(12) United States Patent
Barrett et al.

(10) Patent No.: US 11,446,398 B2
(45) Date of Patent: Sep. 20, 2022

(54) REGULATED BIOCIRCUIT SYSTEMS

(71) Applicant: Obsidian Therapeutics, Inc., Cambridge, MA (US)

(72) Inventors: Peter Barrett, Cambridge, MA (US); Michael N. Gladstone, Cambridge, MA (US); Tariq A. Kassum, Cambridge, MA (US); Vipin Suri, Belmont, MA (US); Dan Jun Li, Cambridge, MA (US); Dexue Sun, Cambridge, MA (US); Brian Dolinski, Cambridge, MA (US)

(73) Assignee: OBSIDIAN THERAPEUTICS, INC., Cambridge, MA (US)

( * ) Notice: Subject to any disclaimer, the term of this patent is extended or adjusted under 35 U.S.C. 154(b) by 821 days.

(21) Appl. No.: 16/092,829

(22) PCT Filed: Apr. 11, 2017

(86) PCT No.: PCT/US2017/026950
§ 371 (c)(1),
(2) Date: Oct. 11, 2018

(87) PCT Pub. No.: WO2017/180587
PCT Pub. Date: Oct. 19, 2017

(65) Prior Publication Data
US 2019/0192691 A1 Jun. 27, 2019

Related U.S. Application Data

(60) Provisional application No. 62/466,596, filed on Mar. 3, 2017, provisional application No. 62/320,864, filed on Apr. 11, 2016.

(51) Int. Cl.
| | |
|---|---|
| A61K 38/52 | (2006.01) |
| C12N 9/90 | (2006.01) |
| A61K 48/00 | (2006.01) |
| C07K 16/28 | (2006.01) |
| C07K 14/00 | (2006.01) |
| A61P 3/08 | (2006.01) |
| A61K 35/17 | (2015.01) |
| C07K 14/195 | (2006.01) |
| C07K 14/54 | (2006.01) |
| C07K 14/605 | (2006.01) |
| C07K 14/725 | (2006.01) |
| C07K 14/705 | (2006.01) |
| C12N 5/0789 | (2010.01) |
| C12N 9/22 | (2006.01) |
| C12N 9/00 | (2006.01) |
| C12N 15/11 | (2006.01) |
| A61K 38/00 | (2006.01) |

(52) U.S. Cl.
CPC .......... *A61K 48/0066* (2013.01); *A61K 35/17* (2013.01); *A61P 3/08* (2018.01); *C07K 14/00* (2013.01); *C07K 14/195* (2013.01); *C07K 14/5428* (2013.01); *C07K 14/5443* (2013.01); *C07K 14/605* (2013.01); *C07K 14/7051* (2013.01); *C07K 14/70517* (2013.01); *C07K 14/70578* (2013.01); *C07K 16/2803* (2013.01); *C12N 5/0647* (2013.01); *C12N 9/22* (2013.01); *C12N 9/93* (2013.01); *C12N 15/11* (2013.01); *C12Y 603/04016* (2013.01); *A61K 38/00* (2013.01); *C07K 2317/622* (2013.01); *C07K 2319/00* (2013.01); *C07K 2319/03* (2013.01); *C07K 2319/30* (2013.01); *C07K 2319/31* (2013.01); *C07K 2319/50* (2013.01); *C12N 2310/20* (2017.05); *C12N 2501/125* (2013.01); *C12N 2501/145* (2013.01); *C12N 2501/22* (2013.01); *C12N 2501/2303* (2013.01); *C12N 2501/2316* (2013.01); *C12N 2800/80* (2013.01)

(58) Field of Classification Search
CPC .................. A61K 35/17; A61K 38/52; A61K 39/001129; C07K 2319/00; C07K 2319/33; C12N 9/90
See application file for complete search history.

(56) References Cited

U.S. PATENT DOCUMENTS

| | | | |
|---|---|---|---|
| 4,442,203 | A | 4/1984 | Varshavsky |
| 5,093,242 | A | 3/1992 | Bachmair |
| 5,132,213 | A | 7/1992 | Bachmair |
| 5,196,321 | A | 3/1993 | Bachmair |
| 5,212,058 | A | 5/1993 | Baker |
| 5,494,818 | A | 2/1996 | Baker |
| 5,503,977 | A | 4/1996 | Johnsson |
| 5,538,862 | A | 7/1996 | Wu |

(Continued)

FOREIGN PATENT DOCUMENTS

| | | |
|---|---|---|
| CA | 2820681 | 6/2012 |
| EP | 2289534 B1 | 3/2011 |

(Continued)

OTHER PUBLICATIONS

Juillerat et al. 2016; Design of chimeric antigen receptors with integrated controllable transient functions. Scientific Reports. 6, 18950, pp. 1-7.*

(Continued)

*Primary Examiner* — Karen Cochrane Carlson
(74) *Attorney, Agent, or Firm* — Kilpatrick Townsend & Stockton LLP

(57) ABSTRACT

The present invention provides regulatable biocircuit systems. Such systems provide modular and tunable protein expression systems in support of the discovery and development of therapeutic modalities.

7 Claims, 30 Drawing Sheets

Specification includes a Sequence Listing.

(56) References Cited

U.S. PATENT DOCUMENTS

| | | |
|---|---|---|
| 5,763,212 A | 6/1998 | Varshavsky |
| 5,766,927 A | 6/1998 | Baker |
| 5,994,104 A | 11/1999 | Anderson |
| 5,994,136 A | 11/1999 | Naldini |
| 6,011,018 A | 1/2000 | Crabtree |
| 6,133,456 A | 10/2000 | Holt |
| 6,136,597 A | 10/2000 | Hope |
| 6,150,527 A | 11/2000 | Holt |
| 6,159,732 A | 12/2000 | Varshavsky |
| 6,187,757 B1 | 2/2001 | Clackson |
| 6,235,522 B1 | 5/2001 | Kingsman |
| 6,566,073 B1 | 5/2003 | Rivera |
| 6,649,595 B2 | 11/2003 | Clackson |
| 6,669,936 B2 | 12/2003 | Kingsman |
| 6,682,907 B1 | 1/2004 | Charneau |
| 6,693,189 B2 | 2/2004 | Holt |
| 7,196,192 B2 | 3/2007 | Yang |
| 7,435,596 B2 | 10/2008 | Campana |
| 7,446,179 B2 | 11/2008 | Jensen |
| 7,446,190 B2 | 11/2008 | Sadelain |
| 7,575,924 B2 | 8/2009 | Trono |
| 8,026,097 B2 | 9/2011 | Campana |
| 8,084,596 B2 | 12/2011 | Crabtree |
| 8,129,355 B2 | 3/2012 | Tice |
| 8,173,792 B2 | 5/2012 | Wandless |
| 8,389,282 B2 | 3/2013 | Sadelain |
| 8,399,645 B2 | 3/2013 | Campana |
| 8,436,183 B2 | 5/2013 | Holt |
| 8,530,636 B2 | 9/2013 | Wandless |
| 8,556,882 B2 | 10/2013 | Morgan |
| 8,669,072 B2 | 3/2014 | Hormann |
| 8,871,191 B2 | 10/2014 | Pavlakis |
| 8,975,071 B1 | 3/2015 | June |
| 9,101,584 B2 | 8/2015 | June |
| 9,102,760 B2 | 8/2015 | June |
| 9,102,761 B2 | 8/2015 | June |
| 9,115,184 B2 | 8/2015 | Bonger |
| 9,127,024 B2 | 9/2015 | Chellappan |
| 9,169,210 B2 | 10/2015 | Hormann |
| 9,278,124 B2 | 3/2016 | Shepard |
| 9,279,021 B2 | 3/2016 | Khabar |
| 9,328,156 B2 | 5/2016 | June |
| 9,371,368 B2 | 6/2016 | Lefrancois |
| 9,492,482 B2 | 11/2016 | Beech |
| 9,512,401 B2 | 12/2016 | Radvanyi |
| 9,623,082 B2 | 4/2017 | Copik |
| 9,750,816 B2 | 9/2017 | Bradner |
| 9,766,255 B2 | 9/2017 | Church |
| 9,772,328 B2 | 9/2017 | Stein |
| 9,809,797 B2 | 11/2017 | Yee |
| 10,221,245 B2* | 3/2019 | Brogdon .................. A61P 35/00 |
| 2002/0100068 A1 | 7/2002 | Chambon |
| 2004/0038373 A1 | 2/2004 | Platz |
| 2004/0038886 A1 | 2/2004 | Finney |
| 2005/0048573 A1 | 3/2005 | Artis |
| 2005/0209146 A1 | 9/2005 | Briesewitz |
| 2005/0214738 A1 | 9/2005 | Stankunas |
| 2006/0160104 A1 | 7/2006 | Johnson |
| 2008/0280830 A1 | 11/2008 | Choi |
| 2009/0042251 A1 | 2/2009 | Scholz |
| 2009/0215169 A1 | 8/2009 | Wandless |
| 2010/0034777 A1* | 2/2010 | Wandless ............. A61K 31/445 514/1.1 |
| 2012/0076732 A1 | 3/2012 | Feng |
| 2012/0177598 A1 | 7/2012 | Lefrancois |
| 2012/0178168 A1 | 7/2012 | Wandless et al. |
| 2013/0178622 A1 | 7/2013 | Huang |
| 2013/0266551 A1 | 10/2013 | Campana |
| 2014/0010791 A1 | 1/2014 | Wandless et al. |
| 2014/0057349 A1 | 2/2014 | Hormann |
| 2014/0220062 A1 | 8/2014 | Fu |
| 2014/0255361 A1 | 9/2014 | Wandless |
| 2014/0271635 A1 | 9/2014 | Brogdon |
| 2014/0286898 A1 | 9/2014 | Gavin |
| 2015/0005256 A1 | 1/2015 | Hormann |
| 2015/0045441 A1 | 2/2015 | Hormann |
| 2015/0099636 A1 | 4/2015 | Hormann |
| 2015/0148543 A1 | 5/2015 | Li |
| 2015/0307564 A1 | 10/2015 | Young |
| 2015/0322092 A1 | 11/2015 | Chellappan |
| 2015/0368342 A1 | 12/2015 | Wu |
| 2016/0046724 A1 | 2/2016 | Brogdon |
| 2016/0051651 A1 | 2/2016 | Brogdon |
| 2016/0096892 A1 | 4/2016 | Brogdon |
| 2016/0120906 A1 | 5/2016 | Galetto |
| 2016/0122707 A1 | 5/2016 | Swee |
| 2016/0145337 A1 | 5/2016 | Galetto |
| 2016/0229901 A1 | 8/2016 | Merchant |
| 2016/0272718 A1 | 9/2016 | Wang |
| 2016/0280798 A1 | 9/2016 | Orentas |
| 2016/0317678 A1 | 11/2016 | Roeth |
| 2016/0346326 A1 | 12/2016 | Bot |
| 2017/0088597 A1 | 3/2017 | Wong |
| 2017/0157176 A1 | 6/2017 | Wang |
| 2017/0246270 A1 | 8/2017 | Young |
| 2017/0274095 A1 | 9/2017 | Meyer |
| 2017/0296678 A1 | 10/2017 | Frost |
| 2017/0304464 A1 | 10/2017 | Kügler |
| 2017/0336393 A1 | 11/2017 | Wang |
| 2017/0356010 A1 | 12/2017 | Frost |
| 2018/0009779 A1 | 1/2018 | Bradner |
| 2018/0010138 A1 | 1/2018 | Kiley |
| 2018/0030143 A1 | 2/2018 | Wang |
| 2018/0044417 A1 | 2/2018 | Pule |
| 2018/0050065 A1 | 2/2018 | Pule |
| 2018/0127502 A1 | 5/2018 | Brentjens |

FOREIGN PATENT DOCUMENTS

| | | |
|---|---|---|
| EP | 2649086 | 10/2013 |
| WO | 1994029438 | 12/1994 |
| WO | 1995002684 | 1/1995 |
| WO | 1996037623 | 11/1996 |
| WO | 1997012622 | 4/1997 |
| WO | 1998017815 | 4/1998 |
| WO | 1998018934 | 5/1998 |
| WO | 1999031251 | 6/1999 |
| WO | 1999055892 | 11/1999 |
| WO | 2000023091 | 4/2000 |
| WO | 2000066759 | 11/2000 |
| WO | 2001027304 | 4/2001 |
| WO | 2001079518 | 10/2001 |
| WO | 2002029065 | 4/2002 |
| WO | 2003012054 | 2/2003 |
| WO | 2005012493 | 2/2005 |
| WO | 2007142929 | 12/2007 |
| WO | 2008121420 | 10/2008 |
| WO | 2009002562 | 12/2008 |
| WO | 2011070214 | 6/2011 |
| WO | 2012079000 | 6/2012 |
| WO | 2012099973 | 7/2012 |
| WO | 2012175222 | 12/2012 |
| WO | 2013059593 | 4/2013 |
| WO | 2013151774 | 10/2013 |
| WO | 2014043189 | 3/2014 |
| WO | 2014062856 | 4/2014 |
| WO | 2014066527 | 5/2014 |
| WO | 2014089158 | 6/2014 |
| WO | 2014134165 | 9/2014 |
| WO | 2014145252 | 9/2014 |
| WO | 2014164828 | 10/2014 |
| WO | 2014170032 | 10/2014 |
| WO | 2014186469 | 11/2014 |
| WO | 2014188220 | 11/2014 |
| WO | 2014190273 | 11/2014 |
| WO | 2015007542 | 1/2015 |
| WO | 2015018528 | 2/2015 |
| WO | 2015018529 | 2/2015 |
| WO | 2015057852 | 4/2015 |
| WO | 2015058018 | 4/2015 |
| WO | 2015120096 | 8/2015 |
| WO | 2015120180 | 8/2015 |
| WO | 2015120187 | 8/2015 |
| WO | 2015123527 | 8/2015 |

(56) References Cited

FOREIGN PATENT DOCUMENTS

| | | |
|---|---|---|
| WO | 2015142675 | 9/2015 |
| WO | WO2015142675 A2 | 9/2015 |
| WO | 2015150771 | 10/2015 |
| WO | 2015152813 | 10/2015 |
| WO | 2015157252 | 10/2015 |
| WO | WO2015150771 A1 | 10/2015 |
| WO | 2015174928 | 11/2015 |
| WO | 2016012623 | 1/2016 |
| WO | 2016014530 | 1/2016 |
| WO | 2016014535 | 1/2016 |
| WO | 2016014553 | 1/2016 |
| WO | 2016014565 | 1/2016 |
| WO | 2016014576 | 1/2016 |
| WO | WO2016012623 A1 | 1/2016 |
| WO | 2016018920 | 2/2016 |
| WO | 2016019300 | 2/2016 |
| WO | 2016025880 | 2/2016 |
| WO | 2016028896 | 2/2016 |
| WO | 2016036746 | 3/2016 |
| WO | 2016040395 | 3/2016 |
| WO | 2016044605 | 3/2016 |
| WO | 2016057705 | 4/2016 |
| WO | 2016090034 | 6/2016 |
| WO | 2016106244 | 6/2016 |
| WO | 2016109410 | 7/2016 |
| WO | 2016113203 | 7/2016 |
| WO | 2016115482 | 7/2016 |
| WO | 2016123142 | 8/2016 |
| WO | 2016123143 | 8/2016 |
| WO | 2016126608 | 8/2016 |
| WO | 2016134284 | 8/2016 |
| WO | 2016137949 | 9/2016 |
| WO | 2016138034 | 9/2016 |
| WO | 2016149665 | 9/2016 |
| WO | 2016161516 | 10/2016 |
| WO | 2016164580 | 10/2016 |
| WO | 2016164731 | 10/2016 |
| WO | 2016172583 | 10/2016 |
| WO | 2016191684 | 12/2016 |
| WO | 2016210293 | 12/2016 |
| WO | 2017001572 A1 | 1/2017 |
| WO | 2017015427 | 1/2017 |
| WO | 2017017184 | 2/2017 |
| WO | 2017024318 | 2/2017 |
| WO | 2017027392 | 2/2017 |
| WO | 2017044699 | 3/2017 |
| WO | 2017048316 | 3/2017 |
| WO | 2017049166 | 3/2017 |
| WO | 2017049252 | 3/2017 |
| WO | 2017078839 | 5/2017 |
| WO | 2017083722 | 5/2017 |
| WO | 2017091786 | 6/2017 |
| WO | 2017100176 | 6/2017 |
| WO | 2017156238 | 9/2017 |
| WO | 2017165245 | 9/2017 |
| WO | 2017175072 | 10/2017 |
| WO | 2017180587 | 10/2017 |
| WO | 2017180842 | 10/2017 |
| WO | 2017181119 | 10/2017 |
| WO | 2017193059 | 11/2017 |
| WO | 2017198839 | 11/2017 |
| WO | 2017201019 | 11/2017 |
| WO | 2017216562 | 12/2017 |
| WO | 2018009923 | 1/2018 |
| WO | 2018022747 | 2/2018 |
| WO | 2018023025 | 2/2018 |
| WO | 2018023093 | 2/2018 |
| WO | 2018026872 | 2/2018 |
| WO | 2018035158 | 2/2018 |
| WO | 2018044619 | 3/2018 |
| WO | 2018064589 | 4/2018 |
| WO | 2018083461 | 5/2018 |
| WO | 2018104554 | 6/2018 |
| WO | 2018104562 | 6/2018 |
| WO | 2018148440 | 8/2018 |
| WO | 2018150187 | 8/2018 |
| WO | 2018160695 | 9/2018 |
| WO | 2018237323 | 12/2018 |
| WO | 2019007869 | 1/2019 |

OTHER PUBLICATIONS

Bosse, K. R. et al. "Identification of GPC2 as an Oncoprotein and Candidate Immunotherapeutic Target in High-Risk Neuroblastoma" Cancer Cell. Sep. 11, 2017;32(3):295-309.e12.

Brandsen, B. M. et al. "A biosensor strategy for *E. coli* based on ligand-dependent stabilization" ACS Synth. Biol., Just Accepted Manuscript, Publication Date (Web): Jul. 31, 2018.

Datta, S. et al. "A Destabilizing Domain Allows for Fast, Noninvasive, Conditional Control of Protein Abundance in the Mouse Eye—Implications for Ocular Gene Therapy" Invest Ophthalmol Vis Sci. 2018;59:4909-4920.

Fry, T. J. et al. "CD22-targeted CAR T cells induce remission in B-ALL that is naive or resistant to CD19-targeted CAR immunotherapy" Nature Medicine, published online Nov. 20, 2017.

Huang, L. et al. "Development of a novel conditional knockdown mouse based on YB-1 protein degradation" Division of Molecular Biology, Tokyo University of Science, Research Institute for Biomedical Science, 2669.

Jester, B. et al. "Engineered biosensors from dimeric ligand-binding domains" ACS Synth. Biol., Just Accepted Manuscript, DOI: 10.1021/acssynbio.8b00242, Publication Date (Web): Sep. 11, 2018.

Kogenaru, M. et al. "Drug-Inducible Control of Lethality Genes: A Low Background Destabilizing Domain Architecture Applied to the Gal4-UAS System in *Drosophila*" ACS Synth. Biol. 2018, 7, 1496-1506.

Lusty, E. et al. "IL-18/IL-15/IL-12 synergy induces elevated and prolonged IFN-γ production by ex vivo expanded NK cells which is not due to enhanced STAT4 activation" Molecular Immunology 88 (2017) 138-147.

Maniaci, C. et al. "*Homo*-PROTACs: bivalent small-molecule dimerizers of the VHL E3 ubiquitin ligase to induce self-degradation" Nat Commun. Oct. 10, 2017;8(1):830.

Mbofung, R. M. et al. "HSP90 inhibition enhances cancer immunotherapy by upregulating interferon response genes" Nat Commun. Sep. 6, 2017;8(1):451.

Miyazawa, S. "Selection originating from protein stability/foldability: Relationships between protein folding free energy, sequence ensemble, and fitness" J Theor Biol. Nov. 21, 2017;433:21-38.

Quintino, L. et al. "Destabilizing Domains Enable Long-Term and Inert Regulation of GDNF Expression in the Brain" Mol Ther Methods Clin Dev. Sep. 4, 2018;11:29-39.

Sakellariou-Thompson, D. et al. "4-1BB agonist focuses CD8+ tumor-infiltrating T-cell growth into a distinct repertoire capable of tumor recognition in pancreatic cancer" Clin Cancer Res. Sep. 25, 2017.

Scarfò, I. et al. "Anti-CD37 chimeric antigen receptor T cells are active against B and T cell lymphomas" Blood First Edition Paper, prepublished online Aug. 8, 2018.

Schafer, J. R. et al. "Education-dependent activation of glycolysis promotes the cytolytic potency of licensed human natural killer cells" Journal of Allergy and Clinical Immunology (2018).

Singh, M. et al. "Intratumoral CD40 activation and checkpoint blockade induces T cell-mediated eradication of melanoma in the brain" Nat Commun. Nov. 13, 2017;8(1):1447.

Tong, J. G. et al. "Spatial and temporal epithelial ovarian cancer cell heterogeneity impacts Maraba virus oncolytic potential" BMC Cancer. Aug. 30, 2017;17(1):594.

Zhang, ZB et al. "Design of Tunable Oscillatory Dynamics in a Synthetic NF-kB Signaling Circuit" Cell Syst. Oct. 24, 2017; 5, 460-470.

Malhotra, S. "Deducing the Essentiality of a Putative Apicoplast Deubiquitinating Protease: the OTU-like cysteine protease PF10_0308 in Plasmodium falciparum" Research Thesis, Presented in partial fulfillment of the requirements for graduation with research distinction in Molecular Genetics in the undergraduate colleges of The Ohio State University, Feb. 2012.

(56) References Cited

OTHER PUBLICATIONS

Mesen-Ramirez, P. et al. "Stable Translocation Intermediates Jam Global Protein Export in Plasmodium falciparum Parasites and Link the PTEX Component EXP2 with Translocation Activity" PLoS Pathog. May 11, 2016;12(5):e1005618.
(NIH) FKBP1A protein [*Homo sapiens*]. National Center for Biotechnology Information. Sequence Accession AAI 19733. Oct. 4, 2006 [retrieved on Apr. 18, 2018]. Retrieved from the Internet:< https://www.ncbi.nlm.nih.gov/proteln/AAI19733>Genbank Supplement pp. 1-2.
International Search Report and Written Opinion dated Oct. 24, 2018 in Application No. PCT/US2017/026950, entitled "Regulated Biocircuit Systems".
Written Opinion dated Oct. 4, 2018 in Application No. PCT/US2018/039096 entitled "PDE5A Destabilizing Domains".
Ainavarapu, S. et al. "Ligand Binding Modulates the Mechanical Stability of Dihydrofolate Reductase" Biophysical Journal vol. 89 Nov. 2005 3337-3344.
Banaszynski, L. A. et al. "Conditional Control of Protein Function" Chemistry & Biology 13, 11-21, Jan. 2006.
Bishop, A. C. et al. "Design of allele-specific inhibitors to probe protein kinase signaling" Current Biology, vol. 8 No. 5, 1998, 8:257-266.
Clackson, T. et al. "Redesigning an FKBP-ligand interface to generate chemical dimerizers with novel specificity" Proc. Natl. Acad. Sci., vol. 95, pp. 10437-10442, Sep. 1998.
Clackson, T. "A Stability Switch for Proteins" Chemistry & Biology 13, Sep. 2006.
Foa, R. et al. "IL2 treatment for cancer: from biology to gene therapy" Br J Cancer. Dec. 1992; 66(6): 992-998.
Herm-Götz, A. et al. "Rapid control of protein level in the apicomplexan Toxoplasma gondii" Nat Methods. Dec. 2007;4(12):1003-5. Epub Nov. 11, 2007.
Johnston, J. A. et al. "Methotrexate Inhibits Proteolysis of Dihydrofolate Reductase by the N-end Rule Pathway" The Journal of Biological Chemistry, vol. 270, No. 14, Issue of Apr. 7, pp. 8172-8178, 1995.
Levy, F. et al. "Analysis of a conditional degradation signal in yeast and mammalian cells" Eur J Biochem. Jan. 1999;259(1-2):244-52.
Liberles, S. D. et al. "Inducible gene expression and protein translocation using nontoxic ligands identified by a mammalian three-hybrid screen" *Proc Natl Acad Sci U S A*. Jul. 22, 1997;94(15):7825-30.
McCart, J. A. et al. "Systemic Cancer Therapy with a Tumor-selective Vaccinia Virus Mutant Lacking Thymidine Kinase and Vaccinia Growth Factor Genes" Cancer Res. Dec. 15, 2001;61(24):8751-7.
Raval, A. P. et al. "Protein kinase C delta cleavage initiates an aberrant signal transduction pathway after cardiac arrest and oxygen glucose deprivation" J. Cerebral Blood Flow & Metabolism, vol. 25, No. 6, pp. 730-741 (2005).
Shah, K. et al. "Engineering unnatural nucleotide specificity for Rous sarcoma virus tyrosine kinase to uniquely label its direct substrates" Proc Natl Acad Sci U S A. 1997;94(8):3565-70.
Vilella-Bach, M. et al. "The FKBP12-Rapamycin-binding Domain Is Required for FKBP12-Rapamycin-associated Protein Kinase Activity and G1 Progression" The Journal of Biological Chemistry, vol. 274, No. 7, Issue of Feb. 12, pp. 4266-4272, 1999.
Werber, A. H. et al. "Effect of Chronic Hypertension on Acute Hypertensive Disruption of the Blood-Brain Barrier in Rats" Hypertension, vol. 12, No. 6, pp. 549-555 (1988).
Ahmed, N. et al. "Immunotherapy for Osteosarcoma: Genetic Modification of T cells Overcomes Low Levels of Tumor Antigen Expression" Molecular Therapy vol. 17 No. 10, 1779-1787 Oct. 2009.
Anguille S. et al. "Interieukin-15 Dendritic Cells Harness NK Cell Cytotoxic Effector Function in a Contact- and IL-15-Dependent Manner" PLoS One. May 7, 2015;10(5):e0123340. eCollection 2015.
Ayello, J. et al. "Genetically re-engineered K562 cells significantly expand and functionally activate cord blood natural killer cells: Potential for adoptive cellular immunotherapy" Exp Hematol. Feb. 2017;46:38-47. Epub Oct. 17, 2016.
Banaszynski, L. A. et al. "Chemical control of protein stability and function in living mice" Nature Medicine, vol. 14, No. 10, Oct. 2008, 1123-1127.
Bessard, A. et al. "High antitumor activity of RLI, an interleukin-15 (IL-15)-IL-15 receptor α fusion protein, in metastatic melanoma and colorectal cancer" Mol Cancer Ther. Sep. 2009;8(9):2736-45.
Blomqvist, K. et al. "Receptor for Activated C-Kinase 1 (PfRACK1) is required for Plasmodium falciparum intra-erythrocytic proliferation" Mol Biochem Parasitol. Oct. 11, 2016. pii: S0166-6851(16)30129-3.
Bowley, D.R. et al. "Antigen selection from an HIV-1 immune antibody library displayed on yeast yields many novel antibodies compared to selection from the same library displayed on phage" Protein Engineering, Design & Selection vol. 20 No. 2 pp. 81-90, 2007.
Brooks, C. F. et al. "The phosphate translocator is the source of carbon and energy for the Toxoplasma apicoplast and essential for parasite survival" Cell Host Microbe. Jan. 21, 2010; 7(1): 62-73.
Bugaj, L. J. et al. "Interrogating cellular perception and decision making with optogenetic tools" J. Cell Biol. vol. 216 No. 125-28, Dec. 2016.
Campeau, E. et al. "A Versatile Viral System for Expression and Depletion of Proteins in Mammalian Cells" PLoS ONE, Aug. 2009, vol. 4, issue 8.
Cederfjäll, E. et al. "Controlled Striatal DOPA Production From a Gene Delivery System in a Rodent Model of Parkinson's Disease" Mol Ther. 2015;23(5):896-906.
Cho, D. et al. "Expansion and Activation of Natural Killer Cells for Cancer Immunotherapy" Korean J Lab Med. Apr. 2009; 29(2): 89-96.
Chung, B. et al. "Engineering the Human Thymic Microenvironment to Support Thymopoiesis In Vivo" Stem Cells 2014;32(9):2386-2396.
Close, D.W. et al. "Using phage display selected antibodies to dissect microbiomes for complete de novo genome sequencing of low abundance microbes" BMC Microbiology 2013, 13:270.
Curran, K. J. et al. "Enhancing Antitumor Efficacy of Chimeric Antigen Receptor T Cells Through Constitutive CD40L Expression" Molecular Therapy vol. 23 No. 4, 769-778 Apr. 2015.
da Silva, L. M. et al. "Regulated expression of the Leishmania major surface virulence factor lipophosphoglycan using conditionally destabilized fusion proteins" PNAS, May 5, 2009, vol. 106, No. 18, pp. 7583-7588.
Dabrowski, M. et al. "Translational readthrough potential of natural termination codons in eucaryotes—The impact of RNA sequence" RNA Biology 12:9, 950-958; Sep. 2015.
D'Angelo, S. et al. "From deep sequencing to actual clones" Protein Engineering, Design & Selection vol. 27 No. 10 pp. 301-307, 2014.
D'Angelo, S. et al, "The antibody mining toolbox An open source tool for the rapid analysis of antibody repertoires" mAbs 6:1, 160-172; Jan./Feb. 2014.
Desbois, M. et al. "IL-15 Trans-Signaling with the Superagonist RLI Promotes Effector/Memory CDS + T Cell Responses and Enhances Antitumor Activity of PD-1 Antagonists" J Immunol. Jul. 1, 2016;197(1):168-78.
Dolan, B. P. et al. "MHC class I antigen processing distinguishes endogenous antigens based on their translation from cellular vs. viral mRNA" PNAS, May 1, 2012, vol. 109, No. 18, 7025-7030.
Dull, T. et al. "A Third-Generation Lentivirus Vector with a Conditional Packaging System" Journal of Virology, Nov. 1998, vol. 72(11), p. 8463-8471.
Dvorin, J. D. et al. "A Plant-Like Kinase in Plasmodium falciparum Regulates Parasite Egress From Erythrocytes" Science. May 14, 2010; 328(5980): 910-912.
Ferrara, F. et al. "Using Phage and Yeast Display to Select Hundreds of Monoclonal Antibodies: Application to Antigen 85, a Tuberculosis Biomarker" PLOS ONE, Nov. 2012, vol. 7, Issue 11.
Ferrara, F. et al. "Recombinant renewable polyclonal antibodies" mAbs 7:1, 32-41; Jan./Feb. 2015.

(56) References Cited

OTHER PUBLICATIONS

Finney, H. M. et al. "Chimeric Receptors Providing Both Primary and Costimulatory Signaling in T Cells from a Single Gene Product" J Immunol 1998; 161(6):2791-2797.
Finney, H. M. et al. "Activation of Resting Human Primary T Cells with Chimeric Receptors: Costimulation from CD28, Inducible Costimulator, CD134, and CD137 in Series with Signals from the TCR Chain" J Immunol 2004; 172(1):104-113.
Foltz, J. A. et al. "NCR1 Expression Identifies Canine Natural Killer Cell Subsets with Phenotypic Similarity to Human Natural Killer Cells" Front Immunol Nov. 23, 2016;7:521.
Fujisaki, H. et al. "Expansion of Highly Cytotoxic Human Natural Killer Cells for Cancer Cell Therapy" Cancer Res. May 1, 2009; 69(9): 4010-4017.
Gai, S. A. et al. "Yeast surface display for protein engineering and characterization" Curr Opin Struct Biol. Aug. 2007 ; 17(4): 467-473. Epub Sep. 17, 2007.
Gao, Y. et al. "Complex transcriptional modulation with orthogonal and inducible dCas9 regulators" Nat Methods. Dec. 2016 ; 13(12): 1043-1049.
Garg, T. K. et al. "Highly activated and expanded natural killer cells for multiple myeloma immunotherapy" Haematologica, Sep. 2012;97(9):1348-56. Epub Mar. 14, 2012.
Giron-Michel, J. et al. "Membrane-bound and soluble IL-15/IL-15R complexes display differential signaling and functions on human hematopoietic progenitors" Blood. Oct. 1, 2005;106(7):2302-10. Epub Jun. 23, 2005.
Glanville, J. et al. "Deep sequencing in library selection projects: what insight does it bring?" Curr Opin Struct Biol. Aug. 2015 ; 33: 146-160.
Gong, Y. et al. "A Shld1-controlled POT1a provides support for repression of ATR signaling at telomeres through RPA exclusion" Mol Cell. Nov. 12, 2010; 40(3): 377-387.
Goodwin, E. C. et al. "The 3'-Flanking Sequence of the Bovine Growth Hormone Gene Contains Novel Elements Required for Efficient and Accurate Polyadenylation" The Journal of Biological Chemistry, vol. 267, No. 23.
Gordley, R. M. et al. "Engineering dynamical control of cell fate switching using synthetic phospho-regulons" PNAS, Nov. 22, 2016, vol. 113, No. 47.
Hofhuis, J. et al. "The functional readthrough extension of malate dehydrogenase reveals a modification of the genetic code" Open Biol. 2016;6(11):160246.
Hurton, L. "Tethered IL-15 to Augment the Therapeutic Potential of T Cells Expressing Chimeric Antigen Receptor: Maintaining Memory Potential, Persistence, and Antitumor Activity" 2014, UT GSBS Dissertations and Theses (Open Access). Paper 421.
Imai, C. et al. "Chimeric receptors with 4-1BB signaling capacity provoke potent cytotoxicity against acute lymphoblastic leukemia" Leukemia. Apr. 2004;18(4):676-84.
Imai, C. et al. "Genetic modification of primary natural killer cells overcomes inhibitory signals and induces specific killing of leukemic cells" Blood. Jul. 1, 2005;106(1):376-83.
Imamura, M. et al. "Autonomous Growth and Increased Cytotoxicity of Natural Killer Cells Expressing Membrane-Bound Interleukin-15" Blood. Aug. 14, 2014;124(7):1081-8.
Jahn, T. et al. "An IL12-IL2-Antibody Fusion Protein Targeting Hodgkin's Lymphoma Cells Potentiates Activation of NK and T cells for an Anti-Tumor Attack" PLOS ONE, Sep. 2012, vol. 7, issue 9.
Juillerat, A. et al. "Design of chimeric antigen receptors with integrated controllable transient functions" Scientific Reports vol. 6, Article No. 18950 (2016).
Kamiya, T. et al. "Expanded and Activated Natural Killer Cells for Immunotherapy of Hepatocellular Carcinoma" Cancer Immunol Res. Jul. 2016;4(7):574-81.
Kehoe, J. W. et al. "Using Phage Display to Select Antibodies Recognizing Post-translational Modifications Independently of Sequence Context" Mol Cell Proteomics. Dec. 2006;5(12):2350-63. Epub Sep. 12, 2006.
Kermer, V. et al. "An Antibody Fusion Protein for Cancer Immunotherapy Mimicking IL-15 trans-Presentation at the Tumor Site" Mol Cancer Ther. Jun. 2012;11(6):1279-88.
Khawam, K. et al. "Human Renal Cancer Cells Express a Novel Membrane-Bound Interleukin-15 that Induces, in Response to the Soluble Interleukin-15 Receptor A Chain, Epithelial-to-Mesenchymal Transition" Cancer Res. Feb. 15, 2009;69(4):1561-9. Epub Feb. 3, 2009.
Kim, V. et al. "Minimal Requirement for a Lentivirus Vector Based on Human Immunodeficiency Virus Type 1" Journal of Virology, Jan. 1998, 72(1):811-6.
Kolonin, M. G. et al. "Ligand-Directed Surface Profiling of Human Cancer Cells with Combinatorial Peptide Libraries" Cancer Res 2006; 66: (1). Jan. 1, 2006.
Kowolik, C. M. et al. "CD28 Costimulation Provided through a CD19-Specific Chimeric Antigen Receptor Enhances In vivo Persistence and Antitumor Efficacy of Adoptively Transferred T Cells" Cancer Res. Jan. 1, 2006;66(1):34-40.
Kwan, M. D. et al. "Chemical Control of FGF-2 Release for Promoting Calvarial Healing with Adipose Stem Cells" The Journal of Biological Chemistry vol. 286, No. 13, pp. 11307-11313, Apr. 1, 2011.
Lapteva, N. et al. "Large-scale ex vivo expansion and characterization of natural killer cells for clinical applications" Cytotherapy. Oct. 2012 ; 14(9): 1131-1143.
Lillo, A. M. et al. "Development of Phage-Based Single Chain Fv Antibody Reagents for Detection of Yersinia pestis" PLOS ONE, Dec. 2011, vol. 6, issue 12, Epub Dec. 8, 2011.
Lou, J. et al. "Antibodies in haystacks: how selection strategy influences the outcome of selection from molecular diversity libraries" J Immunol Methods. Jul. 1, 2001;253(1-2):233-42.
Loughran, G. et al. "Evidence of efficient stop codon readthrough in four mammalian genes" Nucleic Acids Res. 2014;42(14):8928-38.
Machado Diaz, A. C. et al. "Proinflammatory Soluble Interleukin-15 Receptor Alpha Is Increased in Rheumatoid Arthritis" Arthritis. 2012;2012:943156. Epub Jul. 25, 2012.
Marzari, R. et al. "The cleavage site of C5 from man and animals as a common target for neutralizing human monoclonal antibodies: in vitro and in vivo studies" Eur J Immunol. Oct. 2002;32(10):2773-82.
Milone, M. C. et al. "Chimeric Receptors Containing CD137 Signal Transduction Domains Mediate Enhanced Survival of T Cells and Increased Antileukemic Efficacy In Vivo" Molecular Therapy vol. 17 No. 8, 1453-1464 Aug. 2009.
Miyazaki, Y. et al. "Destabilizing Domains Derived from the Human Estrogen Receptor" J Am Chem Soc. Mar. 7, 2012; 134(9): 3942-3945.
Mizushima, S. et al. "pEF-BOS, a powerful mammalian expression vector" Nucleic Acids Research, vol. 18, No. 17, 1990: 5322.
Morsut, L. et al. "Engineering Customized Cell Sensing and Response Behaviors Using Synthetic Notch Receptors" Cell 164, 1-12. Feb. 11, 2016.
International Search Report and Written Opinion dated Oct. 24, 2017 in application No. PCT/US2017/026950, entitled "Regulated Biocircuit Systems".
Mortier, E. et al. "Soluble Interleukin-15 Receptor (IL-15R)-sushi as a Selective and Potent Agonist of IL-15 Action through IL-15R beta/gamma. Hyperagonist IL-15/IL-15R alpha fusion proteins" J Biol Chem. Jan. 20, 2006;281(3):1612-9.
Muralidharan, V. et al. "Plasmodium falciparum heat shock protein 110 stabilizes the asparagine repeat-rich parasite proteome during malarial fevers" Nat Commun. 2012 ; 3: 1310-1310.
Musso, T. et al. "Naturally occurring isoform: Human Monocytes Constitutively Express Membrane-Bound, Biologically Active, and Interferon-g-Upregulated Interleukin-15" Blood. May 15, 1999;93(10):3531-9. Erratum in: Blood. Sep. 2012 ;120(10):2155.
Neely, G. G. et al. "Monocyte Surface-Bound IL-15 Can Function as an Activating Receptor and Participate in Reverse Signaling" Apr. 1, 2004;172(7):4225-34.
Nishimura, H. et al. "A novel autoregulatory mechanism for transcriptional activation of the IL-15 gene by a nonsecretable isoform of IL-15 generated by alternative splicing" FASEB J. Jan. 2005;19(1):19-28.

(56) References Cited

OTHER PUBLICATIONS

Navarro, R. et al. "A Novel Destabilizing Domain Based on a Small-Molecule Dependent Fluorophore" ACS Chem Biol. Aug. 19, 2016; 11(8): 2101-2104.

Ochoa, M. C. et al. "Antitumor Immunotherapeutic and Toxic Properties of an HDL-Conjugated Chimeric IL-15 Fusion Protein" Cancer Res. Jan. 1, 2013;73(1):139-49.

Okoye, I. et al. "The protein LEM promotes CD8+ T cell immunity through effects on mitochondrial respiration" Science May 29, 2015: vol. 348 No. 6238 pp. 995-1001.

Pacheco, Y. et al. "Despite an impaired response to IL-7, CD4R+EM T cells from HIV-positive patients proliferate normally in response to IL-15 and its superagonist, RLI" AIDS. Sep. 10, 2011;25(14):1701-10.

Pavlik, P. et al. "Predicting antigenic peptides suitable for the selection of phage antibodies" Human Antibodies 12(4) (2003) 99-112.

Pegram, H. J. et al. "Tumor-targeted T cells modified to secrete IL-12 eradicate systemic tumors without need for prior conditioning" Blood. May 3, 2012;119(18):4133-41.

Pfarr, D. S. et al. "Differential Effects of Polyadenylation Regions on Gene Expression in Mammalian Cells" DNA, vol. 5, No. 2, 1986, pp. 115-122.

pLVX-IRES-Puro Vector Information, Clontech, Catalog No. 632183, Protocol No. PT4063-5, Version No. PR882580; published Sep. 26, 2008.

Pratt, M. R. et al. "Small-molecule-mediated rescue of protein function by an inducible proteolytic shunt" PNAS, Jul. 3, 2007, vol. 104, No. 27, p. 11209-14.

Pruett-Miller, S. M. et al. "Attenuation of Zinc Finger Nuclease Toxicity by Small-Molecule Regulation of Protein Levels" PLOS Genetics, Feb. 2009, vol. 5, issue 2, e1000376.

Qian, L. et al. "Construction of a plasmid for co-expression of mouse membrane-bound form of IL-15 and RAE-1e and its biological activity" Plasmid. May 2011;65(3):239-45. Epub Mar. 4, 2011.

Rafiq, S. et al. "Targeted delivery of a PD-1-blocking scFv by CAR-T cells enhances anti-tumor efficacy in vivo" Nat Biotechnol. Oct. 2018;36(9):847-856. doi: 10.1038/nbt.4195. Epub Aug. 13, 2018.

Raj, D. K. et al. "Antibodies to PfSEA-1 block parasite egress from RBCs and protect against malaria infection" Science. May 23, 2014; 344(6186): 871-877.

Richardson, M. W. et al. "Mode of Transmission Affects the Sensitivity of Human Immunodeficiency Virus Type 1 to Restriction by Rhesus TRIM5" Journal of Virology, Nov. 2008, 82(22), p. 11117-11128.

Chu, B. W. et al. "Recent progress with FKBP-derived destabilizing domains" Bioorganic & Medicinal Chemistry Letters, (2008), vol. 18, No. 22, pp. 5941-5944.

Wang, L. et al. "Overcoming intrinsic inhibitory pathways to augment the antineoplastic activity of adoptively transferred T cells: Re-tuning your CAR before hitting a rocky road," OncoImmunology, Nov. 1, 2013, vol. 2, No. 11, pp. e26492-1-e26492-3.

International Search Report and Written Opinion dated Oct. 25, 2018 in Application No. PCT/US2018/037005, entitled "PDE5 Compositions and Methods for Immunotherapy".

Turko, I. V. et at. "Potential Roles of Conserved Amino Acids in the Catalytic Domain of the cGMP-binding cGMP-specific Phosphodiesterase (PDE5)" The Journal of Biological Chemistry, vol. 273, No. 11, Issue Mar. 13, 1998, pp. 6460-6466.

Chen, D. S. et al. "Oncology Meets Immunology: The Cancer-Immunity Cycle" Immunity 39, Jul. 25, 2013.

Kerkar, S. P. et al. "Tumor-specific CD8+ T cells expressing IL-12 eradicate established cancers in lymphodepleted hosts" Cancer Res. Sep. 1, 2010; 70(17): 6725-6734.

Koneru, M. et al. "A phase I clinical trial of adoptive T cell therapy using IL-12 secreting MUC-16ecto directed chimeric antigen receptors for recurrent ovarian cancer" Journal of Translational Medicine (2015) 13:102.

Maude, S. L. et al. "Chimeric Antigen Receptor T Cells for Sustained Remissions in Leukemia" The New England Journal o f Medicine, 2014;371:1507-17.

Porter, D. L. et al. "Chimeric antigen receptor T cells persist and induce sustained remissions in relapsed refractory chronic lymphocytic leukemia" Sci Transl Med. Sep. 2, 2015; 7(303): 303ra139.

Rezvani, K. et al. "Engineering Natural Killer Cells for Cancer Immunotherapy" Mol Ther. Aug. 2, 2017; 25(8): 1769-1781.

Yeku, O. O. et al. "Armored CAR T cells enhance antitumor efficacy and overcome the tumor microenvironment" Sci Rep. Sep. 5, 2017;7(1):10541.

Zhang, L. et al. "Tumor-Infiltrating Lymphocytes Genetically Engineered with an Inducible Gene Encoding Interleukin-12 for the Immunotherapy of Metastatic Melanoma" Clin Cancer Res; 21(10) May 15, 2015.

Banaszynski, L. A. et al. "A Rapid, Reversible, and Tunable Method to Regulate Protein Function in Living Cells Using Synthetic Small Molecules" Cell. Sep. 8, 2006; 126(5): 995-1004.

Bonger, K. M. et al. "Small molecule displacement of a cryptic degron causes conditional protein degradation" Nat Chem Biol.; Jul. 2011; 7(8): 531-537.

Egeler E. L. et al. "Ligand-switchable Substrates for a Ubiquitin-Proteasome System" J Biol Chem. Sep. 9, 2011; 286(36):31328-36.

Hurton, L. V. et al. "Tethered IL-15 augments antitumor activity and promotes a stem-cell memory subset in tumor-specific T cells" Proc Natl Acad Sci U S A. 2016;113(48):E7788-E7797.

Iwamoto, M. et al. "A general chemical method to regulate protein stability in the mammalian central nervous system" Chem Biol. Sep. 24, 2010; 17(9): 981-988. doi:10.1016/j.chembiol.2010.07.009.

Kochenderfer, J. N. et al. "Lymphoma Remissions Caused by Anti-CD19 Chimeric Antigen Receptor T Cells Are Associated With High Serum Interleukin-15 Levels" J Clin Oncol. 2017; 35(16):1803-1813.

Sando III, R. et al. "Inducible control of gene expression with destabilized Cre" Nat Methods. Nov. 2013 ; 10(11):1085-1088.

Jin, B. Y. et al. "Engineered T cells targeting E7 mediate regression of human papillomavirus cancers in a murine model" JCI Insight. 2018;3(8):e99488.

Roybal, K. T. et al. "Engineering T cells with Customized Therapeutic Response Programs Using Synthetic Notch Receptors" Cell. Oct. 6, 2016; 167(2): 419-432.e16.

Roybal, K. T. et al. "Precision Tumor Recognition by T Cells With Combinatorial Antigen-Sensing Circuits" Cell. Feb. 11, 2016;164(4):770-9.

Sadelain, M. et al. "The basic principles of chimeric antigen receptor (CAR) design" Cancer Discov. Apr. 2013 ; 3(4):388-398.

Sblattero, D. et al. "Exploiting recombination in single bacteria to make large phage antibody libraries" Nature Biotech. 18 (1), 75-80, 2000.

Shanafelt, A. B. et al. "A T-cell-selective interleukin 2 mutein exhibits potent antitumor activity and is well tolerated in vivo" Nat Biotechnol. Nov. 2000;18(11):1197-202.

Shook, D. R. et al. "Natural Killer Cell Engineering for Cellular Therapy of Cancer" Tissue Antigens. Dec. 2011 ; 78(6): 409-415.

Sim, G. C. et al. "IL2 Variant Circumvents ICOSp Regulatory T-cell Expansion and Promotes NK Cell Activation" Cancer Immunol Res. Nov. 2016;4(11):983-994.

Sotillo, E. et al. "Convergence of Acquired Mutations and Alternative Splicing of CD19 Enables Resistance to CART-19 Immunotherapy" Cancer Discov. Dec. 2015 ; 5(12): 1282-1295.

Stankunas, K. et al. "Conditional Protein Alleles Technique Using Knockin Mice and a Chemical Inducer of Dimerization" Molecular Cell, vol. 12, 1615-1624, Dec. 2003.

Staquicini, F. I. et al. "Receptor Tyrosine Kinase EphA5 Is a Functional Molecular Target in Human Lung Cancer" The Journal of Biological Chemistry vol. 290, No. 12, pp. 7345-7359, Mar. 20, 2015.

Stone, J. D. et al. "Design and characterization of a protein superagonist of IL-15 fused with IL-15Rα and a high-affinity T cell receptor" Biotechnol Prog. Nov. 2012 ; 28(6): 1588-1597.

Szmania, S. et al. "Ex Vivo Expanded Natural Killer Cells Demonstrate Robust Proliferation In Vivo In High-Risk Relapsed Multiple Myeloma Patients" J Immunother. Jan. 2015 ; 38(1): 24-36.

(56) References Cited

OTHER PUBLICATIONS

Tagaya, Y. et al. "Generation of secretable and nonsecretable interleukin 15 isoforms through alternate usage of signal peptides" Cell Biology, Proc. Natl. Acad. Sci. USA, vol. 94, pp. 14444-14449, Dec. 1997.

Uryu, D. et al. "Study of local intracellular signals regulating axonal morphogenesis using a microfluidic device" Science and Technology of Advanced Materials, 2016, vol. 17, No. 1, 691-697.

Vincent, M. et al. "Tumor targeting of the IL-15 superagonist RLI by an anti-GD2 antibody strongly enhances its antitumor potency" Int. J. Cancer: 133, 757-766 (2013).

Vincent, M. et al. "Highly potent anti-CD20-RLI immunocytokine targeting established human B lymphoma in SCID mouse" mAbs 6:4, 1026-1037; Jul./Aug. 2014.

Wagner, T. E. et al. "Small-molecule-based regulation of RNA-delivered circuits in mammalian cells" Nature Chemical Biology, vol. 14, pp. 1043-1050 (2018).

Wang, W. et al. "Human NK cells maintain licensing status and are subject to killer immunoglobulin-like receptor (KIR) and KIR-ligand inhibition following ex vivo expansion" Cancer Immunol Immunother (2016) 65:1047-1059.

Weinstein-Marom, H. et al. "Membrane-attached Cytokines Expressed by mRNA Electroporation Act as Potent T-Cell Adjuvants" J Immunother, vol. 39, No. 2, Feb./Mar. 2016.

Wittnebel, S. et al. "Membrane-Bound Interleukin (IL)-15 on Renal Tumor Cells Rescues Natural Killer Cells from IL-2 Starvation-Induced Apoptosis" Cancer Res. Jun. 15, 2007;67(12):5594-9.

Wu, CY et al. "Remote control of therapeutic T cells through a small molecule-gated chimeric receptor" Science. Oct. 16, 2015;350(6258):aab4077.

Yuan, H. et al. "Transmembrane-Bound IL-15—Promoted Epithelial-Mesenchymal Transition in Renal Cancer Cells Requires the Src-Dependent Akt/GSK-3β/β-Catenin Pathway" Neoplasia. May 2015;17(5): 410 20.

Zennou, V. et al. "HIV-1 Genome Nuclear Import Is Mediated by a Central DNA Flap" Cell, vol. 101, 173-185, Apr. 14, 2000.

Zhang, L. et al. "Improving Adoptive T Cell Therapy by Targeting and Controlling IL-12 Expression to the Tumor Environment" Molecular Therapy vol. 19 No. 4, 751-759 Apr. 2011.

Zhao, Z. et al. "Structural Design of Engineered Costimulation Determines Tumor Rejection Kinetics and Persistence of CAR T Cells" Cancer Cell. Oct. 12, 2015;28(4):415-428.

Zufferey, R. et al. "Self-Inactivating Lentivirus Vector for Safe and Efficient In Vivo Gene Delivery" Journal of Virology, Dec. 1998, p. 9873-9880.

Zufferey, R. et al. "Woodchuck Hepatitis Virus Posttranscriptional Regulatory Element Enhances Expression of Transgenes Delivered by Retroviral Vectors" Journal of Virology, Apr. 1999, p. 2886-2892.

Park, M. et al. "Engineering Epigenetic Regulation Using Synthetic Read-Write Modules" Cell 176, 1-12, Jan. 10, 2019.

Yin, Y. et al. "Checkpoint Blockade Reverses Anergy in IL-13Ra2 Humanized scFv-Based CAR T Cells to Treat Murine and Canine Gliomas" Mol Ther Oncolytics. 2018;11:20-38.

An, W. et al. "Engineering FKBP-Based Destabilizing Domains to Build Sophisticated Protein Regulation Systems" Plos One, Dec. 30, 2015.

An, Y. et al. "Stereotactic radiosurgery of early melanoma brain metastases after initiation of anti-CTLA-4 treatment is associated with improved intracranial control" Radiother Oncol. Sep. 12, 2017.

Le Boeuf, F. et al. "Reovirus FAST Protein Enhances Vesicular Stomatitis Virus Oncolytic Virotherapy in Primary and Metastatic Tumor Models" Mol Ther Oncolytics. Aug. 4, 2017; 6:80-89.

\* cited by examiner

T Cell Activation

CAR Design

Split CAR Design

Negative Regulation

Positive Regulation

*Inactive*

*Inactive*

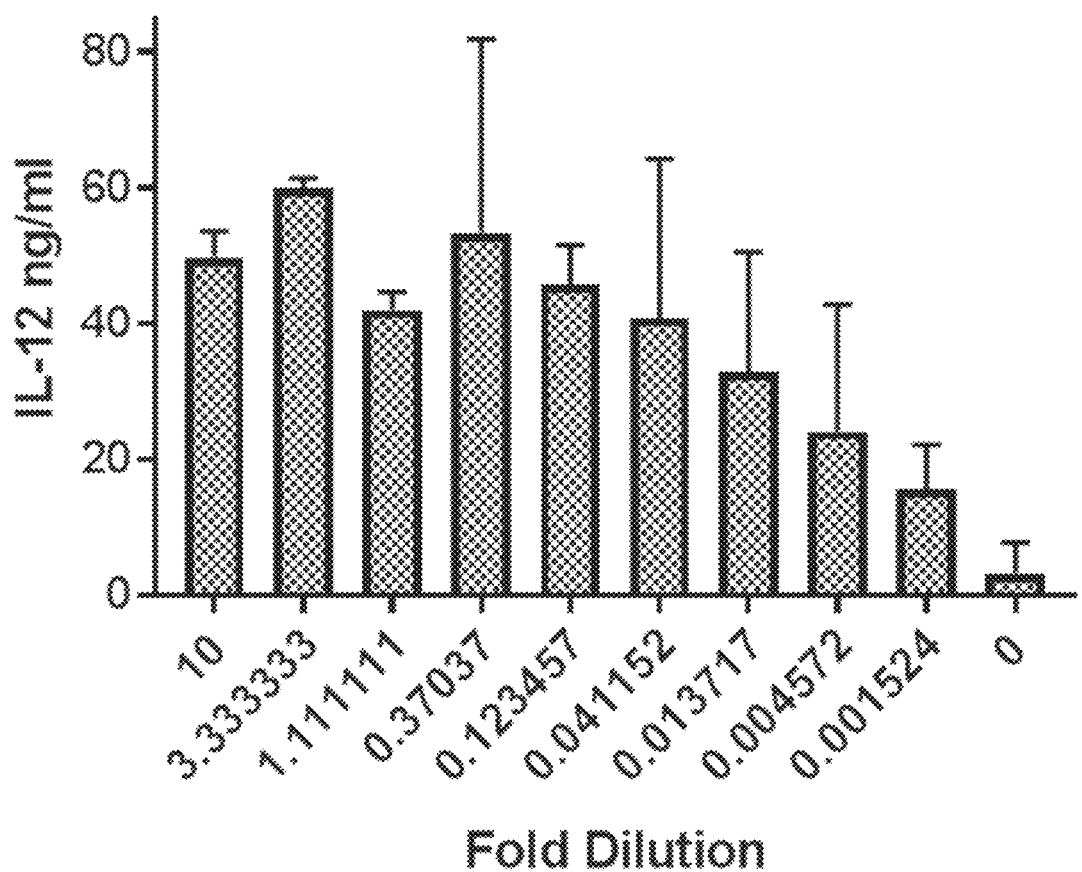

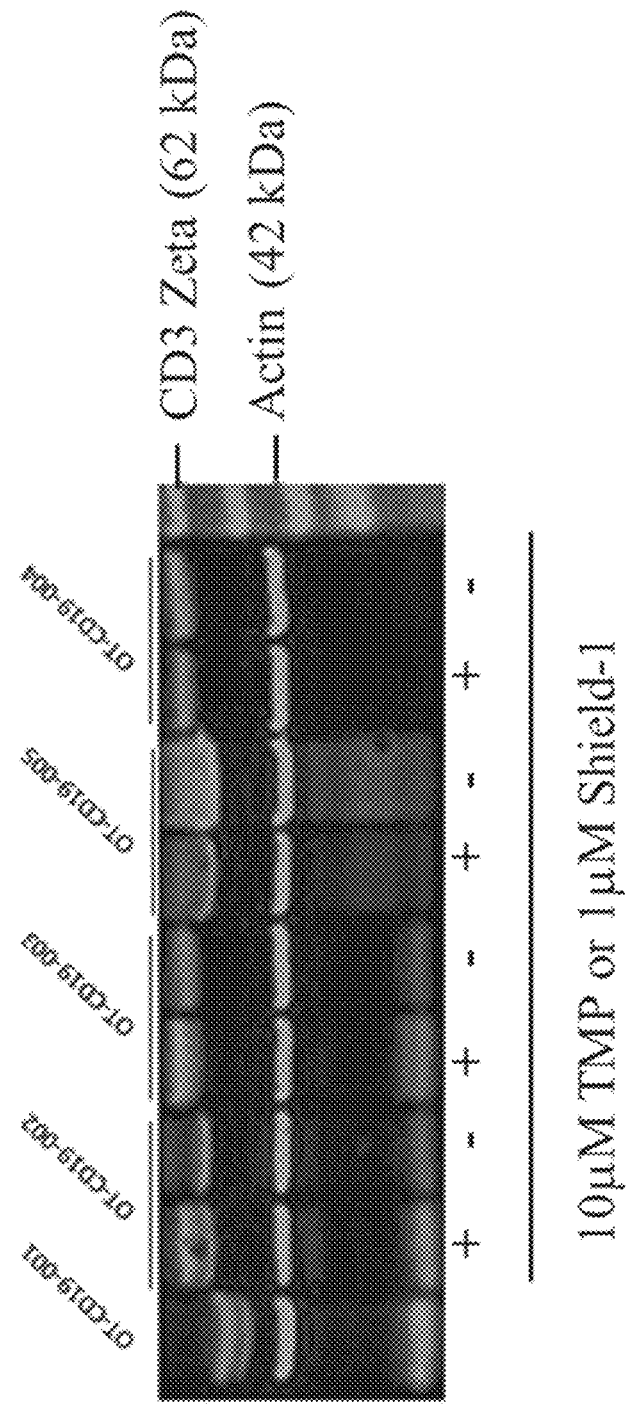

REGULATED BIOCIRCUIT SYSTEMS

CROSS REFERENCE TO RELATED APPLICATIONS

This application is a 35 U.S.C. § 371 U.S. National Stage Entry of International Application No. PCT/US2017/026950 filed Apr. 11, 2017, which claims the benefit of priority of to U.S. Provisional Patent Application No. 62/320,864, filed Apr. 11, 2016, entitled REGULATED BIOCIRCUIT SYSTEMS, and U.S. Provisional Patent Application No. 62/466, 596, filed Mar. 3, 2017, entitled REGULATED BIOCIRCUIT SYSTEMS, the contents of each of which are herein incorporated by reference in their entirety.

REFERENCE TO SEQUENCE LISTING

The instant application contains a "lengthy" Sequence Listing which has been submitted via CD-R in lieu of a printed paper copy, and is hereby incorporated by reference in its entirety. This contains a sequence listing text file as part of the originally filed subject matter as follows: File name: 20951300US371SL_update.txt; File size: 671,707, 136 Bytes; Date created: Nov. 19, 2018. These CD-Rs are labeled "CRF," "COPY 1-SEQUENCE LISTING PART," "COPY 2-SEQUENCE LISTING PART," and "COPY 3-SEQUENCE LISTING PART," respectively, and each contain only one identical file, as identified immediately above. The machine-readable format of each CD-R is IBM-PC and the operating system of each compact disc is MS-Windows.

FIELD OF THE INVENTION

The invention relates to regulatable and tunable biocircuit systems for the development of controlled and/or regulated therapeutic systems, e.g., biocircuits.

BACKGROUND OF THE INVENTION

Gene therapy is revolutionizing medicine and offering new promise for the treatment of previously intractable conditions. However, current technologies do not allow titration of the timing or levels of target protein induction. This has rendered many potential gene therapy applications difficult or impossible to safely and effectively deploy.

Inadequate exogenous and/or endogenous gene control is a critical issue in numerous gene therapy settings. This lack of tunability also makes it difficult to safely express proteins with narrow or uncertain therapeutic windows or those requiring more titrated or transient expression.

One approach to regulated protein expression or function is the use of Destabilizing Domains (DDs). Destabilizing domains are small protein domains that can be appended to a target protein of interest. DDs render the attached protein of interest unstable in the absence of a DD-binding ligand such that the protein is rapidly degraded by the ubiquitin-proteasome system of the cell (Stankunas, K., et al., (2003). *Mol. Cell* 12, 1615-1624; Banaszynski, et al., (2006) *Cell;* 126(5): 995-1004; reviewed in Banaszynski, L. A., and Wandless, T. J. (2006) *Chem. Biol.;* 13, 11-21 and Rakhit R, Navarro R, Wandless T J (2014) *Chem Biol.* September 18; 21(9):1238-52). However, when a specific small molecule ligand binds its intended DD as a ligand binding partner, the instability is reversed and protein function is restored. Such a system is herein referred to as a biocircuit, with the canonical DD-containing biocircuit described above being the prototypical model biocircuit.

It is believed that improvements of biocircuits, including those containing DDs can form the basis of a new class of cell and gene therapies that employ tunable and temporal control of gene expression and function. Such novel moieties are described by the present inventors as stimulus response elements (SREs) which act in the context of an effector module to complete a biocircuit arising from a stimulus and ultimately producing a signal or outcome. When properly formatted with a polypeptide payload, and when activated by a particular stimulus, e.g., a small molecule, biocircuit systems can be used to regulate transgene and/or protein levels either up or down by perpetuating a stabilizing signal or destabilizing signal. This approach has many advantages over existing methods of regulating protein function and/or expression, which are currently focused on top level transcriptional regulation via inducible promoters.

Beyond the initial work on destabilizing domains (Banaszynski, et al., (2006) *Cell;* 126(5): 995-1004; U.S. Pat. Nos. 8,173,792 and 8,530,636, the contents of which are each incorporated herein by reference in their entirety), is the development of expanded biocircuit systems such as those taught in the present application including stimulus response elements (SREs) which go far beyond the destabilizing or dimerization domains of the art. Such therapies represent a significant improvement on existing gene therapy strategies, and could also expand the universe of protein therapeutics that can be safely and effectively incorporated into gene therapy modalities, including applications that have previously been considered unsuitable for therapeutic use.

SUMMARY OF THE INVENTION

The invention provides biocircuit systems which may comprise an effector module responsive to at least one stimulus. The effector module may comprise a first component and a second component which may be independently selected from, but are not limited to, a peptide, peptide complex, peptide-protein complex, protein, fusion protein, protein complex, protein-protein complex. In one aspect, the biocircuit system may comprise two or more effector modules.

In one aspect, the first component may be a stimulus response element (SRE) comprising one or more regions derived from a payload, one or more regions derived from a Target of a ligand binding partner pair, one or more regions derived from an antibody, and/or an SRE.

In one aspect, the second component may be a payload construct comprising a payload, a Target of a ligand binding partner pair, and/or an antibody or a functional fragment thereof.

In one aspect, the first component may be a stimulus response element (SRE) comprising one or more regions derived from a payload, the payload may have a sequence such as, but not limited to, SEQ ID NO: 1-102450, and 212852-213270, one or more regions derived from a Target of a ligand binding partner pair listed in Table 2 or Table 3, one or more regions derived from an antibody listed in Table 5, and/or an SRE listed in Table 4.

In one aspect, the second component may be a payload construct comprising a payload, the payload may have a sequence such as, but not limited to, SEQ ID NO: 1-102450, and 212852-213270 or functional fragment thereof, a Target of a ligand binding partner pair listed in Table 2, Table 3 or functional fragment thereof, and/or an antibody listed in Table 5 or a functional fragment thereof.

In one aspect, at least one of the first or second component of the effector module may comprise one or more post translational modifications such as, but not limited to, acetylation, phosphorylation, ubiquitination, carboxylation, deamination, deamination, deacetylation, dihydroxylation, dephosphorylation, formylation, gamma-carboxyglutamation, glutathionylation, glycation, hydroxylation, methylation, nitration, sumoylation, N- or O-transglutamination, glycosylation and farnesylation.

In one aspect, the biocircuit system may be, but is not limited to, a DD biocircuit system, a Dimer biocircuit system, a CAR biocircuit system, a Receptor biocircuit system, and a Cell biocircuit system.

In one aspect, the effector module of the biocircuit system may comprise a signal sequence, a cleavage and/or processing feature, a targeting and/or penetrating peptide, and/or a linker.

In one aspect, the effector module of the biocircuit system may comprise a signal sequence selected from those listed in Table 6, a cleavage and/or processing feature selected from those listed in Table 7, a targeting and/or penetrating peptide selected from those listed in Tables 8 or 10, and/or a linker selected from those listed in Tables 9, 11 and 12.

In one aspect, the stimulus of the biocircuit system may be, but is not limited to, a ligand, an externally added or endogenous metabolite, the presence or absence of a defined ligand, pH, temperature, light, ionic strength, cellular location, subject site, microenvironment, the presence or concentration of one or more cations or one or more anions, an effector module, a concentration gradient of ions, biomolecules or the like, and the presence or concentration of one or more metal ions.

In another aspect, the stimulus of the biocircuit system may be a ligand. The ligand may be, but is not limited to, any of the ligands of Tables 1-3, a protein, peptide, nucleic acid, lipid, lipid derivative, sterol, steroid, metabolite, metabolite derivative, and small molecule. The ligand may be complexed or bound to another molecule.

In one aspect, the stimulus is a ligand which is a small molecule. As a non-limiting example, the small molecule may be cell permeable.

In one aspect, the stimulus of the biocircuit system may be a cellular location such as, but not limited to, the nucleus, the cytoplasm, a membrane, lysosome, mitochondria, endoplasmic reticulum, cellular organelle, cytoskeletal protein or subregion, intracellular membrane surface, a transmembrane region, and the extracellular matrix.

In one aspect, the stimulus of the biocircuit system may be a subject site such as, but not limited to, a location in the subject selected from the blood, plasma, an organ selected from liver, kidney, brain, heart, lung, bone, and bone marrow.

In one aspect, the stimulus of the biocircuit system may be a microenvironment such as, but not limited to, a tumor microenvironment, the cell periphery, the cell membrane, the nuclear membrane, an endosome, a microenvironment characterized by an intracellular or extracellular gradient, and cytoskeletal structures or regions.

In one aspect, the stimulus of the biocircuit system may be the presence of one or more cations and the cation such as, but not limited to, Aluminum, Ammonium, Barium, Calcium, Chromium(II), Chromium(III), Copper(I), Copper (II), Iron(II), Iron(III), Hydrogen, Hydronium, Lead(II), Lithium, Magnesium, Manganese(II), Manganese(III), Mercury(I), Mercury(II), Nitronium, Potassium, Silver, Sodium, Strontium, Tin(II), Tin(IV), and Zinc.

In one aspect, the stimulus of the biocircuit system may be the presence of one or more anions or oxoanions such as, but not limited to, Chloride, Fluoride, Arsenate, Phosphate, Arsenite, Hydrogen phosphate, Dihydrogen phosphate, Sulfate, Nitrate, Hydrogen sulfate, Nitrite, Thiosulfate, Sulfite, Perchlorate, Iodate, Chlorate, Bromate, Chlorite, Hypochlorite, Hypobromite, Carbonate, Chromate, Hydrogen carbonate or Bicarbonate, Dichromate, Acetate, formate, Cyanide, Cyanate, Peroxide, Thiocyanate, Oxalate, Hydroxide, and Permanganate.

In one aspect, the stimulus of the biocircuit system may be the presence of one or more metal ions and the metal ion such as, but not limited to, Magnesium, Manganese, Calcium and Zinc.

The invention also provides polynucleotides encoding an effector module of a biocircuit system described herein. In one aspect, at least one region of the polynucleotide is codon optimized such as, but not limited to, the region encoding the first component of the effector module and/or the region encoding the second component of the effector module.

The polynucleotide encoding an effector module of a biocircuit system may be a DNA molecule. The polynucleotide may have a region such as, but not limited to, a region comprising the sequence of any known microRNAs. The polynucleotide may have a region such as, but not limited to, a region comprising the sequence of any of the microRNAs listed in Table 13, the reverse complement of the microRNAs listed in Table 13, or the microRNA anti-seed region of any of the microRNAs listed in Table 13.

The polynucleotide encoding an effector module of a biocircuit system may be a messenger RNA (mRNA) molecule. The polynucleotide may have a region such as, but not limited to, a region comprising the sequence of any of the microRNAs listed in Table 13, the reverse complement of the microRNAs listed in Table 13, or the microRNA anti-seed region of any of the microRNAs listed in Table 13. The mRNA molecule may comprise one or more chemical modifications such as, but not limited to, a sugar, nucleobase or backbone modifications. The modifications may be naturally or non-naturally occurring modifications.

The invention also provides polynucleotides comprising a first region encoding a stimulus response element (SRE). The SRE may be, but is not limited to, a peptide, a peptide complex, a peptide-protein complex, a protein, a fusion protein, a protein complex, and a protein-protein complex. The SRE may comprise one or more regions derived from a payload, the payload may have a sequence such as, but not limited to, SEQ ID NO: 102451-204900, one or more regions derived from a Target of a ligand binding partner pair listed in Table 2, Table 3, or an SRE listed in Table 4.

The polynucleotide may comprise a second region encoding one or more payload constructs. The payload construct may comprise a payload or an antibody or functional fragment thereof. The payload may have a sequence such as, but not limited to, SEQ ID NO: 102451-204900 or functional fragment thereof, or an antibody listed in Table 5 or a functional fragment thereof.

The polynucleotide may also comprise a third region encoding a linker, modifier, signal sequence; binding domain, regulatory motif, dimerization domain, and/or cleavage site.

At least one region of the polynucleotide may be codon optimized. As a non-limiting example, the region encoding the first component of the effector module is codon optimized. As another non-limiting example, the region encoding the second component of the effector module is codon optimized.

The polynucleotide may be a DNA molecule. The polynucleotide may have a region such as, but not limited to, a region comprising the sequence of any known microRNA. The polynucleotide may have a region such as, but not limited to, a region comprising the sequence of any of the microRNAs listed in Table 13, the reverse complement of the microRNAs listed in Table 13, or the microRNA anti-seed region of any of the microRNAs listed in Table 13.

The polynucleotide may be a messenger RNA (mRNA) molecule. The polynucleotide may have a region such as, but not limited to, a region comprising the sequence of any of the known microRNAs. The polynucleotide may have a region such as, but not limited to, a region comprising the sequence of any of the microRNAs listed in Table 13, the reverse complement of the microRNAs listed in Table 13, or the microRNA anti-seed region of any of the microRNAs listed in Table 13. The mRNA molecule may comprise one or more chemical modifications such as, but not limited to, a sugar, nucleobase or backbone modifications. The modifications may be naturally or non-naturally occurring modifications.

The invention also provides an expression vector comprising any of the polynucleotides described herein.

The invention also provides a cell comprising any of the expression vectors described herein.

The invention also provides a transgenic animal comprising any of the cells comprising expression vectors described herein.

The invention also provides a kit comprising any of the polynucleotides or expression vectors described herein.

The invention also provides methods of treating a disease or disorder in a subject, comprising administration of a pharmaceutical composition comprising a biocircuit system or component thereof described herein or the polynucleotides described herein.

In one aspect of the method, the pharmaceutical composition may be administered via a route such as, but not limited to, enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedu-laris), intracorneal (within the cornea), dental intracornal, intracoronary (within the coronary arteries), intracorporus cavernosum (within the dilatable spaces of the corporus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis and spinal.

The invention also provides a regulatable human T cell or T cell population engineered to express an effector module. In one aspect, the effector module encodes a chimeric antigen receptor (CAR). In one aspect, the T-cells are primary T-cells. In another aspect, the T cell may be, but is not limited to, cytotoxic T-cells, helper T-cells, memory T-cells, regulatory T-cells, tissue infiltrating lymphocytes and combinations thereof.

In one aspect, the cell population may be obtained from a subject suffering from, being treated for, diagnosed with, at risk of developing, or suspected of having a disorder selected from the group consisting of an immune disorder (including autoimmune disorders), a hypoproliferative condition including cancer, an infectious disease, a non-infectious disease, and graft vs. host disease.

The invention also provides methods of producing a regulatable human T-cell or population thereof by contacting an isolated population of T-cells with a polynucleotide encoding one or more effector modules which can be expressed in the contacted population. The contacting of the isolated population may cause the level of the payload encoded by one or more effector modules to be modulated upon exposure of the expressed effector module with one or more stimuli.

In one aspect, the level of the payload encoded by one or more effector modules may be upregulated upon exposure to the stimulus.

In one aspect, the one or more effector modules encodes at least one cytokine.

In one aspect, the isolated population of T-cells may be contacted with two effector modules. The expressed payload of one of the effector modules may act as a stimulus to the other effector module. Additionally, an isolated population of T-cells may be contacted with a third effector module. The expressed payload of one of the two effector modules can act as a stimulus to the third effector module.

In one aspect, the level of the payload encoded by both of the two effector modules is increased upon exposure to a stimulus.

In another aspect, the level of the payload encoded by one of the two effector modules is increased upon exposure to a stimulus and the level of the payload encoded by the other of the two effector modules is reduced upon exposure to a stimulus.

In another aspect, the exposed stimulus of the first effector module is different from the exposed stimulus of the other effector module.

The invention also provides a method of treating a patent in need, the method comprising administration of the regulatable human T cell or T cell population described herein. The treatment may comprise adoptive immunotherapy.

In one aspect, prior to administration, the regulatable human T cell or T cell population may be expanded.

The invention also provides a multi-tuned effector module responsive to at least one stimulus. The multi-tuned effector module may comprise a first component and a second component, wherein each of the first said second component may independently be but are not limited to, a peptide, peptide complex, peptide-protein complex, protein, fusion protein, protein complex, protein-protein complex.

The first component of the multi-tuned effector module responsive to at least one stimulus may be a stimulus response element (SRE) which comprises one or more regions derived from a payload, one or more regions derived from a Target of a ligand binding partner pair, one or more regions derived from an antibody, or an SRE. The second component of the multi-tuned effector module responsive to at least one stimulus may be a payload construct comprising a payload, a Target of a ligand binding partner pair listed, or an antibody. The payload construct may comprise a polypeptide variant which comprises a cleavage motif; or one or more insertions, deletions, substitutions, additions, or covalent modifications.

The first component of the multi-tuned effector module responsive to at least one stimulus may be a stimulus response element (SRE) which comprises one or more regions derived from a payload, the payload may have a sequence such as, but not limited to, SEQ ID NO: 1-102450, and 212852-213270, one or more regions derived from a Target of a ligand binding partner pair listed in Table 2, Table 3, one or more regions derived from an antibody listed in Table 5, or an SRE listed in Table 4. The second component of the multi-tuned effector module responsive to at least one stimulus may be a payload construct comprising a payload, the payload may have a sequence such as, but not limited to, SEQ ID NO: 1-102450, and 212852-213270 or functional fragment thereof, a Target of a ligand binding partner pair listed in Table 2, Table 3, or functional fragment thereof; or an antibody listed in Table 5 or a functional fragment thereof. The payload construct may comprise a polypeptide variant which comprises a cleavage motif; or one or more insertions, deletions, substitutions, additions, or covalent modifications.

BRIEF DESCRIPTION OF THE DRAWINGS

FIG. 21B is a bar graph depicting the Shield-1 dose responsive induction of DD-IL12.

FIG. 23A and FIG. 23B are western blots depicting CD3 zeta levels in CD19 CAR expressing cells.

DETAILED DESCRIPTION OF THE INVENTION

I. Introduction

Figure 1:
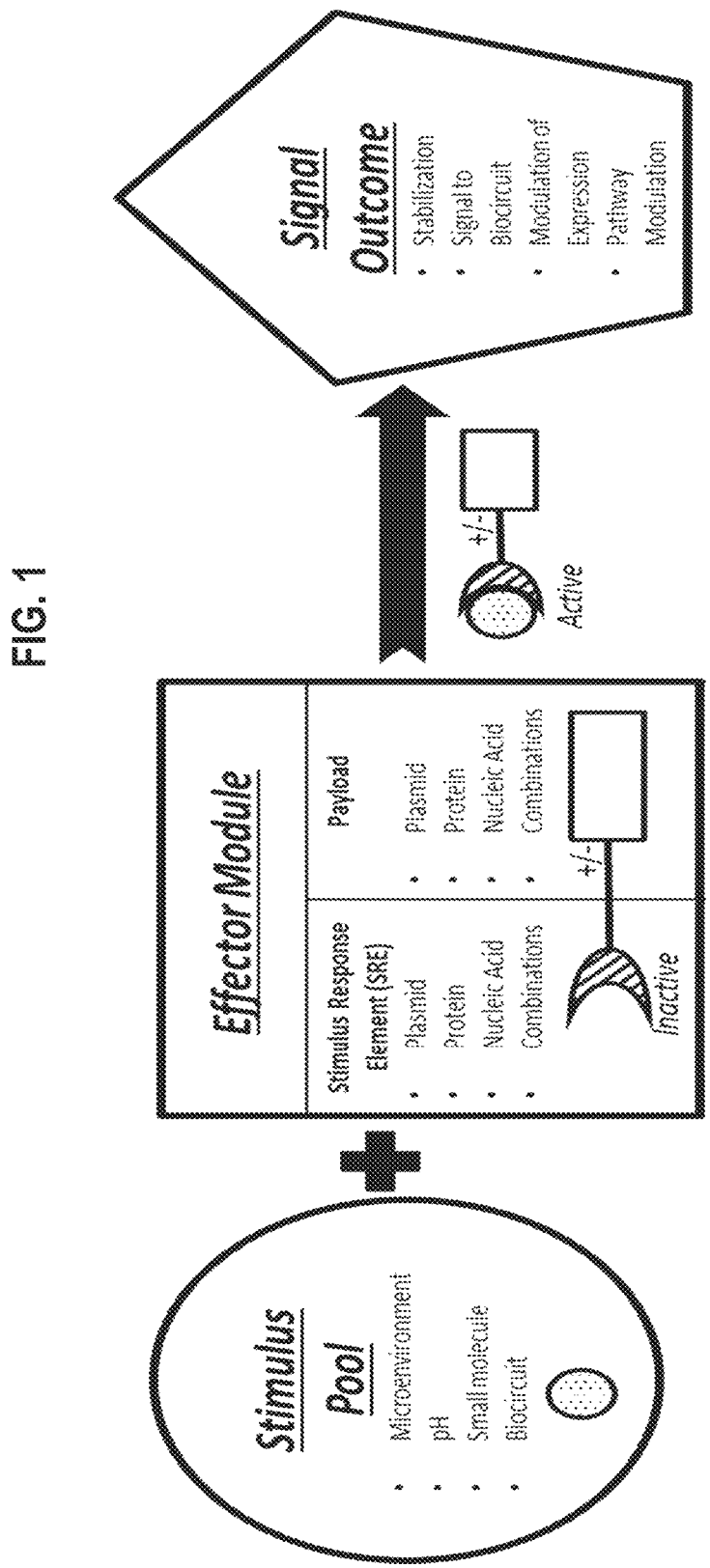
FIG. 1 shows an overview diagram of a biocircuit system of the invention. The biocircuit comprises a stimulus and at least one effector module responsive to a stimulus, where the response to the stimulus produces a signal or outcome. The effector module comprises at least one stimulus response element (SRE) and one payload.
Figure 2:
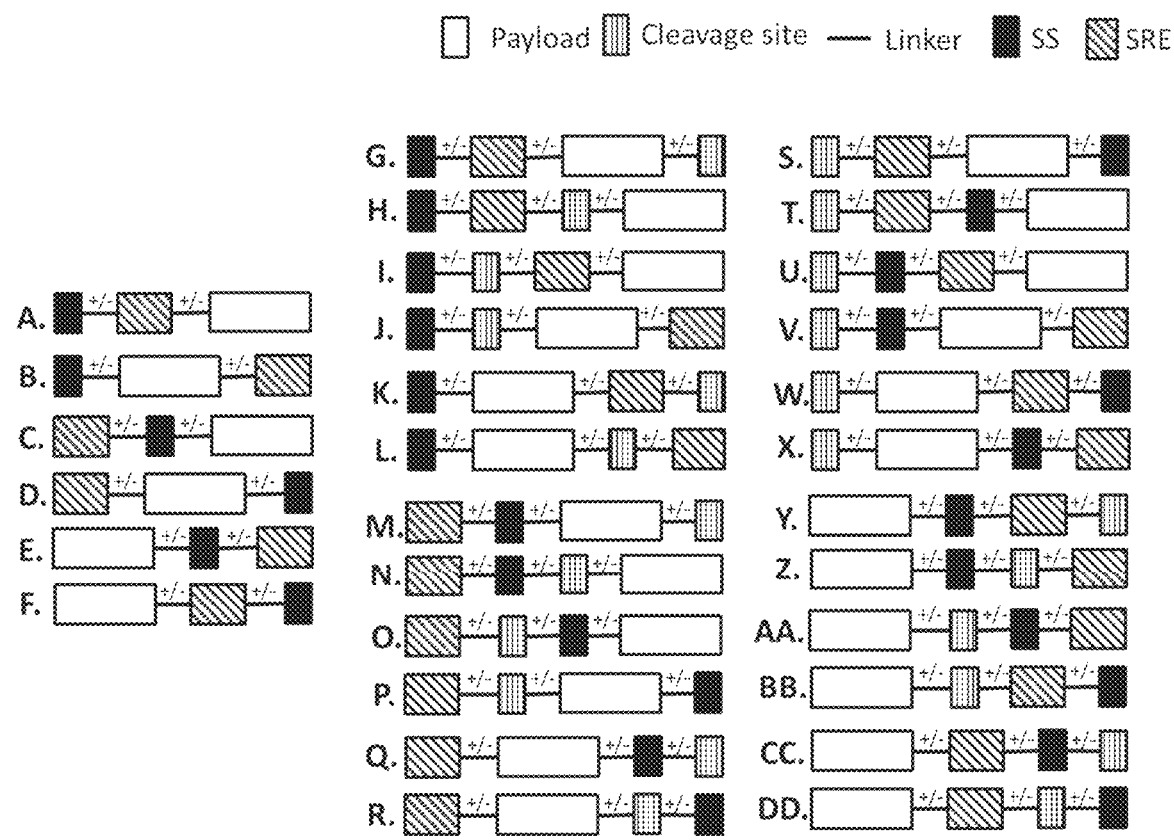
FIG. 2 shows representative effector modules carrying one payload. The signal sequence (SS), SRE and payload may be located or positioned in various arrangements without (A to F) or with (G to Z, and M to DD) a cleavage site. An optional linker may be inserted between each component of the effector module.
Figure 3:
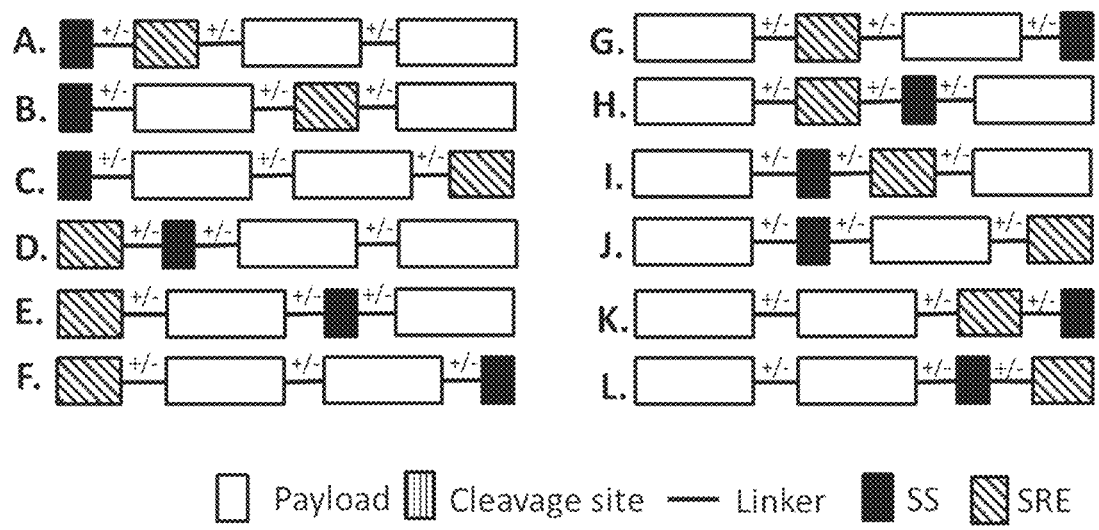
FIG. 3 shows representative effector modules carrying two payloads without a cleavage site. The two payloads may be either directly linked to each other or separated.
Figure 4:
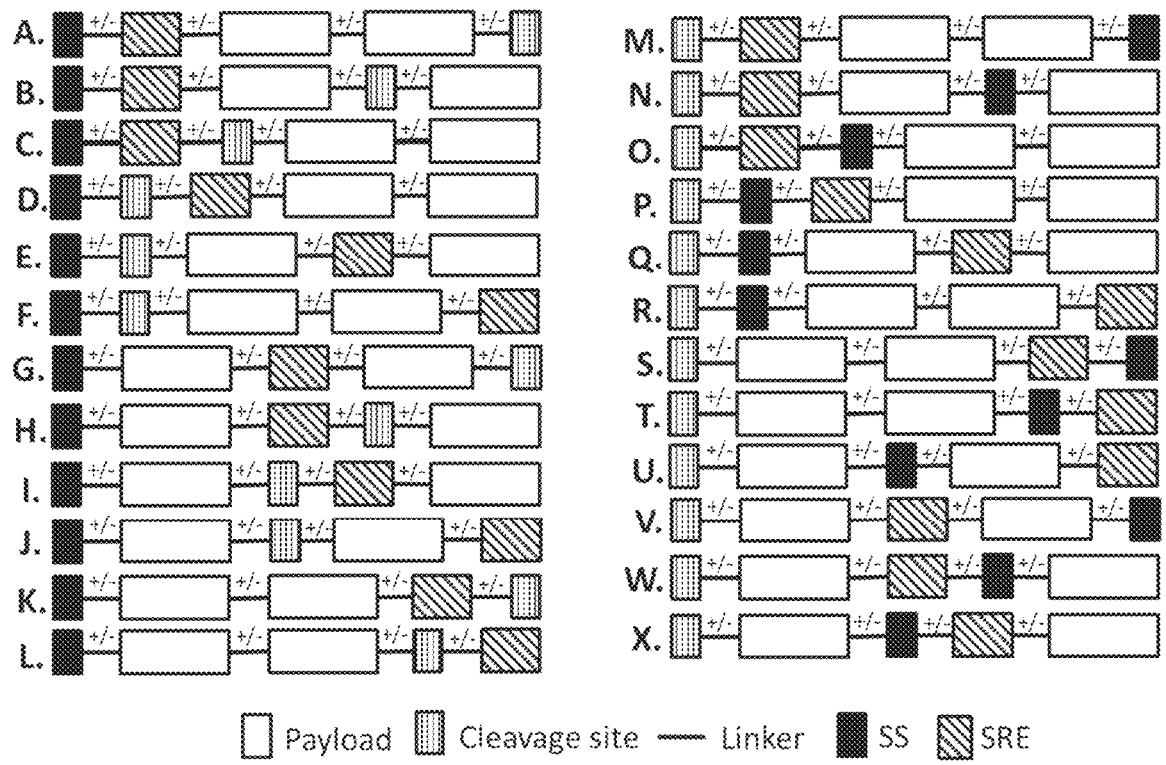
FIG. 4 shows representative effector modules carrying two payloads with a cleavage site. In one embodiment, an SS is positioned at the N-terminus of the construct, while other components: SRE, two payloads and the cleavage site may be located at different positions (A to L). In another embodiment, the cleavage site is positioned at the N-terminus of the construct (M to X). An optional linker may be inserted between each component of the effector module.
Figure 5:
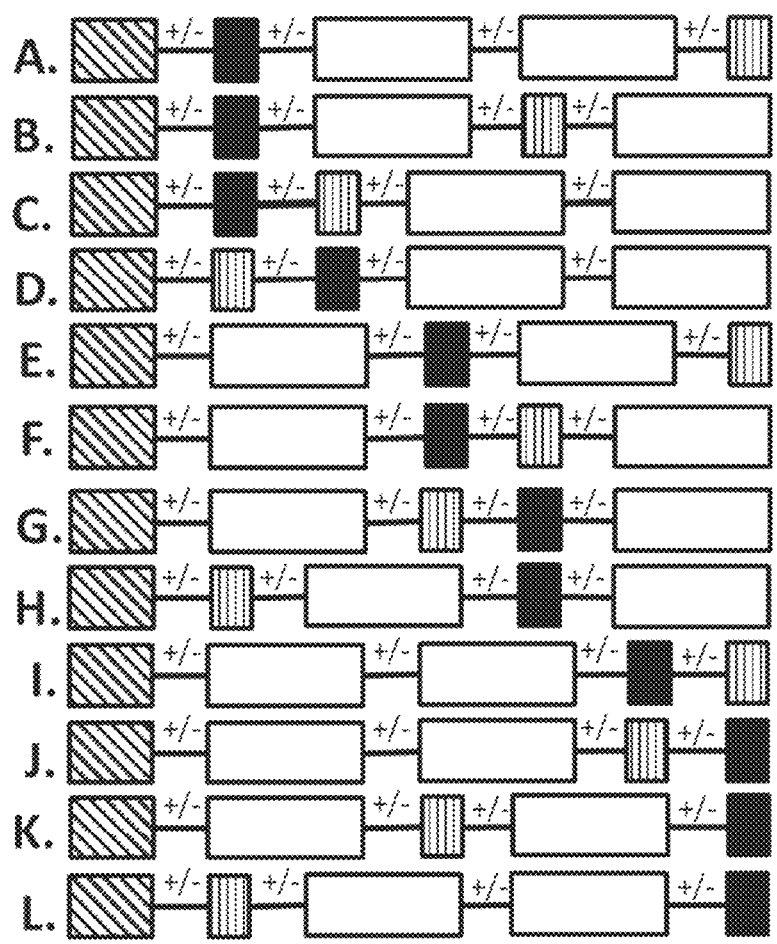
FIG. 5 shows effector modules of the invention carrying two payloads, where an SRE is positioned at the N-terminus of the construct (A to L), while SS, two payloads and the cleavage site can be in any configuration. An optional linker may be inserted between each component of the effector module.
Figure 6:
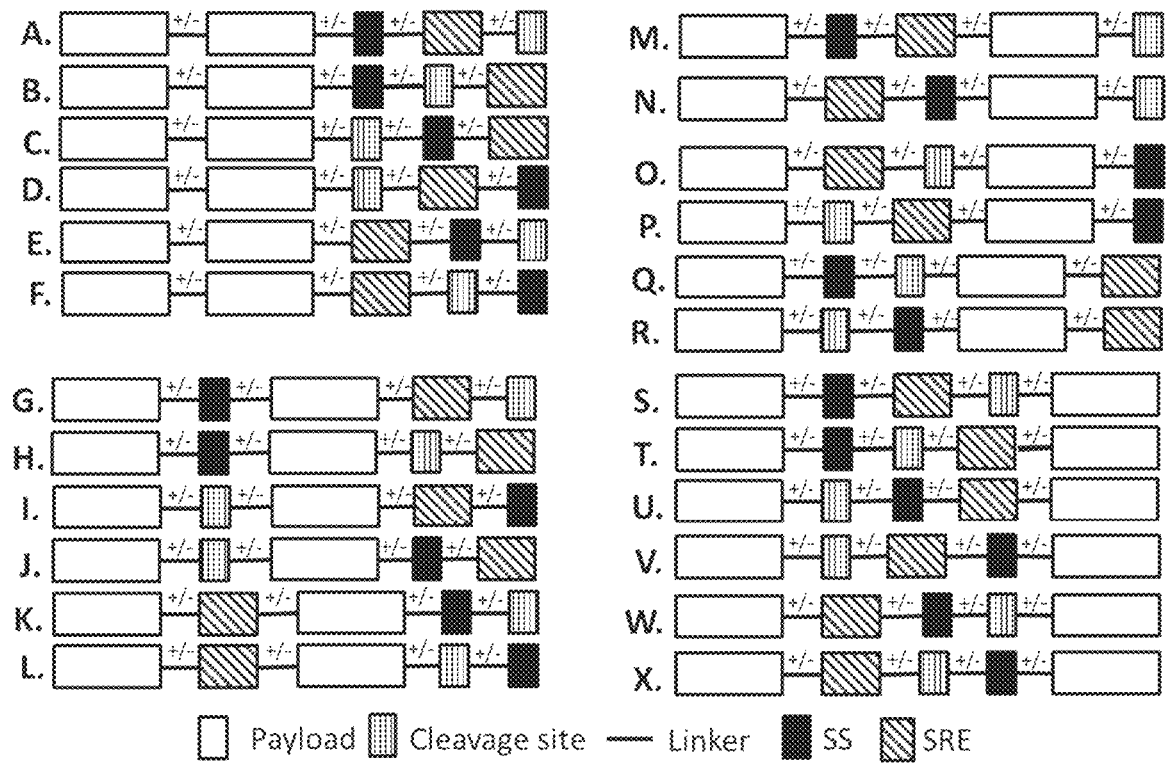
FIG. 6 shows effector modules of the invention carrying two payloads, where either the two payloads (A to F) or one of the two payloads (G to X) is positioned at the N-terminus of the construct (A to L), while SS, SRE and the cleavage site can be in any configuration. An optional linker may be inserted between each component of the effector module.
Figure 7A:
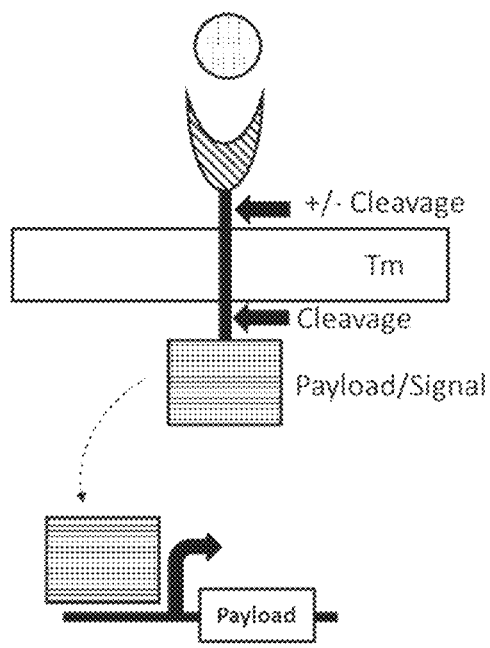
FIG. 7 depicts representative configurations of the stimulus and effector module within a biocircuit system. A transmembrane effector module is activated either by a free stimulus (FIG. 7A) or a membrane bound stimulus (FIG. 7B) which binds to SRE. The response to the stimulus causes the cleavage of the intracellular signal/payload, which activates down-stream effector/payload.
Figure 7B:
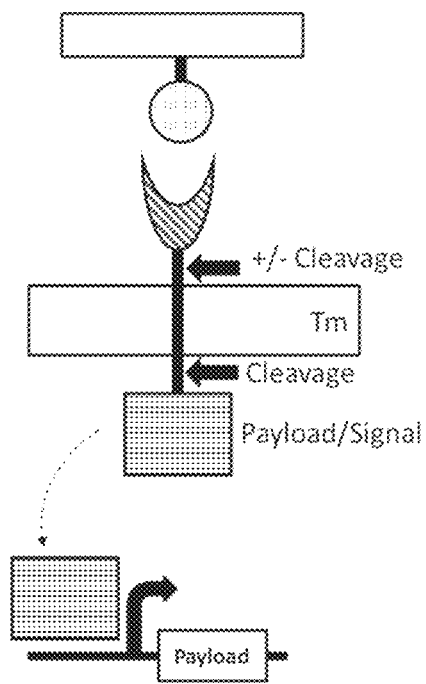
Figure 8:
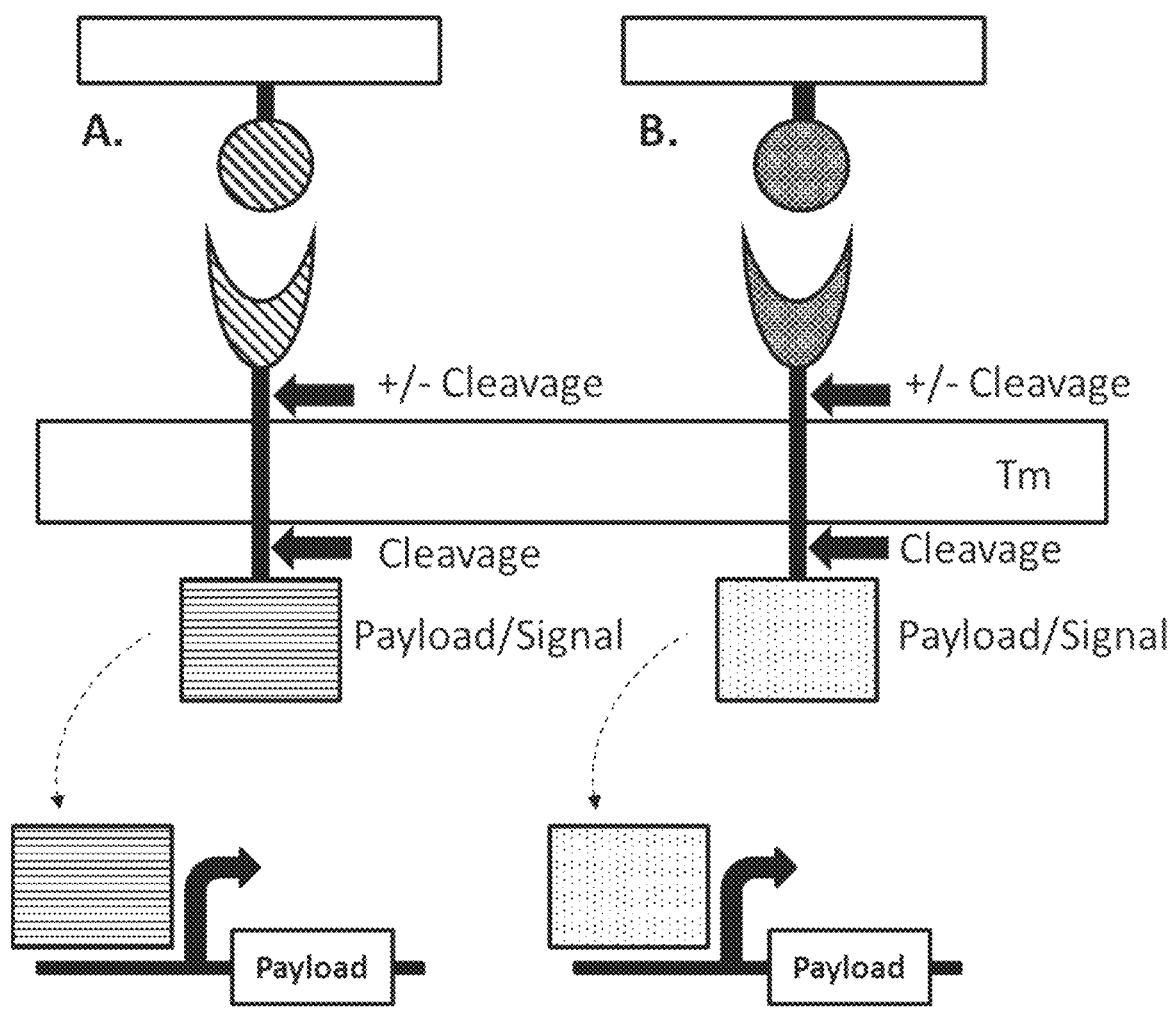
FIG. 8 depicts a dual stimulus-dual presenter biocircuit system, where two bound stimuli (A and B) from two different presenters (e.g., different cells) bind to two different effector modules in a single receiver (e.g., another single cell) simultaneously and create a dual-signal to downstream payloads.
Figure 9:
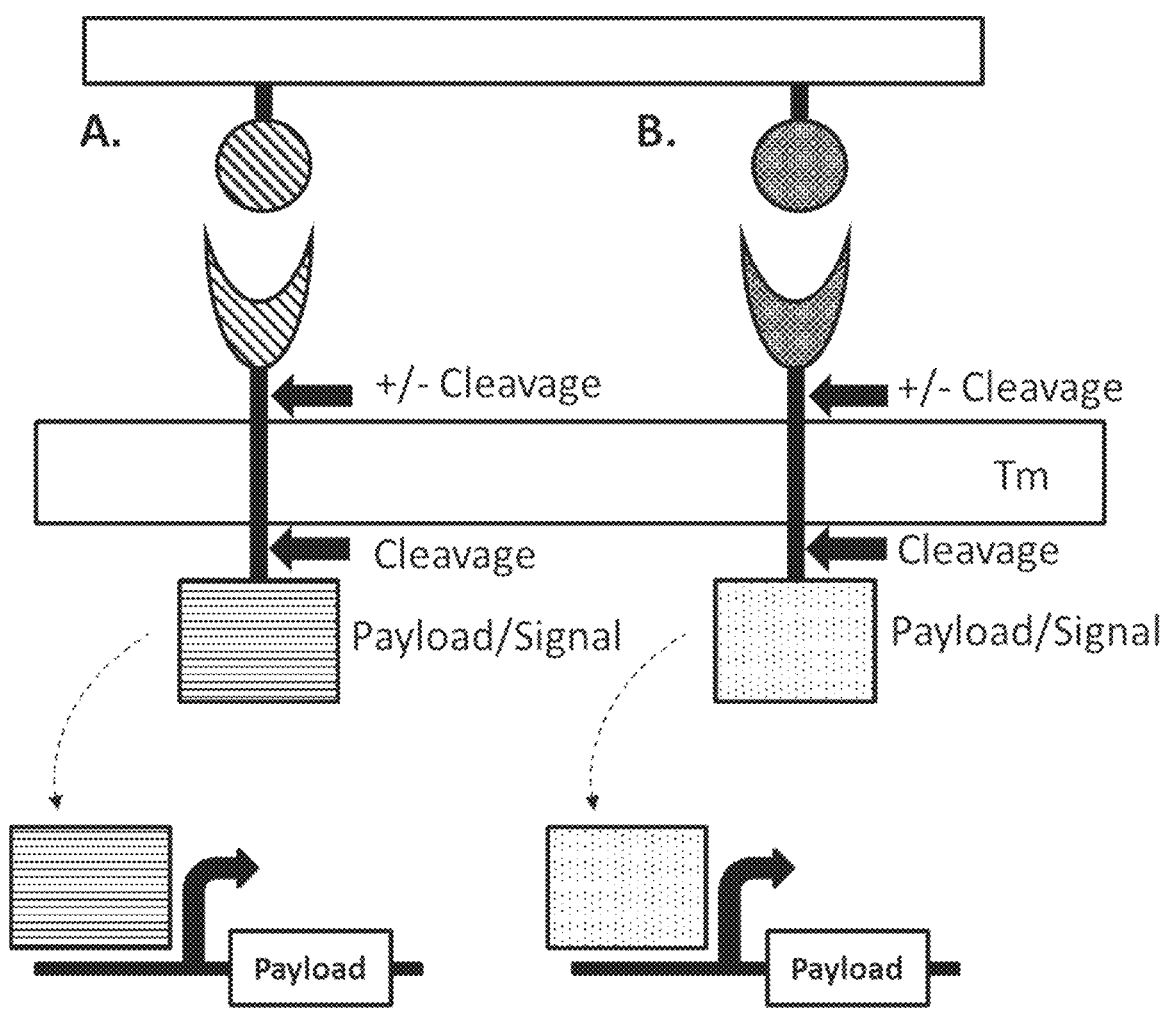
FIG. 9 depicts a dual stimulus-single presenter biocircuit system, where two bound stimuli (A and B) from the same presenter (e.g., a single cell) bind to two different effector modules in another single cell simultaneously and create a dual-signal.
Figure 10:
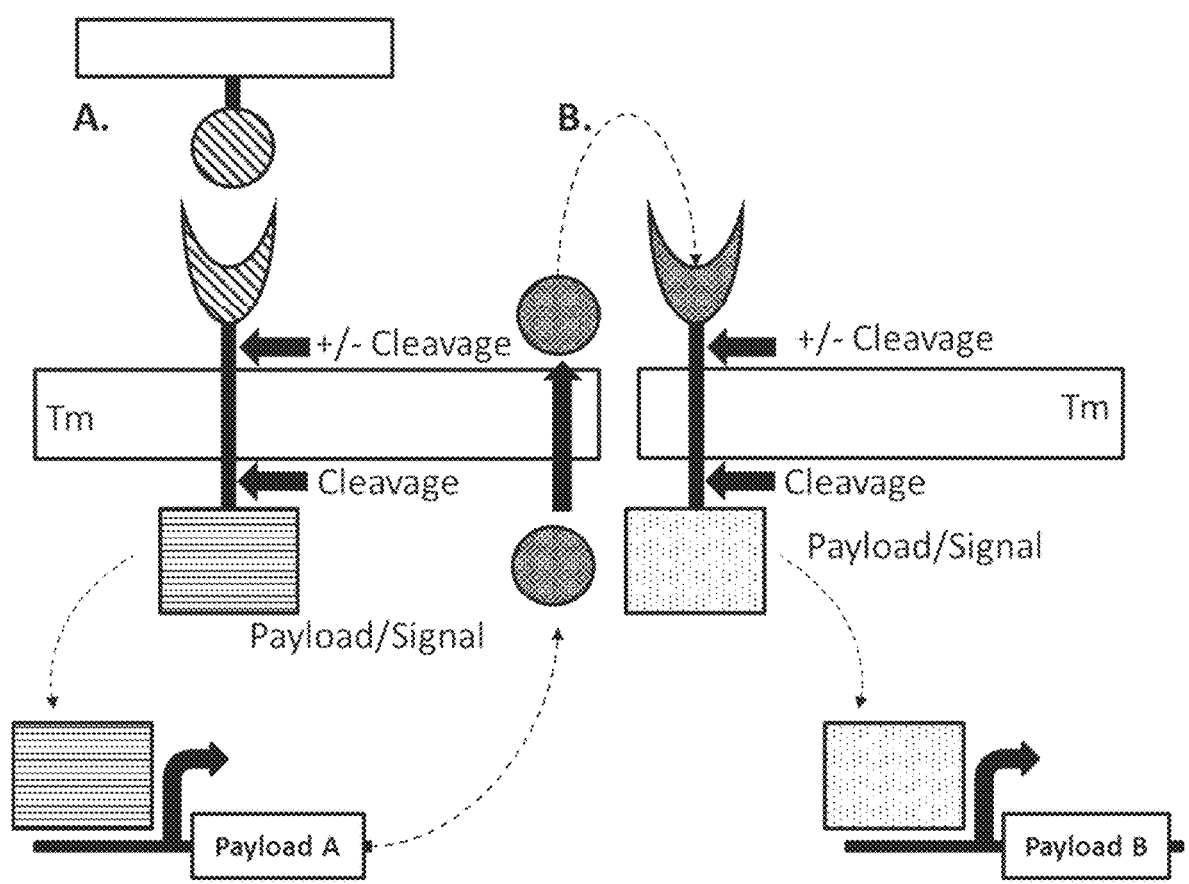
FIG. 10 depicts a single-stimulus-bridged receiver biocircuit system. In this configuration, a bound stimulus (A) binds to an effector module in the bridge cell and creates a signal to activate a payload which is a stimulus (B) for another effector module in the final receiver (e.g., another cell).
Figure 11:
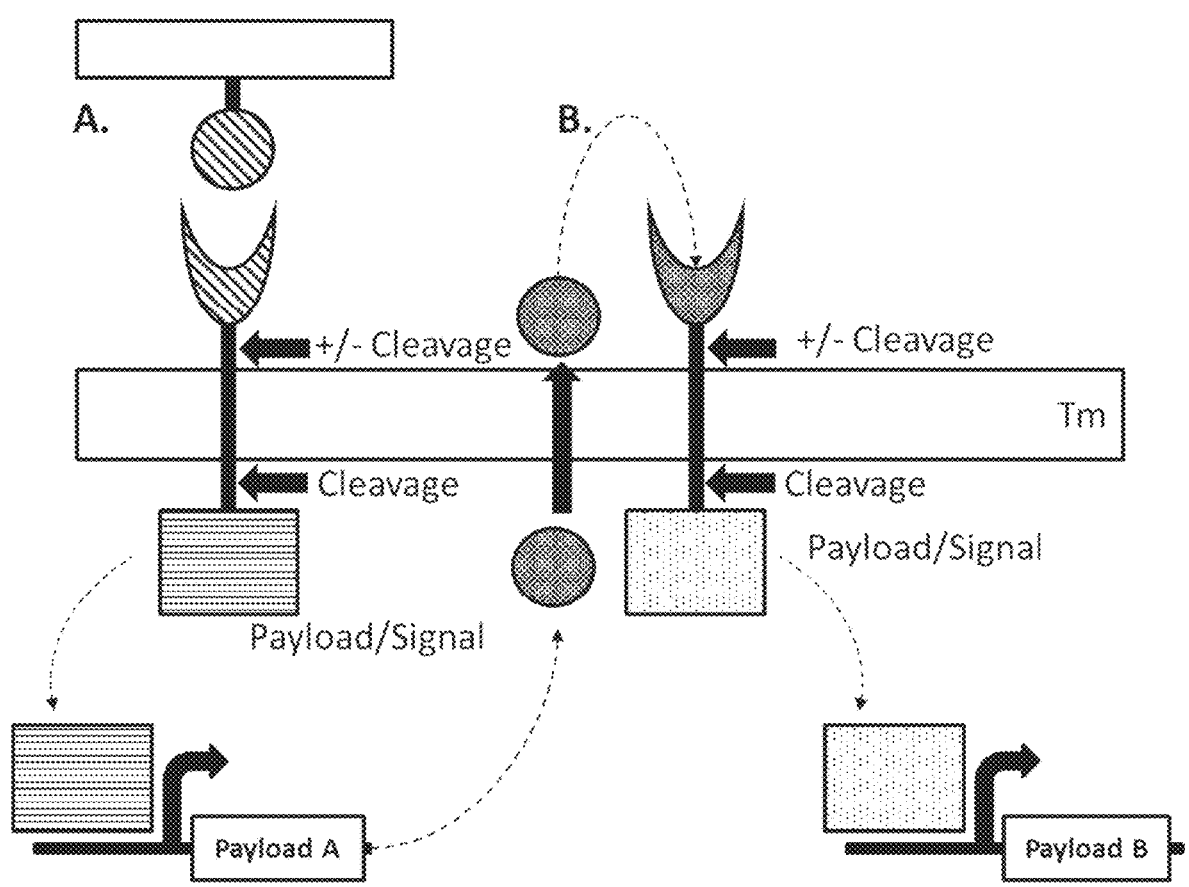
FIG. 11 depicts a single stimulus-single receiver biocircuit system, wherein the single receiver contains the two effector modules which are sequentially activated by a single stimulus.
Figure 12:
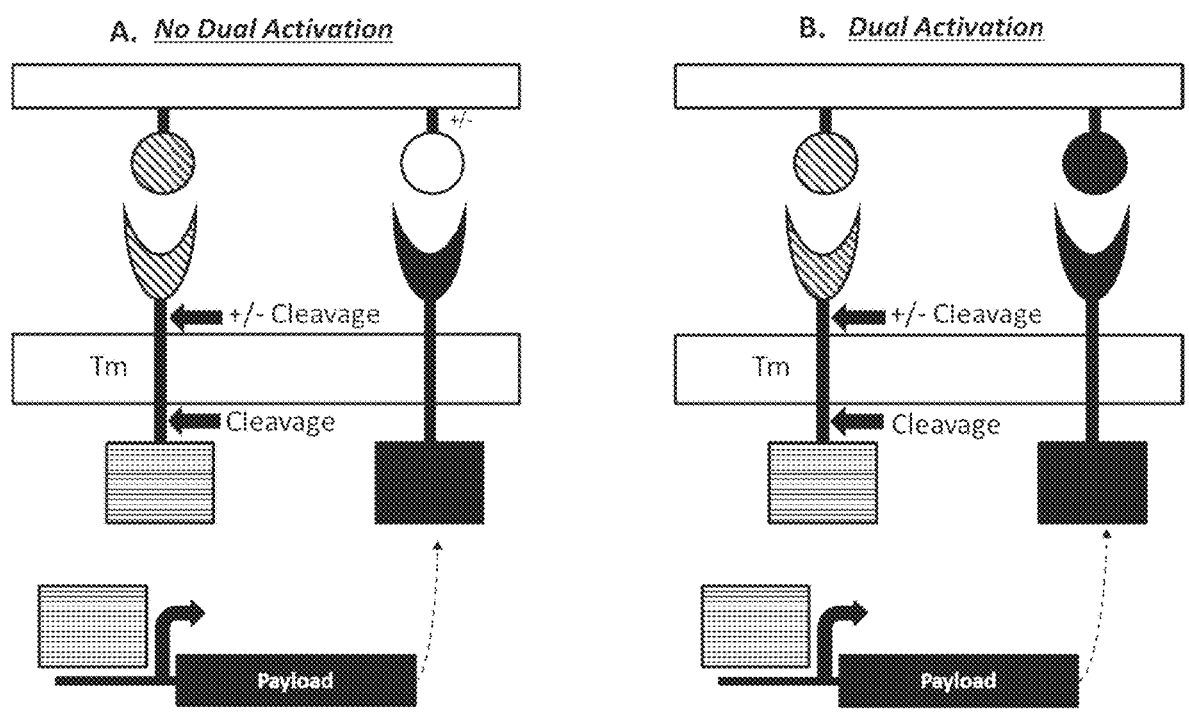
FIG. 12 depicts a biocircuit system which requires a dual activation. In this embodiment, one stimulus must bind the transmembrane effector module first to prime the receiver cell being activated by the other stimulus. The receiver only activates when it senses both stimuli (B).
Figure 13:
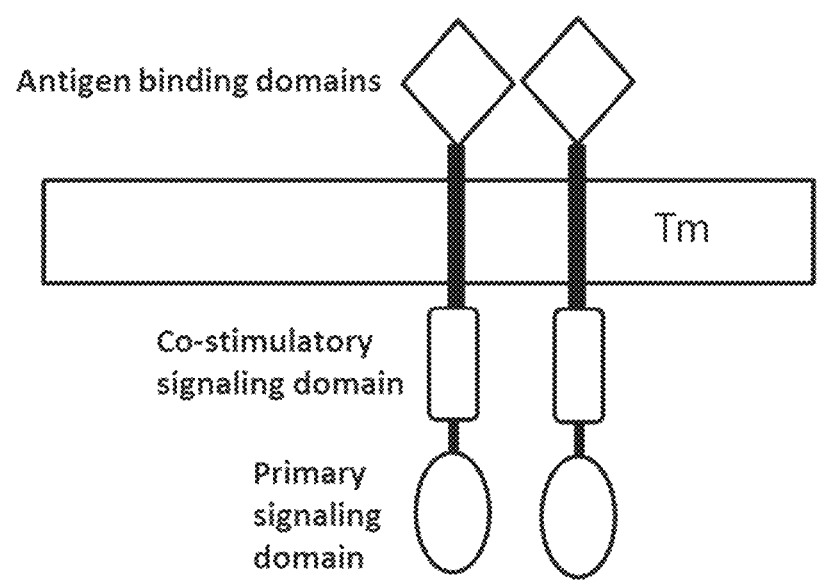
FIG. 13 depicts a standard effector module of a chimeric antigen receptor (CAR) system which comprises an antigen binding domain as an SRE, and signaling domain(s) as payload.
Figure 14:
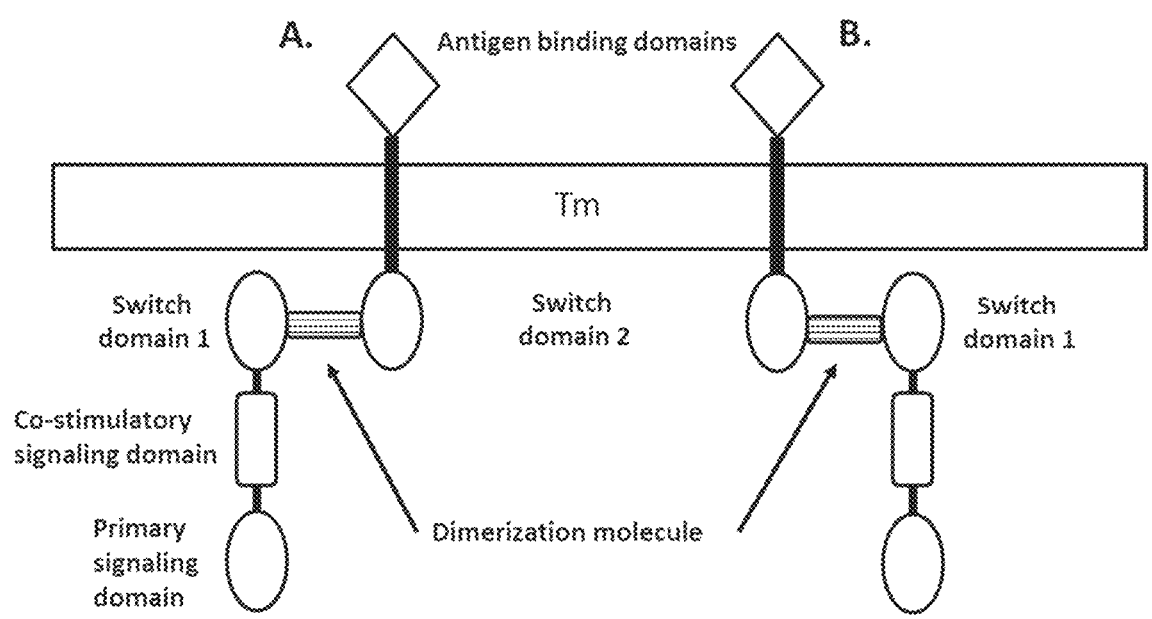
FIG. 14 depicts the structure design of a regulatable CAR system, where the trans-membrane effector modules comprise antigen binding domains sensing an antigen and a first switch domain and the intracellular module comprises a second switch domain and signaling domains. A stimulus (e.g., a dimerization small molecule) can dimerize the first and second switch domains and assemble an activated CAR system.
Figure 15:
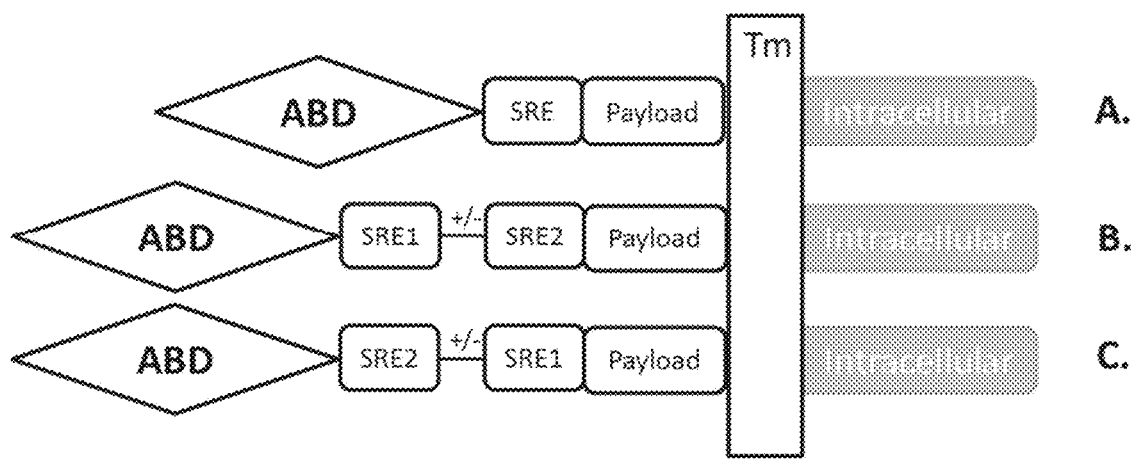
FIG. 15 shows schematic representation of CAR systems having one (A) or two (B and C) SREs incorporated into the effector module.
Figure 16A:
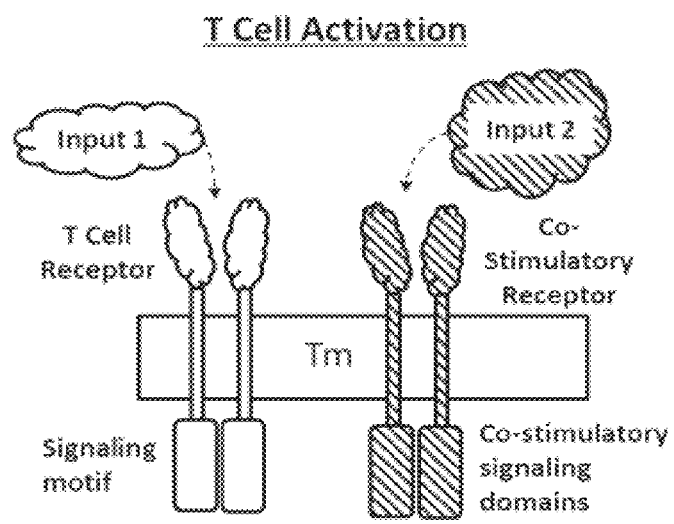
FIG. 16A shows normal T cell activation which entails a dual activation of TCR and co-stimulatory receptor. The regular CAR design (FIG. 16B) combines the antigen recognition domain with TCR signaling motif and co-stimulatory motif in a single molecule. The split CAR system separates the components of the regular CAR into two separate effector modules which can be reassembled when a heterodimerizing small molecule (stimulus) is present (FIG. 16C).
Figure 16B:
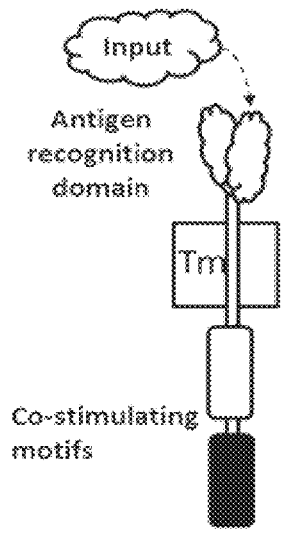
FIG. 16 depicts a split CAR design to control T cell activation by a dual stimulus (e.g., an antigen and small molecule).
Figure 16C:
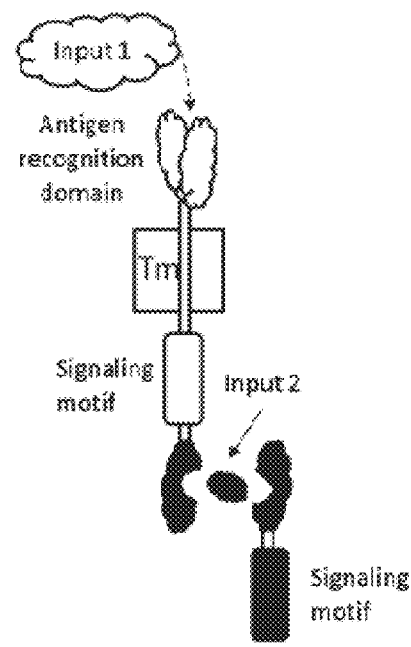
Figure 17A:
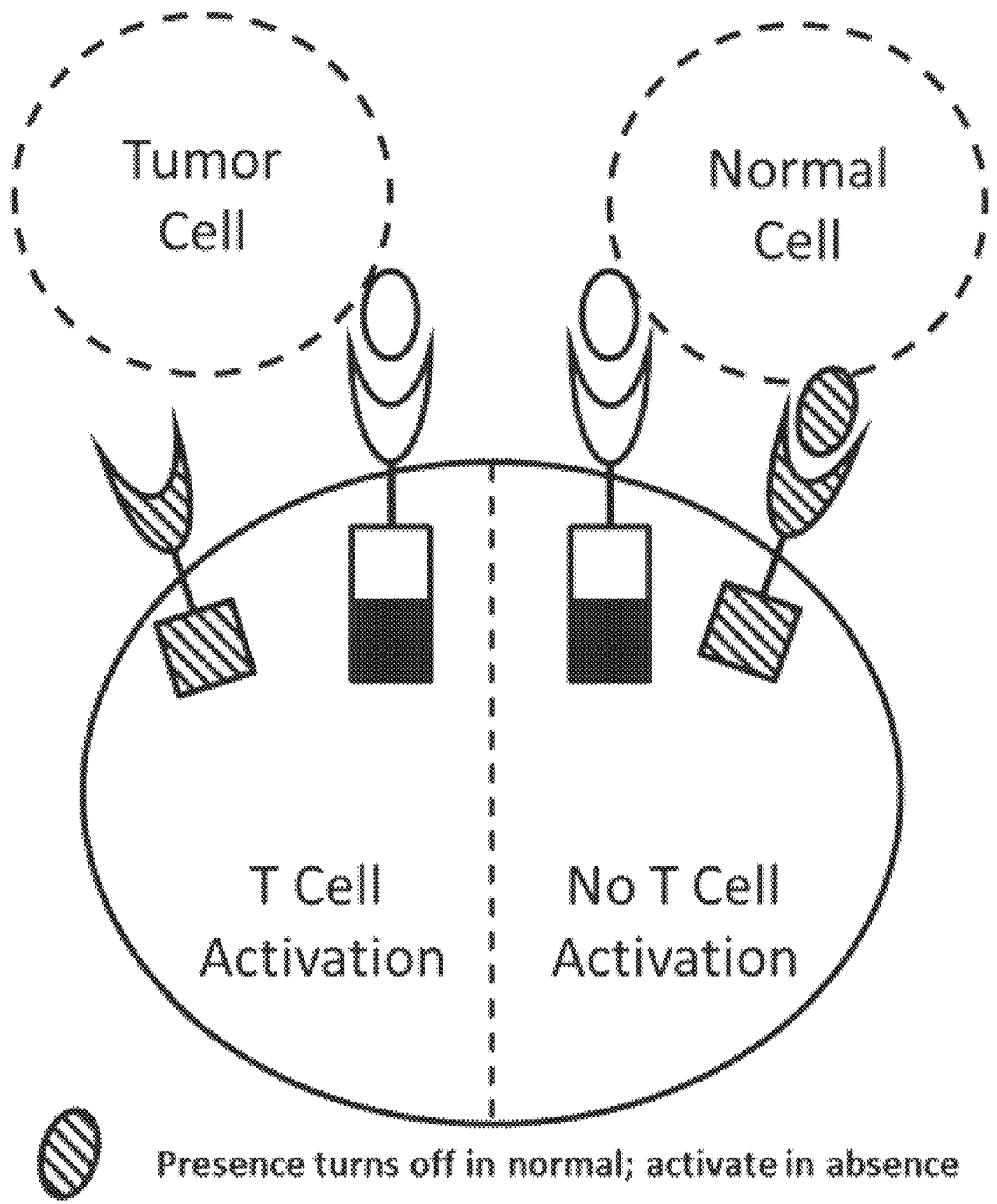
FIG. 17 depicts the positive and negative regulation of CAR engineered T cell activation. The absence or presence of a second stimulus can negatively (FIG. 17A) or positively (FIG. 17B) control T cell activation.
Figure 17B:
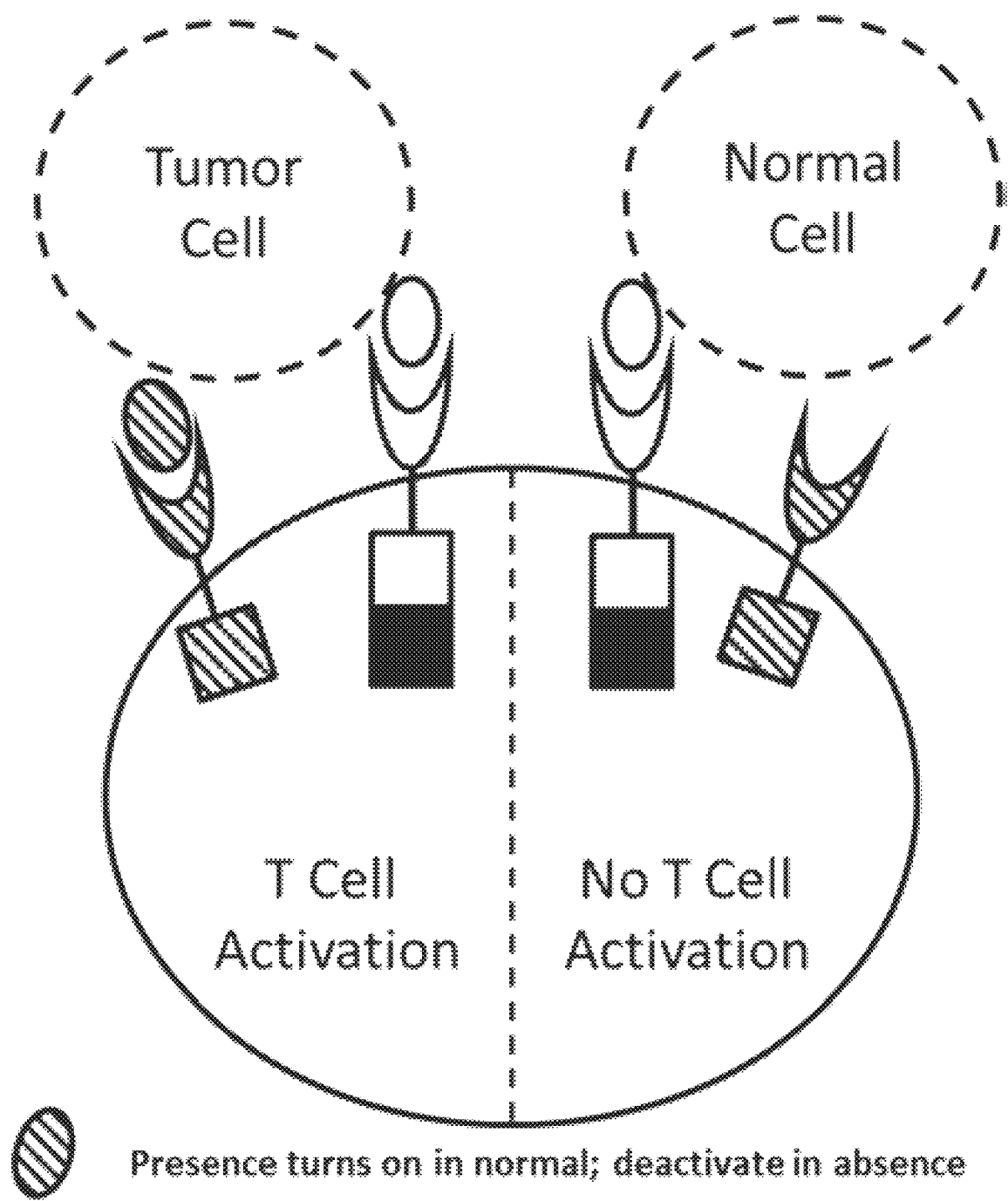
Figure 18A:
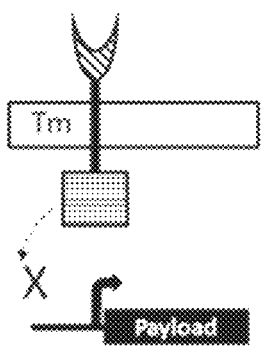
FIG. 18 shows schematic representation of gated activation of CAR engineered T cells. If a normal cell that has no stimulus (e.g., an antigen) (FIG. 18A) or an antigen that cannot bind to the trans-membrane effector module (FIG. 18B), or only an antigen that activates the trans-membrane effector module and primes the receiver T cell to express the second effector (FIG. 18C), the receiver T cell remains inactive. When both stimuli (e.g. two antigens) that bind the trans-membrane effector module and the primed effector, are present on the presenter cell (e.g. a cancer cell), the T cell is activated (FIG. 18D).
Figure 18B:
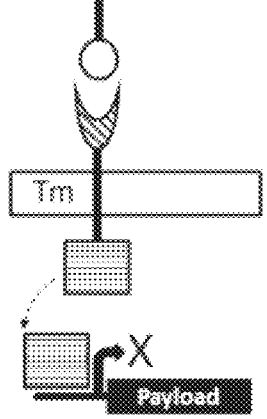
Figure 18C:
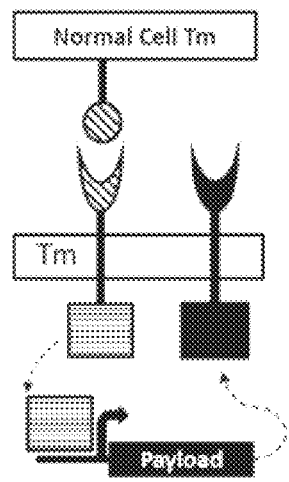
Figure 18D:
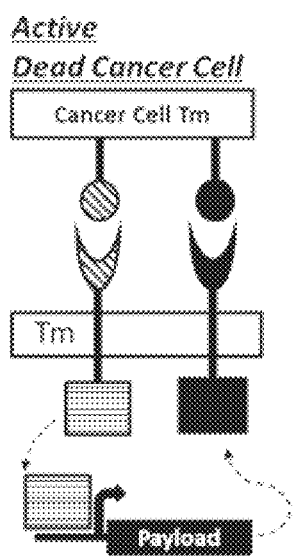

Strategies for the conditional regulation of gene expression and protein function have been described in the art and have focused predominantly on the manipulation of gene promoters to alter expression levels. However, such strategies suffer from delays between administration of the stimulus, most often a ligand, and the ultimate response from the system—owing to the delay for signals to reach the nucleus and effect transcriptional changes.

Further, knock down strategies aimed at muting the DNA or destruction of mRNA suffer from a long wait time for the ultimate desired drop in protein levels and function, owing in part to residual protein present and longer protein half-lives for destruction.

The longer lag times between administration of a particular perturbation agent and the response of the natural systems involving transcription, translation and protein degradation limit the application of the methods whose mechanism of action is subject to such natural processing times.

It is more advantageous to target the protein molecule directly. Strategies which directly trigger a cell's natural degradation systems have been developed. One such system relies on temperature sensitivity (for DHFR and the ligand, methotrexate) (Dohmen R J, et al., Science. 1994; 263:1273-1276; and Levy F, et al., Eur. J. Biochem. 1999; 259:244-252).

Others have used reversible systems employing a rapamycin derivative for the regulation of GSK-3β kinase fused to an unstable triple-mutant of the FRB domain (FRB*) (Stankunas et al., Mol Cell. 2003; 12:1615-1624 and Liu et al., Nature. 2007; 446:79-82).

Banaszynski, et al., developed a cell-permeable ligand systems using mutants of FKBP12 protein which were engineered to be unstable in the absence of a high-affinity ligand, Shield-1. (Banaszynski et al., Cell. 2006; 126:995-1004). They termed these unstable domains, destabilizing domains (DDs).

Subsequently, *E. coli* dihydrofolate reductase (ecDHFR) was explored as a candidate protein from which to design destabilizing domains. One inhibitor of DHFR, trimethoprim (TMP), inhibits ecDHFR much more potently than mammalian DHFR and this differential responsiveness makes this protein-ligand pair ideal for development for use as a biocircuit (Iwamoto, et al., Chem Biol. (2010) September 24; 17(9): 981-988).

Post-translational control has been of great interest in several gene therapy and cell therapy areas including immune-oncology applications and the expanding area of stem cell technology (Reviewed in Rakhit, et al., Chem Biol. 2014 Sep. 18; 21(9): 1238-1252).

Most recently protein switches useful as biosensors as well as new chimeric antigen receptors and other small molecule stabilization frameworks have been disclosed (An W, et al. (2015), PLoS ONE (2015) 10(12): e0145783. doi: 10.1371/journal.pone.0145783; Nicholes, et al., Protein Engineering, Design & Selection, 2016, vol. 29 no. 2, pp. 77-85; Nath, et al., Biochemical and Biophysical Research Communications 470 (2016) 411e416); Stevers, et al., PNAS, 2016, vol. 119, no. 9, pp. E112-1161; Juillerat, A. et al., Sci. Rep. (2016), 6, 18950; Roybal, Cell, (2016), vol. 164, pp. 1-10; and Morsut, Cell, (2016), vol. 164, pp. 1-12).

But collectively, these may all be characterized as simple on-off switches, even when combined with one another switch, e.g., the propagation of a single input or effect.

The present invention expands upon the early understandings of destabilizing domain research toward the development of new regulatable biocircuit systems and their methods of use. Such biocircuits include broader spectrum tunable stimulus response elements (SREs) which may be exploited alone or in concert with tunable proteins thus providing increased modularity and flexibility.

II. Compositions of the Invention

According to the present invention, biocircuit systems are provided which comprise, at their core, at least one effector module system. Such effector module systems comprise at least one effector module having associated, or integral therewith, one or more stimulus response elements (SREs). The overall architecture of a biocircuit system of the invention is illustrated in FIG. 1.

As used herein, a "biocircuit" or "biocircuit system" is defined as a circuit within or useful in biologic systems comprising a stimulus and at least one effector module responsive to a stimulus, where the response to the stimulus produces at least one signal or outcome within, between, as an indicator of, or on a biologic system. Biologic systems are generally understood to be any cell, tissue, organ, organ system or organism, whether animal, plant, fungi, bacterial, or viral. It is also understood that biocircuits may be artificial circuits which employ the stimuli or effector modules taught by the present invention and effect signals or outcomes in acellular environments such as with diagnostic, reporter systems, devices, assays or kits. The artificial circuits may be associated with one or more electronic, magnetic, or radioactive components or parts.

The present invention includes several types of biocircuits including destabilizing domain (DD) biocircuit system, dimer biocircuit systems, chimeric antigen receptor (CAR) biocircuit systems (also known as immune-oncology (I/O) biocircuit systems), receptor biocircuit systems, and cell biocircuit systems. Any of these systems may act as a signal to any other of these biocircuit systems.

Effector Modules, SREs and Payloads

As stated, the biocircuits of the invention include at least one effector module as a component of an effector module system. As used herein, an "effector module" is a single or multi-component construct or complex comprising at least (a) one or more stimulus response elements and (b) one or more payloads.

As used herein a "stimulus response element (SRE)" is a component of an effector module which is joined, attached, linked to or associated with one or more payloads of the effector module and in some instances, is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1% and 100% or a factored increase or decrease such as 2-fold, 3-fold, 4-fold, 5-fold, 10-fold or more.

In some embodiments, the present invention provides methods for modulating protein expression, function or level. In some aspects, the modulation of protein expression, function or level refers to modulation of expression, function or level by at least about 20%, such as by at least about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100%.

As used herein a "payload" or "target payload" or "payload of interest (POI)" is defined as any protein or nucleic acid whose function is to be altered.

Payloads may include any coding or non-coding gene or any protein or fragment thereof.

Payloads are often associated with one or more SREs and may be encoded alone or in combination with one or more SRE in a polynucleotide of the invention. Payloads themselves may be altered (at the protein or nucleic acid level) thereby providing for an added layer of tenability of the effector module. For example, payloads may be engineered or designed to contain mutations, single or multiple, which affect the stability of the payload or its susceptibility to degradation, cleavage or trafficking. The combination of an SRE which can have a spectrum of responses to a stimulus with a payload which is altered to exhibit a variety of responses or gradations of output signals, e.g., expression levels, produce biocircuits which are superior to those in the art. For example, mutations or substitutional designs such as those created for IL-12 in WO2016048903 (specifically in Example 1 therein), the contents of which are incorporated herein by reference in their entirety, may be used in any protein payload in conjunction with an SRE of the present invention to create dual tunable biocircuits. The ability to independently tune both the SRE and the payload greatly increases the scope of uses of the effector modules of the present invention.

Effector modules may be designed to include one or more payloads, one or more SREs, one or more cleavage sites, one or more signal sequences and one or more additional features including the presence or absence of one or more linkers. Representative effector module embodiments of the invention are illustrated in FIGS. 2-6. Biocircuits and components utilizing such effector molecules are given in FIGS. 7-12.

Effector modules, including their SREs and payloads, may be nucleic acid-based, protein-based or a combination thereof. They may be in the form of DNA, RNA, mRNA, proteins, fusion proteins, or any combination of the foregoing.

Effector modules, including their SREs and payloads may individually, collectively or independently comprise peptides, polypeptides or proteins. At the protein level, such payload may be any natural or artificial peptide or polypeptide or fragment thereof. Natural peptides or polypeptide components of the payload may be derived from any known protein of any species. In some embodiments, they are selected from the payloads represented by SEQ ID NO: 1-102450 (also taught in Lengthy Table 1 of U.S. Patent Application No. 62/320,864, the contents of which is herein incorporated by reference in its entirety), their coding sequences (such as the nucleotide sequences represented by SEQ ID NO: 102451-204900), or fragments thereof.

Shown in the following paragraph are payloads which may be used in the present invention. Separated by a semi-colon, each payload description includes, in order, the payload identifier (Payload ID), the gene symbol (if the gene symbol is unknown, the gene symbol is noted as "N/A"), the amino acid sequence identifier (ENSP SEQ ID), the nucleic acid sequence identifier (ENST SEQ ID) and the CDS start and stop location of the corresponding nucleic acid sequence. For example, 1, SEP15, 1, 102451, 255-752 describes a payload that has a payload identifier of 1, a gene symbol of SEP15, the amino acid sequence identifier is 1, the nucleic acid sequence identifier is 102451, and the CDS start and stop location of SEQ ID 102451 is 255-75. Additional information regarding the gene name, the ENSEMBL database Identifier for the protein sequence (ENSP ID) or the ENSEMBL database Identifier for the nucleic acid sequence (ENST ID), and/or CDS start and end location for the nucleic acid sequences may be found in the sequence listing and is incorporated herein by reference in its entirety. The payloads may also comprise any one or more of the ligand binding partners of Tables 2 or 3, any polypeptides taught herein or fragments thereof.

In one embodiment, the payload of the invention (POI) may be, but is not limited to, one of the following semi-colon delimited payloads (Payload ID, gene symbol, amino acid sequence identifier (ENSP SEQ ID), the nucleic acid sequence identifier (ENST SEQ and the CDS start and stop location of the corresponding nucleic acid sequence): 1, SEP15, 1, 102451, 255-752; 1, SEP15, 2, 102452, 24-398; 1, SEP15, 3, 102453, 16-450; 1, SEP15, 4, 102454, 314-685; 1, SEP15, 5, 102455, 314-808; 1, SEP15, 6, 102456, 1-266; 1, SEP15, 7, 102457, 1-95; 2, AGPAT1, 8, 102458, 106-957; 2, AGPAT1, 9, 102459, 102-953; 2, AGPAT1, 10, 102460, 319-1170; 2, AGPAT1, 11, 102461, 106-957; 2, AGPAT1, 12, 102462, 188-1039; 2, AGPAT1, 13, 102463, 253-1104; 2, AGPAT1, 14, 102464, 581-1432; 2, AGPAT1, 15, 102465, 581-1432; 2, AGPAT1, 16, 102466, 188-1039; 2, AGPAT1, 17, 102467, 253-1104; 2, AGPAT1, 18, 102468, 102-953; 2, AGPAT1, 19, 102469, 319-1170; 2, AGPAT1, 20, 102470, 319-1170; 2, AGPAT1, 21, 102471, 319-1170; 2, AGPAT1, 22, 102472, 253-1104; 2, AGPAT1, 23, 102473, 106-957; 2, AGPAT1, 24, 102474, 106-957; 2, AGPAT1, 25, 102475, 319-1170; 2, AGPAT1, 26, 102476, 102-953; 2, AGPAT1, 27, 102477, 253-1104; 2, AGPAT1, 28, 102478, 253-1104; 2, AGPAT1, 29, 102479, 106-957; 2, AGPAT1, 30, 102480, 102-953; 2, AGPAT1, 31, 102481, 102-953; 2, AGPAT1, 32, 102482, 253-1104; 2, AGPAT1, 33, 102483, 581-1432; 2, AGPAT1, 34, 102484, 102-953; 2, AGPAT1, 35, 102485, 188-1039; 2, AGPAT1, 36, 102486, 102-953; 2, AGPAT1, 37, 102487, 106-957; 2, AGPAT1, 38, 102488, 188-1039; 2, AGPAT1, 39, 102489, 319-1170; 2, AGPAT1, 40, 102490, 253-1104; 2, AGPAT1, 41, 102491, 188-1039; 2, AGPAT1, 42, 102492, 188-1039; 2, AGPAT1, 43, 102493, 319-1170; 2, AGPAT1, 44, 102494, 581-1432; 2, AGPAT1, 45, 102495, 188-1039; 2, AGPAT1, 46, 102496, 581-1432; 2, AGPAT1, 47, 102497, 581-1432; 2, AGPAT1, 48, 102498, 581-1432; 2, AGPAT1, 49, 102499, 106-957; 3, AGPAT2, 50, 102500, 42-782; 3, AGPAT2, 51, 102501, 67-903; 3, AGPAT2, 52, 102502, 40-876; 4, AGPAT3, 58, 102508, 217-454; 4, AGPAT3, 59, 102509, 278-392; 4, AGPAT3, 60, 102510, 199-582; 4, AGPAT3, 61, 102511, 158-924; 4, AGPAT3, 62, 102512, 237-1003; 4, AGPAT3, 53, 102503, 272-1402; 4, AGPAT3, 54, 102504, 178-1308; 4, AGPAT3, 55, 102505, 927-2057; 4, AGPAT3, 56, 102506, 184-1314; 4, AGPAT3, 57, 102507, 493-1623; 4, AGPAT3, 63, 102513, 744-1874; 5, AGPAT4, 65, 102515, 185-664; 5, AGPAT4, 66, 102516, 178-534; 5, AGPAT4, 67, 102517, 1-317; 5, AGPAT4, 68, 102518, 24-425; 5, AGPAT4, 64, 102514, 214-1350; 6, AGPAT5, 70, 102520, 1-214; 6, AGPAT5, 71, 102521, 4-270; 6, AGPAT5, 72, 102522, 1-545; 6, AGPAT5, 69, 102519, 313-1407; 7, ACCS, 74, 102524, 145-563; 7, ACCS, 75, 102525, 169-400; 7, ACCS, 73, 102523, 435-1940; 8, ACCSL, 77, 102527, 23-550; 8, ACCSL, 76, 102526, 57-1763; 9, BPGM, 81, 102531, 402-635; 9, BPGM, 78, 102528, 192-971; 9, BPGM, 79, 102529, 490-1269; 9, BPGM, 80, 102530, 314-1093; 10, CNP, 84, 102534, 190-622; 10, CNP, 85, 102535, 155-516; 10, CNP, 86, 102536, 123-272; 10, CNP, 87, 102537, 88-581; 10, CNP, 88, 102538, 229-689; 10, CNP, 82, 102532, 126-1331; 10, CNP, 83, 102533, 145-1410; 11, DECR1, 90, 102540, 159-774; 11, DECR1, 91, 102541, 1-131; 11, DECR1, 92, 102542, 48-194; 11, DECR1, 93, 102543, 36-161; 11, DECR1, 94, 102544, 411-864; 11, DECR1, 95, 102545, 18-143; 11, DECR1, 97, 102547, 162-705; 11, DECR1, 98, 102548, 14-301; 11, DECR1, 99, 102549, 89-214; 11, DECR1, 89, 102539, 89-1096; 11, DECR1, 96, 102546, 684-1664; 12, DECR2, 101, 102551, 1-283; 12, DECR2, 102, 102552, 39-284; 12, DECR2, 104, 102554, 83-925; 12, DECR2, 105, 102555, 50-295; 12, DECR2, 107, 102557, 107-352; 12, DECR2, 108, 102558, 107-352; 12, DECR2, 109, 102559, 83-925; 12, DECR2, 110, 102560, 82-509; 12, DECR2, 111, 102561, 39-284; 12, DECR2, 112, 102562, 4-249; 12, DECR2, 113, 102563, 48-762; 12, DECR2, 114, 102564, 4-249; 12, DECR2, 115, 102565, 48-762; 12, DECR2, 116, 102566, 80-328; 12, DECR2, 117, 102567, 50-295; 12, DECR2, 118, 102568, 82-509; 12, DECR2, 120, 102570, 1-283; 12, DECR2, 121, 102571, 80-328; 12, DECR2, 100, 102550, 139-1017; 12, DECR2, 103, 102553, 72-707; 12, DECR2, 106, 102556, 139-1017; 12, DECR2, 119, 102569, 72-707; 13, DHCR24, 123, 102573, 1-463; 13, DHCR24, 124, 102574, 272-1555; 13, DHCR24, 122, 102572, 100-1650; 14, OAS1, 128, 102578, 3-536; 14, OAS1, 129, 102579, 1-909; 14, OAS1, 130, 102580, 34-1116; 14, OAS1, 131, 102581, 1-393; 14, OAS1, 132, 102582, 75-324; 14, OAS1, 133, 102583, 1-68; 14, OAS1, 134, 102584, 1-48; 14, OAS1, 125, 102575, 264-1466; 14, OAS1, 126, 102576, 258-1502; 14, OAS1, 127, 102577, 191-1285; 15, OAS2, 138, 102588, 70-879; 15, OAS2, 139, 102589, 8-190; 15, OAS2, 140, 102590, 20-2200; 15, OAS2, 135, 102585, 215-2374; 15, OAS2, 136, 102586, 208-2271; 15, OAS2, 137, 102587, 128-646; 16, OAS3, 142, 102592, 1-499; 16, OAS3, 143, 102593, 72-743; 16, OAS3, 144, 102594, 88-621; 16, OAS3, 141, 102591, 180-3443; 17, OASL, 147, 102597, 1-461; 17, OASL, 145, 102595, 272-1816; 17, OASL, 146, 102596, 186-953; 17, OASL, 148, 102598, 272-1426; 18, ADO, 149, 102599, 204-1016; 19, DNPH1, 152, 102602, 1-732; 19, DNPH1, 150, 102600, 29-553; 19, DNPH1, 151, 102601, 23-469; 20, HACL1, 154, 102604, 95-454; 20, HACL1, 156, 102606, 130-861; 20, HACL1, 157, 102607, 107-520; 20, HACL1, 158, 102608, 107-1120; 20, HACL1, 159, 102609, 99-569; 20, HACL1, 162, 102612, 390-749; 20, HACL1, 153, 102603, 369-2105; 20, HACL1, 155, 102605, 107-1762; 20, HACL1, 160, 102610, 125-1615; 20, HACL1, 161, 102611, 107-1663; 21, OGFOD1, 163, 102613, 56-175; 21, OGFOD1, 164, 102614, 59-199; 21, OGFOD1, 165, 102615, 91-420; 21, OGFOD1, 166, 102616, 93-586; 21, OGFOD1, 168, 102618, 59-584; 21, OGFOD1, 169, 102619, 52-1551; 21, OGFOD1, 167, 102617, 124-1752; 22, OGFOD2, 173, 102623, 947-1426; 22, OGFOD2, 177, 102627, 14-635; 22, OGFOD2, 178, 102628, 1089-1568;

22, OGFOD2, 170, 102620, 33-1085; 22, OGFOD2, 171, 102621, 740-1612; 22, OGFOD2, 172, 102622, 512-1072; 22, OGFOD2, 174, 102624, 829-1389; 22, OGFOD2, 175, 102625, 699-1259; 22, OGFOD2, 176, 102626, 1-390; 22, OGFOD2, 179, 102629, 973-1533; 22, OGFOD2, 180, 102630, 813-1373; 22, OGFOD2, 181, 102631, 1044-1604; 23, OGFOD3, 184, 102634, 153-533; 23, OGFOD3, 185, 102635, 1-724; 23, OGFOD3, 186, 102636, 1-286; 23, OGFOD3, 187, 102637, 827-872; 23, OGFOD3, 188, 102638, 1-657; 23, OGFOD3, 182, 102632, 153-1112; 23, OGFOD3, 183, 102633, 92-1087; 24, PXYLP1, 191, 102641, 132-568; 24, PXYLP1, 192, 102642, 338-1666; 24, PXYLP1, 193, 102643, 1908-3323; 24, PXYLP1, 194, 102644, 178-569; 24, PXYLP1, 195, 102645, 141-221; 24, PXYLP1, 196, 102646, 364-444; 24, PXYLP1, 197, 102647, 83-1474; 24, PXYLP1, 198, 102648, 193-478; 24, PXYLP1, 189, 102639, 138-1580; 24, PXYLP1, 190, 102640, 279-1721; 25, BPNT1, 200, 102650, 96-971; 25, BPNT1, 204, 102654, 151-559; 25, BPNT1, 205, 102655, 135-644; 25, BPNT1, 206, 102656, 236-583; 25, BPNT1, 207, 102657, 178-569; 25, BPNT1, 199, 102649, 177-1103; 25, BPNT1, 201, 102651, 177-995; 25, BPNT1, 202, 102652, 256-1017; 25, BPNT1, 203, 102653, 451-1377; 26, HMGCR, 210, 102660, 214-268; 26, HMGCR, 211, 102661, 1-348; 26, HMGCR, 212, 102662, 1-497; 26, HMGCR, 214, 102664, 195-527; 26, HMGCR, 208, 102658, 157-2823; 26, HMGCR, 209, 102659, 93-2600; 26, HMGCR, 213, 102663, 313-2979; 27, HMGCS1, 217, 102667, 214-500; 27, HMGCS1, 215, 102665, 208-1770; 27, HMGCS1, 216, 102666, 168-1730; 28, HMGCS2, 218, 102668, 51-1577; 28, HMGCS2, 219, 102669, 62-1462; 29, HACD1, 220, 102670, 29-505; 29, HACD1, 222, 102672, 1-523; 29, HACD1, 223, 102673, 1-114; 29, HACD1, 221, 102671, 39-905; 30, HACD2, 225, 102675, 1-184; 30, HACD2, 226, 102676, 295-590; 30, HACD2, 224, 102674, 159-923; 31, HACD3, 229, 102679, 372-789; 31, HACD3, 230, 102680, 387-1124; 31, HACD3, 231, 102681, 128-1141; 31, HACD3, 232, 102682, 447-1184; 31, HACD3, 233, 102683, 766-1503; 31, HACD3, 234, 102684, 345-1082; 31, HACD3, 235, 102685, 143-1345; 31, HACD3, 227, 102677, 167-1255; 31, HACD3, 228, 102678, 151-1074; 32, HACD4, 236, 102686, 47-745; 33, HMO, 238, 102688, 298-827; 33, HMO, 237, 102687, 57-917; 34, BDH1, 242, 102692, 371-868; 34, BDH1, 243, 102693, 187-453; 34, BDH1, 244, 102694, 388-539; 34, BDH1, 245, 102695, 1-386; 34, BDH1, 246, 102696, 154-659; 34, BDH1, 247, 102697, 396-955; 34, BDH1, 248, 102698, 534-1304; 34, BDH1, 251, 102701, 371-868; 34, BDH1, 252, 102702, 534-1304; 34, BDH1, 253, 102703, 286-845; 34, BDH1, 254, 102704, 154-658; 34, BDH1, 255, 102705, 388-949; 34, BDH1, 256, 102706, 44-310; 34, BDH1, 239, 102689, 187-1218; 34, BDH1, 240, 102690, 312-1343; 34, BDH1, 241, 102691, 403-1434; 34, BDH1, 249, 102699, 403-1434; 34, BDH1, 250, 102700, 312-1343; 35, BDH2, 258, 102708, 68-340; 35, BDH2, 259, 102709, 268-616; 35, BDH2, 260, 102710, 109-303; 35, BDH2, 261, 102711, 187-578; 35, BDH2, 257, 102707, 122-859; 36, HIBADH, 263, 102713, 1-618; 36, HIBADH, 264, 102714, 81-200; 36, HIBADH, 262, 102712, 208-1218; 37, HIBCH, 267, 102717, 1-209; 37, HIBCH, 268, 102718, 261-752; 37, HIBCH, 269, 102719, 127-511; 37, HIBCH, 270, 102720, 6-826; 37, HIBCH, 271, 102721, 1-116; 37, HIBCH, 272, 102722, 1-360; 37, HIBCH, 273, 102723, 1-159; 37, HIBCH, 274, 102724, 63-1205; 37, HIBCH, 265, 102715, 296-1456; 37, HIBCH, 266, 102716, 141-1157; 38, HMGCL, 275, 102725, 1-548; 38, HMGCL, 276, 102726, 323-556; 38, HMGCL, 277, 102727, 45-1022; 38, HMGCL, 278, 102728, 14-778; 39, HMGCLL1, 281, 102731, 112-825; 39, HMGCLL1, 284, 102734, 19-474; 39, HMGCLL1, 285, 102735, 51-575; 39, HMGCLL1, 286, 102736, 112-231; 39, HMGCLL1, 279, 102729, 160-1182; 39, HMGCLL1, 280, 102730, 126-1052; 39, HMGCLL1, 282, 102732, 45-206; 39, HMGCLL1, 283, 102733, 133-1245; 40, KDSR, 289, 102739, 87-553; 40, KDSR, 290, 102740, 1-612; 40, KDSR, 287, 102737, 87-893; 40, KDSR, 288, 102738, 393-1391; 41, OXCT1, 294, 102744, 78-1082; 41, OXCT1, 291, 102741, 162-1724; 41, OXCT1, 292, 102742, 234-605; 41, OXCT1, 293, 102743, 182-553; 42, OXCT2, 295, 102745, 94-1647; 43, OXSM, 297, 102747, 240-899; 43, OXSM, 298, 102748, 90-398; 43, OXSM, 299, 102749, 63-756; 43, OXSM, 301, 102751, 1-309; 43, OXSM, 296, 102746, 100-1479; 43, OXSM, 300, 102750, 86-1216; 44, PAPSS1, 302, 102752, 274-2148; 45, PAPSS2, 303, 102753, 370-2214; 45, PAPSS2, 304, 102754, 264-2123; 46, PDPK1, 307, 102757, 666-2255; 46, PDPK1, 309, 102759, 94-201; 46, PDPK1, 310, 102760, 1-121; 46, PDPK1, 311, 102761, 188-451; 46, PDPK1, 312, 102762, 165-611; 46, PDPK1, 313, 102763, 93-260; 46, PDPK1, 305, 102755, 111-1400; 46, PDPK1, 306, 102756, 150-1820; 46, PDPK1, 308, 102758, 117-1481; 47, ABAT, 317, 102767, 307-580; 47, ABAT, 318, 102768, 258-1805; 47, ABAT, 319, 102769, 486-580; 47, ABAT, 320, 102770, 918-1079; 47, ABAT, 321, 102771, 155-508; 47, ABAT, 322, 102772, 397-592; 47, ABAT, 323, 102773, 263-1810; 47, ABAT, 324, 102774, 180-466; 47, ABAT, 314, 102764, 189-1691; 47, ABAT, 315, 102765, 939-2441; 47, ABAT, 316, 102766, 261-1763; 48, HOGA1, 325, 102775, 1-256; 48, HOGA1, 326, 102776, 362-1345; 48, HOGA1, 327, 102777, 362-856; 49, HPD, 328, 102778, 37-1218; 49, HPD, 329, 102779, 447-1511; 50, HPDL, 330, 102780, 245-1360; 51, NTSC, 332, 102782, 38-586; 51, NTSC, 334, 102784, 277-396; 51, NTSC, 335, 102785, 1-462; 51, NTSC, 336, 102786, 250-597; 51, NTSC, 337, 102787, 125-244; 51, NTSC, 338, 102788, 1-262; 51, NTSC, 331, 102781, 89-694; 51, NTSC, 333, 102783, 37-390; 52, MTHFS, 340, 102790, 1-118; 52, MTHFS, 341, 102791, 10-144; 52, MTHFS, 342, 102792, 16-714; 52, MTHFS, 339, 102789, 62-673; 53, NTSM, 344, 102794, 162-443; 53, NTSM, 345, 102795, 186-527; 53, NTSM, 346, 102796, 1-155; 53, NTSM, 347, 102797, 217-921; 53, NTSM, 343, 102793, 217-903; 54, XRN1, 351, 102801, 1-190; 54, XRN1, 352, 102802, 1-3481; 54, XRN1, 353, 102803, 190-686; 54, XRN1, 354, 102804, 69-392; 54, XRN1, 348, 102798, 119-5239; 54, XRN1, 349, 102799, 49-5133; 54, XRN1, 350, 102800, 67-1446; 55, XRN2, 355, 102805, 96-2948; 56, ATIC, 357, 102807, 188-442; 56, ATIC, 358, 102808, 14-145; 56, ATIC, 359, 102809, 1-694; 56, ATIC, 360, 102810, 185-695; 56, ATIC, 361, 102811, 72-203; 56, ATIC, 356, 102806, 327-2105; 56, ATIC, 362, 102812, 392-2167; 57, ALAS1, 365, 102815, 1-713; 57, ALAS1, 368, 102818, 1-350; 57, ALAS1, 363, 102813, 146-2068; 57, ALAS1, 364, 102814, 361-2283; 57, ALAS1, 366, 102816, 203-2125; 57, ALAS1, 367, 102817, 322-2244; 58, ALAS2, 372, 102822, 1-664; 58, ALAS2, 369, 102819, 139-1902; 58, ALAS2, 370, 102820, 52-1704; 58, ALAS2, 371, 102821, 87-1811; 59, AZI2, 376, 102826, 1-229; 59, AZI2, 377, 102827, 415-1061; 59, AZI2, 378, 102828, 323-608; 59, AZI2, 373, 102823, 35-733; 59, AZI2, 374, 102824, 361-1092; 59, AZI2, 375, 102825, 456-1187; 59, AZI2, 379, 102829, 533-1711; 60, HMCES, 382, 102832, 84-1022; 60, HMCES, 383, 102833, 223-643; 60, HMCES, 384, 102834, 102-948; 60, HMCES, 385, 102835, 75-774; 60, HMCES, 387, 102837, 50-599; 60, HMCES, 380, 102830, 90-1154; 60, HMCES, 381, 102831, 262-1326; 60, HMCES, 386, 102836, 272-1336; 61, HTR1A, 389, 102839, 429-553; 61, HTR1A, 388, 102838, 415-1683; 62, HTR1B, 390, 102840, 62-1234; 63, HTR1D, 391, 102841, 511-1644; 64, HTR1E, 392, 102842, 704-1801; 65, HTR1F, 393, 102843, 55-1155; 66, HTR2A, 397, 102847, 1-333; 66, HTR2A, 394, 102844, 133-1548; 66, HTR2A, 395, 102845, 732-2147; 66, HTR2A, 396, 102846, 244-1407; 67, HTR2B, 398, 102848, 514-1959; 68, HTR2C, 399, 102849, 729-2105; 68, HTR2C, 400, 102850, 725-1471; 68, HTR2C, 401, 102851, 820-2196; 69, HTR3A, 405, 102855, 41-757; 69, HTR3A, 402, 102852, 56-1447; 69, HTR3A, 403, 102853, 234-1784; 69, HTR3A, 404, 102854, 234-1688; 69, HTR3A, 406, 102856, 446-1882; 69, HTR3A, 407, 102857, 139-1671; 70, HTR3B, 409, 102859, 1-527; 70, HTR3B, 408, 102858, 258-1583; 70, HTR3B, 410, 102860, 285-1577; 71, HTR3C, 411, 102861, 35-1378; 72, HTR3D, 412, 102862, 226-1065; 72, HTR3D, 413, 102863, 1-1365; 72, HTR3D, 414, 102864, 117-818; 72, HTR3D, 415, 102865, 1-1215; 73, HTR3E, 417, 102867, 232-705; 73, HTR3E, 416, 102866, 195-1610; 73, HTR3E, 418, 102868, 1-1371; 73, HTR3E, 419, 102869, 467-1837; 73, HTR3E, 420, 102870, 1-1326; 73, HTR3E, 421, 102871, 1-1449; 74, HTR4, 427, 102877, 26-289; 74, HTR4, 428, 102878, 514-1629; 74, HTR4, 422, 102872, 140-1426; 74, HTR4, 423, 102873, 48-1334; 74, HTR4, 424, 102874, 140-1306; 74, HTR4, 425, 102875, 1-1236; 74, HTR4, 426, 102876, 7-1170; 74, HTR4, 429, 102879, 1-1137; 74, HTR4, 430, 102880, 3-1139; 74, HTR4, 431, 102881, 16-1098; 74, HTR4, 432, 102882, 20-1186; 75, HTR5A, 433, 102883, 577-1650; 76, HTR6, 434, 102884, 468-1790; 77, HTR7, 435, 102885, 28-1365; 77, HTR7, 436, 102886, 28-1467; 77, HTR7, 437, 102887, 28-1326; 78, MTR, 438, 102888, 1-2460; 78, MTR, 439, 102889, 395-4192; 78, MTR, 440, 102890, 424-4068; 79, MTRR, 443, 102893, 185-520; 79, MTRR, 444, 102894, 1-1117; 79, MTRR, 445, 102895, 1-346; 79, MTRR, 446, 102896, 1-478; 79, MTRR, 447, 102897, 98-567; 79, MTRR, 448, 102898, 58-198; 79, MTRR, 449, 102899, 1-244; 79, MTRR, 451, 102901, 138-416; 79, MTRR, 453, 102903, 506-628; 79, MTRR, 441, 102891, 31-2208; 79, MTRR, 442, 102892, 53-2149; 79, MTRR, 450, 102900, 48-224; 79, MTRR, 452, 102902, 94-270; 80, NT5DC1, 455, 102905, 81-667; 80, NT5DC1, 456, 102906, 1-425; 80, NT5DC1, 454, 102904, 83-1450; 81, NT5DC2, 459, 102909, 1-772; 81, NT5DC2, 460, 102910, 326-582; 81, NT5DC2, 461, 102911, 1-585; 81, NT5DC2, 463, 102913, 354-689; 81, NT5DC2, 457, 102907, 402-1964; 81, NT5DC2, 458, 102908, 41-1714; 81, NT5DC2, 462, 102912, 41-1639; 82, NT5DC3, 465, 102915, 1-406; 82, NT5DC3, 466, 102916, 1-368; 82, NT5DC3, 464, 102914, 42-1688; 83, NT5DC4, 467, 102917, 52-1338; 84, NT5C1A, 468, 102918, 1-1107; 85, NT5C1B, 471, 102921, 105-716; 85, NT5C1B, 472, 102922, 1-796; 85, NT5C1B, 473, 102923, 69-685; 85, NT5C1B, 469, 102919, 102-1754; 85, NT5C1B, 470, 102920, 79-1911; 86, NT5C2, 476, 102926, 62-856; 86, NT5C2, 477, 102927, 1-440; 86, NT5C2, 478, 102928, 1-525; 86, NT5C2, 479, 102929, 1-472; 86, NT5C2, 480, 102930, 88-276; 86, NT5C2, 481, 102931, 88-222; 86, NT5C2, 474, 102924, 96-1781; 86, NT5C2, 475, 102925, 25-1710; 87, NT5C3A, 487, 102937, 15-632; 87, NT5C3A, 488, 102938, 77-241; 87, NT5C3A, 489, 102939, 180-306; 87, NT5C3A, 490, 102940, 75-1070; 87, NT5C3A, 482, 102932, 78-1088; 87, NT5C3A, 483, 102933, 436-1293; 87, NT5C3A, 484, 102934, 304-1197; 87, NT5C3A, 485, 102935, 250-1143; 87, NT5C3A, 486, 102936, 175-1032; 87, NT5C3A, 491, 102941, 78-1088; 88, NT5C3B, 493, 102943, 52-276; 88, NT5C3B, 494, 102944, 49-730; 88, NT5C3B, 495, 102945, 68-670; 88, NT5C3B, 496, 102946, 54-227; 88, NT5C3B, 497, 102947, 1-318; 88, NT5C3B, 492, 102942, 71-973; 89, NT5E, 499, 102949, 50-844; 89, NT5E, 501, 102951, 1-539; 89, NT5E, 502, 102952, 1-689; 89, NT5E, 498, 102948, 50-1774; 89, NT5E, 500, 102950, 557-2131; 90, OPLAH, 504, 102954, 187-659; 90, OPLAH, 503, 102953, 105-3971; 91, PHYKPL, 506, 102956, 81-739; 91, PHYKPL, 507, 102957, 1-548; 91, PHYKPL, 508, 102958, 22-393; 91, PHYKPL, 509, 102959, 241-438; 91, PHYKPL, 510, 102960, 1-348; 91, PHYKPL, 511, 102961, 219-386; 91, PHYKPL, 512, 102962, 1-87; 91, PHYKPL, 505, 102955, 236-1588; 92, N/A, 513, 102963, 483-1057; 92, N/A, 514, 102964, 165-620; 92, N/A, 515, 102965, 31-831; 93, PFKFB1, 516, 102966, 72-887; 93, PFKFB1, 519, 102969, 603-1337; 93, PFKFB1, 517, 102967, 72-1487; 93, PFKFB1, 518, 102968, 102-1322; 94, PFKFB2, 522, 102972, 273-563; 94, PFKFB2, 523, 102973, 169-543; 94, PFKFB2, 524, 102974, 110-244; 94, PFKFB2, 525, 102975, 408-554; 94, PFKFB2, 520, 102970, 74-1489; 94, PFKFB2, 521, 102971, 125-1642; 95, PFKFB3, 528, 102978, 396-1937; 95, PFKFB3, 529, 102979, 396-1976; 95, PFKFB3, 531, 102981, 1-430; 95, PFKFB3, 532, 102982, 1-96; 95, PFKFB3, 533, 102983, 1-279; 95, PFKFB3, 534, 102984, 396-1763; 95, PFKFB3, 535, 102985, 396-1763; 95, PFKFB3, 536, 102986, 1-186; 95, PFKFB3, 537, 102987, 396-1763; 95, PFKFB3, 538, 102988, 396-1763; 95, PFKFB3, 540, 102990, 385-1752; 95, PFKFB3, 541, 102991, 385-1965; 95, PFKFB3, 526, 102976, 362-1906; 95, PFKFB3, 527, 102977, 331-1893; 95, PFKFB3, 530, 102980, 65-1567; 95, PFKFB3, 539, 102989, 64-1668; 96, PFKFB4, 544, 102994, 114-1502; 96, PFKFB4, 545, 102995, 114-230; 96, PFKFB4, 546, 102996, 41-567; 96, PFKFB4, 547, 102997, 114-356; 96, PFKFB4, 548, 102998, 58-1011; 96, PFKFB4, 549, 102999, 250-636; 96, PFKFB4, 542, 102992, 114-1523; 96, PFKFB4, 543, 102993, 114-1418; 97, PGLS, 551, 103001, 38-577; 97, PGLS, 552, 103002, 1-444; 97, PGLS, 553, 103003, 4-651; 97, PGLS, 550, 103000, 45-821; 98, PTS, 555, 103005, 13-198; 98, PTS, 556, 103006, 57-224; 98, PTS, 557, 103007, 208-441; 98, PTS, 558, 103008, 78-245; 98, PTS, 554, 103004, 80-517; 99, DHCR7, 561, 103011, 1-349; 99, DHCR7, 562, 103012, 191-507; 99, DHCR7, 563, 103013, 1-666; 99, DHCR7, 564, 103014, 230-1005; 99, DHCR7, 565, 103015, 306-525; 99, DHCR7, 566, 103016, 476-968; 99, DHCR7, 567, 103017, 200-520; 99, DHCR7, 568, 103018, 1-738; 99, DHCR7, 569, 103019, 307-579; 99, DHCR7, 559, 103009, 278-1705; 99, DHCR7, 560, 103010, 213-1640; 100, OGG1, 575, 103025, 1-790; 100, OGG1, 578, 103028, 1-668; 100, OGG1, 579, 103029, 1-505; 100, OGG1, 580, 103030, 205-363; 100, OGG1, 581, 103031, 1-386; 100, OGG1, 582, 103032, 1-396; 100, OGG1, 570, 103020, 344-1417; 100, OGG1, 571, 103021, 215-1285; 100, OGG1, 572, 103022, 344-1576; 100, OGG1, 573, 103023, 344-1618; 100, OGG1, 574, 103024, 344-1381; 100, OGG1, 576, 103026, 307-1281; 100, OGG1, 577, 103027, 201-788; 100, OGG1, 583, 103033, 216-1184; 101, AKAP1, 588, 103038, 121-532; 101, AKAP1, 589, 103039, 1-418; 101, AKAP1, 590, 103040, 1-614; 101, AKAP1, 591, 103041, 548-568; 101, AKAP1, 592, 103042, 163-710; 101, AKAP1, 593, 103043, 92-650; 101, AKAP1, 596, 103046, 304-588; 101, AKAP1, 597, 103047, 317-565; 101, AKAP1, 598, 103048, 344-484; 101, AKAP1, 599, 103049, 1-540; 101, AKAP1, 600, 103050, 556-578; 101, AKAP1, 601, 103051, 1-1083; 101, AKAP1, 584, 103034, 63-1844; 101, AKAP1, 585, 103035, 234-2945; 101, AKAP1, 586, 103036, 253-2034; 101, AKAP1, 587, 103037, 211-2922; 101, AKAP1, 594, 103044, 141-2852; 101, AKAP1, 595, 103045, 343-3054; 101, AKAP1, 602, 103052, 556-3267;

102, AKAP10, 604, 103054, 1-1815; 102, AKAP10, 605, 103055, 150-565; 102, AKAP10, 606, 103056, 150-350; 102, AKAP10, 607, 103057, 150-341; 102, AKAP10, 608, 103058, 1-236; 102, AKAP10, 609, 103059, 150-602; 102, AKAP10, 610, 103060, 1-179; 102, AKAP10, 611, 103061, 1-94; 102, AKAP10, 603, 103053, 159-2147; 103, AKAP11, 612, 103062, 176-5881; 104, AKAP12, 613, 103063, 190-5538; 104, AKAP12, 614, 103064, 174-5228; 104, AKAP12, 615, 103065, 98-5131; 104, AKAP12, 616, 103066, 241-5589; 105, AKAP13, 618, 103068, 143-4447; 105, AKAP13, 620, 103070, 280-558; 105, AKAP13, 621, 103071, 9-447; 105, AKAP13, 622, 103072, 1-827; 105, AKAP13, 623, 103073, 209-322; 105, AKAP13, 625, 103075, 224-5459; 105, AKAP13, 626, 103076, 1-4290; 105, AKAP13, 627, 103077, 162-660; 105, AKAP13, 628, 103078, 397-3297; 105, AKAP13, 629, 103079, 227-425; 105, AKAP13, 630, 103080, 258-553; 105, AKAP13, 617, 103067, 82-8535; 105, AKAP13, 619, 103069, 96-8537; 105, AKAP13, 624, 103074, 171-710; 106, AKAP14, 631, 103081, 86-499; 106, AKAP14, 632, 103082, 86-355; 106, AKAP14, 633, 103083, 275-688; 106, AKAP14, 634, 103084, 275-868; 107, AKAP17A, 636, 103086, 165-1505; 107, AKAP17A, 635, 103085, 197-2284; 107, AKAP17A, 637, 103087, 167-1324; 108, AKAP2, 641, 103091, 185-2520; 108, AKAP2, 642, 103092, 3-167; 108, AKAP2, 638, 103088, 208-2787; 108, AKAP2, 639, 103089, 5-2851; 108, AKAP2, 640, 103090, 103-2988; 109, AKAP3, 644, 103094, 239-528; 109, AKAP3, 646, 103096, 147-631; 109, AKAP3, 643, 103093, 548-3109; 109, AKAP3, 645, 103095, 526-3087; 110, AKAP4, 649, 103099, 144-783; 110, AKAP4, 650, 103100, 130-892; 110, AKAP4, 647, 103097, 125-2689; 110, AKAP4, 648, 103098, 144-2681; 111, AKAP5, 651, 103101, 1289-2572; 111, AKAP5, 652, 103102, 379-1662; 112, AKAP6, 655, 103105, 239-562; 112, AKAP6, 656, 103106, 1205-2274; 112, AKAP6, 657, 103107, 507-582; 112, AKAP6, 658, 103108, 44-3781; 112, AKAP6, 659, 103109, 1-356; 112, AKAP6, 660, 103110, 736-876; 112, AKAP6, 653, 103103, 171-7130; 112, AKAP6, 654, 103104, 100-3327; 113, AKAP7, 661, 103111, 175-429; 113, AKAP7, 665, 103115, 28-1080; 113, AKAP7, 666, 103116, 1-155; 113, AKAP7, 667, 103117, 163-426; 113, AKAP7, 662, 103112, 410-655; 113, AKAP7, 664, 103114, 139-453; 113, AKAP7, 663, 103113, 99-1145; 114, AKAP8, 669, 103119, 68-469; 114, AKAP8, 670, 103120, 1-535; 114, AKAP8, 668, 103118, 62-2140; 115, AKAP8L, 672, 103122, 66-553; 115, AKAP8L, 673, 103123, 199-399; 115, AKAP8L, 674, 103124, 66-548; 115, AKAP8L, 676, 103126, 98-235; 115, AKAP8L, 677, 103127, 257-583; 115, AKAP8L, 678, 103128, 66-1361; 115, AKAP8L, 671, 103121, 132-2072; 115, AKAP8L, 675, 103125, 104-1861; 116, AKAP9, 680, 103130, 1-9381; 116, AKAP9, 681, 103131, 1-11733; 116, AKAP9, 682, 103132, 1-5310; 116, AKAP9, 683, 103133, 175-1119; 116, AKAP9, 684, 103134, 1-696; 116, AKAP9, 685, 103135, 1-956; 116, AKAP9, 686, 103136, 185-5098; 116, AKAP9, 679, 103129, 234-11957; 117, AKIP1, 692, 103142, 1-456; 117, AKIP1, 693, 103143, 259-846; 117, AKIP1, 694, 103144, 262-768; 117, AKIP1, 695, 103145, 32-569; 117, AKIP1, 696, 103146, 32-538; 117, AKIP1, 697, 103147, 167-469; 117, AKIP1, 687, 103137, 92-643; 117, AKIP1, 688, 103138, 91-723; 117, AKIP1, 689, 103139, 77-628; 117, AKIP1, 690, 103140, 113-664; 117, AKIP1, 691, 103141, 8-640; 118, AAR2, 700, 103150, 94-1290; 118, AAR2, 698, 103148, 88-1242; 118, AAR2, 699, 103149, 347-1501; 119, ADCK1, 703, 103153, 63-719; 119, ADCK1, 704, 103154, 66-434; 119, ADCK1, 705, 103155, 48-844; 119, ADCK1, 701, 103151, 100-1671; 119, ADCK1, 702, 103152, 44-1411; 120, ADCK2, 707, 103157, 1-1411; 120, ADCK2, 708, 103158, 1-672; 120, ADCK2, 709, 103159, 179-1951; 120, ADCK2, 710, 103160, 176-1399; 120, ADCK2, 706, 103156, 179-2059; 121, ADCK3, 711, 103161, 122-2065; 121, ADCK3, 712, 103162, 149-1936; 121, ADCK3, 713, 103163, 2772-4715; 122, ADCK4, 716, 103166, 39-486; 122, ADCK4, 717, 103167, 255-867; 122, ADCK4, 718, 103168, 46-735; 122, ADCK4, 719, 103169, 53-400; 122, ADCK4, 720, 103170, 4-406; 122, ADCK4, 721, 103171, 154-399; 122, ADCK4, 722, 103172, 296-325; 122, ADCK4, 723, 103173, 43-373; 122, ADCK4, 724, 103174, 31-394; 122, ADCK4, 725, 103175, 254-473; 122, ADCK4, 726, 103176, 122-594; 122, ADCK4, 714, 103164, 25-1536; 122, ADCK4, 715, 103165, 303-1937; 123, ADCK5, 728, 103178, 51-440; 123, ADCK5, 729, 103179, 21-368; 123, ADCK5, 730, 103180, 55-318; 123, ADCK5, 727, 103177, 45-1787; 124, AHI1, 733, 103183, 1-2006; 124, AHI1, 737, 103187, 269-433; 124, AHI1, 738, 103188, 210-1074; 124, AHI1, 739, 103189, 1-88; 124, AHI1, 740, 103190, 1-389; 124, AHI1, 741, 103191, 1-1627; 124, AHI1, 742, 103192, 142-288; 124, AHI1, 743, 103193, 383-529; 124, AHI1, 731, 103181, 396-3986; 124, AHI1, 732, 103182, 280-3441; 124, AHI1, 734, 103184, 218-3808; 124, AHI1, 735, 103185, 300-3890; 124, AHI1, 736, 103186, 275-2104; 125, ABHD14A-ACY1, 744, 103194, 87-590; 125, ABHD14A-ACY1, 745, 103195, 87-590; 125, ABHD14A-ACY1, 746, 103196, 77-1606; 126, ABHD1, 748, 103198, 142-450; 126, ABHD1, 749, 103199, 138-668; 126, ABHD1, 747, 103197, 115-1332; 126, ABHD1, 750, 103200, 127-1044; 126, ABHD1, 751, 103201, 161-1078; 127, ABHD10, 753, 103203, 11-169; 127, ABHD10, 754, 103204, 53-280; 127, ABHD10, 752, 103202, 28-948; 127, ABHD10, 755, 103205, 10-627; 128, ABHD11, 758, 103208, 1-554; 128, ABHD11, 760, 103210, 27-506; 128, ABHD11, 761, 103211, 1-370; 128, ABHD11, 763, 103213, 1-264; 128, ABHD11, 756, 103206, 71-1018; 128, ABHD11, 757, 103207, 36-812; 128, ABHD11, 759, 103209, 56-361; 128, ABHD11, 762, 103212, 56-982; 129, ABHD12, 766, 103216, 55-615; 129, ABHD12, 767, 103217, 1-585; 129, ABHD12, 768, 103218, 1-40; 129, ABHD12, 769, 103219, 336-814; 129, ABHD12, 770, 103220, 51-407; 129, ABHD12, 771, 103221, 490-805; 129, ABHD12, 764, 103214, 274-1470; 129, ABHD12, 765, 103215, 281-1495; 130, ABHD12B, 772, 103222, 16-1104; 130, ABHD12B, 773, 103223, 16-873; 130, ABHD12B, 774, 103224, 16-198; 130, ABHD12B, 775, 103225, 16-198; 131, ABHD13, 776, 103226, 302-1315; 132, ABHD14A, 778, 103228, 243-932; 132, ABHD14A, 779, 103229, 129-802; 132, ABHD14A, 780, 103230, 34-408; 132, ABHD14A, 781, 103231, 169-626; 132, ABHD14A, 777, 103227, 69-884; 133, ABHD14B, 782, 103232, 695-1321; 133, ABHD14B, 785, 103235, 86-652; 133, ABHD14B, 783, 103233, 131-763; 133, ABHD14B, 784, 103234, 290-922; 133, ABHD14B, 786, 103236, 508-1140; 133, ABHD14B, 787, 103237, 195-827; 134, ABHD15, 788, 103238, 172-1578; 135, ABHD16A, 790, 103240, 99-889; 135, ABHD16A, 791, 103241, 7-1812; 135, ABHD16A, 792, 103242, 99-889; 135, ABHD16A, 793, 103243, 99-889; 135, ABHD16A, 795, 103245, 99-889; 135, ABHD16A, 796, 103246, 7-1812; 135, ABHD16A, 797, 103247, 7-1812; 135, ABHD16A, 798, 103248, 99-889; 135, ABHD16A, 799, 103249, 7-1812; 135, ABHD16A, 801, 103251, 99-889; 135, ABHD16A, 802, 103252, 7-1812; 135, ABHD16A, 803, 103253, 217-414; 135, ABHD16A, 804, 103254, 60-257; 135, ABHD16A, 805, 103255, 20-160; 135, ABHD16A, 806, 103256, 31-228; 135, ABHD16A, 807, 103257, 306-503; 135, ABHD16A, 808, 103258, 76-216; 135, ABHD16A, 789, 103239, 164-1840; 135, ABHD16A, 794, 103244, 136-1812; 135, ABHD16A, 800, 103250, 303-1880; 135, ABHD16A, 809, 103259, 306-1883; 135, ABHD16A, 810, 103260, 306-1883; 135, ABHD16A, 811, 103261, 306-1883; 135, ABHD16A, 812, 103262, 306-1883; 135, ABHD16A, 813, 103263, 306-1883; 135, ABHD16A, 814, 103264, 306-1883; 136, ABHD16B, 815, 103265, 44-1453; 137, ABHD17A, 818, 103268, 1-119; 137, ABHD17A, 819, 103269, 20-697; 137, ABHD17A, 816, 103266, 321-1406; 137, ABHD17A, 817, 103267, 435-1367; 138, ABHD17B, 820, 103270, 113-979; 138, ABHD17B, 821, 103271, 302-1183; 139, ABHD17C, 824, 103274, 194-478; 139, ABHD17C, 822, 103272, 128-1117; 139, ABHD17C, 823, 103273, 120-1007; 140, ABHD18, 825, 103275, 404-1552; 140, ABHD18, 828, 103278, 254-569; 140, ABHD18, 829, 103279, 310-507; 140, ABHD18, 826, 103276, 319-1563; 140, ABHD18, 827, 103277, 248-1492; 140, ABHD18, 830, 103280, 399-1364; 141, ABHD2, 833, 103283, 476-845; 141, ABHD2, 834, 103284, 391-557; 141, ABHD2, 836, 103286, 165-558; 141, ABHD2, 831, 103281, 521-1798; 141, ABHD2, 832, 103282, 474-1751; 141, ABHD2, 835, 103285, 742-2019; 142, ABHD3, 838, 103288, 942-1586; 142, ABHD3, 839, 103289, 103-1173; 142, ABHD3, 841, 103291, 1-337; 142, ABHD3, 842, 103292, 1-113; 142, ABHD3, 837, 103287, 141-1370; 142, ABHD3, 840, 103290, 110-520; 143, ABHD4, 843, 103293, 8-457; 143, ABHD4, 846, 103296, 195-465; 143, ABHD4, 847, 103297, 1-163; 143, ABHD4, 848, 103298, 18-275; 143, ABHD4, 849, 103299, 53-185; 143, ABHD4, 844, 103294, 4-549; 143, ABHD4, 845, 103295, 71-1099; 144, ABHD5, 850, 103300, 43-177; 144, ABHD5, 852, 103302, 497-876; 144, ABHD5, 853, 103303, 1-468; 144, ABHD5, 854, 103304, 330-464; 144, ABHD5, 851, 103301, 124-1173; 145, ABHD6, 856, 103306, 96-251; 145, ABHD6, 857, 103307, 249-768; 145, ABHD6, 859, 103309, 247-921; 145, ABHD6, 860, 103310, 411-1367; 145, ABHD6, 855, 103305, 411-1424; 145, ABHD6, 858, 103308, 502-1515; 146, ABHD8, 862, 103312, 31-555; 146, ABHD8, 863, 103313, 180-570; 146, ABHD8, 861, 103311, 241-1560; 147, ABI3, 866, 103316, 1-574; 147, ABI3, 867, 103317, 1-481; 147, ABI3, 864, 103314, 499-1599; 147, ABI3, 865, 103315, 315-1397; 148, ABI3BP, 869, 103319, 1-251; 148, ABI3BP, 870, 103320, 1-561; 148, ABI3BP, 871, 103321, 1-922; 148, ABI3BP, 872, 103322, 1-560; 148, ABI3BP, 873, 103323, 1-560; 148, ABI3BP, 874, 103324, 1-475; 148, ABI3BP, 875, 103325, 1-3395; 148, ABI3BP, 876, 103326, 1-700; 148, ABI3BP, 877, 103327, 111-5444; 148, ABI3BP, 878, 103328, 1-566; 148, ABI3BP, 879, 103329, 1-453; 148, ABI3BP, 880, 103330, 1-375; 148, ABI3BP, 881, 103331, 1-563; 148, ABI3BP, 882, 103332, 49-3066; 148, ABI3BP, 883, 103333, 17-199; 148, ABI3BP, 884, 103334, 1-261; 148, ABI3BP, 885, 103335, 1-573; 148, ABI3BP, 886, 103336, 1-561; 148, ABI3BP, 887, 103337, 88-571; 148, ABI3BP, 888, 103338, 1-910; 148, ABI3BP, 889, 103339, 1-450; 148, ABI3BP, 868, 103318, 111-3338; 149, ABL1, 892, 103342, 341-532; 149, ABL1, 890, 103340, 382-3774; 149, ABL1, 891, 103341, 375-3824; 150, ABL2, 893, 103343, 46-3240; 150, ABL2, 894, 103344, 1-3486; 150, ABL2, 895, 103345, 288-1916; 150, ABL2, 896, 103346, 1-3177; 150, ABL2, 897, 103347, 13-3516; 150, ABL2, 898, 103348, 1-3240; 150, ABL2, 899, 103349, 1-3132; 150, ABL2, 900, 103350, 205-3753; 151, ABI1, 908, 103358, 111-1538; 151, ABI1, 911, 103361, 225-1406; 151, ABI1, 901, 103351, 225-1715; 151, ABI1, 902, 103352, 73-1515; 151, ABI1, 903, 103353, 225-1493; 151, ABI1, 904, 103354, 168-1526; 151, ABI1, 905, 103355, 109-1539; 151, ABI1, 906, 103356, 1-1446; 151, ABI1, 907, 103357, 73-1599; 151, ABI1, 909, 103359, 124-1464; 151, ABI1, 910, 103360, 30-1385; 151, ABI1, 912, 103362, 225-1214; 152, ABI2, 913, 103363, 642-1814; 152, ABI2, 915, 103365, 277-1818; 152, ABI2, 916, 103366, 297-1838; 152, ABI2, 917, 103367, 121-1644; 152, ABI2, 918, 103368, 32-1474; 152, ABI2, 919, 103369, 234-461; 152, ABI2, 920, 103370, 111-245; 152, ABI2, 921, 103371, 122-301; 152, ABI2, 922, 103372, 1-881; 152, ABI2, 923, 103373, 121-282; 152, ABI2, 924, 103374, 125-388; 152, ABI2, 925, 103375, 117-443; 152, ABI2, 926, 103376, 124-1500; 152, ABI2, 927, 103377, 1-131; 152, ABI2, 928, 103378, 1-603; 152, ABI2, 929, 103379, 109-1567; 152, ABI2, 914, 103364, 236-1663; 153, ASPM, 931, 103381, 127-3555; 153, ASPM, 933, 103383, 258-4427; 153, ASPM, 930, 103380, 258-5936; 153, ASPM, 932, 103382, 258-10691; 154, ABO, 934, 103384, 26-1147; 154, ABO, 935, 103385, 26-1087; 155, ABRACL, 937, 103387, 41-244; 155, ABRACL, 936, 103386, 201-446; 156, AIM1, 939, 103389, 85-1032; 156, AIM1, 940, 103390, 102-6497; 156, AIM1, 938, 103388, 488-5659; 157, AIM1L, 942, 103392, 117-1175; 157, AIM1L, 943, 103393, 1-886; 157, AIM1L, 944, 103394, 151-1548; 157, AIM1L, 945, 103395, 51-2414; 157, AIM1L, 941, 103391, 151-5136; 158, AIM2, 946, 103396, 94-594; 158, AIM2, 948, 103398, 244-1311; 158, AIM2, 947, 103397, 290-1321; 159, N/A, 949, 103399, 174-1166; 160, N/A, 950, 103400, 98-377; 161, N/A, 951, 103401, 120-287; 162, N/A, 952, 103402, 1-254; 162, N/A, 953, 103403, 1-254; 163, N/A, 954, 103404, 151-456; 164, N/A, 955, 103405, 217-536; 164, N/A, 956, 103406, 93-630; 165, N/A, 957, 103407, 234-413; 165, N/A, 958, 103408, 199-375; 166, N/A, 959, 103409, 168-612; 167, N/A, 960, 103410, 1-218; 168, N/A, 961, 103411, 195-593; 169, N/A, 962, 103412, 1-375; 170, N/A, 963, 103413, 158-1342; 171, N/A, 964, 103414, 92-553; 172, N/A, 965, 103415, 142-1737; 173, N/A, 966, 103416, 1-375; 174, N/A, 967, 103417, 1-189; 175, N/A, 968, 103418, 1-189; 176, N/A, 969, 103419, 1-954; 177, N/A, 970, 103420, 1-273; 178, N/A, 971, 103421, 1-39; 179, N/A, 972, 103422, 10-258; 180, N/A, 973, 103423, 28-105; 181, N/A, 974, 103424, 1-84; 182, N/A, 975, 103425, 37-207; 183, N/A, 976, 103426, 1-375; 184, N/A, 977, 103427, 13-411; 185, N/A, 978, 103428, 28-105; 186, N/A, 979, 103429, 1-120; 187, N/A, 980, 103430, 1-366; 188, N/A, 981, 103431, 1-366; 189, N/A, 982, 103432, 134-634; 190, N/A, 983, 103433, 227-543; 191, N/A, 984, 103434, 598-921; 192, N/A, 985, 103435, 580-1173; 192, N/A, 986, 103436, 1-148; 193, N/A, 987, 103437, 1-375; 194, N/A, 988, 103438, 428-1714; 195, N/A, 989, 103439, 205-2007; 195, N/A, 990, 103440, 114-1592; 196, N/A, 991, 103441, 153-815; 197, N/A, 992, 103442, 1-228; 198, N/A, 993, 103443, 1-78; 199, N/A, 994, 103444, 124-696; 200, N/A, 995, 103445, 577-987; 201, N/A, 996, 103446, 2251-2772; 202, N/A, 997, 103447, 1-48; 203, N/A, 998, 103448, 1-69; 204, N/A, 999, 103449, 1-384; 205, N/A, 1000, 103450, 1-93; 206, N/A, 1001, 103451, 1-375; 207, N/A, 1002, 103452, 1-72; 208, N/A, 1003, 103453, 1-375; 209, N/A, 1004, 103454, 1-381; 210, N/A, 1005, 103455, 1-381; 211, N/A, 1006, 103456, 1-537; 212, N/A, 1007, 103457, 1-78; 213, N/A, 1008, 103458, 117-610; 214, N/A, 1009, 103459, 129-1208; 215, N/A, 1010, 103460, 1-369; 216, N/A, 1011, 103461, 550-990; 217, N/A, 1012, 103462, 1-384; 218, N/A, 1013, 103463, 1-384; 219, N/A, 1014, 103464, 1-945; 220, N/A, 1015, 103465, 1-1668; 221, N/A, 1016, 103466, 1-99; 222, N/A, 1017, 103467, 1-69; 223, N/A, 1018, 103468, 77-439; 224, N/A, 1019, 103469, 1-375; 225, N/A, 1020, 103470, 504-788; 226, N/A, 1021, 103471, 117-530; 227, N/A, 1022, 103472, 377-515; 228, N/A, 1023, 103473, 1-66; 229, N/A, 1024, 103474, 97-459; 230, N/A, 1025, 103475, 51-176; 231, N/A, 1026, 103476, 13-408; 232, N/A, 1027, 103477, 1-48; 233, N/A, 1028, 103478, 121-578; 233, N/A, 1029, 103479, 76-277; 234, N/A, 1030, 103480, 1-397; 234, N/A, 1031, 103481, 1-321; 234, N/A, 1032, 103482, 1-398; 234, N/A, 1033, 103483, 1-171; 235, N/A, 1034, 103484, 97-459; 236, N/A, 1035, 103485, 28-105; 237, N/A, 1036, 103486, 13-411; 238, N/A, 1037, 103487, 57-641; 238, N/A, 1038, 103488, 57-476; 239, N/A, 1039, 103489, 57-641; 239, N/A, 1040, 103490, 57-476; 240, N/A, 1041, 103491, 57-641; 240, N/A, 1042, 103492, 57-476; 241, N/A, 1043, 103493, 57-641; 241, N/A, 1044, 103494, 57-476; 242, N/A, 1045, 103495, 57-641; 242, N/A, 1046, 103496, 57-476; 243, N/A, 1047, 103497, 57-641; 243, N/A, 1048, 103498, 57-476; 244, N/A, 1049, 103499, 1-42; 245, N/A, 1050, 103500, 197-646; 246, N/A, 1051, 103501, 1-48; 247, N/A, 1052, 103502, 1-282; 247, N/A, 1053, 103503, 1-200; 248, N/A, 1054, 103504, 1-375; 249, N/A, 1055, 103505, 1149-1514; 250, N/A, 1056, 103506, 1-228; 251, N/A, 1057, 103507, 72-878; 251, N/A, 1058, 103508, 125-673; 251, N/A, 1059, 103509, 1-318; 251, N/A, 1060, 103510, 19-732; 251, N/A, 1061, 103511, 1-675; 251, N/A, 1062, 103512, 60-233; 251, N/A, 1063, 103513, 1-411; 252, N/A, 1064, 103514, 1-75; 253, N/A, 1065, 103515, 1-264; 254, N/A, 1066, 103516, 1-381; 255, N/A, 1067, 103517, 1-48; 256, N/A, 1068, 103518, 131-1786; 256, N/A, 1069, 103519, 42-1697; 257, N/A, 1070, 103520, 1-72; 258, N/A, 1071, 103521, 1-45; 259, N/A, 1072, 103522, 1-192; 260, N/A, 1073, 103523, 275-430; 261, N/A, 1074, 103524, 1-501; 262, N/A, 1075, 103525, 1-54; 263, N/A, 1076, 103526, 1-375; 264, N/A, 1077, 103527, 1-81; 265, N/A, 1078, 103528, 428-1714; 266, N/A, 1079, 103529, 1-63; 267, N/A, 1080, 103530, 1-54; 268, N/A, 1081, 103531, 80-445; 268, N/A, 1082, 103532, 1-506; 268, N/A, 1083, 103533, 1-431; 269, N/A, 1084, 103534, 1-231; 270, N/A, 1085, 103535, 1-375; 271, N/A, 1086, 103536, 119-676; 272, N/A, 1087, 103537, 1-63; 273, N/A, 1088, 103538, 103-977; 273, N/A, 1089, 103539, 84-482; 273, N/A, 1090, 103540, 1-424; 274, N/A, 1091, 103541, 58-690; 275, N/A, 1092, 103542, 1-375; 276, N/A, 1093, 103543, 1-33; 277, N/A, 1094, 103544, 1-51; 278, N/A, 1095, 103545, 1-51; 279, N/A, 1096, 103546, 82-369; 279, N/A, 1097, 103547, 1-387; 280, N/A, 1098, 103548, 1-375; 281, N/A, 1099, 103549, 1-922; 282, N/A, 1100, 103550, 1-66; 283, N/A, 1101, 103551, 1119-1229; 284, N/A, 1102, 103552, 70-750; 285, N/A, 1103, 103553, 1-48; 286, N/A, 1104, 103554, 1-123; 287, N/A, 1105, 103555, 1-48; 288, N/A, 1106, 103556, 1-381; 289, N/A, 1107, 103557, 1-189; 290, N/A, 1108, 103558, 1-183; 291, N/A, 1109, 103559, 1-45; 292, N/A, 1110, 103560, 1-648; 293, N/A, 1111, 103561, 1-63; 294, N/A, 1112, 103562, 84-1880; 295, N/A, 1113, 103563, 1-96; 296, N/A, 1114, 103564, 1-57; 297, N/A, 1115, 103565, 1-63; 298, N/A, 1116, 103566, 1-63; 299, N/A, 1117, 103567, 751-1275; 300, N/A, 1118, 103568, 1-171; 301, N/A, 1119, 103569, 28-105; 302, N/A, 1120, 103570, 210-533; 303, N/A, 1121, 103571, 1-51; 304, N/A, 1122, 103572, 1-78; 305, N/A, 1123, 103573, 88-228; 306, N/A, 1124, 103574, 1-48; 307, N/A, 1125, 103575, 1-921; 308, N/A, 1126, 103576, 282-1850; 308, N/A, 1127, 103577, 106-475; 309, N/A, 1128, 103578, 2221-2577; 310, N/A, 1129, 103579, 1-60; 311, N/A, 1130, 103580, 1-903; 312, N/A, 1131, 103581, 1-906; 313, N/A, 1132, 103582, 1-411; 314, N/A, 1133, 103583, 1-411; 315, N/A, 1134, 103584, 51-257; 316, N/A, 1135, 103585, 1-963; 316, N/A, 1136, 103586, 1-342; 316, N/A, 1137, 103587, 1-342; 316, N/A, 1138, 103588, 1-963; 317, N/A, 1139, 103589, 1-48; 318, N/A, 1140, 103590, 1-84; 319, N/A, 1141, 103591, 1-375; 320, N/A, 1142, 103592, 1-60; 321, N/A, 1143, 103593, 1-483; 322, N/A, 1144, 103594, 1-129; 323, N/A, 1145, 103595, 1-375; 324, N/A, 1146, 103596, 298-1044; 325, N/A, 1147, 103597, 1-690; 326, N/A, 1148, 103598, 1-375; 327, N/A, 1149, 103599, 42-825; 328, N/A, 1150, 103600, 1-375; 329, N/A, 1151, 103601, 1-108; 330, N/A, 1152, 103602, 811-1089; 331, N/A, 1153, 103603, 1-90; 332, N/A, 1154, 103604, 1-468; 333, N/A, 1155, 103605, 1-291; 334, N/A, 1156, 103606, 1-258; 335, N/A, 1157, 103607, 1-417; 336, N/A, 1158, 103608, 1-96; 337, N/A, 1159, 103609, 319-720; 338, N/A, 1160, 103610, 1018-1614; 339, N/A, 1161, 103611, 1-171; 340, N/A, 1162, 103612, 31-339; 341, N/A, 1163, 103613, 368-2113; 341, N/A, 1164, 103614, 372-1517; 342, N/A, 1165, 103615, 1-600; 343, N/A, 1166, 103616, 32-406; 344, N/A, 1167, 103617, 279-2183; 344, N/A, 1168, 103618, 173-1732; 345, N/A, 1169, 103619, 1-336; 345, N/A, 1170, 103620, 1-225; 346, N/A, 1171, 103621, 1-285; 347, N/A, 1172, 103622, 1-72; 348, N/A, 1173, 103623, 1-462; 348, N/A, 1174, 103624, 412-1521; 348, N/A, 1175, 103625, 1-812; 348, N/A, 1176, 103626, 1-345; 348, N/A, 1177, 103627, 1-699; 349, N/A, 1178, 103628, 1-288; 350, N/A, 1179, 103629, 1-75; 351, N/A, 1180, 103630, 73-462; 352, N/A, 1181, 103631, 473-604; 353, N/A, 1182, 103632, 1-951; 354, N/A, 1183, 103633, 99-1040; 355, CYP2D6, 1184, 103634, 91-1584; 355, CYP2D6, 1185, 103635, 91-1431; 356, N/A, 1186, 103636, 157-687; 357, N/A, 1187, 103637, 1-252; 358, N/A, 1188, 103638, 1-351; 359, N/A, 1189, 103639, 1-294; 360, N/A, 1190, 103640, 1-303; 361, N/A, 1191, 103641, 1-303; 362, N/A, 1192, 103642, 91-1431; 362, N/A, 1193, 103643, 91-1584; 363, N/A, 1194, 103644, 174-1073; 363, N/A, 1195, 103645, 72-2090; 363, N/A, 1196, 103646, 174-2546; 363, N/A, 1197, 103647, 402-2213; 364, N/A, 1198, 103648, 41-847; 365, N/A, 1199, 103649, 41-847; 366, N/A, 1200, 103650, 1-75; 367, N/A, 1201, 103651, 622-1425; 368, N/A, 1202, 103652, 76-570; 369, N/A, 1203, 103653, 1-399; 370, N/A, 1204, 103654, 1-375; 371, N/A, 1205, 103655, 1-288; 371, N/A, 1206, 103656, 1-306; 372, N/A, 1207, 103657, 41-847; 373, N/A, 1208, 103658, 373-1083; 374, N/A, 1209, 103659, 91-1584; 374, N/A, 1210, 103660, 1-1335; 375, N/A, 1211, 103661, 1-1338; 375, N/A, 1212, 103662, 91-1584; 375, N/A, 1213, 103663, 1-1491; 376, N/A, 1214, 103664, 91-1584; 376, N/A, 1215, 103665, 91-1431; 377, N/A, 1216, 103666, 146-949; 378, N/A, 1217, 103667, 1-1335; 378, N/A, 1218, 103668, 91-1584; 379, AACS, 1220, 103670, 152-808; 379, AACS, 1219, 103669, 207-2225; 380, ACHE, 1223, 103673, 2-1213; 380, ACHE, 1225, 103675, 110-585; 380, ACHE, 1226, 103676, 2-1194; 380, ACHE, 1227, 103677, 2-1305; 380, ACHE, 1228, 103678, 70-153; 380, ACHE, 1231, 103681, 2-1081; 380, ACHE, 1233, 103683, 2-169; 380, ACHE, 1221, 103671, 108-1952; 380, ACHE, 1222, 103672, 140-1993; 380, ACHE, 1224, 103674, 157-2001; 380, ACHE, 1229, 103679, 106-1686; 380, ACHE, 1230, 103680, 84-1937; 380, ACHE, 1232, 103682, 95-1939; 381, ACAT1, 1236, 103686, 330-493; 381, ACAT1, 1237, 103687, 24-449; 381, ACAT1, 1238, 103688, 1-409; 381, ACAT1, 1234, 103684, 92-1375; 381, ACAT1, 1235, 103685, 41-529; 382, ACAT2, 1239, 103689, 1761-2954; 383, ACAA1, 1242, 103692, 62-427; 383, ACAA1, 1243, 103693, 1-713; 383, ACAA1, 1244, 103694, 91-1242; 383, ACAA1, 1245, 103695, 103-444; 383, ACAA1, 1246, 103696, 1-869; 383, ACAA1, 1247, 103697, 58-399; 383, ACAA1, 1248, 103698, 38-403; 383, ACAA1, 1249, 103699, 208-669; 383, ACAA1, 1250, 103700, 208-549; 383, ACAA1, 1251, 103701, 208-573; 383, ACAA1, 1240, 103690, 208-1203; 383, ACAA1, 1241, 103691, 174-1448; 384, ACAA2, 1253, 103703, 356-727;

384, ACAA2, 1254, 103704, 286-538; 384, ACAA2, 1255, 103705, 131-1315; 384, ACAA2, 1256, 103706, 468-1496; 384, ACAA2, 1257, 103707, 422-639; 384, ACAA2, 1252, 103702, 477-1670; 385, ACACA, 1258, 103708, 1267-1626; 385, ACACA, 1261, 103711, 483-827; 385, ACACA, 1262, 103712, 537-662; 385, ACACA, 1265, 103715, 1-157; 385, ACACA, 1266, 103716, 482-826; 385, ACACA, 1267, 103717, 1-290; 385, ACACA, 1270, 103720, 374-718; 385, ACACA, 1273, 103723, 269-551; 385, ACACA, 1274, 103724, 1-339; 385, ACACA, 1275, 103725, 1-2997; 385, ACACA, 1276, 103726, 200-451; 385, ACACA, 1277, 103727, 1268-1627; 385, ACACA, 1278, 103728, 375-719; 385, ACACA, 1279, 103729, 269-551; 385, ACACA, 1280, 103730, 1-290; 385, ACACA, 1281, 103731, 200-451; 385, ACACA, 1282, 103732, 537-662; 385, ACACA, 1283, 103733, 1-157; 385, ACACA, 1284, 103734, 1-339; 385, ACACA, 1285, 103735, 1-2997; 385, ACACA, 1259, 103709, 192-7232; 385, ACACA, 1260, 103710, 483-7634; 385, ACACA, 1263, 103713, 436-7302; 385, ACACA, 1264, 103714, 607-7413; 385, ACACA, 1268, 103718, 436-7302; 385, ACACA, 1269, 103719, 607-7413; 385, ACACA, 1271, 103721, 482-7633; 385, ACACA, 1272, 103722, 192-7232; 386, ACACB, 1288, 103738, 4012-6588; 386, ACACB, 1289, 103739, 1-2578; 386, ACACB, 1290, 103740, 154-583; 386, ACACB, 1291, 103741, 213-678; 386, ACACB, 1292, 103742, 1-338; 386, ACACB, 1286, 103736, 120-7496; 386, ACACB, 1287, 103737, 10-7386; 387, ASMT, 1296, 103746, 1-375; 387, ASMT, 1293, 103743, 37-1074; 387, ASMT, 1294, 103744, 26-922; 387, ASMT, 1295, 103745, 200-1321; 388, ASMTL, 1297, 103747, 34-1899; 388, ASMTL, 1298, 103748, 90-1907; 388, ASMTL, 1299, 103749, 227-1918; 389, ASCL1, 1300, 103750, 560-1270; 390, ASCL2, 1301, 103751, 621-1202; 391, ASCL3, 1302, 103752, 51-596; 392, ASCL4, 1303, 103753, 832-1353; 393, ASCL5, 1305, 103755, 607-1227; 393, ASCL5, 1304, 103754, 1-621; 394, AAAS, 1308, 103758, 355-1623; 394, AAAS, 1309, 103759, 117-949; 394, AAAS, 1310, 103760, 1-1075; 394, AAAS, 1306, 103756, 167-1807; 394, AAAS, 1307, 103757, 132-1673; 395, ACP1, 1313, 103763, 47-187; 395, ACP1, 1314, 103764, 40-252; 395, ACP1, 1316, 103766, 66-206; 395, ACP1, 1317, 103767, 50-307; 395, ACP1, 1318, 103768, 73-315; 395, ACP1, 1319, 103769, 1-213; 395, ACP1, 1311, 103761, 94-570; 395, ACP1, 1312, 103762, 97-573; 395, ACP1, 1315, 103765, 66-404; 396, ACP2, 1321, 103771, 31-1206; 396, ACP2, 1322, 103772, 115-1302; 396, ACP2, 1323, 103773, 26-508; 396, ACP2, 1324, 103774, 17-505; 396, ACP2, 1325, 103775, 26-481; 396, ACP2, 1326, 103776, 52-967; 396, ACP2, 1327, 103777, 14-1096; 396, ACP2, 1320, 103770, 118-1389; 397, ACP5, 1331, 103781, 424-581; 397, ACP5, 1332, 103782, 211-583; 397, ACP5, 1333, 103783, 787-803; 397, ACP5, 1334, 103784, 41-220; 397, ACP5, 1335, 103785, 149-372; 397, ACP5, 1328, 103778, 303-1280; 397, ACP5, 1329, 103779, 231-1208; 397, ACP5, 1330, 103780, 150-1127; 397, ACP5, 1336, 103786, 404-1381; 398, ACP6, 1337, 103787, 231-917; 398, ACP6, 1338, 103788, 449-1735; 398, ACP6, 1339, 103789, 1-473; 398, ACP6, 1340, 103790, 115-543; 398, ACP6, 1341, 103791, 232-465; 398, ACP6, 1343, 103793, 1-499; 398, ACP6, 1342, 103792, 1-816; 399, ACPP, 1347, 103797, 89-584; 399, ACPP, 1348, 103798, 1-299; 399, ACPP, 1344, 103794, 51-1307; 399, ACPP, 1345, 103795, 91-1251; 399, ACPP, 1346, 103796, 52-1113; 400, ACPT, 1349, 103799, 1-1281; 401, ASIC1, 1352, 103802, 1-1190; 401, ASIC1, 1353, 103803, 1-382; 401, ASIC1, 1354, 103804, 189-980; 401, ASIC1, 1350, 103800, 386-2110; 401, ASIC1, 1351, 103801, 230-1816; 401, ASIC1, 1355, 103805, 11-1699; 402, ASIC2, 1356, 103806, 874-2565; 402, ASIC2, 1357, 103807, 763-2301; 403, ASIC3, 1362, 103812, 1-450; 403, ASIC3, 1364, 103814, 1-434; 403, ASIC3, 1358, 103808, 1-1650; 403, ASIC3, 1359, 103809, 199-1794; 403, ASIC3, 1360, 103810, 595-2226; 403, ASIC3, 1361, 103811, 369-1592; 403, ASIC3, 1363, 103813, 120-1343; 404, ASIC4, 1365, 103815, 15-1958; 404, ASIC4, 1366, 103816, 15-2015; 405, ASIC5, 1367, 103817, 48-1565; 406, ASIC5, 1368, 103818, 48-1282; 407, ANP32A, 1369, 103819, 118-357; 407, ANP32A, 1371, 103821, 136-669; 407, ANP32A, 1370, 103820, 145-894; 408, ANP32B, 1372, 103822, 196-951; 409, ANP32D, 1373, 103823, 1-396; 410, ANP32E, 1374, 103824, 300-749; 410, ANP32E, 1375, 103825, 68-478; 410, ANP32E, 1377, 103827, 1-303; 410, ANP32E, 1378, 103828, 279-621; 410, ANP32E, 1379, 103829, 170-667; 410, ANP32E, 1380, 103830, 198-512; 410, ANP32E, 1383, 103833, 371-781; 410, ANP32E, 1376, 103826, 237-920; 410, ANP32E, 1381, 103831, 371-1177; 410, ANP32E, 1382, 103832, 191-853; 411, ACRC, 1384, 103834, 538-2613; 411, ACRC, 1385, 103835, 115-2190; 412, ARMT1, 1387, 103837, 61-231; 412, ARMT1, 1388, 103838, 540-1508; 412, ARMT1, 1386, 103836, 260-1585; 413, ADI1, 1391, 103841, 1-352; 413, ADI1, 1392, 103842, 1-300; 413, ADI1, 1389, 103839, 250-789; 413, ADI1, 1390, 103840, 2839-3360; 414, ACO1, 1393, 103843, 139-2808; 414, ACO1, 1394, 103844, 207-2876; 414, ACO1, 1395, 103845, 228-2897; 415, ACO2, 1397, 103847, 18-2435; 415, ACO2, 1396, 103846, 23-2365; 416, ACR, 1399, 103849, 7-645; 416, ACR, 1398, 103848, 41-1306; 417, ACRBP, 1401, 103851, 46-1578; 417, ACRBP, 1402, 103852, 68-588; 417, ACRBP, 1403, 103853, 28-987; 417, ACRBP, 1404, 103854, 46-348; 417, ACRBP, 1400, 103850, 95-1726; 418, ACRV1, 1405, 103855, 52-792; 418, ACRV1, 1406, 103856, 344-1141; 418, ACRV1, 1407, 103857, 52-684; 418, ACRV1, 1408, 103858, 95-682; 419, ABLIM1, 1410, 103860, 303-2543; 419, ABLIM1, 1413, 103863, 226-1431; 419, ABLIM1, 1416, 103866, 335-854; 419, ABLIM1, 1417, 103867, 1-519; 419, ABLIM1, 1418, 103868, 303-2459; 419, ABLIM1, 1409, 103859, 99-2435; 419, ABLIM1, 1411, 103861, 231-1436; 419, ABLIM1, 1412, 103862, 651-2897; 419, ABLIM1, 1414, 103864, 327-1694; 419, ABLIM1, 1415, 103865, 105-2261; 420, ABLIM2, 1419, 103869, 144-2078; 420, ABLIM2, 1427, 103877, 114-1028; 420, ABLIM2, 1429, 103879, 21-1961; 420, ABLIM2, 1420, 103870, 66-1901; 420, ABLIM2, 1421, 103871, 123-1718; 420, ABLIM2, 1422, 103872, 66-1784; 420, ABLIM2, 1423, 103873, 95-1660; 420, ABLIM2, 1424, 103874, 144-1556; 420, ABLIM2, 1425, 103875, 21-1958; 420, ABLIM2, 1426, 103876, 1-1680; 420, ABLIM2, 1428, 103878, 273-1313; 421, ABLIM3, 1432, 103882, 1725-2237; 421, ABLIM3, 1433, 103883, 50-2002; 421, ABLIM3, 1434, 103884, 346-801; 421, ABLIM3, 1430, 103880, 240-2291; 421, ABLIM3, 1431, 103881, 260-2026; 421, ABLIM3, 1435, 103885, 276-1910; 421, ABLIM3, 1436, 103886, 483-2534; 421, ABLIM3, 1437, 103887, 1725-2234; 422, ABRA, 1438, 103888, 56-1201; 423, AFAP1, 1443, 103893, 1-279; 423, AFAP1, 1439, 103889, 274-2466; 423, AFAP1, 1440, 103890, 236-2428; 423, AFAP1, 1441, 103891, 5-2449; 423, AFAP1, 1442, 103892, 274-2718; 424, AFAP1L1, 1444, 103894, 99-2405; 424, AFAP1L1, 1445, 103895, 51-2228; 425, AFAP1L2, 1448, 103898, 26-961; 425, AFAP1L2, 1446, 103896, 31-2487; 425, AFAP1L2, 1447, 103897, 302-2746; 426, ACTG1, 1452, 103902, 101-742; 426, ACTG1, 1454, 103904, 213-856; 426, ACTG1, 1455, 103905, 322-813; 426, ACTG1, 1456, 103906, 37-761; 426, ACTG1, 1458, 103908, 55-651; 426, ACTG1, 1459, 103909, 73-471; 426, ACTG1, 1449, 103899, 148-1275; 426, ACTG1, 1450, 103900, 428-1555; 426, ACTG1, 1451, 103901, 173-1300; 426, ACTG1, 1453, 103903, 192-1319; 426, ACTG1, 1457, 103907, 65-1192; 426, ACTG1, 1460, 103910, 29-1156; 427, ARPC1A, 1462, 103912, 108-947; 427, ARPC1A, 1463, 103913, 137-298; 427, ARPC1A, 1461, 103911, 125-1237; 428, ARPC1B, 1465, 103915, 164-561; 428, ARPC1B, 1467, 103917, 184-581; 428, ARPC1B, 1468, 103918, 267-572; 428, ARPC1B, 1469, 103919, 16-408; 428, ARPC1B, 1470, 103920, 148-545; 428, ARPC1B, 1471, 103921, 168-559; 428, ARPC1B, 1472, 103922, 16-114; 428, ARPC1B, 1473, 103923, 285-348; 428, ARPC1B, 1474, 103924, 195-580; 428, ARPC1B, 1475, 103925, 316-563; 428, ARPC1B, 1476, 103926, 344-669; 428, ARPC1B, 1464, 103914, 121-1239; 428, ARPC1B, 1466, 103916, 310-1428; 429, ARPC2, 1479, 103929, 83-358; 429, ARPC2, 1480, 103930, 214-482; 429, ARPC2, 1481, 103931, 1-498; 429, ARPC2, 1482, 103932, 62-178; 429, ARPC2, 1477, 103927, 262-1164; 429, ARPC2, 1478, 103928, 170-1072; 430, ARPC3, 1484, 103934, 52-349; 430, ARPC3, 1485, 103935, 55-308; 430, ARPC3, 1483, 103933, 148-684; 431, ARPC4, 1488, 103938, 30-371; 431, ARPC4, 1489, 103939, 41-175; 431, ARPC4, 1491, 103941, 347-577; 431, ARPC4, 1486, 103936, 565-1071; 431, ARPC4, 1487, 103937, 6-569; 431, ARPC4, 1490, 103940, 479-715; 432, ARPC5, 1494, 103944, 24-431; 432, ARPC5, 1492, 103942, 99-563; 432, ARPC5, 1493, 103943, 68-523; 433, ARPC5L, 1495, 103945, 87-548; 433, ARPC5L, 1496, 103946, 1253-1714; 434, ACTA1, 1497, 103947, 108-872; 434, ACTA1, 1498, 103948, 104-1237; 435, ACTA2, 1500, 103950, 425-878; 435, ACTA2, 1501, 103951, 291-744; 435, ACTA2, 1499, 103949, 67-1200; 435, ACTA2, 1502, 103952, 476-1609; 436, ACTC1, 1503, 103953, 657-1790; 437, ACTB, 1505, 103955, 262-569; 437, ACTB, 1506, 103956, 175-472; 437, ACTB, 1507, 103957, 320-561; 437, ACTB, 1508, 103958, 78-568; 437, ACTB, 1509, 103959, 85-462; 437, ACTB, 1504, 103954, 193-1320; 438, ACTBL2, 1510, 103960, 103-1233; 439, ACTG2, 1514, 103964, 107-466; 439, ACTG2, 1515, 103965, 122-280; 439, ACTG2, 1516, 103966, 107-540; 439, ACTG2, 1517, 103967, 308-625; 439, ACTG2, 1511, 103961, 110-1240; 439, ACTG2, 1512, 103962, 644-1774; 439, ACTG2, 1513, 103963, 122-1123; 440, ACTN1, 1519, 103969, 280-2748; 440, ACTN1, 1523, 103973, 1-891; 440, ACTN1, 1524, 103974, 276-530; 440, ACTN1, 1525, 103975, 1-619; 440, ACTN1, 1526, 103976, 478-1259; 440, ACTN1, 1527, 103977, 204-919; 440, ACTN1, 1528, 103978, 172-605; 440, ACTN1, 1529, 103979, 219-434; 440, ACTN1, 1530, 103980, 1-755; 440, ACTN1, 1531, 103981, 190-568; 440, ACTN1, 1518, 103968, 385-3063; 440, ACTN1, 1520, 103970, 184-2928; 440, ACTN1, 1521, 103971, 207-2870; 440, ACTN1, 1522, 103972, 21-2813; 441, ACTN2, 1533, 103983, 1042-3102; 441, ACTN2, 1532, 103982, 167-2851; 441, ACTN2, 1534, 103984, 221-2905; 442, ACTN3, 1535, 103985, 117-2951; 442, ACTN3, 1536, 103986, 24-242; 442, ACTN3, 1537, 103987, 98-2803; 443, ACTN4, 1539, 103989, 1-1029; 443, ACTN4, 1540, 103990, 1-1566; 443, ACTN4, 1542, 103992, 1-546; 443, ACTN4, 1543, 103993, 1-317; 443, ACTN4, 1544, 103994, 9-2087; 443, ACTN4, 1545, 103995, 1-317; 443, ACTN4, 1546, 103996, 77-2812; 443, ACTN4, 1547, 103997, 1-1029; 443, ACTN4, 1548, 103998, 1-1566; 443, ACTN4, 1549, 103999, 1-546; 443, ACTN4, 1538, 103988, 77-2812; 443, ACTN4, 1541, 103991, 9-2087; 444, ACTL10, 1550, 104000, 1001-1738; 445, ACTL6A, 1554, 104004, 309-459; 445, ACTL6A, 1555, 104005, 1-485; 445, ACTL6A, 1551, 104001, 348-1511; 445, ACTL6A, 1552, 104002, 190-1353; 445, ACTL6A, 1553, 104003, 214-1503; 446, ACTL6B, 1557, 104007, 246-444; 446, ACTL6B, 1556, 104006, 108-1388; 447, ACTL7A, 1558, 104008, 58-1365; 448, ACTL7B, 1559, 104009, 1038-2285; 449, ACTL8, 1560, 104010, 217-1317; 449, ACTL8, 1561, 104011, 28-1128; 450, ACTL9, 1562, 104012, 122-1372; 450, ACTL9, 1563, 104013, 5-1252; 451, ACTR10, 1565, 104015, 139-696; 451, ACTR10, 1566, 104016, 70-450; 451, ACTR10, 1567, 104017, 1-448; 451, ACTR10, 1568, 104018, 1-106; 451, ACTR10, 1569, 104019, 65-196; 451, ACTR10, 1570, 104020, 8-280; 451, ACTR10, 1571, 104021, 77-616; 451, ACTR10, 1572, 104022, 1-908; 451, ACTR10, 1564, 104014, 81-1334; 452, ARPIN, 1574, 104024, 1-409; 452, ARPIN, 1575, 104025, 833-1225; 452, ARPIN, 1573, 104023, 122-802; 453, ACTRT1, 1576, 104026, 193-1323; 454, ACTRT2, 1577, 104027, 205-1338; 455, ACTRT3, 1578, 104028, 376-1494; 456, ALCAM, 1580, 104030, 119-1717; 456, ALCAM, 1581, 104031, 1-1033; 456, ALCAM, 1579, 104029, 501-2252; 456, ALCAM, 1582, 104032, 67-1779; 457, ASCC1, 1588, 104038, 177-548; 457, ASCC1, 1589, 104039, 1-877; 457, ASCC1, 1590, 104040, 231-540; 457, ASCC1, 1591, 104041, 212-581; 457, ASCC1, 1592, 104042, 431-599; 457, ASCC1, 1593, 104043, 124-580; 457, ASCC1, 1594, 104044, 110-241; 457, ASCC1, 1595, 104045, 1-527; 457, ASCC1, 1596, 104046, 1-211; 457, ASCC1, 1597, 104047, 34-450; 457, ASCC1, 1598, 104048, 1-437; 457, ASCC1, 1583, 104033, 348-1421; 457, ASCC1, 1584, 104034, 116-1189; 457, ASCC1, 1585, 104035, 103-1305; 457, ASCC1, 1586, 104036, 308-1510; 457, ASCC1, 1587, 104037, 308-1381; 458, ASCC2, 1601, 104051, 249-485; 458, ASCC2, 1602, 104052, 80-193; 458, ASCC2, 1603, 104053, 178-291; 458, ASCC2, 1604, 104054, 1-163; 458, ASCC2, 1605, 104055, 154-873; 458, ASCC2, 1606, 104056, 1-261; 458, ASCC2, 1599, 104049, 115-2388; 458, ASCC2, 1600, 104050, 179-2452; 458, ASCC2, 1607, 104057, 145-2190; 459, ASCC3, 1608, 104058, 354-500; 459, ASCC3, 1609, 104059, 324-852; 459, ASCC3, 1610, 104060, 293-628; 459, ASCC3, 1611, 104061, 346-6954; 459, ASCC3, 1612, 104062, 346-2541; 460, ATF1, 1614, 104064, 237-470; 460, ATF1, 1615, 104065, 39-549; 460, ATF1, 1616, 104066, 146-745; 460, ATF1, 1617, 104067, 159-326; 460, ATF1, 1613, 104063, 23-838; 461, ATF2, 1622, 104072, 184-1353; 461, ATF2, 1625, 104075, 298-1485; 461, ATF2, 1626, 104076, 263-394; 461, ATF2, 1627, 104077, 298-1485; 461, ATF2, 1628, 104078, 1-797; 461, ATF2, 1630, 104080, 298-429; 461, ATF2, 1631, 104081, 298-1011; 461, ATF2, 1632, 104082, 263-1450; 461, ATF2, 1633, 104083, 262-393; 461, ATF2, 1634, 104084, 317-883; 461, ATF2, 1635, 104085, 15-1004; 461, ATF2, 1618, 104068, 300-1817; 461, ATF2, 1619, 104069, 377-1720; 461, ATF2, 1620, 104070, 298-1815; 461, ATF2, 1621, 104071, 263-697; 461, ATF2, 1623, 104073, 263-892; 461, ATF2, 1624, 104074, 437-1780; 461, ATF2, 1629, 104079, 314-1777; 462, ATF3, 1638, 104088, 155-680; 462, ATF3, 1640, 104090, 1-460; 462, ATF3, 1636, 104086, 1-321; 462, ATF3, 1637, 104087, 266-811; 462, ATF3, 1639, 104089, 1-408; 462, ATF3, 1641, 104091, 155-700; 462, ATF3, 1642, 104092, 1-408; 462, ATF3, 1643, 104093, 16-390; 462, ATF3, 1644, 104094, 440-814; 463, ATF4, 1645, 104095, 883-1938; 463, ATF4, 1646, 104096, 281-1336; 463, ATF4, 1647, 104097, 774-1829; 464, ATF5, 1649, 104099, 334-722; 464, ATF5, 1651, 104101, 464-828; 464, ATF5, 1652, 104102, 304-570; 464, ATF5, 1648, 104098, 378-1226; 464, ATF5, 1650, 104100, 583-1431; 465, ATF6, 1653, 104103, 68-2080; 466, ATF6B, 1658, 104108, 1-425; 466, ATF6B, 1660, 104110, 1-425;

466, ATF6B, 1662, 104112, 1-425; 466, ATF6B, 1665, 104115, 1-425; 466, ATF6B, 1654, 104104, 34-2145; 466, ATF6B, 1655, 104105, 47-2149; 466, ATF6B, 1656, 104106, 34-2145; 466, ATF6B, 1657, 104107, 47-2149; 466, ATF6B, 1659, 104109, 47-2149; 466, ATF6B, 1661, 104111, 47-2149; 466, ATF6B, 1663, 104113, 34-2145; 466, ATF6B, 1664, 104114, 34-2145; 467, ATF7, 1668, 104118, 239-473; 467, ATF7, 1672, 104122, 295-531; 467, ATF7, 1673, 104123, 43-531; 467, ATF7, 1666, 104116, 72-1523; 467, ATF7, 1667, 104117, 151-1602; 467, ATF7, 1669, 104119, 114-1598; 467, ATF7, 1670, 104120, 68-421; 467, ATF7, 1671, 104121, 154-507; 468, ATF7IP, 1675, 104125, 182-1727; 468, ATF7IP, 1676, 104126, 180-555; 468, ATF7IP, 1677, 104127, 1-346; 468, ATF7IP, 1678, 104128, 484-580; 468, ATF7IP, 1679, 104129, 95-550; 468, ATF7IP, 1680, 104130, 44-573; 468, ATF7IP, 1682, 104132, 270-558; 468, ATF7IP, 1683, 104133, 63-570; 468, ATF7IP, 1684, 104134, 304-571; 468, ATF7IP, 1686, 104136, 179-575; 468, ATF7IP, 1687, 104137, 398-574; 468, ATF7IP, 1689, 104139, 148-577; 468, ATF7IP, 1690, 104140, 37-564; 468, ATF7IP, 1691, 104141, 264-572; 468, ATF7IP, 1693, 104143, 63-568; 468, ATF7IP, 1674, 104124, 204-4016; 468, ATF7IP, 1681, 104131, 321-4157; 468, ATF7IP, 1685, 104135, 143-3460; 468, ATF7IP, 1688, 104138, 156-3968; 468, ATF7IP, 1692, 104142, 107-3916; 469, ATF7IP2, 1698, 104148, 222-1499; 469, ATF7IP2, 1699, 104149, 81-761; 469, ATF7IP2, 1700, 104150, 486-564; 469, ATF7IP2, 1701, 104151, 127-1323; 469, ATF7IP2, 1702, 104152, 337-559; 469, ATF7IP2, 1703, 104153, 307-558; 469, ATF7IP2, 1704, 104154, 574-625; 469, ATF7IP2, 1694, 104144, 27-1658; 469, ATF7IP2, 1695, 104145, 27-2075; 469, ATF7IP2, 1696, 104146, 271-1902; 469, ATF7IP2, 1697, 104147, 228-2276; 470, AICDA, 1706, 104156, 1-434; 470, AICDA, 1707, 104157, 1-206; 470, AICDA, 1708, 104158, 1-592; 470, AICDA, 1705, 104155, 105-701; 470, AICDA, 1709, 104159, 101-667; 471, ABT1, 1710, 104160, 32-850; 472, ABR, 1713, 104163, 288-2213; 472, ABR, 1716, 104166, 1-566; 472, ABR, 1717, 104167, 264-760; 472, ABR, 1718, 104168, 339-597; 472, ABR, 1719, 104169, 62-523; 472, ABR, 1720, 104170, 284-549; 472, ABR, 1721, 104171, 186-690; 472, ABR, 1722, 104172, 1-353; 472, ABR, 1723, 104173, 290-689; 472, ABR, 1725, 104175, 290-678; 472, ABR, 1726, 104176, 1-575; 472, ABR, 1729, 104179, 288-2213; 472, ABR, 1730, 104180, 1-2334; 472, ABR, 1734, 104184, 1-2334; 472, ABR, 1735, 104185, 78-466; 472, ABR, 1736, 104186, 264-760; 472, ABR, 1737, 104187, 1-566; 472, ABR, 1738, 104188, 1-151; 472, ABR, 1739, 104189, 1-575; 472, ABR, 1740, 104190, 1-281; 472, ABR, 1741, 104191, 78-477; 472, ABR, 1743, 104193, 186-690; 472, ABR, 1745, 104195, 186-690; 472, ABR, 1746, 104196, 1-63; 472, ABR, 1747, 104197, 62-523; 472, ABR, 1748, 104198, 1-292; 472, ABR, 1749, 104199, 339-597; 472, ABR, 1750, 104200, 1-2334; 472, ABR, 1751, 104201, 1-353; 472, ABR, 1752, 104202, 1-158; 472, ABR, 1753, 104203, 62-523; 472, ABR, 1754, 104204, 264-760; 472, ABR, 1755, 104205, 1-150; 472, ABR, 1756, 104206, 288-2213; 472, ABR, 1757, 104207, 284-549; 472, ABR, 1758, 104208, 1-575; 472, ABR, 1759, 104209, 1-353; 472, ABR, 1760, 104210, 1-63; 472, ABR, 1761, 104211, 1-150; 472, ABR, 1711, 104161, 33-2501; 472, ABR, 1712, 104162, 148-2727; 472, ABR, 1714, 104164, 601-3042; 472, ABR, 1715, 104165, 98-1030; 472, ABR, 1724, 104174, 466-2907; 472, ABR, 1727, 104177, 601-3042; 472, ABR, 1728, 104178, 98-1030; 472, ABR, 1731, 104181, 148-2727; 472, ABR, 1732, 104182, 33-2501; 472, ABR, 1733, 104183, 98-1030; 472, ABR, 1742, 104192, 466-2907; 472, ABR, 1744, 104194, 33-2501; 473, ACVRL1, 1763, 104213, 63-1052; 473, ACVRL1, 1764, 104214, 105-582; 473, ACVRL1, 1765, 104215, 102-1655; 473, ACVRL1, 1766, 104216, 291-557; 473, ACVRL1, 1767, 104217, 1-490; 473, ACVRL1, 1762, 104212, 284-1795; 474, ACVR1, 1771, 104221, 472-536; 474, ACVR1, 1772, 104222, 337-550; 474, ACVR1, 1773, 104223, 275-534; 474, ACVR1, 1774, 104224, 270-531; 474, ACVR1, 1776, 104226, 347-564; 474, ACVR1, 1768, 104218, 431-1960; 474, ACVR1, 1769, 104219, 340-1869; 474, ACVR1, 1770, 104220, 268-1797; 474, ACVR1, 1775, 104225, 250-1779; 475, ACVR1B, 1782, 104232, 327-539; 475, ACVR1B, 1777, 104227, 78-1595; 475, ACVR1B, 1778, 104228, 43-1473; 475, ACVR1B, 1779, 104229, 1-1464; 475, ACVR1B, 1780, 104230, 44-1684; 475, ACVR1B, 1781, 104231, 186-1547; 476, ACVR1C, 1783, 104233, 362-1843; 476, ACVR1C, 1784, 104234, 84-1094; 476, ACVR1C, 1785, 104235, 84-1325; 476, ACVR1C, 1786, 104236, 279-1610; 477, ACVR2A, 1787, 104237, 637-2178; 477, ACVR2A, 1788, 104238, 171-1712; 477, ACVR2A, 1789, 104239, 397-1614; 478, ACVR2B, 1790, 104240, 473-2011; 479, ADNP, 1795, 104245, 256-773; 479, ADNP, 1791, 104241, 298-3606; 479, ADNP, 1792, 104242, 321-3629; 479, ADNP, 1793, 104243, 596-3904; 479, ADNP, 1794, 104244, 171-3479; 479, ADNP, 1796, 104246, 430-3738; 480, ARC, 1797, 104247, 202-1392; 481, APEH, 1799, 104249, 18-170; 481, APEH, 1800, 104250, 1-924; 481, APEH, 1801, 104251, 1-165; 481, APEH, 1802, 104252, 43-219; 481, APEH, 1803, 104253, 1-853; 481, APEH, 1804, 104254, 129-825; 481, APEH, 1805, 104255, 36-2249; 481, APEH, 1806, 104256, 1-144; 481, APEH, 1798, 104248, 401-2599; 482, ACBD3, 1807, 104257, 56-1642; 483, ACBD4, 1814, 104264, 302-1111; 483, ACBD4, 1815, 104265, 38-154; 483, ACBD4, 1808, 104258, 284-1201; 483, ACBD4, 1809, 104259, 298-1104; 483, ACBD4, 1810, 104260, 459-1376; 483, ACBD4, 1811, 104261, 470-1495; 483, ACBD4, 1812, 104262, 345-1370; 483, ACBD4, 1813, 104263, 438-1463; 483, ACBD4, 1816, 104266, 470-1276; 484, ACBD5, 1818, 104268, 387-1958; 484, ACBD5, 1822, 104272, 123-876; 484, ACBD5, 1823, 104273, 258-1014; 484, ACBD5, 1824, 104274, 90-293; 484, ACBD5, 1817, 104267, 66-1670; 484, ACBD5, 1819, 104269, 222-1472; 484, ACBD5, 1820, 104270, 163-1635; 484, ACBD5, 1821, 104271, 128-1705; 485, ACBD6, 1825, 104275, 689-1537; 486, ACBD7, 1826, 104276, 49-315; 487, ACAD10, 1829, 104279, 214-501; 487, ACAD10, 1830, 104280, 1-833; 487, ACAD10, 1831, 104281, 183-2315; 487, ACAD10, 1832, 104282, 550-589; 487, ACAD10, 1833, 104283, 1-678; 487, ACAD10, 1834, 104284, 266-703; 487, ACAD10, 1827, 104277, 156-3335; 487, ACAD10, 1828, 104278, 178-3450; 488, ACAD11, 1836, 104286, 316-1617; 488, ACAD11, 1837, 104287, 94-1524; 488, ACAD11, 1838, 104288, 1-468; 488, ACAD11, 1835, 104285, 973-3315; 489, ACAD8, 1841, 104291, 44-274; 489, ACAD8, 1842, 104292, 54-263; 489, ACAD8, 1839, 104289, 107-1354; 489, ACAD8, 1840, 104290, 41-907; 490, ACAD9, 1844, 104294, 89-388; 490, ACAD9, 1845, 104295, 1-1155; 490, ACAD9, 1846, 104296, 64-583; 490, ACAD9, 1847, 104297, 70-351; 490, ACAD9, 1848, 104298, 47-328; 490, ACAD9, 1849, 104299, 64-345; 490, ACAD9, 1850, 104300, 70-279; 490, ACAD9, 1851, 104301, 73-354; 490, ACAD9, 1852, 104302, 1-507; 490, ACAD9, 1843, 104293, 82-1947; 491, ACADS, 1854, 104304, 26-1252; 491, ACADS, 1853, 104303, 152-1390; 492, ACADM, 1855, 104305, 80-1444; 492, ACADM, 1858, 104308, 28-180; 492, ACADM, 1859, 104309, 83-226; 492, ACADM, 1860, 104310, 80-217; 492, ACADM, 1861, 104311, 83-313; 492,

ACADM, 1862, 104312, 1-204; 492, ACADM, 1863, 104313, 22-165; 492, ACADM, 1864, 104314, 22-336; 492, ACADM, 1865, 104315, 462-1619; 492, ACADM, 1856, 104306, 438-1703; 492, ACADM, 1857, 104307, 9-1286; 493, ACADL, 1866, 104316, 229-1521; 494, ACADSB, 1867, 104317, 253-1245; 494, ACADSB, 1868, 104318, 15-1313; 495, ACADVL, 1869, 104319, 142-261; 495, ACADVL, 1873, 104323, 1-847; 495, ACADVL, 1874, 104324, 1-230; 495, ACADVL, 1875, 104325, 1-613; 495, ACADVL, 1876, 104326, 38-502; 495, ACADVL, 1877, 104327, 1-582; 495, ACADVL, 1878, 104328, 83-555; 495, ACADVL, 1879, 104329, 1-138; 495, ACADVL, 1880, 104330, 126-799; 495, ACADVL, 1870, 104320, 123-2024; 495, ACADVL, 1871, 104321, 180-2147; 495, ACADVL, 1872, 104322, 22-2058; 496, ACOX1, 1883, 104333, 56-727; 496, ACOX1, 1884, 104334, 1-216; 496, ACOX1, 1885, 104335, 1-326; 496, ACOX1, 1886, 104336, 105-574; 496, ACOX1, 1887, 104337, 1-398; 496, ACOX1, 1888, 104338, 56-271; 496, ACOX1, 1889, 104339, 1-461; 496, ACOX1, 1881, 104331, 291-2273; 496, ACOX1, 1882, 104332, 62-2044; 497, ACOX2, 1891, 104341, 1-282; 497, ACOX2, 1892, 104342, 1-324; 497, ACOX2, 1893, 104343, 257-2260; 497, ACOX2, 1894, 104344, 1-41; 497, ACOX2, 1895, 104345, 195-708; 497, ACOX2, 1890, 104340, 293-2338; 498, ACOX3, 1899, 104349, 253-584; 498, ACOX3, 1896, 104346, 79-2181; 498, ACOX3, 1897, 104347, 91-1965; 498, ACOX3, 1898, 104348, 151-2253; 499, ACOXL, 1902, 104352, 1-1068; 499, ACOXL, 1903, 104353, 1-282; 499, ACOXL, 1904, 104354, 277-486; 499, ACOXL, 1905, 104355, 1-483; 499, ACOXL, 1907, 104357, 1-321; 499, ACOXL, 1900, 104350, 164-1003; 499, ACOXL, 1901, 104351, 225-1868; 499, ACOXL, 1906, 104356, 225-1967; 500, ACSBG1, 1909, 104359, 74-316; 500, ACSBG1, 1910, 104360, 484-1932; 500, ACSBG1, 1911, 104361, 195-925; 500, ACSBG1, 1912, 104362, 102-269; 500, ACSBG1, 1913, 104363, 25-180; 500, ACSBG1, 1914, 104364, 25-569; 500, ACSBG1, 1915, 104365, 144-559; 500, ACSBG1, 1908, 104358, 207-2381; 501, ACSBG2, 1917, 104367, 196-600; 501, ACSBG2, 1918, 104368, 1-354; 501, ACSBG2, 1920, 104370, 145-571; 501, ACSBG2, 1922, 104372, 1-113; 501, ACSBG2, 1924, 104374, 232-619; 501, ACSBG2, 1925, 104375, 372-599; 501, ACSBG2, 1926, 104376, 261-665; 501, ACSBG2, 1916, 104366, 447-2297; 501, ACSBG2, 1919, 104369, 277-2277; 501, ACSBG2, 1921, 104371, 582-2021; 501, ACSBG2, 1923, 104373, 228-2228; 502, ACSF2, 1929, 104379, 1-314; 502, ACSF2, 1931, 104381, 1-258; 502, ACSF2, 1932, 104382, 45-594; 502, ACSF2, 1933, 104383, 105-242; 502, ACSF2, 1934, 104384, 45-1763; 502, ACSF2, 1935, 104385, 45-209; 502, ACSF2, 1927, 104377, 105-1952; 502, ACSF2, 1928, 104378, 44-1966; 502, ACSF2, 1930, 104380, 11-1819; 503, ACSF3, 1937, 104387, 225-1160; 503, ACSF3, 1939, 104389, 234-550; 503, ACSF3, 1940, 104390, 159-869; 503, ACSF3, 1941, 104391, 1-550; 503, ACSF3, 1942, 104392, 179-883; 503, ACSF3, 1943, 104393, 1-320; 503, ACSF3, 1944, 104394, 259-829; 503, ACSF3, 1945, 104395, 1-434; 503, ACSF3, 1946, 104396, 110-1216; 503, ACSF3, 1947, 104397, 392-477; 503, ACSF3, 1936, 104386, 378-2108; 503, ACSF3, 1938, 104388, 135-1865; 503, ACSF3, 1948, 104398, 382-2112; 504, ACSL1, 1950, 104400, 523-2106; 504, ACSL1, 1952, 104402, 170-1336; 504, ACSL1, 1954, 104404, 1-885; 504, ACSL1, 1955, 104405, 1-280; 504, ACSL1, 1957, 104407, 152-2146; 504, ACSL1, 1958, 104408, 193-573; 504, ACSL1, 1959, 104409, 991-2574; 504, ACSL1, 1949, 104399, 212-2308; 504, ACSL1, 1951, 104401, 327-2423; 504, ACSL1, 1953, 104403, 133-2229; 504, ACSL1, 1956, 104406, 295-2391; 505, ACSL3, 1962, 104412, 1-55; 505, ACSL3, 1963, 104413, 387-650; 505, ACSL3, 1964, 104414, 274-560; 505, ACSL3, 1965, 104415, 202-624; 505, ACSL3, 1960, 104410, 532-2694; 505, ACSL3, 1961, 104411, 417-2579; 506, ACSL4, 1969, 104419, 195-573; 506, ACSL4, 1970, 104420, 345-506; 506, ACSL4, 1971, 104421, 1-470; 506, ACSL4, 1972, 104422, 125-587; 506, ACSL4, 1973, 104423, 254-637; 506, ACSL4, 1974, 104424, 368-802; 506, ACSL4, 1966, 104416, 328-2340; 506, ACSL4, 1967, 104417, 506-2641; 506, ACSL4, 1968, 104418, 398-2533; 507, ACSL5, 1975, 104425, 280-2331; 507, ACSL5, 1976, 104426, 282-2333; 507, ACSL5, 1977, 104427, 113-2332; 507, ACSL5, 1978, 104428, 308-2359; 507, ACSL5, 1979, 104429, 281-2260; 508, ACSL6, 1987, 104437, 477-934; 508, ACSL6, 1988, 104438, 116-414; 508, ACSL6, 1989, 104439, 116-519; 508, ACSL6, 1990, 104440, 29-1123; 508, ACSL6, 1991, 104441, 97-530; 508, ACSL6, 1992, 104442, 161-799; 508, ACSL6, 1993, 104443, 27-2060; 508, ACSL6, 1980, 104430, 61-2229; 508, ACSL6, 1981, 104431, 172-2040; 508, ACSL6, 1982, 104432, 155-2248; 508, ACSL6, 1983, 104433, 238-2331; 508, ACSL6, 1984, 104434, 167-2293; 508, ACSL6, 1985, 104435, 97-1965; 508, ACSL6, 1986, 104436, 110-2278; 508, ACSL6, 1994, 104444, 1-2139; 509, ACSM1, 1997, 104447, 1-749; 509, ACSM1, 1999, 104449, 240-701; 509, ACSM1, 1995, 104445, 69-1802; 509, ACSM1, 1996, 104446, 161-1894; 509, ACSM1, 1998, 104448, 69-683; 510, ACSM2A, 2002, 104452, 171-1667; 510, ACSM2A, 2004, 104454, 208-561; 510, ACSM2A, 2005, 104455, 361-545; 510, ACSM2A, 2007, 104457, 84-710; 510, ACSM2A, 2008, 104458, 240-556; 510, ACSM2A, 2000, 104450, 142-1875; 510, ACSM2A, 2001, 104451, 12-1745; 510, ACSM2A, 2003, 104453, 115-1848; 510, ACSM2A, 2006, 104456, 471-2204; 511, ACSM2B, 2011, 104461, 208-561; 511, ACSM2B, 2012, 104462, 84-710; 511, ACSM2B, 2014, 104464, 1-332; 511, ACSM2B, 2015, 104465, 361-545; 511, ACSM2B, 2016, 104466, 240-556; 511, ACSM2B, 2017, 104467, 1-450; 511, ACSM2B, 2019, 104469, 171-1667; 511, ACSM2B, 2020, 104470, 1-603; 511, ACSM2B, 2009, 104459, 170-1903; 511, ACSM2B, 2010, 104460, 12-1745; 511, ACSM2B, 2013, 104463, 471-2204; 511, ACSM2B, 2018, 104468, 142-1875; 512, ACSM3, 2023, 104473, 405-561; 512, ACSM3, 2024, 104474, 1-1747; 512, ACSM3, 2025, 104475, 258-558; 512, ACSM3, 2026, 104476, 682-756; 512, ACSM3, 2027, 104477, 1-405; 512, ACSM3, 2028, 104478, 1-706; 512, ACSM3, 2029, 104479, 106-580; 512, ACSM3, 2021, 104471, 476-2236; 512, ACSM3, 2022, 104472, 138-1454; 513, ACSM4, 2030, 104480, 49-1791; 514, ACSM5, 2033, 104483, 1-339; 514, ACSM5, 2034, 104484, 136-360; 514, ACSM5, 2031, 104481, 148-1887; 514, ACSM5, 2032, 104482, 148-774; 515, ACSM6, 2035, 104485, 126-551; 515, ACSM6, 2038, 104488, 10-267; 515, ACSM6, 2036, 104486, 126-1568; 515, ACSM6, 2037, 104487, 10-1452; 516, ACSS1, 2040, 104490, 879-1340; 516, ACSS1, 2039, 104489, 81-2150; 516, ACSS1, 2041, 104491, 81-1808; 516, ACSS1, 2042, 104492, 271-1977; 517, ACSS2, 2045, 104495, 159-648; 517, ACSS2, 2046, 104496, 138-251; 517, ACSS2, 2047, 104497, 57-431; 517, ACSS2, 2048, 104498, 67-249; 517, ACSS2, 2049, 104499, 57-603; 517, ACSS2, 2050, 104500, 75-517; 517, ACSS2, 2051, 104501, 57-665; 517, ACSS2, 2052, 104502, 122-346; 517, ACSS2, 2053, 104503, 54-617; 517, ACSS2, 2043, 104493, 33-2177; 517, ACSS2, 2044, 104494, 212-2317; 518, ACSS3, 2054, 104504, 65-2122; 518, ACSS3, 2055, 104505, 255-534; 518, ACSS3, 2056, 104506, 1-226; 518, ACSS3, 2057, 104507, 911-2971; 519, ACOT1, 2059, 104509, 29-1216; 519, ACOT1, 2058, 104508, 309-1574; 520, ACOT11, 2060, 104510, 83-1867; 520, ACOT11, 2061, 104511, 83-1906; 521, ACOT12, 2062, 104512, 30-1697; 521, ACOT12, 2063, 104513, 66-569; 522, ACOT13, 2064, 104514, 194-616; 522, ACOT13, 2065, 104515, 588-941; 523, ACOT2, 2067, 104517, 534-728; 523, ACOT2, 2068, 104518, 17-1408; 523, ACOT2, 2069, 104519, 199-1464; 523, ACOT2, 2066, 104516, 183-1634; 524, ACOT4, 2070, 104520, 255-1520; 525, ACOT6, 2072, 104522, 365-870; 525, ACOT6, 2071, 104521, 332-955; 526, ACOT7, 2080, 104530, 30-868; 526, ACOT7, 2073, 104523, 993-2105; 526, ACOT7, 2074, 104524, 500-1489; 526, ACOT7, 2075, 104525, 56-1108; 526, ACOT7, 2076, 104526, 148-1290; 526, ACOT7, 2077, 104527, 59-910; 526, ACOT7, 2078, 104528, 59-799; 526, ACOT7, 2079, 104529, 368-1480; 526, ACOT7, 2081, 104531, 59-1075; 527, ACOT8, 2083, 104533, 1-223; 527, ACOT8, 2084, 104534, 1-279; 527, ACOT8, 2085, 104535, 1-629; 527, ACOT8, 2086, 104536, 91-375; 527, ACOT8, 2087, 104537, 57-455; 527, ACOT8, 2088, 104538, 55-570; 527, ACOT8, 2089, 104539, 88-411; 527, ACOT8, 2090, 104540, 75-755; 527, ACOT8, 2082, 104532, 92-1051; 528, ACOT9, 2094, 104544, 189-599; 528, ACOT9, 2095, 104545, 147-287; 528, ACOT9, 2096, 104546, 1-793; 528, ACOT9, 2091, 104541, 133-1452; 528, ACOT9, 2092, 104542, 1419-2558; 528, ACOT9, 2093, 104543, 130-1476; 529, AWAT1, 2097, 104547, 42-1028; 530, AWAT2, 2099, 104549, 1-501; 530, AWAT2, 2098, 104548, 7-1008; 531, AGK, 2101, 104551, 15-749; 531, AGK, 2103, 104553, 32-172; 531, AGK, 2104, 104554, 143-1327; 531, AGK, 2106, 104556, 1-156; 531, AGK, 2107, 104557, 1-681; 531, AGK, 2108, 104558, 172-906; 531, AGK, 2100, 104550, 261-1529; 531, AGK, 2102, 104552, 15-212; 531, AGK, 2105, 104555, 1-681; 532, AOAH, 2109, 104559, 353-678; 532, AOAH, 2110, 104560, 327-485; 532, AOAH, 2111, 104561, 302-2368; 532, AOAH, 2112, 104562, 401-2128; 532, AOAH, 2113, 104563, 402-2033; 533, ACYP1, 2116, 104566, 193-582; 533, ACYP1, 2117, 104567, 76-189; 533, ACYP1, 2119, 104569, 63-251; 533, ACYP1, 2114, 104564, 105-404; 533, ACYP1, 2115, 104565, 71-238; 533, ACYP1, 2118, 104568, 65-364; 534, ACYP2, 2120, 104570, 112-408; 534, ACYP2, 2122, 104572, 213-506; 534, ACYP2, 2123, 104573, 1-200; 534, ACYP2, 2124, 104574, 206-457; 534, ACYP2, 2125, 104575, 521-643; 534, ACYP2, 2126, 104576, 251-601; 534, ACYP2, 2127, 104577, 256-774; 534, ACYP2, 2121, 104571, 196-495; 535, N/A, 2128, 104578, 42-335; 536, ADAM10, 2130, 104580, 61-276; 536, ADAM10, 2131, 104581, 225-601; 536, ADAM10, 2132, 104582, 174-290; 536, ADAM10, 2133, 104583, 241-587; 536, ADAM10, 2134, 104584, 97-541; 536, ADAM10, 2135, 104585, 1-176; 536, ADAM10, 2136, 104586, 186-365; 536, ADAM10, 2129, 104579, 445-2691; 537, ADAM11, 2138, 104588, 22-747; 537, ADAM11, 2139, 104589, 699-2408; 537, ADAM11, 2140, 104590, 1-1554; 537, ADAM11, 2137, 104587, 170-2479; 538, ADAM12, 2143, 104593, 311-1145; 538, ADAM12, 2141, 104591, 311-2527; 538, ADAM12, 2142, 104592, 311-3040; 539, ADAM15, 2144, 104594, 82-2526; 539, ADAM15, 2145, 104595, 102-2621; 539, ADAM15, 2146, 104596, 102-2693; 539, ADAM15, 2147, 104597, 102-2618; 539, ADAM15, 2148, 104598, 102-2420; 539, ADAM15, 2149, 104599, 102-2492; 539, ADAM15, 2150, 104600, 72-1634; 539, ADAM15, 2151, 104601, 102-2690; 539, ADAM15, 2152, 104602, 102-2570; 539, ADAM15, 2153, 104603, 37-2511; 539, ADAM15, 2154, 104604, 102-2495; 539, ADAM15, 2155, 104605, 36-1937; 540, ADAM17, 2157, 104607, 188-1045; 540, ADAM17, 2158, 104608, 188-964; 540, ADAM17, 2156, 104606, 184-2658; 541, ADAM18, 2161, 104611, 1-348; 541, ADAM18, 2162, 104612, 135-323; 541, ADAM18, 2165, 104615, 1-348; 541, ADAM18, 2168, 104618, 135-323; 541, ADAM18, 2159, 104609, 46-2265; 541, ADAM18, 2160, 104610, 43-2190; 541, ADAM18, 2163, 104613, 39-587; 541, ADAM18, 2164, 104614, 46-2265; 541, ADAM18, 2166, 104616, 39-587; 541, ADAM18, 2167, 104617, 43-2190; 542, ADAM19, 2170, 104620, 80-898; 542, ADAM19, 2172, 104622, 1-1469; 542, ADAM19, 2169, 104619, 80-2836; 542, ADAM19, 2171, 104621, 46-2913; 543, ADAM2, 2175, 104625, 26-1765; 543, ADAM2, 2176, 104626, 43-2061; 543, ADAM2, 2177, 104627, 105-2123; 543, ADAM2, 2178, 104628, 26-1765; 543, ADAM2, 2180, 104630, 105-2123; 543, ADAM2, 2182, 104632, 43-2061; 543, ADAM2, 2173, 104623, 105-2312; 543, ADAM2, 2174, 104624, 25-2175; 543, ADAM2, 2179, 104629, 105-2312; 543, ADAM2, 2181, 104631, 25-2175; 544, ADAM20, 2183, 104633, 246-2576; 545, ADAM21, 2184, 104634, 259-2427; 546, ADAM22, 2187, 104637, 285-2697; 546, ADAM22, 2190, 104640, 216-1244; 546, ADAM22, 2191, 104641, 1-993; 546, ADAM22, 2192, 104642, 1-793; 546, ADAM22, 2193, 104643, 138-726; 546, ADAM22, 2185, 104635, 80-2800; 546, ADAM22, 2186, 104636, 120-2699; 546, ADAM22, 2188, 104638, 324-2936; 546, ADAM22, 2189, 104639, 47-2746; 547, ADAM23, 2195, 104645, 1-2499; 547, ADAM23, 2196, 104646, 1-323; 547, ADAM23, 2194, 104644, 329-2827; 548, ADAM28, 2199, 104649, 1-1162; 548, ADAM28, 2200, 104650, 82-735; 548, ADAM28, 2201, 104651, 1-523; 548, ADAM28, 2202, 104652, 82-258; 548, ADAM28, 2197, 104647, 111-2438; 548, ADAM28, 2198, 104648, 40-1662; 549, ADAM29, 2206, 104656, 657-788; 549, ADAM29, 2208, 104658, 590-632; 549, ADAM29, 2209, 104659, 287-555; 549, ADAM29, 2203, 104653, 671-3133; 549, ADAM29, 2204, 104654, 517-2979; 549, ADAM29, 2205, 104655, 590-3052; 549, ADAM29, 2207, 104657, 431-2893; 549, ADAM29, 2210, 104660, 295-2757; 549, ADAM29, 2211, 104661, 732-3194; 550, ADAM30, 2212, 104662, 160-2532; 551, ADAM32, 2214, 104664, 248-712; 551, ADAM32, 2215, 104665, 105-2171; 551, ADAM32, 2216, 104666, 60-577; 551, ADAM32, 2217, 104667, 4-557; 551, ADAM32, 2218, 104668, 169-2058; 551, ADAM32, 2219, 104669, 411-571; 551, ADAM32, 2220, 104670, 169-2058; 551, ADAM32, 2222, 104672, 248-712; 551, ADAM32, 2223, 104673, 411-571; 551, ADAM32, 2224, 104674, 1-163; 551, ADAM32, 2225, 104675, 105-2171; 551, ADAM32, 2226, 104676, 60-577; 551, ADAM32, 2227, 104677, 4-557; 551, ADAM32, 2213, 104663, 128-2491; 551, ADAM32, 2221, 104671, 128-2491; 552, ADAM33, 2230, 104680, 243-2681; 552, ADAM33, 2231, 104681, 48-464; 552, ADAM33, 2232, 104682, 128-2206; 552, ADAM33, 2228, 104678, 128-2491; 552, ADAM33, 2229, 104679, 243-2684; 553, ADAM7, 2234, 104684, 26-2356; 553, ADAM7, 2236, 104686, 131-1681; 553, ADAM7, 2233, 104683, 84-2348; 553, ADAM7, 2235, 104685, 180-812; 554, ADAM8, 2237, 104687, 47-376; 554, ADAM8, 2240, 104690, 41-776; 554, ADAM8, 2238, 104688, 52-2253; 554, ADAM8, 2239, 104689, 52-2526; 554, ADAM8, 2241, 104691, 34-2262; 555, ADAM9, 2243, 104693, 79-465; 555, ADAM9, 2244, 104694, 39-2177; 555, ADAM9, 2245, 104695, 39-1925; 555, ADAM9, 2247, 104697, 196-639; 555, ADAM9, 2248, 104698, 1-162; 555, ADAM9, 2242, 104692, 39-2006; 555, ADAM9, 2246, 104696, 79-2538; 556, ADAMTS13, 2249, 104699, 121-1155; 556, ADAMTS13, 2250, 104700, 121-4143; 556, ADAMTS13, 2251, 104701, 121-1155; 556,

ADAMTS13, 2252, 104702, 445-4728; 556, ADAMTS13, 2253, 104703, 120-950; 556, ADAMTS13, 2254, 104704, 121-4236; 556, ADAMTS13, 2255, 104705, 1189-2523; 556, ADAMTS13, 2256, 104706, 197-868; 557, ADAMTS1, 2258, 104708, 1-601; 557, ADAMTS1, 2259, 104709, 86-598; 557, ADAMTS1, 2260, 104710, 21-405; 557, ADAMTS1, 2257, 104707, 456-3359; 558, ADAMTS10, 2261, 104711, 232-3543; 558, ADAMTS10, 2262, 104712, 55-435; 558, ADAMTS10, 2263, 104713, 138-1007; 558, ADAMTS10, 2264, 104714, 70-939; 558, ADAMTS10, 2266, 104716, 272-3583; 558, ADAMTS10, 2265, 104715, 35-1807; 559, ADAMTS12, 2268, 104718, 164-862; 559, ADAMTS12, 2270, 104720, 337-825; 559, ADAMTS12, 2271, 104721, 86-574; 559, ADAMTS12, 2267, 104717, 86-4615; 559, ADAMTS12, 2269, 104719, 337-5121; 560, ADAMTS13, 2274, 104724, 197-868; 560, ADAMTS13, 2275, 104725, 121-1155; 560, ADAMTS13, 2276, 104726, 1189-2523; 560, ADAMTS13, 2278, 104728, 121-1155; 560, ADAMTS13, 2279, 104729, 120-950; 560, ADAMTS13, 2272, 104722, 121-4236; 560, ADAMTS13, 2273, 104723, 121-4143; 560, ADAMTS13, 2277, 104727, 445-4728; 561, ADAMTS14, 2280, 104730, 1-3672; 561, ADAMTS14, 2281, 104731, 1-3681; 562, ADAMTS15, 2282, 104732, 1-2853; 563, ADAMTS16, 2284, 104734, 139-1851; 563, ADAMTS16, 2283, 104733, 139-3813; 564, ADAMTS17, 2286, 104736, 107-313; 564, ADAMTS17, 2287, 104737, 1-643; 564, ADAMTS17, 2288, 104738, 1-362; 564, ADAMTS17, 2285, 104735, 107-3394; 565, ADAMTS18, 2290, 104740, 340-1164; 565, ADAMTS18, 2291, 104741, 1-188; 565, ADAMTS18, 2292, 104742, 1-556; 565, ADAMTS18, 2289, 104739, 420-4085; 566, ADAMTS19, 2294, 104744, 1-436; 566, ADAMTS19, 2295, 104745, 130-225; 566, ADAMTS19, 2293, 104743, 146-3769; 567, ADAMTS2, 2296, 104746, 103-3738; 567, ADAMTS2, 2297, 104747, 103-1803; 568, ADAMTS20, 2299, 104749, 1-4515; 568, ADAMTS20, 2300, 104750, 1-1905; 568, ADAMTS20, 2301, 104751, 1-4515; 568, ADAMTS20, 2298, 104748, 1-5733; 569, ADAMTS3, 2302, 104752, 38-3655; 569, ADAMTS3, 2303, 104753, 35-3652; 570, ADAMTS4, 2304, 104754, 427-1446; 570, ADAMTS4, 2305, 104755, 430-2943; 571, ADAMTS5, 2306, 104756, 123-2915; 572, ADAMTS6, 2307, 104757, 858-4211; 572, ADAMTS6, 2308, 104758, 355-1233; 573, ADAMTS7, 2309, 104759, 212-5272; 574, ADAMTS8, 2310, 104760, 708-3377; 575, ADAMTS9, 2312, 104762, 1-2975; 575, ADAMTS9, 2314, 104764, 334-1800; 575, ADAMTS9, 2315, 104765, 1-210; 575, ADAMTS9, 2311, 104761, 23-5746; 575, ADAMTS9, 2313, 104763, 344-6151; 576, ADAMDEC1, 2318, 104768, 1-126; 576, ADAMDEC1, 2316, 104766, 221-1633; 576, ADAMDEC1, 2317, 104767, 154-1329; 577, ADAMTSL1, 2321, 104771, 1-453; 577, ADAMTSL1, 2325, 104775, 81-740; 577, ADAMTSL1, 2326, 104776, 100-927; 577, ADAMTSL1, 2327, 104777, 90-647; 577, ADAMTSL1, 2319, 104769, 1-2052; 577, ADAMTSL1, 2320, 104770, 134-1711; 577, ADAMTSL1, 2322, 104772, 110-1501; 577, ADAMTSL1, 2323, 104773, 340-5628; 577, ADAMTSL1, 2324, 104774, 65-1384; 577, ADAMTSL1, 2328, 104778, 110-886; 578, ADAMTSL2, 2331, 104781, 433-3615; 578, ADAMTSL2, 2329, 104779, 558-3413; 578, ADAMTSL2, 2330, 104780, 216-3071; 579, ADAMTSL3, 2332, 104782, 225-5300; 579, ADAMTSL3, 2333, 104783, 223-5271; 580, ADAMTSL4, 2338, 104788, 209-1516; 580, ADAMTSL4, 2334, 104784, 290-3514; 580, ADAMTSL4, 2335, 104785, 202-3426; 580, ADAMTSL4, 2336, 104786, 290-3583; 580, ADAMTSL4, 2337, 104787, 251-2884; 581, ADAMTSL5, 2339, 104789, 445-1860; 581, ADAMTSL5, 2340, 104790, 1138-1533; 581, ADAMTSL5, 2341, 104791, 1-406; 581, ADAMTSL5, 2342, 104792, 150-573; 581, ADAMTSL5, 2343, 104793, 105-735; 581, ADAMTSL5, 2344, 104794, 184-574; 582, APPL1, 2346, 104796, 116-516; 582, APPL1, 2347, 104797, 54-396; 582, APPL1, 2345, 104795, 148-2277; 583, APPL2, 2350, 104800, 1-564; 583, APPL2, 2352, 104802, 309-493; 583, APPL2, 2353, 104803, 152-475; 583, APPL2, 2354, 104804, 2-121; 583, APPL2, 2355, 104805, 192-899; 583, APPL2, 2356, 104806, 82-514; 583, APPL2, 2348, 104798, 227-2221; 583, APPL2, 2349, 104799, 436-2301; 583, APPL2, 2351, 104801, 72-2084; 584, AP1AR, 2359, 104809, 1-230; 584, AP1AR, 2357, 104807, 356-1264; 584, AP1AR, 2358, 104808, 260-1069; 585, AP1B1, 2365, 104815, 1-519; 585, AP1B1, 2366, 104816, 175-1908; 585, AP1B1, 2360, 104810, 188-2947; 585, AP1B1, 2361, 104811, 188-3037; 585, AP1B1, 2362, 104812, 33-2882; 585, AP1B1, 2363, 104813, 33-2852; 585, AP1B1, 2364, 104814, 19-2838; 585, AP1B1, 2367, 104817, 188-3007; 586, AP1G1, 2370, 104820, 74-604; 586, AP1G1, 2371, 104821, 805-1548; 586, AP1G1, 2373, 104823, 449-882; 586, AP1G1, 2374, 104824, 402-561; 586, AP1G1, 2375, 104825, 1-177; 586, AP1G1, 2376, 104826, 249-959; 586, AP1G1, 2377, 104827, 735-814; 586, AP1G1, 2378, 104828, 284-844; 586, AP1G1, 2379, 104829, 141-559; 586, AP1G1, 2380, 104830, 363-619; 586, AP1G1, 2381, 104831, 224-850; 586, AP1G1, 2382, 104832, 332-606; 586, AP1G1, 2368, 104818, 443-2911; 586, AP1G1, 2369, 104819, 443-2920; 586, AP1G1, 2372, 104822, 911-3379; 587, AP1G2, 2385, 104835, 1-430; 587, AP1G2, 2386, 104836, 1-592; 587, AP1G2, 2387, 104837, 53-259; 587, AP1G2, 2388, 104838, 193-399; 587, AP1G2, 2389, 104839, 153-562; 587, AP1G2, 2390, 104840, 78-678; 587, AP1G2, 2383, 104833, 757-3114; 587, AP1G2, 2384, 104834, 71-2428; 588, AP1M1, 2393, 104843, 117-1229; 588, AP1M1, 2394, 104844, 174-1229; 588, AP1M1, 2395, 104845, 137-546; 588, AP1M1, 2396, 104846, 189-564; 588, AP1M1, 2397, 104847, 358-549; 588, AP1M1, 2398, 104848, 1-530; 588, AP1M1, 2399, 104849, 248-562; 588, AP1M1, 2400, 104850, 1-387; 588, AP1M1, 2391, 104841, 450-1721; 588, AP1M1, 2392, 104842, 94-1401; 589, AP1M2, 2402, 104852, 1-736; 589, AP1M2, 2403, 104853, 1-133; 589, AP1M2, 2405, 104855, 1-387; 589, AP1M2, 2406, 104856, 65-961; 589, AP1M2, 2407, 104857, 69-185; 589, AP1M2, 2408, 104858, 133-850; 589, AP1M2, 2409, 104859, 1-312; 589, AP1M2, 2401, 104851, 84-1355; 589, AP1M2, 2404, 104854, 85-1362; 590, AP1S1, 2411, 104861, 1-573; 590, AP1S1, 2410, 104860, 119-595; 590, AP1S1, 2412, 104862, 33-509; 591, AP1S2, 2414, 104864, 118-600; 591, AP1S2, 2415, 104865, 1-440; 591, AP1S2, 2416, 104866, 1-460; 591, AP1S2, 2417, 104867, 328-810; 591, AP1S2, 2413, 104863, 245-718; 592, AP1S3, 2418, 104868, 121-366; 592, AP1S3, 2419, 104869, 133-324; 592, AP1S3, 2421, 104871, 92-505; 592, AP1S3, 2424, 104874, 392-561; 592, AP1S3, 2420, 104870, 133-597; 592, AP1S3, 2422, 104872, 35-499; 592, AP1S3, 2423, 104873, 153-647; 592, AP1S3, 2425, 104875, 286-600; 593, AP2A1, 2428, 104878, 1-172; 593, AP2A1, 2426, 104876, 167-3034; 593, AP2A1, 2427, 104877, 1-2934; 594, AP2A2, 2432, 104882, 1-554; 594, AP2A2, 2433, 104883, 665-935; 594, AP2A2, 2434, 104884, 377-557; 594, AP2A2, 2435, 104885, 112-527; 594, AP2A2, 2436, 104886, 1-556; 594, AP2A2, 2437, 104887, 278-464; 594, AP2A2, 2438, 104888, 143-1279; 594, AP2A2, 2439, 104889, 175-551; 594, AP2A2, 2440, 104890, 1-1070; 594, AP2A2, 2441, 104891, 665-935; 594, AP2A2, 2442, 104892, 665-935; 594, AP2A2, 2443, 104893, 1-1904; 594, AP2A2, 2444, 104894, 377-557; 594, AP2A2, 2445, 104895, 1-469; 594, AP2A2, 2446, 104896, 1-519; 594, AP2A2, 2447, 104897, 112-527; 594, AP2A2, 2448, 104898, 1-1070; 594, AP2A2, 2449, 104899, 1-519; 594, AP2A2, 2450, 104900, 112-527; 594, AP2A2, 2451, 104901, 278-464; 594, AP2A2, 2452, 104902, 46-422; 594, AP2A2, 2453, 104903, 1-422; 594, AP2A2, 2454, 104904, 1-2753; 594, AP2A2, 2455, 104905, 278-464; 594, AP2A2, 2456, 104906, 1-469; 594, AP2A2, 2457, 104907, 1-1904; 594, AP2A2, 2458, 104908, 377-557; 594, AP2A2, 2459, 104909, 1-2753; 594, AP2A2, 2429, 104879, 214-3036; 594, AP2A2, 2430, 104880, 142-2961; 594, AP2A2, 2431, 104881, 123-2093; 595, AP2B1, 2460, 104910, 1-495; 595, AP2B1, 2461, 104911, 315-554; 595, AP2B1, 2462, 104912, 131-322; 595, AP2B1, 2463, 104913, 1-546; 595, AP2B1, 2464, 104914, 180-577; 595, AP2B1, 2465, 104915, 122-313; 595, AP2B1, 2466, 104916, 100-552; 595, AP2B1, 2467, 104917, 131-322; 595, AP2B1, 2468, 104918, 236-2266; 595, AP2B1, 2469, 104919, 554-2542; 595, AP2B1, 2470, 104920, 255-2285; 595, AP2B1, 2471, 104921, 139-288; 595, AP2B1, 2472, 104922, 139-2055; 595, AP2B1, 2474, 104924, 131-2161; 595, AP2B1, 2477, 104927, 139-2880; 595, AP2B1, 2478, 104928, 1-192; 595, AP2B1, 2473, 104923, 179-2992; 595, AP2B1, 2475, 104925, 173-3028; 595, AP2B1, 2476, 104926, 131-2986; 596, AP2M1, 2481, 104931, 46-802; 596, AP2M1, 2482, 104932, 149-557; 596, AP2M1, 2483, 104933, 122-601; 596, AP2M1, 2484, 104934, 149-1531; 596, AP2M1, 2485, 104935, 206-545; 596, AP2M1, 2486, 104936, 16-602; 596, AP2M1, 2488, 104938, 1-369; 596, AP2M1, 2489, 104939, 1-1305; 596, AP2M1, 2479, 104929, 149-1456; 596, AP2M1, 2480, 104930, 315-1616; 596, AP2M1, 2487, 104937, 217-1518; 597, AP2S1, 2491, 104941, 12-482; 597, AP2S1, 2492, 104942, 133-609; 597, AP2S1, 2493, 104943, 64-432; 597, AP2S1, 2495, 104945, 106-540; 597, AP2S1, 2496, 104946, 69-347; 597, AP2S1, 2490, 104940, 227-655; 597, AP2S1, 2494, 104944, 1-315; 598, AP3B1, 2498, 104948, 1-464; 598, AP3B1, 2497, 104947, 177-3461; 598, AP3B1, 2499, 104949, 273-3410; 599, AP3B2, 2502, 104952, 154-579; 599, AP3B2, 2504, 104954, 168-746; 599, AP3B2, 2505, 104955, 1-69; 599, AP3B2, 2500, 104950, 209-3457; 599, AP3B2, 2501, 104951, 74-3226; 599, AP3B2, 2503, 104953, 74-3379; 599, AP3B2, 2506, 104956, 203-3451; 600, AP3D1, 2509, 104959, 1-581; 600, AP3D1, 2510, 104960, 1-466; 600, AP3D1, 2511, 104961, 1-610; 600, AP3D1, 2507, 104957, 224-3685; 600, AP3D1, 2508, 104958, 208-3855; 601, AP3M1, 2512, 104962, 313-1569; 601, AP3M1, 2513, 104963, 218-1474; 602, AP3M2, 2516, 104966, 1-293; 602, AP3M2, 2518, 104968, 1-396; 602, AP3M2, 2519, 104969, 73-879; 602, AP3M2, 2520, 104970, 157-574; 602, AP3M2, 2521, 104971, 1-147; 602, AP3M2, 2522, 104972, 1696-2025; 602, AP3M2, 2523, 104973, 479-509; 602, AP3M2, 2524, 104974, 105-966; 602, AP3M2, 2514, 104964, 283-1539; 602, AP3M2, 2515, 104965, 168-1424; 602, AP3M2, 2517, 104967, 292-1548; 602, AP3M2, 2525, 104975, 94-915; 603, AP3S1, 2527, 104977, 81-569; 603, AP3S1, 2526, 104976, 558-1139; 604, AP3S2, 2530, 104980, 46-180; 604, AP3S2, 2531, 104981, 46-663; 604, AP3S2, 2533, 104983, 46-456; 604, AP3S2, 2534, 104984, 33-503; 604, AP3S2, 2535, 104985, 80-190; 604, AP3S2, 2536, 104986, 690-881; 604, AP3S2, 2528, 104978, 394-975; 604, AP3S2, 2529, 104979, 29-403; 604, AP3S2, 2532, 104982, 29-403; 605, AP4B1, 2538, 104988, 337-1225; 605, AP4B1, 2539, 104989, 112-1827; 605, AP4B1, 2541, 104991, 194-980; 605, AP4B1, 2542, 104992, 156-681; 605, AP4B1, 2537, 104987, 206-2425; 605, AP4B1, 2540, 104990, 282-2501; 606, AP4E1, 2544, 104994, 355-1011; 606, AP4E1, 2545, 104995, 107-1072; 606, AP4E1, 2547, 104997, 108-1214; 606, AP4E1, 2543, 104993, 107-3520; 606, AP4E1, 2546, 104996, 233-3421; 607, AP4M1, 2549, 104999, 167-361; 607, AP4M1, 2550, 105000, 1-483; 607, AP4M1, 2551, 105001, 1-416; 607, AP4M1, 2552, 105002, 57-713; 607, AP4M1, 2553, 105003, 159-452; 607, AP4M1, 2554, 105004, 159-1091; 607, AP4M1, 2555, 105005, 159-1541; 607, AP4M1, 2556, 105006, 1-580; 607, AP4M1, 2557, 105007, 571-1548; 607, AP4M1, 2559, 105009, 125-921; 607, AP4M1, 2548, 104998, 159-1520; 607, AP4M1, 2558, 105008, 52-1413; 608, AP4S1, 2565, 105015, 265-663; 608, AP4S1, 2566, 105016, 747-769; 608, AP4S1, 2567, 105017, 1-252; 608, AP4S1, 2568, 105018, 249-542; 608, AP4S1, 2569, 105019, 189-497; 608, AP4S1, 2560, 105010, 209-688; 608, AP4S1, 2561, 105011, 390-839; 608, AP4S1, 2562, 105012, 192-641; 608, AP4S1, 2563, 105013, 394-828; 608, AP4S1, 2564, 105014, 177-584; 608, AP4S1, 2570, 105020, 747-1181; 608, AP4S1, 2571, 105021, 265-699; 609, AP5B1, 2572, 105022, 212-2848; 610, AP5M1, 2574, 105024, 260-1774; 610, AP5M1, 2575, 105025, 1-180; 610, AP5M1, 2576, 105026, 290-406; 610, AP5M1, 2577, 105027, 366-610; 610, AP5M1, 2578, 105028, 1-280; 610, AP5M1, 2573, 105023, 407-1879; 611, AP5S1, 2581, 105031, 245-424; 611, AP5S1, 2582, 105032, 325-584; 611, AP5S1, 2579, 105029, 348-950; 611, AP5S1, 2580, 105030, 184-786; 611, AP5S1, 2583, 105033, 220-822; 612, AP5Z1, 2584, 105034, 95-2518; 613, ASXL1, 2585, 105035, 1-4611; 613, ASXL1, 2587, 105037, 183-428; 613, ASXL1, 2588, 105038, 433-690; 613, ASXL1, 2589, 105039, 1-223; 613, ASXL1, 2590, 105040, 695-868; 613, ASXL1, 2586, 105036, 425-5050; 613, ASXL1, 2591, 105041, 433-5058; 613, ASXL1, 2592, 105042, 196-4821; 614, ASXL2, 2593, 105043, 329-4552; 614, ASXL2, 2594, 105044, 439-3195; 614, ASXL2, 2595, 105045, 295-4602; 615, ASXL3, 2597, 105047, 15-191; 615, ASXL3, 2598, 105048, 18-974; 615, ASXL3, 2599, 105049, 1-523; 615, ASXL3, 2600, 105050, 88-192; 615, ASXL3, 2601, 105051, 1-186; 615, ASXL3, 2602, 105052, 101-544; 615, ASXL3, 2603, 105053, 70-246; 615, ASXL3, 2604, 105054, 93-197; 615, ASXL3, 2605, 105055, 61-165; 615, ASXL3, 2606, 105056, 1-538; 615, ASXL3, 2607, 105057, 100-159; 615, ASXL3, 2608, 105058, 79-255; 615, ASXL3, 2596, 105046, 1-6747; 616, ADD1, 2614, 105064, 124-1326; 616, ADD1, 2615, 105065, 73-1971; 616, ADD1, 2616, 105066, 259-671; 616, ADD1, 2617, 105067, 59-2050; 616, ADD1, 2618, 105068, 1-1332; 616, ADD1, 2619, 105069, 174-383; 616, ADD1, 2620, 105070, 64-491; 616, ADD1, 2621, 105071, 1-318; 616, ADD1, 2622, 105072, 1-344; 616, ADD1, 2609, 105059, 189-2495; 616, ADD1, 2610, 105060, 864-2852; 616, ADD1, 2611, 105061, 21-2009; 616, ADD1, 2612, 105062, 189-2177; 616, ADD1, 2613, 105063, 21-2234; 617, ADD2, 2629, 105079, 531-582; 617, ADD2, 2630, 105080, 251-930; 617, ADD2, 2631, 105081, 294-721; 617, ADD2, 2632, 105082, 1-997; 617, ADD2, 2633, 105083, 36-874; 617, ADD2, 2623, 105073, 446-2626; 617, ADD2, 2624, 105074, 446-2377; 617, ADD2, 2625, 105075, 467-2647; 617, ADD2, 2626, 105076, 266-2446; 617, ADD2, 2627, 105077, 481-2160; 617, ADD2, 2628, 105078, 299-2026; 618, ADD3, 2637, 105087, 125-2143; 618, ADD3, 2634, 105084, 366-2390; 618, ADD3, 2635, 105085, 368-2488; 618, ADD3, 2636, 105086, 378-2402; 619, APRT, 2640, 105090, 1-487; 619, APRT, 2641, 105091, 25-470; 619, APRT, 2642, 105092, 22-483; 619, APRT, 2643, 105093, 39-230; 619, APRT, 2644, 105094, 30-221; 619, APRT, 2638, 105088, 46-588; 619, APRT, 2639, 105089, 27-431; 620, APC2, 2646, 105096, 203-2394; 620, APC2, 2648, 105098, 201-781; 620, APC2, 2649, 105099, 59-568; 620, APC2, 2650, 105100, 209-2316; 620, APC2, 2651, 105101, 140-555; 620, APC2, 2645, 105095, 209-7120; 620, APC2, 2647, 105097, 1714-8625; 621, APCDD1, 2653, 105103, 147-332; 621, APCDD1, 2654, 105104, 1-555; 621, APCDD1, 2655, 105105, 99-167; 621, APCDD1, 2656, 105106, 1-285; 621, APCDD1, 2657, 105107, 1-682; 621, APCDD1, 2652, 105102, 355-1899; 622, APCDD1L, 2659, 105109, 563-802; 622, APCDD1L, 2658, 105108, 232-1737; 623, APC, 2661, 105111, 197-3602; 623, APC, 2662, 105112, 148-4061; 623, APC, 2663, 105113, 60-923; 623, APC, 2664, 105114, 171-524; 623, APC, 2666, 105116, 1-817; 623, APC, 2667, 105117, 198-374; 623, APC, 2668, 105118, 1-155; 623, APC, 2660, 105110, 57-8588; 623, APC, 2665, 105115, 158-8689; 624, ADORA1, 2673, 105123, 68-700; 624, ADORA1, 2669, 105119, 412-1392; 624, ADORA1, 2670, 105120, 434-1414; 624, ADORA1, 2671, 105121, 185-562; 624, ADORA1, 2672, 105122, 922-1902; 625, ADORA2A, 2675, 105125, 477-669; 625, ADORA2A, 2676, 105126, 331-560; 625, ADORA2A, 2677, 105127, 307-569; 625, ADORA2A, 2678, 105128, 423-1517; 625, ADORA2A, 2679, 105129, 602-926; 625, ADORA2A, 2680, 105130, 440-689; 625, ADORA2A, 2681, 105131, 540-558; 625, ADORA2A, 2682, 105132, 631-718; 625, ADORA2A, 2674, 105124, 460-1698; 626, ADORA2B, 2683, 105133, 333-1331; 627, ADORA3, 2685, 105135, 59-430; 627, ADORA3, 2684, 105134, 407-1363; 628, ADA, 2687, 105137, 75-866; 628, ADA, 2688, 105138, 85-1104; 628, ADA, 2689, 105139, 85-312; 628, ADA, 2686, 105136, 136-1227; 629, ADAD1, 2693, 105143, 159-627; 629, ADAD1, 2694, 105144, 254-977; 629, ADAD1, 2690, 105140, 186-1916; 629, ADAD1, 2691, 105141, 152-1849; 629, ADAD1, 2692, 105142, 197-1873; 630, ADAD2, 2697, 105147, 1-801; 630, ADAD2, 2695, 105145, 94-2091; 630, ADAD2, 2696, 105146, 53-1804; 631, ADAR, 2700, 105150, 1-3585; 631, ADAR, 2698, 105148, 981-3776; 631, ADAR, 2699, 105149, 201-3881; 632, ADARB1, 2704, 105154, 280-704; 632, ADARB1, 2708, 105158, 1-159; 632, ADARB1, 2701, 105151, 414-2519; 632, ADARB1, 2702, 105152, 16-2241; 632, ADARB1, 2703, 105153, 414-2558; 632, ADARB1, 2705, 105155, 414-2639; 632, ADARB1, 2706, 105156, 414-2639; 632, ADARB1, 2707, 105157, 414-2519; 632, ADARB1, 2709, 105159, 1-2190; 633, ADARB2, 2710, 105160, 236-661; 633, ADARB2, 2711, 105161, 5-751; 633, ADARB2, 2712, 105162, 327-2546; 634, ADAT1, 2714, 105164, 1-57; 634, ADAT1, 2715, 105165, 66-547; 634, ADAT1, 2716, 105166, 1-363; 634, ADAT1, 2717, 105167, 552-582; 634, ADAT1, 2718, 105168, 86-397; 634, ADAT1, 2719, 105169, 403-731; 634, ADAT1, 2720, 105170, 128-403; 634, ADAT1, 2713, 105163, 147-1655; 635, ADAT2, 2721, 105171, 16-591; 635, ADAT2, 2722, 105172, 586-1020; 636, ADAT3, 2723, 105173, 221-1324; 636, ADAT3, 2724, 105174, 776-983; 637, ADAL, 2728, 105178, 193-300; 637, ADAL, 2730, 105180, 1-332; 637, ADAL, 2725, 105175, 421-1224; 637, ADAL, 2726, 105176, 171-1157; 637, ADAL, 2727, 105177, 575-1561; 637, ADAL, 2729, 105179, 17-1084; 637, ADAL, 2731, 105181, 171-974; 638, ADK, 2732, 105182, 51-1139; 638, ADK, 2733, 105183, 188-1225; 638, ADK, 2734, 105184, 385-1368; 638, ADK, 2735, 105185, 95-1012; 639, AMPD1, 2736, 105186, 49-2379; 639, AMPD1, 2737, 105187, 17-2359; 640, AMPD2, 2741, 105191, 1-2584; 640, AMPD2, 2743, 105193, 1-585; 640, AMPD2, 2744, 105194, 315-575; 640, AMPD2, 2745, 105195, 423-426; 640, AMPD2, 2746, 105196, 262-572; 640, AMPD2, 2747, 105197, 1-252; 640, AMPD2, 2748, 105198, 510-513; 640, AMPD2, 2750, 105200, 1-695; 640, AMPD2, 2738, 105188, 361-3000; 640, AMPD2, 2739, 105189, 433-2829; 640, AMPD2, 2740, 105190, 35-2449; 640, AMPD2, 2742, 105192, 38-2320; 640, AMPD2, 2749, 105199, 495-3134; 640, AMPD2, 2751, 105201, 378-2663; 641, AMPD3, 2756, 105206, 244-576; 641, AMPD3, 2757, 105207, 180-980; 641, AMPD3, 2758, 105208, 1-333; 641, AMPD3, 2759, 105209, 81-719; 641, AMPD3, 2760, 105210, 1-273; 641, AMPD3, 2761, 105211, 48-2081; 641, AMPD3, 2752, 105202, 135-2438; 641, AMPD3, 2753, 105203, 342-2672; 641, AMPD3, 2754, 105204, 473-2299; 641, AMPD3, 2755, 105205, 291-2594; 641, AMPD3, 2762, 105212, 202-2526; 642, AHOY, 2763, 105213, 79-1377; 642, AHOY, 2764, 105214, 388-1602; 643, AHCYL1, 2765, 105215, 343-1794; 643, AHCYL1, 2766, 105216, 368-1960; 643, AHCYL1, 2767, 105217, 801-2252; 644, AHCYL2, 2770, 105220, 1-1556; 644, AHCYL2, 2771, 105221, 34-581; 644, AHCYL2, 2772, 105222, 373-599; 644, AHCYL2, 2768, 105218, 55-1890; 644, AHCYL2, 2769, 105219, 28-1860; 644, AHCYL2, 2773, 105223, 355-1881; 644, AHCYL2, 2774, 105224, 228-1754; 645, AMD1, 2775, 105225, 146-943; 645, AMD1, 2776, 105226, 442-1239; 645, AMD1, 2777, 105227, 323-967; 645, AMD1, 2779, 105229, 337-483; 645, AMD1, 2780, 105230, 1-18; 645, AMD1, 2781, 105231, 293-1090; 645, AMD1, 2778, 105228, 337-1341; 646, ADCY1, 2783, 105233, 380-1396; 646, ADCY1, 2784, 105234, 335-1351; 646, ADCY1, 2782, 105232, 23-3382; 647, ADCY10, 2788, 105238, 173-394; 647, ADCY10, 2789, 105239, 1-752; 647, ADCY10, 2785, 105235, 499-5055; 647, ADCY10, 2786, 105236, 186-5018; 647, ADCY10, 2787, 105237, 303-4676; 648, ADCY2, 2791, 105241, 131-431; 648, ADCY2, 2792, 105242, 1-230; 648, ADCY2, 2793, 105243, 27-3296; 648, ADCY2, 2790, 105240, 90-3365; 649, ADCY3, 2795, 105245, 200-3637; 649, ADCY3, 2796, 105246, 355-1801; 649, ADCY3, 2797, 105247, 1-894; 649, ADCY3, 2798, 105248, 98-561; 649, ADCY3, 2799, 105249, 1-595; 649, ADCY3, 2800, 105250, 237-572; 649, ADCY3, 2801, 105251, 1-2376; 649, ADCY3, 2802, 105252, 1-148; 649, ADCY3, 2794, 105244, 853-4287; 650, ADCY4, 2805, 105255, 96-1445; 650, ADCY4, 2806, 105256, 365-1015; 650, ADCY4, 2807, 105257, 1-411; 650, ADCY4, 2809, 105259, 468-575; 650, ADCY4, 2810, 105260, 214-559; 650, ADCY4, 2803, 105253, 115-3348; 650, ADCY4, 2804, 105254, 96-3329; 650, ADCY4, 2808, 105258, 119-3352; 651, ADCY5, 2812, 105262, 190-426; 651, ADCY5, 2813, 105263, 539-3298; 651, ADCY5, 2815, 105265, 313-1789; 651, ADCY5, 2816, 105266, 306-577; 651, ADCY5, 2811, 105261, 76-2811; 651, ADCY5, 2814, 105264, 1214-4999; 652, ADCY6, 2820, 105270, 135-382; 652, ADCY6, 2817, 105267, 696-4202; 652, ADCY6, 2818, 105268, 8-3355; 652, ADCY6, 2819, 105269, 137-3484; 653, ADCY7, 2823, 105273, 270-1571; 653, ADCY7, 2824, 105274, 345-670; 653, ADCY7, 2825, 105275, 104-1696; 653, ADCY7, 2826, 105276, 306-2510; 653, ADCY7, 2827, 105277, 447-497; 653, ADCY7, 2828, 105278, 336-578; 653, ADCY7, 2821, 105271, 269-3511; 653, ADCY7, 2822, 105272, 341-3583; 654, ADCY8, 2830, 105280, 1-3363; 654, ADCY8, 2831, 105281, 173-928; 654, ADCY8, 2829, 105279, 2094-5849; 655, ADCY9, 2833, 105283, 1-646; 655, ADCY9, 2834, 105284, 1-217; 655, ADCY9, 2835, 105285, 1-772; 655, ADCY9, 2832, 105282, 540-4601; 656, ADCYAP1, 2836, 105286, 120-650; 656, ADCYAP1, 2837, 105287, 279-809; 657, ADCYAP1R1, 2840, 105290, 27-1601; 657, ADCYAP1R1, 2842, 105292, 245-466; 657, ADCYAP1R1, 2843, 105293, 1-441; 657, ADCYAP1R1, 2838, 105288, 290-1696; 657, ADCYAP1R1, 2839, 105289, 72-1562; 657, ADCYAP1R1, 2841, 105291, 224-1567; 657, ADCYAP1R1, 2844, 105294, 290-1780; 658, AK1, 2845, 105295, 97-729; 658, AK1, 2848, 105298, 1-407; 658, AK1, 2849, 105299, 82-180; 658, AK1, 2850, 105300, 1-156; 658, AK1, 2846, 105296, 164-748; 658, AK1, 2847, 105297, 154-738; 659, AK2, 2853, 105303, 17-505; 659, AK2, 2854, 105304, 59-757; 659, AK2, 2855, 105305, 13-585; 659, AK2, 2856, 105306, 75-203; 659, AK2, 2857, 105307, 50-451; 659, AK2, 2858, 105308, 32-160; 659, AK2, 2859, 105309, 84-485; 659, AK2, 2851, 105301, 165-884; 659, AK2, 2852, 105302, 43-741; 660, AK3, 2860, 105310, 132-605; 660, AK3, 2861, 105311, 232-915; 660, AK3, 2862, 105312, 141-704; 660, AK3, 2863, 105313, 139-612; 661, AK4, 2867, 105317, 106-621; 661, AK4, 2864, 105314, 206-877; 661, AK4, 2865, 105315, 359-1030; 661, AK4, 2866, 105316, 248-919; 662, AK5, 2870, 105320, 262-495; 662, AK5, 2871, 105321, 124-653; 662, AK5, 2872, 105322, 1-188; 662, AK5, 2868, 105318, 1027-2637; 662, AK5, 2869, 105319, 264-1952; 663, AK6, 2875, 105325, 31-456; 663, AK6, 2876, 105326, 291-1085; 663, AK6, 2877, 105327, 337-1131; 663, AK6, 2878, 105328, 449-754; 663, AK6, 2879, 105329, 468-1262; 663, AK6, 2880, 105330, 1-330; 663, AK6, 2881, 105331, 202-582; 663, AK6, 2882, 105332, 374-966; 663, AK6, 2883, 105333, 14-157; 663, AK6, 2884, 105334, 182-588; 663, AK6, 2885, 105335, 263-761; 663, AK6, 2873, 105323, 339-848; 663, AK6, 2874, 105324, 53-571; 664, AK7, 2887, 105337, 1-457; 664, AK7, 2888, 105338, 23-346; 664, AK7, 2886, 105336, 45-2216; 665, AK8, 2889, 105339, 523-1962; 666, AK9, 2892, 105342, 83-2293; 666, AK9, 2893, 105343, 150-831; 666, AK9, 2895, 105345, 1-656; 666, AK9, 2896, 105346, 1-2249; 666, AK9, 2897, 105347, 1-937; 666, AK9, 2898, 105348, 1-577; 666, AK9, 2899, 105349, 211-988; 666, AK9, 2900, 105350, 1-411; 666, AK9, 2890, 105340, 83-1348; 666, AK9, 2891, 105341, 248-1258; 666, AK9, 2894, 105344, 78-5813; 667, ADSL, 2901, 105351, 32-1528; 667, ADSL, 2903, 105353, 42-425; 667, ADSL, 2904, 105354, 1-245; 667, ADSL, 2905, 105355, 28-522; 667, ADSL, 2906, 105356, 60-847; 667, ADSL, 2907, 105357, 1-1079; 667, ADSL, 2908, 105358, 30-479; 667, ADSL, 2909, 105359, 1-308; 667, ADSL, 2910, 105360, 1-236; 667, ADSL, 2911, 105361, 312-712; 667, ADSL, 2902, 105352, 57-1334; 667, ADSL, 2912, 105362, 60-1514; 668, ADSS, 2913, 105363, 318-1688; 669, ADSSL1, 2916, 105366, 192-416; 669, ADSSL1, 2917, 105367, 1-681; 669, ADSSL1, 2918, 105368, 154-345; 669, ADSSL1, 2919, 105369, 1-546; 669, ADSSL1, 2914, 105364, 86-1459; 669, ADSSL1, 2915, 105365, 160-1662; 670, AJAP1, 2920, 105370, 695-1930; 670, AJAP1, 2921, 105371, 382-1617; 671, ADGRA1, 2922, 105372, 130-1521; 671, ADGRA1, 2923, 105373, 437-2119; 671, ADGRA1, 2924, 105374, 1-3840; 672, ADGRA2, 2926, 105376, 1-571; 672, ADGRA2, 2925, 105375, 364-3729; 672, ADGRA2, 2927, 105377, 14-4030; 673, ADGRA3, 2931, 105381, 213-317; 673, ADGRA3, 2932, 105382, 443-733; 673, ADGRA3, 2928, 105378, 271-4236; 673, ADGRA3, 2929, 105379, 214-2064; 673, ADGRA3, 2930, 105380, 29-1174; 674, ADGRB1, 2934, 105384, 646-4125; 674, ADGRB1, 2933, 105383, 184-4938; 674, ADGRB1, 2935, 105385, 895-5649; 675, ADGRB2, 2938, 105388, 2-4666; 675, ADGRB2, 2939, 105389, 473-4873; 675, ADGRB2, 2940, 105390, 55-4554; 675, ADGRB2, 2941, 105391, 74-4576; 675, ADGRB2, 2942, 105392, 1-2541; 675, ADGRB2, 2943, 105393, 179-183; 675, ADGRB2, 2945, 105395, 92-1613; 675, ADGRB2, 2936, 105386, 343-5097; 675, ADGRB2, 2937, 105387, 355-5112; 675, ADGRB2, 2944, 105394, 39-4694; 676, ADGRB3, 2946, 105396, 127-2313; 676, ADGRB3, 2949, 105399, 96-532; 676, ADGRB3, 2950, 105400, 387-590; 676, ADGRB3, 2947, 105397, 822-5390; 676, ADGRB3, 2948, 105398, 1-4569; 677, ADGRD1, 2952, 105402, 216-686; 677, ADGRD1, 2954, 105404, 74-735; 677, ADGRD1, 2956, 105406, 1856-2893; 677, ADGRD1, 2951, 105401, 560-3184; 677, ADGRD1, 2953, 105403, 1-1182; 677, ADGRD1, 2955, 105405, 31-2751; 678, ADGRD2, 2958, 105408, 1-126; 678, ADGRD2, 2957, 105407, 1-2917; 679, ADGRE1, 2964, 105414, 1-956; 679, ADGRE1, 2959, 105409, 44-2509; 679, ADGRE1, 2960, 105410, 38-2698; 679, ADGRE1, 2961, 105411, 31-2634; 679, ADGRE1, 2962, 105412, 39-2276; 679, ADGRE1, 2963, 105413, 33-2162; 680, ADGRE2, 2966, 105416, 86-1225; 680, ADGRE2, 2969, 105419, 1-992; 680, ADGRE2, 2971, 105421, 87-2582; 680, ADGRE2, 2965, 105415, 453-2924; 680, ADGRE2, 2967, 105417, 87-2384; 680, ADGRE2, 2968, 105418, 1-2046; 680, ADGRE2, 2970, 105420, 1-2325; 680, ADGRE2, 2972, 105422, 1-2439; 680, ADGRE2, 2973, 105423, 1-2193; 681, ADGRE3, 2976, 105426, 75-1655; 681, ADGRE3, 2977, 105427, 229-402; 681, ADGRE3, 2978, 105428, 589-1902; 681, ADGRE3, 2974, 105424, 102-2060; 681, ADGRE3, 2975, 105425, 149-1951; 682, ADGRE5, 2982, 105432, 109-572; 682, ADGRE5, 2983, 105433, 109-578; 682, ADGRE5, 2984, 105434, 81-573; 682, ADGRE5, 2979, 105429, 81-2588; 682, ADGRE5, 2980, 105430, 90-2450; 682, ADGRE5, 2981, 105431, 369-2597; 683, ADGRF1, 2985, 105435, 1-2142; 683, ADGRF1, 2988, 105438, 1-483; 683, ADGRF1, 2989, 105439, 1-412; 683, ADGRF1, 2986, 105436, 148-804; 683, ADGRF1, 2987, 105437, 217-2949; 684, ADGRF2, 2992, 105442, 279-2201; 684, ADGRF2, 2990, 105440, 1-2127; 684, ADGRF2, 2991, 105441, 50-1978; 684, ADGRF2, 2993, 105443, 277-2205; 685, ADGRF3, 2997, 105447, 510-872; 685, ADGRF3, 2999, 105449, 313-575; 685, ADGRF3, 2994, 105444, 1-3240; 685, ADGRF3, 2995, 105445, 584-3205; 685, ADGRF3, 2996, 105446, 54-3047; 685, ADGRF3, 2998, 105448, 584-3205; 686, ADGRF4, 3002, 105452, 1-2259; 686, ADGRF4, 3000, 105450, 259-2346; 686, ADGRF4, 3001, 105451, 171-2258; 687, ADGRF5, 3003, 105453, 235-4275; 687, ADGRF5, 3004, 105454, 290-4330; 688, ADGRG1, 3008, 105458, 272-554; 688, ADGRG1, 3009, 105459, 195-571; 688, ADGRG1, 3010, 105460, 143-536; 688, ADGRG1, 3011, 105461, 347-590; 688, ADGRG1, 3012, 105462, 211-567; 688, ADGRG1, 3013, 105463, 530-548; 688, ADGRG1, 3014, 105464, 260-553; 688, ADGRG1, 3015, 105465, 69-507; 688, ADGRG1, 3016, 105466, 282-572; 688, ADGRG1, 3017, 105467, 351-944; 688, ADGRG1, 3018, 105468, 348-641; 688, ADGRG1, 3019, 105469, 294-575; 688, ADGRG1, 3020, 105470, 246-594; 688, ADGRG1, 3021, 105471, 79-582; 688, ADGRG1, 3022, 105472, 333-568; 688, ADGRG1, 3024, 105474, 271-565; 688, ADGRG1, 3025, 105475, 167-460; 688, ADGRG1, 3027, 105477, 267-551; 688, ADGRG1, 3028, 105478, 93-594; 688, ADGRG1, 3029, 105479, 303-574; 688, ADGRG1, 3030, 105480, 413-576; 688, ADGRG1, 3031, 105481, 144-622; 688, ADGRG1, 3032, 105482, 254-586; 688, ADGRG1, 3033, 105483, 342-553; 688, ADGRG1, 3034, 105484, 249-1016; 688, ADGRG1, 3035, 105485, 346-699; 688, ADGRG1, 3036, 105486, 394-855; 688, ADGRG1, 3037, 105487, 85-586; 688, ADGRG1, 3038, 105488, 181-602; 688, ADGRG1, 3039, 105489, 361-487; 688, ADGRG1, 3040, 105490, 224-578; 688, ADGRG1, 3041, 105491, 141-533; 688, ADGRG1, 3042, 105492, 322-591; 688, ADGRG1, 3044, 105494, 343-690; 688, ADGRG1, 3045, 105495, 184-560; 688, ADGRG1, 3046, 105496, 1-561; 688, ADGRG1, 3047, 105497, 415-563; 688, ADGRG1, 3048, 105498, 272-593;

688, ADGRG1, 3050, 105500, 246-555; 688, ADGRG1, 3051, 105501, 247-478; 688, ADGRG1, 3052, 105502, 265-618; 688, ADGRG1, 3053, 105503, 254-592; 688, ADGRG1, 3054, 105504, 392-560; 688, ADGRG1, 3055, 105505, 327-579; 688, ADGRG1, 3056, 105506, 87-545; 688, ADGRG1, 3057, 105507, 226-525; 688, ADGRG1, 3058, 105508, 96-451; 688, ADGRG1, 3060, 105510, 282-575; 688, ADGRG1, 3061, 105511, 157-523; 688, ADGRG1, 3062, 105512, 204-547; 688, ADGRG1, 3063, 105513, 109-601; 688, ADGRG1, 3064, 105514, 138-734; 688, ADGRG1, 3065, 105515, 232-563; 688, ADGRG1, 3066, 105516, 354-558; 688, ADGRG1, 3067, 105517, 207-640; 688, ADGRG1, 3068, 105518, 451-937; 688, ADGRG1, 3069, 105519, 311-563; 688, ADGRG1, 3005, 105455, 428-2491; 688, ADGRG1, 3006, 105456, 332-2410; 688, ADGRG1, 3007, 105457, 307-2370; 688, ADGRG1, 3023, 105473, 175-2256; 688, ADGRG1, 3026, 105476, 533-2596; 688, ADGRG1, 3043, 105493, 352-2415; 688, ADGRG1, 3049, 105499, 214-2295; 688, ADGRG1, 3059, 105509, 349-2412; 689, ADGRG2, 3070, 105520, 44-2740; 689, ADGRG2, 3071, 105521, 243-2939; 689, ADGRG2, 3072, 105522, 70-3081; 689, ADGRG2, 3073, 105523, 165-3128; 689, ADGRG2, 3074, 105524, 67-3111; 689, ADGRG2, 3075, 105525, 165-3152; 689, ADGRG2, 3076, 105526, 165-3218; 689, ADGRG2, 3077, 105527, 243-3143; 689, ADGRG2, 3078, 105528, 243-3224; 689, ADGRG2, 3079, 105529, 243-3248; 690, ADGRG3, 3081, 105531, 262-1551; 690, ADGRG3, 3082, 105532, 32-979; 690, ADGRG3, 3083, 105533, 72-281; 690, ADGRG3, 3080, 105530, 162-1811; 691, ADGRG4, 3084, 105534, 181-9423; 691, ADGRG4, 3085, 105535, 151-8778; 691, ADGRG4, 3086, 105536, 292-9534; 692, ADGRG5, 3089, 105539, 54-719; 692, ADGRG5, 3087, 105537, 320-1906; 692, ADGRG5, 3088, 105538, 524-2110; 693, ADGRG6, 3094, 105544, 116-540; 693, ADGRG6, 3095, 105545, 1-311; 693, ADGRG6, 3096, 105546, 1-407; 693, ADGRG6, 3097, 105547, 121-844; 693, ADGRG6, 3090, 105540, 477-4142; 693, ADGRG6, 3091, 105541, 402-3983; 693, ADGRG6, 3092, 105542, 472-4140; 693, ADGRG6, 3093, 105543, 402-4154; 694, ADGRG7, 3099, 105549, 270-1778; 694, ADGRG7, 3098, 105548, 269-2662; 695, ADGRL1, 3102, 105552, 1-791; 695, ADGRL1, 3103, 105553, 1-729; 695, ADGRL1, 3104, 105554, 1-675; 695, ADGRL1, 3100, 105550, 299-4723; 695, ADGRL1, 3101, 105551, 281-4690; 696, ADGRL2, 3110, 105560, 646-4800; 696, ADGRL2, 3113, 105563, 646-4941; 696, ADGRL2, 3116, 105566, 1-1414; 696, ADGRL2, 3117, 105567, 1-4055; 696, ADGRL2, 3118, 105568, 217-4512; 696, ADGRL2, 3105, 105555, 217-4428; 696, ADGRL2, 3106, 105556, 182-4393; 696, ADGRL2, 3107, 105557, 217-3588; 696, ADGRL2, 3108, 105558, 217-3750; 696, ADGRL2, 3109, 105559, 217-4596; 696, ADGRL2, 3111, 105561, 646-5031; 696, ADGRL2, 3112, 105562, 646-5070; 696, ADGRL2, 3114, 105564, 646-5025; 696, ADGRL2, 3115, 105565, 646-4896; 697, ADGRL3, 3119, 105569, 1-4743; 697, ADGRL3, 3120, 105570, 107-4693; 697, ADGRL3, 3121, 105571, 130-4158; 697, ADGRL3, 3122, 105572, 1-4539; 697, ADGRL3, 3125, 105575, 96-3947; 697, ADGRL3, 3126, 105576, 174-4100; 697, ADGRL3, 3127, 105577, 130-4185; 697, ADGRL3, 3128, 105578, 174-3869; 697, ADGRL3, 3129, 105579, 1-4512; 697, ADGRL3, 3130, 105580, 1-2755; 697, ADGRL3, 3131, 105581, 174-4073; 697, ADGRL3, 3132, 105582, 96-3920; 697, ADGRL3, 3133, 105583, 1-4716; 697, ADGRL3, 3134, 105584, 1-4038; 697, ADGRL3, 3123, 105573, 330-4739; 697, ADGRL3, 3124, 105574, 748-4470; 698, ADGRL4, 3136, 105586, 1-450; 698, ADGRL4, 3135, 105585, 65-2137; 699, ADGRV1, 3139, 105589, 1-4826; 699, ADGRV1, 3140, 105590, 1-3166; 699, ADGRV1, 3141, 105591, 139-582; 699, ADGRV1, 3137, 105587, 97-19017; 699, ADGRV1, 3138, 105588, 285-6188; 700, AMIGO1, 3142, 105592, 385-1866; 700, AMIGO1, 3143, 105593, 351-1832; 701, AMIGO2, 3144, 105594, 468-2036; 701, AMIGO2, 3145, 105595, 656-2224; 701, AMIGO2, 3146, 105596, 352-1920; 702, AMIGO3, 3147, 105597, 231-1745; 703, AMICA1, 3151, 105601, 517-1434; 703, AMICA1, 3152, 105602, 110-574; 703, AMICA1, 3153, 105603, 230-591; 703, AMICA1, 3154, 105604, 173-373; 703, AMICA1, 3155, 105605, 26-1177; 703, AMICA1, 3148, 105598, 443-1597; 703, AMICA1, 3149, 105599, 175-1359; 703, AMICA1, 3150, 105600, 156-1223; 704, ADRM1, 3158, 105608, 312-735; 704, ADRM1, 3159, 105609, 156-1262; 704, ADRM1, 3156, 105606, 156-1379; 704, ADRM1, 3157, 105607, 206-1429; 705, APMAP, 3161, 105611, 1-1229; 705, APMAP, 3160, 105610, 292-1542; 706, AAMDC, 3162, 105612, 148-591; 706, AAMDC, 3165, 105615, 49-474; 706, AAMDC, 3166, 105616, 149-562; 706, AAMDC, 3168, 105618, 112-384; 706, AAMDC, 3169, 105619, 147-428; 706, AAMDC, 3170, 105620, 61-567; 706, AAMDC, 3171, 105621, 1-156; 706, AAMDC, 3172, 105622, 99-542; 706, AAMDC, 3163, 105613, 117-485; 706, AAMDC, 3164, 105614, 174-542; 706, AAMDC, 3167, 105617, 91-357; 707, ADIRF, 3174, 105624, 114-229; 707, ADIRF, 3173, 105623, 354-584; 707, ADIRF, 3175, 105625, 56-286; 708, ADIG, 3176, 105626, 46-225; 708, ADIG, 3177, 105627, 1-539; 708, ADIG, 3178, 105628, 57-299; 708, ADIG, 3179, 105629, 57-299; 709, ADIPOR1, 3181, 105631, 175-690; 709, ADIPOR1, 3182, 105632, 263-879; 709, ADIPOR1, 3183, 105633, 260-1058; 709, ADIPOR1, 3180, 105630, 300-1427; 710, ADIPOR2, 3184, 105634, 252-1412; 711, ADIPOQ, 3185, 105635, 69-803; 711, ADIPOQ, 3186, 105636, 106-840; 712, ADNP2, 3188, 105638, 310-823; 712, ADNP2, 3189, 105639, 194-880; 712, ADNP2, 3190, 105640, 1-80; 712, ADNP2, 3191, 105641, 1-247; 712, ADNP2, 3187, 105637, 456-3851; 713, ADPGK, 3196, 105646, 86-427; 713, ADPGK, 3197, 105647, 1-613; 713, ADPGK, 3198, 105648, 1-174; 713, ADPGK, 3199, 105649, 332-795; 713, ADPGK, 3200, 105650, 1-80; 713, ADPGK, 3192, 105642, 95-1585; 713, ADPGK, 3193, 105643, 1-669; 713, ADPGK, 3194, 105644, 25-261; 713, ADPGK, 3195, 105645, 40-276; 713, ADPGK, 3201, 105651, 41-277; 714, ADPRM, 3204, 105654, 28-912; 714, ADPRM, 3202, 105652, 92-1120; 714, ADPRM, 3203, 105653, 72-689; 715, ADPRH, 3208, 105658, 608-984; 715, ADPRH, 3205, 105655, 299-1372; 715, ADPRH, 3206, 105656, 106-1179; 715, ADPRH, 3207, 105657, 299-1372; 715, ADPRH, 3209, 105659, 1406-2479; 716, ARF1, 3210, 105660, 144-689; 716, ARF1, 3211, 105661, 263-808; 716, ARF1, 3212, 105662, 229-774; 717, ARF3, 3215, 105665, 425-576; 717, ARF3, 3216, 105666, 179-485; 717, ARF3, 3218, 105668, 437-557; 717, ARF3, 3213, 105663, 336-881; 717, ARF3, 3214, 105664, 262-696; 717, ARF3, 3217, 105667, 240-785; 718, ARF4, 3220, 105670, 186-647; 718, ARF4, 3221, 105671, 666-732; 718, ARF4, 3222, 105672, 261-641; 718, ARF4, 3223, 105673, 227-406; 718, ARF4, 3224, 105674, 331-546; 718, ARF4, 3219, 105669, 269-811; 719, ARF5, 3226, 105676, 97-546; 719, ARF5, 3225, 105675, 155-697; 720, ARF6, 3227, 105677, 548-1075; 721, ARFGAP1, 3231, 105681, 110-502; 721, ARFGAP1, 3232, 105682, 342-579; 721, ARFGAP1, 3233, 105683, 174-905; 721, ARFGAP1, 3234, 105684, 113-572; 721, ARFGAP1, 3236, 105686, 212-995; 721, ARFGAP1, 3238, 105688, 227-1040; 721, ARFGAP1, 3239, 105689, 206-572; 721, ARFGAP1, 3240, 105690, 241-1263; 721, ARFGAP1, 3241, 105691, 1-314; 721, ARFGAP1, 3228, 105678, 61-1305; 721, ARFGAP1, 3229, 105679, 93-1304; 721, ARFGAP1, 3230, 105680, 141-1361; 721, ARFGAP1, 3235, 105685, 190-1275; 721, ARFGAP1, 3237, 105687, 379-1260; 722, ARFGAP2, 3242, 105692, 273-1754; 722, ARFGAP2, 3243, 105693, 1-51; 722, ARFGAP2, 3244, 105694, 15-730; 722, ARFGAP2, 3245, 105695, 1-54; 722, ARFGAP2, 3246, 105696, 18-1000; 722, ARFGAP2, 3247, 105697, 27-296; 722, ARFGAP2, 3248, 105698, 15-299; 722, ARFGAP2, 3249, 105699, 273-485; 722, ARFGAP2, 3250, 105700, 1-709; 722, ARFGAP2, 3251, 105701, 28-850; 722, ARFGAP2, 3253, 105703, 1-400; 722, ARFGAP2, 3254, 105704, 30-785; 722, ARFGAP2, 3255, 105705, 16-534; 722, ARFGAP2, 3256, 105706, 27-359; 722, ARFGAP2, 3257, 105707, 1-360; 722, ARFGAP2, 3258, 105708, 7-474; 722, ARFGAP2, 3259, 105709, 1-213; 722, ARFGAP2, 3260, 105710, 273-1430; 722, ARFGAP2, 3252, 105702, 230-1795; 723, ARFGAP3, 3263, 105713, 87-542; 723, ARFGAP3, 3264, 105714, 1-817; 723, ARFGAP3, 3265, 105715, 226-501; 723, ARFGAP3, 3261, 105711, 221-1771; 723, ARFGAP3, 3262, 105712, 58-1476; 724, ARFGEF1, 3267, 105717, 1-3838; 724, ARFGEF1, 3268, 105718, 218-571; 724, ARFGEF1, 3269, 105719, 1-578; 724, ARFGEF1, 3270, 105720, 1-2477; 724, ARFGEF1, 3266, 105716, 391-5940; 725, ARFGEF2, 3271, 105721, 1-5358; 726, ARFIP1, 3272, 105722, 300-1421; 726, ARFIP1, 3273, 105723, 252-1277; 726, ARFIP1, 3274, 105724, 131-1156; 726, ARFIP1, 3275, 105725, 165-1286; 726, ARFIP1, 3276, 105726, 163-744; 726, ARFIP1, 3277, 105727, 31-1056; 727, ARFIP2, 3282, 105732, 127-735; 727, ARFIP2, 3283, 105733, 97-576; 727, ARFIP2, 3284, 105734, 292-1416; 727, ARFIP2, 3278, 105728, 85-1110; 727, ARFIP2, 3279, 105729, 249-1274; 727, ARFIP2, 3280, 105730, 151-921; 727, ARFIP2, 3281, 105731, 220-1131; 728, ARFRP1, 3285, 105735, 208-672; 728, ARFRP1, 3286, 105736, 57-578; 728, ARFRP1, 3287, 105737, 31-636; 728, ARFRP1, 3288, 105738, 51-656; 728, ARFRP1, 3289, 105739, 132-497; 728, ARFRP1, 3290, 105740, 149-514; 728, ARFRP1, 3291, 105741, 154-759; 728, ARFRP1, 3292, 105742, 709-1173; 729, ARL1, 3294, 105744, 102-509; 729, ARL1, 3296, 105746, 160-318; 729, ARL1, 3298, 105748, 109-693; 729, ARL1, 3299, 105749, 118-312; 729, ARL1, 3300, 105750, 540-590; 729, ARL1, 3293, 105743, 176-721; 729, ARL1, 3295, 105745, 132-626; 729, ARL1, 3297, 105747, 234-728; 730, ARL10, 3302, 105752, 1-145; 730, ARL10, 3303, 105753, 1-240; 730, ARL10, 3301, 105751, 97-831; 731, ARL11, 3304, 105754, 336-926; 732, ARL13A, 3305, 105755, 1-489; 732, ARL13A, 3308, 105758, 1-373; 732, ARL13A, 3306, 105756, 114-884; 732, ARL13A, 3307, 105757, 117-989; 733, ARL13B, 3310, 105760, 235-504; 733, ARL13B, 3312, 105762, 255-425; 733, ARL13B, 3309, 105759, 283-1248; 733, ARL13B, 3311, 105761, 276-1562; 733, ARL13B, 3313, 105763, 270-1556; 733, ARL13B, 3314, 105764, 524-1501; 734, ARL14, 3315, 105765, 189-767; 735, ARL14EP, 3317, 105767, 2914-3417; 735, ARL14EP, 3316, 105766, 216-998; 736, ARL14EPL, 3319, 105769, 1-459; 736, ARL14EPL, 3318, 105768, 285-743; 737, ARL15, 3320, 105770, 98-574; 737, ARL15, 3322, 105772, 555-632; 737, ARL15, 3323, 105773, 95-709; 737, ARL15, 3321, 105771, 95-709; 738, ARL16, 3325, 105775, 81-362; 738, ARL16, 3326, 105776, 382-663; 738, ARL16, 3327, 105777, 191-526; 738, ARL16, 3328, 105778, 131-412; 738, ARL16, 3329, 105779, 1-147; 738, ARL16, 3330, 105780, 143-478; 738, ARL16, 3332, 105782, 11-532; 738, ARL16, 3324, 105774, 100-693; 738, ARL16, 3331, 105781, 100-693; 739, ARL17A, 3333, 105783, 140-565; 739, ARL17A, 3336, 105786, 75-338; 739, ARL17A, 3337, 105787, 69-356; 739, ARL17A, 3338, 105788, 140-406; 739, ARL17A, 3334, 105784, 100-633; 739, ARL17A, 3335, 105785, 88-465; 740, ARL17B, 3341, 105791, 1-335; 740, ARL17B, 3342, 105792, 69-356; 740, ARL17B, 3344, 105794, 75-338; 740, ARL17B, 3345, 105795, 61-606; 740, ARL17B, 3346, 105796, 140-406; 740, ARL17B, 3348, 105798, 140-565; 740, ARL17B, 3349, 105799, 140-565; 740, ARL17B, 3354, 105804, 140-565; 740, ARL17B, 3355, 105805, 61-606; 740, ARL17B, 3356, 105806, 69-356; 740, ARL17B, 3357, 105807, 75-338; 740, ARL17B, 3358, 105808, 1-335; 740, ARL17B, 3361, 105811, 61-606; 740, ARL17B, 3362, 105812, 69-356; 740, ARL17B, 3363, 105813, 1-335; 740, ARL17B, 3364, 105814, 75-338; 740, ARL17B, 3339, 105789, 88-465; 740, ARL17B, 3340, 105790, 107-640; 740, ARL17B, 3343, 105793, 107-484; 740, ARL17B, 3347, 105797, 140-517; 740, ARL17B, 3350, 105800, 111-644; 740, ARL17B, 3351, 105801, 88-465; 740, ARL17B, 3352, 105802, 88-465; 740, ARL17B, 3353, 105803, 107-637; 740, ARL17B, 3359, 105809, 95-472; 740, ARL17B, 3360, 105810, 107-484; 741, ARL2, 3365, 105815, 96-650; 741, ARL2, 3366, 105816, 17-490; 741, ARL2, 3367, 105817, 29-583; 742, ARL2BP, 3369, 105819, 1-514; 742, ARL2BP, 3370, 105820, 19-390; 742, ARL2BP, 3368, 105818, 271-762; 743, ARL3, 3371, 105821, 133-681; 744, ARL4A, 3377, 105827, 694-845; 744, ARL4A, 3372, 105822, 226-828; 744, ARL4A, 3373, 105823, 372-974; 744, ARL4A, 3374, 105824, 533-1135; 744, ARL4A, 3375, 105825, 223-825; 744, ARL4A, 3376, 105826, 181-783; 745, ARL4C, 3378, 105828, 15-620; 745, ARL4C, 3379, 105829, 468-1046; 746, ARL4D, 3380, 105830, 208-813; 747, ARL5A, 3382, 105832, 170-403; 747, ARL5A, 3381, 105831, 313-852; 747, ARL5A, 3383, 105833, 119-547; 747, ARL5A, 3384, 105834, 146-574; 748, ARL5B, 3385, 105835, 234-773; 749, ARL5C, 3387, 105837, 1-300; 749, ARL5C, 3386, 105836, 1-540; 750, ARL6, 3391, 105841, 532-894; 750, ARL6, 3393, 105843, 1-164; 750, ARL6, 3394, 105844, 1-444; 750, ARL6, 3388, 105838, 584-1144; 750, ARL6, 3389, 105839, 544-1104; 750, ARL6, 3390, 105840, 584-1144; 750, ARL6, 3392, 105842, 478-1038; 751, ARL6IP1, 3397, 105847, 88-391; 751, ARL6IP1, 3398, 105848, 82-381; 751, ARL6IP1, 3399, 105849, 82-348; 751, ARL6IP1, 3395, 105845, 213-824; 751, ARL6IP1, 3396, 105846, 278-802; 752, ARL6IP4, 3401, 105851, 1-546; 752, ARL6IP4, 3403, 105853, 1-651; 752, ARL6IP4, 3404, 105854, 77-766; 752, ARL6IP4, 3406, 105856, 135-791; 752, ARL6IP4, 3407, 105857, 122-634; 752, ARL6IP4, 3409, 105859, 210-857; 752, ARL6IP4, 3410, 105860, 167-799; 752, ARL6IP4, 3411, 105861, 198-1119; 752, ARL6IP4, 3400, 105850, 146-1411; 752, ARL6IP4, 3402, 105852, 15-1214; 752, ARL6IP4, 3405, 105855, 405-1085; 752, ARL6IP4, 3408, 105858, 17-1258; 752, ARL6IP4, 3412, 105862, 146-1354; 753, ARL6IP5, 3414, 105864, 7-186; 753, ARL6IP5, 3415, 105865, 34-315; 753, ARL6IP5, 3416, 105866, 28-294; 753, ARL6IP5, 3413, 105863, 105-671; 754, ARL6IP6, 3418, 105868, 1-116; 754, ARL6IP6, 3419, 105869, 1-201; 754, ARL6IP6, 3417, 105867, 712-1392; 755, ARL8A, 3421, 105871, 172-615; 755, ARL8A, 3420, 105870, 170-730; 756, ARL8B, 3423, 105873, 3-314; 756, ARL8B, 3425, 105875, 46-354; 756, ARL8B, 3422, 105872, 247-807; 756, ARL8B, 3424, 105874, 171-662; 756, ARL8B, 3426, 105876, 222-782; 757, ARL9, 3427, 105877, 315-686; 758, ADPRHL1, 3430, 105880, 312-839; 758, ADPRHL1, 3431, 105881, 88-5991; 758, ADPRHL1, 3428, 105878, 177-995; 758, ADPRHL1, 3429, 105879, 88-1152; 759, ADPRHL2, 3432, 105882, 31-1122; 760, ART1, 3433, 105883, 102-1085; 761, ART3, 3437, 105887, 181-502; 761, ART3, 3438, 105888, 157-545; 761, ART3, 3439, 105889, 1-352; 761, ART3, 3440, 105890, 197-801; 761, ART3, 3441, 105891, 37-560; 761, ART3, 3434, 105884, 120-1256; 761, ART3, 3435, 105885, 131-1234; 761, ART3, 3436, 105886, 120-1289; 762, ART4, 3443, 105893, 1-822; 762, ART4, 3444, 105894, 1-198; 762, ART4, 3445, 105895, 1-126; 762, ART4, 3442, 105892, 383-1327; 763, ART5, 3449, 105899, 1-793; 763, ART5, 3450, 105900, 1-455; 763, ART5, 3446, 105896, 142-1017; 763, ART5, 3447, 105897, 131-850; 763, ART5, 3448, 105898, 394-1269; 764, ADRBK1, 3452, 105902, 220-1446; 764, ADRBK1, 3451, 105901, 291-2360; 765, ADRBK2, 3454, 105904, 1-138; 765, ADRBK2, 3455, 105905, 89-1252; 765, ADRBK2, 3453, 105903, 193-2259; 766, ADRA1A, 3463, 105913, 8-1291; 766, ADRA1A, 3456, 105906, 437-1837; 766, ADRA1A, 3457, 105907, 201-1568; 766, ADRA1A, 3458, 105908, 437-1465; 766, ADRA1A, 3459, 105909, 1025-2425; 766, ADRA1A, 3460, 105910, 437-1726; 766, ADRA1A, 3461, 105911, 437-1864; 766, ADRA1A, 3462, 105912, 437-1411; 766, ADRA1A, 3464, 105914, 437-1411; 767, ADRA1B, 3465, 105915, 124-1686; 768, ADRA1D, 3466, 105916, 118-1836; 769, ADRA2A, 3467, 105917, 835-2232; 770, ADRA2B, 3468, 105918, 97-1449; 771, ADRA2C, 3470, 105920, 260-1384; 771, ADRA2C, 3469, 105919, 210-1598; 772, ADRB1, 3471, 105921, 78-1511; 773, ADRB2, 3472, 105922, 1588-2829; 774, ADRB3, 3473, 105923, 497-1723; 774, ADRB3, 3474, 105924, 198-1424; 775, ACD, 3477, 105927, 1-547; 775, ACD, 3478, 105928, 1-51; 775, ACD, 3479, 105929, 20-1348; 775, ACD, 3480, 105930, 13-1389; 775, ACD, 3475, 105925, 333-1958; 775, ACD, 3476, 105926, 266-1900; 775, ACD, 3481, 105931, 338-1972; 776, ADM, 3483, 105933, 470-886; 776, ADM, 3484, 105934, 175-426; 776, ADM, 3485, 105935, 164-583; 776, ADM, 3486, 105936, 325-576; 776, ADM, 3489, 105939, 765-1118; 776, ADM, 3482, 105932, 572-1129; 776, ADM, 3487, 105937, 164-721; 776, ADM, 3488, 105938, 618-1175; 777, ADM2, 3490, 105940, 52-498; 777, ADM2, 3491, 105941, 293-739; 778, ADM5, 3492, 105942, 1175-1636; 779, AGER, 3494, 105944, 16-715; 779, AGER, 3495, 105945, 264-665; 779, AGER, 3498, 105948, 404-1288; 779, AGER, 3504, 105954, 14-716; 779, AGER, 3506, 105956, 14-716; 779, AGER, 3508, 105958, 16-1044; 779, AGER, 3509, 105959, 16-715; 779, AGER, 3510, 105960, 14-716; 779, AGER, 3513, 105963, 16-715; 779, AGER, 3514, 105964, 16-1044; 779, AGER, 3515, 105965, 14-716; 779, AGER, 3516, 105966, 16-715; 779, AGER, 3520, 105970, 14-716; 779, AGER, 3521, 105971, 25-1068; 779, AGER, 3522, 105972, 25-1068; 779, AGER, 3524, 105974, 16-715; 779, AGER, 3525, 105975, 16-715; 779, AGER, 3526, 105976, 16-715; 779, AGER, 3527, 105977, 14-716; 779, AGER, 3530, 105980, 14-716; 779, AGER, 3532, 105982, 101-487; 779, AGER, 3533, 105983, 264-665; 779, AGER, 3534, 105984, 264-665; 779, AGER, 3535, 105985, 101-487; 779, AGER, 3536, 105986, 101-1192; 779, AGER, 3537, 105987, 101-1363; 779, AGER, 3538, 105988, 264-665; 779, AGER, 3540, 105990, 101-487; 779, AGER, 3542, 105992, 404-1288; 779, AGER, 3543, 105993, 101-487; 779, AGER, 3544, 105994, 101-562; 779, AGER, 3545, 105995, 264-665; 779, AGER, 3546, 105996, 404-1288; 779, AGER, 3547, 105997, 101-562; 779, AGER, 3548, 105998, 101-487; 779, AGER, 3551, 106001, 101-562; 779, AGER, 3552, 106002, 101-1192; 779, AGER, 3554, 106004, 404-1288; 779, AGER, 3555, 106005, 404-1288; 779, AGER, 3556, 106006, 101-562; 779, AGER, 3558, 106008, 404-1288; 779, AGER, 3559, 106009, 264-665; 779, AGER, 3560, 106010, 264-665; 779, AGER, 3562, 106012, 101-1363; 779, AGER, 3563, 106013, 404-1288; 779, AGER, 3564, 106014, 101-562; 779, AGER, 3565, 106015, 101-562; 779, AGER, 3566, 106016, 101-487; 779, AGER, 3568, 106018, 101-487; 779, AGER, 3569, 106019, 101-562; 779, AGER, 3493, 105943, 25-1068; 779, AGER, 3496, 105946, 16-1044; 779, AGER, 3497, 105947, 101-1363; 779, AGER, 3499, 105949, 103-1317; 779, AGER, 3500, 105950, 25-1068; 779, AGER, 3501, 105951, 16-1044; 779, AGER, 3502, 105952, 16-1044; 779, AGER, 3503, 105953, 101-1192; 779, AGER, 3505, 105955, 16-1044; 779, AGER, 3507, 105957, 16-1044; 779, AGER, 3511, 105961, 103-1317; 779, AGER, 3512, 105962, 103-1317; 779, AGER, 3517, 105967, 25-1068; 779, AGER, 3518, 105968, 25-1068; 779, AGER, 3519, 105969, 103-1317; 779, AGER, 3523, 105973, 103-1317; 779, AGER, 3528, 105978, 25-1068; 779, AGER, 3529, 105979, 103-1317; 779, AGER, 3531, 105981, 103-1317; 779, AGER, 3539, 105989, 101-1192; 779, AGER, 3541, 105991, 101-1363; 779, AGER, 3549, 105999, 101-1363; 779, AGER, 3550, 106000, 101-1363; 779, AGER, 3553, 106003, 101-1192; 779, AGER, 3557, 106007, 101-1192; 779, AGER, 3561, 106011, 101-1192; 779, AGER, 3567, 106017, 101-1363; 780, AVIL, 3571, 106021, 96-568; 780, AVIL, 3572, 106022, 19-249; 780, AVIL, 3570, 106020, 432-2891; 781, AEBP1, 3574, 106024, 1-315; 781, AEBP1, 3576, 106026, 1-210; 781, AEBP1, 3577, 106027, 80-566; 781, AEBP1, 3578, 106028, 1-200; 781, AEBP1, 3579, 106029, 1-751; 781, AEBP1, 3580, 106030, 1-165; 781, AEBP1, 3573, 106023, 306-3782; 781, AEBP1, 3575, 106025, 69-2270; 782, AEBP2, 3583, 106033, 1-423; 782, AEBP2, 3585, 106035, 76-900; 782, AEBP2, 3586, 106036, 189-518; 782, AEBP2, 3587, 106037, 1-393; 782, AEBP2, 3581, 106031, 2-1513; 782, AEBP2, 3582, 106032, 125-1030; 782, AEBP2, 3584, 106034, 27-1580; 783, N/A, 3588, 106038, 1413-2432; 784, N/A, 3589, 106039, 1-375; 785, N/A, 3590, 106040, 699-1061; 786, N/A, 3591, 106041, 51-548; 786, N/A, 3592, 106042, 1-459; 787, AFF1, 3595, 106045, 228-1478; 787, AFF1, 3596, 106046, 228-638; 787, AFF1, 3597, 106047, 1-582; 787, AFF1, 3598, 106048, 307-463; 787, AFF1, 3599, 106049, 267-1486; 787, AFF1, 3600, 106050, 13-3630; 787, AFF1, 3593, 106043, 421-4053; 787, AFF1, 3594, 106044, 276-3932; 788, AFF2, 3601, 106051, 91-2949; 788, AFF2, 3602, 106052, 391-4221; 788, AFF2, 3603, 106053, 52-3882; 788, AFF2, 3604, 106054, 90-1373; 788, AFF2, 3605, 106055, 480-4415; 789, AFF3, 3609, 106059, 125-591; 789, AFF3, 3610, 106060, 248-545; 789, AFF3, 3611, 106061, 237-702; 789, AFF3, 3612, 106062, 158-543; 789, AFF3, 3613, 106063, 77-559; 789, AFF3, 3614, 106064, 26-574; 789, AFF3, 3615, 106065, 210-551; 789, AFF3, 3616, 106066, 1-538; 789, AFF3, 3617, 106067, 476-528; 789, AFF3, 3618, 106068, 1-555; 789, AFF3, 3606, 106056, 237-3917; 789, AFF3, 3607, 106057, 234-3989; 789, AFF3, 3608, 106058, 114-3794; 790, AFF4, 3621, 106071, 97-541; 790, AFF4, 3622, 106072, 1-513; 790, AFF4, 3619, 106069, 381-3872; 790, AFF4, 3620, 106070, 365-3067; 791, AFM, 3623, 106073, 94-1893; 792, AFG3L2, 3625, 106075, 1-627; 792, AFG3L2, 3624, 106074, 233-2626; 793, AFTPH, 3628, 106078, 1-1777; 793, AFTPH, 3630, 106080, 86-502; 793, AFTPH, 3631, 106081, 1-684; 793, AFTPH, 3626, 106076, 341-3151; 793, AFTPH, 3627, 106077, 341-3070; 793, AFTPH, 3629, 106079, 1-2811; 794, ARMS2, 3632, 106082, 76-399; 795, ACAN, 3633, 106083, 59-7354; 795, ACAN, 3634, 106084, 375-7967; 795, ACAN, 3635, 106085, 1-470; 795, ACAN, 3636, 106086, 344-2509; 795, ACAN, 3637, 106087, 1-7593; 795, ACAN, 3638, 106088, 59-7537; 795, ACAN, 3639, 106089, 1-679; 795, ACAN, 3640, 106090, 375-7796; 796, AGMAT, 3641, 106091, 144-1202; 797, AGRP, 3642, 106092, 301-699; 798, ASIP, 3643, 106093, 11-409; 798, ASIP, 3644, 106094, 203-601; 799, AGRN, 3646, 106096, 1-813; 799, AGRN, 3647, 106097, 465-6257; 799, AGRN, 3645, 106095, 51-6188; 800, AHSA1, 3650, 106100, 1-271; 800, AHSA1, 3651, 106101, 154-456; 800, AHSA1, 3652, 106102, 1-649; 800, AHSA1, 3653, 106103, 439-1048; 800, AHSA1, 3654, 106104, 1-400; 800, AHSA1, 3648, 106098, 161-1177; 800, AHSA1, 3649, 106099, 159-1025; 801, AHSA2, 3657, 106107, 15-455; 801, AHSA2, 3655, 106105, 1259-1672; 801, AHSA2, 3656, 106106, 1744-2157; 802, AHNAK, 3660, 106110, 148-580; 802, AHNAK, 3661, 106111, 222-584; 802, AHNAK, 3662, 106112, 10-405; 802, AHNAK, 3663, 106113, 198-568; 802, AHNAK, 3664, 106114, 323-579; 802, AHNAK, 3658, 106108, 237-686; 802, AHNAK, 3659, 106109, 276-17948; 803, AHNAK2, 3665, 106115, 121-17508; 803, AHNAK2, 3666, 106116, 245-2626; 804, AAED1, 3668, 106118, 1-541; 804, AAED1, 3669, 106119, 1-332; 804, AAED1, 3667, 106117, 1-681; 805, N/A, 3670, 106120, 86-274; 806, AJUBA, 3674, 106124, 412-651; 806, AJUBA, 3675, 106125, 1-430; 806, AJUBA, 3676, 106126, 374-567; 806, AJUBA, 3677, 106127, 179-418; 806, AJUBA, 3671, 106121, 377-1993; 806, AJUBA, 3672, 106122, 73-1689; 806, AJUBA, 3673, 106123, 655-1020; 807, AKIRIN1, 3678, 106128, 94-531; 807, AKIRIN1, 3681, 106131, 1-392; 807, AKIRIN1, 3679, 106129, 94-537; 807, AKIRIN1, 3680, 106130, 159-737; 808, AKIRIN2, 3682, 106132, 526-1137; 809, AKNAD1, 3683, 106133, 54-2222; 809, AKNAD1, 3687, 106137, 252-1961; 809, AKNAD1, 3684, 106134, 260-2545; 809, AKNAD1, 3685, 106135, 270-2780; 809, AKNAD1, 3686, 106136, 260-1507; 809, AKNAD1, 3688, 106138, 407-2365; 810, AKTIP, 3691, 106141, 71-819; 810, AKTIP, 3692, 106142, 578-959; 810, AKTIP, 3694, 106144, 500-541; 810, AKTIP, 3695, 106145, 114-562; 810, AKTIP, 3696, 106146, 454-574; 810, AKTIP, 3697, 106147, 154-562; 810, AKTIP, 3689, 106139, 219-1100; 810, AKTIP, 3690, 106140, 176-1054; 810, AKTIP, 3693, 106143, 177-1055; 811, AKT1S1, 3699, 106149, 298-623; 811, AKT1S1, 3705, 106155, 339-438; 811, AKT1S1, 3698, 106148, 112-882; 811, AKT1S1, 3700, 106150, 384-1154; 811, AKT1S1, 3701, 106151, 263-1033; 811, AKT1S1, 3702, 106152, 1991-2761; 811, AKT1S1, 3703, 106153, 195-965; 811, AKT1S1, 3704, 106154, 1374-2204; 812, N/A, 3706, 106156, 9-347; 813, N/A, 3707, 106157, 1-505; 814, N/A, 3708, 106158, 11-742; 815, N/A, 3709, 106159, 150-755; 816, N/A, 3710, 106160, 1-375; 817, N/A, 3711, 106161, 1275-1634; 818, N/A, 3712, 106162, 1-63; 819, N/A, 3713, 106163, 1-171; 820, N/A, 3714, 106164, 1-375; 821, N/A, 3715, 106165, 1-99; 822, N/A, 3716, 106166, 1-375; 823, N/A, 3717, 106167, 1-93; 824, N/A, 3718, 106168, 1-375; 825, N/A, 3719, 106169, 1-69; 826, N/A, 3720, 106170, 1-375; 827, N/A, 3721, 106171, 1-57; 828, N/A, 3722, 106172, 1-33; 829, N/A, 3723, 106173, 1-54; 830, N/A, 3724, 106174, 1-57; 831, N/A, 3725, 106175, 1-54; 832, N/A, 3726, 106176, 680-1411; 833, N/A, 3727, 106177, 1-1212; 834, N/A, 3728, 106178, 1-681; 835, N/A, 3729, 106179, 1-510; 836, N/A, 3730, 106180, 1-33; 837, N/A, 3731, 106181, 1567-2139; 838, N/A, 3732, 106182, 1-900; 839, N/A, 3733, 106183, 1-900; 840, N/A, 3734, 106184, 25-408; 841, N/A, 3735, 106185, 71-619; 842, N/A, 3736, 106186, 205-753; 843, N/A, 3737, 106187, 1165-1584; 844, N/A, 3738, 106188, 1-294; 845, N/A, 3739, 106189, 1-48; 846, N/A, 3740, 106190, 1-2508; 847, N/A, 3741, 106191, 468-890; 848, N/A, 3742, 106192, 468-890; 849, N/A, 3743, 106193, 362-994; 850, N/A, 3744, 106194, 1-375; 851, N/A, 3745, 106195, 1-150; 852, N/A, 3746, 106196, 1-372; 853, N/A, 3747, 106197, 1-135; 854, N/A, 3748, 106198, 1-276; 855, N/A, 3749, 106199, 1-69; 856, N/A, 3750, 106200, 1-414; 857, N/A, 3751, 106201, 1-414; 858, MRD, 3752, 106202, 46-513; 859, AGXT, 3753, 106203, 388-1566; 860, AGXT2, 3754, 106204, 202-1746; 860, AGXT2, 3755, 106205, 44-1363; 860, AGXT2, 3756, 106206, 244-1563; 861, ANPEP, 3758, 106208, 353-663; 861, ANPEP, 3759, 106209, 1-198; 861, ANPEP, 3760, 106210, 456-638; 861, ANPEP, 3761, 106211, 1-369; 861, ANPEP, 3757, 106207, 315-3218; 862, AARS, 3763, 106213, 1-839; 862, AARS, 3762, 106212, 145-3051; 863, AARS2, 3764, 106214, 4-2961; 864, AARSD1, 3765, 106215, 317-571; 864, AARSD1, 3766, 106216, 333-752; 864, AARSD1, 3768, 106218, 15-311; 864, AARSD1, 3769, 106219, 1-239; 864, AARSD1, 3770, 106220, 1-283; 864, AARSD1, 3767, 106217, 37-1275; 865, ALB, 3772, 106222, 21-1505; 865, ALB, 3773, 106223, 1-591; 865, ALB, 3774, 106224, 42-1295; 865, ALB, 3775, 106225, 208-1587; 865, ALB, 3776, 106226, 25-1839; 865, ALB, 3777, 106227, 28-345; 865, ALB, 3778, 106228, 1-1363; 865, ALB, 3779, 106229, 74-1264; 865, ALB, 3771, 106221, 90-1919; 865, ALB, 3780, 106230, 42-1232; 866, ADH1A, 3781, 106231, 115-1242; 867, ADH1B, 3783, 106233, 313-1320; 867, ADH1B, 3784, 106234, 189-1196; 867, ADH1B, 3782, 106232, 69-1196; 868, ADH1C, 3786, 106236, 296-872; 868, ADH1C, 3787, 106237, 72-581; 868, ADH1C, 3785, 106235, 353-1480; 869, ADH4, 3789, 106239, 174-946; 869, ADH4, 3790, 106240, 1-348; 869, ADH4, 3793, 106243, 138-248; 869, ADH4, 3794, 106244, 137-247; 869, ADH4, 3795, 106245, 47-665; 869, ADH4, 3796, 106246, 60-1235; 869, ADH4, 3788, 106238, 76-1218; 869, ADH4, 3791, 106241, 167-1366; 869, ADH4, 3792, 106242, 138-1337; 870, ADH5, 3798, 106248, 37-384; 870, ADH5, 3799, 106249, 5-292; 870, ADH5, 3800, 106250, 3-173; 870, ADH5, 3801, 106251, 14-61; 870, ADH5, 3802, 106252, 1-786; 870, ADH5, 3803, 106253, 52-222; 870, ADH5, 3797, 106247, 52-1176; 871, ADH6, 3805, 106255, 84-971; 871, ADH6, 3806, 106256, 95-1222; 871, ADH6, 3807, 106257, 1-207; 871, ADH6, 3808, 106258, 23-199; 871, ADH6, 3809, 106259, 92-863; 871, ADH6, 3804, 106254, 386-1492; 872, ADH7, 3811, 106261, 505-1629; 872, ADH7, 3813, 106263, 267-589; 872, ADH7, 3814, 106264, 325-1278; 872, ADH7, 3810, 106260, 242-1402; 872, ADH7, 3812, 106262, 31-1215; 873, ADHFE1, 3815, 106265, 19-135; 873, ADHFE1, 3816, 106266, 18-398; 873, ADHFE1, 3818, 106268, 13-408; 873, ADHFE1, 3819, 106269, 5-109; 873, ADHFE1, 3820, 106270, 13-117; 873, ADHFE1, 3821, 106271, 17-133; 873, ADHFE1, 3823, 106273, 10-117; 873, ADHFE1, 3825, 106275, 13-120; 873, ADHFE1, 3826, 106276, 293-557; 873, ADHFE1, 3817, 106267, 32-1435; 873, ADHFE1, 3822, 106272, 240-1499; 873, ADHFE1, 3824, 106274, 20-931; 874, ALDH1A1, 3828, 106278, 57-749; 874, ALDH1A1, 3829, 106279, 91-806; 874, ALDH1A1, 3830, 106280, 197-805; 874, ALDH1A1, 3827, 106277, 56-1561; 875, ALDH1A2, 3833, 106283, 19-141; 875, ALDH1A2, 3835, 106285, 300-554; 875, ALDH1A2, 3836, 106286, 590-664; 875, ALDH1A2, 3838, 106288, 61-1530; 875, ALDH1A2, 3839, 106289, 1-73; 875, ALDH1A2, 3840, 106290, 551-577; 875, ALDH1A2, 3831, 106281, 769-2325; 875, ALDH1A2, 3832, 106282, 89-1531; 875, ALDH1A2, 3834, 106284, 434-1927; 875, ALDH1A2, 3837, 106287, 170-1438; 876, ALDH1A3, 3842, 106292, 34-1251; 876, ALDH1A3, 3843, 106293, 138-571; 876, ALDH1A3, 3844, 106294, 70-378; 876, ALDH1A3, 3845, 106295, 96-521; 876, ALDH1A3, 3841, 106291, 533-2071; 877, ALDH1B1, 3847, 106297, 195-584; 877, ALDH1B1, 3846, 106296, 154-1707; 878, ALDH1L1, 3853, 106303, 83-615; 878, ALDH1L1, 3854, 106304, 135-380; 878, ALDH1L1, 3855, 106305, 78-221; 878, ALDH1L1, 3856, 106306, 515-1020; 878, ALDH1L1, 3857, 106307, 219-689; 878, ALDH1L1, 3859, 106309, 284-583; 878, ALDH1L1, 3860, 106310, 231-374; 878, ALDH1L1, 3848, 106298, 219-2957; 878, ALDH1L1, 3849, 106299, 124-1641; 878, ALDH1L1, 3850, 106300, 351-3059; 878, ALDH1L1, 3851, 106301, 135-2540; 878, ALDH1L1, 3852, 106302, 351-1868; 878, ALDH1L1, 3858, 106308, 229-2937; 879, ALDH1L2, 3862, 106312, 1-277; 879, ALDH1L2, 3861, 106311, 142-2913; 879, ALDH1L2, 3863, 106313, 23-634; 880, ALDH16A1, 3866, 106316, 188-2107; 880, ALDH16A1, 3867, 106317, 1-492; 880, ALDH16A1, 3868, 106318, 45-356; 880, ALDH16A1, 3864, 106314, 164-2572; 880, ALDH16A1, 3865, 106315, 97-2352; 881, ALDH18A1, 3869, 106319, 139-2520; 881, ALDH18A1, 3870, 106320, 139-2526; 882, ALDH2, 3873, 106323, 36-275; 882, ALDH2, 3874, 106324, 1-352; 882, ALDH2, 3871, 106321, 62-1615; 882, ALDH2, 3872, 106322, 97-1509; 883, ALDH3A1, 3876, 106326, 89-1258; 883, ALDH3A1, 3877, 106327, 5-781; 883, ALDH3A1, 3879, 106329, 244-1359; 883, ALDH3A1, 3881, 106331, 89-1279; 883, ALDH3A1, 3882, 106332, 466-859; 883, ALDH3A1, 3883, 106333, 193-1335; 883, ALDH3A1, 3884, 106334, 364-587; 883, ALDH3A1, 3885, 106335, 42-400; 883, ALDH3A1, 3875, 106325, 181-1542; 883, ALDH3A1, 3878, 106328, 176-1537; 883, ALDH3A1, 3880, 106330, 331-1692; 884, ALDH3A2, 3889, 106339, 168-665; 884, ALDH3A2, 3890, 106340, 122-670; 884, ALDH3A2, 3891, 106341, 1-489; 884, ALDH3A2, 3892, 106342, 1-294; 884, ALDH3A2, 3893, 106343, 1-258; 884, ALDH3A2, 3895, 106345, 1-189; 884, ALDH3A2, 3896, 106346, 102-540; 884, ALDH3A2, 3897, 106347, 195-359; 884, ALDH3A2, 3899, 106349, 1-176; 884, ALDH3A2, 3900, 106350, 250-1431; 884, ALDH3A2, 3901, 106351, 1-400; 884, ALDH3A2, 3902, 106352, 194-573; 884, ALDH3A2, 3903, 106353, 447-1628; 884, ALDH3A2, 3904, 106354, 447-995; 884, ALDH3A2, 3905, 106355, 1148-1441; 884, ALDH3A2, 3886, 106336, 447-1904; 884, ALDH3A2, 3887, 106337, 222-1748; 884, ALDH3A2, 3888, 106338, 159-1616; 884, ALDH3A2, 3894, 106344, 250-1776; 884, ALDH3A2, 3898, 106348, 100-1557; 885, ALDH3B1, 3907, 106357, 1-201; 885, ALDH3B1, 3908, 106358, 1-216; 885, ALDH3B1, 3910, 106360, 52-561; 885, ALDH3B1, 3911, 106361, 72-764; 885, ALDH3B1, 3913, 106363, 77-709; 885, ALDH3B1, 3914, 106364, 5-1060; 885, ALDH3B1, 3906, 106356, 43-1449; 885, ALDH3B1, 3909, 106359, 117-1523; 885, ALDH3B1, 3912, 106362, 28-1323; 886, ALDH3B2, 3917, 106367, 278-561; 886, ALDH3B2, 3918, 106368, 284-726; 886, ALDH3B2, 3919, 106369, 1-385; 886, ALDH3B2, 3915, 106365, 440-1597; 886, ALDH3B2, 3916, 106366, 270-1427; 887, ALDH4A1, 3922, 106372, 202-844; 887, ALDH4A1, 3920, 106370, 31-1722; 887, ALDH4A1, 3921, 106371, 259-1950; 887, ALDH4A1, 3923, 106373, 317-1828; 887, ALDH4A1, 3924, 106374, 6-1544; 888, ALDH5A1, 3927, 106377, 131-1654; 888, ALDH5A1, 3925, 106375, 29-1675; 888, ALDH5A1, 3926, 106376, 146-1753; 889, ALDH6A1, 3930, 106380, 397-1155; 889, ALDH6A1, 3928, 106378, 54-1622; 889, ALDH6A1, 3929, 106379, 100-1707; 890, ALDH7A1, 3932, 106382, 1-294; 890, ALDH7A1, 3934, 106384, 165-398; 890, ALDH7A1, 3935, 106385, 1-719; 890, ALDH7A1, 3936, 106386, 139-1566; 890, ALDH7A1, 3937, 106387, 22-446; 890, ALDH7A1, 3938, 106388, 21-905; 890, ALDH7A1, 3939, 106389, 1-83; 890, ALDH7A1, 3940, 106390, 1-124; 890, ALDH7A1, 3931, 106381, 221-1840; 890, ALDH7A1, 3933, 106383, 112-1620; 891, ALDH8A1, 3945, 106395, 444-489; 891, ALDH8A1, 3946, 106396, 1-404; 891, ALDH8A1, 3941, 106391, 70-1533; 891, ALDH8A1, 3942, 106392, 37-519; 891, ALDH8A1, 3943, 106393, 63-1364; 891, ALDH8A1, 3944, 106394, 32-1345; 892, ALDH9A1, 3947, 106397, 306-1862; 893, AOX1, 3948, 106398, 1-580; 893, AOX1, 3950, 106400, 128-581; 893, AOX1, 3951, 106401, 1-573; 893, AOX1, 3949, 106399, 242-4258; 894, AKR1A1, 3954, 106404, 398-840; 894, AKR1A1, 3955, 106405, 95-454; 894, AKR1A1, 3956, 106406, 96-516; 894, AKR1A1, 3952, 106402, 96-1073; 894, AKR1A1, 3953, 106403, 748-1725; 894, AKR1A1, 3957, 106407, 291-1268; 895, AKR1B1, 3959, 106409, 37-345; 895, AKR1B1, 3960, 106410, 41-832; 895, AKR1B1, 3958, 106408, 81-1031; 896, AKR1B10, 3961, 106411, 321-1271; 897, AKR1B15, 3962, 106412, 261-1295; 897, AKR1B15, 3963, 106413, 1-1035; 898, AKR1C1, 3964, 106414, 16-633; 898, AKR1C1, 3966, 106416, 1-975; 898, AKR1C1, 3967, 106417, 1-744; 898, AKR1C1, 3965, 106415, 193-1164; 899, AKR1C2, 3969, 106419, 1-972; 899, AKR1C2, 3970, 106420, 26-919; 899, AKR1C2, 3972, 106422, 144-745; 899, AKR1C2, 3968, 106418, 189-1160; 899, AKR1C2, 3971, 106421, 180-599; 900, AKR1C3, 3974, 106424, 171-636; 900, AKR1C3, 3975, 106425, 326-1228; 900, AKR1C3, 3973, 106423, 653-1624; 901, N/A, 3976, 106426, 1-972; 902, AKR1C4, 3977, 106427, 34-1005; 902, AKR1C4, 3978, 106428, 254-1225; 903, AKR1D1, 3981, 106431, 2-290; 903, AKR1D1, 3979, 106429, 43-1023; 903, AKR1D1, 3980, 106430, 88-960; 903, AKR1D1, 3982, 106432, 53-910; 904, AKR1E2, 3986, 106436, 1-170; 904, AKR1E2, 3988, 106438, 1-112; 904, AKR1E2, 3989, 106439, 375-986; 904, AKR1E2, 3990, 106440, 159-754; 904, AKR1E2, 3983, 106433, 72-1034; 904, AKR1E2, 3984, 106434, 30-821; 904, AKR1E2, 3985, 106435, 30-698; 904, AKR1E2, 3987, 106437, 30-782; 904, AKR1E2, 3991, 106441, 92-1015; 905, AKR7A2, 3993, 106443, 1-945; 905, AKR7A2, 3994, 106444, 1-168; 905, AKR7A2, 3995, 106445, 1-617; 905, AKR7A2, 3992, 106442, 23-1102; 906, AKR7A3, 3996, 106446, 542-1537; 907, AKR7L, 3997, 106447, 1-617; 907, AKR7L, 3999, 106449, 121-1116; 907, AKR7L, 3998, 106448, 78-1070; 908, ALDOA, 4001, 106451, 173-1279; 908, ALDOA, 4004, 106454, 92-512; 908, ALDOA, 4005, 106455, 72-906; 908, ALDOA, 4009, 106459, 178-1263; 908, ALDOA, 4011, 106461, 181-666; 908, ALDOA, 4012, 106462, 1-392; 908, ALDOA, 4014, 106464, 1-613; 908, ALDOA, 4015, 106465, 120-586; 908, ALDOA, 4016, 106466, 900-935; 908, ALDOA, 4017, 106467, 1088-2194; 908, ALDOA, 4000, 106450, 1088-2182; 908, ALDOA, 4002, 106452, 983-2239; 908, ALDOA, 4003, 106453, 310-1404; 908, ALDOA, 4006, 106456, 220-1314; 908, ALDOA, 4007, 106457, 1153-2247; 908, ALDOA, 4008, 106458, 254-1348; 908, ALDOA, 4010, 106460, 802-1896; 908, ALDOA, 4013, 106463, 208-1464; 909, ALDOB, 4019, 106469, 77-1027; 909, ALDOB, 4018, 106468, 126-1220; 910, ALDOC, 4021, 106471, 98-1108; 910, ALDOC, 4023, 106473, 132-579; 910, ALDOC, 4024, 106474, 161-686; 910, ALDOC, 4025, 106475, 473-839; 910, ALDOC, 4026, 106476, 383-922; 910, ALDOC, 4027, 106477, 176-580; 910, ALDOC, 4020, 106470, 477-1571; 910, ALDOC, 4022, 106472, 217-1311; 911, ALG1, 4030, 106480, 240-742; 911, ALG1, 4031, 106481, 29-582; 911, ALG1, 4032, 106482, 2-256; 911, ALG1, 4028, 106478, 32-1426; 911,

ALG1, 4029, 106479, 182-1243; 911, ALG1, 4033, 106483, 1101-2162; 912, ALG1L, 4035, 106485, 1-624; 912, ALG1L, 4034, 106484, 165-728; 913, ALG1L2, 4036, 106486, 187-834; 914, ALG10, 4038, 106488, 128-361; 914, ALG10, 4039, 106489, 133-513; 914, ALG10, 4037, 106487, 320-1741; 915, ALG10B, 4041, 106491, 133-513; 915, ALG10B, 4042, 106492, 56-289; 915, ALG10B, 4040, 106490, 317-1738; 916, ALG11, 4043, 106493, 22-132; 916, ALG11, 4045, 106495, 9-101; 916, ALG11, 4044, 106494, 6-1484; 917, ALG12, 4047, 106497, 1-590; 917, ALG12, 4048, 106498, 1-616; 917, ALG12, 4046, 106496, 275-1741; 918, ALG13, 4053, 106503, 22-501; 918, ALG13, 4054, 106504, 22-177; 918, ALG13, 4055, 106505, 396-581; 918, ALG13, 4056, 106506, 45-560; 918, ALG13, 4057, 106507, 13-144; 918, ALG13, 4058, 106508, 26-157; 918, ALG13, 4059, 106509, 28-183; 918, ALG13, 4061, 106511, 41-196; 918, ALG13, 4062, 106512, 31-432; 918, ALG13, 4064, 106514, 4-159; 918, ALG13, 4065, 106515, 1-108; 918, ALG13, 4066, 106516, 25-423; 918, ALG13, 4067, 106517, 1-233; 918, ALG13, 4068, 106518, 41-493; 918, ALG13, 4069, 106519, 44-175; 918, ALG13, 4070, 106520, 16-171; 918, ALG13, 4071, 106521, 1-489; 918, ALG13, 4072, 106522, 142-327; 918, ALG13, 4073, 106523, 1-127; 918, ALG13, 4074, 106524, 50-205; 918, ALG13, 4075, 106525, 1-1121; 918, ALG13, 4076, 106526, 1-108; 918, ALG13, 4049, 106499, 487-3351; 918, ALG13, 4050, 106500, 102-599; 918, ALG13, 4051, 106501, 70-3483; 918, ALG13, 4052, 106502, 298-3162; 918, ALG13, 4060, 106510, 350-3529; 918, ALG13, 4063, 106513, 383-3247; 919, ALG14, 4077, 106527, 48-698; 920, ALG2, 4080, 106530, 49-465; 920, ALG2, 4078, 106528, 94-1065; 920, ALG2, 4079, 106529, 63-1313; 921, ALG3, 4082, 106532, 1-317; 921, ALG3, 4083, 106533, 23-346; 921, ALG3, 4084, 106534, 1-967; 921, ALG3, 4085, 106535, 456-1652; 921, ALG3, 4087, 106537, 10-207; 921, ALG3, 4081, 106531, 32-1348; 921, ALG3, 4086, 106536, 272-1444; 922, ALG5, 4088, 106538, 68-1042; 922, ALG5, 4089, 106539, 68-952; 923, ALG6, 4090, 106540, 209-1738; 923, ALG6, 4092, 106542, 246-377; 923, ALG6, 4093, 106543, 209-1054; 923, ALG6, 4091, 106541, 306-1829; 924, ALG8, 4096, 106546, 179-468; 924, ALG8, 4097, 106547, 1-686; 924, ALG8, 4098, 106548, 1-473; 924, ALG8, 4099, 106549, 1-680; 924, ALG8, 4100, 106550, 1-263; 924, ALG8, 4101, 106551, 1-594; 924, ALG8, 4102, 106552, 35-881; 924, ALG8, 4103, 106553, 261-778; 924, ALG8, 4104, 106554, 111-838; 924, ALG8, 4105, 106555, 1-844; 924, ALG8, 4106, 106556, 421-829; 924, ALG8, 4107, 106557, 62-463; 924, ALG8, 4108, 106558, 482-860; 924, ALG8, 4109, 106559, 35-745; 924, ALG8, 4094, 106544, 73-1653; 924, ALG8, 4095, 106545, 5-1408; 924, ALG8, 4110, 106560, 66-1469; 925, ALG9, 4112, 106562, 1-623; 925, ALG9, 4114, 106564, 1-107; 925, ALG9, 4115, 106565, 1-73; 925, ALG9, 4116, 106566, 100-504; 925, ALG9, 4117, 106567, 65-571; 925, ALG9, 4118, 106568, 79-387; 925, ALG9, 4120, 106570, 62-658; 925, ALG9, 4111, 106561, 910-2232; 925, ALG9, 4113, 106563, 474-1817; 925, ALG9, 4119, 106569, 100-1956; 925, ALG9, 4121, 106571, 52-1887; 926, ACER1, 4122, 106572, 79-873; 927, ACER2, 4123, 106573, 27-854; 928, ACER3, 4124, 106574, 28-258; 928, ACER3, 4125, 106575, 378-896; 928, ACER3, 4126, 106576, 35-190; 928, ACER3, 4127, 106577, 54-209; 928, ACER3, 4128, 106578, 43-285; 928, ACER3, 4129, 106579, 42-266; 928, ACER3, 4131, 106581, 41-256; 928, ACER3, 4132, 106582, 220-834; 928, ACER3, 4133, 106583, 36-728; 928, ACER3, 4130, 106580, 105-908; 929, ALPI, 4135, 106585, 76-228; 929, ALPI, 4134, 106584, 78-1664; 930, ALPL, 4136, 106586, 1-650; 930, ALPL, 4137, 106587, 255-1829; 930, ALPL, 4138, 106588, 251-1825; 930, ALPL, 4139, 106589, 147-1490; 930, ALPL, 4140, 106590, 195-1604; 931, ALPP, 4141, 106591, 270-1877; 932, ALPPL2, 4143, 106593, 1-1596; 932, ALPPL2, 4142, 106592, 53-1651; 933, ALKBH1, 4145, 106595, 1-339; 933, ALKBH1, 4146, 106596, 7-357; 933, ALKBH1, 4144, 106594, 17-1186; 934, ALKBH2, 4150, 106600, 122-572; 934, ALKBH2, 4151, 106601, 687-1049; 934, ALKBH2, 4152, 106602, 1-449; 934, ALKBH2, 4147, 106597, 228-1013; 934, ALKBH2, 4148, 106598, 365-1150; 934, ALKBH2, 4149, 106599, 4-477; 934, ALKBH2, 4153, 106603, 291-764; 935, ALKBH3, 4155, 106605, 401-601; 935, ALKBH3, 4156, 106606, 1-469; 935, ALKBH3, 4157, 106607, 663-842; 935, ALKBH3, 4158, 106608, 440-955; 935, ALKBH3, 4159, 106609, 77-747; 935, ALKBH3, 4154, 106604, 412-1272; 935, ALKBH3, 4160, 106610, 377-889; 936, ALKBH4, 4161, 106611, 41-949; 936, ALKBH4, 4162, 106612, 28-156; 937, ALKBH5, 4164, 106614, 442-603; 937, ALKBH5, 4163, 106613, 6-1190; 938, ALKBH6, 4167, 106617, 1-152; 938, ALKBH6, 4168, 106618, 1-282; 938, ALKBH6, 4169, 106619, 1-142; 938, ALKBH6, 4170, 106620, 1-398; 938, ALKBH6, 4171, 106621, 1-218; 938, ALKBH6, 4172, 106622, 166-567; 938, ALKBH6, 4173, 106623, 750-1082; 938, ALKBH6, 4165, 106615, 154-870; 938, ALKBH6, 4166, 106616, 7-807; 939, ALKBH7, 4175, 106625, 310-549; 939, ALKBH7, 4176, 106626, 16-498; 939, ALKBH7, 4174, 106624, 389-1054; 940, ALKBH8, 4179, 106629, 141-575; 940, ALKBH8, 4177, 106627, 108-824; 940, ALKBH8, 4178, 106628, 434-2428; 940, ALKBH8, 4180, 106630, 142-816; 940, ALKBH8, 4181, 106631, 111-2114; 940, ALKBH8, 4182, 106632, 153-2147; 941, AGMO, 4184, 106634, 1-262; 941, AGMO, 4185, 106635, 1-225; 941, AGMO, 4183, 106633, 171-1508; 942, AGPS, 4187, 106637, 23-592; 942, AGPS, 4186, 106636, 147-2123; 943, ALLC, 4188, 106638, 163-1338; 944, AIF1, 4189, 106639, 1-486; 944, AIF1, 4195, 106645, 1-486; 944, AIF1, 4196, 106646, 1-486; 944, AIF1, 4197, 106647, 1-486; 944, AIF1, 4202, 106652, 1-486; 944, AIF1, 4205, 106655, 1-486; 944, AIF1, 4190, 106640, 122-403; 944, AIF1, 4191, 106641, 147-590; 944, AIF1, 4192, 106642, 122-403; 944, AIF1, 4193, 106643, 147-590; 944, AIF1, 4194, 106644, 147-590; 944, AIF1, 4198, 106648, 147-590; 944, AIF1, 4199, 106649, 147-590; 944, AIF1, 4200, 106650, 122-403; 944, AIF1, 4201, 106651, 122-403; 944, AIF1, 4203, 106653, 122-403; 944, AIF1, 4204, 106654, 122-403; 944, AIF1, 4206, 106656, 147-590; 945, AIF1L, 4208, 106658, 184-324; 945, AIF1L, 4209, 106659, 75-368; 945, AIF1L, 4211, 106661, 271-555; 945, AIF1L, 4214, 106664, 101-229; 945, AIF1L, 4207, 106657, 89-541; 945, AIF1L, 4210, 106660, 80-388; 945, AIF1L, 4212, 106662, 89-517; 945, AIF1L, 4213, 106663, 155-685; 946, ATRAID, 4217, 106667, 387-612; 946, ATRAID, 4215, 106665, 178-1032; 946, ATRAID, 4216, 106666, 314-829; 946, ATRAID, 4218, 106668, 59-748; 946, ATRAID, 4219, 106669, 174-1028; 947, A3GALT2, 4220, 106670, 1-1023; 948, A4GALT, 4221, 106671, 190-1251; 948, A4GALT, 4222, 106672, 106-1167; 948, A4GALT, 4223, 106673, 491-1552; 949, AAGAB, 4226, 106676, 390-563; 949, AAGAB, 4224, 106674, 106-1053; 949, AAGAB, 4225, 106675, 314-934; 949, AAGAB, 4227, 106677, 517-1137; 950, AHSP, 4229, 106679, 43-213; 950, AHSP, 4228, 106678, 104-412; 951, ATRX, 4232, 106682, 1-597; 951, ATRX, 4233, 106683, 216-710; 951, ATRX, 4234, 106684, 1-593; 951, ATRX, 4235, 106685, 260-583; 951, ATRX, 4236, 106686, 220-4272; 951, ATRX, 4237, 106687, 277-1860; 951, ATRX, 4238, 106688, 1-199; 951, ATRX, 4239, 106689, 208-3071; 951, ATRX, 4240, 106690, 1-527; 951, ATRX, 4241, 106691, 1-882; 951, ATRX, 4242, 106692, 487-628; 951, ATRX, 4230, 106680, 269-7747; 951, ATRX, 4231, 106681, 216-7580; 952, ATAT1, 4243, 106693, 45-947; 952, ATAT1, 4244, 106694, 12-944; 952, ATAT1, 4245, 106695, 319-1548; 952, ATAT1, 4246, 106696, 1-1002; 952, ATAT1, 4247, 106697, 11-982; 952, ATAT1, 4248, 106698, 31-1296; 952, ATAT1, 4249, 106699, 319-1548; 952, ATAT1, 4250, 106700, 1-1002; 952, ATAT1, 4251, 106701, 45-947; 952, ATAT1, 4252, 106702, 31-1296; 952, ATAT1, 4253, 106703, 11-982; 952, ATAT1, 4254, 106704, 12-944; 952, ATAT1, 4255, 106705, 11-982; 952, ATAT1, 4256, 106706, 11-982; 952, ATAT1, 4257, 106707, 319-1548; 952, ATAT1, 4258, 106708, 319-1548; 952, ATAT1, 4259, 106709, 11-982; 952, ATAT1, 4260, 106710, 45-947; 952, ATAT1, 4261, 106711, 1-1002; 952, ATAT1, 4262, 106712, 31-1296; 952, ATAT1, 4263, 106713, 319-1548; 952, ATAT1, 4264, 106714, 31-1296; 952, ATAT1, 4265, 106715, 1-1002; 952, ATAT1, 4266, 106716, 1-1002; 952, ATAT1, 4267, 106717, 45-947; 952, ATAT1, 4268, 106718, 45-947; 952, ATAT1, 4269, 106719, 11-982; 952, ATAT1, 4270, 106720, 1-1002; 952, ATAT1, 4271, 106721, 45-947; 952, ATAT1, 4272, 106722, 12-944; 952, ATAT1, 4273, 106723, 1-1002; 952, ATAT1, 4274, 106724, 31-1296; 952, ATAT1, 4275, 106725, 12-944; 952, ATAT1, 4276, 106726, 12-944; 952, ATAT1, 4277, 106727, 31-1296; 952, ATAT1, 4278, 106728, 11-982; 952, ATAT1, 4279, 106729, 12-944; 952, ATAT1, 4280, 106730, 319-1548; 952, ATAT1, 4281, 106731, 45-947; 952, ATAT1, 4282, 106732, 12-944; 952, ATAT1, 4283, 106733, 319-1548; 952, ATAT1, 4284, 106734, 31-1296; 953, A4GNT, 4285, 106735, 203-1225; 954, A1BG, 4287, 106737, 1-917; 954, A1BG, 4286, 106736, 63-1550; 955, AMBP, 4289, 106739, 120-836; 955, AMBP, 4290, 106740, 1-579; 955, AMBP, 4288, 106738, 264-1322; 956, AZGP1, 4292, 106742, 1-257; 956, AZGP1, 4293, 106743, 7-690; 956, AZGP1, 4291, 106741, 138-1034; 957, AHSG, 4294, 106744, 77-1183; 957, AHSG, 4295, 106745, 220-1323; 958, A2M, 4297, 106747, 120-623; 958, A2M, 4298, 106748, 1-222; 958, A2M, 4299, 106749, 12-284; 958, A2M, 4296, 106746, 309-4733; 959, A2ML1, 4302, 106752, 20-570; 959, A2ML1, 4303, 106753, 219-462; 959, A2ML1, 4304, 106754, 1-3015; 959, A2ML1, 4305, 106755, 1-547; 959, A2ML1, 4300, 106750, 181-4545; 959, A2ML1, 4301, 106751, 169-3060; 960, N/A, 4306, 106756, 70-591; 960, N/A, 4307, 106757, 63-473; 960, N/A, 4308, 106758, 204-587; 961, AFP, 4309, 106759, 17-1885; 961, AFP, 4310, 106760, 101-1930; 962, ALPK1, 4313, 106763, 227-733; 962, ALPK1, 4314, 106764, 191-592; 962, ALPK1, 4315, 106765, 222-551; 962, ALPK1, 4316, 106766, 241-1155; 962, ALPK1, 4311, 106761, 201-3935; 962, ALPK1, 4312, 106762, 280-4014; 962, ALPK1, 4317, 106767, 307-3807; 963, ALPK2, 4318, 106768, 215-6727; 964, ALPK3, 4319, 106769, 168-5891; 965, AMACR, 4323, 106773, 86-1189; 965, AMACR, 4325, 106775, 66-932; 965, AMACR, 4326, 106776, 10-855; 965, AMACR, 4327, 106777, 10-792; 965, AMACR, 4320, 106770, 90-1238; 965, AMACR, 4321, 106771, 13-609; 965, AMACR, 4322, 106772, 10-1194; 965, AMACR, 4324, 106774, 13-702; 966, AMMECR1, 4328, 106778, 169-1170; 966, AMMECR1, 4329, 106779, 638-1270; 966, AMMECR1, 4330, 106780, 14-904; 967, ALS2CL, 4333, 106783, 1-908; 967, ALS2CL, 4334, 106784, 88-1695; 967, ALS2CL, 4331, 106781, 85-2946; 967, ALS2CL, 4332, 106782, 433-1335; 967, ALS2CL, 4335, 106785, 191-3052; 968, ALMS1, 4336, 106786, 1-3072; 968, ALMS1, 4337, 106787, 112-12492; 968, ALMS1, 4338, 106788, 1-11580; 968, ALMS1, 4339, 106789, 112-12618; 969, ASPSCR1, 4342, 106792, 46-222; 969, ASPSCR1, 4343, 106793, 1-539; 969, ASPSCR1, 4344, 106794, 1-564; 969, ASPSCR1, 4345, 106795, 188-1246; 969, ASPSCR1, 4347, 106797, 81-1001; 969, ASPSCR1, 4348, 106798, 1022-1035; 969, ASPSCR1, 4349, 106799, 284-1696; 969, ASPSCR1, 4350, 106800, 7-489; 969, ASPSCR1, 4351, 106801, 17-565; 969, ASPSCR1, 4340, 106790, 98-1759; 969, ASPSCR1, 4341, 106791, 98-2041; 969, ASPSCR1, 4346, 106796, 189-1694; 970, ALX1, 4352, 106802, 156-1136; 971, ALX3, 4353, 106803, 89-1120; 972, ALX4, 4354, 106804, 105-1340; 973, ALYREF, 4355, 106805, 7-801; 974, AMBN, 4358, 106808, 102-1442; 974, AMBN, 4356, 106806, 104-1447; 974, AMBN, 4357, 106807, 65-1363; 975, AMELX, 4359, 106809, 69-596; 975, AMELX, 4360, 106810, 69-686; 975, AMELX, 4361, 106811, 69-644; 976, AMELY, 4362, 106812, 69-647; 976, AMELY, 4363, 106813, 1-621; 977, AMTN, 4364, 106814, 131-760; 977, AMTN, 4365, 106815, 86-712; 978, AMDHD1, 4367, 106817, 1-335; 978, AMDHD1, 4368, 106818, 549-566; 978, AMDHD1, 4366, 106816, 107-1387; 979, AMDHD2, 4372, 106822, 24-490; 979, AMDHD2, 4373, 106823, 39-940; 979, AMDHD2, 4374, 106824, 67-564; 979, AMDHD2, 4375, 106825, 674-1482; 979, AMDHD2, 4376, 106826, 35-924; 979, AMDHD2, 4369, 106819, 95-1324; 979, AMDHD2, 4370, 106820, 95-1414; 979, AMDHD2, 4371, 106821, 70-1854; 980, AOC1, 4379, 106829, 303-1314; 980, AOC1, 4381, 106831, 199-945; 980, AOC1, 4383, 106833, 1521-2105; 980, AOC1, 4384, 106834, 41-2173; 980, AOC1, 4377, 106827, 99-2354; 980, AOC1, 4378, 106828, 61-2373; 980, AOC1, 4380, 106830, 307-2562; 980, AOC1, 4382, 106832, 585-2840; 981, AOC2, 4385, 106835, 28-2298; 981, AOC2, 4386, 106836, 27-2216; 982, AOC3, 4388, 106838, 1-433; 982, AOC3, 4389, 106839, 118-573; 982, AOC3, 4390, 106840, 207-542; 982, AOC3, 4387, 106837, 161-2452; 982, AOC3, 4391, 106841, 280-942; 982, AOC3, 4392, 106842, 152-814; 982, AOC3, 4393, 106843, 161-2065; 983, AIMP1, 4397, 106847, 119-568; 983, AIMP1, 4394, 106844, 675-1613; 983, AIMP1, 4395, 106845, 42-1052; 983, AIMP1, 4396, 106846, 53-991; 984, AIMP2, 4399, 106849, 49-804; 984, AIMP2, 4400, 106850, 375-1103; 984, AIMP2, 4401, 106851, 75-221; 984, AIMP2, 4398, 106848, 120-1082; 985, ACY1, 4405, 106855, 166-771; 985, ACY1, 4407, 106857, 72-755; 985, ACY1, 4402, 106852, 147-1373; 985, ACY1, 4403, 106853, 166-1287; 985, ACY1, 4404, 106854, 166-1176; 985, ACY1, 4406, 106856, 166-1197; 986, ACY3, 4409, 106859, 314-910; 986, ACY3, 4408, 106858, 172-1131; 987, AADAT, 4412, 106862, 182-810; 987, AADAT, 4415, 106865, 267-806; 987, AADAT, 4416, 106866, 95-755; 987, AADAT, 4410, 106860, 125-1402; 987, AADAT, 4411, 106861, 278-1555; 987, AADAT, 4413, 106863, 118-1407; 987, AADAT, 4414, 106864, 210-1487; 988, AASDH, 4420, 106870, 141-401; 988, AASDH, 4422, 106872, 151-513; 988, AASDH, 4423, 106873, 528-3365; 988, AASDH, 4417, 106867, 182-3478; 988, AASDH, 4418, 106868, 190-2763; 988, AASDH, 4419, 106869, 182-2707; 988, AASDH, 4421, 106871, 133-3129; 989, AASDHPPT, 4425, 106875, 60-629; 989, AASDHPPT, 4427, 106877, 89-568; 989, AASDHPPT, 4424, 106874, 223-1152; 989, AASDHPPT, 4426, 106876, 54-470; 990, AASS, 4428, 106878, 56-2254; 990, AASS, 4430, 106880, 1-66; 990, AASS, 4432, 106882, 56-1591; 990, AASS, 4429, 106879, 97-2877; 990, AASS, 4431, 106881, 136-2916; 991, ACMSD, 4433, 106883, 137-1147; 991, ACMSD, 4434, 106884, 297-1133; 992, ALAD, 4436, 106886, 175-536; 992, ALAD, 4437, 106887, 662-703; 992, ALAD, 4438, 106888, 406-583; 992, ALAD, 4435, 106885, 198-1190; 993, AMT, 4441, 106891, 24-811; 993, AMT, 4442, 106892, 2-121; 993, AMT, 4443, 106893, 1-1153; 993, AMT, 4439, 106889, 304-1515; 993, AMT, 4440, 106890, 229-1389; 993, AMT, 4444, 106894, 20-1099; 993, AMT, 4445, 106895, 229-1272; 994, NPEPPS, 4447, 106897, 1-197; 994, NPEPPS, 4448, 106898, 31-2778; 994, NPEPPS, 4449, 106899, 1-510; 994, NPEPPS, 4450, 106900, 1-426; 994, NPEPPS, 4451, 106901, 20-424; 994, NPEPPS, 4452, 106902, 11-547; 994, NPEPPS, 4453, 106903, 20-511; 994, NPEPPS, 4454, 106904, 80-554; 994, NPEPPS, 4455, 106905, 18-534; 994, NPEPPS, 4456, 106906, 35-418; 994, NPEPPS, 4457, 106907, 46-649; 994, NPEPPS, 4446, 106896, 238-2997; 995, NPEPL1, 4460, 106910, 1-541; 995, NPEPL1, 4458, 106908, 289-1860; 995, NPEPL1, 4459, 106909, 123-1610; 995, NPEPL1, 4461, 106911, 129-1556; 996, AES, 4464, 106914, 1-793; 996, AES, 4465, 106915, 211-357; 996, AES, 4466, 106916, 289-714; 996, AES, 4462, 106912, 181-975; 996, AES, 4463, 106913, 358-951; 997, AMMECR1L, 4467, 106917, 262-1194; 997, AMMECR1L, 4468, 106918, 252-1184; 998, AMN, 4470, 106920, 1-393; 998, AMN, 4471, 106921, 1-320; 998, AMN, 4469, 106919, 34-1395; 999, AMPH, 4474, 106924, 1-338; 999, AMPH, 4475, 106925, 1-1735; 999, AMPH, 4472, 106922, 70-2031; 999, AMPH, 4473, 106923, 217-2304; 1000, AREG, 4477, 106927, 45-869; 1000, AREG, 4476, 106926, 213-971; 1001, AMY1A, 4479, 106929, 686-1363; 1001, AMY1A, 4480, 106930, 89-403; 1001, AMY1A, 4478, 106928, 221-1756; 1002, AMY1B, 4483, 106933, 686-1363; 1002, AMY1B, 4484, 106934, 89-403; 1002, AMY1B, 4481, 106931, 296-1831; 1002, AMY1B, 4482, 106932, 218-1753; 1003, AMY1C, 4485, 106935, 65-1600; 1004, AMY2A, 4486, 106936, 1-626; 1004, AMY2A, 4487, 106937, 65-1600; 1004, AMY2A, 4488, 106938, 296-1831; 1005, AMY2B, 4490, 106940, 545-832; 1005, AMY2B, 4491, 106941, 611-869; 1005, AMY2B, 4489, 106939, 617-2152; 1005, AMY2B, 4492, 106942, 1342-2454; 1005, AMY2B, 4493, 106943, 171-1706; 1006, AGL, 4494, 106944, 479-5077; 1006, AGL, 4495, 106945, 263-4810; 1006, AGL, 4496, 106946, 260-4810; 1006, AGL, 4497, 106947, 401-4999; 1006, AGL, 4498, 106948, 1-4551; 1006, AGL, 4499, 106949, 199-4797; 1006, AGL, 4500, 106950, 139-4737; 1007, APP, 4506, 106956, 193-2175; 1007, APP, 4508, 106958, 1-1456; 1007, APP, 4509, 106959, 35-2179; 1007, APP, 4510, 106960, 1-541; 1007, APP, 4501, 106951, 35-2347; 1007, APP, 4502, 106952, 148-2235; 1007, APP, 4503, 106953, 128-2047; 1007, APP, 4504, 106954, 168-2423; 1007, APP, 4505, 106955, 48-2306; 1007, APP, 4507, 106957, 267-2507; 1008, APBA1, 4512, 106962, 1-1314; 1008, APBA1, 4513, 106963, 1-367; 1008, APBA1, 4514, 106964, 1-367; 1008, APBA1, 4511, 106961, 224-2737; 1009, APBA2, 4516, 106966, 582-594; 1009, APBA2, 4518, 106968, 376-711; 1009, APBA2, 4521, 106971, 146-936; 1009, APBA2, 4522, 106972, 473-554; 1009, APBA2, 4523, 106973, 326-535; 1009, APBA2, 4527, 106977, 146-936; 1009, APBA2, 4528, 106978, 473-554; 1009, APBA2, 4530, 106980, 205-217; 1009, APBA2, 4531, 106981, 376-711; 1009, APBA2, 4532, 106982, 326-535; 1009, APBA2, 4515, 106965, 208-2421; 1009, APBA2, 4517, 106967, 552-2765; 1009, APBA2, 4519, 106969, 305-2554; 1009, APBA2, 4520, 106970, 600-2849; 1009, APBA2, 4524, 106974, 208-2457; 1009, APBA2, 4525, 106975, 205-2454; 1009, APBA2, 4526, 106976, 205-2418; 1009, APBA2, 4529, 106979, 174-2423; 1010, APBA3, 4533, 106983, 202-1929; 1011, APBB1, 4536, 106986, 142-2274; 1011, APBB1, 4539, 106989, 230-1014; 1011, APBB1, 4541, 106991, 162-424; 1011, APBB1, 4542, 106992, 102-2221; 1011, APBB1, 4545, 106995, 364-1071; 1011, APBB1, 4548, 106998, 70-1497; 1011, APBB1, 4549, 106999, 382-1737; 1011, APBB1, 4550, 107000, 342-1697; 1011, APBB1, 4534, 106984, 101-2227; 1011, APBB1, 4535, 106985, 84-2210; 1011, APBB1, 4537, 106987, 94-1560; 1011, APBB1, 4538, 106988, 382-1737; 1011, APBB1, 4540, 106990, 340-1695; 1011, APBB1, 4543, 106993, 39-1511; 1011, APBB1, 4544, 106994, 331-1686; 1011, APBB1, 4546, 106996, 43-1470; 1011, APBB1, 4547, 106997, 101-2233; 1012, APBB1IP, 4551, 107001, 234-752; 1012, APBB1IP, 4552, 107002, 456-2456; 1013, APBB2, 4554, 107004, 515-544; 1013, APBB2, 4555, 107005, 277-537; 1013, APBB2, 4556, 107006, 628-2841; 1013, APBB2, 4557, 107007, 266-550; 1013, APBB2, 4558, 107008, 523-604; 1013, APBB2, 4559, 107009, 1-125; 1013, APBB2, 4561, 107011, 488-907; 1013, APBB2, 4562, 107012, 435-639; 1013, APBB2, 4563, 107013, 1-426; 1013, APBB2, 4564, 107014, 415-493; 1013, APBB2, 4567, 107017, 1-539; 1013, APBB2, 4568, 107018, 286-591; 1013, APBB2, 4570, 107020, 1-2185; 1013, APBB2, 4553, 107003, 631-2907; 1013, APBB2, 4560, 107010, 296-928; 1013, APBB2, 4565, 107015, 290-922; 1013, APBB2, 4566, 107016, 471-2681; 1013, APBB2, 4569, 107019, 545-2824; 1013, APBB2, 4571, 107021, 296-928; 1014, APBB3, 4575, 107025, 360-1379; 1014, APBB3, 4578, 107028, 1-1014; 1014, APBB3, 4580, 107030, 127-618; 1014, APBB3, 4572, 107022, 16-1497; 1014, APBB3, 4573, 107023, 16-1491; 1014, APBB3, 4574, 107024, 445-1905; 1014, APBB3, 4576, 107026, 1-1455; 1014, APBB3, 4577, 107027, 1-738; 1014, APBB3, 4579, 107029, 88-732; 1015, APLP1, 4582, 107032, 346-2181; 1015, APLP1, 4583, 107033, 66-2000; 1015, APLP1, 4584, 107034, 68-586; 1015, APLP1, 4585, 107035, 1-664; 1015, APLP1, 4586, 107036, 75-431; 1015, APLP1, 4587, 107037, 443-1324; 1015, APLP1, 4588, 107038, 1-869; 1015, APLP1, 4581, 107031, 193-2148; 1016, APLP2, 4593, 107043, 85-192; 1016, APLP2, 4594, 107044, 85-560; 1016, APLP2, 4595, 107045, 85-560; 1016, APLP2, 4596, 107046, 142-261; 1016, APLP2, 4597, 107047, 85-435; 1016, APLP2, 4589, 107039, 73-2364; 1016, APLP2, 4590, 107040, 63-1631; 1016, APLP2, 4591, 107041, 46-2331; 1016, APLP2, 4592, 107042, 58-2313; 1016, APLP2, 4598, 107048, 85-2172; 1017, APPBP2, 4600, 107050, 77-447; 1017, APPBP2, 4601, 107051, 8-295; 1017, APPBP2, 4602, 107052, 202-387; 1017, APPBP2, 4599, 107049, 289-2046; 1018, APCS, 4603, 107053, 98-769; 1019, ALS2, 4605, 107055, 154-571; 1019, ALS2, 4606, 107056, 241-559; 1019, ALS2, 4607, 107057, 1-1756; 1019, ALS2, 4604, 107054, 374-5347; 1019, ALS2, 4608, 107058, 141-1331; 1020, ALS2CR11, 4609, 107059, 46-1917; 1020, ALS2CR11, 4610, 107060, 49-1701; 1020, ALS2CR11, 4611, 107061, 25-1212; 1020, ALS2CR11, 4612, 107062, 46-5508; 1021, ALS2CR12, 4616, 107066, 1-430; 1021, ALS2CR12, 4617, 107067, 1-374; 1021, ALS2CR12, 4618, 107068, 312-458; 1021, ALS2CR12, 4613, 107063, 48-1385; 1021, ALS2CR12, 4614, 107064, 445-1713; 1021, ALS2CR12, 4615, 107065, 445-1782; 1021, ALS2CR12, 4619, 107069, 133-1401; 1022, ANAPC1, 4621, 107071, 1-4357; 1022, ANAPC1, 4622, 107072, 54-503; 1022, ANAPC1, 4623, 107073, 1-450; 1022, ANAPC1, 4620, 107070, 774-6608; 1023, ANAPC10, 4626, 107076, 215-689; 1023, ANAPC10, 4627, 107077, 319-794; 1023, ANAPC10, 4628, 107078, 151-477; 1023, ANAPC10, 4630, 107080, 403-608; 1023, ANAPC10, 4631, 107081, 77-457; 1023, ANAPC10, 4624, 107074, 96-653; 1023, ANAPC10, 4625, 107075, 156-713; 1023, ANAPC10, 4629, 107079, 95-652; 1023, ANAPC10, 4632, 107082, 319-876; 1024, ANAPC11, 4643, 107093, 198-332;

1024, ANAPC11, 4644, 107094, 13-345; 1024, ANAPC11, 4645, 107095, 123-257; 1024, ANAPC11, 4646, 107096, 72-206; 1024, ANAPC11, 4650, 107100, 82-216; 1024, ANAPC11, 4651, 107101, 194-328; 1024, ANAPC11, 4652, 107102, 171-386; 1024, ANAPC11, 4654, 107104, 262-531; 1024, ANAPC11, 4633, 107083, 196-450; 1024, ANAPC11, 4634, 107084, 137-727; 1024, ANAPC11, 4635, 107085, 244-498; 1024, ANAPC11, 4636, 107086, 137-391; 1024, ANAPC11, 4637, 107087, 141-395; 1024, ANAPC11, 4638, 107088, 181-435; 1024, ANAPC11, 4639, 107089, 193-447; 1024, ANAPC11, 4640, 107090, 177-431; 1024, ANAPC11, 4641, 107091, 134-388; 1024, ANAPC11, 4642, 107092, 123-377; 1024, ANAPC11, 4647, 107097, 229-483; 1024, ANAPC11, 4648, 107098, 56-310; 1024, ANAPC11, 4649, 107099, 134-388; 1024, ANAPC11, 4653, 107103, 251-505; 1025, ANAPC13, 4655, 107105, 103-327; 1025, ANAPC13, 4656, 107106, 158-382; 1025, ANAPC13, 4657, 107107, 732-956; 1025, ANAPC13, 4658, 107108, 317-541; 1026, ANAPC15, 4660, 107110, 53-330; 1026, ANAPC15, 4661, 107111, 43-615; 1026, ANAPC15, 4662, 107112, 236-606; 1026, ANAPC15, 4663, 107113, 274-468; 1026, ANAPC15, 4666, 107116, 430-563; 1026, ANAPC15, 4668, 107118, 191-508; 1026, ANAPC15, 4672, 107122, 92-424; 1026, ANAPC15, 4659, 107109, 227-592; 1026, ANAPC15, 4664, 107114, 208-585; 1026, ANAPC15, 4665, 107115, 211-576; 1026, ANAPC15, 4667, 107117, 405-770; 1026, ANAPC15, 4669, 107119, 138-503; 1026, ANAPC15, 4670, 107120, 201-578; 1026, ANAPC15, 4671, 107121, 155-520; 1026, ANAPC15, 4673, 107123, 48-413; 1026, ANAPC15, 4674, 107124, 191-556; 1027, ANAPC16, 4677, 107127, 101-358; 1027, ANAPC16, 4675, 107125, 119-451; 1027, ANAPC16, 4676, 107126, 493-825; 1028, ANAPC2, 4678, 107128, 6-2474; 1029, ANAPC4, 4680, 107130, 109-595; 1029, ANAPC4, 4681, 107131, 41-292; 1029, ANAPC4, 4679, 107129, 143-2569; 1029, ANAPC4, 4682, 107132, 63-2492; 1030, ANAPC5, 4685, 107135, 1-1189; 1030, ANAPC5, 4686, 107136, 690-1955; 1030, ANAPC5, 4687, 107137, 49-2277; 1030, ANAPC5, 4688, 107138, 263-915; 1030, ANAPC5, 4689, 107139, 377-509; 1030, ANAPC5, 4690, 107140, 56-704; 1030, ANAPC5, 4683, 107133, 123-2390; 1030, ANAPC5, 4684, 107134, 93-2024; 1031, ANAPC7, 4693, 107143, 1-448; 1031, ANAPC7, 4694, 107144, 1-163; 1031, ANAPC7, 4691, 107141, 2-1801; 1031, ANAPC7, 4692, 107142, 2-1615; 1032, ALK, 4696, 107146, 1-459; 1032, ALK, 4697, 107147, 1-1743; 1032, ALK, 4698, 107148, 468-4199; 1032, ALK, 4695, 107145, 908-5770; 1033, AUP1, 4699, 107149, 311-1543; 1033, AUP1, 4700, 107150, 132-1253; 1034, AR, 4701, 107151, 525-3287; 1034, AR, 4703, 107153, 1116-3320; 1034, AR, 4704, 107154, 328-2262; 1034, AR, 4705, 107155, 328-2130; 1034, AR, 4706, 107156, 328-2046; 1034, AR, 4707, 107157, 328-2256; 1034, AR, 4708, 107158, 1686-3899; 1034, AR, 4702, 107152, 115-1281; 1035, ADTRP, 4710, 107160, 486-991; 1035, ADTRP, 4712, 107162, 1-261; 1035, ADTRP, 4713, 107163, 314-817; 1035, ADTRP, 4714, 107164, 1-362; 1035, ADTRP, 4715, 107165, 1-351; 1035, ADTRP, 4709, 107159, 45-791; 1035, ADTRP, 4711, 107161, 412-1104; 1036, AIG1, 4717, 107167, 12-683; 1036, AIG1, 4719, 107169, 26-169; 1036, AIG1, 4720, 107170, 150-727; 1036, AIG1, 4721, 107171, 74-444; 1036, AIG1, 4722, 107172, 179-593; 1036, AIG1, 4716, 107166, 26-763; 1036, AIG1, 4718, 107168, 51-767; 1036, AIG1, 4723, 107173, 26-439; 1036, AIG1, 4724, 107174, 28-432; 1037, ADGB, 4725, 107175, 141-918; 1037, ADGB, 4726, 107176, 1-339; 1037, ADGB, 4727, 107177, 1-1878; 1037, ADGB, 4729, 107179, 135-557; 1037, ADGB, 4730, 107180, 72-607; 1037, ADGB, 4731, 107181, 1-2144; 1037, ADGB, 4732, 107182, 75-182; 1037, ADGB, 4733, 107183, 37-699; 1037, ADGB, 4734, 107184, 1-216; 1037, ADGB, 4728, 107178, 77-5080; 1038, ANGEL1, 4736, 107186, 449-1156; 1038, ANGEL1, 4737, 107187, 339-727; 1038, ANGEL1, 4738, 107188, 352-553; 1038, ANGEL1, 4735, 107185, 114-2126; 1039, ANGEL2, 4742, 107192, 11-799; 1039, ANGEL2, 4739, 107189, 337-1464; 1039, ANGEL2, 4740, 107190, 156-1790; 1039, ANGEL2, 4741, 107191, 341-1468; 1040, AAMP, 4744, 107194, 70-671; 1040, MMP, 4745, 107195, 1-569; 1040, AAMP, 4746, 107196, 93-1400; 1040, AAMP, 4747, 107197, 143-1390; 1040, AAMP, 4743, 107193, 172-1476; 1041, AGGF1, 4749, 107199, 1-262; 1041, AGGF1, 4748, 107198, 383-2527; 1041, AGGF1, 4750, 107200, 312-842; 1042, ANG, 4751, 107201, 601-1044; 1042, ANG, 4752, 107202, 121-564; 1043, AMOT, 4754, 107204, 155-1948; 1043, AMOT, 4756, 107206, 107-2665; 1043, AMOT, 4753, 107203, 797-2824; 1043, AMOT, 4755, 107205, 1-3255; 1043, AMOT, 4757, 107207, 76-3330; 1044, AMOTL1, 4758, 107208, 218-653; 1044, AMOTL1, 4759, 107209, 171-2891; 1044, AMOTL1, 4760, 107210, 142-3012; 1045, AMOTL2, 4763, 107213, 437-535; 1045, AMOTL2, 4764, 107214, 163-544; 1045, AMOTL2, 4766, 107216, 171-623; 1045, AMOTL2, 4768, 107218, 252-845; 1045, AMOTL2, 4769, 107219, 94-527; 1045, AMOTL2, 4770, 107220, 344-713; 1045, AMOTL2, 4761, 107211, 315-2657; 1045, AMOTL2, 4762, 107212, 168-2507; 1045, AMOTL2, 4765, 107215, 180-2693; 1045, AMOTL2, 4767, 107217, 166-2499; 1046, ANGPT1, 4773, 107223, 458-548; 1046, ANGPT1, 4774, 107224, 287-1180; 1046, ANGPT1, 4775, 107225, 287-1183; 1046, ANGPT1, 4771, 107221, 498-1991; 1046, ANGPT1, 4772, 107222, 453-1949; 1047, ANGPT2, 4778, 107228, 312-1691; 1047, ANGPT2, 4776, 107226, 476-1966; 1047, ANGPT2, 4777, 107227, 111-1445; 1047, ANGPT2, 4779, 107229, 312-1799; 1048, ANGPT4, 4780, 107230, 104-1615; 1049, ANGPTL1, 4783, 107233, 192-534; 1049, ANGPTL1, 4781, 107231, 449-1924; 1049, ANGPTL1, 4782, 107232, 309-1784; 1050, ANGPTL2, 4784, 107234, 410-985; 1050, ANGPTL2, 4785, 107235, 619-2100; 1051, ANGPTL3, 4786, 107236, 81-1463; 1052, ANGPTL4, 4789, 107239, 265-552; 1052, ANGPTL4, 4790, 107240, 557-813; 1052, ANGPTL4, 4792, 107242, 1-389; 1052, ANGPTL4, 4793, 107243, 167-553; 1052, ANGPTL4, 4794, 107244, 258-571; 1052, ANGPTL4, 4787, 107237, 172-1392; 1052, ANGPTL4, 4788, 107238, 154-1260; 1052, ANGPTL4, 4791, 107241, 154-1374; 1053, ANGPTL5, 4796, 107246, 26-601; 1053, ANGPTL5, 4795, 107245, 597-1763; 1054, ANGPTL6, 4798, 107248, 36-1328; 1054, ANGPTL6, 4797, 107247, 240-1652; 1054, ANGPTL6, 4799, 107249, 119-1531; 1055, ANGPTL7, 4800, 107250, 240-1280; 1056, ACE, 4804, 107254, 35-3763; 1056, ACE, 4805, 107255, 25-462; 1056, ACE, 4806, 107256, 23-133; 1056, ACE, 4807, 107257, 61-1002; 1056, ACE, 4808, 107258, 23-649; 1056, ACE, 4809, 107259, 1-846; 1056, ACE, 4810, 107260, 35-541; 1056, ACE, 4811, 107261, 1-359; 1056, ACE, 4812, 107262, 1-416; 1056, ACE, 4813, 107263, 1-111; 1056, ACE, 4801, 107251, 29-2227; 1056, ACE, 4802, 107252, 25-3945; 1056, ACE, 4803, 107253, 23-2098; 1057, ACE2, 4814, 107264, 104-2521; 1057, ACE2, 4815, 107265, 218-2635; 1058, AGTR1, 4818, 107268, 120-1286; 1058, AGTR1, 4819, 107269, 1-1185; 1058, AGTR1, 4816, 107266, 389-1468; 1058, AGTR1, 4817, 107267, 280-1359; 1058, AGTR1, 4820, 107270, 584-1663; 1058, AGTR1, 4821, 107271, 334-1413; 1058, AGTR1, 4822, 107272, 392-1471; 1058, AGTR1, 4823, 107273, 458-1537; 1059, AGTR2, 4824, 107274, 191-1282;

1060, AGTRAP, 4826, 107276, 57-536; 1060, AGTRAP, 4831, 107281, 35-502; 1060, AGTRAP, 4832, 107282, 93-284; 1060, AGTRAP, 4825, 107275, 55-534; 1060, AGTRAP, 4827, 107277, 63-521; 1060, AGTRAP, 4828, 107278, 126-461; 1060, AGTRAP, 4829, 107279, 86-529; 1060, AGTRAP, 4830, 107280, 37-504; 1061, AGT, 4833, 107283, 216-1673; 1062, ANLN, 4836, 107286, 1-209; 1062, ANLN, 4837, 107287, 1-222; 1062, ANLN, 4838, 107288, 1-757; 1062, ANLN, 4839, 107289, 1-829; 1062, ANLN, 4840, 107290, 90-596; 1062, ANLN, 4841, 107291, 356-463; 1062, ANLN, 4842, 107292, 1-79; 1062, ANLN, 4843, 107293, 1-707; 1062, ANLN, 4834, 107284, 222-3596; 1062, ANLN, 4835, 107285, 207-3470; 1063, ANKH, 4845, 107295, 280-660; 1063, ANKH, 4844, 107294, 332-1810; 1064, ANKHD1-EIF4EBP3, 4846, 107296, 1-1911; 1064, ANKHD1-EIF4EBP3, 4847, 107297, 61-7914; 1065, ANK1, 4852, 107302, 185-525; 1065, ANK1, 4854, 107304, 1-533; 1065, ANK1, 4855, 107305, 239-634; 1065, ANK1, 4856, 107306, 1-3121; 1065, ANK1, 4848, 107298, 283-5976; 1065, ANK1, 4849, 107299, 85-5727; 1065, ANK1, 4850, 107300, 252-581; 1065, ANK1, 4851, 107301, 252-719; 1065, ANK1, 4853, 107303, 85-5730; 1065, ANK1, 4857, 107307, 264-734; 1066, ANK2, 4858, 107308, 1-11775; 1066, ANK2, 4861, 107311, 196-5029; 1066, ANK2, 4863, 107313, 349-545; 1066, ANK2, 4865, 107315, 1-243; 1066, ANK2, 4866, 107316, 1-3087; 1066, ANK2, 4867, 107317, 1-2899; 1066, ANK2, 4868, 107318, 1-592; 1066, ANK2, 4869, 107319, 298-829; 1066, ANK2, 4870, 107320, 196-3537; 1066, ANK2, 4871, 107321, 80-5270; 1066, ANK2, 4872, 107322, 238-573; 1066, ANK2, 4873, 107323, 316-3462; 1066, ANK2, 4874, 107324, 1-561; 1066, ANK2, 4875, 107325, 99-641; 1066, ANK2, 4876, 107326, 1-3584; 1066, ANK2, 4859, 107309, 54-11927; 1066, ANK2, 4860, 107310, 54-5672; 1066, ANK2, 4862, 107312, 7-1674; 1066, ANK2, 4864, 107314, 196-5787; 1067, ANK3, 4879, 107329, 75-660; 1067, ANK3, 4880, 107330, 1-1380; 1067, ANK3, 4882, 107332, 354-569; 1067, ANK3, 4883, 107333, 1-345; 1067, ANK3, 4884, 107334, 1-501; 1067, ANK3, 4885, 107335, 1-587; 1067, ANK3, 4887, 107337, 129-947; 1067, ANK3, 4888, 107338, 1-562; 1067, ANK3, 4889, 107339, 68-544; 1067, ANK3, 4890, 107340, 1-261; 1067, ANK3, 4891, 107341, 1-651; 1067, ANK3, 4892, 107342, 1-724; 1067, ANK3, 4893, 107343, 1-4930; 1067, ANK3, 4894, 107344, 1-2606; 1067, ANK3, 4895, 107345, 309-2744; 1067, ANK3, 4896, 107346, 1-965; 1067, ANK3, 4897, 107347, 1-290; 1067, ANK3, 4898, 107348, 1-526; 1067, ANK3, 4899, 107349, 1-536; 1067, ANK3, 4900, 107350, 1-604; 1067, ANK3, 4901, 107351, 1-2920; 1067, ANK3, 4902, 107352, 383-1735; 1067, ANK3, 4903, 107353, 176-367; 1067, ANK3, 4877, 107327, 193-13326; 1067, ANK3, 4878, 107328, 650-3655; 1067, ANK3, 4881, 107331, 172-5757; 1067, ANK3, 4886, 107336, 137-5743; 1068, ANKAR, 4905, 107355, 302-3331; 1068, ANKAR, 4904, 107354, 65-4369; 1068, ANKAR, 4906, 107356, 649-3054; 1068, ANKAR, 4907, 107357, 89-4393; 1069, ABTB1, 4911, 107361, 1-425; 1069, ABTB1, 4912, 107362, 69-242; 1069, ABTB1, 4913, 107363, 92-265; 1069, ABTB1, 4908, 107358, 87-1523; 1069, ABTB1, 4909, 107359, 506-1516; 1069, ABTB1, 4910, 107360, 617-1627; 1070, ABTB2, 4914, 107364, 426-3503; 1071, ANKDD1A, 4916, 107366, 1-1272; 1071, ANKDD1A, 4917, 107367, 1-1200; 1071, ANKDD1A, 4918, 107368, 54-599; 1071, ANKDD1A, 4919, 107369, 1-402; 1071, ANKDD1A, 4920, 107370, 4-375; 1071, ANKDD1A, 4921, 107371, 1-1272; 1071, ANKDD1A, 4915, 107365, 30-1598; 1072, ANKDD1B, 4922, 107372, 177-1763; 1073, ANKEF1, 4923, 107373, 330-2660; 1073, ANKEF1, 4924, 107374, 402-2732; 1074, ANKFY1, 4926, 107376, 391-570; 1074, ANKFY1, 4929, 107379, 16-225; 1074, ANKFY1, 4930, 107380, 1-242; 1074, ANKFY1, 4925, 107375, 37-3546; 1074, ANKFY1, 4927, 107377, 16-3528; 1074, ANKFY1, 4928, 107378, 118-3753; 1075, ANKIB1, 4932, 107382, 1-163; 1075, ANKIB1, 4933, 107383, 1-254; 1075, ANKIB1, 4934, 107384, 146-547; 1075, ANKIB1, 4935, 107385, 1-487; 1075, ANKIB1, 4931, 107381, 377-3646; 1076, ANKHD1, 4936, 107386, 1-2062; 1076, ANKHD1, 4937, 107387, 5006-7606; 1076, ANKHD1, 4941, 107391, 1-3219; 1076, ANKHD1, 4942, 107392, 1-3648; 1076, ANKHD1, 4943, 107393, 119-4814; 1076, ANKHD1, 4944, 107394, 1-557; 1076, ANKHD1, 4945, 107395, 1-1826; 1076, ANKHD1, 4946, 107396, 1-3073; 1076, ANKHD1, 4947, 107397, 1-2803; 1076, ANKHD1, 4948, 107398, 113-1216; 1076, ANKHD1, 4938, 107388, 155-7783; 1076, ANKHD1, 4939, 107389, 48-1898; 1076, ANKHD1, 4940, 107390, 115-1998; 1076, ANKHD1, 4949, 107399, 155-1900; 1077, ANKK1, 4951, 107401, 1-164; 1077, ANKK1, 4950, 107400, 95-2392; 1078, ANKLE1, 4953, 107403, 61-318; 1078, ANKLE1, 4954, 107404, 115-1434; 1078, ANKLE1, 4955, 107405, 61-1992; 1078, ANKLE1, 4956, 107406, 1-1796; 1078, ANKLE1, 4952, 107402, 115-2124; 1079, ANKLE2, 4958, 107408, 1-357; 1079, ANKLE2, 4961, 107411, 784-1557; 1079, ANKLE2, 4957, 107407, 91-2907; 1079, ANKLE2, 4959, 107409, 1985-2866; 1079, ANKLE2, 4960, 107410, 1456-2337; 1080, ANKMY1, 4964, 107414, 100-2262; 1080, ANKMY1, 4965, 107415, 426-1166; 1080, ANKMY1, 4966, 107416, 1-569; 1080, ANKMY1, 4967, 107417, 161-2692; 1080, ANKMY1, 4968, 107418, 101-2209; 1080, ANKMY1, 4969, 107419, 483-1361; 1080, ANKMY1, 4970, 107420, 1-252; 1080, ANKMY1, 4972, 107422, 140-3232; 1080, ANKMY1, 4973, 107423, 1-565; 1080, ANKMY1, 4974, 107424, 430-652; 1080, ANKMY1, 4975, 107425, 52-555; 1080, ANKMY1, 4976, 107426, 264-945; 1080, ANKMY1, 4962, 107412, 216-3041; 1080, ANKMY1, 4963, 107413, 159-2312; 1080, ANKMY1, 4971, 107421, 159-1478; 1081, ANKMY2, 4978, 107428, 183-1208; 1081, ANKMY2, 4979, 107429, 90-299; 1081, ANKMY2, 4980, 107430, 245-1270; 1081, ANKMY2, 4981, 107431, 1-210; 1081, ANKMY2, 4977, 107427, 245-1570; 1082, ASB1, 4983, 107433, 68-772; 1082, ASB1, 4984, 107434, 43-228; 1082, ASB1, 4982, 107432, 248-1255; 1083, ASB10, 4988, 107438, 57-404; 1083, ASB10, 4985, 107435, 262-1551; 1083, ASB10, 4986, 107436, 111-1469; 1083, ASB10, 4987, 107437, 26-1429; 1084, ASB11, 4992, 107442, 1-675; 1084, ASB11, 4989, 107439, 74-982; 1084, ASB11, 4990, 107440, 20-940; 1084, ASB11, 4991, 107441, 52-1023; 1085, ASB12, 4993, 107443, 194-1150; 1086, ASB13, 4994, 107444, 28-864; 1086, ASB13, 4995, 107445, 28-549; 1087, ASB14, 4996, 107446, 122-1885; 1087, ASB14, 4997, 107447, 122-1885; 1088, ASB15, 5001, 107451, 43-765; 1088, ASB15, 5002, 107452, 240-531; 1088, ASB15, 5004, 107454, 622-1371; 1088, ASB15, 4998, 107448, 43-1809; 1088, ASB15, 4999, 107449, 165-1931; 1088, ASB15, 5000, 107450, 522-2288; 1088, ASB15, 5003, 107453, 293-2059; 1089, ASB16, 5006, 107456, 67-888; 1089, ASB16, 5007, 107457, 287-499; 1089, ASB16, 5005, 107455, 85-1446; 1090, ASB17, 5008, 107458, 141-1028; 1091, ASB18, 5010, 107460, 65-650; 1091, ASB18, 5011, 107461, 1-447; 1091, ASB18, 5009, 107459, 1-1401; 1092, ASB2, 5013, 107463, 468-1911; 1092, ASB2, 5014, 107464, 210-576; 1092, ASB2, 5016, 107466, 327-661; 1092, ASB2, 5017, 107467, 160-566; 1092, ASB2, 5019, 107469, 327-661; 1092, ASB2, 5020, 107470, 468-1911; 1092, ASB2, 5021, 107471, 210-

576; 1092, ASB2, 5023, 107473, 160-566; 1092, ASB2, 5012, 107462, 490-2253; 1092, ASB2, 5015, 107465, 432-2339; 1092, ASB2, 5018, 107468, 432-2339; 1092, ASB2, 5022, 107472, 490-2253; 1093, ASB3, 5025, 107475, 213-1550; 1093, ASB3, 5026, 107476, 684-2021; 1093, ASB3, 5027, 107477, 1-1432; 1093, ASB3, 5024, 107474, 136-1692; 1094, ASB4, 5028, 107478, 72-1352; 1094, ASB4, 5029, 107479, 72-1121; 1095, ASB5, 5032, 107482, 544-603; 1095, ASB5, 5030, 107480, 115-1104; 1095, ASB5, 5031, 107481, 179-1009; 1096, ASB6, 5035, 107485, 171-1349; 1096, ASB6, 5033, 107483, 167-1432; 1096, ASB6, 5034, 107484, 126-719; 1097, ASB7, 5038, 107488, 712-1062; 1097, ASB7, 5036, 107486, 786-1742; 1097, ASB7, 5037, 107487, 711-1535; 1098, ASB8, 5040, 107490, 141-401; 1098, ASB8, 5041, 107491, 229-570; 1098, ASB8, 5042, 107492, 53-250; 1098, ASB8, 5043, 107493, 166-423; 1098, ASB8, 5044, 107494, 167-367; 1098, ASB8, 5045, 107495, 163-420; 1098, ASB8, 5046, 107496, 225-561; 1098, ASB8, 5047, 107497, 91-378; 1098, ASB8, 5048, 107498, 163-423; 1098, ASB8, 5049, 107499, 87-287; 1098, ASB8, 5050, 107500, 419-800; 1098, ASB8, 5051, 107501, 74-331; 1098, ASB8, 5053, 107503, 430-582; 1098, ASB8, 5054, 107504, 78-278; 1098, ASB8, 5039, 107489, 171-1037; 1098, ASB8, 5052, 107502, 167-1033; 1099, ASB9, 5059, 107509, 1-633; 1099, ASB9, 5055, 107505, 178-936; 1099, ASB9, 5056, 107506, 188-976; 1099, ASB9, 5057, 107507, 275-1159; 1099, ASB9, 5058, 107508, 485-1273; 1100, ANKS1A, 5060, 107510, 139-3543; 1101, ANKS1B, 5061, 107511, 467-1336; 1101, ANKS1B, 5062, 107512, 1-996; 1101, ANKS1B, 5070, 107520, 1-1598; 1101, ANKS1B, 5073, 107523, 418-2105; 1101, ANKS1B, 5075, 107525, 1-157; 1101, ANKS1B, 5076, 107526, 210-533; 1101, ANKS1B, 5077, 107527, 410-694; 1101, ANKS1B, 5078, 107528, 281-569; 1101, ANKS1B, 5079, 107529, 373-489; 1101, ANKS1B, 5080, 107530, 401-460; 1101, ANKS1B, 5081, 107531, 336-418; 1101, ANKS1B, 5082, 107532, 327-779; 1101, ANKS1B, 5083, 107533, 383-574; 1101, ANKS1B, 5063, 107513, 475-1239; 1101, ANKS1B, 5064, 107514, 135-1208; 1101, ANKS1B, 5065, 107515, 1-1383; 1101, ANKS1B, 5066, 107516, 255-1607; 1101, ANKS1B, 5067, 107517, 273-1805; 1101, ANKS1B, 5068, 107518, 1-1281; 1101, ANKS1B, 5069, 107519, 301-2595; 1101, ANKS1B, 5071, 107521, 255-1499; 1101, ANKS1B, 5072, 107522, 1-3747; 1101, ANKS1B, 5074, 107524, 118-1302; 1102, ANKS3, 5085, 107535, 225-1874; 1102, ANKS3, 5086, 107536, 286-1869; 1102, ANKS3, 5087, 107537, 135-320; 1102, ANKS3, 5089, 107539, 40-684; 1102, ANKS3, 5090, 107540, 40-420; 1102, ANKS3, 5091, 107541, 155-672; 1102, ANKS3, 5092, 107542, 226-411; 1102, ANKS3, 5093, 107543, 76-566; 1102, ANKS3, 5094, 107544, 102-344; 1102, ANKS3, 5095, 107545, 193-1146; 1102, ANKS3, 5096, 107546, 163-561; 1102, ANKS3, 5097, 107547, 1-867; 1102, ANKS3, 5098, 107548, 52-237; 1102, ANKS3, 5099, 107549, 47-469; 1102, ANKS3, 5100, 107550, 803-1128; 1102, ANKS3, 5101, 107551, 204-968; 1102, ANKS3, 5102, 107552, 226-723; 1102, ANKS3, 5103, 107553, 193-537; 1102, ANKS3, 5084, 107534, 296-2266; 1102, ANKS3, 5088, 107538, 144-1895; 1102, ANKS3, 5104, 107554, 19-1989; 1103, ANKS4B, 5105, 107555, 74-1327; 1104, ANKS6, 5107, 107557, 324-2078; 1104, ANKS6, 5108, 107558, 1-1024; 1104, ANKS6, 5106, 107556, 49-2664; 1105, ANKUB1, 5109, 107559, 458-2092; 1105, ANKUB1, 5111, 107561, 458-577; 1105, ANKUB1, 5110, 107560, 401-1909; 1106, ANKZF1, 5114, 107564, 381-1931; 1106, ANKZF1, 5115, 107565, 166-511; 1106, ANKZF1, 5116, 107566, 300-571; 1106, ANKZF1, 5117, 107567, 116-537; 1106, ANKZF1, 5118, 107568, 94-255; 1106, ANKZF1, 5119, 107569, 374-552; 1106, ANKZF1, 5112, 107562, 175-2355; 1106, ANKZF1, 5113, 107563, 102-2282; 1107, ANKRD1, 5120, 107570, 250-1209; 1108, ANKRD10, 5123, 107573, 104-589; 1108, ANKRD10, 5124, 107574, 1-365; 1108, ANKRD10, 5121, 107571, 136-1398; 1108, ANKRD10, 5122, 107572, 73-735; 1109, ANKRD11, 5126, 107576, 124-417; 1109, ANKRD11, 5128, 107578, 418-525; 1109, ANKRD11, 5129, 107579, 57-350; 1109, ANKRD11, 5130, 107580, 101-475; 1109, ANKRD11, 5131, 107581, 1-616; 1109, ANKRD11, 5132, 107582, 219-1319; 1109, ANKRD11, 5125, 107575, 462-8453; 1109, ANKRD11, 5127, 107577, 290-8281; 1110, ANKRD12, 5134, 107584, 1-292; 1110, ANKRD12, 5135, 107585, 286-1602; 1110, ANKRD12, 5137, 107587, 48-978; 1110, ANKRD12, 5138, 107588, 353-390; 1110, ANKRD12, 5139, 107589, 179-427; 1110, ANKRD12, 5140, 107590, 180-313; 1110, ANKRD12, 5133, 107583, 241-6429; 1110, ANKRD12, 5136, 107586, 363-6482; 1111, ANKRD13D, 5146, 107596, 1-98; 1111, ANKRD13D, 5147, 107597, 316-642; 1111, ANKRD13D, 5141, 107591, 512-2068; 1111, ANKRD13D, 5142, 107592, 1176-2732; 1111, ANKRD13D, 5143, 107593, 171-1988; 1111, ANKRD13D, 5144, 107594, 192-959; 1111, ANKRD13D, 5145, 107595, 429-1985; 1112, ANKRD13A, 5149, 107599, 1-252; 1112, ANKRD13A, 5150, 107600, 1-904; 1112, ANKRD13A, 5151, 107601, 303-824; 1112, ANKRD13A, 5152, 107602, 1-521; 1112, ANKRD13A, 5148, 107598, 167-1939; 1113, ANKRD13B, 5155, 107605, 1-387; 1113, ANKRD13B, 5156, 107606, 377-582; 1113, ANKRD13B, 5153, 107603, 155-2035; 1113, ANKRD13B, 5154, 107604, 155-2035; 1113, ANKRD13B, 5157, 107607, 155-2035; 1114, ANKRD13C, 5158, 107608, 327-1847; 1114, ANKRD13C, 5159, 107609, 315-1940; 1115, ANKRD16, 5160, 107610, 553-1467; 1115, ANKRD16, 5161, 107611, 518-1603; 1115, ANKRD16, 5162, 107612, 545-1630; 1116, ANKRD17, 5166, 107616, 131-2717; 1116, ANKRD17, 5167, 107617, 1-7463; 1116, ANKRD17, 5163, 107613, 131-7189; 1116, ANKRD17, 5164, 107614, 118-7929; 1116, ANKRD17, 5165, 107615, 88-7560; 1117, ANKRD18A, 5169, 107619, 1-1206; 1117, ANKRD18A, 5168, 107618, 376-3354; 1118, ANKRD18B, 5171, 107621, 1-1206; 1118, ANKRD18B, 5172, 107622, 1-483; 1118, ANKRD18B, 5173, 107623, 1-223; 1118, ANKRD18B, 5170, 107620, 97-3132; 1119, ANKRD2, 5176, 107626, 291-1292; 1119, ANKRD2, 5177, 107627, 11-913; 1119, ANKRD2, 5174, 107624, 210-1193; 1119, ANKRD2, 5175, 107625, 210-1292; 1120, ANKRD20A1, 5179, 107629, 30-586; 1120, ANKRD20A1, 5180, 107630, 265-552; 1120, ANKRD20A1, 5178, 107628, 281-2752; 1121, ANKRD20A2, 5182, 107632, 81-509; 1121, ANKRD20A2, 5181, 107631, 113-2584; 1122, ANKRD20A3, 5183, 107633, 265-552; 1122, ANKRD20A3, 5184, 107634, 113-2584; 1123, ANKRD20A4, 5186, 107636, 81-509; 1123, ANKRD20A4, 5185, 107635, 282-2753; 1124, ANKRD22, 5187, 107637, 212-787; 1125, ANKRD23, 5188, 107638, 43-960; 1125, ANKRD23, 5189, 107639, 30-821; 1125, ANKRD23, 5190, 107640, 14-931; 1126, ANKRD24, 5193, 107643, 6-2524; 1126, ANKRD24, 5195, 107645, 1-491; 1126, ANKRD24, 5191, 107641, 1-3711; 1126, ANKRD24, 5192, 107642, 157-3597; 1126, ANKRD24, 5194, 107644, 277-3717; 1127, ANKRD26, 5197, 107647, 1-640; 1127, ANKRD26, 5198, 107648, 173-5353; 1127, ANKRD26, 5196, 107646, 167-5299; 1128, ANKRD27, 5200, 107650, 106-628; 1128, ANKRD27, 5201, 107651, 843-1067; 1128, ANKRD27, 5202, 107652, 130-1299; 1128, ANKRD27, 5203, 107653, 153-401; 1128, ANKRD27, 5204, 107654, 652-743; 1128, ANKRD27, 5205, 107655, 108-557; 1128, ANKRD27, 5206, 107656, 130-654; 1128, ANKRD27, 5199, 107649, 160-3312; 1129, ANKRD28, 5209, 107659, 67-111; 1129, ANKRD28, 5210, 107660, 182-2350; 1129, ANKRD28, 5207, 107657, 341-3040; 1129, ANKRD28, 5208, 107658, 369-3530; 1129, ANKRD28, 5211, 107661, 20-3181; 1129, ANKRD28, 5212, 107662, 650-3349; 1130, ANKRD29, 5214, 107664, 154-583; 1130, ANKRD29, 5215, 107665, 1-380; 1130, ANKRD29, 5217, 107667, 43-375; 1130, ANKRD29, 5213, 107663, 86-892; 1130, ANKRD29, 5216, 107666, 156-1061; 1131, ANKRD30A, 5218, 107668, 100-4125; 1131, ANKRD30A, 5219, 107669, 100-4482; 1131, ANKRD30A, 5220, 107670, 100-4125; 1131, ANKRD30A, 5221, 107671, 1-4194; 1132, ANKRD30B, 5222, 107672, 181-4359; 1132, ANKRD30B, 5223, 107673, 86-1945; 1133, ANKRD30BL, 5224, 107674, 251-1006; 1133, ANKRD30BL, 5225, 107675, 251-1027; 1134, ANKRD31, 5227, 107677, 193-5985; 1134, ANKRD31, 5226, 107676, 193-5814; 1135, ANKRD33, 5230, 107680, 179-589; 1135, ANKRD33, 5228, 107678, 228-1586; 1135, ANKRD33, 5229, 107679, 372-1190; 1136, ANKRD33B, 5232, 107682, 139-735; 1136, ANKRD33B, 5231, 107681, 1-1485; 1137, ANKRD34A, 5234, 107684, 361-716; 1137, ANKRD34A, 5235, 107685, 261-571; 1137, ANKRD34A, 5233, 107683, 1296-2786; 1138, ANKRD34B, 5237, 107687, 492-542; 1138, ANKRD34B, 5236, 107686, 674-2218; 1139, ANKRD34C, 5238, 107688, 1-1608; 1140, ANKRD35, 5240, 107690, 109-2844; 1140, ANKRD35, 5239, 107689, 88-3093; 1141, ANKRD36, 5243, 107693, 84-1013; 1141, ANKRD36, 5241, 107691, 245-6070; 1141, ANKRD36, 5242, 107692, 245-6070; 1142, ANKRD36B, 5245, 107695, 131-646; 1142, ANKRD36B, 5247, 107697, 41-454; 1142, ANKRD36B, 5249, 107699, 1325-4423; 1142, ANKRD36B, 5244, 107694, 37-4098; 1142, ANKRD36B, 5246, 107696, 281-4342; 1142, ANKRD36B, 5248, 107698, 180-899; 1143, ANKRD36C, 5252, 107702, 86-1684; 1143, ANKRD36C, 5253, 107703, 1-184; 1143, ANKRD36C, 5254, 107704, 124-615; 1143, ANKRD36C, 5255, 107705, 41-454; 1143, ANKRD36C, 5250, 107700, 206-2062; 1143, ANKRD36C, 5251, 107701, 86-5422; 1144, ANKRD37, 5257, 107707, 473-605; 1144, ANKRD37, 5256, 107706, 441-917; 1145, ANKRD39, 5258, 107708, 109-660; 1145, ANKRD39, 5259, 107709, 28-579; 1146, ANKRD40, 5261, 107711, 483-848; 1146, ANKRD40, 5260, 107710, 271-1377; 1147, ANKRD42, 5262, 107712, 796-2349; 1147, ANKRD42, 5265, 107715, 566-823; 1147, ANKRD42, 5266, 107716, 423-1115; 1147, ANKRD42, 5267, 107717, 274-1782; 1147, ANKRD42, 5268, 107718, 1-429; 1147, ANKRD42, 5269, 107719, 27-1610; 1147, ANKRD42, 5263, 107713, 933-1529; 1147, ANKRD42, 5264, 107714, 163-1332; 1148, ANKRD44, 5274, 107724, 98-326; 1148, ANKRD44, 5275, 107725, 1-2376; 1148, ANKRD44, 5276, 107726, 194-316; 1148, ANKRD44, 5277, 107727, 1-547; 1148, ANKRD44, 5278, 107728, 1-949; 1148, ANKRD44, 5270, 107720, 194-3175; 1148, ANKRD44, 5271, 107721, 78-2837; 1148, ANKRD44, 5272, 107722, 184-1923; 1148, ANKRD44, 5273, 107723, 184-1287; 1149, ANKRD45, 5279, 107729, 62-862; 1150, ANKRD46, 5281, 107731, 77-661; 1150, ANKRD46, 5284, 107734, 346-592; 1150, ANKRD46, 5286, 107736, 272-580; 1150, ANKRD46, 5287, 107737, 311-567; 1150, ANKRD46, 5288, 107738, 145-672; 1150, ANKRD46, 5280, 107730, 180-866; 1150, ANKRD46, 5282, 107732, 805-1491; 1150, ANKRD46, 5283, 107733, 163-861; 1150, ANKRD46, 5285, 107735, 310-996; 1151, ANKRD49, 5290, 107740, 148-525; 1151, ANKRD49, 5291, 107741, 233-567; 1151, ANKRD49, 5293, 107743, 123-562; 1151, ANKRD49, 5294, 107744, 124-515; 1151, ANKRD49, 5295, 107745, 143-520; 1151, ANKRD49, 5296, 107746, 123-383; 1151, ANKRD49, 5297, 107747, 119-496; 1151, ANKRD49, 5289, 107739, 95-814; 1151, ANKRD49, 5292, 107742, 498-1217; 1152, ANKRD50, 5298, 107748, 301-4053; 1152, ANKRD50, 5299, 107749, 1039-5328; 1153, ANKRD52, 5300, 107750, 123-3353; 1154, ANKRD53, 5303, 107753, 195-959; 1154, ANKRD53, 5304, 107754, 140-1630; 1154, ANKRD53, 5301, 107751, 267-1298; 1154, ANKRD53, 5302, 107752, 35-1627; 1155, ANKRD54, 5306, 107756, 294-836; 1155, ANKRD54, 5307, 107757, 322-789; 1155, ANKRD54, 5308, 107758, 86-735; 1155, ANKRD54, 5309, 107759, 1-536; 1155, ANKRD54, 5310, 107760, 328-597; 1155, ANKRD54, 5311, 107761, 84-938; 1155, ANKRD54, 5312, 107762, 1-623; 1155, ANKRD54, 5313, 107763, 419-742; 1155, ANKRD54, 5305, 107755, 194-1096; 1156, ANKRD55, 5315, 107765, 84-620; 1156, ANKRD55, 5316, 107766, 14-1729; 1156, ANKRD55, 5314, 107764, 153-1997; 1156, ANKRD55, 5317, 107767, 237-1217; 1157, ANKRD6, 5321, 107771, 223-576; 1157, ANKRD6, 5322, 107772, 241-546; 1157, ANKRD6, 5323, 107773, 48-737; 1157, ANKRD6, 5324, 107774, 412-574; 1157, ANKRD6, 5325, 107775, 304-829; 1157, ANKRD6, 5326, 107776, 1-230; 1157, ANKRD6, 5327, 107777, 1-455; 1157, ANKRD6, 5329, 107779, 1-393; 1157, ANKRD6, 5330, 107780, 257-1180; 1157, ANKRD6, 5332, 107782, 300-539; 1157, ANKRD6, 5318, 107768, 311-2494; 1157, ANKRD6, 5319, 107769, 350-2428; 1157, ANKRD6, 5320, 107770, 307-2475; 1157, ANKRD6, 5328, 107778, 2-1993; 1157, ANKRD6, 5331, 107781, 642-2825; 1158, ANKRD60, 5333, 107783, 1-1038; 1159, ANKRD61, 5334, 107784, 1-1257; 1160, ANKRD62, 5335, 107785, 166-2919; 1161, ANKRD63, 5336, 107786, 1-1143; 1162, ANKRD65, 5337, 107787, 256-780; 1162, ANKRD65, 5338, 107788, 638-1162; 1162, ANKRD65, 5339, 107789, 313-510; 1162, ANKRD65, 5340, 107790, 313-1512; 1162, ANKRD65, 5341, 107791, 87-1286; 1163, ANKRD66, 5343, 107793, 1-221; 1163, ANKRD66, 5342, 107792, 6-761; 1164, ANKRD7, 5345, 107795, 101-892; 1164, ANKRD7, 5346, 107796, 125-436; 1164, ANKRD7, 5347, 107797, 237-689; 1164, ANKRD7, 5348, 107798, 470-718; 1164, ANKRD7, 5344, 107794, 156-920; 1165, ANKRD9, 5350, 107800, 724-1502; 1165, ANKRD9, 5352, 107802, 305-620; 1165, ANKRD9, 5349, 107799, 598-1551; 1165, ANKRD9, 5351, 107801, 400-1353; 1165, ANKRD9, 5353, 107803, 397-1350; 1166, ANKRA2, 5355, 107805, 370-902; 1166, ANKRA2, 5354, 107804, 660-1601; 1167, ASZ1, 5357, 107807, 48-494; 1167, ASZ1, 5358, 107808, 109-242; 1167, ASZ1, 5356, 107806, 64-1491; 1168, ANKFN1, 5360, 107810, 1-3450; 1168, ANKFN1, 5361, 107811, 147-665; 1168, ANKFN1, 5359, 107809, 36-2327; 1169, ANXA1, 5364, 107814, 187-799; 1169, ANXA1, 5365, 107815, 181-526; 1169, ANXA1, 5362, 107812, 183-1223; 1169, ANXA1, 5363, 107813, 883-1923; 1170, ANXA10, 5367, 107817, 127-1098; 1170, ANXA10, 5366, 107816, 187-1161; 1171, ANXA11, 5372, 107822, 1-446; 1171, ANXA11, 5373, 107823, 161-610; 1171, ANXA11, 5368, 107818, 379-1797; 1171, ANXA11, 5369, 107819, 239-1756; 1171, ANXA11, 5370, 107820, 484-2001; 1171, ANXA11, 5371, 107821, 288-1805; 1172, ANXA13, 5376, 107826, 225-563; 1172, ANXA13, 5374, 107824, 69-1142; 1172, ANXA13, 5375, 107825, 74-1024; 1173, ANXA2, 5381, 107831, 333-663; 1173, ANXA2, 5382, 107832, 56-265; 1173, ANXA2, 5383, 107833, 285-812; 1173, ANXA2, 5384, 107834, 191-718; 1173, ANXA2, 5385, 107835, 127-369; 1173, ANXA2, 5386, 107836, 111-513;

1173, ANXA2, 5387, 107837, 399-755; 1173, ANXA2, 5388, 107838, 354-780; 1173, ANXA2, 5389, 107839, 427-561; 1173, ANXA2, 5390, 107840, 230-628; 1173, ANXA2, 5391, 107841, 1-744; 1173, ANXA2, 5392, 107842, 96-777; 1173, ANXA2, 5393, 107843, 326-521; 1173, ANXA2, 5394, 107844, 67-594; 1173, ANXA2, 5395, 107845, 222-669; 1173, ANXA2, 5396, 107846, 202-558; 1173, ANXA2, 5397, 107847, 161-560; 1173, ANXA2, 5398, 107848, 720-733; 1173, ANXA2, 5399, 107849, 1023-1715; 1173, ANXA2, 5400, 107850, 363-802; 1173, ANXA2, 5401, 107851, 248-665; 1173, ANXA2, 5402, 107852, 110-878; 1173, ANXA2, 5403, 107853, 388-564; 1173, ANXA2, 5404, 107854, 307-543; 1173, ANXA2, 5405, 107855, 416-557; 1173, ANXA2, 5406, 107856, 56-580; 1173, ANXA2, 5377, 107827, 73-1146; 1173, ANXA2, 5378, 107828, 161-1180; 1173, ANXA2, 5379, 107829, 113-1132; 1173, ANXA2, 5380, 107830, 137-1156; 1174, ANXA2R, 5407, 107857, 1421-2002; 1174, ANXA2R, 5408, 107858, 300-881; 1175, ANXA3, 5410, 107860, 399-1253; 1175, ANXA3, 5411, 107861, 418-880; 1175, ANXA3, 5412, 107862, 165-567; 1175, ANXA3, 5413, 107863, 181-1035; 1175, ANXA3, 5414, 107864, 233-545; 1175, ANXA3, 5415, 107865, 142-307; 1175, ANXA3, 5409, 107859, 380-1351; 1176, ANXA4, 5417, 107867, 249-1148; 1176, ANXA4, 5418, 107868, 91-519; 1176, ANXA4, 5419, 107869, 1-23; 1176, ANXA4, 5420, 107870, 1-27; 1176, ANXA4, 5416, 107866, 249-1214; 1177, ANXA5, 5422, 107872, 140-631; 1177, ANXA5, 5423, 107873, 140-922; 1177, ANXA5, 5424, 107874, 136-798; 1177, ANXA5, 5425, 107875, 149-256; 1177, ANXA5, 5421, 107871, 287-1249; 1178, ANXA6, 5427, 107877, 99-1091; 1178, ANXA6, 5428, 107878, 94-562; 1178, ANXA6, 5429, 107879, 107-1489; 1178, ANXA6, 5430, 107880, 431-880; 1178, ANXA6, 5432, 107882, 165-553; 1178, ANXA6, 5433, 107883, 114-401; 1178, ANXA6, 5434, 107884, 112-501; 1178, ANXA6, 5435, 107885, 593-923; 1178, ANXA6, 5436, 107886, 1-274; 1178, ANXA6, 5426, 107876, 229-2250; 1178, ANXA6, 5431, 107881, 187-2112; 1179, ANXA7, 5439, 107889, 215-648; 1179, ANXA7, 5437, 107887, 58-1524; 1179, ANXA7, 5438, 107888, 58-1458; 1180, ANXA8, 5440, 107890, 151-216; 1180, ANXA8, 5444, 107894, 176-1006; 1180, ANXA8, 5445, 107895, 226-1323; 1180, ANXA8, 5441, 107891, 123-1106; 1180, ANXA8, 5442, 107892, 226-1023; 1180, ANXA8, 5443, 107893, 84-509; 1181, ANXA8L1, 5446, 107896, 226-1323; 1181, ANXA8L1, 5447, 107897, 226-1023; 1181, ANXA8L1, 5450, 107900, 97-909; 1181, ANXA8L1, 5448, 107898, 126-1109; 1181, ANXA8L1, 5449, 107899, 177-1007; 1182, ANXA9, 5451, 107901, 477-1514; 1183, ANO1, 5454, 107904, 217-2304; 1183, ANO1, 5455, 107905, 1-806; 1183, ANO1, 5457, 107907, 124-577; 1183, ANO1, 5458, 107908, 35-789; 1183, ANO1, 5452, 107902, 106-2034; 1183, ANO1, 5453, 107903, 306-3266; 1183, ANO1, 5456, 107906, 490-3012; 1184, ANO10, 5464, 107914, 159-560; 1184, ANO10, 5465, 107915, 90-511; 1184, ANO10, 5466, 107916, 137-575; 1184, ANO10, 5467, 107917, 123-545; 1184, ANO10, 5468, 107918, 382-497; 1184, ANO10, 5469, 107919, 170-746; 1184, ANO10, 5470, 107920, 305-641; 1184, ANO10, 5471, 107921, 1-566; 1184, ANO10, 5472, 107922, 107-592; 1184, ANO10, 5459, 107909, 172-2154; 1184, ANO10, 5460, 107910, 69-1481; 1184, ANO10, 5461, 107911, 88-1872; 1184, ANO10, 5462, 107912, 107-1756; 1184, ANO10, 5463, 107913, 115-1998; 1185, ANO2, 5475, 107925, 43-3054; 1185, ANO2, 5476, 107926, 31-640; 1185, ANO2, 5477, 107927, 186-446; 1185, ANO2, 5473, 107923, 73-3072; 1185, ANO2, 5474, 107924, 73-3072; 1186, ANO3, 5480, 107930, 124-3021; 1186, ANO3, 5481, 107931, 156-776; 1186, ANO3, 5478, 107928, 853-3798; 1186, ANO3, 5479, 107929, 234-2741; 1187, ANO4, 5484, 107934, 539-571; 1187, ANO4, 5485, 107935, 499-1071; 1187, ANO4, 5482, 107932, 211-3078; 1187, ANO4, 5483, 107933, 362-3124; 1187, ANO4, 5486, 107936, 95-1522; 1187, ANO4, 5487, 107937, 1-530; 1187, ANO4, 5488, 107938, 1-530; 1187, ANO4, 5489, 107939, 1-530; 1188, ANO5, 5490, 107940, 318-3059; 1189, ANO6, 5495, 107945, 203-340; 1189, ANO6, 5491, 107941, 203-2935; 1189, ANO6, 5492, 107942, 303-3092; 1189, ANO6, 5493, 107943, 238-3033; 1189, ANO6, 5494, 107944, 237-2915; 1190, ANO7, 5499, 107949, 1-555; 1190, ANO7, 5496, 107946, 104-2905; 1190, ANO7, 5497, 107947, 104-643; 1190, ANO7, 5498, 107948, 1-2652; 1191, ANO8, 5501, 107951, 68-1813; 1191, ANO8, 5502, 107952, 160-1905; 1191, ANO8, 5500, 107950, 160-3858; 1192, ANO9, 5503, 107953, 86-2434; 1193, ANHX, 5504, 107954, 53-1192; 1193, ANHX, 5505, 107955, 1740-2879; 1194, ANOS1, 5507, 107957, 152-2191; 1194, ANOS1, 5506, 107956, 151-2193; 1195, AMN1, 5509, 107959, 277-571; 1195, AMN1, 5510, 107960, 148-796; 1195, AMN1, 5511, 107961, 570-746; 1195, AMN1, 5512, 107962, 87-403; 1195, AMN1, 5515, 107965, 136-397; 1195, AMN1, 5516, 107966, 690-797; 1195, AMN1, 5508, 107958, 167-943; 1195, AMN1, 5513, 107963, 277-999; 1195, AMN1, 5514, 107964, 457-1179; 1196, AGR2, 5517, 107967, 43-609; 1196, AGR2, 5519, 107969, 277-670; 1196, AGR2, 5520, 107970, 1-360; 1196, AGR2, 5518, 107968, 154-681; 1197, AGR3, 5522, 107972, 66-557; 1197, AGR3, 5523, 107973, 1-386; 1197, AGR3, 5521, 107971, 72-572; 1198, ANTXR1, 5527, 107977, 1-539; 1198, ANTXR1, 5524, 107974, 323-2017; 1198, ANTXR1, 5525, 107975, 104-1210; 1198, ANTXR1, 5526, 107976, 195-1196; 1199, ANTXR2, 5530, 107980, 158-1393; 1199, ANTXR2, 5532, 107982, 46-783; 1199, ANTXR2, 5528, 107978, 4-1473; 1199, ANTXR2, 5529, 107979, 141-1301; 1199, ANTXR2, 5531, 107981, 527-1993; 1200, ANTXRL, 5533, 107983, 1-338; 1200, ANTXRL, 5534, 107984, 267-1964; 1200, ANTXRL, 5535, 107985, 308-490; 1200, ANTXRL, 5537, 107987, 253-1026; 1200, ANTXRL, 5536, 107986, 266-2161; 1201, MFI2, 5540, 107990, 86-629; 1201, MFI2, 5538, 107988, 115-2331; 1201, MFI2, 5539, 107989, 90-998; 1202, AMH, 5541, 107991, 23-1705; 1203, AMHR2, 5545, 107995, 371-887; 1203, AMHR2, 5542, 107992, 81-1802; 1203, AMHR2, 5543, 107993, 1-1437; 1203, AMHR2, 5544, 107994, 70-1506; 1204, ATOX1, 5547, 107997, 111-332; 1204, ATOX1, 5549, 107999, 103-282; 1204, ATOX1, 5550, 108000, 361-540; 1204, ATOX1, 5546, 107996, 99-305; 1204, ATOX1, 5548, 107998, 106-312; 1204, ATOX1, 5551, 108001, 359-565; 1205, ASF1A, 5552, 108002, 195-809; 1206, ASF1B, 5554, 108004, 158-403; 1206, ASF1B, 5555, 108005, 119-616; 1206, ASF1B, 5556, 108006, 134-280; 1206, ASF1B, 5557, 108007, 98-529; 1206, ASF1B, 5553, 108003, 501-1109; 1207, AZIN1, 5560, 108010, 675-773; 1207, AZIN1, 5561, 108011, 370-660; 1207, AZIN1, 5562, 108012, 186-680; 1207, AZIN1, 5558, 108008, 767-2113; 1207, AZIN1, 5559, 108009, 1165-2511; 1208, AZIN2, 5563, 108013, 588-1970; 1208, AZIN2, 5564, 108014, 1-615; 1208, AZIN2, 5565, 108015, 1-1443; 1208, AZIN2, 5566, 108016, 319-1701; 1209, N/A, 5567, 108017, 1-891; 1209, N/A, 5568, 108018, 39-929; 1210, N/A, 5569, 108019, 1-1000; 1210, N/A, 5570, 108020, 1-338; 1211, N/A, 5571, 108021, 352-1078; 1212, N/A, 5572, 108022, 128-547; 1213, N/A, 5573, 108023, 1-747; 1214, N/A, 5574, 108024, 1-747; 1215, N/A, 5575, 108025, 1-630; 1215, N/A, 5576, 108026, 1-630; 1216, N/A, 5577, 108027, 1-111; 1217, N/A, 5578, 108028, 1-375; 1218, N/A, 5579, 108029, 62-556; 1219, N/A, 5580, 108030, 126-329; 1220, N/A, 5581, 108031, 1-42; 1221, N/A, 5582, 108032, 6-428; 1221, N/A, 5583, 108033, 6-428; 1222, N/A, 5584, 108034, 1-942; 1223, N/A, 5585, 108035, 46-288; 1224, N/A, 5586, 108036, 86-274; 1225, N/A, 5587, 108037, 1018-1614; 1226, N/A, 5588, 108038, 1018-1614; 1227, AAK1, 5590, 108040, 315-2339; 1227, AAK1, 5592, 108042, 1-1019; 1227, AAK1, 5593, 108043, 1-1536; 1227, AAK1, 5594, 108044, 1-300; 1227, AAK1, 5589, 108039, 378-2969; 1227, AAK1, 5591, 108041, 378-3263; 1228, APIP, 5596, 108046, 173-760; 1228, APIP, 5595, 108045, 216-944; 1229, AMER1, 5597, 108047, 274-3681; 1229, AMER1, 5598, 108048, 274-2688; 1230, AMER2, 5599, 108049, 477-2135; 1230, AMER2, 5600, 108050, 669-2684; 1231, AMER3, 5602, 108052, 111-651; 1231, AMER3, 5604, 108054, 175-599; 1231, AMER3, 5601, 108051, 260-2845; 1231, AMER3, 5603, 108053, 111-2696; 1232, APLN, 5605, 108055, 308-541; 1233, APLNR, 5606, 108056, 232-1374; 1233, APLNR, 5607, 108057, 198-1340; 1233, APLNR, 5608, 108058, 311-1453; 1234, APELA, 5609, 108059, 91-255; 1234, APELA, 5610, 108060, 139-303; 1234, APELA, 5611, 108061, 329-493; 1235, APEX2, 5612, 108062, 67-1623; 1236, APEX1, 5615, 108065, 1-451; 1236, APEX1, 5616, 108066, 237-386; 1236, APEX1, 5617, 108067, 124-640; 1236, APEX1, 5618, 108068, 251-773; 1236, APEX1, 5619, 108069, 109-899; 1236, APEX1, 5620, 108070, 180-304; 1236, APEX1, 5622, 108072, 233-671; 1236, APEX1, 5623, 108073, 217-261; 1236, APEX1, 5624, 108074, 244-566; 1236, APEX1, 5625, 108075, 254-740; 1236, APEX1, 5626, 108076, 225-952; 1236, APEX1, 5613, 108063, 269-1225; 1236, APEX1, 5614, 108064, 172-1128; 1236, APEX1, 5621, 108071, 217-1173; 1237, APH1A, 5627, 108077, 214-663; 1237, APH1A, 5628, 108078, 494-1237; 1237, APH1A, 5629, 108079, 190-987; 1237, APH1A, 5630, 108080, 400-987; 1238, APH1B, 5632, 108082, 15-260; 1238, APH1B, 5634, 108084, 193-758; 1238, APH1B, 5635, 108085, 7-672; 1238, APH1B, 5636, 108086, 1-60; 1238, APH1B, 5631, 108081, 71-844; 1238, APH1B, 5633, 108083, 15-665; 1239, APITD1-CORT, 5637, 108087, 417-911; 1239, APITD1-CORT, 5638, 108088, 135-368; 1239, APITD1-CORT, 5639, 108089, 487-918; 1239, APITD1-CORT, 5640, 108090, 84-500; 1239, APITD1-CORT, 5641, 108091, 33-182; 1240, A1CF, 5647, 108097, 401-2209; 1240, A1CF, 5649, 108099, 282-885; 1240, A1CF, 5642, 108092, 282-2042; 1240, A1CF, 5643, 108093, 46-1830; 1240, A1CF, 5644, 108094, 260-2044; 1240, A1CF, 5645, 108095, 189-1949; 1240, A1CF, 5646, 108096, 141-1901; 1240, A1CF, 5648, 108098, 308-2092; 1241, APOC4-APOC2, 5650, 108100, 108-413; 1241, APOC4-APOC2, 5651, 108101, 41-424; 1241, APOC4-APOC2, 5652, 108102, 23-559; 1242, APOA1, 5657, 108107, 133-870; 1242, APOA1, 5653, 108103, 367-1170; 1242, APOA1, 5654, 108104, 72-875; 1242, APOA1, 5655, 108105, 80-883; 1242, APOA1, 5656, 108106, 228-1031; 1243, APOA1BP, 5658, 108108, 28-765; 1243, APOA1BP, 5659, 108109, 44-826; 1243, APOA1BP, 5660, 108110, 44-910; 1244, APOA2, 5662, 108112, 66-265; 1244, APOA2, 5663, 108113, 150-308; 1244, APOA2, 5664, 108114, 185-469; 1244, APOA2, 5665, 108115, 130-288; 1244, APOA2, 5666, 108116, 40-441; 1244, APOA2, 5667, 108117, 59-307; 1244, APOA2, 5668, 108118, 25-243; 1244, APOA2, 5669, 108119, 8-91; 1244, APOA2, 5661, 108111, 59-361; 1245, APOA4, 5670, 108120, 116-1306; 1246, APOA5, 5672, 108122, 41-526; 1246, APOA5, 5671, 108121, 36-1136; 1246, APOA5, 5673, 108123, 74-1174; 1247, APOB, 5675, 108125, 18-2504; 1247, APOB, 5676, 108126, 1-13035; 1247, APOB, 5674, 108124, 129-13820; 1248, APOBEC1, 5678, 108128, 32-142; 1248, APOBEC1, 5677, 108127, 22-732; 1249, APOBEC2, 5679, 108129, 45-719; 1250, APOBEC3A, 5680, 108130, 171-770; 1250, APOBEC3A, 5681, 108131, 205-804; 1250, APOBEC3A, 5682, 108132, 171-770; 1250, APOBEC3A, 5683, 108133, 171-770; 1250, APOBEC3A, 5684, 108134, 205-804; 1251, APOBEC3B, 5687, 108137, 56-1528; 1251, APOBEC3B, 5685, 108135, 46-1194; 1251, APOBEC3B, 5686, 108136, 49-804; 1251, APOBEC3B, 5688, 108138, 108-1181; 1252, APOBEC3C, 5690, 108140, 102-287; 1252, APOBEC3C, 5689, 108139, 281-853; 1253, APOBEC3D, 5693, 108143, 408-1016; 1253, APOBEC3D, 5694, 108144, 19-591; 1253, APOBEC3D, 5691, 108141, 408-1568; 1253, APOBEC3D, 5692, 108142, 1-1161; 1254, APOBEC3F, 5695, 108145, 358-1479; 1254, APOBEC3F, 5696, 108146, 105-410; 1255, APOBEC3G, 5697, 108147, 358-1512; 1255, APOBEC3G, 5698, 108148, 1-1155; 1256, APOBEC3H, 5703, 108153, 1-465; 1256, APOBEC3H, 5704, 108154, 128-730; 1256, APOBEC3H, 5699, 108149, 128-676; 1256, APOBEC3H, 5700, 108150, 77-679; 1256, APOBEC3H, 5701, 108151, 128-592; 1256, APOBEC3H, 5702, 108152, 67-618; 1257, APOBEC4, 5705, 108155, 273-1376; 1258, APOBR, 5706, 108156, 34-3300; 1258, APOBR, 5707, 108157, 34-3327; 1259, APOC1, 5708, 108158, 24-275; 1259, APOC1, 5710, 108160, 53-213; 1259, APOC1, 5711, 108161, 24-302; 1259, APOC1, 5712, 108162, 24-143; 1259, APOC1, 5713, 108163, 52-441; 1259, APOC1, 5714, 108164, 45-134; 1259, APOC1, 5716, 108166, 200-430; 1259, APOC1, 5709, 108159, 326-577; 1259, APOC1, 5715, 108165, 186-437; 1260, APOC2, 5717, 108167, 194-412; 1260, APOC2, 5719, 108169, 34-297; 1260, APOC2, 5720, 108170, 55-198; 1260, APOC2, 5718, 108168, 123-428; 1261, APOC3, 5722, 108172, 63-416; 1261, APOC3, 5723, 108173, 195-359; 1261, APOC3, 5724, 108174, 1-354; 1261, APOC3, 5721, 108171, 63-362; 1262, APOC4, 5725, 108175, 5-226; 1262, APOC4, 5726, 108176, 41-424; 1263, APOD, 5728, 108178, 112-438; 1263, APOD, 5729, 108179, 234-681; 1263, APOD, 5730, 108180, 137-782; 1263, APOD, 5727, 108177, 363-932; 1264, APOE, 5732, 108182, 266-923; 1264, APOE, 5733, 108183, 90-737; 1264, APOE, 5734, 108184, 58-864; 1264, APOE, 5731, 108181, 112-1065; 1265, APOF, 5735, 108185, 79-1059; 1266, APOH, 5737, 108187, 1-313; 1266, APOH, 5738, 108188, 148-748; 1266, APOH, 5739, 108189, 164-707; 1266, APOH, 5736, 108186, 39-1076; 1267, APOLD1, 5742, 108192, 85-207; 1267, APOLD1, 5743, 108193, 73-195; 1267, APOLD1, 5740, 108190, 71-910; 1267, APOLD1, 5741, 108191, 86-832; 1268, APOL1, 5748, 108198, 109-534; 1268, APOL1, 5749, 108199, 146-624; 1268, APOL1, 5750, 108200, 118-541; 1268, APOL1, 5751, 108201, 76-504; 1268, APOL1, 5752, 108202, 107-478; 1268, APOL1, 5753, 108203, 213-566; 1268, APOL1, 5744, 108194, 268-1512; 1268, APOL1, 5745, 108195, 230-1426; 1268, APOL1, 5746, 108196, 99-1295; 1268, APOL1, 5747, 108197, 169-1311; 1268, APOL1, 5754, 108204, 208-1404; 1269, APOL2, 5757, 108207, 355-577; 1269, APOL2, 5758, 108208, 10-1359; 1269, APOL2, 5759, 108209, 226-611; 1269, APOL2, 5755, 108205, 478-1491; 1269, APOL2, 5756, 108206, 337-1350; 1270, APOL3, 5763, 108213, 39-332; 1270, APOL3, 5765, 108215, 1-157; 1270, APOL3, 5766, 108216, 39-287; 1270, APOL3, 5768, 108218, 39-287; 1270, APOL3, 5769, 108219, 1-123; 1270, APOL3, 5770, 108220, 1-260; 1270, APOL3, 5771, 108221, 1-101; 1270, APOL3, 5772, 108222, 1-157; 1270, APOL3, 5773, 108223, 1-113; 1270, APOL3, 5774, 108224, 1-119; 1270, APOL3, 5760, 108210, 39-1247; 1270, APOL3, 5761, 108211, 2085-2693; 1270, APOL3, 5762, 108212, 2148-

2756; 1270, APOL3, 5764, 108214, 736-1344; 1270, APOL3, 5767, 108217, 72-1067; 1271, APOL4, 5775, 108225, 334-657; 1271, APOL4, 5778, 108228, 334-657; 1271, APOL4, 5779, 108229, 436-512; 1271, APOL4, 5780, 108230, 350-543; 1271, APOL4, 5781, 108231, 305-520; 1271, APOL4, 5782, 108232, 144-356; 1271, APOL4, 5776, 108226, 501-1547; 1271, APOL4, 5777, 108227, 226-1281; 1271, APOL4, 5783, 108233, 431-1477; 1272, APOL5, 5785, 108235, 1-1302; 1272, APOL5, 5784, 108234, 1-1302; 1273, APOL6, 5786, 108236, 277-1308; 1274, APOM, 5788, 108238, 239-628; 1274, APOM, 5794, 108244, 239-628; 1274, APOM, 5797, 108247, 239-628; 1274, APOM, 5798, 108248, 239-628; 1274, APOM, 5803, 108253, 239-628; 1274, APOM, 5804, 108254, 239-628; 1274, APOM, 5806, 108256, 239-628; 1274, APOM, 5787, 108237, 497-1063; 1274, APOM, 5789, 108239, 238-588; 1274, APOM, 5790, 108240, 74-640; 1274, APOM, 5791, 108241, 238-588; 1274, APOM, 5792, 108242, 74-640; 1274, APOM, 5793, 108243, 238-588; 1274, APOM, 5795, 108245, 238-588; 1274, APOM, 5796, 108246, 74-640; 1274, APOM, 5799, 108249, 74-640; 1274, APOM, 5800, 108250, 74-640; 1274, APOM, 5801, 108251, 239-589; 1274, APOM, 5802, 108252, 74-640; 1274, APOM, 5805, 108255, 238-588; 1274, APOM, 5807, 108257, 238-588; 1275, APOO, 5809, 108259, 1-537; 1275, APOO, 5810, 108260, 202-546; 1275, APOO, 5811, 108261, 1-272; 1275, APOO, 5812, 108262, 917-1159; 1275, APOO, 5813, 108263, 1-148; 1275, APOO, 5808, 108258, 233-829; 1276, APOOL, 5815, 108265, 37-828; 1276, APOOL, 5816, 108266, 1-807; 1276, APOOL, 5814, 108264, 88-894; 1277, APOPT1, 5818, 108268, 1-357; 1277, APOPT1, 5819, 108269, 1-362; 1277, APOPT1, 5820, 108270, 1-172; 1277, APOPT1, 5821, 108271, 1-327; 1277, APOPT1, 5822, 108272, 1-219; 1277, APOPT1, 5823, 108273, 16-549; 1277, APOPT1, 5824, 108274, 301-531; 1277, APOPT1, 5825, 108275, 499-666; 1277, APOPT1, 5826, 108276, 1-399; 1277, APOPT1, 5827, 108277, 418-585; 1277, APOPT1, 5828, 108278, 243-410; 1277, APOPT1, 5817, 108267, 2-622; 1278, AATF, 5830, 108280, 1-296; 1278, AATF, 5831, 108281, 108-275; 1278, AATF, 5832, 108282, 1-465; 1278, AATF, 5834, 108284, 1-296; 1278, AATF, 5835, 108285, 1-465; 1278, AATF, 5836, 108286, 108-275; 1278, AATF, 5829, 108279, 252-1934; 1278, AATF, 5833, 108283, 252-1934; 1279, AEN, 5838, 108288, 359-895; 1279, AEN, 5837, 108287, 152-1129; 1280, APIS, 5843, 108293, 33-1565; 1280, APIS, 5844, 108294, 166-537; 1280, APIS, 5845, 108295, 1-883; 1280, APIS, 5839, 108289, 126-1640; 1280, APIS, 5840, 108290, 246-1787; 1280, APIS, 5841, 108291, 131-1483; 1280, APIS, 5842, 108292, 140-1714; 1281, AREL1, 5847, 108297, 194-581; 1281, AREL1, 5848, 108298, 46-1560; 1281, AREL1, 5849, 108299, 1-270; 1281, AREL1, 5850, 108300, 1-358; 1281, AREL1, 5851, 108301, 1-246; 1281, AREL1, 5852, 108302, 1-394; 1281, AREL1, 5853, 108303, 745-2639; 1281, AREL1, 5854, 108304, 32-331; 1281, AREL1, 5846, 108296, 517-2988; 1282, AVEN, 5856, 108306, 1-178; 1282, AVEN, 5855, 108305, 131-1219; 1283, AATK, 5859, 108309, 168-3983; 1283, AATK, 5860, 108310, 127-475; 1283, AATK, 5861, 108311, 1-318; 1283, AATK, 5857, 108307, 26-4150; 1283, AATK, 5858, 108308, 81-2720; 1284, AIFM1, 5866, 108316, 906-1730; 1284, AIFM1, 5867, 108317, 104-373; 1284, AIFM1, 5868, 108318, 9-140; 1284, AIFM1, 5862, 108312, 232-2073; 1284, AIFM1, 5863, 108313, 224-2053; 1284, AIFM1, 5864, 108314, 25-1005; 1284, AIFM1, 5865, 108315, 9-983; 1284, AIFM1, 5869, 108319, 232-1206; 1285, AIFM2, 5870, 108320, 215-1336; 1285, AIFM2, 5871, 108321, 19-1140; 1285, AIFM2, 5872, 108322, 218-1339; 1286, AIFM3, 5877, 108327, 286-1092; 1286, AIFM3, 5878, 108328, 218-606; 1286, AIFM3, 5879, 108329, 197-421; 1286, AIFM3, 5880, 108330, 182-547; 1286, AIFM3, 5873, 108323, 186-1982; 1286, AIFM3, 5874, 108324, 241-2058; 1286, AIFM3, 5875, 108325, 190-2004; 1286, AIFM3, 5876, 108326, 222-2039; 1287, APITD1, 5882, 108332, 508-744; 1287, APITD1, 5883, 108333, 168-317; 1287, APITD1, 5881, 108331, 76-492; 1288, ACIN1, 5888, 108338, 329-4234; 1288, ACIN1, 5889, 108339, 419-2167; 1288, ACIN1, 5891, 108341, 152-734; 1288, ACIN1, 5892, 108342, 42-3893; 1288, ACIN1, 5893, 108343, 1-249; 1288, ACIN1, 5894, 108344, 1-110; 1288, ACIN1, 5884, 108334, 329-4354; 1288, ACIN1, 5885, 108335, 20-1864; 1288, ACIN1, 5886, 108336, 231-1982; 1288, ACIN1, 5887, 108337, 419-2170; 1288, ACIN1, 5890, 108340, 98-4084; 1289, APAF1, 5898, 108348, 1-3492; 1289, APAF1, 5903, 108353, 207-599; 1289, APAF1, 5895, 108345, 578-1594; 1289, APAF1, 5896, 108346, 578-4195; 1289, APAF1, 5897, 108347, 578-4162; 1289, APAF1, 5899, 108349, 737-4483; 1289, APAF1, 5900, 108350, 8-3721; 1289, APAF1, 5901, 108351, 45-1061; 1289, APAF1, 5902, 108352, 6-3623; 1290, APTX, 5905, 108355, 4-599; 1290, APTX, 5906, 108356, 9-1019; 1290, APTX, 5913, 108363, 102-568; 1290, APTX, 5914, 108364, 36-194; 1290, APTX, 5915, 108365, 1-224; 1290, APTX, 5917, 108367, 16-207; 1290, APTX, 5921, 108371, 38-687; 1290, APTX, 5924, 108374, 198-455; 1290, APTX, 5925, 108375, 16-315; 1290, APTX, 5927, 108377, 198-455; 1290, APTX, 5904, 108354, 102-968; 1290, APTX, 5907, 108357, 198-1226; 1290, APTX, 5908, 108358, 1-1071; 1290, APTX, 5909, 108359, 25-945; 1290, APTX, 5910, 108360, 4-858; 1290, APTX, 5911, 108361, 249-1277; 1290, APTX, 5912, 108362, 194-343; 1290, APTX, 5916, 108366, 198-347; 1290, APTX, 5918, 108368, 198-347; 1290, APTX, 5919, 108369, 198-347; 1290, APTX, 5920, 108370, 198-347; 1290, APTX, 5922, 108372, 38-946; 1290, APTX, 5923, 108373, 198-776; 1290, APTX, 5926, 108376, 314-463; 1290, APTX, 5928, 108378, 195-1223; 1290, APTX, 5929, 108379, 123-272; 1290, APTX, 5930, 108380, 94-1122; 1291, APLF, 5932, 108382, 1-1182; 1291, APLF, 5933, 108383, 130-972; 1291, APLF, 5934, 108384, 161-718; 1291, APLF, 5931, 108381, 172-1707; 1292, AQP1, 5935, 108385, 56-865; 1292, AQP1, 5936, 108386, 153-617; 1292, AQP1, 5937, 108387, 119-775; 1292, AQP1, 5938, 108388, 40-600; 1293, AQP10, 5939, 108389, 41-946; 1293, AQP10, 5940, 108390, 37-831; 1294, AQP11, 5941, 108391, 359-1174; 1295, AQP12A, 5943, 108393, 64-987; 1295, AQP12A, 5942, 108392, 70-957; 1296, AQP12B, 5945, 108395, 70-195; 1296, AQP12B, 5946, 108396, 44-169; 1296, AQP12B, 5947, 108397, 28-153; 1296, AQP12B, 5944, 108394, 64-987; 1296, AQP12B, 5948, 108398, 70-957; 1297, AQP2, 5950, 108400, 91-762; 1297, AQP2, 5951, 108401, 78-809; 1297, AQP2, 5949, 108399, 86-901; 1298, AQP3, 5952, 108402, 82-960; 1299, AQP4, 5954, 108404, 83-379; 1299, AQP4, 5956, 108406, 19-575; 1299, AQP4, 5958, 108408, 1-891; 1299, AQP4, 5953, 108403, 130-1101; 1299, AQP4, 5955, 108405, 264-1169; 1299, AQP4, 5957, 108407, 287-1192; 1300, AQP5, 5959, 108409, 149-946; 1301, AQP6, 5961, 108411, 499-825; 1301, AQP6, 5963, 108413, 338-829; 1301, AQP6, 5960, 108410, 338-1186; 1301, AQP6, 5962, 108412, 1-849; 1302, AQP7, 5965, 108415, 18-788; 1302, AQP7, 5966, 108416, 28-1053; 1302, AQP7, 5967, 108417, 215-865; 1302, AQP7, 5968, 108418, 167-675; 1302, AQP7, 5970, 108420, 168-323; 1302, AQP7, 5971, 108421, 334-575; 1302, AQP7, 5972, 108422, 150-275; 1302, AQP7, 5973, 108423, 336-491; 1302, AQP7, 5974, 108424, 436-585; 1302, AQP7, 5975, 108425, 240-1013; 1302, AQP7, 5976, 108426, 120-377; 1302, AQP7, 5977, 108427, 51-305; 1302, AQP7, 5964, 108414, 173-1201; 1302, AQP7, 5969, 108419, 389-886; 1303, AQP8, 5979, 108429, 69-836; 1303, AQP8, 5978, 108428, 126-911; 1304, AQP9, 5982, 108432, 198-890; 1304, AQP9, 5980, 108430, 371-1258; 1304, AQP9, 5981, 108431, 186-1073; 1305, AQR, 5984, 108434, 121-2061; 1305, AQR, 5985, 108435, 2-543; 1305, AQR, 5983, 108433, 227-4684; 1306, ALOX12, 5987, 108437, 1-443; 1306, ALOX12, 5986, 108436, 54-2045; 1307, ALOX12B, 5988, 108438, 262-2367; 1308, ALOX15, 5990, 108440, 225-553; 1308, ALOX15, 5992, 108442, 570-581; 1308, ALOX15, 5989, 108439, 15-2003; 1308, ALOX15, 5991, 108441, 98-2086; 1308, ALOX15, 5993, 108443, 285-2156; 1309, ALOX15B, 5996, 108446, 123-2117; 1309, ALOX15B, 5994, 108444, 117-2060; 1309, ALOX15B, 5995, 108445, 140-2170; 1309, ALOX15B, 5997, 108447, 1-1809; 1310, ALOX5, 6000, 108450, 1-420; 1310, ALOX5, 6002, 108452, 1-420; 1310, ALOX5, 5998, 108448, 54-2078; 1310, ALOX5, 5999, 108449, 105-1958; 1310, ALOX5, 6001, 108451, 105-1958; 1310, ALOX5, 6003, 108453, 54-2078; 1311, ALOX5AP, 6005, 108455, 249-905; 1311, ALOX5AP, 6004, 108454, 99-584; 1312, ALOXE3, 6007, 108457, 32-2635; 1312, ALOXE3, 6006, 108456, 270-2801; 1312, ALOXE3, 6008, 108458, 342-2477; 1313, ARAF, 6009, 108459, 212-2041; 1313, ARAF, 6010, 108460, 90-650; 1313, ARAF, 6011, 108461, 195-2015; 1314, AANAT, 6014, 108464, 86-364; 1314, AANAT, 6015, 108465, 24-478; 1314, AANAT, 6012, 108462, 1008-1766; 1314, AANAT, 6013, 108463, 235-858; 1315, AMZ1, 6016, 108466, 369-1865; 1315, AMZ1, 6017, 108467, 314-1207; 1316, AMZ2, 6021, 108471, 153-897; 1316, AMZ2, 6022, 108472, 2-607; 1316, AMZ2, 6023, 108473, 123-713; 1316, AMZ2, 6024, 108474, 244-829; 1316, AMZ2, 6026, 108476, 8-672; 1316, AMZ2, 6027, 108477, 1-229; 1316, AMZ2, 6028, 108478, 103-722; 1316, AMZ2, 6029, 108479, 1-72; 1316, AMZ2, 6018, 108468, 656-1564; 1316, AMZ2, 6019, 108469, 1133-2215; 1316, AMZ2, 6020, 108470, 111-1193; 1316, AMZ2, 6025, 108475, 87-1169; 1316, AMZ2, 6030, 108480, 289-1371; 1316, AMZ2, 6031, 108481, 989-2071; 1316, AMZ2, 6032, 108482, 221-1303; 1317, ARCN1, 6034, 108484, 166-1824; 1317, ARCN1, 6036, 108486, 113-364; 1317, ARCN1, 6037, 108487, 125-694; 1317, ARCN1, 6033, 108483, 96-1631; 1317, ARCN1, 6035, 108485, 159-1430; 1318, ACAP1, 6039, 108489, 427-870; 1318, ACAP1, 6040, 108490, 310-614; 1318, ACAP1, 6041, 108491, 102-236; 1318, ACAP1, 6042, 108492, 58-192; 1318, ACAP1, 6043, 108493, 133-330; 1318, ACAP1, 6044, 108494, 105-239; 1318, ACAP1, 6038, 108488, 207-2429; 1319, ACAP2, 6046, 108496, 59-208; 1319, ACAP2, 6047, 108497, 83-235; 1319, ACAP2, 6048, 108498, 1-684; 1319, ACAP2, 6049, 108499, 1-766; 1319, ACAP2, 6050, 108500, 61-2394; 1319, ACAP2, 6051, 108501, 7-1647; 1319, ACAP2, 6045, 108495, 232-2568; 1320, ACAP3, 6054, 108504, 7-165; 1320, ACAP3, 6052, 108502, 1-2280; 1320, ACAP3, 6053, 108503, 204-2708; 1321, ADAP1, 6056, 108506, 1-576; 1321, ADAP1, 6057, 108507, 72-559; 1321, ADAP1, 6058, 108508, 1-622; 1321, ADAP1, 6060, 108510, 1-738; 1321, ADAP1, 6061, 108511, 1-1073; 1321, ADAP1, 6062, 108512, 1-560; 1321, ADAP1, 6064, 108514, 87-926; 1321, ADAP1, 6055, 108505, 221-1345; 1321, ADAP1, 6059, 108509, 165-1073; 1321, ADAP1, 6063, 108513, 1-1158; 1321, ADAP1, 6065, 108515, 190-1098; 1322, ADAP2, 6067, 108517, 1-296; 1322, ADAP2, 6068, 108518, 68-322; 1322, ADAP2, 6069, 108519, 1-437; 1322, ADAP2, 6070, 108520, 336-656; 1322, ADAP2, 6071, 108521, 84-1247; 1322, ADAP2, 6072, 108522, 81-1080; 1322, ADAP2, 6073, 108523, 242-584; 1322, ADAP2, 6066, 108516, 336-1481; 1323, AGFG1, 6076, 108526, 54-1679; 1323, AGFG1, 6079, 108529, 1-398; 1323, AGFG1, 6080, 108530, 353-1065; 1323, AGFG1, 6074, 108524, 261-1949; 1323, AGFG1, 6075, 108525, 51-1619; 1323, AGFG1, 6077, 108527, 51-1733; 1323, AGFG1, 6078, 108528, 271-2025; 1324, AGFG2, 6082, 108532, 1-671; 1324, AGFG2, 6083, 108533, 137-604; 1324, AGFG2, 6081, 108531, 123-1568; 1325, AGAP1, 6086, 108536, 213-563; 1325, AGAP1, 6087, 108537, 497-3706; 1325, AGAP1, 6089, 108539, 1-826; 1325, AGAP1, 6090, 108540, 1-757; 1325, AGAP1, 6091, 108541, 1-2412; 1325, AGAP1, 6092, 108542, 2-1057; 1325, AGAP1, 6093, 108543, 2-2254; 1325, AGAP1, 6094, 108544, 1-327; 1325, AGAP1, 6084, 108534, 581-3154; 1325, AGAP1, 6085, 108535, 581-2995; 1325, AGAP1, 6088, 108538, 599-1816; 1326, AGAP2, 6096, 108546, 1-3109; 1326, AGAP2, 6097, 108547, 1-510; 1326, AGAP2, 6098, 108548, 1-3579; 1326, AGAP2, 6095, 108545, 87-2597; 1327, AGAP3, 6099, 108549, 94-1824; 1327, AGAP3, 6101, 108551, 1-582; 1327, AGAP3, 6102, 108552, 1-1214; 1327, AGAP3, 6104, 108554, 1-1032; 1327, AGAP3, 6105, 108555, 1-534; 1327, AGAP3, 6107, 108557, 1-512; 1327, AGAP3, 6100, 108550, 1-2736; 1327, AGAP3, 6103, 108553, 497-2239; 1327, AGAP3, 6106, 108556, 1-1191; 1327, AGAP3, 6108, 108558, 1-2628; 1328, AGAP4, 6109, 108559, 411-2402; 1328, AGAP4, 6111, 108561, 1-413; 1328, AGAP4, 6112, 108562, 113-2089; 1328, AGAP4, 6113, 108563, 411-2471; 1328, AGAP4, 6110, 108560, 127-2118; 1329, AGAP5, 6115, 108565, 127-2118; 1329, AGAP5, 6116, 108566, 1-83; 1329, AGAP5, 6117, 108567, 113-2089; 1329, AGAP5, 6118, 108568, 405-2465; 1329, AGAP5, 6114, 108564, 113-2173; 1330, AGAP6, 6121, 108571, 712-2379; 1330, AGAP6, 6122, 108572, 113-2089; 1330, AGAP6, 6119, 108569, 399-2390; 1330, AGAP6, 6120, 108570, 73-2133; 1331, AGAP9, 6123, 108573, 113-2089; 1332, ARAP1, 6128, 108578, 50-2089; 1332, ARAP1, 6129, 108579, 406-3990; 1332, ARAP1, 6130, 108580, 231-994; 1332, ARAP1, 6132, 108582, 180-1101; 1332, ARAP1, 6133, 108583, 1-699; 1332, ARAP1, 6134, 108584, 1-535; 1332, ARAP1, 6124, 108574, 736-4353; 1332, ARAP1, 6125, 108575, 853-5172; 1332, ARAP1, 6126, 108576, 557-4189; 1332, ARAP1, 6127, 108577, 204-4556; 1332, ARAP1, 6131, 108581, 406-3807; 1333, ARAP2, 6136, 108586, 491-631; 1333, ARAP2, 6137, 108587, 245-396; 1333, ARAP2, 6138, 108588, 1-2592; 1333, ARAP2, 6135, 108585, 491-5605; 1334, ARAP3, 6140, 108590, 346-1765; 1334, ARAP3, 6142, 108592, 251-4378; 1334, ARAP3, 6143, 108593, 254-4381; 1334, ARAP3, 6139, 108589, 67-4701; 1334, ARAP3, 6141, 108591, 70-3651; 1335, ASAP1, 6144, 108594, 352-3720; 1335, ASAP1, 6145, 108595, 26-145; 1335, ASAP1, 6146, 108596, 97-216; 1335, ASAP1, 6147, 108597, 468-566; 1335, ASAP1, 6148, 108598, 1-2851; 1335, ASAP1, 6149, 108599, 106-225; 1335, ASAP1, 6150, 108600, 1-1449; 1335, ASAP1, 6152, 108602, 272-566; 1335, ASAP1, 6151, 108601, 229-3618; 1336, ASAP2, 6153, 108603, 341-3361; 1336, ASAP2, 6154, 108604, 341-3226; 1337, ASAP3, 6157, 108607, 1-373; 1337, ASAP3, 6158, 108608, 1-612; 1337, ASAP3, 6159, 108609, 52-186; 1337, ASAP3, 6161, 108611, 1-363; 1337, ASAP3, 6162, 108612, 117-589; 1337, ASAP3, 6163, 108613, 113-721; 1337, ASAP3, 6164, 108614, 36-1259; 1337, ASAP3, 6165, 108615, 46-2757; 1337, ASAP3, 6166, 108616, 47-2731; 1337, ASAP3, 6167, 108617, 1-363; 1337, ASAP3, 6168, 108618, 117-589; 1337, ASAP3, 6169, 108619, 1-373; 1337, ASAP3, 6170, 108620, 113-721; 1337, ASAP3, 6171, 108621, 1-612; 1337, ASAP3, 6172, 108622, 52-186; 1337, ASAP3, 6155, 108605, 46-2757; 1337, ASAP3, 6156, 108606, 47-2731; 1337, ASAP3, 6160, 108610, 36-1259; 1338, ARFGEF3, 6173, 108623, 167-6700; 1339, ARG1, 6174, 108624, 59-1051; 1339, ARG1, 6175, 108625, 140-1108; 1340, ARG2, 6176, 108626, 181-1245; 1341, ARGLU1, 6177, 108627, 156-361; 1341, ARGLU1, 6178, 108628, 225-653; 1341, ARGLU1, 6179, 108629, 246-1067; 1342, AVP, 6180, 108630, 51-545; 1343, AVPR1A, 6182, 108632, 1-561; 1343, AVPR1A, 6181, 108631, 107-1363; 1344, AVPR1B, 6183, 108633, 466-1740; 1345, AVPR2, 6187, 108637, 535-681; 1345, AVPR2, 6188, 108638, 146-1261; 1345, AVPR2, 6184, 108634, 72-1187; 1345, AVPR2, 6185, 108635, 210-1325; 1345, AVPR2, 6186, 108636, 33-962; 1346, AVPI1, 6189, 108639, 569-1012; 1347, RSRC1, 6192, 108642, 159-769; 1347, RSRC1, 6193, 108643, 186-679; 1347, RSRC1, 6194, 108644, 94-945; 1347, RSRC1, 6195, 108645, 1-338; 1347, RSRC1, 6196, 108646, 206-788; 1347, RSRC1, 6198, 108648, 86-685; 1347, RSRC1, 6200, 108650, 1-625; 1347, RSRC1, 6190, 108640, 163-1167; 1347, RSRC1, 6191, 108641, 95-925; 1347, RSRC1, 6197, 108647, 126-956; 1347, RSRC1, 6199, 108649, 159-1163; 1347, RSRC1, 6201, 108651, 175-1179; 1348, RSRC2, 6203, 108653, 228-936; 1348, RSRC2, 6204, 108654, 84-314; 1348, RSRC2, 6205, 108655, 143-373; 1348, RSRC2, 6206, 108656, 148-378; 1348, RSRC2, 6207, 108657, 1-530; 1348, RSRC2, 6208, 108658, 486-562; 1348, RSRC2, 6209, 108659, 272-545; 1348, RSRC2, 6202, 108652, 147-1451; 1349, RSRP1, 6212, 108662, 1-253; 1349, RSRP1, 6213, 108663, 243-629; 1349, RSRP1, 6214, 108664, 1-550; 1349, RSRP1, 6215, 108665, 190-477; 1349, RSRP1, 6216, 108666, 216-896; 1349, RSRP1, 6218, 108668, 212-480; 1349, RSRP1, 6210, 108660, 278-1150; 1349, RSRP1, 6211, 108661, 205-933; 1349, RSRP1, 6217, 108667, 1193-1873; 1350, ARGFX, 6219, 108669, 11-958; 1351, RERE, 6221, 108671, 156-4052; 1351, RERE, 6222, 108672, 75-1829; 1351, RERE, 6225, 108675, 1-273; 1351, RERE, 6226, 108676, 1-533; 1351, RERE, 6227, 108677, 477-743; 1351, RERE, 6228, 108678, 885-962; 1351, RERE, 6229, 108679, 1-639; 1351, RERE, 6230, 108680, 310-414; 1351, RERE, 6220, 108670, 636-5336; 1351, RERE, 6223, 108673, 629-5329; 1351, RERE, 6224, 108674, 566-3604; 1352, ASL, 6232, 108682, 203-928; 1352, ASL, 6231, 108681, 103-1497; 1352, ASL, 6233, 108683, 217-1533; 1352, ASL, 6234, 108684, 199-1533; 1352, ASL, 6235, 108685, 209-1603; 1353, ASS1, 6239, 108689, 213-807; 1353, ASS1, 6240, 108690, 7-545; 1353, ASS1, 6236, 108686, 73-1311; 1353, ASS1, 6237, 108687, 76-1314; 1353, ASS1, 6238, 108688, 482-1720; 1354, RNPEP, 6242, 108692, 16-1851; 1354, RNPEP, 6243, 108693, 134-1166; 1354, RNPEP, 6244, 108694, 1-505; 1354, RNPEP, 6245, 108695, 1-516; 1354, RNPEP, 6246, 108696, 1-454; 1354, RNPEP, 6241, 108691, 44-1996; 1355, RNPEPL1, 6248, 108698, 1-744; 1355, RNPEPL1, 6249, 108699, 195-538; 1355, RNPEPL1, 6247, 108697, 594-2078; 1356, ATE1, 6251, 108701, 276-1544; 1356, ATE1, 6253, 108703, 1-1546; 1356, ATE1, 6254, 108704, 32-697; 1356, ATE1, 6255, 108705, 371-1906; 1356, ATE1, 6256, 108706, 356-1567; 1356, ATE1, 6250, 108700, 115-1671; 1356, ATE1, 6252, 108702, 88-1644; 1357, RARS, 6258, 108708, 30-206; 1357, RARS, 6259, 108709, 9-398; 1357, RARS, 6260, 108710, 18-359; 1357, RARS, 6261, 108711, 1-177; 1357, RARS, 6257, 108707, 55-2037; 1358, RARS2, 6263, 108713, 1-618; 1358, RARS2, 6262, 108712, 47-1783; 1359, AGO1, 6265, 108715, 297-2645; 1359, AGO1, 6266, 108716, 1-401; 1359, AGO1, 6264, 108714, 214-2787; 1360, AGO2, 6268, 108718, 41-262; 1360, AGO2, 6270, 108720, 209-316; 1360, AGO2, 6267, 108717, 114-2693; 1360, AGO2, 6269, 108719, 41-2518; 1361, AGO3, 6272, 108722, 280-969; 1361, AGO3, 6274, 108724, 346-1035; 1361, AGO3, 6275, 108725, 333-527; 1361, AGO3, 6271, 108721, 614-2494; 1361, AGO3, 6273, 108723, 350-2932; 1362, AGO4, 6276, 108726, 246-2831; 1363, ARHGAP19-SLIT1, 6277, 108727, 11-1564; 1364, ARIH2OS, 6278, 108728, 237-1109; 1365, ARIH1, 6280, 108730, 1-612; 1365, ARIH1, 6281, 108731, 151-654; 1365, ARIH1, 6282, 108732, 1-142; 1365, ARIH1, 6283, 108733, 1-345; 1365, ARIH1, 6279, 108729, 315-1988; 1366, ARIH2, 6285, 108735, 276-598; 1366, ARIH2, 6286, 108736, 562-884; 1366, ARIH2, 6287, 108737, 340-753; 1366, ARIH2, 6289, 108739, 842-1162; 1366, ARIH2, 6290, 108740, 424-678; 1366, ARIH2, 6291, 108741, 394-560; 1366, ARIH2, 6284, 108734, 340-1821; 1366, ARIH2, 6288, 108738, 447-1928; 1367, ARX, 6292, 108742, 212-1900; 1368, ARL2-SNX15, 6293, 108743, 27-368; 1369, ARMC1, 6296, 108746, 480-1050; 1369, ARMC1, 6297, 108747, 316-686; 1369, ARMC1, 6298, 108748, 210-518; 1369, ARMC1, 6294, 108744, 246-1094; 1369, ARMC1, 6295, 108745, 372-914; 1370, ARMC10, 6299, 108749, 324-569; 1370, ARMC10, 6301, 108751, 348-929; 1370, ARMC10, 6304, 108754, 106-805; 1370, ARMC10, 6306, 108756, 1-558; 1370, ARMC10, 6309, 108759, 1-462; 1370, ARMC10, 6310, 108760, 1-558; 1370, ARMC10, 6311, 108761, 1-462; 1370, ARMC10, 6312, 108762, 1-639; 1370, ARMC10, 6313, 108763, 1-639; 1370, ARMC10, 6314, 108764, 1-274; 1370, ARMC10, 6315, 108765, 1-189; 1370, ARMC10, 6300, 108750, 393-1424; 1370, ARMC10, 6302, 108752, 393-1247; 1370, ARMC10, 6303, 108753, 393-1247; 1370, ARMC10, 6305, 108755, 393-1142; 1370, ARMC10, 6307, 108757, 393-1319; 1370, ARMC10, 6308, 108758, 393-1070; 1371, ARMC12, 6319, 108769, 18-185; 1371, ARMC12, 6316, 108766, 28-1131; 1371, ARMC12, 6317, 108767, 23-1045; 1371, ARMC12, 6318, 108768, 78-1070; 1372, ARMC2, 6320, 108770, 169-836; 1372, ARMC2, 6323, 108773, 1-257; 1372, ARMC2, 6321, 108771, 597-2705; 1372, ARMC2, 6322, 108772, 169-2772; 1373, ARMC3, 6325, 108775, 385-2214; 1373, ARMC3, 6328, 108778, 170-525; 1373, ARMC3, 6324, 108774, 85-2703; 1373, ARMC3, 6326, 108776, 72-2669; 1373, ARMC3, 6327, 108777, 45-2111; 1374, ARMC4, 6330, 108780, 1-1170; 1374, ARMC4, 6331, 108781, 138-308; 1374, ARMC4, 6329, 108779, 94-3228; 1375, ARMC5, 6333, 108783, 318-3410; 1375, ARMC5, 6336, 108786, 1-32; 1375, ARMC5, 6337, 108787, 1-1796; 1375, ARMC5, 6332, 108782, 530-3337; 1375, ARMC5, 6334, 108784, 702-2879; 1375, ARMC5, 6335, 108785, 427-2742; 1375, ARMC5, 6338, 108788, 547-3354; 1376, ARMC6, 6342, 108792, 154-622; 1376, ARMC6, 6343, 108793, 242-552; 1376, ARMC6, 6344, 108794, 347-537; 1376, ARMC6, 6345, 108795, 352-563; 1376, ARMC6, 6346, 108796, 467-951; 1376, ARMC6, 6347, 108797, 371-514; 1376, ARMC6, 6348, 108798, 549-1318; 1376, ARMC6, 6349, 108799, 468-557; 1376, ARMC6, 6350, 108800, 1-244; 1376, ARMC6, 6352, 108802, 1-412; 1376, ARMC6, 6353, 108803, 155-286; 1376, ARMC6, 6354, 108804, 319-1545; 1376, ARMC6, 6355, 108805, 10-222; 1376, ARMC6, 6356, 108806, 421-1198; 1376, ARMC6, 6357, 108807, 71-560; 1376, ARMC6, 6358, 108808, 1-436; 1376, ARMC6, 6339, 108789, 451-1881; 1376, ARMC6, 6340, 108790, 403-1833; 1376, ARMC6, 6341, 108791, 1-1613; 1376, ARMC6, 6351, 108801, 433-1938; 1377, ARMC7, 6360, 108810, 312-560; 1377, ARMC7, 6361, 108811, 109-414; 1377, ARMC7, 6359, 108809, 303-899; 1377, ARMC7, 6362, 108812, 338-649; 1378, ARMC8, 6364, 108814, 77-1879; 1378, ARMC8, 6366, 108816, 4-1059; 1378, ARMC8, 6367, 108817, 1-271; 1378, ARMC8, 6368, 108818, 417-807; 1378, ARMC8, 6369, 108819, 137-731; 1378, ARMC8, 6370, 108820, 25-1224; 1378, ARMC8, 6371, 108821, 255-1328; 1378, ARMC8, 6372, 108822, 753-829; 1378, ARMC8, 6374, 108824, 1-341; 1378, ARMC8, 6375, 108825, 1-353; 1378, ARMC8, 6379, 108829, 9-691; 1378, ARMC8, 6363, 108813, 386-1543; 1378, ARMC8, 6365, 108815, 380-2275; 1378, ARMC8, 6373, 108823, 272-2293; 1378, ARMC8, 6376, 108826, 407-2386; 1378, ARMC8, 6377, 108827, 145-1302; 1378, ARMC8, 6378, 108828, 39-1859; 1378, ARMC8, 6380, 108830, 308-2236; 1379, ARMC9, 6382, 108832, 231-729; 1379, ARMC9, 6383, 108833, 1-517; 1379, ARMC9, 6384, 108834, 1-626; 1379, ARMC9, 6385, 108835, 1-222; 1379, ARMC9, 6386, 108836, 125-599; 1379, ARMC9, 6387, 108837, 1-582; 1379, ARMC9, 6388, 108838, 159-2615; 1379, ARMC9, 6389, 108839, 1-2457; 1379, ARMC9, 6381, 108831, 195-2192; 1380, ARMCX1, 6391, 108841, 301-1398; 1380, ARMCX1, 6390, 108840, 372-1733; 1381, ARMCX2, 6395, 108845, 508-821; 1381, ARMCX2, 6396, 108846, 393-580; 1381, ARMCX2, 6397, 108847, 359-854; 1381, ARMCX2, 6398, 108848, 413-914; 1381, ARMCX2, 6399, 108849, 481-758; 1381, ARMCX2, 6392, 108842, 356-2254; 1381, ARMCX2, 6393, 108843, 455-2353; 1381, ARMCX2, 6394, 108844, 553-2451; 1382, ARMCX3, 6402, 108852, 447-637; 1382, ARMCX3, 6404, 108854, 691-973; 1382, ARMCX3, 6400, 108850, 867-2006; 1382, ARMCX3, 6401, 108851, 457-1596; 1382, ARMCX3, 6403, 108853, 547-1686; 1383, ARMCX4, 6405, 108855, 203-7075; 1383, ARMCX4, 6406, 108856, 438-593; 1383, ARMCX4, 6411, 108861, 242-397; 1383, ARMCX4, 6407, 108857, 236-1282; 1383, ARMCX4, 6408, 108858, 217-1263; 1383, ARMCX4, 6409, 108859, 487-1569; 1383, ARMCX4, 6410, 108860, 265-1347; 1384, ARMCX5, 6414, 108864, 760-782; 1384, ARMCX5, 6415, 108865, 619-822; 1384, ARMCX5, 6416, 108866, 647-859; 1384, ARMCX5, 6412, 108862, 882-2558; 1384, ARMCX5, 6413, 108863, 636-2312; 1384, ARMCX5, 6417, 108867, 2623-4299; 1385, ARMCX6, 6418, 108868, 346-1248; 1385, ARMCX6, 6419, 108869, 264-1166; 1385, ARMCX6, 6420, 108870, 434-1336; 1386, ARVCF, 6423, 108873, 1-2682; 1386, ARVCF, 6424, 108874, 1-2871; 1386, ARVCF, 6421, 108871, 293-3181; 1386, ARVCF, 6422, 108872, 1-2700; 1387, ACTR1A, 6426, 108876, 32-1030; 1387, ACTR1A, 6425, 108875, 65-1195; 1388, ACTR1B, 6427, 108877, 218-1348; 1389, ACTR2, 6430, 108880, 389-1408; 1389, ACTR2, 6428, 108878, 158-1342; 1389, ACTR2, 6429, 108879, 74-1273; 1390, ACTR3, 6432, 108882, 183-308; 1390, ACTR3, 6433, 108883, 315-566; 1390, ACTR3, 6434, 108884, 188-292; 1390, ACTR3, 6435, 108885, 291-1394; 1390, ACTR3, 6431, 108881, 321-1577; 1391, ACTR3B, 6436, 108886, 135-1391; 1391, ACTR3B, 6437, 108887, 135-1181; 1391, ACTR3B, 6438, 108888, 304-1296; 1392, ACTR3C, 6440, 108890, 1-627; 1392, ACTR3C, 6441, 108891, 350-502; 1392, ACTR3C, 6442, 108892, 12-678; 1392, ACTR3C, 6443, 108893, 1-570; 1392, ACTR3C, 6444, 108894, 1-75; 1392, ACTR3C, 6439, 108889, 191-823; 1393, ACTR5, 6445, 108895, 38-1861; 1394, ACTR6, 6447, 108897, 23-1153; 1394, ACTR6, 6448, 108898, 36-470; 1394, ACTR6, 6449, 108899, 988-1371; 1394, ACTR6, 6450, 108900, 389-1273; 1394, ACTR6, 6451, 108901, 23-289; 1394, ACTR6, 6452, 108902, 6-582; 1394, ACTR6, 6453, 108903, 424-1368; 1394, ACTR6, 6454, 108904, 36-302; 1394, ACTR6, 6446, 108896, 766-1956; 1395, ACTR8, 6456, 108906, 1-1136; 1395, ACTR8, 6457, 108907, 403-708; 1395, ACTR8, 6455, 108905, 102-1976; 1395, ACTR8, 6458, 108908, 333-1874; 1396, ARPC4-TTLL3, 6459, 108909, 9-1886; 1396, ARPC4-TTLL3, 6460, 108910, 1-499; 1396, ARPC4-TTLL3, 6461, 108911, 41-184; 1396, ARPC4-TTLL3, 6462, 108912, 41-586; 1397, ARR3, 6465, 108915, 259-549; 1397, ARR3, 6466, 108916, 69-1235; 1397, ARR3, 6463, 108913, 52-1218; 1397, ARR3, 6464, 108914, 99-1178; 1398, ARRDC1, 6468, 108918, 25-555; 1398, ARRDC1, 6469, 108919, 16-829; 1398, ARRDC1, 6470, 108920, 23-394; 1398, ARRDC1, 6467, 108917, 65-1366; 1399, ARRDC2, 6473, 108923, 598-615; 1399, ARRDC2, 6474, 108924, 144-1109; 1399, ARRDC2, 6471, 108921, 144-1367; 1399, ARRDC2, 6472, 108922, 184-1392; 1400, ARRDC3, 6475, 108925, 268-1512; 1401, ARRDC4, 6476, 108926, 165-1421; 1402, ARRDC5, 6477, 108927, 1-1029; 1403, ARRB1, 6480, 108930, 1-218; 1403, ARRB1, 6481, 108931, 153-925; 1403, ARRB1, 6482, 108932, 1-209; 1403, ARRB1, 6483, 108933, 1-180; 1403, ARRB1, 6484, 108934, 1-586; 1403, ARRB1, 6478, 108928, 99-1331; 1403, ARRB1, 6479, 108929, 99-1355; 1404, ARRB2, 6489, 108939, 127-321; 1404, ARRB2, 6490, 108940, 32-256; 1404, ARRB2, 6491, 108941, 907-1560; 1404, ARRB2, 6492, 108942, 1-591; 1404, ARRB2, 6493, 108943, 564-1217; 1404, ARRB2, 6494, 108944, 526-864; 1404, ARRB2, 6495, 108945, 638-1291; 1404, ARRB2, 6496, 108946, 24-1016; 1404, ARRB2, 6485, 108935, 234-1463; 1404, ARRB2, 6486, 108936, 89-1309; 1404, ARRB2, 6487, 108937, 30-1214; 1404, ARRB2, 6488, 108938, 30-1322; 1405, ASNA1, 6499, 108949, 249-848; 1405, ASNA1, 6500, 108950, 1-996; 1405, ASNA1, 6497, 108947, 15-1061; 1405, ASNA1, 6498, 108948, 103-1149; 1406, AS3MT, 6502, 108952, 78-1094; 1406, AS3MT, 6501, 108951, 78-1205; 1407, ARTN, 6507, 108957, 134-364; 1407, ARTN, 6508, 108958, 279-477; 1407, ARTN, 6509, 108959, 218-485; 1407, ARTN, 6510, 108960, 66-296; 1407, ARTN, 6511, 108961, 319-517; 1407, ARTN, 6512, 108962, 257-524; 1407, ARTN, 6503, 108953, 299-961; 1407, ARTN, 6504, 108954, 783-1445; 1407, ARTN, 6505, 108955, 783-1469; 1407, ARTN, 6506, 108956, 176-889; 1407, ARTN, 6513, 108963, 142-828; 1408, ARV1, 6515, 108965, 13-708; 1408, ARV1, 6516, 108966, 1-875; 1408, ARV1, 6517, 108967, 1-806; 1408, ARV1, 6518, 108968, 1-368; 1408, ARV1, 6519, 108969, 45-788; 1408, ARV1, 6514, 108964, 58-873; 1409, AHR, 6520, 108970, 644-3190; 1409, AHR, 6521, 108971, 583-3129; 1410, AIP, 6523, 108973, 119-815; 1410, AIP, 6524, 108974, 1-567; 1410, AIP, 6522, 108972, 119-1111; 1411, AIPL1, 6526, 108976, 29-214; 1411, AIPL1, 6528, 108978, 30-1148; 1411, AIPL1, 6530, 108980, 18-830; 1411, AIPL1, 6531, 108981, 17-805; 1411, AIPL1, 6532, 108982, 4-653; 1411, AIPL1, 6535, 108985, 1-409; 1411, AIPL1, 6536, 108986, 15-995; 1411, AIPL1, 6525, 108975, 96-1061; 1411, AIPL1, 6527, 108977, 82-1236; 1411, AIPL1, 6529, 108979, 49-1023; 1411, AIPL1, 6533, 108983, 49-1131; 1411, AIPL1, 6534, 108984, 49-1137; 1412, ARNT, 6540, 108990, 130-297; 1412, ARNT, 6541, 108991, 139-1389; 1412, ARNT, 6537, 108987, 13-2376; 1412, ARNT, 6538, 108988, 202-2571; 1412, ARNT, 6539, 108989, 225-2552; 1412, ARNT, 6542, 108992, 43-2367; 1413, ARNTL, 6548, 108998, 266-567; 1413, ARNTL, 6549, 108999, 629-807; 1413, ARNTL, 6550, 109000, 292-519; 1413, ARNTL, 6551, 109001, 204-610; 1413, ARNTL, 6552, 109002, 503-571; 1413, ARNTL, 6553, 109003, 412-551; 1413, ARNTL, 6554, 109004, 209-390; 1413, ARNTL, 6555, 109005, 446-868; 1413, ARNTL, 6556, 109006, 1-516; 1413, ARNTL, 6557, 109007, 523-739; 1413, ARNTL, 6543, 108993, 389-2266; 1413, ARNTL, 6544, 108994, 356-2236; 1413, ARNTL, 6545, 108995, 490-2238; 1413, ARNTL, 108996, 5-1879; 1413, ARNTL, 6547, 108997, 527-2278; 1414, ARNTL2, 6562, 109012, 1-1766; 1414, ARNTL2, 6558, 109008, 19-1785; 1414, ARNTL2, 6559, 109009, 19-1929; 1414, ARNTL2, 6560, 109010, 19-1887; 1414, ARNTL2, 6561, 109011, 154-1953; 1414, ARNTL2, 6563, 109013, 154-1776; 1414, ARNTL2, 6564, 109014, 220-2028; 1414, ARNTL2, 6565, 109015, 7-1662; 1415, AADAC, 6567, 109017, 91-705; 1415, AADAC, 6566, 109016, 127-1326; 1416, AADACL2, 6569, 109019, 121-282; 1416, AADACL2, 6571, 109021, 121-282; 1416, AADACL2, 6568, 109018, 110-1315; 1416, AADACL2, 6570, 109020, 110-1315; 1417, AADACL3, 6572, 109022, 35-1258; 1418, AADACL4, 6573, 109023, 1-1224; 1419, AFMID, 6576, 109026, 10-291; 1419, AFMID, 6577, 109027, 10-345; 1419, AFMID, 6578, 109028, 22-135; 1419, AFMID, 6579, 109029, 14-631; 1419, AFMID, 6580, 109030, 8-569; 1419, AFMID, 6581, 109031, 10-183; 1419, AFMID, 6582, 109032, 10-264; 1419, AFMID, 6583, 109033, 10-192; 1419, AFMID, 6574, 109024, 10-936; 1419, AFMID, 6575, 109025, 55-966; 1420, ARNT2, 6585, 109035, 196-585; 1420, ARNT2, 6588, 109038, 116-2266; 1420, ARNT2, 6589, 109039, 27-1727; 1420, ARNT2, 6584, 109034, 166-2319; 1420, ARNT2, 6586, 109036, 340-2460; 1420, ARNT2, 6587, 109037, 143-2263; 1421, AHRR, 6592, 109042, 210-1853; 1421, AHRR, 6593, 109043, 1-646; 1421, AHRR, 6594, 109044, 401-2074; 1421, AHRR, 6595, 109045, 104-576; 1421, AHRR, 6596, 109046, 192-435; 1421, AHRR, 6597, 109047, 34-453; 1421, AHRR, 6598, 109048, 527-563; 1421, AHRR, 6590, 109040, 45-2204; 1421, AHRR, 6591, 109041, 45-2150; 1422, ARSA, 6599, 109049, 394-1923; 1422, ARSA, 6600, 109050, 239-1768; 1422, ARSA, 6601, 109051, 183-1712; 1422, ARSA, 6602, 109052, 272-1801; 1422, ARSA, 6604, 109054, 1-209; 1422, ARSA, 6603, 109053, 263-1534; 1423, ARSB, 6607, 109057, 437-573; 1423, ARSB, 6605, 109055, 538-2139; 1423, ARSB, 6606, 109056, 500-1741; 1423, ARSB, 6608, 109058, 500-1741; 1424, ARSD, 6610, 109060, 1-480; 1424, ARSD, 6611, 109061, 65-313; 1424, ARSD, 6609, 109059, 77-1858; 1425, ARSE, 6613, 109063, 110-644; 1425, ARSE, 6614, 109064, 156-1790; 1425, ARSE, 6615, 109065, 462-2306; 1425, ARSE, 6612, 109062, 68-1837; 1426, ARSF, 6616, 109066, 69-1841; 1426, ARSF, 6617, 109067, 222-1994; 1427, ARSH, 6618, 109068, 1-1689; 1428, ARSI, 6620, 109070, 213-472; 1428, ARSI, 6619, 109069, 581-2290; 1428, ARSI, 6621, 109071, 149-1429; 1429, ARSJ, 6623, 109073, 451-852; 1429, ARSJ, 6622, 109072, 868-2667; 1430, ARSK, 6625, 109075, 113-253; 1430, ARSK, 6626, 109076, 143-604; 1430, ARSK, 6627, 109077, 97-1284; 1430, ARSK, 6628, 109078, 1-279; 1430, ARSK, 6624, 109074, 206-1816; 1431, ARSG, 6630, 109080, 326-1411; 1431, ARSG, 6631, 109081, 630-715; 1431, ARSG, 6629, 109079, 797-2374; 1431, ARSG, 6632, 109082, 626-2203; 1432, ASH1L, 6635, 109085, 1-463; 1432, ASH1L, 6636, 109086, 272-805; 1432, ASH1L, 6633, 109083, 641-9550; 1432, ASH1L, 6634, 109084, 480-9374; 1433, ASH2L, 6639, 109089, 1-271; 1433, ASH2L, 6640, 109090, 52-656; 1433, ASH2L, 6641, 109091, 1-575; 1433, ASH2L, 6643, 109093, 2-367; 1433, ASH2L, 6644, 109094, 330-1799; 1433, ASH2L, 6637, 109087, 310-2196; 1433, ASH2L, 6638, 109088, 442-2046; 1433, ASH2L, 6642, 109092, 296-1801; 1434, ASGR1, 6646, 109096, 266-838; 1434, ASGR1, 6647, 109097, 435-719; 1434, ASGR1, 6648, 109098, 539-627; 1434, ASGR1, 6650, 109100, 503-855; 1434, ASGR1, 6651, 109101, 1-488; 1434, ASGR1, 6645, 109095, 401-1276; 1434, ASGR1, 6649, 109099, 794-1552; 1434, ASGR1, 6652, 109102, 401-1159; 1435, ASGR2, 6656, 109106, 797-1202; 1435, ASGR2, 6653, 109103, 280-1143; 1435, ASGR2, 6654, 109104, 198-1133; 1435, ASGR2, 6655, 109105, 1-879; 1436, ASPG, 6657, 109107, 1-423; 1436, ASPG, 6658, 109108, 1-377; 1436, ASPG, 6659, 109109, 81-1748; 1436, ASPG, 6660, 109110, 93-1814; 1437, ASRGL1, 6663, 109113, 136-348; 1437, ASRGL1, 6664, 109114, 194-406; 1437, ASRGL1, 6665, 109115, 92-586; 1437, ASRGL1, 6666, 109116, 135-535; 1437, ASRGL1, 6667, 109117, 1-171; 1437, ASRGL1, 6668, 109118, 94-306; 1437, ASRGL1, 6661, 109111, 134-1060; 1437, ASRGL1, 6662, 109112, 216-1142; 1438, ASNS, 6672, 109122, 259-745; 1438, ASNS, 6673, 109123, 465-562; 1438, ASNS, 6674, 109124, 185-828; 1438, ASNS, 6675, 109125, 60-1265; 1438, ASNS, 6676, 109126, 224-579; 1438, ASNS, 6679, 109129, 385-573; 1438, ASNS, 6680, 109130, 500-584; 1438, ASNS, 6669, 109119, 530-2215; 1438, ASNS, 6670, 109120, 181-1866; 1438, ASNS, 6671, 109121, 473-2158; 1438, ASNS, 6677, 109127, 135-1757; 1438, ASNS, 6678, 109128, 45-1481; 1438, ASNS, 6681, 109131, 74-1510; 1438, ASNS, 6682, 109132, 130-1752; 1439, ASNSD1, 6684, 109134, 349-567; 1439, ASNSD1, 6685, 109135, 317-2172; 1439, ASNSD1, 6686, 109136, 1-291; 1439, ASNSD1, 6687, 109137, 1-192; 1439, ASNSD1, 6688, 109138, 63-200; 1439, ASNSD1, 6689, 109139, 449-937; 1439, ASNSD1, 6690, 109140, 3-741; 1439, ASNSD1, 6691, 109141, 70-243; 1439, ASNSD1, 6683, 109133, 414-2345; 1440, NARS, 6694, 109144, 76-562; 1440, NARS, 6695, 109145, 69-479; 1440, NARS, 6696, 109146, 618-1002; 1440, NARS, 6697, 109147, 21-164; 1440, NARS, 6698, 109148, 93-582; 1440, NARS, 6699, 109149, 84-584; 1440, NARS, 6692, 109142, 457-2103; 1440, NARS, 6693, 109143, 76-600; 1441, NARS2, 6701, 109151, 31-755; 1441, NARS2, 6703, 109153, 587-594; 1441, NARS2, 6704, 109154, 1-244; 1441, NARS2, 6705, 109155, 1-319; 1441, NARS2, 6700, 109150, 377-1810; 1441, NARS2, 6702, 109152, 938-1690; 1442, ASPH, 6710, 109160, 270-1154; 1442, ASPH, 6711, 109161, 155-1138; 1442, ASPH, 6712, 109162, 162-755; 1442, ASPH, 6713, 109163, 88-612; 1442, ASPH, 6716, 109166, 124-531; 1442, ASPH, 6717, 109167, 217-558; 1442, ASPH, 6720, 109170, 1-492; 1442, ASPH, 6723, 109173, 1-556; 1442, ASPH, 6724, 109174, 1-135; 1442, ASPH, 6725, 109175, 1-587; 1442, ASPH, 6726, 109176, 1-404; 1442, ASPH, 6706, 109156, 226-1167; 1442, ASPH, 6707, 109157, 176-787; 1442, ASPH, 6708, 109158, 189-2465; 1442, ASPH, 6709, 109159, 87-764; 1442, ASPH, 6714, 109164, 125-895; 1442, ASPH, 6715, 109165, 198-1010; 1442, ASPH, 6718, 109168, 81-980; 1442, ASPH, 6719, 109169, 92-988; 1442, ASPH, 6721, 109171, 99-731; 1442, ASPH, 6722, 109172, 162-2351; 1443, ASPHD1, 6730, 109180, 627-956; 1443, ASPHD1, 6731, 109181, 456-775; 1443, ASPHD1, 6727, 109177, 253-1425; 1443, ASPHD1, 6728, 109178, 115-1287; 1443, ASPHD1, 6729, 109179, 115-1287; 1444, ASPHD2, 6732, 109182, 439-1548; 1445, ASPDH, 6735, 109185, 156-310; 1445, ASPDH, 6736, 109186, 235-637; 1445, ASPDH, 6733, 109183, 182-718; 1445, ASPDH, 6734, 109184, 63-914; 1446, DRICH1, 6737, 109187, 299-988; 1446, DRICH1, 6738, 109188, 1-687; 1447, ASPRV1, 6739, 109189, 578-1609; 1448, ASPA, 6742, 109192, 328-563; 1448, ASPA, 6743, 109193, 137-307; 1448, ASPA, 6740, 109190, 159-1100; 1448, ASPA, 6741, 109191, 149-1090; 1449, DNPEP, 6745, 109195, 114-925; 1449, DNPEP, 6746, 109196, 136-279; 1449, DNPEP, 6747, 109197, 139-249; 1449, DNPEP, 6748, 109198, 248-1480; 1449, DNPEP, 6749, 109199, 77-896; 1449, DNPEP, 6750, 109200, 98-1091; 1449, DNPEP, 6751, 109201, 226-638; 1449, DNPEP, 6752, 109202, 227-577; 1449, DNPEP, 6753, 109203, 82-219; 1449, DNPEP, 6754, 109204, 3-113; 1449, DNPEP, 6755, 109205, 41-714; 1449, DNPEP, 6756, 109206, 308-576; 1449, DNPEP, 6757, 109207, 83-1564; 1449, DNPEP, 6744, 109194, 222-1679; 1450, AGA, 6759, 109209, 1-414; 1450, AGA, 6760, 109210, 1-464; 1450, AGA, 6758, 109208, 129-1169; 1451, DARS, 6762, 109212, 1-567; 1451, DARS, 6763, 109213, 138-543; 1451, DARS, 6764, 109214, 106-651; 1451, DARS, 6765, 109215, 205-731; 1451, DARS, 6766, 109216, 1-539; 1451, DARS, 6761, 109211, 217-1722; 1452, DARS2, 6767, 109217, 728-2665; 1453, ASPN, 6768, 109218, 245-976; 1453, ASPN, 6769, 109219, 245-1387; 1454, ASTL, 6770, 109220, 1-1296; 1455, ASTE1, 6773, 109223, 425-569; 1455, ASTE1, 6774, 109224, 1-292; 1455, ASTE1, 6775, 109225, 403-551; 1455, ASTE1, 6776, 109226, 92-310; 1455, ASTE1, 6777, 109227, 208-2322; 1455, ASTE1, 6778, 109228, 569-589; 1455, ASTE1, 6771, 109221, 443-2482; 1455, ASTE1, 6772, 109222, 495-2057; 1456, ASTN1, 6780, 109230, 192-3878; 1456, ASTN1, 6779, 109229, 15-3899; 1456, ASTN1, 6781, 109231, 8-3658; 1457, ASTN2, 6785, 109235, 195-779; 1457, ASTN2, 6787, 109237, 2793-4001; 1457, ASTN2, 6788, 109238, 1-3189; 1457, ASTN2, 6789, 109239, 1-296; 1457, ASTN2, 6782, 109232, 411-1733; 1457, ASTN2, 6783, 109233, 102-4121; 1457, ASTN2, 6784, 109234, 208-1395; 1457, ASTN2, 6786, 109236, 133-3999; 1458, ASUN, 6791, 109241, 71-560; 1458, ASUN, 6792, 109242, 1-1062; 1458, ASUN, 6793, 109243, 201-875; 1458, ASUN, 6794, 109244, 181-552; 1458, ASUN, 6795, 109245, 1-460; 1458, ASUN, 6790, 109240, 538-2658; 1459, AHCTF1, 6798, 109248, 409-611; 1459, AHCTF1, 6799, 109249, 1-243; 1459, AHCTF1, 6796, 109246, 138-7043; 1459, AHCTF1, 6797, 109247, 98-6925; 1460, AHDC1, 6800, 109250, 598-5409; 1460, AHDC1, 6801, 109251, 970-5781; 1461, ARID1A, 6805, 109255, 1-3547; 1461, ARID1A, 6806, 109256, 1-434; 1461, ARID1A, 6807, 109257, 179-546; 1461, ARID1A, 6808, 109258, 1-566; 1461, ARID1A, 6809, 109259, 284-3709; 1461, ARID1A, 6802, 109252, 372-7229; 1461, ARID1A, 6803, 109253, 284-5992; 1461, ARID1A, 6804, 109254, 1-6207; 1462, ARID1B, 6811, 109261, 1-2187; 1462, ARID1B, 6813, 109263, 1-822; 1462, ARID1B, 6814, 109264, 1-5277; 1462, ARID1B, 6815, 109265, 1-916; 1462, ARID1B, 6810, 109260, 2-6712; 1462, ARID1B, 6812, 109262, 557-7306; 1463, ARID2, 6817, 109267, 6-1211; 1463, ARID2, 6818, 109268, 17-4354; 1463, ARID2, 6819, 109269, 369-5288; 1463, ARID2, 6820, 109270, 1-193; 1463, ARID2, 6816, 109266, 173-5680; 1464, ARID3A, 6822, 109272, 1-289; 1464, ARID3A, 6823, 109273, 1-1016; 1464, ARID3A, 6821, 109271, 291-2072; 1465, ARID3B, 6825, 109275, 166-581; 1465, ARID3B, 6824, 109274, 232-1914; 1465, ARID3B, 6826, 109276, 203-1888; 1466, ARID3C, 6827, 109277, 94-1332; 1467, ARID4A, 6831, 109281, 171-965; 1467, ARID4A, 6833, 109283, 200-322; 1467, ARID4A, 6834, 109284, 419-582; 1467, ARID4A, 6835, 109285, 293-2537; 1467, ARID4A, 6828, 109278, 255-3821; 1467, ARID4A, 6829, 109279, 374-4147; 1467, ARID4A, 6830, 109280, 203-3814; 1467, ARID4A, 6832, 109282, 319-3885; 1468, ARID4B, 6839, 109289, 311-1759; 1468, ARID4B, 6841, 109291, 1-1660; 1468, ARID4B, 6842, 109292, 1-2089; 1468, ARID4B, 6836, 109286, 499-4437; 1468, ARID4B, 6837, 109287, 501-4181; 1468, ARID4B, 6838, 109288, 378-4316; 1468, ARID4B, 6840, 109290, 416-3877; 1469, ARID5A, 6844, 109294, 76-252; 1469, ARID5A, 6845, 109295, 1178-2758; 1469, ARID5A, 6843, 109293, 79-1863; 1470, ARID5B, 6846, 109296, 411-3977; 1470, ARID5B, 6847, 109297, 270-3107; 1471, ATCAY, 6850, 109300, 233-530; 1471, ATCAY, 6851, 109301, 366-590; 1471, ATCAY, 6848, 109298, 468-1583; 1471, ATCAY, 6849, 109299, 1-1134; 1472, ATXN1, 6852, 109302, 938-3385; 1472, ATXN1, 6853, 109303, 923-3370; 1473, ATXN10, 6856, 109306, 58-438; 1473, ATXN10, 6857, 109307, 1-594; 1473, ATXN10, 6854, 109304, 266-1693; 1473, ATXN10, 6855, 109305, 267-1502; 1474, ATXN1L, 6858, 109308, 294-2363; 1475, ATXN2, 6860, 109310, 104-3256; 1475, ATXN2, 6861, 109311, 1-1275; 1475, ATXN2, 6863, 109313, 164-3385; 1475, ATXN2, 6864, 109314, 1-2750; 1475, ATXN2, 6866, 109316, 1-887; 1475, ATXN2, 6867, 109317, 1-591; 1475, ATXN2, 6868, 109318, 1-704; 1475, ATXN2, 6869, 109319, 3-556; 1475, ATXN2, 6870, 109320, 1-322; 1475, ATXN2, 6871, 109321, 1-360; 1475, ATXN2, 6872, 109322, 317-3778; 1475, ATXN2, 6859, 109309, 163-4104; 1475, ATXN2, 6862, 109312, 127-3147; 1475, ATXN2, 6865, 109315, 163-4104; 1475, ATXN2, 6873, 109323, 958-3978; 1476, ATXN2L, 6880, 109330, 1-559; 1476, ATXN2L, 6881, 109331, 1-1206; 1476, ATXN2L, 6882, 109332, 1-333; 1476, ATXN2L, 6883, 109333, 1-35; 1476, ATXN2L, 6884, 109334, 1-386; 1476, ATXN2L, 6885, 109335, 1-1203; 1476, ATXN2L, 6886, 109336, 287-1294; 1476, ATXN2L, 6887, 109337, 279-552; 1476, ATXN2L, 6888, 109338, 1-654; 1476, ATXN2L, 6889, 109339, 166-3372; 1476, ATXN2L, 6874, 109324, 168-3356; 1476, ATXN2L, 6875, 109325, 168-3395; 1476, ATXN2L, 6876, 109326, 213-3347; 1476, ATXN2L, 6877, 109327, 168-3302; 1476, ATXN2L, 6878, 109328, 168-3461; 1476, ATXN2L, 6879, 109329, 9-3197; 1477, ATXN3, 6891, 109341, 39-278; 1477, ATXN3, 6892, 109342, 70-1002; 1477, ATXN3, 6893, 109343, 70-945; 1477, ATXN3, 6894, 109344, 12-311; 1477, ATXN3, 6897, 109347, 22-637; 1477, ATXN3, 6899, 109349, 70-1182; 1477, ATXN3, 6900, 109350, 23-262; 1477, ATXN3, 6901, 109351, 23-262; 1477, ATXN3, 6902, 109352, 23-692; 1477, ATXN3, 6903, 109353, 109-562; 1477, ATXN3, 6904, 109354, 23-803; 1477, ATXN3, 6905, 109355, 23-355; 1477, ATXN3, 6906, 109356, 23-259; 1477, ATXN3, 6907, 109357, 23-1010; 1477, ATXN3, 6908, 109358, 23-367; 1477, ATXN3, 6909, 109359, 23-310; 1477, ATXN3, 6910, 109360, 63-759; 1477, ATXN3, 6911, 109361, 23-355; 1477, ATXN3, 6912, 109362, 23-262; 1477, ATXN3, 6913, 109363, 23-502; 1477, ATXN3, 6914, 109364, 23-475; 1477, ATXN3, 6915, 109365, 23-262; 1477, ATXN3, 6916, 109366, 23-857; 1477, ATXN3, 6917, 109367, 22-624; 1477, ATXN3, 6918, 109368, 23-508; 1477, ATXN3, 6919, 109369, 23-262; 1477, ATXN3, 6920, 109370, 23-322; 1477, ATXN3, 6921, 109371, 1-597; 1477, ATXN3, 6923, 109373, 70-936; 1477, ATXN3, 6924, 109374, 23-928; 1477, ATXN3, 6925, 109375, 70-1044; 1477, ATXN3, 6890, 109340, 59-979; 1477, ATXN3, 6895, 109345, 272-820; 1477, ATXN3, 6896, 109346, 49-1089; 1477, ATXN3, 6898, 109348, 11-1105; 1477, ATXN3, 6922, 109372, 59-1144; 1478, ATXN3L, 6927, 109377, 19-504; 1478, ATXN3L, 6926, 109376, 19-1086; 1479, ATXN7, 6929, 109379, 652-728; 1479, ATXN7, 6931, 109381, 1-346; 1479, ATXN7, 6928, 109378, 551-3229; 1479, ATXN7, 6930, 109380, 265-2943; 1479, ATXN7, 6932, 109382, 169-2412; 1479, ATXN7, 6933, 109383, 111-2948; 1480, ATXN7L1, 6937, 109387, 4-291; 1480, ATXN7L1, 6938, 109388, 1-1725; 1480, ATXN7L1, 6939, 109389, 96-2324; 1480, ATXN7L1, 6940, 109390, 91-297; 1480, ATXN7L1, 6934, 109384, 25-465; 1480, ATXN7L1, 6935, 109385, 47-2632; 1480, ATXN7L1, 6936, 109386, 129-

2345; 1481, ATXN7L2, 6942, 109392, 476-787; 1481, ATXN7L2, 6943, 109393, 16-1758; 1481, ATXN7L2, 6941, 109391, 16-2184; 1482, ATXN7L3, 6946, 109396, 322-539; 1482, ATXN7L3, 6947, 109397, 418-1341; 1482, ATXN7L3, 6948, 109398, 204-622; 1482, ATXN7L3, 6949, 109399, 1-559; 1482, ATXN7L3, 6950, 109400, 152-593; 1482, ATXN7L3, 6944, 109394, 310-1353; 1482, ATXN7L3, 6945, 109395, 1-1065; 1483, ATXN7L3B, 6951, 109401, 287-580; 1484, ATHL1, 6952, 109402, 1-578; 1484, ATHL1, 6953, 109403, 567-2036; 1484, ATHL1, 6954, 109404, 259-2553; 1484, ATHL1, 6956, 109406, 1-611; 1484, ATHL1, 6955, 109405, 116-2329; 1485, AKNA, 6957, 109407, 826-3525; 1485, AKNA, 6958, 109408, 163-4482; 1485, AKNA, 6959, 109409, 336-2831; 1485, AKNA, 6960, 109410, 73-4149; 1485, AKNA, 6961, 109411, 58-1212; 1485, AKNA, 6962, 109412, 218-4537; 1486, ATL1, 6965, 109415, 1-159; 1486, ATL1, 6966, 109416, 439-527; 1486, ATL1, 6967, 109417, 430-570; 1486, ATL1, 6968, 109418, 1-318; 1486, ATL1, 6969, 109419, 320-545; 1486, ATL1, 6970, 109420, 322-620; 1486, ATL1, 6963, 109413, 242-1918; 1486, ATL1, 6964, 109414, 482-2143; 1487, ATL2, 6972, 109422, 14-163; 1487, ATL2, 6974, 109424, 294-1535; 1487, ATL2, 6976, 109426, 20-576; 1487, ATL2, 6977, 109427, 14-295; 1487, ATL2, 6978, 109428, 2-526; 1487, ATL2, 6979, 109429, 1-775; 1487, ATL2, 6980, 109430, 3-263; 1487, ATL2, 6982, 109432, 1-1242; 1487, ATL2, 6971, 109421, 3-1754; 1487, ATL2, 6973, 109423, 260-1498; 1487, ATL2, 6975, 109425, 416-2113; 1487, ATL2, 6981, 109431, 14-1753; 1488, ATL3, 6984, 109434, 283-1854; 1488, ATL3, 6985, 109435, 207-714; 1488, ATL3, 6983, 109433, 278-1903; 1489, ATMIN, 6989, 109439, 424-587; 1489, ATMIN, 6986, 109436, 25-2496; 1489, ATMIN, 6987, 109437, 964-2967; 1489, ATMIN, 6988, 109438, 422-2425; 1490, ATM, 6992, 109442, 202-481; 1490, ATM, 6993, 109443, 133-595; 1490, ATM, 6994, 109444, 1-468; 1490, ATM, 6995, 109445, 1-233; 1490, ATM, 6996, 109446, 734-4841; 1490, ATM, 6997, 109447, 178-582; 1490, ATM, 6998, 109448, 189-527; 1490, ATM, 6999, 109449, 4523-5029; 1490, ATM, 6990, 109440, 386-9556; 1490, ATM, 6991, 109441, 190-9360; 1491, ATOH1, 7000, 109450, 175-1239; 1492, ATOH7, 7001, 109451, 427-885; 1493, ATOH8, 7002, 109452, 297-1262; 1494, ACLY, 7007, 109457, 185-583; 1494, ACLY, 7009, 109459, 213-540; 1494, ACLY, 7003, 109453, 132-3437; 1494, ACLY, 7004, 109454, 164-3439; 1494, ACLY, 7005, 109455, 171-3446; 1494, ACLY, 7006, 109456, 128-2620; 1494, ACLY, 7008, 109458, 111-3416; 1495, ATPAF1, 7010, 109460, 37-888; 1495, ATPAF1, 7011, 109461, 37-1092; 1495, ATPAF1, 7012, 109462, 1-342; 1495, ATPAF1, 7013, 109463, 1-551; 1495, ATPAF1, 7014, 109464, 1-259; 1495, ATPAF1, 7016, 109466, 208-345; 1495, ATPAF1, 7017, 109467, 1-525; 1495, ATPAF1, 7020, 109470, 64-1119; 1495, ATPAF1, 7015, 109465, 208-930; 1495, ATPAF1, 7018, 109468, 511-1044; 1495, ATPAF1, 7019, 109469, 43-1029; 1496, ATPAF2, 7021, 109471, 70-685; 1496, ATPAF2, 7023, 109473, 156-479; 1496, ATPAF2, 7024, 109474, 156-479; 1496, ATPAF2, 7025, 109475, 63-386; 1496, ATPAF2, 7026, 109476, 1-178; 1496, ATPAF2, 7022, 109472, 156-1025; 1497, ATP5A1, 7029, 109479, 374-807; 1497, ATP5A1, 7031, 109481, 289-910; 1497, ATP5A1, 7032, 109482, 66-200; 1497, ATP5A1, 7033, 109483, 85-357; 1497, ATP5A1, 7034, 109484, 65-241; 1497, ATP5A1, 7035, 109485, 65-662; 1497, ATP5A1, 7037, 109487, 220-553; 1497, ATP5A1, 7038, 109488, 13-249; 1497, ATP5A1, 7039, 109489, 140-756; 1497, ATP5A1, 7040, 109490, 55-288; 1497, ATP5A1, 7027, 109477, 146-1807; 1497, ATP5A1, 7028, 109478, 123-1784; 1497, ATP5A1, 7030, 109480, 609-2120; 1497, ATP5A1, 7036, 109486, 66-1661; 1498, ATP5B, 7042, 109492, 1-1085; 1498, ATP5B, 7043, 109493, 5-856; 1498, ATP5B, 7044, 109494, 5-814; 1498, ATP5B, 7045, 109495, 1-399; 1498, ATP5B, 7041, 109491, 106-1695; 1499, ATP5D, 7049, 109499, 1-299; 1499, ATP5D, 7046, 109496, 102-608; 1499, ATP5D, 7047, 109497, 106-612; 1499, ATP5D, 7048, 109498, 32-538; 1500, ATP5E, 7050, 109500, 132-287; 1500, ATP5E, 7051, 109501, 95-250; 1500, ATP5E, 7052, 109502, 42-197; 1501, ATP5EP2, 7053, 109503, 55-210; 1502, ATP5C1, 7054, 109504, 32-925; 1502, ATP5C1, 7055, 109505, 80-976; 1503, ATP5O, 7057, 109507, 1-259; 1503, ATP5O, 7058, 109508, 1-223; 1503, ATP5O, 7059, 109509, 1-79; 1503, ATP5O, 7060, 109510, 1-123; 1503, ATP5O, 7056, 109506, 218-859; 1504, ATP5F1, 7062, 109512, 59-646; 1504, ATP5F1, 7061, 109511, 607-1377; 1505, ATP5G1, 7065, 109515, 49-348; 1505, ATP5G1, 7066, 109516, 34-366; 1505, ATP5G1, 7067, 109517, 54-437; 1505, ATP5G1, 7068, 109518, 106-401; 1505, ATP5G1, 7063, 109513, 86-496; 1505, ATP5G1, 7064, 109514, 104-514; 1506, ATP5G2, 7072, 109522, 603-653; 1506, ATP5G2, 7069, 109519, 1207-1680; 1506, ATP5G2, 7070, 109520, 134-730; 1506, ATP5G2, 7071, 109521, 189-614; 1506, ATP5G2, 7073, 109523, 1382-1807; 1506, ATP5G2, 7074, 109524, 95-520; 1507, ATP5G3, 7075, 109525, 3026-3454; 1507, ATP5G3, 7076, 109526, 271-699; 1507, ATP5G3, 7077, 109527, 146-574; 1508, ATPSH, 7080, 109530, 36-281; 1508, ATPSH, 7078, 109528, 49-534; 1508, ATPSH, 7079, 109529, 71-484; 1509, ATPSI, 7081, 109531, 92-301; 1510, ATP5J2, 7085, 109535, 27-323; 1510, ATP5J2, 7088, 109538, 27-84; 1510, ATP5J2, 7082, 109532, 191-475; 1510, ATP5J2, 7083, 109533, 24-191; 1510, ATP5J2, 7084, 109534, 21-287; 1510, ATP5J2, 7086, 109536, 25-174; 1510, ATP5J2, 7087, 109537, 27-176; 1511, ATP5J, 7094, 109544, 47-406; 1511, ATP5J, 7089, 109539, 128-454; 1511, ATP5J, 7090, 109540, 340-666; 1511, ATP5J, 7091, 109541, 161-487; 1511, ATP5J, 7092, 109542, 693-1019; 1511, ATP5J, 7093, 109543, 103-429; 1511, ATP5J, 7095, 109545, 79-429; 1512, ATP5L, 7097, 109547, 35-265; 1512, ATP5L, 7096, 109546, 513-824; 1513, ATP5L2, 7098, 109548, 328-630; 1514, ATP5S, 7101, 109551, 1-801; 1514, ATP5S, 7103, 109553, 462-506; 1514, ATP5S, 7099, 109549, 693-1076; 1514, ATP5S, 7100, 109550, 381-1028; 1514, ATP5S, 7102, 109552, 638-1048; 1515, AGTPBP1, 7104, 109554, 68-3904; 1515, AGTPBP1, 7105, 109555, 146-3826; 1515, AGTPBP1, 7106, 109556, 78-3638; 1515, AGTPBP1, 7107, 109557, 68-3784; 1516, AGBL1, 7108, 109558, 81-3176; 1516, AGBL1, 7109, 109559, 96-3296; 1517, AGBL2, 7110, 109560, 1-2715; 1517, AGBL2, 7111, 109561, 383-479; 1517, AGBL2, 7112, 109562, 1-380; 1517, AGBL2, 7113, 109563, 60-245; 1517, AGBL2, 7114, 109564, 108-552; 1517, AGBL2, 7116, 109566, 296-1288; 1517, AGBL2, 7117, 109567, 642-927; 1517, AGBL2, 7118, 109568, 255-2729; 1517, AGBL2, 7115, 109565, 287-2995; 1518, AGBL3, 7121, 109571, 235-2349; 1518, AGBL3, 7122, 109572, 218-497; 1518, AGBL3, 7119, 109569, 235-2100; 1518, AGBL3, 7120, 109570, 254-3016; 1519, AGBL4, 7123, 109573, 3-881; 1519, AGBL4, 7124, 109574, 105-758; 1519, AGBL4, 7125, 109575, 118-1080; 1519, AGBL4, 7127, 109577, 1-899; 1519, AGBL4, 7126, 109576, 118-1629; 1520, AGBL5, 7130, 109580, 202-673; 1520, AGBL5, 7131, 109581, 364-559; 1520, AGBL5, 7132, 109582, 414-489; 1520, AGBL5, 7133, 109583, 1-414; 1520, AGBL5, 7134, 109584, 384-581; 1520, AGBL5, 7128, 109578, 163-2316; 1520, AGBL5, 7129, 109579, 160-2820; 1520, AGBL5, 7135, 109585, 195-2645; 1521, ATP5J2-PTCD1, 7136, 109586, 24-2273; 1521, ATP5J2-PTCD1, 7137, 109587, 22-186; 1522, ATP5L, 7142, 109592, 12-541; 1522, ATP5SL, 7145, 109595, 68-604; 1522, ATP5SL, 7146, 109596, 259-562; 1522, ATP5SL, 7147, 109597, 29-97; 1522, ATP5SL, 7148, 109598, 10-528; 1522, ATP5SL, 7149, 109599, 1-451; 1522, ATP5SL, 7150, 109600, 7-372; 1522, ATP5SL, 7138, 109588, 7-780; 1522, ATP5SL, 7139, 109589, 31-606; 1522, ATP5SL, 7140, 109590, 12-488; 1522, ATP5SL, 7141, 109591, 31-822; 1522, ATP5SL, 7143, 109593, 10-567; 1522, ATP5SL, 7144, 109594, 38-730; 1523, ATP6V1G2-DDX39B, 7151, 109601, 24-323; 1523, ATP6V1G2-DDX39B, 7152, 109602, 50-349; 1524, ATAD1, 7155, 109605, 284-1369; 1524, ATAD1, 7156, 109606, 380-1465; 1524, ATAD1, 7153, 109603, 284-1369; 1524, ATAD1, 7154, 109604, 380-1465; 1525, ATAD2, 7158, 109608, 2385-4511; 1525, ATAD2, 7159, 109609, 78-272; 1525, ATAD2, 7160, 109610, 23-214; 1525, ATAD2, 7157, 109607, 109-4281; 1526, ATAD2B, 7162, 109612, 1-2204; 1526, ATAD2B, 7163, 109613, 363-554; 1526, ATAD2B, 7164, 109614, 296-1406; 1526, ATAD2B, 7161, 109611, 345-4721; 1527, ATAD3A, 7165, 109615, 1-1717; 1527, ATAD3A, 7168, 109618, 1-603; 1527, ATAD3A, 7166, 109616, 95-1999; 1527, ATAD3A, 7167, 109617, 119-1879; 1527, ATAD3A, 7169, 109619, 194-1717; 1528, ATAD3B, 7170, 109620, 117-2063; 1529, ATAD3C, 7172, 109622, 132-525; 1529, ATAD3C, 7171, 109621, 996-2231; 1530, ATAD5, 7174, 109624, 379-4051; 1530, ATAD5, 7173, 109623, 379-5913; 1531, ATPIF1, 7176, 109626, 43-270; 1531, ATPIF1, 7175, 109625, 52-372; 1531, ATPIF1, 7177, 109627, 76-291; 1531, ATPIF1, 7178, 109628, 31-213; 1532, ATP13A1, 7181, 109631, 1-554; 1532, ATP13A1, 7179, 109629, 1-3261; 1532, ATP13A1, 7180, 109630, 28-3642; 1533, ATP13A2, 7185, 109635, 1-774; 1533, ATP13A2, 7186, 109636, 1-562; 1533, ATP13A2, 7187, 109637, 1-570; 1533, ATP13A2, 7188, 109638, 1-1197; 1533, ATP13A2, 7189, 109639, 1-962; 1533, ATP13A2, 7190, 109640, 1-573; 1533, ATP13A2, 7191, 109641, 1-569; 1533, ATP13A2, 7192, 109642, 1037-1723; 1533, ATP13A2, 7182, 109632, 35-3577; 1533, ATP13A2, 7183, 109633, 178-3654; 1533, ATP13A2, 7184, 109634, 191-3718; 1534, ATP13A3, 7194, 109644, 1-487; 1534, ATP13A3, 7195, 109645, 183-490; 1534, ATP13A3, 7196, 109646, 403-542; 1534, ATP13A3, 7198, 109648, 1759-3864; 1534, ATP13A3, 7193, 109643, 403-4083; 1534, ATP13A3, 7197, 109647, 793-4473; 1535, ATP13A4, 7201, 109651, 189-3722; 1535, ATP13A4, 7203, 109653, 1-1730; 1535, ATP13A4, 7204, 109654, 1-367; 1535, ATP13A4, 7205, 109655, 71-322; 1535, ATP13A4, 7199, 109649, 1-1731; 1535, ATP13A4, 7200, 109650, 324-3914; 1535, ATP13A4, 7202, 109652, 245-883; 1536, ATP13A5, 7207, 109657, 96-569; 1536, ATP13A5, 7208, 109658, 119-463; 1536, ATP13A5, 7206, 109656, 119-3775; 1537, ATP8A1, 7211, 109661, 1-427; 1537, ATP8A1, 7212, 109662, 1-228; 1537, ATP8A1, 7213, 109663, 221-388; 1537, ATP8A1, 7214, 109664, 1-342; 1537, ATP8A1, 7215, 109665, 1-90; 1537, ATP8A1, 7209, 109659, 221-3670; 1537, ATP8A1, 7210, 109660, 233-3727; 1538, ATP8A2, 7216, 109666, 1-2985; 1538, ATP8A2, 7217, 109667, 393-2324; 1538, ATP8A2, 7218, 109668, 143-3709; 1539, ATP8B1, 7221, 109671, 127-312; 1539, ATP8B1, 7222, 109672, 214-489; 1539, ATP8B1, 7223, 109673, 495-527; 1539, ATP8B1, 7669, 1-3756; 1539, ATP8B1, 7220, 109670, 121-3876; 1540, ATP8B2, 7224, 109674, 188-1351; 1540, ATP8B2, 7225, 109675, 1-3672; 1541, ATP8B3, 7228, 109678, 1-116; 1541, ATP8B3, 7229, 109679, 240-500; 1541, ATP8B3, 7230, 109680, 181-1869; 1541, ATP8B3, 7231, 109681, 319-933; 1541, ATP8B3, 7226, 109676, 240-4142; 1541, ATP8B3, 7227, 109677, 223-4014; 1542, ATP2A1, 7235, 109685, 1-126; 1542, ATP2A1, 7236, 109686, 1-386; 1542, ATP2A1, 7237, 109687, 1-73; 1542, ATP2A1, 7238, 109688, 498-576; 1542, ATP2A1, 7239, 109689, 205-545; 1542, ATP2A1, 7232, 109682, 268-3273; 1542, ATP2A1, 7233, 109683, 185-3169; 1542, ATP2A1, 7234, 109684, 199-2808; 1543, ATP2A2, 7241, 109691, 494-646; 1543, ATP2A2, 7243, 109693, 393-527; 1543, ATP2A2, 7244, 109694, 1-2800; 1543, ATP2A2, 7245, 109695, 1-141; 1543, ATP2A2, 7240, 109690, 675-3668; 1543, ATP2A2, 7242, 109692, 110-3238; 1544, ATP2B1, 7248, 109698, 94-2985; 1544, ATP2B1, 7250, 109700, 304-607; 1544, ATP2B1, 7251, 109701, 1-486; 1544, ATP2B1, 7252, 109702, 1-902; 1544, ATP2B1, 7246, 109696, 182-3844; 1544, ATP2B1, 7247, 109697, 226-3756; 1544, ATP2B1, 7249, 109699, 458-4120; 1545, ATP2B2, 7257, 109707, 1-3300; 1545, ATP2B2, 7253, 109703, 71-3802; 1545, ATP2B2, 7254, 109704, 440-4171; 1545, ATP2B2, 7255, 109705, 513-4109; 1545, ATP2B2, 7256, 109706, 577-4173; 1545, ATP2B2, 7258, 109708, 415-3879; 1546, ATP2B3, 7259, 109709, 127-3789; 1546, ATP2B3, 7260, 109710, 327-3989; 1546, ATP2B3, 7261, 109711, 127-3648; 1546, ATP2B3, 7262, 109712, 327-3806; 1546, ATP2B3, 7263, 109713, 405-3869; 1547, ATP2B4, 7265, 109715, 1-389; 1547, ATP2B4, 7268, 109718, 1-353; 1547, ATP2B4, 7269, 109719, 1-308; 1547, ATP2B4, 7264, 109714, 398-3910; 1547, ATP2B4, 7266, 109716, 1124-4741; 1547, ATP2B4, 7267, 109717, 898-4410; 1548, ATP2C1, 7274, 109724, 295-540; 1548, ATP2C1, 7276, 109726, 1-648; 1548, ATP2C1, 7278, 109728, 169-561; 1548, ATP2C1, 7280, 109730, 227-3088; 1548, ATP2C1, 7282, 109732, 1-943; 1548, ATP2C1, 7283, 109733, 1-2711; 1548, ATP2C1, 7285, 109735, 253-559; 1548, ATP2C1, 7286, 109736, 1-153; 1548, ATP2C1, 7288, 109738, 196-556; 1548, ATP2C1, 7270, 109720, 323-2989; 1548, ATP2C1, 7271, 109721, 130-2979; 1548, ATP2C1, 7272, 109722, 236-2995; 1548, ATP2C1, 7273, 109723, 130-2949; 1548, ATP2C1, 7275, 109725, 221-3142; 1548, ATP2C1, 7277, 109727, 203-2974; 1548, ATP2C1, 7279, 109729, 203-2914; 1548, ATP2C1, 7281, 109731, 410-3169; 1548, ATP2C1, 7284, 109734, 227-3061; 1548, ATP2C1, 7287, 109737, 551-3310; 1548, ATP2C1, 7289, 109739, 504-3170; 1549, ATP2C2, 7291, 109741, 90-3017; 1549, ATP2C2, 7292, 109742, 1-160; 1549, ATP2C2, 7290, 109740, 90-2930; 1550, ATP2A3, 7299, 109749, 1-429; 1550, ATP2A3, 7300, 109750, 1-462; 1550, ATP2A3, 7293, 109743, 56-3187; 1550, ATP2A3, 7294, 109744, 174-3263; 1550, ATP2A3, 7295, 109745, 1-3159; 1550, ATP2A3, 7296, 109746, 129-3218; 1550, ATP2A3, 7297, 109747, 129-3128; 1550, ATP2A3, 7298, 109748, 125-3121; 1551, ATP8B4, 7302, 109752, 147-515; 1551, ATP8B4, 7303, 109753, 1-286; 1551, ATP8B4, 7305, 109755, 162-530; 1551, ATP8B4, 7306, 109756, 1-253; 1551, ATP8B4, 7307, 109757, 600-759; 1551, ATP8B4, 7308, 109758, 139-2292; 1551, ATP8B4, 7301, 109751, 143-3721; 1551, ATP8B4, 7304, 109754, 122-3700; 1552, ATP9A, 7309, 109759, 5-2740; 1552, ATP9A, 7310, 109760, 266-3409; 1553, ATP9B, 7313, 109763, 1-1416; 1553, ATP9B, 7314, 109764, 1-438; 1553, ATP9B, 7315, 109765, 127-427; 1553, ATP9B, 7316, 109766, 1-421; 1553, ATP9B, 7317, 109767, 1-56; 1553, ATP9B, 7318, 109768, 1-242; 1553, ATP9B, 7319, 109769, 4-570; 1553, ATP9B, 7320, 109770, 20-889; 1553, ATP9B, 7321, 109771, 1-112; 1553, ATP9B, 7322, 109772, 1-603; 1553, ATP9B, 7323, 109773, 6-583; 1553, ATP9B, 7324, 109774, 1-423; 1553, ATP9B, 7325, 109775, 10-128; 1553, ATP9B, 7326, 109776, 20-138; 1553, ATP9B, 7327, 109777, 6-124; 1553, ATP9B, 7328, 109778, 4-122; 1553, ATP9B, 7329, 109779, 15-133; 1553, ATP9B, 7330, 109780, 127-421; 1553, ATP9B, 7331, 109781, 18-136; 1553, ATP9B, 7311, 109761, 15-3425; 1553, ATP9B, 7312, 109762, 18-3461; 1554, ATP10A, 7334, 109784, 200-1984; 1554, ATP10A, 7335, 109785, 1-418; 1554, ATP10A, 7332, 109782, 113-4612; 1554, ATP10A, 7333, 109783, 263-730; 1554, ATP10A, 7336, 109786, 265-732; 1555, ATP10B, 7338, 109788, 1-1671; 1555, ATP10B, 7337, 109787, 848-5233; 1556, ATP10D, 7340, 109790, 259-1866; 1556, ATP10D, 7341, 109791, 1-673; 1556, ATP10D, 7339, 109789, 270-4550; 1557, ATP11A, 7342, 109792, 89-3664; 1557, ATP11A, 7344, 109794, 1-2807; 1557, ATP11A, 7345, 109795, 1-226; 1557, ATP11A, 7346, 109796, 1-552; 1557, ATP11A, 7348, 109798, 1-1058; 1557, ATP11A, 7349, 109799, 1-189; 1557, ATP11A, 7343, 109793, 89-3493; 1557, ATP11A, 7347, 109797, 89-3493; 1558, ATP11B, 7351, 109801, 1-716; 1558, ATP11B, 7352, 109802, 1-327; 1558, ATP11B, 7353, 109803, 1-2912; 1558, ATP11B, 7354, 109804, 258-845; 1558, ATP11B, 7355, 109805, 1-358; 1558, ATP11B, 7356, 109806, 1-442; 1558, ATP11B, 7350, 109800, 261-3794; 1559, ATP11C, 7359, 109809, 1029-4370; 1559, ATP11C, 7360, 109810, 1-519; 1559, ATP11C, 7361, 109811, 1-606; 1559, ATP11C, 7362, 109812, 1-496; 1559, ATP11C, 7357, 109807, 100-3498; 1559, ATP11C, 7358, 109808, 100-3459; 1560, ATP7A, 7363, 109813, 202-4470; 1560, ATP7A, 7364, 109814, 131-955; 1560, ATP7A, 7365, 109815, 156-4658; 1561, ATP7B, 7369, 109819, 75-3182; 1561, ATP7B, 7370, 109820, 75-4277; 1561, ATP7B, 7371, 109821, 158-4321; 1561, ATP7B, 7372, 109822, 73-2757; 1561, ATP7B, 7373, 109823, 75-4328; 1561, ATP7B, 7374, 109824, 1-128; 1561, ATP7B, 7366, 109816, 158-4555; 1561, ATP7B, 7367, 109817, 3-3779; 1561, ATP7B, 7368, 109818, 158-4222; 1562, ATP6V0E2, 7377, 109827, 952-1593; 1562, ATP6V0E2, 7379, 109829, 91-330; 1562, ATP6V0E2, 7384, 109834, 952-1593; 1562, ATP6V0E2, 7375, 109825, 24-269; 1562, ATP6V0E2, 7376, 109826, 952-1344; 1562, ATP6V0E2, 7378, 109828, 91-654; 1562, ATP6V0E2, 7380, 109830, 80-325; 1562, ATP6V0E2, 7381, 109831, 74-319; 1562, ATP6V0E2, 7382, 109832, 80-574; 1562, ATP6V0E2, 7383, 109833, 952-1344; 1563, ATP6V1G1, 7385, 109835, 94-450; 1564, ATP6V1G1, 7389, 109839, 1-477; 1564, ATP6V1G2, 7386, 109836, 286-642; 1564, ATP6V1G2, 7387, 109837, 79-315; 1564, ATP6V1G2, 7388, 109838, 49-405; 1564, ATP6V1G2, 7390, 109840, 49-405; 1564, ATP6V1G2, 7391, 109841, 79-315; 1564, ATP6V1G2, 7392, 109842, 79-315; 1564, ATP6V1G2, 7393, 109843, 49-405; 1564, ATP6V1G2, 7394, 109844, 49-405; 1564, ATP6V1G2, 7395, 109845, 79-315; 1564, ATP6V1G2, 7396, 109846, 79-315; 1564, ATP6V1G2, 7397, 109847, 49-405; 1564, ATP6V1G2, 7398, 109848, 79-315; 1564, ATP6V1G2, 7399, 109849, 49-405; 1564, ATP6V1G2, 7400, 109850, 79-315; 1564, ATP6V1G2, 7401, 109851, 259-492; 1565, ATP6V1G3, 7402, 109852, 107-463; 1565, ATP6V1G3, 7403, 109853, 107-286; 1565, ATP6V1G3, 7404, 109854, 107-463; 1565, ATP6V1G3, 7405, 109855, 86-442; 1565, ATP6V1G3, 7406, 109856, 25-399; 1565, ATP6V1G3, 7407, 109857, 25-399; 1565, ATP6V1G3, 7408, 109858, 86-442; 1565, ATP6V1G3, 7409, 109859, 107-286; 1566, ATP6V1F, 7410, 109860, 80-439; 1566, ATP6V1F, 7411, 109861, 2-445; 1567, ATP6V0C, 7413, 109863, 129-320; 1567, ATP6V0C, 7414, 109864, 270-608; 1567, ATP6V0C, 7415, 109865, 155-493; 1567, ATP6V0C, 7412, 109862, 235-702; 1568, ATP6V0B, 7417, 109867, 1-265; 1568, ATP6V0B, 7419, 109869, 91-849; 1568, ATP6V0B, 7420, 109870, 154-411; 1568, ATP6V0B, 7422, 109872, 98-883; 1568, ATP6V0B, 7423, 109873, 82-222; 1568, ATP6V0B, 7416, 109866, 186-662; 1568, ATP6V0B, 7418, 109868, 394-1011; 1568, ATP6V0B, 7421, 109871, 61-537; 1569, ATP6V1E1, 7427, 109877, 190-800; 1569, ATP6V1E1, 7424, 109874, 184-864; 1569, ATP6V1E1, 7425, 109875, 113-703; 1569, ATP6V1E1, 7426, 109876, 115-729; 1570, ATP6V1E2, 7428, 109878, 1115-1795; 1570, ATP6V1E2, 7429, 109879, 715-1395; 1571, ATP6V1D, 7431, 109881, 1-135; 1571, ATP6V1D, 7432, 109882, 137-715; 1571, ATP6V1D, 7433, 109883, 106-552; 1571, ATP6V1D, 7434, 109884, 365-582; 1571, ATP6V1D, 7436, 109886, 97-357; 1571, ATP6V1D, 7437, 109887, 1-462; 1571, ATP6V1D, 7438, 109888, 1-360; 1571, ATP6V1D, 7439, 109889, 90-629; 1571, ATP6V1D, 7440, 109890, 450-627; 1571, ATP6V1D, 7430, 109880, 552-1295; 1571, ATP6V1D, 7435, 109885, 94-837; 1572, ATP6V0D1, 7442, 109892, 1-176; 1572, ATP6V0D1, 7443, 109893, 32-1210; 1572, ATP6V0D1, 7444, 109894, 1-215; 1572, ATP6V0D1, 7445, 109895, 83-424; 1572, ATP6V0D1, 7446, 109896, 1-680; 1572, ATP6V0D1, 7447, 109897, 1-348; 1572, ATP6V0D1, 7448, 109898, 1-121; 1572, ATP6V0D1, 7449, 109899, 96-269; 1572, ATP6V0D1, 7450, 109900, 63-206; 1572, ATP6V0D1, 7451, 109901, 1-698; 1572, ATP6V0D1, 7452, 109902, 256-1080; 1572, ATP6V0D1, 7441, 109891, 152-1207; 1573, ATP6V0D2, 7454, 109904, 375-504; 1573, ATP6V0D2, 7455, 109905, 341-448; 1573, ATP6V0D2, 7453, 109903, 143-1195; 1574, ATP6V1C1, 7457, 109907, 146-1069; 1574, ATP6V1C1, 7458, 109908, 232-1155; 1574, ATP6V1C1, 7456, 109906, 160-1308; 1574, ATP6V1C1, 7459, 109909, 164-1312; 1575, ATP6V1C2, 7462, 109912, 79-1392; 1575, ATP6V1C2, 7460, 109910, 110-1393; 1575, ATP6V1C2, 7461, 109911, 110-1255; 1576, ATP6V1H, 7466, 109916, 432-735; 1576, ATP6V1H, 7467, 109917, 296-442; 1576, ATP6V1H, 7468, 109918, 1-261; 1576, ATP6V1H, 7469, 109919, 248-358; 1576, ATP6V1H, 7470, 109920, 98-403; 1576, ATP6V1H, 7471, 109921, 345-1676; 1576, ATP6V1H, 7472, 109922, 1-144; 1576, ATP6V1H, 7463, 109913, 561-1958; 1576, ATP6V1H, 7464, 109914, 265-1716; 1576, ATP6V1H, 7465, 109915, 208-1659; 1577, ATP6V1B1, 7474, 109924, 323-546; 1577, ATP6V1B1, 7475, 109925, 35-1525; 1577, ATP6V1B1, 7476, 109926, 54-800; 1577, ATP6V1B1, 7477, 109927, 118-472; 1577, ATP6V1B1, 7478, 109928, 116-863; 1577, ATP6V1B1, 7473, 109923, 74-1615; 1578, ATP6V1B2, 7480, 109930, 1-169; 1578, ATP6V1B2, 7481, 109931, 4-204; 1578, ATP6V1B2, 7482, 109932, 1-598; 1578, ATP6V1B2, 7483, 109933, 1-148; 1578, ATP6V1B2, 7479, 109929, 41-1576; 1579, ATP6V1A, 7485, 109935, 157-710; 1579, ATP6V1A, 7486, 109936, 92-754; 1579, ATP6V1A, 7487, 109937, 91-240; 1579, ATP6V1A, 7484, 109934, 109-1962; 1580, ATP6V0E1, 7488, 109938, 46-243; 1580, ATP6V0E1, 7491, 109941, 81-257; 1580, ATP6V0E1, 7489, 109939, 31-276; 1580, ATP6V0E1, 7490, 109940, 105-350; 1581, ATP6AP1, 7493, 109943, 31-720; 1581, ATP6AP1, 7494, 109944, 1-400; 1581, ATP6AP1, 7495, 109945, 49-867; 1581, ATP6AP1, 7496, 109946, 7-411; 1581, ATP6AP1, 7497, 109947, 1-387; 1581, ATP6AP1, 7498, 109948, 5-409; 1581, ATP6AP1, 7499, 109949, 1354-2199; 1581, ATP6AP1, 7492, 109942, 62-1474; 1582, ATP6AP1L, 7500, 109950, 1326-2000; 1582, ATP6AP1L, 7501, 109951, 56-730; 1583, ATP6AP2, 7503, 109953, 1-609; 1583, ATP6AP2, 7504, 109954, 1-728; 1583, ATP6AP2, 7505, 109955, 1-777; 1583, ATP6AP2, 7502, 109952, 159-1211; 1584, ATP6V0A1, 7509, 109959, 134-2500; 1584, ATP6V0A1, 7510, 109960, 138-1589; 1584, ATP6V0A1, 7511, 109961, 301-580; 1584, ATP6V0A1, 7512, 109962, 163-554; 1584, ATP6V0A1, 7513, 109963, 1-585; 1584, ATP6V0A1, 7514, 109964, 1-573; 1584, ATP6V0A1, 7515, 109965, 124-2508; 1584, ATP6V0A1, 7516, 109966, 71-664; 1584, ATP6V0A1, 7517, 109967, 134-340; 1584, ATP6V0A1, 7518, 109968, 1-388; 1584, ATP6V0A1, 7519, 109969, 1-567; 1584, ATP6V0A1, 7506, 109956, 132-2648; 1584, ATP6V0A1, 7507, 109957, 124-2637; 1584, ATP6V0A1, 7508, 109958, 168-2663; 1585, ATP6V0A2, 7521, 109971, 409-825; 1585, ATP6V0A2, 7522, 109972, 1541-2525; 1585, ATP6V0A2, 7523, 109973, 1340-1733; 1585, ATP6V0A2, 7524, 109974, 211-1329; 1585, ATP6V0A2, 7520, 109970, 249-2819; 1586, ATP6V0A4, 7525, 109975, 89-2611; 1586, ATP6V0A4, 7526, 109976, 284-2806; 1586, ATP6V0A4, 7527, 109977, 239-2761; 1587, ATP4A, 7529, 109979, 1-103; 1587, ATP4A, 7528, 109978, 30-3137; 1588, ATP4B, 7530, 109980, 43-918; 1589, ATP12A, 7531, 109981, 334-3471; 1589, ATP12A, 7532, 109982, 168-3287; 1590, ATP1A1, 7534, 109984, 265-698; 1590, ATP1A1, 7536, 109986, 1-474; 1590, ATP1A1, 7537, 109987, 336-654; 1590, ATP1A1, 7533, 109983, 253-3324; 1590, ATP1A1, 7535, 109985, 266-3244; 1590, ATP1A1, 7538, 109988, 364-3435; 1591, ATP1A2, 7540, 109990, 86-3115; 1591, ATP1A2, 7541, 109991, 1-2144; 1591, ATP1A2, 7539, 109989, 90-3152; 1592, ATP1A3, 7543, 109993, 139-3818; 1592, ATP1A3, 7546, 109996, 136-889; 1592, ATP1A3, 7547, 109997, 154-3105; 1592, ATP1A3, 7542, 109992, 201-3242; 1592, ATP1A3, 7544, 109994, 37-3111; 1592, ATP1A3, 7545, 109995, 185-3265; 1593, ATP1A4, 7550, 110000, 456-2009; 1593, ATP1A4, 7548, 109998, 472-3561; 1593, ATP1A4, 7549, 109999, 111-608; 1594, ATP1B1, 7553, 110003, 329-718; 1594, ATP1B1, 7551, 110001, 508-1419; 1594, ATP1B1, 7552, 110002, 530-1441; 1595, ATP1B2, 7555, 110005, 81-580; 1595, ATP1B2, 7556, 110006, 1-518; 1595, ATP1B2, 7554, 110004, 408-1280; 1596, ATP1B3, 7558, 110008, 334-734; 1596, ATP1B3, 7559, 110009, 1-84; 1596, ATP1B3, 7560, 110010, 187-321; 1596, ATP1B3, 7561, 110011, 87-356; 1596, ATP1B3, 7562, 110012, 1-131; 1596, ATP1B3, 7563, 110013, 60-418; 1596, ATP1B3, 7557, 110007, 189-1028; 1597, ATP1B4, 7566, 110016, 85-1029; 1597, ATP1B4, 7564, 110014, 58-1131; 1597, ATP1B4, 7565, 110015, 58-1119; 1598, ABCA1, 7567, 110017, 320-691; 1598, ABCA1, 7569, 110019, 298-1389; 1598, ABCA1, 7568, 110018, 396-7181; 1599, ABCA10, 7571, 110021, 85-4065; 1599, ABCA10, 7572, 110022, 1-413; 1599, ABCA10, 7575, 110025, 85-1107; 1599, ABCA10, 7576, 110026, 1-229; 1599, ABCA10, 7577, 110027, 1-138; 1599, ABCA10, 7570, 110020, 911-5542; 1599, ABCA10, 7573, 110023, 388-1746; 1599, ABCA10, 7574, 110024, 410-688; 1600, ABCA12, 7580, 110030, 197-469; 1600, ABCA12, 7578, 110028, 221-8008; 1600, ABCA12, 7579, 110029, 160-6993; 1601, ABCA13, 7581, 110031, 1-463; 1601, ABCA13, 7582, 110032, 1-2496; 1601, ABCA13, 7583, 110033, 1-3577; 1601, ABCA13, 7585, 110035, 25-15201; 1601, ABCA13, 7586, 110036, 1-7099; 1601, ABCA13, 7584, 110034, 27-980; 1602, ABCA2, 7587, 110037, 149-7459; 1602, ABCA2, 7590, 110040, 44-3013; 1602, ABCA2, 7591, 110041, 1-3201; 1602, ABCA2, 7592, 110042, 1-4325; 1602, ABCA2, 7593, 110043, 1-134; 1602, ABCA2, 7594, 110044, 1-588; 1602, ABCA2, 7595, 110045, 51-7451; 1602, ABCA2, 7596, 110046, 7-371; 1602, ABCA2, 7588, 110038, 51-7361; 1602, ABCA2, 7589, 110039, 149-7456; 1603, ABCA3, 7598, 110048, 713-5653; 1603, ABCA3, 7597, 110047, 702-5816; 1603, ABCA3, 7599, 110049, 409-1038; 1604, ABCA4, 7601, 110051, 141-3338; 1604, ABCA4, 7600, 110050, 88-6909; 1605, ABCA5, 7603, 110053, 228-1948; 1605, ABCA5, 7604, 110054, 1-192; 1605, ABCA5, 7605, 110055, 235-616; 1605, ABCA5, 7606, 110056, 1-577; 1605, ABCA5, 7607, 110057, 1-1296; 1605, ABCA5, 7608, 110058, 266-3017; 1605, ABCA5, 7609, 110059, 946-1695; 1605, ABCA5, 7610, 110060, 447-560; 1605, ABCA5, 7611, 110061, 55-804; 1605, ABCA5, 7602, 110052, 66-4994; 1605, ABCA5, 7612, 110062, 1011-5939; 1606, ABCA6, 7613, 110063, 176-5029; 1606, ABCA6, 7614, 110064, 190-747; 1607, ABCA7, 7617, 110067, 85-576; 1607, ABCA7, 7618, 110068, 1-1774; 1607, ABCA7, 7619, 110069, 161-569; 1607, ABCA7, 7620, 110070, 1-187; 1607, ABCA7, 7622, 110072, 234-343; 1607, ABCA7, 7623, 110073, 1-289; 1607, ABCA7, 7624, 110074, 1-843; 1607, ABCA7, 7615, 110065, 232-6672; 1607, ABCA7, 7616, 110066, 117-6557; 1607, ABCA7, 7621, 110071, 38-6064; 1608, ABCA8, 7626, 110076, 180-5030; 1608, ABCA8, 7627, 110077, 164-509; 1608, ABCA8, 7628, 110078, 1-2106; 1608, ABCA8, 7630, 110080, 1211-1681; 1608, ABCA8, 7625, 110075, 139-4884; 1608, ABCA8, 7629, 110079, 190-5055; 1609, ABCA9, 7632, 110082, 73-4833; 1609, ABCA9, 7633, 110083, 314-582; 1609, ABCA9, 7631, 110081, 213-5087; 1609, ABCA9, 7634, 110084, 55-858; 1610, ABCB1, 7636, 110086, 318-461; 1610, ABCB1, 7635, 110085, 419-4261; 1610, ABCB1, 7637, 110087, 494-4144; 1610, ABCB1, 7638, 110088, 326-4168; 1611, ABCB10, 7639, 110089, 44-2260; 1612, ABCB11, 7641, 110091, 1-219; 1612, ABCB11, 7642, 110092, 1-1356; 1612, ABCB11, 7640, 110090, 126-4091; 1613, ABCB4, 7647, 110097, 1825-2007; 1613, ABCB4, 7648, 110098, 1-298; 1613, ABCB4, 7643, 110093, 113-3973; 1613, ABCB4, 7644, 110094, 77-3775; 1613, ABCB4, 7645, 110095, 33-3872; 1613, ABCB4, 7646, 110096, 1-3699; 1614, ABCB5, 7652, 110102, 1-945; 1614, ABCB5, 7649, 110099, 468-2906; 1614, ABCB5, 7650, 110100, 547-927; 1614, ABCB5, 7651, 110101, 653-4426; 1614, ABCB5, 7653, 110103, 547-942; 1615, ABCB6, 7655, 110105, 1-2072; 1615, ABCB6, 7656, 110106, 1-443; 1615, ABCB6, 7657, 110107, 1-207; 1615, ABCB6, 7658, 110108, 1-358; 1615, ABCB6, 7659, 110109, 1-122; 1615, ABCB6, 7654, 110104, 318-2846; 1616, ABCB7, 7663, 110113, 36-550; 1616, ABCB7, 7664, 110114, 15-580; 1616, ABCB7, 7665, 110115, 11-2116; 1616, ABCB7, 7666, 110116, 69-2210; 1616, ABCB7, 7660, 110110, 26-2287; 1616, ABCB7, 7661, 110111, 8-2146; 1616, ABCB7, 7662, 110112, 9-2267; 1617, ABCB8, 7669, 110119, 94-537; 1617, ABCB8, 7671, 110121, 41-187; 1617, ABCB8, 7672, 110122, 79-255; 1617, ABCB8, 7673, 110123, 91-210; 1617, ABCB8, 7674, 110124, 50-1345; 1617, ABCB8, 7675, 110125, 53-1282; 1617, ABCB8, 7676, 110126, 1-421; 1617, ABCB8, 7677, 110127, 67-213; 1617, ABCB8, 7678, 110128, 67-186; 1617, ABCB8, 7667, 110117, 67-2274; 1617, ABCB8, 7668, 110118, 94-2250; 1617, ABCB8, 7670, 110120, 55-2136; 1617, ABCB8, 7679, 110129, 46-1938; 1618, ABCB9, 7683, 110133, 579-2888; 1618, ABCB9, 7684, 110134, 1-438; 1618, ABCB9, 7685, 110135, 204-1022; 1618, ABCB9, 7686, 110136, 1672-2108; 1618, ABCB9, 7687, 110137, 325-1104; 1618, ABCB9, 7689, 110139, 519-1066; 1618, ABCB9, 7691, 110141, 85-917; 1618, ABCB9, 7692, 110142, 1073-1419; 1618, ABCB9, 7693, 110143, 372-568; 1618, ABCB9, 7694, 110144, 503-1168; 1618, ABCB9, 7695, 110145, 82-549; 1618, ABCB9, 7680, 110130, 311-2482; 1618, ABCB9, 7681, 110131, 298-2598; 1618, ABCB9, 7682, 110132, 579-2879; 1618, ABCB9, 7688, 110138, 2840-5140; 1618, ABCB9, 7690, 110140, 302-2413; 1618,

ABCB9, 7696, 110146, 262-2313; 1618, ABCB9, 7697, 110147, 262-2307; 1619, ABCC1, 7698, 110148, 1154-4801; 1619, ABCC1, 7700, 110150, 1-69; 1619, ABCC1, 7701, 110151, 1-4321; 1619, ABCC1, 7702, 110152, 1166-4813; 1619, ABCC1, 7703, 110153, 1-4321; 1619, ABCC1, 7699, 110149, 176-4771; 1619, ABCC1, 7704, 110154, 141-4736; 1620, ABCC10, 7706, 110156, 103-933; 1620, ABCC10, 7708, 110158, 1-390; 1620, ABCC10, 7705, 110155, 360-4754; 1620, ABCC10, 7707, 110157, 216-4694; 1621, ABCC11, 7713, 110163, 106-582; 1621, ABCC11, 7709, 110159, 65-4099; 1621, ABCC11, 7710, 110160, 100-4248; 1621, ABCC11, 7711, 110161, 351-4499; 1621, ABCC11, 7712, 110162, 65-4213; 1622, ABCC12, 7719, 110169, 204-1061; 1622, ABCC12, 7720, 110170, 227-544; 1622, ABCC12, 7714, 110164, 347-4426; 1622, ABCC12, 7715, 110165, 7-3036; 1622, ABCC12, 7716, 110166, 227-3019; 1622, ABCC12, 7717, 110167, 7-2814; 1622, ABCC12, 7718, 110168, 498-2399; 1622, ABCC12, 7721, 110171, 7-3036; 1623, ABCC2, 7722, 110172, 83-964; 1623, ABCC2, 7723, 110173, 114-4751; 1624, ABCC3, 7726, 110176, 1-898; 1624, ABCC3, 7727, 110177, 1-171; 1624, ABCC3, 7728, 110178, 50-280; 1624, ABCC3, 7729, 110179, 1-131; 1624, ABCC3, 7730, 110180, 124-255; 1624, ABCC3, 7724, 110174, 81-4664; 1624, ABCC3, 7725, 110175, 81-1799; 1624, ABCC3, 7731, 110181, 37-1569; 1624, ABCC3, 7732, 110182, 37-3753; 1625, ABCC4, 7733, 110183, 116-4093; 1625, ABCC4, 7734, 110184, 120-2474; 1625, ABCC4, 7735, 110185, 133-2712; 1626, ABCC5, 7740, 110190, 166-327; 1626, ABCC5, 7741, 110191, 150-591; 1626, ABCC5, 7742, 110192, 63-1484; 1626, ABCC5, 7743, 110193, 1-212; 1626, ABCC5, 7744, 110194, 90-785; 1626, ABCC5, 7745, 110195, 143-304; 1626, ABCC5, 7736, 110186, 166-4350; 1626, ABCC5, 7737, 110187, 242-4555; 1626, ABCC5, 7738, 110188, 116-742; 1626, ABCC5, 7739, 110189, 116-793; 1626, ABCC5, 7746, 110196, 116-754; 1627, ABCC6, 7749, 110199, 89-337; 1627, ABCC6, 7751, 110201, 31-4542; 1627, ABCC6, 7754, 110204, 1-2616; 1627, ABCC6, 7755, 110205, 89-337; 1627, ABCC6, 7747, 110197, 31-4542; 1627, ABCC6, 7748, 110198, 1-2616; 1627, ABCC6, 7750, 110200, 34-333; 1627, ABCC6, 7752, 110202, 34-333; 1627, ABCC6, 7753, 110203, 38-2653; 1628, ABCC8, 7758, 110208, 44-3037; 1628, ABCC8, 7759, 110209, 1-611; 1628, ABCC8, 7760, 110210, 1-161; 1628, ABCC8, 7761, 110211, 1-187; 1628, ABCC8, 7762, 110212, 1-101; 1628, ABCC8, 7756, 110206, 70-4818; 1628, ABCC8, 7757, 110207, 70-4815; 1628, ABCC8, 7763, 110213, 3-155; 1629, ABCC9, 7766, 110216, 400-849; 1629, ABCC9, 7767, 110217, 1-3531; 1629, ABCC9, 7768, 110218, 171-683; 1629, ABCC9, 7769, 110219, 1-450; 1629, ABCC9, 7764, 110214, 1-4650; 1629, ABCC9, 7765, 110215, 1-4650; 1630, ABCD1, 7771, 110221, 6-689; 1630, ABCD1, 7770, 110220, 400-2637; 1631, ABCD2, 7772, 110222, 137-2359; 1632, ABCD3, 7773, 110223, 1-711; 1632, ABCD3, 7774, 110224, 25-2004; 1633, ABCD4, 7776, 110226, 1-520; 1633, ABCD4, 7777, 110227, 48-218; 1633, ABCD4, 7778, 110228, 81-200; 1633, ABCD4, 7779, 110229, 1-554; 1633, ABCD4, 7780, 110230, 144-314; 1633, ABCD4, 7781, 110231, 26-196; 1633, ABCD4, 7782, 110232, 5-124; 1633, ABCD4, 7783, 110233, 34-204; 1633, ABCD4, 7784, 110234, 1-554; 1633, ABCD4, 7785, 110235, 1-476; 1633, ABCD4, 7786, 110236, 7-303; 1633, ABCD4, 7787, 110237, 48-167; 1633, ABCD4, 7788, 110238, 1-617; 1633, ABCD4, 7789, 110239, 58-177; 1633, ABCD4, 7790, 110240, 76-687; 1633, ABCD4, 7791, 110241, 1-283; 1633, ABCD4, 7775, 110225, 145-1965; 1634, ABCE1, 7793, 110243, 157-786; 1634, ABCE1, 7794, 110244, 137-1402; 1634, ABCE1, 7795, 110245, 1-444; 1634, ABCE1, 7792, 110242, 516-2315; 1635, ABCF1, 7800, 110250, 37-753; 1635, ABCF1, 7803, 110253, 37-753; 1635, ABCF1, 7806, 110256, 37-753; 1635, ABCF1, 7807, 110257, 56-1074; 1635, ABCF1, 7808, 110258, 37-753; 1635, ABCF1, 7809, 110259, 37-753; 1635, ABCF1, 7810, 110260, 37-753; 1635, ABCF1, 7811, 110261, 56-1074; 1635, ABCF1, 7814, 110264, 56-1074; 1635, ABCF1, 7815, 110265, 56-1074; 1635, ABCF1, 7816, 110266, 56-1074; 1635, ABCF1, 7817, 110267, 56-1074; 1635, ABCF1, 7822, 110272, 56-1074; 1635, ABCF1, 7823, 110273, 291-606; 1635, ABCF1, 7824, 110274, 1-1789; 1635, ABCF1, 7796, 110246, 113-2650; 1635, ABCF1, 7797, 110247, 96-2519; 1635, ABCF1, 7798, 110248, 96-2519; 1635, ABCF1, 7799, 110249, 113-2650; 1635, ABCF1, 7801, 110251, 113-2650; 1635, ABCF1, 7802, 110252, 96-2519; 1635, ABCF1, 7804, 110254, 96-2519; 1635, ABCF1, 7805, 110255, 96-2519; 1635, ABCF1, 7812, 110262, 96-2519; 1635, ABCF1, 7813, 110263, 96-2519; 1635, ABCF1, 7818, 110268, 113-2650; 1635, ABCF1, 7819, 110269, 113-2650; 1635, ABCF1, 7820, 110270, 113-2650; 1635, ABCF1, 7821, 110271, 113-2650; 1636, ABCF2, 7827, 110277, 222-941; 1636, ABCF2, 7828, 110278, 169-1031; 1636, ABCF2, 7825, 110275, 47-1951; 1636, ABCF2, 7826, 110276, 111-1982; 1637, ABCF3, 7831, 110281, 114-425; 1637, ABCF3, 7829, 110279, 35-2146; 1637, ABCF3, 7830, 110280, 186-2315; 1638, ABCG1, 7835, 110285, 149-2623; 1638, ABCG1, 7838, 110288, 147-918; 1638, ABCG1, 7832, 110282, 80-2071; 1638, ABCG1, 7833, 110283, 152-2185; 1638, ABCG1, 7834, 110284, 146-2182; 1638, ABCG1, 7836, 110286, 146-2146; 1638, ABCG1, 7837, 110287, 261-2267; 1639, ABCG2, 7840, 110290, 1-451; 1639, ABCG2, 7842, 110292, 1-391; 1639, ABCG2, 7839, 110289, 547-2514; 1639, ABCG2, 7841, 110291, 349-2184; 1640, ABCG4, 7843, 110293, 41-496; 1640, ABCG4, 7844, 110294, 189-2129; 1640, ABCG4, 7845, 110295, 365-2305; 1640, ABCG4, 7846, 110296, 71-2011; 1641, ABCG5, 7848, 110298, 898-2340; 1641, ABCG5, 7849, 110299, 1011-1409; 1641, ABCG5, 7850, 110300, 896-1252; 1641, ABCG5, 7847, 110297, 141-2096; 1642, ABCG8, 7851, 110301, 91-2112; 1643, ATRIP, 7855, 110305, 123-518; 1643, ATRIP, 7856, 110306, 123-711; 1643, ATRIP, 7852, 110302, 114-2408; 1643, ATRIP, 7853, 110303, 114-2489; 1643, ATRIP, 7854, 110304, 463-2559; 1644, N/A, 7859, 110309, 96-236; 1644, N/A, 7860, 110310, 1-1395; 1644, N/A, 7858, 110308, 308-2302; 1644, N/A, 7857, 110307, 888-1832; 1645, ATR, 7862, 110312, 1-120; 1645, ATR, 7863, 110313, 1-243; 1645, ATR, 7864, 110314, 1-1372; 1645, ATR, 7865, 110315, 1-929; 1645, ATR, 7866, 110316, 21-323; 1645, ATR, 7861, 110311, 123-8057; 1646, ATN1, 7867, 110317, 238-3810; 1646, ATN1, 7868, 110318, 235-3807; 1647, ATRN, 7869, 110319, 69-4358; 1647, ATRN, 7870, 110320, 1-3819; 1648, ATRNL1, 7872, 110322, 175-932; 1648, ATRNL1, 7873, 110323, 1-648; 1648, ATRNL1, 7874, 110324, 289-1485; 1648, ATRNL1, 7876, 110326, 181-291; 1648, ATRNL1, 7871, 110321, 127-4266; 1648, ATRNL1, 7875, 110325, 387-1790; 1649, ACKR1, 7879, 110329, 86-550; 1649, ACKR1, 7877, 110327, 176-1192; 1649, ACKR1, 7878, 110328, 680-1690; 1649, ACKR1, 7880, 110330, 844-1854; 1650, ACKR2, 7883, 110333, 180-878; 1650, ACKR2, 7884, 110334, 346-719; 1650, ACKR2, 7885, 110335, 287-797; 1650, ACKR2, 7886, 110336, 140-567; 1650, ACKR2, 7881, 110331, 99-1253; 1650, ACKR2, 7882, 110332, 176-1330; 1651, ACKR3, 7888, 110338, 82-713; 1651, ACKR3, 7887, 110337, 311-1399; 1652, ACKR4, 7890, 110340, 1-63; 1652, ACKR4, 7889, 110339, 97-1149; 1653, AUH, 7891, 110341, 25-957; 1653, AUH, 7892, 110342, 25-1044; 1654, AURKA, 7896, 110346, 54-1097; 1654, AURKA, 7901, 110351, 314-879; 1654, AURKA, 7902, 110352, 178-991; 1654, AURKA, 7903, 110353, 346-584; 1654, AURKA, 7904, 110354, 305-744; 1654, AURKA, 7905, 110355, 492-810; 1654, AURKA, 7893, 110343, 269-1480; 1654, AURKA, 7894, 110344, 244-1455; 1654, AURKA, 7895, 110345, 133-1344; 1654, AURKA, 7897, 110347, 166-1377; 1654, AURKA, 7898, 110348, 190-1401; 1654, AURKA, 7899, 110349, 258-1469; 1654, AURKA, 7900, 110350, 135-1346; 1655, AUNIP, 7906, 110356, 56-1129; 1655, AUNIP, 7907, 110357, 102-1217; 1656, AURKAIP1, 7908, 110358, 130-729; 1656, AURKAIP1, 7909, 110359, 377-976; 1656, AURKAIP1, 7910, 110360, 402-1001; 1656, AURKAIP1, 7911, 110361, 212-811; 1657, AURKB, 7914, 110364, 24-395; 1657, AURKB, 7915, 110365, 189-397; 1657, AURKB, 7917, 110367, 1-727; 1657, AURKB, 7918, 110368, 57-742; 1657, AURKB, 7919, 110369, 176-867; 1657, AURKB, 7921, 110371, 256-771; 1657, AURKB, 7912, 110362, 79-1116; 1657, AURKB, 7913, 110363, 128-1039; 1657, AURKB, 7916, 110366, 1-939; 1657, AURKB, 7920, 110370, 95-1129; 1658, AURKC, 7923, 110373, 364-1188; 1658, AURKC, 7925, 110375, 110-250; 1658, AURKC, 7926, 110376, 1-414; 1658, AURKC, 7927, 110377, 1-921; 1658, AURKC, 7928, 110378, 59-400; 1658, AURKC, 7922, 110372, 187-1116; 1658, AURKC, 7924, 110374, 106-978; 1658, AURKC, 7929, 110379, 168-995; 1659, AUTS2, 7933, 110383, 1-550; 1659, AUTS2, 7934, 110384, 1-542; 1659, AUTS2, 7935, 110385, 1-595; 1659, AUTS2, 7936, 110386, 1-302; 1659, AUTS2, 7937, 110387, 1-188; 1659, AUTS2, 7938, 110388, 57-3092; 1659, AUTS2, 7939, 110389, 57-3020; 1659, AUTS2, 7930, 110380, 322-4101; 1659, AUTS2, 7931, 110381, 736-4443; 1659, AUTS2, 7932, 110382, 44-844; 1660, AMFR, 7941, 110391, 72-567; 1660, AMFR, 7942, 110392, 1-866; 1660, AMFR, 7943, 110393, 116-803; 1660, AMFR, 7944, 110394, 1-900; 1660, AMFR, 7940, 110390, 212-2143; 1661, AIRE, 7945, 110395, 128-1765; 1662, ATG10, 7949, 110399, 441-549; 1662, ATG10, 7950, 110400, 59-574; 1662, ATG10, 7952, 110402, 14-568; 1662, ATG10, 7946, 110396, 295-957; 1662, ATG10, 7947, 110397, 295-672; 1662, ATG10, 7948, 110398, 404-1066; 1662, ATG10, 7951, 110401, 448-825; 1663, ATG101, 7954, 110404, 236-658; 1663, ATG101, 7955, 110405, 276-846; 1663, ATG101, 7956, 110406, 419-671; 1663, ATG101, 7953, 110403, 479-1135; 1664, ATG12, 7957, 110407, 286-513; 1664, ATG12, 7958, 110408, 272-442; 1664, ATG12, 7961, 110411, 1-178; 1664, ATG12, 7962, 110412, 1-199; 1664, ATG12, 7959, 110409, 307-729; 1664, ATG12, 7960, 110410, 14-238; 1665, ATG13, 7964, 110414, 342-937; 1665, ATG13, 7965, 110415, 1-237; 1665, ATG13, 7970, 110420, 1-142; 1665, ATG13, 7972, 110422, 1-581; 1665, ATG13, 7973, 110423, 665-1021; 1665, ATG13, 7974, 110424, 1-127; 1665, ATG13, 7975, 110425, 444-613; 1665, ATG13, 7976, 110426, 488-587; 1665, ATG13, 7977, 110427, 580-619; 1665, ATG13, 7978, 110428, 527-624; 1665, ATG13, 7979, 110429, 464-544; 1665, ATG13, 7980, 110430, 487-600; 1665, ATG13, 7981, 110431, 592-741; 1665, ATG13, 7963, 110413, 309-1862; 1665, ATG13, 7966, 110416, 458-2011; 1665, ATG13, 7967, 110417, 305-1957; 1665, ATG13, 7968, 110418, 384-1826; 1665, ATG13, 7969, 110419, 415-1857; 1665, ATG13, 7971, 110421, 497-1702; 1666, ATG14, 7982, 110432, 37-1515; 1667, ATG16L1, 7986, 110436, 115-1989; 1667, ATG16L1, 7988, 110438, 156-272; 1667, ATG16L1, 7989, 110439, 424-589; 1667, ATG16L1, 7990, 110440, 153-644; 1667, ATG16L1, 7991, 110441, 159-691; 1667, ATG16L1, 7992, 110442, 124-684; 1667, ATG16L1, 7993, 110443, 156-272; 1667, ATG16L1, 7994, 110444, 124-684; 1667, ATG16L1, 7995, 110445, 115-1989; 1667, ATG16L1, 7996, 110446, 159-691; 1667, ATG16L1, 7997, 110447, 424-589; 1667, ATG16L1, 7999, 110449, 153-644; 1667, ATG16L1, 7983, 110433, 258-1592; 1667, ATG16L1, 7984, 110434, 157-1443; 1667, ATG16L1, 7985, 110435, 258-2081; 1667, ATG16L1, 7987, 110437, 123-1889; 1667, ATG16L1, 7998, 110448, 258-1592; 1667, ATG16L1, 8000, 110450, 123-1889; 1667, ATG16L1, 8001, 110451, 157-1443; 1667, ATG16L1, 8002, 110452, 258-2081; 1668, ATG16L2, 8004, 110454, 32-397; 1668, ATG16L2, 8005, 110455, 1-1353; 1668, ATG16L2, 8006, 110456, 1-224; 1668, ATG16L2, 8007, 110457, 1-963; 1668, ATG16L2, 8008, 110458, 1-295; 1668, ATG16L2, 8009, 110459, 41-535; 1668, ATG16L2, 8010, 110460, 1-1192; 1668, ATG16L2, 8011, 110461, 1-1251; 1668, ATG16L2, 8012, 110462, 20-340; 1668, ATG16L2, 8013, 110463, 1-297; 1668, ATG16L2, 8014, 110464, 1-353; 1668, ATG16L2, 8003, 110453, 139-1998; 1669, ATG2A, 8017, 110467, 1-5227; 1669, ATG2A, 8015, 110465, 114-5930; 1669, ATG2A, 8016, 110466, 85-1080; 1670, ATG2B, 8018, 110468, 895-7131; 1671, ATG3, 8021, 110471, 125-349; 1671, ATG3, 8022, 110472, 391-639; 1671, ATG3, 8019, 110469, 436-1380; 1671, ATG3, 8020, 110470, 389-1324; 1672, ATG4A, 8024, 110474, 18-713; 1672, ATG4A, 8026, 110476, 44-187; 1672, ATG4A, 8027, 110477, 1-935; 1672, ATG4A, 8028, 110478, 333-939; 1672, ATG4A, 8023, 110473, 160-1170; 1672, ATG4A, 8025, 110475, 160-1356; 1673, ATG4B, 8029, 110479, 1-230; 1673, ATG4B, 8030, 110480, 6-663; 1673, ATG4B, 8031, 110481, 90-356; 1673, ATG4B, 8035, 110485, 6-272; 1673, ATG4B, 8036, 110486, 355-553; 1673, ATG4B, 8037, 110487, 1-580; 1673, ATG4B, 8038, 110488, 308-623; 1673, ATG4B, 8039, 110489, 9-807; 1673, ATG4B, 8040, 110490, 84-524; 1673, ATG4B, 8041, 110491, 104-370; 1673, ATG4B, 8032, 110482, 503-1645; 1673, ATG4B, 8033, 110483, 104-1285; 1673, ATG4B, 8034, 110484, 326-1321; 1674, ATG4C, 8043, 110493, 97-665; 1674, ATG4C, 8045, 110495, 1-332; 1674, ATG4C, 8046, 110496, 149-603; 1674, ATG4C, 8042, 110492, 208-1584; 1674, ATG4C, 8044, 110494, 160-1536; 1675, ATG4D, 8048, 110498, 1-529; 1675, ATG4D, 8049, 110499, 174-536; 1675, ATG4D, 8050, 110500, 1-204; 1675, ATG4D, 8051, 110501, 1-534; 1675, ATG4D, 8052, 110502, 1-628; 1675, ATG4D, 8053, 110503, 121-807; 1675, ATG4D, 8054, 110504, 1-300; 1675, ATG4D, 8055, 110505, 197-679; 1675, ATG4D, 8056, 110506, 175-1179; 1675, ATG4D, 8057, 110507, 1-607; 1675, ATG4D, 8047, 110497, 174-1598; 1676, ATG5, 8059, 110509, 354-629; 1676, ATG5, 8062, 110512, 1-489; 1676, ATG5, 8058, 110508, 201-1028; 1676, ATG5, 8060, 110510, 431-1024; 1676, ATG5, 8061, 110511, 325-1152; 1677, ATG7, 8065, 110515, 1-290; 1677, ATG7, 8066, 110516, 36-266; 1677, ATG7, 8067, 110517, 285-565; 1677, ATG7, 8068, 110518, 449-647; 1677, ATG7, 8069, 110519, 1-318; 1677, ATG7, 8070, 110520, 1-418; 1677, ATG7, 8071, 110521, 1-288; 1677, ATG7, 8072, 110522, 298-565; 1677, ATG7, 8073, 110523, 1-233; 1677, ATG7, 8074, 110524, 94-549; 1677, ATG7, 8076, 110526, 445-972; 1677, ATG7, 8077, 110527, 212-589; 1677, ATG7, 8063, 110513, 26-2137; 1677, ATG7, 8064, 110514, 26-2056; 1677, ATG7, 8075, 110525, 26-1897; 1678, ATG9A, 8083, 110533, 184-480; 1678, ATG9A, 8084, 110534, 132-428; 1678, ATG9A, 8085, 110535, 290-568; 1678, ATG9A, 8086, 110536, 182-581; 1678, ATG9A, 8087, 110537, 1-766; 1678, ATG9A, 8088, 110538, 1-733; 1678, ATG9A, 8089, 110539, 331-893; 1678, ATG9A, 8090, 110540, 184-699; 1678, ATG9A, 8091, 110541, 363-796; 1678, ATG9A, 8092, 110542, 192-700; 1678, ATG9A, 8093, 110543, 197-589; 1678, ATG9A, 8094, 110544, 395-685; 1678, ATG9A, 8078, 110528, 218-2737; 1678, ATG9A, 8079, 110529, 213-2732; 1678, ATG9A, 8080, 110530, 174-1760; 1678, ATG9A, 8081, 110531, 176-2512; 1678, ATG9A, 8082, 110532, 441-2960; 1679, ATG9B, 8095, 110545, 77-2851; 1679, ATG9B, 8096, 110546, 1-2775; 1680, AMBRA1, 8099, 110549, 451-522; 1680, AMBRA1, 8101, 110551, 242-3781; 1680, AMBRA1, 8103, 110553, 1-771; 1680, AMBRA1, 8097, 110547, 361-3987; 1680, AMBRA1, 8098, 110548, 420-4316; 1680, AMBRA1, 8100, 110550, 315-4031; 1680, AMBRA1, 8102, 110552, 293-4102; 1681, AVL9, 8105, 110555, 185-2077; 1681, AVL9, 8106, 110556, 1-1707; 1681, AVL9, 8104, 110554, 222-2168; 1682, AXIN1, 8109, 110559, 1-308; 1682, AXIN1, 8107, 110557, 373-2961; 1682, AXIN1, 8108, 110558, 163-2643; 1683, AXIN2, 8111, 110561, 110-2446; 1683, AXIN2, 8112, 110562, 170-621; 1683, AXIN2, 8113, 110563, 460-1034; 1683, AXIN2, 8114, 110564, 484-1060; 1683, AXIN2, 8115, 110565, 162-976; 1683, AXIN2, 8116, 110566, 315-2651; 1683, AXIN2, 8117, 110567, 490-972; 1683, AXIN2, 8110, 110560, 315-2846; 1684, AIDA, 8118, 110568, 208-1128; 1684, AIDA, 8119, 110569, 112-786; 1685, AXL, 8122, 110572, 377-2257; 1685, AXL, 8120, 110570, 191-2875; 1685, AXL, 8121, 110571, 159-2816; 1686, AXDND1, 8124, 110574, 1-2619; 1686, AXDND1, 8125, 110575, 388-2406; 1686, AXDND1, 8126, 110576, 351-586; 1686, AXDND1, 8127, 110577, 262-1851; 1686, AXDND1, 8128, 110578, 311-765; 1686, AXDND1, 8129, 110579, 185-553; 1686, AXDND1, 8130, 110580, 388-1977; 1686, AXDND1, 8123, 110573, 388-3426; 1687, AZU1, 8133, 110583, 230-682; 1687, AZU1, 8134, 110584, 230-682; 1687, AZU1, 8131, 110581, 12-767; 1687, AZU1, 8132, 110582, 12-767; 1688, BTLA, 8135, 110585, 204-1073; 1688, BTLA, 8136, 110586, 1-726; 1689, BDP1, 8138, 110588, 220-2760; 1689, BDP1, 8139, 110589, 1-1751; 1689, BDP1, 8140, 110590, 1-1821; 1689, BDP1, 8141, 110591, 1-1751; 1689, BDP1, 8142, 110592, 1-1821; 1689, BDP1, 8143, 110593, 220-2760; 1689, BDP1, 8144, 110594, 220-2760; 1689, BDP1, 8145, 110595, 264-8138; 1689, BDP1, 8147, 110597, 1-1751; 1689, BDP1, 8148, 110598, 1-1821; 1689, BDP1, 8137, 110587, 264-8138; 1689, BDP1, 8146, 110596, 264-8138; 1690, N/A, 8149, 110599, 1-120; 1691, B9D1, 8152, 110602, 8-493; 1691, B9D1, 8153, 110603, 165-728; 1691, B9D1, 8154, 110604, 1-402; 1691, B9D1, 8155, 110605, 46-606; 1691, B9D1, 8156, 110606, 133-553; 1691, B9D1, 8157, 110607, 335-778; 1691, B9D1, 8158, 110608, 335-976; 1691, B9D1, 8159, 110609, 177-496; 1691, B9D1, 8160, 110610, 1-339; 1691, B9D1, 8161, 110611, 238-295; 1691, B9D1, 8150, 110600, 145-759; 1691, B9D1, 8151, 110601, 101-562; 1692, B9D2, 8163, 110613, 213-461; 1692, B9D2, 8162, 110612, 221-748; 1693, BPI, 8165, 110615, 112-399; 1693, BPI, 8166, 110616, 138-507; 1693, BPI, 8167, 110617, 81-941; 1693, BPI, 8168, 110618, 58-225; 1693, BPI, 8169, 110619, 81-170; 1693, BPI, 8164, 110614, 90-1553; 1694, BIRC2, 8172, 110622, 269-505; 1694, BIRC2, 8173, 110623, 173-720; 1694, BIRC2, 8174, 110624, 1-789; 1694, BIRC2, 8175, 110625, 149-595; 1694, BIRC2, 8176, 110626, 338-2131; 1694, BIRC2, 8177, 110627, 154-572; 1694, BIRC2, 8179, 110629, 1730-3331; 1694, BIRC2, 8170, 110620, 1400-3256; 1694, BIRC2, 8171, 110621, 165-1874; 1694, BIRC2, 8178, 110628, 1730-3586; 1695, BIRC3, 8181, 110631, 1-549; 1695, BIRC3, 8180, 110630, 2751-4565; 1695, BIRC3, 8182, 110632, 123-1937; 1695, BIRC3, 8183, 110633, 236-2050; 1696, BIRC5, 8184, 110634, 132-629; 1696, BIRC5, 8185, 110635, 120-548; 1696, BIRC5, 8188, 110638, 1-250; 1696, BIRC5, 8190, 110640, 1-364; 1696, BIRC5, 8191, 110641, 1-157; 1696, BIRC5, 8186, 110636, 54-467; 1696, BIRC5, 8187, 110637, 38-262; 1696, BIRC5, 8189, 110639, 1-237; 1696, BIRC5, 8192, 110642, 55-417; 1697, BIRC6, 8193, 110643, 1-331; 1697, BIRC6, 8195, 110645, 1-575; 1697, BIRC6, 8194, 110644, 135-14708; 1698, BIRC7, 8198, 110648, 7-588; 1698, BIRC7, 8196, 110646, 215-1111; 1698, BIRC7, 8197, 110647, 215-1057; 1699, BIRC8, 8199, 110649, 1253-1963; 1700, BAHCC1, 8200, 110650, 1-7827; 1700, BAHCC1, 8201, 110651, 368-8287; 1701, BAIAP2, 8204, 110654, 1-1128; 1701, BAIAP2, 8207, 110657, 161-581; 1701, BAIAP2, 8208, 110658, 359-748; 1701, BAIAP2, 8209, 110659, 327-565; 1701, BAIAP2, 8210, 110660, 161-567; 1701, BAIAP2, 8211, 110661, 106-646; 1701, BAIAP2, 8213, 110663, 96-272; 1701, BAIAP2, 8214, 110664, 79-782; 1701, BAIAP2, 8215, 110665, 100-626; 1701, BAIAP2, 8216, 110666, 106-426; 1701, BAIAP2, 8217, 110667, 1-649; 1701, BAIAP2, 8218, 110668, 105-554; 1701, BAIAP2, 8219, 110669, 1-294; 1701, BAIAP2, 8220, 110670, 98-1759; 1701, BAIAP2, 8221, 110671, 236-578; 1701, BAIAP2, 8202, 110652, 134-1699; 1701, BAIAP2, 8203, 110653, 94-1752; 1701, BAIAP2, 8205, 110655, 105-1709; 1701, BAIAP2, 8206, 110656, 94-1656; 1701, BAIAP2, 8212, 110662, 100-1638; 1702, BAIAP2L1, 8222, 110672, 217-1752; 1703, BAIAP2L2, 8225, 110675, 1-591; 1703, BAIAP2L2, 8223, 110673, 121-1668; 1703, BAIAP2L2, 8224, 110674, 146-1735; 1704, BAIAP3, 8230, 110680, 1-571; 1704, BAIAP3, 8232, 110682, 1-653; 1704, BAIAP3, 8226, 110676, 159-3722; 1704, BAIAP3, 8227, 110677, 118-3627; 1704, BAIAP3, 8228, 110678, 160-3618; 1704, BAIAP3, 8229, 110679, 214-3564; 1704, BAIAP3, 8231, 110681, 116-3490; 1704, BAIAP3, 8233, 110683, 116-3505; 1704, BAIAP3, 8234, 110684, 264-3773; 1705, BBS1, 8237, 110687, 19-1509; 1705, BBS1, 8238, 110688, 25-601; 1705, BBS1, 8239, 110689, 12-269; 1705, BBS1, 8240, 110690, 55-312; 1705, BBS1, 8241, 110691, 17-274; 1705, BBS1, 8242, 110692, 441-608; 1705, BBS1, 8243, 110693, 26-283; 1705, BBS1, 8244, 110694, 52-546; 1705, BBS1, 8245, 110695, 38-205; 1705, BBS1, 8246, 110696, 423-584; 1705, BBS1, 8247, 110697, 134-333; 1705, BBS1, 8248, 110698, 6-263; 1705, BBS1, 8235, 110685, 52-1833; 1705, BBS1, 8236, 110686, 6-1346; 1706, BBS10, 8249, 110699, 85-2256; 1707, BBS12, 8251, 110701, 287-859; 1707, BBS12, 8250, 110700, 194-2326; 1707, BBS12, 8252, 110702, 382-2514; 1708, BBS2, 8254, 110704, 1-229; 1708, BBS2, 8255, 110705, 1-360; 1708, BBS2, 8256, 110706, 180-2207; 1708, BBS2, 8257, 110707, 550-564; 1708, BBS2, 8258, 110708, 1-256; 1708, BBS2, 8259, 110709, 1-429; 1708, BBS2, 8253, 110703, 422-2587; 1709, BBS4, 8262, 110712, 9-242; 1709, BBS4, 8263, 110713, 35-463; 1709, BBS4, 8264, 110714, 128-551; 1709, BBS4, 8265, 110715, 22-84; 1709, BBS4, 8266, 110716, 22-225; 1709, BBS4, 8267, 110717, 1-843; 1709, BBS4, 8268, 110718, 43-105; 1709, BBS4, 8269, 110719, 1-541; 1709, BBS4, 8270, 110720, 22-174; 1709, BBS4, 8271, 110721, 25-336; 1709, BBS4, 8272, 110722, 22-123; 1709, BBS4, 8260, 110710, 42-1601; 1709, BBS4, 8261, 110711, 519-1562; 1710, BBS5, 8275, 110725, 53-214; 1710, BBS5, 8273, 110723, 377-1402; 1710, BBS5, 8274, 110724, 72-1034; 1711, BBS7, 8277, 110727, 1-417; 1711, BBS7, 8276, 110726, 185-2332; 1711, BBS7, 8278, 110728, 138-2156; 1711, BBS7, 8283, 110733, 1-1363; 1712, BBS9, 8284, 110734, 158-596; 1712, BBS9, 8286, 110736, 492-1874; 1712, BBS9, 8287, 110737, 321-613; 1712, BBS9, 8288, 110738, 1-549; 1712, BBS9, 8279, 110729, 522-3185;

1712, BBS9, 8280, 110730, 514-3057; 1712, BBS9, 8281, 110731, 514-3162; 1712, BBS9, 8282, 110732, 514-3072; 1712, BBS9, 8285, 110735, 60-992; 1713, BARHL1, 8289, 110739, 614-1597; 1713, BARHL1, 8290, 110740, 53-1036; 1714, BARHL2, 8291, 110741, 43-1206; 1715, BANF1, 8294, 110744, 502-586; 1715, BANF1, 8292, 110742, 509-778; 1715, BANF1, 8293, 110743, 303-572; 1715, BANF1, 8295, 110745, 275-544; 1715, BANF1, 8296, 110746, 507-776; 1716, BANF2, 8299, 110749, 498-623; 1716, BANF2, 8297, 110747, 263-535; 1716, BANF2, 8298, 110748, 112-384; 1716, BANF2, 8300, 110750, 18-311; 1717, BSND, 8301, 110751, 255-1217; 1718, BARX1, 8302, 110752, 227-991; 1718, BARX1, 8303, 110753, 484-786; 1719, BARX2, 8304, 110754, 97-936; 1720, BBOF1, 8306, 110756, 318-689; 1720, BBOF1, 8307, 110757, 223-420; 1720, BBOF1, 8305, 110755, 124-1713; 1721, BCAM, 8309, 110759, 5-878; 1721, BCAM, 8310, 110760, 1-185; 1721, BCAM, 8311, 110761, 55-1821; 1721, BCAM, 8312, 110762, 67-1833; 1721, BCAM, 8308, 110758, 23-1909; 1722, BPY2, 8315, 110765, 527-559; 1722, BPY2, 8313, 110763, 333-653; 1722, BPY2, 8314, 110764, 1-321; 1723, BPY2B, 8317, 110767, 527-559; 1723, BPY2B, 8316, 110766, 333-653; 1723, BPY2B, 8318, 110768, 1-321; 1724, BPY2C, 8320, 110770, 527-559; 1724, BPY2C, 8319, 110769, 333-653; 1724, BPY2C, 8321, 110771, 1-321; 1725, BHMG1, 8322, 110772, 417-2333; 1726, BHLHB9, 8323, 110773, 529-2172; 1726, BHLHB9, 8324, 110774, 586-2229; 1726, BHLHB9, 8325, 110775, 494-2137; 1726, BHLHB9, 8326, 110776, 640-2283; 1726, BHLHB9, 8327, 110777, 589-2232; 1727, BHLHA15, 8328, 110778, 57-626; 1727, BHLHA15, 8329, 110779, 127-696; 1728, BHLHA9, 8330, 110780, 6-713; 1729, BHLHE22, 8331, 110781, 425-1570; 1730, BHLHE23, 8333, 110783, 262-987; 1730, BHLHE23, 8332, 110782, 310-987; 1731, BHLHE40, 8334, 110784, 604-1842; 1732, BHLHE41, 8335, 110785, 349-1797; 1733, BZW1, 8338, 110788, 193-1075; 1733, BZW1, 8339, 110789, 412-1059; 1733, BZW1, 8340, 110790, 209-557; 1733, BZW1, 8342, 110792, 1-407; 1733, BZW1, 8343, 110793, 73-557; 1733, BZW1, 8344, 110794, 115-578; 1733, BZW1, 8336, 110786, 456-1715; 1733, BZW1, 8337, 110787, 124-1395; 1733, BZW1, 8341, 110791, 53-1408; 1734, BZW2, 8346, 110796, 112-789; 1734, BZW2, 8347, 110797, 265-1296; 1734, BZW2, 8348, 110798, 123-635; 1734, BZW2, 8350, 110800, 182-1405; 1734, BZW2, 8351, 110801, 153-638; 1734, BZW2, 8352, 110802, 471-1040; 1734, BZW2, 8353, 110803, 38-859; 1734, BZW2, 8354, 110804, 49-674; 1734, BZW2, 8355, 110805, 130-617; 1734, BZW2, 8356, 110806, 163-648; 1734, BZW2, 8345, 110795, 166-1425; 1734, BZW2, 8349, 110799, 179-1438; 1735, BLZF1, 8360, 110810, 177-926; 1735, BLZF1, 8361, 110811, 413-795; 1735, BLZF1, 8357, 110807, 424-1626; 1735, BLZF1, 8358, 110808, 424-948; 1735, BLZF1, 8359, 110809, 424-1626; 1736, BATF, 8363, 110813, 124-345; 1736, BATF, 8362, 110812, 259-636; 1737, BATF2, 8366, 110816, 133-885; 1737, BATF2, 8367, 110817, 105-569; 1737, BATF2, 8364, 110814, 132-956; 1737, BATF2, 8365, 110815, 196-765; 1738, BATF3, 8368, 110818, 224-607; 1739, BTF3, 8371, 110821, 50-377; 1739, BTF3, 8372, 110822, 1-260; 1739, BTF3, 8369, 110819, 152-640; 1739, BTF3, 8370, 110820, 220-840; 1740, BTF3L4, 8374, 110824, 73-510; 1740, BTF3L4, 8375, 110825, 195-359; 1740, BTF3L4, 8373, 110823, 269-745; 1740, BTF3L4, 8376, 110826, 123-359; 1740, BTF3L4, 8377, 110827, 197-499; 1741, BIVM, 8378, 110828, 680-2191; 1741, BIVM, 8379, 110829, 683-1528; 1742, BSG, 8383, 110833, 64-545; 1742, BSG, 8384, 110834, 307-559; 1742, BSG, 8385, 110835, 387-544; 1742, BSG, 8387, 110837, 17-586; 1742, BSG, 8388, 110838, 13-180; 1742, BSG, 8389, 110839, 26-689; 1742, BSG, 8380, 110830, 71-1228; 1742, BSG, 8381, 110831, 58-867; 1742, BSG, 8382, 110832, 239-856; 1742, BSG, 8386, 110836, 516-1046; 1743, BNC1, 8391, 110841, 108-3071; 1743, BNC1, 8392, 110842, 89-3070; 1743, BNC1, 8390, 110840, 87-3071; 1744, BNC2, 8393, 110843, 328-1211; 1744, BNC2, 8394, 110844, 84-3182; 1744, BNC2, 8396, 110846, 1-984; 1744, BNC2, 8397, 110847, 1-2583; 1744, BNC2, 8399, 110849, 496-2685; 1744, BNC2, 8400, 110850, 181-545; 1744, BNC2, 8401, 110851, 274-1008; 1744, BNC2, 8402, 110852, 1-330; 1744, BNC2, 8403, 110853, 196-688; 1744, BNC2, 8404, 110854, 328-459; 1744, BNC2, 8405, 110855, 440-561; 1744, BNC2, 8406, 110856, 566-687; 1744, BNC2, 8395, 110845, 59-3358; 1744, BNC2, 8398, 110848, 113-2824; 1745, BSN, 8407, 110857, 115-11895; 1746, BSPRY, 8408, 110858, 40-1248; 1747, BBIP1, 8413, 110863, 119-256; 1747, BBIP1, 8409, 110859, 40-252; 1747, BBIP1, 8410, 110860, 94-297; 1747, BBIP1, 8411, 110861, 111-323; 1747, BBIP1, 8412, 110862, 138-449; 1747, BBIP1, 8414, 110864, 211-489; 1747, BBIP1, 8415, 110865, 149-427; 1748, BCS1L, 8420, 110870, 1-365; 1748, BCS1L, 8421, 110871, 575-804; 1748, BCS1L, 8422, 110872, 198-815; 1748, BCS1L, 8423, 110873, 253-583; 1748, BCS1L, 8424, 110874, 419-1036; 1748, BCS1L, 8427, 110877, 129-580; 1748, BCS1L, 8429, 110879, 1-604; 1748, BCS1L, 8416, 110866, 138-1397; 1748, BCS1L, 8417, 110867, 267-1526; 1748, BCS1L, 8418, 110868, 210-1469; 1748, BCS1L, 8419, 110869, 268-1527; 1748, BCS1L, 8425, 110875, 206-1465; 1748, BCS1L, 8426, 110876, 114-1373; 1748, BCS1L, 8428, 110878, 700-1959; 1749, BCDIN3D, 8430, 110880, 43-921; 1750, BLACE, 8431, 110881, 1262-1801; 1750, BLACE, 8432, 110882, 1-540; 1751, BCL10, 8434, 110884, 105-575; 1751, BCL10, 8433, 110883, 739-1440; 1752, BCL11A, 8439, 110889, 231-659; 1752, BCL11A, 8440, 110890, 149-724; 1752, BCL11A, 8441, 110891, 1-52; 1752, BCL11A, 8442, 110892, 238-741; 1752, BCL11A, 8435, 110885, 229-2736; 1752, BCL11A, 8436, 110886, 230-2551; 1752, BCL11A, 8437, 110887, 162-2567; 1752, BCL11A, 8438, 110888, 298-1029; 1753, BCL11B, 8445, 110895, 307-2409; 1753, BCL11B, 8443, 110893, 268-2739; 1753, BCL11B, 8444, 110894, 11-2695; 1754, BCL2, 8446, 110896, 900-1619; 1754, BCL2, 8447, 110897, 1463-2182; 1754, BCL2, 8448, 110898, 147-764; 1755, BCL3, 8450, 110900, 1-923; 1755, BCL3, 8449, 110899, 245-1609; 1756, BCL6, 8453, 110903, 1049-1216; 1756, BCL6, 8455, 110905, 398-709; 1756, BCL6, 8456, 110906, 90-454; 1756, BCL6, 8451, 110901, 530-2650; 1756, BCL6, 8452, 110902, 368-2488; 1756, BCL6, 8454, 110904, 25-1977; 1756, BCL6, 8457, 110907, 366-2318; 1757, BCL6B, 8459, 110909, 1-408; 1757, BCL6B, 8460, 110910, 59-459; 1757, BCL6B, 8461, 110911, 196-529; 1757, BCL6B, 8458, 110908, 93-1532; 1758, BCL7A, 8464, 110914, 2671-3366; 1758, BCL7A, 8465, 110915, 207-839; 1758, BCL7A, 8462, 110912, 207-839; 1758, BCL7A, 8463, 110913, 2671-3366; 1759, BCL7B, 8468, 110918, 188-829; 1759, BCL7B, 8469, 110919, 77-313; 1759, BCL7B, 8470, 110920, 32-298; 1759, BCL7B, 8466, 110916, 425-1033; 1759, BCL7B, 8467, 110917, 94-531; 1760, BCL7C, 8473, 110923, 1-880; 1760, BCL7C, 8474, 110924, 257-571; 1760, BCL7C, 8471, 110921, 1017-1670; 1760, BCL7C, 8472, 110922, 359-1087; 1761, BCL9, 8476, 110926, 741-4925; 1761, BCL9, 8475, 110925, 741-5021; 1762, BCL9L, 8478, 110928, 347-611; 1762, BCL9L, 8479, 110929, 457-4845; 1762, BCL9L, 8477, 110927, 966-5465; 1763, BLNK, 8482, 110932, 119-1018; 1763, BLNK, 8484, 110934, 1-198;

1763, BLNK, 8485, 110935, 190-555; 1763, BLNK, 8480, 110930, 143-1513; 1763, BLNK, 8481, 110931, 143-1444; 1763, BLNK, 8483, 110933, 119-1333; 1764, BCAP29, 8489, 110939, 51-566; 1764, BCAP29, 8490, 110940, 76-474; 1764, BCAP29, 8492, 110942, 309-998; 1764, BCAP29, 8493, 110943, 1-490; 1764, BCAP29, 8494, 110944, 158-746; 1764, BCAP29, 8495, 110945, 247-690; 1764, BCAP29, 8496, 110946, 1-885; 1764, BCAP29, 8497, 110947, 306-498; 1764, BCAP29, 8498, 110948, 56-256; 1764, BCAP29, 8486, 110936, 340-1065; 1764, BCAP29, 8487, 110937, 138-863; 1764, BCAP29, 8488, 110938, 15-1061; 1764, BCAP29, 8491, 110941, 52-1098; 1765, BCAP31, 8500, 110950, 135-669; 1765, BCAP31, 8502, 110952, 143-688; 1765, BCAP31, 8503, 110953, 228-793; 1765, BCAP31, 8504, 110954, 156-570; 1765, BCAP31, 8505, 110955, 124-684; 1765, BCAP31, 8499, 110949, 409-1149; 1765, BCAP31, 8501, 110951, 431-1372; 1766, BANK1, 8506, 110956, 275-2632; 1766, BANK1, 8507, 110957, 134-2401; 1766, BANK1, 8508, 110958, 275-2233; 1766, BANK1, 8509, 110959, 419-2731; 1766, BANK1, 8510, 110960, 152-2110; 1767, BTG1, 8512, 110962, 252-504; 1767, BTG1, 8511, 110961, 363-878; 1768, BTG4, 8514, 110964, 273-754; 1768, BTG4, 8513, 110963, 201-872; 1768, BTG4, 8515, 110965, 186-806; 1769, BBC3, 8516, 110966, 165-470; 1769, BBC3, 8519, 110969, 165-950; 1769, BBC3, 8517, 110967, 165-560; 1769, BBC3, 8518, 110968, 282-863; 1770, BMF, 8523, 110973, 452-490; 1770, BMF, 8528, 110978, 322-505; 1770, BMF, 8520, 110970, 236-790; 1770, BMF, 8521, 110971, 97-651; 1770, BMF, 8522, 110972, 1-492; 1770, BMF, 8524, 110974, 124-678; 1770, BMF, 8525, 110975, 70-624; 1770, BMF, 8526, 110976, 225-614; 1770, BMF, 8527, 110977, 241-630; 1771, BNIPL, 8530, 110980, 1-1025; 1771, BNIPL, 8532, 110982, 211-510; 1771, BNIPL, 8529, 110979, 610-1437; 1771, BNIPL, 8531, 110981, 157-1230; 1771, BNIPL, 8533, 110983, 1-615; 1772, BNIP1, 8538, 110988, 1-123; 1772, BNIP1, 8534, 110984, 105-920; 1772, BNIP1, 8535, 110985, 10-723; 1772, BNIP1, 8536, 110986, 32-718; 1772, BNIP1, 8537, 110987, 1-585; 1773, BNIP2, 8539, 110989, 95-1402; 1773, BNIP2, 8540, 110990, 1-615; 1773, BNIP2, 8541, 110991, 1-262; 1773, BNIP2, 8544, 110994, 4-1311; 1773, BNIP2, 8542, 110992, 67-1197; 1773, BNIP2, 8543, 110993, 204-1148; 1774, BNIP3, 8546, 110996, 1-660; 1774, BNIP3, 8547, 110997, 1-731; 1774, BNIP3, 8545, 110995, 13-792; 1775, BNIP3L, 8550, 111000, 78-260; 1775, BNIP3L, 8551, 111001, 1-558; 1775, BNIP3L, 8554, 111004, 78-767; 1775, BNIP3L, 8548, 110998, 234-893; 1775, BNIP3L, 8549, 110999, 103-642; 1775, BNIP3L, 8552, 111002, 122-661; 1775, BNIP3L, 8553, 111003, 177-716; 1776, BAK1, 8555, 111005, 301-876; 1776, BAK1, 8556, 111006, 250-885; 1776, BAK1, 8557, 111007, 301-762; 1777, BAD, 8559, 111009, 32-523; 1777, BAD, 8561, 111011, 134-325; 1777, BAD, 8562, 111012, 207-359; 1777, BAD, 8563, 111013, 2-475; 1777, BAD, 8558, 111008, 48-554; 1777, BAD, 8560, 111010, 272-778; 1778, BAG1, 8565, 111015, 392-874; 1778, BAG1, 8566, 111016, 342-485; 1778, BAG1, 8567, 111017, 231-681; 1778, BAG1, 8568, 111018, 88-1125; 1778, BAG1, 8569, 111019, 377-658; 1778, BAG1, 8570, 111020, 1-1038; 1778, BAG1, 8571, 111021, 1-192; 1778, BAG1, 8564, 111014, 243-935; 1779, BAG2, 8572, 111022, 373-1008; 1780, BAG3, 8574, 111024, 171-1146; 1780, BAG3, 8573, 111023, 307-2034; 1781, BAG4, 8577, 111027, 1-468; 1781, BAG4, 8575, 111025, 272-1645; 1781, BAG4, 8576, 111026, 283-1548; 1782, BAG5, 8581, 111031, 245-878; 1782, BAG5, 8578, 111028, 228-1571; 1782, BAG5, 8579, 111029, 292-1758; 1782, BAG5, 8580, 111030, 248-1591; 1783, BAG6, 8589, 111039, 124-902; 1783, BAG6, 8590, 111040, 124-902; 1783, BAG6, 8591, 111041, 124-902; 1783, BAG6, 8592, 111042, 217-807; 1783, BAG6, 8593, 111043, 1-714; 1783, BAG6, 8594, 111044, 180-2407; 1783, BAG6, 8596, 111046, 282-1056; 1783, BAG6, 8597, 111047, 36-654; 1783, BAG6, 8598, 111048, 69-544; 1783, BAG6, 8599, 111049, 180-2407; 1783, BAG6, 8600, 111050, 282-1056; 1783, BAG6, 8602, 111052, 69-544; 1783, BAG6, 8603, 111053, 147-844; 1783, BAG6, 8604, 111054, 1-554; 1783, BAG6, 8605, 111055, 263-993; 1783, BAG6, 8606, 111056, 1-680; 1783, BAG6, 8607, 111057, 217-807; 1783, BAG6, 8608, 111058, 103-747; 1783, BAG6, 8609, 111059, 1-410; 1783, BAG6, 8610, 111060, 103-747; 1783, BAG6, 8611, 111061, 147-844; 1783, BAG6, 8612, 111062, 1-714; 1783, BAG6, 8613, 111063, 1-410; 1783, BAG6, 8614, 111064, 33-766; 1783, BAG6, 8615, 111065, 93-880; 1783, BAG6, 8616, 111066, 124-902; 1783, BAG6, 8617, 111067, 263-993; 1783, BAG6, 8618, 111068, 124-902; 1783, BAG6, 8619, 111069, 126-859; 1783, BAG6, 8620, 111070, 263-993; 1783, BAG6, 8621, 111071, 93-880; 1783, BAG6, 8622, 111072, 33-766; 1783, BAG6, 8623, 111073, 1-680; 1783, BAG6, 8624, 111074, 296-3676; 1783, BAG6, 8625, 111075, 33-766; 1783, BAG6, 8626, 111076, 103-747; 1783, BAG6, 8627, 111077, 36-654; 1783, BAG6, 8628, 111078, 1-714; 1783, BAG6, 8629, 111079, 166-1710; 1783, BAG6, 8630, 111080, 1-714; 1783, BAG6, 8631, 111081, 69-544; 1783, BAG6, 8632, 111082, 1-736; 1783, BAG6, 8633, 111083, 1-736; 1783, BAG6, 8634, 111084, 33-766; 1783, BAG6, 8635, 111085, 1-554; 1783, BAG6, 8637, 111087, 124-902; 1783, BAG6, 8638, 111088, 180-2407; 1783, BAG6, 8639, 111089, 1-736; 1783, BAG6, 8640, 111090, 1-680; 1783, BAG6, 8641, 111091, 266-1051; 1783, BAG6, 8642, 111092, 36-654; 1783, BAG6, 8643, 111093, 1-554; 1783, BAG6, 8644, 111094, 145-1689; 1783, BAG6, 8645, 111095, 180-2407; 1783, BAG6, 8646, 111096, 266-1051; 1783, BAG6, 8647, 111097, 36-654; 1783, BAG6, 8648, 111098, 126-859; 1783, BAG6, 8649, 111099, 69-544; 1783, BAG6, 8650, 111100, 69-544; 1783, BAG6, 8651, 111101, 126-859; 1783, BAG6, 8652, 111102, 36-654; 1783, BAG6, 8653, 111103, 266-1051; 1783, BAG6, 8654, 111104, 1-736; 1783, BAG6, 8655, 111105, 180-2407; 1783, BAG6, 8656, 111106, 282-1056; 1783, BAG6, 8658, 111108, 145-1689; 1783, BAG6, 8659, 111109, 126-859; 1783, BAG6, 8660, 111110, 144-1688; 1783, BAG6, 8661, 111111, 282-1056; 1783, BAG6, 8662, 111112, 170-1714; 1783, BAG6, 8663, 111113, 93-880; 1783, BAG6, 8664, 111114, 152-3532; 1783, BAG6, 8665, 111115, 166-1710; 1783, BAG6, 8666, 111116, 69-544; 1783, BAG6, 8667, 111117, 103-747; 1783, BAG6, 8668, 111118, 93-880; 1783, BAG6, 8669, 111119, 93-880; 1783, BAG6, 8670, 111120, 217-807; 1783, BAG6, 8671, 111121, 263-993; 1783, BAG6, 8672, 111122, 1-554; 1783, BAG6, 8673, 111123, 180-2407; 1783, BAG6, 8674, 111124, 124-902; 1783, BAG6, 8675, 111125, 1-714; 1783, BAG6, 8676, 111126, 126-859; 1783, BAG6, 8677, 111127, 266-1051; 1783, BAG6, 8678, 111128, 36-654; 1783, BAG6, 8679, 111129, 263-993; 1783, BAG6, 8680, 111130, 1-554; 1783, BAG6, 8681, 111131, 217-807; 1783, BAG6, 8682, 111132, 103-747; 1783, BAG6, 8683, 111133, 33-766; 1783, BAG6, 8684, 111134, 282-1056; 1783, BAG6, 8685, 111135, 69-544; 1783, BAG6, 8686, 111136, 147-844; 1783, BAG6, 8687, 111137, 126-859; 1783, BAG6, 8688, 111138, 147-844; 1783, BAG6, 8689, 111139, 263-993; 1783, BAG6, 8690, 111140, 217-807; 1783, BAG6, 8691, 111141, 1-410; 1783, BAG6, 8692, 111142, 165-3545; 1783, BAG6, 8693, 111143, 217-807; 1783, BAG6, 8694, 111144, 103-747;

1783, BAG6, 8695, 111145, 296-3676; 1783, BAG6, 8696, 111146, 147-844; 1783, BAG6, 8697, 111147, 1-410; 1783, BAG6, 8698, 111148, 1-410; 1783, BAG6, 8699, 111149, 180-2407; 1783, BAG6, 8700, 111150, 93-880; 1783, BAG6, 8701, 111151, 1-680; 1783, BAG6, 8702, 111152, 126-859; 1783, BAG6, 8703, 111153, 266-1051; 1783, BAG6, 8705, 111155, 103-747; 1783, BAG6, 8706, 111156, 1-714; 1783, BAG6, 8707, 111157, 147-844; 1783, BAG6, 8708, 111158, 33-766; 1783, BAG6, 8709, 111159, 1-714; 1783, BAG6, 8710, 111160, 282-1056; 1783, BAG6, 8711, 111161, 166-1710; 1783, BAG6, 8712, 111162, 217-807; 1783, BAG6, 8713, 111163, 1-736; 1783, BAG6, 8715, 111165, 1-410; 1783, BAG6, 8716, 111166, 1-410; 1783, BAG6, 8717, 111167, 36-654; 1783, BAG6, 8718, 111168, 250-3648; 1783, BAG6, 8719, 111169, 250-3648; 1783, BAG6, 8720, 111170, 1-554; 1783, BAG6, 8721, 111171, 1-736; 1783, BAG6, 8722, 111172, 266-1051; 1783, BAG6, 8724, 111174, 1-680; 1783, BAG6, 8725, 111175, 263-993; 1783, BAG6, 8726, 111176, 282-1056; 1783, BAG6, 8727, 111177, 33-766; 1783, BAG6, 8728, 111178, 296-3676; 1783, BAG6, 8729, 111179, 250-3648; 1783, BAG6, 8730, 111180, 93-880; 1783, BAG6, 8731, 111181, 161-3541; 1783, BAG6, 8732, 111182, 1-680; 1783, BAG6, 8733, 111183, 266-1051; 1783, BAG6, 8734, 111184, 1-554; 1783, BAG6, 8735, 111185, 1-680; 1783, BAG6, 8739, 111189, 291-3524; 1783, BAG6, 8740, 111190, 291-3524; 1783, BAG6, 8741, 111191, 291-3524; 1783, BAG6, 8582, 111032, 296-3676; 1783, BAG6, 8583, 111033, 250-3648; 1783, BAG6, 8584, 111034, 291-3524; 1783, BAG6, 8585, 111035, 315-3713; 1783, BAG6, 8586, 111036, 161-3541; 1783, BAG6, 8587, 111037, 169-3549; 1783, BAG6, 8588, 111038, 296-3676; 1783, BAG6, 8595, 111045, 296-3676; 1783, BAG6, 8601, 111051, 250-3648; 1783, BAG6, 8636, 111086, 250-3648; 1783, BAG6, 8657, 111107, 291-3002; 1783, BAG6, 8704, 111154, 165-3545; 1783, BAG6, 8714, 111164, 296-3676; 1783, BAG6, 8723, 111173, 161-3541; 1783, BAG6, 8736, 111186, 291-3524; 1783, BAG6, 8737, 111187, 291-3524; 1783, BAG6, 8738, 111188, 291-3524; 1783, BAG6, 8742, 111192, 291-3002; 1783, BAG6, 8743, 111193, 291-3002; 1783, BAG6, 8744, 111194, 291-3002; 1783, BAG6, 8745, 111195, 291-3002; 1783, BAG6, 8746, 111196, 291-3002; 1783, BAG6, 8747, 111197, 291-3002; 1784, BCLAF1, 8750, 111200, 247-2423; 1784, BCLAF1, 8751, 111201, 244-2502; 1784, BCLAF1, 8752, 111202, 198-1601; 1784, BCLAF1, 8755, 111205, 232-2847; 1784, BCLAF1, 8756, 111206, 187-2439; 1784, BCLAF1, 8757, 111207, 198-2456; 1784, BCLAF1, 8759, 111209, 1-357; 1784, BCLAF1, 8760, 111210, 1-562; 1784, BCLAF1, 8761, 111211, 1-380; 1784, BCLAF1, 8762, 111212, 254-2512; 1784, BCLAF1, 8748, 111198, 254-2863; 1784, BCLAF1, 8749, 111199, 1-2610; 1784, BCLAF1, 8753, 111203, 198-2954; 1784, BCLAF1, 8754, 111204, 254-3016; 1784, BCLAF1, 8758, 111208, 184-2427; 1785, BAX, 8767, 111217, 1-528; 1785, BAX, 8769, 111219, 1-380; 1785, BAX, 8771, 111221, 36-458; 1785, BAX, 8763, 111213, 53-631; 1785, BAX, 8764, 111214, 1-657; 1785, BAX, 8765, 111215, 1-432; 1785, BAX, 8766, 111216, 1-495; 1785, BAX, 8768, 111218, 1-540; 1785, BAX, 8770, 111220, 1-126; 1786, BIK, 8772, 111222, 64-546; 1787, BCL2L2-PABPN1, 8773, 111223, 157-1158; 1787, BCL2L2-PABPN1, 8774, 111224, 322-1323; 1788, BCL2L1, 8778, 111228, 239-781; 1788, BCL2L1, 8779, 111229, 257-820; 1788, BCL2L1, 8780, 111230, 351-914; 1788, BCL2L1, 8781, 111231, 236-381; 1788, BCL2L1, 8782, 111232, 279-894; 1788, BCL2L1, 8783, 111233, 594-1157; 1788, BCL2L1, 8775, 111225, 412-1113; 1788, BCL2L1, 8776, 111226, 374-886; 1788, BCL2L1, 8777, 111227, 380-1081; 1789, BCL2L10, 8785, 111235, 43-768; 1789, BCL2L10, 8784, 111234, 50-664; 1790, BCL2L11, 8788, 111238, 289-585; 1790, BCL2L11, 8789, 111239, 1-228; 1790, BCL2L11, 8790, 111240, 268-482; 1790, BCL2L11, 8793, 111243, 1-291; 1790, BCL2L11, 8800, 111250, 206-572; 1790, BCL2L11, 8786, 111236, 289-705; 1790, BCL2L11, 8787, 111237, 289-627; 1790, BCL2L11, 8791, 111241, 274-870; 1790, BCL2L11, 8792, 111242, 1-339; 1790, BCL2L11, 8794, 111244, 1-249; 1790, BCL2L11, 8795, 111245, 1-243; 1790, BCL2L11, 8796, 111246, 1-408; 1790, BCL2L11, 8797, 111247, 244-573; 1790, BCL2L11, 8798, 111248, 1-423; 1790, BCL2L11, 8799, 111249, 1-258; 1790, BCL2L11, 8801, 111251, 1-519; 1790, BCL2L11, 8802, 111252, 289-618; 1790, BCL2L11, 8803, 111253, 289-696; 1790, BCL2L11, 8804, 111254, 289-711; 1790, BCL2L11, 8805, 111255, 289-546; 1790, BCL2L11, 8806, 111256, 289-798; 1790, BCL2L11, 8807, 111257, 289-807; 1790, BCL2L11, 8808, 111258, 289-696; 1791, BCL2L12, 8809, 111259, 70-822; 1791, BCL2L12, 8812, 111262, 116-394; 1791, BCL2L12, 8813, 111263, 78-494; 1791, BCL2L12, 8814, 111264, 116-394; 1791, BCL2L12, 8815, 111265, 64-342; 1791, BCL2L12, 8816, 111266, 683-1075; 1791, BCL2L12, 8817, 111267, 683-1264; 1791, BCL2L12, 8819, 111269, 683-1492; 1791, BCL2L12, 8810, 111260, 259-1263; 1791, BCL2L12, 8811, 111261, 259-1260; 1791, BCL2L12, 8818, 111268, 683-1687; 1792, BCL2L13, 8821, 111271, 354-740; 1792, BCL2L13, 8822, 111272, 127-642; 1792, BCL2L13, 8823, 111273, 1-115; 1792, BCL2L13, 8827, 111277, 197-433; 1792, BCL2L13, 8829, 111279, 354-632; 1792, BCL2L13, 8830, 111280, 111-1496; 1792, BCL2L13, 8831, 111281, 354-596; 1792, BCL2L13, 8832, 111282, 111-1640; 1792, BCL2L13, 8820, 111270, 348-1805; 1792, BCL2L13, 8824, 111274, 740-1345; 1792, BCL2L13, 8825, 111275, 770-1741; 1792, BCL2L13, 8826, 111276, 166-771; 1792, BCL2L13, 8828, 111278, 683-1654; 1793, BCL2L14, 8837, 111287, 426-598; 1793, BCL2L14, 8838, 111288, 388-762; 1793, BCL2L14, 8839, 111289, 54-583; 1793, BCL2L14, 8840, 111290, 149-1231; 1793, BCL2L14, 8844, 111294, 54-583; 1793, BCL2L14, 8846, 111296, 149-1231; 1793, BCL2L14, 8848, 111298, 388-762; 1793, BCL2L14, 8850, 111300, 426-598; 1793, BCL2L14, 8833, 111283, 196-954; 1793, BCL2L14, 8834, 111284, 8-838; 1793, BCL2L14, 8835, 111285, 207-1190; 1793, BCL2L14, 8836, 111286, 196-1179; 1793, BCL2L14, 8841, 111291, 171-1154; 1793, BCL2L14, 8842, 111292, 8-838; 1793, BCL2L14, 8843, 111293, 171-1154; 1793, BCL2L14, 8845, 111295, 196-954; 1793, BCL2L14, 8847, 111297, 207-1190; 1793, BCL2L14, 8849, 111299, 196-1179; 1794, BCL2L15, 8853, 111303, 1-267; 1794, BCL2L15, 8851, 111301, 173-664; 1794, BCL2L15, 8852, 111302, 63-233; 1795, BCL2L2, 8855, 111305, 394-548; 1795, BCL2L2, 8856, 111306, 1-502; 1795, BCL2L2, 8857, 111307, 331-545; 1795, BCL2L2, 8858, 111308, 185-631; 1795, BCL2L2, 8859, 111309, 165-596; 1795, BCL2L2, 8854, 111304, 230-811; 1796, BOK, 8860, 111310, 303-941; 1797, BCL2A1, 8861, 111311, 328-855; 1797, BCL2A1, 8862, 111312, 51-542; 1798, BCOR, 8866, 111316, 261-2129; 1798, BCOR, 8868, 111318, 355-4216; 1798, BCOR, 8869, 111319, 1-999; 1798, BCOR, 8870, 111320, 203-288; 1798, BCOR, 8871, 111321, 1-869; 1798, BCOR, 8872, 111322, 1-1785; 1798, BCOR, 8873, 111323, 996-2231; 1798, BCOR, 8863, 111313, 364-5529; 1798, BCOR, 8864, 111314, 230-5497; 1798, BCOR, 8865, 111315, 364-5475; 1798, BCOR, 8867, 111317, 230-5395; 1799, BCORL1, 8875, 111325, 1-4158; 1799, BCORL1, 8876, 111326, 1-2221; 1799, BCORL1, 8878, 111328, 296-433; 1799, BCORL1, 8879, 111329, 383-468; 1799, BCORL1, 8874, 111324, 198-5333; 1799, BCORL1, 8877, 111327, 45-5180; 1800, BFSP1, 8880, 111330, 272-1894; 1800, BFSP1, 8881, 111331, 41-2038; 1800, BFSP1, 8882, 111332, 435-2015; 1801, BFSP2, 8883, 111333, 90-1337; 1802, BECN1, 8885, 111335, 136-975; 1802, BECN1, 8887, 111337, 136-366; 1802, BECN1, 8888, 111338, 1-168; 1802, BECN1, 8889, 111339, 1-689; 1802, BECN1, 8890, 111340, 1-319; 1802, BECN1, 8891, 111341, 100-629; 1802, BECN1, 8892, 111342, 384-561; 1802, BECN1, 8893, 111343, 1-399; 1802, BECN1, 8894, 111344, 1-218; 1802, BECN1, 8895, 111345, 1-329; 1802, BECN1, 8896, 111346, 500-559; 1802, BECN1, 8884, 111334, 134-1486; 1802, BECN1, 8886, 111336, 112-1464; 1803, BECN2, 8897, 111347, 1-1296; 1804, BEND2, 8898, 111348, 1-1938; 1804, BEND2, 8899, 111349, 134-2533; 1805, BEND3, 8900, 111350, 192-2678; 1805, BEND3, 8901, 111351, 651-3137; 1806, BEND4, 8902, 111352, 593-1906; 1806, BEND4, 8904, 111354, 53-1270; 1806, BEND4, 8903, 111353, 581-2185; 1807, BEND5, 8905, 111355, 88-1353; 1808, BEND6, 8906, 111356, 190-579; 1808, BEND6, 8907, 111357, 270-1109; 1808, BEND6, 8908, 111358, 436-756; 1809, BEND7, 8911, 111361, 1-354; 1809, BEND7, 8909, 111359, 298-1704; 1809, BEND7, 8910, 111360, 97-1221; 1810, BZRAP1, 8914, 111364, 1-516; 1810, BZRAP1, 8915, 111365, 1-887; 1810, BZRAP1, 8916, 111366, 1-809; 1810, BZRAP1, 8912, 111362, 841-6234; 1810, BZRAP1, 8913, 111363, 165-5738; 1811, BSCL2, 8918, 111368, 324-1157; 1811, BSCL2, 8921, 111371, 1-240; 1811, BSCL2, 8922, 111372, 498-1892; 1811, BSCL2, 8924, 111374, 269-388; 1811, BSCL2, 8925, 111375, 1-453; 1811, BSCL2, 8927, 111377, 322-992; 1811, BSCL2, 8928, 111378, 516-794; 1811, BSCL2, 8929, 111379, 187-865; 1811, BSCL2, 8930, 111380, 288-585; 1811, BSCL2, 8931, 111381, 455-539; 1811, BSCL2, 8932, 111382, 294-662; 1811, BSCL2, 8933, 111383, 512-844; 1811, BSCL2, 8934, 111384, 484-553; 1811, BSCL2, 8935, 111385, 1-154; 1811, BSCL2, 8917, 111367, 219-1082; 1811, BSCL2, 8919, 111369, 204-1592; 1811, BSCL2, 8920, 111370, 248-1444; 1811, BSCL2, 8923, 111373, 425-1621; 1811, BSCL2, 8926, 111376, 192-1388; 1812, BEST1, 8938, 111388, 577-744; 1812, BEST1, 8939, 111389, 105-1412; 1812, BEST1, 8940, 111390, 162-1151; 1812, BEST1, 8936, 111386, 644-2401; 1812, BEST1, 8937, 111387, 87-1901; 1813, BEST2, 8944, 111394, 1-236; 1813, BEST2, 8941, 111391, 1-1530; 1813, BEST2, 8942, 111392, 90-1619; 1813, BEST2, 8943, 111393, 325-1854; 1814, BEST3, 8949, 111399, 332-925; 1814, BEST3, 8950, 111400, 147-572; 1814, BEST3, 8951, 111401, 237-720; 1814, BEST3, 8954, 111404, 210-641; 1814, BEST3, 8945, 111395, 344-562; 1814, BEST3, 8946, 111396, 173-1369; 1814, BEST3, 8947, 111397, 228-2234; 1814, BEST3, 8948, 111398, 213-1580; 1814, BEST3, 8952, 111402, 358-576; 1814, BEST3, 8953, 111403, 153-1841; 1815, BEST4, 8955, 111405, 1-1422; 1816, BET1, 8957, 111407, 140-523; 1816, BET1, 8959, 111409, 1-400; 1816, BET1, 8960, 111410, 167-463; 1816, BET1, 8956, 111406, 160-516; 1816, BET1, 8958, 111408, 146-397; 1817, BET1L, 8961, 111411, 36-212; 1817, BET1L, 8962, 111412, 62-370; 1817, BET1L, 8964, 111414, 63-521; 1817, BET1L, 8965, 111415, 266-532; 1817, BET1L, 8966, 111416, 54-332; 1817, BET1L, 8963, 111413, 108-443; 1818, B3GLCT, 8967, 111417, 150-1646; 1819, B3GAT1, 8968, 111418, 394-1398; 1819, B3GAT1, 8969, 111419, 262-1266; 1819, B3GAT1, 8970, 111420, 4546-5550; 1820, B3GAT2, 8972, 111422, 1-756; 1820, B3GAT2, 8971, 111421, 610-1581; 1821, B3GAT3, 8974, 111424, 208-1167; 1821, B3GAT3, 8976, 111426, 38-154; 1821, B3GAT3, 8977, 111427, 200-868; 1821, B3GAT3, 8973, 111423, 229-1236; 1821, B3GAT3, 8975, 111425, 38-985; 1822, B3GALNT1, 8981, 111431, 64-339; 1822, B3GALNT1, 8982, 111432, 134-584; 1822, B3GALNT1, 8983, 111433, 380-541; 1822, B3GALNT1, 8985, 111435, 467-662; 1822, B3GALNT1, 8986, 111436, 578-666; 1822, B3GALNT1, 8987, 111437, 582-914; 1822, B3GALNT1, 8988, 111438, 429-552; 1822, B3GALNT1, 8990, 111440, 397-572; 1822, B3GALNT1, 8978, 111428, 399-1394; 1822, B3GALNT1, 8979, 111429, 350-1345; 1822, B3GALNT1, 8980, 111430, 749-1744; 1822, B3GALNT1, 8984, 111434, 352-1347; 1822, B3GALNT1, 8989, 111439, 665-1660; 1823, B3GALNT2, 8993, 111443, 3-281; 1823, B3GALNT2, 8994, 111444, 171-1151; 1823, B3GALNT2, 8995, 111445, 3-281; 1823, B3GALNT2, 8996, 111446, 230-1732; 1823, B3GALNT2, 8991, 111441, 171-1151; 1823, B3GALNT2, 8992, 111442, 230-1732; 1824, B4GAT1, 8997, 111447, 148-1395; 1825, B4GALNT1, 9000, 111450, 477-837; 1825, B4GALNT1, 9001, 111451, 117-812; 1825, B4GALNT1, 9002, 111452, 1-383; 1825, B4GALNT1, 9003, 111453, 130-841; 1825, B4GALNT1, 9004, 111454, 111-401; 1825, B4GALNT1, 9006, 111456, 1-453; 1825, B4GALNT1, 9007, 111457, 174-419; 1825, B4GALNT1, 9009, 111459, 470-1384; 1825, B4GALNT1, 8998, 111448, 586-2187; 1825, B4GALNT1, 8999, 111449, 109-1545; 1825, B4GALNT1, 9005, 111455, 130-1116; 1825, B4GALNT1, 9008, 111458, 433-1419; 1826, B4GALNT2, 9010, 111460, 60-1760; 1826, B4GALNT2, 9011, 111461, 25-1545; 1826, B4GALNT2, 9012, 111462, 116-1558; 1827, B4GALNT3, 9014, 111464, 17-1926; 1827, B4GALNT3, 9013, 111463, 14-3010; 1828, B4GALNT4, 9016, 111466, 1-162; 1828, B4GALNT4, 9017, 111467, 1-81; 1828, B4GALNT4, 9015, 111465, 1-3120; 1829, B2M, 9018, 111468, 31-204; 1829, B2M, 9019, 111469, 61-366; 1829, B2M, 9021, 111471, 29-184; 1829, B2M, 9022, 111472, 1-216; 1829, B2M, 9026, 111476, 61-366; 1829, B2M, 9027, 111477, 29-184; 1829, B2M, 9028, 111478, 1-216; 1829, B2M, 9030, 111480, 31-204; 1829, B2M, 9020, 111470, 71-430; 1829, B2M, 9023, 111473, 39-398; 1829, B2M, 9024, 111474, 35-394; 1829, B2M, 9025, 111475, 71-430; 1829, B2M, 9029, 111479, 39-398; 1829, B2M, 9031, 111481, 35-394; 1830, BCO1, 9033, 111483, 219-707; 1830, BCO1, 9034, 111484, 221-466; 1830, BCO1, 9032, 111482, 462-2105; 1831, BCO2, 9039, 111489, 1-215; 1831, BCO2, 9040, 111490, 1-817; 1831, BCO2, 9041, 111491, 87-239; 1831, BCO2, 9042, 111492, 71-367; 1831, BCO2, 9044, 111494, 57-209; 1831, BCO2, 9046, 111496, 1-635; 1831, BCO2, 9035, 111485, 136-1875; 1831, BCO2, 9036, 111486, 81-1601; 1831, BCO2, 9037, 111487, 718-2355; 1831, BCO2, 9038, 111488, 107-1531; 1831, BCO2, 9043, 111493, 103-1722; 1831, BCO2, 9045, 111495, 74-1711; 1832, BTC, 9048, 111498, 1-326; 1832, BTC, 9047, 111497, 362-898; 1833, CRYBG3, 9050, 111500, 186-578; 1833, CRYBG3, 9049, 111499, 168-9080; 1834, BHMT, 9052, 111502, 78-839; 1834, BHMT, 9051, 111501, 108-1328; 1835, BHMT2, 9054, 111504, 320-524; 1835, BHMT2, 9055, 111505, 15-191; 1835, BHMT2, 9053, 111503, 67-1158; 1835, BHMT2, 9056, 111506, 17-916; 1836, BACE1, 9062, 111512, 465-1868; 1836, BACE1, 9063, 111513, 491-611; 1836, BACE1, 9064, 111514, 409-561; 1836, BACE1, 9057, 111507, 462-1967; 1836, BACE1, 9058, 111508, 4-1302; 1836, BACE1, 9059, 111509, 4-1377; 1836, BACE1, 9060, 111510, 27-1157; 1836, BACE1, 9061, 111511, 4-1434; 1836, BACE1, 9065, 111515, 90-1295; 1837, BACE2, 9066, 111516, 464-1870; 1837, BACE2, 9067, 111517, 464-2020; 1837, BACE2, 9068, 111518, 464-1654; 1838, BTRC, 9069, 111519, 83-655; 1838, BTRC, 9071, 111521, 149-1888; 1838, BTRC, 9070, 111520, 119-1936; 1838, BTRC, 9072, 111522, 75-1784; 1839, BID, 9081, 111531, 174-542; 1839, BID, 9073, 111523, 328-1053; 1839, BID, 9074, 111524, 91-504; 1839, BID, 9075, 111525, 175-474; 1839, BID, 9076, 111526, 392-691; 1839, BID, 9077, 111527, 171-758; 1839, BID, 9078, 111528, 85-672; 1839, BID, 9079, 111529, 251-550; 1839, BID, 9080, 111530, 174-761; 1839, BID, 9082, 111532, 499-798; 1839, BID, 9083, 111533, 92-391; 1840, BLID, 9084, 111534, 294-620; 1841, BICD1, 9086, 111536, 81-2564; 1841, BICD1, 9088, 111538, 37-318; 1841, BICD1, 9089, 111539, 448-687; 1841, BICD1, 9091, 111541, 1-208; 1841, BICD1, 9092, 111542, 1-521; 1841, BICD1, 9085, 111535, 104-3031; 1841, BICD1, 9087, 111537, 182-2689; 1841, BICD1, 9090, 111540, 498-779; 1842, BICD2, 9093, 111543, 69-2636; 1842, BICD2, 9094, 111544, 69-2543; 1843, BICC1, 9095, 111545, 25-1545; 1843, BICC1, 9096, 111546, 5-2929; 1844, BFAR, 9098, 111548, 162-1139; 1844, BFAR, 9099, 111549, 1-309; 1844, BFAR, 9100, 111550, 119-388; 1844, BFAR, 9101, 111551, 395-722; 1844, BFAR, 9102, 111552, 1-619; 1844, BFAR, 9103, 111553, 1-294; 1844, BFAR, 9104, 111554, 60-485; 1844, BFAR, 9106, 111556, 161-802; 1844, BFAR, 9107, 111557, 162-1139; 1844, BFAR, 9108, 111558, 119-388; 1844, BFAR, 9109, 111559, 161-802; 1844, BFAR, 9110, 111560, 60-485; 1844, BFAR, 9111, 111561, 1-619; 1844, BFAR, 9112, 111562, 1-294; 1844, BFAR, 9113, 111563, 1-309; 1844, BFAR, 9114, 111564, 395-722; 1844, BFAR, 9097, 111547, 278-1630; 1844, BFAR, 9105, 111555, 278-1630; 1845, BGN, 9116, 111566, 133-846; 1845, BGN, 9115, 111565, 187-1293; 1846, BMT, 9117, 111567, 110-1366; 1846, BMT, 9118, 111568, 72-1328; 1846, BAAT, 9119, 111569, 72-1328; 1847, BLVRA, 9122, 111572, 137-443; 1847, BLVRA, 9120, 111570, 77-967; 1847, BLVRA, 9121, 111571, 164-1054; 1848, BLVRB, 9124, 111574, 48-512; 1848, BLVRB, 9125, 111575, 58-549; 1848, BLVRB, 9123, 111573, 153-773; 1849, BSPH1, 9126, 111576, 90-488; 1850, BLOC1S1, 9127, 111577, 1-136; 1850, BLOC1S1, 9129, 111579, 295-489; 1850, BLOC1S1, 9130, 111580, 516-743; 1850, BLOC1S1, 9131, 111581, 204-431; 1850, BLOC1S1, 9132, 111582, 15-443; 1850, BLOC1S1, 9128, 111578, 16-477; 1851, BLOC1S2, 9135, 111585, 1-354; 1851, BLOC1S2, 9137, 111587, 1-288; 1851, BLOC1S2, 9133, 111583, 54-482; 1851, BLOC1S2, 9134, 111584, 219-518; 1851, BLOC1S2, 9136, 111586, 153-452; 1852, BLOC1S3, 9139, 111589, 1-237; 1852, BLOC1S3, 9138, 111588, 97-705; 1852, BLOC1S3, 9140, 111590, 75-683; 1853, BLOC1S4, 9141, 111591, 156-809; 1854, BLOC1S5, 9142, 111592, 18-362; 1854, BLOC1S5, 9144, 111594, 1-273; 1854, BLOC1S5, 9145, 111595, 21-227; 1854, BLOC1S5, 9143, 111593, 39-602; 1855, BLOC1S6, 9147, 111597, 93-224; 1855, BLOC1S6, 9148, 111598, 262-402; 1855, BLOC1S6, 9149, 111599, 69-329; 1855, BLOC1S6, 9150, 111600, 275-338; 1855, BLOC1S6, 9151, 111601, 217-557; 1855, BLOC1S6, 9152, 111602, 590-817; 1855, BLOC1S6, 9153, 111603, 1-172; 1855, BLOC1S6, 9154, 111604, 302-529; 1855, BLOC1S6, 9155, 111605, 21-416; 1855, BLOC1S6, 9156, 111606, 358-585; 1855, BLOC1S6, 9158, 111608, 84-617; 1855, BLOC1S6, 9159, 111609, 254-481; 1855, BLOC1S6, 9160, 111610, 90-347; 1855, BLOC1S6, 9146, 111596, 322-840; 1855, BLOC1S6, 9157, 111607, 66-308; 1856, BOD1, 9163, 111613, 229-353; 1856, BOD1, 9164, 111614, 1-355; 1856, BOD1, 9165, 111615, 218-475; 1856, BOD1, 9161, 111611, 153-542; 1856, BOD1, 9162, 111612, 225-782; 1857, BOD1L1, 9167, 111617, 115-396; 1857, BOD1L1, 9168, 111618, 1-623; 1857, BOD1L1, 9166, 111616, 137-9292; 1858, BOD1L2, 9169, 111619, 252-770; 1859, BTD, 9173, 111623, 359-1112; 1859, BTD, 9174, 111624, 324-499; 1859, BTD, 9176, 111626, 19-213; 1859, BTD, 9170, 111620, 110-1741; 1859, BTD, 9171, 111621, 359-1930; 1859, BTD, 9172, 111622, 89-1726; 1859, BTD, 9175, 111625, 233-1870; 1860, BPHL, 9177, 111627, 213-797; 1860, BPHL, 9181, 111631, 366-500; 1860, BPHL, 9182, 111632, 1-89; 1860, BPHL, 9183, 111633, 366-500; 1860, BPHL, 9184, 111634, 50-685; 1860, BPHL, 9178, 111628, 132-956; 1860, BPHL, 9179, 111629, 50-925; 1860, BPHL, 9180, 111630, 362-1186; 1861, BIVM-ERCC5, 9185, 111635, 1-4155; 1862, BLCAP, 9191, 111641, 552-572; 1862, BLCAP, 9192, 111642, 396-581; 1862, BLCAP, 9194, 111644, 354-588; 1862, BLCAP, 9186, 111636, 316-579; 1862, BLCAP, 9187, 111637, 352-615; 1862, BLCAP, 9188, 111638, 245-508; 1862, BLCAP, 9189, 111639, 327-590; 1862, BLCAP, 9190, 111640, 279-542; 1862, BLCAP, 9193, 111643, 449-712; 1862, BLCAP, 9195, 111645, 329-591; 1863, BLMH, 9197, 111647, 31-246; 1863, BLMH, 9198, 111648, 1-788; 1863, BLMH, 9199, 111649, 360-561; 1863, BLMH, 9200, 111650, 176-457; 1863, BLMH, 9201, 111651, 67-1020; 1863, BLMH, 9202, 111652, 130-823; 1863, BLMH, 9196, 111646, 176-1543; 1864, BLK, 9204, 111654, 293-1597; 1864, BLK, 9203, 111653, 593-2110; 1865, BORCS5, 9207, 111657, 40-573; 1865, BORCS5, 9208, 111658, 40-573; 1865, BORCS5, 9209, 111659, 332-922; 1865, BORCS5, 9210, 111660, 35-481; 1865, BORCS5, 9205, 111655, 35-481; 1865, BORCS5, 9206, 111656, 332-922; 1866, BORCS6, 9211, 111661, 768-1841; 1867, BORCS7, 9212, 111662, 65-385; 1867, BORCS7, 9213, 111663, 26-346; 1868, BORCS8, 9216, 111666, 1-210; 1868, BORCS8, 9218, 111668, 149-337; 1868, BORCS8, 9214, 111664, 473-802; 1868, BORCS8, 9215, 111665, 473-832; 1868, BORCS8, 9217, 111667, 296-655; 1869, BLOC1S5-TXNDC5, 9219, 111669, 1-411; 1870, BOP1, 9221, 111671, 1-651; 1870, BOP1, 9220, 111670, 1-2241; 1871, BVES, 9222, 111672, 218-1300; 1871, BVES, 9223, 111673, 105-1187; 1871, BVES, 9224, 111674, 160-1242; 1872, BLM, 9226, 111676, 42-1283; 1872, BLM, 9227, 111677, 52-3912; 1872, BLM, 9225, 111675, 119-4372; 1873, BMI1, 9229, 111679, 1-552; 1873, BMI1, 9230, 111680, 85-536; 1873, BMI1, 9231, 111681, 92-406; 1873, BMI1, 9228, 111678, 506-1486; 1874, BAMBI, 9232, 111682, 557-1339; 1875, BMPER, 9234, 111684, 375-647; 1875, BMPER, 9235, 111685, 82-565; 1875, BMPER, 9236, 111686, 76-477; 1875, BMPER, 9233, 111683, 375-2432; 1876, BMP2K, 9238, 111688, 203-1270; 1876, BMP2K, 9240, 111690, 1-2563; 1876, BMP2K, 9241, 111691, 167-1234; 1876, BMP2K, 9237, 111687, 167-3652; 1876, BMP2K, 9239, 111689, 167-2155; 1877, BMS1, 9242, 111692, 64-3912; 1878, BMX, 9243, 111693, 122-2149; 1878, BMX, 9244, 111694, 102-2129; 1878, BMX, 9245, 111695, 189-2216; 1879, ABO, 9246, 111696, 26-1090; 1880, BBX, 9248, 111698, 420-3095; 1880, BBX, 9249, 111699, 242-1586; 1880, BBX, 9251, 111701, 244-601; 1880, BBX, 9252, 111702, 354-392; 1880, BBX, 9253, 111703, 367-581; 1880, BBX, 9254, 111704, 1-396; 1880, BBX, 9255, 111705, 1-238; 1880, BBX, 9256, 111706, 373-819; 1880, BBX, 9258, 111708, 221-513; 1880, BBX, 9259, 111709, 302-556; 1880, BBX, 9260, 111710, 212-552; 1880, BBX, 9261, 111711, 367-843; 1880, BBX, 9262, 111712, 244-675; 1880, BBX, 9264, 111714, 479-550; 1880, BBX, 9265, 111715, 256-871; 1880, BBX, 9266, 111716, 379-959; 1880, BBX, 9267, 111717, 42-539; 1880, BBX, 9247, 111697, 288-3113; 1880, BBX, 9250, 111700, 538-3273; 1880, BBX, 9257, 111707, 221-2107; 1880,

BBX, 9263, 111713, 328-3063; 1881, BOC, 9270, 111720, 152-625; 1881, BOC, 9271, 111721, 329-582; 1881, BOC, 9272, 111722, 497-561; 1881, BOC, 9273, 111723, 1-119; 1881, BOC, 9274, 111724, 448-544; 1881, BOC, 9276, 111726, 509-703; 1881, BOC, 9277, 111727, 1-253; 1881, BOC, 9278, 111728, 626-1099; 1881, BOC, 9268, 111718, 340-3687; 1881, BOC, 9269, 111719, 340-3684; 1881, BOC, 9275, 111725, 705-4049; 1882, BOLA1, 9279, 111729, 323-736; 1882, BOLA1, 9280, 111730, 127-540; 1882, BOLA1, 9281, 111731, 665-1078; 1883, BOLA2, 9283, 111733, 112-570; 1883, BOLA2, 9282, 111732, 514-972; 1884, BOLA2B, 9285, 111735, 1-245; 1884, BOLA2B, 9286, 111736, 1-267; 1884, BOLA2B, 9284, 111734, 514-972; 1885, BOLA3, 9287, 111737, 32-337; 1885, BOLA3, 9288, 111738, 121-444; 1886, BRS3, 9289, 111739, 229-1428; 1887, BGLAP, 9290, 111740, 271-573; 1888, BST1, 9292, 111742, 50-1051; 1888, BST1, 9293, 111743, 1-468; 1888, BST1, 9294, 111744, 1-560; 1888, BST1, 9295, 111745, 1-293; 1888, BST1, 9291, 111741, 196-1152; 1889, BST2, 9296, 111746, 74-616; 1890, BMP1, 9299, 111749, 267-1175; 1890, BMP1, 9300, 111750, 267-836; 1890, BMP1, 9301, 111751, 155-724; 1890, BMP1, 9302, 111752, 7-915; 1890, BMP1, 9305, 111755, 83-652; 1890, BMP1, 9306, 111756, 83-268; 1890, BMP1, 9308, 111758, 72-641; 1890, BMP1, 9297, 111747, 671-3631; 1890, BMP1, 9298, 111748, 155-2347; 1890, BMP1, 9303, 111753, 220-2412; 1890, BMP1, 9304, 111754, 7-1875; 1890, BMP1, 9307, 111757, 7-2160; 1891, BMP10, 9309, 111759, 160-1434; 1892, BMP15, 9310, 111760, 1-1179; 1893, BMP2, 9311, 111761, 1220-2410; 1894, BMP3, 9312, 111762, 321-1739; 1895, BMP4, 9315, 111765, 298-1112; 1895, BMP4, 9316, 111766, 175-505; 1895, BMP4, 9318, 111768, 1-315; 1895, BMP4, 9320, 111770, 1-90; 1895, BMP4, 9313, 111763, 395-1621; 1895, BMP4, 9314, 111764, 265-1491; 1895, BMP4, 9317, 111767, 186-1412; 1895, BMP4, 9319, 111769, 188-1414; 1896, BMP5, 9321, 111771, 700-2064; 1897, BMP6, 9322, 111772, 160-1701; 1898, BMP7, 9324, 111774, 221-1318; 1898, BMP7, 9325, 111775, 1-890; 1898, BMP7, 9326, 111776, 508-1746; 1898, BMP7, 9323, 111773, 507-1802; 1899, BMP8A, 9327, 111777, 347-1555; 1900, BMP8B, 9328, 111778, 377-1585; 1900, BMP8B, 9329, 111779, 365-1414; 1901, BMPR1A, 9331, 111781, 299-421; 1901, BMPR1A, 9330, 111780, 538-2136; 1902, BMPR1B, 9335, 111785, 357-731; 1902, BMPR1B, 9337, 111787, 212-556; 1902, BMPR1B, 9332, 111782, 155-1663; 1902, BMPR1B, 9333, 111783, 71-1579; 1902, BMPR1B, 9334, 111784, 22-1620; 1902, BMPR1B, 9336, 111786, 112-1620; 1902, BMPR1B, 9338, 111788, 171-1679; 1902, BMPR1B, 9339, 111789, 284-1792; 1903, BMPR2, 9340, 111790, 42-1634; 1903, BMPR2, 9341, 111791, 540-3656; 1904, BRINP1, 9342, 111792, 463-2748; 1904, BRINP1, 9343, 111793, 421-1383; 1905, BRINP2, 9344, 111794, 313-2664; 1906, BRINP3, 9346, 111796, 445-528; 1906, BRINP3, 9347, 111797, 256-729; 1906, BRINP3, 9345, 111795, 486-2786; 1907, BORA, 9348, 111798, 1-642; 1907, BORA, 9350, 111800, 95-1954; 1907, BORA, 9351, 111801, 148-2052; 1907, BORA, 9352, 111802, 92-436; 1907, BORA, 9349, 111799, 204-1673; 1908, BORCS7-ASMT, 9353, 111803, 16-336; 1909, BORCS8-MEF2B, 9354, 111804, 268-1365; 1909, BORCS8-MEF2B, 9355, 111805, 148-1296; 1909, BORCS8-MEF2B, 9356, 111806, 42-401; 1909, BORCS8-MEF2B, 9357, 111807, 6-365; 1909, BORCS8-MEF2B, 9358, 111808, 42-401; 1909, BORCS8-MEF2B, 9359, 111809, 12-371; 1910, BOLL, 9364, 111814, 398-1399; 1910, BOLL, 9365, 111815, 310-573; 1910, BOLL, 9360, 111810, 542-1066; 1910, BOLL, 9361, 111811, 572-1459; 1910, BOLL, 9362, 111812, 311-1162; 1910, BOLL, 9363, 111813, 398-1249; 1911, BPIFA1, 9366, 111816, 72-842; 1911, BPIFA1, 9367, 111817, 72-842; 1911, BPIFA1, 9368, 111818, 72-842; 1911, BPIFA1, 9369, 111819, 1-729; 1912, BPIFA2, 9370, 111820, 147-896; 1912, BPIFA2, 9371, 111821, 72-821; 1913, BPIFA3, 9372, 111822, 186-842; 1913, BPIFA3, 9373, 111823, 211-975; 1914, BPIFB1, 9375, 111825, 217-658; 1914, BPIFB1, 9374, 111824, 162-1616; 1915, BPIFB2, 9376, 111826, 196-1572; 1916, BPIFB3, 9377, 111827, 1-1431; 1917, BPIFB4, 9379, 111829, 184-318; 1917, BPIFB4, 9378, 111828, 1-1845; 1918, BPIFB6, 9381, 111831, 1-267; 1918, BPIFB6, 9380, 111830, 1-1362; 1919, BPIFC, 9383, 111833, 165-413; 1919, BPIFC, 9382, 111832, 1-1524; 1919, BPIFC, 9384, 111834, 112-1635; 1919, BPIFC, 9385, 111835, 559-1353; 1920, BRSK1, 9387, 111837, 209-1630; 1920, BRSK1, 9388, 111838, 162-556; 1920, BRSK1, 9389, 111839, 1-190; 1920, BRSK1, 9386, 111836, 278-2614; 1920, BRSK1, 9390, 111840, 23-1054; 1920, BRSK1, 9391, 111841, 128-2512; 1921, BRSK2, 9396, 111846, 1-512; 1921, BRSK2, 9397, 111847, 191-580; 1921, BRSK2, 9401, 111851, 322-581; 1921, BRSK2, 9402, 111852, 1-601; 1921, BRSK2, 9403, 111853, 155-667; 1921, BRSK2, 9392, 111842, 387-2393; 1921, BRSK2, 9393, 111843, 254-2554; 1921, BRSK2, 9394, 111844, 385-2409; 1921, BRSK2, 9395, 111845, 385-2595; 1921, BRSK2, 9398, 111848, 554-2398; 1921, BRSK2, 9399, 111849, 1-2091; 1921, BRSK2, 9400, 111850, 385-2409; 1922, BDKRB1, 9405, 111855, 221-1075; 1922, BDKRB1, 9404, 111854, 607-1668; 1922, BDKRB1, 9406, 111856, 14-1075; 1923, BDKRB2, 9407, 111857, 403-1497; 1923, BDKRB2, 9408, 111858, 3089-4183; 1923, BDKRB2, 9409, 111859, 205-1380; 1924, BRAF, 9411, 111861, 1-309; 1924, BRAF, 9412, 111862, 1-1127; 1924, BRAF, 9413, 111863, 1-585; 1924, BRAF, 9410, 111860, 62-2362; 1925, BASP1, 9415, 111865, 265-401; 1925, BASP1, 9414, 111864, 261-944; 1925, BASP1, 9416, 111866, 85-768; 1926, BAALC, 9417, 111867, 140-682; 1926, BAALC, 9418, 111868, 1-243; 1926, BAALC, 9419, 111869, 189-626; 1926, BAALC, 9420, 111870, 1-222; 1926, BAALC, 9421, 111871, 186-350; 1927, BRE, 9426, 111876, 13-865; 1927, BRE, 9428, 111878, 415-874; 1927, BRE, 9429, 111879, 1-500; 1927, BRE, 9422, 111872, 142-1293; 1927, BRE, 9423, 111873, 139-1386; 1927, BRE, 9424, 111874, 75-1205; 1927, BRE, 9425, 111875, 118-1269; 1927, BRE, 9427, 111877, 141-1271; 1928, BEX2, 9432, 111882, 432-736; 1928, BEX2, 9430, 111880, 194-580; 1928, BEX2, 9431, 111881, 269-655; 1928, BEX2, 9433, 111883, 359-841; 1929, BEAN1, 9437, 111887, 191-409; 1929, BEAN1, 9439, 111889, 1-248; 1929, BEAN1, 9440, 111890, 97-437; 1929, BEAN1, 9434, 111884, 364-816; 1929, BEAN1, 9435, 111885, 218-997; 1929, BEAN1, 9436, 111886, 364-990; 1929, BEAN1, 9438, 111888, 398-850; 1929, BEAN1, 9441, 111891, 545-1171; 1930, BEX1, 9442, 111892, 241-618; 1931, BEX4, 9443, 111893, 121-483; 1931, BEX4, 9444, 111894, 236-598; 1932, BEX5, 9445, 111895, 304-639; 1932, BEX5, 9446, 111896, 303-638; 1933, BRI3, 9448, 111898, 130-426; 1933, BRI3, 9449, 111899, 1-144; 1933, BRI3, 9447, 111897, 122-499; 1934, BDNF, 9464, 111914, 142-375; 1934, BDNF, 9450, 111900, 645-1412; 1934, BDNF, 9451, 111901, 347-1090; 1934, BDNF, 9452, 111902, 317-1060; 1934, BDNF, 9453, 111903, 359-1102; 1934, BDNF, 9454, 111904, 400-1143; 1934, BDNF, 9455, 111905, 105-848; 1934, BDNF, 9456, 111906, 263-1051; 1934, BDNF, 9457, 111907, 861-1604; 1934, BDNF, 9458, 111908, 505-1248; 1934, BDNF, 9459, 111909, 454-1197; 1934, BDNF, 9460, 111910, 142-1131; 1934, BDNF, 9461, 111911, 158-901; 1934, BDNF, 9462, 111912, 329-1072; 1934, BDNF, 9463, 111913, 207-950; 1934, BDNF, 9465, 111915, 247-990; 1934, BDNF, 9466, 111916, 259-1002; 1934, BDNF, 9467, 111917, 1095-1838; 1935, BEGAIN, 9470, 111920, 147-649; 1935, BEGAIN, 9471, 111921, 124-632; 1935, BEGAIN, 9472, 111922, 3406-4995; 1935, BEGAIN, 9473, 111923, 27-925; 1935, BEGAIN, 9474, 111924, 148-1010; 1935, BEGAIN, 9475, 111925, 224-747; 1935, BEGAIN, 9468, 111918, 73-1854; 1935, BEGAIN, 9469, 111919, 147-1928; 1936, BSX, 9476, 111926, 50-751; 1937, BCAT1, 9479, 111929, 118-549; 1937, BCAT1, 9483, 111933, 1-675; 1937, BCAT1, 9477, 111927, 528-1688; 1937, BCAT1, 9478, 111928, 155-1132; 1937, BCAT1, 9480, 111930, 332-1489; 1937, BCAT1, 9481, 111931, 112-1161; 1937, BCAT1, 9482, 111932, 88-1284; 1938, BCAT2, 9485, 111935, 622-1680; 1938, BCAT2, 9487, 111937, 1-1338; 1938, BCAT2, 9488, 111938, 205-1263; 1938, BCAT2, 9489, 111939, 21-1238; 1938, BCAT2, 9490, 111940, 23-964; 1938, BCAT2, 9491, 111941, 691-1016; 1938, BCAT2, 9484, 111934, 14-1192; 1938, BCAT2, 9486, 111936, 6-908; 1939, BCKDHA, 9494, 111944, 9-994; 1939, BCKDHA, 9495, 111945, 1-283; 1939, BCKDHA, 9496, 111946, 1-632; 1939, BCKDHA, 9497, 111947, 40-1251; 1939, BCKDHA, 9492, 111942, 369-1706; 1939, BCKDHA, 9493, 111943, 6-1352; 1940, BCKDHB, 9498, 111948, 48-1226; 1940, BCKDHB, 9499, 111949, 48-1226; 1940, BCKDHB, 9500, 111950, 48-704; 1941, BCKDK, 9505, 111955, 291-554; 1941, BCKDK, 9506, 111956, 461-640; 1941, BCKDK, 9507, 111957, 364-1017; 1941, BCKDK, 9508, 111958, 105-754; 1941, BCKDK, 9509, 111959, 1-439; 1941, BCKDK, 9501, 111951, 364-1602; 1941, BCKDK, 9502, 111952, 364-1371; 1941, BCKDK, 9503, 111953, 364-1461; 1941, BCKDK, 9504, 111954, 624-1862; 1942, BRAP, 9510, 111960, 142-1830; 1942, BRAP, 9511, 111961, 195-1973; 1943, BAP1, 9512, 111962, 37-2172; 1943, BAP1, 9514, 111964, 241-578; 1943, BAP1, 9515, 111965, 1-389; 1943, BAP1, 9516, 111966, 74-199; 1943, BAP1, 9517, 111967, 1-762; 1943, BAP1, 9518, 111968, 1-489; 1943, BAP1, 9513, 111963, 473-2662; 1944, BARD1, 9520, 111970, 119-766; 1944, BARD1, 9521, 111971, 1-134; 1944, BARD1, 9522, 111972, 105-335; 1944, BARD1, 9525, 111975, 143-937; 1944, BARD1, 9526, 111976, 200-703; 1944, BARD1, 9527, 111977, 143-1066; 1944, BARD1, 9528, 111978, 143-1123; 1944, BARD1, 9519, 111969, 136-2469; 1944, BARD1, 9523, 111973, 143-2419; 1944, BARD1, 9524, 111974, 74-457; 1945, BRIP1, 9530, 111980, 258-466; 1945, BRIP1, 9531, 111981, 1-542; 1945, BRIP1, 9532, 111982, 1-254; 1945, BRIP1, 9533, 111983, 1-2985; 1945, BRIP1, 9529, 111979, 269-4018; 1946, BRCC3, 9538, 111988, 1-273; 1946, BRCC3, 9539, 111989, 1-954; 1946, BRCC3, 9540, 111990, 11-688; 1946, BRCC3, 9541, 111991, 1-257; 1946, BRCC3, 9542, 111992, 1-882; 1946, BRCC3, 9543, 111993, 1-954; 1946, BRCC3, 9534, 111984, 98-973; 1946, BRCC3, 9535, 111985, 109-987; 1946, BRCC3, 9536, 111986, 30-773; 1946, BRCC3, 9537, 111987, 26-976; 1947, BRAT1, 9545, 111995, 18-524; 1947, BRAT1, 9544, 111994, 258-2723; 1948, BCCIP, 9546, 111996, 13-957; 1948, BCCIP, 9547, 111997, 13-891; 1948, BCCIP, 9548, 111998, 13-981; 1949, BCR, 9551, 112001, 1-1398; 1949, BCR, 9552, 112002, 1-771; 1949, BCR, 9549, 111999, 752-4567; 1949, BCR, 9550, 112000, 597-4280; 1950, BRCA1, 9554, 112004, 65-4264; 1950, BRCA1, 9556, 112006, 1-1312; 1950, BRCA1, 9558, 112008, 1-726; 1950, BRCA1, 9559, 112009, 103-769; 1950, BRCA1, 9561, 112011, 1-800; 1950, BRCA1, 9564, 112014, 233-1948; 1950, BRCA1, 9566, 112016, 249-779; 1950, BRCA1, 9567, 112017, 194-1612; 1950, BRCA1, 9568, 112018, 162-2108; 1950, BRCA1, 9569, 112019, 1-1495; 1950, BRCA1, 9570, 112020, 114-1980; 1950, BRCA1, 9571, 112021, 1-958; 1950, BRCA1, 9572, 112022, 50-229; 1950, BRCA1, 9573, 112023, 103-1972; 1950, BRCA1, 9575, 112025, 160-455; 1950, BRCA1, 9576, 112026, 158-448; 1950, BRCA1, 9577, 112027, 145-666; 1950, BRCA1, 9578, 112028, 103-1167; 1950, BRCA1, 9579, 112029, 648-718; 1950, BRCA1, 9580, 112030, 140-2534; 1950, BRCA1, 9553, 112003, 120-2285; 1950, BRCA1, 9555, 112005, 120-5711; 1950, BRCA1, 9557, 112007, 195-2294; 1950, BRCA1, 9560, 112010, 114-305; 1950, BRCA1, 9562, 112012, 127-318; 1950, BRCA1, 9563, 112013, 233-5683; 1950, BRCA1, 9565, 112015, 233-5887; 1950, BRCA1, 9574, 112024, 100-2379; 1951, BRCA2, 9582, 112032, 1-195; 1951, BRCA2, 9583, 112033, 1-560; 1951, BRCA2, 9581, 112031, 234-10490; 1951, BRCA2, 9584, 112034, 228-10484; 1952, BCAR1, 9592, 112042, 716-889; 1952, BCAR1, 9594, 112044, 1-714; 1952, BCAR1, 9595, 112045, 716-889; 1952, BCAR1, 9596, 112046, 158-558; 1952, BCAR1, 9597, 112047, 152-556; 1952, BCAR1, 9598, 112048, 164-547; 1952, BCAR1, 9599, 112049, 383-558; 1952, BCAR1, 9600, 112050, 431-581; 1952, BCAR1, 9601, 112051, 355-594; 1952, BCAR1, 9602, 112052, 215-574; 1952, BCAR1, 9585, 112035, 128-2740; 1952, BCAR1, 9586, 112036, 1-2667; 1952, BCAR1, 9587, 112037, 74-2740; 1952, BCAR1, 9588, 112038, 285-3035; 1952, BCAR1, 9589, 112039, 3-2669; 1952, BCAR1, 9590, 112040, 277-2445; 1952, BCAR1, 9591, 112041, 182-2788; 1952, BCAR1, 9593, 112043, 172-2784; 1953, BCAR3, 9603, 112053, 244-2721; 1953, BCAR3, 9604, 112054, 276-2753; 1953, BCAR3, 9605, 112055, 290-2767; 1953, BCAR3, 9606, 112056, 168-2372; 1953, BCAR3, 9607, 112057, 155-1660; 1954, BRMS1, 9609, 112059, 156-1028; 1954, BRMS1, 9610, 112060, 1-802; 1954, BRMS1, 9611, 112061, 231-963; 1954, BRMS1, 9612, 112062, 116-496; 1954, BRMS1, 9608, 112058, 162-902; 1955, BRMS1L, 9614, 112064, 1-647; 1955, BRMS1L, 9615, 112065, 72-218; 1955, BRMS1L, 9616, 112066, 77-223; 1955, BRMS1L, 9613, 112063, 200-1171; 1956, BCAS1, 9617, 112067, 119-1639; 1956, BCAS1, 9618, 112068, 483-1637; 1956, BCAS1, 9620, 112070, 1-1431; 1956, BCAS1, 9621, 112071, 1-743; 1956, BCAS1, 9619, 112069, 168-1922; 1957, BCAS2, 9622, 112072, 49-726; 1958, BCAS3, 9626, 112076, 1-550; 1958, BCAS3, 9628, 112078, 29-139; 1958, BCAS3, 9629, 112079, 100-633; 1958, BCAS3, 9630, 112080, 140-545; 1958, BCAS3, 9631, 112081, 42-203; 1958, BCAS3, 9632, 112082, 128-562; 1958, BCAS3, 9633, 112083, 73-243; 1958, BCAS3, 9635, 112085, 196-747; 1958, BCAS3, 9636, 112086, 34-195; 1958, BCAS3, 9638, 112088, 104-2203; 1958, BCAS3, 9639, 112089, 1-1950; 1958, BCAS3, 9640, 112090, 1-1995; 1958, BCAS3, 9641, 112091, 66-227; 1958, BCAS3, 9623, 112073, 32-2818; 1958, BCAS3, 9624, 112074, 49-2790; 1958, BCAS3, 9625, 112075, 1-2808; 1958, BCAS3, 9627, 112077, 189-2243; 1958, BCAS3, 9634, 112084, 69-2855; 1958, BCAS3, 9637, 112087, 1-2853; 1959, BCAS4, 9644, 112094, 15-365; 1959, BCAS4, 9645, 112095, 14-283; 1959, BCAS4, 9646, 112096, 54-599; 1959, BCAS4, 9642, 112092, 101-736; 1959, BCAS4, 9643, 112093, 1-612; 1960, BCAN, 9649, 112099, 167-807; 1960, BCAN, 9650, 112100, 166-600; 1960, BCAN, 9651, 112101, 151-844; 1960, BCAN, 9652, 112102, 1-80; 1960, BCAN, 9653, 112103, 153-743; 1960, BCAN, 9647, 112097, 337-3072; 1960, BCAN, 9648, 112098, 42-2057; 1961, BRF1, 9655, 112105, 397-801; 1961, BRF1, 9661, 112111, 192-677; 1961, BRF1, 9662, 112112, 1321-1362; 1961, BRF1, 9663, 112113, 60-2093;

1961, BRF1, 9664, 112114, 1260-1962; 1961, BRF1, 9665, 112115, 410-600; 1961, BRF1, 9666, 112116, 906-1040; 1961, BRF1, 9667, 112117, 313-778; 1961, BRF1, 9668, 112118, 1-554; 1961, BRF1, 9669, 112119, 976-1530; 1961, BRF1, 9654, 112104, 331-2019; 1961, BRF1, 9656, 112106, 97-2049; 1961, BRF1, 9657, 112107, 893-2314; 1961, BRF1, 9658, 112108, 430-2184; 1961, BRF1, 9659, 112109, 277-1596; 1961, BRF1, 9660, 112110, 650-1276; 1962, BRF2, 9671, 112121, 72-290; 1962, BRF2, 9672, 112122, 56-664; 1962, BRF2, 9673, 112123, 79-297; 1962, BRF2, 9670, 112120, 122-1381; 1963, BRI3BP, 9674, 112124, 92-847; 1964, BRICD5, 9677, 112127, 73-534; 1964, BRICD5, 9675, 112125, 1118-1804; 1964, BRICD5, 9676, 112126, 1-783; 1965, BRK1, 9678, 112128, 111-338; 1966, BIN1, 9679, 112129, 346-1575; 1966, BIN1, 9680, 112130, 346-1839; 1966, BIN1, 9681, 112131, 346-1710; 1966, BIN1, 9682, 112132, 346-1866; 1966, BIN1, 9683, 112133, 346-1902; 1966, BIN1, 9684, 112134, 413-2194; 1966, BIN1, 9685, 112135, 346-1998; 1966, BIN1, 9686, 112136, 59-1333; 1966, BIN1, 9687, 112137, 346-1794; 1966, BIN1, 9688, 112138, 346-1773; 1966, BIN1, 9689, 112139, 336-1655; 1967, BIN2, 9690, 112140, 1-1654; 1967, BIN2, 9691, 112141, 154-1773; 1967, BIN2, 9692, 112142, 1-220; 1967, BIN2, 9693, 112143, 1-1609; 1967, BIN2, 9694, 112144, 1-1794; 1968, BIN3, 9696, 112146, 76-693; 1968, BIN3, 9697, 112147, 98-181; 1968, BIN3, 9698, 112148, 72-521; 1968, BIN3, 9700, 112150, 75-266; 1968, BIN3, 9695, 112145, 70-831; 1968, BIN3, 9699, 112149, 122-721; 1969, BABAM1, 9702, 112152, 166-930; 1969, BABAM1, 9703, 112153, 78-842; 1969, BABAM1, 9704, 112154, 166-492; 1969, BABAM1, 9705, 112155, 1-293; 1969, BABAM1, 9706, 112156, 1-99; 1969, BABAM1, 9708, 112158, 123-799; 1969, BABAM1, 9710, 112160, 71-725; 1969, BABAM1, 9711, 112161, 68-648; 1969, BABAM1, 9712, 112162, 71-782; 1969, BABAM1, 9713, 112163, 132-731; 1969, BABAM1, 9714, 112164, 91-634; 1969, BABAM1, 9715, 112165, 85-267; 1969, BABAM1, 9701, 112151, 194-1183; 1969, BABAM1, 9707, 112157, 88-1077; 1969, BABAM1, 9709, 112159, 192-1181; 1970, BROX, 9717, 112167, 65-709; 1970, BROX, 9718, 112168, 113-1129; 1970, BROX, 9716, 112166, 407-1642; 1970, BROX, 9719, 112169, 113-1252; 1970, BROX, 9720, 112170, 407-1546; 1971, BAHD1, 9721, 112171, 72-2414; 1971, BAHD1, 9722, 112172, 1-2334; 1971, BAHD1, 9723, 112173, 260-2599; 1972, BAZ1A, 9727, 112177, 1-37; 1972, BAZ1A, 9728, 112178, 1-229; 1972, BAZ1A, 9729, 112179, 1-233; 1972, BAZ1A, 9730, 112180, 1-656; 1972, BAZ1A, 9724, 112174, 569-5143; 1972, BAZ1A, 9725, 112175, 569-5239; 1972, BAZ1A, 9726, 112176, 329-4999; 1973, BAZ1B, 9731, 112181, 340-4791; 1973, BAZ1B, 9732, 112182, 346-4797; 1974, BAZ2A, 9733, 112183, 182-5809; 1974, BAZ2A, 9735, 112185, 230-577; 1974, BAZ2A, 9736, 112186, 1-484; 1974, BAZ2A, 9737, 112187, 1-833; 1974, BAZ2A, 9738, 112188, 90-5801; 1974, BAZ2A, 9739, 112189, 1-2514; 1974, BAZ2A, 9740, 112190, 1-614; 1974, BAZ2A, 9741, 112191, 328-722; 1974, BAZ2A, 9734, 112184, 195-5912; 1975, BAZ2B, 9742, 112192, 1-631; 1975, BAZ2B, 9743, 112193, 298-2229; 1975, BAZ2B, 9746, 112196, 1-580; 1975, BAZ2B, 9747, 112197, 1-537; 1975, BAZ2B, 9748, 112198, 213-640; 1975, BAZ2B, 9749, 112199, 310-594; 1975, BAZ2B, 9744, 112194, 374-6772; 1975, BAZ2B, 9745, 112195, 497-7003; 1976, BRPF1, 9753, 112203, 219-534; 1976, BRPF1, 9755, 112205, 560-860; 1976, BRPF1, 9750, 112200, 405-4067; 1976, BRPF1, 9751, 112201, 405-4046; 1976, BRPF1, 9752, 112202, 421-3780; 1976, BRPF1, 9754, 112204, 12-3656; 1977, BRPF3, 9758, 112208, 129-414; 1977, BRPF3, 9759, 112209, 1-1798; 1977, BRPF3, 9760, 112210, 1-739; 1977, BRPF3, 9761, 112211, 196-582; 1977, BRPF3, 9762, 112212, 32-2497; 1977, BRPF3, 9763, 112213, 159-437; 1977, BRPF3, 9765, 112215, 27-3347; 1977, BRPF3, 9766, 112216, 27-1907; 1977, BRPF3, 9756, 112206, 32-2839; 1977, BRPF3, 9757, 112207, 254-3871; 1977, BRPF3, 9764, 112214, 32-2647; 1978, BRWD1, 9771, 112221, 1-1644; 1978, BRWD1, 9772, 112222, 1-706; 1978, BRWD1, 9773, 112223, 1-1923; 1978, BRWD1, 9774, 112224, 1-799; 1978, BRWD1, 9775, 112225, 1-1228; 1978, BRWD1, 9776, 112226, 1-1402; 1978, BRWD1, 9777, 112227, 1-1356; 1978, BRWD1, 9767, 112217, 329-7291; 1978, BRWD1, 9768, 112218, 152-514; 1978, BRWD1, 9769, 112219, 80-6889; 1978, BRWD1, 9770, 112220, 100-6699; 1979, BRWD3, 9778, 112228, 218-5626; 1980, BRD1, 9782, 112232, 1-1530; 1980, BRD1, 9779, 112229, 488-3664; 1980, BRD1, 9780, 112230, 186-3362; 1980, BRD1, 9781, 112231, 31-3600; 1980, BRD1, 9783, 112233, 488-4057; 1981, BRD2, 9791, 112241, 1615-3455; 1981, BRD2, 9792, 112242, 1-985; 1981, BRD2, 9794, 112244, 1-887; 1981, BRD2, 9795, 112245, 1-985; 1981, BRD2, 9797, 112247, 1702-3542; 1981, BRD2, 9798, 112248, 1-2423; 1981, BRD2, 9800, 112250, 1-1858; 1981, BRD2, 9801, 112251, 1-1090; 1981, BRD2, 9802, 112252, 1-2423; 1981, BRD2, 9803, 112253, 1-887; 1981, BRD2, 9805, 112255, 1-887; 1981, BRD2, 9806, 112256, 1-2423; 1981, BRD2, 9808, 112258, 1-2423; 1981, BRD2, 9810, 112260, 1-887; 1981, BRD2, 9811, 112261, 1-887; 1981, BRD2, 9813, 112263, 1-985; 1981, BRD2, 9814, 112264, 170-2680; 1981, BRD2, 9815, 112265, 170-2115; 1981, BRD2, 9816, 112266, 1-887; 1981, BRD2, 9817, 112267, 1-985; 1981, BRD2, 9818, 112268, 1550-1993; 1981, BRD2, 9819, 112269, 1550-1993; 1981, BRD2, 9820, 112270, 1-413; 1981, BRD2, 9821, 112271, 1-413; 1981, BRD2, 9822, 112272, 1550-1993; 1981, BRD2, 9823, 112273, 1550-1993; 1981, BRD2, 9824, 112274, 1573-2778; 1981, BRD2, 9825, 112275, 1573-2778; 1981, BRD2, 9826, 112276, 1573-2778; 1981, BRD2, 9827, 112277, 1550-1993; 1981, BRD2, 9830, 112280, 82-570; 1981, BRD2, 9831, 112281, 1-478; 1981, BRD2, 9832, 112282, 683-2338; 1981, BRD2, 9784, 112234, 1702-4107; 1981, BRD2, 9785, 112235, 1615-4020; 1981, BRD2, 9786, 112236, 1615-4020; 1981, BRD2, 9787, 112237, 170-2680; 1981, BRD2, 9788, 112238, 170-2680; 1981, BRD2, 9789, 112239, 1615-4020; 1981, BRD2, 9790, 112240, 1702-4107; 1981, BRD2, 9793, 112243, 1702-4107; 1981, BRD2, 9796, 112246, 1615-4020; 1981, BRD2, 9799, 112249, 1702-4107; 1981, BRD2, 9804, 112254, 159-2423; 1981, BRD2, 9807, 112257, 159-2423; 1981, BRD2, 9809, 112259, 170-2680; 1981, BRD2, 9812, 112262, 170-2680; 1981, BRD2, 9828, 112278, 1615-4020; 1981, BRD2, 9829, 112279, 1702-4107; 1982, BRD3, 9835, 112285, 351-574; 1982, BRD3, 9836, 112286, 540-599; 1982, BRD3, 9833, 112283, 187-2367; 1982, BRD3, 9834, 112284, 323-1993; 1983, BRD4, 9840, 112290, 189-629; 1983, BRD4, 9841, 112291, 106-1821; 1983, BRD4, 9842, 112292, 290-604; 1983, BRD4, 9843, 112293, 286-726; 1983, BRD4, 9837, 112287, 223-4311; 1983, BRD4, 9838, 112288, 291-2675; 1983, BRD4, 9839, 112289, 223-2391; 1984, BRD7, 9846, 112296, 1-99; 1984, BRD7, 9847, 112297, 1-330; 1984, BRD7, 9844, 112294, 161-2116; 1984, BRD7, 9845, 112295, 6-1964; 1985, BRD8, 9850, 112300, 20-2656; 1985, BRD8, 9851, 112301, 1-1011; 1985, BRD8, 9853, 112303, 15-218; 1985, BRD8, 9854, 112304, 1-2679; 1985, BRD8, 9855, 112305, 1-2573; 1985, BRD8, 9856, 112306, 340-579; 1985, BRD8, 9857, 112307, 1-2586; 1985, BRD8, 9858, 112308, 1-561; 1985, BRD8, 9859, 112309, 65-432;

1985, BRD8, 9860, 112310, 16-135; 1985, BRD8, 9861, 112311, 1-109; 1985, BRD8, 9862, 112312, 1-586; 1985, BRD8, 9863, 112313, 1-879; 1985, BRD8, 9864, 112314, 17-163; 1985, BRD8, 9848, 112298, 17-2872; 1985, BRD8, 9849, 112299, 373-4080; 1985, BRD8, 9852, 112302, 56-2656; 1986, BRD9, 9865, 112315, 46-318; 1986, BRD9, 9866, 112316, 539-811; 1986, BRD9, 9869, 112319, 298-570; 1986, BRD9, 9870, 112320, 154-426; 1986, BRD9, 9871, 112321, 205-477; 1986, BRD9, 9872, 112322, 464-1139; 1986, BRD9, 9873, 112323, 1-372; 1986, BRD9, 9874, 112324, 1-524; 1986, BRD9, 9875, 112325, 1-277; 1986, BRD9, 9876, 112326, 1-218; 1986, BRD9, 9867, 112317, 168-1961; 1986, BRD9, 9868, 112318, 141-1775; 1987, BPTF, 9879, 112329, 31-2463; 1987, BPTF, 9880, 112330, 1-1951; 1987, BPTF, 9881, 112331, 1-8295; 1987, BPTF, 9882, 112332, 202-7573; 1987, BPTF, 9883, 112333, 1-409; 1987, BPTF, 9884, 112334, 1-1453; 1987, BPTF, 9885, 112335, 1-194; 1987, BPTF, 9886, 112336, 1-208; 1987, BPTF, 9887, 112337, 1-1015; 1987, BPTF, 9888, 112338, 1-1262; 1987, BPTF, 9877, 112327, 61-8823; 1987, BPTF, 9878, 112328, 62-9202; 1988, BRDT, 9894, 112344, 231-760; 1988, BRDT, 9895, 112345, 898-1363; 1988, BRDT, 9896, 112346, 493-534; 1988, BRDT, 9897, 112347, 320-1707; 1988, BRDT, 9898, 112348, 457-551; 1988, BRDT, 9899, 112349, 395-550; 1988, BRDT, 9900, 112350, 126-591; 1988, BRDT, 9901, 112351, 272-559; 1988, BRDT, 9902, 112352, 188-788; 1988, BRDT, 9903, 112353, 389-578; 1988, BRDT, 9904, 112354, 269-569; 1988, BRDT, 9889, 112339, 419-3262; 1988, BRDT, 9890, 112340, 925-3549; 1988, BRDT, 9891, 112341, 350-3055; 1988, BRDT, 9892, 112342, 135-2978; 1988, BRDT, 9893, 112343, 350-3205; 1989, BTK, 9906, 112356, 359-1810; 1989, BTK, 9907, 112357, 1-1707; 1989, BTK, 9905, 112355, 165-2144; 1989, BTK, 9908, 112358, 248-2329; 1990, BRIX1, 9909, 112359, 364-1425; 1991, BSDC1, 9911, 112361, 15-209; 1991, BSDC1, 9917, 112367, 35-567; 1991, BSDC1, 9918, 112368, 12-281; 1991, BSDC1, 9919, 112369, 15-482; 1991, BSDC1, 9910, 112360, 13-1437; 1991, BSDC1, 9912, 112362, 17-1360; 1991, BSDC1, 9913, 112363, 28-1152; 1991, BSDC1, 9914, 112364, 35-1327; 1991, BSDC1, 9915, 112365, 15-1301; 1991, BSDC1, 9916, 112366, 28-1035; 1992, BTAF1, 9921, 112371, 1-5550; 1992, BTAF1, 9920, 112370, 309-5858; 1993, BTBD1, 9924, 112374, 1-112; 1993, BTBD1, 9922, 112372, 204-1652; 1993, BTBD1, 9923, 112373, 1-1158; 1994, BTBD10, 9927, 112377, 316-508; 1994, BTBD10, 9928, 112378, 419-616; 1994, BTBD10, 9929, 112379, 264-374; 1994, BTBD10, 9930, 112380, 250-1533; 1994, BTBD10, 9931, 112381, 193-801; 1994, BTBD10, 9925, 112375, 247-1674; 1994, BTBD10, 9926, 112376, 272-1723; 1995, BTBD11, 9934, 112384, 12-723; 1995, BTBD11, 9937, 112387, 1-667; 1995, BTBD11, 9932, 112382, 529-3843; 1995, BTBD11, 9933, 112383, 258-2183; 1995, BTBD11, 9935, 112385, 521-3478; 1995, BTBD11, 9936, 112386, 1-3024; 1995, BTBD11, 9938, 112388, 260-811; 1996, BTBD16, 9939, 112389, 252-1772; 1997, BTBD17, 9940, 112390, 128-1564; 1998, BTBD18, 9943, 112393, 290-557; 1998, BTBD18, 9941, 112391, 290-2428; 1998, BTBD18, 9942, 112392, 189-2327; 1999, BTBD19, 9944, 112394, 299-1060; 1999, BTBD19, 9945, 112395, 340-1215; 1999, BTBD19, 9946, 112396, 255-743; 2000, BTBD2, 9948, 112398, 1-335; 2000, BTBD2, 9949, 112399, 1-961; 2000, BTBD2, 9950, 112400, 278-352; 2000, BTBD2, 9951, 112401, 1-349; 2000, BTBD2, 9952, 112402, 414-572; 2000, BTBD2, 9953, 112403, 455-559; 2000, BTBD2, 9947, 112397, 22-1599; 2001, BTBD3, 9958, 112408, 177-583; 2001, BTBD3, 9959, 112409, 481-485; 2001, BTBD3, 9960, 112410, 243-541; 2001, BTBD3, 9961, 112411, 75-493; 2001, BTBD3, 9962, 112412, 211-363; 2001, BTBD3, 9954, 112404, 358-1743; 2001, BTBD3, 9955, 112405, 412-1980; 2001, BTBD3, 9956, 112406, 498-1883; 2001, BTBD3, 9957, 112407, 626-2194; 2001, BTBD3, 9963, 112413, 273-1658; 2001, BTBD3, 9964, 112414, 177-1562; 2002, BTBD6, 9969, 112419, 113-1335; 2002, BTBD6, 9965, 112415, 304-1536; 2002, BTBD6, 9966, 112416, 298-1755; 2002, BTBD6, 9967, 112417, 542-1774; 2002, BTBD6, 9968, 112418, 104-1561; 2003, BTBD7, 9972, 112422, 1-79; 2003, BTBD7, 9973, 112423, 150-316; 2003, BTBD7, 9974, 112424, 1-2244; 2003, BTBD7, 9976, 112426, 108-1544; 2003, BTBD7, 9977, 112427, 1-79; 2003, BTBD7, 9980, 112430, 1-2244; 2003, BTBD7, 9982, 112432, 150-316; 2003, BTBD7, 9983, 112433, 108-1544; 2003, BTBD7, 9970, 112420, 380-1612; 2003, BTBD7, 9971, 112421, 309-3707; 2003, BTBD7, 9975, 112425, 112-2457; 2003, BTBD7, 9978, 112428, 309-3707; 2003, BTBD7, 9979, 112429, 380-1612; 2003, BTBD7, 9981, 112431, 112-2457; 2004, BTBD8, 9984, 112434, 237-1373; 2004, BTBD8, 9985, 112435, 268-1185; 2005, BTBD9, 9987, 112437, 239-1195; 2005, BTBD9, 9988, 112438, 1-1155; 2005, BTBD9, 9989, 112439, 1-1062; 2005, BTBD9, 9991, 112441, 517-861; 2005, BTBD9, 9993, 112443, 297-573; 2005, BTBD9, 9986, 112436, 318-1952; 2005, BTBD9, 9990, 112440, 260-2008; 2005, BTBD9, 9992, 112442, 153-1991; 2006, BACH1, 9996, 112446, 181-692; 2006, BACH1, 9997, 112447, 104-777; 2006, BACH1, 9998, 112448, 92-751; 2006, BACH1, 9999, 112449, 1-655; 2006, BACH1, 10000, 112450, 251-325; 2006, BACH1, 10001, 112451, 241-315; 2006, BACH1, 10002, 112452, 143-217; 2006, BACH1, 10003, 112453, 275-349; 2006, BACH1, 10004, 112454, 411-485; 2006, BACH1, 10005, 112455, 1-415; 2006, BACH1, 9994, 112444, 144-2354; 2006, BACH1, 9995, 112445, 244-2454; 2007, BACH2, 10008, 112458, 538-780; 2007, BACH2, 10009, 112459, 626-868; 2007, BACH2, 10006, 112456, 709-3234; 2007, BACH2, 10007, 112457, 533-3058; 2007, BACH2, 10010, 112460, 704-3229; 2008, BTG2, 10011, 112461, 72-548; 2008, BTG2, 10012, 112462, 117-593; 2009, BTG3, 10015, 112465, 374-511; 2009, BTG3, 10016, 112466, 374-511; 2009, BTG3, 10017, 112467, 155-597; 2009, BTG3, 10018, 112468, 258-568; 2009, BTG3, 10013, 112463, 258-1016; 2009, BTG3, 10014, 112464, 155-1045; 2010, BANP, 10021, 112471, 321-1073; 2010, BANP, 10024, 112474, 233-586; 2010, BANP, 10025, 112475, 192-560; 2010, BANP, 10026, 112476, 171-455; 2010, BANP, 10027, 112477, 561-644; 2010, BANP, 10028, 112478, 210-566; 2010, BANP, 10029, 112479, 153-736; 2010, BANP, 10030, 112480, 389-558; 2010, BANP, 10031, 112481, 100-486; 2010, BANP, 10033, 112483, 150-272; 2010, BANP, 10034, 112484, 104-226; 2010, BANP, 10019, 112469, 153-1712; 2010, BANP, 10020, 112470, 98-1507; 2010, BANP, 10022, 112472, 222-1781; 2010, BANP, 10023, 112473, 151-1626; 2010, BANP, 10032, 112482, 151-1551; 2010, BANP, 10035, 112485, 192-1718; 2010, BANP, 10036, 112486, 106-1599; 2011, BUB1, 10039, 112489, 373-540; 2011, BUB1, 10040, 112490, 113-551; 2011, BUB1, 10041, 112491, 165-566; 2011, BUB1, 10037, 112487, 120-3377; 2011, BUB1, 10038, 112488, 69-3155; 2011, BUB1, 10042, 112492, 113-3310; 2012, BUB1B, 10045, 112495, 1-199; 2012, BUB1B, 10046, 112496, 155-445; 2012, BUB1B, 10043, 112493, 196-3348; 2012, BUB1B, 10044, 112494, 155-3349; 2013, BUB3, 10048, 112498, 85-522; 2013, BUB3, 10050, 112500, 60-895; 2013, BUB3, 10047, 112497, 72-1052; 2013, BUB3, 10049, 112499, 210-1196; 2014,

BUD13, 10053, 112503, 1-355; 2014, BUD13, 10051, 112501, 25-1884; 2014, BUD13, 10052, 112502, 24-1481; 2015, BUD31, 10056, 112506, 37-348; 2015, BUD31, 10057, 112507, 125-472; 2015, BUD31, 10058, 112508, 499-612; 2015, BUD31, 10054, 112504, 434-868; 2015, BUD31, 10055, 112505, 530-964; 2016, BBOX1, 10062, 112512, 498-703; 2016, BBOX1, 10059, 112509, 369-1532; 2016, BBOX1, 10060, 112510, 215-1378; 2016, BBOX1, 10061, 112511, 205-1368; 2016, BBOX1, 10063, 112513, 340-1503; 2017, BTN1A1, 10065, 112515, 21-1505; 2017, BTN1A1, 10064, 112514, 67-1647; 2018, BTN2A1, 10067, 112517, 252-707; 2018, BTN2A1, 10069, 112519, 1-236; 2018, BTN2A1, 10071, 112521, 295-551; 2018, BTN2A1, 10066, 112516, 249-1832; 2018, BTN2A1, 10068, 112518, 213-1217; 2018, BTN2A1, 10070, 112520, 206-1198; 2018, BTN2A1, 10072, 112522, 341-1741; 2019, BTN2A2, 10077, 112527, 1-171; 2019, BTN2A2, 10079, 112529, 252-540; 2019, BTN2A2, 10080, 112530, 346-587; 2019, BTN2A2, 10081, 112531, 390-942; 2019, BTN2A2, 10082, 112532, 140-259; 2019, BTN2A2, 10083, 112533, 163-881; 2019, BTN2A2, 10084, 112534, 255-966; 2019, BTN2A2, 10085, 112535, 205-535; 2019, BTN2A2, 10073, 112523, 111-1334; 2019, BTN2A2, 10074, 112524, 112-1683; 2019, BTN2A2, 10075, 112525, 87-857; 2019, BTN2A2, 10076, 112526, 137-1708; 2019, BTN2A2, 10078, 112528, 235-1245; 2019, BTN2A2, 10086, 112536, 87-1028; 2020, BTN3A1, 10088, 112538, 224-580; 2020, BTN3A1, 10090, 112540, 441-570; 2020, BTN3A1, 10093, 112543, 345-619; 2020, BTN3A1, 10087, 112537, 369-1910; 2020, BTN3A1, 10089, 112539, 356-1492; 2020, BTN3A1, 10091, 112541, 311-1696; 2020, BTN3A1, 10092, 112542, 199-1257; 2021, BTN3A2, 10099, 112549, 115-593; 2021, BTN3A2, 10100, 112550, 192-323; 2021, BTN3A2, 10101, 112551, 151-496; 2021, BTN3A2, 10102, 112552, 297-885; 2021, BTN3A2, 10104, 112554, 1-348; 2021, BTN3A2, 10094, 112544, 189-1193; 2021, BTN3A2, 10095, 112545, 156-1160; 2021, BTN3A2, 10096, 112546, 179-1114; 2021, BTN3A2, 10097, 112547, 154-1158; 2021, BTN3A2, 10098, 112548, 199-1203; 2021, BTN3A2, 10103, 112553, 297-1175; 2022, BTN3A3, 10107, 112557, 259-671; 2022, BTN3A3, 10108, 112558, 276-697; 2022, BTN3A3, 10109, 112559, 244-626; 2022, BTN3A3, 10110, 112560, 133-883; 2022, BTN3A3, 10111, 112561, 135-765; 2022, BTN3A3, 10112, 112562, 290-1002; 2022, BTN3A3, 10113, 112563, 326-626; 2022, BTN3A3, 10105, 112555, 244-1998; 2022, BTN3A3, 10106, 112556, 283-1890; 2023, BTNL2, 10115, 112565, 8-333; 2023, BTNL2, 10116, 112566, 6-331; 2023, BTNL2, 10117, 112567, 6-1454; 2023, BTNL2, 10118, 112568, 1-207; 2023, BTNL2, 10119, 112569, 1-207; 2023, BTNL2, 10120, 112570, 8-333; 2023, BTNL2, 10121, 112571, 1-207; 2023, BTNL2, 10122, 112572, 1-207; 2023, BTNL2, 10123, 112573, 8-1456; 2023, BTNL2, 10124, 112574, 8-1456; 2023, BTNL2, 10125, 112575, 8-1456; 2023, BTNL2, 10126, 112576, 1-207; 2023, BTNL2, 10127, 112577, 8-333; 2023, BTNL2, 10128, 112578, 8-333; 2023, BTNL2, 10129, 112579, 8-333; 2023, BTNL2, 10130, 112580, 8-333; 2023, BTNL2, 10131, 112581, 1-207; 2023, BTNL2, 10132, 112582, 8-1456; 2023, BTNL2, 10133, 112583, 8-1456; 2023, BTNL2, 10134, 112584, 8-1456; 2023, BTNL2, 10135, 112585, 8-1456; 2023, BTNL2, 10136, 112586, 8-333; 2023, BTNL2, 10137, 112587, 1-207; 2023, BTNL2, 10146, 112596, 1-1368; 2023, BTNL2, 10149, 112599, 1-1368; 2023, BTNL2, 10150, 112600, 1-1368; 2023, BTNL2, 10156, 112606, 309-845; 2023, BTNL2, 10157, 112607, 1-1368; 2023, BTNL2, 10114, 112564, 1-1368; 2023, BTNL2, 10138, 112588, 309-845; 2023, BTNL2, 10139, 112589, 309-845; 2023, BTNL2, 10140, 112590, 309-845; 2023, BTNL2, 10141, 112591, 309-845; 2023, BTNL2, 10142, 112592, 309-845; 2023, BTNL2, 10143, 112593, 1-738; 2023, BTNL2, 10144, 112594, 1-1368; 2023, BTNL2, 10145, 112595, 1-1368; 2023, BTNL2, 10147, 112597, 309-845; 2023, BTNL2, 10148, 112598, 1-738; 2023, BTNL2, 10151, 112601, 309-845; 2023, BTNL2, 10152, 112602, 1-1368; 2023, BTNL2, 10153, 112603, 1-1368; 2023, BTNL2, 10154, 112604, 309-845; 2023, BTNL2, 10155, 112605, 1-738; 2024, BTNL3, 10158, 112608, 185-1585; 2025, BTNL8, 10162, 112612, 6-131; 2025, BTNL8, 10165, 112615, 359-1240; 2025, BTNL8, 10159, 112609, 235-1278; 2025, BTNL8, 10160, 112610, 207-1709; 2025, BTNL8, 10161, 112611, 268-1395; 2025, BTNL8, 10163, 112613, 38-1060; 2025, BTNL8, 10164, 112614, 38-1192; 2025, BTNL8, 10166, 112616, 290-1240; 2025, BTNL8, 10167, 112617, 1-1128; 2026, BTNL9, 10171, 112621, 266-1006; 2026, BTNL9, 10168, 112618, 232-1839; 2026, BTNL9, 10169, 112619, 232-1266; 2026, BTNL9, 10170, 112620, 220-1167; 2027, BCHE, 10173, 112623, 1-399; 2027, BCHE, 10174, 112624, 1-363; 2027, BCHE, 10175, 112625, 158-1846; 2027, BCHE, 10176, 112626, 158-1735; 2027, BCHE, 10172, 112622, 168-1976; 2028, N/A, 10177, 112627, 69-296; 2029, N/A, 10178, 112628, 1-414; 2030, BYSL, 10180, 112630, 1-550; 2030, BYSL, 10181, 112631, 30-614; 2030, BYSL, 10179, 112629, 376-1689; 2031, C15orf38-AP3S2, 10182, 112632, 48-1232; 2031, C15orf38-AP3S2, 10183, 112633, 108-664; 2031, C15orf38-AP3S2, 10184, 112634, 122-675; 2032, C1D, 10186, 112636, 157-699; 2032, C1D, 10185, 112635, 49-474; 2032, C1D, 10187, 112637, 78-503; 2032, C1D, 10188, 112638, 135-560; 2033, C1GALT1C1, 10189, 112639, 240-1196; 2033, C1GALT1C1, 10190, 112640, 257-1213; 2034, C1GALT1C1L, 10191, 112641, 1-948; 2035, C1QTNF1, 10192, 112642, 326-925; 2035, C1QTNF1, 10200, 112650, 536-1135; 2035, C1QTNF1, 10193, 112643, 556-1401; 2035, C1QTNF1, 10194, 112644, 170-1015; 2035, C1QTNF1, 10195, 112645, 288-1133; 2035, C1QTNF1, 10196, 112646, 364-1209; 2035, C1QTNF1, 10197, 112647, 392-1237; 2035, C1QTNF1, 10198, 112648, 125-970; 2035, C1QTNF1, 10199, 112649, 377-1222; 2035, C1QTNF1, 10201, 112651, 440-1285; 2036, C1QTNF2, 10202, 112652, 5-997; 2037, C1QTNF3, 10203, 112653, 89-829; 2037, C1QTNF3, 10204, 112654, 708-1667; 2038, C1QTNF4, 10206, 112656, 1-301; 2038, C1QTNF4, 10205, 112655, 518-1507; 2039, C1QTNF5, 10209, 112659, 290-469; 2039, C1QTNF5, 10207, 112657, 233-964; 2039, C1QTNF5, 10208, 112658, 171-902; 2040, C1QTNF6, 10212, 112662, 24-374; 2040, C1QTNF6, 10210, 112660, 77-913; 2040, C1QTNF6, 10211, 112661, 74-910; 2041, C1QTNF7, 10214, 112664, 230-566; 2041, C1QTNF7, 10215, 112665, 130-583; 2041, C1QTNF7, 10213, 112663, 260-1150; 2041, C1QTNF7, 10216, 112666, 327-1196; 2041, C1QTNF7, 10217, 112667, 228-1097; 2042, C1QTNF8, 10219, 112669, 45-815; 2042, C1QTNF8, 10218, 112668, 275-1033; 2043, C1QTNF9, 10220, 112670, 62-1063; 2043, C1QTNF9, 10221, 112671, 86-1087; 2044, C1QTNF9B, 10224, 112674, 211-510; 2044, C1QTNF9B, 10222, 112672, 21-1022; 2044, C1QTNF9B, 10223, 112673, 62-1063; 2045, C1QTNF3-AMACR, 10225, 112675, 76-930; 2046, N/A, 10226, 112676, 1-303; 2047, C2CD2, 10229, 112679, 1-547; 2047, C2CD2, 10227, 112677, 207-1832; 2047, C2CD2, 10228, 112678, 243-2333; 2048, C2CD3, 10232, 112682, 1-2331; 2048, C2CD3, 10233, 112683, 1-2034; 2048, C2CD3, 10234, 112684, 1-574; 2048, C2CD3, 10235, 112685, 1-514; 2048, C2CD3, 10236, 112686, 193-1713; 2048, C2CD3, 10230, 112680, 228-6119; 2048, C2CD3, 10231, 112681, 228-7289; 2049, C2CD4A, 10237, 112687, 142-1251; 2050, C2CD4B, 10238, 112688, 130-1224; 2051, C2CD4C, 10239, 112689, 206-1471; 2052, C2CD4D, 10240, 112690, 587-1648; 2053, C2CD5, 10244, 112694, 1-850; 2053, C2CD5, 10245, 112695, 1-497; 2053, C2CD5, 10249, 112699, 1-544; 2053, C2CD5, 10241, 112691, 257-3259; 2053, C2CD5, 10242, 112692, 120-3248; 2053, C2CD5, 10243, 112693, 120-3275; 2053, C2CD5, 10246, 112696, 120-3281; 2053, C2CD5, 10247, 112697, 104-3259; 2053, C2CD5, 10248, 112698, 203-3367; 2054, C21orf62-AS1, 10251, 112701, 230-271; 2054, C21orf62-AS1, 10252, 112702, 203-352; 2054, C21orf62-AS1, 10250, 112700, 241-480; 2054, C21orf62-AS1, 10253, 112703, 291-530; 2055, C2CD2L, 10255, 112705, 71-1246; 2055, C2CD2L, 10254, 112704, 360-2483; 2056, CPAMD8, 10257, 112707, 174-1685; 2056, CPAMD8, 10259, 112709, 1-526; 2056, CPAMD8, 10260, 112710, 1-1016; 2056, CPAMD8, 10261, 112711, 1-171; 2056, CPAMD8, 10256, 112706, 33-1685; 2056, CPAMD8, 10258, 112708, 33-5831; 2057, C7orf55-LUC7L2, 10262, 112712, 26-1402; 2058, C8orf44-SGK3, 10263, 112713, 568-2058; 2059, CADPS, 10267, 112717, 1-570; 2059, CADPS, 10268, 112718, 1-719; 2059, CADPS, 10269, 112719, 1-933; 2059, CADPS, 10271, 112721, 1-1037; 2059, CADPS, 10272, 112722, 1-637; 2059, CADPS, 10273, 112723, 85-753; 2059, CADPS, 10274, 112724, 361-4395; 2059, CADPS, 10264, 112714, 213-4157; 2059, CADPS, 10265, 112715, 310-4134; 2059, CADPS, 10266, 112716, 351-4412; 2059, CADPS, 10270, 112720, 1-1374; 2060, CADPS2, 10275, 112725, 741-4325; 2060, CADPS2, 10276, 112726, 423-4307; 2060, CADPS2, 10277, 112727, 1-2698; 2060, CADPS2, 10280, 112730, 1-1472; 2060, CADPS2, 10281, 112731, 423-4328; 2060, CADPS2, 10278, 112728, 21-3911; 2060, CADPS2, 10279, 112729, 122-3889; 2061, CACHD1, 10282, 112732, 107-3778; 2062, CACTIN, 10286, 112736, 1-354; 2062, CACTIN, 10288, 112738, 1-424; 2062, CACTIN, 10289, 112739, 1-874; 2062, CACTIN, 10290, 112740, 1-391; 2062, CACTIN, 10283, 112733, 54-2330; 2062, CACTIN, 10284, 112734, 54-2330; 2062, CACTIN, 10285, 112735, 54-2330; 2062, CACTIN, 10287, 112737, 54-2330; 2063, CDH1, 10293, 112743, 105-1718; 2063, CDH1, 10294, 112744, 65-1309; 2063, CDH1, 10295, 112745, 1-466; 2063, CDH1, 10296, 112746, 125-2068; 2063, CDH1, 10297, 112747, 108-2051; 2063, CDH1, 10298, 112748, 125-2836; 2063, CDH1, 10291, 112741, 192-2840; 2063, CDH1, 10292, 112742, 65-2530; 2064, CDH10, 10300, 112750, 311-1621; 2064, CDH10, 10299, 112749, 509-2875; 2065, CDH11, 10303, 112753, 453-613; 2065, CDH11, 10304, 112754, 359-568; 2065, CDH11, 10305, 112755, 466-569; 2065, CDH11, 10306, 112756, 570-1235; 2065, CDH11, 10307, 112757, 516-582; 2065, CDH11, 10308, 112758, 370-566; 2065, CDH11, 10309, 112759, 327-2339; 2065, CDH11, 10310, 112760, 1-187; 2065, CDH11, 10301, 112751, 617-3007; 2065, CDH11, 10302, 112752, 455-2536; 2066, CDH12, 10311, 112761, 1088-3472; 2066, CDH12, 10312, 112762, 712-3096; 2066, CDH12, 10313, 112763, 524-2788; 2066, CDH12, 10314, 112764, 535-2919; 2067, CDH13, 10318, 112768, 124-282; 2067, CDH13, 10319, 112769, 1-2106; 2067, CDH13, 10320, 112770, 126-329; 2067, CDH13, 10321, 112771, 55-258; 2067, CDH13, 10323, 112773, 125-238; 2067, CDH13, 10324, 112774, 128-298; 2067, CDH13, 10326, 112776, 1-1062; 2067, CDH13, 10327, 112777, 1-1986; 2067, CDH13, 10315, 112765, 94-2376; 2067, CDH13, 10316, 112766, 124-2148; 2067, CDH13, 10317, 112767, 124-696; 2067, CDH13, 10322, 112772, 124-651; 2067, CDH13, 10325, 112775, 291-2432; 2068, CDH15, 10328, 112778, 66-2510; 2069, CDH16, 10333, 112783, 95-622; 2069, CDH16, 10334, 112784, 87-2336; 2069, CDH16, 10335, 112785, 63-809; 2069, CDH16, 10336, 112786, 1-715; 2069, CDH16, 10337, 112787, 210-582; 2069, CDH16, 10329, 112779, 195-2684; 2069, CDH16, 10330, 112780, 128-2551; 2069, CDH16, 10331, 112781, 59-2431; 2069, CDH16, 10332, 112782, 59-2257; 2070, CDH17, 10339, 112789, 94-1836; 2070, CDH17, 10341, 112791, 196-637; 2070, CDH17, 10342, 112792, 1-271; 2070, CDH17, 10338, 112788, 126-2624; 2070, CDH17, 10340, 112790, 127-2625; 2071, CDH18, 10346, 112796, 513-2240; 2071, CDH18, 10348, 112798, 379-2151; 2071, CDH18, 10349, 112799, 1-1326; 2071, CDH18, 10343, 112793, 259-2631; 2071, CDH18, 10344, 112794, 521-2893; 2071, CDH18, 10345, 112795, 476-2200; 2071, CDH18, 10347, 112797, 992-3364; 2072, CDH19, 10351, 112801, 1-1305; 2072, CDH19, 10353, 112803, 298-1923; 2072, CDH19, 10354, 112804, 393-587; 2072, CDH19, 10350, 112800, 294-2612; 2072, CDH19, 10352, 112802, 248-1720; 2073, CDH2, 10357, 112807, 168-740; 2073, CDH2, 10358, 112808, 251-610; 2073, CDH2, 10359, 112809, 345-563; 2073, CDH2, 10355, 112805, 425-3145; 2073, CDH2, 10356, 112806, 38-2665; 2074, CDH20, 10360, 112810, 399-2804; 2074, CDH20, 10361, 112811, 278-2683; 2074, CDH20, 10362, 112812, 13-2418; 2075, CDH22, 10363, 112813, 402-2888; 2075, CDH22, 10364, 112814, 644-3130; 2076, CDH24, 10369, 112819, 261-1205; 2076, CDH24, 10365, 112815, 94-2553; 2076, CDH24, 10366, 112816, 261-2720; 2076, CDH24, 10367, 112817, 261-2606; 2076, CDH24, 10368, 112818, 94-2439; 2077, CDH26, 10373, 112823, 1-1334; 2077, CDH26, 10374, 112824, 178-418; 2077, CDH26, 10370, 112820, 208-582; 2077, CDH26, 10371, 112821, 198-695; 2077, CDH26, 10372, 112822, 301-2799; 2078, CDH3, 10377, 112827, 1-221; 2078, CDH3, 10378, 112828, 1-125; 2078, CDH3, 10379, 112829, 1-467; 2078, CDH3, 10380, 112830, 1-246; 2078, CDH3, 10381, 112831, 80-226; 2078, CDH3, 10382, 112832, 1-179; 2078, CDH3, 10375, 112825, 545-3034; 2078, CDH3, 10376, 112826, 388-2742; 2079, CDH4, 10384, 112834, 561-3029; 2079, CDH4, 10386, 112836, 1-1701; 2079, CDH4, 10387, 112837, 1-1701; 2079, CDH4, 10388, 112838, 1-1701; 2079, CDH4, 10383, 112833, 283-2811; 2079, CDH4, 10385, 112835, 89-2839; 2080, CDH5, 10390, 112840, 222-615; 2080, CDH5, 10391, 112841, 540-591; 2080, CDH5, 10392, 112842, 89-421; 2080, CDH5, 10393, 112843, 231-459; 2080, CDH5, 10394, 112844, 114-1334; 2080, CDH5, 10395, 112845, 835-1506; 2080, CDH5, 10389, 112839, 149-2503; 2080, CDH5, 10396, 112846, 157-2166; 2081, CDH6, 10398, 112848, 431-2257; 2081, CDH6, 10397, 112847, 266-2638; 2082, CDH7, 10401, 112851, 695-2587; 2082, CDH7, 10399, 112849, 326-2683; 2082, CDH7, 10400, 112850, 427-2784; 2083, CDH8, 10402, 112852, 956-3193; 2083, CDH8, 10403, 112853, 200-2434; 2083, CDH8, 10405, 112855, 316-559; 2083, CDH8, 10406, 112856, 252-1528; 2083, CDH8, 10407, 112857, 433-1863; 2083, CDH8, 10408, 112858, 523-2121; 2083, CDH8, 10404, 112854, 956-3355; 2084, CDH9, 10410, 112860, 288-532; 2084, CDH9, 10411, 112861, 159-556; 2084, CDH9, 10409, 112859, 174-2543; 2085, CELSR1, 10413, 112863, 1-2318; 2085, CELSR1, 10412, 112862, 1-9045; 2086, CELSR2, 10414, 112864, 62-8833; 2087, CELSR3, 10415, 112865, 282-10220; 2088, CPED1, 10417, 112867, 448-1056; 2088, CPED1, 10418, 112868, 116-1118; 2088, CPED1, 10419, 112869, 572-2219; 2088, CPED1, 10421, 112871, 253-1944; 2088, CPED1, 10422, 112872, 1-183; 2088, CPED1, 10416, 112866, 468-3548; 2088, CPED1, 10420, 112870, 24-2375; 2089, CDH23, 10423, 112873, 391-10470; 2089, CDH23, 10424, 112874, 388-3573; 2089, CDH23, 10426, 112876, 391-4533; 2089, CDH23, 10427, 112877, 403-1740; 2089, CDH23, 10428, 112878, 1-2411; 2089, CDH23, 10429, 112879, 389-1981; 2089, CDH23, 10430, 112880, 1-2863; 2089, CDH23, 10432, 112882, 1-496; 2089, CDH23, 10433, 112883, 363-4508; 2089, CDH23, 10434, 112884, 391-10455; 2089, CDH23, 10425, 112875, 318-3662; 2089, CDH23, 10431, 112881, 318-3557; 2090, CDHR1, 10436, 112886, 1-1795; 2090, CDHR1, 10437, 112887, 1-407; 2090, CDHR1, 10438, 112888, 1-235; 2090, CDHR1, 10439, 112889, 1-145; 2090, CDHR1, 10435, 112885, 112-2349; 2090, CDHR1, 10440, 112890, 127-2706; 2091, CDHR2, 10444, 112894, 193-381; 2091, CDHR2, 10441, 112891, 40-3972; 2091, CDHR2, 10442, 112892, 48-3980; 2091, CDHR2, 10443, 112893, 275-4207; 2092, CDHR3, 10446, 112896, 24-473; 2092, CDHR3, 10447, 112897, 122-2515; 2092, CDHR3, 10448, 112898, 1-482; 2092, CDHR3, 10449, 112899, 1-957; 2092, CDHR3, 10450, 112900, 170-355; 2092, CDHR3, 10445, 112895, 81-2738; 2093, CDHR4, 10453, 112903, 1-405; 2093, CDHR4, 10454, 112904, 1-454; 2093, CDHR4, 10455, 112905, 24-578; 2093, CDHR4, 10451, 112901, 24-623; 2093, CDHR4, 10452, 112902, 10-2376; 2094, CDHR5, 10459, 112909, 452-496; 2094, CDHR5, 10460, 112910, 54-625; 2094, CDHR5, 10461, 112911, 54-550; 2094, CDHR5, 10462, 112912, 31-351; 2094, CDHR5, 10463, 112913, 166-2703; 2094, CDHR5, 10464, 112914, 268-2223; 2094, CDHR5, 10465, 112915, 452-496; 2094, CDHR5, 10466, 112916, 54-550; 2094, CDHR5, 10467, 112917, 31-351; 2094, CDHR5, 10468, 112918, 54-625; 2094, CDHR5, 10469, 112919, 324-2861; 2094, CDHR5, 10456, 112906, 268-2223; 2094, CDHR5, 10457, 112907, 324-2861; 2094, CDHR5, 10458, 112908, 166-2703; 2095, CALB1, 10471, 112921, 280-636; 2095, CALB1, 10473, 112923, 553-561; 2095, CALB1, 10474, 112924, 243-548; 2095, CALB1, 10470, 112920, 183-968; 2095, CALB1, 10472, 112922, 122-736; 2096, CALB2, 10476, 112926, 81-659; 2096, CALB2, 10477, 112927, 1-472; 2096, CALB2, 10478, 112928, 1-704; 2096, CALB2, 10479, 112929, 78-893; 2096, CALB2, 10480, 112930, 81-659; 2096, CALB2, 10481, 112931, 1-704; 2096, CALB2, 10482, 112932, 1-472; 2096, CALB2, 10475, 112925, 78-893; 2097, CABIN1, 10484, 112934, 219-1991; 2097, CABIN1, 10487, 112937, 251-1321; 2097, CABIN1, 10488, 112938, 388-1472; 2097, CABIN1, 10489, 112939, 128-6640; 2097, CABIN1, 10490, 112940, 53-1822; 2097, CABIN1, 10483, 112933, 128-6790; 2097, CABIN1, 10485, 112935, 386-7048; 2097, CABIN1, 10486, 112936, 95-6520; 2098, CHP1, 10492, 112942, 145-531; 2098, CHP1, 10493, 112943, 162-533; 2098, CHP1, 10494, 112944, 244-405; 2098, CHP1, 10495, 112945, 1-274; 2098, CHP1, 10496, 112946, 91-555; 2098, CHP1, 10491, 112941, 241-828; 2099, CHP2, 10497, 112947, 424-1014; 2100, CPPED1, 10498, 112948, 76-444; 2100, CPPED1, 10499, 112949, 242-1186; 2100, CPPED1, 10500, 112950, 76-594; 2101, CALCR, 10501, 112951, 301-1827; 2101, CALCR, 10502, 112952, 33-521; 2101, CALCR, 10503, 112953, 317-1741; 2101, CALCR, 10504, 112954, 284-1708; 2101, CALCR, 10506, 112956, 290-1762; 2101, CALCR, 10505, 112955, 1-873; 2101, CALCR, 10507, 112957, 1-825; 2102, CAL-CRL, 10509, 112959, 479-591; 2102, CALCRL, 10512, 112962, 410-642; 2102, CALCRL, 10508, 112958, 715-2100; 2102, CALCRL, 10510, 112960, 783-2168; 2102, CALCRL, 10511, 112961, 342-1727; 2103, CALCA, 10513, 112963, 120-545; 2103, CALCA, 10515, 112965, 63-488; 2103, CALCA, 10517, 112967, 38-463; 2103, CALCA, 10514, 112964, 76-462; 2103, CALCA, 10516, 112966, 10-396; 2104, CALCB, 10519, 112969, 1263-1679; 2104, CALCB, 10518, 112968, 112-495; 2104, CALCB, 10520, 112970, 112-495; 2105, CANT1, 10523, 112973, 351-466; 2105, CANT1, 10524, 112974, 652-881; 2105, CANT1, 10525, 112975, 545-900; 2105, CANT1, 10526, 112976, 419-614; 2105, CANT1, 10527, 112977, 127-921; 2105, CANT1, 10529, 112979, 554-599; 2105, CANT1, 10530, 112980, 387-502; 2105, CANT1, 10531, 112981, 587-769; 2105, CANT1, 10521, 112971, 496-1701; 2105, CANT1, 10522, 112972, 214-1419; 2105, CANT1, 10528, 112978, 401-1606; 2105, CANT1, 10532, 112982, 299-1504; 2106, CIB1, 10533, 112983, 163-738; 2106, CIB1, 10534, 112984, 163-858; 2107, CIB2, 10537, 112987, 143-646; 2107, CIB2, 10538, 112988, 21-462; 2107, CIB2, 10539, 112989, 11-390; 2107, CIB2, 10540, 112990, 280-443; 2107, CIB2, 10542, 112992, 1-147; 2107, CIB2, 10543, 112993, 57-335; 2107, CIB2, 10535, 112985, 330-893; 2107, CIB2, 10536, 112986, 415-849; 2107, CIB2, 10541, 112991, 219-635; 2108, CIB3, 10546, 112996, 1-138; 2108, CIB3, 10544, 112994, 51-614; 2108, CIB3, 10545, 112995, 1-417; 2109, CIB4, 10547, 112997, 55-612; 2110, CALCOCO1, 10550, 113000, 165-567; 2110, CAL-COCO1, 10551, 113001, 298-746; 2110, CALCOCO1, 10553, 113003, 192-551; 2110, CALCOCO1, 10554, 113004, 71-549; 2110, CALCOCO1, 10555, 113005, 73-554; 2110, CALCOCO1, 10556, 113006, 236-549; 2110, CALCOCO1, 10558, 113008, 240-586; 2110, CALCOCO1, 10559, 113009, 66-559; 2110, CALCOCO1, 10560, 113010, 1-698; 2110, CALCOCO1, 10548, 112998, 367-2439; 2110, CALCOCO1, 10549, 112999, 61-1881; 2110, CALCOCO1, 10552, 113002, 50-1951; 2110, CALCOCO1, 10557, 113007, 62-2137; 2111, CALCOCO2, 10564, 113014, 34-495; 2111, CALCOCO2, 10566, 113016, 1-388; 2111, CALCOCO2, 10567, 113017, 686-767; 2111, CALCOCO2, 10569, 113019, 146-724; 2111, CALCOCO2, 10570, 113020, 195-973; 2111, CALCOCO2, 10571, 113021, 55-558; 2111, CALCOCO2, 10572, 113022, 1-132; 2111, CALCOCO2, 10573, 113023, 191-553; 2111, CALCOCO2, 10574, 113024, 47-373; 2111, CALCOCO2, 10561, 113011, 102-1442; 2111, CALCOCO2, 10562, 113012, 56-1468; 2111, CALCOCO2, 10563, 113013, 55-1269; 2111, CAL-COCO2, 10565, 113015, 81-1205; 2111, CALCOCO2, 10568, 113018, 64-1467; 2112, CABP1, 10578, 113028, 513-1433; 2112, CABP1, 10575, 113025, 132-635; 2112, CABP1, 10576, 113026, 554-1237; 2112, CABP1, 10577, 113027, 135-1247; 2113, CABP2, 10581, 113031, 103-321; 2113, CABP2, 10579, 113029, 71-733; 2113, CABP2, 10580, 113030, 71-562; 2114, CAB39, 10585, 113035, 5-1024; 2114, CAB39, 10582, 113032, 430-1455; 2114, CAB39, 10583, 113033, 555-1580; 2114, CAB39, 10584, 113034, 299-1324; 2115, CAB39L, 10590, 113040, 189-468; 2115, CAB39L, 10591, 113041, 145-726; 2115, CAB39L, 10592, 113042, 249-633; 2115, CAB39L, 10593, 113043, 163-727; 2115, CAB39L, 10594, 113044, 1-843; 2115, CAB39L, 10586, 113036, 189-1202; 2115, CAB39L, 10587, 113037, 499-1512; 2115, CAB39L, 10588, 113038, 452-1465; 2115, CAB39L, 10589, 113039, 387-1400; 2115, CAB39L, 10595, 113045, 520-1533; 2116, CABP4, 10598, 113048, 22-408; 2116, CABP4, 10596, 113046, 78-905; 2116, CABP4, 10597, 113047, 345-857; 2117, CABP5, 10599, 113049, 132-653; 2118, CABP7, 10600, 113050, 342-989; 2119, CABYR, 10608, 113058, 82-303; 2119, CABYR, 10609, 113059, 82-303; 2119, CABYR, 10610, 113060, 199-451; 2119, CABYR, 10611, 113061, 47-634; 2119, CABYR, 10612, 113062, 1-880; 2119, CABYR, 10613, 113063, 467-605; 2119, CABYR, 10614, 113064, 487-596; 2119, CABYR, 10615, 113065, 82-303; 2119, CABYR, 10617, 113067, 228-1415; 2119, CABYR, 10601, 113051, 183-1028; 2119, CABYR, 10602, 113052, 127-1554; 2119, CABYR, 10603, 113053, 188-1327; 2119, CABYR, 10604, 113054, 61-1200; 2119, CABYR, 10605, 113055, 76-741; 2119, CABYR, 10606, 113056, 82-1563; 2119, CABYR, 10607, 113057, 86-1567; 2119, CABYR, 10616, 113066, 49-1530; 2120, CACFD1, 10620, 113070, 13-356; 2120, CACFD1, 10623, 113073, 103-804; 2120, CACFD1, 10624, 113074, 101-493; 2120, CACFD1, 10625, 113075, 81-599; 2120, CACFD1, 10626, 113076, 103-678; 2120, CACFD1, 10627, 113077, 13-356; 2120, CACFD1, 10618, 113068, 101-493; 2120, CACFD1, 10619, 113069, 81-599; 2120, CACFD1, 10621, 113071, 103-804; 2120, CACFD1, 10622, 113072, 103-678; 2121, CACNA2D1, 10630, 113080, 258-1187; 2121, CACNA2D1, 10631, 113081, 1-840; 2121, CACNA2D1, 10628, 113078, 257-3568; 2121, CACNA2D1, 10629, 113079, 340-3615; 2122, CACNA2D2, 10635, 113085, 6-3440; 2122, CACNA2D2, 10636, 113086, 1-3462; 2122, CACNA2D2, 10632, 113082, 175-3612; 2122, CACNA2D2, 10633, 113083, 178-3408; 2122, CACNA2D2, 10634, 113084, 1-3432; 2122, CACNA2D2, 10637, 113087, 1-3453; 2123, CACNA2D3, 10641, 113091, 195-1772; 2123, CACNA2D3, 10642, 113092, 216-356; 2123, CACNA2D3, 10643, 113093, 182-559; 2123, CACNA2D3, 10638, 113088, 49-3324; 2123, CACNA2D3, 10639, 113089, 119-3394; 2123, CACNA2D3, 10640, 113090, 213-3206; 2123, CACNA2D3, 10644, 113094, 213-1772; 2123, CACNA2D3, 10645, 113095, 49-3324; 2123, CACNA2D3, 10646, 113096, 213-1772; 2124, CACNA2D4, 10648, 113098, 165-1970; 2124, CACNA2D4, 10649, 113099, 1-577; 2124, CACNA2D4, 10651, 113101, 52-900; 2124, CACNA2D4, 10652, 113102, 83-886; 2124, CACNA2D4, 10653, 113103, 32-202; 2124, CACNA2D4, 10655, 113105, 59-3397; 2124, CACNA2D4, 10656, 113106, 52-222; 2124, CACNA2D4, 10658, 113108, 74-2416; 2124, CACNA2D4, 10659, 113109, 1-854; 2124, CACNA2D4, 10647, 113097, 364-3777; 2124, CACNA2D4, 10650, 113100, 30-155; 2124, CACNA2D4, 10654, 113104, 1-3465; 2124, CACNA2D4, 10657, 113107, 1-3273; 2124, CACNA2D4, 10660, 113110, 1-3222; 2125, CACNB1, 10664, 113114, 209-859; 2125, CACNB1, 10661, 113111, 209-1780; 2125, CACNB1, 10662, 113112, 209-2005; 2125, CACNB1, 10663, 113113, 208-1644; 2126, CACNB2, 10670, 113120, 1-1233; 2126, CACNB2, 10674, 113124, 97-591; 2126, CACNB2, 10675, 113125, 502-2247; 2126, CACNB2, 10676, 113126, 502-1569; 2126, CACNB2, 10677, 113127, 1-531; 2126, CACNB2, 10665, 113115, 223-2121; 2126, CACNB2, 10666, 113116, 61-2043; 2126, CACNB2, 10667, 113117, 1-1911; 2126, CACNB2, 10668, 113118, 220-2058; 2126, CACNB2, 10669, 113119, 10-1713; 2126, CACNB2, 10671, 113121, 191-2011; 2126, CACNB2, 10672, 113122, 1-1827; 2126, CACNB2, 10673, 113123, 502-2319; 2127, CACNB3, 10681, 113131, 427-1800; 2127, CACNB3, 10682, 113132, 97-414; 2127, CACNB3, 10683, 113133, 1-255; 2127, CACNB3, 10684, 113134, 22-135; 2127, CACNB3, 10685, 113135, 582-746; 2127, CACNB3, 10686, 113136, 1-229; 2127, CACNB3, 10687, 113137, 539-904; 2127, CACNB3, 10689, 113139, 117-572; 2127, CACNB3, 10690, 113140, 144-576; 2127, CACNB3, 10678, 113128, 200-1654; 2127, CACNB3, 10679, 113129, 101-1552; 2127, CACNB3, 10680, 113130, 98-1513; 2127, CACNB3, 10688, 113138, 22-1353; 2128, CACNB4, 10692, 113142, 223-846; 2128, CACNB4, 10693, 113143, 427-1848; 2128, CACNB4, 10694, 113144, 1-1548; 2128, CACNB4, 10695, 113145, 258-583; 2128, CACNB4, 10691, 113141, 13-1389; 2128, CACNB4, 10696, 113146, 73-1581; 2128, CACNB4, 10697, 113147, 69-1631; 2128, CACNB4, 10698, 113148, 228-1688; 2129, CBARP, 10699, 113149, 87-431; 2129, CBARP, 10701, 113151, 113-262; 2129, CBARP, 10702, 113152, 294-1655; 2129, CBARP, 10703, 113153, 1-275; 2129, CBARP, 10700, 113150, 276-2453; 2130, CACNG1, 10704, 113154, 72-740; 2131, CACNG2, 10705, 113155, 983-1954; 2132, CACNG3, 10706, 113156, 1203-2150; 2133, CACNG4, 10707, 113157, 3-986; 2134, CACNG5, 10708, 113158, 61-888; 2134, CACNG5, 10709, 113159, 238-1065; 2135, CACNG6, 10711, 113161, 1-645; 2135, CACNG6, 10712, 113162, 591-1160; 2135, CACNG6, 10710, 113160, 591-1373; 2136, CACNG7, 10714, 113164, 16-612; 2136, CACNG7, 10713, 113163, 96-923; 2136, CACNG7, 10715, 113165, 213-1040; 2137, CACNG8, 10716, 113166, 104-1381; 2138, CACNA1C, 10718, 113168, 1-6522; 2138, CACNA1C, 10719, 113169, 266-6757; 2138, CACNA1C, 10727, 113177, 1-6522; 2138, CACNA1C, 10730, 113180, 1-6630; 2138, CACNA1C, 10738, 113188, 1-6630; 2138, CACNA1C, 10739, 113189, 26-3865; 2138, CACNA1C, 10740, 113190, 278-577; 2138, CACNA1C, 10741, 113191, 1-730; 2138, CACNA1C, 10742, 113192, 1-6120; 2138, CACNA1C, 10743, 113193, 114-545; 2138, CACNA1C, 10744, 113194, 1-6084; 2138, CACNA1C, 10745, 113195, 1-6189; 2138, CACNA1C, 10746, 113196, 276-2765; 2138, CACNA1C, 10747, 113197, 1-6045; 2138, CACNA1C, 10748, 113198, 1-6045; 2138, CACNA1C, 10717, 113167, 1-6561; 2138, CACNA1C, 10720, 113170, 1-6540; 2138, CACNA1C, 10721, 113171, 1-6441; 2138, CACNA1C, 10722, 113172, 1-6441; 2138, CACNA1C, 10723, 113173, 1-6417; 2138, CACNA1C, 10724, 113174, 1-6417; 2138, CACNA1C, 10725, 113175, 1-6417; 2138, CACNA1C, 10726, 113176, 1-6477; 2138, CACNA1C, 10728, 113178, 1-6474; 2138, CACNA1C, 10729, 113179, 1-6468; 2138, CACNA1C, 10731, 113181, 1-6474; 2138, CACNA1C, 10732, 113182, 1-6501; 2138, CACNA1C, 10733, 113183, 1-6417; 2138, CACNA1C, 10734, 113184, 1-6417; 2138, CACNA1C, 10735, 113185, 1-6435; 2138, CACNA1C, 10736, 113186, 266-6682; 2138, CACNA1C, 10737, 113187, 1-6474; 2139, CACNA1D, 10752, 113202, 1-5565; 2139, CACNA1D, 10753, 113203, 1-791; 2139, CACNA1D, 10749, 113199, 512-6997; 2139, CACNA1D, 10750, 113200, 119-6664; 2139, CACNA1D, 10751, 113201, 1-6414; 2140, CACNA1F, 10757, 113207, 1-351; 2140, CACNA1F, 10754, 113204, 63-5963; 2140, CACNA1F, 10755, 113205, 1-5739; 2140, CACNA1F, 10756, 113206, 63-5996; 2141, CACNA1S, 10759, 113209, 113-5677; 2141, CACNA1S, 10758, 113208, 228-5849; 2142, CACNA1B, 10760, 113210, 146-6859; 2142, CACNA1B, 10762, 113212, 1-7023; 2142, CACNA1B, 10763, 113213, 1-7017; 2142, CACNA1B, 10764, 113214, 120-7133; 2142, CACNA1B, 10766, 113216, 1-492; 2142, CACNA1B, 10761, 113211, 146-6859; 2142, CACNA1B, 10765, 113215, 146-7165; 2143, CACNA1A, 10768, 113218, 351-659; 2143, CACNA1A, 10770, 113220, 1-238; 2143, CACNA1A, 10771, 113221, 149-256; 2143, CACNA1A, 10772, 113222, 1-3543; 2143, CACNA1A, 10773, 113223, 1-2946; 2143, CACNA1A, 10774, 113224, 1-7539; 2143, CACNA1A, 10767, 113217, 1-7521; 2143, CACNA1A, 10769, 113219, 280-7065; 2144, CACNA1E, 10775, 113225, 1-6939; 2144, CACNA1E, 10777, 113227, 8-6892; 2144, CACNA1E, 10781, 113231, 481-1795; 2144, CACNA1E, 10776, 113226, 1-6756; 2144, CACNA1E, 10778, 113228, 1-6813; 2144, CACNA1E, 10779, 113229, 166-6978; 2144, CACNA1E, 10780, 113230, 1-6942; 2144, CACNA1E, 10782, 113232, 166-6921; 2144, CACNA1E, 10783, 113233, 1-6942; 2145, CACNA1G, 10789, 113239, 29-4696; 2145, CACNA1G, 10816, 113266, 1-1014; 2145, CACNA1G, 10817, 113267, 1-834; 2145, CACNA1G, 10784, 113234, 373-7125; 2145, CACNA1G, 10785, 113235, 393-7424; 2145, CACNA1G, 10786, 113236, 1-6516; 2145, CACNA1G, 10787, 113237, 1-7134; 2145, CACNA1G, 10788, 113238, 393-7178; 2145, CACNA1G, 10790, 113240, 176-6907; 2145, CACNA1G, 10791, 113241, 1-6801; 2145, CACNA1G, 10792, 113242, 1-7101; 2145, CACNA1G, 10793, 113243, 1-6585; 2145, CACNA1G, 10794, 113244, 1-6618; 2145, CACNA1G, 10795, 113245, 1-6684; 2145, CACNA1G, 10796, 113246, 1-6834; 2145, CACNA1G, 10797, 113247, 1-6999; 2145, CACNA1G, 10798, 113248, 1-6945; 2145, CACNA1G, 10799, 113249, 1-6876; 2145, CACNA1G, 10800, 113250, 1-5241; 2145, CACNA1G, 10801, 113251, 1-5298; 2145, CACNA1G, 10802, 113252, 1-6720; 2145, CACNA1G, 10803, 113253, 1-6921; 2145, CACNA1G, 10804, 113254, 1-6780; 2145, CACNA1G, 10805, 113255, 1-6855; 2145, CACNA1G, 10806, 113256, 1-6864; 2145, CACNA1G, 10807, 113257, 1-6966; 2145, CACNA1G, 10808, 113258, 1-6822; 2145, CACNA1G, 10809, 113259, 1-5331; 2145, CACNA1G, 10810, 113260, 1-5208; 2145, CACNA1G, 10811, 113261, 1-6699; 2145, CACNA1G, 10812, 113262, 1-6897; 2145, CACNA1G, 10813, 113263, 1-5262; 2145, CACNA1G, 10814, 113264, 1-6753; 2145, CACNA1G, 10815, 113265, 1-5277; 2146, CACNA1H, 10820, 113270, 1-3235; 2146, CACNA1H, 10821, 113271, 1-3301; 2146, CACNA1H, 10822, 113272, 1-2693; 2146, CACNA1H, 10824, 113274, 1-3253; 2146, CACNA1H, 10818, 113268, 249-7310; 2146, CACNA1H, 10819, 113269, 249-7292; 2146, CACNA1H, 10823, 113273, 1-7044; 2147, CACNA1I, 10825, 113275, 1-6051; 2147, CACNA1I, 10826, 113276, 1-6567; 2147, CACNA1I, 10827, 113277, 1-6672; 2147, CACNA1I, 10828, 113278, 1-5946; 2148, CHERP, 10829, 113279, 38-2821; 2148, CHERP, 10830, 113280, 153-2903; 2149, CALHM1, 10831, 113281, 138-1178; 2150, CALHM2, 10832, 113282, 525-1496; 2150, CALHM2, 10833, 113283, 506-1477; 2151, CALHM3, 10834, 113284, 209-1243; 2152, CAMLG, 10836, 113286, 39-281; 2152, CAMLG, 10835, 113285, 121-1011; 2153, CARHSP1, 10839, 113289, 163-556; 2153, CARHSP1, 10841, 113291, 189-565; 2153, CARHSP1, 10843, 113293, 118-461; 2153, CARHSP1, 10844, 113294, 185-521; 2153, CARHSP1, 10845, 113295, 230-442; 2153, CARHSP1, 10846, 113296, 308-681; 2153, CARHSP1, 10847, 113297, 303-587; 2153, CARHSP1, 10837, 113287, 52-495; 2153, CARHSP1, 10838, 113288, 361-804; 2153, CARHSP1, 10840, 113290, 43-486; 2153, CARHSP1, 10842, 113292, 56-499; 2153, CARHSP1, 10848, 113298, 177-620; 2153, CARHSP1, 10849, 113299, 185-628; 2153, CARHSP1, 10850, 113300, 267-710; 2153, CARHSP1, 10851, 113301, 169-612; 2153, CARHSP1, 10852, 113302, 308-751; 2154, CRACR2A, 10854, 113304, 1-596; 2154, CRACR2A, 10856, 113306, 1-355; 2154, CRACR2A, 10853, 113303, 470-1657; 2154, CRACR2A, 10855, 113305, 475-2670; 2155, CRACR2B, 10859, 113309, 561-824; 2155, CRACR2B, 10860, 113310, 500-742; 2155, CRACR2B, 10861, 113311, 472-575; 2155, CRACR2B, 10863, 113313, 372-530; 2155, CRACR2B, 10857, 113307, 349-1233; 2155, CRACR2B, 10858, 113308, 483-1367; 2155, CRACR2B, 10862, 113312, 102-1301; 2156, CARF, 10866, 113316, 312-597; 2156, CARF, 10867, 113317, 332-726; 2156, CARF, 10868, 113318, 228-1487; 2156, CARF, 10869, 113319, 474-537; 2156, CARF, 10870, 113320, 333-572; 2156, CARF, 10871, 113321, 317-594; 2156, CARF, 10873, 113323, 355-572; 2156, CARF, 10874, 113324, 345-460; 2156, CARF, 10875, 113325, 384-485; 2156, CARF, 10876, 113326, 376-595; 2156, CARF, 10877, 113327, 413-575; 2156, CARF, 10879, 113329, 219-788; 2156, CARF, 10881, 113331, 210-2081; 2156, CARF, 10882, 113332, 281-1210; 2156, CARF, 10864, 113314, 399-2348; 2156, CARF, 10865, 113315, 322-2499; 2156, CARF, 10872, 113322, 253-2202; 2156, CARF, 10878, 113328, 832-3009; 2156, CARF, 10880, 113330, 323-946; 2157, CAMK1, 10884, 113334, 163-282; 2157, CAMK1, 10885, 113335, 1-781; 2157, CAMK1, 10886, 113336, 194-560; 2157, CAMK1, 10883, 113333, 179-1291; 2158, CAMK1D, 10888, 113338, 1-876; 2158, CAMK1D, 10887, 113337, 87-1160; 2158, CAMK1D, 10889, 113339, 338-1495; 2159, CAMK1G, 10892, 113342, 74-808; 2159, CAMK1G, 10890, 113340, 246-1676; 2159, CAMK1G, 10891, 113341, 74-1504; 2160, CAMK2A, 10895, 113345, 269-540; 2160, CAMK2A, 10896, 113346, 485-557; 2160, CAMK2A, 10893, 113343, 667-2103; 2160, CAMK2A, 10894, 113344, 5-1474; 2161, CAMK2B, 10902, 113352, 65-1153; 2161, CAMK2B, 10906, 113356, 27-567; 2161, CAMK2B, 10907, 113357, 1-552; 2161, CAMK2B, 10909, 113359, 40-559; 2161, CAMK2B, 10911, 113361, 54-558; 2161, CAMK2B, 10912, 113362, 1-555; 2161, CAMK2B, 10913, 113363, 55-393; 2161, CAMK2B, 10897, 113347, 4-1557; 2161, CAMK2B, 10898, 113348, 76-1704; 2161, CAMK2B, 10899, 113349, 11-1450; 2161, CAMK2B, 10900, 113350, 4-1353; 2161, CAMK2B, 10901, 113351, 4-1482; 2161, CAMK2B, 10903, 113353, 205-1716; 2161, CAMK2B, 10904, 113354, 1-1557; 2161, CAMK2B, 10905, 113355, 78-2078; 2161, CAMK2B, 10908, 113358, 211-1767; 2161, CAMK2B, 10910, 113360, 236-1864; 2162, CAMK2D, 10921, 113371, 1-1497; 2162, CAMK2D, 10922, 113372, 1-583; 2162, CAMK2D, 10923, 113373, 116-1654; 2162, CAMK2D, 10924, 113374, 1-547; 2162, CAMK2D, 10925, 113375, 151-1752; 2162, CAMK2D, 10914, 113364, 860-2296; 2162, CAMK2D, 10915, 113365, 1-1500; 2162, CAMK2D, 10916, 113366, 63-1499; 2162, CAMK2D, 10917, 113367, 496-1974; 2162, CAMK2D, 10918, 113368, 378-1814; 2162, CAMK2D, 10919, 113369, 1-1470; 2162, CAMK2D, 10920, 113370, 1-1533; 2163, CAMK2G, 10930, 113380, 42-1592; 2163, CAMK2G, 10931, 113381, 131-1750; 2163, CAMK2G, 10932, 113382, 1-1362; 2163, CAMK2G, 10933, 113383, 1-1006; 2163, CAMK2G, 10934, 113384, 131-1807; 2163, CAMK2G, 10926, 113376, 59-1546; 2163, CAMK2G, 10927, 113377, 1-1590; 2163, CAMK2G, 10928, 113378, 120-1703; 2163, CAMK2G, 10929, 113379, 131-1801; 2164, CAMK2N1, 10935, 113385, 842-1078; 2165, CAMK2N2, 10936, 113386, 179-418; 2166, CAMK4, 10938, 113388, 76-405; 2166, CAMK4, 10940, 113390, 103-369; 2166, CAMK4, 10941, 113391, 103-369; 2166, CAMK4, 10942, 113392, 132-557; 2166, CAMK4, 10937, 113387, 399-1820; 2166, CAMK4, 10939, 113389, 100-1521; 2167, CAMKK1, 10945, 113395, 14-1612; 2167, CAMKK1, 10943, 113393, 150-1712; 2167, CAMKK1, 10944, 113394, 150-1667; 2168, CAMKK2, 10955, 113405, 68-1099; 2168, CAMKK2, 10956, 113406, 189-563; 2168, CAMKK2, 10957, 113407, 282-543; 2168, CAMKK2, 10946, 113396, 830-2596; 2168, CAMKK2, 10947, 113397, 579-2216; 2168, CAMKK2, 10948, 113398, 579-2204; 2168, CAMKK2, 10949, 113399, 830-2431; 2168, CAMKK2, 10950, 113400, 6-1676; 2168, CAMKK2, 10951, 113401, 133-1899; 2168, CAMKK2, 10952, 113402, 176-1942; 2168, CAMKK2, 10953, 113403, 579-2051; 2168, CAMKK2, 10954, 113404, 109-1734; 2168, CAMKK2, 10958, 113408, 579-2075; 2169, CASK, 10959, 113409, 476-2248; 2169, CASK, 10963, 113413, 1-1146; 2169, CASK, 10964, 113414, 360-1916; 2169, CASK, 10960, 113410, 352-3081; 2169, CASK, 10961, 113411, 476-3256; 2169, CASK, 10962, 113412, 28-2793; 2169, CASK, 10965, 113415, 20-2716; 2169, CASK, 10966, 113416, 25-2718; 2170, CABS1, 10967, 113417, 75-1262; 2171, CASR, 10969, 113419, 439-3705; 2171, CASR, 10968, 113418, 373-3609; 2172, CACYBP, 10973, 113423, 348-499; 2172, CACYBP, 10970, 113420, 449-1135; 2172, CACYBP, 10971, 113421, 1-243; 2172, CACYBP, 10972, 113422, 502-1059; 2172, CACYBP, 10974, 113424, 642-1199; 2173, CALY, 10975, 113425, 95-748; 2173, CALY, 10976, 113426, 60-536; 2173, CALY, 10977, 113427, 117-491; 2174, CAPS, 10980, 113430, 2368-3195; 2174, CAPS, 10981, 113431, 135-537; 2174, CAPS, 10978, 113428, 1-489; 2174, CAPS, 10979, 113429, 488-1234; 2174, CAPS, 10982, 113432, 151-720; 2175, CAPS2, 10983, 113433, 53-178; 2175, CAPS2, 10984, 113434, 52-480; 2175, CAPS2, 10987, 113437, 168-1595; 2175, CAPS2, 10988, 113438, 195-599; 2175, CAPS2, 10989, 113439, 459-559; 2175, CAPS2, 10990, 113440, 32-593; 2175, CAPS2, 10985, 113435, 603-1751; 2175, CAPS2, 10986, 113436, 198-1871; 2176, CAPSL, 10993, 113443, 96-638; 2176, CAPSL, 10994, 113444, 96-665; 2176, CAPSL, 10991, 113441, 96-722; 2176, CAPSL, 10992, 113442, 128-754; 2177, CALD1, 10998, 113448, 130-525; 2177, CALD1, 11000, 113450, 243-500; 2177, CALD1, 11003, 113453, 341-558; 2177, CALD1, 11004, 113454, 164-1774; 2177, CALD1, 11005, 113455, 236-1614; 2177, CALD1, 11006, 113456, 241-458; 2177, CALD1, 11007, 113457, 12-1685; 2177, CALD1, 10995, 113445, 202-1818; 2177, CALD1, 10996, 113446, 230-2611; 2177, CALD1, 10997, 113447, 222-1898; 2177, CALD1, 10999, 113449, 12-1610; 2177, CALD1, 11001, 113451, 460-2151; 2177, CALD1, 11002, 113452, 242-1858; 2178, CCIN, 11008, 113458, 110-1876; 2179, CLGN, 11011, 113461, 168-706; 2179, CLGN, 11009, 113459, 442-2274; 2179, CLGN, 11010, 113460, 219-2051; 2180, CLMN, 11013, 113463, 87-380; 2180, CLMN, 11014, 113464, 321-718; 2180, CLMN, 11015, 113465, 216-419; 2180, CLMN, 11016, 113466, 383-685; 2180, CLMN, 11012, 113462, 115-3123; 2181, CALM1, 11018, 113468, 297-749; 2181, CALM1, 11019, 113469, 333-674; 2181, CALM1, 11020, 113470, 1-231; 2181, CALM1, 11021, 113471, 205-546; 2181, CALM1, 11022, 113472, 263-557; 2181, CALM1, 11023, 113473, 192-443; 2181, CALM1, 11024, 113474, 200-451; 2181, CALM1, 11017, 113467, 249-698; 2182, CALM2, 11026, 113476, 143-733; 2182, CALM2, 11027, 113477, 58-255; 2182, CALM2, 11028, 113478, 1-564; 2182, CALM2, 11029, 113479, 159-410; 2182, CALM2, 11025, 113475, 159-608; 2183, CALM3, 11031, 113481, 209-550; 2183, CALM3, 11032, 113482, 170-511; 2183, CALM3, 11033, 113483, 160-411; 2183, CALM3, 11034, 113484, 183-524; 2183, CALM3, 11035, 113485, 171-512; 2183, CALM3, 11030, 113480, 200-649; 2183, CALM3, 11036, 113486, 137-586; 2184, CAMTA1, 11038, 113488, 14-292; 2184, CAMTA1, 11040, 113490, 1-119; 2184, CAMTA1, 11042, 113492, 1-1913; 2184, CAMTA1, 11043, 113493, 1-719; 2184, CAMTA1, 11044, 113494, 1-222; 2184, CAMTA1, 11045, 113495, 1-714; 2184, CAMTA1, 11046, 113496, 1-133; 2184, CAMTA1, 11037, 113487, 208-5229; 2184, CAMTA1, 11039, 113489, 52-294; 2184, CAMTA1, 11041, 113491, 41-346; 2185, CAMTA2, 11051, 113501, 13-498; 2185, CAMTA2, 11052, 113502, 1-534; 2185, CAMTA2, 11053, 113503, 4-495; 2185, CAMTA2, 11054, 113504, 114-3737; 2185, CAMTA2, 11047, 113497, 125-3733; 2185, CAMTA2, 11048, 113498, 413-4018; 2185, CAMTA2, 11049, 113499, 22-3615; 2185, CAMTA2, 11050, 113500, 155-3880; 2186, CAMSAP1, 11055, 113505, 352-4326; 2186, CAMSAP1, 11056, 113506, 66-4874; 2186, CAMSAP1, 11057, 113507, 70-4911; 2187, CAMSAP2, 11060, 113510, 1-400; 2187, CAMSAP2, 11062, 113512, 1-169; 2187, CAMSAP2, 11058, 113508, 50-4519; 2187, CAMSAP2, 11059, 113509, 271-4707; 2187, CAMSAP2, 11061, 113511, 50-4438; 2188, CAMSAP3, 11063, 113513, 102-3851; 2188, CAMSAP3, 11064, 113514, 102-3932; 2189, CALML3, 11065, 113515, 1078-1527; 2190, CALML4, 11069, 113519, 1-90; 2190, CALML4, 11070, 113520, 674-856; 2190, CALML4, 11072, 113522, 347-611; 2190, CALML4, 11066, 113516, 704-883; 2190, CALML4, 11067, 113517, 113-562; 2190, CALML4, 11068, 113518, 186-776; 2190, CALML4, 11071, 113521, 932-1294; 2191, CALML5, 11073, 113523, 118-558; 2192, CALML6, 11075, 113525, 174-668; 2192, CALML6, 11074, 113524, 455-1000; 2193, CAMKMT, 11077, 113527, 53-463; 2193, CAMKMT, 11079, 113529, 59-478; 2193, CAMKMT, 11080, 113530, 1-281; 2193, CAMKMT, 11081, 113531, 1-214; 2193, CAMKMT, 11082, 113532, 1-250; 2193, CAMKMT, 11083, 113533, 1-594; 2193, CAMKMT, 11076, 113526, 45-1016; 2193, CAMKMT, 11078, 113528, 45-443; 2194, CALN1, 11087, 113537, 1-288; 2194, CALN1, 11089, 113539, 176-550; 2194, CALN1, 11084, 113534, 300-959; 2194, CALN1, 11085, 113535, 390-1175; 2194, CALN1, 11086, 113536, 246-905; 2194, CALN1, 11088, 113538, 118-777; 2195, CANX, 11092, 113542, 77-1000; 2195, CANX, 11093, 113543, 474-569; 2195, CANX, 11094, 113544, 406-727; 2195, CANX, 11096, 113546, 1-568; 2195, CANX, 11097, 113547, 154-585; 2195, CANX, 11098, 113548, 1-511; 2195, CANX, 11099, 113549, 424-825; 2195, CANX, 11100, 113550, 66-570; 2195, CANX, 11101, 113551, 347-582; 2195, CANX, 11102, 113552, 139-324; 2195, CANX, 11103, 113553, 199-592; 2195, CANX, 11104, 113554, 119-409; 2195, CANX, 11090, 113540, 201-1979; 2195, CANX, 11091, 113541, 148-1926; 2195, CANX, 11095, 113545, 191-1969; 2196, CAPN1, 11106, 113556, 109-564; 2196, CAPN1, 11107, 113557, 66-550; 2196, CAPN1, 11109, 113559, 175-581; 2196, CAPN1, 11111, 113561, 21-593; 2196, CAPN1, 11112, 113562, 117-690; 2196, CAPN1, 11113, 113563, 98-582; 2196, CAPN1, 11115, 113565, 130-496; 2196, CAPN1, 11116, 113566, 129-573; 2196, CAPN1, 11118, 113568, 82-571; 2196, CAPN1, 11119, 113569, 16-621; 2196, CAPN1, 11120, 113570, 380-568; 2196, CAPN1, 11105, 113555, 144-2288; 2196, CAPN1, 11108, 113558, 76-2220; 2196, CAPN1, 11110, 113560, 241-2385; 2196, CAPN1, 11114, 113564, 101-2245; 2196, CAPN1, 11117, 113567, 219-2363; 2197, CAPN10, 11128, 113578, 174-2135; 2197, CAPN10, 11130, 113580, 1-140; 2197, CAPN10, 11131, 113581, 1-258; 2197, CAPN10, 11121, 113571, 42-866; 2197, CAPN10, 11122, 113572, 42-1595; 2197, CAPN10, 11123, 113573, 141-560; 2197, CAPN10, 11124, 113574, 42-458; 2197, CAPN10, 11125, 113575, 42-1583; 2197, CAPN10, 11126, 113576, 42-1676; 2197, CAPN10, 11127, 113577, 197-2215; 2197, CAPN10, 11129, 113579, 42-1376; 2198, CAPN11, 11133, 113583, 30-152; 2198, CAPN11, 11134, 113584, 39-585; 2198, CAPN11, 11132, 113582, 39-2258; 2199, CAPN12, 11136, 113586, 1-110; 2199, CAPN12, 11137, 113587, 8-546; 2199, CAPN12, 11138, 113588, 1-318; 2199, CAPN12, 11139, 113589, 1-314; 2199, CAPN12, 11140, 113590, 8-289; 2199, CAPN12, 11141, 113591, 248-1960; 2199, CAPN12, 11142, 113592, 310-2469; 2199, CAPN12, 11135, 113585, 310-2469; 2200, CAPN13, 11144, 113594, 1-377; 2200, CAPN13, 11146, 113596, 244-552; 2200, CAPN13, 11143, 113593, 178-2187; 2200, CAPN13, 11145, 113595, 244-1515; 2201, CAPN14, 11147, 113597, 245-676; 2201, CAPN14, 11148, 113598, 143-2197; 2202, CAPN15, 11150, 113600, 389-942; 2202, CAPN15, 11151, 113601, 575-911; 2202, CAPN15, 11152, 113602, 1-215; 2202, CAPN15, 11149, 113599, 364-3624; 2203, CAPN2, 11154, 113604, 185-577; 2203, CAPN2, 11153, 113603, 310-2412; 2203, CAPN2, 11155, 113605, 237-2105; 2204, CAPN3, 11157, 113607, 307-2628; 2204, CAPN3, 11164, 113614, 142-908; 2204, CAPN3, 11165, 113615, 1-203; 2204, CAPN3, 11167, 113617, 1-282; 2204, CAPN3, 11168, 113618, 240-815; 2204, CAPN3, 11169, 113619, 1-563; 2204, CAPN3, 11170, 113620, 1-333; 2204, CAPN3, 11171, 113621, 239-711; 2204, CAPN3, 11172, 113622, 1-509; 2204, CAPN3, 11156, 113606, 222-2411; 2204, CAPN3, 11158, 113608, 259-729; 2204, CAPN3, 11159, 113609, 277-747; 2204, CAPN3, 11160, 113610, 222-2669; 2204, CAPN3, 11161, 113611, 220-2685; 2204, CAPN3, 11162, 113612, 170-1099; 2204, CAPN3, 11163, 113613, 225-695; 2204, CAPN3, 11166, 113616, 390-860; 2205, CAPN5, 11174, 113624, 138-2180; 2205, CAPN5, 11176, 113626, 307-597; 2205, CAPN5, 11177, 113627, 199-357; 2205, CAPN5, 11178, 113628, 126-2045; 2205, CAPN5, 11173, 113623, 190-2112; 2205, CAPN5, 11175, 113625, 227-2149; 2206, CAPN6, 11179, 113629, 169-2094; 2207, CAPN7, 11181, 113631, 276-404; 2207, CAPN7, 11182, 113632, 1-339; 2207, CAPN7, 11183, 113633, 1-742; 2207, CAPN7, 11184, 113634, 345-455; 2207, CAPN7, 11180, 113630, 254-2695; 2208, CAPN8, 11186, 113636, 78-1223; 2208, CAPN8, 11187, 113637, 1-471; 2208, CAPN8, 11188, 113638, 89-1399; 2208, CAPN8, 11189, 113639, 1-306; 2208, CAPN8, 11190, 113640, 1-117; 2208, CAPN8, 11191, 113641, 1-521; 2208, CAPN8, 11192, 113642, 1-62; 2208, CAPN8, 11185, 113635, 89-2200; 2209, CAPN9, 11195, 113645, 114-1997; 2209, CAPN9, 11193, 113643, 114-2186; 2209, CAPN9, 11194, 113644, 83-2077; 2210, CAPNS1, 11198, 113648, 1-589; 2210, CAPNS1, 11199, 113649, 48-764; 2210, CAPNS1, 11200, 113650, 45-881; 2210, CAPNS1, 11201, 113651, 322-812; 2210, CAPNS1, 11202, 113652, 221-505; 2210, CAPNS1, 11203, 113653, 66-1034; 2210, CAPNS1, 11204, 113654, 215-431; 2210, CAPNS1, 11205, 113655, 1-592; 2210, CAPNS1, 11206, 113656, 1-164; 2210, CAPNS1, 11207, 113657, 390-690; 2210, CAPNS1, 11208, 113658, 87-570; 2210, CAPNS1, 11209, 113659, 1-285; 2210, CAPNS1, 11210, 113660, 159-875; 2210, CAPNS1, 11211, 113661, 159-995; 2210, CAPNS1, 11196, 113646, 599-1405; 2210, CAPNS1, 11197, 113647, 152-958; 2211, CAPNS2, 11212, 113662, 86-832; 2212, CAST, 11214, 113664, 1-1293; 2212, CAST, 11219, 113669, 1-913; 2212, CAST, 11220, 113670, 1-1310; 2212, CAST, 11221, 113671, 238-2319; 2212, CAST, 11222, 113672, 113-559; 2212, CAST, 11224, 113674, 154-2079; 2212, CAST, 11225, 113675, 153-401; 2212, CAST, 11226, 113676, 138-588; 2212, CAST, 11227, 113677, 85-2349; 2212, CAST, 11228, 113678, 265-499; 2212, CAST, 11229, 113679, 99-567; 2212, CAST, 11230, 113680, 88-1383; 2212, CAST, 11231, 113681, 221-1399; 2212, CAST, 11232, 113682, 1-864; 2212, CAST, 11233, 113683, 212-2296; 2212, CAST, 11234, 113684, 291-565; 2212, CAST, 11235, 113685, 1-1396; 2212, CAST, 11236, 113686, 150-2060; 2212, CAST, 11238, 113688, 290-1561; 2212, CAST, 11239, 113689, 1-904; 2212, CAST, 11240, 113690, 150-2171; 2212, CAST, 11241, 113691, 113-582; 2212, CAST, 11242, 113692, 1-612; 2212, CAST, 11243, 113693, 1-1351; 2212, CAST, 11213, 113663, 155-2215; 2212, CAST, 11215, 113665, 163-2289; 2212, CAST, 11216, 113666, 268-2355; 2212, CAST, 11217, 113667, 187-2439; 2212, CAST, 11218, 113668, 167-2293; 2212, CAST, 11223, 113673, 1-2310; 2212, CAST, 11237, 113687, 164-2539; 2213, CNN1, 11245, 113695, 579-1322; 2213, CNN1, 11246, 113696, 216-565; 2213, CNN1, 11247, 113697, 1-520; 2213, CNN1, 11248, 113698, 1-686; 2213, CNN1, 11249, 113699, 578-1321; 2213, CNN1, 11250, 113700, 1-525; 2213, CNN1, 11251, 113701, 191-549; 2213, CNN1, 11252, 113702, 1-348; 2213, CNN1, 11244, 113694, 212-1105; 2214, CNN2, 11255, 113705, 161-623; 2214, CNN2, 11256, 113706, 34-1026; 2214, CNN2, 11257, 113707, 45-941; 2214, CNN2, 11258, 113708, 1-657; 2214, CNN2, 11259, 113709, 34-480; 2214, CNN2, 11260, 113710, 1-307; 2214, CNN2, 11261, 113711, 364-563; 2214, CNN2, 11262, 113712, 255-828; 2214, CNN2, 11263, 113713, 1-537; 2214, CNN2, 11253, 113703, 82-1011; 2214, CNN2, 11254, 113704, 53-865; 2215, CNN3, 11266, 113716, 236-792; 2215, CNN3, 11264, 113714, 385-1374; 2215, CNN3, 11265, 113715, 330-1181; 2215, CNN3, 11267, 113717, 243-1109; 2216, CALR, 11269, 113719, 36-776; 2216, CALR, 11270, 113720, 1-491; 2216, CALR, 11271, 113721, 1-41; 2216, CALR, 11268, 113718, 74-1327; 2217, CALR3, 11273, 113723, 1-425; 2217, CALR3, 11272, 113722, 64-1218; 2218, CASQ1, 11275, 113725, 125-478; 2218, CASQ1, 11274, 113724, 197-1387; 2219, CASQ2, 11276, 113726, 241-1440; 2220, CLSTN1, 11279, 113729, 1-2349; 2220, CLSTN1, 11277, 113727, 252-3167; 2220, CLSTN1, 11278, 113728, 794-3739; 2221, CLSTN2, 11281, 113731, 1-2676; 2221, CLSTN2, 11280, 113730, 191-3058; 2222, CLSTN3, 11284, 113734, 107-533; 2222, CLSTN3, 11285, 113735, 41-570; 2222, CLSTN3, 11286, 113736, 145-533; 2222, CLSTN3, 11287, 113737, 84-547; 2222, CLSTN3, 11288, 113738, 169-570; 2222, CLSTN3, 11282, 113732, 451-3321; 2222, CLSTN3, 11283, 113733, 539-3445; 2223, CALU, 11291, 113741, 1-442; 2223, CALU, 11289, 113739, 103-1050; 2223, CALU, 11290, 113740, 82-1029; 2223, CALU, 11292, 113742, 832-1803; 2223, CALU, 11293, 113743, 944-1915; 2223, CALU, 11294, 113744, 153-827; 2224, CAMKV, 11296, 113746, 189-1493; 2224, CAMKV, 11299, 113749, 193-561; 2224, CAMKV, 11300, 113750, 351-1631; 2224, CAMKV, 11301, 113751, 161-445; 2224, CAMKV, 11302, 113752, 167-1450; 2224, CAMKV, 11303, 113753, 163-594; 2224, CAMKV, 11295, 113745, 163-1584; 2224, CAMKV, 11297, 113747, 164-1576; 2224, CAMKV, 11298, 113748, 480-1985; 2224, CAMKV, 11304, 113754, 1-1422; 2225, CREB1, 11307, 113757, 37-430; 2225, CREB1, 11308, 113758, 122-518; 2225, CREB1, 11309, 113759, 1-423; 2225, CREB1, 11310, 113760, 202-713; 2225, CREB1, 11311, 113761, 344-580; 2225, CREB1, 11313, 113763, 75-829; 2225, CREB1, 11314, 113764, 105-651; 2225, CREB1, 11315, 113765, 1-545; 2225, CREB1, 11305, 113755, 232-1215; 2225, CREB1, 11306, 113756, 252-1277; 2225, CREB1, 11312, 113762, 291-1274; 2226, CREB3, 11317, 113767, 454-1638; 2226, CREB3, 11316, 113766, 439-1554; 2227, CREB3L1, 11318, 113768, 245-561; 2227, CREB3L1, 11319, 113769, 1-372; 2227, CREB3L1, 11320, 113770, 452-2011; 2228, CREB3L2, 11322, 113772, 216-773; 2228, CREB3L2, 11323, 113773, 1-719; 2228, CREB3L2, 11326, 113776, 123-575; 2228, CREB3L2, 11327, 113777, 162-689; 2228, CREB3L2, 11321, 113771, 353-1915; 2228, CREB3L2, 11324, 113774, 363-1745; 2228, CREB3L2, 11325, 113775, 343-1089; 2229, CREB3L3, 11328, 113778, 148-1533; 2229, CREB3L3, 11329, 113779, 109-1491; 2229, CREB3L3, 11330, 113780, 81-1094; 2229, CREB3L3, 11331, 113781, 81-1460; 2230, CREB3L4, 11334, 113784, 79-732; 2230, CREB3L4, 11337, 113787, 298-982; 2230, CREB3L4, 11338, 113788, 57-602; 2230, CREB3L4, 11332, 113782, 269-1456; 2230, CREB3L4, 11333, 113783, 73-1200; 2230, CREB3L4, 11335, 113785, 79-1266; 2230, CREB3L4, 11336, 113786, 267-1454; 2231, CREB3L4, 11336, 113786, 267-1454; 2231, CREB5, 11344, 113794, 219-563; 2231, CREB5, 11345, 113795, 119-753; 2231, CREB5, 11346, 113796, 1-120; 2231, CREB5, 11339, 113789, 391-1917; 2231, CREB5, 11340, 113790, 171-1280; 2231, CREB5, 11341, 113791, 146-1573; 2231, CREB5, 11342, 113792, 93-1598; 2231, CREB5, 11343, 113793, 159-1586; 2232, CREBL2, 11347, 113797, 282-644; 2233, CREM, 11351, 113801, 241-528; 2233, CREM, 11356, 113806, 487-1296; 2233, CREM, 11361, 113811, 206-1243; 2233, CREM, 11362, 113812, 166-635; 2233, CREM, 11364, 113814, 240-428; 2233, CREM, 11365, 113815, 321-555; 2233, CREM, 11366, 113816, 1-660; 2233, CREM, 11368, 113818, 217-563; 2233, CREM, 11373, 113823, 1-160; 2233, CREM, 11374, 113824, 96-655; 2233, CREM, 11375, 113825, 418-708; 2233, CREM, 11377, 113827, 1-582; 2233, CREM, 11380, 113830, 92-379; 2233, CREM, 11381, 113831, 136-276; 2233, CREM, 11384, 113834, 97-276; 2233, CREM, 11348, 113798, 163-1065; 2233, CREM, 11349, 113799, 1-900; 2233, CREM, 11350, 113800, 111-848; 2233, CREM, 11352, 113802, 1-666; 2233, CREM, 11353, 113803, 87-833; 2233, CREM, 11354, 113804, 44-370; 2233, CREM, 11355, 113805, 211-1023; 2233, CREM, 11357, 113807, 276-689; 2233, CREM, 11358, 113808, 116-781; 2233, CREM, 11359, 113809, 1-711; 2233, CREM, 11360, 113810, 1-849; 2233, CREM, 11363, 113813, 1-747; 2233, CREM, 11367, 113817, 55-396; 2233, CREM, 11369, 113819, 58-387; 2233, CREM, 11370, 113820, 162-500; 2233, CREM, 11371, 113821, 64-429; 2233, CREM, 11372, 113822, 191-607; 2233, CREM, 11376, 113826, 308-616; 2233, CREM, 11378, 113828, 155-532; 2233, CREM, 11379, 113829, 149-562; 2233, CREM, 11382, 113832, 1-939; 2233, CREM, 11383, 113833, 64-426; 2234, ARPP19, 11388, 113838, 279-674; 2234, ARPP19, 11389, 113839, 124-519; 2234, ARPP19, 11391, 113841, 50-265; 2234, ARPP19, 11394, 113844, 60-275; 2234, ARPP19, 11385, 113835, 273-611; 2234, ARPP19, 11386, 113836, 548-838; 2234, ARPP19, 11387, 113837, 61-399; 2234, ARPP19, 11390, 113840, 67-405; 2234, ARPP19, 11392, 113842, 135-473; 2234, ARPP19, 11393, 113843, 98-388; 2234, ARPP19, 11395, 113845, 113-403; 2234, ARPP19, 11396, 113846, 526-816; 2235, ARPP21, 11402, 113852, 255-550; 2235, ARPP21, 11403, 113853, 1-373; 2235, ARPP21, 11404, 113854, 332-620; 2235, ARPP21, 11406, 113856, 449-544; 2235, ARPP21, 11407, 113857, 1-436; 2235, ARPP21, 11411, 113861, 1-781; 2235, ARPP21, 11412, 113862, 308-590; 2235, ARPP21, 11413, 113863, 496-657; 2235, ARPP21, 11415, 113865, 300-611; 2235, ARPP21, 11416, 113866, 1-726; 2235, ARPP21, 11418, 113868, 271-574; 2235, ARPP21, 11420, 113870, 415-543; 2235, ARPP21, 11421, 113871, 282-578; 2235, ARPP21, 11397, 113847, 457-2895; 2235, ARPP21, 11398, 113848, 273-542; 2235, ARPP21, 11399, 113849, 291-560; 2235, ARPP21, 11400, 113850, 380-649; 2235, ARPP21, 11401, 113851, 379-648; 2235, ARPP21, 11405, 113855, 180-449; 2235, ARPP21, 11408, 113858, 239-508; 2235, ARPP21, 11409, 113859, 302-2683; 2235, ARPP21, 11410, 113860, 753-1022; 2235, ARPP21, 11414, 113864, 105-374; 2235, ARPP21, 11417, 113867, 215-2656; 2235, ARPP21, 11419, 113869, 1023-1292; 2235, ARPP21, 11422, 113872, 286-555; 2236, CAGE1, 11425, 113875, 225-2678; 2236, CAGE1, 11427, 113877, 202-930; 2236, CAGE1, 11428, 113878, 108-1781; 2236, CAGE1, 11423, 113873, 722-2647; 2236, CAGE1, 11424, 113874, 229-2703; 2236, CAGE1, 11426, 113876, 213-2315; 2236, CAGE1, 11429, 113879, 566-3085; 2236, CAGE1, 11430, 113880, 204-2537; 2237, CASC1, 11433, 113883, 67-2235; 2237, CASC1, 11436, 113886, 85-192; 2237, CASC1, 11437, 113887, 83-220; 2237, CASC1, 11438, 113888, 306-583; 2237, CASC1, 11439, 113889, 1-1646; 2237, CASC1, 11431, 113881, 83-2233; 2237, CASC1, 11432, 113882, 37-2109; 2237, CASC1, 11434, 113884, 259-2289; 2237, CASC1, 11435, 113885, 49-2022; 2238, CASC10, 11440, 113890, 449-859; 2239, CASC3, 11442, 113892, 1-670; 2239, CASC3, 11443, 113893, 1-389; 2239, CASC3, 11444, 113894, 345-543; 2239, CASC3, 11441, 113891, 227-2338; 2240, CASC4, 11447, 113897, 1-75; 2240, CASC4, 11448, 113898, 1-485; 2240, CASC4, 11449, 113899, 405-742; 2240, CASC4, 11451, 113901, 1-248; 2240, CASC4, 11445, 113895, 300-1610; 2240, CASC4, 11446, 113896, 271-1413; 2240, CASC4, 11450, 113900, 300-833; 2241, CASC5, 11454, 113904, 1-4084; 2241, CASC5, 11455, 113905, 162-5402; 2241, CASC5, 11456, 113906, 1-579; 2241, CASC5, 11457, 113907, 139-381; 2241, CASC5, 11458, 113908, 229-259; 2241, CASC5, 11459, 113909, 556-578; 2241, CASC5, 11452, 113902, 391-7419; 2241, CASC5, 11453, 113903, 162-7112; 2242, CTAG1A, 11461, 113911, 65-697; 2242, CTAG1A, 11460, 113910, 54-596; 2243, CTAG1B, 11464, 113914, 65-697; 2243, CTAG1B, 11462, 113912, 54-596; 2243, CTAG1B, 11463, 113913, 65-571; 2244, CTAG2, 11465, 113915, 65-697; 2244, CTAG2, 11466, 113916, 54-596; 2245, CT55, 11467, 113917, 228-1022; 2245, CT55, 11468, 113918, 228-956; 2246, CT62, 11470, 113920, 692-982; 2246, CT62, 11471, 113921, 784-1017; 2246, CT62, 11472, 113922, 1-310; 2246, CT62, 11469, 113919, 508-918; 2247, CT83, 11473, 113923, 148-489; 2248, CT45A1, 11474, 113924, 12-581; 2248, CT45A1, 11475, 113925, 245-814; 2249, CT45A10, 11476, 113926, 9-578; 2249, CT45A10, 11477, 113927, 246-815; 2250, CT45A2, 11478, 113928, 1-570; 2250, CT45A2, 11479, 113929, 246-815; 2251, CT45A3, 11480, 113930, 1-570; 2251, CT45A3, 11481, 113931, 91-660; 2252, CT45A5, 11482, 113932, 86-655; 2252, CT45A5, 11483, 113933, 1-570; 2253, CT45A6, 11484, 113934, 153-722; 2253, CT45A6, 11485, 113935, 9-578; 2254, CT45A7, 11486, 113936, 9-578; 2254, CT45A7, 11487, 113937, 234-803; 2255, CT45A8, 11488, 113938, 9-578; 2255, CT45A8, 11489, 113939, 246-815; 2256, CT45A9, 11490, 113940, 9-578; 2256, CT45A9, 11491, 113941, 246-815; 2257, CT47A1, 11492, 113942, 260-1126; 2258, CT47A10, 11493, 113943, 260-1126; 2259, CT47A11, 11494, 113944, 256-1122; 2260, CT47A12, 11495, 113945, 260-1126; 2261, CT47A2, 11496, 113946, 260-1126; 2262, CT47A3, 11497, 113947, 260-1126; 2263, CT47A4, 11498, 113948, 260-1126; 2264, CT47A5, 11499, 113949, 260-1126; 2264, CT47A5, 11500, 113950, 256-1122; 2265, CT47A6, 11501, 113951, 260-1126; 2265, CT47A6, 11502, 113952, 256-1122; 2266, CT47A7, 11503, 113953, 256-1122; 2267, CT47A8, 11504, 113954, 260-1126; 2267, CT47A8, 11505, 113955, 1-867; 2268, CT47A9, 11506, 113956, 260-1126; 2269, CT47B1, 11507, 113957, 260-1159; 2270, CNR1, 11508, 113958, 1-111; 2270, CNR1, 11513, 113963, 358-591; 2270, CNR1, 11509, 113959, 151-1569; 2270, CNR1, 11510, 113960, 621-2039; 2270, CNR1, 11511, 113961, 132-1550; 2270, CNR1, 11512, 113962, 1-1320; 2270, CNR1, 11514, 113964, 92-1510; 2271, CNR2, 11515, 113965, 163-1245; 2272, CNRIP1, 11517, 113967, 183-596; 2272, CNRIP1, 11516, 113966, 607-1101; 2272, CNRIP1, 11518, 113968, 1-387; 2273, CNPY1, 11519, 113969, 164-442; 2273, CNPY1, 11520, 113970, 140-418; 2274, CNPY2, 11522, 113972, 179-484;

2274, CNPY2, 11523, 113973, 1-243; 2274, CNPY2, 11524, 113974, 170-674; 2274, CNPY2, 11525, 113975, 1-124; 2274, CNPY2, 11521, 113971, 542-1090; 2275, CNPY3, 11527, 113977, 380-811; 2275, CNPY3, 11526, 113976, 372-1208; 2276, CNPY4, 11529, 113979, 614-721; 2276, CNPY4, 11530, 113980, 1-356; 2276, CNPY4, 11528, 113978, 133-879; 2277, CMTR1, 11532, 113982, 1-470; 2277, CMTR1, 11533, 113983, 165-1280; 2277, CMTR1, 11534, 113984, 1-340; 2277, CMTR1, 11531, 113981, 165-2672; 2278, CMTR2, 11537, 113987, 161-476; 2278, CMTR2, 11538, 113988, 90-565; 2278, CMTR2, 11539, 113989, 299-695; 2278, CMTR2, 11540, 113990, 109-587; 2278, CMTR2, 11541, 113991, 362-632; 2278, CMTR2, 11542, 113992, 446-1468; 2278, CMTR2, 11543, 113993, 551-2863; 2278, CMTR2, 11535, 113985, 338-2650; 2278, CMTR2, 11536, 113986, 484-2796; 2279, CAP1, 11550, 114000, 98-273; 2279, CAP1, 11551, 114001, 159-681; 2279, CAP1, 11552, 114002, 93-528; 2279, CAP1, 11553, 114003, 83-610; 2279, CAP1, 11554, 114004, 215-824; 2279, CAP1, 11555, 114005, 149-772; 2279, CAP1, 11556, 114006, 130-668; 2279, CAP1, 11557, 114007, 30-817; 2279, CAP1, 11558, 114008, 98-702; 2279, CAP1, 11559, 114009, 93-739; 2279, CAP1, 11544, 113994, 60-1484; 2279, CAP1, 11545, 113995, 67-1494; 2279, CAP1, 11546, 113996, 562-1989; 2279, CAP1, 11547, 113997, 64-1488; 2279, CAP1, 11548, 113998, 558-1982; 2279, CAP1, 11549, 113999, 52-1479; 2280, CAP2, 11561, 114011, 104-1459; 2280, CAP2, 11563, 114013, 116-1213; 2280, CAP2, 11565, 114015, 17-331; 2280, CAP2, 11566, 114016, 37-621; 2280, CAP2, 11567, 114017, 154-1338; 2280, CAP2, 11568, 114018, 244-1428; 2280, CAP2, 11560, 114010, 533-1966; 2280, CAP2, 11562, 114012, 86-739; 2280, CAP2, 11564, 114014, 37-1278; 2281, CLIP1, 11571, 114021, 175-4125; 2281, CLIP1, 11572, 114022, 2032-2385; 2281, CLIP1, 11573, 114023, 145-2554; 2281, CLIP1, 11574, 114024, 151-3192; 2281, CLIP1, 11576, 114026, 341-665; 2281, CLIP1, 11577, 114027, 715-2000; 2281, CLIP1, 11578, 114028, 311-560; 2281, CLIP1, 11580, 114030, 108-1160; 2281, CLIP1, 11569, 114019, 109-4392; 2281, CLIP1, 11570, 114020, 156-4439; 2281, CLIP1, 11575, 114025, 43-4359; 2281, CLIP1, 11579, 114029, 219-4397; 2281, CLIP1, 11581, 114031, 156-4472; 2282, CLIP2, 11585, 114035, 1-561; 2282, CLIP2, 11586, 114036, 1-86; 2282, CLIP2, 11582, 114032, 328-3468; 2282, CLIP2, 11583, 114033, 328-3363; 2282, CLIP2, 11584, 114034, 1-3141; 2283, CLIP3, 11588, 114038, 150-549; 2283, CLIP3, 11590, 114040, 305-704; 2283, CLIP3, 11587, 114037, 229-1872; 2283, CLIP3, 11589, 114039, 315-1958; 2284, CLIP4, 11593, 114043, 409-2124; 2284, CLIP4, 11595, 114045, 284-562; 2284, CLIP4, 11596, 114046, 183-826; 2284, CLIP4, 11597, 114047, 288-581; 2284, CLIP4, 11598, 114048, 223-1710; 2284, CLIP4, 11591, 114041, 256-2373; 2284, CLIP4, 11592, 114042, 259-2058; 2284, CLIP4, 11594, 114044, 333-2450; 2285, CIC, 11599, 114049, 686-5506; 2285, CIC, 11600, 114050, 1-927; 2285, CIC, 11602, 114052, 1-961; 2285, CIC, 11603, 114053, 169-601; 2285, CIC, 11604, 114054, 69-7613; 2285, CIC, 11605, 114055, 1-435; 2285, CIC, 11601, 114051, 41-4867; 2286, CAPZA1, 11606, 114056, 673-1533; 2287, CAPZA2, 11608, 114058, 13-537; 2287, CAPZA2, 11609, 114059, 26-139; 2287, CAPZA2, 11610, 114060, 222-324; 2287, CAPZA2, 11611, 114061, 13-453; 2287, CAPZA2, 11612, 114062, 62-164; 2287, CAPZA2, 11613, 114063, 1-525; 2287, CAPZA3, 11607, 114057, 140-1000; 2288, CAPZA3, 11614, 114064, 169-1068; 2289, CAPZB, 11616, 114066, 495-1277; 2289, CAPZB, 11618, 114068, 35-817; 2289, CAPZB, 11619, 114069, 386-1291; 2289, CAPZB, 11615, 114065, 40-858; 2289, CAPZB, 11617, 114067, 48-881; 2290, CAPG, 11622, 114072, 180-835; 2290, CAPG, 11625, 114075, 107-865; 2290, CAPG, 11626, 114076, 1-312; 2290, CAPG, 11627, 114077, 172-930; 2290, CAPG, 11628, 114078, 81-839; 2290, CAPG, 11620, 114070, 251-1297; 2290, CAPG, 11621, 114071, 72-1118; 2290, CAPG, 11623, 114073, 105-1151; 2290, CAPG, 11624, 114074, 68-1069; 2291, CAPRIN2, 11633, 114083, 1-2121; 2291, CAPRIN2, 11634, 114084, 82-2187; 2291, CAPRIN2, 11635, 114085, 424-628; 2291, CAPRIN2, 11636, 114086, 212-569; 2291, CAPRIN2, 11637, 114087, 178-557; 2291, CAPRIN2, 11638, 114088, 1-523; 2291, CAPRIN2, 11639, 114089, 213-770; 2291, CAPRIN2, 11640, 114090, 379-630; 2291, CAPRIN2, 11641, 114091, 1-408; 2291, CAPRI N2, 11629, 114079, 752-3985; 2291, CAPRI N2, 11630, 114080, 549-3266; 2291, CAPRIN2, 11631, 114081, 549-3431; 2291, CAPRIN2, 11632, 114082, 752-1588; 2292, CPS1, 11643, 114093, 335-699; 2292, CPS1, 11646, 114096, 75-546; 2292, CPS1, 11647, 114097, 221-585; 2292, CPS1, 11648, 114098, 1-1542; 2292, CPS1, 11642, 114092, 197-4699; 2292, CPS1, 11644, 114094, 56-4576; 2292, CPS1, 11645, 114095, 499-3648; 2293, CAD, 11650, 114100, 145-6633; 2293, CAD, 11651, 114101, 1-837; 2293, CAD, 11652, 114102, 1-881; 2293, CAD, 11653, 114103, 1-806; 2293, CAD, 11649, 114099, 163-6840; 2294, CHST11, 11655, 114105, 412-630; 2294, CHST11, 11656, 114106, 445-678; 2294, CHST11, 11657, 114107, 99-573; 2294, CHST11, 11654, 114104, 440-1498; 2294, CHST11, 11658, 114108, 442-1485; 2295, CHST12, 11660, 114110, 186-921; 2295, CHST12, 11659, 114109, 136-1380; 2295, CHST12, 11661, 114111, 192-1436; 2296, CHST13, 11663, 114113, 1-678; 2296, CHST13, 11662, 114112, 51-1076; 2297, CHST3, 11664, 114114, 438-1877; 2298, CHST1, 11665, 114115, 672-1907; 2299, CHST14, 11667, 114117, 129-1184; 2299, CHST14, 11666, 114116, 217-1347; 2300, CHST8, 11671, 114121, 506-1040; 2300, CHST8, 11668, 114118, 759-2033; 2300, CHST8, 11669, 114119, 506-1780; 2300, CHST8, 11670, 114120, 413-1687; 2301, CHST9, 11672, 114122, 98-1174; 2301, CHST9, 11673, 114123, 230-1561; 2301, CHST9, 11674, 114124, 260-484; 2301, CHST9, 11675, 114125, 279-1610; 2302, CHST15, 11679, 114129, 627-826; 2302, CHST15, 11676, 114126, 644-2329; 2302, CHST15, 11677, 114127, 652-2337; 2302, CHST15, 11678, 114128, 604-2124; 2303, CHST4, 11680, 114130, 344-1504; 2303, CHST4, 11681, 114131, 264-1424; 2304, CHST5, 11683, 114133, 217-514; 2304, CHST5, 11682, 114132, 1396-2631; 2305, CHST6, 11684, 114134, 181-1368; 2305, CHST6, 11685, 114135, 693-1880; 2306, CHST7, 11686, 114136, 149-1609; 2307, CHST2, 11687, 114137, 1385-2977; 2308, CARKD, 11688, 114138, 15-1187; 2308, CARKD, 11689, 114139, 133-846; 2309, CHST10, 11691, 114141, 181-604; 2309, CHST10, 11693, 114143, 159-585; 2309, CHST10, 11694, 114144, 574-673; 2309, CHST10, 11695, 114145, 176-574; 2309, CHST10, 11696, 114146, 305-559; 2309, CHST10, 11697, 114147, 501-692; 2309, CHST10, 11690, 114140, 387-1457; 2309, CHST10, 11692, 114142, 268-1338; 2310, CA1, 11699, 114149, 47-430; 2310, CA1, 11700, 114150, 168-614; 2310, CA1, 11701, 114151, 93-675; 2310, CA1, 11702, 114152, 1-535; 2310, CA1, 11703, 114153, 425-491; 2310, CA1, 11705, 114155, 170-696; 2310, CA1, 11706, 114156, 148-501; 2310, CA1, 11707, 114157, 219-666; 2310, CA1, 11708, 114158, 115-527; 2310, CA1, 11709, 114159, 192-454; 2310, CA1, 11711, 114161, 93-338; 2310, CA1, 11712, 114162, 174-618; 2310, CA1, 11713, 114163, 80-832; 2310, CA1, 11714, 114164, 222-518; 2310, CA1, 11716, 114166, 1070-1453; 2310, CA1, 11698, 114148, 116-901; 2310,

CA1, 11704, 114154, 93-878; 2310, CA1, 11710, 114160, 1048-1833; 2310, CA1, 11715, 114165, 120-905; 2311, CA2, 11718, 114168, 115-408; 2311, CA2, 11719, 114169, 69-374; 2311, CA2, 11717, 114167, 231-1013; 2312, CA3, 11721, 114171, 513-571; 2312, CA3, 11720, 114170, 84-866; 2313, CA4, 11723, 114173, 1-298; 2313, CA4, 11724, 114174, 1-555; 2313, CA4, 11725, 114175, 452-565; 2313, CA4, 11722, 114172, 100-1038; 2313, CA4, 11726, 114176, 94-414; 2314, CA9, 11728, 114178, 43-1113; 2314, CA9, 11727, 114177, 105-1484; 2315, CA5A, 11729, 114179, 67-984; 2316, CA5B, 11732, 114182, 1-212; 2316, CA5B, 11733, 114183, 122-529; 2316, CA5B, 11734, 114184, 259-488; 2316, CA5B, 11730, 114180, 137-1090; 2316, CA5B, 11731, 114181, 55-1008; 2317, CA6, 11738, 114188, 6-545; 2317, CA6, 11739, 114189, 21-582; 2317, CA6, 11735, 114185, 1-942; 2317, CA6, 11736, 114186, 1-747; 2317, CA6, 11737, 114187, 5-931; 2318, CA7, 11742, 114192, 432-566; 2318, CA7, 11740, 114190, 110-904; 2318, CA7, 11741, 114191, 432-1058; 2319, CA8, 11743, 114193, 266-1138; 2320, CA10, 11747, 114197, 1-171; 2320, CA10, 11749, 114199, 647-1474; 2320, CA10, 11750, 114200, 278-406; 2320, CA10, 11744, 114194, 1113-2099; 2320, CA10, 11745, 114195, 678-1664; 2320, CA10, 11746, 114196, 942-1928; 2320, CA10, 11748, 114198, 244-1005; 2321, CA11, 11752, 114202, 1-341; 2321, CA11, 11751, 114201, 681-1667; 2322, CA12, 11755, 114205, 127-978; 2322, CA12, 11753, 114203, 442-1506; 2322, CA12, 11754, 114204, 116-1147; 2323, CA13, 11756, 114206, 303-1091; 2324, CA14, 11758, 114208, 1-393; 2324, CA14, 11759, 114209, 36-164; 2324, CA14, 11757, 114207, 971-1984; 2325, CBR1, 11761, 114211, 82-750; 2325, CBR1, 11762, 114212, 102-638; 2325, CBR1, 11760, 114210, 176-1009; 2325, CBR1, 11763, 114213, 176-697; 2326, CBR3, 11764, 114214, 282-1115; 2327, CBR4, 11766, 114216, 162-344; 2327, CBR4, 11767, 114217, 1-561; 2327, CBR4, 11768, 114218, 170-325; 2327, CBR4, 11769, 114219, 187-369; 2327, CBR4, 11765, 114215, 170-883; 2327, CBR4, 11770, 114220, 166-705; 2328, CEL, 11771, 114221, 17-2287; 2328, CEL, 11772, 114222, 14-193; 2329, CES1, 11776, 114226, 1-135; 2329, CES1, 11777, 114227, 1-396; 2329, CES1, 11778, 114228, 1-135; 2329, CES1, 11779, 114229, 1-253; 2329, CES1, 11781, 114231, 1-405; 2329, CES1, 11782, 114232, 1-253; 2329, CES1, 11773, 114223, 104-1810; 2329, CES1, 11774, 114224, 132-1835; 2329, CES1, 11775, 114225, 283-1983; 2329, CES1, 11780, 114230, 96-1796; 2329, CES1, 11783, 114233, 60-1763; 2329, CES1, 11784, 114234, 96-1802; 2330, CES2, 11785, 114235, 985-2856; 2330, CES2, 11787, 114237, 974-1342; 2330, CES2, 11788, 114238, 110-478; 2330, CES2, 11789, 114239, 827-891; 2330, CES2, 11790, 114240, 543-918; 2330, CES2, 11791, 114241, 1-605; 2330, CES2, 11786, 114236, 1001-2824; 2331, CES3, 11793, 114243, 64-1770; 2331, CES3, 11795, 114245, 51-173; 2331, CES3, 11796, 114246, 6-1145; 2331, CES3, 11792, 114242, 72-1787; 2331, CES3, 11794, 114244, 447-1079; 2332, CES4A, 11797, 114247, 1-1365; 2332, CES4A, 11801, 114251, 121-528; 2332, CES4A, 11802, 114252, 1-533; 2332, CES4A, 11798, 114248, 99-1223; 2332, CES4A, 11799, 114249, 120-1511; 2332, CES4A, 11800, 114250, 185-1591; 2333, CES5A, 11807, 114257, 79-1716; 2333, CES5A, 11808, 114258, 350-574; 2333, CES5A, 11809, 114259, 79-1716; 2333, CES5A, 11810, 114260, 123-1850; 2333, CES5A, 11811, 114261, 350-574; 2333, CES5A, 11812, 114262, 147-1961; 2333, CES5A, 11813, 114263, 370-1437; 2333, CES5A, 11814, 114264, 150-1727; 2333, CES5A, 11815, 114265, 394-1803; 2333, CES5A, 11816, 114266, 350-586; 2333, CES5A, 11817, 114267, 370-1437; 2333, CES5A, 11818, 114268, 350-586; 2333, CES5A, 11803, 114253, 123-1850; 2333, CES5A, 11804, 114254, 150-1727; 2333, CES5A, 11805, 114255, 394-1803; 2333, CES5A, 11806, 114256, 147-1961; 2334, CMBL, 11819, 114269, 422-1159; 2335, CPA1, 11821, 114271, 255-1062; 2335, CPA1, 11822, 114272, 205-1200; 2335, CPA1, 11823, 114273, 271-581; 2335, CPA1, 11824, 114274, 1-573; 2335, CPA1, 11820, 114270, 151-1410; 2336, CPA2, 11826, 114276, 8-556; 2336, CPA2, 11825, 114275, 56-1315; 2337, CPA3, 11827, 114277, 53-1306; 2338, CPA4, 11830, 114280, 21-535; 2338, CPA4, 11831, 114281, 482-568; 2338, CPA4, 11832, 114282, 19-551; 2338, CPA4, 11833, 114283, 114-1067; 2338, CPA4, 11828, 114278, 29-1294; 2338, CPA4, 11829, 114279, 48-1214; 2339, CPA5, 11837, 114287, 1-257; 2339, CPA5, 11839, 114289, 528-552; 2339, CPA5, 11841, 114291, 467-562; 2339, CPA5, 11842, 114292, 223-592; 2339, CPA5, 11834, 114284, 1-1311; 2339, CPA5, 11835, 114285, 446-1657; 2339, CPA5, 11836, 114286, 497-1807; 2339, CPA5, 11838, 114288, 484-1794; 2339, CPA5, 11840, 114290, 656-1966; 2339, CPA5, 11843, 114293, 1130-2440; 2340, CPA6, 11845, 114295, 215-493; 2340, CPA6, 11844, 114294, 217-1530; 2340, CPA6, 11846, 114296, 215-1162; 2341, CPB1, 11848, 114298, 287-584; 2341, CPB1, 11850, 114300, 408-585; 2341, CPB1, 11851, 114301, 5-614; 2341, CPB1, 11847, 114297, 24-1277; 2341, CPB1, 11849, 114299, 335-1588; 2342, CPB2, 11853, 114303, 68-1228; 2342, CPB2, 11852, 114302, 18-1289; 2343, CPD, 11856, 114306, 1-555; 2343, CPD, 11857, 114307, 1-249; 2343, CPD, 11858, 114308, 1-121; 2343, CPD, 11854, 114304, 77-4219; 2343, CPD, 11855, 114305, 403-3804; 2344, CPE, 11860, 114310, 192-633; 2344, CPE, 11861, 114311, 93-563; 2344, CPE, 11862, 114312, 148-564; 2344, CPE, 11863, 114313, 1-326; 2344, CPE, 11859, 114309, 281-1711; 2345, CPM, 11865, 114315, 65-259; 2345, CPM, 11866, 114316, 47-794; 2345, CPM, 11867, 114317, 1-108; 2345, CPM, 11869, 114319, 1-596; 2345, CPM, 11870, 114320, 26-243; 2345, CPM, 11872, 114322, 46-454; 2345, CPM, 11873, 114323, 34-228; 2345, CPM, 11864, 114314, 48-1379; 2345, CPM, 11868, 114318, 105-1436; 2345, CPM, 11871, 114321, 62-1393; 2346, CPN1, 11875, 114325, 58-669; 2346, CPN1, 11874, 114324, 253-1629; 2347, CPN2, 11876, 114326, 91-1728; 2347, CPN2, 11877, 114327, 78-1715; 2348, CPO, 11878, 114328, 47-1171; 2349, CPQ, 11880, 114330, 1-392; 2349, CPQ, 11881, 114331, 103-660; 2349, CPQ, 11882, 114332, 288-677; 2349, CPQ, 11883, 114333, 172-566; 2349, CPQ, 11884, 114334, 141-553; 2349, CPQ, 11879, 114329, 211-1629; 2350, CPXM1, 11885, 114335, 66-2270; 2351, CPXM2, 11887, 114337, 1838-2512; 2351, CPXM2, 11886, 114336, 156-2426; 2352, CPZ, 11891, 114341, 109-318; 2352, CPZ, 11888, 114338, 79-2004; 2352, CPZ, 11889, 114339, 175-2133; 2352, CPZ, 11890, 114340, 849-2396; 2353, CPVL, 11895, 114345, 129-553; 2353, CPVL, 11896, 114346, 1-541; 2353, CPVL, 11897, 114347, 1-426; 2353, CPVL, 11898, 114348, 141-874; 2353, CPVL, 11899, 114349, 441-571; 2353, CPVL, 11900, 114350, 372-528; 2353, CPVL, 11901, 114351, 505-524; 2353, CPVL, 11902, 114352, 224-525; 2353, CPVL, 11903, 114353, 396-1094; 2353, CPVL, 11904, 114354, 354-1046; 2353, CPVL, 11892, 114342, 120-1550; 2353, CPVL, 11893, 114343, 168-1598; 2353, CPVL, 11894, 114344, 648-2078; 2354, CEACAM1, 11910, 114360, 138-434; 2354, CEACAM1, 11912, 114362, 135-417; 2354, CEACAM1, 11905, 114355, 136-1716; 2354, CEACAM1, 11906, 114356, 73-1365; 2354, CEACAM1, 11907, 114357, 93-1478; 2354, CEACAM1, 11908, 114358, 7-1113; 2354, CEACAM1, 11909, 114359, 105-1499; 2354, CEACAM1, 11911, 114361, 108-1307; 2355, CEACAM16, 11913, 114363, 98-1375; 2355, CEACAM16, 11914, 114364, 216-1493; 2356, CEACAM18, 11915, 114365, 22-1176; 2357, CEACAM19, 11918, 114368, 308-475; 2357, CEACAM19, 11919, 114369, 441-608; 2357, CEACAM19, 11920, 114370, 672-835; 2357, CEACAM19, 11921, 114371, 661-828; 2357, CEACAM19, 11922, 114372, 805-972; 2357, CEACAM19, 11916, 114366, 481-1380; 2357, CEACAM19, 11917, 114367, 211-1113; 2358, CEACAM20, 11923, 114373, 280-2037; 2358, CEACAM20, 11924, 114374, 17-1492; 2358, CEACAM20, 11925, 114375, 17-1807; 2358, CEACAM20, 11926, 114376, 17-1528; 2358, CEACAM20, 11927, 114377, 280-2034; 2358, CEACAM20, 11928, 114378, 17-1771; 2359, CEACAM21, 11930, 114380, 814-1311; 2359, CEACAM21, 11933, 114383, 814-1311; 2359, CEACAM21, 11935, 114385, 97-672; 2359, CEACAM21, 11936, 114386, 27-908; 2359, CEACAM21, 11937, 114387, 1-287; 2359, CEACAM21, 11929, 114379, 41-919; 2359, CEACAM21, 11931, 114381, 27-908; 2359, CEACAM21, 11932, 114382, 97-672; 2359, CEACAM21, 11934, 114384, 41-919; 2360, CEACAM3, 11941, 114391, 178-474; 2360, CEACAM3, 11938, 114388, 55-693; 2360, CEACAM3, 11939, 114389, 242-1000; 2360, CEACAM3, 11940, 114390, 62-595; 2360, CEACAM3, 11942, 114392, 89-727; 2361, CEACAM4, 11944, 114394, 112-876; 2361, CEACAM4, 11946, 114396, 112-876; 2361, CEACAM4, 11943, 114393, 112-846; 2361, CEACAM4, 11945, 114395, 112-846; 2362, CEACAM5, 11950, 114400, 1-423; 2362, CEACAM5, 11951, 114401, 1-581; 2362, CEACAM5, 11952, 114402, 84-1124; 2362, CEACAM5, 11953, 114403, 84-1658; 2362, CEACAM5, 11954, 114404, 84-2192; 2362, CEACAM5, 11947, 114397, 115-2223; 2362, CEACAM5, 11948, 114398, 148-2253; 2362, CEACAM5, 11949, 114399, 84-2192; 2363, CEACAM6, 11956, 114406, 472-571; 2363, CEACAM6, 11955, 114405, 219-1253; 2364, CEACAM7, 11959, 114409, 3-521; 2364, CEACAM7, 11960, 114410, 1-92; 2364, CEACAM7, 11961, 114411, 1-92; 2364, CEACAM7, 11962, 114412, 1-92; 2364, CEACAM7, 11957, 114407, 203-1000; 2364, CEACAM7, 11958, 114408, 106-903; 2365, CEACAM8, 11964, 114414, 228-383; 2365, CEACAM8, 11965, 114415, 1-1035; 2365, CEACAM8, 11963, 114413, 103-1152; 2366, CRLS1, 11968, 114418, 155-772; 2366, CRLS1, 11966, 114416, 158-1063; 2366, CRLS1, 11967, 114417, 151-759; 2367, CMYA5, 11969, 114419, 32-12241; 2368, CTF1, 11970, 114420, 38-643; 2368, CTF1, 11971, 114421, 7-609; 2369, CLCF1, 11972, 114422, 199-876; 2369, CLCF1, 11973, 114423, 146-793; 2370, CRAT, 11975, 114425, 203-688; 2370, CRAT, 11976, 114426, 302-595; 2370, CRAT, 11977, 114427, 1-95; 2370, CRAT, 11978, 114428, 1-604; 2370, CRAT, 11979, 114429, 274-396; 2370, CRAT, 11980, 114430, 261-383; 2370, CRAT, 11974, 114424, 296-2176; 2371, CROT, 11983, 114433, 118-1842; 2371, CROT, 11981, 114431, 186-2024; 2371, CROT, 11982, 114432, 188-451; 2371, CROT, 11984, 114434, 200-2122; 2372, CPT1A, 11989, 114439, 103-339; 2372, CPT1A, 11990, 114440, 147-499; 2372, CPT1A, 11991, 114441, 280-559; 2372, CPT1A, 11992, 114442, 108-511; 2372, CPT1A, 11985, 114435, 156-2477; 2372, CPT1A, 11986, 114436, 171-2441; 2372, CPT1A, 11987, 114437, 30-2300; 2372, CPT1A, 11988, 114438, 30-2351; 2373, CPT1B, 11997, 114447, 1-279; 2373, CPT1B, 11998, 114448, 183-558; 2373, CPT1B, 11993, 114443, 52-2370; 2373, CPT1B, 11994, 114444, 1-2319; 2373, CPT1B, 11995, 114445, 90-2408; 2373, CPT1B, 11996, 114446, 106-2424; 2373, CPT1B, 11999, 114449, 1-2217; 2374, CPT1C, 12003, 114453, 289-1059; 2374, CPT1C, 12004, 114454, 208-414; 2374, CPT1C, 12005, 114455, 184-390; 2374, CPT1C, 12006, 114456, 222-754; 2374, CPT1C, 12007, 114457, 1-246; 2374, CPT1C, 12008, 114458, 197-586; 2374, CPT1C, 12009, 114459, 1-1011; 2374, CPT1C, 12010, 114460, 354-560; 2374, CPT1C, 12011, 114461, 313-599; 2374, CPT1C, 12013, 114463, 42-260; 2374, CPT1C, 12000, 114450, 246-2657; 2374, CPT1C, 12001, 114451, 373-2784; 2374, CPT1C, 12002, 114452, 281-2659; 2374, CPT1C, 12012, 114462, 289-2700; 2375, CPT2, 12014, 114464, 516-2492; 2376, CNDP1, 12016, 114466, 67-1461; 2376, CNDP1, 12017, 114467, 1-115; 2376, CNDP1, 12015, 114465, 229-1752; 2377, CARNMT1, 12018, 114468, 183-644; 2377, CARNMT1, 12020, 114470, 1-715; 2377, CARNMT1, 12019, 114469, 154-1383; 2378, CARNS1, 12021, 114471, 453-2936; 2378, CARNS1, 12022, 114472, 115-2967; 2378, CARNS1, 12023, 114473, 111-2885; 2379, CARTPT, 12024, 114474, 132-482; 2380, CRTAC1, 12025, 114475, 1-1914; 2380, CRTAC1, 12028, 114478, 1-238; 2380, CRTAC1, 12029, 114479, 1-1575; 2380, CRTAC1, 12026, 114476, 357-2294; 2380, CRTAC1, 12027, 114477, 357-2342; 2381, CRTAP, 12031, 114481, 25-1101; 2381, CRTAP, 12030, 114480, 100-1305; 2382, CILP2, 12033, 114483, 103-3591; 2382, CILP2, 12032, 114482, 86-3556; 2383, CILP, 12034, 114484, 168-3722; 2384, COMP, 12037, 114487, 391-2565; 2384, COMP, 12035, 114485, 46-2319; 2384, COMP, 12036, 114486, 37-2151; 2385, CASS4, 12038, 114488, 226-2586; 2385, CASS4, 12039, 114489, 199-1248; 2386, CASD1, 12041, 114491, 18-155; 2386, CASD1, 12042, 114492, 156-532; 2386, CASD1, 12043, 114493, 15-326; 2386, CASD1, 12040, 114490, 288-2681; 2387, CSN1S1, 12045, 114495, 1-231; 2387, CSN1S1, 12047, 114497, 1-510; 2387, CSN1S1, 12048, 114498, 1-534; 2387, CSN1S1, 12049, 114499, 1-165; 2387, CSN1S1, 12044, 114494, 50-607; 2387, CSN1S1, 12046, 114496, 12-542; 2388, CSN2, 12051, 114501, 13-693; 2388, CSN2, 12050, 114500, 13-693; 2389, CSN3, 12052, 114502, 87-635; 2390, CSNK1A1, 12055, 114505, 205-474; 2390, CSNK1A1, 12057, 114507, 1-503; 2390, CSNK1A1, 12058, 114508, 263-973; 2390, CSNK1A1, 12059, 114509, 263-1057; 2390, CSNK1A1, 12060, 114510, 393-629; 2390, CSNK1A1, 12061, 114511, 166-570; 2390, CSNK1A1, 12062, 114512, 189-479; 2390, CSNK1A1, 12063, 114513, 1-553; 2390, CSNK1A1, 12064, 114514, 687-1187; 2390, CSNK1A1, 12053, 114503, 434-1411; 2390, CSNK1A1, 12054, 114504, 589-1602; 2390, CSNK1A1, 12056, 114506, 1-1098; 2391, CSNK1A1L, 12065, 114515, 409-1422; 2392, CSNK1D, 12066, 114516, 1-361; 2392, CSNK1D, 12069, 114519, 48-1331; 2392, CSNK1D, 12070, 114520, 51-431; 2392, CSNK1D, 12071, 114521, 1-193; 2392, CSNK1D, 12072, 114522, 20-190; 2392, CSNK1D, 12073, 114523, 51-612; 2392, CSNK1D, 12074, 114524, 1-61; 2392, CSNK1D, 12075, 114525, 77-208; 2392, CSNK1D, 12067, 114517, 351-1598; 2392, CSNK1D, 12068, 114518, 317-1546; 2393, CSNK1E, 12080, 114530, 293-1228; 2393, CSNK1E, 12081, 114531, 1-275; 2393, CSNK1E, 12082, 114532, 1-359; 2393, CSNK1E, 12083, 114533, 1-812; 2393, CSNK1E, 12084, 114534, 1-433; 2393, CSNK1E, 12085, 114535, 265-1275; 2393, CSNK1E, 12086, 114536, 1-355; 2393, CSNK1E, 12087, 114537, 322-996; 2393, CSNK1E, 12076, 114526, 112-1362; 2393, CSNK1E, 12077, 114527, 262-1512; 2393, CSNK1E, 12078, 114528, 467-1717; 2393, CSNK1E, 12079, 114529, 293-1543; 2394, CSNK1G1, 12090, 114540, 293-1561; 2394, CSNK1G1, 12091, 114541, 411-1838; 2394, CSNK1G1, 12092, 114542, 199-1515; 2394,

CSNK1G1, 12093, 114543, 1-522; 2394, CSNK1G1, 12094, 114544, 134-478; 2394, CSNK1G1, 12095, 114545, 376-790; 2394, CSNK1G1, 12096, 114546, 1-615; 2394, CSNK1G1, 12097, 114547, 1-204; 2394, CSNK1G1, 12098, 114548, 419-1798; 2394, CSNK1G1, 12099, 114549, 225-1517; 2394, CSNK1G1, 12100, 114550, 1-110; 2394, CSNK1G1, 12101, 114551, 309-1688; 2394, CSNK1G1, 12102, 114552, 281-830; 2394, CSNK1G1, 12103, 114553, 1-477; 2394, CSNK1G1, 12104, 114554, 297-1565; 2394, CSNK1G1, 12105, 114555, 370-603; 2394, CSNK1G1, 12088, 114538, 497-1765; 2394, CSNK1G1, 12089, 114539, 129-1310; 2395, CSNK1G2, 12107, 114557, 530-780; 2395, CSNK1G2, 12108, 114558, 421-648; 2395, CSNK1G2, 12109, 114559, 1-896; 2395, CSNK1G2, 12110, 114560, 1-300; 2395, CSNK1G2, 12111, 114561, 1-704; 2395, CSNK1G2, 12112, 114562, 1-617; 2395, CSNK1G2, 12113, 114563, 1-345; 2395, CSNK1G2, 12106, 114556, 536-1783; 2396, CSNK1G3, 12121, 114571, 1-494; 2396, CSNK1G3, 12114, 114564, 720-1991; 2396, CSNK1G3, 12115, 114565, 31-1398; 2396, CSNK1G3, 12116, 114566, 31-1374; 2396, CSNK1G3, 12117, 114567, 362-1297; 2396, CSNK1G3, 12118, 114568, 359-1405; 2396, CSNK1G3, 12119, 114569, 248-1522; 2396, CSNK1G3, 12120, 114570, 250-1521; 2397, CSNK2A1, 12125, 114575, 135-1292; 2397, CSNK2A1, 12126, 114576, 339-577; 2397, CSNK2A1, 12127, 114577, 358-581; 2397, CSNK2A1, 12128, 114578, 472-552; 2397, CSNK2A1, 12129, 114579, 168-1361; 2397, CSNK2A1, 12130, 114580, 1-357; 2397, CSNK2A1, 12122, 114572, 377-1552; 2397, CSNK2A1, 12123, 114573, 260-1435; 2397, CSNK2A1, 12124, 114574, 424-1191; 2398, CSNK2A3, 12131, 114581, 239-1414; 2399, CSNK2A2, 12133, 114583, 143-547; 2399, CSNK2A2, 12134, 114584, 1-693; 2399, CSNK2A2, 12135, 114585, 1-458; 2399, CSNK2A2, 12132, 114582, 185-1237; 2400, CSNK2B, 12139, 114589, 213-917; 2400, CSNK2B, 12141, 114591, 119-805; 2400, CSNK2B, 12144, 114594, 213-917; 2400, CSNK2B, 12145, 114595, 119-805; 2400, CSNK2B, 12151, 114601, 213-917; 2400, CSNK2B, 12152, 114602, 213-917; 2400, CSNK2B, 12156, 114606, 119-805; 2400, CSNK2B, 12157, 114607, 119-805; 2400, CSNK2B, 12160, 114610, 213-917; 2400, CSNK2B, 12163, 114613, 213-917; 2400, CSNK2B, 12167, 114617, 213-917; 2400, CSNK2B, 12168, 114618, 13-699; 2400, CSNK2B, 12169, 114619, 341-826; 2400, CSNK2B, 12170, 114620, 341-1255; 2400, CSNK2B, 12171, 114621, 341-826; 2400, CSNK2B, 12172, 114622, 341-1255; 2400, CSNK2B, 12173, 114623, 341-826; 2400, CSNK2B, 12174, 114624, 341-1255; 2400, CSNK2B, 12175, 114625, 13-699; 2400, CSNK2B, 12176, 114626, 341-826; 2400, CSNK2B, 12177, 114627, 341-1255; 2400, CSNK2B, 12178, 114628, 13-699; 2400, CSNK2B, 12179, 114629, 13-699; 2400, CSNK2B, 12136, 114586, 117-764; 2400, CSNK2B, 12137, 114587, 145-792; 2400, CSNK2B, 12138, 114588, 157-804; 2400, CSNK2B, 12140, 114590, 117-764; 2400, CSNK2B, 12142, 114592, 157-804; 2400, CSNK2B, 12143, 114593, 145-792; 2400, CSNK2B, 12146, 114596, 157-804; 2400, CSNK2B, 12147, 114597, 145-792; 2400, CSNK2B, 12148, 114598, 117-764; 2400, CSNK2B, 12149, 114599, 117-764; 2400, CSNK2B, 12150, 114600, 145-792; 2400, CSNK2B, 12153, 114603, 157-804; 2400, CSNK2B, 12154, 114604, 157-804; 2400, CSNK2B, 12155, 114605, 145-792; 2400, CSNK2B, 12158, 114608, 117-764; 2400, CSNK2B, 12159, 114609, 145-792; 2400, CSNK2B, 12161, 114611, 117-764; 2400, CSNK2B, 12162, 114612, 145-792; 2400, CSNK2B, 12164, 114614, 117-764; 2400, CSNK2B, 12165, 114615, 157-804; 2400, CSNK2B, 12166, 114616, 157-804; 2401, CLPX, 12181, 114631, 143-533; 2401, CLPX, 12182, 114632, 64-870; 2401, CLPX, 12180, 114630, 190-2091; 2402, CLPP, 12184, 114634, 70-240; 2402, CLPP, 12185, 114635, 1-480; 2402, CLPP, 12186, 114636, 129-701; 2402, CLPP, 12183, 114633, 124-957; 2403, CASKIN1, 12187, 114637, 94-4389; 2404, CASKIN2, 12190, 114640, 454-530; 2404, CASKIN2, 12191, 114641, 445-1416; 2404, CASKIN2, 12188, 114638, 588-4196; 2404, CASKIN2, 12189, 114639, 317-3679; 2405, CRADD, 12195, 114645, 81-446; 2405, CRADD, 12196, 114646, 105-497; 2405, CRADD, 12197, 114647, 103-450; 2405, CRADD, 12192, 114642, 105-704; 2405, CRADD, 12193, 114643, 319-918; 2405, CRADD, 12194, 114644, 81-392; 2406, CFLAR, 12199, 114649, 1-963; 2406, CFLAR, 12203, 114653, 213-965; 2406, CFLAR, 12204, 114654, 242-435; 2406, CFLAR, 12205, 114655, 376-1107; 2406, CFLAR, 12208, 114658, 409-596; 2406, CFLAR, 12210, 114660, 269-655; 2406, CFLAR, 12211, 114661, 330-684; 2406, CFLAR, 12213, 114663, 80-433; 2406, CFLAR, 12214, 114664, 84-588; 2406, CFLAR, 12215, 114665, 165-516; 2406, CFLAR, 12198, 114648, 516-1958; 2406, CFLAR, 12200, 114650, 453-1118; 2406, CFLAR, 12201, 114651, 381-1259; 2406, CFLAR, 12202, 114652, 413-1750; 2406, CFLAR, 12206, 114656, 549-1991; 2406, CFLAR, 12207, 114657, 364-1029; 2406, CFLAR, 12209, 114659, 1-1389; 2406, CFLAR, 12212, 114662, 336-1490; 2406, CFLAR, 12216, 114666, 53-1153; 2407, CASP1, 12220, 114670, 35-367; 2407, CASP1, 12221, 114671, 293-1396; 2407, CASP1, 12224, 114674, 66-971; 2407, CASP1, 12227, 114677, 1-711; 2407, CASP1, 12217, 114667, 45-311; 2407, CASP1, 12218, 114668, 45-836; 2407, CASP1, 12219, 114669, 138-1352; 2407, CASP1, 12222, 114672, 37-1251; 2407, CASP1, 12223, 114673, 1-936; 2407, CASP1, 12225, 114675, 1-267; 2407, CASP1, 12226, 114676, 37-1188; 2407, CASP1, 12228, 114678, 1-792; 2408, CASP10, 12236, 114686, 176-532; 2408, CASP10, 12229, 114679, 148-1587; 2408, CASP10, 12230, 114680, 185-1750; 2408, CASP10, 12231, 114681, 436-2004; 2408, CASP10, 12232, 114682, 125-1492; 2408, CASP10, 12233, 114683, 419-1240; 2408, CASP10, 12234, 114684, 157-900; 2408, CASP10, 12235, 114685, 122-1558; 2409, CASP12, 12238, 114688, 257-937; 2409, CASP12, 12239, 114689, 257-931; 2409, CASP12, 12240, 114690, 257-1144; 2409, CASP12, 12243, 114693, 257-1090; 2409, CASP12, 12244, 114694, 257-679; 2409, CASP12, 12247, 114697, 257-685; 2409, CASP12, 12248, 114698, 20-1045; 2409, CASP12, 12237, 114687, 257-763; 2409, CASP12, 12241, 114691, 257-1282; 2409, CASP12, 12242, 114692, 257-763; 2409, CASP12, 12245, 114695, 1-774; 2409, CASP12, 12246, 114696, 257-1279; 2410, CASP14, 12249, 114699, 309-1037; 2411, CASP2, 12251, 114701, 6-332; 2411, CASP2, 12252, 114702, 62-577; 2411, CASP2, 12253, 114703, 242-568; 2411, CASP2, 12250, 114700, 242-1600; 2412, CASP3, 12255, 114705, 336-884; 2412, CASP3, 12256, 114706, 77-625; 2412, CASP3, 12257, 114707, 198-549; 2412, CASP3, 12258, 114708, 236-784; 2412, CASP3, 12260, 114710, 309-779; 2412, CASP3, 12254, 114704, 264-1097; 2412, CASP3, 12259, 114709, 131-964; 2413, CASP4, 12263, 114713, 321-763; 2413, CASP4, 12264, 114714, 1-215; 2413, CASP4, 12265, 114715, 235-1227; 2413, CASP4, 12261, 114711, 264-1229; 2413, CASP4, 12262, 114712, 912-2045; 2414, CASP5, 12269, 114719, 1-353; 2414, CASP5, 12272, 114722, 129-623; 2414, CASP5, 12266, 114716, 1-1305; 2414, CASP5, 114717, 33-1376; 2414, CASP5, 12268, 114718, 32-1162; 2414, CASP5, 12270, 114720, 33-911; 2414, CASP5, 12271, 114721, 1-327; 2414, CASP5, 12273, 114723, 1-879; 2414, CASP5, 12274, 114724, 1-1344; 2415, CASP6, 12277, 114727, 189-431; 2415, CASP6, 12278, 114728, 158-587; 2415, CASP6, 12275, 114725, 79-960; 2415, CASP6, 12276, 114726, 25-639; 2416, CASP7, 12282, 114732, 87-1253; 2416, CASP7, 12285, 114735, 168-834; 2416, CASP7, 12279, 114729, 385-1296; 2416, CASP7, 12280, 114730, 147-1058; 2416, CASP7, 12281, 114731, 103-1014; 2416, CASP7, 12283, 114733, 147-908; 2416, CASP7, 12284, 114734, 68-904; 2416, CASP7, 12286, 114736, 311-1072; 2416, CASP7, 12287, 114737, 1-1011; 2416, CASP7, 12288, 114738, 189-1100; 2417, CASP8AP2, 12289, 114739, 236-6151; 2417, CASP8AP2, 12290, 114740, 70-1153; 2417, CASP8AP2, 12291, 114741, 197-1280; 2418, CASP8, 12298, 114748, 91-927; 2418, CASP8, 12299, 114749, 80-707; 2418, CASP8, 12300, 114750, 1-252; 2418, CASP8, 12301, 114751, 369-717; 2418, CASP8, 12302, 114752, 239-686; 2418, CASP8, 12303, 114753, 1-777; 2418, CASP8, 12304, 114754, 219-592; 2418, CASP8, 12305, 114755, 64-658; 2418, CASP8, 12306, 114756, 115-291; 2418, CASP8, 12292, 114742, 236-1423; 2418, CASP8, 12293, 114743, 281-1771; 2418, CASP8, 12294, 114744, 141-1535; 2418, CASP8, 12295, 114745, 197-1813; 2418, CASP8, 12296, 114746, 241-948; 2418, CASP8, 12297, 114747, 236-1630; 2418, CASP8, 12307, 114757, 190-1629; 2419, CASP9, 12311, 114761, 1-457; 2419, CASP9, 12312, 114762, 156-954; 2419, CASP9, 12313, 114763, 1-595; 2419, CASP9, 12314, 114764, 18-781; 2419, CASP9, 12315, 114765, 1-288; 2419, CASP9, 12316, 114766, 246-1511; 2419, CASP9, 12317, 114767, 583-725; 2419, CASP9, 12308, 114758, 148-948; 2419, CASP9, 12309, 114759, 96-1346; 2419, CASP9, 12310, 114760, 262-1263; 2420, CAAP1, 12319, 114769, 73-474; 2420, CAAP1, 12320, 114770, 89-424; 2420, CAAP1, 12318, 114768, 90-1175; 2420, CAAP1, 12321, 114771, 317-967; 2421, CARD10, 12325, 114775, 1-578; 2421, CARD10, 12326, 114776, 700-2140; 2421, CARD10, 12322, 114772, 41-3139; 2421, CARD10, 12323, 114773, 218-3316; 2421, CARD10, 12324, 114774, 92-2332; 2422, CARD11, 12327, 114777, 1-815; 2422, CARD11, 12328, 114778, 366-584; 2422, CARD11, 12329, 114779, 405-3869; 2423, CARD14, 12332, 114782, 372-582; 2423, CARD14, 12333, 114783, 1-1426; 2423, CARD14, 12334, 114784, 192-1673; 2423, CARD14, 12335, 114785, 432-562; 2423, CARD14, 12330, 114780, 169-3183; 2423, CARD14, 12331, 114781, 537-3551; 2423, CARD14, 12336, 114786, 178-2400; 2424, CARD16, 12339, 114789, 159-445; 2424, CARD16, 12337, 114787, 80-373; 2424, CARD16, 12338, 114788, 19-612; 2424, CARD16, 12340, 114790, 18-311; 2425, CARD17, 12341, 114791, 18-350; 2426, CARD18, 12343, 114793, 315-470; 2426, CARD18, 12344, 114794, 195-350; 2426, CARD18, 12342, 114792, 1-273; 2427, CARD19, 12345, 114795, 129-680; 2427, CARD19, 12346, 114796, 129-815; 2428, CARD6, 12348, 114798, 76-1008; 2428, CARD6, 12347, 114797, 200-3313; 2429, CARD8, 12349, 114799, 115-963; 2429, CARD8, 12352, 114802, 359-571; 2429, CARD8, 12354, 114804, 293-505; 2429, CARD8, 12355, 114805, 248-496; 2429, CARD8, 12357, 114807, 44-442; 2429, CARD8, 12359, 114809, 1-211; 2429, CARD8, 12360, 114810, 215-631; 2429, CARD8, 12361, 114811, 110-508; 2429, CARD8, 12363, 114813, 190-438; 2429, CARD8, 12364, 114814, 243-455; 2429, CARD8, 12365, 114815, 463-579; 2429, CARD8, 12366, 114816, 1-73; 2429, CARD8, 12367, 114817, 190-438; 2429, CARD8, 12368, 114818, 437-567; 2429, CARD8, 12370, 114820, 120-560; 2429, CARD8, 12350, 114800, 44-1657; 2429, CARD8, 12351, 114801, 141-1604; 2429, CARD8, 12353, 114803, 296-1759; 2429, CARD8, 12356, 114806, 231-1694; 2429, CARD8, 12358, 114808, 350-1963; 2429, CARD8, 12362, 114812, 347-1525; 2429, CARD8, 12369, 114819, 127-1305; 2430, CARD9, 12371, 114821, 167-1777; 2430, CARD9, 12372, 114822, 167-1645; 2430, CARD9, 12373, 114823, 145-1245; 2431, CASZ1, 12376, 114826, 1-695; 2431, CASZ1, 12374, 114824, 321-3821; 2431, CASZ1, 12375, 114825, 319-5598; 2432, CECR1, 12381, 114831, 175-581; 2432, CECR1, 12382, 114832, 176-1585; 2432, CECR1, 12383, 114833, 94-549; 2432, CECR1, 12384, 114834, 269-1444; 2432, CECR1, 12377, 114827, 213-1748; 2432, CECR1, 12378, 114828, 206-1018; 2432, CECR1, 12379, 114829, 277-1812; 2432, CECR1, 12380, 114830, 272-1807; 2433, CECR2, 12385, 114835, 386-4291; 2433, CECR2, 12387, 114837, 1-657; 2433, CECR2, 12388, 114838, 439-4341; 2433, CECR2, 12389, 114839, 8-4336; 2433, CECR2, 12386, 114836, 419-4873; 2434, CECR5, 12392, 114842, 5-676; 2434, CECR5, 12390, 114840, 44-1225; 2434, CECR5, 12391, 114841, 27-1298; 2435, CECR6, 12393, 114843, 127-1863; 2435, CECR6, 12394, 114844, 198-869; 2436, CAT, 12395, 114845, 90-1673; 2437, COMT, 12396, 114846, 166-765; 2437, COMT, 12398, 114848, 257-964; 2437, COMT, 12402, 114852, 1-457; 2437, COMT, 12403, 114853, 203-871; 2437, COMT, 12397, 114847, 383-1198; 2437, COMT, 12399, 114849, 380-1195; 2437, COMT, 12400, 114850, 244-1059; 2437, COMT, 12401, 114851, 511-1326; 2437, COMT, 12404, 114854, 108-773; 2438, COMTD1, 12406, 114856, 1-782; 2438, COMTD1, 12405, 114855, 84-872; 2439, CTNNA1, 12408, 114858, 3-2528; 2439, CTNNA1, 12409, 114859, 247-577; 2439, CTNNA1, 12410, 114860, 202-483; 2439, CTNNA1, 12411, 114861, 438-589; 2439, CTNNA1, 12412, 114862, 566-868; 2439, CTNNA1, 12413, 114863, 344-696; 2439, CTNNA1, 12414, 114864, 1-67; 2439, CTNNA1, 12415, 114865, 239-390; 2439, CTNNA1, 12416, 114866, 288-562; 2439, CTNNA1, 12417, 114867, 500-560; 2439, CTNNA1, 12418, 114868, 1-390; 2439, CTNNA1, 12419, 114869, 73-719; 2439, CTNNA1, 12420, 114870, 615-710; 2439, CTNNA1, 12421, 114871, 274-642; 2439, CTNNA1, 12422, 114872, 263-487; 2439, CTNNA1, 12423, 114873, 1-411; 2439, CTNNA1, 12424, 114874, 441-859; 2439, CTNNA1, 12425, 114875, 437-554; 2439, CTNNA1, 12426, 114876, 310-694; 2439, CTNNA1, 12427, 114877, 78-545; 2439, CTNNA1, 12428, 114878, 558-874; 2439, CTNNA1, 12429, 114879, 447-568; 2439, CTNNA1, 12430, 114880, 89-572; 2439, CTNNA1, 12431, 114881, 68-235; 2439, CTNNA1, 12432, 114882, 448-557; 2439, CTNNA1, 12433, 114883, 353-565; 2439, CTNNA1, 12434, 114884, 93-206; 2439, CTNNA1, 12435, 114885, 223-579; 2439, CTNNA1, 12437, 114887, 159-353; 2439, CTNNA1, 12438, 114888, 96-2621; 2439, CTNNA1, 12407, 114857, 91-2811; 2439, CTNNA1, 12436, 114886, 135-1745; 2440, CTNNA2, 12440, 114890, 373-2082; 2440, CTNNA2, 12442, 114892, 25-595; 2440, CTNNA2, 12443, 114893, 190-541; 2440, CTNNA2, 12444, 114894, 165-299; 2440, CTNNA2, 12445, 114895, 323-521; 2440, CTNNA2, 12448, 114898, 373-1803; 2440, CTNNA2, 12439, 114889, 184-1938; 2440, CTNNA2, 12441, 114891, 6-2867; 2440, CTNNA2, 12446, 114896, 725-3442; 2440, CTNNA2, 12447, 114897, 214-2931; 2440, CTNNA2, 12449, 114899, 268-1881; 2440, CTNNA2, 12450, 114900, 79-2661; 2441, CTNNA3, 12451, 114901, 118-696; 2441, CTNNA3, 12453, 114903, 1-555; 2441, CTNNA3, 12454, 114904, 1-382; 2441, CTNNA3, 12452, 114902, 176-2863; 2442, CTNNAL1, 12456, 114906, 71-622; 2442, CTNNAL1, 12457, 114907, 227-634; 2442, CTNNAL1, 12455, 114905, 88-2292; 2442, CTNNAL1, 12458, 114908, 81-2237; 2443, CTNNB1, 12463, 114913, 558-596; 2443, CTNNB1, 12464, 114914, 386-563; 2443, CTNNB1, 12465, 114915, 309-608; 2443, CTNNB1, 12466, 114916, 320-645; 2443, CTNNB1, 12467, 114917, 428-2752; 2443, CTNNB1, 12468, 114918, 186-634; 2443, CTNNB1, 12459, 114909, 281-2626; 2443, CTNNB1, 12460, 114910, 286-2631; 2443, CTNNB1, 12461, 114911, 215-2560; 2443, CTNNB1, 12462, 114912, 157-2502; 2444, CTNND1, 12477, 114927, 1-370; 2444, CTNND1, 12478, 114928, 194-579; 2444, CTNND1, 12482, 114932, 494-505; 2444, CTNND1, 12488, 114938, 83-866; 2444, CTNND1, 12490, 114940, 332-3148; 2444, CTNND1, 12493, 114943, 120-498; 2444, CTNND1, 12469, 114919, 464-3265; 2444, CTNND1, 12470, 114920, 537-3362; 2444, CTNND1, 12471, 114921, 537-3425; 2444, CTNND1, 12472, 114922, 537-3356; 2444, CTNND1, 12473, 114923, 537-3443; 2444, CTNND1, 12474, 114924, 359-2962; 2444, CTNND1, 12475, 114925, 432-2930; 2444, CTNND1, 12476, 114926, 345-3146; 2444, CTNND1, 12479, 114929, 324-3080; 2444, CTNND1, 12480, 114930, 381-2879; 2444, CTNND1, 12481, 114931, 398-3037; 2444, CTNND1, 12483, 114933, 264-2183; 2444, CTNND1, 12484, 114934, 264-2096; 2444, CTNND1, 12485, 114935, 398-3142; 2444, CTNND1, 12486, 114936, 398-3124; 2444, CTNND1, 12487, 114937, 287-2785; 2444, CTNND1, 12489, 114939, 264-2114; 2444, CTNND1, 12491, 114941, 264-2201; 2444, CTNND1, 12492, 114942, 359-2881; 2444, CTNND1, 12494, 114944, 359-2875; 2444, CTNND1, 12495, 114945, 517-3156; 2444, CTNND1, 12496, 114946, 398-3061; 2444, CTNND1, 12497, 114947, 515-3154; 2444, CTNND1, 12498, 114948, 590-3229; 2444, CTNND1, 12499, 114949, 514-3315; 2444, CTNND1, 12500, 114950, 398-3055; 2444, CTNND1, 12501, 114951, 264-2120; 2444, CTNND1, 12502, 114952, 359-2857; 2444, CTNND1, 12503, 114953, 359-2944; 2445, CTNND2, 12505, 114955, 480-1442; 2445, CTNND2, 12506, 114956, 191-886; 2445, CTNND2, 12507, 114957, 128-2866; 2445, CTNND2, 12508, 114958, 77-704; 2445, CTNND2, 12509, 114959, 220-727; 2445, CTNND2, 12510, 114960, 374-3778; 2445, CTNND2, 12511, 114961, 177-720; 2445, CTNND2, 12512, 114962, 203-2869; 2445, CTNND2, 12504, 114954, 191-3868; 2446, CTNNBIP1, 12513, 114963, 147-392; 2446, CTNNBIP1, 12514, 114964, 339-584; 2446, CTNNBIP1, 12515, 114965, 313-558; 2446, CTNNBIP1, 12516, 114966, 352-597; 2447, CTNNBL1, 12521, 114971, 280-778; 2447, CTNNBL1, 12522, 114972, 169-1875; 2447, CTNNBL1, 12517, 114967, 118-1809; 2447, CTNNBL1, 12518, 114968, 79-1014; 2447, CTNNBL1, 12519, 114969, 247-1377; 2447, CTNNBL1, 12520, 114970, 351-1961; 2447, CTNNBL1, 12523, 114973, 244-1854; 2448, CAMP, 12524, 114974, 157-678; 2449, CTSA, 12526, 114976, 5-1450; 2449, CTSA, 12528, 114978, 283-1779; 2449, CTSA, 12529, 114979, 1-606; 2449, CTSA, 12530, 114980, 75-403; 2449, CTSA, 12531, 114981, 14-262; 2449, CTSA, 12532, 114982, 1183-1878; 2449, CTSA, 12525, 114975, 86-1528; 2449, CTSA, 12527, 114977, 194-1636; 2450, CTSB, 12536, 114986, 362-573; 2450, CTSB, 12537, 114987, 152-559; 2450, CTSB, 12538, 114988, 272-368; 2450, CTSB, 12540, 114990, 509-570; 2450, CTSB, 12542, 114992, 341-545; 2450, CTSB, 12543, 114993, 391-556; 2450, CTSB, 12544, 114994, 466-975; 2450, CTSB, 12546, 114996, 150-580; 2450, CTSB, 12547, 114997, 67-561; 2450, CTSB, 12549, 114999, 553-764; 2450, CTSB, 12550, 115000, 237-540; 2450, CTSB, 12551, 115001, 282-557; 2450, CTSB, 12552, 115002, 278-573; 2450, CTSB, 12553, 115003, 95-524; 2450, CTSB, 12554, 115004, 109-633; 2450, CTSB, 12555, 115005, 154-486; 2450, CTSB, 12556, 115006, 115-560; 2450, CTSB, 12557, 115007, 1-231; 2450, CTSB, 12533, 114983, 224-1243; 2450, CTSB, 12534, 114984, 255-1274; 2450, CTSB, 12535, 114985, 187-1206; 2450, CTSB, 12539, 114989, 220-1239; 2450, CTSB, 12541, 114991, 226-1245; 2450, CTSB, 12545, 114995, 215-1234; 2450, CTSB, 12548, 114998, 138-1157; 2451, CTSC, 12560, 115010, 1-733; 2451, CTSC, 12561, 115011, 1-110; 2451, CTSC, 12558, 115008, 116-1507; 2451, CTSC, 12559, 115009, 90-503; 2451, CTSC, 12562, 115012, 62-487; 2452, CTSD, 12564, 115014, 309-907; 2452, CTSD, 12565, 115015, 1-570; 2452, CTSD, 12566, 115016, 43-873; 2452, CTSD, 12567, 115017, 50-946; 2452, CTSD, 12563, 115013, 134-1372; 2453, CTSE, 12568, 115018, 119-1309; 2453, CTSE, 12569, 115019, 105-1196; 2454, CTSF, 12571, 115021, 1-846; 2454, CTSF, 12572, 115022, 1-247; 2454, CTSF, 12573, 115023, 188-548; 2454, CTSF, 12570, 115020, 111-1565; 2455, CTSG, 12574, 115024, 38-805; 2456, CTSH, 12576, 115026, 66-254; 2456, CTSH, 12577, 115027, 114-239; 2456, CTSH, 12578, 115028, 82-438; 2456, CTSH, 12579, 115029, 318-719; 2456, CTSH, 12580, 115030, 1-972; 2456, CTSH, 12575, 115025, 111-1118; 2457, CTSK, 12582, 115032, 11-785; 2457, CTSK, 12581, 115031, 112-1101; 2458, CTSL, 12583, 115033, 125-802; 2458, CTSL, 12584, 115034, 891-1892; 2458, CTSL, 12585, 115035, 156-1157; 2459, CTSO, 12586, 115036, 71-1036; 2459, CTSO, 12587, 115037, 71-1036; 2460, CTSS, 12590, 115040, 1-289; 2460, CTSS, 12591, 115041, 1-17; 2460, CTSS, 12592, 115042, 1-354; 2460, CTSS, 12588, 115038, 262-1257; 2460, CTSS, 12589, 115039, 97-942; 2461, CTSV, 12593, 115043, 251-1255; 2461, CTSV, 12594, 115044, 48-1052; 2462, CTSW, 12596, 115046, 1-634; 2462, CTSW, 12597, 115047, 5-1099; 2462, CTSW, 12595, 115045, 47-1177; 2463, CTSZ, 12598, 115048, 120-1031; 2464, CATSPER1, 12599, 115049, 139-2481; 2465, CATSPER2, 12601, 115051, 15-1619; 2465, CATSPER2, 12603, 115053, 376-568; 2465, CATSPER2, 12604, 115054, 1-224; 2465, CATSPER2, 12606, 115056, 14-252; 2465, CATSPER2, 12607, 115057, 1-40; 2465, CATSPER2, 12600, 115050, 201-1793; 2465, CATSPER2, 12602, 115052, 114-1700; 2465, CATSPER2, 12605, 115055, 1-1245; 2466, CATSPER3, 12608, 115058, 87-1283; 2467, CATSPER4, 12609, 115059, 68-1516; 2467, CATSPER4, 12612, 115062, 33-1154; 2467, CATSPER4, 12610, 115060, 68-1486; 2467, CATSPER4, 12611, 115061, 1-1155; 2468, CATSPERB, 12614, 115064, 131-582; 2468, CATSPERB, 12615, 115065, 210-430; 2468, CATSPERB, 12616, 115066, 1-204; 2468, CATSPERB, 12617, 115067, 270-491; 2468, CATSPERB, 12618, 115068, 133-432; 2468, CATSPERB, 12620, 115070, 210-430; 2468, CATSPERB, 12621, 115071, 1-204; 2468, CATSPERB, 12622, 115072, 131-582; 2468, CATSPERB, 12623, 115073, 270-491; 2468, CATSPERB, 12624, 115074, 133-432; 2468, CATSPERB, 12613, 115063, 158-3508; 2468, CATSPERB, 12619, 115069, 158-3508; 2469, CATSPERD, 12625, 115075, 62-2458; 2470, CATSPERG, 12626, 115076, 73-951; 2470, CATSPERG, 12627, 115077, 653-2634; 2470, CATSPERG, 12629, 115079, 116-3475; 2470, CATSPERG, 12630, 115080, 1-498; 2470, CATSPERG, 12631, 115081, 42-452; 2470, CATSPERG, 12632, 115082, 58-537; 2470, CATSPERG, 12633, 115083, 1-541; 2470, CATSPERG, 12628, 115078, 116-3595; 2471, CDX1, 12635, 115085, 1-465; 2471, CDX1, 12634, 115084, 83-880; 2472, CDX2, 12636, 115086, 2134-3075; 2473, CDX4, 12637, 115087, 1-855; 2474, CAV1, 12641, 115091, 63-566; 2474, CAV1, 12643, 115093, 144-557; 2474, CAV1, 12644, 115094, 55-315; 2474, CAV1, 12638, 115088, 279-815; 2474, CAV1, 12639, 115089, 296-739; 2474, CAV1, 12640, 115090, 176-619; 2474, CAV1, 12642, 115092, 108-551; 2474, CAV1, 12645, 115095, 861-1304; 2475, CAV2, 12648, 115098, 3-344; 2475, CAV2, 12646, 115096, 393-881; 2475, CAV2, 12647, 115097, 43-381; 2476, CAV3, 12649, 115099, 78-533; 2476, CAV3, 12650, 115100, 12-467; 2477, CBLB, 12652, 115102, 1-966; 2477, CBLB, 12653, 115103, 335-928; 2477, CBLB, 12655, 115105, 323-2755; 2477, CBLB, 12656, 115106, 143-561; 2477, CBLB, 12657, 115107, 526-944; 2477, CBLB, 12658, 115108, 35-519; 2477, CBLB, 12651, 115101, 323-3271; 2477, CBLB, 12654, 115104, 323-2635; 2478, CBLC, 12659, 115109, 64-1488; 2478, CBLC, 12660, 115110, 64-1350; 2479, CBL, 12662, 115112, 121-2769; 2479, CBL, 12663, 115113, 119-2707; 2479, CBL, 12664, 115114, 1-270; 2479, CBL, 12661, 115111, 143-2863; 2480, CBLL1, 12666, 115116, 10-381; 2480, CBLL1, 12668, 115118, 23-226; 2480, CBLL1, 12669, 115119, 539-1506; 2480, CBLL1, 12665, 115115, 23-1495; 2480, CBLL1, 12667, 115117, 468-1943; 2481, CITED1, 12673, 115123, 252-666; 2481, CITED1, 12676, 115126, 177-505; 2481, CITED1, 12677, 115127, 1-320; 2481, CITED1, 12678, 115128, 540-716; 2481, CITED1, 12679, 115129, 139-560; 2481, CITED1, 12670, 115120, 577-1158; 2481, CITED1, 12671, 115121, 229-810; 2481, CITED1, 12672, 115122, 199-858; 2481, CITED1, 12674, 115124, 254-913; 2481, CITED1, 12675, 115125, 156-737; 2482, CITED2, 12682, 115132, 76-903; 2482, CITED2, 12680, 115130, 217-1029; 2482, CITED2, 12681, 115131, 108-920; 2482, CITED2, 12683, 115133, 202-843; 2483, CITED4, 12684, 115134, 240-794; 2484, CTIF, 12687, 115137, 100-683; 2484, CTIF, 12688, 115138, 446-859; 2484, CTIF, 12689, 115139, 272-584; 2484, CTIF, 12690, 115140, 132-491; 2484, CTIF, 12691, 115141, 132-491; 2484, CTIF, 12692, 115142, 100-683; 2484, CTIF, 12693, 115143, 272-584; 2484, CTIF, 12694, 115144, 258-2060; 2484, CTIF, 12695, 115145, 446-859; 2484, CTIF, 12696, 115146, 296-2092; 2484, CTIF, 12685, 115135, 296-2092; 2484, CTIF, 12686, 115136, 258-2060; 2485, CEBPA, 12697, 115147, 151-1227; 2486, CEBPB, 12698, 115148, 301-1338; 2487, CEBPD, 12699, 115149, 967-1776; 2488, CEBPE, 12700, 115150, 526-1371; 2489, CEBPG, 12701, 115151, 663-1115; 2489, CEBPG, 12702, 115152, 399-851; 2490, CEBPZ, 12704, 115154, 89-526; 2490, CEBPZ, 12705, 115155, 13-3009; 2490, CEBPZ, 12703, 115153, 147-3311; 2491, CTCF, 12706, 115156, 445-2628; 2491, CTCF, 12707, 115157, 468-1667; 2492, CTCFL, 12712, 115162, 663-2018; 2492, CTCFL, 12720, 115170, 191-2074; 2492, CTCFL, 12721, 115171, 191-1405; 2492, CTCFL, 12724, 115174, 663-1877; 2492, CTCFL, 12725, 115175, 663-1943; 2492, CTCFL, 12708, 115158, 194-2185; 2492, CTCFL, 12709, 115159, 118-2109; 2492, CTCFL, 12710, 115160, 153-1535; 2492, CTCFL, 12711, 115161, 191-1912; 2492, CTCFL, 12713, 115163, 663-2114; 2492, CTCFL, 12714, 115164, 663-1946; 2492, CTCFL, 12715, 115165, 637-2478; 2492, CTCFL, 12716, 115166, 92-2194; 2492, CTCFL, 12717, 115167, 113-1324; 2492, CTCFL, 12718, 115168, 153-1421; 2492, CTCFL, 12719, 115169, 291-2282; 2492, CTCFL, 12722, 115172, 113-1012; 2492, CTCFL, 12723, 115173, 663-2654; 2492, CTCFL, 12726, 115176, 53-2050; 2493, CCDC169-SOHLH2, 12727, 115177, 303-1811; 2494, CNBP, 12734, 115184, 162-502; 2494, CNBP, 12728, 115178, 139-675; 2494, CNBP, 12729, 115179, 139-657; 2494, CNBP, 12730, 115180, 162-695; 2494, CNBP, 12731, 115181, 150-689; 2494, CNBP, 12732, 115182, 145-657; 2494, CNBP, 12733, 115183, 162-665; 2494, CNBP, 12735, 115185, 150-632; 2495, CCL15-CCL14, 12736, 115186, 130-471; 2495, CCL15-CCL14, 12737, 115187, 60-401; 2495, CCL15-CCL14, 12738, 115188, 60-401; 2495, CCL15-CCL14, 12739, 115189, 130-471; 2496, CNOT1, 12740, 115190, 93-1043; 2496, CNOT1, 12743, 115193, 1-831; 2496, CNOT1, 12744, 115194, 1-1317; 2496, CNOT1, 12745, 115195, 1-553; 2496, CNOT1, 12746, 115196, 309-385; 2496, CNOT1, 12748, 115198, 1-578; 2496, CNOT1, 12750, 115200, 395-582; 2496, CNOT1, 12751, 115201, 1-205; 2496, CNOT1, 12752, 115202, 280-570; 2496, CNOT1, 12753, 115203, 461-535; 2496, CNOT1, 12754, 115204, 1-722; 2496, CNOT1, 12755, 115205, 1-291; 2496, CNOT1, 12741, 115191, 334-7464; 2496, CNOT1, 12742, 115192, 286-4941; 2496, CNOT1, 12747, 115197, 282-7397; 2496, CNOT1, 12749, 115199, 280-6732; 2497, CNOT10, 12758, 115208, 1-132; 2497, CNOT10, 12759, 115209, 1-687; 2497, CNOT10, 12761, 115211, 242-2071; 2497, CNOT10, 12762, 115212, 1-632; 2497, CNOT10, 12756, 115206, 317-2470; 2497, CNOT10, 12757, 115207, 317-2551; 2497, CNOT10, 12760, 115210, 86-2500; 2498, CNOT11, 12764, 115214, 1-382; 2498, CNOT11, 12763, 115213, 164-1696; 2499, CNOT2, 12767, 115217, 1-559; 2499, CNOT2, 12768, 115218, 144-1071; 2499, CNOT2, 12769, 115219, 1-315; 2499, CNOT2, 12770, 115220, 1-139; 2499, CNOT2, 12771, 115221, 376-964; 2499, CNOT2, 12772, 115222, 139-249; 2499, CNOT2, 12773, 115223, 1-548; 2499, CNOT2, 12774, 115224, 167-331; 2499, CNOT2, 12775, 115225, 165-993; 2499, CNOT2, 12776, 115226, 368-571; 2499, CNOT2, 12777, 115227, 1-298; 2499, CNOT2, 12779, 115229, 128-238; 2499, CNOT2, 12781, 115231, 156-386; 2499, CNOT2, 12782, 115232, 96-747; 2499, CNOT2, 12783, 115233, 538-1085; 2499, CNOT2, 12784, 115234, 956-2549; 2499, CNOT2, 12785, 115235, 374-618; 2499, CNOT2, 12786, 115236, 96-284; 2499, CNOT2, 12787, 115237, 463-895; 2499, CNOT2, 12788, 115238, 284-677; 2499, CNOT2, 12789, 115239, 506-582; 2499, CNOT2, 12790, 115240, 583-1545; 2499, CNOT2, 12791, 115241, 1-457; 2499, CNOT2, 12765, 115215, 583-2205; 2499, CNOT2, 12766, 115216, 452-2074; 2499, CNOT2, 12778, 115228, 4156-4731; 2499, CNOT2, 12780, 115230, 668-2288; 2500, CNOT3, 12794, 115244, 1-1125; 2500, CNOT3, 12795, 115245, 1-865; 2500, CNOT3, 12796, 115246, 343-2058; 2500, CNOT3, 12797, 115247, 1-267; 2500, CNOT3, 12799, 115249, 343-2058; 2500, CNOT3, 12801, 115251, 1604-3865; 2500, CNOT3, 12802, 115252, 1-865; 2500, CNOT3, 12804, 115254, 1604-3865; 2500, CNOT3, 12805, 115255, 343-2058; 2500, CNOT3, 12807, 115257, 1-319; 2500, CNOT3, 12808, 115258, 325-2586; 2500, CNOT3, 12809, 115259, 343-2058; 2500, CNOT3, 12810, 115260, 325-2586; 2500, CNOT3, 12812, 115262, 1-291; 2500, CNOT3, 12813, 115263, 325-2586; 2500, CNOT3, 12814, 115264, 325-2586; 2500, CNOT3, 12815, 115265, 1-1125; 2500, CNOT3, 12816, 115266, 343-2058; 2500, CNOT3, 12817, 115267, 1604-3865; 2500, CNOT3, 12819, 115269, 1-282; 2500, CNOT3, 12821, 115271, 1-319; 2500, CNOT3, 12822, 115272, 325-2586; 2500, CNOT3, 12823, 115273, 343-2058; 2500, CNOT3, 12824, 115274, 1604-3865; 2500, CNOT3, 12826, 115276, 1604-3865; 2500, CNOT3, 12827, 115277, 325-2586; 2500, CNOT3, 12828, 115278, 1-267; 2500, CNOT3, 12829, 115279, 1-282; 2500, CNOT3, 12831, 115281, 343-2058; 2500, CNOT3, 12832, 115282, 1-291; 2500, CNOT3, 12833, 115283, 1604-3865; 2500, CNOT3, 12792, 115242, 317-2578; 2500, CNOT3, 12793, 115243, 1584-3845; 2500, CNOT3, 12798, 115248, 343-2058; 2500, CNOT3, 12800, 115250, 343-2058; 2500, CNOT3, 12803, 115253, 343-2058; 2500, CNOT3, 12806, 115256, 317-2578; 2500, CNOT3, 12811, 115261, 1604-3865; 2500, CNOT3, 12818, 115268, 1604-3865; 2500, CNOT3, 12820, 115270, 325-2586; 2500, CNOT3, 12825, 115275, 1604-3865; 2500, CNOT3, 12830, 115280, 325-2586; 2501, CNOT4, 12835, 115285, 1081-1608; 2501, CNOT4, 12834, 115284, 332-2059; 2501, CNOT4, 12836, 115286, 296-2215; 2501, CNOT4, 12837, 115287, 285-2417; 2501, CNOT4, 12838, 115288, 281-1999; 2501, CNOT4, 12839, 115289, 282-2210; 2501, CNOT4, 12840, 115290, 1-1302; 2501, CNOT4, 12841, 115291, 332-2473; 2502, CNOT6, 12844, 115294, 3-706; 2502, CNOT6, 12842, 115292, 350-2023; 2502, CNOT6, 12843, 115293, 425-2098; 2502, CNOT6, 12845, 115295, 428-2101; 2503, CNOT6L, 12846, 115296, 1-1408; 2503, CNOT6L, 12848, 115298, 1-1689; 2503, CNOT6L, 12849, 115299, 69-209; 2503, CNOT6L, 12850, 115300, 83-572; 2503, CNOT6L, 12851, 115301, 1-781; 2503, CNOT6L, 12847, 115297, 132-1799; 2504, CNOT7, 12853, 115303, 1-626; 2504, CNOT7, 12854, 115304, 279-467; 2504, CNOT7, 12855, 115305, 447-568; 2504, CNOT7, 12857, 115307, 279-434; 2504, CNOT7, 12858, 115308, 258-700; 2504, CNOT7, 12859, 115309, 1-274; 2504, CNOT7, 12860, 115310, 277-432; 2504, CNOT7, 12852, 115302, 300-1157; 2504, CNOT7, 12856, 115306, 300-1034; 2505, CNOT8, 12863, 115313, 338-692; 2505, CNOT8, 12865, 115315, 392-648; 2505, CNOT8, 12866, 115316, 261-623; 2505, CNOT8, 12868, 115318, 201-554; 2505, CNOT8, 12869, 115319, 236-394; 2505, CNOT8, 12870, 115320, 231-500; 2505, CNOT8, 12871, 115321, 265-620; 2505, CNOT8, 12872, 115322, 396-562; 2505, CNOT8, 12873, 115323, 245-920; 2505, CNOT8, 12874, 115324, 444-830; 2505, CNOT8, 12875, 115325, 351-516; 2505, CNOT8, 12877, 115327, 515-912; 2505, CNOT8, 12861, 115311, 296-1174; 2505, CNOT8, 12862, 115312, 373-1251; 2505, CNOT8, 12864, 115314, 344-904; 2505, CNOT8, 12867, 115317, 285-845; 2505, CNOT8, 12876, 115326, 445-1005; 2505, CNOT8, 12878, 115328, 477-1355; 2505, CNOT8, 12879, 115329, 190-906; 2505, CNOT8, 12880, 115330, 165-725; 2506, CCZ1B, 12882, 115332, 47-283; 2506, CCZ1B, 12883, 115333, 574-810; 2506, CCZ1B, 12881, 115331, 574-2022; 2507, CCZ1, 12885, 115335, 1-237; 2507, CCZ1, 12884, 115334, 67-1515; 2508, CD101, 12886, 115336, 69-3134; 2508, CD101, 12887, 115337, 7-3072; 2509, CD109, 12888, 115338, 113-4450; 2509, CD109, 12889, 115339, 432-4718; 2509, CD109, 12890, 115340, 432-4538; 2510, CD14, 12893, 115343, 392-556; 2510, CD14, 12894, 115344, 243-882; 2510, CD14, 12895, 115345, 243-485; 2510, CD14, 12891, 115341, 631-1758; 2510, CD14, 12892, 115342, 393-1520; 2511, CD151, 12899, 115349, 253-793; 2511, CD151, 12900, 115350, 323-561; 2511, CD151, 12901, 115351, 74-608; 2511, CD151, 12903, 115353, 8-763; 2511, CD151, 12904, 115354, 276-545; 2511, CD151, 12905, 115355, 139-648; 2511, CD151, 12906, 115356, 520-713; 2511, CD151, 12907, 115357, 244-771; 2511, CD151, 12908, 115358, 290-565; 2511, CD151, 12909, 115359, 257-797; 2511, CD151, 12896, 115346, 145-906; 2511, CD151, 12897, 115347, 250-1011; 2511, CD151, 12898, 115348, 83-844; 2511, CD151, 12902, 115352, 84-845; 2512, CD160, 12912, 115362, 1-705; 2512, CD160, 12913, 115363, 1-219; 2512, CD160, 12914, 115364, 159-536; 2512, CD160, 12910, 115360, 85-630; 2512, CD160, 12911, 115361, 219-764; 2513, CD163, 12916, 115366, 87-3551; 2513, CD163, 12918, 115368, 1-413; 2513, CD163, 12919, 115369, 12-3341; 2513, CD163, 12920, 115370, 1-375; 2513, CD163, 12915, 115365, 204-3674; 2513, CD163, 12917, 115367, 87-3452; 2514, CD163L1, 12923, 115373, 1-328; 2514, CD163L1, 12924, 115374, 1-568; 2514, CD163L1, 12925, 115375, 348-532; 2514, CD163L1, 12926, 115376, 1-175; 2514, CD163L1, 12921, 115371, 59-4420; 2514, CD163L1, 12922, 115372, 20-4411; 2515, CD164, 12930, 115380, 182-625; 2515, CD164, 12932, 115382, 125-616; 2515, CD164, 12927, 115377, 67-621; 2515, CD164, 12928, 115378, 67-660; 2515, CD164, 12929, 115379, 67-603; 2515, CD164, 12931, 115381, 80-649; 2515, CD164, 12933, 115383, 33-506; 2516, CD164L2, 12934, 115384, 65-586; 2516, CD164L2, 12935, 115385, 142-666; 2517, CD177, 12937, 115387, 57-1370; 2517, CD177, 12938, 115388, 25-444; 2517, CD177, 12936, 115386, 1-438; 2518, CD180, 12939, 115389, 159-2144; 2519, CD19, 12943, 115393, 17-1420; 2519, CD19, 12940, 115390, 45-1715; 2519, CD19, 12941, 115391, 63-1736; 2519, CD19, 12942, 115392, 34-1707; 2520, CD1A, 12944, 115394, 534-1517; 2521, CD1B, 12946, 115396, 1-739; 2521, CD1B, 12945, 115395, 109-1110; 2522, CD1C, 12948, 115398, 1-844; 2522, CD1C, 12947, 115397, 280-1281; 2523, CD1D, 12949, 115399, 500-1507; 2524, CD1E, 12956, 115406, 1-181; 2524, CD1E, 12950, 115400, 1-435; 2524, CD1E, 12951, 115401, 1-696; 2524, CD1E, 12952, 115402, 1-861; 2524, CD1E, 12953, 115403, 1-399; 2524, CD1E, 12954, 115404, 1-1131; 2524, CD1E, 12955, 115405, 1-873; 2524, CD1E, 12957, 115407, 80-1045; 2524, CD1E, 12958, 115408, 74-379; 2524, CD1E, 12959, 115409, 107-1003; 2524, CD1E, 12960, 115410, 105-668; 2524, CD1E, 12961, 115411, 240-1406; 2524, CD1E, 12962, 115412, 294-1163; 2524, CD1E, 12963, 115413, 146-745; 2525, CD2BP2, 12964, 115414, 177-1202; 2525, CD2BP2, 12965, 115415, 254-1279; 2526, CD2, 12966, 115416, 27-428; 2526, CD2, 12967, 115417, 109-1164; 2527, CD200, 12969, 115419, 176-763; 2527, CD200, 12970, 115420, 146-598; 2527, CD200, 12971, 115421, 176-406; 2527, CD200, 12973, 115423, 196-802; 2527, CD200, 12974, 115424, 365-551; 2527, CD200, 12968, 115418, 58-867; 2527, CD200, 12972, 115422, 58-942; 2528, CD200R1, 12975, 115425, 247-885; 2528, CD200R1, 12976, 115426, 266-1312; 2528, CD200R1, 12977, 115427, 56-622; 2528, CD200R1, 12978, 115428, 56-553; 2528, CD200R1, 12979, 115429, 234-1211; 2529, CD200R1L, 12981, 115431, 1-750; 2529, CD200R1L, 12983, 115433, 220-387; 2529, CD200R1L, 12984, 115434, 1-762; 2529, CD200R1L, 12980, 115430, 227-1042; 2529, CD200R1L, 12982, 115432, 591-1343; 2530, CD207, 12985, 115435, 47-1033; 2531, CD209, 12991, 115441, 54-785; 2531, CD209, 12993, 115443, 101-1105; 2531, CD209, 12996, 115446, 1-807; 2531, CD209, 12986, 115436, 1-1083; 2531, CD209, 12987, 115437, 1-1143; 2531, CD209, 12988, 115438, 24-1238; 2531, CD209, 12989, 115439, 1-1197; 2531, CD209, 12990, 115440, 1-507; 2531, CD209, 12992, 115442, 108-1250; 2531, CD209, 12994, 115444, 101-994; 2531, CD209, 12995, 115445, 1-939; 2532, CD22, 12998, 115448, 26-1969; 2532, CD22, 13003, 115453, 170-603; 2532, CD22, 13004, 115454, 67-559; 2532, CD22, 13005, 115455, 237-554; 2532, CD22, 13007, 115457, 67-642; 2532, CD22, 13008, 115458, 88-204; 2532, CD22, 13009, 115459, 1-447; 2532, CD22, 13010, 115460, 67-542; 2532, CD22, 13011, 115461, 155-831; 2532, CD22, 13012, 115462, 159-558; 2532, CD22, 13013, 115463, 180-592; 2532, CD22, 13014, 115464, 1-438; 2532, CD22, 13015, 115465, 1-462; 2532, CD22, 12997, 115447, 67-2610; 2532, CD22, 12999, 115449, 85-2097; 2532, CD22, 13000, 115450, 383-2410; 2532, CD22, 13001, 115451, 42-2297; 2532, CD22, 13002, 115452, 67-2346; 2532, CD22, 13006, 115456, 26-2038;

2533, CD226, 13018, 115468, 265-810; 2533, CD226, 13019, 115469, 1-114; 2533, CD226, 13020, 115470, 549-930; 2533, CD226, 13021, 115471, 339-1168; 2533, CD226, 13022, 115472, 254-799; 2533, CD226, 13023, 115473, 184-579; 2533, CD226, 13016, 115466, 270-1280; 2533, CD226, 13017, 115467, 448-1458; 2534, CD24, 13024, 115474, 110-352; 2534, CD24, 13025, 115475, 87-200; 2534, CD24, 13026, 115476, 1-265; 2534, CD24, 13027, 115477, 1-368; 2534, CD24, 13028, 115478, 155-544; 2534, CD24, 13029, 115479, 368-610; 2534, CD24, 13030, 115480, 441-683; 2535, CD244, 13031, 115481, 24-845; 2535, CD244, 13032, 115482, 84-1196; 2535, CD244, 13033, 115483, 179-1276; 2535, CD244, 13034, 115484, 24-1013; 2536, CD247, 13035, 115485, 74-568; 2536, CD247, 13036, 115486, 146-637; 2537, CD248, 13037, 115487, 18-2291; 2538, CD27, 13038, 115488, 230-1012; 2539, CD274, 13039, 115489, 109-639; 2539, CD274, 13040, 115490, 87-959; 2540, CD276, 13043, 115493, 552-1718; 2540, CD276, 13044, 115494, 80-547; 2540, CD276, 13045, 115495, 133-628; 2540, CD276, 13047, 115497, 353-507; 2540, CD276, 13048, 115498, 1-598; 2540, CD276, 13049, 115499, 78-194; 2540, CD276, 13050, 115500, 224-621; 2540, CD276, 13051, 115501, 1-512; 2540, CD276, 13052, 115502, 240-649; 2540, CD276, 13053, 115503, 67-505; 2540, CD276, 13055, 115505, 153-550; 2540, CD276, 13056, 115506, 83-199; 2540, CD276, 13041, 115491, 235-1185; 2540, CD276, 13042, 115492, 303-1907; 2540, CD276, 13046, 115496, 125-1726; 2540, CD276, 13054, 115504, 1-951; 2541, CD28, 13057, 115507, 150-812; 2541, CD28, 13058, 115508, 223-528; 2541, CD28, 13059, 115509, 1-705; 2542, CD2AP, 13060, 115510, 457-2376; 2543, CD300LB, 13061, 115511, 125-571; 2543, CD300LB, 13062, 115512, 117-722; 2544, CD300LD, 13063, 115513, 82-666; 2545, CD300LF, 13068, 115518, 76-993; 2545, CD300LF, 13064, 115514, 89-823; 2545, CD300LF, 13065, 115515, 113-985; 2545, CD300LF, 13066, 115516, 1-585; 2545, CD300LF, 13067, 115517, 1-720; 2545, CD300LF, 13069, 115519, 278-862; 2545, CD300LF, 13070, 115520, 56-553; 2545, CD300LF, 13071, 115521, 56-937; 2545, CD300LF, 13072, 115522, 1-720; 2546, CD300LG, 13077, 115527, 65-517; 2546, CD300LG, 13073, 115523, 62-763; 2546, CD300LG, 13074, 115524, 42-1040; 2546, CD300LG, 13075, 115525, 70-891; 2546, CD300LG, 13076, 115526, 70-993; 2546, CD300LG, 13078, 115528, 62-730; 2547, CD300A, 13083, 115533, 780-1289; 2547, CD300A, 13079, 115529, 30-590; 2547, CD300A, 13080, 115530, 289-1188; 2547, CD300A, 13081, 115531, 30-341; 2547, CD300A, 13082, 115532, 47-499; 2548, CD300C, 13084, 115534, 362-1036; 2549, CD300E, 13086, 115536, 206-570; 2549, CD300E, 13085, 115535, 118-735; 2550, CD302, 13089, 115539, 58-645; 2550, CD302, 13087, 115537, 45-743; 2550, CD302, 13088, 115538, 58-582; 2551, CD320, 13092, 115542, 1-266; 2551, CD320, 13093, 115543, 11-256; 2551, CD320, 13090, 115540, 66-914; 2551, CD320, 13091, 115541, 61-783; 2552, CD33, 13096, 115546, 56-694; 2552, CD33, 13094, 115544, 22-1116; 2552, CD33, 13095, 115545, 22-954; 2552, CD33, 13097, 115547, 56-769; 2553, CD34, 13100, 115550, 656-1339; 2553, CD34, 13098, 115548, 323-1480; 2553, CD34, 13099, 115549, 323-1309; 2554, CD36, 13103, 115553, 296-1686; 2554, CD36, 13104, 115554, 33-332; 2554, CD36, 13105, 115555, 256-536; 2554, CD36, 13108, 115558, 247-855; 2554, CD36, 13109, 115559, 261-541; 2554, CD36, 13110, 115560, 292-720; 2554, CD36, 13113, 115563, 121-565; 2554, CD36, 13114, 115564, 282-1472; 2554, CD36, 13115, 115565, 373-569; 2554, CD36, 13116, 115566, 1-199; 2554, CD36, 13101, 115551, 414-1832; 2554, CD36, 13102, 115552, 255-1673; 2554, CD36, 13106, 115556, 685-2103; 2554, CD36, 13107, 115557, 415-1716; 2554, CD36, 13111, 115561, 121-1539; 2554, CD36, 13112, 115562, 255-1673; 2554, CD36, 13117, 115567, 415-1653; 2554, CD36, 13118, 115568, 415-1281; 2555, CD37, 13120, 115570, 170-640; 2555, CD37, 13122, 115572, 115-927; 2555, CD37, 13123, 115573, 78-559; 2555, CD37, 13125, 115575, 1-763; 2555, CD37, 13126, 115576, 251-330; 2555, CD37, 13127, 115577, 142-507; 2555, CD37, 13119, 115569, 142-987; 2555, CD37, 13121, 115571, 316-957; 2555, CD37, 13124, 115574, 316-924; 2556, CD38, 13129, 115579, 1-455; 2556, CD38, 13128, 115578, 138-1040; 2556, CD38, 13130, 115580, 141-509; 2557, CD3D, 13133, 115583, 1-397; 2557, CD3D, 13134, 115584, 41-337; 2557, CD3D, 13131, 115581, 138-653; 2557, CD3D, 13132, 115582, 25-408; 2558, CD3E, 13136, 115586, 55-660; 2558, CD3E, 13135, 115585, 292-915; 2559, CD3EAP, 13139, 115589, 1-202; 2559, CD3EAP, 13140, 115590, 945-1061; 2559, CD3EAP, 13137, 115587, 489-2021; 2559, CD3EAP, 13138, 115588, 7-1545; 2560, CD3G, 13141, 115591, 60-182; 2560, CD3G, 13142, 115592, 261-497; 2560, CD3G, 13143, 115593, 69-617; 2561, CD4, 13145, 115595, 444-579; 2561, CD4, 13146, 115596, 195-641; 2561, CD4, 13144, 115594, 259-1635; 2562, CD40LG, 13147, 115597, 23-745; 2562, CD40LG, 13148, 115598, 57-842; 2563, CD40, 13151, 115601, 1-479; 2563, CD40, 13152, 115602, 67-522; 2563, CD40, 13149, 115599, 29-640; 2563, CD40, 13150, 115600, 73-906; 2564, CD44, 13154, 115604, 1-697; 2564, CD44, 13156, 115606, 1-862; 2564, CD44, 13160, 115610, 123-365; 2564, CD44, 13161, 115611, 1-883; 2564, CD44, 13164, 115614, 1-586; 2564, CD44, 13165, 115615, 1-747; 2564, CD44, 13166, 115616, 123-743; 2564, CD44, 13167, 115617, 1-687; 2564, CD44, 13168, 115618, 1-584; 2564, CD44, 13169, 115619, 1-571; 2564, CD44, 13170, 115620, 1-722; 2564, CD44, 13171, 115621, 1-543; 2564, CD44, 13172, 115622, 1-249; 2564, CD44, 13173, 115623, 1-581; 2564, CD44, 13174, 115624, 423-659; 2564, CD44, 13175, 115625, 1-352; 2564, CD44, 13176, 115626, 1-749; 2564, CD44, 13177, 115627, 1-728; 2564, CD44, 13178, 115628, 1-560; 2564, CD44, 13153, 115603, 435-1520; 2564, CD44, 13155, 115605, 19-438; 2564, CD44, 13157, 115607, 1-1023; 2564, CD44, 13158, 115608, 135-2234; 2564, CD44, 13159, 115609, 117-1598; 2564, CD44, 13162, 115612, 124-2352; 2564, CD44, 13163, 115613, 12-1301; 2565, CD46, 13189, 115639, 1-236; 2565, CD46, 13179, 115629, 157-1356; 2565, CD46, 13180, 115630, 157-1206; 2565, CD46, 13181, 115631, 157-1311; 2565, CD46, 13182, 115632, 157-1266; 2565, CD46, 13183, 115633, 157-1335; 2565, CD46, 13184, 115634, 99-1166; 2565, CD46, 13185, 115635, 157-1245; 2565, CD46, 13186, 115636, 157-1290; 2565, CD46, 13187, 115637, 157-1167; 2565, CD46, 13188, 115638, 91-1203; 2566, CD47, 13192, 115642, 1-260; 2566, CD47, 13193, 115643, 1-329; 2566, CD47, 13190, 115640, 118-1035; 2566, CD47, 13191, 115641, 107-1078; 2567, CD48, 13196, 115646, 69-827; 2567, CD48, 13194, 115644, 41-550; 2567, CD48, 13195, 115645, 89-820; 2568, CD5, 13198, 115648, 53-547; 2568, CD5, 13197, 115647, 167-1654; 2569, CD5L, 13199, 115649, 98-1141; 2570, CD52, 13200, 115650, 62-247; 2571, CD53, 13201, 115651, 113-772; 2572, CD55, 13203, 115653, 1-978; 2572, CD55, 13204, 115654, 235-1569; 2572, CD55, 13206, 115656, 34-1686; 2572, CD55, 13207, 115657, 124-1077; 2572, CD55, 13202, 115652, 66-1388; 2572, CD55, 13205, 115655, 259-1404; 2573, CD58, 13208, 115658, 68-790; 2573, CD58, 13212, 115662, 1-395; 2573, CD58, 13209, 115659, 68-820; 2573, CD58, 13210, 115660, 55-801; 2573, CD58, 13211, 115661, 13-726; 2574, CD59, 13219, 115669, 12-404; 2574, CD59, 13223, 115673, 1-158; 2574, CD59, 13224, 115674, 46-405; 2574, CD59, 13225, 115675, 4-330; 2574, CD59, 13213, 115663, 128-514; 2574, CD59, 13214, 115664, 77-463; 2574, CD59, 13215, 115665, 55-441; 2574, CD59, 13216, 115666, 111-497; 2574, CD59, 13217, 115667, 266-652; 2574, CD59, 13218, 115668, 175-561; 2574, CD59, 13220, 115670, 179-565; 2574, CD59, 13221, 115671, 221-607; 2574, CD59, 13222, 115672, 23-409; 2575, CD6, 13227, 115677, 121-1527; 2575, CD6, 13230, 115680, 1-1268; 2575, CD6, 13231, 115681, 1-835; 2575, CD6, 13232, 115682, 1-556; 2575, CD6, 13233, 115683, 131-247; 2575, CD6, 13226, 115676, 187-2193; 2575, CD6, 13228, 115678, 1-1806; 2575, CD6, 13229, 115679, 1-1779; 2576, CD63, 13236, 115686, 144-788; 2576, CD63, 13240, 115690, 52-489; 2576, CD63, 13242, 115692, 194-845; 2576, CD63, 13244, 115694, 60-392; 2576, CD63, 13245, 115695, 120-557; 2576, CD63, 13246, 115696, 71-508; 2576, CD63, 13247, 115697, 209-607; 2576, CD63, 13234, 115684, 280-996; 2576, CD63, 13235, 115685, 147-863; 2576, CD63, 13237, 115687, 9-656; 2576, CD63, 13238, 115688, 218-688; 2576, CD63, 13239, 115689, 438-1154; 2576, CD63, 13241, 115691, 385-855; 2576, CD63, 13243, 115693, 142-858; 2577, CD68, 13250, 115700, 1-364; 2577, CD68, 13251, 115701, 41-582; 2577, CD68, 13248, 115698, 212-1276; 2577, CD68, 13249, 115699, 188-1171; 2578, CD69, 13253, 115703, 82-576; 2578, CD69, 13252, 115702, 82-681; 2579, CD7, 13255, 115705, 790-1212; 2579, CD7, 13256, 115706, 83-748; 2579, CD7, 13257, 115707, 85-564; 2579, CD7, 13258, 115708, 56-163; 2579, CD7, 13259, 115709, 394-759; 2579, CD7, 13254, 115704, 108-830; 2580, CD70, 13262, 115712, 377-572; 2580, CD70, 13260, 115710, 151-732; 2580, CD70, 13261, 115711, 138-764; 2581, CD72, 13264, 115714, 87-449; 2581, CD72, 13265, 115715, 68-427; 2581, CD72, 13267, 115717, 1-1080; 2581, CD72, 13263, 115713, 125-1204; 2581, CD72, 13266, 115716, 166-1245; 2582, CD74, 13271, 115721, 3-461; 2582, CD74, 13272, 115722, 3-161; 2582, CD74, 13273, 115723, 3-371; 2582, CD74, 13274, 115724, 1-949; 2582, CD74, 13275, 115725, 1-437; 2582, CD74, 13268, 115718, 3-893; 2582, CD74, 13269, 115719, 181-879; 2582, CD74, 13270, 115720, 21-503; 2583, CD79A, 13278, 115728, 26-801; 2583, CD79A, 13276, 115726, 186-866; 2583, CD79A, 13277, 115727, 1-567; 2584, CD79B, 13279, 115729, 94-783; 2584, CD79B, 13280, 115730, 1-378; 2584, CD79B, 13281, 115731, 76-768; 2585, CD80, 13282, 115732, 364-1230; 2585, CD80, 13283, 115733, 1-771; 2585, CD80, 13284, 115734, 318-1184; 2586, CD81, 13286, 115736, 6-830; 2586, CD81, 13287, 115737, 237-734; 2586, CD81, 13288, 115738, 49-777; 2586, CD81, 13289, 115739, 510-1136; 2586, CD81, 13290, 115740, 100-396; 2586, CD81, 13291, 115741, 404-558; 2586, CD81, 13292, 115742, 329-606; 2586, CD81, 13293, 115743, 1-678; 2586, CD81, 13294, 115744, 1-665; 2586, CD81, 13295, 115745, 1-444; 2586, CD81, 13296, 115746, 239-736; 2586, CD81, 13285, 115735, 257-967; 2587, CD82, 13299, 115749, 257-580; 2587, CD82, 13300, 115750, 1-174; 2587, CD82, 13301, 115751, 118-654; 2587, CD82, 13302, 115752, 109-581; 2587, CD82, 13303, 115753, 260-573; 2587, CD82, 13304, 115754, 354-468; 2587, CD82, 13305, 115755, 56-538; 2587, CD82, 13306, 115756, 381-584; 2587, CD82, 13297, 115747, 249-1052; 2587, CD82, 13298, 115748, 239-967; 2588, CD83, 13308, 115758, 185-625; 2588, CD83, 13307, 115757, 172-789; 2589, CD84, 13309, 115759, 68-1105; 2589, CD84, 13310, 115760, 68-1087; 2589, CD84, 13311, 115761, 68-886; 2589, CD84, 13312, 115762, 37-1023; 2589, CD84, 13313, 115763, 80-724; 2590, CD86, 13317, 115767, 1-832; 2590, CD86, 13319, 115769, 65-567; 2590, CD86, 13314, 115764, 202-1029; 2590, CD86, 13315, 115765, 117-1106; 2590, CD86, 13316, 115766, 148-1119; 2590, CD86, 13318, 115768, 321-1064; 2590, CD86, 13320, 115770, 125-778; 2591, CD8A, 13324, 115774, 1-597; 2591, CD8A, 13321, 115771, 856-1563; 2591, CD8A, 13322, 115772, 71-667; 2591, CD8A, 13323, 115773, 1032-1739; 2592, CD8B, 13330, 115780, 60-692; 2592, CD8B, 13325, 115775, 51-782; 2592, CD8B, 13326, 115776, 51-692; 2592, CD8B, 13327, 115777, 60-692; 2592, CD8B, 13328, 115778, 51-716; 2592, CD8B, 13329, 115779, 60-656; 2593, CD9, 13332, 115782, 319-798; 2593, CD9, 13334, 115784, 116-800; 2593, CD9, 13335, 115785, 315-739; 2593, CD9, 13336, 115786, 185-733; 2593, CD9, 13337, 115787, 112-657; 2593, CD9, 13331, 115781, 52-738; 2593, CD9, 13333, 115783, 437-1123; 2594, CD93, 13338, 115788, 149-2107; 2595, CD96, 13341, 115791, 100-1308; 2595, CD96, 13342, 115792, 1-439; 2595, CD96, 13343, 115793, 57-1763; 2595, CD96, 13344, 115794, 66-422; 2595, CD96, 13345, 115795, 493-546; 2595, CD96, 13339, 115789, 132-1889; 2595, CD96, 13340, 115790, 241-1950; 2596, CD99, 13346, 115796, 1-186; 2596, CD99, 13347, 115797, 1-231; 2596, CD99, 13348, 115798, 82-615; 2596, CD99, 13351, 115801, 1-604; 2596, CD99, 13353, 115803, 49-603; 2596, CD99, 13349, 115799, 86-595; 2596, CD99, 13350, 115800, 183-740; 2596, CD99, 13352, 115802, 175-657; 2596, CD99, 13354, 115804, 1-483; 2597, CD99L2, 13357, 115807, 1-473; 2597, CD99L2, 13361, 115811, 1-533; 2597, CD99L2, 13362, 115812, 43-480; 2597, CD99L2, 13355, 115805, 39-611; 2597, CD99L2, 13356, 115806, 119-907; 2597, CD99L2, 13358, 115808, 229-798; 2597, CD99L2, 13359, 115809, 42-683; 2597, CD99L2, 13360, 115810, 229-1047; 2598, CKS1B, 13364, 115814, 64-267; 2598, CKS1B, 13365, 115815, 250-441; 2598, CKS1B, 13363, 115813, 48-287; 2599, CKS2, 13366, 115816, 96-335; 2600, CDC42BPA, 13368, 115818, 944-6043; 2600, CDC42BPA, 13369, 115819, 3152-6208; 2600, CDC42BPA, 13372, 115822, 1-3145; 2600, CDC42BPA, 13373, 115823, 1-1639; 2600, CDC42BPA, 13374, 115824, 1-2183; 2600, CDC42BPA, 13375, 115825, 1-2953; 2600, CDC42BPA, 13367, 115817, 533-5731; 2600, CDC42BPA, 13370, 115820, 1-4917; 2600, CDC42BPA, 13371, 115821, 1293-6452; 2601, CDC42BPB, 13377, 115827, 1-1999; 2601, CDC42BPB, 13378, 115828, 1-390; 2601, CDC42BPB, 13376, 115826, 290-5425; 2602, CDC42BPG, 13379, 115829, 1-4656; 2603, CDC42EP1, 13381, 115831, 419-564; 2603, CDC42EP1, 13382, 115832, 408-588; 2603, CDC42EP1, 13383, 115833, 511-720; 2603, CDC42EP1, 13380, 115830, 421-1596; 2604, CDC42EP2, 13384, 115834, 493-1125; 2604, CDC42EP2, 13385, 115835, 557-1189; 2605, CDC42EP3, 13387, 115837, 850-953; 2605, CDC42EP3, 13388, 115838, 351-997; 2605, CDC42EP3, 13389, 115839, 501-542; 2605, CDC42EP3, 13386, 115836, 1002-1766; 2605, CDC42EP3, 13390, 115840, 419-1183; 2606, CDC42EP4, 13393, 115843, 641-1022; 2606, CDC42EP4, 13394, 115844, 362-580; 2606, CDC42EP4, 13395, 115845, 218-457; 2606, CDC42EP4, 13396, 115846, 1-240; 2606, CDC42EP4, 13391, 115841, 396-1466; 2606, CDC42EP4, 13392, 115842, 214-1074; 2607, CDC42EP5, 13399, 115849, 160-211; 2607, CDC42EP5, 13401, 115851, 160-211; 2607, CDC42EP5, 13397, 115847, 343-789; 2607, CDC42EP5, 13398, 115848, 343-789; 2607, CDC42EP5, 13400, 115850, 340-786; 2607, CDC42EP5, 13402, 115852, 354-800; 2608, ARHGEF9, 13404, 115854, 778-2472; 2608, ARHGEF9, 13405, 115855, 831-2318; 2608, ARHGEF9, 13406, 115856, 402-1865; 2608, ARHGEF9, 13407, 115857, 380-1831; 2608, ARHGEF9, 13408, 115858, 251-582; 2608, ARHGEF9, 13409, 115859, 1-275; 2608, ARHGEF9, 13410, 115860, 213-1700; 2608, ARHGEF9, 13411, 115861, 295-618; 2608, ARHGEF9, 13412, 115862, 773-898; 2608, ARHGEF9, 13413, 115863, 232-578; 2608, ARHGEF9, 13415, 115865, 183-584; 2608, ARHGEF9, 13417, 115867, 588-998; 2608, ARHGEF9, 13403, 115853, 802-2352; 2608, ARHGEF9, 13414, 115864, 414-1805; 2608, ARHGEF9, 13416, 115866, 867-2111; 2609, CDC42SE1, 13418, 115868, 435-674; 2609, CDC42SE1, 13419, 115869, 571-810; 2609, CDC42SE1, 13420, 115870, 886-1125; 2610, CDC42SE2, 13423, 115873, 1-165; 2610, CDC42SE2, 13424, 115874, 646-819; 2610, CDC42SE2, 13421, 115871, 547-801; 2610, CDC42SE2, 13422, 115872, 444-698; 2610, CDC42SE2, 13425, 115875, 522-776; 2611, CLK1, 13427, 115877, 61-984; 2611, CLK1, 13428, 115878, 100-1167; 2611, CLK1, 13431, 115881, 182-1546; 2611, CLK1, 13426, 115876, 137-1591; 2611, CLK1, 13429, 115879, 336-1916; 2611, CLK1, 13430, 115880, 94-504; 2612, CLK2, 13432, 115882, 283-1776; 2612, CLK2, 13435, 115885, 283-1776; 2612, CLK2, 13433, 115883, 88-1584; 2612, CLK2, 13434, 115884, 317-1816; 2612, CLK2, 13436, 115886, 88-1584; 2612, CLK2, 13437, 115887, 317-1816; 2613, CLK3, 13441, 115891, 1-178; 2613, CLK3, 13442, 115892, 1-582; 2613, CLK3, 13443, 115893, 1-918; 2613, CLK3, 13444, 115894, 109-544; 2613, CLK3, 13445, 115895, 291-860; 2613, CLK3, 13446, 115896, 1-522; 2613, CLK3, 13447, 115897, 222-572; 2613, CLK3, 13448, 115898, 1-211; 2613, CLK3, 13449, 115899, 470-526; 2613, CLK3, 13450, 115900, 59-732; 2613, CLK3, 13451, 115901, 1-481; 2613, CLK3, 13452, 115902, 89-805; 2613, CLK3, 13438, 115888, 56-1528; 2613, CLK3, 13439, 115889, 462-2378; 2613, CLK3, 13440, 115890, 56-514; 2614, CLK4, 13454, 115904, 85-246; 2614, CLK4, 13455, 115905, 111-542; 2614, CLK4, 13456, 115906, 168-437; 2614, CLK4, 13457, 115907, 86-250; 2614, CLK4, 13458, 115908, 57-1178; 2614, CLK4, 13459, 115909, 109-1230; 2614, CLK4, 13453, 115903, 170-1615; 2615, CISD1, 13460, 115910, 217-543; 2616, CISD2, 13462, 115912, 45-482; 2616, CISD2, 13463, 115913, 32-175; 2616, CISD2, 13461, 115911, 108-515; 2617, CISD3, 13464, 115914, 125-508; 2617, CISD3, 13465, 115915, 125-508; 2618, CACUL1, 13466, 115916, 485-1594; 2618, CACUL1, 13467, 115917, 488-1399; 2619, CABLES1, 13471, 115921, 315-343; 2619, CABLES1, 13472, 115922, 225-341; 2619, CABLES1, 13473, 115923, 1-491; 2619, CABLES1, 13468, 115918, 1-1902; 2619, CABLES1, 13469, 115919, 244-1164; 2619, CABLES1, 13470, 115920, 79-1185; 2620, CABLES2, 13475, 115925, 1-775; 2620, CABLES2, 13474, 115924, 10-1446; 2621, CDK5RAP1, 13479, 115929, 1-770; 2621, CDK5RAP1, 13476, 115926, 155-1918; 2621, CDK5RAP1, 13477, 115927, 155-1687; 2621, CDK5RAP1, 13478, 115928, 155-1960; 2621, CDK5RAP1, 13480, 115930, 233-1726; 2622, CDKAL1, 13481, 115931, 168-1907; 2622, CDKAL1, 13482, 115932, 11-1750; 2622, CDKAL1, 13483, 115933, 257-550; 2623, CDK5RAP2, 13486, 115936, 193-5184; 2623, CDK5RAP2, 13487, 115937, 1-3864; 2623, CDK5RAP2, 13488, 115938, 1-2712; 2623, CDK5RAP2, 13489, 115939, 84-911; 2623, CDK5RAP2, 13490, 115940, 28-2277; 2623, CDK5RAP2, 13491, 115941, 28-1410; 2623, CDK5RAP2, 13492, 115942, 166-565; 2623, CDK5RAP2, 13484, 115934, 181-5862; 2623, CDK5RAP2, 13485, 115935, 181-5625; 2624, CDK5RAP3, 13495, 115945, 99-416; 2624, CDK5RAP3, 13496, 115946, 70-426; 2624, CDK5RAP3, 13497, 115947, 26-400; 2624, CDK5RAP3, 13498, 115948, 13-159; 2624, CDK5RAP3, 13499, 115949, 376-567; 2624, CDK5RAP3, 13500, 115950, 531-901; 2624, CDK5RAP3, 13501, 115951, 1-312; 2624, CDK5RAP3, 13502, 115952, 342-518; 2624, CDK5RAP3, 13503, 115953, 25-867; 2624, CDK5RAP3, 13504, 115954, 1-818; 2624, CDK5RAP3, 13505, 115955, 26-358; 2624, CDK5RAP3, 13506, 115956, 151-738; 2624, CDK5RAP3, 13493, 115943, 107-1627; 2624, CDK5RAP3, 13494, 115944, 110-1705; 2625, CIZ1, 13507, 115957, 4-2616; 2625, CIZ1, 13508, 115958, 52-809; 2625, CIZ1, 13509, 115959, 164-2776; 2625, CIZ1, 13513, 115963, 1-2514; 2625, CIZ1, 13514, 115964, 1-2463; 2625, CIZ1, 13515, 115965, 179-684; 2625, CIZ1, 13516, 115966, 1-2865; 2625, CIZ1, 13518, 115968, 1-928; 2625, CIZ1, 13519, 115969, 658-3354; 2625, CIZ1, 13510, 115960, 164-2860; 2625, CIZ1, 13511, 115961, 204-2732; 2625, CIZ1, 13512, 115962, 143-2599; 2625, CIZ1, 13517, 115967, 334-2727; 2626, CDKN2AIP, 13520, 115970, 164-544; 2626, CDKN2AIP, 13521, 115971, 102-509; 2626, CDKN2AIP, 13522, 115972, 208-1950; 2627, CDKN2AIPNL, 13523, 115973, 28-285; 2627, CDKN2AIPNL, 13524, 115974, 45-395; 2628, CDS1, 13526, 115976, 134-379; 2628, CDS1, 13525, 115975, 424-1809; 2629, CDS2, 13527, 115977, 195-945; 2629, CDS2, 13528, 115978, 308-1645; 2630, CDIPT, 13531, 115981, 186-899; 2630, CDIPT, 13532, 115982, 420-545; 2630, CDIPT, 13535, 115985, 34-507; 2630, CDIPT, 13529, 115979, 880-1521; 2630, CDIPT, 13530, 115980, 244-885; 2630, CDIPT, 13533, 115983, 87-728; 2630, CDIPT, 13534, 115984, 348-854; 2631, CDV3, 13539, 115989, 1-563; 2631, CDV3, 13540, 115990, 176-502; 2631, CDV3, 13541, 115991, 185-655; 2631, CDV3, 13542, 115992, 312-471; 2631, CDV3, 13543, 115993, 172-448; 2631, CDV3, 13544, 115994, 186-512; 2631, CDV3, 13536, 115986, 316-1092; 2631, CDV3, 13537, 115987, 70-711; 2631, CDV3, 13538, 115988, 203-535; 2632, CEBPZOS, 13545, 115995, 35-277; 2632, CEBPZOS, 13546, 115996, 425-667; 2632, CEBPZOS, 13547, 115997, 15-257; 2632, CEBPZOS, 13548, 115998, 35-277; 2632, CEBPZOS, 13549, 115999, 197-439; 2633, CDON, 13552, 116002, 1-731; 2633, CDON, 13553, 116003, 388-2313; 2633, CDON, 13554, 116004, 129-624; 2633, CDON, 13555, 116005, 1-1948; 2633, CDON, 13556, 116006, 295-722; 2633, CDON, 13557, 116007, 126-459; 2633, CDON, 13550, 116000, 129-3923; 2633, CDON, 13551, 116001, 129-3992; 2634, CADM1, 13561, 116011, 36-581; 2634, CADM1, 13563, 116013, 393-629; 2634, CADM1, 13564, 116014, 22-1353; 2634, CADM1, 13565, 116015, 502-833; 2634, CADM1, 13566, 116016, 1-565; 2634, CADM1, 13567, 116017, 1-1240; 2634, CADM1, 13568, 116018, 22-225; 2634, CADM1, 13569, 116019, 1-1293; 2634, CADM1, 13570, 116020, 1-1206; 2634, CADM1, 13571, 116021, 2-1042; 2634, CADM1, 13572, 116022, 1-1122; 2634, CADM1, 13573, 116023, 1-1239; 2634, CADM1, 13558, 116008, 172-1587; 2634, CADM1, 13559, 116009, 22-1350; 2634, CADM1, 13560, 116010, 130-1374; 2634, CADM1, 13562, 116012, 22-1383; 2635, CADM2, 13574, 116024, 628-1842; 2635, CADM2, 13575, 116025, 1-1314; 2635, CADM2, 13576, 116026, 63-1370; 2636, CADM3, 13579, 116029, 8-711; 2636, CADM3, 13577, 116027, 158-1456; 2636, CADM3, 13578, 116028, 158-1354; 2637, CADM4, 13580, 116030, 50-1216; 2638, CHL1, 13583, 116033, 341-594; 2638, CHL1, 13584, 116034, 1-1076; 2638, CHL1, 13585, 116035, 181-723; 2638, CHL1, 13586, 116036, 376-572; 2638, CHL1, 13587, 116037, 4-285; 2638, CHL1, 13588, 116038, 254-543; 2638, CHL1, 13589, 116039, 95-3610; 2638, CHL1, 13581, 116031, 643-4317; 2638, CHL1, 13582, 116032, 468-4094; 2639, CCAR2, 13592, 116042, 1-1847; 2639, CCAR2, 13593, 116043, 56-542; 2639, CCAR2, 13594, 116044, 277-1107; 2639, CCAR2, 13595, 116045, 91-336; 2639, CCAR2, 13596, 116046, 696-2492; 2639, CCAR2, 13597, 116047, 1-549; 2639, CCAR2, 13598, 116048, 99-549; 2639, CCAR2, 13599, 116049, 1-445; 2639, CCAR2, 13600, 116050, 299-1117; 2639, CCAR2, 13590, 116040, 250-3021; 2639, CCAR2, 13591, 116041, 420-3191; 2640, CAPRIN1, 13603, 116053, 109-668; 2640, CAPRI N1, 13604, 116054, 233-2119; 2640, CAPRIN1, 13607, 116057, 200-2149; 2640, CAPRIN1, 13601, 116051, 190-2319; 2640, CAPRIN1, 13602, 116052, 141-2225; 2640, CAPRIN1, 13605, 116055, 212-2341; 2640, CAPRIN1, 13606, 116056, 93-2177; 2641, CEND1, 13608, 116058, 177-626; 2642, CCPG1, 13613, 116063, 1-610; 2642, CCPG1, 13614, 116064, 69-790; 2642, CCPG1, 13615, 116065, 1-98; 2642, CCPG1, 13616, 116066, 69-527; 2642, CCPG1, 13617, 116067, 303-578; 2642, CCPG1, 13618, 116068, 59-570; 2642, CCPG1, 13619, 116069, 1-352; 2642, CCPG1, 13609, 116059, 300-2573; 2642, CCPG1, 13610, 116060, 49-2472; 2642, CCPG1, 13611, 116061, 96-1370; 2642, CCPG1, 13612, 116062, 216-2489; 2643, CIDEA, 13621, 116071, 24-626; 2643, CIDEA, 13620, 116070, 66-725; 2644, CIDEB, 13625, 116075, 1-184; 2644, CIDEB, 13622, 116072, 1189-1848; 2644, CIDEB, 13623, 116073, 1304-1963; 2644, CIDEB, 13624, 116074, 406-1065; 2645, CIDEC, 13627, 116077, 21-776; 2645, CIDEC, 13631, 116081, 3-404; 2645, CIDEC, 13626, 116076, 141-857; 2645, CIDEC, 13628, 116078, 209-703; 2645, CIDEC, 13629, 116079, 122-616; 2645, CIDEC, 13630, 116080, 26-772; 2645, CIDEC, 13632, 116082, 57-803; 2646, CDIP1, 13637, 116087, 238-396; 2646, CDIP1, 13638, 116088, 179-577; 2646, CDIP1, 13639, 116089, 111-444; 2646, CDIP1, 13641, 116091, 200-484; 2646, CDIP1, 13642, 116092, 20-476; 2646, CDIP1, 13643, 116093, 210-477; 2646, CDIP1, 13644, 116094, 214-299; 2646, CDIP1, 13645, 116095, 514-756; 2646, CDIP1, 13647, 116097, 210-477; 2646, CDIP1, 13649, 116099, 105-503; 2646, CDIP1, 13651, 116101, 105-347; 2646, CDIP1, 13652, 116102, 214-299; 2646, CDIP1, 13653, 116103, 111-444; 2646, CDIP1, 13654, 116104, 20-476; 2646, CDIP1, 13656, 116106, 111-269; 2646, CDIP1, 13657, 116107, 55-339; 2646, CDIP1, 13633, 116083, 550-1176; 2646, CDIP1, 13634, 116084, 251-877; 2646, CDIP1, 13635, 116085, 177-566; 2646, CDIP1, 13636, 116086, 188-697; 2646, CDIP1, 13640, 116090, 188-814; 2646, CDIP1, 13646, 116096, 550-1176; 2646, CDIP1, 13648, 116098, 105-614; 2646, CDIP1, 13650, 116100, 105-731; 2646, CDIP1, 13655, 116105, 105-731; 2646, CDIP1, 13658, 116108, 105-494; 2647, CDC123, 13660, 116110, 24-911; 2647, CDC123, 13661, 116111, 1-433; 2647, CDC123, 13662, 116112, 15-564; 2647, CDC123, 13663, 116113, 176-646; 2647, CDC123, 13659, 116109, 281-1291; 2648, CDC14A, 13667, 116117, 24-841; 2648, CDC14A, 13668, 116118, 285-1982; 2648, CDC14A, 13664, 116114, 356-2140; 2648, CDC14A, 13665, 116115, 465-2336; 2648, CDC14A, 13666, 116116, 454-1605; 2649, CDC14B, 13672, 116122, 1-804; 2649, CDC14B, 13673, 116123, 1-684; 2649, CDC14B, 13674, 116124, 1-1443; 2649, CDC14B, 13669, 116119, 1-1380; 2649, CDC14B, 13670, 116120, 453-1949; 2649, CDC14B, 13671, 116121, 439-1824; 2649, CDC14B, 13675, 116125, 453-1868; 2649, CDC14B, 13676, 116126, 23-1480; 2650, CDC16, 13678, 116128, 284-1711; 2650, CDC16, 13683, 116133, 481-1908; 2650, CDC16, 13677, 116127, 25-1884; 2650, CDC16, 13679, 116129, 109-1971; 2650, CDC16, 13680, 116130, 199-2061; 2650, CDC16, 13681, 116131, 304-1884; 2650, CDC16, 13682, 116132, 426-2006; 2651, CDC20, 13684, 116134, 102-1601; 2651, CDC20, 13685, 116135, 204-1703; 2652, CDC20B, 13686, 116136, 176-1723; 2652, CDC20B, 13687, 116137, 176-1609; 2652, CDC20B, 13688, 116138, 147-1706; 2652, CDC20B, 13689, 116139, 162-740; 2652, CDC20B, 13690, 116140, 16-1134; 2653, CDC23, 13693, 116143, 12-341; 2653, CDC23, 13694, 116144, 1-403; 2653, CDC23, 13695, 116145, 12-383; 2653, CDC23, 13691, 116141, 32-487; 2653, CDC23, 13692, 116142, 32-1825; 2654, CDC25A, 13698, 116148, 302-730; 2654, CDC25A, 13699, 116149, 20-777; 2654, CDC25A, 13696, 116146, 410-1984; 2654, CDC25A, 13697, 116147, 410-1864; 2655, CDC25B, 13701, 116151, 361-1911; 2655, CDC25B, 13703, 116153, 361-1830; 2655, CDC25B, 13700, 116150, 698-2440; 2655, CDC25B, 13702, 116152, 102-1721; 2655, CDC25B, 13704, 116154, 242-1942; 2656, CDC25C, 13708, 116158, 1-774; 2656, CDC25C, 13711, 116161, 358-867; 2656, CDC25C, 13712, 116162, 313-1059; 2656, CDC25C, 13705, 116155, 280-1701; 2656, CDC25C, 13706, 116156, 322-1524; 2656, CDC25C, 13707, 116157, 235-1437; 2656, CDC25C, 13709, 116159, 435-1856; 2656, CDC25C, 13710, 116160, 1-1332; 2657, CDC26, 13713, 116163, 360-617; 2658, CDC27, 13715, 116165, 93-1124; 2658, CDC27, 13716, 116166, 80-364; 2658, CDC27, 13718, 116168, 53-2524; 2658, CDC27, 13719, 116169, 1-179; 2658, CDC27, 13720, 116170, 1-311; 2658, CDC27, 13721, 116171, 1-261; 2658, CDC27, 13722, 116172, 1-341; 2658, CDC27, 13723, 116173, 1-490; 2658, CDC27, 13724, 116174, 1-226; 2658, CDC27, 13725, 116175, 81-781; 2658, CDC27, 13726, 116176, 1-100; 2658, CDC27, 13727, 116177, 90-248; 2658, CDC27, 13714, 116164, 95-2569; 2658, CDC27, 13717, 116167, 5-2497; 2659, CDC34, 13729, 116179, 1-440; 2659, CDC34, 13730, 116180, 1-360; 2659, CDC34, 13731, 116181, 1-324; 2659, CDC34, 13728, 116178, 221-931; 2660, CDC37, 13733, 116183, 1-314; 2660, CDC37, 13734, 116184, 33-215; 2660, CDC37, 13735, 116185, 329-1389; 2660, CDC37, 13736, 116186, 1-554; 2660, CDC37, 13737, 116187, 39-728; 2660, CDC37, 13732, 116182, 55-1191; 2661, CDC37L1, 13739, 116189, 210-1136; 2661, CDC37L1, 13738, 116188, 203-1216; 2662, CDC40, 13741, 116191, 25-1644; 2662, CDC40, 13740, 116190, 25-1764; 2662, CDC40, 13742, 116192, 102-1841; 2663, CDC42, 13746, 116196, 188-597; 2663, CDC42, 13743, 116193, 105-680; 2663, CDC42, 13744, 116194, 252-827; 2663, CDC42, 13745, 116195, 293-868; 2664, CDC45, 13750, 116200, 1-290; 2664, CDC45, 13751, 116201, 76-552; 2664, CDC45, 13753, 116203, 232-568; 2664, CDC45, 13747, 116197, 144-1844; 2664, CDC45, 13748, 116198, 32-1594; 2664, CDC45, 13749, 116199, 257-1957; 2664, CDC45, 13752, 116202, 144-1940; 2665, CDC5L, 13754, 116204, 300-2708; 2666, CDC6, 13756, 116206, 240-541; 2666, CDC6, 13757, 116207, 150-696; 2666, CDC6, 13758, 116208, 230-584; 2666, CDC6, 13755, 116205, 472-2154; 2667, CDC7, 13761, 116211, 230-701; 2667, CDC7, 13759, 116209, 120-1844; 2667, CDC7, 13760, 116210, 260-1984; 2668, CDC73, 13762, 116212, 185-1780; 2669, CCAR1, 13764, 116214, 85-1791; 2669, CCAR1, 13765, 116215, 92-2407; 2669, CCAR1, 13766, 116216, 196-552; 2669, CCAR1, 13767, 116217, 1-869; 2669, CCAR1, 13768, 116218, 107-1813; 2669, CCAR1, 13769, 116219, 95-3224; 2669, CCAR1, 13770, 116220, 95-349; 2669, CCAR1, 13771, 116221, 509-2447; 2669, CCAR1, 13772, 116222, 1-146; 2669, CCAR1, 13773, 116223, 242-754; 2669, CCAR1, 13774, 116224, 286-570; 2669, CCAR1, 13776, 116226, 190-1896; 2669, CCAR1, 13763, 116213, 120-3572; 2669, CCAR1, 13775, 116225, 114-3521; 2670, CDCA2, 13778, 116228, 404-3430; 2670, CDCA2, 13777, 116227, 478-3549; 2671, CDCA3, 13779, 116229, 89-820; 2671,

CDCA3, 13780, 116230, 106-765; 2671, CDCA3, 13781, 116231, 86-634; 2671, CDCA3, 13782, 116232, 903-1709; 2671, CDCA3, 13783, 116233, 307-1113; 2672, CDCA4, 13784, 116234, 157-882; 2672, CDCA4, 13785, 116235, 69-794; 2673, CDCA5, 13787, 116237, 70-993; 2673, CDCA5, 13788, 116238, 1-212; 2673, CDCA5, 13789, 116239, 1-763; 2673, CDCA5, 13790, 116240, 1-672; 2673, CDCA5, 13791, 116241, 1-173; 2673, CDCA5, 13786, 116236, 174-932; 2674, CDCA7, 13796, 116246, 77-247; 2674, CDCA7, 13792, 116242, 145-1260; 2674, CDCA7, 13793, 116243, 104-1456; 2674, CDCA7, 13794, 116244, 93-1313; 2674, CDCA7, 13795, 116245, 93-1082; 2675, CDCA7L, 13800, 116250, 1-295; 2675, CDCA7L, 13801, 116251, 100-568; 2675, CDCA7L, 13802, 116252, 276-563; 2675, CDCA7L, 13803, 116253, 231-569; 2675, CDCA7L, 13797, 116247, 231-1493; 2675, CDCA7L, 13798, 116248, 81-1307; 2675, CDCA7L, 13799, 116249, 281-1645; 2676, CDCA8, 13804, 116254, 114-956; 2676, CDCA8, 13805, 116255, 274-1116; 2677, CGREF1, 13812, 116262, 264-437; 2677, CGREF1, 13806, 116256, 77-982; 2677, CGREF1, 13807, 116257, 493-1449; 2677, CGREF1, 13808, 116258, 282-680; 2677, CGREF1, 13809, 116259, 270-1226; 2677, CGREF1, 13810, 116260, 6-1328; 2677, CGREF1, 13811, 116261, 143-1099; 2678, CGRRF1, 13814, 116264, 55-668; 2678, CGRRF1, 13815, 116265, 49-183; 2678, CGRRF1, 13816, 116266, 149-424; 2678, CGRRF1, 13817, 116267, 1-222; 2678, CGRRF1, 13813, 116263, 133-1131; 2679, CEMIP, 13821, 116271, 1-229; 2679, CEMIP, 13822, 116272, 1-437; 2679, CEMIP, 13818, 116268, 289-4374; 2679, CEMIP, 13819, 116269, 360-4445; 2679, CEMIP, 13820, 116270, 420-4505; 2679, CEMIP, 13823, 116273, 237-3215; 2680, CWH43, 13825, 116275, 186-2204; 2680, CWH43, 13826, 116276, 118-834; 2680, CWH43, 13824, 116274, 184-2283; 2681, CREG1, 13827, 116277, 27-689; 2682, CREG2, 13828, 116278, 139-1011; 2683, CRABP1, 13830, 116280, 1-340; 2683, CRABP1, 13829, 116279, 106-519; 2684, CRABP2, 13831, 116281, 209-456; 2684, CRABP2, 13832, 116282, 97-513; 2684, CRABP2, 13833, 116283, 156-572; 2684, CRABP2, 13834, 116284, 209-625; 2685, CEMP1, 13835, 116285, 345-491; 2685, CEMP1, 13836, 116286, 336-1079; 2686, CENPBD1, 13837, 116287, 613-1176; 2687, CTGLF11P, 13838, 116288, 1-2058; 2688, CNTLN, 13839, 116289, 27-1202; 2688, CNTLN, 13840, 116290, 85-4305; 2689, CETN1, 13841, 116291, 53-571; 2690, CETN2, 13842, 116292, 68-586; 2691, CETN3, 13844, 116294, 97-672; 2691, CETN3, 13845, 116295, 1-246; 2691, CETN3, 13846, 116296, 106-441; 2691, CETN3, 13847, 116297, 72-533; 2691, CETN3, 13848, 116298, 97-567; 2691, CETN3, 13843, 116293, 126-629; 2692, CCP110, 13852, 116302, 549-698; 2692, CCP110, 13853, 116303, 144-302; 2692, CCP110, 13854, 116304, 1-360; 2692, CCP110, 13849, 116299, 248-3286; 2692, CCP110, 13850, 116300, 47-3022; 2692, CCP110, 13851, 116301, 437-3412; 2693, CCSAP, 13855, 116305, 79-891; 2693, CCSAP, 13856, 116306, 209-679; 2693, CCSAP, 13857, 116307, 53-865; 2694, CNTRL, 13859, 116309, 67-504; 2694, CNTRL, 13860, 116310, 158-3142; 2694, CNTRL, 13863, 116313, 237-1617; 2694, CNTRL, 13864, 116314, 795-1833; 2694, CNTRL, 13858, 116308, 32-7009; 2694, CNTRL, 13861, 116311, 79-5400; 2694, CNTRL, 13862, 116312, 261-7238; 2694, CNTRL, 13865, 116315, 549-1997; 2695, CNTROB, 13869, 116319, 1-561; 2695, CNTROB, 13870, 116320, 1-728; 2695, CNTROB, 13871, 116321, 320-917; 2695, CNTROB, 13872, 116322, 1-79; 2695, CNTROB, 13873, 116323, 191-784; 2695, CNTROB, 13874, 116324, 712-752; 2695, CNTROB, 13875, 116325, 465-695; 2695, CNTROB, 13866, 116316, 926-3703; 2695, CNTROB, 13867, 116317, 1-2715; 2695, CNTROB, 13868, 116318, 926-3637; 2696, CENPA, 13878, 116328, 96-356; 2696, CENPA, 13876, 116326, 130-474; 2696, CENPA, 13877, 116327, 201-623; 2697, CENPB, 13879, 116329, 208-2007; 2698, CENPC, 13881, 116331, 1-2187; 2698, CENPC, 13882, 116332, 1-324; 2698, CENPC, 13880, 116330, 252-3083; 2698, CENPC, 13883, 116333, 129-1757; 2699, CENPE, 13886, 116336, 90-3468; 2699, CENPE, 13887, 116337, 31-581; 2699, CENPE, 13888, 116338, 91-8085; 2699, CENPE, 13884, 116334, 91-8196; 2699, CENPE, 13885, 116335, 90-7832; 2700, CENPF, 13890, 116340, 1-528; 2700, CENPF, 13889, 116339, 169-9513; 2701, CENPH, 13892, 116342, 44-340; 2701, CENPH, 13893, 116343, 1-562; 2701, CENPH, 13894, 116344, 62-748; 2701, CENPH, 13891, 116341, 88-831; 2702, CENPI, 13897, 116347, 398-622; 2702, CENPI, 13899, 116349, 256-390; 2702, CENPI, 13895, 116345, 278-1846; 2702, CENPI, 13896, 116346, 278-2548; 2702, CENPI, 13898, 116348, 24-2294; 2703, CENPJ, 13901, 116351, 1-589; 2703, CENPJ, 13902, 116352, 117-3527; 2703, CENPJ, 13900, 116350, 187-4203; 2703, CENPJ, 13903, 116353, 196-3456; 2704, CENPK, 13906, 116356, 212-931; 2704, CENPK, 13907, 116357, 125-653; 2704, CENPK, 13909, 116359, 113-433; 2704, CENPK, 13910, 116360, 138-491; 2704, CENPK, 13911, 116361, 1-73; 2704, CENPK, 13912, 116362, 365-760; 2704, CENPK, 13913, 116363, 280-900; 2704, CENPK, 13914, 116364, 108-428; 2704, CENPK, 13904, 116354, 59-868; 2704, CENPK, 13905, 116355, 216-1025; 2704, CENPK, 13908, 116358, 179-988; 2705, CENPL, 13915, 116365, 215-1249; 2705, CENPL, 13916, 116366, 287-1459; 2705, CENPL, 13917, 116367, 139-1173; 2706, CENPM, 13919, 116369, 279-656; 2706, CENPM, 13920, 116370, 243-683; 2706, CENPM, 13922, 116372, 238-459; 2706, CENPM, 13918, 116368, 89-631; 2706, CENPM, 13921, 116371, 61-384; 2706, CENPM, 13923, 116373, 46-222; 2707, CENPN, 13929, 116379, 200-730; 2707, CENPN, 13930, 116380, 26-256; 2707, CENPN, 13931, 116381, 1-317; 2707, CENPN, 13924, 116374, 737-1351; 2707, CENPN, 13925, 116375, 791-1810; 2707, CENPN, 13926, 116376, 75-1136; 2707, CENPN, 13927, 116377, 45-962; 2707, CENPN, 13928, 116378, 82-1041; 2708, CENPO, 13932, 116382, 128-1030; 2708, CENPO, 13933, 116383, 426-1328; 2708, CENPO, 13934, 116384, 330-1214; 2709, CENPP, 13935, 116385, 765-1073; 2709, CENPP, 13938, 116388, 1-570; 2709, CENPP, 13936, 116386, 208-555; 2709, CENPP, 13937, 116387, 516-1382; 2710, CENPQ, 13939, 116389, 95-901; 2711, CENPT, 13941, 116391, 480-673; 2711, CENPT, 13942, 116392, 85-324; 2711, CENPT, 13943, 116393, 488-633; 2711, CENPT, 13944, 116394, 73-417; 2711, CENPT, 13945, 116395, 80-301; 2711, CENPT, 13946, 116396, 71-292; 2711, CENPT, 13947, 116397, 60-1580; 2711, CENPT, 13948, 116398, 85-390; 2711, CENPT, 13950, 116400, 27-858; 2711, CENPT, 13951, 116401, 556-575; 2711, CENPT, 13952, 116402, 2-493; 2711, CENPT, 13953, 116403, 38-259; 2711, CENPT, 13940, 116390, 409-2094; 2711, CENPT, 13949, 116399, 550-2235; 2712, CENPU, 13955, 116405, 158-688; 2712, CENPU, 13956, 116406, 69-1031; 2712, CENPU, 13954, 116404, 72-1328; 2713, CENPV, 13958, 116408, 21-548; 2713, CENPV, 13959, 116409, 1-45; 2713, CENPV, 13957, 116407, 64-882; 2714, CENPVP1, 13960, 116410, 1-819; 2715, CENPVP3, 13961, 116411, 1-864; 2716, CENPW, 13963, 116413, 101-304; 2716, CENPW, 13962, 116412, 101-412; 2716, CENPW, 13964, 116414, 101-367; 2717, CEP104, 13967, 116417, 321-918; 2717, CEP104, 13968, 116418, 1-572; 2717, CEP104, 13969, 116419, 1-430; 2717, CEP104, 13970, 116420, 1-558; 2717, CEP104, 13965, 116415, 341-1075; 2717, CEP104, 13966, 116416, 326-3103; 2718, CEP112, 13973, 116423, 48-2789; 2718, CEP112, 13975, 116425, 1-162; 2718, CEP112, 13976, 116426, 1-140; 2718, CEP112, 13977, 116427, 206-1902; 2718, CEP112, 13978, 116428, 515-556; 2718, CEP112, 13979, 116429, 1-318; 2718, CEP112, 13971, 116421, 245-880; 2718, CEP112, 13972, 116422, 220-3087; 2718, CEP112, 13974, 116424, 92-2959; 2719, CEP120, 13983, 116433, 114-2645; 2719, CEP120, 13985, 116435, 69-671; 2719, CEP120, 13986, 116436, 83-578; 2719, CEP120, 13987, 116437, 327-539; 2719, CEP120, 13980, 116430, 306-3266; 2719, CEP120, 13981, 116431, 114-2996; 2719, CEP120, 13982, 116432, 117-3077; 2719, CEP120, 13984, 116434, 347-1489; 2720, CEP126, 13989, 116439, 1-1298; 2720, CEP126, 13990, 116440, 1-244; 2720, CEP126, 13988, 116438, 271-3624; 2721, CEP128, 13993, 116443, 1-908; 2721, CEP128, 13994, 116444, 333-869; 2721, CEP128, 13996, 116446, 194-576; 2721, CEP128, 13997, 116447, 1-420; 2721, CEP128, 13998, 116448, 1-2039; 2721, CEP128, 13999, 116449, 450-545; 2721, CEP128, 14000, 116450, 1-481; 2721, CEP128, 14001, 116451, 469-528; 2721, CEP128, 13991, 116441, 279-1586; 2721, CEP128, 13992, 116442, 172-3456; 2721, CEP128, 13995, 116445, 377-3661; 2722, CEP131, 14005, 116455, 180-3323; 2722, CEP131, 14006, 116456, 1-1575; 2722, CEP131, 14007, 116457, 1-619; 2722, CEP131, 14008, 116458, 1-923; 2722, CEP131, 14002, 116452, 249-3500; 2722, CEP131, 14003, 116453, 195-3329; 2722, CEP131, 14004, 116454, 180-3422; 2723, CEP135, 14009, 116459, 125-3547; 2723, CEP135, 14010, 116460, 235-984; 2724, CEP152, 14014, 116464, 194-1947; 2724, CEP152, 14015, 116465, 1-195; 2724, CEP152, 14016, 116466, 384-588; 2724, CEP152, 14011, 116461, 78-3905; 2724, CEP152, 14012, 116462, 189-5321; 2724, CEP152, 14013, 116463, 35-4999; 2725, CEP162, 14019, 116469, 98-316; 2725, CEP162, 14017, 116467, 251-4234; 2725, CEP162, 14018, 116468, 116-4327; 2725, CEP162, 14020, 116470, 284-4267; 2726, CEP164, 14022, 116472, 128-492; 2726, CEP164, 14023, 116473, 413-778; 2726, CEP164, 14024, 116474, 112-585; 2726, CEP164, 14025, 116475, 222-585; 2726, CEP164, 14026, 116476, 270-616; 2726, CEP164, 14021, 116471, 148-4530; 2727, CEP170B, 14028, 116478, 229-5001; 2727, CEP170B, 14027, 116477, 229-4893; 2727, CEP170B, 14029, 116479, 340-4899; 2728, CEP170, 14030, 116480, 1-4676; 2728, CEP170, 14034, 116484, 1-789; 2728, CEP170, 14035, 116485, 513-1475; 2728, CEP170, 14036, 116486, 215-741; 2728, CEP170, 14037, 116487, 162-561; 2728, CEP170, 14038, 116488, 261-593; 2728, CEP170, 14039, 116489, 344-608; 2728, CEP170, 14040, 116490, 1-358; 2728, CEP170, 14041, 116491, 1-520; 2728, CEP170, 14042, 116492, 300-609; 2728, CEP170, 14043, 116493, 85-966; 2728, CEP170, 14031, 116481, 53-4807; 2728, CEP170, 14032, 116482, 324-4706; 2728, CEP170, 14033, 116483, 324-4784; 2728, CEP170, 14044, 116494, 324-4784; 2728, CEP170, 14045, 116495, 54-4808; 2728, CEP170, 14046, 116496, 54-4436; 2729, CEP192, 14047, 116497, 1296-7484; 2729, CEP192, 14048, 116498, 375-1655; 2729, CEP192, 14049, 116499, 1-5796; 2729, CEP192, 14050, 116500, 1-1223; 2729, CEP192, 14052, 116502, 81-3793; 2729, CEP192, 14053, 116503, 1-6230; 2729, CEP192, 14054, 116504, 1-2702; 2729, CEP192, 14055, 116505, 1-144; 2729, CEP192, 14056, 116506, 1-220; 2729, CEP192, 14057, 116507, 66-278; 2729, CEP192, 14051, 116501, 81-7694; 2730, CEP19, 14058, 116508, 296-682; 2730, CEP19, 14059, 116509, 424-927; 2731, CEP250, 14060, 116510, 326-1345; 2731, CEP250, 14062, 116512, 1-417; 2731, CEP250, 14063, 116513, 1-2634; 2731, CEP250, 14064, 116514, 377-868; 2731, CEP250, 14065, 116515, 1-629; 2731, CEP250, 14066, 116516, 104-2156; 2731, CEP250, 14067, 116517, 361-702; 2731, CEP250, 14068, 116518, 382-1998; 2731, CEP250, 14069, 116519, 1-105; 2731, CEP250, 14061, 116511, 721-8049; 2732, CEP290, 14070, 116520, 1-7446; 2732, CEP290, 14071, 116521, 1-2421; 2732, CEP290, 14073, 116523, 1-324; 2732, CEP290, 14074, 116524, 206-697; 2732, CEP290, 14076, 116526, 1-1842; 2732, CEP290, 14077, 116527, 1-2574; 2732, CEP290, 14072, 116522, 1181-5800; 2732, CEP290, 14075, 116525, 345-7784; 2733, CEP295, 14079, 116529, 1322-1735; 2733, CEP295, 14080, 116530, 1062-1298; 2733, CEP295, 14081, 116531, 557-2294; 2733, CEP295, 14082, 116532, 1-744; 2733, CEP295, 14078, 116528, 163-7968; 2733, CEP295, 14083, 116533, 458-2803; 2734, CEP350, 14084, 116534, 1-392; 2734, CEP350, 14086, 116536, 1-1746; 2734, CEP350, 14087, 116537, 1-992; 2734, CEP350, 14088, 116538, 1-333; 2734, CEP350, 14089, 116539, 1-3877; 2734, CEP350, 14090, 116540, 1-174; 2734, CEP350, 14091, 116541, 332-1059; 2734, CEP350, 14085, 116535, 419-9772; 2735, CEP41, 14094, 116544, 92-301; 2735, CEP41, 14095, 116545, 343-827; 2735, CEP41, 14097, 116547, 140-561; 2735, CEP41, 14098, 116548, 322-516; 2735, CEP41, 14099, 116549, 62-439; 2735, CEP41, 14100, 116550, 111-689; 2735, CEP41, 14101, 116551, 14-557; 2735, CEP41, 14092, 116542, 272-1393; 2735, CEP41, 14093, 116543, 30-935; 2735, CEP41, 14096, 116546, 91-255; 2735, CEP41, 14102, 116552, 245-1102; 2735, CEP41, 14103, 116553, 245-409; 2736, CEP44, 14108, 116558, 320-913; 2736, CEP44, 14110, 116560, 315-732; 2736, CEP44, 14111, 116561, 269-605; 2736, CEP44, 14112, 116562, 265-600; 2736, CEP44, 14104, 116554, 53-1225; 2736, CEP44, 14105, 116555, 305-1477; 2736, CEP44, 14106, 116556, 306-1505; 2736, CEP44, 14107, 116557, 53-1252; 2736, CEP44, 14109, 116559, 415-1587; 2737, CEP55, 14114, 116564, 1-626; 2737, CEP55, 14113, 116563, 305-1699; 2738, CEP57, 14117, 116567, 184-432; 2738, CEP57, 14118, 116568, 258-851; 2738, CEP57, 14119, 116569, 1-760; 2738, CEP57, 14120, 116570, 167-382; 2738, CEP57, 14121, 116571, 215-1636; 2738, CEP57, 14122, 116572, 169-294; 2738, CEP57, 14124, 116574, 202-360; 2738, CEP57, 14125, 116575, 1-404; 2738, CEP57, 14127, 116577, 254-870; 2738, CEP57, 14115, 116565, 239-1663; 2738, CEP57, 14116, 116566, 239-1741; 2738, CEP57, 14123, 116573, 1-1476; 2738, CEP57, 14126, 116576, 41-853; 2739, CEP57L1, 14130, 116580, 51-1484; 2739, CEP57L1, 14131, 116581, 422-1177; 2739, CEP57L1, 14132, 116582, 235-819; 2739, CEP57L1, 14134, 116584, 99-1322; 2739, CEP57L1, 14135, 116585, 431-769; 2739, CEP57L1, 14136, 116586, 312-701; 2739, CEP57L1, 14137, 116587, 1-519; 2739, CEP57L1, 14138, 116588, 490-575; 2739, CEP57L1, 14139, 116589, 348-965; 2739, CEP57L1, 14140, 116590, 363-861; 2739, CEP57L1, 14141, 116591, 36-1118; 2739, CEP57L1, 14142, 116592, 560-866; 2739, CEP57L1, 14143, 116593, 124-813; 2739, CEP57L1, 14144, 116594, 653-812; 2739, CEP57L1, 14145, 116595, 198-1589; 2739, CEP57L1, 14146, 116596, 526-1233; 2739, CEP57L1, 14147, 116597, 362-598; 2739, CEP57L1, 14148, 116598, 68-823; 2739, CEP57L1, 14149, 116599, 111-446; 2739, CEP57L1, 14128, 116578, 193-1575; 2739, CEP57L1, 14129, 116579, 60-1235; 2739, CEP57L1, 14133, 116583, 427-1809; 2740, CEP63, 14154, 116604, 1-464; 2740, CEP63, 14155, 116605, 378-566; 2740, CEP63, 14156, 116606, 142-629; 2740, CEP63, 14158, 116608, 1-735; 2740, CEP63, 14159, 116609, 1-585; 2740, CEP63, 14150, 116600, 336-1823; 2740, CEP63, 14151, 116601, 28-2139; 2740, CEP63, 14152, 116602, 288-1715; 2740, CEP63, 14153, 116603, 172-1797; 2740, CEP63, 14157, 116607, 428-2539; 2740, CEP63, 14160, 116610, 329-2440; 2740, CEP63, 14161, 116611, 174-1601; 2741, CEP68, 14164, 116614, 881-1765; 2741, CEP68, 14162, 116612, 111-1973; 2741, CEP68, 14163, 116613, 204-2477; 2742, CEP70, 14167, 116617, 243-1021; 2742, CEP70, 14168, 116618, 217-1554; 2742, CEP70, 14169, 116619, 136-1016; 2742, CEP70, 14170, 116620, 1-216; 2742, CEP70, 14171, 116621, 530-598; 2742, CEP70, 14174, 116624, 204-551; 2742, CEP70, 14165, 116615, 268-2061; 2742, CEP70, 14166, 116616, 160-1824; 2742, CEP70, 14172, 116622, 188-1981; 2742, CEP70, 14173, 116623, 161-799; 2742, CEP70, 14175, 116625, 287-2026; 2743, CEP72, 14177, 116627, 17-528; 2743, CEP72, 14176, 116626, 91-2034; 2744, CEP76, 14180, 116630, 92-316; 2744, CEP76, 14181, 116631, 1-534; 2744, CEP76, 14182, 116632, 120-344; 2744, CEP76, 14183, 116633, 209-547; 2744, CEP76, 14184, 116634, 1-576; 2744, CEP76, 14185, 116635, 1-305; 2744, CEP76, 14178, 116628, 227-2206; 2744, CEP76, 14179, 116629, 175-1929; 2745, CEP78, 14186, 116636, 120-2237; 2745, CEP78, 14187, 116637, 145-2313; 2745, CEP78, 14188, 116638, 1-2118; 2745, CEP78, 14189, 116639, 190-2310; 2745, CEP78, 14190, 116640, 290-2359; 2746, CEP83, 14191, 116641, 492-2597; 2746, CEP83, 14192, 116642, 493-1911; 2746, CEP83, 14193, 116643, 551-2656; 2746, CEP83, 14194, 116644, 1-498; 2746, CEP83, 14195, 116645, 638-644; 2746, CEP83, 14197, 116647, 551-1609; 2746, CEP83, 14196, 116646, 236-1942; 2747, CEP85, 14199, 116649, 1-1307; 2747, CEP85, 14198, 116648, 132-2420; 2747, CEP85, 14200, 116650, 181-2316; 2747, CEP85, 14201, 116651, 134-2419; 2748, CEP85L, 14206, 116656, 68-1797; 2748, CEP85L, 14202, 116652, 351-1535; 2748, CEP85L, 14203, 116653, 68-2494; 2748, CEP85L, 14204, 116654, 623-3040; 2748, CEP85L, 14205, 116655, 172-1671; 2748, CEP85L, 14207, 116657, 589-2079; 2749, CEP89, 14209, 116659, 82-1368; 2749, CEP89, 14210, 116660, 90-1160; 2749, CEP89, 14211, 116661, 1-522; 2749, CEP89, 14212, 116662, 1-652; 2749, CEP89, 14213, 116663, 118-360; 2749, CEP89, 14208, 116658, 90-2441; 2750, CEP95, 14215, 116665, 59-2329; 2750, CEP95, 14216, 116666, 14-313; 2750, CEP95, 14217, 116667, 1-404; 2750, CEP95, 14218, 116668, 88-558; 2750, CEP95, 14219, 116669, 1-309; 2750, CEP95, 14220, 116670, 1-223; 2750, CEP95, 14221, 116671, 234-707; 2750, CEP95, 14222, 116672, 1-214; 2750, CEP95, 14223, 116673, 406-575; 2750, CEP95, 14214, 116664, 511-2976; 2751, CEP97, 14225, 116675, 23-2443; 2751, CEP97, 14226, 116676, 1-528; 2751, CEP97, 14227, 116677, 20-406; 2751, CEP97, 14224, 116674, 753-3350; 2752, CSPP1, 14229, 116679, 80-1294; 2752, CSPP1, 14230, 116680, 82-282; 2752, CSPP1, 14231, 116681, 106-567; 2752, CSPP1, 14228, 116678, 32-3697; 2752, CSPP1, 14232, 116682, 1067-3697; 2753, CEP295NL, 14234, 116684, 615-711; 2753, CEP295NL, 14233, 116683, 167-2032; 2753, CEP295NL, 14235, 116685, 1-1866; 2754, CERK, 14237, 116687, 60-617; 2754, CERK, 14236, 116686, 114-1727; 2755, CERKL, 14238, 116688, 1-1677; 2755, CERKL, 14239, 116689, 1-654; 2755, CERKL, 14240, 116690, 1-1260; 2755, CERKL, 14241, 116691, 1-1392; 2755, CERKL, 14242, 116692, 102-1700; 2755, CERKL, 14243, 116693, 102-1646; 2755, CERKL, 14244, 116694, 1-522; 2755, CERKL, 14245, 116695, 19-540; 2756, CERS1, 14247, 116697, 213-932; 2756, CERS1, 14248, 116698, 1-649; 2756, CERS1, 14250, 116700, 1395-2513; 2756, CERS1, 14246, 116696, 64-1077; 2756, CERS1, 14249, 116699, 25-1077; 2757, CERS2, 14252, 116702, 250-997; 2757, CERS2, 14253, 116703, 89-1002; 2757, CERS2, 14255, 116705, 162-738; 2757, CERS2, 14256, 116706, 160-545; 2757, CERS2, 14257, 116707, 229-896; 2757, CERS2, 14258, 116708, 1-686; 2757, CERS2, 14259, 116709, 23-1156; 2757, CERS2, 14251, 116701, 427-1569; 2757, CERS2, 14254, 116704, 388-1530; 2758, CERS3, 14263, 116713, 387-432; 2758, CERS3, 14264, 116714, 433-920; 2758, CERS3, 14260, 116710, 425-1576; 2758, CERS3, 14261, 116711, 692-1843; 2758, CERS3, 14262, 116712, 503-1654; 2759, CERS4, 14266, 116716, 460-1491; 2759, CERS4, 14267, 116717, 360-768; 2759, CERS4, 14268, 116718, 474-568; 2759, CERS4, 14269, 116719, 374-713; 2759, CERS4, 14271, 116721, 255-531; 2759, CERS4, 14272, 116722, 283-1203; 2759, CERS4, 14273, 116723, 182-758; 2759, CERS4, 14265, 116715, 301-1485; 2759, CERS4, 14270, 116720, 141-1325; 2760, CERS5, 14275, 116725, 24-611; 2760, CERS5, 14277, 116727, 97-636; 2760, CERS5, 14278, 116728, 4-591; 2760, CERS5, 14279, 116729, 63-296; 2760, CERS5, 14280, 116730, 30-230; 2760, CERS5, 14281, 116731, 1-407; 2760, CERS5, 14282, 116732, 1-335; 2760, CERS5, 14283, 116733, 7-228; 2760, CERS5, 14284, 116734, 73-354; 2760, CERS5, 14285, 116735, 47-825; 2760, CERS5, 14286, 116736, 32-313; 2760, CERS5, 14287, 116737, 6-1061; 2760, CERS5, 14288, 116738, 1-235; 2760, CERS5, 14289, 116739, 73-306; 2760, CERS5, 14274, 116724, 126-1304; 2760, CERS5, 14276, 116726, 612-1616; 2761, CERS6, 14290, 116740, 588-1742; 2761, CERS6, 14291, 116741, 201-1379; 2762, CPTP, 14293, 116743, 431-783; 2762, CPTP, 14292, 116742, 412-1056; 2763, CER1, 14294, 116744, 46-849; 2764, CDR1, 14295, 116745, 506-1294; 2765, CDR2, 14297, 116747, 369-556; 2765, CDR2, 14298, 116748, 129-269; 2765, CDR2, 14299, 116749, 218-567; 2765, CDR2, 14300, 116750, 355-1056; 2765, CDR2, 14301, 116751, 1-242; 2765, CDR2, 14296, 116746, 309-1673; 2766, CDR2L, 14302, 116752, 413-1810; 2767, CBLN1, 14305, 116755, 18-440; 2767, CBLN1, 14303, 116753, 367-948; 2767, CBLN1, 14304, 116754, 45-626; 2768, CBLN2, 14307, 116757, 179-511; 2768, CBLN2, 14309, 116759, 61-387; 2768, CBLN2, 14306, 116756, 775-1449; 2768, CBLN2, 14308, 116758, 236-910; 2769, CBLN3, 14311, 116761, 70-534; 2769, CBLN3, 14310, 116760, 472-1089; 2770, CBLN4, 14312, 116762, 1302-1907; 2771, CRBN, 14314, 116764, 1-686; 2771, CRBN, 14315, 116765, 1-1184; 2771, CRBN, 14313, 116763, 24-1352; 2771, CRBN, 14316, 116766, 24-1349; 2772, CCM2, 14319, 116769, 761-2077; 2772, CCM2, 14320, 116770, 86-901; 2772, CCM2, 14321, 116771, 1-406; 2772, CCM2, 14322, 116772, 115-1158; 2772, CCM2, 14317, 116767, 150-1484; 2772, CCM2, 14318, 116768, 72-1469; 2772, CCM2, 14323, 116773, 147-1208; 2772, CCM2, 14324, 116774, 147-1307; 2773, CCM2L, 14326, 116776, 1-975; 2773, CCM2L, 14325, 116775, 6-1307; 2774, CDNF, 14327, 116777, 505-762; 2774, CDNF, 14328, 116778, 127-690; 2775, CERCAM, 14331, 116781, 360-551; 2775, CERCAM, 14332, 116782, 203-530; 2775, CERCAM, 14333, 116783, 940-1176; 2775, CERCAM, 14334, 116784, 234-887; 2775, CERCAM, 14335, 116785, 946-1413; 2775, CERCAM, 14336, 116786, 1-1554; 2775, CERCAM, 14329, 116779, 399-2186; 2775, CERCAM, 14330, 116780, 3145-4698; 2776, CLN3, 14338, 116788, 324-869; 2776, CLN3, 14340, 116790, 178-1332; 2776, CLN3, 14341, 116791, 486-1496; 2776, CLN3, 14343, 116793, 406-1422; 2776, CLN3, 14345, 116795, 1-406; 2776,

CLN3, 14347, 116797, 360-886; 2776, CLN3, 14348, 116798, 1-546; 2776, CLN3, 14349, 116799, 336-557; 2776, CLN3, 14350, 116800, 113-1138; 2776, CLN3, 14351, 116801, 239-637; 2776, CLN3, 14352, 116802, 184-735; 2776, CLN3, 14353, 116803, 74-619; 2776, CLN3, 14355, 116805, 121-650; 2776, CLN3, 14356, 116806, 100-348; 2776, CLN3, 14357, 116807, 1-318; 2776, CLN3, 14358, 116808, 248-609; 2776, CLN3, 14359, 116809, 69-569; 2776, CLN3, 14360, 116810, 324-572; 2776, CLN3, 14361, 116811, 324-1349; 2776, CLN3, 14337, 116787, 100-1344; 2776, CLN3, 14339, 116789, 225-1244; 2776, CLN3, 14342, 116792, 360-1676; 2776, CLN3, 14344, 116794, 821-2137; 2776, CLN3, 14346, 116796, 1-762; 2776, CLN3, 14354, 116804, 1-1266; 2777, CLN5, 14362, 116812, 1293-2516; 2777, CLN5, 14364, 116814, 1-559; 2777, CLN5, 14363, 116813, 16-1092; 2778, CLN6, 14367, 116817, 87-404; 2778, CLN6, 14368, 116818, 88-564; 2778, CLN6, 14369, 116819, 135-881; 2778, CLN6, 14370, 116820, 126-767; 2778, CLN6, 14365, 116815, 159-1094; 2778, CLN6, 14366, 116816, 239-1270; 2779, CLN8, 14373, 116823, 247-779; 2779, CLN8, 14374, 116824, 247-759; 2779, CLN8, 14375, 116825, 429-668; 2779, CLN8, 14376, 116826, 429-668; 2779, CLN8, 14371, 116821, 248-1108; 2779, CLN8, 14372, 116822, 248-1108; 2780, CP, 14378, 116828, 36-2876; 2780, CP, 14379, 116829, 1-678; 2780, CP, 14380, 116830, 1-2559; 2780, CP, 14381, 116831, 36-571; 2780, CP, 14377, 116827, 264-3461; 2781, FIGF, 14382, 116832, 431-1495; 2782, CGGBP1, 14386, 116836, 238-556; 2782, CGGBP1, 14383, 116833, 463-966; 2782, CGGBP1, 14384, 116834, 1334-1837; 2782, CGGBP1, 14385, 116835, 513-1016; 2782, CGGBP1, 14387, 116837, 585-1088; 2783, CRCP, 14389, 116839, 360-488; 2783, CRCP, 14388, 116838, 114-461; 2783, CRCP, 14390, 116840, 359-805; 2783, CROP, 14391, 116841, 123-338; 2783, CRCP, 14392, 116842, 4-429; 2784, N/A, 14393, 116843, 152-292; 2784, N/A, 14394, 116844, 132-272; 2785, N/A, 14395, 116845, 135-242; 2786, N/A, 14396, 116846, 1-353; 2786, N/A, 14397, 116847, 1-353; 2787, N/A, 14398, 116848, 1-356; 2787, N/A, 14399, 116849, 1-356; 2788, N/A, 14400, 116850, 1-353; 2788, N/A, 14401, 116851, 1-353; 2789, N/A, 14402, 116852, 1-353; 2789, N/A, 14403, 116853, 1-353; 2790, N/A, 14404, 116854, 50-402; 2790, N/A, 14405, 116855, 50-402; 2791, N/A, 14406, 116856, 62-192; 2792, N/A, 14407, 116857, 1-699; 2792, N/A, 14408, 116858, 1-462; 2792, N/A, 14409, 116859, 1-655; 2792, N/A, 14410, 116860, 412-1521; 2792, N/A, 14411, 116861, 308-1006; 2793, N/A, 14412, 116862, 1-354; 2793, N/A, 14413, 116863, 1-349; 2794, N/A, 14414, 116864, 1-353; 2795, N/A, 14415, 116865, 134-2485; 2796, N/A, 14416, 116866, 188-1117; 2796, N/A, 14417, 116867, 188-766; 2796, N/A, 14418, 116868, 187-1095; 2796, N/A, 14419, 116869, 150-383; 2796, N/A, 14420, 116870, 148-705; 2797, N/A, 14421, 116871, 1-468; 2798, N/A, 14422, 116872, 1-45; 2799, N/A, 14423, 116873, 1-839; 2800, N/A, 14424, 116874, 95-2854; 2800, N/A, 14425, 116875, 1-240; 2801, N/A, 14426, 116876, 1-612; 2802, CHAC1, 14429, 116879, 347-460; 2802, CHAC1, 14430, 116880, 92-760; 2802, CHAC1, 14427, 116877, 497-1156; 2802, CHAC1, 14428, 116878, 310-1104; 2802, CHAC1, 14431, 116881, 21-815; 2803, CHAC2, 14432, 116882, 96-650; 2804, CCT2, 14434, 116884, 63-1655; 2804, CCT2, 14436, 116886, 51-1301; 2804, CCT2, 14433, 116883, 189-1796; 2804, CCT2, 14435, 116885, 483-1949; 2805, CCT3, 14438, 116888, 80-202; 2805, CCT3, 14440, 116890, 64-228; 2805, CCT3, 14441, 116891, 28-593; 2805, CCT3, 14442, 116892, 14-842; 2805, CCT3, 14443, 116893, 31-513; 2805, CCT3, 14444, 116894, 322-1824; 2805, CCT3, 14445, 116895, 46-748; 2805, CCT3, 14446, 116896, 149-581; 2805, CCT3, 14447, 116897, 122-583; 2805, CCT3, 14437, 116887, 282-1919; 2805, CCT3, 14439, 116889, 62-1585; 2806, CCT4, 14448, 116898, 298-1917; 2806, CCT4, 14449, 116899, 165-1694; 2807, CCT5, 14451, 116901, 1-188; 2807, CCT5, 14453, 116903, 1-267; 2807, CCT5, 14454, 116904, 76-1638; 2807, CCT5, 14455, 116905, 23-157; 2807, CCT5, 14456, 116906, 126-1586; 2807, CCT5, 14457, 116907, 367-1878; 2807, CCT5, 14458, 116908, 1-135; 2807, CCT5, 14450, 116900, 421-2046; 2807, CCT5, 14452, 116902, 365-1711; 2808, CCT6A, 14459, 116909, 220-1815; 2808, CCT6A, 14460, 116910, 165-1625; 2809, CCT6B, 14464, 116914, 271-654; 2809, CCT6B, 14461, 116911, 117-1709; 2809, CCT6B, 14462, 116912, 10-1491; 2809, CCT6B, 14463, 116913, 66-1523; 2810, CCT7, 14467, 116917, 71-322; 2810, CCT7, 14468, 116918, 300-593; 2810, CCT7, 14471, 116921, 1-249; 2810, CCT7, 14465, 116915, 142-1773; 2810, CCT7, 14466, 116916, 72-1091; 2810, CCT7, 14469, 116919, 372-1871; 2810, CCT7, 14470, 116920, 144-1514; 2811, CCT8, 14473, 116923, 1-322; 2811, CCT8, 14474, 116924, 1-968; 2811, CCT8, 14472, 116922, 208-1854; 2811, CCT8, 14475, 116925, 347-1774; 2811, CCT8, 14476, 116926, 127-1716; 2812, CCT8L2, 14477, 116927, 261-1934; 2813, CLC, 14478, 116928, 77-505; 2814, CHMP1A, 14480, 116930, 294-692; 2814, CHMP1A, 14481, 116931, 134-679; 2814, CHMP1A, 14482, 116932, 63-626; 2814, CHMP1A, 14479, 116929, 258-848; 2815, CHMP1B, 14483, 116933, 117-716; 2816, CHMP2A, 14486, 116936, 343-509; 2816, CHMP2A, 14487, 116937, 209-687; 2816, CHMP2A, 14488, 116938, 1-683; 2816, CHMP2A, 14484, 116934, 162-830; 2816, CHMP2A, 14485, 116935, 427-1095; 2816, CHMP2A, 14489, 116939, 134-802; 2817, CHMP2B, 14491, 116941, 222-773; 2817, CHMP2B, 14493, 116943, 298-836; 2817, CHMP2B, 14490, 116940, 239-880; 2817, CHMP2B, 14492, 116942, 284-802; 2818, CHMP3, 14494, 116944, 130-798; 2818, CHMP3, 14495, 116945, 269-739; 2818, CHMP3, 14496, 116946, 27-575; 2819, CHMP4A, 14498, 116948, 94-733; 2819, CHMP4A, 14499, 116949, 263-763; 2819, CHMP4A, 14500, 116950, 1-185; 2819, CHMP4A, 14501, 116951, 361-714; 2819, CHMP4A, 14497, 116947, 302-1099; 2819, CHMP4A, 14502, 116952, 50-718; 2820, CHMP4B, 14503, 116953, 166-840; 2821, CHMP4C, 14504, 116954, 194-895; 2822, CHMP5, 14505, 116955, 138-797; 2822, CHMP5, 14506, 116956, 201-716; 2823, CHMP6, 14508, 116958, 272-611; 2823, CHMP6, 14509, 116959, 1-675; 2823, CHMP6, 14510, 116960, 1-522; 2823, CHMP6, 14507, 116957, 79-684; 2824, CHMP7, 14514, 116964, 60-533; 2824, CHMP7, 14515, 116965, 55-294; 2824, CHMP7, 14516, 116966, 38-666; 2824, CHMP7, 14511, 116961, 606-1967; 2824, CHMP7, 14512, 116962, 649-2010; 2824, CHMP7, 14513, 116963, 31-522; 2825, CHEK1, 14517, 116967, 21-1319; 2825, CHEK1, 14519, 116969, 36-1514; 2825, CHEK1, 14521, 116971, 49-661; 2825, CHEK1, 14522, 116972, 51-562; 2825, CHEK1, 14523, 116973, 203-583; 2825, CHEK1, 14525, 116975, 435-561; 2825, CHEK1, 14526, 116976, 97-450; 2825, CHEK1, 14527, 116977, 41-617; 2825, CHEK1, 14530, 116980, 131-462; 2825, CHEK1, 14531, 116981, 1-270; 2825, CHEK1, 14518, 116968, 898-2328; 2825, CHEK1, 14520, 116970, 60-1490; 2825, CHEK1, 14524, 116974, 212-1642; 2825, CHEK1, 14528, 116978, 256-1686; 2825, CHEK1, 14529, 116979, 115-1263; 2825, CHEK1, 14532, 116982, 898-2226; 2826, CHEK2, 14535, 116985, 73-696; 2826, CHEK2, 14537, 116987, 198-713; 2826, CHEK2, 14542, 116992, 1-138; 2826, CHEK2, 14543, 116993, 388-752; 2826, CHEK2, 14544, 116994, 1-434; 2826, CHEK2, 14545, 116995, 1-174; 2826, CHEK2, 14546, 116996, 7-900; 2826, CHEK2, 14547, 116997, 661-1284; 2826, CHEK2, 14548, 116998, 45-530; 2826, CHEK2, 14551, 117001, 22-906; 2826, CHEK2, 14553, 117003, 1-830; 2826, CHEK2, 14554, 117004, 13-425; 2826, CHEK2, 14533, 116983, 73-1617; 2826, CHEK2, 14534, 116984, 83-1714; 2826, CHEK2, 14536, 116986, 77-1837; 2826, CHEK2, 14538, 116988, 1-1545; 2826, CHEK2, 14539, 116989, 1-1359; 2826, CHEK2, 14540, 116990, 1-1632; 2826, CHEK2, 14541, 116991, 193-1824; 2826, CHEK2, 14549, 116999, 1-870; 2826, CHEK2, 14550, 117000, 1-498; 2826, CHEK2, 14552, 117002, 1-612; 2827, CHFR, 14556, 117006, 340-1389; 2827, CHFR, 14560, 117010, 205-875; 2827, CHFR, 14561, 117011, 838-913; 2827, CHFR, 14562, 117012, 328-542; 2827, CHFR, 14563, 117013, 349-758; 2827, CHFR, 14564, 117014, 491-584; 2827, CHFR, 14565, 117015, 1-183; 2827, CHFR, 14566, 117016, 1-226; 2827, CHFR, 14555, 117005, 65-1936; 2827, CHFR, 14557, 117007, 75-2069; 2827, CHFR, 14558, 117008, 90-2048; 2827, CHFR, 14559, 117009, 70-1788; 2828, CMKLR1, 14570, 117020, 126-555; 2828, CMKLR1, 14571, 117021, 192-632; 2828, CMKLR1, 14567, 117017, 365-1486; 2828, CMKLR1, 14568, 117018, 192-1313; 2828, CMKLR1, 14569, 117019, 504-1619; 2828, CMKLR1, 14572, 117022, 602-1723; 2829, XCL1, 14573, 117023, 166-510; 2830, XCL2, 14574, 117024, 34-378; 2831, XCR1, 14576, 117026, 225-332; 2831, XCR1, 14575, 117025, 358-1359; 2832, CCL1, 14577, 117027, 71-361; 2833, CCL11, 14578, 117028, 142-435; 2834, CCL13, 14580, 117030, 1-190; 2834, CCL13, 14579, 117029, 76-372; 2835, CCL14, 14583, 117033, 27-224; 2835, CCL14, 14584, 117034, 2408-2755; 2835, CCL14, 14586, 117036, 27-224; 2835, CCL14, 14588, 117038, 2408-2755; 2835, CCL14, 14581, 117031, 1-330; 2835, CCL14, 14582, 117032, 110-391; 2835, CCL14, 14585, 117035, 1-330; 2835, CCL14, 14587, 117037, 110-391; 2836, CCL15, 14591, 117041, 1-185; 2836, CCL15, 14592, 117042, 1-185; 2836, CCL15, 14589, 117039, 554-895; 2836, CCL15, 14590, 117040, 547-888; 2837, CCL16, 14594, 117044, 1-287; 2837, CCL16, 14595, 117045, 42-203; 2837, CCL16, 14597, 117047, 42-203; 2837, CCL16, 14598, 117048, 1-287; 2837, CCL16, 14593, 117043, 77-439; 2837, CCL16, 14596, 117046, 77-439; 2838, CCL17, 14599, 117049, 130-414; 2838, CCL17, 14600, 117050, 65-349; 2839, CCL18, 14601, 117051, 64-333; 2839, CCL18, 14602, 117052, 64-333; 2839, CCL18, 14603, 117053, 64-333; 2840, CCL19, 14605, 117055, 66-380; 2840, CCL19, 14604, 117054, 139-435; 2841, CCL2, 14607, 117057, 66-263; 2841, CCL2, 14606, 117056, 66-365; 2842, CCL20, 14608, 117058, 59-349; 2842, CCL20, 14609, 117059, 71-358; 2843, CCL21, 14611, 117061, 4-378; 2843, CCL21, 14610, 117060, 59-463; 2844, CCL22, 14612, 117062, 46-327; 2845, CCL23, 14613, 117063, 1-42; 2845, CCL23, 14618, 117068, 1-42; 2845, CCL23, 14614, 117064, 72-485; 2845, CCL23, 14615, 117065, 72-485; 2845, CCL23, 14616, 117066, 66-428; 2845, CCL23, 14617, 117067, 66-428; 2846, CCL24, 14619, 117069, 92-451; 2846, CCL24, 14620, 117070, 95-454; 2847, CCL25, 14622, 117072, 1-450; 2847, CCL25, 14624, 117074, 1-255; 2847, CCL25, 14621, 117071, 107-556; 2847, CCL25, 14623, 117073, 51-503; 2848, CCL26, 14625, 117075, 82-366; 2848, CCL26, 14626, 117076, 259-543; 2849, CCL27, 14627, 117077, 60-398; 2850, CCL28, 14629, 117079, 308-550; 2850, CCL28, 14628, 117078, 76-459; 2850, CCL28, 14630, 117080, 60-443; 2851, CCL3, 14632, 117082, 84-362; 2851, CCL3, 14631, 117081, 84-362; 2851, CCL3, 14633, 117083, 84-362; 2852, CCL3L1, 14634, 117084, 86-367; 2853, CCL3L3, 14635, 117085, 86-367; 2853, CCL3L3, 14636, 117086, 86-367; 2853, CCL3L3, 14637, 117087, 86-367; 2854, CCL4, 14638, 117088, 80-358; 2854, CCL4, 14639, 117089, 80-238; 2854, CCL4, 14641, 117091, 80-238; 2854, CCL4, 14643, 117093, 80-238; 2854, CCL4, 14640, 117090, 317-595; 2854, CCL4, 14642, 117092, 317-595; 2855, CCL4L2, 14644, 117094, 235-513; 2855, CCL4L2, 14658, 117108, 80-340; 2855, CCL4L2, 14659, 117109, 80-358; 2855, CCL4L2, 14662, 117112, 80-370; 2855, CCL4L2, 14664, 117114, 80-391; 2855, CCL4L2, 14665, 117115, 80-391; 2855, CCL4L2, 14667, 117117, 80-286; 2855, CCL4L2, 14669, 117119, 80-391; 2855, CCL4L2, 14670, 117120, 80-274; 2855, CCL4L2, 14673, 117123, 80-223; 2855, CCL4L2, 14678, 117128, 80-370; 2855, CCL4L2, 14679, 117129, 80-391; 2855, CCL4L2, 14682, 117132, 80-274; 2855, CCL4L2, 14645, 117095, 80-358; 2855, CCL4L2, 14646, 117096, 80-358; 2855, CCL4L2, 14647, 117097, 80-343; 2855, CCL4L2, 14648, 117098, 80-391; 2855, CCL4L2, 14649, 117099, 80-223; 2855, CCL4L2, 14650, 117100, 80-274; 2855, CCL4L2, 14651, 117101, 80-223; 2855, CCL4L2, 14652, 117102, 80-238; 2855, CCL4L2, 14653, 117103, 80-274; 2855, CCL4L2, 14654, 117104, 219-509; 2855, CCL4L2, 14655, 117105, 219-509; 2855, CCL4L2, 14656, 117106, 80-391; 2855, CCL4L2, 14657, 117107, 80-358; 2855, CCL4L2, 14660, 117110, 80-286; 2855, CCL4L2, 14661, 117111, 80-340; 2855, CCL4L2, 14663, 117113, 80-274; 2855, CCL4L2, 14666, 117116, 80-343; 2855, CCL4L2, 14668, 117118, 80-391; 2855, CCL4L2, 14671, 117121, 80-340; 2855, CCL4L2, 14672, 117122, 80-343; 2855, CCL4L2, 14674, 117124, 80-286; 2855, CCL4L2, 14675, 117125, 80-391; 2855, CCL4L2, 14676, 117126, 80-340; 2855, CCL4L2, 14677, 117127, 80-223; 2855, CCL4L2, 14680, 117130, 80-274; 2855, CCL4L2, 14681, 117131, 80-274; 2856, CCL5, 14683, 117133, 1-451; 2856, CCL5, 14687, 117137, 83-358; 2856, CCL5, 14688, 117138, 1-451; 2856, CCL5, 14684, 117134, 204-479; 2856, CCL5, 14685, 117135, 83-358; 2856, CCL5, 14686, 117136, 204-479; 2857, CCL7, 14690, 117140, 68-313; 2857, CCL7, 14691, 117141, 68-211; 2857, CCL7, 14689, 117139, 71-370; 2858, CCL8, 14692, 117142, 467-766; 2859, CCR1, 14693, 117143, 127-1194; 2860, CCR10, 14695, 117145, 745-994; 2860, CCR10, 14696, 117146, 1387-1809; 2860, CCR10, 14694, 117144, 21-1109; 2861, CCR2, 14699, 117149, 199-563; 2861, CCR2, 14697, 117147, 486-1610; 2861, CCR2, 14698, 117148, 40-1164; 2861, CCR2, 14700, 117150, 496-1578; 2862, CCR3, 14704, 117154, 160-400; 2862, CCR3, 14705, 117155, 150-212; 2862, CCR3, 14701, 117151, 544-1611; 2862, CCR3, 14702, 117152, 120-1187; 2862, CCR3, 14703, 117153, 32-1099; 2862, CCR3, 14706, 117156, 176-1306; 2863, CCR4, 14707, 117157, 169-1251; 2864, CCR5, 14708, 117158, 147-1205; 2864, CCR5, 14709, 117159, 234-1292; 2865, CCR6, 14710, 117160, 265-1389; 2865, CCR6, 14711, 117161, 553-1677; 2865, CCR6, 14712, 117162, 306-1430; 2866, CCR7, 14714, 117164, 344-1462; 2866, CCR7, 14715, 117165, 190-787; 2866, CCR7, 14713, 117163, 64-1200; 2867, CCR8, 14717, 117167, 72-428; 2867, CCR8, 14716, 117166, 139-1206; 2868, CCR9, 14721, 117171, 136-459; 2868, CCR9, 14718, 117168, 303-1376; 2868, CCR9, 14719, 117169, 181-1290; 2868, CCR9, 14720, 117170, 163-1236; 2869, CCRL2, 14726, 117176, 62-713; 2869, CCRL2, 14722, 117172, 114-1184; 2869, CCRL2, 14723, 117173, 353-1387; 2869, CCRL2, 14724, 117174, 72-1106; 2869, CCRL2, 14725, 117175, 200-1234; 2870, CX3CL1, 14728, 117178, 93-1304; 2870, CX3CL1, 14729, 117179, 45-212; 2870,

CX3CL1, 14730, 117180, 2707-3786; 2870, CX3CL1, 14727, 117177, 112-1305; 2871, CX3CR1, 14733, 117183, 201-699; 2871, CX3CR1, 14734, 117184, 241-559; 2871, CX3CR1, 14731, 117181, 41-1204; 2871, CX3CR1, 14732, 117182, 91-1158; 2871, CX3CR1, 14735, 117185, 241-1308; 2871, CX3CR1, 14736, 117186, 201-1268; 2872, CXCL1, 14737, 117187, 68-391; 2873, CXCL10, 14738, 117188, 67-363; 2874, CXCL11, 14739, 117189, 211-495; 2874, CXCL11, 14740, 117190, 380-664; 2875, CXCL12, 14741, 117191, 88-357; 2875, CXCL12, 14742, 117192, 39-398; 2875, CXCL12, 14743, 117193, 88-369; 2875, CXCL12, 14744, 117194, 88-399; 2875, CXCL12, 14745, 117195, 45-467; 2875, CXCL12, 14746, 117196, 93-404; 2876, CXCL13, 14747, 117197, 79-408; 2877, CXCL14, 14749, 117199, 287-586; 2877, CXCL14, 14748, 117198, 466-801; 2878, CXCL16, 14752, 117202, 309-589; 2878, CXCL16, 14750, 117200, 424-1245; 2878, CXCL16, 14751, 117201, 527-1348; 2879, CXCL17, 14753, 117203, 21-209; 2879, CXCL17, 14754, 117204, 217-576; 2880, CXCL2, 14755, 117205, 174-497; 2881, CXCL3, 14756, 117206, 79-402; 2882, CXCL5, 14757, 117207, 199-543; 2883, CXCL6, 14759, 117209, 112-453; 2883, CXCL6, 14758, 117208, 255-599; 2884, CXCL8, 14761, 117211, 119-406; 2884, CXCL8, 14760, 117210, 154-453; 2885, CXCL9, 14762, 117212, 40-417; 2886, CXCR1, 14763, 117213, 122-1174; 2887, CXCR2, 14765, 117215, 171-585; 2887, CXCR2, 14766, 117216, 105-621; 2887, CXCR2, 14767, 117217, 218-262; 2887, CXCR2, 14768, 117218, 212-813; 2887, CXCR2, 14769, 117219, 191-597; 2887, CXCR2, 14770, 117220, 179-223; 2887, CXCR2, 14764, 117214, 428-1510; 2888, CXCR3, 14771, 117221, 165-1412; 2888, CXCR3, 14772, 117222, 69-1175; 2889, CXCR4, 14773, 117223, 106-1164; 2889, CXCR4, 14774, 117224, 305-1375; 2890, CXCR5, 14775, 117225, 177-1295; 2891, CXCR6, 14776, 117226, 91-1119; 2891, CXCR6, 14777, 117227, 1464-2492; 2891, CXCR6, 14778, 117228, 387-1415; 2891, CXCR6, 14779, 117229, 156-1184; 2892, CKLF, 14785, 117235, 154-255; 2892, CKLF, 14780, 117230, 150-608; 2892, CKLF, 14781, 117231, 148-447; 2892, CKLF, 14782, 117232, 148-510; 2892, CKLF, 14783, 117233, 148-351; 2892, CKLF, 14784, 117234, 135-476; 2893, CBY1, 14788, 117238, 442-744; 2893, CBY1, 14789, 117239, 432-615; 2893, CBY1, 14790, 117240, 1-510; 2893, CBY1, 14786, 117236, 135-515; 2893, CBY1, 14787, 117237, 279-659; 2894, CBY3, 14791, 117241, 57-785; 2895, CHN1, 14793, 117243, 196-779; 2895, CHN1, 14794, 117244, 17-844; 2895, CHN1, 14797, 117247, 68-561; 2895, CHN1, 14798, 117248, 309-380; 2895, CHN1, 14799, 117249, 7-564; 2895, CHN1, 14800, 117250, 27-582; 2895, CHN1, 14801, 117251, 380-898; 2895, CHN1, 14802, 117252, 227-295; 2895, CHN1, 14792, 117242, 419-1423; 2895, CHN1, 14795, 117245, 333-1634; 2895, CHN1, 14796, 117246, 315-1694; 2896, CHN2, 14804, 117254, 1-783; 2896, CHN2, 14805, 117255, 18-539; 2896, CHN2, 14806, 117256, 1-594; 2896, CHN2, 14808, 117258, 1-542; 2896, CHN2, 14809, 117259, 1-275; 2896, CHN2, 14810, 117260, 438-812; 2896, CHN2, 14811, 117261, 1-687; 2896, CHN2, 14812, 117262, 16-578; 2896, CHN2, 14813, 117263, 1-651; 2896, CHN2, 14814, 117264, 1-570; 2896, CHN2, 14815, 117265, 1-410; 2896, CHN2, 14816, 117266, 1-549; 2896, CHN2, 14817, 117267, 878-989; 2896, CHN2, 14803, 117253, 531-1937; 2896, CHN2, 14807, 117257, 1-825; 2896, CHN2, 14818, 117268, 400-1398; 2897, CHIT1, 14821, 117271, 36-1121; 2897, CHIT1, 14819, 117269, 36-1379; 2897, CHIT1, 14820, 117270, 36-1436; 2897, CHIT1, 14822, 117272, 10-1173; 2898, CHI3L1, 14824, 117274, 1-457; 2898, CHI3L1, 14823, 117273, 127-1278; 2899, CHI3L2, 14827, 117277, 310-914; 2899, CHI3L2, 14828, 117278, 297-732; 2899, CHI3L2, 14830, 117280, 1-482; 2899, CHI3L2, 14831, 117281, 1-552; 2899, CHI3L2, 14832, 117282, 1-129; 2899, CHI3L2, 14833, 117283, 222-589; 2899, CHI3L2, 14834, 117284, 285-946; 2899, CHI3L2, 14835, 117285, 250-757; 2899, CHI3L2, 14836, 117286, 53-600; 2899, CHI3L2, 14825, 117275, 121-1263; 2899, CHI3L2, 14826, 117276, 72-1244; 2899, CHI3L2, 14829, 117279, 230-1165; 2899, CHI3L2, 14837, 117287, 772-1944; 2899, CHI3L2, 14838, 117288, 358-1293; 2900, CHID1, 14844, 117294, 1-325; 2900, CHID1, 14845, 117295, 1-254; 2900, CHI D1, 14846, 117296, 515-594; 2900, CHID1, 14847, 117297, 299-553; 2900, CHID1, 14848, 117298, 167-655; 2900, CHID1, 14849, 117299, 272-523; 2900, CHID1, 14850, 117300, 1-210; 2900, CHID1, 14851, 117301, 162-834; 2900, CHID1, 14852, 117302, 1-217; 2900, CHI D1, 14854, 117304, 323-438; 2900, CHID1, 14855, 117305, 222-578; 2900, CHI D1, 14856, 117306, 358-752; 2900, CHID1, 14857, 117307, 225-571; 2900, CHID1, 14839, 117289, 731-1912; 2900, CHID1, 14840, 117290, 205-1386; 2900, CHID1, 14841, 117291, 358-1539; 2900, CHID1, 14842, 117292, 1-1257; 2900, CHI D1, 14843, 117293, 105-1193; 2900, CHID1, 14853, 117303, 80-1336; 2901, CHIA, 14858, 117308, 146-451; 2901, CHIA, 14862, 117312, 1-1263; 2901, CHIA, 14865, 117315, 116-977; 2901, CHIA, 14859, 117309, 258-1205; 2901, CHIA, 14860, 117310, 95-1525; 2901, CHIA, 14861, 117311, 104-1534; 2901, CHIA, 14863, 117313, 210-1157; 2901, CHIA, 14864, 117314, 114-1220; 2901, CHIA, 14866, 117316, 150-1097; 2902, CTBS, 14867, 117317, 7-240; 2902, CTBS, 14869, 117319, 16-249; 2902, CTBS, 14868, 117318, 50-1207; 2903, CHKB-CPT1B, 14870, 117320, 1-183; 2904, CLCA1, 14871, 117321, 352-3096; 2904, CLCA1, 14872, 117322, 130-2874; 2905, CLCA2, 14873, 117323, 163-2994; 2906, CLCA4, 14874, 117324, 43-2802; 2907, CLCC1, 14881, 117331, 263-1051; 2907, CLCC1, 14875, 117325, 12-1304; 2907, CLCC1, 14876, 117326, 12-1112; 2907, CLCC1, 14877, 117327, 109-1764; 2907, CLCC1, 14878, 117328, 12-1112; 2907, CLCC1, 14879, 117329, 12-1304; 2907, CLCC1, 14880, 117330, 12-1517; 2908, CLNS1A, 14882, 117332, 38-649; 2908, CLNS1A, 14883, 117333, 69-218; 2908, CLNS1A, 14884, 117334, 59-598; 2908, CLNS1A, 14887, 117337, 81-584; 2908, CLNS1A, 14888, 117338, 1-70; 2908, CLNS1A, 14889, 117339, 1-68; 2908, CLNS1A, 14885, 117335, 92-805; 2908, CLNS1A, 14886, 117336, 63-776; 2909, CLCN1, 14891, 117341, 1-229; 2909, CLCN1, 14892, 117342, 1-307; 2909, CLCN1, 14890, 117340, 88-3054; 2910, CLCN2, 14896, 117346, 1-401; 2910, CLCN2, 14893, 117343, 173-2869; 2910, CLCN2, 14894, 117344, 124-2769; 2910, CLCN2, 14895, 117345, 125-2734; 2910, CLCN2, 14897, 117347, 125-2689; 2911, CLCN3, 14900, 117350, 1-735; 2911, CLCN3, 14901, 117351, 1-2406; 2911, CLCN3, 14903, 117353, 62-582; 2911, CLCN3, 14904, 117354, 309-2485; 2911, CLCN3, 14905, 117355, 148-563; 2911, CLCN3, 14906, 117356, 309-2684; 2911, CLCN3, 14898, 117348, 555-3155; 2911, CLCN3, 14899, 117349, 552-2927; 2911, CLCN3, 14902, 117352, 560-3016; 2912, CLCN4, 14907, 117357, 116-2305; 2912, CLCN4, 14909, 117359, 32-487; 2912, CLCN4, 14908, 117358, 392-2674; 2912, CLCN4, 14910, 117360, 458-2458; 2913, CLCN5, 14915, 117365, 208-402; 2913, CLCN5, 14911, 117361, 292-2532; 2913, CLCN5, 14912, 117362, 642-3092; 2913, CLCN5, 14913, 117363, 333-2783; 2913, CLCN5, 14914, 117364, 233-2473; 2914, CLCN6, 14919, 117369, 51-419; 2914, CLCN6, 14916, 117366, 53-2662; 2914, CLCN6, 14917, 117367, 168-2711; 2914, CLCN6, 14918, 117368, 4-2865; 2915, CLCN7, 14920, 117370, 84-2789; 2915, CLCN7, 14923, 117373, 178-533; 2915, CLCN7, 14924, 117374, 367-1014; 2915, CLCN7, 14921, 117371, 607-3024; 2915, CLCN7, 14922, 117372, 111-2456; 2916, CLCNKA, 14925, 117375, 20-2083; 2916, CLCNKA, 14926, 117376, 129-2189; 2916, CLCNKA, 14927, 117377, 58-1992; 2917, CLCNKB, 14930, 117380, 1-441; 2917, CLCNKB, 14931, 117381, 153-1544; 2917, CLCNKB, 14928, 117378, 184-1737; 2917, CLCNKB, 14929, 117379, 112-2175; 2918, CLIC1, 14932, 117382, 141-866; 2918, CLIC1, 14933, 117383, 574-1299; 2918, CLIC1, 14934, 117384, 268-993; 2918, CLIC1, 14935, 117385, 141-866; 2918, CLIC1, 14936, 117386, 574-1299; 2918, CLIC1, 14937, 117387, 211-936; 2918, CLIC1, 14938, 117388, 268-993; 2918, CLIC1, 14939, 117389, 211-936; 2918, CLIC1, 14940, 117390, 211-936; 2918, CLIC1, 14941, 117391, 268-993; 2918, CLIC1, 14942, 117392, 574-1299; 2918, CLIC1, 14943, 117393, 141-866; 2918, CLIC1, 14944, 117394, 268-993; 2918, CLIC1, 14945, 117395, 574-1299; 2918, CLIC1, 14946, 117396, 141-866; 2918, CLIC1, 14947, 117397, 141-866; 2918, CLIC1, 14948, 117398, 268-993; 2918, CLIC1, 14949, 117399, 141-866; 2918, CLIC1, 14950, 117400, 268-993; 2918, CLIC1, 14951, 117401, 268-993; 2918, CLIC1, 14952, 117402, 574-1299; 2918, CLIC1, 14953, 117403, 574-1299; 2918, CLIC1, 14954, 117404, 211-936; 2918, CLIC1, 14955, 117405, 141-866; 2918, CLIC1, 14956, 117406, 574-1299; 2918, CLIC1, 14957, 117407, 211-936; 2918, CLIC1, 14958, 117408, 211-936; 2918, CLIC1, 14959, 117409, 211-936; 2918, CLIC1, 14960, 117410, 114-839; 2918, CLIC1, 14961, 117411, 114-839; 2918, CLIC1, 14962, 117412, 114-839; 2918, CLIC1, 14963, 117413, 114-839; 2918, CLIC1, 14964, 117414, 114-839; 2918, CLIC1, 14965, 117415, 114-839; 2918, CLIC1, 14966, 117416, 114-839; 2919, CLIC2, 14967, 117417, 231-629; 2919, CLIC2, 14968, 117418, 220-963; 2920, CLIC3, 14969, 117419, 261-971; 2921, CLIC4, 14970, 117420, 198-959; 2921, CLIC4, 14971, 117421, 173-934; 2922, CLIC5, 14972, 117422, 154-1386; 2922, CLIC5, 14973, 117423, 308-1063; 2922, CLIC5, 14974, 117424, 348-965; 2923, CLIC6, 14975, 117425, 1-2061; 2923, CLIC6, 14976, 117426, 1-2115; 2924, CCK, 14977, 117427, 210-557; 2924, CCK, 14978, 117428, 907-1254; 2924, CCK, 14979, 117429, 128-475; 2925, CCKAR, 14980, 117430, 196-1482; 2926, CCKBR, 14982, 117432, 124-1215; 2926, CCKBR, 14984, 117434, 4-267; 2926, CCKBR, 14985, 117435, 55-465; 2926, CCKBR, 14981, 117431, 194-1537; 2926, CCKBR, 14983, 117433, 4-1554; 2927, CH25H, 14986, 117436, 23-841; 2928, CETP, 14989, 117439, 268-1554; 2928, CETP, 14987, 117437, 131-1612; 2928, CETP, 14988, 117438, 58-1359; 2929, CHDH, 14991, 117441, 167-631; 2929, CHDH, 14992, 117442, 188-565; 2929, CHDH, 14990, 117440, 439-2223; 2930, CHKA, 14995, 117445, 1-495; 2930, CHKA, 14996, 117446, 56-524; 2930, CHKA, 14993, 117443, 28-1401; 2930, CHKA, 14994, 117444, 268-1587; 2931, CHKB, 14997, 117447, 219-1406; 2932, CHAT, 15003, 117453, 154-492; 2932, CHAT, 14998, 117448, 154-2400; 2932, CHAT, 14999, 117449, 174-2066; 2932, CHAT, 15000, 117450, 336-2228; 2932, CHAT, 15001, 117451, 164-2056; 2932, CHAT, 15002, 117452, 470-2470; 2933, CHPT1, 15005, 117455, 171-1367; 2933, CHPT1, 15007, 117457, 1-284; 2933, CHPT1, 15008, 117458, 1-115; 2933, CHPT1, 15009, 117459, 191-1387; 2933, CHPT1, 15010, 117460, 1-554; 2933, CHPT1, 15004, 117454, 236-1456; 2933, CHPT1, 15006, 117456, 171-827; 2934, CEPT1, 15013, 117463, 39-881; 2934, CEPT1, 15011, 117461, 156-1406; 2934, CEPT1, 15012, 117462, 209-1459; 2935, CHRM1, 15016, 117466, 147-549; 2935, CHRM1, 15014, 117464, 543-1925; 2935, CHRM1, 15015, 117465, 761-2123; 2936, CHRM2, 15017, 117467, 294-1694; 2936, CHRM2, 15018, 117468, 413-1813; 2936, CHRM2, 15019, 117469, 529-1929; 2936, CHRM2, 15020, 117470, 238-1638; 2937, CHRM3, 15022, 117472, 259-587; 2937, CHRM3, 15021, 117471, 780-2552; 2937, CHRM3, 15023, 117473, 331-2103; 2938, CHRM4, 15024, 117474, 52-1491; 2939, CHRM5, 15026, 117476, 507-572; 2939, CHRM5, 15025, 117475, 671-2269; 2939, CHRM5, 15027, 117477, 315-1913; 2940, CHRNA7, 15028, 117478, 105-1613; 2941, CHRNA1, 15031, 117481, 19-1152; 2941, CHRNA1, 15032, 117482, 60-869; 2941, CHRNA1, 15033, 117483, 19-1146; 2941, CHRNA1, 15034, 117484, 19-264; 2941, CHRNA1, 15029, 117479, 68-1516; 2941, CHRNA1, 15030, 117480, 79-1452; 2942, CHRNA10, 15036, 117486, 56-346; 2942, CHRNA10, 15037, 117487, 598-969; 2942, CHRNA10, 15035, 117485, 73-1425; 2943, CHRNA2, 15041, 117491, 427-576; 2943, CHRNA2, 15042, 117492, 252-576; 2943, CHRNA2, 15043, 117493, 528-992; 2943, CHRNA2, 15044, 117494, 304-546; 2943, CHRNA2, 15045, 117495, 522-578; 2943, CHRNA2, 15038, 117488, 165-1709; 2943, CHRNA2, 15039, 117489, 610-2199; 2943, CHRNA2, 15040, 117490, 443-1966; 2944, CHRNA3, 15049, 117499, 483-535; 2944, CHRNA3, 15046, 117496, 502-1971; 2944, CHRNA3, 15047, 117497, 386-1903; 2944, CHRNA3, 15048, 117498, 70-1587; 2945, CHRNA4, 15051, 117501, 1-413; 2945, CHRNA4, 15053, 117503, 140-475; 2945, CHRNA4, 15050, 117500, 179-2062; 2945, CHRNA4, 15052, 117502, 545-2215; 2946, CHRNA5, 15055, 117505, 1-547; 2946, CHRNA5, 15056, 117506, 1-170; 2946, CHRNA5, 15057, 117507, 150-632; 2946, CHRNA5, 15054, 117504, 201-1607; 2947, CHRNA6, 15060, 117510, 219-551; 2947, CHRNA6, 15058, 117508, 357-1841; 2947, CHRNA6, 15059, 117509, 181-1620; 2948, CHRNA7, 15062, 117512, 40-348; 2948, CHRNA7, 15063, 117513, 105-1613; 2948, CHRNA7, 15061, 117511, 98-1606; 2948, CHRNA7, 15064, 117514, 108-1703; 2949, CHRNA9, 15065, 117515, 140-1579; 2950, CHRNB1, 15068, 117518, 103-1245; 2950, CHRNB1, 15069, 117519, 1-947; 2950, CHRNB1, 15070, 117520, 65-539; 2950, CHRNB1, 15071, 117521, 376-489; 2950, CHRNB1, 15066, 117516, 68-1573; 2950, CHRNB1, 15067, 117517, 131-1420; 2951, CHRNB2, 15072, 117522, 265-1773; 2952, CHRNB3, 15074, 117524, 527-554; 2952, CHRNB3, 15073, 117523, 129-1505; 2953, CHRNB4, 15077, 117527, 872-1072; 2953, CHRNB4, 15075, 117525, 113-1609; 2953, CHRNB4, 15076, 117526, 113-808; 2954, CHRND, 15079, 117529, 29-544; 2954, CHRND, 15080, 117530, 57-572; 2954, CHRND, 15081, 117531, 224-931; 2954, CHRND, 15082, 117532, 26-352; 2954, CHRND, 15078, 117528, 33-1586; 2954, CHRND, 15083, 117533, 57-1565; 2955, CHRNE, 15084, 117534, 12-1493; 2956, CHRNG, 15085, 117535, 1-1398; 2956, CHRNG, 15086, 117536, 22-1575; 2957, CHAD, 15089, 117539, 1-128; 2957, CHAD, 15087, 117537, 94-1173; 2957, CHAD, 15088, 117538, 154-1233; 2958, CHADL, 15091, 117541, 1-2054; 2958, CHADL, 15092, 117542, 1-758; 2958, CHADL, 15090, 117540, 54-2342; 2959, CHPF, 15094, 117544, 36-932; 2959, CHPF, 15093, 117543, 250-2577; 2959, CHPF, 15095, 117545, 358-2199; 2960, CHPF2, 15097, 117547, 277-2571; 2960, CHPF2, 15098, 117548, 277-548; 2960, CHPF2, 15099, 117549, 1-372; 2960, CHPF2, 15096, 117546, 1514-3832; 2961, CSGALNACT1, 15103, 117553, 512-554; 2961, CSGALNACT1, 15104, 117554, 481-792; 2961, CSGALNACT1, 15106, 117556, 486-646; 2961, CSGALNACT1, 15107, 117557, 477-766; 2961, CSGALNACT1, 15100, 117550, 655-2253; 2961, CSGALNACT1, 15101, 117551, 458-1351; 2961, CSGALNACT1, 15102, 117552, 1015-2613; 2961, CSGALNACT1, 15105, 117555, 1160-2053; 2961, CSGALNACT1, 15108, 117558, 392-1990; 2962, CSGALNACT2, 15109, 117559, 336-1964; 2963, CSPG4, 15110, 117560, 94-7062; 2964, CSPG5, 15114, 117564, 177-1610; 2964, CSPG5, 15111, 117561, 2100-3719; 2964, CSPG5, 15112, 117562, 2100-3800; 2964, CSPG5, 15113, 117563, 523-1728; 2965, CHSY1, 15115, 117565, 477-2885; 2966, CHSY3, 15116, 117566, 359-3007; 2967, CHODL, 15118, 117568, 52-762; 2967, CHODL, 15121, 117571, 106-816; 2967, CHODL, 15122, 117572, 206-916; 2967, CHODL, 15117, 117567, 392-1213; 2967, CHODL, 15119, 117569, 206-904; 2967, CHODL, 15120, 117570, 388-1086; 2967, CHODL, 15123, 117573, 74-838; 2968, CSAG1, 15124, 117574, 77-160; 2968, CSAG1, 15125, 117575, 329-565; 2968, CSAG1, 15127, 117577, 84-320; 2968, CSAG1, 15126, 117576, 281-502; 2969, CHRD, 15133, 117583, 113-2977; 2969, CHRD, 15128, 117578, 247-3114; 2969, CHRD, 15129, 117579, 1-2748; 2969, CHRD, 15130, 117580, 247-507; 2969, CHRD, 15131, 117581, 247-1299; 2969, CHRD, 15132, 117582, 247-531; 2970, CHRDL1, 15134, 117584, 103-1479; 2970, CHRDL1, 15135, 117585, 133-1485; 2970, CHRDL1, 15136, 117586, 57-1427; 2970, CHRDL1, 15137, 117587, 111-1484; 2970, CHRDL1, 15138, 117588, 111-1247; 2971, CHRDL2, 15140, 117590, 450-878; 2971, CHRDL2, 15142, 117592, 295-1219; 2971, CHRDL2, 15144, 117594, 1-275; 2971, CHRDL2, 15145, 117595, 1-533; 2971, CHRDL2, 15147, 117597, 846-1691; 2971, CHRDL2, 15139, 117589, 288-1643; 2971, CHRDL2, 15141, 117591, 498-1787; 2971, CHRDL2, 15143, 117593, 450-878; 2971, CHRDL2, 15146, 117596, 450-731; 2972, CGB, 15148, 117598, 363-860; 2973, CGB1, 15150, 117600, 398-786; 2973, CGB1, 15149, 117599, 106-573; 2974, CGB2, 15151, 117601, 119-610; 2974, CGB2, 15152, 117602, 387-775; 2975, CGB5, 15153, 117603, 327-824; 2976, CGB7, 15154, 117604, 405-902; 2976, CGB7, 15155, 117605, 1436-1933; 2976, CGB7, 15156, 117606, 2873-3370; 2977, CGB8, 15157, 117607, 368-865; 2978, CSH1, 15159, 117609, 72-842; 2978, CSH1, 15160, 117610, 151-519; 2978, CSH1, 15161, 117611, 166-552; 2978, CSH1, 15158, 117608, 143-796; 2979, CSH2, 15165, 117615, 153-635; 2979, CSH2, 15166, 117616, 169-555; 2979, CSH2, 15167, 117617, 63-731; 2979, CSH2, 15162, 117612, 116-484; 2979, CSH2, 15163, 117613, 153-656; 2979, CSH2, 15164, 117614, 153-806; 2980, CSHL1, 15168, 117618, 146-628; 2980, CSHL1, 15171, 117621, 63-716; 2980, CSHL1, 15173, 117623, 239-742; 2980, CSHL1, 15174, 117624, 94-630; 2980, CSHL1, 15175, 117625, 1-654; 2980, CSHL1, 15169, 117619, 1-669; 2980, CSHL1, 15170, 117620, 169-555; 2980, CSHL1, 15172, 117622, 41-460; 2981, CHM, 15176, 117626, 31-1992; 2981, CHM, 15177, 117627, 8-340; 2982, CHML, 15178, 117628, 165-2135; 2983, CHRFAM7A, 15180, 117630, 776-1741; 2983, CHRFAM7A, 15181, 117631, 713-1678; 2983, CHRFAM7A, 15182, 117632, 261-573; 2983, CHRFAM7A, 15183, 117633, 567-1805; 2983, CHRFAM7A, 15184, 117634, 713-1678; 2983, CHRFAM7A, 15185, 117635, 776-1741; 2983, CHRFAM7A, 15179, 117629, 455-1693; 2984, CHRAC1, 15187, 117637, 190-360; 2984, CHRAC1, 15188, 117638, 1-293; 2984, CHRAC1, 15189, 117639, 1-243; 2984, CHRAC1, 15186, 117636, 203-598; 2985, CHAF1A, 15191, 117641, 47-499; 2985, CHAF1A, 15192, 117642, 1-144; 2985, CHAF1A, 15193, 117643, 1-54; 2985, CHAF1A, 15194, 117644, 1-875; 2985, CHAF1A, 15190, 117640, 102-2972; 2986, CHAF1B, 15195, 117645, 152-1831; 2987, CDT1, 15197, 117647, 1-571; 2987, CDT1, 15196, 117646, 620-2260; 2988, CHTOP, 15198, 117648, 9-314; 2988, CHTOP, 15199, 117649, 222-893; 2988, CHTOP, 15203, 117653, 380-610; 2988, CHTOP, 15200, 117650, 380-1129; 2988, CHTOP, 15201, 117651, 313-1059; 2988, CHTOP, 15202, 117652, 282-890; 2989, CBX1, 15206, 117656, 73-578; 2989, CBX1, 15207, 117657, 215-544; 2989, CBX1, 15208, 117658, 292-812; 2989, CBX1, 15209, 117659, 58-474; 2989, CBX1, 15204, 117654, 292-849; 2989, CBX1, 15205, 117655, 482-1039; 2990, CBX2, 15210, 117660, 43-678; 2990, CBX2, 15211, 117661, 105-1703; 2991, CBX3, 15214, 117664, 91-396; 2991, CBX3, 15215, 117665, 882-1068; 2991, CBX3, 15216, 117666, 1-324; 2991, CBX3, 15212, 117662, 429-980; 2991, CBX3, 15213, 117663, 163-714; 2992, CBX4, 15218, 117668, 137-319; 2992, CBX4, 15219, 117669, 1-271; 2992, CBX4, 15217, 117667, 179-1861; 2993, CBX5, 15223, 117673, 402-675; 2993, CBX5, 15220, 117670, 138-713; 2993, CBX5, 15221, 117671, 127-702; 2993, CBX5, 15222, 117672, 319-894; 2994, CBX6, 15224, 117674, 27-1211; 2994, CBX6, 15225, 117675, 125-1363; 2995, CBX7, 15227, 117677, 1-477; 2995, CBX7, 15228, 117678, 109-472; 2995, CBX7, 15226, 117676, 207-962; 2996, CBX8, 15230, 117680, 52-777; 2996, CBX8, 15231, 117681, 140-665; 2996, CBX8, 15229, 117679, 119-1288; 2997, CHD1, 15233, 117683, 1-342; 2997, CHD1, 15234, 117684, 1-69; 2997, CHD1, 15235, 117685, 1-817; 2997, CHD1, 15232, 117682, 149-5281; 2997, CHD1, 15236, 117686, 568-5700; 2998, CHD1L, 15237, 117687, 377-2227; 2998, CHD1L, 15240, 117690, 257-2650; 2998, CHD1L, 15241, 117691, 21-1154; 2998, CHD1L, 15242, 117692, 21-269; 2998, CHD1L, 15243, 117693, 1-171; 2998, CHD1L, 15238, 117688, 21-2714; 2998, CHD1L, 15239, 117689, 21-2102; 2999, CHD2, 15246, 117696, 1-108; 2999, CHD2, 15247, 117697, 716-888; 2999, CHD2, 15248, 117698, 1-104; 2999, CHD2, 15249, 117699, 1-232; 2999, CHD2, 15250, 117700, 1-340; 2999, CHD2, 15251, 117701, 1-361; 2999, CHD2, 15252, 117702, 436-1980; 2999, CHD2, 15254, 117704, 576-713; 2999, CHD2, 15255, 117705, 1-214; 2999, CHD2, 15256, 117706, 573-668; 2999, CHD2, 15257, 117707, 573-1850; 2999, CHD2, 15244, 117694, 577-6063; 2999, CHD2, 15245, 117695, 562-2067; 2999, CHD2, 15253, 117703, 708-5927; 3000, CHD3, 15261, 117711, 1-1152; 3000, CHD3, 15262, 117712, 1-1573; 3000, CHD3, 15263, 117713, 1-834; 3000, CHD3, 15264, 117714, 1-330; 3000, CHD3, 15265, 117715, 1-749; 3000, CHD3, 15266, 117716, 1-192; 3000, CHD3, 15258, 117708, 151-6153; 3000, CHD3, 15259, 117709, 211-6111; 3000, CHD3, 15260, 117710, 2-6181; 3001, CHD4, 15268, 117718, 256-1317; 3001, CHD4, 15269, 117719, 148-5961; 3001, CHD4, 15270, 117720, 204-5921; 3001, CHD4, 15271, 117721, 177-553; 3001, CHD4, 15267, 117717, 165-5903; 3002, CHD5, 15273, 117723, 1-333; 3002, CHD5, 15274, 117724, 1-3678; 3002, CHD5, 15275, 117725, 1-271; 3002, CHD5, 15276, 117726, 1-3181; 3002, CHD5, 15277, 117727, 1-382; 3002, CHD5, 15272, 117722, 101-5965; 3003, CHD6, 15278, 117728, 111-1577; 3003, CHD6, 15281, 117731, 89-536; 3003, CHD6, 15282, 117732, 1-1577; 3003, CHD6, 15279, 117729, 40-1161; 3003, CHD6, 15280, 117730, 179-8326; 3004, CHD7, 15284, 117734, 1-58; 3004, CHD7, 15285, 117735, 1-120; 3004, CHD7, 15287, 117737, 403-500; 3004, CHD7, 15283, 117733, 480-9473; 3004, CHD7, 15286, 117736, 1-3417; 3004, CHD7, 15288, 117738, 69-2915; 3005, CHD8, 15291, 117741, 249-543; 3005, CHD8, 15292, 117742, 180-633; 3005, CHD8, 15293, 117743, 1-679; 3005, CHD8, 15294, 117744, 1-2617; 3005, CHD8, 15289, 117739, 66-7811; 3005, CHD8, 15290, 117740, 93-7001; 3005, CHD8, 15295, 117745, 265-8010; 3006, CHD9, 15299, 117749, 329-703; 3006, CHD9, 15300, 117750, 274-2169; 3006, CHD9, 15301, 117751, 330-3625; 3006, CHD9, 15303, 117753, 330-488; 3006, CHD9, 15304, 117754, 85-359; 3006, CHD9, 15305, 117755, 1-340; 3006, CHD9, 15306, 117756, 1-368; 3006, CHD9, 15307, 117757, 5106-7997; 3006, CHD9, 15308, 117758, 666-3557; 3006, CHD9, 15296, 117746, 88-8781; 3006, CHD9, 15297, 117747, 210-8903; 3006, CHD9, 15298, 117748, 303-8948; 3006, CHD9, 15302, 117752, 210-8855; 3007, CDYL, 15313, 117763, 178-690; 3007, CDYL, 15309, 117759, 132-1928; 3007, CDYL, 15310, 117760, 508-1746; 3007, CDYL, 15311, 117761, 350-1984; 3007, CDYL, 15312, 117762, 584-1822; 3008, CDYL2, 15314, 117764, 91-1614; 3008, CDYL2, 15315, 117765, 91-1614; 3008, CDYL2, 15316, 117766, 91-1614; 3008, CDYL2, 15317, 117767, 157-1677; 3009, CDY1, 15318, 117768, 282-1946; 3009, CDY1, 15319, 117769, 282-1904; 3010, CDY1B, 15320, 117770, 282-1946; 3010, CDY1B, 15321, 117771, 332-1954; 3011, CDY2A, 15323, 117773, 327-1994; 3011, CDY2A, 15322, 117772, 329-1954; 3012, CDY2B, 15325, 117775, 327-1994; 3012, CDY2B, 15324, 117774, 329-1954; 3013, CHGA, 15327, 117777, 185-1105; 3013, CHGA, 15328, 117778, 204-320; 3013, CHGA, 15330, 117780, 204-320; 3013, CHGA, 15331, 117781, 185-1105; 3013, CHGA, 15326, 117776, 281-1654; 3013, CHGA, 15329, 117779, 281-1654; 3014, CHGB, 15333, 117783, 261-1129; 3014, CHGB, 15332, 117782, 205-2238; 3015, C1orf100, 15334, 117784, 114-557; 3015, C1orf100, 15335, 117785, 114-461; 3016, C1orf101, 15339, 117789, 1-2616; 3016, C1orf101, 15336, 117786, 361-2763; 3016, C1orf101, 15337, 117787, 43-2541; 3016, C1orf101, 15338, 117788, 55-2910; 3017, C1orf105, 15340, 117790, 130-651; 3017, C1orf105, 15342, 117792, 1-378; 3017, C1orf105, 15343, 117793, 153-266; 3017, C1orf105, 15341, 117791, 199-750; 3018, C1orf106, 15346, 117796, 339-708; 3018, C1orf106, 15347, 117797, 450-570; 3018, C1orf106, 15344, 117794, 201-2192; 3018, C1orf106, 15345, 117795, 362-2098; 3019, C1orf109, 15349, 117799, 183-608; 3019, C1orf109, 15350, 117800, 512-852; 3019, C1orf109, 15351, 117801, 309-763; 3019, C1orf109, 15352, 117802, 39-612; 3019, C1orf109, 15353, 117803, 443-717; 3019, C1orf109, 15356, 117806, 447-559; 3019, C1orf109, 15348, 117798, 191-802; 3019, C1orf109, 15354, 117804, 296-907; 3019, C1orf109, 15355, 117805, 419-760; 3020, C1orf111, 15358, 117808, 19-141; 3020, C1orf111, 15359, 117809, 43-774; 3020, C1orf111, 15357, 117807, 81-866; 3021, C1orf112, 15360, 117810, 701-3262; 3021, C1orf112, 15361, 117811, 348-2909; 3021, C1orf112, 15362, 117812, 1019-2611; 3022, C1orf115, 15363, 117813, 559-987; 3023, C1orf116, 15364, 117814, 251-2056; 3023, C1orf116, 15365, 117815, 812-1879; 3024, C1orf122, 15366, 117816, 260-592; 3024, C1orf122, 15367, 117817, 1707-1850; 3024, C1orf122, 15368, 117818, 715-858; 3025, C1orf123, 15369, 117819, 43-525; 3026, C1orf127, 15370, 117820, 1-2472; 3026, C1orf127, 15371, 117821, 1-1976; 3026, C1orf127, 15372, 117822, 1-2327; 3026, C1orf127, 15373, 117823, 1-208; 3027, C1orf131, 15374, 117824, 30-779; 3027, C1orf131, 15377, 117827, 1-771; 3027, C1orf131, 15375, 117825, 27-908; 3027, C1orf131, 15376, 117826, 38-916; 3028, C1orf141, 15380, 117830, 112-973; 3028, C1orf141, 15381, 117831, 22-675; 3028, C1orf141, 15382, 117832, 152-508; 3028, C1orf141, 15383, 117833, 152-736; 3028, C1orf141, 15378, 117828, 22-1224; 3028, C1orf141, 15379, 117829, 111-1313; 3028, C1orf141, 15384, 117834, 22-264; 3029, C1orf145, 15387, 117837, 1-286; 3029, C1orf145, 15385, 117835, 1-342; 3029, C1orf145, 15386, 117836, 5-481; 3030, C1orf146, 15388, 117838, 465-830; 3030, C1orf146, 15389, 117839, 149-691; 3031, C1orf158, 15390, 117840, 7-477; 3031, C1orf158, 15391, 117841, 217-801; 3032, C1orf159, 15393, 117843, 632-1666; 3032, C1orf159, 15396, 117846, 172-842; 3032, C1orf159, 15397, 117847, 384-575; 3032, C1orf159, 15399, 117849, 384-554; 3032, C1orf159, 15400, 117850, 482-740; 3032, C1orf159, 15401, 117851, 166-462; 3032, C1orf159, 15402, 117852, 166-501; 3032, C1orf159, 15403, 117853, 527-836; 3032, C1orf159, 15404, 117854, 536-579; 3032, C1orf159, 15392, 117842, 308-904; 3032, C1orf159, 15394, 117844, 172-741; 3032, C1orf159, 15395, 117845, 212-1354; 3032, C1orf159, 15398, 117848, 175-771; 3033, C1orf162, 15405, 117855, 251-718; 3033, C1orf162, 15406, 117856, 174-566; 3034, C1orf167, 15407, 117857, 1-2485; 3034, C1orf167, 15408, 117858, 1-1849; 3034, C1orf167, 15409, 117859, 1-1598; 3034, C1orf167, 15410, 117860, 1-4407; 3035, C1orf168, 15411, 117861, 82-2268; 3036, C1orf174, 15412, 117862, 100-831; 3037, C1orf185, 15414, 117864, 257-673; 3037, C1orf185, 15415, 117865, 1-588; 3037, C1orf185, 15413, 117863, 1-600; 3038, C1orf186, 15418, 117868, 185-559; 3038, C1orf186, 15416, 117866, 640-1158; 3038, C1orf186, 15417, 117867, 131-649; 3038, C1orf186, 15419, 117869, 177-695; 3039, C1orf189, 15420, 117870, 27-332; 3040, C1orf194, 15421, 117871, 69-461; 3040, C1orf194, 15424, 117874, 168-278; 3040, C1orf194, 15425, 117875, 69-215; 3040, C1orf194, 15422, 117872, 77-586; 3040, C1orf194, 15423, 117873, 181-654; 3041, C1orf198, 15427, 117877, 602-934; 3041, C1orf198, 15429, 117879, 195-675; 3041, C1orf198, 15426, 117876, 142-1125; 3041, C1orf198, 15428, 117878, 217-1086; 3041, C1orf198, 15430, 117880, 217-810; 3042, C1orf204, 15431, 117881, 111-818; 3042, C1orf204, 15432, 117882, 1-708; 3043, C1orf21, 15433, 117883, 436-801; 3044, C1orf210, 15434, 117884, 164-505; 3044, C1orf210, 15435, 117885, 235-576; 3045, C1orf216, 15436, 117886, 772-1461; 3046, C1orf226, 15437, 117887, 190-702; 3046, C1orf226, 15438, 117888, 74-1021; 3046, C1orf226, 15439, 117889, 173-991; 3047, C1orf228, 15440, 117890, 572-917; 3047, C1orf228, 15441, 117891, 258-502; 3047, C1orf228, 15442, 117892, 435-1063; 3047, C1orf228, 15443, 117893, 1-490; 3047, C1orf228, 15444, 117894, 184-363; 3047, C1orf228, 15445, 117895, 175-836; 3047, C1orf228, 15446, 117896, 308-1630; 3047, C1orf228, 15447, 117897, 175-1497; 3048, C1orf233, 15448, 117898, 82-762; 3049, C1orf234, 15450, 117900, 48-413; 3049, C1orf234, 15451, 117901, 1-442; 3049, C1orf234, 15449, 117899, 78-443; 3050, C1orf27, 15452, 117902, 126-1490; 3050, C1orf27, 15453, 117903, 157-1452; 3050, C1orf27, 15454, 117904, 157-1425; 3051, C1orf35, 15455, 117905, 236-1027; 3052, C1orf43, 15458, 117908, 222-689; 3052, C1orf43, 15460, 117910, 179-886; 3052, C1orf43, 15456, 117906, 218-877; 3052, C1orf43, 15457, 117907, 213-818; 3052, C1orf43, 15459, 117909, 127-696; 3052, C1orf43, 15461, 117911, 200-961; 3053, C1orf50, 15463, 117913, 21-149; 3053, C1orf50, 15464, 117914, 7-336; 3053, C1orf50, 15462, 117912, 44-643; 3054, C1orf52, 15465, 117915, 1-504; 3054, C1orf52, 15466, 117916, 10-558; 3055, C1orf53, 15468, 117918, 1-247; 3055, C1orf53, 15467, 117917, 4-441; 3056, C1orf54, 15469, 117919, 39-404; 3056, C1orf54, 15470, 117920, 120-515; 3056, C1orf54, 15471, 117921, 771-1166; 3057, C1orf56, 15472, 117922, 109-1134; 3058, C1orf61, 15473, 117923, 1-423; 3058, C1orf61, 15474, 117924, 1-510; 3058, C1orf61, 15475, 117925, 1-566; 3058, C1orf61, 15477, 117927, 1-199; 3058, C1orf61, 15476, 117926, 118-588; 3058, C1orf61, 15478, 117928, 1-471; 3059, C1orf64, 15479, 117929, 69-578; 3060, C1orf68, 15480, 117930, 1-753; 3061, C1orf74, 15481, 117931, 258-1067; 3062, C1orf87, 15483, 117933, 75-1028; 3062, C1orf87, 15482, 117932, 109-1749; 3063, C1orf94, 15484, 117934, 540-1766; 3063, C1orf94, 15485, 117935, 121-1917; 3064, C1orf95, 15487, 117937, 106-531; 3064, C1orf95, 15486, 117936, 106-531; 3065, C10orf10, 15489, 117939, 362-613; 3065, C10orf10, 15488, 117938, 219-857; 3066, C10orf105, 15490, 117940, 103-504; 3066, C10orf105, 15491, 117941, 201-602; 3067, C10orf107, 15493, 117943, 45-253; 3067, C10orf107, 15492, 117942, 306-932; 3068, C10orf11, 15495, 117945, 877-1044; 3068, C10orf11, 15496, 117946, 273-953; 3068, C10orf11, 15497, 117947, 1-393; 3068, C10orf11, 15494, 117944, 216-812; 3069, C10orf113, 15498, 117948, 52-519; 3069, C10orf113, 15499, 117949, 52-291; 3070, C10orf12, 15500, 117950, 108-3851; 3071, C10orf120, 15502, 117952, 1-479; 3071, C10orf120, 15501, 117951, 33-1040; 3072, C10orf128, 15504, 117954, 83-505; 3072, C10orf128, 15506, 117956, 1-348; 3072, C10orf128, 15508, 117958, 109-540; 3072, C10orf128, 15503, 117953, 56-535; 3072, C10orf128, 15505, 117955, 41-430; 3072, C10orf128, 15507, 117957, 24-341; 3073, C10orf131, 15510, 117960, 263-446; 3073, C10orf131, 15511, 117961, 1-531; 3073, C10orf131, 15509, 117959, 197-727; 3074, C10orf142, 15513, 117963, 193-1005; 3074, C10orf142, 15512, 117962, 12-404; 3075, C10orf2, 15514, 117964, 186-2240; 3075, C10orf2, 15515, 117965, 186-1934; 3076, C10orf35, 15517, 117967, 94-403; 3076, C10orf35, 15516, 117966, 160-525; 3077, C10orf53, 15518, 117968, 13-294; 3077, C10orf53, 15519, 117969, 13-486; 3077, C10orf53, 15520, 117970, 48-329; 3077, C10orf53, 15521, 117971, 13-486; 3078, C10orf54, 15523, 117973, 1-421; 3078, C10orf54, 15522, 117972, 60-995; 3079, C10orf55, 15524, 117974, 198-653; 3080, C10orf62, 15525, 117975, 172-843; 3081, C10orf67, 15527, 117977, 1-888; 3081, C10orf67, 15526, 117976, 69-626; 3082, C10orf71, 15528, 117978, 289-4596; 3083, C10orf76, 15529, 117979, 121-717; 3083, C10orf76, 15531, 117981, 1-284; 3083, C10orf76, 15530, 117980, 121-2190; 3084, C10orf82, 15533, 117983, 41-745; 3084, C10orf82, 15532, 117982, 56-520; 3085, C10orf88, 15534, 117984, 226-1563; 3086, C10orf90, 15536, 117986, 853-2835; 3086, C10orf90, 15537, 117987, 122-2107; 3086, C10orf90, 15538, 117988, 1-728; 3086, C10orf90, 15539, 117989, 399-1025; 3086, C10orf90, 15540, 117990, 147-266; 3086, C10orf90, 15541, 117991, 389-700; 3086, C10orf90, 15535, 117985, 122-2221; 3087, C10orf99, 15542, 117992, 115-360; 3088, C11orf1, 15544, 117994, 676-1248; 3088, C11orf1, 15545, 117995, 84-509; 3088, C11orf1, 15546, 117996, 200-514; 3088, C11orf1, 15547, 117997, 20-385; 3088, C11orf1, 15543, 117993, 338-790; 3089, C11orf16, 15550, 118000, 69-455; 3089, C11orf16, 15548, 117998, 108-1511; 3089, C11orf16, 15549, 117999, 107-1321; 3090, C11orf21, 15552, 118002, 53-589; 3090, C11orf21, 15551, 118001, 253-651; 3091, C11orf24, 15554, 118004, 600-944; 3091, C11orf24, 15555, 118005, 458-533; 3091, C11orf24, 15553, 118003, 404-1753; 3092, C11orf30, 15557, 118007, 144-3818; 3092, C11orf30, 15559, 118009, 1-653; 3092, C11orf30, 15563, 118013, 1-324; 3092, C11orf30, 15564, 118014, 125-452; 3092, C11orf30, 15566, 118016, 1-478; 3092, C11orf30, 15567, 118017, 1-888; 3092, C11orf30, 15556, 118006, 144-4112; 3092, C11orf30, 15558, 118008, 40-4011; 3092, C11orf30, 15560, 118010, 1-3969; 3092, C11orf30, 15561, 118011, 40-4053; 3092, C11orf30, 15562, 118012, 40-3735; 3092, C11orf30, 15565, 118015, 147-395; 3092, C11orf30, 15568, 118018, 40-4011; 3093, C11orf31, 15571, 118021, 1-283; 3093, C11orf31, 15572, 118022, 347-712; 3093, C11orf31, 15569, 118019, 25-393; 3093, C11orf31, 15570, 118020, 244-612; 3094, C11orf40, 15573, 118023, 1-654; 3095, C11orf42, 15574, 118024, 51-1052; 3096, C11orf45, 15575, 118025, 195-632; 3096, C11orf45, 15576, 118026, 172-609; 3097, C11orf49, 15581, 118031, 77-226; 3097, C11orf49, 15582, 118032, 28-213; 3097, C11orf49, 15583, 118033, 1-205; 3097, C11orf49, 15584, 118034, 1-582; 3097, C11orf49, 15585, 118035, 28-282; 3097, C11orf49, 15586, 118036, 27-176; 3097, C11orf49, 15587, 118037, 27-176; 3097, C11orf49, 15588, 118038, 110-418; 3097, C11orf49, 15589, 118039, 29-178; 3097, C11orf49, 15577, 118027, 60-1055; 3097, C11orf49, 15578, 118028, 29-1042; 3097, C11orf49, 15579, 118029, 53-1033; 3097, C11orf49, 15580, 118030, 39-863; 3098, C11orf52, 15591, 118041, 420-551; 3098, C11orf52, 15590, 118040, 97-468; 3099, C11orf53, 15592, 118042, 148-858; 3100, C11orf54, 15596, 118046, 341-903; 3100, C11orf54, 15597, 118047, 266-552; 3100, C11orf54, 15598, 118048, 323-552; 3100, C11orf54, 15599, 118049, 62-779; 3100, C11orf54, 15600, 118050, 141-695; 3100, C11orf54, 15602, 118052, 274-574; 3100, C11orf54, 15603, 118053, 910-1356; 3100, C11orf54, 15604, 118054, 745-1258; 3100, C11orf54, 15606, 118056, 233-1003; 3100, C11orf54, 15593, 118043, 180-1127; 3100, C11orf54, 15594, 118044, 158-1105; 3100, C11orf54, 15595, 118045, 236-1033; 3100, C11orf54, 15601, 118051, 300-1247; 3100, C11orf54, 15605, 118055, 138-1028; 3101, C11orf57, 15611, 118061, 82-273; 3101, C11orf57, 15612, 118062, 178-517; 3101, C11orf57, 15613, 118063, 165-809; 3101, C11orf57, 15614, 118064, 82-355; 3101, C11orf57, 15607, 118057, 637-1515; 3101, C11orf57, 15608, 118058, 610-1491; 3101, C11orf57, 15609, 118059, 282-1160; 3101, C11orf57, 15610, 118060, 767-1561; 3102, C11orf58, 15616, 118066, 122-595; 3102, C11orf58, 15617, 118067, 136-405; 3102, C11orf58, 15618, 118068, 122-382; 3102, C11orf58, 15615, 118065, 379-930; 3103, C11orf63, 15619, 118069, 535-2871; 3103, C11orf63, 15620, 118070, 380-1303; 3103, C11orf63, 15621, 118071, 93-2429; 3104, C11orf65, 15624, 118074, 1-317; 3104, C11orf65, 15626, 118076, 11-582; 3104, C11orf65, 15622, 118072, 71-1012; 3104, C11orf65, 15623, 118073, 104-1045; 3104, C11orf65, 15625, 118075, 71-811; 3104, C11orf65, 15627, 118077, 11-952; 3104, C11orf65, 15628, 118078, 134-1075; 3105, C11orf68, 15629, 118079, 87-968; 3105, C11orf68, 15630, 118080, 32-910; 3105, C11orf68, 15631, 118081, 147-902; 3106, C11orf70, 15633, 118083, 1-287; 3106, C11orf70, 15634, 118084, 17-742; 3106, C11orf70, 15632, 118082, 29-832; 3106, C11orf70, 15635, 118085, 14-313; 3107, C11orf71, 15636, 118086, 220-663; 3107, C11orf71, 15637, 118087, 1-372; 3108, C11orf73, 15639, 118089, 239-823; 3108, C11orf73, 15640, 118090, 199-477; 3108, C11orf73, 15641, 118091, 80-475; 3108, C11orf73, 15638, 118088, 227-820; 3109, C11orf74, 15646, 118096, 383-631; 3109, C11orf74, 15648, 118098, 153-694; 3109, C11orf74, 15649, 118099, 165-494; 3109, C11orf74, 15650, 118100, 95-366; 3109, C11orf74, 15642, 118092, 104-547; 3109, C11orf74, 15643, 118093, 116-781; 3109, C11orf74, 15644, 118094, 293-958; 3109, C11orf74, 15645, 118095, 177-842; 3109, C11orf74, 15647, 118097, 270-713; 3109, C11orf74, 15651, 118101, 168-833; 3110, C11orf80, 15652, 118102, 1-1719; 3110, C11orf80, 15653, 118103, 228-1610; 3110, C11orf80, 15655, 118105, 1-326; 3110, C11orf80, 15656, 118106, 1-632; 3110, C11orf80, 15657, 118107, 1-450; 3110, C11orf80, 15658, 118108, 274-1731; 3110, C11orf80, 15659, 118109, 513-1892; 3110, C11orf80, 15660, 118110, 161-548; 3110, C11orf80, 15661, 118111, 13-156; 3110, C11orf80, 15662, 118112, 130-332; 3110, C11orf80, 15663, 118113, 538-583; 3110, C11orf80, 15664, 118114, 163-

1698; 3110, C11orf80, 15654, 118104, 8-2041; 3111, C11orf84, 15666, 118116, 1-88; 3111, C11orf84, 15667, 118117, 1-339; 3111, C11orf84, 15665, 118115, 300-1445; 3112, C11orf85, 15670, 118120, 274-618; 3112, C11orf85, 15671, 118121, 212-742; 3112, C11orf85, 15672, 118122, 1-178; 3112, C11orf85, 15668, 118118, 75-725; 3112, C11orf85, 15669, 118119, 67-717; 3113, C11orf86, 15673, 118123, 87-434; 3114, C11orf87, 15674, 118124, 404-997; 3115, C11orf88, 15677, 118127, 1-537; 3115, C11orf88, 15678, 118128, 1-90; 3115, C11orf88, 15675, 118125, 1-591; 3115, C11orf88, 15676, 118126, 1-510; 3116, C11orf91, 15680, 118130, 1-212; 3116, C11orf91, 15679, 118129, 62-643; 3117, C11orf94, 15681, 118131, 38-334; 3118, C11orf95, 15682, 118132, 1-827; 3118, C11orf95, 15684, 118134, 20-163; 3118, C11orf95, 15685, 118135, 1-608; 3118, C11orf95, 15683, 118133, 154-2190; 3119, C11orf96, 15687, 118137, 52-1305; 3119, C11orf96, 15688, 118138, 316-684; 3119, C11orf96, 15686, 118136, 1-1308; 3120, C11orf98, 15690, 118140, 49-420; 3120, C11orf98, 15689, 118139, 23-391; 3121, C12orf10, 15692, 118142, 171-812; 3121, C12orf10, 15693, 118143, 61-966; 3121, C12orf10, 15694, 118144, 1-392; 3121, C12orf10, 15691, 118141, 53-1183; 3122, C12orf29, 15699, 118149, 112-264; 3122, C12orf29, 15695, 118145, 204-1181; 3122, C12orf29, 15696, 118146, 88-204; 3122, C12orf29, 15697, 118147, 114-230; 3122, C12orf29, 15698, 118148, 145-261; 3123, C12orf4, 15701, 118151, 195-428; 3123, C12orf4, 15703, 118153, 438-1049; 3123, C12orf4, 15704, 118154, 130-561; 3123, C12orf4, 15705, 118155, 1-144; 3123, C12orf4, 15700, 118150, 89-1747; 3123, C12orf4, 15702, 118152, 118-1776; 3124, C12orf40, 15706, 118156, 155-2113; 3124, C12orf40, 15707, 118157, 171-1604; 3124, C12orf40, 15708, 118158, 212-1396; 3125, C12orf42, 15711, 118161, 209-831; 3125, C12orf42, 15713, 118163, 498-1379; 3125, C12orf42, 15714, 118164, 227-499; 3125, C12orf42, 15709, 118159, 266-1348; 3125, C12orf42, 15710, 118160, 89-412; 3125, C12orf42, 15712, 118162, 89-1171; 3126, C12orf43, 15716, 118166, 1-666; 3126, C12orf43, 15717, 118167, 14-772; 3126, C12orf43, 15718, 118168, 81-645; 3126, C12orf43, 15719, 118169, 1-585; 3126, C12orf43, 15720, 118170, 29-910; 3126, C12orf43, 15721, 118171, 14-214; 3126, C12orf43, 15715, 118165, 14-802; 3127, C12orf45, 15722, 118172, 15-218; 3127, C12orf45, 15724, 118174, 17-580; 3127, C12orf45, 15723, 118173, 44-601; 3128, C12orf49, 15726, 118176, 171-314; 3128, C12orf49, 15727, 118177, 1-131; 3128, C12orf49, 15728, 118178, 309-449; 3128, C12orf49, 15725, 118175, 162-779; 3129, C12orf50, 15730, 118180, 189-1316; 3129, C12orf50, 15731, 118181, 309-597; 3129, C12orf50, 15729, 118179, 182-1426; 3130, C12orf54, 15733, 118183, 37-342; 3130, C12orf54, 15735, 118185, 1-216; 3130, C12orf54, 15732, 118182, 132-515; 3130, C12orf54, 15734, 118184, 58-441; 3131, C12orf56, 15737, 118187, 1-553; 3131, C12orf56, 15736, 118186, 127-1515; 3131, C12orf56, 15738, 118188, 628-2496; 3132, C12orf57, 15741, 118191, 289-582; 3132, C12orf57, 15742, 118192, 306-617; 3132, C12orf57, 15743, 118193, 202-477; 3132, C12orf57, 15739, 118189, 100-480; 3132, C12orf57, 15740, 118190, 177-556; 3133, C12orf60, 15744, 118194, 205-942; 3134, C12orf65, 15748, 118198, 284-573; 3134, C12orf65, 15749, 118199, 496-604; 3134, C12orf65, 15750, 118200, 3319-3733; 3134, C12orf65, 15745, 118195, 645-1145; 3134, C12orf65, 15746, 118196, 473-973; 3134, C12orf65, 15747, 118197, 286-786; 3135, C12orf66, 15751, 118201, 29-1435; 3135, C12orf66, 15753, 118203, 60-1238; 3135, C12orf66, 15752, 118202, 55-1392; 3136, C12orf71, 15754, 118204, 32-841; 3137, C12orf73, 15757, 118207, 158-319; 3137, C12orf73, 15758, 118208, 124-303; 3137, C12orf73, 15759, 118209, 156-296; 3137, C12orf73, 15761, 118211, 410-589; 3137, C12orf73, 15763, 118213, 77-238; 3137, C12orf73, 15764, 118214, 1-114; 3137, C12orf73, 15755, 118205, 207-422; 3137, C12orf73, 15756, 118206, 204-419; 3137, C12orf73, 15760, 118210, 453-668; 3137, C12orf73, 15762, 118212, 145-360; 3138, C12orf74, 15765, 118215, 452-1024; 3138, C12orf74, 15766, 118216, 267-788; 3139, C12orf75, 15767, 118217, 219-359; 3139, C12orf75, 15769, 118219, 183-329; 3139, C12orf75, 15770, 118220, 25-291; 3139, C12orf75, 15771, 118221, 257-412; 3139, C12orf75, 15768, 118218, 257-448; 3140, C12orf76, 15773, 118223, 71-301; 3140, C12orf76, 15774, 118224, 61-210; 3140, C12orf76, 15775, 118225, 28-213; 3140, C12orf76, 15776, 118226, 58-288; 3140, C12orf76, 15777, 118227, 259-582; 3140, C12orf76, 15778, 118228, 605-823; 3140, C12orf76, 15779, 118229, 1-408; 3140, C12orf76, 15772, 118222, 366-773; 3141, C14orf1, 15780, 118230, 447-869; 3142, C14orf105, 15782, 118232, 43-1053; 3142, C14orf105, 15783, 118233, 132-446; 3142, C14orf105, 15784, 118234, 43-267; 3142, C14orf105, 15785, 118235, 43-930; 3142, C14orf105, 15786, 118236, 1-410; 3142, C14orf105, 15787, 118237, 132-446; 3142, C14orf105, 15788, 118238, 144-368; 3142, C14orf105, 15789, 118239, 153-467; 3142, C14orf105, 15781, 118231, 138-1028; 3143, C14orf119, 15790, 118240, 857-1279; 3143, C14orf119, 15791, 118241, 113-535; 3144, C14orf142, 15793, 118243, 1-238; 3144, C14orf142, 15795, 118245, 1-238; 3144, C14orf142, 15792, 118242, 58-360; 3144, C14orf142, 15794, 118244, 58-360; 3145, C14orf159, 15801, 118251, 302-558; 3145, C14orf159, 15802, 118252, 400-650; 3145, C14orf159, 15804, 118254, 457-1060; 3145, C14orf159, 15805, 118255, 1-1694; 3145, C14orf159, 15806, 118256, 1-827; 3145, C14orf159, 15807, 118257, 303-1597; 3145, C14orf159, 15808, 118258, 1-1520; 3145, C14orf159, 15810, 118260, 548-622; 3145, C14orf159, 15811, 118261, 246-359; 3145, C14orf159, 15812, 118262, 394-550; 3145, C14orf159, 15814, 118264, 158-484; 3145, C14orf159, 15815, 118265, 168-544; 3145, C14orf159, 15817, 118267, 407-862; 3145, C14orf159, 15819, 118269, 390-583; 3145, C14orf159, 15820, 118270, 55-315; 3145, C14orf159, 15821, 118271, 215-529; 3145, C14orf159, 15822, 118272, 454-909; 3145, C14orf159, 15824, 118274, 394-678; 3145, C14orf159, 15825, 118275, 247-853; 3145, C14orf159, 15796, 118246, 303-2168; 3145, C14orf159, 15797, 118247, 163-642; 3145, C14orf159, 15798, 118248, 163-2028; 3145, C14orf159, 15799, 118249, 169-2019; 3145, C14orf159, 15800, 118250, 484-2334; 3145, C14orf159, 15803, 118253, 691-2556; 3145, C14orf159, 15809, 118259, 392-2242; 3145, C14orf159, 15813, 118263, 450-929; 3145, C14orf159, 15816, 118266, 474-2168; 3145, C14orf159, 15818, 118268, 604-2454; 3145, C14orf159, 15823, 118273, 452-2197; 3145, C14orf159, 15826, 118276, 163-1908; 3146, C14orf166, 15828, 118278, 1-390; 3146, C14orf166, 15829, 118279, 26-607; 3146, C14orf166, 15830, 118280, 127-333; 3146, C14orf166, 15827, 118277, 166-900; 3147, C14orf169, 15831, 118281, 55-1980; 3148, C14orf177, 15833, 118283, 243-467; 3148, C14orf177, 15832, 118282, 420-797; 3149, C14orf178, 15835, 118285, 290-568; 3149, C14orf178, 15834, 118284, 210-578; 3149, C14orf178, 15836, 118286, 70-144; 3149, C14orf178, 15837, 118287, 70-183; 3150, C14orf180, 15838, 118288, 257-790; 3150, C14orf180, 15842, 118292, 257-790; 3150, C14orf180, 15839, 118289, 502-984; 3150, C14orf180, 15840, 118290, 337-819; 3150, C14orf180, 15841, 118291, 502-984; 3150, C14orf180, 15843, 118293, 337-819; 3151, C14orf2, 15847, 118297, 52-351; 3151, C14orf2, 15849, 118299, 52-351; 3151, C14orf2, 15850, 118300, 61-294;

3151, C14orf2, 15844, 118294, 89-265; 3151, C14orf2, 15845, 118295, 251-478; 3151, C14orf2, 15846, 118296, 146-322; 3151, C14orf2, 15848, 118298, 155-331; 3152, C14orf28, 15852, 118302, 236-1078; 3152, C14orf28, 15851, 118301, 276-1208; 3153, C14orf37, 15854, 118304, 1-293; 3153, C14orf37, 15853, 118303, 196-2520; 3154, C14orf39, 15856, 118306, 84-197; 3154, C14orf39, 15857, 118307, 293-558; 3154, C14orf39, 15858, 118308, 139-482; 3154, C14orf39, 15859, 118309, 1-218; 3154, C14orf39, 15855, 118305, 161-1924; 3155, C14orf79, 15860, 118310, 154-747; 3155, C14orf79, 15861, 118311, 1-659; 3155, C14orf79, 15862, 118312, 97-654; 3155, C14orf79, 15863, 118313, 902-1153; 3155, C14orf79, 15865, 118315, 1809-2060; 3155, C14orf79, 15864, 118314, 640-1617; 3156, C14orf80, 15872, 118322, 304-543; 3156, C14orf80, 15874, 118324, 636-966; 3156, C14orf80, 15875, 118325, 233-880; 3156, C14orf80, 15876, 118326, 281-751; 3156, C14orf80, 15877, 118327, 237-1144; 3156, C14orf80, 15878, 118328, 359-522; 3156, C14orf80, 15879, 118329, 10-369; 3156, C14orf80, 15866, 118316, 254-1318; 3156, C14orf80, 15867, 118317, 330-1076; 3156, C14orf80, 15868, 118318, 109-1290; 3156, C14orf80, 15869, 118319, 128-1408; 3156, C14orf80, 15870, 118320, 122-1609; 3156, C14orf80, 15871, 118321, 178-1236; 3156, C14orf80, 15873, 118323, 361-1107; 3157, C14orf93, 15882, 118332, 484-861; 3157, C14orf93, 15883, 118333, 630-1706; 3157, C14orf93, 15885, 118335, 274-899; 3157, C14orf93, 15887, 118337, 256-852; 3157, C14orf93, 15888, 118338, 383-618; 3157, C14orf93, 15889, 118339, 250-568; 3157, C14orf93, 15890, 118340, 440-467; 3157, C14orf93, 15891, 118341, 338-588; 3157, C14orf93, 15892, 118342, 467-499; 3157, C14orf93, 15893, 118343, 423-571; 3157, C14orf93, 15894, 118344, 177-585; 3157, C14orf93, 15895, 118345, 414-441; 3157, C14orf93, 15880, 118330, 431-2047; 3157, C14orf93, 15881, 118331, 412-1908; 3157, C14orf93, 15884, 118334, 241-1857; 3157, C14orf93, 15886, 118336, 284-1900; 3158, C15orf39, 15898, 118348, 1-2422; 3158, C15orf39, 15899, 118349, 518-581; 3158, C15orf39, 15900, 118350, 273-353; 3158, C15orf39, 15901, 118351, 446-532; 3158, C15orf39, 15896, 118346, 321-3464; 3158, C15orf39, 15897, 118347, 234-3377; 3158, C15orf39, 15902, 118352, 1-2817; 3159, C15orf40, 15905, 118355, 1-287; 3159, C15orf40, 15906, 118356, 1-110; 3159, C15orf40, 15907, 118357, 1-258; 3159, C15orf40, 15909, 118359, 1-104; 3159, C15orf40, 15910, 118360, 1-440; 3159, C15orf40, 15911, 118361, 35-241; 3159, C15orf40, 15903, 118353, 9-470; 3159, C15orf40, 15904, 118354, 1-504; 3159, C15orf40, 15908, 118358, 1-450; 3160, C15orf41, 15914, 118364, 70-387; 3160, C15orf41, 15915, 118365, 198-564; 3160, C15orf41, 15917, 118367, 160-360; 3160, C15orf41, 15918, 118368, 14-877; 3160, C15orf41, 15920, 118370, 220-524; 3160, C15orf41, 15912, 118362, 249-800; 3160, C15orf41, 15913, 118363, 18-863; 3160, C15orf41, 15916, 118366, 251-1096; 3160, C15orf41, 15919, 118369, 274-825; 3160, C15orf41, 15921, 118371, 213-764; 3161, C15orf43, 15923, 118373, 1-131; 3161, C15orf43, 15924, 118374, 10-156; 3161, C15orf43, 15922, 118372, 18-680; 3162, C15orf48, 15927, 118377, 105-500; 3162, C15orf48, 15925, 118375, 191-442; 3162, C15orf48, 15926, 118376, 155-406; 3163, C15orf52, 15929, 118379, 438-541; 3163, C15orf52, 15930, 118380, 52-572; 3163, C15orf52, 15928, 118378, 37-1011; 3163, C15orf52, 15931, 118381, 17-1621; 3164, C15orf53, 15932, 118382, 11-550; 3165, C15orf57, 15937, 118387, 49-570; 3165, C15orf57, 15939, 118389, 98-349; 3165, C15orf57, 15940, 118390, 49-498; 3165, C15orf57, 15941, 118391, 49-660; 3165, C15orf57, 15943, 118393, 47-557; 3165, C15orf57, 15945, 118395, 280-801; 3165, C15orf57, 15933, 118383, 275-832; 3165, C15orf57, 15934, 118384, 95-652; 3165, C15orf57, 15935, 118385, 80-484; 3165, C15orf57, 15936, 118386, 201-785; 3165, C15orf57, 15938, 118388, 27-584; 3165, C15orf57, 15942, 118392, 13-570; 3165, C15orf57, 15944, 118394, 215-619; 3166, C15orf59, 15947, 118397, 321-779; 3166, C15orf59, 15946, 118396, 346-1227; 3166, C15orf59, 15948, 118398, 1206-2087; 3167, C15orf61, 15950, 118400, 494-676; 3167, C15orf61, 15949, 118399, 182-655; 3168, C15orf62, 15951, 118401, 417-944; 3169, C15orf65, 15952, 118402, 222-587; 3170, C16orf13, 15958, 118408, 1-531; 3170, C16orf13, 15959, 118409, 69-590; 3170, C16orf13, 15960, 118410, 1-488; 3170, C16orf13, 15961, 118411, 1-485; 3170, C16orf13, 15962, 118412, 1-402; 3170, C16orf13, 15963, 118413, 42-353; 3170, C16orf13, 15964, 118414, 77-631; 3170, C16orf13, 15953, 118403, 62-445; 3170, C16orf13, 15954, 118404, 13-630; 3170, C16orf13, 15955, 118405, 53-376; 3170, C16orf13, 15956, 118406, 1-558; 3170, C16orf13, 15957, 118407, 13-627; 3171, C16orf45, 15967, 118417, 87-353; 3171, C16orf45, 15968, 118418, 1-346; 3171, C16orf45, 15969, 118419, 1-527; 3171, C16orf45, 15970, 118420, 119-229; 3171, C16orf45, 15971, 118421, 1-405; 3171, C16orf45, 15972, 118422, 180-635; 3171, C16orf45, 15975, 118425, 1-527; 3171, C16orf45, 15976, 118426, 87-353; 3171, C16orf45, 15977, 118427, 1-346; 3171, C16orf45, 15978, 118428, 1-405; 3171, C16orf45, 15979, 118429, 180-635; 3171, C16orf45, 15965, 118415, 360-974; 3171, C16orf45, 15966, 118416, 57-620; 3171, C16orf45, 15973, 118423, 57-620; 3171, C16orf45, 15974, 118424, 360-974; 3172, C16orf46, 15982, 118432, 278-479; 3172, C16orf46, 15980, 118430, 237-1424; 3172, C16orf46, 15981, 118431, 117-1283; 3173, C16orf52, 15985, 118435, 1-120; 3173, C16orf52, 15986, 118436, 20-346; 3173, C16orf52, 15987, 118437, 94-438; 3173, C16orf52, 15988, 118438, 8-280; 3173, C16orf52, 15983, 118433, 94-210; 3173, C16orf52, 15984, 118434, 94-597; 3174, C16orf54, 15989, 118439, 97-771; 3175, C16orf58, 15992, 118442, 12-1283; 3175, C16orf58, 15993, 118443, 14-436; 3175, C16orf58, 15994, 118444, 19-1419; 3175, C16orf58, 15995, 118445, 12-419; 3175, C16orf58, 15996, 118446, 310-555; 3175, C16orf58, 15990, 118440, 41-1447; 3175, C16orf58, 15991, 118441, 7-1413; 3176, C16orf59, 15998, 118448, 60-1277; 3176, C16orf59, 15999, 118449, 352-650; 3176, C16orf59, 16001, 118451, 52-907; 3176, C16orf59, 16002, 118452, 1-515; 3176, C16orf59, 16003, 118453, 12-1229; 3176, C16orf59, 15997, 118447, 66-1367; 3176, C16orf59, 16000, 118450, 614-1414; 3177, C16orf62, 16004, 118454, 49-3207; 3177, C16orf62, 16006, 118456, 262-2703; 3177, C16orf62, 16007, 118457, 49-3207; 3177, C16orf62, 16008, 118458, 11-133; 3177, C16orf62, 16009, 118459, 49-870; 3177, C16orf62, 16010, 118460, 48-2927; 3177, C16orf62, 16011, 118461, 5-511; 3177, C16orf62, 16012, 118462, 285-570; 3177, C16orf62, 16013, 118463, 1-220; 3177, C16orf62, 16014, 118464, 1-349; 3177, C16orf62, 16015, 118465, 564-2702; 3177, C16orf62, 16016, 118466, 5-1360; 3177, C16orf62, 16017, 118467, 266-552; 3177, C16orf62, 16005, 118455, 11-2902; 3178, C16orf70, 16020, 118470, 30-525; 3178, C16orf70, 16021, 118471, 101-768; 3178, C16orf70, 16022, 118472, 64-1025; 3178, C16orf70, 16023, 118473, 1-295; 3178, C16orf70, 16018, 118468, 189-1457; 3178, C16orf70, 16019, 118469, 85-1353; 3179, C16orf71, 16025, 118475, 81-549; 3179, C16orf71, 16026, 118476, 271-1884; 3179, C16orf71, 16027, 118477, 1-411; 3179, C16orf71, 16024, 118474, 479-2041; 3180, C16orf72, 16029, 118479, 1-451; 3180, C16orf72, 16028, 118478, 398-1225; 3181, C16orf74, 16031, 118481, 164-253; 3181, C16orf74, 16032, 118482, 389-478; 3181, C16orf74, 16033, 118483, 223-453;

3181, C16orf74, 16034, 118484, 552-746; 3181, C16orf74, 16035, 118485, 199-285; 3181, C16orf74, 16030, 118480, 185-415; 3182, C16orf78, 16036, 118486, 118-915; 3183, C16orf86, 16038, 118488, 135-305; 3183, C16orf86, 16039, 118489, 82-677; 3183, C16orf86, 16040, 118490, 1-513; 3183, C16orf86, 16037, 118487, 156-1109; 3184, C16orf87, 16043, 118493, 1-485; 3184, C16orf87, 16041, 118491, 263-727; 3184, C16orf87, 16042, 118492, 14-295; 3185, C16orf89, 16045, 118495, 64-1368; 3185, C16orf89, 16044, 118494, 203-1411; 3185, C16orf89, 16046, 118496, 133-1218; 3186, C16orf90, 16047, 118497, 1-574; 3186, C16orf90, 16048, 118498, 4-552; 3187, C16orf91, 16050, 118500, 314-511; 3187, C16orf91, 16049, 118499, 78-476; 3188, C16orf92, 16052, 118502, 1-345; 3188, C16orf92, 16053, 118503, 22-141; 3188, C16orf92, 16054, 118504, 1-150; 3188, C16orf92, 16051, 118501, 22-420; 3189, C16orf95, 16056, 118506, 139-858; 3189, C16orf95, 16057, 118507, 228-659; 3189, C16orf95, 16055, 118505, 175-651; 3190, C16orf96, 16058, 118508, 1-3426; 3191, C17orf100, 16059, 118509, 1-357; 3192, C17orf104, 16062, 118512, 166-553; 3192, C17orf104, 16063, 118513, 69-558; 3192, C17orf104, 16064, 118514, 211-425; 3192, C17orf104, 16065, 118515, 1-453; 3192, C17orf104, 16060, 118510, 143-3001; 3192, C17orf104, 16061, 118511, 406-2385; 3193, C17orf105, 16067, 118517, 1-175; 3193, C17orf105, 16066, 118516, 29-523; 3194, C17orf107, 16069, 118519, 346-642; 3194, C17orf107, 16068, 118518, 228-800; 3195, C17orf47, 16070, 118520, 183-1895; 3196, C17orf49, 16072, 118522, 80-580; 3196, C17orf49, 16073, 118523, 106-579; 3196, C17orf49, 16076, 118526, 1-70; 3196, C17orf49, 16071, 118521, 77-595; 3196, C17orf49, 16074, 118524, 364-942; 3196, C17orf49, 16075, 118525, 90-506; 3197, C17orf50, 16077, 118527, 44-565; 3197, C17orf50, 16078, 118528, 46-456; 3197, C17orf50, 16079, 118529, 33-557; 3198, C17orf51, 16081, 118531, 259-807; 3198, C17orf51, 16080, 118530, 259-924; 3199, C17orf53, 16082, 118532, 122-1687; 3199, C17orf53, 16083, 118533, 238-2181; 3199, C17orf53, 16084, 118534, 236-2176; 3200, C17orf58, 16085, 118535, 316-543; 3200, C17orf58, 16086, 118536, 191-484; 3200, C17orf58, 16087, 118537, 407-634; 3201, C17orf62, 16089, 118539, 727-1410; 3201, C17orf62, 16090, 118540, 243-434; 3201, C17orf62, 16093, 118543, 116-358; 3201, C17orf62, 16094, 118544, 165-401; 3201, C17orf62, 16095, 118545, 57-629; 3201, C17orf62, 16097, 118547, 1-267; 3201, C17orf62, 16098, 118548, 83-319; 3201, C17orf62, 16099, 118549, 265-656; 3201, C17orf62, 16101, 118551, 67-222; 3201, C17orf62, 16102, 118552, 215-573; 3201, C17orf62, 16103, 118553, 1-179; 3201, C17orf62, 16106, 118556, 63-509; 3201, C17orf62, 16107, 118557, 188-540; 3201, C17orf62, 16108, 118558, 215-470; 3201, C17orf62, 16110, 118560, 326-517; 3201, C17orf62, 16111, 118561, 376-567; 3201, C17orf62, 16112, 118562, 416-468; 3201, C17orf62, 16113, 118563, 271-462; 3201, C17orf62, 16088, 118538, 169-732; 3201, C17orf62, 16091, 118541, 319-882; 3201, C17orf62, 16092, 118542, 169-690; 3201, C17orf62, 16096, 118546, 171-734; 3201, C17orf62, 16100, 118550, 335-898; 3201, C17orf62, 16104, 118554, 330-893; 3201, C17orf62, 16105, 118555, 166-729; 3201, C17orf62, 16109, 118559, 214-735; 3202, C17orf64, 16115, 118565, 109-403; 3202, C17orf64, 16116, 118566, 175-203; 3202, C17orf64, 16114, 118564, 85-795; 3203, C17orf67, 16117, 118567, 1281-1553; 3204, C17orf74, 16119, 118569, 49-426; 3204, C17orf74, 16118, 118568, 75-1580; 3205, C17orf75, 16120, 118570, 71-1261; 3205, C17orf75, 16121, 118571, 89-913; 3205, C17orf75, 16122, 118572, 1-292; 3205, C17orf75, 16123, 118573, 71-298; 3205, C17orf75, 16125, 118575, 1-146; 3205, C17orf75, 16126, 118576, 488-884; 3205, C17orf75, 16127, 118577, 469-733; 3205, C17orf75, 16128, 118578, 461-573; 3205, C17orf75, 16124, 118574, 51-1241; 3206, C17orf78, 16129, 118579, 108-587; 3206, C17orf78, 16130, 118580, 51-878; 3206, C17orf78, 16131, 118581, 51-878; 3206, C17orf78, 16132, 118582, 108-587; 3207, C17orf80, 16133, 118583, 371-2014; 3207, C17orf80, 16138, 118588, 215-542; 3207, C17orf80, 16139, 118589, 605-1144; 3207, C17orf80, 16140, 118590, 181-417; 3207, C17orf80, 16134, 118584, 195-1916; 3207, C17orf80, 16135, 118585, 210-2039; 3207, C17orf80, 16136, 118586, 170-1921; 3207, C17orf80, 16137, 118587, 114-1943; 3207, C17orf80, 16141, 118591, 139-1860; 3208, C17orf89, 16143, 118593, 1-239; 3208, C17orf89, 16142, 118592, 126-350; 3209, C17orf96, 16144, 118594, 927-2066; 3209, C17orf96, 16145, 118595, 927-2066; 3210, C17orf97, 16147, 118597, 1-630; 3210, C17orf97, 16148, 118598, 7-468; 3210, C17orf97, 16149, 118599, 1-21; 3210, C17orf97, 16146, 118596, 17-1288; 3211, C17orf98, 16150, 118600, 67-531; 3211, C17orf98, 16151, 118601, 67-531; 3212, C17orf99, 16153, 118603, 1-568; 3212, C17orf99, 16154, 118604, 1-454; 3212, C17orf99, 16152, 118602, 56-853; 3213, C18orf21, 16155, 118605, 372-703; 3213, C18orf21, 16158, 118608, 391-656; 3213, C18orf21, 16160, 118610, 105-497; 3213, C18orf21, 16156, 118606, 288-686; 3213, C18orf21, 16157, 118607, 647-1309; 3213, C18orf21, 16159, 118609, 381-779; 3214, C18orf25, 16161, 118611, 231-668; 3214, C18orf25, 16162, 118612, 277-586; 3214, C18orf25, 16163, 118613, 316-1143; 3214, C18orf25, 16165, 118615, 375-1589; 3214, C18orf25, 16164, 118614, 368-1399; 3215, C18orf32, 16166, 118616, 213-443; 3215, C18orf32, 16167, 118617, 205-435; 3215, C18orf32, 16168, 118618, 70-300; 3216, C18orf42, 16170, 118620, 16-246; 3216, C18orf42, 16169, 118619, 173-382; 3217, C18orf54, 16173, 118623, 1-108; 3217, C18orf54, 16174, 118624, 133-588; 3217, C18orf54, 16171, 118621, 333-1451; 3217, C18orf54, 16172, 118622, 333-1934; 3217, C18orf54, 16175, 118625, 303-1904; 3218, C18orf63, 16176, 118626, 330-2387; 3219, C18orf8, 16178, 118628, 87-1088; 3219, C18orf8, 16179, 118629, 89-289; 3219, C18orf8, 16180, 118630, 101-1930; 3219, C18orf8, 16181, 118631, 100-564; 3219, C18orf8, 16182, 118632, 107-364; 3219, C18orf8, 16183, 118633, 150-1835; 3219, C18orf8, 16177, 118627, 111-2084; 3220, C19orf12, 16185, 118635, 162-368; 3220, C19orf12, 16189, 118639, 228-546; 3220, C19orf12, 16184, 118634, 141-566; 3220, C19orf12, 16186, 118636, 130-363; 3220, C19orf12, 16187, 118637, 128-586; 3220, C19orf12, 16188, 118638, 111-434; 3220, C19orf12, 16190, 118640, 238-663; 3220, C19orf12, 16191, 118641, 183-416; 3221, C19orf18, 16192, 118642, 103-750; 3222, C19orf24, 16194, 118644, 235-633; 3222, C19orf24, 16193, 118643, 113-511; 3223, C19orf25, 16195, 118645, 57-533; 3223, C19orf25, 16197, 118647, 35-517; 3223, C19orf25, 16198, 118648, 14-274; 3223, C19orf25, 16201, 118651, 42-257; 3223, C19orf25, 16202, 118652, 1-129; 3223, C19orf25, 16204, 118654, 54-290; 3223, C19orf25, 16196, 118646, 216-572; 3223, C19orf25, 16199, 118649, 45-401; 3223, C19orf25, 16200, 118650, 73-429; 3223, C19orf25, 16203, 118653, 397-753; 3224, C19orf33, 16205, 118655, 102-422; 3224, C19orf33, 16206, 118656, 99-356; 3225, C19orf35, 16207, 118657, 95-1516; 3226, C19orf38, 16208, 118658, 108-800; 3226, C19orf38, 16209, 118659, 265-957; 3227, C19orf43, 16211, 118661, 15-413; 3227, C19orf43, 16212, 118662, 10-462; 3227, C19orf43, 16213, 118663, 1-402; 3227, C19orf43, 16210, 118660, 119-649; 3228, C19orf44, 16215, 118665, 386-569; 3228, C19orf44, 16216, 118666, 1-108; 3228, C19orf44, 16217, 118667, 62-832; 3228, C19orf44, 16218, 118668, 1-280; 3228, C19orf44, 16219, 118669, 232-565; 3228, C19orf44, 16221, 118671, 74-1951; 3228, C19orf44, 16214, 118664, 157-2130; 3228, C19orf44, 16220, 118670, 29-1885; 3229, C19orf45, 16223, 118673, 257-833; 3229, C19orf45, 16224, 118674, 117-786; 3229, C19orf45, 16225, 118675, 37-578; 3229, C19orf45, 16226, 118676, 1-273; 3229, C19orf45, 16222, 118672, 142-1659; 3230, C19orf47, 16227, 118677, 1-439; 3230, C19orf47, 16230, 118680, 1-426; 3230, C19orf47, 16231, 118681, 155-581; 3230, C19orf47, 16232, 118682, 365-803; 3230, C19orf47, 16233, 118683, 1-506; 3230, C19orf47, 16228, 118678, 240-1307; 3230, C19orf47, 16229, 118679, 14-1282; 3231, C19orf48, 16236, 118686, 708-782; 3231, C19orf48, 16237, 118687, 542-578; 3231, C19orf48, 16238, 118688, 826-971; 3231, C19orf48, 16241, 118691, 596-709; 3231, C19orf48, 16242, 118692, 582-827; 3231, C19orf48, 16243, 118693, 650-892; 3231, C19orf48, 16234, 118684, 974-1327; 3231, C19orf48, 16235, 118685, 923-1276; 3231, C19orf48, 16239, 118689, 952-1305; 3231, C19orf48, 16240, 118690, 1100-1453; 3232, C19orf52, 16245, 118695, 1-82; 3232, C19orf52, 16244, 118694, 91-873; 3233, C19orf53, 16246, 118696, 1-243; 3233, C19orf53, 16247, 118697, 1-18; 3233, C19orf53, 16248, 118698, 1-94; 3233, C19orf53, 16250, 118700, 1-149; 3233, C19orf53, 16251, 118701, 57-227; 3233, C19orf53, 16249, 118699, 311-610; 3234, C19orf54, 16253, 118703, 215-418; 3234, C19orf54, 16254, 118704, 380-553; 3234, C19orf54, 16255, 118705, 427-600; 3234, C19orf54, 16256, 118706, 488-1000; 3234, C19orf54, 16257, 118707, 383-556; 3234, C19orf54, 16258, 118708, 1-338; 3234, C19orf54, 16259, 118709, 1-196; 3234, C19orf54, 16260, 118710, 1-546; 3234, C19orf54, 16252, 118702, 121-1176; 3235, C19orf57, 16262, 118712, 1-886; 3235, C19orf57, 16264, 118714, 286-360; 3235, C19orf57, 16265, 118715, 415-1146; 3235, C19orf57, 16266, 118716, 1-264; 3235, C19orf57, 16267, 118717, 1-420; 3235, C19orf57, 16261, 118711, 129-2042; 3235, C19orf57, 16263, 118713, 1-2007; 3236, C19orf60, 16270, 118720, 1-181; 3236, C19orf60, 16271, 118721, 1-201; 3236, C19orf60, 16268, 118718, 78-683; 3236, C19orf60, 16269, 118719, 7-546; 3237, C19orf66, 16274, 118724, 1-233; 3237, C19orf66, 16275, 118725, 409-621; 3237, C19orf66, 16276, 118726, 81-464; 3237, C19orf66, 16277, 118727, 1-432; 3237, C19orf66, 16272, 118722, 299-1174; 3237, C19orf66, 16273, 118723, 478-1200; 3237, C19orf66, 16278, 118728, 89-856; 3238, C19orf67, 16279, 118729, 104-751; 3238, C19orf67, 16280, 118730, 136-1212; 3239, C19orf68, 16282, 118732, 33-2795; 3239, C19orf68, 16281, 118731, 33-1916; 3240, C19orf70, 16284, 118734, 3-269; 3240, C19orf70, 16285, 118735, 46-378; 3240, C19orf70, 16286, 118736, 104-526; 3240, C19orf70, 16283, 118733, 411-767; 3241, C19orf71, 16287, 118737, 25-654; 3242, C19orf73, 16288, 118738, 119-508; 3243, C19orf80, 16290, 118740, 74-373; 3243, C19orf80, 16291, 118741, 1-176; 3243, C19orf80, 16289, 118739, 20-616; 3243, C19orf80, 16292, 118742, 371-967; 3244, C19orf81, 16293, 118743, 22-493; 3244, C19orf81, 16294, 118744, 1-597; 3245, C19orf84, 16296, 118746, 625-741; 3245, C19orf84, 16295, 118745, 63-623; 3246, C2orf15, 16297, 118747, 637-1014; 3246, C2orf15, 16298, 118748, 468-845; 3247, C2orf16, 16299, 118749, 52-6006; 3248, C2orf40, 16301, 118751, 232-570; 3248, C2orf40, 16302, 118752, 176-602; 3248, C2orf40, 16300, 118750, 110-556; 3249, C2orf42, 16304, 118754, 402-578; 3249, C2orf42, 16305, 118755, 154-536; 3249, C2orf42, 16306, 118756, 798-1133; 3249, C2orf42, 16307, 118757, 369-548; 3249, C2orf42, 16308, 118758, 58-563; 3249, C2orf42, 16309, 118759, 485-551; 3249, C2orf42, 16311, 118761, 569-662; 3249, C2orf42, 16312, 118762, 100-576; 3249, C2orf42, 16303, 118753, 381-2105; 3249, C2orf42, 16310, 118760, 11-1735; 3250, C2orf44, 16315, 118765, 41-562; 3250, C2orf44, 16313, 118763, 59-2224; 3250, C2orf44, 16314, 118764, 67-1935; 3251, C2orf47, 16318, 118768, 1-677; 3251, C2orf47, 16316, 118766, 323-1198; 3251, C2orf47, 16317, 118767, 197-1072; 3252, C2orf49, 16320, 118770, 57-629; 3252, C2orf49, 16319, 118769, 230-928; 3253, C2orf50, 16321, 118771, 283-771; 3253, C2orf50, 16322, 118772, 207-695; 3254, C2orf54, 16326, 118776, 152-549; 3254, C2orf54, 16327, 118777, 47-371; 3254, C2orf54, 16323, 118773, 100-996; 3254, C2orf54, 16324, 118774, 160-1503; 3254, C2orf54, 16325, 118775, 97-936; 3255, C2orf57, 16328, 118778, 52-1239; 3256, C2orf61, 16331, 118781, 1-386; 3256, C2orf61, 16329, 118779, 37-570; 3256, C2orf61, 16330, 118780, 128-874; 3257, C2orf66, 16332, 118782, 890-1243; 3258, C2orf68, 16335, 118785, 83-259; 3258, C2orf68, 16336, 118786, 1-128; 3258, C2orf68, 16333, 118783, 46-546; 3258, C2orf68, 16334, 118784, 49-432; 3259, C2orf69, 16337, 118787, 184-1341; 3260, C2orf70, 16339, 118789, 103-657; 3260, C2orf70, 16340, 118790, 1-385; 3260, C2orf70, 16338, 118788, 32-637; 3261, C2orf71, 16341, 118791, 1-3867; 3262, C2orf72, 16342, 118792, 77-964; 3263, C2orf73, 16343, 118793, 43-222; 3263, C2orf73, 16345, 118795, 75-416; 3263, C2orf73, 16346, 118796, 22-656; 3263, C2orf73, 16347, 118797, 1-247; 3263, C2orf73, 16348, 118798, 133-802; 3263, C2orf73, 16349, 118799, 339-551; 3263, C2orf73, 16344, 118794, 43-906; 3264, C2orf74, 16350, 118800, 83-241; 3264, C2orf74, 16351, 118801, 251-598; 3264, C2orf74, 16353, 118803, 340-423; 3264, C2orf74, 16354, 118804, 97-444; 3264, C2orf74, 16355, 118805, 209-772; 3264, C2orf74, 16352, 118802, 1-585; 3265, C2orf76, 16360, 118810, 254-509; 3265, C2orf76, 16356, 118806, 52-432; 3265, C2orf76, 16357, 118807, 523-903; 3265, C2orf76, 16358, 118808, 339-719; 3265, C2orf76, 16359, 118809, 542-922; 3266, C2orf78, 16361, 118811, 122-2890; 3267, C2orf80, 16363, 118813, 1-420; 3267, C2orf80, 16364, 118814, 19-393; 3267, C2orf80, 16365, 118815, 188-386; 3267, C2orf80, 16366, 118816, 3-527; 3267, C2orf80, 16367, 118817, 1-385; 3267, C2orf80, 16368, 118818, 210-460; 3267, C2orf80, 16362, 118812, 197-778; 3268, C2orf81, 16369, 118819, 310-2076; 3268, C2orf81, 16370, 118820, 400-883; 3268, C2orf81, 16371, 118821, 101-427; 3268, C2orf81, 16372, 118822, 310-898; 3268, C2orf81, 16373, 118823, 693-2255; 3268, C2orf81, 16374, 118824, 1-1749; 3269, C2orf82, 16378, 118828, 299-357; 3269, C2orf82, 16375, 118825, 59-424; 3269, C2orf82, 16376, 118826, 248-613; 3269, C2orf82, 16377, 118827, 146-511; 3270, C2orf83, 16379, 118829, 88-540; 3270, C2orf83, 16380, 118830, 236-526; 3271, C2orf88, 16384, 118834, 368-570; 3271, C2orf88, 16385, 118835, 397-486; 3271, C2orf88, 16381, 118831, 412-699; 3271, C2orf88, 16382, 118832, 380-667; 3271, C2orf88, 16383, 118833, 1093-1380; 3271, C2orf88, 16386, 118836, 339-626; 3272, C2orf91, 16388, 118838, 1-393; 3272, C2orf91, 16387, 118837, 91-486; 3273, C20orf141, 16389, 118839, 175-672; 3273, C20orf141, 16390, 118840, 65-562; 3274, C20orf144, 16391, 118841, 63-524; 3275, C20orf173, 16394, 118844, 189-383; 3275, C20orf173, 16392, 118842, 280-729; 3275, C20orf173, 16393, 118843, 146-754; 3275, C20orf173, 16395, 118845, 146-754; 3276, C20orf194, 16396, 118846, 69-3602; 3277, C20orf195, 16400, 118850, 560-804; 3277, C20orf195, 16397, 118847, 75-1031; 3277, C20orf195, 16398, 118848, 93-1049; 3277, C20orf195, 16399, 118849, 1950-2906; 3278, C20orf196, 16402, 118852, 92-280; 3278, C20orf196, 16403, 118853, 139-501; 3278, C20orf196, 16404, 118854, 28-627; 3278, C20orf196, 16401, 118851, 88-705; 3279, C20orf202, 16405, 118855, 64-432; 3280, C20orf24, 16406, 118856, 219-608; 3280, C20orf24, 16407, 118857, 131-562; 3280, C20orf24, 16408, 118858, 136-549; 3280, C20orf24, 16409, 118859, 164-427; 3280, C20orf24, 16410, 118860, 168-431; 3281, C20orf27, 16414, 118864, 1-383; 3281, C20orf27, 16411, 118861, 153-752; 3281, C20orf27, 16412, 118862, 812-1336; 3281, C20orf27, 16413, 118863, 660-1184; 3282, C20orf85, 16415, 118865, 62-475; 3283, C20orf96, 16417, 118867, 90-1076; 3283, C20orf96, 16418, 118868, 176-1264; 3283, C20orf96, 16416, 118866, 140-1231; 3284, C21orf140, 16419, 118869, 1-756; 3285, C21orf2, 16420, 118870, 209-976; 3285, C21orf2, 16421, 118871, 209-979; 3285, C21orf2, 16422, 118872, 200-1327; 3286, C21orf33, 16425, 118875, 1-675; 3286, C21orf33, 16426, 118876, 81-734; 3286, C21orf33, 16427, 118877, 1-772; 3286, C21orf33, 16428, 118878, 1-575; 3286, C21orf33, 16423, 118873, 94-900; 3286, C21orf33, 16424, 118874, 19-732; 3287, C21orf58, 16430, 118880, 1385-2035; 3287, C21orf58, 16431, 118881, 1109-1759; 3287, C21orf58, 16432, 118882, 1705-2355; 3287, C21orf58, 16433, 118883, 657-1307; 3287, C21orf58, 16434, 118884, 1796-1931; 3287, C21orf58, 16435, 118885, 1-855; 3287, C21orf58, 16436, 118886, 1-720; 3287, C21orf58, 16429, 118879, 1138-2106; 3288, C21orf59, 16438, 118888, 361-777; 3288, C21orf59, 16439, 118889, 344-1081; 3288, C21orf59, 16440, 118890, 313-863; 3288, C21orf59, 16441, 118891, 1-352; 3288, C21orf59, 16442, 118892, 1-239; 3288, C21orf59, 16443, 118893, 110-886; 3288, C21orf59, 16437, 118887, 624-1496; 3289, C21orf62, 16444, 118894, 1-801; 3289, C21orf62, 16450, 118900, 1-801; 3289, C21orf62, 16445, 118895, 153-812; 3289, C21orf62, 16446, 118896, 264-923; 3289, C21orf62, 16447, 118897, 298-957; 3289, C21orf62, 16448, 118898, 142-801; 3289, C21orf62, 16449, 118899, 153-812; 3289, C21orf62, 16451, 118901, 298-957; 3289, C21orf62, 16452, 118902, 264-923; 3289, C21orf62, 16453, 118903, 142-801; 3290, C21orf91, 16457, 118907, 170-896; 3290, C21orf91, 16454, 118904, 92-985; 3290, C21orf91, 16455, 118905, 92-757; 3290, C21orf91, 16456, 118906, 92-982; 3291, C22orf15, 16458, 118908, 101-574; 3291, C22orf15, 16461, 118911, 56-454; 3291, C22orf15, 16462, 118912, 1-404; 3291, C22orf15, 16463, 118913, 1-449; 3291, C22orf15, 16464, 118914, 1-422; 3291, C22orf15, 16459, 118909, 85-513; 3291, C22orf15, 16460, 118910, 254-700; 3292, C22orf23, 16468, 118918, 78-563; 3292, C22orf23, 16469, 118919, 397-758; 3292, C22orf23, 16470, 118920, 62-652; 3292, C22orf23, 16465, 118915, 258-911; 3292, C22orf23, 16466, 118916, 62-715; 3292, C22orf23, 16467, 118917, 210-863; 3293, C22orf29, 16474, 118924, 458-730; 3293, C22orf29, 16471, 118921, 504-1598; 3293, C22orf29, 16472, 118922, 670-1764; 3293, C22orf29, 16473, 118923, 400-1494; 3294, C22orf31, 16475, 118925, 53-925; 3295, C22orf39, 16476, 118926, 10-327; 3295, C22orf39, 16478, 118928, 5-247; 3295, C22orf39, 16479, 118929, 4-282; 3295, C22orf39, 16477, 118927, 434-862; 3295, C22orf39, 16480, 118930, 434-787; 3295, C22orf39, 16481, 118931, 434-862; 3296, C22orf42, 16482, 118932, 74-829; 3297, C22orf46, 16483, 118933, 86-817; 3298, C3orf14, 16486, 118936, 278-465; 3298, C3orf14, 16484, 118934, 47-433; 3298, C3orf14, 16485, 118935, 315-701; 3298, C3orf14, 16487, 118937, 208-594; 3298, C3orf14, 16488, 118938, 125-511; 3299, C3orf17, 16491, 118941, 215-459; 3299, C3orf17, 16492, 118942, 20-130; 3299, C3orf17, 16493, 118943, 18-128; 3299, C3orf17, 16494, 118944, 215-325; 3299, C3orf17, 16495, 118945, 25-369; 3299, C3orf17, 16496, 118946, 25-741; 3299, C3orf17, 16497, 118947, 18-137; 3299, C3orf17, 16498, 118948, 75-185; 3299, C3orf17, 16499, 118949, 205-315; 3299, C3orf17, 16500, 118950, 186-296; 3299, C3orf17, 16501, 118951, 8-118; 3299, C3orf17, 16502, 118952, 1-342; 3299, C3orf17, 16503, 118953, 24-134; 3299, C3orf17, 16504, 118954, 35-145; 3299, C3orf17, 16505, 118955, 12-122; 3299, C3orf17, 16489, 118939, 193-1896; 3299, C3orf17, 16490, 118940, 87-1580; 3300, C3orf18, 16508, 118958, 87-419; 3300, C3orf18, 16509, 118959, 381-695; 3300, C3orf18, 16506, 118956, 541-1029; 3300, C3orf18, 16507, 118957, 366-854; 3300, C3orf18, 16510, 118960, 252-740; 3300, C3orf18, 16511, 118961, 216-644; 3301, C3orf20, 16512, 118962, 453-3167; 3301, C3orf20, 16513, 118963, 237-2585; 3301, C3orf20, 16514, 118964, 380-2728; 3302, C3orf22, 16515, 118965, 380-805; 3302, C3orf22, 16516, 118966, 380-688; 3303, C3orf30, 16518, 118968, 1-1324; 3303, C3orf30, 16519, 118969, 1-667; 3303, C3orf30, 16520, 118970, 1-862; 3303, C3orf30, 16521, 118971, 40-1647; 3303, C3orf30, 16517, 118967, 41-1651; 3304, C3orf33, 16523, 118973, 1-347; 3304, C3orf33, 16524, 118974, 15-374; 3304, C3orf33, 16525, 118975, 8-223; 3304, C3orf33, 16522, 118972, 100-984; 3304, C3orf33, 16526, 118976, 150-905; 3305, C3orf36, 16527, 118977, 1010-1507; 3306, C3orf38, 16529, 118979, 67-489; 3306, C3orf38, 16528, 118978, 311-1300; 3307, C3orf49, 16531, 118981, 1-876; 3307, C3orf49, 16530, 118980, 111-989; 3308, C3orf52, 16534, 118984, 1-724; 3308, C3orf52, 16532, 118982, 60-713; 3308, C3orf52, 16533, 118983, 74-826; 3308, C3orf52, 16535, 118985, 74-517; 3309, C3orf58, 16537, 118987, 156-734; 3309, C3orf58, 16539, 118989, 92-730; 3309, C3orf58, 16536, 118986, 536-1828; 3309, C3orf58, 16538, 118988, 453-1118; 3310, C3orf62, 16541, 118991, 1-297; 3310, C3orf62, 16542, 118992, 10-581; 3310, C3orf62, 16540, 118990, 1038-1841; 3311, C3orf67, 16545, 118995, 840-1844; 3311, C3orf67, 16546, 118996, 420-917; 3311, C3orf67, 16547, 118997, 1-123; 3311, C3orf67, 16548, 118998, 1-133; 3311, C3orf67, 16549, 118999, 520-744; 3311, C3orf67, 16550, 119000, 129-704; 3311, C3orf67, 16551, 119001, 402-992; 3311, C3orf67, 16552, 119002, 1-80; 3311, C3orf67, 16553, 119003, 1-561; 3311, C3orf67, 16554, 119004, 1-238; 3311, C3orf67, 16555, 119005, 1681-2397; 3311, C3orf67, 16543, 118993, 505-2196; 3311, C3orf67, 16544, 118994, 98-2167; 3312, C3orf70, 16556, 119006, 192-944; 3313, C3orf80, 16557, 119007, 1-744; 3314, C3orf84, 16559, 119009, 52-669; 3314, C3orf84, 16558, 119008, 88-702; 3315, C4orf17, 16562, 119012, 355-1239; 3315, C4orf17, 16560, 119010, 363-1442; 3315, C4orf17, 16561, 119011, 355-915; 3316, C4orf19, 16565, 119015, 126-242; 3316, C4orf19, 16563, 119013, 179-1123; 3316, C4orf19, 16564, 119014, 173-1117; 3317, C4orf22, 16567, 119017, 2-472; 3317, C4orf22, 16569, 119019, 28-288; 3317, C4orf22, 16570, 119020, 1-228; 3317, C4orf22, 16566, 119016, 50-751; 3317, C4orf22, 16568, 119018, 1-753; 3318, C4orf26, 16573, 119023, 36-158; 3318, C4orf26, 16574, 119024, 36-293; 3318, C4orf26, 16571, 119021, 36-428; 3318, C4orf26, 16572, 119022, 19-549; 3319, C4orf27, 16575, 119025, 77-1117; 3320, C4orf3, 16576, 119026, 1-600; 3320, C4orf3, 16577, 119027, 387-587; 3321, C4orf32, 16578, 119028, 185-583; 3322, C4orf33, 16581, 119031, 91-396; 3322, C4orf33, 16582, 119032, 339-836; 3322, C4orf33, 16583, 119033, 272-465; 3322, C4orf33, 16579, 119029, 722-1321; 3322, C4orf33, 16580, 119030, 93-692; 3323, C4orf36, 16586, 119036, 428-766; 3323, C4orf36, 16587, 119037, 203-301; 3323, C4orf36, 16588, 119038, 206-448; 3323, C4orf36, 16589, 119039, 185-325; 3323, C4orf36, 16584, 119034, 287-640; 3323, C4orf36, 16585, 119035, 665-1018; 3324, C4orf45, 16590, 119040, 86-646;

3325, C4orf46, 16592, 119042, 92-289; 3325, C4orf46, 16591, 119041, 246-587; 3326, C4orf47, 16594, 119044, 230-714; 3326, C4orf47, 16595, 119045, 252-785; 3326, C4orf47, 16596, 119046, 175-285; 3326, C4orf47, 16593, 119043, 23-952; 3327, C4orf48, 16597, 119047, 152-439; 3327, C4orf48, 16598, 119048, 3-389; 3328, C4orf50, 16600, 119050, 48-2300; 3328, C4orf50, 16599, 119049, 1299-2129; 3329, C4orf51, 16602, 119052, 1-488; 3329, C4orf51, 16601, 119051, 1-609; 3330, C5orf15, 16603, 119053, 204-1001; 3331, C5orf22, 16605, 119055, 105-515; 3331, C5orf22, 16606, 119056, 107-517; 3331, C5orf22, 16607, 119057, 95-244; 3331, C5orf22, 16608, 119058, 78-488; 3331, C5orf22, 16609, 119059, 99-568; 3331, C5orf22, 16604, 119054, 128-1456; 3332, C5orf24, 16614, 119064, 622-643; 3332, C5orf24, 16615, 119065, 1-254; 3332, C5orf24, 16610, 119060, 62-628; 3332, C5orf24, 16611, 119061, 229-795; 3332, C5orf24, 16612, 119062, 264-830; 3332, C5orf24, 16613, 119063, 121-588; 3333, C5orf28, 16618, 119068, 209-736; 3333, C5orf28, 16620, 119070, 137-478; 3333, C5orf28, 16616, 119066, 139-786; 3333, C5orf28, 16617, 119067, 296-943; 3333, C5orf28, 16619, 119069, 333-980; 3334, C5orf30, 16621, 119071, 309-929; 3334, C5orf30, 16622, 119072, 482-1102; 3334, C5orf30, 16623, 119073, 265-885; 3335, C5orf34, 16625, 119075, 277-962; 3335, C5orf34, 16626, 119076, 1-380; 3335, C5orf34, 16624, 119074, 377-2293; 3336, C5orf38, 16630, 119080, 38-244; 3336, C5orf38, 16631, 119081, 38-244; 3336, C5orf38, 16632, 119082, 20-427; 3336, C5orf38, 16633, 119083, 38-445; 3336, C5orf38, 16627, 119077, 118-534; 3336, C5orf38, 16628, 119078, 1-681; 3336, C5orf38, 16629, 119079, 135-347; 3337, C5orf42, 16636, 119086, 1-6792; 3337, C5orf42, 16637, 119087, 1-5670; 3337, C5orf42, 16638, 119088, 1-1487; 3337, C5orf42, 16634, 119084, 232-9825; 3337, C5orf42, 16635, 119085, 95-9688; 3338, C5orf45, 16641, 119091, 2-526; 3338, C5orf45, 16642, 119092, 13-294; 3338, C5orf45, 16643, 119093, 13-591; 3338, C5orf45, 16644, 119094, 44-301; 3338, C5orf45, 16645, 119095, 352-981; 3338, C5orf45, 16646, 119096, 13-204; 3338, C5orf45, 16647, 119097, 49-297; 3338, C5orf45, 16648, 119098, 22-363; 3338, C5orf45, 16649, 119099, 65-322; 3338, C5orf45, 16650, 119100, 49-333; 3338, C5orf45, 16651, 119101, 11-700; 3338, C5orf45, 16652, 119102, 14-286; 3338, C5orf45, 16653, 119103, 43-291; 3338, C5orf45, 16654, 119104, 49-204; 3338, C5orf45, 16655, 119105, 220-696; 3338, C5orf45, 16639, 119089, 92-1123; 3338, C5orf45, 16640, 119090, 13-879; 3339, C5orf46, 16656, 119106, 2-265; 3339, C5orf46, 16657, 119107, 38-256; 3340, C5orf47, 16658, 119108, 106-636; 3341, C5orf49, 16660, 119110, 131-568; 3341, C5orf49, 16659, 119109, 470-913; 3342, C5orf51, 16662, 119112, 1-459; 3342, C5orf51, 16661, 119111, 20-904; 3343, C5orf52, 16663, 119113, 63-542; 3344, C5orf56, 16665, 119115, 124-366; 3344, C5orf56, 16667, 119117, 124-237; 3344, C5orf56, 16664, 119114, 132-512; 3344, C5orf56, 16666, 119116, 477-830; 3344, C5orf56, 16668, 119118, 30-410; 3345, C5orf63, 16671, 119121, 140-307; 3345, C5orf63, 16672, 119122, 152-331; 3345, C5orf63, 16673, 119123, 1-174; 3345, C5orf63, 16675, 119125, 127-396; 3345, C5orf63, 16669, 119119, 152-499; 3345, C5orf63, 16670, 119120, 152-568; 3345, C5orf63, 16674, 119124, 48-464; 3346, C5orf67, 16677, 119127, 1-354; 3346, C5orf67, 16676, 119126, 227-610; 3347, C6orf1, 16678, 119128, 555-974; 3347, C6orf1, 16680, 119130, 268-687; 3347, C6orf1, 16679, 119129, 194-673; 3347, C6orf1, 16681, 119131, 684-1163; 3347, C6orf1, 16682, 119132, 455-934; 3347, C6orf1, 16683, 119133, 395-874; 3348, C6orf10, 16684, 119134, 174-1859; 3348, C6orf10, 16687, 119137, 202-1890; 3348, C6orf10, 16689, 119139, 174-753; 3348, C6orf10, 16690, 119140, 202-1890; 3348, C6orf10, 16691, 119141, 202-778; 3348, C6orf10, 16692, 119142, 174-1865; 3348, C6orf10, 16693, 119143, 174-1865; 3348, C6orf10, 16695, 119145, 174-753; 3348, C6orf10, 16697, 119147, 194-1600; 3348, C6orf10, 16698, 119148, 202-778; 3348, C6orf10, 16699, 119149, 202-1890; 3348, C6orf10, 16701, 119151, 202-1890; 3348, C6orf10, 16703, 119153, 174-549; 3348, C6orf10, 16704, 119154, 167-563; 3348, C6orf10, 16705, 119155, 167-1810; 3348, C6orf10, 16707, 119157, 174-1859; 3348, C6orf10, 16708, 119158, 207-1904; 3348, C6orf10, 16709, 119159, 207-1850; 3348, C6orf10, 16710, 119160, 194-1879; 3348, C6orf10, 16711, 119161, 1-1692; 3348, C6orf10, 16712, 119162, 1-1644; 3348, C6orf10, 16713, 119163, 1-1644; 3348, C6orf10, 16714, 119164, 207-1850; 3348, C6orf10, 16716, 119166, 194-1891; 3348, C6orf10, 16717, 119167, 1-1686; 3348, C6orf10, 16718, 119168, 207-1904; 3348, C6orf10, 16719, 119169, 1-1701; 3348, C6orf10, 16720, 119170, 1-1692; 3348, C6orf10, 16721, 119171, 1-1686; 3348, C6orf10, 16722, 119172, 1-1701; 3348, C6orf10, 16685, 119135, 202-1890; 3348, C6orf10, 16686, 119136, 174-1865; 3348, C6orf10, 16688, 119138, 174-1865; 3348, C6orf10, 16694, 119144, 174-1865; 3348, C6orf10, 16696, 119146, 202-1890; 3348, C6orf10, 16700, 119150, 174-1865; 3348, C6orf10, 16702, 119152, 202-1887; 3348, C6orf10, 16706, 119156, 207-1892; 3348, C6orf10, 16715, 119165, 207-1898; 3348, C6orf10, 16723, 119173, 207-1898; 3349, C6orf106, 16724, 119174, 186-860; 3349, C6orf106, 16725, 119175, 245-1141; 3349, C6orf106, 16726, 119176, 257-955; 3350, C6orf118, 16727, 119177, 22-1431; 3351, C6orf120, 16728, 119178, 271-846; 3352, C6orf132, 16729, 119179, 1-3567; 3352, C6orf132, 16730, 119180, 176-475; 3353, C6orf136, 16737, 119187, 1-1302; 3353, C6orf136, 16740, 119190, 1-1302; 3353, C6orf136, 16745, 119195, 1-1302; 3353, C6orf136, 16746, 119196, 1-1302; 3353, C6orf136, 16749, 119199, 1-1302; 3353, C6orf136, 16750, 119200, 1-1302; 3353, C6orf136, 16751, 119201, 1-1302; 3353, C6orf136, 16753, 119203, 1-315; 3353, C6orf136, 16754, 119204, 107-283; 3353, C6orf136, 16755, 119205, 194-466; 3353, C6orf136, 16756, 119206, 1-147; 3353, C6orf136, 16757, 119207, 1-87; 3353, C6orf136, 16758, 119208, 1-286; 3353, C6orf136, 16759, 119209, 178-744; 3353, C6orf136, 16731, 119181, 194-1684; 3353, C6orf136, 16732, 119182, 69-614; 3353, C6orf136, 16733, 119183, 160-1107; 3353, C6orf136, 16734, 119184, 69-614; 3353, C6orf136, 16735, 119185, 160-1107; 3353, C6orf136, 16736, 119186, 69-614; 3353, C6orf136, 16738, 119188, 160-1107; 3353, C6orf136, 16739, 119189, 69-614; 3353, C6orf136, 16741, 119191, 69-614; 3353, C6orf136, 16742, 119192, 160-1107; 3353, C6orf136, 16743, 119193, 160-1107; 3353, C6orf136, 16744, 119194, 69-614; 3353, C6orf136, 16747, 119197, 160-1107; 3353, C6orf136, 16748, 119198, 69-614; 3353, C6orf136, 16752, 119202, 160-1107; 3354, C6orf141, 16761, 119211, 1-218; 3354, C6orf141, 16760, 119210, 119-853; 3354, C6orf141, 16762, 119212, 148-882; 3354, C6orf141, 16763, 119213, 128-862; 3355, C6orf15, 16764, 119214, 5-982; 3355, C6orf15, 16765, 119215, 5-982; 3355, C6orf15, 16766, 119216, 5-982; 3355, C6orf15, 16767, 119217, 5-982; 3355, C6orf15, 16768, 119218, 5-982; 3355, C6orf15, 16769, 119219, 5-982; 3356, C6orf163, 16771, 119221, 1445-2044; 3356, C6orf163, 16770, 119220, 252-1241; 3357, C6orf183, 16772, 119222, 82-1956; 3358, C6orf201, 16773, 119223, 204-551; 3358, C6orf201, 16776, 119226, 219-635; 3358, C6orf201, 16774, 119224, 371-766; 3358, C6orf201, 16775, 119225, 766-1188; 3359, C6orf203, 16779, 119229, 310-1047; 3359, C6orf203, 16777, 119227, 72-794; 3359, C6orf203, 16778, 119228, 598-1320; 3360, C6orf222, 16780, 119230, 179-2137; 3361, C6orf223, 16783, 119233, 417-1085; 3361, C6orf223, 16781, 119231, 4-321; 3361, C6orf223, 16782, 119232, 21-749; 3362, C6orf226, 16784, 119234, 29-334; 3363, C6orf229, 16785, 119235, 33-725; 3364, C6orf25, 16812, 119262, 1-726; 3364, C6orf25, 16813, 119263, 12-725; 3364, C6orf25, 16818, 119268, 1-654; 3364, C6orf25, 16822, 119272, 41-703; 3364, C6orf25, 16823, 119273, 12-389; 3364, C6orf25, 16786, 119236, 1-582; 3364, C6orf25, 16787, 119237, 15-668; 3364, C6orf25, 16788, 119238, 1-726; 3364, C6orf25, 16789, 119239, 12-725; 3364, C6orf25, 16790, 119240, 41-709; 3364, C6orf25, 16791, 119241, 1-594; 3364, C6orf25, 16792, 119242, 1-594; 3364, C6orf25, 16793, 119243, 1-654; 3364, C6orf25, 16794, 119244, 12-725; 3364, C6orf25, 16795, 119245, 1-582; 3364, C6orf25, 16796, 119246, 1-726; 3364, C6orf25, 16797, 119247, 1-594; 3364, C6orf25, 16798, 119248, 1-582; 3364, C6orf25, 16799, 119249, 12-725; 3364, C6orf25, 16800, 119250, 1-594; 3364, C6orf25, 16801, 119251, 1-726; 3364, C6orf25, 16802, 119252, 1-582; 3364, C6orf25, 16803, 119253, 1-582; 3364, C6orf25, 16804, 119254, 1-594; 3364, C6orf25, 16805, 119255, 1-654; 3364, C6orf25, 16806, 119256, 12-725; 3364, C6orf25, 16807, 119257, 1-654; 3364, C6orf25, 16808, 119258, 1-654; 3364, C6orf25, 16809, 119259, 1-654; 3364, C6orf25, 16810, 119260, 12-725; 3364, C6orf25, 16811, 119261, 1-726; 3364, C6orf25, 16814, 119264, 1-726; 3364, C6orf25, 16815, 119265, 1-582; 3364, C6orf25, 16816, 119266, 1-582; 3364, C6orf25, 16817, 119267, 1-594; 3364, C6orf25, 16819, 119269, 1-594; 3364, C6orf25, 16820, 119270, 12-725; 3364, C6orf25, 16821, 119271, 1-726; 3365, C6orf47, 16824, 119274, 826-1710; 3365, C6orf47, 16825, 119275, 823-1707; 3365, C6orf47, 16826, 119276, 826-1710; 3365, C6orf47, 16827, 119277, 826-1710; 3365, C6orf47, 16828, 119278, 826-1710; 3365, C6orf47, 16829, 119279, 826-1710; 3365, C6orf47, 16830, 119280, 826-1710; 3366, C6orf48, 16831, 119281, 258-485; 3366, C6orf48, 16832, 119282, 285-512; 3366, C6orf48, 16833, 119283, 522-749; 3366, C6orf48, 16834, 119284, 387-614; 3366, C6orf48, 16835, 119285, 728-955; 3366, C6orf48, 16836, 119286, 277-504; 3366, C6orf48, 16837, 119287, 637-864; 3366, C6orf48, 16838, 119288, 522-749; 3366, C6orf48, 16839, 119289, 285-512; 3366, C6orf48, 16840, 119290, 387-614; 3366, C6orf48, 16841, 119291, 487-714; 3366, C6orf48, 16842, 119292, 627-854; 3366, C6orf48, 16843, 119293, 260-487; 3366, C6orf48, 16844, 119294, 627-854; 3366, C6orf48, 16845, 119295, 637-864; 3366, C6orf48, 16846, 119296, 277-504; 3366, C6orf48, 16847, 119297, 487-714; 3366, C6orf48, 16848, 119298, 487-714; 3366, C6orf48, 16849, 119299, 728-955; 3366, C6orf48, 16850, 119300, 277-504; 3366, C6orf48, 16851, 119301, 627-854; 3366, C6orf48, 16852, 119302, 522-749; 3366, C6orf48, 16853, 119303, 522-749; 3366, C6orf48, 16854, 119304, 487-714; 3366, C6orf48, 16855, 119305, 728-955; 3366, C6orf48, 16856, 119306, 637-864; 3366, C6orf48, 16857, 119307, 387-614; 3366, C6orf48, 16858, 119308, 260-487; 3366, C6orf48, 16859, 119309, 387-614; 3366, C6orf48, 16860, 119310, 387-614; 3366, C6orf48, 16861, 119311, 627-854; 3366, C6orf48, 16862, 119312, 637-864; 3366, C6orf48, 16863, 119313, 277-504; 3366, C6orf48, 16864, 119314, 260-487; 3366, C6orf48, 16865, 119315, 277-504; 3366, C6orf48, 16866, 119316, 627-854; 3366, C6orf48, 16867, 119317, 728-955; 3366, C6orf48, 16868, 119318, 285-512; 3366, C6orf48, 16869, 119319, 285-512; 3366, C6orf48, 16870, 119320, 487-714; 3366, C6orf48, 16871, 119321, 637-864; 3366, C6orf48, 16872, 119322, 522-749; 3366, C6orf48, 16873, 119323, 260-487; 3366, C6orf48, 16874, 119324, 728-955; 3366, C6orf48, 16875, 119325, 285-512; 3366, C6orf48, 16876, 119326, 418-645; 3366, C6orf48, 16877, 119327, 418-645; 3366, C6orf48, 16878, 119328, 418-645; 3366, C6orf48, 16879, 119329, 418-645; 3366, C6orf48, 16880, 119330, 418-645; 3367, C6orf52, 16884, 119334, 312-503; 3367, C6orf52, 16885, 119335, 367-648; 3367, C6orf52, 16881, 119331, 125-583; 3367, C6orf52, 16882, 119332, 199-396; 3367, C6orf52, 16883, 119333, 1-459; 3368, C6orf58, 16886, 119336, 13-1005; 3369, C6orf62, 16887, 119337, 98-700; 3369, C6orf62, 16888, 119338, 2169-2858; 3370, C6orf89, 16890, 119340, 726-1451; 3370, C6orf89, 16889, 119339, 164-1228; 3370, C6orf89, 16891, 119341, 276-1319; 3370, C6orf89, 16892, 119342, 295-1338; 3371, C7orf25, 16896, 119346, 104-637; 3371, C7orf25, 16898, 119348, 324-578; 3371, C7orf25, 16893, 119343, 277-1542; 3371, C7orf25, 16894, 119344, 465-1730; 3371, C7orf25, 16895, 119345, 24-1463; 3371, C7orf25, 16897, 119347, 24-1463; 3372, C7orf26, 16901, 119351, 1-448; 3372, C7orf26, 16902, 119352, 1-294; 3372, C7orf26, 16899, 119349, 268-1617; 3372, C7orf26, 16900, 119350, 141-1199; 3373, C7orf31, 16905, 119355, 95-555; 3373, C7orf31, 16906, 119356, 411-757; 3373, C7orf31, 16907, 119357, 242-519; 3373, C7orf31, 16903, 119353, 664-2436; 3373, C7orf31, 16904, 119354, 310-2082; 3374, C7orf33, 16908, 119358, 362-895; 3375, C7orf34, 16911, 119361, 42-485; 3375, C7orf34, 16912, 119362, 2-460; 3375, C7orf34, 16909, 119359, 42-485; 3375, C7orf34, 16910, 119360, 1-460; 3376, C7orf43, 16914, 119364, 1-78; 3376, C7orf43, 16915, 119365, 524-1459; 3376, C7orf43, 16916, 119366, 479-1414; 3376, C7orf43, 16917, 119367, 161-670; 3376, C7orf43, 16918, 119368, 1-452; 3376, C7orf43, 16919, 119369, 1-300; 3376, C7orf43, 16920, 119370, 44-808; 3376, C7orf43, 16913, 119363, 187-1929; 3377, C7orf49, 16922, 119372, 327-797; 3377, C7orf49, 16925, 119375, 388-597; 3377, C7orf49, 16921, 119371, 183-656; 3377, C7orf49, 16923, 119373, 604-912; 3377, C7orf49, 16924, 119374, 145-453; 3377, C7orf49, 16926, 119376, 212-520; 3378, C7orf50, 16930, 119380, 1-489; 3378, C7orf50, 16931, 119381, 1-538; 3378, C7orf50, 16932, 119382, 45-621; 3378, C7orf50, 16927, 119377, 71-655; 3378, C7orf50, 16928, 119378, 928-1512; 3378, C7orf50, 16929, 119379, 42-626; 3379, C7orf55, 16933, 119383, 254-595; 3380, C7orf57, 16936, 119386, 2-976; 3380, C7orf57, 16937, 119387, 2-1024; 3380, C7orf57, 16938, 119388, 432-905; 3380, C7orf57, 16934, 119384, 213-1100; 3380, C7orf57, 16935, 119385, 432-893; 3381, C7orf60, 16940, 119390, 1-1164; 3381, C7orf60, 16939, 119389, 167-1384; 3382, C7orf61, 16942, 119392, 1-573; 3382, C7orf61, 16941, 119391, 247-867; 3383, C7orf62, 16943, 119393, 187-948; 3384, C7orf72, 16944, 119394, 51-1367; 3385, C7orf73, 16946, 119396, 85-222; 3385, C7orf73, 16945, 119395, 60-203; 3386, C7orf77, 16947, 119397, 66-338; 3387, C8orf22, 16948, 119398, 174-428; 3387, C8orf22, 16949, 119399, 184-429; 3387, C8orf22, 16950, 119400, 187-441; 3387, C8orf22, 16951, 119401, 104-358; 3388, C8orf33, 16952, 119402, 115-804; 3389, C8orf34, 16955, 119405, 47-910; 3389, C8orf34, 16957, 119407, 30-650; 3389, C8orf34, 16953, 119403, 119-724; 3389, C8orf34, 16954, 119404, 1593-2876; 3389, C8orf34, 16956, 119406, 292-1908; 3389, C8orf34, 16958, 119408, 50-439; 3390, C8orf37, 16959, 119409, 13-636; 3391, C8orf4, 16960, 119410, 79-399; 3392, C8orf44, 16963, 119413, 276-533; 3392, C8orf44, 16961, 119411, 292-771; 3392, C8orf44, 16962, 119412, 152-631; 3393, C8orf46, 16965, 119415, 23-466; 3393, C8orf46, 16967, 119417, 89-322; 3393, C8orf46, 16968, 119418, 130-498; 3393, C8orf46, 16969, 119419, 88-234; 3393, C8orf46, 16964, 119414, 442-1065; 3393, C8orf46, 16966, 119416, 44-448; 3394, C8orf48, 16970, 119420, 150-1109; 3395, C8orf58, 16973, 119423, 4-448; 3395, C8orf58, 16974, 119424, 1-526; 3395, C8orf58, 16975, 119425, 121-1023; 3395, C8orf58, 16976, 119426, 128-1114; 3395, C8orf58, 16971, 119421, 75-1172; 3395, C8orf58, 16972, 119422, 121-1194; 3396, C8orf59, 16978, 119428, 620-756; 3396, C8orf59, 16979, 119429, 248-433; 3396, C8orf59, 16980, 119430, 66-251; 3396, C8orf59, 16977, 119427, 79-210; 3396, C8orf59, 16981, 119431, 115-417; 3396, C8orf59, 16982, 119432, 177-479; 3396, C8orf59, 16983, 119433, 211-513; 3396, C8orf59, 16984, 119434, 73-375; 3396, C8orf59, 16985, 119435, 204-506; 3397, C8orf74, 16987, 119437, 1-298; 3397, C8orf74, 16988, 119438, 6-305; 3397, C8orf74, 16989, 119439, 14-313; 3397, C8orf74, 16986, 119436, 30-914; 3398, C8orf76, 16990, 119440, 53-1195; 3399, C8orf82, 16991, 119441, 177-437; 3399, C8orf82, 16993, 119443, 1-401; 3399, C8orf82, 16995, 119445, 1-784; 3399, C8orf82, 16992, 119442, 217-867; 3399, C8orf82, 16994, 119444, 217-867; 3400, C8orf86, 16996, 119446, 26-697; 3400, C8orf86, 16997, 119447, 21-443; 3401, C8orf86, 16998, 119448, 171-524; 3402, C8orf89, 16999, 119449, 45-272; 3402, C8orf89, 17000, 119450, 45-341; 3402, C8orf89, 17001, 119451, 45-530; 3403, C9orf114, 17003, 119453, 1-264; 3403, C9orf114, 17004, 119454, 42-1208; 3403, C9orf114, 17002, 119452, 42-1172; 3404, C9orf116, 17008, 119458, 1-212; 3404, C9orf116, 17005, 119455, 668-946; 3404, C9orf116, 17006, 119456, 171-449; 3404, C9orf116, 17007, 119457, 22-432; 3405, C9orf129, 17009, 119459, 365-955; 3406, C9orf131, 17012, 119462, 43-810; 3406, C9orf131, 17014, 119464, 1-29; 3406, C9orf131, 17015, 119465, 352-395; 3406, C9orf131, 17016, 119466, 540-579; 3406, C9orf131, 17010, 119460, 48-3287; 3406, C9orf131, 17011, 119461, 51-3071; 3406, C9orf131, 17013, 119463, 51-3146; 3407, C9orf135, 17019, 119469, 1-448; 3407, C9orf135, 17020, 119470, 1-113; 3407, C9orf135, 17021, 119471, 54-206; 3407, C9orf135, 17022, 119472, 53-205; 3407, C9orf135, 17017, 119467, 88-777; 3407, C9orf135, 17018, 119468, 54-533; 3408, C9orf142, 17023, 119473, 27-641; 3409, C9orf152, 17024, 119474, 611-1330; 3410, C9orf153, 17025, 119475, 135-422; 3410, C9orf153, 17026, 119476, 82-387; 3410, C9orf153, 17027, 119477, 28-315; 3410, C9orf153, 17028, 119478, 28-333; 3411, C9orf16, 17029, 119479, 149-400; 3412, C9orf172, 17030, 119480, 1-2931; 3413, C9orf173, 17034, 119484, 1-252; 3413, C9orf173, 17035, 119485, 27-788; 3413, C9orf173, 17036, 119486, 26-418; 3413, C9orf173, 17031, 119481, 27-1187; 3413, C9orf173, 17032, 119482, 27-953; 3413, C9orf173, 17033, 119483, 2-997; 3414, C9orf24, 17042, 119492, 1-376; 3414, C9orf24, 17037, 119487, 200-988; 3414, C9orf24, 17038, 119488, 97-591; 3414, C9orf24, 17039, 119489, 104-439; 3414, C9orf24, 17040, 119490, 45-539; 3414, C9orf24, 17041, 119491, 166-549; 3415, C9orf3, 17046, 119496, 1-423; 3415, C9orf3, 17047, 119497, 1-1806; 3415, C9orf3, 17048, 119498, 1-1527; 3415, C9orf3, 17049, 119499, 1-436; 3415, C9orf3, 17050, 119500, 1-553; 3415, C9orf3, 17051, 119501, 1-541; 3415, C9orf3, 17043, 119493, 187-1887; 3415, C9orf3, 17044, 119494, 176-2338; 3415, C9orf3, 17045, 119495, 136-2595; 3416, C9orf40, 17052, 119502, 276-860; 3417, C9orf43, 17053, 119503, 447-1832; 3417, C9orf43, 17054, 119504, 366-1751; 3418, C9orf47, 17056, 119506, 76-783; 3418, C9orf47, 17055, 119505, 69-677; 3418, C9orf47, 17057, 119507, 134-685; 3419, C9orf50, 17059, 119509, 509-718; 3419, C9orf50, 17058, 119508, 203-1498; 3420, C9orf57, 17060, 119510, 97-582; 3420, C9orf57, 17061, 119511, 1-384; 3421, C9orf64, 17062, 119512, 268-870; 3421, C9orf64, 17063, 119513, 251-433; 3421, C9orf64, 17064, 119514, 218-1243; 3422, C9orf66, 17065, 119515, 346-1233; 3423, C9orf69, 17068, 119518, 534-648; 3423, C9orf69, 17070, 119520, 492-588; 3423, C9orf69, 17066, 119516, 485-904; 3423, C9orf69, 17067, 119517, 504-923; 3423, C9orf69, 17069, 119519, 175-594; 3424, C9orf72, 17071, 119521, 77-745; 3424, C9orf72, 17072, 119522, 125-793; 3424, C9orf72, 17073, 119523, 65-1510; 3424, C9orf72, 17074, 119524, 203-1648; 3425, C9orf78, 17076, 119526, 286-813; 3425, C9orf78, 17075, 119525, 55-924; 3426, C9orf84, 17080, 119530, 246-4358; 3426, C9orf84, 17077, 119527, 130-4464; 3426, C9orf84, 17078, 119528, 146-1612; 3426, C9orf84, 17079, 119529, 136-4470; 3426, C9orf84, 17081, 119531, 246-4463; 3427, C9orf85, 17083, 119533, 1-68; 3427, C9orf85, 17085, 119535, 75-284; 3427, C9orf85, 17087, 119537, 95-229; 3427, C9orf85, 17082, 119532, 191-664; 3427, C9orf85, 17084, 119534, 191-730; 3427, C9orf85, 17086, 119536, 226-333; 3428, C9orf9, 17088, 119538, 155-661; 3428, C9orf9, 17089, 119539, 155-823; 3428, C9orf9, 17090, 119540, 448-1116; 3429, C9orf91, 17091, 119541, 438-1466; 3429, C9orf91, 17092, 119542, 438-1469; 3430, C9orf92, 17095, 119545, 1-219; 3430, C9orf92, 17093, 119543, 14-340; 3430, C9orf92, 17094, 119544, 115-348; 3431, CHAMP1, 17097, 119547, 160-596; 3431, CHAMP1, 17096, 119546, 310-2748; 3432, CHTF18, 17099, 119549, 61-2988; 3432, CHTF18, 17100, 119550, 61-1431; 3432, CHTF18, 17102, 119552, 1-790; 3432, CHTF18, 17103, 119553, 1-245; 3432, CHTF18, 17104, 119554, 62-373; 3432, CHTF18, 17105, 119555, 1-3555; 3432, CHTF18, 17098, 119548, 64-2991; 3432, CHTF18, 17101, 119551, 62-3073; 3433, CHTF8, 17109, 119559, 137-175; 3433, CHTF8, 17110, 119560, 99-137; 3433, CHTF8, 17111, 119561, 1-433; 3433, CHTF8, 17112, 119562, 35-211; 3433, CHTF8, 17113, 119563, 120-347; 3433, CHTF8, 17114, 119564, 1-314; 3433, CHTF8, 17115, 119565, 131-430; 3433, CHTF8, 17116, 119566, 1-198; 3433, CHTF8, 17106, 119556, 143-1717; 3433, CHTF8, 17107, 119557, 94-459; 3433, CHTF8, 17108, 119558, 123-488; 3434, CXorf21, 17117, 119567, 324-1229; 3435, CXorf23, 17118, 119568, 1-703; 3435, CXorf23, 17121, 119571, 284-1006; 3435, CXorf23, 17119, 119569, 35-2170; 3435, CXorf23, 17120, 119570, 35-2083; 3436, CXorf36, 17122, 119572, 76-624; 3436, CXorf36, 17123, 119573, 76-1377; 3437, CXorf38, 17124, 119574, 28-987; 3437, CXorf38, 17125, 119575, 1551-2153; 3437, CXorf38, 17126, 119576, 599-1201; 3438, CXorf40A, 17129, 119579, 528-968; 3438, CXorf40A, 17132, 119582, 568-1008; 3438, CXorf40A, 17133, 119583, 371-460; 3438, CXorf40A, 17134, 119584, 314-754; 3438, CXorf40A, 17136, 119586, 250-540; 3438, CXorf40A, 17127, 119577, 154-630; 3438, CXorf40A, 17128, 119578, 600-1076; 3438, CXorf40A, 17130, 119580, 580-1056; 3438, CXorf40A, 17131, 119581, 1588-2064; 3438, CXorf40A, 17135, 119585, 540-1016; 3438, CXorf40A, 17137, 119587, 381-857; 3439, CXorf40B, 17141, 119591, 454-894; 3439, CXorf40B, 17142, 119592, 688-1129; 3439, CXorf40B, 17143, 119593, 672-808; 3439, CXorf40B, 17138, 119588, 245-721; 3439, CXorf40B, 17139, 119589, 497-973; 3439, CXorf40B, 17140, 119590, 830-1306; 3440, CXorf49, 17144, 119594, 1-1545; 3441, CXorf49B, 17145, 119595, 1-1545; 3442, CXorf56, 17146, 119596, 273-794; 3442, CXorf56, 17147, 119597, 54-680; 3443, CXorf57, 17150, 119600, 1-1701; 3443, CXorf57, 17148, 119598, 152-2428; 3443, CXorf57, 17149, 119599, 110-2677; 3443, CXorf57, 17151, 119601, 107-1810; 3444, CXorf58, 17153, 119603, 1-379; 3444, CXorf58, 17152, 119602, 550-1548; 3445, CXorf65, 17155, 119605, 233-361; 3445, CXorf65, 17154, 119604, 50-601; 3446, CXorf66, 17156, 119606, 25-1110; 3447, CXorf67, 17157, 119607, 103-1614; 3448, CLLU1, 17158, 119608, 723-1088; 3449, CLLU1OS, 17159, 119609, 3-308; 3450, CHURC1-FNTB, 17160, 119610, 4-1419; 3450, CHURC1-FNTB, 17161, 119611, 1-323; 3450, CHURC1-FNTB, 17162, 119612, 1-258; 3450, CHURC1-FNTB, 17163, 119613, 1-207; 3451, CHURC1, 17164, 119614, 53-379; 3451, CHURC1, 17165, 119615, 1-379; 3451, CHURC1, 17166, 119616, 1-251; 3451, CHURC1, 17168, 119618, 1-287; 3451, CHURC1, 17169, 119619, 73-411; 3451, CHURC1, 17167, 119617, 55-474; 3451, CHURC1, 17170, 119620, 1-318; 3451, CHURC1, 17171, 119621, 55-477; 3452, CMA1, 17172, 119622, 213-623; 3452, CMA1, 17173, 119623, 31-774; 3453, CTRC, 17174, 119624, 24-233; 3453, CTRC, 17175, 119625, 27-833; 3454, CTRL, 17177, 119627, 11-580; 3454, CTRL, 17178, 119628, 11-582; 3454, CTRL, 17176, 119626, 563-1357; 3455, CELA1, 17179, 119629, 42-818; 3456, CELA2A, 17180, 119630, 26-835; 3457, CELA2B, 17182, 119632, 1-377; 3457, CELA2B, 17181, 119631, 26-835; 3458, CELA3A, 17184, 119634, 16-381; 3458, CELA3A, 17185, 119635, 1-228; 3458, CELA3A, 17183, 119633, 20-832; 3459, CELA3B, 17187, 119637, 4-497; 3459, CELA3B, 17188, 119638, 1-543; 3459, CELA3B, 17186, 119636, 20-832; 3460, CTRB1, 17190, 119640, 35-581; 3460, CTRB1, 17189, 119639, 9-800; 3461, CTRB2, 17192, 119642, 1-507; 3461, CTRB2, 17193, 119643, 1-414; 3461, CTRB2, 17194, 119644, 1-345; 3461, CTRB2, 17191, 119641, 45-836; 3462, CFAP54, 17196, 119646, 1-796; 3462, CFAP54, 17197, 119647, 36-1967; 3462, CFAP54, 17195, 119645, 24-9314; 3463, CFAP100, 17200, 119650, 93-446; 3463, CFAP100, 17198, 119648, 100-1935; 3463, CFAP100, 17199, 119649, 30-1868; 3464, CFAP126, 17201, 119651, 7-540; 3465, CFAP157, 17204, 119654, 1-409; 3465, CFAP157, 17202, 119652, 41-1603; 3465, CFAP157, 17203, 119653, 14-1291; 3466, CFAP161, 17206, 119656, 241-574; 3466, CFAP161, 17207, 119657, 256-572; 3466, CFAP161, 17205, 119655, 84-989; 3467, CFAP20, 17209, 119659, 247-572; 3467, CFAP20, 17208, 119658, 336-917; 3468, CFAP206, 17211, 119661, 296-1050; 3468, CFAP206, 17212, 119662, 66-353; 3468, CFAP206, 17210, 119660, 113-1981; 3469, CFAP221, 17213, 119663, 127-936; 3469, CFAP221, 17214, 119664, 110-271; 3469, CFAP221, 17216, 119666, 1-290; 3469, CFAP221, 17217, 119667, 253-779; 3469, CFAP221, 17218, 119668, 1-1199; 3469, CFAP221, 17219, 119669, 1-521; 3469, CFAP221, 17220, 119670, 110-514; 3469, CFAP221, 17221, 119671, 88-360; 3469, CFAP221, 17222, 119672, 1-355; 3469, CFAP221, 17223, 119673, 1-266; 3469, CFAP221, 17224, 119674, 1-141; 3469, CFAP221, 17215, 119665, 88-2610; 3469, CFAP221, 17225, 119675, 74-637; 3470, CFAP36, 17228, 119678, 113-1054; 3470, CFAP36, 17229, 119679, 157-813; 3470, CFAP36, 17230, 119680, 72-743; 3470, CFAP36, 17226, 119676, 149-1177; 3470, CFAP36, 17227, 119677, 199-1302; 3471, CFAP43, 17231, 119681, 327-2939; 3471, CFAP43, 17233, 119683, 305-1216; 3471, CFAP43, 17234, 119684, 270-1508; 3471, CFAP43, 17235, 119685, 1-2993; 3471, CFAP43, 17236, 119686, 1-1544; 3471, CFAP43, 17232, 119682, 117-5114; 3472, CFAP44, 17239, 119689, 1-2974; 3472, CFAP44, 17240, 119690, 1-169; 3472, CFAP44, 17241, 119691, 1-81; 3472, CFAP44, 17242, 119692, 1-1259; 3472, CFAP44, 17243, 119693, 1-358; 3472, CFAP44, 17244, 119694, 472-724; 3472, CFAP44, 17245, 119695, 67-180; 3472, CFAP44, 17246, 119696, 1-31; 3472, CFAP44, 17237, 119687, 164-3112; 3472, CFAP44, 17238, 119688, 68-5632; 3473, CFAP45, 17249, 119699, 473-896; 3473, CFAP45, 17250, 119700, 28-1323; 3473, CFAP45, 17247, 119697, 66-1721; 3473, CFAP45, 17248, 119698, 457-1857; 3474, CFAP46, 17253, 119703, 1-461; 3474, CFAP46, 17251, 119701, 340-1557; 3474, CFAP46, 17252, 119702, 102-8249; 3475, CFAP47, 17254, 119704, 67-2997; 3475, CFAP47, 17255, 119705, 41-1549; 3475, CFAP47, 17256, 119706, 67-9630; 3475, CFAP47, 17257, 119707, 695-2596; 3475, CFAP47, 17258, 119708, 20-2284; 3475, CFAP47, 17259, 119709, 1-269; 3476, CFAP52, 17262, 119712, 27-155; 3476, CFAP52, 17263, 119713, 27-122; 3476, CFAP52, 17264, 119714, 53-199; 3476, CFAP52, 17265, 119715, 55-150; 3476, CFAP52, 17266, 119716, 1-280; 3476, CFAP52, 17267, 119717, 15-398; 3476, CFAP52, 17260, 119710, 70-1932; 3476, CFAP52, 17261, 119711, 70-1728; 3477, CFAP53, 17268, 119718, 119-1663; 3478, CFAP57, 17270, 119720, 1-235; 3478, CFAP57, 17271, 119721, 52-243; 3478, CFAP57, 17272, 119722, 79-576; 3478, CFAP57, 17273, 119723, 63-254; 3478, CFAP57, 17275, 119725, 147-3998; 3478, CFAP57, 17269, 119719, 325-4077; 3478, CFAP57, 17274, 119724, 147-2243; 3479, CFAP58, 17276, 119726, 1-279; 3479, CFAP58, 17277, 119727, 135-2753; 3480, CFAP61, 17279, 119729, 74-1185; 3480, CFAP61, 17281, 119731, 113-679; 3480, CFAP61, 17285, 119735, 1-683; 3480, CFAP61, 17286, 119736, 100-303; 3480, CFAP61, 17288, 119738, 163-569; 3480, CFAP61, 17289, 119739, 43-210; 3480, CFAP61, 17290, 119740, 61-542; 3480, CFAP61, 17278, 119728, 77-3790; 3480, CFAP61, 17280, 119730, 70-672; 3480, CFAP61, 17282, 119732, 77-1489; 3480, CFAP61, 17283, 119733, 130-1092; 3480, CFAP61, 17284, 119734, 4-606; 3480, CFAP61, 17287, 119737, 9-1421; 3481, CFAP69, 17292, 119742, 1-1437; 3481, CFAP69, 17293, 119743, 1-1545; 3481, CFAP69, 17294, 119744, 1-269; 3481, CFAP69, 17295, 119745, 231-590; 3481, CFAP69, 17297, 119747, 1-280; 3481, CFAP69, 17298, 119748, 1-511; 3481, CFAP69, 17291, 119741, 252-3077; 3481, CFAP69, 17296, 119746, 215-904; 3481, CFAP69, 17299, 119749, 211-2982; 3482, CFAP70, 17301, 119751, 105-1190; 3482, CFAP70, 17302, 119752, 1706-3478; 3482, CFAP70, 17303, 119753, 474-1013; 3482, CFAP70, 17304, 119754, 1-1497; 3482, CFAP70, 17300, 119750, 122-2487; 3483, CFAP73, 17306, 119756, 1-372; 3483, CFAP73, 17305, 119755, 1-927; 3484, CFAP74, 17307, 119757, 1-279; 3484, CFAP74, 17308, 119758, 157-4911; 3485, CFAP77, 17310, 119760, 230-826; 3485, CFAP77, 17309, 119759, 49-1011; 3485, CFAP77, 17311, 119761, 45-899; 3486, CFAP97, 17312, 119762, 85-279; 3486, CFAP97, 17314, 119764, 254-682; 3486, CFAP97, 17313, 119763, 121-1719; 3486, CFAP97, 17315, 119765, 261-1622; 3487, CFAP99, 17316, 119766, 1-1941; 3488, N/A, 17318, 119768, 138-2282; 3488, N/A, 17317, 119767, 4-1383; 3489, CNTF, 17319, 119769, 81-683; 3490, CNTFR, 17322, 119772, 154-921; 3490, CNTFR, 17320, 119770, 153-1271; 3490, CNTFR, 17321, 119771, 295-1413; 3490, CNTFR, 17323, 119773, 171-1289; 3491, CR000, 17325, 119775, 1-3931; 3491, CR000, 17326, 119776, 1-614; 3491, CR000, 17327, 119777, 1-2515; 3491, CR000, 17324, 119774, 70-6123; 3492, CR0002, 17328, 119778, 185-5152; 3493, CATIP, 17329, 119779, 30-1193; 3494, CGN, 17331, 119781, 1-394; 3494, CGN, 17332, 119782, 266-1138; 3494, CGN, 17333, 119783, 80-589; 3494, CGN, 17334, 119784, 55-564; 3494, CGN, 17330, 119780, 134-3745; 3495, CGNL1, 17335, 119785, 79-3987; 3496, CIART, 17337, 119787, 147-1040; 3496, CIART, 17339, 119789, 123-838; 3496, CIART, 17340, 119790, 95-771; 3496, CIART, 17336, 119786, 450-1607; 3496, CIART, 17338, 119788, 137-1294; 3497, CIRH1A, 17343, 119793, 143-586; 3497, CIRH1A, 17344, 119794, 1-636; 3497, CIRH1A, 17346, 119796, 1-2103; 3497, CIRH1A, 17348, 119798, 34-581; 3497, CIRH1A, 17349, 119799, 327-562; 3497, CIRH1A, 17350, 119800, 154-747; 3497, CIRH1A, 17351, 119801, 168-595; 3497, CIRH1A, 17352, 119802, 1-1352; 3497, CIRH1A, 17353, 119803, 1-1535; 3497, CIRH1A, 17354, 119804, 1-212; 3497, CIRH1A, 17355, 119805, 1-1190; 3497, CIRH1A, 17356, 119806, 1-151; 3497, CIRH1A, 17357, 119807, 1-636; 3497, CIRH1A, 17341, 119791, 178-2238; 3497, CIRH1A, 17342, 119792, 43-1758; 3497, CIRH1A, 17345, 119795, 35-1912; 3497, CIRH1A, 17347, 119797, 1-1535; 3498, CLYBL, 17361, 119811, 1-270; 3498, CLYBL, 17362, 119812, 1-312; 3498, CLYBL, 17363, 119813, 1-444; 3498, CLYBL, 17364, 119814, 1-546; 3498, CLYBL, 17358, 119808, 1-1023; 3498, CLYBL, 17359, 119809, 7-927; 3498, CLYBL, 17360, 119810, 28-1050; 3499, CS, 17366, 119816, 256-1617; 3499, CS, 17367, 119817, 1-573; 3499, CS, 17368, 119818, 472-1674; 3499, CS, 17369, 119819, 405-646; 3499, CS, 17370, 119820, 108-580; 3499, CS, 17371, 119821, 117-344; 3499, CS, 17372, 119822, 116-542; 3499, CS, 17373, 119823, 115-561; 3499, CS, 17374, 119824, 552-751; 3499, CS, 17375, 119825, 54-589; 3499, CS, 17376, 119826, 304-656; 3499, CS, 17377, 119827, 133-553; 3499, CS, 17378, 119828, 314-747; 3499, CS, 17379, 119829, 1-372; 3499, CS, 17380, 119830, 436-797; 3499, CS, 17381, 119831, 176-571; 3499, CS, 17382, 119832, 118-267; 3499, CS, 17383, 119833, 560-903; 3499, CS, 17384, 119834, 255-676; 3499, CS, 17385, 119835, 311-744; 3499, CS, 17386, 119836, 130-568; 3499, CS, 17365, 119815, 192-1592; 3500, CIT, 17388, 119838, 1-4922; 3500, CIT, 17390, 119840, 1-329; 3500, CIT, 17391, 119841, 192-677; 3500, CIT, 17387, 119837, 54-6137; 3500, CIT, 17389, 119839, 57-6266; 3500, CIT, 17392, 119842, 54-1502; 3501, CKLF-CMTM1, 17393, 119843, 1-195; 3501, CKLF-CMTM1, 17394, 119844, 68-250; 3501, CKLF-CMTM1, 17395, 119845, 104-451; 3501, CKLF-CMTM1, 17396, 119846, 130-231; 3501, CKLF-CMTM1, 17397, 119847, 38-544; 3501, CKLF-CMTM1, 17398, 119848, 38-316; 3502, CMTM1, 17399, 119849, 1-696; 3502, CMTM1, 17405, 119855, 1-394; 3502, CMTM1, 17407, 119857, 1-394; 3502, CMTM1, 17411, 119861, 1-394; 3502, CMTM1, 17412, 119862, 235-447; 3502, CMTM1, 17414, 119864, 1-394; 3502, CMTM1, 17415, 119865, 1-394; 3502, CMTM1, 17417, 119867, 84-800; 3502, CMTM1, 17400, 119850, 122-490; 3502, CMTM1, 17401, 119851, 122-397; 3502, CMTM1, 17402, 119852, 122-472; 3502, CMTM1, 17403, 119853, 68-928; 3502, CMTM1, 17404, 119854, 122-631; 3502, CMTM1, 17406, 119856, 122-238; 3502, CMTM1, 17408, 119858, 122-220; 3502, CMTM1, 17409, 119859, 122-466; 3502, CMTM1, 17410, 119860, 122-307; 3502, CMTM1, 17413, 119863, 122-208; 3502, CMTM1, 17416, 119866, 122-397; 3502, CMTM1, 17418, 119868, 122-238; 3503, CMTM2, 17421, 119871, 149-304; 3503, CMTM2, 17419, 119869, 152-898; 3503, CMTM2, 17420, 119870, 161-748; 3504, CMTM3, 17424, 119874, 426-792; 3504, CMTM3, 17428, 119878, 112-460; 3504, CMTM3, 17429, 119879, 75-527; 3504, CMTM3, 17430, 119880, 159-449; 3504, CMTM3, 17431, 119881, 170-460; 3504, CMTM3, 17432, 119882, 266-556; 3504, CMTM3, 17433, 119883, 252-542; 3504, CMTM3, 17434, 119884, 327-566; 3504, CMTM3, 17435, 119885, 66-563; 3504, CMTM3, 17422, 119872, 356-904; 3504, CMTM3, 17423, 119873, 527-1075; 3504, CMTM3, 17425, 119875, 102-650; 3504, CMTM3, 17426, 119876, 143-691; 3504, CMTM3, 17427, 119877, 75-254; 3505, CMTM4, 17439, 119889, 1-423; 3505, CMTM4, 17436, 119886, 183-887; 3505, CMTM4, 17437, 119887, 183-809; 3505, CMTM4, 17438, 119888, 183-722; 3506, CMTM5, 17445, 119895, 190-546; 3506, CMTM5, 17440, 119890, 216-440; 3506, CMTM5, 17441, 119891, 217-888; 3506, CMTM5, 17442, 119892, 445-915; 3506, CMTM5, 17443, 119893, 1-378; 3506, CMTM5, 17444, 119894, 216-533; 3507, CMTM6, 17446, 119896, 664-1215; 3508, CMTM7, 17449, 119899, 19-474; 3508, CMTM7, 17450, 119900, 1-492; 3508, CMTM7, 17451, 119901, 1-134; 3508, CMTM7, 17447, 119897, 210-638; 3508, CMTM7, 17448, 119898, 237-764; 3509, CMTM8, 17452, 119902, 295-816; 3509, CMTM8, 17453, 119903, 295-642; 3510, CLRN1, 17457, 119907, 587-704; 3510, CLRN1, 17458, 119908, 377-722; 3510, CLRN1, 17454, 119904, 393-755; 3510, CLRN1, 17455, 119905, 292-990; 3510, CLRN1, 17456, 119906, 1-738; 3511, CLRN2, 17459, 119909, 103-801; 3512, CLRN3, 17460, 119910, 164-844; 3513, CLSPN, 17464, 119914, 59-3919; 3513, CLSPN, 17461, 119911, 98-4096; 3513, CLSPN, 17462, 119912, 59-4078; 3513, CLSPN, 17463, 119913, 59-3886; 3514, CIITA, 17465, 119915, 134-3526; 3514, CIITA, 17467, 119917, 95-626; 3514, CIITA, 17468, 119918, 109-627; 3514, CIITA, 17469, 119919, 116-2770; 3514, CIITA, 17470, 119920, 134-1195; 3514, CIITA, 17471, 119921, 134-3529; 3514, CIITA, 17466, 119916, 122-1762; 3515, CLHC1, 17474, 119924, 291-430; 3515, CLHC1, 17476, 119926, 1-150; 3515, CLHC1, 17477, 119927, 448-499; 3515, CLHC1, 17478, 119928, 122-400; 3515, CLHC1, 17479, 119929, 375-616; 3515, CLHC1, 17472, 119922, 347-2107; 3515, CLHC1, 17473, 119923, 262-1656; 3515, CLHC1, 17475, 119925, 238-1998; 3516, CLINT1, 17483, 119933, 1-166; 3516, CLINT1, 17484, 119934, 1-399; 3516, CLINT1, 17486, 119936, 1-199; 3516, CLINT1, 17480, 119930, 206-2083; 3516, CLINT1, 17481, 119931, 207-2084; 3516, CLINT1, 17482, 119932, 174-2105; 3516, CLINT1, 17485, 119935, 108-1985; 3517, CLTC, 17489, 119939, 1-395; 3517, CLTC, 17490, 119940, 201-2039; 3517, CLTC, 17491, 119941, 209-575; 3517, CLTC, 17492, 119942, 1-73; 3517, CLTC, 17493, 119943, 190-483; 3517, CLTC, 17494, 119944, 1-665; 3517, CLTC, 17495, 119945, 444-5483; 3517, CLTC, 17487, 119937, 275-5302; 3517, CLTC, 17488, 119938, 275-5194; 3518, CLTCL1, 17496, 119946, 1-132; 3518, CLTCL1, 17498, 119948, 76-582; 3518, CLTCL1, 17499, 119949, 1-204; 3518, CLTCL1, 17500, 119950, 91-1200; 3518, CLTCL1, 17501, 119951, 21-3803; 3518, CLTCL1, 17502, 119952, 89-1480; 3518, CLTCL1, 17497, 119947, 74-4996; 3518, CLTCL1, 17503, 119953, 45-4796; 3519, CLTA, 17508, 119958, 95-685; 3519, CLTA, 17509, 119959, 127-909; 3519, CLTA, 17513, 119963, 1-195; 3519, CLTA, 17504, 119954, 135-791; 3519, CLTA, 17505, 119955, 121-867; 3519, CLTA, 17506, 119956, 95-805; 3519, CLTA, 17507, 119957, 202-948; 3519, CLTA, 17510, 119960, 126-818; 3519, CLTA, 17511, 119961, 202-702; 3519, CLTA, 17512, 119962, 202-894; 3520, CLTB, 17516, 119966, 177-581; 3520, CLTB, 17517, 119967, 1-246; 3520, CLTB, 17518, 119968, 176-552; 3520, CLTB, 17514, 119964, 207-896; 3520, CLTB, 17515, 119965, 207-842; 3521, CLDN1, 17519, 119969, 270-905; 3522, CLDN10, 17521, 119971, 9-230; 3522, CLDN10, 17520, 119970, 30-716; 3522, CLDN10, 17522, 119972, 231-911; 3523, CLDN11, 17524, 119974, 200-697; 3523, CLDN11, 17523, 119973, 203-826; 3524, CLDN12, 17526, 119976, 285-846; 3524, CLDN12, 17528, 119978, 240-618; 3524, CLDN12, 17529, 119979, 637-1163; 3524, CLDN12, 17525, 119975, 288-1022; 3524, CLDN12, 17527, 119977, 211-945; 3524, CLDN12, 17530, 119980, 364-1098; 3525, CLDN14, 17531, 119981, 379-1098; 3525, CLDN14, 17532, 119982, 678-1397; 3525, CLDN14, 17533, 119983, 256-975; 3525, CLDN14, 17534, 119984, 868-1587; 3525, CLDN14, 17535, 119985, 157-876; 3526, CLDN15, 17538, 119988, 180-691; 3526, CLDN15, 17539, 119989, 189-632; 3526, CLDN15, 17540, 119990, 1-319; 3526, CLDN15, 17541, 119991, 366-752; 3526, CLDN15, 17536, 119986, 366-1052; 3526, CLDN15, 17537, 119987, 1127-1813; 3527, CLDN16, 17543, 119993, 1-360; 3527, CLDN16, 17542, 119992, 249-1166; 3528, CLDN17, 17544, 119994, 140-814; 3529, CLDN18, 17547, 119997, 11-451; 3529, CLDN18, 17545, 119995, 227-1012; 3529, CLDN18, 17546, 119996, 135-920; 3530, CLDN19, 17548, 119998, 192-866; 3530, CLDN19, 17549, 119999, 78-713; 3530, CLDN19, 17550, 120000, 192-848; 3531, CLDN2, 17551, 120001, 327-1019; 3531, CLDN2, 17552, 120002, 520-1212; 3531, CLDN2, 17553, 120003, 289-981; 3532, CLDN20, 17554, 120004, 381-1040; 3533, CLDN22, 17555, 120005, 557-1219; 3534, CLDN23, 17556, 120006, 462-1340; 3535, CLDN24, 17557, 120007, 7-597; 3535, CLDN24, 17558, 120008, 1-663; 3536, CLDN25, 17559, 120009, 50-739; 3537, CLDN3, 17560, 120010, 222-884; 3538, CLDN34, 17561, 120011, 1-645; 3539, CLDN4, 17562, 120012, 340-969; 3539, CLDN4, 17563, 120013, 2627-3256; 3539, CLDN4, 17564, 120014, 2681-3310; 3540, CLDN5, 17565, 120015, 874-1785; 3540, CLDN5, 17566, 120016, 1062-1973; 3540, CLDN5, 17567, 120017, 302-1213; 3540, CLDN5, 17568, 120018, 146-802; 3541, CLDN6, 17571, 120021, 44-163; 3541, CLDN6, 17569, 120019, 61-723; 3541, CLDN6, 17570, 120020, 430-1092; 3542, CLDN7, 17574, 120024, 903-1340; 3542, CLDN7, 17575, 120025, 187-485; 3542, CLDN7, 17576, 120026, 25-605; 3542, CLDN7, 17577, 120027, 301-723; 3542, CLDN7, 17578, 120028, 356-743; 3542, CLDN7, 17572, 120022, 436-1071; 3542, CLDN7, 17573, 120023, 356-991; 3543, CLDN8, 17579, 120029, 149-826; 3544, CLDN9, 17580, 120030, 908-1561; 3545, CLDND1, 17583, 120033, 164-994; 3545, CLDND1, 17585, 120035, 148-865; 3545, CLDND1, 17587, 120037, 207-916; 3545, CLDND1, 17588, 120038, 1-468; 3545, CLDND1, 17589, 120039, 159-791; 3545, CLDND1, 17590, 120040, 123-663; 3545, CLDND1, 17591, 120041, 375-1013; 3545, CLDND1, 17593, 120043, 33-296; 3545, CLDND1, 17594, 120044, 202-871; 3545, CLDND1, 17595, 120045, 272-573; 3545, CLDND1, 17596, 120046, 97-417; 3545, CLDND1, 17598, 120048, 373-903; 3545, CLDND1, 17599, 120049, 122-556; 3545, CLDND1, 17600, 120050, 129-862; 3545, CLDND1, 17601, 120051, 1-219; 3545, CLDND1, 17603, 120053, 146-414; 3545, CLDND1, 17604, 120054, 218-582; 3545, CLDND1, 17605, 120055, 125-539; 3545, CLDND1, 17606, 120056, 165-681; 3545, CLDND1, 17581, 120031, 214-975; 3545, CLDND1, 17582, 120032, 288-1049; 3545, CLDND1, 17584, 120034, 222-983; 3545, CLDND1, 17586, 120036, 881-1642; 3545, CLDND1, 17592, 120042, 191-952; 3545, CLDND1, 17597, 120047, 51-527; 3545, CLDND1, 17602, 120052, 232-993; 3546, CLDND2, 17608, 120058, 1-328; 3546, CLDND2, 17607, 120057, 427-930; 3546, CLDND2, 17609, 120059, 30-533; 3547, CLVS1, 17611, 120061, 704-709; 3547, CLVS1, 17613, 120063, 316-552; 3547, CLVS1, 17614, 120064, 552-582; 3547, CLVS1, 17615, 120065, 484-661; 3547, CLVS1, 17616, 120066, 550-777; 3547, CLVS1, 17610, 120060, 319-1383; 3547, CLVS1, 17612, 120062, 473-1537; 3548, CLVS2, 17617, 120067, 1336-2319; 3548, CLVS2, 17618, 120068, 108-653; 3549, CLP1, 17620, 120070, 157-553; 3549, CLP1, 17621, 120071, 55-1365; 3549, CLP1, 17623, 120073, 291-566; 3549, CLP1, 17619, 120069, 121-1206; 3549, CLP1, 17622, 120072, 726-2003; 3549, CLP1, 17624, 120074, 115-1392; 3550, CPSF1, 17625, 120075, 24-470; 3550, CPSF1, 17627, 120077, 1-506; 3550, CPSF1, 17628, 120078, 1-615; 3550, CPSF1, 17626, 120076, 131-4462; 3550, CPSF1, 17629, 120079, 76-4407; 3551, CPSF2, 17631, 120081, 1-806; 3551, CPSF2, 17632, 120082, 474-715; 3551, CPSF2, 17633, 120083, 238-426; 3551, CPSF2, 17630, 120080, 286-2634; 3552, CPSF3, 17635, 120085, 1139-3082; 3552, CPSF3, 17636, 120086, 464-871; 3552, CPSF3, 17634, 120084, 207-2261; 3553, CPSF3L, 17638, 120088, 66-1574; 3553, CPSF3L, 17639, 120089, 18-323; 3553, CPSF3L, 17641, 120091, 23-1056; 3553, CPSF3L, 17643, 120093, 21-161; 3553, CPSF3L, 17644, 120094, 1-104; 3553, CPSF3L, 17645, 120095, 59-337; 3553, CPSF3L, 17646, 120096, 52-800; 3553, CPSF3L, 17647, 120097, 41-877; 3553, CPSF3L, 17648, 120098, 1-165; 3553, CPSF3L, 17649, 120099, 53-223; 3553, CPSF3L, 17650, 120100, 43-231; 3553, CPSF3L, 17651, 120101, 1-166; 3553, CPSF3L, 17652, 120102, 253-579; 3553, CPSF3L, 17653, 120103, 51-296; 3553, CPSF3L, 17654, 120104, 64-485; 3553, CPSF3L, 17655, 120105, 1-194; 3553, CPSF3L, 17656, 120106, 123-750; 3553, CPSF3L, 17657, 120107, 53-554; 3553, CPSF3L, 17660, 120110, 587-1615; 3553, CPSF3L, 17661, 120111, 80-1249; 3553, CPSF3L, 17662, 120112, 59-928; 3553, CPSF3L, 17663, 120113, 80-1588; 3553, CPSF3L, 17664, 120114, 1-138; 3553, CPSF3L, 17637, 120087, 63-1799; 3553, CPSF3L, 17640, 120090, 46-1545; 3553, CPSF3L, 17642, 120092, 84-1886; 3553, CPSF3L, 17658, 120108, 274-1989; 3553, CPSF3L, 17659, 120109, 535-2355; 3554, CPSF4, 17666, 120116, 1-687; 3554, CPSF4, 17668, 120118, 138-773; 3554, CPSF4, 17669, 120119, 408-745; 3554, CPSF4, 17670, 120120, 67-201; 3554, CPSF4, 17671, 120121, 278-853; 3554, CPSF4, 17672, 120122, 1-578; 3554, CPSF4, 17665, 120115, 11-820; 3554, CPSF4, 17667, 120117, 162-896; 3555, CPSF4L, 17674, 120124, 334-792; 3555, CPSF4L, 17673, 120123, 63-602; 3556, CPSF6, 17676, 120126, 48-1484; 3556, CPSF6, 17678, 120128, 76-399; 3556, CPSF6, 17679, 120129, 6-176; 3556, CPSF6, 17675, 120125, 32-1798; 3556, CPSF6, 17677, 120127, 111-1766; 3557, CPSF7, 17682, 120132, 138-574; 3557, CPSF7, 17683, 120133, 137-567; 3557, CPSF7, 17684, 120134, 114-727; 3557, CPSF7, 17687, 120137, 157-571; 3557, CPSF7, 17688, 120138, 92-397; 3557, CPSF7, 17689, 120139, 65-722; 3557, CPSF7, 17690, 120140, 56-361; 3557, CPSF7, 17691, 120141, 111-1234; 3557, CPSF7, 17692, 120142, 90-953; 3557, CPSF7, 17693, 120143, 50-358; 3557, CPSF7, 17694, 120144, 131-436; 3557, CPSF7, 17695, 120145, 30-311; 3557, CPSF7, 17696, 120146, 121-423; 3557, CPSF7, 17697, 120147, 91-387; 3557, CPSF7, 17698, 120148, 1-306; 3557, CPSF7, 17680, 120130, 82-1626; 3557, CPSF7, 17681, 120131, 174-1589; 3557, CPSF7, 17685, 120135, 157-1545; 3557, CPSF7, 17686, 120136, 70-1458; 3558, CSTF1, 17700, 120150, 201-1236; 3558, CSTF1, 17701, 120151, 129-554; 3558, CSTF1, 17702, 120152, 198-1233; 3558, CSTF1, 17703, 120153, 166-345; 3558, CSTF1, 17704, 120154, 52-231; 3558, CSTF1, 17699, 120149, 353-1648; 3559, CSTF2, 17706, 120156, 59-1852; 3559, CSTF2, 17707, 120157, 83-757; 3559, CSTF2, 17708, 120158, 1-1317; 3559, CSTF2, 17705, 120155, 17-1750; 3560, CSTF2T, 17709, 120159, 43-1893; 3561, CSTF3, 17713, 120163, 136-693; 3561, CSTF3, 17714, 120164, 251-434; 3561, CSTF3, 17715, 120165, 171-329; 3561, CSTF3, 17716, 120166, 1-274; 3561, CSTF3, 17710, 120160, 141-2294; 3561, CSTF3, 17711, 120161, 207-518; 3561, CSTF3, 17712, 120162, 167-301; 3562, CLPTM1, 17720, 120170, 1-459; 3562, CLPTM1, 17721, 120171, 518-572; 3562, CLPTM1, 17722, 120172, 16-528; 3562, CLPTM1, 17723, 120173, 1-630; 3562, CLPTM1, 17717, 120167, 151-2160; 3562, CLPTM1, 17718, 120168, 466-2433; 3562, CLPTM1, 17719, 120169, 346-2049; 3563, CLASRP, 17724, 120174, 99-2123; 3563, CLASRP, 17727, 120177, 693-2660; 3563, CLASRP, 17728, 120178, 331-590; 3563, CLASRP, 17729, 120179, 89-334; 3563, CLASRP, 17730, 120180, 1-567; 3563, CLASRP, 17731, 120181, 1-396; 3563, CLASRP, 17725, 120175, 74-1858; 3563, CLASRP, 17726, 120176, 93-1931; 3564, CLOCK, 17734, 120184, 201-746; 3564, CLOCK, 17732, 120182, 252-2792; 3564, CLOCK, 17733, 120183, 927-3467; 3564, CLOCK, 17735, 120185, 647-3187; 3565, CIPC, 17737, 120187, 133-444; 3565, CIPC, 17738, 120188, 158-581; 3565, CIPC, 17739, 120189, 181-584; 3565, CIPC, 17740, 120190, 289-474; 3565, CIPC, 17741, 120191, 143-596; 3565, CIPC, 17742, 120192, 413-882; 3565, CIPC, 17736, 120186, 318-1517; 3566, CLPB, 17747, 120197, 37-1542; 3566, CLPB, 17749, 120199, 1-134; 3566, CLPB, 17750, 120200, 167-624; 3566, CLPB, 17751, 120201, 1-2139; 3566, CLPB, 17752, 120202, 1-228; 3566, CLPB, 17753, 120203, 118-564; 3566, CLPB, 17743, 120193, 175-2298; 3566, CLPB, 17744, 120194, 61-2007; 3566, CLPB, 17745, 120195, 449-2437; 3566, CLPB, 17746, 120196, 555-2075; 3566, CLPB, 17748, 120198, 124-2157; 3567, CLPTM1L, 17755, 120205, 15-1124; 3567, CLPTM1L, 17757, 120207, 446-1555; 3567, CLPTM1L, 17758, 120208, 15-1124; 3567, CLPTM1L, 17754, 120204, 259-1875; 3567, CLPTM1L, 17756, 120206, 259-1875; 3568, CLUH, 17761, 120211, 135-3844; 3568, CLUH, 17762, 120212, 90-583; 3568, CLUH, 17763, 120213, 161-433; 3568, CLUH, 17764, 120214, 326-545; 3568, CLUH, 17765, 120215, 1-480; 3568, CLUH, 17766, 120216, 1-3754; 3568, CLUH, 17759, 120209, 87-4016; 3568, CLUH, 17760, 120210, 107-4036; 3569, CLU, 17769, 120219, 57-303; 3569, CLU, 17770, 120220, 1-422; 3569, CLU, 17771, 120221, 180-426; 3569, CLU, 17772, 120222, 266-654; 3569, CLU, 17773, 120223, 696-791; 3569, CLU, 17774, 120224, 126-737; 3569, CLU, 17776, 120226, 174-580; 3569, CLU, 17777, 120227, 1-850; 3569, CLU, 17778, 120228, 167-583; 3569, CLU, 17779, 120229, 66-878; 3569, CLU, 17780, 120230, 148-1039; 3569, CLU, 17767, 120217, 407-1756; 3569, CLU, 17768, 120218, 316-1665; 3569, CLU, 17775, 120225, 787-2136; 3570, CLUAP1, 17781, 120231, 57-1355; 3570, CLUAP1, 17782, 120232, 1-86; 3570, CLUAP1, 17783, 120233, 136-588; 3570, CLUAP1, 17784, 120234, 88-692; 3570, CLUAP1, 17785, 120235, 62-169; 3570, CLUAP1, 17786, 120236, 87-212; 3570, CLUAP1, 17787, 120237, 51-1214; 3570, CLUAP1, 17790, 120240, 93-245; 3570, CLUAP1, 17791, 120241, 53-414; 3570, CLUAP1, 17788, 120238, 145-1386; 3570, CLUAP1, 17789, 120239, 80-823; 3571, CLUL1, 17794, 120244, 210-1766; 3571, CLUL1, 17795, 120245, 848-2323; 3571, CLUL1, 17797, 120247, 328-574; 3571, CLUL1, 17798, 120248, 1-103; 3571, CLUL1, 17799, 120249, 1-1557; 3571, CLUL1, 17792, 120242, 100-1500; 3571, CLUL1, 17793, 120243, 146-1546; 3571, CLUL1, 17796, 120246, 61-1461; 3572, CMIP, 17803, 120253, 370-2130; 3572, CMIP, 17804, 120254, 322-699; 3572, CMIP, 17805, 120255, 1-2037; 3572, CMIP, 17800, 120250, 224-2086; 3572, CMIP, 17801, 120251, 129-2168; 3572, CMIP, 17802, 120252, 73-2394; 3573, CMSS1, 17807, 120257, 79-753; 3573, CMSS1, 17808, 120258, 98-214; 3573, CMSS1, 17809, 120259, 1-247; 3573, CMSS1, 17810, 120260, 321-397; 3573, CMSS1, 17806, 120256, 147-986; 3573, CMSS1, 17811, 120261, 60-845; 3574, CDRT1, 17812, 120262, 1-902; 3574, CDRT1, 17814, 120264, 193-2337; 3574, CDRT1, 17816, 120266, 33-269; 3574, CDRT1, 17817, 120267, 33-296; 3574, CDRT1, 17818, 120268, 1-211; 3574, CDRT1, 17819, 120269, 13-744; 3574, CDRT1, 17813, 120263, 212-970; 3574, CDRT1, 17815, 120265, 1-2259; 3575, CDRT15, 17820, 120270, 104-472; 3575, CDRT15, 17821, 120271, 17-583; 3576, CDRT15L2, 17822, 120272, 21-866; 3577, CDRT4, 17823, 120273, 559-632; 3577, CDRT4, 17824, 120274, 282-740; 3578, CNDP2, 17827, 120277, 309-572; 3578, CNDP2, 17828, 120278, 1-330; 3578, CNDP2, 17830, 120280, 387-551; 3578, CNDP2, 17831, 120281, 127-574; 3578, CNDP2, 17832, 120282, 155-539; 3578, CNDP2, 17833, 120283, 387-1135; 3578, CNDP2, 17834, 120284, 153-567; 3578, CNDP2, 17835, 120285, 198-568; 3578, CNDP2, 17836, 120286, 316-582; 3578, CNDP2, 17837, 120287, 229-595; 3578, CNDP2, 17838, 120288, 96-510; 3578, CNDP2, 17839, 120289, 146-547; 3578, CNDP2, 17840, 120290, 49-661; 3578, CNDP2, 17841, 120291, 151-420; 3578, CNDP2, 17842, 120292, 1-375; 3578, CNDP2, 17843, 120293, 34-507; 3578, CNDP2, 17825, 120275, 317-1744; 3578, CNDP2, 17826, 120276, 114-1289; 3578, CNDP2, 17829, 120279, 163-1590; 3579, CNKSR3, 17844, 120294, 1-536; 3579, CNKSR3, 17845, 120295, 352-1779; 3579, CNKSR3, 17847, 120297, 1-2700; 3579, CNKSR3, 17846, 120296, 546-2213; 3580, COASY, 17851, 120301, 84-742; 3580, COASY, 17852, 120302, 354-625; 3580, COASY, 17853, 120303, 262-551; 3580, COASY, 17854, 120304, 276-570; 3580, COASY, 17855, 120305, 648-994; 3580, COASY, 17856, 120306, 98-539; 3580, COASY, 17857, 120307, 186-569; 3580, COASY, 17848, 120298, 457-2151; 3580, COASY, 17849, 120299, 85-1779; 3580, COASY, 17850, 120300, 126-1907; 3581, CARM1, 17860, 120310, 1-336; 3581, CARM1, 17861, 120311, 108-468; 3581, CARM1, 17862, 120312, 31-516; 3581, CARM1, 17863, 120313, 1-1030; 3581, CARM1, 17864, 120314, 1-531; 3581, CARM1, 17865, 120315, 1-279; 3581, CARM1, 17858, 120308, 191-2017; 3581, CARM1, 17859, 120309, 1-1758; 3582, COTL1, 17867, 120317, 270-491; 3582, COTL1, 17868, 120318, 1-145; 3582, COTL1, 17866, 120316, 164-592; 3583, F2, 17870, 120320, 59-1031; 3583, F2, 17871, 120321, 6-1757; 3583, F2, 17869, 120319, 57-1925; 3584, F2R, 17873, 120323, 110-418; 3584, F2R, 17872, 120322, 266-1543; 3585, F2RL1, 17875, 120325, 270-607; 3585, F2RL1, 17874, 120324, 207-1400; 3586, F2RL2, 17876, 120326, 205-1329; 3586, F2RL2, 17877, 120327, 120-1178; 3587, F2RL3, 17879, 120329, 1-342; 3587, F2RL3, 17878, 120328, 331-1488; 3588, F3, 17880, 120330, 165-1052; 3588, F3, 17881, 120331, 2-718; 3589, F9, 17882, 120332, 8-1393; 3589, F9, 17883, 120333, 1-1272; 3590, F5, 17884, 120334, 203-6892; 3590, F5, 17885, 120335, 203-6877; 3591, F7, 17888, 120338, 4-228; 3591, F7, 17889, 120339, 55-1203; 3591, F7, 17886, 120336, 52-1386; 3591, F7, 17887, 120337, 36-1436; 3592, F8, 17892, 120342, 52-545; 3592, F8, 17893, 120343, 124-791; 3592, F8, 17890, 120340, 161-811; 3592, F8, 17891, 120341, 202-7257; 3593, F8A1, 17894, 120344, 27-1142; 3594, F8A2, 17895, 120345, 1-1116; 3595, F8A3, 17896, 120346, 73-1188; 3596, F10, 17897, 120347, 43-1041; 3596, F10, 17899, 120349, 19-411; 3596, F10, 17900, 120350, 43-1047; 3596, F10, 17898, 120348, 39-1505; 3597, F11, 17901, 120351, 1-478; 3597, F11, 17904, 120354, 1-632; 3597, F11, 17905, 120355, 98-586; 3597, F11, 17902, 120352, 35-1750; 3597, F11, 17903, 120353, 353-2230; 3598, F12, 17906, 120356, 50-1897;

3599, F13A1, 17908, 120358, 1-308; 3599, F13A1, 17909, 120359, 1-443; 3599, F13A1, 17910, 120360, 167-582; 3599, F13A1, 17911, 120361, 36-592; 3599, F13A1, 17907, 120357, 267-2465; 3600, F1313, 17912, 120362, 45-2030; 3601, COPA, 17913, 120363, 231-3905; 3601, COPA, 17914, 120364, 79-3780; 3602, COPB1, 17917, 120367, 318-729; 3602, COPB1, 17918, 120368, 128-1584; 3602, COPB1, 17919, 120369, 181-576; 3602, COPB1, 17915, 120365, 302-3163; 3602, COPB1, 17916, 120366, 247-3108; 3603, COPB2, 17922, 120372, 405-635; 3603, COPB2, 17923, 120373, 297-629; 3603, COPB2, 17924, 120374, 1-534; 3603, COPB2, 17925, 120375, 91-548; 3603, COPB2, 17926, 120376, 462-729; 3603, COPB2, 17927, 120377, 1-355; 3603, COPB2, 17928, 120378, 590-848; 3603, COPB2, 17920, 120370, 183-2903; 3603, COPB2, 17921, 120371, 131-2764; 3604, COPE, 17932, 120382, 33-1028; 3604, COPE, 17933, 120383, 30-470; 3604, COPE, 17934, 120384, 41-964; 3604, COPE, 17929, 120379, 50-976; 3604, COPE, 17930, 120380, 16-786; 3604, COPE, 17931, 120381, 28-801; 3605, COPG1, 17936, 120386, 1-230; 3605, COPG1, 17937, 120387, 1-566; 3605, COPG1, 17938, 120388, 58-207; 3605, COPG1, 17935, 120385, 105-2729; 3606, COPG2, 17939, 120389, 38-2218; 3606, COPG2, 17940, 120390, 81-2696; 3607, COPZ1, 17943, 120393, 34-357; 3607, COPZ1, 17944, 120394, 26-313; 3607, COPZ1, 17945, 120395, 21-380; 3607, COPZ1, 17947, 120397, 346-615; 3607, COPZ1, 17948, 120398, 26-520; 3607, COPZ1, 17949, 120399, 134-548; 3607, COPZ1, 17950, 120400, 14-505; 3607, COPZ1, 17952, 120402, 34-630; 3607, COPZ1, 17953, 120403, 261-537; 3607, COPZ1, 17941, 120391, 38-571; 3607, COPZ1, 17942, 120392, 26-490; 3607, COPZ1, 17946, 120396, 26-508; 3607, COPZ1, 17951, 120401, 96-653; 3608, COPZ2, 17954, 120404, 1-425; 3608, COPZ2, 17955, 120405, 1-138; 3608, COPZ2, 17956, 120406, 129-157; 3608, COPZ2, 17957, 120407, 1-169; 3608, COPZ2, 17958, 120408, 1-240; 3608, COPZ2, 17959, 120409, 1-351; 3608, COPZ2, 17960, 120410, 6-638; 3609, CBWD1, 17964, 120414, 57-809; 3609, CBWD1, 17965, 120415, 261-494; 3609, CBWD1, 17968, 120418, 1-115; 3609, CBWD1, 17969, 120419, 44-526; 3609, CBWD1, 17970, 120420, 1-280; 3609, CBWD1, 17971, 120421, 1-153; 3609, CBWD1, 17972, 120422, 1-115; 3609, CBWD1, 17973, 120423, 48-224; 3609, CBWD1, 17974, 120424, 74-556; 3609, CBWD1, 17975, 120425, 84-626; 3609, CBWD1, 17976, 120426, 1-85; 3609, CBWD1, 17977, 120427, 40-1083; 3609, CBWD1, 17978, 120428, 1-58; 3609, CBWD1, 17961, 120411, 285-1364; 3609, CBWD1, 17962, 120412, 90-1277; 3609, CBWD1, 17963, 120413, 179-1366; 3609, CBWD1, 17966, 120416, 77-418; 3609, CBWD1, 17967, 120417, 53-1183; 3610, CBWD2, 17980, 120430, 79-255; 3610, CBWD2, 17981, 120431, 48-596; 3610, CBWD2, 17982, 120432, 82-624; 3610, CBWD2, 17983, 120433, 107-1237; 3610, CBWD2, 17979, 120429, 179-1366; 3611, CBWD3, 17985, 120435, 107-1237; 3611, CBWD3, 17986, 120436, 44-526; 3611, CBWD3, 17987, 120437, 88-264; 3611, CBWD3, 17988, 120438, 77-418; 3611, CBWD3, 17989, 120439, 79-255; 3611, CBWD3, 17990, 120440, 82-624; 3611, CBWD3, 17991, 120441, 144-1187; 3611, CBWD3, 17992, 120442, 84-626; 3611, CBWD3, 17993, 120443, 48-596; 3611, CBWD3, 17994, 120444, 48-224; 3611, CBWD3, 17995, 120445, 120-296; 3611, CBWD3, 17996, 120446, 179-721; 3611, CBWD3, 17984, 120434, 552-1739; 3612, CBWD5, 17997, 120447, 103-444; 3612, CBWD5, 17998, 120448, 141-317; 3612, CBWD5, 17999, 120449, 1909-2439; 3612, CBWD5, 18002, 120452, 54-1184; 3612, CBWD5, 18003, 120453, 50-1177; 3612, CBWD5, 18004, 120454, 1-532; 3612, CBWD5, 18005, 120455, 48-224; 3612, CBWD5, 18006, 120456, 72-554; 3612, CBWD5, 18007, 120457, 82-624; 3612, CBWD5, 18008, 120458, 84-626; 3612, CBWD5, 18009, 120459, 48-596; 3612, CBWD5, 18010, 120460, 120-296; 3612, CBWD5, 18000, 120450, 40-1083; 3612, CBWD5, 18001, 120451, 179-1366; 3613, CBWD7, 18012, 120462, 53-1183; 3613, CBWD7, 18013, 120463, 1-222; 3613, CBWD7, 18014, 120464, 1-140; 3613, CBWD7, 18015, 120465, 82-624; 3613, CBWD7, 18016, 120466, 179-721; 3613, CBWD7, 18017, 120467, 313-1392; 3613, CBWD7, 18018, 120468, 1-412; 3613, CBWD7, 18019, 120469, 44-526; 3613, CBWD7, 18011, 120461, 179-1366; 3614, COCH, 18023, 120473, 1-168; 3614, COCH, 18024, 120474, 547-1863; 3614, COCH, 18025, 120475, 1-1304; 3614, COCH, 18026, 120476, 57-299; 3614, COCH, 18027, 120477, 195-775; 3614, COCH, 18028, 120478, 177-782; 3614, COCH, 18020, 120470, 397-2049; 3614, COCH, 18021, 120471, 57-1709; 3614, COCH, 18022, 120472, 368-1852; 3615, CDAN1, 18030, 120480, 1-1044; 3615, CDAN1, 18031, 120481, 1-285; 3615, CDAN1, 18029, 120479, 25-3708; 3616, COQ10A, 18035, 120485, 1-461; 3616, COQ10A, 18036, 120486, 1-194; 3616, COQ10A, 18032, 120482, 262-1005; 3616, COQ10A, 18033, 120483, 114-761; 3616, COQ10A, 18034, 120484, 30-722; 3617, COQ10B, 18038, 120488, 69-635; 3617, COQ10B, 18039, 120489, 237-869; 3617, COQ10B, 18037, 120487, 139-855; 3618, COQ2, 18041, 120491, 2-988; 3618, COQ2, 18042, 120492, 32-673; 3618, COQ2, 18043, 120493, 1-678; 3618, COQ2, 18040, 120490, 1-1266; 3619, COQ3, 18045, 120495, 25-450; 3619, COQ3, 18046, 120496, 148-1080; 3619, COQ3, 18044, 120494, 26-1135; 3620, COQ4, 18048, 120498, 8-463; 3620, COQ4, 18049, 120499, 278-568; 3620, COQ4, 18050, 120500, 316-576; 3620, COQ4, 18047, 120497, 324-1121; 3621, COQ5, 18052, 120502, 21-782; 3621, COQ5, 18053, 120503, 333-972; 3621, COQ5, 18054, 120504, 25-552; 3621, COQ5, 18055, 120505, 301-574; 3621, COQ5, 18056, 120506, 169-560; 3621, COQ5, 18051, 120501, 42-1025; 3622, COQ6, 18057, 120507, 8-1411; 3622, COQ6, 18060, 120510, 33-368; 3622, COQ6, 18061, 120511, 154-414; 3622, COQ6, 18062, 120512, 78-864; 3622, COQ6, 18063, 120513, 99-263; 3622, COQ6, 18064, 120514, 26-628; 3622, COQ6, 18065, 120515, 33-368; 3622, COQ6, 18066, 120516, 248-1429; 3622, COQ6, 18058, 120508, 41-1447; 3622, COQ6, 18059, 120509, 168-1499; 3623, COQ7, 18069, 120519, 887-1471; 3623, COQ7, 18070, 120520, 40-360; 3623, COQ7, 18072, 120522, 281-590; 3623, COQ7, 18073, 120523, 349-739; 3623, COQ7, 18074, 120524, 5-415; 3623, COQ7, 18067, 120517, 67-720; 3623, COQ7, 18068, 120518, 134-673; 3623, COQ7, 18071, 120521, 25-678; 3624, COQ9, 18076, 120526, 25-935; 3624, COQ9, 18077, 120527, 20-586; 3624, COQ9, 18078, 120528, 1-309; 3624, COQ9, 18079, 120529, 445-713; 3624, COQ9, 18080, 120530, 10-633; 3624, COQ9, 18081, 120531, 13-864; 3624, COQ9, 18082, 120532, 66-581; 3624, COQ9, 18075, 120525, 70-1026; 3625, CFL1, 18084, 120534, 49-663; 3625, CFL1, 18085, 120535, 296-567; 3625, CFL1, 18086, 120536, 152-601; 3625, CFL1, 18087, 120537, 129-578; 3625, CFL1, 18089, 120539, 108-557; 3625, CFL1, 18090, 120540, 500-737; 3625, CFL1, 18091, 120541, 286-735; 3625, CFL1, 18092, 120542, 377-855; 3625, CFL1, 18093, 120543, 280-647; 3625, CFL1, 18083, 120533, 235-735; 3625, CFL1, 18088, 120538, 717-1217; 3626, CFL2, 18096, 120546, 38-214; 3626, CFL2, 18097, 120547, 284-349; 3626, CFL2, 18094, 120544, 151-651; 3626, CFL2, 18095, 120545, 153-653; 3626, CFL2, 18098, 120548, 90-539; 3626, CFL2, 18099, 120549, 170-619; 3627, CCHCR1, 18103, 120553, 153-2342; 3627, CCHCR1, 18105, 120555, 152-2341; 3627, CCHCR1, 18107, 120557, 153-2342; 3627, CCHCR1, 18109, 120559, 483-838; 3627, CCHCR1, 18110, 120560, 136-700; 3627, CCHCR1, 18111, 120561, 227-740; 3627, CCHCR1, 18112, 120562, 91-470; 3627, CCHCR1, 18113, 120563, 91-470; 3627, CCHCR1, 18114, 120564, 135-699; 3627, CCHCR1, 18115, 120565, 1-769; 3627, CCHCR1, 18116, 120566, 1-769; 3627, CCHCR1, 18117, 120567, 1-769; 3627, CCHCR1, 18118, 120568, 53-1000; 3627, CCHCR1, 18119, 120569, 457-2805; 3627, CCHCR1, 18120, 120570, 189-838; 3627, CCHCR1, 18122, 120572, 91-470; 3627, CCHCR1, 18123, 120573, 227-740; 3627, CCHCR1, 18124, 120574, 53-1000; 3627, CCHCR1, 18125, 120575, 483-838; 3627, CCHCR1, 18126, 120576, 136-700; 3627, CCHCR1, 18127, 120577, 91-470; 3627, CCHCR1, 18128, 120578, 189-646; 3627, CCHCR1, 18129, 120579, 483-838; 3627, CCHCR1, 18130, 120580, 219-676; 3627, CCHCR1, 18131, 120581, 153-2342; 3627, CCHCR1, 18132, 120582, 227-740; 3627, CCHCR1, 18133, 120583, 227-740; 3627, CCHCR1, 18134, 120584, 189-646; 3627, CCHCR1, 18136, 120586, 136-700; 3627, CCHCR1, 18137, 120587, 189-838; 3627, CCHCR1, 18138, 120588, 1-769; 3627, CCHCR1, 18139, 120589, 99-2447; 3627, CCHCR1, 18140, 120590, 136-700; 3627, CCHCR1, 18141, 120591, 53-1000; 3627, CCHCR1, 18142, 120592, 153-2342; 3627, CCHCR1, 18143, 120593, 483-838; 3627, CCHCR1, 18144, 120594, 457-2805; 3627, CCHCR1, 18146, 120596, 227-740; 3627, CCHCR1, 18147, 120597, 53-1000; 3627, CCHCR1, 18148, 120598, 189-646; 3627, CCHCR1, 18149, 120599, 53-1000; 3627, CCHCR1, 18150, 120600, 91-470; 3627, CCHCR1, 18151, 120601, 189-646; 3627, CCHCR1, 18152, 120602, 91-470; 3627, CCHCR1, 18153, 120603, 189-646; 3627, CCHCR1, 18154, 120604, 136-700; 3627, CCHCR1, 18155, 120605, 91-664; 3627, CCHCR1, 18156, 120606, 99-2447; 3627, CCHCR1, 18157, 120607, 1-769; 3627, CCHCR1, 18158, 120608, 153-2342; 3627, CCHCR1, 18159, 120609, 243-589; 3627, CCHCR1, 18160, 120610, 115-588; 3627, CCHCR1, 18161, 120611, 89-567; 3627, CCHCR1, 18162, 120612, 76-318; 3627, CCHCR1, 18163, 120613, 202-580; 3627, CCHCR1, 18164, 120614, 173-415; 3627, CCHCR1, 18165, 120615, 80-322; 3627, CCHCR1, 18166, 120616, 357-479; 3627, CCHCR1, 18167, 120617, 257-544; 3627, CCHCR1, 18168, 120618, 307-662; 3627, CCHCR1, 18169, 120619, 754-861; 3627, CCHCR1, 18170, 120620, 142-560; 3627, CCHCR1, 18171, 120621, 91-511; 3627, CCHCR1, 18172, 120622, 80-214; 3627, CCHCR1, 18173, 120623, 190-2802; 3627, CCHCR1, 18174, 120624, 190-2802; 3627, CCHCR1, 18175, 120625, 190-2802; 3627, CCHCR1, 18176, 120626, 190-2802; 3627, CCHCR1, 18100, 120550, 124-2472; 3627, CCHCR1, 18101, 120551, 99-2447; 3627, CCHCR1, 18102, 120552, 99-2447; 3627, CCHCR1, 18104, 120554, 190-2805; 3627, CCHCR1, 18106, 120556, 457-2805; 3627, CCHCR1, 18108, 120558, 190-2805; 3627, CCHCR1, 18121, 120571, 99-2447; 3627, CCHCR1, 18135, 120585, 8-2515; 3627, CCHCR1, 18145, 120595, 457-2805; 3628, CC2D1A, 18178, 120628, 1-1136; 3628, CC2D1A, 18179, 120629, 1-1217; 3628, CC2D1A, 18177, 120627, 242-3097; 3628, CC2D1A, 18180, 120630, 1-2853; 3629, CC2D1B, 18183, 120633, 1-1886; 3629, CC2D1B, 18184, 120634, 1-2018; 3629, CC2D1B, 18181, 120631, 126-2684; 3629, CC2D1B, 18182, 120632, 140-2716; 3630, CC2D2A, 18185, 120635, 1-4361; 3630, CC2D2A, 18189, 120639, 186-1949; 3630, CC2D2A, 18190, 120640, 1-2711; 3630, CC2D2A, 18192, 120642, 186-407; 3630, CC2D2A, 18195, 120645, 1-425; 3630, CC2D2A, 18196, 120646, 1-390; 3630, CC2D2A, 18186, 120636, 255-623; 3630, CC2D2A, 18187, 120637, 255-5117; 3630, CC2D2A, 18188, 120638, 181-5043; 3630, CC2D2A, 18191, 120641, 165-500; 3630, CC2D2A, 18193, 120643, 98-466; 3630, CC2D2A, 18194, 120644, 208-543; 3631, CC2D2B, 18199, 120649, 233-818; 3631, CC2D2B, 18197, 120647, 165-1133; 3631, CC2D2B, 18198, 120648, 212-1417; 3632, CCDC102A, 18200, 120650, 248-1900; 3633, CCDC102B, 18202, 120652, 226-645; 3633, CCDC102B, 18204, 120654, 261-537; 3633, CCDC102B, 18205, 120655, 54-465; 3633, CCDC102B, 18207, 120657, 170-541; 3633, CCDC102B, 18208, 120658, 203-1179; 3633, CCDC102B, 18201, 120651, 51-1592; 3633, CCDC102B, 18203, 120653, 118-1659; 3633, CCDC102B, 18206, 120656, 1-1452; 3634, CCDC103, 18209, 120659, 138-849; 3634, CCDC103, 18213, 120663, 399-576; 3634, CCDC103, 18210, 120660, 131-427; 3634, CCDC103, 18211, 120661, 128-856; 3634, CCDC103, 18212, 120662, 96-824; 3635, CCDC105, 18214, 120664, 83-1582; 3636, CCDC106, 18217, 120667, 129-866; 3636, CCDC106, 18218, 120668, 224-741; 3636, CCDC106, 18220, 120670, 510-626; 3636, CCDC106, 18221, 120671, 417-552; 3636, CCDC106, 18215, 120665, 289-1131; 3636, CCDC106, 18216, 120666, 905-1747; 3636, CCDC106, 18219, 120669, 335-1177; 3636, CCDC106, 18222, 120672, 147-989; 3637, CCDC107, 18224, 120674, 67-480; 3637, CCDC107, 18223, 120673, 64-531; 3637, CCDC107, 18225, 120675, 77-496; 3637, CCDC107, 18226, 120676, 91-861; 3637, CCDC107, 18227, 120677, 64-423; 3637, CCDC107, 18228, 120678, 67-918; 3638, CCDC108, 18233, 120683, 5-707; 3638, CCDC108, 18234, 120684, 1-383; 3638, CCDC108, 18235, 120685, 165-516; 3638, CCDC108, 18237, 120687, 1678-2493; 3638, CCDC108, 18238, 120688, 220-562; 3638, CCDC108, 18229, 120679, 125-619; 3638, CCDC108, 18230, 120680, 85-5862; 3638, CCDC108, 18231, 120681, 118-2310; 3638, CCDC108, 18232, 120682, 5-2359; 3638, CCDC108, 18236, 120686, 10-5787; 3639, CCDC109B, 18239, 120689, 134-1144; 3640, CCDC110, 18242, 120692, 70-270; 3640, CCDC110, 18243, 120693, 1-375; 3640, CCDC110, 18244, 120694, 17-789; 3640, CCDC110, 18245, 120695, 20-169; 3640, CCDC110, 18246, 120696, 62-2572; 3640, CCDC110, 18247, 120697, 200-544; 3640, CCDC110, 18248, 120698, 255-705; 3640, CCDC110, 18240, 120690, 77-2578; 3640, CCDC110, 18241, 120691, 12-2402; 3641, CCDC112, 18252, 120702, 400-1644; 3641, CCDC112, 18249, 120699, 289-1878; 3641, CCDC112, 18250, 120700, 492-1832; 3641, CCDC112, 18251, 120701, 418-1758; 3642, CCDC113, 18255, 120705, 64-240; 3642, CCDC113, 18256, 120706, 365-556; 3642, CCDC113, 18257, 120707, 39-611; 3642, CCDC113, 18253, 120703, 80-1213; 3642, CCDC113, 18254, 120704, 80-1051; 3643, CCDC114, 18258, 120708, 684-2696; 3644, CCDC115, 18260, 120710, 96-623; 3644, CCDC115, 18261, 120711, 225-806; 3644, CCDC115, 18259, 120709, 225-767; 3645, CCDC116, 18263, 120713, 115-572; 3645, CCDC116, 18262, 120712, 162-2003; 3645, CCDC116, 18264, 120714, 175-1755; 3646, CCDC117, 18268, 120718, 123-463; 3646, CCDC117, 18269, 120719, 147-335; 3646, CCDC117, 18270, 120720, 358-568; 3646, CCDC117, 18265, 120715, 177-1016; 3646, CCDC117, 18266, 120716, 177-791; 3646, CCDC117, 18267, 120717, 177-962; 3647, CCDC12, 18271, 120721, 152-691; 3647, CCDC12, 18272, 120722, 146-412; 3647, CCDC12, 18274, 120724, 137-380; 3647, CCDC12, 18273, 120723, 266-766; 3648, CCDC120, 18278, 120728, 123-314; 3648, CCDC120, 18275, 120725, 283-2139; 3648, CCDC120, 18276, 120726, 508-2400;

3648, CCDC120, 18277, 120727, 178-2268; 3648, CCDC120, 18279, 120729, 296-2188; 3648, CCDC120, 18280, 120730, 220-2112; 3649, CCDC121, 18283, 120733, 129-560; 3649, CCDC121, 18281, 120731, 182-1018; 3649, CCDC121, 18282, 120732, 116-1438; 3650, CCDC122, 18285, 120735, 1-69; 3650, CCDC122, 18284, 120734, 260-1081; 3651, CCDC124, 18288, 120738, 171-580; 3651, CCDC124, 18286, 120736, 45-716; 3651, CCDC124, 18287, 120737, 108-779; 3652, CCDC125, 18289, 120739, 86-1024; 3652, CCDC125, 18294, 120744, 86-1024; 3652, CCDC125, 18290, 120740, 109-1644; 3652, CCDC125, 18291, 120741, 44-1579; 3652, CCDC125, 18292, 120742, 323-1483; 3652, CCDC125, 18293, 120743, 1-1536; 3652, CCDC125, 18295, 120745, 1-1536; 3652, CCDC125, 18296, 120746, 323-1483; 3653, CCDC126, 18300, 120750, 516-847; 3653, CCDC126, 18297, 120747, 458-880; 3653, CCDC126, 18298, 120748, 346-768; 3653, CCDC126, 18299, 120749, 310-732; 3654, CCDC127, 18302, 120752, 370-576; 3654, CCDC127, 18301, 120751, 134-916; 3655, CCDC129, 18306, 120756, 140-566; 3655, CCDC129, 18307, 120757, 55-558; 3655, CCDC129, 18309, 120759, 92-582; 3655, CCDC129, 18310, 120760, 118-3282; 3655, CCDC129, 18303, 120753, 994-3684; 3655, CCDC129, 18304, 120754, 39-3173; 3655, CCDC129, 18305, 120755, 185-3043; 3655, CCDC129, 18308, 120758, 95-3283; 3656, CCDC13, 18311, 120761, 85-2232; 3657, CCDC130, 18313, 120763, 1-571; 3657, CCDC130, 18315, 120765, 203-914; 3657, CCDC130, 18316, 120766, 1-183; 3657, CCDC130, 18317, 120767, 1-309; 3657, CCDC130, 18312, 120762, 378-1568; 3657, CCDC130, 18314, 120764, 504-1694; 3658, CCDC134, 18319, 120769, 105-455; 3658, CCDC134, 18318, 120768, 105-794; 3659, CCDC136, 18322, 120772, 237-253; 3659, CCDC136, 18323, 120773, 319-624; 3659, CCDC136, 18324, 120774, 1-3104; 3659, CCDC136, 18325, 120775, 1-1647; 3659, CCDC136, 18326, 120776, 362-552; 3659, CCDC136, 18327, 120777, 313-723; 3659, CCDC136, 18328, 120778, 45-1385; 3659, CCDC136, 18329, 120779, 395-1942; 3659, CCDC136, 18320, 120770, 368-3832; 3659, CCDC136, 18321, 120771, 51-1355; 3660, CCDC137, 18331, 120781, 13-890; 3660, CCDC137, 18333, 120783, 1-186; 3660, CCDC137, 18334, 120784, 1-133; 3660, CCDC137, 18330, 120780, 404-1273; 3660, CCDC137, 18332, 120782, 16-885; 3661, CCDC138, 18336, 120786, 63-377; 3661, CCDC138, 18337, 120787, 1-1056; 3661, CCDC138, 18338, 120788, 36-173; 3661, CCDC138, 18340, 120790, 1-120; 3661, CCDC138, 18335, 120785, 61-2058; 3661, CCDC138, 18339, 120789, 67-1800; 3662, CCDC14, 18341, 120791, 57-2651; 3662, CCDC14, 18342, 120792, 1-159; 3662, CCDC14, 18343, 120793, 88-2805; 3662, CCDC14, 18344, 120794, 216-567; 3662, CCDC14, 18346, 120796, 65-259; 3662, CCDC14, 18347, 120797, 286-1221; 3662, CCDC14, 18348, 120798, 1-112; 3662, CCDC14, 18349, 120799, 214-735; 3662, CCDC14, 18353, 120803, 1-770; 3662, CCDC14, 18345, 120795, 62-2800; 3662, CCDC14, 18350, 120800, 4594-6855; 3662, CCDC14, 18351, 120801, 3163-5424; 3662, CCDC14, 18352, 120802, 92-2830; 3663, CCDC140, 18355, 120805, 391-441; 3663, CCDC140, 18354, 120804, 385-876; 3664, CCDC141, 18356, 120806, 1-2685; 3664, CCDC141, 18357, 120807, 119-2077; 3664, CCDC141, 18358, 120808, 146-2029; 3664, CCDC141, 18359, 120809, 123-2987; 3664, CCDC141, 18360, 120810, 119-4711; 3665, CCDC142, 18363, 120813, 1-1703; 3665, CCDC142, 18361, 120811, 160-2391; 3665, CCDC142, 18362, 120812, 398-2650; 3666, CCDC144NL, 18364, 120814, 121-786; 3667, CCDC144A, 18365, 120815, 170-1885; 3667, CCDC144A, 18366, 120816, 77-2257; 3667, CCDC144A, 18368, 120818, 161-4438; 3667, CCDC144A, 18369, 120819, 1-534; 3667, CCDC144A, 18367, 120817, 77-4360; 3668, CCDC146, 18371, 120821, 47-557; 3668, CCDC146, 18370, 120820, 128-2995; 3669, CCDC148, 18374, 120824, 152-1954; 3669, CCDC148, 18375, 120825, 161-325; 3669, CCDC148, 18376, 120826, 315-362; 3669, CCDC148, 18377, 120827, 270-392; 3669, CCDC148, 18378, 120828, 128-280; 3669, CCDC148, 18372, 120822, 315-2090; 3669, CCDC148, 18373, 120823, 264-1031; 3670, CCDC149, 18382, 120832, 16-1638; 3670, CCDC149, 18379, 120829, 145-1734; 3670, CCDC149, 18380, 120830, 8-1597; 3670, CCDC149, 18381, 120831, 76-501; 3671, CCDC15, 18384, 120834, 260-3148; 3671, CCDC15, 18383, 120833, 260-3115; 3672, CCDC150, 18386, 120836, 241-2007; 3672, CCDC150, 18387, 120837, 214-420; 3672, CCDC150, 18388, 120838, 259-807; 3672, CCDC150, 18385, 120835, 136-3441; 3672, CCDC150, 18389, 120839, 212-1465; 3673, CCDC151, 18391, 120841, 106-1713; 3673, CCDC151, 18392, 120842, 163-510; 3673, CCDC151, 18393, 120843, 423-1637; 3673, CCDC151, 18390, 120840, 89-1876; 3674, CCDC152, 18394, 120844, 88-852; 3674, CCDC152, 18395, 120845, 71-667; 3675, CCDC153, 18396, 120846, 1-633; 3675, CCDC153, 18397, 120847, 497-1129; 3676, CCDC154, 18399, 120849, 973-2541; 3676, CCDC154, 18400, 120850, 1-300; 3676, CCDC154, 18398, 120848, 168-2192; 3677, CCDC155, 18402, 120852, 305-531; 3677, CCDC155, 18403, 120853, 296-570; 3677, CCDC155, 18404, 120854, 198-776; 3677, CCDC155, 18405, 120855, 127-255; 3677, CCDC155, 18406, 120856, 1-1573; 3677, CCDC155, 18407, 120857, 204-768; 3677, CCDC155, 18401, 120851, 206-1894; 3678, CCDC157, 18409, 120859, 664-915; 3678, CCDC157, 18411, 120861, 144-732; 3678, CCDC157, 18412, 120862, 292-894; 3678, CCDC157, 18408, 120858, 661-2919; 3678, CCDC157, 18410, 120860, 710-2968; 3679, CCDC158, 18413, 120863, 154-3495; 3679, CCDC158, 18414, 120864, 172-1392; 3680, CCDC159, 18416, 120866, 1-467; 3680, CCDC159, 18417, 120867, 68-178; 3680, CCDC159, 18418, 120868, 107-527; 3680, CCDC159, 18419, 120869, 103-213; 3680, CCDC159, 18420, 120870, 215-602; 3680, CCDC159, 18421, 120871, 1-580; 3680, CCDC159, 18422, 120872, 206-534; 3680, CCDC159, 18423, 120873, 36-152; 3680, CCDC159, 18415, 120865, 103-996; 3680, CCDC159, 18424, 120874, 448-1341; 3681, CCDC160, 18425, 120875, 322-1299; 3681, CCDC160, 18426, 120876, 384-1361; 3682, CCDC163P, 18427, 120877, 471-827; 3682, CCDC163P, 18428, 120878, 366-659; 3682, CCDC163P, 18429, 120879, 366-803; 3682, CCDC163P, 18430, 120880, 440-640; 3682, CCDC163P, 18431, 120881, 366-722; 3683, CCDC166, 18432, 120882, 1-1320; 3683, CCDC166, 18433, 120883, 1-1320; 3684, CCDC167, 18434, 120884, 60-353; 3685, CCDC168, 18435, 120885, 139-21384; 3686, CCDC169, 18440, 120890, 257-532; 3686, CCDC169, 18436, 120886, 33-677; 3686, CCDC169, 18437, 120887, 210-635; 3686, CCDC169, 18438, 120888, 255-593; 3686, CCDC169, 18439, 120889, 332-751; 3686, CCDC169, 18441, 120891, 253-672; 3686, CCDC169, 18442, 120892, 31-756; 3686, CCDC169, 18443, 120893, 332-670; 3687, CCDC17, 18444, 120894, 93-272; 3687, CCDC17, 18448, 120898, 149-1843; 3687, CCDC17, 18445, 120895, 145-1986; 3687, CCDC17, 18446, 120896, 59-391; 3687, CCDC17, 18447, 120897, 149-2017; 3688, CCDC170, 18449, 120899, 100-2247; 3689, CCDC171, 18451, 120901, 1-773; 3689, CCDC171, 18452, 120902, 1-1409; 3689, CCDC171, 18453, 120903, 176-1129; 3689,

CCDC171, 18450, 120900, 329-4309; 3690, CCDC172, 18454, 120904, 252-1028; 3691, CCDC173, 18456, 120906, 94-569; 3691, CCDC173, 18457, 120907, 9-334; 3691, CCDC173, 18455, 120905, 107-1765; 3692, CCDC174, 18458, 120908, 74-1249; 3692, CCDC174, 18460, 120910, 377-1261; 3692, CCDC174, 18459, 120909, 74-1477; 3693, CCDC175, 18461, 120911, 1-2487; 3693, CCDC175, 18462, 120912, 57-2438; 3694, CCDC177, 18463, 120913, 325-2448; 3695, CCDC178, 18466, 120916, 144-1017; 3695, CCDC178, 18468, 120918, 25-2700; 3695, CCDC178, 18469, 120919, 107-670; 3695, CCDC178, 18471, 120921, 1-1095; 3695, CCDC178, 18472, 120922, 294-604; 3695, CCDC178, 18473, 120923, 80-2755; 3695, CCDC178, 18474, 120924, 49-267; 3695, CCDC178, 18464, 120914, 212-2701; 3695, CCDC178, 18465, 120915, 184-2787; 3695, CCDC178, 18467, 120917, 143-2746; 3695, CCDC178, 18470, 120920, 184-2733; 3696, CCDC179, 18475, 120925, 6-212; 3697, CCDC18, 18477, 120927, 1-4526; 3697, CCDC18, 18478, 120928, 523-4422; 3697, CCDC18, 18479, 120929, 1-2161; 3697, CCDC18, 18480, 120930, 1-496; 3697, CCDC18, 18481, 120931, 1-1331; 3697, CCDC18, 18482, 120932, 1-288; 3697, CCDC18, 18476, 120926, 503-4867; 3698, CCDC180, 18483, 120933, 98-5203; 3699, CCDC181, 18486, 120936, 179-1246; 3699, CCDC181, 18484, 120934, 211-1737; 3699, CCDC181, 18485, 120935, 154-1683; 3699, CCDC181, 18487, 120937, 509-2035; 3699, CCDC181, 18488, 120938, 211-1467; 3700, CCDC182, 18489, 120939, 41-502; 3701, CCDC183, 18491, 120941, 49-1005; 3701, CCDC183, 18490, 120940, 36-1640; 3702, CCDC184, 18492, 120942, 540-1124; 3703, CCDC185, 18493, 120943, 60-1931; 3704, CCDC186, 18494, 120944, 375-1010; 3704, CCDC186, 18495, 120945, 268-903; 3704, CCDC186, 18497, 120947, 1-1309; 3704, CCDC186, 18496, 120946, 268-2964; 3705, CCDC187, 18498, 120948, 242-3139; 3705, CCDC187, 18499, 120949, 241-3102; 3705, CCDC187, 18500, 120950, 270-3461; 3706, CCDC188, 18501, 120951, 80-1288; 3707, CCDC189, 18504, 120954, 1-437; 3707, CCDC189, 18505, 120955, 338-553; 3707, CCDC189, 18506, 120956, 1-275; 3707, CCDC189, 18507, 120957, 332-1522; 3707, CCDC189, 18502, 120952, 963-1958; 3707, CCDC189, 18503, 120953, 331-864; 3708, CCDC190, 18508, 120958, 122-1030; 3708, CCDC190, 18509, 120959, 19-927; 3708, CCDC190, 18510, 120960, 176-799; 3709, CCDC191, 18512, 120962, 129-1957; 3709, CCDC191, 18513, 120963, 84-329; 3709, CCDC191, 18514, 120964, 1-591; 3709, CCDC191, 18515, 120965, 22-138; 3709, CCDC191, 18511, 120961, 148-2958; 3710, CCDC22, 18516, 120966, 171-2054; 3711, CCDC24, 18518, 120968, 167-457; 3711, CCDC24, 18519, 120969, 132-311; 3711, CCDC24, 18520, 120970, 38-697; 3711, CCDC24, 18521, 120971, 96-293; 3711, CCDC24, 18522, 120972, 168-458; 3711, CCDC24, 18523, 120973, 106-285; 3711, CCDC24, 18517, 120967, 172-1095; 3712, CCDC25, 18525, 120975, 114-242; 3712, CCDC25, 18527, 120977, 74-154; 3712, CCDC25, 18528, 120978, 101-379; 3712, CCDC25, 18529, 120979, 100-228; 3712, CCDC25, 18530, 120980, 88-348; 3712, CCDC25, 18531, 120981, 68-346; 3712, CCDC25, 18524, 120974, 95-721; 3712, CCDC25, 18526, 120976, 199-621; 3713, CCDC27, 18533, 120983, 38-646; 3713, CCDC27, 18532, 120982, 85-2055; 3714, CCDC28A, 18536, 120986, 227-712; 3714, CCDC28A, 18537, 120987, 177-731; 3714, CCDC28A, 18534, 120984, 156-980; 3714, CCDC28A, 18535, 120985, 167-991; 3715, CCDC28B, 18540, 120990, 90-479; 3715, CCDC28B, 18541, 120991, 133-384; 3715, CCDC28B, 18538, 120988, 348-950; 3715, CCDC28B, 18539, 120989, 101-826; 3716, CCDC3, 18542, 120992, 128-940; 3716, CCDC3, 18543, 120993, 954-1391; 3717, CCDC30, 18547, 120997, 2050-3495; 3717, CCDC30, 18548, 120998, 83-268; 3717, CCDC30, 18549, 120999, 433-1371; 3717, CCDC30, 18544, 120994, 111-2462; 3717, CCDC30, 18545, 120995, 1-2352; 3717, CCDC30, 18546, 120996, 559-2910; 3717, CCDC30, 18550, 121000, 569-2287; 3718, CCDC33, 18555, 121005, 1-2104; 3718, CCDC33, 18551, 121001, 21-1124; 3718, CCDC33, 18552, 121002, 50-1051; 3718, CCDC33, 18553, 121003, 432-2699; 3718, CCDC33, 18554, 121004, 32-1033; 3719, CCDC34, 18556, 121006, 41-730; 3719, CCDC34, 18557, 121007, 675-1796; 3720, CCDC36, 18558, 121008, 388-2172; 3720, CCDC36, 18559, 121009, 237-2021; 3720, CCDC36, 18560, 121010, 80-691; 3720, CCDC36, 18561, 121011, 90-1874; 3721, CCDC38, 18563, 121013, 1-272; 3721, CCDC38, 18564, 121014, 193-336; 3721, CCDC38, 18565, 121015, 220-261; 3721, CCDC38, 18566, 121016, 374-559; 3721, CCDC38, 18562, 121012, 559-2250; 3722, CCDC39, 18568, 121018, 873-2888; 3722, CCDC39, 18569, 121019, 1-308; 3722, CCDC39, 18570, 121020, 492-783; 3722, CCDC39, 18571, 121021, 1-204; 3722, CCDC39, 18567, 121017, 121-2946; 3723, CCDC40, 18576, 121026, 170-466; 3723, CCDC40, 18577, 121027, 159-537; 3723, CCDC40, 18578, 121028, 1-257; 3723, CCDC40, 18579, 121029, 1-251; 3723, CCDC40, 18572, 121022, 12-1751; 3723, CCDC40, 18573, 121023, 6-1442; 3723, CCDC40, 18574, 121024, 32-3124; 3723, CCDC40, 18575, 121025, 28-3456; 3724, CCDC42, 18582, 121032, 503-538; 3724, CCDC42, 18580, 121030, 228-1178; 3724, CCDC42, 18581, 121031, 179-907; 3725, CCDC43, 18585, 121035, 11-694; 3725, CCDC43, 18586, 121036, 1-332; 3725, CCDC43, 18583, 121033, 10-684; 3725, CCDC43, 18584, 121034, 27-491; 3726, CCDC47, 18589, 121039, 496-552; 3726, CCDC47, 18591, 121041, 560-1132; 3726, CCDC47, 18587, 121037, 384-1835; 3726, CCDC47, 18588, 121038, 266-1717; 3726, CCDC47, 18590, 121040, 179-1621; 3727, CCDC50, 18592, 121042, 599-1519; 3727, CCDC50, 18593, 121043, 591-2039; 3728, CCDC51, 18597, 121047, 370-556; 3728, CCDC51, 18598, 121048, 357-833; 3728, CCDC51, 18594, 121044, 87-1322; 3728, CCDC51, 18595, 121045, 433-1341; 3728, CCDC51, 18596, 121046, 239-1147; 3728, CCDC51, 18599, 121049, 309-1217; 3729, CCDC53, 18601, 121051, 13-165; 3729, CCDC53, 18602, 121052, 112-633; 3729, CCDC53, 18603, 121053, 73-258; 3729, CCDC53, 18604, 121054, 39-548; 3729, CCDC53, 18605, 121055, 118-699; 3729, CCDC53, 18606, 121056, 1-324; 3729, CCDC53, 18607, 121057, 51-284; 3729, CCDC53, 18600, 121050, 163-747; 3730, CCDC54, 18608, 121058, 395-1381; 3731, CCDC57, 18611, 121061, 1-637; 3731, CCDC57, 18612, 121062, 548-1606; 3731, CCDC57, 18614, 121064, 1-1471; 3731, CCDC57, 18615, 121065, 1-106; 3731, CCDC57, 18616, 121066, 1-136; 3731, CCDC57, 18617, 121067, 1-165; 3731, CCDC57, 18609, 121059, 38-2788; 3731, CCDC57, 18610, 121060, 356-2611; 3731, CCDC57, 18613, 121063, 38-2788; 3732, CCDC58, 18619, 121069, 1-424; 3732, CCDC58, 18620, 121070, 72-464; 3732, CCDC58, 18621, 121071, 8-169; 3732, CCDC58, 18618, 121068, 8-442; 3733, CCDC59, 18623, 121073, 21-563; 3733, CCDC59, 18622, 121072, 413-1138; 3734, CCDC6, 18624, 121074, 233-1657; 3735, CCDC60, 18626, 121076, 249-422; 3735, CCDC60, 18627, 121077, 466-867; 3735, CCDC60, 18625, 121075, 466-2118; 3736, CCDC61, 18630, 121080, 38-187; 3736, CCDC61, 18631, 121081, 203-433; 3736, CCDC61, 18628, 121078, 56-1054; 3736, CCDC61, 18629, 121079, 14-1012; 3736, CCDC61, 18632, 121082, 50-1588; 3737,

CCDC62, 18635, 121085, 31-1524; 3737, CCDC62, 18637, 121087, 140-331; 3737, CCDC62, 18633, 121083, 345-2399; 3737, CCDC62, 18634, 121084, 144-2192; 3737, CCDC62, 18636, 121086, 146-2194; 3737, CCDC62, 18638, 121088, 1203-2540; 3738, CCDC63, 18641, 121091, 138-1592; 3738, CCDC63, 18639, 121089, 243-1934; 3738, CCDC63, 18640, 121090, 258-1829; 3739, CCDC64, 18643, 121093, 1-876; 3739, CCDC64, 18644, 121094, 1-232; 3739, CCDC64, 18645, 121095, 1-685; 3739, CCDC64, 18642, 121092, 1-1722; 3740, CCDC64B, 18646, 121096, 46-1572; 3740, CCDC64B, 18647, 121097, 64-1590; 3740, CCDC64B, 18648, 121098, 2192-3097; 3741, CCDC65, 18651, 121101, 219-1338; 3741, CCDC65, 18652, 121102, 205-333; 3741, CCDC65, 18649, 121099, 228-1721; 3741, CCDC65, 18650, 121100, 189-1643; 3742, CCDC66, 18654, 121104, 25-717; 3742, CCDC66, 18656, 121106, 81-263; 3742, CCDC66, 18657, 121107, 34-216; 3742, CCDC66, 18658, 121108, 83-1983; 3742, CCDC66, 18659, 121109, 25-141; 3742, CCDC66, 18660, 121110, 116-979; 3742, CCDC66, 18653, 121103, 139-2883; 3742, CCDC66, 18655, 121105, 71-2917; 3743, CCDC67, 18662, 121112, 211-1871; 3743, CCDC67, 18663, 121113, 48-1094; 3743, CCDC67, 18664, 121114, 39-359; 3743, CCDC67, 18665, 121115, 173-334; 3743, CCDC67, 18666, 121116, 289-1626; 3743, CCDC67, 18667, 121117, 45-1031; 3743, CCDC67, 18668, 121118, 129-1169; 3743, CCDC67, 18669, 121119, 222-1730; 3743, CCDC67, 18670, 121120, 167-1964; 3743, CCDC67, 18661, 121111, 101-1915; 3744, CCDC68, 18674, 121124, 1-610; 3744, CCDC68, 18671, 121121, 173-1180; 3744, CCDC68, 18672, 121122, 160-1167; 3744, CCDC68, 18673, 121123, 276-1283; 3745, CCDC69, 18676, 121126, 1-267; 3745, CCDC69, 18677, 121127, 123-266; 3745, CCDC69, 18678, 121128, 1-560; 3745, CCDC69, 18675, 121125, 176-1066; 3746, CCDC7, 18680, 121130, 1-1942; 3746, CCDC7, 18683, 121133, 71-1969; 3746, CCDC7, 18684, 121134, 619-2382; 3746, CCDC7, 18685, 121135, 1-482; 3746, CCDC7, 18687, 121137, 297-812; 3746, CCDC7, 18688, 121138, 23-550; 3746, CCDC7, 18689, 121139, 23-544; 3746, CCDC7, 18690, 121140, 23-538; 3746, CCDC7, 18691, 121141, 1-1500; 3746, CCDC7, 18679, 121129, 310-1770; 3746, CCDC7, 18681, 121131, 544-2004; 3746, CCDC7, 18686, 121136, 310-1113; 3746, CCDC7, 18682, 121132, 474-2360; 3747, CCDC70, 18692, 121142, 297-998; 3748, CCDC71, 18693, 121143, 108-1511; 3749, CCDC71L, 18695, 121145, 43-993; 3749, CCDC71L, 18694, 121144, 101-808; 3750, CCDC73, 18697, 121147, 1-347; 3750, CCDC73, 18698, 121148, 278-754; 3750, CCDC73, 18696, 121146, 45-3284; 3751, CCDC74A, 18701, 121151, 116-523; 3751, CCDC74A, 18702, 121152, 232-851; 3751, CCDC74A, 18703, 121153, 138-956; 3751, CCDC74A, 18699, 121149, 139-1275; 3751, CCDC74A, 18700, 121150, 92-1030; 3752, CCDC74B, 18705, 121155, 138-962; 3752, CCDC74B, 18707, 121157, 88-765; 3752, CCDC74B, 18708, 121158, 38-652; 3752, CCDC74B, 18709, 121159, 83-561; 3752, CCDC74B, 18710, 121160, 1-613; 3752, CCDC74B, 18711, 121161, 21-302; 3752, CCDC74B, 18712, 121162, 81-428; 3752, CCDC74B, 18704, 121154, 139-1281; 3752, CCDC74B, 18706, 121156, 84-1028; 3753, CCDC77, 18717, 121167, 281-556; 3753, CCDC77, 18718, 121168, 205-1362; 3753, CCDC77, 18713, 121163, 180-1646; 3753, CCDC77, 18714, 121164, 250-1620; 3753, CCDC77, 18715, 121165, 161-1531; 3753, CCDC78, 18716, 121166, 198-1568; 3754, CCDC78, 18720, 121170, 1-959; 3754, CCDC78, 18721, 121171, 452-621; 3754, CCDC78, 18719, 121169, 107-1423; 3755, CCDC79, 18722, 121172, 150-479; 3755, CCDC79, 18723, 121173, 1-76; 3755, CCDC79, 18724, 121174, 74-2257; 3755, CCDC79, 18725, 121175, 263-2446; 3755, CCDC79, 18726, 121176, 263-1789; 3756, CCDC8, 18727, 121177, 775-2391; 3757, CCDC80, 18730, 121180, 45-681; 3757, CCDC80, 18731, 121181, 1-781; 3757, CCDC80, 18728, 121178, 955-3807; 3757, CCDC80, 18729, 121179, 389-3241; 3758, CCDC81, 18734, 121184, 278-543; 3758, CCDC81, 18732, 121182, 429-2117; 3758, CCDC81, 18733, 121183, 273-2231; 3758, CCDC81, 18735, 121185, 257-1420; 3759, CCDC82, 18738, 121188, 147-236; 3759, CCDC82, 18739, 121189, 63-849; 3759, CCDC82, 18736, 121186, 430-2064; 3759, CCDC82, 18737, 121187, 244-1878; 3760, CCDC83, 18742, 121192, 1-956; 3760, CCDC83, 18740, 121190, 513-1847; 3760, CCDC83, 18741, 121191, 217-1458; 3761, CCDC84, 18744, 121194, 31-615; 3761, CCDC84, 18745, 121195, 44-490; 3761, CCDC84, 18746, 121196, 31-615; 3761, CCDC84, 18747, 121197, 44-490; 3761, CCDC84, 18743, 121193, 57-1055; 3761, CCDC84, 18748, 121198, 57-1055; 3762, CCDC85A, 18749, 121199, 503-2164; 3763, CCDC85B, 18750, 121200, 673-1281; 3764, CCDC85C, 18752, 121202, 577-771; 3764, CCDC85C, 18753, 121203, 385-579; 3764, CCDC85C, 18754, 121204, 1-573; 3764, CCDC85C, 18755, 121205, 208-556; 3764, CCDC85C, 18756, 121206, 403-543; 3764, CCDC85C, 18757, 121207, 1-371; 3764, CCDC85C, 18751, 121201, 68-1327; 3765, CCDC86, 18760, 121210, 1-265; 3765, CCDC86, 18758, 121208, 55-1137; 3765, CCDC86, 18759, 121209, 162-476; 3766, CCDC87, 18761, 121211, 69-2618; 3767, CCDC88A, 18764, 121214, 1-2667; 3767, CCDC88A, 18765, 121215, 141-582; 3767, CCDC88A, 18767, 121217, 1-3609; 3767, CCDC88A, 18769, 121219, 1-1124; 3767, CCDC88A, 18770, 121220, 1-2208; 3767, CCDC88A, 18771, 121221, 760-2985; 3767, CCDC88A, 18762, 121212, 778-6309; 3767, CCDC88A, 18763, 121213, 535-6147; 3767, CCDC88A, 18766, 121216, 843-6233; 3767, CCDC88A, 18768, 121218, 843-6458; 3768, CCDC88B, 18774, 121224, 151-2289; 3768, CCDC88B, 18772, 121222, 12-431; 3768, CCDC88B, 18773, 121223, 45-4475; 3769, CCDC88C, 18775, 121225, 284-1804; 3769, CCDC88C, 18776, 121226, 151-417; 3769, CCDC88C, 18778, 121228, 155-445; 3769, CCDC88C, 18779, 121229, 1-394; 3769, CCDC88C, 18777, 121227, 88-6174; 3770, CCDC89, 18780, 121230, 148-1272; 3771, CCDC9, 18782, 121232, 450-834; 3771, CCDC9, 18783, 121233, 187-356; 3771, CCDC9, 18784, 121234, 313-457; 3771, CCDC9, 18781, 121231, 223-1818; 3772, CCDC90B, 18785, 121235, 383-871; 3772, CCDC90B, 18789, 121239, 7-633; 3772, CCDC90B, 18790, 121240, 8-124; 3772, CCDC90B, 18791, 121241, 17-370; 3772, CCDC90B, 18792, 121242, 17-190; 3772, CCDC90B, 18793, 121243, 1-286; 3772, CCDC90B, 18794, 121244, 114-245; 3772, CCDC90B, 18795, 121245, 384-557; 3772, CCDC90B, 18796, 121246, 239-532; 3772, CCDC90B, 18798, 121248, 19-135; 3772, CCDC90B, 18799, 121249, 1-402; 3772, CCDC90B, 18786, 121236, 219-956; 3772, CCDC90B, 18787, 121237, 1076-1537; 3772, CCDC90B, 18788, 121238, 1003-1464; 3772, CCDC90B, 18797, 121247, 436-1200; 3773, CCDC91, 18802, 121252, 197-364; 3773, CCDC91, 18803, 121253, 1-141; 3773, CCDC91, 18804, 121254, 217-471; 3773, CCDC91, 18806, 121256, 90-893; 3773, CCDC91, 18807, 121257, 157-518; 3773, CCDC91, 18808, 121258, 1-368; 3773, CCDC91, 18809, 121259, 492-1578; 3773, CCDC91, 18810, 121260, 1-93; 3773, CCDC91, 18811, 121261, 170-549; 3773, CCDC91, 18812, 121262, 219-1301; 3773, CCDC91, 18813, 121263, 1-327; 3773, CCDC91, 18814, 121264, 301-575; 3773, CCDC91, 18815, 121265, 1-83; 3773, CCDC91, 18816, 121266, 1-93; 3773, CCDC91, 18800, 121250, 17-1342; 3773, CCDC91, 18801, 121251, 420-1745; 3773, CCDC91, 18805, 121255, 230-1447; 3774, CCDC92, 18818, 121268, 267-555; 3774, CCDC92, 18819, 121269, 386-751; 3774, CCDC92, 18822, 121272, 524-559; 3774, CCDC92, 18823, 121273, 572-860; 3774, CCDC92, 18825, 121275, 60-348; 3774, CCDC92, 18827, 121277, 60-111; 3774, CCDC92, 18828, 121278, 229-594; 3774, CCDC92, 18829, 121279, 18-306; 3774, CCDC92, 18817, 121267, 356-1351; 3774, CCDC92, 18820, 121270, 3298-4242; 3774, CCDC92, 18821, 121271, 224-1168; 3774, CCDC92, 18824, 121274, 18-962; 3774, CCDC92, 18826, 121276, 2479-3423; 3774, CCDC92, 18830, 121280, 60-1055; 3775, CCDC93, 18831, 121281, 139-2031; 3775, CCDC93, 18833, 121283, 1-276; 3775, CCDC93, 18832, 121282, 139-2034; 3776, CCDC94, 18835, 121285, 319-800; 3776, CCDC94, 18834, 121284, 69-1040; 3777, CCDC96, 18836, 121286, 2-1669; 3778, CCDC97, 18838, 121288, 1-464; 3778, CCDC97, 18839, 121289, 365-413; 3778, CCDC97, 18837, 121287, 123-1154; 3779, CCER2, 18840, 121290, 1-801; 3779, CCER2, 18841, 121291, 1-369; 3780, CCER1, 18843, 121293, 1-175; 3780, CCER1, 18842, 121292, 435-1655; 3781, CCER2, 18845, 121295, 1-369; 3781, CCER2, 18844, 121294, 1-801; 3782, CCSER1, 18847, 121297, 339-2330; 3782, CCSER1, 18848, 121298, 234-445; 3782, CCSER1, 18849, 121299, 115-396; 3782, CCSER1, 18850, 121300, 1-508; 3782, CCSER1, 18851, 121301, 225-401; 3782, CCSER1, 18853, 121303, 1-413; 3782, CCSER1, 18854, 121304, 1-224; 3782, CCSER1, 18846, 121296, 355-2388; 3782, CCSER1, 18852, 121302, 289-2991; 3783, CCSER2, 18855, 121305, 186-2690; 3783, CCSER2, 18856, 121306, 263-1966; 3783, CCSER2, 18857, 121307, 260-3403; 3783, CCSER2, 18858, 121308, 125-910; 3784, CHCHD1, 18860, 121310, 30-323; 3784, CHCHD1, 18859, 121309, 14-370; 3785, CHCHD10, 18861, 121311, 69-518; 3785, CHCHD10, 18863, 121313, 47-346; 3785, CHCHD10, 18864, 121314, 3-170; 3785, CHCHD10, 18865, 121315, 69-518; 3785, CHCHD10, 18866, 121316, 3-170; 3785, CHCHD10, 18867, 121317, 47-346; 3785, CHCHD10, 18862, 121312, 570-998; 3785, CHCHD10, 18868, 121318, 570-998; 3786, CHCHD2, 18869, 121319, 164-619; 3787, CHCHD3, 18871, 121321, 118-816; 3787, CHCHD3, 18872, 121322, 152-343; 3787, CHCHD3, 18873, 121323, 134-859; 3787, CHCHD3, 18870, 121320, 146-829; 3788, CHCHD4, 18876, 121326, 74-175; 3788, CHCHD4, 18874, 121324, 326-793; 3788, CHCHD4, 18875, 121325, 183-611; 3789, CHCHD5, 18879, 121329, 180-326; 3789, CHCHD5, 18877, 121327, 208-540; 3789, CHCHD5, 18878, 121328, 54-530; 3790, CHCHD6, 18881, 121331, 1-500; 3790, CHCHD6, 18882, 121332, 73-843; 3790, CHCHD6, 18883, 121333, 74-496; 3790, CHCHD6, 18880, 121330, 94-801; 3791, CHCHD7, 18886, 121336, 177-461; 3791, CHCHD7, 18890, 121340, 187-384; 3791, CHCHD7, 18891, 121341, 403-536; 3791, CHCHD7, 18893, 121343, 66-248; 3791, CHCHD7, 18895, 121345, 187-384; 3791, CHCHD7, 18896, 121346, 187-372; 3791, CHCHD7, 18897, 121347, 47-187; 3791, CHCHD7, 18884, 121334, 172-504; 3791, CHCHD7, 18885, 121335, 100-357; 3791, CHCHD7, 18887, 121337, 107-277; 3791, CHCHD7, 18888, 121338, 149-355; 3791, CHCHD7, 18889, 121339, 149-442; 3791, CHCHD7, 18892, 121342, 169-339; 3791, CHCHD7, 18894, 121344, 137-343; 3792, COIL, 18898, 121348, 36-1766; 3792, COIL, 18899, 121349, 354-466; 3792, COIL, 18898, 121348, 36-1766; 3793, CIRBP, 18901, 121351, 1-177; 3793, CIRBP, 18903, 121353, 62-244; 3793, CIRBP, 18904, 121354, 70-309; 3793, CIRBP, 18905, 121355, 71-577; 3793, CIRBP, 18906, 121356, 92-985; 3793, CIRBP, 18907, 121357, 83-322; 3793, CIRBP, 18908, 121358, 87-532; 3793, CIRBP, 18909, 121359, 305-619; 3793, CIRBP, 18910, 121360, 86-979; 3793, CIRBP, 18912, 121362, 81-974; 3793, CIRBP, 18914, 121364, 1-220; 3793, CIRBP, 18916, 121366, 70-477; 3793, CIRBP, 18917, 121367, 1-270; 3793, CIRBP, 18918, 121368, 112-590; 3793, CIRBP, 18919, 121369, 213-1106; 3793, CIRBP, 18920, 121370, 220-334; 3793, CIRBP, 18921, 121371, 375-616; 3793, CIRBP, 18922, 121372, 85-492; 3793, CIRBP, 18923, 121373, 39-545; 3793, CIRBP, 18924, 121374, 71-577; 3793, CIRBP, 18925, 121375, 82-321; 3793, CIRBP, 18926, 121376, 68-574; 3793, CIRBP, 18927, 121377, 148-387; 3793, CIRBP, 18928, 121378, 66-674; 3793, CIRBP, 18929, 121379, 478-573; 3793, CIRBP, 18930, 121380, 67-587; 3793, CIRBP, 18931, 121381, 86-268; 3793, CIRBP, 18932, 121382, 152-658; 3793, CIRBP, 18934, 121384, 150-1043; 3793, CIRBP, 18900, 121350, 81-599; 3793, CIRBP, 18902, 121352, 86-877; 3793, CIRBP, 18911, 121361, 56-574; 3793, CIRBP, 18913, 121363, 213-731; 3793, CIRBP, 18915, 121365, 212-730; 3793, CIRBP, 18933, 121383, 262-780; 3794, CSDC2, 18936, 121386, 1-456; 3794, CSDC2, 18935, 121385, 545-1006; 3795, CSDE1, 18942, 121392, 589-2595; 3795, CSDE1, 18943, 121393, 489-626; 3795, CSDE1, 18944, 121394, 412-521; 3795, CSDE1, 18945, 121395, 483-503; 3795, CSDE1, 18947, 121397, 318-601; 3795, CSDE1, 18948, 121398, 162-571; 3795, CSDE1, 18937, 121387, 51-2354; 3795, CSDE1, 18938, 121388, 447-2750; 3795, CSDE1, 18939, 121389, 428-2824; 3795, CSDE1, 18940, 121390, 476-2917; 3795, CSDE1, 18941, 121391, 380-2914; 3795, CSDE1, 18946, 121396, 59-2455; 3795, CSDE1, 18949, 121399, 523-3057; 3796, CLPS, 18951, 121401, 1-297; 3796, CLPS, 18952, 121402, 57-272; 3796, CLPS, 18950, 121400, 24-362; 3797, CLPSL1, 18954, 121404, 1-129; 3797, CLPSL1, 18953, 121403, 95-460; 3798, CLPSL2, 18955, 121405, 5-466; 3798, CLPSL2, 18956, 121406, 1-303; 3799, CCBE1, 18957, 121407, 1-1011; 3799, CCBE1, 18959, 121409, 449-587; 3799, CCBE1, 18958, 121408, 39-1259; 3800, COLGALT1, 18961, 121411, 1-654; 3800, COLGALT1, 18962, 121412, 139-552; 3800, COLGALT1, 18960, 121410, 121-1989; 3801, COLGALT2, 18964, 121414, 438-1529; 3801, COLGALT2, 18965, 121415, 1095-1799; 3801, COLGALT2, 18963, 121413, 373-2253; 3802, CTHRC1, 18967, 121417, 108-551; 3802, CTHRC1, 18968, 121418, 205-546; 3802, CTHRC1, 18966, 121416, 143-874; 3802, CTHRC1, 18969, 121419, 120-809; 3803, COL1A1, 18971, 121421, 88-549; 3803, COL1A1, 18970, 121420, 120-4514; 3804, COL1A2, 18973, 121423, 119-4213; 3804, COL1A2, 18972, 121422, 472-4572; 3805, COL2A1, 18974, 121424, 1-4257; 3805, COL2A1, 18975, 121425, 166-4629; 3806, COL3A1, 18978, 121428, 1-268; 3806, COL3A1, 18976, 121426, 171-4571; 3806, COL3A1, 18977, 121427, 105-3596; 3807, COL4A1, 18980, 121430, 105-1664; 3807, COL4A1, 18981, 121431, 408-1077; 3807, COL4A1, 18979, 121429, 123-5132; 3808, COL4A2, 18983, 121433, 177-491; 3808, COL4A2, 18984, 121434, 1-128; 3808, COL4A2, 18982, 121432, 307-5445; 3809, COL4A3, 18985, 121435, 1-471; 3809, COL4A3, 18986, 121436, 163-5175; 3810, COL4A3BP, 18988, 121438, 1-704; 3810, COL4A3BP, 18991, 121441, 1-379; 3810, COL4A3BP, 18987, 121437, 423-2219; 3810, COL4A3BP, 18989, 121439, 295-2553; 3810, COL4A3BP, 18990, 121440, 423-2297; 3811, COL4A4, 18992, 121442, 209-5281; 3812, COL4A5, 18995, 121445, 1-347; 3812, COL4A5, 18996, 121446, 1-524; 3812, COL4A5, 18997, 121447, 1-222; 3812, COL4A5, 18993, 121443, 245-5320; 3812, COL4A5, 18994, 121444, 245-5302; 3813, COL4A6, 19000, 121450, 235-5358; 3813, COL4A6, 19001, 121451, 235-5271; 3813, COL4A6, 19002, 121452, 235-5136; 3813, COL4A6, 19003, 121453, 235-5235; 3813, COL4A6, 18998, 121448, 235-5307; 3813, COL4A6, 18999, 121449, 102-5177; 3814, COL9A1, 19004, 121454, 158-2194; 3814, COL9A1, 19005, 121455, 160-2925; 3814, COL9A1, 19006, 121456, 147-1133; 3815, COL9A2, 19007, 121457, 71-319; 3815, COL9A2, 19009, 121459, 1-677; 3815, COL9A2, 19010, 121460, 1-548; 3815, COL9A2, 19008, 121458, 98-2167; 3816, COL9A3, 19012, 121462, 24-596; 3816, COL9A3, 19011, 121461, 4-2058; 3817, COL5A1, 19014, 121464, 1-628; 3817, COL5A1, 19015, 121465, 384-5900; 3817, COL5A1, 19013, 121463, 415-5931; 3818, COL5A2, 19017, 121467, 906-4244; 3818, COL5A2, 19016, 121466, 276-4775; 3819, COL5A3, 19018, 121468, 87-5324; 3820, COL6A1, 19020, 121470, 83-3163; 3820, COL6A1, 19019, 121469, 115-3201; 3821, COL6A2, 19025, 121475, 379-919; 3821, COL6A2, 19026, 121476, 1-750; 3821, COL6A2, 19021, 121471, 105-3164; 3821, COL6A2, 19022, 121472, 83-2569; 3821, COL6A2, 19023, 121473, 28-2784; 3821, COL6A2, 19024, 121474, 64-2550; 3822, COL6A3, 19028, 121478, 227-7936; 3822, COL6A3, 19033, 121483, 256-2379; 3822, COL6A3, 19035, 121485, 1-522; 3822, COL6A3, 19027, 121477, 454-9987; 3822, COL6A3, 19029, 121479, 286-9201; 3822, COL6A3, 19030, 121480, 286-3396; 3822, COL6A3, 19031, 121481, 256-3969; 3822, COL6A3, 19032, 121482, 1-8916; 3822, COL6A3, 19034, 121484, 227-7939; 3823, COL6A5, 19036, 121486, 495-8330; 3823, COL6A5, 19038, 121488, 1-1674; 3823, COL6A5, 19039, 121489, 1-2335; 3823, COL6A5, 19040, 121490, 1-1332; 3823, COL6A5, 19037, 121487, 495-8342; 3824, COL6A6, 19042, 121492, 1-778; 3824, COL6A6, 19043, 121493, 1-895; 3824, COL6A6, 19041, 121491, 32-6823; 3825, COL7A1, 19045, 121495, 79-597; 3825, COL7A1, 19044, 121494, 109-8943; 3826, COL8A1, 19048, 121498, 319-659; 3826, COL8A1, 19049, 121499, 342-948; 3826, COL8A1, 19046, 121496, 381-2615; 3826, COL8A1, 19047, 121497, 198-2432; 3827, COL8A2, 19052, 121502, 58-1974; 3827, COL8A2, 19053, 121503, 8-1291; 3827, COL8A2, 19050, 121500, 8-2119; 3827, COL8A2, 19051, 121501, 226-2337; 3828, COL10A1, 19056, 121506, 150-303; 3828, COL10A1, 19057, 121507, 84-732; 3828, COL10A1, 19054, 121504, 97-2139; 3828, COL10A1, 19055, 121505, 409-2451; 3829, COL11A1, 19061, 121511, 1-1709; 3829, COL11A1, 19062, 121512, 1-603; 3829, COL11A1, 19064, 121514, 1-2084; 3829, COL11A1, 19058, 121508, 319-5622; 3829, COL11A1, 19059, 121509, 319-5775; 3829, COL11A1, 19060, 121510, 314-5734; 3829, COL11A1, 19063, 121513, 302-5374; 3830, COL11A2, 19065, 121515, 229-5439; 3830, COL11A2, 19066, 121516, 229-5118; 3830, COL11A2, 19067, 121517, 260-5212; 3830, COL11A2, 19070, 121520, 260-5212; 3830, COL11A2, 19072, 121522, 1-1001; 3830, COL11A2, 19073, 121523, 260-5212; 3830, COL11A2, 19074, 121524, 228-2099; 3830, COL11A2, 19075, 121525, 228-2099; 3830, COL11A2, 19076, 121526, 215-1087; 3830, COL11A2, 19077, 121527, 228-2099; 3830, COL11A2, 19078, 121528, 228-2099; 3830, COL11A2, 19080, 121530, 1-1001; 3830, COL11A2, 19081, 121531, 1-4871; 3830, COL11A2, 19082, 121532, 228-2099; 3830, COL11A2, 19084, 121534, 260-5212; 3830, COL11A2, 19085, 121535, 1-791; 3830, COL11A2, 19086, 121536, 260-5212; 3830, COL11A2, 19088, 121538, 1-1790; 3830, COL11A2, 19089, 121539, 228-2099; 3830, COL11A2, 19090, 121540, 229-5118; 3830, COL11A2, 19091, 121541, 229-5439; 3830, COL11A2, 19093, 121543, 229-5439; 3830, COL11A2, 19094, 121544, 229-5439; 3830, COL11A2, 19095, 121545, 229-5439; 3830, COL11A2, 19097, 121547, 229-5118; 3830, COL11A2, 19098, 121548, 229-5118; 3830, COL11A2, 19099, 121549, 229-5118; 3830, COL11A2, 19068, 121518, 260-5212; 3830, COL11A2, 19069, 121519, 215-1087; 3830, COL11A2, 19071, 121521, 215-1087; 3830, COL11A2, 19079, 121529, 215-1087; 3830, COL11A2, 19083, 121533, 215-1087; 3830, COL11A2, 19087, 121537, 215-1087; 3830, COL11A2, 19092, 121542, 229-5118; 3830, COL11A2, 19096, 121546, 229-5439; 3831, COL12A1, 19102, 121552, 1-1914; 3831, COL12A1, 19103, 121553, 1-2271; 3831, COL12A1, 19105, 121555, 82-9270; 3831, COL12A1, 19106, 121556, 1-624; 3831, COL12A1, 19107, 121557, 3734-9358; 3831, COL12A1, 19100, 121550, 111-5810; 3831, COL12A1, 19101, 121551, 311-9502; 3831, COL12A1, 19104, 121554, 1-8964; 3832, COL13A1, 19110, 121560, 307-2235; 3832, COL13A1, 19111, 121561, 1-743; 3832, COL13A1, 19113, 121563, 1-523; 3832, COL13A1, 19117, 121567, 494-2242; 3832, COL13A1, 19108, 121558, 493-2580; 3832, COL13A1, 19109, 121559, 493-2544; 3832, COL13A1, 19112, 121562, 493-2646; 3832, COL13A1, 19114, 121564, 307-2244; 3832, COL13A1, 19115, 121565, 1-2061; 3832, COL13A1, 19116, 121566, 1-2007; 3832, COL13A1, 19118, 121568, 1-1833; 3833, COL14A1, 19119, 121569, 381-2654; 3833, COL14A1, 19122, 121572, 1-450; 3833, COL14A1, 19123, 121573, 1-2532; 3833, COL14A1, 19124, 121574, 297-1901; 3833, COL14A1, 19125, 121575, 1-1008; 3833, COL14A1, 19126, 121576, 175-1779; 3833, COL14A1, 19120, 121570, 271-5661; 3833, COL14A1, 19121, 121571, 271-5613; 3834, COL19A1, 19127, 121577, 1-111; 3834, COL19A1, 19128, 121578, 255-437; 3834, COL19A1, 19129, 121579, 103-3531; 3835, COL15A1, 19131, 121581, 392-4516; 3835, COL15A1, 19130, 121580, 424-4590; 3836, COL16A1, 19132, 121582, 1-924; 3836, COL16A1, 19133, 121583, 518-3418; 3836, COL16A1, 19135, 121585, 1-672; 3836, COL16A1, 19136, 121586, 1-706; 3836, COL16A1, 19134, 121584, 518-5332; 3837, COL17A1, 19139, 121589, 68-1321; 3837, COL17A1, 19140, 121590, 1-200; 3837, COL17A1, 19137, 121587, 292-4785; 3837, COL17A1, 19138, 121588, 292-4539; 3838, COL18A1, 19141, 121591, 1-2064; 3838, COL18A1, 19145, 121595, 1-839; 3838, COL18A1, 19142, 121592, 43-4602; 3838, COL18A1, 19143, 121593, 1-5265; 3838, COL18A1, 19144, 121594, 95-4114; 3839, COL20A1, 19147, 121597, 1-750; 3839, COL20A1, 19148, 121598, 1-1204; 3839, COL20A1, 19146, 121596, 101-3955; 3839, COL20A1, 19149, 121599, 69-3962; 3840, COL21A1, 19151, 121601, 216-624; 3840, COL21A1, 19153, 121603, 1-377; 3840, COL21A1, 19154, 121604, 1-240; 3840, COL21A1, 19155, 121605, 162-3032; 3840, COL21A1, 19150, 121600, 399-3272; 3840, COL21A1, 19152, 121602, 163-3027; 3841, COL22A1, 19158, 121608, 1-198; 3841, COL22A1, 19156, 121606, 448-5328; 3841, COL22A1, 19157, 121607, 40-3999; 3842, COL23A1, 19160, 121610, 70-1251; 3842, COL23A1, 19159, 121609, 359-1981; 3843, COL24A1, 19162, 121612, 368-3040; 3843, COL24A1, 19163, 121613, 1-500; 3843, COL24A1, 19164, 121614, 123-366; 3843, COL24A1, 19161, 121611, 368-5512; 3844, COL25A1, 19166, 121616, 349-2286; 3844, COL25A1, 19168, 121618, 218-428; 3844, COL25A1, 19169, 121619, 1-88; 3844, COL25A1, 19170, 121620, 122-1612; 3844, COL25A1, 19171, 121621, 342-1343; 3844, COL25A1, 19172, 121622, 129-1613; 3844, COL25A1, 19165, 121615, 532-2460; 3844, COL25A1, 19167, 121617, 532-

2496; 3845, COL26A1, 19173, 121623, 214-1539; 3845, COL26A1, 19174, 121624, 157-1476; 3846, COL27A1, 19176, 121626, 1-2145; 3846, COL27A1, 19177, 121627, 1-1456; 3846, COL27A1, 19175, 121625, 392-5974; 3847, COL28A1, 19179, 121629, 1-243; 3847, COL28A1, 19180, 121630, 1-204; 3847, COL28A1, 19181, 121631, 1-393; 3847, COL28A1, 19182, 121632, 1-429; 3847, COL28A1, 19178, 121628, 142-3519; 3848, COLQ, 19186, 121636, 127-1497; 3848, COLQ, 19187, 121637, 1-582; 3848, COLQ, 19183, 121633, 286-1623; 3848, COLQ, 19184, 121634, 112-1377; 3848, COLQ, 19185, 121635, 127-1494; 3849, CRMP1, 19190, 121640, 535-2247; 3849, CRMP1, 19188, 121638, 90-2150; 3849, CRMP1, 19189, 121639, 216-1934; 3850, COLEC10, 19191, 121641, 42-875; 3851, COLEC11, 19199, 121649, 212-581; 3851, COLEC11, 19200, 121650, 42-392; 3851, COLEC11, 19192, 121642, 235-1041; 3851, COLEC11, 19193, 121643, 104-919; 3851, COLEC11, 19194, 121644, 364-1107; 3851, COLEC11, 19195, 121645, 141-806; 3851, COLEC11, 19196, 121646, 492-1229; 3851, COLEC11, 19197, 121647, 141-806; 3851, COLEC11, 19198, 121648, 141-734; 3851, COLEC11, 19201, 121651, 212-1069; 3852, COLEC12, 19202, 121652, 209-2437; 3853, CSF1, 19204, 121654, 240-597; 3853, CSF1, 19208, 121658, 212-551; 3853, CSF1, 19209, 121659, 155-1009; 3853, CSF1, 19210, 121660, 127-577; 3853, CSF1, 19203, 121653, 392-2056; 3853, CSF1, 19205, 121655, 39-1355; 3853, CSF1, 19206, 121656, 126-1790; 3853, CSF1, 19207, 121657, 117-887; 3854, CSF1R, 19212, 121662, 508-655; 3854, CSF1R, 19213, 121663, 164-2179; 3854, CSF1R, 19214, 121664, 1-195; 3854, CSF1R, 19211, 121661, 293-3211; 3854, CSF1R, 19215, 121665, 1-921; 3855, CSF2, 19216, 121666, 35-469; 3856, CSF2RA, 19224, 121674, 293-856; 3856, CSF2RA, 19225, 121675, 89-802; 3856, CSF2RA, 19227, 121677, 150-1007; 3856, CSF2RA, 19229, 121679, 163-435; 3856, CSF2RA, 19217, 121667, 150-1283; 3856, CSF2RA, 19218, 121668, 150-851; 3856, CSF2RA, 19219, 121669, 19-1020; 3856, CSF2RA, 19220, 121670, 163-1395; 3856, CSF2RA, 19221, 121671, 187-1389; 3856, CSF2RA, 19222, 121672, 171-1373; 3856, CSF2RA, 19223, 121673, 195-1499; 3856, CSF2RA, 19226, 121676, 323-1525; 3856, CSF2RA, 19228, 121678, 363-1166; 3857, CSF2RB, 19230, 121680, 218-2887; 3857, CSF2RB, 19233, 121683, 284-969; 3857, CSF2RB, 19231, 121681, 223-2916; 3857, CSF2RB, 19232, 121682, 75-2786; 3858, CSF3, 19235, 121685, 217-819; 3858, CSF3, 19238, 121688, 177-671; 3858, CSF3, 19239, 121689, 30-203; 3858, CSF3, 19240, 121690, 115-579; 3858, CSF3, 19234, 121684, 32-655; 3858, CSF3, 19236, 121686, 9-524; 3858, CSF3, 19237, 121687, 115-729; 3859, CSF3R, 19246, 121696, 448-512; 3859, CSF3R, 19247, 121697, 1-1166; 3859, CSF3R, 19241, 121691, 24-2375; 3859, CSF3R, 19242, 121692, 24-2534; 3859, CSF3R, 19243, 121693, 549-3140; 3859, CSF3R, 19244, 121694, 549-2900; 3859, CSF3R, 19245, 121695, 549-3059; 3860, COLCA2, 19250, 121700, 504-823; 3860, COLCA2, 19248, 121698, 759-1223; 3860, COLCA2, 19249, 121699, 570-1034; 3860, COLCA2, 19251, 121701, 504-968; 3860, COLCA2, 19252, 121702, 37-792; 3861, COMMD10, 19254, 121704, 38-457; 3861, COMMD10, 19255, 121705, 1-366; 3861, COMMD10, 19256, 121706, 135-701; 3861, COMMD10, 19257, 121707, 70-636; 3861, COMMD10, 19253, 121703, 63-671; 3862, COMMD2, 19258, 121708, 29-436; 3862, COMMD2, 19259, 121709, 7-372; 3862, COMMD2, 19260, 121710, 56-655; 3863, COMMD3, 19262, 121712, 1-449; 3863, COMMD3, 19263, 121713, 1-490; 3863, COMMD3, 19264, 121714, 1-532; 3863, COMMD3, 19265, 121715, 1-146; 3863, COMMD3, 19266, 121716, 1-225; 3863, COMMD3, 19261, 121711, 445-1032; 3864, COMMD4, 19270, 121720, 34-666; 3864, COMMD4, 19271, 121721, 38-571; 3864, COMMD4, 19272, 121722, 52-461; 3864, COMMD4, 19273, 121723, 40-480; 3864, COMMD4, 19274, 121724, 37-369; 3864, COMMD4, 19275, 121725, 30-188; 3864, COMMD4, 19267, 121717, 200-799; 3864, COMMD4, 19268, 121718, 32-454; 3864, COMMD4, 19269, 121719, 15-614; 3864, COMMD4, 19276, 121726, 71-412; 3865, COMMD5, 19280, 121730, 336-848; 3865, COMMD5, 19281, 121731, 336-849; 3865, COMMD5, 19282, 121732, 1-511; 3865, COMMD5, 19277, 121727, 254-928; 3865, COMMD5, 19278, 121728, 133-807; 3865, COMMD5, 19279, 121729, 423-1097; 3865, COMMD5, 19283, 121733, 400-1074; 3866, COMMD6, 19285, 121735, 166-285; 3866, COMMD6, 19287, 121737, 139-441; 3866, COMMD6, 19289, 121739, 1-120; 3866, COMMD6, 19284, 121734, 37-333; 3866, COMMD6, 19286, 121736, 166-423; 3866, COMMD6, 19288, 121738, 1-258; 3867, COMMD7, 19292, 121742, 16-488; 3867, COMMD7, 19293, 121743, 55-228; 3867, COMMD7, 19290, 121740, 607-1209; 3867, COMMD7, 19291, 121741, 65-664; 3868, COMMD8, 19294, 121744, 69-620; 3869, COMMD9, 19297, 121747, 13-570; 3869, COMMD9, 19295, 121745, 18-614; 3869, COMMD9, 19296, 121746, 38-508; 3870, COMMD3-BMI1, 19298, 121748, 1-161; 3870, COMMD3-BMI1, 19299, 121749, 31-508; 3870, COMMD3-BMI1, 19300, 121750, 10-1419; 3870, COMMD3-BMI1, 19301, 121751, 1-329; 3871, CR1, 19302, 121752, 1-7470; 3871, CR1, 19304, 121754, 112-6231; 3871, CR1, 19307, 121757, 1-1981; 3871, CR1, 19308, 121758, 8-1822; 3871, CR1, 19303, 121753, 112-6231; 3871, CR1, 19305, 121755, 112-6231; 3871, CR1, 19306, 121756, 41-6160; 3872, CR1L, 19310, 121760, 1-1167; 3872, CR1L, 19309, 121759, 61-1770; 3873, CR2, 19313, 121763, 190-3105; 3873, CR2, 19311, 121761, 190-3468; 3873, CR2, 19312, 121762, 190-3291; 3874, C1QBP, 19315, 121765, 357-383; 3874, C1QBP, 19316, 121766, 151-687; 3874, C1QBP, 19317, 121767, 156-688; 3874, C1QBP, 19314, 121764, 83-931; 3875, C1QA, 19320, 121770, 107-768; 3875, C1QA, 19318, 121768, 205-942; 3875, C1QA, 19319, 121769, 38-775; 3876, C1QB, 19322, 121772, 292-977; 3876, C1QB, 19323, 121773, 347-1102; 3876, C1QB, 19324, 121774, 218-677; 3876, C1QB, 19321, 121771, 133-894; 3877, C1QC, 19325, 121775, 248-985; 3877, C1QC, 19326, 121776, 119-856; 3877, C1QC, 19327, 121777, 99-836; 3878, C1QL1, 19328, 121778, 24-800; 3879, C1QL2, 19329, 121779, 621-1484; 3880, C1QL3, 19330, 121780, 941-1708; 3880, C1QL3, 19331, 121781, 81-722; 3881, C1QL4, 19332, 121782, 712-1428; 3882, C1R, 19334, 121784, 85-2100; 3882, C1R, 19335, 121785, 239-519; 3882, C1R, 19336, 121786, 377-591; 3882, C1R, 19337, 121787, 106-575; 3882, C1R, 19338, 121788, 407-553; 3882, C1R, 19339, 121789, 77-2236; 3882, C1R, 19340, 121790, 54-521; 3882, C1R, 19341, 121791, 43-477; 3882, C1R, 19333, 121783, 220-2337; 3883, C1RL, 19343, 121793, 18-592; 3883, C1RL, 19344, 121794, 1-252; 3883, C1RL, 19345, 121795, 18-350; 3883, C1RL, 19346, 121796, 1-256; 3883, C1RL, 19347, 121797, 1-582; 3883, C1RL, 19348, 121798, 59-1003; 3883, C1RL, 19349, 121799, 31-594; 3883, C1RL, 19350, 121800, 1-200; 3883, C1RL, 19342, 121792, 94-1557; 3884, C1S, 19353, 121803, 648-2213; 3884, C1S, 19354, 121804, 530-1034; 3884, C1S, 19356, 121806, 1-1067; 3884, C1S, 19357, 121807, 272-573; 3884, C1S, 19358, 121808, 359-667; 3884, C1S, 19359, 121809, 191-661; 3884, C1S, 19360, 121810, 418-2466; 3884, C1S, 19351, 121801, 525-2591; 3884, C1S, 19352, 121802, 277-2343; 3884, C1S, 19355, 121805, 629-2695; 3885, C2, 19363, 121813, 1-1580; 3885, C2, 19364, 121814, 3-1580; 3885, C2, 19366, 121816, 3-1580; 3885, C2, 19367, 121817, 64-539; 3885, C2, 19368, 121818, 143-561; 3885, C2, 19369, 121819, 150-404; 3885, C2, 19370, 121820, 229-605; 3885, C2, 19371, 121821, 69-576; 3885, C2, 19372, 121822, 143-561; 3885, C2, 19373, 121823, 1-435; 3885, C2, 19374, 121824, 3-1580; 3885, C2, 19375, 121825, 229-837; 3885, C2, 19376, 121826, 143-561; 3885, C2, 19377, 121827, 64-539; 3885, C2, 19378, 121828, 229-605; 3885, C2, 19380, 121830, 229-605; 3885, C2, 19382, 121832, 1-435; 3885, C2, 19383, 121833, 1-403; 3885, C2, 19385, 121835, 69-576; 3885, C2, 19386, 121836, 3-1580; 3885, C2, 19387, 121837, 69-576; 3885, C2, 19388, 121838, 3-1580; 3885, C2, 19389, 121839, 143-561; 3885, C2, 19391, 121841, 143-561; 3885, C2, 19392, 121842, 143-561; 3885, C2, 19393, 121843, 229-605; 3885, C2, 19394, 121844, 223-1281; 3885, C2, 19395, 121845, 229-605; 3885, C2, 19396, 121846, 69-576; 3885, C2, 19398, 121848, 64-539; 3885, C2, 19399, 121849, 51-1037; 3885, C2, 19401, 121851, 223-1281; 3885, C2, 19402, 121852, 229-605; 3885, C2, 19403, 121853, 223-1281; 3885, C2, 19404, 121854, 64-539; 3885, C2, 19405, 121855, 223-1281; 3885, C2, 19406, 121856, 143-561; 3885, C2, 19407, 121857, 223-1281; 3885, C2, 19408, 121858, 223-1281; 3885, C2, 19409, 121859, 64-539; 3885, C2, 19410, 121860, 3-1580; 3885, C2, 19411, 121861, 1-403; 3885, C2, 19412, 121862, 220-1609; 3885, C2, 19413, 121863, 1-482; 3885, C2, 19414, 121864, 15-329; 3885, C2, 19415, 121865, 222-1742; 3885, C2, 19416, 121866, 128-536; 3885, C2, 19417, 121867, 131-385; 3885, C2, 19420, 121870, 782-2302; 3885, C2, 19421, 121871, 392-2563; 3885, C2, 19423, 121873, 392-2563; 3885, C2, 19425, 121875, 392-2563; 3885, C2, 19426, 121876, 392-2563; 3885, C2, 19428, 121878, 392-2563; 3885, C2, 19429, 121879, 782-2302; 3885, C2, 19430, 121880, 392-2563; 3885, C2, 19432, 121882, 222-1742; 3885, C2, 19435, 121885, 222-1742; 3885, C2, 19436, 121886, 222-1742; 3885, C2, 19438, 121888, 222-1742; 3885, C2, 19361, 121811, 277-2535; 3885, C2, 19362, 121812, 262-2520; 3885, C2, 19365, 121815, 262-2520; 3885, C2, 19379, 121829, 69-1685; 3885, C2, 19381, 121831, 262-2520; 3885, C2, 19384, 121834, 258-2120; 3885, C2, 19390, 121840, 262-2520; 3885, C2, 19397, 121847, 262-2520; 3885, C2, 19400, 121850, 262-2520; 3885, C2, 19418, 121868, 277-2139; 3885, C2, 19419, 121869, 277-2139; 3885, C2, 19422, 121872, 277-2139; 3885, C2, 19424, 121874, 277-2139; 3885, C2, 19427, 121877, 277-2139; 3885, C2, 19431, 121881, 277-2139; 3885, C2, 19433, 121883, 69-1685; 3885, C2, 19434, 121884, 69-1685; 3885, C2, 19437, 121887, 69-1685; 3885, C2, 19439, 121889, 69-1685; 3886, C3, 19441, 121891, 1-301; 3886, C3, 19442, 121892, 1-576; 3886, 03, 19443, 121893, 1-303; 3886, C3, 19444, 121894, 399-708; 3886, C3, 19440, 121890, 94-5085; 3887, C3AR1, 19446, 121896, 128-567; 3887, C3AR1, 19445, 121895, 205-1653; 3888, C4BPA, 19448, 121898, 79-435; 3888, C4BPA, 19449, 121899, 253-708; 3888, C4BPA, 19447, 121897, 195-1988; 3889, C4BPB, 19454, 121904, 200-742; 3889, C4BPB, 19450, 121900, 295-1053; 3889, C4BPB, 19451, 121901, 294-1049; 3889, C4BPB, 19452, 121902, 156-914; 3889, C4BPB, 19453, 121903, 130-888; 3890, C4A, 19455, 121905, 85-5319; 3890, C4A, 19460, 121910, 52-5148; 3890, C4A, 19461, 121911, 52-5148; 3890, C4A, 19462, 121912, 52-5148; 3890, C4A, 19463, 121913, 22-5256; 3890, C4A, 19456, 121906, 85-5319; 3890, C4A, 19457, 121907, 85-5319; 3890, 04A, 19458, 121908, 85-5319; 3890, C4A, 19459, 121909, 41-5137; 3891, C4B, 19465, 121915, 1-5097; 3891, C4B, 19469, 121919, 1-5097; 3891, C4B, 19470, 121920, 1-5097; 3891, C4B, 19471, 121921, 52-5148; 3891, C4B, 19464, 121914, 85-5319; 3891, C4B, 19466, 121916, 85-5319; 3891, C4B, 19467, 121917, 85-5319; 3891, C4B, 19468, 121918, 85-5319; 3892, C4B_2, 19473, 121923, 52-5148; 3892, C4B_2, 19472, 121922, 85-5319; 3893, 05, 19474, 121924, 31-5061; 3894, C5AR1, 19476, 121926, 730-781; 3894, C5AR1, 19475, 121925, 23-1075; 3895, C5AR2, 19477, 121927, 72-1085; 3895, C5AR2, 19478, 121928, 219-1232; 3896, 06, 19481, 121931, 131-530; 3896, C6, 19482, 121932, 398-490; 3896, 06, 19479, 121929, 266-3070; 3896, C6, 19480, 121930, 156-2960; 3897, 07, 19483, 121933, 360-2891; 3898, C8A, 19484, 121934, 97-1851; 3899, C8B, 19486, 121936, 508-2097; 3899, C8B, 19487, 121937, 571-2190; 3899, 08B, 19485, 121935, 68-1843; 3900, C8G, 19489, 121939, 76-567; 3900, C8G, 19488, 121938, 61-669; 3901, 09, 19490, 121940, 97-1776; 3902, CFB, 19491, 121941, 154-1921; 3902, CFB, 19492, 121942, 229-1996; 3902, CFB, 19504, 121954, 97-357; 3902, CFB, 19505, 121955, 1-205; 3902, CFB, 19506, 121956, 1-917; 3902, CFB, 19507, 121957, 154-586; 3902, CFB, 19493, 121943, 154-2448; 3902, CFB, 19494, 121944, 229-2523; 3902, CFB, 19495, 121945, 229-2523; 3902, CFB, 19496, 121946, 229-2523; 3902, CFB, 19497, 121947, 154-2448; 3902, CFB, 19498, 121948, 229-2523; 3902, CFB, 19499, 121949, 229-2523; 3902, CFB, 19500, 121950, 154-2448; 3902, CFB, 19501, 121951, 154-2448; 3902, CFB, 19502, 121952, 154-2448; 3902, CFB, 19503, 121953, 514-2808; 3903, CFD, 19509, 121959, 27-809; 3903, CFD, 19511, 121961, 27-809; 3903, CFD, 19508, 121958, 48-809; 3903, CFD, 19510, 121960, 48-809; 3904, CFH, 19512, 121962, 63-1220; 3904, CFH, 19514, 121964, 74-1423; 3904, CFH, 19513, 121963, 241-3936; 3905, CFHR1, 19516, 121966, 65-880; 3905, CFHR1, 19515, 121965, 89-1081; 3906, CFHR2, 19518, 121968, 110-874; 3906, CFHR2, 19517, 121967, 101-913; 3907, CFHR3, 19520, 121970, 75-773; 3907, CFHR3, 19522, 121972, 75-773; 3907, CFHR3, 19523, 121973, 72-659; 3907, CFHR3, 19519, 121969, 93-1085; 3907, CFHR3, 19521, 121971, 72-881; 3908, CFHR4, 19526, 121976, 49-1044; 3908, CFHR4, 19527, 121977, 430-1035; 3908, CFHR4, 19524, 121974, 70-1065; 3908, CFHR4, 19525, 121975, 138-1871; 3909, CFHR5, 19528, 121978, 110-1819; 3910, N/A, 19529, 121979, 101-913; 3911, CFI, 19531, 121981, 81-1856; 3911, CFI, 19532, 121982, 8-493; 3911, CFI, 19533, 121983, 15-1745; 3911, CFI, 19534, 121984, 209-1345; 3911, CFI, 19530, 121980, 209-1960; 3912, CFP, 19536, 121986, 122-1369; 3912, CFP, 19538, 121988, 428-928; 3912, CFP, 19535, 121985, 243-1652; 3912, CFP, 19537, 121987, 122-1531; 3913, CPLX1, 19540, 121990, 168-497; 3913, CPLX1, 19541, 121991, 127-468; 3913, CPLX1, 19539, 121989, 233-637; 3914, CPLX2, 19544, 121994, 225-557; 3914, CPLX2, 19546, 121996, 450-469; 3914, CPLX2, 19547, 121997, 613-970; 3914, CPLX2, 19548, 121998, 300-532; 3914, CPLX2, 19549, 121999, 455-567; 3914, CPLX2, 19550, 122000, 217-429; 3914, CPLX2, 19542, 121992, 644-1048; 3914, CPLX2, 19543, 121993, 297-701; 3914, CPLX2, 19545, 121995, 164-568; 3915, CPLX3, 19551, 122001, 158-634; 3916, CPLX4, 19553, 122003, 83-376; 3916, CPLX4, 19552, 122002, 188-670; 3917, COG1, 19555, 122005, 1-2887; 3917, COG1, 19556, 122006, 1-373; 3917, COG1, 19557, 122007, 1-81; 3917, COG1, 19558, 122008, 1-308; 3917, COG1, 19559, 122009, 1-379; 3917, COG1, 19560, 122010, 337-3159; 3917, COG1, 19554, 122004, 81-3023; 3918, COG2, 19563, 122013, 336-2375; 3918, COG2, 19564, 122014, 103-477; 3918, COG2, 19561, 122011, 41-2254; 3918, COG2, 19562, 122012, 116-2332; 3919, COG3, 19566, 122016, 1-206; 3919, COG3, 19568, 122018, 1-255; 3919, COG3, 19565, 122015, 113-2599; 3919, COG3, 19567, 122017, 33-1367; 3920, COG4, 19569, 122019, 23-2392; 3920, COG4, 19570, 122020, 12-2318; 3920, COG4, 19572, 122022, 12-314; 3920, COG4, 19573, 122023, 8-589; 3920, COG4, 19574, 122024, 1-432; 3920, COG4, 19575, 122025, 16-408; 3920, COG4, 19576, 122026, 175-647; 3920, COG4, 19577, 122027, 1-218; 3920, COG4, 19571, 122021, 1-1014; 3921, COG5, 19581, 122031, 39-576; 3921, COG5, 19578, 122028, 526-3108; 3921, COG5, 19579, 122029, 52-2571; 3921, COG5, 19580, 122030, 273-2744; 3922, COG6, 19585, 122035, 66-251; 3922, COG6, 19586, 122036, 66-254; 3922, COG6, 19587, 122037, 77-262; 3922, COG6, 19588, 122038, 1-403; 3922, COG6, 19589, 122039, 1-186; 3922, COG6, 19582, 122032, 4-231; 3922, COG6, 19583, 122033, 51-2024; 3922, COG6, 19584, 122034, 101-1948; 3923, COG7, 19591, 122041, 1-265; 3923, COG7, 19592, 122042, 1-341; 3923, COG7, 19590, 122040, 187-2499; 3924, COG8, 19594, 122044, 32-1636; 3924, COG8, 19595, 122045, 1-670; 3924, COG8, 19596, 122046, 414-712; 3924, COG8, 19597, 122047, 1-365; 3924, COG8, 19593, 122043, 116-1954; 3925, CRX, 19600, 122050, 262-433; 3925, CRX, 19601, 122051, 83-208; 3925, CRX, 19598, 122048, 208-1107; 3925, CRX, 19599, 122049, 140-1039; 3926, CTGF, 19602, 122052, 202-1251; 3927, CNKSR1, 19605, 122055, 1008-2375; 3927, CNKSR1, 19606, 122056, 65-256; 3927, CNKSR1, 19607, 122057, 1-236; 3927, CNKSR1, 19608, 122058, 37-726; 3927, CNKSR1, 19609, 122059, 37-975; 3927, CNKSR1, 19603, 122053, 146-2287; 3927, CNKSR1, 19604, 122054, 40-2202; 3928, CNKSR2, 19610, 122060, 457-3153; 3928, CNKSR2, 19611, 122061, 37-3141; 3928, CNKSR2, 19612, 122062, 481-3495; 3928, CNKSR2, 19613, 122063, 481-3030; 3929, CHUK, 19614, 122064, 88-2325; 3930, CNST, 19615, 122065, 202-615; 3930, CNST, 19616, 122066, 381-2231; 3930, CNST, 19617, 122067, 270-2447; 3931, CNTN1, 19621, 122071, 194-463; 3931, CNTN1, 19622, 122072, 299-553; 3931, CNTN1, 19625, 122075, 1-174; 3931, CNTN1, 19626, 122076, 355-572; 3931, CNTN1, 19627, 122077, 368-555; 3931, CNTN1, 19618, 122068, 75-3098; 3931, CNTN1, 19619, 122069, 80-3136; 3931, CNTN1, 19620, 122070, 118-3174; 3931, CNTN1, 19623, 122073, 228-2111; 3931, CNTN1, 19624, 122074, 320-2203; 3932, CNTN2, 19628, 122078, 285-3407; 3933, CNTN3, 19629, 122079, 29-3115; 3934, CNTN4, 19632, 122082, 403-566; 3934, CNTN4, 19634, 122084, 634-1332; 3934, CNTN4, 19635, 122085, 117-528; 3934, CNTN4, 19636, 122086, 311-658; 3934, CNTN4, 19638, 122088, 1-432; 3934, CNTN4, 19630, 122080, 91-2187; 3934, CNTN4, 19631, 122081, 385-3465; 3934, CNTN4, 19633, 122083, 280-3360; 3934, CNTN4, 19637, 122087, 164-3244; 3935, CNTN5, 19639, 122089, 6-3260; 3935, CNTN5, 19644, 122094, 1-3069; 3935, CNTN5, 19640, 122090, 77-3157; 3935, CNTN5, 19641, 122091, 340-3075; 3935, CNTN5, 19642, 122092, 291-3593; 3935, CNTN5, 19643, 122093, 152-3454; 3936, CNTN6, 19646, 122096, 191-316; 3936, CNTN6, 19647, 122097, 79-270; 3936, CNTN6, 19649, 122099, 15-206; 3936, CNTN6, 19645, 122095, 552-3638; 3936, CNTN6, 19648, 122098, 628-3714; 3937, CNTNAP1, 19651, 122101, 132-2354; 3937, CNTNAP1, 19650, 122100, 218-4372; 3938, CNTNAP2, 19654, 122104, 318-676; 3938, CNTNAP2, 19656, 122106, 448-1620; 3938, CNTNAP2, 19657, 122107, 1-986; 3938, CNTNAP2, 19658, 122108, 1-986; 3938, CNTNAP2, 19652, 122102, 519-4514; 3938, CNTNAP2, 19653, 122103, 368-694; 3938, CNTNAP2, 19655, 122105, 368-694; 3939, CNTNAP3, 19660, 122110, 57-3176; 3939, CNTNAP3, 19661, 122111, 240-3863; 3939, CNTNAP3, 19662, 122112, 240-2477; 3939, CNTNAP3, 19663, 122113, 252-2066; 3939, CNTNAP3, 19659, 122109, 75-3941; 3940, CNTNAP3B, 19665, 122115, 264-2081; 3940, CNTNAP3B, 19666, 122116, 32-1990; 3940, CNTNAP3B, 19667, 122117, 394-4260; 3940, CNTNAP3B, 19668, 122118, 252-2489; 3940, CNTNAP3B, 19669, 122119, 157-3057; 3940, CNTNAP3B, 19670, 122120, 1-541; 3940, CNTNAP3B, 19671, 122121, 157-3780; 3940, CNTNAP3B, 19672, 122122, 1-501; 3940, CNTNAP3B, 19664, 122114, 417-1559; 3941, CNTNAP4, 19673, 122123, 386-4312; 3941, CNTNAP4, 19674, 122124, 140-4075; 3941, CNTNAP4, 19676, 122126, 386-4168; 3941, CNTNAP4, 19677, 122127, 1-3783; 3941, CNTNAP4, 19675, 122125, 1-3708; 3941, CNTNAP4, 19678, 122128, 386-4312; 3942, CNTNAP5, 19679, 122129, 365-4285; 3943, COPRS, 19681, 122131, 255-773; 3943, COPRS, 19682, 122132, 93-341; 3943, COPRS, 19683, 122133, 162-471; 3943, COPRS, 19684, 122134, 15-221; 3943, COPRS, 19680, 122130, 139-693; 3944, COPS2, 19687, 122137, 27-1166; 3944, COPS2, 19688, 122138, 13-803; 3944, COPS2, 19689, 122139, 27-575; 3944, COPS2, 19690, 122140, 1-168; 3944, COPS2, 19685, 122135, 84-1436; 3944, COPS2, 19686, 122136, 75-1406; 3945, COPS3, 19692, 122142, 54-1009; 3945, COPS3, 19693, 122143, 133-1170; 3945, COPS3, 19695, 122145, 88-411; 3945, COPS3, 19696, 122146, 61-411; 3945, COPS3, 19697, 122147, 1-63; 3945, COPS3, 19698, 122148, 61-156; 3945, COPS3, 19699, 122149, 88-150; 3945, COPS3, 19700, 122150, 6-101; 3945, COPS3, 19701, 122151, 1-53; 3945, COPS3, 19702, 122152, 1-156; 3945, COPS3, 19703, 122153, 1-365; 3945, COPS3, 19691, 122141, 108-1379; 3945, COPS3, 19694, 122144, 210-1421; 3946, COPS4, 19705, 122155, 1-1263; 3946, COPS4, 19706, 122156, 19-1335; 3946, COPS4, 19707, 122157, 53-878; 3946, COPS4, 19709, 122159, 25-180; 3946, COPS4, 19704, 122154, 136-1356; 3946, COPS4, 19708, 122158, 779-1837; 3947, COPS5, 19711, 122161, 247-453; 3947, COPS5, 19712, 122162, 34-207; 3947, COPS5, 19713, 122163, 77-313; 3947, COPS5, 19714, 122164, 224-676; 3947, COPS5, 19715, 122165, 563-1156; 3947, COPS5, 19710, 122160, 322-1326; 3948, COPS6, 19717, 122167, 94-218; 3948, COPSE, 19718, 122168, 11-991; 3948, COPS6, 19719, 122169, 1-372; 3948, COPS6, 19716, 122166, 38-1021; 3949, COPS7A, 19721, 122171, 185-373; 3949, COPS7A, 19723, 122173, 89-277; 3949, COPS7A, 19725, 122175, 205-393; 3949, COPS7A, 19726, 122176, 107-295; 3949, COPS7A, 19727, 122177, 142-930; 3949, COPS7A, 19728, 122178, 127-502; 3949, COPS7A, 19729, 122179, 192-380; 3949, COPS7A, 19730, 122180, 117-754; 3949, COPS7A, 19731, 122181, 82-297; 3949, COPS7A, 19733, 122183, 364-940; 3949, COPS7A, 19734, 122184, 116-304; 3949, COPS7A, 19735, 122185, 113-283; 3949, COPS7A, 19736, 122186, 221-403; 3949, COPS7A, 19738, 122188, 367-555; 3949, COPS7A, 19739, 122189, 183-371; 3949, COPS7A, 19720, 122170, 126-953; 3949, COPS7A, 19722, 122172, 483-1310; 3949, COPS7A, 19724, 122174, 77-904; 3949, COPS7A, 19732, 122182, 216-1043; 3949, COPS7A, 19737, 122187, 371-1198; 3950, COPS7B, 19742, 122192, 147-839; 3950, COPS7B, 19745, 122195, 111-947; 3950, COPS7B, 19746, 122196, 111-422; 3950, COPS7B, 19747, 122197, 120-356; 3950, COPS7B, 19748, 122198, 1-149; 3950, COPS7B, 19749, 122199, 121-309; 3950, COPS7B, 19750, 122200, 122-310; 3950, COPS7B, 19751, 122201, 194-358; 3950,

COPS7B, 19752, 122202, 194-400; 3950, COPS7B, 19753, 122203, 1-519; 3950, COPS7B, 19754, 122204, 120-284; 3950, COPS7B, 19755, 122205, 122-571; 3950, COPS7B, 19756, 122206, 230-859; 3950, COPS7B, 19758, 122208, 1-189; 3950, COPS7B, 19740, 122190, 142-936; 3950, COPS7B, 19741, 122191, 108-929; 3950, COPS7B, 19743, 122193, 283-756; 3950, COPS7B, 19744, 122194, 230-1024; 3950, COPS7B, 19757, 122207, 418-891; 3951, COPSE, 19761, 122211, 82-603; 3951, COPS8, 19762, 122212, 57-251; 3951, COPS8, 19763, 122213, 1-250; 3951, COPS8, 19759, 122209, 654-1283; 3951, COPS8, 19760, 122210, 296-778; 3952, CPNE9, 19764, 122214, 1-588; 3952, CPNE9, 19767, 122217, 172-1683; 3952, CPNE9, 19765, 122215, 172-1683; 3952, CPNE9, 19766, 122216, 191-1852; 3953, CPNE1, 19768, 122218, 136-1764; 3953, CPNE1, 19770, 122220, 75-1520; 3953, CPNE1, 19772, 122222, 77-1360; 3953, CPNE1, 19773, 122223, 55-748; 3953, CPNE1, 19774, 122224, 105-744; 3953, CPNE1, 19775, 122225, 184-596; 3953, CPNE1, 19776, 122226, 174-1332; 3953, CPNE1, 19777, 122227, 371-826; 3953, CPNE1, 19778, 122228, 1-626; 3953, CPNE1, 19779, 122229, 225-746; 3953, CPNE1, 19780, 122230, 195-821; 3953, CPNE1, 19781, 122231, 158-1070; 3953, CPNE1, 19782, 122232, 124-540; 3953, CPNE1, 19783, 122233, 227-831; 3953, CPNE1, 19784, 122234, 265-673; 3953, CPNE1, 19785, 122235, 201-400; 3953, CPNE1, 19786, 122236, 156-1755; 3953, CPNE1, 19787, 122237, 83-998; 3953, CPNE1, 19769, 122219, 324-1937; 3953, CPNE1, 19771, 122221, 118-1731; 3954, CPNE2, 19790, 122240, 573-936; 3954, CPNE2, 19791, 122241, 160-404; 3954, CPNE2, 19793, 122243, 1-844; 3954, CPNE2, 19788, 122238, 290-1936; 3954, CPNE2, 19789, 122239, 362-2008; 3954, CPNE2, 19792, 122242, 193-1839; 3955, CPNE3, 19795, 122245, 210-446; 3955, CPNE3, 19796, 122246, 1-785; 3955, CPNE3, 19797, 122247, 198-656; 3955, CPNE3, 19799, 122249, 274-680; 3955, CPNE3, 19800, 122250, 254-279; 3955, CPNE3, 19801, 122251, 164-581; 3955, CPNE3, 19802, 122252, 116-817; 3955, CPNE3, 19794, 122244, 59-1672; 3955, CPNE3, 19798, 122248, 164-1777; 3956, CPNE4, 19804, 122254, 358-577; 3956, CPNE4, 19809, 122259, 55-561; 3956, CPNE4, 19810, 122260, 303-550; 3956, CPNE4, 19803, 122253, 878-2551; 3956, CPNE4, 19805, 122255, 221-1948; 3956, CPNE4, 19806, 122256, 2128-3801; 3956, CPNE4, 19807, 122257, 578-2251; 3956, CPNE4, 19808, 122258, 184-1911; 3956, CPNE4, 19811, 122261, 196-1923; 3957, CPNE5, 19814, 122264, 1-870; 3957, CPNE5, 19815, 122265, 68-745; 3957, CPNE5, 19812, 122262, 626-2407; 3957, CPNE5, 19813, 122263, 147-1052; 3958, CPNE6, 19818, 122268, 239-570; 3958, CPNE6, 19819, 122269, 115-573; 3958, CPNE6, 19820, 122270, 97-575; 3958, CPNE6, 19821, 122271, 115-589; 3958, CPNE6, 19822, 122272, 513-590; 3958, CPNE6, 19823, 122273, 287-964; 3958, CPNE6, 19824, 122274, 227-543; 3958, CPNE6, 19825, 122275, 211-657; 3958, CPNE6, 19826, 122276, 199-591; 3958, CPNE6, 19827, 122277, 296-453; 3958, CPNE6, 19828, 122278, 85-282; 3958, CPNE6, 19829, 122279, 311-733; 3958, CPNE6, 19816, 122266, 312-1985; 3958, CPNE6, 19817, 122267, 147-1985; 3959, CPNE7, 19832, 122282, 117-479; 3959, CPNE7, 19833, 122283, 1-277; 3959, CPNE7, 19834, 122284, 1-519; 3959, CPNE7, 19835, 122285, 1-297; 3959, CPNE7, 19830, 122280, 131-2032; 3959, CPNE7, 19831, 122281, 108-1784; 3960, CPNE8, 19837, 122287, 51-1709; 3960, CPNE8, 19839, 122289, 514-549; 3960, CPNE8, 19836, 122286, 98-1792; 3960, CPNE8, 19838, 122288, 650-1351; 3961, CCS, 19840, 122290, 111-878; 3961, CCS, 19841, 122291, 62-811; 3961, CCS, 19843, 122293, 574-777; 3961, CCS, 19842, 122292, 442-1266; 3962, COMMD1, 19845, 122295, 1-152; 3962, COMMD1, 19846, 122296, 1-115; 3962, COMMD1, 19847, 122297, 1-97; 3962, COMMD1, 19848, 122298, 1-115; 3962, COMMD1, 19849, 122299, 33-329; 3962, COMMD1, 19844, 122294, 33-605; 3963, CPDX, 19851, 122301, 145-672; 3963, CPDX, 19852, 122302, 1-212; 3963, CPDX, 19850, 122300, 220-1584; 3964, COBL, 19856, 122306, 101-589; 3964, COBL, 19858, 122308, 1-3321; 3964, COBL, 19859, 122309, 1-1842; 3964, COBL, 19860, 122310, 1-3441; 3964, COBL, 19861, 122311, 131-1315; 3964, COBL, 19853, 122303, 167-3952; 3964, COBL, 19854, 122304, 186-1595; 3964, COBL, 19855, 122305, 186-4001; 3964, COBL, 19857, 122307, 132-1271; 3965, COBLL1, 19866, 122316, 160-575; 3965, COBLL1, 19867, 122317, 131-575; 3965, COBLL1, 19868, 122318, 71-750; 3965, COBLL1, 19869, 122319, 76-565; 3965, COBLL1, 19870, 122320, 1-772; 3965, COBLL1, 19871, 122321, 79-549; 3965, COBLL1, 19872, 122322, 227-737; 3965, COBLL1, 19873, 122323, 165-1439; 3965, COBLL1, 19874, 122324, 125-3826; 3965, COBLL1, 19862, 122312, 217-3717; 3965, COBLL1, 19863, 122313, 223-3609; 3965, COBLL1, 19864, 122314, 149-3763; 3965, COBLL1, 19865, 122315, 1-3506; 3966, C1GALT1, 19878, 122328, 409-802; 3966, C1GALT1, 19879, 122329, 292-591; 3966, C1GALT1, 19875, 122325, 63-1154; 3966, C1GALT1, 19876, 122326, 1-930; 3966, C1GALT1, 19877, 122327, 224-1315; 3967, CBFB, 19882, 122332, 230-509; 3967, CBFB, 19883, 122333, 362-545; 3967, CBFB, 19884, 122334, 257-505; 3967, CBFB, 19885, 122335, 1-181; 3967, CBFB, 19880, 122330, 262-810; 3967, CBFB, 19881, 122331, 164-727; 3968, CBFA2T2, 19893, 122343, 1000-1458; 3968, CBFA2T2, 19886, 122336, 538-2352; 3968, CBFA2T2, 19887, 122337, 368-1159; 3968, CBFA2T2, 19888, 122338, 182-1969; 3968, CBFA2T2, 19889, 122339, 40-1884; 3968, CBFA2T2, 19890, 122340, 413-2227; 3968, CBFA2T2, 19891, 122341, 337-2064; 3968, CBFA2T2, 19892, 122342, 686-2413; 3969, CBFA2T3, 19896, 122346, 214-399; 3969, CBFA2T3, 19897, 122347, 72-1327; 3969, CBFA2T3, 19898, 122348, 274-664; 3969, CBFA2T3, 19899, 122349, 218-284; 3969, CBFA2T3, 19900, 122350, 143-539; 3969, CBFA2T3, 19901, 122351, 107-469; 3969, CBFA2T3, 19902, 122352, 1-103; 3969, CBFA2T3, 19894, 122344, 398-2359; 3969, CBFA2T3, 19895, 122345, 212-1915; 3970, CIR1, 19904, 122354, 1-289; 3970, CIR1, 19903, 122353, 94-1446; 3971, CORIN, 19906, 122356, 158-2362; 3971, CORIN, 19907, 122357, 124-3051; 3971, CORIN, 19908, 122358, 1-3018; 3971, CORIN, 19909, 122359, 250-2961; 3971, CORIN, 19910, 122360, 158-2974; 3971, CORIN, 19905, 122355, 1-3129; 3972, CDSN, 19912, 122362, 28-1617; 3972, CDSN, 19913, 122363, 28-1617; 3972, CDSN, 19911, 122361, 28-1614; 3972, CDSN, 19914, 122364, 28-1617; 3972, CDSN, 19915, 122365, 15-1604; 3972, CDSN, 19916, 122366, 28-1617; 3973, CNIH1, 19918, 122368, 65-355; 3973, CNIH1, 19919, 122369, 14-424; 3973, CNIH1, 19920, 122370, 50-211; 3973, CNIH1, 19921, 122371, 65-547; 3973, CNIH1, 19922, 122372, 31-396; 3973, CNIH1, 19923, 122373, 18-119; 3973, CNIH1, 19917, 122367, 105-539; 3974, CNIH2, 19925, 122375, 268-726; 3974, CNIH2, 19926, 122376, 222-341; 3974, CNIH2, 19927, 122377, 116-304; 3974, CNIH2, 19924, 122374, 259-741; 3975, CNIH3, 19928, 122378, 883-1365; 3976, CNIH4, 19929, 122379, 33-446; 3976, CNIH4, 19931, 122381, 68-340; 3976, CNIH4, 19930, 122380, 55-333; 3976, CNIH4, 19932, 122382, 76-495; 3977, CNFN, 19933, 122383, 51-389;

3977, CNFN, 19934, 122384, 112-450; 3978, CRNN, 19935, 122385, 64-1551; 3979, CORO7-PAM16, 19936, 122386, 467-2074; 3979, CORO7-PAM16, 19937, 122387, 70-3216; 3979, CORO7-PAM16, 19938, 122388, 70-3216; 3979, CORO7-PAM16, 19939, 122389, 467-2074; 3980, CORO6, 19942, 122392, 1-1416; 3980, CORO6, 19943, 122393, 80-1378; 3980, CORO6, 19944, 122394, 273-868; 3980, CORO6, 19945, 122395, 1-88; 3980, CORO6, 19946, 122396, 338-559; 3980, CORO6, 19940, 122390, 215-1633; 3980, CORO6, 19941, 122391, 3-1421; 3981, CORO7, 19949, 122399, 79-563; 3981, CORO7, 19950, 122400, 110-250; 3981, CORO7, 19951, 122401, 79-738; 3981, CORO7, 19952, 122402, 110-593; 3981, CORO7, 19953, 122403, 407-578; 3981, CORO7, 19954, 122404, 361-687; 3981, CORO7, 19955, 122405, 47-663; 3981, CORO7, 19956, 122406, 672-729; 3981, CORO7, 19957, 122407, 525-557; 3981, CORO7, 19958, 122408, 112-581; 3981, CORO7, 19959, 122409, 1-358; 3981, CORO7, 19960, 122410, 78-422; 3981, CORO7, 19961, 122411, 361-501; 3981, CORO7, 19962, 122412, 47-666; 3981, CORO7, 19963, 122413, 1-573; 3981, CORO7, 19964, 122414, 62-202; 3981, CORO7, 19965, 122415, 79-1182; 3981, CORO7, 19967, 122417, 229-832; 3981, CORO7, 19970, 122420, 112-581; 3981, CORO7, 19971, 122421, 1-358; 3981, CORO7, 19972, 122422, 361-687; 3981, CORO7, 19973, 122423, 47-666; 3981, CORO7, 19974, 122424, 79-563; 3981, CORO7, 19975, 122425, 110-250; 3981, CORO7, 19976, 122426, 78-422; 3981, CORO7, 19977, 122427, 62-202; 3981, CORO7, 19978, 122428, 79-738; 3981, CORO7, 19979, 122429, 361-501; 3981, CORO7, 19980, 122430, 110-593; 3981, CORO7, 19981, 122431, 229-832; 3981, CORO7, 19982, 122432, 79-1182; 3981, CORO7, 19983, 122433, 525-557; 3981, CORO7, 19984, 122434, 47-663; 3981, CORO7, 19985, 122435, 407-578; 3981, CORO7, 19986, 122436, 672-729; 3981, CORO7, 19987, 122437, 1-573; 3981, CORO7, 19947, 122397, 147-2924; 3981, CORO7, 19948, 122398, 112-2835; 3981, CORO7, 19966, 122416, 110-2632; 3981, CORO7, 19968, 122418, 147-2924; 3981, CORO7, 19969, 122419, 112-2835; 3981, CORO7, 19988, 122438, 110-2632; 3982, CORO1A, 19990, 122440, 139-582; 3982, CORO1A, 19992, 122442, 189-937; 3982, CORO1A, 19993, 122443, 109-1278; 3982, CORO1A, 19994, 122444, 41-694; 3982, CORO1A, 19995, 122445, 107-844; 3982, CORO1A, 19996, 122446, 219-714; 3982, CORO1A, 19989, 122439, 306-1691; 3982, CORO1A, 19991, 122441, 237-1622; 3983, CORO1B, 19999, 122449, 134-551; 3983, CORO1B, 20000, 122450, 56-904; 3983, CORO1B, 20001, 122451, 84-866; 3983, CORO1B, 20002, 122452, 112-960; 3983, CORO1B, 19997, 122447, 112-1581; 3983, CORO1B, 19998, 122448, 134-1603; 3984, CORO1C, 20005, 122455, 164-1273; 3984, CORO1C, 20007, 122457, 114-567; 3984, CORO1C, 20008, 122458, 1-498; 3984, CORO1C, 20010, 122460, 39-547; 3984, CORO1C, 20011, 122461, 104-583; 3984, CORO1C, 20012, 122462, 413-899; 3984, CORO1C, 20013, 122463, 58-547; 3984, CORO1C, 20014, 122464, 22-566; 3984, CORO1C, 20015, 122465, 211-587; 3984, CORO1C, 20003, 122453, 174-1598; 3984, CORO1C, 20004, 122454, 50-1633; 3984, CORO1C, 20006, 122456, 227-1651; 3984, CORO1C, 20009, 122459, 268-1710; 3985, CORO2A, 20016, 122466, 259-1836; 3985, CORO2A, 20017, 122467, 83-1660; 3986, CORO2B, 20018, 122468, 310-1737; 3986, CORO2B, 20019, 122469, 355-1782; 3986, CORO2B, 20020, 122470, 76-1503; 3986, CORO2B, 20021, 122471, 295-1737; 3987, CTTN, 20025, 122475, 1-798; 3987, CTTN, 20026, 122476, 1-387; 3987, CTTN, 20022, 122472, 207-1859; 3987, CTTN, 20023, 122473, 309-1850; 3987, CTTN, 20024, 122474, 172-2076; 3988, CTTNBP2, 20028, 122478, 1-142; 3988, CTTNBP2, 20029, 122479, 1-3454; 3988, CTTNBP2, 20030, 122480, 185-470; 3988, CTTNBP2, 20031, 122481, 1-580; 3988, CTTNBP2, 20032, 122482, 95-578; 3988, CTTNBP2, 20033, 122483, 15-1937; 3988, CTTNBP2, 20034, 122484, 163-570; 3988, CTTNBP2, 20035, 122485, 1-362; 3988, CTTNBP2, 20027, 122477, 93-5084; 3989, CTXN1, 20036, 122486, 221-469; 3990, CTXN2, 20037, 122487, 373-618; 3991, CTXN3, 20038, 122488, 552-797; 3991, CTXN3, 20039, 122489, 350-595; 3991, CTXN3, 20040, 122490, 100-345; 3992, CRH, 20041, 122491, 448-1038; 3993, CRHBP, 20043, 122493, 87-803; 3993, CRHBP, 20042, 122492, 423-1391; 3994, CRHR1, 20044, 122494, 239-676; 3994, CRHR1, 20045, 122495, 266-1558; 3994, CRHR1, 20047, 122497, 483-1427; 3994, CRHR1, 20050, 122500, 1-157; 3994, CRHR1, 20052, 122502, 1-459; 3994, CRHR1, 20053, 122503, 1-223; 3994, CRHR1, 20054, 122504, 1-281; 3994, CRHR1, 20057, 122507, 266-730; 3994, CRHR1, 20058, 122508, 266-826; 3994, CRHR1, 20059, 122509, 266-1558; 3994, CRHR1, 20060, 122510, 266-1558; 3994, CRHR1, 20063, 122513, 483-1427; 3994, CRHR1, 20065, 122515, 483-1427; 3994, CRHR1, 20067, 122517, 266-730; 3994, CRHR1, 20068, 122518, 1-459; 3994, CRHR1, 20069, 122519, 1-157; 3994, CRHR1, 20071, 122521, 1-281; 3994, CRHR1, 20072, 122522, 239-676; 3994, CRHR1, 20073, 122523, 1-223; 3994, CRHR1, 20046, 122496, 226-1473; 3994, CRHR1, 20048, 122498, 19-1146; 3994, CRHR1, 20049, 122499, 1-1335; 3994, CRHR1, 20051, 122501, 1-1206; 3994, CRHR1, 20055, 122505, 266-1513; 3994, CRHR1, 20056, 122506, 19-1146; 3994, CRHR1, 20061, 122511, 1-1335; 3994, CRHR1, 20062, 122512, 266-1393; 3994, CRHR1, 20064, 122514, 226-1473; 3994, CRHR1, 20066, 122516, 266-1600; 3994, CRHR1, 20070, 122520, 1-1206; 3995, N/A, 20074, 122524, 911-1633; 3996, CRHR2, 20077, 122527, 13-309; 3996, CRHR2, 20078, 122528, 31-225; 3996, CRHR2, 20079, 122529, 13-207; 3996, CRHR2, 20075, 122525, 71-1387; 3996, CRHR2, 20076, 122526, 421-1614; 3996, CRHR2, 20080, 122530, 419-1654; 3996, CRHR2, 20081, 122531, 246-1409; 3997, CORT, 20082, 122532, 506-823; 3998, COX10, 20084, 122534, 111-626; 3998, COX10, 20085, 122535, 3-191; 3998, COX10, 20086, 122536, 3-509; 3998, COX10, 20083, 122533, 78-1409; 3999, COX11, 20090, 122540, 58-750; 3999, COX11, 20091, 122541, 1-154; 3999, COX11, 20087, 122537, 140-970; 3999, COX11, 20088, 122538, 9-704; 3999, COX11, 20089, 122539, 8-838; 4000, COX14, 20092, 122542, 301-474; 4000, COX14, 20093, 122543, 332-505; 4000, COX14, 20094, 122544, 270-443; 4000, COX14, 20095, 122545, 167-340; 4001, COX16, 20097, 122547, 4-81; 4001, COX16, 20096, 122546, 145-465; 4002, COX17, 20099, 122549, 1-176; 4002, COX17, 20100, 122550, 37-333; 4002, COX17, 20103, 122553, 1-137; 4002, COX17, 20098, 122548, 94-285; 4002, COX17, 20101, 122551, 145-336; 4002, COX17, 20102, 122552, 55-246; 4003, COX18, 20107, 122557, 44-1048; 4003, COX18, 20104, 122554, 93-1094; 4003, COX18, 20105, 122555, 93-482; 4003, COX18, 20106, 122556, 78-461; 4004, COX19, 20109, 122559, 41-409; 4004, COX19, 20108, 122558, 91-363; 4005, COX20, 20110, 122560, 100-492; 4005, COX20, 20111, 122561, 394-750; 4006, CXADR, 20112, 122562, 749-1846; 4006, CXADR, 20113, 122563, 1-270; 4006, CXADR, 20114, 122564, 1-603; 4006, CXADR, 20115, 122565, 85-843; 4006, CXADR, 20116, 122566, 1-1059; 4007, N/A, 20117, 122567, 88-1857; 4007, N/A, 20118, 122568, 1-504; 4007, N/A, 20119, 122569, 88-1767; 4007,

N/A, 20120, 122570, 1-3024; 4007, N/A, 20121, 122571, 50-1738; 4007, N/A, 20122, 122572, 50-1753; 4007, N/A, 20123, 122573, 1-3105; 4007, N/A, 20124, 122574, 50-1843; 4008, CPXCR1, 20125, 122575, 260-1165; 4008, CPXCR1, 20126, 122576, 212-1117; 4008, CPXCR1, 20127, 122577, 115-1020; 4009, N/A, 20128, 122578, 1-414; 4010, N/A, 20129, 122579, 669-1172; 4011, N/A, 20130, 122580, 1-414; 4012, N/A, 20131, 122581, 1-69; 4013, N/A, 20132, 122582, 1-108; 4014, N/A, 20133, 122583, 1-108; 4015, N/A, 20134, 122584, 1-414; 4016, CRAMP1, 20137, 122587, 1-550; 4016, CRAMP1, 20135, 122585, 1-3810; 4016, CRAMP1, 20136, 122586, 100-3909; 4017, CFDP1, 20139, 122589, 192-342; 4017, CFDP1, 20140, 122590, 1-60; 4017, CFDP1, 20141, 122591, 1-52; 4017, CFDP1, 20138, 122588, 134-1033; 4018, CRP, 20143, 122593, 105-413; 4018, CRP, 20144, 122594, 105-413; 4018, CRP, 20146, 122596, 399-539; 4018, CRP, 20142, 122592, 105-779; 4018, CRP, 20145, 122595, 105-380; 4019, CKB, 20148, 122598, 69-245; 4019, CKB, 20149, 122599, 1-540; 4019, CKB, 20150, 122600, 139-523; 4019, CKB, 20151, 122601, 1-61; 4019, CKB, 20152, 122602, 1-270; 4019, CKB, 20153, 122603, 204-856; 4019, CKB, 20147, 122597, 359-1504; 4020, CKMT1A, 20154, 122604, 239-448; 4020, CKMT1A, 20155, 122605, 316-759; 4020, CKMT1A, 20156, 122606, 181-845; 4020, CKMT1A, 20159, 122609, 177-1073; 4020, CKMT1A, 20157, 122607, 525-1778; 4020, CKMT1A, 20158, 122608, 393-1646; 4021, CKMT1B, 20161, 122611, 246-632; 4021, CKMT1B, 20162, 122612, 284-593; 4021, CKMT1B, 20163, 122613, 192-368; 4021, CKMT1B, 20164, 122614, 193-801; 4021, CKMT1B, 20166, 122616, 393-1116; 4021, CKMT1B, 20167, 122617, 254-542; 4021, CKMT1B, 20168, 122618, 193-1089; 4021, CKMT1B, 20169, 122619, 178-1074; 4021, CKMT1B, 20160, 122610, 393-1646; 4021, CKMT1B, 20165, 122615, 361-1614; 4022, CKMT2, 20173, 122623, 83-594; 4022, CKMT2, 20174, 122624, 74-546; 4022, CKMT2, 20170, 122620, 114-1373; 4022, CKMT2, 20171, 122621, 239-1498; 4022, CKMT2, 20172, 122622, 83-1342; 4023, CKM, 20175, 122625, 176-1321; 4024, CREBBP, 20178, 122628, 1-764; 4024, CREBBP, 20179, 122629, 1-545; 4024, CREBBP, 20180, 122630, 1-590; 4024, CREBBP, 20181, 122631, 1-3316; 4024, CREBBP, 20176, 122626, 811-8139; 4024, CREBBP, 20177, 122627, 205-7419; 4025, CRTC1, 20184, 122634, 33-1814; 4025, CRTC1, 20185, 122635, 100-1278; 4025, CRTC1, 20182, 122632, 27-1931; 4025, CRTC1, 20183, 122633, 26-1978; 4026, CRTC2, 20186, 122636, 119-283; 4026, CRTC2, 20187, 122637, 80-1201; 4026, CRTC2, 20189, 122639, 1-1446; 4026, CRTC2, 20188, 122638, 129-2210; 4027, CRTC3, 20192, 122642, 105-380; 4027, CRTC3, 20193, 122643, 1-570; 4027, CRTC3, 20190, 122640, 5-1864; 4027, CRTC3, 20191, 122641, 148-2004; 4028, CREBZF, 20194, 122644, 1-855; 4028, CREBZF, 20195, 122645, 1-391; 4028, CREBZF, 20198, 122648, 228-1304; 4028, CREBZF, 20199, 122649, 1-204; 4028, CREBZF, 20196, 122646, 228-1292; 4028, CREBZF, 20197, 122647, 228-1292; 4029, CREBRF, 20202, 122652, 482-559; 4029, CREBRF, 20200, 122650, 320-2239; 4029, CREBRF, 20201, 122651, 304-1557; 4029, CREBRF, 20203, 122653, 316-1569; 4030, CFC1, 20205, 122655, 289-864; 4030, CFC1, 20206, 122656, 289-735; 4030, CFC1, 20204, 122654, 264-935; 4031, CFC1B, 20208, 122658, 289-735; 4031, CFC1B, 20209, 122659, 289-864; 4031, CFC1B, 20207, 122657, 289-960; 4032, CRNKL1, 20210, 122660, 33-2543; 4032, CRNKL1, 20213, 122663, 33-347; 4032, CRNKL1, 20211, 122661, 33-2579; 4032, CRNKL1, 20212, 122662, 33-257; 4032, CRNKL1, 20214, 122664, 125-2188; 4033, CRB1, 20215, 122665, 859-2883; 4033, CRB1, 20218, 122668, 1-129; 4033, CRB1, 20221, 122671, 417-4565; 4033, CRB1, 20216, 122666, 1-3885; 4033, CRB1, 20217, 122667, 136-4356; 4033, CRB1, 20219, 122669, 136-4266; 4033, CRB1, 20220, 122670, 210-2822; 4034, CRB2, 20222, 122672, 92-3622; 4034, CRB2, 20223, 122673, 2-3859; 4034, CRB2, 20224, 122674, 111-2972; 4035, CRB3, 20225, 122675, 172-534; 4035, CRB3, 20226, 122676, 163-534; 4035, CRB3, 20227, 122677, 532-894; 4035, CRB3, 20228, 122678, 167-529; 4036, CRY1, 20230, 122680, 1-321; 4036, CRY1, 20229, 122679, 869-2629; 4037, CRY2, 20232, 122682, 23-1867; 4037, CRY2, 20233, 122683, 23-1867; 4037, CRY2, 20231, 122681, 133-1731; 4037, CRY2, 20234, 122684, 17-1798; 4038, CRYAA, 20236, 122686, 177-587; 4038, CRYAA, 20237, 122687, 125-586; 4038, CRYAA, 20235, 122685, 93-614; 4039, CRYAB, 20239, 122689, 307-695; 4039, CRYAB, 20240, 122690, 393-624; 4039, CRYAB, 20241, 122691, 1-319; 4039, CRYAB, 20244, 122694, 93-560; 4039, CRYAB, 20245, 122695, 198-517; 4039, CRYAB, 20246, 122696, 75-401; 4039, CRYAB, 20247, 122697, 445-771; 4039, CRYAB, 20248, 122698, 274-479; 4039, CRYAB, 20249, 122699, 29-353; 4039, CRYAB, 20251, 122701, 442-965; 4039, CRYAB, 20238, 122688, 186-713; 4039, CRYAB, 20242, 122692, 451-978; 4039, CRYAB, 20243, 122693, 368-895; 4039, CRYAB, 20250, 122700, 291-818; 4039, CRYAB, 20252, 122702, 219-746; 4039, CRYAB, 20253, 122703, 308-835; 4040, CRYBA1, 20255, 122705, 1-227; 4040, CRYBA1, 20254, 122704, 2-649; 4041, CRYBA2, 20258, 122708, 108-493; 4041, CRYBA2, 20256, 122706, 238-831; 4041, CRYBA2, 20257, 122707, 52-645; 4042, CRYBA4, 20259, 122709, 36-626; 4043, CRYBB1, 20260, 122710, 132-890; 4044, CRYBB2, 20261, 122711, 172-789; 4045, CRYBB3, 20263, 122713, 54-395; 4045, CRYBB3, 20262, 122712, 81-716; 4046, CRYGA, 20264, 122714, 21-545; 4047, CRYGB, 20265, 122715, 49-576; 4048, CRYGC, 20266, 122716, 39-563; 4049, CRYGD, 20267, 122717, 29-553; 4050, CRYGN, 20268, 122718, 128-676; 4050, CRYGN, 20269, 122719, 92-469; 4051, CRYGS, 20270, 122720, 126-662; 4051, CRYGS, 20271, 122721, 341-877; 4052, CRYL1, 20274, 122724, 1-445; 4052, CRYL1, 20272, 122722, 64-1023; 4052, CRYL1, 20273, 122723, 230-1123; 4053, CRYM, 20277, 122727, 25-522; 4053, CRYM, 20278, 122728, 151-874; 4053, CRYM, 20279, 122729, 381-457; 4053, CRYM, 20280, 122730, 1-293; 4053, CRYM, 20281, 122731, 275-696; 4053, CRYM, 20275, 122725, 267-1211; 4053, CRYM, 20276, 122726, 193-1137; 4054, CRYZ, 20283, 122733, 159-888; 4054, CRYZ, 20287, 122737, 59-677; 4054, CRYZ, 20282, 122732, 89-1078; 4054, CRYZ, 20284, 122734, 81-968; 4054, CRYZ, 20285, 122735, 200-778; 4054, CRYZ, 20286, 122736, 506-1495; 4055, CRYZL1, 20288, 122738, 245-1249; 4055, CRYZL1, 20289, 122739, 141-1118; 4055, CRYZL1, 20290, 122740, 74-1042; 4055, CRYZL1, 20292, 122742, 103-177; 4055, CRYZL1, 20293, 122743, 156-629; 4055, CRYZL1, 20294, 122744, 49-390; 4055, CRYZL1, 20295, 122745, 1-335; 4055, CRYZL1, 20296, 122746, 57-650; 4055, CRYZL1, 20297, 122747, 68-619; 4055, CRYZL1, 20298, 122748, 183-504; 4055, CRYZL1, 20299, 122749, 64-607; 4055, CRYZL1, 20300, 122750, 1-52; 4055, CRYZL1, 20301, 122751, 562-620; 4055, CRYZL1, 20302, 122752, 1-294; 4055, CRYZL1, 20303, 122753, 1-724; 4055, CRYZL1, 20304, 122754, 1-289; 4055, CRYZL1, 20291, 122741, 87-1136; 4055, CRYZL1, 20305, 122755, 665-1261; 4056, CSE1L, 20306, 122756, 124-3039; 4056, CSE1L, 20307, 122757, 190-2937; 4057, CSK, 20310, 122760, 385-578; 4057, CSK, 20312, 122762, 352-556; 4057, CSK, 20313, 122763, 203-534; 4057, CSK, 20308, 122758, 730-2082; 4057, CSK, 20309, 122759, 179-1531; 4057, CSK, 20311, 122761, 433-1785; 4058, CSRP2BP, 20314, 122764, 210-2555; 4058, CSRP2BP, 20316, 122766, 781-949; 4058, CSRP2BP, 20315, 122765, 342-2690; 4058, CSRP2BP, 20317, 122767, 260-2224; 4059, CTAGE15, 20318, 122768, 18-2351; 4060, CTAGE4, 20319, 122769, 39-2372; 4061, CTAGE5, 20328, 122778, 112-527; 4061, CTAGE5, 20329, 122779, 105-558; 4061, CTAGE5, 20320, 122770, 315-2729; 4061, CTAGE5, 20321, 122771, 215-2530; 4061, CTAGE5, 20322, 122772, 104-2482; 4061, CTAGE5, 20323, 122773, 47-2332; 4061, CTAGE5, 20324, 122774, 337-2766; 4061, CTAGE5, 20325, 122775, 585-2912; 4061, CTAGE5, 20326, 122776, 733-3060; 4061, CTAGE5, 20327, 122777, 269-2443; 4061, CTAGE5, 20330, 122780, 180-2369; 4062, CTAGE6, 20331, 122781, 39-2372; 4063, CTAGE8, 20332, 122782, 39-2372; 4064, CTAGE9, 20333, 122783, 1-2334; 4065, N/A, 20334, 122784, 1-419; 4065, N/A, 20335, 122785, 1-461; 4066, N/A, 20336, 122786, 410-1558; 4067, N/A, 20337, 122787, 55-309; 4068, N/A, 20338, 122788, 1-234; 4069, N/A, 20339, 122789, 398-786; 4069, N/A, 20340, 122790, 175-406; 4070, N/A, 20341, 122791, 1-447; 4071, N/A, 20342, 122792, 13-834; 4072, N/A, 20343, 122793, 151-443; 4073, N/A, 20344, 122794, 1-3537; 4074, N/A, 20345, 122795, 1-114; 4075, N/A, 20346, 122796, 1-1765; 4075, N/A, 20347, 122797, 1-1765; 4076, N/A, 20348, 122798, 1-566; 4077, N/A, 20349, 122799, 1-189; 4077, N/A, 20350, 122800, 6-155; 4077, N/A, 20351, 122801, 1-222; 4077, N/A, 20352, 122802, 1-222; 4077, N/A, 20353, 122803, 11-202; 4077, N/A, 20354, 122804, 6-155; 4078, N/A, 20355, 122805, 63-5018; 4079, N/A, 20356, 122806, 128-1567; 4080, N/A, 20357, 122807, 1-362; 4080, N/A, 20358, 122808, 144-590; 4080, N/A, 20359, 122809, 216-386; 4081, N/A, 20360, 122810, 1-233; 4082, N/A, 20361, 122811, 142-513; 4083, N/A, 20362, 122812, 83-214; 4084, N/A, 20363, 122813, 1-200; 4085, N/A, 20364, 122814, 85-561; 4086, N/A, 20365, 122815, 463-1215; 4086, N/A, 20366, 122816, 319-332; 4087, N/A, 20367, 122817, 1-284; 4088, CTDP1, 20369, 122819, 132-2660; 4088, CTDP1, 20370, 122820, 1-2400; 4088, CTDP1, 20371, 122821, 254-489; 4088, CTDP1, 20373, 122823, 103-2519; 4088, CTDP1, 20374, 122824, 148-2564; 4088, CTDP1, 20375, 122825, 1-2213; 4088, CTDP1, 20376, 122826, 254-489; 4088, CTDP1, 20368, 122818, 103-2706; 4088, CTDP1, 20372, 122822, 148-3033; 4089, CTDSP1, 20379, 122829, 1-788; 4089, CTDSP1, 20380, 122830, 1-764; 4089, CTDSP1, 20381, 122831, 1-586; 4089, CTDSP1, 20377, 122827, 337-1122; 4089, CTDSP1, 20378, 122828, 76-858; 4090, CTDSP2, 20383, 122833, 488-847; 4090, CTDSP2, 20384, 122834, 270-566; 4090, CTDSP2, 20385, 122835, 1-544; 4090, CTDSP2, 20386, 122836, 1-378; 4090, CTDSP2, 20387, 122837, 110-418; 4090, CTDSP2, 20388, 122838, 1-849; 4090, CTDSP2, 20382, 122832, 305-1120; 4091, CTDSPL2, 20392, 122842, 1-259; 4091, CTDSPL2, 20393, 122843, 96-591; 4091, CTDSPL2, 20394, 122844, 307-583; 4091, CTDSPL2, 20395, 122845, 223-575; 4091, CTDSPL2, 20389, 122839, 564-1964; 4091, CTDSPL2, 20390, 122840, 126-1526; 4091, CTDSPL2, 20391, 122841, 13-1197; 4092, CTDSPL, 20398, 122848, 1-280; 4092, CTDSPL, 20399, 122849, 1-591; 4092, CTDSPL, 20400, 122850, 23-190; 4092, CTDSPL, 20401, 122851, 1-311; 4092, CTDSPL, 20396, 122846, 27-857; 4092, CTDSPL, 20397, 122847, 241-1038; 4093, CTDNEP1, 20403, 122853, 367-741; 4093, CTDNEP1, 20405, 122855, 1-606; 4093, CTDNEP1, 20406, 122856, 376-711; 4093, CTDNEP1, 20407, 122857, 1-626; 4093, CTDNEP1, 20409, 122859, 207-876; 4093, CTDNEP1, 20410, 122860, 35-238; 4093, CTDNEP1, 20402, 122852, 469-1203; 4093, CTDNEP1, 20404, 122854, 387-1121; 4093, CTDNEP1, 20408, 122858, 380-1114; 4093, CTDNEP1, 20411, 122861, 423-1157; 4094, CNEP1R1, 20412, 122862, 83-277; 4094, CNEP1R1, 20415, 122865, 308-547; 4094, CNEP1R1, 20416, 122866, 46-372; 4094, CNEP1R1, 20420, 122870, 254-535; 4094, CNEP1R1, 20413, 122863, 111-488; 4094, CNEP1R1, 20414, 122864, 907-1335; 4094, CNEP1R1, 20417, 122867, 53-196; 4094, CNEP1R1, 20418, 122868, 37-414; 4094, CNEP1R1, 20419, 122869, 62-205; 4095, N/A, 20421, 122871, 167-397; 4096, N/A, 20422, 122872, 101-448; 4096, N/A, 20423, 122873, 1-12; 4096, N/A, 20424, 122874, 137-1381; 4096, N/A, 20425, 122875, 92-283; 4097, N/A, 20426, 122876, 1-353; 4098, N/A, 20427, 122877, 1-1418; 4099, N/A, 20428, 122878, 46-192; 4099, N/A, 20429, 122879, 50-400; 4099, N/A, 20430, 122880, 1-58; 4099, N/A, 20431, 122881, 46-243; 4099, N/A, 20432, 122882, 46-381; 4100, N/A, 20433, 122883, 1-84; 4100, N/A, 20434, 122884, 63-548; 4100, N/A, 20435, 122885, 113-958; 4101, N/A, 20436, 122886, 92-1414; 4102, N/A, 20437, 122887, 91-1167; 4103, N/A, 20438, 122888, 143-2068; 4104, N/A, 20439, 122889, 1-491; 4105, N/A, 20440, 122890, 1-595; 4106, N/A, 20441, 122891, 1-585; 4107, N/A, 20442, 122892, 1-91; 4108, N/A, 20443, 122893, 1-144; 4109, N/A, 20444, 122894, 1-3367; 4110, N/A, 20445, 122895, 124-450; 4111, N/A, 20446, 122896, 179-420; 4112, N/A, 20447, 122897, 1-213; 4113, N/A, 20448, 122898, 504-1966; 4114, N/A, 20449, 122899, 1-314; 4114, N/A, 20450, 122900, 1-229; 4115, N/A, 20451, 122901, 5-442; 4116, N/A, 20452, 122902, 1-474; 4117, N/A, 20453, 122903, 1-371; 4117, N/A, 20454, 122904, 1-353; 4117, N/A, 20455, 122905, 47-562; 4117, N/A, 20456, 122906, 1-460; 4118, N/A, 20457, 122907, 211-483; 4119, N/A, 20458, 122908, 46-2265; 4120, N/A, 20459, 122909, 1-333; 4121, N/A, 20460, 122910, 215-892; 4122, N/A, 20461, 122911, 234-428; 4122, N/A, 20462, 122912, 150-269; 4122, N/A, 20463, 122913, 186-578; 4123, N/A, 20464, 122914, 1-139; 4124, N/A, 20465, 122915, 1-89; 4125, N/A, 20466, 122916, 1-1192; 4126, N/A, 20467, 122917, 1-279; 4127, N/A, 20468, 122918, 1-254; 4128, N/A, 20469, 122919, 343-556; 4128, N/A, 20470, 122920, 108-606; 4128, N/A, 20471, 122921, 370-769; 4128, N/A, 20472, 122922, 507-540; 4128, N/A, 20473, 122923, 183-580; 4128, N/A, 20474, 122924, 218-400; 4129, N/A, 20475, 122925, 408-536; 4130, N/A, 20476, 122926, 1-517; 4131, N/A, 20477, 122927, 100-231; 4132, N/A, 20478, 122928, 79-1971; 4133, N/A, 20479, 122929, 154-9849; 4133, N/A, 20480, 122930, 1-240; 4133, N/A, 20481, 122931, 1-141; 4133, N/A, 20482, 122932, 1-1366; 4134, N/A, 20483, 122933, 205-345; 4135, N/A, 20484, 122934, 169-617; 4136, N/A, 20485, 122935, 160-402; 4137, N/A, 20486, 122936, 1-217; 4138, N/A, 20487, 122937, 1-412; 4139, N/A, 20488, 122938, 1-145; 4139, N/A, 20489, 122939, 23-178; 4139, N/A, 20490, 122940, 39-224; 4140, N/A, 20491, 122941, 262-1545; 4141, CTBP1, 20494, 122944, 269-704; 4141, CTBP1, 20495, 122945, 1-553; 4141, CTBP1, 20496, 122946, 1-862; 4141, CTBP1, 20497, 122947, 1-74; 4141, CTBP1, 20498, 122948, 593-1099; 4141, CTBP1, 20499, 122949, 1-437; 4141, CTBP1, 20500, 122950, 284-843; 4141, CTBP1, 20501, 122951, 472-985; 4141, CTBP1, 20502, 122952, 250-856; 4141, CTBP1, 20503, 122953, 1-210; 4141, CTBP1, 20492, 122942, 183-1505; 4141, CTBP1, 20493, 122943, 386-1675; 4142, CTBP2, 20506, 122956, 206-1747; 4142, CTBP2, 20508, 122958, 570-578; 4142, CTBP2, 20511, 122961, 1-352; 4142, CTBP2, 20504, 122954, 132-3089; 4142, CTBP2, 20505, 122955, 401-1738; 4142, CTBP2, 20507, 122957, 406-1743; 4142, CTBP2, 20509, 122959, 288-1625; 4142, CTBP2, 20510, 122960, 384-1721; 4143, CTPS1, 20512, 122962, 131-1906; 4143, CTPS1, 20513, 122963, 509-2284; 4144, CTPS2, 20516, 122966, 1-398; 4144, CTPS2, 20514, 122964, 358-2118; 4144, CTPS2, 20515, 122965, 255-2015; 4144, CTPS2, 20517, 122967, 745-2505; 4145, CTR9, 20519, 122969, 1-902; 4145, CTR9, 20518, 122968, 427-3948; 4146, CTC1, 20522, 122972, 1-375; 4146, CTC1, 20523, 122973, 1-371; 4146, CTC1, 20524, 122974, 1-404; 4146, CTC1, 20520, 122970, 9-3662; 4146, CTC1, 20521, 122971, 7-3102; 4147, CTTNBP2NL, 20526, 122976, 201-1014; 4147, CTTNBP2NL, 20525, 122975, 226-2145; 4148, CLEC1A, 20528, 122978, 352-562; 4148, CLEC1A, 20529, 122979, 93-836; 4148, CLEC1A, 20530, 122980, 29-595; 4148, CLEC1A, 20531, 122981, 107-307; 4148, CLEC1A, 20527, 122977, 64-906; 4149, CLEC1B, 20534, 122984, 1-291; 4149, CLEC1B, 20532, 122982, 181-870; 4149, CLEC1B, 20533, 122983, 201-791; 4149, CLEC1B, 20535, 122985, 271-861; 4150, CLEC10A, 20537, 122987, 289-1158; 4150, CLEC10A, 20540, 122990, 1-410; 4150, CLEC10A, 20536, 122986, 330-1280; 4150, CLEC10A, 20538, 122988, 271-1041; 4150, CLEC10A, 20539, 122989, 306-1184; 4151, CLEC11A, 20542, 122992, 4-957; 4151, CLEC11A, 20543, 122993, 140-877; 4151, CLEC11A, 20541, 122991, 198-1169; 4152, CLEC12A, 20547, 122997, 76-570; 4152, CLEC12A, 20544, 122994, 183-980; 4152, CLEC12A, 20545, 122995, 1-699; 4152, CLEC12A, 20546, 122996, 32-859; 4152, CLEC12A, 20548, 122998, 163-804; 4153, CLEC12B, 20552, 123002, 2-199; 4153, CLEC12B, 20549, 122999, 129-959; 4153, CLEC12B, 20550, 123000, 129-827; 4153, CLEC12B, 20551, 123001, 134-832; 4154, CLEC14A, 20553, 123003, 348-1820; 4155, CLEC16A, 20554, 123004, 1-457; 4155, CLEC16A, 20557, 123007, 1-386; 4155, CLEC16A, 20558, 123008, 1-357; 4155, CLEC16A, 20555, 123005, 138-2858; 4155, CLEC16A, 20556, 123006, 231-3392; 4156, CLEC17A, 20561, 123011, 39-722; 4156, CLEC17A, 20559, 123009, 39-836; 4156, CLEC17A, 20560, 123010, 39-1175; 4156, CLEC17A, 20562, 123012, 78-998; 4157, CLEC18A, 20565, 123015, 135-1502; 4157, CLEC18A, 20567, 123017, 375-574; 4157, CLEC18A, 20568, 123018, 219-1118; 4157, CLEC18A, 20569, 123019, 219-1130; 4157, CLEC18A, 20563, 123013, 188-1528; 4157, CLEC18A, 20564, 123014, 240-1580; 4157, CLEC18A, 20566, 123016, 219-1559; 4157, CLEC18A, 20570, 123020, 139-1479; 4158, CLEC18B, 20572, 123022, 135-1046; 4158, CLEC18B, 20573, 123023, 245-1585; 4158, CLEC18B, 20574, 123024, 139-1479; 4158, CLEC18B, 20571, 123021, 123-1490; 4159, CLEC18C, 20576, 123026, 123-1490; 4159, CLEC18C, 20579, 123029, 434-836; 4159, CLEC18C, 20580, 123030, 161-518; 4159, CLEC18C, 20582, 123032, 219-1127; 4159, CLEC18C, 20583, 123033, 219-1124; 4159, CLEC18C, 20575, 123025, 219-1559; 4159, CLEC18C, 20577, 123027, 240-1580; 4159, CLEC18C, 20578, 123028, 255-1595; 4159, CLEC18C, 20581, 123031, 139-1479; 4160, CLEC19A, 20585, 123035, 70-267; 4160, CLEC19A, 20586, 123036, 114-374; 4160, CLEC19A, 20584, 123034, 74-484; 4161, CLEC2A, 20587, 123037, 19-501; 4161, CLEC2A, 20588, 123038, 53-577; 4162, CLEC2B, 20590, 123040, 336-578; 4162, CLEC2B, 20589, 123039, 935-1384; 4163, CLEC2D, 20594, 123044, 23-391; 4163, CLEC2D, 20595, 123045, 19-387; 4163, CLEC2D, 20596, 123046, 1-522; 4163, CLEC2D, 20597, 123047, 1-321; 4163, CLEC2D, 20598, 123048, 210-452; 4163, CLEC2D, 20601, 123051, 19-183; 4163, CLEC2D, 20602, 123052, 1-402; 4163, CLEC2D, 20603, 123053, 269-511; 4163, CLEC2D, 20605, 123055, 1-423; 4163, CLEC2D, 20591, 123041, 1-465; 4163, CLEC2D, 20592, 123042, 23-607; 4163, CLEC2D, 20593, 123043, 23-598; 4163, CLEC2D, 20599, 123049, 8-472; 4163, CLEC2D, 20600, 123050, 1-399; 4163, CLEC2D, 20604, 123054, 1-288; 4164, CLEC2L, 20607, 123057, 1-324; 4164, CLEC2L, 20606, 123056, 73-717; 4165, CLEC3A, 20608, 123058, 86-706; 4165, CLEC3A, 20609, 123059, 86-238; 4166, CLEC3B, 20611, 123061, 126-608; 4166, CLEC3B, 20610, 123060, 181-789; 4167, CLEC4A, 20616, 123066, 1-255; 4167, CLEC4A, 20612, 123062, 248-961; 4167, CLEC4A, 20613, 123063, 1-615; 4167, CLEC4A, 20614, 123064, 27-524; 4167, CLEC4A, 20615, 123065, 1-597; 4168, CLEC4C, 20619, 123069, 1-267; 4168, CLEC4C, 20621, 123071, 1-414; 4168, CLEC4C, 20617, 123067, 397-945; 4168, CLEC4C, 20618, 123068, 175-816; 4168, CLEC4C, 20620, 123070, 492-1133; 4168, CLEC4C, 20622, 123072, 158-706; 4169, CLEC4D, 20624, 123074, 152-583; 4169, CLEC4D, 20623, 123073, 194-841; 4170, CLEC4E, 20626, 123076, 81-359; 4170, CLEC4E, 20627, 123077, 109-387; 4170, CLEC4E, 20628, 123078, 77-601; 4170, CLEC4E, 20629, 123079, 1-284; 4170, CLEC4E, 20625, 123075, 167-826; 4171, CLEC4F, 20630, 123080, 78-1847; 4171, CLEC4F, 20631, 123081, 25-1728; 4172, CLEC4G, 20633, 123083, 62-509; 4172, CLEC4G, 20634, 123084, 339-1097; 4172, CLEC4G, 20632, 123082, 70-951; 4173, CLEC4M, 20637, 123087, 119-1165; 4173, CLEC4M, 20639, 123089, 119-1282; 4173, CLEC4M, 20641, 123091, 1-999; 4173, CLEC4M, 20642, 123092, 24-870; 4173, CLEC4M, 20635, 123085, 119-1249; 4173, CLEC4M, 20636, 123086, 119-1318; 4173, CLEC4M, 20638, 123088, 119-1117; 4173, CLEC4M, 20640, 123090, 1-792; 4173, CLEC4M, 20643, 123093, 51-941; 4173, CLEC4M, 20644, 123094, 1-699; 4174, CLEC5A, 20645, 123095, 222-383; 4174, CLEC5A, 20646, 123096, 158-412; 4174, CLEC5A, 20647, 123097, 148-615; 4174, CLEC5A, 20648, 123098, 159-656; 4174, CLEC5A, 20649, 123099, 198-764; 4175, CLEC6A, 20650, 123100, 187-816; 4176, CLEC7A, 20660, 123110, 71-481; 4176, CLEC7A, 20651, 123101, 160-765; 4176, CLEC7A, 20652, 123102, 72-503; 4176, CLEC7A, 20653, 123103, 156-899; 4176, CLEC7A, 20654, 123104, 108-341; 4176, CLEC7A, 20655, 123105, 1-138; 4176, CLEC7A, 20656, 123106, 104-610; 4176, CLEC7A, 20657, 123107, 1-570; 4176, CLEC7A, 20658, 123108, 72-815; 4176, CLEC7A, 20659, 123109, 176-754; 4176, CLEC7A, 20661, 123111, 1-351; 4177, CLEC9A, 20662, 123112, 614-1339; 4178, CLECL1, 20664, 123114, 1-359; 4178, CLECL1, 20665, 123115, 1-108; 4178, CLECL1, 20666, 123116, 36-611; 4178, CLECL1, 20663, 123113, 36-539; 4179, N/A, 20667, 123117, 1-54; 4180, CSMD1, 20668, 123118, 1-8902; 4180, CSMD1, 20669, 123119, 286-10452; 4180, CSMD1, 20670, 123120, 557-11254; 4180, CSMD1, 20671, 123121, 1-10281; 4180, CSMD1, 20672, 123122, 557-11254; 4180, CSMD1, 20673, 123123, 286-10452; 4180, CSMD1, 20674, 123124, 557-11251; 4181, CSMD2, 20676, 123126, 414-1091; 4181, CSMD2, 20677, 123127, 507-1787; 4181, CSMD2, 20681, 123131, 30-10805; 4181, CSMD2, 20675, 123125, 30-10493; 4181, CSMD2, 20678, 123128, 222-3725; 4181, CSMD2, 20679, 123129, 178-11073; 4181, CSMD2, 20680, 123130, 30-10493; 4182, CSMD3, 20683, 123133, 1-8934; 4182, CSMD3, 20682, 123132, 246-11369; 4182, CSMD3, 20684, 123134, 172-11175; 4182, CSMD3, 20685, 123135, 30-10646; 4183, CUZD1, 20686, 123136, 333-476; 4183, CUZD1, 20687, 123137, 333-491; 4183, CUZD1, 20688, 123138, 333-491; 4183, CUZD1, 20691, 123141, 865-1935; 4183, CUZD1, 20689, 123139, 951-2774; 4183, CUZD1, 20690, 123140, 333-2156; 4184, CDCP1, 20692, 123142, 136-2646; 4184, CDCP1, 20693, 123143, 136-1167; 4185, CDCP2, 20694, 123144, 849-2198; 4186, CUBN, 20695, 123145, 40-552; 4186, CUBN, 20697, 123147, 1-267; 4186, CUBN, 20698, 123148, 1-318; 4186, CUBN, 20696, 123146, 67-10938; 4187, CUEDC1, 20701, 123151, 1-160; 4187, CUEDC1, 20702, 123152, 1-127; 4187, CUEDC1, 20704, 123154, 220-705; 4187, CUEDC1, 20705, 123155, 109-858; 4187, CUEDC1, 20699, 123149, 720-1880; 4187, CUEDC1, 20700, 123150, 437-1597; 4187, CUEDC1, 20703, 123153, 415-1575; 4188, CUEDC2, 20706, 123156, 147-1010; 4189, CELF1, 20712, 123162, 298-583; 4189, CELF1, 20713, 123163, 202-543; 4189, CELF1, 20714, 123164, 307-476; 4189, CELF1, 20716, 123166, 362-622; 4189, CELF1, 20717, 123167, 280-1824; 4189, CELF1, 20718, 123168, 241-549; 4189, CELF1, 20719, 123169, 444-556; 4189, CELF1, 20720, 123170, 539-581; 4189, CELF1, 20721, 123171, 341-576; 4189, CELF1, 20707, 123157, 137-1585; 4189, CELF1, 20708, 123158, 1-1461; 4189, CELF1, 20709, 123159, 12-1463; 4189, CELF1, 20710, 123160, 11-1468; 4189, CELF1, 20711, 123161, 202-1653; 4189, CELF1, 20715, 123165, 895-2433; 4190, CELF2, 20722, 123172, 20-1528; 4190, CELF2, 20726, 123176, 161-1726; 4190, CELF2, 20727, 123177, 22-234; 4190, CELF2, 20728, 123178, 22-1344; 4190, CELF2, 20731, 123181, 12-1556; 4190, CELF2, 20732, 123182, 125-1726; 4190, CELF2, 20733, 123183, 54-338; 4190, CELF2, 20735, 123185, 168-1733; 4190, CELF2, 20723, 123173, 308-1780; 4190, CELF2, 20724, 123174, 308-1780; 4190, CELF2, 20725, 123175, 68-1594; 4190, CELF2, 20729, 123179, 198-1664; 4190, CELF2, 20730, 123180, 109-1581; 4190, CELF2, 20734, 123184, 65-1591; 4191, CELF3, 20738, 123188, 1-1400; 4191, CELF3, 20736, 123186, 795-2192; 4191, CELF3, 20737, 123187, 33-1280; 4192, CELF4, 20744, 123194, 13-426; 4192, CELF4, 20745, 123195, 13-556; 4192, CELF4, 20746, 123196, 106-592; 4192, CELF4, 20747, 123197, 1-347; 4192, CELF4, 20748, 123198, 13-410; 4192, CELF4, 20749, 123199, 129-329; 4192, CELF4, 20750, 123200, 216-677; 4192, CELF4, 20751, 123201, 11-1375; 4192, CELF4, 20752, 123202, 1-456; 4192, CELF4, 20753, 123203, 53-805; 4192, CELF4, 20754, 123204, 108-1562; 4192, CELF4, 20755, 123205, 108-989; 4192, CELF4, 20756, 123206, 1-209; 4192, CELF4, 20757, 123207, 187-1644; 4192, CELF4, 20739, 123189, 1-1347; 4192, CELF4, 20740, 123190, 125-1579; 4192, CELF4, 20741, 123191, 397-1857; 4192, CELF4, 20742, 123192, 1-1461; 4192, CELF4, 20743, 123193, 108-1562; 4193, CELF5, 20759, 123209, 218-1180; 4193, CELF5, 20761, 123211, 43-930; 4193, CELF5, 20758, 123208, 38-1495; 4193, CELF5, 20760, 123210, 37-1266; 4194, CELF6, 20764, 123214, 1-402; 4194, CELF6, 20762, 123212, 256-1701; 4194, CELF6, 20763, 123213, 215-1321; 4194, CELF6, 20765, 123215, 176-1210; 4194, CELF6, 20766, 123216, 9-1373; 4195, CUL1, 20770, 123220, 125-2383; 4195, CUL1, 20767, 123217, 280-2610; 4195, CUL1, 20768, 123218, 527-2857; 4195, CUL1, 20769, 123219, 281-2611; 4196, CUL2, 20771, 123221, 23-2143; 4196, CUL2, 20775, 123225, 487-759; 4196, CUL2, 20777, 123227, 236-2512; 4196, CUL2, 20778, 123228, 236-2356; 4196, CUL2, 20772, 123222, 315-2552; 4196, CUL2, 20773, 123223, 211-2448; 4196, CUL2, 20774, 123224, 236-2473; 4196, CUL2, 20776, 123226, 63-2357; 4197, CUL3, 20783, 123233, 1-132; 4197, CUL3, 20784, 123234, 1-576; 4197, CUL3, 20785, 123235, 1-334; 4197, CUL3, 20786, 123236, 87-1115; 4197, CUL3, 20787, 123237, 1-168; 4197, CUL3, 20779, 123229, 340-2646; 4197, CUL3, 20780, 123230, 389-2497; 4197, CUL3, 20781, 123231, 607-2841; 4197, CUL3, 20782, 123232, 144-2378; 4198, CUL4A, 20788, 123238, 212-2215; 4198, CUL4A, 20792, 123242, 29-553; 4198, CUL4A, 20789, 123239, 85-2364; 4198, CUL4A, 20790, 123240, 568-2547; 4198, CUL4A, 20791, 123241, 250-2229; 4198, CUL4A, 20793, 123243, 161-2140; 4199, CUL4B, 20794, 123244, 42-2744; 4199, CUL4B, 20796, 123246, 144-846; 4199, CUL4B, 20795, 123245, 63-2750; 4199, CUL4B, 20797, 123247, 403-3144; 4200, CUL5, 20799, 123249, 1-388; 4200, CUL5, 20801, 123251, 430-573; 4200, CUL5, 20798, 123248, 617-2959; 4200, CUL5, 20800, 123250, 90-2432; 4201, CUL7, 20802, 123252, 87-5183; 4201, CUL7, 20803, 123253, 88-5436; 4202, CUL9, 20805, 123255, 75-7544; 4202, CUL9, 20806, 123256, 1-282; 4202, CUL9, 20807, 123257, 1-588; 4202, CUL9, 20804, 123254, 85-7638; 4203, CAND1, 20808, 123258, 365-527; 4203, CAND1, 20810, 123260, 1-2313; 4203, CAND1, 20811, 123261, 1-1329; 4203, CAND1, 20809, 123259, 438-4130; 4204, CAND2, 20814, 123264, 50-382; 4204, CAND2, 20815, 123265, 1-492; 4204, CAND2, 20816, 123266, 1-333; 4204, CAND2, 20812, 123262, 250-3609; 4204, CAND2, 20813, 123263, 42-3752; 4205, CUTA, 20817, 123267, 1-335; 4205, CUTA, 20824, 123274, 108-236; 4205, CUTA, 20825, 123275, 87-554; 4205, CUTA, 20826, 123276, 249-656; 4205, CUTA, 20828, 123278, 94-222; 4205, CUTA, 20829, 123279, 1-335; 4205, CUTA, 20818, 123268, 261-731; 4205, CUTA, 20819, 123269, 133-729; 4205, CUTA, 20820, 123270, 133-729; 4205, CUTA, 20821, 123271, 123-662; 4205, CUTA, 20822, 123272, 254-724; 4205, CUTA, 20823, 123273, 123-662; 4205, CUTA, 20827, 123277, 376-846; 4205, CUTA, 20830, 123280, 91-561; 4205, CUTA, 20831, 123281, 621-1091; 4206, CTAGE1, 20834, 123284, 105-2342; 4206, CTAGE1, 20835, 123285, 14-238; 4206, CTAGE1, 20832, 123282, 105-2342; 4206, CTAGE1, 20833, 123283, 14-238; 4207, CUTC, 20836, 123286, 294-727; 4207, CUTC, 20838, 123288, 69-653; 4207, CUTC, 20837, 123287, 130-951; 4208, CUX1, 20839, 123289, 39-4556; 4208, CUX1, 20841, 123291, 21-4571; 4208, CUX1, 20843, 123293, 11-1909; 4208, CUX1, 20845, 123295, 1-4452; 4208, CUX1, 20846, 123296, 1-4350; 4208, CUX1, 20848, 123298, 1-4212; 4208, CUX1, 20849, 123299, 1-4044; 4208, CUX1, 20840, 123290, 27-2063; 4208, CUX1, 20842, 123292, 24-1943; 4208, CUX1, 20844, 123294, 128-2164; 4208, CUX1, 20847, 123297, 23-2011; 4208, CUX1, 20850, 123300, 93-2123; 4209, CUX2, 20852, 123302, 137-890; 4209, CUX2, 20851, 123301, 155-4615; 4210, CWC15, 20853, 123303, 124-813; 4211, CWC22, 20854, 123304, 158-2392; 4211, CWC22, 20855, 123305, 301-3027; 4212, CWC25, 20858, 123308, 1-10; 4212, CWC25, 20859, 123309, 1-180; 4212, CWC25, 20860, 123310, 124-330; 4212, CWC25, 20861, 123311, 133-339; 4212, CWC25, 20862, 123312, 124-330; 4212, CWC25, 20863, 123313, 1-10; 4212, CWC25, 20864, 123314, 1-180; 4212, CWC25, 20865, 123315, 133-339; 4212, CWC25, 20856, 123306, 299-1576; 4212, CWC25, 20857, 123307, 299-1576; 4213, CWC27, 20867, 123317, 202-1347; 4213, CWC27, 20866, 123316, 218-1636; 4214, CWF19L1, 20869, 123319, 4-765; 4214, CWF19L1, 20868, 123318, 88-1704; 4215, CWF19L2, 20871, 123321, 1-1872; 4215, CWF19L2, 20872, 123322, 1-1662; 4215, CWF19L2, 20870, 123320, 29-2713; 4216, CMC1, 20873, 123323, 171-314; 4216, CMC1, 20874, 123324, 177-407; 4216, CMC1, 20875, 123325, 1-340; 4216, CMC1, 20876, 123326, 200-520; 4217, CMC2, 20878, 123328, 189-356; 4217, CMC2, 20879, 123329, 248-472; 4217, CMC2, 20880, 123330, 209-319; 4217, CMC2, 20881, 123331, 178-333; 4217, CMC2, 20882, 123332, 157-381; 4217, CMC2, 20883, 123333, 386-541; 4217, CMC2, 20884, 123334, 224-391; 4217, CMC2, 20887, 123337, 1-164; 4217, CMC2, 20888, 123338, 198-350; 4217, CMC2, 20890, 123340, 174-455; 4217, CMC2, 20891, 123341, 248-472; 4217, CMC2, 20892, 123342, 200-481; 4217, CMC2, 20877, 123327, 417-656; 4217, CMC2, 20885, 123335, 267-506; 4217, CMC2, 20886, 123336, 199-438; 4217, CMC2, 20889, 123339, 411-650; 4218, CMC4, 20893, 123343, 443-649; 4218, CMC4, 20894, 123344, 680-886; 4219, CLMP, 20895, 123345, 342-1463; 4220, CXXC1, 20898, 123348, 146-838; 4220, CXXC1, 20899, 123349, 96-845; 4220, CXXC1, 20900, 123350, 63-1904; 4220, CXXC1, 20901, 123351, 92-849; 4220, CXXC1, 20896, 123346, 716-2686; 4220, CXXC1, 20897, 123347, 48-2030; 4221, CXXC4, 20902, 123352, 452-1555; 4222, CXXC5, 20904, 123354, 257-506; 4222, CXXC5, 20905, 123355, 419-442; 4222, CXXC5, 20906, 123356, 262-568; 4222, CXXC5, 20907, 123357, 339-558; 4222, CXXC5, 20908, 123358, 358-900; 4222, CXXC5, 20909, 123359, 295-777; 4222, CXXC5, 20910, 123360, 340-581; 4222, CXXC5, 20911, 123361, 298-503; 4222, CXXC5, 20912, 123362, 440-472; 4222, CXXC5, 20914, 123364, 248-542; 4222, CXXC5, 20915, 123365, 466-878; 4222, CXXC5, 20916, 123366, 221-810; 4222, CXXC5, 20903, 123353, 715-1683; 4222, CXXC5, 20913, 123363, 238-1206; 4223, CNBD1, 20917, 123367, 1-485; 4223, CNBD1, 20919, 123369, 1-623; 4223, CNBD1, 20920, 123370, 1-876; 4223, CNBD1, 20918, 123368, 52-1362; 4224, CNBD2, 20924, 123374, 141-575; 4224, CNBD2, 20925, 123375, 1-77; 4224, CNBD2, 20926, 123376, 17-559; 4224, CNBD2, 20927, 123377, 153-455; 4224, CNBD2, 20921, 123371, 157-1875; 4224, CNBD2, 20922, 123372, 174-1904; 4224, CNBD2, 20923, 123373, 141-1412; 4225, CNGA1, 20931, 123381, 107-405; 4225, CNGA1, 20932, 123382, 293-589; 4225, CNGA1, 20933, 123383, 159-543; 4225, CNGA1, 20928, 123378, 113-2185; 4225, CNGA1, 20929, 123379, 144-2423; 4225, CNGA1, 20930, 123380, 267-2339; 4225, CNGA1, 20934, 123384, 321-2393; 4225, CNGA1, 20935, 123385, 1-2280; 4226, CNGA2, 20936, 123386, 34-2028; 4227, CNGA3, 20937, 123387, 40-2124; 4227, CNGA3, 20938, 123388, 418-2502; 4227, CNGA3, 20939, 123389, 142-2238; 4227, CNGA3, 20940, 123390, 385-2415; 4228, CNGA4, 20942, 123392, 152-829; 4228, CNGA4, 20941, 123391, 116-1843; 4229, CNGB1, 20946, 123396, 67-709; 4229, CNGB1, 20947, 123397, 1-378; 4229, CNGB1, 20943, 123393, 62-3817; 4229, CNGB1, 20944, 123394, 66-965; 4229, CNGB1, 20945, 123395, 62-3799; 4230, CNGB3, 20949, 123399, 1-336; 4230, CNGB3, 20948, 123398, 49-2478; 4231, CCNA1, 20950, 123400, 265-1662; 4231, CCNA1, 20951, 123401, 289-1554; 4231, CCNA1, 20952, 123402, 100-1494; 4231, CCNA1, 20953, 123403, 282-1547; 4232, CCNA2, 20954, 123404, 305-1603; 4232, CCNA2, 20955, 123405, 306-1604; 4233, CNNM1, 20956, 123406, 290-3145; 4234, CNNM2, 20957, 123407, 165-1823; 4234, CNNM2, 20958, 123408, 189-2816; 4234, CNNM2, 20959, 123409, 125-2686; 4235, CNNM3, 20960, 123410, 29-2152; 4235, CNNM3, 20961, 123411, 34-2013; 4236, CNNM4, 20962, 123412, 99-2426; 4237, CCNB1, 20964, 123414, 129-1331; 4237, CCNB1, 20966, 123416, 1-186; 4237, CCNB1, 20967, 123417, 48-780; 4237, CCNB1, 20968, 123418, 1-558; 4237, CCNB1, 20963, 123413, 254-1555; 4237, CCNB1, 20965, 123415, 1-1190; 4238, CCNB1IP1, 20975, 123425, 1-194; 4238, CCNB1IP1, 20976, 123426, 1-94; 4238, CCNB1IP1, 20977, 123427, 381-392; 4238, CCNB1IP1, 20978, 123428, 444-646; 4238, CCNB1IP1, 20979, 123429, 481-789; 4238, CCNB1IP1, 20980, 123430, 870-1331; 4238, CCNB1IP1, 20969, 123419, 290-1123; 4238, CCNB1IP1, 20970, 123420, 466-1299; 4238, CCNB1IP1, 20971, 123421, 598-1431; 4238, CCNB1IP1, 20972, 123422, 650-1483; 4238, CCNB1IP1, 20973, 123423, 618-1451; 4238, CCNB1IP1, 20974, 123424, 671-1504; 4239, CCNB2, 20982, 123432, 113-925; 4239, CCNB2, 20983, 123433, 1-1125; 4239, CCNB2, 20981, 123431, 192-1388; 4240, CCNB3, 20984, 123434, 119-4306; 4240, CCNB3, 20985, 123435, 119-994; 4240, CCNB3, 20986, 123436, 119-994; 4240, CCNB3, 20987, 123437, 299-4486; 4240, CCNB3, 20988, 123438, 119-454; 4241, CCNC, 20989, 123439, 105-713; 4241, CCNC, 20990, 123440, 102-950; 4241, CCNC, 20991, 123441, 102-533; 4241, CCNC, 20992, 123442, 274-759; 4241, CCNC, 20993, 123443, 97-674; 4241, CCNC, 20994, 123444, 120-269; 4241, CCNC, 20997, 123447, 1-687; 4241, CCNC, 20999, 123449, 136-984; 4241, CCNC, 21000, 123450, 187-1035; 4241, CCNC, 21001, 123451, 126-470; 4241, CCNC, 21002, 123452, 288-896; 4241, CCNC, 20995, 123445, 447-1298; 4241, CCNC, 20996, 123446, 332-928; 4241, CCNC, 20998, 123448, 282-878; 4242, DMTF1, 21005, 123455, 374-783; 4242, DMTF1, 21007, 123457, 293-581; 4242, DMTF1, 21008, 123458, 314-585; 4242, DMTF1, 21009, 123459, 356-610; 4242, DMTF1, 21010, 123460, 279-2351; 4242, DMTF1, 21011, 123461, 538-568; 4242, DMTF1, 21013, 123463, 1-530; 4242, DMTF1, 21014, 123464, 481-627; 4242, DMTF1, 21017, 123467, 425-572; 4242, DMTF1, 21018, 123468, 452-533; 4242, DMTF1, 21019, 123469, 426-545; 4242, DMTF1, 21020, 123470, 339-557; 4242, DMTF1, 21021, 123471, 112-637; 4242, DMTF1, 21022, 123472, 407-980; 4242, DMTF1, 21023, 123473, 117-1253; 4242, DMTF1, 21024, 123474, 667-770; 4242, DMTF1, 21025, 123475, 1-537; 4242, DMTF1, 21026, 123476, 238-1335; 4242, DMTF1, 21027, 123477, 532-579; 4242, DMTF1, 21003, 123453, 327-2609; 4242, DMTF1, 21004, 123454, 564-2846; 4242, DMTF1, 21006, 123456, 276-1133; 4242, DMTF1, 21012, 123462, 823-1641; 4242, DMTF1, 21015, 123465, 262-996; 4242, DMTF1, 21016, 123466, 367-2385; 4242, DMTF1, 21028, 123478, 190-1008; 4242, DMTF1, 21029, 123479, 276-1094; 4243, CCND1, 21031, 123481, 109-312; 4243, CCND1, 21030, 123480, 228-1115; 4244, CCND2, 21033, 123483, 1-511; 4244, CCND2, 21032, 123482, 270-1139; 4245, CCND3, 21034, 123484, 521-1249; 4245, CCND3, 21039, 123489, 351-490; 4245, CCND3, 21040, 123490, 1-528; 4245, CCND3, 21041, 123491, 545-574; 4245, CCND3, 21042, 123492, 414-544; 4245, CCND3, 21043, 123493, 187-540; 4245, CCND3, 21044, 123494, 254-841; 4245, CCND3, 21035, 123485, 514-1149; 4245, CCND3, 21036, 123486, 200-1078; 4245, CCND3, 21037, 123487, 107-769; 4245, CCND3, 21038, 123488, 569-859; 4245, CCND3, 21045, 123495, 753-1388; 4245, CCND3, 21046, 123496, 751-1041; 4246, CCNDBP1, 21048, 123498, 54-242; 4246, CCNDBP1, 21050, 123500, 94-282; 4246, CCNDBP1, 21051, 123501, 61-489; 4246, CCNDBP1, 21053, 123503, 95-223; 4246, CCNDBP1, 21054, 123504, 91-219; 4246, CCNDBP1, 21047, 123497, 243-1325; 4246, CCNDBP1, 21049, 123499, 61-990; 4246, CCNDBP1, 21052, 123502, 172-1101; 4247, CCNE1, 21056, 123506, 58-1110; 4247, CCNE1, 21058, 123508, 174-820; 4247, CCNE1, 21059, 123509, 1-852; 4247, CCNE1, 21055, 123505, 280-1512; 4247, CCNE1, 21057, 123507, 58-1245; 4248, CCNE2, 21061, 123511, 105-1229; 4248, CCNE2, 21062, 123512, 49-276; 4248, CCNE2, 21064, 123514, 1-458; 4248,

CCNE2, 21065, 123515, 52-237; 4248, CCNE2, 21066, 123516, 164-1054; 4248, CCNE2, 21060, 123510, 105-1319; 4248, CCNE2, 21063, 123513, 254-1468; 4249, CCNF, 21067, 123517, 89-268; 4249, CCNF, 21069, 123519, 1-560; 4249, CCNF, 21068, 123518, 89-2449; 4250, GAK, 21071, 123521, 1-1403; 4250, GAK, 21073, 123523, 131-358; 4250, GAK, 21074, 123524, 358-568; 4250, GAK, 21075, 123525, 1-210; 4250, GAK, 21076, 123526, 141-554; 4250, GAK, 21077, 123527, 1-763; 4250, GAK, 21078, 123528, 131-280; 4250, GAK, 21079, 123529, 179-535; 4250, GAK, 21080, 123530, 1-1248; 4250, GAK, 21081, 123531, 141-497; 4250, GAK, 21070, 123520, 112-4047; 4250, GAK, 21072, 123522, 187-3885; 4251, CCNG1, 21084, 123534, 75-418; 4251, CCNG1, 21085, 123535, 269-772; 4251, CCNG1, 21086, 123536, 157-564; 4251, CCNG1, 21088, 123538, 39-362; 4251, CCNG1, 21082, 123532, 225-1112; 4251, CCNG1, 21083, 123533, 135-1022; 4251, CCNG1, 21087, 123537, 375-860; 4252, CCNG2, 21090, 123540, 304-1335; 4252, CCNG2, 21093, 123543, 97-578; 4252, CCNG2, 21089, 123539, 357-1391; 4252, CCNG2, 21091, 123541, 237-1271; 4252, CCNG2, 21092, 123542, 165-1199; 4252, CCNG2, 21094, 123544, 108-1022; 4253, CCNH, 21096, 123546, 576-1325; 4253, CCNH, 21097, 123547, 54-821; 4253, CCNH, 21095, 123545, 226-1197; 4254, CCNI, 21099, 123549, 447-595; 4254, CCNI, 21100, 123550, 266-436; 4254, CCNI, 21101, 123551, 1-532; 4254, CCNI, 21102, 123552, 278-517; 4254, CCNI, 21103, 123553, 165-541; 4254, CCNI, 21098, 123548, 578-1711; 4255, CCNI2, 21104, 123554, 52-1161; 4255, CCNI2, 21105, 123555, 52-1209; 4256, CCNJ, 21106, 123556, 368-1486; 4256, CCNJ, 21107, 123557, 368-1483; 4256, CCNJ, 21108, 123558, 179-1330; 4257, CCNJL, 21109, 123559, 287-1450; 4257, CCNJL, 21111, 123561, 163-921; 4257, CCNJL, 21112, 123562, 348-914; 4257, CCNJL, 21113, 123563, 1-1251; 4257, CCNJL, 21110, 123560, 287-1594; 4258, CCNK, 21115, 123565, 483-811; 4258, CCNK, 21116, 123566, 256-936; 4258, CCNK, 21117, 123567, 109-1245; 4258, CCNK, 21114, 123564, 124-1866; 4259, CCNL1, 21120, 123570, 1-178; 4259, CCNL1, 21125, 123575, 667-1953; 4259, CCNL1, 21118, 123568, 1-519; 4259, CCNL1, 21119, 123569, 120-1700; 4259, CCNL1, 21121, 123571, 1-699; 4259, CCNL1, 21122, 123572, 62-580; 4259, CCNL1, 21123, 123573, 43-561; 4259, CCNL1, 21124, 123574, 85-603; 4259, CCNL1, 21126, 123576, 270-788; 4260, CCNL2, 21128, 123578, 86-1129; 4260, CCNL2, 21130, 123580, 20-562; 4260, CCNL2, 21131, 123581, 6-716; 4260, CCNL2, 21132, 123582, 23-706; 4260, CCNL2, 21133, 123583, 1-139; 4260, CCNL2, 21134, 123584, 292-548; 4260, CCNL2, 21127, 123577, 7-1569; 4260, CCNL2, 21129, 123579, 12-692; 4261, CNTD1, 21136, 123586, 19-547; 4261, CNTD1, 21137, 123587, 1-342; 4261, CNTD1, 21138, 123588, 215-394; 4261, CNTD1, 21139, 123589, 213-956; 4261, CNTD1, 21135, 123585, 277-1269; 4262, CNTD2, 21142, 123592, 178-783; 4262, CNTD2, 21143, 123593, 1-483; 4262, CNTD2, 21140, 123590, 17-484; 4262, CNTD2, 21141, 123591, 50-973; 4263, CCNO, 21144, 123594, 158-1210; 4263, CCNO, 21145, 123595, 75-470; 4264, CNPPD1, 21148, 123598, 71-919; 4264, CNPPD1, 21149, 123599, 230-1154; 4264, CNPPD1, 21146, 123596, 139-1371; 4264, CNPPD1, 21147, 123597, 429-1661; 4265, CCNT1, 21150, 123600, 224-2404; 4265, CCNT1, 21151, 123601, 1-555; 4265, CCNT1, 21152, 123602, 324-878; 4266, CCNT2, 21155, 123605, 1-448; 4266, CCNT2, 21156, 123606, 271-663; 4266, CCNT2, 21157, 123607, 34-555; 4266, CCNT2, 21158, 123608, 9-530; 4266, CCNT2, 21159, 123609, 621-1142; 4266, CCNT2, 21160, 123610, 1-202; 4266, CCNT2, 21153, 123603, 31-2223; 4266, CCNT2, 21154, 123604, 31-2022; 4267, CONY, 21165, 123615, 639-793; 4267, CONY, 21166, 123616, 514-816; 4267, CONY, 21161, 123611, 406-1269; 4267, CONY, 21162, 123612, 181-1131; 4267, CONY, 21163, 123613, 181-1206; 4267, CONY, 21164, 123614, 323-1186; 4268, CCNYL1, 21170, 123620, 1-358; 4268, CCNYL1, 21171, 123621, 1-444; 4268, CCNYL1, 21172, 123622, 250-555; 4268, CCNYL1, 21167, 123617, 212-1291; 4268, CCNYL1, 21168, 123618, 147-1073; 4268, CCNYL1, 21169, 123619, 316-1185; 4269, CDK1, 21176, 123626, 202-1095; 4269, CDK1, 21177, 123627, 155-723; 4269, CDK1, 21178, 123628, 101-775; 4269, CDK1, 21173, 123623, 143-865; 4269, CDK1, 21174, 123624, 14-736; 4269, CDK1, 21175, 123625, 143-1036; 4270, CDK10, 21179, 123629, 1742-2683; 4270, CDK10, 21181, 123631, 28-237; 4270, CDK10, 21182, 123632, 42-170; 4270, CDK10, 21184, 123634, 32-202; 4270, CDK10, 21185, 123635, 22-231; 4270, CDK10, 21186, 123636, 21-149; 4270, CDK10, 21187, 123637, 1-113; 4270, CDK10, 21188, 123638, 181-897; 4270, CDK10, 21190, 123640, 12-140; 4270, CDK10, 21180, 123630, 44-1126; 4270, CDK10, 21183, 123633, 217-1035; 4270, CDK10, 21189, 123639, 1-819; 4271, CDK11A, 21191, 123641, 236-2476; 4271, CDK11A, 21192, 123642, 81-2420; 4271, CDK11A, 21195, 123645, 163-2403; 4271, CDK11A, 21196, 123646, 340-450; 4271, CDK11A, 21198, 123648, 15-1277; 4271, CDK11A, 21199, 123649, 247-700; 4271, CDK11A, 21200, 123650, 81-1304; 4271, CDK11A, 21193, 123643, 81-2393; 4271, CDK11A, 21194, 123644, 81-2432; 4271, CDK11A, 21197, 123647, 81-2423; 4272, CDK11B, 21201, 123651, 113-2461; 4272, CDK11B, 21202, 123652, 262-2508; 4272, CDK11B, 21203, 123653, 113-2500; 4272, CDK11B, 21204, 123654, 113-724; 4272, CDK11B, 21205, 123655, 113-847; 4272, CDK11B, 21206, 123656, 113-2431; 4272, CDK11B, 21207, 123657, 113-2470; 4272, CDK11B, 21208, 123658, 113-2464; 4273, CDK12, 21211, 123661, 1-479; 4273, CDK12, 21212, 123662, 562-4165; 4273, CDK12, 21209, 123659, 34-4506; 4273, CDK12, 21210, 123660, 312-4757; 4274, CDK13, 21215, 123665, 2125-3099; 4274, CDK13, 21216, 123666, 772-2028; 4274, CDK13, 21213, 123663, 606-5144; 4274, CDK13, 21214, 123664, 133-4491; 4275, CDK14, 21220, 123670, 112-453; 4275, CDK14, 21221, 123671, 378-759; 4275, CDK14, 21222, 123672, 184-565; 4275, CDK14, 21223, 123673, 312-1334; 4275, CDK14, 21224, 123674, 288-563; 4275, CDK14, 21225, 123675, 239-620; 4275, CDK14, 21226, 123676, 210-590; 4275, CDK14, 21217, 123667, 145-1500; 4275, CDK14, 21218, 123668, 132-1541; 4275, CDK14, 21219, 123669, 443-1714; 4276, CDK15, 21229, 123679, 468-632; 4276, CDK15, 21227, 123677, 204-1358; 4276, CDK15, 21228, 123678, 350-1504; 4276, CDK15, 21230, 123680, 87-1376; 4276, CDK15, 21231, 123681, 45-1247; 4277, CDK16, 21235, 123685, 1-783; 4277, CDK16, 21236, 123686, 485-943; 4277, CDK16, 21237, 123687, 218-785; 4277, CDK16, 21238, 123688, 542-991; 4277, CDK16, 21240, 123690, 395-1574; 4277, CDK16, 21241, 123691, 1-454; 4277, CDK16, 21242, 123692, 1-253; 4277, CDK16, 21243, 123693, 267-518; 4277, CDK16, 21244, 123694, 1-498; 4277, CDK16, 21245, 123695, 431-601; 4277, CDK16, 21246, 123696, 397-1743; 4277, CDK16, 21232, 123682, 79-1791; 4277, CDK16, 21233, 123683, 425-1915; 4277, CDK16, 21234, 123684, 421-1929; 4277, CDK16, 21239, 123689, 310-1800; 4278, CDK17, 21248, 123698, 131-1543; 4278, CDK17, 21250, 123700, 101-583; 4278, CDK17, 21251, 123701, 169-556; 4278, CDK17, 21252, 123702, 302-566; 4278, CDK17, 21253, 123703, 90-626; 4278, CDK17, 21247, 123697, 605-2176; 4278, CDK17, 21249, 123699, 525-2096; 4279, CDK18, 21255, 123705, 99-949; 4279, CDK18, 21256, 123706, 114-591; 4279, CDK18, 21258, 123708, 229-447; 4279, CDK18, 21259, 123709, 219-437; 4279, CDK18, 21260, 123710, 241-782; 4279, CDK18, 21262, 123712, 448-666; 4279, CDK18, 21263, 123713, 746-964; 4279, CDK18, 21264, 123714, 242-435; 4279, CDK18, 21254, 123704, 302-1726; 4279, CDK18, 21257, 123707, 224-1648; 4279, CDK18, 21261, 123711, 221-1735; 4280, CDK19, 21267, 123717, 254-1450; 4280, CDK19, 21268, 123718, 203-955; 4280, CDK19, 21269, 123719, 1-367; 4280, CDK19, 21265, 123715, 182-1510; 4280, CDK19, 21266, 123716, 181-1689; 4281, CDK2, 21272, 123722, 180-896; 4281, CDK2, 21273, 123723, 210-329; 4281, CDK2, 21274, 123724, 179-298; 4281, CDK2, 21275, 123725, 189-1229; 4281, CDK2, 21270, 123720, 179-973; 4281, CDK2, 21271, 123721, 241-1137; 4282, CDK2AP1, 21281, 123731, 146-344; 4282, CDK2AP1, 21276, 123726, 523-870; 4282, CDK2AP1, 21277, 123727, 208-471; 4282, CDK2AP1, 21278, 123728, 825-1088; 4282, CDK2AP1, 21279, 123729, 165-428; 4282, CDK2AP1, 21280, 123730, 285-548; 4282, CDK2AP1, 21282, 123732, 116-379; 4283, CDK2AP2, 21284, 123734, 10-330; 4283, CDK2AP2, 21285, 123735, 77-262; 4283, CDK2AP2, 21283, 123733, 550-930; 4284, CINP, 21289, 123739, 64-405; 4284, CINP, 21291, 123741, 1-640; 4284, CINP, 21286, 123736, 42-680; 4284, CINP, 21287, 123737, 90-773; 4284, CINP, 21288, 123738, 18-374; 4284, CINP, 21290, 123740, 66-704; 4285, CDK20, 21292, 123742, 307-1347; 4285, CDK20, 21293, 123743, 144-1160; 4285, CDK20, 21294, 123744, 42-773; 4285, CDK20, 21295, 123745, 308-1285; 4285, CDK20, 21296, 123746, 60-887; 4286, CDK3, 21298, 123748, 164-803; 4286, CDK3, 21299, 123749, 77-570; 4286, CDK3, 21297, 123747, 89-1006; 4287, CDK4, 21301, 123751, 293-628; 4287, CDK4, 21302, 123752, 102-447; 4287, CDK4, 21303, 123753, 337-459; 4287, CDK4, 21304, 123754, 267-825; 4287, CDK4, 21305, 123755, 153-776; 4287, CDK4, 21306, 123756, 141-746; 4287, CDK4, 21307, 123757, 172-396; 4287, CDK4, 21308, 123758, 184-694; 4287, CDK4, 21309, 123759, 161-769; 4287, CDK4, 21310, 123760, 377-773; 4287, CDK4, 21311, 123761, 223-228; 4287, CDK4, 21300, 123750, 367-1278; 4288, CDK5, 21312, 123762, 1-783; 4288, CDK5, 21313, 123763, 683-1561; 4289, CDK5R1, 21315, 123765, 1-347; 4289, CDK5R1, 21316, 123766, 1-347; 4289, CDK5R1, 21314, 123764, 690-1613; 4290, CDK5R2, 21317, 123767, 167-1270; 4291, CDK6, 21318, 123768, 413-1393; 4291, CDK6, 21319, 123769, 485-1465; 4292, CDK7, 21321, 123771, 8-217; 4292, CDK7, 21322, 123772, 19-195; 4292, CDK7, 21323, 123773, 491-1252; 4292, CDK7, 21324, 123774, 65-994; 4292, CDK7, 21325, 123775, 281-728; 4292, CDK7, 21326, 123776, 98-331; 4292, CDK7, 21327, 123777, 85-261; 4292, CDK7, 21328, 123778, 90-257; 4292, CDK7, 21329, 123779, 79-210; 4292, CDK7, 21330, 123780, 85-261; 4292, CDK7, 21331, 123781, 98-331; 4292, CDK7, 21332, 123782, 281-728; 4292, CDK7, 21333, 123783, 8-217; 4292, CDK7, 21334, 123784, 491-1252; 4292, CDK7, 21335, 123785, 90-257; 4292, CDK7, 21337, 123787, 79-210; 4292, CDK7, 21338, 123788, 19-195; 4292, CDK7, 21339, 123789, 65-994; 4292, CDK7, 21340, 123790, 182-358; 4292, CDK7, 21341, 123791, 182-358; 4292, CDK7, 21342, 123792, 182-391; 4292, CDK7, 21343, 123793, 182-391; 4292, CDK7, 21344, 123794, 182-412; 4292, CDK7, 21345, 123795, 182-412; 4292, CDK7, 21320, 123770, 104-1144; 4292, CDK7, 21336, 123786, 104-1144; 4293, CDK8, 21347, 123797, 539-1033; 4293, CDK8, 21348, 123798, 1-446; 4293, CDK8, 21349, 123799, 1-586; 4293, CDK8, 21346, 123796, 504-1898; 4294, CDK9, 21351, 123801, 120-702; 4294, CDK9, 21350, 123800, 101-1219; 4295, CDKN1A, 21352, 123802, 147-641; 4295, CDKN1A, 21353, 123803, 175-669; 4295, CDKN1A, 21354, 123804, 236-730; 4295, CDKN1A, 21355, 123805, 73-567; 4295, CDKN1A, 21356, 123806, 71-565; 4296, CDKN1B, 21358, 123808, 19-636; 4296, CDKN1B, 21359, 123809, 1-315; 4296, CDKN1B, 21357, 123807, 717-1313; 4297, CDKN1C, 21360, 123810, 191-1108; 4297, CDKN1C, 21361, 123811, 127-522; 4297, CDKN1C, 21365, 123815, 393-1343; 4297, CDKN1C, 21366, 123816, 127-522; 4297, CDKN1C, 21367, 123817, 283-1233; 4297, CDKN1C, 21362, 123812, 191-1108; 4297, CDKN1C, 21363, 123813, 283-1233; 4297, CDKN1C, 21364, 123814, 393-1343; 4298, CDKN2A, 21369, 123819, 161-673; 4298, CDKN2A, 21370, 123820, 1-351; 4298, CDKN2A, 21374, 123824, 32-448; 4298, CDKN2A, 21376, 123826, 16-381; 4298, CDKN2A, 21379, 123829, 76-390; 4298, CDKN2A, 21368, 123818, 272-742; 4298, CDKN2A, 21371, 123821, 40-543; 4298, CDKN2A, 21375, 123825, 625-942; 4298, CDKN2A, 21377, 123827, 128-445; 4298, CDKN2A, 21378, 123828, 485-802; 4298, CDKN2A, 21372, 123822, 81-479; 4298, CDKN2A, 21373, 123823, 294-692; 4299, CDKN2B, 21380, 123830, 411-827; 4299, CDKN2B, 21381, 123831, 320-556; 4300, CDKN2C, 21382, 123832, 2035-2541; 4300, CDKN2C, 21383, 123833, 426-932; 4300, CDKN2C, 21384, 123834, 1217-1723; 4301, CDKN2D, 21385, 123835, 129-629; 4301, CDKN2D, 21386, 123836, 326-826; 4302, CDKN3, 21388, 123838, 1-501; 4302, CDKN3, 21389, 123839, 70-705; 4302, CDKN3, 21391, 123841, 91-537; 4302, CDKN3, 21392, 123842, 41-481; 4302, CDKN3, 21393, 123843, 67-678; 4302, CDKN3, 21394, 123844, 1-108; 4302, CDKN3, 21395, 123845, 115-738; 4302, CDKN3, 21387, 123837, 115-753; 4302, CDKN3, 21390, 123840, 75-593; 4303, CDKL1, 21396, 123846, 646-1476; 4303, CDKL1, 21398, 123848, 1-210; 4303, CDKL1, 21399, 123849, 1-421; 4303, CDKL1, 21397, 123847, 29-1105; 4304, CDKL2, 21400, 123850, 515-2227; 4304, CDKL2, 21402, 123852, 475-651; 4304, CDKL2, 21401, 123851, 705-2186; 4305, CDKL3, 21404, 123854, 79-399; 4305, CDKL3, 21405, 123855, 1-221; 4305, CDKL3, 21406, 123856, 36-170; 4305, CDKL3, 21407, 123857, 1-56; 4305, CDKL3, 21408, 123858, 447-1652; 4305, CDKL3, 21409, 123859, 116-1888; 4305, CDKL3, 21411, 123861, 74-322; 4305, CDKL3, 21403, 123853, 120-1898; 4305, CDKL3, 21410, 123860, 1-1368; 4306, CDKL4, 21414, 123864, 1-375; 4306, CDKL4, 21415, 123865, 57-233; 4306, CDKL4, 21412, 123862, 1-948; 4306, CDKL4, 21413, 123863, 1-1140; 4307, CDKL5, 21418, 123868, 279-2632; 4307, CDKL5, 21420, 123870, 359-564; 4307, CDKL5, 21421, 123871, 302-483; 4307, CDKL5, 21422, 123872, 515-567; 4307, CDKL5, 21416, 123866, 286-3378; 4307, CDKL5, 21417, 123867, 276-3368; 4307, CDKL5, 21419, 123869, 1-2883; 4308, CYLC1, 21424, 123874, 58-264; 4308, CYLC1, 21423, 123873, 38-1993; 4309, CYLC2, 21425, 123875, 38-1084; 4309, CYLC2, 21426, 123876, 71-1117; 4309, CYLC2, 21427, 123877, 71-1117; 4310, CYLD, 21432, 123882, 440-539; 4310, CYLD, 21433, 123883, 151-2466; 4310, CYLD, 21434, 123884, 246-1158; 4310, CYLD, 21435, 123885, 279-777; 4310, CYLD, 21437, 123887, 1-200; 4310, CYLD, 21438, 123888, 251-2983; 4310, CYLD, 21439, 123889, 1-315; 4310, CYLD, 21428, 123878, 392-3262; 4310, CYLD, 21429, 123879, 301-3162; 4310, CYLD, 21430, 123880, 206-3076; 4310, CYLD, 21431, 123881, 195-3056; 4310, CYLD, 21436, 123886, 279-3140; 4311, CYP3A7-CYP3A51P, 21440, 123890, 10-1521; 4311, CYP3A7-CYP3A51P, 21441, 123891, 1-1608; 4312, CTH, 21442, 123892, 34-1119; 4312, CTH, 21443, 123893, 145-1362; 4312, CTH, 21444, 123894, 199-1320; 4313, CBS, 21449, 123899, 289-819; 4313, CBS, 21450, 123900, 1-448; 4313, CBS, 21451, 123901, 1-674; 4313, CBS, 21452, 123902, 1-479; 4313, CBS, 21445, 123895, 239-1894; 4313, CBS, 21446, 123896, 223-1878; 4313, CBS, 21447, 123897, 109-1764; 4313, CBS, 21448, 123898, 261-1916; 4314, CBSL, 21453, 123903, 170-1825; 4314, CBSL, 21454, 123904, 223-1878; 4314, CBSL, 21455, 123905, 223-1878; 4314, CBSL, 21456, 123906, 170-1867; 4314, CBSL, 21457, 123907, 109-1764; 4315, CST11, 21458, 123908, 47-358; 4315, CST11, 21459, 123909, 35-451; 4316, CST8, 21461, 123911, 227-630; 4316, CST8, 21460, 123910, 358-786; 4317, CST9, 21462, 123912, 13-492; 4318, CST9L, 21463, 123913, 300-743; 4319, CSTA, 21465, 123915, 32-223; 4319, CSTA, 21464, 123914, 50-346; 4320, CSTB, 21466, 123916, 177-473; 4321, CST3, 21467, 123917, 165-605; 4321, CST3, 21468, 123918, 133-573; 4321, CST3, 21469, 123919, 84-524; 4322, CST5, 21470, 123920, 75-503; 4323, CST6, 21471, 123921, 205-654; 4324, CST7, 21472, 123922, 277-714; 4325, CST4, 21473, 123923, 72-497; 4326, CST2, 21474, 123924, 72-497; 4327, CST1, 21475, 123925, 72-497; 4327, CST1, 21476, 123926, 145-570; 4328, CSTL1, 21479, 123929, 367-477; 4328, CSTL1, 21477, 123927, 21-458; 4328, CSTL1, 21478, 123928, 247-684; 4329, CSRP1, 21482, 123932, 365-826; 4329, CSRP1, 21484, 123934, 56-538; 4329, CSRP1, 21486, 123936, 124-582; 4329, CSRP1, 21487, 123937, 56-109; 4329, CSRP1, 21480, 123930, 192-773; 4329, CSRP1, 21481, 123931, 365-946; 4329, CSRP1, 21483, 123933, 154-735; 4329, CSRP1, 21485, 123935, 218-799; 4330, CSRP2, 21489, 123939, 56-787; 4330, CSRP2, 21491, 123941, 50-613; 4330, CSRP2, 21488, 123938, 125-706; 4330, CSRP2, 21490, 123940, 63-644; 4331, CSRP3, 21492, 123942, 118-702; 4331, CSRP3, 21493, 123943, 242-826; 4332, CHORDC1, 21496, 123946, 124-474; 4332, CHORDC1, 21497, 123947, 119-472; 4332, CHORDC1, 21498, 123948, 118-237; 4332, CHORDC1, 21499, 123949, 303-737; 4332, CHORDC1, 21500, 123950, 96-458; 4332, CHORDC1, 21501, 123951, 3915-4349; 4332, CHORDC1, 21502, 123952, 77-631; 4332, CHORDC1, 21494, 123944, 411-1409; 4332, CHORDC1, 21495, 123945, 106-1047; 4333, CCBL2, 21504, 123954, 66-590; 4333, CCBL2, 21505, 123955, 233-1019; 4333, CCBL2, 21503, 123953, 339-1703; 4333, CCBL2, 21506, 123956, 196-1458; 4334, CCBL1, 21509, 123959, 95-847; 4334, CCBL1, 21510, 123960, 1-477; 4334, CCBL1, 21511, 123961, 295-1845; 4334, CCBL1, 21512, 123962, 185-736; 4334, CCBL1, 21507, 123957, 164-1432; 4334, CCBL1, 21508, 123958, 40-1158; 4335, CDO1, 21513, 123963, 558-1160; 4336, CRIM1, 21515, 123965, 1-528; 4336, CRIM1, 21516, 123966, 1-667; 4336, CRIM1, 21517, 123967, 1-167; 4336, CRIM1, 21518, 123968, 368-698; 4336, CRIM1, 21519, 123969, 1-181; 4336, CRIM1, 21520, 123970, 1-153; 4336, CRIM1, 21514, 123964, 368-3478; 4337, CSAD, 21522, 123972, 55-858; 4337, CSAD, 21524, 123974, 1-1558; 4337, CSAD, 21525, 123975, 70-207; 4337, CSAD, 21526, 123976, 128-565; 4337, CSAD, 21528, 123978, 93-581; 4337, CSAD, 21530, 123980, 50-853; 4337, CSAD, 21531, 123981, 50-455; 4337, CSAD, 21532, 123982, 1-429; 4337, CSAD, 21533, 123983, 199-585; 4337, CSAD, 21521, 123971, 235-1797; 4337, CSAD, 21523, 123973, 105-1145; 4337, CSAD, 21527, 123977, 293-1774; 4337, CSAD, 21529, 123979, 269-1750; 4338, CYHR1, 21538, 123988, 423-853; 4338, CYHR1, 21539, 123989, 208-1422; 4338, CYHR1, 21540, 123990, 274-1012; 4338, CYHR1, 21541, 123991, 454-581; 4338, CYHR1, 21534, 123984, 521-1099; 4338, CYHR1, 21535, 123985, 589-1167; 4338, CYHR1, 21536, 123986, 135-1223; 4338, CYHR1, 21537, 123987, 274-852; 4339, CYYR1, 21542, 123992, 345-809; 4339, CYYR1, 21543, 123993, 237-635; 4340, CRCT1, 21544, 123994, 74-373; 4341, CHIC1, 21547, 123997, 25-678; 4341, CHIC1, 21548, 123998, 1-193; 4341, CHIC1, 21545, 123995, 78-752; 4341, CHIC1, 21546, 123996, 86-700; 4342, CHIC2, 21550, 124000, 1-412; 4342, CHIC2, 21551, 124001, 1-441; 4342, CHIC2, 21549, 123999, 391-888; 4343, CRIPAK, 21552, 124002, 2961-4301; 4344, CRIPT, 21553, 124003, 133-438; 4345, AL928654.7, 21554, 124004, 1-139; 4345, AL928654.7, 21555, 124005, 1-139; 4345, AL928654.7, 21556, 124006, 62-295; 4345, AL928654.7, 21557, 124007, 1-139; 4345, AL928654.7, 21558, 124008, 1-148; 4346, CRIP1, 21559, 124009, 944-1177; 4346, CRIP1, 21560, 124010, 118-351; 4346, CRIP1, 21561, 124011, 154-387; 4347, CRIP2, 21564, 124014, 1-577; 4347, CRIP2, 21565, 124015, 1-313; 4347, CRIP2, 21562, 124012, 714-1340; 4347, CRIP2, 21563, 124013, 287-1135; 4348, CRIP3, 21568, 124018, 1-117; 4348, CRIP3, 21569, 124019, 1-331; 4348, CRIP3, 21566, 124016, 6-659; 4348, CRIP3, 21567, 124017, 6-620; 4349, CRISP1, 21570, 124020, 4-540; 4349, CRISP1, 21571, 124021, 103-852; 4349, CRISP1, 21572, 124022, 74-610; 4349, CRISP1, 21573, 124023, 91-840; 4350, CRISP2, 21574, 124024, 238-969; 4350, CRISP2, 21575, 124025, 241-1077; 4350, CRISP2, 21576, 124026, 230-961; 4351, CRISP3, 21578, 124028, 71-645; 4351, CRISP3, 21579, 124029, 20-850; 4351, CRISP3, 21577, 124027, 48-824; 4351, CRISP3, 21580, 124030, 71-877; 4352, CRISPLD1, 21583, 124033, 563-1501; 4352, CRISPLD1, 21584, 124034, 239-553; 4352, CRISPLD1, 21581, 124031, 469-1971; 4352, CRISPLD1, 21582, 124032, 421-1365; 4353, CRISPLD2, 21587, 124037, 483-538; 4353, CRISPLD2, 21588, 124038, 495-1123; 4353, CRISPLD2, 21589, 124039, 218-1708; 4353, CRISPLD2, 21590, 124040, 281-615; 4353, CRISPLD2, 21592, 124042, 1-130; 4353, CRISPLD2, 21585, 124035, 225-1718; 4353, CRISPLD2, 21586, 124036, 204-566; 4353, CRISPLD2, 21591, 124041, 206-1555; 4354, CYSRT1, 21593, 124043, 488-1042; 4355, CYSTM1, 21594, 124044, 665-958; 4356, CRELD1, 21599, 124049, 1-301; 4356, CRELD1, 21600, 124050, 21-326; 4356, CRELD1, 21595, 124045, 85-1353; 4356, CRELD1, 21596, 124046, 600-1862; 4356, CRELD1, 21597, 124047, 51-1313; 4356, CRELD1, 21598, 124048, 96-1358; 4357, CRELD2, 21605, 124055, 276-963; 4357, CRELD2, 21601, 124051, 75-1136; 4357, CRELD2, 21602, 124052, 136-1344; 4357, CRELD2, 21603, 124053, 38-1015; 4357, CRELD2, 21604, 124054, 38-1003; 4358, CYR61, 21607, 124057, 225-1364; 4358, CYR61, 21606, 124056, 225-1370; 4359, CDPF1, 21609, 124059, 35-304; 4359, CDPF1, 21610, 124060, 2-358; 4359, CDPF1, 21611, 124061, 2-349; 4359, CDPF1, 21608, 124058, 425-796; 4360, CSRNP1, 21612, 124062, 179-1948; 4360, CSRNP1, 21613, 124063, 107-1876; 4361, CSRNP2, 21615, 124065, 191-449; 4361, CSRNP2, 21616, 124066, 502-845; 4361, CSRNP2, 21617, 124067, 486-685; 4361, CSRNP2, 21618, 124068, 506-681; 4361, CSRNP2, 21614, 124064, 299-1930; 4362, CSRNP3, 21621, 124071, 67-482; 4362, CSRNP3, 21622, 124072, 251-2104; 4362, CSRNP3, 21623, 124073, 377-1688; 4362, CSRNP3, 21619, 124069, 377-2134; 4362, CSRNP3, 21620, 124070, 273-2030; 4363, CYSLTR1, 21624, 124074, 294-1307; 4363, CYSLTR1, 21625, 124075, 415-1428; 4364, CYSLTR2, 21628, 124078, 684-727; 4364, CYSLTR2, 21629, 124079, 291-334; 4364, CYSLTR2, 21630, 124080, 661-704; 4364, CYSLTR2, 21626, 124076, 264-1304; 4364, CYSLTR2, 21627, 124077, 550-1590; 4365, CARS, 21634, 124084, 63-200; 4365, CARS, 21635, 124085, 71-457; 4365, CARS, 21636, 124086, 160-2379; 4365, CARS, 21637, 124087, 50-280; 4365, CARS, 21639, 124089, 50-280; 4365, CARS, 21641, 124091, 160-2379; 4365, CARS, 21642, 124092, 63-200; 4365, CARS, 21644, 124094, 71-457; 4365, CARS, 21631, 124081, 52-2232; 4365, CARS, 21632, 124082, 71-2566; 4365, CARS, 21633, 124083, 247-2493; 4365, CARS, 21638, 124088, 71-2566; 4365, CARS, 21640, 124090, 52-2232; 4365, CARS, 21643, 124093, 247-2493; 4366, CARS2, 21646, 124096, 41-505; 4366, CARS2, 21647, 124097, 1-530; 4366, CARS2, 21648, 124098, 1-359; 4366, CARS2, 21649, 124099, 1-277; 4366, CARS2, 21650, 124100, 30-572; 4366, CARS2, 21651, 124101, 1-271; 4366, CARS2, 21645, 124095, 65-1759; 4367, CFTR, 21653, 124103, 1-4316; 4367, CFTR, 21654, 124104, 466-575; 4367, CFTR, 21655, 124105, 1-572; 4367, CFTR, 21656, 124106, 1-470; 4367, CFTR, 21652, 124102, 133-4575; 4368, CYS1, 21657, 124107, 189-665; 4369, CTNS, 21660, 124110, 233-601; 4369, CTNS, 21661, 124111, 393-617; 4369, CTNS, 21662, 124112, 61-548; 4369, CTNS, 21663, 124113, 497-581; 4369, CTNS, 21664, 124114, 304-465; 4369, CTNS, 21665, 124115, 506-565; 4369, CTNS, 21658, 124108, 594-1697; 4369, CTNS, 21659, 124109, 460-1662; 4370, CDADC1, 21667, 124117, 1-290; 4370, CDADC1, 21668, 124118, 98-559; 4370, CDADC1, 21669, 124119, 62-370; 4370, CDADC1, 21666, 124116, 114-1658; 4371, CDA, 21670, 124120, 183-623; 4372, CMPK1, 21671, 124121, 138-647; 4372, CMPK1, 21674, 124124, 68-244; 4372, CMPK1, 21672, 124122, 150-836; 4372, CMPK1, 21673, 124123, 33-572; 4373, CMPK2, 21675, 124125, 1-1350; 4373, CMPK2, 21676, 124126, 17-1246; 4373, CMPK2, 21677, 124127, 124-1224; 4374, CMAS, 21679, 124129, 18-284; 4374, CMAS, 21680, 124130, 248-538; 4374, CMAS, 21678, 124128, 131-1435; 4374, CMAS, 21681, 124131, 80-871; 4375, CYBRD1, 21685, 124135, 159-682; 4375, CYBRD1, 21682, 124132, 199-1059; 4375, CYBRD1, 21683, 124133, 70-543; 4375, CYBRD1, 21684, 124134, 27-713; 4376, CYBA, 21687, 124137, 29-661; 4376, CYBA, 21688, 124138, 3-439; 4376, CYBA, 21689, 124139, 1-221; 4376, CYBA, 21690, 124140, 18-404; 4376, CYBA, 21691, 124141, 16-405; 4376, CYBA, 21686, 124136, 140-727; 4377, CYBB, 21692, 124142, 68-1780; 4378, CYB5D1, 21695, 124145, 1-93; 4378, CYB5D1, 21696, 124146, 106-408; 4378, CYB5D1, 21693, 124143, 153-839; 4378, CYB5D1, 21694, 124144, 390-863; 4379, CYB5D2, 21700, 124150, 149-469; 4379, CYB5D2, 21697, 124147, 501-1295; 4379, CYB5D2, 21698, 124148, 233-691; 4379, CYB5D2, 21699, 124149, 640-1098; 4380, CYB5R1, 21702, 124152, 1-680; 4380, CYB5R1, 21701, 124151, 76-993; 4381, CYB5R2, 21704, 124154, 231-579; 4381, CYB5R2, 21705, 124155, 230-797; 4381, CYB5R2, 21706, 124156, 174-611; 4381, CYB5R2, 21707, 124157, 359-872; 4381, CYB5R2, 21703, 124153, 150-980; 4381, CYB5R2, 21708, 124158, 121-834; 4381, CYB5R2, 21709, 124159, 558-1388; 4382, CYB5R3, 21715, 124165, 234-675; 4382, CYB5R3, 21710, 124160, 254-1159; 4382, CYB5R3, 21711, 124161, 1-1005; 4382, CYB5R3, 21712, 124162, 93-929; 4382, CYB5R3, 21713, 124163, 386-1222; 4382, CYB5R3, 21714, 124164, 185-1021; 4383, CYB5R4, 21716, 124166, 230-559; 4383, CYB5R4, 21717, 124167, 141-1706; 4384, CYB5RL, 21719, 124169, 258-470; 4384, CYB5RL, 21720, 124170, 23-190; 4384, CYB5RL, 21721, 124171, 136-552; 4384, CYB5RL, 21722, 124172, 284-655; 4384, CYB5RL, 21724, 124174, 1-531; 4384, CYB5RL, 21718, 124168, 66-809; 4384, CYB5RL, 21723, 124173, 1-948; 4385, CYB5A, 21725, 124175, 248-430; 4385, CYB5A, 21726, 124176, 142-546; 4385, CYB5A, 21727, 124177, 99-473; 4385, CYB5A, 21728, 124178, 61-357; 4386, CYB5B, 21729, 124179, 90-542; 4386, CYB5B, 21730, 124180, 19-414; 4386, CYB5B, 21732, 124182, 17-439; 4386, CYB5B, 21733, 124183, 1-195; 4386, CYB5B, 21731, 124181, 172-612; 4387, CYB561, 21738, 124188, 84-1040; 4387, CYB561, 21741, 124191, 1-917; 4387, CYB561, 21742, 124192, 301-885; 4387, CYB561, 21743, 124193, 198-481; 4387, CYB561, 21744, 124194, 1-220; 4387, CYB561, 21745, 124195, 124-551; 4387, CYB561, 21746, 124196, 13-789; 4387, CYB561, 21747, 124197, 64-696; 4387, CYB561, 21748, 124198, 87-755; 4387, CYB561, 21734, 124184, 148-903; 4387, CYB561, 21735, 124185, 154-909; 4387, CYB561, 21736, 124186, 301-1056; 4387, CYB561, 21737, 124187, 61-477; 4387, CYB561, 21739, 124189, 403-1158; 4387, CYB561, 21740, 124190, 94-848; 4388, CYB561A3, 21750, 124200, 293-1084; 4388, CYB561A3, 21753, 124203, 408-573; 4388, CYB561A3, 21754, 124204, 3548-4094; 4388, CYB561A3, 21755, 124205, 455-540; 4388, CYB561A3, 21756, 124206, 830-1202; 4388, CYB561A3, 21757, 124207, 270-557; 4388, CYB561A3, 21758, 124208, 434-779; 4388, CYB561A3, 21759, 124209, 52-650; 4388, CYB561A3, 21760, 124210, 89-418; 4388, CYB561A3, 21761, 124211, 233-550; 4388, CYB561A3, 21762, 124212, 229-543; 4388, CYB561A3, 21749, 124199, 679-1407; 4388, CYB561A3, 21751, 124201, 781-1560; 4388, CYB561A3, 21752, 124202, 93-821; 4389, CYB561D1, 21768, 124218, 41-208; 4389, CYB561D1, 21769, 124219, 36-731; 4389, CYB561D1, 21770, 124220, 61-225; 4389, CYB561D1, 21771, 124221, 62-256; 4389, CYB561D1, 21763, 124213, 42-443; 4389, CYB561D1, 21764, 124214, 27-782; 4389, CYB561D1, 21765, 124215, 89-607; 4389, CYB561D1, 21766, 124216, 41-730; 4389, CYB561D1, 21767, 124217, 26-412; 4390, CYB561D2, 21772, 124222, 232-900; 4390, CYB561D2, 21773, 124223, 577-1245; 4390, CYB561D2, 21774, 124224, 316-984; 4390, CYB561D2, 21775, 124225, 236-904; 4391, COA1, 21779, 124229, 108-299; 4391, COA1, 21781, 124231, 121-225; 4391, COA1, 21782, 124232, 213-317; 4391, COA1, 21784, 124234, 184-524; 4391, COA1, 21785, 124235, 195-386; 4391, COA1, 21786, 124236, 186-311; 4391, COA1, 21789, 124239, 457-720; 4391, COA1, 21776, 124226, 152-592; 4391, COA1, 21777, 124227, 320-760; 4391, COA1, 21778, 124228, 1683-2123; 4391, COA1, 21780, 124230, 393-833; 4391, COA1, 21783, 124233, 124-564; 4391, COA1, 21787, 124237, 195-635; 4391, COA1, 21788, 124238, 124-564; 4392, COA3, 21791, 124241, 10-225; 4392, COA3, 21790, 124240, 24-344; 4393, COA4, 21792, 124242, 249-512; 4393, COA4, 21793, 124243, 201-464; 4393, COA4, 21794, 124244, 395-685; 4393, COA4, 21795, 124245, 213-476; 4394, COA5, 21797, 124247, 111-332; 4394, COA5, 21796, 124246, 88-312; 4395, COA6, 21800, 124250, 12-479; 4395, COA6, 21798, 124248, 546-785; 4395, COA6, 21799, 124249, 37-414; 4395, COA6, 21801, 124251, 228-467; 4396, COA7, 21802, 124252, 41-736; 4397, COX15, 21803, 124253, 52-1284; 4397, COX15, 21804, 124254, 52-1218; 4398, COX4I1, 21806, 124256, 5-385; 4398, COX4I1, 21807, 124257, 438-566; 4398, COX4I1, 21808, 124258, 72-491; 4398, COX4I1, 21809, 124259, 167-490; 4398, COX4I1, 21810, 124260, 117-245; 4398, COX4I1, 21811, 124261, 47-298; 4398, COX4I1, 21805, 124255, 71-580;

4398, COX4I1, 21812, 124262, 79-588; 4398, COX4I1, 21813, 124263, 194-703; 4399, COX412, 21814, 124264, 76-591; 4400, COX5A, 21816, 124266, 70-531; 4400, COX5A, 21817, 124267, 57-311; 4400, COX5A, 21818, 124268, 233-442; 4400, COX5A, 21820, 124270, 67-402; 4400, COX5A, 21815, 124265, 155-607; 4400, COX5A, 21819, 124269, 53-505; 4401, COX5B, 21821, 124271, 48-437; 4402, COX6A1, 21822, 124272, 38-367; 4403, COX6A2, 21823, 124273, 104-397; 4404, COX6B1, 21827, 124277, 1-122; 4404, COX6B1, 21824, 124274, 193-453; 4404, COX6B1, 21825, 124275, 96-356; 4404, COX6B1, 21826, 124276, 266-526; 4405, COX6B2, 21828, 124278, 184-450; 4405, COX6B2, 21829, 124279, 20-286; 4405, COX6B2, 21830, 124280, 81-347; 4405, COX6B2, 21831, 124281, 66-332; 4405, COX6B2, 21832, 124282, 89-355; 4406, COX6C, 21833, 124283, 73-300; 4406, COX6C, 21834, 124284, 212-439; 4406, COX6C, 21835, 124285, 100-327; 4406, COX6C, 21836, 124286, 456-683; 4406, COX6C, 21837, 124287, 337-564; 4406, COX6C, 21838, 124288, 155-382; 4406, COX6C, 21839, 124289, 74-301; 4406, COX6C, 21840, 124290, 70-297; 4406, COX6C, 21841, 124291, 91-318; 4406, COX6C, 21842, 124292, 101-328; 4407, COX7A1, 21844, 124294, 30-211; 4407, COX7A1, 21845, 124295, 276-347; 4407, COX7A1, 21843, 124293, 463-702; 4408, COX7A2, 21846, 124296, 312-659; 4408, COX7A2, 21847, 124297, 180-527; 4408, COX7A2, 21848, 124298, 57-366; 4408, COX7A2, 21849, 124299, 1-203; 4408, COX7A2, 21850, 124300, 55-216; 4408, COX7A2, 21851, 124301, 52-282; 4408, COX7A2, 21852, 124302, 62-337; 4409, COX7A2L, 21855, 124305, 32-151; 4409, COX7A2L, 21856, 124306, 1-288; 4409, COX7A2L, 21857, 124307, 12-251; 4409, COX7A2L, 21853, 124303, 56-400; 4409, COX7A2L, 21854, 124304, 831-1175; 4410, COX7B, 21858, 124308, 117-359; 4411, COX7B2, 21861, 124311, 320-417; 4411, COX7B2, 21862, 124312, 230-472; 4411, COX7B2, 21859, 124309, 177-422; 4411, COX7B2, 21860, 124310, 252-497; 4412, COX7C, 21864, 124314, 84-254; 4412, COX7C, 21863, 124313, 153-344; 4412, COX7C, 21865, 124315, 101-292; 4413, COX8A, 21866, 124316, 75-284; 4414, COX8C, 21867, 124317, 79-297; 4414, COX8C, 21868, 124318, 79-297; 4415, CYCS, 21872, 124322, 196-498; 4415, CYCS, 21869, 124319, 171-488; 4415, CYCS, 21870, 124320, 263-580; 4415, CYCS, 21871, 124321, 225-542; 4416, CYC1, 21873, 124323, 74-1051; 4417, CYP1A1, 21876, 124326, 84-1535; 4417, CYP1A1, 21879, 124329, 272-796; 4417, CYP1A1, 21882, 124332, 1-1455; 4417, CYP1A1, 21883, 124333, 123-1574; 4417, CYP1A1, 21874, 124324, 200-1738; 4417, CYP1A1, 21875, 124325, 123-1661; 4417, CYP1A1, 21877, 124327, 78-647; 4417, CYP1A1, 21878, 124328, 78-647; 4417, CYP1A1, 21880, 124330, 236-1774; 4417, CYP1A1, 21881, 124331, 272-745; 4418, CYP1A2, 21884, 124334, 64-1614; 4419, CYP1B1, 21886, 124336, 138-567; 4419, CYP1B1, 21887, 124337, 305-823; 4419, CYP1B1, 21885, 124335, 404-2035; 4419, CYP1B1, 21888, 124338, 303-1934; 4420, CYP11A1, 21891, 124341, 62-566; 4420, CYP11A1, 21892, 124342, 43-1287; 4420, CYP11A1, 21893, 124343, 758-1045; 4420, CYP11A1, 21894, 124344, 493-572; 4420, CYP11A1, 21895, 124345, 287-969; 4420, CYP11A1, 21889, 124339, 156-1721; 4420, CYP11A1, 21890, 124340, 697-1788; 4421, CYP11B1, 21897, 124347, 8-1732; 4421, CYP11B1, 21899, 124349, 1-546; 4421, CYP11B1, 21896, 124346, 34-1545; 4421, CYP11B1, 21898, 124348, 12-1325; 4422, CYP11B2, 21900, 124350, 4-1515; 4423, CYP17A1, 21901, 124351, 173-1699; 4424, CYP19A1, 21906, 124356, 297-794; 4424, CYP19A1, 21907, 124357, 387-1442; 4424, CYP19A1, 21908, 124358, 337-1062; 4424, CYP19A1, 21910, 124360, 1-415; 4424, CYP19A1, 21911, 124361, 478-993; 4424, CYP19A1, 21913, 124363, 183-1032; 4424, CYP19A1, 21914, 124364, 99-592; 4424, CYP19A1, 21915, 124365, 141-1196; 4424, CYP19A1, 21916, 124366, 141-872; 4424, CYP19A1, 21917, 124367, 1-123; 4424, CYP19A1, 21902, 124352, 148-1659; 4424, CYP19A1, 21903, 124353, 155-1666; 4424, CYP19A1, 21904, 124354, 250-1761; 4424, CYP19A1, 21905, 124355, 100-756; 4424, CYP19A1, 21909, 124359, 120-776; 4424, CYP19A1, 21912, 124362, 153-1664; 4425, CYP2A13, 21918, 124368, 1-1485; 4426, CYP2A6, 21920, 124370, 22-219; 4426, CYP2A6, 21921, 124371, 1-1485; 4426, CYP2A6, 21919, 124369, 22-1506; 4427, CYP2A7, 21922, 124372, 543-1874; 4427, CYP2A7, 21924, 124374, 22-264; 4427, CYP2A7, 21923, 124373, 543-2027; 4428, CYP2B6, 21926, 124376, 113-880; 4428, CYP2B6, 21925, 124375, 8-1483; 4429, CYP2C18, 21927, 124377, 200-1672; 4429, CYP2C18, 21928, 124378, 46-1341; 4430, CYP2C19, 21930, 124380, 26-514; 4430, CYP2C19, 21929, 124379, 83-1555; 4431, CYP2C8, 21932, 124382, 2-1183; 4431, CYP2C8, 21933, 124383, 96-347; 4431, CYP2C8, 21934, 124384, 96-395; 4431, CYP2C8, 21935, 124385, 406-1668; 4431, CYP2C8, 21937, 124387, 344-1606; 4431, CYP2C8, 21938, 124388, 1-924; 4431, CYP2C8, 21931, 124381, 96-1568; 4431, CYP2C8, 21936, 124386, 277-1443; 4432, CYP2C9, 21939, 124389, 13-1485; 4433, CYP2D6, 21941, 124391, 1-543; 4433, CYP2D6, 21943, 124393, 157-1641; 4433, CYP2D6, 21944, 124394, 116-1609; 4433, CYP2D6, 21945, 124395, 116-1609; 4433, CYP2D6, 21946, 124396, 91-1431; 4433, CYP2D6, 21948, 124398, 116-1609; 4433, CYP2D6, 21949, 124399, 75-1415; 4433, CYP2D6, 21950, 124400, 1-543; 4433, CYP2D6, 21951, 124401, 1-543; 4433, CYP2D6, 21952, 124402, 157-1641; 4433, CYP2D6, 21953, 124403, 1-543; 4433, CYP2D6, 21954, 124404, 75-1415; 4433, CYP2D6, 21955, 124405, 157-1641; 4433, CYP2D6, 21956, 124406, 116-1609; 4433, CYP2D6, 21940, 124390, 75-1415; 4433, CYP2D6, 21942, 124392, 116-1609; 4433, CYP2D6, 21947, 124397, 75-1415; 4434, CYP2D7, 21957, 124407, 1-138; 4434, CYP2D7, 21958, 124408, 114-1663; 4434, CYP2D7, 21959, 124409, 86-1578; 4434, CYP2D7, 21960, 124410, 112-1663; 4434, CYP2D7, 21961, 124411, 86-1580; 4434, CYP2D7, 21962, 124412, 91-1431; 4434, CYP2D7, 21963, 124413, 112-1663; 4434, CYP2D7, 21964, 124414, 114-1661; 4434, CYP2D7, 21965, 124415, 91-1431; 4434, CYP2D7, 21966, 124416, 91-1431; 4434, CYP2D7, 21967, 124417, 114-1661; 4434, CYP2D7, 21968, 124418, 91-1584; 4434, CYP2D7, 21970, 124420, 1-138; 4434, CYP2D7, 21971, 124421, 7-1501; 4434, CYP2D7, 21972, 124422, 86-1578; 4434, CYP2D7, 21973, 124423, 91-1431; 4434, CYP2D7, 21974, 124424, 114-1663; 4434, CYP2D7, 21975, 124425, 1-138; 4434, CYP2D7, 21976, 124426, 114-1661; 4434, CYP2D7, 21969, 124419, 114-1661; 4435, CYP2E1, 21978, 124428, 1-918; 4435, CYP2E1, 21979, 124429, 1-1068; 4435, CYP2E1, 21980, 124430, 216-475; 4435, CYP2E1, 21982, 124432, 1-130; 4435, CYP2E1, 21977, 124427, 34-1515; 4435, CYP2E1, 21981, 124431, 273-1754; 4436, CYP2F1, 21984, 124434, 1-244; 4436, CYP2F1, 21985, 124435, 1-516; 4436, CYP2F1, 21983, 124433, 73-1548; 4436, CYP2F1, 21986, 124436, 73-1035; 4437, CYP2J2, 21987, 124437, 45-1553; 4438, CYP2R1, 21989, 124439, 576-689; 4438, CYP2R1, 21990, 124440, 856-1662; 4438, CYP2R1, 21991, 124441, 1483-1596; 4438, CYP2R1, 21992, 124442, 554-667; 4438, CYP2R1, 21993, 124443, 1-98; 4438, CYP2R1, 21988, 124438, 48-1553; 4439, CYP2S1, 21995, 124445, 231-413; 4439, CYP2S1, 21996, 124446, 1-222; 4439, CYP2S1, 21997, 124447, 19-580; 4439, CYP2S1, 21998, 124448, 56-580; 4439, CYP2S1, 21999, 124449, 27-524; 4439, CYP2S1, 21994, 124444, 217-1731; 4440, CYP2U1, 22001, 124451, 874-1881; 4440, CYP2U1, 22000, 124450, 276-1910; 4441, CYP2W1, 22003, 124453, 23-1249; 4441, CYP2W1, 22004, 124454, 1-867; 4441, CYP2W1, 22002, 124452, 14-1486; 4442, CYP20A1, 22006, 124456, 37-171; 4442, CYP20A1, 22007, 124457, 43-177; 4442, CYP20A1, 22008, 124458, 82-1494; 4442, CYP20A1, 22009, 124459, 29-804; 4442, CYP20A1, 22010, 124460, 87-713; 4442, CYP20A1, 22012, 124462, 865-1443; 4442, CYP20A1, 22005, 124455, 124-1512; 4442, CYP20A1, 22011, 124461, 615-1922; 4443, CYP21A2, 22014, 124464, 126-1613; 4443, CYP21A2, 22015, 124465, 9-1403; 4443, CYP21A2, 22017, 124467, 126-1613; 4443, CYP21A2, 22021, 124471, 9-1403; 4443, CYP21A2, 22022, 124472, 159-1646; 4443, CYP21A2, 22024, 124474, 126-1613; 4443, CYP21A2, 22025, 124475, 97-423; 4443, CYP21A2, 22026, 124476, 8-244; 4443, CYP21A2, 22027, 124477, 9-579; 4443, CYP21A2, 22028, 124478, 42-599; 4443, CYP21A2, 22013, 124463, 9-1406; 4443, CYP21A2, 22016, 124466, 9-1406; 4443, CYP21A2, 22018, 124468, 126-1610; 4443, CYP21A2, 22019, 124469, 9-1406; 4443, CYP21A2, 22020, 124470, 126-1610; 4443, CYP21A2, 22023, 124473, 9-1406; 4444, CYP24A1, 22029, 124479, 395-1939; 4444, CYP24A1, 22030, 124480, 261-1379; 4444, CYP24A1, 22031, 124481, 71-1417; 4445, CYP26A1, 22034, 124484, 15-785; 4445, CYP26A1, 22032, 124482, 46-1539; 4445, CYP26A1, 22033, 124483, 379-1665; 4446, CYP26B1, 22036, 124486, 226-1191; 4446, CYP26B1, 22037, 124487, 50-567; 4446, CYP26B1, 22038, 124488, 29-574; 4446, CYP26B1, 22035, 124485, 205-1743; 4446, CYP26B1, 22039, 124489, 29-1342; 4447, CYP26C1, 22041, 124491, 457-1365; 4447, CYP26C1, 22040, 124490, 1-1569; 4448, CYP27A1, 22043, 124493, 136-799; 4448, CYP27A1, 22044, 124494, 31-378; 4448, CYP27A1, 22042, 124492, 428-2023; 4449, CYP27B1, 22046, 124496, 506-976; 4449, CYP27B1, 22047, 124497, 1-702; 4449, CYP27B1, 22045, 124495, 211-1737; 4450, CYP27C1, 22048, 124498, 132-1250; 4450, CYP27C1, 22049, 124499, 113-1231; 4451, CYP3A4, 22051, 124501, 108-1169; 4451, CYP3A4, 22052, 124502, 104-564; 4451, CYP3A4, 22050, 124500, 185-1696; 4452, CYP3A43, 22055, 124505, 104-484; 4452, CYP3A43, 22057, 124507, 68-358; 4452, CYP3A43, 22058, 124508, 68-946; 4452, CYP3A43, 22059, 124509, 100-603; 4452, CYP3A43, 22061, 124511, 74-244; 4452, CYP3A43, 22063, 124513, 104-328; 4452, CYP3A43, 22053, 124503, 1-1515; 4452, CYP3A43, 22054, 124504, 1-1263; 4452, CYP3A43, 22056, 124506, 104-1615; 4452, CYP3A43, 22060, 124510, 1-753; 4452, CYP3A43, 22062, 124512, 74-1255; 4453, CYP3A5, 22065, 124515, 103-222; 4453, CYP3A5, 22067, 124517, 98-217; 4453, CYP3A5, 22064, 124514, 101-1609; 4453, CYP3A5, 22066, 124516, 101-523; 4454, CYP3A7, 22068, 124518, 4-1515; 4455, CYP39A1, 22070, 124520, 590-1483; 4455, CYP39A1, 22069, 124519, 205-1614; 4456, CYP4A11, 22072, 124522, 24-1586; 4456, CYP4A11, 22073, 124523, 32-1399; 4456, CYP4A11, 22074, 124524, 44-691; 4456, CYP4A11, 22075, 124525, 52-1185; 4456, CYP4A11, 22076, 124526, 52-846; 4456, CYP4A11, 22077, 124527, 52-801; 4456, CYP4A11, 22078, 124528, 32-1297; 4456, CYP4A11, 22071, 124521, 33-1592; 4457, CYP4A22, 22079, 124529, 32-1399; 4457, CYP4A22, 22080, 124530, 37-1302; 4457, CYP4A22, 22082, 124532, 24-1586; 4457, CYP4A22, 22083, 124533, 33-1106; 4457, CYP4A22, 22081, 124531, 32-1591; 4458, CYP4B1, 22085, 124535, 1-1494; 4458, CYP4B1, 22087, 124537, 19-996; 4458, CYP4B1, 22088, 124538, 85-348; 4458, CYP4B1, 22089, 124539, 351-561; 4458, CYP4B1, 22090, 124540, 32-448; 4458, CYP4B1, 22091, 124541, 1-888; 4458, CYP4B1, 22084, 124534, 37-1572; 4458, CYP4B1, 22086, 124536, 37-1575; 4459, CYP4F11, 22093, 124543, 3-1367; 4459, CYP4F11, 22095, 124545, 1139-1738; 4459, CYP4F11, 22096, 124546, 37-1401; 4459, CYP4F11, 22092, 124542, 38-1612; 4459, CYP4F11, 22094, 124544, 428-2002; 4460, CYP4F12, 22097, 124547, 53-1627; 4460, CYP4F12, 22099, 124549, 62-301; 4460, CYP4F12, 22100, 124550, 114-324; 4460, CYP4F12, 22101, 124551, 120-434; 4460, CYP4F12, 22102, 124552, 381-1955; 4460, CYP4F12, 22098, 124548, 48-356; 4460, CYP4F12, 22103, 124553, 51-359; 4461, CYP4F2, 22104, 124554, 34-1596; 4461, CYP4F2, 22106, 124556, 119-579; 4461, CYP4F2, 22107, 124557, 48-317; 4461, CYP4F2, 22108, 124558, 1-223; 4461, CYP4F2, 22105, 124555, 97-1659; 4462, CYP4F22, 22109, 124559, 200-1795; 4462, CYP4F22, 22110, 124560, 5-1600; 4463, CYP4F3, 22112, 124562, 123-362; 4463, CYP4F3, 22116, 124566, 1-225; 4463, CYP4F3, 22117, 124567, 1-1569; 4463, CYP4F3, 22111, 124561, 48-1610; 4463, CYP4F3, 22113, 124563, 35-1597; 4463, CYP4F3, 22114, 124564, 48-1610; 4463, CYP4F3, 22115, 124565, 108-1670; 4464, CYP4F8, 22119, 124569, 145-778; 4464, CYP4F8, 22120, 124570, 65-274; 4464, CYP4F8, 22121, 124571, 1-311; 4464, CYP4F8, 22118, 124568, 62-1624; 4465, CYP4V2, 22122, 124572, 305-1882; 4466, CYP4X1, 22123, 124573, 251-1780; 4467, CYP4Z1, 22124, 124574, 4-1521; 4468, CYP46A1, 22127, 124577, 115-405; 4468, CYP46A1, 22128, 124578, 1-495; 4468, CYP46A1, 22129, 124579, 1-155; 4468, CYP46A1, 22125, 124575, 105-1607; 4468, CYP46A1, 22126, 124576, 251-1462; 4469, CYP51A1, 22130, 124580, 167-1696; 4469, CYP51A1, 22131, 124581, 1-667; 4469, CYP51A1, 22133, 124583, 467-556; 4469, CYP51A1, 22132, 124582, 262-1476; 4470, CYP7A1, 22134, 124584, 139-1653; 4471, CYP7B1, 22135, 124585, 175-1695; 4472, CYP8B1, 22137, 124587, 83-1573; 4472, CYP8B1, 22136, 124586, 350-1855; 4473, CYGB, 22139, 124589, 243-620; 4473, CYGB, 22140, 124590, 111-791; 4473, CYGB, 22141, 124591, 367-744; 4473, CYGB, 22138, 124588, 364-936; 4474, CYTH1, 22144, 124594, 75-269; 4474, CYTH1, 22145, 124595, 242-553; 4474, CYTH1, 22148, 124598, 67-102; 4474, CYTH1, 22150, 124600, 310-568; 4474, CYTH1, 22151, 124601, 172-988; 4474, CYTH1, 22152, 124602, 254-836; 4474, CYTH1, 22142, 124592, 72-1268; 4474, CYTH1, 22143, 124593, 72-1268; 4474, CYTH1, 22146, 124596, 50-1243; 4474, CYTH1, 22147, 124597, 253-1272; 4474, CYTH1, 22149, 124599, 694-1713; 4475, CYTIP, 22154, 124604, 365-757; 4475, CYTIP, 22155, 124605, 516-623; 4475, CYTIP, 22156, 124606, 338-561; 4475, CYTIP, 22157, 124607, 79-264; 4475, CYTIP, 22153, 124603, 123-1202; 4476, CYTH2, 22158, 124608, 326-1087; 4476, CYTH2, 22159, 124609, 188-1066; 4476, CYTH2, 22161, 124611, 1-645; 4476, CYTH2, 22162, 124612, 1255-1674; 4476, CYTH2, 22163, 124613, 301-1503; 4476, CYTH2, 22160, 124610, 477-1676; 4477, CYTH3, 22164, 124614, 138-1337; 4477, CYTH3, 22165, 124615, 138-1340; 4478, CYTH4, 22167, 124617, 84-557; 4478, CYTH4, 22168, 124618, 96-560; 4478, CYTH4, 22169, 124619, 300-652; 4478, CYTH4, 22170, 124620, 1-442; 4478, CYTH4, 22166, 124616, 188-1372; 4479, CIAPIN1, 22172, 124622, 83-883; 4479, CIAPIN1, 22173, 124623, 121-840; 4479, CIAPIN1, 22174, 124624, 119-505; 4479, CIAPIN1, 22176, 124626, 121-921; 4479, CIAPIN1, 22177, 124627, 496-641; 4479, CIAPIN1, 22178, 124628, 113-328; 4479, CIAPIN1, 22179, 124629, 59-625; 4479, CIAPIN1, 22180, 124630, 48-788; 4479, CIAPIN1, 22171, 124621, 243-1181; 4479, CIAPIN1, 22175, 124625, 134-1033; 4480, CISH, 22181, 124631, 182-958; 4480, CISH, 22182, 124632, 229-1056; 4481, CRLF1, 22184, 124634, 1-520; 4481, CRLF1, 22183, 124633, 195-1463; 4482, CRLF2, 22188, 124638, 90-788; 4482, CRLF2, 22185, 124635, 4-1119; 4482, CRLF2, 22186, 124636, 234-1013; 4482, CRLF2, 22187, 124637, 117-1232; 4483, CRLF3, 22190, 124640, 21-311; 4483, CRLF3, 22191, 124641, 1-356; 4483, CRLF3, 22189, 124639, 126-1454; 4484, CLNK, 22193, 124643, 1-1287; 4484, CLNK, 22195, 124645, 87-587; 4484, CLNK, 22192, 124642, 241-1527; 4484, CLNK, 22194, 124644, 294-803; 4485, CYTL1, 22197, 124647, 1-278; 4485, CYTL1, 22198, 124648, 1-229; 4485, CYTL1, 22196, 124646, 28-438; 4486, CYFIP1, 22199, 124649, 1-531; 4486, CYFIP1, 22200, 124650, 130-582; 4486, CYFIP1, 22202, 124652, 1-553; 4486, CYFIP1, 22203, 124653, 62-544; 4486, CYFIP1, 22205, 124655, 96-329; 4486, CYFIP1, 22207, 124657, 1-137; 4486, CYFIP1, 22208, 124658, 1-553; 4486, CYFIP1, 22209, 124659, 192-2779; 4486, CYFIP1, 22210, 124660, 56-2643; 4486, CYFIP1, 22211, 124661, 96-329; 4486, CYFIP1, 22212, 124662, 1-137; 4486, CYFIP1, 22213, 124663, 62-544; 4486, CYFIP1, 22214, 124664, 130-582; 4486, CYFIP1, 22201, 124651, 192-3953; 4486, CYFIP1, 22204, 124654, 303-2771; 4486, CYFIP1, 22206, 124656, 56-3817; 4487, CYFIP2, 22215, 124665, 97-3450; 4487, CYFIP2, 22216, 124666, 97-3270; 4487, CYFIP2, 22217, 124667, 92-298; 4487, CYFIP2, 22218, 124668, 92-3775; 4487, CYFIP2, 22219, 124669, 260-925; 4487, CYFIP2, 22220, 124670, 139-354; 4487, CYFIP2, 22221, 124671, 435-1000; 4487, CYFIP2, 22224, 124674, 81-967; 4487, CYFIP2, 22225, 124675, 1-306; 4487, CYFIP2, 22226, 124676, 2284-2988; 4487, CYFIP2, 22222, 124672, 141-3977; 4487, CYFIP2, 22223, 124673, 139-3900; 4487, CYFIP2, 22227, 124677, 266-4027; 4488, CLASP1, 22231, 124681, 353-4789; 4488, CLASP1, 22232, 124682, 214-663; 4488, CLASP1, 22233, 124683, 1-3827; 4488, CLASP1, 22234, 124684, 225-555; 4488, CLASP1, 22228, 124678, 391-5007; 4488, CLASP1, 22229, 124679, 391-4830; 4488, CLASP1, 22230, 124680, 502-4917; 4488, CLASP1, 22235, 124685, 391-4824; 4489, CLASP2, 22237, 124687, 227-1603; 4489, CLASP2, 22239, 124689, 355-4896; 4489, CLASP2, 22240, 124690, 1-614; 4489, CLASP2, 22241, 124691, 453-4334; 4489, CLASP2, 22242, 124692, 1-536; 4489, CLASP2, 22243, 124693, 152-685; 4489, CLASP2, 22244, 124694, 1-554; 4489, CLASP2, 22245, 124695, 189-1553; 4489, CLASP2, 22246, 124696, 176-874; 4489, CLASP2, 22247, 124697, 117-3938; 4489, CLASP2, 22248, 124698, 48-4592; 4489, CLASP2, 22249, 124699, 1-661; 4489, CLASP2, 22250, 124700, 144-4058; 4489, CLASP2, 22236, 124686, 178-1473; 4489, CLASP2, 22238, 124688, 212-4759; 4490, CPEB1, 22251, 124701, 213-554; 4490, CPEB1, 22252, 124702, 421-527; 4490, CPEB1, 22253, 124703, 506-557; 4490, CPEB1, 22256, 124706, 1-1686; 4490, CPEB1, 22258, 124708, 138-2018; 4490, CPEB1, 22259, 124709, 187-603; 4490, CPEB1, 22260, 124710, 18-1712; 4490, CPEB1, 22262, 124712, 1727-3493; 4490, CPEB1, 22267, 124717, 1-1686; 4490, CPEB1, 22270, 124720, 211-262; 4490, CPEB1, 22271, 124721, 138-2018; 4490, CPEB1, 22272, 124722, 187-603; 4490, CPEB1, 22274, 124724, 1-1671; 4490, CPEB1, 22275, 124725, 319-425; 4490, CPEB1, 22276, 124726, 213-554; 4490, CPEB1, 22277, 124727, 18-1712; 4490, CPEB1, 22254, 124704, 313-1773; 4490, CPEB1, 22255, 124705, 108-1793; 4490, CPEB1, 22257, 124707, 313-1773; 4490, CPEB1, 22261, 124711, 526-1986; 4490, CPEB1, 22263, 124713, 226-1701; 4490, CPEB1, 22264, 124714, 162-1622; 4490, CPEB1, 22265, 124715, 226-1701; 4490, CPEB1, 22266, 124716, 162-1622; 4490, CPEB1, 22268, 124718, 680-2140; 4490, CPEB1, 22269, 124719, 303-1763; 4490, CPEB1, 22273, 124723, 211-1671; 4491, CPEB2, 22278, 124728, 50-1843; 4491, CPEB2, 22283, 124733, 1-504; 4491, CPEB2, 22279, 124729, 88-1767; 4491, CPEB2, 22280, 124730, 50-1753; 4491, CPEB2, 22281, 124731, 50-1738; 4491, CPEB2, 22282, 124732, 1-3024; 4491, CPEB2, 22284, 124734, 88-1857; 4491, CPEB2, 22285, 124735, 1-3105; 4492, CPEB3, 22286, 124736, 174-2270; 4492, CPEB3, 22287, 124737, 90-2144; 4492, CPEB3, 22288, 124738, 123-2219; 4493, CPEB4, 22292, 124742, 204-2123; 4493, CPEB4, 22293, 124743, 395-2509; 4493, CPEB4, 22294, 124744, 1-441; 4493, CPEB4, 22295, 124745, 155-1174; 4493, CPEB4, 22289, 124739, 1455-3644; 4493, CPEB4, 22290, 124740, 395-2533; 4493, CPEB4, 22291, 124741, 128-1096; 4494, CKAP2, 22300, 124750, 247-537; 4494, CKAP2, 22301, 124751, 299-579; 4494, CKAP2, 22296, 124746, 119-2167; 4494, CKAP2, 22297, 124747, 119-1603; 4494, CKAP2, 22298, 124748, 91-2142; 4494, CKAP2, 22299, 124749, 283-2187; 4495, CKAP2L, 22303, 124753, 20-586; 4495, CKAP2L, 22302, 124752, 80-2317; 4496, CKAP5, 22306, 124756, 1-498; 4496, CKAP5, 22308, 124758, 1-610; 4496, CKAP5, 22309, 124759, 1-570; 4496, CKAP5, 22310, 124760, 130-582; 4496, CKAP5, 22304, 124754, 127-6045; 4496, CKAP5, 22305, 124755, 27-5945; 4496, CKAP5, 22307, 124757, 48-6146; 4497, CKAP4, 22312, 124762, 495-573; 4497, CKAP4, 22311, 124761, 138-1946; 4498, CIAO1, 22313, 124763, 220-1239; 4499, CTU1, 22314, 124764, 46-1092; 4500, CTU2, 22317, 124767, 49-258; 4500, CTU2, 22318, 124768, 663-931; 4500, CTU2, 22319, 124769, 1-327; 4500, CTU2, 22320, 124770, 10-1770; 4500, CTU2, 22315, 124765, 49-1506; 4500, CTU2, 22316, 124766, 69-1616; 4501, CRTAM, 22321, 124771, 48-1229; 4501, CRTAM, 22322, 124772, 107-691; 4502, CTLA4, 22325, 124775, 146-559; 4502, CTLA4, 22323, 124773, 1-525; 4502, CTLA4, 22324, 124774, 158-829; 4502, CTLA4, 22326, 124776, 1-240; 4503, DBP, 22328, 124778, 370-1158; 4503, DBP, 22329, 124779, 186-557; 4503, DBP, 22330, 124780, 235-540; 4503, DBP, 22327, 124777, 445-1422; 4504, D2HGDH, 22332, 124782, 159-1121; 4504, D2HGDH, 22333, 124783, 205-1368; 4504, D2HGDH, 22334, 124784, 1-955; 4504, D2HGDH, 22335, 124785, 1-454; 4504, D2HGDH, 22336, 124786, 1-566; 4504, D2HGDH, 22337, 124787, 174-905; 4504, D2HGDH, 22338, 124788, 1-234; 4504, D2HGDH, 22339, 124789, 1-269; 4504, D2HGDH, 22340, 124790, 436-1044; 4504, D2HGDH, 22331, 124781, 210-1775; 4505, DPF1, 22342, 124792, 125-1321; 4505, DPF1, 22345, 124795, 228-523; 4505, DPF1, 22346, 124796, 84-386; 4505, DPF1, 22347, 124797, 88-1254; 4505, DPF1, 22349, 124799, 343-973; 4505, DPF1, 22350, 124800, 266-428; 4505, DPF1, 22351, 124801, 109-1302; 4505, DPF1, 22341, 124791, 28-1272; 4505, DPF1, 22343, 124793, 601-1599; 4505, DPF1, 22344, 124794, 28-1170; 4505, DPF1, 22348, 124798, 251-1249; 4506, DPF2, 22352, 124802, 21-1238; 4506, DPF2, 22354, 124804, 11-331; 4506, DPF2, 22355, 124805, 1-351; 4506, DPF2, 22353, 124803, 33-656; 4506, DPF2, 22356, 124806, 134-1309; 4507, DPF3, 22358, 124808, 307-1545; 4507, DPF3, 22362, 124812, 307-1545; 4507, DPF3, 22357, 124807, 14-1087; 4507, DPF3, 22359, 124809, 29-1102; 4507, DPF3, 22360, 124810, 128-1231; 4507, DPF3, 22361, 124811, 1-1137; 4507, DPF3, 22363, 124813, 143-1246; 4508, DAB2, 22366, 124816, 536-651; 4508, DAB2, 22367, 124817, 212-562; 4508, DAB2, 22368, 124818, 361-561; 4508, DAB2, 22370, 124820, 325-551; 4508, DAB2, 22364, 124814, 469-2781; 4508, DAB2, 22365, 124815, 279-1937; 4508, DAB2, 22369, 124819, 81-2330; 4508, DAB2, 22371, 124821, 532-2781; 4509, DAB1, 22372, 124822, 36-647; 4509, DAB1, 22375, 124825, 36-752; 4509, DAB1, 22373, 124823, 265-906; 4509, DAB1, 22374, 124824, 36-1802; 4509, DAB1, 22376, 124826, 265-1932; 4509, DAB1, 22377, 124827, 139-1806; 4509, DAB1, 22378, 124828, 37-1698; 4510, DAB2IP, 22381, 124831, 1-3210; 4510, DAB2IP, 22382, 124832, 133-1006; 4510, DAB2IP, 22384, 124834, 242-928; 4510, DAB2IP, 22379, 124829, 88-3486; 4510, DAB2IP, 22380, 124830, 148-3345; 4510, DAB2IP, 22383, 124833, 183-3752; 4511, DACH1, 22385, 124835, 424-1938; 4511, DACH1, 22387, 124837, 424-2100; 4511, DACH1, 22388, 124838, 1-2277; 4511, DACH1, 22386, 124836, 424-2544; 4512, DACH2, 22392, 124842, 162-1484; 4512, DACH2, 22394, 124844, 1-750; 4512, DACH2, 22395, 124845, 1-528; 4512, DACH2, 22396, 124846, 1-1284; 4512, DACH2, 22389, 124839, 1-1800; 4512, DACH2, 22390, 124840, 164-1879; 4512, DACH2, 22391, 124841, 58-1356; 4512, DACH2, 22393, 124843, 175-1317; 4513, DCHS1, 22397, 124847, 413-10309; 4514, DCHS2, 22398, 124848, 362-4471; 4514, DCHS2, 22399, 124849, 1-8750; 4514, DCHS2, 22400, 124850, 1-8751; 4515, N/A, 22401, 124851, 4-1152; 4516, N/A, 22402, 124852, 119-805; 4516, N/A, 22403, 124853, 1-639; 4516, N/A, 22404, 124854, 342-1256; 4516, N/A, 22405, 124855, 13-699; 4516, N/A, 22406, 124856, 342-827; 4517, DALRD3, 22409, 124859, 1-554; 4517, DALRD3, 22410, 124860, 1-881; 4517, DALRD3, 22411, 124861, 704-1864; 4517, DALRD3, 22413, 124863, 623-839; 4517, DALRD3, 22407, 124857, 743-1873; 4517, DALRD3, 22408, 124858, 8-1639; 4517, DALRD3, 22412, 124862, 1-1551; 4518, N/A, 22414, 124864, 4-1152; 4519, N/A, 22415, 124865, 119-805; 4519, N/A, 22416, 124866, 1-639; 4519, N/A, 22417, 124867, 341-1255; 4519, N/A, 22418, 124868, 13-699; 4519, N/A, 22419, 124869, 341-826; 4520, DDB1, 22421, 124871, 395-3673; 4520, DDB1, 22422, 124872, 213-540; 4520, DDB1, 22423, 124873, 803-1220; 4520, DDB1, 22424, 124874, 121-558; 4520, DDB1, 22425, 124875, 310-805; 4520, DDB1, 22426, 124876, 86-571; 4520, DDB1, 22420, 124870, 399-3821; 4521, DDB2, 22431, 124881, 50-325; 4521, DDB2, 22433, 124883, 277-556; 4521, DDB2, 22434, 124884, 93-580; 4521, DDB2, 22435, 124885, 1-287; 4521, DDB2, 22436, 124886, 170-852; 4521, DDB2, 22427, 124877, 196-1479; 4521, DDB2, 22428, 124878, 1-717; 4521, DDB2, 22429, 124879, 146-880; 4521, DDB2, 22430, 124880, 1-1092; 4521, DDB2, 22432, 124882, 1-471; 4522, DADA, 22440, 124890, 259-636; 4522, DADA, 22442, 124892, 349-516; 4522, DADA, 22443, 124893, 20-316; 4522, DADA, 22445, 124895, 42-233; 4522, DADA, 22446, 124896, 1-92; 4522, DADA, 22437, 124887, 279-527; 4522, DADA, 22438, 124888, 47-508; 4522, DADA, 22439, 124889, 527-775; 4522, DADA, 22441, 124891, 272-652; 4522, DADA, 22444, 124894, 534-782; 4522, DADA, 22447, 124897, 1-462; 4523, DAO, 22449, 124899, 114-959; 4523, DAO, 22450, 124900, 51-640; 4523, DAO, 22451, 124901, 144-380; 4523, DAO, 22452, 124902, 95-466; 4523, DAO, 22453, 124903, 177-676; 4523, DAO, 22448, 124898, 205-1248; 4524, DAND5, 22455, 124905, 97-588; 4524, DAND5, 22454, 124904, 180-749; 4525, N/A, 22457, 124907, 1-383; 4525, N/A, 22458, 124908, 192-1097; 4526, N/A, 22459, 124909, 1-211; 4527, DDO, 22462, 124912, 17-349; 4527, DDO, 22460, 124910, 17-949; 4527, DDO, 22461, 124911, 17-1126; 4528, N/A, 22463, 124913, 24-323; 4529, N/A, 22464, 124914, 4-1152; 4530, DAZAP1, 22467, 124917, 95-1315; 4530, DAZAP1, 22468, 124918, 40-1021; 4530, DAZAP1, 22469, 124919, 162-1382; 4530, DAZAP1, 22465, 124915, 162-1385; 4530, DAZAP1, 22466, 124916, 206-1342; 4531, DAZAP2, 22472, 124922, 6-227; 4531, DAZAP2, 22476, 124926, 209-535; 4531, DAZAP2, 22478, 124928, 23-427; 4531, DAZAP2, 22470, 124920, 617-1123; 4531, DAZAP2, 22471, 124921, 83-343; 4531, DAZAP2, 22473, 124923, 83-544; 4531, DAZAP2, 22474, 124924, 185-625; 4531, DAZAP2, 22475, 124925, 55-465; 4531, DAZAP2, 22477, 124927, 85-708; 4532, DZIP1, 22479, 124929, 434-3037; 4532, DZIP1, 22480, 124930, 434-2980; 4532, DZIP1, 22481, 124931, 840-3386; 4532, DZIP1, 22482, 124932, 853-3456; 4532, DZIP1, 22483, 124933, 1-834; 4533, DZIP1L, 22485, 124935, 1-445; 4533, DZIP1L, 22487, 124937, 710-827; 4533, DZIP1L, 22488, 124938, 371-571; 4533, DZIP1L, 22484, 124934, 364-2667; 4533, DZIP1L, 22486, 124936, 311-1930; 4534, DZIP3, 22490, 124940, 364-576; 4534, DZIP3, 22491, 124941, 115-2076; 4534, DZIP3, 22494, 124944, 327-705; 4534, DZIP3, 22489, 124939, 231-3857; 4534, DZIP3, 22492, 124942, 208-1119; 4534, DZIP3, 22493, 124943, 130-3756; 4535, DBF4, 22496, 124946, 134-787; 4535, DBF4, 22497, 124947, 200-334; 4535, DBF4, 22495, 124945, 505-2529; 4535, DBF4, 22498, 124948, 518-1222; 4536, DBF4B, 22501, 124951, 124-597; 4536, DBF4B, 22499, 124949, 139-1986; 4536, DBF4B, 22500, 124950, 214-1509; 4537, DCC, 22502, 124952, 1-2318; 4537, DCC, 22504, 124954, 1-4275; 4537, DCC, 22505, 124955, 1-267; 4537, DCC, 22506, 124956, 1-213; 4537, DCC, 22507, 124957, 1-545; 4537, DCC, 22508, 124958, 139-444; 4537, DCC, 22509, 124959, 1-223; 4537, DCC, 22510, 124960, 1-626; 4537, DCC, 22511, 124961, 266-3496; 4537, DCC, 22503, 124953, 617-4960; 4538, DCTD, 22514, 124964, 676-896; 4538, DCTD, 22515, 124965, 49-183; 4538, DCTD, 22516, 124966, 72-578; 4538, DCTD, 22517, 124967, 851-1027; 4538, DCTD, 22518, 124968, 327-683; 4538, DCTD, 22519, 124969, 65-199; 4538, DCTD, 22520, 124970, 350-645; 4538, DCTD, 22522, 124972, 232-592; 4538, DCTD, 22523, 124973, 94-219; 4538, DCTD, 22524, 124974, 90-215; 4538, DCTD, 22525, 124975, 33-86; 4538, DCTD, 22526, 124976, 262-332; 4538, DCTD, 22527, 124977, 66-200; 4538, DCTD, 22512, 124962, 67-636; 4538, DCTD, 22513, 124963, 292-828; 4538, DCTD, 22521, 124971, 231-767; 4539, DCUN1D1, 22529, 124979, 119-504; 4539, DCUN1D1, 22530, 124980, 284-560; 4539, DCUN1D1, 22531, 124981, 32-139; 4539, DCUN1D1, 22532, 124982, 176-910; 4539, DCUN1D1, 22533, 124983, 274-567; 4539, DCUN1D1, 22534, 124984, 237-461; 4539, DCUN1D1, 22535, 124985, 95-829; 4539, DCUN1D1, 22528, 124978, 155-934; 4540, DCUN1D2, 22536, 124986, 36-416; 4540, DCUN1D2, 22538, 124988, 1-734; 4540, DCUN1D2, 22539, 124989, 292-562; 4540, DCUN1D2, 22540, 124990, 409-460; 4540, DCUN1D2, 22541, 124991, 141-499; 4540, DCUN1D2, 22543, 124993, 177-578; 4540, DCUN1D2, 22537, 124987, 23-583; 4540, DCUN1D2, 22542, 124992, 284-1063; 4541, DCUN1D3, 22544, 124994, 287-1201; 4541, DCUN1D3, 22545, 124995, 192-1106; 4542, DCUN1D4, 22549, 124999, 141-332; 4542, DCUN1D4, 22550, 125000, 46-669; 4542, DCUN1D4, 22551, 125001, 1-350; 4542, DCUN1D4, 22552, 125002, 1-66; 4542, DCUN1D4, 22553, 125003, 91-165; 4542, DCUN1D4, 22554, 125004, 47-478; 4542, DCUN1D4, 22555, 125005, 244-384; 4542, DCUN1D4, 22556, 125006, 111-251; 4542, DCUN1D4, 22557, 125007, 1-309; 4542, DCUN1D4, 22558, 125008, 8-645; 4542, DCUN1D4, 22546, 124996, 181-1059; 4542, DCUN1D4, 22547, 124997, 181-954; 4542, DCUN1D4, 22548, 124998, 8-1018; 4543, DCUN1D5, 22560, 125010, 306-521; 4543, DCUN1D5, 22561, 125011, 1-586; 4543, DCUN1D5, 22562, 125012, 277-531; 4543, DCUN1D5, 22563, 125013, 290-493; 4543, DCUN1D5, 22564, 125014, 1-205; 4543, DCUN1D5, 22565, 125015, 283-375; 4543, DCUN1D5, 22566, 125016, 318-776; 4543, DCUN1D5, 22567, 125017, 323-415; 4543, DCUN1D5, 22568, 125018, 1-129; 4543, DCUN1D5, 22559, 125009, 344-1057; 4544, DCST1, 22572, 125022, 119-1705; 4544, DCST1, 22569, 125019, 97-2217; 4544, DCST1, 22570, 125020, 68-2062; 4544, DCST1, 22571, 125021, 92-2137; 4545, DCST2, 22575, 125025, 1-60; 4545, DCST2, 22573, 125023, 60-2381; 4545, DCST2, 22574, 125024, 81-2000; 4546, DCTPP1, 22577, 125027, 385-534; 4546, DCTPP1, 22578, 125028, 51-266; 4546, DCTPP1, 22579, 125029, 475-624; 4546, DCTPP1, 22580, 125030, 401-550; 4546, DCTPP1, 22576, 125026, 96-608; 4547, DCAF10, 22581, 125031, 75-1235; 4547, DCAF10, 22582, 125032, 366-2045; 4548, DCAF11, 22583, 125033, 233-448; 4548, DCAF11, 22588, 125038, 148-575; 4548, DCAF11, 22589, 125039, 270-683; 4548, DCAF11, 22590, 125040, 581-947; 4548, DCAF11, 22591, 125041, 1-798; 4548, DCAF11, 22592, 125042, 168-603; 4548, DCAF11, 22593, 125043, 268-438; 4548, DCAF11, 22594, 125044, 196-543; 4548, DCAF11, 22595, 125045, 210-300; 4548, DCAF11, 22596, 125046, 275-476; 4548, DCAF11, 22597, 125047, 717-932; 4548, DCAF11, 22598, 125048, 526-849; 4548, DCAF11, 22599, 125049, 133-581; 4548, DCAF11, 22600, 125050, 131-346; 4548, DCAF11, 22601, 125051, 194-549; 4548, DCAF11, 22602, 125052, 138-308; 4548, DCAF11, 22603, 125053, 162-545; 4548, DCAF11, 22604, 125054, 320-490; 4548, DCAF11, 22605, 125055, 313-592; 4548, DCAF11, 22606, 125056, 172-387; 4548, DCAF11, 22607, 125057, 270-587; 4548, DCAF11, 22608, 125058, 278-547; 4548, DCAF11, 22609, 125059, 201-748; 4548, DCAF11, 22610, 125060, 362-581; 4548, DCAF11, 22611, 125061, 109-570; 4548, DCAF11, 22612, 125062, 262-575; 4548, DCAF11, 22584, 125034, 457-1797; 4548, DCAF11, 22585, 125035, 120-1682; 4548, DCAF11, 22586, 125036, 728-2368; 4548, DCAF11, 22587, 125037, 351-1991; 4549, DCAF12, 22614, 125064, 123-803; 4549, DCAF12, 22615, 125065, 109-676; 4549, DCAF12, 22613, 125063, 343-1704; 4550, DCAF12L1, 22616, 125066, 244-1635; 4551, DCAF12L2, 22617, 125067, 28-1419; 4552, DCAF13, 22618, 125068, 278-2071; 4552, DCAF13, 22619, 125069, 36-701; 4552, DCAF13, 22620, 125070, 69-626; 4552, DCAF13, 22621, 125071, 278-2071; 4552, DCAF13, 22623, 125073, 166-779; 4552, DCAF13, 22622, 125072, 69-359; 4552, DCAF13, 22624, 125074, 59-1396; 4553, DCAF15, 22626, 125076, 1-815; 4553, DCAF15, 22627, 125077, 1-165; 4553, DCAF15, 22628, 125078, 1-605; 4553, DCAF15, 22625, 125075, 22-1824; 4554, DCAF16, 22629, 125079, 1062-1712; 4555, DCAF17, 22630, 125080, 1-815; 4555, DCAF17, 22632, 125082, 1-385; 4555, DCAF17, 22633, 125083, 1-668; 4555, DCAF17, 22634, 125084, 328-1689; 4555, DCAF17, 22631, 125081, 328-1890; 4555, DCAF17, 22635, 125085, 200-922; 4556, DCAF4, 22636, 125086, 176-1153; 4556, DCAF4, 22639, 125089, 102-326; 4556, DCAF4, 22641, 125091, 291-1292; 4556, DCAF4, 22637, 125087, 221-1708; 4556, DCAF4, 22638, 125088, 275-1462; 4556, DCAF4, 22640, 125090, 73-1380; 4556, DCAF4, 22642, 125092, 66-1535; 4557, DCAF4L1, 22643, 125093, 98-1288; 4558, DCAF4L2, 22644, 125094, 98-1285; 4559, DCAF5, 22646, 125096, 6-986; 4559, DCAF5, 22647, 125097, 130-759; 4559, DCAF5, 22651, 125101, 159-410; 4559, DCAF5, 22645, 125095, 149-2977; 4559, DCAF5, 22648, 125098, 219-2801; 4559, DCAF5, 22649, 125099, 26-2851; 4559, DCAF5, 22650, 125100, 154-2736; 4560, DCAF6, 22656, 125106, 240-1658; 4560, DCAF6, 22652, 125102, 205-2787; 4560, DCAF6, 22653, 125103, 95-2950; 4560, DCAF6, 22654, 125104, 252-2894; 4560, DCAF6, 22655, 125105, 354-3116; 4561, DCAF7, 22659, 125109, 132-751; 4561, DCAF7, 22657, 125107, 197-1225; 4561, DCAF7, 22658, 125108, 179-607; 4561, DCAF7, 22660, 125110, 218-1246; 4562, DCAF8, 22664, 125114, 200-517; 4562, DCAF8, 22665, 125115, 318-439; 4562, DCAF8, 22666, 125116, 173-501; 4562, DCAF8, 22667, 125117, 93-728; 4562, DCAF8, 22669, 125119, 184-1437; 4562, DCAF8, 22670, 125120, 1-244; 4562, DCAF8, 22671, 125121, 545-919; 4562, DCAF8, 22672, 125122, 1-329; 4562, DCAF8, 22673, 125123, 1-201; 4562, DCAF8, 22661, 125111, 302-2095; 4562, DCAF8, 22662, 125112, 436-2229; 4562, DCAF8, 22663, 125113, 154-1947; 4562, DCAF8, 22668, 125118, 229-1050; 4562, DCAF8, 22674, 125124, 410-1231; 4563, DCAF8L1, 22675, 125125, 22-1824; 4564, DCAF8L2, 22677, 125127, 475-562; 4564, DCAF8L2, 22676, 125126, 400-2295; 4564, DCAF8L2, 22678, 125128, 88-1983; 4565, DDHD1, 22682, 125132, 323-599; 4565, DDHD1, 22683, 125133, 1-2316; 4565, DDHD1, 22679, 125129, 1-2703; 4565, DDHD1, 22680, 125130, 185-2803; 4565, DDHD1, 22681, 125131, 107-2746; 4566, DDHD2, 22687, 125137, 313-801; 4566, DDHD2, 22688, 125138, 87-515; 4566, DDHD2, 22689, 125139, 100-568; 4566, DDHD2, 22690, 125140, 272-683; 4566, DDHD2, 22691, 125141, 117-600; 4566, DDHD2, 22692, 125142, 30-696; 4566, DDHD2, 22693, 125143, 1-240; 4566, DDHD2, 22694, 125144, 188-358; 4566, DDHD2, 22695, 125145, 174-425; 4566, DDHD2, 22696, 125146, 1-641; 4566, DDHD2, 22697, 125147, 1-548; 4566, DDHD2, 22684, 125134, 526-2661; 4566, DDHD2, 22685, 125135, 928-1920; 4566, DDHD2, 22686, 125136, 201-2336; 4567, DDT, 22700, 125150, 46-546; 4567, DDT, 22701, 125151, 234-632; 4567, DDT, 22703, 125153, 1-152; 4567, DDT, 22705, 125155, 46-546; 4567, DDT, 22707, 125157, 1-152; 4567, DDT, 22709, 125159, 234-632; 4567, DDT, 22698, 125148, 129-485; 4567, DDT, 22699, 125149, 171-527; 4567, DDT, 22702, 125152, 46-369; 4567, DDT, 22704, 125154, 129-485; 4567, DDT, 22706, 125156, 20-343; 4567, DDT, 22708, 125158, 171-527; 4568, DDTL, 22710, 125160, 15-419; 4568, DDTL, 22711, 125161, 15-419; 4569, DDRGK1, 22713, 125163, 59-955; 4569, DDRGK1, 22712, 125162, 59-1003; 4570, DDX1, 22716, 125166, 452-500; 4570, DDX1, 22717, 125167, 84-2063; 4570, DDX1, 22718, 125168, 1-1980; 4570, DDX1, 22714, 125164, 314-2536; 4570, DDX1, 22715, 125165, 390-2612; 4571, DDX17, 22719, 125169, 101-2296; 4571, DDX17, 22721, 125171, 1-169; 4571, DDX17, 22720, 125170, 76-2265; 4572, DDX21, 22722, 125172, 99-2450; 4572, DDX21, 22723, 125173, 427-2574; 4573, DDX24, 22725, 125175, 117-1946; 4573, DDX24, 22726, 125176, 93-2543; 4573, DDX24, 22728, 125178, 93-2543; 4573, DDX24, 22729, 125179, 35-1492; 4573, DDX24, 22732, 125182, 35-1492; 4573, DDX24, 22733, 125183, 117-1946; 4573, DDX24, 22724, 125174, 71-2485; 4573, DDX24, 22727, 125177, 71-2485; 4573, DDX24, 22730, 125180, 133-2712; 4573, DDX24, 22731, 125181, 133-2712; 4574, DDX25, 22735, 125185, 1-574; 4574, DDX25, 22736, 125186, 1-1222; 4574, DDX25, 22737, 125187, 1-1407; 4574, DDX25, 22738, 125188, 1-202; 4574, DDX25, 22734, 125184, 156-1607; 4575, DDX3X, 22741, 125191, 92-511; 4575, DDX3X, 22743, 125193, 1-416; 4575, DDX3X, 22744, 125194, 92-388; 4575,

DDX3X, 22745, 125195, 906-3107; 4575, DDX3X, 22746, 125196, 906-2828; 4575, DDX3X, 22747, 125197, 906-2849; 4575, DDX3X, 22750, 125200, 906-2849; 4575, DDX3X, 22752, 125202, 1-494; 4575, DDX3X, 22753, 125203, 92-583; 4575, DDX3X, 22739, 125189, 856-2844; 4575, DDX3X, 22740, 125190, 856-2796; 4575, DDX3X, 22742, 125192, 856-2844; 4575, DDX3X, 22748, 125198, 906-2894; 4575, DDX3X, 22749, 125199, 906-2894; 4575, DDX3X, 22751, 125201, 480-2468; 4576, DDX3Y, 22756, 125206, 377-1049; 4576, DDX3Y, 22757, 125207, 43-792; 4576, DDX3Y, 22754, 125204, 107-2089; 4576, DDX3Y, 22755, 125205, 310-2292; 4577, DDX42, 22760, 125210, 18-2144; 4577, DDX42, 22761, 125211, 1-298; 4577, DDX42, 22762, 125212, 1-212; 4577, DDX42, 22763, 125213, 13-492; 4577, DDX42, 22766, 125216, 276-589; 4577, DDX42, 22758, 125208, 324-2783; 4577, DDX42, 22759, 125209, 205-3021; 4577, DDX42, 22764, 125214, 413-3229; 4577, DDX42, 22765, 125215, 602-3418; 4578, DDX5, 22769, 125219, 171-461; 4578, DDX5, 22770, 125220, 317-676; 4578, DDX5, 22771, 125221, 1-501; 4578, DDX5, 22772, 125222, 168-2012; 4578, DDX5, 22773, 125223, 361-474; 4578, DDX5, 22774, 125224, 920-1051; 4578, DDX5, 22775, 125225, 444-582; 4578, DDX5, 22776, 125226, 513-543; 4578, DDX5, 22777, 125227, 205-504; 4578, DDX5, 22778, 125228, 421-576; 4578, DDX5, 22779, 125229, 385-580; 4578, DDX5, 22780, 125230, 359-996; 4578, DDX5, 22781, 125231, 171-287; 4578, DDX5, 22782, 125232, 438-531; 4578, DDX5, 22783, 125233, 1-461; 4578, DDX5, 22784, 125234, 524-572; 4578, DDX5, 22785, 125235, 174-473; 4578, DDX5, 22767, 125217, 403-2247; 4578, DDX5, 22768, 125218, 169-1776; 4579, DDX56, 22787, 125237, 14-325; 4579, DDX56, 22788, 125238, 1-549; 4579, DDX56, 22789, 125239, 1157-2284; 4579, DDX56, 22791, 125241, 1-558; 4579, DDX56, 22792, 125242, 1-1189; 4579, DDX56, 22786, 125236, 108-1751; 4579, DDX56, 22790, 125240, 31-1554; 4580, DDX6, 22796, 125246, 318-881; 4580, DDX6, 22793, 125243, 362-1813; 4580, DDX6, 22794, 125244, 307-1758; 4580, DDX6, 22795, 125245, 362-1813; 4581, DDX10, 22798, 125248, 33-2540; 4581, DDX10, 22797, 125247, 130-2757; 4582, DDX18, 22800, 125250, 1-644; 4582, DDX18, 22799, 125249, 129-2141; 4583, DDX19A, 22802, 125252, 49-1392; 4583, DDX19A, 22803, 125253, 97-240; 4583, DDX19A, 22804, 125254, 88-243; 4583, DDX19A, 22805, 125255, 88-324; 4583, DDX19A, 22806, 125256, 110-499; 4583, DDX19A, 22807, 125257, 1-1190; 4583, DDX19A, 22808, 125258, 88-282; 4583, DDX19A, 22801, 125251, 164-1600; 4584, DDX19B, 22813, 125263, 26-726; 4584, DDX19B, 22814, 125264, 130-228; 4584, DDX19B, 22815, 125265, 157-249; 4584, DDX19B, 22816, 125266, 70-1524; 4584, DDX19B, 22819, 125269, 90-215; 4584, DDX19B, 22820, 125270, 107-253; 4584, DDX19B, 22821, 125271, 121-267; 4584, DDX19B, 22809, 125259, 246-1685; 4584, DDX19B, 22810, 125260, 105-1451; 4584, DDX19B, 22811, 125261, 361-1473; 4584, DDX19B, 22812, 125262, 50-1411; 4584, DDX19B, 22817, 125267, 410-1522; 4584, DDX19B, 22818, 125268, 456-1568; 4585, DDX20, 22824, 125274, 2359-3657; 4585, DDX20, 22822, 125272, 621-3095; 4585, DDX20, 22823, 125273, 263-679; 4586, DDX23, 22827, 125277, 154-567; 4586, DDX23, 22828, 125278, 1-457; 4586, DDX23, 22829, 125279, 151-696; 4586, DDX23, 22830, 125280, 1-780; 4586, DDX23, 22825, 125275, 81-2543; 4586, DDX23, 22826, 125276, 59-385; 4587, DDX27, 22832, 125282, 18-527; 4587, DDX27, 22833, 125283, 34-2331; 4587, DDX27, 22834, 125284, 1-825; 4587, DDX27, 22831, 125281, 10-2400; 4587, DDX27, 22835, 125285, 62-2452; 4588, DDX28, 22836, 125286, 241-1863; 4589, DDX31, 22840, 125290, 94-2334; 4589, DDX31, 22837, 125287, 153-1910; 4589, DDX31, 22838, 125288, 153-2708; 4589, DDX31, 22839, 125289, 153-2708; 4589, DDX31, 22841, 125291, 153-1112; 4590, DDX39A, 22845, 125295, 211-585; 4590, DDX39A, 22846, 125296, 160-484; 4590, DDX39A, 22847, 125297, 174-565; 4590, DDX39A, 22848, 125298, 287-563; 4590, DDX39A, 22849, 125299, 1-566; 4590, DDX39A, 22851, 125301, 65-829; 4590, DDX39A, 22852, 125302, 1-291; 4590, DDX39A, 22842, 125292, 103-1386; 4590, DDX39A, 22843, 125293, 65-1033; 4590, DDX39A, 22844, 125294, 119-922; 4590, DDX39A, 22850, 125300, 1-804; 4591, DDX39B, 22853, 125303, 5-1282; 4591, DDX39B, 22856, 125306, 5-1282; 4591, DDX39B, 22859, 125309, 1-561; 4591, DDX39B, 22861, 125311, 1-561; 4591, DDX39B, 22862, 125312, 43-633; 4591, DDX39B, 22863, 125313, 175-583; 4591, DDX39B, 22865, 125315, 5-1282; 4591, DDX39B, 22866, 125316, 238-932; 4591, DDX39B, 22868, 125318, 373-659; 4591, DDX39B, 22869, 125319, 1-561; 4591, DDX39B, 22870, 125320, 373-659; 4591, DDX39B, 22872, 125322, 30-591; 4591, DDX39B, 22873, 125323, 175-583; 4591, DDX39B, 22874, 125324, 1-561; 4591, DDX39B, 22875, 125325, 104-817; 4591, DDX39B, 22876, 125326, 222-928; 4591, DDX39B, 22877, 125327, 238-932; 4591, DDX39B, 22878, 125328, 178-914; 4591, DDX39B, 22879, 125329, 373-659; 4591, DDX39B, 22881, 125331, 345-720; 4591, DDX39B, 22883, 125333, 5-1282; 4591, DDX39B, 22884, 125334, 1-406; 4591, DDX39B, 22885, 125335, 345-720; 4591, DDX39B, 22886, 125336, 104-817; 4591, DDX39B, 22887, 125337, 187-583; 4591, DDX39B, 22888, 125338, 104-817; 4591, DDX39B, 22889, 125339, 139-1005; 4591, DDX39B, 22890, 125340, 1-561; 4591, DDX39B, 22891, 125341, 1-566; 4591, DDX39B, 22892, 125342, 222-928; 4591, DDX39B, 22893, 125343, 1-63; 4591, DDX39B, 22894, 125344, 30-591; 4591, DDX39B, 22895, 125345, 104-817; 4591, DDX39B, 22896, 125346, 1-75; 4591, DDX39B, 22897, 125347, 1-561; 4591, DDX39B, 22898, 125348, 187-583; 4591, DDX39B, 22899, 125349, 175-583; 4591, DDX39B, 22901, 125351, 178-914; 4591, DDX39B, 22903, 125353, 139-1005; 4591, DDX39B, 22904, 125354, 1-986; 4591, DDX39B, 22905, 125355, 222-928; 4591, DDX39B, 22906, 125356, 175-583; 4591, DDX39B, 22908, 125358, 345-720; 4591, DDX39B, 22909, 125359, 187-583; 4591, DDX39B, 22910, 125360, 345-720; 4591, DDX39B, 22911, 125361, 104-817; 4591, DDX39B, 22912, 125362, 373-659; 4591, DDX39B, 22913, 125363, 5-1282; 4591, DDX39B, 22915, 125365, 238-932; 4591, DDX39B, 22916, 125366, 187-583; 4591, DDX39B, 22917, 125367, 345-720; 4591, DDX39B, 22918, 125368, 345-720; 4591, DDX39B, 22919, 125369, 104-817; 4591, DDX39B, 22921, 125371, 1-413; 4591, DDX39B, 22922, 125372, 43-633; 4591, DDX39B, 22923, 125373, 43-633; 4591, DDX39B, 22924, 125374, 187-583; 4591, DDX39B, 22925, 125375, 1-192; 4591, DDX39B, 22926, 125376, 139-1005; 4591, DDX39B, 22927, 125377, 104-817; 4591, DDX39B, 22928, 125378, 1-986; 4591, DDX39B, 22929, 125379, 1-561; 4591, DDX39B, 22930, 125380, 238-932; 4591, DDX39B, 22931, 125381, 1-394; 4591, DDX39B, 22932, 125382, 139-1005; 4591, DDX39B, 22934, 125384, 5-1282; 4591, DDX39B, 22935, 125385, 30-591; 4591, DDX39B, 22936, 125386, 5-1282; 4591, DDX39B, 22937, 125387, 178-914; 4591, DDX39B, 22938, 125388, 187-583; 4591, DDX39B, 22939, 125389, 43-633; 4591, DDX39B, 22940, 125390, 43-633; 4591, DDX39B, 22941, 125391, 1-290; 4591, DDX39B, 22942, 125392, 30-591; 4591, DDX39B, 22943, 125393, 43-633; 4591, DDX39B, 22944, 125394, 222-928; 4591, DDX39B, 22945, 125395, 30-591; 4591, DDX39B, 22946, 125396, 175-583; 4591, DDX39B, 22947, 125397, 1-96; 4591, DDX39B, 22948, 125398, 43-633; 4591, DDX39B, 22949, 125399, 345-720; 4591, DDX39B, 22950, 125400, 1-561; 4591, DDX39B, 22951, 125401, 139-1005; 4591, DDX39B, 22952, 125402, 222-928; 4591, DDX39B, 22953, 125403, 178-914; 4591, DDX39B, 22955, 125405, 187-583; 4591, DDX39B, 22956, 125406, 30-591; 4591, DDX39B, 22957, 125407, 238-932; 4591, DDX39B, 22959, 125409, 373-659; 4591, DDX39B, 22960, 125410, 178-914; 4591, DDX39B, 22961, 125411, 178-914; 4591, DDX39B, 22962, 125412, 1-986; 4591, DDX39B, 22963, 125413, 30-591; 4591, DDX39B, 22964, 125414, 139-1005; 4591, DDX39B, 22965, 125415, 222-928; 4591, DDX39B, 22966, 125416, 373-659; 4591, DDX39B, 22967, 125417, 139-1005; 4591, DDX39B, 22968, 125418, 175-583; 4591, DDX39B, 22969, 125419, 178-914; 4591, DDX39B, 22970, 125420, 238-932; 4591, DDX39B, 22971, 125421, 1-977; 4591, DDX39B, 22973, 125423, 238-932; 4591, DDX39B, 22974, 125424, 1-539; 4591, DDX39B, 22975, 125425, 222-928; 4591, DDX39B, 22976, 125426, 175-583; 4591, DDX39B, 22977, 125427, 1-424; 4591, DDX39B, 22978, 125428, 1-424; 4591, DDX39B, 22979, 125429, 1-424; 4591, DDX39B, 22980, 125430, 1-424; 4591, DDX39B, 22981, 125431, 1-424; 4591, DDX39B, 22982, 125432, 1-424; 4591, DDX39B, 22983, 125433, 1-424; 4591, DDX39B, 22984, 125434, 1-424; 4591, DDX39B, 22985, 125435, 468-1210; 4591, DDX39B, 22854, 125304, 538-1824; 4591, DDX39B, 22855, 125305, 632-1918; 4591, DDX39B, 22857, 125307, 502-1788; 4591, DDX39B, 22858, 125308, 632-1918; 4591, DDX39B, 22860, 125310, 632-1918; 4591, DDX39B, 22864, 125314, 502-1788; 4591, DDX39B, 22867, 125317, 632-1918; 4591, DDX39B, 22871, 125321, 632-1918; 4591, DDX39B, 22880, 125330, 538-1824; 4591, DDX39B, 22882, 125332, 538-1824; 4591, DDX39B, 22900, 125350, 502-1788; 4591, DDX39B, 22902, 125352, 632-1918; 4591, DDX39B, 22907, 125357, 502-1788; 4591, DDX39B, 22914, 125364, 502-1788; 4591, DDX39B, 22920, 125370, 632-1918; 4591, DDX39B, 22933, 125383, 502-1788; 4591, DDX39B, 22954, 125404, 538-1824; 4591, DDX39B, 22958, 125408, 538-1824; 4591, DDX39B, 22972, 125422, 502-1788; 4592, DDX4, 22988, 125438, 251-567; 4592, DDX4, 22989, 125439, 1-917; 4592, DDX4, 22991, 125441, 90-566; 4592, DDX4, 22992, 125442, 44-470; 4592, DDX4, 22995, 125445, 77-1631; 4592, DDX4, 22996, 125446, 81-549; 4592, DDX4, 22997, 125447, 1-152; 4592, DDX4, 22986, 125436, 100-2172; 4592, DDX4, 22987, 125437, 15-2087; 4592, DDX4, 22990, 125440, 20-1747; 4592, DDX4, 22993, 125443, 93-2267; 4592, DDX4, 22994, 125444, 100-2214; 4593, DDX41, 22998, 125448, 1-1923; 4593, DDX41, 22999, 125449, 1-520; 4593, DDX41, 23001, 125451, 1-381; 4593, DDX41, 23002, 125452, 6-611; 4593, DDX41, 23003, 125453, 17-166; 4593, DDX41, 23004, 125454, 1-606; 4593, DDX41, 23005, 125455, 1-150; 4593, DDX41, 23000, 125450, 525-2393; 4594, DDX43, 23006, 125456, 159-2105; 4595, DDX46, 23008, 125458, 159-3257; 4595, DDX46, 23009, 125459, 1-211; 4595, DDX46, 23010, 125460, 1-89; 4595, DDX46, 23011, 125461, 161-1576; 4595, DDX46, 23012, 125462, 169-1584; 4595, DDX46, 23007, 125457, 136-3231; 4596, DDX47, 23015, 125465, 9-597; 4596, DDX47, 23013, 125463, 53-1273; 4596, DDX47, 23014, 125464, 23-1390; 4597, DDX49, 23017, 125467, 5-130; 4597, DDX49, 23018, 125468, 28-384; 4597, DDX49, 23019, 125469, 16-516; 4597, DDX49, 23020, 125470, 14-352; 4597, DDX49, 23021, 125471, 15-140; 4597, DDX49, 23022, 125472, 68-568; 4597, DDX49, 23016, 125466, 68-1519; 4598, DDX50, 23024, 125474, 69-224; 4598, DDX50, 23025, 125475, 100-219; 4598, DDX50, 23026, 125476, 97-2289; 4598, DDX50, 23023, 125473, 108-2321; 4599, DDX51, 23027, 125477, 40-2040; 4600, DDX52, 23028, 125478, 14-319; 4600, DDX52, 23031, 125481, 26-364; 4600, DDX52, 23032, 125482, 1-346; 4600, DDX52, 23033, 125483, 27-320; 4600, DDX52, 23034, 125484, 14-319; 4600, DDX52, 23035, 125485, 26-364; 4600, DDX52, 23036, 125486, 27-320; 4600, DDX52, 23037, 125487, 1-346; 4600, DDX52, 23029, 125479, 45-1844; 4600, DDX52, 23030, 125480, 45-1844; 4601, DDX53, 23038, 125488, 98-1993; 4602, DDX54, 23041, 125491, 1-479; 4602, DDX54, 23042, 125492, 1-247; 4602, DDX54, 23043, 125493, 156-780; 4602, DDX54, 23039, 125489, 29-2674; 4602, DDX54, 23040, 125490, 29-2677; 4603, DDX55, 23045, 125495, 20-595; 4603, DDX55, 23047, 125497, 25-177; 4603, DDX55, 23048, 125498, 22-1731; 4603, DDX55, 23049, 125499, 22-150; 4603, DDX55, 23044, 125494, 51-1853; 4603, DDX55, 23046, 125496, 669-1292; 4604, DDX58, 23050, 125500, 504-2672; 4604, DDX58, 23051, 125501, 159-2936; 4605, DDX59, 23053, 125503, 154-635; 4605, DDX59, 23054, 125504, 1-618; 4605, DDX59, 23056, 125506, 419-643; 4605, DDX59, 23057, 125507, 1-592; 4605, DDX59, 23058, 125508, 216-889; 4605, DDX59, 23059, 125509, 1-283; 4605, DDX59, 23052, 125502, 215-2074; 4605, DDX59, 23055, 125505, 153-1895; 4606, DDX60, 23061, 125511, 1-575; 4606, DDX60, 23062, 125512, 176-534; 4606, DDX60, 23063, 125513, 1-314; 4606, DDX60, 23060, 125510, 293-5431; 4607, DDX60L, 23065, 125515, 1-2605; 4607, DDX60L, 23068, 125518, 1-586; 4607, DDX60L, 23069, 125519, 215-588; 4607, DDX60L, 23070, 125520, 337-632; 4607, DDX60L, 23071, 125521, 198-428; 4607, DDX60L, 23064, 125514, 222-5342; 4607, DDX60L, 23066, 125516, 222-4148; 4607, DDX60L, 23067, 125517, 249-5369; 4608, DDX11, 23074, 125524, 210-883; 4608, DDX11, 23076, 125526, 229-1135; 4608, DDX11, 23077, 125527, 188-424; 4608, DDX11, 23078, 125528, 305-879; 4608, DDX11, 23080, 125530, 1-518; 4608, DDX11, 23081, 125531, 113-628; 4608, DDX11, 23082, 125532, 237-1151; 4608, DDX11, 23084, 125534, 101-967; 4608, DDX11, 23085, 125535, 1-230; 4608, DDX11, 23086, 125536, 1-96; 4608, DDX11, 23087, 125537, 215-1108; 4608, DDX11, 23088, 125538, 1-276; 4608, DDX11, 23072, 125522, 120-2762; 4608, DDX11, 23073, 125523, 199-2769; 4608, DDX11, 23075, 125525, 221-1087; 4608, DDX11, 23079, 125529, 81-2993; 4608, DDX11, 23083, 125533, 252-2972; 4609, DDX26B, 23089, 125539, 335-2920; 4610, DEAF1, 23091, 125541, 1-1048; 4610, DEAF1, 23092, 125542, 1-259; 4610, DEAF1, 23093, 125543, 1-485; 4610, DEAF1, 23094, 125544, 1-443; 4610, DEAF1, 23095, 125545, 1-431; 4610, DEAF1, 23090, 125540, 486-2183; 4611, DFNA5, 23099, 125549, 1-467; 4611, DFNA5, 23100, 125550, 1-168; 4611, DFNA5, 23101, 125551, 1-578; 4611, DFNA5, 23103, 125553, 516-571; 4611, DFNA5, 23104, 125554, 1-651; 4611, DFNA5, 23096, 125546, 427-1917; 4611, DFNA5, 23097, 125547, 168-1658; 4611, DFNA5, 23098, 125548, 362-1360; 4611, DFNA5, 23102, 125552, 596-1594; 4612, DFNB31, 23105, 125555, 599-2173; 4612, DFNB31, 23106, 125556, 170-2893; 4612, DFNB31, 23108, 125558, 935-2605; 4612, DFNB31, 23107, 125557, 650-1687; 4613, DFNB59, 23111, 125561, 1-317; 4613, DFNB59, 23112, 125562, 1-469; 4613, DFNB59, 23109, 125559, 144-1202; 4613, DFNB59, 23110, 125560, 357-1415; 4614, DHX57, 23113, 125563, 1-156; 4614, DHX57, 23114, 125564, 1-1996; 4614, DHX57, 23116, 125566, 231-548; 4614, DHX57, 23117, 125567, 213-1631; 4614, DHX57, 23115, 125565, 129-4289; 4615, DHX15, 23118, 125568, 158-2545; 4616, DHX30, 23119, 125569, 421-3921; 4616, DHX30, 23120, 125570, 202-330; 4616, DHX30, 23123, 125573, 229-357; 4616, DHX30, 23125, 125575, 198-326; 4616, DHX30, 23121, 125571, 1-3585; 4616, DHX30, 23122, 125572, 13-3681; 4616, DHX30, 23124, 125574, 408-3992; 4616, DHX30, 23126, 125576, 32-3499; 4617, DHX9, 23127, 125577, 111-3923; 4618, DHX16, 23128, 125578, 128-1810; 4618, DHX16, 23130, 125580, 128-1810; 4618, DHX16, 23133, 125583, 7-892; 4618, DHX16, 23135, 125585, 197-2203; 4618, DHX16, 23136, 125586, 7-892; 4618, DHX16, 23139, 125589, 7-892; 4618, DHX16, 23140, 125590, 7-892; 4618, DHX16, 23141, 125591, 128-1810; 4618, DHX16, 23142, 125592, 128-1810; 4618, DHX16, 23144, 125594, 128-1810; 4618, DHX16, 23145, 125595, 128-1810; 4618, DHX16, 23146, 125596, 128-1810; 4618, DHX16, 23147, 125597, 7-892; 4618, DHX16, 23148, 125598, 7-892; 4618, DHX16, 23149, 125599, 128-691; 4618, DHX16, 23150, 125600, 7-892; 4618, DHX16, 23151, 125601, 7-892; 4618, DHX16, 23129, 125579, 197-3322; 4618, DHX16, 23131, 125581, 197-3322; 4618, DHX16, 23132, 125582, 197-3322; 4618, DHX16, 23134, 125584, 197-3322; 4618, DHX16, 23137, 125587, 197-3322; 4618, DHX16, 23138, 125588, 197-3322; 4618, DHX16, 23143, 125593, 197-3322; 4619, DHX29, 23153, 125603, 1-479; 4619, DHX29, 23154, 125604, 102-4214; 4619, DHX29, 23152, 125602, 150-4259; 4620, DHX32, 23156, 125606, 936-2039; 4620, DHX32, 23157, 125607, 467-803; 4620, DHX32, 23155, 125605, 492-2723; 4621, DHX33, 23159, 125609, 58-1509; 4621, DHX33, 23160, 125610, 1-282; 4621, DHX33, 23161, 125611, 1-1852; 4621, DHX33, 23158, 125608, 202-2325; 4622, DHX34, 23163, 125613, 1-817; 4622, DHX34, 23162, 125612, 350-3781; 4623, DHX35, 23166, 125616, 70-2109; 4623, DHX35, 23167, 125617, 1-504; 4623, DHX35, 23168, 125618, 9-389; 4623, DHX35, 23164, 125614, 34-2145; 4623, DHX35, 23165, 125615, 25-2043; 4624, DHX36, 23172, 125622, 1-360; 4624, DHX36, 23173, 125623, 1-562; 4624, DHX36, 23174, 125624, 220-2612; 4624, DHX36, 23175, 125625, 1-15; 4624, DHX36, 23176, 125626, 1-651; 4624, DHX36, 23177, 125627, 1-651; 4624, DHX36, 23178, 125628, 1-651; 4624, DHX36, 23179, 125629, 1-275; 4624, DHX36, 23169, 125619, 45-2984; 4624, DHX36, 23170, 125620, 1-2985; 4624, DHX36, 23171, 125621, 82-3108; 4625, DHX37, 23181, 125631, 111-2999; 4625, DHX37, 23182, 125632, 269-669; 4625, DHX37, 23180, 125630, 100-3573; 4626, DHX38, 23184, 125634, 1-575; 4626, DHX38, 23185, 125635, 297-710; 4626, DHX38, 23186, 125636, 206-574; 4626, DHX38, 23187, 125637, 225-653; 4626, DHX38, 23188, 125638, 1-564; 4626, DHX38, 23189, 125639, 1-387; 4626, DHX38, 23183, 125633, 510-4193; 4627, DHX40, 23192, 125642, 1-750; 4627, DHX40, 23193, 125643, 62-277; 4627, DHX40, 23194, 125644, 50-855; 4627, DHX40, 23195, 125645, 115-420; 4627, DHX40, 23196, 125646, 60-580; 4627, DHX40, 23190, 125640, 148-2487; 4627, DHX40, 23191, 125641, 61-2169; 4628, DHX8, 23198, 125648, 76-3621; 4628, DHX8, 23199, 125649, 1-100; 4628, DHX8, 23200, 125650, 1-417; 4628, DHX8, 23201, 125651, 174-335; 4628, DHX8, 23197, 125647, 73-3735; 4629, DQX1, 23204, 125654, 1-399; 4629, DQX1, 23205, 125655, 199-555; 4629, DQX1, 23202, 125652, 72-2225; 4629, DQX1, 23203, 125653, 221-2374; 4630, DAP3, 23210, 125660, 8-550; 4630, DAP3, 23211, 125661, 1-632; 4630, DAP3, 23213, 125663, 1-348; 4630, DAP3, 23214, 125664, 1-138; 4630, DAP3, 23215, 125665, 81-439; 4630, DAP3, 23216, 125666, 8-807; 4630, DAP3, 23217, 125667, 89-430; 4630, DAP3, 23218, 125668, 389-1287; 4630, DAP3, 23219, 125669, 1-198; 4630, DAP3, 23220, 125670, 1-423; 4630, DAP3, 23221, 125671, 1-725; 4630, DAP3, 23222, 125672, 1-320; 4630, DAP3, 23206, 125656, 169-1365; 4630, DAP3, 23207, 125657, 125-1321; 4630, DAP3, 23208, 125658, 92-1186; 4630, DAP3, 23209, 125659, 92-1165; 4630, DAP3, 23212, 125662, 314-1387; 4631, DAPL1, 23224, 125674, 1-523; 4631, DAPL1, 23225, 125675, 57-398; 4631, DAPL1, 23226, 125676, 16-615; 4631, DAPL1, 23227, 125677, 57-461; 4631, DAPL1, 23223, 125673, 57-380; 4632, DTHD1, 23230, 125680, 99-2564; 4632, DTHD1, 23228, 125678, 392-2242; 4632, DTHD1, 23229, 125679, 59-2404; 4633, DEDD, 23231, 125681, 88-1134; 4633, DEDD, 23235, 125685, 103-964; 4633, DEDD, 23232, 125682, 216-1172; 4633, DEDD, 23233, 125683, 174-1130; 4633, DEDD, 23234, 125684, 203-1159; 4633, DEDD, 23236, 125686, 211-1167; 4634, DEDD2, 23238, 125688, 90-704; 4634, DEDD2, 23239, 125689, 113-465; 4634, DEDD2, 23237, 125687, 77-1042; 4634, DEDD2, 23240, 125690, 89-1069; 4634, DEDD2, 23241, 125691, 124-1104; 4635, DIDO1, 23242, 125692, 357-7079; 4635, DIDO1, 23243, 125693, 238-1926; 4635, DIDO1, 23244, 125694, 200-1834; 4635, DIDO1, 23245, 125695, 233-1921; 4635, DIDO1, 23246, 125696, 357-2045; 4635, DIDO1, 23247, 125697, 265-3834; 4635, DIDO1, 23248, 125698, 265-6987; 4636, DAP, 23250, 125700, 161-775; 4636, DAP, 23249, 125699, 205-513; 4637, DAPK1, 23254, 125704, 73-639; 4637, DAPK1, 23251, 125701, 184-4476; 4637, DAPK1, 23252, 125702, 336-4628; 4637, DAPK1, 23253, 125703, 201-4493; 4637, DAPK1, 23255, 125705, 536-4630; 4637, DAPK1, 23256, 125706, 74-4168; 4637, DAPK1, 23257, 125707, 211-4503; 4638, DAPK2, 23260, 125710, 483-724; 4638, DAPK2, 23261, 125711, 1-147; 4638, DAPK2, 23263, 125713, 91-357; 4638, DAPK2, 23264, 125714, 7-282; 4638, DAPK2, 23258, 125708, 7-1119; 4638, DAPK2, 23259, 125709, 32-1144; 4638, DAPK2, 23262, 125712, 7-1473; 4638, DAPK2, 23265, 125715, 32-1498; 4639, DAPK3, 23268, 125718, 204-626; 4639, DAPK3, 23269, 125719, 1-278; 4639, DAPK3, 23270, 125720, 197-671; 4639, DAPK3, 23271, 125721, 126-599; 4639, DAPK3, 23266, 125716, 94-1458; 4639, DAPK3, 23267, 125717, 245-1609; 4640, DAXX, 23278, 125728, 228-371; 4640, DAXX, 23279, 125729, 228-371; 4640, DAXX, 23282, 125732, 363-751; 4640, DAXX, 23283, 125733, 168-702; 4640, DAXX, 23286, 125736, 168-702; 4640, DAXX, 23287, 125737, 228-371; 4640, DAXX, 23288, 125738, 228-371; 4640, DAXX, 23289, 125739, 168-702; 4640, DAXX, 23290, 125740, 363-751; 4640, DAXX, 23291, 125741, 363-751; 4640, DAXX, 23293, 125743, 228-371; 4640, DAXX, 23294, 125744, 363-751; 4640, DAXX, 23295, 125745, 168-702; 4640, DAXX, 23296, 125746, 363-751; 4640, DAXX, 23297, 125747, 168-702; 4640, DAXX, 23272, 125722, 199-2421; 4640, DAXX, 23273, 125723, 206-2428; 4640, DAXX, 23274, 125724, 206-2428; 4640, DAXX, 23275, 125725, 206-2428; 4640, DAXX, 23276, 125726, 199-2421; 4640, DAXX, 23277, 125727, 199-2421; 4640, DAXX, 23280, 125730, 139-2361; 4640, DAXX, 23281, 125731, 174-2171; 4640, DAXX, 23284, 125734, 206-2428; 4640, DAXX, 23285, 125735, 116-2338; 4640, DAXX, 23292, 125742, 199-2421; 4640, DAXX, 23298, 125748, 208-2274; 4640, DAXX, 23299, 125749, 208-2274; 4640, DAXX, 23300, 125750, 174-2171; 4640, DAXX, 23301, 125751, 174-2171; 4640, DAXX, 23302, 125752, 208-2274; 4640, DAXX, 23303, 125753, 174-2171; 4640, DAXX, 23304, 125754, 208-2274; 4640, DAXX, 23305, 125755, 206-2272; 4641, DBR1, 23307, 125757, 65-421; 4641, DBR1, 23306, 125756, 155-1789; 4642, DCPS, 23308, 125758, 330-1343; 4643, DXO, 23327, 125777, 259-891; 4643, DXO, 23328, 125778, 1-524; 4643, DXO, 23309, 125759, 371-1561; 4643, DXO, 23310, 125760, 413-1603; 4643, DXO, 23311, 125761, 310-1500; 4643, DXO, 23312, 125762, 371-1561; 4643, DXO, 23313, 125763, 297-1487; 4643, DXO, 23314, 125764, 259-1449; 4643, DXO, 23315, 125765, 371-1561; 4643, DXO, 23316, 125766, 259-1449; 4643, DXO, 23317, 125767, 371-1561; 4643, DXO, 23318, 125768, 259-1449; 4643, DXO, 23319, 125769, 259-1449; 4643, DXO, 23320, 125770, 297-1487; 4643, DXO, 23321, 125771, 259-1449; 4643, DXO, 23322, 125772, 297-1487; 4643, DXO, 23323, 125773, 371-1561; 4643, DXO, 23324, 125774, 371-1561; 4643, DXO, 23325, 125775, 297-1487; 4643, DXO, 23326, 125776, 297-1487; 4644, DCP1A, 23331, 125781, 70-849; 4644, DCP1A, 23332, 125782, 8-581; 4644, DCP1A, 23333, 125783, 27-335; 4644, DCP1A, 23329, 125779, 9-1643; 4644, DCP1A, 23330, 125780, 94-1842; 4645, DCP1B, 23335, 125785, 60-1232; 4645, DCP1B, 23336, 125786, 40-399; 4645, DCP1B, 23337, 125787, 105-566; 4645, DCP1B, 23334, 125784, 81-1934; 4646, DCP2, 23339, 125789, 1-1207; 4646, DCP2, 23341, 125791, 125-349; 4646, DCP2, 23338, 125788, 199-1461; 4646, DCP2, 23340, 125790, 233-1390; 4647, DCN, 23348, 125798, 112-378; 4647, DCN, 23349, 125799, 186-716; 4647, DCN, 23352, 125802, 113-648; 4647, DCN, 23353, 125803, 168-464; 4647, DCN, 23354, 125804, 206-508; 4647, DCN, 23355, 125805, 1-157; 4647, DCN, 23356, 125806, 89-385; 4647, DCN, 23357, 125807, 72-593; 4647, DCN, 23358, 125808, 1-286; 4647, DCN, 23359, 125809, 563-920; 4647, DCN, 23360, 125810, 213-750; 4647, DCN, 23342, 125792, 503-1582; 4647, DCN, 23343, 125793, 255-1334; 4647, DCN, 23344, 125794, 1-228; 4647, DCN, 23345, 125795, 1-519; 4647, DCN, 23346, 125796, 1-639; 4647, DCN, 23347, 125797, 1-753; 4647, DCN, 23350, 125800, 529-1608; 4647, DCN, 23351, 125801, 185-823; 4648, DOCK1, 23362, 125812, 63-5723; 4648, DOCK1, 23361, 125811, 110-5707; 4649, DOCK10, 23365, 125815, 72-500; 4649, DOCK10, 23366, 125816, 1-1140; 4649, DOCK10, 23367, 125817, 11-139; 4649, DOCK10, 23368, 125818, 1-568; 4649, DOCK10, 23363, 125813, 69-6629; 4649, DOCK10, 23364, 125814, 115-6657; 4650, DOCK11, 23370, 125820, 75-6308; 4650, DOCK11, 23371, 125821, 1-5709; 4650, DOCK11, 23372, 125822, 1-121; 4650, DOCK11, 23369, 125819, 64-6285; 4651, DOCK2, 23374, 125824, 1-168; 4651, DOCK2, 23375, 125825, 1-486; 4651, DOCK2, 23376, 125826, 37-3132; 4651, DOCK2, 23377, 125827, 165-4133; 4651, DOCK2, 23378, 125828, 164-1171; 4651, DOCK2, 23373, 125823, 81-5573; 4652, DOCK3, 23379, 125829, 24-6116; 4653, DOCK4, 23380, 125830, 21-161; 4653, DOCK4, 23381, 125831, 1-5999; 4653, DOCK4, 23382, 125832, 269-662; 4653, DOCK4, 23384, 125834, 23-600; 4653, DOCK4, 23385, 125835, 74-637; 4653, DOCK4, 23387, 125837, 1-4169; 4653, DOCK4, 23388, 125838, 1-3285; 4653, DOCK4, 23383, 125833, 258-6158; 4653, DOCK4, 23386, 125836, 274-6201; 4654, DOCK5, 23390, 125840, 187-438; 4654, DOCK5, 23391, 125841, 1-3271; 4654, DOCK5, 23392, 125842, 1-415; 4654, DOCK5, 23389, 125839, 45-5657; 4654, DOCK5, 23393, 125843, 138-1190; 4655, DOCK6, 23395, 125845, 1-554; 4655, DOCK6, 23396, 125846, 1-1391; 4655, DOCK6, 23397, 125847, 1-444; 4655, DOCK6, 23398, 125848, 1-297; 4655, DOCK6, 23399, 125849, 1-4009; 4655, DOCK6, 23394, 125844, 13-6156; 4656, DOCK7, 23403, 125853, 12-6401; 4656, DOCK7, 23404, 125854, 1-2412; 4656, DOCK7, 23405, 125855, 1-139; 4656, DOCK7, 23406, 125856, 1-765; 4656, DOCK7, 23407, 125857, 1-6423; 4656, DOCK7, 23408, 125858, 1-519; 4656, DOCK7, 23409, 125859, 1-6303; 4656, DOCK7, 23410, 125860, 1-306; 4656, DOCK7, 23411, 125861, 1-745; 4656, DOCK7, 23412, 125862, 1-6297; 4656, DOCK7, 23400, 125850, 1-6396; 4656, DOCK7, 23401, 125851, 1-6330; 4656, DOCK7, 23402, 125852, 105-2003; 4657, DOCK8, 23413, 125863, 388-5088; 4657, DOCK8, 23414, 125864, 601-1920; 4657, DOCK8, 23417, 125867, 398-595; 4657, DOCK8, 23418, 125868, 91-1599; 4657, DOCK8, 23419, 125869, 215-537; 4657, DOCK8, 23420, 125870, 124-324; 4657, DOCK8, 23422, 125872, 113-265; 4657, DOCK8, 23415, 125865, 113-6412; 4657, DOCK8, 23416, 125866, 102-6197; 4657, DOCK8, 23421, 125871, 80-6079; 4658, DOCK9, 23423, 125873, 56-6364; 4658, DOCK9, 23424, 125874, 1242-2514; 4658, DOCK9, 23426, 125876, 1-2008; 4658, DOCK9, 23427, 125877, 1-1169; 4658, DOCK9, 23428, 125878, 1-348; 4658, DOCK9, 23429, 125879, 56-6295; 4658, DOCK9, 23430, 125880, 1-750; 4658, DOCK9, 23431, 125881, 176-6481; 4658, DOCK9, 23432, 125882, 1-609; 4658, DOCK9, 23433, 125883, 275-4039; 4658, DOCK9, 23434, 125884, 43-252; 4658, DOCK9, 23435, 125885, 153-2270; 4658, DOCK9, 23425, 125875, 82-6288; 4658, DOCK9, 23436, 125886, 176-3937; 4659, DET1, 23439, 125889, 132-335; 4659, DET1, 23440, 125890, 117-320; 4659, DET1, 23441, 125891, 106-390; 4659, DET1, 23437, 125887, 147-1799; 4659, DET1, 23438, 125888, 1-1686; 4659, DET1, 23442, 125892, 162-1847; 4660, DEF6, 23444, 125894, 1-385; 4660, DEF6, 23443, 125893, 6-1901; 4661, DAD1, 23446, 125896, 1-237; 4661, DAD1, 23447, 125897, 66-323; 4661, DAD1, 23448, 125898, 64-261; 4661, DAD1, 23445, 125895, 113-454; 4662, DEFA1, 23449, 125899, 1-285; 4662, DEFA1, 23450, 125900, 81-365; 4663, DEFA1B, 23451, 125901, 86-370; 4663, DEFA1B, 23452, 125902, 81-365; 4664, DEFA3, 23454, 125904, 51-335; 4664, DEFA3, 23453, 125903, 93-377; 4665, DEFA4, 23455, 125905, 126-419; 4666, DEFA5, 23456, 125906, 38-322; 4667, DEFA6, 23457, 125907, 42-344; 4668, DEFB1, 23458, 125908, 166-372; 4669, DEFB103A, 23459, 125909, 219-422; 4670, DEFB103B, 23460, 125910, 219-422; 4670, DEFB103B, 23461, 125911, 219-422; 4671, DEFB104A, 23462, 125912, 15-233; 4672, DEFB104B, 23463, 125913, 15-233; 4672, DEFB104B, 23464, 125914, 15-233; 4673, DEFB105A, 23465, 125915, 52-288; 4674, DEFB105B, 23466, 125916, 53-289; 4674, DEFB105B, 23467, 125917, 53-289; 4675, DEFB106A, 23468, 125918, 6-203; 4676, DEFB106B, 23469, 125919, 19-216; 4676, DEFB106B, 23470, 125920, 19-216; 4677, DEFB107A, 23471, 125921, 89-301; 4678, DEFB107B, 23472, 125922, 89-301; 4678, DEFB107B, 23473, 125923, 89-301; 4679, DEFB108B, 23474, 125924, 1-222; 4680, DEFB110, 23475, 125925, 47-250; 4680, DEFB110, 23476, 125926, 1-189; 4681, DEFB112, 23477, 125927, 1-342; 4682, DEFB113, 23478, 125928, 1-249; 4683, DEFB114, 23479, 125929, 1-210; 4684, DEFB115, 23480, 125930, 1-267; 4685, DEFB116, 23481, 125931, 1-309; 4686, DEFB118, 23482, 125932, 34-405; 4687, DEFB119, 23483, 125933, 108-239; 4687, DEFB119, 23484, 125934, 1-267; 4687, DEFB119, 23485, 125935, 121-375; 4688, DEFB121, 23486, 125936, 115-345; 4689, DEFB123, 23487, 125937, 181-384; 4690, DEFB124, 23488, 125938, 1-216; 4691, DEFB125, 23489, 125939, 1-471; 4692, DEFB126, 23490, 125940, 261-596; 4693, DEFB127, 23491, 125941, 76-375; 4694, DEFB128, 23492, 125942, 59-340; 4695, DEFB129, 23493, 125943, 32-583; 4696, DEFB130, 23494, 125944, 1-240; 4697, DEFB131, 23495, 125945, 1-213; 4698, DEFB132, 23496, 125946, 44-331; 4699, DEFB133, 23497, 125947, 1-186; 4700, DEFB134, 23498, 125948, 62-262; 4700, DEFB134, 23499, 125949, 62-262; 4701, DEFB135, 23500, 125950, 1-234; 4702, DEFB136, 23501, 125951, 1-237; 4703, DEFB4A, 23502, 125952, 85-279; 4704, DEFB4B, 23503, 125953, 37-231; 4704, DEFB4B, 23504, 125954, 37-231; 4705, DHDDS, 23507, 125957, 91-720; 4705, DHDDS, 23508, 125958, 1-487; 4705, DHDDS, 23509, 125959, 56-703; 4705, DHDDS, 23510, 125960, 117-713; 4705, DHDDS, 23511, 125961, 1-510; 4705, DHDDS, 23512, 125962, 151-372; 4705, DHDDS, 23513, 125963, 185-705; 4705, DHDDS, 23514, 125964, 280-492; 4705, DHDDS, 23515, 125965, 377-556; 4705, DHDDS, 23516, 125966, 327-581; 4705, DHDDS, 23517, 125967, 207-573; 4705, DHDDS, 23520, 125970, 86-582; 4705, DHDDS, 23521, 125971, 105-496; 4705, DHDDS, 23505, 125955, 94-1095; 4705, DHDDS, 23506, 125956, 78-1082; 4705, DHDDS, 23518, 125968, 93-977; 4705, DHDDS, 23519, 125969, 94-993; 4706, DHTKD1, 23523, 125973, 11-933; 4706, DHTKD1, 23524, 125974, 1-643; 4706, DHTKD1, 23525, 125975, 1-482; 4706, DHTKD1, 23522, 125972, 63-2822; 4707, DHRS1, 23528, 125978, 188-631; 4707, DHRS1, 23526, 125976, 278-1219; 4707, DHRS1, 23527, 125977, 270-1211; 4708, DHRS11, 23530, 125980, 124-276; 4708, DHRS11, 23532, 125982, 475-926; 4708, DHRS11, 23533, 125983, 1-330; 4708, DHRS11, 23535, 125985, 1-330; 4708, DHRS11, 23536, 125986, 124-276; 4708, DHRS11, 23537, 125987, 475-926; 4708, DHRS11, 23529, 125979, 195-740; 4708, DHRS11, 23531, 125981, 213-995; 4708, DHRS11, 23534, 125984, 213-995; 4708, DHRS11, 23538, 125988, 195-740; 4709, DHRS12, 23542, 125992, 1-303; 4709, DHRS12, 23539, 125989, 113-841; 4709, DHRS12, 23540, 125990, 54-869; 4709, DHRS12, 23541, 125991, 15-968; 4710, DHRS13, 23543, 125993, 128-1261; 4710, DHRS13, 23544, 125994, 394-1377; 4710, DHRS13, 23545, 125995, 22-912; 4711, DHRS2, 23548, 125998, 160-834; 4711, DHRS2, 23549, 125999, 1-486; 4711, DHRS2, 23550, 126000, 1-541; 4711, DHRS2, 23546, 125996, 477-1319; 4711, DHRS2, 23547, 125997, 439-1341; 4711, DHRS2, 23551, 126001, 50-952; 4712, DHRS3, 23552, 126002, 384-826; 4712, DHRS3, 23553, 126003, 297-539; 4712, DHRS3, 23554, 126004, 384-1292; 4713, DHRS4, 23558, 126008, 20-487; 4713, DHRS4, 23562, 126012, 1-186; 4713, DHRS4, 23555, 126005, 204-1040; 4713, DHRS4, 23556, 126006, 4-480; 4713, DHRS4, 23557, 126007, 11-589; 4713, DHRS4, 23559, 126009, 1-735; 4713, DHRS4, 23560, 126010, 56-622; 4713, DHRS4, 23561, 126011, 1-600; 4714, DHRS4L2, 23564, 126014, 3-833; 4714, DHRS4L2, 23565, 126015, 131-709; 4714, DHRS4L2, 23566, 126016, 61-534; 4714, DHRS4L2, 23567, 126017, 635-907; 4714, DHRS4L2, 23568, 126018, 402-818; 4714, DHRS4L2, 23569, 126019, 1-328; 4714, DHRS4L2, 23570, 126020, 429-574; 4714, DHRS4L2, 23571, 126021, 61-534; 4714, DHRS4L2, 23572, 126022, 127-854; 4714, DHRS4L2, 23573, 126023, 1-648; 4714, DHRS4L2, 23563, 126013, 127-825; 4715, DHRS7, 23576, 126026, 1-1199; 4715, DHRS7, 23577, 126027, 1-480; 4715, DHRS7, 23579, 126029, 1-638; 4715, DHRS7, 23580, 126030, 400-582; 4715, DHRS7, 23581, 126031, 121-1251; 4715, DHRS7, 23574, 126024, 457-1476; 4715, DHRS7, 23575, 126025, 165-1034; 4715, DHRS7, 23578, 126028, 121-1140; 4716, DHRS7B, 23583, 126033, 1-376; 4716, DHRS7B, 23584, 126034, 389-767; 4716, DHRS7B, 23585, 126035, 1-324; 4716, DHRS7B, 23586, 126036, 18-290; 4716, DHRS7B, 23587, 126037, 255-1187; 4716, DHRS7B, 23582, 126032, 321-1298; 4717, DHRS7C, 23590, 126040, 1-399; 4717, DHRS7C, 23588, 126038, 14-952; 4717, DHRS7C, 23589, 126039, 14-949; 4718, DHRS9, 23595, 126045, 327-524; 4718, DHRS9, 23591, 126041, 558-1517; 4718, DHRS9, 23592, 126042, 526-1044; 4718, DHRS9, 23593, 126043, 324-1283; 4718, DHRS9, 23594, 126044, 113-1252; 4718, DHRS9, 23596, 126046, 458-1417; 4718, DHRS9, 23597, 126047, 106-1065; 4718, DHRS9, 23598, 126048, 1504-2463; 4719, DHRSX, 23600, 126050, 49-744; 4719, DHRSX, 23601, 126051, 433-797; 4719, DHRSX, 23602, 126052, 39-230; 4719, DHRSX, 23603, 126053, 1-464; 4719, DHRSX, 23599, 126049, 54-1046; 4720, DIO1, 23607, 126057, 23-271; 4720, DIO1, 23608, 126058, 1-177; 4720, DIO1, 23609, 126059, 137-688; 4720, DIO1, 23610, 126060, 23-376; 4720, DIO1, 23611, 126061, 264-626; 4720, DIO1, 23613, 126063, 23-199; 4720, DIO1, 23615, 126065, 23-271; 4720, DIO1, 23616, 126066, 24-770; 4720, DIO1, 23617, 126067, 24-506; 4720, DIO1, 23618, 126068, 23-277; 4720, DIO1, 23604, 126054, 24-509; 4720, DIO1, 23605, 126055, 25-774; 4720, DIO1, 23606, 126056, 1-606; 4720, DIO1, 23612, 126062, 1-342; 4720, DIO1, 23614, 126064, 1-558; 4721, DIO2, 23620, 126070, 50-487; 4721, DIO2, 23621, 126071, 1-171; 4721, DIO2, 23622, 126072, 1-112; 4721, DIO2, 23623, 126073, 29-958; 4721, DIO2, 23624, 126074, 406-569; 4721, DIO2, 23625, 126075, 474-491; 4721, DIO2, 23626, 126076, 399-417; 4721, DIO2, 23628, 126078, 1-175; 4721, DIO2, 23619, 126069, 156-977; 4721, DIO2, 23627, 126077, 387-1208; 4722, DIO3, 23629, 126079, 147-1061; 4723, DEK, 23632, 126082, 161-1204; 4723, DEK, 23633, 126083, 1-485; 4723, DEK, 23634, 126084, 1-471; 4723, DEK, 23635, 126085, 207-661; 4723, DEK, 23636, 126086, 214-580; 4723, DEK, 23630, 126080, 167-1192; 4723, DEK, 23631, 126081, 449-1576; 4724, DAZ1, 23639, 126089, 209-1309; 4724, DAZ1, 23640, 126090, 211-1383; 4724, DAZ1, 23641, 126091, 188-1648; 4724, DAZ1, 23637, 126087, 124-1965; 4724, DAZ1, 23638, 126088, 295-2529; 4725, DAZ2, 23642, 126092, 285-1385; 4725, DAZ2, 23645, 126095, 285-1745; 4725, DAZ2, 23647, 126097, 267-2231; 4725, DAZ2, 23649, 126099, 308-1624; 4725, DAZ2, 23650, 126100, 308-1480; 4725, DAZ2, 23643, 126093, 285-1889; 4725, DAZ2, 23644, 126094, 285-1961; 4725, DAZ2, 23646, 126096, 194-1870; 4725, DAZ2, 23648, 126098, 295-1899; 4726, DAZ3, 23651, 126101, 285-1385; 4726, DAZ3, 23653, 126103, 308-1480; 4726, DAZ3, 23652, 126102, 295-1611; 4727, DAZ4, 23654, 126104, 1-1956; 4727, DAZ4, 23655, 126105, 211-2022; 4727, DAZ4, 23656, 126106, 194-1870; 4727, DAZ4, 23658, 126108, 285-1385; 4727, DAZ4, 23659, 126109, 188-1648; 4727, DAZ4, 23660, 126110, 1-1740; 4727, DAZ4, 23657, 126107, 211-1383; 4728, DAZL, 23663, 126113, 114-725; 4728, DAZL, 23661, 126111, 289-1236; 4728, DAZL, 23662, 126112, 295-1182; 4729, DEC1, 23665, 126115, 1-210; 4729, DEC1, 23664, 126114, 520-732; 4730, DLEC1, 23668, 126118, 1-249; 4730, DLEC1, 23666, 126116, 22-5289; 4730, DLEC1, 23667, 126117, 22-5358; 4731, DLEU1, 23670, 126120, 267-401; 4731, DLEU1, 23669, 126119, 267-503; 4732, DLEU7, 23671, 126121, 294-776; 4732, DLEU7, 23672, 126122, 51-716; 4733, DMBT1, 23673, 126123, 107-5464; 4733, DMBT1, 23674, 126124, 107-7348; 4733, DMBT1, 23675, 126125, 107-7318; 4733, DMBT1, 23676, 126126, 107-3508; 4733, DMBT1, 23677, 126127, 107-7348; 4733, DMBT1, 23678, 126128, 107-7318; 4733, DMBT1, 23679, 126129, 107-5464; 4733, DMBT1, 23680, 126130, 107-7348; 4734, DPCD, 23681, 126131, 13-525; 4734, DPCD, 23683, 126133, 1-351; 4734, DPCD, 23684, 126134, 29-541; 4734, DPCD, 23682, 126132, 50-661; 4735, DEGS1, 23687, 126137, 174-957; 4735, DEGS1, 23685, 126135, 167-1138; 4735, DEGS1, 23686, 126136, 72-1043; 4736, DEGS2, 23689, 126139, 9-173; 4736, DEGS2, 23688, 126138, 577-1548; 4737, DNER, 23690, 126140, 136-2349; 4738, DLL1, 23693, 126143, 387-548; 4738, DLL1, 23694, 126144, 387-548; 4738, DLL1, 23691, 126141, 335-2506; 4738, DLL1, 23692, 126142, 335-2506; 4739, DLK1, 23697, 126147, 265-555; 4739, DLK1, 23698, 126148, 40-450; 4739, DLK1, 23695, 126145, 161-1093; 4739, DLK1, 23696, 126146, 243-1394; 4740, DLK2, 23700, 126150, 252-1385; 4740, DLK2, 23702, 126152, 1-869; 4740, DLK2, 23699, 126149, 702-1853; 4740, DLK2, 23701, 126151, 252-1403; 4741, DLL3, 23705, 126155, 9-668; 4741, DLL3, 23703, 126153, 8-1864; 4741, DLL3, 23704, 126154, 81-1844; 4742, DLL4, 23706, 126156, 277-2334; 4743, DTX1, 23707, 126157, 504-2366; 4744, DTX2, 23709, 126159, 272-540; 4744, DTX2, 23710, 126160, 466-550; 4744, DTX2, 23712, 126162, 448-633; 4744, DTX2, 23713, 126163, 529-570; 4744, DTX2, 23715, 126165, 299-1894; 4744, DTX2, 23716, 126166, 166-434; 4744, DTX2, 23717, 126167, 216-539; 4744, DTX2, 23718, 126168, 372-566; 4744, DTX2, 23719, 126169, 495-569; 4744, DTX2, 23720, 126170, 1-262; 4744, DTX2, 23722, 126172, 440-859; 4744, DTX2, 23723, 126173, 1-639; 4744, DTX2, 23724, 126174, 1-639; 4744, DTX2, 23725, 126175, 1-639; 4744, DTX2, 23726, 126176, 1-81; 4744, DTX2, 23727, 126177, 1-639; 4744, DTX2, 23728, 126178, 1-639; 4744, DTX2, 23708, 126158, 511-2379; 4744, DTX2, 23711, 126161, 211-2079; 4744, DTX2, 23714, 126164, 1-1728; 4744, DTX2, 23721, 126171, 365-2233; 4745, DTX3L, 23729, 126179, 190-2412; 4745, DTX3L, 23730, 126180, 1-687; 4746, DTX3, 23732, 126182, 1-519; 4746, DTX3, 23734, 126184, 1689-2270; 4746, DTX3, 23736, 126186, 548-569; 4746, DTX3, 23738, 126188, 719-1331; 4746, DTX3, 23739, 126189, 416-561; 4746, DTX3, 23731, 126181, 338-1381; 4746, DTX3, 23733, 126183, 1505-2548; 4746, DTX3, 23735, 126185, 136-1188; 4746, DTX3, 23737, 126187, 376-1419; 4747, DTX4, 23740, 126190, 105-1964; 4747, DTX4, 23741, 126191, 167-1708; 4748, DMTN, 23749, 126199, 402-616; 4748, DMTN, 23750, 126200, 210-813; 4748, DMTN, 23751, 126201, 138-581; 4748, DMTN, 23752, 126202, 115-601; 4748, DMTN, 23755, 126205, 374-977; 4748, DMTN, 23756, 126206, 404-1057; 4748, DMTN, 23757, 126207, 256-587; 4748, DMTN, 23760, 126210, 379-593; 4748, DMTN, 23761, 126211, 361-582; 4748, DMTN, 23742, 126192, 273-1490; 4748, DMTN, 23743, 126193, 494-1711; 4748, DMTN, 23744, 126194, 389-1540; 4748, DMTN, 23745, 126195, 278-1354; 4748, DMTN, 23746, 126196, 188-1339; 4748, DMTN, 23747, 126197, 230-1447; 4748, DMTN, 23748, 126198, 463-1680; 4748, DMTN, 23753, 126203, 104-1180; 4748, DMTN, 23754, 126204, 446-1597; 4748, DMTN, 23758, 126208, 273-1490; 4748, DMTN, 23759, 126209, 249-1346; 4749, DDN, 23762, 126212, 23-2158; 4750, DCANP1, 23763, 126213, 241-975; 4751, DCSTAMP, 23764, 126214, 50-1462; 4751, DCSTAMP, 23765, 126215, 13-864; 4751, DCSTAMP, 23766, 126216, 80-931; 4752, DENND1A, 23770, 126220, 1-1380; 4752, DENND1A, 23771, 126221, 1-2730; 4752, DENND1A, 23767, 126217, 294-1694; 4752, DENND1A, 23768, 126218, 222-1901; 4752, DENND1A, 23769, 126219, 203-3232; 4753, DENND1B, 23773, 126223, 153-1211; 4753, DENND1B, 23775, 126225, 1-1248; 4753, DENND1B, 23776, 126226, 142-583; 4753, DENND1B, 23772, 126222, 279-1469; 4753, DENND1B, 23774, 126224, 171-1451; 4753, DENND1B, 23777, 126227, 339-2666; 4754, DENND1C, 23780, 126230, 354-1001; 4754, DENND1C, 23781, 126231, 104-376; 4754, DENND1C, 23782, 126232, 220-484; 4754, DENND1C, 23783, 126233, 191-571; 4754, DENND1C, 23784, 126234, 160-582; 4754, DENND1C, 23778, 126228, 114-2519; 4754, DENND1C, 23779, 126229, 116-2389; 4755, DENND2A, 23786, 126236, 116-2710; 4755, DENND2A, 23787, 126237, 266-537; 4755, DENND2A, 23788, 126238, 307-542; 4755, DENND2A, 23789, 126239, 328-800; 4755, DENND2A, 23792, 126242, 1-490; 4755, DENND2A, 23793, 126243, 420-735; 4755, DENND2A, 23785, 126235, 419-3448; 4755, DENND2A, 23790, 126240, 248-2635; 4755, DENND2A, 23791, 126241, 290-3319; 4755, DENND2A, 23794, 126244, 146-3175; 4756, DENND2C, 23795, 126245, 627-3413; 4756, DENND2C, 23796, 126246, 334-2949; 4756, DENND2C, 23797, 126247, 210-2996; 4757, DENND2D, 23798, 126248, 231-1646; 4757, DENND2D, 23799, 126249, 57-1463; 4758, DENND3, 23802, 126252, 1-309; 4758, DENND3, 23803, 126253, 1-3610; 4758, DENND3, 23804, 126254, 88-291; 4758, DENND3, 23805, 126255, 71-3907; 4758, DENND3, 23806, 126256, 1-369; 4758, DENND3, 23807, 126257, 1-512; 4758, DENND3, 23808, 126258, 60-899; 4758, DENND3, 23809, 126259, 187-560; 4758, DENND3, 23810, 126260, 97-723; 4758, DENND3, 23811, 126261, 34-906; 4758, DENND3, 23812, 126262, 644-1390; 4758, DENND3, 23800, 126250, 279-3875; 4758, DENND3, 23801, 126251, 22-3462; 4759, DENND4A, 23815, 126265, 1-79; 4759, DENND4A, 23816, 126266, 386-3389; 4759, DENND4A, 23817, 126267, 101-5851; 4759, DENND4A, 23813, 126263, 217-5937; 4759, DENND4A, 23814, 126264, 210-5801; 4760, DENND4B, 23819, 126269, 126-3781; 4760, DENND4B, 23820, 126270, 1-541; 4760, DENND4B, 23818, 126268, 420-4910; 4761, DENND4C, 23821, 126271, 1-2091; 4761, DENND4C, 23822, 126272, 1-1061; 4761, DENND4C, 23823, 126273, 1-2645; 4761, DENND4C, 23824, 126274, 1-1136; 4761, DENND4C, 23825, 126275, 417-6293; 4761, DENND4C, 23826, 126276, 417-6146; 4762, DENND5A, 23828, 126278, 1-566; 4762, DENND5A, 23829, 126279, 1-782; 4762, DENND5A, 23830, 126280, 33-242; 4762, DENND5A, 23831, 126281, 1-560; 4762, DENND5A, 23832, 126282, 1-315; 4762, DENND5A, 23833, 126283, 1-190; 4762, DENND5A, 23834, 126284, 1-587; 4762, DENND5A, 23836, 126286, 59-2482; 4762, DENND5A, 23827, 126277, 322-4185; 4762, DENND5A, 23835, 126285, 19-3744; 4763, DENND5B, 23839, 126289, 1-1614; 4763, DENND5B, 23840, 126290, 152-4081; 4763, DENND5B, 23841, 126291, 168-359; 4763, DENND5B, 23842, 126292, 1-3930; 4763, DENND5B, 23837, 126287, 181-2397; 4763, DENND5B, 23838, 126288, 266-4090; 4764, DENND6A, 23844, 126294, 1-503; 4764, DENND6A, 23845, 126295, 1-376; 4764, DENND6A, 23843, 126293, 72-1898; 4765, DENND6B, 23847, 126297, 27-920; 4765, DENND6B, 23846, 126296, 73-1830; 4766, DENR, 23849, 126299, 137-619; 4766, DENR, 23848, 126298, 187-783; 4767, DTL, 23851, 126301, 339-2405; 4767, DTL, 23850, 126300, 315-2507; 4768, DMP1, 23852, 126302, 100-1593; 4768, DMP1, 23853, 126303, 100-1641; 4769, DSPP, 23854, 126304, 34-3939; 4769, DSPP, 23855, 126305, 121-4026; 4770, DCK, 23857, 126307, 199-1152; 4770, DCK, 23858, 126308, 384-428; 4770, DCK, 23859, 126309, 199-798; 4770, DCK, 23860, 126310, 274-420; 4770, DCK, 23856, 126306, 398-1180; 4771, DGUOK, 23861, 126311, 86-919; 4771, DGUOK, 23862, 126312, 86-655; 4771, DGUOK, 23863, 126313, 37-306; 4771, DGUOK, 23864, 126314, 86-355; 4772, DOHH, 23867, 126317, 426-1095; 4772, DOHH, 23868, 126318, 1-586; 4772, DOHH, 23865, 126315, 178-1086; 4772, DOHH, 23866, 126316, 453-1361; 4773, DHPS, 23871, 126321, 73-471; 4773, DHPS, 23872, 126322, 103-522; 4773, DHPS, 23873, 126323, 1-83; 4773, DHPS, 23874, 126324, 99-371; 4773, DHPS, 23875, 126325, 1-169; 4773, DHPS, 23876, 126326, 1-205; 4773, DHPS, 23877, 126327, 1-478; 4773, DHPS, 23879, 126329, 191-605; 4773, DHPS, 23880, 126330, 1-348; 4773, DHPS, 23881, 126331, 95-928; 4773, DHPS, 23882, 126332, 42-440; 4773, DHPS, 23883, 126333, 50-595; 4773, DHPS, 23884, 126334, 6-1118; 4773, DHPS, 23869, 126319, 137-1246; 4773, DHPS, 23870, 126320, 6-974; 4773, DHPS, 23878, 126328, 94-1077; 4774, DNTTIP1, 23886, 126336, 157-591; 4774, DNTTIP1, 23887, 126337, 1-453; 4774, DNTTIP1, 23888, 126338, 1-698; 4774, DNTTIP1, 23889, 126339, 1-841; 4774, DNTTIP1, 23885, 126335, 69-1058; 4775, DNTTIP2, 23890, 126340, 15-1820; 4775, DNTTIP2, 23892, 126342, 17-499; 4775, DNTTIP2, 23891, 126341, 59-2329; 4776, DNASE1, 23895, 126345, 1638-1898; 4776, DNASE1, 23896, 126346, 1-272; 4776, DNASE1, 23897, 126347, 1-327; 4776, DNASE1, 23898, 126348, 380-562; 4776, DNASE1, 23899, 126349, 1-219; 4776, DNASE1, 23900, 126350, 1-197; 4776, DNASE1, 23901, 126351, 1-227; 4776, DNASE1, 23902, 126352, 187-369; 4776, DNASE1, 23903, 126353, 243-425; 4776, DNASE1, 23893, 126343, 3210-4058; 4776, DNASE1, 23894, 126344, 185-1033; 4777, DNASE2B, 23904, 126354, 529-990; 4777, DNASE2B, 23905, 126355, 34-1119; 4778, DNASE2, 23907, 126357, 92-745; 4778, DNASE2, 23906, 126356, 94-1176; 4779, DNASE1L1, 23914, 126364, 632-942; 4779, DNASE1L1, 23915, 126365, 281-904; 4779, DNASE1L1, 23916, 126366, 43-297; 4779, DNASE1L1, 23917, 126367, 768-847; 4779, DNASE1L1, 23918, 126368, 51-238; 4779, DNASE1L1, 23908, 126358, 795-1703; 4779, DNASE1L1, 23909, 126359, 395-1303; 4779, DNASE1L1, 23910, 126360, 253-1161; 4779, DNASE1L1, 23911, 126361, 809-1717; 4779, DNASE1L1, 23912, 126362, 631-1539; 4779, DNASE1L1, 23913, 126363, 288-1196; 4780, DNASE1L2, 23923, 126373, 1-762; 4780, DNASE1L2, 23919, 126369, 134-1033; 4780, DNASE1L2, 23920, 126370, 93-929; 4780, DNASE1L2, 23921, 126371, 1002-1901; 4780, DNASE1L2, 23922, 126372, 109-1008; 4780, DNASE1L2, 23924, 126374, 134-970; 4781, DNASE1L3, 23926, 126376, 583-1449; 4781, DNASE1L3, 23927, 126377, 1-414; 4781, DNASE1L3, 23928, 126378, 163-635; 4781, DNASE1L3, 23929, 126379, 486-786; 4781, DNASE1L3, 23925, 126375, 318-1235; 4781, DNASE1L3, 23930, 126380, 64-891; 4782, DERA, 23932, 126382, 393-1085; 4782, DERA, 23933, 126383, 520-814; 4782, DERA, 23934, 126384, 26-735; 4782, DERA, 23935, 126385, 22-222; 4782, DERA, 23936, 331-819; 4782, DERA, 23937, 126387, 83-265; 4782, DERA, 23938, 126388, 22-849; 4782, DERA, 23931, 126381, 213-1169; 4783, DTYMK, 23940, 126390, 162-413; 4783, DTYMK, 23941, 126391, 1-575; 4783, DTYMK, 23942, 126392, 1-511; 4783, DTYMK, 23943, 126393, 1-304; 4783, DTYMK, 23939, 126389, 209-847; 4784, DUT, 23946, 126396, 61-724; 4784, DUT, 23947, 126397, 44-724; 4784, DUT, 23948, 126398, 157-558; 4784, DUT, 23949, 126399, 307-627; 4784, DUT, 23950, 126400, 129-554; 4784, DUT, 23951, 126401, 43-474; 4784, DUT, 23952, 126402, 73-576; 4784, DUT, 23944, 126394, 94-852; 4784, DUT, 23945, 126395, 150-644; 4785, DEPDC1, 23955, 126405, 481-582; 4785, DEPDC1, 23956, 126406, 1-925; 4785, DEPDC1, 23953, 126403, 223-1806; 4785, DEPDC1, 23954, 126404, 116-2551; 4786, DEPDC1B, 23959, 126409, 98-208; 4786, DEPDC1B, 23960, 126410, 42-110; 4786, DEPDC1B, 23957, 126407, 69-1658; 4786, DEPDC1B, 23958, 126408, 42-1445; 4787, DEPDC4, 23965, 126415, 4-1003; 4787, DEPDC4, 23966, 126416, 4-1165; 4787, DEPDC4, 23967, 126417, 1-317; 4787, DEPDC4, 23968, 126418, 1-861; 4787, DEPDC4, 23961, 126411, 4-177; 4787, DEPDC4, 23962, 126412, 4-888; 4787, DEPDC4, 23963, 126413, 4-888; 4787, DEPDC4, 23964, 126414, 4-177; 4788, DEPDC5, 23975, 126425, 1-1980; 4788, DEPDC5, 23976, 126426, 79-159; 4788, DEPDC5, 23977, 126427, 1-2938; 4788, DEPDC5, 23978, 126428, 1-181; 4788, DEPDC5, 23979, 126429, 100-236; 4788, DEPDC5, 23969, 126419, 61-4719; 4788, DEPDC5, 23970, 126420, 71-4855; 4788, DEPDC5, 23971, 126421, 157-1836; 4788, DEPDC5, 23972, 126422, 203-5014; 4788, DEPDC5, 23973, 126423, 60-4778; 4788, DEPDC5, 23974, 126424, 203-4921; 4788, DEPDC5, 23980, 126430, 107-4618; 4789, DEPDC7, 23983, 126433, 264-1865; 4789, DEPDC7, 23981, 126431, 93-1628; 4789, DEPDC7, 23982, 126432, 377-1885; 4790, DEPTOR, 23984, 126434, 131-1360; 4790, DEPTOR, 23985, 126435, 131-1057; 4791, DCAKD, 23990, 126440, 374-1000; 4791, DCAKD, 23986, 126436, 340-1035; 4791, DCAKD, 23987, 126437, 246-941; 4791, DCAKD, 23988, 126438, 257-952; 4791, DCAKD, 23989, 126439, 173-868; 4791, DCAKD, 23991, 126441, 272-967; 4792, DERL1, 23994, 126444, 181-636; 4792, DERL1, 23995, 126445, 86-541; 4792, DERL1, 23996, 126446, 115-570; 4792, DERL1, 23992, 126442, 302-1057; 4792, DERL1, 23993, 126443, 1-696; 4793, DERL2, 23998, 126448, 18-617; 4793, DERL2, 23999, 126449, 5-316; 4793, DERL2, 24000, 126450, 18-452; 4793, DERL2, 24001, 126451, 1-477; 4793, DERL2, 24002, 126452, 116-427; 4793, DERL2, 24003, 126453, 2-226; 4793, DERL2, 24004, 126454, 1-239; 4793, DERL2, 24005, 126455, 1-247; 4793, DERL2, 23997, 126447, 57-776; 4794, DERL3, 24007, 126457, 20-556; 4794, DERL3, 24010, 126460, 20-556; 4794, DERL3, 24006, 126456, 18-725; 4794, DERL3, 24008, 126458, 20-739; 4794, DERL3, 24009, 126459, 26-643; 4794, DERL3, 24011, 126461, 20-739; 4794, DERL3, 24012, 126462, 26-643; 4794, DERL3, 24013, 126463, 18-725; 4795, DSE, 24016, 126466, 699-1130; 4795, DSE, 24014, 126464, 445-3321; 4795, DSE, 24015, 126465, 229-3105; 4795, DSE, 24017, 126467, 195-3071; 4796, DSEL, 24018, 126468, 1475-5143; 4796, DSEL, 24019, 126469, 1475-5143; 4797, DPT, 24020, 126470, 91-696; 4798, DCD, 24021, 126471, 191-523; 4798, DCD, 24022, 126472, 191-556; 4798, DCD, 24023, 126473, 191-424; 4799, DMKN, 24025, 126475, 44-343; 4799, DMKN, 24026, 126476, 5-616; 4799, DMKN, 24028, 126478, 1-604; 4799, DMKN, 24033, 126483, 16-364; 4799, DMKN, 24034, 126484, 9-404; 4799, DMKN, 24036, 126486, 13-774; 4799, DMKN, 24038, 126488, 13-531; 4799, DMKN, 24040, 126490, 82-192; 4799, DMKN, 24041, 126491, 9-119; 4799, DMKN, 24042, 126492, 44-154; 4799, DMKN, 24043, 126493, 44-154; 4799, DMKN, 24044, 126494, 44-154; 4799, DMKN, 24045, 126495, 16-126; 4799, DMKN, 24046, 126496, 44-154; 4799, DMKN, 24047, 126497, 9-119; 4799, DMKN, 24048, 126498, 84-194; 4799, DMKN, 24049, 126499, 13-123; 4799, DMKN, 24050, 126500, 20-625; 4799, DMKN, 24051, 126501, 9-119; 4799, DMKN, 24052, 126502, 9-119; 4799, DMKN, 24053, 126503, 1-324; 4799, DMKN, 24054, 126504, 9-119; 4799, DMKN, 24055, 126505, 1-224; 4799, DMKN, 24056, 126506, 9-119; 4799, DMKN, 24057, 126507, 84-194; 4799, DMKN, 24058, 126508, 26-136; 4799, DMKN, 24059, 126509, 33-587; 4799, DMKN, 24060, 126510, 49-297; 4799, DMKN, 24061, 126511, 274-557; 4799, DMKN, 24063, 126513, 2-613; 4799, DMKN, 24064, 126514, 1-290; 4799, DMKN, 24065, 126515, 349-450; 4799, DMKN, 24066, 126516, 359-460; 4799, DMKN, 24068, 126518, 1-459; 4799, DMKN, 24069, 126519, 1-111; 4799, DMKN, 24070, 126520, 10-120; 4799, DMKN, 24024, 126474, 178-1608; 4799, DMKN, 24027, 126477, 9-281; 4799, DMKN, 24029, 126479, 7-1203; 4799, DMKN, 24030, 126480, 8-1405; 4799, DMKN, 24031, 126481, 44-613; 4799, DMKN, 24032, 126482, 184-1494; 4799, DMKN, 24035, 126485, 7-1356; 4799, DMKN, 24037, 126487, 1-1110; 4799, DMKN, 24039, 126489, 7-1167; 4799, DMKN, 24062, 126512, 138-509; 4799, DMKN, 24067, 126517, 249-620; 4800, DHH, 24071, 126521, 308-1498; 4801, DES, 24072, 126522, 87-1499; 4802, DSC1, 24073, 126523, 263-2785; 4802, DSC1, 24074, 126524, 263-2947; 4803, DSC2, 24075, 126525, 34-2577; 4803, DSC2, 24076, 126526, 445-3150; 4804, DSC3, 24079, 126529, 1-644; 4804, DSC3, 24077, 126527, 82-2772; 4804, DSC3, 24078, 126528, 156-2675; 4805, DSG1, 24080, 126530, 213-3362; 4805, DSG1, 24081, 126531, 310-1536; 4806, DSG2, 24083, 126533, 33-731; 4806, DSG2, 24082, 126532, 210-3566; 4807, DSG3, 24084, 126534, 84-3083; 4808, DSG4, 24085, 126535, 136-3258; 4808, DSG4, 24086, 126536, 30-3209; 4809, DSP, 24087, 126537, 342-8957; 4809, DSP, 24088, 126538, 300-7118; 4810, DSTN, 24090, 126540, 120-527; 4810, DSTN, 24089, 126539, 347-844; 4810, DSTN, 24091, 126541, 311-757; 4811, DESI1, 24092, 126542, 258-764; 4812, DESI2, 24095, 126545, 183-486; 4812, DESI2, 24093, 126543, 212-697; 4812, DESI2, 24094, 126544, 380-964; 4813, DDA1, 24096, 126546, 125-433; 4813, DDA1, 24097, 126547, 87-395; 4813, DDA1, 24098, 126548, 138-446; 4814, DBX1, 24099, 126549, 290-1321; 4815, DBX2, 24100, 126550, 173-1192; 4816, DPPA2, 24101, 126551, 248-1144; 4817, DPPA3, 24102, 126552, 118-597; 4818, DPPA4, 24104, 126554, 214-320; 4818, DPPA4, 24105, 126555, 1-207; 4818, DPPA4, 24103, 126553, 56-970; 4819, DPPA5, 24106, 126556, 71-421; 4820, DRG1, 24108, 126558, 75-266; 4820, DRG1, 24109, 126559, 1-169; 4820, DRG1, 24107, 126557, 162-1265; 4821, DRG2, 24111, 126561, 100-1131; 4821, DRG2, 24112, 126562, 49-389; 4821, DRG2, 24113, 126563, 104-376; 4821, DRG2, 24114, 126564, 18-503; 4821, DRG2, 24115, 126565, 59-793; 4821, DRG2, 24116, 126566, 51-389; 4821, DRG2, 24117, 126567, 57-329; 4821, DRG2, 24118, 126568, 60-128; 4821, DRG2, 24119, 126569, 84-356; 4821, DRG2, 24120, 126570, 76-550; 4821, DRG2, 24121, 126571, 53-571; 4821, DRG2, 24110, 126560, 139-1233; 4822, DHX58, 24123, 126573, 263-730; 4822, DHX58, 24124, 126574, 376-1283; 4822, DHX58, 24125, 126575, 243-540; 4822, DHX58, 24126, 126576, 1-154; 4822, DHX58, 24122, 126572, 224-2260; 4823, DEXI, 24127, 126577, 456-743; 4823, DEXI, 24128, 126578, 127-414; 4824, DGCR8, 24132, 126582, 395-770; 4824, DGCR8, 24129, 126579, 430-2751; 4824, DGCR8, 24130, 126580, 430-2652; 4824, DGCR8, 24131, 126581, 143-2365; 4825, DIABLO, 24135, 126585, 39-179; 4825, DIABLO, 24136, 126586, 1-573; 4825, DIABLO, 24137, 126587, 1-362; 4825, DIABLO, 24139, 126589, 641-1141; 4825, DIABLO, 24140, 126590, 330-560; 4825, DIABLO, 24141, 126591, 357-732; 4825, DIABLO, 24142, 126592, 156-555; 4825, DIABLO, 24143, 126593, 318-703; 4825, DIABLO, 24145, 126595, 335-804; 4825, DIABLO, 24133, 126583, 169-729; 4825, DIABLO, 24134, 126584, 39-626; 4825, DIABLO, 24138, 126588, 819-1538; 4825, DIABLO, 24144, 126594, 1395-1955; 4826, DGKA, 24149, 126599, 243-591; 4826, DGKA, 24150, 126600, 383-556; 4826, DGKA, 24152, 126602, 126-567; 4826, DGKA, 24153, 126603, 207-605; 4826, DGKA, 24155, 126605, 479-542; 4826, DGKA, 24156, 126606, 57-407; 4826, DGKA, 24158, 126608, 417-548; 4826, DGKA, 24159, 126609, 265-548; 4826, DGKA, 24160, 126610, 243-564; 4826, DGKA, 24161, 126611, 98-497; 4826, DGKA, 24162, 126612, 1-294; 4826, DGKA, 24163, 126613, 1-607; 4826, DGKA, 24164, 126614, 265-1900; 4826, DGKA, 24165, 126615, 374-505; 4826, DGKA, 24166, 126616, 438-569; 4826, DGKA, 24146, 126596, 455-2662; 4826, DGKA, 24147, 126597, 310-2517; 4826, DGKA, 24148, 126598, 205-948; 4826, DGKA, 24151, 126601, 212-568; 4826, DGKA, 24154, 126604, 126-482; 4826, DGKA, 24157, 126607, 205-2412; 4827, DGKB, 24168, 126618, 287-2698; 4827, DGKB, 24169, 126619, 439-2829; 4827, DGKB, 24172, 126622, 270-494; 4827, DGKB, 24167, 126617, 188-2602; 4827, DGKB, 24170, 126620, 421-2835; 4827, DGKB, 24171, 126621, 85-2406; 4828, DGKD, 24175, 126625, 1-1355; 4828, DGKD, 24176, 126626, 1-494; 4828, DGKD, 24177, 126627, 12-482; 4828, DGKD, 24178, 126628, 80-3586; 4828, DGKD, 24179, 126629, 1-490; 4828, DGKD, 24180, 126630, 1-1355; 4828, DGKD, 24181, 126631, 80-3586; 4828, DGKD, 24182, 126632, 1-490; 4828, DGKD, 24183, 126633, 1-494; 4828, DGKD, 24186, 126636, 12-482; 4828, DGKD, 24173, 126623, 13-3657; 4828, DGKD, 24174, 126624, 80-3592; 4828, DGKD, 24184, 126634, 13-3657; 4828, DGKD, 24185, 126635, 80-3592; 4829, DGKE, 24188, 126638, 1-1369; 4829, DGKE, 24190, 126640, 1-213; 4829, DGKE, 24187, 126637, 181-1884; 4829, DGKE, 24189, 126639, 173-706; 4830, DGKH, 24195, 126645, 1-189; 4830, DGKH, 24197, 126647, 93-362; 4830, DGKH, 24198, 126648, 99-3185; 4830, DGKH, 24191, 126641, 22-3516; 4830, DGKH, 24192, 126642, 22-3684; 4830, DGKH, 24193, 126643, 104-3598; 4830, DGKH, 24194, 126644, 90-3392; 4830, DGKH, 24196, 126646, 133-3387; 4831, DGKG, 24202, 126652, 1-462; 4831, DGKG, 24199, 126649, 541-2916; 4831, DGKG, 24200, 126650, 292-2592; 4831, DGKG, 24201, 126651, 261-2519; 4832, DGKI, 24204, 126654, 541-2745; 4832, DGKI, 24205, 126655, 231-3467; 4832, DGKI, 24206, 126656, 231-3374; 4832, DGKI, 24207, 126657, 1-2799; 4832, DGKI, 24203, 126653, 2-3199; 4833, DGKK, 24208, 126658, 61-3876; 4834, DGKQ, 24210, 126660, 1-474; 4834, DGKQ, 24211, 126661, 1-2630; 4834, DGKQ, 24212, 126662, 45-473; 4834, DGKQ, 24209, 126659, 75-2903; 4835, DGKZ, 24218, 126668, 1-592; 4835, DGKZ, 24219, 126669, 406-2529; 4835, DGKZ, 24220, 126670, 493-542; 4835, DGKZ, 24221, 126671, 138-302; 4835, DGKZ, 24222, 126672, 1-294; 4835, DGKZ, 24225, 126675, 91-498; 4835, DGKZ, 24213, 126663, 73-2793; 4835, DGKZ, 24214, 126664, 372-3209; 4835, DGKZ, 24215, 126665, 73-2862; 4835, DGKZ, 24216, 126666, 89-2875; 4835, DGKZ, 24217, 126667, 126-3479; 4835, DGKZ, 24223, 126673, 144-2945; 4835, DGKZ, 24224, 126674, 198-3002; 4836, DAGLA, 24227, 126677, 83-586; 4836, DAGLA, 24226, 126676, 117-3245; 4837, DAGLB, 24230, 126680, 253-2148; 4837, DAGLB, 24231, 126681, 111-558; 4837, DAGLB, 24232, 126682, 91-609; 4837, DAGLB, 24228, 126678, 171-2189; 4837, DAGLB, 24229, 126679, 93-1724; 4838, DGAT1, 24233, 126683, 275-1222; 4838, DGAT1, 24234, 126684, 275-1741; 4839, DGAT2, 24237, 126687, 268-747; 4839, DGAT2, 24238, 126688, 1-885; 4839, DGAT2, 24239, 126689, 282-618; 4839, DGAT2, 24240, 126690, 245-584; 4839, DGAT2, 24235, 126685, 261-1427; 4839, DGAT2, 24236, 126686, 260-1297; 4840, DGAT2L6, 24241, 126691, 101-1114; 4841, DIAPH1, 24242, 126692, 274-3960; 4841, DIAPH1, 24244, 126694, 142-3933; 4841, DIAPH1, 24245, 126695, 142-3960; 4841, DIAPH1, 24246, 126696, 1-289; 4841, DIAPH1, 24247, 126697, 86-691; 4841, DIAPH1, 24249, 126699, 225-561; 4841, DIAPH1, 24243, 126693, 142-3960; 4841, DIAPH1, 24248, 126698, 1-3792; 4842, DIAPH2, 24251, 126701, 397-3687; 4842, DIAPH2, 24253, 126703, 43-3354; 4842, DIAPH2, 24254, 126704, 397-3702; 4842, DIAPH2, 24250, 126700, 348-3653; 4842, DIAPH2, 24252, 126702, 348-3638; 4843, DIAPH3, 24255, 126705, 1-3339; 4843, DIAPH3, 24256, 126706, 1-3549; 4843, DIAPH3, 24257, 126707, 1-3372; 4843, DIAPH3, 24258, 126708, 1-3444; 4843, DIAPH3, 24259, 126709, 222-3803; 4843, DIAPH3, 24260, 126710, 180-2729; 4843, DIAPH3, 24261, 126711, 149-2224; 4844, DBI, 24267, 126717, 237-668; 4844, DBI, 24268, 126718, 129-422; 4844, DBI, 24262, 126712, 172-486; 4844, DBI, 24263, 126713, 132-395; 4844, DBI, 24264, 126714, 244-510; 4844, DBI, 24265, 126715, 99-413; 4844, DBI, 24266, 126716, 194-508; 4844, DBI, 24269, 126719, 76-465; 4844, DBI, 24270, 126720, 85-531; 4845, DCXR, 24272, 126722, 8-430; 4845, DCXR, 24273, 126723, 6-676; 4845, DCXR, 24274, 126724, 1-429; 4845, DCXR, 24275, 126725, 1-531; 4845, DCXR, 24276, 126726, 1-260; 4845, DCXR, 24277, 126727, 1-676; 4845, DCXR, 24278, 126728, 1-301; 4845, DCXR, 24271, 126721, 51-785; 4846, DICER1, 24281, 126731, 397-607; 4846, DICER1, 24282, 126732, 288-498; 4846, DICER1, 24287, 126737, 1-1183; 4846, DICER1, 24279, 126729, 239-6007; 4846, DICER1, 24280, 126730, 183-5951; 4846, DICER1, 24283, 126733, 234-6002; 4846, DICER1, 24284, 126734, 293-6061; 4846, DICER1, 24285, 126735, 10-5499; 4846, DICER1, 24286, 126736, 284-2746; 4847, DKK1, 24288, 126738, 140-940; 4848, DKK2, 24290, 126740, 235-714; 4848, DKK2, 24291, 126741, 258-899; 4848, DKK2, 24289, 126739, 707-1486; 4849, DKK3, 24294, 126744, 126-521; 4849, DKK3, 24295, 126745, 159-1253; 4849, DKK3, 24296, 126746, 200-903; 4849, DKK3, 24297, 126747, 43-592; 4849, DKK3, 24292, 126742, 226-1278; 4849, DKK3, 24293, 126743, 240-1292; 4850, DKK4, 24298, 126748, 188-862; 4851, DKKL1, 24300, 126750, 134-436; 4851, DKKL1, 24301, 126751, 401-775; 4851, DKKL1, 24302, 126752, 1-412; 4851, DKKL1, 24303, 126753, 66-664; 4851, DKKL1, 24304, 126754, 331-767; 4851, DKKL1, 24299, 126749, 406-1134; 4852, DMBX1, 24305, 126755, 15-1148; 4852, DMBX1, 24306, 126756, 16-1164; 4853, DEF8, 24309, 126759, 249-651; 4853, DEF8, 24310, 126760, 43-573; 4853, DEF8, 24311, 126761, 82-279; 4853, DEF8, 24312, 126762, 168-491; 4853, DEF8, 24313, 126763, 168-549; 4853, DEF8, 24314, 126764, 93-468; 4853, DEF8, 24316, 126766, 253-572; 4853, DEF8, 24318, 126768, 31-558; 4853, DEF8, 24320, 126770, 107-516; 4853, DEF8, 24321, 126771, 129-578; 4853, DEF8, 24322, 126772, 23-580; 4853, DEF8, 24307, 126757, 90-1628; 4853, DEF8, 24308, 126758, 128-721; 4853, DEF8, 24315, 126765, 174-1349; 4853, DEF8, 24317, 126767, 394-1749; 4853, DEF8, 24319, 126769, 128-1453; 4853, DEF8, 24323, 126773, 120-1424; 4853, DEF8, 24324, 126774, 998-2353; 4853, DEF8, 24325, 126775, 95-688; 4853, DEF8, 24326, 126776, 432-1787; 4854, DPCR1, 24328, 126778, 1-1524; 4854, DPCR1, 24329, 126779, 1-1524; 4854, DPCR1, 24330, 126780, 1-1524; 4854, DPCR1, 24331, 126781, 29-4210; 4854, DPCR1, 24333, 126783, 29-2695; 4854, DPCR1, 24335, 126785, 1-1554; 4854, DPCR1, 24327, 126777, 1-1554; 4854, DPCR1, 24332, 126782, 1-1554; 4854, DPCR1, 24334, 126784, 1-1554; 4855, DGCR14, 24337, 126787, 45-926; 4855, DGCR14, 24336, 126786, 45-1475; 4856, DGCR2, 24339, 126789, 1255-2235; 4856, DGCR2, 24341, 126791, 249-1901; 4856, DGCR2, 24342, 126792, 249-1235; 4856, DGCR2, 24338, 126788, 249-1901; 4856, DGCR2, 24340, 126790, 249-1778; 4857, DGCR6, 24345, 126795, 386-640; 4857, DGCR6, 24346, 126796, 21-455; 4857, DGCR6, 24347, 126797, 51-365; 4857, DGCR6, 24348, 126798, 23-457; 4857, DGCR6, 24343, 126793, 153-815; 4857, DGCR6, 24344, 126794, 25-513; 4858, DGCR6L, 24350, 126800, 22-570; 4858, DGCR6L, 24351, 126801, 93-386; 4858, DGCR6L, 24349, 126799, 93-755; 4859, DIEXF, 24352, 126802, 1-746; 4859, DIEXF, 24353, 126803, 58-2328; 4860, DHDH, 24355, 126805, 18-746; 4860, DHDH, 24356, 126806, 21-608; 4860, DHDH, 24357, 126807, 1-414; 4860, DHDH, 24354, 126804, 41-1045; 4861, DHFR, 24360, 126810, 64-453; 4861, DHFR, 24358, 126808, 495-1058; 4861, DHFR, 24359, 126809, 176-583; 4861, DHFR, 24361, 126811, 186-749; 4862, DHFRL1, 24365, 126815, 249-591; 4862, DHFRL1, 24362, 126812, 338-901; 4862, DHFRL1, 24363, 126813, 451-1014; 4862, DHFRL1, 24364, 126814, 127-690; 4862, DHFRL1, 24366, 126816, 127-690; 4863, DBT, 24367, 126817, 1-963; 4863, DBT, 24368, 126818, 15-1463; 4864, DLD, 24371, 126821, 66-413; 4864, DLD, 24373, 126823, 88-264; 4864, DLD, 24374, 126824, 66-410; 4864, DLD, 24375, 126825, 79-1539; 4864, DLD, 24369, 126819, 282-1811; 4864, DLD, 24370, 126820, 78-1463; 4864, DLD, 24372, 126822, 88-1617; 4865, DLAT, 24377, 126827, 34-1662; 4865, DLAT, 24378, 126828, 1-1440; 4865, DLAT, 24379, 126829, 66-263; 4865, DLAT, 24376, 126826, 660-2603; 4866, DLST, 24380, 126830, 39-242; 4866, DLST, 24382, 126832, 64-378; 4866, DLST, 24383, 126833, 1-224; 4866, DLST, 24384, 126834, 40-153; 4866, DLST, 24385, 126835, 1-837; 4866, DLST, 24386, 126836, 52-384; 4866, DLST, 24387, 126837, 14-265; 4866, DLST, 24388, 126838, 1-252; 4866, DLST, 24381, 126831, 62-1423; 4867, DHODH, 24390, 126840, 1-581; 4867, DHODH, 24391, 126841, 178-1359; 4867, DHODH, 24392, 126842, 1-230; 4867, DHODH, 24393, 126843, 411-843; 4867, DHODH, 24389, 126839, 22-1209; 4868, DPYS, 24395, 126845, 125-576; 4868, DPYS, 24396, 126846, 1-163; 4868, DPYS, 24394, 126844, 134-1693; 4869, DPYSL2, 24398, 126848, 52-562; 4869, DPYSL2, 24397, 126847, 413-2131; 4869, DPYSL2, 24399, 126849, 475-2085; 4869, DPYSL2, 24400, 126850, 199-1809; 4870, DPYSL3, 24403, 126853, 263-539; 4870, DPYSL3, 24404, 126854, 1-228; 4870, DPYSL3, 24405, 126855, 1-628; 4870, DPYSL3, 24401, 126851, 199-2253; 4870, DPYSL3, 24402, 126852, 373-2085; 4871, DPYSL4, 24407, 126857, 2-1240; 4871, DPYSL4, 24406, 126856, 165-1883; 4872, DPYSL5, 24410, 126860, 79-647; 4872, DPYSL5, 24411, 126861, 126-621; 4872, DPYSL5, 24412, 126862, 37-560; 4872, DPYSL5, 24408, 126858, 159-1853; 4872, DPYSL5, 24409, 126859, 76-1770; 4872, DPYSL5, 24413, 126863, 79-1773; 4873, DPYD, 24414, 126864, 128-649; 4873, DPYD, 24415, 126865, 102-3179; 4874, DUS1L, 24418, 126868, 1-718; 4874, DUS1L, 24419, 126869, 1-896; 4874, DUS1L, 24420, 126870, 1-575; 4874, DUS1L, 24421, 126871, 1-458; 4874, DUS1L, 24422, 126872, 196-937; 4874, DUS1L, 24423, 126873, 286-1212; 4874, DUS1L, 24424, 126874, 193-648; 4874, DUS1L, 24425, 126875, 182-1084; 4874, DUS1L, 24416, 126866, 38-1459; 4874, DUS1L, 24417, 126867, 487-1908; 4875, DUS2, 24427, 126877, 159-1535; 4875, DUS2, 24428, 126878, 199-546; 4875, DUS2, 24429, 126879, 324-567; 4875, DUS2, 24431, 126881, 220-540; 4875, DUS2, 24432, 126882, 251-373; 4875, DUS2, 24433, 126883, 386-540; 4875, DUS2, 24434, 126884, 21-284; 4875, DUS2, 24435, 126885, 351-571; 4875, DUS2, 24436, 126886, 307-570; 4875, DUS2, 24437, 126887, 201-569; 4875, DUS2, 24438, 126888, 97-570; 4875, DUS2, 24439, 126889, 112-736; 4875, DUS2, 24426, 126876, 118-1599; 4875, DUS2, 24430, 126880, 495-1976; 4876, DUS3L, 24442, 126892, 85-738; 4876, DUS3L, 24443, 126893, 1-508; 4876, DUS3L, 24444, 126894, 1-234; 4876, DUS3L, 24445, 126895, 1-516; 4876, DUS3L, 24446, 126896, 1-419; 4876, DUS3L, 24447, 126897, 103-216; 4876, DUS3L, 24440, 126890, 98-2050; 4876, DUS3L, 24441, 126891, 66-1292; 4877, DUS4L, 24449, 126899, 371-730; 4877, DUS4L, 24450, 126900, 191-463; 4877, DUS4L, 24451, 126901, 296-442; 4877, DUS4L, 24452, 126902, 363-635; 4877, DUS4L, 24453, 126903, 700-972; 4877, DUS4L, 24448, 126898, 363-1316; 4878, DIMT1, 24455, 126905, 127-954; 4878, DIMT1, 24456, 126906, 168-632; 4878, DIMT1, 24454, 126904, 162-1103; 4879, DDAH1, 24461, 126911, 146-703; 4879, DDAH1, 24457, 126907, 96-953; 4879, DDAH1, 24458, 126908, 503-1051; 4879, DDAH1, 24459, 126909, 100-957; 4879, DDAH1, 24460, 126910, 390-938; 4880, DDAH2, 24468, 126918, 205-882; 4880, DDAH2, 24469, 126919, 179-887; 4880, DDAH2, 24471, 126921, 1-565; 4880, DDAH2, 24474, 126924, 205-880; 4880, DDAH2, 24475, 126925, 179-887; 4880, DDAH2, 24477, 126927, 205-882; 4880, DDAH2, 24478, 126928, 179-887; 4880, DDAH2, 24482, 126932, 1-565; 4880, DDAH2, 24486, 126936, 179-887; 4880, DDAH2, 24488, 126938, 1-565; 4880, DDAH2, 24490, 126940, 179-887; 4880, DDAH2, 24491, 126941, 1-565; 4880, DDAH2, 24493, 126943, 205-882; 4880, DDAH2, 24494, 126944, 205-882; 4880, DDAH2, 24495, 126945, 179-887; 4880, DDAH2, 24498, 126948, 1-565; 4880, DDAH2, 24499, 126949, 1-565; 4880, DDAH2, 24500, 126950, 205-882; 4880, DDAH2, 24501, 126951, 179-887; 4880, DDAH2, 24502, 126952, 205-882; 4880, DDAH2, 24503, 126953, 1-565; 4880, DDAH2, 24462, 126912, 274-1131; 4880, DDAH2, 24463, 126913, 632-1489; 4880, DDAH2, 24464, 126914, 632-1489; 4880, DDAH2, 24465, 126915, 274-1131; 4880, DDAH2, 24466, 126916, 632-1489; 4880, DDAH2, 24467, 126917, 632-1489; 4880, DDAH2, 24470, 126920, 632-1489; 4880, DDAH2, 24472, 126922, 274-1131; 4880, DDAH2, 24473, 126923, 632-1489; 4880, DDAH2, 24476, 126926, 632-1489; 4880, DDAH2, 24479, 126929, 632-1489; 4880, DDAH2, 24480, 126930, 632-1489; 4880, DDAH2, 24481, 126931, 274-1131; 4880, DDAH2, 24483, 126933, 632-1489; 4880, DDAH2, 24484, 126934, 632-1489; 4880, DDAH2, 24485, 126935, 274-1131; 4880, DDAH2, 24487, 126937, 632-1489; 4880, DDAH2, 24489, 126939, 274-1131; 4880, DDAH2, 24492, 126942, 632-1489; 4880, DDAH2, 24496, 126946, 274-1131; 4880, DDAH2, 24497, 126947, 632-1489; 4881, DMGDH, 24505, 126955, 10-306; 4881, DMGDH, 24506, 126956, 7-159; 4881, DMGDH, 24507, 126957, 10-330; 4881, DMGDH, 24508, 126958, 55-207; 4881, DMGDH, 24509, 126959, 1-1842; 4881, DMGDH, 24504, 126954, 30-2630; 4882, DPEP1, 24513, 126963, 149-482; 4882, DPEP1, 24514, 126964, 204-525; 4882, DPEP1, 24510, 126960, 123-1358; 4882, DPEP1, 24511, 126961, 292-1527; 4882, DPEP1, 24512, 126962, 204-1439; 4883, DPEP2, 24517, 126967, 667-1443; 4883, DPEP2, 24518, 126968, 169-579; 4883, DPEP2, 24519, 126969, 217-559; 4883, DPEP2, 24520, 126970, 80-447; 4883, DPEP2, 24521, 126971, 97-580; 4883, DPEP2, 24515, 126965, 125-1585; 4883, DPEP2, 24516, 126966, 652-2112; 4884, DPEP3, 24522, 126972, 375-1916; 4885, DPP10, 24524, 126974, 87-862; 4885, DPP10, 24528, 126978, 703-883; 4885, DPP10, 24529, 126979, 275-565; 4885, DPP10, 24530, 126980, 1-183; 4885, DPP10, 24523, 126973, 128-2497; 4885, DPP10, 24525, 126975, 356-2758; 4885, DPP10, 24526, 126976, 481-2871; 4885, DPP10, 24527, 126977, 661-2901; 4886, DPP3, 24531, 126981, 37-547; 4886, DPP3, 24532, 126982, 131-733; 4886, DPP3, 24533, 126983, 402-2675; 4886, DPP3, 24534, 126984, 64-595; 4886, DPP3, 24535, 126985, 402-2672; 4886, DPP3, 24536, 126986, 294-563; 4886, DPP3, 24538, 126988, 250-561; 4886, DPP3, 24537, 126987, 34-2157; 4886, DPP3, 24539, 126989, 57-2270; 4887, DPP4, 24541, 126991, 1-260; 4887, DPP4, 24542, 126992, 142-654; 4887, DPP4, 24543, 126993, 22-378; 4887, DPP4, 24544, 126994, 77-433; 4887, DPP4, 24540, 126990, 562-2862; 4888, DPP6, 24547, 126997, 404-1465; 4888, DPP6, 24548, 126998, 588-2993; 4888, DPP6, 24549, 126999, 54-2330; 4888, DPP6, 24550, 127000, 234-1109; 4888, DPP6, 24545, 126995, 386-2797; 4888, DPP6, 24546, 126996, 142-2739; 4889, DPP7, 24552, 127002, 1-733; 4889, DPP7, 24553, 127003, 1-185; 4889, DPP7, 24554, 127004, 1-362; 4889, DPP7, 24555, 127005, 1-467; 4889, DPP7, 24556, 127006, 1-817; 4889, DPP7, 24551, 127001, 6-1484; 4890, DPP8, 24561, 127011, 113-2302; 4890, DPP8, 24562, 127012, 1-1083; 4890, DPP8, 24563, 127013, 249-906; 4890, DPP8, 24564, 127014, 313-564; 4890, DPP8, 24565, 127015, 233-592; 4890, DPP8, 24567, 127017, 1-935; 4890, DPP8, 24568, 127018, 190-677; 4890, DPP8, 24557, 127007, 226-2874; 4890, DPP8, 24558, 127008, 319-2862; 4890, DPP8, 24559, 127009, 1582-4278; 4890, DPP8, 24560, 127010, 207-2555; 4890, DPP8, 24566, 127016, 113-2809; 4891, DPP9, 24570, 127020, 207-408; 4891, DPP9, 24571, 127021, 255-542; 4891, DPP9, 24572, 127022, 1-661; 4891, DPP9, 24573, 127023, 495-555; 4891, DPP9, 24575, 127025, 236-424; 4891, DPP9, 24576, 127026, 269-626; 4891, DPP9, 24577, 127027, 368-600; 4891, DPP9, 24578, 127028, 1-456; 4891, DPP9, 24579, 127029, 1-423; 4891, DPP9, 24581, 127031, 166-1722; 4891, DPP9, 24582, 127032, 205-625; 4891, DPP9, 24583, 127033, 1-188; 4891, DPP9, 24584, 127034, 198-566; 4891, DPP9, 24585, 127035, 366-570; 4891, DPP9, 24569, 127019, 279-2957; 4891, DPP9, 24574, 127024, 507-3098; 4891, DPP9, 24580, 127030, 1-2511; 4892, PPIP5K1, 24590, 127040, 59-4288; 4892, PPIP5K1, 24591, 127041, 95-4384; 4892, PPIP5K1, 24593, 127043, 1-589; 4892, PPIP5K1, 24594, 127044, 193-535; 4892, PPIP5K1, 24596, 127046, 164-506; 4892, PPIP5K1, 24597, 127047, 54-268; 4892, PPIP5K1, 24598, 127048, 397-796; 4892, PPIP5K1, 24599, 127049, 1-777; 4892, PPIP5K1, 24600, 127050, 1-356; 4892, PPIP5K1, 24586, 127036, 1-4221; 4892, PPIP5K1, 24587, 127037, 148-4374; 4892, PPIP5K1, 24588, 127038, 127-4347; 4892, PPIP5K1, 24589, 127039, 127-4353; 4892, PPIP5K1, 24592, 127042, 123-4424; 4892, PPIP5K1, 24595, 127045, 205-4506; 4893, PPIP5K2, 24604, 127054, 331-505; 4893, PPIP5K2, 24605, 127055, 160-1516; 4893, PPIP5K2, 24606, 127056, 1-630; 4893, PPIP5K2, 24607, 127057, 1-1197; 4893, PPIP5K2, 24608, 127058, 152-307; 4893, PPIP5K2, 24609, 127059, 1-765; 4893, PPIP5K2, 24610, 127060, 300-473; 4893, PPIP5K2, 24611, 127061, 1-1070; 4893, PPIP5K2, 24612, 127062, 384-4220; 4893, PPIP5K2, 24613, 127063, 285-4121; 4893, PPIP5K2, 24601, 127051, 574-4242; 4893, PPIP5K2, 24602, 127052, 510-4241; 4893, PPIP5K2, 24603, 127053, 285-3953; 4894, DPH1, 24616, 127066, 1-1295; 4894, DPH1, 24617, 127067, 1-644; 4894, DPH1, 24618, 127068, 1-446; 4894, DPH1, 24619, 127069, 1-150; 4894, DPH1, 24620, 127070, 1-311; 4894, DPH1, 24621, 127071, 1-324; 4894, DPH1, 24622, 127072, 1-159; 4894, DPH1, 24614, 127064, 46-1377; 4894, DPH1, 24615, 127065, 277-1368; 4895, DPH3, 24623, 127073, 94-267;

4895, DPH3, 24624, 127074, 97-345; 4896, DPH5, 24627, 127077, 125-265; 4896, DPH5, 24629, 127079, 117-848; 4896, DPH5, 24625, 127075, 105-959; 4896, DPH5, 24626, 127076, 114-971; 4896, DPH5, 24628, 127078, 127-984; 4897, DPH7, 24631, 127081, 1-684; 4897, DPH7, 24630, 127080, 159-1517; 4898, DPH6, 24634, 127084, 74-581; 4898, DPH6, 24635, 127085, 1-465; 4898, DPH6, 24632, 127082, 28-831; 4898, DPH6, 24633, 127083, 52-549; 4899, DIRAS1, 24637, 127087, 139-546; 4899, DIRAS1, 24636, 127086, 185-781; 4899, DIRAS1, 24638, 127088, 100-696; 4900, DIRAS2, 24639, 127089, 390-989; 4901, DIRAS3, 24640, 127090, 638-1327; 4901, DIRAS3, 24641, 127091, 296-985; 4902, DIS3, 24644, 127094, 23-1702; 4902, DIS3, 24645, 127095, 819-3209; 4902, DIS3, 24642, 127092, 102-2978; 4902, DIS3, 24643, 127093, 94-2880; 4903, DIS3L2, 24652, 127102, 139-570; 4903, DIS3L2, 24654, 127104, 1-590; 4903, DIS3L2, 24655, 127105, 1-499; 4903, DIS3L2, 24656, 127106, 1-207; 4903, DIS3L2, 24657, 127107, 1-1149; 4903, DIS3L2, 24646, 127096, 615-2426; 4903, DIS3L2, 24647, 127097, 277-2934; 4903, DIS3L2, 24648, 127098, 176-2035; 4903, DIS3L2, 24649, 127099, 176-925; 4903, DIS3L2, 24650, 127100, 1-2658; 4903, DIS3L2, 24651, 127101, 168-917; 4903, DIS3L2, 24653, 127103, 1-1071; 4904, DIS3L, 24660, 127110, 423-873; 4904, DIS3L, 24661, 127111, 2-169; 4904, DIS3L, 24662, 127112, 172-339; 4904, DIS3L, 24663, 127113, 157-327; 4904, DIS3L, 24664, 127114, 501-792; 4904, DIS3L, 24665, 127115, 196-504; 4904, DIS3L, 24658, 127108, 262-3177; 4904, DIS3L, 24659, 127109, 51-3215; 4905, DDR1, 24674, 127124, 233-675; 4905, DDR1, 24675, 127125, 118-560; 4905, DDR1, 24679, 127129, 118-560; 4905, DDR1, 24685, 127135, 342-758; 4905, DDR1, 24686, 127136, 172-588; 4905, DDR1, 24687, 127137, 457-873; 4905, DDR1, 24688, 127138, 457-873; 4905, DDR1, 24689, 127139, 457-1257; 4905, DDR1, 24690, 127140, 1-1479; 4905, DDR1, 24691, 127141, 296-485; 4905, DDR1, 24693, 127143, 43-459; 4905, DDR1, 24694, 127144, 457-873; 4905, DDR1, 24695, 127145, 322-496; 4905, DDR1, 24696, 127146, 457-873; 4905, DDR1, 24697, 127147, 99-515; 4905, DDR1, 24698, 127148, 1-1479; 4905, DDR1, 24699, 127149, 128-587; 4905, DDR1, 24700, 127150, 43-459; 4905, DDR1, 24701, 127151, 188-939; 4905, DDR1, 24702, 127152, 1-1136; 4905, DDR1, 24703, 127153, 370-1121; 4905, DDR1, 24704, 127154, 81-580; 4905, DDR1, 24706, 127156, 296-485; 4905, DDR1, 24707, 127157, 1-1136; 4905, DDR1, 24708, 127158, 296-485; 4905, DDR1, 24709, 127159, 1-1479; 4905, DDR1, 24710, 127160, 342-1093; 4905, DDR1, 24711, 127161, 118-560; 4905, DDR1, 24713, 127163, 172-799; 4905, DDR1, 24714, 127164, 81-580; 4905, DDR1, 24716, 127166, 367-1118; 4905, DDR1, 24718, 127168, 99-515; 4905, DDR1, 24719, 127169, 43-459; 4905, DDR1, 24720, 127170, 118-560; 4905, DDR1, 24721, 127171, 172-799; 4905, DDR1, 24722, 127172, 1-1479; 4905, DDR1, 24723, 127173, 355-1106; 4905, DDR1, 24724, 127174, 172-799; 4905, DDR1, 24725, 127175, 43-232; 4905, DDR1, 24727, 127177, 1-1479; 4905, DDR1, 24729, 127179, 1-1136; 4905, DDR1, 24730, 127180, 43-2346; 4905, DDR1, 24731, 127181, 296-485; 4905, DDR1, 24733, 127183, 296-485; 4905, DDR1, 24734, 127184, 43-459; 4905, DDR1, 24735, 127185, 118-560; 4905, DDR1, 24736, 127186, 81-580; 4905, DDR1, 24738, 127188, 1-1136; 4905, DDR1, 24739, 127189, 81-580; 4905, DDR1, 24740, 127190, 1-587; 4905, DDR1, 24741, 127191, 173-800; 4905, DDR1, 24742, 127192, 1-140; 4905, DDR1, 24744, 127194, 43-459; 4905, DDR1, 24745, 127195, 457-873; 4905, DDR1, 24747, 127197, 172-799; 4905, DDR1, 24748, 127198, 172-799; 4905, DDR1, 24751, 127201, 372-673; 4905, DDR1, 24752, 127202, 274-481; 4905, DDR1, 24753, 127203, 159-556; 4905, DDR1, 24754, 127204, 237-572; 4905, DDR1, 24755, 127205, 182-289; 4905, DDR1, 24757, 127207, 124-539; 4905, DDR1, 24758, 127208, 272-615; 4905, DDR1, 24760, 127210, 166-580; 4905, DDR1, 24761, 127211, 448-572; 4905, DDR1, 24762, 127212, 701-956; 4905, DDR1, 24763, 127213, 48-636; 4905, DDR1, 24764, 127214, 94-460; 4905, DDR1, 24765, 127215, 451-604; 4905, DDR1, 24766, 127216, 1-833; 4905, DDR1, 24767, 127217, 410-574; 4905, DDR1, 24768, 127218, 374-527; 4905, DDR1, 24769, 127219, 329-562; 4905, DDR1, 24770, 127220, 353-571; 4905, DDR1, 24771, 127221, 120-547; 4905, DDR1, 24772, 127222, 364-573; 4905, DDR1, 24773, 127223, 114-623; 4905, DDR1, 24774, 127224, 389-1248; 4905, DDR1, 24775, 127225, 104-211; 4905, DDR1, 24776, 127226, 1-514; 4905, DDR1, 24777, 127227, 159-538; 4905, DDR1, 24779, 127229, 62-542; 4905, DDR1, 24780, 127230, 43-2346; 4905, DDR1, 24784, 127234, 43-2346; 4905, DDR1, 24785, 127235, 43-2346; 4905, DDR1, 24793, 127243, 43-2346; 4905, DDR1, 24666, 127116, 355-2985; 4905, DDR1, 24667, 127117, 549-3290; 4905, DDR1, 24668, 127118, 342-2972; 4905, DDR1, 24669, 127119, 296-3037; 4905, DDR1, 24670, 127120, 293-2923; 4905, DDR1, 24671, 127121, 334-2964; 4905, DDR1, 24672, 127122, 1-732; 4905, DDR1, 24673, 127123, 370-3111; 4905, DDR1, 24676, 127126, 342-2972; 4905, DDR1, 24677, 127127, 188-2818; 4905, DDR1, 24678, 127128, 367-3108; 4905, DDR1, 24680, 127130, 342-2972; 4905, DDR1, 24681, 127131, 188-2818; 4905, DDR1, 24682, 127132, 355-2985; 4905, DDR1, 24683, 127133, 367-3108; 4905, DDR1, 24684, 127134, 370-3111; 4905, DDR1, 24692, 127142, 370-3111; 4905, DDR1, 24705, 127155, 370-3111; 4905, DDR1, 24712, 127162, 188-2818; 4905, DDR1, 24715, 127165, 342-2972; 4905, DDR1, 24717, 127167, 367-3108; 4905, DDR1, 24726, 127176, 260-3001; 4905, DDR1, 24728, 127178, 188-2818; 4905, DDR1, 24732, 127182, 452-3082; 4905, DDR1, 24737, 127187, 414-3044; 4905, DDR1, 24743, 127193, 367-3108; 4905, DDR1, 24746, 127196, 355-2985; 4905, DDR1, 24749, 127199, 355-2985; 4905, DDR1, 24750, 127200, 342-2972; 4905, DDR1, 24756, 127206, 198-929; 4905, DDR1, 24759, 127209, 253-2937; 4905, DDR1, 24778, 127228, 1-2760; 4905, DDR1, 24781, 127231, 241-2925; 4905, DDR1, 24782, 127232, 241-2925; 4905, DDR1, 24783, 127233, 260-3001; 4905, DDR1, 24786, 127236, 260-3001; 4905, DDR1, 24787, 127237, 241-2925; 4905, DDR1, 24788, 127238, 260-3001; 4905, DDR1, 24789, 127239, 241-2925; 4905, DDR1, 24790, 127240, 260-3001; 4905, DDR1, 24791, 127241, 1-732; 4905, DDR1, 24792, 127242, 1-732; 4905, DDR1, 24794, 127244, 1-732; 4905, DDR1, 24795, 127245, 1-732; 4906, DDR2, 24798, 127248, 275-718; 4906, DDR2, 24799, 127249, 1-514; 4906, DDR2, 24800, 127250, 267-656; 4906, DDR2, 24801, 127251, 1-501; 4906, DDR2, 24796, 127246, 354-2921; 4906, DDR2, 24797, 127247, 439-3006; 4907, DCBLD1, 24804, 127254, 1-300; 4907, DCBLD1, 24802, 127252, 126-1745; 4907, DCBLD1, 24803, 127253, 121-2268; 4908, DCBLD2, 24807, 127257, 229-554; 4908, DCBLD2, 24805, 127255, 364-2691; 4908, DCBLD2, 24806, 127256, 1-2370; 4909, DIP2A, 24808, 127258, 234-4937; 4909, DIP2A, 24809, 127259, 22-4737; 4909, DIP2A, 24810, 127260, 183-2852; 4909, DIP2A, 24811, 127261, 76-2601; 4909, DIP2A, 24812, 127262, 156-2552; 4910, DIP2B, 24814, 127264, 1-193; 4910, DIP2B, 24813, 127263, 35-4765; 4911, DIP2C, 24816, 127266, 1-4614; 4911, DIP2C, 24817, 127267, 1-721; 4911, DIP2C, 24818, 127268, 1-391; 4911, DIP2C, 24819, 127269, 91-4959; 4911, DIP2C, 24815, 127265, 91-4761; 4912, DLGAP1, 24823, 127273, 47-2050; 4912, DLGAP1, 24824, 127274, 98-2179; 4912, DLGAP1, 24827, 127277, 62-2161; 4912, DLGAP1, 24820, 127270, 597-3530; 4912, DLGAP1, 24821, 127271, 15-1898; 4912, DLGAP1, 24822, 127272, 78-2105; 4912, DLGAP1, 24825, 127275, 53-2104; 4912, DLGAP1, 24826, 127276, 62-2047; 4912, DLGAP1, 24828, 127278, 77-2134; 4912, DLGAP1, 24829, 127279, 26-2077; 4912, DLGAP1, 24830, 127280, 270-3203; 4912, DLGAP1, 24831, 127281, 528-3317; 4913, DLGAP2, 24833, 127283, 51-2936; 4913, DLGAP2, 24834, 127284, 135-3062; 4913, DLGAP2, 24835, 127285, 135-3020; 4913, DLGAP2, 24836, 127286, 135-3020; 4913, DLGAP2, 24837, 127287, 1-530; 4913, DLGAP2, 24838, 127288, 135-1336; 4913, DLGAP2, 24839, 127289, 1-477; 4913, DLGAP2, 24840, 127290, 51-2936; 4913, DLGAP2, 24841, 127291, 1-1684; 4913, DLGAP2, 24842, 127292, 1-477; 4913, DLGAP2, 24843, 127293, 1-530; 4913, DLGAP2, 24844, 127294, 1-1726; 4913, DLGAP2, 24845, 127295, 51-1252; 4913, DLGAP2, 24832, 127282, 135-3062; 4914, DLGAP3, 24846, 127296, 1-2940; 4914, DLGAP3, 24847, 127297, 270-3209; 4915, DLGAP4, 24853, 127303, 1229-1963; 4915, DLGAP4, 24854, 127304, 647-1504; 4915, DLGAP4, 24855, 127305, 700-839; 4915, DLGAP4, 24856, 127306, 418-794; 4915, DLGAP4, 24848, 127298, 436-3414; 4915, DLGAP4, 24849, 127299, 823-2184; 4915, DLGAP4, 24850, 127300, 200-3178; 4915, DLGAP4, 24851, 127301, 481-3450; 4915, DLGAP4, 24852, 127302, 308-3277; 4916, DLGAP5, 24859, 127309, 106-808; 4916, DLGAP5, 24860, 127310, 256-588; 4916, DLGAP5, 24857, 127307, 218-2758; 4916, DLGAP5, 24858, 127308, 84-2612; 4917, DLG1, 24862, 127312, 191-2869; 4917, DLG1, 24863, 127313, 93-716; 4917, DLG1, 24864, 127314, 475-2451; 4917, DLG1, 24866, 127316, 393-710; 4917, DLG1, 24868, 127318, 174-543; 4917, DLG1, 24869, 127319, 93-629; 4917, DLG1, 24871, 127321, 191-1303; 4917, DLG1, 24872, 127322, 1-858; 4917, DLG1, 24874, 127324, 203-309; 4917, DLG1, 24877, 127327, 174-539; 4917, DLG1, 24879, 127329, 120-582; 4917, DLG1, 24861, 127311, 191-2971; 4917, DLG1, 24865, 127315, 75-2690; 4917, DLG1, 24867, 127317, 191-2905; 4917, DLG1, 24870, 127320, 51-2453; 4917, DLG1, 24873, 127323, 324-2690; 4917, DLG1, 24875, 127325, 288-3002; 4917, DLG1, 24876, 127326, 1-2682; 4917, DLG1, 24878, 127328, 1-2562; 4918, DLG2, 24882, 127332, 41-738; 4918, DLG2, 24883, 127333, 195-1853; 4918, DLG2, 24884, 127334, 157-546; 4918, DLG2, 24885, 127335, 18-2393; 4918, DLG2, 24887, 127337, 313-1359; 4918, DLG2, 24888, 127338, 186-849; 4918, DLG2, 24891, 127341, 117-442; 4918, DLG2, 24892, 127342, 1-496; 4918, DLG2, 24893, 127343, 63-2663; 4918, DLG2, 24894, 127344, 26-2461; 4918, DLG2, 24895, 127345, 26-139; 4918, DLG2, 24896, 127346, 279-559; 4918, DLG2, 24897, 127347, 327-550; 4918, DLG2, 24898, 127348, 304-2862; 4918, DLG2, 24899, 127349, 220-547; 4918, DLG2, 24900, 127350, 65-493; 4918, DLG2, 24880, 127330, 195-2924; 4918, DLG2, 24881, 127331, 313-3240; 4918, DLG2, 24886, 127336, 472-3084; 4918, DLG2, 24889, 127339, 282-1286; 4918, DLG2, 24890, 127340, 26-2275; 4919, DLG3, 24901, 127351, 342-2891; 4919, DLG3, 24902, 127352, 318-1856; 4919, DLG3, 24903, 127353, 234-2687; 4919, DLG3, 24904, 127354, 213-1313; 4920, DLG4, 24908, 127358, 60-763; 4920, DLG4, 24909, 127359, 83-926; 4920, DLG4, 24910, 127360, 42-932; 4920, DLG4, 24911, 127361, 240-586; 4920, DLG4, 24912, 127362, 299-573; 4920, DLG4, 24913, 127363, 1-257; 4920, DLG4, 24905, 127355, 201-2366; 4920, DLG4, 24906, 127356, 193-2367; 4920, DLG4, 24907, 127357, 854-3157; 4921, DLG5, 24915, 127365, 1-2643; 4921, DLG5, 24916, 127366, 1-645; 4921, DLG5, 24918, 127368, 1-2643; 4921, DLG5, 24919, 127369, 1-645; 4921, DLG5, 24920, 127370, 1-1795; 4921, DLG5, 24914, 127364, 7-5766; 4921, DLG5, 24917, 127367, 7-5766; 4922, DAAM1, 24923, 127373, 108-398; 4922, DAAM1, 24921, 127371, 127-3333; 4922, DAAM1, 24922, 127372, 24-3260; 4923, DAAM2, 24926, 127376, 428-826; 4923, DAAM2, 24928, 127378, 149-442; 4923, DAAM2, 24929, 127379, 225-3458; 4923, DAAM2, 24924, 127374, 157-3363; 4923, DAAM2, 24925, 127375, 183-3389; 4923, DAAM2, 24927, 127377, 204-3407; 4924, DVL1, 24932, 127382, 71-1405; 4924, DVL1, 24933, 127383, 1-756; 4924, DVL1, 24934, 127384, 1-654; 4924, DVL1, 24930, 127380, 286-2373; 4924, DVL1, 24931, 127381, 48-2060; 4925, DVL2, 24936, 127386, 119-992; 4925, DVL2, 24937, 127387, 1-900; 4925, DVL2, 24938, 127388, 57-2249; 4925, DVL2, 24939, 127389, 47-1136; 4925, DVL2, 24935, 127385, 284-2494; 4926, DVL3, 24941, 127391, 439-1099; 4926, DVL3, 24943, 127393, 79-312; 4926, DVL3, 24940, 127390, 249-2399; 4926, DVL3, 24942, 127392, 77-2176; 4927, DACT1, 24946, 127396, 604-993; 4927, DACT1, 24947, 127397, 814-2481; 4927, DACT1, 24948, 127398, 506-2173; 4927, DACT1, 24944, 127394, 25-2535; 4927, DACT1, 24945, 127395, 148-2547; 4928, DACT2, 24949, 127399, 90-2414; 4928, DACT2, 24950, 127400, 122-964; 4928, DACT2, 24951, 127401, 311-1411; 4928, DACT2, 24952, 127402, 65-1879; 4929, DACT3, 24953, 127403, 442-1656; 4929, DACT3, 24955, 127405, 75-620; 4929, DACT3, 24954, 127404, 75-1964; 4930, DISP1, 24956, 127406, 165-4739; 4931, DISP2, 24957, 127407, 88-4293; 4932, DIRC1, 24958, 127408, 272-586; 4933, DIRC2, 24960, 127410, 110-457; 4933, DIRC2, 24959, 127409, 399-1835; 4934, DIRC3, 24961, 127411, 104-499; 4935, DISC1, 24962, 127412, 54-1697; 4935, DISC1, 24964, 127414, 54-1202; 4935, DISC1, 24967, 127417, 54-2552; 4935, DISC1, 24968, 127418, 54-2618; 4935, DISC1, 24969, 127419, 32-166; 4935, DISC1, 24970, 127420, 54-1922; 4935, DISC1, 24972, 127422, 54-1883; 4935, DISC1, 24979, 127429, 54-1382; 4935, DISC1, 24980, 127430, 54-2252; 4935, DISC1, 24963, 127413, 54-1163; 4935, DISC1, 24965, 127415, 54-2321; 4935, DISC1, 24966, 127416, 54-2090; 4935, DISC1, 24971, 127421, 54-1793; 4935, DISC1, 24973, 127423, 54-2141; 4935, DISC1, 24974, 127424, 54-1124; 4935, DISC1, 24975, 127425, 54-659; 4935, DISC1, 24976, 127426, 54-1124; 4935, DISC1, 24977, 127427, 54-2042; 4935, DISC1, 24978, 127428, 54-1124; 4935, DISC1, 24981, 127431, 54-1733; 4936, DLX1, 24984, 127434, 509-1022; 4936, DLX1, 24985, 127435, 201-762; 4936, DLX1, 24982, 127432, 143-532; 4936, DLX1, 24983, 127433, 453-1220; 4937, DLX2, 24986, 127436, 363-1349; 4937, DLX2, 24987, 127437, 363-1016; 4938, DLX3, 24989, 127439, 149-652; 4938, DLX3, 24988, 127438, 227-1090; 4939, DLX4, 24990, 127440, 296-1018; 4939, DLX4, 24991, 127441, 241-747; 4939, DLX4, 24992, 127442, 68-412; 4940, DLX5, 24993, 127443, 475-1344; 4940, DLX5, 24994, 127444, 328-903; 4941, DLX6, 24996, 127446, 162-659; 4941, DLX6, 24995, 127445, 431-1312; 4942, DPRX, 24997, 127447, 52-627; 4943, DIXDC1, 25000, 127450, 329-559; 4943, DIXDC1, 24998, 127448, 298-2349; 4943, DIXDC1, 24999, 127449, 281-937; 4943, DIXDC1, 25001, 127451, 464-1882; 4944, DLC1, 25008, 127458, 417-562; 4944, DLC1, 25009, 127459, 1-226; 4944, DLC1, 25010, 127460, 196-562; 4944, DLC1, 25002, 127452, 411-4997; 4944, DLC1, 25003, 127453, 290-1786;

4944, DLC1, 25004, 127454, 495-3770; 4944, DLC1, 25005, 127455, 147-3524; 4944, DLC1, 25006, 127456, 412-1803; 4944, DLC1, 25007, 127457, 285-3338; 4945, DMRTA1, 25011, 127461, 226-1740; 4946, DMRTA2, 25012, 127462, 394-2022; 4946, DMRTA2, 25013, 127463, 97-1725; 4947, DMRTB1, 25014, 127464, 56-1084; 4948, DMRTC1, 25017, 127467, 335-667; 4948, DMRTC1, 25018, 127468, 196-611; 4948, DMRTC1, 25015, 127465, 238-621; 4948, DMRTC1, 25016, 127466, 281-859; 4949, DMRTC1B, 25022, 127472, 157-458; 4949, DMRTC1B, 25023, 127473, 281-472; 4949, DMRTC1B, 25024, 127474, 1-336; 4949, DMRTC1B, 25025, 127475, 335-667; 4949, DMRTC1B, 25019, 127469, 196-774; 4949, DMRTC1B, 25020, 127470, 95-673; 4949, DMRTC1B, 25021, 127471, 236-619; 4950, DMRTC2, 25027, 127477, 87-1343; 4950, DMRTC2, 25028, 127478, 82-566; 4950, DMRTC2, 25030, 127480, 153-556; 4950, DMRTC2, 25031, 127481, 63-559; 4950, DMRTC2, 25026, 127476, 52-1155; 4950, DMRTC2, 25029, 127479, 266-940; 4951, DMXL1, 25033, 127483, 69-1835; 4951, DMXL1, 25034, 127484, 182-9328; 4951, DMXL1, 25032, 127482, 81-9164; 4952, DMXL2, 25038, 127488, 1-3551; 4952, DMXL2, 25039, 127489, 1-347; 4952, DMXL2, 25040, 127490, 1-231; 4952, DMXL2, 25035, 127485, 289-9399; 4952, DMXL2, 25036, 127486, 91-7293; 4952, DMXL2, 25037, 127487, 91-9204; 4953, DNMT1, 25044, 127494, 6-128; 4953, DNMT1, 25045, 127495, 209-973; 4953, DNMT1, 25046, 127496, 507-583; 4953, DNMT1, 25047, 127497, 354-636; 4953, DNMT1, 25048, 127498, 36-305; 4953, DNMT1, 25049, 127499, 485-841; 4953, DNMT1, 25050, 127500, 1-1169; 4953, DNMT1, 25051, 127501, 1-166; 4953, DNMT1, 25052, 127502, 1-231; 4953, DNMT1, 25053, 127503, 378-591; 4953, DNMT1, 25041, 127491, 237-5087; 4953, DNMT1, 25042, 127492, 181-5079; 4953, DNMT1, 25043, 127493, 754-4596; 4954, DNMT3A, 25057, 127507, 238-2583; 4954, DNMT3A, 25058, 127508, 149-2218; 4954, DNMT3A, 25054, 127504, 339-3077; 4954, DNMT3A, 25055, 127505, 238-2976; 4954, DNMT3A, 25056, 127506, 115-2286; 4954, DNMT3A, 25059, 127509, 339-839; 4955, DNMT3B, 25060, 127510, 265-2802; 4955, DNMT3B, 25061, 127511, 283-2784; 4955, DNMT3B, 25062, 127512, 322-2883; 4955, DNMT3B, 25063, 127513, 283-2595; 4955, DNMT3B, 25064, 127514, 111-2297; 4955, DNMT3B, 25065, 127515, 65-2149; 4956, DNMT3L, 25067, 127517, 151-1014; 4956, DNMT3L, 25068, 127518, 1-545; 4956, DNMT3L, 25066, 127516, 485-1648; 4956, DNMT3L, 25069, 127519, 159-1319; 4957, DCLRE1A, 25070, 127520, 919-4041; 4957, DCLRE1A, 25071, 127521, 696-3818; 4958, DCLRE1B, 25072, 127522, 447-2045; 4959, DCLRE1C, 25074, 127524, 581-833; 4959, DCLRE1C, 25075, 127525, 676-1713; 4959, DCLRE1C, 25084, 127534, 550-901; 4959, DCLRE1C, 25085, 127535, 706-877; 4959, DCLRE1C, 25073, 127523, 253-1986; 4959, DCLRE1C, 25076, 127526, 375-2108; 4959, DCLRE1C, 25077, 127527, 276-2009; 4959, DCLRE1C, 25078, 127528, 530-2248; 4959, DCLRE1C, 25079, 127529, 852-2570; 4959, DCLRE1C, 25080, 127530, 508-2226; 4959, DCLRE1C, 25081, 127531, 39-2117; 4959, DCLRE1C, 25082, 127532, 423-1727; 4959, DCLRE1C, 25083, 127533, 806-2524; 4960, DDIAS, 25087, 127537, 194-870; 4960, DDIAS, 25088, 127538, 242-442; 4960, DDIAS, 25089, 127539, 191-560; 4960, DDIAS, 25090, 127540, 664-889; 4960, DDIAS, 25091, 127541, 104-331; 4960, DDIAS, 25094, 127544, 242-604; 4960, DDIAS, 25095, 127545, 202-564; 4960, DDIAS, 25086, 127536, 51-3047; 4960, DDIAS, 25092, 127542, 213-3209; 4960, DDIAS, 25093, 127543, 456-992; 4961, DFFB, 25096, 127546, 338-1426; 4961, DFFB, 25098, 127548, 1-249; 4961, DFFB, 25099, 127549, 88-330; 4961, DFFB, 25102, 127552, 132-443; 4961, DFFB, 25103, 127553, 1-235; 4961, DFFB, 25104, 127554, 145-492; 4961, DFFB, 25105, 127555, 5-352; 4961, DFFB, 25106, 127556, 338-649; 4961, DFFB, 25097, 127547, 132-482; 4961, DFFB, 25100, 127550, 324-1340; 4961, DFFB, 25101, 127551, 324-1136; 4962, DFFA, 25109, 127559, 22-501; 4962, DFFA, 25107, 127557, 31-837; 4962, DFFA, 25108, 127558, 69-1064; 4963, DMC1, 25111, 127561, 112-721; 4963, DMC1, 25112, 127562, 154-569; 4963, DMC1, 25114, 127564, 176-673; 4963, DMC1, 25110, 127560, 278-1300; 4963, DMC1, 25113, 127563, 154-1011; 4964, DMAP1, 25118, 127568, 1-396; 4964, DMAP1, 25119, 127569, 147-599; 4964, DMAP1, 25120, 127570, 198-909; 4964, DMAP1, 25121, 127571, 101-957; 4964, DMAP1, 25122, 127572, 161-1066; 4964, DMAP1, 25115, 127565, 86-1489; 4964, DMAP1, 25116, 127566, 79-1482; 4964, DMAP1, 25117, 127567, 264-1667; 4965, DNTT, 25123, 127573, 103-1632; 4965, DNTT, 25124, 127574, 90-1616; 4966, DSCC1, 25125, 127575, 216-1397; 4967, DNA2, 25129, 127579, 1-1126; 4967, DNA2, 25130, 127580, 23-142; 4967, DNA2, 25131, 127581, 23-2626; 4967, DNA2, 25126, 127576, 52-3234; 4967, DNA2, 25127, 127577, 90-2153; 4967, DNA2, 25128, 127578, 90-2153; 4968, DDI1, 25132, 127582, 244-1434; 4969, DDI2, 25134, 127584, 1-310; 4969, DDI2, 25135, 127585, 1-300; 4969, DDI2, 25133, 127583, 172-1371; 4970, DRAM1, 25138, 127588, 1-140; 4970, DRAM1, 25139, 127589, 1-160; 4970, DRAM1, 25140, 127590, 100-444; 4970, DRAM1, 25136, 127586, 440-1156; 4970, DRAM1, 25137, 127587, 108-494; 4971, DRAM2, 25143, 127593, 132-332; 4971, DRAM2, 25141, 127591, 619-1419; 4971, DRAM2, 25142, 127592, 258-1058; 4972, DDIT3, 25146, 127596, 210-644; 4972, DDIT3, 25149, 127599, 175-681; 4972, DDIT3, 25144, 127594, 181-690; 4972, DDIT3, 25145, 127595, 142-651; 4972, DDIT3, 25147, 127597, 373-951; 4972, DDIT3, 25148, 127598, 269-847; 4973, DDIT4, 25150, 127600, 202-900; 4974, DDIT4L, 25152, 127602, 170-553; 4974, DDIT4L, 25153, 127603, 322-852; 4974, DDIT4L, 25151, 127601, 216-797; 4975, N/A, 25154, 127604, 41-388; 4976, DNAJA1, 25155, 127605, 184-1377; 4977, DNAJA2, 25157, 127607, 93-236; 4977, DNAJA2, 25158, 127608, 1483-1885; 4977, DNAJA2, 25156, 127606, 217-1455; 4978, DNAJA3, 25162, 127612, 18-386; 4978, DNAJA3, 25163, 127613, 4-558; 4978, DNAJA3, 25164, 127614, 18-314; 4978, DNAJA3, 25165, 127615, 18-251; 4978, DNAJA3, 25168, 127618, 18-314; 4978, DNAJA3, 25169, 127619, 4-558; 4978, DNAJA3, 25170, 127620, 18-251; 4978, DNAJA3, 25171, 127621, 18-386; 4978, DNAJA3, 25159, 127609, 78-1520; 4978, DNAJA3, 25160, 127610, 23-1384; 4978, DNAJA3, 25161, 127611, 188-1090; 4978, DNAJA3, 25166, 127616, 78-1520; 4978, DNAJA3, 25167, 127617, 23-1384; 4979, DNAJA4, 25175, 127625, 50-685; 4979, DNAJA4, 25176, 127626, 32-376; 4979, DNAJA4, 25178, 127628, 170-589; 4979, DNAJA4, 25179, 127629, 156-317; 4979, DNAJA4, 25180, 127630, 32-691; 4979, DNAJA4, 25172, 127622, 32-1225; 4979, DNAJA4, 25173, 127623, 191-1384; 4979, DNAJA4, 25174, 127624, 229-1509; 4979, DNAJA4, 25177, 127627, 63-1175; 4980, DNAJB1, 25183, 127633, 82-569; 4980, DNAJB1, 25184, 127634, 244-593; 4980, DNAJB1, 25185, 127635, 674-995; 4980, DNAJB1, 25186, 127636, 254-601; 4980, DNAJB1, 25187, 127637, 333-882; 4980, DNAJB1, 25188, 127638, 335-573; 4980, DNAJB1, 25189, 127639, 301-573; 4980, DNAJB1, 25190, 127640, 327-567; 4980, DNAJB1, 25181, 127631, 72-1094; 4980, DNAJB1, 25182, 127632, 274-996;

4981, DNAJB11, 25192, 127642, 1-501; 4981, DNAJB11, 25194, 127644, 1-228; 4981, DNAJB11, 25191, 127641, 221-1297; 4981, DNAJB11, 25193, 127643, 930-2006; 4982, DNAJB12, 25195, 127645, 151-1380; 4982, DNAJB12, 25196, 127646, 151-1380; 4982, DNAJB12, 25198, 127648, 1344-1862; 4982, DNAJB12, 25199, 127649, 1-829; 4982, DNAJB12, 25197, 127647, 334-1461; 4983, DNAJB13, 25203, 127653, 1-652; 4983, DNAJB13, 25200, 127650, 752-1702; 4983, DNAJB13, 25201, 127651, 1249-1674; 4983, DNAJB13, 25202, 127652, 371-796; 4984, DNAJB14, 25204, 127654, 18-155; 4984, DNAJB14, 25205, 127655, 1-126; 4984, DNAJB14, 25206, 127656, 1-317; 4984, DNAJB14, 25207, 127657, 25-162; 4984, DNAJB14, 25209, 127659, 1-146; 4984, DNAJB14, 25210, 127660, 10-339; 4984, DNAJB14, 25208, 127658, 156-1295; 4985, DNAJB2, 25213, 127663, 91-823; 4985, DNAJB2, 25214, 127664, 208-652; 4985, DNAJB2, 25215, 127665, 319-686; 4985, DNAJB2, 25216, 127666, 190-585; 4985, DNAJB2, 25217, 127667, 145-828; 4985, DNAJB2, 25211, 127661, 289-1263; 4985, DNAJB2, 25212, 127662, 212-1045; 4986, DNAJB4, 25219, 127669, 171-686; 4986, DNAJB4, 25218, 127668, 258-1271; 4987, DNAJB5, 25221, 127671, 386-484; 4987, DNAJB5, 25222, 127672, 150-615; 4987, DNAJB5, 25225, 127675, 118-435; 4987, DNAJB5, 25226, 127676, 235-851; 4987, DNAJB5, 25228, 127678, 49-683; 4987, DNAJB5, 25220, 127670, 173-1219; 4987, DNAJB5, 25223, 127673, 29-1417; 4987, DNAJB5, 25224, 127674, 382-1644; 4987, DNAJB5, 25227, 127677, 381-1427; 4988, DNAJB6, 25230, 127680, 264-398; 4988, DNAJB6, 25231, 127681, 368-566; 4988, DNAJB6, 25232, 127682, 296-590; 4988, DNAJB6, 25233, 127683, 147-782; 4988, DNAJB6, 25235, 127685, 168-852; 4988, DNAJB6, 25236, 127686, 131-506; 4988, DNAJB6, 25237, 127687, 586-1022; 4988, DNAJB6, 25238, 127688, 126-515; 4988, DNAJB6, 25239, 127689, 149-1153; 4988, DNAJB6, 25240, 127690, 1-1005; 4988, DNAJB6, 25229, 127679, 206-1186; 4988, DNAJB6, 25234, 127684, 206-931; 4989, DNAJB7, 25241, 127691, 133-1062; 4990, DNAJB8, 25242, 127692, 1662-2360; 4990, DNAJB8, 25243, 127693, 2559-3257; 4991, DNAJB9, 25244, 127694, 547-1218; 4992, DNAJC25, 25246, 127696, 49-456; 4992, DNAJC25, 25247, 127697, 49-474; 4992, DNAJC25, 25245, 127695, 57-1139; 4993, DNAJC1, 25249, 127699, 152-481; 4993, DNAJC1, 25248, 127698, 292-1956; 4994, DNAJC10, 25251, 127701, 1-828; 4994, DNAJC10, 25252, 127702, 1-366; 4994, DNAJC10, 25255, 127705, 1-534; 4994, DNAJC10, 25250, 127700, 416-2797; 4994, DNAJC10, 25253, 127703, 21-1019; 4994, DNAJC10, 25254, 127704, 647-2890; 4995, DNAJC11, 25258, 127708, 3-975; 4995, DNAJC11, 25259, 127709, 1-999; 4995, DNAJC11, 25256, 127706, 125-1648; 4995, DNAJC11, 25257, 127707, 125-1804; 4996, DNAJC12, 25262, 127712, 53-226; 4996, DNAJC12, 25263, 127713, 49-735; 4996, DNAJC12, 25264, 127714, 156-278; 4996, DNAJC12, 25260, 127710, 154-750; 4996, DNAJC12, 25261, 127711, 86-409; 4997, DNAJC13, 25266, 127716, 1-522; 4997, DNAJC13, 25267, 127717, 1-290; 4997, DNAJC13, 25265, 127715, 249-6980; 4998, DNAJC14, 25271, 127721, 520-756; 4998, DNAJC14, 25272, 127722, 186-638; 4998, DNAJC14, 25268, 127718, 205-2313; 4998, DNAJC14, 25269, 127719, 440-2548; 4998, DNAJC14, 25270, 127720, 291-2399; 4999, DNAJC15, 25273, 127723, 425-877; 5000, DNAJC16, 25274, 127724, 165-1952; 5000, DNAJC16, 25276, 127726, 165-2132; 5000, DNAJC16, 25277, 127727, 165-1952; 5000, DNAJC16, 25278, 127728, 1-293; 5000, DNAJC16, 25275, 127725, 165-2513; 5000, DNAJC16, 25279, 127729, 916-2328; 5001, DNAJC17, 25281, 127731, 28-459; 5001, DNAJC17, 25282, 127732, 28-423; 5001, DNAJC17, 25283, 127733, 28-336; 5001, DNAJC17, 25284, 127734, 12-407; 5001, DNAJC17, 25285, 127735, 7-384; 5001, DNAJC17, 25286, 127736, 33-428; 5001, DNAJC17, 25280, 127730, 32-946; 5002, DNAJC18, 25288, 127738, 57-191; 5002, DNAJC18, 25289, 127739, 503-1046; 5002, DNAJC18, 25290, 127740, 1-365; 5002, DNAJC18, 25291, 127741, 314-832; 5002, DNAJC18, 25292, 127742, 1-534; 5002, DNAJC18, 25293, 127743, 504-579; 5002, DNAJC18, 25294, 127744, 15-278; 5002, DNAJC18, 25295, 127745, 1-92; 5002, DNAJC18, 25287, 127737, 82-1158; 5003, DNAJC19, 25297, 127747, 102-245; 5003, DNAJC19, 25299, 127749, 168-347; 5003, DNAJC19, 25296, 127746, 172-522; 5003, DNAJC19, 25298, 127748, 260-535; 5003, DNAJC19, 25300, 127750, 132-407; 5004, DNAJC2, 25302, 127752, 177-680; 5004, DNAJC2, 25304, 127754, 290-854; 5004, DNAJC2, 25305, 127755, 209-565; 5004, DNAJC2, 25306, 127756, 1-729; 5004, DNAJC2, 25301, 127751, 45-1751; 5004, DNAJC2, 25303, 127753, 252-2117; 5005, DNAJC21, 25307, 127757, 228-1823; 5005, DNAJC21, 25308, 127758, 228-1958; 5006, DNAJC22, 25309, 127759, 622-1647; 5006, DNAJC22, 25310, 127760, 1205-2230; 5007, DNAJC24, 25311, 127761, 1-89; 5007, DNAJC24, 25312, 127762, 107-556; 5007, DNAJC24, 25313, 127763, 99-233; 5007, DNAJC24, 25314, 127764, 1-128; 5007, DNAJC24, 25315, 127765, 86-217; 5007, DNAJC24, 25316, 127766, 90-347; 5008, DNAJC27, 25317, 127767, 191-1012; 5008, DNAJC27, 25318, 127768, 159-431; 5008, DNAJC27, 25319, 127769, 191-724; 5009, DNAJC28, 25320, 127770, 440-1606; 5009, DNAJC28, 25321, 127771, 151-1317; 5009, DNAJC28, 25322, 127772, 306-1472; 5009, DNAJC28, 25323, 127773, 306-1472; 5009, DNAJC28, 25324, 127774, 440-1606; 5009, DNAJC28, 25325, 127775, 151-1317; 5009, DNAJC28, 25326, 127776, 440-1606; 5009, DNAJC28, 25327, 127777, 440-1606; 5010, DNAJC3, 25328, 127778, 99-1460; 5010, DNAJC3, 25329, 127779, 118-1632; 5011, DNAJC30, 25330, 127780, 31-711; 5012, DNAJC4, 25331, 127781, 98-847; 5012, DNAJC4, 25332, 127782, 289-492; 5012, DNAJC4, 25334, 127784, 1-502; 5012, DNAJC4, 25335, 127785, 204-347; 5012, DNAJC4, 25336, 127786, 466-669; 5012, DNAJC4, 25333, 127783, 466-1191; 5013, DNAJC5, 25337, 127787, 154-750; 5013, DNAJC5, 25338, 127788, 154-657; 5014, DNAJC5B, 25340, 127790, 153-441; 5014, DNAJC5B, 25339, 127789, 288-887; 5015, DNAJC5G, 25344, 127794, 106-627; 5015, DNAJC5G, 25345, 127795, 407-593; 5015, DNAJC5G, 25341, 127791, 419-988; 5015, DNAJC5G, 25342, 127792, 315-884; 5015, DNAJC5G, 25343, 127793, 166-480; 5016, DNAJC6, 25349, 127799, 74-1621; 5016, DNAJC6, 25346, 127796, 370-3072; 5016, DNAJC6, 25347, 127797, 202-3114; 5016, DNAJC6, 25348, 127798, 158-2899; 5017, DNAJC7, 25353, 127803, 48-832; 5017, DNAJC7, 25354, 127804, 1-268; 5017, DNAJC7, 25355, 127805, 345-566; 5017, DNAJC7, 25356, 127806, 372-678; 5017, DNAJC7, 25357, 127807, 204-544; 5017, DNAJC7, 25358, 127808, 317-543; 5017, DNAJC7, 25359, 127809, 4-417; 5017, DNAJC7, 25360, 127810, 309-620; 5017, DNAJC7, 25361, 127811, 8-127; 5017, DNAJC7, 25362, 127812, 204-965; 5017, DNAJC7, 25363, 127813, 1-168; 5017, DNAJC7, 25364, 127814, 203-586; 5017, DNAJC7, 25365, 127815, 8-782; 5017, DNAJC7, 25350, 127800, 83-1399; 5017, DNAJC7, 25351, 127801, 204-1520; 5017, DNAJC7, 25352, 127802, 238-1722; 5018, DNAJC8, 25367, 127817, 1-319; 5018, DNAJC8, 25366, 127816, 28-789; 5019, DNAJC9, 25368, 127818, 1674-2456; 5020, DNAJC25-GNG10, 25369, 127819, 23-484; 5021, DND1, 25370, 127820, 45-1106; 5022, DNLZ, 25372, 127822, 6-359; 5022, DNLZ, 25371, 127821, 76-612; 5023, DOK1, 25376, 127826, 1-266; 5023, DOK1, 25373, 127823, 670-2115; 5023, DOK1, 25374, 127824, 25-558; 5023, DOK1, 25375, 127825, 505-1533; 5024, DOK2, 25378, 127828, 76-774; 5024, DOK2, 25379, 127829, 90-461; 5024, DOK2, 25380, 127830, 155-607; 5024, DOK2, 25377, 127827, 260-1498; 5025, DOK3, 25384, 127834, 351-1673; 5025, DOK3, 25385, 127835, 81-721; 5025, DOK3, 25386, 127836, 108-577; 5025, DOK3, 25387, 127837, 114-545; 5025, DOK3, 25388, 127838, 473-603; 5025, DOK3, 25389, 127839, 213-467; 5025, DOK3, 25390, 127840, 505-543; 5025, DOK3, 25381, 127831, 162-1154; 5025, DOK3, 25382, 127832, 6-1496; 5025, DOK3, 25383, 127833, 241-927; 5026, DOK4, 25392, 127842, 516-751; 5026, DOK4, 25394, 127844, 379-539; 5026, DOK4, 25395, 127845, 299-1396; 5026, DOK4, 25396, 127846, 221-586; 5026, DOK4, 25397, 127847, 259-558; 5026, DOK4, 25398, 127848, 250-429; 5026, DOK4, 25399, 127849, 265-495; 5026, DOK4, 25400, 127850, 210-549; 5026, DOK4, 25401, 127851, 270-579; 5026, DOK4, 25402, 127852, 574-920; 5026, DOK4, 25403, 127853, 226-564; 5026, DOK4, 25404, 127854, 207-546; 5026, DOK4, 25405, 127855, 323-1060; 5026, DOK4, 25406, 127856, 233-580; 5026, DOK4, 25391, 127841, 373-1353; 5026, DOK4, 25393, 127843, 368-1348; 5027, DOK5, 25407, 127857, 351-1271; 5027, DOK5, 25408, 127858, 446-1042; 5028, DOK6, 25410, 127860, 1-470; 5028, DOK6, 25409, 127859, 191-1186; 5029, DOK7, 25411, 127861, 66-1580; 5029, DOK7, 25412, 127862, 66-833; 5030, DOLK, 25413, 127863, 317-1933; 5031, DOLPP1, 25414, 127864, 1-274; 5031, DOLPP1, 25417, 127867, 1-268; 5031, DOLPP1, 25415, 127865, 33-749; 5031, DOLPP1, 25416, 127866, 22-609; 5032, DDOST, 25420, 127870, 42-1361; 5032, DDOST, 25421, 127871, 39-502; 5032, DDOST, 25418, 127868, 107-1477; 5032, DDOST, 25419, 127869, 144-1514; 5033, DPAGT1, 25423, 127873, 224-397; 5033, DPAGT1, 25425, 127875, 206-493; 5033, DPAGT1, 25426, 127876, 1-681; 5033, DPAGT1, 25422, 127872, 488-1714; 5033, DPAGT1, 25424, 127874, 1553-2779; 5034, DPM1, 25427, 127877, 33-896; 5034, DPM1, 25428, 127878, 1-886; 5034, DPM1, 25430, 127880, 10-672; 5034, DPM1, 25429, 127879, 28-810; 5035, DPM2, 25432, 127882, 24-416; 5035, DPM2, 25431, 127881, 665-919; 5036, DPM3, 25433, 127883, 137-415; 5036, DPM3, 25434, 127884, 78-446; 5036, DPM3, 25435, 127885, 60-338; 5037, DDC, 25438, 127888, 1-1085; 5037, DDC, 25439, 127889, 70-759; 5037, DDC, 25443, 127893, 369-460; 5037, DDC, 25444, 127894, 87-1385; 5037, DDC, 25445, 127895, 87-1415; 5037, DDC, 25436, 127886, 70-1512; 5037, DDC, 25437, 127887, 64-1080; 5037, DDC, 25440, 127890, 70-1278; 5037, DDC, 25441, 127891, 35-1198; 5037, DDC, 25442, 127892, 202-1644; 5037, DDC, 25446, 127896, 87-1250; 5038, DCT, 25449, 127899, 1-702; 5038, DCT, 25447, 127897, 415-1974; 5038, DCT, 25448, 127898, 428-2086; 5039, DBH, 25450, 127900, 37-769; 5039, DBH, 25451, 127901, 13-1866; 5040, DRD1, 25452, 127902, 994-2334; 5041, DRD2, 25456, 127906, 183-714; 5041, DRD2, 25457, 127907, 34-1362; 5041, DRD2, 25458, 127908, 422-443; 5041, DRD2, 25453, 127903, 77-1321; 5041, DRD2, 25454, 127904, 346-1677; 5041, DRD2, 25455, 127905, 1-1338; 5041, DRD2, 25459, 127909, 322-1653; 5042, DRD3, 25460, 127910, 432-1535; 5042, DRD3, 25461, 127911, 432-1634; 5042, DRD3, 25462, 127912, 291-1493; 5042, DRD3, 25463, 127913, 346-1548; 5043, DRD4, 25465, 127915, 13-1272; 5043, DRD4, 25464, 127914, 13-1272; 5044, DRD5, 25466, 127916, 351-1784; 5045, DOPEY1, 25468, 127918, 261-7691; 5045, DOPEY1, 25469, 127919, 149-7579; 5045, DOPEY1, 25470, 127920, 1-511; 5045, DOPEY1, 25467, 127917, 261-7658; 5046, DOPEY2, 25471, 127921, 189-623; 5046, DOPEY2, 25472, 127922, 86-6982; 5047, DRAXIN, 25473, 127923, 136-1185; 5048, DRGX, 25474, 127924, 12-803; 5048, DRGX, 25475, 127925, 164-955; 5049, DOT1L, 25477, 127927, 1-624; 5049, DOT1L, 25478, 127928, 1-1962; 5049, DOT1L, 25479, 127929, 1-376; 5049, DOT1L, 25480, 127930, 1-429; 5049, DOT1L, 25481, 127931, 1-209; 5049, DOT1L, 25476, 127926, 37-4650; 5050, DOC2A, 25483, 127933, 316-556; 5050, DOC2A, 25487, 127937, 233-843; 5050, DOC2A, 25488, 127938, 205-858; 5050, DOC2A, 25489, 127939, 403-562; 5050, DOC2A, 25490, 127940, 284-463; 5050, DOC2A, 25491, 127941, 489-527; 5050, DOC2A, 25482, 127932, 192-1394; 5050, DOC2A, 25484, 127934, 284-775; 5050, DOC2A, 25485, 127935, 193-1395; 5050, DOC2A, 25486, 127936, 114-1316; 5050, DOC2A, 25492, 127942, 193-1395; 5051, DOC2B, 25493, 127943, 158-1396; 5051, DOC2B, 25494, 127944, 158-1396; 5052, DUX4, 25495, 127945, 1-483; 5052, DUX4, 25496, 127946, 1-1275; 5052, DUX4, 25497, 127947, 1-1275; 5052, DUX4, 25498, 127948, 1-1275; 5053, DUXA, 25499, 127949, 1-615; 5054, DZANK1, 25501, 127951, 1-1389; 5054, DZANK1, 25502, 127952, 1032-2711; 5054, DZANK1, 25504, 127954, 55-798; 5054, DZANK1, 25505, 127955, 152-721; 5054, DZANK1, 25507, 127957, 235-978; 5054, DZANK1, 25508, 127958, 1-677; 5054, DZANK1, 25509, 127959, 418-837; 5054, DZANK1, 25500, 127950, 210-2468; 5054, DZANK1, 25503, 127953, 24-2282; 5054, DZANK1, 25506, 127956, 381-2105; 5055, DCX, 25512, 127962, 1-1316; 5055, DCX, 25514, 127964, 180-518; 5055, DCX, 25510, 127960, 173-1498; 5055, DCX, 25511, 127961, 101-1198; 5055, DCX, 25513, 127963, 245-1327; 5055, DCX, 25515, 127965, 261-1343; 5056, DCDC1, 25516, 127966, 1-1222; 5056, DCDC1, 25518, 127968, 317-2989; 5056, DCDC1, 25520, 127970, 1-2455; 5056, DCDC1, 25521, 127971, 1-5352; 5056, DCDC1, 25517, 127967, 239-1051; 5056, DCDC1, 25519, 127969, 203-1267; 5057, DCDC2, 25524, 127974, 1-266; 5057, DCDC2, 25522, 127972, 21-710; 5057, DCDC2, 25523, 127973, 303-1733; 5058, DCDC2B, 25525, 127975, 1-1050; 5059, DCDC2C, 25527, 127977, 1-895; 5059, DCDC2C, 25526, 127976, 161-1255; 5060, DCLK1, 25530, 127980, 213-1304; 5060, DCLK1, 25528, 127978, 213-2402; 5060, DCLK1, 25529, 127979, 213-2435; 5060, DCLK1, 25531, 127981, 115-1416; 5060, DCLK1, 25532, 127982, 334-1602; 5061, DCLK2, 25535, 127985, 40-2127; 5061, DCLK2, 25537, 127987, 3-2153; 5061, DCLK2, 25538, 127988, 1-237; 5061, DCLK2, 25533, 127983, 755-3055; 5061, DCLK2, 25534, 127984, 1-2352; 5061, DCLK2, 25536, 127986, 1-2298; 5062, DCLK3, 25539, 127989, 492-2438; 5063, DMRT1, 25541, 127991, 362-1009; 5063, DMRT1, 25540, 127990, 150-1271; 5064, DMRT2, 25543, 127993, 1-1218; 5064, DMRT2, 25548, 127998, 670-1350; 5064, DMRT2, 25542, 127992, 1-681; 5064, DMRT2, 25544, 127994, 1-1686; 5064, DMRT2, 25545, 127995, 330-2015; 5064, DMRT2, 25546, 127996, 330-1010; 5064, DMRT2, 25547, 127997, 466-1146; 5065, DMRT3, 25550, 128000, 162-497; 5065, DMRT3, 25549, 127999, 39-1457; 5066, DSCAM, 25552, 128002, 1-5241; 5066, DSCAM, 25553, 128003, 13-5556; 5066, DSCAM, 25551, 128001, 479-6517; 5067, DSCAML1, 25555, 128005, 13-5544; 5067, DSCAML1, 25556, 128006, 386-583; 5067, DSCAML1, 25554, 128004, 3-6344; 5068, DSCR3, 25558, 128008, 239-988; 5068, DSCR3, 25559

128009, 58-576; 5068, DSCR3, 25557, 128007, 239-1132; 5068, DSCR3, 25560, 128010, 53-865; 5069, DSCR4, 25562, 128012, 85-468; 5069, DSCR4, 25563, 128013, 77-316; 5069, DSCR4, 25561, 128011, 106-462; 5070, DSCR8, 25564, 128014, 150-443; 5070, DSCR8, 25565, 128015, 150-425; 5070, DSCR8, 25566, 128016, 1-294; 5071, DR1, 25567, 128017, 588-1118; 5071, DR1, 25568, 128018, 759-1289; 5072, DONSON, 25569, 128019, 30-1688; 5072, DONSON, 25571, 128021, 30-440; 5072, DONSON, 25572, 128022, 1-477; 5072, DONSON, 25573, 128023, 6-1532; 5072, DONSON, 25574, 128024, 66-1553; 5072, DONSON, 25575, 128025, 1-1613; 5072, DONSON, 25576, 128026, 1-703; 5072, DONSON, 25577, 128027, 1-471; 5072, DONSON, 25578, 128028, 6-638; 5072, DONSON, 25579, 128029, 1-57; 5072, DONSON, 25570, 128020, 68-1768; 5073, DPH2, 25582, 128032, 110-268; 5073, DPH2, 25583, 128033, 167-448; 5073, DPH2, 25584, 128034, 1-789; 5073, DPH2, 25585, 128035, 154-456; 5073, DPH2, 25586, 128036, 169-612; 5073, DPH2, 25587, 128037, 1-106; 5073, DPH2, 25588, 128038, 177-485; 5073, DPH2, 25580, 128030, 173-1642; 5073, DPH2, 25581, 128031, 152-937; 5074, N/A, 25589, 128039, 386-2797; 5074, N/A, 25590, 128040, 234-1109; 5074, N/A, 25591, 128041, 142-2739; 5074, N/A, 25592, 128042, 588-2993; 5074, N/A, 25593, 128043, 404-1465; 5074, N/A, 25594, 128044, 54-2330; 5075, DPY19L1, 25596, 128046, 1-619; 5075, DPY19L1, 25597, 128047, 1-250; 5075, DPY19L1, 25595, 128045, 146-2173; 5075, DPY19L1, 25598, 128048, 177-434; 5076, DPY19L2, 25600, 128050, 1-449; 5076, DPY19L2, 25601, 128051, 350-491; 5076, DPY19L2, 25602, 128052, 230-603; 5076, DPY19L2, 25603, 128053, 234-505; 5076, DPY19L2, 25604, 128054, 150-578; 5076, DPY19L2, 25599, 128049, 185-2461; 5077, DPY19L3, 25607, 128057, 405-713; 5077, DPY19L3, 25608, 128058, 1-928; 5077, DPY19L3, 25609, 128059, 152-529; 5077, DPY19L3, 25610, 128060, 68-2134; 5077, DPY19L3, 25611, 128061, 1-404; 5077, DPY19L3, 25605, 128055, 216-2366; 5077, DPY19L3, 25606, 128056, 199-2349; 5078, DPY19L4, 25613, 128063, 1-340; 5078, DPY19L4, 25614, 128064, 297-680; 5078, DPY19L4, 25615, 128065, 1-204; 5078, DPY19L4, 25616, 128066, 1-226; 5078, DPY19L4, 25617, 128067, 1-828; 5078, DPY19L4, 25618, 128068, 125-259; 5078, DPY19L4, 25619, 128069, 1-573; 5078, DPY19L4, 25612, 128062, 100-2271; 5079, DYDC1, 25622, 128072, 511-750; 5079, DYDC1, 25624, 128074, 372-829; 5079, DYDC1, 25620, 128070, 52-585; 5079, DYDC1, 25621, 128071, 166-699; 5079, DYDC1, 25623, 128073, 127-660; 5080, DYDC2, 25627, 128077, 39-614; 5080, DYDC2, 25629, 128079, 63-439; 5080, DYDC2, 25625, 128075, 187-720; 5080, DYDC2, 25626, 128076, 367-900; 5080, DYDC2, 25628, 128078, 599-1132; 5080, DYDC2, 25630, 128080, 310-843; 5080, DYDC2, 25631, 128081, 68-601; 5081, DPY30, 25632, 128082, 250-549; 5081, DPY30, 25633, 128083, 117-416; 5082, DRAP1, 25635, 128085, 168-806; 5082, DRAP1, 25636, 128086, 75-632; 5082, DRAP1, 25637, 128087, 229-695; 5082, DRAP1, 25638, 128088, 1-486; 5082, DRAP1, 25634, 128084, 246-863; 5083, DBN1, 25642, 128092, 85-456; 5083, DBN1, 25643, 128093, 93-1044; 5083, DBN1, 25644, 128094, 216-1391; 5083, DBN1, 25645, 128095, 199-477; 5083, DBN1, 25639, 128089, 611-2566; 5083, DBN1, 25640, 128090, 221-2170; 5083, DBN1, 25641, 128091, 117-2204; 5084, DBNL, 25646, 128096, 19-207; 5084, DBNL, 25647, 128097, 53-205; 5084, DBNL, 25648, 128098, 1-416; 5084, DBNL, 25649, 128099, 1-1078; 5084, DBNL, 25650, 128100, 31-294; 5084, DBNL, 25651, 128101, 64-147; 5084, DBNL, 25652, 128102, 37-1257; 5084, DBNL, 25653, 128103, 37-132; 5084, DBNL, 25656, 128106, 22-168; 5084, DBNL, 25660, 128110, 37-423; 5084, DBNL, 25661, 128111, 33-155; 5084, DBNL, 25662, 128112, 37-183; 5084, DBNL, 25654, 128104, 99-1391; 5084, DBNL, 25655, 128105, 203-1186; 5084, DBNL, 25657, 128107, 66-1214; 5084, DBNL, 25658, 128108, 28-1347; 5084, DBNL, 25659, 128109, 196-1206; 5084, DBNL, 25663, 128113, 22-1317; 5085, DROSHA, 25666, 128116, 1-1124; 5085, DROSHA, 25669, 128119, 1-585; 5085, DROSHA, 25670, 128120, 257-860; 5085, DROSHA, 25664, 128114, 48-4172; 5085, DROSHA, 25665, 128115, 48-4061; 5085, DROSHA, 25667, 128117, 370-4383; 5085, DROSHA, 25668, 128118, 246-4370; 5086, DSN1, 25672, 128122, 75-929; 5086, DSN1, 25675, 128125, 207-631; 5086, DSN1, 25676, 128126, 422-1146; 5086, DSN1, 25671, 128121, 173-922; 5086, DSN1, 25673, 128123, 170-1240; 5086, DSN1, 25674, 128124, 374-1444; 5086, DSN1, 25677, 128127, 114-1136; 5087, DTWD1, 25681, 128131, 301-583; 5087, DTWD1, 25682, 128132, 99-678; 5087, DTWD1, 25684, 128134, 97-552; 5087, DTWD1, 25685, 128135, 105-413; 5087, DTWD1, 25678, 128128, 208-1122; 5087, DTWD1, 25679, 128129, 199-1113; 5087, DTWD1, 25680, 128130, 142-471; 5087, DTWD1, 25683, 128133, 185-1099; 5088, DTWD2, 25686, 128136, 72-770; 5088, DTWD2, 25687, 128137, 29-637; 5088, DTWD2, 25688, 128138, 29-442; 5088, DTWD2, 25689, 128139, 35-931; 5089, DTD1, 25691, 128141, 27-695; 5089, DTD1, 25690, 128140, 181-810; 5090, DTD2, 25694, 128144, 96-302; 5090, DTD2, 25692, 128142, 118-624; 5090, DTD2, 25693, 128143, 33-539; 5091, DAPP1, 25695, 128145, 82-873; 5091, DAPP1, 25696, 128146, 69-911; 5092, DUOX1, 25699, 128149, 111-1445; 5092, DUOX1, 25701, 128151, 308-436; 5092, DUOX1, 25697, 128147, 408-5063; 5092, DUOX1, 25698, 128148, 155-4810; 5092, DUOX1, 25700, 128150, 274-3867; 5093, DUOX2, 25702, 128152, 387-5033; 5093, DUOX2, 25703, 128153, 204-4850; 5094, DUOXA1, 25705, 128155, 1-1317; 5094, DUOXA1, 25706, 128156, 358-572; 5094, DUOXA1, 25707, 128157, 595-641; 5094, DUOXA1, 25708, 128158, 495-532; 5094, DUOXA1, 25709, 128159, 361-578; 5094, DUOXA1, 25711, 128161, 1-500; 5094, DUOXA1, 25712, 128162, 78-441; 5094, DUOXA1, 25716, 128166, 331-562; 5094, DUOXA1, 25717, 128167, 403-1719; 5094, DUOXA1, 25704, 128154, 401-1852; 5094, DUOXA1, 25710, 128160, 373-1824; 5094, DUOXA1, 25713, 128163, 397-1293; 5094, DUOXA1, 25714, 128164, 56-952; 5094, DUOXA1, 25715, 128165, 7-1038; 5095, DUOXA2, 25718, 128168, 286-1248; 5095, DUOXA2, 25719, 128169, 133-498; 5096, DSTYK, 25720, 128170, 32-2686; 5096, DSTYK, 25721, 128171, 32-2821; 5096, DSTYK, 25722, 128172, 447-986; 5097, DUSP1, 25723, 128173, 244-1347; 5098, DUSP10, 25725, 128175, 208-408; 5098, DUSP10, 25726, 128176, 137-337; 5098, DUSP10, 25727, 128177, 86-286; 5098, DUSP10, 25724, 128174, 240-1688; 5099, DUSP11, 25729, 128179, 1-453; 5099, DUSP11, 25730, 128180, 7-828; 5099, DUSP11, 25728, 128178, 43-1176; 5100, DUSP12, 25732, 128182, 45-458; 5100, DUSP12, 25733, 128183, 23-436; 5100, DUSP12, 25734, 128184, 76-324; 5100, DUSP12, 25731, 128181, 33-1055; 5101, DUSP13, 25738, 128188, 1-444; 5101, DUSP13, 25744, 128194, 91-1095; 5101, DUSP13, 25745, 128195, 113-775; 5101, DUSP13, 25746, 128196, 50-628; 5101, DUSP13, 25748, 128198, 1-780; 5101, DUSP13, 25735, 128185, 29-211; 5101, DUSP13, 25737, 128187, 65-631; 5101, DUSP13, 25741, 128191, 34-237; 5101, DUSP13, 25742, 128192, 56-556; 5101, DUSP13, 25743, 128193, 62-340;

5101, DUSP13, 25736, 128186, 35-781; 5101, DUSP13, 25739, 128189, 931-1527; 5101, DUSP13, 25740, 128190, 80-676; 5101, DUSP13, 25747, 128197, 188-784; 5102, DUSP14, 25753, 128203, 345-941; 5102, DUSP14, 25754, 128204, 979-1575; 5102, DUSP14, 25749, 128199, 979-1575; 5102, DUSP14, 25750, 128200, 309-905; 5102, DUSP14, 25751, 128201, 309-905; 5102, DUSP14, 25752, 128202, 345-941; 5103, DUSP15, 25760, 128210, 236-464; 5103, DUSP15, 25761, 128211, 1-281; 5103, DUSP15, 25755, 128205, 78-965; 5103, DUSP15, 25756, 128206, 411-1118; 5103, DUSP15, 25757, 128207, 43-741; 5103, DUSP15, 25758, 128208, 478-876; 5103, DUSP15, 25759, 128209, 522-920; 5103, DUSP15, 25762, 128212, 917-1315; 5104, DUSP16, 25765, 128215, 568-585; 5104, DUSP16, 25766, 128216, 492-566; 5104, DUSP16, 25767, 128217, 492-566; 5104, DUSP16, 25768, 128218, 633-1064; 5104, DUSP16, 25769, 128219, 568-585; 5104, DUSP16, 25770, 128220, 633-2630; 5104, DUSP16, 25763, 128213, 633-1064; 5104, DUSP16, 25764, 128214, 633-2630; 5105, DUSP18, 25772, 128222, 669-1157; 5105, DUSP18, 25774, 128224, 472-825; 5105, DUSP18, 25777, 128227, 1-21; 5105, DUSP18, 25778, 128228, 625-657; 5105, DUSP18, 25779, 128229, 1-70; 5105, DUSP18, 25771, 128221, 507-1073; 5105, DUSP18, 25773, 128223, 426-992; 5105, DUSP18, 25775, 128225, 460-1026; 5105, DUSP18, 25776, 128226, 1132-1698; 5106, DUSP19, 25780, 128230, 376-876; 5106, DUSP19, 25781, 128231, 176-829; 5107, DUSP2, 25782, 128232, 87-1031; 5108, DUSP21, 25783, 128233, 130-702; 5109, DUSP22, 25786, 128236, 204-344; 5109, DUSP22, 25787, 128237, 180-405; 5109, DUSP22, 25788, 128238, 1-165; 5109, DUSP22, 25789, 128239, 410-465; 5109, DUSP22, 25790, 128240, 1114-1422; 5109, DUSP22, 25791, 128241, 493-801; 5109, DUSP22, 25792, 128242, 408-716; 5109, DUSP22, 25793, 128243, 323-463; 5109, DUSP22, 25794, 128244, 79-243; 5109, DUSP22, 25784, 128234, 444-998; 5109, DUSP22, 25785, 128235, 79-696; 5110, DUSP23, 25795, 128245, 99-551; 5110, DUSP23, 25796, 128246, 37-489; 5110, DUSP23, 25797, 128247, 72-524; 5111, DUSP26, 25800, 128250, 293-729; 5111, DUSP26, 25798, 128248, 519-1154; 5111, DUSP26, 25799, 128249, 573-1208; 5112, DUSP27, 25801, 128251, 121-3597; 5112, DUSP27, 25802, 128252, 167-3643; 5112, DUSP27, 25803, 128253, 1-3477; 5113, DUSP28, 25806, 128256, 1-424; 5113, DUSP28, 25804, 128254, 632-1162; 5113, DUSP28, 25805, 128255, 384-914; 5114, DUSP3, 25808, 128258, 1-338; 5114, DUSP3, 25809, 128259, 12-149; 5114, DUSP3, 25810, 128260, 1-397; 5114, DUSP3, 25807, 128257, 65-622; 5115, DUSP4, 25811, 128261, 391-1575; 5115, DUSP4, 25812, 128262, 1561-2472; 5116, DUSP5, 25813, 128263, 285-1439; 5117, DUSP6, 25816, 128266, 217-567; 5117, DUSP6, 25817, 128267, 122-892; 5117, DUSP6, 25814, 128264, 1233-2378; 5117, DUSP6, 25815, 128265, 367-1074; 5118, DUSP7, 25819, 128269, 1-828; 5118, DUSP7, 25818, 128268, 185-1444; 5119, DUSP8, 25820, 128270, 111-1988; 5119, DUSP8, 25821, 128271, 129-2006; 5119, DUSP8, 25822, 128272, 111-1988; 5119, DUSP8, 25823, 128273, 111-1988; 5119, DUSP8, 25824, 128274, 129-2006; 5119, DUSP8, 25825, 128275, 129-2006; 5120, DUSP9, 25826, 128276, 266-1420; 5120, DUSP9, 25827, 128277, 114-1268; 5121, DUPD1, 25829, 128279, 1-663; 5121, DUPD1, 25828, 128278, 1-663; 5122, DYRK1A, 25834, 128284, 201-338; 5122, DYRK1A, 25835, 128285, 125-519; 5122, DYRK1A, 25830, 128280, 1471-3735; 5122, DYRK1A, 25831, 128281, 230-1984; 5122, DYRK1A, 25832, 128282, 1-1590; 5122, DYRK1A, 25833, 128283, 76-2367; 5123, DYRK1B, 25840, 128290, 140-657; 5123, DYRK1B, 25841, 128291, 232-645; 5123, DYRK1B, 25844, 128294, 232-645; 5123, DYRK1B, 25847, 128297, 140-657; 5123, DYRK1B, 25836, 128286, 281-2086; 5123, DYRK1B, 25837, 128287, 281-2170; 5123, DYRK1B, 25838, 128288, 238-2007; 5123, DYRK1B, 25839, 128289, 470-2359; 5123, DYRK1B, 25842, 128292, 1-1806; 5123, DYRK1B, 25843, 128293, 281-2170; 5123, DYRK1B, 25845, 128295, 470-2359; 5123, DYRK1B, 25846, 128296, 281-2086; 5123, DYRK1B, 25848, 128298, 1-1806; 5123, DYRK1B, 25849, 128299, 238-2007; 5124, DYRK2, 25850, 128300, 286-566; 5124, DYRK2, 25853, 128303, 99-568; 5124, DYRK2, 25854, 128304, 59-560; 5124, DYRK2, 25851, 128301, 414-2219; 5124, DYRK2, 25852, 128302, 427-2013; 5125, DYRK3, 25858, 128308, 140-870; 5125, DYRK3, 25855, 128305, 474-2180; 5125, DYRK3, 25856, 128306, 280-1986; 5125, DYRK3, 25857, 128307, 169-1935; 5126, DYRK4, 25860, 128310, 1-361; 5126, DYRK4, 25861, 128311, 24-155; 5126, DYRK4, 25862, 128312, 43-1947; 5126, DYRK4, 25864, 128314, 37-243; 5126, DYRK4, 25865, 128315, 33-212; 5126, DYRK4, 25859, 128309, 143-1705; 5126, DYRK4, 25863, 128313, 161-1723; 5127, DYM, 25868, 128318, 176-295; 5127, DYM, 25869, 128319, 80-568; 5127, DYM, 25870, 128320, 151-568; 5127, DYM, 25871, 128321, 1-366; 5127, DYM, 25872, 128322, 284-508; 5127, DYM, 25873, 128323, 205-555; 5127, DYM, 25874, 128324, 226-554; 5127, DYM, 25875, 128325, 1-203; 5127, DYM, 25876, 128326, 141-566; 5127, DYM, 25877, 128327, 141-564; 5127, DYM, 25866, 128316, 459-2468; 5127, DYM, 25867, 128317, 322-1761; 5128, DCTN1, 25883, 128333, 91-3861; 5128, DCTN1, 25884, 128334, 337-598; 5128, DCTN1, 25885, 128335, 330-521; 5128, DCTN1, 25886, 128336, 152-556; 5128, DCTN1, 25887, 128337, 264-627; 5128, DCTN1, 25888, 128338, 521-561; 5128, DCTN1, 25889, 128339, 315-542; 5128, DCTN1, 25890, 128340, 366-593; 5128, DCTN1, 25891, 128341, 6-565; 5128, DCTN1, 25892, 128342, 93-2765; 5128, DCTN1, 25893, 128343, 370-4140; 5128, DCTN1, 25878, 128328, 319-4155; 5128, DCTN1, 25879, 128329, 319-4134; 5128, DCTN1, 25880, 128330, 313-4023; 5128, DCTN1, 25881, 128331, 263-4024; 5128, DCTN1, 25882, 128332, 384-3803; 5128, DCTN1, 25894, 128344, 384-3818; 5129, DCTN2, 25897, 128347, 90-1037; 5129, DCTN2, 25898, 128348, 1-384; 5129, DCTN2, 25899, 128349, 58-195; 5129, DCTN2, 25901, 128351, 123-580; 5129, DCTN2, 25902, 128352, 1-807; 5129, DCTN2, 25903, 128353, 162-567; 5129, DCTN2, 25904, 128354, 59-892; 5129, DCTN2, 25895, 128345, 79-1299; 5129, DCTN2, 25896, 128346, 110-1321; 5129, DCTN2, 25900, 128350, 269-1474; 5130, DCTN3, 25907, 128357, 1-482; 5130, DCTN3, 25908, 128358, 18-446; 5130, DCTN3, 25910, 128360, 1-456; 5130, DCTN3, 25911, 128361, 5-535; 5130, DCTN3, 25905, 128355, 17-577; 5130, DCTN3, 25906, 128356, 11-541; 5130, DCTN3, 25909, 128359, 60-536; 5131, DCTN4, 25915, 128365, 387-661; 5131, DCTN4, 25916, 128366, 28-288; 5131, DCTN4, 25917, 128367, 236-578; 5131, DCTN4, 25918, 128368, 178-579; 5131, DCTN4, 25919, 128369, 103-363; 5131, DCTN4, 25920, 128370, 43-303; 5131, DCTN4, 25912, 128362, 442-1653; 5131, DCTN4, 25913, 128363, 43-1446; 5131, DCTN4, 25914, 128364, 117-1499; 5132, DCTN5, 25924, 128374, 33-500; 5132, DCTN5, 25925, 128375, 31-258; 5132, DCTN5, 25926, 128376, 68-229; 5132, DCTN5, 25927, 128377, 447-744; 5132, DCTN5, 25921, 128371, 152-700; 5132, DCTN5, 25922, 128372, 73-531; 5132, DCTN5, 25923, 128373, 15-269; 5133, DCTN6, 25929, 128379, 15-236; 5133, DCTN6, 25930, 128380, 10-123; 5133, DCTN6, 25931, 128381, 66-206; 5133, DCTN6, 25932, 128382, 16-528; 5133, DCTN6, 25928, 128378, 88-660; 5134, DYNAP, 25934, 128384, 92-568; 5134, DYNAP, 25933, 128383, 47-679; 5135, DNM1, 25940, 128390, 1-395; 5135, DNM1, 25941, 128391, 55-2562; 5135, DNM1, 25942, 128392, 75-2669; 5135, DNM1, 25943, 128393, 1-161; 5135, DNM1, 25945, 128395, 120-2690; 5135, DNM1, 25935, 128385, 93-2648; 5135, DNM1, 25936, 128386, 120-2714; 5135, DNM1, 25937, 128387, 84-2639; 5135, DNM1, 25938, 128388, 93-2648; 5135, DNM1, 25939, 128389, 57-2651; 5135, DNM1, 25944, 128394, 55-2610; 5136, DNM1L, 25947, 128397, 73-2211; 5136, DNM1L, 25949, 128399, 45-515; 5136, DNM1L, 25950, 128400, 45-587; 5136, DNM1L, 25953, 128403, 45-550; 5136, DNM1L, 25954, 128404, 29-813; 5136, DNM1L, 25955, 128405, 45-560; 5136, DNM1L, 25956, 128406, 1-165; 5136, DNM1L, 25958, 128408, 1-146; 5136, DNM1L, 25959, 128409, 45-398; 5136, DNM1L, 25962, 128412, 45-338; 5136, DNM1L, 25946, 128396, 62-2161; 5136, DNM1L, 25948, 128398, 42-2258; 5136, DNM1L, 25951, 128401, 370-1971; 5136, DNM1L, 25952, 128402, 165-2297; 5136, DNM1L, 25957, 128407, 45-2222; 5136, DNM1L, 25960, 128410, 78-2327; 5136, DNM1L, 25961, 128411, 75-2285; 5137, DNM2, 25967, 128417, 1-868; 5137, DNM2, 25968, 128418, 1-510; 5137, DNM2, 25969, 128419, 1-413; 5137, DNM2, 25970, 128420, 400-551; 5137, DNM2, 25963, 128413, 81-2693; 5137, DNM2, 25964, 128414, 151-2751; 5137, DNM2, 25965, 128415, 113-2725; 5137, DNM2, 25966, 128416, 36-2636; 5137, DNM2, 25971, 128421, 165-2774; 5138, DNM3, 25975, 128425, 1-666; 5138, DNM3, 25976, 128426, 220-1554; 5138, DNM3, 25977, 128427, 129-2048; 5138, DNM3, 25972, 128422, 158-2767; 5138, DNM3, 25973, 128423, 158-2737; 5138, DNM3, 25974, 128424, 160-1827; 5138, DNM3, 25978, 128428, 158-2749; 5139, DNMBP, 25980, 128430, 7-679; 5139, DNMBP, 25979, 128429, 93-4826; 5139, DNMBP, 25981, 128431, 132-2603; 5140, DAW1, 25983, 128433, 637-1746; 5140, DAW1, 25984, 128434, 352-564; 5140, DAW1, 25985, 128435, 49-159; 5140, DAW1, 25982, 128432, 84-1331; 5141, DNHD1, 25988, 128438, 1-1082; 5141, DNHD1, 25989, 128439, 1-477; 5141, DNHD1, 25991, 128441, 1-587; 5141, DNHD1, 25992, 128442, 1-427; 5141, DNHD1, 25993, 128443, 565-581; 5141, DNHD1, 25986, 128436, 565-14826; 5141, DNHD1, 25987, 128437, 663-2456; 5141, DNHD1, 25990, 128440, 1-14262; 5142, DRC1, 25995, 128445, 53-415; 5142, DRC1, 25994, 128444, 75-2297; 5143, DRC3, 25999, 128449, 157-551; 5143, DRC3, 26000, 128450, 1-202; 5143, DRC3, 26002, 128452, 1-234; 5143, DRC3, 26003, 128453, 404-558; 5143, DRC3, 26004, 128454, 75-490; 5143, DRC3, 26005, 128455, 267-573; 5143, DRC3, 26006, 128456, 291-541; 5143, DRC3, 26007, 128457, 1-172; 5143, DRC3, 25996, 128446, 291-1862; 5143, DRC3, 25997, 128447, 167-1540; 5143, DRC3, 25998, 128448, 219-1790; 5143, DRC3, 26001, 128451, 304-1677; 5144, DRC7, 26011, 128461, 74-286; 5144, DRC7, 26012, 128462, 278-436; 5144, DRC7, 26013, 128463, 1-1283; 5144, DRC7, 26014, 128464, 1-479; 5144, DRC7, 26015, 128465, 290-571; 5144, DRC7, 26016, 128466, 80-589; 5144, DRC7, 26008, 128458, 55-2484; 5144, DRC7, 26009, 128459, 222-2846; 5144, DRC7, 26010, 128460, 85-2709; 5145, DNAAF1, 26018, 128468, 1-573; 5145, DNAAF1, 26019, 128469, 132-875; 5145, DNAAF1, 26021, 128471, 1-176; 5145, DNAAF1, 26017, 128467, 125-2302; 5145, DNAAF1, 26020, 128470, 132-1388; 5146, DNAAF2, 26022, 128472, 82-2595; 5146, DNAAF2, 26023, 128473, 82-2451; 5147, DNAAF3, 26024, 128474, 4-1770; 5147, DNAAF3, 26025, 128475, 454-1917; 5147, DNAAF3, 26026, 128476, 35-1660; 5147, DNAAF3, 26027, 128477, 201-537; 5147, DNAAF3, 26028, 128478, 254-570; 5147, DNAAF3, 26031, 128481, 3-1829; 5147, DNAAF3, 26032, 128482, 1-625; 5147, DNAAF3, 26033, 128483, 86-565; 5147, DNAAF3, 26029, 128479, 59-346; 5147, DNAAF3, 26030, 128480, 115-402; 5148, DNAAF5, 26035, 128485, 674-1516; 5148, DNAAF5, 26036, 128486, 1-1972; 5148, DNAAF5, 26037, 128487, 1-585; 5148, DNAAF5, 26034, 128484, 21-2588; 5149, DNAH1, 26039, 128489, 1-579; 5149, DNAH1, 26040, 128490, 1-2787; 5149, DNAH1, 26038, 128488, 262-13059; 5150, DNAH10, 26042, 128492, 1-1947; 5150, DNAH10, 26043, 128493, 45-1003; 5150, DNAH10, 26044, 128494, 572-3484; 5150, DNAH10, 26045, 128495, 1-246; 5150, DNAH10, 26046, 128496, 45-1003; 5150, DNAH10, 26047, 128497, 1-255; 5150, DNAH10, 26048, 128498, 1-9591; 5150, DNAH10, 26049, 128499, 1-1947; 5150, DNAH10, 26041, 128491, 333-13748; 5151, DNAH10OS, 26050, 128500, 402-893; 5152, DNAH11, 26051, 128501, 32-13603; 5152, DNAH11, 26053, 128503, 1-524; 5152, DNAH11, 26054, 128504, 32-13603; 5152, DNAH11, 26052, 128502, 32-13582; 5153, DNAH12, 26057, 128507, 182-2536; 5153, DNAH12, 26058, 128508, 182-12064; 5153, DNAH12, 26059, 128509, 1-2222; 5153, DNAH12, 26060, 128510, 1-165; 5153, DNAH12, 26055, 128505, 182-9460; 5153, DNAH12, 26056, 128506, 182-1555; 5154, DNAH14, 26061, 128511, 1-4444; 5154, DNAH14, 26062, 128512, 1-612; 5154, DNAH14, 26064, 128514, 188-1480; 5154, DNAH14, 26068, 128518, 1-898; 5154, DNAH14, 26070, 128520, 1-380; 5154, DNAH14, 26072, 128522, 1-658; 5154, DNAH14, 26073, 128523, 1-207; 5154, DNAH14, 26074, 128524, 1-393; 5154, DNAH14, 26063, 128513, 34-720; 5154, DNAH14, 26065, 128515, 209-895; 5154, DNAH14, 26066, 128516, 203-1564; 5154, DNAH14, 26067, 128517, 1-13548; 5154, DNAH14, 26069, 128519, 1-10524; 5154, DNAH14, 26071, 128521, 216-13763; 5155, DNAH17, 26076, 128526, 126-13499; 5155, DNAH17, 26077, 128527, 1-4691; 5155, DNAH17, 26075, 128525, 126-13514; 5156, DNAH2, 26081, 128531, 1-784; 5156, DNAH2, 26082, 128532, 1-3476; 5156, DNAH2, 26078, 128528, 15-13298; 5156, DNAH2, 26079, 128529, 1461-14744; 5156, DNAH2, 26080, 128530, 86-2704; 5157, DNAH3, 26083, 128533, 1-12351; 5158, DNAH5, 26084, 128534, 106-13980; 5159, DNAH6, 26087, 128537, 166-1821; 5159, DNAH6, 26085, 128535, 9-12485; 5159, DNAH6, 26086, 128536, 138-12614; 5160, DNAH7, 26091, 128541, 197-559; 5160, DNAH7, 26092, 128542, 1-171; 5160, DNAH7, 26088, 128538, 102-12176; 5160, DNAH7, 26089, 128539, 102-1607; 5160, DNAH7, 26090, 128540, 104-1627; 5161, DNAH8, 26093, 128543, 110-14233; 5161, DNAH8, 26095, 128545, 305-955; 5161, DNAH8, 26096, 128546, 1-404; 5161, DNAH8, 26097, 128547, 1-12567; 5161, DNAH8, 26094, 128544, 255-13727; 5162, DNAH9, 26099, 128549, 1-13233; 5162, DNAH9, 26100, 128550, 1-854; 5162, DNAH9, 26101, 128551, 30-989; 5162, DNAH9, 26102, 128552, 1-264; 5162, DNAH9, 26103, 128553, 1-132; 5162, DNAH9, 26098, 128548, 69-13529; 5162, DNAH9, 26104, 128554, 530-2926; 5163, DNAI1, 26106, 128556, 172-1039; 5163, DNAI1, 26107, 128557, 1-428; 5163, DNAI1, 26108, 128558, 1-527; 5163, DNAI1, 26109, 128559, 255-2366; 5163, DNAI1, 26105, 128555, 172-2271; 5164, DNAI2, 26113, 128563, 102-608; 5164, DNAI2, 26114, 128564, 136-2124; 5164, DNAI2, 26110, 128560, 68-1885; 5164, DNAI2, 26111, 128561, 307-2124; 5164, DNAI2, 26112, 128562, 108-1889; 5165, DNAL1, 26116, 128566, 23-334; 5165, DNAL1, 26117, 128567, 348-504; 5165, DNAL1, 26118, 128568, 1-204; 5165, DNAL1, 26119, 128569, 213-627; 5165, DNAL1, 26122, 128572, 356-526; 5165, DNAL1, 26123, 128573, 445-639; 5165, DNAL1, 26115, 128565, 261-494; 5165, DNAL1, 26120, 128570, 177-632; 5165, DNAL1, 26121, 128571, 42-614; 5166, DNAL4, 26125, 128575, 271-477; 5166, DNAL4, 26124, 128574, 246-563; 5167, DNALI1, 26126, 128576, 11-853; 5168, DYNC1H1, 26128, 128578, 1-539; 5168, DYNC1H1, 26127, 128577, 165-14105; 5169, DYNC1I1, 26133, 128583, 180-530; 5169, DYNC1I1, 26135, 128585, 155-540; 5169, DYNC1I1, 26136, 128586, 320-575; 5169, DYNC1I1, 26137, 128587, 512-2146; 5169, DYNC1I1, 26129, 128579, 194-2131; 5169, DYNC1I1, 26130, 128580, 186-2012; 5169, DYNC1I1, 26131, 128581, 230-2116; 5169, DYNC1I1, 26132, 128582, 187-2064; 5169, DYNC1I1, 26134, 128584, 101-1987; 5169, DYNC1I1, 26138, 128588, 190-1998; 5170, DYNC1I2, 26146, 128596, 179-741; 5170, DYNC1I2, 26147, 128597, 166-808; 5170, DYNC1I2, 26148, 128598, 66-622; 5170, DYNC1I2, 26149, 128599, 66-585; 5170, DYNC1I2, 26150, 128600, 229-980; 5170, DYNC1I2, 26151, 128601, 171-589; 5170, DYNC1I2, 26152, 128602, 12-564; 5170, DYNC1I2, 26153, 128603, 129-582; 5170, DYNC1I2, 26154, 128604, 166-577; 5170, DYNC1I2, 26155, 128605, 237-566; 5170, DYNC1I2, 26156, 128606, 133-1047; 5170, DYNC1I2, 26157, 128607, 92-457; 5170, DYNC1I2, 26139, 128589, 229-2067; 5170, DYNC1I2, 26140, 128590, 168-2084; 5170, DYNC1I2, 26141, 128591, 212-2050; 5170, DYNC1I2, 26142, 128592, 140-2056; 5170, DYNC1I2, 26143, 128593, 167-2059; 5170, DYNC1I2, 26144, 128594, 176-2074; 5170, DYNC1I2, 26145, 128595, 108-2021; 5170, DYNC1I2, 26158, 128608, 137-1972; 5171, DYNC1LI1, 26160, 128610, 47-616; 5171, DYNC1LI1, 26161, 128611, 89-1312; 5171, DYNC1LI1, 26162, 128612, 89-666; 5171, DYNC1LI1, 26159, 128609, 105-1676; 5172, DYNC1LI2, 26165, 128615, 4-819; 5172, DYNC1LI2, 26166, 128616, 11-181; 5172, DYNC1LI2, 26167, 128617, 11-568; 5172, DYNC1LI2, 26168, 128618, 1-504; 5172, DYNC1LI2, 26169, 128619, 1-277; 5172, DYNC1LI2, 26170, 128620, 1-150; 5172, DYNC1LI2, 26171, 128621, 11-133; 5172, DYNC1LI2, 26163, 128613, 208-1686; 5172, DYNC1LI2, 26164, 128614, 11-1258; 5173, DYNC2H1, 26175, 128625, 1-1137; 5173, DYNC2H1, 26176, 128626, 1-675; 5173, DYNC2H1, 26172, 128622, 54-2816; 5173, DYNC2H1, 26173, 128623, 145-13068; 5173, DYNC2H1, 26174, 128624, 1-12945; 5174, DYNC2LI1, 26178, 128628, 1-956; 5174, DYNC2LI1, 26181, 128631, 54-281; 5174, DYNC2LI1, 26182, 128632, 91-375; 5174, DYNC2LI1, 26183, 128633, 91-309; 5174, DYNC2LI1, 26177, 128627, 101-1156; 5174, DYNC2LI1, 26179, 128629, 76-510; 5174, DYNC2LI1, 26180, 128630, 91-696; 5174, DYNC2LI1, 26184, 128634, 58-1116; 5175, DYNLL1, 26188, 128638, 322-525; 5175, DYNLL1, 26190, 128640, 125-328; 5175, DYNLL1, 26192, 128642, 142-345; 5175, DYNLL1, 26193, 128643, 669-794; 5175, DYNLL1, 26194, 128644, 111-254; 5175, DYNLL1, 26185, 128635, 168-437; 5175, DYNLL1, 26186, 128636, 147-416; 5175, DYNLL1, 26187, 128637, 262-531; 5175, DYNLL1, 26189, 128639, 310-579; 5175, DYNLL1, 26191, 128641, 366-635; 5176, DYNLL2, 26195, 128645, 279-548; 5177, DYNLRB1, 26198, 128648, 264-710; 5177, DYNLRB1, 26196, 128646, 16-159; 5177, DYNLRB1, 26197, 128647, 51-341; 5178, DYNLRB2, 26200, 128650, 53-217; 5178, DYNLRB2, 26201, 128651, 85-207; 5178, DYNLRB2, 26202, 128652, 50-184; 5178, DYNLRB2, 26203, 128653, 32-409; 5178, DYNLRB2, 26199, 128649, 121-411; 5179, DYNLT1, 26204, 128654, 31-309; 5179, DYNLT1, 26205, 128655, 2174-2377; 5179, DYNLT1, 26206, 128656, 32-373; 5180, DYNLT3, 26208, 128658, 5-463; 5180, DYNLT3, 26209, 128659, 319-687; 5180, DYNLT3, 26207, 128657, 128-478; 5181, DBNDD1, 26212, 128662, 733-1227; 5181, DBNDD1, 26213, 128663, 1-239; 5181, DBNDD1, 26210, 128660, 133-609; 5181, DBNDD1, 26211, 128661, 75-611; 5181, DBNDD1, 26214, 128664, 11-847; 5182, DBNDD2, 26223, 128673, 1-518; 5182, DBNDD2, 26215, 128665, 81-566; 5182, DBNDD2, 26216, 128666, 123-608; 5182, DBNDD2, 26217, 128667, 156-947; 5182, DBNDD2, 26218, 128668, 582-1067; 5182, DBNDD2, 26219, 128669, 154-492; 5182, DBNDD2, 26220, 128670, 232-1011; 5182, DBNDD2, 26221, 128671, 149-487; 5182, DBNDD2, 26222, 128672, 163-648; 5183, DYSF, 26224, 128674, 278-6520; 5183, DYSF, 26225, 128675, 142-6387; 5183, DYSF, 26226, 128676, 142-6408; 5183, DYSF, 26227, 128677, 142-6450; 5183, DYSF, 26228, 128678, 278-6634; 5183, DYSF, 26229, 128679, 142-6438; 5183, DYSF, 26230, 128680, 142-6480; 5183, DYSF, 26231, 128681, 142-6501; 5183, DYSF, 26232, 128682, 278-6571; 5183, DYSF, 26233, 128683, 278-6583; 5183, DYSF, 26234, 128684, 278-6613; 5184, DKC1, 26236, 128686, 1-229; 5184, DKC1, 26237, 128687, 1-686; 5184, DKC1, 26238, 128688, 76-851; 5184, DKC1, 26239, 128689, 1-623; 5184, DKC1, 26240, 128690, 1-510; 5184, DKC1, 26235, 128685, 211-1755; 5184, DKC1, 26241, 128691, 225-1487; 5185, DYX1C1, 26246, 128696, 13-453; 5185, DYX1C1, 26247, 128697, 41-256; 5185, DYX1C1, 26242, 128692, 273-1535; 5185, DYX1C1, 26243, 128693, 369-1631; 5185, DYX1C1, 26244, 128694, 49-1179; 5185, DYX1C1, 26245, 128695, 20-1165; 5186, DST, 26249, 128699, 127-16740; 5186, DST, 26250, 128700, 9-22394; 5186, DST, 26251, 128701, 42-17069; 5186, DST, 26253, 128703, 521-16648; 5186, DST, 26254, 128704, 42-2108; 5186, DST, 26255, 128705, 521-17014; 5186, DST, 26257, 128707, 1-530; 5186, DST, 26258, 128708, 166-565; 5186, DST, 26259, 128709, 84-545; 5186, DST, 26260, 128710, 1-372; 5186, DST, 26261, 128711, 73-3504; 5186, DST, 26262, 128712, 1-779; 5186, DST, 26263, 128713, 162-4598; 5186, DST, 26264, 128714, 1-1346; 5186, DST, 26265, 128715, 1-912; 5186, DST, 26266, 128716, 1-5024; 5186, DST, 26267, 128717, 550-569; 5186, DST, 26248, 128698, 209-15724; 5186, DST, 26252, 128702, 109-8058; 5186, DST, 26256, 128706, 1-9180; 5187, DTNBP1, 26270, 128720, 190-1194; 5187, DTNBP1, 26271, 128721, 72-498; 5187, DTNBP1, 26272, 128722, 52-192; 5187, DTNBP1, 26273, 128723, 190-330; 5187, DTNBP1, 26274, 128724, 139-273; 5187, DTNBP1, 26275, 128725, 162-788; 5187, DTNBP1, 26276, 128726, 255-842; 5187, DTNBP1, 26277, 128727, 152-843; 5187, DTNBP1, 26278, 128728, 190-1140; 5187, DTNBP1, 26268, 128718, 174-1229; 5187, DTNBP1, 26269, 128719, 107-1018; 5188, DTNA, 26288, 128738, 521-576; 5188, DTNA, 26289, 128739, 246-604; 5188, DTNA, 26290, 128740, 434-534; 5188, DTNA, 26291, 128741, 458-587; 5188, DTNA, 26293, 128743, 244-556; 5188, DTNA, 26294, 128744, 228-555; 5188, DTNA, 26295, 128745, 284-682; 5188, DTNA, 26296, 128746, 276-578; 5188, DTNA, 26299, 128749, 448-1545; 5188, DTNA, 26301, 128751, 279-767; 5188, DTNA, 26302, 128752, 63-572; 5188, DTNA, 26279, 128729, 346-1704; 5188, DTNA, 26280, 128730, 352-2412; 5188, DTNA, 26281, 128731, 325-1449; 5188, DTNA, 26282, 128732, 164-1867; 5188, DTNA, 26283, 128733, 1-2232; 5188, DTNA, 26284, 128734, 308-2380; 5188, DTNA, 26285, 128735, 2-2233;

5188, DTNA, 26286, 128736, 308-1423; 5188, DTNA, 26287, 128737, 335-1522; 5188, DTNA, 26292, 128742, 336-1511; 5188, DTNA, 26297, 128747, 338-1300; 5188, DTNA, 26298, 128748, 327-2501; 5188, DTNA, 26300, 128750, 58-2118; 5188, DTNA, 26303, 128753, 335-913; 5188, DTNA, 26304, 128754, 58-1599; 5188, DTNA, 26305, 128755, 301-2352; 5188, DTNA, 26306, 128756, 151-1683; 5189, DTNB, 26307, 128757, 264-2126; 5189, DTNB, 26308, 128758, 258-822; 5189, DTNB, 26309, 128759, 169-565; 5189, DTNB, 26310, 128760, 213-404; 5189, DTNB, 26311, 128761, 167-616; 5189, DTNB, 26317, 128767, 178-1950; 5189, DTNB, 26312, 128762, 251-2134; 5189, DTNB, 26313, 128763, 251-1954; 5189, DTNB, 26314, 128764, 251-1933; 5189, DTNB, 26315, 128765, 251-2080; 5189, DTNB, 26316, 128766, 251-2044; 5189, DTNB, 26318, 128768, 306-1943; 5190, DAG1, 26320, 128770, 425-547; 5190, DAG1, 26321, 128771, 197-549; 5190, DAG1, 26322, 128772, 555-841; 5190, DAG1, 26323, 128773, 372-397; 5190, DAG1, 26324, 128774, 517-562; 5190, DAG1, 26325, 128775, 467-731; 5190, DAG1, 26326, 128776, 329-588; 5190, DAG1, 26327, 128777, 260-579; 5190, DAG1, 26328, 128778, 394-550; 5190, DAG1, 26319, 128769, 419-3106; 5190, DAG1, 26329, 128779, 476-3163; 5190, DAG1, 26330, 128780, 559-3246; 5190, DAG1, 26331, 128781, 570-3257; 5190, DAG1, 26332, 128782, 470-3157; 5190, DAG1, 26333, 128783, 723-3410; 5191, DMWD, 26335, 128785, 47-1996; 5191, DMWD, 26336, 128786, 1-195; 5191, DMWD, 26337, 128787, 1-485; 5191, DMWD, 26338, 128788, 1-449; 5191, DMWD, 26339, 128789, 1-309; 5191, DMWD, 26334, 128784, 47-2071; 5192, DMPK, 26345, 128795, 201-437; 5192, DMPK, 26346, 128796, 1-548; 5192, DMPK, 26347, 128797, 123-498; 5192, DMPK, 26348, 128798, 1-567; 5192, DMPK, 26349, 128799, 689-2596; 5192, DMPK, 26340, 128790, 127-2016; 5192, DMPK, 26341, 128791, 545-2464; 5192, DMPK, 26342, 128792, 138-1730; 5192, DMPK, 26343, 128793, 37-1914; 5192, DMPK, 26344, 128794, 128-2002; 5192, DMPK, 26350, 128800, 37-1914; 5193, DMD, 26351, 128801, 177-2495; 5193, DMD, 26352, 128802, 62-2932; 5193, DMD, 26353, 128803, 1-4161; 5193, DMD, 26354, 128804, 1042-4734; 5193, DMD, 26356, 128806, 208-11265; 5193, DMD, 26357, 128807, 196-11241; 5193, DMD, 26360, 128810, 1-714; 5193, DMD, 26361, 128811, 1042-4719; 5193, DMD, 26363, 128813, 1-123; 5193, DMD, 26364, 128814, 1-375; 5193, DMD, 26365, 128815, 1-303; 5193, DMD, 26366, 128816, 1-93; 5193, DMD, 26367, 128817, 1042-4773; 5193, DMD, 26368, 128818, 1-405; 5193, DMD, 26369, 128819, 1042-4389; 5193, DMD, 26370, 128820, 1-11055; 5193, DMD, 26371, 128821, 1-11043; 5193, DMD, 26355, 128805, 79-1947; 5193, DMD, 26358, 128808, 121-1698; 5193, DMD, 26359, 128809, 29-1882; 5193, DMD, 26362, 128812, 124-2031; 5194, DRP2, 26372, 128822, 319-1380; 5194, DRP2, 26373, 128823, 528-3401; 5194, DRP2, 26374, 128824, 269-3142; 5194, DRP2, 26375, 128825, 104-2977; 5194, DRP2, 26376, 128826, 321-2960; 5195, DYTN, 26377, 128827, 118-1854; 5196, EP300, 26379, 128829, 1-401; 5196, EP300, 26380, 128830, 1-559; 5196, EP300, 26378, 128828, 1220-8464; 5197, EP400, 26381, 128831, 1-1124; 5197, EP400, 26382, 128832, 110-2588; 5197, EP400, 26383, 128833, 102-3059; 5197, EP400, 26384, 128834, 153-9524; 5197, EP400, 26385, 128835, 36-9407; 5198, E2F1, 26386, 128836, 141-1454; 5199, E2F2, 26387, 128837, 428-1741; 5199, E2F2, 26388, 128838, 428-1741; 5200, E2F3, 26391, 128841, 424-810; 5200, E2F3, 26389, 128839, 67-1464; 5200, E2F3, 26390, 128840, 137-1141; 5201, E2F4, 26393, 128843, 39-284; 5201, E2F4, 26394, 128844, 21-386; 5201, E2F4, 26395, 128845, 22-459; 5201, E2F4, 26396, 128846, 1-433; 5201, E2F4, 26392, 128842, 60-1301; 5202, E2F5, 26397, 128847, 1-748; 5202, E2F5, 26400, 128850, 402-923; 5202, E2F5, 26402, 128852, 1-549; 5202, E2F5, 26403, 128853, 1-391; 5202, E2F5, 26398, 128848, 35-1075; 5202, E2F5, 26399, 128849, 197-1234; 5202, E2F5, 26401, 128851, 362-919; 5203, E2F6, 26406, 128856, 293-409; 5203, E2F6, 26407, 128857, 1-153; 5203, E2F6, 26408, 128858, 275-442; 5203, E2F6, 26409, 128859, 268-459; 5203, E2F6, 26410, 128860, 278-430; 5203, E2F6, 26404, 128854, 466-1215; 5203, E2F6, 26405, 128855, 271-1116; 5203, E2F6, 26411, 128861, 469-1089; 5203, E2F6, 26412, 128862, 728-1348; 5204, E2F7, 26415, 128865, 1-627; 5204, E2F7, 26416, 128866, 224-2302; 5204, E2F7, 26417, 128867, 225-570; 5204, E2F7, 26418, 128868, 1-659; 5204, E2F7, 26413, 128863, 237-2972; 5204, E2F7, 26414, 128864, 220-2406; 5205, E2F8, 26421, 128871, 302-719; 5205, E2F8, 26419, 128869, 514-3117; 5205, E2F8, 26420, 128870, 234-2837; 5205, E2F8, 26422, 128872, 324-2927; 5206, EAPP, 26424, 128874, 160-774; 5206, EAPP, 26425, 128875, 71-400; 5206, EAPP, 26426, 128876, 84-779; 5206, EAPP, 26423, 128873, 83-940; 5207, E4F1, 26428, 128878, 124-940; 5207, E4F1, 26429, 128879, 1-626; 5207, E4F1, 26430, 128880, 35-1858; 5207, E4F1, 26431, 128881, 21-1985; 5207, E4F1, 26427, 128877, 49-2403; 5208, ELF1, 26433, 128883, 832-903; 5208, ELF1, 26434, 128884, 427-1512; 5208, ELF1, 26436, 128886, 189-563; 5208, ELF1, 26437, 128887, 271-2116; 5208, ELF1, 26432, 128882, 316-2175; 5208, ELF1, 26435, 128885, 172-1959; 5209, ELF2, 26442, 128892, 148-882; 5209, ELF2, 26443, 128893, 485-766; 5209, ELF2, 26444, 128894, 35-611; 5209, ELF2, 26438, 128888, 307-1908; 5209, ELF2, 26439, 128889, 225-1739; 5209, ELF2, 26440, 128890, 231-2012; 5209, ELF2, 26441, 128891, 504-2249; 5209, ELF2, 26445, 128895, 136-1701; 5210, ELF3, 26449, 128899, 72-769; 5210, ELF3, 26446, 128896, 3193-4308; 5210, ELF3, 26447, 128897, 243-1358; 5210, ELF3, 26448, 128898, 199-1314; 5211, ELF4, 26452, 128902, 177-406; 5211, ELF4, 26453, 128903, 103-2091; 5211, ELF4, 26450, 128900, 381-2372; 5211, ELF4, 26451, 128901, 307-2298; 5212, ELF5, 26458, 128908, 231-794; 5212, ELF5, 26454, 128904, 129-896; 5212, ELF5, 26455, 128905, 231-1028; 5212, ELF5, 26456, 128906, 134-616; 5212, ELF5, 26457, 128907, 94-510; 5213, EBF1, 26461, 128911, 284-1855; 5213, EBF1, 26462, 128912, 12-1235; 5213, EBF1, 26459, 128909, 284-2059; 5213, EBF1, 26460, 128910, 216-1898; 5214, EBF2, 26463, 128913, 358-1641; 5214, EBF2, 26464, 128914, 539-2266; 5214, EBF2, 26465, 128915, 1-795; 5215, EBF3, 26468, 128918, 1-574; 5215, EBF3, 26466, 128916, 74-1864; 5215, EBF3, 26467, 128917, 74-1729; 5216, EBF4, 26469, 128919, 1-1866; 5216, EBF4, 26470, 128920, 269-2065; 5216, EBF4, 26471, 128921, 269-1891; 5216, EBF4, 26473, 128923, 1-534; 5216, EBF4, 26472, 128922, 73-1881; 5217, EEA1, 26475, 128925, 262-384; 5217, EEA1, 26476, 128926, 415-542; 5217, EEA1, 26477, 128927, 197-328; 5217, EEA1, 26474, 128924, 266-4501; 5218, EGR1, 26478, 128928, 273-1904; 5219, EGR2, 26479, 128929, 327-1757; 5219, EGR2, 26480, 128930, 388-1668; 5219, EGR2, 26481, 128931, 210-1640; 5220, EGR3, 26483, 128933, 235-450; 5220, EGR3, 26482, 128932, 359-1522; 5220, EGR3, 26484, 128934, 74-1123; 5221, EGR4, 26485, 128935, 389-1849; 5221, EGR4, 26486, 128936, 76-1845; 5222, EBNA1BP2, 26488, 128938, 150-1235; 5222, EBNA1BP2, 26487, 128937, 143-1063; 5223, ECD, 26490, 128940, 248-884; 5223, ECD, 26493, 128943, 227-877; 5223, ECD, 26494, 128944, 101-

592; 5223, ECD, 26495, 128945, 1-262; 5223, ECD, 26489, 128939, 208-2142; 5223, ECD, 26491, 128941, 220-2025; 5223, ECD, 26492, 128942, 213-2246; 5224, EML1, 26497, 128947, 1092-3503; 5224, EML1, 26499, 128949, 65-322; 5224, EML1, 26500, 128950, 1-230; 5224, EML1, 26501, 128951, 141-1277; 5224, EML1, 26502, 128952, 246-568; 5224, EML1, 26503, 128953, 1-366; 5224, EML1, 26504, 128954, 155-539; 5224, EML1, 26505, 128955, 330-584; 5224, EML1, 26506, 128956, 1-201; 5224, EML1, 26507, 128957, 110-964; 5224, EML1, 26508, 128958, 85-553; 5224, EML1, 26509, 128959, 225-501; 5224, EML1, 26510, 128960, 1-546; 5224, EML1, 26496, 128946, 140-2587; 5224, EML1, 26498, 128948, 135-2639; 5225, EML2, 26512, 128962, 167-1978; 5225, EML2, 26514, 128964, 1-543; 5225, EML2, 26515, 128965, 28-2349; 5225, EML2, 26516, 128966, 150-482; 5225, EML2, 26517, 128967, 1-156; 5225, EML2, 26518, 128968, 20-457; 5225, EML2, 26519, 128969, 1-669; 5225, EML2, 26520, 128970, 278-952; 5225, EML2, 26521, 128971, 1-230; 5225, EML2, 26522, 128972, 1-219; 5225, EML2, 26523, 128973, 1-361; 5225, EML2, 26524, 128974, 155-553; 5225, EML2, 26526, 128976, 16-1299; 5225, EML2, 26527, 128977, 257-551; 5225, EML2, 26528, 128978, 1-276; 5225, EML2, 26529, 128979, 83-526; 5225, EML2, 26530, 128980, 118-542; 5225, EML2, 26511, 128961, 52-2001; 5225, EML2, 26513, 128963, 140-2530; 5225, EML2, 26525, 128975, 186-2738; 5226, EML3, 26531, 128981, 68-2761; 5226, EML3, 26533, 128983, 1-2735; 5226, EML3, 26534, 128984, 1-414; 5226, EML3, 26535, 128985, 239-578; 5226, EML3, 26537, 128987, 215-2254; 5226, EML3, 26538, 128988, 218-599; 5226, EML3, 26540, 128990, 150-2819; 5226, EML3, 26541, 128991, 182-565; 5226, EML3, 26532, 128982, 309-2999; 5226, EML3, 26536, 128986, 851-1435; 5226, EML3, 26539, 128989, 74-2827; 5227, EML4, 26543, 128993, 152-3130; 5227, EML4, 26542, 128992, 263-3208; 5227, EML4, 26544, 128994, 260-3031; 5228, EML5, 26546, 128996, 1-183; 5228, EML5, 26548, 128998, 1-770; 5228, EML5, 26549, 128999, 1-617; 5228, EML5, 26545, 128995, 1-5910; 5228, EML5, 26547, 128997, 250-6183; 5229, EML6, 26550, 129000, 521-6397; 5230, EVI2A, 26551, 129001, 338-1117; 5230, EVI2A, 26552, 129002, 87-797; 5230, EVI2A, 26553, 129003, 401-1111; 5231, EVI2B, 26554, 129004, 156-1502; 5231, EVI2B, 26555, 129005, 222-1568; 5232, EVI5, 26556, 129006, 11-2443; 5232, EVI5, 26557, 129007, 11-2476; 5233, EVI5L, 26560, 129010, 1-417; 5233, EVI5L, 26561, 129011, 1-534; 5233, EVI5L, 26558, 129008, 197-2581; 5233, EVI5L, 26559, 129009, 1-2418; 5234, ECSIT, 26565, 129015, 324-993; 5234, ECSIT, 26566, 129016, 1-178; 5234, ECSIT, 26567, 129017, 1-215; 5234, ECSIT, 26568, 129018, 336-642; 5234, ECSIT, 26569, 129019, 185-258; 5234, ECSIT, 26571, 129021, 316-1119; 5234, ECSIT, 26572, 129022, 191-873; 5234, ECSIT, 26573, 129023, 59-307; 5234, ECSIT, 26562, 129012, 100-990; 5234, ECSIT, 26563, 129013, 137-1432; 5234, ECSIT, 26564, 129014, 135-788; 5234, ECSIT, 26570, 129020, 145-1035; 5235, ENC1, 26575, 129025, 1257-1405; 5235, ENC1, 26577, 129027, 573-584; 5235, ENC1, 26574, 129024, 1132-2901; 5235, ENC1, 26576, 129026, 1215-2765; 5235, ENC1, 26578, 129028, 159-1928; 5235, ENC1, 26579, 129029, 1269-3038; 5236, EDA, 26583, 129033, 148-557; 5236, EDA, 26587, 129037, 4-783; 5236, EDA, 26580, 129030, 243-686; 5236, EDA, 26581, 129031, 243-1418; 5236, EDA, 26582, 129032, 243-1412; 5236, EDA, 26584, 129034, 193-1353; 5236, EDA, 26585, 129035, 243-650; 5236, EDA, 26586, 129036, 243-689; 5237, EDAR, 26588, 129038, 432-1778; 5237, EDAR, 26589, 129039, 432-1874; 5237, EDAR, 26590, 129040, 445-1887; 5238, EDA2R, 26591, 129041, 1-957; 5238, EDA2R, 26592, 129042, 58-951; 5238, EDA2R, 26593, 129043, 11-967; 5238, EDA2R, 26594, 129044, 109-1002; 5239, ENOX1, 26595, 129045, 579-2510; 5239, ENOX1, 26596, 129046, 257-2188; 5240, ENOX2, 26601, 129051, 387-1515; 5240, ENOX2, 26602, 129052, 219-1010; 5240, ENOX2, 26597, 129047, 502-2334; 5240, ENOX2, 26598, 129048, 23-1855; 5240, ENOX2, 26599, 129049, 273-2018; 5240, ENOX2, 26600, 129050, 500-2245; 5241, ENTPD1, 26607, 129057, 62-217; 5241, ENTPD1, 26608, 129058, 278-469; 5241, ENTPD1, 26603, 129053, 284-1816; 5241, ENTPD1, 26604, 129054, 64-1632; 5241, ENTPD1, 26605, 129055, 179-1732; 5241, ENTPD1, 26606, 129056, 196-1404; 5242, N/A, 26609, 129059, 1-1119; 5243, ENTPD2, 26610, 129060, 22-1440; 5243, ENTPD2, 26611, 129061, 49-1536; 5244, ENTPD3, 26615, 129065, 160-551; 5244, ENTPD3, 26612, 129062, 119-1708; 5244, ENTPD3, 26613, 129063, 160-1749; 5244, ENTPD3, 26614, 129064, 62-1420; 5245, ENTPD4, 26616, 129066, 237-1952; 5245, ENTPD4, 26619, 129069, 1-351; 5245, ENTPD4, 26620, 129070, 186-566; 5245, ENTPD4, 26621, 129071, 1-645; 5245, ENTPD4, 26617, 129067, 237-2087; 5245, ENTPD4, 26618, 129068, 237-2063; 5246, ENTPD5, 26623, 129073, 299-574; 5246, ENTPD5, 26624, 129074, 1-242; 5246, ENTPD5, 26625, 129075, 272-904; 5246, ENTPD5, 26626, 129076, 353-1576; 5246, ENTPD5, 26622, 129072, 321-1607; 5247, ENTPD6, 26630, 129080, 1-886; 5247, ENTPD6, 26631, 129081, 1-940; 5247, ENTPD6, 26632, 129082, 73-656; 5247, ENTPD6, 26633, 129083, 45-945; 5247, ENTPD6, 26634, 129084, 130-809; 5247, ENTPD6, 26635, 129085, 315-878; 5247, ENTPD6, 26636, 129086, 1-451; 5247, ENTPD6, 26637, 129087, 127-1440; 5247, ENTPD6, 26638, 129088, 1-932; 5247, ENTPD6, 26639, 129089, 140-1028; 5247, ENTPD6, 26627, 129077, 173-1576; 5247, ENTPD6, 26628, 129078, 183-1634; 5247, ENTPD6, 26629, 129079, 164-1618; 5248, ENTPD7, 26641, 129091, 1-211; 5248, ENTPD7, 26640, 129090, 179-1993; 5249, ENTPD8, 26644, 129094, 1-668; 5249, ENTPD8, 26642, 129092, 185-1561; 5249, ENTPD8, 26643, 129093, 185-1672; 5249, ENTPD8, 26645, 129095, 18-1505; 5250, ENPP1, 26647, 129097, 3-1139; 5250, ENPP1, 26646, 129096, 21-2798; 5251, ENPP2, 26650, 129100, 182-2836; 5251, ENPP2, 26652, 129102, 35-769; 5251, ENPP2, 26653, 129103, 45-533; 5251, ENPP2, 26654, 129104, 87-1583; 5251, ENPP2, 26648, 129098, 60-2651; 5251, ENPP2, 26649, 129099, 51-2798; 5251, ENPP2, 26651, 129101, 1-2667; 5252, ENPP3, 26656, 129106, 84-2075; 5252, ENPP3, 26658, 129108, 82-243; 5252, ENPP3, 26659, 129109, 348-509; 5252, ENPP3, 26655, 129105, 84-2711; 5252, ENPP3, 26657, 129107, 329-2956; 5253, ENPP4, 26660, 129110, 231-1592; 5254, ENPP5, 26661, 129111, 200-1633; 5254, ENPP5, 26662, 129112, 262-1695; 5255, ENPP6, 26664, 129114, 269-852; 5255, ENPP6, 26663, 129113, 143-1465; 5256, ENPP7, 26666, 129116, 1-480; 5256, ENPP7, 26665, 129115, 222-1598; 5257, EPG5, 26668, 129118, 9-1982; 5257, EPG5, 26669, 129119, 9-1019; 5257, EPG5, 26670, 129120, 1-1517; 5257, EPG5, 26671, 129121, 9-2579; 5257, EPG5, 26667, 129117, 36-7775; 5258, EDARADD, 26674, 129124, 407-658; 5258, EDARADD, 26672, 129122, 168-815; 5258, EDARADD, 26673, 129123, 215-832; 5259, EEF1E1-BLOC1S5, 26675, 129125, 10-465; 5260, EFCC1, 26676, 129126, 1-1797; 5261, EFCAB1, 26679, 129129, 1-235; 5261, EFCAB1, 26680, 129130, 151-315; 5261, EFCAB1, 26682, 129132, 1-388; 5261, EFCAB1, 26677, 129127, 82-717; 5261, EFCAB1, 26678, 129128, 161-640;

5261, EFCAB1, 26681, 129131, 118-597; 5262, EFCAB10, 26683, 129133, 24-419; 5262, EFCAB10, 26684, 129134, 34-483; 5262, EFCAB10, 26685, 129135, 228-458; 5262, EFCAB10, 26686, 129136, 38-421; 5263, EFCAB11, 26693, 129143, 1-354; 5263, EFCAB11, 26687, 129137, 30-521; 5263, EFCAB11, 26688, 129138, 91-519; 5263, EFCAB11, 26689, 129139, 167-523; 5263, EFCAB11, 26690, 129140, 201-620; 5263, EFCAB11, 26691, 129141, 115-462; 5263, EFCAB11, 26692, 129142, 71-256; 5264, EFCAB12, 26696, 129146, 143-618; 5264, EFCAB12, 26694, 129144, 164-1882; 5264, EFCAB12, 26695, 129145, 164-1882; 5265, EFCAB13, 26698, 129148, 463-573; 5265, EFCAB13, 26699, 129149, 1-603; 5265, EFCAB13, 26701, 129151, 393-553; 5265, EFCAB13, 26702, 129152, 1165-1477; 5265, EFCAB13, 26703, 129153, 338-355; 5265, EFCAB13, 26697, 129147, 412-3333; 5265, EFCAB13, 26700, 129150, 368-2722; 5266, EFCAB14, 26705, 129155, 1-200; 5266, EFCAB14, 26704, 129154, 978-2465; 5267, EFCAB2, 26706, 129156, 1-664; 5267, EFCAB2, 26709, 129159, 1-158; 5267, EFCAB2, 26710, 129160, 1-383; 5267, EFCAB2, 26712, 129162, 1-395; 5267, EFCAB2, 26707, 129157, 142-951; 5267, EFCAB2, 26708, 129158, 266-754; 5267, EFCAB2, 26711, 129161, 93-494; 5268, EFCAB3, 26715, 129165, 223-710; 5268, EFCAB3, 26716, 129166, 52-574; 5268, EFCAB3, 26713, 129163, 79-1395; 5268, EFCAB3, 26714, 129164, 72-1544; 5269, EFCAB5, 26718, 129168, 240-410; 5269, EFCAB5, 26720, 129170, 257-566; 5269, EFCAB5, 26721, 129171, 1-3558; 5269, EFCAB5, 26723, 129173, 1-2323; 5269, EFCAB5, 26717, 129167, 193-4704; 5269, EFCAB5, 26719, 129169, 130-2910; 5269, EFCAB5, 26722, 129172, 193-2763; 5270, EFCAB6, 26725, 129175, 389-991; 5270, EFCAB6, 26724, 129174, 255-4760; 5270, EFCAB6, 26726, 129176, 266-4315; 5271, EFCAB7, 26727, 129177, 247-2136; 5272, EFCAB8, 26728, 129178, 95-3961; 5272, EFCAB8, 26729, 129179, 1-435; 5273, EFCAB9, 26730, 129180, 2-595; 5274, EFHC1, 26731, 129181, 104-2026; 5274, EFHC1, 26732, 129182, 104-940; 5274, EFHC1, 26733, 129183, 1-1866; 5275, EFHC2, 26734, 129184, 85-2334; 5276, EFHB, 26737, 129187, 207-2077; 5276, EFHB, 26738, 129188, 1-782; 5276, EFHB, 26735, 129185, 163-2664; 5276, EFHB, 26736, 129186, 123-2234; 5277, EFHD1, 26740, 129190, 379-762; 5277, EFHD1, 26742, 129192, 104-487; 5277, EFHD1, 26743, 129193, 1-298; 5277, EFHD1, 26744, 129194, 298-541; 5277, EFHD1, 26745, 129195, 1-429; 5277, EFHD1, 26739, 129189, 478-1197; 5277, EFHD1, 26741, 129191, 104-535; 5278, EFHD2, 26747, 129197, 1-538; 5278, EFHD2, 26746, 129196, 78-800; 5279, EFR3A, 26750, 129200, 438-477; 5279, EFR3A, 26751, 129201, 382-780; 5279, EFR3A, 26748, 129198, 226-2691; 5279, EFR3A, 26749, 129199, 143-2500; 5280, EFR3B, 26752, 129202, 1-1959; 5280, EFR3B, 26755, 129205, 303-2651; 5280, EFR3B, 26753, 129203, 184-2637; 5280, EFR3B, 26754, 129204, 198-2207; 5280, EFR3B, 26756, 129206, 184-2370; 5281, EFEMP1, 26759, 129209, 298-558; 5281, EFEMP1, 26760, 129210, 217-733; 5281, EFEMP1, 26761, 129211, 242-559; 5281, EFEMP1, 26762, 129212, 259-339; 5281, EFEMP1, 26763, 129213, 368-552; 5281, EFEMP1, 26764, 129214, 393-547; 5281, EFEMP1, 26765, 129215, 216-572; 5281, EFEMP1, 26766, 129216, 1-841; 5281, EFEMP1, 26767, 129217, 74-214; 5281, EFEMP1, 26757, 129207, 126-1607; 5281, EFEMP1, 26758, 129208, 437-1918; 5282, EFEMP2, 26769, 129219, 1-163; 5282, EFEMP2, 26770, 129220, 1-208; 5282, EFEMP2, 26771, 129221, 69-1379; 5282, EFEMP2, 26773, 129223, 301-907; 5282, EFEMP2, 26774, 129224, 268-501; 5282, EFEMP2, 26775, 129225, 66-614; 5282, EFEMP2, 26776, 129226, 1-549; 5282, EFEMP2, 26777, 129227, 179-408; 5282, EFEMP2, 26778, 129228, 1-225; 5282, EFEMP2, 26779, 129229, 66-242; 5282, EFEMP2, 26768, 129218, 232-1563; 5282, EFEMP2, 26772, 129222, 137-1468; 5283, EOGT, 26782, 129232, 433-1053; 5283, EOGT, 26783, 129233, 529-924; 5283, EOGT, 26784, 129234, 366-736; 5283, EOGT, 26787, 129237, 42-449; 5283, EOGT, 26780, 129230, 406-1737; 5283, EOGT, 26781, 129231, 744-2327; 5283, EOGT, 26785, 129235, 1-1584; 5283, EOGT, 26786, 129236, 1-1332; 5284, EDIL3, 26788, 129238, 420-1862; 5284, EDIL3, 26789, 129239, 13-1425; 5285, EGFLAM, 26797, 129247, 91-234; 5285, EGFLAM, 26798, 129248, 215-552; 5285, EGFLAM, 26790, 129240, 347-3376; 5285, EGFLAM, 26791, 129241, 342-2669; 5285, EGFLAM, 26792, 129242, 347-3400; 5285, EGFLAM, 26793, 129243, 708-1835; 5285, EGFLAM, 26794, 129244, 271-729; 5285, EGFLAM, 26795, 129245, 153-611; 5285, EGFLAM, 26796, 129246, 280-738; 5286, EGFL6, 26799, 129249, 258-1919; 5286, EGFL6, 26800, 129250, 241-1905; 5287, EGFL7, 26805, 129255, 527-723; 5287, EGFL7, 26801, 129251, 535-1356; 5287, EGFL7, 26802, 129252, 69-890; 5287, EGFL7, 26803, 129253, 912-1733; 5287, EGFL7, 26804, 129254, 316-1137; 5288, EGFL8, 26809, 129259, 51-825; 5288, EGFL8, 26813, 129263, 51-825; 5288, EGFL8, 26816, 129266, 51-825; 5288, EGFL8, 26817, 129267, 51-825; 5288, EGFL8, 26818, 129268, 51-825; 5288, EGFL8, 26819, 129269, 51-825; 5288, EGFL8, 26823, 129273, 51-825; 5288, EGFL8, 26806, 129256, 104-985; 5288, EGFL8, 26807, 129257, 106-987; 5288, EGFL8, 26808, 129258, 106-987; 5288, EGFL8, 26810, 129260, 106-987; 5288, EGFL8, 26811, 129261, 106-987; 5288, EGFL8, 26812, 129262, 104-985; 5288, EGFL8, 26814, 129264, 104-985; 5288, EGFL8, 26815, 129265, 74-955; 5288, EGFL8, 26820, 129270, 106-987; 5288, EGFL8, 26821, 129271, 104-985; 5288, EGFL8, 26822, 129272, 104-985; 5288, EGFL8, 26824, 129274, 106-987; 5288, EGFL8, 26825, 129275, 104-985; 5288, EGFL8, 26826, 129276, 106-987; 5289, EGLN1, 26827, 129277, 3157-4437; 5290, EGLN2, 26830, 129280, 479-709; 5290, EGLN2, 26831, 129281, 303-584; 5290, EGLN2, 26833, 129283, 335-597; 5290, EGLN2, 26834, 129284, 517-935; 5290, EGLN2, 26835, 129285, 288-590; 5290, EGLN2, 26836, 129286, 1-156; 5290, EGLN2, 26837, 129287, 1-290; 5290, EGLN2, 26838, 129288, 356-572; 5290, EGLN2, 26839, 129289, 100-477; 5290, EGLN2, 26840, 129290, 373-574; 5290, EGLN2, 26841, 129291, 1-387; 5290, EGLN2, 26828, 129278, 311-1534; 5290, EGLN2, 26829, 129279, 359-1582; 5290, EGLN2, 26832, 129282, 1029-2252; 5291, EGLN3, 26843, 129293, 330-776; 5291, EGLN3, 26844, 129294, 75-512; 5291, EGLN3, 26845, 129295, 612-848; 5291, EGLN3, 26842, 129292, 330-1049; 5292, EHBP1, 26848, 129298, 381-1311; 5292, EHBP1, 26850, 129300, 1-669; 5292, EHBP1, 26851, 129301, 209-533; 5292, EHBP1, 26852, 129302, 463-586; 5292, EHBP1, 26853, 129303, 1-329; 5292, EHBP1, 26854, 129304, 255-539; 5292, EHBP1, 26855, 129305, 1-460; 5292, EHBP1, 26857, 129307, 349-581; 5292, EHBP1, 26846, 129296, 483-4178; 5292, EHBP1, 26847, 129297, 529-4011; 5292, EHBP1, 26849, 129299, 1-3591; 5292, EHBP1, 26856, 129306, 607-4089; 5293, EHBP1L1, 26859, 129309, 258-2267; 5293, EHBP1L1, 26860, 129310, 1-793; 5293, EHBP1L1, 26861, 129311, 242-1643; 5293, EHBP1L1, 26858, 129308, 266-4837; 5294, EHD1, 26864, 129314, 98-1015; 5294, EHD1, 26865, 129315, 61-546; 5294, EHD1, 26866, 129316, 90-534; 5294, EHD1, 26867, 129317, 123-557; 5294, EHD1, 26868, 129318, 70-1191;

5294, EHD1, 26869, 129319, 84-1730; 5294, EHD1, 26862, 129312, 256-1860; 5294, EHD1, 26863, 129313, 412-2016; 5295, EHD2, 26872, 129322, 1-93; 5295, EHD2, 26870, 129320, 252-1883; 5295, EHD2, 26871, 129321, 122-1345; 5296, EHD3, 26874, 129324, 45-1685; 5296, EHD3, 26873, 129323, 286-1893; 5297, EHD4, 26876, 129326, 52-1674; 5297, EHD4, 26875, 129325, 85-1710; 5298, ELAC1, 26878, 129328, 76-747; 5298, ELAC1, 26879, 129329, 133-399; 5298, ELAC1, 26877, 129327, 108-1199; 5299, ELAC2, 26881, 129331, 75-2498; 5299, ELAC2, 26883, 129333, 1-858; 5299, ELAC2, 26884, 129334, 185-581; 5299, ELAC2, 26885, 129335, 136-579; 5299, ELAC2, 26886, 129336, 1-1880; 5299, ELAC2, 26887, 129337, 1-137; 5299, ELAC2, 26888, 129338, 113-479; 5299, ELAC2, 26889, 129339, 140-866; 5299, ELAC2, 26890, 129340, 216-588; 5299, ELAC2, 26891, 129341, 20-496; 5299, ELAC2, 26880, 129330, 241-2721; 5299, ELAC2, 26882, 129332, 53-2413; 5300, ELANE, 26892, 129342, 39-842; 5300, ELANE, 26893, 129343, 142-945; 5300, ELANE, 26894, 129344, 39-842; 5300, ELANE, 26895, 129345, 142-945; 5301, ELN, 26898, 129348, 83-2014; 5301, ELN, 26900, 129350, 400-2760; 5301, ELN, 26906, 129356, 60-563; 5301, ELN, 26907, 129357, 400-2520; 5301, ELN, 26909, 129359, 60-2162; 5301, ELN, 26910, 129360, 88-542; 5301, ELN, 26911, 129361, 13-512; 5301, ELN, 26912, 129362, 26-2170; 5301, ELN, 26913, 129363, 14-542; 5301, ELN, 26914, 129364, 14-220; 5301, ELN, 26915, 129365, 80-962; 5301, ELN, 26916, 129366, 16-658; 5301, ELN, 26917, 129367, 1-183; 5301, ELN, 26918, 129368, 400-2253; 5301, ELN, 26896, 129346, 400-2574; 5301, ELN, 26897, 129347, 1-2274; 5301, ELN, 26899, 129349, 19-2154; 5301, ELN, 26901, 129351, 14-1726; 5301, ELN, 26902, 129352, 48-2240; 5301, ELN, 26903, 129353, 32-2065; 5301, ELN, 26904, 129354, 14-2131; 5301, ELN, 26905, 129355, 31-2007; 5301, ELN, 26908, 129358, 16-2094; 5302, EMILIN1, 26919, 129369, 500-3550; 5302, EMILIN1, 26920, 129370, 1-1043; 5303, EMILIN2, 26921, 129371, 160-3321; 5304, EMILIN3, 26922, 129372, 194-2494; 5305, ELAVL2, 26924, 129374, 69-1238; 5305, ELAVL2, 26927, 129377, 506-777; 5305, ELAVL2, 26928, 129378, 155-723; 5305, ELAVL2, 26923, 129373, 270-1310; 5305, ELAVL2, 26925, 129375, 545-1624; 5305, ELAVL2, 26926, 129376, 276-1355; 5305, ELAVL2, 26929, 129379, 260-1339; 5306, ELAVL3, 26932, 129382, 90-367; 5306, ELAVL3, 26930, 129380, 426-1529; 5306, ELAVL3, 26931, 129381, 18-1100; 5307, ELAVL4, 26933, 129383, 13-1221; 5307, ELAVL4, 26934, 129384, 236-1351; 5307, ELAVL4, 26935, 129385, 316-1473; 5307, ELAVL4, 26936, 129386, 225-1367; 5307, ELAVL4, 26937, 129387, 258-1358; 5307, ELAVL4, 26938, 129388, 83-1183; 5307, ELAVL4, 26939, 129389, 152-1261; 5308, ELAVL1, 26942, 129392, 182-643; 5308, ELAVL1, 26943, 129393, 1-402; 5308, ELAVL1, 26940, 129390, 124-1104; 5308, ELAVL1, 26941, 129391, 131-1111; 5308, ELAVL1, 26944, 129394, 169-1149; 5309, ETFA, 26945, 129395, 61-255; 5309, ETFA, 26947, 129397, 27-716; 5309, ETFA, 26949, 129399, 26-893; 5309, ETFA, 26950, 129400, 85-222; 5309, ETFA, 26951, 129401, 1-717; 5309, ETFA, 26952, 129402, 630-851; 5309, ETFA, 26953, 129403, 9-917; 5309, ETFA, 26954, 129404, 578-697; 5309, ETFA, 26955, 129405, 56-193; 5309, ETFA, 26956, 129406, 1-763; 5309, ETFA, 26957, 129407, 1-141; 5309, ETFA, 26946, 129396, 17-871; 5309, ETFA, 26948, 129398, 82-1083; 5310, ETFB, 26960, 129410, 41-575; 5310, ETFB, 26958, 129408, 93-860; 5310, ETFB, 26959, 129409, 2469-3509; 5311, ETFDH, 26962, 129412, 275-767; 5311, ETFDH, 26963, 129413, 333-446; 5311, ETFDH, 26961, 129411, 119-1831; 5311, ETFDH, 26964, 129414, 333-2186; 5312, ELOF1, 26966, 129416, 159-473; 5312, ELOF1, 26967, 129417, 542-585; 5312, ELOF1, 26968, 129418, 330-692; 5312, ELOF1, 26969, 129419, 198-428; 5312, ELOF1, 26971, 129421, 192-464; 5312, ELOF1, 26972, 129422, 59-403; 5312, ELOF1, 26965, 129415, 65-316; 5312, ELOF1, 26970, 129420, 179-430; 5312, ELOF1, 26973, 129423, 225-476; 5313, ELK1, 26974, 129424, 101-1387; 5313, ELK1, 26975, 129425, 310-597; 5313, ELK1, 26976, 129426, 310-1596; 5314, ELK3, 26978, 129428, 424-539; 5314, ELK3, 26979, 129429, 330-808; 5314, ELK3, 26980, 129430, 1-307; 5314, ELK3, 26981, 129431, 164-592; 5314, ELK3, 26977, 129427, 327-1550; 5315, ELK4, 26985, 129435, 46-477; 5315, ELK4, 26982, 129432, 341-1558; 5315, ELK4, 26983, 129433, 341-1636; 5315, ELK4, 26984, 129434, 272-1567; 5316, ERC1, 26987, 129437, 133-3393; 5316, ERC1, 26992, 129442, 529-3891; 5316, ERC1, 26994, 129444, 529-3459; 5316, ERC1, 26995, 129445, 433-868; 5316, ERC1, 26996, 129446, 278-546; 5316, ERC1, 26997, 129447, 1-269; 5316, ERC1, 26998, 129448, 1-857; 5316, ERC1, 26999, 129449, 244-1275; 5316, ERC1, 26986, 129436, 407-3253; 5316, ERC1, 26988, 129438, 182-3532; 5316, ERC1, 26989, 129439, 158-3424; 5316, ERC1, 26990, 129440, 378-3356; 5316, ERC1, 26991, 129441, 272-3538; 5316, ERC1, 26993, 129443, 207-2369; 5316, ERC1, 27000, 129450, 158-3508; 5316, ERC1, 27001, 129451, 158-2320; 5317, ERC2, 27003, 129453, 1-1585; 5317, ERC2, 27002, 129452, 257-3130; 5317, ERC2, 27004, 129454, 231-3104; 5317, ERC2, 27005, 129455, 231-3104; 5318, EAF1, 27007, 129457, 183-386; 5318, EAF1, 27006, 129456, 426-1232; 5319, EAF2, 27009, 129459, 50-841; 5319, EAF2, 27010, 129460, 104-310; 5319, EAF2, 27011, 129461, 10-117; 5319, EAF2, 27008, 129458, 72-854; 5320, EVC, 27013, 129463, 167-1774; 5320, EVC, 27012, 129462, 185-3163; 5321, EVC2, 27016, 129466, 342-1700; 5321, EVC2, 27017, 129467, 733-4233; 5321, EVC2, 27014, 129464, 733-4419; 5321, EVC2, 27015, 129465, 55-3981; 5322, ELMSAN1, 27020, 129470, 1-1338; 5322, ELMSAN1, 27021, 129471, 362-558; 5322, ELMSAN1, 27022, 129472, 784-3839; 5322, ELMSAN1, 27018, 129468, 784-3921; 5322, ELMSAN1, 27019, 129469, 405-3542; 5322, ELMSAN1, 27023, 129473, 248-3382; 5323, ELMOD1, 27026, 129476, 559-1545; 5323, ELMOD1, 27024, 129474, 266-1270; 5323, ELMOD1, 27025, 129475, 247-1227; 5324, ELMOD2, 27028, 129478, 236-738; 5324, ELMOD2, 27029, 129479, 490-594; 5324, ELMOD2, 27030, 129480, 246-535; 5324, ELMOD2, 27031, 129481, 123-302; 5324, ELMOD2, 27027, 129477, 133-1014; 5325, ELMOD3, 27035, 129485, 387-994; 5325, ELMOD3, 27039, 129489, 850-1209; 5325, ELMOD3, 27041, 129491, 2-136; 5325, ELMOD3, 27044, 129494, 456-710; 5325, ELMOD3, 27045, 129495, 407-895; 5325, ELMOD3, 27046, 129496, 599-977; 5325, ELMOD3, 27032, 129482, 260-1435; 5325, ELMOD3, 27033, 129483, 401-1546; 5325, ELMOD3, 27034, 129484, 633-1778; 5325, ELMOD3, 27036, 129486, 559-1704; 5325, ELMOD3, 27037, 129487, 9-566; 5325, ELMOD3, 27038, 129488, 482-1627; 5325, ELMOD3, 27040, 129490, 120-605; 5325, ELMOD3, 27042, 129492, 9-773; 5325, ELMOD3, 27043, 129493, 2208-2972; 5326, ELL, 27048, 129498, 385-1851; 5326, ELL, 27049, 129499, 62-286; 5326, ELL, 27047, 129497, 73-1938; 5327, ELL3, 27051, 129501, 174-792; 5327, ELL3, 27050, 129500, 643-1836; 5328, EFTUD1, 27054, 129504, 141-317; 5328, EFTUD1, 27055, 129505, 1-417; 5328, EFTUD1, 27056, 129506, 493-542; 5328, EFTUD1, 27057, 129507, 431-521;

5328, EFTUD1, 27052, 129502, 170-3532; 5328, EFTUD1, 27053, 129503, 121-3330; 5329, EFTUD2, 27060, 129510, 107-551; 5329, EFTUD2, 27061, 129511, 244-562; 5329, EFTUD2, 27062, 129512, 1-404; 5329, EFTUD2, 27064, 129514, 1-672; 5329, EFTUD2, 27065, 129515, 1-102; 5329, EFTUD2, 27067, 129517, 1-117; 5329, EFTUD2, 27058, 129508, 78-2891; 5329, EFTUD2, 27059, 129509, 299-3217; 5329, EFTUD2, 27063, 129513, 68-2956; 5329, EFTUD2, 27066, 129516, 399-3317; 5330, ELL2, 27069, 129519, 1-413; 5330, ELL2, 27070, 129520, 128-582; 5330, ELL2, 27071, 129521, 1-196; 5330, ELL2, 27068, 129518, 351-2273; 5331, ELP2, 27077, 129527, 40-195; 5331, ELP2, 27078, 129528, 364-535; 5331, ELP2, 27079, 129529, 55-210; 5331, ELP2, 27080, 129530, 1-144; 5331, ELP2, 27081, 129531, 18-380; 5331, ELP2, 27084, 129534, 10-315; 5331, ELP2, 27072, 129522, 44-2446; 5331, ELP2, 27073, 129523, 15-2480; 5331, ELP2, 27074, 129524, 64-2544; 5331, ELP2, 27075, 129525, 36-2306; 5331, ELP2, 27076, 129526, 37-2712; 5331, ELP2, 27082, 129532, 34-2151; 5331, ELP2, 27083, 129533, 11-2281; 5332, ELP3, 27087, 129537, 1-423; 5332, ELP3, 27088, 129538, 192-317; 5332, ELP3, 27090, 129540, 82-656; 5332, ELP3, 27091, 129541, 220-1647; 5332, ELP3, 27092, 129542, 163-566; 5332, ELP3, 27093, 129543, 207-545; 5332, ELP3, 27094, 129544, 77-214; 5332, ELP3, 27095, 129545, 227-545; 5332, ELP3, 27096, 129546, 114-251; 5332, ELP3, 27097, 129547, 1-201; 5332, ELP3, 27085, 129535, 378-2021; 5332, ELP3, 27086, 129536, 286-1653; 5332, ELP3, 27089, 129539, 126-1727; 5332, ELP3, 27098, 129548, 342-1628; 5333, ELP4, 27101, 129551, 8-1615; 5333, ELP4, 27102, 129552, 15-572; 5333, ELP4, 27099, 129549, 36-1310; 5333, ELP4, 27100, 129550, 16-1446; 5334, ELP5, 27107, 129557, 187-473; 5334, ELP5, 27108, 129558, 1-788; 5334, ELP5, 27109, 129559, 1-325; 5334, ELP5, 27110, 129560, 1-354; 5334, ELP5, 27113, 129563, 236-864; 5334, ELP5, 27114, 129564, 137-827; 5334, ELP5, 27115, 129565, 1-737; 5334, ELP5, 27117, 129567, 381-510; 5334, ELP5, 27103, 129553, 108-1058; 5334, ELP5, 27104, 129554, 215-1054; 5334, ELP5, 27105, 129555, 184-1134; 5334, ELP5, 27106, 129556, 218-1168; 5334, ELP5, 27111, 129561, 128-667; 5334, ELP5, 27112, 129562, 218-1057; 5334, ELP5, 27116, 129566, 105-644; 5335, ELP6, 27119, 129569, 120-302; 5335, ELP6, 27120, 129570, 236-442; 5335, ELP6, 27121, 129571, 255-594; 5335, ELP6, 27122, 129572, 259-840; 5335, ELP6, 27123, 129573, 318-557; 5335, ELP6, 27124, 129574, 556-1008; 5335, ELP6, 27125, 129575, 283-579; 5335, ELP6, 27126, 129576, 190-771; 5335, ELP6, 27127, 129577, 233-705; 5335, ELP6, 27118, 129568, 172-972; 5336, ELOVL1, 27128, 129578, 119-958; 5336, ELOVL1, 27129, 129579, 175-933; 5336, ELOVL1, 27130, 129580, 268-1107; 5337, ELOVL2, 27131, 129581, 85-975; 5338, ELOVL3, 27132, 129582, 222-1034; 5339, ELOVL4, 27133, 129583, 302-1246; 5340, ELOVL5, 27137, 129587, 372-1160; 5340, ELOVL5, 27134, 129584, 200-1099; 5340, ELOVL5, 27135, 129585, 119-385; 5340, ELOVL5, 27136, 129586, 372-1352; 5341, ELOVL6, 27140, 129590, 113-409; 5341, ELOVL6, 27141, 129591, 201-610; 5341, ELOVL6, 27142, 129592, 133-458; 5341, ELOVL6, 27138, 129588, 342-1139; 5341, ELOVL6, 27139, 129589, 165-962; 5342, ELOVL7, 27144, 129594, 528-1334; 5342, ELOVL7, 27145, 129595, 86-352; 5342, ELOVL7, 27146, 129596, 242-737; 5342, ELOVL7, 27148, 129598, 69-284; 5342, ELOVL7, 27149, 129599, 235-730; 5342, ELOVL7, 27143, 129593, 150-995; 5342, ELOVL7, 27147, 129597, 316-1161; 5343, EMB, 27151, 129601, 200-1021; 5343, EMB, 27150, 129600, 217-1200; 5343, EMB, 27152, 129602, 308-1141; 5344, EFS, 27153, 129603, 609-2294; 5344, EFS, 27154, 129604, 728-2134; 5344, EFS, 27155, 129605, 609-1787; 5345, EED, 27159, 129609, 478-1563; 5345, EED, 27160, 129610, 1-347; 5345, EED, 27161, 129611, 888-1208; 5345, EED, 27156, 129606, 687-2012; 5345, EED, 27157, 129607, 91-1293; 5345, EED, 27158, 129608, 8-1408; 5346, EMD, 27162, 129612, 213-872; 5346, EMD, 27164, 129614, 125-190; 5346, EMD, 27163, 129613, 289-1053; 5347, EMG1, 27166, 129616, 1-448; 5347, EMG1, 27165, 129615, 32-766; 5348, EMID1, 27168, 129618, 128-1465; 5348, EMID1, 27169, 129619, 128-1396; 5348, EMID1, 27170, 129620, 117-641; 5348, EMID1, 27171, 129621, 81-185; 5348, EMID1, 27172, 129622, 134-769; 5348, EMID1, 27173, 129623, 1-707; 5348, EMID1, 27167, 129617, 189-1520; 5349, EBP, 27174, 129624, 234-714; 5349, EBP, 27175, 129625, 173-609; 5349, EBP, 27176, 129626, 824-1516; 5350, EBPL, 27181, 129631, 40-444; 5350, EBPL, 27177, 129627, 52-672; 5350, EBPL, 27178, 129628, 40-498; 5350, EBPL, 27179, 129629, 34-342; 5350, EBPL, 27180, 129630, 40-333; 5351, EMX1, 27183, 129633, 39-480; 5351, EMX1, 27184, 129634, 425-1054; 5351, EMX1, 27182, 129632, 379-1251; 5352, EMX2, 27187, 129637, 1-210; 5352, EMX2, 27185, 129635, 825-1583; 5352, EMX2, 27186, 129636, 824-1333; 5353, ENAH, 27188, 129638, 27-665; 5353, ENAH, 27191, 129641, 1-727; 5353, ENAH, 27192, 129642, 10-2418; 5353, ENAH, 27189, 129639, 356-2068; 5353, ENAH, 27190, 129640, 453-2228; 5354, EVL, 27196, 129646, 239-583; 5354, EVL, 27197, 129647, 238-883; 5354, EVL, 27198, 129648, 70-435; 5354, EVL, 27199, 129649, 1-314; 5354, EVL, 27200, 129650, 1-639; 5354, EVL, 27201, 129651, 72-446; 5354, EVL, 27202, 129652, 86-590; 5354, EVL, 27203, 129653, 77-928; 5354, EVL, 27193, 129643, 224-1480; 5354, EVL, 27194, 129644, 605-1855; 5354, EVL, 27195, 129645, 284-1456; 5355, ENAM, 27204, 129654, 282-3710; 5356, EXOG, 27206, 129656, 27-350; 5356, EXOG, 27207, 129657, 1-562; 5356, EXOG, 27208, 129658, 242-412; 5356, EXOG, 27209, 129659, 4-435; 5356, EXOG, 27211, 129661, 26-196; 5356, EXOG, 27212, 129662, 4-174; 5356, EXOG, 27213, 129663, 24-464; 5356, EXOG, 27214, 129664, 29-199; 5356, EXOG, 27215, 129665, 97-342; 5356, EXOG, 27216, 129666, 1-324; 5356, EXOG, 27217, 129667, 1-47; 5356, EXOG, 27218, 129668, 27-197; 5356, EXOG, 27205, 129655, 97-1203; 5356, EXOG, 27210, 129660, 24-980; 5357, ENGASE, 27219, 129669, 1-551; 5357, ENGASE, 27220, 129670, 1-1097; 5357, ENGASE, 27222, 129672, 7-447; 5357, ENGASE, 27221, 129671, 1-2232; 5358, EBLN1, 27223, 129673, 39-1139; 5359, EBLN2, 27224, 129674, 424-1242; 5360, ERV3-1, 27225, 129675, 502-2316; 5361, ERVFRD-1, 27226, 129676, 377-1993; 5361, ERVFRD-1, 27227, 129677, 365-1981; 5362, ERVK3-1, 27228, 129678, 279-503; 5362, ERVK3-1, 27229, 129679, 260-589; 5362, ERVK3-1, 27230, 129680, 326-564; 5362, ERVK3-1, 27231, 129681, 245-501; 5362, ERVK3-1, 27232, 129682, 243-536; 5362, ERVK3-1, 27233, 129683, 321-669; 5363, ERVMER34-1, 27234, 129684, 741-2432; 5363, ERVMER34-1, 27235, 129685, 862-2553; 5364, ERW-1, 27236, 129686, 171-1604; 5365, ERW-2, 27237, 129687, 607-2214; 5366, ERVW-1, 27238, 129688, 925-2541; 5366, ERVW-1, 27239, 129689, 762-2378; 5367, ENG, 27242, 129692, 705-2135; 5367, ENG, 27240, 129690, 282-2159; 5367, ENG, 27241, 129691, 402-2378; 5368, EMCN, 27246, 129696, 1-231; 5368, EMCN, 27247, 129697, 89-583; 5368, EMCN, 27243, 129693, 180-965; 5368, EMCN, 27244, 129694, 90-626; 5368, EMCN, 27245, 129695, 88-834; 5369, ENDOD1, 27248, 129698, 119-

1621; 5370, ENDOG, 27249, 129699, 212-1105; 5371, ENDOV, 27251, 129701, 18-335; 5371, ENDOV, 27252, 129702, 175-885; 5371, ENDOV, 27253, 129703, 18-311; 5371, ENDOV, 27255, 129705, 29-445; 5371, ENDOV, 27256, 129706, 395-545; 5371, ENDOV, 27257, 129707, 31-402; 5371, ENDOV, 27258, 129708, 1-395; 5371, ENDOV, 27259, 129709, 1-513; 5371, ENDOV, 27261, 129711, 727-1074; 5371, ENDOV, 27264, 129714, 255-547; 5371, ENDOV, 27265, 129715, 583-607; 5371, ENDOV, 27267, 129717, 244-561; 5371, ENDOV, 27268, 129718, 459-468; 5371, ENDOV, 27269, 129719, 1-329; 5371, ENDOV, 27270, 129720, 391-855; 5371, ENDOV, 27250, 129700, 12-806; 5371, ENDOV, 27254, 129704, 29-877; 5371, ENDOV, 27260, 129710, 29-742; 5371, ENDOV, 27262, 129712, 333-530; 5371, ENDOV, 27263, 129713, 419-616; 5371, ENDOV, 27266, 129716, 344-610; 5371, ENDOV, 27271, 129721, 339-605; 5372, ENDOU, 27272, 129722, 155-1264; 5372, ENDOU, 27273, 129723, 124-1356; 5372, ENDOU, 27274, 129724, 122-1165; 5373, EEPD1, 27276, 129726, 1-103; 5373, EEPD1, 27275, 129725, 719-2428; 5373, EEPD1, 27277, 129727, 541-2250; 5374, ERAP1, 27280, 129730, 197-583; 5374, ERAP1, 27281, 129731, 529-555; 5374, ERAP1, 27282, 129732, 1-434; 5374, ERAP1, 27283, 129733, 92-94; 5374, ERAP1, 27278, 129728, 259-3105; 5374, ERAP1, 27279, 129729, 68-2893; 5375, ERAP2, 27286, 129736, 228-2309; 5375, ERAP2, 27288, 129738, 1-238; 5375, ERAP2, 27290, 129740, 496-582; 5375, ERAP2, 27291, 129741, 1-489; 5375, ERAP2, 27284, 129734, 145-2892; 5375, ERAP2, 27285, 129735, 712-3594; 5375, ERAP2, 27287, 129737, 151-1749; 5375, ERAP2, 27289, 129739, 123-1175; 5376, ERLEC1, 27292, 129742, 132-1583; 5376, ERLEC1, 27293, 129743, 132-1421; 5376, ERLEC1, 27294, 129744, 132-1505; 5377, ERMP1, 27297, 129747, 29-2554; 5377, ERMP1, 27298, 129748, 839-1894; 5377, ERMP1, 27295, 129745, 91-2805; 5377, ERMP1, 27296, 129746, 44-2758; 5378, ERO1A, 27300, 129750, 727-951; 5378, ERO1A, 27301, 129751, 408-1181; 5378, ERO1A, 27302, 129752, 420-1193; 5378, ERO1A, 27303, 129753, 49-426; 5378, ERO1A, 27304, 129754, 49-555; 5378, ERO1A, 27305, 129755, 225-998; 5378, ERO1A, 27299, 129749, 225-1631; 5379, ERO1B, 27306, 129756, 1-522; 5379, ERO1B, 27308, 129758, 391-605; 5379, ERO1B, 27307, 129757, 203-1606; 5380, ERP27, 27310, 129760, 152-670; 5380, ERP27, 27309, 129759, 575-1396; 5381, ERP29, 27313, 129763, 1-284; 5381, ERP29, 27314, 129764, 700-1182; 5381, ERP29, 27311, 129761, 151-936; 5381, ERP29, 27312, 129762, 119-280; 5382, ERP44, 27315, 129765, 201-1421; 5383, ERN1, 27316, 129766, 97-3030; 5383, ERN1, 27317, 129767, 791-1003; 5384, ERN2, 27319, 129769, 40-2664; 5384, ERN2, 27320, 129770, 1-72; 5384, ERN2, 27321, 129771, 36-425; 5384, ERN2, 27322, 129772, 24-266; 5384, ERN2, 27323, 129773, 170-3094; 5384, ERN2, 27318, 129768, 314-3094; 5385, ERGIC1, 27326, 129776, 4-420; 5385, ERGIC1, 27327, 129777, 30-197; 5385, ERGIC1, 27328, 129778, 1-163; 5385, ERGIC1, 27329, 129779, 239-554; 5385, ERGIC1, 27324, 129774, 216-695; 5385, ERGIC1, 27325, 129775, 140-1012; 5386, ENSA, 27332, 129782, 108-530; 5386, ENSA, 27337, 129787, 97-660; 5386, ENSA, 27330, 129780, 108-461; 5386, ENSA, 27331, 129781, 107-520; 5386, ENSA, 27333, 129783, 36-389; 5386, ENSA, 27334, 129784, 108-425; 5386, ENSA, 27335, 129785, 24-425; 5386, ENSA, 27336, 129786, 127-492; 5386, ENSA, 27338, 129788, 112-429; 5386, ENSA, 27339, 129789, 12-353; 5386, ENSA, 27340, 129790, 90-491; 5386, ENSA, 27341, 129791, 33-350; 5387, ESAM, 27343, 129793, 127-864; 5387, ESAM, 27345, 129795, 137-581; 5387, ESAM, 27342, 129792, 131-1303; 5387, ESAM, 27344, 129794, 137-560; 5388, ECSCR, 27346, 129796, 74-691; 5389, N/A, 27347, 129797, 38-655; 5390, ESM1, 27350, 129800, 488-756; 5390, ESM1, 27348, 129798, 77-481; 5390, ESM1, 27349, 129799, 147-701; 5391, EDF1, 27351, 129801, 29-475; 5391, EDF1, 27352, 129802, 9-428; 5391, EDF1, 27353, 129803, 28-453; 5392, EPAS1, 27355, 129805, 289-1067; 5392, EPAS1, 27354, 129804, 511-3123; 5393, EDN1, 27356, 129806, 268-906; 5394, EDN2, 27357, 129807, 71-607; 5395, EDN3, 27360, 129810, 196-774; 5395, EDN3, 27358, 129808, 371-1030; 5395, EDN3, 27359, 129809, 387-1103; 5395, EDN3, 27361, 129811, 370-1086; 5395, EDN3, 27362, 129812, 111-785; 5396, ECE1, 27366, 129816, 51-2267; 5396, ECE1, 27368, 129818, 444-674; 5396, ECE1, 27369, 129819, 272-580; 5396, ECE1, 27370, 129820, 175-578; 5396, ECE1, 27363, 129813, 60-2363; 5396, ECE1, 27364, 129814, 116-2392; 5396, ECE1, 27365, 129815, 76-2388; 5396, ECE1, 27367, 129817, 127-2391; 5397, ECE2, 27376, 129826, 1-204; 5397, ECE2, 27377, 129827, 1-2151; 5397, ECE2, 27371, 129821, 46-813; 5397, ECE2, 27372, 129822, 120-2555; 5397, ECE2, 27373, 129823, 144-2354; 5397, ECE2, 27374, 129824, 1-2652; 5397, ECE2, 27375, 129825, 139-2436; 5398, ECEL1, 27380, 129830, 1-507; 5398, ECEL1, 27378, 129828, 212-2539; 5398, ECEL1, 27379, 129829, 1-2322; 5399, EDNRA, 27381, 129831, 516-1799; 5399, EDNRA, 27382, 129832, 531-1487; 5399, EDNRA, 27383, 129833, 1-957; 5399, EDNRA, 27384, 129834, 701-1309; 5399, EDNRA, 27385, 129835, 1-564; 5400, EDNRB, 27389, 129839, 409-643; 5400, EDNRB, 27386, 129836, 238-1566; 5400, EDNRB, 27387, 129837, 154-1752; 5400, EDNRB, 27388, 129838, 227-1537; 5401, ENHO, 27390, 129840, 427-657; 5402, EN1, 27391, 129841, 512-1690; 5403, EN2, 27392, 129842, 250-1251; 5404, ELMO1, 27396, 129846, 261-503; 5404, ELMO1, 27398, 129848, 1-375; 5404, ELMO1, 27399, 129849, 1-549; 5404, ELMO1, 27400, 129850, 682-858; 5404, ELMO1, 27401, 129851, 74-576; 5404, ELMO1, 27403, 129853, 1-580; 5404, ELMO1, 27404, 129854, 202-650; 5404, ELMO1, 27393, 129843, 649-2832; 5404, ELMO1, 27394, 129844, 150-893; 5404, ELMO1, 27395, 129845, 591-1334; 5404, ELMO1, 27397, 129847, 438-2621; 5404, ELMO1, 27402, 129852, 711-2894; 5405, ELMO2, 27406, 129856, 1-2157; 5405, ELMO2, 27409, 129859, 1-804; 5405, ELMO2, 27410, 129860, 1-852; 5405, ELMO2, 27411, 129861, 154-1168; 5405, ELMO2, 27412, 129862, 1-1325; 5405, ELMO2, 27405, 129855, 196-2358; 5405, ELMO2, 27407, 129857, 470-2368; 5405, ELMO2, 27408, 129858, 107-2269; 5406, ELMO3, 27413, 129863, 58-2328; 5406, ELMO3, 27416, 129866, 3-290; 5406, ELMO3, 27414, 129864, 58-2379; 5406, ELMO3, 27415, 129865, 306-2129; 5407, EDC3, 27419, 129869, 312-588; 5407, EDC3, 27420, 129870, 169-342; 5407, EDC3, 27421, 129871, 1-640; 5407, EDC3, 27422, 129872, 209-967; 5407, EDC3, 27424, 129874, 126-658; 5407, EDC3, 27425, 129875, 386-479; 5407, EDC3, 27426, 129876, 204-574; 5407, EDC3, 27427, 129877, 199-688; 5407, EDC3, 27428, 129878, 1-204; 5407, EDC3, 27429, 129879, 308-471; 5407, EDC3, 27430, 129880, 270-573; 5407, EDC3, 27431, 129881, 318-711; 5407, EDC3, 27417, 129867, 183-1709; 5407, EDC3, 27418, 129868, 464-1990; 5407, EDC3, 27423, 129873, 229-1755; 5408, EDC4, 27433, 129883, 1-465; 5408, EDC4, 27434, 129884, 1-406; 5408, EDC4, 27435, 129885, 1-530; 5408, EDC4, 27432, 129882, 240-4445; 5409, EPC1, 27436, 129886, 271-2781; 5409, EPC1, 27437, 129887, 304-2745; 5409, EPC1, 27438, 129888, 306-2597; 5410, EPC2, 27440, 129890, 192-672; 5410, EPC2, 27441, 129891, 20-385; 5410, EPC2, 27442, 129892, 1-381; 5410, EPC2, 27443, 129893, 244-724; 5410, EPC2, 27439, 129889, 35-2458; 5411, ERH, 27444, 129894, 67-282; 5411, ERH, 27445, 129895, 395-709; 5412, ENY2, 27446, 129896, 69-215; 5412, ENY2, 27447, 129897, 89-244; 5412, ENY2, 27448, 129898, 144-314; 5412, ENY2, 27449, 129899, 73-375; 5412, ENY2, 27450, 129900, 119-280; 5412, ENY2, 27451, 129901, 89-379; 5412, ENY2, 27452, 129902, 146-451; 5413, EZH1, 27454, 129904, 135-2351; 5413, EZH1, 27455, 129905, 133-1022; 5413, EZH1, 27457, 129907, 130-501; 5413, EZH1, 27458, 129908, 1-377; 5413, EZH1, 27459, 129909, 216-535; 5413, EZH1, 27460, 129910, 51-559; 5413, EZH1, 27462, 129912, 130-381; 5413, EZH1, 27463, 129913, 247-745; 5413, EZH1, 27465, 129915, 1-154; 5413, EZH1, 27453, 129903, 123-2366; 5413, EZH1, 27456, 129906, 212-2245; 5413, EZH1, 27461, 129911, 51-2294; 5413, EZH1, 27464, 129914, 124-2247; 5414, EZH2, 27469, 129919, 128-1132; 5414, EZH2, 27470, 129920, 166-600; 5414, EZH2, 27466, 129916, 93-2216; 5414, EZH2, 27467, 129917, 123-2378; 5414, EZH2, 27468, 129918, 173-2260; 5414, EZH2, 27471, 129921, 321-2408; 5414, EZH2, 27472, 129922, 90-2330; 5414, EZH2, 27473, 129923, 132-2345; 5415, ENKD1, 27475, 129925, 286-963; 5415, ENKD1, 27476, 129926, 1-266; 5415, ENKD1, 27474, 129924, 323-1363; 5416, ENKUR, 27478, 129928, 221-988; 5416, ENKUR, 27480, 129930, 167-542; 5416, ENKUR, 27481, 129931, 320-904; 5416, ENKUR, 27477, 129927, 221-991; 5416, ENKUR, 27479, 129929, 225-995; 5417, ENO1, 27483, 129933, 63-647; 5417, ENO1, 27484, 129934, 680-732; 5417, ENO1, 27482, 129932, 121-1425; 5418, ENO2, 27487, 129937, 66-1013; 5418, ENO2, 27490, 129940, 238-547; 5418, ENO2, 27491, 129941, 1-222; 5418, ENO2, 27492, 129942, 1-260; 5418, ENO2, 27485, 129935, 223-1527; 5418, ENO2, 27486, 129936, 627-1931; 5418, ENO2, 27488, 129938, 349-1653; 5418, ENO2, 27489, 129939, 87-1262; 5419, ENO3, 27494, 129944, 120-563; 5419, ENO3, 27495, 129945, 99-561; 5419, ENO3, 27496, 129946, 97-945; 5419, ENO3, 27497, 129947, 67-243; 5419, ENO3, 27500, 129950, 213-656; 5419, ENO3, 27501, 129951, 444-1081; 5419, ENO3, 27502, 129952, 259-343; 5419, ENO3, 27503, 129953, 125-714; 5419, ENO3, 27493, 129943, 133-1437; 5419, ENO3, 27498, 129948, 67-1242; 5419, ENO3, 27499, 129949, 73-1377; 5420, ENO4, 27504, 129954, 56-1933; 5420, ENO4, 27505, 129955, 177-1268; 5420, ENO4, 27507, 129957, 1-415; 5420, ENO4, 27508, 129958, 56-1942; 5420, ENO4, 27506, 129956, 56-982; 5421, ENOSF1, 27512, 129962, 1-290; 5421, ENOSF1, 27513, 129963, 29-1132; 5421, ENOSF1, 27514, 129964, 38-577; 5421, ENOSF1, 27515, 129965, 21-635; 5421, ENOSF1, 27516, 129966, 143-436; 5421, ENOSF1, 27509, 129959, 90-1421; 5421, ENOSF1, 27510, 129960, 39-1391; 5421, ENOSF1, 27511, 129961, 206-1291; 5422, ENOPH1, 27518, 129968, 418-939; 5422, ENOPH1, 27520, 129970, 221-844; 5422, ENOPH1, 27521, 129971, 52-501; 5422, ENOPH1, 27517, 129967, 269-1054; 5422, ENOPH1, 27519, 129969, 375-722; 5423, ECH1, 27523, 129973, 332-440; 5423, ECH1, 27524, 129974, 1-209; 5423, ECH1, 27525, 129975, 18-560; 5423, ECH1, 27526, 129976, 11-124; 5423, ECH1, 27527, 129977, 4-169; 5423, ECH1, 27528, 129978, 1-799; 5423, ECH1, 27529, 129979, 257-308; 5423, ECH1, 27522, 129972, 234-1220; 5424, ECHDC2, 27531, 129981, 31-228; 5424, ECHDC2, 27533, 129983, 113-244; 5424, ECHDC2, 27534, 129984, 102-836; 5424, ECHDC2, 27535, 129985, 351-500; 5424, ECHDC2, 27536, 129986, 46-702; 5424, ECHDC2, 27537, 129987, 318-464; 5424, ECHDC2, 27530, 129980, 54-839; 5424, ECHDC2, 27532, 129982, 95-973; 5425, ECHDC3, 27539, 129989, 124-623; 5425, ECHDC3, 27540, 129990, 132-854; 5425, ECHDC3, 27538, 129988, 212-1123; 5426, ECHS1, 27541, 129991, 357-1229; 5427, ECI1, 27544, 129994, 288-961; 5427, ECI1, 27545, 129995, 742-1473; 5427, ECI1, 27542, 129992, 49-957; 5427, ECI1, 27543, 129993, 7-864; 5428, ECI2, 27546, 129996, 118-1212; 5428, ECI2, 27548, 129998, 31-489; 5428, ECI2, 27549, 129999, 130-1224; 5428, ECI2, 27550, 130000, 112-534; 5428, ECI2, 27551, 130001, 155-814; 5428, ECI2, 27552, 130002, 5-598; 5428, ECI2, 27553, 130003, 287-1381; 5428, ECI2, 27547, 129997, 38-1222; 5429, ECH1, 27554, 130004, 257-308; 5429, ECH1, 27555, 130005, 1-209; 5429, ECH1, 27556, 130006, 11-124; 5429, ECH1, 27557, 130007, 332-440; 5429, ECH1, 27558, 130008, 4-169; 5429, ECH1, 27559, 130009, 18-560; 5429, ECH1, 27560, 130010, 234-1220; 5429, ECH1, 27561, 130011, 1-799; 5430, EHHADH, 27564, 130014, 10-240; 5430, EHHADH, 27562, 130012, 77-2248; 5430, EHHADH, 27563, 130013, 438-2321; 5431, ENTHD1, 27565, 130015, 252-2075; 5432, ENTHD2, 27567, 130017, 1-158; 5432, ENTHD2, 27568, 130018, 25-576; 5432, ENTHD2, 27569, 130019, 1-292; 5432, ENTHD2, 27570, 130020, 113-453; 5432, ENTHD2, 27566, 130016, 59-1636; 5433, EVPL, 27572, 130022, 34-6201; 5433, EVPL, 27573, 130023, 1-339; 5433, EVPL, 27571, 130021, 255-6356; 5434, EVPLL, 27574, 130024, 359-1264; 5435, EOMES, 27575, 130025, 205-2265; 5435, EOMES, 27576, 130026, 19-2136; 5435, EOMES, 27577, 130027, 287-1519; 5436, EPX, 27578, 130028, 111-2258; 5437, EID1, 27580, 130030, 42-539; 5437, EID1, 27579, 130029, 292-855; 5438, EID2, 27581, 130031, 152-862; 5439, EID2B, 27582, 130032, 53-538; 5440, EID3, 27583, 130033, 197-1198; 5441, EP400NL, 27585, 130035, 322-1581; 5441, EP400NL, 27587, 130037, 293-945; 5441, EP400NL, 27589, 130039, 112-781; 5441, EP400NL, 27591, 130041, 116-583; 5441, EP400NL, 27584, 130034, 318-1610; 5441, EP400NL, 27586, 130036, 957-2027; 5441, EP400NL, 27588, 130038, 237-1703; 5441, EP400NL, 27590, 130040, 542-1612; 5442, EPDR1, 27595, 130045, 171-539; 5442, EPDR1, 27592, 130042, 380-1054; 5442, EPDR1, 27593, 130043, 283-555; 5442, EPDR1, 27594, 130044, 47-538; 5443, EPHA1, 27596, 130046, 88-3018; 5444, EPHA10, 27599, 130049, 1-3045; 5444, EPHA10, 27600, 130050, 1-1179; 5444, EPHA10, 27601, 130051, 1-657; 5444, EPHA10, 27602, 130052, 1-277; 5444, EPHA10, 27603, 130053, 1-653; 5444, EPHA10, 27604, 130054, 253-720; 5444, EPHA10, 27597, 130047, 68-955; 5444, EPHA10, 27598, 130048, 1-3027; 5445, EPHA2, 27605, 130055, 156-3086; 5446, EPHA3, 27608, 130058, 74-2830; 5446, EPHA3, 27606, 130056, 226-3177; 5446, EPHA3, 27607, 130057, 88-1707; 5447, EPHA4, 27610, 130060, 36-2885; 5447, EPHA4, 27612, 130062, 53-169; 5447, EPHA4, 27613, 130063, 53-584; 5447, EPHA4, 27614, 130064, 1-565; 5447, EPHA4, 27615, 130065, 343-617; 5447, EPHA4, 27616, 130066, 1-114; 5447, EPHA4, 27617, 130067, 173-552; 5447, EPHA4, 27618, 130068, 111-558; 5447, EPHA4, 27609, 130059, 43-3003; 5447, EPHA4, 27611, 130061, 276-3236; 5448, EPHA5, 27621, 130071, 319-2943; 5448, EPHA5, 27622, 130072, 754-3768; 5448, EPHA5, 27623, 130073, 754-3804; 5448, EPHA5, 27624, 130074, 754-3870; 5448, EPHA5, 27619, 130069, 602-3715; 5448, EPHA5, 27620, 130070, 194-3241; 5449, EPHA6, 27625, 130075, 39-3431; 5449, EPHA6, 27626, 130076, 277-1398; 5449, EPHA6, 27627, 130077, 44-1687; 5449, EPHA6, 27628, 130078, 263-889; 5449, EPHA6, 27629, 130079, 1-168; 5449,

EPHA6, 27632, 130082, 229-954; 5449, EPHA6, 27633, 130083, 1-973; 5449, EPHA6, 27630, 130080, 243-1439; 5449, EPHA6, 27631, 130081, 331-1335; 5450, EPHA7, 27634, 130084, 207-1046; 5450, EPHA7, 27635, 130085, 186-3182; 5451, EPHA8, 27636, 130086, 73-3090; 5451, EPHA8, 27637, 130087, 73-1560; 5451, EPHA8, 27638, 130088, 55-1542; 5452, EPHB1, 27640, 130090, 204-511; 5452, EPHB1, 27641, 130091, 227-564; 5452, EPHB1, 27642, 130092, 106-554; 5452, EPHB1, 27644, 130094, 262-389; 5452, EPHB1, 27645, 130095, 371-1216; 5452, EPHB1, 27639, 130089, 371-3325; 5452, EPHB1, 27643, 130093, 899-2536; 5453, EPHB2, 27646, 130096, 25-2865; 5453, EPHB2, 27650, 130100, 145-1593; 5453, EPHB2, 27647, 130097, 19-2979; 5453, EPHB2, 27648, 130098, 14-2977; 5453, EPHB2, 27649, 130099, 19-3186; 5454, EPHB3, 27651, 130101, 453-3449; 5455, EPHB4, 27653, 130103, 86-2893; 5455, EPHB4, 27652, 130102, 470-3433; 5455, EPHB4, 27654, 130104, 492-1412; 5456, EPHB6, 27655, 130105, 180-3248; 5456, EPHB6, 27656, 130106, 990-3179; 5456, EPHB6, 27657, 130107, 279-830; 5456, EPHB6, 27658, 130108, 989-3178; 5456, EPHB6, 27659, 130109, 179-3247; 5456, EPHB6, 27660, 130110, 753-3821; 5456, EPHB6, 27661, 130111, 1-339; 5456, EPHB6, 27662, 130112, 675-827; 5456, EPHB6, 27663, 130113, 756-3824; 5456, EPHB6, 27664, 130114, 674-826; 5456, EPHB6, 27665, 130115, 1-339; 5456, EPHB6, 27666, 130116, 1-357; 5456, EPHB6, 27667, 130117, 278-829; 5457, EFNA1, 27668, 130118, 103-654; 5457, EFNA1, 27669, 130119, 519-1136; 5458, EFNA2, 27670, 130120, 16-657; 5459, EFNA3, 27671, 130121, 71-787; 5460, EFNA4, 27672, 130122, 88-669; 5460, EFNA4, 27673, 130123, 94-699; 5460, EFNA4, 27674, 130124, 64-687; 5461, EFNA5, 27676, 130126, 15-620; 5461, EFNA5, 27677, 130127, 1-567; 5461, EFNA5, 27675, 130125, 283-969; 5462, EFNB1, 27678, 130128, 781-1821; 5463, EFNB2, 27679, 130129, 151-1152; 5464, EFNB3, 27680, 130130, 398-1420; 5465, EGF, 27681, 130131, 446-4069; 5465, EGF, 27682, 130132, 96-3596; 5465, EGF, 27683, 130133, 453-3950; 5466, EGFR, 27687, 130137, 247-3744; 5466, EGFR, 27688, 130138, 161-2134; 5466, EGFR, 27689, 130139, 308-691; 5466, EGFR, 27691, 130141, 258-3533; 5466, EGFR, 27684, 130134, 178-3810; 5466, EGFR, 27685, 130135, 247-2133; 5466, EGFR, 27686, 130136, 246-2363; 5466, EGFR, 27690, 130140, 245-1462; 5467, EPS15, 27692, 130142, 11-2299; 5467, EPS15, 27694, 130144, 1-272; 5467, EPS15, 27693, 130143, 98-2788; 5468, EPS15L1, 27698, 130148, 26-265; 5468, EPS15L1, 27699, 130149, 1-271; 5468, EPS15L1, 27700, 130150, 1-215; 5468, EPS15L1, 27701, 130151, 141-2411; 5468, EPS15L1, 27703, 130153, 7-339; 5468, EPS15L1, 27705, 130155, 897-2240; 5468, EPS15L1, 27706, 130156, 15-266; 5468, EPS15L1, 27707, 130157, 1-640; 5468, EPS15L1, 27695, 130145, 141-2735; 5468, EPS15L1, 27696, 130146, 68-2800; 5468, EPS15L1, 27697, 130147, 32-2296; 5468, EPS15L1, 27702, 130152, 17-2281; 5468, EPS15L1, 27704, 130154, 6-1811; 5469, EPS8, 27710, 130160, 1-205; 5469, EPS8, 27711, 130161, 356-559; 5469, EPS8, 27712, 130162, 182-543; 5469, EPS8, 27716, 130166, 262-387; 5469, EPS8, 27717, 130167, 171-374; 5469, EPS8, 27718, 130168, 159-542; 5469, EPS8, 27719, 130169, 377-577; 5469, EPS8, 27720, 130170, 232-834; 5469, EPS8, 27708, 130158, 438-2906; 5469, EPS8, 27709, 130159, 127-1815; 5469, EPS8, 27713, 130163, 298-2766; 5469, EPS8, 27714, 130164, 402-2090; 5469, EPS8, 27715, 130165, 163-2631; 5470, EPPIN, 27723, 130173, 396-629; 5470, EPPIN, 27721, 130171, 565-918; 5470, EPPIN, 27722, 130172, 68-469; 5471, EDDM3A, 27725, 130175, 62-505; 5471, EDDM3A, 27724, 130174, 128-571; 5472, EDDM3B, 27726, 130176, 99-542; 5473, ELSPBP1, 27728, 130178, 1-231; 5473, ELSPBP1, 27729, 130179, 125-574; 5473, ELSPBP1, 27730, 130180, 121-348; 5473, ELSPBP1, 27731, 130181, 1-464; 5473, ELSPBP1, 27732, 130182, 28-690; 5473, ELSPBP1, 27727, 130177, 179-850; 5474, EPM2A, 27734, 130184, 1-713; 5474, EPM2A, 27735, 130185, 1-512; 5474, EPM2A, 27733, 130183, 527-1522; 5474, EPM2A, 27736, 130186, 956-1537; 5474, EPM2A, 27737, 130187, 358-1311; 5475, EPYC, 27739, 130189, 89-790; 5475, EPYC, 27738, 130188, 94-1062; 5476, EPPK1, 27740, 130190, 89-15280; 5476, EPPK1, 27741, 130191, 73-15339; 5477, EREG, 27742, 130192, 167-676; 5478, EPCAM, 27744, 130194, 215-1243; 5478, EPCAM, 27745, 130195, 12-609; 5478, EPCAM, 27746, 130196, 210-1238; 5478, EPCAM, 27743, 130193, 359-1303; 5479, ECT2, 27749, 130199, 123-573; 5479, ECT2, 27750, 130200, 504-558; 5479, ECT2, 27751, 130201, 1-895; 5479, ECT2, 27752, 130202, 405-734; 5479, ECT2, 27753, 130203, 123-735; 5479, ECT2, 27754, 130204, 1-627; 5479, ECT2, 27755, 130205, 160-637; 5479, ECT2, 27757, 130207, 241-560; 5479, ECT2, 27747, 130197, 199-2850; 5479, ECT2, 27748, 130198, 177-2921; 5479, ECT2, 27756, 130206, 75-2726; 5479, ECT2, 27758, 130208, 478-3126; 5479, ECT2, 27759, 130209, 519-3170; 5480, ECT2L, 27761, 130211, 317-548; 5480, ECT2L, 27760, 130210, 186-2900; 5480, ECT2L, 27762, 130212, 162-2876; 5480, ECT2L, 27763, 130213, 326-3040; 5481, EMP1, 27766, 130216, 177-449; 5481, EMP1, 27767, 130217, 133-571; 5481, EMP1, 27768, 130218, 1-210; 5481, EMP1, 27769, 130219, 271-555; 5481, EMP1, 27770, 130220, 546-555; 5481, EMP1, 27764, 130214, 200-673; 5481, EMP1, 27765, 130215, 130-555; 5482, EMP2, 27771, 130221, 211-714; 5482, EMP2, 27772, 130222, 222-725; 5483, EMP3, 27775, 130225, 19-502; 5483, EMP3, 27776, 130226, 394-678; 5483, EMP3, 27777, 130227, 485-753; 5483, EMP3, 27778, 130228, 66-257; 5483, EMP3, 27779, 130229, 94-263; 5483, EMP3, 27773, 130223, 302-793; 5483, EMP3, 27774, 130224, 109-600; 5484, EPGN, 27781, 130231, 1-391; 5484, EPGN, 27783, 130233, 61-345; 5484, EPGN, 27780, 130230, 48-449; 5484, EPGN, 27782, 130232, 62-526; 5484, EPGN, 27784, 130234, 1-285; 5484, EPGN, 27785, 130235, 1-339; 5484, EPGN, 27786, 130236, 1-312; 5484, EPGN, 27787, 130237, 1-222; 5484, EPGN, 27788, 130238, 1-312; 5485, ESRP1, 27793, 130243, 328-609; 5485, ESRP1, 27794, 130244, 1-1569; 5485, ESRP1, 27795, 130245, 1-1507; 5485, ESRP1, 27796, 130246, 693-764; 5485, ESRP1, 27789, 130239, 146-2179; 5485, ESRP1, 27790, 130240, 121-1947; 5485, ESRP1, 27791, 130241, 191-2236; 5485, ESRP1, 27792, 130242, 246-2225; 5486, ESRP2, 27799, 130249, 349-478; 5486, ESRP2, 27800, 130250, 1-197; 5486, ESRP2, 27801, 130251, 346-592; 5486, ESRP2, 27797, 130247, 540-2693; 5486, ESRP2, 27798, 130248, 88-2271; 5487, EPSTI1, 27805, 130255, 327-561; 5487, EPSTI1, 27806, 130256, 71-313; 5487, EPSTI1, 27802, 130252, 85-1008; 5487, EPSTI1, 27803, 130253, 66-1298; 5487, EPSTI1, 27804, 130254, 1-957; 5488, EPM2AIP1, 27808, 130258, 1-418; 5488, EPM2AIP1, 27809, 130259, 1-127; 5488, EPM2AIP1, 27807, 130257, 92-1915; 5489, EPHX1, 27812, 130262, 84-567; 5489, EPHX1, 27813, 130263, 488-895; 5489, EPHX1, 27810, 130260, 81-1448; 5489, EPHX1, 27811, 130261, 197-1564; 5489, EPHX1, 27814, 130264, 210-1577; 5490, EPHX2, 27816, 130266, 18-1589; 5490, EPHX2, 27817, 130267, 1-935; 5490, EPHX2, 27818, 130268, 85-1203; 5490, EPHX2, 27821, 130271, 100-574; 5490, EPHX2, 27815, 130265, 165-1673; 5490, EPHX2, 27819, 130269, 431-2098; 5490, EPHX2, 27820, 130270, 172-1641; 5491, EPHX3, 27824, 130274, 174-550; 5491, EPHX3, 27822, 130272, 222-1304; 5491, EPHX3, 27823, 130273, 174-1256; 5491, EPHX3, 27825, 130275, 211-1293; 5492, EPHX4, 27826, 130276, 99-1187; 5493, EPPIN-WFDC6, 27827, 130277, 70-609; 5494, EPS8L1, 27830, 130280, 147-2126; 5494, EPS8L1, 27831, 130281, 145-1431; 5494, EPS8L1, 27832, 130282, 103-1332; 5494, EPS8L1, 27833, 130283, 179-1825; 5494, EPS8L1, 27828, 130278, 57-2228; 5494, EPS8L1, 27829, 130279, 103-1893; 5495, EPS8L2, 27835, 130285, 298-582; 5495, EPS8L2, 27836, 130286, 236-474; 5495, EPS8L2, 27837, 130287, 1-418; 5495, EPS8L2, 27838, 130288, 144-251; 5495, EPS8L2, 27839, 130289, 337-587; 5495, EPS8L2, 27840, 130290, 265-580; 5495, EPS8L2, 27844, 130294, 465-540; 5495, EPS8L2, 27845, 130295, 1-503; 5495, EPS8L2, 27847, 130297, 581-1279; 5495, EPS8L2, 27834, 130284, 255-2402; 5495, EPS8L2, 27841, 130291, 376-2523; 5495, EPS8L2, 27842, 130292, 252-2399; 5495, EPS8L2, 27843, 130293, 41-2236; 5495, EPS8L2, 27846, 130296, 248-2443; 5496, EPS8L3, 27851, 130301, 124-243; 5496, EPS8L3, 27848, 130298, 128-1819; 5496, EPS8L3, 27849, 130299, 108-1889; 5496, EPS8L3, 27850, 130300, 231-2015; 5497, EPN1, 27855, 130305, 1-182; 5497, EPN1, 27852, 130302, 293-1945; 5497, EPN1, 27853, 130303, 312-2042; 5497, EPN1, 27854, 130304, 548-2536; 5498, EPN2, 27860, 130310, 142-1596; 5498, EPN2, 27861, 130311, 429-1657; 5498, EPN2, 27862, 130312, 74-1807; 5498, EPN2, 27863, 130313, 206-1255; 5498, EPN2, 27864, 130314, 206-959; 5498, EPN2, 27865, 130315, 377-563; 5498, EPN2, 27866, 130316, 320-546; 5498, EPN2, 27867, 130317, 465-562; 5498, EPN2, 27868, 130318, 518-578; 5498, EPN2, 27869, 130319, 526-639; 5498, EPN2, 27870, 130320, 572-637; 5498, EPN2, 27871, 130321, 307-591; 5498, EPN2, 27872, 130322, 272-382; 5498, EPN2, 27856, 130306, 449-2203; 5498, EPN2, 27857, 130307, 485-2410; 5498, EPN2, 27858, 130308, 226-1296; 5498, EPN2, 27859, 130309, 1166-2920; 5499, EPN3, 27874, 130324, 403-810; 5499, EPN3, 27876, 130326, 244-396; 5499, EPN3, 27877, 130327, 385-537; 5499, EPN3, 27878, 130328, 235-560; 5499, EPN3, 27879, 130329, 428-580; 5499, EPN3, 27880, 130330, 569-603; 5499, EPN3, 27881, 130331, 506-558; 5499, EPN3, 27882, 130332, 300-804; 5499, EPN3, 27883, 130333, 131-1087; 5499, EPN3, 27884, 130334, 131-1087; 5499, EPN3, 27873, 130323, 580-2478; 5499, EPN3, 27875, 130325, 365-991; 5500, EBI3, 27885, 130335, 54-743; 5501, EQTN, 27886, 130336, 82-465; 5501, EQTN, 27887, 130337, 85-969; 5501, EQTN, 27888, 130338, 82-879; 5502, EDEM1, 27890, 130340, 52-288; 5502, EDEM1, 27892, 130342, 20-181; 5502, EDEM1, 27889, 130339, 134-2107; 5502, EDEM1, 27891, 130341, 187-1317; 5503, EDEM2, 27893, 130343, 62-1687; 5503, EDEM2, 27894, 130344, 107-1843; 5504, EDEM3, 27897, 130347, 1-1143; 5504, EDEM3, 27895, 130345, 268-3066; 5504, EDEM3, 27896, 130346, 391-3108; 5505, ERLIN1, 27898, 130348, 138-962; 5505, ERLIN1, 27899, 130349, 84-1130; 5505, ERLIN1, 27900, 130350, 2709-3755; 5506, ERLIN2, 27906, 130356, 72-663; 5506, ERLIN2, 27907, 130357, 587-1602; 5506, ERLIN2, 27901, 130351, 68-1087; 5506, ERLIN2, 27902, 130352, 339-797; 5506, ERLIN2, 27903, 130353, 96-554; 5506, ERLIN2, 27904, 130354, 343-963; 5506, ERLIN2, 27905, 130355, 358-1377; 5506, ERLIN2, 27908, 130358, 70-690; 5506, ERLIN2, 27909, 130359, 123-743; 5507, EMC1, 27910, 130360, 19-246; 5507, EMC1, 27913, 130363, 1-260; 5507, EMC1, 27914, 130364, 17-244; 5507, EMC1, 27915, 130365, 1-537; 5507, EMC1, 27911, 130361, 1-2979; 5507, EMC1, 27912, 130362, 14-2929; 5507, EMC1, 27916, 130366, 44-3025; 5508, EMC10, 27919, 130369, 146-274; 5508, EMC10, 27920, 130370, 50-180; 5508, EMC10, 27921, 130371, 197-462; 5508, EMC10, 27922, 130372, 25-1140; 5508, EMC10, 27923, 130373, 12-140; 5508, EMC10, 27917, 130367, 47-835; 5508, EMC10, 27918, 130368, 47-811; 5509, EMC2, 27925, 130375, 1-404; 5509, EMC2, 27926, 130376, 196-533; 5509, EMC2, 27924, 130374, 36-929; 5510, EMC3, 27928, 130378, 22-633; 5510, EMC3, 27929, 130379, 336-570; 5510, EMC3, 27927, 130377, 460-1245; 5511, EMC4, 27932, 130382, 50-286; 5511, EMC4, 27933, 130383, 1-295; 5511, EMC4, 27934, 130384, 91-466; 5511, EMC4, 27935, 130385, 98-316; 5511, EMC4, 27936, 130386, 76-207; 5511, EMC4, 27937, 130387, 79-333; 5511, EMC4, 27938, 130388, 80-388; 5511, EMC4, 27939, 130389, 78-296; 5511, EMC4, 27930, 130380, 103-552; 5511, EMC4, 27931, 130381, 117-668; 5512, EMC6, 27940, 130390, 135-467; 5512, EMC6, 27941, 130391, 241-573; 5513, EMC7, 27943, 130393, 1-577; 5513, EMC7, 27944, 130394, 27-506; 5513, EMC7, 27942, 130392, 110-838; 5514, EMC8, 27947, 130397, 1-303; 5514, EMC8, 27945, 130395, 246-878; 5514, EMC8, 27946, 130396, 314-694; 5515, EMC9, 27950, 130400, 63-347; 5515, EMC9, 27951, 130401, 423-827; 5515, EMC9, 27948, 130398, 164-790; 5515, EMC9, 27949, 130399, 282-908; 5516, ERMARD, 27956, 130406, 1-139; 5516, ERMARD, 27957, 130407, 335-556; 5516, ERMARD, 27958, 130408, 468-552; 5516, ERMARD, 27959, 130409, 34-255; 5516, ERMARD, 27960, 130410, 533-547; 5516, ERMARD, 27961, 130411, 21-543; 5516, ERMARD, 27962, 130412, 514-2142; 5516, ERMARD, 27963, 130413, 496-551; 5516, ERMARD, 27968, 130418, 468-552; 5516, ERMARD, 27969, 130419, 34-255; 5516, ERMARD, 27970, 130420, 514-2142; 5516, ERMARD, 27971, 130421, 21-543; 5516, ERMARD, 27972, 130422, 533-547; 5516, ERMARD, 27973, 130423, 335-556; 5516, ERMARD, 27974, 130424, 1-139; 5516, ERMARD, 27975, 130425, 496-551; 5516, ERMARD, 27952, 130402, 37-1932; 5516, ERMARD, 27953, 130403, 34-2070; 5516, ERMARD, 27954, 130404, 243-1901; 5516, ERMARD, 27955, 130405, 21-1838; 5516, ERMARD, 27964, 130414, 243-1901; 5516, ERMARD, 27965, 130415, 37-1932; 5516, ERMARD, 27966, 130416, 21-1838; 5516, ERMARD, 27967, 130417, 34-2070; 5517, ERAL1, 27977, 130427, 26-541; 5517, ERAL1, 27978, 130428, 1-850; 5517, ERAL1, 27979, 130429, 1-830; 5517, ERAL1, 27980, 130430, 1-243; 5517, ERAL1, 27976, 130426, 98-1411; 5518, ERRFI1, 27982, 130432, 15-254; 5518, ERRFI1, 27983, 130433, 213-437; 5518, ERRFI1, 27984, 130434, 200-361; 5518, ERRFI1, 27985, 130435, 213-371; 5518, ERRFI1, 27981, 130431, 225-1613; 5519, ERBB2IP, 27990, 130440, 298-2130; 5519, ERBB2IP, 27993, 130443, 1-474; 5519, ERBB2IP, 27994, 130444, 1-589; 5519, ERBB2IP, 27986, 130436, 390-4628; 5519, ERBB2IP, 27987, 130437, 291-4199; 5519, ERBB2IP, 27988, 130438, 255-4295; 5519, ERBB2IP, 27989, 130439, 309-4424; 5519, ERBB2IP, 27991, 130441, 60-3968; 5519, ERBB2IP, 27992, 130442, 138-4241; 5519, ERBB2IP, 27995, 130445, 92-4351; 5520, ERBB2, 27998, 130448, 264-3203; 5520, ERBB2, 28000, 130450, 166-456; 5520, ERBB2, 28001, 130451, 167-583; 5520, ERBB2, 28003, 130453, 542-2353; 5520, ERBB2, 28004, 130454, 1-754; 5520, ERBB2, 28005, 130455, 160-432; 5520, ERBB2, 28006, 130456, 216-3383; 5520, ERBB2, 28007, 130457, 253-559; 5520, ERBB2, 28008, 130458, 1-529; 5520, ERBB2, 28009, 130459, 1-497; 5520, ERBB2, 27996, 130446, 160-3927; 5520, ERBB2, 27997, 130447, 269-

3946; 5520, ERBB2, 27999, 130449, 1-3723; 5520, ERBB2, 28002, 130452, 798-4475; 5521, ERBB3, 28014, 130464, 134-2899; 5521, ERBB3, 28015, 130465, 183-561; 5521, ERBB3, 28016, 130466, 135-266; 5521, ERBB3, 28017, 130467, 457-1845; 5521, ERBB3, 28018, 130468, 1-1950; 5521, ERBB3, 28019, 130469, 735-2486; 5521, ERBB3, 28020, 130470, 212-560; 5521, ERBB3, 28021, 130471, 332-676; 5521, ERBB3, 28022, 130472, 1-246; 5521, ERBB3, 28010, 130460, 441-4469; 5521, ERBB3, 28011, 130461, 221-4072; 5521, ERBB3, 28012, 130462, 165-716; 5521, ERBB3, 28013, 130463, 97-1092; 5522, ERBB4, 28023, 130473, 1-2194; 5522, ERBB4, 28025, 130475, 108-3857; 5522, ERBB4, 28027, 130477, 185-569; 5522, ERBB4, 28024, 130474, 312-4238; 5522, ERBB4, 28026, 130476, 312-4190; 5523, N/A, 28028, 130478, 433-868; 5523, N/A, 28029, 130479, 407-3253; 5523, N/A, 28030, 130480, 207-2369; 5523, N/A, 28031, 130481, 244-1275; 5523, N/A, 28032, 130482, 1-857; 5523, N/A, 28033, 130483, 158-3508; 5523, N/A, 28034, 130484, 272-3538; 5523, N/A, 28035, 130485, 378-3356; 5523, N/A, 28036, 130486, 529-3891; 5523, N/A, 28037, 130487, 182-3532; 5523, N/A, 28038, 130488, 1-269; 5523, N/A, 28039, 130489, 529-3459; 5523, N/A, 28040, 130490, 158-3424; 5523, N/A, 28041, 130491, 133-3393; 5523, N/A, 28042, 130492, 278-546; 5523, N/A, 28043, 130493, 158-2320; 5524, ERCC6-PGBD3, 28044, 130494, 94-3279; 5524, ERCC6-PGBD3, 28045, 130495, 122-3307; 5525, ERGIC2, 28047, 130497, 99-616; 5525, ERGIC2, 28048, 130498, 1-172; 5525, ERGIC2, 28049, 130499, 1-150; 5525, ERGIC2, 28050, 130500, 170-695; 5525, ERGIC2, 28051, 130501, 218-432; 5525, ERGIC2, 28052, 130502, 1-629; 5525, ERGIC2, 28053, 130503, 1-490; 5525, ERGIC2, 28054, 130504, 85-693; 5525, ERGIC2, 28055, 130505, 614-1274; 5525, ERGIC2, 28056, 130506, 1-1161; 5525, ERGIC2, 28046, 130496, 77-1210; 5526, ERGIC3, 28059, 130509, 20-391; 5526, ERGIC3, 28060, 130510, 1-1193; 5526, ERGIC3, 28061, 130511, 1-977; 5526, ERGIC3, 28062, 130512, 1-472; 5526, ERGIC3, 28063, 130513, 1-357; 5526, ERGIC3, 28064, 130514, 1-391; 5526, ERGIC3, 28057, 130507, 78-1229; 5526, ERGIC3, 28058, 130508, 61-1227; 5527, ERI2, 28068, 130518, 43-513; 5527, ERI2, 28065, 130515, 44-1030; 5527, ERI2, 28066, 130516, 44-2119; 5527, ERI2, 28067, 130517, 757-2553; 5527, ERI2, 28069, 130519, 477-2273; 5527, ERI2, 28070, 130520, 47-886; 5528, ERI3, 28073, 130523, 1-615; 5528, ERI3, 28074, 130524, 235-764; 5528, ERI3, 28075, 130525, 224-975; 5528, ERI3, 28071, 130521, 183-1196; 5528, ERI3, 28072, 130522, 176-844; 5529, ERMN, 28078, 130528, 183-623; 5529, ERMN, 28079, 130529, 18-458; 5529, ERMN, 28080, 130530, 232-486; 5529, ERMN, 28081, 130531, 134-590; 5529, ERMN, 28082, 130532, 61-541; 5529, ERMN, 28083, 130533, 183-977; 5529, ERMN, 28084, 130534, 260-594; 5529, ERMN, 28076, 130526, 235-1128; 5529, ERMN, 28077, 130527, 293-1147; 5530, ERMAP, 28085, 130535, 1039-2196; 5530, ERMAP, 28086, 130536, 185-1612; 5530, ERMAP, 28087, 130537, 245-1672; 5531, EPB41, 28091, 130541, 755-2623; 5531, EPB41, 28088, 130538, 47-2374; 5531, EPB41, 28089, 130539, 802-2727; 5531, EPB41, 28090, 130540, 128-2722; 5531, EPB41, 28092, 130542, 198-2360; 5531, EPB41, 28093, 130543, 105-2699; 5531, EPB41, 28094, 130544, 785-2551; 5532, EPB41L4A, 28095, 130545, 278-2338; 5532, EPB41L4A, 28096, 130546, 275-2335; 5533, EPB41L4B, 28097, 130547, 519-2075; 5533 EPB41L4B, 28098, 130548, 519-3221; 5534, EPB41L5, 28099, 130549, 215-2416; 5534, EPB41L5, 28100, 130550, 101-1618; 5534, EPB41L5, 28101, 130551, 1-2199; 5534, EPB41L5, 28102, 130552, 480-1997; 5534, EPB41L5, 28103, 130553, 143-2206; 5535, EPB41L1, 28106, 130556, 10-2652; 5535, EPB41L1, 28107, 130557, 165-763; 5535, EPB41L1, 28108, 130558, 226-2868; 5535, EPB41L1, 28110, 130560, 149-652; 5535, EPB41L1, 28111, 130561, 1-593; 5535, EPB41L1, 28112, 130562, 1-359; 5535, EPB41L1, 28113, 130563, 99-210; 5535, EPB41L1, 28114, 130564, 555-896; 5535, EPB41L1, 28116, 130566, 126-896; 5535, EPB41L1, 28117, 130567, 1-803; 5535, EPB41L1, 28118, 130568, 284-460; 5535, EPB41L1, 28119, 130569, 204-769; 5535, EPB41L1, 28104, 130554, 174-2513; 5535, EPB41L1, 28105, 130555, 162-2807; 5535, EPB41L1, 28109, 130559, 326-2644; 5535, EPB41L1, 28115, 130565, 169-2508; 5535, EPB41L1, 28120, 130570, 179-2284; 5536, EPB41L2, 28124, 130574, 1-1138; 5536, EPB41L2, 28126, 130576, 1-2436; 5536, EPB41L2, 28127, 130577, 1-2121; 5536, EPB41L2, 28128, 130578, 104-591; 5536, EPB41L2, 28129, 130579, 92-552; 5536, EPB41L2, 28131, 130581, 7-727; 5536, EPB41L2, 28134, 130584, 1289-1669; 5536, EPB41L2, 28135, 130585, 308-981; 5536, EPB41L2, 28136, 130586, 212-565; 5536, EPB41L2, 28137, 130587, 207-588; 5536, EPB41L2, 28138, 130588, 132-2939; 5536, EPB41L2, 28139, 130589, 2501-3106; 5536, EPB41L2, 28140, 130590, 216-3023; 5536, EPB41L2, 28141, 130591, 49-585; 5536, EPB41L2, 28142, 130592, 1470-2621; 5536, EPB41L2, 28143, 130593, 159-962; 5536, EPB41L2, 28144, 130594, 99-2000; 5536, EPB41L2, 28145, 130595, 183-2990; 5536, EPB41L2, 28121, 130571, 183-3200; 5536, EPB41L2, 28122, 130572, 192-3209; 5536, EPB41L2, 28123, 130573, 94-2115; 5536, EPB41L2, 28125, 130575, 177-2420; 5536, EPB41L2, 28130, 130580, 125-2146; 5536, EPB41L2, 28132, 130582, 163-2406; 5536, EPB41L2, 28133, 130583, 99-2657; 5537, EPB41L3, 28146, 130596, 410-3166; 5537, EPB41L3, 28148, 130598, 396-1907; 5537, EPB41L3, 28151, 130601, 223-572; 5537, EPB41L3, 28152, 130602, 280-551; 5537, EPB41L3, 28153, 130603, 61-546; 5537, EPB41L3, 28154, 130604, 100-542; 5537, EPB41L3, 28155, 130605, 178-552; 5537, EPB41L3, 28156, 130606, 229-567; 5537, EPB41L3, 28157, 130607, 265-553; 5537, EPB41L3, 28158, 130608, 112-492; 5537, EPB41L3, 28159, 130609, 120-500; 5537, EPB41L3, 28160, 130610, 258-496; 5537, EPB41L3, 28161, 130611, 68-553; 5537, EPB41L3, 28162, 130612, 1-333; 5537, EPB41L3, 28163, 130613, 1-564; 5537, EPB41L3, 28164, 130614, 1-551; 5537, EPB41L3, 28165, 130615, 1-583; 5537, EPB41L3, 28166, 130616, 1-569; 5537, EPB41L3, 28167, 130617, 1-591; 5537, EPB41L3, 28168, 130618, 538-2808; 5537, EPB41L3, 28169, 130619, 1-973; 5537, EPB41L3, 28170, 130620, 1-110; 5537, EPB41L3, 28147, 130597, 342-3605; 5537, EPB41L3, 28149, 130599, 229-2880; 5537, EPB41L3, 28150, 130600, 381-2978; 5538, EPB42, 28173, 130623, 185-2026; 5538, EPB42, 28174, 130624, 1-574; 5538, EPB42, 28175, 130625, 1-1632; 5538, EPB42, 28176, 130626, 1-442; 5538, EPB42, 28171, 130621, 459-2624; 5538, EPB42, 28172, 130622, 227-2302; 5538, EPB42, 28177, 130627, 301-2160; 5539, EDRF1, 28180, 130630, 1-954; 5539, EDRF1, 28183, 130633, 294-1325; 5539, EDRF1, 28184, 130634, 1-71; 5539, EDRF1, 28185, 130635, 1-454; 5539, EDRF1, 28178, 130628, 106-3720; 5539, EDRF1, 28179, 130629, 233-3949; 5539, EDRF1, 28181, 130631, 233-2014; 5539, EDRF1, 28182, 130632, 294-2684; 5540, EPO, 28186, 130636, 182-763; 5541, EPOR, 28188, 130638, 78-437; 5541, EPOR, 28189, 130639, 78-470; 5541, EPOR, 28191, 130641, 78-908; 5541, EPOR, 28187, 130637, 106-1632; 5541, EPOR, 28190, 130640, 106-1092; 5542, ERAS, 28192, 130642, 252-953; 5543, ESF1, 28194, 130644, 85-1455; 5543, ESF1, 28193, 130643, 109-2664; 5544, ESPN, 28196, 130646, 220-1086; 5544, ESPN, 28197, 130647, 1-641; 5544, ESPN, 28198, 130648, 1-565; 5544, ESPN, 28200, 130650, 187-270; 5544, ESPN, 28201, 130651, 274-455; 5544, ESPN, 28202, 130652, 1-714; 5544, ESPN, 28203, 130653, 278-813; 5544, ESPN, 28195, 130645, 169-2733; 5544, ESPN, 28199, 130649, 220-1086; 5545, ESPNL, 28207, 130657, 230-476; 5545, ESPNL, 28208, 130658, 2358-2780; 5545, ESPNL, 28204, 130654, 264-3281; 5545, ESPNL, 28205, 130655, 1-2886; 5545, ESPNL, 28206, 130656, 142-2055; 5546, EME1, 28212, 130662, 49-562; 5546, EME1, 28213, 130663, 1-1010; 5546, EME1, 28214, 130664, 61-366; 5546, EME1, 28209, 130659, 83-1795; 5546, EME1, 28210, 130660, 83-1834; 5546, EME1, 28211, 130661, 25-1776; 5547, EME2, 28215, 130665, 1-346; 5547, EME2, 28217, 130667, 1-571; 5547, EME2, 28216, 130666, 22-1161; 5548, ESCO1, 28220, 130670, 299-817; 5548, ESCO1, 28218, 130668, 939-3461; 5548, ESCO1, 28219, 130669, 1087-3192; 5549, ESCO2, 28223, 130673, 176-574; 5549, ESCO2, 28224, 130674, 137-698; 5549, ESCO2, 28225, 130675, 71-943; 5549, ESCO2, 28226, 130676, 1-528; 5549, ESCO2, 28221, 130671, 239-2044; 5549, ESCO2, 28222, 130672, 1-720; 5550, ESD, 28227, 130677, 237-998; 5550, ESD, 28229, 130679, 1-692; 5550, ESD, 28230, 130680, 1-361; 5550, ESD, 28228, 130678, 184-1032; 5551, ESR1, 28233, 130683, 235-1239; 5551, ESR1, 28234, 130684, 371-624; 5551, ESR1, 28236, 130686, 233-1165; 5551, ESR1, 28237, 130687, 1-323; 5551, ESR1, 28239, 130689, 385-731; 5551, ESR1, 28240, 130690, 235-693; 5551, ESR1, 28231, 130681, 363-2150; 5551, ESR1, 28232, 130682, 1461-3248; 5551, ESR1, 28235, 130685, 262-2049; 5551, ESR1, 28238, 130688, 371-2158; 5552, ESR2, 28250, 130700, 469-2010; 5552, ESR2, 28241, 130691, 91-1410; 5552, ESR2, 28242, 130692, 469-1956; 5552, ESR2, 28243, 130693, 419-2011; 5552, ESR2, 28244, 130694, 52-1023; 5552, ESR2, 28245, 130695, 306-1793; 5552, ESR2, 28246, 130696, 1-1446; 5552, ESR2, 28247, 130697, 1275-2762; 5552, ESR2, 28248, 130698, 1-1419; 5552, ESR2, 28249, 130699, 1-1425; 5553, EBAG9, 28254, 130704, 116-706; 5553, EBAG9, 28255, 130705, 291-413; 5553, EBAG9, 28256, 130706, 579-813; 5553, EBAG9, 28257, 130707, 293-754; 5553, EBAG9, 28251, 130701, 301-942; 5553, EBAG9, 28252, 130702, 225-866; 5553, EBAG9, 28253, 130703, 1-777; 5553, EBAG9, 28258, 130708, 116-757; 5553, EBAG9, 28259, 130709, 403-1179; 5554, ESRRA, 28263, 130713, 262-747; 5554, ESRRA, 28264, 130714, 414-742; 5554, ESRRA, 28265, 130715, 1-593; 5554, ESRRA, 28260, 130710, 172-1443; 5554, ESRRA, 28261, 130711, 235-1506; 5554, ESRRA, 28262, 130712, 178-1446; 5555, ESRRB, 28269, 130719, 302-1826; 5555, ESRRB, 28266, 130716, 99-1625; 5555, ESRRB, 28267, 130717, 209-1735; 5555, ESRRB, 28268, 130718, 575-2077; 5555, ESRRB, 28270, 130720, 73-1374; 5556, ESRRG, 28281, 130731, 306-583; 5556, ESRRG, 28283, 130733, 434-584; 5556, ESRRG, 28285, 130735, 402-1464; 5556, ESRRG, 28287, 130737, 399-565; 5556, ESRRG, 28288, 130738, 303-446; 5556, ESRRG, 28271, 130721, 205-1512; 5556, ESRRG, 28272, 130722, 439-1746; 5556, ESRRG, 28273, 130723, 224-1531; 5556, ESRRG, 28274, 130724, 363-1670; 5556, ESRRG, 28275, 130725, 268-1680; 5556, ESRRG, 28276, 130726, 282-1589; 5556, ESRRG, 28277, 130727, 319-1626; 5556, ESRRG, 28278, 130728, 542-1849; 5556, ESRRG, 28279, 130729, 155-1531; 5556, ESRRG, 28280, 130730, 616-1923; 5556, ESRRG, 28282, 130732, 684-1874; 5556, ESRRG, 28284, 130734, 259-1566; 5556, ESRRG, 28286, 130736, 312-1619; 5556, ESRRG, 28289, 130739, 194-1501; 5557, ESX1, 28290, 130740, 85-1305; 5558, ETNK1, 28293, 130743, 1-248; 5558, ETNK1, 28294, 130744, 1-1277; 5558, ETNK1, 28291, 130741, 90-1448; 5558, ETNK1, 28292, 130742, 24-800; 5559, ETNK2, 28295, 130745, 409-615; 5559, ETNK2, 28298, 130748, 512-547; 5559, ETNK2, 28299, 130749, 1-577; 5559, ETNK2, 28300, 130750, 1-653; 5559, ETNK2, 28301, 130751, 1-443; 5559, ETNK2, 28302, 130752, 1-449; 5559, ETNK2, 28296, 130746, 43-1227; 5559, ETNK2, 28297, 130747, 152-1312; 5560, ETNPPL, 28305, 130755, 388-567; 5560, ETNPPL, 28306, 130756, 32-226; 5560, ETNPPL, 28307, 130757, 298-1677; 5560, ETNPPL, 28308, 130758, 332-543; 5560, ETNPPL, 28309, 130759, 157-306; 5560, ETNPPL, 28303, 130753, 156-1655; 5560, ETNPPL, 28304, 130754, 111-1592; 5560, ETNPPL, 28310, 130760, 144-1469; 5561, EPT1, 28312, 130762, 85-624; 5561, EPT1, 28313, 130763, 151-504; 5561, EPT1, 28314, 130764, 148-1338; 5561, EPT1, 28311, 130761, 120-1313; 5562, ETHE1, 28316, 130766, 16-171; 5562, ETHE1, 28317, 130767, 25-807; 5562, ETHE1, 28318, 130768, 46-333; 5562, ETHE1, 28319, 130769, 29-316; 5562, ETHE1, 28315, 130765, 68-832; 5563, ECHDC1, 28322, 130772, 3-380; 5563, ECHDC1, 28323, 130773, 1-229; 5563, ECHDC1, 28324, 130774, 1-766; 5563, ECHDC1, 28328, 130778, 275-652; 5563, ECHDC1, 28329, 130779, 1-301; 5563, ECHDC1, 28330, 130780, 1-104; 5563, ECHDC1, 28331, 130781, 27-278; 5563, ECHDC1, 28332, 130782, 125-531; 5563, ECHDC1, 28334, 130784, 65-601; 5563, ECHDC1, 28335, 130785, 124-577; 5563, ECHDC1, 28338, 130788, 27-446; 5563, ECHDC1, 28320, 130770, 65-502; 5563, ECHDC1, 28321, 130771, 267-704; 5563, ECHDC1, 28325, 130775, 277-1182; 5563, ECHDC1, 28326, 130776, 104-1009; 5563, ECHDC1, 28327, 130777, 233-913; 5563, ECHDC1, 28333, 130783, 389-1294; 5563, ECHDC1, 28336, 130786, 220-432; 5563, ECHDC1, 28337, 130787, 505-1428; 5564, E124, 28340, 130790, 156-944; 5564, E124, 28341, 130791, 160-534; 5564, E124, 28342, 130792, 255-815; 5564, E124, 28343, 130793, 179-452; 5564, E124, 28344, 130794, 187-837; 5564, E124, 28345, 130795, 452-493; 5564, E124, 28346, 130796, 560-1063; 5564, E124, 28347, 130797, 168-293; 5564, E124, 28349, 130799, 718-1221; 5564, E124, 28339, 130789, 429-1451; 5564, E124, 28348, 130798, 187-1167; 5564, E124, 28350, 130800, 128-1150; 5565, EHF, 28353, 130803, 83-557; 5565, EHF, 28354, 130804, 62-560; 5565, EHF, 28356, 130806, 46-564; 5565, EHF, 28359, 130809, 5-385; 5565, EHF, 28360, 130810, 56-436; 5565, EHF, 28351, 130801, 122-1024; 5565, EHF, 28352, 130802, 98-931; 5565, EHF, 28355, 130805, 141-1043; 5565, EHF, 28357, 130807, 127-1095; 5565, EHF, 28358, 130808, 218-1120; 5566, ETV1, 28363, 130813, 108-1583; 5566, ETV1, 28368, 130818, 186-554; 5566, ETV1, 28369, 130819, 277-1141; 5566, ETV1, 28370, 130820, 266-784; 5566, ETV1, 28372, 130822, 487-546; 5566, ETV1, 28373, 130823, 295-580; 5566, ETV1, 28375, 130825, 423-1526; 5566, ETV1, 28361, 130811, 336-1715; 5566, ETV1, 28362, 130812, 339-1463; 5566, ETV1, 28364, 130814, 339-1652; 5566, ETV1, 28365, 130815, 202-1566; 5566, ETV1, 28366, 130816, 473-1906; 5566, ETV1, 28367, 130817, 216-1595; 5566, ETV1, 28371, 130821, 669-2102; 5566, ETV1, 28374, 130824, 339-1598; 5567, ETV2, 28376, 130826, 440-907; 5567, ETV2, 28380, 130830, 574-1323; 5567, ETV2, 28381, 130831, 1-288; 5567, ETV2, 28382, 130832, 440-994; 5567, ETV2, 28383, 130833, 46-600; 5567, ETV2, 28377, 130827, 440-1552; 5567, ETV2, 28378, 130828, 440-1468; 5567, ETV2, 28379, 130829, 307-1335; 5568, ETV3, 28384, 130834, 173-604; 5568, ETV3, 28385, 130835, 66-1604; 5569, ETV3L, 28386, 130836, 286-1371; 5570, ETV4, 28390, 130840, 97-1389; 5570, ETV4, 28393, 130843, 498-581; 5570, ETV4, 28387, 130837, 300-1754; 5570, ETV4, 28388, 130838, 55-1509; 5570, ETV4, 28389, 130839, 197-1534; 5570, ETV4, 28391, 130841, 135-1472; 5570, ETV4, 28392, 130842, 91-1545; 5570, ETV4, 28394, 130844, 274-897; 5571, ETV5, 28396, 130846, 169-564; 5571, ETV5, 28397, 130847, 125-574; 5571, ETV5, 28398, 130848, 1-268; 5571, ETV5, 28399, 130849, 177-573; 5571, ETV5, 28400, 130850, 135-554; 5571, ETV5, 28395, 130845, 248-1780; 5571, ETV5, 28401, 130851, 294-1826; 5572, ETV6, 28402, 130852, 1-151; 5572, ETV6, 28404, 130854, 1-267; 5572, ETV6, 28403, 130853, 275-1633; 5573, ETV7, 28405, 130855, 243-1268; 5573, ETV7, 28406, 130856, 26-979; 5573, ETV7, 28407, 130857, 243-1037; 5573, ETV7, 28408, 130858, 260-1120; 5573, ETV7, 28409, 130859, 412-984; 5573, ETV7, 28410, 130860, 478-1326; 5573, ETV7, 28411, 130861, 367-1149; 5573, ETV7, 28412, 130862, 76-864; 5574, ERF, 28415, 130865, 80-264; 5574, ERF, 28416, 130866, 262-555; 5574, ERF, 28413, 130863, 159-1805; 5574, ERF, 28414, 130864, 303-1724; 5575, EHMT1, 28419, 130869, 1-2412; 5575, EHMT1, 28420, 130870, 239-558; 5575, EHMT1, 28421, 130871, 1-1297; 5575, EHMT1, 28422, 130872, 298-709; 5575, EHMT1, 28424, 130874, 1-689; 5575, EHMT1, 28425, 130875, 1-326; 5575, EHMT1, 28426, 130876, 1-503; 5575, EHMT1, 28427, 130877, 114-437; 5575, EHMT1, 28428, 130878, 294-710; 5575, EHMT1, 28429, 130879, 67-420; 5575, EHMT1, 28430, 130880, 479-882; 5575, EHMT1, 28431, 130881, 14-818; 5575, EHMT1, 28417, 130867, 38-2464; 5575, EHMT1, 28418, 130868, 67-3963; 5575, EHMT1, 28423, 130873, 37-237; 5576, EHMT2, 28432, 130882, 21-3722; 5576, EHMT2, 28437, 130887, 1-3804; 5576, EHMT2, 28438, 130888, 1-3804; 5576, EHMT2, 28439, 130889, 21-3722; 5576, EHMT2, 28440, 130890, 21-3722; 5576, EHMT2, 28442, 130892, 1-894; 5576, EHMT2, 28443, 130893, 1-894; 5576, EHMT2, 28445, 130895, 1-3804; 5576, EHMT2, 28446, 130896, 1-3804; 5576, EHMT2, 28447, 130897, 1-2769; 5576, EHMT2, 28448, 130898, 1-3531; 5576, EHMT2, 28450, 130900, 21-3722; 5576, EHMT2, 28451, 130901, 21-3722; 5576, EHMT2, 28452, 130902, 1-3531; 5576, EHMT2, 28453, 130903, 1-894; 5576, EHMT2, 28454, 130904, 1-894; 5576, EHMT2, 28455, 130905, 21-3722; 5576, EHMT2, 28457, 130907, 1-894; 5576, EHMT2, 28458, 130908, 1-3804; 5576, EHMT2, 28460, 130910, 1-894; 5576, EHMT2, 28461, 130911, 1-2667; 5576, EHMT2, 28462, 130912, 1-3804; 5576, EHMT2, 28463, 130913, 1-894; 5576, EHMT2, 28465, 130915, 1-2769; 5576, EHMT2, 28466, 130916, 1-2667; 5576, EHMT2, 28433, 130883, 1-3531; 5576, EHMT2, 28434, 130884, 8-3640; 5576, EHMT2, 28435, 130885, 1-3531; 5576, EHMT2, 28436, 130886, 23-3655; 5576, EHMT2, 28441, 130891, 8-3640; 5576, EHMT2, 28444, 130894, 8-3640; 5576, EHMT2, 28449, 130899, 1-3531; 5576, EHMT2, 28456, 130906, 8-3640; 5576, EHMT2, 28459, 130909, 1-3531; 5576, EHMT2, 28464, 130914, 8-3640; 5577, EEF2K, 28468, 130918, 431-1669; 5577, EEF2K, 28467, 130917, 475-2652; 5578, EEF2KMT, 28471, 130921, 28-204; 5578, EEF2KMT, 28472, 130922, 16-237; 5578, EEF2KMT, 28473, 130923, 36-257; 5578, EEF2KMT, 28474, 130924, 4-813; 5578, EEF2KMT, 28469, 130919, 50-940; 5578, EEF2KMT, 28470, 130920, 70-1062; 5579, EEFSEC, 28476, 130926, 8-1318; 5579, EEFSEC, 28475, 130925, 55-1845; 5580, EEF1A1, 28480, 130930, 200-635; 5580, EEF1A1, 28481, 130931, 382-701; 5580, EEF1A1, 28482, 130932, 64-1344; 5580, EEF1A1, 28483, 130933, 64-1389; 5580, EEF1A1, 28477, 130927, 246-1634; 5580, EEF1A1, 28478, 130928, 620-2008; 5580, EEF1A1, 28479, 130929, 993-2381; 5581, EEF1A2, 28484, 130934, 330-1721; 5581, EEF1A2, 28485, 130935, 72-1463; 5582, EEF1B2, 28489, 130939, 47-253; 5582, EEF1B2, 28490, 130940, 54-260; 5582, EEF1B2, 28491, 130941, 71-277; 5582, EEF1B2, 28492, 130942, 47-136; 5582, EEF1B2, 28493, 130943, 146-515; 5582, EEF1B2, 28486, 130936, 122-799; 5582, EEF1B2, 28487, 130937, 159-836; 5582, EEF1B2, 28488, 130938, 376-1053; 5583, EEF1D, 28499, 130949, 316-559; 5583, EEF1D, 28500, 130950, 156-343; 5583, EEF1D, 28501, 130951, 365-616; 5583, EEF1D, 28502, 130952, 57-617; 5583, EEF1D, 28503, 130953, 494-610; 5583, EEF1D, 28504, 130954, 55-473; 5583, EEF1D, 28506, 130956, 1-632; 5583, EEF1D, 28507, 130957, 221-633; 5583, EEF1D, 28508, 130958, 43-813; 5583, EEF1D, 28509, 130959, 61-777; 5583, EEF1D, 28510, 130960, 89-409; 5583, EEF1D, 28511, 130961, 191-761; 5583, EEF1D, 28512, 130962, 287-828; 5583, EEF1D, 28513, 130963, 351-555; 5583, EEF1D, 28514, 130964, 495-558; 5583, EEF1D, 28515, 130965, 445-538; 5583, EEF1D, 28516, 130966, 254-758; 5583, EEF1D, 28517, 130967, 197-583; 5583, EEF1D, 28518, 130968, 217-1001; 5583, EEF1D, 28519, 130969, 390-926; 5583, EEF1D, 28520, 130970, 57-356; 5583, EEF1D, 28521, 130971, 230-2323; 5583, EEF1D, 28522, 130972, 675-791; 5583, EEF1D, 28523, 130973, 96-996; 5583, EEF1D, 28524, 130974, 192-787; 5583, EEF1D, 28525, 130975, 231-842; 5583, EEF1D, 28527, 130977, 1-360; 5583, EEF1D, 28528, 130978, 1-469; 5583, EEF1D, 28529, 130979, 582-770; 5583, EEF1D, 28530, 130980, 258-367; 5583, EEF1D, 28532, 130982, 359-506; 5583, EEF1D, 28533, 130983, 48-440; 5583, EEF1D, 28534, 130984, 82-553; 5583, EEF1D, 28536, 130986, 242-853; 5583, EEF1D, 28537, 130987, 376-535; 5583, EEF1D, 28538, 130988, 199-308; 5583, EEF1D, 28539, 130989, 720-1217; 5583, EEF1D, 28540, 130990, 509-614; 5583, EEF1D, 28541, 130991, 163-600; 5583, EEF1D, 28542, 130992, 244-636; 5583, EEF1D, 28544, 130994, 343-2238; 5583, EEF1D, 28549, 130999, 343-2238; 5583, EEF1D, 28550, 131000, 390-926; 5583, EEF1D, 28551, 131001, 495-558; 5583, EEF1D, 28552, 131002, 365-616; 5583, EEF1D, 28554, 131004, 192-787; 5583, EEF1D, 28555, 131005, 720-1217; 5583, EEF1D, 28556, 131006, 217-1001; 5583, EEF1D, 28557, 131007, 509-614; 5583, EEF1D, 28558, 131008, 414-573; 5583, EEF1D, 28559, 131009, 351-555; 5583, EEF1D, 28560, 131010, 156-343; 5583, EEF1D, 28561, 131011, 61-777; 5583, EEF1D, 28563, 131013, 82-553; 5583, EEF1D, 28564, 131014, 258-367; 5583, EEF1D, 28565, 131015, 266-770; 5583, EEF1D, 28566, 131016, 316-559; 5583, EEF1D, 28567, 131017, 242-853; 5583, EEF1D, 28568, 131018, 287-828; 5583, EEF1D, 28569, 131019, 163-600; 5583, EEF1D, 28571, 131021, 582-770; 5583, EEF1D, 28572, 131022, 445-538; 5583, EEF1D, 28573, 131023, 96-996; 5583, EEF1D, 28574, 131024, 57-356; 5583, EEF1D, 28575, 131025, 55-473; 5583, EEF1D, 28576, 131026, 1-330; 5583, EEF1D, 28577, 131027, 675-791; 5583, EEF1D, 28578, 131028, 231-842; 5583, EEF1D, 28580, 131030, 359-506; 5583, EEF1D, 28581, 131031, 43-813; 5583, EEF1D, 28582, 131032, 197-583; 5583, EEF1D, 28583, 131033, 191-761; 5583, EEF1D, 28584, 131034, 57-617; 5583, EEF1D, 28494, 130944, 518-1363; 5583, EEF1D, 28495, 130945, 340-1185; 5583, EEF1D, 28496, 130946, 512-1357; 5583, EEF1D, 28497, 130947, 200-2143; 5583, EEF1D, 28498, 130948, 340-2283; 5583, EEF1D, 28505, 130955, 86-859;

5583, EEF1D, 28526, 130976, 402-1247; 5583, EEF1D, 28531, 130981, 255-1028; 5583, EEF1D, 28535, 130985, 74-862; 5583, EEF1D, 28543, 130993, 200-2143; 5583, EEF1D, 28545, 130995, 340-1185; 5583, EEF1D, 28546, 130996, 512-1357; 5583, EEF1D, 28547, 130997, 340-2283; 5583, EEF1D, 28548, 130998, 518-1363; 5583, EEF1D, 28553, 131003, 402-1247; 5583, EEF1D, 28562, 131012, 86-859; 5583, EEF1D, 28570, 131020, 255-1028; 5583, EEF1D, 28579, 131029, 74-862; 5584, EEF1E1, 28587, 131037, 39-491; 5584, EEF1E1, 28588, 131038, 160-443; 5584, EEF1E1, 28589, 131039, 1-171; 5584, EEF1E1, 28590, 131040, 1-410; 5584, EEF1E1, 28585, 131035, 58-582; 5584, EEF1E1, 28586, 131036, 28-447; 5585, EEF1G, 28591, 131041, 132-1445; 5586, EEF2, 28593, 131043, 1-256; 5586, EEF2, 28592, 131042, 90-2666; 5587, EIF1, 28595, 131045, 153-518; 5587, EIF1, 28596, 131046, 1-162; 5587, EIF1, 28594, 131044, 147-488; 5588, EIF1AD, 28598, 131048, 354-588; 5588, EIF1AD, 28599, 131049, 245-584; 5588, EIF1AD, 28601, 131051, 192-533; 5588, EIF1AD, 28603, 131053, 238-580; 5588, EIF1AD, 28606, 131056, 94-288; 5588, EIF1AD, 28597, 131047, 336-833; 5588, EIF1AD, 28600, 131050, 362-859; 5588, EIF1AD, 28602, 131052, 360-857; 5588, EIF1AD, 28604, 131054, 145-642; 5588, EIF1AD, 28605, 131055, 210-707; 5589, EIF1AX, 28607, 131057, 187-537; 5589, EIF1AX, 28608, 131058, 205-639; 5590, EIF1AY, 28610, 131060, 79-462; 5590, EIF1AY, 28609, 131059, 148-582; 5591, EIF1B, 28611, 131061, 259-600; 5592, EIF2AK4, 28614, 131064, 1-4282; 5592, EIF2AK4, 28615, 131065, 21-431; 5592, EIF2AK4, 28616, 131066, 1-241; 5592, EIF2AK4, 28612, 131062, 44-4993; 5592, EIF2AK4, 28613, 131063, 51-1901; 5593, EIF2S1, 28619, 131069, 181-999; 5593, EIF2S1, 28620, 131070, 1-758; 5593, EIF2S1, 28617, 131067, 462-1409; 5593, EIF2S1, 28618, 131068, 761-1708; 5594, EIF2S2, 28621, 131071, 223-1224; 5595, EIF2S3, 28623, 131073, 1-550; 5595, EIF2S3, 28622, 131072, 254-1672; 5596, EIF2A, 28624, 131074, 10-1752; 5596, EIF2A, 28627, 131077, 4-231; 5596, EIF2A, 28628, 131078, 16-725; 5596, EIF2A, 28629, 131079, 37-216; 5596, EIF2A, 28630, 131080, 1-475; 5596, EIF2A, 28631, 131081, 1-123; 5596, EIF2A, 28633, 131083, 1-950; 5596, EIF2A, 28625, 131075, 17-1591; 5596, EIF2A, 28626, 131076, 110-1867; 5596, EIF2A, 28632, 131082, 119-1801; 5597, EIF2AK1, 28635, 131085, 82-327; 5597, EIF2AK1, 28636, 131086, 1-217; 5597, EIF2AK1, 28637, 131087, 82-573; 5597, EIF2AK1, 28634, 131084, 148-2040; 5598, EIF2AK2, 28639, 131089, 258-564; 5598, EIF2AK2, 28642, 131092, 201-623; 5598, EIF2AK2, 28638, 131088, 324-1979; 5598, EIF2AK2, 28640, 131090, 558-2213; 5598, EIF2AK2, 28641, 131091, 1-1533; 5599, EIF2AK3, 28644, 131094, 330-3227; 5599, EIF2AK3, 28645, 131095, 33-2902; 5599, EIF2AK3, 28643, 131093, 303-3653; 5600, EIF2B1, 28647, 131097, 28-636; 5600, EIF2B1, 28648, 131098, 1-458; 5600, EIF2B1, 28646, 131096, 210-1127; 5600, EIF2B1, 28649, 131099, 210-878; 5601, EIF2B2, 28651, 131101, 1-603; 5601, EIF2B2, 28652, 131102, 18-638; 5601, EIF2B2, 28653, 131103, 1-216; 5601, EIF2B2, 28650, 131100, 81-1136; 5602, EIF2B3, 28656, 131106, 1-668; 5602, EIF2B3, 28658, 131108, 117-503; 5602, EIF2B3, 28654, 131104, 128-1486; 5602, EIF2B3, 28655, 131105, 105-1343; 5602, EIF2B3, 28657, 131107, 240-1445; 5603, EIF2B4, 28660, 131110, 2-709; 5603, EIF2B4, 28663, 131113, 1-584; 5603, EIF2B4, 28664, 131114, 16-54; 5603, EIF2B4, 28665, 131115, 314-1948; 5603, EIF2B4, 28666, 131116, 144-1706; 5603, EIF2B4, 28667, 131117, 210-896; 5603, EIF2B4, 28659, 131109, 173-1744; 5603, EIF2B4, 28661, 131111, 21-1589; 5603, EIF2B4, 28662, 131112, 1-1632; 5604, EIF2B5, 28669, 131119, 1-277; 5604, EIF2B5, 28670, 131120, 11-2128; 5604, EIF2B5, 28671, 131121, 22-345; 5604, EIF2B5, 28668, 131118, 123-2288; 5605, EIF2D, 28674, 131124, 109-920; 5605, EIF2D, 28675, 131125, 1-199; 5605, EIF2D, 28676, 131126, 1-189; 5605, EIF2D, 28677, 131127, 1-220; 5605, EIF2D, 28672, 131122, 118-1872; 5605, EIF2D, 28673, 131123, 118-1500; 5606, EIF3F, 28678, 131128, 627-1700; 5606, EIF3F, 28679, 131129, 34-1107; 5606, EIF3F, 28680, 131130, 17-391; 5606, EIF3F, 28681, 131131, 1-303; 5607, EIF3A, 28682, 131132, 129-4277; 5607, EIF3A, 28683, 131133, 148-4296; 5608, EIF3B, 28686, 131136, 56-962; 5608, EIF3B, 28687, 131137, 615-1074; 5608, EIF3B, 28684, 131134, 57-2501; 5608, EIF3B, 28685, 131135, 41-2485; 5609, EIF3C, 28690, 131140, 175-572; 5609, EIF3C, 28691, 131141, 136-581; 5609, EIF3C, 28693, 131143, 278-516; 5609, EIF3C, 28688, 131138, 187-2928; 5609, EIF3C, 28689, 131139, 182-2923; 5609, EIF3C, 28692, 131142, 76-2787; 5609, EIF3C, 28694, 131144, 161-2902; 5609, EIF3C, 28695, 131145, 302-3043; 5610, EIF3CL, 28696, 131146, 124-2868; 5610, EIF3CL, 28697, 131147, 90-2834; 5611, EIF3D, 28699, 131149, 211-581; 5611, EIF3D, 28701, 131151, 188-996; 5611, EIF3D, 28702, 131152, 1-316; 5611, EIF3D, 28703, 131153, 209-729; 5611, EIF3D, 28704, 131154, 1-150; 5611, EIF3D, 28698, 131148, 372-2018; 5611, EIF3D, 28700, 131150, 117-1763; 5612, EIF3E, 28706, 131156, 1-469; 5612, EIF3E, 28707, 131157, 161-1219; 5612, EIF3E, 28708, 131158, 15-152; 5612, EIF3E, 28709, 131159, 1-223; 5612, EIF3E, 28710, 131160, 1-515; 5612, EIF3E, 28711, 131161, 16-186; 5612, EIF3E, 28712, 131162, 334-558; 5612, EIF3E, 28713, 131163, 17-244; 5612, EIF3E, 28714, 131164, 18-697; 5612, EIF3E, 28705, 131155, 64-1401; 5613, EIF3F, 28717, 131167, 17-391; 5613, EIF3F, 28718, 131168, 1-303; 5613, EIF3F, 28715, 131165, 34-1107; 5613, EIF3F, 28716, 131166, 627-1700; 5614, EIF3G, 28720, 131170, 41-828; 5614, EIF3G, 28721, 131171, 60-509; 5614, EIF3G, 28722, 131172, 6-873; 5614, EIF3G, 28723, 131173, 11-169; 5614, EIF3G, 28724, 131174, 1-357; 5614, EIF3G, 28725, 131175, 28-709; 5614, EIF3G, 28726, 131176, 20-142; 5614, EIF3G, 28719, 131169, 44-1006; 5615, EIF3H, 28727, 131177, 768-1868; 5615, EIF3H, 28728, 131178, 271-562; 5615, EIF3H, 28729, 131179, 112-843; 5615, EIF3H, 28730, 131180, 26-731; 5615, EIF3H, 28731, 131181, 9-518; 5615, EIF3H, 28732, 131182, 33-203; 5615, EIF3H, 28734, 131184, 27-167; 5615, EIF3H, 28735, 131185, 27-1076; 5615, EIF3H, 28733, 131183, 25-1083; 5616, EIF3I, 28736, 131186, 190-564; 5616, EIF3I, 28737, 131187, 73-1050; 5617, EIF3J, 28741, 131191, 1-319; 5617, EIF3J, 28742, 131192, 1-352; 5617, EIF3J, 28738, 131188, 139-915; 5617, EIF3J, 28739, 131189, 71-700; 5617, EIF3J, 28740, 131190, 13-627; 5618, EIF3K, 28745, 131195, 236-610; 5618, EIF3K, 28746, 131196, 332-727; 5618, EIF3K, 28747, 131197, 74-583; 5618, EIF3K, 28748, 131198, 59-637; 5618, EIF3K, 28749, 131199, 84-497; 5618, EIF3K, 28750, 131200, 188-745; 5618, EIF3K, 28751, 131201, 188-745; 5618, EIF3K, 28752, 131202, 59-637; 5618, EIF3K, 28753, 131203, 236-610; 5618, EIF3K, 28754, 131204, 77-712; 5618, EIF3K, 28755, 131205, 173-829; 5618, EIF3K, 28756, 131206, 74-583; 5618, EIF3K, 28757, 131207, 332-727; 5618, EIF3K, 28758, 131208, 84-497; 5618, EIF3K, 28743, 131193, 173-829; 5618, EIF3K, 28744, 131194, 77-712; 5619, EIF3L, 28760, 131210, 716-2116; 5619, EIF3L, 28761, 131211, 134-583; 5619, EIF3L, 28762, 131212, 31-581; 5619, EIF3L, 28763, 131213, 1-123; 5619, EIF3L, 28764, 131214, 1-384; 5619,

EIF3L, 28765, 131215, 1-330; 5619, EIF3L, 28766, 131216, 454-2277; 5619, EIF3L, 28759, 131209, 34-1584; 5619, EIF3L, 28767, 131217, 79-1773; 5620, EIF3M, 28768, 131218, 317-889; 5620, EIF3M, 28769, 131219, 1-662; 5620, EIF3M, 28770, 131220, 41-220; 5620, EIF3M, 28771, 131221, 444-749; 5620, EIF3M, 28772, 131222, 57-281; 5620, EIF3M, 28773, 131223, 91-462; 5620, EIF3M, 28774, 131224, 51-143; 5620, EIF3M, 28775, 131225, 64-1188; 5620, EIF3M, 28776, 131226, 55-783; 5621, EIF4G1, 28779, 131229, 369-4556; 5621, EIF4G1, 28784, 131234, 199-414; 5621, EIF4G1, 28785, 131235, 158-2658; 5621, EIF4G1, 28787, 131237, 1-677; 5621, EIF4G1, 28788, 131238, 1-4683; 5621, EIF4G1, 28789, 131239, 1-541; 5621, EIF4G1, 28790, 131240, 114-2384; 5621, EIF4G1, 28791, 131241, 1-4311; 5621, EIF4G1, 28792, 131242, 129-983; 5621, EIF4G1, 28793, 131243, 293-445; 5621, EIF4G1, 28794, 131244, 198-2907; 5621, EIF4G1, 28796, 131246, 148-578; 5621, EIF4G1, 28797, 131247, 177-558; 5621, EIF4G1, 28798, 131248, 497-5038; 5621, EIF4G1, 28799, 131249, 108-596; 5621, EIF4G1, 28800, 131250, 455-730; 5621, EIF4G1, 28801, 131251, 94-524; 5621, EIF4G1, 28803, 131253, 148-2755; 5621, EIF4G1, 28804, 131254, 282-542; 5621, EIF4G1, 28805, 131255, 215-694; 5621, EIF4G1, 28777, 131227, 272-5071; 5621, EIF4G1, 28778, 131228, 238-4545; 5621, EIF4G1, 28780, 131230, 215-5035; 5621, EIF4G1, 28781, 131231, 415-5217; 5621, EIF4G1, 28782, 131232, 200-5020; 5621, EIF4G1, 28783, 131233, 248-4786; 5621, EIF4G1, 28786, 131236, 445-5124; 5621, EIF4G1, 28795, 131245, 18-4229; 5621, EIF4G1, 28802, 131252, 369-4583; 5621, EIF4G1, 28806, 131256, 390-5210; 5622, EIF4G2, 28808, 131258, 91-2700; 5622, EIF4G2, 28809, 131259, 185-573; 5622, EIF4G2, 28810, 131260, 638-1969; 5622, EIF4G2, 28811, 131261, 223-1069; 5622, EIF4G2, 28812, 131262, 40-294; 5622, EIF4G2, 28813, 131263, 244-591; 5622, EIF4G2, 28814, 131264, 168-2891; 5622, EIF4G2, 28815, 131265, 1-557; 5622, EIF4G2, 28816, 131266, 512-3235; 5622, EIF4G2, 28817, 131267, 1-702; 5622, EIF4G2, 28818, 131268, 306-571; 5622, EIF4G2, 28819, 131269, 307-447; 5622, EIF4G2, 28820, 131270, 555-1286; 5622, EIF4G2, 28821, 131271, 312-563; 5622, EIF4G2, 28822, 131272, 219-555; 5622, EIF4G2, 28823, 131273, 1-62; 5622, EIF4G3, 28807, 131257, 493-3216; 5623, EIF4G3, 28827, 131277, 582-5447; 5623, EIF4G3, 28828, 131278, 619-1270; 5623, EIF4G3, 28829, 131279, 463-1122; 5623, EIF4G3, 28831, 131281, 1-5325; 5623, EIF4G3, 28824, 131274, 196-4953; 5623, EIF4G3, 28825, 131275, 498-2045; 5623, EIF4G3, 28826, 131276, 623-4540; 5623, EIF4G3, 28830, 131280, 585-5360; 5624, EIF4A1, 28833, 131283, 16-273; 5624, EIF4A1, 28834, 131284, 15-577; 5624, EIF4A1, 28835, 131285, 442-696; 5624, EIF4A1, 28836, 131286, 61-213; 5624, EIF4A1, 28837, 131287, 1-691; 5624, EIF4A1, 28838, 131288, 193-447; 5624, EIF4A1, 28839, 131289, 1-1026; 5624, EIF4A1, 28840, 131290, 339-1109; 5624, EIF4A1, 28841, 131291, 197-547; 5624, EIF4A1, 28842, 131292, 149-552; 5624, EIF4A1, 28843, 131293, 5-818; 5624, EIF4A1, 28844, 131294, 1-207; 5624, EIF4A1, 28846, 131296, 74-563; 5624, EIF4A1, 28847, 131297, 15-302; 5624, EIF4A1, 28848, 131298, 1-642; 5624, EIF4A1, 28849, 131299, 17-241; 5624, EIF4A1, 28850, 131300, 17-241; 5624, EIF4A1, 28851, 131301, 17-916; 5624, EIF4A1, 28832, 131282, 17-1237; 5624, EIF4A1, 28845, 131295, 6-1049; 5625, EIF4A2, 28853, 131303, 35-325; 5625, EIF4A2, 28854, 131304, 40-330; 5625, EIF4A2, 28856, 131306, 15-308; 5625, EIF4A2, 28857, 131307, 310-480; 5625, EIF4A2, 28858, 131308, 35-1123; 5625, EIF4A2, 28859, 131309, 307-600; 5625, EIF4A2, 28860, 131310, 252-579; 5625, EIF4A2, 28852, 131302, 65-1288; 5625, EIF4A2, 28855, 131305, 35-1261; 5626, EIF4A3, 28862, 131312, 179-553; 5626, EIF4A3, 28861, 131311, 223-1458; 5627, EIF4B, 28864, 131314, 29-1879; 5627, EIF4B, 28866, 131316, 29-537; 5627, EIF4B, 28867, 131317, 26-709; 5627, EIF4B, 28868, 131318, 54-581; 5627, EIF4B, 28869, 131319, 1-558; 5627, EIF4B, 28870, 131320, 17-1097; 5627, EIF4B, 28871, 131321, 16-841; 5627, EIF4B, 28863, 131313, 327-2162; 5627, EIF4B, 28865, 131315, 28-1746; 5628, EIF4E, 28874, 131324, 1-466; 5628, EIF4E, 28875, 131325, 212-949; 5628, EIF4E, 28877, 131327, 14-142; 5628, EIF4E, 28872, 131322, 121-834; 5628, EIF4E, 28873, 131323, 1526-2179; 5628, EIF4E, 28876, 131326, 22-768; 5629, EIF4EBP1, 28878, 131328, 234-590; 5630, EIF4EBP2, 28879, 131329, 24-386; 5631, EIF4EBP3, 28880, 131330, 73-375; 5632, EIF4E1B, 28882, 131332, 312-581; 5632, EIF4E1B, 28883, 131333, 1-514; 5632, EIF4E1B, 28881, 131331, 585-1313; 5632, EIF4E1B, 28884, 131334, 321-1049; 5633, EIF4E2, 28886, 131336, 34-636; 5633, EIF4E2, 28887, 131337, 37-738; 5633, EIF4E2, 28888, 131338, 22-591; 5633, EIF4E2, 28890, 131340, 37-603; 5633, EIF4E2, 28891, 131341, 43-753; 5633, EIF4E2, 28892, 131342, 1-366; 5633, EIF4E2, 28893, 131343, 408-1048; 5633, EIF4E2, 28885, 131335, 674-1411; 5633, EIF4E2, 28889, 131339, 43-747; 5634, EIF4E3, 28899, 131349, 460-613; 5634, EIF4E3, 28900, 131350, 415-693; 5634, EIF4E3, 28901, 131351, 388-519; 5634, EIF4E3, 28894, 131344, 453-809; 5634, EIF4E3, 28895, 131345, 336-692; 5634, EIF4E3, 28896, 131346, 9-683; 5634, EIF4E3, 28897, 131347, 460-816; 5634, EIF4E3, 28898, 131348, 421-777; 5635, EIF4ENIF1, 28904, 131354, 61-251; 5635, EIF4ENIF1, 28905, 131355, 184-374; 5635, EIF4ENIF1, 28906, 131356, 28-2913; 5635, EIF4ENIF1, 28908, 131358, 1-284; 5635, EIF4ENIF1, 28909, 131359, 123-688; 5635, EIF4ENIF1, 28910, 131360, 1-718; 5635, EIF4ENIF1, 28902, 131352, 76-3033; 5635, EIF4ENIF1, 28903, 131353, 159-2594; 5635, EIF4ENIF1, 28907, 131357, 225-3182; 5636, EIF4H, 28911, 131361, 140-886; 5636, EIF4H, 28912, 131362, 29-715; 5637, EIF5, 28915, 131365, 378-583; 5637, EIF5, 28916, 131366, 570-723; 5637, EIF5, 28917, 131367, 243-569; 5637, EIF5, 28918, 131368, 281-719; 5637, EIF5, 28919, 131369, 352-678; 5637, EIF5, 28920, 131370, 278-580; 5637, EIF5, 28922, 131372, 272-872; 5637, EIF5, 28913, 131363, 677-1972; 5637, EIF5, 28914, 131364, 534-1829; 5637, EIF5, 28921, 131371, 913-2208; 5638, EIF5A, 28930, 131380, 163-602; 5638, EIF5A, 28931, 131381, 193-753; 5638, EIF5A, 28923, 131373, 49-603; 5638, EIF5A, 28924, 131374, 402-866; 5638, EIF5A, 28925, 131375, 162-626; 5638, EIF5A, 28926, 131376, 227-691; 5638, EIF5A, 28927, 131377, 257-721; 5638, EIF5A, 28928, 131378, 330-794; 5638, EIF5A, 28929, 131379, 191-655; 5639, EIF5A2, 28933, 131383, 113-457; 5639, EIF5A2, 28934, 131384, 92-421; 5639, EIF5A2, 28935, 131385, 138-455; 5639, EIF5A2, 28932, 131382, 187-648; 5640, EIF5AL1, 28936, 131386, 50-514; 5641, EIF5B, 28938, 131388, 185-3847; 5641, EIF5B, 28937, 131387, 203-3865; 5642, EIF6, 28942, 131392, 227-551; 5642, EIF6, 28943, 131393, 37-216; 5642, EIF6, 28944, 131394, 85-411; 5642, EIF6, 28945, 131395, 67-627; 5642, EIF6, 28939, 131389, 229-966; 5642, EIF6, 28940, 131390, 51-731; 5642, EIF6, 28941, 131391, 266-1003; 5642, EIF6, 28946, 131396, 27-764; 5643, ETF1, 28949, 131399, 150-1421; 5643, ETF1, 28950, 131400, 74-361; 5643, ETF1, 28951, 131401, 355-713; 5643, ETF1, 28952, 131402, 366-990; 5643, ETF1, 28947, 131397, 223-1536; 5643, ETF1, 28948, 131398, 450-1664;

5644, EVA1A, 28956, 131406, 112-534; 5644, EVA1A, 28958, 131408, 132-434; 5644, EVA1A, 28959, 131409, 142-569; 5644, EVA1A, 28953, 131403, 439-897; 5644, EVA1A, 28954, 131404, 426-884; 5644, EVA1A, 28955, 131405, 539-997; 5644, EVA1A, 28957, 131407, 234-692; 5645, EVA1B, 28960, 131410, 293-790; 5646, EVA1C, 28963, 131413, 170-1351; 5646, EVA1C, 28964, 131414, 477-936; 5646, EVA1C, 28965, 131415, 418-630; 5646, EVA1C, 28966, 131416, 302-880; 5646, EVA1C, 28967, 131417, 418-630; 5646, EVA1C, 28961, 131411, 474-1799; 5646, EVA1C, 28962, 131412, 153-1469; 5647, EVX1, 28968, 131418, 332-937; 5647, EVX1, 28970, 131420, 1-321; 5647, EVX1, 28969, 131419, 332-1555; 5648, EVX2, 28971, 131421, 138-1568; 5649, ETAA1, 28972, 131422, 131-2911; 5650, EWSR1, 28974, 131424, 47-1903; 5650, EWSR1, 28975, 131425, 329-2191; 5650, EWSR1, 28977, 131427, 1-925; 5650, EWSR1, 28980, 131430, 12-710; 5650, EWSR1, 28981, 131431, 48-587; 5650, EWSR1, 28983, 131433, 85-582; 5650, EWSR1, 28984, 131434, 85-553; 5650, EWSR1, 28985, 131435, 56-933; 5650, EWSR1, 28986, 131436, 329-560; 5650, EWSR1, 28987, 131437, 329-2083; 5650, EWSR1, 28973, 131423, 20-1084; 5650, EWSR1, 28976, 131426, 12-1814; 5650, EWSR1, 28978, 131428, 320-2290; 5650, EWSR1, 28979, 131429, 65-2032; 5650, EWSR1, 28982, 131432, 22-2007; 5651, ERCC1, 28992, 131442, 1-138; 5651, ERCC1, 28993, 131443, 1-337; 5651, ERCC1, 28994, 131444, 250-674; 5651, ERCC1, 28995, 131445, 1-275; 5651, ERCC1, 28996, 131446, 165-938; 5651, ERCC1, 28998, 131448, 128-769; 5651, ERCC1, 28999, 131449, 37-738; 5651, ERCC1, 29000, 131450, 112-738; 5651, ERCC1, 28988, 131438, 193-1164; 5651, ERCC1, 28989, 131439, 593-1486; 5651, ERCC1, 28990, 131440, 67-888; 5651, ERCC1, 28991, 131441, 101-778; 5651, ERCC1, 28997, 131447, 553-1446; 5652, ERCC2, 29001, 131451, 754-2871; 5652, ERCC2, 29002, 131452, 48-2096; 5652, ERCC2, 29005, 131455, 131-1007; 5652, ERCC2, 29006, 131456, 18-401; 5652, ERCC2, 29007, 131457, 1-608; 5652, ERCC2, 29008, 131458, 364-690; 5652, ERCC2, 29003, 131453, 79-2361; 5652, ERCC2, 29004, 131454, 220-1437; 5653, ERCC3, 29010, 131460, 14-229; 5653, ERCC3, 29011, 131461, 1-563; 5653, ERCC3, 29012, 131462, 65-280; 5653, ERCC3, 29009, 131459, 96-2444; 5654, ERCC4, 29015, 131465, 1-108; 5654, ERCC4, 29016, 131466, 1-227; 5654, ERCC4, 29013, 131463, 10-2760; 5654, ERCC4, 29014, 131464, 10-1128; 5655, ERCC5, 29019, 131469, 219-350; 5655, ERCC5, 29021, 131471, 11-3568; 5655, ERCC5, 29017, 131467, 1424-4984; 5655, ERCC5, 29018, 131468, 1647-2906; 5655, ERCC5, 29020, 131470, 427-1125; 5656, ERCC6, 29023, 131473, 122-660; 5656, ERCC6, 29024, 131474, 1-233; 5656, ERCC6, 29025, 131475, 314-2905; 5656, ERCC6, 29026, 131476, 194-546; 5656, ERCC6, 29027, 131477, 5858-6088; 5656, ERCC6, 29022, 131472, 80-4561; 5657, ERCC6L, 29029, 131479, 604-3987; 5657, ERCC6L, 29028, 131478, 137-3889; 5658, ERCC6L2, 29031, 131481, 1-1568; 5658, ERCC6L2, 29032, 131482, 1-546; 5658, ERCC6L2, 29033, 131483, 1-249; 5658, ERCC6L2, 29034, 131484, 1-1098; 5658, ERCC6L2, 29035, 131485, 1-164; 5658, ERCC6L2, 29030, 131480, 306-2444; 5659, ERCC8, 29037, 131487, 44-217; 5659, ERCC8, 29038, 131488, 282-684; 5659, ERCC8, 29036, 131486, 44-1234; 5660, EXOC1, 29039, 131489, 134-2818; 5660, EXOC1, 29040, 131490, 70-2709; 5660, EXOC1, 29041, 131491, 349-3033; 5661, EXOC2, 29043, 131493, 299-720; 5661, EXOC2, 29042, 131492, 137-2911; 5662, EXOC3, 29045, 131495, 219-424; 5662, EXOC3, 29046, 131496, 1-1421; 5662, EXOC3, 29047, 131497, 115-1503; 5662, EXOC3, 29044, 131494, 58-2295; 5662, EXOC3, 29048, 131498, 190-2427; 5663, EXOC3L1, 29050, 131500, 210-2247; 5663, EXOC3L1, 29051, 131501, 174-2225; 5663, EXOC3L1, 29052, 131502, 424-666; 5663, EXOC3L1, 29053, 131503, 260-803; 5663, EXOC3L1, 29049, 131499, 242-2482; 5664, EXOC3L2, 29054, 131504, 29-1258; 5664, EXOC3L2, 29055, 131505, 42-1271; 5665, EXOC3L4, 29057, 131507, 1-637; 5665, EXOC3L4, 29058, 131508, 1-460; 5665, EXOC3L4, 29059, 131509, 1-46; 5665, EXOC3L4, 29056, 131506, 77-2245; 5666, EXOC4, 29060, 131510, 30-2954; 5666, EXOC4, 29061, 131511, 30-1451; 5667, EXOC5, 29062, 131512, 252-2183; 5667, EXOC5, 29063, 131513, 252-2387; 5667, EXOC5, 29064, 131514, 190-324; 5667, EXOC5, 29065, 131515, 333-518; 5667, EXOC5, 29066, 131516, 361-2487; 5668, EXOC6, 29068, 131518, 50-511; 5668, EXOC6, 29070, 131520, 67-2172; 5668, EXOC6, 29071, 131521, 1-216; 5668, EXOC6, 29072, 131522, 47-1261; 5668, EXOC6, 29067, 131517, 15-2429; 5668, EXOC6, 29069, 131519, 27-2426; 5669, EXOC6B, 29074, 131524, 96-218; 5669, EXOC6B, 29075, 131525, 132-2177; 5669, EXOC6B, 29076, 131526, 110-2557; 5669, EXOC6B, 29073, 131523, 132-2567; 5670, EXOC7, 29079, 131529, 1-1853; 5670, EXOC7, 29080, 131530, 55-2136; 5670, EXOC7, 29081, 131531, 43-522; 5670, EXOC7, 29082, 131532, 221-583; 5670, EXOC7, 29083, 131533, 178-543; 5670, EXOC7, 29085, 131535, 161-2131; 5670, EXOC7, 29086, 131536, 1-102; 5670, EXOC7, 29087, 131537, 317-820; 5670, EXOC7, 29089, 131539, 127-2097; 5670, EXOC7, 29090, 131540, 1-2124; 5670, EXOC7, 29077, 131527, 4-1965; 5670, EXOC7, 29078, 131528, 55-2262; 5670, EXOC7, 29084, 131534, 1-2031; 5670, EXOC7, 29088, 131538, 67-2121; 5671, EXOC8, 29091, 131541, 108-2285; 5672, EXO1, 29094, 131544, 203-607; 5672, EXO1, 29095, 131545, 96-593; 5672, EXO1, 29096, 131546, 444-950; 5672, EXO1, 29097, 131547, 1-623; 5672, EXO1, 29098, 131548, 549-583; 5672, EXO1, 29099, 131549, 337-621; 5672, EXO1, 29092, 131542, 315-2855; 5672, EXO1, 29093, 131543, 594-3134; 5672, EXO1, 29100, 131550, 215-2626; 5673, EXD1, 29103, 131553, 319-483; 5673, EXD1, 29101, 131551, 192-1736; 5673, EXD1, 29102, 131552, 267-1985; 5674, EXD2, 29110, 131560, 802-1143; 5674, EXD2, 29104, 131554, 322-2187; 5674, EXD2, 29105, 131555, 781-2271; 5674, EXD2, 29106, 131556, 80-1570; 5674, EXD2, 29107, 131557, 657-2147; 5674, EXD2, 29108, 131558, 658-2148; 5674, EXD2, 29109, 131559, 129-1994; 5675, EXD3, 29113, 131563, 97-267; 5675, EXD3, 29114, 131564, 1-110; 5675, EXD3, 29115, 131565, 1-423; 5675, EXD3, 29116, 131566, 146-268; 5675, EXD3, 29111, 131561, 197-2827; 5675, EXD3, 29112, 131562, 90-830; 5676, EXO5, 29120, 131570, 134-805; 5676, EXO5, 29121, 131571, 115-856; 5676, EXO5, 29122, 131572, 186-863; 5676, EXO5, 29123, 131573, 200-941; 5676, EXO5, 29124, 131574, 383-865; 5676, EXO5, 29125, 131575, 387-688; 5676, EXO5, 29117, 131567, 206-1327; 5676, EXO5, 29118, 131568, 401-1522; 5676, EXO5, 29119, 131569, 1075-2196; 5677, EXPH5, 29128, 131578, 296-5495; 5677, EXPH5, 29129, 131579, 319-555; 5677, EXPH5, 29130, 131580, 318-3893; 5677, EXPH5, 29131, 131581, 251-1882; 5677, EXPH5, 29126, 131576, 112-6081; 5677, EXPH5, 29127, 131577, 6-5954; 5678, ERI1, 29133, 131583, 174-308; 5678, ERI1, 29136, 131586, 136-435; 5678, ERI1, 29132, 131582, 261-1310; 5678, ERI1, 29134, 131584, 680-1729; 5678, ERI1, 29135, 131585, 221-1270; 5679, EXOSC1, 29137, 131587, 1-497; 5679, EXOSC1, 29138, 131588, 9-521; 5679, EXOSC1, 29139, 131589, 4-540; 5679, EXOSC1, 29141, 131591, 1-431; 5679, EXOSC1, 29142, 131592, 1-420; 5679, EXOSC1, 29140, 131590, 33-620; 5680, EXOSC10, 29145, 131595, 24-398; 5680, EXOSC10, 29143, 131593, 39-2621; 5680, EXOSC10, 29144, 131594, 51-2708; 5681, EXOSC2, 29146, 131596, 6-606; 5681, EXOSC2, 29148, 131598, 13-870; 5681, EXOSC2, 29150, 131600, 1-709; 5681, EXOSC2, 29147, 131597, 7-798; 5681, EXOSC2, 29149, 131599, 72-953; 5681, EXOSC2, 29151, 131601, 33-836; 5682, EXOSC3, 29152, 131602, 14-841; 5682, EXOSC3, 29153, 131603, 21-515; 5682, EXOSC3, 29154, 131604, 18-512; 5683, EXOSC4, 29156, 131606, 82-552; 5683, EXOSC4, 29157, 131607, 281-1065; 5683, EXOSC4, 29155, 131605, 104-841; 5684, EXOSC5, 29159, 131609, 15-608; 5684, EXOSC5, 29160, 131610, 4-404; 5684, EXOSC5, 29161, 131611, 1-189; 5684, EXOSC5, 29158, 131608, 152-859; 5685, EXOSC6, 29162, 131612, 31-849; 5686, EXOSC7, 29163, 131613, 49-924; 5687, EXOSC8, 29164, 131614, 24-137; 5687, EXOSC8, 29166, 131616, 1-210; 5687, EXOSC8, 29165, 131615, 266-1096; 5688, EXOSC9, 29169, 131619, 101-361; 5688, EXOSC9, 29170, 131620, 80-757; 5688, EXOSC9, 29171, 131621, 103-831; 5688, EXOSC9, 29172, 131622, 1-515; 5688, EXOSC9, 29173, 131623, 217-1488; 5688, EXOSC9, 29167, 131617, 109-1428; 5688, EXOSC9, 29168, 131618, 106-1496; 5689, EXT1, 29175, 131625, 1-622; 5689, EXT1, 29176, 131626, 297-422; 5689, EXT1, 29174, 131624, 808-3048; 5690, EXT2, 29181, 131631, 434-580; 5690, EXT2, 29182, 131632, 244-580; 5690, EXT2, 29177, 131627, 130-2286; 5690, EXT2, 29178, 131628, 167-2353; 5690, EXT2, 29179, 131629, 57-2312; 5690, EXT2, 29180, 131630, 335-2491; 5691, EXTL1, 29183, 131633, 868-2898; 5692, EXTL2, 29186, 131636, 380-730; 5692, EXTL2, 29187, 131637, 104-902; 5692, EXTL2, 29188, 131638, 655-1098; 5692, EXTL2, 29184, 131634, 288-1280; 5692, EXTL2, 29185, 131635, 1438-2430; 5693, EXTL3, 29190, 131640, 1-227; 5693, EXTL3, 29191, 131641, 135-1742; 5693, EXTL3, 29192, 131642, 1-601; 5693, EXTL3, 29193, 131643, 174-529; 5693, EXTL3, 29194, 131644, 105-517; 5693, EXTL3, 29189, 131639, 903-3662; 5694, XPO1, 29198, 131648, 1-219; 5694, XPO1, 29199, 131649, 142-318; 5694, XPO1, 29200, 131650, 382-682; 5694, XPO1, 29201, 131651, 207-488; 5694, XPO1, 29202, 131652, 168-565; 5694, XPO1, 29203, 131653, 394-579; 5694, XPO1, 29204, 131654, 677-925; 5694, XPO1, 29205, 131655, 97-382; 5694, XPO1, 29206, 131656, 106-643; 5694, XPO1, 29195, 131645, 729-3944; 5694, XPO1, 29196, 131646, 144-3359; 5694, XPO1, 29197, 131647, 408-3623; 5695, XPO4, 29208, 131658, 37-3492; 5695, XPO4, 29207, 131657, 73-3528; 5696, XPO5, 29210, 131660, 122-352; 5696, XPO5, 29211, 131661, 1-74; 5696, XPO5, 29212, 131662, 1-758; 5696, XPO5, 29213, 131663, 1-324; 5696, XPO5, 29214, 131664, 1-182; 5696, XPO5, 29209, 131659, 212-3826; 5697, XPO6, 29216, 131666, 1-462; 5697, XPO6, 29217, 131667, 1-484; 5697, XPO6, 29218, 131668, 131-558; 5697, XPO6, 29219, 131669, 664-715; 5697, XPO6, 29220, 131670, 1-399; 5697, XPO6, 29222, 131672, 198-262; 5697, XPO6, 29223, 131673, 1-403; 5697, XPO6, 29224, 131674, 1-60; 5697, XPO6, 29225, 131675, 1-765; 5697, XPO6, 29215, 131665, 502-3879; 5697, XPO6, 29221, 131671, 361-3696; 5698, XPO7, 29227, 131677, 56-3322; 5698, XPO7, 29228, 131678, 1-569; 5698, XPO7, 29229, 131679, 172-883; 5698, XPO7, 29226, 131676, 101-3364; 5699, XPOT, 29231, 131681, 380-984; 5699, XPOT, 29232, 131682, 367-548; 5699, XPOT, 29233, 131683, 1-192; 5699, XPOT, 29230, 131680, 530-3418; 5700, ESYT1, 29236, 131686, 277-540; 5700, ESYT1, 29234, 131684, 54-3398; 5700, ESYT1, 29235, 131685, 265-3579; 5701, ESYT2, 29238, 131688, 1-2655; 5701, ESYT2, 29239, 131689, 1-2766; 5701, ESYT2, 29237, 131687, 67-2748; 5702, ESYT3, 29240, 131690, 175-1107; 5702, ESYT3, 29241, 131691, 187-2847; 5702, ESYT3, 29242, 131692, 184-1689; 5703, ESPL1, 29244, 131694, 58-207; 5703, ESPL1, 29246, 131696, 92-714; 5703, ESPL1, 29243, 131693, 92-6454; 5703, ESPL1, 29245, 131695, 85-6447; 5704, ELFN1, 29247, 131697, 488-2974; 5704, ELFN1, 29248, 131698, 385-2871; 5705, ELFN2, 29249, 131699, 787-3249; 5705, ELFN2, 29250, 131700, 787-3249; 5706, ECM1, 29251, 131701, 104-1351; 5706, ECM1, 29252, 131702, 126-1748; 5706, ECM1, 29253, 131703, 135-1838; 5707, ECM2, 29255, 131705, 151-645; 5707, ECM2, 29256, 131706, 133-612; 5707, ECM2, 29254, 131704, 151-2250; 5707, ECM2, 29257, 131707, 188-2119; 5708, EYA1, 29258, 131708, 269-2029; 5708, EYA1, 29261, 131711, 516-2192; 5708, EYA1, 29263, 131713, 153-1928; 5708, EYA1, 29265, 131715, 140-778; 5708, EYA1, 29266, 131716, 320-445; 5708, EYA1, 29259, 131709, 641-2419; 5708, EYA1, 29260, 131710, 204-1883; 5708, EYA1, 29262, 131712, 222-2000; 5708, EYA1, 29264, 131714, 30-1703; 5709, EYA2, 29267, 131717, 11-1537; 5709, EYA2, 29270, 131720, 1-592; 5709, EYA2, 29272, 131722, 375-1901; 5709, EYA2, 29268, 131718, 375-1991; 5709, EYA2, 29269, 131719, 375-1754; 5709, EYA2, 29271, 131721, 129-1673; 5710, EYA3, 29274, 131724, 211-1461; 5710, EYA3, 29273, 131723, 110-1720; 5710, EYA3, 29275, 131725, 242-1963; 5710, EYA3, 29276, 131726, 262-1824; 5710, EYA3, 29277, 131727, 183-1766; 5711, EYA4, 29281, 131731, 465-2177; 5711, EYA4, 29284, 131734, 230-2167; 5711, EYA4, 29285, 131735, 185-2035; 5711, EYA4, 29278, 131728, 459-2378; 5711, EYA4, 29279, 131729, 398-2248; 5711, EYA4, 29280, 131730, 465-2384; 5711, EYA4, 29282, 131732, 557-2314; 5711, EYA4, 29283, 131733, 1-1920; 5712, EYS, 29291, 131741, 1-1420; 5712, EYS, 29292, 131742, 534-992; 5712, EYS, 29286, 131736, 333-2117; 5712, EYS, 29287, 131737, 1-9498; 5712, EYS, 29288, 131738, 1-9435; 5712, EYS, 29289, 131739, 528-10025; 5712, EYS, 29290, 131740, 539-2398; 5712, EYS, 29293, 131743, 539-9973; 5713, EZR, 29296, 131746, 1-1761; 5713, EZR, 29294, 131744, 135-1895; 5713, EZR, 29295, 131745, 170-1930; 5714, F11R, 29299, 131749, 271-1110; 5714, F11R, 29297, 131747, 276-1175; 5714, F11R, 29298, 131748, 24-776; 5715, FIP1L1, 29303, 131753, 1-79; 5715, FIP1L1, 29304, 131754, 1-765; 5715, FIP1L1, 29300, 131750, 144-1706; 5715, FIP1L1, 29301, 131751, 195-1979; 5715, FIP1L1, 29302, 131752, 195-1961; 5715, FIP1L1, 29305, 131755, 169-1305; 5716, FOXRED1, 29308, 131758, 37-183; 5716, FOXRED1, 29309, 131759, 18-575; 5716, FOXRED1, 29306, 131756, 75-1535; 5716, FOXRED1, 29307, 131757, 165-1583; 5717, FOXRED2, 29313, 131763, 309-567; 5717, FOXRED2, 29310, 131760, 113-2167; 5717, FOXRED2, 29311, 131761, 109-2163; 5717, FOXRED2, 29312, 131762, 95-2149; 5718, FAXC, 29314, 131764, 284-1513; 5718, FAXC, 29315, 131765, 55-444; 5719, FAM47E-STBD1, 29316, 131766, 27-1082; 5719, FAM47E-STBD1, 29317, 131767, 1-576; 5719, FAM47E-STBD1, 29318, 131768, 16-177; 5719, FAM47E-STBD1, 29319, 131769, 15-176; 5720, FAM101A, 29320, 131770, 244-651; 5720, FAM101A, 29321, 131771, 147-554; 5720, FAM101A, 29322, 131772, 481-888; 5720, FAM101A, 29323, 131773, 205-855; 5721, FAM101B, 29324, 131774, 1-435; 5722, FAM102A, 29325, 131775, 313-1041; 5722, FAM102A, 29326, 131776, 377-1531; 5723, FAM102B, 29327, 131777, 341-1423; 5723, FAM102B, 29328, 131778, 341-

1408; 5724, FAM103A1, 29329, 131779, 222-578; 5725, FAM104A, 29332, 131782, 15-344; 5725, FAM104A, 29333, 131783, 140-430; 5725, FAM104A, 29334, 131784, 46-422; 5725, FAM104A, 29335, 131785, 89-400; 5725, FAM104A, 29330, 131780, 62-622; 5725, FAM104A, 29331, 131781, 66-689; 5726, FAM104B, 29336, 131786, 40-390; 5726, FAM104B, 29337, 131787, 155-502; 5726, FAM104B, 29338, 131788, 40-390; 5726, FAM104B, 29339, 131789, 27-167; 5726, FAM104B, 29340, 131790, 135-473; 5726, FAM104B, 29341, 131791, 222-566; 5727, FAM105A, 29342, 131792, 121-1191; 5728, FAM106A, 29343, 131793, 44-553; 5729, FAM107A, 29347, 131797, 265-580; 5729, FAM107A, 29344, 131794, 462-896; 5729, FAM107A, 29345, 131795, 560-994; 5729, FAM107A, 29346, 131796, 178-696; 5729, FAM107A, 29348, 131798, 617-1144; 5729, FAM107A, 29349, 131799, 86-493; 5730, FAM107B, 29356, 131806, 187-458; 5730, FAM107B, 29357, 131807, 450-834; 5730, FAM107B, 29358, 131808, 279-583; 5730, FAM107B, 29360, 131810, 296-549; 5730, FAM107B, 29363, 131813, 258-413; 5730, FAM107B, 29364, 131814, 188-561; 5730, FAM107B, 29365, 131815, 273-475; 5730, FAM107B, 29367, 131817, 181-559; 5730, FAM107B, 29368, 131818, 43-525; 5730, FAM107B, 29369, 131819, 274-552; 5730, FAM107B, 29370, 131820, 234-625; 5730, FAM107B, 29350, 131800, 235-1155; 5730, FAM107B, 29351, 131801, 550-945; 5730, FAM107B, 29352, 131802, 180-575; 5730, FAM107B, 29353, 131803, 262-657; 5730, FAM107B, 29354, 131804, 302-697; 5730, FAM107B, 29355, 131805, 288-683; 5730, FAM107B, 29359, 131809, 222-617; 5730, FAM107B, 29361, 131811, 207-602; 5730, FAM107B, 29362, 131812, 249-644; 5730, FAM107B, 29366, 131816, 143-538; 5730, FAM107B, 29371, 131821, 484-879; 5731, FAM109A, 29373, 131823, 221-571; 5731, FAM109A, 29375, 131825, 351-574; 5731, FAM109A, 29372, 131822, 441-1229; 5731, FAM109A, 29374, 131824, 99-848; 5731, FAM109A, 29376, 131826, 105-854; 5732, FAM109B, 29378, 131828, 213-537; 5732, FAM109B, 29377, 131827, 188-967; 5733, FAM110A, 29384, 131834, 1-569; 5733, FAM110A, 29379, 131829, 145-1032; 5733, FAM110A, 29380, 131830, 382-1269; 5733, FAM110A, 29381, 131831, 263-1150; 5733, FAM110A, 29382, 131832, 335-1222; 5733, FAM110A, 29383, 131833, 140-1027; 5734, FAM110B, 29385, 131835, 881-1993; 5735, FAM110C, 29386, 131836, 1-966; 5736, FAM110D, 29387, 131837, 188-1003; 5737, FAM111A, 29391, 131841, 136-423; 5737, FAM111A, 29394, 131844, 318-867; 5737, FAM111A, 29388, 131838, 225-2060; 5737, FAM111A, 29389, 131839, 415-2250; 5737, FAM111A, 29390, 131840, 629-2464; 5737, FAM111A, 29392, 131842, 832-2667; 5737, FAM111A, 29393, 131843, 2819-4654; 5738, FAM111B, 29397, 131847, 70-557; 5738, FAM111B, 29395, 131845, 192-2396; 5738, FAM111B, 29396, 131846, 122-2236; 5738, FAM111B, 29398, 131848, 116-2230; 5738, FAM111B, 29399, 131849, 93-2297; 5739, FAM114A1, 29401, 131851, 167-567; 5739, FAM114A1, 29400, 131850, 177-1868; 5739, FAM114A1, 29402, 131852, 358-1428; 5740, FAM114A2, 29404, 131854, 241-550; 5740, FAM114A2, 29405, 131855, 78-576; 5740, FAM114A2, 29406, 131856, 325-562; 5740, FAM114A2, 29407, 131857, 66-1373; 5740, FAM114A2, 29408, 131858, 526-571; 5740, FAM114A2, 29409, 131859, 233-609; 5740, FAM114A2, 29410, 131860, 604-794; 5740, FAM114A2, 29411, 131861, 125-754; 5740, FAM114A2, 29414, 131864, 58-807; 5740, FAM114A2, 29403, 131853, 78-1595; 5740, FAM114A2, 29412, 131862, 127-1644; 5740, FAM114A2, 29413, 131863, 589-2106; 5741, FAM117A, 29416, 131866, 45-714; 5741, FAM117A, 29417, 131867, 99-789; 5741, FAM117A, 29419, 131869, 1-168; 5741, FAM117A, 29415, 131865, 81-1442; 5741, FAM117A, 29418, 131868, 717-1262; 5742, FAM117B, 29420, 131870, 1-1770; 5743, FAM118A, 29422, 131872, 70-678; 5743, FAM118A, 29423, 131873, 495-583; 5743, FAM118A, 29424, 131874, 504-549; 5743, FAM118A, 29425, 131875, 103-521; 5743, FAM118A, 29421, 131871, 835-1908; 5743, FAM118A, 29426, 131876, 347-1420; 5744, FAM118B, 29427, 131877, 66-1118; 5744, FAM118B, 29428, 131878, 66-893; 5744, FAM118B, 29430, 131880, 272-1311; 5744, FAM118B, 29431, 131881, 78-784; 5744, FAM118B, 29432, 131882, 174-632; 5744, FAM118B, 29433, 131883, 184-1011; 5744, FAM118B, 29429, 131879, 494-1549; 5745, FAM120A, 29436, 131886, 1-1488; 5745, FAM120A, 29437, 131887, 1-1485; 5745, FAM120A, 29434, 131884, 195-3551; 5745, FAM120A, 29435, 131885, 26-1912; 5746, FAM120AOS, 29439, 131889, 459-683; 5746, FAM120AOS, 29440, 131890, 229-426; 5746, FAM120AOS, 29441, 131891, 459-635; 5746, FAM120AOS, 29438, 131888, 884-1654; 5747, FAM120B, 29443, 131893, 86-2887; 5747, FAM120B, 29444, 131894, 356-3124; 5747, FAM120B, 29445, 131895, 86-2887; 5747, FAM120B, 29448, 131898, 356-3124; 5747, FAM120B, 29442, 131892, 109-2841; 5747, FAM120B, 29446, 131896, 109-2841; 5747, FAM120B, 29447, 131897, 175-903; 5747, FAM120B, 29449, 131899, 175-903; 5748, FAM120C, 29450, 131900, 58-2745; 5748, FAM120C, 29451, 131901, 58-3348; 5748, FAM120C, 29452, 131902, 84-800; 5749, FAM122A, 29453, 131903, 111-974; 5750, FAM122B, 29455, 131905, 951-1754; 5750, FAM122B, 29458, 131908, 218-1021; 5750, FAM122B, 29454, 131904, 263-988; 5750, FAM122B, 29456, 131906, 930-1673; 5750, FAM122B, 29457, 131907, 70-816; 5750, FAM122B, 29459, 131909, 218-1018; 5751, FAM122C, 29463, 131913, 227-466; 5751, FAM122C, 29460, 131910, 407-994; 5751, FAM122C, 29461, 131911, 406-864; 5751, FAM122C, 29462, 131912, 174-521; 5752, FAM124A, 29467, 131917, 169-1029; 5752, FAM124A, 29464, 131914, 132-1880; 5752, FAM124A, 29465, 131915, 136-1776; 5752, FAM124A, 29466, 131916, 169-1074; 5753, FAM124B, 29468, 131918, 318-1136; 5753, FAM124B, 29469, 131919, 227-1045; 5753, FAM124B, 29470, 131920, 267-1634; 5754, FAM126A, 29471, 131921, 189-1448; 5754, FAM126A, 29472, 131922, 179-523; 5754, FAM126A, 29473, 131923, 1-1415; 5754, FAM126A, 29474, 131924, 234-1799; 5755, FAM126B, 29475, 131925, 185-487; 5755, FAM126B, 29477, 131927, 67-692; 5755, FAM126B, 29478, 131928, 275-536; 5755, FAM126B, 29479, 131929, 270-522; 5755, FAM126B, 29476, 131926, 189-1781; 5756, FAM127A, 29480, 131930, 19-360; 5757, FAM127B, 29481, 131931, 68-409; 5758, FAM127C, 29482, 131932, 71-412; 5759, FAM129A, 29484, 131934, 1-301; 5759, FAM129A, 29483, 131933, 195-2981; 5760, FAM129B, 29485, 131935, 215-2455; 5760, FAM129B, 29486, 131936, 53-2254; 5761, FAM129C, 29490, 131940, 54-1742; 5761, FAM129C, 29491, 131941, 79-1941; 5761, FAM129C, 29493, 131943, 38-1792; 5761, FAM129C, 29494, 131944, 51-1760; 5761, FAM129C, 29495, 131945, 104-2104; 5761, FAM129C, 29487, 131937, 139-2094; 5761, FAM129C, 29488, 131938, 139-2232; 5761, FAM129C, 29489, 131939, 662-1933; 5761, FAM129C, 29492, 131942, 139-2139; 5762, FAM13A, 29498, 131948, 195-581; 5762, FAM13A, 29500, 131950, 646-2475; 5762, FAM13A, 29501, 131951, 253-861; 5762, FAM13A, 29503, 131953, 187-639; 5762, FAM13A, 29504, 131954, 201-692; 5762, FAM13A, 29505, 131955, 199-1032; 5762, FAM13A, 29506, 131956, 255-815; 5762, FAM13A, 29496, 131946, 209-3280; 5762, FAM13A, 29497, 131947, 358-2367; 5762, FAM13A, 29499, 131949, 198-2291; 5762, FAM13A, 29502, 131952, 227-2236; 5762, FAM13A, 29507, 131957, 228-2279; 5763, FAM13B, 29511, 131961, 328-590; 5763, FAM13B, 29512, 131962, 373-529; 5763, FAM13B, 29513, 131963, 287-572; 5763, FAM13B, 29514, 131964, 244-669; 5763, FAM13B, 29515, 131965, 338-530; 5763, FAM13B, 29508, 131958, 453-3200; 5763, FAM13B, 29509, 131959, 507-3170; 5763, FAM13B, 29510, 131960, 670-3045; 5764, FAM13C, 29516, 131966, 49-1770; 5764, FAM13C, 29519, 131969, 567-582; 5764, FAM13C, 29520, 131970, 385-459; 5764, FAM13C, 29521, 131971, 1-405; 5764, FAM13C, 29525, 131975, 88-1908; 5764, FAM13C, 29526, 131976, 1-149; 5764, FAM13C, 29527, 131977, 131-283; 5764, FAM13C, 29528, 131978, 105-1922; 5764, FAM13C, 29529, 131979, 63-215; 5764, FAM13C, 29517, 131967, 1-1377; 5764, FAM13C, 29518, 131968, 555-2063; 5764, FAM13C, 29522, 131972, 469-1974; 5764, FAM13C, 29523, 131973, 135-1598; 5764, FAM13C, 29524, 131974, 91-1848; 5765, FAM131A, 29535, 131985, 204-573; 5765, FAM131A, 29536, 131986, 301-1056; 5765, FAM131A, 29537, 131987, 118-812; 5765, FAM131A, 29530, 131980, 1365-2372; 5765, FAM131A, 29531, 131981, 273-1118; 5765, FAM131A, 29532, 131982, 180-1280; 5765, FAM131A, 29533, 131983, 427-1272; 5765, FAM131A, 29534, 131984, 177-1022; 5766, FAM131B, 29538, 131988, 1-35; 5766, FAM131B, 29544, 131994, 30-221; 5766, FAM131B, 29545, 131995, 122-256; 5766, FAM131B, 29539, 131989, 91-1137; 5766, FAM131B, 29540, 131990, 148-1146; 5766, FAM131B, 29541, 131991, 1710-2708; 5766, FAM131B, 29542, 131992, 97-1095; 5766, FAM131B, 29543, 131993, 150-1232; 5767, FAM131C, 29546, 131996, 185-1027; 5768, FAM132A, 29547, 131997, 33-941; 5769, FAM132B, 29548, 131998, 1-224; 5769, FAM132B, 29549, 131999, 1-191; 5769, FAM132B, 29550, 132000, 1-1065; 5770, FAM133A, 29551, 132001, 438-1184; 5770, FAM133A, 29552, 132002, 314-1060; 5771, FAM133B, 29553, 132003, 39-356; 5771, FAM133B, 29557, 132007, 162-253; 5771, FAM133B, 29558, 132008, 1-363; 5771, FAM133B, 29554, 132004, 232-945; 5771, FAM133B, 29555, 132005, 104-847; 5771, FAM133B, 29556, 132006, 218-931; 5772, FAM134A, 29559, 132009, 127-663; 5772, FAM134A, 29560, 132010, 448-729; 5772, FAM134A, 29561, 132011, 77-385; 5772, FAM134A, 29563, 132013, 549-563; 5772, FAM134A, 29564, 132014, 491-992; 5772, FAM134A, 29565, 132015, 1-610; 5772, FAM134A, 29566, 132016, 543-558; 5772, FAM134A, 29562, 132012, 137-1768; 5773, FAM134B, 29569, 132019, 1-653; 5773, FAM134B, 29567, 132017, 88-1581; 5773, FAM134B, 29568, 132018, 387-1457; 5774, FAM134C, 29571, 132021, 52-441; 5774, FAM134C, 29572, 132022, 205-564; 5774, FAM134C, 29573, 132023, 61-312; 5774, FAM134C, 29574, 132024, 1-246; 5774, FAM134C, 29575, 132025, 63-464; 5774, FAM134C, 29576, 132026, 54-296; 5774, FAM134C, 29577, 132027, 233-559; 5774, FAM134C, 29578, 132028, 140-1249; 5774, FAM134C, 29570, 132020, 61-1461; 5775, FAM135A, 29579, 132029, 45-488; 5775, FAM135A, 29584, 132034, 454-546; 5775, FAM135A, 29585, 132035, 412-1926; 5775, FAM135A, 29587, 132037, 408-3695; 5775, FAM135A, 29588, 132038, 491-641; 5775, FAM135A, 29580, 132030, 345-4304; 5775, FAM135A, 29581, 132031, 134-4681; 5775, FAM135A, 29582, 132032, 271-4179; 5775, FAM135A, 29583, 132033, 615-5162; 5775, FAM135A, 29586, 132036, 1-4410; 5776, FAM135B, 29589, 132039, 100-558; 5776, FAM135B, 29592, 132042, 479-684; 5776, FAM135B, 29593, 132043, 125-256; 5776, FAM135B, 29594, 132044, 1-1356; 5776, FAM135B, 29590, 132040, 172-3597; 5776, FAM135B, 29591, 132041, 172-4392; 5777, FAM136A, 29596, 132046, 29-518; 5777, FAM136A, 29597, 132047, 46-363; 5777, FAM136A, 29598, 132048, 35-772; 5777, FAM136A, 29595, 132045, 80-496; 5778, FAM149A, 29601, 132051, 216-1424; 5778, FAM149A, 29602, 132052, 449-557; 5778, FAM149A, 29603, 132053, 388-570; 5778, FAM149A, 29604, 132054, 488-716; 5778, FAM149A, 29605, 132055, 1-161; 5778, FAM149A, 29606, 132056, 1-478; 5778, FAM149A, 29607, 132057, 1-443; 5778, FAM149A, 29599, 132049, 580-2028; 5778, FAM149A, 29600, 132050, 1-2322; 5778, FAM149A, 29608, 132058, 467-1915; 5778, FAM149A, 29609, 132059, 410-1858; 5778, FAM149A, 29610, 132060, 419-1867; 5779, FAM149B1, 29612, 132062, 1-1409; 5779, FAM149B1, 29613, 132063, 1-1008; 5779, FAM149B1, 29614, 132064, 1-630; 5779, FAM149B1, 29611, 132061, 175-1923; 5780, FAM150A, 29615, 132065, 252-641; 5780, FAM150A, 29616, 132066, 153-488; 5781, FAM150B, 29617, 132067, 74-253; 5781, FAM150B, 29619, 132069, 1-308; 5781, FAM150B, 29620, 132070, 185-367; 5781, FAM150B, 29621, 132071, 161-340; 5781, FAM150B, 29622, 132072, 357-809; 5781, FAM150B, 29618, 132068, 342-800; 5781, FAM150B, 29623, 132073, 3-278; 5782, FAM151A, 29624, 132074, 162-1919; 5782, FAM151A, 29625, 132075, 162-1358; 5783, FAM151B, 29627, 132077, 156-359; 5783, FAM151B, 29626, 132076, 156-986; 5784, FAM153A, 29629, 132079, 454-798; 5784, FAM153A, 29631, 132081, 208-596; 5784, FAM153A, 29633, 132083, 91-448; 5784, FAM153A, 29634, 132084, 92-217; 5784, FAM153A, 29635, 132085, 486-558; 5784, FAM153A, 29636, 132086, 70-177; 5784, FAM153A, 29637, 132087, 467-901; 5784, FAM153A, 29638, 132088, 1-1164; 5784, FAM153A, 29628, 132078, 74-1006; 5784, FAM153A, 29630, 132080, 285-1217; 5784, FAM153A, 29632, 132082, 422-1354; 5785, FAM153B, 29640, 132090, 74-1006; 5785, FAM153B, 29641, 132091, 285-1217; 5785, FAM153B, 29642, 132092, 203-602; 5785, FAM153B, 29643, 132093, 422-1354; 5785, FAM153B, 29644, 132094, 202-636; 5785, FAM153B, 29645, 132095, 454-888; 5785, FAM153B, 29639, 132089, 1-1164; 5786, FAM153C, 29647, 132097, 70-597; 5786, FAM153C, 29648, 132098, 422-539; 5786, FAM153C, 29650, 132100, 58-579; 5786, FAM153C, 29646, 132096, 454-798; 5786, FAM153C, 29649, 132099, 202-636; 5786, FAM153C, 29651, 132101, 454-888; 5787, FAM155A, 29652, 132102, 140-1516; 5788, FAM155B, 29653, 132103, 43-1461; 5789, FAM156A, 29655, 132105, 733-848; 5789, FAM156A, 29657, 132107, 233-567; 5789, FAM156A, 29658, 132108, 343-896; 5789, FAM156A, 29659, 132109, 854-865; 5789, FAM156A, 29663, 132113, 360-753; 5789, FAM156A, 29665, 132115, 399-644; 5789, FAM156A, 29666, 132116, 825-992; 5789, FAM156A, 29668, 132118, 501-510; 5789, FAM156A, 29669, 132119, 535-914; 5789, FAM156A, 29670, 132120, 465-569; 5789, FAM156A, 29654, 132104, 1612-2253; 5789, FAM156A, 29656, 132106, 768-1409; 5789, FAM156A, 29660, 132110, 208-849; 5789, FAM156A, 29661, 132111, 351-992; 5789, FAM156A, 29662, 132112, 698-1339; 5789, FAM156A, 29664, 132114, 2423-3064; 5789, FAM156A, 29667, 132117, 903-1544; 5789, FAM156A, 29671, 132121, 601-1242; 5790, FAM156B, 29675, 132125, 825-992; 5790, FAM156B, 29676, 132126, 535-545; 5790, FAM156B, 29677, 132127, 389-776; 5790, FAM156B, 29679, 132129, 710-858; 5790, FAM156B, 29672, 132122, 367-1008; 5790, FAM156B, 29673, 132123, 1203-1844;

5790, FAM156B, 29674, 132124, 1612-2253; 5790, FAM156B, 29678, 132128, 698-1339; 5791, FAM159A, 29680, 132130, 151-723; 5792, FAM159B, 29682, 132132, 93-305; 5792, FAM159B, 29683, 132133, 183-395; 5792, FAM159B, 29681, 132131, 317-799; 5793, FAM160A1, 29686, 132136, 369-548; 5793, FAM160A1, 29687, 132137, 451-570; 5793, FAM160A1, 29688, 132138, 362-401; 5793, FAM160A1, 29689, 132139, 439-565; 5793, FAM160A1, 29684, 132134, 576-3698; 5793, FAM160A1, 29685, 132135, 160-3282; 5794, FAM160A2, 29692, 132142, 312-2828; 5794, FAM160A2, 29690, 132140, 360-3320; 5794, FAM160A2, 29691, 132141, 265-3183; 5795, FAM160B1, 29693, 132143, 310-615; 5795, FAM160B1, 29696, 132146, 1-252; 5795, FAM160B1, 29694, 132144, 336-2633; 5795, FAM160B1, 29695, 132145, 336-2552; 5796, FAM160B2, 29698, 132148, 71-226; 5796, FAM160B2, 29697, 132147, 47-2278; 5796, FAM160B2, 29699, 132149, 47-2278; 5797, FAM161A, 29700, 132150, 24-251; 5797, FAM161A, 29703, 132153, 52-480; 5797, FAM161A, 29704, 132154, 1-1805; 5797, FAM161A, 29701, 132151, 13-2163; 5797, FAM161A, 29702, 132152, 103-2085; 5798, FAM161B, 29706, 132156, 1-433; 5798, FAM161B, 29705, 132155, 200-2332; 5799, FAM162A, 29707, 132157, 281-715; 5799, FAM162A, 29709, 132159, 69-494; 5799, FAM162A, 29708, 132158, 85-549; 5800, FAM162B, 29710, 132160, 148-636; 5801, FAM163A, 29711, 132161, 397-900; 5802, FAM163B, 29712, 132162, 24-524; 5802, FAM163B, 29713, 132163, 246-746; 5803, FAM166A, 29715, 132165, 36-705; 5803, FAM166A, 29714, 132164, 56-1009; 5804, FAM166B, 29718, 132168, 72-851; 5804, FAM166B, 29716, 132166, 72-899; 5804, FAM166B, 29717, 132167, 72-722; 5805, FAM167A, 29720, 132170, 847-1120; 5805, FAM167A, 29719, 132169, 540-1184; 5805, FAM167A, 29721, 132171, 476-1120; 5805, FAM167A, 29722, 132172, 621-1265; 5806, FAM167B, 29723, 132173, 190-681; 5807, FAM168A, 29724, 132174, 286-1020; 5807, FAM168A, 29725, 132175, 280-987; 5807, FAM168A, 29726, 132176, 195-584; 5808, FAM168B, 29727, 132177, 259-846; 5808, FAM168B, 29728, 132178, 109-696; 5809, FAM169A, 29730, 132180, 314-571; 5809, FAM169A, 29731, 132181, 136-803; 5809, FAM169A, 29732, 132182, 227-751; 5809, FAM169A, 29734, 132184, 92-1924; 5809, FAM169A, 29729, 132179, 92-2104; 5809, FAM169A, 29733, 132183, 184-567; 5809, FAM169A, 29735, 132185, 228-611; 5810, FAM169B, 29736, 132186, 1-576; 5810, FAM169B, 29737, 132187, 251-829; 5811, FAM170A, 29741, 132191, 84-642; 5811, FAM170A, 29742, 132192, 211-1062; 5811, FAM170A, 29738, 132188, 172-1161; 5811, FAM170A, 29739, 132189, 211-1059; 5811, FAM170A, 29740, 132190, 173-1165; 5811, FAM170A, 29743, 132193, 211-1200; 5811, FAM170A, 29744, 132194, 211-1059; 5812, FAM170B, 29745, 132195, 91-942; 5813, FAM171A1, 29747, 132197, 11-605; 5813, FAM171A1, 29746, 132196, 8-2680; 5814, FAM171A2, 29749, 132199, 99-578; 5814, FAM171A2, 29750, 132200, 121-600; 5814, FAM171A2, 29748, 132198, 162-2642; 5815, FAM171B, 29752, 132202, 95-811; 5815, FAM171B, 29751, 132201, 204-2684; 5816, FAM172A, 29754, 132204, 118-927; 5816, FAM172A, 29756, 132206, 356-1273; 5816, FAM172A, 29753, 132203, 144-1394; 5816, FAM172A, 29755, 132205, 199-1311; 5816, FAM172A, 29757, 132207, 171-1091; 5817, FAM173A, 29758, 132208, 134-790; 5817, FAM173A, 29760, 132210, 179-703; 5817, FAM173A, 29761, 132211, 1-421; 5817, FAM173A, 29759, 132209, 301-1008; 5818, FAM173B, 29762, 132212, 608-817; 5818, FAM173B, 29765, 132215, 13-342; 5818, FAM173B, 29766, 132216, 16-465; 5818, FAM173B, 29763, 132213, 25-675; 5818, FAM173B, 29764, 132214, 14-715; 5819, FAM174A, 29767, 132217, 227-799; 5820, FAM174B, 29769, 132219, 355-696; 5820, FAM174B, 29770, 132220, 227-555; 5820, FAM174B, 29771, 132221, 191-464; 5820, FAM174B, 29772, 132222, 168-509; 5820, FAM174B, 29773, 132223, 367-567; 5820, FAM174B, 29774, 132224, 156-497; 5820, FAM174B, 29775, 132225, 166-279; 5820, FAM174B, 29768, 132218, 300-779; 5821, FAM175A, 29777, 132227, 145-393; 5821, FAM175A, 29778, 132228, 32-145; 5821, FAM175A, 29779, 132229, 32-256; 5821, FAM175A, 29780, 132230, 327-1409; 5821, FAM175A, 29781, 132231, 188-847; 5821, FAM175A, 29782, 132232, 29-595; 5821, FAM175A, 29783, 132233, 1-597; 5821, FAM175A, 29776, 132226, 110-1339; 5822, FAM175B, 29784, 132234, 46-1293; 5823, FAM177A1, 29788, 132238, 1-23; 5823, FAM177A1, 29789, 132239, 1-111; 5823, FAM177A1, 29790, 132240, 250-476; 5823, FAM177A1, 29791, 132241, 79-499; 5823, FAM177A1, 29792, 132242, 1-148; 5823, FAM177A1, 29793, 132243, 1-118; 5823, FAM177A1, 29794, 132244, 12-281; 5823, FAM177A1, 29785, 132235, 62-772; 5823, FAM177A1, 29786, 132236, 58-699; 5823, FAM177A1, 29787, 132237, 460-1101; 5824, FAM177B, 29797, 132247, 166-466; 5824, FAM177B, 29798, 132248, 248-545; 5824, FAM177B, 29795, 132245, 150-626; 5824, FAM177B, 29796, 132246, 267-629; 5824, FAM177B, 29799, 132249, 18-494; 5825, FAM178B, 29800, 132250, 251-610; 5825, FAM178B, 29801, 132251, 280-2319; 5826, FAM179A, 29803, 132253, 234-720; 5826, FAM179A, 29804, 132254, 321-658; 5826, FAM179A, 29805, 132255, 287-493; 5826, FAM179A, 29802, 132252, 352-3411; 5827, FAM179B, 29806, 132256, 184-5505; 5827, FAM179B, 29808, 132258, 1-468; 5827, FAM179B, 29809, 132259, 1-479; 5827, FAM179B, 29810, 132260, 22-544; 5827, FAM179B, 29807, 132257, 215-5377; 5827, FAM179B, 29811, 132261, 210-3197; 5828, FAM180A, 29812, 132262, 267-788; 5828, FAM180A, 29813, 132263, 133-654; 5828, FAM180A, 29814, 132264, 40-561; 5829, FAM180B, 29815, 132265, 23-628; 5830, FAM181A, 29820, 132270, 146-842; 5830, FAM181A, 29824, 132274, 146-842; 5830, FAM181A, 29816, 132266, 308-1372; 5830, FAM181A, 29817, 132267, 330-1208; 5830, FAM181A, 29818, 132268, 284-1162; 5830, FAM181A, 29819, 132269, 189-1067; 5830, FAM181A, 29821, 132271, 189-1067; 5830, FAM181A, 29822, 132272, 330-1208; 5830, FAM181A, 29823, 132273, 308-1372; 5830, FAM181A, 29825, 132275, 284-1162; 5831, FAM181B, 29826, 132276, 136-1416; 5832, FAM182B, 29828, 132278, 1-456; 5832, FAM182B, 29829, 132279, 413-733; 5832, FAM182B, 29827, 132277, 380-838; 5833, FAM183A, 29831, 132281, 36-212; 5833, FAM183A, 29832, 132282, 97-417; 5833, FAM183A, 29833, 132283, 30-448; 5833, FAM183A, 29830, 132280, 1-405; 5834, FAM184A, 29836, 132286, 1-498; 5834, FAM184A, 29837, 132287, 312-3122; 5834, FAM184A, 29838, 132288, 1-425; 5834, FAM184A, 29839, 132289, 1-1115; 5834, FAM184A, 29840, 132290, 1-807; 5834, FAM184A, 29841, 132291, 1-224; 5834, FAM184A, 29842, 132292, 377-1966; 5834, FAM184A, 29844, 132294, 1-211; 5834, FAM184A, 29845, 132295, 8-814; 5834, FAM184A, 29846, 132296, 478-3774; 5834, FAM184A, 29834, 132284, 512-3427; 5834, FAM184A, 29835, 132285, 445-3867; 5834, FAM184A, 29843, 132293, 74-3244; 5835, FAM184B, 29847, 132297, 214-3396; 5836, FAM185A, 29850, 132300, 199-414; 5836, FAM185A, 29851, 132301, 172-755; 5836, FAM185A, 29848, 132298, 181-1008; 5836, FAM185A, 29849, 132299, 1-1179; 5836, FAM185A, 29852, 132302, 238-672; 5837, FAM186A, 29854, 132304, 1-220; 5837, FAM186A, 29855, 132305, 139-7185; 5837, FAM186A, 29856, 132306, 22-1101; 5837, FAM186A, 29853, 132303, 1-7056; 5838, FAM186B, 29858, 132308, 151-324; 5838, FAM186B, 29859, 132309, 1-1521; 5838, FAM186B, 29860, 132310, 142-867; 5838, FAM186B, 29861, 132311, 1-353; 5838, FAM186B, 29857, 132307, 163-2844; 5839, FAM187A, 29863, 132313, 158-886; 5839, FAM187A, 29862, 132312, 1837-3078; 5840, FAM187B, 29864, 132314, 50-1159; 5841, FAM188A, 29866, 132316, 1178-1630; 5841, FAM188A, 29867, 132317, 1-549; 5841, FAM188A, 29868, 132318, 125-618; 5841, FAM188A, 29865, 132315, 222-1559; 5842, FAM188B, 29869, 132319, 78-2351; 5843, FAM189A1, 29871, 132321, 300-533; 5843, FAM189A1, 29872, 132322, 1-1620; 5843, FAM189A1, 29870, 132320, 1-1620; 5844, FAM189A2, 29874, 132324, 543-1400; 5844, FAM189A2, 29875, 132325, 21-734; 5844, FAM189A2, 29873, 132323, 421-1773; 5844, FAM189A2, 29876, 132326, 105-1457; 5845, FAM189B, 29880, 132330, 32-1006; 5845, FAM189B, 29881, 132331, 315-749; 5845, FAM189B, 29883, 132333, 32-1006; 5845, FAM189B, 29886, 132336, 315-749; 5845, FAM189B, 29887, 132337, 471-1199; 5845, FAM189B, 29888, 132338, 607-1335; 5845, FAM189B, 29877, 132327, 84-1802; 5845, FAM189B, 29878, 132328, 511-2517; 5845, FAM189B, 29879, 132329, 92-2044; 5845, FAM189B, 29882, 132332, 92-2044; 5845, FAM189B, 29884, 132334, 84-1802; 5845, FAM189B, 29885, 132335, 511-2517; 5846, FAM19A1, 29891, 132341, 1-159; 5846, FAM19A1, 29889, 132339, 398-799; 5846, FAM19A1, 29890, 132340, 491-892; 5847, FAM19A2, 29893, 132343, 166-468; 5847, FAM19A2, 29895, 132345, 490-885; 5847, FAM19A2, 29896, 132346, 294-555; 5847, FAM19A2, 29898, 132348, 240-570; 5847, FAM19A2, 29899, 132349, 180-329; 5847, FAM19A2, 29892, 132342, 1586-1981; 5847, FAM19A2, 29894, 132344, 191-586; 5847, FAM19A2, 29897, 132347, 266-370; 5848, FAM19A3, 29900, 132350, 60-461; 5848, FAM19A3, 29901, 132351, 218-727; 5849, FAM19A4, 29903, 132353, 370-602; 5849, FAM19A4, 29904, 132354, 1128-1300; 5849, FAM19A4, 29902, 132352, 494-916; 5850, FAM19A5, 29905, 132355, 2-546; 5850, FAM19A5, 29906, 132356, 176-553; 5850, FAM19A5, 29907, 132357, 134-532; 5850, FAM19A5, 29908, 132358, 111-272; 5851, FAM192A, 29911, 132361, 102-597; 5851, FAM192A, 29912, 132362, 401-593; 5851, FAM192A, 29913, 132363, 1-463; 5851, FAM192A, 29914, 132364, 168-413; 5851, FAM192A, 29915, 132365, 586-1029; 5851, FAM192A, 29916, 132366, 540-621; 5851, FAM192A, 29917, 132367, 283-356; 5851, FAM192A, 29918, 132368, 369-658; 5851, FAM192A, 29920, 132370, 274-538; 5851, FAM192A, 29921, 132371, 98-519; 5851, FAM192A, 29922, 132372, 289-608; 5851, FAM192A, 29923, 132373, 287-676; 5851, FAM192A, 29924, 132374, 386-919; 5851, FAM192A, 29925, 132375, 412-893; 5851, FAM192A, 29909, 132359, 260-1024; 5851, FAM192A, 29910, 132360, 28-792; 5851, FAM192A, 29919, 132369, 280-1044; 5851, FAM192A, 29926, 132376, 72-836; 5851, FAM192A, 29927, 132377, 232-996; 5852, FAM193A, 29931, 132381, 322-2736; 5852, FAM193A, 29932, 132382, 374-503; 5852, FAM193A, 29934, 132384, 710-3727; 5852, FAM193A, 29928, 132378, 352-4149; 5852, FAM193A, 29929, 132379, 352-4026; 5852, FAM193A, 29930, 132380, 322-3957; 5852, FAM193A, 29933, 132383, 352-2730; 5852, FAM193A, 29935, 132385, 322-4062; 5852, FAM193A, 29936, 132386, 352-3987; 5853, FAM193B, 29938, 132388, 1-91; 5853, FAM193B, 29939, 132389, 624-839; 5853, FAM193B, 29940, 132390, 1-420; 5853, FAM193B, 29941, 132391, 1-222; 5853, FAM193B, 29942, 132392, 334-568; 5853, FAM193B, 29943, 132393, 84-512; 5853, FAM193B, 29944, 132394, 49-411; 5853, FAM193B, 29945, 132395, 290-426; 5853, FAM193B, 29946, 132396, 1-325; 5853, FAM193B, 29947, 132397, 1-1525; 5853, FAM193B, 29937, 132387, 50-2518; 5854, FAM195A, 29950, 132400, 147-344; 5854, FAM195A, 29951, 132401, 144-341; 5854, FAM195A, 29948, 132398, 180-662; 5854, FAM195A, 29949, 132399, 64-291; 5855, FAM195B, 29952, 132402, 1-357; 5855, FAM195B, 29957, 132407, 41-319; 5855, FAM195B, 29958, 132408, 54-407; 5855, FAM195B, 29959, 132409, 114-305; 5855, FAM195B, 29960, 132410, 64-300; 5855, FAM195B, 29961, 132411, 141-497; 5855, FAM195B, 29962, 132412, 153-509; 5855, FAM195B, 29953, 132403, 80-373; 5855, FAM195B, 29954, 132404, 103-396; 5855, FAM195B, 29955, 132405, 2157-2450; 5855, FAM195B, 29956, 132406, 1689-1982; 5856, FAM196A, 29963, 132413, 139-1506; 5856, FAM196A, 29964, 132414, 557-1996; 5856, FAM196A, 29965, 132415, 557-1924; 5857, FAM196B, 29966, 132416, 1383-2990; 5858, FAM198A, 29969, 132419, 363-783; 5858, FAM198A, 29967, 132417, 377-2104; 5858, FAM198A, 29968, 132418, 96-1823; 5859, FAM198B, 29972, 132422, 225-548; 5859, FAM198B, 29974, 132424, 561-587; 5859, FAM198B, 29975, 132425, 139-701; 5859, FAM198B, 29977, 132427, 1-574; 5859, FAM198B, 29970, 132420, 623-2182; 5859, FAM198B, 29971, 132421, 408-1991; 5859, FAM198B, 29973, 132423, 408-1967; 5859, FAM198B, 29976, 132426, 404-1399; 5860, FAM199X, 29978, 132428, 167-1333; 5861, FAM20A, 29979, 132429, 1-383; 5861, FAM20A, 29980, 132430, 1-66; 5861, FAM20A, 29982, 132432, 1-438; 5861, FAM20A, 29981, 132431, 724-2349; 5862, FAM20B, 29984, 132434, 189-603; 5862, FAM20B, 29983, 132433, 337-1566; 5863, FAM20C, 29986, 132436, 232-1015; 5863, FAM20C, 29987, 132437, 232-1015; 5863, FAM20C, 29985, 132435, 232-1986; 5864, FAM200A, 29988, 132438, 337-1943; 5864, FAM200A, 29989, 132439, 381-2102; 5865, FAM200B, 29991, 132441, 955-1027; 5865, FAM200B, 29990, 132440, 839-2812; 5865, FAM200B, 29992, 132442, 916-2889; 5866, FAM204A, 29993, 132443, 523-975; 5866, FAM204A, 29996, 132446, 55-714; 5866, FAM204A, 29994, 132444, 60-761; 5866, FAM204A, 29995, 132445, 261-962; 5867, FAM205A, 29997, 132447, 41-4048; 5868, FAM205C, 29998, 132448, 40-426; 5868, FAM205C, 29999, 132449, 57-683; 5868, FAM205C, 30000, 132450, 1-1017; 5869, FAM206A, 30002, 132452, 1-348; 5869, FAM206A, 30003, 132453, 1-389; 5869, FAM206A, 30001, 132451, 307-852; 5870, FAM207A, 30006, 132456, 34-643; 5870, FAM207A, 30004, 132454, 49-741; 5870, FAM207A, 30005, 132455, 47-694; 5871, FAM208A, 30010, 132460, 159-3266; 5871, FAM208A, 30007, 132457, 232-5061; 5871, FAM208A, 30008, 132458, 926-4627; 5871, FAM208A, 30009, 132459, 12-4550; 5872, FAM208B, 30012, 132462, 1-738; 5872, FAM208B, 30013, 132463, 497-522; 5872, FAM208B, 30011, 132461, 626-7918; 5873, FAM209A, 30014, 132464, 324-839; 5874, FAM209B, 30015, 132465, 97-612; 5875, FAM21A, 30017, 132467, 119-3958; 5875, FAM21A, 30019, 132469, 1-3762; 5875, FAM21A, 30020, 132470, 1-471; 5875, FAM21A, 30021, 132471, 83-403; 5875, FAM21A, 30022, 132472, 119-3856; 5875, FAM21A, 30016, 132466, 46-4071; 5875, FAM21A, 30018, 132468, 119-4081; 5876, FAM21C, 30023, 132473, 83-4108; 5876, FAM21C, 30024, 132474, 122-3910; 5876, FAM21C, 30026, 132476, 31-868; 5876, FAM21C, 30029, 132479, 55-4080; 5876, FAM21C, 30025, 132475, 100-4062; 5876, FAM21C, 30027, 132477, 119-3958; 5876, FAM21C, 30028, 132478, 119-3856; 5877, FAM210A, 30032, 132482, 287-1091; 5877, FAM210A, 30033, 132483, 1-204; 5877, FAM210A, 30034, 132484, 504-1038; 5877, FAM210A, 30030, 132480, 389-1207; 5877, FAM210A, 30031, 132481, 293-1111; 5878, FAM210B, 30036, 132486, 1-158; 5878, FAM210B, 30035, 132485, 92-670; 5879, FAM212A, 30037, 132487, 134-997; 5880, FAM212B, 30040, 132490, 122-466; 5880, FAM212B, 30041, 132491, 12-556; 5880, FAM212B, 30038, 132488, 183-1076; 5880, FAM212B, 30039, 132489, 113-961; 5881, FAM213A, 30042, 132492, 471-1160; 5881, FAM213A, 30043, 132493, 169-825; 5881, FAM213A, 30044, 132494, 61-750; 5881, FAM213A, 30045, 132495, 131-820; 5881, FAM213A, 30046, 132496, 627-1316; 5881, FAM213A, 30047, 132497, 154-843; 5882, FAM213B, 30048, 132498, 17-712; 5882, FAM213B, 30049, 132499, 47-625; 5882, FAM213B, 30050, 132500, 1-640; 5882, FAM213B, 30052, 132502, 47-787; 5882, FAM213B, 30054, 132504, 1-589; 5882, FAM213B, 30055, 132505, 1-464; 5882, FAM213B, 30056, 132506, 47-787; 5882, FAM213B, 30057, 132507, 47-625; 5882, FAM213B, 30058, 132508, 1-640; 5882, FAM213B, 30059, 132509, 17-712; 5882, FAM213B, 30061, 132511, 1-589; 5882, FAM213B, 30063, 132513, 1-464; 5882, FAM213B, 30051, 132501, 22-708; 5882, FAM213B, 30053, 132503, 1-576; 5882, FAM213B, 30060, 132510, 22-708; 5882, FAM213B, 30062, 132512, 1-576; 5883, FAM214A, 30065, 132515, 234-3048; 5883, FAM214A, 30068, 132518, 1-138; 5883, FAM214A, 30069, 132519, 199-576; 5883, FAM214A, 30070, 132520, 201-468; 5883, FAM214A, 30071, 132521, 647-931; 5883, FAM214A, 30072, 132522, 194-547; 5883, FAM214A, 30073, 132523, 155-581; 5883, FAM214A, 30074, 132524, 1-667; 5883, FAM214A, 30075, 132525, 233-325; 5883, FAM214A, 30064, 132514, 154-3384; 5883, FAM214A, 30066, 132516, 145-3396; 5883, FAM214A, 30067, 132517, 432-3323; 5883, FAM214A, 30076, 132526, 96-3326; 5884, FAM214B, 30077, 132527, 312-1928; 5884, FAM214B, 30078, 132528, 375-1991; 5884, FAM214B, 30079, 132529, 3057-4673; 5884, FAM214B, 30080, 132530, 756-1457; 5884, FAM214B, 30081, 132531, 540-2156; 5884, FAM214B, 30082, 132532, 300-1916; 5884, FAM214B, 30083, 132533, 283-1899; 5885, FAM216A, 30085, 132535, 96-329; 5885, FAM216A, 30084, 132534, 513-1334; 5886, FAM216B, 30086, 132536, 65-484; 5886, FAM216B, 30087, 132537, 124-543; 5887, FAM217A, 30089, 132539, 379-474; 5887, FAM217A, 30090, 132540, 328-470; 5887, FAM217A, 30088, 132538, 405-1931; 5888, FAM217B, 30093, 132543, 277-419; 5888, FAM217B, 30091, 132541, 416-1567; 5888, FAM217B, 30092, 132542, 300-1451; 5889, FAM218A, 30094, 132544, 76-549; 5890, FAM219A, 30096, 132546, 293-763; 5890, FAM219A, 30097, 132547, 293-811; 5890, FAM219A, 30098, 132548, 293-763; 5890, FAM219A, 30099, 132549, 293-787; 5890, FAM219A, 30100, 132550, 293-793; 5890, FAM219A, 30101, 132551, 293-844; 5890, FAM219A, 30103, 132553, 293-798; 5890, FAM219A, 30095, 132545, 308-814; 5890, FAM219A, 30102, 132552, 308-865; 5891, FAM219B, 30105, 132555, 84-587; 5891, FAM219B, 30106, 132556, 49-312; 5891, FAM219B, 30107, 132557, 1-209; 5891, FAM219B, 30109, 132559, 81-302; 5891, FAM219B, 30110, 132560, 293-631; 5891, FAM219B, 30111, 132561, 1-590; 5891, FAM219B, 30112, 132562, 84-305; 5891, FAM219B, 30113, 132563, 8-403; 5891, FAM219B, 30114, 132564, 6-227; 5891, FAM219B, 30116, 132566, 1-33; 5891, FAM219B, 30117, 132567, 84-305; 5891, FAM219B, 30118, 132568, 43-264; 5891, FAM219B, 30104, 132554, 322-918; 5891, FAM219B, 30108, 132558, 38-634; 5891, FAM219B, 30115, 132565, 81-527; 5892, FAM220A, 30120, 132570, 143-502; 5892, FAM220A, 30121, 132571, 232-558; 5892, FAM220A, 30122, 132572, 1-207; 5892, FAM220A, 30119, 132569, 469-1248; 5892, FAM220A, 30123, 132573, 469-1248; 5893, FAM221A, 30126, 132576, 36-758; 5893, FAM221A, 30128, 132578, 36-332; 5893, FAM221A, 30129, 132579, 53-397; 5893, FAM221A, 30124, 132574, 90-986; 5893, FAM221A, 30125, 132575, 36-650; 5893, FAM221A, 30127, 132577, 90-878; 5894, FAM221B, 30130, 132580, 264-1167; 5894, FAM221B, 30133, 132583, 449-719; 5894, FAM221B, 30131, 132581, 286-1308; 5894, FAM221B, 30132, 132582, 271-1479; 5895, FAM222A, 30134, 132584, 167-1525; 5895, FAM222A, 30135, 132585, 717-2075; 5896, FAM222B, 30136, 132586, 437-1741; 5896, FAM222B, 30138, 132588, 108-194; 5896, FAM222B, 30140, 132590, 144-230; 5896, FAM222B, 30141, 132591, 281-367; 5896, FAM222B, 30142, 132592, 302-388; 5896, FAM222B, 30143, 132593, 184-270; 5896, FAM222B, 30144, 132594, 169-886; 5896, FAM222B, 30145, 132595, 324-731; 5896, FAM222B, 30146, 132596, 116-202; 5896, FAM222B, 30147, 132597, 438-568; 5896, FAM222B, 30148, 132598, 183-347; 5896, FAM222B, 30149, 132599, 191-598; 5896, FAM222B, 30150, 132600, 184-720; 5896, FAM222B, 30137, 132587, 268-1956; 5896, FAM222B, 30139, 132589, 183-1871; 5897, FAM227A, 30151, 132601, 297-2237; 5897, FAM227A, 30152, 132602, 605-2317; 5898, FAM227B, 30154, 132604, 249-749; 5898, FAM227B, 30156, 132606, 247-792; 5898, FAM227B, 30157, 132607, 68-211; 5898, FAM227B, 30158, 132608, 1-404; 5898, FAM227B, 30159, 132609, 252-788; 5898, FAM227B, 30153, 132603, 305-1831; 5898, FAM227B, 30155, 132605, 372-1286; 5899, FAM228A, 30161, 132611, 121-441; 5899, FAM228A, 30162, 132612, 1-630; 5899, FAM228A, 30163, 132613, 1-411; 5899, FAM228A, 30160, 132610, 87-707; 5900, FAM228B, 30164, 132614, 200-424; 5900, FAM228B, 30165, 132615, 378-941; 5900, FAM228B, 30166, 132616, 87-1061; 5900, FAM228B, 30167, 132617, 1-327; 5900, FAM228B, 30168, 132618, 1-117; 5900, FAM228B, 30169, 132619, 1-975; 5901, FAM229A, 30170, 132620, 1-159; 5901, FAM229A, 30171, 132621, 153-536; 5902, FAM229B, 30172, 132622, 298-540; 5902, FAM229B, 30173, 132623, 248-490; 5903, FAM231A, 30174, 132624, 1-510; 5904, FAM231B, 30175, 132625, 1-510; 5905, FAM231C, 30176, 132626, 1-510; 5906, N/A, 30177, 132627, 1-510; 5907, FAM231D, 30178, 132628, 2176-2685; 5908, FAM234A, 30182, 132632, 277-583; 5908, FAM234A, 30183, 132633, 223-374; 5908, FAM234A, 30184, 132634, 172-432; 5908, FAM234A, 30185, 132635, 308-1006; 5908, FAM234A, 30186, 132636, 277-984; 5908, FAM234A, 30187, 132637, 162-554; 5908, FAM234A, 30188, 132638, 378-583; 5908, FAM234A, 30189, 132639, 160-887; 5908, FAM234A, 30190, 132640, 1-578; 5908, FAM234A, 30191, 132641, 151-459; 5908, FAM234A, 30192, 132642, 1-704; 5908, FAM234A, 30179, 132629, 145-1803; 5908, FAM234A, 30180, 132630, 196-1818; 5908, FAM234A, 30181, 132631, 452-2110; 5909, FAM234B, 30195, 132645, 1-975; 5909, FAM234B, 30193, 132643, 121-1989; 5909, FAM234B, 30194, 132644, 24-1892; 5910, FAM24A, 30196, 132646, 122-439; 5911, FAM24B, 30197, 132647, 269-553; 5911, FAM24B, 30198, 132648, 292-576; 5912, FAM25A, 30199, 132649, 20-289; 5913, FAM25C, 30200, 132650, 27-296; 5914, FAM25G, 30201, 132651, 20-289; 5915, FAM26D, 30205, 132655, 199-568; 5915, FAM26D, 30202, 132652, 45-989; 5915, FAM26D, 30203, 132653, 268-654; 5915, FAM26D, 30204, 132654, 286-801; 5915, FAM26D, 30206, 132656, 228-740; 5916, FAM26E, 30207, 132657, 52-981; 5917, FAM26F, 30208, 132658, 1-477; 5917, FAM26F, 30209, 132659, 96-1043; 5917, FAM26F, 30210, 132660, 52-483; 5918, FAM3A, 30211, 132661, 430-1164; 5918, FAM3A, 30213, 132663, 370-1083; 5918, FAM3A, 30216, 132666, 458-670; 5918, FAM3A, 30218, 132668, 471-683; 5918, FAM3A, 30219, 132669, 446-936; 5918, FAM3A, 30220, 132670, 399-518; 5918, FAM3A, 30221, 132671, 50-205; 5918, FAM3A, 30222, 132672, 362-574; 5918, FAM3A, 30223, 132673, 394-606; 5918, FAM3A, 30224, 132674, 466-627; 5918, FAM3A, 30225, 132675, 438-500; 5918, FAM3A, 30226, 132676, 347-580; 5918, FAM3A, 30228, 132678, 471-683; 5918, FAM3A, 30212, 132662, 368-1060; 5918, FAM3A, 30214, 132664, 189-881; 5918, FAM3A, 30215, 132665, 292-870; 5918, FAM3A, 30217, 132667, 471-1112; 5918, FAM3A, 30227, 132677, 468-1160; 5919, FAM3B, 30230, 132680, 16-792; 5919, FAM3B, 30229, 132679, 147-854; 5919, FAM3B, 30231, 132681, 67-630; 5919, FAM3B, 30232, 132682, 67-891; 5920, FAM3C, 30234, 132684, 108-561; 5920, FAM3C, 30235, 132685, 335-662; 5920, FAM3C, 30233, 132683, 215-898; 5921, FAM3D, 30237, 132687, 284-737; 5921, FAM3D, 30238, 132688, 298-633; 5921, FAM3D, 30239, 132689, 214-333; 5921, FAM3D, 30240, 132690, 142-449; 5921, FAM3D, 30236, 132686, 312-986; 5922, FAM32A, 30242, 132692, 21-305; 5922, FAM32A, 30244, 132694, 1-249; 5922, FAM32A, 30245, 132695, 11-334; 5922, FAM32A, 30241, 132691, 26-364; 5922, FAM32A, 30243, 132693, 231-509; 5923, FAM35A, 30248, 132698, 690-969; 5923, FAM35A, 30246, 132696, 115-2622; 5923, FAM35A, 30247, 132697, 115-2829; 5924, FAM43A, 30249, 132699, 284-1555; 5925, FAM43B, 30250, 132700, 536-1525; 5926, FAM45A, 30252, 132702, 45-710; 5926, FAM45A, 30251, 132701, 27-1100; 5927, FAM46A, 30255, 132705, 1-1572; 5927, FAM46A, 30256, 132706, 1-265; 5927, FAM46A, 30257, 132707, 1-260; 5927, FAM46A, 30253, 132703, 316-1644; 5927, FAM46A, 30254, 132704, 314-1699; 5928, FAM46B, 30258, 132708, 167-1444; 5929, FAM46C, 30259, 132709, 248-1423; 5930, FAM46D, 30260, 132710, 240-1409; 5930, FAM46D, 30261, 132711, 335-1504; 5931, FAM47A, 30263, 132713, 37-2373; 5931, FAM47A, 30262, 132712, 34-2409; 5932, FAM47B, 30264, 132714, 37-1974; 5933, FAM47C, 30265, 132715, 15-3122; 5934, FAM47E, 30268, 132718, 172-571; 5934, FAM47E, 30269, 132719, 1-374; 5934, FAM47E, 30266, 132716, 7-1188; 5934, FAM47E, 30267, 132717, 415-1302; 5935, FAM49A, 30272, 132722, 317-579; 5935, FAM49A, 30273, 132723, 263-544; 5935, FAM49A, 30270, 132720, 222-1193; 5935, FAM49A, 30271, 132721, 415-1386; 5936, FAM49B, 30275, 132725, 227-421; 5936, FAM49B, 30277, 132727, 399-699; 5936, FAM49B, 30278, 132728, 302-581; 5936, FAM49B, 30282, 132732, 370-573; 5936, FAM49B, 30284, 132734, 419-561; 5936, FAM49B, 30286, 132736, 344-579; 5936, FAM49B, 30287, 132737, 231-367; 5936, FAM49B, 30289, 132739, 360-548; 5936, FAM49B, 30291, 132741, 279-574; 5936, FAM49B, 30292, 132742, 231-696; 5936, FAM49B, 30293, 132743, 1-654; 5936, FAM49B, 30274, 132724, 378-1352; 5936, FAM49B, 30276, 132726, 550-1524; 5936, FAM49B, 30279, 132729, 256-1230; 5936, FAM49B, 30280, 132730, 275-1249; 5936, FAM49B, 30281, 132731, 402-1376; 5936, FAM49B, 30283, 132733, 322-1296; 5936, FAM49B, 30285, 132735, 453-989; 5936, FAM49B, 30288, 132738, 525-1061; 5936, FAM49B, 30290, 132740, 185-1159; 5937, FAM50A, 30294, 132744, 461-1240; 5937, FAM50A, 30295, 132745, 111-1130; 5938, FAM50B, 30296, 132746, 123-1100; 5938, FAM50B, 30297, 132747, 427-1404; 5939, FAM53A, 30299, 132749, 235-558; 5939, FAM53A, 30301, 132751, 599-1681; 5939, FAM53A, 30302, 132752, 1-470; 5939, FAM53A, 30298, 132748, 194-1390; 5939, FAM53A, 30300, 132750, 165-1361; 5939, FAM53A, 30303, 132753, 199-1395; 5940, FAM53B, 30304, 132754, 432-1349; 5940, FAM53B, 30305, 132755, 213-1481; 5940, FAM53B, 30306, 132756, 718-1986; 5941, FAM53C, 30309, 132759, 195-539; 5941, FAM53C, 30310, 132760, 75-571; 5941, FAM53C, 30307, 132757, 429-1607; 5941, FAM53C, 30308, 132758, 495-1673; 5942, FAM57A, 30313, 132763, 237-686; 5942, FAM57A, 30314, 132764, 80-421; 5942, FAM57A, 30315, 132765, 103-312; 5942, FAM57A, 30316, 132766, 1-115; 5942, FAM57A, 30311, 132761, 65-742; 5942, FAM57A, 30312, 132762, 237-1010; 5943, FAM57B, 30319, 132769, 499-937; 5943, FAM57B, 30320, 132770, 383-511; 5943, FAM57B, 30321, 132771, 47-559; 5943, FAM57B, 30322, 132772, 450-502; 5943, FAM57B, 30317, 132767, 51-725; 5943, FAM57B, 30318, 132768, 733-1557; 5944, FAM58A, 30324, 132774, 1-283; 5944, FAM58A, 30326, 132776, 154-578; 5944, FAM58A, 30327, 132777, 45-164; 5944, FAM58A, 30328, 132778, 44-163; 5944, FAM58A, 30329, 132779, 1-290; 5944, FAM58A, 30330, 132780, 45-164; 5944, FAM58A, 30331, 132781, 1-509; 5944, FAM58A, 30323, 132773, 45-731; 5944, FAM58A, 30325, 132775, 114-860; 5945, FAM60A, 30334, 132784, 290-669; 5945, FAM60A, 30336, 132786, 1-178; 5945, FAM60A, 30338, 132788, 57-459; 5945, FAM60A, 30340, 132790, 290-669; 5945, FAM60A, 30341, 132791, 57-459; 5945, FAM60A, 30342, 132792, 1-178; 5945, FAM60A, 30332, 132782, 370-1035; 5945, FAM60A, 30333, 132783, 240-905; 5945, FAM60A, 30335, 132785, 493-714; 5945, FAM60A, 30337, 132787, 183-404; 5945, FAM60A, 30339, 132789, 370-1035; 5945, FAM60A, 30343, 132793, 493-714; 5945, FAM60A, 30344, 132794, 240-905; 5945, FAM60A, 30345, 132795, 183-404; 5946, FAM63A, 30350, 132800, 1-428; 5946, FAM63A, 30346, 132796, 679-1662; 5946, FAM63A, 30347, 132797, 221-1774; 5946, FAM63A, 30348, 132798, 956-2365; 5946, FAM63A, 30349, 132799, 243-1367; 5946, FAM63A, 30351, 132801, 445-1854; 5947, FAM63B, 30352, 132802, 205-1473; 5947, FAM63B, 30355, 132805, 111-1250; 5947, FAM63B, 30353, 132803, 35-1897; 5947, FAM63B, 30354, 132804, 83-1948; 5948, FAM64A, 30358, 132808, 79-918; 5948, FAM64A, 30360, 132810, 82-825; 5948, FAM64A, 30361, 132811, 1-391; 5948, FAM64A, 30362, 132812, 82-825; 5948, FAM64A, 30363, 132813, 83-619; 5948, FAM64A, 30356, 132806, 84-830; 5948, FAM64A, 30357, 132807, 50-766; 5948, FAM64A, 30359, 132809, 110-826; 5949, FAM65A, 30368, 132818, 221-3937; 5949, FAM65A, 30369, 132819, 107-1874; 5949, FAM65A, 30370, 132820, 1-418; 5949, FAM65A, 30371, 132821, 220-244; 5949, FAM65A, 30372, 132822, 107-562; 5949, FAM65A, 30373, 132823, 321-584; 5949, FAM65A, 30374, 132824, 370-2251; 5949, FAM65A, 30375, 132825, 1-467; 5949, FAM65A, 30376, 132826, 1-607; 5949, FAM65A, 30377, 132827, 250-538; 5949, FAM65A, 30378, 132828, 477-634; 5949, FAM65A, 30364, 132814, 69-3728; 5949, FAM65A, 30365, 132815, 122-3793; 5949, FAM65A, 30366, 132816, 126-3827; 5949, FAM65A, 30367, 132817, 187-3906; 5950, FAM65B, 30381, 132831, 442-2283; 5950, FAM65B, 30382, 132832, 155-3298; 5950, FAM65B, 30383, 132833, 243-2186; 5950, FAM65B, 30384, 132834, 465-2075; 5950, FAM65B, 30379, 132829, 177-3383; 5950, FAM65B, 30380, 132830, 432-2207; 5950, FAM65B, 30385, 132835, 242-3448; 5951, FAM65C, 30386, 132836, 319-3159; 5951, FAM65C, 30387, 132837, 413-3253; 5952,

FAM69A, 30389, 132839, 212-1423; 5952, FAM69A, 30390, 132840, 94-1203; 5952, FAM69A, 30392, 132842, 94-1245; 5952, FAM69A, 30388, 132838, 72-1358; 5952, FAM69A, 30391, 132841, 94-582; 5953, FAM69B, 30395, 132845, 1100-1900; 5953, FAM69B, 30393, 132843, 1100-2134; 5953, FAM69B, 30394, 132844, 97-1392; 5954, FAM69C, 30396, 132846, 10-1269; 5954, FAM69C, 30397, 132847, 194-556; 5955, FAM71A, 30398, 132848, 405-2189; 5956, FAM71B, 30399, 132849, 97-1914; 5957, FAM71C, 30400, 132850, 423-1148; 5958, FAM71D, 30403, 132853, 320-552; 5958, FAM71D, 30404, 132854, 348-543; 5958, FAM71D, 30405, 132855, 1-215; 5958, FAM71D, 30406, 132856, 225-485; 5958, FAM71D, 30407, 132857, 1-157; 5958, FAM71D, 30408, 132858, 241-411; 5958, FAM71D, 30401, 132851, 255-1523; 5958, FAM71D, 30402, 132852, 223-1425; 5958, FAM71D, 30409, 132859, 291-1559; 5959, FAM71E1, 30410, 132860, 73-653; 5959, FAM71E1, 30412, 132862, 1-443; 5959, FAM71E1, 30414, 132864, 103-609; 5959, FAM71E1, 30411, 132861, 359-1054; 5959, FAM71E1, 30413, 132863, 366-1109; 5960, FAM71E2, 30416, 132866, 187-378; 5960, FAM71E2, 30415, 132865, 195-2963; 5961, FAM71F1, 30418, 132868, 1-404; 5961, FAM71F1, 30420, 132870, 405-836; 5961, FAM71F1, 30421, 132871, 54-914; 5961, FAM71F1, 30417, 132867, 54-1088; 5961, FAM71F1, 30419, 132869, 345-1076; 5961, FAM71F1, 30422, 132872, 230-961; 5962, FAM71F2, 30425, 132875, 100-609; 5962, FAM71F2, 30423, 132873, 106-1008; 5962, FAM71F2, 30424, 132874, 107-1009; 5962, FAM71F2, 30426, 132876, 107-1036; 5963, FAM72A, 30429, 132879, 71-520; 5963, FAM72A, 30430, 132880, 380-740; 5963, FAM72A, 30431, 132881, 395-550; 5963, FAM72A, 30432, 132882, 99-311; 5963, FAM72A, 30427, 132877, 422-751; 5963, FAM72A, 30428, 132878, 849-1298; 5964, FAM72B, 30435, 132885, 380-742; 5964, FAM72B, 30436, 132886, 826-1110; 5964, FAM72B, 30437, 132887, 71-520; 5964, FAM72B, 30433, 132883, 423-752; 5964, FAM72B, 30434, 132884, 852-1301; 5965, FAM72C, 30438, 132888, 825-1109; 5965, FAM72C, 30439, 132889, 825-1274; 5966, FAM72D, 30440, 132890, 849-1298; 5967, FAM73A, 30442, 132892, 33-1934; 5967, FAM73A, 30443, 132893, 301-500; 5967, FAM73A, 30441, 132891, 33-1931; 5968, FAM73B, 30447, 132897, 265-563; 5968, FAM73B, 30448, 132898, 1-432; 5968, FAM73B, 30444, 132894, 227-2008; 5968, FAM73B, 30445, 132895, 182-1153; 5968, FAM73B, 30446, 132896, 180-1229; 5969, FAM76A, 30453, 132903, 1-375; 5969, FAM76A, 30455, 132905, 54-920; 5969, FAM76A, 30449, 132899, 25-1050; 5969, FAM76A, 30450, 132900, 54-992; 5969, FAM76A, 30451, 132901, 54-890; 5969, FAM76A, 30452, 132902, 103-1026; 5969, FAM76A, 30454, 132904, 86-769; 5970, FAM76B, 30458, 132908, 614-754; 5970, FAM76B, 30459, 132909, 84-1100; 5970, FAM76B, 30460, 132910, 457-730; 5970, FAM76B, 30461, 132911, 291-440; 5970, FAM76B, 30463, 132913, 337-610; 5970, FAM76B, 30456, 132906, 314-1333; 5970, FAM76B, 30457, 132907, 138-839; 5970, FAM76B, 30462, 132912, 313-1014; 5971, FAM78A, 30464, 132914, 71-913; 5971, FAM78A, 30466, 132916, 1-759; 5971, FAM78A, 30465, 132915, 369-1220; 5972, FAM78B, 30470, 132920, 1-772; 5972, FAM78B, 30471, 132921, 1-763; 5972, FAM78B, 30467, 132917, 591-1376; 5972, FAM78B, 30468, 132918, 468-1253; 5972, FAM78B, 30469, 132919, 134-919; 5973, FAM8A1, 30472, 132922, 56-1297; 5974, FAM81A, 30474, 132924, 74-513; 5974, FAM81A, 30475, 132925, 325-528; 5974, FAM81A, 30476, 132926, 258-656; 5974, FAM81A, 30477, 132927, 189-567; 5974, FAM81A, 30478, 132928, 370-572; 5974, FAM81A, 30479, 132929, 235-581; 5974, FAM81A, 30480, 132930, 399-573; 5974, FAM81A, 30481, 132931, 213-557; 5974, FAM81A, 30482, 132932, 248-573; 5974, FAM81A, 30473, 132923, 188-1294; 5975, FAM81B, 30484, 132934, 1-384; 5975, FAM81B, 30485, 132935, 1-162; 5975, FAM81B, 30486, 132936, 1-547; 5975, FAM81B, 30487, 132937, 1-124; 5975, FAM81B, 30488, 132938, 1-263; 5975, FAM81B, 30489, 132939, 1-381; 5975, FAM81B, 30483, 132933, 47-1405; 5976, FAM83A, 30490, 132940, 177-1280; 5976, FAM83A, 30491, 132941, 177-1061; 5976, FAM83A, 30492, 132942, 2015-3319; 5976, FAM83A, 30493, 132943, 2015-3118; 5977, FAM83B, 30494, 132944, 117-3152; 5978, FAM83C, 30495, 132945, 98-2341; 5979, FAM83D, 30496, 132946, 42-1889; 5979, FAM83D, 30497, 132947, 42-1889; 5979, FAM83D, 30498, 132948, 18-1775; 5980, FAM83E, 30500, 132950, 293-565; 5980, FAM83E, 30499, 132949, 191-1627; 5981, FAM83F, 30501, 132951, 95-1597; 5981, FAM83F, 30502, 132952, 453-1451; 5982, FAM83G, 30505, 132955, 1-426; 5982, FAM83G, 30503, 132953, 167-2638; 5982, FAM83G, 30504, 132954, 225-2696; 5983, FAM83H, 30507, 132957, 1-2720; 5983, FAM83H, 30509, 132959, 1-2720; 5983, FAM83H, 30506, 132956, 127-3666; 5983, FAM83H, 30508, 132958, 127-3666; 5984, FAM84A, 30510, 132960, 289-1167; 5984, FAM84A, 30511, 132961, 518-1396; 5985, FAM84B, 30512, 132962, 457-1389; 5986, FAM86B1, 30516, 132966, 29-205; 5986, FAM86B1, 30517, 132967, 1-294; 5986, FAM86B1, 30518, 132968, 1-993; 5986, FAM86B1, 30519, 132969, 64-381; 5986, FAM86B1, 30520, 132970, 1-307; 5986, FAM86B1, 30521, 132971, 1-309; 5986, FAM86B1, 30522, 132972, 4-483; 5986, FAM86B1, 30523, 132973, 13-213; 5986, FAM86B1, 30524, 132974, 213-392; 5986, FAM86B1, 30525, 132975, 36-236; 5986, FAM86B1, 30526, 132976, 20-346; 5986, FAM86B1, 30527, 132977, 113-322; 5986, FAM86B1, 30513, 132963, 13-474; 5986, FAM86B1, 30514, 132964, 51-941; 5986, FAM86B1, 30515, 132965, 58-519; 5987, FAM86B2, 30529, 132979, 259-678; 5987, FAM86B2, 30530, 132980, 1-885; 5987, FAM86B2, 30531, 132981, 1-447; 5987, FAM86B2, 30528, 132978, 1-993; 5988, FAM86C1, 30535, 132985, 24-185; 5988, FAM86C1, 30536, 132986, 27-188; 5988, FAM86C1, 30537, 132987, 1-378; 5988, FAM86C1, 30532, 132982, 28-423; 5988, FAM86C1, 30533, 132983, 24-521; 5988, FAM86C1, 30534, 132984, 20-496; 5989, FAM89A, 30538, 132988, 36-590; 5990, FAM89B, 30539, 132989, 322-852; 5990, FAM89B, 30540, 132990, 209-673; 5990, FAM89B, 30541, 132991, 143-712; 5991, FAM9A, 30542, 132992, 112-1110; 5991, FAM9A, 30543, 132993, 137-1135; 5992, FAM9B, 30547, 132997, 493-765; 5992, FAM9B, 30544, 132994, 366-926; 5992, FAM9B, 30545, 132995, 190-870; 5992, FAM9B, 30546, 132996, 90-650; 5993, FAM9C, 30550, 133000, 1-380; 5993, FAM9C, 30551, 133001, 212-598; 5993, FAM9C, 30548, 132998, 132-632; 5993, FAM9C, 30549, 132999, 211-711; 5994, FAM90A1, 30553, 133003, 551-592; 5994, FAM90A1, 30552, 133002, 386-1780; 5994, FAM90A1, 30554, 133004, 560-1954; 5995, FAM90A26, 30555, 133005, 535-1929; 5996, FAM91A1, 30557, 133007, 248-2617; 5996, FAM91A1, 30558, 133008, 58-714; 5996, FAM91A1, 30559, 133009, 1-344; 5996, FAM91A1, 30560, 133010, 1-183; 5996, FAM91A1, 30556, 133006, 247-2763; 5997, FAM92A1, 30561, 133011, 87-578; 5997, FAM92A1, 30564, 133014, 574-769; 5997, FAM92A1, 30566, 133016, 222-552; 5997, FAM92A1, 30567, 133017, 347-457; 5997, FAM92A1, 30568, 133018, 78-582; 5997, FAM92A1, 30569, 133019, 156-560; 5997, FAM92A1, 30570, 133020, 274-678; 5997, FAM92A1, 30572, 133022, 55-453; 5997, FAM92A1, 30573, 133023, 36-380; 5997, FAM92A1, 30574, 133024, 99-587; 5997, FAM92A1, 30575, 133025, 372-608; 5997, FAM92A1, 30576, 133026, 1-563; 5997, FAM92A1, 30577, 133027, 56-922; 5997, FAM92A1, 30562, 133012, 142-957; 5997, FAM92A1, 30563, 133013, 67-822; 5997, FAM92A1, 30565, 133015, 35-823; 5997, FAM92A1, 30571, 133021, 142-1011; 5998, FAM92B, 30579, 133029, 1-617; 5998, FAM92B, 30580, 133030, 39-953; 5998, FAM92B, 30578, 133028, 157-1071; 5999, FAM96A, 30583, 133033, 90-482; 5999, FAM96A, 30584, 133034, 86-295; 5999, FAM96A, 30581, 133031, 251-733; 5999, FAM96A, 30582, 133032, 41-349; 5999, FAM96A, 30585, 133035, 28-336; 6000, FAM96B, 30587, 133037, 1-484; 6000, FAM96B, 30588, 133038, 1-321; 6000, FAM96B, 30589, 133039, 19-129; 6000, FAM96B, 30586, 133036, 37-528; 6001, FAM98A, 30591, 133041, 71-1009; 6001, FAM98A, 30592, 133042, 57-260; 6001, FAM98A, 30590, 133040, 142-1698; 6002, FAM98B, 30595, 133045, 1-305; 6002, FAM98B, 30593, 133043, 36-1337; 6002, FAM98B, 30594, 133044, 9-1001; 6003, FAM98C, 30598, 133048, 1-542; 6003, FAM98C, 30599, 133049, 20-580; 6003, FAM98C, 30600, 133050, 1-169; 6003, FAM98C, 30596, 133046, 20-1069; 6003, FAM98C, 30597, 133047, 1-804; 6004, FANCD2OS, 30601, 133051, 1-294; 6004, FANCD2OS, 30602, 133052, 218-751; 6004, FANCD2OS, 30603, 133053, 226-759; 6005, FAN1, 30607, 133057, 266-1558; 6005, FAN1, 30609, 133059, 30-344; 6005, FAN1, 30604, 133054, 292-3345; 6005, FAN1, 30605, 133055, 286-1887; 6005, FAN1, 30606, 133056, 272-1873; 6005, FAN1, 30608, 133058, 189-1790; 6005, FAN1, 30610, 133060, 292-3345; 6006, FAAP100, 30612, 133062, 47-340; 6006, FAAP100, 30613, 133063, 471-2063; 6006, FAAP100, 30614, 133064, 200-1101; 6006, FAAP100, 30615, 133065, 408-924; 6006, FAAP100, 30616, 133066, 343-1091; 6006, FAAP100, 30617, 133067, 1-333; 6006, FAAP100, 30611, 133061, 48-2693; 6007, FAAP20, 30621, 133071, 27-596; 6007, FAAP20, 30622, 133072, 1-580; 6007, FAAP20, 30623, 133073, 1-587; 6007, FAAP20, 30625, 133075, 1-442; 6007, FAAP20, 30618, 133068, 2-340; 6007, FAAP20, 30619, 133069, 26-568; 6007, FAAP20, 30620, 133070, 3-515; 6007, FAAP20, 30624, 133074, 27-614; 6008, FAAP24, 30626, 133076, 152-361; 6008, FAAP24, 30627, 133077, 306-668; 6008, FAAP24, 30628, 133078, 130-492; 6008, FAAP24, 30629, 133079, 111-758; 6008, FAAP24, 30630, 133080, 88-735; 6009, FANCA, 30633, 133083, 43-840; 6009, FANCA, 30634, 133084, 41-949; 6009, FANCA, 30635, 133085, 1-328; 6009, FANCA, 30636, 133086, 1-722; 6009, FANCA, 30637, 133087, 34-510; 6009, FANCA, 30638, 133088, 7-351; 6009, FANCA, 30639, 133089, 1-306; 6009, FANCA, 30640, 133090, 1-505; 6009, FANCA, 30641, 133091, 21-971; 6009, FANCA, 30642, 133092, 1-460; 6009, FANCA, 30643, 133093, 1-548; 6009, FANCA, 30644, 133094, 1-588; 6009, FANCA, 30645, 133095, 1-633; 6009, FANCA, 30646, 133096, 1-377; 6009, FANCA, 30648, 133098, 1-154; 6009, FANCA, 30649, 133099, 1-645; 6009, FANCA, 30650, 133100, 1-192; 6009, FANCA, 30651, 133101, 1-125; 6009, FANCA, 30652, 133102, 1-232; 6009, FANCA, 30631, 133081, 32-4399; 6009, FANCA, 30632, 133082, 43-936; 6009, FANCA, 30647, 133097, 32-4306; 6010, FANCB, 30655, 133105, 259-2712; 6010, FANCB, 30653, 133103, 155-2734; 6010, FANCB, 30654, 133104, 269-2848; 6011, FANCC, 30658, 133108, 142-591; 6011, FANCC, 30659, 133109, 263-1741; 6011, FANCC, 30656, 133106, 256-1932; 6011, FANCC, 30657, 133107, 176-1852; 6012, FANCD2, 30662, 133112, 1-2249; 6012, FANCD2, 30665, 133115, 193-309; 6012, FANCD2, 30666, 133116, 1-117; 6012, FANCD2, 30660, 133110, 94-4509; 6012, FANCD2, 30661, 133111, 79-4434; 6012, FANCD2, 30663, 133113, 162-4517; 6012, FANCD2, 30664, 133114, 39-764; 6013, FANCE, 30667, 133117, 186-1796; 6014, FANCF, 30668, 133118, 978-2102; 6015, FANCG, 30670, 133120, 224-868; 6015, FANCG, 30671, 133121, 170-490; 6015, FANCG, 30669, 133119, 493-2361; 6016, FANCI, 30674, 133124, 50-3337; 6016, FANCI, 30675, 133125, 75-754; 6016, FANCI, 30676, 133126, 1-438; 6016, FANCI, 30677, 133127, 1-3268; 6016, FANCI, 30678, 133128, 113-584; 6016, FANCI, 30679, 133129, 186-562; 6016, FANCI, 30680, 133130, 54-700; 6016, FANCI, 30672, 133122, 105-3911; 6016, FANCI, 30673, 133123, 87-4073; 6016, FANCI, 30681, 133131, 272-1030; 6017, FANCL, 30683, 133133, 63-839; 6017, FANCL, 30685, 133135, 11-1054; 6017, FANCL, 30686, 133136, 109-545; 6017, FANCL, 30687, 133137, 13-487; 6017, FANCL, 30688, 133138, 1-864; 6017, FANCL, 30689, 133139, 60-964; 6017, FANCL, 30690, 133140, 1-375; 6017, FANCL, 30682, 133132, 38-1165; 6017, FANCL, 30684, 133134, 38-1180; 6018, FANCM, 30694, 133144, 1-3049; 6018, FANCM, 30695, 133145, 1-321; 6018, FANCM, 30696, 133146, 1-408; 6018, FANCM, 30697, 133147, 1-4695; 6018, FANCM, 30691, 133141, 86-6232; 6018, FANCM, 30692, 133142, 79-6147; 6018, FANCM, 30693, 133143, 93-2102; 6019, FUBP1, 30699, 133149, 89-2056; 6019, FUBP1, 30701, 133151, 107-802; 6019, FUBP1, 30698, 133148, 84-2045; 6019, FUBP1, 30700, 133150, 83-2017; 6020, FUBP3, 30702, 133152, 76-1794; 6021, FDPS, 30706, 133156, 114-356; 6021, FDPS, 30708, 133158, 90-912; 6021, FDPS, 30710, 133160, 393-1139; 6021, FDPS, 30711, 133161, 156-677; 6021, FDPS, 30703, 133153, 163-1422; 6021, FDPS, 30704, 133154, 116-1375; 6021, FDPS, 30705, 133155, 195-1256; 6021, FDPS, 30707, 133157, 109-1170; 6021, FDPS, 30709, 133159, 79-1140; 6022, FDFT1, 30716, 133166, 292-741; 6022, FDFT1, 30718, 133168, 93-230; 6022, FDFT1, 30719, 133169, 93-296; 6022, FDFT1, 30720, 133170, 68-1300; 6022, FDFT1, 30721, 133171, 88-243; 6022, FDFT1, 30722, 133172, 97-438; 6022, FDFT1, 30712, 133162, 223-1476; 6022, FDFT1, 30713, 133163, 95-1219; 6022, FDFT1, 30714, 133164, 406-1404; 6022, FDFT1, 30715, 133165, 601-1662; 6022, FDFT1, 30717, 133167, 469-1530; 6022, FDFT1, 30723, 133173, 470-1468; 6022, FDFT1, 30724, 133174, 533-1594; 6022, FDFT1, 30725, 133175, 712-1965; 6022, FDFT1, 30726, 133176, 514-1767; 6022, FDFT1, 30727, 133177, 231-1292; 6022, FDFT1, 30728, 133178, 612-1673; 6023, FNTA, 30730, 133180, 1-590; 6023, FNTA, 30731, 133181, 17-370; 6023, FNTA, 30732, 133182, 127-874; 6023, FNTA, 30733, 133183, 18-221; 6023, FNTA, 30734, 133184, 337-516; 6023, FNTA, 30735, 133185, 40-243; 6023, FNTA, 30736, 133186, 889-1575; 6023, FNTA, 30729, 133179, 195-1334; 6024, FNTB, 30737, 133187, 235-1548; 6025, FAF1, 30738, 133188, 7-1479; 6025, FAF1, 30740, 133190, 192-1586; 6025, FAF1, 30739, 133189, 453-2405; 6026, FBF1, 30741, 133191, 1-3277; 6026, FBF1, 30743, 133193, 1-267; 6026, FBF1, 30744, 133194, 1-3445; 6026, FBF1, 30745, 133195, 1-451; 6026, FBF1, 30746, 133196, 1-279; 6026, FBF1, 30747, 133197, 184-336; 6026, FBF1, 30742, 133192, 275-3676; 6026, FBF1, 30748, 133198, 1-3402; 6027, FADD, 30749, 133199, 298-924; 6028, FAIM, 30755, 133205, 81-465; 6028, FAIM, 30750, 133200, 684-1325; 6028, FAIM, 30751, 133201, 255-860; 6028, FAIM, 30752, 133202, 98-637; 6028, FAIM, 30753, 133203, 110-649; 6028, FAIM, 30754, 133204, 78-617; 6029, FAIM2, 30757, 133207, 18-815; 6029, FAIM2, 30758, 133208, 78-704; 6029,

FAIM2, 30759, 133209, 214-547; 6029, FAIM2, 30760, 133210, 235-980; 6029, FAIM2, 30761, 133211, 1-433; 6029, FAIM2, 30756, 133206, 96-1046; 6029, FAIM2, 30762, 133212, 1178-1990; 6030, FAF2, 30764, 133214, 540-684; 6030, FAF2, 30763, 133213, 54-1391; 6031, FAS, 30765, 133215, 191-892; 6031, FAS, 30774, 133224, 195-845; 6031, FAS, 30775, 133225, 347-1111; 6031, FAS, 30776, 133226, 347-1081; 6031, FAS, 30766, 133216, 1-663; 6031, FAS, 30767, 133217, 221-1228; 6031, FAS, 30768, 133218, 100-1044; 6031, FAS, 30769, 133219, 147-458; 6031, FAS, 30770, 133220, 1-399; 6031, FAS, 30771, 133221, 26-475; 6031, FAS, 30772, 133222, 26-286; 6031, FAS, 30773, 133223, 26-475; 6032, FASLG, 30777, 133227, 59-442; 6032, FASLG, 30778, 133228, 185-1030; 6033, FASTK, 30782, 133232, 30-1427; 6033, FASTK, 30779, 133229, 79-1728; 6033, FASTK, 30780, 133230, 77-1303; 6033, FASTK, 30781, 133231, 97-1665; 6034, FEZ1, 30786, 133236, 333-569; 6034, FEZ1, 30787, 133237, 1-619; 6034, FEZ1, 30783, 133233, 236-1414; 6034, FEZ1, 30784, 133234, 203-517; 6034, FEZ1, 30785, 133235, 324-638; 6035, FEZ2, 30788, 133238, 334-882; 6035, FEZ2, 30789, 133239, 111-847; 6035, FEZ2, 30792, 133242, 25-942; 6035, FEZ2, 30793, 133243, 1-416; 6035, FEZ2, 30794, 133244, 1-211; 6035, FEZ2, 30795, 133245, 191-382; 6035, FEZ2, 30796, 133246, 1-550; 6035, FEZ2, 30790, 133240, 50-1192; 6035, FEZ2, 30791, 133241, 1-1062; 6036, FSCN1, 30798, 133248, 138-550; 6036, FSCN1, 30799, 133249, 183-580; 6036, FSCN1, 30800, 133250, 353-713; 6036, FSCN1, 30797, 133247, 115-1596; 6037, FSCN2, 30801, 133251, 1-1551; 6037, FSCN2, 30802, 133252, 137-1615; 6038, FSCN3, 30804, 133254, 113-352; 6038, FSCN3, 30805, 133255, 284-725; 6038, FSCN3, 30803, 133253, 220-1716; 6039, FASTKD1, 30806, 133256, 287-1045; 6039, FASTKD1, 30807, 133257, 1023-1850; 6039, FASTKD1, 30810, 133260, 376-687; 6039, FASTKD1, 30808, 133258, 348-2891; 6039, FASTKD1, 30809, 133259, 307-2721; 6040, FASTKD2, 30814, 133264, 205-576; 6040, FASTKD2, 30811, 133261, 349-2481; 6040, FASTKD2, 30812, 133262, 208-2340; 6040, FASTKD2, 30813, 133263, 367-2499; 6041, FASTKD3, 30816, 133266, 88-1914; 6041, FASTKD3, 30817, 133267, 55-597; 6041, FASTKD3, 30818, 133268, 88-261; 6041, FASTKD3, 30819, 133269, 84-817; 6041, FASTKD3, 30815, 133265, 138-2126; 6042, FASTKD5, 30820, 133270, 323-2617; 6043, FAT1, 30822, 133272, 1-357; 6043, FAT1, 30823, 133273, 49-207; 6043, FAT1, 30824, 133274, 388-1852; 6043, FAT1, 30825, 133275, 1-854; 6043, FAT1, 30826, 133276, 1-1105; 6043, FAT1, 30827, 133277, 189-13961; 6043, FAT1, 30821, 133271, 211-13977; 6044, FAT2, 30829, 133279, 1-3367; 6044, FAT2, 30828, 133278, 14-13063; 6045, FAT3, 30831, 133281, 23-13342; 6045, FAT3, 30832, 133282, 24-2702; 6045, FAT3, 30830, 133280, 18-13691; 6046, FAT4, 30833, 133283, 1-9669; 6046, FAT4, 30834, 133284, 14-14959; 6047, FTO, 30835, 133285, 1-390; 6047, FTO, 30839, 133289, 4-216; 6047, FTO, 30836, 133286, 164-484; 6047, FTO, 30837, 133287, 125-445; 6047, FTO, 30838, 133288, 125-508; 6047, FTO, 30840, 133290, 223-1740; 6048, FITM1, 30841, 133291, 290-1168; 6048, FITM1, 30842, 133292, 484-774; 6049, FITM2, 30843, 133293, 22-810; 6050, N/A, 30844, 133294, 24-2702; 6050, N/A, 30845, 133295, 23-13342; 6050, N/A, 30846, 133296, 18-13691; 6051, FA2H, 30848, 133298, 77-547; 6051, FA2H, 30849, 133299, 2-578; 6051, FA2H, 30850, 133300, 1-55; 6051, FA2H, 30847, 133297, 71-1189; 6052, FAAH, 30852, 133302, 1-148; 6052, FAAH, 30851, 133301, 85-1824; 6053, FAAH2, 30853, 133303, 121-1719; 6054, FABP1, 30855, 133305, 33-407; 6054, FABP1, 30854, 133304, 100-483; 6055, FABP12, 30857, 133307, 1-271; 6055, FABP12, 30856, 133306, 64-486; 6056, FABP2, 30858, 133308, 289-687; 6057, FABP3, 30860, 133310, 229-625; 6057, FABP3, 30861, 133311, 60-329; 6057, FABP3, 30859, 133309, 63-464; 6058, FABP4, 30863, 133313, 67-186; 6058, FABP4, 30862, 133312, 97-495; 6059, FABP5, 30865, 133315, 471-776; 6059, FABP5, 30864, 133314, 234-641; 6060, FABP6, 30868, 133318, 1-117; 6060, FABP6, 30866, 133316, 147-680; 6060, FABP6, 30867, 133317, 129-515; 6061, FABP7, 30869, 133319, 37-537; 6061, FABP7, 30870, 133320, 321-719; 6062, FABP9, 30871, 133321, 57-455; 6063, FADS1, 30872, 133322, 234-1739; 6063, FADS1, 30873, 133323, 417-559; 6063, FADS1, 30875, 133325, 1-685; 6063, FADS1, 30876, 133326, 167-583; 6063, FADS1, 30877, 133327, 1-525; 6063, FADS1, 30878, 133328, 304-563; 6063, FADS1, 30879, 133329, 1719-2297; 6063, FADS1, 30880, 133330, 255-581; 6063, FADS1, 30881, 133331, 124-582; 6063, FADS1, 30883, 133333, 248-742; 6063, FADS1, 30884, 133334, 218-709; 6063, FADS1, 30885, 133335, 231-567; 6063, FADS1, 30886, 133336, 34-405; 6063, FADS1, 30887, 133337, 926-1366; 6063, FADS1, 30888, 133338, 526-574; 6063, FADS1, 30889, 133339, 309-640; 6063, FADS1, 30874, 133324, 255-1337; 6063, FADS1, 30882, 133332, 545-1627; 6064, FADS2, 30892, 133342, 79-246; 6064, FADS2, 30894, 133344, 38-196; 6064, FADS2, 30895, 133345, 200-510; 6064, FADS2, 30896, 133346, 309-588; 6064, FADS2, 30898, 133348, 1653-2107; 6064, FADS2, 30899, 133349, 514-799; 6064, FADS2, 30900, 133350, 104-271; 6064, FADS2, 30890, 133340, 31-1299; 6064, FADS2, 30891, 133341, 631-1965; 6064, FADS2, 30893, 133343, 180-1421; 6064, FADS2, 30897, 133347, 112-1272; 6065, FADS3, 30902, 133352, 353-1345; 6065, FADS3, 30903, 133353, 1-349; 6065, FADS3, 30904, 133354, 1-1254; 6065, FADS3, 30905, 133355, 236-800; 6065, FADS3, 30906, 133356, 1-689; 6065, FADS3, 30907, 133357, 243-841; 6065, FADS3, 30901, 133351, 154-1491; 6066, FADS6, 30908, 133358, 1-660; 6066, FADS6, 30909, 133359, 13-1065; 6066, FADS6, 30910, 133360, 187-555; 6066, FADS6, 30911, 133361, 16-1122; 6067, FAXDC2, 30913, 133363, 42-341; 6067, FAXDC2, 30914, 133364, 122-274; 6067, FAXDC2, 30915, 133365, 176-307; 6067, FAXDC2, 30916, 133366, 241-549; 6067, FAXDC2, 30917, 133367, 376-815; 6067, FAXDC2, 30918, 133368, 143-487; 6067, FAXDC2, 30920, 133370, 509-603; 6067, FAXDC2, 30921, 133371, 116-298; 6067, FAXDC2, 30912, 133362, 425-1426; 6067, FAXDC2, 30919, 133369, 149-1081; 6068, FASN, 30923, 133373, 1-236; 6068, FASN, 30924, 133374, 75-7604; 6068, FASN, 30925, 133375, 177-627; 6068, FASN, 30922, 133372, 220-7755; 6069, FAR1, 30927, 133377, 1829-2248; 6069, FAR1, 30928, 133378, 104-1109; 6069, FAR1, 30926, 133376, 145-1692; 6070, FAR2, 30931, 133381, 1-68; 6070, FAR2, 30932, 133382, 1-258; 6070, FAR2, 30934, 133384, 2-205; 6070, FAR2, 30935, 133385, 408-539; 6070, FAR2, 30929, 133379, 269-1816; 6070, FAR2, 30930, 133380, 247-1794; 6070, FAR2, 30933, 133383, 253-1509; 6071, FOS, 30938, 133388, 158-670; 6071, FOS, 30939, 133389, 419-1117; 6071, FOS, 30940, 133390, 1-249; 6071, FOS, 30941, 133391, 7-537; 6071, FOS, 30942, 133392, 409-834; 6071, FOS, 30943, 133393, 156-567; 6071, FOS, 30936, 133386, 210-1352; 6071, FOS, 30937, 133387, 156-1190; 6071, FOS, 30944, 133394, 436-1236; 6072, FOSB, 30948, 133398, 592-1125; 6072, FOSB, 30949, 133399, 170-580; 6072, FOSB, 30950, 133400, 153-866; 6072, FOSB, 30954, 133404, 775-1341; 6072, FOSB, 30945, 133395, 593-1609; 6072, FOSB, 30946, 133396, 593-1501; 6072, FOSB, 30947, 133397, 593-1180; 6072, FOSB, 30951, 133401, 593-1492; 6072, FOSB, 30952, 133402, 593-1384; 6072, FOSB, 30953, 133403, 738-1607; 6072, FOSB, 30955, 133405, 593-1468; 6073, FBXL12, 30957, 133407, 267-434; 6073, FBXL12, 30958, 133408, 267-434; 6073, FBXL12, 30959, 133409, 33-437; 6073, FBXL12, 30960, 133410, 4-165; 6073, FBXL12, 30961, 133411, 17-274; 6073, FBXL12, 30963, 133413, 318-581; 6073, FBXL12, 30964, 133414, 1-258; 6073, FBXL12, 30965, 133415, 291-500; 6073, FBXL12, 30966, 133416, 264-407; 6073, FBXL12, 30968, 133418, 1-125; 6073, FBXL12, 30956, 133406, 243-1223; 6073, FBXL12, 30962, 133412, 100-921; 6073, FBXL12, 30967, 133417, 184-1005; 6074, FBXL13, 30971, 133421, 74-2125; 6074, FBXL13, 30973, 133423, 42-672; 6074, FBXL13, 30975, 133425, 70-2124; 6074, FBXL13, 30969, 133419, 428-2635; 6074, FBXL13, 30970, 133420, 243-2366; 6074, FBXL13, 30972, 133422, 261-2468; 6074, FBXL13, 30974, 133424, 135-2207; 6074, FBXL13, 30976, 133426, 135-1496; 6075, FBXL14, 30977, 133427, 100-1356; 6076, FBXL15, 30979, 133429, 1311-2201; 6076, FBXL15, 30980, 133430, 304-776; 6076, FBXL15, 30981, 133431, 196-804; 6076, FBXL15, 30982, 133432, 248-871; 6076, FBXL15, 30983, 133433, 305-874; 6076, FBXL15, 30978, 133428, 1317-2219; 6077, FBXL16, 30984, 133434, 204-1643; 6077, FBXL16, 30985, 133435, 333-1772; 6077, FBXL16, 30986, 133436, 106-909; 6078, FBXL17, 30990, 133440, 1-1392; 6078, FBXL17, 30987, 133437, 914-1825; 6078, FBXL17, 30988, 133438, 203-1147; 6078, FBXL17, 30989, 133439, 408-2513; 6079, FBXL18, 30992, 133442, 1-2057; 6079, FBXL18, 30995, 133445, 49-828; 6079, FBXL18, 30991, 133441, 125-2281; 6079, FBXL18, 30993, 133443, 79-2085; 6079, FBXL18, 30994, 133444, 95-1192; 6080, FBXL19, 30996, 133446, 388-2412; 6080, FBXL19, 30998, 133448, 1-1759; 6080, FBXL19, 30999, 133449, 106-1782; 6080, FBXL19, 31000, 133450, 1-416; 6080, FBXL19, 31001, 133451, 219-2243; 6080, FBXL19, 31002, 133452, 123-299; 6080, FBXL19, 31003, 133453, 1-368; 6080, FBXL19, 31004, 133454, 947-2095; 6080, FBXL19, 30997, 133447, 159-2243; 6081, FBXL2, 31005, 133455, 42-284; 6081, FBXL2, 31006, 133456, 38-148; 6081, FBXL2, 31007, 133457, 37-426; 6081, FBXL2, 31008, 133458, 63-251; 6081, FBXL2, 31009, 133459, 69-260; 6081, FBXL2, 31010, 133460, 61-330; 6081, FBXL2, 31011, 133461, 92-1363; 6081, FBXL2, 31012, 133462, 38-1105; 6081, FBXL2, 31013, 133463, 69-1136; 6082, FBXL20, 31017, 133467, 304-1620; 6082, FBXL20, 31018, 133468, 1-348; 6082, FBXL20, 31014, 133464, 262-1572; 6082, FBXL20, 31015, 133465, 222-1436; 6082, FBXL20, 31016, 133466, 255-1565; 6083, FBXL22, 31020, 133470, 3-395; 6083, FBXL22, 31021, 133471, 1-84; 6083, FBXL22, 31019, 133469, 41-784; 6084, FBXL3, 31023, 133473, 371-1093; 6084, FBXL3, 31022, 133472, 326-1612; 6085, FBXL4, 31024, 133474, 392-2257; 6085, FBXL4, 31025, 133475, 430-2295; 6086, FBXL5, 31028, 133478, 220-596; 6086, FBXL5, 31029, 133479, 456-741; 6086, FBXL5, 31030, 133480, 297-532; 6086, FBXL5, 31031, 133481, 422-591; 6086, FBXL5, 31032, 133482, 55-387; 6086, FBXL5, 31033, 133483, 1-1837; 6086, FBXL5, 31034, 133484, 209-595; 6086, FBXL5, 31035, 133485, 1-550; 6086, FBXL5, 31026, 133476, 126-2201; 6086, FBXL5, 31027, 133477, 96-2120; 6087, FBXL6, 31036, 133486, 66-1685; 6087, FBXL6, 31037, 133487, 26-1627; 6088, FBXL7, 31038, 133488, 2-1351; 6088, FBXL7, 31039, 133489, 482-1957; 6088, FBXL7, 31040, 133490, 391-1725; 6089, FBXL8, 31042, 133492, 104-292; 6089, FBXL8, 31043, 133493, 174-559; 6089, FBXL8, 31044, 133494, 160-363; 6089, FBXL8, 31045, 133495, 98-586; 6089, FBXL8, 31047, 133497, 136-543; 6089, FBXL8, 31048, 133498, 177-332; 6089, FBXL8, 31041, 133491, 178-1302; 6089, FBXL8, 31046, 133496, 148-1272; 6090, FBXW10, 31052, 133502, 174-764; 6090, FBXW10, 31049, 133499, 171-3170; 6090, FBXW10, 31050, 133500, 220-3405; 6090, FBXW10, 31051, 133501, 222-3380; 6091, FBXW11, 31056, 133506, 158-301; 6091, FBXW11, 31057, 133507, 47-636; 6091, FBXW11, 31058, 133508, 89-310; 6091, FBXW11, 31059, 133509, 148-291; 6091, FBXW11, 31060, 133510, 148-291; 6091, FBXW11, 31053, 133503, 139-1767; 6091, FBXW11, 31054, 133504, 372-1961; 6091, FBXW11, 31055, 133505, 149-1675; 6092, FBXW12, 31063, 133513, 166-1089; 6092, FBXW12, 31061, 133511, 187-1581; 6092, FBXW12, 31062, 133512, 14-1351; 6092, FBXW12, 31064, 133514, 158-1342; 6093, FBXW2, 31065, 133515, 454-1079; 6093, FBXW2, 31066, 133516, 189-1553; 6094, FBXW4, 31067, 133517, 620-1858; 6095, FBXW5, 31069, 133519, 452-839; 6095, FBXW5, 31070, 133520, 118-718; 6095, FBXW5, 31071, 133521, 1-581; 6095, FBXW5, 31072, 133522, 51-404; 6095, FBXW5, 31068, 133518, 81-1781; 6096, FBXW7, 31076, 133526, 78-1673; 6096, FBXW7, 31077, 133527, 197-671; 6096, FBXW7, 31079, 133529, 327-857; 6096, FBXW7, 31073, 133523, 242-2125; 6096, FBXW7, 31074, 133524, 1231-3354; 6096, FBXW7, 31075, 133525, 181-1950; 6096, FBXW7, 31078, 133528, 181-2304; 6096, FBXW7, 31080, 133530, 76-2199; 6097, FBXW8, 31081, 133531, 83-1879; 6097, FBXW8, 31082, 133532, 74-1672; 6098, FBXW9, 31085, 133535, 39-557; 6098, FBXW9, 31083, 133533, 63-1439; 6098, FBXW9, 31084, 133534, 1-1437; 6099, FBXO10, 31086, 133536, 120-1841; 6099, FBXO10, 31088, 133538, 286-498; 6099, FBXO10, 31087, 133537, 50-2920; 6100, FBXO11, 31089, 133539, 90-1865; 6100, FBXO11, 31091, 133541, 12-185; 6100, FBXO11, 31093, 133543, 139-560; 6100, FBXO11, 31094, 133544, 78-323; 6100, FBXO11, 31095, 133545, 1-1687; 6100, FBXO11, 31090, 133540, 74-2857; 6100, FBXO11, 31092, 133542, 115-2646; 6101, FBXO15, 31097, 133547, 1-307; 6101, FBXO15, 31098, 133548, 1-47; 6101, FBXO15, 31099, 133549, 1-109; 6101, FBXO15, 31100, 133550, 1-168; 6101, FBXO15, 31101, 133551, 1-367; 6101, FBXO15, 31102, 133552, 1-237; 6101, FBXO15, 31103, 133553, 59-468; 6101, FBXO15, 31104, 133554, 47-166; 6101, FBXO15, 31096, 133546, 81-1613; 6102, FBXO16, 31105, 133555, 110-1060; 6102, FBXO16, 31107, 133557, 17-226; 6102, FBXO16, 31108, 133558, 109-1158; 6102, FBXO16, 31109, 133559, 56-607; 6102, FBXO16, 31111, 133561, 1-284; 6102, FBXO16, 31106, 133556, 150-1028; 6102, FBXO16, 31110, 133560, 69-911; 6103, FBXO17, 31113, 133563, 1-330; 6103, FBXO17, 31114, 133564, 135-668; 6103, FBXO17, 31116, 133566, 1-284; 6103, FBXO17, 31117, 133567, 343-1179; 6103, FBXO17, 31118, 133568, 1-284; 6103, FBXO17, 31119, 133569, 135-668; 6103, FBXO17, 31120, 133570, 1-330; 6103, FBXO17, 31121, 133571, 133-969; 6103, FBXO17, 31112, 133562, 343-1179; 6103, FBXO17, 31115, 133565, 133-969; 6104, FBXO2, 31123, 133573, 74-434; 6104, FBXO2, 31122, 133572, 343-1233; 6105, FBXO21, 31125, 133575, 219-1832; 6105, FBXO21, 31126, 133576, 1-678; 6105, FBXO21, 31127, 133577, 1-1516; 6105, FBXO21, 31124, 133574, 1-1887; 6105, FBXO21, 31128, 133578, 76-1941; 6106, FBXO22, 31131, 133581, 89-370; 6106, FBXO22, 31132, 133582, 1-725; 6106, FBXO22, 31133, 133583, 1-237; 6106, FBXO22, 31135, 133585, 301-782; 6106, FBXO22, 31136, 133586, 1-460; 6106, FBXO22, 31129, 133579, 106-1317; 6106, FBXO22, 31130, 133580, 87-917; 6106, FBXO22, 31134, 133584, 87-227; 6107, FBXO24, 31139, 133589, 17-579; 6107, FBXO24, 31140, 133590, 281-394; 6107, FBXO24, 31141, 133591, 208-598; 6107, FBXO24, 31137, 133587, 323-2065; 6107, FBXO24, 31138, 133588, 13-1869; 6107, FBXO24, 31142, 133592, 1-957; 6107, FBXO24, 31143, 133593, 69-1775; 6108, FBXO25, 31148, 133598, 259-632; 6108, FBXO25, 31149, 133599, 1-90; 6108, FBXO25, 31144, 133594, 160-1035; 6108, FBXO25, 31145, 133595, 418-1293; 6108, FBXO25, 31146, 133596, 267-1343; 6108, FBXO25, 31147, 133597, 120-1223; 6109, FBXO27, 31152, 133602, 127-975; 6109, FBXO27, 31153, 133603, 1-300; 6109, FBXO27, 31154, 133604, 109-508; 6109, FBXO27, 31150, 133600, 121-972; 6109, FBXO27, 31151, 133601, 50-901; 6110, FBXO28, 31157, 133607, 12-392; 6110, FBXO28, 31155, 133605, 44-1150; 6110, FBXO28, 31156, 133606, 20-559; 6111, FBXO3, 31160, 133610, 8-397; 6111, FBXO3, 31161, 133611, 8-1300; 6111, FBXO3, 31163, 133613, 273-749; 6111, FBXO3, 31164, 133614, 24-542; 6111, FBXO3, 31165, 133615, 506-982; 6111, FBXO3, 31166, 133616, 3753-4829; 6111, FBXO3, 31158, 133608, 20-1435; 6111, FBXO3, 31159, 133609, 47-1294; 6111, FBXO3, 31162, 133612, 22-1254; 6112, FBXO30, 31167, 133617, 168-2405; 6113, FBXO31, 31169, 133619, 20-439; 6113, FBXO31, 31170, 133620, 291-726; 6113, FBXO31, 31171, 133621, 314-1417; 6113, FBXO31, 31168, 133618, 14-1633; 6114, FBXO32, 31172, 133622, 193-981; 6114, FBXO32, 31173, 133623, 193-1260; 6115, FBXO33, 31175, 133625, 399-405; 6115, FBXO33, 31176, 133626, 98-367; 6115, FBXO33, 31174, 133624, 339-2006; 6116, FBXO34, 31179, 133629, 5-1738; 6116, FBXO34, 31177, 133627, 246-2381; 6116, FBXO34, 31178, 133628, 139-2274; 6117, FBXO36, 31182, 133632, 9-515; 6117, FBXO36, 31180, 133630, 19-585; 6117, FBXO36, 31181, 133631, 422-895; 6118, FBXO38, 31183, 133633, 169-3000; 6118, FBXO38, 31184, 133634, 169-3735; 6118, FBXO38, 31185, 133635, 102-3443; 6118, FBXO38, 31186, 133636, 66-2897; 6119, FBXO39, 31188, 133638, 1-111; 6119, FBXO39, 31189, 133639, 1-151; 6119, FBXO39, 31187, 133637, 131-1459; 6120, FBXO4, 31192, 133642, 10-927; 6120, FBXO4, 31193, 133643, 57-251; 6120, FBXO4, 31194, 133644, 12-476; 6120, FBXO4, 31190, 133640, 57-1220; 6120, FBXO4, 31191, 133641, 57-980; 6121, FBXO40, 31195, 133645, 415-2544; 6122, FBXO41, 31196, 133646, 1-2628; 6122, FBXO41, 31197, 133647, 417-3044; 6122, FBXO41, 31198, 133648, 290-2917; 6123, FBXO42, 31200, 133650, 50-945; 6123, FBXO42, 31201, 133651, 258-1153; 6123, FBXO42, 31199, 133649, 218-2371; 6124, FBXO43, 31203, 133653, 666-776; 6124, FBXO43, 31202, 133652, 318-2444; 6125, FBXO44, 31208, 133658, 103-873; 6125, FBXO44, 31210, 133660, 499-994; 6125, FBXO44, 31211, 133661, 1-446; 6125, FBXO44, 31212, 133662, 1-399; 6125, FBXO44, 31204, 133654, 238-912; 6125, FBXO44, 31205, 133655, 83-850; 6125, FBXO44, 31206, 133656, 104-778; 6125, FBXO44, 31207, 133657, 74-748; 6125, FBXO44, 31209, 133659, 499-1266; 6126, FBXO45, 31214, 133664, 397-720; 6126, FBXO45, 31213, 133663, 298-1158; 6127, FBXO46, 31216, 133666, 589-628; 6127, FBXO46, 31217, 133667, 103-654; 6127, FBXO46, 31215, 133665, 135-1946; 6128, FBXO47, 31218, 133668, 201-1559; 6129, FBXO48, 31219, 133669, 409-876; 6130, FBXO5, 31220, 133670, 60-1403; 6130, FBXO5, 31221, 133671, 382-1587; 6131, FBXO6, 31223, 133673, 1-749; 6131, FBXO6, 31222, 133672, 136-1017; 6132, FBXO7, 31227, 133677, 206-355; 6132, FBXO7, 31228, 133678, 586-747; 6132, FBXO7, 31229, 133679, 328-453; 6132, FBXO7, 31224, 133674, 328-1896; 6132, FBXO7, 31225, 133675, 363-1589; 6132, FBXO7, 31226, 133676, 126-1457; 6133, FBXO8, 31232, 133682, 246-755; 6133, FBXO8, 31233, 133683, 377-928; 6133, FBXO8, 31234, 133684, 1110-1808; 6133, FBXO8, 31230, 133680, 864-1823; 6133, FBXO8, 31231, 133681, 267-1103; 6133, FBXO8, 31235, 133685, 1-837; 6134, FBXO9, 31239, 133689, 307-452; 6134, FBXO9, 31240, 133690, 1-574; 6134, FBXO9, 31241, 133691, 293-728; 6134, FBXO9, 31242, 133692, 214-569; 6134, FBXO9, 31243, 133693, 1-453; 6134, FBXO9, 31236, 133686, 173-1516; 6134, FBXO9, 31237, 133687, 332-1645; 6134, FBXO9, 31238, 133688, 311-1522; 6135, FBXO18, 31246, 133696, 366-3326; 6135, FBXO18, 31244, 133694, 116-3247; 6135, FBXO18, 31245, 133695, 105-3389; 6136, N/A, 31247, 133697, 50-901; 6136, N/A, 31248, 133698, 109-508; 6136, N/A, 31249, 133699, 1-300; 6136, N/A, 31250, 133700, 121-972; 6136, N/A, 31251, 133701, 127-975; 6137, FCAR, 31268, 133718, 56-919; 6137, FCAR, 31273, 133723, 1-762; 6137, FCAR, 31274, 133724, 43-395; 6137, FCAR, 31277, 133727, 1-429; 6137, FCAR, 31305, 133755, 1-828; 6137, FCAR, 31311, 133761, 1-429; 6137, FCAR, 31312, 133762, 11-730; 6137, FCAR, 31322, 133772, 11-694; 6137, FCAR, 31338, 133788, 6-581; 6137, FCAR, 31344, 133794, 43-395; 6137, FCAR, 31345, 133795, 6-803; 6137, FCAR, 31252, 133702, 1-537; 6137, FCAR, 31253, 133703, 6-581; 6137, FCAR, 31254, 133704, 11-874; 6137, FCAR, 31255, 133705, 1-828; 6137, FCAR, 31256, 133706, 1-630; 6137, FCAR, 31257, 133707, 1-762; 6137, FCAR, 31258, 133708, 6-803; 6137, FCAR, 31259, 133709, 43-582; 6137, FCAR, 31260, 133710, 11-730; 6137, FCAR, 31261, 133711, 11-694; 6137, FCAR, 31262, 133712, 11-694; 6137, FCAR, 31263, 133713, 1-630; 6137, FCAR, 31264, 133714, 1-630; 6137, FCAR, 31265, 133715, 1-828; 6137, FCAR, 31266, 133716, 1-537; 6137, FCAR, 31267, 133717, 6-803; 6137, FCAR, 31269, 133719, 1-762; 6137, FCAR, 31270, 133720, 6-803; 6137, FCAR, 31271, 133721, 6-581; 6137, FCAR, 31272, 133722, 1-537; 6137, FCAR, 31275, 133725, 1-630; 6137, FCAR, 31276, 133726, 11-874; 6137, FCAR, 31278, 133728, 11-694; 6137, FCAR, 31279, 133729, 11-694; 6137, FCAR, 31280, 133730, 1-762; 6137, FCAR, 31281, 133731, 11-730; 6137, FCAR, 31282, 133732, 6-581; 6137, FCAR, 31283, 133733, 1-630; 6137, FCAR, 31284, 133734, 11-730; 6137, FCAR, 31285, 133735, 11-874; 6137, FCAR, 31286, 133736, 1-630; 6137, FCAR, 31287, 133737, 6-803; 6137, FCAR, 31288, 133738, 11-730; 6137, FCAR, 31289, 133739, 43-582; 6137, FCAR, 31290, 133740, 11-694; 6137, FCAR, 31291, 133741, 11-694; 6137, FCAR, 31292, 133742, 1-537; 6137, FCAR, 31293, 133743, 1-762; 6137, FCAR, 31294, 133744, 11-694; 6137, FCAR, 31295, 133745, 1-828; 6137, FCAR, 31296, 133746, 6-581; 6137, FCAR, 31297, 133747, 6-803; 6137, FCAR, 31298, 133748, 6-581; 6137, FCAR, 31299, 133749, 43-582; 6137, FCAR, 31300, 133750, 6-581; 6137, FCAR, 31301, 133751, 11-874; 6137, FCAR, 31302, 133752, 1-762; 6137, FCAR, 31303, 133753, 1-828; 6137, FCAR, 31304, 133754, 11-694; 6137, FCAR, 31306, 133756, 1-828; 6137, FCAR, 31307, 133757, 56-919; 6137, FCAR, 31308, 133758, 11-730; 6137, FCAR, 31309, 133759, 18-845; 6137, FCAR, 31310, 133760, 1-828; 6137, FCAR, 31313, 133763, 6-803; 6137, FCAR, 31314, 133764, 1-762; 6137, FCAR, 31315, 133765, 6-581; 6137, FCAR, 31316, 133766, 6-581; 6137, FCAR, 31317, 133767, 11-730; 6137, FCAR, 31318, 133768, 6-803; 6137, FCAR, 31319, 133769, 11-874; 6137, FCAR, 31320, 133770, 43-582; 6137, FCAR, 31321, 133771, 1-537; 6137, FCAR, 31323, 133773, 11-874; 6137, FCAR, 31324, 133774, 43-582; 6137, FCAR, 31325, 133775, 43-582; 6137, FCAR, 31326, 133776, 11-874; 6137, FCAR, 31327, 133777, 1-828; 6137, FCAR, 31328, 133778, 11-874; 6137, FCAR, 31329, 133779, 1-630; 6137, FCAR, 31330, 133780, 6-803; 6137, FCAR, 31331, 133781, 1-762; 6137, FCAR, 31332, 133782, 1-537; 6137, FCAR, 31333, 133783, 1-576; 6137, FCAR, 31334, 133784, 11-730; 6137, FCAR, 31335, 133785, 43-582; 6137, FCAR, 31336, 133786, 1-630; 6137, FCAR, 31337, 133787, 11-730; 6137, FCAR, 31339, 133789, 11-694; 6137, FCAR, 31340, 133790, 1-537; 6137, FCAR, 31341, 133791, 1-537; 6137, FCAR, 31342, 133792, 6-803; 6137, FCAR, 31343, 133793, 1-762; 6137, FCAR, 31346, 133796, 43-582; 6137, FCAR, 31347, 133797, 1-537; 6137, FCAR, 31348, 133798, 1-828; 6137, FCAR, 31349, 133799, 11-730; 6137, FCAR, 31350, 133800, 1-537; 6137, FCAR, 31351, 133801, 1-762; 6138, FCER1A, 31352, 133802, 30-704; 6138, FCER1A, 31353, 133803, 100-873; 6139, FCER1G, 31355, 133805, 44-382; 6139, FCER1G, 31354, 133804, 26-286; 6140, FCER2, 31357, 133807, 85-1047; 6140, FCER2, 31359, 133809, 325-801; 6140, FCER2, 31356, 133806, 214-1179; 6140, FCER2, 31358, 133808, 183-1148; 6141, FCGBP, 31360, 133810, 1-4926; 6141, FCGBP, 31361, 133811, 9-12623; 6142, FCGR1A, 31363, 133813, 74-795; 6142, FCGR1A, 31362, 133812, 55-1179; 6143, FCGR1B, 31365, 133815, 44-886; 6143, FCGR1B, 31366, 133816, 51-728; 6143, FCGR1B, 31367, 133817, 38-712; 6143, FCGR1B, 31368, 133818, 23-771; 6143, FCGR1B, 31369, 133819, 51-725; 6143, FCGR1B, 31364, 133814, 1-567; 6144, FCGR2A, 31372, 133822, 12-422; 6144, FCGR2A, 31373, 133823, 12-425; 6144, FCGR2A, 31374, 133824, 1-259; 6144, FCGR2A, 31375, 133825, 1-573; 6144, FCGR2A, 31370, 133820, 39-992; 6144, FCGR2A, 31371, 133821, 39-989; 6145, FCGR2B, 31376, 133826, 96-971; 6145, FCGR2B, 31377, 133827, 82-1014; 6145, FCGR2B, 31378, 133828, 82-993; 6145, FCGR2B, 31379, 133829, 14-946; 6146, FCGR2C, 31380, 133830, 99-1070; 6146, FCGR2C, 31381, 133831, 100-1068; 6146, FCGR2C, 31382, 133832, 3-803; 6147, FCGR3A, 31384, 133834, 185-1057; 6147, FCGR3A, 31386, 133836, 147-462; 6147, FCGR3A, 31387, 133837, 1-815; 6147, FCGR3A, 31383, 133833, 106-870; 6147, FCGR3A, 31385, 133835, 293-1057; 6147, FCGR3A, 31388, 133838, 156-920; 6148, FCGR3B, 31391, 133841, 1-763; 6148, FCGR3B, 31392, 133842, 5-814; 6148, FCGR3B, 31393, 133843, 271-584; 6148, FCGR3B, 31394, 133844, 286-678; 6148, FCGR3B, 31395, 133845, 286-936; 6148, FCGR3B, 31389, 133839, 369-1070; 6148, FCGR3B, 31390, 133840, 123-824; 6149, FCGRT, 31398, 133848, 80-582; 6149, FCGRT, 31399, 133849, 104-781; 6149, FCGRT, 31400, 133850, 23-844; 6149, FCGRT, 31401, 133851, 1-462; 6149, FCGRT, 31402, 133852, 147-446; 6149, FCGRT, 31403, 133853, 1-566; 6149, FCGRT, 31404, 133854, 155-578; 6149, FCGRT, 31405, 133855, 1-636; 6149, FCGRT, 31406, 133856, 464-579; 6149, FCGRT, 31396, 133846, 487-1584; 6149, FCGRT, 31397, 133847, 248-1345; 6150, FCMR, 31409, 133859, 142-594; 6150, FCMR, 31410, 133860, 144-567; 6150, FCMR, 31411, 133861, 88-465; 6150, FCMR, 31412, 133862, 138-580; 6150, FCMR, 31407, 133857, 145-1317; 6150, FCMR, 31408, 133858, 145-981; 6150, FCMR, 31413, 133863, 14-934; 6151, FCAMR, 31414, 133864, 476-2209; 6151, FCAMR, 31415, 133865, 336-488; 6151, FCAMR, 31416, 133866, 418-1215; 6151, FCAMR, 31417, 133867, 25-822; 6152, FCRL1, 31418, 133868, 53-1153; 6152, FCRL1, 31419, 133869, 69-1358; 6152, FCRL1, 31420, 133870, 24-1310; 6153, FCRL2, 31421, 133871, 50-1576; 6153, FCRL2, 31422, 133872, 60-668; 6153, FCRL2, 31423, 133873, 142-720; 6154, FCRL3, 31429, 133879, 140-907; 6154, FCRL3, 31424, 133874, 293-2497; 6154, FCRL3, 31425, 133875, 174-2402; 6154, FCRL3, 31426, 133876, 166-2085; 6154, FCRL3, 31427, 133877, 179-2383; 6154, FCRL3, 31428, 133878, 166-2388; 6155, FCRL4, 31430, 133880, 137-1684; 6156, FCRL5, 31431, 133881, 159-3092; 6156, FCRL5, 31432, 133882, 94-1872; 6156, FCRL5, 31433, 133883, 94-2373; 6157, FCRL6, 31438, 133888, 87-560; 6157, FCRL6, 31434, 133884, 87-1328; 6157, FCRL6, 31435, 133885, 9-1202; 6157, FCRL6, 31436, 133886, 2-1306; 6157, FCRL6, 31437, 133887, 2-937; 6158, FCRLA, 31445, 133895, 40-498; 6158, FCRLA, 31439, 133889, 243-1373; 6158, FCRLA, 31440, 133890, 1-678; 6158, FCRLA, 31441, 133891, 22-816; 6158, FCRLA, 31442, 133892, 1-813; 6158, FCRLA, 31443, 133893, 243-668; 6158, FCRLA, 31444, 133894, 243-821; 6158, FCRLA, 31446, 133896, 1-1098; 6158, FCRLA, 31447, 133897, 6-716; 6158, FCRLA, 31448, 133898, 243-1391; 6158, FCRLA, 31449, 133899, 243-1106; 6158, FCRLA, 31450, 133900, 243-971; 6159, FCRLB, 31451, 133901, 15-842; 6159, FCRLB, 31452, 133902, 15-821; 6159, FCRLB, 31453, 133903, 15-950; 6159, FCRLB, 31454, 133904, 15-971; 6159, FCRLB, 31455, 133905, 216-1496; 6160, FCF1, 31457, 133907, 124-684; 6160, FCF1, 31458, 133908, 390-574; 6160, FCF1, 31459, 133909, 31-228; 6160, FCF1, 31460, 133910, 90-212; 6160, FCF1, 31461, 133911, 29-187; 6160, FCF1, 31462, 133912, 29-580; 6160, FCF1, 31456, 133906, 55-651; 6161, FCHSD1, 31465, 133915, 9-1805; 6161, FCHSD1, 31466, 133916, 20-787; 6161, FCHSD1, 31467, 133917, 81-714; 6161, FCHSD1, 31463, 133913, 52-2124; 6161, FCHSD1, 31464, 133914, 202-1431; 6162, FCHSD2, 31471, 133921, 235-540; 6162, FCHSD2, 31472, 133922, 170-2464; 6162, FCHSD2, 31473, 133923, 372-2186; 6162, FCHSD2, 31474, 133924, 1-352; 6162, FCHSD2, 31475, 133925, 167-587; 6162, FCHSD2, 31476, 133926, 1-257; 6162, FCHSD2, 31468, 133918, 240-2294; 6162, FCHSD2, 31469, 133919, 134-1681; 6162, FCHSD2, 31470, 133920, 385-2607; 6163, FCHO1, 31478, 133928, 357-881; 6163, FCHO1, 31479, 133929, 220-554; 6163, FCHO1, 31480, 133930, 459-543; 6163, FCHO1, 31481, 133931, 376-841; 6163, FCHO1, 31482, 133932, 424-551; 6163, FCHO1, 31483, 133933, 464-534; 6163, FCHO1, 31484, 133934, 462-567; 6163, FCHO1, 31486, 133936, 177-580; 6163, FCHO1, 31487, 133937, 322-598; 6163, FCHO1, 31488, 133938, 12-2702; 6163, FCHO1, 31489, 133939, 68-774; 6163, FCHO1, 31490, 133940, 182-556; 6163, FCHO1, 31492, 133942, 568-573; 6163, FCHO1, 31493, 133943, 520-565; 6163, FCHO1, 31494, 133944, 272-575; 6163, FCHO1, 31495, 133945, 339-1131; 6163, FCHO1, 31497, 133947, 288-579; 6163, FCHO1, 31499, 133949, 280-2955; 6163, FCHO1, 31500, 133950, 360-1014; 6163, FCHO1, 31501, 133951, 330-884; 6163, FCHO1, 31477, 133927, 187-2856; 6163, FCHO1, 31485, 133935, 163-2832; 6163, FCHO1, 31491, 133941, 284-2953; 6163, FCHO1, 31496, 133946, 54-2723; 6163, FCHO1, 31498, 133948, 241-2760; 6164, FCHO2, 31502, 133952, 27-1163; 6164, FCHO2, 31504, 133954, 32-726; 6164, FCHO2, 31503, 133953, 117-2549; 6164, FCHO2, 31505, 133955, 29-2362; 6165, FLVCR1, 31507, 133957, 1-1064; 6165, FLVCR1, 31506, 133956, 199-1866; 6166, FLVCR2, 31510, 133960, 268-532; 6166, FLVCR2, 31511, 133961, 107-508; 6166, FLVCR2, 31512, 133962, 61-669; 6166, FLVCR2, 31513, 133963, 52-777; 6166, FLVCR2, 31514, 133964, 75-356; 6166, FLVCR2, 31515, 133965, 109-719; 6166, FLVCR2, 31508, 133958, 357-1937; 6166, FLVCR2, 31509, 133959, 110-1075; 6167, FEM1A, 31516, 133966, 175-2184; 6168, FEM1B, 31518, 133968, 1-809; 6168, FEM1B, 31519, 133969, 567-579; 6168, FEM1B, 31520, 133970, 334-574; 6168, FEM1B, 31517, 133967, 616-2499; 6169, FEM1C, 31521, 133971, 563-2416; 6170, FER, 31523, 133973, 199-1434; 6170, FER, 31524, 133974, 238-492; 6170, FER, 31526, 133976, 70-558; 6170, FER, 31522, 133972, 385-2853; 6170, FER, 31525, 133975, 56-1417; 6171, FER1L5, 31528, 133978, 1-6174; 6171, FER1L5, 31529, 133979, 1-6294; 6171, FER1L5, 31530, 133980, 1033-6318; 6171, FER1L5, 31527, 133977, 1-6282; 6172, FER1L6, 31531, 133981, 15-5588; 6172, FER1L6, 31532, 133982, 207-5780; 6173, FERD3L, 31533, 133983, 60-560; 6174, FRMPD1, 31535, 133985, 312-499; 6174, FRMPD1, 31534, 133984, 100-4836; 6174, FRMPD1, 31536, 133986, 594-5330; 6175, FRMPD2, 31537, 133987, 48-3902; 6175, FRMPD2, 31538, 133988, 304-4233; 6175, FRMPD2, 31539, 133989, 410-1195; 6176, FRMPD3, 31541, 133991, 1-5277; 6176, FRMPD3, 31540, 133990, 1-5433; 6177, FRMPD4, 31543, 133993, 87-3935; 6177, FRMPD4, 31542, 133992, 507-4475; 6178, FRMD1, 31546, 133996, 1-543; 6178, FRMD1, 31547, 133997, 20-606; 6178, FRMD1, 31548, 133998, 1-543; 6178, FRMD1, 31544, 133994, 66-1715; 6178, FRMD1, 31545, 133995, 120-1565; 6179, FRMD3, 31553, 134003, 1-423; 6179, FRMD3, 31549, 133999, 208-2001; 6179, FRMD3, 31550, 134000, 111-752; 6179, FRMD3, 31551, 134001, 97-1185; 6179, FRMD3, 31552, 134002, 316-1986; 6179, FRMD3, 31554, 134004, 111-1772; 6180, FRMD4A, 31555, 134005, 571-2145; 6180, FRMD4A, 31557, 134007, 1-3075; 6180, FRMD4A, 31558, 134008, 380-598; 6180, FRMD4A, 31559, 134009, 109-270; 6180, FRMD4A, 31560, 134010, 430-662; 6180, FRMD4A, 31561, 134011, 391-495; 6180, FRMD4A, 31562, 134012, 1-688; 6180, FRMD4A, 31556, 134006, 370-3489; 6181, FRMD4B, 31564, 134014, 507-846; 6181, FRMD4B, 31565, 134015, 315-555; 6181, FRMD4B, 31566, 134016, 155-581; 6181, FRMD4B, 31567, 134017, 67-569; 6181, FRMD4B, 31568, 134018, 647-2707; 6181, FRMD4B, 31569, 134019, 1-549; 6181, FRMD4B, 31570, 134020, 79-561; 6181, FRMD4B, 31571, 134021, 454-505; 6181, FRMD4B, 31563, 134013, 85-3189; 6182, FRMD5, 31572, 134022, 157-1710; 6182, FRMD5, 31573, 134023, 199-849; 6182, FRMD5, 31574, 134024, 1-1425; 6182, FRMD5, 31575, 134025, 140-511; 6182, FRMD5, 31577, 134027, 1-358; 6182, FRMD5, 31578, 134028, 458-1702; 6182, FRMD5, 31579, 134029, 1-537; 6182, FRMD5, 31580, 134030, 925-1935; 6182, FRMD5, 31576, 134026, 178-1890; 6183, FRMD6, 31584, 134034, 1-390; 6183, FRMD6, 31585, 134035, 145-573; 6183, FRMD6, 31586, 134036, 1-618; 6183, FRMD6, 31587, 134037, 263-624; 6183, FRMD6, 31588, 134038, 138-1775; 6183, FRMD6, 31589, 134039, 385-569; 6183, FRMD6, 31581, 134031, 197-2065; 6183, FRMD6, 31582, 134032, 494-2338; 6183, FRMD6, 31583, 134033, 286-2130; 6183, FRMD6, 31590, 134040, 145-939; 6184, FRMD7, 31592, 134042, 201-1985; 6184, FRMD7, 31591, 134041, 177-2321; 6184, FRMD7, 31593, 134043, 1-2100; 6185, FRMD8, 31597, 134047, 142-342; 6185, FRMD8, 31598, 134048, 110-380; 6185, FRMD8, 31599, 134049, 126-677; 6185, FRMD8, 31600, 134050, 103-568; 6185, FRMD8, 31594, 134044, 164-1558; 6185, FRMD8, 31595, 134045, 126-1352; 6185, FRMD8, 31596, 134046, 106-1398; 6186, FARP1, 31603, 134053, 1-648; 6186, FARP1, 31604, 134054, 1-744; 6186, FARP1, 31605, 134055, 526-555; 6186, FARP1, 31606, 134056, 137-747; 6186, FARP1, 31607, 134057, 240-3470; 6186, FARP1, 31608, 134058, 1-514; 6186, FARP1, 31609, 134059, 419-3649; 6186, FARP1, 31601, 134051, 266-3403; 6186, FARP1, 31602, 134052, 37-426; 6187, FARP2, 31612, 134062, 260-538; 6187, FARP2, 31613, 134063, 54-456; 6187, FARP2, 31614, 134064, 1-170; 6187, FARP2, 31615, 134065, 1-239; 6187, FARP2, 31616, 134066, 1-1449; 6187, FARP2, 31617, 134067, 1-587; 6187, FARP2, 31610, 134060, 171-3335; 6187, FARP2, 31611, 134061, 117-2060; 6187, FARP2, 31618, 134068, 125-2041; 6188, FERMT1, 31620, 134070, 128-567; 6188, FERMT1, 31621, 134071, 816-2078; 6188, FERMT1, 31619, 134069, 790-2823; 6189, FERMT2, 31626, 134076, 128-587; 6189, FERMT2, 31627, 134077, 1-1923; 6189, FERMT2, 31629, 134079, 94-291; 6189, FERMT2, 31630, 134080, 1-400; 6189, FERMT2, 31631, 134081, 234-700; 6189, FERMT2, 31632, 134082, 356-754; 6189, FERMT2, 31633, 134083, 1-1636; 6189, FERMT2, 31622, 134072, 187-2229; 6189, FERMT2, 31623, 134073, 82-2145; 6189, FERMT2, 31624, 134074, 218-2260; 6189, FERMT2, 31625, 134075, 108-2009; 6189, FERMT2, 31628, 134078, 1-2064; 6190, FERMT3, 31636, 134086, 471-714; 6190, FERMT3, 31637, 134087, 1-555; 6190, FERMT3, 31638, 134088, 149-1006; 6190, FERMT3, 31634, 134084, 96-2099; 6190, FERMT3, 31635, 134085, 96-2087; 6191, FDX1, 31639, 134089, 239-793; 6192, FDX1L, 31641, 134091, 307-453; 6192, FDX1L, 31642, 134092, 358-504; 6192, FDX1L, 31640, 134090, 11-571; 6193, FDXR, 31643, 134093, 80-1555; 6193, FDXR, 31644, 134094, 33-1601; 6193, FDXR, 31646, 134096, 88-1692; 6193, FDXR, 31647, 134097, 189-1508; 6193, FDXR, 31648, 134098, 33-173; 6193, FDXR, 31649, 134099, 25-165; 6193, FDXR, 31650, 134100, 42-1493; 6193, FDXR, 31651, 134101, 25-300; 6193, FDXR, 31652, 134102, 31-171; 6193, FDXR, 31653, 134103, 1-139; 6193, FDXR, 31654, 134104, 18-1511; 6193, FDXR, 31655, 134105, 67-558; 6193, FDXR, 31656, 134106, 34-567; 6193, FDXR, 31657, 134107, 72-1463; 6193, FDXR, 31658, 134108, 70-300; 6193, FDXR, 31645, 134095, 31-1386; 6194, FDXACB1, 31660, 134110, 326-643; 6194, FDXACB1, 31661, 134111, 424-1611; 6194, FDXACB1, 31659, 134109, 49-1923; 6195, FRRS1, 31662, 134112, 603-2483; 6196, FRRS1L, 31663, 134113, 1-1035; 6197, FTMT, 31664, 134114, 10-738; 6198, FTH1, 31666, 134116, 207-452; 6198, FTH1, 31667, 134117, 207-515; 6198, FTH1, 31668, 134118, 207-494; 6198, FTH1, 31669, 134119, 183-644; 6198, FTH1, 31670, 134120, 207-550; 6198, FTH1, 31671, 134121, 209-361; 6198, FTH1, 31672, 134122, 275-616; 6198, FTH1, 31673, 134123, 393-567; 6198, FTH1, 31665, 134115, 236-787; 6198, FTH1, 31674, 134124, 113-664; 6199, FTHL17, 31675, 134125, 101-652; 6200, FTL, 31677, 134127, 200-772; 6200, FTL, 31676, 134126, 208-735; 6201, FECH, 31680, 134130, 82-417; 6201, FECH, 31681, 134131, 1-431; 6201, FECH, 31682, 134132, 70-564; 6201, FECH, 31683, 134133, 71-1049; 6201, FECH, 31684, 134134, 319-590; 6201, FECH, 31678, 134128, 153-1424; 6201, FECH, 31679, 134129, 35-1324; 6202, FES, 31687, 134137, 86-2131; 6202, FES, 31688, 134138, 146-587; 6202, FES, 31689, 134139, 201-544; 6202, FES, 31691, 134141, 359-485; 6202, FES, 31693, 134143, 32-1669; 6202, FES, 31694, 134144, 81-587; 6202, FES, 31695, 134145, 203-568; 6202, FES, 31685, 134135, 143-2611; 6202, FES, 31686, 134136, 1-2295; 6202, FES, 31690, 134140, 1-2259; 6202, FES, 31692, 134142, 108-2192; 6203, FATE1, 31697, 134147, 1-243; 6203, FATE1, 31696, 134146, 86-637; 6204, FETUB, 31699, 134149, 102-1055; 6204, FETUB, 31701, 134151, 70-429; 6204, FETUB, 31702, 134152, 281-591; 6204, FETUB, 31704, 134154, 55-333; 6204, FETUB, 31698, 134148, 102-1250; 6204, FETUB, 31700, 134150, 3-1040; 6204, FETUB, 31703, 134153, 262-1410; 6205, FEV, 31705, 134155, 583-1299; 6206, FEZF1, 31707, 134157, 582-688; 6206, FEZF1, 31706, 134156, 63-1340; 6206, FEZF1, 31708, 134158, 69-1496; 6207, FEZF2, 31709, 134159, 296-1675; 6207, FEZF2, 31710, 134160, 220-1599; 6207, FEZF2, 31711, 134161, 148-1527; 6208, FGFR1OP, 31714, 134164, 97-1152; 6208, FGFR1OP, 31712, 134162, 6-1145; 6208, FGFR1OP, 31713, 134163, 232-1431; 6209, FGFR1OP2, 31718, 134168, 403-582; 6209, FGFR1OP2, 31715, 134165, 343-1104; 6209, FGFR1OP2, 31716, 134166, 226-873; 6209, FGFR1OP2, 31717, 134167, 229-747; 6210, FOPNL, 31720, 134170, 41-289; 6210, FOPNL, 31721, 134171, 9-381; 6210, FOPNL, 31722, 134172, 19-345; 6210, FOPNL, 31723, 134173, 41-355; 6210, FOPNL, 31725, 134175, 39-413; 6210, FOPNL, 31726, 134176, 15-401; 6210, FOPNL, 31727, 134177, 30-626; 6210, FOPNL, 31729, 134179, 39-413; 6210, FOPNL, 31730, 134180, 30-626; 6210, FOPNL, 31731, 134181, 15-401; 6210, FOPNL, 31733, 134183, 41-355; 6210, FOPNL, 31734, 134184, 19-345; 6210, FOPNL, 31735, 134185, 41-289; 6210, FOPNL, 31736, 134186, 9-381; 6210, FOPNL, 31719, 134169, 31-555; 6210, FOPNL, 31724, 134174, 18-320; 6210, FOPNL, 31728, 134178, 31-555; 6210, FOPNL, 31732, 134182, 18-320; 6211, FGGY, 31741, 134191, 171-1694; 6211, FGGY, 31742, 134192, 128-681; 6211, FGGY, 31743, 134193, 401-563; 6211, FGGY, 31744, 134194, 237-986; 6211, FGGY, 31745, 134195, 128-466; 6211, FGGY, 31746, 134196, 122-508; 6211, FGGY, 31747, 134197, 122-1513; 6211, FGGY, 31748, 134198, 517-2061; 6211, FGGY, 31749, 134199, 234-695; 6211, FGGY, 31737, 134187, 175-1830; 6211, FGGY, 31738, 134188, 139-897; 6211, FGGY, 31739, 134189, 105-1496; 6211, FGGY, 31740, 134190, 185-1912; 6212, FGR, 31754, 134204, 167-1104; 6212, FGR, 31750, 134200, 187-1776; 6212, FGR, 31751, 134201, 147-1736; 6212, FGR, 31752, 134202, 290-1879; 6212, FGR, 31753, 134203, 272-1861; 6213, FHDC1, 31755, 134205, 76-3507; 6213, FHDC1, 31756, 134206, 189-3620; 6214, FBL, 31758, 134208, 71-193; 6214, FBL, 31759, 134209, 1-732; 6214, FBL, 31760, 134210, 43-726; 6214, FBL, 31761, 134211, 48-581; 6214, FBL, 31762, 134212, 1-690; 6214, FBL, 31763, 134213, 58-603; 6214, FBL, 31764, 134214, 58-877; 6214, FBL, 31765, 134215, 30-500; 6214, FBL, 31766, 134216, 1-732; 6214, FBL, 31767, 134217, 30-500; 6214, FBL, 31768, 134218, 58-603; 6214, FBL, 31769, 134219, 1-690; 6214, FBL, 31770, 134220, 1-111; 6214, FBL, 31771, 134221, 1-111; 6214, FBL, 31772, 134222, 48-581; 6214, FBL, 31773, 134223, 43-726; 6214, FBL, 31774, 134224, 71-193; 6214, FBL, 31775, 134225, 58-877; 6214, FBL, 31757, 134207, 115-1080; 6214, FBL, 31776, 134226, 115-1080; 6215, FBLL1, 31777, 134227, 390-1394; 6216, FBN1, 31779, 134229, 317-1225; 6216, FBN1, 31780, 134230, 329-496; 6216, FBN1, 31781, 134231, 1-2561; 6216, FBN1, 31778, 134228, 457-9072; 6217, FBN2, 31784, 134234, 621-1646; 6217, FBN2, 31785, 134235, 219-4640; 6217, FBN2, 31786, 134236, 238-1308; 6217, FBN2, 31787, 134237, 621-1451; 6217, FBN2, 31788, 134238, 1-8736; 6217, FBN2, 31782, 134232, 440-9178; 6217, FBN2, 31783, 134233, 976-9714; 6218, FBN3, 31790, 134240, 1-562; 6218, FBN3, 31793, 134243, 1-512; 6218, FBN3, 31789, 134239, 287-8716; 6218, FBN3, 31791, 134241, 416-8845; 6218, FBN3, 31792, 134242, 141-8570; 6219, FGA, 31796, 134246, 58-927; 6219, FGA, 31794, 134244, 80-2680; 6219, FGA, 31795, 134245, 80-2014; 6220, FGB, 31798, 134248, 3-140; 6220, FGB, 31799, 134249, 275-1093; 6220, FGB, 31797, 134247, 64-1539; 6221, FIBCD1, 31800, 134250, 569-1480; 6221, FIBCD1, 31802, 134252, 180-1046; 6221, FIBCD1, 31803, 134253, 1-932; 6221, FIBCD1, 31801, 134251, 244-1629; 6221, FIBCD1, 31804, 134254, 108-1493; 6222, FGG, 31806, 134256, 285-641; 6222, FGG, 31807, 134257, 35-1372; 6222, FGG, 31808, 134258, 27-1412; 6222, FGG, 31810, 134260, 421-789; 6222, FGG, 31805, 134255, 40-1401; 6222, FGG, 31809, 134259, 241-1554; 6223, FSBP, 31812, 134262, 85-474; 6223, FSBP, 31811, 134261, 75-974; 6224, FGL1, 31813, 134263, 198-1136; 6224, FGL1, 31814, 134264, 237-1175; 6224, FGL1, 31815, 134265, 325-1263; 6224, FGL1, 31816, 134266, 817-1755; 6224, FGL1, 31817, 134267, 110-1048; 6224, FGL1, 31818, 134268, 147-1085; 6224, FGL1, 31819, 134269, 226-1164; 6225, FGL2, 31820, 134270, 34-1353; 6226, FAP, 31822, 134272, 114-578; 6226, FAP, 31823, 134273, 168-533; 6226, FAP, 31824, 134274, 130-2337; 6226, FAP, 31825, 134275, 1-78; 6226, FAP, 31826, 134276, 1-143; 6226, FAP, 31827, 134277, 1-2280; 6226, FAP, 31821, 134271, 209-2491; 6227, FIBP, 31830, 134280, 73-513; 6227, FIBP, 31831, 134281, 1-413; 6227, FIBP, 31832, 134282, 19-459; 6227, FIBP, 31833, 134283, 97-1143; 6227, FIBP, 31828, 134278, 114-1208; 6227, FIBP, 31829, 134279, 122-1195; 6228, FGF1, 31838, 134288, 124-298; 6228, FGF1, 31839, 134289, 238-519; 6228, FGF1, 31841, 134291, 428-550; 6228, FGF1, 31834, 134284, 464-931; 6228, FGF1, 31835, 134285, 81-548; 6228, FGF1, 31836, 134286, 130-312; 6228, FGF1, 31837, 134287, 194-661; 6228, FGF1, 31840, 134290, 169-636; 6228, FGF1, 31842, 134292, 263-730; 6228, FGF1, 31843, 134293, 227-694; 6228, FGF1, 31844, 134294, 484-951; 6228, FGF1, 31845, 134295, 240-707; 6228, FGF1, 31846, 134296, 224-691; 6229, FGF10, 31848, 134298, 934-1131; 6229, FGF10, 31847, 134297, 116-742; 6230, FGF11, 31850, 134300, 438-743; 6230, FGF11, 31851, 134301, 275-580; 6230, FGF11, 31852, 134302, 254-559; 6230, FGF11, 31853, 134303, 1771-2076; 6230, FGF11, 31849, 134299, 595-1272; 6231, FGF12, 31855, 134305, 333-653; 6231, FGF12, 31857, 134307, 148-582; 6231, FGF12, 31858, 134308, 118-540; 6231, FGF12, 31854, 134304, 247-792; 6231, FGF12, 31856, 134306, 192-737; 6231, FGF12, 31859, 134309, 827-1558; 6232, FGF13, 31862, 134312, 223-352; 6232, FGF13, 31864, 134314, 68-687; 6232, FGF13, 31866, 134316, 359-652; 6232, FGF13, 31860, 134310, 85-663; 6232, FGF13, 31861, 134311, 663-1400; 6232, FGF13, 31863, 134313, 251-1018; 6232, FGF13, 31865, 134315, 39-719; 6232, FGF13, 31867, 134317, 268-867; 6233, FGF14, 31868, 134318, 97-855; 6233, FGF14, 31869, 134319, 1-744; 6234, FGF16, 31870, 134320, 271-894; 6235, FGF17, 31871, 134321, 504-1154; 6235, FGF17, 31872, 134322, 532-1149; 6236, FGF18, 31873, 134323, 545-1168; 6237, FGF19, 31874, 134324, 767-1417; 6238, FGF2, 31875, 134325, 69-935; 6238, FGF2, 31877, 134327, 69-935; 6238, FGF2, 31876, 134326, 345-812; 6239, FGF20, 31879, 134329, 1-340; 6239, FGF20, 31878, 134328, 150-785; 6240, FGF21, 31880, 134330, 151-780; 6240, FGF21, 31881, 134331, 573-1202; 6241, FGF22, 31883, 134333, 32-529; 6241, FGF22, 31882, 134332, 32-544; 6242, FGF23, 31884, 134334, 147-902; 6243, FGF3, 31885, 134335, 92-811; 6244, FGF4, 31886, 134336, 320-940; 6245, FGF5, 31889, 134339, 1-360; 6245, FGF5, 31887, 134337, 227-1033; 6245, FGF5, 31888, 134338, 187-558; 6246, FGF6, 31891, 134341, 1-96; 6246, FGF6, 31890, 134340, 45-671; 6247, FGF7, 31894, 134344, 213-579; 6247, FGF7, 31892, 134342, 612-1196; 6247, FGF7, 31893, 134343, 450-1034; 6247, FGF7, 31895, 134345, 471-764; 6247, FGF7, 31896, 134346, 530-1114; 6248, FGF8, 31901, 134351, 198-311; 6248, FGF8, 31902, 134352, 235-657; 6248, FGF8, 31897, 134347, 60-794; 6248, FGF8, 31898, 134348, 171-818; 6248, FGF8, 31899, 134349, 1-702; 6248, FGF8, 31900, 134350, 75-689; 6249,

FGF9, 31903, 134353, 531-1157; 6250, FGFBP1, 31904, 134354, 296-1000; 6251, FGFBP2, 31905, 134355, 108-779; 6252, FGFBP3, 31906, 134356, 165-941; 6253, FGFR1, 31909, 134359, 943-2046; 6253, FGFR1, 31912, 134362, 58-2259; 6253, FGFR1, 31915, 134365, 366-529; 6253, FGFR1, 31917, 134367, 345-349; 6253, FGFR1, 31919, 134369, 268-587; 6253, FGFR1, 31922, 134372, 222-657; 6253, FGFR1, 31923, 134373, 211-467; 6253, FGFR1, 31924, 134374, 260-1155; 6253, FGFR1, 31925, 134375, 1-405; 6253, FGFR1, 31926, 134376, 153-571; 6253, FGFR1, 31927, 134377, 1-186; 6253, FGFR1, 31928, 134378, 263-688; 6253, FGFR1, 31929, 134379, 943-1629; 6253, FGFR1, 31907, 134357, 725-2920; 6253, FGFR1, 31908, 134358, 822-3260; 6253, FGFR1, 31910, 134360, 725-2926; 6253, FGFR1, 31911, 134361, 750-3212; 6253, FGFR1, 31913, 134363, 302-2764; 6253, FGFR1, 31914, 134364, 318-2780; 6253, FGFR1, 31916, 134366, 324-2885; 6253, FGFR1, 31918, 134368, 943-3411; 6253, FGFR1, 31920, 134370, 731-3193; 6253, FGFR1, 31921, 134371, 1-453; 6254, FGFR2, 31931, 134381, 13-2478; 6254, FGFR2, 31932, 134382, 586-2593; 6254, FGFR2, 31940, 134390, 642-2765; 6254, FGFR2, 31943, 134393, 1-1116; 6254, FGFR2, 31945, 134395, 716-2497; 6254, FGFR2, 31946, 134396, 603-1358; 6254, FGFR2, 31947, 134397, 1-409; 6254, FGFR2, 31948, 134398, 648-2846; 6254, FGFR2, 31949, 134399, 71-265; 6254, FGFR2, 31930, 134380, 13-2472; 6254, FGFR2, 31933, 134383, 648-2762; 6254, FGFR2, 31934, 134384, 320-2443; 6254, FGFR2, 31935, 134385, 274-2739; 6254, FGFR2, 31936, 134386, 488-1252; 6254, FGFR2, 31937, 134387, 622-2664; 6254, FGFR2, 31938, 134388, 25-2334; 6254, FGFR2, 31939, 134389, 424-2727; 6254, FGFR2, 31941, 134391, 488-2605; 6254, FGFR2, 31942, 134392, 151-2280; 6254, FGFR2, 31944, 134394, 593-3061; 6255, FGFR3, 31955, 134405, 262-2640; 6255, FGFR3, 31956, 134406, 1-336; 6255, FGFR3, 31957, 134407, 257-1351; 6255, FGFR3, 31950, 134400, 40-2124; 6255, FGFR3, 31951, 134401, 103-2523; 6255, FGFR3, 31952, 134402, 257-2683; 6255, FGFR3, 31953, 134403, 257-2341; 6255, FGFR3, 31954, 134404, 257-2677; 6256, FGFR4, 31960, 134410, 183-2387; 6256, FGFR4, 31961, 134411, 28-246; 6256, FGFR4, 31962, 134412, 271-594; 6256, FGFR4, 31963, 134413, 1-838; 6256, FGFR4, 31964, 134414, 168-770; 6256, FGFR4, 31966, 134416, 210-552; 6256, FGFR4, 31967, 134417, 448-709; 6256, FGFR4, 31958, 134408, 246-2654; 6256, FGFR4, 31959, 134409, 37-2325; 6256, FGFR4, 31965, 134415, 174-2582; 6257, FRS2, 31969, 134419, 428-521; 6257, FRS2, 31971, 134421, 504-611; 6257, FRS2, 31972, 134422, 509-781; 6257, FRS2, 31973, 134423, 540-570; 6257, FRS2, 31974, 134424, 477-597; 6257, FRS2, 31975, 134425, 486-584; 6257, FRS2, 31976, 134426, 154-704; 6257, FRS2, 31977, 134427, 510-545; 6257, FRS2, 31968, 134418, 190-1716; 6257, FRS2, 31970, 134420, 247-1773; 6257, FRS2, 31978, 134428, 417-1943; 6258, FRS3, 31981, 134431, 34-474; 6258, FRS3, 31982, 134432, 218-326; 6258, FRS3, 31979, 134429, 173-1651; 6258, FRS3, 31980, 134430, 253-1731; 6259, FGFRL1, 31986, 134436, 106-562; 6259, FGFRL1, 31988, 134438, 332-571; 6259, FGFRL1, 31983, 134433, 36-1550; 6259, FGFRL1, 31984, 134434, 581-2095; 6259, FGFRL1, 31985, 134435, 149-1663; 6259, FGFRL1, 31987, 134437, 150-1664; 6260, FMOD, 31989, 134439, 465-1595; 6261, FN1, 31996, 134446, 1-723; 6261, FN1, 32002, 134452, 1-3312; 6261, FN1, 31990, 134440, 267-7607; 6261, FN1, 31991, 134441, 267-7334; 6261, FN1, 31992, 134442, 371-7804; 6261, FN1, 31993, 134443, 267-7157; 6261, FN1, 31994, 134444, 267-6797; 6261, FN1, 31995, 134445, 267-7427; 6261, FN1, 31997, 134447, 266-6988; 6261, FN1, 31998, 134448, 272-2245; 6261, FN1, 31999, 134449, 266-7069; 6261, FN1, 32000, 134450, 267-7259; 6261, FN1, 32001, 134451, 272-7069; 6262, FLRT1, 32003, 134453, 1044-3068; 6263, FLRT2, 32004, 134454, 768-2750; 6263, FLRT2, 32005, 134455, 706-2688; 6264, FLRT3, 32006, 134456, 460-2409; 6264, FLRT3, 32007, 134457, 258-2207; 6265, FANK1, 32008, 134458, 65-466; 6265, FANK1, 32009, 134459, 85-933; 6265, FANK1, 32011, 134461, 123-1142; 6265, FANK1, 32012, 134462, 129-499; 6265, FANK1, 32013, 134463, 1-599; 6265, FANK1, 32014, 134464, 275-672; 6265, FANK1, 32010, 134460, 105-1142; 6266, FSD1, 32016, 134466, 1-379; 6266, FSD1, 32017, 134467, 59-254; 6266, FSD1, 32018, 134468, 1-530; 6266, FSD1, 32019, 134469, 72-1385; 6266, FSD1, 32015, 134465, 148-1638; 6267, FSD1L, 32020, 134470, 177-1112; 6267, FSD1L, 32021, 134471, 188-1714; 6267, FSD1L, 32022, 134472, 99-1628; 6267, FSD1L, 32024, 134474, 99-1592; 6267, FSD1L, 32025, 134475, 426-1571; 6267, FSD1L, 32023, 134473, 120-1712; 6267, FSD1L, 32026, 134476, 177-614; 6268, FSD2, 32029, 134479, 301-603; 6268, FSD2, 32027, 134477, 183-2432; 6268, FSD2, 32028, 134478, 168-2282; 6269, FNDC1, 32031, 134481, 1-5371; 6269, FNDC1, 32030, 134480, 201-5885; 6270, FNDC3A, 32034, 134484, 1-420; 6270, FNDC3A, 32035, 134485, 285-2339; 6270, FNDC3A, 32037, 134487, 149-1129; 6270, FNDC3A, 32032, 134482, 88-3516; 6270, FNDC3A, 32033, 134483, 306-3902; 6270, FNDC3A, 32036, 134486, 349-3945; 6271, FNDC3B, 32039, 134489, 55-678; 6271, FNDC3B, 32038, 134488, 100-3714; 6271, FNDC3B, 32040, 134490, 64-3678; 6271, FNDC3B, 32041, 134491, 99-314; 6271, FNDC3B, 32042, 134492, 173-388; 6271, FNDC3B, 32043, 134493, 173-3787; 6272, FNDC4, 32044, 134494, 393-1097; 6273, FNDC5, 32045, 134495, 68-706; 6273, FNDC5, 32046, 134496, 215-676; 6274, FNDC7, 32048, 134498, 1-1498; 6274, FNDC7, 32047, 134497, 278-2479; 6275, FNDC5, 32049, 134499, 116-1090; 6276, FNDC9, 32051, 134501, 192-732; 6276, FNDC9, 32050, 134500, 189-863; 6277, FBRS, 32053, 134503, 1089-4031; 6277, FBRS, 32054, 134504, 1-632; 6277, FBRS, 32052, 134502, 264-1646; 6278, FBRSL1, 32055, 134505, 1021-4158; 6279, FSCB, 32056, 134506, 293-2770; 6280, FSIP1, 32058, 134508, 1-47; 6280, FSIP1, 32057, 134507, 211-1956; 6281, FSIP2, 32059, 134509, 1-20991; 6281, FSIP2, 32060, 134510, 1-2920; 6281, FSIP2, 32061, 134511, 1-411; 6281, FSIP2, 32063, 134513, 605-2545; 6281, FSIP2, 32062, 134512, 1-20724; 6282, FBLN1, 32067, 134517, 104-2269; 6282, FBLN1, 32069, 134519, 1-279; 6282, FBLN1, 32070, 134520, 1-550; 6282, FBLN1, 32071, 134521, 155-671; 6282, FBLN1, 32072, 134522, 318-512; 6282, FBLN1, 32073, 134523, 148-565; 6282, FBLN1, 32074, 134524, 1-544; 6282, FBLN1, 32075, 134525, 1-568; 6282, FBLN1, 32076, 134526, 1-183; 6282, FBLN1, 32064, 134514, 104-2155; 6282, FBLN1, 32065, 134515, 96-2207; 6282, FBLN1, 32066, 134516, 11-1711; 6282, FBLN1, 32068, 134518, 17-1822; 6283, FBLN2, 32078, 134528, 1-329; 6283, FBLN2, 32080, 134530, 1-305; 6283, FBLN2, 32082, 134532, 109-584; 6283, FBLN2, 32077, 134527, 70-3624; 6283, FBLN2, 32079, 134529, 120-3815; 6283, FBLN2, 32081, 134531, 383-4078; 6284, FBLN5, 32083, 134533, 171-1640; 6284, FBLN5, 32085, 134535, 463-570; 6284, FBLN5, 32086, 134536, 356-490; 6284, FBLN5, 32087, 134537, 275-547; 6284, FBLN5, 32088, 134538, 333-1694; 6284, FBLN5, 32084, 134534, 595-1941; 6285, FBLN7, 32089, 134539, 1-786; 6285, FBLN7, 32091, 134541, 231-1331; 6285, FBLN7, 32094, 134544, 1-819; 6285, FBLN7, 32090, 134540, 272-1591; 6285, FBLN7, 32092, 134542, 74-991; 6285, FBLN7, 32093, 134543, 74-1255; 6286, FICD, 32095, 134545, 105-647; 6286, FICD, 32097, 134547, 121-540; 6286, FICD, 32098, 134548, 1-170; 6286, FICD, 32096, 134546, 236-1612; 6287, FCN2, 32099, 134549, 11-838; 6287, FCN2, 32100, 134550, 11-952; 6288, FCN1, 32102, 134552, 7-1089; 6288, FCN1, 32101, 134551, 93-1073; 6289, FCN3, 32103, 134553, 7-906; 6289, FCN3, 32104, 134554, 7-873; 6290, FIGN, 32106, 134556, 321-410; 6290, FIGN, 32105, 134555, 316-2595; 6291, FIGNL1, 32109, 134559, 325-617; 6291, FIGNL1, 32110, 134560, 184-559; 6291, FIGNL1, 32112, 134562, 468-572; 6291, FIGNL1, 32113, 134563, 276-582; 6291, FIGNL1, 32114, 134564, 423-582; 6291, FIGNL1, 32115, 134565, 208-411; 6291, FIGNL1, 32107, 134557, 312-2336; 6291, FIGNL1, 32108, 134558, 331-2355; 6291, FIGNL1, 32111, 134561, 816-2840; 6291, FIGNL1, 32116, 134566, 1555-3579; 6291, FIGNL1, 32117, 134567, 29-2053; 6291, FIGNL1, 32118, 134568, 101-2125; 6291, FIGNL1, 32119, 134569, 210-2234; 6291, FIGNL1, 32120, 134570, 385-2409; 6292, FIG4, 32122, 134572, 6-425; 6292, FIG4, 32123, 134573, 428-724; 6292, FIG4, 32124, 134574, 1-409; 6292, FIG4, 32125, 134575, 1-712; 6292, FIG4, 32121, 134571, 125-2848; 6293, FLG, 32126, 134576, 37-12222; 6294, FLG2, 32127, 134577, 74-7249; 6295, FILIP1, 32129, 134579, 108-3452; 6295, FILIP1, 32128, 134578, 332-3973; 6295, FILIP1, 32130, 134580, 223-3756; 6296, FILIP1L, 32135, 134585, 1-445; 6296, FILIP1L, 32138, 134588, 388-2898; 6296, FILIP1L, 32131, 134581, 472-3873; 6296, FILIP1L, 32132, 134582, 472-3879; 6296, FILIP1L, 32133, 134583, 248-2929; 6296, FILIP1L, 32134, 134584, 472-1239; 6296, FILIP1L, 32136, 134586, 168-2303; 6296, FILIP1L, 32137, 134587, 149-2836; 6297, FLNA, 32140, 134590, 44-7867; 6297, FLNA, 32142, 134592, 59-7921; 6297, FLNA, 32143, 134593, 1-843; 6297, FLNA, 32144, 134594, 1-696; 6297, FLNA, 32145, 134595, 1-272; 6297, FLNA, 32146, 134596, 1-1815; 6297, FLNA, 32148, 134598, 331-7278; 6297, FLNA, 32139, 134589, 39-7958; 6297, FLNA, 32141, 134591, 238-8181; 6297, FLNA, 32147, 134597, 250-8169; 6298, FLNB, 32151, 134601, 107-694; 6298, FLNB, 32153, 134603, 158-7387; 6298, FLNB, 32154, 134604, 1-219; 6298, FLNB, 32155, 134605, 1-404; 6298, FLNB, 32149, 134599, 166-7974; 6298, FLNB, 32150, 134600, 166-7902; 6298, FLNB, 32152, 134602, 166-7941; 6298, FLNB, 32156, 134606, 166-8067; 6299, FBLIM1, 32160, 134610, 456-507; 6299, FBLIM1, 32161, 134611, 266-577; 6299, FBLIM1, 32163, 134613, 468-511; 6299, FBLIM1, 32164, 134614, 343-576; 6299, FBLIM1, 32165, 134615, 490-582; 6299, FBLIM1, 32166, 134616, 522-611; 6299, FBLIM1, 32167, 134617, 509-611; 6299, FBLIM1, 32168, 134618, 129-562; 6299, FBLIM1, 32169, 134619, 138-571; 6299, FBLIM1, 32157, 134607, 32-862; 6299, FBLIM1, 32158, 134608, 641-1762; 6299, FBLIM1, 32159, 134609, 444-1565; 6299, FBLIM1, 32162, 134612, 208-1332; 6300, FLNC, 32170, 134620, 262-8439; 6300, FLNC, 32171, 134621, 213-8291; 6301, FIBIN, 32172, 134622, 344-979; 6302, FAU, 32173, 134623, 73-336; 6302, FAU, 32174, 134624, 97-324; 6302, FAU, 32176, 134626, 182-507; 6302, FAU, 32178, 134628, 103-330; 6302, FAU, 32180, 134630, 9-305; 6302, FAU, 32175, 134625, 245-646; 6302, FAU, 32177, 134627, 87-488; 6302, FAU, 32179, 134629, 393-794; 6303, FIS1, 32182, 134632, 45-317; 6303, FIS1, 32183, 134633, 72-212; 6303, FIS1, 32184, 134634, 226-692; 6303, FIS1, 32185, 134635, 409-588; 6303, FIS1, 32186, 134636, 384-626; 6303, FIS1, 32181, 134631, 82-540; 6304, FZR1, 32190, 134640, 7-1092; 6304, FZR1, 32187, 134637, 1-1215; 6304, FZR1, 32188, 134638, 1-1491; 6304, FZR1, 32189, 134639, 237-1718; 6305, FKBP10, 32192, 134642, 156-398; 6305, FKBP10, 32193, 134643, 1-1160; 6305, FKBP10, 32194, 134644, 51-563; 6305, FKBP10, 32195, 134645, 47-490; 6305, FKBP10, 32196, 134646, 83-598; 6305, FKBP10, 32191, 134641, 105-1853; 6306, FKBP11, 32197, 134647, 58-336; 6306, FKBP11, 32199, 134649, 306-605; 6306, FKBP11, 32200, 134650, 1-192; 6306, FKBP11, 32201, 134651, 84-632; 6306, FKBP11, 32202, 134652, 65-283; 6306, FKBP11, 32198, 134648, 93-533; 6306, FKBP11, 32203, 134653, 400-1005; 6307, FKBP14, 32205, 134655, 1-268; 6307, FKBP14, 32206, 134656, 155-355; 6307, FKBP14, 32204, 134654, 177-812; 6308, FKBP15, 32208, 134658, 1-1494; 6308, FKBP15, 32209, 134659, 1-3735; 6308, FKBP15, 32207, 134657, 119-3778; 6309, FKBP1A, 32210, 134660, 60-371; 6309, FKBP1A, 32212, 134662, 136-447; 6309, FKBP1A, 32214, 134664, 175-453; 6309, FKBP1A, 32215, 134665, 175-468; 6309, FKBP1A, 32216, 134666, 1-114; 6309, FKBP1A, 32217, 134667, 167-556; 6309, FKBP1A, 32211, 134661, 31-357; 6309, FKBP1A, 32213, 134663, 165-491; 6310, FKBP1B, 32220, 134670, 1-128; 6310, FKBP1B, 32221, 134671, 235-474; 6310, FKBP1B, 32222, 134672, 120-293; 6310, FKBP1B, 32218, 134668, 137-463; 6310, FKBP1B, 32219, 134669, 150-392; 6311, FKBP1C, 32223, 134673, 112-438; 6312, FKBP2, 32227, 134677, 334-639; 6312, FKBP2, 32224, 134674, 134-562; 6312, FKBP2, 32225, 134675, 471-899; 6312, FKBP2, 32226, 134676, 88-516; 6313, FKBP3, 32230, 134680, 28-225; 6313, FKBP3, 32228, 134678, 412-1086; 6313, FKBP3, 32229, 134679, 74-748; 6314, FKBP4, 32232, 134682, 1-254; 6314, FKBP4, 32233, 134683, 72-227; 6314, FKBP4, 32234, 134684, 1-71; 6314, FKBP4, 32235, 134685, 315-572; 6314, FKBP4, 32236, 134686, 1-156; 6314, FKBP4, 32231, 134681, 188-1567; 6315, FKBP5, 32237, 134687, 154-1527; 6315, FKBP5, 32238, 134688, 204-1577; 6315, FKBP5, 32239, 134689, 159-965; 6315, FKBP5, 32240, 134690, 317-1690; 6316, FKBP6, 32243, 134693, 21-778; 6316, FKBP6, 32244, 134694, 97-696; 6316, FKBP6, 32245, 134695, 118-423; 6316, FKBP6, 32241, 134691, 70-1053; 6316, FKBP6, 32242, 134692, 155-1048; 6316, FKBP6, 32246, 134696, 110-1078; 6317, FKBP7, 32247, 134697, 77-460; 6317, FKBP7, 32248, 134698, 1-202; 6317, FKBP7, 32249, 134699, 97-357; 6317, FKBP7, 32250, 134700, 55-279; 6317, FKBP7, 32251, 134701, 60-728; 6317, FKBP7, 32252, 134702, 1-666; 6318, FKBP8, 32254, 134704, 114-861; 6318, FKBP8, 32256, 134706, 85-574; 6318, FKBP8, 32257, 134707, 91-593; 6318, FKBP8, 32259, 134709, 195-966; 6318, FKBP8, 32260, 134710, 529-1140; 6318, FKBP8, 32261, 134711, 122-472; 6318, FKBP8, 32262, 134712, 1-548; 6318, FKBP8, 32263, 134713, 1-311; 6318, FKBP8, 32265, 134715, 152-220; 6318, FKBP8, 32253, 134703, 65-1303; 6318, FKBP8, 32255, 134705, 122-1363; 6318, FKBP8, 32258, 134708, 111-1349; 6318, FKBP8, 32264, 134714, 201-1442; 6319, FKBP9, 32267, 134717, 104-780; 6319, FKBP9, 32266, 134716, 170-1882; 6319, FKBP9, 32268, 134718, 171-2042; 6319, FKBP9, 32269, 134719, 104-1120; 6320, FKBPL, 32270, 134720, 272-1321; 6320, FKBPL, 32271, 134721, 272-1321; 6320, FKBPL, 32272, 134722, 272-1321; 6320, FKBPL, 32273, 134723, 272-1321; 6321, FEN1, 32275, 134725, 282-776; 6321, FEN1, 32276, 134726, 1-463; 6321, FEN1, 32274, 134724, 414-1556; 6322, FLAD1, 32278, 134728, 478-990; 6322, FLAD1, 32280, 134730, 651-1037; 6322, FLAD1, 32283, 134733, 344-1714; 6322, FLAD1, 32277, 134727, 323-2086; 6322, FLAD1, 32279, 134729, 184-1656; 6322,

FLAD1, 32281, 134731, 821-1705; 6322, FLAD1, 32282, 134732, 178-1518; 6323, FMO1, 32287, 134737, 132-757; 6323, FMO1, 32284, 134734, 132-1730; 6323, FMO1, 32285, 134735, 123-1721; 6323, FMO1, 32286, 134736, 160-1569; 6323, FMO1, 32288, 134738, 160-1758; 6324, FMO2, 32290, 134740, 1-462; 6324, FMO2, 32291, 134741, 191-583; 6324, FMO2, 32289, 134739, 159-1766; 6325, FMO3, 32293, 134743, 72-218; 6325, FMO3, 32294, 134744, 70-723; 6325, FMO3, 32292, 134742, 112-1710; 6326, FMO4, 32295, 134745, 331-2007; 6327, FMO5, 32299, 134749, 183-618; 6327, FMO5, 32300, 134750, 276-1112; 6327, FMO5, 32301, 134751, 96-671; 6327, FMO5, 32296, 134746, 390-1991; 6327, FMO5, 32297, 134747, 281-1138; 6327, FMO5, 32298, 134748, 115-1509; 6327, FMO5, 32302, 134752, 390-1784; 6328, FLI1, 32305, 134755, 172-420; 6328, FLI1, 32308, 134758, 244-561; 6328, FLI1, 32309, 134759, 249-398; 6328, FLI1, 32303, 134753, 713-1873; 6328, FLI1, 32304, 134754, 370-1149; 6328, FLI1, 32306, 134756, 321-1580; 6328, FLI1, 32307, 134757, 490-1848; 6329, FLII, 32312, 134762, 16-171; 6329, FLII, 32313, 134763, 37-2139; 6329, FLII, 32314, 134764, 1-90; 6329, FLII, 32316, 134766, 1-555; 6329, FLII, 32317, 134767, 1-838; 6329, FLII, 32318, 134768, 1-354; 6329, FLII, 32319, 134769, 1-71; 6329, FLII, 32320, 134770, 184-582; 6329, FLII, 32321, 134771, 288-585; 6329, FLII, 32322, 134772, 1-624; 6329, FLII, 32323, 134773, 1-156; 6329, FLII, 32310, 134760, 227-4036; 6329, FLII, 32311, 134761, 34-3678; 6329, FLII, 32315, 134765, 81-3857; 6330, FLOT1, 32327, 134777, 141-856; 6330, FLOT1, 32328, 134778, 1-182; 6330, FLOT1, 32329, 134779, 1-246; 6330, FLOT1, 32330, 134780, 141-581; 6330, FLOT1, 32332, 134782, 15-592; 6330, FLOT1, 32333, 134783, 23-457; 6330, FLOT1, 32334, 134784, 73-629; 6330, FLOT1, 32335, 134785, 88-717; 6330, FLOT1, 32336, 134786, 88-792; 6330, FLOT1, 32337, 134787, 73-629; 6330, FLOT1, 32339, 134789, 15-592; 6330, FLOT1, 32340, 134790, 15-592; 6330, FLOT1, 32341, 134791, 1-547; 6330, FLOT1, 32342, 134792, 1-416; 6330, FLOT1, 32343, 134793, 132-888; 6330, FLOT1, 32344, 134794, 132-888; 6330, FLOT1, 32345, 134795, 1-271; 6330, FLOT1, 32346, 134796, 141-856; 6330, FLOT1, 32347, 134797, 88-792; 6330, FLOT1, 32348, 134798, 141-856; 6330, FLOT1, 32349, 134799, 15-592; 6330, FLOT1, 32350, 134800, 1-347; 6330, FLOT1, 32351, 134801, 88-792; 6330, FLOT1, 32352, 134802, 1-495; 6330, FLOT1, 32353, 134803, 73-629; 6330, FLOT1, 32354, 134804, 132-888; 6330, FLOT1, 32355, 134805, 73-629; 6330, FLOT1, 32356, 134806, 1-34; 6330, FLOT1, 32357, 134807, 88-792; 6330, FLOT1, 32358, 134808, 132-761; 6330, FLOT1, 32359, 134809, 23-457; 6330, FLOT1, 32360, 134810, 23-367; 6330, FLOT1, 32361, 134811, 15-592; 6330, FLOT1, 32362, 134812, 73-629; 6330, FLOT1, 32363, 134813, 222-851; 6330, FLOT1, 32364, 134814, 23-457; 6330, FLOT1, 32365, 134815, 1-1074; 6330, FLOT1, 32366, 134816, 132-888; 6330, FLOT1, 32367, 134817, 15-592; 6330, FLOT1, 32368, 134818, 73-629; 6330, FLOT1, 32369, 134819, 88-792; 6330, FLOT1, 32370, 134820, 23-457; 6330, FLOT1, 32371, 134821, 141-856; 6330, FLOT1, 32372, 134822, 1-695; 6330, FLOT1, 32373, 134823, 1-561; 6330, FLOT1, 32374, 134824, 23-457; 6330, FLOT1, 32375, 134825, 141-856; 6330, FLOT1, 32376, 134826, 132-888; 6330, FLOT1, 32324, 134774, 222-1505; 6330, FLOT1, 32325, 134775, 222-1505; 6330, FLOT1, 32326, 134776, 222-1505; 6330, FLOT1, 32331, 134781, 222-1505; 6330, FLOT1, 32338, 134788, 222-1505; 6331, FLOT2, 32377, 134827, 79-1530; 6331, FLOT2, 32379, 134829, 80-436; 6331, FLOT2, 32380, 134830, 79-1365; 6331, FLOT2, 32381, 134831, 15-221; 6331, FLOT2, 32382, 134832, 1-746; 6331, FLOT2, 32378, 134828, 106-1392; 6332, FIZ1, 32384, 134834, 4106-4686; 6332, FIZ1, 32385, 134835, 331-462; 6332, FIZ1, 32386, 134836, 1-403; 6332, FIZ1, 32387, 134837, 194-400; 6332, FIZ1, 32383, 134833, 91-1581; 6333, FLYWCH2, 32390, 134840, 308-742; 6333, FLYWCH2, 32391, 134841, 238-511; 6333, FLYWCH2, 32388, 134838, 260-682; 6333, FLYWCH2, 32389, 134839, 381-803; 6334, FLYWCH1, 32393, 134843, 1-1483; 6334, FLYWCH1, 32395, 134845, 581-721; 6334, FLYWCH1, 32396, 134846, 1-1403; 6334, FLYWCH1, 32397, 134847, 1-235; 6334, FLYWCH1, 32398, 134848, 413-643; 6334, FLYWCH1, 32399, 134849, 1-280; 6334, FLYWCH1, 32400, 134850, 1-594; 6334, FLYWCH1, 32392, 134842, 406-2556; 6334, FLYWCH1, 32394, 134844, 344-2491; 6335, N/A, 32401, 134851, 468-2456; 6335, N/A, 32402, 134852, 127-4092; 6335, N/A, 32403, 134853, 1-3591; 6335, N/A, 32404, 134854, 1-4260; 6335, N/A, 32405, 134855, 1-175; 6335, N/A, 32406, 134856, 505-4764; 6335, N/A, 32407, 134857, 1-545; 6335, N/A, 32408, 134858, 1-343; 6335, N/A, 32409, 134859, 279-1790; 6336, FLT1, 32414, 134864, 1647-1904; 6336, FLT1, 32416, 134866, 134-1435; 6336, FLT1, 32417, 134867, 136-393; 6336, FLT1, 32410, 134860, 253-4269; 6336, FLT1, 32411, 134861, 286-2487; 6336, FLT1, 32412, 134862, 157-1242; 6336, FLT1, 32413, 134863, 286-1911; 6336, FLT1, 32415, 134865, 237-2300; 6337, FLT3, 32419, 134869, 83-2302; 6337, FLT3, 32418, 134868, 83-3064; 6338, FLT3LG, 32422, 134872, 1-562; 6338, FLT3LG, 32424, 134874, 92-745; 6338, FLT3LG, 32427, 134877, 113-289; 6338, FLT3LG, 32428, 134878, 84-260; 6338, FLT3LG, 32429, 134879, 1-397; 6338, FLT3LG, 32420, 134870, 347-808; 6338, FLT3LG, 32421, 134871, 86-793; 6338, FLT3LG, 32423, 134873, 80-787; 6338, FLT3LG, 32425, 134875, 68-775; 6338, FLT3LG, 32426, 134876, 302-763; 6339, FLT4, 32432, 134882, 154-580; 6339, FLT4, 32433, 134883, 56-3976; 6339, FLT4, 32434, 134884, 80-967; 6339, FLT4, 32430, 134880, 80-4171; 6339, FLT4, 32431, 134881, 80-3976; 6340, N/A, 32435, 134885, 1-1080; 6340, N/A, 32436, 134886, 237-1604; 6340, N/A, 32437, 134887, 1-1395; 6341, N/A, 32438, 134888, 317-718; 6342, FOCAD, 32441, 134891, 32-572; 6342, FOCAD, 32442, 134892, 263-559; 6342, FOCAD, 32443, 134893, 163-3876; 6342, FOCAD, 32444, 134894, 68-208; 6342, FOCAD, 32445, 134895, 251-635; 6342, FOCAD, 32439, 134889, 34-5439; 6342, FOCAD, 32440, 134890, 365-5770; 6343, FOLH1, 32450, 134900, 230-376; 6343, FOLH1, 32452, 134902, 347-540; 6343, FOLH1, 32453, 134903, 194-418; 6343, FOLH1, 32454, 134904, 185-325; 6343, FOLH1, 32446, 134896, 262-2514; 6343, FOLH1, 32447, 134897, 812-2140; 6343, FOLH1, 32448, 134898, 370-2577; 6343, FOLH1, 32449, 134899, 124-2283; 6343, FOLH1, 32451, 134901, 106-2220; 6344, FOLR1, 32455, 134905, 211-984; 6344, FOLR1, 32456, 134906, 50-823; 6344, FOLR1, 32457, 134907, 437-1210; 6344, FOLR1, 32458, 134908, 167-940; 6345, FOLR2, 32460, 134910, 69-699; 6345, FOLR2, 32461, 134911, 299-1054; 6345, FOLR2, 32462, 134912, 119-763; 6345, FOLR2, 32463, 134913, 104-697; 6345, FOLR2, 32464, 134914, 48-556; 6345, FOLR2, 32465, 134915, 106-647; 6345, FOLR2, 32466, 134916, 106-551; 6345, FOLR2, 32467, 134917, 96-610; 6345, FOLR2, 32468, 134918, 125-859; 6345, FOLR2, 32459, 134909, 188-955; 6346, FOLR3, 32470, 134920, 112-335; 6346, FOLR3, 32471, 134921, 66-584; 6346, FOLR3, 32472, 134922, 24-761; 6346, FOLR3, 32473, 134923, 215-749; 6346, FOLR3, 32469, 134919, 17-331; 6347, FSHR, 32475, 134925, 121-2208; 6347, FSHR, 32476, 134926, 111-569; 6347, FSHR, 32477, 134927, 17-851; 6347, FSHR, 32474, 134924, 65-2074; 6348, FSHB, 32478, 134928, 70-459; 6348, FSHB, 32479, 134929, 40-429; 6348, FSHB, 32480, 134930, 31-420; 6349, FDCSP, 32481, 134931, 113-370; 6350, FLCN, 32484, 134934, 299-757; 6350, FLCN, 32485, 134935, 132-243; 6350, FLCN, 32482, 134932, 456-2195; 6350, FLCN, 32483, 134933, 456-1484; 6351, FNIP1, 32487, 134937, 30-3395; 6351, FNIP1, 32490, 134940, 863-3619; 6351, FNIP1, 32486, 134936, 1-3417; 6351, FNIP1, 32488, 134938, 97-3597; 6351, FNIP1, 32489, 134939, 96-1622; 6352, FNIP2, 32492, 134942, 1-724; 6352, FNIP2, 32493, 134943, 155-2173; 6352, FNIP2, 32491, 134941, 76-3420; 6353, FIGLA, 32494, 134944, 6-665; 6354, FST, 32497, 134947, 1-648; 6354, FST, 32498, 134948, 1-308; 6354, FST, 32495, 134945, 384-1418; 6354, FST, 32496, 134946, 167-1120; 6355, FSTL1, 32501, 134951, 1-61; 6355, FSTL1, 32502, 134952, 147-565; 6355, FSTL1, 32499, 134949, 358-1284; 6355, FSTL1, 32500, 134950, 96-917; 6356, FSTL3, 32504, 134954, 225-347; 6356, FSTL3, 32505, 134955, 294-568; 6356, FSTL3, 32506, 134956, 338-460; 6356, FSTL3, 32507, 134957, 285-537; 6356, FSTL3, 32508, 134958, 227-349; 6356, FSTL3, 32503, 134953, 60-851; 6357, FSTL4, 32510, 134960, 246-716; 6357, FSTL4, 32509, 134959, 251-2779; 6357, FSTL4, 32511, 134961, 12-2033; 6358, FSTL5, 32512, 134962, 438-2981; 6358, FSTL5, 32513, 134963, 369-2909; 6358, FSTL5, 32514, 134964, 407-2920; 6359, FPGS, 32516, 134966, 15-1142; 6359, FPGS, 32519, 134969, 166-959; 6359, FPGS, 32520, 134970, 94-677; 6359, FPGS, 32521, 134971, 68-1195; 6359, FPGS, 32515, 134965, 210-1823; 6359, FPGS, 32517, 134967, 51-1814; 6359, FPGS, 32518, 134968, 68-1753; 6360, FOXA1, 32523, 134973, 139-249; 6360, FOXA1, 32522, 134972, 63-1481; 6361, FOXA2, 32524, 134974, 183-1556; 6361, FOXA2, 32525, 134975, 186-1577; 6362, FOXA3, 32527, 134977, 234-538; 6362, FOXA3, 32526, 134976, 198-1250; 6363, FOXB1, 32528, 134978, 480-1457; 6364, FOXB2, 32529, 134979, 1-1299; 6365, FOXC1, 32530, 134980, 475-2136; 6366, FOXC2, 32531, 134981, 86-1591; 6367, FOXD1, 32532, 134982, 1-1398; 6368, FOXD2, 32533, 134983, 2120-3607; 6369, FOXD3, 32534, 134984, 19-1455; 6370, FOXD4, 32535, 134985, 86-1405; 6371, FOXD4L1, 32536, 134986, 593-1819; 6372, FOXD4L3, 32537, 134987, 86-1339; 6373, FOXD4L4, 32538, 134988, 592-1842; 6374, FOXD4L5, 32539, 134989, 833-2083; 6375, FOXD4L6, 32540, 134990, 81-1334; 6376, FOXE1, 32541, 134991, 662-1783; 6377, FOXE3, 32542, 134992, 245-1204; 6378, FOXF1, 32543, 134993, 44-1183; 6379, FOXF2, 32544, 134994, 115-1449; 6380, FOXG1, 32545, 134995, 1893-3362; 6381, FOXH1, 32546, 134996, 580-1677; 6382, FOXI1, 32547, 134997, 62-1198; 6382, FOXI1, 32548, 134998, 46-897; 6383, FOXI2, 32549, 134999, 40-996; 6384, FOXI3, 32550, 135000, 122-1384; 6385, FOXJ1, 32551, 135001, 356-1621; 6386, FOXJ2, 32552, 135002, 1146-2870; 6386, FOXJ2, 32553, 135003, 489-2069; 6387, FOXJ3, 32556, 135006, 887-1297; 6387, FOXJ3, 32559, 135009, 188-447; 6387, FOXJ3, 32560, 135010, 181-1326; 6387, FOXJ3, 32561, 135011, 1-378; 6387, FOXJ3, 32554, 135004, 175-1941; 6387, FOXJ3, 32555, 135005, 192-2060; 6387, FOXJ3, 32557, 135007, 313-2181; 6387, FOXJ3, 32558, 135008, 270-2138; 6387, FOXJ3, 32562, 135012, 132-2000; 6388, FOXK1, 32564, 135014, 1-328; 6388, FOXK1, 32563, 135013, 1-2202; 6389, FOXK2, 32566, 135016, 26-786; 6389, FOXK2, 32567, 135017, 290-805; 6389, FOXK2, 32569, 135019, 1-388; 6389, FOXK2, 32570, 135020, 177-2009; 6389, FOXK2, 32565, 135015, 175-2157; 6389, FOXK2, 32568, 135018, 177-2021; 6390, FOXL1, 32572, 135022, 250-592; 6390, FOXL1, 32571, 135021, 219-1256; 6391, FOXL2, 32573, 135023, 419-1549; 6392, FOXM1, 32577, 135027, 1-618; 6392, FOXM1, 32578, 135028, 1-243; 6392, FOXM1, 32579, 135029, 284-2530; 6392, FOXM1, 32574, 135024, 115-2520; 6392, FOXM1, 32575, 135025, 70-2361; 6392, FOXM1, 32576, 135026, 169-2415; 6393, FOXN1, 32581, 135031, 211-562; 6393, FOXN1, 32580, 135030, 30-1976; 6393, FOXN1, 32582, 135032, 199-2145; 6394, FOXN2, 32584, 135034, 193-932; 6394, FOXN2, 32585, 135035, 270-1292; 6394, FOXN2, 32583, 135033, 262-1557; 6395, FOXN3, 32588, 135038, 1-335; 6395, FOXN3, 32589, 135039, 1-240; 6395, FOXN3, 32590, 135040, 1-555; 6395, FOXN3, 32591, 135041, 1-276; 6395, FOXN3, 32592, 135042, 228-851; 6395, FOXN3, 32593, 135043, 1-231; 6395, FOXN3, 32594, 135044, 174-337; 6395, FOXN3, 32597, 135047, 226-505; 6395, FOXN3, 32598, 135048, 1-366; 6395, FOXN3, 32586, 135036, 17-1489; 6395, FOXN3, 32587, 135037, 118-1590; 6395, FOXN3, 32595, 135045, 257-1663; 6395, FOXN3, 32596, 135046, 137-1543; 6395, FOXN3, 32599, 135049, 1-1407; 6396, FOXN4, 32602, 135052, 1-657; 6396, FOXN4, 32603, 135053, 1-253; 6396, FOXN4, 32600, 135050, 106-1659; 6396, FOXN4, 32601, 135051, 253-1266; 6397, FOXO1, 32604, 135054, 386-2353; 6398, FOXO3, 32605, 135055, 305-2326; 6398, FOXO3, 32606, 135056, 344-2365; 6398, FOXO3, 32607, 135057, 233-1594; 6399, FOXO4, 32608, 135058, 1-1353; 6399, FOXO4, 32609, 135059, 333-1850; 6400, FOXO6, 32610, 135060, 10-1689; 6400, FOXO6, 32612, 135062, 1-1680; 6400, FOXO6, 32613, 135063, 1-1680; 6400, FOXO6, 32611, 135061, 1-1476; 6401, FOXP1, 32616, 135066, 3426-5126; 6401, FOXP1, 32618, 135068, 122-795; 6401, FOXP1, 32620, 135070, 1-1722; 6401, FOXP1, 32622, 135072, 162-530; 6401, FOXP1, 32623, 135073, 1-1842; 6401, FOXP1, 32625, 135075, 155-2194; 6401, FOXP1, 32627, 135077, 225-577; 6401, FOXP1, 32628, 135078, 119-1852; 6401, FOXP1, 32629, 135079, 527-2608; 6401, FOXP1, 32630, 135080, 1-612; 6401, FOXP1, 32614, 135064, 477-821; 6401, FOXP1, 32615, 135065, 527-2560; 6401, FOXP1, 32617, 135067, 155-1960; 6401, FOXP1, 32619, 135069, 324-2357; 6401, FOXP1, 32621, 135071, 630-2660; 6401, FOXP1, 32624, 135074, 432-2465; 6401, FOXP1, 32626, 135076, 63-407; 6402, FOXP2, 32634, 135084, 1-1371; 6402, FOXP2, 32636, 135086, 651-2243; 6402, FOXP2, 32638, 135088, 260-772; 6402, FOXP2, 32639, 135089, 314-2398; 6402, FOXP2, 32642, 135092, 420-668; 6402, FOXP2, 32644, 135094, 11-625; 6402, FOXP2, 32646, 135096, 375-578; 6402, FOXP2, 32647, 135097, 90-1858; 6402, FOXP2, 32648, 135098, 1-685; 6402, FOXP2, 32649, 135099, 339-2489; 6402, FOXP2, 32650, 135100, 150-2246; 6402, FOXP2, 32651, 135101, 153-2291; 6402, FOXP2, 32652, 135102, 102-365; 6402, FOXP2, 32631, 135081, 317-2464; 6402, FOXP2, 32632, 135082, 13-1311; 6402, FOXP2, 32633, 135083, 53-1150; 6402, FOXP2, 32635, 135085, 383-2254; 6402, FOXP2, 32637, 135087, 280-2427; 6402, FOXP2, 32640, 135090, 375-2573; 6402, FOXP2, 32641, 135091, 375-2597; 6402, FOXP2, 32643, 135093, 387-650; 6402, FOXP2, 32645, 135095, 487-750; 6403, FOXP3, 32653, 135103, 1-1326; 6403, FOXP3, 32656, 135106, 189-1553; 6403, FOXP3, 32654, 135104, 189-1379; 6403, FOXP3, 32655, 135105, 189-1484; 6403, FOXP3, 32657, 135107, 23-1213; 6403, FOXP3, 32658, 135108, 1-1371; 6404, FOXP4, 32663, 135113, 312-2318; 6404, FOXP4, 32664, 135114, 105-367; 6404, FOXP4, 32659, 135109, 13-2055; 6404, FOXP4, 32660, 135110, 237-2273; 6404, FOXP4, 32661, 135111, 459-2501; 6404, FOXP4, 32662, 135112, 459-2462; 6405, FOXQ1, 32665, 135115, 233-1444; 6406, FOXR1, 32667, 135117, 1-409; 6406, FOXR1, 32669, 135119, 226-1104; 6406, FOXR1, 32670, 135120, 1-409; 6406, FOXR1, 32671, 135121, 221-841; 6406, FOXR1, 32666, 135116, 226-1104; 6406, FOXR1, 32668, 135118, 221-841; 6407, FOXR2, 32672, 135122, 313-1248; 6408, FOXS1, 32673, 135123, 78-1070; 6409, FHAD1, 32674, 135124, 1-1944; 6409, FHAD1, 32676, 135126, 8-763; 6409, FHAD1, 32677, 135127, 26-976; 6409, FHAD1, 32679, 135129, 1-2081; 6409, FHAD1, 32680, 135130, 1-570; 6409, FHAD1, 32681, 135131, 1-1411; 6409, FHAD1, 32682, 135132, 1-2106; 6409, FHAD1, 32683, 135133, 19-378; 6409, FHAD1, 32675, 135125, 139-4377; 6409, FHAD1, 32678, 135128, 1-4239; 6410, FTCD, 32685, 135135, 45-1532; 6410, FTCD, 32688, 135138, 1-401; 6410, FTCD, 32689, 135139, 45-1304; 6410, FTCD, 32690, 135140, 45-1304; 6410, FTCD, 32691, 135141, 45-1304; 6410, FTCD, 32692, 135142, 45-1304; 6410, FTCD, 32684, 135134, 45-1670; 6410, FTCD, 32686, 135136, 45-1670; 6410, FTCD, 32687, 135137, 45-1763; 6411, FTCDNL1, 32693, 135143, 442-675; 6411, FTCDNL1, 32694, 135144, 123-467; 6411, FTCDNL1, 32695, 135145, 412-828; 6411, FTCDNL1, 32696, 135146, 389-832; 6412, FMN1, 32700, 135150, 1-343; 6412, FMN1, 32701, 135151, 1-545; 6412, FMN1, 32702, 135152, 127-4092; 6412, FMN1, 32703, 135153, 1-175; 6412, FMN1, 32697, 135147, 468-2456; 6412, FMN1, 32698, 135148, 1-3591; 6412, FMN1, 32699, 135149, 279-1790; 6412, FMN1, 32704, 135154, 1-4260; 6412, FMN1, 32705, 135155, 505-4764; 6413, FMN2, 32707, 135157, 304-602; 6413, FMN2, 32708, 135158, 221-906; 6413, FMN2, 32709, 135159, 288-884; 6413, FMN2, 32710, 135160, 2661-2789; 6413, FMN2, 32706, 135156, 231-5399; 6414, FNBP1, 32712, 135162, 220-1875; 6414, FNBP1, 32715, 135165, 1-1706; 6414, FNBP1, 32711, 135161, 193-1971; 6414, FNBP1, 32713, 135163, 220-2058; 6414, FNBP1, 32714, 135164, 188-2041; 6415, FNBP1L, 32719, 135169, 1-1355; 6415, FNBP1L, 32720, 135170, 1-1830; 6415, FNBP1L, 32716, 135166, 152-1807; 6415, FNBP1L, 32717, 135167, 152-1969; 6415, FNBP1L, 32718, 135168, 1-1644; 6416, FNBP4, 32722, 135172, 154-582; 6416, FNBP4, 32721, 135171, 14-3067; 6417, FHOD1, 32724, 135174, 69-542; 6417, FHOD1, 32725, 135175, 1-68; 6417, FHOD1, 32726, 135176, 1-327; 6417, FHOD1, 32727, 135177, 1-85; 6417, FHOD1, 32723, 135173, 249-3743; 6418, FHOD3, 32730, 135180, 1-1127; 6418, FHOD3, 32732, 135182, 603-2510; 6418, FHOD3, 32733, 135183, 1-1587; 6418, FHOD3, 32734, 135184, 1-3601; 6418, FHOD3, 32728, 135178, 123-4442; 6418, FHOD3, 32729, 135179, 1-4269; 6418, FHOD3, 32731, 135181, 1-4869; 6419, FMNL1, 32735, 135185, 49-1929; 6419, FMNL1, 32737, 135187, 1-1467; 6419, FMNL1, 32738, 135188, 91-2139; 6419, FMNL1, 32739, 135189, 1-384; 6419, FMNL1, 32740, 135190, 1-453; 6419, FMNL1, 32736, 135186, 337-3639; 6420, FMNL2, 32742, 135192, 201-1586; 6420, FMNL2, 32741, 135191, 368-3646; 6421, FMNL3, 32745, 135195, 41-3124; 6421, FMNL3, 32746, 135196, 382-547; 6421, FMNL3, 32743, 135193, 235-3318; 6421, FMNL3, 32744, 135194, 214-3144; 6422, FPR1, 32748, 135198, 469-587; 6422, FPR1, 32750, 135200, 168-742; 6422, FPR1, 32747, 135197, 108-1160; 6422, FPR1, 32749, 135199, 143-1195; 6423, FPR2, 32754, 135204, 167-576; 6423, FPR2, 32755, 135205, 721-985; 6423, FPR2, 32756, 135206, 170-543; 6423, FPR2, 32751, 135201, 395-1450; 6423, FPR2, 32752, 135202, 190-1245; 6423, FPR2, 32753, 135203, 773-1828; 6424, FPR3, 32757, 135207, 180-1241; 6424, FPR3, 32758, 135208, 163-1224; 6425, FYTTD1, 32760, 135210, 279-491; 6425, FYTTD1, 32763, 135213, 189-718; 6425, FYTTD1, 32765, 135215, 95-460; 6425, FYTTD1, 32766, 135216, 1-381; 6425, FYTTD1, 32759, 135209, 223-1179; 6425, FYTTD1, 32761, 135211, 239-1117; 6425, FYTTD1, 32762, 135212, 532-1287; 6425, FYTTD1, 32764, 135214, 35-424; 6426, FOSL1, 32769, 135219, 81-488; 6426, FOSL1, 32770, 135220, 547-584; 6426, FOSL1, 32771, 135221, 81-788; 6426, FOSL1, 32767, 135217, 188-1003; 6426, FOSL1, 32768, 135218, 81-590; 6427, FOSL2, 32774, 135224, 282-889; 6427, FOSL2, 32772, 135222, 864-1844; 6427, FOSL2, 32773, 135223, 9-965; 6428, FHL1, 32776, 135226, 246-1017; 6428, FHL1, 32777, 135227, 88-720; 6428, FHL1, 32782, 135232, 165-629; 6428, FHL1, 32783, 135233, 314-926; 6428, FHL1, 32784, 135234, 175-796; 6428, FHL1, 32785, 135235, 159-775; 6428, FHL1, 32786, 135236, 175-796; 6428, FHL1, 32787, 135237, 117-539; 6428, FHL1, 32793, 135243, 260-457; 6428, FHL1, 32794, 135244, 123-580; 6428, FHL1, 32796, 135246, 136-578; 6428, FHL1, 32798, 135248, 54-578; 6428, FHL1, 32799, 135249, 179-569; 6428, FHL1, 32800, 135250, 152-566; 6428, FHL1, 32801, 135251, 361-416; 6428, FHL1, 32802, 135252, 334-567; 6428, FHL1, 32775, 135225, 82-1053; 6428, FHL1, 32778, 135228, 341-1231; 6428, FHL1, 32779, 135229, 265-1107; 6428, FHL1, 32780, 135230, 198-1040; 6428, FHL1, 32781, 135231, 330-1301; 6428, FHL1, 32788, 135238, 47-976; 6428, FHL1, 32789, 135239, 712-1554; 6428, FHL1, 32790, 135240, 185-1027; 6428, FHL1, 32791, 135241, 194-778; 6428, FHL1, 32792, 135242, 261-1103; 6428, FHL1, 32795, 135245, 412-1254; 6428, FHL1, 32797, 135247, 133-975; 6429, FHL2, 32804, 135254, 129-1298; 6429, FHL2, 32810, 135260, 123-1310; 6429, FHL2, 32811, 135261, 516-574; 6429, FHL2, 32812, 135262, 76-240; 6429, FHL2, 32813, 135263, 129-563; 6429, FHL2, 32814, 135264, 140-337; 6429, FHL2, 32803, 135253, 168-1007; 6429, FHL2, 32805, 135255, 459-914; 6429, FHL2, 32806, 135256, 130-969; 6429, FHL2, 32807, 135257, 235-1074; 6429, FHL2, 32808, 135258, 106-945; 6429, FHL2, 32809, 135259, 336-1175; 6430, FHL3, 32815, 135265, 170-1012; 6431, FHL5, 32817, 135267, 150-779; 6431, FHL5, 32816, 135266, 381-1235; 6431, FHL5, 32818, 135268, 186-1040; 6432, FJX1, 32819, 135269, 219-1532; 6433, FOXL2NB, 32821, 135271, 132-257; 6433, FOXL2NB, 32820, 135270, 132-659; 6434, N/A, 32822, 135272, 333-830; 6435, FPGT-TNNI3K, 32823, 135273, 16-471; 6435, FPGT-TNNI3K, 32824, 135274, 36-2129; 6435, FPGT-TNNI3K, 32825, 135275, 38-2569; 6435, FPGT-TNNI3K, 32826, 135276, 31-517; 6435, FPGT-TNNI3K, 32827, 135277, 6-2855; 6436, FHIT, 32828, 135278, 1-174; 6436, FHIT, 32832, 135282, 366-601; 6436, FHIT, 32829, 135279, 372-815; 6436, FHIT, 32830, 135280, 326-769; 6436, FHIT, 32831, 135281, 363-806; 6437, FRA10AC1, 32833, 135283, 199-1146; 6438, FMR1, 32835, 135285, 129-1022; 6438, FMR1, 32837, 135287, 230-1843; 6438, FMR1, 32839, 135289, 218-1966; 6438, FMR1, 32840, 135290, 129-1907; 6438, FMR1, 32842, 135292, 186-1079; 6438, FMR1, 32843, 135293, 230-1864; 6438, FMR1, 32844, 135294, 1-307; 6438, FMR1, 32845, 135295, 225-455; 6438, FMR1, 32846, 135296, 1-360; 6438, FMR1, 32847, 135297, 63-1322; 6438, FMR1, 32848, 135298, 19-776; 6438, FMR1, 32849, 135299, 58-153; 6438, FMR1, 32834, 135284, 230-2065; 6438, FMR1, 32836, 135286, 1-1773; 6438, FMR1, 32838, 135288, 129-2027; 6438, FMR1, 32841, 135291, 230-1990; 6439, FMR1NB, 32851, 135301, 1-257; 6439, FMR1NB, 32850, 135300, 75-842; 6440, FXR1, 32855, 135305, 345-571; 6440, FXR1, 32856, 135306, 110-562; 6440, FXR1, 32857, 135307, 1-739; 6440, FXR1, 32858, 135308, 84-1910; 6440, FXR1, 32859, 135309, 291-572; 6440, FXR1, 32860, 135310, 149-208; 6440, FXR1, 32861, 135311, 213-570; 6440, FXR1, 32862, 135312, 454-824; 6440, FXR1, 32863, 135313, 218-1582; 6440, FXR1, 32864, 135314, 16-1488; 6440, FXR1, 32852, 135302, 804-2414; 6440, FXR1, 32853, 135303, 385-2250; 6440, FXR1, 32854, 135304, 15-1634; 6441, FXR2, 32866, 135316, 211-565; 6441, FXR2, 32865, 135315, 336-2357; 6442, FREM1, 32867, 135317, 817-4824; 6442, FREM1, 32868, 135318, 785-7324; 6442, FREM1, 32869, 135319, 90-2237; 6442, FREM1, 32870, 135320, 2-670; 6442, FREM1, 32871, 135321, 817-7356; 6443, FREM3, 32872, 135322, 1-6420; 6444, FREM2, 32873, 135323, 217-9726; 6445, FRAS1, 32874, 135324, 31-984; 6445, FRAS1, 32876, 135326, 1-1279; 6445, FRAS1, 32878, 135328, 1-2000; 6445, FRAS1, 32879, 135329, 1-1957; 6445, FRAS1, 32880, 135330, 407-526; 6445, FRAS1, 32875, 135325, 441-6371; 6445, FRAS1, 32877, 135327, 441-12479; 6446, FXN, 32884, 135334, 106-513; 6446, FXN, 32885, 135335, 1-325; 6446, FXN, 32881, 135331, 525-1157; 6446, FXN, 32882, 135332, 221-736; 6446, FXN, 32883, 135333, 22-612; 6447, FFAR1, 32886, 135336, 1-903; 6448, FFAR2, 32887, 135337, 1-993; 6448, FFAR2, 32888, 135338, 81-1073; 6449, FFAR3, 32889, 135339, 202-1242; 6449, FFAR3, 32890, 135340, 71-1111; 6450, FFAR4, 32893, 135343, 40-750; 6450, FFAR4, 32891, 135341, 57-1142; 6450, FFAR4, 32892, 135342, 57-1190; 6451, FRAT1, 32894, 135344, 188-1027; 6452, FRAT2, 32895, 135345, 138-839; 6453, FZD1, 32896, 135346, 518-2461; 6454, FZD10, 32898, 135348, 583-1947; 6454, FZD10, 32897, 135347, 485-2230; 6455, FZD2, 32899, 135349, 231-1928; 6456, FZD3, 32901, 135351, 475-580; 6456, FZD3, 32900, 135350, 479-2479; 6456, FZD3, 32902, 135352, 484-2484; 6457, FZD4, 32903, 135353, 307-1920; 6458, FZD5, 32904, 135354, 555-2312; 6459, FZD6, 32906, 135356, 273-455; 6459, FZD6, 32907, 135357, 155-349; 6459, FZD6, 32908, 135358, 265-567; 6459, FZD6, 32909, 135359, 318-1721; 6459, FZD6, 32905, 135355, 318-2438; 6459, FZD6, 32910, 135360, 291-2411; 6459, FZD6, 32911, 135361, 265-2289; 6460, FZD7, 32912, 135362, 62-1786; 6461, FZD8, 32913, 135363, 850-2934; 6462, FZD9, 32914, 135364, 226-2001; 6463, FRZB, 32915, 135365, 611-1588; 6464, FN3K, 32916, 135366, 63-992; 6465, FN3KRP, 32918, 135368, 8-445; 6465, FN3KRP, 32919, 135369, 133-515; 6465, FN3KRP, 32920, 135370, 1-153; 6465, FN3KRP, 32921, 135371, 254-627; 6465, FN3KRP, 32922, 135372, 1-308; 6465, FN3KRP, 32923, 135373, 35-205; 6465, FN3KRP, 32917, 135367, 74-1003; 6466, FBP1, 32926, 135376, 177-629; 6466, FBP1, 32924, 135374, 198-1214; 6466, FBP1, 32925, 135375, 231-1247; 6467, FBP2, 32927, 135377, 68-1087; 6468, FRYL, 32929, 135379, 555-5216; 6468, FRYL, 32931, 135381, 47-618; 6468, FRYL, 32932, 135382, 1-4364; 6468, FRYL, 32933, 135383, 155-1570; 6468, FRYL, 32928, 135378, 606-9647; 6468, FRYL, 32930, 135380, 3941-5152; 6468, FRYL, 32934, 135384, 1-9042; 6469, FRG1, 32936, 135386, 448-755; 6469, FRG1, 32937, 135387, 391-738; 6469, FRG1, 32938, 135388, 112-240; 6469, FRG1, 32939, 135389, 1-255; 6469, FRG1, 32941, 135391, 448-755; 6469, FRG1, 32942, 135392, 112-240; 6469, FRG1, 32943, 135393, 391-738; 6469, FRG1, 32944, 135394, 1-255; 6469, FRG1, 32935, 135385, 223-999; 6469, FRG1, 32940, 135390, 223-999; 6470, FRG2, 32945, 135395, 54-890; 6470, FRG2, 32946, 135396, 51-890; 6470, FRG2, 32947, 135397, 54-890; 6470, FRG2, 32948, 135398, 51-890; 6471, FRG2B, 32950, 135400, 51-890; 6471, FRG2B, 32949, 135399, 54-890; 6472, FRG2C, 32952, 135402, 51-896; 6472, FRG2C, 32951, 135401, 51-899; 6473, FTSJ3, 32954, 135404, 1-90; 6473, FTSJ3, 32955, 135405, 163-615; 6473, FTSJ3, 32956, 135406, 9-212; 6473, FTSJ3, 32957, 135407, 478-535; 6473, FTSJ3, 32958, 135408, 29-151; 6473, FTSJ3, 32959, 135409, 443-543; 6473, FTSJ3, 32960, 135410, 248-592; 6473, FTSJ3, 32953, 135403, 647-3190; 6474, FTSJ1, 32963, 135413, 453-1031; 6474, FTSJ1, 32961, 135411, 430-1413; 6474, FTSJ1, 32962, 135412, 324-1313; 6475, FTSJ2, 32965, 135415, 49-507; 6475, FTSJ2, 32964, 135414, 30-770; 6475, FTSJ2, 32966, 135416, 1-741; 6476, FUK, 32969, 135419, 179-538; 6476, FUK, 32970, 135420, 102-539; 6476, FUK, 32971, 135421, 122-590; 6476, FUK, 32972, 135422, 237-564; 6476, FUK, 32973, 135423, 734-2461; 6476, FUK, 32974, 135424, 1-612; 6476, FUK, 32967, 135417, 233-3487; 6476, FUK, 32968, 135418, 59-3331; 6477, FUOM, 32976, 135426, 132-461; 6477, FUOM, 32978, 135428, 1-384; 6477, FUOM, 32975, 135425, 29-493; 6477, FUOM, 32977, 135427, 19-423; 6478, FPGT, 32980, 135430, 29-1852; 6478, FPGT, 32981, 135431, 36-341; 6478, FPGT, 32983, 135433, 38-451; 6478, FPGT, 32984, 135434, 1-524; 6478, FPGT, 32985, 135435, 3-389; 6478, FPGT, 32979, 135429, 39-548; 6478, FPGT, 32982, 135432, 13-1035; 6479, FUCA1, 32986, 135436, 9-1409; 6480, FUCA2, 32988, 135438, 1-330; 6480, FUCA2, 32987, 135437, 57-1460; 6481, FUT1, 32989, 135439, 976-2073; 6482, FUT10, 32990, 135440, 633-2072; 6482, FUT10, 32991, 135441, 374-1729; 6482, FUT10, 32992, 135442, 244-1599; 6483, FUT11, 32993, 135443, 44-1522; 6483, FUT11, 32994, 135444, 44-1474; 6484, FUT2, 32997, 135447, 112-771; 6484, FUT2, 32995, 135445, 44-1075; 6484, FUT2, 32996, 135446, 118-1149; 6485, FUT3, 33001, 135451, 247-567; 6485, FUT3, 33002, 135452, 622-754; 6485, FUT3, 33004, 135454, 278-577; 6485, FUT3, 33005, 135455, 586-599; 6485, FUT3, 32998, 135448, 636-1721; 6485, FUT3, 32999, 135449, 73-1158; 6485, FUT3, 33000, 135450, 291-1376; 6485, FUT3, 33003, 135453, 234-1319; 6486, FUT4, 33006, 135456, 295-1887; 6487, FUT5, 33008, 135458, 89-1213; 6487, FUT5, 33007, 135457, 17-1141; 6488, FUT6, 33012, 135462, 397-530; 6488, FUT6, 33013, 135463, 476-682; 6488, FUT6, 33015, 135465, 437-527; 6488, FUT6, 33016, 135466, 365-564; 6488, FUT6, 33017, 135467, 290-700; 6488, FUT6, 33009, 135459, 1054-2133; 6488, FUT6, 33010, 135460, 1196-2275; 6488, FUT6, 33011, 135461, 641-1720; 6488, FUT6, 33014, 135464, 270-1349; 6488, FUT6, 33018, 135468, 1-1095; 6489, FUT7, 33019, 135469, 1020-2048; 6490, FUT8, 33021, 135471, 592-1932; 6490, FUT8, 33024, 135474, 681-727; 6490, FUT8, 33025, 135475, 462-583; 6490, FUT8, 33026, 135476, 600-751; 6490, FUT8, 33027, 135477, 494-632; 6490, FUT8, 33028, 135478, 421-554; 6490, FUT8, 33030, 135480, 551-639; 6490, FUT8, 33020, 135470, 455-1381; 6490, FUT8, 33022, 135472, 1728-3455; 6490, FUT8, 33023, 135473, 1100-2827; 6490, FUT8, 33029, 135479, 505-1743; 6491, FUT9, 33031, 135481, 327-1406; 6492, FKTN, 33034, 135484, 81-786; 6492, FKTN, 33036, 135486, 1-482; 6492, FKTN, 33037, 135487, 33-236; 6492, FKTN, 33032, 135482, 125-1510; 6492, FKTN, 33033, 135483, 117-1409; 6492, FKTN, 33035, 135485, 215-1507; 6492, FKTN, 33038, 135488, 217-1602; 6493, FKRP, 33041, 135491, 242-559; 6493, FKRP, 33042, 135492, 365-569; 6493, FKRP, 33043, 135493, 336-551; 6493, FKRP, 33044, 135494, 358-597; 6493, FKRP, 33045, 135495, 147-633; 6493, FKRP, 33046, 135496, 335-593; 6493, FKRP, 33047, 135497, 207-548; 6493, FKRP, 33048, 135498, 167-577; 6493, FKRP, 33049, 135499, 400-583; 6493, FKRP, 33050, 135500, 506-592; 6493, FKRP, 33051, 135501, 289-591; 6493, FKRP, 33052, 135502, 347-556; 6493, FKRP, 33053, 135503, 441-545; 6493, FKRP, 33054, 135504, 406-584; 6493, FKRP, 33055, 135505, 410-569; 6493, FKRP, 33056, 135506, 621-633; 6493, FKRP, 33057, 135507, 196-482; 6493, FKRP, 33039, 135489, 298-1785; 6493, FKRP, 33040, 135490, 339-1826; 6494, FH, 33058, 135508, 40-1572; 6495, FAH, 33061, 135511, 86-568; 6495, FAH, 33064, 135514, 1-181; 6495, FAH, 33059, 135509, 78-1337; 6495, FAH, 33060, 135510, 156-1415; 6495, FAH, 33062, 135512, 159-1418; 6495, FAH, 33063, 135513, 2239-3288; 6496, FAHD1, 33065, 135515, 264-1010; 6496, FAHD1, 33066, 135516, 264-944; 6496, FAHD1, 33067, 135517, 290-964; 6496, FAHD1, 33068, 135518, 11-757; 6497, FAHD2A, 33070, 135520, 335-715; 6497, FAHD2A, 33071, 135521, 279-522; 6497, FAHD2A, 33069, 135519, 154-1098; 6497, FAHD2A, 33072, 135522, 283-1227; 6498, FAHD2B, 33073, 135523, 189-1133; 6498, FAHD2B, 33074, 135524, 272-1216; 6499, FUNDC1, 33075, 135525, 170-637; 6500, FUNDC2, 33077, 135527, 1-285; 6500, FUNDC2, 33076, 135526, 255-824; 6501, FURIN, 33079, 135529, 381-587; 6501, FURIN, 33080, 135530, 54-580; 6501, FURIN, 33081, 135531, 1-651; 6501, FURIN, 33078, 135528, 280-2664; 6501, FURIN, 33082, 135532, 381-2765; 6501, FURIN, 33083, 135533, 227-2611; 6502, FRY, 33084, 135534, 20-607; 6502, FRY, 33085, 135535, 497-9535; 6502, FRY, 33086, 135536, 240-691; 6502, FRY, 33087, 135537, 1-399; 6502, FRY, 33088, 135538, 497-9538; 6503, FUS, 33091, 135541, 78-869; 6503, FUS, 33092, 135542, 65-1648; 6503, FUS, 33089, 135539, 106-1686; 6503, FUS, 33090, 135540, 77-1654; 6504, FUZ, 33094, 135544, 168-404; 6504, FUZ, 33095, 135545, 157-417; 6504, FUZ, 33096, 135546, 51-311; 6504, FUZ, 33097, 135547, 157-1263; 6504, FUZ, 33098, 135548, 1-170; 6504, FUZ, 33099, 135549, 73-333; 6504, FUZ, 33100, 135550, 85-345; 6504, FUZ, 33102, 135552, 194-481; 6504, FUZ, 33103, 135553, 179-415; 6504, FUZ, 33104, 135554, 181-318; 6504, FUZ, 33105, 135555, 143-280; 6504, FUZ, 33106, 135556, 399-572; 6504, FUZ, 33093, 135543, 165-1421; 6504, FUZ, 33101, 135551, 70-1218; 6505, FXYD1, 33112, 135562, 1-347; 6505, FXYD1, 33107, 135557, 92-370; 6505, FXYD1, 33108, 135558, 153-431; 6505, FXYD1, 33109, 135559, 47-325; 6505, FXYD1, 33110, 135560, 120-398; 6505, FXYD1, 33111, 135561, 59-337; 6505, FXYD1, 33113, 135563, 192-470; 6505, FXYD1, 33114, 135564, 245-523; 6506, FXYD2, 33115, 135565, 80-274; 6506, FXYD2, 33116, 135566, 67-267; 6506, FXYD2, 33117, 135567, 169-363; 6506, FXYD2, 33118, 135568, 56-250; 6507, FXYD3, 33124, 135574, 197-547; 6507, FXYD3, 33126, 135576, 56-268; 6507, FXYD3, 33131, 135581, 56-406; 6507, FXYD3, 33119, 135569, 113-454; 6507, FXYD3, 33120, 135570, 197-538; 6507, FXYD3, 33121, 135571, 260-601; 6507, FXYD3, 33122, 135572, 148-582; 6507, FXYD3, 33123, 135573, 57-242; 6507, FXYD3, 33125, 135575, 192-455; 6507, FXYD3, 33127, 135577, 85-348; 6507, FXYD3, 33128, 135578, 15-305; 6507, FXYD3, 33129, 135579, 295-558; 6507, FXYD3, 33130, 135580, 139-324; 6508, FXYD4, 33132, 135582, 335-604; 6508, FXYD4, 33133, 135583, 340-609; 6509, FXYD5, 33136, 135586, 81-371; 6509, FXYD5, 33140, 135590, 81-665; 6509, FXYD5, 33141, 135591, 64-435; 6509, FXYD5, 33143, 135593, 24-608; 6509, FXYD5, 33144, 135594, 44-247; 6509, FXYD5, 33134, 135584, 779-1315; 6509, FXYD5, 33135, 135585, 43-366; 6509, FXYD5, 33137, 135587, 68-604; 6509, FXYD5, 33138, 135588, 92-628; 6509, FXYD5, 33139, 135589, 118-654; 6509, FXYD5, 33142, 135592, 76-612; 6510, FXYD6, 33148, 135598, 138-410; 6510, FXYD6, 33150, 135600, 134-469; 6510, FXYD6, 33153, 135603, 79-351; 6510, FXYD6, 33154, 135604, 137-409; 6510, FXYD6, 33145, 135595, 321-608; 6510, FXYD6, 33146, 135596, 298-585; 6510, FXYD6, 33147, 135597, 194-481; 6510, FXYD6, 33149, 135599, 597-884; 6510, FXYD6, 33151, 135601, 522-809; 6510, FXYD6, 33152, 135602, 201-488; 6511, FXYD7, 33156, 135606, 56-409; 6511, FXYD7, 33157, 135607, 85-318; 6511, FXYD7, 33155, 135605, 85-327; 6512, FXYD6-FXYD2, 33158, 135608, 82-420; 6512, FXYD6-FXYD2, 33159, 135609, 43-477; 6513, FYB, 33161, 135611, 590-594; 6513, FYB, 33162, 135612, 502-688; 6513, FYB, 33163, 135613, 523-589; 6513, FYB, 33164, 135614, 240-583; 6513, FYB, 33167, 135617, 154-676; 6513, FYB, 33160, 135610, 192-2543; 6513, FYB, 33165, 135615, 87-2606; 6513, FYB, 33166, 135616, 68-2419; 6513, FYB, 33168, 135618, 159-2648; 6514, FYN, 33174, 135624, 293-989; 6514, FYN, 33175, 135625, 301-609; 6514, FYN, 33176, 135626, 250-597; 6514, FYN, 33177, 135627, 107-541; 6514, FYN, 33178, 135628, 554-1012; 6514, FYN, 33179, 135629, 393-712; 6514, FYN, 33180, 135630, 306-864; 6514, FYN, 33181, 135631, 616-825; 6514, FYN, 33182, 135632, 218-571; 6514, FYN, 33183, 135633, 85-610; 6514, FYN, 33184, 135634, 151-569; 6514, FYN, 33185, 135635, 555-1012; 6514, FYN, 33186, 135636, 325-518; 6514, FYN, 33169, 135619, 104-1552; 6514, FYN, 33170, 135620, 608-2221; 6514, FYN, 33171, 135621, 346-1959; 6514, FYN, 33172, 135622, 516-2120; 6514, FYN, 33173, 135623, 223-1827; 6514, FYN, 33187, 135637, 12-1616; 6515, FRK, 33188, 135638, 448-1965; 6516, FYCO1, 33190, 135640, 1-803; 6516, FYCO1, 33191, 135641, 443-892; 6516, FYCO1, 33189, 135639, 207-4643; 6516, FYCO1, 33192, 135642, 216-4712; 6517, FGD1, 33193, 135643, 735-3620; 6518, FGD2, 33195, 135645, 164-472; 6518, FGD2, 33196, 135646, 164-478; 6518, FGD2, 33194, 135644, 172-2139; 6519, FGD3, 33197, 135647, 483-2660; 6519, FGD3, 33198, 135648, 497-2674; 6519, FGD3, 33199, 135649, 611-2785; 6519, FGD3, 33200, 135650, 206-2110; 6520, FGD4, 33201, 135651, 415-1122; 6520, FGD4, 33203, 135653, 163-2718; 6520, FGD4, 33204, 135654, 85-2721; 6520, FGD4, 33205, 135655, 1-197; 6520, FGD4, 33206, 135656, 542-1165; 6520, FGD4, 33207, 135657, 451-1158; 6520, FGD4, 33208, 135658, 496-2517; 6520, FGD4, 33209, 135659, 266-2977; 6520, FGD4, 33210, 135660, 428-550; 6520, FGD4, 33211, 135661, 490-580; 6520, FGD4, 33202, 135652, 425-2725; 6521, FGD5, 33213, 135663, 1-755; 6521, FGD5, 33214, 135664, 834-4370; 6521, FGD5, 33212, 135662, 111-4499; 6522, FGD6, 33216, 135666, 243-422; 6522, FGD6, 33217, 135667, 1-401; 6522, FGD6, 33218, 135668, 140-3757; 6522, FGD6, 33219, 135669, 67-904; 6522, FGD6, 33215, 135665, 225-4517; 6522, FGD6, 33220, 135670, 225-4349; 6523, GAGE1, 33222, 135672, 112-531; 6523, GAGE1, 33221, 135671, 75-428; 6523, GAGE1, 33223, 135673, 117-470; 6523, GAGE1, 33224, 135674, 1-354; 6524, GAGE10, 33225, 135675, 94-444; 6525, GAGE12B, 33226, 135676, 1-23; 6526, GAGE12C, 33227, 135677, 83-436; 6527, GAGE12D, 33228, 135678, 83-436; 6528, GAGE12E, 33229, 135679, 73-426; 6529, GAGE12F, 33230, 135680, 83-436; 6530, GAGE12G, 33231, 135681, 83-436; 6531, GAGE12H, 33232, 135682, 83-436; 6532, GAGE12J, 33233, 135683, 97-450; 6533, GAGE13, 33234, 135684, 83-436; 6534, GAGE2A, 33235, 135685, 84-434;

6535, GAGE2E, 33236, 135686, 73-403; 6536, GFM1, 33238, 135688, 108-1469; 6536, GFM1, 33239, 135689, 322-502; 6536, GFM1, 33240, 135690, 108-1883; 6536, GFM1, 33242, 135692, 1-52; 6536, GFM1, 33237, 135687, 39-2351; 6536, GFM1, 33241, 135691, 358-2613; 6537, GFM2, 33246, 135696, 149-1004; 6537, GFM2, 33247, 135697, 373-566; 6537, GFM2, 33243, 135693, 209-2407; 6537, GFM2, 33244, 135694, 459-2798; 6537, GFM2, 33245, 135695, 234-1775; 6537, GFM2, 33248, 135698, 311-2650; 6538, GKAP1, 33251, 135701, 526-906; 6538, GKAP1, 33252, 135702, 241-403; 6538, GKAP1, 33249, 135699, 292-1239; 6538, GKAP1, 33250, 135700, 402-1502; 6539, GPANK1, 33264, 135714, 391-986; 6539, GPANK1, 33265, 135715, 687-1757; 6539, GPANK1, 33266, 135716, 650-1720; 6539, GPANK1, 33268, 135718, 338-1408; 6539, GPANK1, 33270, 135720, 367-822; 6539, GPANK1, 33272, 135722, 359-627; 6539, GPANK1, 33273, 135723, 431-751; 6539, GPANK1, 33274, 135724, 431-751; 6539, GPANK1, 33275, 135725, 367-822; 6539, GPANK1, 33276, 135726, 431-751; 6539, GPANK1, 33278, 135728, 309-802; 6539, GPANK1, 33279, 135729, 359-627; 6539, GPANK1, 33280, 135730, 359-627; 6539, GPANK1, 33283, 135733, 431-751; 6539, GPANK1, 33284, 135734, 359-627; 6539, GPANK1, 33285, 135735, 391-986; 6539, GPANK1, 33288, 135738, 309-802; 6539, GPANK1, 33290, 135740, 309-802; 6539, GPANK1, 33291, 135741, 431-751; 6539, GPANK1, 33293, 135743, 367-822; 6539, GPANK1, 33294, 135744, 359-627; 6539, GPANK1, 33295, 135745, 309-802; 6539, GPANK1, 33297, 135747, 431-751; 6539, GPANK1, 33299, 135749, 359-627; 6539, GPANK1, 33300, 135750, 309-802; 6539, GPANK1, 33302, 135752, 309-802; 6539, GPANK1, 33303, 135753, 367-822; 6539, GPANK1, 33304, 135754, 540-1610; 6539, GPANK1, 33308, 135758, 391-986; 6539, GPANK1, 33310, 135760, 391-986; 6539, GPANK1, 33311, 135761, 367-822; 6539, GPANK1, 33313, 135763, 391-986; 6539, GPANK1, 33314, 135764, 359-627; 6539, GPANK1, 33315, 135765, 367-822; 6539, GPANK1, 33316, 135766, 554-1624; 6539, GPANK1, 33318, 135768, 309-802; 6539, GPANK1, 33319, 135769, 367-822; 6539, GPANK1, 33320, 135770, 391-986; 6539, GPANK1, 33253, 135703, 686-1756; 6539, GPANK1, 33254, 135704, 338-1408; 6539, GPANK1, 33255, 135705, 540-1610; 6539, GPANK1, 33256, 135706, 650-1720; 6539, GPANK1, 33257, 135707, 554-1624; 6539, GPANK1, 33258, 135708, 686-1756; 6539, GPANK1, 33259, 135709, 338-1408; 6539, GPANK1, 33260, 135710, 554-1624; 6539, GPANK1, 33261, 135711, 650-1720; 6539, GPANK1, 33262, 135712, 540-1610; 6539, GPANK1, 33263, 135713, 686-1756; 6539, GPANK1, 33267, 135717, 554-1624; 6539, GPANK1, 33269, 135719, 338-1408; 6539, GPANK1, 33271, 135721, 338-1408; 6539, GPANK1, 33277, 135727, 650-1720; 6539, GPANK1, 33281, 135731, 650-1720; 6539, GPANK1, 33282, 135732, 540-1610; 6539, GPANK1, 33286, 135736, 686-1756; 6539, GPANK1, 33287, 135737, 540-1610; 6539, GPANK1, 33289, 135739, 686-1756; 6539, GPANK1, 33292, 135742, 650-1720; 6539, GPANK1, 33296, 135746, 540-1610; 6539, GPANK1, 33298, 135748, 554-1624; 6539, GPANK1, 33301, 135751, 540-1610; 6539, GPANK1, 33305, 135755, 554-1624; 6539, GPANK1, 33306, 135756, 686-1756; 6539, GPANK1, 33307, 135757, 650-1720; 6539, GPANK1, 33309, 135759, 338-1408; 6539, GPANK1, 33312, 135762, 338-1408; 6539, GPANK1, 33317, 135767, 554-1624; 6540, GPKOW, 33321, 135771, 80-1510; 6541, GPATCH1, 33323, 135773, 296-682; 6541, GPATCH1, 33322, 135772, 315-3110; 6542, GPATCH11, 33325, 135775, 68-925; 6542, GPATCH11, 33324, 135774, 119-589; 6543, GPATCH2, 33326, 135776, 112-1242; 6543, GPATCH2, 33327, 135777, 112-1698; 6544, GPATCH2L, 33330, 135780, 159-344; 6544, GPATCH2L, 33331, 135781, 84-575; 6544, GPATCH2L, 33333, 135783, 657-821; 6544, GPATCH2L, 33335, 135785, 1-94; 6544, GPATCH2L, 33336, 135786, 14-316; 6544, GPATCH2L, 33337, 135787, 87-1184; 6544, GPATCH2L, 33338, 135788, 129-446; 6544, GPATCH2L, 33328, 135778, 67-1515; 6544, GPATCH2L, 33329, 135779, 68-1501; 6544, GPATCH2L, 33332, 135782, 719-1774; 6544, GPATCH2L, 33334, 135784, 65-1120; 6544, GPATCH2L, 33339, 135789, 11-1444; 6545, GPATCH3, 33341, 135791, 1-230; 6545, GPATCH3, 33342, 135792, 137-521; 6545, GPATCH3, 33340, 135790, 25-1602; 6546, GPATCH4, 33343, 135793, 134-1246; 6546, GPATCH4, 33344, 135794, 32-1159; 6546, GPATCH4, 33345, 135795, 141-934; 6546, GPATCH4, 33346, 135796, 113-472; 6546, GPATCH4, 33347, 135797, 121-552; 6547, GPATCH8, 33348, 135798, 34-174; 6547, GPATCH8, 33349, 135799, 22-686; 6547, GPATCH8, 33350, 135800, 20-160; 6547, GPATCH8, 33353, 135803, 34-174; 6547, GPATCH8, 33351, 135801, 32-4540; 6547, GPATCH8, 33352, 135802, 35-166; 6548, GPS1, 33355, 135805, 191-1606; 6548, GPS1, 33357, 135807, 36-594; 6548, GPS1, 33358, 135808, 36-795; 6548, GPS1, 33359, 135809, 6-140; 6548, GPS1, 33361, 135811, 4-138; 6548, GPS1, 33362, 135812, 366-997; 6548, GPS1, 33363, 135813, 25-306; 6548, GPS1, 33364, 135814, 162-580; 6548, GPS1, 33365, 135815, 77-581; 6548, GPS1, 33366, 135816, 75-574; 6548, GPS1, 33367, 135817, 64-567; 6548, GPS1, 33368, 135818, 31-213; 6548, GPS1, 33369, 135819, 1-240; 6548, GPS1, 33370, 135820, 32-166; 6548, GPS1, 33371, 135821, 166-470; 6548, GPS1, 33372, 135822, 160-561; 6548, GPS1, 33373, 135823, 66-1646; 6548, GPS1, 33374, 135824, 36-1496; 6548, GPS1, 33375, 135825, 40-1512; 6548, GPS1, 33354, 135804, 24-1499; 6548, GPS1, 33356, 135806, 350-1933; 6548, GPS1, 33360, 135810, 68-1531; 6549, GPS2, 33378, 135828, 1-477; 6549, GPS2, 33379, 135829, 1-221; 6549, GPS2, 33380, 135830, 1-983; 6549, GPS2, 33381, 135831, 139-916; 6549, GPS2, 33376, 135826, 302-1285; 6549, GPS2, 33377, 135827, 292-1275; 6550, GPRIN1, 33382, 135832, 179-3205; 6551, GPRIN2, 33383, 135833, 9-1385; 6551, GPRIN2, 33384, 135834, 274-1650; 6552, GPBAR1, 33385, 135835, 342-1334; 6552, GPBAR1, 33386, 135836, 248-1240; 6552, GPBAR1, 33387, 135837, 735-1727; 6552, GPBAR1, 33388, 135838, 869-1861; 6553, GPER1, 33393, 135843, 885-1105; 6553, GPER1, 33394, 135844, 102-1328; 6553, GPER1, 33395, 135845, 1-531; 6553, GPER1, 33389, 135839, 692-1819; 6553, GPER1, 33390, 135840, 558-1685; 6553, GPER1, 33391, 135841, 885-2012; 6553, GPER1, 33392, 135842, 390-1517; 6554, GPR1, 33397, 135847, 222-756; 6554, GPR1, 33399, 135849, 383-603; 6554, GPR1, 33400, 135850, 345-592; 6554, GPR1, 33401, 135851, 161-572; 6554, GPR1, 33402, 135852, 149-830; 6554, GPR1, 33403, 135853, 491-547; 6554, GPR1, 33396, 135846, 364-1431; 6554, GPR1, 33398, 135848, 490-1557; 6554, GPR1, 33404, 135854, 638-1705; 6554, GPR1, 33405, 135855, 229-1296; 6555, GPR101, 33406, 135856, 1-1527; 6556, GPR107, 33409, 135859, 228-1943; 6556, GPR107, 33410, 135860, 13-399; 6556, GPR107, 33407, 135857, 508-2166; 6556, GPR107, 33408, 135858, 508-2310; 6556, GPR107, 33411, 135861, 9-1811; 6557, GPR108, 33413, 135863, 878-1783; 6557, GPR108, 33414, 135864, 1-670; 6557, GPR108, 33415, 135865, 657-765; 6557, GPR108, 33416, 135866, 1-534; 6557, GPR108, 33417, 135867, 1-311;

6557, GPR108, 33418, 135868, 1-995; 6557, GPR108, 33419, 135869, 1-437; 6557, GPR108, 33420, 135870, 1-504; 6557, GPR108, 33421, 135871, 1-581; 6557, GPR108, 33412, 135862, 28-1659; 6558, GPR119, 33422, 135872, 1-1008; 6559, GPR12, 33423, 135873, 464-1468; 6559, GPR12, 33424, 135874, 223-1227; 6560, GPR132, 33428, 135878, 372-578; 6560, GPR132, 33429, 135879, 1063-1092; 6560, GPR132, 33425, 135875, 913-2055; 6560, GPR132, 33426, 135876, 175-1290; 6560, GPR132, 33427, 135877, 1003-2145; 6561, GPR135, 33430, 135880, 117-1601; 6561, GPR135, 33431, 135881, 116-1600; 6562, GPR137, 33436, 135886, 143-562; 6562, GPR137, 33437, 135887, 340-998; 6562, GPR137, 33438, 135888, 706-800; 6562, GPR137, 33439, 135889, 86-805; 6562, GPR137, 33440, 135890, 14-431; 6562, GPR137, 33441, 135891, 162-350; 6562, GPR137, 33443, 135893, 5-473; 6562, GPR137, 33444, 135894, 1-266; 6562, GPR137, 33445, 135895, 60-560; 6562, GPR137, 33446, 135896, 598-1274; 6562, GPR137, 33447, 135897, 147-542; 6562, GPR137, 33448, 135898, 292-527; 6562, GPR137, 33449, 135899, 416-1051; 6562, GPR137, 33432, 135882, 106-1359; 6562, GPR137, 33433, 135883, 140-1180; 6562, GPR137, 33434, 135884, 29-1456; 6562, GPR137, 33435, 135885, 108-1298; 6562, GPR137, 33442, 135892, 468-1430; 6563, GPR137B, 33451, 135901, 1-692; 6563, GPR137B, 33452, 135902, 119-661; 6563, GPR137B, 33450, 135900, 92-1291; 6564, GPR137C, 33454, 135904, 1-1198; 6564, GPR137C, 33455, 135905, 1-613; 6564, GPR137C, 33453, 135903, 1-1290; 6565, GPR139, 33456, 135906, 152-304; 6565, GPR139, 33457, 135907, 302-1363; 6566, GPR141, 33460, 135910, 366-677; 6566, GPR141, 33458, 135908, 1-918; 6566, GPR141, 33459, 135909, 290-1207; 6567, GPR142, 33462, 135912, 49-444; 6567, GPR142, 33463, 135913, 100-405; 6567, GPR142, 33461, 135911, 49-1437; 6568, GPR143, 33464, 135914, 59-859; 6568, GPR143, 33465, 135915, 73-587; 6568, GPR143, 33466, 135916, 148-1362; 6569, GPR146, 33469, 135919, 198-313; 6569, GPR146, 33470, 135920, 108-1053; 6569, GPR146, 33467, 135917, 12-1013; 6569, GPR146, 33468, 135918, 224-1225; 6570, GPR148, 33471, 135921, 83-1126; 6571, GPR149, 33472, 135922, 101-2296; 6572, GPR15, 33473, 135923, 136-1218; 6573, GPR150, 33474, 135924, 199-1503; 6574, GPR151, 33475, 135925, 78-1337; 6575, GPR152, 33476, 135926, 6-1418; 6576, GPR153, 33477, 135927, 261-2090; 6577, GPR155, 33481, 135931, 248-2776; 6577, GPR155, 33478, 135928, 346-2958; 6577, GPR155, 33479, 135929, 300-2912; 6577, GPR155, 33480, 135930, 240-2852; 6578, GPR156, 33483, 135933, 23-259; 6578, GPR156, 33482, 135932, 198-2642; 6578, GPR156, 33484, 135934, 447-2891; 6578, GPR156, 33485, 135935, 19-2451; 6579, GPR157, 33487, 135937, 1-198; 6579, GPR157, 33486, 135936, 144-1151; 6580, GPR158, 33488, 135938, 360-4007; 6581, GPR160, 33490, 135940, 1201-1299; 6581, GPR160, 33491, 135941, 476-740; 6581, GPR160, 33492, 135942, 243-731; 6581, GPR160, 33493, 135943, 353-783; 6581, GPR160, 33489, 135939, 609-1625; 6582, GPR161, 33494, 135944, 178-1818; 6582, GPR161, 33495, 135945, 558-2147; 6582, GPR161, 33496, 135946, 528-1721; 6582, GPR161, 33497, 135947, 315-1904; 6582, GPR161, 33498, 135948, 312-1667; 6582, GPR161, 33499, 135949, 619-2268; 6582, GPR161, 33500, 135950, 153-1400; 6583, GPR162, 33502, 135952, 79-933; 6583, GPR162, 33504, 135954, 1-683; 6583, GPR162, 33501, 135951, 788-2554; 6583, GPR162, 33503, 135953, 479-1393; 6584, GPR17, 33507, 135957, 172-581; 6584, GPR17, 33505, 135955, 75-1178; 6584, GPR17, 33506, 135956, 74-1177; 6584, GPR17, 33508, 135958, 612-1715; 6585, GPR171, 33510, 135960, 152-205; 6585, GPR171, 33509, 135959, 232-1191; 6585, GPR171, 33511, 135961, 1-960; 6586, GPR173, 33513, 135963, 423-579; 6586, GPR173, 33512, 135962, 492-1613; 6587, GPR174, 33514, 135964, 37-1038; 6588, GPR176, 33515, 135965, 200-1744; 6588, GPR176, 33516, 135966, 160-1572; 6588, GPR176, 33517, 135967, 867-2414; 6589, GPR179, 33518, 135968, 22-7128; 6589, GPR179, 33519, 135969, 22-7125; 6589, GPR179, 33520, 135970, 22-7125; 6590, GPR18, 33524, 135974, 448-741; 6590, GPR18, 33521, 135971, 558-1553; 6590, GPR18, 33522, 135972, 310-1305; 6590, GPR18, 33523, 135973, 502-1497; 6591, GPR180, 33525, 135975, 26-1348; 6592, GPR182, 33527, 135977, 1-591; 6592, GPR182, 33528, 135978, 1-166; 6592, GPR182, 33526, 135976, 220-1434; 6593, GPR183, 33529, 135979, 85-1170; 6594, GPR19, 33532, 135982, 376-553; 6594, GPR19, 33530, 135980, 356-1603; 6594, GPR19, 33531, 135981, 194-1441; 6595, GPR20, 33533, 135983, 92-1168; 6595, GPR20, 33534, 135984, 92-1168; 6596, GPR21, 33535, 135985, 41-1090; 6597, GPR22, 33536, 135986, 1344-2645; 6598, GPR25, 33537, 135987, 1-1086; 6599, GPR26, 33538, 135988, 54-1067; 6600, GPR27, 33539, 135989, 1-1128; 6601, GPR3, 33540, 135990, 100-1092; 6602, GPR31, 33541, 135991, 499-1458; 6603, GPR32, 33542, 135992, 138-1208; 6604, GPR33, 33543, 135993, 56-1057; 6605, GPR34, 33546, 135996, 278-1282; 6605, GPR34, 33544, 135994, 176-1321; 6605, GPR34, 33545, 135995, 285-1430; 6606, GPR35, 33547, 135997, 943-1872; 6606, GPR35, 33548, 135998, 329-1258; 6606, GPR35, 33549, 135999, 815-1744; 6606, GPR35, 33550, 136000, 1-1023; 6606, GPR35, 33551, 136001, 2521-3450; 6607, GPR37, 33552, 136002, 652-2493; 6608, GPR37L1, 33553, 136003, 107-1552; 6609, GPR39, 33555, 136005, 1-900; 6609, GPR39, 33554, 136004, 470-1831; 6610, GPR4, 33556, 136006, 946-2034; 6611, GPR42, 33557, 136007, 202-1242; 6611, GPR42, 33558, 136008, 71-1111; 6612, GPR45, 33559, 136009, 117-1235; 6613, GPR50, 33561, 136011, 1-1848; 6613, GPR50, 33560, 136010, 70-1923; 6614, GPR52, 33562, 136012, 2-1087; 6615, GPR55, 33566, 136016, 194-919; 6615, GPR55, 33563, 136013, 427-1386; 6615, GPR55, 33564, 136014, 194-1153; 6615, GPR55, 33565, 136015, 194-1153; 6615, GPR55, 33567, 136017, 194-1153; 6616, GPR6, 33568, 136018, 1-1089; 6616, GPR6, 33569, 136019, 295-1428; 6617, GPR61, 33570, 136020, 684-2039; 6617, GPR61, 33571, 136021, 684-2039; 6617, GPR61, 33572, 136022, 635-1990; 6617, GPR61, 33573, 136023, 320-1675; 6617, GPR61, 33574, 136024, 684-2039; 6618, GPR62, 33575, 136025, 340-1446; 6619, GPR63, 33576, 136026, 347-1606; 6620, GPR65, 33577, 136027, 559-1572; 6621, GPR68, 33578, 136028, 342-1355; 6621, GPR68, 33579, 136029, 341-1438; 6621, GPR68, 33580, 136030, 342-1439; 6622, GPR75, 33581, 136031, 272-1894; 6623, GPR78, 33583, 136033, 2053-2838; 6623, GPR78, 33582, 136032, 418-1509; 6624, GPR82, 33584, 136034, 241-1251; 6625, GPR83, 33586, 136036, 146-1291; 6625, GPR83, 33585, 136035, 173-1444; 6626, GPR84, 33587, 136037, 91-1281; 6626, GPR84, 33588, 136038, 637-1827; 6627, GPR85, 33592, 136042, 219-582; 6627, GPR85, 33593, 136043, 379-591; 6627, GPR85, 33589, 136039, 605-1717; 6627, GPR85, 33590, 136040, 455-1567; 6627, GPR85, 33591, 136041, 518-1630; 6627, GPR85, 33594, 136044, 269-1381; 6628, GPR87, 33595, 136045, 466-1542; 6629, GPR88, 33596, 136046, 440-1594; 6630, GPR89A, 33598, 136048, 87-254; 6630, GPR89A, 33600, 136050, 102-791; 6630, GPR89A, 33597, 136047, 145-1512; 6630, GPR89A, 33599, 136049, 97-1389; 6630,

GPR89A, 33601, 136051, 108-482; 6630, GPR89A, 33602, 136052, 208-1500; 6630, GPR89A, 33603, 136053, 145-519; 6631, GPR89B, 33605, 136055, 102-750; 6631, GPR89B, 33606, 136056, 1-280; 6631, GPR89B, 33607, 136057, 1-385; 6631, GPR89B, 33608, 136058, 145-519; 6631, GPR89B, 33604, 136054, 145-1512; 6632, GPRASP1, 33609, 136059, 802-4989; 6632, GPRASP1, 33610, 136060, 711-4898; 6632, GPRASP1, 33611, 136061, 643-4830; 6632, GPRASP1, 33612, 136062, 814-5001; 6633, GPRASP2, 33613, 136063, 857-3373; 6633, GPRASP2, 33614, 136064, 985-3501; 6633, GPRASP2, 33615, 136065, 1073-3589; 6634, GRK1, 33617, 136067, 1-623; 6634, GRK1, 33616, 136066, 233-1924; 6635, GRK4, 33621, 136071, 438-692; 6635, GRK4, 33618, 136068, 251-1891; 6635, GRK4, 33619, 136069, 464-1966; 6635, GRK4, 33620, 136070, 344-2080; 6635, GRK4, 33622, 136072, 251-1849; 6636, GRK5, 33623, 136073, 330-2102; 6637, GRK6, 33626, 136076, 53-1681; 6637, GRK6, 33627, 136077, 197-955; 6637, GRK6, 33628, 136078, 285-336; 6637, GRK6, 33629, 136079, 368-557; 6637, GRK6, 33630, 136080, 1-267; 6637, GRK6, 33631, 136081, 169-555; 6637, GRK6, 33632, 136082, 102-1529; 6637, GRK6, 33624, 136074, 169-1899; 6637, GRK6, 33625, 136075, 4-1686; 6637, GRK6, 33633, 136083, 4-1773; 6638, GRK7, 33634, 136084, 138-1799; 6639, GIT1, 33636, 136086, 219-660; 6639, GIT1, 33638, 136088, 54-2297; 6639, GIT1, 33639, 136089, 1-534; 6639, GIT1, 33640, 136090, 1-686; 6639, GIT1, 33641, 136091, 1-449; 6639, GIT1, 33642, 136092, 215-2299; 6639, GIT1, 33643, 136093, 391-547; 6639, GIT1, 33644, 136094, 26-546; 6639, GIT1, 33635, 136085, 250-2535; 6639, GIT1, 33637, 136087, 172-2484; 6640, GIT2, 33645, 136095, 68-1333; 6640, GIT2, 33646, 136096, 166-2211; 6640, GIT2, 33651, 136101, 1-2127; 6640, GIT2, 33653, 136103, 53-1977; 6640, GIT2, 33647, 136097, 1-2280; 6640, GIT2, 33648, 136098, 81-2270; 6640, GIT2, 33649, 136099, 72-2117; 6640, GIT2, 33650, 136100, 166-2061; 6640, GIT2, 33652, 136102, 73-1488; 6641, GPRC5A, 33655, 136105, 1-201; 6641, GPRC5A, 33656, 136106, 77-897; 6641, GPRC5A, 33654, 136104, 891-1964; 6642, GPRC5B, 33659, 136109, 231-763; 6642, GPRC5B, 33661, 136111, 374-818; 6642, GPRC5B, 33662, 136112, 310-568; 6642, GPRC5B, 33663, 136113, 495-571; 6642, GPRC5B, 33664, 136114, 299-568; 6642, GPRC5B, 33657, 136107, 193-1404; 6642, GPRC5B, 33658, 136108, 1-1215; 6642, GPRC5B, 33660, 136110, 244-1455; 6642, GPRC5B, 33665, 136115, 527-1738; 6643, GPRC5C, 33666, 136116, 492-872; 6643, GPRC5C, 33667, 136117, 1127-2587; 6643, GPRC5C, 33668, 136118, 1-1387; 6643, GPRC5C, 33670, 136120, 512-964; 6643, GPRC5C, 33671, 136121, 124-584; 6643, GPRC5C, 33672, 136122, 1-1066; 6643, GPRC5C, 33673, 136123, 115-550; 6643, GPRC5C, 33669, 136119, 58-1419; 6644, GPRC5D, 33676, 136126, 87-448; 6644, GPRC5D, 33674, 136124, 1-1038; 6644, GPRC5D, 33675, 136125, 1-903; 6645, GPRC6A, 33677, 136127, 23-2803; 6645, GPRC6A, 33678, 136128, 25-2592; 6645, GPRC6A, 33679, 136129, 25-2280; 6646, G0S2, 33680, 136130, 163-474; 6647, GSPT1, 33685, 136135, 185-466; 6647, GSPT1, 33686, 136136, 1-1427; 6647, GSPT1, 33687, 136137, 192-790; 6647, GSPT1, 33681, 136131, 201-2114; 6647, GSPT1, 33682, 136132, 104-1603; 6647, GSPT1, 33683, 136133, 159-2069; 6647, GSPT1, 33684, 136134, 28-1527; 6648, GSPT2, 33688, 136138, 197-2083; 6649, GTSE1, 33689, 136139, 213-2432; 6650, G2E3, 33691, 136141, 217-2199; 6650, G2E3, 33692, 136142, 1-304; 6650, G2E3, 33693, 136143, 96-623; 6650, G2E3, 33694, 136144, 1-367; 6650, G2E3, 33695, 136145, 204-565; 6650, G2E3, 33696, 136146, 145-537; 6650, G2E3, 33697, 136147, 1448-3658; 6650, G2E3, 33698, 136148, 175-411; 6650, G2E3, 33690, 136140, 155-2275; 6651, GABPA, 33699, 136149, 528-1892; 6651, GABPA, 33700, 136150, 222-1586; 6652, GABPB1, 33706, 136156, 261-1220; 6652, GABPB1, 33707, 136157, 243-1286; 6652, GABPB1, 33708, 136158, 138-406; 6652, GABPB1, 33709, 136159, 1-610; 6652, GABPB1, 33710, 136160, 463-730; 6652, GABPB1, 33701, 136151, 170-1357; 6652, GABPB1, 33702, 136152, 449-1495; 6652, GABPB1, 33703, 136153, 425-1576; 6652, GABPB1, 33704, 136154, 215-1261; 6652, GABPB1, 33705, 136155, 170-1252; 6653, GABPB2, 33711, 136161, 33-1265; 6653, GABPB2, 33712, 136162, 332-1678; 6654, GABARAP, 33714, 136164, 118-414; 6654, GABARAP, 33715, 136165, 754-837; 6654, GABARAP, 33716, 136166, 29-139; 6654, GABARAP, 33717, 136167, 233-316; 6654, GABARAP, 33718, 136168, 259-342; 6654, GABARAP, 33713, 136163, 441-794; 6655, GABARAPL1, 33721, 136171, 552-582; 6655, GABARAPL1, 33722, 136172, 483-614; 6655, GABARAPL1, 33723, 136173, 350-433; 6655, GABARAPL1, 33724, 136174, 254-364; 6655, GABARAPL1, 33725, 136175, 482-613; 6655, GABARAPL1, 33726, 136176, 234-365; 6655, GABARAPL1, 33727, 136177, 209-340; 6655, GABARAPL1, 33728, 136178, 343-553; 6655, GABARAPL1, 33730, 136180, 359-442; 6655, GABARAPL1, 33731, 136181, 709-792; 6655, GABARAPL1, 33732, 136182, 25-336; 6655, GABARAPL1, 33734, 136184, 254-364; 6655, GABARAPL1, 33735, 136185, 940-1023; 6655, GABARAPL1, 33736, 136186, 248-379; 6655, GABARAPL1, 33719, 136169, 326-679; 6655, GABARAPL1, 33720, 136170, 295-735; 6655, GABARAPL1, 33729, 136179, 101-454; 6655, GABARAPL1, 33733, 136183, 146-586; 6656, GABARAPL2, 33738, 136188, 312-485; 6656, GABARAPL2, 33739, 136189, 113-379; 6656, GABARAPL2, 33740, 136190, 99-227; 6656, GABARAPL2, 33737, 136187, 137-490; 6657, GALK1, 33742, 136192, 1-555; 6657, GALK1, 33744, 136194, 57-419; 6657, GALK1, 33745, 136195, 1-276; 6657, GALK1, 33741, 136191, 101-1279; 6657, GALK1, 33743, 136193, 576-1754; 6658, GALK2, 33747, 136197, 175-1479; 6658, GALK2, 33748, 136198, 244-1548; 6658, GALK2, 33749, 136199, 96-722; 6658, GALK2, 33750, 136200, 1-332; 6658, GALK2, 33751, 136201, 162-395; 6658, GALK2, 33753, 136203, 120-1424; 6658, GALK2, 33754, 136204, 342-467; 6658, GALK2, 33755, 136205, 204-341; 6658, GALK2, 33756, 136206, 1-472; 6658, GALK2, 33757, 136207, 1-489; 6658, GALK2, 33758, 136208, 239-388; 6658, GALK2, 33759, 136209, 67-300; 6658, GALK2, 33760, 136210, 100-405; 6658, GALK2, 33761, 136211, 223-372; 6658, GALK2, 33762, 136212, 119-319; 6658, GALK2, 33763, 136213, 390-784; 6658, GALK2, 33764, 136214, 327-567; 6658, GALK2, 33746, 136196, 233-1576; 6658, GALK2, 33752, 136202, 308-1684; 6659, GALNS, 33766, 136216, 1-210; 6659, GALNS, 33767, 136217, 94-444; 6659, GALNS, 33768, 136218, 98-609; 6659, GALNS, 33769, 136219, 55-291; 6659, GALNS, 33770, 136220, 1-156; 6659, GALNS, 33765, 136215, 90-1658; 6660, GALM, 33772, 136222, 46-630; 6660, GALM, 33773, 136223, 1-657; 6660, GALM, 33774, 136224, 1-585; 6660, GALM, 33771, 136221, 253-1281; 6661, GALT, 33777, 136227, 68-430; 6661, GALT, 33778, 136228, 29-301; 6661, GALT, 33779, 136229, 31-285; 6661, GALT, 33780, 136230, 70-324; 6661, GALT, 33781, 136231, 1-178; 6661, GALT, 136225, 43-1182; 6661, GALT, 33776, 136226, 319-1131; 6662, GAL3ST1, 33788, 136238, 246-553; 6662, GAL3ST1, 33789, 136239, 361-575; 6662, GAL3ST1, 33790, 136240, 58-894; 6662, GAL3ST1, 33791, 136241, 72-582; 6662, GAL3ST1, 33792, 136242, 210-656; 6662, GAL3ST1, 33793, 136243, 318-572; 6662, GAL3ST1, 33794, 136244, 56-851; 6662, GAL3ST1, 33795, 136245, 43-533; 6662, GAL3ST1, 33796, 136246, 339-639; 6662, GAL3ST1, 33797, 136247, 341-567; 6662, GAL3ST1, 33798, 136248, 302-639; 6662, GAL3ST1, 33799, 136249, 158-755; 6662, GAL3ST1, 33800, 136250, 156-882; 6662, GAL3ST1, 33801, 136251, 154-584; 6662, GAL3ST1, 33802, 136252, 281-567; 6662, GAL3ST1, 33803, 136253, 268-563; 6662, GAL3ST1, 33782, 136232, 195-1466; 6662, GAL3ST1, 33783, 136233, 123-1394; 6662, GAL3ST1, 33784, 136234, 204-1475; 6662, GAL3ST1, 33785, 136235, 242-1513; 6662, GAL3ST1, 33786, 136236, 319-1590; 6662, GAL3ST1, 33787, 136237, 46-1317; 6663, GAL3ST2, 33805, 136255, 1-1168; 6663, GAL3ST2, 33806, 136256, 1-1170; 6663, GAL3ST2, 33804, 136254, 132-1328; 6664, GAL3ST3, 33807, 136257, 283-1578; 6664, GAL3ST3, 33808, 136258, 161-1456; 6665, GAL3ST4, 33810, 136260, 257-919; 6665, GAL3ST4, 33812, 136262, 136-798; 6665, GAL3ST4, 33813, 136263, 338-735; 6665, GAL3ST4, 33814, 136264, 224-579; 6665, GAL3ST4, 33815, 136265, 217-548; 6665, GAL3ST4, 33809, 136259, 394-1854; 6665, GAL3ST4, 33811, 136261, 190-1650; 6666, GLA, 33817, 136267, 6-674; 6666, GLA, 33816, 136266, 23-1312; 6667, GLB1, 33818, 136268, 62-1702; 6667, GLB1, 33821, 136271, 118-558; 6667, GLB1, 33822, 136272, 62-187; 6667, GLB1, 33823, 136273, 234-540; 6667, GLB1, 33824, 136274, 18-272; 6667, GLB1, 33825, 136275, 285-626; 6667, GLB1, 33826, 136276, 37-591; 6667, GLB1, 33819, 136269, 146-2179; 6667, GLB1, 33820, 136270, 133-2076; 6668, GLB1L, 33830, 136280, 1-556; 6668, GLB1L, 33831, 136281, 583-609; 6668, GLB1L, 33832, 136282, 26-178; 6668, GLB1L, 33833, 136283, 545-888; 6668, GLB1L, 33834, 136284, 439-517; 6668, GLB1L, 33827, 136277, 315-2279; 6668, GLB1L, 33828, 136278, 309-2273; 6668, GLB1L, 33829, 136279, 42-1736; 6669, GLB1L2, 33835, 136285, 189-2099; 6669, GLB1L2, 33836, 136286, 189-2099; 6670, GLB1L3, 33839, 136289, 1-560; 6670, GLB1L3, 33837, 136287, 2497-3438; 6670, GLB1L3, 33838, 136288, 1-1962; 6671, GALC, 33840, 136290, 108-2165; 6671, GALC, 33841, 136291, 15-2003; 6671, GALC, 33842, 136292, 167-2146; 6671, GALC, 33844, 136294, 157-1461; 6671, GALC, 33845, 136295, 1-217; 6671, GALC, 33846, 136296, 9-347; 6671, GALC, 33847, 136297, 1-189; 6671, GALC, 33848, 136298, 7-642; 6671, GALC, 33849, 136299, 1-1214; 6671, GALC, 33843, 136293, 509-2278; 6672, GALR1, 33850, 136300, 1-1050; 6673, GALR2, 33851, 136301, 91-1254; 6674, GALR3, 33852, 136302, 26-1132; 6675, GAL, 33853, 136303, 259-630; 6676, GALP, 33854, 136304, 83-433; 6676, GALP, 33855, 136305, 83-232; 6676, GALP, 33856, 136306, 1-150; 6677, GRIFIN, 33857, 136307, 1-435; 6678, GTSF1, 33860, 136310, 34-564; 6678, GTSF1, 33861, 136311, 87-617; 6678, GTSF1, 33858, 136308, 84-587; 6678, GTSF1, 33859, 136309, 898-1401; 6679, GTSF1L, 33862, 136312, 305-751; 6679, GTSF1L, 33863, 136313, 4-375; 6680, GGN, 33865, 136315, 342-520; 6680, GGN, 33866, 136316, 250-495; 6680, GGN, 33864, 136314, 134-2092; 6680, GGN, 33867, 136317, 125-1498; 6681, GGNBP2, 33870, 136320, 293-499; 6681, GGNBP2, 33871, 136321, 222-695; 6681, GGNBP2, 33872, 136322, 1-401; 6681, GGNBP2, 33873, 136323, 1-401; 6681, GGNBP2, 33874, 136324, 222-695; 6681, GGNBP2, 33875, 136325, 293-499; 6681, GGNBP2, 33868, 136318, 317-2410; 6681, GGNBP2, 33869, 136319, 317-2410; 6682, GABRA1, 33880, 136330, 63-566; 6682, GABRA1, 33881, 136331, 253-591; 6682, GABRA1, 33882, 136332, 142-414; 6682, GABRA1, 33883, 136333, 307-411; 6682, GABRA1, 33884, 136334, 215-1070; 6682, GABRA1, 33876, 136326, 469-1839; 6682, GABRA1, 33877, 136327, 784-2154; 6682, GABRA1, 33878, 136328, 356-1726; 6682, GABRA1, 33879, 136329, 185-1555; 6683, GABRA2, 33888, 136338, 8-208; 6683, GABRA2, 33890, 136340, 8-487; 6683, GABRA2, 33891, 136341, 334-555; 6683, GABRA2, 33892, 136342, 154-1257; 6683, GABRA2, 33893, 136343, 171-582; 6683, GABRA2, 33894, 136344, 142-596; 6683, GABRA2, 33895, 136345, 1-171; 6683, GABRA2, 33896, 136346, 65-265; 6683, GABRA2, 33897, 136347, 8-1543; 6683, GABRA2, 33898, 136348, 568-1851; 6683, GABRA2, 33899, 136349, 65-265; 6683, GABRA2, 33885, 136335, 674-2029; 6683, GABRA2, 33886, 136336, 205-1560; 6683, GABRA2, 33887, 136337, 182-1537; 6683, GABRA2, 33889, 136339, 175-1530; 6684, GABRA3, 33900, 136350, 240-1718; 6684, GABRA3, 33901, 136351, 219-1697; 6685, GABRA4, 33903, 136353, 82-192; 6685, GABRA4, 33904, 136354, 117-227; 6685, GABRA4, 33905, 136355, 82-192; 6685, GABRA4, 33902, 136352, 984-2648; 6686, GABRA5, 33909, 136359, 314-570; 6686, GABRA5, 33910, 136360, 51-549; 6686, GABRA5, 33911, 136361, 154-650; 6686, GABRA5, 33912, 136362, 283-728; 6686, GABRA5, 33913, 136363, 411-458; 6686, GABRA5, 33914, 136364, 396-653; 6686, GABRA5, 33906, 136356, 889-2277; 6686, GABRA5, 33907, 136357, 276-1664; 6686, GABRA5, 33908, 136358, 399-1787; 6687, GABRA6, 33916, 136366, 1-573; 6687, GABRA6, 33917, 136367, 1-591; 6687, GABRA6, 33918, 136368, 1-555; 6687, GABRA6, 33919, 136369, 243-1574; 6687, GABRA6, 33915, 136365, 434-1795; 6688, GABRB1, 33921, 136371, 224-576; 6688, GABRB1, 33920, 136370, 293-1717; 6688, GABRB1, 33922, 136372, 20-283; 6689, GABRB2, 33927, 136377, 222-1166; 6689, GABRB2, 33928, 136378, 327-1562; 6689, GABRB2, 33923, 136373, 322-1746; 6689, GABRB2, 33924, 136374, 219-1757; 6689, GABRB2, 33925, 136375, 1-1539; 6689, GABRB2, 33926, 136376, 389-1813; 6689, GABRB2, 33929, 136379, 134-1075; 6690, GABRB3, 33934, 136384, 104-1693; 6690, GABRB3, 33935, 136385, 96-413; 6690, GABRB3, 33936, 136386, 53-316; 6690, GABRB3, 33937, 136387, 1-133; 6690, GABRB3, 33930, 136380, 65-1486; 6690, GABRB3, 33931, 136381, 113-1534; 6690, GABRB3, 33932, 136382, 88-1296; 6690, GABRB3, 33933, 136383, 101-1267; 6690, GABRB3, 33938, 136388, 466-1632; 6690, GABRB3, 33939, 136389, 168-1334; 6691, GABRD, 33940, 136390, 101-1459; 6692, GABRE, 33942, 136392, 56-187; 6692, GABRE, 33943, 136393, 40-171; 6692, GABRE, 33941, 136391, 55-1575; 6693, GABRG1, 33944, 136394, 169-1566; 6694, GABRG2, 33948, 136398, 1-156; 6694, GABRG2, 33949, 136399, 177-843; 6694, GABRG2, 33950, 136400, 127-462; 6694, GABRG2, 33945, 136395, 461-1888; 6694, GABRG2, 33946, 136396, 221-1624; 6694, GABRG2, 33947, 136397, 226-1773; 6695, GABRG3, 33951, 136401, 269-1135; 6695, GABRG3, 33952, 136402, 1-509; 6695, GABRG3, 33953, 136403, 1-116; 6695, GABRG3, 33954, 136404, 1-774; 6695, GABRG3, 33955, 136405, 144-905; 6695, GABRG3, 33956, 136406, 255-1658; 6696, GABRP, 33958, 136408, 180-456; 6696, GABRP, 33959, 136409, 208-721; 6696, GABRP, 33960, 136410, 512-689; 6696, GABRP, 33961, 136411, 426-582; 6696, GABRP, 33963, 136413, 133-700; 6696, GABRP, 33964, 136414, 193-1062; 6696, GABRP, 33965, 136415, 171-1220; 6696, GABRP, 33957, 136407, 199-1521; 6696, GABRP, 33962, 136412, 465-1787; 6697, GABRR1, 33968, 136418, 456-593; 6697, GABRR1, 33966, 136416, 474-1652; 6697, GABRR1, 33967, 136417, 456-1844; 6697, GABRR1, 33969, 136419, 112-1551; 6697, GABRR1, 33970, 136420, 819-1997; 6697, GABRR1, 33971, 136421, 417-1595; 6698, GABRR2, 33972, 136422, 135-1532; 6699, GABRR3, 33973, 136423, 3-1406; 6699, GABRR3, 33974, 136424, 118-1521; 6700, GABRQ, 33975, 136425, 21-1919; 6701, GABBR1, 34001, 136451, 287-2986; 6701, GABBR1, 34003, 136453, 312-3197; 6701, GABBR1, 34005, 136455, 87-487; 6701, GABBR1, 34006, 136456, 86-499; 6701, GABBR1, 34007, 136457, 125-418; 6701, GABBR1, 34009, 136459, 283-678; 6701, GABBR1, 34010, 136460, 140-609; 6701, GABBR1, 34011, 136461, 75-656; 6701, GABBR1, 34015, 136465, 3-1739; 6701, GABBR1, 33976, 136426, 248-2782; 6701, GABBR1, 33977, 136427, 3-1739; 6701, GABBR1, 33978, 136428, 262-2796; 6701, GABBR1, 33979, 136429, 287-2986; 6701, GABBR1, 33980, 136430, 337-3222; 6701, GABBR1, 33981, 136431, 223-2757; 6701, GABBR1, 33982, 136432, 287-2986; 6701, GABBR1, 33983, 136433, 312-3197; 6701, GABBR1, 33984, 136434, 248-2782; 6701, GABBR1, 33985, 136435, 223-2757; 6701, GABBR1, 33986, 136436, 287-2986; 6701, GABBR1, 33987, 136437, 312-3197; 6701, GABBR1, 33988, 136438, 248-2782; 6701, GABBR1, 33989, 136439, 312-3197; 6701, GABBR1, 33990, 136440, 248-2782; 6701, GABBR1, 33991, 136441, 223-2757; 6701, GABBR1, 33992, 136442, 287-2986; 6701, GABBR1, 33993, 136443, 286-2985; 6701, GABBR1, 33994, 136444, 248-2782; 6701, GABBR1, 33995, 136445, 311-3196; 6701, GABBR1, 33996, 136446, 248-2782; 6701, GABBR1, 33997, 136447, 223-2757; 6701, GABBR1, 33998, 136448, 223-2757; 6701, GABBR1, 33999, 136449, 248-2782; 6701, GABBR1, 34000, 136450, 312-3197; 6701, GABBR1, 34002, 136452, 287-2986; 6701, GABBR1, 34004, 136454, 223-2757; 6701, GABBR1, 34008, 136458, 1-1737; 6701, GABBR1, 34012, 136462, 3-1739; 6701, GABBR1, 34013, 136463, 3-1739; 6701, GABBR1, 34014, 136464, 3-1739; 6701, GABBR1, 34016, 136466, 1-2886; 6701, GABBR1, 34017, 136467, 3-1739; 6701, GABBR1, 34018, 136468, 3-1739; 6702, GABBR2, 34020, 136470, 1-550; 6702, GABBR2, 34019, 136469, 461-3286; 6703, GGCX, 34022, 136472, 46-417; 6703, GGCX, 34023, 136473, 66-287; 6703, GGCX, 34024, 136474, 66-266; 6703, GGCX, 34021, 136471, 82-2358; 6703, GGCX, 34025, 136475, 105-2210; 6704, GGH, 34026, 136476, 404-1360; 6705, GGACT, 34029, 136479, 378-455; 6705, GGACT, 34030, 136480, 402-498; 6705, GGACT, 34031, 136481, 316-393; 6705, GGACT, 34032, 136482, 200-296; 6705, GGACT, 34027, 136477, 396-857; 6705, GGACT, 34028, 136478, 251-712; 6706, GGCT, 34036, 136486, 108-608; 6706, GGCT, 34038, 136488, 93-248; 6706, GGCT, 34039, 136489, 1-359; 6706, GGCT, 34040, 136490, 121-276; 6706, GGCT, 34033, 136483, 133-477; 6706, GGCT, 34034, 136484, 136-702; 6706, GGCT, 34035, 136485, 93-377; 6706, GGCT, 34037, 136487, 91-591; 6707, GGT1, 34046, 136496, 1-657; 6707, GGT1, 34047, 136497, 37-795; 6707, GGT1, 34050, 136500, 506-853; 6707, GGT1, 34051, 136501, 397-758; 6707, GGT1, 34052, 136502, 404-606; 6707, GGT1, 34053, 136503, 702-2091; 6707, GGT1, 34054, 136504, 556-1078; 6707, GGT1, 34055, 136505, 415-747; 6707, GGT1, 34056, 136506, 364-743; 6707, GGT1, 34057, 136507, 427-537; 6707, GGT1, 34058, 136508, 592-831; 6707, GGT1, 34059, 136509, 287-579; 6707, GGT1, 34060, 136510, 495-874; 6707, GGT1, 34061, 136511, 508-597; 6707, GGT1, 34062, 136512, 430-811; 6707, GGT1, 34063, 136513, 604-929; 6707, GGT1, 34041, 136491, 488-2197; 6707, GGT1, 34042, 136492, 669-2378; 6707, GGT1, 34043, 136493, 756-2465; 6707, GGT1, 34044, 136494, 134-811; 6707, GGT1, 34045, 136495, 190-867; 6707, GGT1, 34048, 136498, 40-717; 6707, GGT1, 34049, 136499, 744-1844; 6708, GGT2, 34064, 136514, 1-1680; 6708, GGT2, 34065, 136515, 493-2202; 6708, GGT2, 34066, 136516, 63-1772; 6709, GGT5, 34070, 136520, 1-662; 6709, GGT5, 34071, 136521, 358-576; 6709, GGT5, 34067, 136517, 354-2018; 6709, GGT5, 34068, 136518, 418-2178; 6709, GGT5, 34069, 136519, 335-2098; 6710, GGT6, 34073, 136523, 56-1555; 6710, GGT6, 34075, 136525, 44-583; 6710, GGT6, 34076, 136526, 498-1535; 6710, GGT6, 34072, 136522, 61-1446; 6710, GGT6, 34074, 136524, 298-1779; 6711, GGT7, 34078, 136528, 8-615; 6711, GGT7, 34079, 136529, 1-265; 6711, GGT7, 34080, 136530, 1-454; 6711, GGT7, 34077, 136527, 46-2034; 6712, GGTLC1, 34081, 136531, 134-811; 6712, GGTLC1, 34082, 136532, 185-862; 6712, GGTLC1, 34083, 136533, 206-883; 6713, GGTLC2, 34084, 136534, 1-678; 6713, GGTLC2, 34086, 136536, 134-811; 6713, GGTLC2, 34087, 136537, 208-885; 6713, GGTLC2, 34085, 136535, 1-657; 6714, GGTLC3, 34088, 136538, 134-811; 6715, GSAP, 34090, 136540, 1-564; 6715, GSAP, 34091, 136541, 401-577; 6715, GSAP, 34092, 136542, 175-702; 6715, GSAP, 34089, 136539, 80-2644; 6716, GDAP1, 34095, 136545, 19-201; 6716, GDAP1, 34093, 136543, 81-1157; 6716, GDAP1, 34094, 136544, 119-991; 6717, GDAP1L1, 34098, 136548, 1-372; 6717, GDAP1L1, 34099, 136549, 16-880; 6717, GDAP1L1, 34100, 136550, 1-754; 6717, GDAP1L1, 34102, 136552, 192-1028; 6717, GDAP1L1, 34103, 136553, 78-968; 6717, GDAP1L1, 34104, 136554, 17-1111; 6717, GDAP1L1, 34096, 136546, 89-1192; 6717, GDAP1L1, 34097, 136547, 3-446; 6717, GDAP1L1, 34101, 136551, 78-1238; 6718, GDAP2, 34105, 136555, 204-1694; 6718, GDAP2, 34106, 136556, 251-1744; 6719, GJA1, 34107, 136557, 158-1306; 6720, GJA10, 34108, 136558, 1-1632; 6721, GJA3, 34109, 136559, 178-1485; 6722, GJA4, 34111, 136561, 183-1059; 6722, GJA4, 34110, 136560, 89-1090; 6723, GJA5, 34112, 136562, 137-891; 6723, GJA5, 34113, 136563, 142-1218; 6723, GJA5, 34114, 136564, 145-1221; 6724, GJA8, 34115, 136565, 1-1302; 6725, GJA9, 34116, 136566, 252-1799; 6725, GJA9, 34117, 136567, 254-1801; 6726, GJB1, 34121, 136571, 232-484; 6726, GJB1, 34118, 136568, 147-998; 6726, GJB1, 34119, 136569, 96-947; 6726, GJB1, 34120, 136570, 95-946; 6727, GJB2, 34122, 136572, 200-880; 6727, GJB2, 34123, 136573, 139-819; 6728, GJB3, 34124, 136574, 191-1003; 6728, GJB3, 34125, 136575, 616-1428; 6729, GJB4, 34126, 136576, 371-1171; 6730, GJB5, 34127, 136577, 174-995; 6731, GJB6, 34128, 136578, 299-1084; 6731, GJB6, 34129, 136579, 622-1407; 6731, GJB6, 34130, 136580, 296-1081; 6731, GJB6, 34131, 136581, 418-1203; 6732, GJB7, 34133, 136583, 84-571; 6732, GJB7, 34132, 136582, 240-911; 6732, GJB7, 34134, 136584, 347-1018; 6733, GJD2, 34135, 136585, 478-1443; 6734, GJD3, 34136, 136586, 1-885; 6735, GJD4, 34137, 136587, 159-1271; 6736, GJE1, 34138, 136588, 70-687; 6737, GJC1, 34142, 136592, 276-586; 6737, GJC1, 34143, 136593, 269-478; 6737, GJC1, 34145, 136595, 355-572; 6737, GJC1, 34146, 136596, 1-340; 6737, GJC1, 34147, 136597, 1-783; 6737, GJC1, 34139, 136589, 512-1702; 6737, GJC1, 34140, 136590, 271-1461; 6737, GJC1, 34141, 136591, 197-1387; 6737, GJC1, 34144, 136594, 267-1457; 6738, GJC2, 34148, 136598, 176-1495; 6739, GJC3, 34149, 136599, 1-840; 6740, GAR1, 34150, 136600, 265-918; 6740, GAR1, 34151, 136601, 49-702; 6741, GSDMA, 34153, 136603, 72-547;

6741, GSDMA, 34152, 136602, 119-1456; 6742, GSDMB, 34159, 136609, 1-552; 6742, GSDMB, 34160, 136610, 1-612; 6742, GSDMB, 34161, 136611, 1-603; 6742, GSDMB, 34163, 136613, 1-223; 6742, GSDMB, 34154, 136604, 72-1283; 6742, GSDMB, 34155, 136605, 1-1251; 6742, GSDMB, 34156, 136606, 225-1409; 6742, GSDMB, 34157, 136607, 1-1212; 6742, GSDMB, 34158, 136608, 132-1382; 6742, GSDMB, 34162, 136612, 108-1331; 6743, GSDMC, 34164, 136614, 883-2409; 6743, GSDMC, 34165, 136615, 1-1527; 6744, GSDMD, 34167, 136617, 368-511; 6744, GSDMD, 34169, 136619, 1-691; 6744, GSDMD, 34170, 136620, 44-1642; 6744, GSDMD, 34171, 136621, 231-724; 6744, GSDMD, 34172, 136622, 100-442; 6744, GSDMD, 34173, 136623, 271-1101; 6744, GSDMD, 34174, 136624, 116-576; 6744, GSDMD, 34176, 136626, 44-1642; 6744, GSDMD, 34177, 136627, 1-691; 6744, GSDMD, 34178, 136628, 231-724; 6744, GSDMD, 34180, 136630, 271-1101; 6744, GSDMD, 34181, 136631, 100-442; 6744, GSDMD, 34182, 136632, 116-576; 6744, GSDMD, 34183, 136633, 368-511; 6744, GSDMD, 34166, 136616, 150-1604; 6744, GSDMD, 34168, 136618, 884-2338; 6744, GSDMD, 34175, 136625, 150-1604; 6744, GSDMD, 34179, 136629, 884-2338; 6745, GIP, 34184, 136634, 102-563; 6746, GIPR, 34187, 136637, 506-557; 6746, GIPR, 34188, 136638, 87-884; 6746, GIPR, 34185, 136635, 88-1347; 6746, GIPR, 34186, 136636, 87-1379; 6746, GIPR, 34189, 136639, 100-1500; 6747, GIF, 34191, 136641, 47-193; 6747, GIF, 34190, 136640, 49-1302; 6748, GAST, 34192, 136642, 68-373; 6749, GRP, 34195, 136645, 1-290; 6749, GRP, 34196, 136646, 1-107; 6749, GRP, 34193, 136643, 99-545; 6749, GRP, 34194, 136644, 1-426; 6749, GRP, 34197, 136647, 95-511; 6750, GRPR, 34198, 136648, 399-1553; 6751, GKN1, 34199, 136649, 64-663; 6752, GKN2, 34201, 136651, 20-505; 6752, GKN2, 34200, 136650, 110-664; 6753, GBX1, 34202, 136652, 1-1092; 6754, GBX2, 34204, 136654, 39-707; 6754, GBX2, 34203, 136653, 399-1445; 6755, GATA1, 34205, 136655, 93-1097; 6755, GATA1, 34206, 136656, 112-1353; 6756, GATA2, 34210, 136660, 395-844; 6756, GATA2, 34211, 136661, 540-563; 6756, GATA2, 34207, 136657, 333-1775; 6756, GATA2, 34208, 136658, 252-1652; 6756, GATA2, 34209, 136659, 436-1878; 6757, GATA3, 34212, 136662, 456-1787; 6757, GATA3, 34213, 136663, 569-1903; 6758, GATA4, 34215, 136665, 661-1010; 6758, GATA4, 34216, 136666, 379-1089; 6758, GATA4, 34217, 136667, 160-686; 6758, GATA4, 34219, 136669, 764-832; 6758, GATA4, 34220, 136670, 830-877; 6758, GATA4, 34221, 136671, 1-1326; 6758, GATA4, 34214, 136664, 559-1887; 6758, GATA4, 34218, 136668, 81-1412; 6759, GATA5, 34222, 136672, 63-1256; 6760, GATA6, 34223, 136673, 278-2065; 6760, GATA6, 34224, 136674, 213-2000; 6761, GATAD1, 34225, 136675, 278-1087; 6762, GATAD2A, 34229, 136679, 153-570; 6762, GATAD2A, 34230, 136680, 123-655; 6762, GATAD2A, 34231, 136681, 233-729; 6762, GATAD2A, 34232, 136682, 286-565; 6762, GATAD2A, 34233, 136683, 7-306; 6762, GATAD2A, 34234, 136684, 125-504; 6762, GATAD2A, 34235, 136685, 170-457; 6762, GATAD2A, 34236, 136686, 409-640; 6762, GATAD2A, 34226, 136676, 156-2057; 6762, GATAD2A, 34227, 136677, 313-2214; 6762, GATAD2A, 34228, 136678, 419-2323; 6763, GATAD2B, 34239, 136689, 194-1975; 6763, GATAD2B, 34240, 136690, 1-788; 6763, GATAD2B, 34241, 136691, 305-867; 6763, GATAD2B, 34242, 136692, 196-642; 6763, GATAD2B, 34243, 136693, 12-1745; 6763, GATAD2B, 34237, 136687, 245-2026; 6763, GATAD2B, 34238, 136688, 2-1783; 6764, GATSL2, 34244, 136694, 169-1158; 6765, GATSL3, 34246, 136696, 111-986; 6765, GATSL3, 34247, 136697, 126-254; 6765, GATSL3, 34248, 136698, 1-188; 6765, GATSL3, 34249, 136699, 44-232; 6765, GATSL3, 34250, 136700, 73-201; 6765, GATSL3, 34251, 136701, 9-233; 6765, GATSL3, 34245, 136695, 131-1120; 6766, GATS, 34253, 136703, 205-762; 6766, GATS, 34252, 136702, 236-727; 6766, GATS, 34254, 136704, 232-723; 6766, GATS, 34255, 136705, 232-723; 6766, GATS, 34256, 136706, 226-717; 6766, GATS, 34257, 136707, 224-715; 6767, GCN1, 34258, 136708, 14-8029; 6768, GPBP1, 34260, 136710, 1275-2756; 6768, GPBP1, 34259, 136709, 11-1453; 6768, GPBP1, 34261, 136711, 1106-2527; 6768, GPBP1, 34262, 136712, 1567-2475; 6768, GPBP1, 34263, 136713, 513-1910; 6769, GPBP1L1, 34264, 136714, 1223-2647; 6769, GPBP1L1, 34265, 136715, 1362-2786; 6770, GCFC2, 34268, 136718, 1-600; 6770, GCFC2, 34269, 136719, 87-642; 6770, GCFC2, 34271, 136721, 1-108; 6770, GCFC2, 34273, 136723, 1-83; 6770, GCFC2, 34274, 136724, 1-131; 6770, GCFC2, 34266, 136716, 135-2480; 6770, GCFC2, 34267, 136717, 38-2269; 6770, GCFC2, 34270, 136720, 131-895; 6770, GCFC2, 34272, 136722, 45-692; 6771, GFRA1, 34275, 136725, 552-1949; 6771, GFRA1, 34276, 136726, 413-1807; 6771, GFRA1, 34277, 136727, 254-1636; 6771, GFRA1, 34278, 136728, 369-1751; 6772, GFRA2, 34279, 136729, 661-849; 6772, GFRA2, 34281, 136731, 79-872; 6772, GFRA2, 34285, 136735, 325-546; 6772, GFRA2, 34280, 136730, 652-2046; 6772, GFRA2, 34282, 136732, 165-1160; 6772, GFRA2, 34283, 136733, 275-1669; 6772, GFRA2, 34284, 136734, 1-1080; 6773, GFRA3, 34286, 136736, 248-1450; 6773, GFRA3, 34287, 136737, 142-1251; 6774, GFRA4, 34288, 136738, 1-810; 6774, GFRA4, 34289, 136739, 1-900; 6774, GFRA4, 34290, 136740, 1-549; 6775, GFRAL, 34291, 136741, 87-1271; 6776, GZF1, 34294, 136744, 650-795; 6776, GZF1, 34292, 136742, 78-2213; 6776, GZF1, 34293, 136743, 1-2136; 6777, GDI1, 34296, 136746, 102-224; 6777, GDI1, 34297, 136747, 90-230; 6777, GDI1, 34298, 136748, 92-535; 6777, GDI1, 34299, 136749, 343-786; 6777, GDI1, 34295, 136745, 336-1679; 6778, GDI2, 34300, 136750, 140-584; 6778, GDI2, 34303, 136753, 1-612; 6778, GDI2, 34304, 136754, 172-636; 6778, GDI2, 34305, 136755, 130-918; 6778, GDI2, 34306, 136756, 244-634; 6778, GDI2, 34307, 136757, 246-622; 6778, GDI2, 34301, 136751, 154-1356; 6778, GDI2, 34302, 136752, 292-1629; 6779, GDPGP1, 34310, 136760, 356-504; 6779, GDPGP1, 34311, 136761, 209-850; 6779, GDPGP1, 34312, 136762, 520-550; 6779, GDPGP1, 34308, 136758, 22-1179; 6779, GDPGP1, 34309, 136759, 421-1578; 6780, GMDS, 34313, 136763, 271-1389; 6780, GMDS, 34314, 136764, 49-1077; 6781, GMPPA, 34320, 136770, 369-907; 6781, GMPPA, 34321, 136771, 366-1238; 6781, GMPPA, 34322, 136772, 39-786; 6781, GMPPA, 34323, 136773, 22-1221; 6781, GMPPA, 34324, 136774, 1-343; 6781, GMPPA, 34315, 136765, 93-1355; 6781, GMPPA, 34316, 136766, 73-1335; 6781, GMPPA, 34317, 136767, 370-1632; 6781, GMPPA, 34318, 136768, 49-1311; 6781, GMPPA, 34319, 136769, 72-1493; 6782, GMPPB, 34325, 136775, 226-1389; 6782, GMPPB, 34326, 136776, 224-1306; 6782, GMPPB, 34327, 136777, 118-1200; 6783, GSN, 34329, 136779, 1-203; 6783, GSN, 34333, 136783, 22-2268; 6783, GSN, 34334, 136784, 263-1042; 6783, GSN, 34335, 136785, 225-2528; 6783, GSN, 34336, 136786, 301-985; 6783, GSN, 34340, 136790, 111-806; 6783, GSN, 34328, 136778, 221-2416; 6783, GSN, 34330, 136780, 128-2323; 6783, GSN, 34331, 136781, 70-2418; 6783, GSN, 34332, 136782, 906-3101; 6783, GSN, 34337, 136787, 259-2487; 6783, GSN, 34338, 136788, 300-2495; 6783, GSN, 34339, 136789, 156-2375;

6784, GEMIN2, 34345, 136795, 1-136; 6784, GEMIN2, 34346, 136796, 1-592; 6784, GEMIN2, 34347, 136797, 1-658; 6784, GEMIN2, 34348, 136798, 22-471; 6784, GEMIN2, 34349, 136799, 1-69; 6784, GEMIN2, 34341, 136791, 1-798; 6784, GEMIN2, 34342, 136792, 84-926; 6784, GEMIN2, 34343, 136793, 1-753; 6784, GEMIN2, 34344, 136794, 1-135; 6785, GEMIN4, 34351, 136801, 33-587; 6785, GEMIN4, 34352, 136802, 463-673; 6785, GEMIN4, 34353, 136803, 1343-4486; 6785, GEMIN4, 34354, 136804, 128-1015; 6785, GEMIN4, 34355, 136805, 234-1048; 6785, GEMIN4, 34356, 136806, 65-633; 6785, GEMIN4, 34350, 136800, 120-3296; 6786, GEMIN5, 34357, 136807, 77-4603; 6787, GEMIN6, 34359, 136809, 92-427; 6787, GEMIN6, 34360, 136810, 566-775; 6787, GEMIN6, 34358, 136808, 117-620; 6788, GEMIN7, 34361, 136811, 248-643; 6788, GEMIN7, 34362, 136812, 118-513; 6788, GEMIN7, 34363, 136813, 154-549; 6788, GEMIN7, 34364, 136814, 94-489; 6789, GEMIN8, 34365, 136815, 338-868; 6789, GEMIN8, 34366, 136816, 320-1048; 6789, GEMIN8, 34367, 136817, 151-879; 6790, GMIP, 34369, 136819, 1-910; 6790, GMIP, 34370, 136820, 73-183; 6790, GMIP, 34372, 136822, 312-594; 6790, GMIP, 34373, 136823, 92-202; 6790, GMIP, 34368, 136818, 139-3051; 6790, GMIP, 34371, 136821, 33-2867; 6791, GMNC, 34374, 136824, 62-253; 6791, GMNC, 34375, 136825, 1-1005; 6792, GMNN, 34378, 136828, 116-653; 6792, GMNN, 34379, 136829, 382-688; 6792, GMNN, 34380, 136830, 384-580; 6792, GMNN, 34376, 136826, 333-962; 6792, GMNN, 34377, 136827, 208-837; 6792, GMNN, 34381, 136831, 116-745; 6793, GEN1, 34384, 136834, 219-498; 6793, GEN1, 34385, 136835, 215-593; 6793, GEN1, 34386, 136836, 1-390; 6793, GEN1, 34382, 136832, 126-2852; 6793, GEN1, 34383, 136833, 215-2941; 6794, GTF2A1, 34387, 136837, 435-614; 6794, GTF2A1, 34388, 136838, 172-1185; 6794, GTF2A1, 34389, 136839, 405-1535; 6795, GTF2A1L, 34392, 136842, 28-195; 6795, GTF2A1L, 34393, 136843, 78-1082; 6795, GTF2A1L, 34394, 136844, 78-571; 6795, GTF2A1L, 34395, 136845, 1-309; 6795, GTF2A1L, 34390, 136840, 38-1474; 6795, GTF2A1L, 34391, 136841, 78-1412; 6796, GTF2A2, 34399, 136849, 165-371; 6796, GTF2A2, 34400, 136850, 165-389; 6796, GTF2A2, 34401, 136851, 166-382; 6796, GTF2A2, 34396, 136846, 183-512; 6796, GTF2A2, 34397, 136847, 406-735; 6796, GTF2A2, 34398, 136848, 378-707; 6797, GTF2B, 34403, 136853, 91-783; 6797, GTF2B, 34404, 136854, 1-675; 6797, GTF2B, 34402, 136852, 120-1070; 6798, GTF2E1, 34406, 136856, 186-551; 6798, GTF2E1, 34407, 136857, 396-543; 6798, GTF2E1, 34408, 136858, 117-503; 6798, GTF2E1, 34405, 136855, 94-1413; 6799, GTF2E2, 34410, 136860, 65-286; 6799, GTF2E2, 34411, 136861, 49-426; 6799, GTF2E2, 34412, 136862, 142-737; 6799, GTF2E2, 34409, 136859, 284-1159; 6800, GTF2F1, 34414, 136864, 1-1302; 6800, GTF2F1, 34415, 136865, 239-1382; 6800, GTF2F1, 34416, 136866, 188-568; 6800, GTF2F1, 34413, 136863, 466-2019; 6801, GTF2F2, 34417, 136867, 142-891; 6802, GTF2H1, 34420, 136870, 261-545; 6802, GTF2H1, 34421, 136871, 584-1294; 6802, GTF2H1, 34423, 136873, 158-703; 6802, GTF2H1, 34424, 136874, 487-903; 6802, GTF2H1, 34418, 136868, 161-1807; 6802, GTF2H1, 34419, 136869, 669-2315; 6802, GTF2H1, 34422, 136872, 345-1643; 6803, GTF2H2, 34427, 136877, 142-297; 6803, GTF2H2, 34428, 136878, 142-297; 6803, GTF2H2, 34429, 136879, 193-564; 6803, GTF2H2, 34430, 136880, 1-457; 6803, GTF2H2, 34431, 136881, 387-457; 6803, GTF2H2, 34434, 136884, 475-486; 6803, GTF2H2, 34435, 136885, 142-297; 6803, GTF2H2, 34437, 136887, 387-395; 6803, GTF2H2, 34438, 136888, 193-564; 6803, GTF2H2, 34439, 136889, 387-457; 6803, GTF2H2, 34441, 136891, 193-564; 6803, GTF2H2, 34442, 136892, 1-457; 6803, GTF2H2, 34425, 136875, 142-1329; 6803, GTF2H2, 34426, 136876, 289-1476; 6803, GTF2H2, 34432, 136882, 289-1476; 6803, GTF2H2, 34433, 136883, 196-1383; 6803, GTF2H2, 34436, 136886, 289-1476; 6803, GTF2H2, 34440, 136890, 142-1329; 6804, GTF2H3, 34444, 136894, 1-582; 6804, GTF2H3, 34445, 136895, 33-236; 6804, GTF2H3, 34446, 136896, 112-714; 6804, GTF2H3, 34447, 136897, 16-790; 6804, GTF2H3, 34448, 136898, 111-555; 6804, GTF2H3, 34450, 136900, 32-663; 6804, GTF2H3, 34451, 136901, 32-562; 6804, GTF2H3, 34452, 136902, 396-884; 6804, GTF2H3, 34443, 136893, 75-878; 6804, GTF2H3, 34449, 136899, 32-958; 6805, GTF2H4, 34459, 136909, 185-598; 6805, GTF2H4, 34460, 136910, 185-598; 6805, GTF2H4, 34463, 136913, 185-598; 6805, GTF2H4, 34464, 136914, 185-598; 6805, GTF2H4, 34469, 136919, 185-598; 6805, GTF2H4, 34453, 136903, 224-1612; 6805, GTF2H4, 34454, 136904, 162-1550; 6805, GTF2H4, 34455, 136905, 224-1612; 6805, GTF2H4, 34456, 136906, 162-1550; 6805, GTF2H4, 34457, 136907, 162-1550; 6805, GTF2H4, 34458, 136908, 162-1550; 6805, GTF2H4, 34461, 136911, 224-1612; 6805, GTF2H4, 34462, 136912, 224-1612; 6805, GTF2H4, 34465, 136915, 162-1550; 6805, GTF2H4, 34466, 136916, 224-1612; 6805, GTF2H4, 34467, 136917, 224-1612; 6805, GTF2H4, 34468, 136918, 162-1550; 6806, GTF2H5, 34470, 136920, 79-294; 6807, GTF2I, 34472, 136922, 254-572; 6807, GTF2I, 34471, 136921, 44-868; 6807, GTF2I, 34473, 136923, 390-3386; 6807, GTF2I, 34474, 136924, 317-3190; 6807, GTF2I, 34475, 136925, 317-3250; 6807, GTF2I, 34476, 136926, 317-3253; 6808, GTF3A, 34478, 136928, 63-377; 6808, GTF3A, 34479, 136929, 77-643; 6808, GTF3A, 34480, 136930, 20-1288; 6808, GTF3A, 34481, 136931, 101-505; 6808, GTF3A, 34477, 136927, 195-1292; 6809, GTF3C1, 34484, 136934, 1-540; 6809, GTF3C1, 34485, 136935, 1-644; 6809, GTF3C1, 34486, 136936, 1-420; 6809, GTF3C1, 34487, 136937, 1-255; 6809, GTF3C1, 34482, 136932, 17-6346; 6809, GTF3C1, 34483, 136933, 24-6278; 6810, GTF3C2, 34490, 136940, 154-557; 6810, GTF3C2, 34491, 136941, 1-1262; 6810, GTF3C2, 34492, 136942, 1-239; 6810, GTF3C2, 34493, 136943, 605-828; 6810, GTF3C2, 34494, 136944, 1-427; 6810, GTF3C2, 34495, 136945, 1-545; 6810, GTF3C2, 34496, 136946, 79-1833; 6810, GTF3C2, 34488, 136938, 321-3056; 6810, GTF3C2, 34489, 136939, 431-3166; 6811, GTF3C3, 34499, 136949, 1-21; 6811, GTF3C3, 34500, 136950, 1-326; 6811, GTF3C3, 34501, 136951, 1-447; 6811, GTF3C3, 34502, 136952, 1-486; 6811, GTF3C3, 34503, 136953, 115-231; 6811, GTF3C3, 34504, 136954, 1-134; 6811, GTF3C3, 34497, 136947, 91-2751; 6811, GTF3C3, 34498, 136948, 49-1290; 6812, GTF3C4, 34506, 136956, 565-1014; 6812, GTF3C4, 34505, 136955, 565-3033; 6813, GTF3C5, 34507, 136957, 9-1382; 6813, GTF3C5, 34509, 136959, 441-1478; 6813, GTF3C5, 34511, 136961, 189-920; 6813, GTF3C5, 34512, 136962, 151-823; 6813, GTF3C5, 34513, 136963, 1-272; 6813, GTF3C5, 34508, 136958, 324-1883; 6813, GTF3C5, 34510, 136960, 9-1589; 6814, GTF3C6, 34514, 136964, 211-852; 6815, GPHN, 34517, 136967, 25-2373; 6815, GPHN, 34518, 136968, 1-182; 6815, GPHN, 34519, 136969, 1-841; 6815, GPHN, 34520, 136970, 22-174; 6815, GPHN, 34521, 136971, 13-132; 6815, GPHN, 34522, 136972, 13-162; 6815, GPHN, 34523, 136973, 22-171; 6815, GPHN, 34524, 136974, 1-606; 6815, GPHN, 34525, 136975, 391-1533; 6815, GPHN, 34515, 136965, 1122-3332; 6815, GPHN, 34516, 136966, 1122-3431; 6816, GGPS1, 34529, 136979, 124-850; 6816, GGPS1, 34530, 136980, 179-868; 6816, GGPS1, 34526, 136976, 233-1135; 6816, GGPS1, 34527, 136977, 85-987; 6816, GGPS1, 34528, 136978, 301-1041; 6816, GGPS1, 34531, 136981, 173-1075; 6817, GGPS1, 34533, 136983, 134-1099; 6817, GSG1, 34537, 136987, 172-832; 6817, GSG1, 34538, 136988, 70-702; 6817, GSG1, 34540, 136990, 131-838; 6817, GSG1, 34532, 136982, 69-1049; 6817, GSG1, 34534, 136984, 200-1057; 6817, GSG1, 34535, 136985, 42-869; 6817, GSG1, 34536, 136986, 134-1153; 6817, GSG1, 34539, 136989, 56-952; 6818, GSG2, 34541, 136991, 34-2430; 6819, GMCL1, 34542, 136992, 252-1799; 6820, GCSAM, 34544, 136994, 139-282; 6820, GCSAM, 34545, 136995, 47-190; 6820, GCSAM, 34546, 136996, 476-809; 6820, GCSAM, 34548, 136998, 437-816; 6820, GCSAM, 34543, 136993, 186-722; 6820, GCSAM, 34547, 136997, 135-677; 6820, GCSAM, 34549, 136999, 132-623; 6821, GCSAML, 34553, 137003, 359-670; 6821, GCSAML, 34554, 137004, 340-562; 6821, GCSAML, 34555, 137005, 245-556; 6821, GCSAML, 34556, 137006, 284-595; 6821, GCSAML, 34557, 137007, 282-522; 6821, GCSAML, 34559, 137009, 340-651; 6821, GCSAML, 34550, 137000, 105-512; 6821, GCSAML, 34551, 137001, 377-724; 6821, GCSAML, 34552, 137002, 498-845; 6821, GCSAML, 34558, 137008, 348-755; 6822, GHDC, 34563, 137013, 184-522; 6822, GHDC, 34564, 137014, 124-561; 6822, GHDC, 34566, 137016, 169-559; 6822, GHDC, 34567, 137017, 165-1604; 6822, GHDC, 34560, 137010, 443-2035; 6822, GHDC, 34561, 137011, 200-1624; 6822, GHDC, 34562, 137012, 224-1648; 6822, GHDC, 34565, 137015, 190-1782; 6823, GHRL, 34572, 137022, 5-127; 6823, GHRL, 34575, 137025, 127-227; 6823, GHRL, 34568, 137018, 842-1192; 6823, GHRL, 34569, 137019, 872-1225; 6823, GHRL, 34570, 137020, 5-319; 6823, GHRL, 34571, 137021, 381-734; 6823, GHRL, 34573, 137023, 381-731; 6823, GHRL, 34574, 137024, 5-205; 6823, GHRL, 34576, 137026, 33-308; 6823, GHRL, 34577, 137027, 319-672; 6823, GHRL, 34578, 137028, 5-322; 6824, GID4, 34580, 137030, 21-950; 6824, GID4, 34581, 137031, 1-336; 6824, GID4, 34582, 137032, 1-441; 6824, GID4, 34579, 137029, 174-1076; 6825, GID8, 34583, 137033, 148-834; 6826, GAN, 34584, 137034, 163-1956; 6827, GIMAP1-GIMAP5, 34585, 137035, 30-1565; 6828, GINS1, 34586, 137036, 95-685; 6829, GINS2, 34588, 137038, 384-537; 6829, GINS2, 34589, 137039, 419-625; 6829, GINS2, 34587, 137037, 102-659; 6830, GINS3, 34590, 137040, 209-859; 6830, GINS3, 34591, 137041, 209-625; 6830, GINS3, 34592, 137042, 209-976; 6831, GINS4, 34595, 137045, 168-746; 6831, GINS4, 34597, 137047, 199-513; 6831, GINS4, 34593, 137043, 211-882; 6831, GINS4, 34594, 137044, 172-843; 6831, GINS4, 34596, 137046, 983-1285; 6832, GIPC1, 34601, 137051, 122-484; 6832, GIPC1, 34602, 137052, 164-352; 6832, GIPC1, 34603, 137053, 146-265; 6832, GIPC1, 34604, 137054, 1-387; 6832, GIPC1, 34605, 137055, 210-330; 6832, GIPC1, 34608, 137058, 100-576; 6832, GIPC1, 34598, 137048, 127-1128; 6832, GIPC1, 34599, 137049, 117-827; 6832, GIPC1, 34600, 137050, 271-1272; 6832, GIPC1, 34606, 137056, 215-1216; 6832, GIPC1, 34607, 137057, 188-898; 6833, GIPC2, 34609, 137059, 194-1141; 6834, GIPC3, 34610, 137060, 46-984; 6835, GLE1, 34611, 137061, 107-2203; 6835, GLE1, 34612, 137062, 76-2055; 6836, GLI1, 34615, 137065, 93-480; 6836, GLI1, 34616, 137066, 259-784; 6836, GLI1, 34613, 137063, 92-3412; 6836, GLI1, 34614, 137064, 1-3196; 6836, GLI1, 34617, 137067, 259-3195; 6836, GLI1, 34618, 137068, 79-3276; 6837, GLI2, 34619, 137069, 383-1951; 6837, GLI2, 34620, 137070, 187-390; 6837, GLI2, 34623, 137073, 187-390; 6837, GLI2, 34624, 137074, 70-315; 6837, GLI2, 34625, 137075, 187-390; 6837, GLI2, 34626, 137076, 1-171; 6837, GLI2, 34627, 137077, 187-390; 6837, GLI2, 34628, 137078, 31-234; 6837, GLI2, 34629, 137079, 1-529; 6837, GLI2, 34621, 137071, 31-4791; 6837, GLI2, 34622, 137072, 61-4821; 6838, GLI3, 34631, 137081, 114-653; 6838, GLI3, 34632, 137082, 132-422; 6838, GLI3, 34630, 137080, 86-4828; 6839, GLI4, 34633, 137083, 40-270; 6839, GLI4, 34635, 137085, 28-361; 6839, GLI4, 34636, 137086, 40-210; 6839, GLI4, 34637, 137087, 1-261; 6839, GLI4, 34638, 137088, 86-583; 6839, GLI4, 34634, 137084, 86-1216; 6839, GLI4, 34639, 137089, 40-1170; 6840, GLIPR1, 34641, 137091, 1-714; 6840, GLIPR1, 34642, 137092, 129-575; 6840, GLIPR1, 34643, 137093, 401-667; 6840, GLIPR1, 34640, 137090, 202-1002; 6841, GLIPR1L1, 34646, 137096, 1-119; 6841, GLIPR1L1, 34647, 137097, 23-196; 6841, GLIPR1L1, 34644, 137094, 47-748; 6841, GLIPR1L1, 34645, 137095, 91-819; 6842, GLIPR1L2, 34648, 137098, 9-770; 6842, GLIPR1L2, 34649, 137099, 468-1181; 6842, GLIPR1L2, 34650, 137100, 1-507; 6842, GLIPR1L2, 34651, 137101, 48-1082; 6843, GLIPR2, 34652, 137102, 38-424; 6843, GLIPR2, 34654, 137104, 244-432; 6843, GLIPR2, 34655, 137105, 36-254; 6843, GLIPR2, 34653, 137103, 35-499; 6844, GMFB, 34657, 137107, 54-170; 6844, GMFB, 34658, 137108, 142-591; 6844, GMFB, 34659, 137109, 99-215; 6844, GMFB, 34661, 137111, 31-147; 6844, GMFB, 34656, 137106, 270-698; 6844, GMFB, 34660, 137110, 100-528; 6845, GMFG, 34662, 137112, 175-504; 6845, GMFG, 34663, 137113, 64-285; 6845, GMFG, 34664, 137114, 49-288; 6845, GMFG, 34665, 137115, 1-180; 6845, GMFG, 34666, 137116, 62-97; 6845, GMFG, 34667, 137117, 30-311; 6845, GMFG, 34668, 137118, 31-447; 6845, GMFG, 34669, 137119, 178-507; 6845, GMFG, 34670, 137120, 68-373; 6845, GMFG, 34672, 137122, 30-212; 6845, GMFG, 34671, 137121, 210-638; 6846, GDNF, 34677, 137127, 124-306; 6846, GDNF, 34678, 137128, 113-295; 6846, GDNF, 34673, 137123, 201-836; 6846, GDNF, 34674, 137124, 124-681; 6846, GDNF, 34675, 137125, 170-778; 6846, GDNF, 34676, 137126, 170-856; 6846, GDNF, 34679, 137129, 207-764; 6846, GDNF, 34680, 137130, 185-664; 6847, GCM1, 34681, 137131, 213-1523; 6848, GCM2, 34682, 137132, 149-1669; 6849, GFAP, 34684, 137134, 15-554; 6849, GFAP, 34686, 137136, 489-524; 6849, GFAP, 34687, 137137, 15-200; 6849, GFAP, 34688, 137138, 19-762; 6849, GFAP, 34689, 137139, 407-578; 6849, GFAP, 34690, 137140, 1-571; 6849, GFAP, 34691, 137141, 3-787; 6849, GFAP, 34692, 137142, 18-585; 6849, GFAP, 34693, 137143, 15-191; 6849, GFAP, 34694, 137144, 345-370; 6849, GFAP, 34695, 137145, 1-193; 6849, GFAP, 34696, 137146, 1-306; 6849, GFAP, 34683, 137133, 67-1365; 6849, GFAP, 34685, 137135, 9-1304; 6849, GFAP, 34697, 137147, 9-1325; 6850, GBAS, 34699, 137149, 5-442; 6850, GBAS, 34700, 137150, 577-818; 6850, GBAS, 34701, 137151, 467-662; 6850, GBAS, 34703, 137153, 1-343; 6850, GBAS, 34698, 137148, 30-890; 6850, GBAS, 34702, 137152, 30-773; 6851, GLTSCR1, 34705, 137155, 154-532; 6851, GLTSCR1, 34706, 137156, 364-4890; 6851, GLTSCR1, 34704, 137154, 195-4877; 6852, GLTSCR2, 34708, 137158, 1-797; 6852, GLTSCR2, 34709, 137159, 1-448; 6852, GLTSCR2, 34710, 137160, 1-603; 6852, GLTSCR2, 34711, 137161, 1-300; 6852, GLTSCR2, 34707, 137157, 39-1475; 6853, GLDN, 34714, 137164, 77-571; 6853, GLDN, 34716, 137166, 1-454; 6853, GLDN, 34712, 137162, 57-1712; 6853, GLDN, 34713, 137163, 50-1333; 6853, GLDN, 34715, 137165, 3-1286; 6854, GLIS1, 34718, 137168, 43-2430; 6854, GLIS1, 34717, 137167, 568-2430;

6855, GLIS2, 34719, 137169, 822-2396; 6855, GLIS2, 34720, 137170, 58-1632; 6855, GLIS2, 34721, 137171, 58-1632; 6855, GLIS2, 34722, 137172, 822-2396; 6856, GLIS3, 34725, 137175, 595-1327; 6856, GLIS3, 34726, 137176, 212-944; 6856, GLIS3, 34727, 137177, 191-458; 6856, GLIS3, 34728, 137178, 433-700; 6856, GLIS3, 34729, 137179, 426-693; 6856, GLIS3, 34730, 137180, 273-701; 6856, GLIS3, 34723, 137173, 195-2522; 6856, GLIS3, 34724, 137174, 595-3387; 6857, GBGT1, 34731, 137181, 263-481; 6857, GBGT1, 34732, 137182, 265-747; 6857, GBGT1, 34733, 137183, 313-1356; 6857, GBGT1, 34734, 137184, 287-1171; 6857, GBGT1, 34735, 137185, 313-1305; 6858, GLMN, 34738, 137188, 1-734; 6858, GLMN, 34739, 137189, 1-891; 6858, GLMN, 34736, 137186, 83-1867; 6858, GLMN, 34737, 137187, 94-1347; 6859, GLTSCR1L, 34740, 137190, 177-3416; 6859, GLTSCR1L, 34741, 137191, 164-3403; 6859, GLTSCR1L, 34742, 137192, 327-3566; 6860, GCG, 34743, 137193, 257-799; 6860, GCG, 34744, 137194, 256-798; 6861, GCGR, 34746, 137196, 325-564; 6861, GCGR, 34747, 137197, 279-1850; 6861, GCGR, 34745, 137195, 294-1727; 6862, GLP1R, 34748, 137198, 44-1435; 6863, GLP2R, 34750, 137200, 169-523; 6863, GLP2R, 34751, 137201, 161-442; 6863, GLP2R, 34752, 137202, 432-1553; 6863, GLP2R, 34749, 137199, 514-2175; 6864, GBE1, 34754, 137204, 54-2039; 6864, GBE1, 34753, 137203, 645-2753; 6865, GLCCI1, 34756, 137206, 1-574; 6865, GLCCI1, 34757, 137207, 1-581; 6865, GLCCI1, 34758, 137208, 1-575; 6865, GLCCI1, 34755, 137205, 558-2201; 6866, GMEB1, 34759, 137209, 91-1812; 6866, GMEB1, 34760, 137210, 90-1781; 6866, GMEB1, 34761, 137211, 139-1830; 6867, GMEB2, 34763, 137213, 85-1524; 6867, GMEB2, 34762, 137212, 480-2072; 6867, GMEB2, 34764, 137214, 144-1736; 6868, GCK, 34766, 137216, 1-450; 6868, GCK, 34769, 137219, 35-1381; 6868, GCK, 34765, 137215, 163-1563; 6868, GCK, 34767, 137217, 286-1680; 6868, GCK, 34768, 137218, 471-1868; 6868, GCK, 34770, 137220, 1-1395; 6869, GCKR, 34771, 137221, 64-1941; 6869, GCKR, 34773, 137223, 1-684; 6869, GCKR, 34774, 137224, 1-569; 6869, GCKR, 34772, 137222, 58-510; 6870, GNS, 34776, 137226, 91-1581; 6870, GNS, 34777, 137227, 1-907; 6870, GNS, 34778, 137228, 131-1885; 6870, GNS, 34780, 137230, 164-906; 6870, GNS, 34775, 137225, 172-1830; 6870, GNS, 34779, 137229, 156-1754; 6871, GNE, 34781, 137231, 222-2390; 6871, GNE, 34782, 137232, 113-2374; 6871, GNE, 34783, 137233, 52-1998; 6871, GNE, 34784, 137234, 1-2154; 6871, GNE, 34785, 137235, 42-2210; 6871, GNE, 34786, 137236, 139-1977; 6872, GNPDA1, 34788, 137238, 54-925; 6872, GNPDA1, 34789, 137239, 130-543; 6872, GNPDA1, 34791, 137241, 40-864; 6872, GNPDA1, 34794, 137244, 89-570; 6872, GNPDA1, 34795, 137245, 44-754; 6872, GNPDA1, 34796, 137246, 387-473; 6872, GNPDA1, 34787, 137237, 44-913; 6872, GNPDA1, 34790, 137240, 402-1271; 6872, GNPDA1, 34792, 137242, 760-1629; 6872, GNPDA1, 34793, 137243, 95-964; 6873, GNPDA2, 34801, 137251, 1-353; 6873, GNPDA2, 34802, 137252, 1-192; 6873, GNPDA2, 34797, 137247, 158-988; 6873, GNPDA2, 34798, 137248, 108-887; 6873, GNPDA2, 34799, 137249, 133-861; 6873, GNPDA2, 34800, 137250, 137-757; 6874, GNPNAT1, 34804, 137254, 295-785; 6874, GNPNAT1, 34805, 137255, 143-484; 6874, GNPNAT1, 34803, 137253, 189-743; 6875, GCNT1, 34806, 137256, 484-1770; 6875, GCNT1, 34807, 137257, 444-1730; 6875, GCNT1, 34808, 137258, 940-2226; 6876, GCNT2, 34812, 137262, 290-640; 6876, GCNT2, 34810, 137260, 418-1620; 6876, GCNT2, 34811, 137261, 557-1765; 6876, GCNT2, 34813, 137263, 536-1744; 6876, GCNT2, 34809, 137259, 245-1453; 6877, GCNT3, 34816, 137266, 500-761; 6877, GCNT3, 34817, 137267, 209-667; 6877, GCNT3, 34818, 137268, 509-668; 6877, GCNT3, 34814, 137264, 449-1765; 6877, GCNT3, 34815, 137265, 591-1907; 6878, GCNT4, 34819, 137269, 863-2224; 6879, GCNT7, 34821, 137271, 1-1290; 6879, GCNT7, 34820, 137270, 1073-1999; 6880, G6PC3, 34823, 137273, 1-209; 6880, G6PC3, 34824, 137274, 222-443; 6880, G6PC3, 34825, 137275, 216-437; 6880, G6PC3, 34826, 137276, 217-435; 6880, G6PC3, 34827, 137277, 75-805; 6880, G6PC3, 34822, 137272, 232-1272; 6881, G6PC, 34830, 137280, 78-569; 6881, G6PC, 34828, 137278, 80-1153; 6881, G6PC, 34829, 137279, 81-611; 6882, G6PC2, 34833, 137283, 8-250; 6882, G6PC2, 34835, 137285, 8-250; 6882, G6PC2, 34831, 137281, 40-348; 6882, G6PC2, 34832, 137282, 93-1160; 6882, G6PC2, 34834, 137284, 42-506; 6882, G6PC2, 34836, 137286, 42-506; 6882, G6PC2, 34837, 137287, 93-1160; 6882, G6PC2, 34838, 137288, 40-348; 6883, G6PD, 34842, 137292, 49-817; 6883, G6PD, 34843, 137293, 59-1074; 6883, G6PD, 34844, 137294, 95-1056; 6883, G6PD, 34839, 137289, 114-1799; 6883, G6PD, 34840, 137290, 385-2022; 6883, G6PD, 34841, 137291, 114-1661; 6883, G6PD, 34845, 137295, 475-2022; 6884, GPI, 34848, 137298, 228-557; 6884, GPI, 34849, 137299, 1-32; 6884, GPI, 34850, 137300, 1-1722; 6884, GPI, 34851, 137301, 178-615; 6884, GPI, 34852, 137302, 72-559; 6884, GPI, 34853, 137303, 52-529; 6884, GPI, 34854, 137304, 72-571; 6884, GPI, 34855, 137305, 26-1450; 6884, GPI, 34856, 137306, 81-565; 6884, GPI, 34857, 137307, 411-810; 6884, GPI, 34858, 137308, 26-829; 6884, GPI, 34859, 137309, 72-559; 6884, GPI, 34860, 137310, 52-529; 6884, GPI, 34861, 137311, 72-571; 6884, GPI, 34862, 137312, 171-1007; 6884, GPI, 34863, 137313, 411-809; 6884, GPI, 34864, 137314, 81-565; 6884, GPI, 34865, 137315, 242-1045; 6884, GPI, 34866, 137316, 1-32; 6884, GPI, 34867, 137317, 178-615; 6884, GPI, 34868, 137318, 1-849; 6884, GPI, 34869, 137319, 228-557; 6884, GPI, 34846, 137296, 242-1918; 6884, GPI, 34847, 137297, 171-1880; 6885, N/A, 34870, 137320, 758-2047; 6886, GFOD1, 34873, 137323, 773-1219; 6886, GFOD1, 34871, 137321, 285-1148; 6886, GFOD1, 34872, 137322, 666-1838; 6886, GFOD1, 34874, 137324, 230-1093; 6887, GFOD2, 34877, 137327, 256-529; 6887, GFOD2, 34878, 137328, 265-531; 6887, GFOD2, 34880, 137330, 1-311; 6887, GFOD2, 34875, 137325, 347-1504; 6887, GFOD2, 34876, 137326, 250-588; 6887, GFOD2, 34879, 137329, 226-564; 6888, GM, 34883, 137333, 187-812; 6888, GM, 34884, 137334, 1-281; 6888, GM, 34885, 137335, 103-956; 6888, GM, 34881, 137331, 220-3078; 6888, GM, 34882, 137332, 145-3003; 6889, GANAB, 34889, 137339, 25-255; 6889, GANAB, 34891, 137341, 34-390; 6889, GANAB, 34893, 137343, 34-2592; 6889, GANAB, 34894, 137344, 310-2853; 6889, GANAB, 34886, 137336, 17-2917; 6889, GANAB, 34887, 137337, 18-2852; 6889, GANAB, 34888, 137338, 4-162; 6889, GANAB, 34890, 137340, 15-173; 6889, GANAB, 34892, 137342, 18-176; 6890, GANC, 34896, 137346, 241-1089; 6890, GANC, 34897, 137347, 632-1052; 6890, GANC, 34898, 137348, 474-676; 6890, GANC, 34899, 137349, 702-1775; 6890, GANC, 34900, 137350, 912-940; 6890, GANC, 34901, 137351, 362-672; 6890, GANC, 34902, 137352, 239-352; 6890, GANC, 34903, 137353, 219-332; 6890, GANC, 34904, 137354, 215-555; 6890, GANC, 34895, 137345, 241-2985; 6891, GBA2, 34905, 137355, 384-902; 6891, GBA2, 34906, 137356, 515-3148; 6891, GBA2, 34907, 137357, 525-3308; 6892, GBA, 34912, 137362, 234-1844; 6892, GBA, 34913, 137363, 123-1733;

6892, GBA, 34914, 137364, 164-1627; 6892, GBA, 34915, 137365, 504-1853; 6892, GBA, 34908, 137358, 234-1844; 6892, GBA, 34909, 137359, 123-1733; 6892, GBA, 34910, 137360, 341-1690; 6892, GBA, 34911, 137361, 164-1627; 6893, GBA3, 34916, 137366, 92-580; 6893, GBA3, 34917, 137367, 518-1414; 6893, GBA3, 34918, 137368, 103-1512; 6893, GBA3, 34919, 137369, 103-1509; 6893, GBA3, 34920, 137370, 103-588; 6894, GXYLT1, 34921, 137371, 67-1296; 6894, GXYLT1, 34922, 137372, 234-1556; 6895, GXYLT2, 34924, 137374, 449-754; 6895, GXYLT2, 34925, 137375, 1-494; 6895, GXYLT2, 34923, 137373, 162-1493; 6896, GLCE, 34927, 137377, 206-1867; 6896, GLCE, 34926, 137376, 229-2082; 6897, GUSB, 34930, 137380, 14-448; 6897, GUSB, 34931, 137381, 33-437; 6897, GUSB, 34932, 137382, 31-465; 6897, GUSB, 34928, 137378, 132-2087; 6897, GUSB, 34929, 137379, 29-1546; 6898, GAD1, 34936, 137386, 194-556; 6898, GAD1, 34937, 137387, 528-639; 6898, GAD1, 34938, 137388, 274-529; 6898, GAD1, 34939, 137389, 75-776; 6898, GAD1, 34940, 137390, 226-571; 6898, GAD1, 34942, 137392, 1-254; 6898, GAD1, 34933, 137383, 201-875; 6898, GAD1, 34934, 137384, 551-2335; 6898, GAD1, 34935, 137385, 427-1101; 6898, GAD1, 34941, 137391, 823-2100; 6898, GAD1, 34943, 137393, 551-1828; 6899, GAD2, 34945, 137395, 190-579; 6899, GAD2, 34947, 137397, 78-641; 6899, GAD2, 34944, 137394, 146-1903; 6899, GAD2, 34946, 137396, 504-2261; 6900, GADL1, 34948, 137398, 152-1717; 6900, GADL1, 34949, 137399, 48-1304; 6901, GLUD1, 34950, 137400, 98-1774; 6902, GLUD2, 34951, 137401, 98-1774; 6903, GRIP1, 34954, 137404, 145-592; 6903, GRIP1, 34955, 137405, 2-567; 6903, GRIP1, 34956, 137406, 1-2786; 6903, GRIP1, 34957, 137407, 31-662; 6903, GRIP1, 34958, 137408, 1-233; 6903, GRIP1, 34959, 137409, 1-366; 6903, GRIP1, 34960, 137410, 163-524; 6903, GRIP1, 34961, 137411, 1-848; 6903, GRIP1, 34962, 137412, 130-2491; 6903, GRIP1, 34963, 137413, 216-2843; 6903, GRIP1, 34964, 137414, 242-3410; 6903, GRIP1, 34965, 137415, 554-600; 6903, GRIP1, 34952, 137402, 242-3628; 6903, GRIP1, 34953, 137403, 70-3300; 6904, GRIP2, 34966, 137416, 67-3198; 6904, GRIP2, 34967, 137417, 1-3423; 6904, GRIP2, 34968, 137418, 1-984; 6905, GRIA1, 34969, 137419, 344-3064; 6905, GRIA1, 34970, 137420, 74-2794; 6905, GRIA1, 34971, 137421, 28-2778; 6905, GRIA1, 34972, 137422, 162-2675; 6905, GRIA1, 34973, 137423, 235-2715; 6905, GRIA1, 34974, 137424, 28-2778; 6906, GRIA2, 34977, 137427, 355-2547; 6906, GRIA2, 34979, 137429, 123-558; 6906, GRIA2, 34980, 137430, 1-643; 6906, GRIA2, 34981, 137431, 378-522; 6906, GRIA2, 34982, 137432, 171-544; 6906, GRIA2, 34983, 137433, 259-429; 6906, GRIA2, 34984, 137434, 243-556; 6906, GRIA2, 34975, 137425, 280-2931; 6906, GRIA2, 34976, 137426, 326-2977; 6906, GRIA2, 34978, 137428, 112-2622; 6906, GRIA2, 34985, 137435, 278-2788; 6907, GRIA3, 34988, 137438, 238-672; 6907, GRIA3, 34989, 137439, 86-520; 6907, GRIA3, 34991, 137441, 166-2640; 6907, GRIA3, 34986, 137436, 54-2738; 6907, GRIA3, 34987, 137437, 54-2738; 6907, GRIA3, 34990, 137440, 294-2978; 6908, GRIA4, 34994, 137444, 447-3101; 6908, GRIA4, 34996, 137446, 1-2655; 6908, GRIA4, 34997, 137447, 399-653; 6908, GRIA4, 34998, 137448, 92-766; 6908, GRIA4, 34999, 137449, 224-470; 6908, GRIA4, 35000, 137450, 1-313; 6908, GRIA4, 35002, 137452, 428-674; 6908, GRIA4, 35003, 137453, 121-367; 6908, GRIA4, 34992, 137442, 447-3155; 6908, GRIA4, 34993, 137443, 491-1792; 6908, GRIA4, 34995, 137445, 275-1576; 6908, GRIA4, 35001, 137451, 1-2709; 6909, GRID1, 35005, 137455, 102-2369; 6909, GRID1, 35006, 137456, 57-2306; 6909, GRID1, 35004, 137454, 87-3116; 6910, GRID2, 35009, 137459, 86-577; 6910, GRID2, 35010, 137460, 361-579; 6910, GRID2, 35011, 137461, 1-189; 6910, GRID2, 35012, 137462, 9-2789; 6910, GRID2, 35007, 137457, 1036-4059; 6910, GRID2, 35008, 137458, 1-2739; 6911, GRID2IP, 35014, 137464, 54-3116; 6911, GRID2IP, 35015, 137465, 85-3168; 6911, GRID2IP, 35013, 137463, 1-3636; 6912, GRIK1, 35016, 137466, 1-2637; 6912, GRIK1, 35017, 137467, 33-2882; 6912, GRIK1, 35018, 137468, 33-2648; 6912, GRIK1, 35021, 137471, 413-3124; 6912, GRIK1, 35022, 137472, 175-2937; 6912, GRIK1, 35023, 137473, 523-3327; 6912, GRIK1, 35024, 137474, 1-2601; 6912, GRIK1, 35019, 137469, 126-2843; 6912, GRIK1, 35020, 137470, 413-3169; 6913, GRIK2, 35025, 137475, 1-2565; 6913, GRIK2, 35026, 137476, 486-1547; 6913, GRIK2, 35027, 137477, 1-2613; 6913, GRIK2, 35028, 137478, 1-2496; 6913, GRIK2, 35030, 137480, 1-540; 6913, GRIK2, 35033, 137483, 1-549; 6913, GRIK2, 35029, 137479, 491-3169; 6913, GRIK2, 35031, 137481, 491-3217; 6913, GRIK2, 35032, 137482, 491-3100; 6914, GRIK3, 35034, 137484, 18-2777; 6914, GRIK3, 35035, 137485, 22-2640; 6915, GRIK4, 35036, 137486, 343-3213; 6915, GRIK4, 35037, 137487, 288-3158; 6916, GRIK5, 35040, 137490, 36-368; 6916, GRIK5, 35038, 137488, 1-2943; 6916, GRIK5, 35039, 137489, 36-2981; 6916, GRIK5, 35041, 137491, 309-3251; 6917, GRIN1, 35042, 137492, 313-1383; 6917, GRIN1, 35046, 137496, 7-2775; 6917, GRIN1, 35043, 137493, 7-2886; 6917, GRIN1, 35044, 137494, 7-2712; 6917, GRIN1, 35045, 137495, 7-2838; 6917, GRIN1, 35047, 137497, 7-2664; 6917, GRIN1, 35048, 137498, 7-2727; 6917, GRIN1, 35049, 137499, 1098-3914; 6918, GRIN2A, 35052, 137502, 1-3984; 6918, GRIN2A, 35053, 137503, 5-3439; 6918, GRIN2A, 35050, 137500, 549-4943; 6918, GRIN2A, 35051, 137501, 311-4705; 6918, GRIN2A, 35054, 137504, 30-3875; 6919, GRIN2B, 35056, 137506, 490-595; 6919, GRIN2B, 35057, 137507, 725-830; 6919, GRIN2B, 35055, 137505, 455-4909; 6920, GRIN2C, 35059, 137509, 103-2724; 6920, GRIN2C, 35058, 137508, 148-3849; 6921, GRIN2D, 35060, 137510, 89-4099; 6922, GRINA, 35063, 137513, 1-553; 6922, GRINA, 35064, 137514, 1-564; 6922, GRINA, 35065, 137515, 254-1075; 6922, GRINA, 35066, 137516, 1-1050; 6922, GRINA, 35067, 137517, 256-558; 6922, GRINA, 35061, 137511, 279-1394; 6922, GRINA, 35062, 137512, 125-1240; 6923, GRIN3A, 35068, 137518, 602-3949; 6924, GRIN3B, 35069, 137519, 20-3151; 6925, GRM1, 35070, 137520, 236-3820; 6925, GRM1, 35071, 137521, 236-2962; 6925, GRM1, 35072, 137522, 368-3952; 6925, GRM1, 35073, 137523, 368-3088; 6925, GRM1, 35074, 137524, 33-2753; 6926, GRM2, 35075, 137525, 217-1524; 6926, GRM2, 35077, 137527, 381-590; 6926, GRM2, 35078, 137528, 140-1924; 6926, GRM2, 35076, 137526, 235-2853; 6927, GRM3, 35080, 137530, 268-528; 6927, GRM3, 35082, 137532, 256-770; 6927, GRM3, 35083, 137533, 248-491; 6927, GRM3, 35079, 137529, 1100-3739; 6927, GRM3, 35081, 137531, 172-1785; 6928, GRM4, 35085, 137535, 502-3099; 6928, GRM4, 35090, 137540, 283-570; 6928, GRM4, 35091, 137541, 457-1002; 6928, GRM4, 35084, 137534, 233-2623; 6928, GRM4, 35086, 137536, 32-2350; 6928, GRM4, 35087, 137537, 364-2595; 6928, GRM4, 35088, 137538, 155-2494; 6928, GRM4, 35089, 137539, 445-3183; 6928, GRM4, 35092, 137542, 194-2533; 6929, GRM5, 35095, 137545, 371-1267; 6929, GRM5, 35096, 137546, 1-263; 6929, GRM5, 35093, 137543, 151-3693; 6929, GRM5, 35094, 137544, 151-3789; 6929, GRM5, 35097, 137547, 369-3911; 6930, GRM6, 35098, 137548, 180-2813; 6930, GRM6, 35099, 137549, 40-2673; 6931, GRM7, 35103, 137553, 1-2034; 6931, GRM7, 35104, 137554, 230-595; 6931, GRM7, 35105, 137555, 129-683; 6931, GRM7, 35106, 137556, 53-259; 6931, GRM7, 35107, 137557, 239-352; 6931, GRM7, 35108, 137558, 150-2891; 6931, GRM7, 35100, 137550, 275-3022; 6931, GRM7, 35101, 137551, 150-2885; 6931, GRM7, 35102, 137552, 150-2870; 6931, GRM7, 35109, 137559, 275-3043; 6931, GRM7, 35110, 137560, 275-3043; 6932, GRM8, 35114, 137564, 490-551; 6932, GRM8, 35115, 137565, 1-1251; 6932, GRM8, 35116, 137566, 367-1247; 6932, GRM8, 35117, 137567, 1-276; 6932, GRM8, 35111, 137561, 810-3536; 6932, GRM8, 35112, 137562, 16-1521; 6932, GRM8, 35113, 137563, 565-3291; 6932, GRM8, 35118, 137568, 609-3335; 6933, GLUL, 35123, 137573, 57-758; 6933, GLUL, 35119, 137569, 898-2019; 6933, GLUL, 35120, 137570, 1310-2431; 6933, GLUL, 35121, 137571, 542-1663; 6933, GLUL, 35122, 137572, 244-1365; 6934, GCLC, 35125, 137575, 444-608; 6934, GCLC, 35126, 137576, 262-630; 6934, GCLC, 35127, 137577, 389-1147; 6934, GCLC, 35128, 137578, 80-542; 6934, GCLC, 35129, 137579, 1-519; 6934, GCLC, 35130, 137580, 1-282; 6934, GCLC, 35131, 137581, 539-592; 6934, GCLC, 35132, 137582, 485-2284; 6934, GCLC, 35124, 137574, 485-2398; 6935, GCLM, 35133, 137583, 248-1072; 6935, GCLM, 35134, 137584, 294-1052; 6936, ERICH1, 35136, 137586, 1-671; 6936, ERICH1, 35137, 137587, 37-1074; 6936, ERICH1, 35138, 137588, 1-373; 6936, ERICH1, 35139, 137589, 37-58; 6936, ERICH1, 35140, 137590, 79-100; 6936, ERICH1, 35135, 137585, 79-1410; 6937, ERICH2, 35141, 137591, 54-524; 6938, ERICH3, 35144, 137594, 66-398; 6938, ERICH3, 35142, 137592, 220-4812; 6938, ERICH3, 35143, 137593, 180-1781; 6939, ERICH4, 35145, 137595, 13-405; 6940, ERICH5, 35146, 137596, 360-1484; 6940, ERICH5, 35147, 137597, 149-319; 6941, ERICH6, 35149, 137599, 74-479; 6941, ERICH6, 35150, 137600, 35-526; 6941, ERICH6, 35148, 137598, 54-2045; 6941, ERICH6, 35151, 137601, 195-1748; 6942, ERICH6B, 35152, 137602, 166-2256; 6943, GRWD1, 35154, 137604, 197-881; 6943, GRWD1, 35153, 137603, 234-1574; 6944, GPT2, 35157, 137607, 22-554; 6944, GPT2, 35155, 137605, 113-1684; 6944, GPT2, 35156, 137606, 666-1937; 6945, GOT1, 35158, 137608, 29-1270; 6946, GOT1L1, 35160, 137610, 109-474; 6946, GOT1L1, 35161, 137611, 96-600; 6946, GOT1L1, 35159, 137609, 101-1366; 6947, GOT2, 35164, 137614, 89-268; 6947, GOT2, 35162, 137612, 130-1422; 6947, GOT2, 35163, 137613, 99-1262; 6948, GPT, 35165, 137615, 224-1714; 6948, GPT, 35166, 137616, 158-1648; 6949, GLS, 35169, 137619, 342-851; 6949, GLS, 35170, 137620, 99-410; 6949, GLS, 35171, 137621, 120-644; 6949, GLS, 35172, 137622, 1-345; 6949, GLS, 35173, 137623, 330-821; 6949, GLS, 35174, 137624, 1-549; 6949, GLS, 35167, 137617, 259-2268; 6949, GLS, 35168, 137618, 252-2048; 6950, GLS2, 35176, 137626, 12-545; 6950, GLS2, 35177, 137627, 15-567; 6950, GLS2, 35178, 137628, 297-485; 6950, GLS2, 35179, 137629, 35-508; 6950, GLS2, 35181, 137631, 251-562; 6950, GLS2, 35182, 137632, 280-1263; 6950, GLS2, 35183, 137633, 1-843; 6950, GLS2, 35184, 137634, 740-1753; 6950, GLS2, 35185, 137635, 962-1975; 6950, GLS2, 35175, 137625, 280-2088; 6950, GLS2, 35180, 137630, 132-761; 6951, QSER1, 35187, 137637, 1-2342; 6951, QSER1, 35189, 137639, 627-818; 6951, QSER1, 35186, 137636, 336-5543; 6951, QSER1, 35188, 137638, 357-4946; 6952, QRICH2, 35191, 137641, 1-1488; 6952, QRICH2, 35192, 137642, 66-392; 6952, QRICH2, 35193, 137643, 1-839; 6952, QRICH2, 35190, 137640, 181-5172; 6953, GFPT1, 35194, 137644, 184-2283; 6953, GFPT1, 35195, 137645, 178-2223; 6954, GFPT2, 35197, 137647, 22-557; 6954, GFPT2, 35198, 137648, 50-697; 6954, GFPT2, 35196, 137646, 171-2219; 6955, QRICH1, 35201, 137651, 439-583; 6955, QRICH1, 35202, 137652, 49-359; 6955, QRICH1, 35204, 137654, 116-426; 6955, QRICH1, 35205, 137655, 200-510; 6955, QRICH1, 35199, 137649, 233-2563; 6955, QRICH1, 35200, 137650, 474-2804; 6955, QRICH1, 35203, 137653, 439-2769; 6956, QPCT, 35207, 137657, 139-992; 6956, QPCT, 35208, 137658, 362-714; 6956, QPCT, 35206, 137656, 159-1244; 6957, QPCTL, 35211, 137661, 1-366; 6957, QPCTL, 35209, 137659, 222-1370; 6957, QPCTL, 35210, 137660, 8-874; 6958, QRSL1, 35212, 137662, 69-1028; 6958, QRSL1, 35213, 137663, 105-1691; 6959, QARS, 35215, 137665, 25-327; 6959, QARS, 35217, 137667, 28-1044; 6959, QARS, 35218, 137668, 1-762; 6959, QARS, 35219, 137669, 25-327; 6959, QARS, 35220, 137670, 25-228; 6959, QARS, 35221, 137671, 20-582; 6959, QARS, 35222, 137672, 1-81; 6959, QARS, 35223, 137673, 380-2272; 6959, QARS, 35224, 137674, 445-732; 6959, QARS, 35225, 137675, 1-574; 6959, QARS, 35226, 137676, 25-544; 6959, QARS, 35227, 137677, 1-582; 6959, QARS, 35228, 137678, 28-1053; 6959, QARS, 35229, 137679, 26-550; 6959, QARS, 35230, 137680, 1-405; 6959, QARS, 35231, 137681, 1-250; 6959, QARS, 35232, 137682, 27-329; 6959, QARS, 35233, 137683, 387-907; 6959, QARS, 35234, 137684, 1-228; 6959, QARS, 35235, 137685, 25-327; 6959, QARS, 35236, 137686, 1-276; 6959, QARS, 35237, 137687, 31-578; 6959, QARS, 35238, 137688, 496-701; 6959, QARS, 35214, 137664, 403-2730; 6959, QARS, 35216, 137666, 26-2320; 6960, ENPEP, 35240, 137690, 1-433; 6960, ENPEP, 35239, 137689, 343-3216; 6961, EPRS, 35242, 137692, 64-2968; 6961, EPRS, 35243, 137693, 143-727; 6961, EPRS, 35241, 137691, 271-4809; 6962, EARS2, 35245, 137695, 11-175; 6962, EARS2, 35246, 137696, 22-321; 6962, EARS2, 35247, 137697, 22-261; 6962, EARS2, 35250, 137700, 389-1909; 6962, EARS2, 35251, 137701, 13-351; 6962, EARS2, 35244, 137694, 33-1604; 6962, EARS2, 35248, 137698, 2-1606; 6962, EARS2, 35249, 137699, 8-1579; 6963, GATB, 35253, 137703, 4-1077; 6963, GATB, 35254, 137704, 1-410; 6963, GATB, 35255, 137705, 9-356; 6963, GATB, 35256, 137706, 1-441; 6963, GATB, 35257, 137707, 1-424; 6963, GATB, 35258, 137708, 1-397; 6963, GATB, 35259, 137709, 18-1568; 6963, GATB, 35252, 137702, 42-1715; 6964, GATC, 35260, 137710, 231-372; 6964, GATC, 35262, 137712, 38-403; 6964, GATC, 35261, 137711, 44-454; 6965, GLRX, 35263, 137713, 344-664; 6965, GLRX, 35264, 137714, 53-373; 6965, GLRX, 35265, 137715, 65-385; 6965, GLRX, 35266, 137716, 50-370; 6965, GLRX, 35267, 137717, 61-381; 6966, GLRX2, 35268, 137718, 50-544; 6966, GLRX2, 35269, 137719, 477-974; 6967, GLRX3, 35270, 137720, 23-1030; 6967, GLRX3, 35271, 137721, 23-1030; 6967, GLRX3, 35272, 137722, 23-1030; 6968, GLRX5, 35274, 137724, 1-412; 6968, GLRX5, 35273, 137723, 498-971; 6969, GRXCR1, 35275, 137725, 1-873; 6970, GRXCR2, 35276, 137726, 1-747; 6971, GCDH, 35278, 137728, 78-523; 6971, GCDH, 35279, 137729, 70-562; 6971, GCDH, 35281, 137731, 1-308; 6971, GCDH, 35282, 137732, 74-334; 6971, GCDH, 35283, 137733, 72-686; 6971, GCDH, 35284, 137734, 61-453; 6971, GCDH, 35285, 137735, 1-346; 6971, GCDH, 35277, 137727, 212-1528; 6971, GCDH, 35280, 137730, 146-1462; 6972, GPX1, 35288, 137738, 81-689; 6972, GPX1, 35286, 137736, 6-302; 6972, GPX1, 35287, 137737, 323-934; 6973, GPX2, 35290, 137740, 20-256; 6973, GPX2, 35291, 137741, 1-405; 6973, GPX2, 35292, 137742, 21-257; 6973, GPX2, 35293, 137743, 180-749; 6973, GPX2, 35289, 137739, 88-660; 6974, GPX3, 35295, 137745, 52-467; 6974, GPX3, 35296, 137746, 1-239; 6974, GPX3, 35297, 137747, 50-352; 6974, GPX3, 35298, 137748, 50-241; 6974, GPX3, 35299, 137749, 1-524; 6974, GPX3, 35300, 137750, 67-285; 6974, GPX3, 35301, 137751, 218-895; 6974, GPX3, 35294, 137744, 93-773; 6975, GPX4, 35303, 137753, 53-781; 6975, GPX4, 35304, 137754, 59-583; 6975, GPX4, 35305, 137755, 37-579; 6975, GPX4, 35306, 137756, 1-501; 6975, GPX4, 35307, 137757, 71-536; 6975, GPX4, 35308, 137758, 321-859; 6975, GPX4, 35309, 137759, 86-787; 6975, GPX4, 35311, 137761, 30-431; 6975, GPX4, 35312, 137762, 119-709; 6975, GPX4, 35302, 137752, 108-701; 6975, GPX4, 35310, 137760, 74-586; 6976, GPX5, 35315, 137765, 3-305; 6976, GPX5, 35316, 137766, 3-668; 6976, GPX5, 35313, 137763, 90-755; 6976, GPX5, 35314, 137764, 3-305; 6977, GPX6, 35318, 137768, 45-590; 6977, GPX6, 35319, 137769, 51-713; 6977, GPX6, 35320, 137770, 1-219; 6977, GPX6, 35317, 137767, 51-716; 6978, GPX7, 35321, 137771, 39-602; 6979, GPX8, 35322, 137772, 25-297; 6979, GPX8, 35324, 137774, 24-500; 6979, GPX8, 35323, 137773, 76-705; 6980, GSR, 35326, 137776, 149-582; 6980, GSR, 35327, 137777, 1-396; 6980, GSR, 35325, 137775, 92-1660; 6980, GSR, 35328, 137778, 1-1323; 6980, GSR, 35329, 137779, 1-1410; 6980, GSR, 35330, 137780, 1-1482; 6981, GSTA1, 35331, 137781, 157-825; 6982, GSTA2, 35332, 137782, 157-825; 6983, GSTA3, 35334, 137784, 90-608; 6983, GSTA3, 35335, 137785, 87-411; 6983, GSTA3, 35336, 137786, 1-669; 6983, GSTA3, 35333, 137783, 67-735; 6984, GSTA4, 35340, 137790, 113-379; 6984, GSTA4, 35337, 137787, 119-787; 6984, GSTA4, 35338, 137788, 255-644; 6984, GSTA4, 35339, 137789, 149-817; 6985, GSTA5, 35343, 137793, 1-669; 6985, GSTA5, 35341, 137791, 71-739; 6985, GSTA5, 35342, 137792, 31-699; 6986, GSTK1, 35346, 137796, 64-636; 6986, GSTK1, 35347, 137797, 203-556; 6986, GSTK1, 35344, 137794, 72-752; 6986, GSTK1, 35345, 137795, 86-730; 6986, GSTK1, 35348, 137798, 74-625; 6986, GSTK1, 35349, 137799, 59-907; 6987, GSTM1, 35352, 137802, 17-466; 6987, GSTM1, 35353, 137803, 46-759; 6987, GSTM1, 35354, 137804, 30-287; 6987, GSTM1, 35355, 137805, 185-491; 6987, GSTM1, 35350, 137800, 35-580; 6987, GSTM1, 35351, 137801, 55-711; 6988, GSTM2, 35357, 137807, 81-626; 6988, GSTM2, 35358, 137808, 25-606; 6988, GSTM2, 35359, 137809, 95-757; 6988, GSTM2, 35360, 137810, 324-587; 6988, GSTM2, 35362, 137812, 34-476; 6988, GSTM2, 35356, 137806, 51-707; 6988, GSTM2, 35361, 137811, 95-670; 6988, GSTM2, 35363, 137813, 66-641; 6989, GSTM3, 35366, 137816, 18-656; 6989, GSTM3, 35364, 137814, 230-907; 6989, GSTM3, 35365, 137815, 311-988; 6990, GSTM4, 35368, 137818, 1-657; 6990, GSTM4, 35369, 137819, 915-1523; 6990, GSTM4, 35367, 137817, 269-856; 6990, GSTM4, 35370, 137820, 310-966; 6991, GSTM5, 35372, 137822, 1-657; 6991, GSTM5, 35373, 137823, 906-1514; 6991, GSTM5, 35371, 137821, 59-715; 6992, GSTO1, 35376, 137826, 51-592; 6992, GSTO1, 35377, 137827, 228-829; 6992, GSTO1, 35374, 137824, 220-846; 6992, GSTO1, 35375, 137825, 195-920; 6992, GSTO1, 35378, 137828, 357-998; 6993, GSTO2, 35379, 137829, 321-1052; 6993, GSTO2, 35380, 137830, 115-762; 6993, GSTO2, 35381, 137831, 629-1258; 6994, GSTP1, 35382, 137832, 103-627; 6994, GSTP1, 35384, 137834, 1-210; 6994, GSTP1, 35385, 137835, 1-239; 6994, GSTP1, 35383, 137833, 250-882; 6995, GSTT1, 35386, 137836, 37-171; 6995, GSTT1, 35388, 137838, 365-559; 6995, GSTT1, 35389, 137839, 35-172; 6995, GSTT1, 35390, 137840, 29-322; 6995, GSTT1, 35391, 137841, 22-218; 6995, GSTT1, 35392, 137842, 22-162; 6995, GSTT1, 35393, 137843, 41-385; 6995, GSTT1, 35394, 137844, 18-335; 6995, GSTT1, 35395, 137845, 16-696; 6995, GSTT1, 35387, 137837, 54-776; 6996, GSTT2, 35396, 137846, 141-833; 6996, GSTT2, 35398, 137848, 76-807; 6996, GSTT2, 35399, 137849, 141-875; 6996, GSTT2, 35397, 137847, 51-785; 6997, GSTT2B, 35401, 137851, 23-715; 6997, GSTT2B, 35402, 137852, 76-810; 6997, GSTT2B, 35400, 137850, 56-790; 6998, GSTZ1, 35403, 137853, 286-936; 6998, GSTZ1, 35404, 137854, 145-669; 6998, GSTZ1, 35407, 137857, 132-701; 6998, GSTZ1, 35408, 137858, 205-564; 6998, GSTZ1, 35409, 137859, 1-213; 6998, GSTZ1, 35411, 137861, 37-690; 6998, GSTZ1, 35412, 137862, 451-564; 6998, GSTZ1, 35413, 137863, 155-763; 6998, GSTZ1, 35414, 137864, 538-714; 6998, GSTZ1, 35405, 137855, 525-1010; 6998, GSTZ1, 35406, 137856, 538-1023; 6998, GSTZ1, 35410, 137860, 263-748; 6999, GSTCD, 35419, 137869, 252-1274; 6999, GSTCD, 35420, 137870, 451-572; 6999, GSTCD, 35421, 137871, 217-718; 6999, GSTCD, 35422, 137872, 79-578; 6999, GSTCD, 35415, 137865, 76-1977; 6999, GSTCD, 35416, 137866, 114-2015; 6999, GSTCD, 35417, 137867, 255-1895; 6999, GSTCD, 35418, 137868, 221-2122; 7000, GSS, 35423, 137873, 100-1524; 7000, GSS, 35424, 137874, 1-1092; 7001, GAPDH, 35426, 137876, 314-1096; 7001, GAPDH, 35425, 137875, 667-1674; 7001, GAPDH, 35427, 137877, 266-1147; 7001, GAPDH, 35428, 137878, 80-1087; 7001, GAPDH, 35429, 137879, 152-1159; 7001, GAPDH, 35430, 137880, 1-882; 7002, GAPDHS, 35432, 137882, 74-208; 7002, GAPDHS, 35433, 137883, 168-704; 7002, GAPDHS, 35431, 137881, 117-1343; 7003, GLYCTK, 35436, 137886, 6-857; 7003, GLYCTK, 35437, 137887, 47-769; 7003, GLYCTK, 35440, 137890, 97-735; 7003, GLYCTK, 35434, 137884, 97-801; 7003, GLYCTK, 35435, 137885, 61-1632; 7003, GLYCTK, 35438, 137888, 97-714; 7003, GLYCTK, 35439, 137889, 30-734; 7004, GK, 35441, 137891, 1-285; 7004, GK, 35442, 137892, 1-357; 7004, GK, 35447, 137897, 1-371; 7004, GK, 35448, 137898, 32-304; 7004, GK, 35449, 137899, 50-358; 7004, GK, 35450, 137900, 39-152; 7004, GK, 35451, 137901, 1-126; 7004, GK, 35452, 137902, 43-282; 7004, GK, 35443, 137893, 180-1841; 7004, GK, 35444, 137894, 61-1635; 7004, GK, 35445, 137895, 180-1772; 7004, GK, 35446, 137896, 180-1859; 7005, GK2, 35453, 137903, 94-1755; 7006, GK5, 35454, 137904, 1-52; 7006, GK5, 35456, 137906, 138-599; 7006, GK5, 35459, 137909, 1-519; 7006, GK5, 35455, 137905, 153-1742; 7006, GK5, 35457, 137907, 94-999; 7006, GK5, 35458, 137908, 113-1018; 7007, GPAT2, 35462, 137912, 80-2254; 7007, GPAT2, 35463, 137913, 109-588; 7007, GPAT2, 35460, 137910, 161-2548; 7007, GPAT2, 35461, 137911, 461-2848; 7008, GPAT3, 35464, 137914, 213-1517; 7008, GPAT3, 35465, 137915, 219-1523; 7008, GPAT3, 35466, 137916, 224-1528; 7009, GPAT4, 35468, 137918, 93-632; 7009, GPAT4, 35469, 137919, 1015-1101; 7009, GPAT4, 35470, 137920, 294-768; 7009, GPAT4, 35467, 137917, 928-2298; 7010, GPAM, 35472, 137922, 165-2297; 7010, GPAM, 35471, 137921, 199-2685; 7011, GPD1, 35475, 137925, 70-222; 7011, GPD1, 35473, 137923, 233-1282; 7011, GPD1, 35474, 137924, 44-1024; 7012, GPD1L, 35477, 137927, 101-295; 7012, GPD1L, 35478, 137928, 212-594; 7012, GPD1L, 35479, 137929, 80-599; 7012, GPD1L, 35480, 137930, 190-621; 7012, GPD1L, 35476, 137926, 202-1257; 7013, GPD2, 35485, 137935, 74-244; 7013, GPD2, 35486, 137936, 54-224; 7013, GPD2, 35488, 137938, 129-456;

7013, GPD2, 35489, 137939, 38-1177; 7013, GPD2, 35481, 137931, 373-2556; 7013, GPD2, 35482, 137932, 74-2257; 7013, GPD2, 35483, 137933, 546-2351; 7013, GPD2, 35484, 137934, 74-2257; 7013, GPD2, 35487, 137937, 134-2317; 7014, GNPAT, 35491, 137941, 173-839; 7014, GNPAT, 35492, 137942, 164-1924; 7014, GNPAT, 35490, 137940, 170-2212; 7015, GPCPD1, 35494, 137944, 1-793; 7015, GPCPD1, 35495, 137945, 1-187; 7015, GPCPD1, 35496, 137946, 112-417; 7015, GPCPD1, 35493, 137943, 214-2232; 7016, GDE1, 35498, 137948, 432-739; 7016, GDE1, 35499, 137949, 1-390; 7016, GDE1, 35500, 137950, 160-486; 7016, GDE1, 35497, 137947, 182-1177; 7017, GDPD1, 35502, 137952, 144-536; 7017, GDPD1, 35504, 137954, 81-713; 7017, GDPD1, 35505, 137955, 1-366; 7017, GDPD1, 35501, 137951, 138-1082; 7017, GDPD1, 35503, 137953, 89-958; 7017, GDPD1, 35506, 137956, 49-921; 7018, GDPD2, 35507, 137957, 252-1871; 7018, GDPD2, 35508, 137958, 362-2134; 7018, GDPD2, 35509, 137959, 381-1763; 7018, GDPD2, 35510, 137960, 485-1867; 7019, GDPD3, 35512, 137962, 1-142; 7019, GDPD3, 35513, 137963, 1-124; 7019, GDPD3, 35511, 137961, 379-1335; 7020, GDPD4, 35514, 137964, 252-1814; 7020, GDPD4, 35515, 137965, 252-2123; 7021, GDPD5, 35517, 137967, 117-524; 7021, GDPD5, 35519, 137969, 605-825; 7021, GDPD5, 35522, 137972, 1-527; 7021, GDPD5, 35524, 137974, 221-628; 7021, GDPD5, 35516, 137966, 839-2656; 7021, GDPD5, 35518, 137968, 538-2355; 7021, GDPD5, 35520, 137970, 1880-3283; 7021, GDPD5, 35521, 137971, 476-1558; 7021, GDPD5, 35523, 137973, 114-1574; 7022, GATM, 35526, 137976, 32-322; 7022, GATM, 35527, 137977, 535-579; 7022, GATM, 35528, 137978, 398-493; 7022, GATM, 35529, 137979, 67-569; 7022, GATM, 35530, 137980, 810-903; 7022, GATM, 35525, 137975, 341-1612; 7022, GATM, 35531, 137981, 95-1270; 7023, GCAT, 35534, 137984, 1-716; 7023, GCAT, 35535, 137985, 31-306; 7023, GCAT, 35536, 137986, 53-583; 7023, GCAT, 35532, 137982, 57-1316; 7023, GCAT, 35533, 137983, 64-1401; 7024, GCSH, 35538, 137988, 22-510; 7024, GCSH, 35539, 137989, 41-193; 7024, GCSH, 35540, 137990, 1-199; 7024, GCSH, 35541, 137991, 1-239; 7024, GCSH, 35542, 137992, 1-131; 7024, GCSH, 35537, 137987, 126-647; 7025, GLDC, 35543, 137993, 152-3214; 7026, GNMT, 35544, 137994, 11-898; 7027, GLRA1, 35547, 137997, 288-401; 7027, GLRA1, 35545, 137995, 294-1643; 7027, GLRA1, 35546, 137996, 288-1661; 7028, GLRA2, 35551, 138001, 14-659; 7028, GLRA2, 35548, 137998, 531-1889; 7028, GLRA2, 35549, 137999, 287-1645; 7028, GLRA2, 35550, 138000, 767-1858; 7029, GLRA3, 35552, 138002, 504-1898; 7029, GLRA3, 35553, 138003, 417-1766; 7030, GLRA4, 35555, 138005, 453-587; 7030, GLRA4, 35554, 138004, 422-1675; 7031, GLRB, 35557, 138007, 162-302; 7031, GLRB, 35558, 138008, 124-264; 7031, GLRB, 35559, 138009, 133-303; 7031, GLRB, 35556, 138006, 271-1764; 7031, GLRB, 35560, 138010, 186-1679; 7031, GLRB, 35561, 138011, 203-1114; 7032, GLYAT, 35565, 138015, 1-215; 7032, GLYAT, 35562, 138012, 156-647; 7032, GLYAT, 35563, 138013, 143-1033; 7032, GLYAT, 35564, 138014, 82-972; 7032, GLYAT, 35566, 138016, 1-891; 7033, GLYATL1, 35569, 138019, 249-401; 7033, GLYATL1, 35570, 138020, 91-243; 7033, GLYATL1, 35571, 138021, 368-573; 7033, GLYATL1, 35572, 138022, 241-760; 7033, GLYATL1, 35573, 138023, 40-261; 7033, GLYATL1, 35574, 138024, 51-227; 7033, GLYATL1, 35575, 138025, 334-571; 7033, GLYATL1, 35576, 138026, 232-384; 7033, GLYATL1, 35567, 138017, 51-1052; 7033, GLYATL1, 35568, 138018, 341-1249; 7033, GLYATL1, 35577, 138027, 1-909; 7034, GLYATL1P3, 35578, 138028, 1-909; 7035, GLYATL2, 35579, 138029, 392-1276; 7035, GLYATL2, 35580, 138030, 272-1156; 7036, GLYATL3, 35582, 138032, 104-571; 7036, GLYATL3, 35581, 138031, 114-980; 7037, GYS1, 35585, 138035, 1-341; 7037, GYS1, 35583, 138033, 199-2220; 7037, GYS1, 35584, 138034, 198-2411; 7038, GYS2, 35586, 138036, 256-2367; 7039, GSK3A, 35588, 138038, 1715-2920; 7039, GSK3A, 35587, 138037, 129-1580; 7039, GSK3A, 35589, 138039, 161-1612; 7040, GSK3B, 35590, 138040, 984-2246; 7040, GSK3B, 35591, 138041, 233-1534; 7041, GYG1, 35594, 138044, 534-713; 7041, GYG1, 35595, 138045, 327-657; 7041, GYG1, 35596, 138046, 130-711; 7041, GYG1, 35597, 138047, 70-866; 7041, GYG1, 35599, 138049, 234-815; 7041, GYG1, 35592, 138042, 190-1191; 7041, GYG1, 35593, 138043, 301-1353; 7041, GYG1, 35598, 138048, 84-923; 7042, GYG2, 35600, 138050, 1-731; 7042, GYG2, 35603, 138053, 212-624; 7042, GYG2, 35601, 138051, 283-1788; 7042, GYG2, 35602, 138052, 317-1729; 7042, GYG2, 35604, 138054, 1-1293; 7043, GLTP, 35606, 138056, 5-208; 7043, GLTP, 35607, 138057, 1-550; 7043, GLTP, 35608, 138058, 10-213; 7043, GLTP, 35609, 138059, 48-620; 7043, GLTP, 35610, 138060, 1-204; 7043, GLTP, 35605, 138055, 115-744; 7044, GLTPD2, 35611, 138061, 54-929; 7045, GYPA, 35613, 138063, 117-569; 7045, GYPA, 35614, 138064, 1-318; 7045, GYPA, 35615, 138065, 1-258; 7045, GYPA, 35616, 138066, 1-357; 7045, GYPA, 35617, 138067, 38-166; 7045, GYPA, 35618, 138068, 1-414; 7045, GYPA, 35619, 138069, 199-645; 7045, GYPA, 35620, 138070, 1-447; 7045, GYPA, 35612, 138062, 59-412; 7046, GYPB, 35621, 138071, 51-239; 7046, GYPB, 35622, 138072, 38-175; 7046, GYPB, 35623, 138073, 53-181; 7046, GYPB, 35624, 138074, 38-175; 7046, GYPB, 35625, 138075, 38-175; 7046, GYPB, 35626, 138076, 38-97; 7046, GYPB, 35627, 138077, 38-214; 7046, GYPB, 35628, 138078, 53-328; 7047, GYPC, 35629, 138079, 332-718; 7047, GYPC, 35630, 138080, 1211-1534; 7047, GYPC, 35631, 138081, 81-410; 7048, GYPE, 35634, 138084, 13-192; 7048, GYPE, 35632, 138082, 53-289; 7048, GYPE, 35633, 138083, 57-293; 7049, GPNMB, 35637, 138087, 150-770; 7049, GPNMB, 35635, 138085, 296-1978; 7049, GPNMB, 35636, 138086, 162-1880; 7050, GP2, 35642, 138092, 189-572; 7050, GP2, 35643, 138093, 1-128; 7050, GP2, 35644, 138094, 139-573; 7050, GP2, 35645, 138095, 78-567; 7050, GP2, 35646, 138096, 158-580; 7050, GP2, 35638, 138088, 151-1755; 7050, GP2, 35639, 138089, 78-1241; 7050, GP2, 35640, 138090, 379-1551; 7050, GP2, 35641, 138091, 78-1691; 7051, GPA33, 35648, 138098, 40-285; 7051, GPA33, 35649, 138099, 479-677; 7051, GPA33, 35647, 138097, 345-1304; 7052, GPHA2, 35651, 138101, 50-406; 7052, GPHA2, 35650, 138100, 56-445; 7052, GPHA2, 35652, 138102, 64-453; 7053, GPHB5, 35653, 138103, 58-450; 7053, GPHB5, 35654, 138104, 1-393; 7054, CGA, 35655, 138105, 126-476; 7054, CGA, 35656, 138106, 100-543; 7054, CGA, 35658, 138108, 401-587; 7054, CGA, 35659, 138109, 100-405; 7054, CGA, 35657, 138107, 402-752; 7055, GP1BA, 35661, 138111, 43-1923; 7055, GP1BA, 35660, 138110, 76-2034; 7056, GP1BB, 35662, 138112, 626-1246; 7057, GINM1, 35664, 138114, 1-378; 7057, GINM1, 35663, 138113, 122-1114; 7058, GP9, 35665, 138115, 223-756; 7059, GPM6A, 35668, 138118, 284-579; 7059, GPM6A, 35669, 138119, 445-568; 7059, GPM6A, 35671, 138121, 403-551; 7059, GPM6A, 35672, 138122, 83-737; 7059, GPM6A, 35673, 138123, 348-734; 7059, GPM6A, 35675, 138125, 251-566; 7059, GPM6A, 35676, 138126, 316-561; 7059, GPM6A, 35677, 138127, 306-566; 7059, GPM6A, 35678, 138128, 423-690; 7059,

GPM6A, 35679, 138129, 352-550; 7059, GPM6A, 35680, 138130, 454-584; 7059, GPM6A, 35681, 138131, 525-555; 7059, GPM6A, 35682, 138132, 265-616; 7059, GPM6A, 35683, 138133, 221-579; 7059, GPM6A, 35666, 138116, 47-883; 7059, GPM6A, 35667, 138117, 525-1361; 7059, GPM6A, 35670, 138120, 353-1156; 7059, GPM6A, 35674, 138124, 326-1141; 7060, GPM6B, 35687, 138137, 287-826; 7060, GPM6B, 35689, 138139, 275-558; 7060, GPM6B, 35690, 138140, 358-678; 7060, GPM6B, 35691, 138141, 359-587; 7060, GPM6B, 35692, 138142, 282-1190; 7060, GPM6B, 35684, 138134, 439-1425; 7060, GPM6B, 35685, 138135, 166-1083; 7060, GPM6B, 35686, 138136, 443-1240; 7060, GPM6B, 35688, 138138, 129-869; 7061, GPS, 35693, 138143, 73-1755; 7062, GP6, 35697, 138147, 525-876; 7062, GP6, 35698, 138148, 29-1891; 7062, GP6, 35702, 138152, 29-1891; 7062, GP6, 35703, 138153, 29-994; 7062, GP6, 35706, 138156, 29-1891; 7062, GP6, 35707, 138157, 29-994; 7062, GP6, 35708, 138158, 29-1891; 7062, GP6, 35709, 138159, 29-1891; 7062, GP6, 35710, 138160, 29-994; 7062, GP6, 35712, 138162, 29-994; 7062, GP6, 35715, 138165, 29-994; 7062, GP6, 35716, 138166, 525-876; 7062, GP6, 35694, 138144, 29-1891; 7062, GP6, 35695, 138145, 29-994; 7062, GP6, 35696, 138146, 29-1048; 7062, GP6, 35699, 138149, 29-994; 7062, GP6, 35700, 138150, 29-994; 7062, GP6, 35701, 138151, 29-994; 7062, GP6, 35704, 138154, 29-1891; 7062, GP6, 35705, 138155, 29-994; 7062, GP6, 35711, 138161, 29-1891; 7062, GP6, 35713, 138163, 29-1891; 7062, GP6, 35714, 138164, 29-1048; 7062, GP6, 35717, 138167, 29-1891; 7063, GLMP, 35719, 138169, 10-561; 7063, GLMP, 35720, 138170, 1-228; 7063, GLMP, 35721, 138171, 10-402; 7063, GLMP, 35722, 138172, 1-335; 7063, GLMP, 35723, 138173, 9-278; 7063, GLMP, 35724, 138174, 45-1007; 7063, GLMP, 35726, 138176, 45-1040; 7063, GLMP, 35718, 138168, 28-1248; 7063, GLMP, 35725, 138175, 517-1494; 7064, GPAA1, 35729, 138179, 106-402; 7064, GPAA1, 35730, 138180, 118-937; 7064, GPAA1, 35731, 138181, 46-825; 7064, GPAA1, 35732, 138182, 142-618; 7064, GPAA1, 35733, 138183, 44-748; 7064, GPAA1, 35734, 138184, 293-535; 7064, GPAA1, 35727, 138177, 122-1987; 7064, GPAA1, 35728, 138178, 64-1749; 7065, GPIHBP1, 35735, 138185, 76-630; 7066, GML, 35737, 138187, 66-420; 7066, GML, 35736, 138186, 91-567; 7067, GPLD1, 35738, 138188, 112-2634; 7068, GLT1D1, 35741, 138191, 1-363; 7068, GLT1D1, 35743, 138193, 10-1065; 7068, GLT1D1, 35739, 138189, 47-847; 7068, GLT1D1, 35740, 138190, 89-1129; 7068, GLT1D1, 35742, 138192, 156-614; 7068, GLT1D1, 35744, 138194, 1-459; 7069, GLT6D1, 35746, 138196, 255-1178; 7069, GLT6D1, 35745, 138195, 255-1085; 7070, GLT8D1, 35749, 138199, 739-1419; 7070, GLT8D1, 35750, 138200, 377-724; 7070, GLT8D1, 35751, 138201, 198-720; 7070, GLT8D1, 35752, 138202, 531-622; 7070, GLT8D1, 35753, 138203, 1-72; 7070, GLT8D1, 35755, 138205, 600-789; 7070, GLT8D1, 35757, 138207, 310-577; 7070, GLT8D1, 35758, 138208, 584-770; 7070, GLT8D1, 35747, 138197, 674-1789; 7070, GLT8D1, 35748, 138198, 153-1268; 7070, GLT8D1, 35754, 138204, 120-1235; 7070, GLT8D1, 35756, 138206, 355-1470; 7071, GLT8D2, 35760, 138210, 385-582; 7071, GLT8D2, 35762, 138212, 406-657; 7071, GLT8D2, 35759, 138209, 407-1456; 7071, GLT8D2, 35761, 138211, 658-1707; 7071, GLT8D2, 35763, 138213, 110-1159; 7072, GYLTL1B, 35766, 138216, 136-2208; 7072, GYLTL1B, 35768, 138218, 1-476; 7072, GYLTL1B, 35769, 138219, 1-329; 7072, GYLTL1B, 35770, 138220, 404-1177; 7072, GYLTL1B, 35764, 138214, 106-2271; 7072, GYLTL1B, 35765, 138215, 100-2265; 7072, GYLTL1B, 35767, 138217, 112-2277; 7073, GTDC1, 35777, 138227, 151-1173; 7073, GTDC1, 35778, 138228, 281-481; 7073, GTDC1, 35779, 138229, 303-601; 7073, GTDC1, 35780, 138230, 153-353; 7073, GTDC1, 35781, 138231, 233-753; 7073, GTDC1, 35771, 138221, 89-1219; 7073, GTDC1, 35772, 138222, 195-1571; 7073, GTDC1, 35773, 138223, 249-1370; 7073, GTDC1, 35774, 138224, 154-1530; 7073, GTDC1, 35775, 138225, 92-1222; 7073, GTDC1, 35776, 138226, 280-1656; 7073, GTDC1, 35782, 138232, 349-1338; 7073, GTDC1, 35783, 138233, 265-1641; 7073, GTDC1, 35784, 138234, 1-1281; 7074, GARS, 35786, 138236, 82-321; 7074, GARS, 35787, 138237, 1-234; 7074, GARS, 35788, 138238, 85-324; 7074, GARS, 35785, 138235, 242-2461; 7075, GLOD4, 35791, 138241, 126-1634; 7075, GLOD4, 35792, 138242, 37-216; 7075, GLOD4, 35793, 138243, 1-347; 7075, GLOD4, 35794, 138244, 13-243; 7075, GLOD4, 35795, 138245, 1-159; 7075, GLOD4, 35796, 138246, 1-176; 7075, GLOD4, 35797, 138247, 25-705; 7075, GLOD4, 35798, 138248, 26-136; 7075, GLOD4, 35799, 138249, 22-132; 7075, GLOD4, 35800, 138250, 1-205; 7075, GLOD4, 35801, 138251, 1-111; 7075, GLOD4, 35802, 138252, 1-111; 7075, GLOD4, 35789, 138239, 25-966; 7075, GLOD4, 35790, 138240, 87-983; 7076, GLOD5, 35804, 138254, 1-383; 7076, GLOD5, 35803, 138253, 42-524; 7077, GLO1, 35805, 138255, 88-642; 7078, GLYR1, 35808, 138258, 1-114; 7078, GLYR1, 35809, 138259, 7-165; 7078, GLYR1, 35810, 138260, 1-1573; 7078, GLYR1, 35811, 138261, 1-516; 7078, GLYR1, 35812, 138262, 24-580; 7078, GLYR1, 35806, 138256, 78-1739; 7078, GLYR1, 35807, 138257, 15-1433; 7078, GLYR1, 35813, 138263, 1-1644; 7079, GRHPR, 35816, 138266, 6-1082; 7079, GRHPR, 35814, 138264, 86-1072; 7079, GRHPR, 35815, 138265, 674-1432; 7080, GPC1, 35818, 138268, 87-573; 7080, GPC1, 35819, 138269, 1-841; 7080, GPC1, 35820, 138270, 204-1085; 7080, GPC1, 35821, 138271, 168-636; 7080, GPC1, 35822, 138272, 335-1795; 7080, GPC1, 35817, 138267, 249-1925; 7081, GPC2, 35824, 138274, 171-575; 7081, GPC2, 35823, 138273, 169-1908; 7082, GPC3, 35827, 138277, 1-770; 7082, GPC3, 35825, 138275, 447-2189; 7082, GPC3, 35826, 138276, 198-2009; 7082, GPC3, 35828, 138278, 1-1581; 7083, GPC4, 35829, 138279, 526-2196; 7084, GPC5, 35831, 138281, 1-155; 7084, GPC5, 35832, 138282, 1-960; 7084, GPC5, 35830, 138280, 441-2159; 7085, GPC6, 35834, 138284, 1-792; 7085, GPC6, 35833, 138283, 616-2283; 7086, GM2A, 35836, 138286, 116-553; 7086, GM2A, 35837, 138287, 1-313; 7086, GM2A, 35835, 138285, 326-907; 7087, GNAS, 35839, 138289, 1-581; 7087, GNAS, 35841, 138291, 1-477; 7087, GNAS, 35843, 138293, 1-186; 7087, GNAS, 35846, 138296, 12-275; 7087, GNAS, 35850, 138300, 4-2166; 7087, GNAS, 35853, 138303, 1-501; 7087, GNAS, 35854, 138304, 1-281; 7087, GNAS, 35855, 138305, 1-595; 7087, GNAS, 35856, 138306, 1-341; 7087, GNAS, 35857, 138307, 212-693; 7087, GNAS, 35858, 138308, 213-573; 7087, GNAS, 35842, 138292, 390-1127; 7087, GNAS, 35845, 138295, 360-1097; 7087, GNAS, 35849, 138299, 360-1097; 7087, GNAS, 35838, 138288, 364-1503; 7087, GNAS, 35844, 138294, 425-1612; 7087, GNAS, 35847, 138297, 425-1609; 7087, GNAS, 35848, 138298, 426-1568; 7087, GNAS, 35840, 138290, 1-1878; 7087, GNAS, 35851, 138301, 553-3666; 7087, GNAS, 35852, 138302, 4-3075; 7088, N/A, 35859, 138309, 217-444; 7088, N/A, 35860, 138310, 329-556; 7088, N/A, 35861, 138311, 455-682; 7088, N/A, 35862, 138312, 102-329; 7088, N/A, 35863, 138313, 91-318; 7089, GBF1, 35864, 138314, 261-5840; 7090, GLG1, 35868, 138318, 12-2108; 7090, GLG1, 35869, 138319, 380-601; 7090, GLG1, 35870, 138320, 5-922; 7090, GLG1, 35871, 138321, 4-461; 7090, GLG1, 35872, 138322, 51-2147; 7090, GLG1, 35865, 138315, 21-3632; 7090, GLG1, 35866, 138316, 1-3540; 7090, GLG1, 35867, 138317, 19-3597; 7091, GOLIM4, 35873, 138323, 60-2066; 7091, GOLIM4, 35874, 138324, 691-2781; 7092, GOLM1, 35877, 138327, 22-339; 7092, GOLM1, 35878, 138328, 267-506; 7092, GOLM1, 35879, 138329, 506-869; 7092, GOLM1, 35875, 138325, 147-1352; 7092, GOLM1, 35876, 138326, 170-1375; 7093, GOLPH3, 35881, 138331, 269-550; 7093, GOLPH3, 35880, 138330, 317-1213; 7094, GOLPH3L, 35883, 138333, 166-973; 7094, GOLPH3L, 35882, 138332, 46-903; 7095, GORASP1, 35885, 138335, 29-979; 7095, GORASP1, 35886, 138336, 7-587; 7095, GORASP1, 35887, 138337, 1-426; 7095, GORASP1, 35888, 138338, 98-955; 7095, GORASP1, 35891, 138341, 329-537; 7095, GORASP1, 35892, 138342, 323-588; 7095, GORASP1, 35893, 138343, 100-1137; 7095, GORASP1, 35884, 138334, 823-2145; 7095, GORASP1, 35889, 138339, 81-728; 7095, GORASP1, 35890, 138340, 506-1246; 7096, GORASP2, 35895, 138345, 75-296; 7096, GORASP2, 35896, 138346, 21-92; 7096, GORASP2, 35897, 138347, 85-201; 7096, GORASP2, 35898, 138348, 145-243; 7096, GORASP2, 35894, 138344, 816-2174; 7097, GOSR1, 35900, 138350, 15-539; 7097, GOSR1, 35901, 138351, 58-804; 7097, GOSR1, 35902, 138352, 1-767; 7097, GOSR1, 35903, 138353, 12-257; 7097, GOSR1, 35905, 138355, 8-718; 7097, GOSR1, 35906, 138356, 12-539; 7097, GOSR1, 35907, 138357, 12-779; 7097, GOSR1, 35899, 138349, 73-825; 7097, GOSR1, 35904, 138354, 223-780; 7098, GOSR2, 35911, 138361, 1-597; 7098, GOSR2, 35912, 138362, 41-472; 7098, GOSR2, 35913, 138363, 200-648; 7098, GOSR2, 35914, 138364, 77-574; 7098, GOSR2, 35915, 138365, 1-297; 7098, GOSR2, 35908, 138358, 32-673; 7098, GOSR2, 35909, 138359, 58-696; 7098, GOSR2, 35910, 138360, 56-643; 7099, GET4, 35918, 138368, 181-682; 7099, GET4, 35919, 138369, 27-502; 7099, GET4, 35920, 138370, 428-873; 7099, GET4, 35916, 138366, 95-1078; 7099, GET4, 35917, 138367, 2518-3342; 7100, GOLT1A, 35921, 138371, 187-585; 7101, GOLT1B, 35923, 138373, 110-496; 7101, GOLT1B, 35924, 138374, 101-229; 7101, GOLT1B, 35925, 138375, 72-194; 7101, GOLT1B, 35926, 138376, 232-456; 7101, GOLT1B, 35927, 138377, 96-224; 7101, GOLT1B, 35928, 138378, 95-223; 7101, GOLT1B, 35922, 138372, 110-526; 7102, GOPC, 35931, 138381, 255-1478; 7102, GOPC, 35929, 138379, 241-1605; 7102, GOPC, 35930, 138380, 77-1465; 7103, GGA1, 35935, 138385, 28-345; 7103, GGA1, 35937, 138387, 189-927; 7103, GGA1, 35938, 138388, 431-483; 7103, GGA1, 35939, 138389, 540-661; 7103, GGA1, 35940, 138390, 833-946; 7103, GGA1, 35941, 138391, 242-566; 7103, GGA1, 35942, 138392, 390-568; 7103, GGA1, 35943, 138393, 240-565; 7103, GGA1, 35944, 138394, 494-577; 7103, GGA1, 35945, 138395, 234-559; 7103, GGA1, 35946, 138396, 428-639; 7103, GGA1, 35932, 138382, 17-1675; 7103, GGA1, 35933, 138383, 387-2306; 7103, GGA1, 35934, 138384, 137-2107; 7103, GGA1, 35936, 138386, 653-2353; 7104, GGA2, 35948, 138398, 14-685; 7104, GGA2, 35949, 138399, 54-233; 7104, GGA2, 35950, 138400, 14-163; 7104, GGA2, 35951, 138401, 196-572; 7104, GGA2, 35952, 138402, 82-261; 7104, GGA2, 35953, 138403, 1-387; 7104, GGA2, 35954, 138404, 38-388; 7104, GGA2, 35955, 138405, 78-257; 7104, GGA2, 35947, 138397, 84-1925; 7105, GGA3, 35958, 138408, 31-240; 7105, GGA3, 35960, 138410, 1-194; 7105, GGA3, 35961, 138411, 113-521; 7105, GGA3, 35962, 138412, 257-2155; 7105, GGA3, 35963, 138413, 1-333; 7105, GGA3, 35965, 138415, 1-230; 7105, GGA3, 35966, 138416, 1-457; 7105, GGA3, 35967, 138417, 7-327; 7105, GGA3, 35968, 138418, 1-475; 7105, GGA3, 35969, 138419, 14-223; 7105, GGA3, 35970, 138420, 423-560; 7105, GGA3, 35971, 138421, 35-496; 7105, GGA3, 35956, 138406, 218-2389; 7105, GGA3, 35957, 138407, 14-2086; 7105, GGA3, 35959, 138409, 259-2214; 7105, GGA3, 35964, 138414, 308-2086; 7106, GFY, 35972, 138422, 320-1876; 7106, GFY, 35973, 138423, 1-1557; 7107, GOLGA1, 35975, 138425, 252-589; 7107, GOLGA1, 35976, 138426, 1-456; 7107, GOLGA1, 35977, 138427, 1-505; 7107, GOLGA1, 35974, 138424, 335-2638; 7108, GOLGA2, 35978, 138428, 20-1439; 7108, GOLGA2, 35979, 138429, 1-704; 7108, GOLGA2, 35981, 138431, 12-311; 7108, GOLGA2, 35982, 138432, 1-2973; 7108, GOLGA2, 35984, 138434, 117-977; 7108, GOLGA2, 35980, 138430, 14-3022; 7108, GOLGA2, 35983, 138433, 14-3022; 7109, GOLGA3, 35989, 138439, 1-254; 7109, GOLGA3, 35985, 138435, 560-5056; 7109, GOLGA3, 35986, 138436, 711-4883; 7109, GOLGA3, 35987, 138437, 184-4680; 7109, GOLGA3, 35988, 138438, 222-3626; 7110, GOLGA4, 35992, 138442, 282-1617; 7110, GOLGA4, 35993, 138443, 214-568; 7110, GOLGA4, 35994, 138444, 281-2036; 7110, GOLGA4, 35995, 138445, 1-6300; 7110, GOLGA4, 35996, 138446, 305-805; 7110, GOLGA4, 35997, 138447, 889-1545; 7110, GOLGA4, 35990, 138440, 300-7031; 7110, GOLGA4, 35991, 138441, 375-7067; 7111, GOLGA5, 35999, 138449, 1-353; 7111, GOLGA5, 35998, 138448, 257-2452; 7112, GOLGA6A, 36000, 138450, 42-2123; 7113, GOLGA6B, 36001, 138451, 1-2082; 7114, GOLGA6C, 36002, 138452, 1-2082; 7115, GOLGA6D, 36004, 138454, 42-2123; 7115, GOLGA6D, 36003, 138453, 42-2123; 7116, GOLGA6L1, 36005, 138455, 92-2098; 7116, GOLGA6L1, 36006, 138456, 92-2098; 7116, GOLGA6L1, 36007, 138457, 92-2098; 7117, GOLGA6L10, 36008, 138458, 63-1487; 7117, GOLGA6L10, 36010, 138460, 1-1425; 7117, GOLGA6L10, 36011, 138461, 101-1528; 7117, GOLGA6L10, 36012, 138462, 63-1382; 7117, GOLGA6L10, 36013, 138463, 63-1631; 7117, GOLGA6L10, 36014, 138464, 63-1673; 7117, GOLGA6L10, 36009, 138459, 101-1669; 7118, GOLGA6L2, 36016, 138466, 781-1725; 7118, GOLGA6L2, 36017, 138467, 54-2783; 7118, GOLGA6L2, 36018, 138468, 54-680; 7118, GOLGA6L2, 36015, 138465, 90-1334; 7119, GOLGA6L22, 36019, 138469, 1-1980; 7119, GOLGA6L22, 36020, 138470, 1-2433; 7119, GOLGA6L22, 36021, 138471, 92-2242; 7119, GOLGA6L22, 36022, 138472, 1-1899; 7120, GOLGA6L4, 36023, 138473, 63-1379; 7120, GOLGA6L4, 36025, 138475, 1-585; 7120, GOLGA6L4, 36024, 138474, 63-1787; 7121, GOLGA6L6, 36026, 138476, 92-2266; 7122, GOLGA6L9, 36027, 138477, 61-1359; 7122, GOLGA6L9, 36028, 138478, 61-1359; 7123, GOLGA7, 36029, 138479, 202-615; 7123, GOLGA7, 36030, 138480, 79-483; 7123, GOLGA7, 36031, 138481, 194-607; 7123, GOLGA7, 36032, 138482, 159-572; 7124, GOLGA7B, 36034, 138484, 1-501; 7124, GOLGA7B, 36033, 138483, 66-569; 7125, GOLGA8O, 36035, 138485, 1-1899; 7126, GOLGA8A, 36036, 138486, 66-1877; 7126, GOLGA8A, 36037, 138487, 342-2237; 7127, GOLGA8B, 36039, 138489, 1-1902; 7127, GOLGA8B, 36038, 138488, 99-1910; 7128, GOLGA8F, 36040, 138490, 63-2009; 7128, GOLGA8F, 36042, 138492, 990-2282; 7128, GOLGA8F, 36043, 138493, 63-2009; 7128, GOLGA8F, 36041, 138491, 990-2282; 7129, GOLGA8G, 36044, 138494, 63-2009; 7129, GOLGA8G, 36046, 138496, 1-1947; 7129,

GOLGA8G, 36045, 138495, 63-2009; 7130, GOLGA8H, 36047, 138497, 1-1899; 7131, GOLGA8J, 36048, 138498, 1-1899; 7131, GOLGA8J, 36049, 138499, 99-1997; 7132, GOLGA8K, 36050, 138500, 2-1894; 7133, GOLGA8M, 36051, 138501, 1-1899; 7134, GOLGA8N, 36053, 138503, 1-1791; 7134, GOLGA8N, 36054, 138504, 161-555; 7134, GOLGA8N, 36052, 138502, 99-1997; 7135, GOLGA8O, 36056, 138506, 161-555; 7135, GOLGA8O, 36055, 138505, 99-1997; 7136, GOLGA8Q, 36057, 138507, 1-1899; 7137, GOLGA8R, 36058, 138508, 1-1896; 7138, GOLGA8S, 36059, 138509, 1-1878; 7139, GOLGA8T, 36060, 138510, 1-1896; 7140, GOLGB1, 36063, 138513, 157-280; 7140, GOLGB1, 36064, 138514, 1-3093; 7140, GOLGB1, 36065, 138515, 38-4959; 7140, GOLGB1, 36066, 138516, 94-213; 7140, GOLGB1, 36067, 138517, 1-330; 7140, GOLGB1, 36061, 138511, 127-9906; 7140, GOLGB1, 36062, 138512, 112-9921; 7140, GOLGB1, 36068, 138518, 284-9838; 7141, GORAB, 36071, 138521, 1-379; 7141, GORAB, 36069, 138519, 19-759; 7141, GORAB, 36070, 138520, 21-1205; 7142, GON4L, 36076, 138526, 176-4801; 7142, GON4L, 36077, 138527, 164-3076; 7142, GON4L, 36072, 138522, 164-6886; 7142, GON4L, 36073, 138523, 73-4662; 7142, GON4L, 36074, 138524, 176-6901; 7142, GON4L, 36075, 138525, 124-6846; 7142, GON4L, 36078, 138528, 124-6849; 7143, GNRH1, 36079, 138529, 1325-1603; 7143, GNRH1, 36080, 138530, 33-311; 7144, GNRH2, 36081, 138531, 52-414; 7144, GNRH2, 36082, 138532, 52-393; 7144, GNRH2, 36083, 138533, 4-342; 7144, GNRH2, 36084, 138534, 406-747; 7145, GNRHR, 36085, 138535, 26-1012; 7145, GNRHR, 36086, 138536, 1-750; 7146, GSC, 36087, 138537, 216-989; 7147, GSC2, 36088, 138538, 1-618; 7148, GPALPP1, 36090, 138540, 92-1108; 7148, GPALPP1, 36093, 138543, 127-429; 7148, GPALPP1, 36089, 138539, 422-934; 7148, GPALPP1, 36091, 138541, 104-1126; 7148, GPALPP1, 36092, 138542, 36-1058; 7149, GPN1, 36096, 138546, 36-257; 7149, GPN1, 36094, 138544, 22-1188; 7149, GPN1, 36095, 138545, 51-1139; 7149, GPN1, 36097, 138547, 194-1081; 7149, GPN1, 36098, 138548, 135-974; 7149, GPN1, 36099, 138549, 596-1483; 7149, GPN1, 36100, 138550, 136-975; 7149, GPN1, 36101, 138551, 8-1132; 7149, GPN1, 36102, 138552, 22-1188; 7150, GPN2, 36103, 138553, 19-414; 7150, GPN2, 36105, 138555, 165-503; 7150, GPN2, 36104, 138554, 202-1134; 7151, GPN3, 36109, 138559, 88-564; 7151, GPN3, 36110, 138560, 1-363; 7151, GPN3, 36111, 138561, 1-353; 7151, GPN3, 36112, 138562, 421-497; 7151, GPN3, 36106, 138556, 64-918; 7151, GPN3, 36107, 138557, 86-1057; 7151, GPN3, 36108, 138558, 62-946; 7152, GPR75-ASB3, 36113, 138563, 233-1903; 7153, GPRIN3, 36114, 138564, 1085-3415; 7153, GPRIN3, 36115, 138565, 520-2850; 7154, GPSM1, 36117, 138567, 1-1960; 7154, GPSM1, 36120, 138570, 221-2248; 7154, GPSM1, 36121, 138571, 221-1594; 7154, GPSM1, 36116, 138566, 233-733; 7154, GPSM1, 36118, 138568, 288-788; 7154, GPSM1, 36119, 138569, 172-672; 7155, GPSM2, 36124, 138574, 1-653; 7155, GPSM2, 36125, 138575, 416-571; 7155, GPSM2, 36126, 138576, 768-992; 7155, GPSM2, 36127, 138577, 265-904; 7155, GPSM2, 36122, 138572, 497-2551; 7155, GPSM2, 36123, 138573, 774-2828; 7156, GPSM3, 36142, 138592, 387-860; 7156, GPSM3, 36143, 138593, 373-522; 7156, GPSM3, 36144, 138594, 373-522; 7156, GPSM3, 36145, 138595, 387-860; 7156, GPSM3, 36146, 138596, 373-522; 7156, GPSM3, 36147, 138597, 373-522; 7156, GPSM3, 36148, 138598, 387-860; 7156, GPSM3, 36149, 138599, 373-522; 7156, GPSM3, 36150, 138600, 387-860; 7156, GPSM3, 36151, 138601, 387-860; 7156, GPSM3, 36152, 138602, 373-522; 7156, GPSM3, 36153, 138603, 387-860; 7156, GPSM3, 36154, 138604, 373-522; 7156, GPSM3, 36155, 138605, 1-375; 7156, GPSM3, 36156, 138606, 1-375; 7156, GPSM3, 36157, 138607, 1-375; 7156, GPSM3, 36158, 138608, 1-375; 7156, GPSM3, 36159, 138609, 1-375; 7156, GPSM3, 36160, 138610, 1-375; 7156, GPSM3, 36128, 138578, 394-876; 7156, GPSM3, 36129, 138579, 374-856; 7156, GPSM3, 36130, 138580, 394-876; 7156, GPSM3, 36131, 138581, 374-856; 7156, GPSM3, 36132, 138582, 394-876; 7156, GPSM3, 36133, 138583, 374-856; 7156, GPSM3, 36134, 138584, 374-856; 7156, GPSM3, 36135, 138585, 394-876; 7156, GPSM3, 36136, 138586, 374-856; 7156, GPSM3, 36137, 138587, 374-856; 7156, GPSM3, 36138, 138588, 394-876; 7156, GPSM3, 36139, 138589, 374-856; 7156, GPSM3, 36140, 138590, 394-876; 7156, GPSM3, 36141, 138591, 394-876; 7157, GRHL1, 36163, 138613, 142-423; 7157, GRHL1, 36165, 138615, 195-413; 7157, GRHL1, 36166, 138616, 287-976; 7157, GRHL1, 36161, 138611, 137-1993; 7157, GRHL1, 36162, 138612, 94-1383; 7157, GRHL1, 36164, 138614, 53-1588; 7158, GRHL2, 36169, 138619, 217-236; 7158, GRHL2, 36167, 138617, 339-2216; 7158, GRHL2, 36168, 138618, 121-1950; 7159, GRHL3, 36174, 138624, 250-494; 7159, GRHL3, 36175, 138625, 47-205; 7159, GRHL3, 36170, 138620, 47-1870; 7159, GRHL3, 36171, 138621, 128-2008; 7159, GRHL3, 36172, 138622, 304-1974; 7159, GRHL3, 36173, 138623, 231-2039; 7160, GRAMD1A, 36178, 138628, 72-2495; 7160, GRAMD1A, 36179, 138629, 157-825; 7160, GRAMD1A, 36180, 138630, 24-641; 7160, GRAMD1A, 36176, 138626, 54-2195; 7160, GRAMD1A, 36177, 138627, 193-2367; 7161, GRAMD1B, 36181, 138631, 328-2544; 7161, GRAMD1B, 36185, 138635, 366-1689; 7161, GRAMD1B, 36187, 138637, 348-847; 7161, GRAMD1B, 36188, 138638, 65-577; 7161, GRAMD1B, 36189, 138639, 218-541; 7161, GRAMD1B, 36182, 138632, 694-1971; 7161, GRAMD1B, 36183, 138633, 514-2751; 7161, GRAMD1B, 36184, 138634, 364-2460; 7161, GRAMD1B, 36186, 138636, 328-2544; 7162, GRAMD1C, 36192, 138642, 30-650; 7162, GRAMD1C, 36193, 138643, 436-1576; 7162, GRAMD1C, 36194, 138644, 6-275; 7162, GRAMD1C, 36195, 138645, 97-1584; 7162, GRAMD1C, 36196, 138646, 435-567; 7162, GRAMD1C, 36190, 138640, 493-2481; 7162, GRAMD1C, 36191, 138641, 420-1793; 7163, GRAMD2, 36198, 138648, 122-556; 7163, GRAMD2, 36199, 138649, 98-241; 7163, GRAMD2, 36200, 138650, 116-623; 7163, GRAMD2, 36201, 138651, 32-664; 7163, GRAMD2, 36197, 138647, 15-1079; 7164, GRAMD3, 36203, 138653, 136-399; 7164, GRAMD3, 36204, 138654, 136-399; 7164, GRAMD3, 36205, 138655, 131-994; 7164, GRAMD3, 36208, 138658, 462-1694; 7164, GRAMD3, 36209, 138659, 343-1314; 7164, GRAMD3, 36202, 138652, 462-1760; 7164, GRAMD3, 36206, 138656, 81-1331; 7164, GRAMD3, 36207, 138657, 201-1544; 7164, GRAMD3, 36210, 138660, 450-1772; 7164, GRAMD3, 36211, 138661, 631-1617; 7165, GRAMD4, 36215, 138665, 1-669; 7165, GRAMD4, 36216, 138666, 212-311; 7165, GRAMD4, 36217, 138667, 117-375; 7165, GRAMD4, 36212, 138662, 40-1776; 7165, GRAMD4, 36213, 138663, 214-1950; 7165, GRAMD4, 36214, 138664, 97-402; 7166, GCA, 36218, 138668, 219-815; 7166, GCA, 36219, 138669, 252-691; 7166, GCA, 36221, 138671, 256-652; 7166, GCA, 36222, 138672, 1-440; 7166, GCA, 36223, 138673, 223-486; 7166, GCA, 36220, 138670, 162-815; 7167, GRN, 36225, 138675, 57-546; 7167, GRN, 36226, 138676, 118-526; 7167, GRN, 36227, 138677, 1-1166; 7167, GRN, 36228, 138678, 349-535; 7167, GRN, 36229, 138679, 317-763; 7167, GRN, 36230, 138680, 41-558; 7167, GRN, 36231, 138681, 213-546; 7167, GRN, 36232, 138682, 181-585; 7167, GRN, 36233, 138683, 41-614; 7167, GRN, 36234, 138684, 38-1348; 7167, GRN, 36235, 138685, 452-562; 7167, GRN, 36236, 138686, 1-332; 7167, GRN, 36237, 138687, 116-541; 7167, GRN, 36238, 138688, 29-598; 7167, GRN, 36224, 138674, 257-2038; 7168, GNLY, 36241, 138691, 1-561; 7168, GNLY, 36242, 138692, 62-580; 7168, GNLY, 36239, 138689, 129-566; 7168, GNLY, 36240, 138690, 283-675; 7169, GZMA, 36243, 138693, 36-824; 7170, GZMB, 36245, 138695, 108-716; 7170, GZMB, 36246, 138696, 1-609; 7170, GZMB, 36247, 138697, 99-806; 7170, GZMB, 36248, 138698, 1-108; 7170, GZMB, 36249, 138699, 37-309; 7170, GZMB, 36250, 138700, 64-198; 7170, GZMB, 36251, 138701, 1-273; 7170, GZMB, 36252, 138702, 1-459; 7170, GZMB, 36244, 138694, 108-851; 7171, GZMH, 36255, 138705, 55-402; 7171, GZMH, 36253, 138703, 46-786; 7171, GZMH, 36254, 138704, 87-569; 7172, GZMK, 36256, 138706, 71-865; 7173, GZMM, 36258, 138708, 152-808; 7173, GZMM, 36257, 138707, 38-811; 7174, GIGYF1, 36259, 138709, 1211-4318; 7175, GIGYF2, 36262, 138712, 263-4228; 7175, GIGYF2, 36265, 138715, 428-957; 7175, GIGYF2, 36266, 138716, 70-249; 7175, GIGYF2, 36267, 138717, 295-564; 7175, GIGYF2, 36268, 138718, 231-588; 7175, GIGYF2, 36269, 138719, 288-606; 7175, GIGYF2, 36270, 138720, 371-556; 7175, GIGYF2, 36271, 138721, 491-530; 7175, GIGYF2, 36272, 138722, 224-561; 7175, GIGYF2, 36273, 138723, 249-677; 7175, GIGYF2, 36274, 138724, 113-391; 7175, GIGYF2, 36275, 138725, 362-547; 7175, GIGYF2, 36276, 138726, 370-583; 7175, GIGYF2, 36277, 138727, 285-564; 7175, GIGYF2, 36278, 138728, 199-544; 7175, GIGYF2, 36279, 138729, 170-2329; 7175, GIGYF2, 36280, 138730, 290-588; 7175, GIGYF2, 36281, 138731, 151-2658; 7175, GIGYF2, 36282, 138732, 263-466; 7175, GIGYF2, 36283, 138733, 114-561; 7175, GIGYF2, 36284, 138734, 198-4163; 7175, GIGYF2, 36260, 138710, 196-4095; 7175, GIGYF2, 36261, 138711, 312-4211; 7175, GIGYF2, 36263, 138713, 99-3980; 7175, GIGYF2, 36264, 138714, 227-4189; 7176, GAREM, 36287, 138737, 1-110; 7176, GAREM, 36285, 138735, 5-2635; 7176, GAREM, 36286, 138736, 57-2684; 7177, GAREML, 36288, 138738, 1757-3751; 7177, GAREML, 36289, 138739, 131-2755; 7178, GAB1, 36292, 138742, 1-283; 7178, GAB1, 36293, 138743, 324-2099; 7178, GAB1, 36294, 138744, 214-743; 7178, GAB1, 36295, 138745, 1-275; 7178, GAB1, 36296, 138746, 438-582; 7178, GAB1, 36297, 138747, 12-728; 7178, GAB1, 36290, 138740, 303-2387; 7178, GAB1, 36291, 138741, 428-2602; 7179, GAB2, 36300, 138750, 262-567; 7179, GAB2, 36301, 138751, 152-543; 7179, GAB2, 36298, 138748, 161-2077; 7179, GAB2, 36299, 138749, 87-2117; 7180, GAB3, 36305, 138755, 1-450; 7180, GAB3, 36302, 138752, 49-1695; 7180, GAB3, 36303, 138753, 33-1793; 7180, GAB3, 36304, 138754, 53-1816; 7181, GAB4, 36307, 138757, 1-575; 7181, GAB4, 36306, 138756, 109-1833; 7182, GAPT, 36310, 138760, 563-769; 7182, GAPT, 36311, 138761, 526-731; 7182, GAPT, 36308, 138758, 298-771; 7182, GAPT, 36309, 138759, 463-936; 7183, GRAP, 36313, 138763, 172-738; 7183, GRAP, 36314, 138764, 72-689; 7183, GRAP, 36315, 138765, 35-346; 7183, GRAP, 36312, 138762, 712-1365; 7184, GRAP2, 36318, 138768, 278-568; 7184, GRAP2, 36316, 138766, 264-1256; 7184, GRAP2, 36317, 138767, 291-1283; 7185, GRAPL, 36320, 138770, 1-196; 7185, GRAPL, 36321, 138771, 1-53; 7185, GRAPL, 36322, 138772, 180-391; 7185, GRAPL, 36323, 138773, 86-388; 7185, GRAPL, 36319, 138769, 152-508; 7186, GREM1, 36327, 138777, 160-288; 7186, GREM1, 36329, 138779, 160-591; 7186, GREM1, 36330, 138780, 160-288; 7186, GREM1, 36331, 138781, 190-744; 7186, GREM1, 36324, 138774, 160-714; 7186, GREM1, 36325, 138775, 160-591; 7186, GREM1, 36326, 138776, 160-591; 7186, GREM1, 36328, 138778, 190-744; 7187, GREM2, 36332, 138782, 268-774; 7188, GRSF1, 36334, 138784, 1-1253; 7188, GRSF1, 36336, 138786, 1-1362; 7188, GRSF1, 36337, 138787, 1-345; 7188, GRSF1, 36338, 138788, 54-1328; 7188, GRSF1, 36333, 138783, 119-1561; 7188, GRSF1, 36335, 138785, 263-1219; 7189, GCOM1, 36339, 138789, 3-1340; 7189, GCOM1, 36340, 138790, 128-1780; 7189, GCOM1, 36341, 138791, 3-1403; 7189, GCOM1, 36342, 138792, 3-1196; 7189, GCOM1, 36343, 138793, 3-1310; 7189, GCOM1, 36344, 138794, 3-1142; 7189, GCOM1, 36345, 138795, 3-1250; 7189, GCOM1, 36346, 138796, 3-1247; 7189, GCOM1, 36347, 138797, 3-1319; 7189, GCOM1, 36348, 138798, 3-1175; 7189, GCOM1, 36349, 138799, 3-1226; 7189, GCOM1, 36350, 138800, 22-2319; 7190, GCC1, 36351, 138801, 426-2753; 7191, GCC2, 36353, 138803, 1-744; 7191, GCC2, 36354, 138804, 160-2908; 7191, GCC2, 36355, 138805, 45-786; 7191, GCC2, 36356, 138806, 1-263; 7191, GCC2, 36358, 138808, 1-441; 7191, GCC2, 36359, 138809, 1-383; 7191, GCC2, 36360, 138810, 288-2339; 7191, GCC2, 36352, 138802, 715-5769; 7191, GCC2, 36357, 138807, 36-173; 7192, GRIPAP1, 36362, 138812, 6-2438; 7192, GRIPAP1, 36363, 138813, 21-2411; 7192, GRIPAP1, 36364, 138814, 485-553; 7192, GRIPAP1, 36365, 138815, 323-531; 7192, GRIPAP1, 36366, 138816, 1-184; 7192, GRIPAP1, 36367, 138817, 1-904; 7192, GRIPAP1, 36368, 138818, 5-367; 7192, GRIPAP1, 36361, 138811, 36-2561; 7193, GC, 36371, 138821, 48-1094; 7193, GC, 36372, 138822, 29-1459; 7193, GC, 36373, 138823, 128-562; 7193, GC, 36369, 138819, 345-1769; 7193, GC, 36370, 138820, 96-1577; 7194, GADD45A, 36376, 138826, 319-501; 7194, GADD45A, 36374, 138824, 295-690; 7194, GADD45A, 36375, 138825, 435-932; 7195, GADD45B, 36378, 138828, 214-396; 7195, GADD45B, 36379, 138829, 212-742; 7195, GADD45B, 36380, 138830, 175-373; 7195, GADD45B, 36381, 138831, 78-276; 7195, GADD45B, 36377, 138827, 233-715; 7196, GADD45G, 36383, 138833, 396-821; 7196, GADD45G, 36382, 138832, 110-589; 7197, GADD45GIP1, 36384, 138834, 25-693; 7198, GAS1, 36385, 138835, 411-1448; 7199, GAS2, 36389, 138839, 193-736; 7199, GAS2, 36390, 138840, 115-579; 7199, GAS2, 36391, 138841, 140-547; 7199, GAS2, 36392, 138842, 98-712; 7199, GAS2, 36386, 138836, 249-1190; 7199, GAS2, 36387, 138837, 306-1247; 7199, GAS2, 36388, 138838, 249-674; 7199, GAS2, 36393, 138843, 249-674; 7200, GAS2L1, 36395, 138845, 140-569; 7200, GAS2L1, 36396, 138846, 331-745; 7200, GAS2L1, 36397, 138847, 150-2195; 7200, GAS2L1, 36398, 138848, 592-2637; 7200, GAS2L1, 36399, 138849, 149-2194; 7200, GAS2L1, 36400, 138850, 1049-3094; 7200, GAS2L1, 36394, 138844, 151-1515; 7200, GAS2L1, 36401, 138851, 133-1146; 7201, GAS2L2, 36402, 138852, 29-2623; 7201, GAS2L2, 36404, 138854, 29-670; 7201, GAS2L2, 36403, 138853, 29-2671; 7202, GAS2L3, 36407, 138857, 955-2727; 7202, GAS2L3, 36408, 138858, 420-567; 7202, GAS2L3, 36410, 138860, 1-1176; 7202, GAS2L3, 36405, 138855, 134-2218; 7202, GAS2L3, 36406, 138856, 132-2216; 7202, GAS2L3, 36409, 138859, 227-2311; 7203, GAS6, 36411, 138861, 148-2184; 7204, GAS7, 36413, 138863, 146-691; 7204, GAS7, 36417, 138867, 194-732; 7204, GAS7, 36418, 138868, 171-554; 7204, GAS7, 36420, 138870, 226-544; 7204, GAS7, 36422, 138872, 157-393; 7204, GAS7, 36424, 138874, 134-556; 7204, GAS7, 36412, 138862, 164-1414; 7204, GAS7, 36414, 138864, 162-1592; 7204, GAS7, 36415, 138865, 146-1384; 7204, GAS7, 36416, 138866, 169-1407; 7204, GAS7, 36419, 138869, 115-1353; 7204, GAS7, 36421, 138871, 157-1167; 7204, GAS7, 36423, 138873, 312-1562; 7205, GAS8, 36427, 138877, 40-147; 7205, GAS8, 36428, 138878, 199-550; 7205, GAS8, 36429, 138879, 194-479; 7205, GAS8, 36430, 138880, 70-405; 7205, GAS8, 36431, 138881, 307-486; 7205, GAS8, 36432, 138882, 495-1682; 7205, GAS8, 36425, 138875, 123-1559; 7205, GAS8, 36426, 138876, 213-1574; 7206, GAP43, 36433, 138883, 367-1083; 7206, GAP43, 36434, 138884, 469-1293; 7207, GDF1, 36435, 138885, 1347-2465; 7208, GDF10, 36436, 138886, 267-1703; 7209, GDF11, 36438, 138888, 1-1142; 7209, GDF11, 36437, 138887, 38-1261; 7210, GDF15, 36440, 138890, 544-562; 7210, GDF15, 36441, 138891, 552-890; 7210, GDF15, 36439, 138889, 33-959; 7211, GDF2, 36442, 138892, 180-1469; 7212, GDF3, 36443, 138893, 49-1143; 7213, GDF5, 36444, 138894, 316-1821; 7213, GDF5, 36445, 138895, 505-2010; 7214, GDF5OS, 36446, 138896, 443-1195; 7215, GDF6, 36448, 138898, 28-843; 7215, GDF6, 36449, 138899, 25-1086; 7215, GDF6, 36447, 138897, 101-1468; 7216, GDF7, 36450, 138900, 577-1929; 7217, GDF9, 36451, 138901, 291-1391; 7217, GDF9, 36453, 138903, 434-1534; 7217, GDF9, 36454, 138904, 318-1418; 7217, GDF9, 36455, 138905, 294-1394; 7217, GDF9, 36452, 138902, 868-2232; 7218, GFI1, 36456, 138906, 251-1519; 7218, GFI1, 36457, 138907, 320-1588; 7218, GFI1, 36458, 138908, 158-1426; 7219, GFI1B, 36459, 138909, 820-1812; 7219, GFI1B, 36460, 138910, 168-1160; 7219, GFI1B, 36461, 138911, 23-877; 7220, GRB10, 36472, 138922, 1-327; 7220, GRB10, 36473, 138923, 390-733; 7220, GRB10, 36462, 138912, 533-2143; 7220, GRB10, 36463, 138913, 32-1678; 7220, GRB10, 36464, 138914, 286-1896; 7220, GRB10, 36465, 138915, 32-1816; 7220, GRB10, 36466, 138916, 297-1907; 7220, GRB10, 36467, 138917, 266-1876; 7220, GRB10, 36468, 138918, 486-2096; 7220, GRB10, 36469, 138919, 782-2548; 7220, GRB10, 36470, 138920, 337-1947; 7220, GRB10, 36471, 138921, 471-2255; 7221, GRB14, 36475, 138925, 122-587; 7221, GRB14, 36476, 138926, 189-1435; 7221, GRB14, 36474, 138924, 540-2162; 7222, GRB2, 36482, 138932, 253-584; 7222, GRB2, 36483, 138933, 1-128; 7222, GRB2, 36484, 138934, 176-646; 7222, GRB2, 36477, 138927, 359-889; 7222, GRB2, 36478, 138928, 303-956; 7222, GRB2, 36479, 138929, 784-1437; 7222, GRB2, 36480, 138930, 29-559; 7222, GRB2, 36481, 138931, 237-890; 7223, GRB7, 36490, 138940, 223-381; 7223, GRB7, 36491, 138941, 258-612; 7223, GRB7, 36485, 138935, 258-1856; 7223, GRB7, 36486, 138936, 51-1394; 7223, GRB7, 36487, 138937, 266-1864; 7223, GRB7, 36488, 138938, 107-1705; 7223, GRB7, 36489, 138939, 136-1803; 7224, GFER, 36493, 138943, 4-396; 7224, GFER, 36494, 138944, 1-420; 7224, GFER, 36495, 138945, 13-342; 7224, GFER, 36492, 138942, 7-624; 7225, GH1, 36497, 138947, 63-431; 7225, GH1, 36500, 138950, 63-155; 7225, GH1, 36496, 138946, 44-697; 7225, GH1, 36498, 138948, 43-576; 7225, GH1, 36499, 138949, 42-650; 7226, GH2, 36505, 138955, 63-596; 7226, GH2, 36501, 138951, 135-905; 7226, GH2, 36502, 138952, 42-779; 7226, GH2, 36503, 138953, 63-716; 7226, GH2, 36504, 138954, 42-650; 7227, GHITM, 36507, 138957, 132-1091; 7227, GHITM, 36506, 138956, 194-1231; 7228, GHR, 36510, 138960, 20-277; 7228, GHR, 36511, 138961, 93-281; 7228, GHR, 36517, 138967, 138-2075; 7228, GHR, 36518, 138968, 12-899; 7228, GHR, 36508, 138958, 191-2107; 7228, GHR, 36509, 138959, 12-1862; 7228, GHR, 36512, 138962, 49-1965; 7228, GHR, 36513, 138963, 444-2360; 7228, GHR, 36514, 138964, 329-2245; 7228, GHR, 36515, 138965, 154-2070; 7228, GHR, 36516, 138966, 121-2037; 7229, GRTP1, 36522, 138972, 98-808; 7229, GRTP1, 36519, 138969, 9-809; 7229, GRTP1, 36520, 138970, 98-1132; 7229, GRTP1, 36521, 138971, 76-1086; 7230, GHRH, 36523, 138973, 8-334; 7230, GHRH, 36524, 138974, 1-324; 7230, GHRH, 36525, 138975, 113-439; 7231, GHRHR, 36527, 138977, 259-465; 7231, GHRHR, 36528, 138978, 259-696; 7231, GHRHR, 36529, 138979, 438-893; 7231, GHRHR, 36530, 138980, 259-1338; 7231, GHRHR, 36531, 138981, 131-754; 7231, GHRHR, 36526, 138976, 47-1318; 7232, GHSR, 36532, 138982, 44-1144; 7232, GHSR, 36533, 138983, 43-912; 7233, GREB1, 36538, 138988, 312-1073; 7233, GREB1, 36540, 138990, 430-2052; 7233, GREB1, 36541, 138991, 200-438; 7233, GREB1, 36534, 138984, 263-6112; 7233, GREB1, 36535, 138985, 428-1657; 7233, GREB1, 36536, 138986, 252-1625; 7233, GREB1, 36537, 138987, 301-6150; 7233, GREB1, 36539, 138989, 119-2962; 7234, GREB1L, 36544, 138994, 1-568; 7234, GREB1L, 36545, 138995, 1-598; 7234, GREB1L, 36546, 138996, 1-528; 7234, GREB1L, 36542, 138992, 156-5600; 7234, GREB1L, 36543, 138993, 272-6043; 7234, GREB1L, 36547, 138997, 382-6153; 7235, GRASP, 36549, 138999, 131-794; 7235, GRASP, 36548, 138998, 81-1268; 7235, GRASP, 36550, 139000, 242-1000; 7236, GRPEL1, 36551, 139001, 166-819; 7237, GRPEL2, 36554, 139004, 111-497; 7237, GRPEL2, 36552, 139002, 111-788; 7237, GRPEL2, 36553, 139003, 39-407; 7238, GSX1, 36555, 139005, 49-843; 7239, GSX2, 36557, 139007, 173-577; 7239, GSX2, 36556, 139006, 315-1229; 7239, GSX2, 36558, 139008, 315-1229; 7240, N/A, 36559, 139009, 1-35; 7241, N/A, 36560, 139010, 121-501; 7242, N/A, 36561, 139011, 1-79; 7243, GSE1, 36565, 139015, 1-2960; 7243, GSE1, 36566, 139016, 241-872; 7243, GSE1, 36567, 139017, 1-1259; 7243, GSE1, 36562, 139012, 177-3830; 7243, GSE1, 36563, 139013, 41-3475; 7243, GSE1, 36564, 139014, 210-3551; 7244, GSG1L, 36572, 139022, 1-529; 7244, GSG1L, 36568, 139018, 167-697; 7244, GSG1L, 36569, 139019, 78-920; 7244, GSG1L, 36570, 139020, 86-1081; 7244, GSG1L, 36571, 139021, 1-585; 7245, GSG1L2, 36573, 139023, 1-882; 7246, GSKIP, 36579, 139026, 268-501; 7246, GSKIP, 36579, 139029, 35-361; 7246, GSKIP, 36574, 139024, 119-538; 7246, GSKIP, 36575, 139025, 195-614; 7246, GSKIP, 36577, 139027, 1813-2232; 7246, GSKIP, 36578, 139028, 113-532; 7247, GTF2H2C, 36581, 139031, 144-299; 7247, GTF2H2C, 36582, 139032, 191-562; 7247, GTF2H2C, 36584, 139034, 166-321; 7247, GTF2H2C, 36585, 139035, 69-566; 7247, GTF2H2C, 36586, 139036, 52-330; 7247, GTF2H2C, 36587, 139037, 12-772; 7247, GTF2H2C, 36588, 139038, 54-209; 7247, GTF2H2C, 36580, 139030, 289-1476; 7247, GTF2H2C, 36583, 139033, 196-1383; 7248, GTF2H2C_2, 36590, 139040, 68-565; 7248, GTF2H2C_2, 36591, 139041, 144-299; 7248, GTF2H2C_2, 36592, 139042, 54-209; 7248, GTF2H2C_2, 36589, 139039, 169-1356; 7248, GTF2H2C_2, 36593, 139043, 289-1476; 7249, GTF2IRD1, 36597, 139047, 1-824; 7249, GTF2IRD1, 36598, 139048, 1692-4574; 7249, GTF2IRD1, 36594, 139044, 394-3273; 7249, GTF2IRD1, 36595, 139045, 214-3144; 7249, GTF2IRD1, 36596, 139046, 75-2909; 7250, GTF2IRD2, 36599, 139049, 191-3040; 7250, GTF2IRD2, 36601, 139051, 180-1673; 7250, GTF2IRD2, 36600, 139050, 169-495; 7251, GTF2IRD2B, 36603, 139053, 180-1493; 7251, GTF2IRD2B, 36605, 139055, 172-498; 7251, GTF2IRD2B, 36606, 139056, 180-1673; 7251, GTF2IRD2B, 36602, 139052, 160-840; 7251, GTF2IRD2B, 36604, 139054, 191-3040; 7252, GTPBP1, 36608, 139058, 1-1050; 7252, GTPBP1, 36609, 139059, 8-220; 7252, GTPBP1, 36610, 139060, 1-122; 7252, GTPBP1, 36611, 139061, 323-582; 7252, GTPBP1, 36612, 139062, 1-92; 7252, GTPBP1, 36613, 139063, 389-505; 7252, GTPBP1, 36614, 139064, 128-585; 7252, GTPBP1, 36615, 139065, 1-273; 7252, GTPBP1, 36607, 139057, 234-2243; 7253, GTPBP2, 36618, 139068, 1-460; 7253, GTPBP2, 36619, 139069, 1-463; 7253, GTPBP2, 36620, 139070, 1-681; 7253, GTPBP2, 36621, 139071, 1-946; 7253, GTPBP2, 36622, 139072, 1-318; 7253, GTPBP2, 36616, 139066, 1-1809; 7253, GTPBP2, 36617, 139067, 154-1698; 7254, GTPBP3, 36626, 139076, 25-159; 7254, GTPBP3, 36627, 139077, 42-347; 7254, GTPBP3, 36628, 139078, 21-704; 7254, GTPBP3, 36629, 139079, 5-382; 7254, GTPBP3, 36630, 139080, 54-509; 7254, GTPBP3, 36623, 139073, 69-1547; 7254, GTPBP3, 36624, 139074, 58-1632; 7254, GTPBP3, 36625, 139075, 85-1629; 7254, GTPBP3, 36631, 139081, 58-1473; 7255, GTPBP4, 36632, 139082, 337-756; 7255, GTPBP4, 36633, 139083, 462-2366; 7256, GTPBP6, 36634, 139084, 33-1583; 7257, GEM, 36637, 139087, 83-363; 7257, GEM, 36635, 139085, 266-1156; 7257, GEM, 36636, 139086, 156-1046; 7258, GCH1, 36638, 139088, 162-914; 7258, GCH1, 36639, 139089, 190-942; 7258, GCH1, 36640, 139090, 145-846; 7258, GCH1, 36641, 139091, 154-795; 7258, GCH1, 36642, 139092, 162-914; 7259, GCHFR, 36644, 139094, 223-426; 7259, GCHFR, 36646, 139096, 78-212; 7259, GCHFR, 36647, 139097, 199-402; 7259, GCHFR, 36648, 139098, 59-100; 7259, GCHFR, 36643, 139093, 162-416; 7259, GCHFR, 36645, 139095, 55-276; 7260, G3BP1, 36652, 139102, 440-754; 7260, G3BP1, 36654, 139104, 133-577; 7260, G3BP1, 36655, 139105, 184-297; 7260, G3BP1, 36656, 139106, 179-530; 7260, G3BP1, 36657, 139107, 102-215; 7260, G3BP1, 36658, 139108, 163-624; 7260, G3BP1, 36659, 139109, 218-535; 7260, G3BP1, 36660, 139110, 1-114; 7260, G3BP1, 36649, 139099, 144-1544; 7260, G3BP1, 36650, 139100, 146-1546; 7260, G3BP1, 36651, 139101, 133-501; 7260, G3BP1, 36653, 139103, 133-501; 7261, G3BP2, 36664, 139114, 275-573; 7261, G3BP2, 36665, 139115, 261-567; 7261, G3BP2, 36666, 139116, 160-584; 7261, G3BP2, 36667, 139117, 341-508; 7261, G3BP2, 36668, 139118, 378-554; 7261, G3BP2, 36669, 139119, 231-577; 7261, G3BP2, 36670, 139120, 327-559; 7261, G3BP2, 36671, 139121, 477-1071; 7261, G3BP2, 36672, 139122, 229-560; 7261, G3BP2, 36673, 139123, 140-514; 7261, G3BP2, 36674, 139124, 1-72; 7261, G3BP2, 36661, 139111, 219-1568; 7261, G3BP2, 36662, 139112, 787-2235; 7261, G3BP2, 36663, 139113, 121-1569; 7262, GAPVD1, 36675, 139125, 113-2002; 7262, GAPVD1, 36678, 139128, 150-4388; 7262, GAPVD1, 36679, 139129, 330-1823; 7262, GAPVD1, 36682, 139132, 1-2490; 7262, GAPVD1, 36683, 139133, 1-2512; 7262, GAPVD1, 36684, 139134, 199-3163; 7262, GAPVD1, 36685, 139135, 232-582; 7262, GAPVD1, 36688, 139138, 199-2469; 7262, GAPVD1, 36676, 139126, 248-4630; 7262, GAPVD1, 36677, 139127, 1-4320; 7262, GAPVD1, 36680, 139130, 37-4473; 7262, GAPVD1, 36681, 139131, 161-4624; 7262, GAPVD1, 36686, 139136, 291-4727; 7262, GAPVD1, 36687, 139137, 161-4462; 7263, GARNL3, 36689, 139139, 10-2418; 7263, GARNL3, 36691, 139141, 95-241; 7263, GARNL3, 36693, 139143, 78-224; 7263, GARNL3, 36694, 139144, 129-395; 7263, GARNL3, 36695, 139145, 103-905; 7263, GARNL3, 36696, 139146, 250-667; 7263, GARNL3, 36697, 139147, 331-831; 7263, GARNL3, 36698, 139148, 194-523; 7263, GARNL3, 36699, 139149, 1-245; 7263, GARNL3, 36690, 139140, 353-3394; 7263, GARNL3, 36692, 139142, 331-3306; 7264, GIMAP1, 36700, 139150, 141-1061; 7265, GIMAP2, 36702, 139152, 68-199; 7265, GIMAP2, 36701, 139151, 95-1108; 7266, GIMAP4, 36704, 139154, 100-552; 7266, GIMAP4, 36705, 139155, 84-1115; 7266, GIMAP4, 36703, 139153, 176-1165; 7267, GIMAP5, 36707, 139157, 329-1252; 7267, GIMAP5, 36706, 139156, 368-1291; 7268, GIMAP6, 36710, 139160, 481-1569; 7268, GIMAP6, 36708, 139158, 218-1096; 7268, GIMAP6, 36709, 139159, 179-367; 7269, GIMAP7, 36711, 139161, 158-1060; 7270, GIMAP5, 36712, 139162, 575-2572; 7271, GTPBP10, 36716, 139166, 149-856; 7271, GTPBP10, 36717, 139167, 149-778; 7271, GTPBP10, 36718, 139168, 149-472; 7271, GTPBP10, 36719, 139169, 149-361; 7271, GTPBP10, 36720, 139170, 48-775; 7271, GTPBP10, 36721, 139171, 13-252; 7271, GTPBP10, 36713, 139163, 67-1230; 7271, GTPBP10, 36714, 139164, 78-1004; 7271, GTPBP10, 36715, 139165, 36-386; 7272, GTPBP8, 36725, 139175, 139-660; 7272, GTPBP8, 36726, 139176, 37-456; 7272, GTPBP8, 36727, 139177, 1089-1493; 7272, GTPBP8, 36729, 139179, 16-939; 7272, GTPBP8, 36730, 139180, 1-924; 7272, GTPBP8, 36722, 139172, 14-379; 7272, GTPBP8, 36723, 139173, 16-771; 7272, GTPBP8, 36724, 139174, 83-937; 7272, GTPBP8, 36728, 139178, 10-765; 7273, N/A, 36731, 139181, 37-951; 7274, N/A, 36732, 139182, 1-880; 7275, N/A, 36733, 139183, 37-951; 7276, N/A, 36734, 139184, 2-988; 7277, N/A, 36735, 139185, 2-988; 7278, N/A, 36736, 139186, 57-1253; 7278, N/A, 36737, 139187, 39-1088; 7279, GAMT, 36740, 139190, 1-327; 7279, GAMT, 36738, 139188, 68-778; 7279, GAMT, 36739, 139189, 95-904; 7280, GDA, 36743, 139193, 230-1411; 7280, GDA, 36744, 139194, 1-540; 7280, GDA, 36745, 139195, 109-694; 7280, GDA, 36746, 139196, 1-530; 7280, GDA, 36741, 139191, 210-1625; 7280, GDA, 36742, 139192, 94-1458; 7280, GDA, 36747, 139197, 86-1450; 7280, GDA, 36748, 139198, 339-1481; 7281, GMPS, 36749, 139199, 222-2006; 7281, GMPS, 36750, 139200, 336-2417; 7282, GNA12, 36753, 139203, 253-1170; 7282, GNA12, 36754, 139204, 329-559; 7282, GNA12, 36751, 139201, 164-1309; 7282, GNA12, 36752, 139202, 330-1298; 7283, GNA11, 36756, 139206, 1-710; 7283, GNA11, 36757, 139207, 1-217; 7283, GNA11, 36755, 139205, 243-1322; 7284, GNA13, 36758, 139208, 247-1380; 7284, GNA13, 36759, 139209, 185-1033; 7285, GNA14, 36760, 139210, 515-1582; 7286, GNA15, 36762, 139212, 10-168; 7286, GNA15, 36761, 139211, 259-1383; 7287, GNAO1, 36765, 139215, 462-847; 7287, GNAO1, 36766, 139216, 1-285; 7287, GNAO1, 36767, 139217, 294-543; 7287, GNAO1, 36768, 139218, 161-492; 7287, GNAO1, 36769, 139219, 262-426; 7287, GNAO1, 36763, 139213, 847-1911; 7287, GNAO1, 36764, 139214, 261-1325; 7288, GNAL, 36774, 139224, 1-164; 7288, GNAL, 36775, 139225, 86-623; 7288, GNAL, 36776, 139226, 151-585; 7288, GNAL, 36770, 139220, 302-1447; 7288, GNAL, 36771, 139221, 609-1985; 7288, GNAL, 36772, 139222, 322-1467; 7288, GNAL, 36773, 139223, 140-1285; 7288, GNAL, 36777, 139227, 477-1001; 7289, GNAI1, 36779, 139229, 447-571; 7289, GNAI1, 36780, 139230, 174-607; 7289, GNAI1, 36781, 139231, 472-539; 7289, GNAI1, 36778, 139228, 374-1438; 7289, GNAI1, 36782, 139232, 357-1265; 7290, GNAI2, 36785, 139235, 133-561; 7290, GNAI2, 36787, 139237, 388-828; 7290, GNAI2, 36783, 139233, 262-1173; 7290, GNAI2, 36784, 139234, 385-1452; 7290, GNAI2, 36786, 139236, 344-1255; 7290, GNAI2, 36788, 139238, 176-1132; 7290, GNAI2, 36789, 139239, 833-1852; 7291, GNAI3, 36790, 139240, 111-

1175; 7292, GNAT1, 36793, 139243, 90-479; 7292, GNAT1, 36791, 139241, 115-1167; 7292, GNAT1, 36792, 139242, 57-1109; 7293, GNAT2, 36795, 139245, 96-466; 7293, GNAT2, 36794, 139244, 188-1252; 7294, GNAZ, 36796, 139246, 660-1727; 7295, GNB5, 36800, 139250, 22-402; 7295, GNB5, 36801, 139251, 1-312; 7295, GNB5, 36802, 139252, 95-397; 7295, GNB5, 36797, 139247, 67-1254; 7295, GNB5, 36798, 139248, 123-1184; 7295, GNB5, 36799, 139249, 9-860; 7296, GNB1, 36804, 139254, 188-684; 7296, GNB1, 36805, 139255, 113-602; 7296, GNB1, 36806, 139256, 101-423; 7296, GNB1, 36808, 139258, 548-1270; 7296, GNB1, 36803, 139253, 333-1355; 7296, GNB1, 36807, 139257, 345-1367; 7297, GNB1L, 36812, 139262, 422-702; 7297, GNB1L, 36809, 139259, 238-1221; 7297, GNB1L, 36810, 139260, 238-876; 7297, GNB1L, 36811, 139261, 422-1405; 7298, GNB2, 36816, 139266, 251-1141; 7298, GNB2, 36817, 139267, 214-910; 7298, GNB2, 36819, 139269, 134-887; 7298, GNB2, 36821, 139271, 242-1132; 7298, GNB2, 36822, 139272, 90-545; 7298, GNB2, 36813, 139263, 483-1505; 7298, GNB2, 36814, 139264, 129-1151; 7298, GNB2, 36815, 139265, 246-1268; 7298, GNB2, 36818, 139268, 199-921; 7298, GNB2, 36820, 139270, 80-802; 7299, GNB2L1, 36823, 139273, 104-925; 7299, GNB2L1, 36824, 139274, 117-236; 7299, GNB2L1, 36825, 139275, 105-697; 7299, GNB2L1, 36826, 139276, 103-685; 7299, GNB2L1, 36827, 139277, 1-416; 7299, GNB2L1, 36828, 139278, 751-1460; 7299, GNB2L1, 36829, 139279, 90-440; 7299, GNB2L1, 36830, 139280, 1-824; 7299, GNB2L1, 36831, 139281, 81-890; 7299, GNB2L1, 36832, 139282, 201-1100; 7299, GNB2L1, 36833, 139283, 107-587; 7299, GNB2L1, 36834, 139284, 1-250; 7299, GNB2L1, 36835, 139285, 103-546; 7299, GNB2L1, 36836, 139286, 94-1058; 7299, GNB2L1, 36837, 139287, 92-352; 7299, GNB2L1, 36838, 139288, 81-782; 7299, GNB2L1, 36839, 139289, 82-543; 7299, GNB2L1, 36840, 139290, 103-318; 7299, GNB2L1, 36841, 139291, 437-742; 7299, GNB2L1, 36843, 139293, 1-595; 7299, GNB2L1, 36844, 139294, 1-742; 7299, GNB2L1, 36845, 139295, 103-564; 7299, GNB2L1, 36842, 139292, 410-1363; 7300, GNB3, 36847, 139297, 91-1110; 7300, GNB3, 36848, 139298, 265-962; 7300, GNB3, 36849, 139299, 66-761; 7300, GNB3, 36850, 139300, 70-180; 7300, GNB3, 36851, 139301, 3-796; 7300, GNB3, 36846, 139296, 406-1428; 7301, GNB4, 36854, 139304, 1-496; 7301, GNB4, 36855, 139305, 333-571; 7301, GNB4, 36852, 139302, 288-1310; 7301, GNB4, 36853, 139303, 212-1234; 7302, GNG10, 36856, 139306, 301-507; 7303, GNG11, 36857, 139307, 440-661; 7304, GNG12, 36858, 139308, 201-419; 7305, GNG13, 36859, 139309, 103-306; 7306, GNG2, 36861, 139311, 324-479; 7306, GNG2, 36862, 139312, 151-483; 7306, GNG2, 36863, 139313, 108-221; 7306, GNG2, 36866, 139316, 113-421; 7306, GNG2, 36867, 139317, 125-310; 7306, GNG2, 36860, 139310, 407-622; 7306, GNG2, 36864, 139314, 340-555; 7306, GNG2, 36865, 139315, 216-431; 7306, GNG2, 36868, 139318, 96-311; 7306, GNG2, 36869, 139319, 138-353; 7306, GNG2, 36870, 139320, 728-943; 7307, GNL3, 36871, 139321, 260-487; 7308, GNG4, 36872, 139322, 91-318; 7308, GNG4, 36873, 139323, 217-444; 7308, GNG4, 36874, 139324, 455-682; 7308, GNG4, 36875, 139325, 329-556; 7308, GNG4, 36876, 139326, 102-329; 7309, GNG5, 36877, 139327, 475-681; 7309, GNG5, 36878, 139328, 341-547; 7310, GNG7, 36880, 139330, 347-457; 7310, GNG7, 36879, 139329, 199-405; 7311, GNG8, 36881, 139331, 4-216; 7312, GNGT1, 36884, 139334, 156-296; 7312, GNGT1, 36885, 139335, 255-395; 7312, GNGT1, 36886, 139336, 63-203; 7312, GNGT1, 36882, 139332, 149-373; 7312, GNGT1, 36883, 139333, 162-386; 7313, GNGT2, 36888, 139338, 91-357; 7313, GNGT2, 36887, 139337, 312-521; 7313, GNGT2, 36889, 139339, 264-473; 7313, GNGT2, 36890, 139340, 291-500; 7313, GNGT2, 36891, 139341, 396-605; 7313, GNGT2, 36892, 139342, 181-390; 7314, GNAQ, 36894, 139344, 42-551; 7314, GNAQ, 36893, 139343, 224-1303; 7315, GNAT3, 36895, 139345, 95-1159; 7316, GNL1, 36897, 139347, 1-1224; 7316, GNL1, 36899, 139349, 302-1094; 7316, GNL1, 36901, 139351, 1-198; 7316, GNL1, 36902, 139352, 302-1093; 7316, GNL1, 36903, 139353, 302-1093; 7316, GNL1, 36904, 139354, 302-1093; 7316, GNL1, 36906, 139356, 302-1093; 7316, GNL1, 36907, 139357, 302-1093; 7316, GNL1, 36910, 139360, 302-1093; 7316, GNL1, 36896, 139346, 972-2795; 7316, GNL1, 36898, 139348, 972-2795; 7316, GNL1, 36900, 139350, 972-2795; 7316, GNL1, 36905, 139355, 972-2795; 7316, GNL1, 36908, 139358, 972-2795; 7316, GNL1, 36909, 139359, 972-2795; 7316, GNL1, 36911, 139361, 972-2795; 7317, GNL2, 36913, 139363, 1-698; 7317, GNL2, 36912, 139362, 100-2295; 7318, GNL3, 36916, 139366, 144-547; 7318, GNL3, 36917, 139367, 279-567; 7318, GNL3, 36918, 139368, 62-478; 7318, GNL3, 36914, 139364, 211-1824; 7318, GNL3, 36915, 139365, 174-1823; 7319, GNL3L, 36919, 139369, 140-1888; 7319, GNL3L, 36920, 139370, 226-1974; 7320, GMPR, 36921, 139371, 115-1152; 7321, GMPR2, 36922, 139372, 174-1223; 7321, GMPR2, 36927, 139377, 1-265; 7321, GMPR2, 36928, 139378, 335-547; 7321, GMPR2, 36929, 139379, 1-419; 7321, GMPR2, 36930, 139380, 1-193; 7321, GMPR2, 36931, 139381, 299-565; 7321, GMPR2, 36932, 139382, 174-346; 7321, GMPR2, 36933, 139383, 1-510; 7321, GMPR2, 36935, 139385, 254-1255; 7321, GMPR2, 36936, 139386, 189-1136; 7321, GMPR2, 36937, 139387, 116-328; 7321, GMPR2, 36938, 139388, 249-476; 7321, GMPR2, 36939, 139389, 189-583; 7321, GMPR2, 36940, 139390, 149-601; 7321, GMPR2, 36941, 139391, 1-280; 7321, GMPR2, 36942, 139392, 1-209; 7321, GMPR2, 36943, 139393, 283-564; 7321, GMPR2, 36944, 139394, 159-877; 7321, GMPR2, 36945, 139395, 278-1561; 7321, GMPR2, 36946, 139396, 359-735; 7321, GMPR2, 36947, 139397, 403-1449; 7321, GMPR2, 36923, 139373, 462-1508; 7321, GMPR2, 36924, 139374, 142-1188; 7321, GMPR2, 36925, 139375, 300-1400; 7321, GMPR2, 36926, 139376, 66-1028; 7321, GMPR2, 36934, 139384, 383-1429; 7322, GBP1, 36948, 139398, 221-1999; 7323, GBP2, 36949, 139399, 270-2045; 7323, GBP2, 36950, 139400, 839-2614; 7324, GBP3, 36951, 139401, 178-606; 7324, GBP3, 36953, 139403, 1-411; 7324, GBP3, 36954, 139404, 118-990; 7324, GBP3, 36955, 139405, 1-656; 7324, GBP3, 36956, 139406, 143-433; 7324, GBP3, 36957, 139407, 231-599; 7324, GBP3, 36958, 139408, 234-509; 7324, GBP3, 36952, 139402, 222-2009; 7325, GBP4, 36959, 139409, 99-2021; 7326, GBP5, 36961, 139411, 3250-4699; 7326, GBP5, 36960, 139410, 129-1889; 7327, GBP7, 36962, 139412, 140-2056; 7328, GBP6, 36963, 139413, 94-1995; 7329, GUCY1A2, 36964, 139414, 391-2682; 7329, GUCY1A2, 36965, 139415, 97-2358; 7329, GUCY1A2, 36966, 139416, 470-2668; 7330, GUCY1A3, 36968, 139418, 874-2172; 7330, GUCY1A3, 36969, 139419, 304-720; 7330, GUCY1A3, 36972, 139422, 195-626; 7330, GUCY1A3, 36974, 139424, 366-614; 7330, GUCY1A3, 36977, 139427, 521-952; 7330, GUCY1A3, 36967, 139417, 210-2282; 7330, GUCY1A3, 36970, 139420, 374-2446; 7330, GUCY1A3, 36971, 139421, 521-2593; 7330, GUCY1A3, 36973, 139423, 442-2514; 7330, GUCY1A3, 36975, 139425, 383-2455; 7330, GUCY1A3, 36976, 139426, 305-

2179; 7331, GUCY1B3, 36980, 139430, 501-2285; 7331, GUCY1B3, 36981, 139431, 285-1940; 7331, GUCY1B3, 36983, 139433, 121-2046; 7331, GUCY1B3, 36984, 139434, 280-1935; 7331, GUCY1B3, 36978, 139428, 83-1942; 7331, GUCY1B3, 36979, 139429, 52-1812; 7331, GUCY1B3, 36982, 139432, 328-2127; 7332, GUCY2C, 36985, 139435, 138-3359; 7333, GUCY2D, 36986, 139436, 151-3462; 7334, GUCY2F, 36987, 139437, 293-3619; 7335, GUCA1A, 36991, 139441, 538-801; 7335, GUCA1A, 36992, 139442, 658-1275; 7335, GUCA1A, 36988, 139438, 616-1221; 7335, GUCA1A, 36989, 139439, 324-929; 7335, GUCA1A, 36990, 139440, 977-1582; 7336, GUCA1B, 36993, 139443, 97-699; 7337, GUCA1C, 36995, 139445, 1-591; 7337, GUCA1C, 36996, 139446, 5-490; 7337, GUCA1C, 36994, 139444, 134-763; 7338, GUCA2A, 36997, 139447, 7-354; 7339, GUCA2B, 36998, 139448, 31-369; 7340, GUK1, 37002, 139452, 35-634; 7340, GUK1, 37003, 139453, 69-797; 7340, GUK1, 37004, 139454, 2-709; 7340, GUK1, 37009, 139459, 6-656; 7340, GUK1, 37010, 139460, 48-865; 7340, GUK1, 37011, 139461, 253-1012; 7340, GUK1, 36999, 139449, 242-835; 7340, GUK1, 37000, 139450, 60-653; 7340, GUK1, 37001, 139451, 428-1021; 7340, GUK1, 37005, 139455, 97-690; 7340, GUK1, 37006, 139456, 14-739; 7340, GUK1, 37007, 139457, 201-794; 7340, GUK1, 37008, 139458, 76-732; 7341, GUCD1, 37014, 139464, 135-548; 7341, GUCD1, 37015, 139465, 391-773; 7341, GUCD1, 37017, 139467, 99-509; 7341, GUCD1, 37019, 139469, 111-1001; 7341, GUCD1, 37012, 139462, 181-900; 7341, GUCD1, 37013, 139463, 111-998; 7341, GUCD1, 37016, 139466, 192-914; 7341, GUCD1, 37018, 139468, 326-1045; 7342, GUF1, 37021, 139471, 130-426; 7342, GUF1, 37020, 139470, 195-2204; 7343, GULP1, 37026, 139476, 378-583; 7343, GULP1, 37031, 139481, 1-569; 7343, GULP1, 37032, 139482, 1-443; 7343, GULP1, 37022, 139472, 513-1427; 7343, GULP1, 37023, 139473, 715-1629; 7343, GULP1, 37024, 139474, 446-949; 7343, GULP1, 37025, 139475, 462-1376; 7343, GULP1, 37027, 139477, 748-1662; 7343, GULP1, 37028, 139478, 393-896; 7343, GULP1, 37029, 139479, 670-1545; 7343, GULP1, 37030, 139480, 299-904; 7344, GVQW1, 37033, 139483, 277-864; 7345, GVQW2, 37034, 139484, 103-429; 7346, GIN1, 37035, 139485, 96-1664; 7346, GIN1, 37036, 139486, 53-295; 7346, GIN1, 37037, 139487, 34-276; 7346, GIN1, 37038, 139488, 42-710; 7347, H1F0, 37039, 139489, 453-1037; 7348, H1FNT, 37040, 139490, 313-1080; 7349, H1FOO, 37041, 139491, 6-1046; 7349, H1FOO, 37042, 139492, 131-754; 7350, H1FX, 37043, 139493, 376-1017; 7351, HLX, 37045, 139495, 241-695; 7351, HLX, 37044, 139494, 459-1925; 7352, H2AFB1, 37046, 139496, 79-426; 7353, H2AFB2, 37047, 139497, 1-348; 7354, H2AFB3, 37048, 139498, 79-426; 7355, H2AFJ, 37051, 139501, 1-279; 7355, H2AFJ, 37049, 139499, 53-442; 7355, H2AFJ, 37050, 139500, 89-478; 7356, H2AFV, 37057, 139507, 112-342; 7356, H2AFV, 37058, 139508, 113-481; 7356, H2AFV, 37059, 139509, 70-192; 7356, H2AFV, 37052, 139502, 107-451; 7356, H2AFV, 37053, 139503, 93-479; 7356, H2AFV, 37054, 139504, 106-414; 7356, H2AFV, 37055, 139505, 51-323; 7356, H2AFV, 37056, 139506, 110-310; 7357, H2AFX, 37060, 139510, 56-487; 7357, H2AFX, 37061, 139511, 74-505; 7358, H2AFY, 37064, 139514, 202-804; 7358, H2AFY, 37066, 139516, 211-708; 7358, H2AFY, 37062, 139512, 173-1288; 7358, H2AFY, 37063, 139513, 184-1293; 7358, H2AFY, 37065, 139515, 595-1713; 7358, H2AFY, 37067, 139517, 133-1251; 7359, H2AFY2, 37069, 139519, 181-908; 7359, H2AFY2, 37068, 139518, 265-1383; 7360, H2AFZ, 37070, 139520, 219-605; 7361, H2BFM, 37072, 139522, 1-159; 7361, H2BFM, 37071, 139521, 29-493; 7361, H2BFM, 37073, 139523, 1-465; 7362, H2BFS, 37074, 139524, 51-431; 7363, H2BFWT, 37075, 139525, 28-555; 7363, H2BFWT, 37076, 139526, 1-528; 7364, H3F3A, 37078, 139528, 122-493; 7364, H3F3A, 37077, 139527, 376-786; 7364, H3F3A, 37079, 139529, 158-568; 7364, H3F3A, 37080, 139530, 345-755; 7365, H3F3B, 37082, 139532, 73-468; 7365, H3F3B, 37085, 139535, 114-392; 7365, H3F3B, 37086, 139536, 113-454; 7365, H3F3B, 37087, 139537, 133-586; 7365, H3F3B, 37081, 139531, 134-544; 7365, H3F3B, 37083, 139533, 145-555; 7365, H3F3B, 37084, 139534, 122-532; 7365, H3F3B, 37088, 139538, 113-523; 7366, H3F3C, 37089, 139539, 76-483; 7367, HMX1, 37091, 139541, 9-581; 7367, HMX1, 37092, 139542, 204-1325; 7367, HMX1, 37090, 139540, 204-1250; 7368, HMX2, 37093, 139543, 258-1079; 7369, HMX3, 37094, 139544, 90-1163; 7370, HR, 37097, 139547, 1-163; 7370, HR, 37095, 139545, 666-4070; 7370, HR, 37096, 139546, 1482-5051; 7371, HDHD2, 37099, 139549, 194-559; 7371, HDHD2, 37100, 139550, 145-309; 7371, HDHD2, 37101, 139551, 134-298; 7371, HDHD2, 37102, 139552, 132-569; 7371, HDHD2, 37103, 139553, 172-566; 7371, HDHD2, 37104, 139554, 189-353; 7371, HDHD2, 37105, 139555, 151-546; 7371, HDHD2, 37106, 139556, 173-569; 7371, HDHD2, 37107, 139557, 197-809; 7371, HDHD2, 37098, 139548, 154-933; 7372, HDHD3, 37108, 139558, 899-1654; 7372, HDHD3, 37109, 139559, 562-1317; 7373, HP, 37110, 139560, 115-960; 7373, HP, 37112, 139562, 28-1356; 7373, HP, 37114, 139564, 28-306; 7373, HP, 37115, 139565, 25-1068; 7373, HP, 37116, 139566, 28-695; 7373, HP, 37118, 139568, 1-448; 7373, HP, 37119, 139569, 16-280; 7373, HP, 37120, 139570, 1-1096; 7373, HP, 37121, 139571, 31-306; 7373, HP, 37122, 139572, 1-1213; 7373, HP, 37123, 139573, 98-943; 7373, HP, 37111, 139561, 59-1279; 7373, HP, 37113, 139563, 45-1088; 7373, HP, 37117, 139567, 62-1105; 7374, HPR, 37124, 139574, 101-946; 7374, HPR, 37126, 139576, 28-381; 7374, HPR, 37125, 139575, 33-1079; 7375, HRK, 37128, 139578, 1-57; 7375, HRK, 37127, 139577, 135-410; 7376, HARBI1, 37130, 139580, 492-717; 7376, HARBI1, 37131, 139581, 493-620; 7376, HARBI1, 37129, 139579, 249-1298; 7377, HRAS, 37143, 139593, 124-167; 7377, HRAS, 37132, 139582, 173-742; 7377, HRAS, 37133, 139583, 54-566; 7377, HRAS, 37134, 139584, 137-706; 7377, HRAS, 37135, 139585, 189-701; 7377, HRAS, 37136, 139586, 189-758; 7377, HRAS, 37137, 139587, 177-689; 7377, HRAS, 37138, 139588, 189-701; 7377, HRAS, 37139, 139589, 189-758; 7377, HRAS, 37140, 139590, 173-742; 7377, HRAS, 37141, 139591, 54-566; 7377, HRAS, 37142, 139592, 177-689; 7377, HRAS, 37144, 139594, 137-706; 7378, HAUS1, 37146, 139596, 17-259; 7378, HAUS1, 37147, 139597, 13-228; 7378, HAUS1, 37148, 139598, 1-284; 7378, HAUS1, 37149, 139599, 28-312; 7378, HAUS1, 37150, 139600, 7-291; 7378, HAUS1, 37151, 139601, 11-382; 7378, HAUS1, 37152, 139602, 35-357; 7378, HAUS1, 37145, 139595, 81-917; 7379, HAUS2, 37154, 139604, 36-317; 7379, HAUS2, 37155, 139605, 16-390; 7379, HAUS2, 37156, 139606, 7-294; 7379, HAUS2, 37157, 139607, 36-575; 7379, HAUS2, 37158, 139608, 36-251; 7379, HAUS2, 37160, 139610, 46-237; 7379, HAUS2, 37161, 139611, 40-321; 7379, HAUS2, 37162, 139612, 1-168; 7379, HAUS2, 37153, 139603, 64-771; 7379, HAUS2, 37159, 139609, 46-660; 7380, HAUS3, 37165, 139615, 481-580; 7380, HAUS3, 37167, 139617, 544-574; 7380, HAUS3, 37163, 139613, 231-2042; 7380, HAUS3, 37164, 139614, 533-2344; 7380, HAUS3, 37166, 139616, 750-2219; 7381, HAUS4, 37172, 139622, 1-435; 7381, HAUS4, 37173, 139623, 1-443; 7381, HAUS4, 37174, 139624, 601-652; 7381, HAUS4, 37176, 139626, 102-582; 7381, HAUS4, 37177, 139627, 269-1107; 7381, HAUS4, 37180, 139630, 422-983; 7381, HAUS4, 37181, 139631, 122-578; 7381, HAUS4, 37168, 139618, 254-1345; 7381, HAUS4, 37169, 139619, 229-1185; 7381, HAUS4, 37170, 139620, 426-1139; 7381, HAUS4, 37171, 139621, 250-1341; 7381, HAUS4, 37175, 139625, 415-1371; 7381, HAUS4, 37178, 139628, 234-1190; 7381, HAUS4, 37179, 139629, 431-1150; 7382, HAUS5, 37184, 139634, 1-507; 7382, HAUS5, 37185, 139635, 33-302; 7382, HAUS5, 37186, 139636, 25-207; 7382, HAUS5, 37182, 139632, 26-1927; 7382, HAUS5, 37183, 139633, 52-924; 7383, HAUS6, 37187, 139637, 16-2424; 7383, HAUS6, 37189, 139639, 130-680; 7383, HAUS6, 37188, 139638, 469-3336; 7384, HAUS7, 37190, 139640, 732-1115; 7384, HAUS7, 37192, 139642, 1-635; 7384, HAUS7, 37193, 139643, 31-414; 7384, HAUS7, 37191, 139641, 45-1151; 7385, HAUS8, 37197, 139647, 1-120; 7385, HAUS8, 37198, 139648, 23-298; 7385, HAUS8, 37194, 139644, 192-1424; 7385, HAUS8, 37195, 139645, 204-1433; 7385, HAUS8, 37196, 139646, 2020-3069; 7386, HBS1L, 37199, 139649, 113-760; 7386, HBS1L, 37200, 139650, 110-553; 7386, HBS1L, 37204, 139654, 129-1988; 7386, HBS1L, 37205, 139655, 202-629; 7386, HBS1L, 37206, 139656, 42-544; 7386, HBS1L, 37207, 139657, 1-224; 7386, HBS1L, 37208, 139658, 1-1665; 7386, HBS1L, 37209, 139659, 127-551; 7386, HBS1L, 37210, 139660, 162-518; 7386, HBS1L, 37211, 139661, 406-1968; 7386, HBS1L, 37212, 139662, 1-512; 7386, HBS1L, 37213, 139663, 153-881; 7386, HBS1L, 37201, 139651, 194-2092; 7386, HBS1L, 37202, 139652, 129-2057; 7386, HBS1L, 37203, 139653, 208-2262; 7387, HCK, 37214, 139664, 184-309; 7387, HCK, 37215, 139665, 165-1745; 7387, HCK, 37216, 139666, 229-1806; 7387, HCK, 37217, 139667, 184-369; 7387, HCK, 37221, 139671, 238-1818; 7387, HCK, 37218, 139668, 228-1742; 7387, HCK, 37219, 139669, 247-1764; 7387, HCK, 37220, 139670, 365-1882; 7387, HCK, 37222, 139672, 311-1828; 7388, HAX1, 37224, 139674, 57-822; 7388, HAX1, 37227, 139677, 178-633; 7388, HAX1, 37223, 139673, 214-1053; 7388, HAX1, 37225, 139675, 105-680; 7388, HAX1, 37226, 139676, 136-831; 7388, HAX1, 37228, 139678, 116-979; 7389, HS1BP3, 37230, 139680, 16-657; 7389, HS1BP3, 37231, 139681, 22-621; 7389, HS1BP3, 37232, 139682, 1-224; 7389, HS1BP3, 37233, 139683, 472-841; 7389, HS1BP3, 37234, 139684, 1-399; 7389, HS1BP3, 37235, 139685, 1-334; 7389, HS1BP3, 37236, 139686, 1-78; 7389, HS1BP3, 37229, 139679, 27-1205; 7390, HDDC2, 37240, 139690, 147-470; 7390, HDDC2, 37241, 139691, 6-332; 7390, HDDC2, 37237, 139687, 43-258; 7390, HDDC2, 37238, 139688, 44-658; 7390, HDDC2, 37239, 139689, 27-242; 7391, HDDC3, 37244, 139694, 1-457; 7391, HDDC3, 37245, 139695, 11-442; 7391, HDDC3, 37242, 139692, 7-429; 7391, HDDC3, 37243, 139693, 30-569; 7392, HECA, 37246, 139696, 286-1917; 7393, HAND1, 37247, 139697, 257-904; 7394, HAND2, 37249, 139699, 1-277; 7394, HAND2, 37250, 139700, 1-561; 7394, HAND2, 37248, 139698, 941-1594; 7395, HEG1, 37252, 139702, 1-192; 7395, HEG1, 37253, 139703, 1-798; 7395, HEG1, 37251, 139701, 69-4214; 7396, HEATR1, 37254, 139704, 100-462; 7396, HEATR1, 37255, 139705, 116-6307; 7396, HEATR1, 37256, 139706, 116-6550; 7397, HEATR3, 37257, 139707, 192-2234; 7398, HEATR4, 37260, 139710, 436-552; 7398, HEATR4, 37261, 139711, 252-824; 7398, HEATR4, 37262, 139712, 516-623; 7398, HEATR4, 37258, 139708, 270-3350; 7398, HEATR4, 37259, 139709, 323-3403; 7399, HEATR5A, 37264, 139714, 186-6326; 7399, HEATR5A, 37265, 139715, 1-4799; 7399, HEATR5A, 37266, 139716, 1-373; 7399, HEATR5A, 37267, 139717, 1-598; 7399, HEATR5A, 37268, 139718, 219-480; 7399, HEATR5A, 37269, 139719, 1-2687; 7399, HEATR5A, 37263, 139713, 135-476; 7400, HEATR5B, 37271, 139721, 1-348; 7400, HEATR5B, 37270, 139720, 97-6312; 7401, HEATR6, 37273, 139723, 8-3217; 7401, HEATR6, 37274, 139724, 1-550; 7401, HEATR6, 37275, 139725, 1-162; 7401, HEATR6, 37276, 139726, 1-74; 7401, HEATR6, 37277, 139727, 8-352; 7401, HEATR6, 37278, 139728, 1-363; 7401, HEATR6, 37279, 139729, 8-1249; 7401, HEATR6, 37280, 139730, 8-648; 7401, HEATR6, 37281, 139731, 466-3216; 7401, HEATR6, 37272, 139722, 18-3563; 7402, HEATR9, 37284, 139734, 130-549; 7402, HEATR9, 37285, 139735, 86-937; 7402, HEATR9, 37292, 139742, 86-937; 7402, HEATR9, 37282, 139732, 130-1722; 7402, HEATR9, 37283, 139733, 150-1862; 7402, HEATR9, 37286, 139736, 216-1238; 7402, HEATR9, 37287, 139737, 215-1357; 7402, HEATR9, 37288, 139738, 150-1862; 7402, HEATR9, 37289, 139739, 215-1357; 7402, HEATR9, 37290, 139740, 216-1238; 7402, HEATR9, 37291, 139741, 130-1722; 7403, HSPH1, 37295, 139745, 295-2643; 7403, HSPH1, 37296, 139746, 1-348; 7403, HSPH1, 37297, 139747, 346-693; 7403, HSPH1, 37293, 139743, 346-2922; 7403, HSPH1, 37294, 139744, 346-2790; 7403, HSPH1, 37298, 139748, 295-2877; 7404, HSPE1, 37300, 139750, 59-364; 7404, HSPE1, 37301, 139751, 298-441; 7404, HSPE1, 37299, 139749, 444-752; 7405, HSPB8, 37303, 139753, 1-458; 7405, HSPB8, 37302, 139752, 672-1262; 7406, HSPB1, 37305, 139755, 292-405; 7406, HSPB1, 37306, 139756, 26-586; 7406, HSPB1, 37304, 139754, 170-787; 7407, HSPB2, 37307, 139757, 589-1137; 7408, HSPB3, 37308, 139758, 190-642; 7409, HSPB7, 37310, 139760, 126-863; 7409, HSPB7, 37311, 139761, 43-567; 7409, HSPB7, 37312, 139762, 79-576; 7409, HSPB7, 37313, 139763, 1-375; 7409, HSPB7, 37309, 139759, 828-1340; 7409, HSPB7, 37314, 139764, 111-638; 7410, HSPD1, 37317, 139767, 44-190; 7410, HSPD1, 37318, 139768, 52-754; 7410, HSPD1, 37319, 139769, 268-549; 7410, HSPD1, 37320, 139770, 329-578; 7410, HSPD1, 37321, 139771, 359-533; 7410, HSPD1, 37322, 139772, 226-888; 7410, HSPD1, 37323, 139773, 5-529; 7410, HSPD1, 37315, 139765, 118-1839; 7410, HSPD1, 37316, 139766, 269-1990; 7411, HSPA12B, 37325, 139775, 262-2064; 7411, HSPA12B, 37324, 139774, 146-2206; 7412, HSPA12A, 37327, 139777, 1-360; 7412, HSPA12A, 37328, 139778, 188-596; 7412, HSPA12A, 37326, 139776, 106-2133; 7413, HSPA14, 37330, 139780, 102-533; 7413, HSPA14, 37331, 139781, 1-386; 7413, HSPA14, 37329, 139779, 240-1769; 7414, HSPA1A, 37333, 139783, 215-1645; 7414, HSPA1A, 37335, 139785, 215-1645; 7414, HSPA1A, 37339, 139789, 215-1645; 7414, HSPA1A, 37340, 139790, 215-1645; 7414, HSPA1A, 37341, 139791, 215-1645; 7414, HSPA1A, 37332, 139782, 294-2219; 7414, HSPA1A, 37334, 139784, 294-2219; 7414, HSPA1A, 37336, 139786, 294-2219; 7414, HSPA1A, 37337, 139787, 294-2219; 7414, HSPA1A, 37338, 139788, 294-2219; 7415, HSPA1B, 37345, 139795, 1-1929; 7415, HSPA1B, 37347, 139797, 38-1966; 7415, HSPA1B, 37349, 139799, 38-1966; 7415, HSPA1B, 37342, 139792, 217-2142; 7415, HSPA1B, 37343, 139793, 217-2142; 7415, HSPA1B, 37344, 139794, 217-2142; 7415, HSPA1B, 37346, 139796, 217-2142; 7415, HSPA1B, 37348, 139798, 217-2142; 7416, HSPA1L, 37354, 139804, 191-2116; 7416, HSPA1L, 37350, 139800, 191-2116; 7416, HSPA1L, 37351, 139801, 191-2116; 7416, HSPA1L, 37352, 139802, 191-2116; 7416, HSPA1L, 37353, 139803, 191-2116; 7417, HSPA2, 37355, 139805, 383-2302; 7417, HSPA2, 37356, 139806, 77-1996; 7418, HSPA4, 37358, 139808, 11-1438; 7418, HSPA4, 37360, 139810, 124-2223; 7418, HSPA4, 37357, 139807, 290-2812; 7418, HSPA4, 37359, 139809, 282-728; 7419, HSPA4L, 37363, 139813, 104-2545; 7419, HSPA4L, 37364, 139814, 230-1822; 7419, HSPA4L, 37361, 139811, 412-2931; 7419, HSPA4L, 37362, 139812, 333-2852; 7420, HSPA5, 37365, 139815, 205-2169; 7421, HSPA6, 37366, 139816, 120-2051; 7422, HSPA8, 37369, 139819, 38-588; 7422, HSPA8, 37371, 139821, 176-1112; 7422, HSPA8, 37372, 139822, 416-1648; 7422, HSPA8, 37373, 139823, 8-1891; 7422, HSPA8, 37374, 139824, 160-674; 7422, HSPA8, 37375, 139825, 126-536; 7422, HSPA8, 37376, 139826, 252-648; 7422, HSPA8, 37377, 139827, 289-740; 7422, HSPA8, 37378, 139828, 487-1048; 7422, HSPA8, 37379, 139829, 295-963; 7422, HSPA8, 37380, 139830, 46-579; 7422, HSPA8, 37381, 139831, 79-583; 7422, HSPA8, 37383, 139833, 79-1581; 7422, HSPA8, 37367, 139817, 9-1949; 7422, HSPA8, 37368, 139818, 278-1759; 7422, HSPA8, 37370, 139820, 278-2218; 7422, HSPA8, 37382, 139832, 121-2061; 7423, HSPA9, 37385, 139835, 84-200; 7423, HSPA9, 37386, 139836, 1-301; 7423, HSPA9, 37387, 139837, 1-307; 7423, HSPA9, 37388, 139838, 366-551; 7423, HSPA9, 37389, 139839, 86-214; 7423, HSPA9, 37390, 139840, 300-584; 7423, HSPA9, 37391, 139841, 1-491; 7423, HSPA9, 37384, 139834, 127-2166; 7424, HSBP1, 37393, 139843, 16-216; 7424, HSBP1, 37392, 139842, 235-465; 7424, HSBP1, 37394, 139844, 89-319; 7425, HSBP1L1, 37396, 139846, 107-244; 7425, HSBP1L1, 37395, 139845, 176-400; 7426, HSPA13, 37397, 139847, 69-1484; 7427, HSP90AA1, 37400, 139850, 60-581; 7427, HSP90AA1, 37401, 139851, 1-157; 7427, HSP90AA1, 37402, 139852, 62-304; 7427, HSP90AA1, 37403, 139853, 296-595; 7427, HSP90AA1, 37398, 139848, 207-2405; 7427, HSP90AA1, 37399, 139849, 283-2847; 7428, HSP90AB1, 37404, 139854, 123-2297; 7428, HSP90AB1, 37405, 139855, 215-2389; 7428, HSP90AB1, 37406, 139856, 110-2284; 7428, HSP90AB1, 37407, 139857, 180-2354; 7429, HSP90B1, 37409, 139859, 107-268; 7429, HSP90B1, 37410, 139860, 436-581; 7429, HSP90B1, 37411, 139861, 1-443; 7429, HSP90B1, 37412, 139862, 79-1026; 7429, HSP90B1, 37408, 139858, 183-2594; 7430, HSPB11, 37414, 139864, 19-243; 7430, HSPB11, 37415, 139865, 72-410; 7430, HSPB11, 37416, 139866, 34-678; 7430, HSPB11, 37413, 139863, 391-825; 7431, HSPB6, 37418, 139868, 2-415; 7431, HSPB6, 37417, 139867, 22-504; 7431, HSPB6, 37419, 139869, 198-680; 7432, HSPB9, 37420, 139870, 1421-1900; 7433, HSF1, 37421, 139871, 168-1655; 7433, HSF1, 37423, 139873, 146-561; 7433, HSF1, 37424, 139874, 1-144; 7433, HSF1, 37425, 139875, 154-348; 7433, HSF1, 37426, 139876, 1-275; 7433, HSF1, 37422, 139872, 161-1750; 7434, HSF2, 37429, 139879, 1-642; 7434, HSF2, 37427, 139877, 193-1803; 7434, HSF2, 37428, 139878, 188-1744; 7435, HSF2BP, 37431, 139881, 310-989; 7435, HSF2BP, 37430, 139880, 333-1337; 7436, HSF4, 37432, 139882, 69-1016; 7436, HSF4, 37433, 139883, 70-654; 7436, HSF4, 37434, 139884, 1-52; 7436, HSF4, 37435, 139885, 1-669; 7436, HSF4, 37436, 139886, 23-979; 7436, HSF4, 37437, 139887, 1-1249; 7436, HSF4, 37438, 139888, 1-190; 7436, HSF4, 37439, 139889, 42-185; 7436, HSF4, 37440, 139890, 1-546; 7436, HSF4, 37441, 139891, 1-556; 7436, HSF4, 37442, 139892, 23-970; 7436, HSF4, 37443, 139893, 1-233; 7436, HSF4, 37444, 139894, 1-425; 7436, HSF4, 37445, 139895, 1-1479; 7436, HSF4, 37446, 139896, 1-1389; 7437, HSF5, 37447, 139897, 111-1901; 7437, HSF5, 37448, 139898, 67-1494; 7438, HSFX1, 37449, 139899, 615-1886; 7439, HSFX2, 37450, 139900, 17-1288; 7440, HSFY1, 37451, 139901, 118-1323; 7440, HSFY1, 37452, 139902, 98-709; 7440, HSFY1, 37453, 139903, 98-742; 7440, HSFY1, 37454, 139904, 69-713; 7441, HSFY2, 37455, 139905, 118-1323; 7441, HSFY2, 37456, 139906, 98-709; 7441, HSFY2, 37457, 139907, 69-713; 7442, HRSP12, 37459, 139909, 1-445; 7442, HRSP12, 37460, 139910, 64-192; 7442, HRSP12, 37461, 139911, 1-383; 7442, HRSP12, 37458, 139908, 146-559; 7443, HERC2, 37463, 139913, 107-349; 7443, HERC2, 37464, 139914, 1-598; 7443, HERC2, 37465, 139915, 110-181; 7443, HERC2, 37466, 139916, 59-1630; 7443, HERC2, 37467, 139917, 1-6245; 7443, HERC2, 37468, 139918, 101-2977; 7443, HERC2, 37469, 139919, 107-178; 7443, HERC2, 37462, 139912, 110-14614; 7444, HERC3, 37473, 139923, 175-559; 7444, HERC3, 37474, 139924, 367-761; 7444, HERC3, 37475, 139925, 205-887; 7444, HERC3, 37476, 139926, 298-579; 7444, HERC3, 37477, 139927, 1-836; 7444, HERC3, 37478, 139928, 349-582; 7444, HERC3, 37470, 139920, 31-3183; 7444, HERC3, 37471, 139921, 167-1273; 7444, HERC3, 37472, 139922, 240-3392; 7445, HERC4, 37482, 139932, 1-1198; 7445, HERC4, 37486, 139936, 453-540; 7445, HERC4, 37487, 139937, 223-944; 7445, HERC4, 37479, 139929, 496-3339; 7445, HERC4, 37480, 139930, 314-3463; 7445, HERC4, 37481, 139931, 249-3422; 7445, HERC4, 37483, 139933, 249-3188; 7445, HERC4, 37484, 139934, 249-581; 7445, HERC4, 37485, 139935, 249-602; 7446, HERC5, 37489, 139939, 111-2099; 7446, HERC5, 37488, 139938, 154-3228; 7447, HERC1, 37491, 139941, 1-495; 7447, HERC1, 37492, 139942, 1-81; 7447, HERC1, 37493, 139943, 212-647; 7447, HERC1, 37494, 139944, 518-577; 7447, HERC1, 37495, 139945, 123-581; 7447, HERC1, 37496, 139946, 1-458; 7447, HERC1, 37497, 139947, 1-143; 7447, HERC1, 37498, 139948, 143-2215; 7447, HERC1, 37490, 139940, 89-14674; 7448, HERC6, 37500, 139950, 184-1152; 7448, HERC6, 37502, 139952, 1-557; 7448, HERC6, 37503, 139953, 12-233; 7448, HERC6, 37499, 139949, 60-3128; 7448, HERC6, 37501, 139951, 184-3144; 7449, HACE1, 37506, 139956, 236-772; 7449, HACE1, 37507, 139957, 209-622; 7449, HACE1, 37508, 139958, 1-901; 7449, HACE1, 37509, 139959, 1-988; 7449, HACE1, 37510, 139960, 238-859; 7449, HACE1, 37511, 139961, 1-133; 7449, HACE1, 37512, 139962, 1-527; 7449, HACE1, 37504, 139954, 278-3007; 7449, HACE1, 37505, 139955, 278-2362; 7450, HECTD1, 37515, 139965, 1-368; 7450, HECTD1, 37516, 139966, 1-2930; 7450, HECTD1, 37517, 139967, 1-4395; 7450, HECTD1, 37518, 139968, 490-3267; 7450, HECTD1, 37519, 139969, 1-554; 7450, HECTD1, 37520, 139970, 1-637; 7450, HECTD1, 37521, 139971, 324-8168; 7450, HECTD1, 37513, 139963, 490-8322; 7450, HECTD1, 37514, 139964, 436-8268; 7451, HECTD2, 37523, 139973, 629-1909; 7451, HECTD2, 37525, 139975, 155-2497; 7451, HECTD2, 37526, 139976, 326-395; 7451, HECTD2, 37522, 139972, 95-2425; 7451, HECTD2, 37524, 139974, 96-719; 7452, HECTD3, 37527, 139977, 163-1578; 7452, HECTD3, 37528, 139978, 73-2658; 7453, HECTD4, 37529, 139979, 312-13562; 7453, HECTD4, 37530, 139980, 1-330; 7453, HECTD4, 37531, 139981, 397-13251; 7453, HECTD4, 37532, 139982, 1-787; 7454, HECW1, 37535, 139985, 1-415; 7454, HECW1, 37533, 139983, 606-5426; 7454, HECW1, 37534, 139984, 325-5043; 7455, HECW2, 37538, 139988, 215-568; 7455, HECW2, 37539, 139989, 221-620; 7455, HECW2, 37536, 139986, 184-4902; 7455, HECW2, 37537, 139987, 1016-4666; 7456, HUWE1, 37542, 139992, 1-3592; 7456, HUWE1, 37543, 139993, 595-872; 7456, HUWE1, 37545, 139995, 1-574; 7456, HUWE1, 37546, 139996, 1-688; 7456, HUWE1, 37540, 139990, 404-13528; 7456, HUWE1, 37541, 139991, 459-13583; 7456, HUWE1, 37544, 139994, 1-13098; 7457, HHAT, 37548, 139998, 246-797; 7457, HHAT, 37550, 140000, 99-721; 7457, HHAT, 37553, 140003, 284-532; 7457, HHAT, 37547, 139997, 196-1677; 7457, HHAT, 37549, 139999, 228-1709; 7457, HHAT, 37551, 140001, 177-1658; 7457, HHAT, 37552, 140002, 106-1590; 7457, HHAT, 37554, 140004, 243-1529; 7457, HHAT, 37555, 140005, 177-1247; 7458, HHATL, 37557, 140007, 222-915; 7458, HHATL, 37558, 140008, 1-373; 7458, HHATL, 37559, 140009, 214-996; 7458, HHATL, 37561, 140011, 139-491; 7458, HHATL, 37562, 140012, 139-487; 7458, HHATL, 37563, 140013, 80-690; 7458, HHATL, 37556, 140006, 148-1662; 7458, HHATL, 37560, 140010, 263-1777; 7459, HHIP, 37564, 140014, 656-2758; 7459, HHIP, 37565, 140015, 505-1467; 7460, HELB, 37568, 140018, 26-2566; 7460, HELB, 37566, 140016, 60-3323; 7460, HELB, 37567, 140017, 26-1750; 7460, HELB, 37569, 140019, 25-3288; 7461, HELZ, 37571, 140021, 172-1872; 7461, HELZ, 37572, 140022, 387-583; 7461, HELZ, 37573, 140023, 307-617; 7461, HELZ, 37575, 140025, 1-577; 7461, HELZ, 37576, 140026, 168-5999; 7461, HELZ, 37570, 140020, 168-5996; 7461, HELZ, 37574, 140024, 55-3546; 7462, HELZ2, 37577, 140027, 425-6667; 7462, HELZ2, 37578, 140028, 71-8020; 7463, HELLS, 37579, 140029, 120-2264; 7463, HELLS, 37581, 140031, 1-933; 7463, HELLS, 37582, 140032, 97-2199; 7463, HELLS, 37583, 140033, 1-2655; 7463, HELLS, 37585, 140035, 136-711; 7463, HELLS, 37586, 140036, 107-400; 7463, HELLS, 37580, 140030, 106-2622; 7463, HELLS, 37584, 140034, 1-2223; 7464, HELQ, 37588, 140038, 112-1581; 7464, HELQ, 37589, 140039, 131-3235; 7464, HELQ, 37587, 140037, 164-3469; 7465, HLTF, 37592, 140042, 1-1276; 7465, HLTF, 37594, 140044, 187-3213; 7465, HLTF, 37590, 140040, 195-3224; 7465, HLTF, 37591, 140041, 169-3198; 7465, HLTF, 37593, 140043, 219-3248; 7466, HELT, 37595, 140045, 1-984; 7466, HELT, 37596, 140046, 89-814; 7466, HELT, 37597, 140047, 89-817; 7467, HN1, 37598, 140048, 279-413; 7467, HN1, 37602, 140052, 131-411; 7467, HN1, 37604, 140054, 116-430; 7467, HN1, 37599, 140049, 279-824; 7467, HN1, 37600, 140050, 287-751; 7467, HN1, 37601, 140051, 140-466; 7467, HN1, 37603, 140053, 121-447; 7467, HN1, 37605, 140055, 472-798; 7467, HN1, 37606, 140056, 1109-1435; 7468, HN1L, 37608, 140058, 155-691; 7468, HN1L, 37610, 140060, 35-247; 7468, HN1L, 37611, 140061, 256-601; 7468, HN1L, 37612, 140062, 24-593; 7468, HN1L, 37613, 140063, 1-234; 7468, HN1L, 37614, 140064, 1-351; 7468, HN1L, 37615, 140065, 63-565; 7468, HN1L, 37616, 140066, 1-297; 7468, HN1L, 37607, 140057, 58-630; 7468, HN1L, 37609, 140059, 131-655; 7468, HN1L, 37617, 140067, 37-693; 7469, HOST, 37618, 140068, 115-396; 7469, HOST, 37619, 140069, 57-335; 7470, HCLS1, 37621, 140071, 80-1429; 7470, HCLS1, 37623, 140073, 101-331; 7470, HCLS1, 37624, 140074, 65-292; 7470, HCLS1, 37620, 140070, 93-1553; 7470, HCLS1, 37622, 140072, 109-738; 7471, HPGDS, 37625, 140075, 92-691; 7472, HSH2D, 37626, 140076, 67-585; 7472, HSH2D, 37627, 140077, 1-122; 7472, HSH2D, 37628, 140078, 118-336; 7472, HSH2D, 37629, 140079, 112-321; 7472, HSH2D, 37632, 140082, 88-345; 7472, HSH2D, 37630, 140080, 532-1590; 7472, HSH2D, 37631, 140081, 118-1176; 7473, HHEX, 37634, 140084, 492-788; 7473, HHEX, 37635, 140085, 436-732; 7473, HHEX, 37633, 140083, 37-849; 7474, HEBP1, 37637, 140087, 152-553; 7474, HEBP1, 37638, 140088, 1-189; 7474, HEBP1, 37636, 140086, 160-729; 7475, HEBP2, 37639, 140089, 250-600; 7475, HEBP2, 37640, 140090, 34-417; 7475, HEBP2, 37641, 140091, 1-137; 7475, HEBP2, 37642, 140092, 278-895; 7476, HMOX1, 37644, 140094, 361-921; 7476, HMOX1, 37643, 140093, 340-1206; 7477, HMOX2, 37650, 140100, 189-877; 7477, HMOX2, 37651, 140101, 200-914; 7477, HMOX2, 37652, 140102, 190-583; 7477, HMOX2, 37653, 140103, 1-332; 7477, HMOX2, 37655, 140105, 220-549; 7477, HMOX2, 37657, 140107, 212-607; 7477, HMOX2, 37658, 140108, 296-687; 7477, HMOX2, 37659, 140109, 1-1113; 7477, HMOX2, 37661, 140111, 1-1113; 7477, HMOX2, 37668, 140118, 296-687; 7477, HMOX2, 37670, 140120, 189-877; 7477, HMOX2, 37671, 140121, 200-914; 7477, HMOX2, 37672, 140122, 190-583; 7477, HMOX2, 37673, 140123, 220-549; 7477, HMOX2, 37675, 140125, 212-607; 7477, HMOX2, 37678, 140128, 1-332; 7477, HMOX2, 37645, 140095, 81-1031; 7477, HMOX2, 37646, 140096, 549-1499; 7477, HMOX2, 37647, 140097, 187-1137; 7477, HMOX2, 37648, 140098, 212-1162; 7477, HMOX2, 37649, 140099, 308-1258; 7477, HMOX2, 37654, 140104, 606-1556; 7477, HMOX2, 37656, 140106, 84-947; 7477, HMOX2, 37660, 140110, 289-1239; 7477, HMOX2, 37662, 140112, 187-1137; 7477, HMOX2, 37663, 140113, 368-1318; 7477, HMOX2, 37664, 140114, 81-1031; 7477, HMOX2, 37665, 140115, 212-1162; 7477, HMOX2, 37666, 140116, 289-1239; 7477, HMOX2, 37667, 140117, 368-1318; 7477, HMOX2, 37669, 140119, 308-1258; 7477, HMOX2, 37674, 140124, 549-1499; 7477, HMOX2, 37676, 140126, 84-947; 7477, HMOX2, 37677, 140127, 606-1556; 7478, HMCN1, 37680, 140130, 1-720; 7478, HMCN1, 37679, 140129, 230-17137; 7479, HMCN2, 37681, 140131, 1-926; 7479, HMCN2, 37682, 140132, 60-1847; 7479, HMCN2, 37683, 140133, 1-15180; 7479, HMCN2, 37684, 140134, 1-1438; 7480, HEMK1, 37686, 140136, 417-683; 7480, HEMK1, 37687, 140137, 272-538; 7480, HEMK1, 37688, 140138, 1-375; 7480, HEMK1, 37685, 140135, 553-1569; 7480, HEMK1, 37689, 140139, 228-1244; 7480, HEMK1, 37690, 140140, 297-1313; 7481, HFE, 37692, 140142, 3-1016; 7481, HFE, 37699, 140149, 1-168; 7481, HFE, 37700, 140150, 50-1087; 7481, HFE, 37691, 140141, 161-943; 7481, HFE, 37693, 140143, 161-667; 7481, HFE, 37694, 140144, 161-931; 7481, HFE, 37695, 140145, 161-391; 7481, HFE, 37696, 140146, 45-773; 7481, HFE, 37697, 140147, 161-1138; 7481, HFE, 37698, 140148, 123-1169; 7481, HFE, 37701, 140151, 37-777; 7481, HFE, 37702, 140152, 37-1041; 7482, HFE2, 37705, 140155, 257-536; 7482, HFE2, 37708, 140158, 239-451; 7482, HFE2, 37703, 140153, 345-1625; 7482, HFE2, 37704, 140154, 575-1516; 7482, HFE2, 37706, 140156, 208-810; 7482, HFE2, 37707, 140157, 170-772; 7483, HEMGN, 37709, 140159, 145-1599; 7483, HEMGN, 37710, 140160, 258-1712; 7484, HBA1, 37712, 140162, 61-393; 7484, HBA1, 37711, 140161, 38-466; 7485, HBA2, 37714, 140164, 71-403; 7485, HBA2, 37713, 140163, 67-495; 7486, HBB, 37716, 140166, 231-502; 7486, HBB, 37717, 140167, 51-218; 7486, HBB, 37715, 140165, 51-494; 7487, HBD, 37718, 140168, 51-476; 7487, HBD, 37720, 140170, 254-566; 7487, HBD, 37721, 140171, 51-305; 7487, HBD, 37719, 140169, 216-659; 7488, HBE1, 37724, 140174, 316-578; 7488, HBE1, 37722, 140172, 269-712; 7488, HBE1, 37723, 140173, 346-789; 7489, HBG1, 37726, 140176, 33-125; 7489, HBG1, 37725, 140175, 89-532; 7490, HBG2, 37728, 140178, 194-607; 7490, HBG2, 37730, 140180, 54-497; 7490, HBG2, 37731, 140181, 14-106; 7490, HBG2, 37727, 140177, 84-527; 7490, HBG2, 37729, 140179, 1242-1685; 7491, HBM, 37732, 140182, 21-446;

7492, HBQ1, 37733, 140183, 35-463; 7493, HBZ, 37734, 140184, 224-652; 7494, HPX, 37736, 140186, 62-826; 7494, HPX, 37735, 140185, 102-1490; 7495, HENMT1, 37737, 140187, 172-1446; 7495, HENMT1, 37740, 140190, 297-1244; 7495, HENMT1, 37738, 140188, 422-1603; 7495, HENMT1, 37739, 140189, 239-1420; 7496, HEPACAM2, 37743, 140193, 52-1419; 7496, HEPACAM2, 37741, 140191, 89-1441; 7496, HEPACAM2, 37742, 140192, 79-1467; 7496, HEPACAM2, 37744, 140194, 24-1481; 7497, HS3ST1, 37746, 140196, 249-496; 7497, HS3ST1, 37747, 140197, 244-491; 7497, HS3ST1, 37745, 140195, 1176-2099; 7498, HS3ST2, 37749, 140199, 115-603; 7498, HS3ST2, 37748, 140198, 435-1538; 7499, HS3ST3A1, 37751, 140201, 109-723; 7499, HS3ST3A1, 37750, 140200, 799-2019; 7500, HS3ST3B1, 37752, 140202, 437-1609; 7500, HS3ST3B1, 37753, 140203, 437-1609; 7501, HS3ST4, 37754, 140204, 393-1763; 7502, HS3ST5, 37755, 140205, 1190-2230; 7502, HS3ST5, 37756, 140206, 33-1073; 7503, HS3ST6, 37757, 140207, 118-1146; 7503, HS3ST6, 37758, 140208, 118-1146; 7504, HS2ST1, 37761, 140211, 208-540; 7504, HS2ST1, 37759, 140209, 364-1434; 7504, HS2ST1, 37760, 140210, 390-1079; 7505, HS6ST1, 37762, 140212, 15-1250; 7506, HS6ST2, 37763, 140213, 1-1938; 7506, HS6ST2, 37764, 140214, 417-2234; 7506, HS6ST2, 37765, 140215, 1-1818; 7506, HS6ST2, 37766, 140216, 417-2354; 7507, HS6ST3, 37768, 140218, 1-711; 7507, HS6ST3, 37767, 140217, 25-1440; 7508, HSPG2, 37769, 140219, 1-328; 7508, HSPG2, 37771, 140221, 1-589; 7508, HSPG2, 37772, 140222, 1-921; 7508, HSPG2, 37770, 140220, 81-13256; 7509, HGSNAT, 37774, 140224, 1-757; 7509, HGSNAT, 37775, 140225, 288-1346; 7509, HGSNAT, 37776, 140226, 144-662; 7509, HGSNAT, 37777, 140227, 1-294; 7509, HGSNAT, 37778, 140228, 9-560; 7509, HGSNAT, 37773, 140223, 43-1950; 7510, HPSE, 37783, 140233, 138-644; 7510, HPSE, 37785, 140235, 138-818; 7510, HPSE, 37779, 140229, 101-1732; 7510, HPSE, 37780, 140230, 138-1769; 7510, HPSE, 37781, 140231, 138-1280; 7510, HPSE, 37782, 140232, 1-1458; 7510, HPSE, 37784, 140234, 138-1547; 7511, HPSE2, 37789, 140239, 15-1184; 7511, HPSE2, 37790, 140240, 1-447; 7511, HPSE2, 37786, 140236, 1-1647; 7511, HPSE2, 37787, 140237, 61-1665; 7511, HPSE2, 37788, 140238, 61-1839; 7511, HPSE2, 37791, 140241, 61-1503; 7512, HBEGF, 37792, 140242, 304-930; 7513, HEPACAM, 37793, 140243, 407-1657; 7514, HLF, 37796, 140246, 277-510; 7514, HLF, 37799, 140249, 1-711; 7514, HLF, 37794, 140244, 474-1361; 7514, HLF, 37795, 140245, 218-850; 7514, HLF, 37797, 140247, 235-867; 7514, HLF, 37798, 140248, 301-933; 7515, HAVCR1, 37802, 140252, 106-774; 7515, HAVCR1, 37803, 140253, 333-1538; 7515, HAVCR1, 37804, 140254, 534-1739; 7515, HAVCR1, 37800, 140250, 534-1628; 7515, HAVCR1, 37801, 140251, 48-1142; 7516, HAVCR2, 37806, 140256, 344-566; 7516, HAVCR2, 37807, 140257, 140-961; 7516, HAVCR2, 37805, 140255, 732-1637; 7517, HEPN1, 37808, 140258, 508-774; 7518, HGF, 37810, 140260, 1-555; 7518, HGF, 37811, 140261, 191-545; 7518, HGF, 37814, 140264, 346-522; 7518, HGF, 37815, 140265, 166-590; 7518, HGF, 37809, 140259, 228-2414; 7518, HGF, 37812, 140262, 61-933; 7518, HGF, 37813, 140263, 78-2249; 7518, HGF, 37816, 140266, 44-901; 7518, HGF, 37817, 140267, 135-767; 7519, HGS, 37819, 140269, 503-716; 7519, HGS, 37820, 140270, 1-878; 7519, HGS, 37821, 140271, 1-191; 7519, HGS, 37822, 140272, 35-824; 7519, HGS, 37823, 140273, 468-644; 7519, HGS, 37824, 140274, 1-330; 7519, HGS, 37825, 140275, 1-116; 7519, HGS, 37818, 140268, 136-2469; 7520, HNF4A, 37828, 140278, 104-427; 7520, HNF4A, 37832, 140282, 232-540; 7520, HNF4A, 37834, 140284, 236-1585; 7520, HNF4A, 37826, 140276, 90-1514; 7520, HNF4A, 37827, 140277, 106-1464; 7520, HNF4A, 37829, 140279, 5-1333; 7520, HNF4A, 37830, 140280, 90-1343; 7520, HNF4A, 37831, 140281, 73-1467; 7520, HNF4A, 37833, 140283, 5-1192; 7521, HNF4G, 37835, 140285, 271-1497; 7521, HNF4G, 37836, 140286, 125-1462; 7522, HDGFL1, 37837, 140287, 84-839; 7523, HDGF, 37838, 140288, 316-1038; 7523, HDGF, 37839, 140289, 86-856; 7523, HDGF, 37840, 140290, 131-832; 7523, HDGF, 37841, 140291, 170-892; 7524, N/A, 37842, 140292, 443-805; 7524, N/A, 37843, 140293, 1-462; 7524, N/A, 37844, 140294, 667-740; 7524, N/A, 37845, 140295, 1-527; 7524, N/A, 37846, 140296, 44-337; 7524, N/A, 37847, 140297, 1-1420; 7524, N/A, 37848, 140298, 1-207; 7524, N/A, 37849, 140299, 1-216; 7524, N/A, 37851, 140301, 46-2058; 7524, N/A, 37850, 140300, 65-2080; 7525, N/A, 37853, 140303, 1-426; 7525, N/A, 37854, 140304, 128-262; 7525, N/A, 37855, 140305, 115-249; 7525, N/A, 37852, 140302, 605-1216; 7526, HAMP, 37856, 140306, 233-487; 7526, HAMP, 37857, 140307, 297-551; 7527, HEPH, 37860, 140310, 178-369; 7527, HEPH, 37861, 140311, 215-838; 7527, HEPH, 37862, 140312, 26-2459; 7527, HEPH, 37863, 140313, 117-3599; 7527, HEPH, 37864, 140314, 111-3020; 7527, HEPH, 37858, 140308, 839-3514; 7527, HEPH, 37859, 140309, 665-4141; 7527, HEPH, 37865, 140315, 180-3818; 7528, HEPHL1, 37866, 140316, 9-3488; 7529, HPN, 37869, 140319, 162-941; 7529, HPN, 37870, 140320, 324-564; 7529, HPN, 37867, 140317, 826-2079; 7529, HPN, 37868, 140318, 246-1499; 7530, HPS1, 37873, 140323, 1-978; 7530, HPS1, 37875, 140325, 1-478; 7530, HPS1, 37871, 140321, 235-2337; 7530, HPS1, 37872, 140322, 222-1196; 7530, HPS1, 37874, 140324, 210-2312; 7530, HPS1, 37876, 140326, 247-2349; 7531, HPS3, 37878, 140328, 87-2606; 7531, HPS3, 37879, 140329, 1-801; 7531, HPS3, 37877, 140327, 141-3155; 7532, HPS4, 37883, 140333, 68-643; 7532, HPS4, 37884, 140334, 551-1141; 7532, HPS4, 37885, 140335, 498-1942; 7532, HPS4, 37886, 140336, 166-669; 7532, HPS4, 37880, 140330, 510-2636; 7532, HPS4, 37881, 140331, 618-2744; 7532, HPS4, 37882, 140332, 301-2412; 7533, HPS5, 37890, 140340, 357-1559; 7533, HPS5, 37891, 140341, 167-958; 7533, HPS5, 37892, 140342, 278-759; 7533, HPS5, 37887, 140337, 279-3668; 7533, HPS5, 37888, 140338, 464-3511; 7533, HPS5, 37889, 140339, 277-3324; 7534, HPS6, 37893, 140343, 86-2413; 7535, HERPUD2, 37896, 140346, 237-808; 7535, HERPUD2, 37897, 140347, 491-672; 7535, HERPUD2, 37898, 140348, 272-811; 7535, HERPUD2, 37899, 140349, 450-505; 7535, HERPUD2, 37894, 140344, 633-1853; 7535, HERPUD2, 37895, 140345, 806-2026; 7536, HHLA1, 37901, 140351, 87-1718; 7536, HHLA1, 37900, 140350, 1-1596; 7537, HHLA2, 37904, 140354, 166-573; 7537, HHLA2, 37905, 140355, 246-1439; 7537, HHLA2, 37907, 140357, 1-985; 7537, HHLA2, 37909, 140359, 295-585; 7537, HHLA2, 37910, 140360, 161-594; 7537, HHLA2, 37911, 140361, 185-568; 7537, HHLA2, 37902, 140352, 415-1659; 7537, HHLA2, 37903, 140353, 155-1399; 7537, HHLA2, 37906, 140356, 175-1227; 7537, HHLA2, 37908, 140358, 128-1372; 7537, HHLA2, 37912, 140362, 302-1546; 7538, HHLA3, 37918, 140368, 98-322; 7538, HHLA3, 37913, 140363, 141-485; 7538, HHLA3, 37914, 140364, 148-378; 7538, HHLA3, 37915, 140365, 117-482; 7538, HHLA3, 37916, 140366, 109-453; 7538, HHLA3, 37917, 140367, 124-354; 7539, HES1, 37919, 140369, 237-1079; 7540, HES2, 37923, 140373, 88-321; 7540, HES2, 37924, 140374, 98-346; 7540, HES2, 37920, 140370, 100-621; 7540, HES2, 37921, 140371, 84-314; 7540, HES2, 37922, 140372, 217-447; 7541, HES3, 37925, 140375, 66-626; 7542, HES4, 37927, 140377, 200-943; 7542, HES4, 37928, 140378, 9-578; 7542, HES4, 37926, 140376, 139-804; 7543, HES5, 37929, 140379, 82-582; 7543, HES5, 37930, 140380, 82-582; 7544, HES6, 37933, 140383, 120-404; 7544, HES6, 37936, 140386, 54-641; 7544, HES6, 37937, 140387, 97-530; 7544, HES6, 37938, 140388, 1-512; 7544, HES6, 37939, 140389, 1-51; 7544, HES6, 37931, 140381, 220-894; 7544, HES6, 37932, 140382, 137-475; 7544, HES6, 37934, 140384, 67-735; 7544, HES6, 37935, 140385, 134-778; 7545, HES7, 37942, 140392, 219-654; 7545, HES7, 37940, 140390, 1-678; 7545, HES7, 37941, 140391, 1-693; 7546, HEY1, 37945, 140395, 204-761; 7546, HEY1, 37946, 140396, 213-857; 7546, HEY1, 37943, 140393, 195-1121; 7546, HEY1, 37944, 140394, 201-1115; 7547, HEY2, 37948, 140398, 119-994; 7547, HEY2, 37947, 140397, 198-1211; 7548, HEYL, 37949, 140399, 321-1307; 7549, HESX1, 37951, 140401, 21-476; 7549, HESX1, 37952, 140402, 337-657; 7549, HESX1, 37950, 140400, 70-627; 7550, HP1BP3, 37956, 140406, 199-572; 7550, HP1BP3, 37957, 140407, 1-759; 7550, HP1BP3, 37958, 140408, 419-538; 7550, HP1BP3, 37959, 140409, 500-557; 7550, HP1BP3, 37960, 140410, 339-473; 7550, HP1BP3, 37961, 140411, 137-970; 7550, HP1BP3, 37962, 140412, 179-1159; 7550, HP1BP3, 37963, 140413, 501-727; 7550, HP1BP3, 37953, 140403, 141-1802; 7550, HP1BP3, 37954, 140404, 228-629; 7550, HP1BP3, 37955, 140405, 1502-2707; 7551, HNRNPAB, 37966, 140416, 232-1215; 7551, HNRNPAB, 37967, 140417, 221-1063; 7551, HNRNPAB, 37969, 140419, 224-1075; 7551, HNRNPAB, 37971, 140421, 16-1008; 7551, HNRNPAB, 37964, 140414, 226-1083; 7551, HNRNPAB, 37965, 140415, 258-1256; 7551, HNRNPAB, 37968, 140418, 268-1266; 7551, HNRNPAB, 37970, 140420, 291-1148; 7552, HNRNPA0, 37972, 140422, 311-1228; 7553, HNRNPA1, 37973, 140423, 34-957; 7553, HNRNPA1, 37975, 140425, 1-576; 7553, HNRNPA1, 37977, 140427, 18-711; 7553, HNRNPA1, 37978, 140428, 46-481; 7553, HNRNPA1, 37979, 140429, 61-530; 7553, HNRNPA1, 37981, 140431, 231-569; 7553, HNRNPA1, 37974, 140424, 54-1172; 7553, HNRNPA1, 37976, 140426, 29-832; 7553, HNRNPA1, 37980, 140430, 616-1578; 7553, HNRNPA1, 37982, 140432, 61-1023; 7554, HNRNPA1L2, 37983, 140433, 1708-2670; 7555, HNRNPA2B1, 37987, 140437, 217-1002; 7555, HNRNPA2B1, 37984, 140434, 170-1231; 7555, HNRNPA2B1, 37985, 140435, 170-1195; 7555, HNRNPA2B1, 37986, 140436, 170-1231; 7556, HNRNPA3, 37989, 140439, 1-348; 7556, HNRNPA3, 37988, 140438, 238-1374; 7556, HNRNPA3, 37990, 140440, 52-1122; 7556, HNRNPA3, 37991, 140441, 29-1165; 7557, HNRNPC, 37992, 140442, 234-1100; 7557, HNRNPC, 37993, 140443, 53-925; 7557, HNRNPC, 37996, 140446, 267-644; 7557, HNRNPC, 37998, 140448, 169-1035; 7557, HNRNPC, 37999, 140449, 55-698; 7557, HNRNPC, 38001, 140451, 437-599; 7557, HNRNPC, 38003, 140453, 187-1104; 7557, HNRNPC, 38005, 140455, 163-858; 7557, HNRNPC, 38007, 140457, 265-629; 7557, HNRNPC, 38009, 140459, 170-1048; 7557, HNRNPC, 38010, 140460, 382-580; 7557, HNRNPC, 38011, 140461, 254-1039; 7557, HNRNPC, 38012, 140462, 265-789; 7557, HNRNPC, 38013, 140463, 221-781; 7557, HNRNPC, 38014, 140464, 354-1049; 7557, HNRNPC, 38016, 140466, 209-748; 7557, HNRNPC, 38017, 140467, 180-531; 7557, HNRNPC, 38018, 140468, 190-633; 7557, HNRNPC, 37994, 140444, 522-1442; 7557, HNRNPC, 37995, 140445, 2953-3834; 7557, HNRNPC, 37997, 140447, 208-1089; 7557, HNRNPC, 38000, 140450, 140-892; 7557, HNRNPC, 38002, 140452, 354-1235; 7557, HNRNPC, 38004, 140454, 114-995; 7557, HNRNPC, 38006, 140456, 191-1111; 7557, HNRNPC, 38008, 140458, 176-856; 7557, HNRNPC, 38015, 140465, 165-1085; 7558, HNRNPCL1, 38019, 140469, 227-1108; 7558, HNRNPCL1, 38020, 140470, 244-1125; 7558, HNRNPCL1, 38021, 140471, 227-1108; 7558, HNRNPCL1, 38022, 140472, 244-1125; 7559, HNRNPCL2, 38024, 140474, 244-1125; 7559, HNRNPCL2, 38025, 140475, 244-1125; 7559, HNRNPCL2, 38023, 140473, 244-1125; 7560, HNRNPCL3, 38027, 140477, 244-1125; 7560, HNRNPCL3, 38026, 140476, 244-1125; 7561, HNRNPCL4, 38028, 140478, 244-1125; 7561, HNRNPCL4, 38030, 140480, 1-882; 7561, HNRNPCL4, 38029, 140479, 1-882; 7562, HNRNPD, 38034, 140484, 1-782; 7562, HNRNPD, 38035, 140485, 86-748; 7562, HNRNPD, 38036, 140486, 143-607; 7562, HNRNPD, 38037, 140487, 314-574; 7562, HNRNPD, 38038, 140488, 308-583; 7562, HNRNPD, 38039, 140489, 1-631; 7562, HNRNPD, 38040, 140490, 211-545; 7562, HNRNPD, 38031, 140481, 306-1316; 7562, HNRNPD, 38032, 140482, 279-1346; 7562, HNRNPD, 38033, 140483, 309-1229; 7563, HNRNPDL, 38045, 140495, 93-266; 7563, HNRNPDL, 38046, 140496, 536-1627; 7563, HNRNPDL, 38041, 140491, 177-1439; 7563, HNRNPDL, 38042, 140492, 115-1020; 7563, HNRNPDL, 38043, 140493, 712-1974; 7563, HNRNPDL, 38044, 140494, 109-1014; 7563, HNRNPDL, 38047, 140497, 65-970; 7563, HNRNPDL, 38048, 140498, 536-1798; 7563, HNRNPDL, 38049, 140499, 138-1043; 7563, HNRNPDL, 38050, 140500, 147-1052; 7564, HNRNPF, 38051, 140501, 324-1571; 7564, HNRNPF, 38052, 140502, 403-1650; 7564, HNRNPF, 38053, 140503, 350-1597; 7564, HNRNPF, 38054, 140504, 488-1735; 7564, HNRNPF, 38055, 140505, 409-1656; 7565, HNRNPH1, 38056, 140506, 36-1454; 7565, HNRNPH1, 38060, 140510, 90-602; 7565, HNRNPH1, 38061, 140511, 459-850; 7565, HNRNPH1, 38062, 140512, 67-189; 7565, HNRNPH1, 38063, 140513, 136-620; 7565, HNRNPH1, 38064, 140514, 520-1155; 7565, HNRNPH1, 38065, 140515, 438-690; 7565, HNRNPH1, 38066, 140516, 95-610; 7565, HNRNPH1, 38067, 140517, 37-591; 7565, HNRNPH1, 38068, 140518, 37-1326; 7565, HNRNPH1, 38069, 140519, 316-805; 7565, HNRNPH1, 38070, 140520, 422-569; 7565, HNRNPH1, 38071, 140521, 127-249; 7565, HNRNPH1, 38072, 140522, 91-594; 7565, HNRNPH1, 38073, 140523, 68-559; 7565, HNRNPH1, 38074, 140524, 1-396; 7565, HNRNPH1, 38075, 140525, 1066-1563; 7565, HNRNPH1, 38076, 140526, 1-831; 7565, HNRNPH1, 38077, 140527, 408-492; 7565, HNRNPH1, 38078, 140528, 1-584; 7565, HNRNPH1, 38079, 140529, 1-558; 7565, HNRNPH1, 38080, 140530, 461-806; 7565, HNRNPH1, 38081, 140531, 1-352; 7565, HNRNPH1, 38082, 140532, 249-549; 7565, HNRNPH1, 38083, 140533, 1-143; 7565, HNRNPH1, 38084, 140534, 66-530; 7565, HNRNPH1, 38085, 140535, 1-123; 7565, HNRNPH1, 38057, 140507, 1537-2886; 7565, HNRNPH1, 38058, 140508, 148-1497; 7565, HNRNPH1, 38059, 140509, 118-1467; 7566, HNRNPH2, 38086, 140536, 79-1428; 7567, HNRNPH3, 38087, 140537, 166-1206; 7567, HNRNPH3, 38088, 140538, 119-1114; 7568, HNRNPK, 38093, 140543, 146-1283; 7568, HNRNPK, 38094, 140544, 1-301; 7568, HNRNPK, 38095, 140545, 222-455; 7568, HNRNPK, 38089, 140539, 108-1499; 7568, HNRNPK, 38090, 140540, 206-1597; 7568, HNRNPK, 38091, 140541, 225-1619; 7568, HNRNPK, 38092, 140542, 210-1604; 7569, HNRNPL, 38097, 140547, 185-724; 7569, HNRNPL, 38098, 140548, 1-1591; 7569, HNRNPL, 38099, 140549, 1-593; 7569, HNRNPL, 38101, 140551, 1-659; 7569, HNRNPL, 38102, 140552, 1-659; 7569, HNRNPL, 38103, 140553, 368-2137; 7569, HNRNPL, 38104, 140554, 176-1546; 7569, HNRNPL, 38105, 140555, 1-593; 7569, HNRNPL, 38106, 140556, 1-1591; 7569, HNRNPL, 38107, 140557, 185-724; 7569, HNRNPL, 38096, 140546, 368-2137; 7569, HNRNPL, 38100, 140550, 176-1546; 7570, HNRNPLL, 38108, 140558, 1-653; 7570, HNRNPLL, 38109, 140559, 170-1783; 7570, HNRNPLL, 38110, 140560, 1-1527; 7570, HNRNPLL, 38115, 140565, 124-570; 7570, HNRNPLL, 38116, 140566, 1-400; 7570, HNRNPLL, 38117, 140567, 411-2039; 7570, HNRNPLL, 38111, 140561, 232-1758; 7570, HNRNPLL, 38112, 140562, 63-890; 7570, HNRNPLL, 38113, 140563, 163-1776; 7570, HNRNPLL, 38114, 140564, 341-1969; 7571, HNRNPM, 38120, 140570, 1-350; 7571, HNRNPM, 38121, 140571, 1-298; 7571, HNRNPM, 38122, 140572, 7-664; 7571, HNRNPM, 38123, 140573, 1-1147; 7571, HNRNPM, 38124, 140574, 29-1086; 7571, HNRNPM, 38125, 140575, 6-832; 7571, HNRNPM, 38126, 140576, 23-322; 7571, HNRNPM, 38127, 140577, 1-643; 7571, HNRNPM, 38128, 140578, 8-1078; 7571, HNRNPM, 38129, 140579, 10-2202; 7571, HNRNPM, 38118, 140568, 42-2234; 7571, HNRNPM, 38119, 140569, 233-2308; 7572, HNRNPR, 38135, 140585, 232-1716; 7572, HNRNPR, 38136, 140586, 1-1788; 7572, HNRNPR, 38137, 140587, 110-2020; 7572, HNRNPR, 38138, 140588, 62-1963; 7572, HNRNPR, 38139, 140589, 273-1880; 7572, HNRNPR, 38140, 140590, 125-2026; 7572, HNRNPR, 38141, 140591, 232-1716; 7572, HNRNPR, 38130, 140580, 62-1963; 7572, HNRNPR, 38131, 140581, 125-2026; 7572, HNRNPR, 38132, 140582, 110-2020; 7572, HNRNPR, 38133, 140583, 1-1788; 7572, HNRNPR, 38134, 140584, 273-1880; 7573, HNRNPU, 38144, 140594, 343-1067; 7573, HNRNPU, 38142, 140592, 165-2642; 7573, HNRNPU, 38143, 140593, 236-2656; 7574, HNRNPUL1, 38145, 140595, 195-2498; 7574, HNRNPUL1, 38146, 140596, 93-2393; 7574, HNRNPUL1, 38149, 140599, 1-80; 7574, HNRNPUL1, 38150, 140600, 56-573; 7574, HNRNPUL1, 38151, 140601, 1-271; 7574, HNRNPUL1, 38152, 140602, 361-1473; 7574, HNRNPUL1, 38154, 140604, 317-672; 7574, HNRNPUL1, 38155, 140605, 281-754; 7574, HNRNPUL1, 38156, 140606, 151-393; 7574, HNRNPUL1, 38157, 140607, 94-411; 7574, HNRNPUL1, 38160, 140610, 1-1925; 7574, HNRNPUL1, 38161, 140611, 83-451; 7574, HNRNPUL1, 38162, 140612, 47-415; 7574, HNRNPUL1, 38147, 140597, 133-2391; 7574, HNRNPUL1, 38148, 140598, 174-2744; 7574, HNRNPUL1, 38153, 140603, 54-2468; 7574, HNRNPUL1, 38158, 140608, 95-2365; 7574, HNRNPUL1, 38159, 140609, 70-2340; 7575, HNRNPUL2, 38163, 140613, 194-2437; 7576, HEXIM1, 38164, 140614, 690-1769; 7577, HEXIM2, 38166, 140616, 237-473; 7577, HEXIM2, 38167, 140617, 352-783; 7577, HEXIM2, 38169, 140619, 380-796; 7577, HEXIM2, 38171, 140621, 193-803; 7577, HEXIM2, 38172, 140622, 216-581; 7577, HEXIM2, 38165, 140615, 437-1297; 7577, HEXIM2, 38168, 140618, 90-950; 7577, HEXIM2, 38170, 140620, 160-1020; 7578, HK1, 38176, 140626, 365-707; 7578, HK1, 38178, 140628, 321-739; 7578, HK1, 38179, 140629, 171-1042; 7578, HK1, 38173, 140623, 102-2852; 7578, HK1, 38174, 140624, 105-2858; 7578, HK1, 38175, 140625, 500-3217; 7578, HK1, 38177, 140627, 359-3124; 7579, HK2, 38181, 140631, 191-2860; 7579, HK2, 38180, 140630, 601-3354; 7580, HK3, 38183, 140633, 1-321; 7580, HK3, 38184, 140634, 1-395; 7580, HK3, 38185, 140635, 1-174; 7580, HK3, 38182, 140632, 93-2864; 7581, HKDC1, 38186, 140636, 134-2887; 7582, HEXDC, 38189, 140639, 1-645; 7582, HEXDC, 38190, 140640, 1-231; 7582, HEXDC, 38191, 140641, 286-638; 7582, HEXDC, 38192, 140642, 103-246; 7582, HEXDC, 38193, 140643, 96-1730; 7582, HEXDC, 38194, 140644, 1-267; 7582, HEXDC, 38195, 140645, 348-582; 7582, HEXDC, 38196, 140646, 80-220; 7582, HEXDC, 38197, 140647, 1-1085; 7582, HEXDC, 38198, 140648, 1-241; 7582, HEXDC, 38187, 140637, 12-1472; 7582, HEXDC, 38188, 140638, 475-2232; 7583, HEXA, 38200, 140650, 22-1644; 7583, HEXA, 38201, 140651, 32-463; 7583, HEXA, 38202, 140652, 1-267; 7583, HEXA, 38203, 140653, 22-1551; 7583, HEXA, 38204, 140654, 32-463; 7583, HEXA, 38205, 140655, 4-1125; 7583, HEXA, 38206, 140656, 1-955; 7583, HEXA, 38207, 140657, 1-386; 7583, HEXA, 38208, 140658, 18-377; 7583, HEXA, 38199, 140649, 505-2094; 7584, HEXB, 38210, 140660, 1-607; 7584, HEXB, 38211, 140661, 1-158; 7584, HEXB, 38212, 140662, 586-693; 7584, HEXB, 38213, 140663, 913-1908; 7584, HEXB, 38214, 140664, 1-511; 7584, HEXB, 38209, 140659, 118-1788; 7585, H6PD, 38216, 140666, 153-2561; 7585, H6PD, 38215, 140665, 303-2678; 7586, HFM1, 38218, 140668, 1-1877; 7586, HFM1, 38219, 140669, 84-672; 7586, HFM1, 38220, 140670, 87-540; 7586, HFM1, 38221, 140671, 183-596; 7586, HFM1, 38217, 140667, 100-4407; 7587, HGFAC, 38223, 140673, 28-2016; 7587, HGFAC, 38222, 140672, 116-2083; 7588, HGH1, 38225, 140675, 33-290; 7588, HGH1, 38226, 140676, 1-258; 7588, HGH1, 38224, 140674, 68-1240; 7589, HHIPL1, 38227, 140677, 99-2447; 7589, HHIPL1, 38228, 140678, 66-1892; 7590, HHIPL2, 38229, 140679, 60-2234; 7591, HID1, 38230, 140680, 1-748; 7591, HID1, 38232, 140682, 61-820; 7591, HID1, 38233, 140683, 65-640; 7591, HID1, 38234, 140684, 116-458; 7591, HID1, 38231, 140681, 79-2445; 7592, HIGD1A, 38238, 140688, 78-368; 7592, HIGD1A, 38235, 140685, 119-400; 7592, HIGD1A, 38236, 140686, 243-566; 7592, HIGD1A, 38237, 140687, 100-381; 7593, HIGD1B, 38240, 140690, 213-377; 7593, HIGD1B, 38241, 140691, 1-122; 7593, HIGD1B, 38239, 140689, 252-551; 7593, HIGD1B, 38242, 140692, 168-467; 7594, HIGD1C, 38243, 140693, 78-371; 7595, HIGD2A, 38244, 140694, 74-394; 7596, HIGD2B, 38245, 140695, 525-845; 7597, HDLBP, 38246, 140696, 376-4182; 7597, HDLBP, 38247, 140697, 1-2920; 7597, HDLBP, 38248, 140698, 229-4035; 7597, HDLBP, 38249, 140699, 294-4100; 7597, HDLBP, 38250, 140700, 505-996; 7597, HDLBP, 38251, 140701, 1-801; 7597, HDLBP, 38252, 140702, 337-581; 7597, HDLBP, 38253, 140703, 294-530; 7597, HDLBP, 38254, 140704, 483-525; 7597, HDLBP, 38255, 140705, 1-997; 7597, HDLBP, 38256, 140706, 305-594; 7597, HDLBP, 38257, 140707, 421-529; 7597, HDLBP, 38258, 140708, 515-566; 7597, HDLBP, 38259, 140709, 330-708; 7597, HDLBP, 38260, 140710, 402-459; 7597, HDLBP, 38262, 140712, 353-559; 7597, HDLBP, 38263, 140713, 256-929; 7597, HDLBP, 38264, 140714, 188-612; 7597, HDLBP, 38265, 140715, 434-1096; 7597, HDLBP, 38266, 140716, 1-924; 7597, HDLBP, 38267, 140717, 281-420; 7597, HDLBP, 38268, 140718, 418-578; 7597, HDLBP, 38269, 140719, 1-381; 7597, HDLBP, 38270, 140720, 301-544; 7597, HDLBP, 38271, 140721, 185-569; 7597, HDLBP, 38272, 140722, 158-598; 7597, HDLBP, 38261, 140711, 197-3904; 7598, HMG20A, 38275, 140725, 402-479; 7598, HMG20A, 38276, 140726, 1-355; 7598, HMG20A, 38277, 140727, 73-559; 7598, HMG20A, 38278, 140728, 331-631; 7598, HMG20A, 38279, 140729, 108-362; 7598, HMG20A, 38280, 140730, 407-494; 7598, HMG20A, 38281, 140731, 89-558; 7598, HMG20A, 38273, 140723, 359-1402; 7598,

HMG20A, 38274, 140724, 429-1472; 7599, HMG20B, 38282, 140732, 28-886; 7599, HMG20B, 38284, 140734, 35-412; 7599, HMG20B, 38285, 140735, 66-561; 7599, HMG20B, 38286, 140736, 334-759; 7599, HMG20B, 38287, 140737, 67-711; 7599, HMG20B, 38288, 140738, 1-555; 7599, HMG20B, 38283, 140733, 76-1029; 7600, HMGA1, 38289, 140739, 136-426; 7600, HMGA1, 38290, 140740, 250-573; 7600, HMGA1, 38291, 140741, 212-502; 7600, HMGA1, 38292, 140742, 250-540; 7600, HMGA1, 38293, 140743, 490-813; 7601, HMGA2, 38295, 140745, 149-505; 7601, HMGA2, 38299, 140749, 812-1255; 7601, HMGA2, 38301, 140751, 374-673; 7601, HMGA2, 38302, 140752, 1-168; 7601, HMGA2, 38294, 140744, 812-1132; 7601, HMGA2, 38296, 140746, 812-1084; 7601, HMGA2, 38297, 140747, 1141-1470; 7601, HMGA2, 38298, 140748, 812-1090; 7601, HMGA2, 38300, 140750, 812-1123; 7601, HMGA2, 38303, 140753, 812-1072; 7602, HMGB1, 38306, 140756, 158-634; 7602, HMGB1, 38307, 140757, 568-1044; 7602, HMGB1, 38304, 140754, 165-812; 7602, HMGB1, 38305, 140755, 185-832; 7602, HMGB1, 38308, 140758, 185-832; 7602, HMGB1, 38309, 140759, 942-1589; 7603, HMGB2, 38313, 140763, 227-629; 7603, HMGB2, 38310, 140760, 875-1504; 7603, HMGB2, 38311, 140761, 167-796; 7603, HMGB2, 38312, 140762, 24-653; 7604, HMGB3, 38315, 140765, 213-793; 7604, HMGB3, 38316, 140766, 142-707; 7604, HMGB3, 38317, 140767, 70-529; 7604, HMGB3, 38314, 140764, 97-699; 7604, HMGB3, 38318, 140768, 192-794; 7605, HMGB4, 38319, 140769, 1744-2304; 7605, HMGB4, 38320, 140770, 1906-2466; 7606, HMGN2, 38321, 140771, 95-367; 7606, HMGN2, 38322, 140772, 54-326; 7607, HMGN3, 38325, 140775, 179-571; 7607, HMGN3, 38323, 140773, 130-363; 7607, HMGN3, 38324, 140774, 130-429; 7608, HMGN4, 38326, 140776, 178-450; 7609, HMGN1, 38327, 140777, 75-221; 7609, HMGN1, 38328, 140778, 126-476; 7609, HMGN1, 38329, 140779, 137-409; 7609, HMGN1, 38331, 140781, 224-361; 7609, HMGN1, 38332, 140782, 138-272; 7609, HMGN1, 38333, 140783, 124-261; 7609, HMGN1, 38334, 140784, 172-306; 7609, HMGN1, 38330, 140780, 284-586; 7610, HMGN5, 38336, 140786, 90-572; 7610, HMGN5, 38337, 140787, 135-578; 7610, HMGN5, 38338, 140788, 454-720; 7610, HMGN5, 38339, 140789, 140-742; 7610, HMGN5, 38340, 140790, 554-859; 7610, HMGN5, 38335, 140785, 330-1178; 7611, HDX, 38343, 140793, 166-786; 7611, HDX, 38341, 140791, 113-2185; 7611, HDX, 38342, 140792, 160-2232; 7611, HDX, 38344, 140794, 249-2147; 7612, HPCA, 38345, 140795, 103-684; 7613, HPCAL4, 38348, 140798, 189-548; 7613, HPCAL4, 38346, 140796, 393-968; 7613, HPCAL4, 38347, 140797, 295-870; 7614, HPCAL1, 38351, 140801, 1-310; 7614, HPCAL1, 38352, 140802, 497-586; 7614, HPCAL1, 38353, 140803, 500-1027; 7614, HPCAL1, 38349, 140799, 382-963; 7614, HPCAL1, 38350, 140800, 527-1108; 7614, HPCAL1, 38354, 140804, 171-752; 7614, HPCAL1, 38355, 140805, 159-740; 7614, HPCAL1, 38356, 140806, 565-1146; 7615, HIAT1, 38358, 140808, 1-361; 7615, HIAT1, 38357, 140807, 137-1609; 7616, HIATL1, 38360, 140810, 126-599; 7616, HIATL1, 38359, 140809, 270-1790; 7617, HIATL2, 38362, 140812, 215-667; 7617, HIATL2, 38361, 140811, 215-619; 7618, HIRIP3, 38363, 140813, 832-2502; 7618, HIRIP3, 38364, 140814, 39-566; 7619, HNMT, 38365, 140815, 20-175; 7619, HNMT, 38366, 140816, 183-1061; 7619, HNMT, 38367, 140817, 183-563; 7619, HNMT, 38368, 140818, 149-1027; 7619, HNMT, 38369, 140819, 14-169; 7620, HRH1, 38371, 140821, 537-574; 7620, HRH1, 38370, 140820, 192-1655; 7620, HRH1, 38372, 140822, 63-1526; 7620, HRH1, 38373, 140823, 343-1806; 7621, HRH2, 38374, 140824, 1-1080; 7621, HRH2, 38375, 140825, 652-1845; 7622, HRH3, 38376, 140826, 298-1419; 7622, HRH3, 38378, 140828, 298-900; 7622, HRH3, 38377, 140827, 286-1623; 7623, HRH4, 38379, 140829, 101-1273; 7623, HRH4, 38380, 140830, 1-909; 7624, HTN1, 38384, 140834, 72-245; 7624, HTN1, 38385, 140835, 108-281; 7624, HTN1, 38386, 140836, 68-241; 7624, HTN1, 38381, 140831, 108-281; 7624, HTN1, 38382, 140832, 72-245; 7624, HTN1, 38383, 140833, 68-241; 7625, HTN3, 38387, 140837, 72-197; 7625, HTN3, 38390, 140840, 118-273; 7625, HTN3, 38391, 140841, 76-231; 7625, HTN3, 38392, 140842, 72-197; 7625, HTN3, 38388, 140838, 76-231; 7625, HTN3, 38389, 140839, 118-273; 7626, HAL, 38394, 140844, 296-799; 7626, HAL, 38397, 140847, 1-463; 7626, HAL, 38398, 140848, 225-697; 7626, HAL, 38399, 140849, 230-733; 7626, HAL, 38400, 140850, 19-1026; 7626, HAL, 38393, 140843, 370-2343; 7626, HAL, 38395, 140845, 349-2124; 7626, HAL, 38396, 140846, 927-2276; 7627, HDC, 38403, 140853, 10-545; 7627, HDC, 38401, 140851, 404-2392; 7627, HDC, 38402, 140852, 44-1933; 7628, HRC, 38405, 140855, 1-289; 7628, HRC, 38406, 140856, 7-2037; 7628, HRC, 38404, 140854, 188-2287; 7629, HRCT1, 38407, 140857, 97-444; 7630, HINT1, 38409, 140859, 129-326; 7630, HINT1, 38410, 140860, 52-249; 7630, HINT1, 38411, 140861, 97-333; 7630, HINT1, 38412, 140862, 16-213; 7630, HINT1, 38413, 140863, 137-373; 7630, HINT1, 38414, 140864, 36-347; 7630, HINT1, 38415, 140865, 121-432; 7630, HINT1, 38416, 140866, 1-82; 7630, HINT1, 38408, 140858, 281-661; 7631, HINT2, 38417, 140867, 43-534; 7632, HINT3, 38418, 140868, 198-746; 7633, HRG, 38419, 140869, 81-1658; 7634, HARS, 38422, 140872, 234-1421; 7634, HARS, 38423, 140873, 38-1345; 7634, HARS, 38425, 140875, 38-220; 7634, HARS, 38427, 140877, 86-950; 7634, HARS, 38428, 140878, 1821-3143; 7634, HARS, 38420, 140870, 80-1429; 7634, HARS, 38421, 140871, 74-1543; 7634, HARS, 38424, 140874, 38-1447; 7634, HARS, 38426, 140876, 721-2250; 7635, HARS2, 38430, 140880, 36-1040; 7635, HARS2, 38431, 140881, 219-518; 7635, HARS2, 38433, 140883, 192-541; 7635, HARS2, 38434, 140884, 106-648; 7635, HARS2, 38435, 140885, 129-428; 7635, HARS2, 38429, 140879, 224-1744; 7635, HARS2, 38432, 140882, 41-1486; 7636, HM13, 38437, 140887, 32-847; 7636, HM13, 38440, 140890, 96-527; 7636, HM13, 38441, 140891, 1-153; 7636, HM13, 38436, 140886, 125-1309; 7636, HM13, 38438, 140888, 125-1258; 7636, HM13, 38439, 140889, 125-1405; 7637, HMHA1, 38443, 140893, 69-3128; 7637, HMHA1, 38445, 140895, 90-272; 7637, HMHA1, 38446, 140896, 80-3571; 7637, HMHA1, 38447, 140897, 29-539; 7637, HMHA1, 38448, 140898, 281-2596; 7637, HMHA1, 38449, 140899, 76-3498; 7637, HMHA1, 38450, 140900, 1-237; 7637, HMHA1, 38442, 140892, 241-3651; 7637, HMHA1, 38444, 140894, 104-3562; 7638, HMHB1, 38451, 140901, 108-233; 7639, HMSD, 38452, 140902, 203-622; 7639, HMSD, 38453, 140903, 1-162; 7640, HAT1, 38455, 140905, 40-417; 7640, HAT1, 38456, 140906, 54-194; 7640, HAT1, 38454, 140904, 37-1296; 7641, HIRA, 38459, 140909, 1-160; 7641, HIRA, 38457, 140907, 258-3311; 7641, HIRA, 38458, 140908, 221-2653; 7642, HIST1H1A, 38460, 140910, 1-648; 7643, HIST1H1B, 38461, 140911, 1-681; 7644, HIST1H1C, 38462, 140912, 1-642; 7645, HIST1H1D, 38463, 140913, 1-666; 7646, HIST1H1E, 38464, 140914, 38-697; 7647, HIST1H1T, 38465, 140915, 44-667; 7648, HIST1H2AA, 38466, 140916, 1-396; 7649, HIST1H2AB, 38467, 140917, 1-393; 7650, HIST1H2AC, 38468, 140918, 89-481; 7650, HIST1H2AC, 38469, 140919, 89-481; 7650, HIST1H2AC, 38470, 140920, 31-423; 7651, HIST1H2AD, 38471, 140921, 1-393; 7652, HIST1H2AE, 38472, 140922, 1-393; 7653, HIST1H2AG, 38473, 140923, 31-423; 7654, HIST1H2AH, 38474, 140924, 1-387; 7655, HIST1H2AI, 38475, 140925, 12-404; 7656, HIST1H2AJ, 38476, 140926, 1-387; 7657, HIST1H2AK, 38477, 140927, 1-393; 7658, HIST1H2AL, 38478, 140928, 1-393; 7659, HIST1H2AM, 38479, 140929, 1-393; 7660, HIST1H2BA, 38480, 140930, 1-384; 7661, HIST1H2BB, 38482, 140932, 1-381; 7661, HIST1H2BB, 38481, 140931, 1-381; 7662, HIST1H2BC, 38483, 140933, 7-387; 7662, HIST1H2BC, 38484, 140934, 23-403; 7663, HIST1H2BD, 38485, 140935, 25-405; 7663, HIST1H2BD, 38486, 140936, 25-405; 7664, HIST1H2BE, 38488, 140938, 1726-2106; 7664, HIST1H2BE, 38487, 140937, 67-447; 7665, HIST1H2BF, 38489, 140939, 40-420; 7666, HIST1H2BG, 38490, 140940, 50-430; 7667, HIST1H2BH, 38491, 140941, 1-381; 7668, HIST1H2BI, 38492, 140942, 1-381; 7669, HIST1H2BJ, 38494, 140944, 1-65; 7669, HIST1H2BJ, 38493, 140943, 1-381; 7669, HIST1H2BJ, 38495, 140945, 1-381; 7670, HIST1H2BK, 38496, 140946, 1-381; 7671, HIST1H2BL, 38497, 140947, 26-406; 7672, HIST1H2BM, 38498, 140948, 1-381; 7673, HIST1H2BN, 38501, 140951, 62-562; 7673, HIST1H2BN, 38499, 140949, 1-381; 7673, HIST1H2BN, 38500, 140950, 118-498; 7673, HIST1H2BN, 38502, 140952, 903-1283; 7674, HIST1H2BO, 38503, 140953, 1-381; 7675, HIST1H3A, 38504, 140954, 1-411; 7676, HIST1H3B, 38505, 140955, 1-411; 7677, HIST1H3C, 38506, 140956, 1-411; 7678, HIST1H3D, 38507, 140957, 1-411; 7679, HIST1H3E, 38509, 140959, 361-771; 7679, HIST1H3E, 38508, 140958, 1-411; 7680, HIST1H3F, 38510, 140960, 1-411; 7681, HIST1H3G, 38511, 140961, 432-842; 7682, HIST1H3H, 38512, 140962, 11-421; 7683, HIST1H3I, 38513, 140963, 1-411; 7684, HIST1H3J, 38514, 140964, 1-411; 7685, HIST1H4A, 38515, 140965, 1-312; 7686, HIST1H4B, 38516, 140966, 1-312; 7687, HIST1H4C, 38517, 140967, 73-384; 7688, HIST1H4D, 38518, 140968, 1-312; 7689, HIST1H4E, 38519, 140969, 94-405; 7690, HIST1H4F, 38520, 140970, 1-312; 7691, HIST1H4G, 38521, 140971, 1-297; 7692, HIST1H4H, 38523, 140973, 36-347; 7692, HIST1H4H, 38524, 140974, 36-347; 7692, HIST1H4H, 38525, 140975, 140-451; 7692, HIST1H4H, 38522, 140972, 11-322; 7693, HIST1H4I, 38526, 140976, 722-1033; 7694, HIST1H4J, 38527, 140977, 18-329; 7695, HIST1H4K, 38528, 140978, 1-312; 7696, HIST1H4L, 38529, 140979, 1-312; 7697, HIST2H2AA3, 38530, 140980, 39-431; 7698, HIST2H2AA4, 38531, 140981, 54-446; 7699, HIST2H2AB, 38532, 140982, 1-393; 7700, HIST2H2AC, 38533, 140983, 1-390; 7701, HIST2H2BE, 38534, 140984, 13-393; 7701, HIST2H2BE, 38535, 140985, 2-379; 7702, HIST2H2BF, 38536, 140986, 37-417; 7702, HIST2H2BF, 38537, 140987, 51-455; 7703, HIST2H3PS2, 38538, 140988, 1-411; 7704, HIST2H3A, 38539, 140989, 37-447; 7705, HIST2H3C, 38540, 140990, 37-447; 7706, HIST2H3D, 38541, 140991, 1-411; 7707, HIST2H4A, 38542, 140992, 27-338; 7707, HIST2H4A, 38543, 140993, 16-327; 7707, HIST2H4A, 38544, 140994, 18-329; 7707, HIST2H4A, 38545, 140995, 8-319; 7708, HIST2H4B, 38546, 140996, 80-391; 7708, HIST2H4B, 38547, 140997, 8-319; 7708, HIST2H4B, 38548, 140998, 18-329; 7709, HIST3H2A, 38549, 140999, 57-449; 7710, HIST3H2BB, 38550, 141000, 24-404; 7711, HIST3H3, 38551, 141001, 1-411; 7712, HIST4H4, 38552, 141002, 48-359; 7712, HIST4H4, 38553, 141003, 48-359; 7713, HDAC1, 38555, 141005, 31-664; 7713, HDAC1, 38554, 141004, 85-1533; 7714, HDAC10, 38558, 141008, 230-520; 7714, HDAC10, 38559, 141009, 209-2068; 7714, HDAC10, 38561, 141011, 48-338; 7714, HDAC10, 38562, 141012, 374-664; 7714, HDAC10, 38556, 141006, 354-2363; 7714, HDAC10, 38557, 141007, 1-1950; 7714, HDAC10, 38560, 141010, 1-1191; 7715, HDAC11, 38564, 141014, 154-510; 7715, HDAC11, 38565, 141015, 46-852; 7715, HDAC11, 38566, 141016, 67-612; 7715, HDAC11, 38567, 141017, 186-799; 7715, HDAC11, 38568, 141018, 25-768; 7715, HDAC11, 38569, 141019, 25-465; 7715, HDAC11, 38570, 141020, 83-1042; 7715, HDAC11, 38571, 141021, 234-731; 7715, HDAC11, 38572, 141022, 16-520; 7715, HDAC11, 38573, 141023, 43-204; 7715, HDAC11, 38574, 141024, 218-928; 7715, HDAC11, 38575, 141025, 306-580; 7715, HDAC11, 38576, 141026, 259-580; 7715, HDAC11, 38577, 141027, 476-1186; 7715, HDAC11, 38563, 141013, 184-1227; 7715, HDAC11, 38578, 141028, 119-1009; 7716, HDAC2, 38580, 141030, 1-486; 7716, HDAC2, 38581, 141031, 240-549; 7716, HDAC2, 38582, 141032, 230-557; 7716, HDAC2, 38583, 141033, 245-502; 7716, HDAC2, 38584, 141034, 352-564; 7716, HDAC2, 38585, 141035, 372-551; 7716, HDAC2, 38586, 141036, 413-570; 7716, HDAC2, 38587, 141037, 361-557; 7716, HDAC2, 38588, 141038, 280-580; 7716, HDAC2, 38579, 141029, 368-1744; 7716, HDAC2, 38589, 141039, 284-1660; 7716, HDAC2, 38590, 141040, 378-1844; 7717, HDAC3, 38592, 141042, 44-699; 7717, HDAC3, 38593, 141043, 49-210; 7717, HDAC3, 38591, 141041, 81-1367; 7718, HDAC4, 38595, 141045, 1-445; 7718, HDAC4, 38596, 141046, 186-554; 7718, HDAC4, 38597, 141047, 78-565; 7718, HDAC4, 38598, 141048, 1-527; 7718, HDAC4, 38599, 141049, 254-342; 7718, HDAC4, 38594, 141044, 793-4047; 7718, HDAC4, 38600, 141050, 1144-4062; 7719, HDAC5, 38603, 141053, 1-846; 7719, HDAC5, 38604, 141054, 208-445; 7719, HDAC5, 38605, 141055, 384-504; 7719, HDAC5, 38607, 141057, 463-667; 7719, HDAC5, 38601, 141051, 325-3696; 7719, HDAC5, 38602, 141052, 305-3418; 7719, HDAC5, 38606, 141056, 212-3580; 7720, HDAC6, 38609, 141059, 105-736; 7720, HDAC6, 38611, 141061, 276-907; 7720, HDAC6, 38612, 141062, 157-583; 7720, HDAC6, 38613, 141063, 117-599; 7720, HDAC6, 38614, 141064, 144-658; 7720, HDAC6, 38615, 141065, 1-254; 7720, HDAC6, 38616, 141066, 75-882; 7720, HDAC6, 38617, 141067, 68-568; 7720, HDAC6, 38618, 141068, 458-610; 7720, HDAC6, 38608, 141058, 179-3826; 7720, HDAC6, 38610, 141060, 168-3815; 7721, HDAC7, 38621, 141071, 8-3052; 7721, HDAC7, 38622, 141072, 336-569; 7721, HDAC7, 38623, 141073, 186-645; 7721, HDAC7, 38624, 141074, 96-555; 7721, HDAC7, 38625, 141075, 211-364; 7721, HDAC7, 38626, 141076, 91-914; 7721, HDAC7, 38627, 141077, 242-579; 7721, HDAC7, 38628, 141078, 177-576; 7721, HDAC7, 38629, 141079, 99-404; 7721, HDAC7, 38630, 141080, 139-402; 7721, HDAC7, 38632, 141082, 170-593; 7721, HDAC7, 38633, 141083, 102-580; 7721, HDAC7, 38634, 141084, 170-583; 7721, HDAC7, 38635, 141085, 1-1154; 7721, HDAC7, 38636, 141086, 1-331; 7721, HDAC7, 38637, 141087, 1-185; 7721, HDAC7, 38638, 141088, 1-459; 7721, HDAC7, 38640, 141090, 216-890; 7721, HDAC7, 38641, 141091, 1-616; 7721, HDAC7, 38619, 141069, 1-2976; 7721, HDAC7, 38620, 141070, 82-2946; 7721, HDAC7, 38631, 141081, 158-3016; 7721, HDAC7, 38639, 141089, 102-3026; 7722, HDAC8, 38645, 141095, 64-534; 7722, HDAC8, 38646, 141096, 293-1037; 7722, HDAC8, 38647, 141097, 83-844; 7722, HDAC8, 38649, 141099, 77-271; 7722, HDAC8, 38651, 141101, 16-913; 7722, HDAC8, 38652, 141102, 198-592; 7722, HDAC8, 38653, 141103, 10-180; 7722, HDAC8, 38654, 141104, 319-486; 7722, HDAC8, 38656, 141106, 98-655; 7722, HDAC8, 38642, 141092, 93-533; 7722, HDAC8, 38643, 141093, 53-529; 7722, HDAC8, 38644, 141094, 52-471; 7722, HDAC8, 38648, 141098, 343-1476; 7722, HDAC8, 38650, 141100, 343-1203; 7722, HDAC8, 38655, 141105, 288-1058; 7723, HDAC9, 38658, 141108, 53-1786; 7723, HDAC9, 38662, 141112, 356-799; 7723, HDAC9, 38665, 141115, 254-584; 7723, HDAC9, 38667, 141117, 535-602; 7723, HDAC9, 38669, 141119, 334-545; 7723, HDAC9, 38670, 141120, 136-550; 7723, HDAC9, 38671, 141121, 128-244; 7723, HDAC9, 38673, 141123, 320-1969; 7723, HDAC9, 38657, 141107, 42-3119; 7723, HDAC9, 38659, 141109, 151-1923; 7723, HDAC9, 38660, 141110, 151-3351; 7723, HDAC9, 38661, 141111, 246-1934; 7723, HDAC9, 38663, 141113, 141-1781; 7723, HDAC9, 38664, 141114, 362-2128; 7723, HDAC9, 38666, 141116, 1-3210; 7723, HDAC9, 38668, 141118, 1-3036; 7723, HDAC9, 38672, 141122, 206-1747; 7724, HINFP, 38675, 141125, 273-572; 7724, HINFP, 38676, 141126, 515-676; 7724, HINFP, 38674, 141124, 64-1617; 7724, HINFP, 38677, 141127, 35-1294; 7725, HTATIP2, 38685, 141135, 59-649; 7725, HTATIP2, 38678, 141128, 76-804; 7725, HTATIP2, 38679, 141129, 70-900; 7725, HTATIP2, 38680, 141130, 442-1170; 7725, HTATIP2, 38681, 141131, 29-757; 7725, HTATIP2, 38682, 141132, 98-499; 7725, HTATIP2, 38683, 141133, 61-462; 7725, HTATIP2, 38684, 141134, 67-468; 7726, HTATSF1, 38687, 141137, 281-1014; 7726, HTATSF1, 38688, 141138, 216-885; 7726, HTATSF1, 38686, 141136, 175-2442; 7726, HTATSF1, 38689, 141139, 423-2690; 7727, HKR1, 38692, 141142, 1023-2183; 7727, HKR1, 38693, 141143, 290-2086; 7727, HKR1, 38694, 141144, 460-527; 7727, HKR1, 38695, 141145, 94-369; 7727, HKR1, 38696, 141146, 253-573; 7727, HKR1, 38697, 141147, 237-512; 7727, HKR1, 38698, 141148, 338-568; 7727, HKR1, 38699, 141149, 1642-2802; 7727, HKR1, 38700, 141150, 128-643; 7727, HKR1, 38701, 141151, 309-704; 7727, HKR1, 38702, 141152, 169-294; 7727, HKR1, 38703, 141153, 231-371; 7727, HKR1, 38704, 141154, 138-2063; 7727, HKR1, 38705, 141155, 290-454; 7727, HKR1, 38706, 141156, 182-563; 7727, HKR1, 38707, 141157, 368-480; 7727, HKR1, 38708, 141158, 512-576; 7727, HKR1, 38690, 141140, 270-2249; 7727, HKR1, 38691, 141141, 174-2096; 7728, HCG27, 38709, 141159, 1-569; 7728, HCG27, 38710, 141160, 1-490; 7729, N/A, 38711, 141161, 64-864; 7729, N/A, 38712, 141162, 24-833; 7730, HMGXB3, 38714, 141164, 862-4644; 7730, HMGXB3, 38715, 141165, 1-337; 7730, HMGXB3, 38713, 141163, 465-4343; 7730, HMGXB3, 38716, 141166, 1-4617; 7731, HMGXB4, 38718, 141168, 140-418; 7731, HMGXB4, 38719, 141169, 403-1257; 7731, HMGXB4, 38720, 141170, 474-1325; 7731, HMGXB4, 38717, 141167, 129-1934; 7732, HBP1, 38722, 141172, 378-702; 7732, HBP1, 38723, 141173, 269-601; 7732, HBP1, 38724, 141174, 1-1365; 7732, HBP1, 38725, 141175, 352-563; 7732, HBP1, 38727, 141177, 1-258; 7732, HBP1, 38728, 141178, 106-478; 7732, HBP1, 38729, 141179, 489-573; 7732, HBP1, 38731, 141181, 1-464; 7732, HBP1, 38721, 141171, 187-1731; 7732, HBP1, 38726, 141176, 672-2216; 7732, HBP1, 38730, 141180, 83-1627; 7733, N/A, 38733, 141183, 161-445; 7733, N/A, 38734, 141184, 207-643; 7733, N/A, 38735, 141185, 123-422; 7733, N/A, 38736, 141186, 93-568; 7733, N/A, 38732, 141182, 263-778; 7733, N/A, 38737, 141187, 98-613; 7734, HNF1A, 38738, 141188, 227-2122; 7734, HNF1A, 38739, 141189, 119-244; 7734, HNF1A, 38740, 141190, 21-1937; 7734, HNF1A, 38741, 141191, 144-1502; 7734, HNF1A, 38743, 141193, 24-2012; 7734, HNF1A, 38746, 141196, 1-1070; 7734, HNF1A, 38747, 141197, 202-1830; 7734, HNF1A, 38748, 141198, 144-851; 7734, HNF1A, 38749, 141199, 344-1027; 7734, HNF1A, 38742, 141192, 119-862; 7734, HNF1A, 38744, 141194, 119-955; 7734, HNF1A, 38745, 141195, 24-383; 7735, HNF1B, 38750, 141200, 135-1508; 7735, HNF1B, 38751, 141201, 135-1412; 7735, HNF1B, 38752, 141202, 135-1508; 7735, HNF1B, 38754, 141204, 222-1103; 7735, HNF1B, 38755, 141205, 222-1103; 7735, HNF1B, 38756, 141206, 135-1781; 7735, HNF1B, 38758, 141208, 135-1412; 7735, HNF1B, 38761, 141211, 135-1781; 7735, HNF1B, 38753, 141203, 364-2037; 7735, HNF1B, 38757, 141207, 176-1771; 7735, HNF1B, 38759, 141209, 364-2037; 7735, HNF1B, 38760, 141210, 176-1771; 7736, HNRNPUL2-BSCL2, 38762, 141212, 229-2469; 7737, HJURP, 38763, 141213, 67-1776; 7737, HJURP, 38764, 141214, 1-206; 7737, HJURP, 38766, 141216, 36-404; 7737, HJURP, 38768, 141218, 1-806; 7737, HJURP, 38765, 141215, 67-2058; 7737, HJURP, 38767, 141217, 67-2151; 7737, HJURP, 38769, 141219, 67-2313; 7738, HLCS, 38772, 141222, 504-780; 7738, HLCS, 38773, 141223, 443-702; 7738, HLCS, 38774, 141224, 436-666; 7738, HLCS, 38770, 141220, 472-2652; 7738, HLCS, 38771, 141221, 1232-3412; 7738, HLCS, 38775, 141225, 574-2754; 7739, HCCS, 38776, 141226, 203-1009; 7739, HCCS, 38777, 141227, 197-1003; 7739, HCCS, 38778, 141228, 125-931; 7740, HOXA1, 38780, 141230, 85-498; 7740, HOXA1, 38779, 141229, 63-1070; 7741, HOXA10, 38783, 141233, 1-609; 7741, HOXA10, 38781, 141231, 1-1233; 7741, HOXA10, 38782, 141232, 607-891; 7742, HOXA11, 38785, 141235, 1-851; 7742, HOXA11, 38784, 141234, 73-1014; 7743, HOXA13, 38786, 141236, 30-1196; 7744, HOXA2, 38787, 141237, 312-1442; 7745, HOXA3, 38790, 141240, 329-581; 7745, HOXA3, 38791, 141241, 342-503; 7745, HOXA3, 38788, 141238, 527-1858; 7745, HOXA3, 38789, 141239, 201-1532; 7745, HOXA3, 38792, 141242, 340-1671; 7746, HOXA4, 38795, 141245, 1-421; 7746, HOXA4, 38793, 141243, 67-1029; 7746, HOXA4, 38794, 141244, 1-963; 7746, HOXA4, 38796, 141246, 48-1010; 7747, HOXA5, 38797, 141247, 62-874; 7748, HOXA6, 38798, 141248, 26-727; 7749, HOXA7, 38800, 141250, 494-585; 7749, HOXA7, 38799, 141249, 133-825; 7750, HOXA9, 38802, 141252, 70-390; 7750, HOXA9, 38801, 141251, 74-892; 7751, HOMEZ, 38805, 141255, 1-972; 7751, HOMEZ, 38803, 141253, 166-1818; 7751, HOMEZ, 38804, 141254, 160-1818; 7752, HOXB1, 38806, 141256, 94-999; 7752, HOXB1, 38807, 141257, 7-705; 7753, HOXB13, 38808, 141258, 586-1440; 7754, HOXB2, 38809, 141259, 79-1149; 7755, HOXB3, 38812, 141262, 296-565; 7755, HOXB3, 38818, 141268, 251-610; 7755, HOXB3, 38819, 141269, 139-1032; 7755, HOXB3, 38810, 141260, 898-2193; 7755, HOXB3, 38811, 141261, 1449-2744; 7755, HOXB3, 38813, 141263, 559-1458; 7755, HOXB3, 38814, 141264, 703-1779; 7755, HOXB3, 38815, 141265, 125-1420; 7755, HOXB3, 38816, 141266, 311-1387; 7755, HOXB3, 38817, 141267, 573-1868; 7756, HOXB4, 38820, 141270, 1793-2548; 7757, HOXB5, 38821, 141271, 280-1089; 7758, HOXB6, 38822, 141272, 326-1000; 7758, HOXB6, 38823, 141273, 624-1298; 7759, HOXB7, 38824, 141274, 103-756; 7760, HOXB8, 38826, 141276, 1-386; 7760, HOXB8, 38827, 141277, 1-729; 7760, HOXB8, 38825, 141275, 236-967; 7761, HOXB9, 38828, 141278, 88-840; 7762, HOXC10, 38830, 141280, 145-526; 7762, HOXC10, 38829, 141279, 75-1103; 7763, HOXC11, 38831, 141281, 115-1251; 7763, HOXC11, 38832, 141282, 117-1031; 7764, HOXC12, 38833, 141283, 97-945; 7765, HOXC13, 38834, 141284, 143-1135; 7766, HOXC4, 38835, 141285, 608-1402; 7766, HOXC4, 38836, 141286, 47-841; 7767,

HOXC5, 38837, 141287, 271-939; 7768, HOXC6, 38840, 141290, 146-358; 7768, HOXC6, 38841, 141291, 384-538; 7768, HOXC6, 38838, 141288, 165-872; 7768, HOXC6, 38839, 141289, 1711-2172; 7769, HOXC8, 38842, 141292, 180-908; 7770, HOXC9, 38843, 141293, 71-853; 7770, HOXC9, 38844, 141294, 99-881; 7771, HMBOX1, 38847, 141297, 458-811; 7771, HMBOX1, 38848, 141298, 1-138; 7771, HMBOX1, 38849, 141299, 112-1272; 7771, HMBOX1, 38852, 141302, 333-1523; 7771, HMBOX1, 38853, 141303, 333-1426; 7771, HMBOX1, 38855, 141305, 227-1387; 7771, HMBOX1, 38845, 141295, 343-1605; 7771, HMBOX1, 38846, 141296, 705-1967; 7771, HMBOX1, 38850, 141300, 6-1337; 7771, HMBOX1, 38851, 141301, 112-1026; 7771, HMBOX1, 38854, 141304, 342-1559; 7772, HOXD1, 38856, 141306, 224-1210; 7773, HOXD10, 38857, 141307, 256-1278; 7774, HOXD11, 38859, 141309, 40-525; 7774, HOXD11, 38858, 141308, 71-1087; 7775, HOXD12, 38860, 141310, 1-741; 7775, HOXD12, 38861, 141311, 73-885; 7776, HOXD13, 38862, 141312, 1-1032; 7777, HOXD3, 38865, 141315, 128-428; 7777, HOXD3, 38863, 141313, 177-1475; 7777, HOXD3, 38864, 141314, 275-1573; 7778, HOXD4, 38866, 141316, 413-1180; 7779, HOXD8, 38868, 141318, 205-525; 7779, HOXD8, 38870, 141320, 187-747; 7779, HOXD8, 38867, 141317, 628-1500; 7779, HOXD8, 38869, 141319, 11-880; 7780, HOXD9, 38872, 141322, 37-1062; 7780, HOXD9, 38871, 141321, 50-1108; 7781, HIPK1, 38874, 141324, 1-1474; 7781, HIPK1, 38876, 141326, 84-3581; 7781, HIPK1, 38879, 141329, 188-3718; 7781, HIPK1, 38881, 141331, 218-574; 7781, HIPK1, 38882, 141332, 252-570; 7781, HIPK1, 38883, 141333, 162-3659; 7781, HIPK1, 38873, 141323, 195-2705; 7781, HIPK1, 38875, 141325, 64-2514; 7781, HIPK1, 38877, 141327, 233-3865; 7781, HIPK1, 38878, 141328, 162-3389; 7781, HIPK1, 38880, 141330, 344-3976; 7782, HIPK2, 38884, 141334, 1-2736; 7782, HIPK2, 38885, 141335, 96-3692; 7782, HIPK2, 38886, 141336, 156-3671; 7783, HIPK3, 38891, 141341, 363-591; 7783, HIPK3, 38887, 141337, 306-3953; 7783, HIPK3, 38888, 141338, 306-3890; 7783, HIPK3, 38889, 141339, 363-3947; 7783, HIPK3, 38890, 141340, 84-3668; 7784, HIPK4, 38892, 141342, 286-2136; 7785, HOMER1, 38896, 141346, 21-563; 7785, HOMER1, 38893, 141343, 21-695; 7785, HOMER1, 38894, 141344, 1444-2508; 7785, HOMER1, 38895, 141345, 21-554; 7786, HOMER2, 38899, 141349, 1-13; 7786, HOMER2, 38900, 141350, 1-555; 7786, HOMER2, 38897, 141347, 194-1258; 7786, HOMER2, 38898, 141348, 187-1218; 7787, HOMER3, 38906, 141356, 208-666; 7787, HOMER3, 38907, 141357, 224-675; 7787, HOMER3, 38909, 141359, 514-770; 7787, HOMER3, 38910, 141360, 137-866; 7787, HOMER3, 38901, 141351, 68-1144; 7787, HOMER3, 38902, 141352, 232-1317; 7787, HOMER3, 38903, 141353, 100-1176; 7787, HOMER3, 38904, 141354, 654-1739; 7787, HOMER3, 38905, 141355, 522-1607; 7787, HOMER3, 38908, 141358, 1-978; 7788, N/A, 38911, 141361, 9-16226; 7789, N/A, 38912, 141362, 513-2243; 7790, N/A, 38913, 141363, 425-1105; 7790, N/A, 38914, 141364, 131-940; 7790, N/A, 38915, 141365, 477-1157; 7790, N/A, 38916, 141366, 198-584; 7790, N/A, 38917, 141367, 75-635; 7790, N/A, 38918, 141368, 131-610; 7791, HERPUD1, 38923, 141373, 88-567; 7791, HERPUD1, 38924, 141374, 1-680; 7791, HERPUD1, 38925, 141375, 99-260; 7791, HERPUD1, 38926, 141376, 1-329; 7791, HERPUD1, 38927, 141377, 112-562; 7791, HERPUD1, 38928, 141378, 1-451; 7791, HERPUD1, 38919, 141369, 99-1271; 7791, HERPUD1, 38920, 141370, 99-797; 7791, HERPUD1, 38921, 141371, 86-1186; 7791, HERPUD1, 38922, 141372, 198-1373; 7792, HGD, 38930, 141380, 1-266; 7792, HGD, 38931, 141381, 1-437; 7792, HGD, 38932, 141382, 37-462; 7792, HGD, 38933, 141383, 1-297; 7792, HGD, 38929, 141379, 461-1798; 7793, HOOK1, 38935, 141385, 108-519; 7793, HOOK1, 38934, 141384, 258-2444; 7794, HOOK2, 38938, 141388, 288-965; 7794, HOOK2, 38939, 141389, 122-748; 7794, HOOK2, 38940, 141390, 1-215; 7794, HOOK2, 38941, 141391, 284-565; 7794, HOOK2, 38942, 141392, 225-607; 7794, HOOK2, 38943, 141393, 330-801; 7794, HOOK2, 38944, 141394, 288-1097; 7794, HOOK2, 38936, 141386, 172-2325; 7794, HOOK2, 38937, 141387, 75-2234; 7795, HOOK3, 38946, 141396, 1-94; 7795, HOOK3, 38947, 141397, 1-485; 7795, HOOK3, 38948, 141398, 1-305; 7795, HOOK3, 38945, 141395, 201-2357; 7796, HOPX, 38949, 141399, 186-407; 7796, HOPX, 38950, 141400, 658-879; 7796, HOPX, 38951, 141401, 221-442; 7796, HOPX, 38952, 141402, 68-352; 7796, HOPX, 38953, 141403, 536-811; 7796, HOPX, 38954, 141404, 238-459; 7796, HOPX, 38955, 141405, 305-526; 7796, HOPX, 38956, 141406, 536-874; 7796, HOPX, 38957, 141407, 121-342; 7796, HOPX, 38958, 141408, 195-416; 7796, HOPX, 38959, 141409, 196-417; 7796, HOPX, 38960, 141410, 58-279; 7797, HORMAD1, 38963, 141413, 220-791; 7797, HORMAD1, 38965, 141415, 248-740; 7797, HORMAD1, 38961, 141411, 116-1279; 7797, HORMAD1, 38962, 141412, 107-1291; 7797, HORMAD1, 38964, 141414, 256-1200; 7798, HORMAD2, 38968, 141418, 58-333; 7798, HORMAD2, 38966, 141416, 356-1279; 7798, HORMAD2, 38967, 141417, 286-1209; 7799, HUNK, 38970, 141420, 1-339; 7799, HUNK, 38971, 141421, 1-486; 7799, HUNK, 38969, 141419, 361-2505; 7800, HRNR, 38972, 141422, 77-8629; 7801, HCFC1, 38974, 141424, 345-6587; 7801, HCFC1, 38975, 141425, 1-1834; 7801, HCFC1, 38973, 141423, 968-7075; 7802, HCFC1R1, 38977, 141427, 333-743; 7802, HCFC1R1, 38978, 141428, 134-495; 7802, HCFC1R1, 38979, 141429, 80-376; 7802, HCFC1R1, 38976, 141426, 306-722; 7802, HCFC1R1, 38980, 141430, 21-380; 7802, HCFC1R1, 38981, 141431, 242-658; 7803, HCFC2, 38984, 141434, 512-746; 7803, HCFC2, 38982, 141432, 105-2483; 7803, HCFC2, 38983, 141433, 20-1258; 7804, N/A, 38985, 141435, 359-697; 7805, HRASLS, 38986, 141436, 95-916; 7805, HRASLS, 38987, 141437, 1-336; 7806, HRASLS2, 38988, 141438, 60-548; 7807, HRASLS5, 38990, 141440, 1-114; 7807, HRASLS5, 38992, 141442, 1-148; 7807, HRASLS5, 38994, 141444, 676-732; 7807, HRASLS5, 38989, 141439, 161-1000; 7807, HRASLS5, 38991, 141441, 135-896; 7807, HRASLS5, 38993, 141443, 134-943; 7808, HSCB, 38996, 141446, 42-473; 7808, HSCB, 38997, 141447, 55-372; 7808, HSCB, 38998, 141448, 36-467; 7808, HSCB, 38995, 141445, 66-773; 7809, HSPBP1, 39001, 141451, 145-557; 7809, HSPBP1, 39002, 141452, 243-884; 7809, HSPBP1, 39003, 141453, 97-666; 7809, HSPBP1, 39004, 141454, 133-424; 7809, HSPBP1, 39006, 141456, 442-536; 7809, HSPBP1, 39007, 141457, 287-696; 7809, HSPBP1, 38999, 141449, 312-1391; 7809, HSPBP1, 39000, 141450, 238-1317; 7809, HSPBP1, 39005, 141455, 249-1328; 7810, HSPBAP1, 39008, 141458, 145-1611; 7811, HSPB2-C11orf52, 39009, 141459, 89-247; 7811, HSPB2-C11orf52, 39010, 141460, 95-643; 7812, HSPE1-MOB4, 39011, 141461, 25-810; 7813, HTRA1, 39013, 141463, 1-666; 7813, HTRA1, 39012, 141462, 129-1571; 7814, HTRA2, 39016, 141466, 1-1272; 7814, HTRA2, 39014, 141464, 631-2007; 7814, HTRA2, 39015, 141465, 18-1103; 7815, HTRA3, 39017, 141467, 205-1566; 7815, HTRA3, 39018, 141468, 193-1266; 7816, HTRA4, 39019, 141469, 101-1531; 7817, HIVEP1, 39021, 141471, 1-131; 7817, HIVEP1, 39022, 141472, 324-1044; 7817, HIVEP1, 39023, 141473, 159-585; 7817, HIVEP1, 39024, 141474, 192-576; 7817, HIVEP1, 39025, 141475, 43-186; 7817, HIVEP1, 39026, 141476, 218-579; 7817, HIVEP1, 39027, 141477, 333-8486; 7817, HIVEP1, 39028, 141478, 6636-8387; 7817, HIVEP1, 39020, 141470, 333-8489; 7818, HIVEP2, 39029, 141479, 546-7886; 7818, HIVEP2, 39030, 141480, 744-8084; 7818, HIVEP2, 39031, 141481, 641-7981; 7819, HIVEP3, 39032, 141482, 807-8027; 7819, HIVEP3, 39033, 141483, 887-8107; 7819, HIVEP3, 39034, 141484, 1016-8233; 7820, HTT, 39036, 141486, 1-337; 7820, HTT, 39035, 141485, 146-9574; 7821, HIP1, 39039, 141489, 146-583; 7821, HIP1, 39037, 141487, 28-3141; 7821, HIP1, 39038, 141488, 22-2982; 7821, HIP1, 39040, 141490, 5-3031; 7822, HIP1R, 39042, 141492, 1-593; 7822, HIP1R, 39041, 141491, 126-3332; 7823, HYPK, 39044, 141494, 1-249; 7823, HYPK, 39046, 141496, 2428-3033; 7823, HYPK, 39043, 141493, 4112-4501; 7823, HYPK, 39045, 141495, 177-566; 7824, HYPM, 39047, 141497, 24-377; 7825, HAP1, 39052, 141502, 1-222; 7825, HAP1, 39053, 141503, 1-121; 7825, HAP1, 39054, 141504, 1-336; 7825, HAP1, 39048, 141498, 11-2026; 7825, HAP1, 39049, 141499, 11-1870; 7825, HAP1, 39050, 141500, 11-1819; 7825, HAP1, 39051, 141501, 11-1795; 7826, HUS1, 39056, 141506, 145-579; 7826, HUS1, 39059, 141509, 1-316; 7826, HUS1, 39060, 141510, 77-627; 7826, HUS1, 39061, 141511, 91-573; 7826, HUS1, 39055, 141505, 25-867; 7826, HUS1, 39057, 141507, 156-935; 7826, HUS1, 39058, 141508, 63-905; 7826, HUS1, 39062, 141512, 156-935; 7827, HUS1B, 39063, 141513, 20-856; 7828, HAPLN1, 39065, 141515, 203-799; 7828, HAPLN1, 39066, 141516, 241-726; 7828, HAPLN1, 39067, 141517, 315-823; 7828, HAPLN1, 39068, 141518, 215-989; 7828, HAPLN1, 39069, 141519, 102-560; 7828, HAPLN1, 39070, 141520, 22-568; 7828, HAPLN1, 39064, 141514, 852-1916; 7829, HAPLN2, 39072, 141522, 327-882; 7829, HAPLN2, 39071, 141521, 408-1430; 7830, HAPLN3, 39074, 141524, 121-681; 7830, HAPLN3, 39075, 141525, 123-801; 7830, HAPLN3, 39076, 141526, 140-1408; 7830, HAPLN3, 39073, 141523, 216-1298; 7831, HAPLN4, 39077, 141527, 65-1273; 7832, HABP2, 39078, 141528, 97-1779; 7832, HABP2, 39079, 141529, 135-1739; 7833, HABP4, 39080, 141530, 76-1317; 7833, HABP4, 39081, 141531, 80-1006; 7834, HAS1, 39083, 141533, 62-1795; 7834, HAS1, 39084, 141534, 1-645; 7834, HAS1, 39085, 141535, 1-421; 7834, HAS1, 39086, 141536, 14-1771; 7834, HAS1, 39082, 141532, 36-1772; 7835, HAS2, 39087, 141537, 539-2197; 7836, HAS3, 39091, 141541, 108-900; 7836, HAS3, 39088, 141538, 61-906; 7836, HAS3, 39089, 141539, 157-1818; 7836, HAS3, 39090, 141540, 225-1886; 7837, HMMR, 39096, 141546, 333-609; 7837, HMMR, 39097, 141547, 416-720; 7837, HMMR, 39092, 141542, 328-2457; 7837, HMMR, 39093, 141543, 37-2211; 7837, HMMR, 39094, 141544, 144-2321; 7837, HMMR, 39095, 141545, 94-2010; 7838, HYAL1, 39103, 141553, 354-561; 7838, HYAL1, 39105, 141555, 258-567; 7838, HYAL1, 39098, 141548, 617-1924; 7838, HYAL1, 39099, 141549, 428-1735; 7838, HYAL1, 39100, 141550, 133-1350; 7838, HYAL1, 39101, 141551, 180-1487; 7838, HYAL1, 39102, 141552, 135-665; 7838, HYAL1, 39104, 141554, 322-1083; 7838, HYAL1, 39106, 141556, 325-1632; 7839, HYAL2, 39109, 141559, 198-550; 7839, HYAL2, 39110, 141560, 383-745; 7839, HYAL2, 39112, 141562, 159-301; 7839, HYAL2, 39114, 141564, 114-357; 7839, HYAL2, 39115, 141565, 342-571; 7839, HYAL2, 39107, 141557, 301-1722; 7839, HYAL2, 39108, 141558, 395-1816; 7839, HYAL2, 39111, 141561, 2294-3715; 7839, HYAL2, 39113, 141563, 580-2001; 7840, HYAL3, 39118, 141568, 67-545; 7840, HYAL3, 39116, 141566, 274-1527; 7840, HYAL3, 39117, 141567, 57-1220; 7840, HYAL3, 39119, 141569, 38-1201; 7840, HYAL3, 39120, 141570, 188-694; 7840, HYAL3, 39121, 141571, 19-435; 7840, HYAL3, 39122, 141572, 29-1282; 7841, HYAL4, 39125, 141575, 178-314; 7841, HYAL4, 39126, 141576, 399-589; 7841, HYAL4, 39127, 141577, 77-1126; 7841, HYAL4, 39123, 141573, 639-2084; 7841, HYAL4, 39124, 141574, 141-1586; 7842, N/A, 39128, 141578, 1-455; 7842, N/A, 39129, 141579, 1-130; 7842, N/A, 39130, 141580, 15-2192; 7842, N/A, 39131, 141581, 432-540; 7842, N/A, 39132, 141582, 491-609; 7842, N/A, 39133, 141583, 1-1587; 7842, N/A, 39134, 141584, 1-2502; 7842, N/A, 39135, 141585, 36-2888; 7842, N/A, 39136, 141586, 28-2850; 7842, N/A, 39137, 141587, 152-3205; 7842, N/A, 39138, 141588, 1-341; 7842, N/A, 39139, 141589, 1-248; 7842, N/A, 39140, 141590, 1-148; 7842, N/A, 39141, 141591, 1-614; 7842, N/A, 39142, 141592, 1-383; 7842, N/A, 39143, 141593, 152-15517; 7843, HYDIN, 39144, 141594, 15-2192; 7843, HYDIN, 39148, 141598, 1-614; 7843, HYDIN, 39149, 141599, 432-540; 7843, HYDIN, 39150, 141600, 491-609; 7843, HYDIN, 39152, 141602, 1-383; 7843, HYDIN, 39153, 141603, 1-341; 7843, HYDIN, 39154, 141604, 1-130; 7843, HYDIN, 39155, 141605, 1-455; 7843, HYDIN, 39156, 141606, 1-148; 7843, HYDIN, 39157, 141607, 1-1587; 7843, HYDIN, 39158, 141608, 1-2502; 7843, HYDIN, 39159, 141609, 1-248; 7843, HYDIN, 39145, 141595, 152-3205; 7843, HYDIN, 39146, 141596, 152-15517; 7843, HYDIN, 39147, 141597, 28-2850; 7843, HYDIN, 39151, 141601, 36-2888; 7844, HVCN1, 39163, 141613, 305-539; 7844, HVCN1, 39164, 141614, 23-262; 7844, HVCN1, 39166, 141616, 188-829; 7844, HVCN1, 39160, 141610, 182-1003; 7844, HVCN1, 39161, 141611, 755-1576; 7844, HVCN1, 39162, 141612, 177-938; 7844, HVCN1, 39165, 141615, 210-977; 7844, HVCN1, 39167, 141617, 23-844; 7845, HYLS1, 39168, 141618, 535-1434; 7845, HYLS1, 39169, 141619, 782-1681; 7845, HYLS1, 39170, 141620, 555-1454; 7846, HAO1, 39171, 141621, 53-1165; 7847, HAO2, 39174, 141624, 133-691; 7847, HAO2, 39172, 141622, 74-1129; 7847, HAO2, 39173, 141623, 284-1378; 7847, HAO2, 39175, 141625, 353-1408; 7848, HADH, 39177, 141627, 43-1215; 7848, HADH, 39178, 141628, 79-237; 7848, HADH, 39179, 141629, 274-1230; 7848, HADH, 39181, 141631, 1-957; 7848, HADH, 39176, 141626, 150-1094; 7848, HADH, 39180, 141630, 220-1215; 7849, HADHA, 39183, 141633, 1-752; 7849, HADHA, 39182, 141632, 131-2422; 7850, HADHB, 39185, 141635, 74-1129; 7850, HADHB, 39186, 141636, 170-696; 7850, HADHB, 39187, 141637, 321-574; 7850, HADHB, 39188, 141638, 109-557; 7850, HADHB, 39190, 141640, 252-1631; 7850, HADHB, 39184, 141634, 105-1529; 7850, HADHB, 39189, 141639, 1-1359; 7851, HAGH, 39194, 141644, 1-718; 7851, HAGH, 39195, 141645, 286-1062; 7851, HAGH, 39196, 141646, 341-820; 7851, HAGH, 39197, 141647, 1-195; 7851, HAGH, 39191, 141641, 295-1077; 7851, HAGH, 39192, 141642, 408-1334; 7851, HAGH, 39193, 141643, 48-758; 7852, HAGHL, 39201, 141651, 249-503; 7852, HAGHL, 39202, 141652, 165-740; 7852, HAGHL, 39203, 141653, 170-493; 7852, HAGHL, 39204, 141654, 265-948; 7852, HAGHL, 39205, 141655, 51-650; 7852, HAGHL, 39207, 141657, 1-285; 7852, HAGHL, 39208, 141658, 1-65; 7852, HAGHL, 39209, 141659, 61-100; 7852, HAGHL, 39210, 141660, 218-735; 7852, HAGHL, 39198, 141648, 282-1154; 7852, HAGHL, 39199, 141649, 240-1088; 7852, HAGHL, 39200, 141650, 304-912; 7852, HAGHL, 39206, 141656, 169-777; 7853, N/A, 39211, 141661, 660-888; 7853, N/A, 39212, 141662, 633-847; 7853, N/A, 39214, 141664, 487-648; 7853, N/A, 39213, 141663, 661-1167; 7853, N/A, 39215, 141665, 520-1026; 7853, N/A, 39216, 141666, 548-1054; 7854, HCAR1, 39217, 141667, 505-1545; 7855, HCAR2, 39218, 141668, 61-1152; 7856, HCAR3, 39219, 141669, 156-1319; 7857, HSD3B1, 39222, 141672, 108-352; 7857, HSD3B1, 39220, 141670, 146-1267; 7857, HSD3B1, 39221, 141671, 160-1281; 7858, HSD3B2, 39224, 141674, 131-717; 7858, HSD3B2, 39223, 141673, 209-1327; 7858, HSD3B2, 39225, 141675, 250-1368; 7859, HSD3B7, 39228, 141678, 217-746; 7859, HSD3B7, 39229, 141679, 90-746; 7859, HSD3B7, 39226, 141676, 291-881; 7859, HSD3B7, 39227, 141677, 94-1203; 7860, HYKK, 39235, 141685, 61-741; 7860, HYKK, 39230, 141680, 114-1235; 7860, HYKK, 39231, 141681, 114-776; 7860, HYKK, 39232, 141682, 1-663; 7860, HYKK, 39233, 141683, 1-1122; 7860, HYKK, 39234, 141684, 96-614; 7861, HMBS, 39240, 141690, 150-507; 7861, HMBS, 39241, 141691, 120-311; 7861, HMBS, 39242, 141692, 595-1155; 7861, HMBS, 39243, 141693, 195-755; 7861, HMBS, 39246, 141696, 128-373; 7861, HMBS, 39247, 141697, 154-399; 7861, HMBS, 39248, 141698, 105-1097; 7861, HMBS, 39249, 141699, 135-708; 7861, HMBS, 39236, 141686, 152-1237; 7861, HMBS, 39237, 141687, 111-1145; 7861, HMBS, 39238, 141688, 264-1298; 7861, HMBS, 39239, 141689, 121-1086; 7861, HMBS, 39244, 141694, 292-1206; 7861, HMBS, 39245, 141695, 292-1326; 7862, HPGD, 39253, 141703, 49-579; 7862, HPGD, 39255, 141705, 522-819; 7862, HPGD, 39256, 141706, 537-827; 7862, HPGD, 39257, 141707, 191-454; 7862, HPGD, 39258, 141708, 25-138; 7862, HPGD, 39250, 141700, 37-573; 7862, HPGD, 39251, 141701, 448-1248; 7862, HPGD, 39252, 141702, 38-634; 7862, HPGD, 39254, 141704, 713-1150; 7862, HPGD, 39259, 141709, 704-1141; 7862, HPGD, 39260, 141710, 448-879; 7863, HYI, 39262, 141712, 1-716; 7863, HYI, 39264, 141714, 1-640; 7863, HYI, 39265, 141715, 33-941; 7863, HYI, 39266, 141716, 56-886; 7863, HYI, 39267, 141717, 1-485; 7863, HYI, 39268, 141718, 1-560; 7863, HYI, 39269, 141719, 197-1015; 7863, HYI, 39261, 141711, 197-1030; 7863, HYI, 39263, 141713, 171-914; 7864, HSD11B1, 39270, 141720, 66-901; 7864, HSD11B1, 39273, 141723, 135-681; 7864, HSD11B1, 39271, 141721, 98-976; 7864, HSD11B1, 39272, 141722, 155-1033; 7865, HSD11B1L, 39280, 141730, 250-348; 7865, HSD11B1L, 39281, 141731, 250-477; 7865, HSD11B1L, 39283, 141733, 1-407; 7865, HSD11B1L, 39286, 141736, 128-695; 7865, HSD11B1L, 39287, 141737, 270-413; 7865, HSD11B1L, 39290, 141740, 180-407; 7865, HSD11B1L, 39291, 141741, 721-1151; 7865, HSD11B1L, 39292, 141742, 1-1002; 7865, HSD11B1L, 39274, 141724, 263-880; 7865, HSD11B1L, 39275, 141725, 223-1083; 7865, HSD11B1L, 39276, 141726, 444-1043; 7865, HSD11B1L, 39277, 141727, 490-1035; 7865, HSD11B1L, 39278, 141728, 251-1198; 7865, HSD11B1L, 39279, 141729, 239-502; 7865, HSD11B1L, 39282, 141732, 322-780; 7865, HSD11B1L, 39284, 141734, 400-1260; 7865, HSD11B1L, 39285, 141735, 522-1226; 7865, HSD11B1L, 39288, 141738, 476-1336; 7865, HSD11B1L, 39289, 141739, 505-963; 7866, HSD11B2, 39294, 141744, 1-177; 7866, HSD11B2, 39293, 141743, 133-1350; 7867, HSD17B1, 39295, 141745, 1-990; 7867, HSD17B1, 39296, 141746, 12-461; 7867, HSD17B1, 39297, 141747, 3721-4707; 7868, HSD17B10, 39299, 141749, 6-515; 7868, HSD17B10, 39298, 141748, 29-814; 7868, HSD17B10, 39300, 141750, 12-770; 7869, HSD17B11, 39302, 141752, 80-850; 7869, HSD17B11, 39301, 141751, 317-1219; 7870, HSD17B12, 39305, 141755, 120-611; 7870, HSD17B12, 39303, 141753, 120-1058; 7870, HSD17B12, 39304, 141754, 48-344; 7871, HSD17B13, 39306, 141756, 46-840; 7871, HSD17B13, 39307, 141757, 66-968; 7872, HSD17B14, 39309, 141759, 1-531; 7872, HSD17B14, 39310, 141760, 1-321; 7872, HSD17B14, 39311, 141761, 100-840; 7872, HSD17B14, 39308, 141758, 268-1080; 7873, HSD17B2, 39313, 141763, 1-603; 7873, HSD17B2, 39314, 141764, 289-487; 7873, HSD17B2, 39315, 141765, 1-567; 7873, HSD17B2, 39316, 141766, 205-865; 7873, HSD17B2, 39317, 141767, 152-551; 7873, HSD17B2, 39312, 141762, 194-1357; 7874, HSD17B3, 39318, 141768, 49-831; 7874, HSD17B3, 39319, 141769, 49-981; 7875, HSD17B4, 39321, 141771, 80-1582; 7875, HSD17B4, 39322, 141772, 423-2213; 7875, HSD17B4, 39325, 141775, 176-2314; 7875, HSD17B4, 39326, 141776, 246-2045; 7875, HSD17B4, 39327, 141777, 632-2056; 7875, HSD17B4, 39320, 141770, 134-2344; 7875, HSD17B4, 39323, 141773, 185-2470; 7875, HSD17B4, 39324, 141774, 80-2236; 7876, HSD17B6, 39331, 141781, 327-592; 7876, HSD17B6, 39333, 141783, 366-591; 7876, HSD17B6, 39328, 141778, 111-1064; 7876, HSD17B6, 39329, 141779, 178-1131; 7876, HSD17B6, 39330, 141780, 350-1303; 7876, HSD17B6, 39332, 141782, 375-1328; 7876, HSD17B6, 39334, 141784, 360-1313; 7877, HSD17B7, 39336, 141786, 13-348; 7877, HSD17B7, 39337, 141787, 79-333; 7877, HSD17B7, 39338, 141788, 69-398; 7877, HSD17B7, 39339, 141789, 1-187; 7877, HSD17B7, 39335, 141785, 56-1081; 7878, HSD17B8, 39340, 141790, 28-813; 7878, HSD17B8, 39341, 141791, 28-813; 7878, HSD17B8, 39342, 141792, 28-813; 7878, HSD17B8, 39343, 141793, 28-813; 7878, HSD17B8, 39344, 141794, 28-813; 7878, HSD17B8, 39345, 141795, 28-813; 7879, HSDL1, 39348, 141798, 249-459; 7879, HSDL1, 39349, 141799, 134-457; 7879, HSDL1, 39350, 141800, 217-549; 7879, HSDL1, 39346, 141796, 178-1170; 7879, HSDL1, 39347, 141797, 159-986; 7880, HSDL2, 39351, 141801, 85-1122; 7880, HSDL2, 39352, 141802, 228-1484; 7881, HIC1, 39355, 141805, 366-654; 7881, HIC1, 39356, 141806, 1106-1134; 7881, HIC1, 39357, 141807, 473-725; 7881, HIC1, 39358, 141808, 614-812; 7881, HIC1, 39353, 141803, 1-2202; 7881, HIC1, 39354, 141804, 161-2305; 7881, HIC1, 39359, 141809, 161-2305; 7882, HIC2, 39360, 141810, 196-2043; 7882, HIC2, 39361, 141811, 231-2078; 7882, HIC2, 39362, 141812, 373-2220; 7883, HCN1, 39364, 141814, 406-1293; 7883, HCN1, 39363, 141813, 242-2914; 7884, HCN2, 39365, 141815, 54-2723; 7885, HCN3, 39366, 141816, 9-2333; 7885, HCN3, 39367, 141817, 9-2333; 7886, HCN4, 39368, 141818, 995-4606; 7887, HCRT, 39369, 141819, 88-483; 7888, HCRTR1, 39370, 141820, 1-1170; 7888, HCRTR1, 39371, 141821, 154-1431; 7888, HCRTR1, 39372, 141822, 388-1665; 7889, HCRTR2, 39373, 141823, 337-1671; 7889, HCRTR2, 39374, 141824, 464-1798; 7890, HPRT1, 39375, 141825, 160-816; 7891, HIF1A, 39378, 141828, 266-2749; 7891, HIF1A, 39380, 141830, 479-2782; 7891, HIF1A, 39376, 141826, 29-2236; 7891, HIF1A, 39377, 141827, 266-2746; 7891, HIF1A, 39379, 141829, 230-2782; 7892, HIF1AN, 39382, 141832, 45-152; 7892, HIF1AN, 39383, 141833, 470-1042; 7892, HIF1AN, 39381, 141831, 101-1150; 7893, HIF3A, 39387, 141837, 118-327; 7893, HIF3A, 39388, 141838, 32-277; 7893, HIF3A, 39389, 141839, 125-1477; 7893, HIF3A, 39390, 141840, 1-281; 7893, HIF3A, 39391, 141841, 129-573; 7893, HIF3A, 39392, 141842, 157-366; 7893, HIF3A, 39393, 141843, 85-294; 7893, HIF3A, 39394, 141844, 85-1869; 7893, HIF3A, 39384, 141834, 161-1963; 7893, HIF3A, 39385, 141835, 70-2073; 7893, HIF3A, 39386, 141836, 32-2041;

7894, HILPDA, 39395, 141845, 202-393; 7894, HILPDA, 39396, 141846, 130-321; 7895, HYOU1, 39397, 141847, 54-2023; 7895, HYOU1, 39398, 141848, 128-244; 7895, HYOU1, 39399, 141849, 39-711; 7895, HYOU1, 39400, 141850, 228-862; 7895, HYOU1, 39401, 141851, 119-582; 7895, HYOU1, 39402, 141852, 183-629; 7895, HYOU1, 39403, 141853, 58-174; 7895, HYOU1, 39404, 141854, 126-2162; 7895, HYOU1, 39405, 141855, 245-552; 7895, HYOU1, 39407, 141857, 101-2134; 7895, HYOU1, 39408, 141858, 50-493; 7895, HYOU1, 39409, 141859, 146-2959; 7895, HYOU1, 39410, 141860, 263-3076; 7895, HYOU1, 39411, 141861, 216-491; 7895, HYOU1, 39412, 141862, 146-2959; 7895, HYOU1, 39413, 141863, 128-244; 7895, HYOU1, 39414, 141864, 39-711; 7895, HYOU1, 39415, 141865, 228-862; 7895, HYOU1, 39416, 141866, 58-174; 7895, HYOU1, 39417, 141867, 50-493; 7895, HYOU1, 39418, 141868, 216-491; 7895, HYOU1, 39419, 141869, 245-552; 7895, HYOU1, 39420, 141870, 101-2134; 7895, HYOU1, 39421, 141871, 119-582; 7895, HYOU1, 39422, 141872, 126-3125; 7895, HYOU1, 39423, 141873, 263-3076; 7895, HYOU1, 39424, 141874, 126-2162; 7895, HYOU1, 39425, 141875, 183-629; 7895, HYOU1, 39426, 141876, 54-2023; 7895, HYOU1, 39406, 141856, 126-3125; 7896, IBA57, 39427, 141877, 3-1073; 7897, IDNK, 39428, 141878, 5-277; 7897, IDNK, 39430, 141880, 7-186; 7897, IDNK, 39432, 141882, 124-444; 7897, IDNK, 39433, 141883, 338-607; 7897, IDNK, 39429, 141879, 5-568; 7897, IDNK, 39431, 141881, 436-861; 7898, IDS, 39436, 141886, 144-683; 7898, IDS, 39438, 141888, 1-321; 7898, IDS, 39439, 141889, 314-572; 7898, IDS, 39434, 141884, 211-1863; 7898, IDS, 39435, 141885, 211-1242; 7898, IDS, 39437, 141887, 211-1149; 7899, IDUA, 39441, 141891, 42-714; 7899, IDUA, 39442, 141892, 1-697; 7899, IDUA, 39443, 141893, 268-796; 7899, IDUA, 39444, 141894, 1-586; 7899, IDUA, 39445, 141895, 453-2018; 7899, IDUA, 39440, 141890, 89-2050; 7900, IGIP, 39446, 141896, 2543-2704; 7901, IGFL1, 39447, 141897, 24-356; 7902, IGFL2, 39450, 141900, 1-255; 7902, IGFL2, 39448, 141898, 37-396; 7902, IGFL2, 39449, 141899, 292-684; 7903, IGFL3, 39451, 141901, 26-403; 7904, IGFL4, 39453, 141903, 507-599; 7904, IGFL4, 39452, 141902, 55-429; 7905, IGFLR1, 39455, 141905, 102-665; 7905, IGFLR1, 39458, 141908, 153-200; 7905, IGFLR1, 39459, 141909, 60-458; 7905, IGFLR1, 39460, 141910, 168-581; 7905, IGFLR1, 39461, 141911, 1-182; 7905, IGFLR1, 39462, 141912, 1-224; 7905, IGFLR1, 39454, 141904, 99-1166; 7905, IGFLR1, 39456, 141906, 102-1169; 7905, IGFLR1, 39457, 141907, 156-659; 7906, N/A, 39463, 141913, 77-434; 7906, N/A, 39464, 141914, 77-434; 7907, IGLON5, 39465, 141915, 1-1011; 7908, IK, 39467, 141917, 81-302; 7908, IK, 39468, 141918, 68-868; 7908, IK, 39469, 141919, 68-489; 7908, IK, 39470, 141920, 249-569; 7908, IK, 39471, 141921, 54-690; 7908, IK, 39472, 141922, 35-757; 7908, IK, 39473, 141923, 37-525; 7908, IK, 39466, 141916, 140-1813; 7909, IKZF1, 39475, 141925, 156-905; 7909, IKZF1, 39480, 141930, 210-734; 7909, IKZF1, 39482, 141932, 156-1040; 7909, IKZF1, 39483, 141933, 1-201; 7909, IKZF1, 39485, 141935, 156-1166; 7909, IKZF1, 39486, 141936, 156-962; 7909, IKZF1, 39474, 141924, 156-1715; 7909, IKZF1, 39476, 141926, 156-1286; 7909, IKZF1, 39477, 141927, 156-1454; 7909, IKZF1, 39478, 141928, 156-1454; 7909, IKZF1, 39479, 141929, 156-1589; 7909, IKZF1, 39481, 141931, 201-1499; 7909, IKZF1, 39484, 141934, 200-1633; 7910, IKZF2, 39487, 141937, 152-1750; 7910, IKZF2, 39491, 141941, 59-337; 7910, IKZF2, 39492, 141942, 446-1675; 7910, IKZF2, 39494, 141944, 318-567; 7910, IKZF2, 39495, 141945, 226-602; 7910, IKZF2, 39496, 141946, 446-1681; 7910, IKZF2, 39488, 141938, 311-1813; 7910, IKZF2, 39489, 141939, 1-159; 7910, IKZF2, 39490, 141940, 1-447; 7910, IKZF2, 39493, 141943, 1-720; 7910, IKZF2, 39497, 141947, 1-159; 7910, IKZF2, 39498, 141948, 311-1891; 7910, IKZF2, 39499, 141949, 1-159; 7911, IKZF3, 39515, 141965, 63-686; 7911, IKZF3, 39500, 141950, 1-1296; 7911, IKZF3, 39501, 141951, 1-1413; 7911, IKZF3, 39502, 141952, 63-1592; 7911, IKZF3, 39503, 141953, 1-1413; 7911, IKZF3, 39504, 141954, 63-1163; 7911, IKZF3, 39505, 141955, 63-1190; 7911, IKZF3, 39506, 141956, 63-929; 7911, IKZF3, 39507, 141957, 63-1331; 7911, IKZF3, 39508, 141958, 63-1046; 7911, IKZF3, 39509, 141959, 2-1246; 7911, IKZF3, 39510, 141960, 63-1373; 7911, IKZF3, 39511, 141961, 1-1362; 7911, IKZF3, 39512, 141962, 63-1490; 7911, IKZF3, 39513, 141963, 374-1162; 7911, IKZF3, 39514, 141964, 63-854; 7911, IKZF3, 39516, 141966, 930-1718; 7912, IKZF4, 39520, 141970, 391-420; 7912, IKZF4, 39521, 141971, 447-593; 7912, IKZF4, 39522, 141972, 90-1712; 7912, IKZF4, 39517, 141967, 368-2125; 7912, IKZF4, 39518, 141968, 160-1917; 7912, IKZF4, 39519, 141969, 415-2172; 7913, IKZF5, 39523, 141973, 322-1581; 7913, IKZF5, 39524, 141974, 311-1570; 7914, IKBIP, 39525, 141975, 375-1508; 7914, IKBIP, 39526, 141976, 413-1465; 7914, IKBIP, 39527, 141977, 254-466; 7915, ITK, 39529, 141979, 351-571; 7915, ITK, 39530, 141980, 112-462; 7915, ITK, 39528, 141978, 153-2015; 7916, ILVBL, 39532, 141982, 291-788; 7916, ILVBL, 39533, 141983, 265-423; 7916, ILVBL, 39534, 141984, 304-1090; 7916, ILVBL, 39535, 141985, 59-747; 7916, ILVBL, 39536, 141986, 254-1831; 7916, ILVBL, 39537, 141987, 213-709; 7916, ILVBL, 39531, 141981, 141-2039; 7917, ICT1, 39539, 141989, 18-593; 7917, ICT1, 39540, 141990, 1-214; 7917, ICT1, 39538, 141988, 14-634; 7918, IER2, 39541, 141991, 364-1035; 7918, IER2, 39542, 141992, 1213-1884; 7918, IER2, 39543, 141993, 229-900; 7919, IER3, 39545, 141995, 31-447; 7919, IER3, 39547, 141997, 31-447; 7919, IER3, 39548, 141998, 31-447; 7919, IER3, 39550, 142000, 31-447; 7919, IER3, 39553, 142003, 31-447; 7919, IER3, 39555, 142005, 31-447; 7919, IER3, 39544, 141994, 37-507; 7919, IER3, 39546, 141996, 37-507; 7919, IER3, 39549, 141999, 37-507; 7919, IER3, 39551, 142001, 37-507; 7919, IER3, 39552, 142002, 37-507; 7919, IER3, 39554, 142004, 37-507; 7920, IER3IP1, 39556, 142006, 98-346; 7921, IER5, 39557, 142007, 192-1175; 7922, IER5L, 39558, 142008, 211-1425; 7923, IRGC, 39560, 142010, 102-926; 7923, IRGC, 39559, 142009, 200-1591; 7924, IRGM, 39562, 142012, 1-215; 7924, IRGM, 39561, 142011, 1114-1659; 7925, IRGQ, 39564, 142014, 157-564; 7925, IRGQ, 39563, 142013, 157-2028; 7925, IRGQ, 39565, 142015, 187-2058; 7926, IGSF21, 39566, 142016, 384-1787; 7927, IGBP1, 39567, 142017, 304-1323; 7927, IGBP1, 39568, 142018, 500-1519; 7928, IGHA1, 39569, 142019, 1-1062; 7928, IGHA1, 39570, 142020, 1-1062; 7929, IGHA2, 39571, 142021, 1-1023; 7929, IGHA2, 39572, 142022, 1-1023; 7930, IGHD, 39573, 142023, 1-1292; 7930, IGHD, 39574, 142024, 1-1155; 7930, IGHD, 39575, 142025, 1-1155; 7930, IGHD, 39576, 142026, 1-1292; 7931, IGHE, 39577, 142027, 1-1287; 7931, IGHE, 39578, 142028, 1-1287; 7932, IGHG1, 39579, 142029, 1-888; 7932, IGHG1, 39580, 142030, 1-1200; 7932, IGHG1, 39582, 142032, 21-1409; 7932, IGHG1, 39583, 142033, 81-1502; 7932, IGHG1, 39584, 142034, 68-1462; 7932, IGHG1, 39585, 142035, 1-1428; 7932, IGHG1, 39586, 142036, 63-1463; 7932, IGHG1, 39587, 142037, 1-1200; 7932, IGHG1, 39589, 142039, 1-888; 7932, IGHG1, 39581, 142031, 1-993; 7932,

IGHG1, 39588, 142038, 1-993; 7933, IGHG2, 39590, 142040, 1-981; 7933, IGHG2, 39591, 142041, 1-981; 7934, IGHG3, 39592, 142042, 1-1133; 7934, IGHG3, 39593, 142043, 1-1566; 7934, IGHG3, 39594, 142044, 45-1598; 7934, IGHG3, 39595, 142045, 1-1133; 7935, IGHG4, 39596, 142046, 1-984; 7935, IGHG4, 39597, 142047, 1-984; 7936, IGHM, 39598, 142048, 1-1362; 7936, IGHM, 39599, 142049, 28-1827; 7936, IGHM, 39600, 142050, 58-1824; 7936, IGHM, 39601, 142051, 1-1362; 7937, IGHD1OR15-1A, 39602, 142052, 1-17; 7938, IGHD1OR15-1B, 39603, 142053, 1-17; 7939, IGHD1-1, 39604, 142054, 1-17; 7939, IGHD1-1, 39605, 142055, 1-17; 7940, IGHD1-14, 39606, 142056, 1-17; 7940, IGHD1-14, 39607, 142057, 1-17; 7941, IGHD1-20, 39608, 142058, 1-17; 7941, IGHD1-20, 39609, 142059, 1-17; 7942, IGHD1-26, 39610, 142060, 1-20; 7942, IGHD1-26, 39611, 142061, 1-20; 7943, IGHD1-7, 39612, 142062, 1-17; 7943, IGHD1-7, 39613, 142063, 1-17; 7944, IGHD2OR15-2A, 39614, 142064, 1-31; 7945, IGHD2OR15-2B, 39615, 142065, 1-31; 7946, IGHD2-15, 39616, 142066, 1-31; 7946, IGHD2-15, 39617, 142067, 1-31; 7947, IGHD2-2, 39618, 142068, 1-31; 7947, IGHD2-2, 39619, 142069, 1-31; 7948, IGHD2-21, 39620, 142070, 1-28; 7948, IGHD2-21, 39621, 142071, 1-28; 7949, IGHD2-8, 39622, 142072, 1-31; 7949, IGHD2-8, 39623, 142073, 1-31; 7950, IGHD3OR15-3A, 39624, 142074, 1-31; 7951, IGHD3OR15-3B, 39625, 142075, 1-31; 7952, IGHD3-10, 39626, 142076, 1-30; 7952, IGHD3-10, 39627, 142077, 1-30; 7953, IGHD3-16, 39628, 142078, 1-37; 7953, IGHD3-16, 39629, 142079, 1-37; 7954, IGHD3-22, 39630, 142080, 1-31; 7954, IGHD3-22, 39631, 142081, 1-31; 7955, IGHD3-3, 39632, 142082, 1-31; 7955, IGHD3-3, 39633, 142083, 1-31; 7956, IGHD3-9, 39634, 142084, 1-30; 7956, IGHD3-9, 39635, 142085, 1-30; 7957, IGHD4OR15-4A, 39636, 142086, 1-19; 7958, IGHD4OR15-4B, 39637, 142087, 1-19; 7959, IGHD4-11, 39638, 142088, 1-16; 7959, IGHD4-11, 39639, 142089, 1-16; 7960, IGHD4-17, 39640, 142090, 1-16; 7960, IGHD4-17, 39641, 142091, 1-16; 7961, IGHD4-23, 39642, 142092, 1-19; 7961, IGHD4-23, 39643, 142093, 1-19; 7962, IGHD4-4, 39644, 142094, 1-16; 7962, IGHD4-4, 39645, 142095, 1-16; 7963, IGHD5OR15-5A, 39646, 142096, 1-23; 7964, IGHD5OR15-5B, 39647, 142097, 1-23; 7965, IGHD5-12, 39648, 142098, 1-23; 7965, IGHD5-12, 39649, 142099, 1-23; 7966, IGHD5-18, 39650, 142100, 1-20; 7966, IGHD5-18, 39651, 142101, 1-20; 7967, IGHD5-24, 39652, 142102, 1-20; 7967, IGHD5-24, 39653, 142103, 1-20; 7968, IGHD5-5, 39654, 142104, 1-20; 7968, IGHD5-5, 39655, 142105, 1-20; 7969, IGHD6-13, 39656, 142106, 1-21; 7969, IGHD6-13, 39657, 142107, 1-21; 7970, IGHD6-19, 39658, 142108, 1-21; 7970, IGHD6-19, 39659, 142109, 1-21; 7971, IGHD6-25, 39660, 142110, 1-18; 7971, IGHD6-25, 39661, 142111, 1-18; 7972, IGHD6-6, 39662, 142112, 1-18; 7972, IGHD6-6, 39663, 142113, 1-18; 7973, IGHD7-27, 39664, 142114, 1-11; 7973, IGHD7-27, 39665, 142115, 1-11; 7974, IGHJ1, 39666, 142116, 1-52; 7974, IGHJ1, 39667, 142117, 1-52; 7975, IGHJ2, 39668, 142118, 1-52; 7975, IGHJ2, 39669, 142119, 1-53; 7976, IGHJ3, 39670, 142120, 1-49; 7976, IGHJ3, 39671, 142121, 1-50; 7977, IGHJ4, 39672, 142122, 1-46; 7977, IGHJ4, 39673, 142123, 1-48; 7978, IGHJ5, 39674, 142124, 1-49; 7978, IGHJ5, 39675, 142125, 1-51; 7979, IGHJ6, 39676, 142126, 1-61; 7979, IGHJ6, 39677, 142127, 1-63; 7980, IGHV1OR15-1, 39678, 142128, 1-353; 7981, IGHV1OR15-9, 39679, 142129, 1-353; 7982, IGHV1OR21-1, 39680, 142130, 1-353; 7983, IGHV1-18, 39681, 142131, 60-410; 7983, IGHV1-18, 39682, 142132, 60-412; 7984, IGHV1-2, 39683, 142133, 65-417; 7984, IGHV1-2, 39684, 142134, 65-417; 7985, IGHV1-24, 39685, 142135, 61-411; 7985, IGHV1-24, 39686, 142136, 61-413; 7986, IGHV1-3, 39687, 142137, 43-395; 7986, IGHV1-3, 39688, 142138, 43-395; 7987, IGHV1-45, 39689, 142139, 59-411; 7987, IGHV1-45, 39690, 142140, 59-411; 7988, IGHV1-46, 39691, 142141, 305-655; 7988, IGHV1-46, 39692, 142142, 305-657; 7989, IGHV1-58, 39693, 142143, 62-414; 7989, IGHV1-58, 39694, 142144, 62-414; 7990, IGHV1-69, 39695, 142145, 62-412; 7990, IGHV1-69, 39696, 142146, 62-414; 7991, IGHV1-69-2, 39697, 142147, 59-411; 7991, IGHV1-69-2, 39698, 142148, 59-411; 7992, IGHV2OR16-5, 39699, 142149, 1-358; 7993, IGHV2-26, 39700, 142150, 25-381; 7993, IGHV2-26, 39701, 142151, 25-382; 7994, IGHV2-5, 39702, 142152, 21-378; 7994, IGHV2-5, 39703, 142153, 21-378; 7995, IGHV2-70, 39704, 142154, 1-358; 7995, IGHV2-70, 39705, 142155, 77-434; 7996, IGHV3OR15-7, 39706, 142156, 1-359; 7997, IGHV3OR16-10, 39707, 142157, 1-350; 7998, IGHV3OR16-12, 39708, 142158, 1-353; 7999, IGHV3OR16-13, 39709, 142159, 1-353; 8000, IGHV3OR16-8, 39710, 142160, 1-349; 8001, IGHV3OR16-9, 39711, 142161, 1-294; 8001, IGHV3OR16-9, 39712, 142162, 1-288; 8002, IGHV3-11, 39713, 142163, 121-473; 8002, IGHV3-11, 39714, 142164, 121-473; 8003, IGHV3-13, 39715, 142165, 81-430; 8003, IGHV3-13, 39716, 142166, 81-430; 8004, IGHV3-15, 39717, 142167, 81-437; 8004, IGHV3-15, 39718, 142168, 81-439; 8005, IGHV3-16, 39719, 142169, 75-425; 8005, IGHV3-16, 39720, 142170, 75-425; 8006, IGHV3-20, 39721, 142171, 63-415; 8006, IGHV3-20, 39722, 142172, 63-415; 8007, IGHV3-21, 39723, 142173, 80-430; 8007, IGHV3-21, 39724, 142174, 80-432; 8008, IGHV3-23, 39725, 142175, 80-432; 8008, IGHV3-23, 39726, 142176, 80-432; 8009, IGHV3-30, 39727, 142177, 81-431; 8009, IGHV3-30, 39728, 142178, 81-431; 8010, IGHV3-33, 39729, 142179, 81-431; 8010, IGHV3-33, 39730, 142180, 68-420; 8011, IGHV3-35, 39731, 142181, 16-366; 8011, IGHV3-35, 39732, 142182, 16-368; 8012, IGHV3-38, 39733, 142183, 79-426; 8012, IGHV3-38, 39734, 142184, 79-427; 8013, IGHV3-43, 39735, 142185, 81-434; 8013, IGHV3-43, 39736, 142186, 81-435; 8014, IGHV3-48, 39737, 142187, 80-432; 8014, IGHV3-48, 39738, 142188, 80-432; 8015, IGHV3-49, 39739, 142189, 81-439; 8015, IGHV3-49, 39740, 142190, 1-342; 8015, IGHV3-49, 39741, 142191, 1-342; 8015, IGHV3-49, 39742, 142192, 81-439; 8016, IGHV3-53, 39743, 142193, 222-571; 8016, IGHV3-53, 39744, 142194, 222-571; 8017, IGHV3-64, 39745, 142195, 78-431; 8017, IGHV3-64, 39746, 142196, 1-225; 8017, IGHV3-64, 39747, 142197, 1-225; 8017, IGHV3-64, 39748, 142198, 78-433; 8018, IGHV3-66, 39749, 142199, 80-427; 8018, IGHV3-66, 39750, 142200, 80-429; 8019, IGHV3-7, 39751, 142201, 80-430; 8019, IGHV3-7, 39752, 142202, 80-432; 8020, IGHV3-72, 39753, 142203, 81-437; 8020, IGHV3-72, 39754, 142204, 1-303; 8020, IGHV3-72, 39755, 142205, 1-303; 8020, IGHV3-72, 39756, 142206, 81-439; 8021, IGHV3-73, 39757, 142207, 81-437; 8021, IGHV3-73, 39758, 142208, 1-249; 8021, IGHV3-73, 39759, 142209, 81-439; 8022, IGHV3-74, 39760, 142210, 237-587; 8022, IGHV3-74, 39761, 142211, 237-589; 8023, IGHV4OR15-8, 39762, 142212, 1-353; 8024, IGHV4-28, 39763, 142213, 73-425; 8024, IGHV4-28, 39764, 142214, 73-425; 8025, IGHV4-31, 39765, 142215, 73-428; 8025, IGHV4-31, 39766, 142216, 36-391; 8026, IGHV4-34, 39767, 142217, 32-400; 8026, IGHV4-34, 39768, 142218, 32-402; 8027, IGHV4-39, 39769, 142219, 51-425; 8027, IGHV4-39, 39770, 142220, 51-427; 8028, IGHV4-4, 39771, 142221, 65-417; 8028, IGHV4-4, 39772, 142222, 65-417; 8029, IGHV4-59, 39773, 142223, 146-495; 8029, IGHV4-

59, 39774, 142224, 146-495; 8030, IGHV4-61, 39775, 142225, 102-457; 8030, IGHV4-61, 39776, 142226, 102-457; 8031, IGHV5-51, 39777, 142227, 60-410; 8031, IGHV5-51, 39778, 142228, 60-412; 8032, IGHV6-1, 39779, 142229, 53-415; 8032, IGHV6-1, 39780, 142230, 53-417; 8033, IGHV7-81, 39781, 142231, 55-405; 8034, IGKC, 39782, 142232, 1-323; 8034, IGKC, 39783, 142233, 1-720; 8034, IGKC, 39784, 142234, 354-713; 8034, IGKC, 39785, 142235, 354-713; 8034, IGKC, 39786, 142236, 1-323; 8034, IGKC, 39787, 142237, 1-720; 8035, IGKJ1, 39788, 142238, 1-38; 8036, IGKJ2, 39789, 142239, 1-39; 8037, IGKJ3, 39790, 142240, 1-38; 8038, IGKJ4, 39791, 142241, 1-37; 8039, IGKJ5, 39792, 142242, 1-38; 8040, IGKV1OR2-108, 39793, 142243, 1-353; 8041, IGKV1-12, 39794, 142244, 48-398; 8041, IGKV1-12, 39795, 142245, 1-555; 8041, IGKV1-12, 39796, 142246, 48-398; 8041, IGKV1-12, 39797, 142247, 1-555; 8042, IGKV1-16, 39798, 142248, 28-378; 8042, IGKV1-16, 39799, 142249, 28-378; 8043, IGKV1-17, 39800, 142250, 28-378; 8043, IGKV1-17, 39801, 142251, 28-378; 8044, IGKV1-27, 39802, 142252, 32-382; 8044, IGKV1-27, 39803, 142253, 32-382; 8045, IGKV1-33, 39804, 142254, 32-382; 8045, IGKV1-33, 39805, 142255, 1-324; 8045, IGKV1-33, 39806, 142256, 32-382; 8045, IGKV1-33, 39807, 142257, 1-324; 8046, IGKV1-37, 39808, 142258, 48-398; 8046, IGKV1-37, 39809, 142259, 48-398; 8047, IGKV1-39, 39810, 142260, 48-398; 8047, IGKV1-39, 39811, 142261, 48-398; 8048, IGKV1-5, 39812, 142262, 182-532; 8048, IGKV1-5, 39813, 142263, 182-532; 8049, IGKV1-6, 39814, 142264, 30-380; 8049, IGKV1-6, 39815, 142265, 30-380; 8050, IGKV1-8, 39816, 142266, 54-398; 8050, IGKV1-8, 39817, 142267, 54-398; 8050, IGKV1-8, 39818, 142268, 1-549; 8050, IGKV1-8, 39819, 142269, 1-549; 8051, IGKV1-9, 39820, 142270, 59-409; 8051, IGKV1-9, 39821, 142271, 59-409; 8052, IGKV1D-12, 39822, 142272, 21-371; 8053, IGKV1D-13, 39823, 142273, 26-376; 8054, IGKV1D-16, 39824, 142274, 28-378; 8055, IGKV1D-17, 39825, 142275, 182-532; 8056, IGKV1D-33, 39826, 142276, 90-440; 8056, IGKV1D-33, 39827, 142277, 1-324; 8057, IGKV1D-37, 39828, 142278, 1-353; 8058, IGKV1D-39, 39829, 142279, 24-376; 8059, IGKV1D-42, 39830, 142280, 21-373; 8060, IGKV1D-43, 39831, 142281, 182-532; 8061, IGKV1D-8, 39832, 142282, 182-534; 8061, IGKV1D-8, 39833, 142283, 182-534; 8062, IGKV2-24, 39834, 142284, 31-390; 8062, IGKV2-24, 39835, 142285, 31-390; 8063, IGKV2-28, 39836, 142286, 31-390; 8063, IGKV2-28, 39837, 142287, 31-390; 8064, IGKV2-30, 39838, 142288, 31-390; 8064, IGKV2-30, 39839, 142289, 31-390; 8065, IGKV2-40, 39840, 142290, 1-314; 8065, IGKV2-40, 39841, 142291, 1-312; 8065, IGKV2-40, 39842, 142292, 1-314; 8065, IGKV2-40, 39843, 142293, 1-312; 8066, IGKV2D-24, 39844, 142294, 31-390; 8067, IGKV2D-26, 39845, 142295, 31-390; 8068, IGKV2D-28, 39846, 142296, 37-396; 8068, IGKV2D-28, 39847, 142297, 1-306; 8069, IGKV2D-29, 39848, 142298, 31-390; 8069, IGKV2D-29, 39849, 142299, 1-306; 8070, IGKV2D-30, 39850, 142300, 36-395; 8071, IGKV2D-40, 39851, 142301, 1-332; 8071, IGKV2D-40, 39852, 142302, 1-312; 8072, IGKV3OR2-268, 39853, 142303, 1-350; 8073, IGKV3-11, 39854, 142304, 48-392; 8073, IGKV3-11, 39855, 142305, 48-392; 8074, IGKV3-15, 39856, 142306, 98-442; 8074, IGKV3-15, 39857, 142307, 98-442; 8075, IGKV3-20, 39858, 142308, 53-400; 8075, IGKV3-20, 39859, 142309, 53-400; 8076, IGKV3-7, 39860, 142310, 98-445; 8076, IGKV3-7, 39861, 142311, 98-445; 8077, IGKV3D-11, 39862, 142312, 98-444; 8077, IGKV3D-11, 39863, 142313, 1-324; 8078, IGKV3D-15, 39864, 142314, 50-396; 8079, IGKV3D-20, 39865, 142315, 98-445; 8080, IGKV3D-7, 39866, 142316, 26-384; 8080, IGKV3D-7, 39867, 142317, 1-333; 8080, IGKV3D-7, 39868, 142318, 26-384; 8081, IGKV4-1, 39869, 142319, 176-538; 8082, IGKV5-2, 39870, 142320, 64-408; 8082, IGKV5-2, 39871, 142321, 64-408; 8083, IGKV6-21, 39872, 142322, 65-406; 8083, IGKV6-21, 39873, 142323, 65-406; 8084, IGKV6D-21, 39874, 142324, 68-409; 8085, IGKV6D-41, 39875, 142325, 27-371; 8086, IGLC1, 39876, 142326, 1-320; 8087, IGLC2, 39877, 142327, 1-320; 8088, IGLC3, 39878, 142328, 1-320; 8089, IGLC7, 39879, 142329, 1-320; 8090, IGLJ1, 39880, 142330, 1-127; 8091, IGLJ2, 39881, 142331, 34-175; 8092, IGLJ3, 39882, 142332, 26-176; 8093, IGLJ4, 39883, 142333, 1-33; 8094, IGLJ5, 39884, 142334, 1-72; 8095, IGLJ6, 39885, 142335, 1-70; 8096, IGLJ7, 39886, 142336, 1-46; 8097, IGLV10-54, 39887, 142337, 14-365; 8098, IGLV11-55, 39888, 142338, 13-426; 8099, IGLV1-36, 39889, 142339, 41-393; 8099, IGLV1-36, 39890, 142340, 1-351; 8099, IGLV1-36, 39891, 142341, 41-393; 8100, IGLV1-40, 39892, 142342, 52-407; 8100, IGLV1-40, 39893, 142343, 52-407; 8101, IGLV1-44, 39894, 142344, 115-467; 8101, IGLV1-44, 39895, 142345, 115-466; 8102, IGLV1-47, 39896, 142346, 57-407; 8103, IGLV1-50, 39897, 142347, 52-405; 8104, IGLV1-51, 39898, 142348, 37-400; 8105, IGLV2-11, 39899, 142349, 43-400; 8106, IGLV2-14, 39900, 142350, 42-402; 8107, IGLV2-18, 39901, 142351, 14-374; 8108, IGLV2-23, 39902, 142352, 163-502; 8109, IGLV2-33, 39903, 142353, 59-412; 8109, IGLV2-33, 39904, 142354, 59-412; 8110, IGLV2-8, 39905, 142355, 50-521; 8111, IGLV3-1, 39906, 142356, 53-398; 8112, IGLV3-10, 39907, 142357, 36-386; 8113, IGLV3-12, 39908, 142358, 10-360; 8114, IGLV3-16, 39909, 142359, 39-375; 8115, IGLV3-19, 39910, 142360, 41-377; 8116, IGLV3-21, 39911, 142361, 252-602; 8117, IGLV3-22, 39912, 142362, 65-409; 8118, IGLV3-25, 39913, 142363, 44-380; 8119, IGLV3-27, 39914, 142364, 39-377; 8120, IGLV3-32, 39915, 142365, 40-383; 8120, IGLV3-32, 39916, 142366, 40-383; 8121, IGLV3-9, 39917, 142367, 116-461; 8122, IGLV4-3, 39918, 142368, 33-401; 8123, IGLV4-60, 39919, 142369, 1-362; 8124, IGLV4-69, 39920, 142370, 61-419; 8125, IGLV5-37, 39921, 142371, 6-374; 8125, IGLV5-37, 39922, 142372, 6-374; 8126, IGLV5-45, 39923, 142373, 29-397; 8126, IGLV5-45, 39924, 142374, 29-397; 8127, IGLV5-48, 39925, 142375, 1-318; 8128, IGLV5-52, 39926, 142376, 6-379; 8129, IGLV6-57, 39927, 142377, 87-533; 8130, IGLV7-43, 39928, 142378, 35-385; 8130, IGLV7-43, 39929, 142379, 35-385; 8131, IGLV7-46, 39930, 142380, 35-385; 8132, IGLV8-61, 39931, 142381, 47-414; 8133, IGLV9-49, 39932, 142382, 38-409; 8134, IGLL1, 39935, 142385, 113-654; 8134, IGLL1, 39933, 142383, 50-304; 8134, IGLL1, 39934, 142384, 119-760; 8135, IGLL5, 39938, 142388, 275-922; 8135, IGLL5, 39936, 142386, 275-919; 8135, IGLL5, 39937, 142387, 226-480; 8136, IGHMBP2, 39940, 142390, 57-635; 8136, IGHMBP2, 39941, 142391, 63-152; 8136, IGHMBP2, 39942, 142392, 28-303; 8136, IGHMBP2, 39939, 142389, 112-3093; 8137, ISLR, 39945, 142395, 35-585; 8137, ISLR, 39946, 142396, 130-570; 8137, ISLR, 39943, 142393, 358-1644; 8137, ISLR, 39944, 142394, 162-1448; 8138, ISLR2, 39948, 142398, 86-1090; 8138, ISLR2, 39951, 142401, 245-586; 8138, ISLR2, 39952, 142402, 369-636; 8138, ISLR2, 39953, 142403, 609-623; 8138, ISLR2, 39954, 142404, 217-630; 8138, ISLR2, 39947, 142397, 770-3007; 8138, ISLR2, 39949, 142399, 214-2451; 8138, ISLR2, 39950, 142400, 441-2678; 8138, ISLR2, 39955, 142405, 502-2739; 8138, ISLR2, 39956, 142406, 117-2354; 8139, IGDCC3, 39958, 142408, 154-564; 8139, IGDCC3, 39959, 142409, 179-1783; 8139,

IGDCC3, 39957, 142407, 253-2697; 8140, IGDCC4, 39960, 142410, 211-3963; 8141, IGSF1, 39961, 142411, 81-4091; 8141, IGSF1, 39962, 142412, 107-835; 8141, IGSF1, 39963, 142413, 141-869; 8141, IGSF1, 39964, 142414, 284-4309; 8141, IGSF1, 39965, 142415, 1145-5128; 8141, IGSF1, 39966, 142416, 133-4116; 8142, IGSF10, 39968, 142418, 1-261; 8142, IGSF10, 39967, 142417, 1-7872; 8143, IGSF11, 39973, 142423, 147-1358; 8143, IGSF11, 39974, 142424, 641-738; 8143, IGSF11, 39975, 142425, 687-864; 8143, IGSF11, 39976, 142426, 211-1434; 8143, IGSF11, 39969, 142419, 30-1322; 8143, IGSF11, 39970, 142420, 307-1602; 8143, IGSF11, 39971, 142421, 366-1586; 8143, IGSF11, 39972, 142422, 270-1562; 8144, IGSF22, 39977, 142427, 191-2902; 8144, IGSF22, 39978, 142428, 141-4121; 8145, IGSF23, 39980, 142430, 1-415; 8145, IGSF23, 39981, 142431, 1-637; 8145, IGSF23, 39982, 142432, 87-285; 8145, IGSF23, 39979, 142429, 17-595; 8146, IGSF3, 39986, 142436, 254-268; 8146, IGSF3, 39983, 142433, 106-3750; 8146, IGSF3, 39984, 142434, 769-4413; 8146, IGSF3, 39985, 142435, 767-4351; 8147, IGSF5, 39987, 142437, 104-1327; 8148, IGSF6, 39989, 142439, 9-368; 8148, IGSF6, 39988, 142438, 63-788; 8149, IGSF8, 39992, 142442, 156-1059; 8149, IGSF8, 39990, 142440, 218-2059; 8149, IGSF8, 39991, 142441, 218-2059; 8149, IGSF8, 39993, 142443, 76-1917; 8150, IGSF9, 39996, 142446, 207-2360; 8150, IGSF9, 39994, 142444, 199-3690; 8150, IGSF9, 39995, 142445, 199-3738; 8151, IGSF9B, 39998, 142448, 1-618; 8151, IGSF9B, 39999, 142449, 80-565; 8151, IGSF9B, 39997, 142447, 1-4050; 8151, IGSF9B, 40000, 142450, 232-4545; 8152, IGFN1, 40003, 142453, 1-3379; 8152, IGFN1, 40001, 142451, 131-3886; 8152, IGFN1, 40002, 142452, 131-11257; 8152, IGFN1, 40004, 142454, 131-1843; 8153, ILDR1, 40005, 142455, 107-1615; 8153, ILDR1, 40006, 142456, 128-1768; 8153, ILDR1, 40007, 142457, 46-1419; 8153, ILDR1, 40008, 142458, 47-1591; 8154, ILDR2, 40010, 142460, 215-718; 8154, ILDR2, 40011, 142461, 215-1957; 8154, ILDR2, 40012, 142462, 215-1810; 8154, ILDR2, 40013, 142463, 215-1753; 8154, ILDR2, 40014, 142464, 215-2077; 8154, ILDR2, 40015, 142465, 215-1528; 8154, ILDR2, 40009, 142459, 57-1976; 8155, IRG1, 40017, 142467, 1-1446; 8155, IRG1, 40016, 142466, 63-1508; 8156, IMPDH1, 40022, 142472, 79-1620; 8156, IMPDH1, 40023, 142473, 47-598; 8156, IMPDH1, 40024, 142474, 1-681; 8156, IMPDH1, 40025, 142475, 86-952; 8156, IMPDH1, 40027, 142477, 82-291; 8156, IMPDH1, 40028, 142478, 1-571; 8156, IMPDH1, 40030, 142480, 607-2148; 8156, IMPDH1, 40018, 142468, 82-1773; 8156, IMPDH1, 40019, 142469, 352-2151; 8156, IMPDH1, 40020, 142470, 82-1851; 8156, IMPDH1, 40021, 142471, 1-1701; 8156, IMPDH1, 40026, 142476, 79-1608; 8156, IMPDH1, 40029, 142479, 85-1554; 8157, IMPDH2, 40032, 142482, 1-1411; 8157, IMPDH2, 40033, 142483, 29-865; 8157, IMPDH2, 40031, 142481, 41-1585; 8158, IMP3, 40034, 142484, 945-1499; 8158, IMP3, 40035, 142485, 156-710; 8159, IMP4, 40037, 142487, 57-803; 8159, IMP4, 40038, 142488, 306-822; 8159, IMP4, 40039, 142489, 215-924; 8159, IMP4, 40040, 142490, 1-842; 8159, IMP4, 40041, 142491, 22-252; 8159, IMP4, 40036, 142486, 709-1584; 8160, IMPACT, 40043, 142493, 64-603; 8160, IMPACT, 40044, 142494, 1-55; 8160, IMPACT, 40045, 142495, 1-321; 8160, IMPACT, 40046, 142496, 16-570; 8160, IMPACT, 40042, 142492, 142-1104; 8161, IPO11, 40049, 142499, 177-461; 8161, IPO11, 40050, 142500, 114-2705; 8161, IPO11, 40051, 142501, 1-180; 8161, IPO11, 40052, 142502, 1-482; 8161, IPO11, 40053, 142503, 340-530; 8161, IPO11, 40054, 142504, 139-584; 8161, IPO11, 40055, 142505, 69-554; 8161, IPO11, 40047, 142497, 170-3097; 8161, IPO11, 40048, 142498, 131-3178; 8162, IPO13, 40056, 142506, 586-1131; 8162, IPO13, 40057, 142507, 663-3554; 8163, IPO4, 40059, 142509, 36-182; 8163, IPO4, 40060, 142510, 11-475; 8163, IPO4, 40061, 142511, 36-341; 8163, IPO4, 40062, 142512, 58-354; 8163, IPO4, 40063, 142513, 1-1642; 8163, IPO4, 40064, 142514, 1-937; 8163, IPO4, 40065, 142515, 83-2818; 8163, IPO4, 40058, 142508, 178-3423; 8164, IPO5, 40068, 142518, 1-547; 8164, IPO5, 40069, 142519, 245-564; 8164, IPO5, 40070, 142520, 249-542; 8164, IPO5, 40071, 142521, 23-403; 8164, IPO5, 40072, 142522, 299-524; 8164, IPO5, 40073, 142523, 373-522; 8164, IPO5, 40075, 142525, 312-543; 8164, IPO5, 40076, 142526, 353-544; 8164, IPO5, 40077, 142527, 173-364; 8164, IPO5, 40078, 142528, 1-3299; 8164, IPO5, 40079, 142529, 197-555; 8164, IPO5, 40080, 142530, 334-556; 8164, IPO5, 40081, 142531, 240-591; 8164, IPO5, 40082, 142532, 183-568; 8164, IPO5, 40083, 142533, 372-883; 8164, IPO5, 40084, 142534, 230-493; 8164, IPO5, 40085, 142535, 118-544; 8164, IPO5, 40086, 142536, 42-536; 8164, IPO5, 40087, 142537, 1-192; 8164, IPO5, 40066, 142516, 181-3528; 8164, IPO5, 40067, 142517, 375-3668; 8164, IPO5, 40074, 142524, 66-3359; 8165, IPO7, 40089, 142539, 113-307; 8165, IPO7, 40090, 142540, 216-607; 8165, IPO7, 40091, 142541, 1-195; 8165, IPO7, 40088, 142538, 143-3259; 8166, IPO8, 40093, 142543, 291-544; 8166, IPO8, 40094, 142544, 35-535; 8166, IPO8, 40095, 142545, 85-537; 8166, IPO8, 40096, 142546, 223-330; 8166, IPO8, 40097, 142547, 426-526; 8166, IPO8, 40099, 142549, 1-503; 8166, IPO8, 40100, 142550, 102-239; 8166, IPO8, 40101, 142551, 1-426; 8166, IPO8, 40092, 142542, 340-3453; 8166, IPO8, 40098, 142548, 326-2824; 8167, IPO9, 40103, 142553, 1-468; 8167, IPO9, 40102, 142552, 70-3195; 8168, INADL, 40104, 142554, 79-1437; 8168, INADL, 40108, 142558, 98-3646; 8168, INADL, 40109, 142559, 1-419; 8168, INADL, 40110, 142560, 316-2097; 8168, INADL, 40111, 142561, 1-439; 8168, INADL, 40112, 142562, 47-2098; 8168, INADL, 40113, 142563, 1-336; 8168, INADL, 40105, 142555, 115-3657; 8168, INADL, 40106, 142556, 115-5520; 8168, INADL, 40107, 142557, 13-3417; 8169, INAFM1, 40114, 142564, 468-896; 8170, IST1, 40118, 142568, 98-521; 8170, IST1, 40119, 142569, 16-141; 8170, IST1, 40120, 142570, 1-870; 8170, IST1, 40122, 142572, 56-674; 8170, IST1, 40123, 142573, 298-476; 8170, IST1, 40124, 142574, 412-531; 8170, IST1, 40125, 142575, 44-542; 8170, IST1, 40126, 142576, 149-908; 8170, IST1, 40128, 142578, 187-503; 8170, IST1, 40129, 142579, 136-894; 8170, IST1, 40132, 142582, 1-258; 8170, IST1, 40134, 142584, 1-126; 8170, IST1, 40115, 142565, 63-1145; 8170, IST1, 40116, 142566, 53-1060; 8170, IST1, 40117, 142567, 357-1457; 8170, IST1, 40121, 142571, 117-1256; 8170, IST1, 40127, 142577, 702-1802; 8170, IST1, 40130, 142580, 323-1423; 8170, IST1, 40131, 142581, 130-786; 8170, IST1, 40133, 142583, 101-757; 8171, IHH, 40135, 142585, 1-1236; 8172, IDO1, 40136, 142586, 55-567; 8172, IDO1, 40137, 142587, 599-1138; 8172, IDO1, 40138, 142588, 379-612; 8172, IDO1, 40139, 142589, 431-572; 8172, IDO1, 40140, 142590, 257-1468; 8172, IDO1, 40141, 142591, 640-1851; 8173, IDO2, 40143, 142593, 243-1505; 8173, IDO2, 40142, 142592, 1-1224; 8174, INMT, 40144, 142594, 17-808; 8174, INMT, 40145, 142595, 15-803; 8175, ICOS, 40146, 142596, 68-667; 8175, ICOS, 40147, 142597, 36-542; 8176, ICOSLG, 40150, 142600, 129-1550; 8176, ICOSLG, 40148, 142598, 24-953; 8176, ICOSLG, 40149, 142599, 150-707; 8176, ICOSLG, 40151, 142601, 129-1037; 8177,

IVNS1ABP, 40152, 142602, 52-459; 8177, IVNS1ABP, 40154, 142604, 1-354; 8177, IVNS1ABP, 40153, 142603, 624-2552; 8178, INHA, 40155, 142605, 181-1281; 8179, INHBA, 40156, 142606, 248-1528; 8179, INHBA, 40157, 142607, 236-1516; 8180, INHBB, 40158, 142608, 47-1270; 8181, INHBC, 40159, 142609, 128-1186; 8182, INHBE, 40161, 142611, 235-1056; 8182, INHBE, 40160, 142610, 217-1269; 8183, IBTK, 40163, 142613, 468-1184; 8183, IBTK, 40164, 142614, 80-3538; 8183, IBTK, 40165, 142615, 1-387; 8183, IBTK, 40166, 142616, 80-4096; 8183, IBTK, 40167, 142617, 551-4009; 8183, IBTK, 40168, 142618, 1-387; 8183, IBTK, 40169, 142619, 80-3538; 8183, IBTK, 40170, 142620, 468-1184; 8183, IBTK, 40171, 142621, 551-4612; 8183, IBTK, 40172, 142622, 80-4096; 8183, IBTK, 40173, 142623, 551-4009; 8183, IBTK, 40162, 142612, 551-4612; 8184, INCA1, 40174, 142624, 443-1108; 8184, INCA1, 40175, 142625, 357-1067; 8184, INCA1, 40176, 142626, 70-780; 8184, INCA1, 40177, 142627, 281-946; 8185, ID1, 40178, 142628, 106-555; 8185, ID1, 40179, 142629, 106-573; 8186, ID2, 40180, 142630, 861-1265; 8186, ID2, 40181, 142631, 184-588; 8186, ID2, 40182, 142632, 111-515; 8187, ID3, 40184, 142634, 369-728; 8187, ID3, 40183, 142633, 369-728; 8188, ID4, 40186, 142636, 315-794; 8188, ID4, 40185, 142635, 370-855; 8189, ING1, 40189, 142639, 463-1731; 8189, ING1, 40191, 142641, 8-340; 8189, ING1, 40187, 142637, 873-1712; 8189, ING1, 40188, 142638, 239-946; 8189, ING1, 40190, 142640, 199-831; 8190, ING2, 40193, 142643, 186-599; 8190, ING2, 40192, 142642, 203-1045; 8191, ING3, 40196, 142646, 66-1277; 8191, ING3, 40197, 142647, 103-402; 8191, ING3, 40194, 142644, 149-1405; 8191, ING3, 40195, 142645, 135-413; 8191, ING3, 40198, 142648, 113-394; 8192, ING4, 40205, 142655, 29-172; 8192, ING4, 40206, 142656, 14-169; 8192, ING4, 40207, 142657, 1-111; 8192, ING4, 40208, 142658, 29-172; 8192, ING4, 40209, 142659, 334-397; 8192, ING4, 40210, 142660, 377-529; 8192, ING4, 40211, 142661, 42-197; 8192, ING4, 40199, 142649, 48-794; 8192, ING4, 40200, 142650, 40-789; 8192, ING4, 40201, 142651, 1-678; 8192, ING4, 40202, 142652, 1-741; 8192, ING4, 40203, 142653, 1-540; 8192, ING4, 40204, 142654, 42-779; 8193, ING5, 40214, 142664, 6-434; 8193, ING5, 40212, 142662, 27-749; 8193, ING5, 40213, 142663, 21-701; 8194, IKBKB, 40215, 142665, 155-649; 8194, IKBKB, 40217, 142667, 119-349; 8194, IKBKB, 40218, 142668, 53-1741; 8194, IKBKB, 40219, 142669, 173-319; 8194, IKBKB, 40220, 142670, 19-348; 8194, IKBKB, 40221, 142671, 639-2327; 8194, IKBKB, 40222, 142672, 171-317; 8194, IKBKB, 40223, 142673, 171-326; 8194, IKBKB, 40224, 142674, 181-327; 8194, IKBKB, 40225, 142675, 179-325; 8194, IKBKB, 40226, 142676, 99-245; 8194, IKBKB, 40227, 142677, 19-1146; 8194, IKBKB, 40229, 142679, 170-301; 8194, IKBKB, 40232, 142682, 187-1875; 8194, IKBKB, 40216, 142666, 269-2362; 8194, IKBKB, 40228, 142678, 171-941; 8194, IKBKB, 40230, 142680, 187-2457; 8194, IKBKB, 40231, 142681, 54-2318; 8195, IKBKAP, 40234, 142684, 1-1040; 8195, IKBKAP, 40235, 142685, 398-3349; 8195, IKBKAP, 40233, 142683, 309-4307; 8196, IKBKE, 40238, 142688, 327-2300; 8196, IKBKE, 40239, 142689, 143-580; 8196, IKBKE, 40240, 142690, 180-641; 8196, IKBKE, 40236, 142686, 463-2358; 8196, IKBKE, 40237, 142687, 327-2477; 8197, IKBKG, 40241, 142691, 324-841; 8197, IKBKG, 40242, 142692, 209-960; 8197, IKBKG, 40243, 142693, 280-693; 8197, IKBKG, 40244, 142694, 306-892; 8197, IKBKG, 40247, 142697, 124-1362; 8197, IKBKG, 40248, 142698, 144-488; 8197, IKBKG, 40250, 142700, 2-148; 8197, IKBKG, 40251, 142701, 124-1359; 8197, IKBKG, 40253, 142703, 121-1377; 8197, IKBKG, 40254, 142704, 1-546; 8197, IKBKG, 40245, 142695, 455-1714; 8197, IKBKG, 40246, 142696, 120-1082; 8197, IKBKG, 40249, 142699, 259-1518; 8197, IKBKG, 40252, 142702, 21-1484; 8198, INMT-FAM188B, 40255, 142705, 15-440; 8198, INMT-FAM188B, 40256, 142706, 1-367; 8199, INCENP, 40259, 142709, 70-570; 8199, INCENP, 40257, 142707, 178-2922; 8199, INCENP, 40258, 142708, 203-2959; 8200, IMMT, 40260, 142710, 298-2277; 8200, IMMT, 40261, 142711, 52-2187; 8200, IMMT, 40262, 142712, 52-495; 8200, IMMT, 40266, 142716, 1-1840; 8200, IMMT, 40267, 142717, 83-1201; 8200, IMMT, 40263, 142713, 389-2665; 8200, IMMT, 40264, 142714, 91-2334; 8200, IMMT, 40265, 142715, 22-2295; 8201, IMMP1L, 40269, 142719, 155-475; 8201, IMMP1L, 40270, 142720, 134-307; 8201, IMMP1L, 40271, 142721, 1-91; 8201, IMMP1L, 40272, 142722, 340-513; 8201, IMMP1L, 40273, 142723, 265-552; 8201, IMMP1L, 40274, 142724, 86-370; 8201, IMMP1L, 40268, 142718, 197-697; 8201, IMMP1L, 40275, 142725, 86-586; 8202, IMMP2L, 40279, 142729, 1-243; 8202, IMMP2L, 40281, 142731, 112-585; 8202, IMMP2L, 40282, 142732, 185-421; 8202, IMMP2L, 40276, 142726, 130-657; 8202, IMMP2L, 40277, 142727, 444-971; 8202, IMMP2L, 40278, 142728, 77-409; 8202, IMMP2L, 40280, 142730, 120-647; 8203, INO80, 40285, 142735, 1-82; 8203, INO80, 40286, 142736, 204-3518; 8203, INO80, 40287, 142737, 1-239; 8203, INO80, 40288, 142738, 3694-4272; 8203, INO80, 40283, 142733, 426-5096; 8203, INO80, 40284, 142734, 225-4895; 8204, INO80B, 40290, 142740, 2-623; 8204, INO80B, 40291, 142741, 16-570; 8204, INO80B, 40292, 142742, 31-559; 8204, INO80B, 40293, 142743, 1-294; 8204, INO80B, 40289, 142739, 95-1165; 8205, INO80C, 40296, 142746, 154-567; 8205, INO80C, 40298, 142748, 212-299; 8205, INO80C, 40299, 142749, 62-331; 8205, INO80C, 40300, 142750, 87-382; 8205, INO80C, 40301, 142751, 31-318; 8205, INO80C, 40302, 142752, 1-408; 8205, INO80C, 40294, 142744, 118-696; 8205, INO80C, 40295, 142745, 70-756; 8205, INO80C, 40297, 142747, 60-653; 8206, INO80D, 40304, 142754, 348-1664; 8206, INO80D, 40305, 142755, 643-753; 8206, INO80D, 40303, 142753, 406-3489; 8207, INO80E, 40306, 142756, 597-1214; 8207, INO80E, 40308, 142758, 62-745; 8207, INO80E, 40311, 142761, 1-255; 8207, INO80E, 40312, 142762, 61-627; 8207, INO80E, 40313, 142763, 68-589; 8207, INO80E, 40307, 142757, 66-479; 8207, INO80E, 40309, 142759, 66-479; 8207, INO80E, 40310, 142760, 1018-1752; 8207, INO80E, 40314, 142764, 102-515; 8208, INO80B-WBP1, 40315, 142765, 30-1121; 8208, INO80B-WBP1, 40316, 142766, 18-809; 8209, ITPA, 40317, 142767, 193-777; 8209, ITPA, 40318, 142768, 28-489; 8209, ITPA, 40319, 142769, 40-573; 8210, IPPK, 40321, 142771, 86-577; 8210, IPPK, 40320, 142770, 278-1753; 8211, ITPRIP, 40325, 142775, 454-796; 8211, ITPRIP, 40322, 142772, 454-2097; 8211, ITPRIP, 40323, 142773, 173-1816; 8211, ITPRIP, 40324, 142774, 74-1717; 8212, ITPRIPL1, 40328, 142778, 1-1763; 8212, ITPRIPL1, 40329, 142779, 250-790; 8212, ITPRIPL1, 40326, 142776, 386-2077; 8212, ITPRIPL1, 40327, 142777, 252-1919; 8212, ITPRIPL1, 40330, 142780, 250-1893; 8213, ITPRIPL2, 40332, 142782, 1-384; 8213, ITPRIPL2, 40331, 142781, 80-1687; 8214, ITPR1, 40338, 142788, 351-2516; 8214, ITPR1, 40333, 142783, 351-8582; 8214, ITPR1, 40334, 142784, 351-8627; 8214, ITPR1, 40335, 142785, 349-8481; 8214, ITPR1, 40336, 142786, 349-8436; 8214, ITPR1, 40337, 142787, 1-8232; 8215, ITPR2, 40341, 142791, 1-309; 8215, ITPR2, 40342, 142792, 6-245; 8215, ITPR2, 40339, 142789, 1-546; 8215,

ITPR2, 40340, 142790, 418-8523; 8216, ITPR3, 40343, 142793, 1061-9076; 8216, ITPR3, 40344, 142794, 225-8240; 8217, IP6K1, 40347, 142797, 316-1140; 8217, IP6K1, 40345, 142795, 303-1628; 8217, IP6K1, 40346, 142796, 460-1290; 8217, IP6K1, 40348, 142798, 336-1166; 8217, IP6K1, 40349, 142799, 654-1979; 8218, IP6K2, 40352, 142802, 152-544; 8218, IP6K2, 40354, 142804, 178-570; 8218, IP6K2, 40355, 142805, 399-560; 8218, IP6K2, 40356, 142806, 186-572; 8218, IP6K2, 40357, 142807, 279-579; 8218, IP6K2, 40358, 142808, 167-559; 8218, IP6K2, 40359, 142809, 374-537; 8218, IP6K2, 40360, 142810, 69-524; 8218, IP6K2, 40361, 142811, 283-543; 8218, IP6K2, 40363, 142813, 1108-1500; 8218, IP6K2, 40366, 142816, 304-576; 8218, IP6K2, 40367, 142817, 284-568; 8218, IP6K2, 40368, 142818, 95-539; 8218, IP6K2, 40369, 142819, 129-698; 8218, IP6K2, 40370, 142820, 189-580; 8218, IP6K2, 40371, 142821, 211-631; 8218, IP6K2, 40373, 142823, 240-553; 8218, IP6K2, 40350, 142800, 225-1505; 8218, IP6K2, 40351, 142801, 191-484; 8218, IP6K2, 40353, 142803, 175-387; 8218, IP6K2, 40362, 142812, 303-596; 8218, IP6K2, 40364, 142814, 151-717; 8218, IP6K2, 40365, 142815, 253-516; 8218, IP6K2, 40372, 142822, 239-796; 8219, IP6K3, 40376, 142826, 317-546; 8219, IP6K3, 40374, 142824, 328-1560; 8219, IP6K3, 40375, 142825, 457-1689; 8220, IMPAD1, 40378, 142828, 1-248; 8220, IMPAD1, 40379, 142829, 1-249; 8220, IMPAD1, 40377, 142827, 260-1339; 8221, IPMK, 40380, 142830, 324-1574; 8222, INPPL1, 40382, 142832, 1-449; 8222, INPPL1, 40383, 142833, 1-125; 8222, INPPL1, 40384, 142834, 361-741; 8222, INPPL1, 40385, 142835, 223-275; 8222, INPPL1, 40386, 142836, 309-375; 8222, INPPL1, 40387, 142837, 1-594; 8222, INPPL1, 40389, 142839, 450-550; 8222, INPPL1, 40390, 142840, 321-3761; 8222, INPPL1, 40381, 142831, 205-3981; 8222, INPPL1, 40388, 142838, 854-3904; 8223, INPP1, 40393, 142843, 166-631; 8223, INPP1, 40394, 142844, 349-613; 8223, INPP1, 40395, 142845, 198-626; 8223, INPP1, 40396, 142846, 205-840; 8223, INPP1, 40397, 142847, 226-797; 8223, INPP1, 40398, 142848, 172-812; 8223, INPP1, 40399, 142849, 335-425; 8223, INPP1, 40400, 142850, 338-541; 8223, INPP1, 40401, 142851, 524-552; 8223, INPP1, 40391, 142841, 457-1656; 8223, INPP1, 40392, 142842, 701-1900; 8224, INPP4A, 40403, 142853, 394-1314; 8224, INPP4A, 40402, 142852, 394-3327; 8224, INPP4A, 40404, 142854, 398-3214; 8224, INPP4A, 40405, 142855, 394-3312; 8224, INPP4A, 40406, 142856, 302-3166; 8224, INPP4A, 40407, 142857, 1-2934; 8225, INPP4B, 40409, 142859, 249-392; 8225, INPP4B, 40410, 142860, 98-2155; 8225, INPP4B, 40411, 142861, 467-583; 8225, INPP4B, 40412, 142862, 346-3162; 8225, INPP4B, 40413, 142863, 263-1513; 8225, INPP4B, 40416, 142866, 1-102; 8225, INPP4B, 40418, 142868, 1-196; 8225, INPP4B, 40419, 142869, 201-2265; 8225, INPP4B, 40420, 142870, 374-535; 8225, INPP4B, 40421, 142871, 312-563; 8225, INPP4B, 40422, 142872, 404-2855; 8225, INPP4B, 40423, 142873, 193-354; 8225, INPP4B, 40408, 142858, 218-2992; 8225, INPP4B, 40414, 142864, 354-3128; 8225, INPP4B, 40415, 142865, 1-396; 8225, INPP4B, 40417, 142867, 435-3209; 8226, INPP5A, 40424, 142874, 1-832; 8226, INPP5A, 40425, 142875, 249-1412; 8226, INPP5A, 40427, 142877, 1-315; 8226, INPP5A, 40428, 142878, 1-416; 8226, INPP5A, 40426, 142876, 278-1516; 8227, INPP5B, 40429, 142879, 27-986; 8227, INPP5B, 40434, 142884, 59-2305; 8227, INPP5B, 40430, 142880, 95-3076; 8227, INPP5B, 40431, 142881, 89-2830; 8227, INPP5B, 40432, 142882, 2-2983; 8227, INPP5B, 40433, 142883, 38-2287; 8228, INPP5D, 40436, 142886, 1-2433; 8228, INPP5D, 40438, 142888, 1-393; 8228, INPP5D, 40439, 142889, 1-130; 8228, INPP5D, 40440, 142890, 1-130; 8228, INPP5D, 40443, 142893, 1-393; 8228, INPP5D, 40444, 142894, 1-2433; 8228, INPP5D, 40435, 142885, 513-4079; 8228, INPP5D, 40437, 142887, 82-3651; 8228, INPP5D, 40441, 142891, 513-4079; 8228, INPP5D, 40442, 142892, 82-3651; 8229, INPP5E, 40445, 142895, 404-2338; 8230, INPP5F, 40448, 142898, 516-686; 8230, INPP5F, 40449, 142899, 267-583; 8230, INPP5F, 40450, 142900, 4-552; 8230, INPP5F, 40451, 142901, 349-596; 8230, INPP5F, 40446, 142896, 167-3565; 8230, INPP5F, 40447, 142897, 769-2337; 8231, INPP5J, 40455, 142905, 419-1534; 8231, INPP5J, 40457, 142907, 310-1347; 8231, INPP5J, 40458, 142908, 281-1396; 8231, INPP5J, 40459, 142909, 416-3235; 8231, INPP5J, 40460, 142910, 373-805; 8231, INPP5J, 40461, 142911, 253-558; 8231, INPP5J, 40462, 142912, 314-2029; 8231, INPP5J, 40452, 142902, 50-3070; 8231, INPP5J, 40453, 142903, 197-2116; 8231, INPP5J, 40454, 142904, 22-1938; 8231, INPP5J, 40456, 142906, 319-2238; 8232, INPP5K, 40463, 142913, 120-311; 8232, INPP5K, 40466, 142916, 182-340; 8232, INPP5K, 40467, 142917, 263-949; 8232, INPP5K, 40469, 142919, 318-571; 8232, INPP5K, 40470, 142920, 163-318; 8232, INPP5K, 40471, 142921, 120-594; 8232, INPP5K, 40472, 142922, 129-591; 8232, INPP5K, 40473, 142923, 84-383; 8232, INPP5K, 40474, 142924, 1-115; 8232, INPP5K, 40475, 142925, 553-622; 8232, INPP5K, 40476, 142926, 590-739; 8232, INPP5K, 40464, 142914, 696-1814; 8232, INPP5K, 40465, 142915, 862-1980; 8232, INPP5K, 40468, 142918, 390-1736; 8233, IMPA1, 40480, 142930, 84-413; 8233, IMPA1, 40481, 142931, 56-436; 8233, IMPA1, 40482, 142932, 102-407; 8233, IMPA1, 40483, 142933, 112-653; 8233, IMPA1, 40484, 142934, 105-627; 8233, IMPA1, 40485, 142935, 1-793; 8233, IMPA1, 40486, 142936, 137-770; 8233, IMPA1, 40487, 142937, 84-543; 8233, IMPA1, 40477, 142927, 467-1300; 8233, IMPA1, 40478, 142928, 75-671; 8233, IMPA1, 40479, 142929, 81-1091; 8234, IMPA2, 40489, 142939, 155-412; 8234, IMPA2, 40490, 142940, 1-379; 8234, IMPA2, 40491, 142941, 488-787; 8234, IMPA2, 40492, 142942, 566-865; 8234, IMPA2, 40493, 142943, 60-410; 8234, IMPA2, 40494, 142944, 206-697; 8234, IMPA2, 40495, 142945, 243-500; 8234, IMPA2, 40488, 142938, 243-1109; 8235, ISYNA1, 40498, 142948, 61-592; 8235, ISYNA1, 40499, 142949, 33-173; 8235, ISYNA1, 40500, 142950, 80-627; 8235, ISYNA1, 40501, 142951, 133-273; 8235, ISYNA1, 40502, 142952, 80-535; 8235, ISYNA1, 40503, 142953, 184-629; 8235, ISYNA1, 40504, 142954, 1-701; 8235, ISYNA1, 40496, 142946, 219-1895; 8235, ISYNA1, 40497, 142947, 85-1599; 8235, ISYNA1, 40505, 142955, 307-1599; 8236, ITPK1, 40508, 142958, 267-770; 8236, ITPK1, 40510, 142960, 124-667; 8236, ITPK1, 40511, 142961, 449-1336; 8236, ITPK1, 40512, 142962, 106-609; 8236, ITPK1, 40513, 142963, 110-727; 8236, ITPK1, 40516, 142966, 110-727; 8236, ITPK1, 40517, 142967, 267-770; 8236, ITPK1, 40518, 142968, 124-667; 8236, ITPK1, 40519, 142969, 449-1336; 8236, ITPK1, 40520, 142970, 106-609; 8236, ITPK1, 40506, 142956, 175-1419; 8236, ITPK1, 40507, 142957, 290-1234; 8236, ITPK1, 40509, 142959, 122-1366; 8236, ITPK1, 40514, 142964, 290-1234; 8236, ITPK1, 40515, 142965, 122-1366; 8236, ITPK1, 40521, 142971, 175-1419; 8237, ITPKA, 40523, 142973, 73-852; 8237, ITPKA, 40522, 142972, 54-1439; 8238, ITPKB, 40524, 142974, 1-2841; 8238, ITPKB, 40525, 142975, 489-2423; 8238, ITPKB, 40526, 142976, 341-3181; 8239, ITPKC, 40528, 142978, 1-153; 8239, ITPKC, 40527, 142977, 34-2085; 8240, INSC, 40531, 142981, 77-1777; 8240, INSC, 40529, 142979, 47-1786; 8240, INSC, 40530, 142980, 112-1710; 8240, INSC, 40532, 142982, 74-1636; 8240, INSC, 40533, 142983, 68-1540; 8240, INSC, 40534, 142984, 68-1666; 8241, INS-IGF2, 40535, 142985, 60-662; 8241, INS-IGF2, 40536, 142986, 60-662; 8242, INS, 40540, 142990, 188-464; 8242, INS, 40541, 142991, 1-297; 8242, INS, 40537, 142987, 98-430; 8242, INS, 40538, 142988, 192-524; 8242, INS, 40539, 142989, 234-566; 8243, INSIG1, 40542, 142992, 212-748; 8243, INSIG1, 40545, 142995, 227-596; 8243, INSIG1, 40546, 142996, 1-718; 8243, INSIG1, 40543, 142993, 99-593; 8243, INSIG1, 40544, 142994, 212-1045; 8244, INSIG2, 40548, 142998, 205-324; 8244, INSIG2, 40549, 142999, 140-856; 8244, INSIG2, 40547, 142997, 207-884; 8245, INSR, 40552, 143002, 1-459; 8245, INSR, 40550, 143000, 144-4292; 8245, INSR, 40551, 143001, 41-4153; 8246, IRS1, 40553, 143003, 1022-4750; 8247, IRS2, 40554, 143004, 516-4532; 8248, IRS4, 40555, 143005, 66-3839; 8249, INSRR, 40556, 143006, 398-4291; 8250, IDE, 40559, 143009, 1-772; 8250, IDE, 40560, 143010, 49-234; 8250, IDE, 40557, 143007, 58-3117; 8250, IDE, 40558, 143008, 326-1720; 8251, INSL3, 40563, 143013, 1-215; 8251, INSL3, 40561, 143011, 18-413; 8251, INSL3, 40562, 143012, 69-542; 8252, INSL4, 40564, 143014, 106-525; 8253, INSL5, 40565, 143015, 36-443; 8254, INSL6, 40566, 143016, 67-708; 8255, IGF1, 40570, 143020, 1-420; 8255, IGF1, 40567, 143017, 183-770; 8255, IGF1, 40568, 143018, 265-726; 8255, IGF1, 40569, 143019, 72-548; 8255, IGF1, 40571, 143021, 220-696; 8255, IGF1, 40572, 143022, 151-564; 8256, IGF1R, 40574, 143024, 539-4639; 8256, IGF1R, 40575, 143025, 1-310; 8256, IGF1R, 40576, 143026, 1-572; 8256, IGF1R, 40577, 143027, 398-1034; 8256, IGF1R, 40578, 143028, 1-271; 8256, IGF1R, 40573, 143023, 612-4715; 8257, IGF2, 40579, 143029, 167-709; 8257, IGF2, 40580, 143030, 107-658; 8257, IGF2, 40581, 143031, 110-652; 8257, IGF2, 40582, 143032, 753-1304; 8257, IGF2, 40583, 143033, 386-1096; 8257, IGF2, 40584, 143034, 121-663; 8257, IGF2, 40585, 143035, 1168-1710; 8258, IGF2BP1, 40586, 143036, 335-2068; 8258, IGF2BP1, 40587, 143037, 1-1317; 8259, IGF2BP2, 40590, 143040, 53-1870; 8259, IGF2BP2, 40588, 143038, 65-1735; 8259, IGF2BP2, 40589, 143039, 97-1896; 8259, IGF2BP2, 40591, 143041, 71-1681; 8260, IGF2BP3, 40593, 143043, 346-591; 8260, IGF2BP3, 40592, 143042, 358-2097; 8260, IGF2BP3, 40594, 143044, 295-891; 8261, IGF2R, 40596, 143046, 1-556; 8261, IGF2R, 40595, 143045, 149-7624; 8262, IGFBP1, 40598, 143048, 294-1067; 8262, IGFBP1, 40599, 143049, 157-807; 8262, IGFBP1, 40597, 143047, 297-1076; 8263, IGFBP2, 40601, 143051, 120-665; 8263, IGFBP2, 40602, 143052, 1-297; 8263, IGFBP2, 40603, 143053, 244-477; 8263, IGFBP2, 40600, 143050, 130-1107; 8264, IGFBP3, 40606, 143056, 133-717; 8264, IGFBP3, 40607, 143057, 176-571; 8264, IGFBP3, 40608, 143058, 1-431; 8264, IGFBP3, 40609, 143059, 1-460; 8264, IGFBP3, 40610, 143060, 1-813; 8264, IGFBP3, 40611, 143061, 1-792; 8264, IGFBP3, 40604, 143054, 135-1010; 8264, IGFBP3, 40605, 143055, 112-1005; 8265, IGFBP4, 40612, 143062, 276-1052; 8266, IGFBP5, 40614, 143064, 20-718; 8266, IGFBP5, 40613, 143063, 751-1569; 8267, IGFBP6, 40616, 143066, 283-999; 8267, IGFBP6, 40617, 143067, 52-462; 8267, IGFBP6, 40615, 143065, 274-996; 8268, IGFBP7, 40618, 143068, 35-883; 8268, IGFBP7, 40619, 143069, 35-874; 8269, IGFALS, 40622, 143072, 86-481; 8269, IGFALS, 40620, 143070, 112-1929; 8269, IGFALS, 40621, 143071, 81-2012; 8270, IGFBPL1, 40623, 143073, 24-860; 8271, INSM1, 40624, 143074, 148-1680; 8272, INSM2, 40625, 143075, 212-1912; 8273, ITM2A, 40626, 143076, 145-936; 8273, ITM2A, 40627, 143077, 338-997; 8274, ITM2B, 40630, 143080, 1-161; 8274, ITM2B, 40631, 143081, 1-88; 8274, ITM2B, 40628, 143078, 159-641; 8274, ITM2B, 40629, 143079, 204-1004; 8275, ITM2C, 40635, 143085, 203-820; 8275, ITM2C, 40636, 143086, 223-763; 8275, ITM2C, 40637, 143087, 189-563; 8275, ITM2C, 40638, 143088, 198-572; 8275, ITM2C, 40639, 143089, 206-573; 8275, ITM2C, 40640, 143090, 1-501; 8275, ITM2C, 40632, 143082, 47-739; 8275, ITM2C, 40633, 143083, 127-930; 8275, ITM2C, 40634, 143084, 79-741; 8276, INTS1, 40642, 143092, 1-386; 8276, INTS1, 40641, 143091, 87-6659; 8277, INTS10, 40644, 143094, 1-164; 8277, INTS10, 40645, 143095, 1-88; 8277, INTS10, 40646, 143096, 1-521; 8277, INTS10, 40647, 143097, 1-125; 8277, INTS10, 40648, 143098, 148-348; 8277, INTS10, 40649, 143099, 1-311; 8277, INTS10, 40650, 143100, 1-457; 8277, INTS10, 40651, 143101, 1-704; 8277, INTS10, 40652, 143102, 1-149; 8277, INTS10, 40653, 143103, 102-299; 8277, INTS10, 40643, 143093, 399-2531; 8278, INTS12, 40656, 143106, 731-995; 8278, INTS12, 40657, 143107, 300-562; 8278, INTS12, 40658, 143108, 332-726; 8278, INTS12, 40660, 143110, 515-569; 8278, INTS12, 40661, 143111, 371-542; 8278, INTS12, 40662, 143112, 176-653; 8278, INTS12, 40663, 143113, 12-1346; 8278, INTS12, 40654, 143104, 216-1604; 8278, INTS12, 40655, 143105, 433-1821; 8278, INTS12, 40659, 143109, 481-1869; 8279, INTS2, 40664, 143114, 357-3947; 8279, INTS2, 40666, 143116, 175-411; 8279, INTS2, 40665, 143115, 77-3691; 8279, INTS2, 40667, 143117, 1-3615; 8280, INTS3, 40670, 143120, 1-148; 8280, INTS3, 40673, 143123, 1-148; 8280, INTS3, 40676, 143126, 1-126; 8280, INTS3, 40677, 143127, 1-843; 8280, INTS3, 40678, 143128, 1-843; 8280, INTS3, 40679, 143129, 1-126; 8280, INTS3, 40668, 143118, 569-3697; 8280, INTS3, 40669, 143119, 204-3332; 8280, INTS3, 40671, 143121, 276-2984; 8280, INTS3, 40672, 143122, 204-3332; 8280, INTS3, 40674, 143124, 276-2984; 8280, INTS3, 40675, 143125, 569-3697; 8281, INTS4, 40680, 143130, 29-427; 8281, INTS4, 40681, 143131, 11-301; 8281, INTS4, 40684, 143134, 28-318; 8281, INTS4, 40685, 143135, 23-313; 8281, INTS4, 40682, 143132, 24-1541; 8281, INTS4, 40683, 143133, 36-2927; 8281, INTS4, 40686, 143136, 139-1155; 8282, INTS5, 40687, 143137, 54-3113; 8283, INTS6, 40691, 143141, 267-722; 8283, INTS6, 40692, 143142, 219-597; 8283, INTS6, 40693, 143143, 21-483; 8283, INTS6, 40694, 143144, 184-452; 8283, INTS6, 40695, 143145, 102-496; 8283, INTS6, 40696, 143146, 85-474; 8283, INTS6, 40697, 143147, 369-2498; 8283, INTS6, 40698, 143148, 576-2291; 8283, INTS6, 40688, 143138, 474-3137; 8283, INTS6, 40689, 143139, 230-2854; 8283, INTS6, 40690, 143140, 491-838; 8284, INTS7, 40703, 143153, 1-459; 8284, INTS7, 40704, 143154, 100-363; 8284, INTS7, 40705, 143155, 1-344; 8284, INTS7, 40706, 143156, 94-222; 8284, INTS7, 40699, 143149, 84-2912; 8284, INTS7, 40700, 143150, 100-2946; 8284, INTS7, 40701, 143151, 106-2994; 8284, INTS7, 40702, 143152, 103-2844; 8285, INTS8, 40707, 143157, 57-2333; 8285, INTS8, 40708, 143158, 134-1009; 8285, INTS8, 40709, 143159, 143-581; 8285, INTS8, 40710, 143160, 287-569; 8285, INTS8, 40711, 143161, 122-735; 8285, INTS8, 40712, 143162, 57-932; 8285, INTS8, 40713, 143163, 10-597; 8285, INTS8, 40714, 143164, 1-548; 8285, INTS8, 40715, 143165, 1-2402; 8285, INTS8, 40717, 143167, 1-396; 8285, INTS8, 40716, 143166, 134-3121; 8286, INTS9, 40719, 143169, 28-929; 8286, INTS9, 40720, 143170, 32-1609; 8286, INTS9, 40721, 143171, 46-558; 8286, INTS9, 40723, 143173, 298-

559; 8286, INTS9, 40724, 143174, 1-668; 8286, INTS9, 40725, 143175, 1-452; 8286, INTS9, 40726, 143176, 1-78; 8286, INTS9, 40727, 143177, 61-177; 8286, INTS9, 40718, 143168, 361-2274; 8286, INTS9, 40722, 143172, 83-2059; 8286, INTS9, 40728, 143178, 138-2042; 8287, ITFG1, 40730, 143180, 292-1686; 8287, ITFG1, 40731, 143181, 330-550; 8287, ITFG1, 40732, 143182, 1-537; 8287, ITFG1, 40733, 143183, 1-341; 8287, ITFG1, 40729, 143179, 230-2068; 8288, ITFG2, 40735, 143185, 1-396; 8288, ITFG2, 40736, 143186, 1-53; 8288, ITFG2, 40737, 143187, 1-172; 8288, ITFG2, 40739, 143189, 1-179; 8288, ITFG2, 40740, 143190, 77-247; 8288, ITFG2, 40734, 143184, 140-1483; 8288, ITFG2, 40738, 143188, 69-512; 8289, ITGB1BP2, 40741, 143191, 74-1117; 8289, ITGB1BP2, 40742, 143192, 341-1330; 8290, ITGB1BP1, 40745, 143195, 808-1362; 8290, ITGB1BP1, 40747, 143197, 94-648; 8290, ITGB1BP1, 40748, 143198, 411-663; 8290, ITGB1BP1, 40749, 143199, 358-699; 8290, ITGB1BP1, 40750, 143200, 281-540; 8290, ITGB1BP1, 40751, 143201, 463-659; 8290, ITGB1BP1, 40752, 143202, 164-280; 8290, ITGB1BP1, 40754, 143204, 158-445; 8290, ITGB1BP1, 40755, 143205, 341-748; 8290, ITGB1BP1, 40756, 143206, 120-443; 8290, ITGB1BP1, 40743, 143193, 170-622; 8290, ITGB1BP1, 40744, 143194, 211-813; 8290, ITGB1BP1, 40746, 143196, 898-1500; 8290, ITGB1BP1, 40753, 143203, 255-707; 8291, ITGB3BP, 40757, 143207, 83-616; 8291, ITGB3BP, 40758, 143208, 62-712; 8291, ITGB3BP, 40759, 143209, 370-882; 8292, ITGA1, 40760, 143210, 459-3998; 8293, ITGA10, 40761, 143211, 176-3679; 8293, ITGA10, 40762, 143212, 77-3151; 8294, ITGA11, 40763, 143213, 97-3663; 8294, ITGA11, 40764, 143214, 97-3666; 8295, ITGA2, 40766, 143216, 30-194; 8295, ITGA2, 40767, 143217, 30-2858; 8295, ITGA2, 40768, 143218, 30-2477; 8295, ITGA2, 40769, 143219, 30-1955; 8295, ITGA2, 40770, 143220, 130-657; 8295, ITGA2, 40765, 143215, 144-3689; 8296, ITGA2B, 40772, 143222, 1-97; 8296, ITGA2B, 40773, 143223, 1-313; 8296, ITGA2B, 40771, 143221, 33-3152; 8297, ITGA3, 40776, 143226, 52-480; 8297, ITGA3, 40777, 143227, 1-253; 8297, ITGA3, 40778, 143228, 1-664; 8297, ITGA3, 40779, 143229, 1-351; 8297, ITGA3, 40780, 143230, 1-89; 8297, ITGA3, 40774, 143224, 1-3201; 8297, ITGA3, 40775, 143225, 331-3486; 8298, ITGA4, 40781, 143231, 228-2070; 8298, ITGA4, 40782, 143232, 449-1036; 8298, ITGA4, 40783, 143233, 431-3529; 8299, ITGA5, 40785, 143235, 23-436; 8299, ITGA5, 40786, 143236, 1-361; 8299, ITGA5, 40787, 143237, 1-359; 8299, ITGA5, 40784, 143234, 263-3412; 8300, ITGA6, 40791, 143241, 1-777; 8300, ITGA6, 40794, 143244, 278-970; 8300, ITGA6, 40788, 143238, 235-3456; 8300, ITGA6, 40789, 143239, 214-3078; 8300, ITGA6, 40790, 143240, 1-3276; 8300, ITGA6, 40792, 143242, 1-3261; 8300, ITGA6, 40793, 143243, 1-3393; 8301, ITGA7, 40796, 143246, 203-3598; 8301, ITGA7, 40798, 143248, 117-576; 8301, ITGA7, 40799, 143249, 134-430; 8301, ITGA7, 40800, 143250, 1-328; 8301, ITGA7, 40801, 143251, 132-278; 8301, ITGA7, 40802, 143252, 1-617; 8301, ITGA7, 40803, 143253, 13-180; 8301, ITGA7, 40804, 143254, 1-106; 8301, ITGA7, 40807, 143257, 121-267; 8301, ITGA7, 40795, 143245, 217-3630; 8301, ITGA7, 40797, 143247, 143-3277; 8301, ITGA7, 40805, 143255, 20-3445; 8301, ITGA7, 40806, 143256, 30-3575; 8302, ITGA8, 40808, 143258, 355-3546; 8303, ITGA9, 40810, 143260, 261-2159; 8303, ITGA9, 40811, 143261, 1-208; 8303, ITGA9, 40809, 143259, 257-3364; 8304, ITGAD, 40812, 143262, 50-3535; 8305, ITGAE, 40814, 143264, 1-416; 8305, ITGAE, 40813, 143263, 100-3639; 8306, ITGAL, 40817, 143267, 88-1302; 8306, ITGAL, 40818, 143268, 93-581; 8306, ITGAL, 40819, 143269, 93-260; 8306, ITGAL, 40820, 143270, 120-392; 8306, ITGAL, 40821, 143271, 89-699; 8306, ITGAL, 40822, 143272, 94-423; 8306, ITGAL, 40823, 143273, 1-116; 8306, ITGAL, 40824, 143274, 423-545; 8306, ITGAL, 40815, 143265, 181-3693; 8306, ITGAL, 40816, 143266, 110-3370; 8307, ITGAM, 40827, 143277, 1-494; 8307, ITGAM, 40828, 143278, 1-354; 8307, ITGAM, 40825, 143275, 76-3534; 8307, ITGAM, 40826, 143276, 72-3533; 8308, ITGAV, 40831, 143281, 1-410; 8308, ITGAV, 40829, 143279, 275-3421; 8308, ITGAV, 40830, 143280, 260-3298; 8308, ITGAV, 40832, 143282, 131-3139; 8309, ITGAX, 40834, 143284, 34-3543; 8309, ITGAX, 40835, 143285, 82-627; 8309, ITGAX, 40833, 143283, 122-3613; 8310, ITGB1, 40839, 143289, 37-445; 8310, ITGB1, 40840, 143290, 354-500; 8310, ITGB1, 40841, 143291, 301-569; 8310, ITGB1, 40842, 143292, 179-552; 8310, ITGB1, 40843, 143293, 1-211; 8310, ITGB1, 40844, 143294, 95-585; 8310, ITGB1, 40845, 143295, 1-325; 8310, ITGB1, 40846, 143296, 84-540; 8310, ITGB1, 40847, 143297, 493-788; 8310, ITGB1, 40848, 143298, 627-668; 8310, ITGB1, 40849, 143299, 274-366; 8310, ITGB1, 40850, 143300, 134-562; 8310, ITGB1, 40851, 143301, 234-546; 8310, ITGB1, 40836, 143286, 66-2462; 8310, ITGB1, 40837, 143287, 137-2533; 8310, ITGB1, 40838, 143288, 1-2406; 8311, ITGB2, 40853, 143303, 1-966; 8311, ITGB2, 40855, 143305, 80-406; 8311, ITGB2, 40858, 143308, 39-2177; 8311, ITGB2, 40860, 143310, 59-274; 8311, ITGB2, 40861, 143311, 458-606; 8311, ITGB2, 40862, 143312, 211-571; 8311, ITGB2, 40863, 143313, 111-392; 8311, ITGB2, 40864, 143314, 182-680; 8311, ITGB2, 40865, 143315, 317-527; 8311, ITGB2, 40866, 143316, 94-573; 8311, ITGB2, 40867, 143317, 410-556; 8311, ITGB2, 40868, 143318, 458-568; 8311, ITGB2, 40869, 143319, 53-1189; 8311, ITGB2, 40852, 143302, 234-2543; 8311, ITGB2, 40854, 143304, 189-2498; 8311, ITGB2, 40856, 143306, 454-2763; 8311, ITGB2, 40857, 143307, 45-2354; 8311, ITGB2, 40859, 143309, 89-2398; 8312, ITGB3, 40871, 143321, 10-1341; 8312, ITGB3, 40872, 143322, 1-108; 8312, ITGB3, 40870, 143320, 17-2383; 8313, ITGB4, 40876, 143326, 1-191; 8313, ITGB4, 40878, 143328, 1-345; 8313, ITGB4, 40879, 143329, 1-603; 8313, ITGB4, 40873, 143323, 188-5656; 8313, ITGB4, 40874, 143324, 9-5426; 8313, ITGB4, 40875, 143325, 127-5385; 8313, ITGB4, 40877, 143327, 247-5505; 8314, ITGB5, 40881, 143331, 483-605; 8314, ITGB5, 40882, 143332, 1-789; 8314, ITGB5, 40883, 143333, 340-576; 8314, ITGB5, 40884, 143334, 1-1202; 8314, ITGB5, 40885, 143335, 372-548; 8314, ITGB5, 40886, 143336, 408-825; 8314, ITGB5, 40887, 143337, 1-971; 8314, ITGB5, 40880, 143330, 298-2697; 8315, ITGB6, 40890, 143340, 242-454; 8315, ITGB6, 40892, 143342, 236-2476; 8315, ITGB6, 40893, 143343, 251-2332; 8315, ITGB6, 40888, 143338, 239-2605; 8315, ITGB6, 40889, 143339, 135-2501; 8315, ITGB6, 40891, 143341, 196-2241; 8316, ITGB7, 40896, 143346, 84-1499; 8316, ITGB7, 40897, 143347, 311-576; 8316, ITGB7, 40898, 143348, 132-607; 8316, ITGB7, 40900, 143350, 233-513; 8316, ITGB7, 40901, 143351, 1-353; 8316, ITGB7, 40894, 143344, 233-2629; 8316, ITGB7, 40895, 143345, 162-2558; 8316, ITGB7, 40899, 143349, 1-1953; 8317, ITGB8, 40902, 143352, 685-2994; 8317, ITGB8, 40903, 143353, 1183-3087; 8318, ITGBL1, 40907, 143357, 1-625; 8318, ITGBL1, 40908, 143358, 379-1584; 8318, ITGBL1, 40909, 143359, 242-1579; 8318, ITGBL1, 40904, 143354, 13-1218; 8318, ITGBL1, 40905, 143355, 220-1704; 8318, ITGBL1, 40906, 143356, 373-1434; 8319,

IBSP, 40910, 143360, 68-1021; 8320, ILK, 40914, 143364, 143-253; 8320, ILK, 40917, 143367, 88-198; 8320, ILK, 40918, 143368, 126-1577; 8320, ILK, 40919, 143369, 139-261; 8320, ILK, 40920, 143370, 1-336; 8320, ILK, 40921, 143371, 1-111; 8320, ILK, 40911, 143361, 185-1543; 8320, ILK, 40912, 143362, 457-1815; 8320, ILK, 40913, 143363, 112-1470; 8320, ILK, 40915, 143365, 398-1354; 8320, ILK, 40916, 143366, 129-1304; 8321, ILKAP, 40923, 143373, 156-793; 8321, ILKAP, 40924, 143374, 1-612; 8321, ILKAP, 40925, 143375, 131-619; 8321, ILKAP, 40926, 143376, 131-955; 8321, ILKAP, 40922, 143372, 177-1355; 8322, ITLN1, 40927, 143377, 117-1058; 8323, ITLN2, 40928, 143378, 59-1036; 8324, IPCEF1, 40932, 143382, 174-558; 8324, IPCEF1, 40933, 143383, 244-568; 8324, IPCEF1, 40934, 143384, 246-1475; 8324, IPCEF1, 40935, 143385, 251-485; 8324, IPCEF1, 40936, 143386, 108-580; 8324, IPCEF1, 40929, 143379, 157-1470; 8324, IPCEF1, 40930, 143380, 126-1442; 8324, IPCEF1, 40931, 143381, 197-1513; 8325, ICE1, 40938, 143388, 177-613; 8325, ICE1, 40937, 143387, 223-7023; 8326, ICE2, 40940, 143390, 287-568; 8326, ICE2, 40941, 143391, 104-289; 8326, ICE2, 40942, 143392, 455-1470; 8326, ICE2, 40943, 143393, 125-559; 8326, ICE2, 40946, 143396, 287-584; 8326, ICE2, 40947, 143397, 201-356; 8326, ICE2, 40948, 143398, 164-1315; 8326, ICE2, 40939, 143389, 236-3184; 8326, ICE2, 40944, 143394, 154-375; 8326, ICE2, 40945, 143395, 251-472; 8327, ITIH1, 40950, 143400, 140-973; 8327, ITIH1, 40951, 143401, 1-1395; 8327, ITIH1, 40952, 143402, 22-663; 8327, ITIH1, 40953, 143403, 1-223; 8327, ITIH1, 40949, 143399, 25-2760; 8327, ITIH1, 40954, 143404, 465-2336; 8328, ITIH2, 40956, 143406, 36-2843; 8328, ITIH2, 40957, 143407, 56-767; 8328, ITIH2, 40958, 143408, 64-2901; 8328, ITIH2, 40955, 143405, 167-3007; 8329, ITIH3, 40959, 143409, 9-2105; 8329, ITIH3, 40961, 143411, 37-2049; 8329, ITIH3, 40960, 143410, 7-2679; 8330, ITIH4, 40964, 143414, 1-2158; 8330, ITIH4, 40965, 143415, 32-2839; 8330, ITIH4, 40962, 143412, 98-2890; 8330, ITIH4, 40963, 143413, 31-2733; 8331, ITIH5, 40966, 143416, 107-2215; 8331, ITIH5, 40967, 143417, 80-2908; 8331, ITIH5, 40968, 143418, 1-358; 8331, ITIH5, 40969, 143419, 71-2257; 8332, ITIH6, 40970, 143420, 31-3972; 8333, ICAM1, 40972, 143422, 68-1000; 8333, ICAM1, 40973, 143423, 41-581; 8333, ICAM1, 40971, 143421, 326-1924; 8334, ICAM2, 40978, 143428, 148-309; 8334, ICAM2, 40979, 143429, 387-911; 8334, ICAM2, 40980, 143430, 219-718; 8334, ICAM2, 40981, 143431, 70-713; 8334, ICAM2, 40982, 143432, 301-949; 8334, ICAM2, 40983, 143433, 148-903; 8334, ICAM2, 40974, 143424, 274-1101; 8334, ICAM2, 40975, 143425, 242-1069; 8334, ICAM2, 40976, 143426, 356-1183; 8334, ICAM2, 40977, 143427, 212-1039; 8334, ICAM2, 40984, 143434, 125-952; 8335, ICAM3, 40986, 143436, 443-564; 8335, ICAM3, 40987, 143437, 11-190; 8335, ICAM3, 40988, 143438, 1-905; 8335, ICAM3, 40989, 143439, 187-584; 8335, ICAM3, 40990, 143440, 1-579; 8335, ICAM3, 40991, 143441, 513-582; 8335, ICAM3, 40992, 143442, 534-1946; 8335, ICAM3, 40985, 143435, 210-1853; 8336, ICAM4, 40993, 143443, 40-858; 8336, ICAM4, 40994, 143444, 47-862; 8336, ICAM4, 40995, 143445, 10-723; 8337, ICAM5, 40997, 143447, 389-624; 8337, ICAM5, 40996, 143446, 64-2838; 8338, IFNAR1, 40999, 143449, 84-491; 8338, IFNAR1, 40998, 143448, 153-1826; 8339, IFNAR2, 41002, 143452, 114-707; 8339, IFNAR2, 41005, 143455, 1-165; 8339, IFNAR2, 41006, 143456, 115-726; 8339, IFNAR2, 41007, 143457, 155-841; 8339, IFNAR2, 41008, 143458, 155-658; 8339, IFNAR2, 41000, 143450, 165-884; 8339, IFNAR2, 41001, 143451, 327-1874; 8339, IFNAR2, 41003, 143453, 354-1349; 8339, IFNAR2, 41004, 143454, 330-1325; 8340, IFNGR1, 41010, 143460, 123-753; 8340, IFNGR1, 41011, 143461, 264-748; 8340, IFNGR1, 41012, 143462, 44-868; 8340, IFNGR1, 41009, 143459, 123-1592; 8341, IFNGR2, 41014, 143464, 113-1183; 8341, IFNGR2, 41015, 143465, 368-1144; 8341, IFNGR2, 41016, 143466, 1-182; 8341, IFNGR2, 41017, 143467, 118-330; 8341, IFNGR2, 41018, 143468, 104-217; 8341, IFNGR2, 41020, 143470, 1-140; 8341, IFNGR2, 41021, 143471, 1-182; 8341, IFNGR2, 41022, 143472, 1-998; 8341, IFNGR2, 41023, 143473, 1-41; 8341, IFNGR2, 41024, 143474, 1-993; 8341, IFNGR2, 41013, 143463, 649-1662; 8341, IFNGR2, 41019, 143469, 1-941; 8342, IFITM1, 41025, 143475, 340-717; 8342, IFITM1, 41026, 143476, 319-696; 8342, IFITM1, 41027, 143477, 194-571; 8343, IFITM10, 41029, 143479, 139-525; 8343, IFITM10, 41030, 143480, 1-150; 8343, IFITM10, 41028, 143478, 150-836; 8344, IFITM2, 41031, 143481, 1-223; 8344, IFITM2, 41033, 143483, 1-167; 8344, IFITM2, 41034, 143484, 185-523; 8344, IFITM2, 41035, 143485, 37-375; 8344, IFITM2, 41032, 143482, 31-429; 8344, IFITM2, 41036, 143486, 267-665; 8345, IFITM3, 41038, 143488, 140-478; 8345, IFITM3, 41039, 143489, 310-648; 8345, IFITM3, 41040, 143490, 1-167; 8345, IFITM3, 41037, 143487, 238-639; 8346, IFITM5, 41041, 143491, 37-435; 8347, IFIH1, 41042, 143492, 397-3474; 8347, IFIH1, 41043, 143493, 378-1043; 8348, IRF1, 41046, 143496, 188-343; 8348, IRF1, 41047, 143497, 309-885; 8348, IRF1, 41048, 143498, 239-832; 8348, IRF1, 41049, 143499, 168-523; 8348, IRF1, 41050, 143500, 117-722; 8348, IRF1, 41044, 143494, 260-1237; 8348, IRF1, 41045, 143495, 219-1196; 8349, IRF2, 41052, 143502, 1-586; 8349, IRF2, 41053, 143503, 88-498; 8349, IRF2, 41054, 143504, 1-339; 8349, IRF2, 41055, 143505, 87-568; 8349, IRF2, 41056, 143506, 65-316; 8349, IRF2, 41057, 143507, 67-595; 8349, IRF2, 41051, 143501, 209-1258; 8350, IRF2BP1, 41058, 143508, 397-2151; 8351, IRF2BP2, 41059, 143509, 32-1795; 8351, IRF2BP2, 41060, 143510, 32-1747; 8352, IRF2BPL, 41061, 143511, 908-3298; 8353, IRF3, 41063, 143513, 519-1364; 8353, IRF3, 41066, 143516, 399-806; 8353, IRF3, 41067, 143517, 381-739; 8353, IRF3, 41069, 143519, 203-1048; 8353, IRF3, 41070, 143520, 197-768; 8353, IRF3, 41071, 143521, 394-1620; 8353, IRF3, 41072, 143522, 1020-2009; 8353, IRF3, 41074, 143524, 394-700; 8353, IRF3, 41076, 143526, 428-680; 8353, IRF3, 41077, 143527, 608-924; 8353, IRF3, 41079, 143529, 258-1118; 8353, IRF3, 41080, 143530, 607-1452; 8353, IRF3, 41081, 143531, 580-1425; 8353, IRF3, 41083, 143533, 139-931; 8353, IRF3, 41084, 143534, 173-633; 8353, IRF3, 41085, 143535, 1-215; 8353, IRF3, 41062, 143512, 332-1615; 8353, IRF3, 41064, 143514, 254-1537; 8353, IRF3, 41065, 143515, 1-315; 8353, IRF3, 41068, 143518, 383-1666; 8353, IRF3, 41073, 143523, 177-641; 8353, IRF3, 41075, 143525, 84-986; 8353, IRF3, 41078, 143528, 181-1539; 8353, IRF3, 41082, 143532, 349-813; 8354, IRF4, 41087, 143537, 98-1330; 8354, IRF4, 41086, 143536, 127-1482; 8355, IRF5, 41091, 143541, 383-560; 8355, IRF5, 41092, 143542, 213-637; 8355, IRF5, 41093, 143543, 235-689; 8355, IRF5, 41095, 143545, 236-553; 8355, IRF5, 41098, 143548, 71-385; 8355, IRF5, 41099, 143549, 122-595; 8355, IRF5, 41088, 143538, 41-1537; 8355, IRF5, 41089, 143539, 122-1666; 8355, IRF5, 41090, 143540, 73-1569; 8355, IRF5, 41094, 143544, 50-493; 8355, IRF5, 41096, 143546, 216-1712; 8355, IRF5, 41097, 143547, 122-1360; 8355, IRF5, 41100, 143550, 50-493; 8356, IRF6, 41102, 143552, 199-1027; 8356, IRF6, 41101, 143551, 174-1577; 8356, IRF6, 41103, 143553, 341-1459; 8357, IRF7, 41107, 143557, 411-1874; 8357,

IRF7, 41109, 143559, 397-930; 8357, IRF7, 41111, 143561, 303-1496; 8357, IRF7, 41112, 143562, 310-717; 8357, IRF7, 41114, 143564, 355-912; 8357, IRF7, 41115, 143565, 411-1874; 8357, IRF7, 41118, 143568, 355-912; 8357, IRF7, 41120, 143570, 303-1496; 8357, IRF7, 41104, 143554, 388-1938; 8357, IRF7, 41105, 143555, 287-1711; 8357, IRF7, 41106, 143556, 411-1961; 8357, IRF7, 41108, 143558, 371-1882; 8357, IRF7, 41110, 143560, 322-816; 8357, IRF7, 41113, 143563, 287-781; 8357, IRF7, 41116, 143566, 411-1961; 8357, IRF7, 41117, 143567, 371-1882; 8357, IRF7, 41119, 143569, 388-1938; 8357, IRF7, 41121, 143571, 287-781; 8357, IRF7, 41122, 143572, 322-816; 8357, IRF7, 41123, 143573, 287-1711; 8358, IRF8, 41125, 143575, 1-458; 8358, IRF8, 41126, 143576, 189-857; 8358, IRF8, 41127, 143577, 247-289; 8358, IRF8, 41128, 143578, 55-531; 8358, IRF8, 41129, 143579, 382-522; 8358, IRF8, 41130, 143580, 220-880; 8358, IRF8, 41131, 143581, 54-1038; 8358, IRF8, 41132, 143582, 328-708; 8358, IRF8, 41124, 143574, 423-1703; 8359, IRF9, 41133, 143583, 1-630; 8359, IRF9, 41135, 143585, 193-1254; 8359, IRF9, 41136, 143586, 48-583; 8359, IRF9, 41137, 143587, 64-216; 8359, IRF9, 41138, 143588, 24-176; 8359, IRF9, 41139, 143589, 40-841; 8359, IRF9, 41134, 143584, 288-1469; 8360, ISG20, 41141, 143591, 161-424; 8360, ISG20, 41143, 143593, 149-614; 8360, ISG20, 41140, 143590, 359-904; 8360, ISG20, 41142, 143592, 165-710; 8361, ISG20L2, 41144, 143594, 784-1845; 8361, ISG20L2, 41145, 143595, 503-1564; 8362, IFNA1, 41147, 143597, 9-578; 8362, IFNA1, 41146, 143596, 55-624; 8363, IFNA10, 41148, 143598, 47-616; 8364, IFNA13, 41150, 143600, 953-1525; 8364, IFNA13, 41149, 143599, 51-620; 8365, IFNA14, 41151, 143601, 57-626; 8366, IFNA16, 41152, 143602, 7-576; 8367, IFNA17, 41153, 143603, 50-619; 8368, IFNA2, 41154, 143604, 60-626; 8369, IFNA21, 41155, 143605, 49-618; 8370, IFNA4, 41157, 143607, 1-567; 8370, IFNA4, 41156, 143606, 141-710; 8371, IFNA5, 41158, 143608, 57-626; 8372, IFNA6, 41159, 143609, 67-639; 8372, IFNA6, 41160, 143610, 492-1061; 8373, IFNA7, 41161, 143611, 41-610; 8374, IFNA8, 41162, 143612, 31-600; 8375, IFI27, 41163, 143613, 155-275; 8375, IFI27, 41164, 143614, 177-545; 8375, IFI27, 41165, 143615, 76-364; 8375, IFI27, 41166, 143616, 498-692; 8375, IFI27, 41167, 143617, 103-342; 8375, IFI27, 41168, 143618, 189-548; 8375, IFI27, 41169, 143619, 1-331; 8375, IFI27, 41170, 143620, 103-342; 8375, IFI27, 41171, 143621, 48-227; 8375, IFI27, 41172, 143622, 189-557; 8375, IFI27, 41173, 143623, 108-476; 8375, IFI27, 41174, 143624, 155-523; 8375, IFI27, 41175, 143625, 95-433; 8375, IFI27, 41176, 143626, 108-476; 8375, IFI27, 41177, 143627, 189-548; 8375, IFI27, 41178, 143628, 498-692; 8375, IFI27, 41179, 143629, 95-433; 8375, IFI27, 41180, 143630, 189-557; 8375, IFI27, 41181, 143631, 48-227; 8375, IFI27, 41182, 143632, 1-331; 8376, IFI27L1, 41184, 143634, 120-272; 8376, IFI27L1, 41185, 143635, 32-310; 8376, IFI27L1, 41186, 143636, 126-443; 8376, IFI27L1, 41187, 143637, 336-611; 8376, IFI27L1, 41188, 143638, 345-629; 8376, IFI27L1, 41189, 143639, 146-265; 8376, IFI27L1, 41191, 143641, 287-439; 8376, IFI27L1, 41192, 143642, 336-615; 8376, IFI27L1, 41194, 143644, 336-611; 8376, IFI27L1, 41196, 143646, 120-272; 8376, IFI27L1, 41197, 143647, 146-265; 8376, IFI27L1, 41198, 143648, 287-439; 8376, IFI27L1, 41199, 143649, 345-629; 8376, IFI27L1, 41200, 143650, 32-310; 8376, IFI27L1, 41201, 143651, 336-615; 8376, IFI27L1, 41202, 143652, 126-443; 8376, IFI27L1, 41183, 143633, 219-533; 8376, IFI27L1, 41190, 143640, 220-534; 8376, IFI27L1, 41193, 143643, 219-533; 8376, IFI27L1, 41195, 143645, 220-534; 8377, IFI27L2, 41204, 143654, 229-546; 8377, IFI27L2, 41206, 143656, 229-546; 8377, IFI27L2, 41203, 143653, 101-493; 8377, IFI27L2, 41205, 143655, 101-493; 8378, IFI6, 41207, 143657, 89-505; 8378, IFI6, 41208, 143658, 129-521; 8378, IFI6, 41209, 143659, 109-513; 8379, IFNB1, 41210, 143660, 95-658; 8380, IFNE, 41211, 143661, 620-1246; 8381, IFNG, 41212, 143662, 133-633; 8382, IFI16, 41214, 143664, 1749-2480; 8382, IFI16, 41219, 143669, 260-761; 8382, IFI16, 41220, 143670, 411-951; 8382, IFI16, 41221, 143671, 324-546; 8382, IFI16, 41222, 143672, 409-1095; 8382, IFI16, 41223, 143673, 608-856; 8382, IFI16, 41213, 143663, 256-2613; 8382, IFI16, 41215, 143665, 173-2362; 8382, IFI16, 41216, 143666, 291-2480; 8382, IFI16, 41217, 143667, 265-2454; 8382, IFI16, 41218, 143668, 1-2022; 8383, IFI30, 41225, 143675, 97-411; 8383, IFI30, 41224, 143674, 176-928; 8384, IFNK, 41226, 143676, 24-647; 8385, IFNL1, 41227, 143677, 98-700; 8386, IFNL2, 41228, 143678, 56-658; 8387, IFNL3, 41230, 143680, 53-655; 8387, IFNL3, 41229, 143679, 40-630; 8388, IFNL4, 41231, 143681, 278-818; 8388, IFNL4, 41232, 143682, 278-709; 8388, IFNL4, 41233, 143683, 278-817; 8388, IFNL4, 41234, 143684, 278-602; 8388, IFNL4, 41235, 143685, 278-674; 8389, IFNLR1, 41239, 143689, 350-907; 8389, IFNLR1, 41236, 143686, 14-1576; 8389, IFNLR1, 41237, 143687, 14-748; 8389, IFNLR1, 41238, 143688, 1-636; 8389, IFNLR1, 41240, 143690, 1-1476; 8390, IFNW1, 41241, 143691, 576-1163; 8391, IFI35, 41242, 143692, 224-1084; 8391, IFI35, 41243, 143693, 209-1075; 8392, IFI44, 41245, 143695, 102-686; 8392, IFI44, 41246, 143696, 1-230; 8392, IFI44, 41244, 143694, 86-1420; 8393, IFI44L, 41248, 143698, 1-699; 8393, IFI44L, 41249, 143699, 263-554; 8393, IFI44L, 41247, 143697, 180-1538; 8394, IFIT1, 41250, 143700, 168-1604; 8394, IFIT1, 41251, 143701, 496-1839; 8395, IFIT1B, 41252, 143702, 81-1505; 8396, IFIT2, 41254, 143704, 79-1530; 8396, IFIT2, 41253, 143703, 170-1588; 8397, IFIT3, 41255, 143705, 140-1612; 8397, IFIT3, 41256, 143706, 181-1653; 8398, IFIT5, 41257, 143707, 214-1662; 8399, IFRD1, 41260, 143710, 483-574; 8399, IFRD1, 41261, 143711, 232-678; 8399, IFRD1, 41262, 143712, 320-440; 8399, IFRD1, 41263, 143713, 511-891; 8399, IFRD1, 41264, 143714, 384-570; 8399, IFRD1, 41265, 143715, 763-1034; 8399, IFRD1, 41266, 143716, 377-429; 8399, IFRD1, 41267, 143717, 1-297; 8399, IFRD1, 41268, 143718, 176-486; 8399, IFRD1, 41258, 143708, 471-1826; 8399, IFRD1, 41259, 143709, 262-1617; 8399, IFRD1, 41269, 143719, 511-1716; 8399, IFRD1, 41270, 143720, 346-1551; 8400, IFRD2, 41271, 143721, 499-1827; 8400, IFRD2, 41273, 143723, 1-216; 8400, IFRD2, 41274, 143724, 116-340; 8400, IFRD2, 41275, 143725, 1-513; 8400, IFRD2, 41272, 143722, 130-1650; 8401, IL1F10, 41276, 143726, 76-534; 8401, IL1F10, 41277, 143727, 422-880; 8402, IL1RAP, 41282, 143732, 196-534; 8402, IL1RAP, 41284, 143734, 192-839; 8402, IL1RAP, 41288, 143738, 89-523; 8402, IL1RAP, 41290, 143740, 1-581; 8402, IL1RAP, 41278, 143728, 171-1883; 8402, IL1RAP, 41279, 143729, 207-2270; 8402, IL1RAP, 41280, 143730, 120-1160; 8402, IL1RAP, 41281, 143731, 120-1190; 8402, IL1RAP, 41283, 143733, 250-1962; 8402, IL1RAP, 41285, 143735, 414-2126; 8402, IL1RAP, 41286, 143736, 108-2171; 8402, IL1RAP, 41287, 143737, 211-1281; 8402, IL1RAP, 41289, 143739, 350-2062; 8402, IL1RAP, 41291, 143741, 207-1247; 8403, IL1RAPL1, 41292, 143742, 1-1314; 8403, IL1RAPL1, 41293, 143743, 674-2764; 8404, IL1RAPL2, 41294, 143744, 1-1290; 8404, IL1RAPL2, 41295, 143745, 757-2817; 8405, URN, 41296, 143746, 123-665; 8405, URN, 41297, 143747, 123-602; 8405, URN, 41298, 143748, 346-777; 8405, URN, 41299, 143749, 65-598; 8405, IL1RN, 41300, 143750, 472-903; 8406, IL1R1, 41302, 143752, 319-1662; 8406, IL1R1, 41303, 143753, 394-915; 8406, IL1R1, 41304, 143754, 242-1858; 8406, IL1R1, 41305, 143755, 388-1731; 8406, IL1R1, 41306, 143756, 1-374; 8406, IL1R1, 41307, 143757, 234-577; 8406, IL1R1, 41308, 143758, 369-609; 8406, IL1R1, 41309, 143759, 76-435; 8406, IL1R1, 41310, 143760, 163-709; 8406, IL1R1, 41311, 143761, 630-1525; 8406, IL1R1, 41312, 143762, 232-549; 8406, IL1R1, 41313, 143763, 242-1585; 8406, IL1R1, 41301, 143751, 319-2028; 8407, IL1R2, 41316, 143766, 105-792; 8407, IL1R2, 41314, 143764, 230-1426; 8407, IL1R2, 41315, 143765, 184-1380; 8407, IL1R2, 41317, 143767, 62-952; 8408, IL1RL1, 41321, 143771, 230-1174; 8408, IL1RL1, 41323, 143773, 430-545; 8408, IL1RL1, 41318, 143768, 272-1942; 8408, IL1RL1, 41319, 143769, 340-1326; 8408, IL1RL1, 41320, 143770, 269-904; 8408, IL1RL1, 41322, 143772, 200-979; 8409, IL1RL2, 41325, 143775, 42-557; 8409, IL1RL2, 41324, 143774, 127-1854; 8409, IL1RL2, 41326, 143776, 1-1374; 8410, IL1A, 41327, 143777, 157-972; 8411, IL1B, 41329, 143779, 248-580; 8411, IL1B, 41330, 143780, 153-581; 8411, IL1B, 41331, 143781, 206-581; 8411, IL1B, 41328, 143778, 212-1021; 8412, IL10, 41332, 143782, 60-596; 8413, IL10RA, 41334, 143784, 75-359; 8413, IL10RA, 41335, 143785, 75-341; 8413, IL10RA, 41333, 143783, 121-1857; 8414, IL10RB, 41337, 143787, 1-651; 8414, IL10RB, 41338, 143788, 85-300; 8414, IL10RB, 41336, 143786, 109-1086; 8415, IL11, 41342, 143792, 531-650; 8415, IL11, 41339, 143789, 64-663; 8415, IL11, 41340, 143790, 218-580; 8415, IL11, 41341, 143791, 154-753; 8416, IL11RA, 41345, 143795, 1-233; 8416, IL11RA, 41346, 143796, 157-575; 8416, IL11RA, 41348, 143798, 135-944; 8416, IL11RA, 41349, 143799, 73-237; 8416, IL11RA, 41350, 143800, 37-537; 8416, IL11RA, 41351, 143801, 55-261; 8416, IL11RA, 41352, 143802, 35-491; 8416, IL11RA, 41343, 143793, 66-1334; 8416, IL11RA, 41344, 143794, 43-1311; 8416, IL11RA, 41347, 143797, 1357-2625; 8416, IL11RA, 41353, 143803, 1-1173; 8417, IL12RB1, 41355, 143805, 174-528; 8417, IL12RB1, 41356, 143806, 394-595; 8417, IL12RB1, 41359, 143809, 403-557; 8417, IL12RB1, 41354, 143804, 110-1255; 8417, IL12RB1, 41357, 143807, 300-2288; 8417, IL12RB1, 41358, 143808, 181-2169; 8418, IL12RB2, 41362, 143812, 1-687; 8418, IL12RB2, 41364, 143814, 641-2548; 8418, IL12RB2, 41360, 143810, 641-3229; 8418, IL12RB2, 41361, 143811, 220-2199; 8418, IL12RB2, 41363, 143813, 641-2971; 8419, IL12A, 41366, 143816, 104-823; 8419, IL12A, 41367, 143817, 104-751; 8419, IL12A, 41365, 143815, 308-1069; 8420, IL12B, 41368, 143818, 457-1443; 8421, IL13, 41370, 143820, 57-491; 8421, IL13, 41369, 143819, 15-455; 8422, IL13RA1, 41371, 143821, 38-877; 8422, IL13RA1, 41372, 143822, 68-1351; 8423, IL13RA2, 41373, 143823, 126-1268; 8423, IL13RA2, 41374, 143824, 251-1393; 8424, IL15, 41375, 143825, 845-1333; 8424, IL15, 41376, 143826, 372-860; 8424, IL15, 41377, 143827, 1-408; 8424, IL15, 41378, 143828, 647-1054; 8424, IL15, 41379, 143829, 592-1080; 8424, IL15, 41380, 143830, 5009-5416; 8425, IL15RA, 41383, 143833, 343-858; 8425, IL15RA, 41384, 143834, 15-1076; 8425, IL15RA, 41386, 143836, 120-1046; 8425, IL15RA, 41388, 143838, 1-596; 8425, IL15RA, 41389, 143839, 31-547; 8425, IL15RA, 41390, 143840, 287-730; 8425, IL15RA, 41391, 143841, 1-467; 8425, IL15RA, 41393, 143843, 1-629; 8425, IL15RA, 41396, 143846, 120-1037; 8425, IL15RA, 41397, 143847, 120-1115; 8425, IL15RA, 41398, 143848, 120-1070; 8425, IL15RA, 41399, 143849, 120-1160; 8425, IL15RA, 41381, 143831, 16-480; 8425, IL15RA, 41382, 143832, 99-902; 8425, IL15RA, 41385, 143835, 31-540; 8425, IL15RA, 41387, 143837, 1-759; 8425, IL15RA, 41392, 143842, 432-1127; 8425, IL15RA, 41394, 143844, 31-735; 8425, IL15RA, 41395, 143845, 1-660; 8426, IL16, 41403, 143853, 399-1763; 8426, IL16, 41404, 143854, 1-135; 8426, IL16, 41405, 143855, 1-1835; 8426, IL16, 41406, 143856, 377-2158; 8426, IL16, 41407, 143857, 1-604; 8426, IL16, 41408, 143858, 190-1644; 8426, IL16, 41400, 143850, 1-3999; 8426, IL16, 41401, 143851, 217-2112; 8426, IL16, 41402, 143852, 361-4356; 8426, IL16, 41409, 143859, 15-1697; 8427, IL17RA, 41410, 143860, 134-2734; 8427, IL17RA, 41411, 143861, 134-2632; 8428, IL17RB, 41413, 143863, 5-1048; 8428, IL17RB, 41412, 143862, 10-1518; 8429, IL17RC, 41417, 143867, 219-494; 8429, IL17RC, 41418, 143868, 183-653; 8429, IL17RC, 41419, 143869, 219-515; 8429, IL17RC, 41420, 143870, 243-2315; 8429, IL17RC, 41422, 143872, 219-947; 8429, IL17RC, 41423, 143873, 198-1445; 8429, IL17RC, 41425, 143875, 219-590; 8429, IL17RC, 41426, 143876, 192-404; 8429, IL17RC, 41427, 143877, 162-461; 8429, IL17RC, 41428, 143878, 219-1208; 8429, IL17RC, 41429, 143879, 192-326; 8429, IL17RC, 41414, 143864, 219-2594; 8429, IL17RC, 41415, 143865, 243-2360; 8429, IL17RC, 41416, 143866, 198-2360; 8429, IL17RC, 41421, 143871, 1-2124; 8429, IL17RC, 41424, 143874, 154-2220; 8430, IL17RD, 41433, 143883, 370-589; 8430, IL17RD, 41430, 143880, 90-2309; 8430, IL17RD, 41431, 143881, 544-2331; 8430, IL17RD, 41432, 143882, 346-2133; 8431, IL17RE, 41435, 143885, 84-644; 8431, IL17RE, 41437, 143887, 52-571; 8431, IL17RE, 41438, 143888, 19-2121; 8431, IL17RE, 41439, 143889, 86-658; 8431, IL17RE, 41440, 143890, 86-526; 8431, IL17RE, 41434, 143884, 106-2109; 8431, IL17RE, 41436, 143886, 86-1687; 8432, IL17REL, 41441, 143891, 98-1108; 8432, IL17REL, 41442, 143892, 266-1276; 8433, IL17A, 41443, 143893, 46-513; 8434, IL17B, 41444, 143894, 52-594; 8435, IL17C, 41445, 143895, 50-643; 8436, IL17D, 41447, 143897, 1180-1285; 8436, IL17D, 41448, 143898, 1-271; 8436, IL17D, 41446, 143896, 109-717; 8437, IL17F, 41449, 143899, 109-600; 8438, IL18, 41450, 143900, 221-802; 8438, IL18, 41451, 143901, 214-795; 8438, IL18, 41452, 143902, 178-747; 8439, IL18BP, 41461, 143911, 1373-1972; 8439, IL18BP, 41462, 143912, 154-753; 8439, IL18BP, 41453, 143903, 105-689; 8439, IL18BP, 41454, 143904, 356-940; 8439, IL18BP, 41455, 143905, 150-641; 8439, IL18BP, 41456, 143906, 538-1122; 8439, IL18BP, 41457, 143907, 299-883; 8439, IL18BP, 41458, 143908, 59-406; 8439, IL18BP, 41459, 143909, 923-1507; 8439, IL18BP, 41460, 143910, 385-969; 8439, IL18BP, 41463, 143913, 167-658; 8440, IL18R1, 41465, 143915, 25-537; 8440, IL18R1, 41464, 143914, 147-1772; 8440, IL18R1, 41466, 143916, 124-1749; 8440, IL18R1, 41467, 143917, 357-1982; 8441, IL18RAP, 41470, 143920, 454-587; 8441, IL18RAP, 41468, 143918, 590-2389; 8441, IL18RAP, 41469, 143919, 314-1687; 8442, IL19, 41471, 143921, 940-1473; 8442, IL19, 41472, 143922, 26-673; 8442, IL19, 41473, 143923, 696-1229; 8443, IL2, 41474, 143924, 286-747; 8444, IL2RA, 41475, 143925, 140-931; 8444, IL2RA, 41476, 143926, 159-761; 8444, IL2RA, 41478, 143928, 1-326; 8444, IL2RA, 41477, 143927, 175-993; 8445, IL2RB, 41480, 143930, 1-318; 8445, IL2RB, 41481, 143931, 322-587; 8445, IL2RB, 41482, 143932, 131-569; 8445, IL2RB, 41483, 143933, 95-660; 8445, IL2RB, 41479, 143929, 200-1855; 8446, IL2RG, 41484, 143934, 809-1105; 8446, IL2RG, 41487, 143937, 1-196; 8446, IL2RG, 41488, 143938, 107-404; 8446, IL2RG, 41489, 143939, 432-959; 8446, IL2RG, 41490, 143940, 125-783; 8446, IL2RG, 41485, 143935, 93-1202; 8446, IL2RG, 41486, 143936, 1-540; 8447, IL20, 41491, 143941, 45-575; 8447, IL20, 41492, 143942, 364-894; 8447, IL20, 41493, 143943, 45-500; 8448, IL20RB, 41495, 143945, 29-196; 8448, IL20RB, 41496, 143946, 106-255; 8448, IL20RB, 41497, 143947, 1-363; 8448, IL20RB, 41494, 143944, 250-1185; 8449, IL20RA, 41499, 143949, 237-866; 8449, IL20RA, 41502, 143952, 237-365; 8449, IL20RA, 41503, 143953, 391-921; 8449, IL20RA, 41504, 143954, 254-521; 8449, IL20RA, 41498, 143948, 237-1898; 8449, IL20RA, 41500, 143950, 607-1935; 8449, IL20RA, 41501, 143951, 281-1795; 8450, IL21, 41505, 143955, 59-547; 8450, IL21, 41506, 143956, 47-508; 8451, IL21R, 41507, 143957, 474-2090; 8451, IL21R, 41508, 143958, 135-1751; 8451, IL21R, 41509, 143959, 603-2219; 8452, IL22, 41510, 143960, 57-596; 8452, IL22, 41511, 143961, 72-611; 8453, IL22RA1, 41512, 143962, 40-1764; 8454, IL22RA2, 41513, 143963, 302-997; 8454, IL22RA2, 41514, 143964, 302-1093; 8454, IL22RA2, 41515, 143965, 302-694; 8455, IL23R, 41519, 143969, 29-244; 8455, IL23R, 41516, 143966, 172-2061; 8455, IL23R, 41517, 143967, 233-916; 8455, IL23R, 41518, 143968, 51-1175; 8456, IL23A, 41520, 143970, 171-740; 8457, IL24, 41523, 143973, 275-430; 8457, IL24, 41525, 143975, 1-182; 8457, IL24, 41521, 143971, 275-895; 8457, IL24, 41522, 143972, 275-739; 8457, IL24, 41524, 143974, 276-899; 8457, IL24, 41526, 143976, 276-467; 8458, IL25, 41527, 143977, 259-792; 8458, IL25, 41528, 143978, 159-644; 8459, IL26, 41529, 143979, 66-581; 8460, IL27, 41531, 143981, 587-657; 8460, IL27, 41530, 143980, 24-755; 8461, IL27RA, 41532, 143982, 126-2036; 8462, IL3, 41533, 143983, 179-637; 8463, IL3RA, 41536, 143986, 170-662; 8463, IL3RA, 41534, 143984, 350-1486; 8463, IL3RA, 41535, 143985, 350-1252; 8464, IL31, 41537, 143987, 28-522; 8465, IL31RA, 41545, 143995, 34-1008; 8465, IL31RA, 41538, 143988, 241-2478; 8465, IL31RA, 41539, 143989, 249-2237; 8465, IL31RA, 41540, 143990, 66-2111; 8465, IL31RA, 41541, 143991, 497-2485; 8465, IL31RA, 41542, 143992, 193-1941; 8465, IL31RA, 41543, 143993, 66-2360; 8465, IL31RA, 41544, 143994, 546-2414; 8466, IL32, 41553, 144003, 173-566; 8466, IL32, 41560, 144010, 99-764; 8466, IL32, 41562, 144012, 166-672; 8466, IL32, 41566, 144016, 55-693; 8466, IL32, 41570, 144020, 135-810; 8466, IL32, 41572, 144022, 101-778; 8466, IL32, 41575, 144025, 215-721; 8466, IL32, 41546, 143996, 86-592; 8466, IL32, 41547, 143997, 227-793; 8466, IL32, 41548, 143998, 29-568; 8466, IL32, 41549, 143999, 202-597; 8466, IL32, 41550, 144000, 78-782; 8466, IL32, 41551, 144001, 158-724; 8466, IL32, 41552, 144002, 130-696; 8466, IL32, 41554, 144004, 212-916; 8466, IL32, 41555, 144005, 333-899; 8466, IL32, 41556, 144006, 187-753; 8466, IL32, 41557, 144007, 71-637; 8466, IL32, 41558, 144008, 189-725; 8466, IL32, 41559, 144009, 75-581; 8466, IL32, 41561, 144011, 67-633; 8466, IL32, 41563, 144013, 193-759; 8466, IL32, 41564, 144014, 77-616; 8466, IL32, 41565, 144015, 63-569; 8466, IL32, 41567, 144017, 147-542; 8466, IL32, 41568, 144018, 63-458; 8466, IL32, 41569, 144019, 1-447; 8466, IL32, 41571, 144021, 80-646; 8466, IL32, 41573, 144023, 151-855; 8466, IL32, 41574, 144024, 444-1010; 8467, IL33, 41576, 144026, 14-826; 8467, IL33, 41577, 144027, 79-513; 8467, IL33, 41578, 144028, 1-687; 8467, IL33, 41579, 144029, 16-702; 8468, IL34, 41582, 144032, 542-703; 8468, IL34, 41583, 144033, 266-919; 8468, IL34, 41580, 144030, 384-1112; 8468, IL34, 41581, 144031, 556-1284; 8469, IL36RN, 41586, 144036, 53-403; 8469, IL36RN, 41587, 144037, 1-158; 8469, IL36RN, 41584, 144034, 134-601; 8469, IL36RN, 41585, 144035, 162-629; 8470, IL36A, 41588, 144038, 412-888; 8471, IL36B, 41589, 144039, 109-603; 8471, IL36B, 41590, 144040, 109-582; 8472, IL36G, 41593, 144043, 255-369; 8472, IL36G, 41591, 144041, 70-579; 8472, IL36G, 41592, 144042, 80-484; 8473, IL37, 41594, 144044, 43-699; 8473, IL37, 41595, 144045, 43-636; 8473, IL37, 41596, 144046, 43-516; 8473, IL37, 41597, 144047, 43-579; 8473, IL37, 41598, 144048, 1-579; 8474, IL4, 41601, 144051, 66-476; 8474, IL4, 41599, 144049, 66-527; 8474, IL4, 41600, 144050, 1-414; 8475, IL411, 41604, 144054, 441-689; 8475, IL411, 41605, 144055, 439-651; 8475, IL411, 41606, 144056, 57-506; 8475, IL411, 41607, 144057, 430-747; 8475, IL411, 41609, 144059, 618-714; 8475, IL411, 41602, 144052, 564-2333; 8475, IL411, 41603, 144053, 144-1847; 8475, IL411, 41608, 144058, 622-2391; 8476, IL4R, 41613, 144063, 247-447; 8476, IL4R, 41614, 144064, 349-379; 8476, IL4R, 41615, 144065, 169-529; 8476, IL4R, 41616, 144066, 106-306; 8476, IL4R, 41617, 144067, 102-476; 8476, IL4R, 41618, 144068, 1-148; 8476, IL4R, 41619, 144069, 181-541; 8476, IL4R, 41620, 144070, 328-518; 8476, IL4R, 41621, 144071, 1-402; 8476, IL4R, 41622, 144072, 1-579; 8476, IL4R, 41623, 144073, 1-201; 8476, IL4R, 41610, 144060, 1-2433; 8476, IL4R, 41611, 144061, 260-2737; 8476, IL4R, 41612, 144062, 114-2591; 8477, IL5, 41625, 144075, 124-276; 8477, IL5, 41624, 144074, 45-449; 8478, IL5RA, 41629, 144079, 645-1622; 8478, IL5RA, 41631, 144081, 513-839; 8478, IL5RA, 41633, 144083, 200-788; 8478, IL5RA, 41626, 144076, 251-1513; 8478, IL5RA, 41627, 144077, 251-1258; 8478, IL5RA, 41628, 144078, 549-1556; 8478, IL5RA, 41630, 144080, 576-1712; 8478, IL5RA, 41632, 144082, 185-1186; 8478, IL5RA, 41634, 144084, 251-1252; 8478, IL5RA, 41635, 144085, 576-1838; 8479, IL6, 41637, 144087, 40-609; 8479, IL6, 41638, 144088, 87-497; 8479, IL6, 41639, 144089, 24-620; 8479, IL6, 41641, 144091, 154-522; 8479, IL6, 41642, 144092, 117-574; 8479, IL6, 41636, 144086, 117-755; 8479, IL6, 41640, 144090, 460-1098; 8480, IL6R, 41645, 144095, 1-570; 8480, IL6R, 41646, 144096, 16-527; 8480, IL6R, 41647, 144097, 1-881; 8480, IL6R, 41648, 144098, 438-1496; 8480, IL6R, 41643, 144093, 408-1505; 8480, IL6R, 41644, 144094, 438-1844; 8481, IL6ST, 41650, 144100, 1-201; 8481, IL6ST, 41652, 144102, 1-612; 8481, IL6ST, 41655, 144105, 113-1114; 8481, IL6ST, 41658, 144108, 1-168; 8481, IL6ST, 41649, 144099, 37-2793; 8481, IL6ST, 41651, 144101, 37-1026; 8481, IL6ST, 41653, 144103, 1-2574; 8481, IL6ST, 41654, 144104, 314-3070; 8481, IL6ST, 41656, 144106, 93-1082; 8481, IL6ST, 41657, 144107, 197-2953; 8482, IL7, 41660, 144110, 602-949; 8482, IL7, 41662, 144112, 530-643; 8482, IL7, 41663, 144113, 7-120; 8482, IL7, 41664, 144114, 543-758; 8482, IL7, 41665, 144115, 602-1081; 8482, IL7, 41659, 144109, 602-1135; 8482, IL7, 41661, 144111, 7-408; 8483, IL7R, 41667, 144117, 88-873; 8483, IL7R, 41668, 144118, 87-539; 8483, IL7R, 41669, 144119, 395-551; 8483, IL7R, 41670, 144120, 1-198; 8483, IL7R, 41671, 144121, 384-562; 8483, IL7R, 41672, 144122, 90-632; 8483, IL7R, 41666, 144116, 130-1509; 8484, IL9, 41673, 144123, 12-446; 8485, IL9R, 41674, 144124, 180-1745; 8485, IL9R, 41675, 144125, 39-1067; 8486, ILF2, 41677, 144127, 61-513; 8486, ILF2, 41678, 144128, 131-476; 8486, ILF2, 41679, 144129, 240-1298; 8486, ILF2, 41676, 144126, 127-1299; 8487, ILF3, 41683, 144133, 166-533; 8487, ILF3, 41686, 144136, 191-953; 8487, ILF3, 41687, 144137, 1-476; 8487, ILF3, 41688, 144138, 1-351; 8487, ILF3, 41689, 144139, 301-599; 8487, ILF3, 41690, 144140, 1-340; 8487, ILF3, 41691, 144141, 95-334; 8487, ILF3, 41692, 144142, 1-222; 8487, ILF3, 41693, 144143, 1-168; 8487, ILF3, 41694, 144144, 1-541; 8487, ILF3, 41695, 144145, 91-330; 8487, ILF3, 41696, 144146, 355-839; 8487, ILF3, 41699, 144149, 181-413; 8487, ILF3, 41680, 144130, 70-2142; 8487, ILF3, 41681, 144131, 251-2371; 8487, ILF3, 41682, 144132, 318-3014; 8487, ILF3, 41684, 144134, 218-2326; 8487, ILF3, 41685, 144135, 1-2097; 8487, ILF3, 41697, 144147, 1-2685; 8487, ILF3, 41698, 144148, 1-2697; 8488, IRAK1, 41700, 144150, 86-1105; 8488, IRAK1, 41704, 144154, 1-2127; 8488, IRAK1, 41705, 144155, 1-705; 8488, IRAK1, 41706, 144156, 1-1175; 8488, IRAK1, 41707, 144157, 1-830; 8488, IRAK1, 41708, 144158, 1-655; 8488, IRAK1, 41709, 144159, 1-639; 8488, IRAK1, 41701, 144151, 65-1966; 8488, IRAK1, 41702, 144152, 169-2307; 8488, IRAK1, 41703, 144153, 1-2049; 8489, IRAK1BP1, 41711, 144161, 1-134; 8489, IRAK1BP1, 41712, 144162, 792-1370; 8489, IRAK1BP1, 41713, 144163, 1-534; 8489, IRAK1BP1, 41710, 144160, 106-888; 8490, IRAK2, 41714, 144164, 91-1968; 8491, IRAK3, 41717, 144167, 106-387; 8491, IRAK3, 41715, 144165, 422-2212; 8491, IRAK3, 41716, 144166, 44-1651; 8492, IRAK4, 41719, 144169, 1-657; 8492, IRAK4, 41722, 144172, 280-547; 8492, IRAK4, 41723, 144173, 108-290; 8492, IRAK4, 41724, 144174, 66-230; 8492, IRAK4, 41725, 144175, 77-259; 8492, IRAK4, 41726, 144176, 700-882; 8492, IRAK4, 41727, 144177, 114-278; 8492, IRAK4, 41728, 144178, 175-357; 8492, IRAK4, 41718, 144168, 309-1319; 8492, IRAK4, 41720, 144170, 139-1149; 8492, IRAK4, 41721, 144171, 114-1496; 8492, IRAK4, 41729, 144179, 72-1454; 8493, IFFO1, 41733, 144183, 561-1331; 8493, IFFO1, 41735, 144185, 561-1328; 8493, IFFO1, 41736, 144186, 55-1770; 8493, IFFO1, 41737, 144187, 1062-1832; 8493, IFFO1, 41730, 144180, 43-1731; 8493, IFFO1, 41731, 144181, 45-1736; 8493, IFFO1, 41732, 144182, 43-1722; 8493, IFFO1, 41734, 144184, 43-837; 8494, IFFO2, 41738, 144188, 1-267; 8494, IFFO2, 41740, 144190, 1-779; 8494, IFFO2, 41739, 144189, 355-1908; 8495, INA, 41742, 144192, 46-1536; 8495, INA, 41741, 144191, 50-1549; 8496, IMPG1, 41744, 144194, 1-477; 8496, IMPG1, 41745, 144195, 446-868; 8496, IMPG1, 41746, 144196, 191-2350; 8496, IMPG1, 41743, 144193, 191-2584; 8497, IMPG2, 41747, 144197, 189-3914; 8498, ITSN1, 41748, 144198, 39-752; 8498, ITSN1, 41749, 144199, 33-1116; 8498, ITSN1, 41750, 144200, 1-949; 8498, ITSN1, 41751, 144201, 269-2902; 8498, ITSN1, 41758, 144208, 249-3698; 8498, ITSN1, 41760, 144210, 617-1330; 8498, ITSN1, 41761, 144211, 1-781; 8498, ITSN1, 41762, 144212, 482-827; 8498, ITSN1, 41763, 144213, 267-501; 8498, ITSN1, 41764, 144214, 1-200; 8498, ITSN1, 41765, 144215, 1-519; 8498, ITSN1, 41766, 144216, 1-181; 8498, ITSN1, 41767, 144217, 1-232; 8498, ITSN1, 41768, 144218, 1-234; 8498, ITSN1, 41752, 144202, 269-3931; 8498, ITSN1, 41753, 144203, 289-5454; 8498, ITSN1, 41754, 144204, 20-3082; 8498, ITSN1, 41755, 144205, 249-3683; 8498, ITSN1, 41756, 144206, 251-3898; 8498, ITSN1, 41757, 144207, 347-3883; 8498, ITSN1, 41759, 144209, 264-5414; 8499, ITSN2, 41772, 144222, 1-362; 8499, ITSN2, 41773, 144223, 240-2066; 8499, ITSN2, 41774, 144224, 352-902; 8499, ITSN2, 41775, 144225, 1-167; 8499, ITSN2, 41776, 144226, 1-109; 8499, ITSN2, 41777, 144227, 4-5046; 8499, ITSN2, 41769, 144219, 445-5538; 8499, ITSN2, 41770, 144220, 40-5052; 8499, ITSN2, 41771, 144221, 239-3988; 8500, ICK, 41778, 144228, 348-2246; 8500, ICK, 41779, 144229, 491-2389; 8501, ISX, 41780, 144230, 953-1690; 8501, ISX, 41781, 144231, 664-1401; 8502, IPP, 41782, 144232, 105-1853; 8502, IPP, 41783, 144233, 104-1858; 8503, IFT122, 41790, 144240, 1-329; 8503, IFT122, 41791, 144241, 99-341; 8503, IFT122, 41793, 144243, 295-584; 8503, IFT122, 41794, 144244, 1-962; 8503, IFT122, 41795, 144245, 1-337; 8503, IFT122, 41796, 144246, 1-296; 8503, IFT122, 41797, 144247, 1-734; 8503, IFT122, 41798, 144248, 1-1141; 8503, IFT122, 41800, 144250, 1-139; 8503, IFT122, 41801, 144251, 1-208; 8503, IFT122, 41802, 144252, 1-202; 8503, IFT122, 41803, 144253, 76-590; 8503, IFT122, 41784, 144234, 193-4071; 8503, IFT122, 41785, 144235, 207-3755; 8503, IFT122, 41786, 144236, 78-3803; 8503, IFT122, 41787, 144237, 88-3483; 8503, IFT122, 41788, 144238, 667-3765; 8503, IFT122, 41789, 144239, 897-4172; 8503, IFT122, 41792, 144242, 95-3451; 8503, IFT122, 41799, 144249, 120-3824; 8504, IFT140, 41805, 144255, 62-682; 8504, IFT140, 41807, 144257, 282-643; 8504, IFT140, 41808, 144258, 112-452; 8504, IFT140, 41809, 144259, 1-378; 8504, IFT140, 41804, 144254, 500-2470; 8504, IFT140, 41806, 144256, 365-4753; 8505, IFT172, 41812, 144262, 1-489; 8505, IFT172, 41813, 144263, 1-291; 8505, IFT172, 41814, 144264, 1-589; 8505, IFT172, 41815, 144265, 284-1819; 8505, IFT172, 41816, 144266, 1-973; 8505, IFT172, 41810, 144260, 105-5354; 8505, IFT172, 41811, 144261, 121-1719; 8506, IFT20, 41819, 144269, 301-557; 8506, IFT20, 41822, 144272, 263-661; 8506, IFT20, 41823, 144273, 258-683; 8506, IFT20, 41824, 144274, 1-216; 8506, IFT20, 41826, 144276, 153-377; 8506, IFT20, 41817, 144267, 133-579; 8506, IFT20, 41818, 144268, 104-502; 8506, IFT20, 41820, 144270, 139-537; 8506, IFT20, 41821, 144271, 139-483; 8506, IFT20, 41825, 144275, 272-748; 8507, IFT22, 41828, 144278, 89-202; 8507, IFT22, 41827, 144277, 95-652; 8507, IFT22, 41829, 144279, 69-536; 8507, IFT22, 41830, 144280, 86-643; 8507, IFT22, 41831, 144281, 372-698; 8507, IFT22, 41832, 144282, 210-536; 8507, IFT22, 41833, 144283, 179-505; 8508, IFT27, 41835, 144285, 183-531; 8508, IFT27, 41836, 144286, 397-946; 8508, IFT27, 41838, 144288, 662-813; 8508, IFT27, 41839, 144289, 1-388; 8508, IFT27, 41834, 144284, 447-1004; 8508, IFT27, 41837, 144287, 427-987; 8509, IFT43, 41844, 144294, 6-104; 8509, IFT43, 41840, 144290, 6-647; 8509, IFT43, 41841, 144291, 35-661; 8509, IFT43, 41842, 144292, 18-644; 8509, IFT43, 41843, 144293, 4-345; 8510, IFT46, 41847, 144297, 261-1154; 8510, IFT46, 41848, 144298, 298-774; 8510, IFT46, 41849, 144299, 193-776; 8510, IFT46, 41850, 144300, 508-830; 8510, IFT46, 41851, 144301, 369-553; 8510, IFT46, 41852, 144302, 594-1182; 8510, IFT46, 41845, 144295, 379-1446; 8510, IFT46, 41846, 144296, 420-1334; 8511, IFT52, 41853, 144303, 131-1444; 8511, IFT52, 41854, 144304, 47-1360; 8512, IFT57, 41856, 144306, 54-526; 8512, IFT57, 41857, 144307, 114-359; 8512, IFT57, 41855, 144305, 249-1538; 8513, IFT74, 41862, 144312, 128-652; 8513, IFT74, 41863, 144313, 184-563; 8513, IFT74, 41864, 144314, 125-563; 8513, IFT74, 41865, 144315, 211-652; 8513, IFT74, 41858, 144308, 164-1966; 8513, IFT74, 41859, 144309, 128-1930; 8513, IFT74, 41860, 144310, 58-1176; 8513, IFT74, 41861, 144311, 172-1974; 8514, IFT80, 41867, 144317, 442-567; 8514, IFT80, 41868, 144318, 1-369; 8514, IFT80, 41869, 144319, 442-539; 8514, IFT80, 41871, 144321, 247-610; 8514, IFT80, 41872, 144322, 118-405; 8514, IFT80, 41873, 144323, 495-860; 8514, IFT80, 41874, 144324, 298-529; 8514, IFT80, 41875, 144325, 350-542; 8514, IFT80, 41876, 144326, 181-719; 8514, IFT80, 41877, 144327, 1-168; 8514, IFT80, 41878, 144328, 1-209; 8514, IFT80, 41880, 144330, 482-579; 8514, IFT80, 41866, 144316, 434-2767; 8514, IFT80, 41870, 144320, 589-2511; 8514, IFT80, 41879, 144329, 806-2728; 8515, IFT81, 41883, 144333, 1-1873; 8515, IFT81, 41884, 144334, 74-1171; 8515, IFT81, 41886, 144336, 1-314; 8515, IFT81, 41881, 144331, 507-2537; 8515, IFT81, 41882, 144332, 549-1844; 8515, IFT81, 41885, 144335, 131-2161; 8516, IFT88, 41889, 144339, 426-575; 8516, IFT88, 41890, 144340, 1-1105; 8516, IFT88, 41887, 144337, 195-2669; 8516, IFT88, 41888, 144338, 328-2829; 8517, INIP, 41891, 144341, 187-354; 8517, INIP, 41892, 144342, 229-453; 8517, INIP, 41893, 144343, 307-621; 8518, INTU, 41896, 144346, 133-737; 8518, INTU, 41897, 144347, 1-290; 8518, INTU, 41899, 144349, 1-280; 8518, INTU, 41894, 144344, 104-2932; 8518, INTU, 41895, 144345, 70-1377; 8518, INTU, 41898, 144348, 79-1305; 8519, INVS, 41900, 144350, 167-2854; 8519, INVS, 41901, 144351, 186-3383; 8519, INVS, 41902, 144352, 154-459; 8520, INF2, 41903, 144353, 1-2154; 8520, INF2, 41907, 144357, 2528-2956; 8520, INF2, 41904, 144354, 144-3866; 8520, INF2, 41905, 144355, 113-3862; 8520, INF2, 41906, 144356, 129-833; 8521, IVL, 41908, 144358, 65-1822; 8522, IYD, 41912, 144362, 36-848; 8522, IYD, 41914, 144364, 24-602; 8522, IYD, 41915, 144365, 1-270; 8522, IYD, 41916, 144366, 36-890; 8522, IYD, 41909, 144359, 141-1022; 8522, IYD, 41910, 144360, 141-1010; 8522, IYD, 41911, 144361, 80-823; 8522, IYD, 41913, 144363, 80-823; 8523, IQSEC1, 41918, 144368, 368-2812; 8523, IQSEC1, 41919, 144369, 104-3448; 8523, IQSEC1, 41917, 144367, 218-3109; 8524, IQSEC2, 41920, 144370, 94-2943; 8524, IQSEC2, 41921, 144371, 202-4668; 8525, IQSEC3, 41925, 144375, 119-3232; 8525, IQSEC3, 41922, 144372, 413-2692; 8525, IQSEC3, 41923, 144373, 119-3667; 8525, IQSEC3, 41924, 144374, 413-2692; 8526, IQUB, 41928, 144378, 77-1342; 8526, IQUB, 41926, 144376, 178-2553; 8526, IQUB, 41927, 144377, 165-1955; 8526, IQUB, 41929, 144379, 578-2953; 8527, IQCB1, 41933, 144383, 448-701; 8527, IQCB1, 41934, 144384, 559-988; 8527, IQCB1, 41935, 144385, 340-602; 8527, IQCB1, 41930, 144380, 216-2012; 8527, IQCB1, 41931, 144381, 171-1568; 8527, IQCB1, 41932, 144382, 216-1127; 8528, IQCC, 41936, 144386, 22-1422; 8528, IQCC, 41937, 144387, 12-1652; 8529, IQCD, 41940, 144390, 375-1613; 8529, IQCD, 41938, 144388, 192-1235; 8529, IQCD, 41939, 144389, 192-1541; 8530, IQCE, 41942, 144392, 126-254; 8530, IQCE, 41946, 144396, 158-541; 8530, IQCE, 41947, 144397, 162-899; 8530, IQCE, 41948, 144398, 60-866; 8530, IQCE, 41949, 144399, 160-543; 8530, IQCE, 41950, 144400, 1-580; 8530, IQCE, 41951, 144401, 34-2094; 8530, IQCE, 41952, 144402, 104-2212; 8530, IQCE, 41941, 144391, 287-2179; 8530, IQCE, 41943, 144393, 185-2272; 8530, IQCE, 41944, 144394, 45-1979; 8530, IQCE, 41945, 144395, 131-2170; 8530, IQCE, 41953, 144403, 312-2204; 8531, IQCF1, 41955, 144405, 64-192; 8531, IQCF1, 41954, 144404, 64-681; 8532, IQCF2, 41956, 144406, 30-524; 8533, IQCF3, 41959, 144409, 41-322; 8533, IQCF3, 41957, 144407, 747-1211; 8533, IQCF3, 41958, 144408, 41-505; 8533, IQCF3, 41960, 144410, 780-1244; 8533, IQCF3, 41961, 144411, 1166-1630; 8534, IQCF5, 41962, 144412, 54-500; 8535, IQCF6, 41963, 144413, 61-384; 8536, IQCG, 41965, 144415, 184-1116; 8536, IQCG, 41966, 144416, 389-550; 8536, IQCG, 41967, 144417, 117-712; 8536, IQCG, 41964, 144414, 426-1757; 8536, IQCG, 41968, 144418, 147-1478; 8537, IQGAP1, 41970, 144420, 430-559; 8537, IQGAP1, 41971, 144421, 82-3339; 8537, IQGAP1, 41972, 144422, 1-324; 8537, IQGAP1, 41973, 144423, 1-146; 8537, IQGAP1, 41974, 144424, 96-3671; 8537, IQGAP1, 41969, 144419, 125-5098; 8538, IQGAP2, 41977, 144427, 48-4255; 8538, IQGAP2, 41978, 144428, 78-410; 8538, IQGAP2, 41979, 144429, 121-1648; 8538, IQGAP2, 41980, 144430, 27-209; 8538, IQGAP2, 41981, 144431, 144-2617; 8538, IQGAP2, 41982, 144432, 97-599; 8538, IQGAP2, 41983, 144433, 1-240; 8538, IQGAP2, 41985, 144435, 48-4625; 8538, IQGAP2, 41975, 144425, 298-5025; 8538, IQGAP2, 41976, 144426, 70-3285; 8538, IQGAP2, 41984, 144434, 91-3306; 8539, IQGAP3, 41987, 144437, 117-4883; 8539, IQGAP3, 41986, 144436, 12-4907; 8540, IQCH, 41990, 144440, 97-279; 8540, IQCH, 41992, 144442, 50-562; 8540, IQCH, 41994, 144444, 50-109; 8540, IQCH, 41995, 144445, 1-141; 8540, IQCH, 41996, 144446, 1-273; 8540, IQCH, 41997, 144447, 1-583; 8540, IQCH, 41988, 144438, 67-3150; 8540, IQCH, 41989, 144439, 1-1866; 8540, IQCH, 41991, 144441, 98-604; 8540, IQCH, 41993, 144443, 1-2055; 8540, IQCH, 41998, 144448, 235-1152; 8541, IQCJ, 41999, 144449, 106-444; 8541, IQCJ, 42000, 144450, 106-585; 8541, IQCJ, 42001, 144451, 106-504; 8542, IQCK, 42004, 144454, 1-177; 8542, IQCK, 42005, 144455, 29-313; 8542, IQCK, 42006, 144456, 1-502; 8542, IQCK, 42007, 144457, 700-984; 8542, IQCK, 42008, 144458, 1-370; 8542, IQCK, 42009, 144459, 28-876; 8542, IQCK, 42002, 144452, 700-1269; 8542, IQCK, 42003, 144453, 700-1563; 8543, IQCA1, 42013, 144463, 1-1606; 8543, IQCA1, 42014, 144464, 36-2528; 8543, IQCA1, 42010, 144460, 266-2305; 8543, IQCA1, 42011, 144461, 269-2614; 8543, IQCA1, 42012, 144462, 276-2744; 8544, IQCA1L, 42015, 144465, 1-365; 8544, IQCA1L, 42016, 144466, 43-2499; 8544, IQCA1L, 42017, 144467, 1-356; 8545, IQCJ-SCHIP1, 42018, 144468, 578-2041; 8545, IQCJ-SCHIP1, 42019, 144469, 67-1491; 8545, IQCJ-SCHIP1, 42020, 144470, 154-583; 8545, IQCJ-SCHIP1, 42021, 144471, 242-1597; 8545, IQCJ-SCHIP1, 42022, 144472, 197-699; 8545, IQCJ-SCHIP1, 42023, 144473, 1-301; 8545, IQCJ-SCHIP1, 42024, 144474, 170-1780; 8545, IQCJ-SCHIP1, 42025, 144475, 102-575; 8545, IQCJ-SCHIP1, 42026, 144476, 124-584; 8545, IQCJ-SCHIP1, 42027, 144477, 182-484; 8545, IQCJ-SCHIP1, 42028, 144478, 170-1861; 8545, IQCJ-SCHIP1, 42029, 144479, 302-574; 8545, IQCJ-SCHIP1, 42030, 144480, 67-834; 8546, N/A, 42032, 144482, 224-1327; 8546, N/A, 42033, 144483, 1-682; 8546, N/A, 42034, 144484, 35-1039; 8546, N/A, 42031, 144481, 275-1591; 8547, IREB2, 42035, 144485, 150-3041; 8547, IREB2, 42037, 144487, 111-266; 8547, IREB2, 42038, 144488, 444-558; 8547, IREB2, 42039, 144489, 163-303; 8547, IREB2, 42040, 144490, 1-268; 8547, IREB2, 42041, 144491, 30-692; 8547, IREB2, 42036, 144486, 55-1086; 8548, ISCA1, 42042, 144492, 354-449; 8548, ISCA1, 42043, 144493, 81-341; 8548, ISCA1, 42044, 144494, 72-461; 8549, ISCA2, 42045, 144495, 20-346; 8549, ISCA2, 42046, 144496, 11-193; 8549, ISCA2, 42047, 144497, 56-520; 8550, ISCU, 42050, 144500, 23-493; 8550, ISCU, 42051, 144501, 18-158; 8550, ISCU, 42052, 144502, 14-478; 8550, ISCU, 42053, 144503, 23-487; 8550, ISCU, 42054, 144504, 23-487; 8550, ISCU, 42048, 144498, 23-526; 8550, ISCU, 42049, 144499, 189-617; 8551, IRX1, 42055, 144505, 53-1495; 8552, IRX2, 42056, 144506, 243-1658; 8552, IRX2, 42057, 144507, 250-1665; 8553, IRX3, 42059, 144509, 1-255; 8553, IRX3, 42058, 144508, 714-2219; 8554, IRX4, 42061, 144511, 98-745; 8554, IRX4, 42062, 144512, 106-696; 8554, IRX4, 42060, 144510, 120-1679; 8554, IRX4, 42063, 144513, 458-2017; 8554, IRX4, 42064, 144514, 276-1835; 8554, IRX4, 42065, 144515, 219-1856; 8554, IRX4, 42066, 144516, 224-1861; 8555, IRX5, 42069, 144519, 1-792; 8555, IRX5, 42071, 144521, 1-441; 8555, IRX5, 42067, 144517, 1-1449; 8555, IRX5, 42068, 144518, 338-1789; 8555, IRX5, 42070, 144520, 376-1629; 8556, IRX6, 42072, 144522, 1333-2673; 8557,

ISG15, 42074, 144524, 227-657; 8557, ISG15, 42075, 144525, 252-725; 8557, ISG15, 42073, 144523, 152-649; 8558, ISL1, 42077, 144527, 1-981; 8558, ISL1, 42076, 144526, 282-1331; 8559, ISL2, 42079, 144529, 77-664; 8559, ISL2, 42078, 144528, 161-1240; 8560, IAPP, 42082, 144532, 1-257; 8560, IAPP, 42083, 144533, 102-341; 8560, IAPP, 42084, 144534, 113-351; 8560, IAPP, 42080, 144530, 137-406; 8560, IAPP, 42081, 144531, 71-340; 8561, ICA1, 42086, 144536, 179-946; 8561, ICA1, 42087, 144537, 168-941; 8561, ICA1, 42089, 144539, 183-1598; 8561, ICA1, 42092, 144542, 253-1305; 8561, ICA1, 42093, 144543, 157-414; 8561, ICA1, 42094, 144544, 150-551; 8561, ICA1, 42095, 144545, 119-604; 8561, ICA1, 42097, 144547, 328-539; 8561, ICA1, 42098, 144548, 140-403; 8561, ICA1, 42085, 144535, 193-1641; 8561, ICA1, 42088, 144538, 68-1519; 8561, ICA1, 42090, 144540, 268-1719; 8561, ICA1, 42091, 144541, 253-1704; 8561, ICA1, 42096, 144546, 1-1539; 8562, ICA1L, 42101, 144551, 238-595; 8562, ICA1L, 42102, 144552, 268-562; 8562, ICA1L, 42103, 144553, 393-689; 8562, ICA1L, 42104, 144554, 261-443; 8562, ICA1L, 42105, 144555, 470-1789; 8562, ICA1L, 42106, 144556, 240-572; 8562, ICA1L, 42108, 144558, 168-526; 8562, ICA1L, 42109, 144559, 260-559; 8562, ICA1L, 42110, 144560, 114-515; 8562, ICA1L, 42111, 144561, 322-556; 8562, ICA1L, 42112, 144562, 195-566; 8562, ICA1L, 42113, 144563, 125-576; 8562, ICA1L, 42114, 144564, 267-500; 8562, ICA1L, 42115, 144565, 673-799; 8562, ICA1L, 42116, 144566, 425-714; 8562, ICA1L, 42099, 144549, 375-1823; 8562, ICA1L, 42100, 144550, 159-1607; 8562, ICA1L, 42107, 144557, 226-789; 8562, ICA1L, 42117, 144567, 320-1768; 8563, IAH1, 42118, 144568, 1-226; 8563, IAH1, 42120, 144570, 448-670; 8563, IAH1, 42123, 144573, 29-151; 8563, IAH1, 42124, 144574, 1-686; 8563, IAH1, 42125, 144575, 355-834; 8563, IAH1, 42126, 144576, 337-478; 8563, IAH1, 42119, 144569, 38-784; 8563, IAH1, 42121, 144571, 341-748; 8563, IAH1, 42122, 144572, 317-724; 8564, ISOC1, 42128, 144578, 17-581; 8564, ISOC1, 42127, 144577, 17-913; 8565, 15002, 42132, 144582, 319-854; 8565, ISOC2, 42133, 144583, 240-763; 8565, ISOC2, 42129, 144579, 138-803; 8565, 15002, 42130, 144580, 62-679; 8565, ISOC2, 42131, 144581, 836-1243; 8566, IDH1, 42136, 144586, 471-942; 8566, IDH1, 42137, 144587, 378-563; 8566, IDH1, 42138, 144588, 482-702; 8566, IDH1, 42134, 144584, 286-1530; 8566, IDH1, 42135, 144585, 383-1627; 8566, IDH1, 42139, 144589, 207-1451; 8567, IDH2, 42142, 144592, 88-1026; 8567, IDH2, 42143, 144593, 79-195; 8567, IDH2, 42140, 144590, 115-1473; 8567, IDH2, 42141, 144591, 162-1364; 8568, IDH3A, 42145, 144595, 79-261; 8568, IDH3A, 42146, 144596, 418-744; 8568, IDH3A, 42147, 144597, 1-109; 8568, IDH3A, 42148, 144598, 45-158; 8568, IDH3A, 42149, 144599, 45-1040; 8568, IDH3A, 42150, 144600, 32-160; 8568, IDH3A, 42151, 144601, 335-738; 8568, IDH3A, 42152, 144602, 25-207; 8568, IDH3A, 42153, 144603, 28-141; 8568, IDH3A, 42154, 144604, 1-146; 8568, IDH3A, 42155, 144605, 449-587; 8568, IDH3A, 42156, 144606, 43-569; 8568, IDH3A, 42157, 144607, 1-138; 8568, IDH3A, 42158, 144608, 563-586; 8568, IDH3A, 42159, 144609, 25-288; 8568, IDH3A, 42160, 144610, 28-210; 8568, IDH3A, 42161, 144611, 1-114; 8568, IDH3A, 42144, 144594, 84-1184; 8569, IDH3B, 42164, 144614, 2-1165; 8569, IDH3B, 42165, 144615, 32-1162; 8569, IDH3B, 42166, 144616, 1-251; 8569, IDH3B, 42167, 144617, 1-436; 8569, IDH3B, 42162, 144612, 32-1189; 8569, IDH3B, 42163, 144613, 32-1183; 8570, IDH3G, 42170, 144620, 56-1078; 8570, IDH3G, 42171, 144621, 1-634; 8570, IDH3G, 42172, 144622, 34-888; 8570, IDH3G, 42173, 144623, 1-597; 8570, IDH3G, 42174, 144624, 207-1175; 8570, IDH3G, 42175, 144625, 371-1339; 8570, IDH3G, 42168, 144618, 198-1379; 8570, IDH3G, 42169, 144619, 187-1329; 8571, IARS, 42176, 144626, 81-605; 8571, IARS, 42178, 144628, 114-1103; 8571, IARS, 42179, 144629, 197-414; 8571, IARS, 42180, 144630, 92-3820; 8571, IARS, 42181, 144631, 266-3724; 8571, IARS, 42182, 144632, 2995-3519; 8571, IARS, 42177, 144627, 268-4056; 8572, IARS2, 42183, 144633, 116-3154; 8573, IDI1, 42185, 144635, 652-1017; 8573, IDI1, 42186, 144636, 80-441; 8573, IDI1, 42184, 144634, 168-1022; 8574, 1D12, 42187, 144637, 66-749; 8575, ISPD, 42188, 144638, 1-1206; 8575, ISPD, 42189, 144639, 1-1356; 8576, ICMT, 42191, 144641, 62-412; 8576, ICMT, 42192, 144642, 62-346; 8576, ICMT, 42190, 144640, 30-884; 8577, IVD, 42193, 144643, 1-920; 8577, IVD, 42195, 144645, 25-1305; 8577, IVD, 42196, 144646, 1-437; 8577, IVD, 42197, 144647, 1-732; 8577, IVD, 42198, 144648, 182-819; 8577, IVD, 42199, 144649, 1-124; 8577, IVD, 42200, 144650, 1-175; 8577, IVD, 42201, 144651, 25-668; 8577, IVD, 42194, 144644, 25-1215; 8578, ISM1, 42202, 144652, 7-1401; 8579, ISM2, 42205, 144655, 1-221; 8579, ISM2, 42206, 144656, 1-313; 8579, ISM2, 42208, 144658, 24-579; 8579, ISM2, 42203, 144653, 24-254; 8579, ISM2, 42204, 144654, 58-1773; 8579, ISM2, 42207, 144657, 24-902; 8580, ISY1, 42210, 144660, 63-821; 8580, ISY1, 42212, 144662, 54-428; 8580, ISY1, 42213, 144663, 1-447; 8580, ISY1, 42209, 144659, 74-997; 8580, ISY1, 42211, 144661, 319-1176; 8581, ISY1-RAB43, 42214, 144664, 62-1057; 8582, ITCH, 42215, 144665, 137-2848; 8582, ITCH, 42216, 144666, 214-2802; 8582, ITCH, 42217, 144667, 233-2491; 8582, ITCH, 42218, 144668, 45-2756; 8582, ITCH, 42219, 144669, 45-2633; 8583, IWS1, 42221, 144671, 203-1080; 8583, IWS1, 42222, 144672, 1-102; 8583, IWS1, 42220, 144670, 261-2720; 8584, IZUMO2, 42224, 144674, 1-269; 8584, IZUMO2, 42225, 144675, 1-280; 8584, IZUMO2, 42226, 144676, 1-703; 8584, IZUMO2, 42223, 144673, 2-667; 8585, IZUMO3, 42227, 144677, 1-381; 8585, IZUMO3, 42229, 144679, 28-729; 8585, IZUMO3, 42228, 144678, 233-952; 8586, IZUMO4, 42230, 144680, 4-630; 8586, IZUMO4, 42233, 144683, 1-415; 8586, IZUMO4, 42234, 144684, 1-459; 8586, IZUMO4, 42235, 144685, 16-570; 8586, IZUMO4, 42236, 144686, 1-457; 8586, IZUMO4, 42231, 144681, 78-776; 8586, IZUMO4, 42232, 144682, 65-709; 8587, IZUMO1, 42239, 144689, 175-221; 8587, IZUMO1, 42237, 144687, 549-1601; 8587, IZUMO1, 42238, 144688, 1-585; 8587, IZUMO1, 42240, 144690, 1-207; 8588, IZUMO1R, 42241, 144691, 1-583; 8588, IZUMO1R, 42242, 144692, 45-776; 8589, JADE1, 42246, 144696, 136-564; 8589, JADE1, 42247, 144697, 132-281; 8589, JADE1, 42248, 144698, 196-584; 8589, JADE1, 42250, 144700, 158-552; 8589, JADE1, 42251, 144701, 148-504; 8589, JADE1, 42253, 144703, 158-567; 8589, JADE1, 42254, 144704, 480-532; 8589, JADE1, 42243, 144693, 282-2810; 8589, JADE1, 42244, 144694, 90-2582; 8589, JADE1, 42245, 144695, 105-1634; 8589, JADE1, 42249, 144699, 202-1731; 8589, JADE1, 42252, 144702, 400-2928; 8589, JADE1, 42255, 144705, 158-2686; 8589, JADE1, 42256, 144706, 154-2682; 8590, JADE2, 42257, 144707, 87-2591; 8590, JADE2, 42258, 144708, 340-2715; 8590, JADE2, 42260, 144710, 256-1785; 8590, JADE2, 42261, 144711, 1-143; 8590, JADE2, 42262, 144712, 123-887; 8590, JADE2, 42263, 144713, 119-567; 8590, JADE2, 42264, 144714, 354-1094; 8590, JADE2, 42259, 144709, 180-2552; 8591, JADE3, 42265, 144715, 77-636; 8591, JADE3, 42266, 144716, 149-492; 8591, JADE3, 42267, 144717, 77-2548; 8591, JADE3, 42268, 144718, 299-2770; 8592, JAG1, 42270, 144720, 1-518; 8592, JAG1, 42271, 144721, 1-223; 8592, JAG1, 42269, 144719, 578-4234; 8593, JAG2, 42272, 144722, 405-4121; 8593, JAG2, 42273, 144723, 405-4007; 8594, JAGN1, 42275, 144725, 137-682; 8594, JAGN1, 42274, 144724, 170-721; 8595, JAK1, 42276, 144726, 250-3714; 8596, JAK2, 42277, 144727, 495-3893; 8597, JAK3, 42278, 144728, 101-3475; 8597, JAK3, 42279, 144729, 31-3405; 8597, JAK3, 42280, 144730, 86-3370; 8598, JAKMIP1, 42286, 144736, 451-2160; 8598, JAKMIP1, 42281, 144731, 487-2367; 8598, JAKMIP1, 42282, 144732, 451-2946; 8598, JAKMIP1, 42283, 144733, 277-1662; 8598, JAKMIP1, 42284, 144734, 275-2155; 8598, JAKMIP1, 42285, 144735, 451-2391; 8599, JAKMIP2, 42287, 144737, 469-2901; 8599, JAKMIP2, 42288, 144738, 311-2647; 8599, JAKMIP2, 42289, 144739, 236-2635; 8599, JAKMIP2, 42290, 144740, 542-3004; 8600, JAKMIP3, 42291, 144741, 139-2673; 8601, JAZF1, 42293, 144743, 52-571; 8601, JAZF1, 42294, 144744, 1-692; 8601, JAZF1, 42295, 144745, 56-256; 8601, JAZF1, 42296, 144746, 41-585; 8601, JAZF1, 42297, 144747, 2-244; 8601, JAZF1, 42292, 144742, 167-898; 8602, JMJD7-PLA2G4B, 42298, 144748, 9-2690; 8602, JMJD7-PLA2G4B, 42299, 144749, 10-3048; 8602, JMJD7-PLA2G4B, 42301, 144751, 1-245; 8602, JMJD7-PLA2G4B, 42300, 144750, 102-2447; 8603, JKAMP, 42305, 144755, 527-1504; 8603, JKAMP, 42306, 144756, 116-856; 8603, JKAMP, 42307, 144757, 54-515; 8603, JKAMP, 42308, 144758, 60-482; 8603, JKAMP, 42309, 144759, 148-786; 8603, JKAMP, 42302, 144752, 148-1083; 8603, JKAMP, 42303, 144753, 233-1192; 8603, JKAMP, 42304, 144754, 88-1005; 8604, JCHAIN, 42311, 144761, 65-275; 8604, JCHAIN, 42312, 144762, 37-508; 8604, JCHAIN, 42314, 144764, 61-533; 8604, JCHAIN, 42310, 144760, 171-650; 8604, JCHAIN, 42313, 144763, 152-631; 8604, JCHAIN, 42315, 144765, 142-621; 8605, JOSD1, 42317, 144767, 437-623; 8605, JOSD1, 42318, 144768, 659-843; 8605, JOSD1, 42319, 144769, 202-571; 8605, JOSD1, 42320, 144770, 216-529; 8605, JOSD1, 42321, 144771, 1-463; 8605, JOSD1, 42316, 144766, 681-1289; 8606, JOSD2, 42324, 144774, 100-582; 8606, JOSD2, 42322, 144772, 122-562; 8606, JOSD2, 42323, 144773, 255-821; 8606, JOSD2, 42325, 144775, 61-627; 8607, JRK, 42326, 144776, 526-2196; 8607, JRK, 42327, 144777, 526-2232; 8607, JRK, 42328, 144778, 511-587; 8607, JRK, 42329, 144779, 502-2172; 8607, JRK, 42330, 144780, 334-2040; 8608, JRKL, 42331, 144781, 248-1822; 8609, JMJD1C, 42332, 144782, 1-2870; 8609, JMJD1C, 42333, 144783, 220-7842; 8609, JMJD1C, 42334, 144784, 618-7694; 8610, JMJD4, 42337, 144787, 11-1264; 8610, JMJD4, 42335, 144785, 1-1392; 8610, JMJD4, 42336, 144786, 1-1344; 8610, JMJD4, 42338, 144788, 1-1392; 8611, JMJD6, 42339, 144789, 310-1317; 8611, JMJD6, 42342, 144792, 310-1395; 8611, JMJD6, 42343, 144793, 29-1216; 8611, JMJD6, 42344, 144794, 325-1410; 8611, JMJD6, 42340, 144790, 116-1327; 8611, JMJD6, 42341, 144791, 205-1449; 8612, JMJD7, 42346, 144796, 243-896; 8612, JMJD7, 42347, 144797, 424-828; 8612, JMJD7, 42345, 144795, 41-991; 8613, JMJD8, 42349, 144799, 45-749; 8613, JMJD8, 42350, 144800, 1-245; 8613, JMJD8, 42351, 144801, 28-687; 8613, JMJD8, 42348, 144798, 58-915; 8613, JMJD8, 42352, 144802, 16-810; 8614, JARID2, 42353, 144803, 245-3985; 8614, JARID2, 42354, 144804, 582-3806; 8615, JTB, 42355, 144805, 437-877; 8615, JTB, 42356, 144806, 520-873; 8615, JTB, 42357, 144807, 696-1049; 8615, JTB, 42358, 144808, 170-520; 8616, JUNB, 42359, 144809, 277-1320; 8617, JUND, 42361, 144811, 1-500; 8617, JUND, 42360, 144810, 139-1182; 8618, JDP2, 42366, 144816, 231-631; 8618, JDP2, 42362, 144812, 194-718; 8618, JDP2, 42363, 144813, 274-765; 8618, JDP2, 42364, 144814, 60-551; 8618, JDP2, 42365, 144815, 158-649; 8619, JUN, 42367, 144817, 1258-2253; 8620, JMY, 42368, 144818, 463-3429; 8621, JUP, 42372, 144822, 177-1069; 8621, JUP, 42373, 144823, 143-1029; 8621, JUP, 42374, 144824, 243-949; 8621, JUP, 42375, 144825, 327-586; 8621, JUP, 42376, 144826, 86-915; 8621, JUP, 42377, 144827, 425-432; 8621, JUP, 42378, 144828, 272-583; 8621, JUP, 42369, 144819, 120-2357; 8621, JUP, 42370, 144820, 218-2455; 8621, JUP, 42371, 144821, 120-2357; 8622, JAM2, 42382, 144832, 1-785; 8622, JAM2, 42379, 144829, 541-1329; 8622, JAM2, 42380, 144830, 551-1489; 8622, JAM2, 42381, 144831, 551-1447; 8623, JAM3, 42385, 144835, 14-130; 8623, JAM3, 42386, 144836, 14-385; 8623, JAM3, 42383, 144833, 160-1092; 8623, JAM3, 42384, 144834, 14-793; 8624, JSRP1, 42388, 144838, 61-843; 8624, JSRP1, 42387, 144837, 66-1061; 8625, JPH1, 42390, 144840, 41-280; 8625, JPH1, 42389, 144839, 42-2027; 8626, JPH2, 42391, 144841, 389-778; 8626, JPH2, 42392, 144842, 874-2964; 8627, JPH3, 42393, 144843, 243-2489; 8628, JPH4, 42396, 144846, 24-905; 8628, JPH4, 42397, 144847, 1-1890; 8628, JPH4, 42394, 144844, 793-2679; 8628, JPH4, 42395, 144845, 904-2790; 8629, KAT2A, 42399, 144849, 1-213; 8629, KAT2A, 42400, 144850, 1-831; 8629, KAT2A, 42398, 144848, 55-2568; 8630, KAT2B, 42401, 144851, 456-2954; 8631, KATS, 42405, 144855, 545-1453; 8631, KATS, 42407, 144857, 447-583; 8631, KATS, 42408, 144858, 1-287; 8631, KATS, 42409, 144859, 529-576; 8631, KATS, 42410, 144860, 42-609; 8631, KATS, 42411, 144861, 38-845; 8631, KATS, 42412, 144862, 1-499; 8631, KATS, 42402, 144852, 235-1875; 8631, KATS, 42403, 144853, 251-1636; 8631, KATS, 42404, 144854, 273-1814; 8631, KATS, 42406, 144856, 30-1514; 8632, KAT6A, 42416, 144866, 548-588; 8632, KAT6A, 42417, 144867, 1094-3279; 8632, KAT6A, 42418, 144868, 413-2860; 8632, KAT6A, 42413, 144863, 413-6427; 8632, KAT6A, 42414, 144864, 545-6559; 8632, KAT6A, 42415, 144865, 501-6515; 8633, KAT6B, 42424, 144874, 403-5748; 8633, KAT6B, 42425, 144875, 490-6711; 8633, KAT6B, 42426, 144876, 312-5984; 8633, KAT6B, 42427, 144877, 352-5697; 8633, KAT6B, 42428, 144878, 515-5860; 8633, KAT6B, 42419, 144869, 490-6711; 8633, KAT6B, 42420, 144870, 312-5984; 8633, KAT6B, 42421, 144871, 403-5748; 8633, KAT6B, 42422, 144872, 515-5860; 8633, KAT6B, 42423, 144873, 352-5697; 8634, KAT7, 42431, 144881, 767-2044; 8634, KAT7, 42433, 144883, 516-563; 8634, KAT7, 42429, 144879, 281-2116; 8634, KAT7, 42430, 144880, 130-1875; 8634, KAT7, 42432, 144882, 155-1573; 8634, KAT7, 42434, 144884, 143-1471; 8634, KAT7, 42435, 144885, 154-1659; 8635, KAT8, 42438, 144888, 1-562; 8635, KAT8, 42436, 144886, 19-1395; 8635, KAT8, 42437, 144887, 19-1422; 8635, KAT8, 42439, 144889, 336-1712; 8636, KALRN, 42442, 144892, 1-8867; 8636, KALRN, 42443, 144893, 128-9088; 8636, KALRN, 42444, 144894, 1-804; 8636, KALRN, 42445, 144895, 141-722; 8636, KALRN, 42446, 144896, 1-648; 8636, KALRN, 42447, 144897, 158-5122; 8636, KALRN, 42448, 144898, 86-247; 8636, KALRN, 42440, 144890, 158-5149; 8636, KALRN, 42441, 144891, 164-4033; 8637, KLK1, 42450, 144900, 40-210; 8637, KLK1, 42449, 144899, 37-825; 8638, KLKB1, 42452, 144902, 202-645; 8638, KLKB1, 42453, 144903, 147-569; 8638, KLKB1, 42454, 144904, 255-1799; 8638, KLKB1, 42455, 144905, 1-2060; 8638, KLKB1, 42451, 144901, 188-2104; 8639, N/A, 42457, 144907, 1-276; 8639, N/A, 42456, 144906, 35-787; 8640, KLK10, 42461, 144911, 121-549; 8640, KLK10, 42462, 144912, 600-731; 8640, KLK10, 42458, 144908, 220-1050; 8640, KLK10, 42459, 144909, 148-978; 8640, KLK10, 42460, 144910, 121-951; 8641, KLK11, 42464, 144914, 107-457; 8641, KLK11, 42467, 144917, 1-424; 8641, KLK11, 42468, 144918, 97-608; 8641, KLK11, 42469, 144919, 147-351; 8641, KLK11, 42470, 144920, 101-430; 8641, KLK11, 42463, 144913, 132-884; 8641, KLK11, 42465, 144915, 47-874; 8641, KLK11, 42466, 144916, 113-865; 8641, KLK11, 42471, 144921, 187-1035; 8642, KLK12, 42475, 144925, 77-316; 8642, KLK12, 42476, 144926, 445-684; 8642, KLK12, 42477, 144927, 77-610; 8642, KLK12, 42472, 144922, 118-882; 8642, KLK12, 42473, 144923, 118-864; 8642, KLK12, 42474, 144924, 77-412; 8642, KLK12, 42478, 144928, 121-867; 8643, KLK13, 42479, 144929, 44-343; 8643, KLK13, 42481, 144931, 232-528; 8643, KLK13, 42482, 144932, 44-325; 8643, KLK13, 42483, 144933, 1-615; 8643, KLK13, 42485, 144935, 232-528; 8643, KLK13, 42486, 144936, 48-590; 8643, KLK13, 42487, 144937, 44-325; 8643, KLK13, 42480, 144930, 1-378; 8643, KLK13, 42484, 144934, 44-877; 8644, KLK14, 42488, 144938, 220-1023; 8644, KLK14, 42489, 144939, 220-1023; 8645, KLK15, 42491, 144941, 22-384; 8645, KLK15, 42493, 144943, 22-504; 8645, KLK15, 42494, 144944, 245-374; 8645, KLK15, 42490, 144940, 131-898; 8645, KLK15, 42492, 144942, 32-802; 8646, KLK2, 42498, 144948, 177-543; 8646, KLK2, 42499, 144949, 36-185; 8646, KLK2, 42500, 144950, 39-188; 8646, KLK2, 42502, 144952, 1-155; 8646, KLK2, 42503, 144953, 398-528; 8646, KLK2, 42504, 144954, 1-550; 8646, KLK2, 42505, 144955, 42-251; 8646, KLK2, 42506, 144956, 36-185; 8646, KLK2, 42507, 144957, 445-512; 8646, KLK2, 42495, 144945, 226-1011; 8646, KLK2, 42496, 144946, 17-688; 8646, KLK2, 42497, 144947, 188-667; 8646, KLK2, 42501, 144951, 17-511; 8647, KLK3, 42510, 144960, 42-314; 8647, KLK3, 42511, 144961, 22-396; 8647, KLK3, 42512, 144962, 36-552; 8647, KLK3, 42514, 144964, 42-356; 8647, KLK3, 42515, 144965, 1-788; 8647, KLK3, 42516, 144966, 42-559; 8647, KLK3, 42517, 144967, 27-614; 8647, KLK3, 42519, 144969, 42-704; 8647, KLK3, 42508, 144958, 42-827; 8647, KLK3, 42509, 144959, 1-717; 8647, KLK3, 42513, 144963, 8-664; 8647, KLK3, 42518, 144968, 22-705; 8648, KLK4, 42520, 144970, 1-765; 8648, KLK4, 42522, 144972, 186-401; 8648, KLK4, 42523, 144973, 279-494; 8648, KLK4, 42524, 144974, 1-228; 8648, KLK4, 42521, 144971, 1-333; 8649, KLK5, 42527, 144977, 57-672; 8649, KLK5, 42525, 144975, 354-1235; 8649, KLK5, 42526, 144976, 196-1077; 8649, KLK5, 42528, 144978, 156-1037; 8650, KLK6, 42531, 144981, 244-606; 8650, KLK6, 42534, 144984, 258-467; 8650, KLK6, 42529, 144979, 244-978; 8650, KLK6, 42530, 144980, 441-1175; 8650, KLK6, 42532, 144982, 533-946; 8650, KLK6, 42533, 144983, 244-366; 8650, KLK6, 42535, 144985, 93-827; 8650, KLK6, 42536, 144986, 236-358; 8651, KLK7, 42537, 144987, 308-508; 8651, KLK7, 42540, 144990, 418-624; 8651, KLK7, 42538, 144988, 103-864; 8651, KLK7, 42539, 144989, 332-877; 8651, KLK7, 42541, 144991, 247-1008; 8652, KLK8, 42542, 144992, 383-802; 8652, KLK8, 42548, 144998, 280-570; 8652, KLK8, 42549, 144999, 1-163; 8652, KLK8, 42543, 144993, 180-278; 8652, KLK8, 42544, 144994, 146-505; 8652, KLK8, 42545, 144995, 82-999; 8652, KLK8, 42546, 144996, 1-99; 8652, KLK8, 42547, 144997, 491-1273; 8653, KLK9, 42550, 145000, 88-273; 8653, KLK9, 42551, 145001, 2-754; 8654, KPTN, 42553, 145003, 17-806; 8654, KPTN, 42554, 145004, 3-455; 8654, KPTN, 42555, 145005, 616-743; 8654, KPTN, 42552, 145002, 109-1419; 8655, KPNB1, 42559, 145009, 1-68; 8655, KPNB1, 42560, 145010, 1-2071; 8655, KPNB1, 42561, 145011, 1-742; 8655, KPNB1, 42562, 145012, 451-896; 8655, KPNB1, 42563, 145013, 424-605; 8655, KPNB1, 42556, 145006, 408-3038; 8655, KPNB1, 42557, 145007, 739-2934; 8655, KPNB1, 42558, 145008, 518-2713; 8656, KPNA1, 42565, 145015, 84-727; 8656, KPNA1, 42566, 145016, 69-575; 8656, KPNA1, 42567, 145017, 184-732; 8656, KPNA1, 42568, 145018, 73-596; 8656, KPNA1, 42569, 145019, 77-1062; 8656, KPNA1, 42570, 145020, 73-621; 8656, KPNA1, 42564, 145014, 178-1794; 8657, KPNA2, 42573, 145023, 140-569; 8657, KPNA2, 42574, 145024, 157-309; 8657, KPNA2, 42575, 145025, 160-561; 8657, KPNA2, 42571, 145021, 346-1935; 8657, KPNA2, 42572, 145022, 621-2210; 8658, KPNA3, 42577, 145027, 1-275; 8658, KPNA3, 42576, 145026, 416-1981; 8659, KPNA4, 42579, 145029, 1-510; 8659, KPNA4, 42578, 145028, 307-1872; 8660, KPNA5, 42582, 145032, 1-367; 8660, KPNA5, 42583, 145033, 264-689; 8660, KPNA5, 42580, 145030, 132-1751; 8660, KPNA5, 42581, 145031, 149-1768; 8661, KPNA6, 42585, 145035, 1-965; 8661, KPNA6, 42586, 145036, 74-634; 8661, KPNA6, 42584, 145034, 94-1704; 8662, KPNA7, 42587, 145037, 41-1591; 8663, KANSL1, 42590, 145040, 220-586; 8663, KANSL1, 42591, 145041, 251-667; 8663, KANSL1, 42592, 145042, 378-404; 8663, KANSL1, 42593, 145043, 35-3160; 8663, KANSL1, 42596, 145046, 92-3409; 8663, KANSL1, 42597, 145047, 258-3572; 8663, KANSL1, 42598, 145048, 174-3491; 8663, KANSL1, 42599, 145049, 472-3789; 8663, KANSL1, 42600, 145050, 228-3545; 8663, KANSL1, 42601, 145051, 35-3160; 8663, KANSL1, 42602, 145052, 472-3789; 8663, KANSL1, 42603, 145053, 378-404; 8663, KANSL1, 42604, 145054, 174-3491; 8663, KANSL1, 42605, 145055, 251-667; 8663, KANSL1, 42606, 145056, 220-586; 8663, KANSL1, 42607, 145057, 35-3160; 8663, KANSL1, 42608, 145058, 251-667; 8663, KANSL1, 42609, 145059, 228-3545; 8663, KANSL1, 42610, 145060, 220-586; 8663, KANSL1, 42611, 145061, 378-404; 8663, KANSL1, 42588, 145038, 472-3789; 8663, KANSL1, 42589, 145039, 258-3572; 8663, KANSL1, 42594, 145044, 174-3491; 8663, KANSL1, 42595, 145045, 228-3545; 8664, KANSL1L, 42613, 145063, 1-599; 8664, KANSL1L, 42616, 145066, 1-1030; 8664, KANSL1L, 42618, 145068, 1-575; 8664, KANSL1L, 42619, 145069, 1-211; 8664, KANSL1L, 42612, 145062, 265-3228; 8664, KANSL1L, 42614, 145064, 139-2256; 8664, KANSL1L, 42615, 145065, 209-2326; 8664, KANSL1L, 42617, 145067, 209-3046; 8665, KANSL2, 42621, 145071, 135-343; 8665, KANSL2, 42622, 145072, 1-77; 8665, KANSL2, 42623, 145073, 1-621; 8665, KANSL2, 42624, 145074, 62-461; 8665, KANSL2, 42626, 145076, 270-593; 8665, KANSL2, 42627, 145077, 311-1675; 8665, KANSL2, 42628, 145078, 1-225; 8665, KANSL2, 42629, 145079, 45-2072; 8665, KANSL2, 42630, 145080, 1-1022; 8665, KANSL2, 42620, 145070, 49-1527; 8665, KANSL2, 42625, 145075, 35-502; 8666, KANSL3, 42631, 145081, 115-333; 8666, KANSL3, 42632, 145082, 1-282; 8666, KANSL3, 42634, 145084, 100-330; 8666, KANSL3, 42635, 145085, 184-701; 8666, KANSL3, 42636, 145086, 143-370; 8666, KANSL3, 42637, 145087, 94-312; 8666, KANSL3, 42639, 145089, 147-611; 8666, KANSL3, 42640, 145090, 92-295; 8666, KANSL3, 42641, 145091, 58-456; 8666, KANSL3, 42642, 145092, 89-553; 8666, KANSL3, 42633, 145083, 78-2714; 8666, KANSL3, 42638, 145088, 100-2442; 8667, KATNA1, 42646, 145096, 297-1138; 8667, KATNA1, 42647, 145097, 84-716; 8667, KATNA1, 42643, 145093, 46-1521; 8667, KATNA1, 42644, 145094, 281-1216; 8667, KATNA1, 42645, 145095, 350-1825; 8668, KATNAL1, 42650, 145100, 108-566; 8668, KATNAL1, 42651, 145101, 347-797; 8668, KATNAL1, 42648, 145098, 169-1641; 8668, KATNAL1, 42649, 145099, 102-1574; 8669, KATNAL2, 42654, 145104, 1-1023; 8669, KATNAL2, 42655, 145105, 1-387; 8669, KATNAL2, 42656, 145106, 200-865; 8669, KATNAL2, 42657, 145107, 1-465; 8669, KATNAL2, 42658, 145108, 674-991; 8669, KATNAL2, 42652, 145102, 195-1595; 8669, KATNAL2, 42653, 145103, 19-1635; 8670, KATNB1, 42660, 145110, 104-728; 8670, KATNB1, 42661, 145111, 222-853; 8670, KATNB1, 42662, 145112, 272-622; 8670, KATNB1, 42663, 145113, 1-827; 8670, KATNB1, 42664, 145114, 383-619; 8670, KATNB1, 42659, 145109, 393-2360; 8671, KATNBL1, 42666, 145116, 262-797; 8671, KATNBL1, 42667, 145117, 1-507; 8671, KATNBL1, 42668, 145118, 456-572; 8671, KATNBL1, 42669, 145119, 1-334; 8671, KATNBL1, 42670, 145120, 1-459; 8671, KATNBL1, 42671, 145121, 214-436; 8671, KATNBL1, 42672, 145122, 323-853; 8671, KATNBL1, 42673, 145123, 318-562; 8671, KATNBL1, 42674, 145124, 218-597; 8671, KATNBL1, 42665, 145115, 144-1058; 8672, KAZALD1, 42675, 145125, 327-1241; 8673, KAZN, 42677, 145127, 302-800; 8673, KAZN, 42676, 145126, 236-1483; 8673, KAZN, 42678, 145128, 295-2622; 8673, KAZN, 42679, 145129, 312-1295; 8673, KAZN, 42680, 145130, 302-1285; 8673, KAZN, 42681, 145131, 210-1475; 8674, N/A, 42682, 145132, 201-599; 8674, N/A, 42683, 145133, 202-591; 8674, N/A, 42684, 145134, 466-736; 8674, N/A, 42685, 145135, 224-622; 8675, KDELC1, 42686, 145136, 338-1846; 8676, KDELC2, 42690, 145140, 1-481; 8676, KDELC2, 42687, 145137, 67-1590; 8676, KDELC2, 42688, 145138, 304-1659; 8676, KDELC2, 42689, 145139, 17-1246; 8677, KDELR1, 42693, 145143, 154-815; 8677, KDELR1, 42691, 145141, 196-834; 8677, KDELR1, 42692, 145142, 427-879; 8678, KDELR2, 42695, 145145, 93-209; 8678, KDELR2, 42694, 145144, 186-824; 8678, KDELR2, 42696, 145146, 1-561; 8679, KDELR3, 42697, 145147, 173-817; 8679, KDELR3, 42698, 145148, 157-819; 8680, KLHDC1, 42700, 145150, 91-381; 8680, KLHDC1, 42701, 145151, 67-655; 8680, KLHDC1, 42702, 145152, 91-294; 8680, KLHDC1, 42703, 145153, 76-645; 8680, KLHDC1, 42699, 145149, 91-1311; 8681, KLHDC10, 42705, 145155, 339-772; 8681, KLHDC10, 42706, 145156, 95-503; 8681, KLHDC10, 42704, 145154, 135-1463; 8682, KLHDC2, 42709, 145159, 302-1225; 8682, KLHDC2, 42711, 145161, 316-1389; 8682, KLHDC2, 42707, 145157, 862-2082; 8682, KLHDC2, 42708, 145158, 340-1089; 8682, KLHDC2, 42710, 145160, 302-1051; 8683, KLHDC3, 42712, 145162, 592-1338; 8683, KLHDC3, 42714, 145164, 154-1323; 8683, KLHDC3, 42713, 145163, 196-1344; 8684, KLHDC4, 42718, 145168, 78-953; 8684, KLHDC4, 42719, 145169, 72-206; 8684, KLHDC4, 42720, 145170, 72-332; 8684, KLHDC4, 42721, 145171, 78-395; 8684, KLHDC4, 42722, 145172, 62-1065; 8684, KLHDC4, 42723, 145173, 40-339; 8684, KLHDC4, 42724, 145174, 103-219; 8684, KLHDC4, 42726, 145176, 72-206; 8684, KLHDC4, 42727, 145177, 42-562; 8684, KLHDC4, 42728, 145178, 646-1422; 8684, KLHDC4, 42715, 145165, 10-1401; 8684, KLHDC4, 42716, 145166, 60-1622; 8684, KLHDC4, 42717, 145167, 87-1556; 8684, KLHDC4, 42725, 145175, 83-1645; 8685, KLHDC7A, 42729, 145179, 1-2334; 8686, KLHDC7B, 42730, 145180, 135-1919; 8687, KLHDC8A, 42734, 145184, 330-566; 8687, KLHDC8A, 42735, 145185, 751-948; 8687, KLHDC8A, 42736, 145186, 80-606; 8687, KLHDC8A, 42737, 145187, 288-938; 8687, KLHDC8A, 42738, 145188, 275-523; 8687, KLHDC8A, 42739, 145189, 493-571; 8687, KLHDC8A, 42731, 145181, 569-1621; 8687, KLHDC8A, 42732, 145182, 818-1870; 8687, KLHDC8A, 42733, 145183, 545-1597; 8688, KLHDC8B, 42740, 145190, 210-1274; 8689, KLHDC9, 42741, 145191, 143-1192; 8689, KLHDC9, 42742, 145192, 143-1009; 8690, KBTBD11, 42743, 145193, 967-2838; 8690, KBTBD11, 42744, 145194, 967-2838; 8691, KBTBD12, 42746, 145196, 222-914; 8691, KBTBD12, 42745, 145195, 141-737; 8691, KBTBD12, 42747, 145197, 4-1875; 8691, KBTBD12, 42748, 145198, 468-2339; 8692, KBTBD13, 42749, 145199, 1-1377; 8693, KBTBD2, 42751, 145201, 581-593; 8693, KBTBD2, 42752, 145202, 395-537; 8693, KBTBD2, 42753, 145203, 636-724; 8693, KBTBD2, 42754, 145204, 516-556; 8693, KBTBD2, 42755, 145205, 69-1073; 8693, KBTBD2, 42750, 145200, 701-2572; 8694, KBTBD3, 42756, 145206, 43-1644; 8694, KBTBD3, 42758, 145208, 199-297; 8694, KBTBD3, 42760, 145210, 15-290; 8694, KBTBD3, 42757, 145207, 668-2506; 8694, KBTBD3, 42759, 145209, 161-1999; 8695, KBTBD4, 42763, 145213, 26-546; 8695, KBTBD4, 42765, 145215, 169-764; 8695, KBTBD4, 42766, 145216, 114-596; 8695, KBTBD4, 42767, 145217, 111-971; 8695, KBTBD4, 42768, 145218, 66-542; 8695, KBTBD4, 42769, 145219, 23-118; 8695, KBTBD4, 42770, 145220, 716-2347; 8695, KBTBD4, 42761, 145211, 172-1728; 8695, KBTBD4, 42762, 145212, 65-1669; 8695, KBTBD4, 42764, 145214, 155-1711; 8696, KBTBD6, 42771, 145221, 236-2260; 8697, KBTBD7, 42772, 145222, 310-2364; 8698, KBTBD8, 42774, 145224, 70-568; 8698, KBTBD8, 42775, 145225, 119-557; 8698, KBTBD8, 42773, 145223, 50-1855; 8698, KBTBD8, 42776, 145226, 50-529; 8699, KEAP1, 42779, 145229, 325-960; 8699, KEAP1, 42780, 145230, 348-986; 8699, KEAP1, 42781, 145231, 1-389; 8699, KEAP1, 42782, 145232, 1-350; 8699, KEAP1, 42783, 145233, 1-517; 8699, KEAP1, 42784, 145234, 142-979; 8699, KEAP1, 42777, 145227, 549-2423; 8699, KEAP1, 42778, 145228, 248-2122; 8700, KLHL1, 42786, 145236, 795-2858; 8700, KLHL1, 42785, 145235, 761-3007; 8701, KLHL10, 42788, 145238, 276-641; 8701, KLHL10, 42789, 145239, 109-566; 8701, KLHL10, 42787, 145237, 154-1980; 8702, KLHL11, 42790, 145240, 62-2188; 8703, KLHL12, 42791, 145241, 88-1033; 8703, KLHL12, 42792, 145242, 122-736; 8703, KLHL12, 42793, 145243, 220-1926; 8704, KLHL13, 42795, 145245, 2423-4237; 8704, KLHL13, 42796, 145246, 326-2140; 8704, KLHL13, 42797, 145247, 347-2161; 8704, KLHL13, 42798, 145248, 194-306; 8704, KLHL13, 42799, 145249, 1064-2878; 8704, KLHL13, 42800, 145250, 203-2017; 8704, KLHL13, 42794, 145244, 911-2878; 8704, KLHL13, 42801, 145251, 387-2228; 8704, KLHL13, 42802, 145252, 383-2302; 8704, KLHL13, 42803, 145253, 1-1977; 8704, KLHL13, 42804, 145254, 89-2008; 8705, KLHL14, 42807, 145257, 84-765; 8705, KLHL14, 42805, 145255, 257-1423; 8705, KLHL14, 42806, 145256, 440-2326; 8706, KLHL15, 42808, 145258, 257-2071; 8707, KLHL17, 42810, 145260, 1-463; 8707, KLHL17, 42811, 145261, 455-1132; 8707, KLHL17, 42809, 145259, 108-2036; 8708, KLHL18, 42813, 145263, 20-199; 8708, KLHL18, 42814, 145264, 50-241; 8708, KLHL18, 42815, 145265, 21-463; 8708, KLHL18, 42812, 145262, 21-1745; 8709, KLHL2, 42817, 145267, 77-1567; 8709, KLHL2, 42818, 145268, 231-582; 8709, KLHL2, 42819, 145269, 108-275; 8709, KLHL2, 42820, 145270, 55-487; 8709, KLHL2, 42821, 145271, 235-1518; 8709, KLHL2, 42816, 145266, 260-2041; 8709, KLHL2, 42822, 145272, 251-2044; 8709, KLHL2, 42823, 145273, 294-1811; 8710, KLHL20, 42824, 145274, 137-1966; 8711,

KLHL21, 42827, 145277, 192-884; 8711, KLHL21, 42828, 145278, 239-640; 8711, KLHL21, 42829, 145279, 148-824; 8711, KLHL21, 42830, 145280, 1678-1785; 8711, KLHL21, 42825, 145275, 53-1846; 8711, KLHL21, 42826, 145276, 185-1804; 8712, KLHL22, 42832, 145282, 38-792; 8712, KLHL22, 42833, 145283, 38-742; 8712, KLHL22, 42834, 145284, 48-724; 8712, KLHL22, 42835, 145285, 447-769; 8712, KLHL22, 42836, 145286, 160-1045; 8712, KLHL22, 42837, 145287, 98-572; 8712, KLHL22, 42831, 145281, 158-2062; 8713, KLHL23, 42840, 145290, 1-867; 8713, KLHL23, 42841, 145291, 1-77; 8713, KLHL23, 42842, 145292, 696-843; 8713, KLHL23, 42843, 145293, 406-603; 8713, KLHL23, 42838, 145288, 339-2015; 8713, KLHL23, 42839, 145289, 245-1921; 8714, KLHL24, 42846, 145296, 382-563; 8714, KLHL24, 42847, 145297, 222-562; 8714, KLHL24, 42848, 145298, 253-603; 8714, KLHL24, 42849, 145299, 187-588; 8714, KLHL24, 42850, 145300, 246-627; 8714, KLHL24, 42851, 145301, 237-613; 8714, KLHL24, 42853, 145303, 324-542; 8714, KLHL24, 42854, 145304, 341-574; 8714, KLHL24, 42844, 145294, 351-2153; 8714, KLHL24, 42845, 145295, 387-2189; 8714, KLHL24, 42852, 145302, 1-1614; 8715, KLHL25, 42855, 145305, 276-2045; 8716, KLHL26, 42857, 145307, 1-554; 8716, KLHL26, 42858, 145308, 28-168; 8716, KLHL26, 42859, 145309, 28-465; 8716, KLHL26, 42860, 145310, 31-339; 8716, KLHL26, 42856, 145306, 91-1938; 8717, KLHL28, 42861, 145311, 205-1962; 8717, KLHL28, 42863, 145313, 520-656; 8717, KLHL28, 42864, 145314, 372-859; 8717, KLHL28, 42865, 145315, 295-546; 8717, KLHL28, 42866, 145316, 152-847; 8717, KLHL28, 42862, 145312, 121-1836; 8718, KLHL29, 42867, 145317, 1-1628; 8718, KLHL29, 42868, 145318, 718-3345; 8719, KLHL3, 42871, 145321, 442-759; 8719, KLHL3, 42873, 145323, 370-1570; 8719, KLHL3, 42869, 145319, 445-2208; 8719, KLHL3, 42870, 145320, 716-2383; 8719, KLHL3, 42872, 145322, 451-1968; 8720, KLHL30, 42874, 145324, 108-1844; 8721, KLHL31, 42875, 145325, 142-2046; 8721, KLHL31, 42876, 145326, 1-1905; 8722, KLHL32, 42877, 145327, 53-472; 8722, KLHL32, 42879, 145329, 1-531; 8722, KLHL32, 42882, 145332, 862-1392; 8722, KLHL32, 42883, 145333, 700-1170; 8722, KLHL32, 42878, 145328, 364-2226; 8722, KLHL32, 42880, 145330, 473-2227; 8722, KLHL32, 42881, 145331, 473-2128; 8723, KLHL33, 42884, 145334, 224-1825; 8724, KLHL34, 42885, 145335, 543-2477; 8725, KLHL35, 42886, 145336, 223-1314; 8725, KLHL35, 42887, 145337, 1-1752; 8726, KLHL36, 42889, 145339, 293-585; 8726, KLHL36, 42890, 145340, 162-508; 8726, KLHL36, 42891, 145341, 370-555; 8726, KLHL36, 42888, 145338, 132-1793; 8726, KLHL36, 42892, 145342, 142-1992; 8727, KLHL38, 42893, 145343, 25-1770; 8728, KLHL4, 42894, 145344, 81-2243; 8728, KLHL4, 42895, 145345, 146-2302; 8729, KLHL40, 42896, 145346, 101-1966; 8730, KLHL41, 42897, 145347, 78-1898; 8731, KLHL42, 42899, 145349, 1-538; 8731, KLHL42, 42900, 145350, 284-1393; 8731, KLHL42, 42898, 145348, 312-1829; 8732, KLHL5, 42906, 145356, 1-847; 8732, KLHL5, 42907, 145357, 1-109; 8732, KLHL5, 42901, 145351, 153-2282; 8732, KLHL5, 42902, 145352, 76-2160; 8732, KLHL5, 42903, 145353, 76-2349; 8732, KLHL5, 42904, 145354, 78-1784; 8732, KLHL5, 42905, 145355, 284-2551; 8733, KLHL6, 42909, 145359, 1-1833; 8733, KLHL6, 42908, 145358, 37-1902; 8734, KLHL7, 42914, 145364, 1-282; 8734, KLHL7, 42915, 145365, 270-392; 8734, KLHL7, 42910, 145360, 243-743; 8734, KLHL7, 42911, 145361, 244-2004; 8734, KLHL7, 42912, 145362, 525-2141; 8734, KLHL7, 42913, 145363, 575-1009; 8735, KLHL8, 42917, 145367, 260-1573; 8735, KLHL8, 42919, 145369, 198-431; 8735, KLHL8, 42916, 145366, 343-2205; 8735, KLHL8, 42918, 145368, 386-2248; 8735, KLHL8, 42920, 145370, 271-1905; 8736, KLHL9, 42921, 145371, 522-2375; 8737, KEL, 42923, 145373, 1-556; 8737, KEL, 42924, 145374, 96-649; 8737, KEL, 42925, 145375, 175-786; 8737, KEL, 42927, 145377, 1-556; 8737, KEL, 42928, 145378, 175-786; 8737, KEL, 42929, 145379, 96-649; 8737, KEL, 42922, 145372, 476-2674; 8737, KEL, 42926, 145376, 476-2674; 8738, KRT1, 42930, 145380, 60-1994; 8739, KRT10, 42931, 145381, 11-1765; 8740, KRT12, 42932, 145382, 25-1509; 8740, KRT12, 42933, 145383, 25-1509; 8741, KRT13, 42936, 145386, 78-572; 8741, KRT13, 42937, 145387, 63-254; 8741, KRT13, 42938, 145388, 64-549; 8741, KRT13, 42939, 145389, 64-1311; 8741, KRT13, 42934, 145384, 48-1424; 8741, KRT13, 42935, 145385, 48-1310; 8742, KRT14, 42940, 145390, 88-1506; 8743, KRT15, 42942, 145392, 2605-3480; 8743, KRT15, 42944, 145394, 242-903; 8743, KRT15, 42945, 145395, 472-717; 8743, KRT15, 42946, 145396, 182-331; 8743, KRT15, 42941, 145391, 3587-4957; 8743, KRT15, 42943, 145393, 747-2117; 8744, KRT16, 42948, 145398, 354-499; 8744, KRT16, 42949, 145399, 423-910; 8744, KRT16, 42947, 145397, 66-1487; 8745, KRT17, 42951, 145401, 238-1287; 8745, KRT17, 42952, 145402, 420-566; 8745, KRT17, 42953, 145403, 1-695; 8745, KRT17, 42954, 145404, 413-697; 8745, KRT17, 42950, 145400, 69-1367; 8746, KRT18, 42957, 145407, 55-1230; 8746, KRT18, 42955, 145405, 211-1503; 8746, KRT18, 42956, 145406, 70-1362; 8747, KRT19, 42959, 145409, 53-641; 8747, KRT19, 42960, 145410, 186-728; 8747, KRT19, 42958, 145408, 62-1264; 8748, KRT2, 42961, 145411, 23-1942; 8749, KRT20, 42962, 145412, 43-1317; 8749, KRT20, 42963, 145413, 43-1317; 8750, KRT222, 42964, 145414, 58-234; 8750, KRT222, 42966, 145416, 47-223; 8750, KRT222, 42967, 145417, 83-259; 8750, KRT222, 42965, 145415, 43-930; 8751, KRT23, 42972, 145422, 473-586; 8751, KRT23, 42973, 145423, 1-450; 8751, KRT23, 42974, 145424, 348-461; 8751, KRT23, 42975, 145425, 473-586; 8751, KRT23, 42976, 145426, 1-450; 8751, KRT23, 42977, 145427, 348-461; 8751, KRT23, 42978, 145428, 710-865; 8751, KRT23, 42979, 145429, 710-865; 8751, KRT23, 42968, 145418, 426-1694; 8751, KRT23, 42969, 145419, 339-1196; 8751, KRT23, 42970, 145420, 426-1694; 8751, KRT23, 42971, 145421, 339-1196; 8752, KRT24, 42980, 145430, 58-1635; 8753, KRT25, 42981, 145431, 62-1414; 8754, KRT26, 42982, 145432, 50-1456; 8755, KRT27, 42983, 145433, 42-1421; 8756, KRT28, 42984, 145434, 67-1461; 8757, KRT3, 42985, 145435, 76-1962; 8758, KRT31, 42986, 145436, 54-1304; 8758, KRT31, 42987, 145437, 54-1304; 8759, KRT32, 42988, 145438, 105-1451; 8760, KRT33A, 42989, 145439, 46-1260; 8760, KRT33A, 42990, 145440, 46-1260; 8761, KRT33B, 42991, 145441, 51-1265; 8761, KRT33B, 42992, 145442, 51-1265; 8762, KRT34, 42994, 145444, 32-1342; 8762, KRT34, 42993, 145443, 32-1342; 8763, KRT35, 42995, 145445, 134-1411; 8763, KRT35, 42996, 145446, 44-1411; 8764, KRT36, 42997, 145447, 1-1404; 8764, KRT36, 42998, 145448, 214-1467; 8765, KRT37, 42999, 145449, 1-1350; 8765, KRT37, 43000, 145450, 1-1350; 8766, KRT38, 43001, 145451, 1-1371; 8767, KRT39, 43004, 145454, 31-585; 8767, KRT39, 43005, 145455, 31-585; 8767, KRT39, 43002, 145452, 37-1512; 8767, KRT39, 43003, 145453, 37-1512; 8768, KRT4, 43006, 145456, 59-319; 8768, KRT4, 43008, 145458, 59-295; 8768, KRT4, 43007, 145457, 494-2056; 8769, KRT40, 43011, 145461, 153-863; 8769, KRT40, 43012, 145462, 153-863; 8769, KRT40, 43009, 145459, 36-1331; 8769, KRT40, 43010, 145460, 162-1457;

8769, KRT40, 43013, 145463, 162-1457; 8769, KRT40, 43014, 145464, 36-1331; 8770, KRT5, 43016, 145466, 76-611; 8770, KRT5, 43017, 145467, 99-539; 8770, KRT5, 43018, 145468, 1-604; 8770, KRT5, 43019, 145469, 147-542; 8770, KRT5, 43020, 145470, 1-587; 8770, KRT5, 43015, 145465, 392-2164; 8771, KRT6A, 43021, 145471, 70-1764; 8772, KRT6B, 43022, 145472, 49-1743; 8773, KRT6C, 43023, 145473, 49-1743; 8774, KRT7, 43024, 145474, 184-1593; 8775, KRT71, 43025, 145475, 71-1642; 8776, KRT72, 43029, 145479, 1-430; 8776, KRT72, 43030, 145480, 1-574; 8776, KRT72, 43026, 145476, 87-1622; 8776, KRT72, 43027, 145477, 87-1496; 8776, KRT72, 43028, 145478, 12-1547; 8777, KRT73, 43032, 145482, 1-858; 8777, KRT73, 43031, 145481, 36-1658; 8778, KRT74, 43034, 145484, 40-1671; 8778, KRT74, 43033, 145483, 49-1638; 8779, KRT75, 43035, 145485, 222-1877; 8780, KRT76, 43036, 145486, 55-1971; 8781, KRT77, 43038, 145488, 30-776; 8781, KRT77, 43037, 145487, 30-1766; 8782, KRT78, 43041, 145491, 1-124; 8782, KRT78, 43039, 145489, 65-1627; 8782, KRT78, 43040, 145490, 13-1245; 8783, KRT79, 43043, 145493, 1-360; 8783, KRT79, 43042, 145492, 36-1643; 8784, KRT8, 43045, 145495, 51-918; 8784, KRT8, 43048, 145498, 345-1165; 8784, KRT8, 43049, 145499, 1-106; 8784, KRT8, 43051, 145501, 226-765; 8784, KRT8, 43052, 145502, 185-523; 8784, KRT8, 43053, 145503, 149-247; 8784, KRT8, 43044, 145494, 197-1648; 8784, KRT8, 43046, 145496, 157-1608; 8784, KRT8, 43047, 145497, 434-1885; 8784, KRT8, 43050, 145500, 21-1556; 8785, KRT80, 43054, 145504, 99-1367; 8785, KRT80, 43055, 145505, 99-1457; 8786, KRT81, 43057, 145507, 51-1505; 8786, KRT81, 43056, 145506, 70-1587; 8787, KRT82, 43058, 145508, 79-1620; 8788, KRT83, 43059, 145509, 64-1545; 8789, KRT84, 43060, 145510, 68-1870; 8790, KRT85, 43062, 145512, 203-1090; 8790, KRT85, 43061, 145511, 77-1600; 8791, KRT86, 43065, 145515, 134-562; 8791, KRT86, 43063, 145513, 53-1513; 8791, KRT86, 43064, 145514, 179-1639; 8792, KRT9, 43067, 145517, 232-1404; 8792, KRT9, 43066, 145516, 67-1938; 8793, KRTAP10-1, 43068, 145518, 46-894; 8794, KRTAP10-10, 43069, 145519, 63-818; 8795, KRTAP10-11, 43070, 145520, 46-942; 8796, KRTAP10-12, 43072, 145522, 1-282; 8796, KRTAP10-12, 43071, 145521, 31-768; 8797, KRTAP10-2, 43073, 145523, 48-815; 8798, KRTAP10-3, 43074, 145524, 46-711; 8799, KRTAP10-4, 43075, 145525, 31-1236; 8800, KRTAP10-5, 43076, 145526, 27-842; 8801, KRTAP10-6, 43078, 145528, 30-764; 8801, KRTAP10-6, 43077, 145527, 22-1119; 8802, KRTAP10-7, 43080, 145530, 31-768; 8802, KRTAP10-7, 43079, 145529, 26-1138; 8803, KRTAP10-8, 43081, 145531, 23-802; 8804, KRTAP10-9, 43083, 145533, 25-603; 8804, KRTAP10-9, 43082, 145532, 50-928; 8805, KRTAP1-1, 43084, 145534, 65-598; 8805, KRTAP1-1, 43085, 145535, 65-598; 8806, KRTAP11-1, 43086, 145536, 32-523; 8807, KRTAP12-1, 43087, 145537, 41-331; 8808, KRTAP12-2, 43088, 145538, 42-482; 8809, KRTAP12-3, 43090, 145540, 1-441; 8809, KRTAP12-3, 43089, 145539, 49-339; 8810, KRTAP12-4, 43091, 145541, 46-384; 8811, KRTAP1-3, 43092, 145542, 35-538; 8811, KRTAP1-3, 43093, 145543, 35-538; 8812, KRTAP13-1, 43094, 145544, 14-532; 8813, KRTAP13-2, 43096, 145546, 1-486; 8813, KRTAP13-2, 43095, 145545, 45-572; 8814, KRTAP13-3, 43097, 145547, 57-575; 8815, KRTAP13-4, 43098, 145548, 47-529; 8816, KRTAP1-4, 43099, 145549, 27-392; 8816, KRTAP1-4, 43100, 145550, 27-392; 8817, KRTAP1-5, 43101, 145551, 48-572; 8817, KRTAP1-5, 43102, 145552, 48-572; 8818, KRTAP15-1, 43103, 145553, 54-467; 8819, KRTAP16-1, 43104, 145554, 1-1554; 8819, KRTAP16-1, 43105, 145555, 1-1554; 8820, KRTAP17-1, 43106, 145556, 46-363; 8820, KRTAP17-1, 43107, 145557, 46-363; 8821, KRTAP19-1, 43108, 145558, 28-300; 8822, KRTAP19-2, 43109, 145559, 89-247; 8823, KRTAP19-3, 43111, 145561, 1-216; 8823, KRTAP19-3, 43110, 145560, 29-274; 8824, KRTAP19-4, 43112, 145562, 24-278; 8825, KRTAP19-5, 43113, 145563, 28-246; 8826, KRTAP19-6, 43114, 145564, 32-208; 8827, KRTAP19-7, 43116, 145566, 1-216; 8827, KRTAP19-7, 43115, 145565, 26-217; 8828, KRTAP19-8, 43117, 145567, 34-225; 8829, KRTAP20-1, 43118, 145568, 31-201; 8830, KRTAP20-2, 43119, 145569, 29-226; 8831, KRTAP20-3, 43120, 145570, 26-160; 8832, KRTAP20-4, 43121, 145571, 32-166; 8833, KRTAP2-1, 43123, 145573, 1-375; 8833, KRTAP2-1, 43125, 145575, 1-375; 8833, KRTAP2-1, 43122, 145572, 50-436; 8833, KRTAP2-1, 43124, 145574, 50-436; 8834, KRTAP21-1, 43126, 145576, 51-290; 8835, KRTAP21-2, 43127, 145577, 32-283; 8836, KRTAP21-3, 43128, 145578, 19-195; 8837, KRTAP2-2, 43130, 145580, 1-390; 8837, KRTAP2-2, 43131, 145581, 49-435; 8837, KRTAP2-2, 43132, 145582, 1-372; 8837, KRTAP2-2, 43129, 145579, 20-391; 8838, KRTAP22-1, 43133, 145583, 35-181; 8839, KRTAP22-2, 43134, 145584, 24-161; 8840, KRTAP2-3, 43135, 145585, 65-451; 8840, KRTAP2-3, 43136, 145586, 65-451; 8841, KRTAP23-1, 43137, 145587, 4-201; 8842, KRTAP2-4, 43138, 145588, 35-421; 8842, KRTAP2-4, 43139, 145589, 35-421; 8843, KRTAP24-1, 43140, 145590, 27-791; 8844, KRTAP25-1, 43141, 145591, 25-333; 8845, KRTAP26-1, 43142, 145592, 282-914; 8846, KRTAP27-1, 43143, 145593, 27-650; 8847, KRTAP29-1, 43144, 145594, 1-1026; 8847, KRTAP29-1, 43145, 145595, 1-1026; 8847, KRTAP29-1, 43146, 145596, 1-1026; 8848, KRTAP3-1, 43147, 145597, 41-337; 8848, KRTAP3-1, 43148, 145598, 41-337; 8849, KRTAP3-2, 43149, 145599, 42-338; 8849, KRTAP3-2, 43150, 145600, 42-338; 8850, KRTAP3-3, 43151, 145601, 37-333; 8850, KRTAP3-3, 43152, 145602, 37-333; 8851, KRTAP4-1, 43154, 145604, 42-425; 8851, KRTAP4-1, 43153, 145603, 489-929; 8852, KRTAP4-11, 43157, 145607, 27-659; 8852, KRTAP4-11, 43155, 145605, 46-633; 8852, KRTAP4-11, 43156, 145606, 46-633; 8853, KRTAP4-12, 43158, 145608, 46-651; 8853, KRTAP4-12, 43159, 145609, 46-651; 8854, KRTAP4-16P, 43160, 145610, 1-708; 8854, KRTAP4-16P, 43161, 145611, 1-708; 8855, KRTAP4-2, 43162, 145612, 45-455; 8856, KRTAP4-3, 43163, 145613, 23-610; 8857, KRTAP4-4, 43164, 145614, 41-541; 8858, KRTAP4-5, 43165, 145615, 36-581; 8859, KRTAP4-6, 43166, 145616, 1-618; 8860, KRTAP4-7, 43168, 145618, 1-423; 8860, KRTAP4-7, 43169, 145619, 27-644; 8860, KRTAP4-7, 43167, 145617, 58-525; 8861, KRTAP4-8, 43170, 145620, 1-468; 8861, KRTAP4-8, 43172, 145622, 1-588; 8861, KRTAP4-8, 43173, 145623, 41-598; 8861, KRTAP4-8, 43171, 145621, 58-615; 8862, KRTAP4-9, 43175, 145625, 58-690; 8862, KRTAP4-9, 43176, 145626, 1-558; 8862, KRTAP4-9, 43174, 145624, 58-690; 8863, KRTAP5-1, 43177, 145627, 35-871; 8863, KRTAP5-1, 43178, 145628, 35-871; 8863, KRTAP5-1, 43179, 145629, 35-871; 8864, KRTAP5-10, 43180, 145630, 1-504; 8864, KRTAP5-10, 43181, 145631, 26-634; 8865, KRTAP5-11, 43183, 145633, 1-531; 8865, KRTAP5-11, 43184, 145634, 1-558; 8865, KRTAP5-11, 43182, 145632, 39-509; 8866, KRTAP5-2, 43185, 145635, 45-578; 8866, KRTAP5-2, 43186, 145636, 45-578; 8866, KRTAP5-2, 43187, 145637, 45-578; 8867, KRTAP5-3, 43190, 145640, 1-510; 8867, KRTAP5-3, 43188, 145638, 79-795; 8867, KRTAP5-3, 43189, 145639, 79-795; 8867, KRTAP5-3, 43191, 145641, 79-795; 8868, KRTAP5-4, 43192, 145642, 46-732; 8868, KRTAP5-4, 43193, 145643, 1-660; 8868, KRTAP5-4, 43194, 145644, 1-660; 8868, KRTAP5-4, 43195, 145645, 1-564; 8868, KRTAP5-4, 43196, 145646, 35-532; 8868, KRTAP5-4, 43198, 145648, 46-732; 8868, KRTAP5-4, 43197, 145647, 46-912; 8869, KRTAP5-5, 43200, 145650, 1-558; 8869, KRTAP5-5, 43202, 145652, 67-732; 8869, KRTAP5-5, 43199, 145649, 67-780; 8869, KRTAP5-5, 43201, 145651, 67-780; 8870, KRTAP5-6, 43203, 145653, 52-441; 8870, KRTAP5-6, 43204, 145654, 52-441; 8871, KRTAP5-7, 43205, 145655, 35-532; 8872, KRTAP5-8, 43206, 145656, 32-595; 8873, KRTAP5-9, 43207, 145657, 241-750; 8874, KRTAP6-1, 43208, 145658, 27-242; 8875, KRTAP6-2, 43209, 145659, 29-217; 8876, KRTAP6-3, 43210, 145660, 7-339; 8877, KRTAP7-1, 43211, 145661, 62-325; 8878, KRTAP8-1, 43212, 145662, 33-224; 8879, KRTAP9-1, 43214, 145664, 1-351; 8879, KRTAP9-1, 43215, 145665, 1-369; 8879, KRTAP9-1, 43216, 145666, 1-330; 8879, KRTAP9-1, 43213, 145663, 1-753; 8880, KRTAP9-2, 43219, 145669, 8-532; 8880, KRTAP9-2, 43220, 145670, 28-492; 8880, KRTAP9-2, 43217, 145667, 8-532; 8880, KRTAP9-2, 43218, 145668, 8-532; 8881, KRTAP9-3, 43221, 145671, 40-519; 8881, KRTAP9-3, 43222, 145672, 40-519; 8882, KRTAP9-4, 43223, 145673, 35-499; 8882, KRTAP9-4, 43224, 145674, 35-499; 8882, KRTAP9-4, 43225, 145675, 35-499; 8883, KRTAP9-6, 43227, 145677, 1-525; 8883, KRTAP9-6, 43226, 145676, 40-522; 8883, KRTAP9-6, 43228, 145678, 40-522; 8884, KRTAP9-7, 43229, 145679, 40-549; 8884, KRTAP9-7, 43230, 145680, 40-549; 8885, KRTAP9-8, 43232, 145682, 28-522; 8885, KRTAP9-8, 43231, 145681, 8-487; 8886, KRTAP9-9, 43235, 145685, 1-525; 8886, KRTAP9-9, 43237, 145687, 3-467; 8886, KRTAP9-9, 43238, 145688, 29-553; 8886, KRTAP9-9, 43239, 145689, 3-512; 8886, KRTAP9-9, 43240, 145690, 25-504; 8886, KRTAP9-9, 43233, 145683, 3-512; 8886, KRTAP9-9, 43234, 145684, 3-512; 8886, KRTAP9-9, 43236, 145686, 3-467; 8886, KRTAP9-9, 43241, 145691, 3-467; 8887, RP5-1028K7.3, 43242, 145692, 43-930; 8888, KRTCAP2, 43243, 145693, 32-520; 8889, KRTCAP3, 43246, 145696, 1-189; 8889, KRTCAP3, 43247, 145697, 16-222; 8889, KRTCAP3, 43244, 145694, 33-755; 8889, KRTCAP3, 43245, 145695, 160-828; 8889, KRTCAP3, 43248, 145698, 48-770; 8890, KDF1, 43250, 145700, 69-692; 8890, KDF1, 43249, 145699, 90-1286; 8891, KRTDAP, 43251, 145701, 90-389; 8891, KRTDAP, 43252, 145702, 90-347; 8892, KPRP, 43253, 145703, 29-1768; 8893, KERA, 43254, 145704, 249-1307; 8894, KHK, 43257, 145707, 467-1303; 8894, KHK, 43255, 145705, 479-1375; 8894, KHK, 43256, 145706, 514-1410; 8895, KHNYN, 43260, 145710, 508-911; 8895, KHNYN, 43262, 145712, 249-620; 8895, KHNYN, 43258, 145708, 140-2176; 8895, KHNYN, 43259, 145709, 200-2236; 8895, KHNYN, 43261, 145711, 75-2111; 8896, KHDC3L, 43263, 145713, 54-707; 8897, KHDRBS1, 43264, 145714, 168-1499; 8897, KHDRBS1, 43265, 145715, 1-1215; 8898, KHDRBS2, 43266, 145716, 280-1329; 8899, KHDRBS3, 43268, 145718, 1-585; 8899, KHDRBS3, 43269, 145719, 1-589; 8899, KHDRBS3, 43270, 145720, 358-717; 8899, KHDRBS3, 43271, 145721, 1-179; 8899, KHDRBS3, 43272, 145722, 198-679; 8899, KHDRBS3, 43273, 145723, 94-889; 8899, KHDRBS3, 43267, 145717, 411-1451; 8900, KHDC1, 43276, 145726, 253-547; 8900, KHDC1, 43278, 145728, 45-431; 8900, KHDC1, 43274, 145724, 425-919; 8900, KHDC1, 43275, 145725, 502-1215; 8900, KHDC1, 43277, 145727, 395-889; 8901, KHDC1L, 43279, 145729, 45-431; 8902, KHSRP, 43281, 145731, 324-672; 8902, KHSRP, 43282, 145732, 1-344; 8902, KHSRP, 43283, 145733, 295-801; 8902, KHSRP, 43284, 145734, 1-530; 8902, KHSRP, 43285, 145735, 1-837; 8902, KHSRP, 43286, 145736, 1-239; 8902, KHSRP, 43287, 145737, 1-432; 8902, KHSRP, 43288, 145738, 1-809; 8902, KHSRP, 43289, 145739, 75-2210; 8902, KHSRP, 43280, 145730, 94-2229; 8903, KIAA0040, 43290, 145740, 538-837; 8903, KIAA0040, 43291, 145741, 468-767; 8903, KIAA0040, 43292, 145742, 425-724; 8903, KIAA0040, 43293, 145743, 697-1158; 8904, KIAA0100, 43295, 145745, 392-6670; 8904, KIAA0100, 43296, 145746, 93-353; 8904, KIAA0100, 43297, 145747, 1-65; 8904, KIAA0100, 43298, 145748, 392-6670; 8904, KIAA0100, 43299, 145749, 1-862; 8904, KIAA0100, 43294, 145744, 76-6783; 8905, KIAA0101, 43302, 145752, 71-325; 8905, KIAA0101, 43303, 145753, 68-415; 8905, KIAA0101, 43304, 145754, 140-487; 8905, KIAA0101, 43300, 145750, 140-475; 8905, KIAA0101, 43301, 145751, 74-271; 8906, KIAA0141, 43307, 145757, 33-998; 8906, KIAA0141, 43308, 145758, 1-651; 8906, KIAA0141, 43305, 145755, 88-1635; 8906, KIAA0141, 43306, 145756, 135-1682; 8907, KIAA0196, 43310, 145760, 369-859; 8907, KIAA0196, 43311, 145761, 282-3317; 8907, KIAA0196, 43309, 145759, 351-3830; 8908, KIAA0226L, 43312, 145762, 420-1937; 8908, KIAA0226L, 43315, 145765, 478-1821; 8908, KIAA0226L, 43317, 145767, 1062-2579; 8908, KIAA0226L, 43319, 145769, 106-494; 8908, KIAA0226L, 43320, 145770, 341-1204; 8908, KIAA0226L, 43321, 145771, 438-972; 8908, KIAA0226L, 43313, 145763, 153-1940; 8908, KIAA0226L, 43314, 145764, 476-2383; 8908, KIAA0226L, 43316, 145766, 584-2572; 8908, KIAA0226L, 43318, 145768, 606-2594; 8908, KIAA0226L, 43322, 145772, 260-1843; 8909, KIAA0232, 43325, 145775, 470-696; 8909, KIAA0232, 43323, 145773, 456-4643; 8909, KIAA0232, 43324, 145774, 380-4567; 8910, KIAA0319, 43331, 145781, 803-2254; 8910, KIAA0319, 43326, 145776, 526-3744; 8910, KIAA0319, 43327, 145777, 476-3559; 8910, KIAA0319, 43328, 145778, 353-3571; 8910, KIAA0319, 43329, 145779, 526-3561; 8910, KIAA0319, 43330, 145780, 644-3835; 8911, KIAA0319L, 43333, 145783, 128-1588; 8911, KIAA0319L, 43334, 145784, 1-912; 8911, KIAA0319L, 43335, 145785, 135-3213; 8911, KIAA0319L, 43336, 145786, 117-2171; 8911, KIAA0319L, 43337, 145787, 198-431; 8911, KIAA0319L, 43338, 145788, 71-889; 8911, KIAA0319L, 43339, 145789, 228-766; 8911, KIAA0319L, 43340, 145790, 387-1421; 8911, KIAA0319L, 43341, 145791, 269-1303; 8911, KIAA0319L, 43332, 145782, 236-3385; 8912, KIAA0355, 43343, 145793, 489-582; 8912, KIAA0355, 43344, 145794, 400-632; 8912, KIAA0355, 43345, 145795, 874-1350; 8912, KIAA0355, 43346, 145796, 489-582; 8912, KIAA0355, 43347, 145797, 400-504; 8912, KIAA0355, 43348, 145798, 1-388; 8912, KIAA0355, 43342, 145792, 874-4086; 8913, KIAA0368, 43349, 145799, 1-6054; 8913, KIAA0368, 43351, 145801, 1-429; 8913, KIAA0368, 43352, 145802, 137-2806; 8913, KIAA0368, 43353, 145803, 156-539; 8913, KIAA0368, 43350, 145800, 221-5740; 8914, KIAA0391, 43357, 145807, 235-789; 8914, KIAA0391, 43361, 145811, 494-552; 8914, KIAA0391, 43362, 145812, 509-578; 8914, KIAA0391, 43363, 145813, 502-603; 8914, KIAA0391, 43354, 145804, 367-2070; 8914, KIAA0391, 43355, 145805, 442-1077; 8914, KIAA0391, 43356, 145806, 361-2112; 8914, KIAA0391, 43358, 145808, 425-2128; 8914, KIAA0391, 43359, 145809, 320-955; 8914, KIAA0391, 43360, 145810, 116-1582; 8915, KIAA0408, 43364, 145814, 312-1068; 8915, KIAA0408, 43366, 145816, 1-267; 8915, KIAA0408, 43365, 145815, 338-2422; 8916, KIAA0430, 43368, 145818, 66-4799; 8916, KIAA0430, 43369, 145819, 89-581; 8916, KIAA0430, 43370, 145820, 1-59; 8916, KIAA0430, 43371, 145821, 1-3114; 8916, KIAA0430, 43375, 145825, 1-3114; 8916, KIAA0430, 43378, 145828, 89-581; 8916, KIAA0430, 43379, 145829, 1-59; 8916, KIAA0430, 43380, 145830, 59-4792; 8916, KIAA0430, 43367, 145817, 208-5436; 8916, KIAA0430, 43372, 145822, 150-5369; 8916, KIAA0430, 43373, 145823, 150-5378; 8916, KIAA0430, 43374, 145824, 208-5436; 8916, KIAA0430, 43376, 145826, 150-5369; 8916, KIAA0430, 43377, 145827, 150-5378; 8917, KIAA0513, 43383, 145833, 1-597; 8917, KIAA0513, 43384, 145834, 1-342; 8917, KIAA0513, 43381, 145831, 274-1509; 8917, KIAA0513, 43382, 145832, 281-1486; 8917, KIAA0513, 43385, 145835, 221-1126; 8917, KIAA0513, 43386, 145836, 632-1867; 8918, KIAA0556, 43388, 145838, 1-746; 8918, KIAA0556, 43389, 145839, 1-167; 8918, KIAA0556, 43390, 145840, 1-333; 8918, KIAA0556, 43387, 145837, 20-4876; 8919, KIAA0586, 43394, 145844, 143-846; 8919, KIAA0586, 43395, 145845, 1-627; 8919, KIAA0586, 43396, 145846, 187-582; 8919, KIAA0586, 43398, 145848, 187-456; 8919, KIAA0586, 43400, 145850, 310-4701; 8919, KIAA0586, 43391, 145841, 276-4694; 8919, KIAA0586, 43392, 145842, 245-5179; 8919, KIAA0586, 43393, 145843, 259-4773; 8919, KIAA0586, 43397, 145847, 502-5016; 8919, KIAA0586, 43399, 145849, 275-4876; 8920, KIAA0753, 43402, 145852, 1-137; 8920, KIAA0753, 43403, 145853, 600-815; 8920, KIAA0753, 43404, 145854, 329-590; 8920, KIAA0753, 43405, 145855, 1-210; 8920, KIAA0753, 43407, 145857, 1-390; 8920, KIAA0753, 43408, 145858, 71-817; 8920, KIAA0753, 43401, 145851, 360-3263; 8920, KIAA0753, 43406, 145856, 899-2905; 8921, KIAA0825, 43410, 145860, 258-3968; 8921, KIAA0825, 43411, 145861, 74-3901; 8921, KIAA0825, 43409, 145859, 251-1225; 8922, KIAA0895, 43416, 145866, 74-901; 8922, KIAA0895, 43417, 145867, 13-437; 8922, KIAA0895, 43419, 145869, 312-603; 8922, KIAA0895, 43412, 145862, 52-1614; 8922, KIAA0895, 43413, 145863, 302-1711; 8922, KIAA0895, 43414, 145864, 72-1595; 8922, KIAA0895, 43415, 145865, 435-1688; 8922, KIAA0895, 43418, 145868, 262-1815; 8922, KIAA0895, 43420, 145870, 332-1246; 8923, KIAA0895L, 43424, 145874, 1-616; 8923, KIAA0895L, 43421, 145871, 928-2343; 8923, KIAA0895L, 43422, 145872, 737-2152; 8923, KIAA0895L, 43423, 145873, 888-2114; 8924, KIAA0907, 43425, 145875, 1-1155; 8924, KIAA0907, 43426, 145876, 27-1721; 8924, KIAA0907, 43427, 145877, 25-1869; 8925, KIAA0922, 43428, 145878, 1-4164; 8925, KIAA0922, 43431, 145881, 51-266; 8925, KIAA0922, 43429, 145879, 53-4882; 8925, KIAA0922, 43430, 145880, 50-4882; 8926, KIAA0930, 43435, 145885, 170-625; 8926, KIAA0930, 43436, 145886, 40-294; 8926, KIAA0930, 43437, 145887, 1-870; 8926, KIAA0930, 43438, 145888, 1-213; 8926, KIAA0930, 43439, 145889, 147-556; 8926, KIAA0930, 43440, 145890, 75-332; 8926, KIAA0930, 43441, 145891, 248-517; 8926, KIAA0930, 43432, 145882, 146-1375; 8926, KIAA0930, 43433, 145883, 67-1281; 8926, KIAA0930, 43434, 145884, 163-1275; 8927, KIAA1024, 43443, 145893, 53-2617; 8927, KIAA1024, 43442, 145892, 76-2826; 8928, KIAA1024L, 43444, 145894, 113-685; 8929, KIAA1033, 43446, 145896, 228-575; 8929, KIAA1033, 43447, 145897, 87-656; 8929, KIAA1033, 43448, 145898, 214-359; 8929, KIAA1033, 43449, 145899, 452-576; 8929, KIAA1033, 43450, 145900, 257-445; 8929, KIAA1033, 43451, 145901, 88-3612; 8929, KIAA1033, 43445, 145895, 88-3609; 8930, KIAA1107, 43452, 145902, 99-4163; 8931, KIAA1109, 43454, 145904, 1-4145; 8931, KIAA1109, 43456, 145906, 1-4915; 8931, KIAA1109, 43457, 145907, 1-4343; 8931, KIAA1109, 43458, 145908, 1-592; 8931, KIAA1109, 43459, 145909, 1-3741; 8931, KIAA1109, 43460, 145910, 1-624; 8931, KIAA1109, 43461, 145911, 1-5025; 8931, KIAA1109, 43462, 145912, 1-492; 8931, KIAA1109, 43453, 145903, 374-15391; 8931, KIAA1109, 43455, 145905, 46-15063; 8932, N/A, 43464, 145914, 61-525; 8932, KIAA1143, 43463, 145913, 61-525; 8933, KIAA1147, 43465, 145915, 66-1121; 8933, KIAA1147, 43468, 145918, 66-1121; 8933, KIAA1147, 43466, 145916, 1-1368; 8933, KIAA1147, 43467, 145917, 1-1368; 8934, KIAA1161, 43470, 145920, 1-480; 8934, KIAA1161, 43469, 145919, 125-2269; 8935, KIAA1191, 43474, 145924, 226-512; 8935, KIAA1191, 43475, 145925, 430-639; 8935, KIAA1191, 43476, 145926, 291-486; 8935, KIAA1191, 43477, 145927, 331-453; 8935, KIAA1191, 43478, 145928, 243-917; 8935, KIAA1191, 43471, 145921, 535-1452; 8935, KIAA1191, 43472, 145922, 302-1162; 8935, KIAA1191, 43473, 145923, 220-1137; 8935, KIAA1191, 43479, 145929, 236-1096; 8936, KIAA1210, 43480, 145930, 1-5130; 8937, KIAA1211, 43483, 145933, 149-3829; 8937, KIAA1211, 43484, 145934, 1-257; 8937, KIAA1211, 43485, 145935, 720-830; 8937, KIAA1211, 43481, 145931, 392-4093; 8937, KIAA1211, 43482, 145932, 106-3807; 8938, KIAA1211L, 43487, 145937, 340-921; 8938, KIAA1211L, 43488, 145938, 200-735; 8938, KIAA1211L, 43489, 145939, 212-1017; 8938, KIAA1211L, 43490, 145940, 631-742; 8938, KIAA1211L, 43491, 145941, 307-2127; 8938, KIAA1211L, 43486, 145936, 333-3221; 8939, KIAA1217, 43496, 145946, 404-3203; 8939, KIAA1217, 43502, 145952, 240-2589; 8939, KIAA1217, 43503, 145953, 28-568; 8939, KIAA1217, 43504, 145954, 1-1358; 8939, KIAA1217, 43492, 145942, 333-3131; 8939, KIAA1217, 43493, 145943, 261-4658; 8939, KIAA1217, 43494, 145944, 404-4528; 8939, KIAA1217, 43495, 145945, 31-5862; 8939, KIAA1217, 43497, 145947, 810-4604; 8939, KIAA1217, 43498, 145948, 261-2981; 8939, KIAA1217, 43499, 145949, 261-2861; 8939, KIAA1217, 43500, 145950, 644-4438; 8939, KIAA1217, 43501, 145951, 404-4453; 8940, KIAA1257, 43507, 145957, 773-1975; 8940, KIAA1257, 43505, 145955, 169-1398; 8940, KIAA1257, 43506, 145956, 494-1387; 8941, KIAA1324, 43509, 145959, 78-2782; 8941, KIAA1324, 43510, 145960, 291-564; 8941, KIAA1324, 43511, 145961, 136-750; 8941, KIAA1324, 43512, 145962, 16-204; 8941, KIAA1324, 43513, 145963, 114-570; 8941, KIAA1324, 43514, 145964, 1-249; 8941, KIAA1324, 43516, 145966, 87-553; 8941, KIAA1324, 43508, 145958, 184-3225; 8941, KIAA1324, 43515, 145965, 30-2810; 8942, KIAA1324L, 43517, 145967, 1-256; 8942, KIAA1324L, 43518, 145968, 228-563; 8942, KIAA1324L, 43519, 145969, 1-239; 8942, KIAA1324L, 43520, 145970, 119-2995; 8942, KIAA1324L, 43522, 145972, 1-2911; 8942, KIAA1324L, 43523, 145973, 316-576; 8942, KIAA1324L, 43521, 145971, 197-2785; 8942, KIAA1324L, 43524, 145974, 187-3276; 8943, KIAA1328, 43526, 145976, 11-502; 8943, KIAA1328, 43528, 145978, 1-1805; 8943, KIAA1328, 43529, 145979, 9-254; 8943, KIAA1328, 43531, 145981, 34-279; 8943, KIAA1328, 43532, 145982, 461-496; 8943, KIAA1328, 43525, 145975, 23-1756; 8943, KIAA1328, 43527, 145977, 787-2508; 8943, KIAA1328, 43530, 145980, 695-1534; 8943, KIAA1328, 43533, 145983, 301-690; 8944, KIAA1429, 43536, 145986, 1-274; 8944, KIAA1429, 43537, 145987, 1-2193; 8944, KIAA1429, 43538, 145988, 1-183; 8944, KIAA1429, 43534, 145984, 77-5515; 8944, KIAA1429, 43535, 145985, 83-3526; 8945, KIAA1456, 43539, 145989, 506-668; 8945, KIAA1456, 43541, 145991, 330-920; 8945,

KIAA1456, 43542, 145992, 924-1106; 8945, KIAA1456, 43543, 145993, 515-697; 8945, KIAA1456, 43540, 145990, 490-1854; 8946, KIAA1462, 43544, 145994, 103-4182; 8947, KIAA1468, 43547, 145997, 1-764; 8947, KIAA1468, 43548, 145998, 216-3268; 8947, KIAA1468, 43545, 145995, 249-4001; 8947, KIAA1468, 43546, 145996, 233-3883; 8948, KIAA1522, 43549, 145999, 137-568; 8948, KIAA1522, 43550, 146000, 104-3211; 8948, KIAA1522, 43551, 146001, 70-3210; 8948, KIAA1522, 43552, 146002, 71-3355; 8949, KIAA1524, 43554, 146004, 78-443; 8949, KIAA1524, 43555, 146005, 82-228; 8949, KIAA1524, 43557, 146007, 37-2757; 8949, KIAA1524, 43558, 146008, 1-147; 8949, KIAA1524, 43553, 146003, 78-2795; 8949, KIAA1524, 43556, 146006, 474-2714; 8950, KIAA1549, 43559, 146009, 50-5854; 8950, KIAA1549, 43560, 146010, 50-5902; 8951, KIAA1549L, 43563, 146013, 1-2507; 8951, KIAA1549L, 43561, 146011, 125-3832; 8951, KIAA1549L, 43562, 146012, 181-5730; 8952, KIAA1551, 43565, 146015, 303-2326; 8952, KIAA1551, 43566, 146016, 258-362; 8952, KIAA1551, 43564, 146014, 415-5658; 8953, KIAA1586, 43568, 146018, 225-2507; 8953, KIAA1586, 43567, 146017, 208-2571; 8954, KIAA1614, 43569, 146019, 360-2795; 8954, KIAA1614, 43570, 146020, 56-3628; 8955, KIAA1644, 43571, 146021, 134-733; 8956, KIAA1671, 43572, 146022, 27-5447; 8956, KIAA1671, 43573, 146023, 388-5808; 8956, KIAA1671, 43574, 146024, 398-1339; 8957, KIAA1683, 43578, 146028, 511-533; 8957, KIAA1683, 43579, 146029, 472-537; 8957, KIAA1683, 43580, 146030, 253-535; 8957, KIAA1683, 43581, 146031, 183-632; 8957, KIAA1683, 43582, 146032, 217-2601; 8957, KIAA1683, 43575, 146025, 217-4320; 8957, KIAA1683, 43576, 146026, 195-3737; 8957, KIAA1683, 43577, 146027, 385-3789; 8958, KIAA1715, 43584, 146034, 187-528; 8958, KIAA1715, 43586, 146036, 391-639; 8958, KIAA1715, 43587, 146037, 1-210; 8958, KIAA1715, 43583, 146033, 249-1535; 8958, KIAA1715, 43585, 146035, 317-1234; 8958, KIAA1715, 43588, 146038, 198-1577; 8959, KIAA1755, 43590, 146040, 1-798; 8959, KIAA1755, 43591, 146041, 1-116; 8959, KIAA1755, 43592, 146042, 273-2471; 8959, KIAA1755, 43589, 146039, 273-3875; 8960, KIAA1841, 43596, 146046, 295-645; 8960, KIAA1841, 43593, 146043, 378-2501; 8960, KIAA1841, 43594, 146044, 26-2149; 8960, KIAA1841, 43595, 146045, 242-2398; 8960, KIAA1841, 43597, 146047, 26-2182; 8960, KIAA1841, 43598, 146048, 370-2088; 8961, KIAA1919, 43599, 146049, 354-1910; 8962, KIAA1958, 43600, 146050, 297-2447; 8962, KIAA1958, 43601, 146051, 129-2345; 8962, KIAA1958, 43602, 146052, 176-2410; 8963, KIAA2012, 43603, 146053, 1-1925; 8963, KIAA2012, 43604, 146054, 374-3916; 8964, KIAA2013, 43605, 146055, 187-2091; 8964, KIAA2013, 43606, 146056, 192-2195; 8964, KIAA2013, 43607, 146057, 134-2038; 8965, KIAA2022, 43609, 146059, 1-355; 8965, KIAA2022, 43608, 146058, 613-5163; 8965, KIAA2022, 43610, 146060, 246-4796; 8966, KIAA2026, 43613, 146063, 1-622; 8966, KIAA2026, 43614, 146064, 1-395; 8966, KIAA2026, 43615, 146065, 115-1967; 8966, KIAA2026, 43611, 146061, 1-6222; 8966, KIAA2026, 43612, 146062, 1-6312; 8967, KAAG1, 43616, 146066, 738-992; 8968, KCP, 43617, 146067, 44-4750; 8968, KCP, 43618, 146068, 44-4930; 8968, KCP, 43619, 146069, 44-3871; 8968, KCP, 43620, 146070, 1-4515; 8969, KIF1BP, 43622, 146072, 28-921; 8969, KIF1BP, 43621, 146071, 113-1978; 8970, KIR3DL1, 43623, 146073, 15-1298; 8970, KIR3DL1, 43626, 146076, 34-1401; 8970, KIR3DL1, 43627, 146077, 25-1308; 8970, KIR3DL1, 43628, 146078, 1-1368; 8970, KIR3DL1, 43629, 146079, 64-1398; 8970, KIR3DL1, 43630, 146080, 26-1393; 8970, KIR3DL1, 43631, 146081, 28-1362; 8970, KIR3DL1, 43632, 146082, 34-1368; 8970, KIR3DL1, 43633, 146083, 64-1398; 8970, KIR3DL1, 43634, 146084, 25-1308; 8970, KIR3DL1, 43635, 146085, 25-1308; 8970, KIR3DL1, 43636, 146086, 34-1368; 8970, KIR3DL1, 43637, 146087, 1-1368; 8970, KIR3DL1, 43638, 146088, 64-1398; 8970, KIR3DL1, 43639, 146089, 28-1362; 8970, KIR3DL1, 43640, 146090, 28-1362; 8970, KIR3DL1, 43642, 146092, 26-1360; 8970, KIR3DL1, 43643, 146093, 64-1398; 8970, KIR3DL1, 43644, 146094, 25-1308; 8970, KIR3DL1, 43645, 146095, 34-1401; 8970, KIR3DL1, 43646, 146096, 64-1398; 8970, KIR3DL1, 43647, 146097, 34-1401; 8970, KIR3DL1, 43648, 146098, 34-1368; 8970, KIR3DL1, 43649, 146099, 25-1308; 8970, KIR3DL1, 43650, 146100, 26-1393; 8970, KIR3DL1, 43651, 146101, 34-1401; 8970, KIR3DL1, 43652, 146102, 64-1398; 8970, KIR3DL1, 43653, 146103, 25-1308; 8970, KIR3DL1, 43654, 146104, 34-1401; 8970, KIR3DL1, 43655, 146105, 25-1308; 8970, KIR3DL1, 43656, 146106, 64-1398; 8970, KIR3DL1, 43657, 146107, 64-1398; 8970, KIR3DL1, 43658, 146108, 26-1360; 8970, KIR3DL1, 43659, 146109, 64-1347; 8970, KIR3DL1, 43660, 146110, 64-1398; 8970, KIR3DL1, 43661, 146111, 64-1398; 8970, KIR3DL1, 43662, 146112, 64-1398; 8970, KIR3DL1, 43664, 146114, 25-1308; 8970, KIR3DL1, 43665, 146115, 25-1308; 8970, KIR3DL1, 43666, 146116, 64-1398; 8970, KIR3DL1, 43667, 146117, 1-1368; 8970, KIR3DL1, 43668, 146118, 64-1398; 8970, KIR3DL1, 43669, 146119, 64-1398; 8970, KIR3DL1, 43670, 146120, 28-1362; 8970, KIR3DL1, 43671, 146121, 12-1061; 8970, KIR3DL1, 43672, 146122, 1-1368; 8970, KIR3DL1, 43673, 146123, 25-1308; 8970, KIR3DL1, 43674, 146124, 25-1308; 8970, KIR3DL1, 43675, 146125, 25-1074; 8970, KIR3DL1, 43676, 146126, 28-1362; 8970, KIR3DL1, 43677, 146127, 39-1373; 8970, KIR3DL1, 43678, 146128, 39-1373; 8970, KIR3DL1, 43679, 146129, 39-1373; 8970, KIR3DL1, 43681, 146131, 1-1368; 8970, KIR3DL1, 43682, 146132, 26-1393; 8970, KIR3DL1, 43683, 146133, 25-1308; 8970, KIR3DL1, 43684, 146134, 28-1362; 8970, KIR3DL1, 43685, 146135, 25-1308; 8970, KIR3DL1, 43686, 146136, 25-1308; 8970, KIR3DL1, 43687, 146137, 64-1398; 8970, KIR3DL1, 43689, 146139, 26-1360; 8970, KIR3DL1, 43690, 146140, 1-1368; 8970, KIR3DL1, 43692, 146142, 64-1398; 8970, KIR3DL1, 43624, 146074, 12-1061; 8970, KIR3DL1, 43625, 146075, 34-1368; 8970, KIR3DL1, 43641, 146091, 34-1368; 8970, KIR3DL1, 43663, 146113, 34-1368; 8970, KIR3DL1, 43680, 146130, 64-1398; 8970, KIR3DL1, 43688, 146138, 28-1362; 8970, KIR3DL1, 43691, 146141, 20-1354; 8971, KIR3DL2, 43697, 146147, 34-1350; 8971, KIR3DL2, 43698, 146148, 34-1401; 8971, KIR3DL2, 43699, 146149, 64-1431; 8971, KIR3DL2, 43700, 146150, 26-1393; 8971, KIR3DL2, 43701, 146151, 34-1350; 8971, KIR3DL2, 43702, 146152, 34-1350; 8971, KIR3DL2, 43703, 146153, 31-1398; 8971, KIR3DL2, 43704, 146154, 34-1350; 8971, KIR3DL2, 43705, 146155, 1-1317; 8971, KIR3DL2, 43707, 146157, 31-1398; 8971, KIR3DL2, 43708, 146158, 34-1350; 8971, KIR3DL2, 43709, 146159, 34-1350; 8971, KIR3DL2, 43710, 146160, 31-1398; 8971, KIR3DL2, 43712, 146162, 1-1317; 8971, KIR3DL2, 43714, 146164, 34-1350; 8971, KIR3DL2, 43715, 146165, 34-1350; 8971, KIR3DL2, 43716, 146166, 20-1387; 8971, KIR3DL2, 43718, 146168, 34-1350; 8971, KIR3DL2, 43720, 146170, 34-1350; 8971, KIR3DL2, 43721, 146171, 34-1350; 8971, KIR3DL2, 43723, 146173, 34-1350; 8971, KIR3DL2, 43724, 146174, 34-1350; 8971, KIR3DL2, 43725, 146175, 34-1401; 8971, KIR3DL2, 43726, 146176, 44-398; 8971,

KIR3DL2, 43727, 146177, 1-666; 8971, KIR3DL2, 43728, 146178, 34-1401; 8971, KIR3DL2, 43731, 146181, 34-1350; 8971, KIR3DL2, 43734, 146184, 34-1350; 8971, KIR3DL2, 43735, 146185, 34-1350; 8971, KIR3DL2, 43737, 146187, 31-1398; 8971, KIR3DL2, 43743, 146193, 34-1033; 8971, KIR3DL2, 43744, 146194, 34-1350; 8971, KIR3DL2, 43745, 146195, 31-1398; 8971, KIR3DL2, 43746, 146196, 1-1317; 8971, KIR3DL2, 43747, 146197, 13-1380; 8971, KIR3DL2, 43748, 146198, 31-1398; 8971, KIR3DL2, 43749, 146199, 64-1063; 8971, KIR3DL2, 43750, 146200, 34-1350; 8971, KIR3DL2, 43751, 146201, 34-1350; 8971, KIR3DL2, 43752, 146202, 20-1387; 8971, KIR3DL2, 43753, 146203, 34-1401; 8971, KIR3DL2, 43693, 146143, 1-1317; 8971, KIR3DL2, 43694, 146144, 34-1401; 8971, KIR3DL2, 43695, 146145, 1-1368; 8971, KIR3DL2, 43696, 146146, 20-1387; 8971, KIR3DL2, 43706, 146156, 31-1398; 8971, KIR3DL2, 43711, 146161, 31-1398; 8971, KIR3DL2, 43713, 146163, 34-1401; 8971, KIR3DL2, 43717, 146167, 34-1401; 8971, KIR3DL2, 43719, 146169, 20-1387; 8971, KIR3DL2, 43722, 146172, 34-1350; 8971, KIR3DL2, 43729, 146179, 34-1401; 8971, KIR3DL2, 43730, 146180, 34-1350; 8971, KIR3DL2, 43732, 146182, 34-1401; 8971, KIR3DL2, 43733, 146183, 31-1398; 8971, KIR3DL2, 43736, 146186, 34-1350; 8971, KIR3DL2, 43738, 146188, 34-1401; 8971, KIR3DL2, 43739, 146189, 20-1387; 8971, KIR3DL2, 43740, 146190, 13-1380; 8971, KIR3DL2, 43741, 146191, 34-1350; 8971, KIR3DL2, 43742, 146192, 1-1317; 8972, KIR3DL3, 43754, 146204, 19-1251; 8972, KIR3DL3, 43755, 146205, 19-1251; 8972, KIR3DL3, 43756, 146206, 19-1251; 8972, KIR3DL3, 43757, 146207, 19-1251; 8972, KIR3DL3, 43759, 146209, 51-1283; 8972, KIR3DL3, 43760, 146210, 19-1251; 8972, KIR3DL3, 43761, 146211, 31-1263; 8972, KIR3DL3, 43762, 146212, 51-1283; 8972, KIR3DL3, 43763, 146213, 1-1233; 8972, KIR3DL3, 43764, 146214, 51-1283; 8972, KIR3DL3, 43765, 146215, 51-1283; 8972, KIR3DL3, 43766, 146216, 19-1251; 8972, KIR3DL3, 43767, 146217, 19-1251; 8972, KIR3DL3, 43768, 146218, 19-1251; 8972, KIR3DL3, 43769, 146219, 6-1238; 8972, KIR3DL3, 43770, 146220, 19-1251; 8972, KIR3DL3, 43771, 146221, 19-1251; 8972, KIR3DL3, 43772, 146222, 51-1283; 8972, KIR3DL3, 43773, 146223, 19-1251; 8972, KIR3DL3, 43774, 146224, 19-1251; 8972, KIR3DL3, 43775, 146225, 51-1283; 8972, KIR3DL3, 43776, 146226, 19-1251; 8972, KIR3DL3, 43777, 146227, 20-1297; 8972, KIR3DL3, 43778, 146228, 26-1390; 8972, KIR3DL3, 43779, 146229, 51-1283; 8972, KIR3DL3, 43781, 146231, 51-1283; 8972, KIR3DL3, 43782, 146232, 51-1283; 8972, KIR3DL3, 43783, 146233, 19-1251; 8972, KIR3DL3, 43784, 146234, 19-1251; 8972, KIR3DL3, 43785, 146235, 19-1251; 8972, KIR3DL3, 43786, 146236, 19-1251; 8972, KIR3DL3, 43787, 146237, 1-1164; 8972, KIR3DL3, 43758, 146208, 51-1283; 8972, KIR3DL3, 43780, 146230, 19-1251; 8973, KIR3DP1, 43788, 146238, 2-988; 8973, KIR3DP1, 43789, 146239, 2-988; 8974, KIR3DS1, 43790, 146240, 12-839; 8974, KIR3DS1, 43792, 146242, 26-1393; 8974, KIR3DS1, 43793, 146243, 38-1186; 8974, KIR3DS1, 43795, 146245, 64-1212; 8974, KIR3DS1, 43796, 146246, 38-1204; 8974, KIR3DS1, 43797, 146247, 38-1204; 8974, KIR3DS1, 43799, 146249, 34-1182; 8974, KIR3DS1, 43800, 146250, 1-864; 8974, KIR3DS1, 43801, 146251, 38-1204; 8974, KIR3DS1, 43802, 146252, 14-1162; 8974, KIR3DS1, 43804, 146254, 64-1212; 8974, KIR3DS1, 43805, 146255, 38-1186; 8974, KIR3DS1, 43806, 146256, 38-1204; 8974, KIR3DS1, 43809, 146259, 12-1175; 8974, KIR3DS1, 43810, 146260, 64-1212; 8974, KIR3DS1, 43811, 146261, 15-671; 8974, KIR3DS1, 43812, 146262, 38-1204; 8974, KIR3DS1, 43791, 146241, 12-1175; 8974, KIR3DS1, 43794, 146244, 12-1175; 8974, KIR3DS1, 43798, 146248, 12-1175; 8974, KIR3DS1, 43803, 146253, 12-1175; 8974, KIR3DS1, 43807, 146257, 12-1175; 8974, KIR3DS1, 43808, 146258, 12-1175; 8975, KIR3DX1, 43814, 146264, 107-526; 8975, KIR3DX1, 43815, 146265, 107-508; 8975, KIR3DX1, 43816, 146266, 107-508; 8975, KIR3DX1, 43817, 146267, 107-526; 8975, KIR3DX1, 43818, 146268, 1-362; 8975, KIR3DX1, 43820, 146270, 39-1136; 8975, KIR3DX1, 43821, 146271, 107-508; 8975, KIR3DX1, 43823, 146273, 39-1136; 8975, KIR3DX1, 43824, 146274, 107-508; 8975, KIR3DX1, 43826, 146276, 1-362; 8975, KIR3DX1, 43813, 146263, 8-1066; 8975, KIR3DX1, 43819, 146269, 8-1066; 8975, KIR3DX1, 43822, 146272, 8-1066; 8975, KIR3DX1, 43825, 146275, 8-1066; 8976, KIR2DL1, 43828, 146278, 41-1087; 8976, KIR2DL1, 43829, 146279, 90-1136; 8976, KIR2DL1, 43830, 146280, 38-1084; 8976, KIR2DL1, 43831, 146281, 33-1079; 8976, KIR2DL1, 43834, 146284, 90-1136; 8976, KIR2DL1, 43835, 146285, 27-1073; 8976, KIR2DL1, 43836, 146286, 33-1079; 8976, KIR2DL1, 43837, 146287, 39-1085; 8976, KIR2DL1, 43838, 146288, 30-1076; 8976, KIR2DL1, 43840, 146290, 38-1084; 8976, KIR2DL1, 43841, 146291, 38-1084; 8976, KIR2DL1, 43842, 146292, 27-1151; 8976, KIR2DL1, 43843, 146293, 41-1087; 8976, KIR2DL1, 43844, 146294, 41-1087; 8976, KIR2DL1, 43845, 146295, 41-1087; 8976, KIR2DL1, 43846, 146296, 27-1151; 8976, KIR2DL1, 43847, 146297, 1-349; 8976, KIR2DL1, 43849, 146299, 15-1061; 8976, KIR2DL1, 43850, 146300, 38-1084; 8976, KIR2DL1, 43851, 146301, 33-1079; 8976, KIR2DL1, 43852, 146302, 37-1083; 8976, KIR2DL1, 43853, 146303, 12-1058; 8976, KIR2DL1, 43854, 146304, 38-1084; 8976, KIR2DL1, 43857, 146307, 30-1076; 8976, KIR2DL1, 43858, 146308, 27-1151; 8976, KIR2DL1, 43859, 146309, 41-1087; 8976, KIR2DL1, 43860, 146310, 21-1067; 8976, KIR2DL1, 43827, 146277, 27-1151; 8976, KIR2DL1, 43832, 146282, 27-1073; 8976, KIR2DL1, 43833, 146283, 27-1151; 8976, KIR2DL1, 43839, 146289, 41-1087; 8976, KIR2DL1, 43848, 146298, 41-1087; 8976, KIR2DL1, 43855, 146305, 27-1151; 8976, KIR2DL1, 43856, 146306, 27-1151; 8977, KIR2DL2, 43861, 146311, 39-1085; 8977, KIR2DL2, 43862, 146312, 39-1085; 8977, KIR2DL2, 43863, 146313, 1-996; 8977, KIR2DL2, 43865, 146315, 39-1085; 8977, KIR2DL2, 43866, 146316, 39-1085; 8977, KIR2DL2, 43867, 146317, 39-1085; 8977, KIR2DL2, 43868, 146318, 15-1061; 8977, KIR2DL2, 43869, 146319, 3-917; 8977, KIR2DL2, 43872, 146322, 39-1085; 8977, KIR2DL2, 43874, 146324, 90-1136; 8977, KIR2DL2, 43876, 146326, 32-1078; 8977, KIR2DL2, 43878, 146328, 1-747; 8977, KIR2DL2, 43879, 146329, 30-1076; 8977, KIR2DL2, 43880, 146330, 39-1085; 8977, KIR2DL2, 43881, 146331, 90-1136; 8977, KIR2DL2, 43882, 146332, 15-1061; 8977, KIR2DL2, 43883, 146333, 39-1085; 8977, KIR2DL2, 43884, 146334, 32-1078; 8977, KIR2DL2, 43864, 146314, 15-1061; 8977, KIR2DL2, 43870, 146320, 30-1076; 8977, KIR2DL2, 43871, 146321, 38-1084; 8977, KIR2DL2, 43873, 146323, 90-1136; 8977, KIR2DL2, 43875, 146325, 30-1076; 8977, KIR2DL2, 43877, 146327, 15-1061; 8978, KIR2DL3, 43886, 146336, 39-1088; 8978, KIR2DL3, 43887, 146337, 39-1088; 8978, KIR2DL3, 43889, 146339, 39-1088; 8978, KIR2DL3, 43892, 146342, 39-1088; 8978, KIR2DL3, 43894, 146344, 39-1088; 8978, KIR2DL3, 43895, 146345, 39-1088; 8978, KIR2DL3, 43897, 146347, 39-1088; 8978, KIR2DL3, 43899, 146349, 39-1088; 8978, KIR2DL3, 43902, 146352, 30-1079; 8978, KIR2DL3, 43904, 146354, 39-1088; 8978, KIR2DL3, 43906, 146356, 8-1033; 8978,

KIR2DL3, 43907, 146357, 39-1088; 8978, KIR2DL3, 43908, 146358, 39-1088; 8978, KIR2DL3, 43910, 146360, 30-1076; 8978, KIR2DL3, 43912, 146362, 39-1088; 8978, KIR2DL3, 43914, 146364, 39-1088; 8978, KIR2DL3, 43915, 146365, 39-1088; 8978, KIR2DL3, 43916, 146366, 39-1088; 8978, KIR2DL3, 43918, 146368, 39-1088; 8978, KIR2DL3, 43921, 146371, 32-1081; 8978, KIR2DL3, 43922, 146372, 39-1088; 8978, KIR2DL3, 43924, 146374, 39-1088; 8978, KIR2DL3, 43885, 146335, 32-1057; 8978, KIR2DL3, 43888, 146338, 32-1057; 8978, KIR2DL3, 43890, 146340, 23-1048; 8978, KIR2DL3, 43891, 146341, 38-1063; 8978, KIR2DL3, 43893, 146343, 32-1057; 8978, KIR2DL3, 43896, 146346, 41-1066; 8978, KIR2DL3, 43898, 146348, 38-1063; 8978, KIR2DL3, 43900, 146350, 32-1057; 8978, KIR2DL3, 43901, 146351, 38-1063; 8978, KIR2DL3, 43903, 146353, 90-1115; 8978, KIR2DL3, 43905, 146355, 14-1039; 8978, KIR2DL3, 43909, 146359, 32-1057; 8978, KIR2DL3, 43911, 146361, 22-1047; 8978, KIR2DL3, 43913, 146363, 38-1063; 8978, KIR2DL3, 43917, 146367, 38-1063; 8978, KIR2DL3, 43919, 146369, 38-1063; 8978, KIR2DL3, 43920, 146370, 38-1063; 8978, KIR2DL3, 43923, 146373, 20-1045; 8979, KIR2DL4, 43926, 146376, 1-744; 8979, KIR2DL4, 43928, 146378, 42-863; 8979, KIR2DL4, 43929, 146379, 1-1251; 8979, KIR2DL4, 43930, 146380, 1-1195; 8979, KIR2DL4, 43932, 146382, 203-1141; 8979, KIR2DL4, 43933, 146383, 3-740; 8979, KIR2DL4, 43934, 146384, 12-704; 8979, KIR2DL4, 43935, 146385, 47-784; 8979, KIR2DL4, 43937, 146387, 1-1194; 8979, KIR2DL4, 43938, 146388, 1-1251; 8979, KIR2DL4, 43942, 146392, 13-1041; 8979, KIR2DL4, 43943, 146393, 42-863; 8979, KIR2DL4, 43944, 146394, 1-740; 8979, KIR2DL4, 43947, 146397, 13-1146; 8979, KIR2DL4, 43948, 146398, 1-1134; 8979, KIR2DL4, 43949, 146399, 203-1231; 8979, KIR2DL4, 43950, 146400, 191-1390; 8979, KIR2DL4, 43951, 146401, 28-849; 8979, KIR2DL4, 43952, 146402, 203-1141; 8979, KIR2DL4, 43955, 146405, 42-1175; 8979, KIR2DL4, 43956, 146406, 203-1231; 8979, KIR2DL4, 43958, 146408, 13-990; 8979, KIR2DL4, 43960, 146410, 13-1041; 8979, KIR2DL4, 43961, 146411, 28-849; 8979, KIR2DL4, 43962, 146412, 1-1083; 8979, KIR2DL4, 43963, 146413, 1-1251; 8979, KIR2DL4, 43964, 146414, 203-1231; 8979, KIR2DL4, 43965, 146415, 1-1251; 8979, KIR2DL4, 43967, 146417, 28-1161; 8979, KIR2DL4, 43968, 146418, 33-854; 8979, KIR2DL4, 43969, 146419, 41-1069; 8979, KIR2DL4, 43970, 146420, 203-1336; 8979, KIR2DL4, 43971, 146421, 203-1231; 8979, KIR2DL4, 43972, 146422, 1-933; 8979, KIR2DL4, 43973, 146423, 33-1232; 8979, KIR2DL4, 43974, 146424, 277-1215; 8979, KIR2DL4, 43975, 146425, 1-1251; 8979, KIR2DL4, 43976, 146426, 1-1251; 8979, KIR2DL4, 43977, 146427, 47-784; 8979, KIR2DL4, 43978, 146428, 203-1231; 8979, KIR2DL4, 43980, 146430, 203-1231; 8979, KIR2DL4, 43982, 146432, 13-990; 8979, KIR2DL4, 43985, 146435, 42-863; 8979, KIR2DL4, 43986, 146436, 1-1134; 8979, KIR2DL4, 43987, 146437, 13-990; 8979, KIR2DL4, 43989, 146439, 13-1146; 8979, KIR2DL4, 43990, 146440, 41-1069; 8979, KIR2DL4, 43991, 146441, 86-1336; 8979, KIR2DL4, 43993, 146443, 203-1231; 8979, KIR2DL4, 43994, 146444, 1-1251; 8979, KIR2DL4, 43995, 146445, 42-863; 8979, KIR2DL4, 43996, 146446, 13-990; 8979, KIR2DL4, 43997, 146447, 28-849; 8979, KIR2DL4, 43998, 146448, 1-1251; 8979, KIR2DL4, 43999, 146449, 42-1175; 8979, KIR2DL4, 44000, 146450, 1-1134; 8979, KIR2DL4, 44001, 146451, 1-1029; 8979, KIR2DL4, 44002, 146452, 13-834; 8979, KIR2DL4, 44003, 146453, 203-1402; 8979, KIR2DL4, 44004, 146454, 1-822; 8979, KIR2DL4, 44007, 146457, 12-704; 8979, KIR2DL4, 44008, 146458, 1-1251; 8979, KIR2DL4, 44009, 146459, 13-783; 8979, KIR2DL4, 43925, 146375, 13-1041; 8979, KIR2DL4, 43927, 146377, 13-990; 8979, KIR2DL4, 43931, 146381, 12-704; 8979, KIR2DL4, 43936, 146386, 1-1134; 8979, KIR2DL4, 43939, 146389, 19-1152; 8979, KIR2DL4, 43940, 146390, 191-1324; 8979, KIR2DL4, 43941, 146391, 13-1041; 8979, KIR2DL4, 43945, 146395, 1-1134; 8979, KIR2DL4, 43946, 146396, 42-1175; 8979, KIR2DL4, 43953, 146403, 41-1069; 8979, KIR2DL4, 43954, 146404, 13-1095; 8979, KIR2DL4, 43957, 146407, 41-1069; 8979, KIR2DL4, 43959, 146409, 12-704; 8979, KIR2DL4, 43966, 146416, 13-1146; 8979, KIR2DL4, 43979, 146429, 1-1134; 8979, KIR2DL4, 43981, 146431, 42-1175; 8979, KIR2DL4, 43983, 146433, 13-1095; 8979, KIR2DL4, 43984, 146434, 13-990; 8979, KIR2DL4, 43988, 146438, 42-1175; 8979, KIR2DL4, 43992, 146442, 42-1175; 8979, KIR2DL4, 44005, 146455, 42-1175; 8979, KIR2DL4, 44006, 146456, 13-1041; 8980, KIR2DL5A, 44010, 146460, 56-1183; 8980, KIR2DL5A, 44012, 146462, 56-1183; 8980, KIR2DL5A, 44014, 146464, 1-1128; 8980, KIR2DL5A, 44015, 146465, 1-1128; 8980, KIR2DL5A, 44016, 146466, 1-1128; 8980, KIR2DL5A, 44018, 146468, 1-1128; 8980, KIR2DL5A, 44011, 146461, 56-1183; 8980, KIR2DL5A, 44013, 146463, 56-1183; 8980, KIR2DL5A, 44017, 146467, 56-1183; 8981, KIR2DL5B, 44019, 146469, 1-1128; 8981, KIR2DL5B, 44020, 146470, 2-1129; 8981, KIR2DL5B, 44021, 146471, 1-1128; 8981, KIR2DL5B, 44022, 146472, 1-1128; 8981, KIR2DL5B, 44023, 146473, 1-1128; 8981, KIR2DL5B, 44024, 146474, 1-1128; 8981, KIR2DL5B, 44025, 146475, 56-1183; 8981, KIR2DL5B, 44026, 146476, 56-1183; 8982, KIR2DP1, 44027, 146477, 1-915; 8982, KIR2DP1, 44028, 146478, 26-1390; 8982, KIR2DP1, 44029, 146479, 39-953; 8982, KIR2DP1, 44030, 146480, 39-1088; 8982, KIR2DP1, 44031, 146481, 1-1368; 8982, KIR2DP1, 44032, 146482, 38-1087; 8982, KIR2DP1, 44033, 146483, 3-1019; 8983, KIR2DS1, 44034, 146484, 14-928; 8983, KIR2DS1, 44035, 146485, 39-953; 8983, KIR2DS1, 44036, 146486, 41-955; 8983, KIR2DS1, 44037, 146487, 41-955; 8983, KIR2DS1, 44038, 146488, 31-1077; 8983, KIR2DS1, 44039, 146489, 90-1004; 8983, KIR2DS1, 44040, 146490, 14-928; 8983, KIR2DS1, 44041, 146491, 20-934; 8983, KIR2DS1, 44042, 146492, 41-955; 8983, KIR2DS1, 44043, 146493, 12-926; 8983, KIR2DS1, 44044, 146494, 20-913; 8984, KIR2DS2, 44045, 146495, 90-953; 8984, KIR2DS2, 44051, 146501, 1-864; 8984, KIR2DS2, 44058, 146508, 12-626; 8984, KIR2DS2, 44060, 146510, 90-953; 8984, KIR2DS2, 44046, 146496, 20-934; 8984, KIR2DS2, 44047, 146497, 20-934; 8984, KIR2DS2, 44048, 146498, 20-934; 8984, KIR2DS2, 44049, 146499, 32-946; 8984, KIR2DS2, 44050, 146500, 1-915; 8984, KIR2DS2, 44052, 146502, 90-1004; 8984, KIR2DS2, 44053, 146503, 32-946; 8984, KIR2DS2, 44054, 146504, 11-925; 8984, KIR2DS2, 44055, 146505, 32-946; 8984, KIR2DS2, 44056, 146506, 11-925; 8984, KIR2DS2, 44057, 146507, 32-946; 8984, KIR2DS2, 44059, 146509, 32-946; 8984, KIR2DS2, 44061, 146511, 3-917; 8984, KIR2DS2, 44062, 146512, 3-917; 8984, KIR2DS2, 44063, 146513, 1-915; 8985, KIR2DS3, 44065, 146515, 60-974; 8985, KIR2DS3, 44067, 146517, 37-951; 8985, KIR2DS3, 44064, 146514, 60-974; 8985, KIR2DS3, 44066, 146516, 37-951; 8985, KIR2DS3, 44068, 146518, 37-951; 8986, KIR2DS4, 44069, 146519, 90-982; 8986, KIR2DS4, 44070, 146520, 1-677; 8986, KIR2DS4, 44073, 146523, 47-939; 8986, KIR2DS4, 44074, 146524, 8-900; 8986, KIR2DS4, 44075, 146525, 1-677; 8986, KIR2DS4, 44076, 146526, 8-900; 8986, KIR2DS4, 44077, 146527, 12-904; 8986, KIR2DS4, 44078, 146528, 47-1171; 8986, KIR2DS4, 44079, 146529, 56-775; 8986,

KIR2DS4, 44082, 146532, 1-516; 8986, KIR2DS4, 44083, 146533, 8-900; 8986, KIR2DS4, 44084, 146534, 31-1227; 8986, KIR2DS4, 44085, 146535, 90-1214; 8986, KIR2DS4, 44087, 146537, 90-981; 8986, KIR2DS4, 44091, 146541, 1-677; 8986, KIR2DS4, 44092, 146542, 47-938; 8986, KIR2DS4, 44071, 146521, 39-953; 8986, KIR2DS4, 44072, 146522, 90-1004; 8986, KIR2DS4, 44080, 146530, 90-1004; 8986, KIR2DS4, 44081, 146531, 90-1004; 8986, KIR2DS4, 44086, 146536, 99-1004; 8986, KIR2DS4, 44088, 146538, 90-1004; 8986, KIR2DS4, 44089, 146539, 56-970; 8986, KIR2DS4, 44090, 146540, 90-1004; 8986, KIR2DS4, 44093, 146543, 90-1004; 8987, KIR2DS5, 44094, 146544, 59-973; 8987, KIR2DS5, 44095, 146545, 57-971; 8987, KIR2DS5, 44096, 146546, 35-949; 8987, KIR2DS5, 44097, 146547, 12-926; 8987, KIR2DS5, 44098, 146548, 39-1088; 8987, KIR2DS5, 44099, 146549, 35-949; 8988, KLRB1, 44100, 146550, 48-725; 8989, KLRC1, 44105, 146555, 458-1144; 8989, KLRC1, 44106, 146556, 1-233; 8989, KLRC1, 44101, 146551, 165-812; 8989, KLRC1, 44102, 146552, 183-884; 8989, KLRC1, 44103, 146553, 389-1036; 8989, KLRC1, 44104, 146554, 389-1090; 8990, KLRC2, 44107, 146557, 8-703; 8990, KLRC2, 44109, 146559, 1-312; 8990, KLRC2, 44110, 146560, 116-634; 8990, KLRC2, 44111, 146561, 1-257; 8990, KLRC2, 44112, 146562, 1-375; 8990, KLRC2, 44108, 146558, 8-703; 8991, KLRC3, 44113, 146563, 1-774; 8991, KLRC3, 44114, 146564, 46-768; 8992, KLRC4, 44115, 146565, 183-659; 8993, KLRD1, 44118, 146568, 129-347; 8993, KLRD1, 44120, 146570, 1-156; 8993, KLRD1, 44121, 146571, 29-349; 8993, KLRD1, 44122, 146572, 277-694; 8993, KLRD1, 44123, 146573, 129-449; 8993, KLRD1, 44124, 146574, 129-605; 8993, KLRD1, 44116, 146566, 261-707; 8993, KLRD1, 44117, 146567, 261-800; 8993, KLRD1, 44119, 146569, 203-742; 8994, KLRF1, 44125, 146575, 65-610; 8994, KLRF1, 44127, 146577, 25-369; 8994, KLRF1, 44128, 146578, 25-399; 8994, KLRF1, 44129, 146579, 65-760; 8994, KLRF1, 44131, 146581, 65-451; 8994, KLRF1, 44126, 146576, 65-259; 8994, KLRF1, 44130, 146580, 65-301; 8995, KLRF2, 44132, 146582, 108-731; 8996, KLRG1, 44135, 146585, 292-532; 8996, KLRG1, 44136, 146586, 349-592; 8996, KLRG1, 44133, 146583, 16-603; 8996, KLRG1, 44134, 146584, 96-665; 8997, KLRG2, 44137, 146587, 71-1300; 8997, KLRG2, 44138, 146588, 22-966; 8998, KLRK1, 44140, 146590, 191-433; 8998, KLRK1, 44139, 146589, 142-792; 8998, KLRK1, 44141, 146591, 167-817; 8999, KLLN, 44143, 146593, 951-1487; 8999, KLLN, 44142, 146592, 951-1487; 9000, KIRREL, 44145, 146595, 592-2373; 9000, KIRREL, 44146, 146596, 13-1728; 9000, KIRREL, 44147, 146597, 405-2378; 9000, KIRREL, 44144, 146594, 68-2341; 9001, KIRREL2, 44148, 146598, 15-1916; 9001, KIRREL2, 44149, 146599, 211-1962; 9001, KIRREL2, 44151, 146601, 534-2555; 9001, KIRREL2, 44152, 146602, 195-767; 9001, KIRREL2, 44150, 146600, 199-2325; 9002, KIRREL3, 44153, 146603, 74-2287; 9002, KIRREL3, 44154, 146604, 12-2312; 9002, KIRREL3, 44155, 146605, 302-2104; 9002, KIRREL3, 44156, 146606, 251-2587; 9003, KIN, 44158, 146608, 1-327; 9003, KIN, 44157, 146607, 49-1230; 9004, KIDINS220, 44161, 146611, 154-264; 9004, KIDINS220, 44163, 146613, 1-456; 9004, KIDINS220, 44164, 146614, 170-4084; 9004, KIDINS220, 44165, 146615, 1-3174; 9004, KIDINS220, 44159, 146609, 183-5498; 9004, KIDINS220, 44160, 146610, 158-3253; 9004, KIDINS220, 44162, 146612, 199-5457; 9005, KDR, 44166, 146616, 297-4367; 9006, KNDC1, 44167, 146617, 22-5271; 9006, KNDC1, 44168, 146618, 291-3716; 9007, KSR1, 44169, 146619, 266-2806; 9007, KSR1, 44170, 146620, 1-1839; 9007, KSR1, 44173, 146623, 342-479; 9007, KSR1, 44174, 146624, 1-296; 9007, KSR1, 44175, 146625, 179-571; 9007, KSR1, 44176, 146626, 1-420; 9007, KSR1, 44177, 146627, 576-1041; 9007, KSR1, 44178, 146628, 292-633; 9007, KSR1, 44171, 146621, 446-2734; 9007, KSR1, 44172, 146622, 446-2731; 9008, KSR2, 44180, 146630, 56-2821; 9008, KSR2, 44179, 146629, 729-3581; 9009, KTN1, 44188, 146638, 1-49; 9009, KTN1, 44189, 146639, 110-291; 9009, KTN1, 44190, 146640, 235-1239; 9009, KTN1, 44191, 146641, 1-416; 9009, KTN1, 44192, 146642, 371-595; 9009, KTN1, 44193, 146643, 113-1900; 9009, KTN1, 44194, 146644, 1-274; 9009, KTN1, 44195, 146645, 102-588; 9009, KTN1, 44196, 146646, 250-731; 9009, KTN1, 44197, 146647, 688-730; 9009, KTN1, 44198, 146648, 1-462; 9009, KTN1, 44181, 146631, 186-4106; 9009, KTN1, 44182, 146632, 73-3993; 9009, KTN1, 44183, 146633, 120-4040; 9009, KTN1, 44184, 146634, 69-4142; 9009, KTN1, 44185, 146635, 71-3973; 9009, KTN1, 44186, 146636, 73-3993; 9009, KTN1, 44187, 146637, 188-4261; 9010, KIF11, 44199, 146649, 91-3261; 9011, KIF12, 44200, 146650, 239-1780; 9011, KIF12, 44201, 146651, 859-1860; 9012, KIF13A, 44203, 146653, 1-2669; 9012, KIF13A, 44207, 146657, 1-810; 9012, KIF13A, 44209, 146659, 1-2406; 9012, KIF13A, 44202, 146652, 107-5524; 9012, KIF13A, 44204, 146654, 1-5250; 9012, KIF13A, 44205, 146655, 20-5332; 9012, KIF13A, 44206, 146656, 19-5292; 9012, KIF13A, 44208, 146658, 161-373; 9013, KIF13B, 44211, 146661, 91-276; 9013, KIF13B, 44212, 146662, 1-1257; 9013, KIF13B, 44213, 146663, 64-2295; 9013, KIF13B, 44214, 146664, 29-190; 9013, KIF13B, 44210, 146660, 40-5520; 9014, KIF14, 44215, 146665, 440-5386; 9014, KIF14, 44216, 146666, 1-4947; 9015, KIF15, 44218, 146668, 103-3174; 9015, KIF15, 44219, 146669, 1-584; 9015, KIF15, 44220, 146670, 1-386; 9015, KIF15, 44221, 146671, 146-397; 9015, KIF15, 44222, 146672, 107-2240; 9015, KIF15, 44223, 146673, 1-386; 9015, KIF15, 44224, 146674, 150-4316; 9015, KIF15, 44225, 146675, 146-397; 9015, KIF15, 44226, 146676, 1-584; 9015, KIF15, 44227, 146677, 107-2240; 9015, KIF15, 44228, 146678, 103-3174; 9015, KIF15, 44217, 146667, 150-4316; 9016, KIF16B, 44230, 146680, 1-606; 9016, KIF16B, 44232, 146682, 1-556; 9016, KIF16B, 44229, 146679, 159-4112; 9016, KIF16B, 44231, 146681, 159-4337; 9017, KIF17, 44234, 146684, 213-3002; 9017, KIF17, 44233, 146683, 312-3401; 9017, KIF17, 44235, 146685, 75-3161; 9018, KIF18A, 44236, 146686, 292-2988; 9019, KIF18B, 44237, 146687, 25-2526; 9019, KIF18B, 44239, 146689, 99-2657; 9019, KIF18B, 44238, 146688, 1-2529; 9020, KIF19, 44241, 146691, 141-1980; 9020, KIF19, 44240, 146690, 139-3135; 9021, KIF1A, 44243, 146693, 1-4414; 9021, KIF1A, 44244, 146694, 1-680; 9021, KIF1A, 44245, 146695, 471-585; 9021, KIF1A, 44246, 146696, 1-1072; 9021, KIF1A, 44247, 146697, 1-550; 9021, KIF1A, 44242, 146692, 160-5232; 9021, KIF1A, 44248, 146698, 248-5623; 9022, KIF1B, 44254, 146704, 1-5430; 9022, KIF1B, 44255, 146705, 1-5394; 9022, KIF1B, 44256, 146706, 1-1496; 9022, KIF1B, 44249, 146699, 154-5466; 9022, KIF1B, 44250, 146700, 80-5551; 9022, KIF1B, 44251, 146701, 314-3775; 9022, KIF1B, 44252, 146702, 203-5653; 9022, KIF1B, 44253, 146703, 154-3615; 9023, KIF1C, 44258, 146708, 386-799; 9023, KIF1C, 44257, 146707, 358-3669; 9024, KIF20A, 44261, 146711, 154-631; 9024, KIF20A, 44262, 146712, 135-810; 9024, KIF20A, 44263, 146713, 1-249; 9024, KIF20A, 44259, 146709, 227-2899; 9024, KIF20A, 44260, 146710, 65-2683; 9025, KIF20B, 44266, 146716, 41-660; 9025, KIF20B, 44264, 146714, 73-5415; 9025,

KIF20B, 44265, 146715, 66-5528; 9026, KIF21A, 44271, 146721, 1-417; 9026, KIF21A, 44272, 146722, 1-2927; 9026, KIF21A, 44273, 146723, 1-1968; 9026, KIF21A, 44274, 146724, 1-1427; 9026, KIF21A, 44275, 146725, 1-871; 9026, KIF21A, 44267, 146717, 421-5406; 9026, KIF21A, 44268, 146718, 17-5041; 9026, KIF21A, 44269, 146719, 1-4866; 9026, KIF21A, 44270, 146720, 90-5003; 9027, KIF21B, 44276, 146726, 318-5192; 9027, KIF21B, 44277, 146727, 26-4858; 9027, KIF21B, 44278, 146728, 318-5231; 9027, KIF21B, 44279, 146729, 26-4897; 9028, KIF22, 44283, 146733, 7-276; 9028, KIF22, 44284, 146734, 142-1977; 9028, KIF22, 44285, 146735, 280-834; 9028, KIF22, 44286, 146736, 1-219; 9028, KIF22, 44280, 146730, 41-2038; 9028, KIF22, 44281, 146731, 626-2419; 9028, KIF22, 44282, 146732, 638-2431; 9029, KIF23, 44289, 146739, 174-3032; 9029, KIF23, 44290, 146740, 279-1081; 9029, KIF23, 44293, 146743, 118-1233; 9029, KIF23, 44294, 146744, 142-471; 9029, KIF23, 44287, 146737, 221-3103; 9029, KIF23, 44288, 146738, 163-2733; 9029, KIF23, 44291, 146741, 164-2185; 9029, KIF23, 44292, 146742, 221-2791; 9030, KIF24, 44295, 146745, 121-4227; 9030, KIF24, 44296, 146746, 26-3730; 9030, KIF24, 44297, 146747, 26-4132; 9031, KIF25, 44301, 146751, 1-44; 9031, KIF25, 44299, 146748, 235-1233; 9031, KIF25, 44299, 146749, 263-1417; 9031, KIF25, 44300, 146750, 392-1546; 9032, KIF26A, 44302, 146752, 379-5610; 9032, KIF26A, 44303, 146753, 1-5649; 9033, KIF26B, 44304, 146754, 105-5288; 9033, KIF26B, 44306, 146756, 1-5864; 9033, KIF26B, 44305, 146755, 441-6767; 9034, KIF27, 44311, 146761, 88-603; 9034, KIF27, 44307, 146757, 145-4350; 9034, KIF27, 44308, 146758, 183-4097; 9034, KIF27, 44309, 146759, 36-896; 9034, KIF27, 44310, 146760, 183-4190; 9035, KIF2B, 44312, 146762, 134-2155; 9036, KIF2C, 44315, 146765, 48-908; 9036, KIF2C, 44316, 146766, 1-320; 9036, KIF2C, 44317, 146767, 116-1124; 9036, KIF2C, 44313, 146763, 352-2367; 9036, KIF2C, 44314, 146764, 114-2291; 9037, KIF3A, 44318, 146768, 154-2262; 9037, KIF3A, 44320, 146770, 1-2181; 9037, KIF3A, 44321, 146771, 152-658; 9037, KIF3A, 44322, 146772, 1-558; 9037, KIF3A, 44323, 146773, 154-2331; 9037, KIF3A, 44319, 146769, 220-2319; 9038, KIF3B, 44324, 146774, 168-2411; 9039, KIF3C, 44327, 146777, 581-2638; 9039, KIF3C, 44328, 146778, 581-2599; 9039, KIF3C, 44329, 146779, 154-2532; 9039, KIF3C, 44325, 146775, 581-2962; 9039, KIF3C, 44326, 146776, 574-2955; 9040, KIF4A, 44330, 146780, 83-3781; 9041, KIF4B, 44331, 146781, 106-3810; 9042, KIF5A, 44332, 146782, 229-3060; 9042, KIF5A, 44333, 146783, 275-3373; 9043, KIF5B, 44334, 146784, 459-3350; 9044, KIF5C, 44335, 146785, 278-505; 9044, KIF5C, 44337, 146787, 1-2583; 9044, KIF5C, 44336, 146786, 369-3242; 9045, KIF6, 44340, 146790, 216-962; 9045, KIF6, 44341, 146791, 1-486; 9045, KIF6, 44342, 146792, 1-2069; 9045, KIF6, 44343, 146793, 1505-2386; 9045, KIF6, 44338, 146788, 155-952; 9045, KIF6, 44339, 146789, 96-2540; 9046, KIF7, 44345, 146795, 78-521; 9046, KIF7, 44344, 146794, 78-4109; 9047, KIF9, 44348, 146798, 264-741; 9047, KIF9, 44349, 146799, 278-553; 9047, KIF9, 44351, 146801, 49-1050; 9047, KIF9, 44352, 146802, 267-584; 9047, KIF9, 44353, 146803, 385-660; 9047, KIF9, 44346, 146796, 682-3054; 9047, KIF9, 44347, 146797, 359-2731; 9047, KIF9, 44350, 146800, 335-2707; 9047, KIF9, 44354, 146804, 359-2536; 9048, KIFC1, 44357, 146807, 126-734; 9048, KIFC1, 44359, 146809, 126-734; 9048, KIFC1, 44360, 146810, 126-734; 9048, KIFC1, 44361, 146811, 1-464; 9048, KIFC1, 44355, 146805, 451-2472; 9048, KIFC1, 44356, 146806, 451-2472; 9048, KIFC1, 44358, 146808, 451-2472; 9049, KIFC2, 44362, 146812, 378-2894; 9050, KIFC3, 44366, 146816, 132-2306; 9050, KIFC3, 44368, 146818, 562-2616; 9050, KIFC3, 44369, 146819, 374-551; 9050, KIFC3, 44370, 146820, 235-737; 9050, KIFC3, 44371, 146821, 568-777; 9050, KIFC3, 44372, 146822, 314-577; 9050, KIFC3, 44373, 146823, 283-297; 9050, KIFC3, 44375, 146825, 110-424; 9050, KIFC3, 44376, 146826, 227-623; 9050, KIFC3, 44378, 146828, 218-681; 9050, KIFC3, 44379, 146829, 684-698; 9050, KIFC3, 44380, 146830, 80-651; 9050, KIFC3, 44381, 146831, 13-509; 9050, KIFC3, 44382, 146832, 242-1081; 9050, KIFC3, 44383, 146833, 384-564; 9050, KIFC3, 44384, 146834, 347-788; 9050, KIFC3, 44385, 146835, 1-589; 9050, KIFC3, 44386, 146836, 132-443; 9050, KIFC3, 44387, 146837, 743-2239; 9050, KIFC3, 44363, 146813, 259-2760; 9050, KIFC3, 44364, 146814, 559-2622; 9050, KIFC3, 44365, 146815, 184-2664; 9050, KIFC3, 44367, 146817, 12-2558; 9050, KIFC3, 44374, 146824, 445-2508; 9050, KIFC3, 44377, 146827, 944-3007; 9051, KIF2A, 44391, 146841, 1-392; 9051, KIF2A, 44392, 146842, 22-874; 9051, KIF2A, 44394, 146844, 310-549; 9051, KIF2A, 44388, 146838, 486-2546; 9051, KIF2A, 44389, 146839, 22-2256; 9051, KIF2A, 44390, 146840, 312-2432; 9051, KIF2A, 44393, 146843, 87-2069; 9052, KLC1, 44399, 146849, 294-2024; 9052, KLC1, 44401, 146851, 200-1849; 9052, KLC1, 44403, 146853, 1-805; 9052, KLC1, 44404, 146854, 1-181; 9052, KLC1, 44406, 146856, 260-1915; 9052, KLC1, 44408, 146858, 91-540; 9052, KLC1, 44409, 146859, 256-2085; 9052, KLC1, 44410, 146860, 1-133; 9052, KLC1, 44411, 146861, 1-452; 9052, KLC1, 44412, 146862, 1-485; 9052, KLC1, 44413, 146863, 1-395; 9052, KLC1, 44414, 146864, 260-2152; 9052, KLC1, 44416, 146866, 256-2010; 9052, KLC1, 44395, 146845, 256-2169; 9052, KLC1, 44396, 146846, 260-2179; 9052, KLC1, 44397, 146847, 260-2146; 9052, KLC1, 44398, 146848, 320-2041; 9052, KLC1, 44400, 146850, 270-1952; 9052, KLC1, 44402, 146852, 256-2112; 9052, KLC1, 44405, 146855, 256-1938; 9052, KLC1, 44407, 146857, 256-1950; 9052, KLC1, 44415, 146865, 260-1942; 9053, KLC2, 44418, 146868, 1019-2584; 9053, KLC2, 44421, 146871, 165-1166; 9053, KLC2, 44422, 146872, 123-620; 9053, KLC2, 44425, 146875, 560-1073; 9053, KLC2, 44426, 146876, 76-643; 9053, KLC2, 44427, 146877, 244-559; 9053, KLC2, 44428, 146878, 160-594; 9053, KLC2, 44417, 146867, 218-2086; 9053, KLC2, 44419, 146869, 51-1688; 9053, KLC2, 44420, 146870, 181-2049; 9053, KLC2, 44423, 146873, 244-2112; 9053, KLC2, 44424, 146874, 181-1818; 9054, KLC3, 44431, 146881, 817-2006; 9054, KLC3, 44433, 146883, 338-809; 9054, KLC3, 44434, 146884, 82-973; 9054, KLC3, 44429, 146879, 103-1617; 9054, KLC3, 44430, 146880, 101-1657; 9054, KLC3, 44432, 146882, 95-1606; 9055, KLC4, 44440, 146890, 1-478; 9055, KLC4, 44441, 146891, 60-872; 9055, KLC4, 44443, 146893, 321-458; 9055, KLC4, 44445, 146895, 330-577; 9055, KLC4, 44446, 146896, 275-549; 9055, KLC4, 44447, 146897, 43-528; 9055, KLC4, 44448, 146898, 299-550; 9055, KLC4, 44435, 146885, 354-2267; 9055, KLC4, 44436, 146886, 118-1977; 9055, KLC4, 44437, 146887, 496-2355; 9055, KLC4, 44438, 146888, 81-1709; 9055, KLC4, 44439, 146889, 59-1006; 9055, KLC4, 44442, 146892, 326-2185; 9055, KLC4, 44444, 146894, 1352-1747; 9056, KIFAP3, 44449, 146899, 229-2607; 9056, KIFAP3, 44450, 146900, 1503-3761; 9056, KIFAP3, 44451, 146901, 122-2368; 9056, KIFAP3, 44452, 146902, 670-2814; 9057, KNTC1, 44454, 146904, 939-1250; 9057, KNTC1, 44455, 146905, 147-3551; 9057, KNTC1, 44456, 146906, 1852-2244; 9057, KNTC1, 44457, 146907, 526-918; 9057, KNTC1, 44458, 146908, 1-624; 9057, KNTC1, 44453, 146903, 178-6807; 9058, KNSTRN, 44462, 146912, 1-195; 9058, KNSTRN, 44463, 146913, 1-373; 9058, KNSTRN, 44464, 146914, 1-386; 9058, KNSTRN, 44465, 146915, 116-496; 9058, KNSTRN, 44466, 146916, 1-651; 9058, KNSTRN, 44467, 146917, 1-82; 9058, KNSTRN, 44468, 146918, 1-202; 9058, KNSTRN, 44469, 146919, 130-846; 9058, KNSTRN, 44459, 146909, 116-1066; 9058, KNSTRN, 44460, 146910, 116-976; 9058, KNSTRN, 44461, 146911, 1-726; 9059, KNG1, 44470, 146920, 213-2147; 9059, KNG1, 44471, 146921, 268-1551; 9059, KNG1, 44472, 146922, 196-1371; 9060, KNCN, 44473, 146923, 1-306; 9060, KNCN, 44474, 146924, 313-687; 9061, KRAS, 44477, 146927, 178-309; 9061, KRAS, 44478, 146928, 198-425; 9061, KRAS, 44475, 146925, 65-634; 9061, KRAS, 44476, 146926, 193-759; 9062, KISS1, 44480, 146930, 1-435; 9062, KISS1, 44479, 146929, 150-566; 9063, KISS1R, 44482, 146932, 217-507; 9063, KISS1R, 44483, 146933, 1-681; 9063, KISS1R, 44481, 146931, 162-1358; 9064, KITLG, 44486, 146936, 256-426; 9064, KITLG, 44487, 146937, 482-555; 9064, KITLG, 44488, 146938, 1-135; 9064, KITLG, 44484, 146934, 574-1311; 9064, KITLG, 44485, 146935, 184-1005; 9065, KIZ, 44489, 146939, 1-1617; 9065, KIZ, 44493, 146943, 1-1351; 9065, KIZ, 44494, 146944, 103-288; 9065, KIZ, 44495, 146945, 1-1566; 9065, KIZ, 44496, 146946, 1-1873; 9065, KIZ, 44497, 146947, 55-1929; 9065, KIZ, 44490, 146940, 256-1968; 9065, KIZ, 44491, 146941, 63-2084; 9065, KIZ, 44492, 146942, 211-1833; 9066, KL, 44498, 146948, 9-3047; 9067, KLB, 44499, 146949, 98-3232; 9068, KLRC4-KLRK1, 44500, 146950, 1-451; 9068, KLRC4-KLRK1, 44501, 146951, 1-114; 9068, KLRC4-KLRK1, 44502, 146952, 111-338; 9068, KLRC4-KLRK1, 44503, 146953, 93-320; 9068, KLRC4-KLRK1, 44504, 146954, 93-320; 9068, KLRC4-KLRK1, 44505, 146955, 183-410; 9068, KLRC4-KLRK1, 44506, 146956, 93-320; 9068, KLRC4-KLRK1, 44507, 146957, 1-451; 9068, KLRC4-KLRK1, 44508, 146958, 1-107; 9068, KLRC4-KLRK1, 44509, 146959, 183-410; 9068, KLRC4-KLRK1, 44510, 146960, 183-410; 9068, KLRC4-KLRK1, 44511, 146961, 183-410; 9069, KANK1, 44512, 146962, 1-850; 9069, KANK1, 44513, 146963, 1-1059; 9069, KANK1, 44514, 146964, 797-4381; 9069, KANK1, 44515, 146965, 123-4181; 9069, KANK1, 44516, 146966, 653-4711; 9069, KANK1, 44517, 146967, 759-4817; 9070, KANK2, 44518, 146968, 569-576; 9070, KANK2, 44519, 146969, 1-664; 9070, KANK2, 44521, 146971, 409-542; 9070, KANK2, 44524, 146974, 257-624; 9070, KANK2, 44525, 146975, 481-923; 9070, KANK2, 44520, 146970, 316-2871; 9070, KANK2, 44522, 146972, 1-2526; 9070, KANK2, 44523, 146973, 469-3048; 9071, KANK3, 44527, 146977, 67-506; 9071, KANK3, 44529, 146979, 353-991; 9071, KANK3, 44526, 146976, 67-2532; 9071, KANK3, 44528, 146978, 67-2589; 9072, KANK4, 44530, 146980, 381-782; 9072, KANK4, 44532, 146982, 1235-2290; 9072, KANK4, 44531, 146981, 267-1370; 9072, KANK4, 44533, 146983, 380-3367; 9073, KRBOX1, 44534, 146984, 143-529; 9073, KRBOX1, 44535, 146985, 2035-2421; 9073, KRBOX1, 44536, 146986, 295-681; 9074, KRBOX4, 44541, 146991, 192-473; 9074, KRBOX4, 44542, 146992, 192-585; 9074, KRBOX4, 44537, 146987, 197-697; 9074, KRBOX4, 44538, 146988, 632-1147; 9074, KRBOX4, 44539, 146989, 195-491; 9074, KRBOX4, 44540, 146990, 109-405; 9075, KRBA1, 44544, 146994, 218-527; 9075, KRBA1, 44545, 146995, 45-3239; 9075, KRBA1, 44546, 146996, 1-502; 9075, KRBA1, 44547, 146997, 491-596; 9075, KRBA1, 44549, 146999, 1-1853; 9075, KRBA1, 44543, 146993, 400-3492; 9075, KRBA1, 44548, 146998, 1-2910; 9076, KRBA2, 44551, 147001, 833-2065; 9076, KRBA2, 44550, 147000, 7-1485; 9077, KRI1, 44553, 147003, 295-885; 9077, KRI1, 44554, 147004, 1-571; 9077, KRI1, 44555, 147005, 1-339; 9077, KRI1, 44556, 147006, 1-582; 9077, KRI1, 44552, 147002, 21-2150; 9078, KREMEN1, 44560, 147010, 1-248; 9078, KREMEN1, 44557, 147007, 14-1492; 9078, KREMEN1, 44558, 147008, 54-1430; 9078, KREMEN1, 44559, 147009, 1-1422; 9079, KREMEN2, 44561, 147011, 578-1966; 9079, KREMEN2, 44562, 147012, 210-1472; 9079, KREMEN2, 44563, 147013, 247-1392; 9079, KREMEN2, 44564, 147014, 306-1505; 9079, KREMEN2, 44565, 147015, 1-1275; 9079, KREMEN2, 44566, 147016, 247-1518; 9080, KRIT1, 44571, 147021, 682-783; 9080, KRIT1, 44572, 147022, 410-702; 9080, KRIT1, 44573, 147023, 744-1472; 9080, KRIT1, 44574, 147024, 492-665; 9080, KRIT1, 44575, 147025, 409-483; 9080, KRIT1, 44576, 147026, 222-557; 9080, KRIT1, 44577, 147027, 311-507; 9080, KRIT1, 44578, 147028, 68-561; 9080, KRIT1, 44579, 147029, 512-546; 9080, KRIT1, 44580, 147030, 492-978; 9080, KRIT1, 44581, 147031, 303-855; 9080, KRIT1, 44582, 147032, 344-551; 9080, KRIT1, 44584, 147034, 459-572; 9080, KRIT1, 44585, 147035, 485-2182; 9080, KRIT1, 44567, 147017, 1020-3230; 9080, KRIT1, 44568, 147018, 398-2464; 9080, KRIT1, 44569, 147019, 555-2765; 9080, KRIT1, 44570, 147020, 785-2995; 9080, KRIT1, 44583, 147033, 790-3000; 9081, KRR1, 44588, 147038, 12-878; 9081, KRR1, 44586, 147036, 25-1170; 9081, KRR1, 44587, 147037, 1-975; 9082, KLF1, 44589, 147039, 42-1130; 9083, KLF10, 44590, 147040, 302-1744; 9083, KLF10, 44591, 147041, 904-2313; 9084, KLF11, 44593, 147043, 233-614; 9084, KLF11, 44594, 147044, 69-559; 9084, KLF11, 44595, 147045, 287-653; 9084, KLF11, 44592, 147042, 163-1701; 9084, KLF11, 44596, 147046, 217-1704; 9084, KLF11, 44597, 147047, 69-1556; 9085, KLF12, 44598, 147048, 274-1407; 9085, KLF12, 44599, 147049, 28-1236; 9086, KLF13, 44601, 147051, 43-345; 9086, KLF13, 44602, 147052, 533-574; 9086, KLF13, 44603, 147053, 47-907; 9086, KLF13, 44604, 147054, 47-907; 9086, KLF13, 44600, 147050, 359-1225; 9086, KLF13, 44605, 147055, 334-1200; 9087, KLF14, 44606, 147056, 29-1000; 9088, KLF15, 44607, 147057, 232-1482; 9089, KLF16, 44610, 147060, 20-367; 9089, KLF16, 44608, 147058, 72-830; 9089, KLF16, 44609, 147059, 1-759; 9089, KLF16, 44611, 147061, 1-759; 9090, KLF17, 44613, 147063, 39-386; 9090, KLF17, 44612, 147062, 59-1228; 9091, KLF18, 44614, 147064, 1-3159; 9092, KLF2, 44616, 147066, 85-321; 9092, KLF2, 44615, 147065, 108-1175; 9093, KLF3, 44617, 147067, 306-1343; 9093, KLF3, 44618, 147068, 305-1003; 9094, KLF4, 44620, 147070, 103-800; 9094, KLF4, 44621, 147071, 756-822; 9094, KLF4, 44622, 147072, 622-1059; 9094, KLF4, 44619, 147069, 475-1914; 9095, KLF5, 44623, 147073, 537-1910; 9095, KLF5, 44624, 147074, 196-1296; 9096, KLF6, 44625, 147075, 180-1025; 9096, KLF6, 44626, 147076, 262-1113; 9096, KLF6, 44627, 147077, 268-981; 9097, KLF7, 44630, 147080, 413-594; 9097, KLF7, 44632, 147082, 413-750; 9097, KLF7, 44635, 147085, 202-357; 9097, KLF7, 44636, 147086, 54-578; 9097, KLF7, 44628, 147078, 378-1286; 9097, KLF7, 44629, 147079, 105-914; 9097, KLF7, 44631, 147081, 4-342; 9097, KLF7, 44633, 147083, 230-922; 9097, KLF7, 44634, 147084, 54-878; 9098, KLF8, 44639, 147089, 147-833; 9098, KLF8, 44640, 147090, 65-823; 9098, KLF8, 44637, 147087, 487-1260; 9098, KLF8, 44638, 147088, 289-1368; 9099, KLF9, 44641, 147091, 1262-1996; 9100,

KTI12, 44642, 147092, 56-1120; 9101, KCNIP1, 44643, 147093, 538-1188; 9101, KCNIP1, 44645, 147095, 763-1425; 9101, KCNIP1, 44648, 147098, 189-317; 9101, KCNIP1, 44650, 147100, 1-624; 9101, KCNIP1, 44644, 147094, 391-1068; 9101, KCNIP1, 44646, 147096, 1-684; 9101, KCNIP1, 44647, 147097, 1-726; 9101, KCNIP1, 44649, 147099, 460-1026; 9102, KCNIP2, 44657, 147107, 202-756; 9102, KCNIP2, 44651, 147101, 1-555; 9102, KCNIP2, 44652, 147102, 33-710; 9102, KCNIP2, 44653, 147103, 1-684; 9102, KCNIP2, 44654, 147104, 1-663; 9102, KCNIP2, 44655, 147105, 277-1089; 9102, KCNIP2, 44656, 147106, 353-1111; 9102, KCNIP2, 44658, 147108, 1-534; 9102, KCNIP2, 44659, 147109, 1-858; 9103, KCNIP3, 44661, 147111, 1-771; 9103, KCNIP3, 44660, 147110, 136-906; 9103, KCNIP3, 44662, 147112, 293-985; 9104, KCNIP4, 44669, 147119, 1-105; 9104, KCNIP4, 44670, 147120, 338-425; 9104, KCNIP4, 44663, 147113, 136-702; 9104, KCNIP4, 44664, 147114, 338-1015; 9104, KCNIP4, 44665, 147115, 84-773; 9104, KCNIP4, 44666, 147116, 169-921; 9104, KCNIP4, 44667, 147117, 115-765; 9104, KCNIP4, 44668, 147118, 291-857; 9105, KXD1, 44674, 147124, 538-924; 9105, KXD1, 44675, 147125, 278-686; 9105, KXD1, 44677, 147127, 490-712; 9105, KXD1, 44678, 147128, 135-635; 9105, KXD1, 44679, 147129, 61-648; 9105, KXD1, 44680, 147130, 1-257; 9105, KXD1, 44682, 147132, 262-656; 9105, KXD1, 44683, 147133, 58-444; 9105, KXD1, 44686, 147136, 326-341; 9105, KXD1, 44671, 147121, 149-679; 9105, KXD1, 44672, 147122, 210-740; 9105, KXD1, 44673, 147123, 306-836; 9105, KXD1, 44676, 147126, 88-618; 9105, KXD1, 44681, 147131, 49-579; 9105, KXD1, 44684, 147134, 45-575; 9105, KXD1, 44685, 147135, 1461-1991; 9106, KYNU, 44690, 147140, 91-537; 9106, KYNU, 44691, 147141, 277-507; 9106, KYNU, 44692, 147142, 1-505; 9106, KYNU, 44693, 147143, 1-472; 9106, KYNU, 44694, 147144, 1-711; 9106, KYNU, 44687, 147137, 259-1656; 9106, KYNU, 44688, 147138, 100-1023; 9106, KYNU, 44689, 147139, 179-1576; 9107, KMO, 44695, 147145, 1-547; 9107, KMO, 44696, 147146, 41-1399; 9107, KMO, 44697, 147147, 312-1733; 9107, KMO, 44698, 147148, 312-1772; 9108, KY, 44701, 147151, 62-988; 9108, KY, 44699, 147149, 63-2048; 9108, KY, 44700, 147150, 59-1981; 9109, LAGE3, 44703, 147153, 11-328; 9109, LAGE3, 44702, 147152, 343-774; 9110, L3MBTL1, 44704, 147154, 20-2251; 9110, L3MBTL1, 44706, 147156, 47-460; 9110, L3MBTL1, 44709, 147159, 1-1617; 9110, L3MBTL1, 44710, 147160, 1-136; 9110, L3MBTL1, 44711, 147161, 320-573; 9110, L3MBTL1, 44705, 147155, 133-2451; 9110, L3MBTL1, 44707, 147157, 77-2599; 9110, L3MBTL1, 44708, 147158, 160-2682; 9111, L3MBTL2, 44713, 147163, 1-864; 9111, L3MBTL2, 44714, 147164, 1-699; 9111, L3MBTL2, 44715, 147165, 52-174; 9111, L3MBTL2, 44712, 147162, 159-2276; 9111, L3MBTL2, 44716, 147166, 40-1884; 9112, L3MBTL3, 44721, 147171, 192-762; 9112, L3MBTL3, 44722, 147172, 177-665; 9112, L3MBTL3, 44717, 147167, 177-2519; 9112, L3MBTL3, 44718, 147168, 207-2549; 9112, L3MBTL3, 44719, 147169, 194-2461; 9112, L3MBTL3, 44720, 147170, 480-2822; 9112, L3MBTL3, 44723, 147173, 244-2511; 9112, L3MBTL3, 44724, 147174, 171-2438; 9113, L3MBTL4, 44726, 147176, 202-2046; 9113, L3MBTL4, 44729, 147179, 182-549; 9113, L3MBTL4, 44730, 147180, 328-568; 9113, L3MBTL4, 44731, 147181, 377-1002; 9113, L3MBTL4, 44725, 147175, 1-1872; 9113, L3MBTL4, 44727, 147177, 202-1806; 9113, L3MBTL4, 44728, 147178, 161-2032; 9114, L1CAM, 44735, 147185, 1-462; 9114, L1CAM, 44737, 147187, 192-576; 9114, L1CAM, 44738, 147188, 300-569; 9114, L1CAM, 44739, 147189, 387-637; 9114, L1CAM, 44740, 147190, 1-570; 9114, L1CAM, 44741, 147191, 204-655; 9114, L1CAM, 44732, 147182, 109-3855; 9114, L1CAM, 44733, 147183, 12-3773; 9114, L1CAM, 44734, 147184, 199-3945; 9114, L1CAM, 44736, 147186, 191-3964; 9115, L2HGDH, 44742, 147192, 19-1344; 9115, L2HGDH, 44745, 147195, 77-787; 9115, L2HGDH, 44746, 147196, 77-277; 9115, L2HGDH, 44747, 147197, 5-640; 9115, L2HGDH, 44743, 147193, 399-1790; 9115, L2HGDH, 44744, 147194, 80-1471; 9116, N/A, 44748, 147198, 1-393; 9117, L3HYPDH, 44750, 147200, 333-758; 9117, L3HYPDH, 44751, 147201, 202-639; 9117, L3HYPDH, 44749, 147199, 115-1179; 9118, LARP1, 44753, 147203, 1-450; 9118, LARP1, 44754, 147204, 1-184; 9118, LARP1, 44755, 147205, 184-2630; 9118, LARP1, 44756, 147206, 1-202; 9118, LARP1, 44757, 147207, 292-569; 9118, LARP1, 44758, 147208, 1-501; 9118, LARP1, 44759, 147209, 297-2128; 9118, LARP1, 44760, 147210, 1-109; 9118, LARP1, 44761, 147211, 1-843; 9118, LARP1, 44762, 147212, 1-551; 9118, LARP1, 44763, 147213, 1-587; 9118, LARP1, 44752, 147202, 25-3084; 9119, LARP1B, 44766, 147216, 132-1208; 9119, LARP1B, 44767, 147217, 194-1750; 9119, LARP1B, 44768, 147218, 1-78; 9119, LARP1B, 44769, 147219, 1-1474; 9119, LARP1B, 44770, 147220, 168-1891; 9119, LARP1B, 44764, 147214, 212-2956; 9119, LARP1B, 44765, 147215, 145-1152; 9120, LARP4, 44775, 147225, 307-559; 9120, LARP4, 44777, 147227, 1-1476; 9120, LARP4, 44779, 147229, 478-588; 9120, LARP4, 44780, 147230, 315-1442; 9120, LARP4, 44781, 147231, 238-584; 9120, LARP4, 44782, 147232, 415-790; 9120, LARP4, 44783, 147233, 540-722; 9120, LARP4, 44784, 147234, 80-586; 9120, LARP4, 44785, 147235, 399-567; 9120, LARP4, 44786, 147236, 11-583; 9120, LARP4, 44787, 147237, 480-587; 9120, LARP4, 44788, 147238, 104-1228; 9120, LARP4, 44789, 147239, 290-856; 9120, LARP4, 44790, 147240, 315-881; 9120, LARP4, 44771, 147221, 203-2164; 9120, LARP4, 44772, 147222, 27-1988; 9120, LARP4, 44773, 147223, 113-2287; 9120, LARP4, 44774, 147224, 155-2347; 9120, LARP4, 44776, 147226, 83-2254; 9120, LARP4, 44778, 147228, 104-1441; 9121, LARP4B, 44792, 147242, 288-681; 9121, LARP4B, 44793, 147243, 262-432; 9121, LARP4B, 44794, 147244, 1-1018; 9121, LARP4B, 44795, 147245, 1-572; 9121, LARP4B, 44796, 147246, 113-352; 9121, LARP4B, 44798, 147248, 1-462; 9121, LARP4B, 44791, 147241, 42-2258; 9121, LARP4B, 44797, 147247, 318-2534; 9122, LARP6, 44801, 147251, 1-235; 9122, LARP6, 44802, 147252, 465-558; 9122, LARP6, 44799, 147249, 72-1547; 9122, LARP6, 44800, 147250, 34-315; 9123, LARP7, 44805, 147255, 151-1047; 9123, LARP7, 44806, 147256, 367-753; 9123, LARP7, 44807, 147257, 62-528; 9123, LARP7, 44808, 147258, 116-253; 9123, LARP7, 44810, 147260, 82-219; 9123, LARP7, 44811, 147261, 1-1003; 9123, LARP7, 44812, 147262, 222-579; 9123, LARP7, 44813, 147263, 136-441; 9123, LARP7, 44803, 147253, 151-1899; 9123, LARP7, 44804, 147254, 279-2027; 9123, LARP7, 44809, 147259, 304-2073; 9124, N/A, 44814, 147264, 84-374; 9124, N/A, 44815, 147265, 797-1132; 9125, N/A, 44816, 147266, 22-1632; 9126, N/A, 44817, 147267, 1-367; 9127, LACC1, 44820, 147270, 212-705; 9127, LACC1, 44818, 147268, 322-1614; 9127, LACC1, 44819, 147269, 486-1778; 9128, LACRT, 44822, 147272, 40-423; 9128, LACRT, 44823, 147273, 1-258; 9128, LACRT, 44821, 147271, 55-471; 9129, LALBA, 44825, 147275, 47-418; 9129, LALBA, 44824, 147274, 27-455; 9130, LACTB, 44828, 147278, 174-552; 9130, LACTB, 44826, 147276, 73-1716; 9130,

LACTB, 44827, 147277, 40-1161; 9131, LACTB2, 44829, 147279, 38-904; 9131, LACTB2, 44830, 147280, 55-921; 9132, LACTBL1, 44831, 147281, 1-1641; 9132, LACTBL1, 44832, 147282, 1-1500; 9133, LCT, 44834, 147284, 1-3012; 9133, LCT, 44833, 147283, 12-5795; 9134, LCTL, 44837, 147287, 525-635; 9134, LCTL, 44835, 147285, 133-1836; 9134, LCTL, 44836, 147286, 346-1530; 9135, LDHA, 44843, 147293, 107-576; 9135, LDHA, 44844, 147294, 99-239; 9135, LDHA, 44845, 147295, 99-236; 9135, LDHA, 44846, 147296, 300-732; 9135, LDHA, 44847, 147297, 26-163; 9135, LDHA, 44848, 147298, 99-236; 9135, LDHA, 44849, 147299, 99-383; 9135, LDHA, 44850, 147300, 99-368; 9135, LDHA, 44851, 147301, 100-228; 9135, LDHA, 44852, 147302, 249-465; 9135, LDHA, 44855, 147305, 339-682; 9135, LDHA, 44856, 147306, 1-141; 9135, LDHA, 44838, 147288, 76-801; 9135, LDHA, 44839, 147289, 358-1356; 9135, LDHA, 44840, 147290, 100-924; 9135, LDHA, 44841, 147291, 274-1272; 9135, LDHA, 44842, 147292, 100-924; 9135, LDHA, 44853, 147303, 283-1368; 9135, LDHA, 44854, 147304, 290-1288; 9136, LDHAL6A, 44859, 147309, 265-966; 9136, LDHAL6A, 44857, 147307, 798-1796; 9136, LDHAL6A, 44858, 147308, 265-1263; 9137, LDHAL6B, 44860, 147310, 119-1264; 9138, LDHB, 44862, 147312, 47-744; 9138, LDHB, 44864, 147314, 323-732; 9138, LDHB, 44865, 147315, 182-487; 9138, LDHB, 44861, 147311, 99-1103; 9138, LDHB, 44863, 147313, 334-1338; 9139, LDHC, 44867, 147317, 96-251; 9139, LDHC, 44869, 147319, 59-214; 9139, LDHC, 44870, 147320, 1-726; 9139, LDHC, 44871, 147321, 1-957; 9139, LDHC, 44872, 147322, 1-504; 9139, LDHC, 44873, 147323, 59-196; 9139, LDHC, 44874, 147324, 1-552; 9139, LDHC, 44875, 147325, 1-678; 9139, LDHC, 44866, 147316, 142-1140; 9139, LDHC, 44868, 147318, 112-1110; 9140, LDHD, 44878, 147328, 36-143; 9140, LDHD, 44876, 147326, 48-1571; 9140, LDHD, 44877, 147327, 52-1506; 9141, LACE1, 44880, 147330, 263-742; 9141, LACE1, 44881, 147331, 1-1049; 9141, LACE1, 44882, 147332, 1-242; 9141, LACE1, 44879, 147329, 187-1632; 9142, LPO, 44884, 147334, 1-354; 9142, LPO, 44886, 147336, 241-2202; 9142, LPO, 44887, 147337, 1-288; 9142, LPO, 44889, 147339, 217-585; 9142, LPO, 44883, 147333, 317-2455; 9142, LPO, 44885, 147335, 317-2206; 9142, LPO, 44888, 147338, 559-2448; 9143, LTF, 44891, 147341, 39-584; 9143, LTF, 44892, 147342, 569-2656; 9143, LTF, 44893, 147343, 2-2128; 9143, LTF, 44890, 147340, 297-2429; 9143, LTF, 44894, 147344, 318-2318; 9144, LAD1, 44895, 147345, 60-1655; 9144, LAD1, 44897, 147347, 1-579; 9144, LAD1, 44898, 147348, 56-589; 9144, LAD1, 44899, 147349, 1-565; 9144, LAD1, 44900, 147350, 1-550; 9144, LAD1, 44896, 147346, 303-1856; 9145, LBX1, 44901, 147351, 980-1825; 9146, LBX2, 44904, 147354, 126-299; 9146, LBX2, 44902, 147352, 180-776; 9146, LBX2, 44903, 147353, 458-1042; 9147, LVRN, 44906, 147356, 125-3061; 9147, LVRN, 44905, 147355, 125-3097; 9147, LVRN, 44907, 147357, 165-2270; 9147, LVRN, 44908, 147358, 262-858; 9147, LVRN, 44909, 147359, 242-838; 9147, LVRN, 44910, 147360, 262-942; 9148, LMNA, 44912, 147362, 250-1713; 9148, LMNA, 44913, 147363, 103-1578; 9148, LMNA, 44919, 147369, 118-234; 9148, LMNA, 44920, 147370, 1-783; 9148, LMNA, 44921, 147371, 1-546; 9148, LMNA, 44911, 147361, 250-2154; 9148, LMNA, 44914, 147364, 198-2042; 9148, LMNA, 44915, 147365, 213-2207; 9148, LMNA, 44916, 147366, 642-2360; 9148, LMNA, 44917, 147367, 45-1769; 9148, LMNA, 44918, 147368, 121-1818; 9149, LBR, 44924, 147374, 235-874; 9149, LBR, 44925, 147375, 582-736; 9149, LBR, 44922, 147372, 97-1944; 9149, LBR, 44923, 147373, 165-2012; 9150, LMNB1, 44927, 147377, 321-1484; 9150, LMNB1, 44928, 147378, 887-1876; 9150, LMNB1, 44929, 147379, 241-738; 9150, LMNB1, 44926, 147376, 362-2122; 9151, LMNB2, 44930, 147380, 64-1926; 9152, LMNTD1, 44935, 147385, 1-318; 9152, LMNTD1, 44936, 147386, 1-490; 9152, LMNTD1, 44937, 147387, 206-716; 9152, LMNTD1, 44939, 147389, 309-525; 9152, LMNTD1, 44940, 147390, 152-582; 9152, LMNTD1, 44941, 147391, 101-597; 9152, LMNTD1, 44931, 147381, 151-1317; 9152, LMNTD1, 44932, 147382, 244-1353; 9152, LMNTD1, 44933, 147383, 4-981; 9152, LMNTD1, 44934, 147384, 246-1475; 9152, LMNTD1, 44938, 147388, 481-1356; 9153, LMNTD2, 44943, 147393, 146-1051; 9153, LMNTD2, 44944, 147394, 56-798; 9153, LMNTD2, 44946, 147396, 146-1051; 9153, LMNTD2, 44947, 147397, 56-798; 9153, LMNTD2, 44942, 147392, 64-1968; 9153, LMNTD2, 44945, 147395, 64-1968; 9154, LAMA1, 44948, 147398, 95-9322; 9155, LAMA2, 44950, 147400, 106-9471; 9155, LAMA2, 44951, 147401, 106-9462; 9155, LAMA2, 44949, 147399, 50-9418; 9156, LAMA3, 44952, 147402, 206-5380; 9156, LAMA3, 44954, 147404, 1-9834; 9156, LAMA3, 44955, 147405, 1-3442; 9156, LAMA3, 44956, 147406, 1-5007; 9156, LAMA3, 44957, 147407, 1-112; 9156, LAMA3, 44958, 147408, 1-285; 9156, LAMA3, 44959, 147409, 1-178; 9156, LAMA3, 44960, 147410, 1-403; 9156, LAMA3, 44961, 147411, 87-1815; 9156, LAMA3, 44953, 147403, 242-10243; 9157, LAMA4, 44962, 147412, 399-5870; 9157, LAMA4, 44963, 147413, 279-541; 9157, LAMA4, 44965, 147415, 1-536; 9157, LAMA4, 44966, 147416, 284-5734; 9157, LAMA4, 44969, 147419, 256-645; 9157, LAMA4, 44970, 147420, 389-5839; 9157, LAMA4, 44971, 147421, 1-566; 9157, LAMA4, 44972, 147422, 1-562; 9157, LAMA4, 44973, 147423, 269-588; 9157, LAMA4, 44974, 147424, 411-5861; 9157, LAMA4, 44975, 147425, 336-1330; 9157, LAMA4, 44976, 147426, 296-539; 9157, LAMA4, 44964, 147414, 272-634; 9157, LAMA4, 44967, 147417, 279-641; 9157, LAMA4, 44968, 147418, 194-554; 9158, LAMA5, 44978, 147428, 1-117; 9158, LAMA5, 44979, 147429, 1-723; 9158, LAMA5, 44977, 147427, 68-11155; 9159, LAMB1, 44981, 147431, 276-550; 9159, LAMB1, 44982, 147432, 164-2716; 9159, LAMB1, 44983, 147433, 186-5618; 9159, LAMB1, 44984, 147434, 153-703; 9159, LAMB1, 44980, 147430, 232-5592; 9160, LAMB2, 44987, 147437, 130-582; 9160, LAMB2, 44985, 147435, 154-5550; 9160, LAMB2, 44986, 147436, 166-5562; 9161, LAMB3, 44991, 147441, 345-908; 9161, LAMB3, 44992, 147442, 232-710; 9161, LAMB3, 44988, 147438, 136-3654; 9161, LAMB3, 44989, 147439, 119-3637; 9161, LAMB3, 44990, 147440, 391-3909; 9162, LAMB4, 44995, 147445, 81-2399; 9162, LAMB4, 44996, 147446, 1-2250; 9162, LAMB4, 44993, 147443, 81-5366; 9162, LAMB4, 44994, 147444, 85-5370; 9163, LAMC1, 44998, 147448, 545-657; 9163, LAMC1, 44997, 147447, 258-5087; 9164, LAMC2, 44999, 147449, 66-3647; 9164, LAMC2, 45000, 147450, 116-3451; 9165, LAMC3, 45001, 147451, 1-773; 9165, LAMC3, 45002, 147452, 134-4861; 9166, LANCL1, 45007, 147457, 103-351; 9166, LANCL1, 45008, 147458, 220-808; 9166, LANCL1, 45010, 147460, 1-441; 9166, LANCL1, 45003, 147453, 76-1275; 9166, LANCL1, 45004, 147454, 344-1543; 9166, LANCL1, 45005, 147455, 66-1265; 9166, LANCL1, 45006, 147456, 165-1364; 9166, LANCL1, 45009, 147459, 71-1270; 9167, LANCL2, 45012, 147462, 1-122; 9167, LANCL2, 45011, 147461, 579-1931; 9168, LANCL3, 45013, 147463, 220-1482; 9168, LANCL3, 45014, 147464, 303-1469; 9168,

LANCL3, 45015, 147465, 303-1469; 9169, LSS, 45018, 147468, 68-853; 9169, LSS, 45020, 147470, 1-409; 9169, LSS, 45022, 147472, 1-1649; 9169, LSS, 45023, 147473, 1-1649; 9169, LSS, 45024, 147474, 1-1649; 9169, LSS, 45025, 147475, 1-409; 9169, LSS, 45026, 147476, 1-233; 9169, LSS, 45016, 147466, 78-2276; 9169, LSS, 45017, 147467, 80-2278; 9169, LSS, 45019, 147469, 452-2410; 9169, LSS, 45021, 147471, 37-2202; 9170, LSG1, 45028, 147478, 1-537; 9170, LSG1, 45029, 147479, 1-854; 9170, LSG1, 45027, 147477, 316-2292; 9171, LATS1, 45031, 147481, 360-767; 9171, LATS1, 45033, 147483, 1-602; 9171, LATS1, 45034, 147484, 317-724; 9171, LATS1, 45030, 147480, 229-3621; 9171, LATS1, 45032, 147482, 549-3941; 9171, LATS1, 45035, 147485, 398-2470; 9172, LATS2, 45036, 147486, 407-3673; 9173, LAS1L, 45041, 147491, 1-221; 9173, LAS1L, 45037, 147487, 42-2069; 9173, LAS1L, 45038, 147488, 40-2193; 9173, LAS1L, 45039, 147489, 42-2246; 9173, LAS1L, 45040, 147490, 61-936; 9174, LCE1A, 45042, 147492, 1-333; 9175, LCE1B, 45043, 147493, 477-833; 9176, LCE1C, 45045, 147495, 49-211; 9176, LCE1C, 45044, 147494, 1-357; 9177, LCE1D, 45046, 147496, 44-388; 9178, LCE1E, 45049, 147499, 1-267; 9178, LCE1E, 45047, 147497, 54-410; 9178, LCE1E, 45048, 147498, 173-529; 9179, LCE1F, 45050, 147500, 1-357; 9180, LCE2A, 45051, 147501, 52-372; 9181, LCE2B, 45052, 147502, 55-387; 9182, LCE2C, 45053, 147503, 56-388; 9183, LCE2D, 45054, 147504, 56-388; 9184, LCE3A, 45055, 147505, 1-270; 9185, LCE3B, 45056, 147506, 1-288; 9186, LCE3C, 45058, 147508, 1-270; 9186, LCE3C, 45057, 147507, 71-355; 9187, LCE3D, 45059, 147509, 58-336; 9188, LCE3E, 45060, 147510, 57-335; 9189, LCE4A, 45061, 147511, 30-329; 9189, LCE4A, 45062, 147512, 257-556; 9190, LCE5A, 45063, 147513, 177-533; 9191, LCE6A, 45064, 147514, 166-408; 9192, LELP1, 45065, 147515, 111-407; 9193, LAMTOR1, 45067, 147517, 1-239; 9193, LAMTOR1, 45068, 147518, 13-495; 9193, LAMTOR1, 45069, 147519, 74-304; 9193, LAMTOR1, 45070, 147520, 23-451; 9193, LAMTOR1, 45071, 147521, 14-313; 9193, LAMTOR1, 45066, 147516, 164-649; 9194, LAMTOR2, 45072, 147522, 41-493; 9194, LAMTOR2, 45073, 147523, 99-386; 9194, LAMTOR2, 45074, 147524, 139-516; 9195, LAMTOR3, 45075, 147525, 80-433; 9195, LAMTOR3, 45076, 147526, 194-568; 9196, LAMTOR4, 45078, 147528, 36-449; 9196, LAMTOR4, 45079, 147529, 62-280; 9196, LAMTOR4, 45080, 147530, 248-373; 9196, LAMTOR4, 45081, 147531, 61-309; 9196, LAMTOR4, 45082, 147532, 232-306; 9196, LAMTOR4, 45083, 147533, 356-481; 9196, LAMTOR4, 45084, 147534, 312-371; 9196, LAMTOR4, 45085, 147535, 1-58; 9196, LAMTOR4, 45077, 147527, 67-366; 9197, LAMTOR5, 45086, 147536, 77-598; 9197, LAMTOR5, 45087, 147537, 608-880; 9197, LAMTOR5, 45088, 147538, 148-420; 9197, LAMTOR5, 45089, 147539, 48-287; 9197, LAMTOR5, 45091, 147541, 59-580; 9197, LAMTOR5, 45090, 147540, 89-364; 9198, LTBP1, 45093, 147543, 114-4136; 9198, LTBP1, 45096, 147546, 1-799; 9198, LTBP1, 45097, 147547, 142-4203; 9198, LTBP1, 45098, 147548, 1-810; 9198, LTBP1, 45099, 147549, 289-593; 9198, LTBP1, 45100, 147550, 57-713; 9198, LTBP1, 45101, 147551, 1-662; 9198, LTBP1, 45092, 147542, 82-4269; 9198, LTBP1, 45094, 147544, 100-4128; 9198, LTBP1, 45095, 147545, 354-5519; 9199, LTBP2, 45103, 147553, 1-699; 9199, LTBP2, 45104, 147554, 129-5462; 9199, LTBP2, 45105, 147555, 435-5744; 9199, LTBP2, 45102, 147552, 388-5853; 9200, LTBP3, 45108, 147558, 1-2722; 9200, LTBP3, 45109, 147559, 1-423; 9200, LTBP3, 45110, 147560, 80-430; 9200, LTBP3, 45111, 147561, 1-431; 9200, LTBP3, 45112, 147562, 1280-2200; 9200, LTBP3, 45113, 147563, 957-1736; 9200, LTBP3, 45114, 147564, 1-208; 9200, LTBP3, 45115, 147565, 347-3756; 9200, LTBP3, 45116, 147566, 865-3066; 9200, LTBP3, 45117, 147567, 205-575; 9200, LTBP3, 45118, 147568, 84-748; 9200, LTBP3, 45119, 147569, 3261-4052; 9200, LTBP3, 45106, 147556, 270-4181; 9200, LTBP3, 45107, 147557, 1-3771; 9201, LTBP4, 45120, 147570, 1-4764; 9201, LTBP4, 45121, 147571, 1-2873; 9201, LTBP4, 45124, 147574, 1-573; 9201, LTBP4, 45125, 147575, 1-910; 9201, LTBP4, 45126, 147576, 1-2019; 9201, LTBP4, 45127, 147577, 1-670; 9201, LTBP4, 45128, 147578, 1-547; 9201, LTBP4, 45129, 147579, 1-281; 9201, LTBP4, 45130, 147580, 1-755; 9201, LTBP4, 45131, 147581, 5-217; 9201, LTBP4, 45132, 147582, 1-567; 9201, LTBP4, 45133, 147583, 1-438; 9201, LTBP4, 45134, 147584, 12-146; 9201, LTBP4, 45135, 147585, 284-418; 9201, LTBP4, 45122, 147572, 1-4875; 9201, LTBP4, 45123, 147573, 18-4691; 9202, LXN, 45137, 147587, 1-472; 9202, LXN, 45136, 147586, 216-884; 9203, LAYN, 45141, 147591, 601-927; 9203, LAYN, 45142, 147592, 403-550; 9203, LAYN, 45143, 147593, 125-529; 9203, LAYN, 45144, 147594, 136-948; 9203, LAYN, 45145, 147595, 115-903; 9203, LAYN, 45146, 147596, 339-664; 9203, LAYN, 45138, 147588, 337-1461; 9203, LAYN, 45139, 147589, 186-1334; 9203, LAYN, 45140, 147590, 614-1303; 9204, LBHD1, 45148, 147598, 28-821; 9204, LBHD1, 45150, 147600, 37-403; 9204, LBHD1, 45152, 147602, 129-492; 9204, LBHD1, 45147, 147597, 217-1008; 9204, LBHD1, 45149, 147599, 1735-2604; 9204, LBHD1, 45151, 147601, 436-1227; 9205, LIME1, 45154, 147604, 132-451; 9205, LIME1, 45155, 147605, 267-661; 9205, LIME1, 45156, 147606, 62-592; 9205, LIME1, 45157, 147607, 52-809; 9205, LIME1, 45158, 147608, 74-709; 9205, LIME1, 45153, 147603, 88-975; 9206, LCK, 45161, 147611, 78-932; 9206, LCK, 45162, 147612, 139-551; 9206, LCK, 45163, 147613, 139-1689; 9206, LCK, 45164, 147614, 114-714; 9206, LCK, 45165, 147615, 120-566; 9206, LCK, 45166, 147616, 104-1060; 9206, LCK, 45167, 147617, 78-580; 9206, LCK, 45159, 147609, 101-1720; 9206, LCK, 45160, 147610, 139-1668; 9206, LCK, 45168, 147618, 122-1651; 9207, LCA5, 45171, 147621, 408-1700; 9207, LCA5, 45169, 147619, 436-2529; 9207, LCA5, 45170, 147620, 613-2706; 9208, LCA5L, 45175, 147625, 498-706; 9208, LCA5L, 45176, 147626, 238-523; 9208, LCA5L, 45177, 147627, 626-657; 9208, LCA5L, 45178, 147628, 318-885; 9208, LCA5L, 45179, 147629, 566-849; 9208, LCA5L, 45180, 147630, 483-804; 9208, LCA5L, 45181, 147631, 521-612; 9208, LCA5L, 45182, 147632, 530-808; 9208, LCA5L, 45183, 147633, 502-690; 9208, LCA5L, 45184, 147634, 299-1165; 9208, LCA5L, 45172, 147622, 366-2378; 9208, LCA5L, 45173, 147623, 530-2542; 9208, LCA5L, 45174, 147624, 30-2042; 9209, LRAT, 45186, 147636, 340-546; 9209, LRAT, 45185, 147635, 254-946; 9209, LRAT, 45187, 147637, 63-755; 9210, LCAT, 45189, 147639, 1-241; 9210, LCAT, 45190, 147640, 1-322; 9210, LCAT, 45191, 147641, 1-186; 9210, LCAT, 45192, 147642, 31-312; 9210, LCAT, 45193, 147643, 1-417; 9210, LCAT, 45194, 147644, 476-1240; 9210, LCAT, 45188, 147638, 31-1353; 9211, LGALS1, 45196, 147646, 16-132; 9211, LGALS1, 45197, 147647, 47-256; 9211, LGALS1, 45195, 147645, 96-503; 9212, LGALS12, 45198, 147648, 310-1293; 9212, LGALS12, 45199, 147649, 31-1044; 9212, LGALS12, 45200, 147650, 292-1302; 9212, LGALS12, 45201, 147651, 615-1442; 9212, LGALS12, 45202, 147652, 615-1415; 9213, LGALS13, 45204, 147654, 33-282; 9213, LGALS13, 45205, 147655, 69-494; 9213,

LGALS13, 45203, 147653, 46-465; 9214, LGALS14, 45208, 147658, 1-370; 9214, LGALS14, 45206, 147656, 267-773; 9214, LGALS14, 45207, 147657, 224-643; 9215, LGALS16, 45210, 147660, 44-226; 9215, LGALS16, 45209, 147659, 69-497; 9216, LGALS2, 45212, 147662, 318-406; 9216, LGALS2, 45211, 147661, 176-574; 9217, LGALS3, 45214, 147664, 46-747; 9217, LGALS3, 45215, 147665, 54-319; 9217, LGALS3, 45213, 147663, 262-1014; 9218, LGALS3BP, 45217, 147667, 119-736; 9218, LGALS3BP, 45218, 147668, 109-540; 9218, LGALS3BP, 45219, 147669, 136-768; 9218, LGALS3BP, 45220, 147670, 109-165; 9218, LGALS3BP, 45221, 147671, 92-280; 9218, LGALS3BP, 45222, 147672, 112-237; 9218, LGALS3BP, 45223, 147673, 124-465; 9218, LGALS3BP, 45224, 147674, 42-818; 9218, LGALS3BP, 45225, 147675, 26-214; 9218, LGALS3BP, 45226, 147676, 124-270; 9218, LGALS3BP, 45227, 147677, 128-253; 9218, LGALS3BP, 45228, 147678, 148-543; 9218, LGALS3BP, 45229, 147679, 114-379; 9218, LGALS3BP, 45230, 147680, 265-893; 9218, LGALS3BP, 45216, 147666, 310-2067; 9219, LGALS4, 45232, 147682, 1-656; 9219, LGALS4, 45233, 147683, 1-117; 9219, LGALS4, 45234, 147684, 472-566; 9219, LGALS4, 45235, 147685, 472-566; 9219, LGALS4, 45236, 147686, 1-117; 9219, LGALS4, 45237, 147687, 1-656; 9219, LGALS4, 45238, 147688, 479-1450; 9219, LGALS4, 45231, 147681, 479-1450; 9220, LGALS7, 45240, 147690, 460-565; 9220, LGALS7, 45241, 147691, 17-427; 9220, LGALS7, 45239, 147689, 1-411; 9221, LGALS7B, 45243, 147693, 460-565; 9221, LGALS7B, 45244, 147694, 1-411; 9221, LGALS7B, 45242, 147692, 17-427; 9222, LGALS8, 45245, 147695, 293-819; 9222, LGALS8, 45249, 147699, 411-1035; 9222, LGALS8, 45250, 147700, 206-569; 9222, LGALS8, 45251, 147701, 344-846; 9222, LGALS8, 45252, 147702, 146-307; 9222, LGALS8, 45254, 147704, 382-1284; 9222, LGALS8, 45255, 147705, 160-321; 9222, LGALS8, 45257, 147707, 1-903; 9222, LGALS8, 45258, 147708, 142-1014; 9222, LGALS8, 45260, 147710, 481-799; 9222, LGALS8, 45261, 147711, 426-554; 9222, LGALS8, 45246, 147696, 201-1280; 9222, LGALS8, 45247, 147697, 382-1335; 9222, LGALS8, 45248, 147698, 567-1520; 9222, LGALS8, 45253, 147703, 382-1461; 9222, LGALS8, 45256, 147706, 150-1229; 9222, LGALS8, 45259, 147709, 521-1600; 9222, LGALS8, 45262, 147712, 264-1217; 9223, LGALS9, 45266, 147716, 74-598; 9223, LGALS9, 45267, 147717, 1-412; 9223, LGALS9, 45268, 147718, 53-280; 9223, LGALS9, 45269, 147719, 100-327; 9223, LGALS9, 45270, 147720, 1-377; 9223, LGALS9, 45271, 147721, 250-594; 9223, LGALS9, 45263, 147713, 1469-2440; 9223, LGALS9, 45264, 147714, 119-859; 9223, LGALS9, 45265, 147715, 1469-2536; 9224, LGALS9B, 45274, 147724, 1-156; 9224, LGALS9B, 45275, 147725, 70-177; 9224, LGALS9B, 45272, 147722, 66-1133; 9224, LGALS9B, 45273, 147723, 65-1135; 9225, LGALS9C, 45277, 147727, 56-283; 9225, LGALS9C, 45278, 147728, 1-162; 9225, LGALS9C, 45279, 147729, 60-1031; 9225, LGALS9C, 45280, 147730, 58-762; 9225, LGALS9C, 45281, 147731, 100-327; 9225, LGALS9C, 45282, 147732, 72-179; 9225, LGALS9C, 45283, 147733, 119-859; 9225, LGALS9C, 45284, 147734, 91-615; 9225, LGALS9C, 45276, 147726, 82-1152; 9226, LGALSL, 45286, 147736, 5-307; 9226, LGALSL, 45287, 147737, 26-259; 9226, LGALSL, 45288, 147738, 233-607; 9226, LGALSL, 45289, 147739, 100-261; 9226, LGALSL, 45285, 147735, 455-973; 9227, LMAN2, 45291, 147741, 1-978; 9227, LMAN2, 45292, 147742, 6-616; 9227, LMAN2, 45293, 147743, 13-876; 9227, LMAN2, 45294, 147744, 249-823; 9227, LMAN2, 45290, 147740, 206-1276; 9228, LMAN2L, 45297, 147747, 24-395; 9228, LMAN2L, 45298, 147748, 25-396; 9228, LMAN2L, 45299, 147749, 25-360; 9228, LMAN2L, 45300, 147750, 2-325; 9228, LMAN2L, 45301, 147751, 25-534; 9228, LMAN2L, 45295, 147745, 24-1070; 9228, LMAN2L, 45296, 147746, 25-1104; 9229, LMAN1, 45302, 147752, 719-2251; 9230, LMAN1L, 45305, 147755, 1-372; 9230, LMAN1L, 45306, 147756, 229-555; 9230, LMAN1L, 45303, 147753, 140-1720; 9230, LMAN1L, 45304, 147754, 3-1547; 9231, LEFTY1, 45308, 147758, 321-512; 9231, LEFTY1, 45307, 147757, 81-1181; 9232, LEFTY2, 45311, 147761, 34-1152; 9232, LEFTY2, 45309, 147759, 350-1450; 9232, LEFTY2, 45310, 147760, 244-1242; 9233, LGMN, 45314, 147764, 169-315; 9233, LGMN, 45315, 147765, 225-283; 9233, LGMN, 45316, 147766, 298-533; 9233, LGMN, 45317, 147767, 169-573; 9233, LGMN, 45318, 147768, 145-498; 9233, LGMN, 45319, 147769, 154-825; 9233, LGMN, 45320, 147770, 324-495; 9233, LGMN, 45321, 147771, 1-275; 9233, LGMN, 45323, 147773, 311-546; 9233, LGMN, 45324, 147774, 416-588; 9233, LGMN, 45312, 147762, 244-1545; 9233, LGMN, 45313, 147763, 339-1640; 9233, LGMN, 45322, 147772, 154-1272; 9233, LGMN, 45325, 147775, 187-1317; 9234, LMOD1, 45326, 147776, 248-2050; 9234, LMOD1, 45327, 147777, 333-1142; 9235, LMOD2, 45328, 147778, 96-575; 9235, LMOD2, 45329, 147779, 158-1801; 9236, LMOD3, 45330, 147780, 181-1863; 9236, LMOD3, 45331, 147781, 116-1798; 9236, LMOD3, 45332, 147782, 185-1867; 9237, LMLN, 45333, 147783, 1-1812; 9237, LMLN, 45335, 147785, 21-474; 9237, LMLN, 45334, 147784, 23-1990; 9237, LMLN, 45336, 147786, 1-2079; 9237, LMLN, 45337, 147787, 58-1980; 9238, LEMD1, 45338, 147788, 47-250; 9238, LEMD1, 45339, 147789, 47-592; 9238, LEMD1, 45340, 147790, 39-461; 9238, LEMD1, 45341, 147791, 104-649; 9238, LEMD1, 45342, 147792, 103-429; 9238, LEMD1, 45343, 147793, 47-373; 9238, LEMD1, 45344, 147794, 77-280; 9239, LEMD2, 45346, 147796, 10-354; 9239, LEMD2, 45347, 147797, 1-839; 9239, LEMD2, 45348, 147798, 1-307; 9239, LEMD2, 45350, 147800, 395-555; 9239, LEMD2, 45351, 147801, 1-258; 9239, LEMD2, 45345, 147795, 21-1532; 9239, LEMD2, 45349, 147799, 398-1003; 9239, LEMD2, 45352, 147802, 4-1515; 9240, LEMD3, 45353, 147803, 27-2762; 9241, LMTK2, 45354, 147804, 294-4805; 9242, LMTK3, 45355, 147805, 1-4470; 9242, LMTK3, 45356, 147806, 229-4611; 9243, LGSN, 45359, 147809, 35-608; 9243, LGSN, 45357, 147807, 35-1564; 9243, LGSN, 45358, 147808, 35-661; 9243, LGSN, 45360, 147810, 1-357; 9244, LENEP, 45361, 147811, 23-208; 9244, LENEP, 45362, 147812, 21-206; 9245, LIM2, 45363, 147813, 44-691; 9245, LIM2, 45364, 147814, 49-570; 9246, LEO1, 45365, 147815, 62-2062; 9246, LEO1, 45366, 147816, 32-1852; 9247, LEP, 45367, 147817, 52-555; 9248, LEPR, 45373, 147823, 738-1436; 9248, LEPR, 45368, 147818, 186-3683; 9248, LEPR, 45369, 147819, 151-2871; 9248, LEPR, 45370, 147820, 21-2741; 9248, LEPR, 45371, 147821, 186-3062; 9248, LEPR, 45372, 147822, 186-2876; 9248, LEPR, 45374, 147824, 151-2841; 9249, LEPROT, 45376, 147826, 115-537; 9249, LEPROT, 45375, 147825, 139-534; 9250, LEPROTL1, 45378, 147828, 89-523; 9250, LEPROTL1, 45379, 147829, 156-620; 9250, LEPROTL1, 45381, 147831, 1-410; 9250, LEPROTL1, 45382, 147832, 27-347; 9250, LEPROTL1, 45383, 147833, 94-580; 9250, LEPROTL1, 45384, 147834, 211-423; 9250, LEPROTL1, 45377, 147827, 116-511; 9250, LEPROTL1, 45380, 147830, 34-543; 9251, LLGL1, 45386, 147836, 7-3177; 9251, LLGL1, 45385, 147835, 97-3291; 9252, LLGL2, 45390, 147840, 86-204; 9252, LLGL2, 45391, 147841, 1-189; 9252, LLGL2, 45392, 147842, 1-317; 9252, LLGL2, 45393, 147843, 167-585; 9252, LLGL2, 45394, 147844, 1-259; 9252, LLGL2, 45395, 147845, 174-483; 9252, LLGL2, 45396, 147846, 105-3164; 9252, LLGL2, 45397, 147847, 469-784; 9252, LLGL2, 45398, 147848, 99-566; 9252, LLGL2, 45399, 147849, 126-577; 9252, LLGL2, 45387, 147837, 131-3178; 9252, LLGL2, 45388, 147838, 125-1195; 9252, LLGL2, 45389, 147839, 118-3180; 9252, LLGL2, 45400, 147850, 142-1212; 9253, LETMD1, 45402, 147852, 14-457; 9253, LETMD1, 45404, 147854, 1-332; 9253, LETMD1, 45405, 147855, 315-1186; 9253, LETMD1, 45406, 147856, 1-295; 9253, LETMD1, 45408, 147858, 31-582; 9253, LETMD1, 45409, 147859, 17-727; 9253, LETMD1, 45410, 147860, 20-151; 9253, LETMD1, 45411, 147861, 38-469; 9253, LETMD1, 45412, 147862, 92-565; 9253, LETMD1, 45413, 147863, 57-473; 9253, LETMD1, 45414, 147864, 31-330; 9253, LETMD1, 45415, 147865, 101-232; 9253, LETMD1, 45416, 147866, 37-818; 9253, LETMD1, 45417, 147867, 29-433; 9253, LETMD1, 45419, 147869, 1-434; 9253, LETMD1, 45420, 147870, 31-568; 9253, LETMD1, 45421, 147871, 12-743; 9253, LETMD1, 45422, 147872, 31-156; 9253, LETMD1, 45423, 147873, 273-601; 9253, LETMD1, 45401, 147851, 40-1122; 9253, LETMD1, 45403, 147853, 20-1141; 9253, LETMD1, 45407, 147857, 14-481; 9253, LETMD1, 45418, 147868, 101-1015; 9254, LAP3, 45425, 147875, 1-359; 9254, LAP3, 45426, 147876, 1-626; 9254, LAP3, 45424, 147874, 275-1834; 9254, LAP3, 45427, 147877, 65-1531; 9254, LAP3, 45428, 147878, 163-1722; 9255, LCMT1, 45429, 147879, 154-459; 9255, LCMT1, 45432, 147882, 150-485; 9255, LCMT1, 45433, 147883, 1-280; 9255, LCMT1, 45434, 147884, 1-360; 9255, LCMT1, 45435, 147885, 1-475; 9255, LCMT1, 45436, 147886, 1-416; 9255, LCMT1, 45430, 147880, 150-989; 9255, LCMT1, 45431, 147881, 156-1160; 9256, LCMT2, 45438, 147888, 94-213; 9256, LCMT2, 45437, 147887, 117-2177; 9257, LURAP1, 45439, 147889, 94-813; 9258, LURAP1L, 45440, 147890, 696-1382; 9259, LRCOL1, 45441, 147891, 66-206; 9259, LRCOL1, 45443, 147893, 14-199; 9259, LRCOL1, 45444, 147894, 89-508; 9259, LRCOL1, 45442, 147892, 66-545; 9260, LRRFIP1, 45449, 147899, 124-570; 9260, LRRFIP1, 45445, 147895, 241-2595; 9260, LRRFIP1, 45446, 147896, 312-2570; 9260, LRRFIP1, 45447, 147897, 70-1992; 9260, LRRFIP1, 45448, 147898, 118-2544; 9261, LRRFIP2, 45453, 147903, 176-352; 9261, LRRFIP2, 45455, 147905, 287-961; 9261, LRRFIP2, 45456, 147906, 358-560; 9261, LRRFIP2, 45457, 147907, 1-545; 9261, LRRFIP2, 45458, 147908, 213-389; 9261, LRRFIP2, 45460, 147910, 542-718; 9261, LRRFIP2, 45450, 147900, 82-2247; 9261, LRRFIP2, 45451, 147901, 424-1626; 9261, LRRFIP2, 45452, 147902, 150-1661; 9261, LRRFIP2, 45454, 147904, 614-1888; 9261, LRRFIP2, 45459, 147909, 401-1675; 9262, LRRCC1, 45463, 147913, 59-166; 9262, LRRCC1, 45464, 147914, 82-192; 9262, LRRCC1, 45465, 147915, 59-169; 9262, LRRCC1, 45466, 147916, 59-169; 9262, LRRCC1, 45461, 147911, 150-3248; 9262, LRRCC1, 45462, 147912, 890-3928; 9263, LRFN1, 45467, 147917, 1-2316; 9264, LRFN2, 45468, 147918, 544-2913; 9265, LRFN3, 45469, 147919, 453-2339; 9265, LRFN3, 45470, 147920, 1055-2941; 9266, LRFN4, 45472, 147922, 190-1446; 9266, LRFN4, 45471, 147921, 244-2151; 9267, LRFN5, 45474, 147924, 2433-3833; 9267, LRFN5, 45475, 147925, 345-1742; 9267, LRFN5, 45473, 147923, 1190-3349; 9268, LINGO1, 45477, 147927, 58-1035; 9268, LINGO1, 45479, 147929, 386-552; 9268, LINGO1, 45480, 147930, 416-522; 9268, LINGO1, 45481, 147931, 213-588; 9268, LINGO1, 45482, 147932, 516-571; 9268, LINGO1, 45483, 147933, 396-611; 9268, LINGO1, 45484, 147934, 403-938; 9268, LINGO1, 45485, 147935, 533-567; 9268, LINGO1, 45486, 147936, 543-554; 9268, LINGO1, 45476, 147926, 176-2038; 9268, LINGO1, 45478, 147928, 459-2303; 9269, LINGO2, 45487, 147937, 446-2266; 9269, LINGO2, 45488, 147938, 451-2271; 9269, LINGO2, 45489, 147939, 396-2216; 9270, LINGO3, 45490, 147940, 249-2027; 9271, LINGO4, 45491, 147941, 939-2720; 9272, LRSAM1, 45492, 147942, 373-2544; 9272, LRSAM1, 45493, 147943, 605-2776; 9272, LRSAM1, 45494, 147944, 78-2249; 9272, LRSAM1, 45495, 147945, 354-2444; 9273, LRRC1, 45496, 147946, 168-632; 9273, LRRC1, 45497, 147947, 278-1852; 9273, LRRC1, 45498, 147948, 642-1235; 9274, LRRC10, 45499, 147949, 325-1158; 9275, LRRC10B, 45500, 147950, 200-1078; 9276, LRRC14, 45502, 147952, 183-661; 9276, LRRC14, 45504, 147954, 471-730; 9276, LRRC14, 45505, 147955, 76-978; 9276, LRRC14, 45501, 147951, 147-1628; 9276, LRRC14, 45503, 147953, 216-1697; 9277, LRRC14B, 45506, 147956, 29-1573; 9278, LRRC15, 45507, 147957, 87-1832; 9278, LRRC15, 45508, 147958, 114-1877; 9279, LRRC16A, 45510, 147960, 1-2799; 9279, LRRC16A, 45511, 147961, 372-962; 9279, LRRC16A, 45509, 147959, 369-4484; 9280, LRRC16B, 45512, 147962, 155-4273; 9281, LRRC17, 45515, 147965, 489-801; 9281, LRRC17, 45513, 147963, 282-1223; 9281, LRRC17, 45514, 147964, 296-1621; 9282, LRRC18, 45516, 147966, 92-877; 9282, LRRC18, 45517, 147967, 78-863; 9283, LRRC19, 45518, 147968, 112-1224; 9284, LRRC2, 45519, 147969, 183-1298; 9284, LRRC2, 45520, 147970, 394-1509; 9285, LRRC20, 45525, 147975, 228-575; 9285, LRRC20, 45527, 147977, 140-663; 9285, LRRC20, 45521, 147971, 479-1033; 9285, LRRC20, 45522, 147972, 142-528; 9285, LRRC20, 45523, 147973, 142-546; 9285, LRRC20, 45524, 147974, 160-714; 9285, LRRC20, 45526, 147976, 115-519; 9286, LRRC23, 45531, 147981, 411-599; 9286, LRRC23, 45532, 147982, 120-308; 9286, LRRC23, 45533, 147983, 98-748; 9286, LRRC23, 45534, 147984, 1-609; 9286, LRRC23, 45535, 147985, 479-1171; 9286, LRRC23, 45536, 147986, 290-572; 9286, LRRC23, 45537, 147987, 163-351; 9286, LRRC23, 45538, 147988, 221-829; 9286, LRRC23, 45528, 147978, 221-1252; 9286, LRRC23, 45529, 147979, 113-1051; 9286, LRRC23, 45530, 147980, 220-1251; 9287, LRRC24, 45540, 147990, 133-1665; 9287, LRRC24, 45539, 147989, 119-1660; 9288, LRRC25, 45541, 147991, 655-1572; 9288, LRRC25, 45542, 147992, 169-1086; 9289, LRRC26, 45543, 147993, 109-1113; 9290, LRRC27, 45544, 147994, 152-1303; 9290, LRRC27, 45545, 147995, 146-1552; 9290, LRRC27, 45546, 147996, 307-1899; 9290, LRRC27, 45547, 147997, 106-1698; 9290, LRRC27, 45548, 147998, 151-1302; 9291, LRRC28, 45550, 148000, 277-558; 9291, LRRC28, 45552, 148002, 117-341; 9291, LRRC28, 45553, 148003, 235-744; 9291, LRRC28, 45554, 148004, 66-967; 9291, LRRC28, 45555, 148005, 140-322; 9291, LRRC28, 45556, 148006, 241-423; 9291, LRRC28, 45557, 148007, 143-328; 9291, LRRC28, 45558, 148008, 88-644; 9291, LRRC28, 45559, 148009, 1-114; 9291, LRRC28, 45549, 147999, 241-1344; 9291, LRRC28, 45551, 148001, 98-1036; 9292, LRRC29, 45563, 148013, 290-785; 9292, LRRC29, 45564, 148014, 302-786; 9292, LRRC29, 45565, 148015, 396-941; 9292, LRRC29, 45560, 148010, 426-1097; 9292, LRRC29, 45561, 148011, 273-944; 9292, LRRC29, 45562, 148012, 898-1569; 9292, LRRC29, 45566, 148016, 261-932; 9293, LRRC3, 45567, 148017, 318-1091; 9294, LRRC30, 45568, 148018, 15-920; 9295, LRRC31, 45569, 148019, 124-1614; 9295, LRRC31, 45570, 148020, 59-1717; 9295, LRRC31, 45571, 148021, 27-1358; 9296, LRRC32, 45575, 148025, 244-801; 9296, LRRC32, 45572, 148022, 139-2127; 9296, LRRC32, 45573, 148023, 244-2232; 9296, LRRC32, 45574, 148024, 139-2127; 9297, LRRC34, 45578, 148028, 408-1619; 9297, LRRC34, 45579, 148029, 1-171; 9297, LRRC34, 45576, 148026, 117-1511; 9297, LRRC34, 45577, 148027, 439-1737; 9298, LRRC36, 45582, 148032, 92-160; 9298, LRRC36, 45583, 148033, 20-136; 9298, LRRC36, 45584, 148034, 100-492; 9298, LRRC36, 45586, 148036, 118-186; 9298, LRRC36, 45587, 148037, 92-472; 9298, LRRC36, 45588, 148038, 80-304; 9298, LRRC36, 45589, 148039, 18-210; 9298, LRRC36, 45590, 148040, 79-147; 9298, LRRC36, 45591, 148041, 498-747; 9298, LRRC36, 45592, 148042, 508-596; 9298, LRRC36, 45593, 148043, 1-826; 9298, LRRC36, 45580, 148030, 20-2284; 9298, LRRC36, 45581, 148031, 65-1654; 9298, LRRC36, 45585, 148035, 92-1993; 9299, LRRC37A2, 45596, 148046, 4-5106; 9299, LRRC37A2, 45597, 148047, 4-5106; 9299, LRRC37A2, 45598, 148048, 1568-3784; 9299, LRRC37A2, 45599, 148049, 36-4943; 9299, LRRC37A2, 45600, 148050, 4-5034; 9299, LRRC37A2, 45601, 148051, 1498-3714; 9299, LRRC37A2, 45602, 148052, 36-4871; 9299, LRRC37A2, 45594, 148044, 4-5106; 9299, LRRC37A2, 45595, 148045, 496-5598; 9300, LRRC37A3, 45604, 148054, 584-2419; 9300, LRRC37A3, 45605, 148055, 44-2302; 9300, LRRC37A3, 45606, 148056, 1018-3036; 9300, LRRC37A3, 45607, 148057, 1-692; 9300, LRRC37A3, 45608, 148058, 1-282; 9300, LRRC37A3, 45609, 148059, 1-589; 9300, LRRC37A3, 45610, 148060, 28-735; 9300, LRRC37A3, 45603, 148053, 404-5308; 9300, LRRC37A3, 45611, 148061, 532-5436; 9301, LRRC37A, 45613, 148063, 36-4943; 9301, LRRC37A, 45614, 148064, 1575-3791; 9301, LRRC37A, 45615, 148065, 4-5106; 9301, LRRC37A, 45616, 148066, 1570-3786; 9301, LRRC37A, 45617, 148067, 36-4943; 9301, LRRC37A, 45612, 148062, 4-5106; 9302, LRRC37B, 45618, 148068, 62-2986; 9302, LRRC37B, 45621, 148071, 336-2933; 9302, LRRC37B, 45622, 148072, 15-2741; 9302, LRRC37B, 45623, 148073, 1-710; 9302, LRRC37B, 45624, 148074, 267-733; 9302, LRRC37B, 45625, 148075, 70-725; 9302, LRRC37B, 45626, 148076, 15-2177; 9302, LRRC37B, 45619, 148069, 6-2849; 9302, LRRC37B, 45620, 148070, 12-2855; 9303, LRRC38, 45627, 148077, 456-1340; 9304, LRRC39, 45628, 148078, 281-1288; 9304, LRRC39, 45629, 148079, 200-1207; 9304, LRRC39, 45630, 148080, 200-1219; 9304, LRRC39, 45631, 148081, 281-1300; 9305, LRRC3B, 45633, 148083, 326-489; 9305, LRRC3B, 45635, 148085, 439-927; 9305, LRRC3B, 45632, 148082, 593-1372; 9305, LRRC3B, 45634, 148084, 448-1227; 9305, LRRC3B, 45636, 148086, 592-1371; 9306, LRRC3C, 45637, 148087, 51-878; 9307, LRRC4, 45639, 148089, 300-451; 9307, LRRC4, 45640, 148090, 278-561; 9307, LRRC4, 45641, 148091, 322-557; 9307, LRRC4, 45638, 148088, 259-2220; 9308, LRRC40, 45642, 148092, 81-1889; 9309, LRRC41, 45645, 148095, 1-684; 9309, LRRC41, 45646, 148096, 1652-3514; 9309, LRRC41, 45647, 148097, 19-1584; 9309, LRRC41, 45648, 148098, 1-1854; 9309, LRRC41, 45649, 148099, 8-2380; 9309, LRRC41, 45643, 148093, 45-2483; 9309, LRRC41, 45644, 148094, 287-2725; 9310, LRRC42, 45651, 148101, 262-838; 9310, LRRC42, 45653, 148103, 327-1044; 9310, LRRC42, 45650, 148100, 212-1498; 9310, LRRC42, 45652, 148102, 522-1808; 9311, LRRC43, 45655, 148105, 451-891; 9311, LRRC43, 45654, 148104, 29-1999; 9312, LRRC45, 45657, 148107, 713-730; 9312, LRRC45, 45658, 148108, 1-566; 9312, LRRC45, 45656, 148106, 343-2355; 9313, LRRC46, 45660, 148110, 300-596; 9313, LRRC46, 45661, 148111, 268-411; 9313, LRRC46, 45662, 148112, 357-500; 9313, LRRC46, 45659, 148109, 364-1329; 9314, LRRC47, 45664, 148114, 1-152; 9314, LRRC47, 45663, 148113, 29-1780; 9315, LRRC49, 45668, 148118, 311-1435; 9315, LRRC49, 45669, 148119, 298-585; 9315, LRRC49, 45670, 148120, 48-398; 9315, LRRC49, 45671, 148121, 512-602; 9315, LRRC49, 45672, 148122, 34-222; 9315, LRRC49, 45674, 148124, 398-744; 9315, LRRC49, 45675, 148125, 298-570; 9315, LRRC49, 45676, 148126, 51-239; 9315, LRRC49, 45677, 148127, 453-677; 9315, LRRC49, 45678, 148128, 100-303; 9315, LRRC49, 45679, 148129, 301-504; 9315, LRRC49, 45680, 148130, 346-580; 9315, LRRC49, 45681, 148131, 1331-2509; 9315, LRRC49, 45682, 148132, 425-613; 9315, LRRC49, 45683, 148133, 522-584; 9315, LRRC49, 45665, 148115, 261-2321; 9315, LRRC49, 45666, 148116, 674-2602; 9315, LRRC49, 45667, 148117, 530-2560; 9315, LRRC49, 45673, 148123, 270-2345; 9316, LRRC4B, 45686, 148136, 138-853; 9316, LRRC4B, 45684, 148134, 138-2279; 9316, LRRC4B, 45685, 148135, 199-2340; 9317, LRRC4C, 45688, 148138, 461-583; 9317, LRRC4C, 45687, 148137, 1965-3887; 9317, LRRC4C, 45689, 148139, 670-2592; 9317, LRRC4C, 45690, 148140, 1034-2956; 9317, LRRC4C, 45691, 148141, 651-2573; 9317, LRRC4C, 45692, 148142, 199-2121; 9318, LRRC52, 45693, 148143, 291-1232; 9319, LRRC53, 45694, 148144, 116-3859; 9320, LRRC55, 45695, 148145, 148-1173; 9321, LRRC56, 45697, 148147, 501-2129; 9321, LRRC56, 45696, 148146, 501-2129; 9322, LRRC57, 45701, 148151, 117-561; 9322, LRRC57, 45698, 148148, 369-1088; 9322, LRRC57, 45699, 148149, 104-823; 9322, LRRC57, 45700, 148150, 129-848; 9323, LRRC58, 45702, 148152, 97-1212; 9324, LRRC59, 45704, 148154, 188-376; 9324, LRRC59, 45705, 148155, 1-172; 9324, LRRC59, 45703, 148153, 237-1160; 9325, LRRC6, 45706, 148156, 67-1302; 9325, LRRC6, 45707, 148157, 1-621; 9325, LRRC6, 45708, 148158, 67-1302; 9325, LRRC6, 45709, 148159, 1-421; 9325, LRRC6, 45711, 148161, 66-335; 9325, LRRC6, 45713, 148163, 1-1401; 9325, LRRC6, 45710, 148160, 100-1500; 9325, LRRC6, 45712, 148162, 125-1525; 9326, LRRC61, 45714, 148164, 443-1222; 9326, LRRC61, 45715, 148165, 589-1368; 9326, LRRC61, 45716, 148166, 646-1425; 9327, LRRC63, 45718, 148168, 351-2114; 9327, LRRC63, 45719, 148169, 1-1764; 9327, LRRC63, 45717, 148167, 346-1864; 9328, LRRC66, 45720, 148170, 8-2650; 9329, LRRC69, 45723, 148173, 420-571; 9329, LRRC69, 45724, 148174, 44-253; 9329, LRRC69, 45721, 148171, 18-593; 9329, LRRC69, 45722, 148172, 1-1044; 9330, LRRC7, 45726, 148176, 419-4906; 9330, LRRC7, 45727, 148177, 191-844; 9330, LRRC7, 45728, 148178, 1424-3889; 9330, LRRC7, 45729, 148179, 1-185; 9330, LRRC7, 45730, 148180, 1-98; 9330, LRRC7, 45731, 148181, 1-110; 9330, LRRC7, 45732, 148182, 1-77; 9330, LRRC7, 45725, 148175, 31-4644; 9331, LRRC70, 45734, 148184, 100-315; 9331, LRRC70, 45733, 148183, 240-2108; 9332, LRRC71, 45735, 148185, 155-1834; 9333, LRRC72, 45736, 148186, 74-247; 9333, LRRC72, 45737, 148187, 58-921; 9334, LRRC73, 45738, 148188, 902-1852; 9335, LRRC74A, 45739, 148189, 125-727; 9335, LRRC74A, 45741, 148191, 110-576; 9335, LRRC74A, 45742, 148192, 113-235; 9335, LRRC74A, 45743, 148193, 115-237; 9335, LRRC74A, 45740, 148190, 125-1591; 9336, LRRC74B, 45744, 148194, 1-1179; 9337, LRRC75A, 45745, 148195, 164-802; 9337, LRRC75A, 45746, 148196, 29-1063; 9338, LRRC75B, 45748, 148198, 26-250; 9338, LRRC75B, 45749, 148199, 28-354; 9338, LRRC75B, 45747, 148197, 25-972; 9339, LRRC8A, 45750, 148200, 524-2956; 9339, LRRC8A, 45751, 148201, 64-2496; 9339, LRRC8A, 45752, 148202, 255-2687; 9340, LRRC8B, 45754, 148204, 148-840; 9340, LRRC8B, 45755, 148205, 453-763; 9340, LRRC8B, 45753, 148203, 361-2772; 9340, LRRC8B, 45756, 148206, 247-2658; 9341, LRRC8C, 45758, 148208, 147-323; 9341, LRRC8C, 45757, 148207, 256-2667; 9342, LRRC8D, 45761, 148211, 82-905; 9342, LRRC8D, 45762, 148212, 317-666; 9342, LRRC8D, 45763, 148213, 363-922; 9342, LRRC8D, 45764, 148214, 233-597; 9342, LRRC8D, 45765, 148215, 497-588; 9342, LRRC8D, 45759, 148209, 408-2984; 9342, LRRC8D, 45760, 148210, 413-2989; 9343, LRRC8E, 45767, 148217, 199-760; 9343, LRRC8E, 45768, 148218, 471-881; 9343, LRRC8E, 45769, 148219, 270-555; 9343, LRRC8E, 45770, 148220, 311-531; 9343, LRRC8E, 45766, 148216, 102-2492; 9343, LRRC8E, 45771, 148221, 245-2635; 9344, LRRC9, 45774, 148224, 1-337; 9344, LRRC9, 45775, 148225, 159-500; 9344, LRRC9, 45772, 148222, 205-4566; 9344, LRRC9, 45773, 148223, 205-3540; 9345, LRRN1, 45776, 148226, 762-2912; 9346, LRRN2, 45777, 148227, 2214-4355; 9346, LRRN2, 45778, 148228, 389-2530; 9346, LRRN2, 45779, 148229, 641-2782; 9347, LRRN3, 45782, 148232, 1010-1830; 9347, LRRN3, 45780, 148230, 940-3066; 9347, LRRN3, 45781, 148231, 1047-3173; 9347, LRRN3, 45783, 148233, 832-2958; 9348, LRRN4, 45784, 148234, 226-2448; 9349, LRR1, 45787, 148237, 70-264; 9349, LRR1, 45788, 148238, 247-648; 9349, LRR1, 45785, 148235, 325-1569; 9349, LRR1, 45786, 148236, 261-701; 9350, LRRTM1, 45791, 148241, 215-765; 9350, LRRTM1, 45793, 148243, 252-578; 9350, LRRTM1, 45795, 148245, 211-879; 9350, LRRTM1, 45789, 148239, 658-2226; 9350, LRRTM1, 45790, 148240, 187-1755; 9350, LRRTM1, 45792, 148242, 302-1870; 9350, LRRTM1, 45794, 148244, 639-2207; 9351, LRRTM2, 45797, 148247, 458-574; 9351, LRRTM2, 45798, 148248, 394-627; 9351, LRRTM2, 45796, 148246, 380-1930; 9352, LRRTM3, 45799, 148249, 579-2324; 9353, LRRTM4, 45801, 148251, 96-1655; 9353, LRRTM4, 45803, 148253, 225-2000; 9353, LRRTM4, 45805, 148255, 412-485; 9353, LRRTM4, 45800, 148250, 416-1972; 9353, LRRTM4, 45802, 148252, 338-2110; 9353, LRRTM4, 45804, 148254, 313-2085; 9354, LRTOMT, 45808, 148258, 74-217; 9354, LRTOMT, 45809, 148259, 79-546; 9354, LRTOMT, 45810, 148260, 167-637; 9354, LRTOMT, 45814, 148264, 460-576; 9354, LRTOMT, 45815, 148265, 176-307; 9354, LRTOMT, 45816, 148266, 113-308; 9354, LRTOMT, 45818, 148268, 566-842; 9354, LRTOMT, 45819, 148269, 217-527; 9354, LRTOMT, 45823, 148273, 431-562; 9354, LRTOMT, 45807, 148257, 877-1752; 9354, LRTOMT, 45812, 148262, 462-1337; 9354, LRTOMT, 45806, 148256, 379-957; 9354, LRTOMT, 45811, 148261, 167-850; 9354, LRTOMT, 45813, 148263, 59-637; 9354, LRTOMT, 45817, 148267, 117-593; 9354, LRTOMT, 45820, 148270, 167-607; 9354, LRTOMT, 45821, 148271, 167-730; 9354, LRTOMT, 45822, 148272, 131-655; 9354, LRTOMT, 45824, 148274, 18-458; 9354, LRTOMT, 45825, 148275, 138-716; 9354, LRTOMT, 45826, 148276, 1-525; 9355, LEUTX, 45827, 148277, 165-671; 9355, LEUTX, 45828, 148278, 165-671; 9356, LZIC, 45832, 148282, 1-510; 9356, LZIC, 45829, 148279, 227-799; 9356, LZIC, 45830, 148280, 249-821; 9356, LZIC, 45831, 148281, 154-726; 9357, LUZP1, 45836, 148286, 372-1190; 9357, LUZP1, 45837, 148287, 507-613; 9357, LUZP1, 45833, 148283, 803-4033; 9357, LUZP1, 45834, 148284, 172-3252; 9357, LUZP1, 45835, 148285, 319-3549; 9358, LUZP2, 45840, 148290, 50-577; 9358, LUZP2, 45838, 148288, 67-1107; 9358, LUZP2, 45839, 148289, 288-1070; 9358, LUZP2, 45841, 148291, 226-1008; 9359, LUZP4, 45843, 148293, 34-270; 9359, LUZP4, 45842, 148292, 8-949; 9360, LUZP6, 45844, 148294, 1-177; 9361, N/A, 45847, 148297, 335-2218; 9361, N/A, 45845, 148295, 1399-3420; 9361, N/A, 45846, 148296, 381-2402; 9362, LZTFL1, 45849, 148299, 168-347; 9362, LZTFL1, 45850, 148300, 107-433; 9362, LZTFL1, 45851, 148301, 173-444; 9362, LZTFL1, 45852, 148302, 1-706; 9362, LZTFL1, 45853, 148303, 425-751; 9362, LZTFL1, 45848, 148298, 176-1075; 9362, LZTFL1, 45854, 148304, 500-1348; 9362, LZTFL1, 45855, 148305, 336-1106; 9363, LDOC1, 45856, 148306, 105-545; 9364, LDOC1L, 45857, 148307, 511-1230; 9365, LZTS1, 45858, 148308, 112-1902; 9365, LZTS1, 45859, 148309, 359-2149; 9365, LZTS1, 45860, 148310, 1-1614; 9365, LZTS1, 45861, 148311, 1-231; 9366, LZTS2, 45864, 148314, 106-701; 9366, LZTS2, 45865, 148315, 97-816; 9366, LZTS2, 45866, 148316, 143-804; 9366, LZTS2, 45867, 148317, 338-745; 9366, LZTS2, 45862, 148312, 3064-5073; 9366, LZTS2, 45863, 148313, 206-2215; 9367, LETM1, 45868, 148318, 298-2517; 9368, LETM2, 45872, 148322, 102-611; 9368, LETM2, 45873, 148323, 787-1155; 9368, LETM2, 45874, 148324, 301-822; 9368, LETM2, 45875, 148325, 128-1459; 9368, LETM2, 45876, 148326, 209-557; 9368, LETM2, 45877, 148327, 1-259; 9368, LETM2, 45878, 148328, 128-554; 9368, LETM2, 45869, 148319, 233-1423; 9368, LETM2, 45870, 148320, 128-1603; 9368, LETM2, 45871, 148321, 173-1507; 9368, LETM2, 45879, 148329, 158-991; 9369, LEKR1, 45880, 148330, 115-2193; 9369, LEKR1, 45882, 148332, 111-482; 9369, LEKR1, 45883, 148333, 108-506; 9369, LEKR1, 45884, 148334, 122-454; 9369, LEKR1, 45885, 148335, 796-1194; 9369, LEKR1, 45881, 148331, 1336-2502; 9370, LRG1, 45886, 148336, 462-1505; 9371, LRPPRC, 45888, 148338, 32-1627; 9371, LRPPRC, 45889, 148339, 43-1557; 9371, LRPPRC, 45890, 148340, 133-1209; 9371, LRPPRC, 45891, 148341, 1-234; 9371, LRPPRC, 45887, 148337, 59-4243; 9372, LGR4, 45894, 148344, 13-489; 9372, LGR4, 45892, 148342, 445-3300; 9372, LGR4, 45893, 148343, 474-3257; 9373, LGR5, 45895, 148345, 312-3035; 9373, LGR5, 45896, 148346, 47-2698; 9373, LGR5, 45897, 148347, 49-2556; 9374, LGR6, 45901, 148351, 95-792; 9374, LGR6, 45902, 148352, 44-1090; 9374, LGR6, 45898, 148348, 85-2832; 9374, LGR6, 45899, 148349, 90-2993; 9374, LGR6, 45900, 148350, 1-2487; 9375, LRRK1, 45904, 148354, 31-1983; 9375, LRRK1, 45905, 148355, 31-2100; 9375, LRRK1, 45907, 148357, 473-569; 9375, LRRK1, 45908, 148358, 1-1982; 9375, LRRK1, 45903, 148353, 360-6407; 9375, LRRK1, 45906, 148356, 230-1024; 9376, LRRK2, 45910, 148360, 122-3937; 9376, LRRK2, 45911, 148361, 93-1655; 9376, LRRK2, 45912, 148362, 1-623; 9376, LRRK2, 45909, 148359, 59-7642; 9377, LGI2, 45914, 148364, 1-767; 9377, LGI2, 45913, 148363, 187-1824; 9378, LGI3, 45917, 148367, 70-663; 9378, LGI3, 45918, 148368, 136-540; 9378, LGI3, 45915, 148365, 291-1937; 9378, LGI3, 45916, 148366, 210-1784; 9379, LGI4, 45920, 148370, 521-2005; 9379, LGI4, 45921, 148371, 1-1136; 9379, LGI4, 45919, 148369, 521-2134; 9379, LGI4, 45922, 148372, 184-969; 9380, LRIT1, 45923, 148373, 23-1894; 9381, LRIT2, 45924, 148374, 7-1659; 9381, LRIT2, 45925, 148375, 70-1752; 9382, LRIT3, 45926, 148376, 765-2255; 9382, LRIT3, 45927, 148377, 1-2040; 9383, LRCH1, 45931, 148381, 261-554; 9383, LRCH1, 45932, 148382, 329-545; 9383, LRCH1, 45928, 148378, 230-2320; 9383, LRCH1, 45929, 148379, 138-2429; 9383, LRCH1, 45930, 148380, 198-2384; 9384, LRCH2, 45933, 148383, 32-2329; 9384, LRCH2, 45934, 148384, 32-2278; 9385, LRCH3, 45937, 148387, 16-1887; 9385, LRCH3, 45938, 148388, 1-544; 9385, LRCH3, 45940, 148390, 1-681; 9385, LRCH3, 45942, 148392, 1-645; 9385, LRCH3, 45943, 148393, 54-332; 9385, LRCH3, 45935, 148385, 6-2144; 9385, LRCH3, 45936, 148386, 1-2334; 9385, LRCH3, 45939, 148389, 16-2193; 9385, LRCH3, 45941, 148391, 45-2456; 9386, LRCH4, 45945, 148395, 1-533; 9386, LRCH4, 45946, 148396, 1275-1970; 9386, LRCH4, 45947, 148397, 1223-1651; 9386, LRCH4, 45944, 148394, 54-2105; 9387, LRRD1, 45949, 148399, 231-407; 9387, LRRD1, 45948, 148398, 556-906; 9387, LRRD1, 45950, 148400, 202-2784; 9387, LRRD1, 45951, 148401, 75-2657; 9388, LRGUK, 45952, 148402, 70-2547; 9389, LRIG1, 45953, 148403, 526-3807; 9389, LRIG1, 45954, 148404, 605-3817; 9390, LRIG2, 45955, 148405, 199-3396; 9391, LRIG3, 45958, 148408, 200-2071; 9391, LRIG3, 45959, 148409, 291-759; 9391, LRIG3, 45960, 148410, 1-490; 9391, LRIG3, 45956, 148406, 288-3647; 9391, LRIG3, 45957, 148407, 65-3244; 9392, LRRIQ1, 45961, 148411, 62-555; 9392, LRRIQ1, 45963, 148413, 1-323; 9392, LRRIQ1, 45964, 148414, 1-432; 9392, LRRIQ1, 45962, 148412, 62-5230; 9393, LRRIQ3, 45966, 148416, 161-736; 9393, LRRIQ3, 45969, 148419, 1-183; 9393, LRRIQ3, 45970, 148420, 1-316; 9393, LRRIQ3, 45965, 148415, 193-2067; 9393, LRRIQ3, 45967, 148417, 153-752; 9393, LRRIQ3, 45968, 148418, 1-1875; 9393, LRRIQ3, 45971, 148421, 193-1092; 9394, LRRIQ4, 45972, 148422, 1-1683; 9395, LRTM1, 45973, 148423, 164-1201; 9395, LRTM1, 45974, 148424, 383-1192; 9396, LRTM2, 45976, 148426, 319-597; 9396, LRTM2, 45977, 148427, 301-587; 9396, LRTM2, 45975, 148425, 545-1657; 9396, LRTM2, 45978, 148428, 446-1558; 9396, LRTM2, 45979, 148429, 843-1955; 9397, LRWD1, 45981, 148431, 1-124; 9397, LRWD1, 45982, 148432, 81-218; 9397, LRWD1, 45983, 148433, 1-728; 9397, LRWD1, 45984, 148434, 600-1062; 9397, LRWD1, 45985, 148435, 1-538; 9397, LRWD1, 45986, 148436, 1-138; 9397, LRWD1, 45980, 148430, 153-2096; 9398, LSMEM1, 45987, 148437, 362-757; 9398, LSMEM1, 45988, 148438, 136-531; 9398, LSMEM1, 45989, 148439, 315-494; 9399, LSMEM2, 45990, 148440, 88-582; 9400, LGI1, 45993, 148443, 70-288; 9400, LGI1, 45995, 148445, 233-523; 9400, LGI1, 45996, 148446, 208-714; 9400, LGI1, 45997, 148447, 271-489; 9400, LGI1, 45998, 148448, 295-1896; 9400, LGI1, 45999, 148449, 306-524; 9400, LGI1, 45991, 148441, 1-876; 9400, LGI1, 45992, 148442, 337-2010; 9400, LGI1, 45994, 148444, 175-1704; 9401, LZTR1, 46001, 148451, 1-334; 9401, LZTR1, 46002, 148452, 1-294; 9401, LZTR1, 46003, 148453, 104-457; 9401, LZTR1, 46004, 148454, 1-475; 9401, LZTR1, 46005, 148455, 50-355; 9401, LZTR1, 46006, 148456, 1-165; 9401, LZTR1, 46000, 148450, 360-2882; 9402, LNPEP, 46007, 148457, 693-3770; 9402, LNPEP, 46008, 148458, 350-3385; 9403, LARS, 46012, 148462, 133-615; 9403, LARS, 46009, 148459, 546-2003; 9403, LARS, 46010, 148460, 168-3698; 9403, LARS, 46011, 148461, 174-3542; 9404, LARS2, 46014, 148464, 224-566; 9404, LARS2, 46015, 148465, 139-570; 9404, LARS2, 46017, 148467, 139-2721; 9404, LARS2, 46013, 148463, 263-2974; 9404, LARS2, 46016, 148466, 142-2853; 9405, LIF, 46018, 148468, 157-765; 9405, LIF, 46019, 148469, 45-311; 9406, LIFR, 46022, 148472, 384-760; 9406, LIFR, 46023, 148473, 1-200; 9406, LIFR, 46024, 148474, 351-574; 9406, LIFR, 46020, 148470, 164-3457; 9406, LIFR, 46021, 148471, 333-3626; 9407, LNP1, 46026, 148476, 863-1438; 9407, LNP1, 46027, 148477, 942-1112; 9407, LNP1, 46025, 148475, 1281-1817; 9408, LECT1, 46030, 148480, 344-731; 9408, LECT1, 46028, 148478, 80-1084; 9408, LECT1, 46029, 148479, 112-1113; 9409, LECT2, 46032, 148482, 150-485; 9409, LECT2, 46033, 148483, 342-581; 9409, LECT2, 46034, 148484, 130-525; 9409, LECT2, 46031, 148481, 202-657; 9410, LILRA1, 46039, 148489, 1-1320; 9410, LILRA1, 46040, 148490, 1-1320; 9410, LILRA1, 46041, 148491, 222-1742; 9410, LILRA1, 46042, 148492, 1-1320; 9410, LILRA1, 46043, 148493, 132-1652; 9410, LILRA1, 46044, 148494, 1-1320; 9410, LILRA1, 46035, 148485, 183-1652; 9410, LILRA1, 46036, 148486, 171-1040; 9410, LILRA1, 46037, 148487, 183-1652; 9410, LILRA1, 46038, 148488, 171-1040; 9410, LILRA1, 46045, 148495, 255-1124; 9410, LILRA1, 46046, 148496, 255-1124; 9411, LILRA2, 46049, 148499, 39-1403; 9411, LILRA2, 46051, 148501, 590-1571; 9411, LILRA2, 46052, 148502, 1-256; 9411, LILRA2, 46053, 148503, 470-1942; 9411, LILRA2, 46055, 148505, 470-1942; 9411, LILRA2, 46057, 148507, 39-1403; 9411, LILRA2, 46058, 148508, 590-1571; 9411, LILRA2, 46060, 148510, 39-1403; 9411, LILRA2, 46061, 148511, 1-256; 9411, LILRA2, 46066, 148516, 1-612; 9411, LILRA2, 46067, 148517, 1-612; 9411, LILRA2, 46068, 148518, 1-612; 9411, LILRA2, 46069, 148519, 39-1403; 9411, LILRA2, 46070, 148520, 1-612; 9411, LILRA2, 46047, 148497, 88-1488; 9411, LILRA2, 46048, 148498, 134-1585; 9411, LILRA2, 46050, 148500, 90-1541; 9411, LILRA2, 46054, 148504, 134-1585; 9411, LILRA2, 46056, 148506, 88-1488; 9411, LILRA2, 46059, 148509, 40-1491; 9411, LILRA2, 46062, 148512, 124-1524; 9411, LILRA2, 46063, 148513, 90-1541; 9411, LILRA2, 46064, 148514, 40-1491; 9411, LILRA2, 46065, 148515, 124-1524; 9412, LILRA4, 46072, 148522, 1-421; 9412, LILRA4, 46075, 148525, 58-1260; 9412, LILRA4, 46071, 148521, 58-1557; 9412, LILRA4, 46073, 148523, 58-1557; 9412, LILRA4, 46074, 148524, 77-1576; 9412, LILRA4, 46076, 148526, 58-1557; 9413, LILRA5, 46077, 148527, 121-1020; 9413, LILRA5, 46078, 148528, 80-877; 9413, LILRA5, 46079, 148529, 121-1020; 9413, LILRA5, 46080, 148530, 56-919; 9413, LILRA5, 46081, 148531, 73-834; 9413, LILRA5, 46082, 148532, 73-834; 9413, LILRA5, 46083, 148533, 121-1020; 9413, LILRA5, 46084, 148534, 56-919; 9413, LILRA5, 46085, 148535, 121-1020; 9413, LILRA5, 46086, 148536, 80-877; 9413, LILRA5, 46087, 148537, 56-919; 9413, LILRA5, 46088, 148538, 73-834; 9413, LILRA5, 46089, 148539, 56-919; 9413, LILRA5, 46090, 148540, 80-877; 9413, LILRA5, 46091, 148541, 121-1020; 9413, LILRA5, 46092, 148542, 56-919; 9414, LILRA6, 46093, 148543, 1-1395; 9414, LILRA6, 46096, 148546, 45-1193; 9414, LILRA6, 46098, 148548, 3-584; 9414, LILRA6, 46099, 148549, 112-2010; 9414, LILRA6, 46100, 148550, 18-599; 9414, LILRA6, 46102, 148552, 32-1570; 9414, LILRA6, 46104, 148554, 32-1546; 9414, LILRA6, 46105, 148555, 112-2010; 9414, LILRA6, 46106, 148556, 45-1193; 9414, LILRA6, 46108, 148558, 112-1260; 9414, LILRA6, 46109, 148559, 112-1557; 9414, LILRA6, 46110, 148560, 3-1949; 9414, LILRA6, 46111, 148561, 1-1446; 9414, LILRA6, 46112, 148562, 32-1546; 9414, LILRA6, 46113, 148563, 32-1546; 9414, LILRA6, 46114, 148564, 32-1546; 9414, LILRA6, 46115, 148565, 18-599; 9414, LILRA6, 46116, 148566, 32-1570; 9414, LILRA6, 46118, 148568, 3-578; 9414, LILRA6, 46119, 148569, 3-1949; 9414, LILRA6, 46120, 148570, 3-1901; 9414, LILRA6, 46121, 148571, 45-1193; 9414, LILRA6, 46122, 148572, 112-1557; 9414, LILRA6, 46124, 148574, 32-1570; 9414, LILRA6, 46125, 148575, 112-2010; 9414, LILRA6, 46126, 148576, 1-1443; 9414, LILRA6, 46094, 148544, 41-1486; 9414, LILRA6, 46095, 148545, 18-599; 9414, LILRA6, 46097, 148547, 18-599; 9414, LILRA6, 46101, 148551, 3-584; 9414, LILRA6, 46103, 148553, 3-584; 9414, LILRA6, 46107, 148557, 41-1486; 9414,

LILRA6, 46117, 148567, 3-584; 9414, LILRA6, 46123, 148573, 18-599; 9415, LILRA3, 46127, 148577, 1-1128; 9415, LILRA3, 46128, 148578, 422-737; 9415, LILRA3, 46129, 148579, 422-737; 9415, LILRA3, 46130, 148580, 184-1653; 9415, LILRA3, 46131, 148581, 369-481; 9415, LILRA3, 46132, 148582, 121-883; 9415, LILRA3, 46133, 148583, 427-742; 9415, LILRA3, 46134, 148584, 1-618; 9415, LILRA3, 46135, 148585, 355-467; 9415, LILRA3, 46136, 148586, 184-1653; 9415, LILRA3, 46137, 148587, 369-481; 9415, LILRA3, 46139, 148589, 93-1412; 9415, LILRA3, 46141, 148591, 184-1653; 9415, LILRA3, 46143, 148593, 184-1653; 9415, LILRA3, 46138, 148588, 93-1412; 9415, LILRA3, 46140, 148590, 93-1412; 9415, LILRA3, 46142, 148592, 93-1412; 9416, LILRB1, 46144, 148594, 166-2124; 9416, LILRB1, 46145, 148595, 1-1959; 9416, LILRB1, 46146, 148596, 1-1905; 9416, LILRB1, 46147, 148597, 273-2228; 9416, LILRB1, 46148, 148598, 358-2310; 9416, LILRB1, 46149, 148599, 171-2126; 9416, LILRB1, 46150, 148600, 334-2439; 9416, LILRB1, 46151, 148601, 1-1533; 9416, LILRB1, 46152, 148602, 1-2053; 9416, LILRB1, 46154, 148604, 171-2126; 9416, LILRB1, 46155, 148605, 1-204; 9416, LILRB1, 46156, 148606, 1-1458; 9416, LILRB1, 46159, 148609, 1-1458; 9416, LILRB1, 46160, 148610, 1-1458; 9416, LILRB1, 46161, 148611, 1-204; 9416, LILRB1, 46162, 148612, 39-1409; 9416, LILRB1, 46164, 148614, 1-1532; 9416, LILRB1, 46166, 148616, 141-2144; 9416, LILRB1, 46167, 148617, 166-2124; 9416, LILRB1, 46168, 148618, 1-1533; 9416, LILRB1, 46169, 148619, 1-1959; 9416, LILRB1, 46170, 148620, 166-2070; 9416, LILRB1, 46171, 148621, 1-204; 9416, LILRB1, 46172, 148622, 120-2126; 9416, LILRB1, 46173, 148623, 1-1958; 9416, LILRB1, 46174, 148624, 1-204; 9416, LILRB1, 46175, 148625, 39-1409; 9416, LILRB1, 46176, 148626, 148-2154; 9416, LILRB1, 46177, 148627, 199-2154; 9416, LILRB1, 46178, 148628, 166-2070; 9416, LILRB1, 46179, 148629, 1-621; 9416, LILRB1, 46180, 148630, 1-621; 9416, LILRB1, 46181, 148631, 1-621; 9416, LILRB1, 46182, 148632, 39-1409; 9416, LILRB1, 46153, 148603, 171-2126; 9416, LILRB1, 46157, 148607, 176-2131; 9416, LILRB1, 46158, 148608, 1-1959; 9416, LILRB1, 46163, 148613, 341-2293; 9416, LILRB1, 46165, 148615, 586-2538; 9417, LILRB2, 46187, 148637, 1-632; 9417, LILRB2, 46189, 148639, 1-660; 9417, LILRB2, 46190, 148640, 1-657; 9417, LILRB2, 46191, 148641, 129-1922; 9417, LILRB2, 46192, 148642, 1-632; 9417, LILRB2, 46193, 148643, 234-346; 9417, LILRB2, 46195, 148645, 222-2030; 9417, LILRB2, 46198, 148648, 3-1499; 9417, LILRB2, 46199, 148649, 3-1535; 9417, LILRB2, 46200, 148650, 3-1535; 9417, LILRB2, 46201, 148651, 175-1968; 9417, LILRB2, 46202, 148652, 129-1886; 9417, LILRB2, 46203, 148653, 1-657; 9417, LILRB2, 46208, 148658, 222-2033; 9417, LILRB2, 46209, 148659, 39-1406; 9417, LILRB2, 46211, 148661, 183-346; 9417, LILRB2, 46183, 148633, 273-2066; 9417, LILRB2, 46184, 148634, 3-1535; 9417, LILRB2, 46185, 148635, 129-1922; 9417, LILRB2, 46186, 148636, 273-2069; 9417, LILRB2, 46188, 148638, 464-1912; 9417, LILRB2, 46194, 148644, 157-1953; 9417, LILRB2, 46196, 148646, 464-1912; 9417, LILRB2, 46197, 148647, 267-2063; 9417, LILRB2, 46204, 148654, 175-1968; 9417, LILRB2, 46205, 148655, 129-1922; 9417, LILRB2, 46206, 148656, 42-1574; 9417, LILRB2, 46207, 148657, 268-2064; 9417, LILRB2, 46210, 148660, 129-1922; 9418, LILRB3, 46213, 148663, 64-1995; 9418, LILRB3, 46215, 148665, 112-586; 9418, LILRB3, 46216, 148666, 3-578; 9418, LILRB3, 46217, 148667, 50-1945; 9418, LILRB3, 46218, 148668, 54-1949; 9418, LILRB3, 46219, 148669, 3-578; 9418, LILRB3, 46220, 148670, 3-1901; 9418, LILRB3, 46221, 148671, 3-1901; 9418, LILRB3, 46222, 148672, 3-1901; 9418, LILRB3, 46223, 148673, 3-1949; 9418, LILRB3, 46225, 148675, 3-1949; 9418, LILRB3, 46226, 148676, 3-590; 9418, LILRB3, 46227, 148677, 3-1952; 9418, LILRB3, 46228, 148678, 3-1472; 9418, LILRB3, 46229, 148679, 3-1949; 9418, LILRB3, 46230, 148680, 112-2010; 9418, LILRB3, 46231, 148681, 3-578; 9418, LILRB3, 46232, 148682, 3-578; 9418, LILRB3, 46233, 148683, 50-1945; 9418, LILRB3, 46234, 148684, 32-1399; 9418, LILRB3, 46235, 148685, 3-584; 9418, LILRB3, 46237, 148687, 3-584; 9418, LILRB3, 46238, 148688, 3-1472; 9418, LILRB3, 46239, 148689, 3-1901; 9418, LILRB3, 46240, 148690, 3-1949; 9418, LILRB3, 46212, 148662, 3-1901; 9418, LILRB3, 46214, 148664, 138-2033; 9418, LILRB3, 46224, 148674, 191-2086; 9418, LILRB3, 46236, 148686, 81-1976; 9418, LILRB3, 46241, 148691, 1-1896; 9419, LILRB4, 46242, 148692, 145-539; 9419, LILRB4, 46243, 148693, 15-1364; 9419, LILRB4, 46244, 148694, 37-1224; 9419, LILRB4, 46246, 148696, 8-1204; 9419, LILRB4, 46247, 148697, 40-1383; 9419, LILRB4, 46248, 148698, 316-1662; 9419, LILRB4, 46249, 148699, 64-1377; 9419, LILRB4, 46250, 148700, 8-1204; 9419, LILRB4, 46252, 148702, 40-1383; 9419, LILRB4, 46253, 148703, 80-1426; 9419, LILRB4, 46254, 148704, 15-1364; 9419, LILRB4, 46255, 148705, 35-1381; 9419, LILRB4, 46257, 148707, 361-1202; 9419, LILRB4, 46258, 148708, 80-1426; 9419, LILRB4, 46259, 148709, 93-1529; 9419, LILRB4, 46261, 148711, 35-1381; 9419, LILRB4, 46262, 148712, 40-1383; 9419, LILRB4, 46263, 148713, 37-1224; 9419, LILRB4, 46264, 148714, 163-354; 9419, LILRB4, 46265, 148715, 40-1383; 9419, LILRB4, 46266, 148716, 316-820; 9419, LILRB4, 46267, 148717, 15-1364; 9419, LILRB4, 46268, 148718, 1-76; 9419, LILRB4, 46269, 148719, 15-1364; 9419, LILRB4, 46270, 148720, 316-1662; 9419, LILRB4, 46271, 148721, 80-1426; 9419, LILRB4, 46245, 148695, 316-1662; 9419, LILRB4, 46251, 148701, 15-1364; 9419, LILRB4, 46256, 148706, 216-1562; 9419, LILRB4, 46260, 148710, 40-1383; 9420, LILRB5, 46275, 148725, 70-2001; 9420, LILRB5, 46280, 148730, 185-660; 9420, LILRB5, 46281, 148731, 79-1947; 9420, LILRB5, 46284, 148734, 185-639; 9420, LILRB5, 46285, 148735, 70-2001; 9420, LILRB5, 46286, 148736, 185-665; 9420, LILRB5, 46288, 148738, 81-1553; 9420, LILRB5, 46294, 148744, 70-2001; 9420, LILRB5, 46272, 148722, 70-1545; 9420, LILRB5, 46273, 148723, 109-1881; 9420, LILRB5, 46274, 148724, 72-1847; 9420, LILRB5, 46276, 148726, 122-1894; 9420, LILRB5, 46277, 148727, 72-1847; 9420, LILRB5, 46278, 148728, 81-1556; 9420, LILRB5, 46279, 148729, 72-1847; 9420, LILRB5, 46282, 148732, 70-1545; 9420, LILRB5, 46283, 148733, 72-1847; 9420, LILRB5, 46287, 148737, 100-1872; 9420, LILRB5, 46289, 148739, 112-1587; 9420, LILRB5, 46290, 148740, 70-1545; 9420, LILRB5, 46291, 148741, 100-1872; 9420, LILRB5, 46292, 148742, 100-1872; 9420, LILRB5, 46293, 148743, 112-1887; 9421, LENG1, 46296, 148746, 14-808; 9421, LENG1, 46298, 148748, 14-808; 9421, LENG1, 46299, 148749, 14-808; 9421, LENG1, 46300, 148750, 14-808; 9421, LENG1, 46304, 148754, 14-808; 9421, LENG1, 46295, 148745, 188-982; 9421, LENG1, 46297, 148747, 49-843; 9421, LENG1, 46301, 148751, 49-843; 9421, LENG1, 46302, 148752, 14-808; 9421, LENG1, 46303, 148753, 14-808; 9422, LENG8, 46306, 148756, 139-2652; 9422, LENG8, 46307, 148757, 189-463; 9422, LENG8, 46308, 148758, 1-336; 9422, LENG8, 46309, 148759, 173-1073; 9422, LENG8, 46310, 148760, 96-320; 9422, LENG8, 46311, 148761, 480-2825;

9422, LENG8, 46312, 148762, 119-393; 9422, LENG8, 46314, 148764, 56-2680; 9422, LENG8, 46316, 148766, 480-2825; 9422, LENG8, 46318, 148768, 128-582; 9422, LENG8, 46319, 148769, 119-393; 9422, LENG8, 46320, 148770, 480-2825; 9422, LENG8, 46321, 148771, 1-2179; 9422, LENG8, 46322, 148772, 1-2179; 9422, LENG8, 46323, 148773, 1-2179; 9422, LENG8, 46324, 148774, 119-393; 9422, LENG8, 46325, 148775, 145-742; 9422, LENG8, 46326, 148776, 480-2825; 9422, LENG8, 46327, 148777, 1-336; 9422, LENG8, 46305, 148755, 480-2882; 9422, LENG8, 46313, 148763, 648-3050; 9422, LENG8, 46315, 148765, 648-3050; 9422, LENG8, 46317, 148767, 145-2547; 9423, LENG9, 46329, 148779, 186-1622; 9423, LENG9, 46330, 148780, 186-1622; 9423, LENG9, 46328, 148778, 120-1625; 9423, LENG9, 46331, 148781, 120-1625; 9424, LTK, 46335, 148785, 88-1776; 9424, LTK, 46332, 148782, 98-2692; 9424, LTK, 46333, 148783, 171-2582; 9424, LTK, 46334, 148784, 179-2383; 9425, LST1, 46336, 148786, 193-279; 9425, LST1, 46341, 148791, 279-365; 9425, LST1, 46345, 148795, 200-286; 9425, LST1, 46351, 148801, 1-135; 9425, LST1, 46352, 148802, 184-382; 9425, LST1, 46354, 148804, 279-365; 9425, LST1, 46355, 148805, 209-295; 9425, LST1, 46356, 148806, 193-279; 9425, LST1, 46357, 148807, 200-286; 9425, LST1, 46359, 148809, 184-432; 9425, LST1, 46365, 148815, 193-279; 9425, LST1, 46366, 148816, 1-131; 9425, LST1, 46367, 148817, 209-295; 9425, LST1, 46368, 148818, 200-286; 9425, LST1, 46370, 148820, 122-259; 9425, LST1, 46380, 148830, 1-131; 9425, LST1, 46383, 148833, 1-131; 9425, LST1, 46384, 148834, 122-259; 9425, LST1, 46387, 148837, 279-365; 9425, LST1, 46388, 148838, 122-259; 9425, LST1, 46394, 148844, 122-259; 9425, LST1, 46395, 148845, 146-254; 9425, LST1, 46406, 148856, 1-131; 9425, LST1, 46407, 148857, 193-279; 9425, LST1, 46408, 148858, 193-279; 9425, LST1, 46413, 148863, 184-432; 9425, LST1, 46415, 148865, 209-295; 9425, LST1, 46416, 148866, 1-131; 9425, LST1, 46420, 148870, 146-254; 9425, LST1, 46421, 148871, 1-131; 9425, LST1, 46423, 148873, 279-365; 9425, LST1, 46424, 148874, 122-259; 9425, LST1, 46425, 148875, 209-295; 9425, LST1, 46426, 148876, 193-279; 9425, LST1, 46429, 148879, 209-295; 9425, LST1, 46432, 148882, 146-254; 9425, LST1, 46433, 148883, 146-254; 9425, LST1, 46434, 148884, 209-295; 9425, LST1, 46435, 148885, 200-286; 9425, LST1, 46438, 148888, 193-279; 9425, LST1, 46440, 148890, 184-432; 9425, LST1, 46443, 148893, 200-286; 9425, LST1, 46444, 148894, 200-286; 9425, LST1, 46445, 148895, 122-259; 9425, LST1, 46451, 148901, 122-259; 9425, LST1, 46452, 148902, 146-254; 9425, LST1, 46454, 148904, 146-254; 9425, LST1, 46455, 148905, 184-432; 9425, LST1, 46456, 148906, 184-432; 9425, LST1, 46457, 148907, 184-432; 9425, LST1, 46464, 148914, 146-254; 9425, LST1, 46466, 148916, 146-254; 9425, LST1, 46467, 148917, 193-279; 9425, LST1, 46471, 148921, 279-365; 9425, LST1, 46474, 148924, 200-286; 9425, LST1, 46475, 148925, 279-365; 9425, LST1, 46479, 148929, 184-432; 9425, LST1, 46480, 148930, 1-131; 9425, LST1, 46481, 148931, 279-365; 9425, LST1, 46482, 148932, 209-295; 9425, LST1, 46486, 148936, 279-365; 9425, LST1, 46489, 148939, 200-286; 9425, LST1, 46492, 148942, 1-106; 9425, LST1, 46493, 148943, 1-182; 9425, LST1, 46337, 148787, 101-280; 9425, LST1, 46338, 148788, 210-410; 9425, LST1, 46339, 148789, 101-322; 9425, LST1, 46340, 148790, 247-447; 9425, LST1, 46342, 148792, 101-208; 9425, LST1, 46343, 148793, 101-415; 9425, LST1, 46344, 148794, 200-241; 9425, LST1, 46346, 148796, 197-352; 9425, LST1, 46347, 148797, 101-322; 9425, LST1, 46348, 148798, 101-208; 9425, LST1, 46349, 148799, 210-410; 9425, LST1, 46350, 148800, 101-415; 9425, LST1, 46353, 148803, 121-300; 9425, LST1, 46358, 148808, 200-241; 9425, LST1, 46360, 148810, 138-338; 9425, LST1, 46361, 148811, 235-435; 9425, LST1, 46362, 148812, 186-479; 9425, LST1, 46363, 148813, 197-352; 9425, LST1, 46364, 148814, 186-479; 9425, LST1, 46369, 148819, 238-531; 9425, LST1, 46371, 148821, 200-241; 9425, LST1, 46372, 148822, 121-300; 9425, LST1, 46373, 148823, 138-338; 9425, LST1, 46374, 148824, 138-338; 9425, LST1, 46375, 148825, 101-208; 9425, LST1, 46376, 148826, 101-322; 9425, LST1, 46377, 148827, 197-352; 9425, LST1, 46378, 148828, 138-338; 9425, LST1, 46379, 148829, 238-531; 9425, LST1, 46381, 148831, 138-338; 9425, LST1, 46382, 148832, 186-479; 9425, LST1, 46385, 148835, 210-410; 9425, LST1, 46386, 148836, 210-410; 9425, LST1, 46389, 148839, 186-479; 9425, LST1, 46390, 148840, 101-322; 9425, LST1, 46391, 148841, 101-208; 9425, LST1, 46392, 148842, 197-352; 9425, LST1, 46393, 148843, 186-479; 9425, LST1, 46396, 148846, 101-322; 9425, LST1, 46397, 148847, 101-415; 9425, LST1, 46398, 148848, 186-479; 9425, LST1, 46399, 148849, 235-435; 9425, LST1, 46400, 148850, 238-531; 9425, LST1, 46401, 148851, 197-352; 9425, LST1, 46402, 148852, 238-531; 9425, LST1, 46403, 148853, 235-435; 9425, LST1, 46404, 148854, 200-241; 9425, LST1, 46405, 148855, 235-435; 9425, LST1, 46409, 148859, 101-415; 9425, LST1, 46410, 148860, 235-435; 9425, LST1, 46411, 148861, 293-493; 9425, LST1, 46412, 148862, 210-410; 9425, LST1, 46414, 148864, 121-300; 9425, LST1, 46417, 148867, 101-415; 9425, LST1, 46418, 148868, 101-208; 9425, LST1, 46419, 148869, 210-410; 9425, LST1, 46422, 148872, 197-352; 9425, LST1, 46427, 148877, 101-208; 9425, LST1, 46428, 148878, 101-322; 9425, LST1, 46430, 148880, 200-241; 9425, LST1, 46431, 148881, 200-241; 9425, LST1, 46436, 148886, 138-338; 9425, LST1, 46437, 148887, 197-352; 9425, LST1, 46439, 148889, 101-415; 9425, LST1, 46441, 148891, 186-479; 9425, LST1, 46442, 148892, 101-322; 9425, LST1, 46446, 148896, 293-493; 9425, LST1, 46447, 148897, 200-241; 9425, LST1, 46448, 148898, 293-493; 9425, LST1, 46449, 148899, 101-415; 9425, LST1, 46450, 148900, 210-410; 9425, LST1, 46453, 148903, 101-208; 9425, LST1, 46458, 148908, 200-241; 9425, LST1, 46459, 148909, 293-493; 9425, LST1, 46460, 148910, 238-531; 9425, LST1, 46461, 148911, 101-415; 9425, LST1, 46462, 148912, 293-493; 9425, LST1, 46463, 148913, 101-208; 9425, LST1, 46465, 148915, 235-435; 9425, LST1, 46468, 148918, 121-300; 9425, LST1, 46469, 148919, 293-493; 9425, LST1, 46470, 148920, 121-300; 9425, LST1, 46472, 148922, 238-531; 9425, LST1, 46473, 148923, 121-300; 9425, LST1, 46476, 148926, 138-338; 9425, LST1, 46477, 148927, 238-531; 9425, LST1, 46478, 148928, 101-322; 9425, LST1, 46483, 148933, 235-435; 9425, LST1, 46484, 148934, 197-352; 9425, LST1, 46485, 148935, 293-493; 9425, LST1, 46487, 148937, 293-493; 9425, LST1, 46488, 148938, 121-300; 9425, LST1, 46490, 148940, 238-531; 9425, LST1, 46491, 148941, 210-410; 9426, LAIR1, 46495, 148945, 175-1017; 9426, LAIR1, 46496, 148946, 67-450; 9426, LAIR1, 46498, 148948, 282-1091; 9426, LAIR1, 46499, 148949, 192-1052; 9426, LAIR1, 46500, 148950, 215-494; 9426, LAIR1, 46501, 148951, 128-262; 9426, LAIR1, 46502, 148952, 128-262; 9426, LAIR1, 46503, 148953, 64-525; 9426, LAIR1, 46505, 148955, 216-1079; 9426, LAIR1, 46506, 148956, 128-262; 9426, LAIR1, 46508, 148958, 64-474; 9426, LAIR1, 46510, 148960, 67-399; 9426, LAIR1, 46513, 148963, 282-1091; 9426, LAIR1, 46517, 148967, 246-1055; 9426, LAIR1, 46521, 148971, 282-1091; 9426, LAIR1, 46522, 148972, 289-1119; 9426, LAIR1, 46523, 148973, 1-240; 9426, LAIR1, 46524, 148974, 192-1052; 9426, LAIR1, 46526, 148976, 128-262; 9426, LAIR1, 46527, 148977, 282-1091; 9426, LAIR1, 46528, 148978, 1-240; 9426, LAIR1, 46529, 148979, 192-1052; 9426, LAIR1, 46530, 148980, 216-1076; 9426, LAIR1, 46494, 148944, 62-874; 9426, LAIR1, 46497, 148947, 154-1017; 9426, LAIR1, 46504, 148954, 4-813; 9426, LAIR1, 46507, 148957, 4-813; 9426, LAIR1, 46509, 148959, 4-813; 9426, LAIR1, 46511, 148961, 4-813; 9426, LAIR1, 46512, 148962, 119-982; 9426, LAIR1, 46514, 148964, 119-931; 9426, LAIR1, 46515, 148965, 61-924; 9426, LAIR1, 46516, 148966, 154-1017; 9426, LAIR1, 46518, 148968, 62-874; 9426, LAIR1, 46519, 148969, 62-874; 9426, LAIR1, 46520, 148970, 192-1001; 9426, LAIR1, 46525, 148975, 62-874; 9427, LAIR2, 46533, 148983, 364-631; 9427, LAIR2, 46535, 148985, 364-663; 9427, LAIR2, 46538, 148988, 18-543; 9427, LAIR2, 46539, 148989, 364-595; 9427, LAIR2, 46540, 148990, 364-709; 9427, LAIR2, 46541, 148991, 364-595; 9427, LAIR2, 46542, 148992, 364-595; 9427, LAIR2, 46543, 148993, 364-631; 9427, LAIR2, 46545, 148995, 262-888; 9427, LAIR2, 46546, 148996, 364-595; 9427, LAIR2, 46531, 148981, 123-581; 9427, LAIR2, 46532, 148982, 13-420; 9427, LAIR2, 46534, 148984, 123-581; 9427, LAIR2, 46536, 148986, 18-425; 9427, LAIR2, 46537, 148987, 262-720; 9427, LAIR2, 46544, 148994, 13-420; 9428, LTA4H, 46549, 148999, 123-521; 9428, LTA4H, 46547, 148997, 143-1978; 9428, LTA4H, 46548, 148998, 146-1672; 9428, LTA4H, 46550, 149000, 103-1866; 9429, LTB4R, 46554, 149004, 125-431; 9429, LTB4R, 46555, 149005, 102-797; 9429, LTB4R, 46551, 149001, 322-1380; 9429, LTB4R, 46552, 149002, 333-1391; 9429, LTB4R, 46553, 149003, 1726-2784; 9430, LTB4R2, 46558, 149008, 152-1108; 9430, LTB4R2, 46559, 149009, 230-710; 9430, LTB4R2, 46556, 149006, 1618-2787; 9430, LTB4R2, 46557, 149007, 127-1203; 9430, LTB4R2, 46560, 149010, 172-1248; 9431, LTC4S, 46562, 149012, 89-370; 9431, LTC4S, 46563, 149013, 97-306; 9431, LTC4S, 46561, 149011, 96-548; 9432, LPXN, 46566, 149016, 65-385; 9432, LPXN, 46567, 149017, 236-1336; 9432, LPXN, 46564, 149014, 90-1250; 9432, LPXN, 46565, 149015, 121-1296; 9433, LFNG, 46573, 149023, 8-754; 9433, LFNG, 46568, 149018, 21-1160; 9433, LFNG, 46569, 149019, 1-753; 9433, LFNG, 46570, 149020, 1-1086; 9433, LFNG, 46571, 149021, 89-841; 9433, LFNG, 46572, 149022, 127-1053; 9434, LCOR, 46574, 149024, 564-1865; 9434, LCOR, 46575, 149025, 547-1848; 9434, LCOR, 46576, 149026, 522-1823; 9434, LCOR, 46577, 149027, 544-1764; 9435, LCORL, 46579, 149029, 303-1859; 9435, LCORL, 46581, 149031, 7-246; 9435, LCORL, 46578, 149028, 126-1082; 9435, LCORL, 46580, 149030, 110-1918; 9436, LRIF1, 46582, 149032, 392-2701; 9436, LRIF1, 46583, 149033, 358-1059; 9436, LRIF1, 46584, 149034, 443-1144; 9437, LNX1, 46587, 149037, 433-731; 9437, LNX1, 46588, 149038, 538-556; 9437, LNX1, 46589, 149039, 332-603; 9437, LNX1, 46590, 149040, 525-572; 9437, LNX1, 46591, 149041, 648-1024; 9437, LNX1, 46585, 149035, 316-2502; 9437, LNX1, 46586, 149036, 253-2151; 9438, LNX2, 46592, 149042, 131-2203; 9439, LIG1, 46594, 149044, 421-2976; 9439, LIG1, 46596, 149046, 140-1387; 9439, LIG1, 46597, 149047, 139-575; 9439, LIG1, 46598, 149048, 144-2546; 9439, LIG1, 46600, 149050, 132-580; 9439, LIG1, 46601, 149051, 293-377; 9439, LIG1, 46602, 149052, 1-110; 9439, LIG1, 46593, 149043, 421-3180; 9439, LIG1, 46595, 149045, 162-2828; 9439, LIG1, 46599, 149049, 70-2475; 9439, LIG1, 46603, 149053, 62-2467; 9440, LIG3, 46606, 149056, 1-109; 9440, LIG3, 46607, 149057, 1-115; 9440, LIG3, 46608, 149058, 101-722; 9440, LIG3, 46609, 149059, 331-887; 9440, LIG3, 46610, 149060, 64-1699; 9440, LIG3, 46604, 149054, 82-2931; 9440, LIG3, 46605, 149055, 134-3163; 9441, LIG4, 46614, 149064, 263-2797; 9441, LIG4, 46611, 149061, 274-3009; 9441, LIG4, 46612, 149062, 236-2971; 9441, LIG4, 46613, 149063, 153-2888; 9441, LIG4, 46615, 149065, 351-3086; 9442, LARGE, 46619, 149069, 237-562; 9442, LARGE, 46620, 149070, 152-559; 9442, LARGE, 46621, 149071, 98-658; 9442, LARGE, 46622, 149072, 426-568; 9442, LARGE, 46623, 149073, 381-560; 9442, LARGE, 46624, 149074, 367-773; 9442, LARGE, 46625, 149075, 1-978; 9442, LARGE, 46626, 149076, 1-552; 9442, LARGE, 46627, 149077, 1-831; 9442, LARGE, 46616, 149066, 573-2843; 9442, LARGE, 46617, 149067, 517-2787; 9442, LARGE, 46618, 149068, 503-2617; 9443, LIMCH1, 46631, 149081, 410-789; 9443, LIMCH1, 46633, 149083, 1-2753; 9443, LIMCH1, 46634, 149084, 367-3117; 9443, LIMCH1, 46635, 149085, 174-656; 9443, LIMCH1, 46640, 149090, 435-4838; 9443, LIMCH1, 46641, 149091, 221-2914; 9443, LIMCH1, 46642, 149092, 474-551; 9443, LIMCH1, 46643, 149093, 35-2977; 9443, LIMCH1, 46644, 149094, 617-1078; 9443, LIMCH1, 46628, 149078, 55-3306; 9443, LIMCH1, 46629, 149079, 174-2846; 9443, LIMCH1, 46630, 149080, 174-2882; 9443, LIMCH1, 46632, 149082, 387-3080; 9443, LIMCH1, 46636, 149086, 27-3236; 9443, LIMCH1, 46637, 149087, 57-3230; 9443, LIMCH1, 46638, 149088, 57-3227; 9443, LIMCH1, 46639, 149089, 579-3311; 9444, LMCD1, 46646, 149096, 213-974; 9444, LMCD1, 46648, 149098, 170-870; 9444, LMCD1, 46649, 149099, 52-228; 9444, LMCD1, 46650, 149100, 133-876; 9444, LMCD1, 46645, 149095, 233-1330; 9444, LMCD1, 46647, 149097, 212-1090; 9445, LIMS1, 46656, 149106, 108-637; 9445, LIMS1, 46657, 149107, 23-376; 9445, LIMS1, 46658, 149108, 83-385; 9445, LIMS1, 46659, 149109, 52-219; 9445, LIMS1, 46661, 149111, 1-628; 9445, LIMS1, 46651, 149101, 120-1097; 9445, LIMS1, 46652, 149102, 264-1427; 9445, LIMS1, 46653, 149103, 168-1145; 9445, LIMS1, 46654, 149104, 88-1077; 9445, LIMS1, 46655, 149105, 90-1178; 9445, LIMS1, 46660, 149110, 209-1222; 9446, LIMS2, 46671, 149121, 214-396; 9446, LIMS2, 46672, 149122, 1-509; 9446, LIMS2, 46674, 149124, 17-766; 9446, LIMS2, 46662, 149112, 159-1256; 9446, LIMS2, 46663, 149113, 167-1192; 9446, LIMS2, 46664, 149114, 254-823; 9446, LIMS2, 46665, 149115, 196-765; 9446, LIMS2, 46666, 149116, 637-1647; 9446, LIMS2, 46667, 149117, 315-884; 9446, LIMS2, 46668, 149118, 452-1462; 9446, LIMS2, 46669, 149119, 214-783; 9446, LIMS2, 46670, 149120, 472-1482; 9446, LIMS2, 46673, 149123, 79-1170; 9447, LIMS3, 46677, 149127, 1-1197; 9447, LIMS3, 46678, 149128, 52-219; 9447, LIMS3, 46675, 149125, 302-655; 9447, LIMS3, 46676, 149126, 83-829; 9448, LIMS3L, 46680, 149130, 83-829; 9448, LIMS3L, 46681, 149131, 264-1460; 9448, LIMS3L, 46679, 149129, 298-651; 9449, LASP1, 46683, 149133, 264-762; 9449, LASP1, 46686, 149136, 130-405; 9449, LASP1, 46687, 149137, 1-318; 9449, LASP1, 46688, 149138, 160-375; 9449, LASP1, 46682, 149132, 332-1117; 9449, LASP1, 46684, 149134, 48-833; 9449, LASP1, 46685, 149135, 415-1032; 9450, LMO7, 46689, 149139, 722-4918; 9450, LMO7, 46691, 149141, 1306-6312; 9450, LMO7, 46692, 149142, 336-3472; 9450, LMO7, 46693, 149143, 1-4896; 9450, LMO7, 46694, 149144, 1-3165; 9450, LMO7, 46695, 149145, 81-3908; 9450, LMO7, 46696, 149146, 633-995; 9450, LMO7, 46697, 149147, 101-597; 9450, LMO7, 46698, 149148, 98-672; 9450, LMO7, 46699, 149149, 154-650; 9450, LMO7, 46700, 149150, 761-4918; 9450, LMO7, 46701, 149151, 1-914; 9450, LMO7, 46702, 149152, 1-874; 9450, LMO7, 46703, 149153, 150-572; 9450, LMO7, 46704, 149154, 553-589; 9450, LMO7, 46705, 149155, 1-536; 9450, LMO7, 46706, 149156, 282-578; 9450, LMO7, 46690, 149140, 1261-5310; 9451, LIMA1, 46709, 149159, 193-583; 9451, LIMA1, 46710, 149160, 61-1227; 9451, LIMA1, 46711, 149161, 6-1376; 9451, LIMA1, 46714, 149164, 235-567; 9451, LIMA1, 46715, 149165, 187-1983; 9451, LIMA1, 46707, 149157, 151-2430; 9451, LIMA1, 46708, 149158, 111-2393; 9451, LIMA1, 46712, 149162, 1271-2644; 9451, LIMA1, 46713, 149163, 536-2338; 9451, LIMA1, 46716, 149166, 179-1978; 9452, LDB1, 46717, 149167, 625-1752; 9452, LDB1, 46718, 149168, 344-1579; 9453, LDB2, 46721, 149171, 75-567; 9453, LDB2, 46722, 149172, 78-1193; 9453, LDB2, 46723, 149173, 150-1091; 9453, LDB2, 46724, 149174, 137-457; 9453, LDB2, 46725, 149175, 150-482; 9453, LDB2, 46726, 149176, 1-884; 9453, LDB2, 46719, 149169, 325-1446; 9453, LDB2, 46720, 149170, 110-1105; 9454, LDB3, 46732, 149182, 1-696; 9454, LDB3, 46735, 149185, 1-246; 9454, LDB3, 46727, 149177, 1-1854; 9454, LDB3, 46728, 149178, 22-2205; 9454, LDB3, 46729, 149179, 1-1197; 9454, LDB3, 46730, 149180, 80-931; 9454, LDB3, 46731, 149181, 146-2344; 9454, LDB3, 46733, 149183, 1-993; 9454, LDB3, 46734, 149184, 91-2289; 9455, LIMD2, 46737, 149187, 122-385; 9455, LIMD2, 46739, 149189, 343-579; 9455, LIMD2, 46740, 149190, 371-607; 9455, LIMD2, 46741, 149191, 199-435; 9455, LIMD2, 46742, 149192, 240-566; 9455, LIMD2, 46736, 149186, 160-543; 9455, LIMD2, 46738, 149188, 415-798; 9455, LIMD2, 46743, 149193, 110-493; 9456, LPP, 46744, 149194, 224-502; 9456, LPP, 46745, 149195, 1-759; 9456, LPP, 46746, 149196, 147-1433; 9456, LPP, 46747, 149197, 147-343; 9456, LPP, 46748, 149198, 188-386; 9456, LPP, 46749, 149199, 364-521; 9456, LPP, 46750, 149200, 309-479; 9456, LPP, 46751, 149201, 261-400; 9456, LPP, 46752, 149202, 201-535; 9456, LPP, 46753, 149203, 160-612; 9456, LPP, 46755, 149205, 313-2085; 9456, LPP, 46754, 149204, 190-2028; 9457, LIMK1, 46757, 149207, 103-2136; 9457, LIMK1, 46756, 149206, 52-1995; 9457, LIMK1, 46758, 149208, 1-918; 9457, LIMK1, 46759, 149209, 172-2013; 9458, LIMK2, 46763, 149213, 270-2159; 9458, LIMK2, 46764, 149214, 360-606; 9458, LIMK2, 46760, 149210, 316-2169; 9458, LIMK2, 46761, 149211, 115-2031; 9458, LIMK2, 46762, 149212, 231-2291; 9459, LMO1, 46767, 149217, 196-633; 9459, LMO1, 46765, 149215, 497-967; 9459, LMO1, 46766, 149216, 269-736; 9460, LMO2, 46768, 149218, 831-1514; 9460, LMO2, 46769, 149219, 431-907; 9460, LMO2, 46770, 149220, 151-318; 9461, LMO3, 46774, 149224, 245-454; 9461, LMO3, 46775, 149225, 178-360; 9461, LMO3, 46776, 149226, 167-379; 9461, LMO3, 46779, 149229, 266-544; 9461, LMO3, 46780, 149230, 298-480; 9461, LMO3, 46782, 149232, 74-283; 9461, LMO3, 46783, 149233, 313-565; 9461, LMO3, 46785, 149235, 215-397; 9461, LMO3, 46786, 149236, 101-283; 9461, LMO3, 46787, 149237, 259-590; 9461, LMO3, 46788, 149238, 141-496; 9461, LMO3, 46790, 149240, 188-543; 9461, LMO3, 46791, 149241, 267-530; 9461, LMO3, 46793, 149243, 161-516; 9461, LMO3, 46794, 149244, 288-579; 9461, LMO3, 46796, 149246, 448-622; 9461, LMO3, 46799, 149249, 1-378; 9461, LMO3, 46771, 149221, 491-961; 9461, LMO3, 46772, 149222, 524-961; 9461, LMO3, 46773, 149223, 288-725; 9461, LMO3, 46777, 149227, 276-713; 9461, LMO3, 46778, 149228, 127-564; 9461, LMO3, 46781, 149231, 232-669; 9461, LMO3, 46784, 149234, 475-912; 9461, LMO3, 46789, 149239, 226-729; 9461, LMO3, 46792, 149242, 96-533; 9461, LMO3, 46795, 149245, 114-551; 9461, LMO3, 46797, 149247, 212-649; 9461, LMO3, 46798, 149248, 158-649; 9462, LMO4, 46800, 149250, 151-648; 9462, LMO4, 46801, 149251, 781-1278; 9463, LIMD1, 46803, 149253, 557-2419; 9463, LIMD1, 46802, 149252, 22-2052; 9464, LHX1, 46805, 149255, 1-424; 9464, LHX1, 46807, 149257, 1-424; 9464, LHX1, 46804, 149254, 724-1944; 9464, LHX1, 46806, 149256, 724-1944; 9465, LHX2, 46809, 149259, 1-1237; 9465, LHX2, 46810, 149260, 32-471; 9465, LHX2, 46811, 149261, 1-347; 9465, LHX2, 46808, 149258, 740-1960; 9466, LHX3, 46814, 149264, 465-1625; 9466, LHX3, 46812, 149262, 120-1328; 9466, LHX3, 46813, 149263, 98-1291; 9467, LHX4, 46816, 149266, 1-454; 9467, LHX4, 46815, 149265, 245-1417; 9468, LHX5, 46817, 149267, 575-1783; 9469, LHX6, 46823, 149273, 290-397; 9469, LHX6, 46824, 149274, 636-736; 9469, LHX6, 46825, 149275, 261-413; 9469, LHX6, 46818, 149268, 202-1335; 9469, LHX6, 46819, 149269, 110-1156; 9469, LHX6, 46820, 149270, 110-1201; 9469, LHX6, 46821, 149271, 106-1284; 9469, LHX6, 46822, 149272, 72-1172; 9469, LHX6, 46826, 149276, 880-1410; 9470, LHX8, 46827, 149277, 665-1735; 9470, LHX8, 46828, 149278, 86-1126; 9471, LHX9, 46830, 149280, 191-355; 9471, LHX9, 46833, 149283, 843-1853; 9471, LHX9, 46834, 149284, 181-259; 9471, LHX9, 46835, 149285, 321-431; 9471, LHX9, 46829, 149279, 426-1619; 9471, LHX9, 46831, 149281, 28-1194; 9471, LHX9, 46832, 149282, 42-1007; 9472, LMX1A, 46836, 149286, 195-1343; 9472, LMX1A, 46837, 149287, 384-1532; 9472, LMX1A, 46838, 149288, 188-1336; 9473, LMX1B, 46842, 149292, 51-1202; 9473, LMX1B, 46839, 149289, 8-1228; 9473, LMX1B, 46840, 149290, 8-1216; 9473, LMX1B, 46841, 149291, 8-1195; 9474, LIX1, 46844, 149294, 339-529; 9474, LIX1, 46843, 149293, 297-1145; 9475, LIX1L, 46845, 149295, 75-1088; 9476, LBH, 46847, 149297, 203-349; 9476, LBH, 46848, 149298, 203-361; 9476, LBH, 46849, 149299, 11-346; 9476, LBH, 46850, 149300, 441-707; 9476, LBH, 46851, 149301, 204-335; 9476, LBH, 46846, 149296, 209-526; 9477, LMBR1, 46853, 149303, 672-1526; 9477, LMBR1, 46854, 149304, 187-303; 9477, LMBR1, 46855, 149305, 165-356; 9477, LMBR1, 46856, 149306, 216-449; 9477, LMBR1, 46857, 149307, 224-370; 9477, LMBR1, 46858, 149308, 1-138; 9477, LMBR1, 46859, 149309, 1-1590; 9477, LMBR1, 46860, 149310, 190-333; 9477, LMBR1, 46861, 149311, 167-325; 9477, LMBR1, 46852, 149302, 238-1710; 9478, LMBR1L, 46863, 149313, 127-351; 9478, LMBR1L, 46864, 149314, 296-757; 9478, LMBR1L, 46865, 149315, 112-535; 9478, LMBR1L, 46866, 149316, 323-502; 9478, LMBR1L, 46867, 149317, 121-581; 9478, LMBR1L, 46869, 149319, 1-119; 9478, LMBR1L, 46870, 149320, 1-557; 9478, LMBR1L, 46871, 149321, 1-378; 9478, LMBR1L, 46872, 149322, 123-347; 9478, LMBR1L, 46873, 149323, 291-529; 9478, LMBR1L, 46874, 149324, 188-567; 9478, LMBR1L, 46875, 149325, 296-445; 9478, LMBR1L, 46876, 149326, 1-277; 9478, LMBR1L, 46862, 149312, 344-1813; 9478, LMBR1L, 46868, 149318, 296-1705; 9479, LSAMP, 46877, 149327, 1-1038; 9479, LSAMP, 46878, 149328, 157-772; 9479, LSAMP, 46880, 149330, 1-867; 9479, LSAMP, 46879, 149329, 501-1517; 9480, LIN28A, 46881, 149331, 76-705; 9480, LIN28A, 46882, 149332, 115-744; 9481, LIN28B, 46883, 149333, 204-956; 9482, LIN37, 46885, 149335, 235-291; 9482, LIN37, 46886, 149336, 1-491; 9482, LIN37, 46887, 149337, 119-283; 9482, LIN37, 46884, 149334, 365-1105; 9483, LIN52, 46889, 149339, 1-292; 9483, LIN52, 46888, 149338, 168-518; 9484, LIN54, 46894, 149344, 371-559; 9484, LIN54, 46890, 149340, 379-2628; 9484, LIN54, 46891, 149341, 281-1867; 9484, LIN54, 46892, 149342, 110-1696; 9484, LIN54, 46893, 149343, 129-1715; 9484, LIN54, 46895, 149345, 259-2241; 9484, LIN54, 46896, 149346, 168-2417; 9484, LIN54, 46897, 149347, 260-991; 9485, LIN7A, 46898, 149348, 59-364; 9485, LIN7A, 46900, 149350, 1-392; 9485, LIN7A, 46901, 149351, 1-543; 9485, LIN7A, 46899, 149349, 204-905; 9486, LIN7B, 46904, 149354, 1-398; 9486, LIN7B, 46905, 149355, 1-347; 9486, LIN7B, 46902, 149352, 45-668; 9486, LIN7B, 46903, 149353, 82-495; 9487, LIN7C, 46907, 149357, 18-539; 9487, LIN7C, 46906, 149356, 22-615; 9488, LIN9, 46909, 149359, 474-686; 9488, LIN9, 46910, 149360, 1-1842; 9488, LIN9, 46911, 149361, 1-1557; 9488, LIN9, 46912, 149362, 68-1537; 9488, LIN9, 46908, 149358, 547-2223; 9489, L1TD1, 46913, 149363, 296-2893; 9490, LINS1, 46915, 149365, 277-872; 9490, LINS1, 46916, 149366, 172-558; 9490, LINS1, 46917, 149367, 254-827; 9490, LINS1, 46918, 149368, 131-562; 9490, LINS1, 46920, 149370, 158-1111; 9490, LINS1, 46921, 149371, 192-588; 9490, LINS1, 46922, 149372, 1-208; 9490, LINS1, 46914, 149364, 224-2497; 9490, LINS1, 46919, 149369, 155-1465; 9491, LAT, 46927, 149377, 1-258; 9491, LAT, 46928, 149378, 1-501; 9491, LAT, 46931, 149381, 353-610; 9491, LAT, 46923, 149373, 79-867; 9491, LAT, 46924, 149374, 323-1024; 9491, LAT, 46925, 149375, 37-846; 9491, LAT, 46926, 149376, 296-994; 9491, LAT, 46929, 149379, 1-786; 9491, LAT, 46930, 149380, 216-914; 9492, LAT2, 46934, 149384, 391-581; 9492, LAT2, 46936, 149386, 261-561; 9492, LAT2, 46937, 149387, 285-586; 9492, LAT2, 46939, 149389, 411-585; 9492, LAT2, 46932, 149382, 232-963; 9492, LAT2, 46933, 149383, 723-1454; 9492, LAT2, 46935, 149385, 138-869; 9492, LAT2, 46938, 149388, 890-1621; 9492, LAT2, 46940, 149390, 113-448; 9493, LIPA, 46941, 149391, 96-753; 9493, LIPA, 46944, 149394, 184-1055; 9493, LIPA, 46945, 149395, 423-1274; 9493, LIPA, 46942, 149392, 324-1523; 9493, LIPA, 46943, 149393, 223-1254; 9494, LMF1, 46948, 149398, 309-596; 9494, LMF1, 46949, 149399, 288-882; 9494, LMF1, 46950, 149400, 244-694; 9494, LMF1, 46951, 149401, 1-405; 9494, LMF1, 46952, 149402, 3-557; 9494, LMF1, 46953, 149403, 1-450; 9494, LMF1, 46954, 149404, 1-505; 9494, LMF1, 46955, 149405, 1-485; 9494, LMF1, 46956, 149406, 531-1583; 9494, LMF1, 46946, 149396, 20-1723; 9494, LMF1, 46947, 149397, 222-1214; 9495, LMF2, 46957, 149407, 170-2218; 9495, LMF2, 46958, 149408, 17-2140; 9496, LIPG, 46960, 149410, 250-1530; 9496, LIPG, 46962, 149412, 1-565; 9496, LIPG, 46963, 149413, 433-505; 9496, LIPG, 46964, 149414, 988-2160; 9496, LIPG, 46959, 149409, 279-1781; 9496, LIPG, 46961, 149411, 223-1287; 9497, LIPJ, 46966, 149416, 1-462; 9497, LIPJ, 46965, 149415, 315-1415; 9498, LIPK, 46967, 149417, 1-1200; 9499, LIPM, 46968, 149418, 168-1439; 9499, LIPM, 46969, 149419, 1-1152; 9500, LIPN, 46970, 149420, 1-1197; 9501, LIPF, 46971, 149421, 47-1243; 9501, LIPF, 46972, 149422, 97-1224; 9501, LIPF, 46973, 149423, 114-1340; 9501, LIPF, 46974, 149424, 63-1160; 9502, LIPC, 46977, 149427, 43-1359; 9502, LIPC, 46978, 149428, 288-1787; 9502, LIPC, 46975, 149425, 236-1735; 9502, LIPC, 46976, 149426, 616-2115; 9503, LIPE, 46980, 149430, 95-335; 9503, LIPE, 46981, 149431, 232-759; 9503, LIPE, 46982, 149432, 1-915; 9503, LIPE, 46983, 149433, 588-1367; 9503, LIPE, 46984, 149434, 1-824; 9503, LIPE, 46985, 149435, 72-738; 9503, LIPE, 46979, 149429, 278-3508; 9504, LIPH, 46987, 149437, 1-221; 9504, LIPH, 46988, 149438, 88-1341; 9504, LIPH, 46989, 149439, 1-256; 9504, LIPH, 46990, 149440, 40-183; 9504, LIPH, 46986, 149436, 143-1498; 9505, LIPI, 46992, 149442, 1-421; 9505, LIPI, 46994, 149444, 74-1339; 9505, LIPI, 46991, 149441, 27-1472; 9505, LIPI, 46993, 149443, 74-1429; 9506, LDAH, 46996, 149446, 81-1193; 9506, LDAH, 46997, 149447, 305-1027; 9506, LDAH, 46998, 149448, 56-493; 9506, LDAH, 46999, 149449, 97-948; 9506, LDAH, 47000, 149450, 158-548; 9506, LDAH, 47001, 149451, 97-597; 9506, LDAH, 47002, 149452, 89-566; 9506, LDAH, 47003, 149453, 77-547; 9506, LDAH, 46995, 149445, 81-1058; 9506, LDAH, 47004, 149454, 331-918; 9506, LDAH, 47005, 149455, 187-774; 9506, LDAH, 47006, 149456, 68-901; 9507, LPIN1, 47010, 149460, 363-2468; 9507, LPIN1, 47011, 149461, 394-477; 9507, LPIN1, 47014, 149464, 312-599; 9507, LPIN1, 47015, 149465, 1-583; 9507, LPIN1, 47007, 149457, 94-2766; 9507, LPIN1, 47008, 149458, 278-3076; 9507, LPIN1, 47009, 149459, 363-1742; 9507, LPIN1, 47012, 149462, 54-2981; 9507, LPIN1, 47013, 149463, 278-2968; 9508, LPIN2, 47017, 149467, 239-936; 9508, LPIN2, 47018, 149468, 105-491; 9508, LPIN2, 47016, 149466, 240-2930; 9509, LPIN3, 47020, 149470, 1-808; 9509, LPIN3, 47019, 149469, 92-2647; 9509, LPIN3, 47021, 149471, 40-2598; 9510, LCN1, 47022, 149472, 61-591; 9510, LCN1, 47023, 149473, 44-574; 9511, LCN10, 47026, 149476, 57-551; 9511, LCN10, 47027, 149477, 1-112; 9511, LCN10, 47028, 149478, 57-284; 9511, LCN10, 47029, 149479, 38-298; 9511, LCN10, 47024, 149474, 57-659; 9511, LCN10, 47025, 149475, 1-564; 9512, LCN12, 47030, 149480, 1-273; 9512, LCN12, 47032, 149482, 1-309; 9512, LCN12, 47031, 149481, 1-579; 9513, LCN15, 47033, 149483, 26-580; 9514, LCN2, 47035, 149485, 9-611; 9514, LCN2, 47034, 149484, 74-670; 9514, LCN2, 47036, 149486, 238-834; 9515, LCN6, 47038, 149488, 134-370; 9515, LCN6, 47037, 149487, 46-537; 9516, LCN8, 47039, 149489, 297-755; 9516, LCN8, 47040, 149490, 1-528; 9517, LCN9, 47042, 149492, 1-528; 9517, LCN9, 47041, 149491, 1-531; 9518, LCNL1, 47043, 149493, 595-1089; 9519, LIAS, 47047, 149497, 53-781; 9519, LIAS, 47044, 149494, 119-1237; 9519, LIAS, 47045, 149495, 119-1087; 9519, LIAS, 47046, 149496, 47-1036; 9520, LSR, 47053, 149503, 1-343; 9520, LSR, 47054, 149504, 144-297; 9520, LSR, 47055, 149505, 112-530; 9520, LSR, 47057, 149507, 5-1810; 9520, LSR, 47048, 149498, 1-1776; 9520, LSR, 47049, 149499, 108-2000; 9520, LSR, 47050, 149500, 115-1860; 9520, LSR, 47051, 149501, 160-2109; 9520, LSR, 47052, 149502, 22-1503; 9520, LSR, 47056, 149506, 488-2377; 9520, LSR, 47058, 149508, 224-2173; 9521, LHFP, 47059, 149509, 464-1066; 9522, LHFPL1, 47060, 149510, 241-903; 9523, LHFPL2, 47061, 149511, 677-1363; 9523, LHFPL2, 47062, 149512, 312-998; 9524, LHFPL3, 47063, 149513, 123-779; 9524, LHFPL3, 47064, 149514, 167-835; 9525, LHFPL4, 47065, 149515, 287-1030; 9526, LHFPL5, 47066, 149516, 379-1038; 9527, LBP, 47067, 149517, 162-1607; 9528, LITAF, 47071, 149521, 458-556; 9528, LITAF, 47072, 149522, 275-481; 9528, LITAF, 47073, 149523, 182-593; 9528, LITAF, 47074, 149524, 145-553; 9528, LITAF, 47075, 149525, 469-587; 9528, LITAF, 47076, 149526, 1-32; 9528, LITAF, 47079, 149529, 24-251; 9528, LITAF, 47080, 149530, 291-554; 9528, LITAF, 47081, 149531, 40-357; 9528, LITAF, 47082, 149532, 62-442; 9528, LITAF, 47083, 149533, 119-579; 9528, LITAF, 47084, 149534, 40-285; 9528, LITAF, 47068, 149518, 234-719; 9528, LITAF, 47069, 149519, 7-693; 9528, LITAF, 47070, 149520, 71-529; 9528, LITAF, 47077, 149527, 103-588; 9528, LITAF, 47078, 149528, 232-717; 9528, LITAF, 47085, 149535, 94-579; 9528, LITAF, 47086, 149536, 221-706; 9528, LITAF, 47087, 149537, 234-692; 9528, LITAF, 47088, 149538, 71-556; 9529, LPL, 47090, 149540, 241-629; 9529, LPL, 47091, 149541, 216-560; 9529, LPL, 47092, 149542, 243-559; 9529, LPL, 47093, 149543, 186-305; 9529, LPL, 47089, 149539, 471-1898; 9530, LPA, 47096, 149546, 1-1713; 9530, LPA, 47094, 149544, 46-6168; 9530, LPA, 47095, 149545, 1-1839; 9531, LOXHD1, 47100, 149550, 1-6204; 9531, LOXHD1, 47101, 149551, 135-675; 9531, LOXHD1, 47102, 149552, 488-556; 9531, LOXHD1, 47103, 149553, 390-560; 9531, LOXHD1, 47104, 149554, 192-1112; 9531, LOXHD1, 47105, 149555, 1-6636; 9531, LOXHD1, 47106, 149556, 241-3543; 9531, LOXHD1, 47107, 149557, 352-3387; 9531, LOXHD1, 47097, 149547, 415-3759; 9531, LOXHD1, 47098, 149548, 221-1759; 9531, LOXHD1, 47099, 149549, 206-1579; 9532, LIPT2, 47109, 149559, 1-236; 9532, LIPT2, 47110, 149560, 1-218; 9532, LIPT2, 47108, 149558, 31-726; 9533, LIPT1, 47113, 149563, 77-482; 9533, LIPT1, 47114, 149564, 132-885; 9533, LIPT1, 47115, 149565, 486-803; 9533, LIPT1, 47116, 149566, 466-583; 9533, LIPT1, 47111, 149561, 99-1220; 9533, LIPT1, 47112, 149562, 225-1346; 9534, LTN1, 47119, 149569, 7-2448; 9534, LTN1, 47120, 149570, 1-1099; 9534, LTN1, 47117, 149567, 81-5381; 9534, LTN1, 47118, 149568, 7-5445; 9534, LTN1, 47121, 149571, 14-5452; 9535, LEAP2, 47122, 149572, 1374-1607; 9536, LKAAEAR1, 47123, 149573, 141-725; 9536, LKAAEAR1, 47124, 149574, 141-863; 9537, N/A, 47125, 149575, 355-2091; 9538, N/A, 47126, 149576, 75-467; 9539, LLPH, 47127, 149577, 72-461; 9539, LLPH, 47128, 149578, 255-644; 9540, LMBRD1, 47129, 149579, 344-1747; 9540, LMBRD1, 47130, 149580, 231-1853; 9540, LMBRD1, 47131, 149581, 5-1183; 9541, LMBRD2, 47132, 149582, 464-2551; 9542, LMO7DN, 47133, 149583, 90-458; 9543, LONP1, 47136, 149586, 60-2549; 9543, LONP1, 47137, 149587, 148-2685; 9543, LONP1, 47138, 149588, 1-558; 9543, LONP1, 47139, 149589, 1-725; 9543, LONP1, 47140, 149590, 12-641; 9543, LONP1, 47141, 149591, 1-793; 9543, LONP1, 47142, 149592, 15-275; 9543, LONP1, 47134, 149584, 159-3038; 9543, LONP1, 47135, 149585, 514-2805; 9543, LONP1, 47143, 149593, 34-2721; 9544, LONP2, 47145, 149595, 35-1852; 9544, LONP2, 47147, 149597, 1-710; 9544, LONP2, 47148, 149598, 1-510; 9544, LONP2, 47149, 149599, 2-904; 9544, LONP2, 47144, 149594, 94-2652; 9544, LONP2, 47146, 149596, 57-2483; 9545, LONRF1, 47151, 149601, 1668-2918; 9545, LONRF1, 47152, 149602, 1-1131; 9545, LONRF1, 47153, 149603, 312-491; 9545, LONRF1, 47154, 149604, 90-689; 9545, LONRF1, 47155, 149605, 242-421; 9545, LONRF1, 47150, 149600, 71-2392; 9546, LONRF2, 47156, 149606, 641-2905; 9546, LONRF2, 47157, 149607, 72-1607; 9547, LONRF3, 47160, 149610, 722-2233; 9547, LONRF3, 47161, 149611, 1-1576; 9547, LONRF3, 47158, 149608, 168-2324; 9547, LONRF3, 47159, 149609, 32-2311; 9547, LONRF3, 47162, 149612, 164-1996; 9548, LINC00116, 47163, 149613, 38-208; 9548, LINC00116, 47164, 149614, 1401-1817; 9548, LINC00116, 47165, 149615, 58-228; 9549, LINC01420, 47166, 149616, 1-122; 9549, LINC01420, 47167, 149617, 1-207; 9549, LINC01420, 47168, 149618, 96-302; 9550, LINC01556, 47169, 149619, 28-216; 9550, LINC01556, 47170, 149620, 28-216; 9550, LINC01556, 47171, 149621, 28-216; 9550, LINC01556, 47172, 149622, 28-216; 9550, LINC01556, 47173, 149623, 28-216; 9551, LINC01620, 47174, 149624, 1-513; 9552, LINC00493, 47175, 149625, 60-347; 9552, LINC00493, 47176, 149626, 133-417; 9552, LINC00493, 47177, 149627, 33-254; 9553, LINC00694, 47178, 149628, 88-393; 9553, LINC00694, 47179, 149629, 48-353; 9554, N/A, 47180, 149630, 54-2057; 9555, LOR, 47181, 149631, 58-996; 9556, LDLR, 47182, 149632, 1-2837; 9556, LDLR, 47187, 149637, 1-928; 9556, LDLR, 47188, 149638, 88-2934; 9556, LDLR, 47189, 149639, 1-512; 9556, LDLR, 47183, 149633, 87-2165; 9556, LDLR, 47184, 149634, 87-2135; 9556, LDLR, 47185, 149635, 87-2546; 9556, LDLR, 47186, 149636, 72-2648; 9556, LDLR, 47190, 149640, 188-2770; 9557, LDLRAP1, 47191, 149641, 120-1046; 9558, LDLRAD1, 47192, 149642, 19-636; 9558, LDLRAD1, 47193, 149643, 61-411; 9558, LDLRAD1, 47194, 149644, 11-511; 9558, LDLRAD1, 47195, 149645, 75-563; 9559, LDLRAD2, 47196, 149646, 188-1006; 9559, LDLRAD2, 47197, 149647, 90-908; 9560, LDLRAD3, 47200, 149650, 119-1126; 9560, LDLRAD3, 47198, 149648, 22-1059; 9560, LDLRAD3, 47199, 149649, 119-1009; 9561, LDLRAD4, 47203, 149653, 536-743; 9561, LDLRAD4, 47204, 149654, 557-685; 9561, LDLRAD4, 47206, 149656, 469-572; 9561, LDLRAD4, 47201, 149651, 469-1389; 9561, LDLRAD4, 47202, 149652, 669-1535; 9561, LDLRAD4, 47205, 149655, 1242-2051; 9561, LDLRAD4, 47207, 149657, 959-1585; 9561, LDLRAD4, 47208, 149658, 352-1041; 9561, LDLRAD4, 47209, 149659, 87-842; 9562, LRP1, 47212, 149662, 1-550; 9562, LRP1, 47213, 149663, 473-1363; 9562, LRP1, 47214, 149664, 1-418; 9562, LRP1, 47215, 149665, 57-1376; 9562, LRP1, 47210, 149660, 467-14101; 9562, LRP1, 47211, 149661, 250-1128; 9563, LRP10, 47218, 149668, 1-1375; 9563, LRP10, 47216, 149666, 692-2833; 9563, LRP10, 47217, 149667, 1-1671; 9564, LRP11, 47220, 149670, 7-984; 9564, LRP11, 47219, 149669, 7-1509; 9565, LRP12, 47223, 149673, 288-889; 9565, LRP12, 47221, 149671, 110-2689; 9565, LRP12, 47222, 149672, 128-2650; 9566, LRP1B, 47225, 149675, 1-839; 9566, LRP1B, 47226, 149676, 277-2621; 9566, LRP1B, 47227, 149677, 1-2396; 9566, LRP1B, 47228, 149678, 1-13218; 9566, LRP1B, 47224, 149674, 973-14772; 9567, LRP2, 47230, 149680, 136-3813; 9567, LRP2, 47229, 149679, 287-14254; 9568, LRP3, 47232, 149682, 301-575; 9568, LRP3, 47231, 149681, 203-2515; 9569, LRP4, 47234, 149684, 264-663; 9569, LRP4, 47233, 149683, 244-5961; 9570, LRP5, 47236, 149686, 1-518; 9570, LRP5, 47237, 149687, 32-1447; 9570, LRP5, 47235, 149685, 107-4954; 9571, LRP5L, 47241, 149691, 590-600; 9571, LRP5L, 47242, 149692, 134-346; 9571, LRP5L, 47238, 149688, 525-1283; 9571, LRP5L, 47239, 149689, 98-856; 9571, LRP5L, 47240, 149690, 702-1376; 9571, LRP5L, 47243, 149693, 2466-3224; 9572, LRP6, 47245, 149695, 337-562; 9572, LRP6, 47246, 149696, 35-4741; 9572, LRP6, 47247, 149697, 1-210; 9572, LRP6, 47248, 149698, 1-4436; 9572, LRP6, 47250, 149700, 337-562; 9572, LRP6, 47251, 149701, 35-4741; 9572, LRP6, 47252, 149702, 1-210; 9572, LRP6, 47253, 149703, 1-4436; 9572, LRP6, 47244, 149694, 78-4919; 9572, LRP6, 47249, 149699, 78-4919; 9573, LRP8, 47258, 149708, 1-365; 9573, LRP8, 47259, 149709, 159-1337; 9573, LRP8, 47260, 149710, 1-406; 9573, LRP8, 47261, 149711, 1-721; 9573, LRP8, 47262, 149712, 847-2220; 9573, LRP8, 47263, 149713, 1-2100; 9573, LRP8, 47254, 149704, 103-2994; 9573, LRP8, 47255, 149705, 1-2382; 9573, LRP8, 47256, 149706, 1-2103; 9573, LRP8, 47257, 149707, 143-2857; 9574, LRPAP1, 47264, 149714, 5-322; 9574, LRPAP1, 47265, 149715, 148-1221; 9575, LRBA, 47268, 149718, 296-8023; 9575, LRBA, 47269, 149719, 1-405; 9575, LRBA, 47270, 149720, 1-443; 9575, LRBA, 47271, 149721, 1-4517; 9575, LRBA, 47266, 149716, 245-8836; 9575, LRBA, 47267, 149717, 286-8841; 9576, N/A, 47272, 149722, 605-3817; 9576, N/A, 47273, 149723, 526-3807; 9577, LRP2BP, 47275, 149725, 226-685; 9577, LRP2BP, 47276, 149726, 1973-2938; 9577, LRP2BP, 47274, 149724, 813-1856; 9577, LRP2BP, 47277, 149727, 1143-2186; 9578, LRRN4CL, 47278, 149728, 479-1195; 9579, LSM14B, 47280, 149730, 141-811; 9579, LSM14B, 47281, 149731, 494-1239; 9579, LSM14B, 47282, 149732, 207-872; 9579, LSM14B, 47283, 149733, 186-1073; 9579, LSM14B, 47279, 149729, 161-1318; 9580, LSM1, 47285, 149735, 169-303; 9580, LSM1, 47286, 149736, 355-489; 9580, LSM1, 47284, 149734, 397-798; 9581, LSM10, 47287, 149737, 151-522; 9582, LSM11, 47288, 149738, 57-1139; 9583, LSM12, 47290, 149740, 73-765; 9583, LSM12, 47289, 149739, 149-736; 9583, LSM12, 47291, 149741, 324-911; 9584, LSM14A, 47296, 149746, 1-243; 9584, LSM14A, 47297, 149747, 1-1032; 9584, LSM14A, 47299, 149749, 140-448; 9584, LSM14A, 47300, 149750, 1-944; 9584, LSM14A, 47301, 149751, 140-448; 9584, LSM14A, 47302, 149752, 1-445; 9584, LSM14A, 47303, 149753, 1-434; 9584, LSM14A, 47292, 149742, 76-1467; 9584, LSM14A, 47293, 149743, 78-1469; 9584, LSM14A, 47294, 149744, 119-1387; 9584, LSM14A, 47295, 149745, 106-1497; 9584, LSM14A, 47298, 149748, 197-1588; 9585, LSM2, 47304, 149754, 228-515; 9585, LSM2, 47305, 149755, 228-515; 9585, LSM2, 47306, 149756, 228-515; 9585, LSM2, 47307, 149757, 228-515; 9585, LSM2, 47308, 149758, 228-515; 9585, LSM2, 47309, 149759, 228-515; 9586, LSM3, 47310, 149760, 504-812; 9587, LSM4, 47311, 149761, 41-250; 9587, LSM4, 47313, 149763, 52-429; 9587, LSM4, 47314, 149764, 120-446; 9587, LSM4, 47315, 149765, 93-807; 9587, LSM4, 47312, 149762, 255-674; 9588, LSM5, 47316, 149766, 499-714; 9588, LSM5, 47317, 149767, 16-210; 9588, LSM5, 47318, 149768, 96-284; 9588, LSM5, 47319, 149769, 273-461; 9588, LSM5, 47320, 149770, 118-306; 9588, LSM5, 47321, 149771, 240-428; 9588, LSM5, 47322, 149772, 301-489; 9588, LSM5, 47323, 149773, 54-329; 9589, LSM6, 47324, 149774, 138-380; 9589, LSM6, 47325, 149775, 75-317; 9589, LSM6, 47326, 149776, 720-962; 9589, LSM6, 47327, 149777, 120-362; 9590, LSM7, 47329, 149779, 1-183; 9590, LSM7, 47330, 149780, 46-153; 9590, LSM7, 47331, 149781, 266-415; 9590, LSM7, 47328, 149778, 55-366; 9591, LSM8, 47333, 149783, 81-284; 9591, LSM8, 47334, 149784, 1531-1758; 9591, LSM8, 47335, 149785, 58-290; 9591, LSM8, 47332, 149782, 193-483; 9592, LTV1, 47336, 149786, 135-1562; 9593, LUC7L, 47339, 149789, 449-1267; 9593, LUC7L, 47341, 149791, 101-229; 9593, LUC7L, 47342, 149792, 36-203; 9593, LUC7L, 47343, 149793, 148-695; 9593, LUC7L, 47344, 149794, 1-181; 9593, LUC7L, 47345, 149795, 403-498; 9593, LUC7L, 47346, 149796, 1-513; 9593, LUC7L, 47347, 149797, 582-833; 9593, LUC7L, 47348, 149798, 96-263; 9593, LUC7L, 47349, 149799, 112-279; 9593, LUC7L, 47337, 149787, 112-1227; 9593, LUC7L, 47338, 149788, 125-1102; 9593, LUC7L, 47340, 149790, 125-1102; 9594, LUC7L2, 47350, 149800, 1-1170; 9594, LUC7L2, 47352, 149802, 351-602; 9594, LUC7L2, 47353, 149803, 185-1354; 9594, LUC7L2, 47354, 149804, 224-388; 9594, LUC7L2, 47355, 149805, 491-1666; 9594, LUC7L2, 47351, 149801, 355-1533; 9595, LUC7L3, 47357, 149807, 135-1604; 9595, LUC7L3, 47358, 149808, 105-658; 9595, LUC7L3, 47359, 149809, 105-269; 9595, LUC7L3, 47360, 149810, 1-120; 9595, LUC7L3, 47361, 149811, 135-374; 9595, LUC7L3, 47362, 149812, 164-403; 9595, LUC7L3, 47364, 149814, 136-375; 9595, LUC7L3, 47365, 149815, 397-505; 9595, LUC7L3, 47366, 149816, 1-624; 9595, LUC7L3, 47367, 149817, 136-375; 9595, LUC7L3, 47368, 149818, 1-370; 9595, LUC7L3, 47369, 149819, 1-259; 9595, LUC7L3, 47370, 149820, 1-324; 9595, LUC7L3, 47371, 149821, 1-356; 9595, LUC7L3, 47372, 149822, 455-594; 9595, LUC7L3, 47373, 149823, 169-400; 9595, LUC7L3, 47356, 149806, 131-1429; 9595, LUC7L3, 47363, 149813, 190-1488; 9596, LUM, 47374, 149824, 456-1472; 9597, LHB, 47376, 149826, 16-480; 9597, LHB, 47375, 149825, 1-426; 9598, LHCGR, 47378, 149828, 60-1037; 9598, LHCGR, 47379, 149829, 60-1049; 9598, LHCGR, 47380, 149830, 1-2019; 9598, LHCGR, 47381, 149831, 1-528; 9598, LHCGR, 47377, 149827, 23-2122; 9599, LYAR, 47384, 149834, 544-780; 9599, LYAR, 47382, 149832, 242-1381; 9599, LYAR, 47383, 149833, 144-1283; 9600, LYNX1, 47386, 149836, 1-264; 9600, LYNX1, 47387, 149837, 65-313; 9600, LYNX1, 47392, 149842, 388-639; 9600, LYNX1, 47393, 149843, 318-563; 9600, LYNX1, 47385, 149835, 39-332; 9600, LYNX1, 47388, 149838, 388-738; 9600, LYNX1, 47389, 149839, 217-567; 9600, LYNX1, 47390, 149840, 274-624; 9600, LYNX1, 47391, 149841, 631-1026; 9601, LYPD1, 47396, 149846, 269-388; 9601, LYPD1, 47394, 149844, 506-775; 9601, LYPD1, 47395, 149845, 274-699; 9602, LYPD2, 47397, 149847, 84-461; 9603, LYPD3, 47398, 149848, 90-1130; 9604, LYPD4, 47399, 149849, 347-982; 9604, LYPD4, 47400, 149850, 372-1007; 9604, LYPD4, 47401, 149851, 1217-1957; 9605, LYPD5, 47404, 149854, 187-569; 9605, LYPD5, 47406, 149856, 267-607; 9605, LYPD5, 47402, 149852, 82-837; 9605, LYPD5, 47403, 149853, 161-787; 9605, LYPD5, 47405, 149855, 261-887; 9606, LYPD6, 47410, 149860, 406-565; 9606, LYPD6, 47407, 149857, 258-773; 9606, LYPD6, 47408, 149858, 493-723; 9606, LYPD6, 47409, 149859, 290-805; 9606, LYPD6, 47411, 149861, 132-362; 9607, LYPD6B, 47412, 149862, 1-552; 9607, LYPD6B, 47416, 149866, 213-365; 9607, LYPD6B, 47417, 149867, 128-292; 9607, LYPD6B, 47418, 149868, 198-422; 9607, LYPD6B, 47413, 149863, 151-702; 9607, LYPD6B, 47414, 149864, 203-754; 9607, LYPD6B, 47415, 149865, 402-1025; 9608, LYPD8, 47419, 149869, 1-164; 9608, LYPD8, 47420, 149870, 233-946; 9609, LY75-CD302, 47421, 149871, 29-5482; 9609, LY75-CD302, 47422, 149872, 29-5650; 9610, LYVE1, 47424, 149874, 187-402; 9610, LYVE1, 47425, 149875, 46-702; 9610, LYVE1, 47423, 149873, 160-1128; 9611, LYL1, 47427, 149877, 731-902; 9611, LYL1, 47426, 149876, 362-1204; 9612, LY6D, 47428, 149878, 77-463; 9613, LY6E, 47434, 149884, 111-236; 9613, LY6E, 47435, 149885, 36-479; 9613, LY6E, 47437, 149887, 93-293; 9613, LY6E, 47439, 149889, 112-333; 9613, LY6E, 47440, 149890, 92-292; 9613, LY6E, 47441, 149891, 99-224; 9613, LY6E, 47442, 149892, 212-412; 9613, LY6E, 47445, 149895, 93-293; 9613, LY6E, 47446, 149896, 112-333; 9613, LY6E, 47447, 149897, 212-412; 9613, LY6E, 47448, 149898, 36-479; 9613, LY6E, 47449, 149899, 99-224; 9613, LY6E, 47454, 149904, 92-292; 9613, LY6E, 47455, 149905, 111-236; 9613, LY6E, 47429, 149879, 163-558; 9613, LY6E, 47430, 149880, 157-552; 9613, LY6E, 47431, 149881, 239-634; 9613, LY6E, 47432, 149882, 69-464; 9613, LY6E, 47433, 149883, 232-627; 9613, LY6E, 47436, 149886, 370-765; 9613, LY6E, 47438, 149888, 404-799; 9613, LY6E, 47443, 149893, 163-558; 9613, LY6E, 47444, 149894, 232-627; 9613, LY6E, 47450, 149900, 157-552; 9613, LY6E, 47451, 149901, 239-634; 9613, LY6E, 47452, 149902, 404-799; 9613, LY6E, 47453, 149903, 370-765; 9613, LY6E, 47456, 149906, 69-464; 9614, LY6G5B, 47458, 149908, 1-639; 9614, LY6G5B, 47460, 149910, 1-639; 9614, LY6G5B, 47461, 149911, 1-639; 9614, LY6G5B, 47462, 149912, 1-639; 9614, LY6G5B, 47457, 149907, 785-1390; 9614, LY6G5B, 47459, 149909, 885-

1325; 9614, LY6G5B, 47463, 149913, 1-606; 9614, LY6G5B, 47464, 149914, 1-606; 9614, LY6G5B, 47465, 149915, 1-606; 9614, LY6G5B, 47466, 149916, 1-606; 9614, LY6G5B, 47467, 149917, 1-606; 9614, LY6G5B, 47468, 149918, 1-606; 9615, LY6G5C, 47470, 149920, 1-677; 9615, LY6G5C, 47473, 149923, 1-677; 9615, LY6G5C, 47476, 149926, 1-677; 9615, LY6G5C, 47477, 149927, 1-677; 9615, LY6G5C, 47478, 149928, 1-677; 9615, LY6G5C, 47479, 149929, 1-677; 9615, LY6G5C, 47480, 149930, 1-677; 9615, LY6G5C, 47483, 149933, 1-210; 9615, LY6G5C, 47469, 149919, 5-457; 9615, LY6G5C, 47471, 149921, 5-457; 9615, LY6G5C, 47472, 149922, 5-457; 9615, LY6G5C, 47474, 149924, 5-457; 9615, LY6G5C, 47475, 149925, 5-457; 9615, LY6G5C, 47481, 149931, 5-457; 9615, LY6G5C, 47482, 149932, 5-457; 9616, LY6G6C, 47491, 149941, 280-489; 9616, LY6G6C, 47492, 149942, 280-489; 9616, LY6G6C, 47493, 149943, 280-489; 9616, LY6G6C, 47494, 149944, 280-489; 9616, LY6G6C, 47495, 149945, 280-489; 9616, LY6G6C, 47484, 149934, 167-544; 9616, LY6G6C, 47485, 149935, 167-544; 9616, LY6G6C, 47486, 149936, 167-544; 9616, LY6G6C, 47487, 149937, 167-544; 9616, LY6G6C, 47488, 149938, 167-544; 9616, LY6G6C, 47489, 149939, 167-544; 9616, LY6G6C, 47490, 149940, 167-544; 9617, LY6G6D, 47496, 149946, 1-523; 9617, LY6G6D, 47498, 149948, 1-523; 9617, LY6G6D, 47500, 149950, 4-1152; 9617, LY6G6D, 47502, 149952, 1-523; 9617, LY6G6D, 47504, 149954, 1-523; 9617, LY6G6D, 47508, 149958, 4-1152; 9617, LY6G6D, 47509, 149959, 4-1152; 9617, LY6G6D, 47510, 149960, 1-523; 9617, LY6G6D, 47511, 149961, 1-523; 9617, LY6G6D, 47512, 149962, 1-523; 9617, LY6G6D, 47497, 149947, 1-402; 9617, LY6G6D, 47499, 149949, 1-402; 9617, LY6G6D, 47501, 149951, 1-402; 9617, LY6G6D, 47503, 149953, 1-402; 9617, LY6G6D, 47505, 149955, 1-402; 9617, LY6G6D, 47506, 149956, 1-402; 9617, LY6G6D, 47507, 149957, 1-402; 9618, LY6G6E, 47513, 149963, 1-303; 9618, LY6G6E, 47514, 149964, 1-378; 9618, LY6G6E, 47515, 149965, 1-303; 9618, LY6G6E, 47516, 149966, 179-445; 9618, LY6G6E, 47517, 149967, 1-303; 9618, LY6G6E, 47518, 149968, 1-201; 9618, LY6G6E, 47519, 149969, 1-201; 9618, LY6G6E, 47520, 149970, 1-303; 9618, LY6G6E, 47521, 149971, 1-201; 9618, LY6G6E, 47522, 149972, 1-201; 9618, LY6G6E, 47523, 149973, 1-303; 9618, LY6G6E, 47524, 149974, 1-303; 9618, LY6G6E, 47525, 149975, 1-201; 9618, LY6G6E, 47526, 149976, 1-201; 9618, LY6G6E, 47527, 149977, 1-201; 9618, LY6G6E, 47528, 149978, 1-303; 9618, LY6G6E, 47529, 149979, 1-384; 9618, LY6G6E, 47530, 149980, 1-378; 9618, LY6G6E, 47531, 149981, 1-378; 9618, LY6G6E, 47532, 149982, 1-378; 9618, LY6G6E, 47533, 149983, 1-378; 9618, LY6G6E, 47534, 149984, 1-378; 9618, LY6G6E, 47535, 149985, 1-378; 9619, LY6G6F, 47536, 149986, 23-916; 9619, LY6G6F, 47537, 149987, 23-916; 9619, LY6G6F, 47538, 149988, 23-916; 9619, LY6G6F, 47539, 149989, 23-916; 9619, LY6G6F, 47540, 149990, 23-916; 9619, LY6G6F, 47541, 149991, 23-916; 9619, LY6G6F, 47542, 149992, 23-916; 9620, LY6H, 47543, 149993, 130-615; 9620, LY6H, 47544, 149994, 235-720; 9620, LY6H, 47545, 149995, 167-589; 9620, LY6H, 47546, 149996, 167-589; 9620, LY6H, 47547, 149997, 223-645; 9620, LY6H, 47548, 149998, 235-720; 9620, LY6H, 47549, 149999, 130-615; 9621, LY6K, 47551, 150001, 416-718; 9621, LY6K, 47552, 150002, 57-314; 9621, LY6K, 47550, 150000, 418-915; 9621, LY6K, 47553, 150003, 415-732; 9622, LY75, 47554, 150004, 29-5197; 9623, LY86, 47555, 150005, 67-555; 9623, LY86, 47556, 150006, 353-841; 9624, LY9, 47558, 150008, 1-1024; 9624, LY9, 47560, 150010, 2-583; 9624, LY9, 47561, 150011, 77-1774; 9624, LY9, 47562, 150012, 1-216; 9624, LY9, 47563, 150013, 83-268; 9624, LY9, 47557, 150007, 31-1998; 9624, LY9, 47559, 150009, 115-2040; 9625, LY96, 47564, 150014, 92-574; 9625, LY96, 47565, 150015, 18-410; 9626, LCP1, 47568, 150018, 556-753; 9626, LCP1, 47569, 150019, 82-819; 9626, LCP1, 47566, 150016, 239-2122; 9626, LCP1, 47567, 150017, 390-2273; 9627, LCP2, 47571, 150021, 216-1202; 9627, LCP2, 47572, 150022, 247-666; 9627, LCP2, 47573, 150023, 208-1809; 9627, LCP2, 47570, 150020, 617-2218; 9628, LEXM, 47574, 150024, 55-1299; 9628, LEXM, 47575, 150025, 16-1272; 9629, LAX1, 47576, 150026, 167-1315; 9629, LAX1, 47577, 150027, 391-1587; 9630, LAG3, 47578, 150028, 334-1911; 9630, LAG3, 47579, 150029, 335-1417; 9631, LSP1, 47584, 150034, 63-887; 9631, LSP1, 47585, 150035, 58-582; 9631, LSP1, 47586, 150036, 197-574; 9631, LSP1, 47587, 150037, 216-581; 9631, LSP1, 47588, 150038, 503-682; 9631, LSP1, 47589, 150039, 303-968; 9631, LSP1, 47590, 150040, 224-417; 9631, LSP1, 47591, 150041, 222-887; 9631, LSP1, 47580, 150030, 176-1195; 9631, LSP1, 47581, 150031, 109-1512; 9631, LSP1, 47582, 150032, 448-1281; 9631, LSP1, 47583, 150033, 1303-2136; 9631, LSP1, 47592, 150042, 544-1377; 9632, LEF1, 47597, 150047, 518-1037; 9632, LEF1, 47599, 150049, 22-459; 9632, LEF1, 47600, 150050, 7-408; 9632, LEF1, 47593, 150043, 656-1855; 9632, LEF1, 47594, 150044, 1190-2350; 9632, LEF1, 47595, 150045, 32-1147; 9632, LEF1, 47596, 150046, 1-990; 9632, LEF1, 47598, 150048, 442-1353; 9633, LRMP, 47602, 150052, 1070-2116; 9633, LRMP, 47603, 150053, 506-1846; 9633, LRMP, 47605, 150055, 1071-1426; 9633, LRMP, 47607, 150057, 556-785; 9633, LRMP, 47608, 150058, 1-209; 9633, LRMP, 47609, 150059, 736-759; 9633, LRMP, 47610, 150060, 456-644; 9633, LRMP, 47611, 150061, 1-292; 9633, LRMP, 47612, 150062, 892-1253; 9633, LRMP, 47601, 150051, 830-2329; 9633, LRMP, 47604, 150054, 549-2048; 9633, LRMP, 47606, 150056, 521-2020; 9634, LTA, 47613, 150063, 259-876; 9634, LTA, 47614, 150064, 174-791; 9634, LTA, 47615, 150065, 174-791; 9634, LTA, 47616, 150066, 259-876; 9634, LTA, 47617, 150067, 174-791; 9634, LTA, 47618, 150068, 259-876; 9634, LTA, 47622, 150072, 174-791; 9634, LTA, 47625, 150075, 259-876; 9634, LTA, 47619, 150069, 259-876; 9634, LTA, 47620, 150070, 259-876; 9634, LTA, 47621, 150071, 259-876; 9634, LTA, 47623, 150073, 174-791; 9634, LTA, 47624, 150074, 174-791; 9634, LTA, 47626, 150076, 174-791; 9635, LTB, 47627, 150077, 9-743; 9635, LTB, 47628, 150078, 9-743; 9635, LTB, 47629, 150079, 9-743; 9635, LTB, 47630, 150080, 9-743; 9635, LTB, 47631, 150081, 9-743; 9635, LTB, 47632, 150082, 9-743; 9635, LTB, 47633, 150083, 9-743; 9635, LTB, 47634, 150084, 9-743; 9635, LTB, 47635, 150085, 11-244; 9636, LTBR, 47637, 150087, 190-842; 9636, LTBR, 47638, 150088, 40-486; 9636, LTBR, 47639, 150089, 32-910; 9636, LTBR, 47640, 150090, 428-652; 9636, LTBR, 47636, 150086, 327-1634; 9636, LTBR, 47641, 150091, 128-1378; 9637, LYN, 47642, 150092, 100-550; 9637, LYN, 47643, 150093, 275-1750; 9637, LYN, 47644, 150094, 297-1835; 9638, LYRM1, 47647, 150097, 410-511; 9638, LYRM1, 47650, 150100, 565-666; 9638, LYRM1, 47652, 150102, 278-601; 9638, LYRM1, 47654, 150104, 126-449; 9638, LYRM1, 47645, 150095, 370-738; 9638, LYRM1, 47646, 150096, 401-769; 9638, LYRM1, 47648, 150098, 302-670; 9638, LYRM1, 47649, 150099, 401-769; 9638, LYRM1, 47651, 150101, 342-710; 9638, LYRM1, 47653, 150103, 92-460; 9639, LYRM2, 47655, 150105, 19-252; 9639, LYRM2, 47656, 150106, 34-252; 9639, LYRM2, 47658, 150108, 19-315; 9639, LYRM2, 47659, 150109, 1-297; 9639, LYRM2, 47657, 150107, 38-304; 9640, LYRM4, 47660, 150110, 1-223; 9640, LYRM4, 47661, 150111, 10-132; 9640, LYRM4, 47663, 150113, 10-222; 9640, LYRM4, 47664, 150114, 1-291; 9640, LYRM4, 47665, 150115, 5-397; 9640, LYRM4, 47662, 150112, 207-482; 9641, LYRM5, 47667, 150117, 209-475; 9641, LYRM5, 47668, 150118, 170-436; 9641, LYRM5, 47669, 150119, 121-237; 9641, LYRM5, 47670, 150120, 117-383; 9641, LYRM5, 47671, 150121, 220-345; 9641, LYRM5, 47672, 150122, 213-326; 9641, LYRM5, 47673, 150123, 132-233; 9641, LYRM5, 47674, 150124, 218-484; 9641, LYRM5, 47675, 150125, 105-230; 9641, LYRM5, 47666, 150116, 160-432; 9642, LYRM7, 47677, 150127, 78-239; 9642, LYRM7, 47678, 150128, 33-224; 9642, LYRM7, 47676, 150126, 212-526; 9643, LYRM9, 47681, 150131, 131-391; 9643, LYRM9, 47682, 150132, 86-364; 9643, LYRM9, 47683, 150133, 378-460; 9643, LYRM9, 47684, 150134, 62-322; 9643, LYRM9, 47679, 150129, 86-322; 9643, LYRM9, 47680, 150130, 290-526; 9644, KDM1A, 47687, 150137, 1-905; 9644, KDM1A, 47688, 150138, 1-568; 9644, KDM1A, 47685, 150135, 150-2708; 9644, KDM1A, 47686, 150136, 105-2735; 9645, KDM1B, 47690, 150140, 1-1922; 9645, KDM1B, 47691, 150141, 104-445; 9645, KDM1B, 47689, 150139, 178-1950; 9646, KDM2A, 47692, 150142, 222-3659; 9646, KDM2A, 47693, 150143, 865-3213; 9646, KDM2A, 47694, 150144, 447-3935; 9646, KDM2A, 47695, 150145, 162-2333; 9647, KDM2B, 47698, 150148, 19-1549; 9647, KDM2B, 47699, 150149, 81-544; 9647, KDM2B, 47700, 150150, 390-2504; 9647, KDM2B, 47701, 150151, 44-358; 9647, KDM2B, 47702, 150152, 353-892; 9647, KDM2B, 47703, 150153, 318-689; 9647, KDM2B, 47704, 150154, 236-528; 9647, KDM2B, 47705, 150155, 476-600; 9647, KDM2B, 47706, 150156, 84-460; 9647, KDM2B, 47707, 150157, 61-574; 9647, KDM2B, 47708, 150158, 44-2164; 9647, KDM2B, 47709, 150159, 105-1628; 9647, KDM2B, 47696, 150146, 408-4205; 9647, KDM2B, 47697, 150147, 74-4084; 9647, KDM2B, 47710, 150160, 456-2135; 9648, KDM3A, 47714, 150164, 97-2232; 9648, KDM3A, 47715, 150165, 347-709; 9648, KDM3A, 47716, 150166, 54-565; 9648, KDM3A, 47717, 150167, 328-4311; 9648, KDM3A, 47711, 150161, 328-4293; 9648, KDM3A, 47712, 150162, 59-4024; 9648, KDM3A, 47713, 150163, 366-4331; 9649, KDM3B, 47719, 150169, 1-63; 9649, KDM3B, 47720, 150170, 1-825; 9649, KDM3B, 47718, 150168, 201-5486; 9649, KDM3B, 47721, 150171, 118-2397; 9650, KDM4A, 47722, 150172, 135-3329; 9651, KDM4B, 47723, 150173, 219-3509; 9651, KDM4B, 47725, 150175, 41-3433; 9651, KDM4B, 47726, 150176, 1-1871; 9651, KDM4B, 47727, 150177, 143-504; 9651, KDM4B, 47728, 150178, 227-3619; 9651, KDM4B, 47724, 150174, 208-1554; 9652, KDM4C, 47731, 150181, 568-1023; 9652, KDM4C, 47732, 150182, 1-1064; 9652, KDM4C, 47733, 150183, 581-1702; 9652, KDM4C, 47734, 150184, 190-2421; 9652, KDM4C, 47729, 150179, 566-3709; 9652, KDM4C, 47730, 150180, 566-3736; 9652, KDM4C, 47735, 150185, 79-2520; 9653, KDM4D, 47736, 150186, 833-2404; 9653, KDM4D, 47737, 150187, 596-2167; 9653, KDM4D, 47738, 150188, 201-1772; 9654, KDM4E, 47739, 150189, 301-1821; 9655, KDM5A, 47740, 150190, 156-5324; 9655, KDM5A, 47742, 150192, 191-558; 9655, KDM5A, 47743, 150193, 192-2338; 9655, KDM5A, 47744, 150194, 174-551; 9655, KDM5A, 47745, 150195, 183-575; 9655, KDM5A, 47741, 150191, 364-5436; 9656, KDM5B, 47746, 150196, 594-4418; 9656, KDM5B, 47749, 150199, 1-234; 9656, KDM5B, 47747, 150197, 114-4856; 9656, KDM5B, 47748, 150198, 1166-5800; 9657, KDM5C, 47750, 150200, 310-534; 9657, KDM5C, 47755, 150205, 306-605; 9657, KDM5C, 47756, 150206, 320-481; 9657, KDM5C, 47751, 150201, 534-5207; 9657, KDM5C, 47752, 150202, 534-5084; 9657, KDM5C, 47753, 150203, 534-5216; 9657, KDM5C, 47754, 150204, 288-4967; 9657, KDM5C, 47757, 150207, 534-4673; 9658, KDM5D, 47760, 150210, 1-880; 9658, KDM5D, 47761, 150211, 273-4701; 9658, KDM5D, 47762, 150212, 61-1336; 9658, KDM5D, 47758, 150208, 273-4892; 9658, KDM5D, 47759, 150209, 111-4559; 9658, KDM5D, 47763, 150213, 289-5001; 9659, KDM6A, 47765, 150215, 448-4602; 9659, KDM6A, 47766, 150216, 1-3133; 9659, KDM6A, 47767, 150217, 1-671; 9659, KDM6A, 47768, 150218, 1-2998; 9659, KDM6A, 47769, 150219, 1-484; 9659, KDM6A, 47770, 150220, 448-4446; 9659, KDM6A, 47771, 150221, 448-4257; 9659, KDM6A, 47772, 150222, 1-675; 9659, KDM6A, 47773, 150223, 448-4737; 9659, KDM6A, 47764, 150214, 42-4247; 9660, KDM6B, 47776, 150226, 255-1339; 9660, KDM6B, 47774, 150224, 390-5438; 9660, KDM6B, 47775, 150225, 332-5263; 9661, KDM7A, 47778, 150228, 1-1214; 9661, KDM7A, 47777, 150227, 99-2924; 9662, KDM8, 47781, 150231, 201-560; 9662, KDM8, 47782, 150232, 1-272; 9662, KDM8, 47783, 150233, 95-583; 9662, KDM8, 47779, 150229, 174-1424; 9662, KDM8, 47780, 150230, 119-1483; 9662, KDM8, 47784, 150234, 1-663; 9663, KMT2A, 47786, 150236, 1-1098; 9663, KMT2A, 47787, 150237, 4-4320; 9663, KMT2A, 47788, 150238, 1-481; 9663, KMT2A, 47789, 150239, 1-264; 9663, KMT2A, 47790, 150240, 1-264; 9663, KMT2A, 47791, 150241, 1-804; 9663, KMT2A, 47785, 150235, 1-11910; 9663, KMT2A, 47792, 150242, 24-11942; 9664, KMT2B, 47793, 150243, 1-8148; 9665, KMT2C, 47796, 150246, 1-7324; 9665, KMT2C, 47797, 150247, 1-682; 9665, KMT2C, 47798, 150248, 1-710; 9665, KMT2C, 47799, 150249, 14-479; 9665, KMT2C, 47800, 150250, 1-4575; 9665, KMT2C, 47801, 150251, 220-2699; 9665, KMT2C, 47802, 150252, 1-538; 9665, KMT2C, 47794, 150244, 220-14955; 9665, KMT2C, 47795, 150245, 220-14955; 9666, KMT2D, 47804, 150254, 1-657; 9666, KMT2D, 47805, 150255, 200-636; 9666, KMT2D, 47803, 150253, 1-16614; 9667, KMT2E, 47808, 150258, 1-5337; 9667, KMT2E, 47810, 150260, 1-375; 9667, KMT2E, 47811, 150261, 189-623; 9667, KMT2E, 47813, 150263, 1-65; 9667, KMT2E, 47814, 150264, 445-1500; 9667, KMT2E, 47815, 150265, 405-617; 9667, KMT2E, 47816, 150266, 443-1133; 9667, KMT2E, 47817, 150267, 1-434; 9667, KMT2E, 47818, 150268, 12-1373; 9667, KMT2E, 47806, 150256, 387-5963; 9667, KMT2E, 47807, 150257, 546-6122; 9667, KMT2E, 47809, 150259, 535-3132; 9667, KMT2E, 47812, 150262, 507-2336; 9668, KRCC1, 47819, 150269, 395-1174; 9669, KNOP1, 47821, 150271, 784-1020; 9669, KNOP1, 47822, 150272, 344-757; 9669, KNOP1, 47823, 150273, 1-595; 9669, KNOP1, 47820, 150270, 80-1456; 9670, LYSMD1, 47824, 150274, 662-1345; 9670, LYSMD1, 47825, 150275, 167-706; 9671, LYSMD2, 47828, 150278, 86-412; 9671, LYSMD2, 47826, 150276, 516-1163; 9671, LYSMD2, 47827, 150277, 316-690; 9671, LYSMD2, 47829, 150279, 283-657; 9672, LYSMD3, 47831, 150281, 149-421; 9672, LYSMD3, 47830, 150280, 146-1066; 9672, LYSMD3, 47832, 150282, 210-662; 9672, LYSMD3, 47833, 150283, 149-532; 9673, LYSMD4, 47834, 150284, 613-1125; 9673, LYSMD4, 47836, 150286, 1028-1423; 9673, LYSMD4, 47838, 150288, 190-559; 9673, LYSMD4, 47839, 150289, 2-709; 9673, LYSMD4, 47835, 150285, 274-1167; 9673, LYSMD4, 47837, 150287, 64-954; 9674, LCLAT1, 47843, 150293, 192-560; 9674, LCLAT1, 47844, 150294, 198-658; 9674, LCLAT1, 47845, 150295, 221-536; 9674, LCLAT1, 47846, 150296, 126-537; 9674, LCLAT1, 47847, 150297, 113-584; 9674, LCLAT1, 47848, 150298, 173-373; 9674, LCLAT1, 47849, 150299, 163-583; 9674, LCLAT1, 47850, 150300, 174-582; 9674, LCLAT1, 47840, 150290, 210-1454; 9674, LCLAT1, 47841, 150291, 153-1283; 9674, LCLAT1, 47842, 150292, 203-1129; 9675, LPAR1, 47854, 150304, 474-1019; 9675, LPAR1, 47855, 150305, 350-1390; 9675, LPAR1, 47851, 150301, 349-1443; 9675, LPAR1, 47852, 150302, 256-1350; 9675, LPAR1, 47853, 150303, 385-1479; 9676, LPAR2, 47858, 150308, 405-480; 9676, LPAR2, 47860, 150310, 335-558; 9676, LPAR2, 47861, 150311, 549-609; 9676, LPAR2, 47862, 150312, 345-585; 9676, LPAR2, 47856, 150306, 149-1204; 9676, LPAR2, 47857, 150307, 904-1959; 9676, LPAR2, 47859, 150309, 180-1235; 9677, LPAR3, 47863, 150313, 217-1278; 9677, LPAR3, 47864, 150314, 40-1101; 9678, LPAR4, 47866, 150316, 536-672; 9678, LPAR4, 47865, 150315, 387-1499; 9678, LPAR4, 47867, 150317, 621-1733; 9679, LPAR5, 47868, 150318, 758-1876; 9679, LPAR5, 47869, 150319, 282-1400; 9680, LPAR6, 47870, 150320, 1144-2178; 9680, LPAR6, 47871, 150321, 1626-2660; 9680, LPAR6, 47872, 150322, 800-1834; 9681, LPCAT1, 47875, 150325, 1-1470; 9681, LPCAT1, 47876, 150326, 1-1470; 9681, LPCAT1, 47877, 150327, 1-705; 9681, LPCAT1, 47873, 150323, 134-1738; 9681, LPCAT1, 47874, 150324, 119-1723; 9682, LPCAT2, 47879, 150329, 1-566; 9682, LPCAT2, 47880, 150330, 957-1715; 9682, LPCAT2, 47878, 150328, 185-1819; 9683, LPCAT3, 47882, 150332, 51-245; 9683, LPCAT3, 47883, 150333, 54-1097; 9683, LPCAT3, 47884, 150334, 51-647; 9683, LPCAT3, 47885, 150335, 51-308; 9683, LPCAT3, 47886, 150336, 51-527; 9683, LPCAT3, 47881, 150331, 87-1550; 9684, LPCAT4, 47888, 150338, 1-255; 9684, LPCAT4, 47889, 150339, 463-1518; 9684, LPCAT4, 47887, 150337, 179-1753; 9685, LPGAT1, 47890, 150340, 817-1929; 9685, LPGAT1, 47891, 150341, 228-1340; 9686, LYPLA1, 47894, 150344, 33-209; 9686, LYPLA1, 47895, 150345, 310-580; 9686, LYPLA1, 47896, 150346, 155-746; 9686, LYPLA1, 47897, 150347, 36-344; 9686, LYPLA1, 47898, 150348, 195-785; 9686, LYPLA1, 47899, 150349, 329-829; 9686, LYPLA1, 47892, 150342, 195-887; 9686, LYPLA1, 47893, 150343, 6-650; 9687, LYPLA2, 47900, 150350, 78-572; 9687, LYPLA2, 47901, 150351, 57-599; 9687, LYPLA2, 47902, 150352, 75-623; 9687, LYPLA2, 47903, 150353, 91-504; 9687, LYPLA2, 47905, 150355, 158-429; 9687, LYPLA2, 47906, 150356, 128-614; 9687, LYPLA2, 47904, 150354, 308-1003; 9688, LYPLAL1, 47907, 150357, 17-682; 9688, LYPLAL1, 47908, 150358, 48-761; 9689, LAPTM4A, 47909, 150359, 509-1210; 9690, LAPTM4B, 47912, 150362, 162-618; 9690, LAPTM4B, 47910, 150360, 681-1634; 9690, LAPTM4B, 47911, 150361, 235-915; 9690, LAPTM4B, 47913, 150363, 681-1634; 9691, LAPTM5, 47914, 150364, 76-864; 9692, LYST, 47916, 150366, 180-4328; 9692, LYST, 47917, 150367, 1-542; 9692, LYST, 47915, 150365, 176-11581; 9693, LAMP1, 47918, 150368, 195-1448; 9694, LAMP2, 47922, 150372, 1-776; 9694, LAMP2, 47919, 150369, 138-1370; 9694, LAMP2, 47920, 150370, 138-1370; 9694, LAMP2, 47921, 150371, 197-1432; 9695, LAMP3, 47924, 150374, 119-1297; 9695, LAMP3, 47925, 150375, 296-835; 9695, LAMP3, 47926, 150376, 401-829; 9695, LAMP3, 47923, 150373, 257-1507; 9696, LAMPS, 47927, 150377, 493-1335; 9696, LAMPS, 47928, 150378, 496-1206; 9697, LYZ, 47930, 150380, 26-439; 9697, LYZ, 47931, 150381, 24-338; 9697, LYZ, 47929, 150379, 69-515; 9698, LYG1, 47932, 150382, 251-835; 9698, LYG1, 47933, 150383, 318-902; 9699, LYG2, 47935, 150385, 146-694; 9699, LYG2, 47938, 150388, 174-682; 9699, LYG2, 47934, 150384, 114-752; 9699, LYG2, 47936, 150386, 22-660; 9699, LYG2, 47937, 150387, 22-558; 9699, LYG2, 47939, 150389, 114-650; 9700, LYZL1, 47941, 150391, 1-321; 9700, LYZL1, 47940, 150390, 58-642; 9701, LYZL2, 47942, 150392, 58-642; 9702, LYZL4, 47943, 150393, 277-717; 9702, LYZL4, 47944, 150394, 216-656; 9703, LYZL6, 47945, 150395, 1-260; 9703, LYZL6, 47949, 150399, 1-260; 9703, LYZL6, 47950, 150400, 336-782; 9703, LYZL6, 47946, 150396, 193-639; 9703, LYZL6, 47947, 150397, 193-639; 9703, LYZL6, 47948, 150398, 336-782; 9704, LOX, 47952, 150402, 1-186; 9704, LOX, 47951, 150401, 301-1554; 9705, LOXL1, 47954, 150404, 796-2091; 9705, LOXL1, 47953, 150403, 327-2051; 9706, LOXL2, 47956, 150406, 1-204; 9706, LOXL2, 47957, 150407, 202-975; 9706, LOXL2, 47958, 150408, 1-620; 9706, LOXL2, 47959, 150409, 330-746; 9706, LOXL2, 47960, 150410, 477-763; 9706, LOXL2, 47961, 150411, 239-892; 9706, LOXL2, 47962, 150412, 134-588; 9706, LOXL2, 47963, 150413, 257-559; 9706, LOXL2, 47955, 150405, 371-2695; 9707, LOXL3, 47966, 150416, 99-1859; 9707, LOXL3, 47967, 150417, 451-2544; 9707, LOXL3, 47968, 150418, 14-1429; 9707, LOXL3, 47969, 150419, 92-1001; 9707, LOXL3, 47970, 150420, 1-539; 9707, LOXL3, 47964, 150414, 73-2334; 9707, LOXL3, 47965, 150415, 96-1922; 9708, LOXL4, 47971, 150421, 152-2422; 9709, KARS, 47974, 150424, 82-285; 9709, KARS, 47975, 150425, 1-315; 9709, KARS, 47976, 150426, 106-480; 9709, KARS, 47977, 150427, 13-243; 9709, KARS, 47978, 150428, 1-259; 9709, KARS, 47979, 150429, 227-994; 9709, KARS, 47980, 150430, 563-870; 9709, KARS, 47972, 150422, 41-1834; 9709, KARS, 47973, 150423, 123-2000; 9710, MB21D1, 47981, 150431, 96-1664; 9710, MB21D1, 47982, 150432, 79-1422; 9711, MB21D2, 47983, 150433, 322-1797; 9712, MAB21L1, 47984, 150434, 1072-2151; 9713, MAB21L2, 47985, 150435, 1109-2188; 9714, MAB21L3, 47986, 150436, 266-1354; 9715, MACROD1, 47987, 150437, 68-1045; 9716, MACROD2, 47988, 150438, 396-1673; 9716, MACROD2, 47989, 150439, 63-704; 9716, MACROD2, 47990, 150440, 463-1104; 9716, MACROD2, 47991, 150441, 238-534; 9717, MAEA, 47994, 150444, 24-845; 9717, MAEA, 47995, 150445, 28-1332; 9717, MAEA, 47996, 150446, 24-227; 9717, MAEA, 47997, 150447, 25-348; 9717, MAEA, 47998, 150448, 286-1332; 9717, MAEA, 47999, 150449, 21-344; 9717, MAEA, 48000, 150450, 205-1392; 9717, MAEA, 48001, 150451, 21-570; 9717, MAEA, 48002, 150452, 1-738; 9717, MAEA, 48003, 150453, 205-550; 9717, MAEA, 48004, 150454, 20-1006; 9717, MAEA, 47992, 150442, 24-1091; 9717, MAEA, 47993, 150443, 64-1254; 9718, MPEG1, 48005, 150455, 87-2237; 9719, MIF, 48006, 150456, 472-819; 9719, MIF, 48007, 150457, 472-819; 9720, MARCO, 48009, 150459, 379-569; 9720, MARCO, 48008, 150458, 136-1698; 9721, MSR1, 48014, 150464, 65-1474; 9721, MSR1, 48015, 150465, 160-353; 9721, MSR1, 48016, 150466, 59-172; 9721, MSR1, 48017, 150467, 357-530; 9721, MSR1, 48018, 150468, 1-450; 9721, MSR1, 48010, 150460, 199-1365; 9721, MSR1, 48011, 150461, 123-1478; 9721, MSR1, 48012, 150462, 1-1167; 9721, MSR1, 48013, 150463, 67-1143; 9722, MST1, 48019, 150469, 1-586; 9722, MST1, 48020, 150470, 363-2540; 9723, MST1R, 48023, 150473, 1-854; 9723, MST1R, 48024, 150474, 258-3356; 9723, MST1R, 48025, 150475, 1-810; 9723, MST1R, 48026, 150476, 1-765; 9723, MST1R, 48027, 150477, 265-4149; 9723, MST1R, 48028, 150478, 1-1725; 9723,

MST1R, 48021, 150471, 29-4231; 9723, MST1R, 48022, 150472, 1-4056; 9724, MAD1L1, 48033, 150483, 124-557; 9724, MAD1L1, 48034, 150484, 294-535; 9724, MAD1L1, 48035, 150485, 499-864; 9724, MAD1L1, 48036, 150486, 53-850; 9724, MAD1L1, 48037, 150487, 85-555; 9724, MAD1L1, 48038, 150488, 440-564; 9724, MAD1L1, 48039, 150489, 215-831; 9724, MAD1L1, 48040, 150490, 112-750; 9724, MAD1L1, 48041, 150491, 243-839; 9724, MAD1L1, 48029, 150479, 286-2442; 9724, MAD1L1, 48030, 150480, 330-2486; 9724, MAD1L1, 48031, 150481, 199-2079; 9724, MAD1L1, 48032, 150482, 559-2715; 9725, MAD2L1, 48044, 150494, 125-250; 9725, MAD2L1, 48042, 150492, 341-958; 9725, MAD2L1, 48043, 150493, 100-372; 9726, MAD2L2, 48047, 150497, 93-767; 9726, MAD2L2, 48048, 150498, 78-752; 9726, MAD2L2, 48050, 150500, 531-1032; 9726, MAD2L2, 48051, 150501, 86-678; 9726, MAD2L2, 48045, 150495, 930-1565; 9726, MAD2L2, 48046, 150496, 210-845; 9726, MAD2L2, 48049, 150499, 189-824; 9727, MAD2L1BP, 48052, 150502, 58-882; 9727, MAD2L1BP, 48053, 150503, 211-1131; 9728, MAEL, 48056, 150506, 66-1013; 9728, MAEL, 48057, 150507, 206-1342; 9728, MAEL, 48054, 150504, 265-1476; 9728, MAEL, 48055, 150505, 245-1549; 9729, MRO, 48064, 150514, 105-437; 9729, MRO, 48065, 150515, 122-265; 9729, MRO, 48066, 150516, 261-797; 9729, MRO, 48058, 150508, 203-949; 9729, MRO, 48059, 150509, 159-905; 9729, MRO, 48060, 150510, 150-782; 9729, MRO, 48061, 150511, 150-938; 9729, MRO, 48062, 150512, 260-1006; 9729, MRO, 48063, 150513, 77-667; 9729, MRO, 48067, 150517, 295-1041; 9730, MROH1, 48071, 150521, 125-5023; 9730, MROH1, 48068, 150518, 58-4983; 9730, MROH1, 48069, 150519, 98-1366; 9730, MROH1, 48070, 150520, 122-5047; 9730, MROH1, 48072, 150522, 1610-3457; 9731, MROH2A, 48074, 150524, 49-254; 9731, MROH2A, 48075, 150525, 47-252; 9731, MROH2A, 48076, 150526, 118-146; 9731, MROH2A, 48077, 150527, 94-5160; 9731, MROH2A, 48073, 150523, 167-5191; 9732, MROH2B, 48079, 150529, 292-3714; 9732, MROH2B, 48078, 150528, 452-5209; 9733, MROH5, 48080, 150530, 82-201; 9733, MROH5, 48081, 150531, 82-201; 9733, MROH5, 48082, 150532, 284-613; 9733, MROH5, 48083, 150533, 82-4038; 9733, MROH5, 48084, 150534, 82-4035; 9733, MROH5, 48085, 150535, 1-1480; 9734, MROH6, 48087, 150537, 700-852; 9734, MROH6, 48088, 150538, 722-874; 9734, MROH6, 48089, 150539, 601-753; 9734, MROH6, 48090, 150540, 553-572; 9734, MROH6, 48091, 150541, 35-1680; 9734, MROH6, 48093, 150543, 35-1680; 9734, MROH6, 48086, 150536, 258-2417; 9734, MROH6, 48092, 150542, 258-2417; 9735, MROH7, 48094, 150544, 325-3459; 9735, MROH7, 48096, 150546, 227-2902; 9735, MROH7, 48100, 150550, 137-349; 9735, MROH7, 48101, 150551, 278-2542; 9735, MROH7, 48095, 150545, 257-3349; 9735, MROH7, 48097, 150547, 114-1997; 9735, MROH7, 48098, 150548, 822-2705; 9735, MROH7, 48099, 150549, 286-4257; 9735, MROH7, 48102, 150552, 37-1920; 9736, MROH8, 48103, 150553, 1-3209; 9736, MROH8, 48104, 150554, 1-1889; 9736, MROH8, 48105, 150555, 1-2841; 9736, MROH8, 48106, 150556, 428-531; 9736, MROH8, 48107, 150557, 602-675; 9736, MROH8, 48109, 150559, 1-2011; 9736, MROH8, 48108, 150558, 1-1801; 9737, MROH9, 48112, 150562, 1-562; 9737, MROH9, 48110, 150560, 100-1821; 9737, MROH9, 48111, 150561, 155-2740; 9738, MAF1, 48114, 150564, 528-737; 9738, MAF1, 48115, 150565, 392-1252; 9738, MAF1, 48116, 150566, 112-868; 9738, MAF1, 48117, 150567, 1-495; 9738, MAF1, 48113, 150563, 405-1175; 9738, MAF1, 48118, 150568, 220-990; 9739, N/A, 48119, 150569, 1748-2122; 9740, MAGIX, 48120, 150570, 124-553; 9740, MAGIX, 48121, 150571, 1-1005; 9740, MAGIX, 48122, 150572, 48-824; 9740, MAGIX, 48123, 150573, 271-393; 9740, MAGIX, 48124, 150574, 384-1211; 9740, MAGIX, 48125, 150575, 736-1524; 9740, MAGIX, 48126, 150576, 17-778; 9741, MAGT1, 48127, 150577, 88-1191; 9741, MAGT1, 48129, 150579, 63-1166; 9741, MAGT1, 48128, 150578, 31-435; 9741, MAGT1, 48130, 150580, 22-1029; 9742, MDP1, 48131, 150581, 113-643; 9742, MDP1, 48132, 150582, 111-479; 9743, MAGOHB, 48134, 150584, 96-404; 9743, MAGOHB, 48135, 150585, 63-335; 9743, MAGOHB, 48136, 150586, 42-287; 9743, MAGOHB, 48137, 150587, 96-230; 9743, MAGOHB, 48138, 150588, 78-323; 9743, MAGOHB, 48139, 150589, 69-314; 9743, MAGOHB, 48140, 150590, 74-319; 9743, MAGOHB, 48133, 150583, 92-538; 9744, MAGOH, 48141, 150591, 52-381; 9744, MAGOH, 48142, 150592, 163-603; 9745, MGRN1, 48146, 150596, 120-1082; 9745, MGRN1, 48147, 150597, 1-994; 9745, MGRN1, 48148, 150598, 1-498; 9745, MGRN1, 48150, 150600, 116-1898; 9745, MGRN1, 48151, 150601, 110-556; 9745, MGRN1, 48143, 150593, 172-1902; 9745, MGRN1, 48144, 150594, 94-1752; 9745, MGRN1, 48145, 150595, 138-1730; 9745, MGRN1, 48149, 150599, 1-1593; 9745, MGRN1, 48152, 150602, 1-1665; 9746, MFSD1, 48156, 150606, 1-581; 9746, MFSD1, 48157, 150607, 217-566; 9746, MFSD1, 48159, 150609, 530-639; 9746, MFSD1, 48160, 150610, 1-384; 9746, MFSD1, 48161, 150611, 17-253; 9746, MFSD1, 48163, 150613, 108-592; 9746, MFSD1, 48164, 150614, 58-312; 9746, MFSD1, 48165, 150615, 1-195; 9746, MFSD1, 48153, 150603, 63-1460; 9746, MFSD1, 48154, 150604, 81-1508; 9746, MFSD1, 48155, 150605, 142-1686; 9746, MFSD1, 48158, 150608, 103-339; 9746, MFSD1, 48162, 150612, 97-333; 9746, MFSD1, 48166, 150616, 81-1625; 9747, MFSD10, 48169, 150619, 88-1188; 9747, MFSD10, 48170, 150620, 70-798; 9747, MFSD10, 48171, 150621, 69-1139; 9747, MFSD10, 48172, 150622, 25-1467; 9747, MFSD10, 48173, 150623, 75-377; 9747, MFSD10, 48167, 150617, 536-1903; 9747, MFSD10, 48168, 150618, 113-1480; 9748, MFSD11, 48177, 150627, 392-577; 9748, MFSD11, 48178, 150628, 142-486; 9748, MFSD11, 48179, 150629, 1-354; 9748, MFSD11, 48182, 150632, 311-436; 9748, MFSD11, 48183, 150633, 967-1092; 9748, MFSD11, 48184, 150634, 70-405; 9748, MFSD11, 48186, 150636, 1-634; 9748, MFSD11, 48187, 150637, 1-387; 9748, MFSD11, 48188, 150638, 559-898; 9748, MFSD11, 48174, 150624, 255-1604; 9748, MFSD11, 48175, 150625, 737-1930; 9748, MFSD11, 48176, 150626, 2043-3392; 9748, MFSD11, 48180, 150630, 1138-2487; 9748, MFSD11, 48181, 150631, 354-1547; 9748, MFSD11, 48185, 150635, 167-1516; 9748, MFSD11, 48189, 150639, 599-1948; 9749, MFSD12, 48192, 150642, 1-527; 9749, MFSD12, 48193, 150643, 1-777; 9749, MFSD12, 48194, 150644, 268-483; 9749, MFSD12, 48195, 150645, 46-486; 9749, MFSD12, 48197, 150647, 1-543; 9749, MFSD12, 48198, 150648, 31-192; 9749, MFSD12, 48199, 150649, 1-492; 9749, MFSD12, 48200, 150650, 253-684; 9749, MFSD12, 48190, 150640, 171-1613; 9749, MFSD12, 48191, 150641, 161-1576; 9749, MFSD12, 48196, 150646, 161-1576; 9750, MFSD2A, 48203, 150653, 390-1514; 9750, MFSD2A, 48204, 150654, 148-946; 9750, MFSD2A, 48201, 150651, 144-1775; 9750, MFSD2A, 48202, 150652, 164-1756; 9751, MFSD2B, 48205, 150655, 1-1515; 9751, MFSD2B, 48207, 150657, 1-135; 9751, MFSD2B, 48206, 150656, 17-1510; 9752, MFSD3, 48208, 150658, 261-1499; 9753, MFSD4, 48210, 150660, 121-1500; 9753, MFSD4, 48211, 150661, 87-1409; 9753,

MFSD4, 48212, 150662, 50-1135; 9753, MFSD4, 48213, 150663, 100-477; 9753, MFSD4, 48214, 150664, 186-452; 9753, MFSD4, 48215, 150665, 180-542; 9753, MFSD4, 48209, 150659, 94-1638; 9754, MFSD5, 48218, 150668, 81-1318; 9754, MFSD5, 48216, 150666, 192-1544; 9754, MFSD5, 48217, 150667, 148-1821; 9755, MFSD6, 48221, 150671, 1-814; 9755, MFSD6, 48222, 150672, 391-517; 9755, MFSD6, 48223, 150673, 203-546; 9755, MFSD6, 48224, 150674, 83-551; 9755, MFSD6, 48225, 150675, 1-275; 9755, MFSD6, 48226, 150676, 240-777; 9755, MFSD6, 48219, 150669, 136-2511; 9755, MFSD6, 48220, 150670, 325-2700; 9756, MFSD6L, 48227, 150677, 230-1990; 9757, MFSD7, 48231, 150681, 65-1456; 9757, MFSD7, 48232, 150682, 288-938; 9757, MFSD7, 48233, 150683, 57-653; 9757, MFSD7, 48234, 150684, 89-1351; 9757, MFSD7, 48228, 150678, 145-1470; 9757, MFSD7, 48229, 150679, 315-1994; 9757, MFSD7, 48230, 150680, 17-1699; 9758, MFSD8, 48237, 150687, 141-1562; 9758, MFSD8, 48235, 150685, 129-1685; 9758, MFSD8, 48236, 150686, 116-577; 9759, MFSD9, 48239, 150689, 69-347; 9759, MFSD9, 48240, 150690, 79-279; 9759, MFSD9, 48241, 150691, 69-347; 9759, MFSD9, 48242, 150692, 1-240; 9759, MFSD9, 48243, 150693, 69-365; 9759, MFSD9, 48238, 150688, 45-1469; 9760, HLA-A, 48244, 150694, 6-905; 9760, HLA-A, 48245, 150695, 310-1425; 9760, HLA-A, 48247, 150697, 6-905; 9760, HLA-A, 48249, 150699, 310-1425; 9760, HLA-A, 48251, 150701, 310-1425; 9760, HLA-A, 48252, 150702, 310-1425; 9760, HLA-A, 48253, 150703, 1-898; 9760, HLA-A, 48254, 150704, 6-905; 9760, HLA-A, 48255, 150705, 6-905; 9760, HLA-A, 48256, 150706, 6-905; 9760, HLA-A, 48257, 150707, 6-905; 9760, HLA-A, 48258, 150708, 6-905; 9760, HLA-A, 48259, 150709, 310-1425; 9760, HLA-A, 48261, 150711, 1-1096; 9760, HLA-A, 48266, 150716, 1-1114; 9760, HLA-A, 48267, 150717, 310-1338; 9760, HLA-A, 48273, 150723, 1-1185; 9760, HLA-A, 48275, 150725, 1-1185; 9760, HLA-A, 48276, 150726, 85-1182; 9760, HLA-A, 48277, 150727, 85-1065; 9760, HLA-A, 48278, 150728, 144-1160; 9760, HLA-A, 48279, 150729, 1-1185; 9760, HLA-A, 48260, 150710, 342-1439; 9760, HLA-A, 48270, 150720, 85-1182; 9760, HLA-A, 48272, 150722, 85-1182; 9760, HLA-A, 48246, 150696, 85-1182; 9760, HLA-A, 48250, 150700, 342-1439; 9760, HLA-A, 48274, 150724, 85-1182; 9760, HLA-A, 48248, 150698, 342-1439; 9760, HLA-A, 48262, 150712, 339-1436; 9760, HLA-A, 48263, 150713, 339-1436; 9760, HLA-A, 48268, 150718, 85-1182; 9760, HLA-A, 48269, 150719, 85-1182; 9760, HLA-A, 48265, 150715, 342-1439; 9760, HLA-A, 48271, 150721, 85-1182; 9760, HLA-A, 48264, 150714, 342-1439; 9761, HLA-B, 48282, 150732, 1-725; 9761, HLA-B, 48283, 150733, 127-864; 9761, HLA-B, 48284, 150734, 1-738; 9761, HLA-B, 48285, 150735, 1-725; 9761, HLA-B, 48287, 150737, 126-863; 9761, HLA-B, 48289, 150739, 1-725; 9761, HLA-B, 48290, 150740, 1-725; 9761, HLA-B, 48293, 150743, 126-863; 9761, HLA-B, 48294, 150744, 1-725; 9761, HLA-B, 48295, 150745, 83-820; 9761, HLA-B, 48296, 150746, 3-677; 9761, HLA-B, 48297, 150747, 3-677; 9761, HLA-B, 48298, 150748, 3-677; 9761, HLA-B, 48299, 150749, 3-677; 9761, HLA-B, 48300, 150750, 3-677; 9761, HLA-B, 48286, 150736, 30-1118; 9761, HLA-B, 48288, 150738, 88-1176; 9761, HLA-B, 48291, 150741, 88-1176; 9761, HLA-B, 48281, 150731, 88-1176; 9761, HLA-B, 48280, 150730, 44-1132; 9761, HLA-B, 48292, 150742, 72-1160; 9762, HLA-C, 48302, 150752, 35-430; 9762, HLA-C, 48303, 150753, 16-1134; 9762, HLA-C, 48304, 150754, 16-1134; 9762, HLA-C, 48305, 150755, 16-1209; 9762, HLA-C, 48306, 150756, 16-1134; 9762, HLA-C, 48309, 150759, 16-1209; 9762, HLA-C, 48310, 150760, 16-1134; 9762, HLA-C, 48311, 150761, 23-1129; 9762, HLA-C, 48312, 150762, 16-1209; 9762, HLA-C, 48314, 150764, 23-1042; 9762, HLA-C, 48315, 150765, 1-782; 9762, HLA-C, 48317, 150767, 23-1129; 9762, HLA-C, 48318, 150768, 16-1209; 9762, HLA-C, 48319, 150769, 23-1129; 9762, HLA-C, 48320, 150770, 1-782; 9762, HLA-C, 48321, 150771, 20-1126; 9762, HLA-C, 48322, 150772, 16-1134; 9762, HLA-C, 48323, 150773, 16-1134; 9762, HLA-C, 48324, 150774, 1-782; 9762, HLA-C, 48325, 150775, 16-1134; 9762, HLA-C, 48326, 150776, 1-782; 9762, HLA-C, 48328, 150778, 1-782; 9762, HLA-C, 48329, 150779, 1-782; 9762, HLA-C, 48330, 150780, 1-782; 9762, HLA-C, 48331, 150781, 23-1129; 9762, HLA-C, 48332, 150782, 16-1209; 9762, HLA-C, 48333, 150783, 60-1160; 9762, HLA-C, 48334, 150784, 16-1083; 9762, HLA-C, 48335, 150785, 35-430; 9762, HLA-C, 48336, 150786, 35-430; 9762, HLA-C, 48337, 150787, 35-430; 9762, HLA-C, 48338, 150788, 35-430; 9762, HLA-C, 48339, 150789, 3-677; 9762, HLA-C, 48340, 150790, 35-430; 9762, HLA-C, 48341, 150791, 3-677; 9762, HLA-C, 48342, 150792, 35-430; 9762, HLA-C, 48343, 150793, 1-147; 9762, HLA-C, 48344, 150794, 1-147; 9762, HLA-C, 48345, 150795, 1-147; 9762, HLA-C, 48313, 150763, 60-1160; 9762, HLA-C, 48301, 150751, 16-1116; 9762, HLA-C, 48316, 150766, 60-1160; 9762, HLA-C, 48327, 150777, 60-1160; 9762, HLA-C, 48307, 150757, 81-1181; 9762, HLA-C, 48308, 150758, 60-1160; 9763, HLA-E, 48346, 150796, 66-1142; 9763, HLA-E, 48350, 150800, 66-1142; 9763, HLA-E, 48351, 150801, 66-1142; 9763, HLA-E, 48347, 150797, 66-1142; 9763, HLA-E, 48348, 150798, 66-1142; 9763, HLA-E, 48349, 150799, 66-1142; 9763, HLA-E, 48352, 150802, 66-1142; 9764, HLA-F, 48355, 150805, 385-1425; 9764, HLA-F, 48357, 150807, 57-1059; 9764, HLA-F, 48361, 150811, 57-1385; 9764, HLA-F, 48362, 150812, 385-1425; 9764, HLA-F, 48363, 150813, 57-1385; 9764, HLA-F, 48364, 150814, 57-1385; 9764, HLA-F, 48365, 150815, 186-578; 9764, HLA-F, 48366, 150816, 186-578; 9764, HLA-F, 48367, 150817, 1-677; 9764, HLA-F, 48368, 150818, 1-374; 9764, HLA-F, 48370, 150820, 385-1425; 9764, HLA-F, 48371, 150821, 186-578; 9764, HLA-F, 48373, 150823, 57-1385; 9764, HLA-F, 48374, 150824, 1-677; 9764, HLA-F, 48375, 150825, 1-374; 9764, HLA-F, 48376, 150826, 1-374; 9764, HLA-F, 48378, 150828, 1-677; 9764, HLA-F, 48379, 150829, 1-30; 9764, HLA-F, 48380, 150830, 345-1385; 9764, HLA-F, 48381, 150831, 1-374; 9764, HLA-F, 48382, 150832, 186-578; 9764, HLA-F, 48383, 150833, 1-727; 9764, HLA-F, 48384, 150834, 186-578; 9764, HLA-F, 48385, 150835, 385-1425; 9764, HLA-F, 48386, 150836, 186-578; 9764, HLA-F, 48387, 150837, 1-374; 9764, HLA-F, 48388, 150838, 406-1408; 9764, HLA-F, 48389, 150839, 1-677; 9764, HLA-F, 48390, 150840, 57-1385; 9764, HLA-F, 48391, 150841, 1-374; 9764, HLA-F, 48392, 150842, 1-677; 9764, HLA-F, 48393, 150843, 1-639; 9764, HLA-F, 48394, 150844, 125-1165; 9764, HLA-F, 48395, 150845, 125-1165; 9764, HLA-F, 48396, 150846, 125-1165; 9764, HLA-F, 48397, 150847, 125-1165; 9764, HLA-F, 48398, 150848, 125-1165; 9764, HLA-F, 48399, 150849, 1-1017; 9764, HLA-F, 48400, 150850, 1-762; 9764, HLA-F, 48401, 150851, 1-1038; 9764, HLA-F, 48402, 150852, 1-217; 9764, HLA-F, 48403, 150853, 1-432; 9764, HLA-F, 48353, 150803, 186-1514; 9764, HLA-F, 48354, 150804, 125-1165; 9764, HLA-F, 48356, 150806, 1-765; 9764, HLA-F, 48358, 150808, 1-765; 9764, HLA-F, 48359, 150809, 385-1425; 9764, HLA-F, 48360, 150810, 1-765; 9764, HLA-F, 48369, 150819, 1-765; 9764, HLA-F, 48372, 150822, 1-765; 9764, HLA-F, 48377, 150827, 1-765; 9765, HLA-G, 48405, 150855, 1-465; 9765, HLA-G, 48406, 150856, 1-741; 9765, HLA-G, 48407, 150857, 73-1104; 9765, HLA-G, 48409, 150859, 1-465; 9765, HLA-G, 48410, 150860, 1-741; 9765, HLA-G, 48411, 150861, 73-1104; 9765, HLA-G, 48412, 150862, 73-1104; 9765, HLA-G, 48413, 150863, 73-1104; 9765, HLA-G, 48416, 150866, 1-465; 9765, HLA-G, 48417, 150867, 1-741; 9765, HLA-G, 48418, 150868, 1-741; 9765, HLA-G, 48419, 150869, 73-1104; 9765, HLA-G, 48420, 150870, 1-741; 9765, HLA-G, 48421, 150871, 73-1104; 9765, HLA-G, 48422, 150872, 1-741; 9765, HLA-G, 48424, 150874, 1-465; 9765, HLA-G, 48426, 150876, 1-741; 9765, HLA-G, 48428, 150878, 73-1104; 9765, HLA-G, 48429, 150879, 1-465; 9765, HLA-G, 48431, 150881, 1-465; 9765, HLA-G, 48432, 150882, 1-741; 9765, HLA-G, 48433, 150883, 1-465; 9765, HLA-G, 48434, 150884, 1-741; 9765, HLA-G, 48435, 150885, 1-741; 9765, HLA-G, 48436, 150886, 1-741; 9765, HLA-G, 48437, 150887, 1-741; 9765, HLA-G, 48438, 150888, 1-741; 9765, HLA-G, 48439, 150889, 1-741; 9765, HLA-G, 48446, 150896, 1-741; 9765, HLA-G, 48447, 150897, 179-1195; 9765, HLA-G, 48448, 150898, 1-465; 9765, HLA-G, 48449, 150899, 25-1041; 9765, HLA-G, 48450, 150900, 1-741; 9765, HLA-G, 48451, 150901, 73-1104; 9765, HLA-G, 48404, 150854, 25-1041; 9765, HLA-G, 48408, 150858, 25-1041; 9765, HLA-G, 48414, 150864, 25-1041; 9765, HLA-G, 48415, 150865, 25-1041; 9765, HLA-G, 48423, 150873, 25-1041; 9765, HLA-G, 48425, 150875, 25-1041; 9765, HLA-G, 48427, 150877, 25-1041; 9765, HLA-G, 48430, 150880, 179-1195; 9765, HLA-G, 48440, 150890, 179-1195; 9765, HLA-G, 48441, 150891, 179-1195; 9765, HLA-G, 48442, 150892, 179-1195; 9765, HLA-G, 48443, 150893, 179-1195; 9765, HLA-G, 48444, 150894, 179-1195; 9765, HLA-G, 48445, 150895, 179-1195; 9766, HLA-DMA, 48453, 150903, 73-756; 9766, HLA-DMA, 48454, 150904, 26-526; 9766, HLA-DMA, 48456, 150906, 73-756; 9766, HLA-DMA, 48457, 150907, 26-526; 9766, HLA-DMA, 48458, 150908, 73-756; 9766, HLA-DMA, 48459, 150909, 26-526; 9766, HLA-DMA, 48461, 150911, 73-756; 9766, HLA-DMA, 48462, 150912, 105-611; 9766, HLA-DMA, 48464, 150914, 105-611; 9766, HLA-DMA, 48465, 150915, 105-611; 9766, HLA-DMA, 48466, 150916, 73-756; 9766, HLA-DMA, 48467, 150917, 26-526; 9766, HLA-DMA, 48468, 150918, 26-526; 9766, HLA-DMA, 48469, 150919, 12-518; 9766, HLA-DMA, 48470, 150920, 12-518; 9766, HLA-DMA, 48471, 150921, 73-756; 9766, HLA-DMA, 48472, 150922, 105-611; 9766, HLA-DMA, 48473, 150923, 87-872; 9766, HLA-DMA, 48475, 150925, 26-526; 9766, HLA-DMA, 48476, 150926, 1-871; 9766, HLA-DMA, 48478, 150928, 105-611; 9766, HLA-DMA, 48479, 150929, 105-611; 9766, HLA-DMA, 48480, 150930, 1-871; 9766, HLA-DMA, 48481, 150931, 1-871; 9766, HLA-DMA, 48482, 150932, 1-871; 9766, HLA-DMA, 48483, 150933, 26-526; 9766, HLA-DMA, 48485, 150935, 1-871; 9766, HLA-DMA, 48486, 150936, 73-756; 9766, HLA-DMA, 48487, 150937, 148-871; 9766, HLA-DMA, 48488, 150938, 73-756; 9766, HLA-DMA, 48489, 150939, 1-871; 9766, HLA-DMA, 48490, 150940, 26-526; 9766, HLA-DMA, 48491, 150941, 1-871; 9766, HLA-DMA, 48452, 150902, 87-872; 9766, HLA-DMA, 48455, 150905, 87-872; 9766, HLA-DMA, 48460, 150910, 87-872; 9766, HLA-DMA, 48463, 150913, 87-872; 9766, HLA-DMA, 48474, 150924, 87-872; 9766, HLA-DMA, 48477, 150927, 87-872; 9766, HLA-DMA, 48484, 150934, 87-872; 9767, HLA-DMB, 48494, 150944, 87-612; 9767, HLA-DMB, 48495, 150945, 1-321; 9767, HLA-DMB, 48496, 150946, 1-321; 9767, HLA-DMB, 48497, 150947, 1-321; 9767, HLA-DMB, 48498, 150948, 1-424; 9767, HLA-DMB, 48500, 150950, 1-424; 9767, HLA-DMB, 48501, 150951, 215-988; 9767, HLA-DMB, 48502, 150952, 215-988; 9767, HLA-DMB, 48503, 150953, 215-988; 9767, HLA-DMB, 48504, 150954, 1-424; 9767, HLA-DMB, 48505, 150955, 87-612; 9767, HLA-DMB, 48507, 150957, 215-988; 9767, HLA-DMB, 48508, 150958, 1-424; 9767, HLA-DMB, 48509, 150959, 1-424; 9767, HLA-DMB, 48510, 150960, 1-424; 9767, HLA-DMB, 48511, 150961, 1-321; 9767, HLA-DMB, 48512, 150962, 215-988; 9767, HLA-DMB, 48513, 150963, 87-612; 9767, HLA-DMB, 48514, 150964, 1-321; 9767, HLA-DMB, 48515, 150965, 1-321; 9767, HLA-DMB, 48516, 150966, 1-321; 9767, HLA-DMB, 48518, 150968, 1-424; 9767, HLA-DMB, 48519, 150969, 87-612; 9767, HLA-DMB, 48520, 150970, 1-321; 9767, HLA-DMB, 48521, 150971, 87-612; 9767, HLA-DMB, 48522, 150972, 1-424; 9767, HLA-DMB, 48524, 150974, 87-612; 9767, HLA-DMB, 48525, 150975, 215-988; 9767, HLA-DMB, 48527, 150977, 87-612; 9767, HLA-DMB, 48529, 150979, 215-988; 9767, HLA-DMB, 48492, 150942, 264-1055; 9767, HLA-DMB, 48493, 150943, 264-1055; 9767, HLA-DMB, 48499, 150949, 264-1055; 9767, HLA-DMB, 48506, 150956, 264-1055; 9767, HLA-DMB, 48517, 150967, 264-1055; 9767, HLA-DMB, 48523, 150973, 264-1055; 9767, HLA-DMB, 48526, 150976, 264-1055; 9767, HLA-DMB, 48528, 150978, 264-1055; 9768, HLA-DOA, 48531, 150981, 44-303; 9768, HLA-DOA, 48532, 150982, 44-303; 9768, HLA-DOA, 48538, 150988, 44-303; 9768, HLA-DOA, 48539, 150989, 44-303; 9768, HLA-DOA, 48540, 150990, 44-303; 9768, HLA-DOA, 48541, 150991, 25-210; 9768, HLA-DOA, 48542, 150992, 44-303; 9768, HLA-DOA, 48543, 150993, 44-303; 9768, HLA-DOA, 48545, 150995, 25-210; 9768, HLA-DOA, 48546, 150996, 25-210; 9768, HLA-DOA, 48547, 150997, 25-210; 9768, HLA-DOA, 48548, 150998, 25-210; 9768, HLA-DOA, 48549, 150999, 25-210; 9768, HLA-DOA, 48550, 151000, 25-210; 9768, HLA-DOA, 48530, 150980, 77-829; 9768, HLA-DOA, 48533, 150983, 77-829; 9768, HLA-DOA, 48534, 150984, 77-829; 9768, HLA-DOA, 48535, 150985, 77-829; 9768, HLA-DOA, 48536, 150986, 77-829; 9768, HLA-DOA, 48537, 150987, 77-829; 9768, HLA-DOA, 48544, 150994, 77-829; 9769, HLA-DOB, 48552, 151002, 1-543; 9769, HLA-DOB, 48553, 151003, 1-543; 9769, HLA-DOB, 48555, 151005, 1-543; 9769, HLA-DOB, 48558, 151008, 1-543; 9769, HLA-DOB, 48560, 151010, 1-543; 9769, HLA-DOB, 48562, 151012, 1-543; 9769, HLA-DOB, 48563, 151013, 1-735; 9769, HLA-DOB, 48564, 151014, 26-142; 9769, HLA-DOB, 48565, 151015, 26-142; 9769, HLA-DOB, 48566, 151016, 26-142; 9769, HLA-DOB, 48567, 151017, 26-142; 9769, HLA-DOB, 48568, 151018, 26-142; 9769, HLA-DOB, 48569, 151019, 86-547; 9769, HLA-DOB, 48551, 151001, 98-919; 9769, HLA-DOB, 48554, 151004, 98-919; 9769, HLA-DOB, 48556, 151006, 98-919; 9769, HLA-DOB, 48557, 151007, 98-919; 9769, HLA-DOB, 48559, 151009, 98-919; 9769, HLA-DOB, 48561, 151011, 98-919; 9770, HLA-DPA1, 48572, 151022, 68-703; 9770, HLA-DPA1, 48573, 151023, 68-703; 9770, HLA-DPA1, 48574, 151024, 291-918; 9770, HLA-DPA1, 48575, 151025, 68-703; 9770, HLA-DPA1, 48576, 151026, 291-918; 9770, HLA-DPA1, 48577, 151027, 237-305; 9770, HLA-DPA1, 48578, 151028, 1-385; 9770, HLA-DPA1, 48579, 151029, 1-385; 9770, HLA-DPA1, 48581, 151031, 1-385; 9770, HLA-DPA1, 48582, 151032, 68-703; 9770, HLA-DPA1, 48583, 151033, 237-305; 9770, HLA-DPA1, 48584, 151034, 1-385; 9770, HLA-DPA1, 48586, 151036, 1-385; 9770, HLA-DPA1, 48588, 151038, 237-305; 9770, HLA-DPA1, 48589, 151039, 291-918; 9770, HLA-DPA1, 48590, 151040, 291-918; 9770, HLA-DPA1, 48591, 151041, 291-918; 9770, HLA-DPA1, 48592, 151042, 237-305; 9770, HLA-DPA1, 48593, 151043, 1-385; 9770, HLA-DPA1, 48594, 151044, 1-385; 9770, HLA-DPA1, 48595, 151045, 68-703; 9770, HLA-DPA1, 48596, 151046, 1-385; 9770, HLA-DPA1, 48599, 151049, 237-305; 9770, HLA-DPA1, 48600, 151050, 237-305; 9770, HLA-DPA1, 48601, 151051, 291-918; 9770, HLA-DPA1, 48602, 151052, 291-918; 9770, HLA-DPA1, 48603, 151053, 68-703; 9770, HLA-DPA1, 48604, 151054, 237-305; 9770, HLA-DPA1, 48605, 151055, 237-305; 9770, HLA-DPA1, 48606, 151056, 68-703; 9770, HLA-DPA1, 48607, 151057, 291-918; 9770, HLA-DPA1, 48570, 151020, 131-913; 9770, HLA-DPA1, 48571, 151021, 131-913; 9770, HLA-DPA1, 48580, 151030, 131-913; 9770, HLA-DPA1, 48585, 151035, 131-913; 9770, HLA-DPA1, 48587, 151037, 131-913; 9770, HLA-DPA1, 48597, 151047, 53-835; 9770, HLA-DPA1, 48598, 151048, 131-913; 9770, HLA-DPA1, 48608, 151058, 131-913; 9770, HLA-DPA1, 48609, 151059, 199-981; 9771, HLA-DPB1, 48610, 151060, 117-893; 9771, HLA-DPB1, 48611, 151061, 71-757; 9771, HLA-DPB1, 48613, 151063, 1-688; 9771, HLA-DPB1, 48614, 151064, 71-757; 9771, HLA-DPB1, 48615, 151065, 1-688; 9771, HLA-DPB1, 48617, 151067, 1-707; 9771, HLA-DPB1, 48618, 151068, 1-707; 9771, HLA-DPB1, 48619, 151069, 1-688; 9771, HLA-DPB1, 48620, 151070, 1-688; 9771, HLA-DPB1, 48621, 151071, 71-757; 9771, HLA-DPB1, 48623, 151073, 1-688; 9771, HLA-DPB1, 48624, 151074, 71-757; 9771, HLA-DPB1, 48625, 151075, 117-893; 9771, HLA-DPB1, 48626, 151076, 1-707; 9771, HLA-DPB1, 48627, 151077, 1-688; 9771, HLA-DPB1, 48628, 151078, 71-757; 9771, HLA-DPB1, 48629, 151079, 1-707; 9771, HLA-DPB1, 48632, 151082, 1-707; 9771, HLA-DPB1, 48633, 151083, 1-688; 9771, HLA-DPB1, 48634, 151084, 1-707; 9771, HLA-DPB1, 48635, 151085, 71-757; 9771, HLA-DPB1, 48636, 151086, 1-688; 9771, HLA-DPB1, 48637, 151087, 71-757; 9771, HLA-DPB1, 48639, 151089, 1-707; 9771, HLA-DPB1, 48640, 151090, 1-707; 9771, HLA-DPB1, 48612, 151062, 117-893; 9771, HLA-DPB1, 48616, 151066, 117-893; 9771, HLA-DPB1, 48622, 151072, 117-893; 9771, HLA-DPB1, 48630, 151080, 117-893; 9771, HLA-DPB1, 48631, 151081, 117-893; 9771, HLA-DPB1, 48638, 151088, 117-893; 9772, HLA-DQA1, 48648, 151098, 103-870; 9772, HLA-DQA1, 48649, 151099, 448-520; 9772, HLA-DQA1, 48650, 151100, 59-826; 9772, HLA-DQA1, 48651, 151101, 103-867; 9772, HLA-DQA1, 48652, 151102, 40-804; 9772, HLA-DQA1, 48653, 151103, 103-867; 9772, HLA-DQA1, 48654, 151104, 54-821; 9772, HLA-DQA1, 48655, 151105, 103-867; 9772, HLA-DQA1, 48656, 151106, 448-520; 9772, HLA-DQA1, 48657, 151107, 59-823; 9772, HLA-DQA1, 48658, 151108, 103-867; 9772, HLA-DQA1, 48660, 151110, 448-520; 9772, HLA-DQA1, 48661, 151111, 448-520; 9772, HLA-DQA1, 48662, 151112, 34-801; 9772, HLA-DQA1, 48663, 151113, 40-804; 9772, HLA-DQA1, 48664, 151114, 59-823; 9772, HLA-DQA1, 48665, 151115, 33-380; 9772, HLA-DQA1, 48666, 151116, 33-380; 9772, HLA-DQA1, 48667, 151117, 33-194; 9772, HLA-DQA1, 48668, 151118, 33-158; 9772, HLA-DQA1, 48669, 151119, 54-696; 9772, HLA-DQA1, 48671, 151121, 1-768; 9772, HLA-DQA1, 48672, 151122, 1-768; 9772, HLA-DQA1, 48641, 151091, 103-870; 9772, HLA-DQA1, 48642, 151092, 40-807; 9772, HLA-DQA1, 48643, 151093, 103-867; 9772, HLA-DQA1, 48644, 151094, 59-826; 9772, HLA-DQA1, 48645, 151095, 20-784; 9772, HLA-DQA1, 48646, 151096, 20-784; 9772, HLA-DQA1, 48647, 151097, 103-870; 9772, HLA-DQA1, 48659, 151109, 20-787; 9772, HLA-DQA1, 48670, 151120, 51-815; 9773, HLA-DQA2, 48681, 151131, 1-768; 9773, HLA-DQA2, 48682, 151132, 35-799; 9773, HLA-DQA2, 48685, 151135, 51-815; 9773, HLA-DQA2, 48673, 151123, 103-870; 9773, HLA-DQA2, 48674, 151124, 103-870; 9773, HLA-DQA2, 48675, 151125, 103-870; 9773, HLA-DQA2, 48676, 151126, 103-870; 9773, HLA-DQA2, 48677, 151127, 87-854; 9773, HLA-DQA2, 48678, 151128, 103-870; 9773, HLA-DQA2, 48679, 151129, 63-830; 9773, HLA-DQA2, 48680, 151130, 103-870; 9773, HLA-DQA2, 48683, 151133, 59-826; 9773, HLA-DQA2, 48684, 151134, 1-768; 9774, HLA-DQB1, 48686, 151136, 78-887; 9774, HLA-DQB1, 48687, 151137, 57-842; 9774, HLA-DQB1, 48688, 151138, 57-842; 9774, HLA-DQB1, 48689, 151139, 210-1019; 9774, HLA-DQB1, 48690, 151140, 211-1020; 9774, HLA-DQB1, 48691, 151141, 58-732; 9774, HLA-DQB1, 48692, 151142, 46-450; 9774, HLA-DQB1, 48693, 151143, 180-965; 9774, HLA-DQB1, 48695, 151145, 36-710; 9774, HLA-DQB1, 48696, 151146, 46-450; 9774, HLA-DQB1, 48697, 151147, 88-873; 9774, HLA-DQB1, 48698, 151148, 41-715; 9774, HLA-DQB1, 48699, 151149, 51-484; 9774, HLA-DQB1, 48702, 151152, 48-481; 9774, HLA-DQB1, 48703, 151153, 43-447; 9774, HLA-DQB1, 48704, 151154, 88-873; 9774, HLA-DQB1, 48707, 151157, 208-1017; 9774, HLA-DQB1, 48708, 151158, 42-716; 9774, HLA-DQB1, 48709, 151159, 39-713; 9774, HLA-DQB1, 48711, 151161, 46-450; 9774, HLA-DQB1, 48712, 151162, 51-484; 9774, HLA-DQB1, 48713, 151163, 32-442; 9774, HLA-DQB1, 48714, 151164, 29-439; 9774, HLA-DQB1, 48715, 151165, 32-442; 9774, HLA-DQB1, 48716, 151166, 32-442; 9774, HLA-DQB1, 48694, 151144, 88-873; 9774, HLA-DQB1, 48700, 151150, 180-965; 9774, HLA-DQB1, 48701, 151151, 85-870; 9774, HLA-DQB1, 48705, 151155, 88-873; 9774, HLA-DQB1, 48706, 151156, 177-962; 9774, HLA-DQB1, 48710, 151160, 180-965; 9775, HLA-DQB2, 48717, 151167, 51-890; 9775, HLA-DQB2, 48718, 151168, 9-704; 9775, HLA-DQB2, 48720, 151170, 63-890; 9775, HLA-DQB2, 48721, 151171, 65-859; 9775, HLA-DQB2, 48724, 151174, 51-890; 9775, HLA-DQB2, 48725, 151175, 65-859; 9775, HLA-DQB2, 48727, 151177, 9-704; 9775, HLA-DQB2, 48728, 151178, 51-890; 9775, HLA-DQB2, 48729, 151179, 63-890; 9775, HLA-DQB2, 48730, 151180, 1-656; 9775, HLA-DQB2, 48731, 151181, 65-859; 9775, HLA-DQB2, 48733, 151183, 1-656; 9775, HLA-DQB2, 48735, 151185, 9-704; 9775, HLA-DQB2, 48736, 151186, 1-656; 9775, HLA-DQB2, 48737, 151187, 1-656; 9775, HLA-DQB2, 48738, 151188, 1-656; 9775, HLA-DQB2, 48739, 151189, 51-890; 9775, HLA-DQB2, 48740, 151190, 9-704; 9775, HLA-DQB2, 48742, 151192, 63-890; 9775, HLA-DQB2, 48744, 151194, 63-890; 9775, HLA-DQB2, 48745, 151195, 1-656; 9775, HLA-DQB2, 48746, 151196, 1-656; 9775, HLA-DQB2, 48747, 151197, 1-656; 9775, HLA-DQB2, 48748, 151198, 65-859; 9775, HLA-DQB2, 48719, 151169, 53-859; 9775, HLA-DQB2, 48722, 151172, 53-859; 9775, HLA-DQB2, 48723, 151173, 21-704; 9775, HLA-DQB2, 48726, 151176, 21-704; 9775, HLA-DQB2, 48732, 151182, 53-859; 9775, HLA-DQB2, 48734, 151184, 21-704; 9775, HLA-DQB2, 48741, 151191, 21-704; 9775, HLA-DQB2, 48743, 151193, 53-859; 9776, HLA-DRA, 48749, 151199, 74-763; 9776, HLA-DRA, 48751, 151201, 28-717; 9776, HLA-DRA, 48754, 151204, 28-717; 9776, HLA-DRA, 48755, 151205, 28-717; 9776, HLA-DRA, 48757, 151207, 28-717; 9776, HLA-DRA, 48761, 151211, 28-717; 9776, HLA-DRA, 48762, 151212, 28-717; 9776, HLA-DRA, 48763, 151213, 110-874; 9776, HLA-DRA, 48750, 151200, 110-874; 9776, HLA-DRA, 48752, 151202, 110-874; 9776, HLA-DRA, 48753, 151203, 110-874; 9776, HLA-DRA, 48756, 151206, 110-874; 9776, HLA-DRA, 48758, 151208, 110-874; 9776, HLA-DRA, 48759, 151209, 110-874; 9776, HLA-DRA, 48760, 151210, 110-874; 9777, HLA-DRB1, 48768, 151218, 1-749; 9777, HLA-DRB1, 48774, 151224, 27-827; 9777, HLA-DRB1, 48775, 151225, 24-833; 9777, HLA-DRB1, 48776, 151226, 24-833; 9777, HLA-DRB1, 48777, 151227, 24-833; 9777, HLA-DRB1, 48778, 151228, 24-833; 9777, HLA-DRB1, 48780, 151230, 36-836; 9777, HLA-DRB1, 48781, 151231, 27-827; 9777, HLA-DRB1, 48782, 151232, 64-864; 9777, HLA-DRB1, 48783, 151233, 46-846; 9777, HLA-DRB1, 48786, 151236, 27-827; 9777, HLA-DRB1, 48787, 151237, 27-827; 9777, HLA-DRB1, 48788, 151238, 24-833; 9777, HLA-DRB1, 48789, 151239, 96-896; 9777, HLA-DRB1, 48791, 151241, 46-846; 9777, HLA-DRB1, 48792, 151242, 64-864; 9777, HLA-DRB1, 48764, 151214, 107-907; 9777, HLA-DRB1, 48766, 151216, 107-907; 9777, HLA-DRB1, 48779, 151229, 38-838; 9777, HLA-DRB1, 48790, 151240, 38-838; 9777, HLA-DRB1, 48765, 151215, 107-907; 9777, HLA-DRB1, 48769, 151219, 64-864; 9777, HLA-DRB1, 48770, 151220, 108-908; 9777, HLA-DRB1, 48772, 151222, 61-861; 9777, HLA-DRB1, 48784, 151234, 96-896; 9777, HLA-DRB1, 48785, 151235, 96-896; 9777, HLA-DRB1, 48767, 151217, 1-753; 9777, HLA-DRB1, 48771, 151221, 1-751; 9777, HLA-DRB1, 48773, 151223, 1-753; 9778, HLA-DRB3, 48794, 151244, 78-878; 9778, HLA-DRB3, 48795, 151245, 100-900; 9778, HLA-DRB3, 48796, 151246, 15-815; 9778, HLA-DRB3, 48797, 151247, 1-801; 9778, HLA-DRB3, 48798, 151248, 1-801; 9778, HLA-DRB3, 48799, 151249, 1-801; 9778, HLA-DRB3, 48800, 151250, 15-815; 9778, HLA-DRB3, 48793, 151243, 64-864; 9779, HLA-DRB4, 48801, 151251, 64-864; 9779, HLA-DRB4, 48803, 151253, 36-827; 9779, HLA-DRB4, 48804, 151254, 64-864; 9779, HLA-DRB4, 48802, 151252, 64-864; 9780, HLA-DRB5, 48805, 151255, 64-864; 9781, MR1, 48806, 151256, 6-755; 9781, MR1, 48807, 151257, 6-896; 9781, MR1, 48808, 151258, 6-1031; 9781, MR1, 48809, 151259, 162-806; 9781, MR1, 48810, 151260, 162-1187; 9781, MR1, 48811, 151261, 162-911; 9782, MIP, 48812, 151262, 30-821; 9783, MVP, 48815, 151265, 86-211; 9783, MVP, 48816, 151266, 115-548; 9783, MVP, 48817, 151267, 266-548; 9783, MVP, 48818, 151268, 69-188; 9783, MVP, 48819, 151269, 95-340; 9783, MVP, 48820, 151270, 194-854; 9783, MVP, 48821, 151271, 213-658; 9783, MVP, 48822, 151272, 87-408; 9783, MVP, 48823, 151273, 74-247; 9783, MVP, 48824, 151274, 1-185; 9783, MVP, 48825, 151275, 1-120; 9783, MVP, 48813, 151263, 139-2820; 9783, MVP, 48814, 151264, 194-2875; 9784, MAK16, 48827, 151277, 1-412; 9784, MAK16, 48826, 151276, 458-1360; 9785, MKRN1, 48830, 151280, 1-339; 9785, MKRN1, 48831, 151281, 25-552; 9785, MKRN1, 48833, 151283, 12-293; 9785, MKRN1, 48834, 151284, 639-1133; 9785, MKRN1, 48835, 151285, 415-720; 9785, MKRN1, 48836, 151286, 475-1053; 9785, MKRN1, 48837, 151287, 1-120; 9785, MKRN1, 48838, 151288, 11-337; 9785, MKRN1, 48839, 151289, 377-784; 9785, MKRN1, 48840, 151290, 98-433; 9785, MKRN1, 48828, 151278, 226-1674; 9785, MKRN1, 48829, 151279, 156-1145; 9785, MKRN1, 48832, 151282, 156-1412; 9786, MKRN2, 48843, 151293, 62-1306; 9786, MKRN2, 48841, 151291, 138-1388; 9786, MKRN2, 48842, 151292, 65-1186; 9787, MKRN3, 48845, 151295, 11-559; 9787, MKRN3, 48846, 151296, 67-384; 9787, MKRN3, 48847, 151297, 106-192; 9787, MKRN3, 48844, 151294, 100-1623; 9788, MAL, 48848, 151298, 1-294; 9788, MAL, 48849, 151299, 1-336; 9788, MAL, 48850, 151300, 110-571; 9788, MAL, 48851, 151301, 1-168; 9789, MAL2, 48853, 151303, 218-544; 9789, MAL2, 48854, 151304, 207-533; 9789, MAL2, 48855, 151305, 406-732; 9789, MAL2, 48852, 151302, 103-633; 9790, MALL, 48857, 151307, 30-392; 9790, MALL, 48858, 151308, 231-398; 9790, MALL, 48856, 151306, 775-1236; 9791, MDH1, 48860, 151310, 72-704; 9791, MDH1, 48861, 151311, 87-596; 9791, MDH1, 48862, 151312, 322-680; 9791, MDH1, 48863, 151313, 584-785; 9791, MDH1, 48864, 151314, 4-267; 9791, MDH1, 48865, 151315, 234-575; 9791, MDH1, 48866, 151316, 178-844; 9791, MDH1, 48859, 151309, 436-1440; 9791, MDH1, 48867, 151317, 178-1236; 9791, MDH1, 48868, 151318, 402-1139; 9792, MDH1B, 48872, 151322, 37-438; 9792, MDH1B, 48873, 151323, 237-1499; 9792, MDH1B, 48869, 151319, 277-1833; 9792, MDH1B, 48870, 151320, 16-1569; 9792, MDH1B, 48871, 151321, 24-875; 9793, MDH2, 48876, 151326, 229-924; 9793, MDH2, 48877, 151327, 111-197; 9793, MDH2, 48874, 151324, 95-1111; 9793, MDH2, 48875, 151325, 1-891; 9794, MAK, 48881, 151331, 232-1605; 9794, MAK, 48878, 151328, 384-2255; 9794, MAK, 48879, 151329, 283-2229; 9794, MAK, 48880, 151330, 304-2055; 9794, MAK, 48882, 151332, 259-2130; 9795, MLEC, 48884, 151334, 112-549; 9795, MLEC, 48885, 151335, 53-706; 9795, MLEC, 48886, 151336, 1-520; 9795, MLEC, 48883, 151333, 429-1307; 9796, MEA1, 48887, 151337, 156-713; 9797, MSL1, 48889, 151339, 178-525; 9797, MSL1, 48890, 151340, 30-1826; 9797, MSL1, 48891, 151341, 1-441; 9797, MSL1, 48893, 151343, 41-1426; 9797, MSL1, 48888, 151338, 316-2160; 9797, MSL1, 48892, 151342, 265-1320; 9798, MSL2, 48896, 151346, 113-559; 9798, MSL2, 48897, 151347, 259-543; 9798, MSL2, 48898, 151348, 114-576; 9798, MSL2, 48894, 151344, 734-2467; 9798, MSL2, 48895, 151345, 241-1752; 9799, MSL3, 48902, 151352, 1-351; 9799, MSL3, 48903, 151353, 482-1071; 9799, MSL3, 48906, 151356, 123-795; 9799, MSL3, 48907, 151357, 12-395; 9799, MSL3, 48908, 151358, 504-560; 9799, MSL3, 48899, 151349, 106-1671; 9799, MSL3, 48900, 151350, 28-1278; 9799, MSL3, 48901, 151351, 470-1588; 9799, MSL3, 48904, 151354, 638-1705; 9799, MSL3, 48905, 151355, 127-1656; 9800, ME1, 48909, 151359, 118-1836; 9801, ME2, 48910, 151360, 273-2027; 9801, ME2, 48911, 151361, 202-1641; 9802, ME3, 48912, 151362, 289-1068; 9802, ME3, 48914, 151364, 328-2069; 9802, ME3, 48916, 151366, 305-487; 9802, ME3, 48917, 151367, 360-814; 9802, ME3, 48918, 151368, 146-384; 9802, ME3, 48919, 151369, 114-298; 9802, ME3, 48913, 151363, 255-2069; 9802, ME3, 48915, 151365, 328-1356; 9802, ME3, 48920, 151370, 328-2142; 9803, MFHAS1, 48921, 151371, 588-3746; 9804, MCTS1, 48922, 151372, 534-1082; 9804, MCTS1, 48923, 151373, 258-803; 9805, MCAT, 48926, 151376, 1-264; 9805, MCAT, 48924, 151374, 47-1219; 9805, MCAT, 48925, 151375, 17-559; 9806, MLYCD, 48927, 151377, 20-1501; 9807, MALT1, 48930, 151380, 207-565; 9807, MALT1, 48928, 151378, 113-2554; 9807, MALT1, 48929, 151379, 259-2733; 9808, MGAM, 48931, 151381, 154-582; 9808, MGAM, 48932, 151382, 55-8316; 9808, MGAM, 48933, 151383, 236-790; 9808, MGAM, 48936, 151386, 1-6038; 9808, MGAM, 48937, 151387, 1-3343; 9808, MGAM, 48934, 151384, 96-5669; 9808, MGAM, 48935, 151385, 55-5628; 9809, MGAM2, 48938, 151388, 55-7602; 9809, MGAM2, 48939, 151389, 60-1508; 9809, MGAM2, 48940, 151390, 60-1508; 9809, MGAM2, 48941, 151391, 55-7602; 9810, MALRD1, 48942, 151392, 1-1522; 9810, MALRD1, 48943, 151393, 1-4461; 9810, MALRD1, 48944, 151394, 1-201; 9810, MALRD1, 48945, 151395, 1-774; 9810, MALRD1, 48946, 151396, 169-6639; 9811, MAMDC2, 48948, 151398, 618-2265; 9811, MAMDC2, 48947, 151397, 618-2678; 9812,

MAMDC4, 48951, 151401, 1-711; 9812, MAMDC4, 48949, 151399, 51-3464; 9812, MAMDC4, 48950, 151400, 51-3701; 9813, MDGA1, 48952, 151402, 1-478; 9813, MDGA1, 48954, 151404, 207-594; 9813, MDGA1, 48956, 151406, 1-262; 9813, MDGA1, 48957, 151407, 312-542; 9813, MDGA1, 48953, 151403, 1180-4047; 9813, MDGA1, 48955, 151405, 1-2922; 9814, MDGA2, 48960, 151410, 328-2808; 9814, MDGA2, 48961, 151411, 705-1457; 9814, MDGA2, 48962, 151412, 1-757; 9814, MDGA2, 48963, 151413, 149-574; 9814, MDGA2, 48964, 151414, 802-1503; 9814, MDGA2, 48958, 151408, 636-2819; 9814, MDGA2, 48959, 151409, 366-3236; 9815, MASP1, 48968, 151418, 435-1499; 9815, MASP1, 48970, 151420, 349-962; 9815, MASP1, 48971, 151421, 388-553; 9815, MASP1, 48972, 151422, 188-542; 9815, MASP1, 48965, 151415, 326-1468; 9815, MASP1, 48966, 151416, 227-2413; 9815, MASP1, 48967, 151417, 391-2490; 9815, MASP1, 48969, 151419, 453-2300; 9816, MASP2, 48973, 151423, 17-2077; 9816, MASP2, 48974, 151424, 27-584; 9817, MPI, 48977, 151427, 55-1176; 9817, MPI, 48978, 151428, 33-248; 9817, MPI, 48979, 151429, 55-741; 9817, MPI, 48980, 151430, 13-807; 9817, MPI, 48981, 151431, 33-555; 9817, MPI, 48982, 151432, 23-578; 9817, MPI, 48983, 151433, 104-969; 9817, MPI, 48984, 151434, 182-1393; 9817, MPI, 48985, 151435, 64-583; 9817, MPI, 48986, 151436, 36-899; 9817, MPI, 48987, 151437, 500-857; 9817, MPI, 48988, 151438, 33-559; 9817, MPI, 48989, 151439, 1-642; 9817, MPI, 48990, 151440, 56-1015; 9817, MPI, 48991, 151441, 33-537; 9817, MPI, 48992, 151442, 33-407; 9817, MPI, 48993, 151443, 33-1052; 9817, MPI, 48975, 151425, 33-1121; 9817, MPI, 48976, 151426, 68-1339; 9818, MRC1, 48994, 151444, 123-4493; 9819, MRC2, 48996, 151446, 1020-2057; 9819, MRC2, 48997, 151447, 1-473; 9819, MRC2, 48998, 151448, 470-574; 9819, MRC2, 48995, 151445, 403-4842; 9820, M6PR, 49000, 151450, 1-447; 9820, M6PR, 49001, 151451, 1-290; 9820, M6PR, 49002, 151452, 586-660; 9820, M6PR, 49003, 151453, 276-851; 9820, M6PR, 49004, 151454, 269-596; 9820, M6PR, 49005, 151455, 445-720; 9820, M6PR, 49006, 151456, 1-255; 9820, M6PR, 49007, 151457, 151-552; 9820, M6PR, 49008, 151458, 1-313; 9820, M6PR, 49009, 151459, 1-368; 9820, M6PR, 48999, 151449, 470-1303; 9821, MBL2, 49010, 151460, 66-812; 9822, MPDU1, 49012, 151462, 15-200; 9822, MPDU1, 49013, 151463, 36-614; 9822, MPDU1, 49015, 151465, 43-228; 9822, MPDU1, 49016, 151466, 198-383; 9822, MPDU1, 49017, 151467, 1-184; 9822, MPDU1, 49018, 151468, 4-333; 9822, MPDU1, 49019, 151469, 1-164; 9822, MPDU1, 49020, 151470, 4-231; 9822, MPDU1, 49021, 151471, 1-97; 9822, MPDU1, 49022, 151472, 4-333; 9822, MPDU1, 49023, 151473, 335-493; 9822, MPDU1, 49024, 151474, 12-475; 9822, MPDU1, 49025, 151475, 1-351; 9822, MPDU1, 49026, 151476, 12-341; 9822, MPDU1, 49027, 151477, 1-456; 9822, MPDU1, 49028, 151478, 2-582; 9822, MPDU1, 49029, 151479, 12-317; 9822, MPDU1, 49030, 151480, 217-1116; 9822, MPDU1, 49031, 151481, 217-852; 9822, MPDU1, 49032, 151482, 1-900; 9822, MPDU1, 49011, 151461, 217-960; 9822, MPDU1, 49014, 151464, 11-571; 9823, MAN1A1, 49033, 151483, 443-2404; 9824, MAN1A2, 49035, 151485, 1-613; 9824, MAN1A2, 49036, 151486, 1-294; 9824, MAN1A2, 49037, 151487, 1-995; 9824, MAN1A2, 49034, 151484, 736-2661; 9825, MAN1B1, 49039, 151489, 1-159; 9825, MAN1B1, 49040, 151490, 29-2116; 9825, MAN1B1, 49041, 151491, 1-545; 9825, MAN1B1, 49042, 151492, 16-1668; 9825, MAN1B1, 49043, 151493, 1-811; 9825, MAN1B1, 49044, 151494, 1-373; 9825, MAN1B1, 49045, 151495, 1-348; 9825, MAN1B1, 49038, 151488, 74-2173; 9826, MAN1C1, 49046, 151496, 614-1966; 9826, MAN1C1, 49047, 151497, 595-1800; 9826, MAN1C1, 49049, 151499, 961-2049; 9826, MAN1C1, 49048, 151498, 331-2223; 9827, MAN2A1, 49050, 151500, 1053-4487; 9828, MAN2A2, 49052, 151502, 69-2459; 9828, MAN2A2, 49053, 151503, 473-624; 9828, MAN2A2, 49054, 151504, 1-1081; 9828, MAN2A2, 49055, 151505, 1-988; 9828, MAN2A2, 49056, 151506, 1-583; 9828, MAN2A2, 49057, 151507, 1-790; 9828, MAN2A2, 49059, 151509, 169-529; 9828, MAN2A2, 49060, 151510, 1-2382; 9828, MAN2A2, 49061, 151511, 1-492; 9828, MAN2A2, 49062, 151512, 1-956; 9828, MAN2A2, 49063, 151513, 1-175; 9828, MAN2A2, 49064, 151514, 832-1049; 9828, MAN2A2, 49065, 151515, 310-537; 9828, MAN2A2, 49066, 151516, 300-3116; 9828, MAN2A2, 49051, 151501, 19-3471; 9828, MAN2A2, 49058, 151508, 460-3912; 9829, MAN2B1, 49069, 151519, 1-203; 9829, MAN2B1, 49070, 151520, 42-535; 9829, MAN2B1, 49071, 151521, 36-551; 9829, MAN2B1, 49072, 151522, 1-422; 9829, MAN2B1, 49067, 151517, 34-3066; 9829, MAN2B1, 49068, 151518, 42-3077; 9830, MAN2B2, 49074, 151524, 23-2899; 9830, MAN2B2, 49075, 151525, 1-2861; 9830, MAN2B2, 49073, 151523, 37-3066; 9831, MAN2C1, 49077, 151527, 23-652; 9831, MAN2C1, 49078, 151528, 27-569; 9831, MAN2C1, 49080, 151530, 30-580; 9831, MAN2C1, 49081, 151531, 30-299; 9831, MAN2C1, 49083, 151533, 23-569; 9831, MAN2C1, 49084, 151534, 23-256; 9831, MAN2C1, 49085, 151535, 1-519; 9831, MAN2C1, 49086, 151536, 23-256; 9831, MAN2C1, 49088, 151538, 21-568; 9831, MAN2C1, 49089, 151539, 25-1302; 9831, MAN2C1, 49076, 151526, 48-3170; 9831, MAN2C1, 49079, 151529, 22-2847; 9831, MAN2C1, 49082, 151532, 10-3063; 9831, MAN2C1, 49087, 151537, 13-3186; 9832, MANBA, 49091, 151541, 90-296; 9832, MANBA, 49092, 151542, 40-2508; 9832, MANBA, 49090, 151540, 101-2740; 9833, MANBAL, 49095, 151545, 95-265; 9833, MANBAL, 49093, 151543, 813-1070; 9833, MANBAL, 49094, 151544, 106-363; 9833, MANBAL, 49096, 151546, 401-658; 9833, MANBAL, 49097, 151547, 437-694; 9834, MANEA, 49099, 151549, 135-731; 9834, MANEA, 49100, 151550, 135-758; 9834, MANEA, 49098, 151548, 135-1523; 9835, MANEAL, 49104, 151554, 1-393; 9835, MANEAL, 49105, 151555, 258-1049; 9835, MANEAL, 49101, 151551, 289-996; 9835, MANEAL, 49102, 151552, 382-1755; 9835, MANEAL, 49103, 151553, 301-1053; 9836, MGAT1, 49111, 151561, 294-607; 9836, MGAT1, 49112, 151562, 384-693; 9836, MGAT1, 49113, 151563, 231-564; 9836, MGAT1, 49114, 151564, 270-555; 9836, MGAT1, 49115, 151565, 238-619; 9836, MGAT1, 49116, 151566, 280-878; 9836, MGAT1, 49117, 151567, 644-1104; 9836, MGAT1, 49118, 151568, 203-549; 9836, MGAT1, 49119, 151569, 471-572; 9836, MGAT1, 49106, 151556, 333-1670; 9836, MGAT1, 49107, 151557, 674-2011; 9836, MGAT1, 49108, 151558, 654-1991; 9836, MGAT1, 49109, 151559, 430-1767; 9836, MGAT1, 49110, 151560, 752-2089; 9837, MGAT4A, 49124, 151574, 290-424; 9837, MGAT4A, 49120, 151570, 365-1972; 9837, MGAT4A, 49121, 151571, 315-1922; 9837, MGAT4A, 49122, 151572, 350-1957; 9837, MGAT4A, 49123, 151573, 115-1386; 9838, MGAT4B, 49127, 151577, 481-1080; 9838, MGAT4B, 49128, 151578, 1-732; 9838, MGAT4B, 49129, 151579, 1-1120; 9838, MGAT4B, 49130, 151580, 1-722; 9838, MGAT4B, 49131, 151581, 5-478; 9838, MGAT4B, 49132, 151582, 1-1289; 9838, MGAT4B, 49133, 151583, 1-964; 9838, MGAT4B, 49134, 151584, 1-451; 9838, MGAT4B, 49135, 151585, 1-922; 9838, MGAT4B, 49125, 151575, 352-1998; 9838, MGAT4B, 49126, 151576, 888-

2579; 9839, MGAT2, 49136, 151586, 475-1818; 9840, MGAT5, 49137, 151587, 146-2371; 9840, MGAT5, 49138, 151588, 253-2478; 9841, MGAT5B, 49141, 151591, 40-1491; 9841, MGAT5B, 49143, 151593, 315-647; 9841, MGAT5B, 49139, 151589, 575-2947; 9841, MGAT5B, 49140, 151590, 104-2509; 9841, MGAT5B, 49142, 151592, 575-2953; 9842, MGAT3, 49145, 151595, 228-552; 9842, MGAT3, 49146, 151596, 87-569; 9842, MGAT3, 49144, 151594, 216-1817; 9843, MOGS, 49148, 151598, 139-768; 9843, MOGS, 49150, 151600, 86-520; 9843, MOGS, 49151, 151601, 142-1616; 9843, MOGS, 49147, 151597, 164-2677; 9843, MOGS, 49149, 151599, 156-2351; 9844, MANSC1, 49153, 151603, 325-496; 9844, MANSC1, 49155, 151605, 135-1187; 9844, MANSC1, 49156, 151606, 325-496; 9844, MANSC1, 49157, 151607, 135-1187; 9844, MANSC1, 49152, 151602, 265-1458; 9844, MANSC1, 49154, 151604, 565-1860; 9844, MANSC1, 49158, 151608, 265-1458; 9844, MANSC1, 49159, 151609, 565-1860; 9845, MANSC4, 49160, 151610, 1-1023; 9846, MKNK1, 49161, 151611, 83-421; 9846, MKNK1, 49162, 151612, 456-1445; 9846, MKNK1, 49166, 151616, 68-580; 9846, MKNK1, 49167, 151617, 117-494; 9846, MKNK1, 49168, 151618, 116-229; 9846, MKNK1, 49169, 151619, 112-540; 9846, MKNK1, 49170, 151620, 219-575; 9846, MKNK1, 49171, 151621, 268-567; 9846, MKNK1, 49172, 151622, 175-357; 9846, MKNK1, 49173, 151623, 188-358; 9846, MKNK1, 49174, 151624, 135-410; 9846, MKNK1, 49175, 151625, 1-257; 9846, MKNK1, 49176, 151626, 226-530; 9846, MKNK1, 49177, 151627, 203-738; 9846, MKNK1, 49163, 151613, 188-1462; 9846, MKNK1, 49164, 151614, 165-1562; 9846, MKNK1, 49165, 151615, 164-1207; 9847, MKNK2, 49180, 151630, 67-456; 9847, MKNK2, 49181, 151631, 1-531; 9847, MKNK2, 49182, 151632, 3-251; 9847, MKNK2, 49183, 151633, 125-601; 9847, MKNK2, 49184, 151634, 234-454; 9847, MKNK2, 49185, 151635, 124-352; 9847, MKNK2, 49186, 151636, 1-130; 9847, MKNK2, 49178, 151628, 246-1643; 9847, MKNK2, 49179, 151629, 226-1470; 9847, MKNK2, 49187, 151637, 37-1434; 9848, MARK1, 49190, 151640, 641-2983; 9848, MARK1, 49191, 151641, 641-3031; 9848, MARK1, 49188, 151638, 267-2654; 9848, MARK1, 49189, 151639, 598-2874; 9849, MARK2, 49194, 151644, 679-2778; 9849, MARK2, 49197, 151647, 1-2100; 9849, MARK2, 49199, 151649, 213-2549; 9849, MARK2, 49200, 151650, 230-411; 9849, MARK2, 49203, 151653, 224-558; 9849, MARK2, 49204, 151654, 285-557; 9849, MARK2, 49205, 151655, 113-595; 9849, MARK2, 49192, 151642, 415-2544; 9849, MARK2, 49193, 151643, 503-2662; 9849, MARK2, 49195, 151645, 580-2946; 9849, MARK2, 49196, 151646, 19-2094; 9849, MARK2, 49198, 151648, 50-2317; 9849, MARK2, 49201, 151651, 464-2701; 9849, MARK2, 49202, 151652, 503-2677; 9850, MARK3, 49206, 151656, 171-2312; 9850, MARK3, 49208, 151658, 1-2331; 9850, MARK3, 49209, 151659, 639-2618; 9850, MARK3, 49210, 151660, 578-2836; 9850, MARK3, 49211, 151661, 511-2772; 9850, MARK3, 49212, 151662, 1-1517; 9850, MARK3, 49214, 151664, 1-996; 9850, MARK3, 49215, 151665, 136-523; 9850, MARK3, 49216, 151666, 1-669; 9850, MARK3, 49217, 151667, 44-579; 9850, MARK3, 49207, 151657, 490-2679; 9850, MARK3, 49213, 151663, 46-2280; 9851, MARK4, 49220, 151670, 367-553; 9851, MARK4, 49221, 151671, 373-594; 9851, MARK4, 49222, 151672, 203-496; 9851, MARK4, 49223, 151673, 1-146; 9851, MARK4, 49224, 151674, 203-496; 9851, MARK4, 49225, 151675, 249-488; 9851, MARK4, 49218, 151668, 332-2590; 9851, MARK4, 49219, 151669, 298-2364; 9852, MBIP, 49229, 151679, 1-898; 9852, MBIP, 49230, 151680, 10-853; 9852, MBIP, 49231, 151681, 37-702; 9852, MBIP, 49232, 151682, 284-621; 9852, MBIP, 49233, 151683, 37-933; 9852, MBIP, 49226, 151676, 40-1071; 9852, MBIP, 49227, 151677, 20-868; 9852, MBIP, 49228, 151678, 89-1123; 9853, MAP3K7CL, 49243, 151693, 445-577; 9853, MAP3K7CL, 49244, 151694, 275-556; 9853, MAP3K7CL, 49245, 151695, 1-411; 9853, MAP3K7CL, 49234, 151684, 1-729; 9853, MAP3K7CL, 49235, 151685, 130-858; 9853, MAP3K7CL, 49236, 151686, 641-1069; 9853, MAP3K7CL, 49237, 151687, 130-558; 9853, MAP3K7CL, 49238, 151688, 199-627; 9853, MAP3K7CL, 49239, 151689, 479-907; 9853, MAP3K7CL, 49240, 151690, 539-967; 9853, MAP3K7CL, 49241, 151691, 668-1096; 9853, MAP3K7CL, 49242, 151692, 278-1006; 9854, MAP6D1, 49247, 151697, 48-596; 9854, MAP6D1, 49248, 151698, 1-400; 9854, MAP6D1, 49246, 151696, 32-631; 9855, MAP7D1, 49252, 151702, 227-959; 9855, MAP7D1, 49253, 151703, 148-567; 9855, MAP7D1, 49254, 151704, 1-744; 9855, MAP7D1, 49249, 151699, 454-2865; 9855, MAP7D1, 49250, 151700, 221-2647; 9855, MAP7D1, 49251, 151701, 217-2742; 9856, MAP7D2, 49255, 151705, 39-2360; 9856, MAP7D2, 49256, 151706, 20-2218; 9856, MAP7D2, 49257, 151707, 26-2089; 9856, MAP7D2, 49258, 151708, 105-2147; 9857, MAP7D3, 49260, 151710, 25-2432; 9857, MAP7D3, 49259, 151709, 222-2852; 9857, MAP7D3, 49261, 151711, 14-2539; 9857, MAP7D3, 49262, 151712, 164-2740; 9858, MADD, 49265, 151715, 358-5124; 9858, MADD, 49271, 151721, 214-1533; 9858, MADD, 49273, 151723, 212-437; 9858, MADD, 49274, 151724, 87-549; 9858, MADD, 49275, 151725, 176-580; 9858, MADD, 49276, 151726, 303-711; 9858, MADD, 49277, 151727, 1-598; 9858, MADD, 49263, 151713, 166-4992; 9858, MADD, 49264, 151714, 166-5109; 9858, MADD, 49266, 151716, 188-4933; 9858, MADD, 49267, 151717, 156-4781; 9858, MADD, 49268, 151718, 166-4863; 9858, MADD, 49269, 151719, 180-4943; 9858, MADD, 49270, 151720, 166-4605; 9858, MADD, 49272, 151722, 166-4803; 9859, MARCKSL1, 49278, 151728, 347-934; 9860, MZB1, 49282, 151732, 1-181; 9860, MZB1, 49283, 151733, 40-270; 9860, MZB1, 49279, 151729, 59-628; 9860, MZB1, 49280, 151730, 58-285; 9860, MZB1, 49281, 151731, 226-597; 9861, MK167, 49286, 151736, 196-9963; 9861, MK167, 49284, 151734, 196-8886; 9861, MK167, 49285, 151735, 377-10147; 9862, MARVELD1, 49287, 151737, 154-675; 9863, MARVELD2, 49290, 151740, 19-1347; 9863, MARVELD2, 49291, 151741, 19-1347; 9863, MARVELD2, 49292, 151742, 141-576; 9863, MARVELD2, 49293, 151743, 359-1908; 9863, MARVELD2, 49294, 151744, 19-1347; 9863, MARVELD2, 49297, 151747, 141-576; 9863, MARVELD2, 49298, 151748, 359-1908; 9863, MARVELD2, 49299, 151749, 19-1347; 9863, MARVELD2, 49288, 151738, 75-1751; 9863, MARVELD2, 49289, 151739, 60-1700; 9863, MARVELD2, 49295, 151745, 60-1700; 9863, MARVELD2, 49296, 151746, 75-1751; 9864, MARVELD3, 49302, 151752, 193-375; 9864, MARVELD3, 49304, 151754, 70-729; 9864, MARVELD3, 49300, 151750, 45-1250; 9864, MARVELD3, 49301, 151751, 44-1276; 9864, MARVELD3, 49303, 151753, 47-493; 9865, MAS1L, 49305, 151755, 55-1191; 9865, MAS1L, 49306, 151756, 1-1137; 9865, MAS1L, 49307, 151757, 1-1137; 9865, MAS1L, 49308, 151758, 1-1137; 9865, MAS1L, 49309, 151759, 1-1137; 9865, MAS1L, 49310, 151760, 1-1137; 9865, MAS1L, 49311, 151761, 1-1137; 9865, MAS1L, 49312, 151762, 1-1137; 9866, MAS1, 49313, 151763, 267-1244; 9867, MRGPRD, 49314, 151764, 1-966; 9868, MRGPRE, 49315, 151765, 308-1246; 9869, MRGPRF, 49317, 151767, 221-535; 9869, MRGPRF, 49316, 151766, 384-1415; 9869, MRGPRF, 49318, 151768, 368-1399; 9870, MRGPRG, 49319, 151769, 1-870; 9871, MRGPRX1, 49320, 151770, 219-1187; 9872, MRGPRX2, 49321, 151771, 89-1081; 9873, MRGPRX3, 49323, 151773, 254-991; 9873, MRGPRX3, 49322, 151772, 362-1330; 9873, MRGPRX3, 49324, 151774, 154-1122; 9874, MRGPRX4, 49326, 151776, 1-969; 9874, MRGPRX4, 49325, 151775, 421-1389; 9875, MILR1, 49327, 151777, 1-269; 9875, MILR1, 49329, 151779, 40-599; 9875, MILR1, 49333, 151783, 1-269; 9875, MILR1, 49328, 151778, 1-762; 9875, MILR1, 49330, 151780, 133-1164; 9875, MILR1, 49331, 151781, 1-747; 9875, MILR1, 49332, 151782, 55-1086; 9876, MCEMP1, 49335, 151785, 34-468; 9876, MCEMP1, 49334, 151784, 455-1018; 9877, MAMLD1, 49337, 151787, 183-591; 9877, MAMLD1, 49336, 151786, 64-2388; 9877, MAMLD1, 49338, 151788, 311-2635; 9877, MAMLD1, 49339, 151789, 64-2313; 9877, MAMLD1, 49340, 151790, 176-3172; 9878, MAML1, 49341, 151791, 264-3314; 9879, MAML2, 49343, 151793, 1-2961; 9879, MAML2, 49342, 151792, 1286-4756; 9880, MAML3, 49344, 151794, 1-831; 9880, MAML3, 49346, 151796, 1-559; 9880, MAML3, 49345, 151795, 858-4274; 9881, MELK, 49354, 151804, 347-844; 9881, MELK, 49355, 151805, 184-573; 9881, MELK, 49356, 151806, 209-682; 9881, MELK, 49357, 151807, 150-794; 9881, MELK, 49347, 151797, 185-2140; 9881, MELK, 49348, 151798, 185-2017; 9881, MELK, 49349, 151799, 219-1781; 9881, MELK, 49350, 151800, 185-1996; 9881, MELK, 49351, 151801, 195-2054; 9881, MELK, 49352, 151802, 195-1937; 9881, MELK, 49353, 151803, 150-1892; 9882, MATN1, 49358, 151808, 37-1527; 9883, MATN2, 49361, 151811, 255-600; 9883, MATN2, 49362, 151812, 1-467; 9883, MATN2, 49363, 151813, 1-395; 9883, MATN2, 49364, 151814, 1-2161; 9883, MATN2, 49365, 151815, 1-586; 9883, MATN2, 49366, 151816, 1-548; 9883, MATN2, 49369, 151819, 1-530; 9883, MATN2, 49370, 151820, 1-541; 9883, MATN2, 49359, 151809, 232-3102; 9883, MATN2, 49360, 151810, 211-2229; 9883, MATN2, 49367, 151817, 475-3288; 9883, MATN2, 49368, 151818, 204-2951; 9883, MATN2, 49371, 151821, 125-2995; 9884, MATN3, 49372, 151822, 64-1524; 9884, MATN3, 49373, 151823, 35-1369; 9885, MATN4, 49374, 151824, 158-1657; 9885, MATN4, 49375, 151825, 188-1810; 9885, MATN4, 49376, 151826, 10-1878; 9885, MATN4, 49377, 151827, 10-1755; 9885, MATN4, 49378, 151828, 246-1991; 9886, MATR3, 49380, 151830, 538-770; 9886, MATR3, 49381, 151831, 1-1001; 9886, MATR3, 49382, 151832, 327-561; 9886, MATR3, 49383, 151833, 435-696; 9886, MATR3, 49384, 151834, 83-447; 9886, MATR3, 49385, 151835, 95-423; 9886, MATR3, 49386, 151836, 231-1530; 9886, MATR3, 49388, 151838, 187-444; 9886, MATR3, 49389, 151839, 202-575; 9886, MATR3, 49390, 151840, 429-455; 9886, MATR3, 49391, 151841, 125-1654; 9886, MATR3, 49392, 151842, 254-2638; 9886, MATR3, 49393, 151843, 265-564; 9886, MATR3, 49394, 151844, 17-532; 9886, MATR3, 49379, 151829, 336-2879; 9886, MATR3, 49387, 151837, 232-1911; 9887, N/A, 49395, 151845, 428-2971; 9887, N/A, 49396, 151846, 550-3237; 9887, N/A, 49397, 151847, 352-1881; 9887, N/A, 49398, 151848, 508-750; 9887, N/A, 49399, 151849, 266-587; 9887, N/A, 49400, 151850, 653-3340; 9887, N/A, 49401, 151851, 392-580; 9887, N/A, 49403, 151853, 560-579; 9887, N/A, 49404, 151854, 524-664; 9887, N/A, 49405, 151855, 291-589; 9887, N/A, 49406, 151856, 1-852; 9887, N/A, 49402, 151852, 697-3240; 9887, N/A, 49407, 151857, 457-3000; 9888, MEPE, 49411, 151861, 51-341; 9888, MEPE, 49412, 151862, 379-1884; 9888, MEPE, 49408, 151858, 41-1618; 9888, MEPE, 49409, 151859, 111-1781; 9888, MEPE, 49410, 151860, 74-1651; 9888, MEPE, 49413, 151863, 526-1764; 9888, MEPE, 49414, 151864, 597-1835; 9889, MGP, 49416, 151866, 1-224; 9889, MGP, 49415, 151865, 67-453; 9889, MGP, 49417, 151867, 136-447; 9890, MMP1, 49418, 151868, 69-1478; 9891, MMP10, 49420, 151870, 38-581; 9891, MMP10, 49419, 151869, 38-1468; 9892, MMP11, 49422, 151872, 23-1087; 9892, MMP11, 49423, 151873, 26-367; 9892, MMP11, 49424, 151874, 1-512; 9892, MMP11, 49426, 151876, 1-512; 9892, MMP11, 49427, 151877, 23-1087; 9892, MMP11, 49421, 151871, 53-1519; 9892, MMP11, 49425, 151875, 53-1519; 9893, MMP12, 49428, 151878, 98-1510; 9894, MMP13, 49430, 151880, 1-1470; 9894, MMP13, 49431, 151881, 1-1152; 9894, MMP13, 49429, 151879, 30-1445; 9895, MMP14, 49433, 151883, 1-582; 9895, MMP14, 49434, 151884, 199-412; 9895, MMP14, 49432, 151882, 262-2010; 9896, MMP15, 49436, 151886, 1-293; 9896, MMP15, 49435, 151885, 786-2795; 9897, MMP16, 49438, 151888, 46-551; 9897, MMP16, 49437, 151887, 283-2106; 9898, MMP17, 49440, 151890, 300-654; 9898, MMP17, 49442, 151892, 208-552; 9898, MMP17, 49443, 151893, 604-1510; 9898, MMP17, 49444, 151894, 391-510; 9898, MMP17, 49445, 151895, 269-775; 9898, MMP17, 49446, 151896, 195-626; 9898, MMP17, 49439, 151889, 103-1914; 9898, MMP17, 49441, 151891, 233-1792; 9899, MMP19, 49450, 151900, 121-1578; 9899, MMP19, 49451, 151901, 120-365; 9899, MMP19, 49452, 151902, 111-437; 9899, MMP19, 49447, 151897, 93-1619; 9899, MMP19, 49448, 151898, 107-1024; 9899, MMP19, 49449, 151899, 137-328; 9900, MMP2, 49456, 151906, 134-736; 9900, MMP2, 49457, 151907, 1-755; 9900, MMP2, 49458, 151908, 212-566; 9900, MMP2, 49460, 151910, 1-68; 9900, MMP2, 49453, 151903, 510-2492; 9900, MMP2, 49454, 151904, 320-2152; 9900, MMP2, 49455, 151905, 141-1895; 9900, MMP2, 49459, 151909, 686-2440; 9901, MMP20, 49461, 151911, 14-1465; 9902, MMP21, 49462, 151912, 1-1710; 9903, MMP23B, 49464, 151914, 41-1201; 9903, MMP23B, 49465, 151915, 1-728; 9903, MMP23B, 49466, 151916, 42-758; 9903, MMP23B, 49467, 151917, 57-556; 9903, MMP23B, 49468, 151918, 1-798; 9903, MMP23B, 49469, 151919, 1-777; 9903, MMP23B, 49470, 151920, 1-264; 9903, MMP23B, 49472, 151922, 41-1201; 9903, MMP23B, 49463, 151913, 125-1297; 9903, MMP23B, 49471, 151921, 39-1211; 9904, MMP24, 49473, 151923, 86-2023; 9905, MMP25, 49475, 151925, 466-1017; 9905, MMP25, 49474, 151924, 238-1926; 9906, MMP26, 49476, 151926, 19-804; 9906, MMP26, 49477, 151927, 217-1002; 9907, MMP27, 49478, 151928, 93-1634; 9908, MMP28, 49480, 151930, 248-1429; 9908, MMP28, 49481, 151931, 331-1863; 9908, MMP28, 49482, 151932, 1-270; 9908, MMP28, 49483, 151933, 248-1429; 9908, MMP28, 49486, 151936, 1-567; 9908, MMP28, 49487, 151937, 1-265; 9908, MMP28, 49488, 151938, 1-567; 9908, MMP28, 49490, 151940, 331-1863; 9908, MMP28, 49479, 151929, 206-1768; 9908, MMP28, 49484, 151934, 331-723; 9908, MMP28, 49485, 151935, 271-1833; 9908, MMP28, 49489, 151939, 331-723; 9909, MMP3, 49492, 151942, 1-296; 9909, MMP3, 49493, 151943, 62-190; 9909, MMP3, 49491, 151941, 258-1691; 9910, MMP7, 49494, 151944, 54-857; 9911, MMP8, 49496, 151946, 1-1033; 9911, MMP8, 49497, 151947, 216-326; 9911, MMP8, 49498, 151948, 100-231; 9911, MMP8, 49499, 151949, 98-268; 9911, MMP8, 49500, 151950, 87-257; 9911, MMP8, 49495, 151945, 100-1503; 9912, MMP9, 49501, 151951, 20-2143; 9913, MXRA5, 49502, 151952, 156-8642; 9914, MXRA7, 49506, 151956, 1573-2214; 9914, MXRA7, 49507, 151957, 160-207; 9914, MXRA7, 49508, 151958, 342-410; 9914, MXRA7, 49509, 151959, 224-271; 9914, MXRA7, 49503, 151953, 10-624; 9914, MXRA7, 49504, 151954, 59-592; 9914, MXRA7, 49505, 151955, 71-583; 9915, MXRA8, 49510, 151960, 32-1360; 9915, MXRA8, 49511, 151961, 291-1316; 9915, MXRA8, 49512, 151962, 40-1392; 9915, MXRA8, 49513, 151963, 515-1816; 9916, MTCP1, 49516, 151966, 1-30; 9916, MTCP1, 49514, 151964, 164-487; 9916, MTCP1, 49515, 151965, 581-904; 9917, MTURN, 49520, 151970, 326-555; 9917, MTURN, 49517, 151967, 328-723; 9917, MTURN, 49518, 151968, 97-393; 9917, MTURN, 49519, 151969, 150-422; 9918, MAU2, 49522, 151972, 1-551; 9918, MAU2, 49523, 151973, 1-707; 9918, MAU2, 49521, 151971, 180-2021; 9919, MXD1, 49525, 151975, 319-540; 9919, MXD1, 49526, 151976, 316-860; 9919, MXD1, 49524, 151974, 261-926; 9919, MXD1, 49527, 151977, 291-926; 9920, MXD3, 49532, 151982, 67-440; 9920, MXD3, 49533, 151983, 332-555; 9920, MXD3, 49528, 151978, 66-1232; 9920, MXD3, 49529, 151979, 480-1100; 9920, MXD3, 49530, 151980, 69-650; 9920, MXD3, 49531, 151981, 88-708; 9921, MXD4, 49535, 151985, 43-366; 9921, MXD4, 49536, 151986, 1-247; 9921, MXD4, 49534, 151984, 315-944; 9922, MXI1, 49541, 151991, 128-784; 9922, MXI1, 49542, 151992, 126-803; 9922, MXI1, 49543, 151993, 281-634; 9922, MXI1, 49537, 151987, 219-905; 9922, MXI1, 49538, 151988, 205-1092; 9922, MXI1, 49539, 151989, 121-669; 9922, MXI1, 49540, 151990, 240-818; 9923, MNT, 49545, 151995, 393-494; 9923, MNT, 49544, 151994, 407-2155; 9924, MBTD1, 49549, 151999, 1-270; 9924, MBTD1, 49546, 151996, 98-1330; 9924, MBTD1, 49547, 151997, 220-729; 9924, MBTD1, 49548, 151998, 64-1950; 9924, MBTD1, 49550, 152000, 345-2231; 9925, MCF2, 49555, 152005, 1-1288; 9925, MCF2, 49556, 152006, 1-1587; 9925, MCF2, 49551, 152001, 1-2826; 9925, MCF2, 49552, 152002, 1-2583; 9925, MCF2, 49553, 152003, 211-2988; 9925, MCF2, 49554, 152004, 156-3113; 9925, MCF2, 49557, 152007, 287-3244; 9925, MCF2, 49558, 152008, 167-3172; 9925, MCF2, 49559, 152009, 324-2789; 9926, MCF2L, 49560, 152010, 1-890; 9926, MCF2L, 49564, 152014, 1-2380; 9926, MCF2L, 49565, 152015, 64-324; 9926, MCF2L, 49566, 152016, 19-429; 9926, MCF2L, 49568, 152018, 9-203; 9926, MCF2L, 49569, 152019, 165-574; 9926, MCF2L, 49570, 152020, 1-1009; 9926, MCF2L, 49571, 152021, 266-557; 9926, MCF2L, 49572, 152022, 1-262; 9926, MCF2L, 49574, 152024, 9-209; 9926, MCF2L, 49575, 152025, 1-566; 9926, MCF2L, 49576, 152026, 1-642; 9926, MCF2L, 49577, 152027, 1-952; 9926, MCF2L, 49578, 152028, 1-453; 9926, MCF2L, 49580, 152030, 1-282; 9926, MCF2L, 49581, 152031, 1-209; 9926, MCF2L, 49561, 152011, 158-3112; 9926, MCF2L, 49562, 152012, 198-3569; 9926, MCF2L, 49563, 152013, 59-3472; 9926, MCF2L, 49567, 152017, 38-3328; 9926, MCF2L, 49573, 152023, 357-3560; 9926, MCF2L, 49579, 152029, 160-3537; 9927, MCF2L2, 49585, 152035, 198-570; 9927, MCF2L2, 49582, 152032, 299-3643; 9927, MCF2L2, 49583, 152033, 109-2244; 9927, MCF2L2, 49584, 152034, 125-2011; 9927, MCF2L2, 49586, 152036, 1-3225; 9928, MKKS, 49589, 152039, 261-452; 9928, MKKS, 49587, 152037, 764-2476; 9928, MKKS, 49588, 152038, 888-2600; 9929, MDM1, 49591, 152041, 1-92; 9929, MDM1, 49595, 152045, 42-182; 9929, MDM1, 49596, 152046, 1-366; 9929, MDM1, 49597, 152047, 34-874; 9929, MDM1, 49590, 152040, 88-2232; 9929, MDM1, 49592, 152042, 80-289; 9929, MDM1, 49593, 152043, 42-2081; 9929, MDM1, 49594, 152044, 137-805; 9930, MTBP, 49599, 152049, 1-202; 9930, MTBP, 49598, 152048, 46-2760; 9930, MTBP, 49600, 152050, 50-1039; 9931, MDM2, 49601, 152051, 15-1343; 9931, MDM2, 49603, 152053, 1-1401; 9931, MDM2, 49605, 152055, 206-460; 9931, MDM2, 49606, 152056, 1-798; 9931, MDM2, 49609, 152059, 1-732; 9931, MDM2, 49610, 152060, 306-1037; 9931, MDM2, 49612, 152062, 75-842; 9931, MDM2, 49613, 152063, 68-754; 9931, MDM2, 49614, 152064, 306-1037; 9931, MDM2, 49615, 152065, 325-1725; 9931, MDM2, 49616, 152066, 75-505; 9931, MDM2, 49617, 152067, 114-326; 9931, MDM2, 49618, 152068, 1-183; 9931, MDM2, 49619, 152069, 1-393; 9931, MDM2, 49620, 152070, 1-150; 9931, MDM2, 49621, 152071, 1-108; 9931, MDM2, 49622, 152072, 75-427; 9931, MDM2, 49623, 152073, 1-213; 9931, MDM2, 49624, 152074, 1-237; 9931, MDM2, 49625, 152075, 1-237; 9931, MDM2, 49626, 152076, 75-845; 9931, MDM2, 49627, 152077, 1-255; 9931, MDM2, 49628, 152078, 1-156; 9931, MDM2, 49629, 152079, 1-513; 9931, MDM2, 49630, 152080, 1-237; 9931, MDM2, 49602, 152052, 303-1796; 9931, MDM2, 49604, 152054, 1-966; 9931, MDM2, 49607, 152057, 75-1040; 9931, MDM2, 49608, 152058, 1-891; 9931, MDM2, 49611, 152061, 1-657; 9932, MDM4, 49631, 152081, 58-697; 9932, MDM4, 49632, 152082, 30-425; 9932, MDM4, 49635, 152085, 167-589; 9932, MDM4, 49636, 152086, 1-513; 9932, MDM4, 49638, 152088, 1-423; 9932, MDM4, 49639, 152089, 167-970; 9932, MDM4, 49640, 152090, 167-517; 9932, MDM4, 49641, 152091, 167-1345; 9932, MDM4, 49642, 152092, 140-601; 9932, MDM4, 49633, 152083, 163-1635; 9932, MDM4, 49634, 152084, 167-661; 9932, MDM4, 49637, 152087, 167-1489; 9933, MECOM, 49644, 152094, 315-3473; 9933, MECOM, 49645, 152095, 263-638; 9933, MECOM, 49646, 152096, 1-965; 9933, MECOM, 49647, 152097, 99-3791; 9933, MECOM, 49648, 152098, 1482-1792; 9933, MECOM, 49649, 152099, 294-379; 9933, MECOM, 49650, 152100, 404-468; 9933, MECOM, 49651, 152101, 378-580; 9933, MECOM, 49652, 152102, 19-393; 9933, MECOM, 49653, 152103, 1223-1533; 9933, MECOM, 49656, 152106, 270-3428; 9933, MECOM, 49657, 152107, 787-1097; 9933, MECOM, 49658, 152108, 114-3125; 9933, MECOM, 49643, 152093, 140-3490; 9933, MECOM, 49654, 152104, 1202-4330; 9933, MECOM, 49655, 152105, 389-3544; 9933, MECOM, 49659, 152109, 270-3425; 9934, MTOR, 49661, 152111, 803-3067; 9934, MTOR, 49662, 152112, 212-694; 9934, MTOR, 49660, 152110, 78-7727; 9935, MKS1, 49663, 152113, 3-1373; 9935, MKS1, 49665, 152115, 7-501; 9935, MKS1, 49667, 152117, 16-381; 9935, MKS1, 49668, 152118, 1-352; 9935, MKS1, 49669, 152119, 24-170; 9935, MKS1, 49670, 152120, 76-516; 9935, MKS1, 49671, 152121, 1-686; 9935, MKS1, 49672, 152122, 1-636; 9935, MKS1, 49664, 152114, 76-1755; 9935, MKS1, 49666, 152116, 95-1744; 9936, MED1, 49675, 152125, 211-450; 9936, MED1, 49676, 152126, 211-504; 9936, MED1, 49673, 152123, 225-4970; 9936, MED1, 49674, 152124, 207-1877; 9937, MED10, 49677, 152127, 112-519; 9938, MED11, 49679, 152129, 60-341; 9938, MED11, 49680, 152130, 63-320; 9938, MED11, 49678, 152128, 57-410; 9939, MED12, 49681, 152131, 659-6742; 9939, MED12, 49684, 152134, 1-389; 9939, MED12, 49685, 152135, 1-752; 9939, MED12, 49682, 152132, 33-6566; 9939, MED12, 49683, 152133, 61-6591; 9940, MED12L, 49686, 152136, 34-5463; 9940, MED12L, 49690, 152140, 1-223; 9940, MED12L, 49687, 152137, 534-2804; 9940, MED12L, 49688, 152138, 534-2699; 9940, MED12L, 49689, 152139, 39-6476; 9941, MED13, 49692, 152142, 1-982; 9941,

MED13, 49691, 152141, 78-6602; 9942, MED13L, 49694, 152144, 1-572; 9942, MED13L, 49695, 152145, 289-568; 9942, MED13L, 49696, 152146, 1-423; 9942, MED13L, 49697, 152147, 1-584; 9942, MED13L, 49693, 152143, 208-6840; 9943, MED14, 49699, 152149, 1-468; 9943, MED14, 49700, 152150, 1-996; 9943, MED14, 49698, 152148, 120-4484; 9944, MED15, 49704, 152154, 129-2297; 9944, MED15, 49705, 152155, 224-596; 9944, MED15, 49706, 152156, 95-262; 9944, MED15, 49707, 152157, 294-717; 9944, MED15, 49708, 152158, 93-589; 9944, MED15, 49709, 152159, 231-590; 9944, MED15, 49710, 152160, 103-418; 9944, MED15, 49711, 152161, 282-598; 9944, MED15, 49712, 152162, 1-581; 9944, MED15, 49713, 152163, 139-303; 9944, MED15, 49714, 152164, 217-573; 9944, MED15, 49715, 152165, 327-572; 9944, MED15, 49716, 152166, 226-411; 9944, MED15, 49717, 152167, 142-623; 9944, MED15, 49718, 152168, 21-131; 9944, MED15, 49701, 152151, 70-2436; 9944, MED15, 49702, 152152, 78-2324; 9944, MED15, 49703, 152153, 39-2072; 9945, MED16, 49719, 152169, 134-790; 9945, MED16, 49724, 152174, 18-1403; 9945, MED16, 49725, 152175, 92-316; 9945, MED16, 49726, 152176, 488-635; 9945, MED16, 49727, 152177, 18-1628; 9945, MED16, 49728, 152178, 150-2141; 9945, MED16, 49729, 152179, 1-1517; 9945, MED16, 49730, 152180, 1-238; 9945, MED16, 49731, 152181, 18-677; 9945, MED16, 49732, 152182, 18-599; 9945, MED16, 49733, 152183, 18-425; 9945, MED16, 49734, 152184, 1-1115; 9945, MED16, 49735, 152185, 1-1493; 9945, MED16, 49736, 152186, 1-1442; 9945, MED16, 49737, 152187, 1-135; 9945, MED16, 49738, 152188, 1-677; 9945, MED16, 49739, 152189, 1-851; 9945, MED16, 49740, 152190, 1-470; 9945, MED16, 49741, 152191, 1-238; 9945, MED16, 49742, 152192, 1-1385; 9945, MED16, 49720, 152170, 127-2709; 9945, MED16, 49721, 152171, 152-2785; 9945, MED16, 49722, 152172, 152-2677; 9945, MED16, 49723, 152173, 1-2634; 9946, MED17, 49744, 152194, 153-847; 9946, MED17, 49745, 152195, 104-904; 9946, MED17, 49746, 152196, 102-530; 9946, MED17, 49743, 152193, 288-2243; 9946, MED17, 49747, 152197, 233-670; 9947, MED18, 49748, 152198, 210-836; 9947, MED18, 49749, 152199, 193-819; 9948, MED19, 49751, 152201, 31-765; 9948, MED19, 49750, 152200, 23-607; 9949, MED20, 49753, 152203, 112-531; 9949, MED20, 49754, 152204, 76-513; 9949, MED20, 49756, 152206, 126-307; 9949, MED20, 49757, 152207, 82-717; 9949, MED20, 49752, 152202, 82-720; 9949, MED20, 49755, 152205, 102-473; 9950, MED21, 49759, 152209, 35-514; 9950, MED21, 49760, 152210, 19-282; 9950, MED21, 49758, 152208, 31-465; 9951, MED22, 49762, 152212, 215-619; 9951, MED22, 49763, 152213, 148-560; 9951, MED22, 49764, 152214, 229-561; 9951, MED22, 49765, 152215, 128-532; 9951, MED22, 49769, 152219, 229-561; 9951, MED22, 49770, 152220, 235-657; 9951, MED22, 49771, 152221, 583-1185; 9951, MED22, 49772, 152222, 128-532; 9951, MED22, 49773, 152223, 255-677; 9951, MED22, 49774, 152224, 215-619; 9951, MED22, 49775, 152225, 148-560; 9951, MED22, 49776, 152226, 235-837; 9951, MED22, 49761, 152211, 235-837; 9951, MED22, 49766, 152216, 235-657; 9951, MED22, 49767, 152217, 255-677; 9951, MED22, 49768, 152218, 583-1185; 9952, MED23, 49779, 152229, 18-4142; 9952, MED23, 49777, 152227, 157-4254; 9952, MED23, 49778, 152228, 151-2811; 9952, MED23, 49780, 152230, 181-4275; 9952, MED23, 49781, 152231, 181-4287; 9952, MED23, 49782, 152232, 12-1439; 9953, MED24, 49784, 152234, 420-3464; 9953, MED24, 49787, 152237, 201-1105; 9953, MED24, 49788, 152238, 1-879; 9953, MED24, 49789, 152239, 1-253; 9953, MED24, 49790, 152240, 60-628; 9953, MED24, 49791, 152241, 60-548; 9953, MED24, 49792, 152242, 83-385; 9953, MED24, 49793, 152243, 11-3037; 9953, MED24, 49794, 152244, 69-2441; 9953, MED24, 49795, 152245, 64-592; 9953, MED24, 49796, 152246, 120-597; 9953, MED24, 49797, 152247, 1-417; 9953, MED24, 49798, 152248, 152-580; 9953, MED24, 49799, 152249, 1-173; 9953, MED24, 49800, 152250, 152-567; 9953, MED24, 49801, 152251, 1-70; 9953, MED24, 49802, 152252, 49-1963; 9953, MED24, 49803, 152253, 442-604; 9953, MED24, 49804, 152254, 18-431; 9953, MED24, 49783, 152233, 85-3015; 9953, MED24, 49785, 152235, 105-3035; 9953, MED24, 49786, 152236, 83-3052; 9954, MED25, 49807, 152257, 1-760; 9954, MED25, 49808, 152258, 1-746; 9954, MED25, 49809, 152259, 64-606; 9954, MED25, 49810, 152260, 1-780; 9954, MED25, 49811, 152261, 1-1449; 9954, MED25, 49812, 152262, 64-765; 9954, MED25, 49813, 152263, 64-1257; 9954, MED25, 49814, 152264, 2154-2906; 9954, MED25, 49815, 152265, 64-1512; 9954, MED25, 49805, 152255, 54-2297; 9954, MED25, 49806, 152256, 1-1605; 9955, MED26, 49817, 152267, 208-539; 9955, MED26, 49818, 152268, 104-742; 9955, MED26, 49819, 152269, 395-558; 9955, MED26, 49820, 152270, 231-478; 9955, MED26, 49816, 152266, 264-2066; 9955, MED26, 49821, 152271, 1-279; 9956, MED27, 49822, 152272, 65-1000; 9956, MED27, 49823, 152273, 23-850; 9956, MED27, 49824, 152274, 23-415; 9957, MED28, 49826, 152276, 1-540; 9957, MED28, 49827, 152277, 4-582; 9957, MED28, 49825, 152275, 25-561; 9958, MED29, 49828, 152278, 50-715; 9958, MED29, 49829, 152279, 58-348; 9958, MED29, 49830, 152280, 36-380; 9958, MED29, 49833, 152283, 12-636; 9958, MED29, 49834, 152284, 38-703; 9958, MED29, 49831, 152281, 28-630; 9958, MED29, 49832, 152282, 31-621; 9959, MED30, 49835, 152285, 165-701; 9959, MED30, 49836, 152286, 45-476; 9960, MED31, 49838, 152288, 107-238; 9960, MED31, 49839, 152289, 274-447; 9960, MED31, 49837, 152287, 107-502; 9961, MED4, 49842, 152292, 197-911; 9961, MED4, 49843, 152293, 1-460; 9961, MED4, 49840, 152290, 27-839; 9961, MED4, 49841, 152291, 86-760; 9962, MED6, 49847, 152297, 7-756; 9962, MED6, 49848, 152298, 54-827; 9962, MED6, 49844, 152294, 31-771; 9962, MED6, 49845, 152295, 19-564; 9962, MED6, 49846, 152296, 19-780; 9963, MED7, 49851, 152301, 394-979; 9963, MED7, 49849, 152299, 383-1084; 9963, MED7, 49850, 152300, 393-1094; 9964, MED8, 49852, 152302, 45-950; 9964, MED8, 49853, 152303, 331-870; 9964, MED8, 49854, 152304, 45-851; 9965, MED9, 49856, 152306, 18-266; 9965, MED9, 49857, 152307, 49-297; 9965, MED9, 49855, 152305, 57-497; 9966, MEMO1, 49860, 152310, 252-554; 9966, MEMO1, 49863, 152313, 255-315; 9966, MEMO1, 49858, 152308, 311-1204; 9966, MEMO1, 49859, 152309, 58-960; 9966, MEMO1, 49861, 152311, 51-944; 9966, MEMO1, 49862, 152312, 129-953; 9967, MDC1, 49867, 152317, 203-582; 9967, MDC1, 49868, 152318, 244-583; 9967, MDC1, 49869, 152319, 96-582; 9967, MDC1, 49870, 152320, 244-583; 9967, MDC1, 49871, 152321, 96-582; 9967, MDC1, 49872, 152322, 244-583; 9967, MDC1, 49873, 152323, 96-582; 9967, MDC1, 49874, 152324, 96-582; 9967, MDC1, 49875, 152325, 203-582; 9967, MDC1, 49876, 152326, 244-583; 9967, MDC1, 49877, 152327, 1-916; 9967, MDC1, 49878, 152328, 1-916; 9967, MDC1, 49879, 152329, 96-582; 9967, MDC1, 49881, 152331, 203-582; 9967, MDC1, 49882, 152332, 1-916; 9967, MDC1, 49883, 152333, 96-582; 9967, MDC1, 49884, 152334, 1-916; 9967, MDC1, 49885, 152335, 203-582; 9967, MDC1, 49886, 152336, 1-916; 9967, MDC1, 49887, 152337, 203-582; 9967, MDC1, 49888, 152338, 96-582; 9967, MDC1, 49890, 152340, 203-582; 9967, MDC1, 49891, 152341, 244-583; 9967, MDC1, 49892, 152342, 1-916; 9967, MDC1, 49893, 152343, 203-582; 9967, MDC1, 49894, 152344, 96-582; 9967, MDC1, 49895, 152345, 244-583; 9967, MDC1, 49896, 152346, 1-916; 9967, MDC1, 49898, 152348, 203-582; 9967, MDC1, 49899, 152349, 244-583; 9967, MDC1, 49900, 152350, 1-916; 9967, MDC1, 49901, 152351, 244-583; 9967, MDC1, 49904, 152354, 198-626; 9967, MDC1, 49905, 152355, 198-626; 9967, MDC1, 49906, 152356, 198-626; 9967, MDC1, 49907, 152357, 198-626; 9967, MDC1, 49908, 152358, 198-626; 9967, MDC1, 49909, 152359, 198-626; 9967, MDC1, 49910, 152360, 198-626; 9967, MDC1, 49911, 152361, 198-626; 9967, MDC1, 49864, 152314, 649-6918; 9967, MDC1, 49865, 152315, 649-6918; 9967, MDC1, 49866, 152316, 649-6918; 9967, MDC1, 49880, 152330, 649-6918; 9967, MDC1, 49889, 152339, 649-6918; 9967, MDC1, 49897, 152347, 649-6918; 9967, MDC1, 49902, 152352, 649-6918; 9967, MDC1, 49903, 152353, 649-6918; 9968, MEFV, 49913, 152363, 41-1846; 9968, MEFV, 49914, 152364, 41-1513; 9968, MEFV, 49915, 152365, 41-1882; 9968, MEFV, 49917, 152367, 41-1249; 9968, MEFV, 49918, 152368, 1-288; 9968, MEFV, 49919, 152369, 41-1975; 9968, MEFV, 49921, 152371, 1-921; 9968, MEFV, 49922, 152372, 1-288; 9968, MEFV, 49923, 152373, 1-288; 9968, MEFV, 49924, 152374, 1-306; 9968, MEFV, 49925, 152375, 1-1236; 9968, MEFV, 49912, 152362, 41-2386; 9968, MEFV, 49916, 152366, 1-1338; 9968, MEFV, 49920, 152370, 1-1713; 9969, MAMSTR, 49928, 152378, 382-415; 9969, MAMSTR, 49929, 152379, 57-714; 9969, MAMSTR, 49926, 152376, 65-1312; 9969, MAMSTR, 49927, 152377, 616-1554; 9969, MAMSTR, 49930, 152380, 680-1423; 9970, MKL1, 49932, 152382, 592-2988; 9970, MKL1, 49933, 152383, 192-677; 9970, MKL1, 49934, 152384, 598-3243; 9970, MKL1, 49936, 152386, 350-569; 9970, MKL1, 49937, 152387, 1-2649; 9970, MKL1, 49938, 152388, 246-3146; 9970, MKL1, 49939, 152389, 1339-1596; 9970, MKL1, 49940, 152390, 1-2400; 9970, MKL1, 49931, 152381, 592-3387; 9970, MKL1, 49935, 152385, 208-3003; 9971, MATK, 49944, 152394, 556-594; 9971, MATK, 49945, 152395, 1-711; 9971, MATK, 49946, 152396, 201-724; 9971, MATK, 49947, 152397, 448-562; 9971, MATK, 49948, 152398, 320-571; 9971, MATK, 49949, 152399, 266-1786; 9971, MATK, 49950, 152400, 348-741; 9971, MATK, 49951, 152401, 1-801; 9971, MATK, 49952, 152402, 266-1849; 9971, MATK, 49941, 152391, 400-1923; 9971, MATK, 49942, 152392, 297-1697; 9971, MATK, 49943, 152393, 339-1865; 9971, MATK, 49953, 152403, 1-1527; 9972, MLC1, 49956, 152406, 90-758; 9972, MLC1, 49954, 152404, 608-1741; 9972, MLC1, 49955, 152405, 276-1409; 9973, M1AP, 49959, 152409, 98-565; 9973, M1AP, 49960, 152410, 127-408; 9973, M1AP, 49961, 152411, 119-544; 9973, M1AP, 49957, 152407, 118-1710; 9973, M1AP, 49958, 152408, 53-1633; 9973, M1AP, 49962, 152412, 127-1707; 9974, MEIOB, 49966, 152416, 647-807; 9974, MEIOB, 49967, 152417, 794-1588; 9974, MEIOB, 49968, 152418, 113-244; 9974, MEIOB, 49963, 152413, 11-1426; 9974, MEIOB, 49964, 152414, 196-1524; 9974, MEIOB, 49965, 152415, 196-1611; 9975, MEIG1, 49969, 152419, 31-297; 9975, MEIG1, 49970, 152420, 149-415; 9976, MNS1, 49971, 152421, 166-1653; 9977, MEI1, 49974, 152424, 1-190; 9977, MEI1, 49975, 152425, 806-2326; 9977, MEI1, 49972, 152422, 41-3865; 9977, MEI1, 49973, 152423, 1-717; 9978, MEI4, 49976, 152426, 15-1172; 9979, MEIKIN, 49977, 152427, 194-1195; 9979, MEIKIN, 49978, 152428, 1-314; 9979, MEIKIN, 49979, 152429, 194-1315; 9980, MND1, 49981, 152431, 43-540; 9980, MND1, 49982, 152432, 197-502; 9980, MND1, 49983, 152433, 58-438; 9980, MND1, 49984, 152434, 90-458; 9980, MND1, 49980, 152430, 90-707; 9981, MEIS1, 49987, 152437, 1-363; 9981, MEIS1, 49988, 152438, 308-1285; 9981, MEIS1, 49989, 152439, 725-1837; 9981, MEIS1, 49990, 152440, 300-1436; 9981, MEIS1, 49985, 152435, 458-1630; 9981, MEIS1, 49986, 152436, 339-1730; 9982, MEIS2, 49998, 152448, 270-552; 9982, MEIS2, 49999, 152449, 291-605; 9982, MEIS2, 50001, 152451, 17-313; 9982, MEIS2, 50003, 152453, 618-1088; 9982, MEIS2, 50005, 152455, 1-420; 9982, MEIS2, 50006, 152456, 1-705; 9982, MEIS2, 49991, 152441, 256-1164; 9982, MEIS2, 49992, 152442, 436-1581; 9982, MEIS2, 49993, 152443, 448-1860; 9982, MEIS2, 49994, 152444, 726-1646; 9982, MEIS2, 49995, 152445, 352-1272; 9982, MEIS2, 49996, 152446, 1065-2270; 9982, MEIS2, 49997, 152447, 434-1579; 9982, MEIS2, 50000, 152450, 131-1297; 9982, MEIS2, 50002, 152452, 256-1440; 9982, MEIS2, 50004, 152454, 420-1853; 9983, MEIS3, 50007, 152457, 443-1657; 9983, MEIS3, 50010, 152460, 1-532; 9983, MEIS3, 50012, 152462, 1-753; 9983, MEIS3, 50013, 152463, 46-1437; 9983, MEIS3, 50015, 152465, 1-378; 9983, MEIS3, 50016, 152466, 72-733; 9983, MEIS3, 50008, 152458, 235-1311; 9983, MEIS3, 50009, 152459, 42-1307; 9983, MEIS3, 50011, 152461, 208-1473; 9983, MEIS3, 50014, 152464, 189-1316; 9984, MLANA, 50017, 152467, 407-763; 9984, MLANA, 50018, 152468, 200-556; 9984, MLANA, 50019, 152469, 161-517; 9985, MCHR1, 50021, 152471, 174-1064; 9985, MCHR1, 50020, 152470, 697-1965; 9986, MCHR2, 50022, 152472, 316-1338; 9986, MCHR2, 50023, 152473, 101-1123; 9987, MC1R, 50025, 152475, 2304-3452; 9987, MC1R, 50024, 152474, 1381-2334; 9988, MC2R, 50027, 152477, 207-576; 9988, MC2R, 50026, 152476, 182-1075; 9989, MRAP, 50028, 152478, 123-641; 9989, MRAP, 50029, 152479, 1-309; 9989, MRAP, 50030, 152480, 188-706; 9990, MRAP2, 50031, 152481, 136-753; 9991, MC3R, 50032, 152482, 113-1084; 9992, MC4R, 50033, 152483, 427-1425; 9993, MCSR, 50035, 152485, 160-678; 9993, MCSR, 50034, 152484, 223-1200; 9994, MAGEA1, 50036, 152486, 220-1149; 9995, MAGEA10, 50039, 152489, 417-901; 9995, MAGEA10, 50040, 152490, 229-781; 9995, MAGEA10, 50041, 152491, 539-713; 9995, MAGEA10, 50042, 152492, 324-536; 9995, MAGEA10, 50037, 152487, 434-1543; 9995, MAGEA10, 50038, 152488, 318-1427; 9996, MAGEA11, 50043, 152493, 153-1355; 9996, MAGEA11, 50045, 152495, 200-1085; 9996, MAGEA11, 50044, 152494, 103-1392; 9997, MAGEA12, 50046, 152496, 157-1101; 9997, MAGEA12, 50047, 152497, 263-1207; 9997, MAGEA12, 50048, 152498, 355-1299; 9998, MAGEA2, 50053, 152503, 484-725; 9998, MAGEA2, 50054, 152504, 466-576; 9998, MAGEA2, 50049, 152499, 163-1107; 9998, MAGEA2, 50050, 152500, 343-1287; 9998, MAGEA2, 50051, 152501, 229-1173; 9998, MAGEA2, 50052, 152502, 524-1468; 9998, MAGEA2, 50055, 152505, 447-1391; 9998, MAGEA2, 50056, 152506, 510-1454; 9998, MAGEA2, 50057, 152507, 526-1470; 9999, MAGEA2B, 50060, 152510, 345-445; 9999, MAGEA2B, 50061, 152511, 484-750; 9999, MAGEA2B, 50062, 152512, 466-576; 9999, MAGEA2B, 50063, 152513, 424-879; 9999, MAGEA2B, 50064, 152514, 293-652; 9999, MAGEA2B, 50065, 152515, 309-753; 9999, MAGEA2B, 50058, 152508, 447-1391; 9999, MAGEA2B, 50059, 152509, 214-1158; 10000, MAGEA3, 50067, 152517, 259-853; 10000, MAGEA3, 50066, 152516, 210-1154; 10000, MAGEA3, 50068, 152518, 259-1203; 10001, MAGEA4, 50075, 152525, 340-854; 10001, MAGEA4, 50076, 152526, 274-997; 10001, MAGEA4, 50077, 152527, 264-914; 10001, MAGEA4, 50078, 152528, 339-1029; 10001, MAGEA4, 50079, 152529, 263-986; 10001, MAGEA4, 50080, 152530, 264-914; 10001, MAGEA4, 50081, 152531, 267-990; 10001, MAGEA4, 50082, 152532, 267-990; 10001, MAGEA4, 50069, 152519, 219-1172; 10001, MAGEA4, 50070, 152520, 268-1221; 10001, MAGEA4, 50071, 152521, 268-1221; 10001, MAGEA4, 50072, 152522, 268-1221; 10001, MAGEA4, 50073, 152523, 216-1169; 10001, MAGEA4, 50074, 152524, 222-1175; 10002, MAGEA6, 50084, 152534, 215-921; 10002, MAGEA6, 50085, 152535, 259-862; 10002, MAGEA6, 50083, 152533, 226-1170; 10002, MAGEA6, 50086, 152536, 259-1203; 10003, MAGEA8, 50087, 152537, 217-1173; 10003, MAGEA8, 50088, 152538, 550-1506; 10003, MAGEA8, 50089, 152539, 522-1478; 10004, MAGEA9, 50090, 152540, 288-1235; 10005, MAGEA9B, 50091, 152541, 195-536; 10005, MAGEA9B, 50092, 152542, 303-594; 10005, MAGEA9B, 50094, 152544, 305-891; 10005, MAGEA9B, 50093, 152543, 281-1228; 10006, MAGEB1, 50095, 152545, 322-1365; 10006, MAGEB1, 50096, 152546, 164-1207; 10006, MAGEB1, 50097, 152547, 238-1281; 10007, MAGEB10, 50098, 152548, 246-1289; 10007, MAGEB10, 50099, 152549, 50-1093; 10008, MAGEB16, 50104, 152554, 100-1170; 10008, MAGEB16, 50100, 152550, 129-1103; 10008, MAGEB16, 50101, 152551, 198-1172; 10008, MAGEB16, 50102, 152552, 144-1118; 10008, MAGEB16, 50103, 152553, 280-1254; 10009, MAGEB17, 50105, 152555, 298-1308; 10009, MAGEB17, 50106, 152556, 353-1363; 10010, MAGEB18, 50107, 152557, 188-1219; 10011, MAGEB2, 50108, 152558, 102-1061; 10012, MAGEB3, 50109, 152559, 738-1778; 10012, MAGEB3, 50110, 152560, 32-1072; 10013, MAGEB4, 50111, 152561, 85-1125; 10014, MAGEB5, 50112, 152562, 248-1075; 10015, MAGEB6, 50113, 152563, 150-1373; 10016, MAGEB6P1, 50114, 152564, 1-1224; 10017, MAGEC1, 50115, 152565, 287-3715; 10017, MAGEC1, 50116, 152566, 374-1003; 10018, MAGEC2, 50117, 152567, 349-1470; 10019, MAGEC3, 50120, 152570, 161-961; 10019, MAGEC3, 50118, 152568, 1-1932; 10019, MAGEC3, 50119, 152569, 111-1151; 10019, MAGEC3, 50121, 152571, 528-1568; 10020, MAGED1, 50122, 152572, 191-2527; 10020, MAGED1, 50123, 152573, 154-2658; 10020, MAGED1, 50124, 152574, 253-2589; 10020, MAGED1, 50125, 152575, 148-2484; 10021, MAGED2, 50127, 152577, 86-1852; 10021, MAGED2, 50130, 152580, 93-1658; 10021, MAGED2, 50133, 152583, 234-1799; 10021, MAGED2, 50126, 152576, 126-1946; 10021, MAGED2, 50128, 152578, 234-2054; 10021, MAGED2, 50129, 152579, 93-1913; 10021, MAGED2, 50131, 152581, 234-2054; 10021, MAGED2, 50132, 152582, 194-2014; 10022, MAGED4, 50134, 152584, 56-2275; 10022, MAGED4, 50135, 152585, 196-2469; 10023, MAGED4B, 50139, 152589, 1-147; 10023, MAGED4B, 50140, 152590, 1-101; 10023, MAGED4B, 50142, 152592, 75-889; 10023, MAGED4B, 50136, 152586, 151-2376; 10023, MAGED4B, 50137, 152587, 71-2290; 10023, MAGED4B, 50138, 152588, 143-2416; 10023, MAGED4B, 50141, 152591, 55-2280; 10024, MAGEE1, 50143, 152593, 208-3081; 10025, MAGEE2, 50144, 152594, 186-1757; 10026, MAGEF1, 50145, 152595, 182-1105; 10027, MAGEH1, 50146, 152596, 271-930; 10028, MAGEL2, 50147, 152597, 100-3849; 10029, MUM1, 50149, 152599, 27-266; 10029, MUM1, 50150, 152600, 377-522; 10029, MUM1, 50151, 152601, 77-2212; 10029, MUM1, 50152, 152602, 226-1018; 10029, MUM1, 50153, 152603, 101-340; 10029, MUM1, 50154, 152604, 74-313; 10029, MUM1, 50155, 152605, 100-2235; 10029, MUM1, 50156, 152606, 1-2199; 10029, MUM1, 50148, 152598, 27-2225; 10030, MUM1L1, 50160, 152610, 650-1924; 10030, MUM1L1, 50157, 152607, 786-2876; 10030, MUM1L1, 50158, 152608, 650-2740; 10030, MUM1L1, 50159, 152609, 435-2525; 10031, MCAM, 50161, 152611, 16-1956; 10032, MIA, 50165, 152615, 1-287; 10032, MIA, 50166, 152616, 1-176; 10032, MIA, 50167, 152617, 423-559; 10032, MIA, 50162, 152612, 167-562; 10032, MIA, 50163, 152613, 53-448; 10032, MIA, 50164, 152614, 42-437; 10033, MIA2, 50169, 152619, 278-554; 10033, MIA2, 50168, 152618, 200-2164; 10034, MIA3, 50173, 152623, 1-3045; 10034, MIA3, 50174, 152624, 1-322; 10034, MIA3, 50170, 152620, 26-5749; 10034, MIA3, 50171, 152621, 4-1506; 10034, MIA3, 50172, 152622, 174-2531; 10035, MLPH, 50179, 152629, 1-598; 10035, MLPH, 50180, 152630, 1-438; 10035, MLPH, 50181, 152631, 355-565; 10035, MLPH, 50182, 152632, 1-610; 10035, MLPH, 50183, 152633, 351-744; 10035, MLPH, 50184, 152634, 1-709; 10035, MLPH, 50185, 152635, 1-1083; 10035, MLPH, 50175, 152625, 295-2097; 10035, MLPH, 50176, 152626, 212-1930; 10035, MLPH, 50177, 152627, 394-1767; 10035, MLPH, 50178, 152628, 187-1629; 10036, MREG, 50187, 152637, 239-584; 10036, MREG, 50188, 152638, 190-576; 10036, MREG, 50189, 152639, 203-560; 10036, MREG, 50186, 152636, 297-941; 10036, MREG, 50190, 152640, 287-931; 10037, MTNR1A, 50191, 152641, 203-1255; 10038, MTNR1B, 50193, 152643, 1-340; 10038, MTNR1B, 50194, 152644, 1-240; 10038, MTNR1B, 50192, 152642, 7-1095; 10039, MAGI1, 50197, 152647, 1-556; 10039, MAGI1, 50198, 152648, 1-3396; 10039, MAGI1, 50199, 152649, 1-3410; 10039, MAGI1, 50201, 152651, 1-3045; 10039, MAGI1, 50203, 152653, 611-4078; 10039, MAGI1, 50204, 152654, 611-3553; 10039, MAGI1, 50205, 152655, 611-4078; 10039, MAGI1, 50206, 152656, 1-3483; 10039, MAGI1, 50207, 152657, 1-3396; 10039, MAGI1, 50208, 152658, 243-4013; 10039, MAGI1, 50209, 152659, 1-3864; 10039, MAGI1, 50210, 152660, 1-4389; 10039, MAGI1, 50211, 152661, 1-556; 10039, MAGI1, 50212, 152662, 1-3045; 10039, MAGI1, 50213, 152663, 611-3553; 10039, MAGI1, 50214, 152664, 1-3410; 10039, MAGI1, 50195, 152645, 1-3864; 10039, MAGI1, 50196, 152646, 1-4389; 10039, MAGI1, 50200, 152650, 243-4013; 10039, MAGI1, 50202, 152652, 1-3483; 10040, MAGI2, 50217, 152667, 140-3991; 10040, MAGI2, 50218, 152668, 1-3912; 10040, MAGI2, 50219, 152669, 302-1969; 10040, MAGI2, 50220, 152670, 334-3696; 10040, MAGI2, 50221, 152671, 1-715; 10040, MAGI2, 50222, 152672, 1-552; 10040, MAGI2, 50223, 152673, 268-2853; 10040, MAGI2, 50224, 152674, 1-318; 10040, MAGI2, 50225, 152675, 798-2285; 10040, MAGI2, 50226, 152676, 545-3865; 10040, MAGI2, 50227, 152677, 1-3954; 10040, MAGI2, 50228, 152678, 268-492; 10040, MAGI2, 50215, 152665, 255-4622; 10040, MAGI2, 50216, 152666, 236-4561; 10041, MAGI3, 50229, 152679, 76-4521; 10041, MAGI3, 50230, 152680, 46-3423; 10041, MAGI3, 50231, 152681, 63-3440; 10041, MAGI3, 50232, 152682, 286-3738; 10042, MBOAT1, 50233, 152683, 166-1653; 10043, MBOAT2, 50235, 152685, 52-580; 10043, MBOAT2, 50236, 152686, 1-477; 10043, MBOAT2, 50237, 152687, 96-236; 10043, MBOAT2, 50234, 152684, 200-1762; 10044, MBOAT4, 50238, 152688, 86-1393; 10045, MBOAT7, 50242, 152692, 109-876; 10045, MBOAT7, 50243, 152693, 110-322; 10045, MBOAT7, 50244, 152694, 1-372; 10045, MBOAT7, 50245, 152695, 47-557; 10045, MBOAT7, 50247, 152697, 1-545; 10045, MBOAT7, 50248, 152698, 144-911; 10045, MBOAT7, 50249, 152699, 641-1840; 10045, MBOAT7, 50250, 152700, 549-1967; 10045, MBOAT7, 50251, 152701, 549-1967; 10045, MBOAT7, 50253, 152703, 144-911; 10045, MBOAT7, 50254, 152704, 549-1967; 10045, MBOAT7, 50255, 152705, 47-557; 10045, MBOAT7, 50257, 152707, 562-1761; 10045, MBOAT7, 50258, 152708, 109-876; 10045, MBOAT7, 50259, 152709, 339-1373; 10045, MBOAT7, 50260, 152710, 562-1761; 10045, MBOAT7, 50261, 152711, 562-1761; 10045, MBOAT7, 50262, 152712, 339-1373; 10045, MBOAT7, 50263, 152713, 110-322; 10045, MBOAT7, 50265, 152715, 641-1840; 10045, MBOAT7, 50266, 152716, 641-1840; 10045, MBOAT7, 50267, 152717, 641-1840; 10045, MBOAT7, 50268, 152718, 562-1761; 10045, MBOAT7, 50269, 152719, 549-1967; 10045, MBOAT7, 50270, 152720, 47-564; 10045, MBOAT7, 50271, 152721, 1-545; 10045, MBOAT7, 50272, 152722, 641-1840; 10045, MBOAT7, 50273, 152723, 549-1967; 10045, MBOAT7, 50274, 152724, 562-1761; 10045, MBOAT7, 50275, 152725, 562-1761; 10045, MBOAT7, 50276, 152726, 562-1761; 10045, MBOAT7, 50277, 152727, 1-372; 10045, MBOAT7, 50280, 152730, 47-564; 10045, MBOAT7, 50281, 152731, 549-1967; 10045, MBOAT7, 50283, 152733, 549-1967; 10045, MBOAT7, 50239, 152689, 482-1900; 10045, MBOAT7, 50240, 152690, 248-1447; 10045, MBOAT7, 50241, 152691, 339-1373; 10045, MBOAT7, 50246, 152696, 641-1840; 10045, MBOAT7, 50252, 152702, 562-1761; 10045, MBOAT7, 50256, 152706, 339-1373; 10045, MBOAT7, 50264, 152714, 549-1967; 10045, MBOAT7, 50278, 152728, 641-1840; 10045, MBOAT7, 50279, 152729, 248-1447; 10045, MBOAT7, 50282, 152732, 482-1900; 10046, MFRP, 50287, 152737, 105-410; 10046, MFRP, 50284, 152734, 153-1538; 10046, MFRP, 50285, 152735, 1-565; 10046, MFRP, 50286, 152736, 161-1900; 10047, MMGT1, 50288, 152738, 389-784; 10048, MME, 50290, 152740, 457-699; 10048, MME, 50292, 152742, 110-593; 10048, MME, 50293, 152743, 279-324; 10048, MME, 50295, 152745, 310-667; 10048, MME, 50297, 152747, 157-856; 10048, MME, 50299, 152749, 613-892; 10048, MME, 50301, 152751, 457-696; 10048, MME, 50302, 152752, 121-363; 10048, MME, 50289, 152739, 79-2331; 10048, MME, 50291, 152741, 135-2387; 10048, MME, 50294, 152744, 121-2373; 10048, MME, 50296, 152746, 213-2465; 10048, MME, 50298, 152748, 212-2464; 10048, MME, 50300, 152750, 1-2253; 10049, MMEL1, 50306, 152756, 1-201; 10049, MMEL1, 50310, 152760, 1-201; 10049, MMEL1, 50303, 152753, 163-2502; 10049, MMEL1, 50304, 152754, 11-1879; 10049, MMEL1, 50305, 152755, 11-1846; 10049, MMEL1, 50307, 152757, 11-1879; 10049, MMEL1, 50308, 152758, 163-2502; 10049, MMEL1, 50309, 152759, 11-1846; 10050, MPP1, 50311, 152761, 126-519; 10050, MPP1, 50313, 152763, 71-794; 10050, MPP1, 50315, 152765, 155-424; 10050, MPP1, 50316, 152766, 113-581; 10050, MPP1, 50318, 152768, 84-290; 10050, MPP1, 50319, 152769, 113-729; 10050, MPP1, 50312, 152762, 149-1549; 10050, MPP1, 50314, 152764, 25-1365; 10050, MPP1, 50317, 152767, 394-1704; 10051, MPP2, 50320, 152770, 306-1964; 10051, MPP2, 50321, 152771, 47-1756; 10051, MPP2, 50323, 152773, 58-1851; 10051, MPP2, 50324, 152774, 145-564; 10051, MPP2, 50325, 152775, 87-1817; 10051, MPP2, 50326, 152776, 289-741; 10051, MPP2, 50327, 152777, 289-857; 10051, MPP2, 50328, 152778, 104-534; 10051, MPP2, 50329, 152779, 449-543; 10051, MPP2, 50330, 152780, 369-588; 10051, MPP2, 50331, 152781, 168-545; 10051, MPP2, 50332, 152782, 66-1691; 10051, MPP2, 50333, 152783, 139-584; 10051, MPP2, 50334, 152784, 282-1907; 10051, MPP2, 50335, 152785, 836-2494; 10051, MPP2, 50336, 152786, 284-841; 10051, MPP2, 50337, 152787, 173-1798; 10051, MPP2, 50338, 152788, 256-592; 10051, MPP2, 50339, 152789, 503-2224; 10051, MPP2, 50322, 152772, 395-1636; 10052, MPP3, 50341, 152791, 262-2094; 10052, MPP3, 50342, 152792, 167-1114; 10052, MPP3, 50343, 152793, 1-63; 10052, MPP3, 50340, 152790, 167-1924; 10053, MPP4, 50345, 152795, 209-2101; 10053, MPP4, 50346, 152796, 227-1915; 10053, MPP4, 50347, 152797, 62-1366; 10053, MPP4, 50349, 152799, 238-1977; 10053, MPP4, 50350, 152800, 104-1996; 10053, MPP4, 50351, 152801, 166-2007; 10053, MPP4, 50352, 152802, 26-540; 10053, MPP4, 50353, 152803, 209-2029; 10053, MPP4, 50344, 152794, 209-1990; 10053, MPP4, 50348, 152798, 209-2122; 10054, MPP5, 50355, 152805, 348-722; 10054, MPP5, 50356, 152806, 120-567; 10054, MPP5, 50358, 152808, 466-479; 10054, MPP5, 50354, 152804, 662-2689; 10054, MPP5, 50357, 152807, 218-2143; 10055, MPP6, 50361, 152811, 399-1685; 10055, MPP6, 50362, 152812, 269-1191; 10055, MPP6, 50363, 152813, 332-982; 10055, MPP6, 50364, 152814, 244-369; 10055, MPP6, 50365, 152815, 1-193; 10055, MPP6, 50366, 152816, 1-126; 10055, MPP6, 50359, 152809, 251-1873; 10055, MPP6, 50360, 152810, 300-1922; 10056, MPP7, 50370, 152820, 275-1210; 10056, MPP7, 50371, 152821, 134-1498; 10056, MPP7, 50367, 152817, 278-2008; 10056, MPP7, 50368, 152818, 356-2086; 10056, MPP7, 50369, 152819, 261-1991; 10057, MARCH1, 50374, 152824, 489-2126; 10057, MARCH1, 50375, 152825, 10-444; 10057, MARCH1, 50376, 152826, 234-656; 10057, MARCH1, 50372, 152822, 48-917; 10057, MARCH1, 50373, 152823, 31-849; 10057, MARCH1, 50377, 152827, 978-1847; 10058, MARCH10, 50380, 152830, 380-2779; 10058, MARCH10, 50381, 152831, 377-559; 10058, MARCH10, 50382, 152832, 286-2826; 10058, MARCH10, 50383, 152833, 1-495; 10058, MARCH10, 50384, 152834, 1-2082; 10058, MARCH10, 50378, 152828, 276-2702; 10058, MARCH10, 50379, 152829, 242-2668; 10059, MARCH11, 50386, 152836, 1-164; 10059, MARCH11, 50385, 152835, 201-1409; 10060, MARCH2, 50389, 152839, 440-562; 10060, MARCH2, 50390, 152840, 697-865; 10060, MARCH2, 50392, 152842, 245-485; 10060, MARCH2, 50393, 152843, 455-690; 10060, MARCH2, 50387, 152837, 171-911; 10060, MARCH2, 50388, 152838, 204-734; 10060, MARCH2, 50391, 152841, 456-1196; 10061, MARCH3, 50394, 152844, 516-1277; 10061, MARCH3, 50395, 152845, 58-474; 10062, MARCH4, 50396, 152846, 1768-3000; 10063, MARCH5, 50397, 152847, 333-1169; 10064, MARCH6, 50400, 152850, 137-1963; 10064, MARCH6, 50402, 152852, 189-422; 10064, MARCH6, 50398, 152848, 133-2865; 10064, MARCH6, 50399, 152849, 197-2785; 10064, MARCH6, 50401, 152851, 184-2601; 10065, MARCH7, 50406, 152856, 1-375; 10065, MARCH7, 50407, 152857, 256-559; 10065, MARCH7, 50408, 152858, 165-2072; 10065, MARCH7, 50403, 152853, 123-2237; 10065, MARCH7, 50404, 152854, 261-2375; 10065, MARCH7, 50405, 152855, 80-2080; 10066, MARCH8, 50412, 152862, 429-695; 10066, MARCH8, 50414, 152864, 1-114; 10066, MARCH8, 50409, 152859, 751-1626; 10066, MARCH8, 50410, 152860, 240-1115; 10066, MARCH8, 50411, 152861, 1-723; 10066, MARCH8, 50413, 152863, 263-1984; 10067, MARCH9, 50415, 152865, 432-1472; 10067, MARCH9, 50416, 152866, 448-1149; 10068, MBTPS1, 50418, 152868, 539-587; 10068, MBTPS1, 50419, 152869, 1-244; 10068,

MBTPS1, 50420, 152870, 145-582; 10068, MBTPS1, 50421, 152871, 1-405; 10068, MBTPS1, 50417, 152867, 497-3655; 10069, MBTPS2, 50422, 152872, 82-1074; 10069, MBTPS2, 50423, 152873, 100-1659; 10070, MS4A1, 50426, 152876, 540-558; 10070, MS4A1, 50428, 152878, 474-495; 10070, MS4A1, 50430, 152880, 116-970; 10070, MS4A1, 50431, 152881, 239-607; 10070, MS4A1, 50424, 152874, 154-1047; 10070, MS4A1, 50425, 152875, 195-1088; 10070, MS4A1, 50427, 152877, 112-504; 10070, MS4A1, 50429, 152879, 290-1183; 10071, MS4A10, 50432, 152882, 97-900; 10072, MS4A12, 50434, 152884, 58-578; 10072, MS4A12, 50435, 152885, 240-582; 10072, MS4A12, 50433, 152883, 58-861; 10072, MS4A12, 50436, 152886, 58-723; 10073, MS4A13, 50440, 152890, 559-744; 10073, MS4A13, 50437, 152887, 324-662; 10073, MS4A13, 50438, 152888, 324-782; 10073, MS4A13, 50439, 152889, 324-605; 10074, MS4A14, 50442, 152892, 566-2653; 10074, MS4A14, 50444, 152894, 84-368; 10074, MS4A14, 50445, 152895, 1-419; 10074, MS4A14, 50447, 152897, 100-612; 10074, MS4A14, 50448, 152898, 112-573; 10074, MS4A14, 50449, 152899, 115-559; 10074, MS4A14, 50450, 152900, 112-573; 10074, MS4A14, 50451, 152901, 154-1857; 10074, MS4A14, 50441, 152891, 278-2317; 10074, MS4A14, 50443, 152893, 145-2133; 10074, MS4A14, 50446, 152896, 92-2230; 10075, MS4A15, 50454, 152904, 84-647; 10075, MS4A15, 50452, 152902, 77-520; 10075, MS4A15, 50453, 152903, 80-802; 10075, MS4A15, 50455, 152905, 135-734; 10076, MS4A18, 50457, 152907, 13-1215; 10076, MS4A18, 50456, 152906, 1-969; 10077, MS4A2, 50459, 152909, 418-541; 10077, MS4A2, 50460, 152910, 103-702; 10077, MS4A2, 50458, 152908, 103-837; 10078, MS4A3, 50464, 152914, 54-305; 10078, MS4A3, 50461, 152911, 74-718; 10078, MS4A3, 50462, 152912, 129-635; 10078, MS4A3, 50463, 152913, 230-505; 10078, MS4A3, 50465, 152915, 1-507; 10079, MS4A4A, 50467, 152917, 21-227; 10079, MS4A4A, 50469, 152919, 1-108; 10079, MS4A4A, 50470, 152920, 8-214; 10079, MS4A4A, 50466, 152916, 91-810; 10079, MS4A4A, 50468, 152918, 136-696; 10080, MS4A4E, 50472, 152922, 17-520; 10080, MS4A4E, 50474, 152924, 148-360; 10080, MS4A4E, 50476, 152926, 1-202; 10080, MS4A4E, 50471, 152921, 1-399; 10080, MS4A4E, 50473, 152923, 1-270; 10080, MS4A4E, 50475, 152925, 1-333; 10080, MS4A4E, 50477, 152927, 1-399; 10081, MS4A5, 50479, 152929, 1-103; 10081, MS4A5, 50480, 152930, 1-370; 10081, MS4A5, 50481, 152931, 33-236; 10081, MS4A5, 50482, 152932, 71-415; 10081, MS4A5, 50478, 152928, 87-689; 10082, MS4A6A, 50488, 152938, 337-567; 10082, MS4A6A, 50489, 152939, 275-577; 10082, MS4A6A, 50490, 152940, 105-467; 10082, MS4A6A, 50491, 152941, 219-1049; 10082, MS4A6A, 50492, 152942, 1-341; 10082, MS4A6A, 50493, 152943, 69-413; 10082, MS4A6A, 50495, 152945, 614-682; 10082, MS4A6A, 50483, 152933, 474-1235; 10082, MS4A6A, 50484, 152934, 78-614; 10082, MS4A6A, 50485, 152935, 19-780; 10082, MS4A6A, 50486, 152936, 515-940; 10082, MS4A6A, 50487, 152937, 142-819; 10082, MS4A6A, 50494, 152944, 494-1240; 10083, MS4A6E, 50497, 152947, 1-369; 10083, MS4A6E, 50498, 152948, 1-180; 10083, MS4A6E, 50496, 152946, 66-509; 10084, MS4A7, 50501, 152951, 151-268; 10084, MS4A7, 50502, 152952, 140-436; 10084, MS4A7, 50503, 152953, 151-657; 10084, MS4A7, 50505, 152955, 151-633; 10084, MS4A7, 50499, 152949, 197-919; 10084, MS4A7, 50500, 152950, 194-781; 10084, MS4A7, 50504, 152954, 130-717; 10085, MS4A8, 50507, 152957, 1-491; 10085, MS4A8, 50508, 152958, 31-297; 10085, MS4A8, 50509, 152959, 75-746; 10085, MS4A8, 50506, 152956, 204-956; 10086, MN1, 50511, 152961, 1-316; 10086, MN1, 50510, 152960, 956-4918; 10087, MGEA5, 50516, 152966, 1-769; 10087, MGEA5, 50512, 152962, 397-2946; 10087, MGEA5, 50513, 152963, 397-3147; 10087, MGEA5, 50514, 152964, 397-2430; 10087, MGEA5, 50515, 152965, 444-3035; 10088, MEP1A, 50518, 152968, 1-2325; 10088, MEP1A, 50517, 152967, 10-2250; 10089, MEP1B, 50520, 152970, 142-483; 10089, MEP1B, 50521, 152971, 47-2149; 10089, MEP1B, 50519, 152969, 48-2153; 10090, MERTK, 50523, 152973, 215-2686; 10090, MERTK, 50525, 152975, 73-363; 10090, MERTK, 50526, 152976, 1-771; 10090, MERTK, 50527, 152977, 1338-3104; 10090, MERTK, 50522, 152972, 258-3257; 10090, MERTK, 50524, 152974, 129-3128; 10091, MPST, 50532, 152982, 28-702; 10091, MPST, 50534, 152984, 24-698; 10091, MPST, 50528, 152978, 306-1199; 10091, MPST, 50529, 152979, 916-1809; 10091, MPST, 50530, 152980, 280-1173; 10091, MPST, 50531, 152981, 165-1058; 10091, MPST, 50533, 152983, 70-1023; 10092, MANF, 50535, 152985, 1-214; 10092, MANF, 50536, 152986, 288-845; 10093, MEOX1, 50540, 152990, 118-621; 10093, MEOX1, 50537, 152987, 421-1185; 10093, MEOX1, 50538, 152988, 30-584; 10093, MEOX1, 50539, 152989, 257-676; 10094, MEOX2, 50541, 152991, 411-1325; 10095, MEDAG, 50543, 152993, 1-320; 10095, MEDAG, 50542, 152992, 326-1237; 10096, MESDC1, 50544, 152994, 1329-2417; 10097, MESDC2, 50547, 152997, 5-247; 10097, MESDC2, 50545, 152995, 88-792; 10097, MESDC2, 50546, 152996, 29-445; 10097, MESDC2, 50548, 152998, 38-742; 10097, MESDC2, 50549, 152999, 38-742; 10098, MIER2, 50551, 153001, 1-631; 10098, MIER2, 50550, 153000, 1-1638; 10099, MIER3, 50552, 153002, 166-601; 10099, MIER3, 50557, 153007, 1-134; 10099, MIER3, 50558, 153008, 148-219; 10099, MIER3, 50553, 153003, 12-1664; 10099, MIER3, 50554, 153004, 24-1673; 10099, MIER3, 50555, 153005, 17-1684; 10099, MIER3, 50556, 153006, 145-1608; 10099, MIER3, 50559, 153009, 21-380; 10100, MIER1, 50560, 153010, 150-1688; 10100, MIER1, 50561, 153011, 337-1449; 10100, MIER1, 50562, 153012, 258-1847; 10100, MIER1, 50563, 153013, 245-490; 10100, MIER1, 50564, 153014, 71-1531; 10100, MIER1, 50565, 153015, 253-1605; 10100, MIER1, 50566, 153016, 317-1729; 10100, MIER1, 50567, 153017, 71-1768; 10100, MIER1, 50568, 153018, 150-1451; 10101, MESP1, 50569, 153019, 80-886; 10102, MESP2, 50571, 153021, 140-439; 10102, MESP2, 50570, 153020, 1-1194; 10103, MEST, 50576, 153026, 38-390; 10103, MEST, 50577, 153027, 176-555; 10103, MEST, 50578, 153028, 24-531; 10103, MEST, 50579, 153029, 215-1105; 10103, MEST, 50580, 153030, 156-794; 10103, MEST, 50582, 153032, 186-882; 10103, MEST, 50583, 153033, 101-582; 10103, MEST, 50584, 153034, 1-522; 10103, MEST, 50572, 153022, 222-1229; 10103, MEST, 50573, 153023, 227-1207; 10103, MEST, 50574, 153024, 66-944; 10103, MEST, 50575, 153025, 160-1140; 10103, MEST, 50581, 153031, 44-922; 10104, MSGN1, 50585, 153035, 24-605; 10105, MSLN, 50588, 153038, 1-1003; 10105, MSLN, 50590, 153040, 87-1084; 10105, MSLN, 50592, 153042, 1-1195; 10105, MSLN, 50593, 153043, 41-550; 10105, MSLN, 50586, 153036, 96-1988; 10105, MSLN, 50587, 153037, 169-2037; 10105, MSLN, 50589, 153039, 112-1980; 10105, MSLN, 50591, 153041, 418-2286; 10105, MSLN, 50594, 153044, 92-1984; 10106, MSLNL, 50596, 153046, 1-2259; 10106, MSLNL, 50595, 153045, 1-2109; 10107, MET, 50599, 153049, 1-475; 10107, MET, 50600, 153050, 1-645; 10107, MET, 50602, 153052, 196-767; 10107, MET, 50597, 153047, 188-4414;

10107, MET, 50598, 153048, 201-4373; 10107, MET, 50601, 153051, 1-2295; 10108, MTDH, 50604, 153054, 31-1611; 10108, MTDH, 50605, 153055, 1-672; 10108, MTDH, 50606, 153056, 1-181; 10108, MTDH, 50607, 153057, 1-565; 10108, MTDH, 50603, 153053, 329-2077; 10109, MTF2, 50609, 153059, 217-1827; 10109, MTF2, 50610, 153060, 318-1793; 10109, MTF2, 50611, 153061, 519-1994; 10109, MTF2, 50608, 153058, 290-2071; 10110, MBLAC1, 50613, 153063, 378-718; 10110, MBLAC1, 50612, 153062, 400-1200; 10111, MBLAC2, 50614, 153064, 477-1316; 10111, MBLAC2, 50615, 153065, 87-686; 10112, MPPE1, 50617, 153067, 454-1185; 10112, MPPE1, 50619, 153069, 330-1454; 10112, MPPE1, 50621, 153071, 1-246; 10112, MPPE1, 50622, 153072, 461-885; 10112, MPPE1, 50624, 153074, 1-486; 10112, MPPE1, 50625, 153075, 86-602; 10112, MPPE1, 50626, 153076, 301-379; 10112, MPPE1, 50627, 153077, 659-1152; 10112, MPPE1, 50628, 153078, 359-567; 10112, MPPE1, 50629, 153079, 566-1099; 10112, MPPE1, 50630, 153080, 423-698; 10112, MPPE1, 50631, 153081, 359-564; 10112, MPPE1, 50632, 153082, 166-1089; 10112, MPPE1, 50633, 153083, 537-818; 10112, MPPE1, 50616, 153066, 243-1244; 10112, MPPE1, 50618, 153068, 349-1350; 10112, MPPE1, 50620, 153070, 317-1339; 10112, MPPE1, 50623, 153073, 1223-2413; 10113, MPPED1, 50634, 153084, 225-582; 10113, MPPED1, 50637, 153087, 505-728; 10113, MPPED1, 50635, 153085, 445-1425; 10113, MPPED1, 50636, 153086, 224-1204; 10114, MPPED2, 50640, 153090, 253-497; 10114, MPPED2, 50641, 153091, 200-553; 10114, MPPED2, 50638, 153088, 124-1008; 10114, MPPED2, 50639, 153089, 362-1195; 10115, MT1A, 50642, 153092, 74-259; 10115, MT1A, 50643, 153093, 74-259; 10116, MT1B, 50645, 153095, 29-241; 10116, MT1B, 50644, 153094, 56-241; 10117, MT1E, 50648, 153098, 72-191; 10117, MT1E, 50646, 153096, 378-563; 10117, MT1E, 50647, 153097, 55-438; 10118, MT1F, 50650, 153100, 48-182; 10118, MT1F, 50649, 153099, 366-551; 10119, MT1G, 50653, 153103, 42-161; 10119, MT1G, 50654, 153104, 29-235; 10119, MT1G, 50651, 153101, 73-261; 10119, MT1G, 50652, 153102, 73-258; 10120, MT1H, 50656, 153106, 46-303; 10120, MT1H, 50655, 153105, 72-257; 10121, MT1HL1, 50657, 153107, 47-232; 10122, MT1M, 50659, 153109, 26-232; 10122, MT1M, 50658, 153108, 500-685; 10123, MT1X, 50661, 153111, 61-201; 10123, MT1X, 50662, 153112, 72-212; 10123, MT1X, 50660, 153110, 118-303; 10124, MT2A, 50664, 153114, 51-272; 10124, MT2A, 50663, 153113, 458-643; 10125, MT3, 50666, 153116, 47-388; 10125, MT3, 50667, 153117, 47-292; 10125, MT3, 50668, 153118, 52-330; 10125, MT3, 50665, 153115, 224-430; 10126, MT4, 50669, 153119, 81-269; 10127, MTL5, 50673, 153123, 1-614; 10127, MTL5, 50670, 153120, 185-1711; 10127, MTL5, 50671, 153121, 88-843; 10127, MTL5, 50672, 153122, 81-1001; 10128, MTF1, 50674, 153124, 142-2403; 10129, MTA1, 50677, 153127, 145-2256; 10129, MTA1, 50678, 153128, 1609-2376; 10129, MTA1, 50680, 153130, 1-1536; 10129, MTA1, 50681, 153131, 1-166; 10129, MTA1, 50682, 153132, 1-173; 10129, MTA1, 50675, 153125, 215-2362; 10129, MTA1, 50676, 153126, 99-2195; 10129, MTA1, 50679, 153129, 21-1313; 10130, MTA2, 50683, 153133, 391-2397; 10130, MTA2, 50684, 153134, 430-1917; 10130, MTA2, 50685, 153135, 745-2232; 10131, MTA3, 50686, 153136, 671-2284; 10131, MTA3, 50687, 153137, 323-1936; 10131, MTA3, 50689, 153139, 72-1616; 10131, MTA3, 50691, 153141, 9-1781; 10131, MTA3, 50692, 153142, 654-706; 10131, MTA3, 50693, 153143, 72-1250; 10131, MTA3, 50694, 153144, 6-281; 10131, MTA3, 50688, 153138, 230-1777; 10131, MTA3, 50690, 153140, 1-1785; 10132, MACC1, 50695, 153145, 115-2673; 10132, MACC1, 50696, 153146, 310-2868; 10132, MACC1, 50697, 153147, 99-2657; 10133, MTSS1, 50701, 153151, 166-788; 10133, MTSS1, 50702, 153152, 139-2076; 10133, MTSS1, 50703, 153153, 1-857; 10133, MTSS1, 50704, 153154, 1-1630; 10133, MTSS1, 50706, 153156, 1-553; 10133, MTSS1, 50698, 153148, 319-2598; 10133, MTSS1, 50699, 153149, 64-2256; 10133, MTSS1, 50700, 153150, 186-1607; 10133, MTSS1, 50705, 153155, 475-2742; 10134, MTSS1L, 50708, 153158, 1-407; 10134, MTSS1L, 50709, 153159, 1-518; 10134, MTSS1L, 50710, 153160, 1-2241; 10134, MTSS1L, 50707, 153157, 276-2519; 10135, N/A, 50711, 153161, 806-979; 10136, MTX1, 50712, 153162, 9-1316; 10136, MTX1, 50713, 153163, 107-1507; 10136, MTX1, 50714, 153164, 15-377; 10136, MTX1, 50715, 153165, 6-959; 10137, MTX2, 50717, 153167, 129-817; 10137, MTX2, 50718, 153168, 179-316; 10137, MTX2, 50719, 153169, 236-349; 10137, MTX2, 50720, 153170, 161-784; 10137, MTX2, 50716, 153166, 212-1003; 10138, MTX3, 50721, 153171, 22-768; 10138, MTX3, 50722, 153172, 121-876; 10138, MTX3, 50723, 153173, 22-960; 10138, MTX3, 50724, 153174, 25-501; 10139, METRN, 50725, 153175, 1-564; 10139, METRN, 50727, 153177, 54-263; 10139, METRN, 50728, 153178, 37-519; 10139, METRN, 50729, 153179, 1-523; 10139, METRN, 50726, 153176, 176-1057; 10140, METRNL, 50731, 153181, 1-273; 10140, METRNL, 50730, 153180, 126-1061; 10140, METRNL, 50732, 153182, 108-797; 10140, METRNL, 50733, 153183, 942-1631; 10140, METRNL, 50734, 153184, 108-797; 10140, METRNL, 50735, 153185, 125-1060; 10140, METRNL, 50736, 153186, 942-1631; 10141, MTHFSD, 50739, 153189, 611-1273; 10141, MTHFSD, 50741, 153191, 494-543; 10141, MTHFSD, 50742, 153192, 52-222; 10141, MTHFSD, 50743, 153193, 52-573; 10141, MTHFSD, 50744, 153194, 173-508; 10141, MTHFSD, 50745, 153195, 52-372; 10141, MTHFSD, 50746, 153196, 1-701; 10141, MTHFSD, 50747, 153197, 511-565; 10141, MTHFSD, 50748, 153198, 1-672; 10141, MTHFSD, 50749, 153199, 20-274; 10141, MTHFSD, 50750, 153200, 315-581; 10141, MTHFSD, 50751, 153201, 158-493; 10141, MTHFSD, 50752, 153202, 1-459; 10141, MTHFSD, 50753, 153203, 20-1168; 10141, MTHFSD, 50737, 153187, 27-1178; 10141, MTHFSD, 50738, 153188, 20-1171; 10141, MTHFSD, 50740, 153190, 20-1168; 10142, MAT1A, 50755, 153205, 1-435; 10142, MAT1A, 50754, 153204, 262-1449; 10143, MAT2A, 50756, 153206, 124-1311; 10143, MAT2A, 50757, 153207, 458-1357; 10144, MAT2B, 50760, 153210, 104-698; 10144, MAT2B, 50762, 153212, 49-402; 10144, MAT2B, 50758, 153208, 282-1253; 10144, MAT2B, 50759, 153209, 140-1144; 10144, MAT2B, 50761, 153211, 74-853; 10145, MSRA, 50766, 153216, 1-274; 10145, MSRA, 50767, 153217, 625-871; 10145, MSRA, 50768, 153218, 17-658; 10145, MSRA, 50769, 153219, 187-366; 10145, MSRA, 50763, 153213, 250-957; 10145, MSRA, 50764, 153214, 305-883; 10145, MSRA, 50765, 153215, 148-735; 10145, MSRA, 50770, 153220, 624-1133; 10146, MSRB1, 50772, 153222, 40-720; 10146, MSRB1, 50773, 153223, 44-499; 10146, MSRB1, 50774, 153224, 1-169; 10146, MSRB1, 50775, 153225, 138-485; 10146, MSRB1, 50771, 153221, 171-521; 10147, MSRB2, 50777, 153227, 1-362; 10147, MSRB2, 50776, 153226, 104-652; 10148, MSRB3, 50780, 153230, 1-352; 10148, MSRB3, 50781, 153231, 38-520; 10148, MSRB3, 50782, 153232, 1-523; 10148, MSRB3, 50784, 153234, 176-527; 10148, MSRB3, 50785, 153235, 101-235; 10148, MSRB3, 50786, 153236, 137-630; 10148, MSRB3, 50778, 153228, 275-832; 10148, MSRB3, 50779, 153229, 127-705; 10148, MSRB3, 50783, 153233, 340-897; 10148, MSRB3, 50787, 153237, 137-694; 10149, METAP1, 50789, 153239, 1-351; 10149, METAP1, 50790, 153240, 1-513; 10149, METAP1, 50791, 153241, 1-135; 10149, METAP1, 50792, 153242, 15-161; 10149, METAP1, 50793, 153243, 1-116; 10149, METAP1, 50794, 153244, 34-180; 10149, METAP1, 50795, 153245, 1-147; 10149, METAP1, 50788, 153238, 135-1295; 10150, METAP2, 50798, 153248, 661-1647; 10150, METAP2, 50799, 153249, 50-538; 10150, METAP2, 50801, 153251, 29-513; 10150, METAP2, 50802, 153252, 26-1354; 10150, METAP2, 50803, 153253, 29-564; 10150, METAP2, 50804, 153254, 19-1452; 10150, METAP2, 50796, 153246, 31-1398; 10150, METAP2, 50797, 153247, 230-1666; 10150, METAP2, 50800, 153250, 100-1467; 10151, METAP1D, 50805, 153255, 388-1395; 10152, MARS, 50807, 153257, 26-448; 10152, MARS, 50809, 153259, 24-311; 10152, MARS, 50810, 153260, 24-356; 10152, MARS, 50811, 153261, 24-368; 10152, MARS, 50812, 153262, 1-246; 10152, MARS, 50813, 153263, 1-699; 10152, MARS, 50814, 153264, 1-373; 10152, MARS, 50815, 153265, 7-222; 10152, MARS, 50816, 153266, 1-358; 10152, MARS, 50817, 153267, 1-177; 10152, MARS, 50818, 153268, 1-660; 10152, MARS, 50819, 153269, 7-189; 10152, MARS, 50820, 153270, 1-216; 10152, MARS, 50821, 153271, 1-183; 10152, MARS, 50822, 153272, 24-311; 10152, MARS, 50806, 153256, 135-2837; 10152, MARS, 50808, 153258, 687-2327; 10153, MARS2, 50823, 153273, 38-1819; 10154, MECP2, 50825, 153275, 159-272; 10154, MECP2, 50826, 153276, 25-579; 10154, MECP2, 50828, 153278, 265-413; 10154, MECP2, 50829, 153279, 97-603; 10154, MECP2, 50830, 153280, 227-1756; 10154, MECP2, 50831, 153281, 97-1071; 10154, MECP2, 50832, 153282, 137-261; 10154, MECP2, 50833, 153283, 233-751; 10154, MECP2, 50824, 153274, 251-1711; 10154, MECP2, 50827, 153277, 100-1596; 10155, MBD4, 50838, 153288, 95-253; 10155, MBD4, 50834, 153284, 177-1919; 10155, MBD4, 50835, 153285, 347-1135; 10155, MBD4, 50836, 153286, 197-1921; 10155, MBD4, 50837, 153287, 203-1921; 10155, MBD4, 50839, 153289, 175-1797; 10156, MBD1, 50848, 153298, 19-1719; 10156, MBD1, 50850, 153300, 335-469; 10156, MBD1, 50853, 153303, 1-767; 10156, MBD1, 50854, 153304, 1-723; 10156, MBD1, 50856, 153306, 1-1250; 10156, MBD1, 50840, 153290, 438-2255; 10156, MBD1, 50841, 153291, 140-1810; 10156, MBD1, 50842, 153292, 438-2198; 10156, MBD1, 50843, 153293, 438-2087; 10156, MBD1, 50844, 153294, 140-1792; 10156, MBD1, 50845, 153295, 438-2255; 10156, MBD1, 50846, 153296, 1-1512; 10156, MBD1, 50847, 153297, 164-1813; 10156, MBD1, 50849, 153299, 130-2022; 10156, MBD1, 50851, 153301, 1-1611; 10156, MBD1, 50852, 153302, 123-1826; 10156, MBD1, 50855, 153305, 433-2250; 10156, MBD1, 50857, 153307, 1-1761; 10156, MBD1, 50858, 153308, 219-1826; 10156, MBD1, 50859, 153309, 170-2062; 10156, MBD1, 50860, 153310, 348-2315; 10157, MBD2, 50862, 153312, 89-814; 10157, MBD2, 50863, 153313, 1-219; 10157, MBD2, 50861, 153311, 230-1465; 10157, MBD2, 50864, 153314, 59-967; 10158, MBD3, 50867, 153317, 375-1082; 10158, MBD3, 50868, 153318, 152-709; 10158, MBD3, 50869, 153319, 517-907; 10158, MBD3, 50870, 153320, 1-124; 10158, MBD3, 50871, 153321, 467-568; 10158, MBD3, 50872, 153322, 142-583; 10158, MBD3, 50865, 153315, 171-950; 10158, MBD3, 50866, 153316, 78-953; 10159, MBD3L1, 50873, 153323, 87-671; 10159, MBD3L1, 50874, 153324, 232-816; 10160, MBD3L2, 50876, 153326, 36-650; 10160, MBD3L2, 50875, 153325, 54-680; 10161, MBD3L3, 50878, 153328, 36-650; 10161, MBD3L3, 50877, 153327, 36-662; 10162, MBD3L4, 50880, 153330, 36-650; 10162, MBD3L4, 50879, 153329, 36-662; 10163, MBD3L5, 50882, 153332, 36-650; 10163, MBD3L5, 50881, 153331, 35-661; 10164, MBD5, 50883, 153333, 130-5313; 10164, MBD5, 50885, 153335, 1-3194; 10164, MBD5, 50886, 153336, 1-233; 10164, MBD5, 50887, 153337, 1-342; 10164, MBD5, 50889, 153339, 313-3573; 10164, MBD5, 50884, 153334, 998-5482; 10164, MBD5, 50888, 153338, 1099-3654; 10165, MBD6, 50891, 153341, 346-544; 10165, MBD6, 50892, 153342, 1-530; 10165, MBD6, 50893, 153343, 374-509; 10165, MBD6, 50894, 153344, 1-83; 10165, MBD6, 50895, 153345, 123-568; 10165, MBD6, 50896, 153346, 448-607; 10165, MBD6, 50897, 153347, 89-232; 10165, MBD6, 50898, 153348, 377-596; 10165, MBD6, 50899, 153349, 1-1515; 10165, MBD6, 50900, 153350, 1-570; 10165, MBD6, 50901, 153351, 374-532; 10165, MBD6, 50890, 153340, 357-3368; 10166, MCCC1, 50903, 153353, 91-234; 10166, MCCC1, 50904, 153354, 84-254; 10166, MCCC1, 50905, 153355, 79-264; 10166, MCCC1, 50906, 153356, 704-2554; 10166, MCCC1, 50907, 153357, 91-234; 10166, MCCC1, 50908, 153358, 56-394; 10166, MCCC1, 50909, 153359, 111-1906; 10166, MCCC1, 50910, 153360, 79-264; 10166, MCCC1, 50911, 153361, 782-2086; 10166, MCCC1, 50912, 153362, 211-1938; 10166, MCCC1, 50913, 153363, 465-2192; 10166, MCCC1, 50914, 153364, 252-1556; 10166, MCCC1, 50902, 153352, 148-2325; 10167, MCCC2, 50916, 153366, 97-1188; 10167, MCCC2, 50917, 153367, 139-1128; 10167, MCCC2, 50918, 153368, 38-895; 10167, MCCC2, 50919, 153369, 130-753; 10167, MCCC2, 50920, 153370, 97-720; 10167, MCCC2, 50921, 153371, 97-720; 10167, MCCC2, 50922, 153372, 121-744; 10167, MCCC2, 50923, 153373, 139-1128; 10167, MCCC2, 50924, 153374, 139-762; 10167, MCCC2, 50915, 153365, 130-1821; 10168, MTHFD1, 50926, 153376, 230-3292; 10168, MTHFD1, 50928, 153378, 304-509; 10168, MTHFD1, 50929, 153379, 1-324; 10168, MTHFD1, 50930, 153380, 620-688; 10168, MTHFD1, 50931, 153381, 489-563; 10168, MTHFD1, 50925, 153375, 79-2886; 10168, MTHFD1, 50927, 153377, 21-803; 10169, MTHFD1L, 50933, 153383, 1-996; 10169, MTHFD1L, 50935, 153385, 1-279; 10169, MTHFD1L, 50936, 153386, 1-291; 10169, MTHFD1L, 50937, 153387, 1-174; 10169, MTHFD1L, 50938, 153388, 183-524; 10169, MTHFD1L, 50939, 153389, 234-560; 10169, MTHFD1L, 50940, 153390, 145-3084; 10169, MTHFD1L, 50941, 153391, 27-2768; 10169, MTHFD1L, 50932, 153382, 108-935; 10169, MTHFD1L, 50934, 153384, 275-3211; 10170, MTHFD2, 50943, 153393, 33-701; 10170, MTHFD2, 50944, 153394, 27-830; 10170, MTHFD2, 50945, 153395, 30-143; 10170, MTHFD2, 50946, 153396, 28-138; 10170, MTHFD2, 50942, 153392, 81-1133; 10171, MTHFD2L, 50948, 153398, 198-954; 10171, MTHFD2L, 50950, 153400, 240-560; 10171, MTHFD2L, 50952, 153402, 377-817; 10171, MTHFD2L, 50953, 153403, 265-585; 10171, MTHFD2L, 50947, 153397, 141-1010; 10171, MTHFD2L, 50949, 153399, 28-1071; 10171, MTHFD2L, 50951, 153401, 524-1195; 10172, MTHFR, 50954, 153404, 1047-1135; 10172, MTHFR, 50959, 153409, 1382-1539; 10172, MTHFR, 50960, 153410, 782-870; 10172, MTHFR, 50961, 153411, 604-1034; 10172, MTHFR, 50962, 153412, 310-398; 10172, MTHFR, 50955, 153405, 1-2094; 10172, MTHFR, 50956, 153406, 1053-3146; 10172, MTHFR, 50957, 153407, 185-2155; 10172, MTHFR, 50958, 153408, 130-2100; 10173, MMAA, 50964, 153414, 48-830; 10173, MMAA, 50965, 153415, 48-1322; 10173, MMAA, 50963, 153413, 1211-2467; 10174, MMAB, 50966, 153416, 18-311; 10174, MMAB, 50967, 153417, 35-178; 10174, MMAB, 50968, 153418, 24-545; 10174, MMAB, 50970, 153420, 18-614; 10174, MMAB, 50971, 153421, 25-471; 10174, MMAB, 50972, 153422, 1-522; 10174, MMAB, 50973, 153423, 101-394; 10174, MMAB, 50969, 153419, 395-1147; 10175, MMACHC, 50975, 153425, 164-841; 10175, MMACHC, 50974, 153424, 281-1129; 10176, MMADHC, 50978, 153428, 168-1160; 10176, MMADHC, 50976, 153426, 206-1096; 10176, MMADHC, 50977, 153427, 506-1396; 10177, MCEE, 50980, 153430, 1-237; 10177, MCEE, 50981, 153431, 744-836; 10177, MCEE, 50982, 153432, 407-499; 10177, MCEE, 50979, 153429, 19-549; 10178, MUT, 50983, 153433, 129-2381; 10179, MEPCE, 50984, 153434, 389-2458; 10179, MEPCE, 50985, 153435, 1036-1698; 10180, MSMO1, 50988, 153438, 76-765; 10180, MSMO1, 50989, 153439, 228-482; 10180, MSMO1, 50990, 153440, 312-973; 10180, MSMO1, 50986, 153436, 174-1055; 10180, MSMO1, 50987, 153437, 218-706; 10181, MTAP, 50992, 153442, 93-245; 10181, MTAP, 50993, 153443, 226-1128; 10181, MTAP, 50994, 153444, 1-339; 10181, MTAP, 50996, 153446, 88-816; 10181, MTAP, 50991, 153441, 207-1058; 10181, MTAP, 50995, 153445, 101-1105; 10182, MRI1, 50997, 153447, 41-1150; 10182, MRI1, 50998, 153448, 58-1026; 10183, METTL1, 51001, 153451, 1-190; 10183, METTL1, 51002, 153452, 1-245; 10183, METTL1, 51003, 153453, 34-144; 10183, METTL1, 51004, 153454, 1-371; 10183, METTL1, 50999, 153449, 37-504; 10183, METTL1, 51000, 153450, 711-1541; 10184, METTL10, 51006, 153456, 36-350; 10184, METTL10, 51007, 153457, 36-350; 10184, METTL10, 51008, 153458, 1-95; 10184, METTL10, 51009, 153459, 38-613; 10184, METTL10, 51005, 153455, 38-913; 10185, METTL11B, 51010, 153460, 108-959; 10186, METTL12, 51011, 153461, 258-980; 10187, METTL13, 51012, 153462, 267-2366; 10187, METTL13, 51013, 153463, 220-2061; 10187, METTL13, 51014, 153464, 273-1904; 10188, METTL14, 51016, 153466, 1-413; 10188, METTL14, 51017, 153467, 121-485; 10188, METTL14, 51018, 153468, 136-330; 10188, METTL14, 51019, 153469, 123-392; 10188, METTL14, 51015, 153465, 168-1538; 10189, METTL15, 51023, 153473, 387-668; 10189, METTL15, 51025, 153475, 377-871; 10189, METTL15, 51026, 153476, 105-428; 10189, METTL15, 51027, 153477, 108-932; 10189, METTL15, 51028, 153478, 105-554; 10189, METTL15, 51029, 153479, 254-526; 10189, METTL15, 51030, 153480, 108-932; 10189, METTL15, 51020, 153470, 108-929; 10189, METTL15, 51021, 153471, 353-1576; 10189, METTL15, 51022, 153472, 459-1298; 10189, METTL15, 51024, 153474, 105-404; 10190, METTL16, 51032, 153482, 78-584; 10190, METTL16, 51033, 153483, 131-496; 10190, METTL16, 51034, 153484, 132-575; 10190, METTL16, 51035, 153485, 1-304; 10190, METTL16, 51031, 153481, 129-1817; 10191, METTL17, 51038, 153488, 10-486; 10191, METTL17, 51040, 153490, 10-486; 10191, METTL17, 51041, 153491, 282-803; 10191, METTL17, 51042, 153492, 480-900; 10191, METTL17, 51043, 153493, 10-568; 10191, METTL17, 51044, 153494, 251-556; 10191, METTL17, 51045, 153495, 1-370; 10191, METTL17, 51046, 153496, 1-477; 10191, METTL17, 51036, 153486, 234-1604; 10191, METTL17, 51037, 153487, 24-1460; 10191, METTL17, 51039, 153489, 17-1360; 10192, METTL18, 51049, 153499, 297-850; 10192, METTL18, 51047, 153497, 260-1378; 10192, METTL18, 51048, 153498, 355-1473; 10193, METTL20, 51053, 153503, 18-362; 10193, METTL20, 51055, 153505, 339-554; 10193, METTL20, 51050, 153500, 216-1004; 10193, METTL20, 51051, 153501, 290-1078; 10193, METTL20, 51052, 153502, 210-998; 10193, METTL20, 51054, 153504, 684-1472; 10194, METTL21A, 51056, 153506, 177-887; 10194, METTL21A, 51063, 153513, 6-164; 10194, METTL21A, 51065, 153515, 90-473; 10194, METTL21A, 51057, 153507, 144-800; 10194, METTL21A, 51058, 153508, 300-572; 10194, METTL21A, 51059, 153509, 281-937; 10194, METTL21A, 51060, 153510, 145-417; 10194, METTL21A, 51061, 153511, 192-848; 10194, METTL21A, 51062, 153512, 172-828; 10194, METTL21A, 51064, 153514, 218-874; 10195, METTL21B, 51068, 153518, 84-407; 10195, METTL21B, 51069, 153519, 565-702; 10195, METTL21B, 51070, 153520, 1-30; 10195, METTL21B, 51066, 153516, 126-806; 10195, METTL21B, 51067, 153517, 48-497; 10196, METTL21C, 51071, 153521, 7-801; 10197, METTL22, 51074, 153524, 503-550; 10197, METTL22, 51075, 153525, 218-1264; 10197, METTL22, 51076, 153526, 1-140; 10197, METTL22, 51077, 153527, 403-614; 10197, METTL22, 51078, 153528, 215-358; 10197, METTL22, 51079, 153529, 1-465; 10197, METTL22, 51080, 153530, 1-312; 10197, METTL22, 51081, 153531, 1-496; 10197, METTL22, 51072, 153522, 256-873; 10197, METTL22, 51073, 153523, 259-1473; 10198, METTL23, 51083, 153533, 72-512; 10198, METTL23, 51086, 153536, 250-465; 10198, METTL23, 51088, 153538, 159-398; 10198, METTL23, 51089, 153539, 358-774; 10198, METTL23, 51090, 153540, 440-609; 10198, METTL23, 51091, 153541, 52-581; 10198, METTL23, 51092, 153542, 396-846; 10198, METTL23, 51093, 153543, 303-719; 10198, METTL23, 51094, 153544, 356-571; 10198, METTL23, 51082, 153532, 333-905; 10198, METTL23, 51084, 153534, 606-977; 10198, METTL23, 51085, 153535, 443-814; 10198, METTL23, 51087, 153537, 481-852; 10198, METTL23, 51095, 153545, 406-978; 10199, METTL24, 51096, 153546, 1-1101; 10200, METTL25, 51098, 153548, 27-743; 10200, METTL25, 51099, 153549, 1-432; 10200, METTL25, 51100, 153550, 1-568; 10200, METTL25, 51097, 153547, 70-1881; 10201, METTL2A, 51102, 153552, 116-1057; 10201, METTL2A, 51101, 153551, 37-1173; 10202, METTL2B, 51104, 153554, 1-319; 10202, METTL2B, 51105, 153555, 18-248; 10202, METTL2B, 51107, 153557, 1-453; 10202, METTL2B, 51103, 153553, 38-1174; 10202, METTL2B, 51106, 153556, 116-1057; 10203, METTL3, 51109, 153559, 537-563; 10203, METTL3, 51110, 153560, 116-853; 10203, METTL3, 51111, 153561, 1-1009; 10203, METTL3, 51112, 153562, 118-579; 10203, METTL3, 51113, 153563, 88-864; 10203, METTL3, 51108, 153558, 153-1895; 10204, METTL4, 51114, 153564, 800-2059; 10204, METTL4, 51116, 153566, 274-544; 10204, METTL4, 51117, 153567, 1-278; 10204, METTL4, 51118, 153568, 551-613; 10204, METTL4, 51119, 153569, 1-427; 10204, METTL4, 51115, 153565, 777-2195; 10205, METTL5, 51121, 153571, 78-572; 10205, METTL5, 51124, 153574, 82-678; 10205, METTL5, 51125, 153575, 137-871; 10205, METTL5, 51126, 153576, 77-409; 10205, METTL5, 51127, 153577, 1-380; 10205, METTL5, 51128, 153578, 1-264; 10205, METTL5, 51129, 153579, 90-235; 10205, METTL5, 51130, 153580, 82-480; 10205, METTL5, 51120, 153570, 318-947; 10205, METTL5, 51122, 153572, 108-737; 10205, METTL5, 51123, 153573, 188-817; 10206, METTL6, 51133, 153583, 1-316; 10206, METTL6, 51135, 153585, 264-983; 10206, METTL6, 51136, 153586, 1-477; 10206, METTL6, 51137, 153587, 468-880; 10206, METTL6, 51131, 153581, 256-978; 10206, METTL6, 51132, 153582, 242-1096; 10206, METTL6, 51134, 153584, 242-1096; 10207, METTL7A, 51140, 153590, 1-733; 10207, METTL7A, 51142, 153592, 79-618; 10207, METTL7A, 51138, 153588, 289-1023; 10207, METTL7A, 51139, 153589, 57-791; 10207, METTL7A, 51141, 153591, 982-1716; 10208, METTL7B, 51144, 153594, 78-908; 10208, METTL7B, 51143, 153593, 210-944; 10209, METTL8, 51145, 153595, 217-1353; 10209, METTL8, 51146, 153596, 149-828; 10209, METTL8, 51148, 153598, 120-578; 10209, METTL8, 51149, 153599, 1-643; 10209, METTL8, 51151, 153601, 244-558; 10209, METTL8, 51152, 153602, 315-563; 10209, METTL8, 51153, 153603, 142-1365; 10209, METTL8, 51147, 153597, 342-1217; 10209, METTL8, 51150, 153600, 359-1084; 10210, METTL9, 51156, 153606, 368-785; 10210, METTL9, 51157, 153607, 35-763; 10210, METTL9, 51158, 153608, 1-376; 10210, METTL9, 51159, 153609, 1-385; 10210, METTL9, 51160, 153610, 17-202; 10210, METTL9, 51161, 153611, 143-367; 10210, METTL9, 51162, 153612, 1-849; 10210, METTL9, 51154, 153604, 259-1215; 10210, METTL9, 51155, 153605, 177-1130; 10211, MVD, 51164, 153614, 58-870; 10211, MVD, 51165, 153615, 3-278; 10211, MVD, 51166, 153616, 69-194; 10211, MVD, 51167, 153617, 12-167; 10211, MVD, 51168, 153618, 544-960; 10211, MVD, 51163, 153613, 31-1233; 10212, MVK, 51170, 153620, 52-1086; 10212, MVK, 51171, 153621, 96-347; 10212, MVK, 51172, 153622, 285-886; 10212, MVK, 51173, 153623, 161-508; 10212, MVK, 51174, 153624, 323-834; 10212, MVK, 51176, 153626, 57-308; 10212, MVK, 51177, 153627, 75-428; 10212, MVK, 51178, 153628, 17-268; 10212, MVK, 51179, 153629, 17-1051; 10212, MVK, 51169, 153619, 77-1267; 10212, MVK, 51175, 153625, 17-1207; 10213, MEX3A, 51180, 153630, 1-1563; 10214, MEX3B, 51181, 153631, 437-2146; 10214, MEX3B, 51182, 153632, 415-891; 10215, MEX3C, 51184, 153634, 1-348; 10215, MEX3C, 51185, 153635, 1-1470; 10215, MEX3C, 51183, 153633, 1-1980; 10216, MEX3D, 51187, 153637, 1-1473; 10216, MEX3D, 51186, 153636, 1-1956; 10217, MFNG, 51189, 153639, 397-524; 10217, MFNG, 51190, 153640, 249-644; 10217, MFNG, 51191, 153641, 1-263; 10217, MFNG, 51192, 153642, 217-570; 10217, MFNG, 51194, 153644, 203-595; 10217, MFNG, 51195, 153645, 211-594; 10217, MFNG, 51188, 153638, 225-1190; 10217, MFNG, 51193, 153643, 211-1134; 10218, MGA, 51198, 153648, 182-3439; 10218, MGA, 51201, 153651, 122-3537; 10218, MGA, 51202, 153652, 1-251; 10218, MGA, 51203, 153653, 1-3521; 10218, MGA, 51204, 153654, 897-1082; 10218, MGA, 51196, 153646, 182-9379; 10218, MGA, 51197, 153647, 182-8752; 10218, MGA, 51199, 153649, 68-8638; 10218, MGA, 51200, 153650, 1-9198; 10219, MGAT4C, 51207, 153657, 196-531; 10219, MGAT4C, 51208, 153658, 231-1423; 10219, MGAT4C, 51205, 153655, 225-1661; 10219, MGAT4C, 51206, 153656, 179-1615; 10219, MGAT4C, 51209, 153659, 1206-2642; 10219, MGAT4C, 51210, 153660, 602-2038; 10219, MGAT4C, 51211, 153661, 57-1493; 10220, MGAT4D, 51213, 153663, 1-274; 10220, MGAT4D, 51214, 153664, 132-632; 10220, MGAT4D, 51215, 153665, 109-448; 10220, MGAT4D, 51216, 153666, 149-259; 10220, MGAT4D, 51217, 153667, 1-1128; 10220, MGAT4D, 51212, 153662, 1-1125; 10221, MICA, 51218, 153668, 1153-1890; 10221, MICA, 51220, 153670, 404-1402; 10221, MICA, 51221, 153671, 95-1123; 10221, MICA, 51222, 153672, 95-964; 10221, MICA, 51223, 153673, 1-831; 10221, MICA, 51225, 153675, 1-672; 10221, MICA, 51226, 153676, 1-825; 10221, MICA, 51227, 153677, 1153-1737; 10221, MICA, 51228, 153678, 1153-1737; 10221, MICA, 51229, 153679, 1153-1896; 10221, MICA, 51230, 153680, 1-672; 10221, MICA, 51231, 153681, 1-672; 10221, MICA, 51232, 153682, 95-964; 10221, MICA, 51233, 153683, 55-1053; 10221, MICA, 51234, 153684, 404-1402; 10221, MICA, 51235, 153685, 95-733; 10221, MICA, 51236, 153686, 67-1065; 10221, MICA, 51238, 153688, 67-1065; 10221, MICA, 51239, 153689, 1222-1929; 10221, MICA, 51240, 153690, 1222-1929; 10221, MICA, 51241, 153691, 1222-1929; 10221, MICA, 51219, 153669, 404-1555; 10221, MICA, 51224, 153674, 404-1561; 10221, MICA, 51237, 153687, 67-1218; 10222, MICB, 51242, 153692, 80-1231; 10222, MICB, 51243, 153693, 80-1231; 10222, MICB, 51245, 153695, 109-1131; 10222, MICB, 51246, 153696, 109-1131; 10222, MICB, 51248, 153698, 1-1082; 10222, MICB, 51251, 153701, 109-1131; 10222, MICB, 51253, 153703, 1-953; 10222, MICB, 51254, 153704, 80-1231; 10222, MICB, 51255, 153705, 80-1231; 10222, MICB, 51256, 153706, 109-1131; 10222, MICB, 51258, 153708, 142-1197; 10222, MICB, 51259, 153709, 142-1197; 10222, MICB, 51260, 153710, 6-1157; 10222, MICB, 51244, 153694, 109-1131; 10222, MICB, 51247, 153697, 80-1231; 10222, MICB, 51249, 153699, 109-1131; 10222, MICB, 51250, 153700, 80-1231; 10222, MICB, 51252, 153702, 80-1231; 10222, MICB, 51257, 153707, 109-1131; 10223, MIA-RAB4B, 51261, 153711, 423-818; 10224, MICALCL, 51263, 153713, 257-343; 10224, MICALCL, 51262, 153712, 292-2379; 10225, MICALL1, 51265, 153715, 177-808; 10225, MICALL1, 51266, 153716, 1-1108; 10225, MICALL1, 51267, 153717, 1-561; 10225, MICALL1, 51264, 153714, 127-2718; 10226, MICALL2, 51268, 153718, 177-2891; 10226, MICALL2, 51269, 153719, 232-2274; 10227, MCPH1, 51270, 153720, 77-2584; 10227, MCPH1, 51271, 153721, 26-1714; 10227, MCPH1, 51272, 153722, 73-1905; 10228, MFAP5, 51275, 153725, 261-707; 10228, MFAP5, 51276, 153726, 102-431; 10228, MFAP5, 51277, 153727, 79-495; 10228, MFAP5, 51279, 153729, 1-491; 10228, MFAP5, 51280, 153730, 64-519; 10228, MFAP5, 51281, 153731, 66-452; 10228, MFAP5, 51282, 153732, 1-240; 10228, MFAP5, 51283, 153733, 310-582; 10228, MFAP5, 51273, 153723, 189-710; 10228, MFAP5, 51274, 153724, 203-694; 10228, MFAP5, 51278, 153728, 1-492; 10229, MFAP1, 51284, 153734, 234-1553; 10230, MFAP2, 51285, 153735, 4-552; 10230, MFAP2, 51286, 153736, 291-842; 10231, MFAP3, 51289, 153739, 471-520; 10231, MFAP3, 51290, 153740, 240-567; 10231, MFAP3, 51291, 153741, 273-643; 10231, MFAP3, 51287, 153737, 483-1571; 10231, MFAP3, 51288, 153738, 197-847; 10232, MFAP3L, 51296, 153746, 95-564; 10232, MFAP3L, 51297, 153747, 507-725; 10232, MFAP3L, 51298, 153748, 360-550; 10232, MFAP3L, 51299, 153749, 418-551; 10232, MFAP3L, 51300, 153750, 374-667; 10232, MFAP3L, 51301, 153751, 212-481; 10232, MFAP3L, 51292, 153742, 309-1538; 10232, MFAP3L, 51293, 153743, 619-927; 10232, MFAP3L, 51294, 153744, 126-1046; 10232, MFAP3L, 51295, 153745, 204-512; 10233, MFAP4, 51304, 153754, 14-856; 10233, MFAP4, 51302, 153752, 86-853; 10233, MFAP4, 51303, 153753, 73-912; 10234, MITF, 51310, 153760, 32-382; 10234, MITF, 51312, 153762, 33-1116; 10234, MITF, 51313, 153763, 331-542; 10234, MITF, 51314, 153764, 119-589; 10234, MITF, 51316, 153766, 96-413; 10234, MITF, 51318, 153768, 95-370; 10234, MITF, 51305, 153755, 164-1726; 10234, MITF, 51306, 153756, 137-1378; 10234, MITF, 51307, 153757, 80-1594; 10234, MITF, 51308, 153758, 32-1591; 10234, MITF, 51309, 153759, 121-1380; 10234, MITF, 51311, 153761, 128-1708; 10234, MITF, 51315, 153765, 190-1596; 10234, MITF, 51317, 153767, 1-1074; 10235, MSMB, 51319, 153769, 33-266; 10235, MSMB, 51320, 153770, 33-377; 10236, MSMP, 51321, 153771, 141-560;

10237, MGST1, 51326, 153776, 144-284; 10237, MGST1, 51328, 153778, 77-202; 10237, MGST1, 51329, 153779, 66-298; 10237, MGST1, 51330, 153780, 89-406; 10237, MGST1, 51331, 153781, 125-365; 10237, MGST1, 51322, 153772, 66-533; 10237, MGST1, 51323, 153773, 74-541; 10237, MGST1, 51324, 153774, 144-611; 10237, MGST1, 51325, 153775, 85-552; 10237, MGST1, 51327, 153777, 40-303; 10238, MGST2, 51332, 153782, 253-696; 10238, MGST2, 51333, 153783, 5-448; 10238, MGST2, 51334, 153784, 186-419; 10238, MGST2, 51335, 153785, 253-696; 10239, MGST3, 51336, 153786, 90-590; 10239, MGST3, 51338, 153788, 64-564; 10239, MGST3, 51339, 153789, 89-478; 10239, MGST3, 51341, 153791, 1-501; 10239, MGST3, 51337, 153787, 142-600; 10239, MGST3, 51340, 153790, 441-899; 10240, MTTP, 51345, 153795, 14-232; 10240, MTTP, 51346, 153796, 14-184; 10240, MTTP, 51347, 153797, 14-166; 10240, MTTP, 51348, 153798, 81-209; 10240, MTTP, 51349, 153799, 16-195; 10240, MTTP, 51350, 153800, 17-184; 10240, MTTP, 51351, 153801, 14-549; 10240, MTTP, 51352, 153802, 14-2779; 10240, MTTP, 51353, 153803, 25-1575; 10240, MTTP, 51342, 153792, 204-2888; 10240, MTTP, 51343, 153793, 257-2941; 10240, MTTP, 51344, 153794, 87-542; 10241, MCRS1, 51357, 153807, 83-1037; 10241, MCRS1, 51358, 153808, 214-646; 10241, MCRS1, 51359, 153809, 108-293; 10241, MCRS1, 51361, 153811, 1-195; 10241, MCRS1, 51362, 153812, 1-522; 10241, MCRS1, 51363, 153813, 338-894; 10241, MCRS1, 51364, 153814, 260-876; 10241, MCRS1, 51354, 153804, 217-1605; 10241, MCRS1, 51355, 153805, 1-1428; 10241, MCRS1, 51356, 153806, 523-1338; 10241, MCRS1, 51360, 153810, 268-1656; 10242, MICAL1, 51367, 153817, 156-887; 10242, MICAL1, 51368, 153818, 1-754; 10242, MICAL1, 51365, 153815, 68-3013; 10242, MICAL1, 51366, 153816, 313-3516; 10242, MICAL1, 51369, 153819, 292-3552; 10243, MICAL2, 51373, 153823, 289-593; 10243, MICAL2, 51374, 153824, 165-566; 10243, MICAL2, 51375, 153825, 253-516; 10243, MICAL2, 51377, 153827, 295-589; 10243, MICAL2, 51378, 153828, 463-473; 10243, MICAL2, 51379, 153829, 282-546; 10243, MICAL2, 51380, 153830, 212-573; 10243, MICAL2, 51370, 153820, 289-3663; 10243, MICAL2, 51371, 153821, 153-3464; 10243, MICAL2, 51372, 153822, 78-3008; 10243, MICAL2, 51376, 153826, 155-2959; 10243, MICAL2, 51381, 153831, 153-3527; 10244, MICAL3, 51385, 153835, 167-542; 10244, MICAL3, 51387, 153837, 184-1191; 10244, MICAL3, 51389, 153839, 1-519; 10244, MICAL3, 51390, 153840, 1-1490; 10244, MICAL3, 51391, 153841, 1-418; 10244, MICAL3, 51392, 153842, 1-569; 10244, MICAL3, 51393, 153843, 1-807; 10244, MICAL3, 51394, 153844, 1-593; 10244, MICAL3, 51382, 153832, 16-2862; 10244, MICAL3, 51383, 153833, 24-2924; 10244, MICAL3, 51384, 153834, 1-2931; 10244, MICAL3, 51386, 153836, 354-6362; 10244, MICAL3, 51388, 153838, 63-3284; 10245, MAST1, 51396, 153846, 1-398; 10245, MAST1, 51397, 153847, 1-1300; 10245, MAST1, 51398, 153848, 18-1445; 10245, MAST1, 51395, 153845, 40-4752; 10246, MAST2, 51400, 153850, 168-2528; 10246, MAST2, 51401, 153851, 38-2413; 10246, MAST2, 51399, 153849, 284-5680; 10247, MAST3, 51403, 153853, 1-261; 10247, MAST3, 51402, 153852, 1-3930; 10248, MAST4, 51405, 153855, 379-7713; 10248, MAST4, 51407, 153857, 1-717; 10248, MAST4, 51409, 153859, 352-522; 10248, MAST4, 51410, 153860, 296-8167; 10248, MAST4, 51411, 153861, 80-582; 10248, MAST4, 51412, 153862, 1-243; 10248, MAST4, 51413, 153863, 1-200; 10248, MAST4, 51414, 153864, 243-743; 10248, MAST4, 51415, 153865, 1-5041; 10248, MAST4, 51416, 153866, 1-177; 10248, MAST4, 51417, 153867, 1-299; 10248, MAST4, 51418, 153868, 1-369; 10248, MAST4, 51419, 153869, 261-438; 10248, MAST4, 51420, 153870, 71-1123; 10248, MAST4, 51404, 153854, 375-7664; 10248, MAST4, 51406, 153856, 69-7373; 10248, MAST4, 51408, 153858, 277-1029; 10249, MASTL, 51424, 153874, 1-1440; 10249, MASTL, 51421, 153871, 58-2580; 10249, MASTL, 51422, 153872, 58-2697; 10249, MASTL, 51423, 153873, 604-3240; 10250, MTUS1, 51430, 153880, 1-1517; 10250, MTUS1, 51432, 153882, 166-291; 10250, MTUS1, 51433, 153883, 165-1193; 10250, MTUS1, 51425, 153875, 226-4038; 10250, MTUS1, 51426, 153876, 294-1604; 10250, MTUS1, 51427, 153877, 321-1874; 10250, MTUS1, 51428, 153878, 475-4125; 10250, MTUS1, 51429, 153879, 175-3825; 10250, MTUS1, 51431, 153881, 272-1519; 10251, MTUS2, 51435, 153885, 59-4198; 10251, MTUS2, 51437, 153887, 550-4689; 10251, MTUS2, 51434, 153884, 217-1263; 10251, MTUS2, 51436, 153886, 338-1114; 10252, MTCL1, 51442, 153892, 688-2217; 10252, MTCL1, 51444, 153894, 232-373; 10252, MTCL1, 51438, 153888, 1-5718; 10252, MTCL1, 51439, 153889, 143-4903; 10252, MTCL1, 51440, 153890, 93-4853; 10252, MTCL1, 51441, 153891, 183-4820; 10252, MTCL1, 51443, 153893, 95-3025; 10253, MACF1, 51446, 153896, 1-1631; 10253, MACF1, 51449, 153899, 1-13303; 10253, MACF1, 51450, 153900, 1-1366; 10253, MACF1, 51451, 153901, 1-1106; 10253, MACF1, 51452, 153902, 1-477; 10253, MACF1, 51453, 153903, 1194-5477; 10253, MACF1, 51454, 153904, 1-1085; 10253, MACF1, 51455, 153905, 336-701; 10253, MACF1, 51456, 153906, 214-4338; 10253, MACF1, 51457, 153907, 234-3422; 10253, MACF1, 51458, 153908, 329-667; 10253, MACF1, 51459, 153909, 172-6257; 10253, MACF1, 51460, 153910, 778-23445; 10253, MACF1, 51461, 153911, 158-22936; 10253, MACF1, 51462, 153912, 180-545; 10253, MACF1, 51445, 153895, 132-17948; 10253, MACF1, 51447, 153897, 53-16345; 10253, MACF1, 51448, 153898, 88-22254; 10254, MAP1LC3A, 51463, 153913, 762-1127; 10254, MAP1LC3A, 51464, 153914, 137-514; 10254, MAP1LC3A, 51465, 153915, 152-517; 10255, MAP1LC3B, 51467, 153917, 85-291; 10255, MAP1LC3B, 51468, 153918, 112-255; 10255, MAP1LC3B, 51469, 153919, 95-322; 10255, MAP1LC3B, 51466, 153916, 629-1006; 10256, MAP1LC3B2, 51470, 153920, 155-532; 10257, MAP1LC3C, 51471, 153921, 66-509; 10258, MAP10, 51472, 153922, 133-3276; 10259, MAP1A, 51474, 153924, 32-9157; 10259, MAP1A, 51473, 153923, 451-8862; 10260, MAP1B, 51476, 153926, 373-2079; 10260, MAP1B, 51477, 153927, 47-2056; 10260, MAP1B, 51478, 153928, 214-580; 10260, MAP1B, 51479, 153929, 56-367; 10260, MAP1B, 51475, 153925, 299-7705; 10261, MAP1S, 51482, 153932, 194-439; 10261, MAP1S, 51483, 153933, 24-272; 10261, MAP1S, 51484, 153934, 197-436; 10261, MAP1S, 51485, 153935, 24-580; 10261, MAP1S, 51486, 153936, 17-585; 10261, MAP1S, 51487, 153937, 167-370; 10261, MAP1S, 51488, 153938, 24-305; 10261, MAP1S, 51489, 153939, 24-587; 10261, MAP1S, 51490, 153940, 1-363; 10261, MAP1S, 51480, 153930, 152-3331; 10261, MAP1S, 51481, 153931, 236-3337; 10262, MAP2, 51494, 153944, 296-614; 10262, MAP2, 51496, 153946, 1-624; 10262, MAP2, 51498, 153948, 319-2019; 10262, MAP2, 51491, 153941, 441-2120; 10262, MAP2, 51492, 153942, 507-5990; 10262, MAP2, 51493, 153943, 497-1912; 10262, MAP2, 51495, 153945, 167-1582; 10262, MAP2, 51497, 153947, 1-5472; 10263, MAP4, 51499, 153949, 1-1392; 10263, MAP4, 51501, 153951, 1-2282; 10263, MAP4, 51505, 153955, 89-6982; 10263, MAP4, 51506, 153956, 345-2831; 10263, MAP4, 51507, 153957, 49-899; 10263, MAP4, 51508, 153958, 1-1480; 10263, MAP4, 51509, 153959, 260-487; 10263, MAP4, 51510, 153960, 150-570; 10263, MAP4, 51500, 153950, 520-3978; 10263, MAP4, 51502, 153952, 87-3494; 10263, MAP4, 51503, 153953, 72-371; 10263, MAP4, 51504, 153954, 99-398; 10264, MAP6, 51511, 153961, 752-3193; 10264, MAP6, 51512, 153962, 66-1385; 10264, MAP6, 51513, 153963, 161-1615; 10265, MAP7, 51519, 153969, 250-2589; 10265, MAP7, 51514, 153964, 412-2661; 10265, MAP7, 51515, 153965, 20-2224; 10265, MAP7, 51516, 153966, 119-2434; 10265, MAP7, 51517, 153967, 617-2428; 10265, MAP7, 51518, 153968, 94-2298; 10265, MAP7, 51520, 153970, 412-2550; 10265, MAP7, 51521, 153971, 118-1929; 10265, MAP7, 51522, 153972, 412-2379; 10266, MAP9, 51524, 153974, 257-829; 10266, MAP9, 51525, 153975, 180-1644; 10266, MAP9, 51526, 153976, 468-560; 10266, MAP9, 51527, 153977, 265-1395; 10266, MAP9, 51528, 153978, 1-100; 10266, MAP9, 51529, 153979, 131-2002; 10266, MAP9, 51523, 153973, 265-2208; 10267, MAPT, 51541, 153991, 139-318; 10267, MAPT, 51546, 153996, 323-2653; 10267, MAPT, 51549, 153999, 323-2599; 10267, MAPT, 51553, 154003, 138-317; 10267, MAPT, 51554, 154004, 1-2277; 10267, MAPT, 51556, 154006, 1-2331; 10267, MART, 51558, 154008, 139-318; 10267, MAPT, 51561, 154011, 1-2331; 10267, MAPT, 51562, 154012, 1-2277; 10267, MAPT, 51563, 154013, 5493-6518; 10267, MAPT, 51530, 153980, 323-2599; 10267, MAPT, 51531, 153981, 323-1648; 10267, MAPT, 51532, 153982, 37-1095; 10267, MAPT, 51533, 153983, 323-1561; 10267, MAPT, 51534, 153984, 323-2653; 10267, MAPT, 51535, 153985, 1-1233; 10267, MAPT, 51536, 153986, 31-1182; 10267, MAPT, 51537, 153987, 1-2331; 10267, MAPT, 51538, 153988, 1-1239; 10267, MAPT, 51539, 153989, 323-1555; 10267, MAPT, 51540, 153990, 1-2277; 10267, MAPT, 51542, 153992, 1-1326; 10267, MAPT, 51543, 153993, 1-1326; 10267, MAPT, 51544, 153994, 323-1561; 10267, MAPT, 51545, 153995, 21-1172; 10267, MAPT, 51547, 153997, 1-1233; 10267, MAPT, 51548, 153998, 31-1182; 10267, MAPT, 51550, 154000, 1-1239; 10267, MAPT, 51551, 154001, 323-1555; 10267, MAPT, 51552, 154002, 323-1648; 10267, MAPT, 51555, 154005, 31-1182; 10267, MAPT, 51557, 154007, 37-1095; 10267, MAPT, 51559, 154009, 1-1326; 10267, MAPT, 51560, 154010, 1-1239; 10267, MART, 51564, 154014, 37-1095; 10267, MAPT, 51565, 154015, 1-1233; 10268, MAPRE1, 51566, 154016, 140-946; 10269, MAPRE2, 51572, 154022, 151-553; 10269, MAPRE2, 51573, 154023, 351-584; 10269, MAPRE2, 51574, 154024, 222-803; 10269, MAPRE2, 51576, 154026, 163-543; 10269, MAPRE2, 51567, 154017, 181-1164; 10269, MAPRE2, 51568, 154018, 222-1076; 10269, MAPRE2, 51569, 154019, 275-1222; 10269, MAPRE2, 51570, 154020, 168-992; 10269, MAPRE2, 51571, 154021, 125-979; 10269, MAPRE2, 51575, 154025, 110-889; 10270, MAPRE3, 51580, 154030, 225-878; 10270, MAPRE3, 51577, 154027, 199-1044; 10270, MAPRE3, 51578, 154028, 153-953; 10270, MAPRE3, 51579, 154029, 194-994; 10271, MID1IP1, 51581, 154031, 946-1497; 10271, MID1IP1, 51582, 154032, 403-954; 10271, MID1IP1, 51583, 154033, 321-872; 10271, MID1IP1, 51584, 154034, 2200-2751; 10272, MDN1, 51586, 154036, 112-3654; 10272, MDN1, 51587, 154037, 1-189; 10272, MDN1, 51585, 154035, 117-16907; 10272, MDN1, 51588, 154038, 117-16907; 10273, MDK, 51595, 154045, 394-540; 10273, MDK, 51596, 154046, 84-477; 10273, MDK, 51597, 154047, 151-621; 10273, MDK, 51598, 154048, 106-564; 10273, MDK, 51589, 154039, 223-654; 10273, MDK, 51590, 154040, 177-608; 10273, MDK, 51591, 154041, 85-516; 10273, MDK, 51592, 154042, 92-355; 10273, MDK, 51593, 154043, 306-737; 10273, MDK, 51594, 154044, 430-861; 10274, MID1, 51605, 154055, 353-945; 10274, MID1, 51606, 154056, 280-1729; 10274, MID1, 51608, 154058, 57-743; 10274, MID1, 51609, 154059, 57-1679; 10274, MID1, 51599, 154049, 402-2405; 10274, MID1, 51600, 154050, 229-2232; 10274, MID1, 51601, 154051, 380-2383; 10274, MID1, 51602, 154052, 187-1845; 10274, MID1, 51603, 154053, 277-2280; 10274, MID1, 51604, 154054, 158-2161; 10274, MID1, 51607, 154057, 332-2335; 10275, MID2, 51611, 154061, 103-758; 10275, MID2, 51610, 154060, 549-2756; 10275, MID2, 51612, 154062, 14-2131; 10276, MIDN, 51614, 154064, 1-416; 10276, MIDN, 51615, 154065, 516-1163; 10276, MIDN, 51613, 154063, 516-1922; 10276, MIDN, 51616, 154066, 410-1816; 10277, MIF4GD, 51619, 154069, 135-647; 10277, MIF4GD, 51621, 154071, 425-890; 10277, MIF4GD, 51622, 154072, 78-586; 10277, MIF4GD, 51624, 154074, 427-696; 10277, MIF4GD, 51625, 154075, 33-788; 10277, MIF4GD, 51626, 154076, 108-233; 10277, MIF4GD, 51627, 154077, 242-855; 10277, MIF4GD, 51617, 154067, 81-851; 10277, MIF4GD, 51618, 154068, 126-794; 10277, MIF4GD, 51620, 154070, 135-926; 10277, MIF4GD, 51623, 154073, 264-1055; 10277, MIF4GD, 51628, 154078, 54-722; 10278, MIEN1, 51630, 154080, 16-366; 10278, MIEN1, 51629, 154079, 293-640; 10279, MIIP, 51631, 154081, 170-1336; 10280, MFGE8, 51633, 154083, 63-1070; 10280, MFGE8, 51634, 154084, 61-1092; 10280, MFGE8, 51635, 154085, 61-138; 10280, MFGE8, 51636, 154086, 44-849; 10280, MFGE8, 51638, 154088, 1-228; 10280, MFGE8, 51632, 154082, 93-1256; 10280, MFGE8, 51637, 154087, 63-1226; 10281, MIB1, 51639, 154089, 265-3285; 10282, MIB2, 51641, 154091, 179-2938; 10282, MIB2, 51643, 154093, 102-446; 10282, MIB2, 51644, 154094, 344-598; 10282, MIB2, 51645, 154095, 352-2802; 10282, MIB2, 51646, 154096, 162-1349; 10282, MIB2, 51647, 154097, 136-522; 10282, MIB2, 51649, 154099, 328-3237; 10282, MIB2, 51650, 154100, 131-576; 10282, MIB2, 51651, 154101, 364-889; 10282, MIB2, 51652, 154102, 1-2488; 10282, MIB2, 51655, 154105, 1-174; 10282, MIB2, 51656, 154106, 1-999; 10282, MIB2, 51640, 154090, 40-3210; 10282, MIB2, 51642, 154092, 326-2587; 10282, MIB2, 51648, 154098, 18-3230; 10282, MIB2, 51653, 154103, 24-3041; 10282, MIB2, 51654, 154104, 46-3246; 10283, MCM10, 51657, 154107, 76-2643; 10283, MCM10, 51659, 154109, 262-469; 10283, MCM10, 51658, 154108, 129-2753; 10283, MCM10, 51660, 154110, 104-2731; 10284, MCM8, 51661, 154111, 153-2627; 10284, MCM8, 51662, 154112, 378-2759; 10284, MCM8, 51663, 154113, 378-3020; 10284, MCM8, 51664, 154114, 432-2954; 10284, MCM8, 51665, 154115, 378-2900; 10285, MCM9, 51668, 154118, 284-752; 10285, MCM9, 51669, 154119, 1-549; 10285, MCM9, 51670, 154120, 237-470; 10285, MCM9, 51666, 154116, 240-1415; 10285, MCM9, 51667, 154117, 288-3719; 10285, MCM9, 51671, 154121, 16-3447; 10286, MCMBP, 51672, 154122, 171-2099; 10286, MCMBP, 51673, 154123, 266-2188; 10287, MCM2, 51675, 154125, 1-274; 10287, MCM2, 51676, 154126, 238-547; 10287, MCM2, 51677, 154127, 309-693; 10287, MCM2, 51678, 154128, 58-498; 10287, MCM2, 51679, 154129, 1-2510; 10287, MCM2, 51674, 154124, 245-2959; 10288, MCM3, 51681, 154131, 65-2521; 10288, MCM3, 51682, 154132, 1-987; 10288, MCM3, 51683, 154133, 73-306; 10288, MCM3, 51680, 154130, 78-2504; 10288, MCM3, 51684, 154134, 29-2590; 10288, MCM3, 51685, 154135, 73-2634;

10289, MCM3AP, 51688, 154138, 595-876; 10289, MCM3AP, 51686, 154136, 109-6051; 10289, MCM3AP, 51687, 154137, 256-6198; 10290, MCM4, 51690, 154140, 72-317; 10290, MCM4, 51691, 154141, 4-839; 10290, MCM4, 51692, 154142, 100-734; 10290, MCM4, 51694, 154144, 151-572; 10290, MCM4, 51695, 154145, 1-83; 10290, MCM4, 51689, 154139, 210-2801; 10290, MCM4, 51693, 154143, 132-2723; 10291, MCM5, 51697, 154147, 81-2156; 10291, MCM5, 51698, 154148, 48-739; 10291, MCM5, 51699, 154149, 100-551; 10291, MCM5, 51700, 154150, 84-257; 10291, MCM5, 51696, 154146, 155-2359; 10292, MCM6, 51701, 154151, 62-2527; 10293, MCM7, 51705, 154155, 948-1497; 10293, MCM7, 51706, 154156, 1-251; 10293, MCM7, 51702, 154152, 647-2806; 10293, MCM7, 51703, 154153, 647-1816; 10293, MCM7, 51704, 154154, 1141-2772; 10293, MCM7, 51707, 154157, 1250-2881; 10294, MCMDC2, 51708, 154158, 137-2035; 10294, MCMDC2, 51710, 154160, 94-285; 10294, MCMDC2, 51712, 154162, 150-278; 10294, MCMDC2, 51713, 154163, 131-1237; 10294, MCMDC2, 51709, 154159, 172-1944; 10294, MCMDC2, 51711, 154161, 172-2217; 10295, MINOS1-NBL1, 51714, 154164, 1-140; 10295, MINOS1-NBL1, 51715, 154165, 83-295; 10295, MINOS1-NBL1, 51716, 154166, 151-696; 10295, MINOS1-NBL1, 51717, 154167, 1-216; 10296, MIPOL1, 51720, 154170, 462-1697; 10296, MIPOL1, 51721, 154171, 419-1693; 10296, MIPOL1, 51723, 154173, 622-1896; 10296, MIPOL1, 51724, 154174, 391-775; 10296, MIPOL1, 51725, 154175, 421-732; 10296, MIPOL1, 51726, 154176, 435-977; 10296, MIPOL1, 51718, 154168, 467-1795; 10296, MIPOL1, 51719, 154169, 643-1971; 10296, MIPOL1, 51722, 154172, 339-1667; 10297, MIS12, 51728, 154178, 873-945; 10297, MIS12, 51730, 154180, 177-551; 10297, MIS12, 51727, 154177, 554-1171; 10297, MIS12, 51729, 154179, 330-947; 10297, MIS12, 51731, 154181, 746-1363; 10298, MIS18BP1, 51733, 154183, 343-808; 10298, MIS18BP1, 51734, 154184, 256-1746; 10298, MIS18BP1, 51735, 154185, 1-588; 10298, MIS18BP1, 51736, 154186, 1-235; 10298, MIS18BP1, 51737, 154187, 460-1950; 10298, MIS18BP1, 51732, 154182, 460-3858; 10299, MIS18A, 51738, 154188, 56-757; 10300, MSTO1, 51742, 154192, 1-236; 10300, MSTO1, 51739, 154189, 25-1737; 10300, MSTO1, 51740, 154190, 9-1583; 10300, MSTO1, 51741, 154191, 32-331; 10301, MINK1, 51746, 154196, 1-486; 10301, MINK1, 51747, 154197, 1-161; 10301, MINK1, 51748, 154198, 1-1145; 10301, MINK1, 51749, 154199, 172-507; 10301, MINK1, 51743, 154193, 185-4096; 10301, MINK1, 51744, 154194, 197-4195; 10301, MINK1, 51745, 154195, 1-3939; 10302, MIOS, 51752, 154202, 653-844; 10302, MIOS, 51753, 154203, 538-1075; 10302, MIOS, 51754, 154204, 153-602; 10302, MIOS, 51755, 154205, 345-536; 10302, MIOS, 51750, 154200, 422-3049; 10302, MIOS, 51751, 154201, 337-2964; 10303, MITD1, 51757, 154207, 70-662; 10303, MITD1, 51758, 154208, 55-216; 10303, MITD1, 51759, 154209, 1-696; 10303, MITD1, 51756, 154206, 78-827; 10304, MARC1, 51761, 154211, 1-790; 10304, MARC1, 51762, 154212, 1-360; 10304, MARC1, 51763, 154213, 1-299; 10304, MARC1, 51760, 154210, 187-1200; 10305, MARC2, 51766, 154216, 1-519; 10305, MARC2, 51767, 154217, 308-592; 10305, MARC2, 51764, 154214, 264-1037; 10305, MARC2, 51765, 154215, 199-1206; 10306, MAVS, 51768, 154218, 129-1751; 10306, MAVS, 51769, 154219, 421-1620; 10307, MALSU1, 51770, 154220, 154-858; 10308, MCU, 51774, 154224, 10-315; 10308, MCU, 51775, 154225, 141-407; 10308, MCU, 51776, 154226, 10-285; 10308, MCU, 51777, 154227, 10-174; 10308, MCU, 51778, 154228, 56-556; 10308, MCU, 51771, 154221, 10-1002; 10308, MCU, 51772, 154222, 22-1077; 10308, MCU, 51773, 154223, 446-1354; 10309, MCUR1, 51780, 154230, 1-373; 10309, MCUR1, 51779, 154229, 140-1219; 10309, MCUR1, 51781, 154231, 140-913; 10310, MICU1, 51783, 154233, 184-1620; 10310, MICU1, 51786, 154236, 1-739; 10310, MICU1, 51787, 154237, 138-774; 10310, MICU1, 51788, 154238, 104-1268; 10310, MICU1, 51789, 154239, 117-579; 10310, MICU1, 51790, 154240, 124-1566; 10310, MICU1, 51782, 154232, 98-1528; 10310, MICU1, 51784, 154234, 304-1140; 10310, MICU1, 51785, 154235, 95-931; 10311, MICU2, 51792, 154242, 34-742; 10311, MICU2, 51791, 154241, 67-1371; 10312, MICU3, 51794, 154244, 1-1127; 10312, MICU3, 51795, 154245, 1-301; 10312, MICU3, 51793, 154243, 43-1635; 10313, MTCH1, 51798, 154248, 1-602; 10313, MTCH1, 51799, 154249, 1-1185; 10313, MTCH1, 51800, 154250, 45-1136; 10313, MTCH1, 51796, 154246, 126-1244; 10313, MTCH1, 51797, 154247, 126-1295; 10314, MTCH2, 51802, 154252, 143-930; 10314, MTCH2, 51801, 154251, 159-1070; 10315, MCCD1, 51803, 154253, 299-658; 10315, MCCD1, 51804, 154254, 299-658; 10315, MCCD1, 51805, 154255, 299-658; 10315, MCCD1, 51806, 154256, 299-658; 10315, MCCD1, 51807, 154257, 299-658; 10315, MCCD1, 51808, 154258, 299-658; 10315, MCCD1, 51809, 154259, 299-658; 10315, MCCD1, 51810, 154260, 299-658; 10316, MUL1, 51811, 154261, 138-1196; 10317, MIEF1, 51813, 154263, 498-1934; 10317, MIEF1, 51815, 154265, 617-744; 10317, MIEF1, 51812, 154262, 425-1816; 10317, MIEF1, 51814, 154264, 551-1942; 10317, MIEF1, 51816, 154266, 476-922; 10317, MIEF1, 51817, 154267, 531-977; 10318, MIEF2, 51819, 154269, 142-633; 10318, MIEF2, 51822, 154272, 149-502; 10318, MIEF2, 51823, 154273, 101-466; 10318, MIEF2, 51824, 154274, 85-563; 10318, MIEF2, 51818, 154268, 212-1576; 10318, MIEF2, 51820, 154270, 149-766; 10318, MIEF2, 51821, 154271, 27-1424; 10319, MFF, 51830, 154280, 326-991; 10319, MFF, 51833, 154283, 484-581; 10319, MFF, 51834, 154284, 353-566; 10319, MFF, 51835, 154285, 541-720; 10319, MFF, 51836, 154286, 426-527; 10319, MFF, 51837, 154287, 1-465; 10319, MFF, 51838, 154288, 323-736; 10319, MFF, 51839, 154289, 384-560; 10319, MFF, 51840, 154290, 378-584; 10319, MFF, 51841, 154291, 364-576; 10319, MFF, 51842, 154292, 364-633; 10319, MFF, 51843, 154293, 402-558; 10319, MFF, 51825, 154275, 442-1470; 10319, MFF, 51826, 154276, 305-1021; 10319, MFF, 51827, 154277, 412-1287; 10319, MFF, 51828, 154278, 313-1044; 10319, MFF, 51829, 154279, 331-987; 10319, MFF, 51831, 154281, 497-1213; 10319, MFF, 51832, 154282, 210-866; 10320, MTFP1, 51846, 154296, 64-495; 10320, MTFP1, 51847, 154297, 101-325; 10320, MTFP1, 51848, 154298, 258-482; 10320, MTFP1, 51844, 154294, 351-851; 10320, MTFP1, 51845, 154295, 105-512; 10321, MTFR1, 51851, 154301, 1-435; 10321, MTFR1, 51852, 154302, 132-302; 10321, MTFR1, 51853, 154303, 1-875; 10321, MTFR1, 51854, 154304, 1-556; 10321, MTFR1, 51849, 154299, 127-1128; 10321, MTFR1, 51850, 154300, 81-983; 10322, MTFR1L, 51859, 154309, 300-756; 10322, MTFR1L, 51860, 154310, 304-815; 10322, MTFR1L, 51861, 154311, 247-405; 10322, MTFR1L, 51862, 154312, 138-686; 10322, MTFR1L, 51863, 154313, 358-838; 10322, MTFR1L, 51864, 154314, 211-555; 10322, MTFR1L, 51865, 154315, 244-575; 10322, MTFR1L, 51866, 154316, 249-407; 10322, MTFR1L, 51868, 154318, 682-722; 10322, MTFR1L, 51869, 154319, 445-1032; 10322, MTFR1L, 51871, 154321, 136-357; 10322, MTFR1L, 51872, 154322, 515-673; 10322, MTFR1L, 51873, 154323, 382-541; 10322, MTFR1L, 51855, 154305, 263-1141; 10322, MTFR1L, 51856, 154306, 309-1187; 10322, MTFR1L, 51857, 154307, 211-1089; 10322, MTFR1L, 51858, 154308, 114-956; 10322, MTFR1L, 51867, 154317, 1583-2200; 10322, MTFR1L, 51870, 154320, 188-805; 10323, MTFR2, 51877, 154327, 98-833; 10323, MTFR2, 51878, 154328, 1-346; 10323, MTFR2, 51874, 154324, 84-218; 10323, MTFR2, 51875, 154325, 391-1548; 10323, MTFR2, 51876, 154326, 116-1273; 10324, MGME1, 51879, 154329, 87-845; 10324, MGME1, 51880, 154330, 129-923; 10324, MGME1, 51881, 154331, 289-1323; 10325, N/A, 51882, 154332, 33-248; 10325, N/A, 51883, 154333, 17-328; 10326, MINOS1, 51885, 154335, 70-258; 10326, MINOS1, 51884, 154334, 57-293; 10327, MIPEP, 51886, 154336, 100-2241; 10328, MTFMT, 51890, 154340, 1-405; 10328, MTFMT, 51887, 154337, 15-1184; 10328, MTFMT, 51888, 154338, 27-461; 10328, MTFMT, 51889, 154339, 4-1173; 10329, MTPAP, 51892, 154342, 1-453; 10329, MTPAP, 51893, 154343, 160-816; 10329, MTPAP, 51891, 154341, 45-1793; 10330, MPC1, 51894, 154344, 266-466; 10330, MPC1, 51896, 154346, 482-682; 10330, MPC1, 51897, 154347, 138-467; 10330, MPC1, 51895, 154345, 123-452; 10331, MPC2, 51900, 154350, 331-645; 10331, MPC2, 51898, 154348, 160-543; 10331, MPC2, 51899, 154349, 200-583; 10332, MRPL1, 51902, 154352, 1-694; 10332, MRPL1, 51901, 154351, 330-1307; 10333, MRPL10, 51905, 154355, 13-159; 10333, MRPL10, 51907, 154357, 20-166; 10333, MRPL10, 51903, 154353, 454-1269; 10333, MRPL10, 51904, 154354, 7-792; 10333, MRPL10, 51906, 154356, 92-907; 10334, MRPL11, 51911, 154361, 1-192; 10334, MRPL11, 51912, 154362, 73-300; 10334, MRPL11, 51908, 154358, 95-673; 10334, MRPL11, 51909, 154359, 81-626; 10334, MRPL11, 51910, 154360, 95-595; 10335, MRPL12, 51914, 154364, 15-551; 10335, MRPL12, 51913, 154363, 146-742; 10336, MRPL13, 51916, 154366, 1-144; 10336, MRPL13, 51917, 154367, 309-485; 10336, MRPL13, 51918, 154368, 191-633; 10336, MRPL13, 51915, 154365, 293-829; 10337, MRPL14, 51919, 154369, 133-570; 10338, MRPL15, 51921, 154371, 8-601; 10338, MRPL15, 51922, 154372, 1-714; 10338, MRPL15, 51920, 154370, 75-965; 10339, MRPL16, 51924, 154374, 316-574; 10339, MRPL16, 51923, 154373, 215-970; 10340, MRPL17, 51926, 154376, 21-448; 10340, MRPL17, 51925, 154375, 106-633; 10341, MRPL18, 51927, 154377, 123-665; 10342, MRPL19, 51928, 154378, 15-536; 10342, MRPL19, 51931, 154381, 1-240; 10342, MRPL19, 51932, 154382, 315-744; 10342, MRPL19, 51933, 154383, 1-175; 10342, MRPL19, 51929, 154379, 26-904; 10342, MRPL19, 51930, 154380, 6-884; 10343, MRPL2, 51934, 154384, 14-691; 10343, MRPL2, 51936, 154386, 41-325; 10343, MRPL2, 51937, 154387, 58-348; 10343, MRPL2, 51938, 154388, 54-365; 10343, MRPL2, 51935, 154385, 426-1343; 10344, MRPL20, 51940, 154390, 1-201; 10344, MRPL20, 51939, 154389, 97-546; 10344, MRPL20, 51941, 154391, 74-541; 10345, MRPL21, 51944, 154394, 5-115; 10345, MRPL21, 51945, 154395, 18-470; 10345, MRPL21, 51946, 154396, 23-172; 10345, MRPL21, 51947, 154397, 26-175; 10345, MRPL21, 51948, 154398, 237-824; 10345, MRPL21, 51942, 154392, 11-628; 10345, MRPL21, 51943, 154393, 245-607; 10346, MRPL22, 51950, 154400, 17-715; 10346, MRPL22, 51951, 154401, 10-648; 10346, MRPL22, 51952, 154402, 1-117; 10346, MRPL22, 51954, 154404, 7-693; 10346, MRPL22, 51949, 154399, 141-521; 10346, MRPL22, 51953, 154403, 42-662; 10347, MRPL23, 51955, 154405, 23-514; 10347, MRPL23, 51957, 154407, 20-520; 10347, MRPL23, 51958, 154408, 32-607; 10347, MRPL23, 51960, 154410, 1-355; 10347, MRPL23, 51956, 154406, 86-547; 10347, MRPL23, 51959, 154409, 86-547; 10348, MRPL24, 51963, 154413, 219-514; 10348, MRPL24, 51964, 154414, 245-448; 10348, MRPL24, 51965, 154415, 472-990; 10348, MRPL24, 51961, 154411, 138-788; 10348, MRPL24, 51962, 154412, 140-790; 10349, MRPL27, 51967, 154417, 38-322; 10349, MRPL27, 51968, 154418, 216-497; 10349, MRPL27, 51969, 154419, 1-409; 10349, MRPL27, 51970, 154420, 27-281; 10349, MRPL27, 51971, 154421, 384-665; 10349, MRPL27, 51966, 154416, 45-491; 10350, MRPL28, 51974, 154424, 67-722; 10350, MRPL28, 51975, 154425, 37-619; 10350, MRPL28, 51976, 154426, 79-800; 10350, MRPL28, 51977, 154427, 150-296; 10350, MRPL28, 51972, 154422, 37-807; 10350, MRPL28, 51973, 154423, 33-803; 10351, MRPL3, 51979, 154429, 163-1290; 10351, MRPL3, 51980, 154430, 131-659; 10351, MRPL3, 51981, 154431, 384-848; 10351, MRPL3, 51982, 154432, 448-532; 10351, MRPL3, 51983, 154433, 1-1090; 10351, MRPL3, 51978, 154428, 149-1195; 10352, MRPL30, 51986, 154436, 92-397; 10352, MRPL30, 51984, 154434, 199-684; 10352, MRPL30, 51985, 154435, 29-514; 10353, MRPL32, 51988, 154438, 1-128; 10353, MRPL32, 51989, 154439, 12-335; 10353, MRPL32, 51987, 154437, 188-754; 10354, MRPL33, 51992, 154442, 40-249; 10354, MRPL33, 51990, 154440, 62-259; 10354, MRPL33, 51991, 154441, 62-226; 10355, MRPL34, 51995, 154445, 22-132; 10355, MRPL34, 51997, 154447, 33-587; 10355, MRPL34, 51993, 154443, 226-504; 10355, MRPL34, 51994, 154444, 351-629; 10355, MRPL34, 51996, 154446, 131-409; 10356, MRPL35, 52000, 154450, 29-562; 10356, MRPL35, 52001, 154451, 35-322; 10356, MRPL35, 51998, 154448, 137-649; 10356, MRPL35, 51999, 154449, 35-601; 10357, MRPL36, 52005, 154455, 687-793; 10357, MRPL36, 52002, 154452, 42-353; 10357, MRPL36, 52003, 154453, 61-372; 10357, MRPL36, 52004, 154454, 138-449; 10357, MRPL36, 52006, 154456, 46-357; 10358, MRPL37, 52007, 154457, 169-1047; 10358, MRPL37, 52009, 154459, 1-794; 10358, MRPL37, 52010, 154460, 49-1500; 10358, MRPL37, 52008, 154458, 78-1349; 10359, MRPL38, 52011, 154461, 539-1681; 10360, MRPL39, 52014, 154464, 10-900; 10360, MRPL39, 52012, 154462, 43-1059; 10360, MRPL39, 52013, 154463, 43-1104; 10361, MRPL4, 52017, 154467, 28-1101; 10361, MRPL4, 52018, 154468, 1-360; 10361, MRPL4, 52020, 154470, 175-558; 10361, MRPL4, 52021, 154471, 257-747; 10361, MRPL4, 52022, 154472, 68-730; 10361, MRPL4, 52023, 154473, 218-1118; 10361, MRPL4, 52015, 154465, 288-1223; 10361, MRPL4, 52016, 154466, 155-1090; 10361, MRPL4, 52019, 154469, 245-1036; 10362, MRPL40, 52024, 154474, 654-1274; 10363, MRPL41, 52025, 154475, 789-1202; 10364, MRPL42, 52026, 154476, 132-287; 10364, MRPL42, 52027, 154477, 133-552; 10364, MRPL42, 52031, 154481, 113-274; 10364, MRPL42, 52032, 154482, 135-602; 10364, MRPL42, 52033, 154483, 73-459; 10364, MRPL42, 52028, 154478, 137-565; 10364, MRPL42, 52029, 154479, 98-526; 10364, MRPL42, 52030, 154480, 162-590; 10365, MRPL43, 52040, 154490, 14-568; 10365, MRPL43, 52042, 154492, 1-509; 10365, MRPL43, 52043, 154493, 1-445; 10365, MRPL43, 52044, 154494, 73-207; 10365, MRPL43, 52034, 154484, 52-660; 10365, MRPL43, 52035, 154485, 55-702; 10365, MRPL43, 52036, 154486, 73-552; 10365, MRPL43, 52037, 154487, 73-780; 10365, MRPL43, 52038, 154488, 41-535; 10365, MRPL43, 52039, 154489, 41-520; 10365, MRPL43, 52041, 154491, 55-840; 10366, MRPL44, 52045, 154495, 70-1068; 10367, MRPL45, 52046, 154496, 162-932; 10367, MRPL45, 52047, 154497, 162-932; 10367, MRPL45, 52049, 154499, 162-1082; 10367, MRPL45, 52048, 154498, 162-1082; 10368, MRPL46, 52051, 154501, 13-273; 10368, MRPL46, 52052, 154502, 1-137; 10368, MRPL46, 52053, 154503, 14-523; 10368, MRPL46, 52050, 154500, 43-882; 10369, MRPL47, 52054, 154504, 17-709; 10369, MRPL47, 52055, 154505, 210-632; 10369, MRPL47, 52056, 154506, 31-783; 10370, MRPL48, 52058, 154508, 1352-1693; 10370, MRPL48, 52059, 154509, 482-823; 10370, MRPL48, 52060, 154510, 628-969; 10370, MRPL48, 52061, 154511, 520-598; 10370, MRPL48, 52062, 154512, 500-531; 10370, MRPL48, 52063, 154513, 96-254; 10370, MRPL48, 52064, 154514, 88-240; 10370, MRPL48, 52065, 154515, 16-168; 10370, MRPL48, 52066, 154516, 64-429; 10370, MRPL48, 52067, 154517, 90-242; 10370, MRPL48, 52068, 154518, 101-226; 10370, MRPL48, 52069, 154519, 249-287; 10370, MRPL48, 52057, 154507, 657-1295; 10371, MRPL49, 52071, 154521, 1-382; 10371, MRPL49, 52073, 154523, 37-207; 10371, MRPL49, 52074, 154524, 12-311; 10371, MRPL49, 52075, 154525, 27-449; 10371, MRPL49, 52070, 154520, 20-520; 10371, MRPL49, 52072, 154522, 29-529; 10372, MRPL50, 52076, 154526, 23-499; 10373, MRPL51, 52078, 154528, 223-321; 10373, MRPL51, 52079, 154529, 123-353; 10373, MRPL51, 52080, 154530, 152-382; 10373, MRPL51, 52081, 154531, 123-343; 10373, MRPL51, 52082, 154532, 203-433; 10373, MRPL51, 52083, 154533, 460-690; 10373, MRPL51, 52077, 154527, 463-849; 10374, MRPL52, 52084, 154534, 205-363; 10374, MRPL52, 52088, 154538, 11-343; 10374, MRPL52, 52091, 154541, 260-415; 10374, MRPL52, 52093, 154543, 225-383; 10374, MRPL52, 52094, 154544, 4-220; 10374, MRPL52, 52085, 154535, 31-402; 10374, MRPL52, 52086, 154536, 27-395; 10374, MRPL52, 52087, 154537, 1-264; 10374, MRPL52, 52089, 154539, 305-499; 10374, MRPL52, 52090, 154540, 368-562; 10374, MRPL52, 52092, 154542, 178-372; 10375, MRPL53, 52096, 154546, 28-240; 10375, MRPL53, 52095, 154545, 663-1001; 10376, MRPL54, 52098, 154548, 1-230; 10376, MRPL54, 52097, 154547, 38-454; 10377, MRPL55, 52103, 154553, 1175-1342; 10377, MRPL55, 52104, 154554, 474-641; 10377, MRPL55, 52118, 154568, 639-767; 10377, MRPL55, 52120, 154570, 316-544; 10377, MRPL55, 52121, 154571, 777-790; 10377, MRPL55, 52122, 154572, 199-224; 10377, MRPL55, 52123, 154573, 446-613; 10377, MRPL55, 52124, 154574, 565-636; 10377, MRPL55, 52099, 154549, 165-551; 10377, MRPL55, 52100, 154550, 277-663; 10377, MRPL55, 52101, 154551, 255-641; 10377, MRPL55, 52102, 154552, 194-580; 10377, MRPL55, 52105, 154555, 367-753; 10377, MRPL55, 52106, 154556, 523-909; 10377, MRPL55, 52107, 154557, 745-1131; 10377, MRPL55, 52108, 154558, 193-579; 10377, MRPL55, 52109, 154559, 130-624; 10377, MRPL55, 52110, 154560, 174-560; 10377, MRPL55, 52111, 154561, 177-563; 10377, MRPL55, 52112, 154562, 136-522; 10377, MRPL55, 52113, 154563, 163-549; 10377, MRPL55, 52114, 154564, 259-645; 10377, MRPL55, 52115, 154565, 98-484; 10377, MRPL55, 52116, 154566, 136-522; 10377, MRPL55, 52117, 154567, 219-605; 10377, MRPL55, 52119, 154569, 290-784; 10378, MRPL57, 52125, 154575, 79-387; 10379, MRPL9, 52126, 154576, 6-707; 10379, MRPL9, 52127, 154577, 86-889; 10380, MRPS10, 52128, 154578, 17-622; 10381, MRPS11, 52131, 154581, 266-622; 10381, MRPS11, 52129, 154579, 266-850; 10381, MRPS11, 52130, 154580, 1-486; 10382, MRPS12, 52135, 154585, 471-887; 10382, MRPS12, 52136, 154586, 342-758; 10382, MRPS12, 52137, 154587, 193-609; 10382, MRPS12, 52132, 154582, 471-887; 10382, MRPS12, 52133, 154583, 193-609; 10382, MRPS12, 52134, 154584, 342-758; 10383, MRPS14, 52139, 154589, 8-190; 10383, MRPS14, 52138, 154588, 18-404; 10384, MRPS15, 52140, 154590, 163-936; 10385, MRPS16, 52141, 154591, 212-511; 10385, MRPS16, 52142, 154592, 212-625; 10386, MRPS17, 52144, 154594, 332-718; 10386, MRPS17, 52143, 154593, 130-522; 10387, MRPS18A, 52147, 154597, 13-803; 10387, MRPS18A, 52145, 154595, 13-396; 10387, MRPS18A, 52146, 154596, 13-603; 10388, MRPS18B, 52149, 154599, 7-654; 10388, MRPS18B, 52151, 154601, 7-654; 10388, MRPS18B, 52152, 154602, 7-654; 10388, MRPS18B, 52153, 154603, 7-654; 10388, MRPS18B, 52156, 154606, 7-654; 10388, MRPS18B, 52157, 154607, 7-654; 10388, MRPS18B, 52148, 154598, 158-934; 10388, MRPS18B, 52150, 154600, 158-934; 10388, MRPS18B, 52154, 154604, 158-934; 10388, MRPS18B, 52155, 154605, 158-934; 10388, MRPS18B, 52158, 154608, 158-934; 10388, MRPS18B, 52159, 154609, 158-934; 10388, MRPS18B, 52160, 154610, 158-934; 10389, MRPS18C, 52162, 154612, 1-279; 10389, MRPS18C, 52163, 154613, 24-230; 10389, MRPS18C, 52164, 154614, 1-340; 10389, MRPS18C, 52165, 154615, 96-440; 10389, MRPS18C, 52161, 154611, 114-542; 10390, MRPS2, 52168, 154618, 1-810; 10390, MRPS2, 52166, 154616, 81-971; 10390, MRPS2, 52167, 154617, 210-1100; 10391, MRPS21, 52169, 154619, 448-711; 10391, MRPS21, 52170, 154620, 212-475; 10392, MRPS22, 52172, 154622, 378-532; 10392, MRPS22, 52174, 154624, 1-1080; 10392, MRPS22, 52175, 154625, 106-1065; 10392, MRPS22, 52176, 154626, 1-496; 10392, MRPS22, 52177, 154627, 1-600; 10392, MRPS22, 52178, 154628, 1-363; 10392, MRPS22, 52171, 154621, 9-1091; 10392, MRPS22, 52173, 154623, 433-1515; 10392, MRPS22, 52179, 154629, 6-512; 10393, MRPS23, 52181, 154631, 332-516; 10393, MRPS23, 52182, 154632, 35-493; 10393, MRPS23, 52180, 154630, 47-619; 10394, MRPS24, 52184, 154634, 388-606; 10394, MRPS24, 52183, 154633, 63-566; 10395, MRPS25, 52187, 154637, 118-450; 10395, MRPS25, 52188, 154638, 107-439; 10395, MRPS25, 52185, 154635, 142-663; 10395, MRPS25, 52186, 154636, 67-504; 10395, MRPS25, 52189, 154639, 124-513; 10396, MRPS26, 52190, 154640, 125-742; 10397, MRPS27, 52192, 154642, 60-956; 10397, MRPS27, 52194, 154644, 155-748; 10397, MRPS27, 52195, 154645, 171-1247; 10397, MRPS27, 52196, 154646, 8-292; 10397, MRPS27, 52191, 154641, 41-1285; 10397, MRPS27, 52193, 154643, 11-1297; 10398, MRPS28, 52198, 154648, 1-487; 10398, MRPS28, 52199, 154649, 42-302; 10398, MRPS28, 52200, 154650, 1-430; 10398, MRPS28, 52201, 154651, 94-403; 10398, MRPS28, 52202, 154652, 168-545; 10398, MRPS28, 52203, 154653, 86-411; 10398, MRPS28, 52204, 154654, 1-250; 10398, MRPS28, 52197, 154647, 24-587; 10399, MRPS30, 52206, 154656, 39-1052; 10399, MRPS30, 52205, 154655, 39-1358; 10400, MRPS31, 52207, 154657, 38-1225; 10401, MRPS33, 52212, 154662, 71-361; 10401, MRPS33, 52208, 154658, 101-421; 10401, MRPS33, 52209, 154659, 157-477; 10401, MRPS33, 52210, 154660, 162-482; 10401, MRPS33, 52211, 154661, 106-426; 10402, MRPS34, 52213, 154663, 32-709; 10402, MRPS34, 52215, 154665, 1-531; 10402, MRPS34, 52214, 154664, 37-693; 10403, MRPS35, 52217, 154667, 23-148; 10403, MRPS35, 52218, 154668, 1-117; 10403, MRPS35, 52219, 154669, 1-488; 10403, MRPS35, 52216, 154666, 72-1043; 10403, MRPS35, 52220, 154670, 10-594; 10404, MRPS36, 52222, 154672, 434-550; 10404, MRPS36, 52223, 154673, 434-550; 10404, MRPS36, 52225, 154675, 434-550; 10404, MRPS36, 52221, 154671, 71-382; 10404, MRPS36, 52224, 154674, 71-382; 10405, MRPS5, 52226, 154676, 210-1502; 10405, MRPS5, 52227, 154677, 9-764; 10406, MRPS6, 52228, 154678, 179-556;

10407, MRPS7, 52230, 154680, 1-470; 10407, MRPS7, 52231, 154681, 1-87; 10407, MRPS7, 52232, 154682, 228-779; 10407, MRPS7, 52233, 154683, 416-1231; 10407, MRPS7, 52234, 154684, 1-517; 10407, MRPS7, 52229, 154679, 228-956; 10408, MRPS9, 52236, 154686, 1-173; 10408, MRPS9, 52235, 154685, 111-1301; 10409, MRRF, 52242, 154692, 400-858; 10409, MRRF, 52237, 154687, 365-997; 10409, MRRF, 52238, 154688, 312-1100; 10409, MRRF, 52239, 154689, 73-678; 10409, MRRF, 52240, 154690, 107-763; 10409, MRRF, 52241, 154691, 29-634; 10409, MRRF, 52243, 154693, 85-615; 10409, MRRF, 52244, 154694, 42-548; 10409, MRRF, 52245, 154695, 45-551; 10410, MTG1, 52247, 154697, 48-899; 10410, MTG1, 52248, 154698, 103-984; 10410, MTG1, 52246, 154696, 51-1055; 10411, MTG2, 52250, 154700, 29-727; 10411, MTG2, 52251, 154701, 20-439; 10411, MTG2, 52249, 154699, 19-1239; 10412, MRM1, 52254, 154704, 259-735; 10412, MRM1, 52255, 154705, 259-735; 10412, MRM1, 52252, 154702, 240-1301; 10412, MRM1, 52253, 154703, 240-1301; 10413, MECR, 52258, 154708, 1-639; 10413, MECR, 52256, 154706, 27-1148; 10413, MECR, 52257, 154707, 374-1267; 10414, MTERF1, 52260, 154710, 228-1367; 10414, MTERF1, 52261, 154711, 79-554; 10414, MTERF1, 52262, 154712, 641-720; 10414, MTERF1, 52263, 154713, 163-581; 10414, MTERF1, 52264, 154714, 78-1217; 10414, MTERF1, 52259, 154709, 95-1294; 10415, MTERF2, 52268, 154718, 319-418; 10415, MTERF2, 52269, 154719, 180-715; 10415, MTERF2, 52270, 154720, 323-581; 10415, MTERF2, 52265, 154715, 367-1524; 10415, MTERF2, 52266, 154716, 340-1497; 10415, MTERF2, 52267, 154717, 2070-3227; 10416, MTERF3, 52272, 154722, 193-714; 10416, MTERF3, 52273, 154723, 121-1206; 10416, MTERF3, 52274, 154724, 210-412; 10416, MTERF3, 52271, 154721, 100-1353; 10416, MTERF3, 52275, 154725, 191-1081; 10417, MTERF4, 52278, 154728, 92-673; 10417, MTERF4, 52279, 154729, 15-561; 10417, MTERF4, 52280, 154730, 39-797; 10417, MTERF4, 52281, 154731, 96-549; 10417, MTERF4, 52282, 154732, 1-457; 10417, MTERF4, 52283, 154733, 1-774; 10417, MTERF4, 52284, 154734, 1-324; 10417, MTERF4, 52285, 154735, 21-583; 10417, MTERF4, 52286, 154736, 37-786; 10417, MTERF4, 52276, 154726, 23-1168; 10417, MTERF4, 52277, 154727, 60-1205; 10417, MTERF4, 52287, 154737, 23-1168; 10418, MTIF2, 52290, 154740, 227-437; 10418, MTIF2, 52292, 154742, 372-583; 10418, MTIF2, 52293, 154743, 559-580; 10418, MTIF2, 52294, 154744, 738-955; 10418, MTIF2, 52295, 154745, 536-566; 10418, MTIF2, 52296, 154746, 1-903; 10418, MTIF2, 52297, 154747, 439-517; 10418, MTIF2, 52288, 154738, 317-2500; 10418, MTIF2, 52289, 154739, 11-2194; 10418, MTIF2, 52291, 154741, 150-2333; 10419, MTIF3, 52298, 154748, 236-1072; 10419, MTIF3, 52299, 154749, 137-973; 10419, MTIF3, 52300, 154750, 28-864; 10420, MTRF1, 52303, 154753, 143-820; 10420, MTRF1, 52304, 154754, 102-557; 10420, MTRF1, 52305, 154755, 378-833; 10420, MTRF1, 52306, 154756, 1-414; 10420, MTRF1, 52307, 154757, 102-563; 10420, MTRF1, 52301, 154751, 471-1808; 10420, MTRF1, 52302, 154752, 102-1439; 10421, MTRF1L, 52311, 154761, 1-696; 10421, MTRF1L, 52312, 154762, 18-508; 10421, MTRF1L, 52308, 154758, 1-708; 10421, MTRF1L, 52309, 154759, 1-816; 10421, MTRF1L, 52310, 154760, 1-1143; 10422, MTO1, 52315, 154765, 59-415; 10422, MTO1, 52317, 154767, 1-297; 10422, MTO1, 52318, 154768, 91-669; 10422, MTO1, 52320, 154770, 54-386; 10422, MTO1, 52321, 154771, 1-435; 10422, MTO1, 52322, 154772, 78-365; 10422, MTO1, 52323, 154773, 1-346; 10422, MTO1, 52324, 154774, 1-260; 10422, MTO1, 52313, 154763, 91-2244; 10422, MTO1, 52314, 154764, 55-1986; 10422, MTO1, 52316, 154766, 278-2476; 10422, MTO1, 52319, 154769, 278-2356; 10423, MT-ATP6, 52325, 154775, 1-681; 10424, MT-ATP8, 52326, 154776, 1-207; 10425, MT-CYB, 52327, 154777, 1-1141; 10426, MT-CO1, 52328, 154778, 1-1542; 10427, MT-CO2, 52329, 154779, 1-684; 10428, MT-CO3, 52330, 154780, 1-784; 10429, MT-ND1, 52331, 154781, 1-956; 10430, MT-ND2, 52332, 154782, 1-1042; 10431, MT-ND3, 52333, 154783, 1-346; 10432, MT-ND4, 52334, 154784, 1-1378; 10433, MT-ND4L, 52335, 154785, 1-297; 10434, MT-ND5, 52336, 154786, 1-1812; 10435, MT-ND6, 52337, 154787, 1-525; 10436, MGARP, 52338, 154788, 181-903; 10437, MFN1, 52339, 154789, 92-2317; 10437, MFN1, 52341, 154791, 80-543; 10437, MFN1, 52342, 154792, 1-1482; 10437, MFN1, 52343, 154793, 172-543; 10437, MFN1, 52344, 154794, 127-2352; 10437, MFN1, 52340, 154790, 84-1196; 10438, MFN2, 52346, 154796, 196-489; 10438, MFN2, 52345, 154795, 323-2596; 10438, MFN2, 52347, 154797, 309-2582; 10439, MAPK1, 52348, 154798, 190-1272; 10439, MAPK1, 52349, 154799, 241-1323; 10439, MAPK1, 52350, 154800, 1-951; 10440, MAPK1IP1L, 52351, 154801, 178-915; 10440, MAPK1IP1L, 52352, 154802, 126-863; 10441, MAPK10, 52353, 154803, 392-823; 10441, MAPK10, 52356, 154806, 119-1078; 10441, MAPK10, 52358, 154808, 1122-2081; 10441, MAPK10, 52361, 154811, 675-1634; 10441, MAPK10, 52362, 154812, 344-489; 10441, MAPK10, 52363, 154813, 289-562; 10441, MAPK10, 52364, 154814, 430-581; 10441, MAPK10, 52365, 154815, 218-569; 10441, MAPK10, 52366, 154816, 380-743; 10441, MAPK10, 52367, 154817, 313-564; 10441, MAPK10, 52368, 154818, 464-563; 10441, MAPK10, 52369, 154819, 330-550; 10441, MAPK10, 52370, 154820, 1-1006; 10441, MAPK10, 52371, 154821, 173-595; 10441, MAPK10, 52372, 154822, 568-722; 10441, MAPK10, 52354, 154804, 528-1922; 10441, MAPK10, 52355, 154805, 223-1491; 10441, MAPK10, 52357, 154807, 442-1275; 10441, MAPK10, 52359, 154809, 1053-2333; 10441, MAPK10, 52360, 154810, 722-2002; 10442, MAPK11, 52375, 154825, 102-593; 10442, MAPK11, 52373, 154823, 102-1196; 10442, MAPK11, 52374, 154824, 102-1196; 10443, MAPK12, 52377, 154827, 35-394; 10443, MAPK12, 52378, 154828, 128-961; 10443, MAPK12, 52376, 154826, 317-1420; 10443, MAPK12, 52379, 154829, 208-1281; 10444, MAPK13, 52381, 154831, 155-613; 10444, MAPK13, 52380, 154830, 263-1360; 10444, MAPK13, 52382, 154832, 100-873; 10445, MAPK14, 52386, 154836, 1-271; 10445, MAPK14, 52387, 154837, 1-522; 10445, MAPK14, 52388, 154838, 188-585; 10445, MAPK14, 52389, 154839, 302-1153; 10445, MAPK14, 52390, 154840, 482-1003; 10445, MAPK14, 52383, 154833, 389-1471; 10445, MAPK14, 52384, 154834, 448-1530; 10445, MAPK14, 52385, 154835, 1-924; 10446, MAPK15, 52394, 154844, 39-868; 10446, MAPK15, 52391, 154841, 120-1754; 10446, MAPK15, 52392, 154842, 1-834; 10446, MAPK15, 52393, 154843, 1-765; 10446, MAPK15, 52395, 154845, 120-1754; 10447, MAPK3, 52399, 154849, 29-964; 10447, MAPK3, 52401, 154851, 554-961; 10447, MAPK3, 52402, 154852, 19-1038; 10447, MAPK3, 52403, 154853, 1135-1932; 10447, MAPK3, 52404, 154854, 204-465; 10447, MAPK3, 52405, 154855, 86-1036; 10447, MAPK3, 52406, 154856, 1-366; 10447, MAPK3, 52396, 154846, 86-1225; 10447, MAPK3, 52397, 154847, 101-1108; 10447, MAPK3, 52398, 154848, 1-1074; 10447, MAPK3, 52400, 154850, 1-1008; 10448, MAPK4, 52408, 154858, 199-

1329; 10448, MAPK4, 52409, 154859, 989-1834; 10448, MAPK4, 52410, 154860, 973-1674; 10448, MAPK4, 52407, 154857, 1037-2800; 10449, MAPK6, 52411, 154861, 808-2973; 10450, MAPK7, 52416, 154866, 127-850; 10450, MAPK7, 52417, 154867, 54-640; 10450, MAPK7, 52418, 154868, 110-352; 10450, MAPK7, 52419, 154869, 145-615; 10450, MAPK7, 52420, 154870, 151-582; 10450, MAPK7, 52412, 154862, 369-2402; 10450, MAPK7, 52413, 154863, 387-2837; 10450, MAPK7, 52414, 154864, 296-2746; 10450, MAPK7, 52415, 154865, 314-2764; 10451, MAPK8, 52422, 154872, 1-657; 10451, MAPK8, 52428, 154878, 480-907; 10451, MAPK8, 52429, 154879, 311-603; 10451, MAPK8, 52430, 154880, 435-860; 10451, MAPK8, 52421, 154871, 50-976; 10451, MAPK8, 52423, 154873, 14-1297; 10451, MAPK8, 52424, 154874, 18-1172; 10451, MAPK8, 52425, 154875, 19-1173; 10451, MAPK8, 52426, 154876, 182-1465; 10451, MAPK8, 52427, 154877, 233-1516; 10452, MAPK8IP1, 52432, 154882, 331-2436; 10452, MAPK8IP1, 52431, 154881, 171-2306; 10453, MAPK8IP2, 52433, 154883, 135-2609; 10454, MAPK8IP3, 52435, 154885, 148-4140; 10454, MAPK8IP3, 52436, 154886, 1-208; 10454, MAPK8IP3, 52437, 154887, 121-4134; 10454, MAPK8IP3, 52434, 154884, 158-4168; 10455, MAPK9, 52438, 154888, 293-1312; 10455, MAPK9, 52441, 154891, 238-612; 10455, MAPK9, 52442, 154892, 21-395; 10455, MAPK9, 52446, 154896, 347-657; 10455, MAPK9, 52447, 154897, 21-665; 10455, MAPK9, 52439, 154889, 300-1448; 10455, MAPK9, 52440, 154890, 257-1405; 10455, MAPK9, 52443, 154893, 272-1546; 10455, MAPK9, 52444, 154894, 300-1574; 10455, MAPK9, 52445, 154895, 168-896; 10456, MAPKAP1, 52450, 154900, 298-693; 10456, MAPKAP1, 52456, 154906, 490-769; 10456, MAPKAP1, 52457, 154907, 226-984; 10456, MAPKAP1, 52458, 154908, 435-816; 10456, MAPKAP1, 52459, 154909, 1-283; 10456, MAPKAP1, 52460, 154910, 1-401; 10456, MAPKAP1, 52461, 154911, 216-953; 10456, MAPKAP1, 52448, 154898, 334-1902; 10456, MAPKAP1, 52449, 154899, 303-1763; 10456, MAPKAP1, 52451, 154901, 70-1638; 10456, MAPKAP1, 52452, 154902, 560-1552; 10456, MAPKAP1, 52453, 154903, 331-1758; 10456, MAPKAP1, 52454, 154904, 331-1302; 10456, MAPKAP1, 52455, 154905, 492-1484; 10457, MAPKBP1, 52464, 154914, 228-437; 10457, MAPKBP1, 52465, 154915, 440-908; 10457, MAPKBP1, 52467, 154917, 287-1282; 10457, MAPKBP1, 52468, 154918, 1-210; 10457, MAPKBP1, 52462, 154912, 197-4741; 10457, MAPKBP1, 52463, 154913, 287-4813; 10457, MAPKBP1, 52466, 154916, 179-3874; 10458, MAP2K1, 52470, 154920, 51-704; 10458, MAP2K1, 52469, 154919, 532-1713; 10459, MAP2K2, 52472, 154922, 295-1206; 10459, MAP2K2, 52473, 154923, 1-313; 10459, MAP2K2, 52471, 154921, 255-1457; 10460, MAP2K3, 52477, 154927, 250-390; 10460, MAP2K3, 52478, 154928, 212-514; 10460, MAP2K3, 52479, 154929, 95-575; 10460, MAP2K3, 52480, 154930, 1-411; 10460, MAP2K3, 52481, 154931, 211-351; 10460, MAP2K3, 52482, 154932, 211-351; 10460, MAP2K3, 52483, 154933, 100-621; 10460, MAP2K3, 52485, 154935, 211-351; 10460, MAP2K3, 52474, 154924, 210-1166; 10460, MAP2K3, 52475, 154925, 250-1293; 10460, MAP2K3, 52476, 154926, 95-1051; 10460, MAP2K3, 52484, 154934, 338-1294; 10461, MAP2K4, 52488, 154938, 59-196; 10461, MAP2K4, 52489, 154939, 1-49; 10461, MAP2K4, 52490, 154940, 1-126; 10461, MAP2K4, 52491, 154941, 18-296; 10461, MAP2K4, 52492, 154942, 1-126; 10461, MAP2K4, 52493, 154943, 18-143; 10461, MAP2K4, 52494, 154944, 18-155; 10461, MAP2K4, 52486, 154936, 64-1263; 10461, MAP2K4, 52487, 154937, 54-1286; 10462, MAP2K5, 52496, 154946, 352-1128; 10462, MAP2K5, 52499, 154949, 1-387; 10462, MAP2K5, 52500, 154950, 1-548; 10462, MAP2K5, 52501, 154951, 1-150; 10462, MAP2K5, 52495, 154945, 628-1974; 10462, MAP2K5, 52497, 154947, 184-1422; 10462, MAP2K5, 52498, 154948, 6-1322; 10463, MAP2K6, 52502, 154952, 152-358; 10463, MAP2K6, 52503, 154953, 249-632; 10463, MAP2K6, 52504, 154954, 417-669; 10463, MAP2K6, 52505, 154955, 410-1246; 10463, MAP2K6, 52506, 154956, 288-1292; 10463, MAP2K6, 52507, 154957, 409-1245; 10464, MAP2K7, 52508, 154958, 55-1314; 10464, MAP2K7, 52509, 154959, 103-1383; 10464, MAP2K7, 52510, 154960, 61-1368; 10465, MAP3K1, 52511, 154961, 1-4539; 10466, MAP3K10, 52513, 154963, 1-202; 10466, MAP3K10, 52514, 154964, 1-543; 10466, MAP3K10, 52515, 154965, 1-369; 10466, MAP3K10, 52512, 154962, 289-3153; 10467, MAP3K11, 52517, 154967, 1-648; 10467, MAP3K11, 52518, 154968, 486-1277; 10467, MAP3K11, 52520, 154970, 272-561; 10467, MAP3K11, 52521, 154971, 238-571; 10467, MAP3K11, 52516, 154966, 487-3030; 10467, MAP3K11, 52519, 154969, 523-2295; 10468, MAP3K12, 52523, 154973, 519-1700; 10468, MAP3K12, 52526, 154976, 74-150; 10468, MAP3K12, 52522, 154972, 227-2806; 10468, MAP3K12, 52524, 154974, 206-2884; 10468, MAP3K12, 52525, 154975, 68-2746; 10469, MAP3K13, 52528, 154978, 280-618; 10469, MAP3K13, 52530, 154980, 214-336; 10469, MAP3K13, 52531, 154981, 177-299; 10469, MAP3K13, 52534, 154984, 161-573; 10469, MAP3K13, 52535, 154985, 157-279; 10469, MAP3K13, 52536, 154986, 86-670; 10469, MAP3K13, 52539, 154989, 184-306; 10469, MAP3K13, 52540, 154990, 1-740; 10469, MAP3K13, 52527, 154977, 335-3235; 10469, MAP3K13, 52529, 154979, 154-540; 10469, MAP3K13, 52532, 154982, 256-3156; 10469, MAP3K13, 52533, 154983, 213-695; 10469, MAP3K13, 52537, 154987, 202-2670; 10469, MAP3K13, 52538, 154988, 165-2444; 10470, MAP3K14, 52542, 154992, 79-552; 10470, MAP3K14, 52541, 154991, 102-2945; 10470, MAP3K14, 52543, 154993, 232-3075; 10471, MAP3K15, 52545, 154995, 1-851; 10471, MAP3K15, 52544, 154994, 1-3942; 10472, MAP3K19, 52549, 154999, 121-3579; 10472, MAP3K19, 52552, 155002, 231-537; 10472, MAP3K19, 52553, 155003, 1-2094; 10472, MAP3K19, 52554, 155004, 477-541; 10472, MAP3K19, 52546, 154996, 32-3679; 10472, MAP3K19, 52547, 154997, 32-1564; 10472, MAP3K19, 52548, 154998, 32-4018; 10472, MAP3K19, 52550, 155000, 32-1414; 10472, MAP3K19, 52551, 155001, 32-1420; 10473, MAP3K2, 52556, 155006, 547-689; 10473, MAP3K2, 52555, 155005, 101-1960; 10473, MAP3K2, 52557, 155007, 284-2143; 10474, MAP3K3, 52561, 155011, 51-1919; 10474, MAP3K3, 52562, 155012, 51-221; 10474, MAP3K3, 52563, 155013, 336-2297; 10474, MAP3K3, 52564, 155014, 1-128; 10474, MAP3K3, 52565, 155015, 1-95; 10474, MAP3K3, 52558, 155008, 321-2201; 10474, MAP3K3, 52559, 155009, 319-2292; 10474, MAP3K3, 52560, 155010, 67-2040; 10475, MAP3K4, 52566, 155016, 119-4783; 10475, MAP3K4, 52568, 155018, 119-4933; 10475, MAP3K4, 52570, 155020, 156-225; 10475, MAP3K4, 52571, 155021, 164-421; 10475, MAP3K4, 52572, 155022, 89-4417; 10475, MAP3K4, 52573, 155023, 89-1999; 10475, MAP3K4, 52567, 155017, 206-4882; 10475, MAP3K4, 52569, 155019, 149-4975; 10476, MAP3K5, 52574, 155024, 362-4486; 10477, MAP3K6, 52577, 155027, 1-2396; 10477, MAP3K6, 52578, 155028, 1-248; 10477, MAP3K6, 52575, 155025, 270-4136; 10477, MAP3K6, 52576, 155026, 262-4104; 10477, MAP3K6, 52579, 155029, 241-4107; 10478, MAP3K7, 52580, 155030, 1728-2510; 10478, MAP3K7, 52581, 155031, 1-1557; 10478, MAP3K7, 52582, 155032, 7-1482; 10478, MAP3K7, 52583, 155033, 163-1983; 10478, MAP3K7, 52584, 155034, 163-1902; 10479, MAP3K8, 52587, 155037, 390-788; 10479, MAP3K8, 52588, 155038, 108-776; 10479, MAP3K8, 52589, 155039, 262-1026; 10479, MAP3K8, 52585, 155035, 697-2100; 10479, MAP3K8, 52586, 155036, 118-1521; 10479, MAP3K8, 52590, 155040, 382-1785; 10480, MAP3K9, 52591, 155041, 336-3581; 10480, MAP3K9, 52592, 155042, 317-2830; 10480, MAP3K9, 52595, 155045, 239-2737; 10480, MAP3K9, 52596, 155046, 1-2643; 10480, MAP3K9, 52593, 155043, 364-3720; 10480, MAP3K9, 52594, 155044, 1-3315; 10481, MAP4K1, 52599, 155049, 1-1577; 10481, MAP4K1, 52600, 155050, 72-1259; 10481, MAP4K1, 52601, 155051, 99-2552; 10481, MAP4K1, 52602, 155052, 1-208; 10481, MAP4K1, 52603, 155053, 99-2552; 10481, MAP4K1, 52604, 155054, 30-2531; 10481, MAP4K1, 52605, 155055, 72-1259; 10481, MAP4K1, 52606, 155056, 1-208; 10481, MAP4K1, 52607, 155057, 109-2574; 10481, MAP4K1, 52608, 155058, 1-1577; 10481, MAP4K1, 52597, 155047, 109-2574; 10481, MAP4K1, 52598, 155048, 30-2531; 10482, MAP4K2, 52611, 155061, 14-187; 10482, MAP4K2, 52612, 155062, 1-434; 10482, MAP4K2, 52613, 155063, 27-947; 10482, MAP4K2, 52614, 155064, 79-255; 10482, MAP4K2, 52615, 155065, 1-174; 10482, MAP4K2, 52609, 155059, 93-2555; 10482, MAP4K2, 52610, 155060, 93-2531; 10483, MAP4K3, 52618, 155068, 1-432; 10483, MAP4K3, 52619, 155069, 161-556; 10483, MAP4K3, 52620, 155070, 242-376; 10483, MAP4K3, 52621, 155071, 152-2584; 10483, MAP4K3, 52622, 155072, 79-357; 10483, MAP4K3, 52616, 155066, 326-3010; 10483, MAP4K3, 52617, 155067, 315-2936; 10484, MAP4K4, 52623, 155073, 379-3876; 10484, MAP4K4, 52624, 155074, 221-3184; 10484, MAP4K4, 52625, 155075, 379-4086; 10484, MAP4K4, 52627, 155077, 379-4200; 10484, MAP4K4, 52628, 155078, 1-3117; 10484, MAP4K4, 52629, 155079, 56-3520; 10484, MAP4K4, 52630, 155080, 338-4156; 10484, MAP4K4, 52631, 155081, 1-3169; 10484, MAP4K4, 52632, 155082, 221-526; 10484, MAP4K4, 52633, 155083, 1-3513; 10484, MAP4K4, 52634, 155084, 1-776; 10484, MAP4K4, 52635, 155085, 56-4018; 10484, MAP4K4, 52636, 155086, 1-3135; 10484, MAP4K4, 52637, 155087, 56-3553; 10484, MAP4K4, 52626, 155076, 1-3720; 10485, MAP4K5, 52638, 155088, 320-2860; 10485, MAP4K5, 52639, 155089, 318-484; 10485, MAP4K5, 52640, 155090, 39-227; 10485, MAP4K5, 52641, 155091, 135-545; 10485, MAP4K5, 52642, 155092, 267-592; 10486, N/A, 52643, 155093, 121-1569; 10486, N/A, 52644, 155094, 262-1974; 10486, N/A, 52645, 155095, 262-3372; 10487, N/A, 52646, 155096, 196-1563; 10487, N/A, 52649, 155099, 247-661; 10487, N/A, 52650, 155100, 271-1638; 10487, N/A, 52647, 155097, 79-2481; 10487, N/A, 52648, 155098, 137-2539; 10488, MAPKAPK2, 52651, 155101, 287-1399; 10488, MAPKAPK2, 52652, 155102, 194-1396; 10489, MAPKAPK3, 52654, 155104, 1-292; 10489, MAPKAPK3, 52656, 155106, 177-535; 10489, MAPKAPK3, 52657, 155107, 164-1160; 10489, MAPKAPK3, 52653, 155103, 110-1258; 10489, MAPKAPK3, 52655, 155105, 597-1745; 10489, MAPKAPK3, 52658, 155108, 164-1312; 10490, MAPKAPK5, 52659, 155109, 252-476; 10490, MAPKAPK5, 52662, 155112, 1-974; 10490, MAPKAPK5, 52663, 155113, 260-415; 10490, MAPKAPK5, 52660, 155110, 109-1530; 10490, MAPKAPK5, 52661, 155111, 757-2172; 10491, MZT1, 52664, 155114, 86-334; 10492, MZT2A, 52666, 155116, 1-421; 10492, MZT2A, 52665, 155115, 47-523; 10493, MZT2B, 52668, 155118, 27-683; 10493, MZT2B, 52669, 155119, 1-366; 10493, MZT2B, 52670, 155120, 1-368; 10493, MZT2B, 52671, 155121, 1-363; 10493, MZT2B, 52667, 155117, 356-832; 10494, MISP, 52672, 155122, 104-2143; 10495, MIXL1, 52673, 155123, 65-763; 10495, MIXL1, 52674, 155124, 65-787; 10496, MLKL, 52677, 155127, 371-1004; 10496, MLKL, 52678, 155128, 1-307; 10496, MLKL, 52679, 155129, 1-527; 10496, MLKL, 52680, 155130, 382-567; 10496, MLKL, 52675, 155125, 341-1132; 10496, MLKL, 52676, 155126, 465-1880; 10497, MKL2, 52682, 155132, 336-545; 10497, MKL2, 52684, 155134, 1-575; 10497, MKL2, 52686, 155136, 199-1308; 10497, MKL2, 52688, 155138, 1-159; 10497, MKL2, 52681, 155131, 131-3280; 10497, MKL2, 52683, 155133, 156-3305; 10497, MKL2, 52685, 155135, 173-3472; 10497, MKL2, 52687, 155137, 159-1295; 10498, MKRN2OS, 52690, 155140, 59-289; 10498, MKRN2OS, 52689, 155139, 93-764; 10499, MLXIP, 52693, 155143, 1399-1619; 10499, MLXIP, 52695, 155145, 1-513; 10499, MLXIP, 52696, 155146, 759-1682; 10499, MLXIP, 52697, 155147, 138-791; 10499, MLXIP, 52698, 155148, 1-513; 10499, MLXIP, 52699, 155149, 759-1682; 10499, MLXIP, 52700, 155150, 911-2491; 10499, MLXIP, 52701, 155151, 1399-1619; 10499, MLXIP, 52702, 155152, 133-2892; 10499, MLXIP, 52691, 155141, 133-2892; 10499, MLXIP, 52692, 155142, 138-791; 10499, MLXIP, 52694, 155144, 911-2491; 10500, MLXIPL, 52706, 155156, 23-2188; 10500, MLXIPL, 52707, 155157, 52-690; 10500, MLXIPL, 52708, 155158, 1-706; 10500, MLXIPL, 52703, 155153, 49-2607; 10500, MLXIPL, 52704, 155154, 1-1728; 10500, MLXIPL, 52705, 155155, 49-2544; 10500, MLXIPL, 52709, 155159, 1-2502; 10500, MLXIPL, 52710, 155160, 1-2553; 10501, MLX, 52714, 155164, 52-796; 10501, MLX, 52711, 155161, 54-950; 10501, MLX, 52712, 155162, 54-698; 10501, MLX, 52713, 155163, 58-792; 10502, MMP24-AS1, 52715, 155165, 88-303; 10502, MMP24-AS1, 52716, 155166, 23-238; 10502, MMP24-AS1, 52717, 155167, 125-340; 10503, MMS19, 52721, 155171, 46-877; 10503, MMS19, 52722, 155172, 52-348; 10503, MMS19, 52724, 155174, 16-537; 10503, MMS19, 52725, 155175, 1-450; 10503, MMS19, 52726, 155176, 27-933; 10503, MMS19, 52727, 155177, 1-1796; 10503, MMS19, 52730, 155180, 1-272; 10503, MMS19, 52718, 155168, 1-2799; 10503, MMS19, 52719, 155169, 226-3189; 10503, MMS19, 52720, 155170, 72-3164; 10503, MMS19, 52723, 155173, 5-127; 10503, MMS19, 52728, 155178, 337-3429; 10503, MMS19, 52729, 155179, 49-171; 10504, MMS22L, 52732, 155182, 77-3688; 10504, MMS22L, 52733, 155183, 1-267; 10504, MMS22L, 52734, 155184, 192-614; 10504, MMS22L, 52735, 155185, 221-832; 10504, MMS22L, 52736, 155186, 1-966; 10504, MMS22L, 52731, 155181, 267-3998; 10505, MNAT1, 52739, 155189, 1-510; 10505, MNAT1, 52740, 155190, 1-522; 10505, MNAT1, 52737, 155187, 102-1031; 10505, MNAT1, 52738, 155188, 88-891; 10506, MOB4, 52743, 155193, 4-159; 10506, MOB4, 52744, 155194, 279-659; 10506, MOB4, 52746, 155196, 14-151; 10506, MOB4, 52741, 155191, 151-732; 10506, MOB4, 52742, 155192, 256-933; 10506, MOB4, 52745, 155195, 233-814; 10506, MOB4, 52747, 155197, 41-655; 10507, MOB1A, 52748, 155198, 195-845; 10508, MOB1B, 52751, 155201, 369-760; 10508, MOB1B, 52749, 155199, 202-852; 10508, MOB1B, 52750, 155200, 257-922; 10509, MOB2, 52753, 155203, 1-711; 10509, MOB2, 52752, 155202, 191-997;

10510, MOB3A, 52755, 155205, 370-556; 10510, MOB3A, 52756, 155206, 402-451; 10510, MOB3A, 52757, 155207, 376-564; 10510, MOB3A, 52759, 155209, 567-730; 10510, MOB3A, 52760, 155210, 338-567; 10510, MOB3A, 52761, 155211, 450-564; 10510, MOB3A, 52754, 155204, 381-1034; 10510, MOB3A, 52758, 155208, 160-813; 10511, MOB3B, 52762, 155212, 426-1076; 10512, MOB3C, 52763, 155213, 58-864; 10512, MOB3C, 52764, 155214, 232-882; 10512, MOB3C, 52765, 155215, 3145-3795; 10513, MOAP1, 52766, 155216, 395-1450; 10513, MOAP1, 52767, 155217, 486-1541; 10513, MOAP1, 52768, 155218, 395-1450; 10513, MOAP1, 52769, 155219, 486-1541; 10514, MSN, 52771, 155221, 258-568; 10514, MSN, 52770, 155220, 173-1906; 10515, MKX, 52774, 155224, 131-1002; 10515, MKX, 52775, 155225, 258-431; 10515, MKX, 52772, 155222, 434-1492; 10515, MKX, 52773, 155223, 226-1284; 10516, MOK, 52776, 155226, 1-1257; 10516, MOK, 52778, 155228, 168-302; 10516, MOK, 52779, 155229, 187-366; 10516, MOK, 52781, 155231, 175-309; 10516, MOK, 52782, 155232, 201-380; 10516, MOK, 52783, 155233, 187-321; 10516, MOK, 52785, 155235, 167-622; 10516, MOK, 52786, 155236, 211-390; 10516, MOK, 52787, 155237, 316-693; 10516, MOK, 52788, 155238, 1-340; 10516, MOK, 52789, 155239, 170-349; 10516, MOK, 52790, 155240, 373-660; 10516, MOK, 52791, 155241, 430-717; 10516, MOK, 52792, 155242, 369-512; 10516, MOK, 52793, 155243, 1-520; 10516, MOK, 52794, 155244, 322-609; 10516, MOK, 52795, 155245, 320-608; 10516, MOK, 52796, 155246, 236-379; 10516, MOK, 52797, 155247, 1138-1425; 10516, MOK, 52798, 155248, 342-719; 10516, MOK, 52799, 155249, 188-457; 10516, MOK, 52777, 155227, 233-1492; 10516, MOK, 52780, 155230, 218-1387; 10516, MOK, 52784, 155234, 184-1440; 10517, MOCOS, 52800, 155250, 22-2688; 10518, MOCS1, 52808, 155258, 43-339; 10518, MOCS1, 52801, 155251, 5-1915; 10518, MOCS1, 52802, 155252, 269-1114; 10518, MOCS1, 52803, 155253, 139-1296; 10518, MOCS1, 52804, 155254, 135-1292; 10518, MOCS1, 52805, 155255, 215-1816; 10518, MOCS1, 52806, 155256, 1-1071; 10518, MOCS1, 52807, 155257, 10-1920; 10519, MOCS2, 52814, 155264, 77-328; 10519, MOCS2, 52810, 155260, 679-1245; 10519, MOCS2, 52809, 155259, 43-309; 10519, MOCS2, 52811, 155261, 50-316; 10519, MOCS2, 52812, 155262, 14-280; 10519, MOCS2, 52813, 155263, 34-300; 10519, MOCS2, 52815, 155265, 49-315; 10519, MOCS2, 52816, 155266, 49-315; 10520, MOCS3, 52817, 155267, 18-1400; 10521, MON1A, 52818, 155268, 260-2218; 10521, MON1A, 52819, 155269, 695-2386; 10521, MON1A, 52820, 155270, 4-1476; 10522, MON1B, 52822, 155272, 78-1394; 10522, MON1B, 52824, 155274, 546-877; 10522, MON1B, 52825, 155275, 239-598; 10522, MON1B, 52826, 155276, 111-611; 10522, MON1B, 52827, 155277, 273-576; 10522, MON1B, 52828, 155278, 345-1110; 10522, MON1B, 52821, 155271, 351-1994; 10522, MON1B, 52823, 155273, 23-1228; 10523, MON2, 52831, 155281, 361-492; 10523, MON2, 52832, 155282, 360-3578; 10523, MON2, 52835, 155285, 147-326; 10523, MON2, 52829, 155279, 361-5496; 10523, MON2, 52830, 155280, 392-5545; 10523, MON2, 52833, 155283, 387-5414; 10523, MON2, 52834, 155284, 361-5427; 10524, MOGAT1, 52836, 155286, 1-1008; 10525, MOGAT2, 52837, 155287, 71-1075; 10525, MOGAT2, 52838, 155288, 774-1532; 10525, MOGAT2, 52839, 155289, 1-855; 10526, MOGAT3, 52840, 155290, 168-1193; 10526, MOGAT3, 52841, 155291, 62-907; 10526, MOGAT3, 52842, 155292, 59-1093; 10527, MAOA, 52843, 155293, 124-1707; 10527, MAOA, 52844, 155294, 1943-3127; 10528, MAOB, 52845, 155295, 149-1711; 10529, MMD, 52847, 155297, 230-670; 10529, MMD, 52846, 155296, 298-1014; 10530, MMD2, 52848, 155298, 197-937; 10530, MMD2, 52849, 155299, 196-1008; 10530, MMD2, 52850, 155300, 175-756; 10530, MMD2, 52851, 155301, 197-778; 10531, MGLL, 52852, 155302, 565-1506; 10531, MGLL, 52853, 155303, 500-1333; 10531, MGLL, 52857, 155307, 1-629; 10531, MGLL, 52858, 155308, 179-410; 10531, MGLL, 52859, 155309, 289-556; 10531, MGLL, 52860, 155310, 1-594; 10531, MGLL, 52861, 155311, 1-468; 10531, MGLL, 52854, 155304, 188-1099; 10531, MGLL, 52855, 155305, 898-1809; 10531, MGLL, 52856, 155306, 565-1416; 10532, MOXD1, 52864, 155314, 50-397; 10532, MOXD1, 52862, 155312, 229-1866; 10532, MOXD1, 52863, 155313, 120-1961; 10533, MORC1, 52865, 155315, 84-3038; 10533, MORC1, 52866, 155316, 45-2936; 10534, MORC2, 52869, 155319, 1-574; 10534, MORC2, 52870, 155320, 1-270; 10534, MORC2, 52867, 155317, 1365-4277; 10534, MORC2, 52868, 155318, 410-3508; 10535, MORC3, 52872, 155322, 3-578; 10535, MORC3, 52873, 155323, 3-578; 10535, MORC3, 52874, 155324, 3-578; 10535, MORC3, 52875, 155325, 1-680; 10535, MORC3, 52871, 155321, 77-2896; 10536, MORC4, 52878, 155328, 1-115; 10536, MORC4, 52876, 155326, 110-2812; 10536, MORC4, 52877, 155327, 276-3089; 10537, MRFAP1, 52882, 155332, 773-1084; 10537, MRFAP1, 52879, 155329, 654-1037; 10537, MRFAP1, 52880, 155330, 173-556; 10537, MRFAP1, 52881, 155331, 106-489; 10538, MRFAP1L1, 52883, 155333, 252-635; 10539, MORN1, 52884, 155334, 139-609; 10539, MORN1, 52887, 155337, 1-558; 10539, MORN1, 52888, 155338, 1-182; 10539, MORN1, 52885, 155335, 175-1227; 10539, MORN1, 52886, 155336, 175-1668; 10540, MORN2, 52892, 155342, 143-283; 10540, MORN2, 52893, 155343, 234-407; 10540, MORN2, 52894, 155344, 279-485; 10540, MORN2, 52889, 155339, 308-547; 10540, MORN2, 52890, 155340, 380-619; 10540, MORN2, 52891, 155341, 277-516; 10541, MORN3, 52895, 155345, 172-894; 10541, MORN3, 52896, 155346, 168-650; 10541, MORN3, 52897, 155347, 83-565; 10542, MORN4, 52899, 155349, 176-316; 10542, MORN4, 52900, 155350, 185-385; 10542, MORN4, 52898, 155348, 165-605; 10543, MORN5, 52902, 155352, 35-366; 10543, MORN5, 52903, 155353, 66-356; 10543, MORN5, 52901, 155351, 63-548; 10544, MORF4L1, 52905, 155355, 565-1611; 10544, MORF4L1, 52909, 155359, 65-874; 10544, MORF4L1, 52910, 155360, 342-680; 10544, MORF4L1, 52911, 155361, 325-793; 10544, MORF4L1, 52912, 155362, 26-761; 10544, MORF4L1, 52913, 155363, 261-616; 10544, MORF4L1, 52914, 155364, 1-639; 10544, MORF4L1, 52915, 155365, 408-582; 10544, MORF4L1, 52916, 155366, 457-678; 10544, MORF4L1, 52904, 155354, 205-1293; 10544, MORF4L1, 52906, 155356, 243-1214; 10544, MORF4L1, 52907, 155357, 439-1146; 10544, MORF4L1, 52908, 155358, 138-845; 10545, MORF4L2, 52919, 155369, 319-849; 10545, MORF4L2, 52921, 155371, 396-869; 10545, MORF4L2, 52922, 155372, 361-562; 10545, MORF4L2, 52924, 155374, 367-899; 10545, MORF4L2, 52926, 155376, 4-717; 10545, MORF4L2, 52917, 155367, 293-1159; 10545, MORF4L2, 52918, 155368, 306-1172; 10545, MORF4L2, 52920, 155370, 456-1322; 10545, MORF4L2, 52923, 155373, 303-1169; 10545, MORF4L2, 52925, 155375, 438-1304; 10546, MOSPD1, 52927, 155377, 102-746; 10546, MOSPD1, 52928, 155378, 148-627; 10546, MOSPD1, 52929, 155379, 188-829; 10547, MOSPD2, 52931, 155381, 75-1535; 10547, MOSPD2, 52932, 155382, 1-474; 10547, MOSPD2, 52933, 155383, 1-120; 10547, MOSPD2, 52930, 155380, 89-1645;

10548, MOSPD3, 52938, 155388, 177-853; 10548, MOSPD3, 52939, 155389, 147-356; 10548, MOSPD3, 52934, 155384, 203-910; 10548, MOSPD3, 52935, 155385, 119-826; 10548, MOSPD3, 52936, 155386, 283-990; 10548, MOSPD3, 52937, 155387, 237-914; 10549, MLN, 52940, 155390, 58-402; 10549, MLN, 52941, 155391, 67-414; 10549, MLN, 52942, 155392, 36-362; 10550, MLNR, 52943, 155393, 1-1239; 10551, MNX1, 52945, 155395, 384-631; 10551, MNX1, 52946, 155396, 236-322; 10551, MNX1, 52948, 155398, 384-815; 10551, MNX1, 52949, 155399, 1-94; 10551, MNX1, 52950, 155400, 24-134; 10551, MNX1, 52944, 155394, 302-1507; 10551, MNX1, 52947, 155397, 384-953; 10552, MOV10, 52952, 155402, 1030-3873; 10552, MOV10, 52951, 155401, 169-3180; 10552, MOV10, 52953, 155403, 309-3320; 10552, MOV10, 52954, 155404, 391-3402; 10553, MOV10L1, 52958, 155408, 36-206; 10553, MOV10L1, 52960, 155410, 1-500; 10553, MOV10L1, 52961, 155411, 45-215; 10553, MOV10L1, 52955, 155405, 84-3719; 10553, MOV10L1, 52956, 155406, 306-683; 10553, MOV10L1, 52957, 155407, 178-1194; 10553, MOV10L1, 52959, 155409, 25-3522; 10553, MOV10L1, 52962, 155412, 221-3718; 10553, MOV10L1, 52963, 155413, 85-3720; 10554, MPHOSPH10, 52965, 155415, 35-1423; 10554, MPHOSPH10, 52964, 155414, 353-2398; 10555, MPHOSPH6, 52967, 155417, 23-190; 10555, MPHOSPH6, 52968, 155418, 163-591; 10555, MPHOSPH6, 52969, 155419, 107-502; 10555, MPHOSPH6, 52970, 155420, 41-334; 10555, MPHOSPH6, 52966, 155416, 52-534; 10556, MPHOSPH8, 52972, 155422, 1-452; 10556, MPHOSPH8, 52973, 155423, 1-934; 10556, MPHOSPH8, 52971, 155421, 69-2651; 10557, MPHOSPH9, 52974, 155424, 1-2523; 10557, MPHOSPH9, 52975, 155425, 1-1090; 10557, MPHOSPH9, 52976, 155426, 255-400; 10557, MPHOSPH9, 52977, 155427, 192-570; 10557, MPHOSPH9, 52978, 155428, 1-2026; 10557, MPHOSPH9, 52979, 155429, 211-351; 10557, MPHOSPH9, 52980, 155430, 83-3544; 10557, MPHOSPH9, 52981, 155431, 196-465; 10557, MPHOSPH9, 52982, 155432, 321-573; 10557, MPHOSPH9, 52983, 155433, 1-647; 10557, MPHOSPH9, 52985, 155435, 1-93; 10557, MPHOSPH9, 52986, 155436, 1-165; 10557, MPHOSPH9, 52987, 155437, 1-492; 10557, MPHOSPH9, 52984, 155434, 208-3759; 10558, MPLKIP, 52988, 155438, 93-632; 10559, MPL, 52990, 155440, 1-1650; 10559, MPL, 52991, 155441, 1-1740; 10559, MPL, 52989, 155439, 43-1950; 10560, MPND, 52994, 155444, 1-330; 10560, MPND, 52995, 155445, 1-366; 10560, MPND, 52996, 155446, 29-1288; 10560, MPND, 52997, 155447, 1-1409; 10560, MPND, 52998, 155448, 1-1512; 10560, MPND, 52999, 155449, 36-1541; 10560, MPND, 52992, 155442, 68-1483; 10560, MPND, 52993, 155443, 41-1396; 10561, MPV17, 53001, 155451, 1231-1593; 10561, MPV17, 53003, 155453, 52-384; 10561, MPV17, 53004, 155454, 9-521; 10561, MPV17, 53005, 155455, 18-593; 10561, MPV17, 53006, 155456, 57-398; 10561, MPV17, 53007, 155457, 22-537; 10561, MPV17, 53008, 155458, 36-335; 10561, MPV17, 53009, 155459, 18-257; 10561, MPV17, 53010, 155460, 38-337; 10561, MPV17, 53011, 155461, 229-575; 10561, MPV17, 53012, 155462, 1-365; 10561, MPV17, 53000, 155450, 48-578; 10561, MPV17, 53002, 155452, 57-587; 10562, MPV17L, 53015, 155465, 1-159; 10562, MPV17L, 53018, 155468, 1-159; 10562, MPV17L, 53013, 155463, 145-588; 10562, MPV17L, 53014, 155464, 120-710; 10562, MPV17L, 53016, 155466, 145-588; 10562, MPV17L, 53017, 155467, 120-710; 10563, MPV17L2, 53019, 155469, 101-721; 10564, MRE11A, 53022, 155472, 234-2357; 10564, MRE11A, 53024, 155474, 192-572; 10564, MRE11A, 53025, 155475, 150-815; 10564, MRE11A, 53026, 155476, 226-558; 10564, MRE11A, 53020, 155470, 224-2350; 10564, MRE11A, 53021, 155471, 297-2339; 10564, MRE11A, 53023, 155473, 290-2425; 10565, MRGBP, 53027, 155477, 72-686; 10566, MROH7-TTC4, 53028, 155478, 397-2355; 10566, MROH7-TTC4, 53029, 155479, 279-4283; 10566, MROH7-TTC4, 53030, 155480, 293-2176; 10567, MRS2, 53031, 155481, 140-1321; 10567, MRS2, 53034, 155484, 1-546; 10567, MRS2, 53032, 155482, 94-1320; 10567, MRS2, 53033, 155483, 94-1425; 10567, MRS2, 53035, 155485, 140-1480; 10568, MRTO4, 53036, 155486, 298-1017; 10569, MSANTD3-TMEFF1, 53037, 155487, 8-1033; 10570, MSX1, 53038, 155488, 235-1146; 10571, MSX2, 53040, 155490, 59-463; 10571, MSX2, 53039, 155489, 128-931; 10572, MSH5-SAPCD1, 53041, 155491, 57-2612; 10572, MSH5-SAPCD1, 53042, 155492, 1-793; 10572, MSH5-SAPCD1, 53043, 155493, 1-88; 10572, MSH5-SAPCD1, 53044, 155494, 57-2612; 10572, MSH5-SAPCD1, 53045, 155495, 1-793; 10572, MSH5-SAPCD1, 53046, 155496, 1361-1807; 10572, MSH5-SAPCD1, 53049, 155499, 1361-1807; 10572, MSH5-SAPCD1, 53050, 155500, 1-793; 10572, MSH5-SAPCD1, 53051, 155501, 1-793; 10572, MSH5-SAPCD1, 53052, 155502, 57-2612; 10572, MSH5-SAPCD1, 53053, 155503, 1-793; 10572, MSH5-SAPCD1, 53054, 155504, 57-2612; 10572, MSH5-SAPCD1, 53055, 155505, 1-1491; 10572, MSH5-SAPCD1, 53056, 155506, 1-88; 10572, MSH5-SAPCD1, 53057, 155507, 1-1491; 10572, MSH5-SAPCD1, 53058, 155508, 1-88; 10572, MSH5-SAPCD1, 53059, 155509, 1-88; 10572, MSH5-SAPCD1, 53060, 155510, 1-793; 10572, MSH5-SAPCD1, 53061, 155511, 1-88; 10572, MSH5-SAPCD1, 53062, 155512, 1-88; 10572, MSH5-SAPCD1, 53047, 155497, 60-506; 10572, MSH5-SAPCD1, 53048, 155498, 60-506; 10573, MSS51, 53065, 155515, 66-611; 10573, MSS51, 53063, 155513, 67-1449; 10573, MSS51, 53064, 155514, 4-1386; 10574, MLST8, 53066, 155516, 75-1058; 10574, MLST8, 53069, 155519, 88-438; 10574, MLST8, 53070, 155520, 344-562; 10574, MLST8, 53071, 155521, 185-792; 10574, MLST8, 53073, 155523, 171-767; 10574, MLST8, 53074, 155524, 104-499; 10574, MLST8, 53075, 155525, 412-564; 10574, MLST8, 53076, 155526, 115-465; 10574, MLST8, 53077, 155527, 83-581; 10574, MLST8, 53078, 155528, 85-303; 10574, MLST8, 53079, 155529, 79-297; 10574, MLST8, 53081, 155531, 115-939; 10574, MLST8, 53083, 155533, 82-297; 10574, MLST8, 53067, 155517, 365-1342; 10574, MLST8, 53068, 155518, 191-1171; 10574, MLST8, 53072, 155522, 133-1113; 10574, MLST8, 53080, 155530, 355-1335; 10574, MLST8, 53082, 155532, 362-1342; 10575, MTRNR2L1, 53084, 155534, 952-1026; 10576, MTRNR2L10, 53085, 155535, 927-1001; 10577, MTRNR2L11, 53086, 155536, 950-1024; 10578, MTRNR2L12, 53087, 155537, 964-1038; 10579, MTRNR2L13, 53088, 155538, 926-1000; 10580, MTRNR2L3, 53089, 155539, 942-1016; 10581, MTRNR2L4, 53090, 155540, 839-925; 10582, MTRNR2L5, 53091, 155541, 598-672; 10583, MTRNR2L6, 53092, 155542, 960-1034; 10583, MTRNR2L6, 53093, 155543, 960-1034; 10584, MTRNR2L7, 53094, 155544, 931-1005; 10585, MTRNR2L8, 53095, 155545, 964-1038; 10586, MUC1, 53099, 155549, 73-798; 10586, MUC1, 53106, 155556, 51-857; 10586, MUC1, 53107, 155557, 51-740; 10586, MUC1, 53108, 155558, 1-258; 10586, MUC1, 53109, 155559, 1-687; 10586, MUC1, 53110, 155560, 73-3861; 10586, MUC1, 53111, 155561, 51-458; 10586, MUC1, 53112, 155562, 73-1500; 10586, MUC1, 53113, 155563, 51-431; 10586, MUC1, 53114, 155564, 73-444; 10586, MUC1, 53115, 155565, 25-315; 10586, MUC1, 53116, 155566, 73-642; 10586, MUC1, 53117, 155567, 73-792; 10586, MUC1, 53118, 155568, 73-714; 10586, MUC1, 53119, 155569, 25-267; 10586, MUC1, 53120, 155570, 25-474; 10586, MUC1, 53121, 155571, 73-1527; 10586, MUC1, 53096, 155546, 26-847; 10586, MUC1, 53097, 155547, 25-636; 10586, MUC1, 53098, 155548, 25-525; 10586, MUC1, 53100, 155550, 25-531; 10586, MUC1, 53101, 155551, 25-792; 10586, MUC1, 53102, 155552, 51-845; 10586, MUC1, 53103, 155553, 51-647; 10586, MUC1, 53104, 155554, 25-504; 10586, MUC1, 53105, 155555, 25-717; 10587, MUC12, 53122, 155572, 1-285; 10587, MUC12, 53123, 155573, 1-16437; 10587, MUC12, 53124, 155574, 1-16008; 10588, MUC13, 53125, 155575, 36-587; 10588, MUC13, 53126, 155576, 40-1578; 10589, MUC15, 53127, 155577, 1-936; 10589, MUC15, 53129, 155579, 1-1086; 10589, MUC15, 53130, 155580, 148-1083; 10589, MUC15, 53131, 155581, 239-1324; 10589, MUC15, 53128, 155578, 120-1124; 10590, MUC16, 53132, 155582, 205-43728; 10590, MUC16, 53133, 155583, 1-3674; 10590, MUC16, 53134, 155584, 1-3992; 10590, MUC16, 53135, 155585, 1-2011; 10591, MUC17, 53137, 155587, 65-12853; 10591, MUC17, 53136, 155586, 65-13546; 10592, MUC2, 53138, 155588, 1-5337; 10592, MUC2, 53139, 155589, 1-393; 10592, MUC2, 53140, 155590, 28-8481; 10593, MUC20, 53141, 155591, 14-1630; 10593, MUC20, 53142, 155592, 125-2296; 10593, MUC20, 53143, 155593, 1-385; 10593, MUC20, 53146, 155596, 483-1994; 10593, MUC20, 53148, 155598, 483-1994; 10593, MUC20, 53150, 155600, 124-1791; 10593, MUC20, 53151, 155601, 483-1994; 10593, MUC20, 53152, 155602, 483-1994; 10593, MUC20, 53154, 155604, 483-1994; 10593, MUC20, 53155, 155605, 1-385; 10593, MUC20, 53156, 155606, 1-382; 10593, MUC20, 53159, 155609, 1-385; 10593, MUC20, 53161, 155611, 125-2296; 10593, MUC20, 53162, 155612, 124-1731; 10593, MUC20, 53163, 155613, 125-2296; 10593, MUC20, 53164, 155614, 1-385; 10593, MUC20, 53165, 155615, 483-2045; 10593, MUC20, 53166, 155616, 1-385; 10593, MUC20, 53167, 155617, 1-385; 10593, MUC20, 53168, 155618, 1-385; 10593, MUC20, 53169, 155619, 125-1783; 10593, MUC20, 53170, 155620, 122-1771; 10593, MUC20, 53171, 155621, 125-1783; 10593, MUC20, 53172, 155622, 122-1831; 10593, MUC20, 53173, 155623, 127-1743; 10593, MUC20, 53174, 155624, 125-2296; 10593, MUC20, 53175, 155625, 482-1987; 10593, MUC20, 53176, 155626, 127-1743; 10593, MUC20, 53144, 155594, 483-2507; 10593, MUC20, 53145, 155595, 127-2256; 10593, MUC20, 53147, 155597, 127-2256; 10593, MUC20, 53149, 155599, 127-2256; 10593, MUC20, 53153, 155603, 127-2256; 10593, MUC20, 53157, 155607, 483-2507; 10593, MUC20, 53158, 155608, 483-2507; 10593, MUC20, 53160, 155610, 483-2507; 10594, MUC21, 53178, 155628, 242-2122; 10594, MUC21, 53179, 155629, 242-1942; 10594, MUC21, 53180, 155630, 242-1942; 10594, MUC21, 53181, 155631, 242-1942; 10594, MUC21, 53182, 155632, 242-1942; 10594, MUC21, 53183, 155633, 242-2032; 10594, MUC21, 53184, 155634, 252-1952; 10594, MUC21, 53185, 155635, 187-1437; 10594, MUC21, 53186, 155636, 187-1437; 10594, MUC21, 53187, 155637, 1746-2084; 10594, MUC21, 53188, 155638, 187-1443; 10594, MUC21, 53177, 155627, 242-1942; 10595, MUC22, 53189, 155639, 234-5555; 10596, MUC3A, 53190, 155640, 71-10042; 10596, MUC3A, 53192, 155642, 1-9798; 10596, MUC3A, 53191, 155641, 1-3007; 10597, MUC4, 53194, 155644, 1-524; 10597, MUC4, 53196, 155646, 1-434; 10597, MUC4, 53197, 155647, 1-434; 10597, MUC4, 53198, 155648, 1-494; 10597, MUC4, 53199, 155649, 1-434; 10597, MUC4, 53200, 155650, 73-13401; 10597, MUC4, 53201, 155651, 461-16699; 10597, MUC4, 53202, 155652, 73-13449; 10597, MUC4, 53203, 155653, 73-13365; 10597, MUC4, 53204, 155654, 73-13365; 10597, MUC4, 53205, 155655, 73-13605; 10597, MUC4, 53206, 155656, 73-15285; 10597, MUC4, 53207, 155657, 73-13275; 10597, MUC4, 53208, 155658, 73-16155; 10597, MUC4, 53209, 155659, 73-13407; 10597, MUC4, 53210, 155660, 1-1812; 10597, MUC4, 53211, 155661, 1-15945; 10597, MUC4, 53212, 155662, 1-6432; 10597, MUC4, 53213, 155663, 1-3449; 10597, MUC4, 53214, 155664, 1-16157; 10597, MUC4, 53215, 155665, 1-16001; 10597, MUC4, 53216, 155666, 1-14907; 10597, MUC4, 53217, 155667, 1-14907; 10597, MUC4, 53218, 155668, 1-1827; 10597, MUC4, 53219, 155669, 1-3449; 10597, MUC4, 53220, 155670, 1-6417; 10597, MUC4, 53221, 155671, 1-16157; 10597, MUC4, 53222, 155672, 1-16001; 10597, MUC4, 53223, 155673, 1-6417; 10597, MUC4, 53224, 155674, 1-503; 10597, MUC4, 53225, 155675, 1-6417; 10597, MUC4, 53226, 155676, 1-1812; 10597, MUC4, 53227, 155677, 1-16157; 10597, MUC4, 53228, 155678, 1-13181; 10597, MUC4, 53229, 155679, 1-434; 10597, MUC4, 53230, 155680, 1-3296; 10597, MUC4, 53231, 155681, 1-15134; 10597, MUC4, 53232, 155682, 73-19383; 10597, MUC4, 53233, 155683, 1-13121; 10597, MUC4, 53234, 155684, 1-16001; 10597, MUC4, 53235, 155685, 73-19623; 10597, MUC4, 53236, 155686, 1-13211; 10597, MUC4, 53237, 155687, 1-3449; 10597, MUC4, 53238, 155688, 73-21303; 10597, MUC4, 53239, 155689, 1-13211; 10597, MUC4, 53240, 155690, 1-524; 10597, MUC4, 53241, 155691, 1-13295; 10597, MUC4, 53242, 155692, 1-16157; 10597, MUC4, 53243, 155693, 1-13247; 10597, MUC4, 53244, 155694, 1-13253; 10597, MUC4, 53245, 155695, 1-13247; 10597, MUC4, 53246, 155696, 1-494; 10597, MUC4, 53247, 155697, 1-16004; 10597, MUC4, 53248, 155698, 1-16157; 10597, MUC4, 53249, 155699, 1-13253; 10597, MUC4, 53250, 155700, 1-15131; 10597, MUC4, 53251, 155701, 1-13253; 10597, MUC4, 53252, 155702, 1-13247; 10597, MUC4, 53253, 155703, 1-524; 10597, MUC4, 53254, 155704, 1-13295; 10597, MUC4, 53255, 155705, 1-494; 10597, MUC4, 53256, 155706, 1-413; 10597, MUC4, 53257, 155707, 1-13454; 10597, MUC4, 53258, 155708, 73-19383; 10597, MUC4, 53259, 155709, 1-473; 10597, MUC4, 53260, 155710, 1-15131; 10597, MUC4, 53261, 155711, 1-13121; 10597, MUC4, 53262, 155712, 1-434; 10597, MUC4, 53263, 155713, 1-16001; 10597, MUC4, 53264, 155714, 1-13211; 10597, MUC4, 53265, 155715, 1-434; 10597, MUC4, 53266, 155716, 1-13211; 10597, MUC4, 53267, 155717, 1-13211; 10597, MUC4, 53268, 155718, 73-22173; 10597, MUC4, 53269, 155719, 1-16160; 10597, MUC4, 53270, 155720, 1-413; 10597, MUC4, 53271, 155721, 73-19419; 10597, MUC4, 53272, 155722, 1-13124; 10597, MUC4, 53273, 155723, 73-19467; 10597, MUC4, 53274, 155724, 1-413; 10597, MUC4, 53275, 155725, 1-13451; 10597, MUC4, 53276, 155726, 1-3449; 10597, MUC4, 53277, 155727, 1-413; 10597, MUC4, 53278, 155728, 1-434; 10597, MUC4, 53279, 155729, 1-13211; 10597, MUC4, 53280, 155730, 1-434; 10597, MUC4, 53281, 155731, 1-15131; 10597, MUC4, 53282, 155732, 1-13451; 10597, MUC4, 53283, 155733, 73-19293; 10597, MUC4, 53284, 155734, 1-15131; 10597, MUC4, 53285, 155735, 1-494; 10597, MUC4, 53286, 155736, 1-13121; 10597, MUC4, 53287, 155737, 1-413; 10597, MUC4, 53288, 155738, 41-3418; 10597, MUC4, 53289, 155739, 1-524; 10597, MUC4, 53290, 155740, 1-13253; 10597, MUC4, 53291, 155741, 1-13121; 10597, MUC4, 53292, 155742, 1-434; 10597, MUC4, 53293, 155743, 1-13247; 10597, MUC4, 53294, 155744, 73-19425; 10597, MUC4, 53295, 155745, 1-13295; 10597, MUC4, 53296, 155746, 1-13451; 10597, MUC4, 53297, 155747, 1-3296; 10597, MUC4, 53298, 155748, 1-13121; 10597, MUC4, 53299, 155749, 1-434; 10597, MUC4, 53300, 155750, 1-13298; 10597, MUC4, 53301, 155751, 1-13295; 10597, MUC4, 53302, 155752, 1-434; 10597, MUC4, 53303, 155753, 1-13211; 10597, MUC4, 53304, 155754, 1-13121; 10597, MUC4, 53305, 155755, 1-13121; 10597, MUC4, 53306, 155756, 461-22717; 10597, MUC4, 53307, 155757, 1-13451; 10597, MUC4, 53308, 155758, 1-13214; 10597, MUC4, 53309, 155759, 1-3296; 10597, MUC4, 53310, 155760, 1-434; 10597, MUC4, 53311, 155761, 1-13214; 10597, MUC4, 53312, 155762, 1-13211; 10597, MUC4, 53313, 155763, 1-3296; 10597, MUC4, 53314, 155764, 1-13250; 10597, MUC4, 53315, 155765, 1-13211; 10597, MUC4, 53316, 155766, 41-3571; 10597, MUC4, 53317, 155767, 1-413; 10597, MUC4, 53318, 155768, 1-13256; 10597, MUC4, 53319, 155769, 1-3296; 10597, MUC4, 53320, 155770, 1-503; 10597, MUC4, 53321, 155771, 1-473; 10597, MUC4, 53193, 155643, 41-3571; 10597, MUC4, 53195, 155645, 41-3418; 10598, MUC5AC, 53322, 155772, 48-17012; 10599, MUC5B, 53323, 155773, 1-461; 10599, MUC5B, 53324, 155774, 59-17347; 10600, MUC6, 53326, 155776, 1-656; 10600, MUC6, 53327, 155777, 11-553; 10600, MUC6, 53328, 155778, 1-347; 10600, MUC6, 53329, 155779, 52-7371; 10600, MUC6, 53330, 155780, 52-7371; 10600, MUC6, 53331, 155781, 52-12174; 10600, MUC6, 53332, 155782, 52-14194; 10600, MUC6, 53325, 155775, 52-7371; 10601, MUC7, 53336, 155786, 228-635; 10601, MUC7, 53333, 155783, 191-1324; 10601, MUC7, 53334, 155784, 228-1361; 10601, MUC7, 53335, 155785, 289-1422; 10602, MUCL1, 53338, 155788, 37-294; 10602, MUCL1, 53339, 155789, 1-243; 10602, MUCL1, 53337, 155787, 47-319; 10603, MCOLN1, 53341, 155791, 65-666; 10603, MCOLN1, 53342, 155792, 1-548; 10603, MCOLN1, 53340, 155790, 126-1868; 10604, MCOLN2, 53345, 155795, 242-991; 10604, MCOLN2, 53343, 155793, 113-1729; 10604, MCOLN2, 53344, 155794, 69-1769; 10605, MCOLN3, 53347, 155797, 378-1343; 10605, MCOLN3, 53349, 155799, 142-567; 10605, MCOLN3, 53346, 155796, 54-1547; 10605, MCOLN3, 53348, 155798, 54-1715; 10606, MADCAM1, 53353, 155803, 855-1346; 10606, MADCAM1, 53354, 155804, 47-1219; 10606, MADCAM1, 53355, 155805, 47-1267; 10606, MADCAM1, 53356, 155806, 1-1203; 10606, MADCAM1, 53357, 155807, 47-1243; 10606, MADCAM1, 53358, 155808, 47-1249; 10606, MADCAM1, 53350, 155800, 47-1195; 10606, MADCAM1, 53351, 155801, 47-934; 10606, MADCAM1, 53352, 155802, 1-603; 10607, MCIDAS, 53359, 155809, 178-717; 10607, MCIDAS, 53360, 155810, 178-1335; 10608, MMRN1, 53363, 155813, 285-3197; 10608, MMRN1, 53361, 155811, 72-3758; 10608, MMRN1, 53362, 155812, 320-4006; 10609, MMRN2, 53365, 155815, 460-829; 10609, MMRN2, 53366, 155816, 31-360; 10609, MMRN2, 53367, 155817, 279-890; 10609, MMRN2, 53368, 155818, 136-1020; 10609, MMRN2, 53364, 155814, 323-3172; 10610, MCTP1, 53371, 155821, 1-510; 10610, MCTP1, 53372, 155822, 165-570; 10610, MCTP1, 53373, 155823, 240-483; 10610, MCTP1, 53374, 155824, 164-2214; 10610, MCTP1, 53376, 155826, 1-575; 10610, MCTP1, 53377, 155827, 1-874; 10610, MCTP1, 53378, 155828, 1-1245; 10610, MCTP1, 53381, 155831, 285-1751; 10610, MCTP1, 53369, 155819, 1-2337; 10610, MCTP1, 53370, 155820, 164-2242; 10610, MCTP1, 53375, 155825, 1-3000; 10610, MCTP1, 53379, 155829, 177-1724; 10610, MCTP1, 53380, 155830, 146-1948; 10611, MCTP2, 53385, 155835, 193-1383; 10611, MCTP2, 53382, 155832, 1-2637; 10611, MCTP2, 53383, 155833, 350-949; 10611, MCTP2, 53384, 155834, 1-2472; 10611, MCTP2, 53386, 155836, 330-1250; 10612, MCFD2, 53395, 155845, 1-273; 10612, MCFD2, 53396, 155846, 382-565; 10612, MCFD2, 53387, 155837, 153-593; 10612, MCFD2, 53388, 155838, 139-579; 10612, MCFD2, 53389, 155839, 189-629; 10612, MCFD2, 53390, 155840, 168-608; 10612, MCFD2, 53391, 155841, 181-621; 10612, MCFD2, 53392, 155842, 102-386; 10612, MCFD2, 53393, 155843, 292-576; 10612, MCFD2, 53394, 155844, 82-366; 10612, MCFD2, 53397, 155847, 193-576; 10612, MCFD2, 53398, 155848, 151-588; 10613, MEGF10, 53399, 155849, 268-3690; 10613, MEGF10, 53400, 155850, 280-1983; 10613, MEGF10, 53401, 155851, 230-1933; 10613, MEGF10, 53402, 155852, 245-3667; 10614, MEGF11, 53404, 155854, 1-3423; 10614, MEGF11, 53406, 155856, 182-864; 10614, MEGF11, 53408, 155858, 127-1866; 10614, MEGF11, 53409, 155859, 1-91; 10614, MEGF11, 53410, 155860, 160-2644; 10614, MEGF11, 53411, 155861, 1-353; 10614, MEGF11, 53412, 155862, 1-1866; 10614, MEGF11, 53413, 155863, 174-2883; 10614, MEGF11, 53414, 155864, 1-79; 10614, MEGF11, 53415, 155865, 1-91; 10614, MEGF11, 53403, 155853, 160-3069; 10614, MEGF11, 53405, 155855, 174-3308; 10614, MEGF11, 53407, 155857, 142-3276; 10615, MEGF6, 53418, 155868, 10-3981; 10615, MEGF6, 53419, 155869, 1-743; 10615, MEGF6, 53416, 155866, 204-3893; 10615, MEGF6, 53417, 155867, 228-4853; 10616, MEGF8, 53422, 155872, 7721-9040; 10616, MEGF8, 53423, 155873, 1-537; 10616, MEGF8, 53424, 155874, 1-212; 10616, MEGF8, 53420, 155870, 1-8538; 10616, MEGF8, 53421, 155871, 636-8972; 10617, MEGF9, 53425, 155875, 113-1921; 10618, MEN1, 53430, 155880, 377-2044; 10618, MEN1, 53435, 155885, 377-816; 10618, MEN1, 53436, 155886, 80-922; 10618, MEN1, 53437, 155887, 505-944; 10618, MEN1, 53438, 155888, 88-870; 10618, MEN1, 53439, 155889, 69-1107; 10618, MEN1, 53426, 155876, 111-1943; 10618, MEN1, 53427, 155877, 498-2330; 10618, MEN1, 53428, 155878, 505-2352; 10618, MEN1, 53429, 155879, 24-1871; 10618, MEN1, 53431, 155881, 69-1796; 10618, MEN1, 53432, 155882, 500-2332; 10618, MEN1, 53433, 155883, 498-2345; 10618, MEN1, 53434, 155884, 377-2224; 10619, MINPP1, 53440, 155890, 42-980; 10619, MINPP1, 53441, 155891, 42-1505; 10619, MINPP1, 53442, 155892, 373-1233; 10620, MPDZ, 53445, 155895, 212-786; 10620, MPDZ, 53446, 155896, 1-239; 10620, MPDZ, 53448, 155898, 1-1836; 10620, MPDZ, 53449, 155899, 1-103; 10620, MPDZ, 53451, 155901, 1-92; 10620, MPDZ, 53452, 155902, 163-548; 10620, MPDZ, 53454, 155904, 1-3021; 10620, MPDZ, 53455, 155905, 174-2963; 10620, MPDZ, 53456, 155906, 1-287; 10620, MPDZ, 53457, 155907, 66-6320; 10620, MPDZ, 53443, 155893, 249-6461; 10620, MPDZ, 53444, 155894, 223-6336; 10620, MPDZ, 53447, 155897, 44-6157; 10620, MPDZ, 53450, 155900, 223-6348; 10620, MPDZ, 53453, 155903, 44-6070; 10621, MVB12A, 53459, 155909, 65-886; 10621, MVB12A, 53460, 155910, 457-820; 10621, MVB12A, 53461, 155911, 55-654; 10621, MVB12A, 53462, 155912, 256-656; 10621, MVB12A, 53464, 155914, 1-367; 10621, MVB12A, 53465, 155915, 432-795; 10621, MVB12A, 53458, 155908, 1056-1877; 10621, MVB12A, 53463, 155913, 26-847; 10622, MVB12B, 53467, 155917, 154-770; 10622, MVB12B, 53466, 155916, 82-1041; 10622, MVB12B, 53468, 155918, 69-734; 10623, MRVI1, 53471, 155921, 1-354; 10623,

MRVI1, 53472, 155922, 195-2660; 10623, MRVI1, 53473, 155923, 21-227; 10623, MRVI1, 53474, 155924, 339-545; 10623, MRVI1, 53477, 155927, 1-191; 10623, MRVI1, 53478, 155928, 13-276; 10623, MRVI1, 53479, 155929, 151-1437; 10623, MRVI1, 53469, 155919, 781-2574; 10623, MRVI1, 53470, 155920, 151-2889; 10623, MRVI1, 53475, 155925, 65-2779; 10623, MRVI1, 53476, 155926, 1023-2816; 10623, MRVI1, 53480, 155930, 21-2141; 10623, MRVI1, 53481, 155931, 1121-2914; 10623, MRVI1, 53482, 155932, 974-2767; 10624, MUS81, 53484, 155934, 519-923; 10624, MUS81, 53485, 155935, 299-906; 10624, MUS81, 53486, 155936, 362-1792; 10624, MUS81, 53487, 155937, 1-1169; 10624, MUS81, 53488, 155938, 1-692; 10624, MUS81, 53489, 155939, 1-1232; 10624, MUS81, 53490, 155940, 1-192; 10624, MUS81, 53483, 155933, 350-2005; 10625, MSI1, 53492, 155942, 1-698; 10625, MSI1, 53491, 155941, 90-1178; 10626, MSI2, 53495, 155945, 41-844; 10626, MSI2, 53496, 155946, 136-1110; 10626, MSI2, 53498, 155948, 31-452; 10626, MSI2, 53499, 155949, 4-303; 10626, MSI2, 53493, 155943, 210-1196; 10626, MSI2, 53494, 155944, 36-791; 10626, MSI2, 53497, 155947, 106-561; 10627, MRAS, 53502, 155952, 202-271; 10627, MRAS, 53503, 155953, 110-431; 10627, MRAS, 53500, 155950, 648-1274; 10627, MRAS, 53501, 155951, 315-941; 10627, MRAS, 53504, 155954, 137-763; 10627, MRAS, 53505, 155955, 219-617; 10627, MRAS, 53506, 155956, 138-536; 10627, MRAS, 53507, 155957, 714-1112; 10628, MUSK, 53509, 155959, 1-399; 10628, MUSK, 53510, 155960, 47-2398; 10628, MUSK, 53512, 155962, 127-2712; 10628, MUSK, 53508, 155958, 47-2398; 10628, MUSK, 53511, 155961, 135-2744; 10629, MBNL1, 53514, 155964, 1843-3045; 10629, MBNL1, 53519, 155969, 420-594; 10629, MBNL1, 53521, 155971, 276-545; 10629, MBNL1, 53523, 155973, 1-989; 10629, MBNL1, 53525, 155975, 1-633; 10629, MBNL1, 53527, 155977, 322-1353; 10629, MBNL1, 53529, 155979, 790-1836; 10629, MBNL1, 53530, 155980, 433-898; 10629, MBNL1, 53513, 155963, 1843-3009; 10629, MBNL1, 53515, 155965, 790-1812; 10629, MBNL1, 53516, 155966, 920-2068; 10629, MBNL1, 53517, 155967, 1415-2527; 10629, MBNL1, 53518, 155968, 790-1818; 10629, MBNL1, 53520, 155970, 1-945; 10629, MBNL1, 53522, 155972, 512-1678; 10629, MBNL1, 53524, 155974, 512-1420; 10629, MBNL1, 53526, 155976, 1-1023; 10629, MBNL1, 53528, 155978, 1-1029; 10629, MBNL1, 53531, 155981, 790-1734; 10630, MBNL2, 53536, 155986, 1-318; 10630, MBNL2, 53537, 155987, 782-1549; 10630, MBNL2, 53532, 155982, 782-1885; 10630, MBNL2, 53533, 155983, 841-1926; 10630, MBNL2, 53534, 155984, 841-1962; 10630, MBNL2, 53535, 155985, 731-1816; 10631, MBNL3, 53542, 155992, 67-1095; 10631, MBNL3, 53544, 155994, 277-946; 10631, MBNL3, 53545, 155995, 165-891; 10631, MBNL3, 53546, 155996, 1-453; 10631, MBNL3, 53538, 155988, 80-1084; 10631, MBNL3, 53539, 155989, 405-1181; 10631, MBNL3, 53540, 155990, 67-981; 10631, MBNL3, 53541, 155991, 80-1144; 10631, MBNL3, 53543, 155993, 138-914; 10631, MBNL3, 53547, 155997, 67-945; 10632, MURC, 53548, 155998, 66-1160; 10633, MLIP, 53551, 156001, 103-909; 10633, MLIP, 53552, 156002, 354-941; 10633, MLIP, 53553, 156003, 1-989; 10633, MLIP, 53554, 156004, 351-360; 10633, MLIP, 53555, 156005, 240-571; 10633, MLIP, 53558, 156008, 63-1746; 10633, MLIP, 53559, 156009, 335-703; 10633, MLIP, 53560, 156010, 30-710; 10633, MLIP, 53549, 155999, 114-1490; 10633, MLIP, 53550, 156000, 47-751; 10633, MLIP, 53556, 156006, 114-2861; 10633, MLIP, 53557, 156007, 33-3014; 10634, MSC, 53561, 156011, 291-911; 10635, MUSTN1, 53563, 156013, 149-412; 10635, MUSTN1, 53562, 156012, 272-520; 10636, MKLN1, 53565, 156015, 487-864; 10636, MKLN1, 53566, 156016, 413-2344; 10636, MKLN1, 53567, 156017, 219-455; 10636, MKLN1, 53568, 156018, 4-516; 10636, MKLN1, 53569, 156019, 261-551; 10636, MKLN1, 53564, 156014, 41-2248; 10637, MCC, 53572, 156022, 374-2674; 10637, MCC, 53573, 156023, 554-2701; 10637, MCC, 53574, 156024, 1-508; 10637, MCC, 53570, 156020, 565-3054; 10637, MCC, 53571, 156021, 417-3476; 10638, MLH1, 53576, 156026, 16-132; 10638, MLH1, 53577, 156027, 15-131; 10638, MLH1, 53578, 156028, 1-186; 10638, MLH1, 53580, 156030, 603-917; 10638, MLH1, 53581, 156031, 1-176; 10638, MLH1, 53582, 156032, 1-157; 10638, MLH1, 53585, 156035, 313-562; 10638, MLH1, 53586, 156036, 33-149; 10638, MLH1, 53587, 156037, 1-286; 10638, MLH1, 53588, 156038, 1-342; 10638, MLH1, 53589, 156039, 1-2039; 10638, MLH1, 53590, 156040, 25-171; 10638, MLH1, 53593, 156043, 1-670; 10638, MLH1, 53575, 156025, 217-2487; 10638, MLH1, 53579, 156029, 696-2243; 10638, MLH1, 53583, 156033, 261-2237; 10638, MLH1, 53584, 156034, 868-2415; 10638, MLH1, 53591, 156041, 630-2177; 10638, MLH1, 53592, 156042, 831-2378; 10639, MLH3, 53596, 156046, 1-598; 10639, MLH3, 53597, 156047, 1-375; 10639, MLH3, 53598, 156048, 265-583; 10639, MLH3, 53599, 156049, 1-1433; 10639, MLH3, 53600, 156050, 130-616; 10639, MLH3, 53601, 156051, 107-3934; 10639, MLH3, 53602, 156052, 1-323; 10639, MLH3, 53594, 156044, 217-4578; 10639, MLH3, 53595, 156045, 217-4506; 10639, MLH3, 53603, 156053, 37-4398; 10640, MSH2, 53605, 156055, 63-2828; 10640, MSH2, 53606, 156056, 140-560; 10640, MSH2, 53608, 156058, 41-1066; 10640, MSH2, 53609, 156059, 41-2473; 10640, MSH2, 53610, 156060, 41-1273; 10640, MSH2, 53611, 156061, 41-1642; 10640, MSH2, 53612, 156062, 41-1498; 10640, MSH2, 53604, 156054, 224-3028; 10640, MSH2, 53607, 156057, 140-2746; 10641, MSH3, 53613, 156063, 81-3494; 10642, MSH4, 53614, 156064, 105-2915; 10643, MSH5, 53619, 156069, 1033-2559; 10643, MSH5, 53620, 156070, 1-1494; 10643, MSH5, 53621, 156071, 1-471; 10643, MSH5, 53623, 156073, 113-694; 10643, MSH5, 53625, 156075, 1-1404; 10643, MSH5, 53626, 156076, 1-348; 10643, MSH5, 53627, 156077, 1033-2559; 10643, MSH5, 53628, 156078, 113-694; 10643, MSH5, 53629, 156079, 1-405; 10643, MSH5, 53631, 156081, 56-326; 10643, MSH5, 53632, 156082, 56-2290; 10643, MSH5, 53634, 156084, 1-1000; 10643, MSH5, 53635, 156085, 56-2521; 10643, MSH5, 53637, 156087, 1-1000; 10643, MSH5, 53638, 156088, 1-475; 10643, MSH5, 53639, 156089, 1-323; 10643, MSH5, 53640, 156090, 1033-2559; 10643, MSH5, 53641, 156091, 1033-2559; 10643, MSH5, 53642, 156092, 56-326; 10643, MSH5, 53643, 156093, 113-694; 10643, MSH5, 53645, 156095, 1-477; 10643, MSH5, 53647, 156097, 1033-2559; 10643, MSH5, 53648, 156098, 80-2260; 10643, MSH5, 53649, 156099, 1-471; 10643, MSH5, 53650, 156100, 1-1491; 10643, MSH5, 53652, 156102, 113-694; 10643, MSH5, 53653, 156103, 113-694; 10643, MSH5, 53654, 156104, 1033-2559; 10643, MSH5, 53655, 156105, 113-383; 10643, MSH5, 53656, 156106, 1-1401; 10643, MSH5, 53657, 156107, 1-1000; 10643, MSH5, 53659, 156109, 56-2239; 10643, MSH5, 53660, 156110, 1-1491; 10643, MSH5, 53661, 156111, 1-471; 10643, MSH5, 53663, 156113, 1-471; 10643, MSH5, 53664, 156114, 242-2155; 10643, MSH5, 53665, 156115, 1-471; 10643, MSH5, 53668, 156118, 1-1000; 10643, MSH5, 53669, 156119, 1-1491; 10643, MSH5, 53671, 156121, 1034-2236; 10643, MSH5, 53672, 156122, 1-1494;

10643, MSH5, 53673, 156123, 113-694; 10643, MSH5, 53674, 156124, 1-1000; 10643, MSH5, 53675, 156125, 1-475; 10643, MSH5, 53676, 156126, 1-1491; 10643, MSH5, 53677, 156127, 1-471; 10643, MSH5, 53678, 156128, 235-2415; 10643, MSH5, 53679, 156129, 56-2521; 10643, MSH5, 53680, 156130, 113-694; 10643, MSH5, 53681, 156131, 1-195; 10643, MSH5, 53682, 156132, 56-918; 10643, MSH5, 53683, 156133, 1-130; 10643, MSH5, 53684, 156134, 1-478; 10643, MSH5, 53685, 156135, 1-501; 10643, MSH5, 53686, 156136, 1-501; 10643, MSH5, 53687, 156137, 1-144; 10643, MSH5, 53688, 156138, 1-501; 10643, MSH5, 53689, 156139, 206-355; 10643, MSH5, 53690, 156140, 1-501; 10643, MSH5, 53691, 156141, 1-501; 10643, MSH5, 53692, 156142, 56-326; 10643, MSH5, 53693, 156143, 60-330; 10643, MSH5, 53615, 156065, 56-2563; 10643, MSH5, 53616, 156066, 56-2524; 10643, MSH5, 53617, 156067, 126-2630; 10643, MSH5, 53618, 156068, 287-2791; 10643, MSH5, 53622, 156072, 56-2524; 10643, MSH5, 53624, 156074, 80-2584; 10643, MSH5, 53630, 156080, 235-2739; 10643, MSH5, 53633, 156083, 56-2563; 10643, MSH5, 53636, 156086, 80-891; 10643, MSH5, 53644, 156094, 80-2584; 10643, MSH5, 53646, 156096, 56-867; 10643, MSH5, 53651, 156101, 80-2584; 10643, MSH5, 53658, 156108, 235-1046; 10643, MSH5, 53662, 156112, 235-2739; 10643, MSH5, 53666, 156116, 56-2563; 10643, MSH5, 53667, 156117, 56-2563; 10643, MSH5, 53670, 156120, 235-2739; 10644, MSH6, 53695, 156145, 189-491; 10644, MSH6, 53696, 156146, 232-578; 10644, MSH6, 53697, 156147, 153-635; 10644, MSH6, 53698, 156148, 96-548; 10644, MSH6, 53699, 156149, 107-421; 10644, MSH6, 53702, 156152, 681-833; 10644, MSH6, 53704, 156154, 84-3287; 10644, MSH6, 53705, 156155, 3249-4232; 10644, MSH6, 53694, 156144, 153-4235; 10644, MSH6, 53700, 156150, 794-3970; 10644, MSH6, 53701, 156151, 153-3845; 10644, MSH6, 53703, 156153, 889-4065; 10645, MUTYH, 53712, 156162, 32-904; 10645, MUTYH, 53714, 156164, 217-1866; 10645, MUTYH, 53716, 156166, 128-772; 10645, MUTYH, 53717, 156167, 1-134; 10645, MUTYH, 53718, 156168, 195-383; 10645, MUTYH, 53719, 156169, 161-328; 10645, MUTYH, 53720, 156170, 27-677; 10645, MUTYH, 53721, 156171, 1-641; 10645, MUTYH, 53722, 156172, 55-1662; 10645, MUTYH, 53723, 156173, 112-234; 10645, MUTYH, 53724, 156174, 42-599; 10645, MUTYH, 53725, 156175, 1-555; 10645, MUTYH, 53726, 156176, 1-300; 10645, MUTYH, 53727, 156177, 507-788; 10645, MUTYH, 53728, 156178, 134-271; 10645, MUTYH, 53729, 156179, 135-299; 10645, MUTYH, 53730, 156180, 236-886; 10645, MUTYH, 53731, 156181, 162-326; 10645, MUTYH, 53706, 156156, 112-1680; 10645, MUTYH, 53707, 156157, 147-1712; 10645, MUTYH, 53708, 156158, 135-1775; 10645, MUTYH, 53709, 156159, 194-1759; 10645, MUTYH, 53710, 156160, 135-1745; 10645, MUTYH, 53711, 156161, 217-1824; 10645, MUTYH, 53713, 156163, 63-1628; 10645, MUTYH, 53715, 156165, 44-1642; 10646, MX1, 53732, 156182, 358-2277; 10646, MX1, 53735, 156185, 440-516; 10646, MX1, 53736, 156186, 351-583; 10646, MX1, 53737, 156187, 315-905; 10646, MX1, 53738, 156188, 269-872; 10646, MX1, 53739, 156189, 684-887; 10646, MX1, 53741, 156191, 177-281; 10646, MX1, 53733, 156183, 406-2394; 10646, MX1, 53734, 156184, 1026-3014; 10646, MX1, 53740, 156190, 367-2355; 10646, MX1, 53742, 156192, 22-1548; 10647, MX2, 53744, 156194, 242-618; 10647, MX2, 53745, 156195, 195-582; 10647, MX2, 53746, 156196, 204-604; 10647, MX2, 53747, 156197, 801-843; 10647, MX2, 53743, 156193, 185-2332; 10648, MYBBP1A, 53750, 156200, 1-3757; 10648, MYBBP1A, 53751, 156201, 1-613; 10648, MYBBP1A, 53752, 156202, 1-209; 10648, MYBBP1A, 53748, 156198, 308-4294; 10648, MYBBP1A, 53749, 156199, 63-4061; 10649, MSANTD1, 53754, 156204, 65-922; 10649, MSANTD1, 53755, 156205, 844-1641; 10649, MSANTD1, 53756, 156206, 184-987; 10649, MSANTD1, 53753, 156203, 1748-2584; 10650, MSANTD2, 53759, 156209, 4-543; 10650, MSANTD2, 53760, 156210, 11-637; 10650, MSANTD2, 53757, 156207, 294-1817; 10650, MSANTD2, 53758, 156208, 10-1689; 10650, MSANTD2, 53761, 156211, 1449-2438; 10651, MSANTD3, 53763, 156213, 168-710; 10651, MSANTD3, 53765, 156215, 378-780; 10651, MSANTD3, 53762, 156212, 151-630; 10651, MSANTD3, 53764, 156214, 272-1099; 10651, MSANTD3, 53766, 156216, 183-1010; 10651, MSANTD3, 53767, 156217, 176-1003; 10652, MSANTD4, 53769, 156219, 280-612; 10652, MSANTD4, 53770, 156220, 360-948; 10652, MSANTD4, 53771, 156221, 566-780; 10652, MSANTD4, 53772, 156222, 3-407; 10652, MSANTD4, 53768, 156218, 1417-2454; 10653, MYSM1, 53773, 156223, 41-2527; 10653, MYSM1, 53774, 156224, 70-774; 10654, MYPOP, 53775, 156225, 88-1287; 10655, MAX, 53782, 156232, 132-380; 10655, MAX, 53783, 156233, 179-556; 10655, MAX, 53784, 156234, 421-714; 10655, MAX, 53786, 156236, 179-544; 10655, MAX, 53787, 156237, 344-474; 10655, MAX, 53788, 156238, 179-463; 10655, MAX, 53790, 156240, 1-375; 10655, MAX, 53776, 156226, 171-461; 10655, MAX, 53777, 156227, 150-554; 10655, MAX, 53778, 156228, 49-300; 10655, MAX, 53779, 156229, 166-621; 10655, MAX, 53780, 156230, 132-614; 10655, MAX, 53781, 156231, 181-492; 10655, MAX, 53785, 156235, 22-333; 10655, MAX, 53789, 156239, 179-490; 10655, MAX, 53791, 156241, 206-517; 10656, MYCBP, 53793, 156243, 64-234; 10656, MYCBP, 53792, 156242, 801-1112; 10657, MYCBP2, 53795, 156245, 1-3184; 10657, MYCBP2, 53797, 156247, 1-251; 10657, MYCBP2, 53798, 156248, 67-894; 10657, MYCBP2, 53794, 156244, 94-14016; 10657, MYCBP2, 53796, 156246, 19-13941; 10658, MINA, 53802, 156252, 1-84; 10658, MINA, 53803, 156253, 328-664; 10658, MINA, 53804, 156254, 1-327; 10658, MINA, 53799, 156249, 584-1981; 10658, MINA, 53800, 156250, 214-1608; 10658, MINA, 53801, 156251, 111-1508; 10658, MINA, 53805, 156255, 31-873; 10659, MYCT1, 53807, 156257, 7-210; 10659, MYCT1, 53808, 156258, 1-650; 10659, MYCT1, 53806, 156256, 9-716; 10660, MAZ, 53812, 156262, 334-570; 10660, MAZ, 53814, 156264, 1-589; 10660, MAZ, 53815, 156265, 1-459; 10660, MAZ, 53816, 156266, 55-309; 10660, MAZ, 53817, 156267, 132-692; 10660, MAZ, 53818, 156268, 239-523; 10660, MAZ, 53819, 156269, 1-609; 10660, MAZ, 53820, 156270, 292-453; 10660, MAZ, 53821, 156271, 132-686; 10660, MAZ, 53822, 156272, 240-475; 10660, MAZ, 53823, 156273, 85-843; 10660, MAZ, 53809, 156259, 107-1588; 10660, MAZ, 53810, 156260, 166-1599; 10660, MAZ, 53811, 156261, 40-1404; 10660, MAZ, 53813, 156263, 153-671; 10661, MYCBPAP, 53826, 156276, 1-293; 10661, MYCBPAP, 53827, 156277, 6-947; 10661, MYCBPAP, 53828, 156278, 57-326; 10661, MYCBPAP, 53829, 156279, 1-2864; 10661, MYCBPAP, 53830, 156280, 1-320; 10661, MYCBPAP, 53831, 156281, 1-146; 10661, MYCBPAP, 53832, 156282, 1-325; 10661, MYCBPAP, 53824, 156274, 163-3117; 10661, MYCBPAP, 53825, 156275, 274-3102; 10662, MAATS1, 53834, 156284, 64-231; 10662, MAATS1, 53836, 156286, 78-221; 10662, MAATS1, 53837, 156287, 1-306; 10662, MAATS1, 53838, 156288, 49-444; 10662, MAATS1, 53833, 156283, 78-2381; 10662, MAATS1, 53835, 156285, 67-783; 10663, MAG, 53842, 156292, 166-559; 10663, MAG, 53843, 156293, 111-585; 10663, MAG, 53844, 156294, 124-300; 10663, MAG, 53839, 156289, 151-1899; 10663, MAG, 53840, 156290, 160-2040; 10663, MAG, 53841, 156291, 186-1991; 10664, MBP, 53845, 156295, 254-475; 10664, MBP, 53853, 156303, 48-758; 10664, MBP, 53854, 156304, 48-593; 10664, MBP, 53855, 156305, 266-569; 10664, MBP, 53856, 156306, 51-149; 10664, MBP, 53857, 156307, 58-237; 10664, MBP, 53858, 156308, 48-344; 10664, MBP, 53859, 156309, 58-252; 10664, MBP, 53860, 156310, 58-384; 10664, MBP, 53861, 156311, 54-413; 10664, MBP, 53862, 156312, 58-507; 10664, MBP, 53863, 156313, 55-261; 10664, MBP, 53864, 156314, 48-374; 10664, MBP, 53865, 156315, 617-875; 10664, MBP, 53866, 156316, 48-248; 10664, MBP, 53868, 156318, 86-563; 10664, MBP, 53869, 156319, 1-542; 10664, MBP, 53870, 156320, 48-227; 10664, MBP, 53871, 156321, 1-181; 10664, MBP, 53872, 156322, 48-561; 10664, MBP, 53873, 156323, 449-573; 10664, MBP, 53874, 156324, 48-521; 10664, MBP, 53875, 156325, 291-1052; 10664, MBP, 53846, 156296, 265-1179; 10664, MBP, 53847, 156297, 35-595; 10664, MBP, 53848, 156298, 88-681; 10664, MBP, 53849, 156299, 216-809; 10664, MBP, 53850, 156300, 172-765; 10664, MBP, 53851, 156301, 79-561; 10664, MBP, 53852, 156302, 55-570; 10664, MBP, 53867, 156317, 1-915; 10665, MYEF2, 53876, 156326, 117-1847; 10665, MYEF2, 53877, 156327, 281-2083; 10665, MYEF2, 53879, 156329, 1-380; 10665, MYEF2, 53881, 156331, 1-868; 10665, MYEF2, 53882, 156332, 67-1710; 10665, MYEF2, 53883, 156333, 80-460; 10665, MYEF2, 53884, 156334, 5-640; 10665, MYEF2, 53878, 156328, 90-476; 10665, MYEF2, 53880, 156330, 80-466; 10666, MOG, 53888, 156338, 1-428; 10666, MOG, 53892, 156342, 209-346; 10666, MOG, 53900, 156350, 1-675; 10666, MOG, 53903, 156353, 1-539; 10666, MOG, 53906, 156356, 1-396; 10666, MOG, 53912, 156362, 119-1006; 10666, MOG, 53915, 156365, 1-539; 10666, MOG, 53916, 156366, 1-759; 10666, MOG, 53919, 156369, 1-615; 10666, MOG, 53920, 156370, 1-759; 10666, MOG, 53921, 156371, 1-759; 10666, MOG, 53928, 156378, 1-759; 10666, MOG, 53929, 156379, 1-759; 10666, MOG, 53930, 156380, 1-539; 10666, MOG, 53933, 156383, 1-642; 10666, MOG, 53934, 156384, 1-759; 10666, MOG, 53936, 156386, 1-539; 10666, MOG, 53940, 156390, 1-759; 10666, MOG, 53943, 156393, 1-539; 10666, MOG, 53944, 156394, 1-539; 10666, MOG, 53945, 156395, 1-539; 10666, MOG, 53946, 156396, 1-630; 10666, MOG, 53959, 156409, 1-279; 10666, MOG, 53960, 156410, 1-428; 10666, MOG, 53961, 156411, 1-690; 10666, MOG, 53885, 156335, 119-1006; 10666, MOG, 53886, 156336, 1-642; 10666, MOG, 53887, 156337, 208-603; 10666, MOG, 53889, 156339, 1-621; 10666, MOG, 53890, 156340, 119-1006; 10666, MOG, 53891, 156341, 1-759; 10666, MOG, 53893, 156343, 230-973; 10666, MOG, 53894, 156344, 1-396; 10666, MOG, 53895, 156345, 149-892; 10666, MOG, 53896, 156346, 212-955; 10666, MOG, 53897, 156347, 1-690; 10666, MOG, 53898, 156348, 1-642; 10666, MOG, 53899, 156349, 1-675; 10666, MOG, 53901, 156351, 1-690; 10666, MOG, 53902, 156352, 1-642; 10666, MOG, 53904, 156354, 1-396; 10666, MOG, 53905, 156355, 1-615; 10666, MOG, 53907, 156357, 212-955; 10666, MOG, 53908, 156358, 212-955; 10666, MOG, 53909, 156359, 1-675; 10666, MOG, 53910, 156360, 119-1006; 10666, MOG, 53911, 156361, 1-642; 10666, MOG, 53913, 156363, 1-642; 10666, MOG, 53914, 156364, 119-1006; 10666, MOG, 53917, 156367, 1-396; 10666, MOG, 53918, 156368, 119-1006; 10666, MOG, 53922, 156372, 119-1006; 10666, MOG, 53923, 156373, 1-615; 10666, MOG, 53924, 156374, 1-615; 10666, MOG, 53925, 156375, 1-642; 10666, MOG, 53926, 156376, 119-1006; 10666, MOG, 53927, 156377, 1-615; 10666, MOG, 53931, 156381, 212-955; 10666, MOG, 53932, 156382, 1-690; 10666, MOG, 53935, 156385, 1-690; 10666, MOG, 53937, 156387, 1-675; 10666, MOG, 53938, 156388, 1-675; 10666, MOG, 53939, 156389, 1-675; 10666, MOG, 53941, 156391, 212-955; 10666, MOG, 53942, 156392, 1-690; 10666, MOG, 53947, 156397, 1-642; 10666, MOG, 53948, 156398, 1-396; 10666, MOG, 53949, 156399, 1-396; 10666, MOG, 53950, 156400, 1-627; 10666, MOG, 53951, 156401, 1-690; 10666, MOG, 53952, 156402, 1-396; 10666, MOG, 53953, 156403, 1-615; 10666, MOG, 53954, 156404, 1-675; 10666, MOG, 53955, 156405, 212-955; 10666, MOG, 53956, 156406, 1-675; 10666, MOG, 53957, 156407, 1-615; 10666, MOG, 53958, 156408, 1-690; 10666, MOG, 53962, 156412, 1-327; 10666, MOG, 53963, 156413, 230-856; 10666, MOG, 53964, 156414, 230-856; 10666, MOG, 53965, 156415, 230-856; 10666, MOG, 53966, 156416, 230-856; 10666, MOG, 53967, 156417, 230-856; 10666, MOG, 53968, 156418, 230-856; 10667, MPZ, 53969, 156419, 569-727; 10667, MPZ, 53972, 156422, 1-410; 10667, MPZ, 53970, 156420, 50-796; 10667, MPZ, 53971, 156421, 68-814; 10668, MPZL1, 53974, 156424, 1-552; 10668, MPZL1, 53976, 156426, 169-456; 10668, MPZL1, 53973, 156423, 203-1012; 10668, MPZL1, 53975, 156425, 164-523; 10668, MPZL1, 53977, 156427, 1-630; 10669, MPZL2, 53978, 156428, 130-777; 10669, MPZL2, 53979, 156429, 384-1031; 10670, MPZL3, 53983, 156433, 54-251; 10670, MPZL3, 53980, 156430, 57-764; 10670, MPZL3, 53981, 156431, 27-353; 10670, MPZL3, 53982, 156432, 54-725; 10671, MYRF, 53986, 156436, 165-1778; 10671, MYRF, 53984, 156434, 36-3371; 10671, MYRF, 53985, 156435, 97-3552; 10672, MYRFL, 53987, 156437, 1-753; 10672, MYRFL, 53988, 156438, 53-805; 10672, MYRFL, 53989, 156439, 1-1127; 10672, MYRFL, 53991, 156441, 203-2899; 10672, MYRFL, 53990, 156440, 215-2947; 10673, MYT1, 53993, 156443, 219-1994; 10673, MYT1, 53996, 156446, 365-2140; 10673, MYT1, 53997, 156447, 365-2140; 10673, MYT1, 53998, 156448, 219-1994; 10673, MYT1, 53992, 156442, 365-3730; 10673, MYT1, 53994, 156444, 365-3811; 10673, MYT1, 53995, 156445, 365-3730; 10673, MYT1, 53999, 156449, 365-3811; 10674, MYT1L, 54000, 156450, 1-609; 10674, MYT1L, 54004, 156454, 1-1032; 10674, MYT1L, 54001, 156451, 749-4309; 10674, MYT1L, 54002, 156452, 357-911; 10674, MYT1L, 54003, 156453, 671-4225; 10675, MOBP, 54013, 156463, 384-571; 10675, MOBP, 54015, 156465, 393-567; 10675, MOBP, 54005, 156455, 150-770; 10675, MOBP, 54006, 156456, 225-470; 10675, MOBP, 54007, 156457, 207-452; 10675, MOBP, 54008, 156458, 132-683; 10675, MOBP, 54009, 156459, 8-559; 10675, MOBP, 54010, 156460, 225-776; 10675, MOBP, 54011, 156461, 291-536; 10675, MOBP, 54012, 156462, 126-371; 10675, MOBP, 54014, 156464, 141-386; 10675, MOBP, 54016, 156466, 5-553; 10676, MDS2, 54018, 156468, 1-420; 10676, MDS2, 54017, 156467, 588-1010; 10677, MCL1, 54021, 156471, 209-802; 10677, MCL1, 54019, 156469, 1-816; 10677, MCL1, 54020, 156470, 61-1113; 10678, MNDA, 54023, 156473, 1-313; 10678, MNDA, 54022, 156472, 262-1485; 10679, MYD88, 54024, 156474, 185-1114; 10679, MYD88, 54025, 156475, 111-905; 10679, MYD88, 54027, 156477, 1-951; 10679, MYD88, 54028, 156478, 185-1138; 10679, MYD88, 54026, 156476, 2-616; 10679, MYD88, 54029, 156479, 6-485; 10680, MLF1, 54034, 156484, 41-653; 10680, MLF1, 54038, 156488, 41-163; 10680, MLF1, 54039, 156489, 142-707; 10680, MLF1, 54040, 156490, 227-750; 10680, MLF1, 54041, 156491, 108-260; 10680, MLF1, 54043, 156493, 213-787; 10680, MLF1, 54030, 156480, 139-945; 10680, MLF1, 54031, 156481, 237-968; 10680, MLF1, 54032, 156482, 1-900; 10680, MLF1, 54033, 156483, 303-1034; 10680, MLF1, 54035, 156485, 397-1173; 10680, MLF1, 54036, 156486, 321-1052; 10680, MLF1, 54037, 156487, 299-901; 10680, MLF1, 54042, 156492, 300-1076; 10680, MLF1, 54044, 156494, 257-1033; 10680, MLF1, 54045, 156495, 257-859; 10681, MLF2, 54049, 156499, 160-851; 10681, MLF2, 54050, 156500, 345-582; 10681, MLF2, 54051, 156501, 95-458; 10681, MLF2, 54046, 156496, 646-1392; 10681, MLF2, 54047, 156497, 64-810; 10681, MLF2, 54048, 156498, 64-810; 10681, MLF2, 54052, 156502, 364-1110; 10682, MZF1, 54056, 156506, 267-1046; 10682, MZF1, 54057, 156507, 468-657; 10682, MZF1, 54053, 156503, 562-2766; 10682, MZF1, 54054, 156504, 285-1157; 10682, MZF1, 54055, 156505, 244-2448; 10683, MLLT1, 54058, 156508, 165-1844; 10684, MLLT10, 54064, 156514, 1-184; 10684, MLLT10, 54065, 156515, 1-538; 10684, MLLT10, 54066, 156516, 1-1085; 10684, MLLT10, 54059, 156509, 179-3385; 10684, MLLT10, 54060, 156510, 1-3207; 10684, MLLT10, 54061, 156511, 349-3432; 10684, MLLT10, 54062, 156512, 177-557; 10684, MLLT10, 54063, 156513, 357-896; 10684, MLLT10, 54067, 156517, 1-381; 10684, MLLT10, 54068, 156518, 102-3308; 10685, MLLT11, 54069, 156519, 2803-3075; 10686, MLLT3, 54070, 156520, 183-671; 10686, MLLT3, 54073, 156523, 1481-1897; 10686, MLLT3, 54071, 156521, 288-1994; 10686, MLLT3, 54072, 156522, 99-1796; 10687, MLLT4, 54074, 156524, 173-5668; 10687, MLLT4, 54075, 156525, 173-5170; 10687, MLLT4, 54076, 156526, 320-5665; 10687, MLLT4, 54080, 156530, 134-875; 10687, MLLT4, 54081, 156531, 212-963; 10687, MLLT4, 54083, 156533, 1-1168; 10687, MLLT4, 54084, 156534, 1-941; 10687, MLLT4, 54085, 156535, 1-373; 10687, MLLT4, 54086, 156536, 1-574; 10687, MLLT4, 54087, 156537, 1-389; 10687, MLLT4, 54088, 156538, 1-504; 10687, MLLT4, 54077, 156527, 143-5098; 10687, MLLT4, 54078, 156528, 143-5374; 10687, MLLT4, 54079, 156529, 1-5505; 10687, MLLT4, 54082, 156532, 1-5475; 10688, MLLT6, 54089, 156539, 92-3373; 10688, MLLT6, 54090, 156540, 92-1069; 10688, MLLT6, 54091, 156541, 1-907; 10688, MLLT6, 54092, 156542, 92-3373; 10688, MLLT6, 54093, 156543, 92-1069; 10688, MLLT6, 54094, 156544, 1-907; 10689, MYADM, 54100, 156550, 283-1009; 10689, MYADM, 54101, 156551, 213-777; 10689, MYADM, 54102, 156552, 153-592; 10689, MYADM, 54103, 156553, 64-841; 10689, MYADM, 54095, 156545, 149-1117; 10689, MYADM, 54096, 156546, 403-1371; 10689, MYADM, 54097, 156547, 281-1249; 10689, MYADM, 54098, 156548, 149-1117; 10689, MYADM, 54099, 156549, 213-1181; 10690, MYADML2, 54104, 156554, 187-1110; 10690, MYADML2, 54105, 156555, 356-1279; 10691, MYDGF, 54107, 156557, 1-254; 10691, MYDGF, 54108, 156558, 29-598; 10691, MYDGF, 54106, 156556, 37-558; 10692, MYEOV, 54111, 156561, 644-1411; 10692, MYEOV, 54109, 156559, 451-1392; 10692, MYEOV, 54110, 156560, 562-1503; 10693, MYEOV2, 54113, 156563, 461-609; 10693, MYEOV2, 54112, 156562, 1-759; 10693, MYEOV2, 54114, 156564, 20-193; 10694, MPO, 54116, 156566, 1-260; 10694, MPO, 54115, 156565, 178-2415; 10695, N/A, 54117, 156567, 42-5618; 10695, N/A, 54118, 156568, 623-6265; 10695, N/A, 54119, 156569, 42-2864; 10695, N/A, 54120, 156570, 127-5703; 10696, MYZAP, 54123, 156573, 1-369; 10696, MYZAP, 54124, 156574, 171-567; 10696, MYZAP, 54121, 156571, 95-1495; 10696, MYZAP, 54122, 156572, 3-1319; 10697, MYOCD, 54126, 156576, 1-1947; 10697, MYOCD, 54128, 156578, 300-425; 10697, MYOCD, 54125, 156575, 1-2817; 10697, MYOCD, 54127, 156577, 201-3161; 10698, MYOC, 54130, 156580, 23-1057; 10698, MYOC, 54129, 156579, 73-1587; 10699, MEF2A, 54134, 156584, 342-574; 10699, MEF2A, 54137, 156587, 478-732; 10699, MEF2A, 54138, 156588, 451-565; 10699, MEF2A, 54131, 156581, 320-1813; 10699, MEF2A, 54132, 156582, 630-2129; 10699, MEF2A, 54133, 156583, 258-1547; 10699, MEF2A, 54135, 156585, 243-1760; 10699, MEF2A, 54136, 156586, 350-1843; 10699, MEF2A, 54139, 156589, 320-1633; 10700, MEF2B, 54140, 156590, 74-1201; 10700, MEF2B, 54141, 156591, 89-982; 10700, MEF2B, 54142, 156592, 233-1093; 10700, MEF2B, 54143, 156593, 71-1177; 10701, MEF2C, 54148, 156598, 370-1671; 10701, MEF2C, 54150, 156600, 174-854; 10701, MEF2C, 54151, 156601, 336-1063; 10701, MEF2C, 54152, 156602, 263-623; 10701, MEF2C, 54154, 156604, 361-1560; 10701, MEF2C, 54155, 156605, 180-557; 10701, MEF2C, 54156, 156606, 512-773; 10701, MEF2C, 54158, 156608, 223-609; 10701, MEF2C, 54159, 156609, 268-851; 10701, MEF2C, 54160, 156610, 488-573; 10701, MEF2C, 54161, 156611, 300-914; 10701, MEF2C, 54162, 156612, 419-1714; 10701, MEF2C, 54164, 156614, 1-552; 10701, MEF2C, 54165, 156615, 1-456; 10701, MEF2C, 54166, 156616, 1-1182; 10701, MEF2C, 54169, 156619, 325-632; 10701, MEF2C, 54170, 156620, 273-1688; 10701, MEF2C, 54144, 156594, 378-1829; 10701, MEF2C, 54145, 156595, 582-1973; 10701, MEF2C, 54146, 156596, 652-2073; 10701, MEF2C, 54147, 156597, 653-2074; 10701, MEF2C, 54149, 156599, 370-1767; 10701, MEF2C, 54153, 156603, 413-1738; 10701, MEF2C, 54157, 156607, 289-1614; 10701, MEF2C, 54163, 156613, 427-1824; 10701, MEF2C, 54167, 156617, 1-1254; 10701, MEF2C, 54168, 156618, 374-1765; 10702, MEF2D, 54173, 156623, 407-826; 10702, MEF2D, 54175, 156625, 562-593; 10702, MEF2D, 54176, 156626, 407-826; 10702, MEF2D, 54171, 156621, 482-2047; 10702, MEF2D, 54172, 156622, 215-1759; 10702, MEF2D, 54174, 156624, 139-1680; 10703, MDFI, 54178, 156628, 188-745; 10703, MDFI, 54180, 156630, 490-1183; 10703, MDFI, 54181, 156631, 224-650; 10703, MDFI, 54182, 156632, 60-353; 10703, MDFI, 54183, 156633, 252-635; 10703, MDFI, 54184, 156634, 64-703; 10703, MDFI, 54177, 156627, 218-958; 10703, MDFI, 54179, 156629, 218-958; 10704, MDFIC, 54185, 156635, 264-1331; 10704, MDFIC, 54187, 156637, 1-471; 10704, MDFIC, 54188, 156638, 181-312; 10704, MDFIC, 54189, 156639, 184-315; 10704, MDFIC, 54190, 156640, 1-471; 10704, MDFIC, 54191, 156641, 179-584; 10704, MDFIC, 54192, 156642, 264-1331; 10704, MDFIC, 54186, 156636, 386-1126; 10705, MYOF, 54197, 156647, 1-3533; 10705, MYOF, 54193, 156643, 1-6147; 10705, MYOF, 54194, 156644, 1-6186; 10705, MYOF, 54195, 156645, 1-483; 10705, MYOF, 54196, 156646, 124-1461; 10706, MYOD1, 54198, 156648, 216-1178; 10707, MYF5, 54199, 156649, 153-920; 10708, MYF6, 54200, 156650, 223-951; 10709, MYOG, 54201, 156651, 76-750; 10710, MB, 54206, 156656, 211-510; 10710, MB, 54207, 156657, 198-515; 10710, MB, 54208, 156658, 234-551; 10710, MB, 54209, 156659, 220-648; 10710, MB, 54210, 156660, 324-545; 10710, MB, 54211, 156661, 187-418; 10710, MB, 54202, 156652, 173-637; 10710, MB, 54203, 156653, 200-664; 10710, MB, 54204, 156654, 156-620; 10710, MB, 54205, 156655, 93-557; 10711, MIOX, 54213, 156663, 23-835; 10711, MIOX, 54215, 156665, 1-798; 10711, MIOX, 54212, 156662, 75-932; 10711, MIOX, 54214, 156664, 115-810; 10712, MYOM1, 54218, 156668, 115-4473; 10712, MYOM1, 54219, 156669, 1-366; 10712, MYOM1, 54216, 156666, 76-4845; 10712, MYOM1, 54217, 156667, 335-5392; 10713, MYOM2, 54221, 156671, 182-2854; 10713, MYOM2, 54223, 156673, 182-2854; 10713, MYOM2, 54220, 156670, 142-4539; 10713, MYOM2, 54222, 156672, 142-4539; 10714, MYOM3, 54224, 156674, 372-1364; 10714, MYOM3, 54225, 156675, 164-4477; 10715, MYNN, 54229, 156679, 1-716; 10715, MYNN, 54226, 156676, 664-2496; 10715, MYNN, 54227, 156677, 135-1967; 10715, MYNN, 54228, 156678, 32-1777; 10715, MYNN, 54230, 156680, 90-365; 10716, MYPN, 54235, 156685, 1479-4559; 10716, MYPN, 54231, 156681, 215-3352; 10716, MYPN, 54232, 156682, 489-4451; 10716, MYPN, 54233, 156683, 230-1753; 10716, MYPN, 54234, 156684, 188-4150; 10717, MRLN, 54236, 156686, 31-33; 10717, MRLN, 54240, 156690, 4-6; 10717, MRLN, 54237, 156687, 290-430; 10717, MRLN, 54238, 156688, 136-276; 10717, MRLN, 54239, 156689, 315-455; 10717, MRLN, 54241, 156691, 217-357; 10718, MYBPC3, 54242, 156692, 56-3880; 10718, MYBPC3, 54243, 156693, 56-3880; 10718, MYBPC3, 54245, 156695, 56-2482; 10718, MYBPC3, 54244, 156694, 56-3880; 10719, MYBPC2, 54246, 156696, 52-3477; 10720, MYBPC1, 54250, 156700, 78-2426; 10720, MYBPC1, 54255, 156705, 543-3617; 10720, MYBPC1, 54256, 156706, 101-3499; 10720, MYBPC1, 54257, 156707, 348-661; 10720, MYBPC1, 54258, 156708, 101-3565; 10720, MYBPC1, 54247, 156697, 101-3547; 10720, MYBPC1, 54248, 156698, 76-3591; 10720, MYBPC1, 54249, 156699, 101-3520; 10720, MYBPC1, 54251, 156701, 103-3624; 10720, MYBPC1, 54252, 156702, 76-3516; 10720, MYBPC1, 54253, 156703, 76-3480; 10720, MYBPC1, 54254, 156704, 76-3459; 10720, MYBPC1, 54259, 156709, 88-3459; 10720, MYBPC1, 54260, 156710, 223-3585; 10720, MYBPC1, 54261, 156711, 1-3426; 10721, MYBPH, 54263, 156713, 29-1459; 10721, MYBPH, 54262, 156712, 59-1492; 10722, MYBPHL, 54264, 156714, 51-1115; 10723, MYO1A, 54267, 156717, 272-560; 10723, MYO1A, 54268, 156718, 319-2385; 10723, MYO1A, 54269, 156719, 346-566; 10723, MYO1A, 54265, 156715, 252-3383; 10723, MYO1A, 54266, 156716, 289-3420; 10724, MYO1B, 54272, 156722, 12-3335; 10724, MYO1B, 54274, 156724, 124-374; 10724, MYO1B, 54275, 156725, 400-1310; 10724, MYO1B, 54276, 156726, 95-542; 10724, MYO1B, 54277, 156727, 83-572; 10724, MYO1B, 54278, 156728, 1-577; 10724, MYO1B, 54279, 156729, 1-567; 10724, MYO1B, 54270, 156720, 94-3504; 10724, MYO1B, 54271, 156721, 361-3597; 10724, MYO1B, 54273, 156723, 248-3658; 10725, MYO1C, 54283, 156733, 244-3363; 10725, MYO1C, 54284, 156734, 140-541; 10725, MYO1C, 54286, 156736, 101-901; 10725, MYO1C, 54287, 156737, 1-196; 10725, MYO1C, 54288, 156738, 341-753; 10725, MYO1C, 54289, 156739, 73-583; 10725, MYO1C, 54290, 156740, 62-555; 10725, MYO1C, 54291, 156741, 60-565; 10725, MYO1C, 54280, 156730, 326-3517; 10725, MYO1C, 54281, 156731, 110-3196; 10725, MYO1C, 54282, 156732, 224-3358; 10725, MYO1C, 54285, 156735, 178-3264; 10726, MYO1D, 54293, 156743, 306-1616; 10726, MYO1D, 54294, 156744, 273-3158; 10726, MYO1D, 54295, 156745, 1-135; 10726, MYO1D, 54296, 156746, 545-3301; 10726, MYO1D, 54292, 156742, 306-3326; 10727, MYO1E, 54298, 156748, 1-562; 10727, MYO1E, 54299, 156749, 1-828; 10727, MYO1E, 54300, 156750, 28-366; 10727, MYO1E, 54301, 156751, 1-222; 10727, MYO1E, 54302, 156752, 1-952; 10727, MYO1E, 54297, 156747, 401-3727; 10728, MYO1F, 54304, 156754, 1-888; 10728, MYO1F, 54305, 156755, 1-357; 10728, MYO1F, 54306, 156756, 130-360; 10728, MYO1F, 54307, 156757, 130-531; 10728, MYO1F, 54303, 156753, 269-3565; 10728, MYO1F, 54308, 156758, 269-3565; 10729, MYO1G, 54310, 156760, 109-237; 10729, MYO1G, 54311, 156761, 128-760; 10729, MYO1G, 54309, 156759, 138-3194; 10730, MYO1H, 54312, 156762, 59-3175; 10730, MYO1H, 54314, 156764, 1-381; 10730, MYO1H, 54313, 156763, 1-3069; 10731, MYO3A, 54316, 156766, 12-605; 10731, MYO3A, 54318, 156768, 61-2055; 10731, MYO3A, 54315, 156765, 167-5017; 10731, MYO3A, 54317, 156767, 160-903; 10732, MYO3B, 54322, 156772, 1-1081; 10732, MYO3B, 54323, 156773, 5-3320; 10732, MYO3B, 54319, 156769, 144-3899; 10732, MYO3B, 54320, 156770, 144-4169; 10732, MYO3B, 54321, 156771, 144-4088; 10733, MYO9A, 54327, 156777, 639-4544; 10733, MYO9A, 54328, 156778, 139-560; 10733, MYO9A, 54329, 156779, 1-582; 10733, MYO9A, 54330, 156780, 161-7351; 10733, MYO9A, 54331, 156781, 345-564; 10733, MYO9A, 54332, 156782, 1-271; 10733, MYO9A, 54333, 156783, 1-1391; 10733, MYO9A, 54334, 156784, 1-4196; 10733, MYO9A, 54324, 156774, 474-8120; 10733, MYO9A, 54325, 156775, 103-7749; 10733, MYO9A, 54326, 156776, 443-2632; 10734, MYO9B, 54336, 156786, 1-588; 10734, MYO9B, 54337, 156787, 1-179; 10734, MYO9B, 54338, 156788, 1-461; 10734, MYO9B, 54339, 156789, 148-6621; 10734, MYO9B, 54341, 156791, 1-525; 10734, MYO9B, 54342, 156792, 1-524; 10734, MYO9B, 54343, 156793, 1-6215; 10734, MYO9B, 54344, 156794, 1-584; 10734, MYO9B, 54335, 156785, 63-6131; 10734, MYO9B, 54340, 156790, 153-6221; 10735, MYLK, 54350, 156800, 289-501; 10735, MYLK, 54352, 156802, 133-820; 10735, MYLK, 54345, 156795, 295-5832; 10735, MYLK, 54346, 156796, 187-5724; 10735, MYLK, 54347, 156797, 187-5778; 10735, MYLK, 54348, 156798, 187-5931; 10735, MYLK, 54349, 156799, 380-5971; 10735, MYLK, 54351, 156801, 1-5745; 10735, MYLK, 54353, 156803, 5023-5487; 10735, MYLK, 54354, 156804, 173-637; 10735, MYLK, 54355, 156805, 221-682; 10736, MYLK2, 54356, 156806, 105-1895; 10736, MYLK2, 54357, 156807, 274-2064; 10737, MYLK3, 54358, 156808, 117-2576; 10737, MYLK3, 54359, 156809, 321-1757; 10738, MYLK4, 54360, 156810, 344-1510; 10739, MYLPF, 54362, 156812, 247-602; 10739, MYLPF, 54363, 156813, 219-623; 10739, MYLPF, 54364, 156814, 1-600; 10739, MYLPF, 54361, 156811, 82-591; 10740, MPRIP, 54365, 156815, 1-5384; 10740, MPRIP, 54367, 156817, 90-281; 10740, MPRIP, 54369, 156819, 1-832; 10740, MPRIP, 54370, 156820, 1-3275; 10740, MPRIP, 54371, 156821, 95-513; 10740, MPRIP, 54372, 156822, 1-2535; 10740, MPRIP, 54373, 156823, 1-178; 10740, MPRIP, 54374, 156824, 1-544; 10740, MPRIP, 54375, 156825, 1-86; 10740, MPRIP, 54376, 156826, 1-286; 10740, MPRIP, 54366, 156816, 1-3078; 10740, MPRIP, 54368, 156818, 90-3206; 10741, MYLIP, 54377, 156827, 505-1299; 10741, MYLIP, 54378, 156828, 199-1536; 10742, MYOSA, 54380, 156830, 245-5812; 10742, MYOSA, 54381, 156831, 1-684; 10742, MYOSA, 54382, 156832, 1-1758; 10742, MYOSA, 54384, 156834, 245-5812; 10742, MYOSA, 54385, 156835, 36-5597; 10742, MYOSA, 54386, 156836, 75-218; 10742, MYOSA, 54387, 156837, 1-693; 10742, MYOSA, 54388, 156838, 245-5731; 10742, MYOSA, 54379, 156829, 75-5561; 10742, MYOSA, 54383, 156833, 245-5812; 10743, MYOSB, 54390, 156840, 1-2898; 10743, MYOSB, 54392, 156842, 352-2514; 10743, MYOSB, 54389, 156839, 301-5847; 10743, MYOSB, 54391, 156841, 256-1512; 10744, MYOSC, 54394, 156844, 451-770; 10744, MYOSC, 54395, 156845, 134-595; 10744, MYOSC, 54396, 156846, 21-830; 10744, MYOSC, 54393, 156843, 163-5391; 10744, MYOSC, 54397, 156847, 109-1401; 10745, MYO6, 54398, 156848, 26-3787; 10745, MYO6, 54400, 156850, 280-4167; 10745, MYO6, 54402, 156852, 1-522; 10745, MYO6, 54404, 156854, 25-3909; 10745, MYO6, 54399, 156849, 140-3997; 10745, MYO6, 54401, 156851, 263-4051; 10745, MYO6, 54403, 156853, 33-3821; 10746, MYO7A, 54407, 156857, 267-3803; 10746, MYO7A, 54409, 156859, 1-4074; 10746, MYO7A, 54410, 156860, 267-3863; 10746, MYO7A, 54405, 156855, 273-6920; 10746, MYO7A, 54406, 156856, 348-6848; 10746, MYO7A, 54408, 156858, 267-6794; 10747, MYRIP, 54415, 156865, 116-463; 10747, MYRIP, 54411, 156861, 343-2922; 10747, MYRIP, 54412, 156862, 418-2730; 10747, MYRIP, 54413, 156863, 242-2626; 10747, MYRIP, 54414, 156864, 99-2678; 10747, MYRIP, 54416, 156866, 116-2029; 10747, MYRIP, 54417, 156867, 470-2488; 10748, MYO7B, 54419, 156869, 349-3258; 10748, MYO7B, 54420, 156870, 295-822; 10748, MYO7B, 54422, 156872, 1-270; 10748, MYO7B, 54418, 156868, 33-6383; 10748, MYO7B, 54421, 156871, 54-6404; 10749, MYO10, 54423, 156873, 469-6678; 10749, MYO10, 54424, 156874, 480-4673; 10749, MYO10, 54426, 156876, 420-2910; 10749, MYO10, 54427, 156877, 334-4527; 10749, MYO10, 54429, 156879, 131-766; 10749, MYO10, 54425, 156875, 456-6632; 10749, MYO10, 54428, 156878, 452-745; 10750, MYO19, 54432, 156882, 434-963; 10750, MYO19, 54434, 156884, 1-47; 10750, MYO19, 54436, 156886, 432-983; 10750, MYO19, 54437, 156887, 1-328; 10750, MYO19, 54438, 156888, 423-556; 10750, MYO19, 54441, 156891, 993-1553; 10750, MYO19, 54442, 156892, 590-786; 10750, MYO19, 54443, 156893, 411-897; 10750, MYO19, 54445, 156895, 423-556; 10750, MYO19, 54446, 156896, 411-897; 10750, MYO19, 54447, 156897, 590-786; 10750, MYO19, 54448, 156898, 1-47; 10750, MYO19, 54450, 156900, 434-963; 10750, MYO19, 54451, 156901, 1-328; 10750, MYO19, 54452, 156902, 432-983; 10750, MYO19, 54453, 156903, 993-1553; 10750, MYO19, 54430, 156880, 404-1357; 10750, MYO19, 54431, 156881, 463-2775; 10750, MYO19, 54433, 156883, 463-2775; 10750, MYO19, 54435, 156885, 524-3436; 10750, MYO19, 54439, 156889, 951-2861; 10750, MYO19, 54440, 156890, 524-3436; 10750, MYO19, 54444, 156894, 951-2861; 10750, MYO19, 54449, 156899, 404-1357; 10751, MYO15A, 54456, 156906, 114-573; 10751, MYO15A, 54457, 156907, 110-217; 10751, MYO15A, 54458, 156908, 174-485; 10751, MYO15A, 54459, 156909, 1-774; 10751, MYO15A, 54460, 156910, 1-361; 10751, MYO15A, 54461, 156911, 200-568; 10751, MYO15A, 54462, 156912, 339-10931; 10751, MYO15A, 54454, 156904, 339-10931; 10751, MYO15A, 54455, 156905, 623-3016; 10752, MYO15B, 54463, 156913, 1-61; 10752, MYO15B, 54464, 156914, 1-4593; 10752, MYO15B, 54465, 156915, 1-834; 10752, MYO15B, 54466, 156916, 1-4632; 10752, MYO15B, 54467, 156917, 1-2283; 10752, MYO15B, 54468, 156918, 1-201; 10752, MYO15B, 54469, 156919, 1-336; 10752, MYO15B, 54470, 156920, 1-769; 10752, MYO15B, 54471, 156921, 1-577; 10752, MYO15B, 54472, 156922, 1-256; 10752, MYO15B, 54473, 156923, 1-469; 10752, MYO15B, 54474, 156924, 1-312; 10752, MYO15B, 54475, 156925, 1-316; 10752, MYO15B, 54476, 156926, 1-217; 10752, MYO15B, 54477, 156927, 1-9195; 10752, MYO15B, 54478, 156928, 1-304; 10752, MYO15B, 54479, 156929, 1-2283; 10753, MYO16, 54483, 156933, 623-6265; 10753, MYO16, 54480, 156930, 42-2864; 10753, MYO16, 54481, 156931, 127-5703; 10753, MYO16, 54482, 156932, 42-5618; 10754, MYO18A, 54485, 156935, 1-82; 10754, MYO18A, 54487, 156937, 1-589; 10754, MYO18A, 54489, 156939, 1-280; 10754, MYO18A, 54490, 156940, 134-6250; 10754, MYO18A, 54484, 156934, 134-6253; 10754, MYO18A, 54486, 156936, 263-6271; 10754, MYO18A, 54488, 156938, 182-6346; 10755, MYO18B, 54491, 156941, 251-7954; 10755, MYO18B, 54492, 156942, 170-7876; 10755, MYO18B, 54493, 156943, 60-2456; 10755, MYO18B, 54494, 156944, 260-7963; 10755, MYO18B, 54496, 156946, 1-1553; 10755, MYO18B, 54495, 156945, 1-630; 10756, MYH1, 54497, 156947, 96-5915; 10757, MYH10, 54501, 156951, 170-732; 10757, MYH10, 54498, 156948, 140-6070; 10757, MYH10, 54499, 156949, 140-6163; 10757, MYH10, 54500, 156950, 140-6097; 10758, MYH11, 54509, 156959, 108-6197; 10758, MYH11, 54510, 156960, 108-6197; 10758, MYH11, 54502, 156952, 111-6029; 10758, MYH11, 54503, 156953, 89-6028; 10758, MYH11, 54504, 156954, 89-5926; 10758, MYH11, 54505, 156955, 111-5927; 10758, MYH11, 54506, 156956, 89-5926; 10758, MYH11, 54507, 156957, 89-6028; 10758, MYH11, 54508, 156958, 111-5927; 10758, MYH11, 54511, 156961, 111-6029; 10759, MYH13, 54512, 156962, 91-5907; 10759, MYH13, 54513, 156963, 165-5981; 10759, MYH13, 54514, 156964, 15-5831; 10760, MYH14, 54515, 156965, 101-1627; 10760, MYH14, 54517, 156967, 2216-4132; 10760, MYH14, 54519, 156969, 39-3046; 10760, MYH14, 54516, 156966, 48-6035; 10760, MYH14, 54518, 156968, 48-6059; 10760, MYH14, 54520, 156970, 31-6141; 10760, MYH14, 54521, 156971, 126-6137; 10760, MYH14, 54522, 156972, 1-5988; 10761, MYH15, 54523, 156973, 58-5898; 10762, MYH2, 54526, 156976, 129-675; 10762, MYH2, 54528, 156978, 108-572; 10762, MYH2, 54524, 156974, 386-6211; 10762, MYH2, 54525, 156975, 129-5954; 10762, MYH2, 54527, 156977, 270-2396; 10762, MYH2, 54529, 156979, 129-2255; 10763, MYH3, 54530, 156980, 89-5911; 10764, MYH4, 54531, 156981, 112-5931; 10765, MYH6, 54532, 156982, 31-5850; 10765, MYH6, 54533, 156983, 72-5891; 10766, MYH7, 54534, 156984, 164-5971; 10767, MYH7B, 54536, 156986, 1-450; 10767, MYH7B, 54537, 156987, 1-435; 10767, MYH7B, 54538, 156988, 1-450; 10767, MYH7B, 54539, 156989, 1-369; 10767, MYH7B, 54540, 156990, 1-432; 10767, MYH7B, 54541, 156991, 1-5949; 10767, MYH7B, 54535, 156985, 93-6044; 10768, MYH8, 54542, 156992, 96-5909; 10769, MYH9, 54544, 156994, 87-743; 10769, MYH9, 54545, 156995, 141-449; 10769, MYH9, 54543, 156993, 232-6114; 10770, MYL1, 54546, 156996, 149-733; 10770, MYL1, 54547, 156997, 86-538; 10771, MYL10, 54548, 156998, 179-859; 10772, MYL12A, 54552, 157002, 298-334; 10772, MYL12A, 54553, 157003, 281-623; 10772, MYL12A, 54555, 157005, 49-582; 10772, MYL12A, 54549, 156999, 396-911; 10772, MYL12A, 54550, 157000, 67-582; 10772, MYL12A, 54551, 157001, 123-638; 10772, MYL12A, 54554, 157004, 196-711; 10773, MYL12B, 54556, 157006, 345-863; 10773, MYL12B, 54557, 157007, 160-678; 10773, MYL12B, 54558, 157008, 384-902; 10773, MYL12B, 54559, 157009, 199-717; 10774, MYL2, 54561, 157011, 47-505; 10774, MYL2, 54560, 157010, 49-549; 10775, MYL3, 54564, 157014, 314-451; 10775, MYL3, 54562, 157012, 94-681; 10775, MYL3, 54563, 157013, 53-640; 10776, MYL4, 54567, 157017, 61-650; 10776, MYL4, 54568, 157018, 128-313; 10776, MYL4, 54569, 157019, 125-641; 10776, MYL4, 54570, 157020, 176-361; 10776, MYL4, 54571, 157021, 82-429; 10776, MYL4, 54572, 157022, 1-305; 10776, MYL4, 54574, 157024, 24-544; 10776, MYL4, 54565, 157015, 129-722; 10776, MYL4, 54566, 157016, 76-669; 10776, MYL4, 54573, 157023, 92-685; 10777,

MYL5, 54576, 157026, 74-391; 10777, MYL5, 54578, 157028, 1209-1403; 10777, MYL5, 54581, 157031, 452-829; 10777, MYL5, 54575, 157025, 106-627; 10777, MYL5, 54577, 157027, 158-556; 10777, MYL5, 54579, 157029, 349-747; 10777, MYL5, 54580, 157030, 2525-2923; 10778, MYL6, 54582, 157032, 47-505; 10778, MYL6, 54583, 157033, 47-505; 10778, MYL6, 54584, 157034, 41-757; 10778, MYL6, 54585, 157035, 57-368; 10778, MYL6, 54586, 157036, 34-471; 10778, MYL6, 54587, 157037, 45-635; 10778, MYL6, 54589, 157039, 35-520; 10778, MYL6, 54592, 157042, 1-250; 10778, MYL6, 54593, 157043, 21-368; 10778, MYL6, 54594, 157044, 200-343; 10778, MYL6, 54595, 157045, 21-411; 10778, MYL6, 54588, 157038, 41-496; 10778, MYL6, 54590, 157040, 242-697; 10778, MYL6, 54591, 157041, 7-462; 10779, MYL6B, 54597, 157047, 72-599; 10779, MYL6B, 54598, 157048, 476-562; 10779, MYL6B, 54596, 157046, 304-930; 10779, MYL6B, 54599, 157049, 423-1049; 10780, MYL7, 54601, 157051, 1-594; 10780, MYL7, 54602, 157052, 1-116; 10780, MYL7, 54603, 157053, 290-736; 10780, MYL7, 54604, 157054, 1-516; 10780, MYL7, 54605, 157055, 28-123; 10780, MYL7, 54606, 157056, 1-321; 10780, MYL7, 54607, 157057, 1-408; 10780, MYL7, 54600, 157050, 28-555; 10781, MYL9, 54608, 157058, 92-448; 10781, MYL9, 54609, 157059, 105-623; 10782, MSTN, 54610, 157060, 134-1261; 10783, MYOT, 54611, 157061, 375-1871; 10783, MYOT, 54613, 157063, 284-1435; 10783, MYOT, 54612, 157062, 378-1322; 10784, MTPN, 54615, 157065, 254-412; 10784, MTPN, 54614, 157064, 217-573; 10785, MTM1, 54617, 157067, 52-361; 10785, MTM1, 54616, 157066, 55-1866; 10786, MTMR1, 54619, 157069, 1-397; 10786, MTMR1, 54620, 157070, 302-564; 10786, MTMR1, 54621, 157071, 304-573; 10786, MTMR1, 54622, 157072, 289-549; 10786, MTMR1, 54623, 157073, 122-2143; 10786, MTMR1, 54624, 157074, 1-448; 10786, MTMR1, 54625, 157075, 260-700; 10786, MTMR1, 54627, 157077, 1-1217; 10786, MTMR1, 54628, 157078, 153-708; 10786, MTMR1, 54629, 157079, 136-1227; 10786, MTMR1, 54618, 157068, 158-2155; 10786, MTMR1, 54626, 157076, 166-1872; 10787, MTMR10, 54631, 157081, 1-259; 10787, MTMR10, 54632, 157082, 102-254; 10787, MTMR10, 54634, 157084, 73-645; 10787, MTMR10, 54635, 157085, 1-912; 10787, MTMR10, 54638, 157088, 1-150; 10787, MTMR10, 54630, 157080, 99-2432; 10787, MTMR10, 54633, 157083, 345-1700; 10787, MTMR10, 54636, 157086, 98-754; 10787, MTMR10, 54637, 157087, 1-2334; 10788, MTMR11, 54639, 157089, 187-2109; 10788, MTMR11, 54640, 157090, 252-2381; 10789, MTMR12, 54644, 157094, 150-266; 10789, MTMR12, 54645, 157095, 87-206; 10789, MTMR12, 54641, 157091, 132-2045; 10789, MTMR12, 54642, 157092, 101-2182; 10789, MTMR12, 54643, 157093, 172-2415; 10790, MTMR14, 54649, 157099, 92-553; 10790, MTMR14, 54650, 157100, 80-646; 10790, MTMR14, 54651, 157101, 20-202; 10790, MTMR14, 54652, 157102, 135-1013; 10790, MTMR14, 54653, 157103, 66-281; 10790, MTMR14, 54654, 157104, 112-675; 10790, MTMR14, 54655, 157105, 97-207; 10790, MTMR14, 54656, 157106, 70-546; 10790, MTMR14, 54657, 157107, 152-1714; 10790, MTMR14, 54646, 157096, 123-2075; 10790, MTMR14, 54647, 157097, 152-1948; 10790, MTMR14, 54648, 157098, 73-1689; 10791, MTMR2, 54662, 157112, 349-2018; 10791, MTMR2, 54658, 157108, 434-2149; 10791, MTMR2, 54659, 157109, 342-2273; 10791, MTMR2, 54660, 157110, 558-2273; 10791, MTMR2, 54661, 157111, 503-2218; 10792, MTMR3, 54664, 157114, 621-3809; 10792, MTMR3, 54668, 157118, 248-665; 10792, MTMR3, 54663, 157113, 285-3770; 10792, MTMR3, 54665, 157115, 329-3841; 10792, MTMR3, 54666, 157116, 10-3522; 10792, MTMR3, 54667, 157117, 343-3939; 10793, MTMR4, 54670, 157120, 218-556; 10793, MTMR4, 54671, 157121, 140-425; 10793, MTMR4, 54672, 157122, 218-810; 10793, MTMR4, 54673, 157123, 72-3488; 10793, MTMR4, 54674, 157124, 76-372; 10793, MTMR4, 54675, 157125, 269-317; 10793, MTMR4, 54669, 157119, 126-3713; 10794, MTMR6, 54676, 157126, 763-2628; 10795, MTMR7, 54679, 157129, 16-333; 10795, MTMR7, 54677, 157127, 36-2018; 10795, MTMR7, 54678, 157128, 36-1703; 10796, MTMR8, 54680, 157130, 69-2183; 10797, MTMR9, 54683, 157133, 63-368; 10797, MTMR9, 54681, 157131, 474-2123; 10797, MTMR9, 54682, 157132, 297-1691; 10798, MYOZ1, 54684, 157134, 366-1265; 10799, MYOZ2, 54685, 157135, 214-1008; 10800, MYOZ3, 54688, 157138, 111-590; 10800, MYOZ3, 54689, 157139, 1-315; 10800, MYOZ3, 54686, 157136, 200-955; 10800, MYOZ3, 54687, 157137, 556-1311; 10800, MYOZ3, 54690, 157140, 556-819; 10801, MARCKS, 54692, 157142, 309-1301; 10801, MARCKS, 54691, 157141, 385-1383; 10802, MEAF6, 54695, 157145, 708-1217; 10802, MEAF6, 54693, 157143, 29-604; 10802, MEAF6, 54694, 157144, 18-596; 10802, MEAF6, 54696, 157146, 18-623; 10802, MEAF6, 54697, 157147, 1-576; 10803, NAA10, 54699, 157149, 112-538; 10803, NAA10, 54700, 157150, 138-647; 10803, NAA10, 54701, 157151, 55-609; 10803, NAA10, 54702, 157152, 163-599; 10803, NAA10, 54698, 157148, 112-774; 10803, NAA10, 54703, 157153, 320-1027; 10804, NAA11, 54705, 157155, 1-336; 10804, NAA11, 54704, 157154, 174-863; 10805, NAA15, 54707, 157157, 191-2788; 10805, NAA15, 54708, 157158, 76-372; 10805, NAA15, 54706, 157156, 324-2924; 10806, NAA16, 54709, 157159, 325-2919; 10806, NAA16, 54710, 157160, 250-1539; 10806, NAA16, 54711, 157161, 235-1785; 10807, NAA20, 54714, 157164, 636-1136; 10807, NAA20, 54712, 157162, 88-423; 10807, NAA20, 54713, 157163, 282-818; 10808, NAA25, 54716, 157166, 7-120; 10808, NAA25, 54717, 157167, 1-421; 10808, NAA25, 54718, 157168, 24-326; 10808, NAA25, 54715, 157165, 250-3168; 10809, NAA30, 54719, 157169, 1-524; 10809, NAA30, 54720, 157170, 166-480; 10809, NAA30, 54721, 157171, 122-271; 10809, NAA30, 54722, 157172, 155-1243; 10810, NAA35, 54723, 157173, 134-2311; 10810, NAA35, 54724, 157174, 352-1236; 10811, NAA38, 54726, 157176, 262-483; 10811, NAA38, 54727, 157177, 141-392; 10811, NAA38, 54729, 157179, 100-507; 10811, NAA38, 54730, 157180, 212-511; 10811, NAA38, 54725, 157175, 432-953; 10811, NAA38, 54728, 157178, 429-806; 10812, NAA40, 54732, 157182, 96-470; 10812, NAA40, 54733, 157183, 102-221; 10812, NAA40, 54734, 157184, 96-305; 10812, NAA40, 54731, 157181, 102-815; 10812, NAA40, 54735, 157185, 345-995; 10813, NAA50, 54737, 157187, 111-500; 10813, NAA50, 54738, 157188, 268-555; 10813, NAA50, 54739, 157189, 352-858; 10813, NAA50, 54740, 157190, 301-447; 10813, NAA50, 54741, 157191, 374-661; 10813, NAA50, 54742, 157192, 282-458; 10813, NAA50, 54743, 157193, 301-473; 10813, NAA50, 54744, 157194, 246-491; 10813, NAA50, 54745, 157195, 1-177; 10813, NAA50, 54736, 157186, 326-835; 10814, NAA60, 54751, 157201, 360-657; 10814, NAA60, 54752, 157202, 59-463; 10814, NAA60, 54754, 157204, 112-237; 10814, NAA60, 54755, 157205, 256-582; 10814, NAA60, 54758, 157208, 177-565; 10814, NAA60, 54759, 157209, 340-570; 10814, NAA60, 54760, 157210, 265-584; 10814, NAA60, 54761, 157211, 193-552; 10814, NAA60, 54762, 157212, 395-818; 10814, NAA60, 54763, 157213, 196-558; 10814, NAA60, 54765, 157215, 118-381; 10814, NAA60, 54766, 157216, 422-700; 10814, NAA60, 54767, 157217, 158-398; 10814, NAA60, 54768, 157218, 111-515; 10814, NAA60, 54770, 157220, 34-180; 10814, NAA60, 54746, 157196, 275-808; 10814, NAA60, 54747, 157197, 304-1032; 10814, NAA60, 54748, 157198, 177-905; 10814, NAA60, 54749, 157199, 86-835; 10814, NAA60, 54750, 157200, 204-776; 10814, NAA60, 54753, 157203, 111-839; 10814, NAA60, 54756, 157206, 208-741; 10814, NAA60, 54757, 157207, 53-781; 10814, NAA60, 54764, 157214, 59-598; 10814, NAA60, 54769, 157219, 111-650; 10815, N6AMT1, 54772, 157222, 27-671; 10815, N6AMT1, 54773, 157223, 27-671; 10815, N6AMT1, 54771, 157221, 27-587; 10816, N6AMT2, 54774, 157224, 82-726; 10816, N6AMT2, 54775, 157225, 49-693; 10817, NKAIN1, 54777, 157227, 1-455; 10817, NKAIN1, 54778, 157228, 184-562; 10817, NKAIN1, 54776, 157226, 8-631; 10818, NKAIN2, 54782, 157232, 2-148; 10818, NKAIN2, 54779, 157229, 61-627; 10818, NKAIN2, 54780, 157230, 61-687; 10818, NKAIN2, 54781, 157231, 42-665; 10819, NKAIN3, 54784, 157234, 112-414; 10819, NKAIN3, 54783, 157233, 133-726; 10820, NKAIN4, 54785, 157235, 246-686; 10820, NKAIN4, 54786, 157236, 353-712; 10820, NKAIN4, 54788, 157238, 1-504; 10820, NKAIN4, 54787, 157237, 91-717; 10821, NACAD, 54789, 157239, 21-4709; 10822, NACC2, 54790, 157240, 157-1920; 10822, NACC2, 54791, 157241, 60-1823; 10823, NAALAD2, 54792, 157242, 48-2171; 10823, NAALAD2, 54794, 157244, 466-730; 10823, NAALAD2, 54796, 157246, 145-996; 10823, NAALAD2, 54797, 157247, 31-1149; 10823, NAALAD2, 54798, 157248, 164-484; 10823, NAALAD2, 54793, 157243, 22-939; 10823, NAALAD2, 54795, 157245, 231-2453; 10824, NAALADL1, 54799, 157249, 17-2236; 10824, NAALADL1, 54802, 157252, 1-2118; 10824, NAALADL1, 54804, 157254, 759-942; 10824, NAALADL1, 54805, 157255, 593-673; 10824, NAALADL1, 54806, 157256, 651-914; 10824, NAALADL1, 54807, 157257, 570-800; 10824, NAALADL1, 54808, 157258, 771-851; 10824, NAALADL1, 54809, 157259, 1-297; 10824, NAALADL1, 54810, 157260, 352-563; 10824, NAALADL1, 54811, 157261, 345-566; 10824, NAALADL1, 54812, 157262, 391-495; 10824, NAALADL1, 54813, 157263, 1-147; 10824, NAALADL1, 54800, 157250, 1-2376; 10824, NAALADL1, 54801, 157251, 1-2100; 10824, NAALADL1, 54803, 157253, 29-2251; 10825, NAALADL2, 54814, 157264, 1-165; 10825, NAALADL2, 54816, 157266, 230-574; 10825, NAALADL2, 54817, 157267, 1-2352; 10825, NAALADL2, 54815, 157265, 129-2516; 10826, NAGA, 54818, 157268, 534-1769; 10826, NAGA, 54819, 157269, 157-1392; 10826, NAGA, 54820, 157270, 138-1373; 10827, NAGK, 54823, 157273, 165-1046; 10827, NAGK, 54824, 157274, 38-517; 10827, NAGK, 54825, 157275, 211-801; 10827, NAGK, 54826, 157276, 231-410; 10827, NAGK, 54827, 157277, 66-1088; 10827, NAGK, 54828, 157278, 1-411; 10827, NAGK, 54829, 157279, 525-776; 10827, NAGK, 54830, 157280, 1-548; 10827, NAGK, 54831, 157281, 303-584; 10827, NAGK, 54832, 157282, 1-328; 10827, NAGK, 54821, 157271, 63-1097; 10827, NAGK, 54822, 157272, 246-1418; 10827, NAGK, 54833, 157283, 269-1441; 10828, GNPTAB, 54835, 157285, 169-384; 10828, GNPTAB, 54837, 157287, 1-417; 10828, GNPTAB, 54838, 157288, 1-352; 10828, GNPTAB, 54839, 157289, 1-291; 10828, GNPTAB, 54840, 157290, 5-211; 10828, GNPTAB, 54834, 157284, 264-4034; 10828, GNPTAB, 54836, 157286, 144-1616; 10828, GNPTG, 54842, 157292, 36-266; 10829, GNPTG, 54843, 157293, 1-552; 10829, GNPTG, 54844, 157294, 23-253; 10829, GNPTG, 54845, 157295, 16-201; 10829, GNPTG, 54841, 157291, 44-961; 10830, NAGPA, 54849, 157299, 1-315; 10830, NAGPA, 54850, 157300, 1-121; 10830, NAGPA, 54851, 157301, 1-519; 10830, NAGPA, 54852, 157302, 1-946; 10830, NAGPA, 54853, 157303, 1-570; 10830, NAGPA, 54846, 157296, 21-1568; 10830, NAGPA, 54847, 157297, 21-1466; 10830, NAGPA, 54848, 157298, 5-934; 10831, NAGLU, 54855, 157305, 390-634; 10831, NAGLU, 54856, 157306, 1-510; 10831, NAGLU, 54857, 157307, 1-369; 10831, NAGLU, 54858, 157308, 1-196; 10831, NAGLU, 54854, 157304, 102-2333; 10832, NAGS, 54860, 157310, 1-1536; 10832, NAGS, 54859, 157309, 119-1723; 10833, NPL, 54866, 157316, 23-715; 10833, NPL, 54861, 157311, 23-985; 10833, NPL, 54862, 157312, 23-745; 10833, NPL, 54863, 157313, 45-1007; 10833, NPL, 54864, 157314, 646-1551; 10833, NPL, 54865, 157315, 109-831; 10834, NANP, 54867, 157317, 228-974; 10835, NANS, 54869, 157319, 296-715; 10835, NANS, 54870, 157320, 1-348; 10835, NANS, 54868, 157318, 71-1150; 10836, NAT1, 54876, 157326, 1-1059; 10836, NAT1, 54871, 157321, 174-1046; 10836, NAT1, 54872, 157322, 521-1393; 10836, NAT1, 54873, 157323, 272-1144; 10836, NAT1, 54874, 157324, 639-1511; 10836, NAT1, 54875, 157325, 308-1180; 10837, NAT10, 54879, 157329, 125-561; 10837, NAT10, 54880, 157330, 18-884; 10837, NAT10, 54881, 157331, 1-2505; 10837, NAT10, 54877, 157327, 207-3284; 10837, NAT10, 54878, 157328, 193-3054; 10838, NAT14, 54883, 157333, 113-271; 10838, NAT14, 54884, 157334, 1-520; 10838, NAT14, 54885, 157335, 74-208; 10838, NAT14, 54882, 157332, 304-924; 10839, NAT16, 54887, 157337, 145-613; 10839, NAT16, 54886, 157336, 240-1349; 10839, NAT16, 54888, 157338, 179-517; 10839, NAT16, 54889, 157339, 219-1328; 10840, NAT2, 54891, 157341, 117-599; 10840, NAT2, 54890, 157340, 108-980; 10841, NAT6, 54893, 157343, 507-765; 10841, NAT6, 54894, 157344, 690-860; 10841, NAT6, 54898, 157348, 556-583; 10841, NAT6, 54892, 157342, 203-1129; 10841, NAT6, 54895, 157345, 104-964; 10841, NAT6, 54896, 157346, 809-1669; 10841, NAT6, 54897, 157347, 419-1279; 10842, NAT8, 54899, 157349, 151-834; 10843, NAT8B, 54900, 157350, 36-714; 10844, NAT8L, 54901, 157351, 205-609; 10844, NAT8L, 54902, 157352, 1-909; 10845, NAT9, 54905, 157355, 109-531; 10845, NAT9, 54906, 157356, 86-505; 10845, NAT9, 54907, 157357, 172-810; 10845, NAT9, 54908, 157358, 81-488; 10845, NAT9, 54909, 157359, 10-633; 10845, NAT9, 54910, 157360, 251-497; 10845, NAT9, 54911, 157361, 68-676; 10845, NAT9, 54912, 157362, 68-394; 10845, NAT9, 54913, 157363, 33-583; 10845, NAT9, 54914, 157364, 197-832; 10845, NAT9, 54915, 157365, 416-584; 10845, NAT9, 54916, 157366, 75-545; 10845, NAT9, 54903, 157353, 75-698; 10845, NAT9, 54904, 157354, 83-703; 10846, NATD1, 54917, 157367, 147-488; 10847, NWD1, 54920, 157370, 646-1185; 10847, NWD1, 54923, 157373, 252-4820; 10847, NWD1, 54918, 157368, 32-4330; 10847, NWD1, 54919, 157369, 4-234; 10847, NWD1, 54921, 157371, 419-4717; 10847, NWD1, 54922, 157372, 1-4695; 10848, NWD2, 54924, 157374, 849-6077; 10849, NAPEPLD, 54927, 157377, 1-431; 10849, NAPEPLD, 54928, 157378, 194-565; 10849, NAPEPLD, 54931, 157381, 559-575; 10849, NAPEPLD, 54936, 157386, 1-431; 10849, NAPEPLD, 54937, 157387, 194-565; 10849, NAPEPLD, 54940, 157390, 559-575; 10849, NAPEPLD, 54925, 157375, 439-1620; 10849, NAPEPLD, 54926, 157376, 299-1480; 10849, NAPEPLD, 54929, 157379, 156-1337; 10849, NAPEPLD, 54930, 157380, 95-1276; 10849, NAPEPLD, 54932, 157382, 280-1461;

10849, NAPEPLD, 54933, 157383, 156-1337; 10849, NAPEPLD, 54934, 157384, 439-1620; 10849, NAPEPLD, 54935, 157385, 299-1480; 10849, NAPEPLD, 54938, 157388, 280-1461; 10849, NAPEPLD, 54939, 157389, 95-1276; 10850, NW, 54942, 157392, 35-538; 10850, NW, 54943, 157393, 1-418; 10850, NAAA, 54944, 157394, 193-951; 10850, NAAA, 54946, 157396, 1-668; 10850, NAAA, 54941, 157391, 103-1182; 10850, NW, 54945, 157395, 25-996; 10851, ASAH1, 54950, 157400, 313-1425; 10851, ASAH1, 54947, 157397, 313-1500; 10851, ASAH1, 54948, 157398, 185-1354; 10851, ASAH1, 54949, 157399, 168-1403; 10852, ASAH2, 54951, 157401, 1-2181; 10852, ASAH2, 54954, 157404, 1-1869; 10852, ASAH2, 54955, 157405, 1-156; 10852, ASAH2, 54956, 157406, 1-435; 10852, ASAH2, 54952, 157402, 1-2343; 10852, ASAH2, 54953, 157403, 1-2238; 10853, ASAH2B, 54957, 157407, 66-563; 10853, ASAH2B, 54958, 157408, 785-1267; 10854, NADK, 54959, 157409, 45-1289; 10854, NADK, 54963, 157413, 1-133; 10854, NADK, 54964, 157414, 1-225; 10854, NADK, 54965, 157415, 1-93; 10854, NADK, 54966, 157416, 1-117; 10854, NADK, 54960, 157410, 223-1563; 10854, NADK, 54961, 157411, 86-1426; 10854, NADK, 54962, 157412, 206-1981; 10855, NADK2, 54971, 157421, 374-1279; 10855, NADK2, 54972, 157422, 1-413; 10855, NADK2, 54973, 157423, 334-579; 10855, NADK2, 54974, 157424, 1-744; 10855, NADK2, 54967, 157417, 237-1076; 10855, NADK2, 54968, 157418, 1-1329; 10855, NADK2, 54969, 157419, 223-1062; 10855, NADK2, 54970, 157420, 1-1233; 10856, NADSYN1, 54976, 157426, 1-250; 10856, NADSYN1, 54977, 157427, 1222-2229; 10856, NADSYN1, 54978, 157428, 1-779; 10856, NADSYN1, 54979, 157429, 81-965; 10856, NADSYN1, 54980, 157430, 1-335; 10856, NADSYN1, 54981, 157431, 1-178; 10856, NADSYN1, 54982, 157432, 372-820; 10856, NADSYN1, 54983, 157433, 87-353; 10856, NADSYN1, 54975, 157425, 189-2309; 10857, NSDHL, 54986, 157436, 232-994; 10857, NSDHL, 54984, 157434, 195-1316; 10857, NSDHL, 54985, 157435, 262-1383; 10858, NQO1, 54990, 157440, 122-730; 10858, NQO1, 54991, 157441, 117-878; 10858, NQO1, 54992, 157442, 68-877; 10858, NQO1, 54987, 157437, 513-1337; 10858, NQO1, 54988, 157438, 146-856; 10858, NQO1, 54989, 157439, 230-952; 10859, NQO2, 54995, 157445, 340-921; 10859, NQO2, 54996, 157446, 170-751; 10859, NQO2, 54998, 157448, 273-689; 10859, NQO2, 54999, 157449, 417-833; 10859, NQO2, 55000, 157450, 437-626; 10859, NQO2, 55001, 157451, 179-286; 10859, NQO2, 54993, 157443, 713-1408; 10859, NQO2, 54994, 157444, 296-991; 10859, NQO2, 54997, 157447, 175-870; 10860, NDUFA1, 55002, 157452, 426-638; 10861, NDUFA10, 55005, 157455, 7-612; 10861, NDUFA10, 55006, 157456, 6-1178; 10861, NDUFA10, 55007, 157457, 13-297; 10861, NDUFA10, 55008, 157458, 1-400; 10861, NDUFA10, 55009, 157459, 1-390; 10861, NDUFA10, 55010, 157460, 1-417; 10861, NDUFA10, 55011, 157461, 43-776; 10861, NDUFA10, 55012, 157462, 45-1112; 10861, NDUFA10, 55003, 157453, 102-1169; 10861, NDUFA10, 55004, 157454, 24-1313; 10862, NDUFA11, 55015, 157465, 47-154; 10862, NDUFA11, 55016, 157466, 64-426; 10862, NDUFA11, 55013, 157463, 49-474; 10862, NDUFA11, 55014, 157464, 79-765; 10863, NDUFA12, 55018, 157468, 69-368; 10863, NDUFA12, 55019, 157469, 21-188; 10863, NDUFA12, 55020, 157470, 1-163; 10863, NDUFA12, 55021, 157471, 1-144; 10863, NDUFA12, 55017, 157467, 91-528; 10863, NDUFA12, 55022, 157472, 34-225; 10864, NDUFA13, 55024, 157474, 10-462; 10864, NDUFA13, 55025, 157475, 504-827; 10864, NDUFA13, 55026, 157476, 12-374; 10864, NDUFA13, 55027, 157477, 1-227; 10864, NDUFA13, 55023, 157473, 485-919; 10865, NDUFA2, 55028, 157478, 203-502; 10865, NDUFA2, 55029, 157479, 63-293; 10866, NDUFA3, 55030, 157480, 28-246; 10866, NDUFA3, 55031, 157481, 11-196; 10866, NDUFA3, 55032, 157482, 11-256; 10866, NDUFA3, 55033, 157483, 1-103; 10866, NDUFA3, 55035, 157485, 1-209; 10866, NDUFA3, 55036, 157486, 25-222; 10866, NDUFA3, 55037, 157487, 152-349; 10866, NDUFA3, 55039, 157489, 195-320; 10866, NDUFA3, 55040, 157490, 25-246; 10866, NDUFA3, 55041, 157491, 28-246; 10866, NDUFA3, 55043, 157493, 1-103; 10866, NDUFA3, 55044, 157494, 25-246; 10866, NDUFA3, 55045, 157495, 11-256; 10866, NDUFA3, 55046, 157496, 1-209; 10866, NDUFA3, 55047, 157497, 152-349; 10866, NDUFA3, 55048, 157498, 25-222; 10866, NDUFA3, 55049, 157499, 195-320; 10866, NDUFA3, 55051, 157501, 11-196; 10866, NDUFA3, 55034, 157484, 59-313; 10866, NDUFA3, 55038, 157488, 43-297; 10866, NDUFA3, 55042, 157492, 59-313; 10866, NDUFA3, 55050, 157500, 43-297; 10867, N/A, 55052, 157502, 28-282; 10867, N/A, 55053, 157503, 28-282; 10867, N/A, 55054, 157504, 28-282; 10867, N/A, 55056, 157506, 28-282; 10867, N/A, 55057, 157507, 28-282; 10867, N/A, 55058, 157508, 28-282; 10867, N/A, 55059, 157509, 28-282; 10867, N/A, 55055, 157505, 28-282; 10868, NDUFA4L2, 55062, 157512, 8-289; 10868, NDUFA4L2, 55060, 157510, 265-528; 10868, NDUFA4L2, 55061, 157511, 254-517; 10869, NDUFA5, 55064, 157514, 1-337; 10869, NDUFA5, 55066, 157516, 7-219; 10869, NDUFA5, 55067, 157517, 181-459; 10869, NDUFA5, 55068, 157518, 110-343; 10869, NDUFA5, 55069, 157519, 110-415; 10869, NDUFA5, 55063, 157513, 461-811; 10869, NDUFA5, 55065, 157515, 136-486; 10870, NDUFA6, 55071, 157521, 36-422; 10870, NDUFA6, 55072, 157522, 193-408; 10870, NDUFA6, 55077, 157527, 193-408; 10870, NDUFA6, 55079, 157529, 193-408; 10870, NDUFA6, 55080, 157530, 193-408; 10870, NDUFA6, 55081, 157531, 193-408; 10870, NDUFA6, 55082, 157532, 36-422; 10870, NDUFA6, 55083, 157533, 36-422; 10870, NDUFA6, 55085, 157535, 36-422; 10870, NDUFA6, 55070, 157520, 134-598; 10870, NDUFA6, 55073, 157523, 134-598; 10870, NDUFA6, 55074, 157524, 134-598; 10870, NDUFA6, 55075, 157525, 63-527; 10870, NDUFA6, 55076, 157526, 134-598; 10870, NDUFA6, 55078, 157528, 63-527; 10870, NDUFA6, 55084, 157534, 134-598; 10871, NDUFA7, 55088, 157538, 18-209; 10871, NDUFA7, 55089, 157539, 18-248; 10871, NDUFA7, 55086, 157536, 39-380; 10871, NDUFA7, 55087, 157537, 18-359; 10872, NDUFA8, 55090, 157540, 143-661; 10873, NDUFA9, 55092, 157542, 107-517; 10873, NDUFA9, 55093, 157543, 64-512; 10873, NDUFA9, 55091, 157541, 21-1154; 10874, NDUFB1, 55094, 157544, 141-458; 10874, NDUFB1, 55095, 157545, 215-391; 10874, NDUFB1, 55096, 157546, 207-383; 10874, NDUFB1, 55097, 157547, 92-268; 10874, NDUFB1, 55098, 157548, 33-350; 10875, NDUFB10, 55101, 157551, 74-559; 10875, NDUFB10, 55102, 157552, 68-495; 10875, NDUFB10, 55099, 157549, 118-636; 10875, NDUFB10, 55100, 157550, 83-589; 10876, NDUFB11, 55103, 157553, 360-851; 10876, NDUFB11, 55104, 157554, 826-1287; 10877, NDUFB2, 55106, 157556, 36-140; 10877, NDUFB2, 55107, 157557, 268-393; 10877, NDUFB2, 55108, 157558, 182-307; 10877, NDUFB2, 55109, 157559, 194-430; 10877, NDUFB2, 55112, 157562, 306-431; 10877, NDUFB2, 55113, 157563, 1-315; 10877, NDUFB2, 55114, 157564, 107-388; 10877, NDUFB2, 55115, 157565, 58-348; 10877, NDUFB2, 55116, 157566, 250-375; 10877, NDUFB2, 55105, 157555, 74-391; 10877, NDUFB2, 55110, 157560, 75-392; 10877, NDUFB2, 55111, 157561, 56-373; 10878, NDUFB3, 55118, 157568, 268-462; 10878, NDUFB3, 55117, 157567, 324-620; 10878, NDUFB3, 55119, 157569, 116-412; 10878, NDUFB3, 55120, 157570, 78-374; 10879, NDUFB4, 55122, 157572, 6-215; 10879, NDUFB4, 55123, 157573, 4-213; 10879, NDUFB4, 55124, 157574, 14-256; 10879, NDUFB4, 55121, 157571, 52-441; 10879, NDUFB4, 55125, 157575, 33-395; 10880, NDUFB5, 55127, 157577, 6-134; 10880, NDUFB5, 55128, 157578, 1-620; 10880, NDUFB5, 55129, 157579, 1-303; 10880, NDUFB5, 55130, 157580, 16-549; 10880, NDUFB5, 55131, 157581, 1-171; 10880, NDUFB5, 55133, 157583, 8-208; 10880, NDUFB5, 55134, 157584, 30-437; 10880, NDUFB5, 55126, 157576, 115-684; 10880, NDUFB5, 55132, 157582, 26-439; 10881, NDUFB6, 55137, 157587, 125-418; 10881, NDUFB6, 55135, 157585, 100-441; 10881, NDUFB6, 55136, 157586, 103-489; 10882, NDUFB7, 55139, 157589, 63-275; 10882, NDUFB7, 55138, 157588, 63-476; 10883, NDUFB8, 55143, 157593, 20-235; 10883, NDUFB8, 55140, 157590, 14-574; 10883, NDUFB8, 55141, 157591, 14-532; 10883, NDUFB8, 55142, 157592, 152-619; 10884, NDUFB9, 55145, 157595, 57-593; 10884, NDUFB9, 55146, 157596, 44-550; 10884, NDUFB9, 55147, 157597, 48-713; 10884, NDUFB9, 55144, 157594, 85-624; 10885, NDUFAB1, 55149, 157599, 14-238; 10885, NDUFAB1, 55150, 157600, 1-335; 10885, NDUFAB1, 55152, 157602, 311-520; 10885, NDUFAB1, 55148, 157598, 67-537; 10885, NDUFAB1, 55151, 157601, 2-472; 10886, NDUFC1, 55153, 157603, 286-516; 10886, NDUFC1, 55154, 157604, 335-565; 10886, NDUFC1, 55155, 157605, 404-634; 10886, NDUFC1, 55156, 157606, 18-248; 10886, NDUFC1, 55157, 157607, 299-529; 10886, NDUFC1, 55158, 157608, 772-1002; 10886, NDUFC1, 55159, 157609, 831-1061; 10887, NDUFC2, 55161, 157611, 76-291; 10887, NDUFC2, 55164, 157614, 118-441; 10887, NDUFC2, 55160, 157610, 476-835; 10887, NDUFC2, 55162, 157612, 98-364; 10887, NDUFC2, 55163, 157613, 76-366; 10888, NDUFAF1, 55166, 157616, 398-1183; 10888, NDUFAF1, 55167, 157617, 155-781; 10888, NDUFAF1, 55168, 157618, 265-837; 10888, NDUFAF1, 55165, 157615, 383-1366; 10889, NDUFAF2, 55170, 157620, 50-232; 10889, NDUFAF2, 55171, 157621, 1-155; 10889, NDUFAF2, 55169, 157619, 128-637; 10890, NDUFAF3, 55172, 157622, 207-590; 10890, NDUFAF3, 55173, 157623, 1135-1689; 10890, NDUFAF3, 55174, 157624, 310-693; 10890, NDUFAF3, 55175, 157625, 275-658; 10891, NDUFAF4, 55176, 157626, 81-608; 10892, NDUFAF5, 55179, 157629, 63-866; 10892, NDUFAF5, 55177, 157627, 120-1157; 10892, NDUFAF5, 55178, 157628, 20-973; 10893, NDUFAF6, 55180, 157630, 371-1096; 10893, NDUFAF6, 55181, 157631, 1051-1776; 10893, NDUFAF6, 55183, 157633, 1-247; 10893, NDUFAF6, 55184, 157634, 549-949; 10893, NDUFAF6, 55185, 157635, 1-175; 10893, NDUFAF6, 55186, 157636, 1-282; 10893, NDUFAF6, 55189, 157639, 532-816; 10893, NDUFAF6, 55190, 157640, 1-294; 10893, NDUFAF6, 55191, 157641, 112-419; 10893, NDUFAF6, 55192, 157642, 1-427; 10893, NDUFAF6, 55193, 157643, 1-309; 10893, NDUFAF6, 55182, 157632, 24-1025; 10893, NDUFAF6, 55187, 157637, 16-381; 10893, NDUFAF6, 55188, 157638, 4-369; 10894, NDUFAF7, 55196, 157646, 132-934; 10894, NDUFAF7, 55197, 157647, 94-783; 10894, NDUFAF7, 55198, 157648, 220-663; 10894, NDUFAF7, 55199, 157649, 141-473; 10894, NDUFAF7, 55200, 157650, 1-267; 10894, NDUFAF7, 55201, 157651, 76-489; 10894, NDUFAF7, 55194, 157644, 41-1366; 10894, NDUFAF7, 55195, 157645, 28-1059; 10895, NDUFS1, 55203, 157653, 179-569; 10895, NDUFS1, 55205, 157655, 90-365; 10895, NDUFS1, 55208, 157658, 96-1931; 10895, NDUFS1, 55202, 157652, 268-2451; 10895, NDUFS1, 55204, 157654, 62-2287; 10895, NDUFS1, 55206, 157656, 253-2265; 10895, NDUFS1, 55207, 157657, 104-2287; 10895, NDUFS1, 55209, 157659, 146-1996; 10895, NDUFS1, 55210, 157660, 90-2165; 10896, NDUFS2, 55211, 157661, 449-1840; 10896, NDUFS2, 55212, 157662, 240-1613; 10897, NDUFS3, 55214, 157664, 21-253; 10897, NDUFS3, 55215, 157665, 53-538; 10897, NDUFS3, 55216, 157666, 21-386; 10897, NDUFS3, 55217, 157667, 64-267; 10897, NDUFS3, 55213, 157663, 83-877; 10897, NDUFS3, 55218, 157668, 19-417; 10898, NDUFS4, 55220, 157670, 29-250; 10898, NDUFS4, 55221, 157671, 1-351; 10898, NDUFS4, 55222, 157672, 31-180; 10898, NDUFS4, 55223, 157673, 17-412; 10898, NDUFS4, 55219, 157669, 29-556; 10899, NDUFS5, 55224, 157674, 84-404; 10899, NDUFS5, 55225, 157675, 88-408; 10900, NDUFS6, 55227, 157677, 4-522; 10900, NDUFS6, 55226, 157676, 19-393; 10901, NDUFS7, 55230, 157680, 6-716; 10901, NDUFS7, 55232, 157682, 21-221; 10901, NDUFS7, 55233, 157683, 28-576; 10901, NDUFS7, 55234, 157684, 10-135; 10901, NDUFS7, 55235, 157685, 44-688; 10901, NDUFS7, 55236, 157686, 10-654; 10901, NDUFS7, 55228, 157678, 297-938; 10901, NDUFS7, 55229, 157679, 24-644; 10901, NDUFS7, 55231, 157681, 302-922; 10902, NDUFS8, 55238, 157688, 248-620; 10902, NDUFS8, 55239, 157689, 1-123; 10902, NDUFS8, 55240, 157690, 113-307; 10902, NDUFS8, 55241, 157691, 186-515; 10902, NDUFS8, 55242, 157692, 165-377; 10902, NDUFS8, 55243, 157693, 148-561; 10902, NDUFS8, 55244, 157694, 51-182; 10902, NDUFS8, 55245, 157695, 1-281; 10902, NDUFS8, 55246, 157696, 136-689; 10902, NDUFS8, 55237, 157687, 108-740; 10903, NDUFV1, 55248, 157698, 62-1435; 10903, NDUFV1, 55249, 157699, 334-620; 10903, NDUFV1, 55250, 157700, 326-1417; 10903, NDUFV1, 55251, 157701, 1-384; 10903, NDUFV1, 55252, 157702, 48-582; 10903, NDUFV1, 55253, 157703, 48-179; 10903, NDUFV1, 55254, 157704, 402-559; 10903, NDUFV1, 55255, 157705, 1-402; 10903, NDUFV1, 55256, 157706, 378-786; 10903, NDUFV1, 55258, 157708, 251-477; 10903, NDUFV1, 55259, 157709, 150-582; 10903, NDUFV1, 55260, 157710, 48-582; 10903, NDUFV1, 55247, 157697, 154-1548; 10903, NDUFV1, 55257, 157707, 66-1433; 10904, NDUFV2, 55262, 157712, 118-876; 10904, NDUFV2, 55263, 157713, 115-234; 10904, NDUFV2, 55264, 157714, 50-115; 10904, NDUFV2, 55261, 157711, 115-864; 10905, NDUFV3, 55265, 157715, 67-393; 10905, NDUFV3, 55266, 157716, 70-1491; 10906, NDUFA10, 55267, 157717, 1-400; 10906, NDUFA10, 55268, 157718, 45-1112; 10906, NDUFA10, 55269, 157719, 43-776; 10906, NDUFA10, 55270, 157720, 6-1178; 10906, NDUFA10, 55271, 157721, 1-390; 10906, NDUFA10, 55272, 157722, 7-612; 10906, NDUFA10, 55273, 157723, 102-1169; 10906, NDUFA10, 55274, 157724, 1-417; 10906, NDUFA10, 55275, 157725, 13-297; 10906, NDUFA10, 55276, 157726, 24-1313; 10907, N/A, 55277, 157727, 22-363; 10908, NOXRED1, 55279, 157729, 65-734; 10908, NOXRED1, 55278, 157728, 168-1247; 10909, NDOR1, 55280, 157730, 109-1902; 10909, NDOR1, 55281, 157731, 84-1904; 10909, NDOR1, 55282, 157732, 29-1801; 10909, NDOR1, 55283, 157733, 73-1638; 10910, NOX1, 55285, 157735, 207-1790; 10910, NOX1, 55286, 157736, 71-649; 10910, NOX1, 55288, 157738, 1-526; 10910, NOX1, 55284, 157734, 71-1618; 10910, NOX1, 55287, 157737, 207-1901; 10911, NOX3, 55289, 157739, 104-1810; 10912, NOX4, 55299, 157749, 259-1434; 10912,

NOX4, 55300, 157750, 115-1143; 10912, NOX4, 55302, 157752, 49-1710; 10912, NOX4, 55290, 157740, 240-1976; 10912, NOX4, 55291, 157741, 295-1959; 10912, NOX4, 55292, 157742, 8-689; 10912, NOX4, 55293, 157743, 320-484; 10912, NOX4, 55294, 157744, 120-1784; 10912, NOX4, 55295, 157745, 306-1970; 10912, NOX4, 55296, 157746, 86-1630; 10912, NOX4, 55297, 157747, 1-696; 10912, NOX4, 55298, 157748, 112-786; 10912, NOX4, 55301, 157751, 83-1699; 10913, NOXA1, 55303, 157753, 181-1632; 10913, NOXA1, 55304, 157754, 136-1419; 10914, NOXO1, 55308, 157758, 355-582; 10914, NOXO1, 55305, 157755, 371-1483; 10914, NOXO1, 55306, 157756, 289-1404; 10914, NOXO1, 55307, 157757, 5-1135; 10914, NOXO1, 55309, 157759, 5-1132; 10915, NOX5, 55315, 157765, 1-885; 10915, NOX5, 55310, 157760, 42-2339; 10915, NOX5, 55311, 157761, 302-2461; 10915, NOX5, 55312, 157762, 56-2248; 10915, NOX5, 55313, 157763, 39-2252; 10915, NOX5, 55314, 157764, 302-2545; 10916, NKD1, 55316, 157766, 225-1637; 10917, NKD2, 55317, 157767, 97-1032; 10917, NKD2, 55318, 157768, 230-1585; 10917, NKD2, 55319, 157769, 230-1585; 10917, NKD2, 55320, 157770, 97-1032; 10918, NHS, 55323, 157773, 293-4636; 10918, NHS, 55324, 157774, 931-5346; 10918, NHS, 55321, 157771, 339-5231; 10918, NHS, 55322, 157772, 275-4699; 10919, NANOG, 55327, 157777, 278-836; 10919, NANOG, 55325, 157775, 220-1137; 10919, NANOG, 55326, 157776, 1-870; 10920, NANOGP8, 55328, 157778, 1-870; 10920, NANOGP8, 55329, 157779, 1-918; 10921, NANOGNB, 55330, 157780, 71-637; 10922, NANOS1, 55331, 157781, 1-255; 10922, NANOS1, 55332, 157782, 87-965; 10923, NANOS2, 55333, 157783, 178-594; 10924, NANOS3, 55334, 157784, 3-581; 10924, NANOS3, 55335, 157785, 1-522; 10925, NAPSA, 55337, 157787, 5-810; 10925, NAPSA, 55338, 157788, 210-524; 10925, NAPSA, 55336, 157786, 210-1472; 10926, NRD1, 55340, 157790, 191-3850; 10926, NRD1, 55341, 157791, 1-1615; 10926, NRD1, 55342, 157792, 323-3172; 10926, NRD1, 55343, 157793, 114-3377; 10926, NRD1, 55344, 157794, 96-3542; 10926, NRD1, 55339, 157789, 191-3646; 10927, NACA, 55348, 157798, 39-257; 10927, NACA, 55350, 157800, 279-492; 10927, NACA, 55351, 157801, 97-690; 10927, NACA, 55352, 157802, 312-416; 10927, NACA, 55353, 157803, 283-299; 10927, NACA, 55354, 157804, 319-729; 10927, NACA, 55355, 157805, 333-711; 10927, NACA, 55358, 157808, 1-642; 10927, NACA, 55359, 157809, 78-521; 10927, NACA, 55347, 157797, 283-6519; 10927, NACA, 55357, 157807, 40-2817; 10927, NACA, 55345, 157795, 1938-2585; 10927, NACA, 55346, 157796, 309-956; 10927, NACA, 55349, 157799, 121-768; 10927, NACA, 55356, 157806, 324-971; 10928, NACA2, 55360, 157810, 23-670; 10929, NPPA, 55361, 157811, 293-598; 10929, NPPA, 55363, 157813, 100-558; 10929, NPPA, 55362, 157812, 100-555; 10930, NPPB, 55364, 157814, 99-503; 10931, NPPC, 55365, 157815, 80-460; 10931, NPPC, 55366, 157816, 155-535; 10932, NPR1, 55367, 157817, 473-3658; 10933, NPR2, 55369, 157819, 1-495; 10933, NPR2, 55370, 157820, 1-824; 10933, NPR2, 55371, 157821, 1-229; 10933, NPR2, 55368, 157818, 256-3399; 10934, NPR3, 55374, 157824, 1257-2234; 10934, NPR3, 55376, 157826, 1-265; 10934, NPR3, 55377, 157827, 18-774; 10934, NPR3, 55372, 157822, 344-1969; 10934, NPR3, 55373, 157823, 27-1001; 10934, NPR3, 55375, 157825, 55-1677; 10935, NCR1, 55378, 157828, 39-953; 10935, NCR1, 55379, 157829, 8-871; 10935, NCR1, 55382, 157832, 33-908; 10935, NCR1, 55383, 157833, 26-937; 10935, NCR1, 55385, 157835, 33-678; 10935, NCR1, 55386, 157836, 39-720; 10935, NCR1, 55387, 157837, 33-678; 10935, NCR1, 55388, 157838, 26-707; 10935, NCR1, 55389, 157839, 8-404; 10935, NCR1, 55390, 157840, 33-908; 10935, NCR1, 55392, 157842, 8-689; 10935, NCR1, 55393, 157843, 39-953; 10935, NCR1, 55394, 157844, 39-720; 10935, NCR1, 55395, 157845, 39-902; 10935, NCR1, 55396, 157846, 1-361; 10935, NCR1, 55398, 157848, 8-404; 10935, NCR1, 55400, 157850, 39-902; 10935, NCR1, 55401, 157851, 39-720; 10935, NCR1, 55402, 157852, 39-953; 10935, NCR1, 55403, 157853, 1-594; 10935, NCR1, 55404, 157854, 39-668; 10935, NCR1, 55405, 157855, 39-720; 10935, NCR1, 55406, 157856, 39-902; 10935, NCR1, 55407, 157857, 39-953; 10935, NCR1, 55410, 157860, 1-594; 10935, NCR1, 55411, 157861, 1-361; 10935, NCR1, 55412, 157862, 12-890; 10935, NCR1, 55413, 157863, 39-953; 10935, NCR1, 55414, 157864, 33-678; 10935, NCR1, 55415, 157865, 8-404; 10935, NCR1, 55416, 157866, 39-902; 10935, NCR1, 55417, 157867, 33-678; 10935, NCR1, 55418, 157868, 12-887; 10935, NCR1, 55420, 157870, 8-689; 10935, NCR1, 55421, 157871, 39-902; 10935, NCR1, 55423, 157873, 39-953; 10935, NCR1, 55424, 157874, 1-361; 10935, NCR1, 55426, 157876, 39-720; 10935, NCR1, 55428, 157878, 39-668; 10935, NCR1, 55429, 157879, 39-720; 10935, NCR1, 55430, 157880, 1-594; 10935, NCR1, 55433, 157883, 39-668; 10935, NCR1, 55435, 157885, 1-594; 10935, NCR1, 55437, 157887, 39-668; 10935, NCR1, 55441, 157891, 33-678; 10935, NCR1, 55442, 157892, 26-707; 10935, NCR1, 55443, 157893, 1-594; 10935, NCR1, 55447, 157897, 1-361; 10935, NCR1, 55450, 157900, 39-668; 10935, NCR1, 55452, 157902, 8-404; 10935, NCR1, 55453, 157903, 8-404; 10935, NCR1, 55380, 157830, 8-637; 10935, NCR1, 55381, 157831, 1-594; 10935, NCR1, 55384, 157834, 8-586; 10935, NCR1, 55391, 157841, 39-953; 10935, NCR1, 55397, 157847, 1-594; 10935, NCR1, 55399, 157849, 1-594; 10935, NCR1, 55408, 157858, 39-902; 10935, NCR1, 55409, 157859, 1-594; 10935, NCR1, 55419, 157869, 8-637; 10935, NCR1, 55422, 157872, 26-937; 10935, NCR1, 55425, 157875, 39-953; 10935, NCR1, 55427, 157877, 1-594; 10935, NCR1, 55431, 157881, 39-953; 10935, NCR1, 55432, 157882, 26-937; 10935, NCR1, 55434, 157884, 39-668; 10935, NCR1, 55436, 157886, 8-637; 10935, NCR1, 55438, 157888, 28-942; 10935, NCR1, 55439, 157889, 8-871; 10935, NCR1, 55440, 157890, 8-871; 10935, NCR1, 55444, 157894, 8-871; 10935, NCR1, 55445, 157895, 39-953; 10935, NCR1, 55446, 157896, 39-953; 10935, NCR1, 55448, 157898, 8-637; 10935, NCR1, 55449, 157899, 28-942; 10935, NCR1, 55451, 157901, 8-586; 10936, NCR2, 55454, 157904, 223-999; 10936, NCR2, 55455, 157905, 27-839; 10936, NCR2, 55456, 157906, 89-919; 10937, NCR3, 55489, 157939, 29-376; 10937, NCR3, 55490, 157940, 29-376; 10937, NCR3, 55491, 157941, 29-376; 10937, NCR3, 55492, 157942, 29-376; 10937, NCR3, 55493, 157943, 29-376; 10937, NCR3, 55494, 157944, 29-376; 10937, NCR3, 55495, 157945, 29-376; 10937, NCR3, 55457, 157907, 265-870; 10937, NCR3, 55458, 157908, 29-526; 10937, NCR3, 55459, 157909, 265-837; 10937, NCR3, 55460, 157910, 265-798; 10937, NCR3, 55461, 157911, 265-837; 10937, NCR3, 55462, 157912, 265-870; 10937, NCR3, 55463, 157913, 265-798; 10937, NCR3, 55464, 157914, 29-526; 10937, NCR3, 55465, 157915, 265-870; 10937, NCR3, 55466, 157916, 265-798; 10937, NCR3, 55467, 157917, 265-837; 10937, NCR3, 55468, 157918, 265-870; 10937, NCR3, 55469, 157919, 265-798; 10937, NCR3, 55470, 157920, 265-798; 10937, NCR3, 55471, 157921, 265-870; 10937, NCR3, 55472, 157922, 265-837; 10937, NCR3, 55473, 157923, 265-837; 10937, NCR3, 55474, 157924, 265-837; 10937, NCR3, 55475, 157925, 265-837; 10937, NCR3, 55476, 157926, 265-870; 10937, NCR3, 55477, 157927, 29-526; 10937, NCR3, 55478, 157928, 265-798; 10937, NCR3, 55479, 157929, 29-526; 10937, NCR3, 55480, 157930, 265-798; 10937, NCR3, 55481, 157931, 265-798; 10937, NCR3, 55482, 157932, 29-526; 10937, NCR3, 55483, 157933, 265-837; 10937, NCR3, 55484, 157934, 29-526; 10937, NCR3, 55485, 157935, 29-526; 10937, NCR3, 55486, 157936, 265-870; 10937, NCR3, 55487, 157937, 29-526; 10937, NCR3, 55488, 157938, 265-870; 10938, NCR3LG1, 55496, 157946, 245-1609; 10938, NCR3LG1, 55497, 157947, 72-1436; 10939, NKG7, 55499, 157949, 167-595; 10939, NKG7, 55500, 157950, 106-363; 10939, NKG7, 55501, 157951, 1-268; 10939, NKG7, 55502, 157952, 1-219; 10939, NKG7, 55498, 157948, 181-678; 10940, NKTR, 55504, 157954, 60-377; 10940, NKTR, 55505, 157955, 121-438; 10940, NKTR, 55506, 157956, 247-560; 10940, NKTR, 55507, 157957, 1073-4561; 10940, NKTR, 55503, 157953, 189-4577; 10941, NCBP2-AS2, 55508, 157958, 95-394; 10942, NCK1, 55511, 157961, 41-526; 10942, NCK1, 55512, 157962, 60-581; 10942, NCK1, 55513, 157963, 332-557; 10942, NCK1, 55514, 157964, 201-587; 10942, NCK1, 55515, 157965, 1-422; 10942, NCK1, 55517, 157967, 226-571; 10942, NCK1, 55509, 157959, 131-1264; 10942, NCK1, 55510, 157960, 165-1298; 10942, NCK1, 55516, 157966, 92-1033; 10943, NCK2, 55519, 157969, 358-790; 10943, NCK2, 55521, 157971, 164-494; 10943, NCK2, 55522, 157972, 277-528; 10943, NCK2, 55523, 157973, 70-321; 10943, NCK2, 55518, 157968, 443-1585; 10943, NCK2, 55520, 157970, 133-1275; 10944, NCK-IPSD, 55526, 157976, 1-456; 10944, NCKIPSD, 55527, 157977, 1-803; 10944, NCKIPSD, 55528, 157978, 279-889; 10944, NCKIPSD, 55529, 157979, 29-1214; 10944, NCK-IPSD, 55530, 157980, 121-297; 10944, NCKIPSD, 55531, 157981, 401-897; 10944, NCKIPSD, 55524, 157974, 121-2289; 10944, NCKIPSD, 55525, 157975, 78-2225; 10945, NCKAP1, 55532, 157982, 760-4164; 10945, NCKAP1, 55533, 157983, 374-3760; 10946, NCKAP1L, 55536, 157986, 33-1382; 10946, NCKAP1L, 55534, 157984, 80-3463; 10946, NCKAP1L, 55535, 157985, 101-3334; 10947, NCKAP5, 55537, 157987, 182-388; 10947, NCKAP5, 55538, 157988, 375-6104; 10947, NCKAP5, 55539, 157989, 375-2147; 10947, NCKAP5, 55542, 157992, 1-344; 10947, NCKAP5, 55540, 157990, 378-2150; 10947, NCKAP5, 55541, 157991, 375-6104; 10948, NCKAPSL, 55544, 157994, 1-3013; 10948, NCKAPSL, 55543, 157993, 203-4207; 10949, NDC1, 55545, 157995, 600-2624; 10950, NDC80, 55547, 157997, 1-99; 10950, NDC80, 55548, 157998, 129-553; 10950, NDC80, 55549, 157999, 1-507; 10950, NDC80, 55546, 157996, 183-2111; 10951, NDST1, 55551, 158001, 100-576; 10951, NDST1, 55552, 158002, 590-3067; 10951, NDST1, 55553, 158003, 574-777; 10951, NDST1, 55554, 158004, 701-769; 10951, NDST1, 55550, 158000, 503-3151; 10952, NDST2, 55557, 158007, 1-447; 10952, NDST2, 55555, 158005, 344-2995; 10952, NDST2, 55556, 158006, 558-3209; 10953, NDST3, 55558, 158008, 404-3025; 10954, NDST4, 55559, 158009, 680-3298; 10954, NDST4, 55560, 158010, 406-1515; 10954, NDST4, 55561, 158011, 1817-2926; 10955, NDRG2, 55570, 158020, 93-1163; 10955, NDRG2, 55573, 158023, 1-545; 10955, NDRG2, 55574, 158024, 40-453; 10955, NDRG2, 55575, 158025, 303-578; 10955, NDRG2, 55576, 158026, 138-639; 10955, NDRG2, 55577, 158027, 171-603; 10955, NDRG2, 55578, 158028, 150-609; 10955, NDRG2, 55579, 158029, 40-559; 10955, NDRG2, 55580, 158030, 93-848; 10955, NDRG2, 55581, 158031, 227-580; 10955, NDRG2, 55582, 158032, 1-420; 10955, NDRG2, 55583, 158033, 213-635; 10955, NDRG2, 55584, 158034, 72-440; 10955, NDRG2, 55585, 158035, 426-943; 10955, NDRG2, 55586, 158036, 192-775; 10955, NDRG2, 55587, 158037, 207-871; 10955, NDRG2, 55588, 158038, 273-632; 10955, NDRG2, 55589, 158039, 118-565; 10955, NDRG2, 55590, 158040, 344-1162; 10955, NDRG2, 55591, 158041, 206-669; 10955, NDRG2, 55592, 158042, 144-587; 10955, NDRG2, 55593, 158043, 38-448; 10955, NDRG2, 55594, 158044, 127-495; 10955, NDRG2, 55595, 158045, 144-593; 10955, NDRG2, 55596, 158046, 161-561; 10955, NDRG2, 55597, 158047, 208-531; 10955, NDRG2, 55599, 158049, 192-671; 10955, NDRG2, 55600, 158050, 150-1051; 10955, NDRG2, 55601, 158051, 162-583; 10955, NDRG2, 55604, 158054, 210-443; 10955, NDRG2, 55605, 158055, 1-863; 10955, NDRG2, 55606, 158056, 197-583; 10955, NDRG2, 55607, 158057, 468-1322; 10955, NDRG2, 55608, 158058, 196-578; 10955, NDRG2, 55609, 158059, 184-609; 10955, NDRG2, 55610, 158060, 296-554; 10955, NDRG2, 55611, 158061, 73-595; 10955, NDRG2, 55612, 158062, 249-573; 10955, NDRG2, 55614, 158064, 178-851; 10955, NDRG2, 55615, 158065, 191-571; 10955, NDRG2, 55616, 158066, 194-1012; 10955, NDRG2, 55617, 158067, 118-772; 10955, NDRG2, 55618, 158068, 275-571; 10955, NDRG2, 55619, 158069, 268-924; 10955, NDRG2, 55620, 158070, 186-633; 10955, NDRG2, 55621, 158071, 124-583; 10955, NDRG2, 55622, 158072, 1-672; 10955, NDRG2, 55562, 158012, 13-999; 10955, NDRG2, 55563, 158013, 174-1289; 10955, NDRG2, 55564, 158014, 221-1294; 10955, NDRG2, 55565, 158015, 150-1223; 10955, NDRG2, 55566, 158016, 326-1351; 10955, NDRG2, 55567, 158017, 179-1261; 10955, NDRG2, 55568, 158018, 84-1199; 10955, NDRG2, 55569, 158019, 140-1255; 10955, NDRG2, 55571, 158021, 107-1222; 10955, NDRG2, 55572, 158022, 22-1125; 10955, NDRG2, 55598, 158048, 942-2057; 10955, NDRG2, 55602, 158052, 84-1157; 10955, NDRG2, 55603, 158053, 319-1392; 10955, NDRG2, 55613, 158063, 265-1338; 10956, NDRG3, 55625, 158075, 111-953; 10956, NDRG3, 55626, 158076, 58-1224; 10956, NDRG3, 55627, 158077, 176-736; 10956, NDRG3, 55623, 158073, 83-1210; 10956, NDRG3, 55624, 158074, 72-1163; 10957, NDRG4, 55632, 158082, 109-705; 10957, NDRG4, 55633, 158083, 1-244; 10957, NDRG4, 55634, 158084, 307-558; 10957, NDRG4, 55635, 158085, 107-298; 10957, NDRG4, 55637, 158087, 143-590; 10957, NDRG4, 55638, 158088, 99-533; 10957, NDRG4, 55639, 158089, 89-556; 10957, NDRG4, 55640, 158090, 429-545; 10957, NDRG4, 55641, 158091, 1-573; 10957, NDRG4, 55642, 158092, 118-590; 10957, NDRG4, 55643, 158093, 90-550; 10957, NDRG4, 55644, 158094, 150-610; 10957, NDRG4, 55645, 158095, 232-566; 10957, NDRG4, 55646, 158096, 1-464; 10957, NDRG4, 55647, 158097, 191-313; 10957, NDRG4, 55648, 158098, 107-223; 10957, NDRG4, 55649, 158099, 308-558; 10957, NDRG4, 55650, 158100, 179-697; 10957, NDRG4, 55651, 158101, 107-1090; 10957, NDRG4, 55652, 158102, 134-585; 10957, NDRG4, 55654, 158104, 322-747; 10957, NDRG4, 55655, 158105, 114-311; 10957, NDRG4, 55656, 158106, 255-581; 10957, NDRG4, 55657, 158107, 470-575; 10957, NDRG4, 55658, 158108, 364-1218; 10957, NDRG4, 55659, 158109, 160-590; 10957, NDRG4, 55660, 158110, 233-618; 10957, NDRG4, 55661, 158111, 150-287; 10957, NDRG4, 55663, 158113, 356-549; 10957, NDRG4, 55664, 158114, 508-564; 10957, NDRG4, 55665, 158115, 128-587; 10957, NDRG4, 55628, 158078, 157-1272; 10957, NDRG4, 55629, 158079, 107-1216; 10957, NDRG4, 55630, 158080, 274-1389;

10957, NDRG4, 55631, 158081, 408-1583; 10957, NDRG4, 55636, 158086, 203-1222; 10957, NDRG4, 55653, 158103, 143-1216; 10957, NDRG4, 55662, 158112, 107-1165; 10957, NDRG4, 55666, 158116, 107-1180; 10958, NDUFA4, 55667, 158117, 200-445; 10959, NDUFC2-KCTD14, 55669, 158119, 101-301; 10959, NDUFC2-KCTD14, 55670, 158120, 30-434; 10959, NDUFC2-KCTD14, 55671, 158121, 30-290; 10959, NDUFC2-KCTD14, 55668, 158118, 122-466; 10960, NEBL, 55674, 158124, 282-633; 10960, NEBL, 55675, 158125, 1-346; 10960, NEBL, 55676, 158126, 1-192; 10960, NEBL, 55677, 158127, 1-285; 10960, NEBL, 55672, 158122, 398-3442; 10960, NEBL, 55673, 158123, 355-1167; 10961, NEB, 55679, 158129, 1-1979; 10961, NEB, 55682, 158132, 1-2300; 10961, NEB, 55683, 158133, 1-766; 10961, NEB, 55684, 158134, 1-751; 10961, NEB, 55685, 158135, 1-1201; 10961, NEB, 55686, 158136, 1-9024; 10961, NEB, 55690, 158140, 204-25886; 10961, NEB, 55678, 158128, 204-20213; 10961, NEB, 55680, 158130, 204-25781; 10961, NEB, 55681, 158131, 204-20213; 10961, NEB, 55687, 158137, 204-25781; 10961, NEB, 55688, 158138, 1-25578; 10961, NEB, 55689, 158139, 1-25578; 10962, NRAP, 55693, 158143, 189-5384; 10962, NRAP, 55691, 158141, 246-5438; 10962, NRAP, 55692, 158142, 189-5276; 10962, NRAP, 55694, 158144, 165-5276; 10963, NECAP1, 55697, 158147, 514-863; 10963, NECAP1, 55698, 158148, 8-340; 10963, NECAP1, 55695, 158145, 79-906; 10963, NECAP1, 55696, 158146, 22-330; 10964, NECAP2, 55702, 158152, 7-591; 10964, NECAP2, 55703, 158153, 26-331; 10964, NECAP2, 55704, 158154, 1-191; 10964, NECAP2, 55705, 158155, 42-650; 10964, NECAP2, 55699, 158149, 91-882; 10964, NECAP2, 55700, 158150, 27-848; 10964, NECAP2, 55701, 158151, 39-752; 10964, NECAP2, 55706, 158156, 20-811; 10965, NDN, 55707, 158157, 114-1079; 10966, NDNL2, 55708, 158158, 125-1039; 10966, NDNL2, 55709, 158159, 125-1039; 10967, N4BP1, 55711, 158161, 114-540; 10967, N4BP1, 55710, 158160, 238-2928; 10968, N4BP2, 55713, 158163, 204-724; 10968, N4BP2, 55714, 158164, 330-629; 10968, N4BP2, 55715, 158165, 1-4201; 10968, N4BP2, 55712, 158162, 417-5729; 10969, N4BP2L1, 55716, 158166, 49-231; 10969, N4BP2L1, 55720, 158170, 219-632; 10969, N4BP2L1, 55721, 158171, 1-478; 10969, N4BP2L1, 55722, 158172, 1-238; 10969, N4BP2L1, 55724, 158174, 230-640; 10969, N4BP2L1, 55725, 158175, 49-330; 10969, N4BP2L1, 55726, 158176, 1-499; 10969, N4BP2L1, 55717, 158167, 97-828; 10969, N4BP2L1, 55718, 158168, 52-783; 10969, N4BP2L1, 55719, 158169, 52-573; 10969, N4BP2L1, 55723, 158173, 97-618; 10970, N4BP2L2, 55728, 158178, 199-2412; 10970, N4BP2L2, 55731, 158181, 217-2343; 10970, N4BP2L2, 55732, 158182, 93-2306; 10970, N4BP2L2, 55727, 158177, 166-1917; 10970, N4BP2L2, 55729, 158179, 109-2367; 10970, N4BP2L2, 55730, 158180, 1-1968; 10971, N4BP3, 55733, 158183, 360-1994; 10972, NDFIP1, 55734, 158184, 471-1136; 10973, NDFIP2, 55736, 158186, 34-702; 10973, NDFIP2, 55737, 158187, 30-470; 10973, NDFIP2, 55739, 158189, 13-741; 10973, NDFIP2, 55735, 158185, 53-1063; 10973, NDFIP2, 55738, 158188, 81-1091; 10974, NAE1, 55744, 158194, 61-132; 10974, NAE1, 55745, 158195, 75-401; 10974, NAE1, 55746, 158196, 70-147; 10974, NAE1, 55747, 158197, 78-580; 10974, NAE1, 55748, 158198, 78-272; 10974, NAE1, 55749, 158199, 79-336; 10974, NAE1, 55750, 158200, 200-686; 10974, NAE1, 55751, 158201, 1-390; 10974, NAE1, 55752, 158202, 1-339; 10974, NAE1, 55753, 158203, 357-728; 10974, NAE1, 55740, 158190, 99-1703; 10974, NAE1, 55741, 158191, 78-1691; 10974, NAE1, 55742, 158192, 194-1780; 10974, NAE1, 55743, 158193, 220-1557; 10975, NEDD8-MDP1, 55754, 158204, 86-595; 10975, NEDD8-MDP1, 55755, 158205, 19-222; 10975, NEDD8-MDP1, 55756, 158206, 70-324; 10976, NELFA, 55757, 158207, 225-485; 10976, NELFA, 55758, 158208, 1119-2738; 10976, NELFA, 55759, 158209, 1-1599; 10976, NELFA, 55760, 158210, 14-322; 10976, NELFA, 55761, 158211, 6-888; 10976, NELFA, 55762, 158212, 1-561; 10976, NELFA, 55764, 158214, 1-738; 10976, NELFA, 55765, 158215, 1-376; 10976, NELFA, 55766, 158216, 399-1022; 10976, NELFA, 55767, 158217, 1-198; 10976, NELFA, 55768, 158218, 244-1863; 10976, NELFA, 55763, 158213, 17-1603; 10977, NELFB, 55770, 158220, 204-1946; 10977, NELFB, 55769, 158219, 194-2080; 10978, NELFCD, 55772, 158222, 1-1781; 10978, NELFCD, 55773, 158223, 49-1848; 10978, NELFCD, 55771, 158221, 8-1429; 10979, NELFE, 55779, 158229, 289-765; 10979, NELFE, 55781, 158231, 75-1075; 10979, NELFE, 55782, 158232, 126-847; 10979, NELFE, 55783, 158233, 34-914; 10979, NELFE, 55784, 158234, 289-765; 10979, NELFE, 55786, 158236, 126-847; 10979, NELFE, 55787, 158237, 126-847; 10979, NELFE, 55788, 158238, 126-847; 10979, NELFE, 55789, 158239, 34-914; 10979, NELFE, 55790, 158240, 75-1075; 10979, NELFE, 55791, 158241, 289-765; 10979, NELFE, 55792, 158242, 75-1075; 10979, NELFE, 55794, 158244, 75-1075; 10979, NELFE, 55795, 158245, 75-1075; 10979, NELFE, 55796, 158246, 34-914; 10979, NELFE, 55797, 158247, 289-765; 10979, NELFE, 55798, 158248, 34-914; 10979, NELFE, 55799, 158249, 34-914; 10979, NELFE, 55800, 158250, 34-914; 10979, NELFE, 55801, 158251, 289-765; 10979, NELFE, 55802, 158252, 126-847; 10979, NELFE, 55803, 158253, 289-765; 10979, NELFE, 55804, 158254, 126-906; 10979, NELFE, 55805, 158255, 75-1075; 10979, NELFE, 55806, 158256, 86-259; 10979, NELFE, 55807, 158257, 72-182; 10979, NELFE, 55808, 158258, 1-111; 10979, NELFE, 55809, 158259, 1-111; 10979, NELFE, 55810, 158260, 1-111; 10979, NELFE, 55811, 158261, 1-111; 10979, NELFE, 55812, 158262, 1-111; 10979, NELFE, 55813, 158263, 1-111; 10979, NELFE, 55774, 158224, 170-1333; 10979, NELFE, 55775, 158225, 228-1370; 10979, NELFE, 55776, 158226, 210-1352; 10979, NELFE, 55777, 158227, 210-1352; 10979, NELFE, 55778, 158228, 78-1130; 10979, NELFE, 55780, 158230, 210-1352; 10979, NELFE, 55785, 158235, 210-1352; 10979, NELFE, 55793, 158243, 210-1352; 10980, NRROS, 55814, 158264, 204-2282; 10981, NUB1, 55815, 158265, 79-1956; 10981, NUB1, 55816, 158266, 157-619; 10981, NUB1, 55817, 158267, 1-385; 10981, NUB1, 55818, 158268, 6-455; 10981, NUB1, 55819, 158269, 6-767; 10981, NUB1, 55820, 158270, 1-608; 10981, NUB1, 55821, 158271, 46-849; 10981, NUB1, 55822, 158272, 67-1986; 10982, NBR1, 55824, 158274, 111-2624; 10982, NBR1, 55825, 158275, 460-586; 10982, NBR1, 55823, 158273, 141-3041; 10982, NBR1, 55826, 158276, 99-2999; 10982, NBR1, 55827, 158277, 70-2883; 10983, NEIL1, 55829, 158279, 69-532; 10983, NEIL1, 55830, 158280, 469-587; 10983, NEIL1, 55832, 158282, 308-572; 10983, NEIL1, 55833, 158283, 227-780; 10983, NEIL1, 55834, 158284, 518-583; 10983, NEIL1, 55835, 158285, 163-558; 10983, NEIL1, 55836, 158286, 114-572; 10983, NEIL1, 55837, 158287, 236-833; 10983, NEIL1, 55838, 158288, 408-559; 10983, NEIL1, 55840, 158290, 348-593; 10983, NEIL1, 55841, 158291, 392-584; 10983, NEIL1, 55828, 158278, 507-1679; 10983, NEIL1, 55831, 158281, 412-1584; 10983, NEIL1, 55839, 158289, 630-1802; 10984, NEIL2, 55847, 158297, 85-267; 10984, NEIL2, 55842, 158292, 600-1598;

10984, NEIL2, 55843, 158293, 129-944; 10984, NEIL2, 55844, 158294, 156-1154; 10984, NEIL2, 55845, 158295, 258-1256; 10984, NEIL2, 55846, 158296, 247-897; 10985, NEIL3, 55849, 158299, 52-243; 10985, NEIL3, 55848, 158298, 119-1936; 10986, NLK, 55851, 158301, 1-1428; 10986, NLK, 55852, 158302, 36-581; 10986, NLK, 55850, 158300, 719-2302; 10987, NEO1, 55857, 158307, 1-3393; 10987, NEO1, 55853, 158303, 193-4578; 10987, NEO1, 55854, 158304, 448-4833; 10987, NEO1, 55855, 158305, 67-4419; 10987, NEO1, 55856, 158306, 67-4293; 10988, NOV, 55858, 158308, 228-1301; 10989, NPNT, 55863, 158313, 1-313; 10989, NPNT, 55866, 158316, 1-1829; 10989, NPNT, 55867, 158317, 1-80; 10989, NPNT, 55868, 158318, 360-543; 10989, NPNT, 55869, 158319, 1-1360; 10989, NPNT, 55859, 158309, 203-1732; 10989, NPNT, 55860, 158310, 217-1914; 10989, NPNT, 55861, 158311, 213-2000; 10989, NPNT, 55862, 158312, 214-1962; 10989, NPNT, 55864, 158314, 213-1823; 10989, NPNT, 55865, 158315, 161-1861; 10990, NPHP1, 55874, 158324, 1-143; 10990, NPHP1, 55875, 158325, 28-2163; 10990, NPHP1, 55876, 158326, 1-137; 10990, NPHP1, 55877, 158327, 32-397; 10990, NPHP1, 55870, 158320, 75-2276; 10990, NPHP1, 55871, 158321, 5-1849; 10990, NPHP1, 55872, 158322, 99-2297; 10990, NPHP1, 55873, 158323, 25-2058; 10991, NPHP3, 55879, 158329, 1-372; 10991, NPHP3, 55880, 158330, 50-1666; 10991, NPHP3, 55881, 158331, 1-264; 10991, NPHP3, 55878, 158328, 88-4080; 10992, NPHP4, 55883, 158333, 243-1031; 10992, NPHP4, 55885, 158335, 1-415; 10992, NPHP4, 55882, 158332, 267-4547; 10992, NPHP4, 55884, 158334, 269-3004; 10992, NPHP4, 55886, 158336, 269-3004; 10993, NPHS1, 55887, 158337, 2-3607; 10993, NPHS1, 55888, 158338, 1-3726; 10994, NPHS2, 55889, 158339, 70-1221; 10994, NPHS2, 55890, 158340, 89-1036; 10995, NGF, 55891, 158341, 170-895; 10996, NGFR, 55893, 158343, 691-703; 10996, NGFR, 55892, 158342, 126-1409; 10996, NGFR, 55894, 158344, 476-1477; 10997, NGFRAP1, 55895, 158345, 366-671; 10997, NGFRAP1, 55896, 158346, 204-509; 10997, NGFRAP1, 55897, 158347, 237-572; 10997, NGFRAP1, 55898, 158348, 328-663; 10998, NHLH1, 55899, 158349, 447-848; 10999, NHLH2, 55902, 158352, 535-855; 10999, NHLH2, 55900, 158350, 517-924; 10999, NHLH2, 55901, 158351, 5546-5953; 11000, NES, 55903, 158353, 134-4999; 11001, NSF, 55905, 158355, 86-569; 11001, NSF, 55906, 158356, 212-2431; 11001, NSF, 55907, 158357, 303-710; 11001, NSF, 55908, 158358, 231-364; 11001, NSF, 55909, 158359, 22-267; 11001, NSF, 55910, 158360, 1-542; 11001, NSF, 55913, 158363, 212-2431; 11001, NSF, 55914, 158364, 303-710; 11001, NSF, 55915, 158365, 86-569; 11001, NSF, 55916, 158366, 231-364; 11001, NSF, 55917, 158367, 22-267; 11001, NSF, 55918, 158368, 1-542; 11001, NSF, 55919, 158369, 231-364; 11001, NSF, 55920, 158370, 212-2431; 11001, NSF, 55921, 158371, 86-569; 11001, NSF, 55922, 158372, 1-542; 11001, NSF, 55923, 158373, 22-267; 11001, NSF, 55904, 158354, 108-2342; 11001, NSF, 55911, 158361, 108-2342; 11001, NSF, 55912, 158362, 108-2342; 11002, NAPA, 55925, 158375, 119-226; 11002, NAPA, 55926, 158376, 104-286; 11002, NAPA, 55927, 158377, 72-379; 11002, NAPA, 55928, 158378, 152-376; 11002, NAPA, 55929, 158379, 143-553; 11002, NAPA, 55930, 158380, 1-416; 11002, NAPA, 55931, 158381, 81-851; 11002, NAPA, 55932, 158382, 1-252; 11002, NAPA, 55933, 158383, 87-891; 11002, NAPA, 55924, 158374, 301-1188; 11003, NAPB, 55937, 158387, 118-1026; 11003, NAPB, 55934, 158384, 87-983; 11003, NAPB, 55935, 158385, 353-967; 11003, NAPB, 55936, 158386, 118-897; 11004, NAPG, 55939, 158389, 164-694; 11004, NAPG, 55940, 158390, 75-143; 11004, NAPG, 55941, 158391, 199-255; 11004, NAPG, 55938, 158388, 70-1008; 11005, NTN1, 55943, 158393, 1-462; 11005, NTN1, 55942, 158392, 108-1922; 11006, NTN3, 55944, 158394, 204-1946; 11007, NTN4, 55949, 158399, 220-749; 11007, NTN4, 55945, 158395, 98-1873; 11007, NTN4, 55946, 158396, 450-2336; 11007, NTN4, 55947, 158397, 98-1873; 11007, NTN4, 55948, 158398, 1-1818; 11008, NTN5, 55951, 158401, 477-701; 11008, NTN5, 55950, 158400, 97-1566; 11009, NTNG1, 55952, 158402, 1-1485; 11009, NTNG1, 55953, 158403, 1-1443; 11009, NTNG1, 55954, 158404, 628-2010; 11009, NTNG1, 55955, 158405, 847-2466; 11009, NTNG1, 55956, 158406, 719-2161; 11009, NTNG1, 55957, 158407, 719-2338; 11009, NTNG1, 55958, 158408, 719-2035; 11010, NTNG2, 55959, 158409, 335-1603; 11010, NTNG2, 55960, 158410, 777-2369; 11011, NENF, 55961, 158411, 58-576; 11012, NGRN, 55963, 158413, 1-72; 11012, NGRN, 55962, 158412, 9-884; 11013, NCAM1, 55965, 158415, 246-2423; 11013, NCAM1, 55966, 158416, 1-498; 11013, NCAM1, 55967, 158417, 367-2652; 11013, NCAM1, 55968, 158418, 367-2913; 11013, NCAM1, 55969, 158419, 1-253; 11013, NCAM1, 55970, 158420, 367-3021; 11013, NCAM1, 55971, 158421, 212-610; 11013, NCAM1, 55972, 158422, 1-918; 11013, NCAM1, 55973, 158423, 339-2993; 11013, NCAM1, 55974, 158424, 1-1118; 11013, NCAM1, 55976, 158426, 367-2943; 11013, NCAM1, 55979, 158429, 179-585; 11013, NCAM1, 55980, 158430, 1-686; 11013, NCAM1, 55982, 158432, 1-1405; 11013, NCAM1, 55983, 158433, 1-1072; 11013, NCAM1, 55964, 158414, 212-2788; 11013, NCAM1, 55975, 158425, 134-2419; 11013, NCAM1, 55977, 158427, 246-2426; 11013, NCAM1, 55978, 158428, 177-1271; 11013, NCAM1, 55981, 158431, 178-2724; 11014, NCAM2, 55984, 158434, 2-2461; 11014, NCAM2, 55985, 158435, 250-2763; 11015, NELL1, 55986, 158436, 154-2670; 11015, NELL1, 55987, 158437, 174-2435; 11015, NELL1, 55990, 158440, 602-2314; 11015, NELL1, 55988, 158438, 153-2585; 11015, NELL1, 55989, 158439, 64-2355; 11016, NELL2, 55996, 158446, 434-500; 11016, NELL2, 55997, 158447, 91-1053; 11016, NELL2, 55998, 158448, 70-569; 11016, NELL2, 56000, 158450, 1-259; 11016, NELL2, 56001, 158451, 1-736; 11016, NELL2, 56002, 158452, 148-486; 11016, NELL2, 56003, 158453, 255-586; 11016, NELL2, 56004, 158454, 190-2496; 11016, NELL2, 56005, 158455, 1-369; 11016, NELL2, 55991, 158441, 93-2612; 11016, NELL2, 55992, 158442, 97-2544; 11016, NELL2, 55993, 158443, 506-2956; 11016, NELL2, 55994, 158444, 94-2544; 11016, NELL2, 55995, 158445, 373-2973; 11016, NELL2, 55999, 158449, 190-2637; 11017, NEDD1, 56010, 158460, 253-554; 11017, NEDD1, 56011, 158461, 126-371; 11017, NEDD1, 56012, 158462, 80-582; 11017, NEDD1, 56014, 158464, 102-581; 11017, NEDD1, 56015, 158465, 102-595; 11017, NEDD1, 56006, 158456, 340-2322; 11017, NEDD1, 56007, 158457, 86-2068; 11017, NEDD1, 56008, 158458, 279-1994; 11017, NEDD1, 56009, 158459, 353-2068; 11017, NEDD1, 56013, 158463, 147-2150; 11018, NEDD4, 56018, 158468, 1-106; 11018, NEDD4, 56019, 158469, 1-2732; 11018, NEDD4, 56021, 158471, 1-119; 11018, NEDD4, 56023, 158473, 1-1204; 11018, NEDD4, 56016, 158466, 301-4044; 11018, NEDD4, 56017, 158467, 192-2894; 11018, NEDD4, 56020, 158470, 278-4189; 11018, NEDD4, 56022, 158472, 301-4260; 11019, NEDD4L, 56033, 158483, 278-598; 11019, NEDD4L, 56034, 158484, 453-484; 11019, NEDD4L, 56035, 158485, 401-505; 11019, NEDD4L, 56036, 158486, 381-830; 11019, NEDD4L, 56037, 158487, 507-553; 11019, NEDD4L, 56038, 158488, 1-1920; 11019, NEDD4L, 56040, 158490, 275-337; 11019, NEDD4L, 56024, 158474, 1-2616; 11019, NEDD4L, 56025, 158475, 295-3030; 11019, NEDD4L, 56026, 158476, 204-3107; 11019, NEDD4L, 56027, 158477, 114-2981; 11019, NEDD4L, 56028, 158478, 284-3211; 11019, NEDD4L, 56029, 158479, 465-3029; 11019, NEDD4L, 56030, 158480, 631-3135; 11019, NEDD4L, 56031, 158481, 586-3090; 11019, NEDD4L, 56032, 158482, 601-3165; 11019, NEDD4L, 56039, 158489, 200-3043; 11020, NEDD8, 56042, 158492, 37-189; 11020, NEDD8, 56043, 158493, 88-240; 11020, NEDD8, 56041, 158491, 188-433; 11021, NEDD9, 56046, 158496, 375-470; 11021, NEDD9, 56047, 158497, 329-460; 11021, NEDD9, 56048, 158498, 499-587; 11021, NEDD9, 56050, 158500, 516-581; 11021, NEDD9, 56051, 158501, 168-2225; 11021, NEDD9, 56044, 158494, 144-668; 11021, NEDD9, 56045, 158495, 168-2672; 11021, NEDD9, 56049, 158499, 363-2867; 11022, NPDC1, 56052, 158502, 674-1885; 11022, NPDC1, 56054, 158504, 1-86; 11022, NPDC1, 56053, 158503, 215-1192; 11023, NRL, 56060, 158510, 543-737; 11023, NRL, 56055, 158505, 286-582; 11023, NRL, 56056, 158506, 445-1158; 11023, NRL, 56057, 158507, 134-847; 11023, NRL, 56058, 158508, 256-552; 11023, NRL, 56059, 158509, 321-1034; 11024, NEURL1, 56062, 158512, 305-628; 11024, NEURL1, 56063, 158513, 149-746; 11024, NEURL1, 56061, 158511, 410-2134; 11025, NEURL1B, 56064, 158514, 142-1809; 11025, NEURL1B, 56065, 158515, 142-1089; 11025, NEURL1B, 56066, 158516, 142-1263; 11026, NEURL2, 56068, 158518, 1-271; 11026, NEURL2, 56067, 158517, 297-1154; 11027, NEURL3, 56070, 158520, 713-1099; 11027, NEURL3, 56071, 158521, 763-1077; 11027, NEURL3, 56069, 158519, 72-860; 11028, NEURL4, 56074, 158524, 1-4291; 11028, NEURL4, 56075, 158525, 82-4698; 11028, NEURL4, 56076, 158526, 1-3054; 11028, NEURL4, 56077, 158527, 1-750; 11028, NEURL4, 56072, 158522, 5-4687; 11028, NEURL4, 56073, 158523, 17-4705; 11029, NRG1, 56081, 158531, 159-563; 11029, NRG1, 56082, 158532, 251-555; 11029, NRG1, 56084, 158534, 1-2142; 11029, NRG1, 56086, 158536, 10-1453; 11029, NRG1, 56088, 158538, 185-570; 11029, NRG1, 56089, 158539, 1-380; 11029, NRG1, 56091, 158541, 1-591; 11029, NRG1, 56093, 158543, 171-1097; 11029, NRG1, 56094, 158544, 1-762; 11029, NRG1, 56095, 158545, 44-623; 11029, NRG1, 56078, 158528, 93-2030; 11029, NRG1, 56079, 158529, 461-2374; 11029, NRG1, 56080, 158530, 1-1923; 11029, NRG1, 56083, 158533, 109-1497; 11029, NRG1, 56085, 158535, 10-1782; 11029, NRG1, 56087, 158537, 518-1780; 11029, NRG1, 56090, 158540, 1-891; 11029, NRG1, 56092, 158542, 231-1499; 11030, NRG2, 56102, 158552, 231-2585; 11030, NRG2, 56096, 158546, 1-2535; 11030, NRG2, 56097, 158547, 79-2655; 11030, NRG2, 56098, 158548, 1-1944; 11030, NRG2, 56099, 158549, 1-2559; 11030, NRG2, 56100, 158550, 226-2778; 11030, NRG2, 56101, 158551, 1-1281; 11031, NRG3, 56106, 158556, 1-1503; 11031, NRG3, 56107, 158557, 134-1174; 11031, NRG3, 56108, 158558, 99-1139; 11031, NRG3, 56109, 158559, 1-1581; 11031, NRG3, 56110, 158560, 1-231; 11031, NRG3, 56111, 158561, 65-229; 11031, NRG3, 56103, 158553, 28-2118; 11031, NRG3, 56104, 158554, 275-1774; 11031, NRG3, 56105, 158555, 1-2163; 11032, NRG4, 56113, 158563, 178-285; 11032, NRG4, 56114, 158564, 260-370; 11032, NRG4, 56115, 158565, 116-226; 11032, NRG4, 56116, 158566, 189-299; 11032, NRG4, 56117, 158567, 469-799; 11032, NRG4, 56118, 158568, 161-433; 11032, NRG4, 56119, 158569, 133-243; 11032, NRG4, 56120, 158570, 58-168; 11032, NRG4, 56122, 158572, 472-582; 11032, NRG4, 56123, 158573, 336-443; 11032, NRG4, 56112, 158562, 183-530; 11032, NRG4, 56121, 158571, 121-468; 11033, NRSN1, 56124, 158574, 12-452; 11033, NRSN1, 56125, 158575, 184-701; 11033, NRSN1, 56126, 158576, 238-825; 11033, NRSN1, 56127, 158577, 302-889; 11034, NRSN2, 56130, 158580, 1-209; 11034, NRSN2, 56131, 158581, 215-697; 11034, NRSN2, 56132, 158582, 238-578; 11034, NRSN2, 56133, 158583, 122-370; 11034, NRSN2, 56134, 158584, 233-582; 11034, NRSN2, 56135, 158585, 145-342; 11034, NRSN2, 56128, 158578, 239-853; 11034, NRSN2, 56129, 158579, 241-855; 11034, NRSN2, 56136, 158586, 12-626; 11035, NRXN1, 56138, 158588, 204-632; 11035, NRXN1, 56140, 158590, 1142-5665; 11035, NRXN1, 56142, 158592, 1062-1898; 11035, NRXN1, 56143, 158593, 1-2508; 11035, NRXN1, 56144, 158594, 818-2236; 11035, NRXN1, 56145, 158595, 1-2553; 11035, NRXN1, 56146, 158596, 200-619; 11035, NRXN1, 56147, 158597, 1056-5543; 11035, NRXN1, 56148, 158598, 959-1555; 11035, NRXN1, 56149, 158599, 1-264; 11035, NRXN1, 56150, 158600, 848-2257; 11035, NRXN1, 56151, 158601, 184-4674; 11035, NRXN1, 56152, 158602, 1478-2311; 11035, NRXN1, 56153, 158603, 1-506; 11035, NRXN1, 56154, 158604, 1-641; 11035, NRXN1, 56155, 158605, 1093-2472; 11035, NRXN1, 56157, 158607, 409-636; 11035, NRXN1, 56158, 158608, 1-380; 11035, NRXN1, 56159, 158609, 1-411; 11035, NRXN1, 56160, 158610, 23-553; 11035, NRXN1, 56161, 158611, 156-344; 11035, NRXN1, 56162, 158612, 27-2738; 11035, NRXN1, 56137, 158587, 806-2134; 11035, NRXN1, 56139, 158589, 1503-5936; 11035, NRXN1, 56141, 158591, 1341-5984; 11035, NRXN1, 56156, 158606, 1-4500; 11036, NRXN2, 56167, 158617, 245-5362; 11036, NRXN2, 56168, 158618, 1-878; 11036, NRXN2, 56169, 158619, 1-828; 11036, NRXN2, 56170, 158620, 1-618; 11036, NRXN2, 56171, 158621, 1-643; 11036, NRXN2, 56164, 158614, 513-2513; 11036, NRXN2, 56163, 158613, 463-5601; 11036, NRXN2, 56165, 158615, 213-5351; 11036, NRXN2, 56166, 158616, 463-5391; 11037, NRXN3, 56173, 158623, 62-2701; 11037, NRXN3, 56175, 158625, 193-551; 11037, NRXN3, 56177, 158627, 30-1226; 11037, NRXN3, 56180, 158630, 1-523; 11037, NRXN3, 56181, 158631, 285-509; 11037, NRXN3, 56182, 158632, 1006-6000; 11037, NRXN3, 56183, 158633, 58-4773; 11037, NRXN3, 56172, 158622, 880-2178; 11037, NRXN3, 56174, 158624, 387-1766; 11037, NRXN3, 56179, 158629, 954-2867; 11037, NRXN3, 56176, 158626, 704-4882; 11037, NRXN3, 56178, 158628, 492-3677; 11038, NXPH1, 56185, 158635, 151-568; 11038, NXPH1, 56186, 158636, 520-949; 11038, NXPH1, 56187, 158637, 2-763; 11038, NXPH1, 56184, 158634, 912-1727; 11039, NXPH2, 56188, 158638, 108-902; 11040, NXPH3, 56190, 158640, 99-1163; 11040, NXPH3, 56189, 158639, 363-1121; 11041, NXPH4, 56192, 158642, 142-252; 11041, NXPH4, 56191, 158641, 176-1102; 11042, NXPE1, 56195, 158645, 309-495; 11042, NXPE1, 56196, 158646, 179-543; 11042, NXPE1, 56197, 158647, 894-1781; 11042, NXPE1, 56198, 158648, 1245-2036; 11042, NXPE1, 56193, 158643, 418-1635; 11042, NXPE1, 56194, 158644, 1-1644; 11043, NXPE2, 56199, 158649, 191-1870; 11044, NXPE3, 56204, 158654, 788-797; 11044, NXPE3, 56205, 158655, 778-936; 11044, NXPE3, 56206, 158656, 147-416; 11044, NXPE3, 56200, 158650, 593-2272; 11044, NXPE3, 56201, 158651, 198-1877; 11044, NXPE3, 56202, 158652, 957-2636; 11044, NXPE3, 56203, 158653, 902-2581; 11045, NXPE4, 56207, 158657, 182-1816; 11045, NXPE4, 56208, 158658, 558-1340; 11046, NRN1, 56210, 158660, 315-821; 11046, NRN1, 56209, 158659, 219-647; 11046, NRN1, 56211, 158661, 154-582; 11047, NRN1L, 56213, 158663, 1-266;

11047, NRN1L, 56214, 158664, 295-558; 11047, NRN1L, 56212, 158662, 100-597; 11048, NBEA, 56215, 158665, 207-9050; 11048, NBEA, 56217, 158667, 162-8993; 11048, NBEA, 56220, 158670, 207-9047; 11048, NBEA, 56216, 158666, 476-2050; 11048, NBEA, 56218, 158668, 535-9375; 11048, NBEA, 56219, 158669, 126-2345; 11049, NBEAL1, 56221, 158671, 1-2130; 11049, NBEAL1, 56223, 158673, 1-692; 11049, NBEAL1, 56222, 158672, 334-8418; 11050, NBEAL2, 56224, 158674, 1-324; 11050, NBEAL2, 56225, 158675, 1-6128; 11050, NBEAL2, 56226, 158676, 1-3280; 11050, NBEAL2, 56228, 158678, 1-765; 11050, NBEAL2, 56227, 158677, 180-8444; 11051, NBL1, 56231, 158681, 237-622; 11051, NBL1, 56232, 158682, 186-570; 11051, NBL1, 56233, 158683, 84-573; 11051, NBL1, 56234, 158684, 261-588; 11051, NBL1, 56235, 158685, 179-528; 11051, NBL1, 56236, 158686, 196-546; 11051, NBL1, 56238, 158688, 186-833; 11051, NBL1, 56229, 158679, 81-731; 11051, NBL1, 56230, 158680, 304-849; 11051, NBL1, 56237, 158687, 81-626; 11051, NBL1, 56239, 158689, 261-806; 11051, NBL1, 56240, 158690, 237-782; 11051, NBL1, 56241, 158691, 179-724; 11052, NBAS, 56243, 158693, 1-555; 11052, NBAS, 56244, 158694, 1-613; 11052, NBAS, 56245, 158695, 1-516; 11052, NBAS, 56246, 158696, 1-844; 11052, NBAS, 56247, 158697, 1-4259; 11052, NBAS, 56248, 158698, 1-302; 11052, NBAS, 56249, 158699, 1-414; 11052, NBAS, 56242, 158692, 27-7142; 11053, NBPF1, 56250, 158700, 889-4176; 11053, NBPF1, 56251, 158701, 459-674; 11053, NBPF1, 56252, 158702, 889-4308; 11054, NBPF10, 56253, 158703, 36-11423; 11054, NBPF10, 56254, 158704, 72-1805; 11054, NBPF10, 56255, 158705, 18-2783; 11054, NBPF10, 56256, 158706, 7911-11630; 11054, NBPF10, 56257, 158707, 77-2905; 11054, NBPF10, 56258, 158708, 72-2675; 11054, NBPF10, 56259, 158709, 72-1679; 11055, NBPF11, 56260, 158710, 3039-3842; 11055, NBPF11, 56262, 158712, 664-2973; 11055, NBPF11, 56263, 158713, 959-2584; 11055, NBPF11, 56264, 158714, 1-2493; 11055, NBPF11, 56261, 158711, 1152-3749; 11055, NBPF11, 56265, 158715, 184-2781; 11056, NBPF12, 56266, 158716, 72-1805; 11056, NBPF12, 56267, 158717, 77-3412; 11056, NBPF12, 56268, 158718, 1061-5434; 11056, NBPF12, 56269, 158719, 184-2781; 11056, NBPF12, 56270, 158720, 72-2675; 11056, NBPF12, 56271, 158721, 435-4076; 11056, NBPF12, 56272, 158722, 174-1073; 11056, NBPF12, 56273, 158723, 435-4808; 11057, NBPF14, 56274, 158724, 77-2905; 11057, NBPF14, 56275, 158725, 288-1037; 11057, NBPF14, 56276, 158726, 1140-1370; 11057, NBPF14, 56277, 158727, 174-1073; 11057, NBPF14, 56278, 158728, 18-2783; 11057, NBPF14, 56279, 158729, 72-1679; 11057, NBPF14, 56280, 158730, 174-1073; 11057, NBPF14, 56281, 158731, 72-1805; 11057, NBPF14, 56282, 158732, 193-9159; 11057, NBPF14, 56283, 158733, 72-2675; 11057, NBPF14, 56284, 158734, 1-8460; 11058, NBPF15, 56285, 158735, 1068-3080; 11058, NBPF15, 56286, 158736, 633-2645; 11058, NBPF15, 56287, 158737, 900-2912; 11059, NBPF19, 56288, 158738, 18-2783; 11059, NBPF19, 56289, 158739, 447-1157; 11059, NBPF19, 56290, 158740, 1271-12802; 11059, NBPF19, 56291, 158741, 1-900; 11059, NBPF19, 56292, 158742, 174-1073; 11059, NBPF19, 56293, 158743, 1-705; 11060, NBPF20, 56294, 158744, 194-17134; 11060, NBPF20, 56295, 158745, 18-2783; 11060, NBPF20, 56296, 158746, 174-1073; 11060, NBPF20, 56297, 158747, 1201-16824; 11060, NBPF20, 56298, 158748, 18-2783; 11061, NBPF26, 56299, 158749, 18-2783; 11061, NBPF26, 56300, 158750, 72-1679; 11061, NBPF26, 56301, 158751, 72-1805; 11061, NBPF26, 56302, 158752, 174-1073; 11061, NBPF26, 56303, 158753, 77-2905; 11061, NBPF26, 56304, 158754, 1-3561; 11061, NBPF26, 56305, 158755, 1091-2899; 11061, NBPF26, 56306, 158756, 72-2675; 11062, NBPF3, 56307, 158757, 352-513; 11062, NBPF3, 56310, 158760, 144-305; 11062, NBPF3, 56312, 158762, 251-412; 11062, NBPF3, 56313, 158763, 96-236; 11062, NBPF3, 56308, 158758, 176-2077; 11062, NBPF3, 56309, 158759, 325-2190; 11062, NBPF3, 56311, 158761, 361-2052; 11062, NBPF3, 56314, 158764, 72-1805; 11063, NBPF4, 56316, 158766, 219-2222; 11063, NBPF4, 56315, 158765, 205-2121; 11064, NBPF6, 56321, 158771, 180-1897; 11064, NBPF6, 56317, 158767, 1-1917; 11064, NBPF6, 56318, 158768, 219-2222; 11064, NBPF6, 56319, 158769, 219-2135; 11064, NBPF6, 56320, 158770, 214-2130; 11065, NBPF9, 56322, 158772, 76-3411; 11065, NBPF9, 56323, 158773, 871-4206; 11065, NBPF9, 56324, 158774, 76-2679; 11065, NBPF9, 56325, 158775, 76-2904; 11065, NBPF9, 56326, 158776, 173-3001; 11065, NBPF9, 56327, 158777, 1169-4114; 11065, NBPF9, 56328, 158778, 38-937; 11065, NBPF9, 56329, 158779, 76-2904; 11066, NRAS, 56330, 158780, 255-824; 11067, NCALD, 56334, 158784, 327-548; 11067, NCALD, 56336, 158786, 306-549; 11067, NCALD, 56337, 158787, 249-583; 11067, NCALD, 56338, 158788, 226-562; 11067, NCALD, 56339, 158789, 136-720; 11067, NCALD, 56340, 158790, 498-540; 11067, NCALD, 56341, 158791, 315-629; 11067, NCALD, 56342, 158792, 140-548; 11067, NCALD, 56343, 158793, 429-585; 11067, NCALD, 56344, 158794, 535-543; 11067, NCALD, 56345, 158795, 128-583; 11067, NCALD, 56346, 158796, 238-553; 11067, NCALD, 56347, 158797, 221-570; 11067, NCALD, 56348, 158798, 305-565; 11067, NCALD, 56349, 158799, 256-488; 11067, NCALD, 56351, 158801, 282-538; 11067, NCALD, 56352, 158802, 506-552; 11067, NCALD, 56353, 158803, 210-574; 11067, NCALD, 56354, 158804, 221-580; 11067, NCALD, 56331, 158781, 120-701; 11067, NCALD, 56332, 158782, 308-889; 11067, NCALD, 56333, 158783, 461-1042; 11067, NCALD, 56335, 158785, 294-875; 11067, NCALD, 56350, 158800, 20-601; 11068, NCAN, 56356, 158806, 1-527; 11068, NCAN, 56355, 158805, 100-4065; 11069, NCDN, 56360, 158810, 199-930; 11069, NCDN, 56361, 158811, 1-581; 11069, NCDN, 56357, 158807, 128-2317; 11069, NCDN, 56358, 158808, 384-2573; 11069, NCDN, 56359, 158809, 430-2568; 11070, NET1, 56364, 158814, 158-637; 11070, NET1, 56362, 158812, 143-1933; 11070, NET1, 56363, 158813, 156-1784; 11071, NFASC, 56367, 158817, 1-3125; 11071, NFASC, 56372, 158822, 1-709; 11071, NFASC, 56373, 158823, 1-896; 11071, NFASC, 56374, 158824, 1-3498; 11071, NFASC, 56375, 158825, 1-657; 11071, NFASC, 56376, 158826, 66-1526; 11071, NFASC, 56378, 158828, 185-573; 11071, NFASC, 56365, 158815, 329-4051; 11071, NFASC, 56366, 158816, 329-3838; 11071, NFASC, 56368, 158818, 91-3615; 11071, NFASC, 56369, 158819, 288-2147; 11071, NFASC, 56370, 158820, 200-3922; 11071, NFASC, 56371, 158821, 423-3896; 11071, NFASC, 56377, 158827, 66-3575; 11071, NFASC, 56379, 158829, 329-3853; 11072, NF1, 56382, 158832, 1-7509; 11072, NF1, 56384, 158834, 1-619; 11072, NF1, 56385, 158835, 1-4971; 11072, NF1, 56386, 158836, 1-619; 11072, NF1, 56387, 158837, 1-374; 11072, NF1, 56388, 158838, 1-682; 11072, NF1, 56389, 158839, 1-1921; 11072, NF1, 56390, 158840, 1-347; 11072, NF1, 56391, 158841, 1-41; 11072, NF1, 56392, 158842, 1-244; 11072, NF1, 56393, 158843, 192-543; 11072, NF1, 56380, 158830, 384-8840; 11072, NF1, 56381, 158831, 384-8903; 11072, NF1, 56383, 158833, 334-2115; 11073, NF2, 56394, 158844, 273-1796; 11073, NF2, 56395, 158845, 253-1776;

11073, NF2, 56396, 158846, 442-2229; 11073, NF2, 56397, 158847, 1-1773; 11073, NF2, 56398, 158848, 383-2032; 11073, NF2, 56399, 158849, 1-1647; 11073, NF2, 56400, 158850, 1-1773; 11073, NF2, 56401, 158851, 412-2097; 11073, NF2, 56402, 158852, 367-2139; 11073, NF2, 56403, 158853, 51-713; 11073, NF2, 56404, 158854, 444-941; 11074, NEFH, 56405, 158855, 34-3096; 11075, NEFL, 56407, 158857, 98-952; 11075, NEFL, 56406, 158856, 596-2227; 11076, NEFM, 56409, 158859, 31-2664; 11076, NEFM, 56411, 158861, 34-2130; 11076, NEFM, 56408, 158858, 783-3533; 11076, NEFM, 56410, 158860, 405-2027; 11077, NEUROG1, 56412, 158862, 260-973; 11078, NEUROG2, 56413, 158863, 328-1146; 11079, NEUROG3, 56414, 158864, 31-675; 11080, NGB, 56415, 158865, 376-831; 11081, NRGN, 56416, 158866, 240-476; 11081, NRGN, 56417, 158867, 41-277; 11082, NGDN, 56420, 158870, 1-790; 11082, NGDN, 56421, 158871, 362-786; 11082, NGDN, 56422, 158872, 1-225; 11082, NGDN, 56418, 158868, 14-949; 11082, NGDN, 56419, 158869, 29-976; 11083, NLGN1, 56424, 158874, 1-1827; 11083, NLGN1, 56426, 158876, 605-635; 11083, NLGN1, 56427, 158877, 733-771; 11083, NLGN1, 56428, 158878, 436-1536; 11083, NLGN1, 56423, 158873, 801-3272; 11083, NLGN1, 56425, 158875, 430-2901; 11084, NLGN2, 56430, 158880, 1-581; 11084, NLGN2, 56429, 158879, 74-2581; 11084, NLGN2, 56431, 158881, 982-3489; 11085, NLGN3, 56434, 158884, 323-1862; 11085, NLGN3, 56436, 158886, 168-1223; 11085, NLGN3, 56432, 158882, 304-2850; 11085, NLGN3, 56433, 158883, 323-2809; 11085, NLGN3, 56435, 158885, 335-2761; 11086, NLGN4X, 56441, 158891, 50-2503; 11086, NLGN4X, 56437, 158887, 465-2915; 11086, NLGN4X, 56438, 158888, 688-3138; 11086, NLGN4X, 56439, 158889, 630-3080; 11086, NLGN4X, 56440, 158890, 629-3079; 11087, NLGN4Y, 56445, 158895, 253-2874; 11087, NLGN4Y, 56447, 158897, 1-710; 11087, NLGN4Y, 56442, 158892, 100-870; 11087, NLGN4Y, 56443, 158893, 475-2925; 11087, NLGN4Y, 56444, 158894, 253-2703; 11087, NLGN4Y, 56446, 158896, 283-2229; 11088, NLN, 56449, 158899, 128-274; 11088, NLN, 56450, 158900, 184-1986; 11088, NLN, 56451, 158901, 1-852; 11088, NLN, 56452, 158902, 1-1245; 11088, NLN, 56448, 158898, 179-2293; 11089, NMB, 56453, 158903, 397-762; 11089, NMB, 56454, 158904, 412-876; 11090, NMBR, 56455, 158905, 142-1314; 11091, NMS, 56456, 158906, 8-469; 11092, NMU, 56458, 158908, 93-569; 11092, NMU, 56459, 158909, 77-526; 11092, NMU, 56460, 158910, 68-511; 11092, NMU, 56457, 158907, 107-631; 11093, NMUR1, 56461, 158911, 135-1415; 11094, NMUR2, 56462, 158912, 167-1414; 11095, NAV1, 56465, 158915, 781-6273; 11095, NAV1, 56466, 158916, 1-680; 11095, NAV1, 56467, 158917, 1-2263; 11095, NAV1, 56468, 158918, 1-81; 11095, NAV1, 56469, 158919, 1-726; 11095, NAV1, 56463, 158913, 157-4608; 11095, NAV1, 56464, 158914, 421-6054; 11096, NAV2, 56474, 158924, 76-556; 11096, NAV2, 56475, 158925, 362-7831; 11096, NAV2, 56476, 158926, 270-2716; 11096, NAV2, 56478, 158928, 362-7663; 11096, NAV2, 56470, 158920, 331-7620; 11096, NAV2, 56471, 158921, 230-7327; 11096, NAV2, 56472, 158922, 362-7660; 11096, NAV2, 56473, 158923, 100-7566; 11096, NAV2, 56477, 158927, 258-4739; 11097, NAV3, 56481, 158931, 558-2595; 11097, NAV3, 56482, 158932, 1-3775; 11097, NAV3, 56483, 158933, 1-698; 11097, NAV3, 56484, 158934, 1-760; 11097, NAV3, 56485, 158935, 1-2398; 11097, NAV3, 56479, 158929, 174-7331; 11097, NAV3, 56480, 158930, 174-7265; 11098, N/A, 56492, 158942, 96-536; 11098, N/A, 56486, 158936, 470-1027; 11098, N/A, 56487, 158937, 1992-2549; 11098, N/A, 56488, 158938, 133-690; 11098, N/A, 56489, 158939, 231-788; 11098, N/A, 56490, 158940, 162-719; 11098, N/A, 56491, 158941, 193-750; 11098, N/A, 56493, 158943, 1111-1668; 11098, N/A, 56494, 158944, 162-719; 11099, NCS1, 56495, 158945, 87-659; 11099, NCS1, 56496, 158946, 171-689; 11100, NRCAM, 56498, 158948, 1-3900; 11100, NRCAM, 56501, 158951, 301-1594; 11100, NRCAM, 56502, 158952, 242-595; 11100, NRCAM, 56503, 158953, 380-562; 11100, NRCAM, 56504, 158954, 266-583; 11100, NRCAM, 56505, 158955, 1-569; 11100, NRCAM, 56507, 158957, 487-4122; 11100, NRCAM, 56508, 158958, 409-726; 11100, NRCAM, 56509, 158959, 475-2790; 11100, NRCAM, 56497, 158947, 429-3980; 11100, NRCAM, 56499, 158949, 411-3989; 11100, NRCAM, 56500, 158950, 487-4401; 11100, NRCAM, 56506, 158956, 1-3915; 11101, NEUROD1, 56510, 158960, 459-1529; 11102, NEUROD2, 56511, 158961, 222-1370; 11103, NEUROD4, 56512, 158962, 379-1374; 11104, NEUROD6, 56514, 158964, 149-1141; 11104, NEUROD6, 56513, 158963, 324-1337; 11105, NEGR1, 56517, 158967, 1-900; 11105, NEGR1, 56515, 158965, 395-1075; 11105, NEGR1, 56516, 158966, 241-1305; 11106, NGEF, 56521, 158971, 120-569; 11106, NGEF, 56522, 158972, 105-667; 11106, NGEF, 56523, 158973, 1-293; 11106, NGEF, 56518, 158968, 280-2412; 11106, NGEF, 56519, 158969, 156-2012; 11106, NGEF, 56520, 158970, 156-872; 11107, NPAS1, 56526, 158976, 16-303; 11107, NPAS1, 56528, 158978, 122-763; 11107, NPAS1, 56529, 158979, 320-1567; 11107, NPAS1, 56524, 158974, 37-741; 11107, NPAS1, 56525, 158975, 163-1935; 11107, NPAS1, 56527, 158977, 221-1993; 11108, NPAS2, 56531, 158981, 1-774; 11108, NPAS2, 56532, 158982, 1-607; 11108, NPAS2, 56533, 158983, 1-808; 11108, NPAS2, 56534, 158984, 1-321; 11108, NPAS2, 56535, 158985, 3-625; 11108, NPAS2, 56530, 158980, 286-2760; 11109, NPAS3, 56539, 158989, 1-378; 11109, NPAS3, 56540, 158990, 136-603; 11109, NPAS3, 56541, 158991, 1-41; 11109, NPAS3, 56542, 158992, 1-2718; 11109, NPAS3, 56543, 158993, 1-398; 11109, NPAS3, 56546, 158996, 1-2817; 11109, NPAS3, 56536, 158986, 75-2780; 11109, NPAS3, 56537, 158987, 1-2802; 11109, NPAS3, 56538, 158988, 1-2763; 11109, NPAS3, 56544, 158994, 46-2757; 11109, NPAS3, 56545, 158995, 1671-2132; 11110, NPAS4, 56547, 158997, 177-2585; 11110, NPAS4, 56548, 158998, 90-794; 11111, NPTX1, 56549, 158999, 159-1457; 11112, NPTX2, 56550, 159000, 166-1461; 11113, NPTXR, 56551, 159001, 125-1627; 11114, NREP, 56561, 159011, 375-475; 11114, NREP, 56562, 159012, 118-225; 11114, NREP, 56563, 159013, 297-311; 11114, NREP, 56565, 159015, 229-336; 11114, NREP, 56566, 159016, 118-231; 11114, NREP, 56568, 159018, 362-557; 11114, NREP, 56569, 159019, 118-231; 11114, NREP, 56552, 159002, 182-388; 11114, NREP, 56553, 159003, 266-472; 11114, NREP, 56554, 159004, 193-531; 11114, NREP, 56555, 159005, 377-583; 11114, NREP, 56556, 159006, 281-487; 11114, NREP, 56557, 159007, 254-460; 11114, NREP, 56558, 159008, 179-385; 11114, NREP, 56559, 159009, 480-686; 11114, NREP, 56560, 159010, 200-406; 11114, NREP, 56564, 159014, 184-390; 11114, NREP, 56567, 159017, 281-487; 11115, NYAP1, 56571, 159021, 1-2358; 11115, NYAP1, 56570, 159020, 160-2685; 11116, NYAP2, 56572, 159022, 414-2375; 11117, NNAT, 56573, 159023, 118-363; 11117, NNAT, 56574, 159024, 114-278; 11118, NDNF, 56576, 159026, 130-564; 11118, NDNF, 56577, 159027, 211-560; 11118, NDNF, 56575, 159025, 528-2234; 11119, NOVA1, 56578, 159028, 223-549; 11119, NOVA1, 56580, 159030, 128-959; 11119, NOVA1, 56583, 159033, 1-150; 11119, NOVA1, 56584, 159034, 60-695; 11119, NOVA1, 56585, 159035, 84-449; 11119, NOVA1, 56586, 159036, 304-592; 11119, NOVA1, 56587, 159037, 486-1005; 11119, NOVA1, 56588, 159038, 25-483; 11119, NOVA1, 56579, 159029, 5-550; 11119, NOVA1, 56581, 159031, 319-1842; 11119, NOVA1, 56582, 159032, 51-1502; 11120, NOVA2, 56590, 159040, 578-698; 11120, NOVA2, 56589, 159039, 196-1674; 11121, NPB, 56592, 159042, 1534-2004; 11121, NPB, 56591, 159041, 170-547; 11122, NPFFR1, 56593, 159043, 1-1293; 11123, NPFFR2, 56594, 159044, 99-1667; 11123, NPFFR2, 56595, 159045, 1-399; 11123, NPFFR2, 56596, 159046, 48-1310; 11123, NPFFR2, 56597, 159047, 346-1617; 11124, NPFF, 56598, 159048, 165-506; 11125, NPS, 56599, 159049, 1-270; 11126, NPSR1, 56600, 159050, 129-1262; 11126, NPSR1, 56601, 159051, 129-1244; 11126, NPSR1, 56602, 159052, 5-1177; 11126, NPSR1, 56603, 159053, 129-1046; 11126, NPSR1, 56604, 159054, 129-605; 11126, NPSR1, 56605, 159055, 175-606; 11126, NPSR1, 56606, 159056, 129-539; 11126, NPSR1, 56607, 159057, 129-1229; 11126, NPSR1, 56608, 159058, 129-413; 11127, NPVF, 56609, 159059, 48-638; 11128, NPW, 56611, 159061, 514-855; 11128, NPW, 56612, 159062, 13-398; 11128, NPW, 56610, 159060, 383-880; 11129, NPY, 56613, 159063, 114-407; 11129, NPY, 56614, 159064, 291-584; 11129, NPY, 56615, 159065, 135-428; 11130, NPY1R, 56617, 159067, 271-568; 11130, NPY1R, 56618, 159068, 344-536; 11130, NPY1R, 56619, 159069, 680-753; 11130, NPY1R, 56620, 159070, 619-799; 11130, NPY1R, 56621, 159071, 263-688; 11130, NPY1R, 56622, 159072, 375-559; 11130, NPY1R, 56616, 159066, 533-1687; 11131, NPY2R, 56623, 159073, 490-1635; 11131, NPY2R, 56624, 159074, 380-1525; 11132, NPY4R, 56625, 159075, 420-1547; 11132, NPY4R, 56626, 159076, 86-1213; 11132, NPY4R, 56627, 159077, 264-1391; 11133, NPYSR, 56628, 159078, 183-1520; 11133, NPYSR, 56629, 159079, 56-1393; 11133, NPYSR, 56630, 159080, 1523-2860; 11134, NPBWR1, 56631, 159081, 1478-2464; 11135, NPBWR2, 56632, 159082, 341-1342; 11135, NPBWR2, 56633, 159083, 341-1342; 11136, NETO1, 56636, 159086, 1-11; 11136, NETO1, 56637, 159087, 273-575; 11136, NETO1, 56634, 159084, 659-2260; 11136, NETO1, 56635, 159085, 103-573; 11136, NETO1, 56638, 159088, 285-1886; 11137, NETO2, 56640, 159090, 1-1096; 11137, NETO2, 56642, 159092, 1-581; 11137, NETO2, 56643, 159093, 1-685; 11137, NETO2, 56639, 159089, 98-1654; 11137, NETO2, 56641, 159091, 386-1963; 11138, NRP1, 56645, 159095, 141-2066; 11138, NRP1, 56648, 159098, 1-2115; 11138, NRP1, 56650, 159100, 616-2823; 11138, NRP1, 56651, 159101, 524-3244; 11138, NRP1, 56652, 159102, 1-318; 11138, NRP1, 56653, 159103, 1-511; 11138, NRP1, 56654, 159104, 1-302; 11138, NRP1, 56655, 159105, 548-2341; 11138, NRP1, 56656, 159106, 1-233; 11138, NRP1, 56657, 159107, 1-182; 11138, NRP1, 56644, 159094, 527-3298; 11138, NRP1, 56646, 159096, 141-1970; 11138, NRP1, 56647, 159097, 261-2195; 11138, NRP1, 56649, 159099, 524-3295; 11139, NRP2, 56659, 159109, 32-2737; 11139, NRP2, 56660, 159110, 32-2812; 11139, NRP2, 56661, 159111, 792-3587; 11139, NRP2, 56663, 159113, 279-583; 11139, NRP2, 56664, 159114, 1-2730; 11139, NRP2, 56658, 159108, 1-2721; 11139, NRP2, 56662, 159112, 600-2267; 11140, NPTN, 56667, 159117, 114-571; 11140, NPTN, 56668, 159118, 323-1247; 11140, NPTN, 56671, 159121, 31-584; 11140, NPTN, 56665, 159115, 199-1395; 11140, NPTN, 56666, 159116, 920-1768; 11140, NPTN, 56669, 159119, 29-865; 11140, NPTN, 56670, 159120, 30-1214; 11141, NTS, 56673, 159123, 110-397; 11141, NTS, 56672, 159122, 108-620; 11142, NTSR1, 56674, 159124, 372-1628; 11143, NTSR2, 56675, 159125, 36-1268; 11144, NTM, 56679, 159129, 1-359; 11144, NTM, 56681, 159131, 434-488; 11144, NTM, 56682, 159132, 329-436; 11144, NTM, 56683, 159133, 369-908; 11144, NTM, 56684, 159134, 369-875; 11144, NTM, 56685, 159135, 71-644; 11144, NTM, 56676, 159126, 15-965; 11144, NTM, 56677, 159127, 480-1514; 11144, NTM, 56678, 159128, 330-1364; 11144, NTM, 56680, 159130, 21-1088; 11145, NTRK1, 56686, 159136, 42-2423; 11145, NTRK1, 56690, 159140, 152-1318; 11145, NTRK1, 56687, 159137, 121-2493; 11145, NTRK1, 56688, 159138, 175-2457; 11145, NTRK1, 56689, 159139, 42-2432; 11146, NTRK2, 56691, 159141, 484-3000; 11146, NTRK2, 56692, 159142, 484-2145; 11146, NTRK2, 56693, 159143, 354-2822; 11146, NTRK2, 56694, 159144, 90-1523; 11146, NTRK2, 56695, 159145, 484-2097; 11146, NTRK2, 56696, 159146, 939-3407; 11146, NTRK2, 56697, 159147, 939-3455; 11146, NTRK2, 56698, 159148, 551-1984; 11147, NTRK3, 56704, 159154, 161-2014; 11147, NTRK3, 56706, 159156, 27-2144; 11147, NTRK3, 56708, 159158, 1-440; 11147, NTRK3, 56709, 159159, 1-257; 11147, NTRK3, 56710, 159160, 265-535; 11147, NTRK3, 56711, 159161, 1-150; 11147, NTRK3, 56713, 159163, 1-2595; 11147, NTRK3, 56699, 159149, 7-1845; 11147, NTRK3, 56700, 159150, 307-2760; 11147, NTRK3, 56701, 159151, 307-2802; 11147, NTRK3, 56702, 159152, 307-2826; 11147, NTRK3, 56703, 159153, 323-2800; 11147, NTRK3, 56705, 159155, 307-2145; 11147, NTRK3, 56707, 159157, 25-2478; 11147, NTRK3, 56712, 159162, 17-2536; 11148, NTF3, 56714, 159164, 84-857; 11148, NTF3, 56715, 159165, 213-1025; 11149, NTF4, 56717, 159167, 263-724; 11149, NTF4, 56718, 159168, 384-813; 11149, NTF4, 56716, 159166, 1-633; 11150, NRTN, 56719, 159169, 365-958; 11151, NCEH1, 56720, 159170, 1-921; 11151, NCEH1, 56721, 159171, 33-314; 11151, NCEH1, 56722, 159172, 139-1461; 11151, NCEH1, 56723, 159173, 139-1485; 11151, NCEH1, 56724, 159174, 405-1232; 11152, NSMAF, 56727, 159177, 8-205; 11152, NSMAF, 56728, 159178, 34-198; 11152, NSMAF, 56725, 159175, 214-2967; 11152, NSMAF, 56726, 159176, 189-3035; 11153, NCF1, 56730, 159180, 1-489; 11153, NCF1, 56731, 159181, 1-437; 11153, NCF1, 56732, 159182, 1-157; 11153, NCF1, 56729, 159179, 71-1243; 11154, NCF2, 56735, 159185, 208-376; 11154, NCF2, 56737, 159187, 155-584; 11154, NCF2, 56733, 159183, 253-1833; 11154, NCF2, 56734, 159184, 68-1648; 11154, NCF2, 56736, 159186, 276-1721; 11154, NCF2, 56738, 159188, 276-1613; 11155, NCF4, 56741, 159191, 409-906; 11155, NCF4, 56743, 159193, 185-1085; 11155, NCF4, 56745, 159195, 409-906; 11155, NCF4, 56739, 159189, 185-1204; 11155, NCF4, 56740, 159190, 185-1231; 11155, NCF4, 56742, 159192, 1-1047; 11155, NCF4, 56744, 159194, 185-1231; 11156, NEXN, 56748, 159198, 1-1730; 11156, NEXN, 56749, 159199, 300-1263; 11156, NEXN, 56750, 159200, 151-1456; 11156, NEXN, 56746, 159196, 298-2133; 11156, NEXN, 56747, 159197, 185-2212; 11157, NFAM1, 56752, 159202, 6-500; 11157, NFAM1, 56751, 159201, 39-851; 11158, NKAP, 56753, 159203, 168-1415; 11159, NKAPL, 56754, 159204, 53-1261; 11160, NKIRAS1, 56759, 159209, 239-817; 11160, NKIRAS1, 56761, 159211, 322-900; 11160, NKIRAS1, 56762, 159212, 281-859; 11160, NKIRAS1, 56755, 159205, 322-900; 11160, NKIRAS1, 56756, 159206, 409-987; 11160, NKIRAS1, 56757, 159207, 779-1357; 11160, NKIRAS1, 56758, 159208, 187-765; 11160, NKIRAS1, 56760, 159210, 422-1000; 11160, NKIRAS1, 56763, 159213, 22-600; 11161, NKIRAS2, 56765, 159215, 97-786; 11161, NKIRAS2, 56770, 159220, 119-244; 11161, NKI-

RAS2, 56771, 159221, 116-244; 11161, NKIRAS2, 56773, 159223, 142-318; 11161, NKIRAS2, 56774, 159224, 425-564; 11161, NKIRAS2, 56775, 159225, 142-563; 11161, NKIRAS2, 56764, 159214, 622-1197; 11161, NKIRAS2, 56766, 159216, 188-763; 11161, NKIRAS2, 56767, 159217, 142-717; 11161, NKIRAS2, 56768, 159218, 169-744; 11161, NKIRAS2, 56769, 159219, 114-521; 11161, NKIRAS2, 56772, 159222, 142-435; 11162, NKRF, 56779, 159229, 654-1817; 11162, NKRF, 56776, 159226, 182-2254; 11162, NKRF, 56777, 159227, 654-2726; 11162, NKRF, 56778, 159228, 223-2340; 11163, NFS1, 56780, 159230, 17-586; 11163, NFS1, 56784, 159234, 130-744; 11163, NFS1, 56785, 159235, 229-551; 11163, NFS1, 56786, 159236, 127-390; 11163, NFS1, 56787, 159237, 65-508; 11163, NFS1, 56781, 159231, 529-1722; 11163, NFS1, 56782, 159232, 72-1445; 11163, NFS1, 56783, 159233, 124-1317; 11163, NFS1, 56788, 159238, 65-1285; 11164, NFU1, 56792, 159242, 46-165; 11164, NFU1, 56793, 159243, 85-213; 11164, NFU1, 56794, 159244, 283-580; 11164, NFU1, 56795, 159245, 381-668; 11164, NFU1, 56797, 159247, 1-381; 11164, NFU1, 56789, 159239, 216-908; 11164, NFU1, 56790, 159240, 584-925; 11164, NFU1, 56791, 159241, 207-971; 11164, NFU1, 56796, 159246, 94-435; 11165, NAB1, 56799, 159249, 119-1579; 11165, NAB1, 56801, 159251, 133-590; 11165, NAB1, 56802, 159252, 1-721; 11165, NAB1, 56803, 159253, 290-542; 11165, NAB1, 56804, 159254, 246-545; 11165, NAB1, 56805, 159255, 253-438; 11165, NAB1, 56806, 159256, 97-568; 11165, NAB1, 56798, 159248, 462-1925; 11165, NAB1, 56800, 159250, 311-1774; 11166, NAB2, 56807, 159257, 379-1956; 11166, NAB2, 56808, 159258, 179-1564; 11167, NGLY1, 56809, 159259, 1-721; 11167, NGLY1, 56811, 159261, 1-1902; 11167, NGLY1, 56815, 159265, 236-579; 11167, NGLY1, 56810, 159260, 162-2126; 11167, NGLY1, 56812, 159262, 49-1725; 11167, NGLY1, 56813, 159263, 109-2019; 11167, NGLY1, 56814, 159264, 175-2013; 11168, NHLRC2, 56816, 159266, 213-2393; 11169, NHLRC3, 56819, 159269, 663-1115; 11169, NHLRC3, 56820, 159270, 250-711; 11169, NHLRC3, 56817, 159267, 250-1092; 11169, NHLRC3, 56818, 159268, 323-1366; 11170, NHLRC4, 56821, 159271, 658-1029; 11170, NHLRC4, 56822, 159272, 624-995; 11171, NHLRC1, 56823, 159273, 1-1188; 11172, NHP2, 56825, 159275, 13-285; 11172, NHP2, 56826, 159276, 66-472; 11172, NHP2, 56827, 159277, 78-475; 11172, NHP2, 56828, 159278, 1-258; 11172, NHP2, 56824, 159274, 151-612; 11173, NHSL1, 56829, 159279, 74-736; 11173, NHSL1, 56832, 159282, 1-506; 11173, NHSL1, 56833, 159283, 157-568; 11173, NHSL1, 56830, 159280, 205-5025; 11173, NHSL1, 56831, 159281, 630-5462; 11174, NHSL2, 56835, 159285, 449-2955; 11174, NHSL2, 56836, 159286, 271-3948; 11174, NHSL2, 56837, 159287, 29-2881; 11174, NHSL2, 56834, 159284, 472-2601; 11175, NBN, 56839, 159289, 347-523; 11175, NBN, 56840, 159290, 407-2425; 11175, NBN, 56841, 159291, 59-235; 11175, NBN, 56842, 159292, 208-701; 11175, NBN, 56843, 159293, 290-565; 11175, NBN, 56844, 159294, 59-535; 11175, NBN, 56845, 159295, 1-375; 11175, NBN, 56838, 159288, 156-2420; 11176, NCLN, 56847, 159297, 1-848; 11176, NCLN, 56848, 159298, 1-1053; 11176, NCLN, 56849, 159299, 433-1902; 11176, NCLN, 56850, 159300, 1-218; 11176, NCLN, 56851, 159301, 96-1080; 11176, NCLN, 56852, 159302, 1-331; 11176, NCLN, 56846, 159296, 432-2123; 11177, NCSTN, 56855, 159305, 1-958; 11177, NCSTN, 56856, 159306, 7-702; 11177, NCSTN, 56857, 159307, 12-776; 11177, NCSTN, 56858, 159308, 1-824; 11177, NCSTN, 56859, 159309, 1-659; 11177, NCSTN, 56860, 159310, 45-448; 11177, NCSTN, 56853, 159303, 126-2255; 11177, NCSTN, 56854, 159304, 281-2350; 11178, NICN1, 56862, 159312, 88-615; 11178, NICN1, 56861, 159311, 88-729; 11178, NICN1, 56863, 159313, 70-711; 11178, NICN1, 56864, 159314, 50-691; 11179, NNMT, 56865, 159315, 733-1527; 11179, NNMT, 56866, 159316, 265-1059; 11180, NMNAT1, 56868, 159318, 145-627; 11180, NMNAT1, 56870, 159320, 1-127; 11180, NMNAT1, 56867, 159317, 145-984; 11180, NMNAT1, 56869, 159319, 144-983; 11181, NMNAT2, 56871, 159321, 336-1259; 11181, NMNAT2, 56872, 159322, 136-1044; 11182, NMNAT3, 56877, 159327, 454-750; 11182, NMNAT3, 56878, 159328, 141-332; 11182, NMNAT3, 56879, 159329, 442-744; 11182, NMNAT3, 56880, 159330, 155-451; 11182, NMNAT3, 56881, 159331, 423-763; 11182, NMNAT3, 56873, 159323, 383-1141; 11182, NMNAT3, 56874, 159324, 397-1044; 11182, NMNAT3, 56875, 159325, 37-795; 11182, NMNAT3, 56876, 159326, 402-893; 11183, NNT, 56884, 159334, 1-174; 11183, NNT, 56885, 159335, 103-754; 11183, NNT, 56886, 159336, 1-35; 11183, NNT, 56887, 159337, 573-747; 11183, NNT, 56888, 159338, 339-3206; 11183, NNT, 56889, 159339, 112-708; 11183, NNT, 56882, 159332, 222-3482; 11183, NNT, 56883, 159333, 222-3482; 11184, NAMPT, 56891, 159341, 38-1144; 11184, NAMPT, 56892, 159342, 884-1147; 11184, NAMPT, 56893, 159343, 120-300; 11184, NAMPT, 56890, 159340, 309-1784; 11185, NMRK1, 56896, 159346, 464-1075; 11185, NMRK1, 56897, 159347, 238-558; 11185, NMRK1, 56894, 159344, 238-837; 11185, NMRK1, 56895, 159345, 246-773; 11186, NMRK2, 56899, 159349, 1-251; 11186, NMRK2, 56900, 159350, 65-403; 11186, NMRK2, 56898, 159348, 291-983; 11186, NMRK2, 56901, 159351, 66-773; 11186, NMRK2, 56902, 159352, 291-998; 11187, NAPRT, 56903, 159353, 22-1774; 11187, NAPRT, 56906, 159356, 26-1498; 11187, NAPRT, 56907, 159357, 1-386; 11187, NAPRT, 56908, 159358, 1-491; 11187, NAPRT, 56909, 159359, 1-694; 11187, NAPRT, 56911, 159361, 1-386; 11187, NAPRT, 56912, 159362, 1-694; 11187, NAPRT, 56913, 159363, 1-491; 11187, NAPRT, 56914, 159364, 22-1774; 11187, NAPRT, 56904, 159354, 26-1603; 11187, NAPRT, 56905, 159355, 296-1912; 11187, NAPRT, 56910, 159360, 34-1650; 11187, NAPRT, 56915, 159365, 22-1599; 11188, NID1, 56916, 159366, 84-3827; 11188, NID1, 56917, 159367, 31-3375; 11189, NID2, 56919, 159369, 1-4122; 11189, NID2, 56920, 159370, 1-1933; 11189, NID2, 56921, 159371, 235-3144; 11189, NID2, 56918, 159368, 1-4128; 11190, NPC1, 56923, 159373, 1-180; 11190, NPC1, 56924, 159374, 1-127; 11190, NPC1, 56925, 159375, 1-2915; 11190, NPC1, 56926, 159376, 1-526; 11190, NPC1, 56927, 159377, 1-538; 11190, NPC1, 56922, 159372, 556-4392; 11191, NPC2, 56928, 159378, 18-464; 11191, NPC2, 56929, 159379, 34-639; 11191, NPC2, 56931, 159381, 1-521; 11191, NPC2, 56932, 159382, 103-469; 11191, NPC2, 56934, 159384, 66-729; 11191, NPC2, 56935, 159385, 74-598; 11191, NPC2, 56936, 159386, 1-162; 11191, NPC2, 56930, 159380, 8-385; 11191, NPC2, 56933, 159383, 239-694; 11192, NIF3L1, 56940, 159390, 326-813; 11192, NIF3L1, 56942, 159392, 232-719; 11192, NIF3L1, 56943, 159393, 1-254; 11192, NIF3L1, 56944, 159394, 30-788; 11192, NIF3L1, 56945, 159395, 122-749; 11192, NIF3L1, 56937, 159387, 322-1374; 11192, NIF3L1, 56938, 159388, 295-1428; 11192, NIF3L1, 56939, 159389, 28-885; 11192, NIF3L1, 56941, 159391, 328-1461; 11193, NRK, 56947, 159397, 203-694; 11193, NRK, 56948, 159398, 266-1333; 11193, NRK, 56946, 159396, 304-5052; 11193, NRK, 56949, 159399, 294-860; 11194, NIM1K, 56950, 159400, 882-2192; 11194, NIM1K, 56951, 159401, 1500-2810; 11195, NEK1, 56953, 159403, 1-370; 11195, NEK1, 56955, 159405, 595-732; 11195, NEK1, 56952, 159402, 642-4418; 11195, NEK1, 56954, 159404, 579-4307; 11195, NEK1, 56956, 159406, 581-4441; 11195, NEK1, 56957, 159407, 579-4148; 11195, NEK1, 56958, 159408, 613-4257; 11196, NEK10, 56961, 159411, 1-1257; 11196, NEK10, 56963, 159413, 1-590; 11196, NEK10, 56964, 159414, 274-671; 11196, NEK10, 56966, 159416, 1-499; 11196, NEK10, 56959, 159409, 230-1684; 11196, NEK10, 56960, 159410, 275-2413; 11196, NEK10, 56962, 159412, 230-1654; 11196, NEK10, 56965, 159415, 364-3882; 11197, NEK11, 56969, 159419, 169-408; 11197, NEK11, 56970, 159420, 254-1876; 11197, NEK11, 56974, 159424, 181-819; 11197, NEK11, 56976, 159426, 1-659; 11197, NEK11, 56967, 159417, 112-1524; 11197, NEK11, 56968, 159418, 294-2231; 11197, NEK11, 56971, 159421, 1-1938; 11197, NEK11, 56972, 159422, 225-2024; 11197, NEK11, 56973, 159423, 294-1706; 11197, NEK11, 56975, 159425, 371-1819; 11198, NEK2, 56979, 159429, 152-1318; 11198, NEK2, 56977, 159427, 79-1233; 11198, NEK2, 56978, 159428, 140-1477; 11199, NEK3, 56980, 159430, 99-239; 11199, NEK3, 56981, 159431, 396-569; 11199, NEK3, 56983, 159433, 76-1569; 11199, NEK3, 56984, 159434, 1-544; 11199, NEK3, 56987, 159437, 1295-2191; 11199, NEK3, 56988, 159438, 1-141; 11199, NEK3, 56982, 159432, 377-1897; 11199, NEK3, 56985, 159435, 377-1846; 11199, NEK3, 56986, 159436, 396-1916; 11200, NEK4, 56991, 159441, 201-314; 11200, NEK4, 56992, 159442, 111-2276; 11200, NEK4, 56993, 159443, 1-427; 11200, NEK4, 56989, 159439, 204-2729; 11200, NEK4, 56990, 159440, 194-2539; 11200, NEK4, 56994, 159444, 194-2452; 11201, NEK5, 56996, 159446, 1-888; 11201, NEK5, 56995, 159445, 141-2267; 11201, NEK5, 56997, 159447, 1-2127; 11202, NEK6, 56999, 159449, 137-758; 11202, NEK6, 57003, 159453, 132-790; 11202, NEK6, 57004, 159454, 144-726; 11202, NEK6, 57005, 159455, 141-806; 11202, NEK6, 57006, 159456, 203-716; 11202, NEK6, 57007, 159457, 131-732; 11202, NEK6, 57008, 159458, 140-799; 11202, NEK6, 56998, 159448, 146-1087; 11202, NEK6, 57000, 159450, 216-1259; 11202, NEK6, 57001, 159451, 146-1087; 11202, NEK6, 57002, 159452, 1-1044; 11202, NEK6, 57009, 159459, 75-1091; 11202, NEK6, 57010, 159460, 148-1089; 11202, NEK6, 57011, 159461, 92-1087; 11202, NEK6, 57012, 159462, 141-1082; 11203, NEK7, 57015, 159465, 341-587; 11203, NEK7, 57016, 159466, 424-519; 11203, NEK7, 57017, 159467, 380-565; 11203, NEK7, 57013, 159463, 185-544; 11203, NEK7, 57014, 159464, 343-1251; 11203, NEK7, 57018, 159468, 128-1036; 11204, NEK8, 57020, 159470, 11-1393; 11204, NEK8, 57021, 159471, 1-782; 11204, NEK8, 57022, 159472, 147-647; 11204, NEK8, 57023, 159473, 147-643; 11204, NEK8, 57019, 159469, 35-2113; 11205, NEK9, 57025, 159475, 272-657; 11205, NEK9, 57026, 159476, 13-327; 11205, NEK9, 57027, 159477, 359-577; 11205, NEK9, 57028, 159478, 487-603; 11205, NEK9, 57024, 159474, 160-3099; 11206, NOB1, 57030, 159480, 5-205; 11206, NOB1, 57031, 159481, 15-215; 11206, NOB1, 57029, 159479, 31-1269; 11207, NIN, 57036, 159486, 1-4744; 11207, NIN, 57037, 159487, 229-1418; 11207, NIN, 57038, 159488, 192-6332; 11207, NIN, 57039, 159489, 1-423; 11207, NIN, 57040, 159490, 267-569; 11207, NIN, 57041, 159491, 117-6086; 11207, NIN, 57042, 159492, 1-4612; 11207, NIN, 57044, 159494, 1-350; 11207, NIN, 57032, 159482, 192-6593; 11207, NIN, 57033, 159483, 192-4325; 11207, NIN, 57034, 159484, 192-6464; 11207, NIN, 57035, 159485, 38-4171; 11207, NIN, 57043, 159493, 1-6402; 11208, NINL, 57046, 159496, 1-439; 11208, NINL, 57045, 159495, 75-4223; 11208, NINL, 57047, 159497, 75-3176; 11209, NINJ1, 57048, 159498, 72-530; 11210, NINJ2, 57050, 159500, 62-469; 11210, NINJ2, 57051, 159501, 202-474; 11210, NINJ2, 57052, 159502, 231-551; 11210, NINJ2, 57049, 159499, 282-848; 11211, NIP7, 57055, 159505, 263-595; 11211, NIP7, 57056, 159506, 1-213; 11211, NIP7, 57057, 159507, 1-239; 11211, NIP7, 57053, 159503, 401-943; 11211, NIP7, 57054, 159504, 34-435; 11212, NIPAL1, 57059, 159509, 1-279; 11212, NIPAL1, 57060, 159510, 31-426; 11212, NIPAL1, 57058, 159508, 67-1299; 11213, NIPAL2, 57061, 159511, 257-1363; 11213, NIPAL2, 57062, 159512, 200-1351; 11214, NIPAL3, 57064, 159514, 349-1455; 11214, NIPAL3, 57067, 159517, 1-403; 11214, NIPAL3, 57063, 159513, 716-1690; 11214, NIPAL3, 57065, 159515, 350-1030; 11214, NIPAL3, 57066, 159516, 369-1589; 11215, NIPAL4, 57070, 159520, 1-399; 11215, NIPAL4, 57068, 159518, 117-1517; 11215, NIPAL4, 57069, 159519, 117-1460; 11216, NIPBL, 57073, 159523, 1-452; 11216, NIPBL, 57074, 159524, 23-337; 11216, NIPBL, 57071, 159521, 500-8914; 11216, NIPBL, 57072, 159522, 469-8562; 11217, NIPSNAP1, 57076, 159526, 448-674; 11217, NIPSNAP1, 57077, 159527, 12-398; 11217, NIPSNAP1, 57078, 159528, 1-661; 11217, NIPSNAP1, 57075, 159525, 256-1110; 11218, NIPSNAP3A, 57079, 159529, 106-849; 11219, NIPSNAP3B, 57081, 159531, 85-678; 11219, NIPSNAP3B, 57080, 159530, 72-815; 11220, NISCH, 57084, 159534, 26-1777; 11220, NISCH, 57082, 159532, 135-4649; 11220, NISCH, 57083, 159533, 26-1573; 11220, NISCH, 57085, 159535, 73-4587; 11221, NOA1, 57086, 159536, 1239-3335; 11222, NOS1, 57089, 159539, 11-4312; 11222, NOS1, 57087, 159537, 687-4991; 11222, NOS1, 57088, 159538, 6-4412; 11222, NOS1, 57090, 159540, 712-5118; 11223, NOS1AP, 57092, 159542, 89-1138; 11223, NOS1AP, 57095, 159545, 482-724; 11223, NOS1AP, 57091, 159541, 403-1923; 11223, NOS1AP, 57093, 159543, 405-1910; 11223, NOS1AP, 57094, 159544, 2368-3003; 11224, NOS2, 57096, 159546, 235-3696; 11224, NOS2, 57097, 159547, 1-3345; 11225, NOS3, 57099, 159549, 346-3339; 11225, NOS3, 57100, 159550, 1-920; 11225, NOS3, 57102, 159552, 1-1845; 11225, NOS3, 57098, 159548, 358-3969; 11225, NOS3, 57101, 159551, 1-1890; 11226, NOSIP, 57103, 159553, 46-960; 11226, NOSIP, 57104, 159554, 140-429; 11226, NOSIP, 57106, 159556, 1-697; 11226, NOSIP, 57107, 159557, 44-235; 11226, NOSIP, 57108, 159558, 1-529; 11226, NOSIP, 57109, 159559, 20-211; 11226, NOSIP, 57110, 159560, 109-833; 11226, NOSIP, 57105, 159555, 60-965; 11227, NOSTRIN, 57114, 159564, 1-62; 11227, NOSTRIN, 57115, 159565, 300-794; 11227, NOSTRIN, 57119, 159569, 56-349; 11227, NOSTRIN, 57120, 159570, 1-62; 11227, NOSTRIN, 57121, 159571, 1-1179; 11227, NOSTRIN, 57122, 159572, 1-1179; 11227, NOSTRIN, 57123, 159573, 1-1179; 11227, NOSTRIN, 57124, 159574, 1-387; 11227, NOSTRIN, 57125, 159575, 1-1179; 11227, NOSTRIN, 57126, 159576, 1-1179; 11227, NOSTRIN, 57127, 159577, 1-1350; 11227, NOSTRIN, 57111, 159561, 230-1750; 11227, NOSTRIN, 57112, 159562, 160-1446; 11227, NOSTRIN, 57113, 159563, 1-1437; 11227, NOSTRIN, 57116, 159566, 477-2168; 11227, NOSTRIN, 57117, 159567, 759-2450; 11227, NOSTRIN, 57118, 159568, 199-1485; 11227, NOSTRIN, 57128, 159578, 1-1437; 11228, NIT1, 57129, 159579, 383-1321; 11228, NIT1, 57130, 159580, 60-791; 11228, NIT1, 57131, 159581, 77-1060; 11228, NIT1, 57132, 159582, 215-1090; 11229, NIT2, 57134, 159584, 23-301; 11229, NIT2, 57135, 159585, 1-795; 11229, NIT2, 57136, 159586, 17-151;

11229, NIT2, 57133, 159583, 92-922; 11230, NKX1-1, 57137, 159587, 1-1236; 11231, NKX1-2, 57138, 159588, 242-1174; 11232, NKX2-1, 57143, 159593, 551-653; 11232, NKX2-1, 57139, 159589, 100-1305; 11232, NKX2-1, 57140, 159590, 607-1722; 11232, NKX2-1, 57141, 159591, 241-1356; 11232, NKX2-1, 57142, 159592, 337-1452; 11233, NKX2-2, 57144, 159594, 358-1179; 11234, NKX2-3, 57146, 159596, 180-1070; 11234, NKX2-3, 57145, 159595, 200-1294; 11235, NKX2-4, 57147, 159597, 630-1694; 11236, NKX2-5, 57151, 159601, 229-655; 11236, NKX2-5, 57148, 159598, 275-1249; 11236, NKX2-5, 57149, 159599, 182-520; 11236, NKX2-5, 57150, 159600, 124-579; 11237, NKX2-6, 57152, 159602, 1-906; 11238, NKX2-8, 57153, 159603, 219-938; 11239, NKX3-1, 57154, 159604, 39-743; 11239, NKX3-1, 57155, 159605, 1-480; 11240, NKX3-2, 57156, 159606, 637-1638; 11241, NKX6-1, 57158, 159608, 611-892; 11241, NKX6-1, 57157, 159607, 223-1326; 11242, NKX6-2, 57159, 159609, 105-938; 11243, NKX6-3, 57160, 159610, 178-975; 11243, NKX6-3, 57161, 159611, 5-412; 11244, NLRX1, 57166, 159616, 309-762; 11244, NLRX1, 57167, 159617, 164-544; 11244, NLRX1, 57168, 159618, 146-558; 11244, NLRX1, 57162, 159612, 242-3169; 11244, NLRX1, 57163, 159613, 216-3143; 11244, NLRX1, 57164, 159614, 163-3090; 11244, NLRX1, 57165, 159615, 588-3515; 11244, NLRX1, 57169, 159619, 49-2814; 11245, NAIP, 57171, 159621, 1-579; 11245, NAIP, 57174, 159624, 76-672; 11245, NAIP, 57175, 159625, 56-4099; 11245, NAIP, 57176, 159626, 1-15; 11245, NAIP, 57178, 159628, 1-3726; 11245, NAIP, 57179, 159629, 56-4099; 11245, NAIP, 57180, 159630, 1-579; 11245, NAIP, 57181, 159631, 1-3726; 11245, NAIP, 57182, 159632, 56-4099; 11245, NAIP, 57185, 159635, 255-4466; 11245, NAIP, 57186, 159636, 1-15; 11245, NAIP, 57187, 159637, 76-672; 11245, NAIP, 57188, 159638, 534-4013; 11245, NAIP, 57189, 159639, 292-4503; 11245, NAIP, 57190, 159640, 76-672; 11245, NAIP, 57170, 159620, 1-3726; 11245, NAIP, 57172, 159622, 534-4259; 11245, NAIP, 57173, 159623, 292-4503; 11245, NAIP, 57177, 159627, 256-4467; 11245, NAIP, 57183, 159633, 534-4013; 11245, NAIP, 57184, 159634, 56-4267; 11246, NLRC3, 57191, 159641, 76-3414; 11246, NLRC3, 57194, 159644, 1-588; 11246, NLRC3, 57192, 159642, 412-3609; 11246, NLRC3, 57193, 159643, 57-3254; 11246, NLRC3, 57195, 159645, 482-2767; 11247, NLRC4, 57196, 159646, 265-1344; 11247, NLRC4, 57197, 159647, 265-3339; 11247, NLRC4, 57198, 159648, 490-3564; 11247, NLRC4, 57199, 159649, 262-3336; 11248, NLRC5, 57202, 159652, 1-976; 11248, NLRC5, 57203, 159653, 1-1163; 11248, NLRC5, 57204, 159654, 371-594; 11248, NLRC5, 57205, 159655, 1-1894; 11248, NLRC5, 57206, 159656, 1-472; 11248, NLRC5, 57207, 159657, 226-282; 11248, NLRC5, 57208, 159658, 1-2656; 11248, NLRC5, 57211, 159661, 1-3541; 11248, NLRC5, 57212, 159662, 1-3172; 11248, NLRC5, 57213, 159663, 1-2109; 11248, NLRC5, 57214, 159664, 1-332; 11248, NLRC5, 57200, 159650, 226-5826; 11248, NLRC5, 57201, 159651, 128-5728; 11248, NLRC5, 57209, 159659, 261-2423; 11248, NLRC5, 57210, 159660, 1-5514; 11249, NLRP1, 57220, 159670, 449-555; 11249, NLRP1, 57221, 159671, 523-3676; 11249, NLRP1, 57215, 159665, 575-4702; 11249, NLRP1, 57216, 159666, 159-4448; 11249, NLRP1, 57217, 159667, 367-4656; 11249, NLRP1, 57218, 159668, 1-4332; 11249, NLRP1, 57219, 159669, 553-4680; 11249, NLRP1, 57222, 159672, 1-4200; 11249, NLRP1, 57223, 159673, 1-4422; 11249, NLRP1, 57224, 159674, 367-4788; 11249, NLRP1, 57225, 159675, 367-4494; 11249, NLRP1, 57226, 159676, 367-4698; 11250, NLRP10, 57228, 159678, 227-423; 11250, NLRP10, 57230, 159680, 227-423; 11250, NLRP10, 57232, 159682, 227-423; 11250, NLRP10, 57227, 159677, 163-2130; 11250, NLRP10, 57229, 159679, 163-2130; 11250, NLRP10, 57231, 159681, 163-2130; 11251, NLRP11, 57234, 159684, 676-2640; 11251, NLRP11, 57235, 159685, 389-2644; 11251, NLRP11, 57238, 159688, 340-416; 11251, NLRP11, 57233, 159683, 95-3196; 11251, NLRP11, 57236, 159686, 64-3003; 11251, NLRP11, 57237, 159687, 52-2856; 11252, NLRP12, 57240, 159690, 221-3241; 11252, NLRP12, 57241, 159691, 221-2899; 11252, NLRP12, 57239, 159689, 170-3355; 11252, NLRP12, 57242, 159692, 221-3409; 11252, NLRP12, 57243, 159693, 144-3158; 11253, NLRP13, 57245, 159695, 26-3136; 11253, NLRP13, 57244, 159694, 1-3132; 11254, NLRP14, 57246, 159696, 347-3628; 11255, NLRP2, 57247, 159697, 80-3259; 11255, NLRP2, 57253, 159703, 56-550; 11255, NLRP2, 57254, 159704, 52-381; 11255, NLRP2, 57255, 159705, 78-540; 11255, NLRP2, 57257, 159707, 1-267; 11255, NLRP2, 57258, 159708, 220-592; 11255, NLRP2, 57259, 159709, 174-593; 11255, NLRP2, 57260, 159710, 1-592; 11255, NLRP2, 57261, 159711, 171-576; 11255, NLRP2, 57262, 159712, 1-28; 11255, NLRP2, 57264, 159714, 67-2703; 11255, NLRP2, 57265, 159715, 143-3265; 11255, NLRP2, 57268, 159718, 143-3331; 11255, NLRP2, 57269, 159719, 78-540; 11255, NLRP2, 57273, 159723, 143-3331; 11255, NLRP2, 57274, 159724, 143-3262; 11255, NLRP2, 57275, 159725, 112-3300; 11255, NLRP2, 57276, 159726, 112-3300; 11255, NLRP2, 57277, 159727, 80-3259; 11255, NLRP2, 57278, 159728, 143-3331; 11255, NLRP2, 57279, 159729, 112-3300; 11255, NLRP2, 57280, 159730, 144-2852; 11255, NLRP2, 57281, 159731, 56-550; 11255, NLRP2, 57283, 159733, 143-3331; 11255, NLRP2, 57284, 159734, 143-3265; 11255, NLRP2, 57285, 159735, 143-3265; 11255, NLRP2, 57286, 159736, 143-3262; 11255, NLRP2, 57288, 159738, 143-3262; 11255, NLRP2, 57289, 159739, 220-592; 11255, NLRP2, 57290, 159740, 143-3262; 11255, NLRP2, 57291, 159741, 143-3262; 11255, NLRP2, 57293, 159743, 143-3265; 11255, NLRP2, 57294, 159744, 60-2702; 11255, NLRP2, 57297, 159747, 1-592; 11255, NLRP2, 57298, 159748, 111-2651; 11255, NLRP2, 57299, 159749, 174-593; 11255, NLRP2, 57300, 159750, 143-3265; 11255, NLRP2, 57301, 159751, 112-3300; 11255, NLRP2, 57302, 159752, 52-381; 11255, NLRP2, 57303, 159753, 143-3265; 11255, NLRP2, 57304, 159754, 143-3331; 11255, NLRP2, 57305, 159755, 143-3331; 11255, NLRP2, 57306, 159756, 143-3262; 11255, NLRP2, 57308, 159758, 112-3300; 11255, NLRP2, 57310, 159760, 1-28; 11255, NLRP2, 57312, 159762, 171-576; 11255, NLRP2, 57313, 159763, 1-267; 11255, NLRP2, 57248, 159698, 60-3182; 11255, NLRP2, 57249, 159699, 67-3183; 11255, NLRP2, 57250, 159700, 112-3231; 11255, NLRP2, 57251, 159701, 143-3331; 11255, NLRP2, 57252, 159702, 143-3265; 11255, NLRP2, 57256, 159706, 144-3332; 11255, NLRP2, 57263, 159713, 143-3265; 11255, NLRP2, 57266, 159716, 143-3331; 11255, NLRP2, 57267, 159717, 143-3262; 11255, NLRP2, 57270, 159720, 143-3331; 11255, NLRP2, 57271, 159721, 143-3265; 11255, NLRP2, 57272, 159722, 112-3300; 11255, NLRP2, 57282, 159732, 143-3265; 11255, NLRP2, 57287, 159737, 112-3300; 11255, NLRP2, 57292, 159742, 143-3262; 11255, NLRP2, 57295, 159745, 143-3331; 11255, NLRP2, 57296, 159746, 144-3332; 11255, NLRP2, 57307, 159757, 60-3182; 11255, NLRP2, 57309, 159759, 67-3183; 11255, NLRP2, 57311, 159761, 112-3231; 11256, NLRP2P, 57314, 159764, 1-138; 11257, NLRP3, 57315, 159765, 747-3515; 11257, NLRP3, 57316, 159766, 747-3857; 11257, NLRP3, 57317, 159767, 744-3683; 11257, NLRP3, 57318, 159768, 781-3720; 11257, NLRP3, 57319, 159769, 1-2940; 11257, NLRP3, 57320, 159770, 139-3249; 11258, NLRP4, 57323, 159773, 106-572; 11258, NLRP4, 57324, 159774, 1-1514; 11258, NLRP4, 57321, 159771, 423-3407; 11258, NLRP4, 57322, 159772, 175-2934; 11259, NLRP5, 57326, 159776, 1-537; 11259, NLRP5, 57327, 159777, 1-3603; 11259, NLRP5, 57325, 159775, 1-3603; 11260, NLRP6, 57328, 159778, 1-2679; 11260, NLRP6, 57329, 159779, 206-2881; 11261, NLRP7, 57334, 159784, 350-559; 11261, NLRP7, 57335, 159785, 408-568; 11261, NLRP7, 57336, 159786, 254-543; 11261, NLRP7, 57337, 159787, 69-2960; 11261, NLRP7, 57339, 159789, 69-2876; 11261, NLRP7, 57340, 159790, 1-472; 11261, NLRP7, 57342, 159792, 350-559; 11261, NLRP7, 57343, 159793, 77-3019; 11261, NLRP7, 57345, 159795, 77-3190; 11261, NLRP7, 57347, 159797, 254-543; 11261, NLRP7, 57348, 159798, 77-3019; 11261, NLRP7, 57349, 159799, 77-3190; 11261, NLRP7, 57351, 159801, 69-2960; 11261, NLRP7, 57355, 159805, 1-250; 11261, NLRP7, 57356, 159806, 71-2929; 11261, NLRP7, 57357, 159807, 77-3190; 11261, NLRP7, 57358, 159808, 77-3019; 11261, NLRP7, 57359, 159809, 1-301; 11261, NLRP7, 57361, 159811, 77-3190; 11261, NLRP7, 57362, 159812, 408-568; 11261, NLRP7, 57364, 159814, 77-3019; 11261, NLRP7, 57366, 159816, 71-3100; 11261, NLRP7, 57367, 159817, 77-3190; 11261, NLRP7, 57368, 159818, 77-3019; 11261, NLRP7, 57330, 159780, 40-3069; 11261, NLRP7, 57331, 159781, 77-3019; 11261, NLRP7, 57332, 159782, 42-2984; 11261, NLRP7, 57333, 159783, 488-3601; 11261, NLRP7, 57338, 159788, 69-3182; 11261, NLRP7, 57341, 159791, 77-3019; 11261, NLRP7, 57344, 159794, 40-3069; 11261, NLRP7, 57346, 159796, 77-3019; 11261, NLRP7, 57350, 159800, 77-3019; 11261, NLRP7, 57352, 159802, 42-2984; 11261, NLRP7, 57353, 159803, 488-3601; 11261, NLRP7, 57354, 159804, 77-3190; 11261, NLRP7, 57360, 159810, 77-3190; 11261, NLRP7, 57363, 159813, 69-3182; 11261, NLRP7, 57365, 159815, 77-3019; 11261, NLRP7, 57369, 159819, 77-3190; 11262, NLRP8, 57370, 159820, 72-3218; 11262, NLRP8, 57371, 159821, 1-3090; 11263, NLRP9, 57372, 159822, 29-3004; 11263, NLRP9, 57373, 159823, 1-2958; 11264, NMD3, 57375, 159825, 123-1712; 11264, NMD3, 57376, 159826, 296-589; 11264, NMD3, 57377, 159827, 422-1077; 11264, NMD3, 57378, 159828, 81-547; 11264, NMD3, 57380, 159830, 91-746; 11264, NMD3, 57381, 159831, 200-685; 11264, NMD3, 57374, 159824, 141-1652; 11264, NMD3, 57379, 159829, 456-1967; 11265, NSMF, 57383, 159833, 107-1090; 11265, NSMF, 57384, 159834, 72-509; 11265, NSMF, 57389, 159839, 1135-1719; 11265, NSMF, 57382, 159832, 233-1819; 11265, NSMF, 57385, 159835, 201-1787; 11265, NSMF, 57386, 159836, 233-1735; 11265, NSMF, 57387, 159837, 233-1750; 11265, NSMF, 57388, 159838, 233-1825; 11265, NSMF, 57390, 159840, 233-1756; 11266, NME5, 57391, 159841, 51-689; 11267, NME7, 57393, 159843, 237-1256; 11267, NME7, 57394, 159844, 21-791; 11267, NME7, 57392, 159842, 258-1388; 11267, NME7, 57395, 159845, 314-1336; 11268, NME8, 57397, 159847, 127-473; 11268, NME8, 57398, 159848, 112-561; 11268, NME8, 57400, 159850, 15-179; 11268, NME8, 57396, 159846, 373-2139; 11268, NME8, 57399, 159849, 113-1879; 11269, NME9, 57404, 159854, 55-660; 11269, NME9, 57405, 159855, 33-557; 11269, NME9, 57407, 159857, 489-579; 11269, NME9, 57408, 159858, 1-499; 11269, NME9, 57409, 159859, 74-343; 11269, NME9, 57401, 159851, 36-827; 11269, NME9, 57402, 159852, 29-1021; 11269, NME9, 57403, 159853, 239-1030; 11269, NME9, 57406, 159856, 40-825; 11270, NME1, 57413, 159863, 331-510; 11270, NME1, 57414, 159864, 87-335; 11270, NME1, 57415, 159865, 235-654; 11270, NME1, 57416, 159866, 71-319; 11270, NME1, 57410, 159860, 210-743; 11270, NME1, 57411, 159861, 237-770; 11270, NME1, 57412, 159862, 132-590; 11271, NME2, 57417, 159867, 83-331; 11271, NME2, 57418, 159868, 268-726; 11271, NME2, 57419, 159869, 225-683; 11271, NME2, 57420, 159870, 95-553; 11271, NME2, 57421, 159871, 151-609; 11271, NME2, 57422, 159872, 252-710; 11272, NME3, 57424, 159874, 1-174; 11272, NME3, 57425, 159875, 1-162; 11272, NME3, 57426, 159876, 358-615; 11272, NME3, 57427, 159877, 1-372; 11272, NME3, 57423, 159873, 197-706; 11273, NME4, 57429, 159879, 15-602; 11273, NME4, 57432, 159882, 24-725; 11273, NME4, 57433, 159883, 1-508; 11273, NME4, 57434, 159884, 609-719; 11273, NME4, 57435, 159885, 25-159; 11273, NME4, 57436, 159886, 32-493; 11273, NME4, 57428, 159878, 15-578; 11273, NME4, 57430, 159880, 475-828; 11273, NME4, 57431, 159881, 558-911; 11273, NME4, 57437, 159887, 429-782; 11274, NME6, 57439, 159889, 305-638; 11274, NME6, 57441, 159891, 43-291; 11274, NME6, 57444, 159894, 484-668; 11274, NME6, 57447, 159897, 151-399; 11274, NME6, 57448, 159898, 92-613; 11274, NME6, 57449, 159899, 81-506; 11274, NME6, 57450, 159900, 47-631; 11274, NME6, 57438, 159888, 239-799; 11274, NME6, 57440, 159890, 97-588; 11274, NME6, 57442, 159892, 50-409; 11274, NME6, 57443, 159893, 163-723; 11274, NME6, 57445, 159895, 79-639; 11274, NME6, 57446, 159896, 341-832; 11274, NME6, 57451, 159901, 9-569; 11275, NME1-NME2, 57452, 159902, 64-657; 11275, NME1-NME2, 57454, 159904, 177-1055; 11275, NME1-NME2, 57453, 159903, 78-881; 11276, MPG, 57458, 159908, 132-884; 11276, MPG, 57455, 159905, 232-1128; 11276, MPG, 57456, 159906, 248-1129; 11276, MPG, 57457, 159907, 120-965; 11277, NMRAL1, 57461, 159911, 168-731; 11277, NMRAL1, 57463, 159913, 133-306; 11277, NMRAL1, 57464, 159914, 1-573; 11277, NMRAL1, 57465, 159915, 335-460; 11277, NMRAL1, 57467, 159917, 1-672; 11277, NMRAL1, 57468, 159918, 1-375; 11277, NMRAL1, 57469, 159919, 1-480; 11277, NMRAL1, 57472, 159922, 1-375; 11277, NMRAL1, 57473, 159923, 133-306; 11277, NMRAL1, 57474, 159924, 1-672; 11277, NMRAL1, 57475, 159925, 1-480; 11277, NMRAL1, 57476, 159926, 168-731; 11277, NMRAL1, 57478, 159928, 335-460; 11277, NMRAL1, 57480, 159930, 1-573; 11277, NMRAL1, 57459, 159909, 377-1276; 11277, NMRAL1, 57460, 159910, 248-1147; 11277, NMRAL1, 57462, 159912, 731-1630; 11277, NMRAL1, 57466, 159916, 256-1155; 11277, NMRAL1, 57470, 159920, 377-1276; 11277, NMRAL1, 57471, 159921, 248-1147; 11277, NMRAL1, 57477, 159927, 256-1155; 11277, NMRAL1, 57479, 159929, 731-1630; 11278, NMI, 57482, 159932, 496-581; 11278, NMI, 57481, 159931, 472-1395; 11279, NDRG1, 57486, 159936, 3-582; 11279, NDRG1, 57487, 159937, 108-581; 11279, NDRG1, 57488, 159938, 259-558; 11279, NDRG1, 57489, 159939, 30-530; 11279, NDRG1, 57490, 159940, 123-548; 11279, NDRG1, 57491, 159941, 138-425; 11279, NDRG1, 57492, 159942, 77-550; 11279, NDRG1, 57493, 159943, 125-775; 11279, NDRG1, 57494, 159944, 310-709; 11279, NDRG1, 57495, 159945, 67-536; 11279, NDRG1, 57496, 159946, 235-729; 11279, NDRG1, 57497, 159947, 435-562; 11279, NDRG1, 57498, 159948, 138-449; 11279, NDRG1, 57483, 159933, 123-1307; 11279, NDRG1, 57484, 159934, 869-2053; 11279, NDRG1, 57485, 159935, 219-1205; 11279, NDRG1, 57499, 159949, 327-1268; 11280, NMT1, 57501, 159951, 11-424; 11280, NMT1, 57502, 159952, 1-266; 11280, NMT1, 57503, 159953, 342-558; 11280, NMT1, 57500, 159950, 19-1509; 11280, NMT1, 57504, 159954, 132-1622; 11281, NMT2, 57505, 159955, 99-1556; 11281, NMT2, 57506, 159956, 82-1578; 11282, NOBOX, 57507, 159957, 1-2076; 11282, NOBOX, 57508, 159958, 1-1980; 11283, NOC2L, 57509, 159959, 51-2300; 11284, NOC3L, 57510, 159960, 102-2504; 11285, NOCT, 57512, 159962, 187-690; 11285, NOCT, 57511, 159961, 194-1489; 11286, NODAL, 57514, 159964, 1-879; 11286, NODAL, 57513, 159963, 1-1044; 11287, NOMO1, 57516, 159966, 1-433; 11287, NOMO1, 57517, 159967, 429-3731; 11287, NOMO1, 57518, 159968, 73-3876; 11287, NOMO1, 57520, 159970, 429-3731; 11287, NOMO1, 57521, 159971, 73-3876; 11287, NOMO1, 57522, 159972, 1-433; 11287, NOMO1, 57515, 159965, 172-3840; 11287, NOMO1, 57519, 159969, 172-3840; 11288, NOMO2, 57526, 159976, 137-322; 11288, NOMO2, 57527, 159977, 1-242; 11288, NOMO2, 57528, 159978, 1-671; 11288, NOMO2, 57529, 159979, 35-451; 11288, NOMO2, 57531, 159981, 1-849; 11288, NOMO2, 57523, 159973, 172-3840; 11288, NOMO2, 57524, 159974, 67-3870; 11288, NOMO2, 57525, 159975, 429-3731; 11288, NOMO2, 57530, 159980, 73-3876; 11288, NOMO2, 57532, 159982, 73-3741; 11289, NOMO3, 57533, 159983, 67-3870; 11289, NOMO3, 57535, 159985, 35-451; 11289, NOMO3, 57536, 159986, 1-286; 11289, NOMO3, 57537, 159987, 1-152; 11289, NOMO3, 57538, 159988, 138-323; 11289, NOMO3, 57539, 159989, 1-242; 11289, NOMO3, 57540, 159990, 35-451; 11289, NOMO3, 57542, 159992, 67-3870; 11289, NOMO3, 57543, 159993, 1-286; 11289, NOMO3, 57544, 159994, 1-242; 11289, NOMO3, 57545, 159995, 1-152; 11289, NOMO3, 57546, 159996, 138-323; 11289, NOMO3, 57534, 159984, 173-3841; 11289, NOMO3, 57541, 159991, 173-3841; 11290, NOG, 57547, 159997, 526-1224; 11291, NIPA1, 57550, 160000, 1-271; 11291, NIPA1, 57552, 160002, 1-177; 11291, NIPA1, 57548, 159998, 26-1015; 11291, NIPA1, 57549, 159999, 1299-2063; 11291, NIPA1, 57551, 160001, 398-1162; 11292, NIPA2, 57558, 160008, 378-554; 11292, NIPA2, 57553, 160003, 614-1696; 11292, NIPA2, 57554, 160004, 506-1531; 11292, NIPA2, 57555, 160005, 329-1411; 11292, NIPA2, 57556, 160006, 511-1593; 11292, NIPA2, 57557, 160007, 318-1343; 11293, NCMAP, 57559, 160009, 67-375; 11294, NHEJ1, 57562, 160012, 1-675; 11294, NHEJ1, 57563, 160013, 47-734; 11294, NHEJ1, 57564, 160014, 147-299; 11294, NHEJ1, 57565, 160015, 80-778; 11294, NHEJ1, 57560, 160010, 135-1034; 11294, NHEJ1, 57561, 160011, 1-951; 11295, NONO, 57569, 160019, 105-726; 11295, NONO, 57570, 160020, 1-703; 11295, NONO, 57571, 160021, 250-622; 11295, NONO, 57572, 160022, 113-855; 11295, NONO, 57573, 160023, 295-491; 11295, NONO, 57566, 160016, 206-1621; 11295, NONO, 57567, 160017, 99-1514; 11295, NONO, 57568, 160018, 313-1728; 11295, NONO, 57574, 160024, 644-1792; 11296, NCAPD2, 57576, 160026, 86-2844; 11296, NCAPD2, 57577, 160027, 80-325; 11296, NCAPD2, 57578, 160028, 180-533; 11296, NCAPD2, 57575, 160025, 800-5005; 11297, NCAPG, 57580, 160030, 57-755; 11297, NCAPG, 57581, 160031, 1-807; 11297, NCAPG, 57579, 160029, 177-3224; 11298, NCAPH, 57584, 160034, 24-673; 11298, NCAPH, 57585, 160035, 30-1852; 11298, NCAPH, 57586, 160036, 296-2488; 11298, NCAPH, 57587, 160037, 1-547; 11298, NCAPH, 57582, 160032, 44-2269; 11298, NCAPH, 57583, 160033, 190-2007; 11299, NCAPD3, 57588, 160038, 16-243; 11299, NCAPD3, 57589, 160039, 433-537; 11299, NCAPD3, 57590, 160040, 291-2789; 11299, NCAPD3, 57591, 160041, 190-773; 11299, NCAPD3, 57593, 160043, 607-3861; 11299, NCAPD3, 57594, 160044, 729-1521; 11299, NCAPD3, 57595, 160045, 607-720; 11299, NCAPD3, 57596, 160046, 433-532; 11299, NCAPD3, 57597, 160047, 334-555; 11299, NCAPD3, 57592, 160042, 66-4562; 11300, NCAPG2, 57601, 160051, 1-2696; 11300, NCAPG2, 57602, 160052, 196-1365; 11300, NCAPG2, 57598, 160048, 146-3577; 11300, NCAPG2, 57599, 160049, 174-3605; 11300, NCAPG2, 57600, 160050, 115-3585; 11301, NCAPH2, 57605, 160055, 95-1864; 11301, NCAPH2, 57607, 160057, 80-268; 11301, NCAPH2, 57608, 160058, 93-970; 11301, NCAPH2, 57609, 160059, 94-210; 11301, NCAPH2, 57610, 160060, 1-425; 11301, NCAPH2, 57603, 160053, 79-1899; 11301, NCAPH2, 57604, 160054, 96-995; 11301, NCAPH2, 57606, 160056, 123-1940; 11302, NCCRP1, 57611, 160061, 23-850; 11303, NOP10, 57613, 160063, 51-161; 11303, NOP10, 57612, 160062, 105-299; 11304, NOP14, 57617, 160067, 38-2404; 11304, NOP14, 57614, 160064, 50-2623; 11304, NOP14, 57615, 160065, 15-2435; 11304, NOP14, 57616, 160066, 67-2640; 11305, NOP16, 57618, 160068, 49-336; 11305, NOP16, 57619, 160069, 30-482; 11305, NOP16, 57620, 160070, 37-249; 11305, NOP16, 57621, 160071, 224-919; 11305, NOP16, 57624, 160074, 462-1172; 11305, NOP16, 57625, 160075, 224-937; 11305, NOP16, 57622, 160072, 437-973; 11305, NOP16, 57623, 160073, 389-1087; 11306, NOP2, 57630, 160080, 256-1080; 11306, NOP2, 57631, 160081, 181-657; 11306, NOP2, 57632, 160082, 124-369; 11306, NOP2, 57633, 160083, 160-689; 11306, NOP2, 57634, 160084, 98-848; 11306, NOP2, 57636, 160086, 142-438; 11306, NOP2, 57638, 160088, 164-409; 11306, NOP2, 57639, 160089, 1-2568; 11306, NOP2, 57626, 160076, 123-2561; 11306, NOP2, 57627, 160077, 77-2614; 11306, NOP2, 57628, 160078, 153-2579; 11306, NOP2, 57629, 160079, 81-1967; 11306, NOP2, 57635, 160085, 490-2916; 11306, NOP2, 57637, 160087, 45-2483; 11306, NOP2, 57640, 160090, 131-2668; 11306, NOP2, 57641, 160091, 131-2017; 11307, NSUN3, 57643, 160093, 148-381; 11307, NSUN3, 57642, 160092, 212-1234; 11308, NSUN4, 57646, 160096, 39-494; 11308, NSUN4, 57647, 160097, 1-410; 11308, NSUN4, 57648, 160098, 9-1967; 11308, NSUN4, 57649, 160099, 8-328; 11308, NSUN4, 57650, 160100, 26-190; 11308, NSUN4, 57644, 160094, 651-1805; 11308, NSUN4, 57645, 160095, 734-1741; 11309, NSUN5, 57655, 160105, 1-176; 11309, NSUN5, 57651, 160101, 17-1306; 11309, NSUN5, 57652, 160102, 27-1439; 11309, NSUN5, 57653, 160103, 78-1478; 11309, NSUN5, 57654, 160104, 15-1190; 11310, NSUN6, 57657, 160107, 132-578; 11310, NSUN6, 57658, 160108, 167-274; 11310, NSUN6, 57656, 160106, 420-1829; 11311, NSUN7, 57659, 160109, 468-1895; 11311, NSUN7, 57660, 160110, 496-2652; 11312, NSUN2, 57663, 160113, 313-921; 11312, NSUN2, 57664, 160114, 1-308; 11312, NSUN2, 57661, 160111, 313-2616; 11312, NSUN2, 57662, 160112, 64-2262; 11313, N0P56, 57666, 160116, 13-856; 11313, N0P56, 57667, 160117, 1-659; 11313, N0P56, 57668, 160118, 1-757; 11313, N0P56, 57665, 160115, 517-2301; 11314, N0P58, 57670, 160120, 1-564; 11314, N0P58, 57671, 160121, 207-413; 11314, N0P58, 57669, 160119, 227-1816; 11315, NOP9, 57674, 160124, 1-293; 11315, NOP9, 57672, 160122, 94-2004; 11315, NOP9, 57673, 160123, 77-1684; 11316, NDP, 57675, 160125, 409-810; 11317, NOTCH1, 57676, 160126, 77-7744; 11318, NOTCH2, 57678, 160128, 447-1154; 11318, NOTCH2, 57679, 160129, 277-2868; 11318, NOTCH2, 57680, 160130, 447-1157; 11318, NOTCH2, 57677, 160127, 221-7636; 11319, NOTCH2NL, 57681, 160131, 363-1073; 11319, NOTCH2NL, 57682, 160132, 445-1155; 11319, NOTCH2NL, 57683, 160133, 363-1055; 11320, NOTCH3, 57685, 160135, 1-532; 11320, NOTCH3, 57686, 160136, 1-353; 11320, NOTCH3, 57687, 160137, 1-3858; 11320, NOTCH3, 57684, 160134, 77-7042; 11321, NOTCH4, 57689, 160139, 140-6151; 11321, NOTCH4, 57690, 160140, 140-6148; 11321, NOTCH4, 57694, 160144, 140-6157; 11321, NOTCH4, 57688, 160138, 140-6151; 11321, NOTCH4, 57691, 160141, 1-3147; 11321, NOTCH4, 57692, 160142, 140-6151; 11321, NOTCH4, 57693, 160143, 140-6151; 11322, NLE1, 57695, 160145, 29-1360; 11322, NLE1, 57697, 160147, 23-286; 11322, NLE1, 57699, 160149, 1-914; 11322, NLE1, 57700, 160150, 30-413; 11322, NLE1, 57696, 160146, 41-1498; 11322, NLE1, 57698, 160148, 1021-1602; 11323, NRARP, 57701, 160151, 324-668; 11324, NOTO, 57702, 160152, 410-1165; 11325, NOTUM, 57704, 160154, 110-996; 11325, NOTUM, 57705, 160155, 222-813; 11325, NOTUM, 57703, 160153, 385-1875; 11326, NPC1L1, 57707, 160157, 57-4055; 11326, NPC1L1, 57709, 160159, 57-3917; 11326, NPC1L1, 57706, 160156, 57-4136; 11326, NPC1L1, 57708, 160158, 57-2231; 11327, NPHP3-ACAD11, 57710, 160160, 60-512; 11327, NPHP3-ACAD11, 57711, 160161, 105-2015; 11327, NPHP3-ACAD11, 57712, 160162, 1-695; 11328, NPLOC4, 57715, 160165, 1-518; 11328, NPLOC4, 57716, 160166, 1-436; 11328, NPLOC4, 57717, 160167, 1-333; 11328, NPLOC4, 57718, 160168, 1-549; 11328, NPLOC4, 57719, 160169, 1-176; 11328, NPLOC4, 57720, 160170, 150-557; 11328, NPLOC4, 57721, 160171, 206-376; 11328, NPLOC4, 57722, 160172, 256-426; 11328, NPLOC4, 57723, 160173, 1-405; 11328, NPLOC4, 57713, 160163, 217-2043; 11328, NPLOC4, 57714, 160164, 131-1984; 11329, NPRL2, 57725, 160175, 130-393; 11329, NPRL2, 57726, 160176, 103-366; 11329, NPRL2, 57727, 160177, 130-393; 11329, NPRL2, 57728, 160178, 130-393; 11329, NPRL2, 57729, 160179, 53-226; 11329, NPRL2, 57730, 160180, 94-267; 11329, NPRL2, 57724, 160174, 440-1582; 11330, NPRL3, 57731, 160181, 246-1880; 11330, NPRL3, 57732, 160182, 95-304; 11330, NPRL3, 57733, 160183, 69-616; 11330, NPRL3, 57734, 160184, 104-364; 11330, NPRL3, 57735, 160185, 95-271; 11330, NPRL3, 57736, 160186, 79-267; 11330, NPRL3, 57737, 160187, 318-922; 11330, NPRL3, 57738, 160188, 404-613; 11330, NPRL3, 57739, 160189, 83-316; 11330, NPRL3, 57740, 160190, 287-1996; 11330, NPRL3, 57741, 160191, 287-1996; 11331, NRDE2, 57743, 160193, 7-138; 11331, NRDE2, 57744, 160194, 1-612; 11331, NRDE2, 57745, 160195, 1-682; 11331, NRDE2, 57746, 160196, 1-132; 11331, NRDE2, 57742, 160192, 234-3728; 11332, NSA2, 57747, 160197, 371-940; 11332, NSA2, 57748, 160198, 1-295; 11332, NSA2, 57749, 160199, 370-1152; 11333, NSMCE1, 57751, 160201, 252-472; 11333, NSMCE1, 57752, 160202, 67-279; 11333, NSMCE1, 57753, 160203, 283-495; 11333, NSMCE1, 57754, 160204, 192-625; 11333, NSMCE1, 57755, 160205, 80-493; 11333, NSMCE1, 57756, 160206, 1-237; 11333, NSMCE1, 57757, 160207, 47-626; 11333, NSMCE1, 57750, 160200, 101-901; 11334, NSMCE2, 57759, 160209, 200-763; 11334, NSMCE2, 57760, 160210, 1-285; 11334, NSMCE2, 57761, 160211, 370-787; 11334, NSMCE2, 57762, 160212, 263-841; 11334, NSMCE2, 57763, 160213, 191-433; 11334, NSMCE2, 57765, 160215, 272-405; 11334, NSMCE2, 57766, 160216, 226-699; 11334, NSMCE2, 57767, 160217, 168-641; 11334, NSMCE2, 57758, 160208, 217-960; 11334, NSMCE2, 57764, 160214, 104-847; 11335, NSMCE4A, 57768, 160218, 30-980; 11335, NSMCE4A, 57769, 160219, 53-1210; 11336, NSFL1C, 57773, 160223, 1-825; 11336, NSFL1C, 57774, 160224, 12-119; 11336, NSFL1C, 57775, 160225, 82-189; 11336, NSFL1C, 57776, 160226, 6-221; 11336, NSFL1C, 57777, 160227, 1-318; 11336, NSFL1C, 57770, 160220, 869-1981; 11336, NSFL1C, 57771, 160221, 5-1024; 11336, NSFL1C, 57772, 160222, 95-1213; 11337, NSL1, 57778, 160228, 20-538; 11337, NSL1, 57780, 160230, 128-355; 11337, NSL1, 57779, 160229, 20-865; 11337, NSL1, 57781, 160231, 14-655; 11338, SGSH, 57783, 160233, 26-850; 11338, SGSH, 57784, 160234, 48-731; 11338, SGSH, 57785, 160235, 1-320; 11338, SGSH, 57786, 160236, 21-583; 11338, SGSH, 57787, 160237, 1-204; 11338, SGSH, 57788, 160238, 216-546; 11338, SGSH, 57789, 160239, 21-347; 11338, SGSH, 57790, 160240, 1-581; 11338, SGSH, 57782, 160232, 88-1596; 11339, NT5C1B-RDH14, 57791, 160241, 97-1695; 11339, NT5C1B-RDH14, 57792, 160242, 95-1903; 11340, NTAN1, 57794, 160244, 1-57; 11340, NTAN1, 57795, 160245, 69-738; 11340, NTAN1, 57796, 160246, 230-667; 11340, NTAN1, 57797, 160247, 1-84; 11340, NTAN1, 57798, 160248, 57-194; 11340, NTAN1, 57799, 160249, 57-194; 11340, NTAN1, 57800, 160250, 255-872; 11340, NTAN1, 57801, 160251, 255-872; 11340, NTAN1, 57803, 160253, 321-938; 11340, NTAN1, 57804, 160254, 230-667; 11340, NTAN1, 57805, 160255, 69-738; 11340, NTAN1, 57806, 160256, 1-84; 11340, NTAN1, 57807, 160257, 1-57; 11340, NTAN1, 57793, 160243, 94-1026; 11340, NTAN1, 57802, 160252, 94-1026; 11341, NECAB1, 57808, 160258, 338-1393; 11341, NECAB1, 57809, 160259, 271-573; 11341, NECAB1, 57810, 160260, 203-505; 11342, NECAB2, 57812, 160262, 1-549; 11342, NECAB2, 57813, 160263, 1-187; 11342, NECAB2, 57814, 160264, 723-1634; 11342, NECAB2, 57811, 160261, 18-1178; 11343, NECAB3, 57817, 160267, 58-925; 11343, NECAB3, 57818, 160268, 38-616; 11343, NECAB3, 57819, 160269, 8-900; 11343, NECAB3, 57820, 160270, 15-230; 11343, NECAB3, 57821, 160271, 356-732; 11343, NECAB3, 57822, 160272, 69-233; 11343, NECAB3, 57823, 160273, 57-689; 11343, NECAB3, 57824, 160274, 1-287; 11343, NECAB3, 57815, 160265, 57-1247; 11343, NECAB3, 57816, 160266, 112-1200; 11344, NTMT1, 57829, 160279, 199-606; 11344, NTMT1, 57830, 160280, 176-388; 11344, NTMT1, 57831, 160281, 151-480; 11344, NTMT1, 57834, 160284, 272-679; 11344, NTMT1, 57825, 160275, 153-824; 11344, NTMT1, 57826, 160276, 146-583; 11344, NTMT1, 57827, 160277, 178-849; 11344, NTMT1, 57828, 160278, 350-1021; 11344, NTMT1, 57832, 160282, 163-834; 11344, NTMT1, 57833, 160283, 224-895; 11345, NTHL1, 57836, 160286, 1-710; 11345, NTHL1, 57837, 160287, 1-655; 11345, NTHL1, 57838, 160288, 1-301; 11345, NTHL1, 57835, 160285, 20-958; 11346, NKPD1, 57839, 160289, 1-2499; 11346, NKPD1, 57840, 160290, 213-2045; 11346, NKPD1, 57841, 160291, 83-1915; 11347, NUAK1, 57843, 160293, 194-547; 11347, NUAK1, 57844, 160294, 104-560; 11347, NUAK1, 57845, 160295, 347-569; 11347, NUAK1, 57842, 160292, 1381-3366; 11348, NUAK2, 57846, 160296, 32-2050; 11349, NAIF1, 57847, 160297, 221-1204; 11350, NAF1, 57850, 160300, 54-182; 11350, NAF1, 57848, 160298, 195-1679; 11350, NAF1, 57849, 160299, 164-1333; 11351, NASP, 57853, 160303, 85-1353; 11351, NASP, 57854, 160304, 159-275; 11351, NASP, 57855, 160305, 107-874; 11351, NASP, 57856, 160306, 103-219; 11351, NASP, 57857, 160307, 90-894; 11351, NASP, 57858, 160308, 1-526; 11351, NASP, 57859, 160309, 106-276; 11351, NASP, 57860, 160310, 103-270; 11351, NASP, 57861, 160311, 103-219; 11351, NASP, 57862, 160312, 103-273; 11351, NASP, 57863, 160313, 106-219; 11351, NASP, 57864, 160314, 87-1036; 11351, NASP, 57865, 160315, 103-565; 11351, NASP, 57866, 160316, 1-866; 11351, NASP, 57867, 160317, 103-532; 11351, NASP, 57869, 160319, 83-253; 11351, NASP, 57851, 160301, 88-2454; 11351, NASP, 57852, 160302, 83-1432; 11351, NASP, 57868, 160318, 160-2334; 11352, NCBP1, 57870, 160320, 1-466; 11352, NCBP1, 57872, 160322, 215-463; 11352, NCBP1, 57873, 160323, 1-249; 11352, NCBP1, 57871, 160321, 257-2629; 11353, NCBP2, 57875, 160325, 316-564; 11353, NCBP2, 57876, 160326, 331-591; 11353, NCBP2, 57878, 160328, 503-548; 11353, NCBP2, 57880, 160330, 351-611; 11353, NCBP2, 57881, 160331, 92-256; 11353, NCBP2, 57874, 160324, 95-565; 11353, NCBP2, 57877, 160327, 58-369; 11353, NCBP2, 57879, 160329, 483-899; 11354, NCBP2L, 57882, 160332, 199-660; 11355, NCBP3, 57884, 160334, 1-243; 11355, NCBP3, 57885, 160335, 1-109; 11355, NCBP3, 57883, 160333, 29-1891; 11356, NUCKS1, 57886, 160336, 304-1035; 11357, NEMP1, 57889, 160339, 19-351; 11357, NEMP1, 57887, 160337, 25-1359; 11357, NEMP1, 57888, 160338, 19-1134; 11358, NEMP2, 57890, 160340, 24-281; 11358, NEMP2, 57892, 160342, 1-108; 11358, NEMP2, 57894, 160344, 360-432; 11358, NEMP2, 57891, 160341, 68-1321; 11358, NEMP2, 57893, 160343, 449-865; 11359, NEMF, 57896, 160346, 36-570; 11359, NEMF, 57897, 160347, 69-434; 11359, NEMF, 57898, 160348, 34-3029; 11359, NEMF, 57895, 160345, 451-3681; 11360, NFIA, 57899, 160349, 39-1181; 11360, NFIA, 57900, 160350, 45-1508; 11360, NFIA, 57903, 160353, 113-1711; 11360, NFIA, 57906, 160356, 70-1470; 11360, NFIA, 57907, 160357, 1-286; 11360, NFIA, 57908, 160358, 172-730; 11360, NFIA, 57909, 160359, 10-483; 11360, NFIA, 57910, 160360, 1-552; 11360, NFIA, 57911, 160361, 1-142; 11360, NFIA, 57901, 160351, 172-1668; 11360, NFIA, 57902, 160352, 83-1747; 11360, NFIA, 57904, 160354, 485-2014; 11360, NFIA, 57905, 160355, 353-1858; 11361, NFIB, 57912, 160362, 447-1049; 11361, NFIB, 57913, 160363, 329-835; 11361, NFIB, 57914, 160364, 353-1693; 11361, NFIB, 57917, 160367, 559-2244; 11361, NFIB, 57918, 160368, 1072-2535; 11361, NFIB, 57919, 160369, 1009-2721; 11361, NFIB, 57921, 160371, 92-591; 11361, NFIB, 57922, 160372, 381-557; 11361, NFIB, 57923, 160373, 453-1019; 11361, NFIB, 57915, 160365, 157-1641; 11361, NFIB, 57916, 160366, 475-1737; 11361, NFIB, 57920, 160370, 339-1268; 11362, NFIC, 57924, 160374, 89-1375; 11362, NFIC, 57925, 160375, 37-1329; 11362, NFIC, 57926, 160376, 52-1578; 11362, NFIC, 57927, 160377, 1-1221; 11362, NFIC, 57928, 160378, 121-1620; 11362, NFIC, 57929, 160379, 55-1374; 11363, NFIX, 57930, 160380, 66-1277; 11363, NFIX, 57931, 160381, 66-1277; 11363, NFIX, 57933, 160383, 33-582; 11363, NFIX, 57934, 160384, 194-579; 11363, NFIX, 57936, 160386, 175-480; 11363, NFIX, 57937, 160387, 219-1586; 11363, NFIX, 57939, 160389, 61-240; 11363, NFIX, 57941, 160391, 212-587; 11363, NFIX, 57932, 160382, 231-1556; 11363, NFIX, 57935, 160385, 42-1343; 11363, NFIX, 57938, 160388, 1-1509; 11363, NFIX, 57940, 160390, 59-1381; 11363, NFIX, 57942, 160392, 1-1485; 11364, NFAT5, 57946, 160396, 1209-1508; 11364, NFAT5, 57947, 160397, 277-636; 11364, NFAT5, 57950, 160400, 1-430; 11364, NFAT5, 57951, 160401, 1-426; 11364, NFAT5, 57943, 160393, 681-5048; 11364, NFAT5, 57944, 160394, 319-4914; 11364, NFAT5, 57945, 160395, 385-4752; 11364, NFAT5, 57948, 160398, 242-4609; 11364, NFAT5, 57949, 160399, 241-4887; 11364, NFAT5, 57952, 160402, 95-4744; 11365, NFATC1, 57958, 160408, 397-1812; 11365, NFATC1, 57963, 160413, 62-277; 11365, NFATC1, 57964, 160414, 95-2014; 11365, NFATC1, 57953, 160403, 370-2847; 11365, NFATC1, 57954, 160404, 71-2509; 11365, NFATC1, 57955, 160405, 57-2849; 11365, NFATC1, 57956, 160406, 599-1660; 11365, NFATC1, 57957, 160407, 1-2832; 11365, NFATC1, 57959, 160409, 1-2142; 11365, NFATC1, 57960, 160410, 296-2446; 11365, NFATC1, 57961, 160411, 1-2103; 11365, NFATC1, 57962, 160412, 60-2171; 11366, NFATC2, 57965, 160415, 221-2986; 11366, NFATC2, 57966, 160416, 221-2998; 11366, NFATC2, 57967, 160417, 1-2706; 11366, NFATC2, 57968, 160418, 364-2472; 11366, NFATC2, 57969, 160419, 286-2394; 11366, NFATC2, 57970, 160420, 203-2920; 11367, NFATC2IP, 57973, 160423, 93-515; 11367, NFATC2IP, 57971, 160421, 76-1335; 11367, NFATC2IP, 57972, 160422, 358-741; 11368, NFATC3, 57977, 160427, 242-358; 11368, NFATC3, 57978, 160428, 294-410; 11368, NFATC3, 57979, 160429, 317-433; 11368, NFATC3, 57980, 160430, 1-3160; 11368, NFATC3, 57981, 160431, 237-362; 11368, NFATC3, 57982, 160432, 1-3181; 11368, NFATC3, 57983, 160433, 1-504; 11368, NFATC3, 57984, 160434, 339-3482; 11368, NFATC3, 57974, 160424, 225-3422; 11368, NFATC3, 57975, 160425, 25-3252; 11368, NFATC3, 57976, 160426, 25-3231; 11369, NFATC4, 58006, 160456, 130-559; 11369, NFATC4, 58007, 160457, 156-573; 11369, NFATC4, 58011, 160461, 315-904; 11369, NFATC4, 57985, 160435, 142-2850; 11369, NFATC4, 57986, 160436, 83-2827; 11369, NFATC4, 57987, 160437, 145-3039; 11369, NFATC4, 57988, 160438, 161-2830; 11369, NFATC4, 57989, 160439, 224-3025; 11369, NFATC4, 57990, 160440, 457-2955; 11369, NFATC4, 57991, 160441, 1-2706; 11369, NFATC4, 57992, 160442, 83-2506; 11369, NFATC4, 57993, 160443, 147-2819; 11369, NFATC4, 57994, 160444, 457-2631; 11369, NFATC4, 57995, 160445, 393-1382; 11369, NFATC4, 57996, 160446, 322-2706; 11369, NFATC4, 57997, 160447, 393-1706; 11369, NFATC4, 57998, 160448, 83-2830; 11369, NFATC4, 57999, 160449, 457-2952; 11369, NFATC4, 58000, 160450, 393-1703; 11369, NFATC4, 58001, 160451, 161-2509; 11369, NFATC4, 58002, 160452, 608-856; 11369, NFATC4, 58003, 160453, 86-2566; 11369, NFATC4, 58004, 160454, 608-1180; 11369, NFATC4, 58005, 160455, 608-1177; 11369, NFATC4, 58008, 160458, 117-2690; 11369, NFATC4, 58009, 160459, 120-2924; 11369, NFATC4, 58010, 160460, 186-2684; 11370, NFKB1, 58014, 160464, 388-609; 11370, NFKB1, 58015, 160465, 124-557; 11370, NFKB1, 58017, 160467, 163-751; 11370, NFKB1, 58018, 160468, 371-965; 11370, NFKB1, 58012, 160462, 468-3377; 11370, NFKB1, 58013, 160463, 466-3372; 11370, NFKB1, 58016, 160466, 278-3184; 11370, NFKB1, 58019, 160469, 1140-3506; 11371, NFKB2, 58023, 160473, 519-585; 11371, NFKB2, 58024, 160474, 268-472; 11371, NFKB2, 58025, 160475, 164-1411; 11371, NFKB2, 58020, 160470, 164-2863; 11371, NFKB2, 58021, 160471, 251-2953; 11371, NFKB2, 58022, 160472, 564-3263; 11372, NFKBIA, 58027, 160477, 386-1069; 11372, NFKBIA, 58028, 160478, 73-321; 11372, NFKBIA, 58029, 160479, 103-927; 11372, NFKBIA, 58030, 160480, 7-212; 11372, NFKBIA, 58026, 160476, 103-1056; 11373, NFKBIB, 58032, 160482, 120-932; 11373, NFKBIB, 58033, 160483, 54-251; 11373, NFKBIB, 58034, 160484, 96-543; 11373, NFKBIB, 58036, 160486, 120-820; 11373, NFKBIB, 58037, 160487, 96-543; 11373, NFKBIB, 58038, 160488, 54-251; 11373, NFKBIB, 58039, 160489, 35-1105; 11373, NFKBIB, 58040, 160490, 82-1098; 11373, NFKBIB, 58041, 160491, 120-932; 11373, NFKBIB, 58042, 160492, 120-820; 11373, NFKBIB, 58031, 160481, 35-1105; 11373, NFKBIB, 58035, 160485, 82-1098; 11374, NFKBID, 58044, 160494, 587-1036; 11374, NFKBID, 58045, 160495, 1-197; 11374, NFKBID, 58043, 160493, 575-1516; 11374, NFKBID, 58046, 160496, 477-1418; 11375, NFKBIE, 58048, 160498, 1-168; 11375,

NFKBIE, 58049, 160499, 248-673; 11375, NFKBIE, 58050, 160500, 26-1525; 11375, NFKBIE, 58051, 160501, 189-1274; 11375, NFKBIE, 58047, 160497, 26-1528; 11376, NFKBIZ, 58055, 160505, 176-564; 11376, NFKBIZ, 58056, 160506, 1008-1338; 11376, NFKBIZ, 58057, 160507, 204-2006; 11376, NFKBIZ, 58058, 160508, 1-392; 11376, NFKBIZ, 58052, 160502, 116-1906; 11376, NFKBIZ, 58053, 160503, 116-2272; 11376, NFKBIZ, 58054, 160504, 280-2136; 11377, NFKBIL1, 58059, 160509, 83-1183; 11377, NFKBIL1, 58060, 160510, 117-1193; 11377, NFKBIL1, 58080, 160530, 35-700; 11377, NFKBIL1, 58081, 160531, 56-433; 11377, NFKBIL1, 58082, 160532, 56-433; 11377, NFKBIL1, 58061, 160511, 115-1260; 11377, NFKBIL1, 58062, 160512, 83-1183; 11377, NFKBIL1, 58063, 160513, 117-1193; 11377, NFKBIL1, 58064, 160514, 115-1260; 11377, NFKBIL1, 58065, 160515, 115-1260; 11377, NFKBIL1, 58066, 160516, 115-1260; 11377, NFKBIL1, 58067, 160517, 117-1193; 11377, NFKBIL1, 58068, 160518, 115-1260; 11377, NFKBIL1, 58069, 160519, 83-1183; 11377, NFKBIL1, 58070, 160520, 117-1193; 11377, NFKBIL1, 58071, 160521, 83-1183; 11377, NFKBIL1, 58072, 160522, 117-1193; 11377, NFKBIL1, 58073, 160523, 115-1260; 11377, NFKBIL1, 58074, 160524, 117-1193; 11377, NFKBIL1, 58075, 160525, 115-1260; 11377, NFKBIL1, 58076, 160526, 83-1183; 11377, NFKBIL1, 58077, 160527, 117-1193; 11377, NFKBIL1, 58078, 160528, 83-1183; 11377, NFKBIL1, 58079, 160529, 83-1183; 11378, NFRKB, 58084, 160534, 293-568; 11378, NFRKB, 58085, 160535, 375-938; 11378, NFRKB, 58086, 160536, 28-396; 11378, NFRKB, 58087, 160537, 105-3066; 11378, NFRKB, 58089, 160539, 117-559; 11378, NFRKB, 58090, 160540, 425-564; 11378, NFRKB, 58091, 160541, 280-843; 11378, NFRKB, 58083, 160533, 105-4004; 11378, NFRKB, 58088, 160538, 194-4093; 11378, NFRKB, 58092, 160542, 122-4096; 11379, NFE2, 58096, 160546, 178-1208; 11379, NFE2, 58093, 160543, 274-1395; 11379, NFE2, 58094, 160544, 378-1499; 11379, NFE2, 58095, 160545, 511-1632; 11379, NFE2, 58097, 160547, 402-1523; 11380, NFE2L1, 58100, 160550, 605-2890; 11380, NFE2L1, 58101, 160551, 310-2160; 11380, NFE2L1, 58103, 160553, 1-402; 11380, NFE2L1, 58104, 160554, 541-568; 11380, NFE2L1, 58105, 160555, 542-552; 11380, NFE2L1, 58106, 160556, 182-372; 11380, NFE2L1, 58107, 160557, 375-562; 11380, NFE2L1, 58108, 160558, 531-588; 11380, NFE2L1, 58109, 160559, 35-1756; 11380, NFE2L1, 58110, 160560, 282-529; 11380, NFE2L1, 58111, 160561, 441-583; 11380, NFE2L1, 58112, 160562, 100-583; 11380, NFE2L1, 58113, 160563, 259-556; 11380, NFE2L1, 58114, 160564, 444-512; 11380, NFE2L1, 58115, 160565, 142-476; 11380, NFE2L1, 58116, 160566, 52-1806; 11380, NFE2L1, 58098, 160548, 606-2834; 11380, NFE2L1, 58099, 160549, 617-2935; 11380, NFE2L1, 58102, 160552, 316-2544; 11381, NFE2L2, 58119, 160569, 248-451; 11381, NFE2L2, 58120, 160570, 113-909; 11381, NFE2L2, 58121, 160571, 135-975; 11381, NFE2L2, 58122, 160572, 56-481; 11381, NFE2L2, 58124, 160574, 276-979; 11381, NFE2L2, 58125, 160575, 1-144; 11381, NFE2L2, 58126, 160576, 148-942; 11381, NFE2L2, 58128, 160578, 376-814; 11381, NFE2L2, 58117, 160567, 556-2373; 11381, NFE2L2, 58118, 160568, 402-2171; 11381, NFE2L2, 58123, 160573, 174-1922; 11381, NFE2L2, 58127, 160577, 503-2272; 11382, NFE2L3, 58130, 160580, 1-252; 11382, NFE2L3, 58129, 160579, 260-2344; 11383, NFIL3, 58131, 160581, 396-1784; 11384, NUFIP1, 58132, 160582, 48-1535; 11385, NUFIP2, 58133, 160583, 60-2147; 11385, NUFIP2, 58134, 160584, 57-419; 11386, NUGGC, 58135, 160585, 123-352; 11386, NUGGC, 58136, 160586, 144-2534; 11387, NUMA1, 58139, 160589, 310-583; 11387, NUMA1, 58141, 160591, 314-539; 11387, NUMA1, 58142, 160592, 336-583; 11387, NUMA1, 58143, 160593, 104-582; 11387, NUMA1, 58144, 160594, 353-874; 11387, NUMA1, 58145, 160595, 124-600; 11387, NUMA1, 58146, 160596, 279-606; 11387, NUMA1, 58147, 160597, 309-911; 11387, NUMA1, 58148, 160598, 1-2894; 11387, NUMA1, 58149, 160599, 372-589; 11387, NUMA1, 58150, 160600, 400-582; 11387, NUMA1, 58151, 160601, 112-280; 11387, NUMA1, 58152, 160602, 131-792; 11387, NUMA1, 58153, 160603, 258-2331; 11387, NUMA1, 58154, 160604, 139-576; 11387, NUMA1, 58155, 160605, 406-582; 11387, NUMA1, 58156, 160606, 212-2766; 11387, NUMA1, 58157, 160607, 1-1060; 11387, NUMA1, 58160, 160610, 45-6344; 11387, NUMA1, 58137, 160587, 173-3112; 11387, NUMA1, 58138, 160588, 259-6564; 11387, NUMA1, 58140, 160590, 333-6680; 11387, NUMA1, 58158, 160608, 45-6350; 11387, NUMA1, 58159, 160609, 339-3278; 11388, NPAP1, 58161, 160611, 1-3471; 11389, NPIPA1, 58163, 160613, 1-657; 11389, NPIPA1, 58164, 160614, 1-557; 11389, NPIPA1, 58165, 160615, 1-696; 11389, NPIPA1, 58166, 160616, 1-1110; 11389, NPIPA1, 58167, 160617, 1-654; 11389, NPIPA1, 58168, 160618, 1-557; 11389, NPIPA1, 58162, 160612, 1-1053; 11390, NPIPA2, 58170, 160620, 1-954; 11390, NPIPA2, 58171, 160621, 1-1053; 11390, NPIPA2, 58169, 160619, 1-1110; 11391, NPIPA3, 58172, 160622, 1-954; 11391, NPIPA3, 58173, 160623, 1-1110; 11391, NPIPA3, 58175, 160625, 1-1053; 11391, NPIPA3, 58176, 160626, 1-1053; 11391, NPIPA3, 58177, 160627, 1-1053; 11391, NPIPA3, 58178, 160628, 1-1110; 11391, NPIPA3, 58179, 160629, 1-954; 11391, NPIPA3, 58174, 160624, 1-1053; 11392, NPIPA5, 58181, 160631, 1-954; 11392, NPIPA5, 58183, 160633, 70-1122; 11392, NPIPA5, 58180, 160630, 1-1053; 11392, NPIPA5, 58182, 160632, 1-699; 11393, NPIPA7, 58184, 160634, 1-170; 11393, NPIPA7, 58185, 160635, 191-1300; 11393, NPIPA7, 58186, 160636, 1-1110; 11394, NPIPA8, 58189, 160639, 1-391; 11394, NPIPA8, 58187, 160637, 430-1539; 11394, NPIPA8, 58188, 160638, 1-1110; 11395, NPIPB11, 58191, 160641, 55-807; 11395, NPIPB11, 58190, 160640, 76-3561; 11396, NPIPB15, 58192, 160642, 97-1428; 11397, NPIPB3, 58193, 160643, 55-807; 11397, NPIPB3, 58194, 160644, 157-910; 11397, NPIPB3, 58195, 160645, 389-679; 11397, NPIPB3, 58196, 160646, 177-490; 11397, NPIPB3, 58198, 160648, 181-1254; 11397, NPIPB3, 58197, 160647, 33-1295; 11398, NPIPB4, 58199, 160649, 280-767; 11398, NPIPB4, 58201, 160651, 130-279; 11398, NPIPB4, 58202, 160652, 132-576; 11398, NPIPB4, 58203, 160653, 63-212; 11398, NPIPB4, 58204, 160654, 33-1295; 11398, NPIPB4, 58205, 160655, 173-322; 11398, NPIPB4, 58206, 160656, 244-513; 11398, NPIPB4, 58207, 160657, 458-544; 11398, NPIPB4, 58208, 160658, 62-184; 11398, NPIPB4, 58209, 160659, 319-400; 11398, NPIPB4, 58210, 160660, 55-807; 11398, NPIPB4, 58200, 160650, 41-3457; 11399, NPIPB5, 58211, 160661, 33-1295; 11399, NPIPB5, 58212, 160662, 280-3660; 11399, NPIPB5, 58213, 160663, 43-192; 11399, NPIPB5, 58214, 160664, 128-277; 11399, NPIPB5, 58216, 160666, 121-1906; 11399, NPIPB5, 58217, 160667, 257-379; 11399, NPIPB5, 58218, 160668, 519-551; 11399, NPIPB5, 58219, 160669, 173-322; 11399, NPIPB5, 58221, 160671, 363-597; 11399, NPIPB5, 58222, 160672, 62-184; 11399, NPIPB5, 58223, 160673, 398-711; 11399, NPIPB5, 58224, 160674, 280-638; 11399, NPIPB5, 58225, 160675, 503-543; 11399, NPIPB5, 58226, 160676, 483-2268; 11399, NPIPB5, 58227, 160677, 245-394; 11399, NPIPB5, 58228, 160678, 1-207; 11399, NPIPB5, 58229, 160679, 55-807; 11399, NPIPB5, 58215, 160665, 76-3477; 11399, NPIPB5, 58220, 160670, 280-3681; 11400, NPIPB6, 58231, 160681, 54-1277; 11400, NPIPB6, 58230, 160680, 687-1964; 11401, NPIPB7, 58233, 160683, 1-1266; 11401, NPIPB7, 58232, 160682, 110-1354; 11402, NPIPB8, 58234, 160684, 1-435; 11402, NPIPB8, 58235, 160685, 708-2006; 11403, NPIPB9, 58236, 160686, 1041-1985; 11403, NPIPB9, 58237, 160687, 782-2071; 11404, NARF, 58240, 160690, 108-896; 11404, NARF, 58242, 160692, 141-1652; 11404, NARF, 58243, 160693, 102-1610; 11404, NARF, 58244, 160694, 79-645; 11404, NARF, 58245, 160695, 489-599; 11404, NARF, 58246, 160696, 141-794; 11404, NARF, 58247, 160697, 81-866; 11404, NARF, 58248, 160698, 1-500; 11404, NARF, 58249, 160699, 94-525; 11404, NARF, 58250, 160700, 475-733; 11404, NARF, 58251, 160701, 51-350; 11404, NARF, 58252, 160702, 400-873; 11404, NARF, 58253, 160703, 263-525; 11404, NARF, 58254, 160704, 107-406; 11404, NARF, 58238, 160688, 156-1382; 11404, NARF, 58239, 160689, 199-1569; 11404, NARF, 58241, 160691, 475-1668; 11405, NARFL, 58257, 160707, 4-252; 11405, NARFL, 58258, 160708, 13-225; 11405, NARFL, 58259, 160709, 13-579; 11405, NARFL, 58260, 160710, 403-961; 11405, NARFL, 58261, 160711, 237-568; 11405, NARFL, 58263, 160713, 31-231; 11405, NARFL, 58264, 160714, 402-561; 11405, NARFL, 58255, 160705, 18-1448; 11405, NARFL, 58256, 160706, 1437-2561; 11405, NARFL, 58262, 160712, 705-1829; 11406, NPAT, 58266, 160716, 81-263; 11406, NPAT, 58267, 160717, 1-898; 11406, NPAT, 58265, 160715, 107-4390; 11407, NUPR1, 58270, 160720, 45-176; 11407, NUPR1, 58268, 160718, 268-516; 11407, NUPR1, 58269, 160719, 102-404; 11408, NUPR1L, 58271, 160721, 87-380; 11409, NR2C2AP, 58274, 160724, 300-464; 11409, NR2C2AP, 58275, 160725, 316-699; 11409, NR2C2AP, 58276, 160726, 1-90; 11409, NR2C2AP, 58272, 160722, 365-784; 11409, NR2C2AP, 58273, 160723, 298-801; 11410, NRBF2, 58279, 160729, 167-988; 11410, NRBF2, 58277, 160727, 182-1045; 11410, NRBF2, 58278, 160728, 170-1003; 11411, NRBP1, 58282, 160732, 100-1731; 11411, NRBP1, 58283, 160733, 210-674; 11411, NRBP1, 58284, 160734, 341-585; 11411, NRBP1, 58280, 160730, 833-2440; 11411, NRBP1, 58281, 160731, 113-1720; 11412, NRBP2, 58286, 160736, 1-505; 11412, NRBP2, 58287, 160737, 341-1037; 11412, NRBP2, 58285, 160735, 141-1646; 11413, NSD1, 58290, 160740, 1-195; 11413, NSD1, 58292, 160742, 534-561; 11413, NSD1, 58293, 160743, 356-513; 11413, NSD1, 58294, 160744, 120-585; 11413, NSD1, 58295, 160745, 161-533; 11413, NSD1, 58296, 160746, 296-578; 11413, NSD1, 58297, 160747, 505-519; 11413, NSD1, 58298, 160748, 460-561; 11413, NSD1, 58299, 160749, 158-361; 11413, NSD1, 58288, 160738, 102-7385; 11413, NSD1, 58289, 160739, 161-7444; 11413, NSD1, 58291, 160741, 46-8136; 11414, NCOA1, 58304, 160754, 667-4413; 11414, NCOA1, 58300, 160750, 259-4458; 11414, NCOA1, 58301, 160751, 259-4584; 11414, NCOA1, 58302, 160752, 195-4517; 11414, NCOA1, 58303, 160753, 712-4911; 11414, NCOA1, 58305, 160755, 653-4978; 11415, NCOA2, 58307, 160757, 1-1771; 11415, NCOA2, 58308, 160758, 343-3183; 11415, NCOA2, 58309, 160759, 389-438; 11415, NCOA2, 58310, 160760, 502-526; 11415, NCOA2, 58306, 160756, 183-4577; 11416, NCOA3, 58311, 160761, 178-4425; 11416, NCOA3, 58312, 160762, 192-4466; 11416, NCOA3, 58313, 160763, 217-4479; 11417, NCOA4, 58314, 160764, 195-1541; 11417, NCOA4, 58316, 160766, 161-1705; 11417, NCOA4, 58315, 160765, 204-2048; 11417, NCOA4, 58317, 160767, 146-2098; 11417, NCOA4, 58318, 160768, 154-2046; 11417, NCOA4, 58319, 160769, 230-2074; 11417, NCOA4, 58320, 160770, 141-1985; 11418, NCOA5, 58322, 160772, 414-727; 11418, NCOA5, 58321, 160771, 166-1905; 11419, NCOA6, 58325, 160775, 323-3535; 11419, NCOA6, 58326, 160776, 323-3271; 11419, NCOA6, 58327, 160777, 1-660; 11419, NCOA6, 58323, 160773, 342-6533; 11419, NCOA6, 58324, 160774, 2572-8763; 11420, NCOA7, 58331, 160781, 134-793; 11420, NCOA7, 58332, 160782, 311-581; 11420, NCOA7, 58333, 160783, 193-765; 11420, NCOA7, 58334, 160784, 278-548; 11420, NCOA7, 58335, 160785, 53-532; 11420, NCOA7, 58336, 160786, 138-488; 11420, NCOA7, 58328, 160778, 259-2742; 11420, NCOA7, 58329, 160779, 353-3181; 11420, NCOA7, 58330, 160780, 370-3198; 11421, NCOR1, 58339, 160789, 1-3215; 11421, NCOR1, 58341, 160791, 270-7301; 11421, NCOR1, 58342, 160792, 359-1969; 11421, NCOR1, 58343, 160793, 1-274; 11421, NCOR1, 58344, 160794, 247-1883; 11421, NCOR1, 58345, 160795, 830-1204; 11421, NCOR1, 58346, 160796, 1-549; 11421, NCOR1, 58347, 160797, 1-551; 11421, NCOR1, 58348, 160798, 239-1877; 11421, NCOR1, 58349, 160799, 240-506; 11421, NCOR1, 58350, 160800, 1-650; 11421, NCOR1, 58351, 160801, 1-174; 11421, NCOR1, 58337, 160787, 259-7581; 11421, NCOR1, 58338, 160788, 71-2815; 11421, NCOR1, 58340, 160790, 45-7058; 11422, NCOR2, 58353, 160803, 2-7546; 11422, NCOR2, 58354, 160804, 157-7533; 11422, NCOR2, 58355, 160805, 1-6189; 11422, NCOR2, 58356, 160806, 1-389; 11422, NCOR2, 58357, 160807, 1-467; 11422, NCOR2, 58358, 160808, 1-404; 11422, NCOR2, 58359, 160809, 157-7671; 11422, NCOR2, 58360, 160810, 1-674; 11422, NCOR2, 58361, 160811, 322-4675; 11422, NCOR2, 58362, 160812, 1-735; 11422, NCOR2, 58363, 160813, 273-1752; 11422, NCOR2, 58364, 160814, 1-398; 11422, NCOR2, 58365, 160815, 95-582; 11422, NCOR2, 58366, 160816, 1-827; 11422, NCOR2, 58352, 160802, 1-6240; 11423, NRIP1, 58370, 160820, 524-720; 11423, NRIP1, 58367, 160817, 599-4075; 11423, NRIP1, 58368, 160818, 605-4081; 11423, NRIP1, 58369, 160819, 714-4190; 11424, NRIP2, 58372, 160822, 165-578; 11424, NRIP2, 58373, 160823, 66-591; 11424, NRIP2, 58371, 160821, 42-887; 11425, NRIP3, 58375, 160825, 1-198; 11425, NRIP3, 58376, 160826, 115-540; 11425, NRIP3, 58377, 160827, 67-547; 11425, NRIP3, 58378, 160828, 1-167; 11425, NRIP3, 58374, 160824, 115-840; 11426, NROB1, 58379, 160829, 11-328; 11426, NROB1, 58380, 160830, 236-1648; 11427, NROB2, 58381, 160831, 27-800; 11428, NR1D1, 58382, 160832, 632-2476; 11429, NR1D2, 58384, 160834, 205-1431; 11429, NR1D2, 58383, 160833, 320-2059; 11430, NR1H2, 58387, 160837, 173-856; 11430, NR1H2, 58388, 160838, 374-718; 11430, NR1H2, 58390, 160840, 247-1539; 11430, NR1H2, 58391, 160841, 266-894; 11430, NR1H2, 58392, 160842, 880-1410; 11430, NR1H2, 58393, 160843, 232-1482; 11430, NR1H2, 58394, 160844, 386-507; 11430, NR1H2, 58385, 160835, 236-1618; 11430, NR1H2, 58386, 160836, 246-1337; 11430, NR1H2, 58389, 160839, 104-1486; 11431, NR1H3, 58397, 160847, 177-1205; 11431, NR1H3, 58400, 160850, 204-784; 11431, NR1H3, 58401, 160851, 236-440; 11431, NR1H3, 58402, 160852, 276-911; 11431, NR1H3, 58403, 160853, 197-802; 11431, NR1H3, 58404, 160854, 172-516; 11431, NR1H3, 58405, 160855, 234-398; 11431, NR1H3, 58406, 160856, 171-574; 11431, NR1H3, 58407, 160857, 321-552; 11431, NR1H3, 58408, 160858, 211-825; 11431, NR1H3, 58410, 160860, 54-944; 11431, NR1H3, 58411, 160861, 169-1569; 11431, NR1H3, 58412, 160862, 166-667; 11431, NR1H3, 58413, 160863, 222-1583; 11431, NR1H3, 58395, 160845, 177-1385; 11431, NR1H3, 58396, 160846, 170-1333; 11431, NR1H3, 58398, 160848, 82-1245; 11431, NR1H3, 58399, 160849, 206-1549; 11431, NR1H3, 58409, 160859, 1239-2582; 11432, NR1H4, 58415, 160865, 334-1146; 11432, NR1H4, 58417, 160867, 24-197; 11432, NR1H4, 58418, 160868, 295-432; 11432, NR1H4, 58419, 160869, 1-103; 11432, NR1H4, 58414, 160864, 29-1477; 11432, NR1H4, 58416, 160866, 334-1764; 11432, NR1H4, 58420, 160870, 29-1489; 11432, NR1H4, 58421, 160871, 542-1960; 11432, NR1H4, 58422, 160872, 334-1611; 11433, NR1I2, 58424, 160874, 1840-3144; 11433, NR1I2, 58425, 160875, 1840-3033; 11433, NR1I2, 58423, 160873, 49-1470; 11434, NR1I3, 58437, 160887, 95-538; 11434, NR1I3, 58438, 160888, 249-1070; 11434, NR1I3, 58439, 160889, 42-398; 11434, NR1I3, 58440, 160890, 42-314; 11434, NR1I3, 58441, 160891, 144-1037; 11434, NR1I3, 58444, 160894, 104-928; 11434, NR1I3, 58447, 160897, 42-314; 11434, NR1I3, 58448, 160898, 42-314; 11434, NR1I3, 58449, 160899, 95-454; 11434, NR1I3, 58450, 160900, 95-538; 11434, NR1I3, 58451, 160901, 238-954; 11434, NR1I3, 58453, 160903, 42-398; 11434, NR1I3, 58454, 160904, 204-563; 11434, NR1I3, 58426, 160876, 1-1074; 11434, NR1I3, 58427, 160877, 204-1277; 11434, NR1I3, 58428, 160878, 42-1016; 11434, NR1I3, 58429, 160879, 157-1215; 11434, NR1I3, 58430, 160880, 296-1342; 11434, NR1I3, 58431, 160881, 105-1034; 11434, NR1I3, 58432, 160882, 105-1049; 11434, NR1I3, 58433, 160883, 42-989; 11434, NR1I3, 58434, 160884, 95-1114; 11434, NR1I3, 58435, 160885, 42-962; 11434, NR1I3, 58436, 160886, 95-1117; 11434, NR1I3, 58442, 160892, 42-977; 11434, NR1I3, 58443, 160893, 42-884; 11434, NR1I3, 58445, 160895, 95-985; 11434, NR1I3, 58446, 160896, 42-845; 11434, NR1I3, 58452, 160902, 42-1001; 11435, NR2C1, 58458, 160908, 1-142; 11435, NR2C1, 58459, 160909, 386-433; 11435, NR2C1, 58460, 160910, 1-220; 11435, NR2C1, 58461, 160911, 257-1561; 11435, NR2C1, 58455, 160905, 166-1617; 11435, NR2C1, 58456, 160906, 332-2143; 11435, NR2C1, 58457, 160907, 209-1612; 11436, NR2C2, 58466, 160916, 388-495; 11436, NR2C2, 58467, 160917, 124-739; 11436, NR2C2, 58468, 160918, 363-564; 11436, NR2C2, 58469, 160919, 1-669; 11436, NR2C2, 58470, 160920, 1-522; 11436, NR2C2, 58462, 160912, 218-2065; 11436, NR2C2, 58463, 160913, 126-1916; 11436, NR2C2, 58464, 160914, 1-1791; 11436, NR2C2, 58465, 160915, 363-2153; 11436, NR2C2, 58471, 160921, 1-1848; 11437, NR2E1, 58474, 160924, 381-517; 11437, NR2E1, 58472, 160922, 5-1273; 11437, NR2E1, 58473, 160923, 709-1866; 11438, NR2E3, 58475, 160925, 489-1457; 11438, NR2E3, 58476, 160926, 153-1256; 11438, NR2E3, 58477, 160927, 191-1423; 11439, NR2F1, 58479, 160929, 1-1197; 11439, NR2F1, 58478, 160928, 1688-2959; 11440, NR2F2, 58484, 160934, 103-382; 11440, NR2F2, 58480, 160930, 1390-2634; 11440, NR2F2, 58481, 160931, 75-860; 11440, NR2F2, 58482, 160932, 713-1498; 11440, NR2F2, 58483, 160933, 373-1218; 11441, NR2F6, 58486, 160936, 355-731; 11441, NR2F6, 58485, 160935, 721-1935; 11442, NR3C1, 58493, 160943, 63-498; 11442, NR3C1, 58495, 160945, 150-585; 11442, NR3C1, 58496, 160946, 112-547; 11442, NR3C1, 58497, 160947, 154-585; 11442, NR3C1, 58498, 160948, 188-623; 11442, NR3C1, 58487, 160937, 493-2829; 11442, NR3C1, 58488, 160938, 995-3328; 11442, NR3C1, 58489, 160939, 504-2837; 11442, NR3C1, 58490, 160940, 158-2494; 11442, NR3C1, 58491, 160941, 133-2361; 11442, NR3C1, 58492, 160942, 14-2269; 11442, NR3C1, 58494, 160944, 284-2620; 11442, NR3C1, 58499, 160949, 183-2516; 11443, NR3C2, 58500, 160950, 176-3130; 11443, NR3C2, 58501, 160951, 215-2335; 11443, NR3C2, 58502, 160952, 364-3318; 11443, NR3C2, 58505, 160955, 364-3330; 11443, NR3C2, 58503, 160953, 1-2967; 11443, NR3C2, 58504, 160954, 68-2671; 11444, NR4A1, 58510, 160960, 996-2954; 11444, NR4A1, 58513, 160963, 130-574; 11444, NR4A1, 58514, 160964, 387-838; 11444, NR4A1, 58515, 160965, 247-607; 11444, NR4A1, 58516, 160966, 192-548; 11444, NR4A1, 58517, 160967, 286-521; 11444, NR4A1, 58518, 160968, 351-1258; 11444, NR4A1, 58506, 160956, 320-2116; 11444, NR4A1, 58507, 160957, 192-2027; 11444, NR4A1, 58508, 160958, 280-2076; 11444, NR4A1, 58509, 160959, 170-1966; 11444, NR4A1, 58511, 160961, 89-1924; 11444, NR4A1, 58512, 160962, 124-1101; 11445, NR4A2, 58520, 160970, 1-449; 11445, NR4A2, 58522, 160972, 43-1704; 11445, NR4A2, 58523, 160973, 255-574; 11445, NR4A2, 58525, 160975, 320-1498; 11445, NR4A2, 58526, 160976, 237-1010; 11445, NR4A2, 58527, 160977, 68-1540; 11445, NR4A2, 58528, 160978, 135-1313; 11445, NR4A2, 58519, 160969, 364-2160; 11445, NR4A2, 58521, 160971, 436-2232; 11445, NR4A2, 58524, 160974, 373-1980; 11446, NR4A3, 58529, 160979, 45-1958; 11446, NR4A3, 58530, 160980, 730-2061; 11446, NR4A3, 58531, 160981, 730-2610; 11446, NR4A3, 58532, 160982, 769-2682; 11447, NR5A1, 58533, 160983, 1-738; 11447, NR5A1, 58535, 160985, 294-826; 11447, NR5A1, 58536, 160986, 188-1453; 11447, NR5A1, 58534, 160984, 198-1583; 11448, NR5A2, 58538, 160988, 1-1133; 11448, NR5A2, 58540, 160990, 1-213; 11448, NR5A2, 58541, 160991, 192-533; 11448, NR5A2, 58537, 160987, 235-1722; 11448, NR5A2, 58539, 160989, 247-1872; 11448, NR5A2, 58542, 160992, 156-1565; 11449, NR6A1, 58547, 160997, 45-742; 11449, NR6A1, 58543, 160993, 169-1608; 11449, NR6A1, 58544, 160994, 179-1609; 11449, NR6A1, 58545, 160995, 192-1619; 11449, NR6A1, 58546, 160996, 159-1601; 11450, NRF1, 58553, 161003, 186-814; 11450, NRF1, 58548, 160998, 79-1590; 11450, NRF1, 58549, 160999, 79-1647; 11450, NRF1, 58550, 161000, 101-1669; 11450, NRF1, 58551, 161001, 111-1622; 11450, NRF1, 58552, 161002, 118-1629; 11451, NXF1, 58555, 161005, 244-589; 11451, NXF1, 58556, 161006, 85-315; 11451, NXF1, 58557, 161007, 1-374; 11451, NXF1, 58558, 161008, 114-1922; 11451, NXF1, 58560, 161010, 360-548; 11451, NXF1, 58562, 161012, 155-814; 11451, NXF1, 58554, 161004, 137-1996; 11451, NXF1, 58559, 161009, 631-2490; 11451, NXF1, 58561, 161011, 115-1185; 11452, NXF2, 58563, 161013, 58-1938; 11452, NXF2, 58564, 161014, 254-2134; 11453, NXF2B, 58567, 161017, 1670-2899; 11453, NXF2B, 58565, 161015, 239-2119; 11453, NXF2B, 58566, 161016, 58-1938; 11453, NXF2B, 58568, 161018, 801-2681; 11454, NXF3, 58570, 161020, 1-1081; 11454, NXF3, 58569, 161019, 103-1698; 11455, NXF5, 58571, 161021, 361-1554; 11455, NXF5, 58572, 161022, 361-1269; 11455, NXF5, 58573, 161023, 361-1278; 11455, NXF5, 58574, 161024, 361-1467; 11455, NXF5, 58575, 161025, 361-867; 11455, NXF5, 58576, 161026, 182-1279; 11455, NXF5, 58577, 161027, 290-1483; 11456, NSRP1, 58579, 161029, 25-177; 11456, NSRP1, 58580, 161030, 26-154; 11456, NSRP1, 58581, 161031, 15-239; 11456, NSRP1, 58582, 161032, 64-342; 11456, NSRP1, 58583, 161033, 16-141; 11456, NSRP1, 58584, 161034, 390-582; 11456, NSRP1, 58585, 161035, 185-497; 11456, NSRP1, 58586, 161036, 18-143; 11456, NSRP1, 58587, 161037, 1-205; 11456, NSRP1, 58588, 161038, 304-774; 11456, NSRP1, 58589, 161039, 106-1620; 11456, NSRP1, 58578, 161028, 64-1740; 11457, NFYA, 58590, 161040, 164-1120; 11457, NFYA, 58591, 161041, 202-1245; 11458, NFYB, 58594, 161044, 225-618; 11458, NFYB, 58592, 161042, 229-852; 11458, NFYB, 58593, 161043, 722-1345; 11459, NFYC, 58600, 161050, 67-1005; 11459, NFYC, 58602, 161052, 264-650; 11459, NFYC, 58606, 161056, 9-547; 11459, NFYC, 58608, 161058, 1-559; 11459, NFYC, 58609, 161059, 9-293; 11459, NFYC, 58610, 161060, 419-574; 11459, NFYC, 58611, 161061, 345-525; 11459, NFYC, 58612, 161062, 11-433; 11459, NFYC, 58613, 161063, 613-1314; 11459, NFYC, 58595, 161045, 7-1383; 11459, NFYC, 58596, 161046, 83-1090; 11459, NFYC, 58597, 161047, 269-1588; 11459, NFYC, 58598, 161048, 679-1584; 11459, NFYC, 58599, 161049, 174-1181; 11459, NFYC, 58601, 161051, 161-1225; 11459, NFYC, 58603, 161053, 168-1175; 11459, NFYC, 58604, 161054, 188-1081; 11459, NFYC, 58605, 161055, 134-1138; 11459, NFYC, 58607, 161057, 445-1452; 11460, NFX1, 58614, 161064, 29-2530; 11460, NFX1, 58615, 161065, 62-3136; 11460, NFX1, 58616, 161066, 63-3425; 11461, NFXL1, 58617, 161067, 58-2793; 11461, NFXL1, 58618, 161068, 70-2805; 11461, NFXL1, 58619, 161069, 178-2913; 11461, NFXL1, 58620, 161070, 27-2228; 11462, NUTF2, 58622, 161072, 260-582; 11462, NUTF2, 58621, 161071, 284-667; 11462, NUTF2, 58623, 161073, 386-769; 11462, NUTF2, 58624, 161074, 326-709; 11463, NXT1, 58625, 161075, 388-810; 11464, NXT2, 58626, 161076, 103-696; 11464, NXT2, 58627, 161077, 223-567; 11464, NXT2, 58628, 161078, 132-560; 11464, NXT2, 58629, 161079, 307-651; 11465, NVL, 58633, 161083, 254-766; 11465, NVL, 58636, 161086, 53-577; 11465, NVL, 58637, 161087, 13-553; 11465, NVL, 58639, 161089, 42-203; 11465, NVL, 58640, 161090, 12-564; 11465, NVL, 58641, 161091, 11-901; 11465, NVL, 58642, 161092, 1-145; 11465, NVL, 58630, 161080, 261-2831; 11465, NVL, 58631, 161081, 256-2259; 11465, NVL, 58632, 161082, 288-2540; 11465, NVL, 58634, 161084, 711-2714; 11465, NVL, 58635, 161085, 12-2309; 11465, NVL, 58638, 161088, 239-2218; 11466, NABP1, 58644, 161094, 265-429; 11466, NABP1, 58648, 161098, 1-506; 11466, NABP1, 58643, 161093, 480-884; 11466, NABP1, 58645, 161095, 343-717; 11466, NABP1, 58646, 161096, 256-630; 11466, NABP1, 58647, 161097, 469-873; 11466, NABP1, 58649, 161099, 84-698; 11467, NABP2, 58653, 161103, 209-663; 11467, NABP2, 58654, 161104, 338-770; 11467, NABP2, 58650, 161100, 141-776; 11467, NABP2, 58651, 161101, 145-780; 11467, NABP2, 58652, 161102, 499-1134; 11468, NUCB1, 58657, 161107, 62-864; 11468, NUCB1, 58658, 161108, 1-884; 11468, NUCB1, 58659, 161109, 232-563; 11468, NUCB1, 58660, 161110, 30-257; 11468, NUCB1, 58661, 161111, 301-673; 11468, NUCB1, 58655, 161105, 65-1450; 11468, NUCB1, 58656, 161106, 335-1720; 11469, NUCB2, 58662, 161112, 244-1506; 11469, NUCB2, 58663, 161113, 3-1175; 11469, NUCB2, 58664, 161114, 430-530; 11469, NUCB2, 58665, 161115, 362-463; 11469, NUCB2, 58666, 161116, 352-937; 11469, NUCB2, 58667, 161117, 1-220; 11469, NUCB2, 58668, 161118, 229-498; 11469, NUCB2, 58669, 161119, 349-1365; 11469, NUCB2, 58670, 161120, 1242-1837; 11469, NUCB2, 58671, 161121, 328-534; 11469, NUCB2, 58672, 161122, 1-595; 11469, NUCB2, 58673, 161123, 397-514; 11469, NUCB2, 58674, 161124, 290-496; 11469, NUCB2, 58675, 161125, 220-1482; 11469, NUCB2, 58676, 161126, 3-1265; 11470, NOLC1, 58677, 161127, 1-2126; 11470, NOLC1, 58679, 161129, 17-238; 11470, NOLC1, 58680, 161130, 3-777; 11470, NOLC1, 58681, 161131, 1-844; 11470, NOLC1, 58683, 161133, 8-148; 11470, NOLC1, 58678, 161128, 236-2365; 11470, NOLC1, 58682, 161132, 236-2335; 11470, NOLC1, 58684, 161134, 8-2110; 11471, NUSAP1, 58688, 161138, 104-334; 11471, NUSAP1, 58690, 161140, 1-206; 11471, NUSAP1, 58691, 161141, 1-435; 11471, NUSAP1, 58685, 161135, 265-1545; 11471, NUSAP1, 58686, 161136, 88-1410; 11471, NUSAP1, 58687, 161137, 88-1224; 11471, NUSAP1, 58689, 161139, 88-1413; 11471, NUSAP1, 58692, 161142, 46-1368; 11471, NUSAP1, 58693, 161143, 73-1392; 11472, NOC4L, 58695, 161145, 199-1009; 11472, NOC4L, 58694, 161144, 42-1592; 11473, NOL10, 58698, 161148, 1-759; 11473, NOL10, 58696, 161146, 112-2028; 11473, NOL10, 58697, 161147, 107-2173; 11473, NOL10, 58699, 161149, 127-2115; 11474, NOL11, 58702, 161152, 1-257; 11474, NOL11, 58703, 161153, 18-584; 11474, NOL11, 58704, 161154, 1-815; 11474, NOL11, 58700, 161150, 116-2275; 11474, NOL11, 58701, 161151, 4-513; 11475, NOL12, 58705, 161155, 71-712; 11475, NOL12, 58706, 161156, 71-712; 11475, NOL12, 58707, 161157, 34-675; 11476, NOL3, 58709, 161159, 227-642; 11476, NOL3, 58711, 161161, 1-650; 11476, NOL3, 58713, 161163, 59-677; 11476, NOL3, 58714, 161164, 57-579; 11476, NOL3, 58715, 161165, 1-317; 11476, NOL3, 58716, 161166, 1-395; 11476, NOL3, 58708, 161158, 87-713; 11476, NOL3, 58710, 161160, 54-713; 11476, NOL3, 58712, 161162, 349-1161; 11477, NOL4, 58720, 161170, 258-467; 11477, NOL4, 58721, 161171, 229-303; 11477, NOL4, 58723, 161173, 182-838; 11477, NOL4, 58724, 161174, 50-259; 11477, NOL4, 58725, 161175, 1-1677; 11477, NOL4, 58717, 161167, 299-2215; 11477, NOL4, 58718, 161168, 32-1726; 11477, NOL4, 58719, 161169, 240-1301; 11477, NOL4, 58722, 161172, 219-1829; 11478, NOL4L, 58726, 161176, 221-748; 11478, NOL4L, 58727, 161177, 255-530; 11478, NOL4L, 58729, 161179, 29-370; 11478, NOL4L, 58730, 161180, 1252-1719; 11478, NOL4L, 58731, 161181, 1-229; 11478, NOL4L, 58732, 161182, 27-1229; 11478, NOL4L, 58733, 161183, 184-2226; 11478, NOL4L, 58728, 161178, 144-1454; 11479, NOL6, 58736, 161186, 376-978; 11479, NOL6, 58737, 161187, 89-3113; 11479, NOL6, 58734, 161184, 89-3529; 11479, NOL6, 58735, 161185, 89-2188; 11480, NOL7, 58738, 161188, 1-250; 11480, NOL7, 58739, 161189, 33-806; 11481, NOL8, 58741, 161191, 500-760; 11481, NOL8, 58742, 161192, 134-572; 11481, NOL8, 58743, 161193, 326-1098; 11481, NOL8, 58744, 161194, 182-487; 11481, NOL8, 58746, 161196, 156-1396; 11481, NOL8, 58747, 161197, 228-3136; 11481, NOL8, 58748, 161198, 87-347; 11481, NOL8, 58749, 161199, 206-466; 11481, NOL8, 58750, 161200, 82-3339; 11481, NOL8, 58751, 161201, 252-644; 11481, NOL8, 58752, 161202, 92-352; 11481, NOL8, 58756, 161206, 117-551; 11481, NOL8, 58757, 161207, 266-421; 11481, NOL8, 58758, 161208, 249-575; 11481, NOL8, 58759, 161209, 105-365; 11481, NOL8, 58760, 161210, 82-342; 11481, NOL8, 58740, 161190, 646-3945; 11481, NOL8, 58745, 161195, 300-3803; 11481, NOL8, 58753, 161203, 94-3393; 11481, NOL8, 58754, 161204, 494-3997; 11481, NOL8, 58755, 161205, 1-3390; 11482, NOL9, 58761, 161211, 34-2142; 11483, NIFK, 58763, 161213, 1-309; 11483, NIFK, 58764, 161214, 62-559; 11483, NIFK, 58765, 161215, 266-759; 11483, NIFK, 58762, 161212, 74-955; 11484, NOM1, 58766, 161216, 16-2598; 11485, NCL, 58768, 161218, 1-890; 11485, NCL, 58769, 161219, 71-568; 11485, NCL, 58770, 161220, 139-562; 11485, NCL, 58771, 161221, 96-606; 11485, NCL, 58772, 161222, 511-964; 11485, NCL, 58767, 161217, 242-2374; 11486, NPM1, 58776, 161226, 69-247; 11486, NPM1, 58778, 161228, 263-597; 11486, NPM1, 58773, 161223, 302-1186; 11486, NPM1, 58774, 161224, 121-918; 11486, NPM1, 58775, 161225, 99-878; 11486, NPM1, 58777, 161227, 136-1020; 11487, NPM2, 58783, 161233, 155-565; 11487, NPM2, 58785, 161235, 274-570; 11487, NPM2, 58779, 161229, 241-885; 11487, NPM2, 58780, 161230, 233-643; 11487, NPM2, 58781, 161231, 1016-

1660; 11487, NPM2, 58782, 161232, 331-975; 11487, NPM2, 58784, 161234, 659-1303; 11487, NPM2, 58786, 161236, 1-411; 11487, NPM2, 58787, 161237, 1-645; 11488, NPM3, 58788, 161238, 24-560; 11489, NUP107, 58791, 161241, 423-678; 11489, NUP107, 58792, 161242, 1-243; 11489, NUP107, 58794, 161244, 61-372; 11489, NUP107, 58789, 161239, 333-3110; 11489, NUP107, 58790, 161240, 569-2629; 11489, NUP107, 58793, 161243, 245-2935; 11490, NUP133, 58795, 161245, 93-3563; 11491, NUP153, 58796, 161246, 1-4428; 11491, NUP153, 58797, 161247, 448-4968; 11491, NUP153, 58798, 161248, 448-4749; 11492, NUP155, 58801, 161251, 105-4088; 11492, NUP155, 58802, 161252, 127-291; 11492, NUP155, 58799, 161249, 205-4380; 11492, NUP155, 58800, 161250, 141-4139; 11493, NUP160, 58805, 161255, 1-3370; 11493, NUP160, 58806, 161256, 1-3943; 11493, NUP160, 58807, 161257, 1-309; 11493, NUP160, 58803, 161253, 48-4358; 11493, NUP160, 58804, 161254, 136-810; 11494, NUP188, 58808, 161258, 22-5271; 11495, NUP205, 58810, 161260, 1-821; 11495, NUP205, 58811, 161261, 1-215; 11495, NUP205, 58812, 161262, 1-553; 11495, NUP205, 58813, 161263, 1-128; 11495, NUP205, 58809, 161259, 27-6065; 11496, NUP210, 58814, 161264, 84-5747; 11497, NUP210L, 58816, 161266, 14-2023; 11497, NUP210L, 58815, 161265, 73-5283; 11497, NUP210L, 58817, 161267, 73-5739; 11498, NUP214, 58820, 161270, 248-4807; 11498, NUP214, 58821, 161271, 1-2903; 11498, NUP214, 58822, 161272, 1-436; 11498, NUP214, 58823, 161273, 1-237; 11498, NUP214, 58824, 161274, 1-560; 11498, NUP214, 58825, 161275, 291-1775; 11498, NUP214, 58826, 161276, 1-342; 11498, NUP214, 58827, 161277, 390-545; 11498, NUP214, 58828, 161278, 309-3059; 11498, NUP214, 58829, 161279, 1-423; 11498, NUP214, 58818, 161268, 145-6417; 11498, NUP214, 58819, 161269, 120-6362; 11499, NUP35, 58831, 161281, 47-505; 11499, NUP35, 58833, 161283, 183-342; 11499, NUP35, 58834, 161284, 387-616; 11499, NUP35, 58835, 161285, 1-411; 11499, NUP35, 58836, 161286, 125-470; 11499, NUP35, 58830, 161280, 104-1084; 11499, NUP35, 58832, 161282, 234-1163; 11500, NUP37, 58838, 161288, 1-96; 11500, NUP37, 58840, 161290, 137-762; 11500, NUP37, 58841, 161291, 492-645; 11500, NUP37, 58837, 161287, 66-1046; 11500, NUP37, 58839, 161289, 141-1121; 11501, NUP43, 58843, 161293, 58-621; 11501, NUP43, 58845, 161295, 66-419; 11501, NUP43, 58846, 161296, 41-576; 11501, NUP43, 58842, 161292, 78-1220; 11501, NUP43, 58844, 161294, 34-888; 11502, NUP50, 58850, 161300, 308-400; 11502, NUP50, 58851, 161301, 13-105; 11502, NUP50, 58852, 161302, 560-584; 11502, NUP50, 58853, 161303, 308-537; 11502, NUP50, 58854, 161304, 414-443; 11502, NUP50, 58855, 161305, 539-551; 11502, NUP50, 58856, 161306, 443-579; 11502, NUP50, 58857, 161307, 8-543; 11502, NUP50, 58847, 161297, 467-1873; 11502, NUP50, 58848, 161298, 398-1720; 11502, NUP50, 58849, 161299, 562-1884; 11503, NUP54, 58860, 161310, 25-500; 11503, NUP54, 58861, 161311, 24-332; 11503, NUP54, 58862, 161312, 24-278; 11503, NUP54, 58863, 161313, 43-351; 11503, NUP54, 58864, 161314, 32-448; 11503, NUP54, 58858, 161308, 142-1665; 11503, NUP54, 58859, 161309, 24-1403; 11504, NUP58, 58867, 161317, 128-1659; 11504, NUP58, 58868, 161318, 1-1392; 11504, NUP58, 58869, 161319, 150-260; 11504, NUP58, 58870, 161320, 219-407; 11504, NUP58, 58872, 161322, 150-536; 11504, NUP58, 58865, 161315, 142-1905; 11504, NUP58, 58866, 161316, 251-2050; 11504, NUP58, 58871, 161321, 144-1601; 11505, NUP62, 58875, 161325, 519-587; 11505, NUP62, 58876, 161326, 668-894; 11505, NUP62, 58877, 161327, 494-564; 11505, NUP62, 58878, 161328, 132-533; 11505, NUP62, 58879, 161329, 350-1690; 11505, NUP62, 58880, 161330, 457-564; 11505, NUP62, 58881, 161331, 270-567; 11505, NUP62, 58882, 161332, 418-473; 11505, NUP62, 58884, 161334, 280-579; 11505, NUP62, 58885, 161335, 493-905; 11505, NUP62, 58873, 161323, 606-2174; 11505, NUP62, 58874, 161324, 497-2065; 11505, NUP62, 58883, 161333, 1889-3457; 11505, NUP62, 58886, 161336, 351-1919; 11506, NUP62CL, 58888, 161338, 209-618; 11506, NUP62CL, 58889, 161339, 1-595; 11506, NUP62CL, 58887, 161337, 253-807; 11506, NUP62CL, 58890, 161340, 209-427; 11507, NUP85, 58892, 161342, 1069-1848; 11507, NUP85, 58893, 161343, 43-552; 11507, NUP85, 58894, 161344, 1-295; 11507, NUP85, 58895, 161345, 193-553; 11507, NUP85, 58896, 161346, 43-1878; 11507, NUP85, 58897, 161347, 1-301; 11507, NUP85, 58898, 161348, 1-60; 11507, NUP85, 58899, 161349, 298-1932; 11507, NUP85, 58900, 161350, 1-345; 11507, NUP85, 58901, 161351, 1-817; 11507, NUP85, 58902, 161352, 1-907; 11507, NUP85, 58903, 161353, 1-575; 11507, NUP85, 58904, 161354, 1-57; 11507, NUP85, 58905, 161355, 1-140; 11507, NUP85, 58891, 161341, 72-2042; 11508, NUP88, 58906, 161356, 1-2090; 11508, NUP88, 58908, 161358, 312-771; 11508, NUP88, 58909, 161359, 12-398; 11508, NUP88, 58910, 161360, 1-332; 11508, NUP88, 58907, 161357, 511-2736; 11509, NUP93, 58913, 161363, 58-592; 11509, NUP93, 58914, 161364, 254-630; 11509, NUP93, 58915, 161365, 465-584; 11509, NUP93, 58916, 161366, 1-397; 11509, NUP93, 58917, 161367, 266-315; 11509, NUP93, 58918, 161368, 135-604; 11509, NUP93, 58919, 161369, 109-797; 11509, NUP93, 58920, 161370, 1-421; 11509, NUP93, 58921, 161371, 136-589; 11509, NUP93, 58922, 161372, 175-583; 11509, NUP93, 58923, 161373, 1-255; 11509, NUP93, 58925, 161375, 1-354; 11509, NUP93, 58926, 161376, 97-2739; 11509, NUP93, 58911, 161361, 122-2581; 11509, NUP93, 58912, 161362, 490-2580; 11509, NUP93, 58924, 161374, 630-2720; 11510, NUP98, 58932, 161382, 1-409; 11510, NUP98, 58933, 161383, 1-2260; 11510, NUP98, 58934, 161384, 1-536; 11510, NUP98, 58935, 161385, 1-281; 11510, NUP98, 58936, 161386, 1-226; 11510, NUP98, 58937, 161387, 1-698; 11510, NUP98, 58938, 161388, 182-553; 11510, NUP98, 58939, 161389, 1-705; 11510, NUP98, 58927, 161377, 422-5824; 11510, NUP98, 58928, 161378, 88-5268; 11510, NUP98, 58929, 161379, 422-5875; 11510, NUP98, 58930, 161380, 171-2933; 11510, NUP98, 58931, 161381, 177-2990; 11511, NUPL2, 58941, 161391, 49-516; 11511, NUPL2, 58942, 161392, 23-1329; 11511, NUPL2, 58943, 161393, 21-155; 11511, NUPL2, 58945, 161395, 1-249; 11511, NUPL2, 58940, 161390, 260-1531; 11511, NUPL2, 58944, 161394, 63-737; 11512, NXN, 58947, 161397, 599-1159; 11512, NXN, 58949, 161399, 1-691; 11512, NXN, 58950, 161400, 93-452; 11512, NXN, 58951, 161401, 93-452; 11512, NXN, 58946, 161396, 93-1400; 11512, NXN, 58948, 161398, 62-1045; 11513, NXNL1, 58952, 161402, 86-724; 11514, NXNL2, 58955, 161405, 335-739; 11514, NXNL2, 58953, 161403, 335-805; 11514, NXNL2, 58954, 161404, 331-738; 11515, NTPCR, 58956, 161406, 72-758; 11515, NTPCR, 58957, 161407, 88-660; 11516, NAP1L1, 58961, 161411, 509-1135; 11516, NAP1L1, 58962, 161412, 227-1276; 11516, NAP1L1, 58963, 161413, 67-1218; 11516, NAP1L1, 58964, 161414, 1-532; 11516, NAP1L1, 58965, 161415, 139-760; 11516, NAP1L1, 58966, 161416, 190-818; 11516, NAP1L1, 58967, 161417, 1-597; 11516, NAP1L1, 58968, 161418, 114-1253; 11516, NAP1L1, 58970, 161420, 140-851; 11516, NAP1L1, 58971, 161421, 184-1170; 11516,

NAP1L1, 58972, 161422, 118-460; 11516, NAP1L1, 58973, 161423, 283-1074; 11516, NAP1L1, 58974, 161424, 140-786; 11516, NAP1L1, 58975, 161425, 140-623; 11516, NAP1L1, 58976, 161426, 207-1190; 11516, NAP1L1, 58977, 161427, 1-1158; 11516, NAP1L1, 58958, 161408, 413-1588; 11516, NAP1L1, 58959, 161409, 121-1296; 11516, NAP1L1, 58960, 161410, 226-1197; 11516, NAP1L1, 58969, 161419, 140-1246; 11516, NAP1L1, 58978, 161428, 488-1663; 11517, NAP1L2, 58979, 161429, 357-1739; 11518, NAP1L3, 58981, 161431, 207-1706; 11518, NAP1L3, 58980, 161430, 265-1785; 11519, NAP1L4, 58983, 161433, 127-594; 11519, NAP1L4, 58984, 161434, 53-888; 11519, NAP1L4, 58985, 161435, 327-860; 11519, NAP1L4, 58986, 161436, 49-352; 11519, NAP1L4, 58987, 161437, 1-615; 11519, NAP1L4, 58988, 161438, 150-535; 11519, NAP1L4, 58989, 161439, 226-625; 11519, NAP1L4, 58990, 161440, 309-544; 11519, NAP1L4, 58991, 161441, 167-587; 11519, NAP1L4, 58992, 161442, 48-555; 11519, NAP1L4, 58994, 161444, 65-526; 11519, NAP1L4, 58995, 161445, 252-572; 11519, NAP1L4, 58999, 161449, 226-625; 11519, NAP1L4, 59000, 161450, 127-594; 11519, NAP1L4, 59002, 161452, 1-615; 11519, NAP1L4, 59003, 161453, 150-535; 11519, NAP1L4, 59004, 161454, 48-555; 11519, NAP1L4, 59005, 161455, 327-860; 11519, NAP1L4, 59006, 161456, 53-888; 11519, NAP1L4, 59007, 161457, 49-352; 11519, NAP1L4, 59008, 161458, 252-572; 11519, NAP1L4, 59009, 161459, 167-587; 11519, NAP1L4, 59010, 161460, 309-544; 11519, NAP1L4, 58982, 161432, 142-1269; 11519, NAP1L4, 58993, 161443, 285-1445; 11519, NAP1L4, 58996, 161446, 142-1302; 11519, NAP1L4, 58997, 161447, 142-1302; 11519, NAP1L4, 58998, 161448, 142-1269; 11519, NAP1L4, 59001, 161451, 285-1445; 11520, NAP1L5, 59011, 161461, 482-1030; 11521, NAP1L6, 59012, 161462, 199-522; 11522, NUBP1, 59015, 161465, 1-428; 11522, NUBP1, 59016, 161466, 1-191; 11522, NUBP1, 59017, 161467, 79-582; 11522, NUBP1, 59013, 161463, 20-982; 11522, NUBP1, 59014, 161464, 10-939; 11523, NUBP2, 59019, 161469, 54-470; 11523, NUBP2, 59020, 161470, 15-770; 11523, NUBP2, 59021, 161471, 27-839; 11523, NUBP2, 59022, 161472, 1-175; 11523, NUBP2, 59023, 161473, 402-1037; 11523, NUBP2, 59024, 161474, 379-811; 11523, NUBP2, 59025, 161475, 23-163; 11523, NUBP2, 59026, 161476, 90-230; 11523, NUBP2, 59027, 161477, 266-658; 11523, NUBP2, 59018, 161468, 121-936; 11524, NUBPL, 59029, 161479, 398-560; 11524, NUBPL, 59030, 161480, 168-567; 11524, NUBPL, 59031, 161481, 1-312; 11524, NUBPL, 59032, 161482, 56-557; 11524, NUBPL, 59033, 161483, 1-393; 11524, NUBPL, 59028, 161478, 46-1005; 11524, NUBPL, 59034, 161484, 43-564; 11525, NOD1, 59036, 161486, 579-757; 11525, NOD1, 59037, 161487, 616-794; 11525, NOD1, 59038, 161488, 459-637; 11525, NOD1, 59039, 161489, 442-578; 11525, NOD1, 59040, 161490, 485-2824; 11525, NOD1, 59035, 161485, 527-3388; 11526, NOD2, 59042, 161492, 187-624; 11526, NOD2, 59043, 161493, 105-212; 11526, NOD2, 59044, 161494, 1-506; 11526, NOD2, 59045, 161495, 1-181; 11526, NOD2, 59046, 161496, 1-181; 11526, NOD2, 59047, 161497, 1-181; 11526, NOD2, 59048, 161498, 1-181; 11526, NOD2, 59041, 161491, 106-3228; 11527, NACC1, 59050, 161500, 1-285; 11527, NACC1, 59051, 161501, 38-534; 11527, NACC1, 59049, 161499, 127-1710; 11528, NUDCD1, 59054, 161504, 109-435; 11528, NUDCD1, 59055, 161505, 58-297; 11528, NUDCD1, 59052, 161502, 376-2127; 11528, NUDCD1, 59053, 161503, 100-1764; 11529, NUDCD2, 59057, 161507, 6-404; 11529, NUDCD2, 59056, 161506, 91-564; 11530, NUDCD3, 59058, 161508, 281-1366; 11531, NUDC, 59060, 161510, 418-816; 11531, NUDC, 59061, 161511, 264-821; 11531, NUDC, 59059, 161509, 124-1119; 11532, NDE1, 59065, 161515, 1-411; 11532, NDE1, 59066, 161516, 1-522; 11532, NDE1, 59067, 161517, 208-588; 11532, NDE1, 59068, 161518, 1-420; 11532, NDE1, 59069, 161519, 212-590; 11532, NDE1, 59070, 161520, 82-411; 11532, NDE1, 59071, 161521, 1-575; 11532, NDE1, 59072, 161522, 1-462; 11532, NDE1, 59074, 161524, 1-420; 11532, NDE1, 59075, 161525, 208-588; 11532, NDE1, 59076, 161526, 1-462; 11532, NDE1, 59079, 161529, 1-522; 11532, NDE1, 59080, 161530, 1-575; 11532, NDE1, 59081, 161531, 1-411; 11532, NDE1, 59082, 161532, 212-590; 11532, NDE1, 59083, 161533, 82-411; 11532, NDE1, 59062, 161512, 57-1064; 11532, NDE1, 59063, 161513, 112-1119; 11532, NDE1, 59064, 161514, 827-1834; 11532, NDE1, 59073, 161523, 57-1064; 11532, NDE1, 59077, 161527, 827-1834; 11532, NDE1, 59078, 161528, 112-1119; 11533, NDEL1, 59085, 161535, 159-968; 11533, NDEL1, 59087, 161537, 152-588; 11533, NDEL1, 59088, 161538, 478-577; 11533, NDEL1, 59089, 161539, 387-602; 11533, NDEL1, 59090, 161540, 614-790; 11533, NDEL1, 59091, 161541, 81-555; 11533, NDEL1, 59092, 161542, 165-422; 11533, NDEL1, 59093, 161543, 88-318; 11533, NDEL1, 59094, 161544, 1-589; 11533, NDEL1, 59095, 161545, 1-582; 11533, NDEL1, 59084, 161534, 198-1235; 11533, NDEL1, 59086, 161536, 151-1137; 11534, NUDT1, 59102, 161552, 712-822; 11534, NUDT1, 59096, 161546, 88-627; 11534, NUDT1, 59097, 161547, 84-554; 11534, NUDT1, 59098, 161548, 48-518; 11534, NUDT1, 59099, 161549, 98-568; 11534, NUDT1, 59100, 161550, 100-639; 11534, NUDT1, 59101, 161551, 100-570; 11535, NUDT10, 59103, 161553, 137-631; 11535, NUDT10, 59104, 161554, 221-715; 11536, NUDT11, 59105, 161555, 153-647; 11537, NUDT12, 59107, 161557, 94-1428; 11537, NUDT12, 59106, 161556, 98-1486; 11538, NUDT13, 59111, 161561, 759-1226; 11538, NUDT13, 59113, 161563, 203-928; 11538, NUDT13, 59108, 161558, 119-910; 11538, NUDT13, 59109, 161559, 119-1177; 11538, NUDT13, 59110, 161560, 48-755; 11538, NUDT13, 59112, 161562, 653-1333; 11539, NUDT14, 59115, 161565, 104-394; 11539, NUDT14, 59114, 161564, 95-763; 11540, NUDT15, 59116, 161566, 181-675; 11541, NUDT16, 59117, 161567, 21-704; 11541, NUDT16, 59118, 161568, 32-619; 11541, NUDT16, 59119, 161569, 76-555; 11542, NUDT16L1, 59122, 161572, 1-596; 11542, NUDT16L1, 59123, 161573, 25-540; 11542, NUDT16L1, 59124, 161574, 21-599; 11542, NUDT16L1, 59120, 161570, 34-669; 11542, NUDT16L1, 59121, 161571, 10-753; 11543, NUDT17, 59125, 161575, 13-999; 11544, NUDT18, 59126, 161576, 120-521; 11544, NUDT18, 59127, 161577, 98-1069; 11545, NUDT19, 59128, 161578, 1-1128; 11546, NUDT2, 59129, 161579, 246-689; 11546, NUDT2, 59130, 161580, 288-731; 11546, NUDT2, 59131, 161581, 359-802; 11546, NUDT2, 59132, 161582, 111-554; 11547, NUDT21, 59134, 161584, 133-581; 11547, NUDT21, 59135, 161585, 173-385; 11547, NUDT21, 59133, 161583, 174-857; 11548, NUDT22, 59137, 161587, 45-876; 11548, NUDT22, 59139, 161589, 364-861; 11548, NUDT22, 59140, 161590, 49-546; 11548, NUDT22, 59141, 161591, 1-171; 11548, NUDT22, 59142, 161592, 376-746; 11548, NUDT22, 59136, 161586, 157-1068; 11548, NUDT22, 59138, 161588, 157-969; 11549, NUDT3, 59143, 161593, 313-831; 11550, NUDT4, 59147, 161597, 246-531; 11550, NUDT4, 59148, 161598, 233-569; 11550, NUDT4, 59149, 161599, 299-685; 11550, NUDT4, 59150, 161600, 174-560; 11550, NUDT4, 59144, 161594, 441-986; 11550, NUDT4, 59145, 161595, 428-970; 11550, NUDT4, 59146, 161596, 271-660; 11551, NUDT5, 59151, 161601, 95-637; 11551, NUDT5, 59152, 161602, 95-793; 11551, NUDT5, 59153, 161603, 142-702; 11551, NUDT5, 59154, 161604, 118-410; 11551, NUDT5, 59156, 161606, 1-412; 11551, NUDT5, 59155, 161605, 397-1056; 11551, NUDT5, 59157, 161607, 417-1076; 11552, NUDT6, 59160, 161610, 11-325; 11552, NUDT6, 59161, 161611, 3-317; 11552, NUDT6, 59162, 161612, 1-152; 11552, NUDT6, 59158, 161608, 35-985; 11552, NUDT6, 59159, 161609, 438-881; 11552, NUDT6, 59163, 161613, 148-591; 11553, NUDT7, 59166, 161616, 39-86; 11553, NUDT7, 59167, 161617, 68-430; 11553, NUDT7, 59169, 161619, 92-763; 11553, NUDT7, 59164, 161614, 70-786; 11553, NUDT7, 59165, 161615, 65-622; 11553, NUDT7, 59168, 161618, 70-582; 11554, NUDT8, 59170, 161620, 20-442; 11554, NUDT8, 59171, 161621, 11-721; 11555, NUDT9, 59173, 161623, 98-951; 11555, NUDT9, 59175, 161625, 25-258; 11555, NUDT9, 59176, 161626, 73-690; 11555, NUDT9, 59172, 161622, 325-1377; 11555, NUDT9, 59174, 161624, 123-1025; 11556, NUF2, 59179, 161629, 528-1133; 11556, NUF2, 59180, 161630, 427-861; 11556, NUF2, 59181, 161631, 195-567; 11556, NUF2, 59182, 161632, 42-707; 11556, NUF2, 59183, 161633, 334-1587; 11556, NUF2, 59177, 161627, 280-1674; 11556, NUF2, 59178, 161628, 153-1547; 11557, NUMB, 59192, 161642, 236-906; 11557, NUMB, 59193, 161643, 179-954; 11557, NUMB, 59194, 161644, 2289-3812; 11557, NUMB, 59195, 161645, 318-557; 11557, NUMB, 59197, 161647, 352-552; 11557, NUMB, 59199, 161649, 264-1039; 11557, NUMB, 59184, 161634, 19-1974; 11557, NUMB, 59185, 161635, 280-2091; 11557, NUMB, 59186, 161636, 19-1941; 11557, NUMB, 59187, 161637, 19-1830; 11557, NUMB, 59188, 161638, 19-1389; 11557, NUMB, 59189, 161639, 40-1377; 11557, NUMB, 59190, 161640, 263-2185; 11557, NUMB, 59191, 161641, 271-2226; 11557, NUMB, 59196, 161646, 321-2132; 11557, NUMB, 59198, 161648, 40-1524; 11557, NUMB, 59200, 161650, 358-2136; 11557, NUMB, 59201, 161651, 40-1410; 11557, NUMB, 59202, 161652, 40-1557; 11558, NUMBL, 59204, 161654, 98-1804; 11558, NUMBL, 59205, 161655, 1-640; 11558, NUMBL, 59206, 161656, 130-834; 11558, NUMBL, 59207, 161657, 213-559; 11558, NUMBL, 59208, 161658, 225-555; 11558, NUMBL, 59209, 161659, 109-1815; 11558, NUMBL, 59203, 161653, 169-1998; 11559, NRM, 59215, 161665, 1-787; 11559, NRM, 59219, 161669, 1-787; 11559, NRM, 59221, 161671, 1-787; 11559, NRM, 59225, 161675, 1-787; 11559, NRM, 59227, 161677, 1-787; 11559, NRM, 59228, 161678, 1-787; 11559, NRM, 59230, 161680, 1-787; 11559, NRM, 59210, 161660, 353-1141; 11559, NRM, 59211, 161661, 3-614; 11559, NRM, 59212, 161662, 335-1123; 11559, NRM, 59213, 161663, 3-614; 11559, NRM, 59214, 161664, 353-1141; 11559, NRM, 59216, 161666, 3-614; 11559, NRM, 59217, 161667, 3-614; 11559, NRM, 59218, 161668, 3-614; 11559, NRM, 59220, 161670, 353-1141; 11559, NRM, 59222, 161672, 353-1141; 11559, NRM, 59223, 161673, 3-614; 11559, NRM, 59224, 161674, 353-1141; 11559, NRM, 59226, 161676, 3-614; 11559, NRM, 59229, 161679, 353-1141; 11559, NRM, 59231, 161681, 353-1141; 11559, NRM, 59232, 161682, 335-1123; 11559, NRM, 59233, 161683, 335-1123; 11559, NRM, 59234, 161684, 335-1123; 11559, NRM, 59235, 161685, 335-1123; 11559, NRM, 59236, 161686, 335-1123; 11559, NRM, 59237, 161687, 335-1123; 11560, NUS1, 59238, 161688, 170-1051; 11561, NUTM2A, 59239, 161689, 332-2221; 11561, NUTM2A, 59240, 161690, 384-3020; 11562, NUTM2B, 59241, 161691, 1-1969; 11562, NUTM2B, 59242, 161692, 533-2221; 11562, NUTM2B, 59243, 161693, 384-3020; 11563, NUTM2D, 59245, 161695, 547-2220; 11563, NUTM2D, 59246, 161696, 1-458; 11563, NUTM2D, 59247, 161697, 1-2634; 11563, NUTM2D, 59244, 161694, 599-3019; 11564, NUTM2E, 59249, 161699, 384-2360; 11564, NUTM2E, 59248, 161698, 384-3020; 11565, NUTM2F, 59251, 161701, 22-2247; 11565, NUTM2F, 59250, 161700, 22-2292; 11566, NUTM2G, 59252, 161702, 716-2194; 11566, NUTM2G, 59253, 161703, 22-2247; 11567, NUTM1, 59254, 161704, 156-3554; 11567, NUTM1, 59255, 161705, 224-3676; 11567, NUTM1, 59256, 161706, 383-3865; 11567, NUTM1, 59257, 161707, 552-3950; 11568, NYX, 59258, 161708, 457-1902; 11568, NYX, 59259, 161709, 99-1544; 11569, NYNRIN, 59260, 161710, 319-6015; 11570, MGMT, 59261, 161711, 33-749; 11571, OARD1, 59262, 161712, 237-497; 11571, OARD1, 59264, 161714, 127-393; 11571, OARD1, 59265, 161715, 338-571; 11571, OARD1, 59266, 161716, 88-348; 11571, OARD1, 59267, 161717, 214-480; 11571, OARD1, 59268, 161718, 285-626; 11571, OARD1, 59269, 161719, 242-475; 11571, OARD1, 59271, 161721, 422-814; 11571, OARD1, 59272, 161722, 1-232; 11571, OARD1, 59275, 161725, 301-561; 11571, OARD1, 59263, 161713, 345-803; 11571, OARD1, 59270, 161720, 197-655; 11571, OARD1, 59273, 161723, 315-773; 11571, OARD1, 59274, 161724, 207-665; 11572, OLA1, 59278, 161728, 632-1882; 11572, OLA1, 59279, 161729, 177-485; 11572, OLA1, 59281, 161731, 361-709; 11572, OLA1, 59276, 161726, 248-1438; 11572, OLA1, 59277, 161727, 522-1238; 11572, OLA1, 59280, 161730, 25-861; 11573, OBSCN, 59283, 161733, 1-2577; 11573, OBSCN, 59284, 161734, 75-26852; 11573, OBSCN, 59286, 161736, 1-206; 11573, OBSCN, 59287, 161737, 75-26846; 11573, OBSCN, 59288, 161738, 1-4779; 11573, OBSCN, 59282, 161732, 75-19937; 11573, OBSCN, 59285, 161735, 75-23981; 11574, OBSL1, 59289, 161739, 299-2137; 11574, OBSL1, 59291, 161741, 10-5424; 11574, OBSL1, 59293, 161743, 1-1337; 11574, OBSL1, 59295, 161745, 1-1238; 11574, OBSL1, 59290, 161740, 58-3135; 11574, OBSL1, 59292, 161742, 58-5748; 11574, OBSL1, 59294, 161744, 58-4689; 11575, OCLN, 59299, 161749, 437-2005; 11575, OCLN, 59300, 161750, 45-1613; 11575, OCLN, 59301, 161751, 180-1748; 11575, OCLN, 59302, 161752, 45-437; 11575, OCLN, 59296, 161746, 437-2005; 11575, OCLN, 59297, 161747, 180-1748; 11575, OCLN, 59298, 161748, 143-958; 11576, OCEL1, 59304, 161754, 1-733; 11576, OCEL1, 59305, 161755, 1-207; 11576, OCEL1, 59306, 161756, 1-254; 11576, OCEL1, 59307, 161757, 178-804; 11576, OCEL1, 59308, 161758, 1-287; 11576, OCEL1, 59309, 161759, 24-521; 11576, OCEL1, 59310, 161760, 1-739; 11576, OCEL1, 59311, 161761, 1-159; 11576, OCEL1, 59303, 161753, 45-839; 11577, OCIAD1, 59317, 161767, 137-495; 11577, OCIAD1, 59318, 161768, 292-582; 11577, OCIAD1, 59319, 161769, 280-420; 11577, OCIAD1, 59320, 161770, 355-441; 11577, OCIAD1, 59321, 161771, 320-538; 11577, OCIAD1, 59323, 161773, 50-555; 11577, OCIAD1, 59324, 161774, 222-552; 11577, OCIAD1, 59325, 161775, 276-611; 11577, OCIAD1, 59327, 161777, 61-717; 11577, OCIAD1, 59328, 161778, 108-348; 11577, OCIAD1, 59329, 161779, 183-720; 11577, OCIAD1, 59330, 161780, 142-432; 11577, OCIAD1, 59331, 161781, 274-582; 11577, OCIAD1, 59332, 161782, 82-594; 11577, OCIAD1, 59333, 161783, 323-563; 11577, OCIAD1, 59334, 161784, 121-543; 11577, OCIAD1, 59335, 161785, 172-688; 11577, OCIAD1, 59312, 161762, 191-928; 11577, OCIAD1, 59313, 161763, 419-1156; 11577, OCIAD1, 59314, 161764, 191-754; 11577, OCIAD1, 59315, 161765, 148-732; 11577, OCIAD1, 59316, 161766, 276-860; 11577, OCIAD1, 59322, 161772, 232-969; 11577, OCIAD1, 59326, 161776, 63-800; 11578,

OCIAD2, 59337, 161787, 186-450; 11578, OCIAD2, 59339, 161789, 133-318; 11578, OCIAD2, 59336, 161786, 194-493; 11578, OCIAD2, 59338, 161788, 234-698; 11578, OCIAD2, 59340, 161790, 257-556; 11579, OCRL, 59341, 161791, 166-2847; 11579, OCRL, 59342, 161792, 166-2871; 11580, OCA2, 59345, 161795, 95-750; 11580, OCA2, 59346, 161796, 205-996; 11580, OCA2, 59347, 161797, 1-396; 11580, OCA2, 59348, 161798, 157-2400; 11580, OCA2, 59349, 161799, 95-750; 11580, OCA2, 59350, 161800, 111-2282; 11580, OCA2, 59351, 161801, 205-996; 11580, OCA2, 59343, 161793, 111-2555; 11580, OCA2, 59344, 161794, 157-2673; 11581, OCLM, 59352, 161802, 475-609; 11582, OSR1, 59353, 161803, 346-1146; 11583, OSR2, 59357, 161807, 410-1048; 11583, OSR2, 59358, 161808, 497-1363; 11583, OSR2, 59359, 161809, 43-853; 11583, OSR2, 59354, 161804, 497-1435; 11583, OSR2, 59355, 161805, 481-1311; 11583, OSR2, 59356, 161806, 422-1723; 11583, OSR2, 59360, 161810, 529-1467; 11584, ODAM, 59362, 161812, 1-93; 11584, ODAM, 59363, 161813, 20-780; 11584, ODAM, 59364, 161814, 1-651; 11584, ODAM, 59361, 161811, 49-888; 11585, OBP2A, 59365, 161815, 43-486; 11585, OBP2A, 59366, 161816, 43-729; 11585, OBP2A, 59368, 161818, 43-483; 11585, OBP2A, 59370, 161820, 43-300; 11585, OBP2A, 59371, 161821, 43-705; 11585, OBP2A, 59367, 161817, 43-555; 11585, OBP2A, 59369, 161819, 27-539; 11586, OBP2B, 59372, 161822, 29-691; 11586, OBP2B, 59373, 161823, 43-555; 11586, OBP2B, 59374, 161824, 43-540; 11586, OBP2B, 59375, 161825, 52-564; 11587, N/A, 59378, 161828, 29-691; 11587, N/A, 59376, 161826, 52-564; 11587, N/A, 59377, 161827, 43-540; 11587, N/A, 59379, 161829, 43-555; 11588, OLAH, 59381, 161831, 224-637; 11588, OLAH, 59383, 161833, 288-717; 11588, OLAH, 59384, 161834, 262-551; 11588, OLAH, 59385, 161835, 226-768; 11588, OLAH, 59380, 161830, 188-1144; 11588, OLAH, 59382, 161832, 255-1052; 11589, OLFM1, 59388, 161838, 53-542; 11589, OLFM1, 59391, 161841, 286-789; 11589, OLFM1, 59392, 161842, 42-431; 11589, OLFM1, 59394, 161844, 1-298; 11589, OLFM1, 59395, 161845, 167-791; 11589, OLFM1, 59396, 161846, 159-546; 11589, OLFM1, 59397, 161847, 465-971; 11589, OLFM1, 59386, 161836, 188-1591; 11589, OLFM1, 59387, 161837, 286-693; 11589, OLFM1, 59389, 161839, 252-1709; 11589, OLFM1, 59390, 161840, 115-1491; 11589, OLFM1, 59393, 161843, 317-778; 11590, OLFM2, 59399, 161849, 94-1224; 11590, OLFM2, 59400, 161850, 220-1226; 11590, OLFM2, 59401, 161851, 72-308; 11590, OLFM2, 59398, 161848, 187-1551; 11591, OLFM3, 59402, 161852, 1-1437; 11591, OLFM3, 59403, 161853, 215-1591; 11591, OLFM3, 59404, 161854, 161-583; 11592, OLFM4, 59405, 161855, 79-1611; 11593, OLFML1, 59407, 161857, 371-575; 11593, OLFML1, 59409, 161859, 271-441; 11593, OLFML1, 59406, 161856, 395-1603; 11593, OLFML1, 59408, 161858, 251-1459; 11594, OLFML2A, 59411, 161861, 114-1067; 11594, OLFML2A, 59410, 161860, 175-1491; 11594, OLFML2A, 59412, 161862, 1-1959; 11595, OLFML2B, 59415, 161865, 211-2466; 11595, OLFML2B, 59416, 161866, 1-267; 11595, OLFML2B, 59417, 161867, 1-273; 11595, OLFML2B, 59413, 161863, 425-2677; 11595, OLFML2B, 59414, 161864, 330-1031; 11596, OLFML3, 59420, 161870, 439-1476; 11596, OLFML3, 59418, 161868, 75-1295; 11596, OLFML3, 59419, 161869, 289-1449; 11597, OMP, 59421, 161871, 1-492; 11598, N/A, 59422, 161872, 1-945; 11598, N/A, 59423, 161873, 1-945; 11598, N/A, 59424, 161874, 1-945; 11598, N/A, 59425, 161875, 1-945; 11598, N/A, 59426, 161876, 1-945; 11598, N/A, 59427, 161877, 1-945; 11599, N/A, 59428, 161878, 1-981; 11599, N/A, 59429, 161879, 1-981; 11600, N/A, 59430, 161880, 63-1013; 11600, N/A, 59431, 161881, 1-951; 11601, N/A, 59432, 161882, 1-933; 11601, N/A, 59433, 161883, 1-933; 11602, N/A, 59434, 161884, 99-1040; 11603, N/A, 59435, 161885, 49-960; 11603, N/A, 59436, 161886, 49-960; 11604, N/A, 59438, 161888, 1-939; 11604, N/A, 59437, 161887, 1-960; 11605, N/A, 59439, 161889, 1-948; 11605, N/A, 59440, 161890, 1-948; 11606, N/A, 59441, 161891, 25-957; 11606, N/A, 59442, 161892, 25-957; 11607, N/A, 59443, 161893, 1-936; 11607, N/A, 59444, 161894, 101-1036; 11608, N/A, 59445, 161895, 1-975; 11608, N/A, 59446, 161896, 1-975; 11609, N/A, 59447, 161897, 24-977; 11609, N/A, 59448, 161898, 24-977; 11610, N/A, 59449, 161899, 23-952; 11610, N/A, 59450, 161900, 23-952; 11611, OR1A1, 59451, 161901, 1-930; 11612, OR1A2, 59452, 161902, 1-930; 11613, OR1B1, 59453, 161903, 1-957; 11614, OR1C1, 59454, 161904, 1-945; 11615, OR1D2, 59455, 161905, 1-939; 11616, OR1D5, 59456, 161906, 1-939; 11617, OR1E1, 59457, 161907, 1-945; 11618, OR1E2, 59458, 161908, 1-972; 11619, OR1F1, 59459, 161909, 1-939; 11620, OR1G1, 59460, 161910, 31-972; 11621, OR1I1, 59461, 161911, 87-1154; 11622, OR1J1, 59462, 161912, 1-969; 11623, OR1J2, 59463, 161913, 1-942; 11624, OR1J4, 59464, 161914, 1-942; 11625, OR1K1, 59465, 161915, 1-951; 11626, OR1L1, 59466, 161916, 1-933; 11626, OR1L1, 59467, 161917, 1-1083; 11627, OR1L3, 59468, 161918, 1-975; 11628, OR1L4, 59469, 161919, 1-936; 11629, OR1L6, 59470, 161920, 1-936; 11629, OR1L6, 59471, 161921, 1-1044; 11630, OR1L8, 59472, 161922, 1-930; 11631, OR1M1, 59473, 161923, 67-1008; 11632, OR1N1, 59475, 161925, 1-939; 11632, OR1N1, 59474, 161924, 1-936; 11633, OR1N2, 59477, 161927, 1-924; 11633, OR1N2, 59476, 161926, 59-1051; 11634, OR1Q1, 59478, 161928, 1-945; 11635, OR1S1, 59479, 161929, 1-978; 11635, OR1S1, 59480, 161930, 1-978; 11635, OR1S1, 59481, 161931, 1-978; 11636, OR1S2, 59482, 161932, 1-978; 11637, OR10A2, 59483, 161933, 63-974; 11638, OR10A3, 59484, 161934, 75-1019; 11638, OR10A3, 59485, 161935, 75-1019; 11638, OR10A3, 59486, 161936, 75-1019; 11639, OR10A4, 59487, 161937, 24-971; 11640, OR10A5, 59488, 161938, 32-985; 11641, OR10A6, 59489, 161939, 1-945; 11642, OR10A7, 59490, 161940, 1-951; 11643, OR10AC1, 59491, 161941, 1-979; 11644, OR10AD1, 59492, 161942, 96-1049; 11645, OR10AG1, 59493, 161943, 1-906; 11646, OR10C1, 59497, 161947, 711-1649; 11646, OR10C1, 59501, 161951, 711-1649; 11646, OR10C1, 59502, 161952, 72-1016; 11646, OR10C1, 59503, 161953, 72-1016; 11646, OR10C1, 59504, 161954, 72-1016; 11646, OR10C1, 59505, 161955, 72-1016; 11646, OR10C1, 59506, 161956, 72-1016; 11646, OR10C1, 59507, 161957, 72-1016; 11646, OR10C1, 59508, 161958, 72-1016; 11646, OR10C1, 59509, 161959, 72-1016; 11646, OR10C1, 59510, 161960, 1-939; 11646, OR10C1, 59494, 161944, 711-1649; 11646, OR10C1, 59495, 161945, 711-1649; 11646, OR10C1, 59496, 161946, 711-1649; 11646, OR10C1, 59498, 161948, 711-1649; 11646, OR10C1, 59499, 161949, 711-1649; 11646, OR10C1, 59500, 161950, 711-1649; 11647, OR10D3, 59511, 161961, 55-993; 11648, OR10G2, 59512, 161962, 99-1031; 11649, OR10G3, 59513, 161963, 1-942; 11650, OR10G4, 59514, 161964, 1-936; 11651, OR10G6, 59515, 161965, 1-999; 11652, OR10G7, 59516, 161966, 10-945; 11653, OR10G8, 59517, 161967, 34-969; 11654, OR10G9, 59518, 161968, 1-936; 11655, OR10H1, 59519, 161969, 90-1046; 11656, OR10H2, 59520, 161970, 25-972; 11657, OR10H3, 59521, 161971, 1-951; 11658, OR10H4, 59522, 161972, 1-951; 11659, OR10H5, 59523, 161973, 99-1046; 11660, OR10J1, 59524, 161974, 38-1000; 11661, OR10J3, 59525, 161975, 1-990; 11662, OR10J4, 59526, 161976, 1-935; 11663, OR10J5, 59527, 161977, 1-930; 11664, OR10K1, 59528, 161978, 1-942; 11665, OR10K2, 59529, 161979, 1-939; 11666, OR10P1, 59530, 161980, 33-974; 11667, OR10Q1, 59531, 161981, 44-1003; 11668, OR10R2, 59532, 161982, 1-1008; 11669, OR10S1, 59533, 161983, 91-1086; 11670, OR10T2, 59534, 161984, 1-945; 11671, OR10V1, 59535, 161985, 20-949; 11672, OR10W1, 59536, 161986, 403-1320; 11673, OR10X1, 59537, 161987, 1-981; 11674, OR10Z1, 59538, 161988, 1-942; 11675, OR11A1, 59539, 161989, 92-1039; 11675, OR11A1, 59540, 161990, 345-1292; 11675, OR11A1, 59541, 161991, 474-1421; 11675, OR11A1, 59542, 161992, 345-1292; 11675, OR11A1, 59543, 161993, 345-1292; 11675, OR11A1, 59544, 161994, 474-1421; 11675, OR11A1, 59545, 161995, 474-1421; 11675, OR11A1, 59546, 161996, 345-1292; 11675, OR11A1, 59547, 161997, 474-1421; 11675, OR11A1, 59548, 161998, 474-1421; 11675, OR11A1, 59549, 161999, 474-1421; 11675, OR11A1, 59550, 162000, 345-1292; 11675, OR11A1, 59551, 162001, 345-1292; 11675, OR11A1, 59552, 162002, 345-1292; 11675, OR11A1, 59553, 162003, 474-1421; 11675, OR11A1, 59554, 162004, 345-1292; 11675, OR11A1, 59555, 162005, 474-1421; 11675, OR11A1, 59556, 162006, 92-1039; 11675, OR11A1, 59557, 162007, 92-1039; 11675, OR11A1, 59558, 162008, 92-1039; 11675, OR11A1, 59559, 162009, 92-1039; 11675, OR11A1, 59560, 162010, 92-1039; 11675, OR11A1, 59561, 162011, 92-1039; 11675, OR11A1, 59562, 162012, 92-1039; 11676, OR11G2, 59563, 162013, 1-1038; 11677, OR11H1, 59564, 162014, 2-982; 11678, OR11H12, 59565, 162015, 73-1053; 11679, OR11H2, 59566, 162016, 5-985; 11680, OR11H4, 59567, 162017, 54-1028; 11681, OR11H6, 59568, 162018, 79-1071; 11682, OR11H7, 59569, 162019, 1-940; 11683, OR11L1, 59570, 162020, 1-969; 11684, OR12D1, 59571, 162021, 1-947; 11685, OR12D2, 59574, 162024, 146-1069; 11685, OR12D2, 59575, 162025, 146-1069; 11685, OR12D2, 59572, 162022, 146-1069; 11685, OR12D2, 59573, 162023, 1-924; 11685, OR12D2, 59576, 162026, 146-1069; 11685, OR12D2, 59577, 162027, 146-1069; 11685, OR12D2, 59578, 162028, 62-985; 11685, OR12D2, 59579, 162029, 146-1069; 11686, OR12D3, 59584, 162034, 147-1097; 11686, OR12D3, 59585, 162035, 147-1097; 11686, OR12D3, 59586, 162036, 5-955; 11686, OR12D3, 59589, 162039, 5-955; 11686, OR12D3, 59580, 162030, 147-1097; 11686, OR12D3, 59581, 162031, 5-955; 11686, OR12D3, 59582, 162032, 147-1097; 11686, OR12D3, 59583, 162033, 147-1097; 11686, OR12D3, 59587, 162037, 5-955; 11686, OR12D3, 59588, 162038, 5-955; 11686, OR12D3, 59590, 162040, 5-955; 11687, OR13A1, 59591, 162041, 113-1099; 11687, OR13A1, 59592, 162042, 255-1241; 11687, OR13A1, 59593, 162043, 310-1296; 11687, OR13A1, 59594, 162044, 113-1099; 11687, OR13A1, 59595, 162045, 310-1296; 11687, OR13A1, 59596, 162046, 255-1241; 11688, OR1302, 59597, 162047, 1-957; 11689, OR1303, 59598, 162048, 44-1087; 11690, OR1304, 59599, 162049, 1-957; 11691, OR1305, 59600, 162050, 1-957; 11692, OR13C7, 59601, 162051, 1-959; 11693, OR1308, 59602, 162052, 1-963; 11694, OR1309, 59603, 162053, 1-957; 11695, OR13D1, 59604, 162054, 1-1041; 11696, OR13F1, 59605, 162055, 1-960; 11697, OR13G1, 59606, 162056, 1-924; 11698, OR13H1, 59607, 162057, 1-927; 11699, OR13J1, 59608, 162058, 201-1139; 11700, OR14A16, 59609, 162059, 1-930; 11701, OR14A2, 59610, 162060, 1-945; 11702, OR14036, 59611, 162061, 1-939; 11703, OR1411, 59612, 162062, 1-936; 11704, OR14J1, 59613, 162063, 1-966; 11704, OR14J1, 59614, 162064, 1-966; 11704, OR14J1, 59615, 162065, 1-966; 11704, OR14J1, 59616, 162066, 1-966; 11704, OR14J1, 59617, 162067, 1-966; 11704, OR14J1, 59618, 162068, 1-966; 11704, OR14J1, 59619, 162069, 1-966; 11705, OR14K1, 59620, 162070, 1-945; 11706, OR2A1, 59621, 162071, 1-933; 11707, OR2A12, 59622, 162072, 61-993; 11708, OR2A14, 59624, 162074, 1-924; 11708, OR2A14, 59623, 162073, 56-988; 11709, OR2A2, 59625, 162075, 70-1026; 11710, OR2A25, 59626, 162076, 39-971; 11711, OR2A4, 59627, 162077, 1-933; 11712, OR2A42, 59628, 162078, 1-933; 11713, OR2A5, 59629, 162079, 35-970; 11714, OR2A7, 59630, 162080, 95-1027; 11715, OR2AE1, 59631, 162081, 25-996; 11716, OR2AG1, 59632, 162082, 22-972; 11716, OR2AG1, 59633, 162083, 22-972; 11716, OR2AG1, 59634, 162084, 1-951; 11717, OR2AG2, 59635, 162085, 99-1049; 11718, OR2AJ1, 59636, 162086, 1-987; 11719, OR2AK2, 59637, 162087, 100-1107; 11720, OR2AP1, 59638, 162088, 1-930; 11721, OR2AT4, 59639, 162089, 42-1004; 11722, OR2B11, 59640, 162090, 1-954; 11723, OR2B2, 59641, 162091, 78-1151; 11724, OR2B3, 59642, 162092, 66-1007; 11724, OR2B3, 59643, 162093, 66-1007; 11724, OR2B3, 59644, 162094, 66-1007; 11724, OR2B3, 59645, 162095, 66-1007; 11724, OR2B3, 59646, 162096, 66-1007; 11724, OR2B3, 59647, 162097, 66-1007; 11724, OR2B3, 59648, 162098, 66-1007; 11724, OR2B3, 59649, 162099, 66-1007; 11725, OR2B6, 59650, 162100, 1-942; 11726, OR2C1, 59651, 162101, 53-991; 11727, OR2C3, 59652, 162102, 363-1325; 11727, OR203, 59653, 162103, 103-1065; 11728, OR2D2, 59654, 162104, 100-1026; 11729, OR2D3, 59655, 162105, 29-1021; 11730, OR2F1, 59656, 162106, 40-993; 11730, OR2F1, 59657, 162107, 45-998; 11731, OR2F2, 59658, 162108, 68-1021; 11732, OR2G2, 59659, 162109, 1-954; 11733, OR2G3, 59660, 162110, 1-930; 11734, OR2G6, 59661, 162111, 1-951; 11735, OR2H1, 59662, 162112, 710-1660; 11735, OR2H1, 59663, 162113, 463-1413; 11735, OR2H1, 59664, 162114, 466-1416; 11735, OR2H1, 59665, 162115, 710-1660; 11735, OR2H1, 59666, 162116, 710-1660; 11735, OR2H1, 59667, 162117, 331-1281; 11735, OR2H1, 59668, 162118, 331-1281; 11735, OR2H1, 59669, 162119, 463-1413; 11735, OR2H1, 59670, 162120, 466-1416; 11735, OR2H1, 59671, 162121, 331-1281; 11735, OR2H1, 59672, 162122, 463-1413; 11735, OR2H1, 59673, 162123, 466-1416; 11735, OR2H1, 59674, 162124, 463-1413; 11735, OR2H1, 59675, 162125, 710-1660; 11735, OR2H1, 59676, 162126, 466-1416; 11735, OR2H1, 59677, 162127, 331-1281; 11735, OR2H1, 59678, 162128, 331-1281; 11735, OR2H1, 59679, 162129, 331-1281; 11735, OR2H1, 59680, 162130, 463-1413; 11735, OR2H1, 59681, 162131, 710-1660; 11735, OR2H1, 59682, 162132, 710-1660; 11735, OR2H1, 59683, 162133, 466-1416; 11735, OR2H1, 59684, 162134, 466-1416; 11735, OR2H1, 59685, 162135, 463-1413; 11735, OR2H1, 59686, 162136, 463-1413; 11735, OR2H1, 59687, 162137, 466-1416; 11735, OR2H1, 59688, 162138, 466-1416; 11735, OR2H1, 59689, 162139, 710-1660; 11735, OR2H1, 59690, 162140, 331-1281; 11735, OR2H1, 59691, 162141, 463-1413; 11735, OR2H1, 59692, 162142, 331-1281; 11735, OR2H1, 59693, 162143, 710-1660; 11736, OR2H2, 59694, 162144, 491-1429; 11736, OR2H2, 59695, 162145, 491-1429; 11736, OR2H2, 59696, 162146, 491-1429; 11736, OR2H2, 59697, 162147, 491-1429; 11736, OR2H2, 59698, 162148, 491-1429; 11736, OR2H2, 59699, 162149, 491-1429; 11736, OR2H2, 59700, 162150, 491-1429; 11737, OR2J1, 59701, 162151, 335-1273; 11737, OR2J1, 59702, 162152, 335-1273; 11738, OR2J2, 59703, 162153, 334-1272; 11738,

OR2J2, 59704, 162154, 334-1272; 11738, OR2J2, 59705, 162155, 334-1272; 11738, OR2J2, 59706, 162156, 334-1272; 11738, OR2J2, 59707, 162157, 334-1272; 11738, OR2J2, 59708, 162158, 334-1272; 11738, OR2J2, 59709, 162159, 334-1272; 11738, OR2J2, 59710, 162160, 334-1272; 11739, OR2J3, 59716, 162166, 1-774; 11739, OR2J3, 59719, 162169, 82-1017; 11739, OR2J3, 59711, 162161, 1-936; 11739, OR2J3, 59712, 162162, 1-936; 11739, OR2J3, 59713, 162163, 1-936; 11739, OR2J3, 59714, 162164, 1-936; 11739, OR2J3, 59715, 162165, 1-936; 11739, OR2J3, 59717, 162167, 1-936; 11739, OR2J3, 59718, 162168, 1-936; 11740, OR2K2, 59720, 162170, 1-951; 11740, OR2K2, 59721, 162171, 1-1038; 11741, OR2L13, 59722, 162172, 146-1084; 11741, OR2L13, 59723, 162173, 338-1276; 11742, OR2L2, 59724, 162174, 1-939; 11743, OR2L3, 59725, 162175, 1-939; 11744, OR2L5, 59726, 162176, 1-939; 11745, OR2L8, 59727, 162177, 1-939; 11746, OR2M2, 59728, 162178, 1-1044; 11747, OR2M3, 59729, 162179, 1-939; 11748, OR2M4, 59730, 162180, 1-936; 11749, OR2M5, 59731, 162181, 1-939; 11750, OR2M7, 59732, 162182, 1-939; 11751, OR2S2, 59733, 162183, 57-1016; 11751, OR2S2, 59734, 162184, 1-960; 11751, OR2S2, 59735, 162185, 57-1016; 11752, OR2T1, 59736, 162186, 1-1110; 11752, OR2T1, 59737, 162187, 1-1110; 11752, OR2T1, 59738, 162188, 1-1110; 11753, OR2T10, 59739, 162189, 1-939; 11754, OR2T11, 59740, 162190, 1-951; 11755, OR2T12, 59741, 162191, 1-963; 11756, OR2T2, 59742, 162192, 1-975; 11756, OR2T2, 59743, 162193, 1-975; 11756, OR2T2, 59744, 162194, 23-997; 11757, OR2T27, 59745, 162195, 1-954; 11758, OR2T29, 59746, 162196, 1-948; 11759, OR2T3, 59747, 162197, 1-957; 11759, OR2T3, 59748, 162198, 1-957; 11759, OR2T3, 59749, 162199, 26-982; 11760, OR2T33, 59750, 162200, 1-963; 11761, OR2T34, 59751, 162201, 1-957; 11762, OR2T35, 59752, 162202, 1-972; 11763, OR2T4, 59753, 162203, 1-1047; 11763, OR2T4, 59754, 162204, 1-1047; 11763, OR2T4, 59755, 162205, 1-1047; 11764, OR2T5, 59756, 162206, 1-948; 11764, OR2T5, 59757, 162207, 26-973; 11764, OR2T5, 59758, 162208, 1-948; 11765, OR2T6, 59759, 162209, 1-927; 11765, OR2T6, 59760, 162210, 1-927; 11765, OR2T6, 59761, 162211, 1-927; 11766, OR2T7, 59762, 162212, 1-927; 11766, OR2T7, 59763, 162213, 1-927; 11767, OR2T8, 59764, 162214, 1-939; 11768, OR2V1, 59765, 162215, 1-948; 11769, OR2V2, 59766, 162216, 1-948; 11770, OR2W1, 59767, 162217, 66-1028; 11770, OR2W1, 59768, 162218, 66-1028; 11770, OR2W1, 59769, 162219, 66-1028; 11770, OR2W1, 59770, 162220, 66-1028; 11770, OR2W1, 59771, 162221, 66-1028; 11770, OR2W1, 59772, 162222, 66-1028; 11770, OR2W1, 59773, 162223, 66-1028; 11770, OR2W1, 59774, 162224, 66-1028; 11771, OR2W3, 59775, 162225, 1-945; 11772, OR2Y1, 59776, 162226, 42-977; 11773, OR2Z1, 59777, 162227, 76-1020; 11774, OR3A1, 59779, 162229, 1-966; 11774, OR3A1, 59778, 162228, 1-948; 11775, OR3A2, 59780, 162230, 40-1005; 11776, OR3A3, 59781, 162231, 1-966; 11777, OR4A15, 59782, 162232, 1-1035; 11778, OR4A16, 59783, 162233, 1-987; 11779, OR4A47, 59784, 162234, 77-1006; 11780, OR4A5, 59785, 162235, 1-948; 11781, OR4A8, 59786, 162236, 1-945; 11782, OR4B1, 59787, 162237, 19-948; 11783, OR4C11, 59788, 162238, 26-958; 11784, OR4C12, 59789, 162239, 35-964; 11785, OR4C13, 59790, 162240, 33-962; 11786, OR4C15, 59791, 162241, 1-1113; 11787, OR4C16, 59792, 162242, 1-933; 11788, OR4C3, 59794, 162244, 1-597; 11788, OR4C3, 59793, 162243, 22-1011; 11789, OR4C46, 59795, 162245, 1-930; 11790, OR4C5, 59796, 162246, 1-981; 11791, OR4C6, 59797, 162247, 1-930; 11792, OR4D1, 59798, 162248, 22-954; 11793, OR4D10, 59799, 162249, 58-993; 11794, OR4D11, 59800, 162250, 1-936; 11795, OR4D2, 59801, 162251, 1-924; 11796, OR4D5, 59802, 162252, 75-1031; 11797, OR4D6, 59803, 162253, 24-968; 11798, OR4D9, 59804, 162254, 1-945; 11799, OR4E2, 59805, 162255, 1-942; 11800, OR4F15, 59807, 162257, 1-927; 11800, OR4F15, 59806, 162256, 25-963; 11801, OR4F16, 59808, 162258, 1-939; 11802, OR4F17, 59809, 162259, 37-954; 11802, OR4F17, 59810, 162260, 150-1067; 11803, OR4F21, 59811, 162261, 20-958; 11804, OR4F29, 59812, 162262, 1-939; 11805, OR4F3, 59813, 162263, 20-958; 11806, OR4F4, 59814, 162264, 37-954; 11807, OR4F5, 59815, 162265, 1-918; 11808, OR4F6, 59816, 162266, 22-960; 11809, OR4K1, 59817, 162267, 60-995; 11810, OR4K13, 59818, 162268, 3-917; 11811, OR4K14, 59819, 162269, 1-933; 11812, OR4K15, 59820, 162270, 76-1122; 11813, OR4K17, 59821, 162271, 1-1032; 11814, OR4K2, 59822, 162272, 37-981; 11815, OR4K5, 59823, 162273, 26-997; 11816, OR4L1, 59824, 162274, 1-939; 11817, OR4M1, 59825, 162275, 82-1023; 11818, OR4M2, 59826, 162276, 99-1040; 11819, OR4N2, 59828, 162278, 501-565; 11819, OR4N2, 59829, 162279, 85-522; 11819, OR4N2, 59827, 162277, 1-924; 11820, OR4N4, 59830, 162280, 92-1042; 11821, OR4N5, 59831, 162281, 1-927; 11822, OR4P4, 59832, 162282, 1-939; 11823, OR4Q2, 59833, 162283, 1-944; 11823, OR4Q2, 59834, 162284, 1-921; 11824, OR4Q3, 59835, 162285, 1-942; 11825, OR4S1, 59836, 162286, 1-930; 11826, OR4S2, 59837, 162287, 1-936; 11827, OR4X1, 59838, 162288, 1-918; 11827, OR4X1, 59839, 162289, 1-918; 11827, OR4X1, 59840, 162290, 1-918; 11828, OR4X2, 59841, 162291, 1-912; 11829, OR5A1, 59842, 162292, 26-973; 11830, OR5A2, 59843, 162293, 24-998; 11831, OR5AC1, 59844, 162294, 1-925; 11832, OR5AC2, 59845, 162295, 1-930; 11833, OR5AK2, 59846, 162296, 43-972; 11834, OR5AN1, 59847, 162297, 48-983; 11835, OR5AP2, 59849, 162299, 30-983; 11835, OR5AP2, 59848, 162298, 1-951; 11836, OR5AR1, 59850, 162300, 1-933; 11837, OR5AS1, 59851, 162301, 1-975; 11838, OR5AU1, 59852, 162302, 39-1127; 11839, OR5B12, 59853, 162303, 23-967; 11840, OR5B17, 59854, 162304, 1-945; 11841, OR5B2, 59855, 162305, 53-982; 11842, OR5B21, 59856, 162306, 1-930; 11843, OR5B3, 59857, 162307, 1-945; 11844, OR5C1, 59858, 162308, 1-963; 11845, OR5D13, 59859, 162309, 1-945; 11846, OR5D14, 59860, 162310, 1-945; 11847, OR5D16, 59861, 162311, 1-987; 11848, OR5D18, 59862, 162312, 1-942; 11849, OR5F1, 59863, 162313, 1-945; 11850, OR5G3, 59864, 162314, 1-929; 11850, OR5G3, 59865, 162315, 1-936; 11851, OR5H1, 59866, 162316, 1-942; 11852, OR5H14, 59867, 162317, 61-993; 11853, OR5H15, 59869, 162319, 1-933; 11853, OR5H15, 59868, 162318, 1-942; 11854, OR5H2, 59870, 162320, 1-945; 11855, OR5H6, 59871, 162321, 1-978; 11855, OR5H6, 59872, 162322, 1-978; 11855, OR5H6, 59873, 162323, 1-978; 11856, OR5H8, 59874, 162324, 1-931; 11857, OR5I1, 59875, 162325, 1-945; 11858, OR5J2, 59876, 162326, 1-939; 11859, OR5K1, 59877, 162327, 98-1024; 11860, OR5K2, 59878, 162328, 78-1028; 11861, OR5K3, 59879, 162329, 1-966; 11862, OR5K4, 59880, 162330, 1-966; 11863, OR5L1, 59881, 162331, 1-936; 11864, OR5L2, 59882, 162332, 1-936; 11865, OR5M1, 59883, 162333, 1-948; 11866, OR5M10, 59884, 162334, 1-948; 11867, OR5M11, 59885, 162335, 1-918; 11868, OR5M3, 59886, 162336, 1-924; 11869, OR5M8, 59887, 162337, 1-936; 11870, OR5M9, 59888, 162338, 1-933; 11871, OR5P2, 59889, 162339, 32-1000; 11871, OR5P2, 59890, 162340, 32-1000;

11871, OR5P2, 59891, 162341, 32-1000; 11872, OR5P3, 59892, 162342, 1-936; 11872, OR5P3, 59893, 162343, 1-936; 11872, OR5P3, 59894, 162344, 1-936; 11873, OR5R1, 59895, 162345, 1-975; 11874, OR5T1, 59896, 162346, 1-981; 11874, OR5T1, 59897, 162347, 1-981; 11875, OR5T2, 59898, 162348, 1-1080; 11875, OR5T2, 59899, 162349, 1-1080; 11876, OR5T3, 59900, 162350, 1-1023; 11876, OR5T3, 59901, 162351, 1-1023; 11877, OR5V1, 59902, 162352, 83-1048; 11877, OR5V1, 59903, 162353, 301-1266; 11877, OR5V1, 59904, 162354, 301-1266; 11877, OR5V1, 59905, 162355, 301-1266; 11877, OR5V1, 59906, 162356, 152-1117; 11877, OR5V1, 59907, 162357, 152-1117; 11877, OR5V1, 59908, 162358, 301-1266; 11877, OR5V1, 59909, 162359, 301-1266; 11877, OR5V1, 59910, 162360, 152-1117; 11877, OR5V1, 59911, 162361, 83-1048; 11877, OR5V1, 59912, 162362, 83-1048; 11877, OR5V1, 59913, 162363, 83-1048; 11877, OR5V1, 59914, 162364, 83-1048; 11878, OR5W2, 59915, 162365, 1-933; 11879, OR51A2, 59916, 162366, 1-942; 11880, OR51A4, 59917, 162367, 1-942; 11881, OR51A7, 59918, 162368, 1-939; 11882, OR51B2, 59919, 162369, 1-939; 11882, OR51B2, 59920, 162370, 1-939; 11882, OR51B2, 59921, 162371, 56-994; 11883, OR51B4, 59922, 162372, 51-983; 11884, OR51B5, 59923, 162373, 1-939; 11885, OR51B6, 59924, 162374, 1-939; 11886, OR51D1, 59925, 162375, 77-1051; 11887, OR51E1, 59927, 162377, 42-260; 11887, OR51E1, 59926, 162376, 651-1607; 11888, OR51E2, 59929, 162379, 332-582; 11888, OR51E2, 59928, 162378, 241-1203; 11889, OR51F1, 59930, 162380, 1-939; 11890, OR51F2, 59931, 162381, 1-1029; 11891, OR51G1, 59932, 162382, 1-966; 11892, OR51G2, 59933, 162383, 1-945; 11893, OR51H1, 59934, 162384, 1-909; 11894, OR5111, 59935, 162385, 1-945; 11895, OR5112, 59936, 162386, 1-939; 11896, OR51J1, 59937, 162387, 1-951; 11897, OR51L1, 59938, 162388, 1-948; 11898, OR51M1, 59939, 162389, 1-981; 11899, OR51Q1, 59940, 162390, 91-1044; 11900, OR51S1, 59941, 162391, 1-972; 11901, OR51T1, 59943, 162393, 1-1065; 11901, OR51T1, 59942, 162392, 1-984; 11902, OR51V1, 59944, 162394, 1-966; 11903, OR52A1, 59945, 162395, 1-939; 11903, OR52A1, 59946, 162396, 419-1357; 11904, OR52A5, 59947, 162397, 1-951; 11905, OR52B2, 59948, 162398, 83-1054; 11906, OR52B4, 59949, 162399, 92-1036; 11906, OR52B4, 59950, 162400, 92-1036; 11907, OR52B6, 59951, 162401, 1-1008; 11908, OR52D1, 59952, 162402, 23-979; 11909, OR52E2, 59953, 162403, 1-978; 11910, OR52E4, 59954, 162404, 23-961; 11911, OR52E5, 59955, 162405, 1-984; 11912, OR52E6, 59957, 162407, 1-954; 11912, OR52E6, 59956, 162406, 1-942; 11913, OR52E8, 59958, 162408, 33-986; 11914, OR52H1, 59959, 162409, 1-963; 11915, OR5211, 59960, 162410, 1-1050; 11915, OR5211, 59961, 162411, 1-975; 11916, OR5212, 59962, 162412, 23-1075; 11917, OR52J3, 59963, 162413, 1-936; 11918, OR52K1, 59964, 162414, 23-967; 11919, OR52K2, 59965, 162415, 46-990; 11920, OR52L1, 59966, 162416, 56-1045; 11921, OR52M1, 59967, 162417, 1-954; 11922, OR52N1, 59968, 162418, 1-963; 11923, OR52N2, 59969, 162419, 23-988; 11924, OR52N4, 59970, 162420, 49-1014; 11925, OR52N5, 59971, 162421, 34-1008; 11926, OR52R1, 59972, 162422, 1-948; 11927, OR52W1, 59973, 162423, 79-1041; 11928, OR52Z1, 59974, 162424, 1-897; 11929, OR56A1, 59975, 162425, 38-994; 11930, OR56A3, 59976, 162426, 8-955; 11931, OR56A4, 59977, 162427, 47-1144; 11932, OR56A5, 59978, 162428, 1-738; 11932, OR56A5, 59979, 162429, 1-942; 11933, OR56B1, 59980, 162430, 1-975; 11934, OR56B4, 59981, 162431, 96-1055; 11935, OR6A2, 59982, 162432, 76-1059; 11936, OR6B1, 59983, 162433, 69-1004; 11937, OR6B2, 59984, 162434, 28-966; 11938, OR6B3, 59985, 162435, 1-996; 11939, OR6C1, 59986, 162436, 40-978; 11940, OR6C2, 59987, 162437, 1-939; 11941, OR6C3, 59988, 162438, 1-936; 11942, OR6C4, 59989, 162439, 29-958; 11943, OR6C6, 59990, 162440, 1-945; 11944, OR6065, 59991, 162441, 100-1038; 11945, OR6C68, 59992, 162442, 1-939; 11946, OR6C70, 59993, 162443, 1-939; 11947, OR6C74, 59994, 162444, 91-1029; 11948, OR6C75, 59995, 162445, 1-939; 11949, OR6C76, 59996, 162446, 1-939; 11950, OR6F1, 59997, 162447, 1-927; 11951, OR6J1, 59998, 162448, 1-1044; 11952, OR6K2, 59999, 162449, 1-975; 11953, OR6K3, 60000, 162450, 1-948; 11953, OR6K3, 60001, 162451, 1-996; 11954, OR6K6, 60002, 162452, 97-1128; 11955, OR6M1, 60003, 162453, 39-980; 11956, OR6N1, 60004, 162454, 1-939; 11957, OR6N2, 60005, 162455, 1-954; 11958, OR6P1, 60006, 162456, 1-954; 11959, OR6Q1, 60007, 162457, 1-954; 11960, OR6S1, 60008, 162458, 1-996; 11961, OR6T1, 60009, 162459, 36-1007; 11962, OR6V1, 60010, 162460, 22-963; 11962, OR6V1, 60011, 162461, 22-963; 11963, OR6X1, 60012, 162462, 28-966; 11964, OR6Y1, 60013, 162463, 1-978; 11965, OR7A10, 60014, 162464, 1-930; 11966, OR7A17, 60015, 162465, 98-1027; 11967, OR7A5, 60016, 162466, 89-1048; 11967, OR7A5, 60017, 162467, 59-1018; 11968, OR7C1, 60018, 162468, 76-1038; 11969, OR7C2, 60019, 162469, 1-960; 11970, OR7D2, 60020, 162470, 189-1127; 11971, OR7D4, 60021, 162471, 35-973; 11972, OR7E24, 60022, 162472, 115-1134; 11973, OR7G1, 60023, 162473, 1-936; 11974, OR7G2, 60024, 162474, 1-1038; 11975, OR7G3, 60025, 162475, 1-939; 11976, OR8A1, 60026, 162476, 73-1053; 11977, OR8B12, 60027, 162477, 26-958; 11978, OR8B2, 60028, 162478, 20-961; 11979, OR8B3, 60029, 162479, 18-959; 11980, OR8B4, 60030, 162480, 1-930; 11981, OR8B8, 60031, 162481, 74-1009; 11982, OR8D1, 60032, 162482, 72-998; 11983, OR8D2, 60033, 162483, 1-936; 11983, OR8D2, 60034, 162484, 1-936; 11983, OR8D2, 60035, 162485, 92-1027; 11984, OR8D4, 60036, 162486, 287-1231; 11985, OR8G1, 60037, 162487, 1-936; 11986, OR8G5, 60038, 162488, 1-1041; 11987, OR8H1, 60040, 162490, 1-927; 11987, OR8H1, 60041, 162491, 1-927; 11987, OR8H1, 60039, 162489, 29-964; 11987, OR8H1, 60042, 162492, 29-964; 11988, OR8H2, 60044, 162494, 29-964; 11988, OR8H2, 60043, 162493, 1-939; 11989, OR8H3, 60045, 162495, 1-939; 11990, OR812, 60047, 162497, 1-553; 11990, OR812, 60046, 162496, 1-933; 11991, OR8J1, 60048, 162498, 33-983; 11991, OR8J1, 60049, 162499, 33-983; 11992, OR8J2, 60050, 162500, 1-948; 11992, OR8J2, 60051, 162501, 1-948; 11993, OR8J3, 60052, 162502, 1-948; 11994, OR8K1, 60053, 162503, 1-960; 11994, OR8K1, 60054, 162504, 1-960; 11995, OR8K3, 60055, 162505, 1-939; 11995, OR8K3, 60056, 162506, 1-939; 11995, OR8K3, 60057, 162507, 1-939; 11995, OR8K3, 60058, 162508, 1-939; 11996, OR8K5, 60059, 162509, 1-924; 11997, OR8S1, 60060, 162510, 1-1080; 11998, OR8U1, 60062, 162512, 1-930; 11998, OR8U1, 60061, 162511, 1-930; 11999, OR8U8, 60063, 162513, 1-930; 11999, OR8U8, 60064, 162514, 1-960; 12000, OR9A2, 60065, 162515, 64-996; 12000, OR9A2, 60066, 162516, 64-996; 12001, OR9A4, 60067, 162517, 60-1004; 12002, OR9G1, 60069, 162519, 1-918; 12002, OR9G1, 60068, 162518, 1-918; 12003, OR9G4, 60070, 162520, 1-984; 12003, OR9G4, 60071, 162521, 1-984; 12004, OR9G9, 60072, 162522, 1-918; 12005, OR911, 60073, 162523, 1-945; 12006, OR9K2, 60074, 162524, 89-1096; 12007, OR9Q1, 60075, 162525, 317-1249; 12007, OR9Q1, 60076, 162526, 15-947; 12008,

OR9Q2, 60077, 162527, 58-1002; 12009, OLIG2, 60080, 162530, 389-575; 12009, OLIG2, 60078, 162528, 929-1900; 12009, OLIG2, 60079, 162529, 245-1216; 12010, OMG, 60081, 162531, 263-1585; 12011, OLIG1, 60083, 162533, 1-98; 12011, OLIG1, 60082, 162532, 104-919; 12012, OLIG3, 60084, 162534, 81-899; 12013, OPALIN, 60086, 162536, 470-859; 12013, OPALIN, 60089, 162539, 434-673; 12013, OPALIN, 60085, 162535, 407-832; 12013, OPALIN, 60087, 162537, 470-826; 12013, OPALIN, 60088, 162538, 470-862; 12013, OPALIN, 60090, 162540, 1-396; 12014, OBFC1, 60091, 162541, 169-1275; 12014, OBFC1, 60092, 162542, 76-1182; 12015, OPHN1, 60093, 162543, 643-3051; 12016, OSTC, 60096, 162546, 72-323; 12016, OSTC, 60094, 162544, 73-522; 12016, OSTC, 60095, 162545, 10-525; 12017, OST4, 60097, 162547, 51-164; 12017, OST4, 60098, 162548, 188-301; 12017, OST4, 60099, 162549, 175-288; 12018, OGT, 60102, 162552, 88-556; 12018, OGT, 60100, 162550, 178-3288; 12018, OGT, 60101, 162551, 218-3358; 12019, OMA1, 60104, 162554, 1-985; 12019, OMA1, 60105, 162555, 194-744; 12019, OMA1, 60106, 162556, 60-1036; 12019, OMA1, 60107, 162557, 86-852; 12019, OMA1, 60108, 162558, 79-836; 12019, OMA1, 60109, 162559, 91-352; 12019, OMA1, 60103, 162553, 115-1689; 12020, OCM, 60110, 162560, 93-422; 12020, OCM, 60111, 162561, 141-470; 12021, OCM2, 60112, 162562, 93-422; 12022, O1T3, 60113, 162563, 219-1856; 12022, O1T3, 60114, 162564, 216-1181; 12023, OSM, 60116, 162566, 290-985; 12023, OSM, 60117, 162567, 41-103; 12023, OSM, 60115, 162565, 42-800; 12024, OSMR, 60120, 162570, 1-107; 12024, OSMR, 60121, 162571, 1-567; 12024, OSMR, 60122, 162572, 1-188; 12024, OSMR, 60118, 162568, 403-3342; 12024, OSMR, 60119, 162569, 283-1311; 12025, ONECUT1, 60124, 162574, 562-762; 12025, ONECUT1, 60125, 162575, 1-547; 12025, ONECUT1, 60123, 162573, 129-1526; 12026, ONECUT2, 60126, 162576, 33-1547; 12027, ONECUT3, 60127, 162577, 1291-2775; 12028, OOEP, 60129, 162579, 494-778; 12028, OOEP, 60130, 162580, 764-964; 12028, OOEP, 60128, 162578, 1-450; 12029, OOSP2, 60132, 162582, 65-325; 12029, OOSP2, 60131, 162581, 186-662; 12030, O1P5, 60134, 162584, 1-485; 12030, O1P5, 60133, 162583, 61-750; 12031, OPRL1, 60138, 162588, 1-880; 12031, OPRL1, 60139, 162589, 1-880; 12031, OPRL1, 60140, 162590, 1-880; 12031, OPRL1, 60135, 162585, 413-1525; 12031, OPRL1, 60136, 162586, 365-1477; 12031, OPRL1, 60137, 162587, 191-1303; 12032, OPCML, 60141, 162591, 580-1617; 12032, OPCML, 60142, 162592, 215-1129; 12032, OPCML, 60143, 162593, 196-1212; 12032, OPCML, 60144, 162594, 1-1065; 12032, OPCML, 60145, 162595, 1-1038; 12033, OGFR, 60147, 162597, 2278-4155; 12033, OGFR, 60148, 162598, 271-553; 12033, OGFR, 60149, 162599, 8-1180; 12033, OGFR, 60146, 162596, 26-2059; 12034, OGFRL1, 60150, 162600, 135-1490; 12035, OPRD1, 60152, 162602, 243-1217; 12035, OPRD1, 60151, 162601, 243-1361; 12036, OPRK1, 60154, 162604, 219-569; 12036, OPRK1, 60157, 162607, 1-1101; 12036, OPRK1, 60153, 162603, 299-1441; 12036, OPRK1, 60155, 162605, 376-1518; 12036, OPRK1, 60156, 162606, 226-1101; 12036, OPRK1, 60158, 162608, 740-1615; 12037, OPRM1, 60162, 162612, 258-1688; 12037, OPRM1, 60173, 162623, 514-1001; 12037, OPRM1, 60159, 162609, 51-1391; 12037, OPRM1, 60160, 162610, 238-1440; 12037, OPRM1, 60161, 162611, 51-1307; 12037, OPRM1, 60163, 162613, 519-2000; 12037, OPRM1, 60164, 162614, 51-1262; 12037, OPRM1, 60165, 162615, 51-1313; 12037, OPRM1, 60166, 162616, 90-1310; 12037, OPRM1, 60167, 162617, 197-1375; 12037, OPRM1, 60168, 162618, 51-1244; 12037, OPRM1, 60169, 162619, 71-1279; 12037, OPRM1, 60170, 162620, 1309-2211; 12037, OPRM1, 60171, 162621, 1290-2192; 12037, OPRM1, 60172, 162622, 51-1220; 12037, OPRM1, 60174, 162624, 13-972; 12037, OPRM1, 60175, 162625, 67-627; 12037, OPRM1, 60176, 162626, 529-1431; 12037, OPRM1, 60177, 162627, 51-1259; 12038, OPN1LW, 60179, 162629, 1-495; 12038, OPN1LW, 60178, 162628, 61-1155; 12039, OPN1MW, 60180, 162630, 1-493; 12039, OPN1MW, 60181, 162631, 83-1177; 12040, OPN1MW2, 60183, 162633, 1-493; 12040, OPN1MW2, 60182, 162632, 61-1155; 12041, OPN1MW3, 60184, 162634, 83-1177; 12042, OPN1SW, 60185, 162635, 1-1047; 12043, OPN3, 60186, 162636, 108-1316; 12044, OPN4, 60189, 162639, 168-1653; 12044, OPN4, 60187, 162637, 168-1604; 12044, OPN4, 60188, 162638, 228-1697; 12045, OPN5, 60191, 162641, 1-1062; 12045, OPN5, 60192, 162642, 86-1234; 12045, OPN5, 60190, 162640, 29-1093; 12046, OPA1, 60193, 162643, 235-3171; 12046, OPA1, 60195, 162645, 235-3120; 12046, OPA1, 60196, 162646, 235-3174; 12046, OPA1, 60197, 162647, 235-3282; 12046, OPA1, 60198, 162648, 27-757; 12046, OPA1, 60199, 162649, 132-631; 12046, OPA1, 60201, 162651, 1-552; 12046, OPA1, 60202, 162652, 528-780; 12046, OPA1, 60203, 162653, 1-554; 12046, OPA1, 60204, 162654, 1-393; 12046, OPA1, 60194, 162644, 235-3228; 12046, OPA1, 60200, 162650, 235-3117; 12047, OPA3, 60207, 162657, 136-516; 12047, OPA3, 60205, 162655, 56-595; 12047, OPA3, 60206, 162656, 79-621; 12048, OPTC, 60209, 162659, 37-560; 12048, OPTC, 60208, 162658, 117-1115; 12049, OPTN, 60216, 162666, 1-380; 12049, OPTN, 60217, 162667, 142-330; 12049, OPTN, 60218, 162668, 1-323; 12049, OPTN, 60219, 162669, 152-328; 12049, OPTN, 60210, 162660, 674-2407; 12049, OPTN, 60211, 162661, 242-1975; 12049, OPTN, 60212, 162662, 363-2096; 12049, OPTN, 60213, 162663, 348-2063; 12049, OPTN, 60214, 162664, 146-1879; 12049, OPTN, 60215, 162665, 520-2235; 12050, N/A, 60220, 162670, 1-957; 12050, N/A, 60221, 162671, 39-995; 12051, N/A, 60222, 162672, 1-939; 12052, N/A, 60223, 162673, 69-1034; 12052, N/A, 60224, 162674, 1-966; 12053, N/A, 60225, 162675, 1-926; 12054, N/A, 60226, 162676, 1-985; 12055, N/A, 60227, 162677, 1-945; 12055, N/A, 60228, 162678, 1-945; 12056, ORAI1, 60229, 162679, 122-391; 12056, ORAI1, 60231, 162681, 388-1104; 12056, ORAI1, 60230, 162680, 194-1099; 12057, ORAI2, 60234, 162684, 100-736; 12057, ORAI2, 60237, 162687, 188-479; 12057, ORAI2, 60238, 162688, 373-463; 12057, ORAI2, 60239, 162689, 250-937; 12057, ORAI2, 60232, 162682, 278-1042; 12057, ORAI2, 60233, 162683, 100-864; 12057, ORAI2, 60235, 162685, 49-813; 12057, ORAI2, 60236, 162686, 210-974; 12057, ORAI2, 60240, 162690, 146-910; 12058, ORAI3, 60242, 162692, 139-372; 12058, ORAI3, 60243, 162693, 210-506; 12058, ORAI3, 60244, 162694, 168-1010; 12058, ORAI3, 60241, 162691, 225-1112; 12059, ORAOV1, 60246, 162696, 9-221; 12059, ORAOV1, 60247, 162697, 178-408; 12059, ORAOV1, 60248, 162698, 85-321; 12059, ORAOV1, 60249, 162699, 67-177; 12059, ORAOV1, 60250, 162700, 112-243; 12059, ORAOV1, 60251, 162701, 84-458; 12059, ORAOV1, 60253, 162703, 106-771; 12059, ORAOV1, 60254, 162704, 1-187; 12059, ORAOV1, 60245, 162695, 109-522; 12059, ORAOV1, 60252, 162702, 83-496; 12060, OFD1, 60257, 162707, 873-3491; 12060, OFD1, 60258, 162708, 709-1725; 12060, OFD1, 60255, 162705, 328-3366; 12060, OFD1, 60256, 162706, 175-3093; 12061, OSCP1, 60262, 162712, 181-1185; 12061, OSCP1, 60263, 162713, 1-768; 12061,

OSCP1, 60264, 162714, 1-284; 12061, OSCP1, 60265, 162715, 1-41; 12061, OSCP1, 60259, 162709, 83-1222; 12061, OSCP1, 60260, 162710, 75-746; 12061, OSCP1, 60261, 162711, 65-1234; 12062, ORC1, 60266, 162716, 145-2730; 12062, ORC1, 60267, 162717, 220-2805; 12063, ORC2, 60269, 162719, 219-546; 12063, ORC2, 60270, 162720, 270-486; 12063, ORC2, 60268, 162718, 251-1984; 12064, ORC3, 60274, 162724, 465-562; 12064, ORC3, 60271, 162721, 35-2173; 12064, ORC3, 60272, 162722, 49-2184; 12064, ORC3, 60273, 162723, 434-2140; 12065, ORC4, 60277, 162727, 264-647; 12065, ORC4, 60278, 162728, 171-552; 12065, ORC4, 60279, 162729, 136-571; 12065, ORC4, 60275, 162725, 175-1485; 12065, ORC4, 60276, 162726, 109-1419; 12065, ORC4, 60280, 162730, 271-1359; 12065, ORC4, 60281, 162731, 157-1215; 12065, ORC4, 60282, 162732, 287-1597; 12066, ORC5, 60284, 162734, 97-297; 12066, ORC5, 60285, 162735, 97-297; 12066, ORC5, 60287, 162737, 144-344; 12066, ORC5, 60283, 162733, 144-1451; 12066, ORC5, 60286, 162736, 54-1028; 12067, ORC6, 60289, 162739, 64-174; 12067, ORC6, 60290, 162740, 288-899; 12067, ORC6, 60291, 162741, 10-513; 12067, ORC6, 60288, 162738, 61-819; 12068, ORMDL1, 60295, 162745, 58-387; 12068, ORMDL1, 60296, 162746, 589-914; 12068, ORMDL1, 60297, 162747, 568-893; 12068, ORMDL1, 60292, 162742, 788-1249; 12068, ORMDL1, 60293, 162743, 221-682; 12068, ORMDL1, 60294, 162744, 104-565; 12069, ORMDL2, 60299, 162749, 84-443; 12069, ORMDL2, 60301, 162751, 160-357; 12069, ORMDL2, 60298, 162748, 196-657; 12069, ORMDL2, 60300, 162750, 92-553; 12070, ORMDL3, 60304, 162754, 1-307; 12070, ORMDL3, 60305, 162755, 186-572; 12070, ORMDL3, 60302, 162752, 141-602; 12070, ORMDL3, 60303, 162753, 1496-1957; 12070, ORMDL3, 60306, 162756, 1-414; 12070, ORMDL3, 60307, 162757, 136-597; 12071, OAT, 60308, 162758, 94-1413; 12071, OAT, 60309, 162759, 320-1225; 12072, OTC, 60310, 162760, 153-1217; 12073, ODC1, 60313, 162763, 289-494; 12073, ODC1, 60311, 162761, 512-1897; 12073, ODC1, 60312, 162762, 435-1820; 12074, OAZ1, 60314, 162764, 66-746; 12074, OAZ1, 60315, 162765, 91-249; 12074, OAZ1, 60316, 162766, 155-780; 12074, OAZ1, 60317, 162767, 80-766; 12075, OAZ2, 60318, 162768, 168-576; 12075, OAZ2, 60319, 162769, 161-550; 12075, OAZ2, 60321, 162771, 384-566; 12075, OAZ2, 60320, 162770, 234-803; 12076, OAZ3, 60322, 162772, 168-740; 12076, OAZ3, 60323, 162773, 68-775; 12076, OAZ3, 60324, 162774, 16-627; 12076, OAZ3, 60325, 162775, 3145-3519; 12076, OAZ3, 60326, 162776, 1-370; 12076, OAZ3, 60328, 162778, 238-477; 12076, OAZ3, 60329, 162779, 1-318; 12076, OAZ3, 60327, 162777, 168-740; 12077, OFCC1, 60330, 162780, 1-696; 12077, OFCC1, 60332, 162782, 453-464; 12077, OFCC1, 60333, 162783, 1-559; 12077, OFCC1, 60335, 162785, 333-398; 12077, OFCC1, 60336, 162786, 1-320; 12077, OFCC1, 60337, 162787, 20-919; 12077, OFCC1, 60338, 162788, 1-657; 12077, OFCC1, 60339, 162789, 1-356; 12077, OFCC1, 60340, 162790, 1-934; 12077, OFCC1, 60341, 162791, 29-736; 12077, OFCC1, 60342, 162792, 1-708; 12077, OFCC1, 60331, 162781, 1-369; 12077, OFCC1, 60334, 162784, 32-655; 12078, ORM1, 60343, 162793, 79-684; 12079, ORM2, 60344, 162794, 37-642; 12080, OTX1, 60347, 162797, 248-553; 12080, OTX1, 60345, 162795, 277-1341; 12080, OTX1, 60346, 162796, 277-1341; 12081, OTX2, 60350, 162800, 288-395; 12081, OTX2, 60351, 162801, 308-797; 12081, OTX2, 60352, 162802, 193-908; 12081, OTX2, 60354, 162804, 193-300; 12081, OTX2, 60348, 162798, 278-1171; 12081, OTX2, 60349, 162799, 208-1077; 12081, OTX2, 60353, 162803, 410-1279; 12082, OTP, 60355, 162805, 1140-2117; 12083, OSGEP, 60357, 162807, 1-335; 12083, OSGEP, 60358, 162808, 130-578; 12083, OSGEP, 60356, 162806, 423-1430; 12084, OSGEPL1, 60361, 162811, 266-874; 12084, OSGEPL1, 60363, 162813, 424-945; 12084, OSGEPL1, 60364, 162814, 247-914; 12084, OSGEPL1, 60359, 162809, 104-1348; 12084, OSGEPL1, 60360, 162810, 344-1438; 12084, OSGEPL1, 60362, 162812, 535-1779; 12085, OSCAR, 60365, 162815, 66-824; 12085, OSCAR, 60366, 162816, 1-804; 12085, OSCAR, 60367, 162817, 47-838; 12085, OSCAR, 60368, 162818, 24-884; 12085, OSCAR, 60370, 162820, 50-535; 12085, OSCAR, 60374, 162824, 193-996; 12085, OSCAR, 60375, 162825, 193-996; 12085, OSCAR, 60378, 162828, 193-1053; 12085, OSCAR, 60379, 162829, 1-807; 12085, OSCAR, 60380, 162830, 193-1008; 12085, OSCAR, 60381, 162831, 193-1053; 12085, OSCAR, 60382, 162832, 193-1053; 12085, OSCAR, 60383, 162833, 193-1008; 12085, OSCAR, 60384, 162834, 1-807; 12085, OSCAR, 60386, 162836, 1-807; 12085, OSCAR, 60390, 162840, 193-1008; 12085, OSCAR, 60391, 162841, 193-1041; 12085, OSCAR, 60393, 162843, 1-807; 12085, OSCAR, 60395, 162845, 1-807; 12085, OSCAR, 60396, 162846, 193-1041; 12085, OSCAR, 60397, 162847, 193-1053; 12085, OSCAR, 60398, 162848, 50-535; 12085, OSCAR, 60399, 162849, 193-1041; 12085, OSCAR, 60400, 162850, 193-1041; 12085, OSCAR, 60403, 162853, 1-807; 12085, OSCAR, 60404, 162854, 193-996; 12085, OSCAR, 60406, 162856, 193-1041; 12085, OSCAR, 60407, 162857, 1-807; 12085, OSCAR, 60408, 162858, 193-1008; 12085, OSCAR, 60409, 162859, 193-996; 12085, OSCAR, 60410, 162860, 193-1053; 12085, OSCAR, 60411, 162861, 193-1053; 12085, OSCAR, 60413, 162863, 1-807; 12085, OSCAR, 60415, 162865, 193-996; 12085, OSCAR, 60416, 162866, 1-807; 12085, OSCAR, 60419, 162869, 193-1041; 12085, OSCAR, 60420, 162870, 193-996; 12085, OSCAR, 60421, 162871, 193-1008; 12085, OSCAR, 60422, 162872, 193-996; 12085, OSCAR, 60423, 162873, 1-807; 12085, OSCAR, 60424, 162874, 193-1053; 12085, OSCAR, 60425, 162875, 193-1008; 12085, OSCAR, 60369, 162819, 199-1047; 12085, OSCAR, 60371, 162821, 1-816; 12085, OSCAR, 60372, 162822, 1-816; 12085, OSCAR, 60373, 162823, 193-1053; 12085, OSCAR, 60376, 162826, 193-1008; 12085, OSCAR, 60377, 162827, 193-1041; 12085, OSCAR, 60385, 162835, 193-1008; 12085, OSCAR, 60387, 162837, 24-884; 12085, OSCAR, 60388, 162838, 193-1053; 12085, OSCAR, 60389, 162839, 193-1041; 12085, OSCAR, 60392, 162842, 199-1047; 12085, OSCAR, 60394, 162844, 193-996; 12085, OSCAR, 60401, 162851, 193-1053; 12085, OSCAR, 60402, 162852, 193-996; 12085, OSCAR, 60405, 162855, 193-1008; 12085, OSCAR, 60412, 162862, 1-804; 12085, OSCAR, 60414, 162864, 193-996; 12085, OSCAR, 60417, 162867, 47-838; 12085, OSCAR, 60418, 162868, 193-1008; 12085, OSCAR, 60426, 162876, 66-824; 12086, OSTF1, 60427, 162877, 151-795; 12087, OCSTAMP, 60428, 162878, 15-1715; 12088, OSTN, 60430, 162880, 68-403; 12088, OSTN, 60429, 162879, 1-402; 12089, OGN, 60433, 162883, 22-825; 12089, OGN, 60431, 162881, 422-1318; 12089, OGN, 60432, 162882, 194-1090; 12090, OMD, 60434, 162884, 277-1542; 12091, OSTM1, 60436, 162886, 207-724; 12091, OSTM1, 60435, 162885, 87-1091; 12092, OS9, 60443, 162893, 18-1238; 12092, OS9, 60444, 162894, 26-583; 12092, OS9, 60445, 162895, 3-380; 12092, OS9, 60446, 162896, 24-464; 12092, OS9, 60447, 162897, 17-503; 12092, OS9, 60449, 162899, 31-258; 12092, OS9, 60450, 162900, 20-247; 12092, OS9, 60437, 162887, 18-1859; 12092, OS9, 60438, 162888, 42-2045; 12092, OS9, 60439, 162889, 16-1809; 12092, OS9, 60440, 162890, 18-1976; 12092, OS9, 60441, 162891, 18-1700; 12092, OS9, 60442, 162892, 20-1636; 12092, OS9, 60448, 162898, 18-1760; 12092, OS9, 60451, 162901, 208-2046; 12093, OTOA, 60452, 162902, 2-3463; 12093, OTOA, 60453, 162903, 95-3277; 12093, OTOA, 60454, 162904, 68-2515; 12093, OTOA, 60455, 162905, 2-3421; 12094, 0C90, 60456, 162906, 88-1521; 12095, OTOF, 60462, 162912, 1-424; 12095, OTOF, 60457, 162907, 128-6121; 12095, OTOF, 60458, 162908, 227-3919; 12095, OTOF, 60459, 162909, 227-3919; 12095, OTOF, 60460, 162910, 150-4073; 12095, OTOF, 60461, 162911, 108-6101; 12096, OTOG, 60465, 162915, 1-8742; 12096, OTOG, 60466, 162916, 1-282; 12096, OTOG, 60463, 162913, 285-4811; 12096, OTOG, 60464, 162914, 1-8778; 12097, OTOGL, 60467, 162917, 1-2258; 12097, OTOGL, 60468, 162918, 7-7041; 12097, OTOGL, 60470, 162920, 1-500; 12097, OTOGL, 60471, 162921, 1-801; 12097, OTOGL, 60469, 162919, 7-7005; 12098, OTOL1, 60472, 162922, 1-1434; 12099, OTOP1, 60473, 162923, 26-1864; 12100, OTOP2, 60474, 162924, 93-1781; 12100, OTOP2, 60475, 162925, 31-1719; 12101, OTOP3, 60477, 162927, 54-194; 12101, OTOP3, 60476, 162926, 1-1791; 12102, OTOR, 60478, 162928, 45-431; 12103, OTOS, 60479, 162929, 156-425; 12103, OTOS, 60480, 162930, 232-501; 12104, OTUD1, 60481, 162931, 1-1446; 12105, OTUD3, 60482, 162932, 2-1198; 12106, OTUD4, 60485, 162935, 127-543; 12106, OTUD4, 60487, 162937, 139-1255; 12106, OTUD4, 60483, 162933, 189-3533; 12106, OTUD4, 60484, 162934, 139-3288; 12106, OTUD4, 60486, 162936, 65-502; 12107, OTUD5, 60491, 162941, 1-1335; 12107, OTUD5, 60493, 162943, 325-1953; 12107, OTUD5, 60488, 162938, 62-1777; 12107, OTUD5, 60489, 162939, 30-1730; 12107, OTUD5, 60490, 162940, 62-1762; 12107, OTUD5, 60492, 162942, 213-1262; 12108, OTUD6A, 60494, 162944, 35-901; 12109, OTUD7A, 60496, 162946, 349-690; 12109, OTUD7A, 60497, 162947, 394-724; 12109, OTUD7A, 60495, 162945, 94-2874; 12110, OTUD7B, 60498, 162948, 143-1425; 12110, OTUD7B, 60499, 162949, 296-2827; 12111, OTULIN, 60501, 162951, 1-200; 12111, OTULIN, 60502, 162952, 1-253; 12111, OTULIN, 60503, 162953, 163-339; 12111, OTULIN, 60500, 162950, 79-1137; 12112, OTUB1, 60505, 162955, 605-1423; 12112, OTUB1, 60506, 162956, 12-854; 12112, OTUB1, 60507, 162957, 461-973; 12112, OTUB1, 60508, 162958, 453-1313; 12112, OTUB1, 60509, 162959, 230-955; 12112, OTUB1, 60511, 162961, 126-434; 12112, OTUB1, 60504, 162954, 324-1139; 12112, OTUB1, 60510, 162960, 45-860; 12113, OTUB2, 60512, 162962, 210-914; 12113, OTUB2, 60513, 162963, 161-382; 12113, OTUB2, 60514, 162964, 210-914; 12113, OTUB2, 60515, 162965, 161-382; 12114, OTUD6B, 60516, 162966, 100-1071; 12114, OTUD6B, 60518, 162968, 61-387; 12114, OTUD6B, 60520, 162970, 100-1071; 12114, OTUD6B, 60517, 162967, 22-903; 12114, OTUD6B, 60519, 162969, 633-1211; 12115, OAF, 60522, 162972, 244-717; 12115, OAF, 60521, 162971, 514-1335; 12116, ODF1, 60524, 162974, 104-235; 12116, ODF1, 60523, 162973, 157-909; 12117, ODF2, 60532, 162982, 96-1254; 12117, ODF2, 60535, 162985, 320-934; 12117, ODF2, 60536, 162986, 353-822; 12117, ODF2, 60539, 162989, 1-723; 12117, ODF2, 60540, 162990, 147-578; 12117, ODF2, 60541, 162991, 288-588; 12117, ODF2, 60525, 162975, 388-2862; 12117, ODF2, 60526, 162976, 354-2270; 12117, ODF2, 60527, 162977, 1-2475; 12117, ODF2, 60528, 162978, 36-2141; 12117, ODF2, 60529, 162979, 531-2948; 12117, ODF2, 60530, 162980, 11-1984; 12117, ODF2, 60531, 162981, 1-2418; 12117, ODF2, 60533, 162983, 227-1957; 12117, ODF2, 60534, 162984, 364-2853; 12117, ODF2, 60537, 162987, 122-2038; 12117, ODF2, 60538, 162988, 313-2802; 12118, ODF2L, 60546, 162996, 502-648; 12118, ODF2L, 60547, 162997, 1-164; 12118, ODF2L, 60548, 162998, 93-275; 12118, ODF2L, 60549, 162999, 273-1002; 12118, ODF2L, 60550, 163000, 1-1563; 12118, ODF2L, 60551, 163001, 314-445; 12118, ODF2L, 60552, 163002, 1-461; 12118, ODF2L, 60553, 163003, 351-533; 12118, ODF2L, 60542, 162992, 308-2170; 12118, ODF2L, 60543, 162993, 370-2280; 12118, ODF2L, 60544, 162994, 368-2143; 12118, ODF2L, 60545, 162995, 283-2193; 12119, ODF3, 60555, 163005, 3-386; 12119, ODF3, 60554, 163004, 318-1082; 12119, ODF3, 60556, 163006, 103-726; 12120, ODF3B, 60558, 163008, 71-916; 12120, ODF3B, 60559, 163009, 108-836; 12120, ODF3B, 60560, 163010, 32-589; 12120, ODF3B, 60562, 163012, 139-276; 12120, ODF3B, 60557, 163007, 138-899; 12120, ODF3B, 60561, 163011, 1-762; 12121, ODF3L1, 60563, 163013, 224-1048; 12122, ODF3L2, 60564, 163014, 237-1106; 12122, ODF3L2, 60565, 163015, 134-895; 12123, ODF4, 60567, 163017, 183-611; 12123, ODF4, 60566, 163016, 189-962; 12124, OVCA2, 60568, 163018, 113-796; 12125, OVGP1, 60569, 163019, 57-2093; 12126, OVCH1, 60571, 163021, 1-365; 12126, OVCH1, 60572, 163022, 1-243; 12126, OVCH1, 60570, 163020, 1-3405; 12127, OVCH2, 60573, 163023, 28-1725; 12127, OVCH2, 60574, 163024, 1-1698; 12128, OVOL1, 60576, 163026, 409-1026; 12128, OVOL1, 60575, 163025, 353-1156; 12129, OVOL2, 60577, 163027, 244-1071; 12130, OVOL3, 60579, 163029, 53-625; 12130, OVOL3, 60578, 163028, 1-645; 12131, N/A, 60580, 163030, 1-4302; 12131, N/A, 60581, 163031, 1-4299; 12131, N/A, 60582, 163032, 1-4260; 12132, OXA1L, 60583, 163033, 1-1488; 12132, OXA1L, 60585, 163035, 1-1227; 12132, OXA1L, 60586, 163036, 1-249; 12132, OXA1L, 60587, 163037, 554-889; 12132, OXA1L, 60588, 163038, 24-1331; 12132, OXA1L, 60589, 163039, 1-1488; 12132, OXA1L, 60584, 163034, 319-1578; 12133, OXR1, 60592, 163042, 320-583; 12133, OXR1, 60597, 163047, 97-219; 12133, OXR1, 60599, 163049, 266-564; 12133, OXR1, 60600, 163050, 1-1556; 12133, OXR1, 60603, 163053, 380-739; 12133, OXR1, 60590, 163040, 138-869; 12133, OXR1, 60591, 163041, 134-2653; 12133, OXR1, 60593, 163043, 329-2950; 12133, OXR1, 60594, 163044, 329-2869; 12133, OXR1, 60595, 163045, 100-2724; 12133, OXR1, 60596, 163046, 233-883; 12133, OXR1, 60598, 163048, 139-2760; 12133, OXR1, 60601, 163051, 40-1551; 12133, OXR1, 60602, 163052, 139-2679; 12134, OSGIN1, 60607, 163057, 120-434; 12134, OSGIN1, 60608, 163058, 167-534; 12134, OSGIN1, 60609, 163059, 165-656; 12134, OSGIN1, 60604, 163054, 384-2066; 12134, OSGIN1, 60605, 163055, 473-1906; 12134, OSGIN1, 60606, 163056, 182-1615; 12135, OSGIN2, 60612, 163062, 34-657; 12135, OSGIN2, 60610, 163060, 356-1873; 12135, OSGIN2, 60611, 163061, 261-1910; 12136, OXSR1, 60614, 163064, 231-572; 12136, OXSR1, 60615, 163065, 373-1779; 12136, OXSR1, 60613, 163063, 373-1956; 12137, OSER1, 60616, 163066, 138-1016; 12137, OSER1, 60617, 163067, 182-1060; 12138, OLR1, 60619, 163069, 279-591; 12138, OLR1, 60621, 163071, 346-516; 12138, OLR1, 60622, 163072, 213-580; 12138, OLR1, 60624, 163074, 91-732; 12138, OLR1, 60625, 163075, 154-466; 12138, OLR1, 60626, 163076, 62-559; 12138, OLR1, 60627, 163077, 157-390; 12138, OLR1, 60618, 163068, 62-883; 12138, OLR1, 60620, 163070, 56-601; 12138, OLR1, 60623, 163073, 41-610; 12139, OXNAD1, 60629, 163079, 417-1409; 12139, OXNAD1, 60630, 163080, 432-602; 12139, OXNAD1, 60631, 163081, 458-673; 12139, OXNAD1, 60633, 163083, 199-1134; 12139, OXNAD1, 60634, 163084, 467-1459; 12139, OXNAD1, 60628, 163078, 466-1404; 12139, OXNAD1, 60632, 163082, 463-1401; 12140, OXLD1, 60636, 163086, 57-335; 12140, OXLD1, 60637, 163087, 2-280; 12140, OXLD1, 60638, 163088, 1-239; 12140, OXLD1, 60639, 163089, 19-297; 12140, OXLD1, 60635, 163085, 12-455; 12141, OXER1, 60640, 163090, 83-1354; 12142, OGDH, 60643, 163093, 91-3195; 12142, OGDH, 60645, 163095, 110-2731; 12142, OGDH, 60646, 163096, 157-789; 12142, OGDH, 60647, 163097, 54-3170; 12142, OGDH, 60648, 163098, 54-3059; 12142, OGDH, 60641, 163091, 43-3114; 12142, OGDH, 60642, 163092, 94-1377; 12142, OGDH, 60644, 163094, 91-3150; 12143, OXGR1, 60650, 163100, 457-643; 12143, OXGR1, 60652, 163102, 382-588; 12143, OXGR1, 60649, 163099, 245-1258; 12143, OXGR1, 60651, 163101, 292-1305; 12144, OGDHL, 60653, 163103, 87-3119; 12144, OGDHL, 60654, 163104, 394-2799; 12144, OGDHL, 60655, 163105, 143-3004; 12145, OSBP, 60657, 163107, 1-515; 12145, OSBP, 60656, 163106, 481-2904; 12146, OSBP2, 60659, 163109, 333-2243; 12146, OSBP2, 60660, 163110, 145-2376; 12146, OSBP2, 60662, 163112, 338-861; 12146, OSBP2, 60665, 163115, 1-224; 12146, OSBP2, 60666, 163116, 1-895; 12146, OSBP2, 60667, 163117, 1-589; 12146, OSBP2, 60668, 163118, 1-1353; 12146, OSBP2, 60670, 163120, 485-559; 12146, OSBP2, 60671, 163121, 1-1766; 12146, OSBP2, 60658, 163108, 105-2855; 12146, OSBP2, 60661, 163111, 386-2035; 12146, OSBP2, 60663, 163113, 116-2095; 12146, OSBP2, 60664, 163114, 22-2769; 12146, OSBP2, 60669, 163119, 280-2532; 12146, OSBP2, 60672, 163122, 381-1763; 12147, OSBPL10, 60674, 163124, 1-519; 12147, OSBPL10, 60676, 163126, 1-1616; 12147, OSBPL10, 60673, 163123, 124-2418; 12147, OSBPL10, 60675, 163125, 122-2224; 12148, OSBPL11, 60677, 163127, 291-2534; 12149, OSBPL1A, 60680, 163130, 219-521; 12149, OSBPL1A, 60682, 163132, 323-469; 12149, OSBPL1A, 60683, 163133, 204-359; 12149, OSBPL1A, 60684, 163134, 229-384; 12149, OSBPL1A, 60685, 163135, 172-321; 12149, OSBPL1A, 60686, 163136, 124-249; 12149, OSBPL1A, 60687, 163137, 1-858; 12149, OSBPL1A, 60678, 163128, 208-3060; 12149, OSBPL1A, 60679, 163129, 118-1824; 12149, OSBPL1A, 60681, 163131, 870-2183; 12150, OSBPL2, 60690, 163140, 518-1630; 12150, OSBPL2, 60691, 163141, 1-231; 12150, OSBPL2, 60692, 163142, 215-754; 12150, OSBPL2, 60693, 163143, 515-582; 12150, OSBPL2, 60688, 163138, 242-1684; 12150, OSBPL2, 60689, 163139, 206-1612; 12151, OSBPL3, 60702, 163152, 274-540; 12151, OSBPL3, 60703, 163153, 197-534; 12151, OSBPL3, 60704, 163154, 386-568; 12151, OSBPL3, 60694, 163144, 453-3116; 12151, OSBPL3, 60695, 163145, 104-2659; 12151, OSBPL3, 60696, 163146, 141-2711; 12151, OSBPL3, 60697, 163147, 104-1924; 12151, OSBPL3, 60698, 163148, 104-1939; 12151, OSBPL3, 60699, 163149, 104-2032; 12151, OSBPL3, 60700, 163150, 104-2566; 12151, OSBPL3, 60701, 163151, 104-1831; 12152, OSBPL5, 60708, 163158, 1-1299; 12152, OSBPL5, 60709, 163159, 506-774; 12152, OSBPL5, 60710, 163160, 498-706; 12152, OSBPL5, 60712, 163162, 182-554; 12152, OSBPL5, 60713, 163163, 107-454; 12152, OSBPL5, 60714, 163164, 282-575; 12152, OSBPL5, 60715, 163165, 136-554; 12152, OSBPL5, 60716, 163166, 563-1564; 12152, OSBPL5, 60705, 163155, 161-2800; 12152, OSBPL5, 60706, 163156, 159-2594; 12152, OSBPL5, 60707, 163157, 100-2535; 12152, OSBPL5, 60711, 163161, 62-2434; 12153, OSBPL6, 60717, 163167, 377-3181; 12153, OSBPL6, 60718, 163168, 121-2937; 12153, OSBPL6, 60719, 163169, 526-2052; 12153, OSBPL6, 60720, 163170, 545-3241; 12153, OSBPL6, 60721, 163171, 545-3424; 12153, OSBPL6, 60722, 163172, 351-3047; 12153, OSBPL6, 60723, 163173, 503-3214; 12154, OSBPL7, 60726, 163176, 581-1843; 12154, OSBPL7, 60727, 163177, 1-60; 12154, OSBPL7, 60724, 163174, 193-2721; 12154, OSBPL7, 60725, 163175, 257-2785; 12154, OSBPL7, 60728, 163178, 203-1276; 12155, OSBPL8, 60732, 163182, 72-542; 12155, OSBPL8, 60733, 163183, 206-363; 12155, OSBPL8, 60734, 163184, 477-561; 12155, OSBPL8, 60735, 163185, 357-531; 12155, OSBPL8, 60736, 163186, 615-2698; 12155, OSBPL8, 60737, 163187, 465-588; 12155, OSBPL8, 60738, 163188, 569-902; 12155, OSBPL8, 60739, 163189, 503-732; 12155, OSBPL8, 60740, 163190, 420-2583; 12155, OSBPL8, 60729, 163179, 481-3150; 12155, OSBPL8, 60730, 163180, 412-2955; 12155, OSBPL8, 60731, 163181, 561-3104; 12155, OSBPL8, 60741, 163191, 607-3150; 12156, OSBPL9, 60744, 163194, 20-370; 12156, OSBPL9, 60748, 163198, 143-382; 12156, OSBPL9, 60750, 163200, 1-105; 12156, OSBPL9, 60751, 163201, 254-581; 12156, OSBPL9, 60754, 163204, 1-350; 12156, OSBPL9, 60755, 163205, 1-591; 12156, OSBPL9, 60756, 163206, 288-563; 12156, OSBPL9, 60757, 163207, 533-630; 12156, OSBPL9, 60758, 163208, 1-223; 12156, OSBPL9, 60759, 163209, 94-333; 12156, OSBPL9, 60760, 163210, 254-379; 12156, OSBPL9, 60761, 163211, 1-390; 12156, OSBPL9, 60742, 163192, 161-2041; 12156, OSBPL9, 60743, 163193, 501-2672; 12156, OSBPL9, 60745, 163195, 3-2213; 12156, OSBPL9, 60746, 163196, 20-2260; 12156, OSBPL9, 60747, 163197, 3-2162; 12156, OSBPL9, 60749, 163199, 173-1849; 12156, OSBPL9, 60752, 163202, 495-2210; 12156, OSBPL9, 60753, 163203, 399-2075; 12157, OXTR, 60763, 163213, 325-600; 12157, OXTR, 60764, 163214, 614-743; 12157, OXTR, 60762, 163212, 626-1795; 12158, OXT, 60765, 163215, 37-414; 12159, PAGE1, 60766, 163216, 134-574; 12160, PAGE2, 60767, 163217, 61-345; 12160, PAGE2, 60769, 163219, 119-311; 12160, PAGE2, 60768, 163218, 105-440; 12161, PAGE2B, 60771, 163221, 61-345; 12161, PAGE2B, 60770, 163220, 53-388; 12162, PAGE3, 60772, 163222, 310-651; 12162, PAGE3, 60773, 163223, 208-549; 12163, PAGE4, 60774, 163224, 80-388; 12163, PAGE4, 60775, 163225, 68-376; 12164, PAGE5, 60777, 163227, 42-323; 12164, PAGE5, 60776, 163226, 246-638; 12164, PAGE5, 60778, 163228, 105-437; 12165, PAK1, 60781, 163231, 1-733; 12165, PAK1, 60782, 163232, 1-503; 12165, PAK1, 60783, 163233, 263-559; 12165, PAK1, 60784, 163234, 314-581; 12165, PAK1, 60785, 163235, 236-1603; 12165, PAK1, 60786, 163236, 313-1881; 12165, PAK1, 60787, 163237, 257-574; 12165, PAK1, 60788, 163238, 425-502; 12165, PAK1, 60789, 163239, 261-450; 12165, PAK1, 60790, 163240, 1-57; 12165, PAK1, 60779, 163229, 531-2192; 12165, PAK1, 60780, 163230, 533-2170; 12166, PAK2, 60792, 163242, 1-665; 12166, PAK2, 60791, 163241, 323-1897; 12167, PAK3, 60799, 163249, 29-573; 12167, PAK3, 60803, 163253, 1-1632; 12167, PAK3, 60793, 163243, 28-1707; 12167, PAK3, 60794, 163244, 28-1770; 12167, PAK3, 60795, 163245, 392-2026; 12167, PAK3, 60796, 163246, 443-2122; 12167, PAK3, 60797, 163247, 28-1725; 12167, PAK3, 60798, 163248, 372-2006; 12167, PAK3, 60800, 163250, 445-2079; 12167, PAK3, 60801, 163251, 356-2098; 12167, PAK3, 60802, 163252, 443-2140; 12168, PAK4, 60810, 163260, 19-564; 12168, PAK4, 60811, 163261, 1-448; 12168, PAK4, 60812, 163262, 321-714; 12168, PAK4, 60813, 163263, 255-534; 12168, PAK4, 60804, 163254, 228-1733; 12168, PAK4, 60805, 163255, 141-1916; 12168, PAK4, 60806, 163256, 253-2028; 12168, PAK4, 60807, 163257, 428-2203; 12168, PAK4, 60808, 163258, 161-1477; 12168, PAK4, 60809, 163259, 182-1498; 12169, PAK6, 60817, 163267, 331-552; 12169, PAK6, 60818, 163268, 245-571; 12169, PAK6, 60819, 163269, 262-598; 12169, PAK6, 60820, 163270, 381-553; 12169, PAK6, 60821, 163271, 502-561; 12169, PAK6, 60822, 163272, 293-1146; 12169, PAK6, 60823, 163273, 357-569; 12169, PAK6, 60824, 163274, 200-565; 12169, PAK6, 60825, 163275, 578-891; 12169, PAK6, 60826, 163276, 192-560; 12169, PAK6, 60814, 163264, 427-2472; 12169, PAK6, 60815, 163265, 913-2823; 12169, PAK6, 60816, 163266, 112-2157; 12169, PAK6, 60827, 163277, 584-2629; 12170, N/A, 60828, 163278, 158-559; 12170, N/A, 60829, 163279, 420-2465; 12170, N/A, 60830, 163280, 1-483; 12170, N/A, 60831, 163281, 1-424; 12171, PAK7, 60832, 163282, 268-2427; 12171, PAK7, 60833, 163283, 381-2540; 12171, PAK7, 60834, 163284, 548-2707; 12172, P2RX5-TAX1BP3, 60835, 163285, 190-1488; 12173, POR, 60840, 163290, 1-2176; 12173, POR, 60843, 163293, 36-341; 12173, POR, 60845, 163295, 240-565; 12173, POR, 60846, 163296, 407-569; 12173, POR, 60849, 163299, 515-631; 12173, POR, 60850, 163300, 251-1507; 12173, POR, 60836, 163286, 21-1922; 12173, POR, 60837, 163287, 63-561; 12173, POR, 60838, 163288, 549-736; 12173, POR, 60839, 163289, 61-625; 12173, POR, 60841, 163291, 78-498; 12173, POR, 60842, 163292, 33-548; 12173, POR, 60844, 163294, 96-283; 12173, POR, 60847, 163297, 5-640; 12173, POR, 60848, 163298, 148-586; 12173, POR, 60851, 163301, 5-574; 12173, POR, 60852, 163302, 106-2148; 12174, PDRG1, 60853, 163303, 132-533; 12175, PIDD1, 60856, 163306, 1-1016; 12175, PIDD1, 60857, 163307, 716-1042; 12175, PIDD1, 60858, 163308, 288-614; 12175, PIDD1, 60854, 163304, 143-2875; 12175, PIDD1, 60855, 163305, 82-2763; 12176, PAF1, 60860, 163310, 291-1157; 12176, PAF1, 60862, 163312, 1-281; 12176, PAF1, 60859, 163309, 332-1927; 12176, PAF1, 60861, 163311, 291-1748; 12177, PAX1, 60865, 163315, 55-1428; 12177, PAX1, 60863, 163313, 55-1659; 12177, PAX1, 60864, 163314, 2-1303; 12178, PAX2, 60867, 163317, 42-1223; 12178, PAX2, 60870, 163320, 34-677; 12178, PAX2, 60871, 163321, 842-1755; 12178, PAX2, 60866, 163316, 551-1735; 12178, PAX2, 60868, 163318, 551-1741; 12178, PAX2, 60869, 163319, 551-1804; 12179, PAX3, 60872, 163322, 251-871; 12179, PAX3, 60873, 163323, 382-1605; 12179, PAX3, 60874, 163324, 382-1593; 12179, PAX3, 60875, 163325, 138-1577; 12179, PAX3, 60876, 163326, 367-1884; 12179, PAX3, 60877, 163327, 382-1836; 12179, PAX3, 60878, 163328, 281-1732; 12179, PAX3, 60879, 163329, 132-779; 12180, PAX4, 60881, 163331, 1-1050; 12180, PAX4, 60882, 163332, 25-1047; 12180, PAX4, 60883, 163333, 462-1487; 12180, PAX4, 60884, 163334, 462-1235; 12180, PAX4, 60885, 163335, 462-1235; 12180, PAX4, 60880, 163330, 207-1238; 12181, PAX5, 60893, 163343, 1-182; 12181, PAX5, 60894, 163344, 159-821; 12181, PAX5, 60895, 163345, 11-898; 12181, PAX5, 60896, 163346, 159-1010; 12181, PAX5, 60897, 163347, 1-657; 12181, PAX5, 60898, 163348, 11-985; 12181, PAX5, 60886, 163336, 155-1330; 12181, PAX5, 60887, 163337, 11-877; 12181, PAX5, 60888, 163338, 1-987; 12181, PAX5, 60889, 163339, 11-1084; 12181, PAX5, 60890, 163340, 11-1099; 12181, PAX5, 60891, 163341, 1-876; 12181, PAX5, 60892, 163342, 1-1047; 12181, PAX5, 60899, 163349, 1-960; 12181, PAX5, 60900, 163350, 1-924; 12182, PAX6, 60909, 163359, 383-567; 12182, PAX6, 60910, 163360, 125-497; 12182, PAX6, 60912, 163362, 340-455; 12182, PAX6, 60913, 163363, 402-574; 12182, PAX6, 60914, 163364, 672-677; 12182, PAX6, 60901, 163351, 342-1610; 12182, PAX6, 60902, 163352, 529-1839; 12182, PAX6, 60903, 163353, 891-2157; 12182, PAX6, 60904, 163354, 347-1615; 12182, PAX6, 60905, 163355, 436-1746; 12182, PAX6, 60906, 163356, 880-2148; 12182, PAX6, 60907, 163357, 282-1592; 12182, PAX6, 60908, 163358, 282-1550; 12182, PAX6, 60911, 163361, 470-1780; 12182, PAX6, 60915, 163365, 408-1718; 12183, PAX7, 60916, 163366, 599-2161; 12183, PAX7, 60917, 163367, 81-1637; 12183, PAX7, 60918, 163368, 84-1601; 12184, PAX8, 60924, 163374, 209-556; 12184, PAX8, 60925, 163375, 1-520; 12184, PAX8, 60926, 163376, 548-805; 12184, PAX8, 60927, 163377, 1-295; 12184, PAX8, 60919, 163369, 264-1616; 12184, PAX8, 60920, 163370, 157-1122; 12184, PAX8, 60921, 163371, 157-1353; 12184, PAX8, 60922, 163372, 157-1020; 12184, PAX8, 60923, 163373, 196-1548; 12185, PAX9, 60930, 163380, 881-1171; 12185, PAX9, 60928, 163378, 226-1251; 12185, PAX9, 60929, 163379, 727-1752; 12186, PILRA, 60934, 163384, 200-880; 12186, PILRA, 60935, 163385, 165-664; 12186, PILRA, 60931, 163381, 213-1124; 12186, PILRA, 60932, 163382, 130-822; 12186, PILRA, 60933, 163383, 130-657; 12187, PILRB, 60936, 163386, 1217-1599; 12187, PILRB, 60938, 163388, 580-902; 12187, PILRB, 60939, 163389, 982-1364; 12187, PILRB, 60940, 163390, 1124-1506; 12187, PILRB, 60941, 163391, 240-603; 12187, PILRB, 60942, 163392, 1683-1822; 12187, PILRB, 60943, 163393, 1692-2074; 12187, PILRB, 60945, 163395, 593-772; 12187, PILRB, 60946, 163396, 174-587; 12187, PILRB, 60937, 163387, 1060-1743; 12187, PILRB, 60944, 163394, 1118-1933; 12187, PILRB, 60947, 163397, 289-972; 12188, PRRX1, 60950, 163400, 283-885; 12188, PRRX1, 60948, 163398, 314-1051; 12188, PRRX1, 60949, 163399, 1086-1739; 12189, PRRX2, 60951, 163401, 228-989; 12190, PHOX2A, 60953, 163403, 1-256; 12190, PHOX2A, 60952, 163402, 173-1027; 12191, PHOX2B, 60954, 163404, 361-1305; 12192, PITX1, 60956, 163406, 196-587; 12192, PITX1, 60957, 163407, 325-666; 12192, PITX1, 60959, 163409, 1-624; 12192, PITX1, 60955, 163405, 418-1362; 12192, PITX1, 60958, 163408, 135-1079; 12193, PITX2, 60963, 163413, 257-781; 12193, PITX2, 60965, 163415, 216-1085; 12193, PITX2, 60966, 163416, 109-463; 12193, PITX2, 60967, 163417, 592-1386; 12193, PITX2, 60960, 163410, 644-1618; 12193, PITX2, 60961, 163411, 1707-2660; 12193, PITX2, 60962, 163412, 583-1398; 12193, PITX2, 60964, 163414, 251-1204; 12193, PITX2, 60968, 163418, 216-1169; 12193, PITX2, 60969, 163419, 1590-2543; 12193, PITX2, 60970, 163420, 1590-2405; 12194, PITX3, 60971, 163421, 155-1063; 12194, PITX3, 60972, 163422, 4-912; 12195, PAK1IP1, 60973, 163423, 292-1470; 12196, PALLD, 60975, 163425, 325-817; 12196, PALLD, 60976, 163426, 351-565; 12196, PALLD, 60977, 163427, 274-545; 12196, PALLD, 60978, 163428, 1-1539; 12196, PALLD, 60979, 163429, 493-576; 12196, PALLD, 60981, 163431, 321-570; 12196, PALLD, 60982, 163432, 320-607; 12196, PALLD, 60984, 163434, 1-481; 12196, PALLD, 60974, 163424, 212-3532; 12196, PALLD, 60980, 163430, 301-2319; 12196, PALLD, 60983, 163433, 174-3545; 12196, PALLD, 60985, 163435, 523-2856; 12197, PALM2-AKAP2, 60986, 163436, 34-3306; 12197, PALM2-AKAP2, 60987, 163437, 181-3492; 12197, PALM2-AKAP2, 60988, 163438, 51-1351; 12198, PALMD, 60990, 163440, 126-1781; 12198, PALMD, 60989, 163439, 376-2031; 12198, PALMD, 60991, 163441, 123-1538; 12199, PPT1, 60992, 163442, 15-827; 12199,

PPT1, 60995, 163445, 1-534; 12199, PPT1, 60996, 163446, 15-461; 12199, PPT1, 60998, 163448, 260-523; 12199, PPT1, 60999, 163449, 272-565; 12199, PPT1, 61000, 163450, 10-623; 12199, PPT1, 60993, 163443, 15-626; 12199, PPT1, 60994, 163444, 466-1386; 12199, PPT1, 60997, 163447, 8-928; 12200, PPT2, 61005, 163455, 105-1031; 12200, PPT2, 61008, 163458, 118-1026; 12200, PPT2, 61009, 163459, 309-1217; 12200, PPT2, 61010, 163460, 475-1383; 12200, PPT2, 61011, 163461, 118-1026; 12200, PPT2, 61012, 163462, 309-1217; 12200, PPT2, 61013, 163463, 475-1383; 12200, PPT2, 61014, 163464, 130-730; 12200, PPT2, 61015, 163465, 475-1383; 12200, PPT2, 61016, 163466, 344-637; 12200, PPT2, 61017, 163467, 118-396; 12200, PPT2, 61018, 163468, 118-1026; 12200, PPT2, 61019, 163469, 130-730; 12200, PPT2, 61020, 163470, 118-827; 12200, PPT2, 61021, 163471, 475-1383; 12200, PPT2, 61022, 163472, 309-1018; 12200, PPT2, 61023, 163473, 247-722; 12200, PPT2, 61024, 163474, 118-396; 12200, PPT2, 61025, 163475, 238-1146; 12200, PPT2, 61026, 163476, 414-954; 12200, PPT2, 61027, 163477, 143-436; 12200, PPT2, 61028, 163478, 118-396; 12200, PPT2, 61029, 163479, 247-722; 12200, PPT2, 61030, 163480, 475-1184; 12200, PPT2, 61031, 163481, 247-722; 12200, PPT2, 61033, 163483, 414-954; 12200, PPT2, 61034, 163484, 414-954; 12200, PPT2, 61035, 163485, 247-722; 12200, PPT2, 61036, 163486, 118-1026; 12200, PPT2, 61037, 163487, 414-954; 12200, PPT2, 61038, 163488, 414-954; 12200, PPT2, 61039, 163489, 414-954; 12200, PPT2, 61040, 163490, 309-1217; 12200, PPT2, 61041, 163491, 130-730; 12200, PPT2, 61042, 163492, 118-396; 12200, PPT2, 61043, 163493, 130-730; 12200, PPT2, 61045, 163495, 309-1217; 12200, PPT2, 61046, 163496, 492-1400; 12200, PPT2, 61048, 163498, 475-1383; 12200, PPT2, 61049, 163499, 247-722; 12200, PPT2, 61050, 163500, 414-954; 12200, PPT2, 61051, 163501, 130-730; 12200, PPT2, 61052, 163502, 247-722; 12200, PPT2, 61054, 163504, 247-722; 12200, PPT2, 61055, 163505, 309-1217; 12200, PPT2, 61056, 163506, 118-1026; 12200, PPT2, 61057, 163507, 414-954; 12200, PPT2, 61058, 163508, 309-1217; 12200, PPT2, 61059, 163509, 247-722; 12200, PPT2, 61060, 163510, 118-396; 12200, PPT2, 61061, 163511, 118-396; 12200, PPT2, 61062, 163512, 105-832; 12200, PPT2, 61064, 163514, 1-383; 12200, PPT2, 61068, 163518, 1-383; 12200, PPT2, 61071, 163521, 192-901; 12200, PPT2, 61072, 163522, 104-397; 12200, PPT2, 61074, 163524, 746-1654; 12200, PPT2, 61076, 163526, 1-383; 12200, PPT2, 61077, 163527, 1-163; 12200, PPT2, 61078, 163528, 569-1278; 12200, PPT2, 61079, 163529, 1-383; 12200, PPT2, 61080, 163530, 217-615; 12200, PPT2, 61082, 163532, 415-1323; 12200, PPT2, 61083, 163533, 415-1323; 12200, PPT2, 61084, 163534, 415-1323; 12200, PPT2, 61085, 163535, 415-1323; 12200, PPT2, 61086, 163536, 415-1323; 12200, PPT2, 61087, 163537, 415-1323; 12200, PPT2, 61088, 163538, 121-238; 12200, PPT2, 61089, 163539, 217-615; 12200, PPT2, 61090, 163540, 104-397; 12200, PPT2, 61001, 163451, 415-1323; 12200, PPT2, 61002, 163452, 105-1031; 12200, PPT2, 61003, 163453, 309-1217; 12200, PPT2, 61004, 163454, 118-1026; 12200, PPT2, 61006, 163456, 105-1031; 12200, PPT2, 61007, 163457, 475-1383; 12200, PPT2, 61032, 163482, 105-1031; 12200, PPT2, 61044, 163494, 105-1031; 12200, PPT2, 61047, 163497, 130-730; 12200, PPT2, 61053, 163503, 130-730; 12200, PPT2, 61063, 163513, 105-1031; 12200, PPT2, 61065, 163515, 192-1097; 12200, PPT2, 61066, 163516, 192-1097; 12200, PPT2, 61067, 163517, 192-1097; 12200, PPT2, 61069, 163519, 569-1474; 12200, PPT2, 61070, 163520, 569-1474; 12200, PPT2, 61073, 163523, 569-1474; 12200, PPT2, 61075, 163525, 569-1474; 12200, PPT2, 61081, 163531, 192-1097; 12201, ZDHHC3, 61091, 163541, 275-1258; 12201, ZDHHC3, 61092, 163542, 1-182; 12201, ZDHHC3, 61093, 163543, 188-472; 12201, ZDHHC3, 61094, 163544, 259-1260; 12201, ZDHHC3, 61095, 163545, 1-335; 12201, ZDHHC3, 61096, 163546, 1-588; 12201, ZDHHC3, 61097, 163547, 270-1169; 12201, ZDHHC3, 61098, 163548, 404-537; 12202, PAN2, 61102, 163552, 251-585; 12202, PAN2, 61099, 163549, 260-3865; 12202, PAN2, 61100, 163550, 307-3903; 12202, PAN2, 61101, 163551, 378-3986; 12202, PAN2, 61103, 163553, 371-3979; 12202, PAN2, 61104, 163554, 307-3915; 12203, PAN3, 61106, 163556, 64-2127; 12203, PAN3, 61105, 163555, 153-2816; 12204, PTF1A, 61107, 163557, 205-1191; 12205, PDX1, 61108, 163558, 120-971; 12206, PNLIP, 61109, 163559, 29-1426; 12207, PNLIPRP1, 61111, 163561, 51-445; 12207, PNLIPRP1, 61112, 163562, 25-381; 12207, PNLIPRP1, 61113, 163563, 89-579; 12207, PNLIPRP1, 61115, 163565, 1-1404; 12207, PNLIPRP1, 61116, 163566, 1-540; 12207, PNLIPRP1, 61117, 163567, 161-734; 12207, PNLIPRP1, 61118, 163568, 25-581; 12207, PNLIPRP1, 61110, 163560, 35-1438; 12207, PNLIPRP1, 61114, 163564, 72-1475; 12208, PNLIPRP2, 61119, 163569, 27-1436; 12208, PNLIPRP2, 61120, 163570, 1-1410; 12208, PNLIPRP2, 61121, 163571, 1-1407; 12209, PNLIPRP3, 61122, 163572, 147-1550; 12210, PPY, 61124, 163574, 1-318; 12210, PRY, 61126, 163576, 46-285; 12210, PPY, 61127, 163577, 1-397; 12210, PPY, 61123, 163573, 49-336; 12210, PPY, 61125, 163575, 89-376; 12211, PPDPF, 61128, 163578, 146-568; 12211, PPDPF, 61129, 163579, 197-541; 12212, PANX1, 61130, 163580, 386-1666; 12212, PANX1, 61131, 163581, 385-1653; 12213, PANX2, 61134, 163584, 1-234; 12213, PANX2, 61132, 163582, 1-1932; 12213, PANX2, 61133, 163583, 1-2034; 12214, PANX3, 61135, 163585, 68-1246; 12215, PANK1, 61136, 163586, 271-2067; 12215, PANK1, 61137, 163587, 151-1095; 12215, PANK1, 61138, 163588, 164-1285; 12216, PANK2, 61141, 163591, 621-967; 12216, PANK2, 61142, 163592, 82-558; 12216, PANK2, 61139, 163589, 7-1719; 12216, PANK2, 61140, 163590, 312-1151; 12216, PANK2, 61143, 163593, 56-1399; 12216, PANK2, 61144, 163594, 363-1202; 12217, PANK3, 61146, 163596, 187-552; 12217, PANK3, 61145, 163595, 318-1430; 12218, PANK4, 61148, 163598, 1-2214; 12218, PANK4, 61149, 163599, 1-411; 12218, PANK4, 61150, 163600, 1-126; 12218, PANK4, 61151, 163601, 1-465; 12218, PANK4, 61152, 163602, 1-1421; 12218, PANK4, 61153, 163603, 1-573; 12218, PANK4, 61155, 163605, 10-465; 12218, PANK4, 61156, 163606, 1-411; 12218, PANK4, 61157, 163607, 10-2214; 12218, PANK4, 61158, 163608, 1-1421; 12218, PANK4, 61159, 163609, 1-126; 12218, PANK4, 61160, 163610, 1-573; 12218, PANK4, 61147, 163597, 18-2363; 12218, PANK4, 61154, 163604, 14-2335; 12219, PAPD4, 61165, 163615, 679-2004; 12219, PAPD4, 61161, 163611, 300-1754; 12219, PAPD4, 61162, 163612, 406-1848; 12219, PAPD4, 61163, 163613, 443-1897; 12219, PAPD4, 61164, 163614, 694-2148; 12220, PAPD5, 61166, 163616, 1-910; 12220, PAPD5, 61168, 163618, 75-1841; 12220, PAPD5, 61167, 163617, 36-2132; 12221, PAPD7, 61170, 163620, 523-603; 12221, PAPD7, 61169, 163619, 978-3356; 12221, PAPD7, 61171, 163621, 189-1817; 12222, PAPLN, 61172, 163622, 20-2446; 12222, PAPLN, 61174, 163624, 1-645; 12222, PAPLN, 61177, 163627, 21-2810; 12222, PAPLN, 61178, 163628, 1-935; 12222, PAPLN, 61173, 163623, 103-3858; 12222, PAPLN, 61175, 163625, 155-3943; 12222, PAPLN, 61176, 163626, 164-

4000; 12223, PRCC, 61180, 163630, 1-773; 12223, PRCC, 61181, 163631, 1-597; 12223, PRCC, 61179, 163629, 273-1748; 12224, PAPPA2, 61182, 163632, 1165-3648; 12224, PAPPA2, 61183, 163633, 1165-6540; 12225, PARD3, 61187, 163637, 16-555; 12225, PARD3, 61188, 163638, 327-3332; 12225, PARD3, 61192, 163642, 327-4217; 12225, PARD3, 61196, 163646, 144-2387; 12225, PARD3, 61184, 163634, 327-4259; 12225, PARD3, 61185, 163635, 327-4286; 12225, PARD3, 61186, 163636, 331-3426; 12225, PARD3, 61189, 163639, 327-3293; 12225, PARD3, 61190, 163640, 327-4388; 12225, PARD3, 61191, 163641, 327-4397; 12225, PARD3, 61193, 163643, 327-4061; 12225, PARD3, 61194, 163644, 331-4131; 12225, PARD3, 61195, 163645, 331-4353; 12226, PARD3B, 61202, 163652, 161-2968; 12226, PARD3B, 61203, 163653, 1-3189; 12226, PARD3B, 61204, 163654, 1-3093; 12226, PARD3B, 61205, 163655, 1-3210; 12226, PARD3B, 61197, 163647, 1-3411; 12226, PARD3B, 61198, 163648, 1-3315; 12226, PARD3B, 61199, 163649, 1-3432; 12226, PARD3B, 61200, 163650, 208-3825; 12226, PARD3B, 61201, 163651, 208-447; 12227, PARD6A, 61208, 163658, 94-1044; 12227, PARD6A, 61206, 163656, 81-1121; 12227, PARD6A, 61207, 163657, 92-1129; 12228, PARD6B, 61209, 163659, 244-1362; 12228, PARD6B, 61210, 163660, 123-470; 12229, PARD6G, 61212, 163662, 1-186; 12229, PARD6G, 61211, 163661, 199-1329; 12229, PARD6G, 61213, 163663, 1-324; 12230, PALM, 61216, 163666, 29-757; 12230, PALM, 61217, 163667, 26-622; 12230, PALM, 61218, 163668, 557-594; 12230, PALM, 61214, 163664, 209-1240; 12230, PALM, 61215, 163665, 47-1210; 12231, PALM2, 61221, 163671, 87-1220; 12231, PALM2, 61222, 163672, 42-583; 12231, PALM2, 61219, 163669, 51-1286; 12231, PALM2, 61220, 163670, 75-1214; 12232, PALM3, 61224, 163674, 277-855; 12232, PALM3, 61223, 163673, 1-2022; 12233, PNMA1, 61225, 163675, 734-1795; 12234, PNMA2, 61226, 163676, 896-1990; 12235, PNMA3, 61227, 163677, 264-1655; 12235, PNMA3, 61228, 163678, 21-1412; 12235, PNMA3, 61229, 163679, 337-1704; 12236, PNMA5, 61232, 163682, 330-749; 12236, PNMA5, 61230, 163680, 423-1769; 12236, PNMA5, 61231, 163681, 440-1786; 12236, PNMA5, 61233, 163683, 340-1686; 12236, PNMA5, 61234, 163684, 425-1771; 12237, PNMA6A, 61235, 163685, 254-1453; 12238, PNMAL1, 61238, 163688, 307-561; 12238, PNMAL1, 61236, 163686, 307-1626; 12238, PNMAL1, 61237, 163687, 151-1287; 12239, PNMAL2, 61239, 163689, 1034-2941; 12240, PON1, 61241, 163691, 2-235; 12240, PON1, 61240, 163690, 233-1300; 12241, PON2, 61243, 163693, 248-1276; 12241, PON2, 61245, 163695, 41-700; 12241, PON2, 61246, 163696, 459-555; 12241, PON2, 61247, 163697, 58-312; 12241, PON2, 61248, 163698, 316-1443; 12241, PON2, 61249, 163699, 1-255; 12241, PON2, 61250, 163700, 305-645; 12241, PON2, 61251, 163701, 392-550; 12241, PON2, 61252, 163702, 488-694; 12241, PON2, 61253, 163703, 122-1186; 12241, PON2, 61254, 163704, 1-367; 12241, PON2, 61242, 163692, 248-1312; 12241, PON2, 61244, 163694, 26-178; 12242, PON3, 61256, 163706, 14-154; 12242, PON3, 61257, 163707, 14-199; 12242, PON3, 61258, 163708, 14-154; 12242, PON3, 61259, 163709, 14-826; 12242, PON3, 61260, 163710, 12-749; 12242, PON3, 61255, 163705, 12-1076; 12243, PSPC1, 61262, 163712, 121-866; 12243, PSPC1, 61266, 163716, 1-102; 12243, PSPC1, 61261, 163711, 161-1732; 12243, PSPC1, 61263, 163713, 186-1367; 12243, PSPC1, 61264, 163714, 161-1342; 12243, PSPC1, 61265, 163715, 138-1709; 12244, PTMS, 61268, 163718, 332-646; 12244, PTMS, 61269, 163719, 331-501; 12244, PTMS, 61267, 163717, 330-638; 12244, PTMS, 61270, 163720, 332-640; 12245, PTH, 61271, 163721, 116-463; 12245, PTH, 61272, 163722, 146-493; 12246, PTH1R, 61274, 163724, 204-1205; 12246, PTH1R, 61275, 163725, 1-549; 12246, PTH1R, 61276, 163726, 334-1914; 12246, PTH1R, 61273, 163723, 204-1985; 12246, PTH1R, 61277, 163727, 204-1985; 12246, PTH1R, 61278, 163728, 150-1931; 12246, PTH1R, 61279, 163729, 67-1848; 12247, PTH2, 61280, 163730, 103-405; 12248, PTH2R, 61282, 163732, 1-164; 12248, PTH2R, 61283, 163733, 783-2102; 12248, PTH2R, 61281, 163731, 214-1866; 12249, PTHLH, 61291, 163741, 231-746; 12249, PTHLH, 61292, 163742, 125-457; 12249, PTHLH, 61284, 163734, 323-850; 12249, PTHLH, 61285, 163735, 390-917; 12249, PTHLH, 61286, 163736, 310-843; 12249, PTHLH, 61287, 163737, 348-875; 12249, PTHLH, 61288, 163738, 68-601; 12249, PTHLH, 61289, 163739, 542-1075; 12249, PTHLH, 61290, 163740, 1-630; 12250, PACRG, 61296, 163746, 1-383; 12250, PACRG, 61297, 163747, 1-187; 12250, PACRG, 61298, 163748, 1-376; 12250, PACRG, 61299, 163749, 1-360; 12250, PACRG, 61300, 163750, 1-279; 12250, PACRG, 61293, 163743, 225-1115; 12250, PACRG, 61294, 163744, 276-1049; 12250, PACRG, 61295, 163745, 225-998; 12251, PACRGL, 61304, 163754, 346-620; 12251, PACRGL, 61305, 163755, 267-573; 12251, PACRGL, 61306, 163756, 196-647; 12251, PACRGL, 61307, 163757, 514-556; 12251, PACRGL, 61308, 163758, 163-420; 12251, PACRGL, 61309, 163759, 138-564; 12251, PACRGL, 61310, 163760, 306-915; 12251, PACRGL, 61311, 163761, 332-613; 12251, PACRGL, 61312, 163762, 171-580; 12251, PACRGL, 61313, 163763, 579-625; 12251, PACRGL, 61315, 163765, 247-981; 12251, PACRGL, 61316, 163766, 561-577; 12251, PACRGL, 61320, 163770, 428-681; 12251, PACRGL, 61321, 163771, 265-580; 12251, PACRGL, 61322, 163772, 346-609; 12251, PACRGL, 61323, 163773, 171-452; 12251, PACRGL, 61326, 163776, 289-795; 12251, PACRGL, 61327, 163777, 1-205; 12251, PACRGL, 61328, 163778, 494-860; 12251, PACRGL, 61329, 163779, 307-543; 12251, PACRGL, 61330, 163780, 441-543; 12251, PACRGL, 61301, 163751, 297-962; 12251, PACRGL, 61302, 163752, 392-1057; 12251, PACRGL, 61303, 163753, 369-740; 12251, PACRGL, 61314, 163764, 328-993; 12251, PACRGL, 61317, 163767, 176-841; 12251, PACRGL, 61318, 163768, 392-1138; 12251, PACRGL, 61319, 163769, 249-995; 12251, PACRGL, 61324, 163774, 138-740; 12251, PACRGL, 61325, 163775, 124-789; 12252, PARK2, 61332, 163782, 97-1203; 12252, PARK2, 61338, 163788, 1-603; 12252, PARK2, 61339, 163789, 4-225; 12252, PARK2, 61340, 163790, 1-531; 12252, PARK2, 61341, 163791, 1-261; 12252, PARK2, 61331, 163781, 452-1276; 12252, PARK2, 61333, 163783, 333-1157; 12252, PARK2, 61334, 163784, 104-1054; 12252, PARK2, 61335, 163785, 104-1417; 12252, PARK2, 61336, 163786, 104-1501; 12252, PARK2, 61337, 163787, 74-730; 12253, PDDC1, 61346, 163796, 26-586; 12253, PDDC1, 61347, 163797, 1-435; 12253, PDDC1, 61348, 163798, 1-262; 12253, PDDC1, 61349, 163799, 22-384; 12253, PDDC1, 61350, 163800, 1-489; 12253, PDDC1, 61342, 163792, 23-685; 12253, PDDC1, 61343, 163793, 27-581; 12253, PDDC1, 61344, 163794, 10-762; 12253, PDDC1, 61345, 163795, 14-568; 12254, PARK7, 61356, 163806, 59-568; 12254, PARK7, 61357, 163807, 1-483; 12254, PARK7, 61351, 163801, 155-724; 12254, PARK7, 61352, 163802, 157-726; 12254, PARK7, 61353, 163803, 212-781; 12254, PARK7, 61354, 163804, 68-637; 12254, PARK7, 61355, 163805, 57-624; 12255, PNKD, 61358, 163808, 145-573; 12255, PNKD, 61359, 163809, 96-1181; 12255, PNKD, 61360, 163810, 52-1209; 12255, PNKD, 61361, 163811, 1-978; 12256, PARPBP, 61363, 163813, 87-521; 12256, PARPBP, 61365, 163815, 1-795; 12256, PARPBP, 61366, 163816, 1-195; 12256, PARPBP, 61367, 163817, 1-810; 12256, PARPBP, 61368, 163818, 106-2076; 12256, PARPBP, 61370, 163820, 96-647; 12256, PARPBP, 61362, 163812, 46-1785; 12256, PARPBP, 61364, 163814, 282-1778; 12256, PARPBP, 61369, 163819, 46-447; 12257, PALB2, 61372, 163822, 997-3672; 12257, PALB2, 61373, 163823, 1-131; 12257, PALB2, 61374, 163824, 1-91; 12257, PALB2, 61375, 163825, 547-815; 12257, PALB2, 61371, 163821, 154-3714; 12258, PNO1, 61377, 163827, 19-429; 12258, PNO1, 61376, 163826, 92-850; 12259, PVALB, 61379, 163829, 1-320; 12259, PVALB, 61380, 163830, 63-299; 12259, PVALB, 61382, 163832, 167-470; 12259, PVALB, 61384, 163834, 63-299; 12259, PVALB, 61386, 163836, 167-470; 12259, PVALB, 61387, 163837, 1-320; 12259, PVALB, 61378, 163828, 57-389; 12259, PVALB, 61381, 163831, 31-363; 12259, PVALB, 61383, 163833, 57-389; 12259, PVALB, 61385, 163835, 31-363; 12260, PARVA, 61388, 163838, 344-1582; 12260, PARVA, 61389, 163839, 270-897; 12261, PARVB, 61393, 163843, 160-742; 12261, PARVB, 61394, 163844, 118-987; 12261, PARVB, 61390, 163840, 64-1158; 12261, PARVB, 61391, 163841, 102-1085; 12261, PARVB, 61392, 163842, 131-1324; 12262, PARVG, 61398, 163848, 231-309; 12262, PARVG, 61399, 163849, 533-622; 12262, PARVG, 61401, 163851, 70-174; 12262, PARVG, 61395, 163845, 221-784; 12262, PARVG, 61396, 163846, 425-1420; 12262, PARVG, 61397, 163847, 485-1480; 12262, PARVG, 61400, 163850, 192-755; 12263, PASD1, 61402, 163852, 246-2567; 12264, PASK, 61407, 163857, 1-578; 12264, PASK, 61408, 163858, 190-565; 12264, PASK, 61409, 163859, 117-538; 12264, PASK, 61410, 163860, 113-328; 12264, PASK, 61412, 163862, 1-216; 12264, PASK, 61403, 163853, 134-4105; 12264, PASK, 61404, 163854, 65-4057; 12264, PASK, 61405, 163855, 700-4671; 12264, PASK, 61406, 163856, 93-3524; 12264, PASK, 61411, 163861, 287-4258; 12265, PNPLA1, 61416, 163866, 1-1602; 12265, PNPLA1, 61413, 163863, 140-1480; 12265, PNPLA1, 61414, 163864, 140-1453; 12265, PNPLA1, 61415, 163865, 1-1599; 12266, PNPLA2, 61418, 163868, 1857-2504; 12266, PNPLA2, 61417, 163867, 203-1717; 12267, PNPLA3, 61420, 163870, 121-483; 12267, PNPLA3, 61419, 163869, 174-1619; 12267, PNPLA3, 61421, 163871, 110-1543; 12268, PNPLA4, 61423, 163873, 83-652; 12268, PNPLA4, 61422, 163872, 172-933; 12268, PNPLA4, 61424, 163874, 68-829; 12268, PNPLA4, 61425, 163875, 136-636; 12269, PNPLA5, 61428, 163878, 116-921; 12269, PNPLA5, 61426, 163876, 134-1423; 12269, PNPLA5, 61427, 163877, 134-1081; 12269, PNPLA5, 61429, 163879, 131-1420; 12269, PNPLA5, 61430, 163880, 134-1081; 12270, PNPLA6, 61435, 163885, 1-467; 12270, PNPLA6, 61436, 163886, 232-584; 12270, PNPLA6, 61437, 163887, 1-574; 12270, PNPLA6, 61438, 163888, 429-543; 12270, PNPLA6, 61439, 163889, 351-753; 12270, PNPLA6, 61440, 163890, 1-800; 12270, PNPLA6, 61441, 163891, 102-562; 12270, PNPLA6, 61442, 163892, 324-866; 12270, PNPLA6, 61431, 163881, 432-4415; 12270, PNPLA6, 61432, 163882, 272-4255; 12270, PNPLA6, 61433, 163883, 196-4323; 12270, PNPLA6, 61434, 163884, 401-4303; 12270, PNPLA6, 61443, 163893, 84-4181; 12271, PNPLA7, 61444, 163896, 42-644; 12271, PNPLA7, 61446, 163894, 188-4141; 12271, PNPLA7, 61445, 163895, 338-4366; 12272, PNPLA8, 61449, 163899, 404-568; 12272, PNPLA8, 61451, 163901, 408-2326; 12272, PNPLA8, 61452, 163902, 158-735; 12272, PNPLA8, 61447, 163897, 296-2644; 12272, PNPLA8, 61448, 163898, 544-2592; 12272, PNPLA8, 61450, 163900, 127-2289; 12272, PNPLA8, 61453, 163903, 374-2722; 12272, PNPLA8, 61454, 163904, 408-2756; 12273, PTCH1, 61456, 163906, 1-1058; 12273, PTCH1, 61458, 163908, 1-1461; 12273, PTCH1, 61464, 163914, 288-809; 12273, PTCH1, 61465, 163915, 1-51; 12273, PTCH1, 61466, 163916, 516-1037; 12273, PTCH1, 61467, 163917, 360-881; 12273, PTCH1, 61468, 163918, 343-864; 12273, PTCH1, 61469, 163919, 354-553; 12273, PTCH1, 61470, 163920, 587-1138; 12273, PTCH1, 61471, 163921, 253-492; 12273, PTCH1, 61472, 163922, 264-539; 12273, PTCH1, 61455, 163905, 301-4644; 12273, PTCH1, 61457, 163907, 146-4486; 12273, PTCH1, 61459, 163909, 495-4640; 12273, PTCH1, 61460, 163910, 516-4406; 12273, PTCH1, 61461, 163911, 360-4250; 12273, PTCH1, 61462, 163912, 587-4732; 12273, PTCH1, 61463, 163913, 442-4332; 12274, PTCH2, 61475, 163925, 1-265; 12274, PTCH2, 61473, 163923, 132-3743; 12274, PTCH2, 61474, 163924, 13-3453; 12275, PTCHD1, 61477, 163927, 1-311; 12275, PTCHD1, 61476, 163926, 861-3527; 12275, PTCHD1, 61478, 163928, 410-1180; 12276, PTCHD2, 61480, 163930, 119-925; 12276, PTCHD2, 61479, 163929, 139-4317; 12277, PTCHD3, 61482, 163932, 119-1720; 12277, PTCHD3, 61483, 163933, 119-1720; 12277, PTCHD3, 61481, 163931, 119-2422; 12277, PTCHD3, 61484, 163934, 119-2422; 12278, PTCHD4, 61486, 163936, 1-934; 12278, PTCHD4, 61485, 163935, 35-2575; 12279, PEG10, 61488, 163938, 218-1423; 12279, PEG10, 61489, 163939, 157-2382; 12279, PEG10, 61490, 163940, 218-2569; 12279, PEG10, 61491, 163941, 259-2382; 12279, PEG10, 61492, 163942, 481-574; 12279, PEG10, 61493, 163943, 157-1236; 12279, PEG10, 61487, 163937, 480-1457; 12280, PEG3, 61495, 163945, 302-411; 12280, PEG3, 61497, 163947, 372-1558; 12280, PEG3, 61494, 163944, 365-5131; 12280, PEG3, 61496, 163946, 289-5052; 12280, PEG3, 61498, 163948, 352-5115; 12280, PEG3, 61499, 163949, 353-4741; 12280, PEG3, 61500, 163950, 383-4777; 12281, PAXIP1, 61503, 163953, 1-521; 12281, PAXIP1, 61504, 163954, 156-599; 12281, PAXIP1, 61501, 163951, 44-3253; 12281, PAXIP1, 61502, 163952, 156-3365; 12282, PAXBP1, 61507, 163957, 1-111; 12282, PAXBP1, 61509, 163959, 1-78; 12282, PAXBP1, 61505, 163955, 1-2448; 12282, PAXBP1, 61506, 163956, 191-2944; 12282, PAXBP1, 61508, 163958, 20-1555; 12282, PAXBP1, 61510, 163960, 191-662; 12282, PAXBP1, 61511, 163961, 1-472; 12283, PXN, 61516, 163966, 428-957; 12283, PXN, 61517, 163967, 477-2246; 12283, PXN, 61518, 163968, 548-655; 12283, PXN, 61519, 163969, 495-588; 12283, PXN, 61520, 163970, 109-384; 12283, PXN, 61521, 163971, 619-729; 12283, PXN, 61522, 163972, 1-513; 12283, PXN, 61512, 163962, 143-1918; 12283, PXN, 61513, 163963, 143-1960; 12283, PXN, 61514, 163964, 143-1816; 12283, PXN, 61515, 163965, 666-1940; 12284, PAGR1, 61523, 163973, 575-1339; 12285, PKNOX1, 61525, 163975, 391-1350; 12285, PKNOX1, 61526, 163976, 61-246; 12285, PKNOX1, 61524, 163974, 212-1522; 12286, PKNOX2, 61528, 163978, 429-545; 12286, PKNOX2, 61529, 163979, 400-521; 12286, PKNOX2, 61530, 163980, 224-346; 12286, PKNOX2, 61531, 163981, 260-554; 12286, PKNOX2, 61527, 163977, 272-1690; 12287, PSIP1, 61537, 163987, 1-198; 12287, PSIP1, 61532, 163982, 314-1303; 12287, PSIP1, 61533, 163983, 317-1318; 12287, PSIP1, 61534, 163984, 345-1937; 12287, PSIP1, 61535, 163985, 1910; 12287, PSIP1, 61536, 163986, 102-1103; 12288, PCED1A, 61540, 163990, 483-1170; 12288, PCED1A, 61541, 163991, 347-1187; 12288, PCED1A, 61542, 163992, 1-383; 12288, PCED1A, 61538, 163988, 347-1558; 12288, PCED1A, 61539, 163989, 504-1868; 12289, PCED1B, 61545, 163995, 230-732; 12289, PCED1B, 61546, 163996, 155-723; 12289, PCED1B, 61547, 163997, 302-476; 12289, PCED1B, 61548, 163998, 295-796; 12289, PCED1B, 61543, 163993, 264-1562; 12289, PCED1B, 61544, 163994, 732-2030; 12290, PCF11, 61550, 164000, 298-2649; 12290, PCF11, 61551, 164001, 314-3309; 12290, PCF11, 61552, 164002, 282-580; 12290, PCF11, 61553, 164003, 33-628; 12290, PCF11, 61554, 164004, 298-2475; 12290, PCF11, 61549, 163999, 453-5120; 12291, PCID2, 61555, 164005, 36-1397; 12291, PCID2, 61556, 164006, 78-1277; 12291, PCID2, 61557, 164007, 598-1791; 12291, PCID2, 61558, 164008, 54-1247; 12291, PCID2, 61559, 164009, 33-1232; 12291, PCID2, 61560, 164010, 82-1281; 12291, PCID2, 61561, 164011, 82-1443; 12292, PDAP1, 61563, 164013, 43-162; 12292, PDAP1, 61564, 164014, 1-120; 12292, PDAP1, 61562, 164012, 282-827; 12293, PDIK1L, 61567, 164017, 266-838; 12293, PDIK1L, 61565, 164015, 85-1110; 12293, PDIK1L, 61566, 164016, 288-1313; 12293, PDIK1L, 61568, 164018, 274-1299; 12294, PDSSA, 61570, 164020, 1-381; 12294, PDSSA, 61571, 164021, 1-494; 12294, PDSSA, 61572, 164022, 1-132; 12294, PDSSA, 61569, 164019, 541-4554; 12294, PDSSA, 61573, 164023, 541-2343; 12295, PDSSB, 61576, 164026, 1-906; 12295, PDSSB, 61574, 164024, 187-4530; 12295, PDSSB, 61575, 164025, 66-4241; 12296, PCIF1, 61578, 164028, 1-914; 12296, PCIF1, 61577, 164027, 365-2479; 12297, PDLIM1, 61579, 164029, 110-1099; 12298, PDLIM2, 61587, 164037, 58-578; 12298, PDLIM2, 61588, 164038, 83-845; 12298, PDLIM2, 61589, 164039, 47-507; 12298, PDLIM2, 61590, 164040, 52-757; 12298, PDLIM2, 61591, 164041, 189-728; 12298, PDLIM2, 61592, 164042, 6-122; 12298, PDLIM2, 61593, 164043, 95-535; 12298, PDLIM2, 61594, 164044, 156-209; 12298, PDLIM2, 61595, 164045, 94-312; 12298, PDLIM2, 61596, 164046, 135-1112; 12298, PDLIM2, 61597, 164047, 1-414; 12298, PDLIM2, 61598, 164048, 1175-1615; 12298, PDLIM2, 61580, 164030, 116-1216; 12298, PDLIM2, 61581, 164031, 40-1848; 12298, PDLIM2, 61582, 164032, 40-1848; 12298, PDLIM2, 61583, 164033, 401-1459; 12298, PDLIM2, 61584, 164034, 78-1136; 12298, PDLIM2, 61585, 164035, 135-971; 12298, PDLIM2, 61586, 164036, 77-1135; 12299, PDLIM3, 61599, 164049, 125-955; 12299, PDLIM3, 61602, 164052, 74-202; 12299, PDLIM3, 61603, 164053, 33-161; 12299, PDLIM3, 61604, 164054, 125-718; 12299, PDLIM3, 61605, 164055, 74-202; 12299, PDLIM3, 61600, 164050, 75-1169; 12299, PDLIM3, 61601, 164051, 179-1129; 12300, PDLIM4, 61608, 164058, 176-538; 12300, PDLIM4, 61606, 164056, 65-1057; 12300, PDLIM4, 61607, 164057, 29-769; 12301, PDLIM5, 61613, 164063, 738-1553; 12301, PDLIM5, 61614, 164064, 1-695; 12301, PDLIM5, 61615, 164065, 1-258; 12301, PDLIM5, 61616, 164066, 97-213; 12301, PDLIM5, 61619, 164069, 119-262; 12301, PDLIM5, 61621, 164071, 1-590; 12301, PDLIM5, 61624, 164074, 25-554; 12301, PDLIM5, 61625, 164075, 96-215; 12301, PDLIM5, 61609, 164059, 137-1927; 12301, PDLIM5, 61610, 164060, 182-826; 12301, PDLIM5, 61611, 164061, 153-563; 12301, PDLIM5, 61612, 164062, 182-886; 12301, PDLIM5, 61617, 164067, 104-1555; 12301, PDLIM5, 61618, 164068, 45-1922; 12301, PDLIM5, 61620, 164070, 45-749; 12301, PDLIM5, 61622, 164072, 83-1546; 12301, PDLIM5, 61623, 164073, 182-2059; 12302, PDLIM7, 61629, 164079, 86-671; 12302, PDLIM7, 61631, 164081, 366-636; 12302, PDLIM7, 61632, 164082, 1-362; 12302, PDLIM7, 61633, 164083, 240-759; 12302, PDLIM7, 61634, 164084, 71-931; 12302, PDLIM7, 61626, 164076, 58-726; 12302, PDLIM7, 61627, 164077, 68-1441; 12302, PDLIM7, 61628, 164078, 46-1317; 12302, PDLIM7, 61630, 164080, 68-931; 12302, PDLIM7, 61635, 164085, 46-507; 12302, PDLIM7, 61636, 164086, 86-661; 12303, PBK, 61638, 164088, 295-748; 12303, PBK, 61639, 164089, 153-344; 12303, PBK, 61637, 164087, 465-1433; 12303, PBK, 61640, 164090, 394-1395; 12304, PDZK1, 61644, 164094, 218-1010; 12304, PDZK1, 61641, 164091, 74-1633; 12304, PDZK1, 61642, 164092, 87-1646; 12304, PDZK1, 61643, 164093, 87-1313; 12305, PDZD11, 61645, 164095, 134-556; 12305, PDZD11, 61646, 164096, 172-594; 12306, PDZD2, 61648, 164098, 496-536; 12306, PDZD2, 61647, 164097, 389-8908; 12307, PDZD3, 61652, 164102, 16-375; 12307, PDZD3, 61653, 164103, 136-1614; 12307, PDZD3, 61649, 164099, 10-1485; 12307, PDZD3, 61650, 164100, 16-1533; 12307, PDZD3, 61651, 164101, 550-2265; 12308, PDZD4, 61655, 164105, 251-2578; 12308, PDZD4, 61657, 164107, 67-435; 12308, PDZD4, 61654, 164104, 193-2502; 12308, PDZD4, 61656, 164106, 251-2233; 12309, PDZD7, 61659, 164109, 1-624; 12309, PDZD7, 61660, 164110, 199-600; 12309, PDZD7, 61661, 164111, 208-753; 12309, PDZD7, 61658, 164108, 227-1780; 12309, PDZD7, 61662, 164112, 251-3352; 12310, PDZD8, 61663, 164113, 241-3705; 12311, PDZD9, 61665, 164115, 64-357; 12311, PDZD9, 61664, 164114, 64-858; 12311, PDZD9, 61666, 164116, 52-666; 12312, PDZRN3, 61669, 164119, 290-2461; 12312, PDZRN3, 61670, 164120, 280-2451; 12312, PDZRN3, 61671, 164121, 198-2549; 12312, PDZRN3, 61672, 164122, 1-1148; 12312, PDZRN3, 61673, 164123, 300-1776; 12312, PDZRN3, 61667, 164117, 116-3316; 12312, PDZRN3, 61668, 164118, 16-1098; 12313, PDZRN4, 61674, 164124, 389-2719; 12313, PDZRN4, 61675, 164125, 9-3119; 12313, PDZRN4, 61676, 164126, 263-2599; 12314, PDZK1IP1, 61677, 164127, 124-468; 12314, PDZK1IP1, 61678, 164128, 426-770; 12315, PCNX, 61681, 164131, 1-288; 12315, PCNX, 61682, 164132, 1-3986; 12315, PCNX, 61683, 164133, 1-595; 12315, PCNX, 61679, 164129, 447-7472; 12315, PCNX, 61680, 164130, 113-6805; 12316, PCNXL2, 61686, 164136, 747-1982; 12316, PCNXL2, 61687, 164137, 1-328; 12316, PCNXL2, 61688, 164138, 1-537; 12316, PCNXL2, 61689, 164139, 1-1471; 12316, PCNXL2, 61690, 164140, 1-142; 12316, PCNXL2, 61691, 164141, 1-545; 12316, PCNXL2, 61692, 164142, 1-137; 12316, PCNXL2, 61693, 164143, 1-655; 12316, PCNXL2, 61694, 164144, 1-1275; 12316, PCNXL2, 61684, 164134, 236-6649; 12316, PCNXL2, 61685, 164135, 1197-3530; 12317, PCNXL3, 61695, 164145, 540-6644; 12318, PCNXL4, 61696, 164146, 523-3339; 12318, PCNXL4, 61697, 164147, 555-1247; 12318, PCNXL4, 61699, 164149, 507-3128; 12318, PCNXL4, 61700, 164150, 1-1584; 12318, PCNXL4, 61701, 164151, 1-419; 12318, PCNXL4, 61702, 164152, 1-357; 12318, PCNXL4, 61703, 164153, 1-290; 12318, PCNXL4, 61698, 164148, 555-4073; 12319, PELI1, 61704, 164154, 444-1700; 12320, PELI2, 61706, 164156, 491-774; 12320, PELI2, 61707, 164157, 326-558; 12320, PELI2, 61705, 164155, 287-1549; 12321, PELI3, 61710, 164160, 169-525; 12321, PELI3, 61711, 164161, 112-387; 12321, PELI3, 61713, 164163, 1-204; 12321, PELI3, 61714, 164164, 200-964; 12321, PELI3, 61708, 164158, 285-1622; 12321, PELI3, 61709, 164159, 161-1570; 12321, PELI3, 61712, 164162, 106-1101; 12321, PELI3, 61715, 164165, 121-1341; 12322, PELO, 61716, 164166, 986-2143; 12323, PEF1, 61717, 164167, 24-878; 12324, PTCD1, 61719, 164169, 80-571; 12324, PTCD1, 61720, 164170, 216-533; 12324, PTCD1, 61721, 164171, 124-556; 12324, PTCD1, 61718, 164168, 252-2354; 12325, PTCD2, 61724, 164174, 11-235; 12325, PTCD2, 61725, 164175, 1-432; 12325, PTCD2, 61726, 164176, 391-1001; 12325, PTCD2, 61728, 164178, 16-501; 12325, PTCD2, 61729, 164179, 11-292; 12325, PTCD2, 61730, 164180, 508-1104; 12325, PTCD2, 61722, 164172, 11-1177; 12325, PTCD2, 61723, 164173, 17-1183; 12325, PTCD2, 61727, 164177, 8-847; 12325, PTCD2, 61731, 164181, 336-986; 12326, PTCD3, 61733, 164183, 25-587; 12326, PTCD3, 61734, 164184, 26-262; 12326, PTCD3, 61735, 164185, 23-232; 12326, PTCD3, 61736, 164186, 1-210; 12326, PTCD3, 61732, 164182, 67-2136; 12327, PTX3, 61737, 164187, 146-1291; 12328, PTX4, 61740, 164190, 73-651; 12328, PTX4, 61738, 164188, 1-1422; 12328, PTX4, 61739, 164189, 27-1463; 12329, PGA3, 61742, 164192, 344-730; 12329, PGA3, 61743, 164193, 101-805; 12329, PGA3, 61744, 164194, 55-608; 12329, PGA3, 61745, 164195, 831-1627; 12329, PGA3, 61741, 164191, 186-1352; 12330, PGA4, 61747, 164197, 101-805; 12330, PGA4, 61748, 164198, 344-730; 12330, PGA4, 61746, 164196, 186-1352; 12331, PGA5, 61750, 164200, 104-808; 12331, PGA5, 61751, 164201, 344-730; 12331, PGA5, 61749, 164199, 186-1352; 12332, PMPCA, 61753, 164203, 1-816; 12332, PMPCA, 61752, 164202, 100-1677; 12332, PMPCA, 61754, 164204, 307-1491; 12333, PMPCB, 61756, 164206, 5-373; 12333, PMPCB, 61757, 164207, 26-1498; 12333, PMPCB, 61758, 164208, 8-616; 12333, PMPCB, 61759, 164209, 7-375; 12333, PMPCB, 61760, 164210, 4-363; 12333, PMPCB, 61755, 164205, 39-1508; 12334, PEPD, 61764, 164214, 1-581; 12334, PEPD, 61765, 164215, 258-570; 12334, PEPD, 61766, 164216, 1-168; 12334, PEPD, 61767, 164217, 1-127; 12334, PEPD, 61761, 164211, 35-1516; 12334, PEPD, 61762, 164212, 32-1390; 12334, PEPD, 61763, 164213, 29-1318; 12335, PAMR1, 61768, 164218, 378-2402; 12335, PAMR1, 61769, 164219, 19-551; 12335, PAMR1, 61770, 164220, 840-2090; 12335, PAMR1, 61772, 164222, 557-2599; 12335, PAMR1, 61771, 164221, 447-2276; 12335, PAMR1, 61773, 164223, 39-2252; 12335, PAMR1, 61774, 164224, 447-2609; 12336, PI15, 61775, 164225, 180-956; 12336, PI15, 61776, 164226, 465-1241; 12337, PI16, 61777, 164227, 329-1720; 12337, PI16, 61778, 164228, 224-1615; 12338, PI3, 61779, 164229, 48-401; 12339, PM20D1, 61780, 164230, 46-1554; 12340, PM20D2, 61781, 164231, 96-1406; 12341, PDF, 61782, 164232, 26-757; 12342, PYY, 61783, 164233, 542-835; 12342, PYY, 61784, 164234, 92-364; 12343, PGLYRP1, 61785, 164235, 45-635; 12344, PGLYRP2, 61788, 164238, 335-651; 12344, PGLYRP2, 61789, 164239, 36-578; 12344, PGLYRP2, 61786, 164236, 131-2035; 12344, PGLYRP2, 61787, 164237, 482-2212; 12345, PGLYRP3, 61790, 164240, 54-1079; 12346, PGLYRP4, 61791, 164241, 66-1187; 12346, PGLYRP4, 61792, 164242, 360-1469; 12347, PADI1, 61793, 164243, 93-2084; 12347, PADI1, 61794, 164244, 93-2084; 12348, PADI2, 61795, 164245, 65-1378; 12348, PADI2, 61796, 164246, 65-2062; 12349, PADI3, 61797, 164247, 41-2035; 12349, PADI3, 61798, 164248, 41-2035; 12350, PADI4, 61800, 164250, 29-412; 12350, PADI4, 61799, 164249, 27-2018; 12351, PADI6, 61801, 164251, 51-2135; 12352, PAM, 61803, 164253, 378-905; 12352, PAM, 61806, 164256, 1-2038; 12352, PAM, 61809, 164259, 501-575; 12352, PAM, 61810, 164260, 484-570; 12352, PAM, 61811, 164261, 403-528; 12352, PAM, 61812, 164262, 532-616; 12352, PAM, 61813, 164263, 406-564; 12352, PAM, 61814, 164264, 1-752; 12352, PAM, 61815, 164265, 405-609; 12352, PAM, 61802, 164252, 460-3123; 12352, PAM, 61804, 164254, 187-3111; 12352, PAM, 61805, 164255, 374-2974; 12352, PAM, 61807, 164257, 471-3392; 12352, PAM, 61808, 164258, 81-2798; 12353, PIN1, 61817, 164267, 23-460; 12353, PIN1, 61818, 164268, 1-271; 12353, PIN1, 61820, 164270, 1-152; 12353, PIN1, 61816, 164266, 23-514; 12353, PIN1, 61819, 164269, 5-496; 12354, PIN4, 61821, 164271, 36-371; 12354, PIN4, 61823, 164273, 1-276; 12354, PIN4, 61824, 164274, 1-350; 12354, PIN4, 61826, 164276, 359-679; 12354, PIN4, 61827, 164277, 1-348; 12354, PIN4, 61822, 164272, 33-503; 12354, PIN4, 61825, 164275, 36-437; 12355, PPIL1, 61828, 164278, 253-753; 12356, PPIL2, 61832, 164282, 78-557; 12356, PPIL2, 61833, 164283, 78-203; 12356, PPIL2, 61829, 164279, 92-1654; 12356, PPIL2, 61830, 164280, 79-1641; 12356, PPIL2, 61831, 164281, 61-1623; 12356, PPIL2, 61834, 164284, 79-1662; 12357, PPIL3, 61837, 164287, 259-732; 12357, PPIL3, 61838, 164288, 1-543; 12357, PPIL3, 61840, 164290, 94-313; 12357, PPIL3, 61841, 164291, 73-234; 12357, PPIL3, 61842, 164292, 357-596; 12357, PPIL3, 61835, 164285, 385-882; 12357, PPIL3, 61836, 164286, 270-755; 12357, PPIL3, 61839, 164289, 131-628; 12358, PPIL4, 61844, 164294, 535-918; 12358, PPIL4, 61843, 164293, 34-1512; 12359, PPIL6, 61845, 164295, 34-825; 12359, PPIL6, 61848, 164298, 1-617; 12359, PPIL6, 61849, 164299, 1-514; 12359, PPIL6, 61851, 164301, 1-436; 12359, PPIL6, 61846, 164296, 582-1595; 12359, PPIL6, 61847, 164297, 582-1421; 12359, PPIL6, 61850, 164300, 582-1517; 12360, PPIA, 61852, 164302, 44-406; 12360, PPIA, 61853, 164303, 46-411; 12360, PPIA, 61856, 164306, 45-221; 12360, PPIA, 61854, 164304, 46-543; 12360, PPIA, 61855, 164305, 382-699; 12360, PPIA, 61857, 164307, 292-609; 12360, PPIA, 61858, 164308, 301-618; 12361, PPIAL4A, 61859, 164309, 76-570; 12362, PPIAL4C, 61860, 164310, 34-528; 12363, PPIAL4D, 61861, 164311, 1-495; 12364, PPIAL4E, 61862, 164312, 76-570; 12365, PPIAL4F, 61863, 164313, 76-570; 12365, PPIAL4F, 61864, 164314, 76-570; 12366, PPIAL4G, 61865, 164315, 428-922; 12367, PPIB, 61866, 164316, 220-870; 12368, PPIC, 61867, 164317, 117-755; 12369, PPID, 61869, 164319, 1-147; 12369, PPID, 61870, 164320, 1-59; 12369, PPID, 61868, 164318, 109-1221; 12370, PPWD1, 61872, 164322, 1-399; 12370, PPWD1, 61873, 164323, 106-829; 12370, PPWD1, 61874, 164324, 16-222; 12370, PPWD1, 61875, 164325, 19-342; 12370, PPWD1, 61876, 164326, 13-267; 12370, PPWD1, 61877, 164327, 249-570; 12370, PPWD1, 61878, 164328, 22-348; 12370, PPWD1, 61879, 164329, 200-2050; 12370, PPWD1, 61871, 164321, 73-2013; 12370, PPWD1, 61880, 164330, 438-1910; 12371, PPIE, 61884, 164334, 1-753; 12371, PPIE, 61885, 164335, 1-627; 12371, PPIE, 61886, 164336, 1-114; 12371, PPIE, 61887, 164337, 275-913; 12371, PPIE, 61888, 164338, 1-110; 12371, PPIE, 61889, 164339, 14-130; 12371, PPIE, 61890, 164340, 733-947; 12371, PPIE, 61881, 164331, 20-925; 12371, PPIE, 61882, 164332, 17-907; 12371, PPIE, 61883, 164333, 1-945; 12372, PPIF, 61892, 164342, 1-497; 12372, PPIF, 61893, 164343, 81-518; 12372, PPIF, 61891, 164341, 72-695; 12373, PPIG, 61895, 164345, 208-2427; 12373, PPIG, 61896, 164346, 349-525; 12373, PPIG, 61897, 164347, 323-1062; 12373, PPIG, 61899, 164349, 24-1485; 12373, PPIG, 61900, 164350, 3-317; 12373, PPIG, 61894, 164344, 221-2485; 12373, PPIG, 61898, 164348, 136-2400; 12373, PPIG, 61901, 164351, 181-1254; 12374, PPIH, 61903, 164353, 137-310; 12374, PPIH, 61905, 164355, 236-669; 12374, PPIH, 61906, 164356, 213-416; 12374, PPIH, 61907, 164357, 1-291; 12374, PPIH, 61902, 164352, 23-556; 12374, PPIH, 61904, 164354, 240-644; 12375, PTRH1, 61908, 164358, 365-913; 12375, PTRH1, 61911, 164361, 1-517; 12375,

PTRH1, 61912, 164362, 13-424; 12375, PTRH1, 61913, 164363, 1-487; 12375, PTRH1, 61909, 164359, 1458-2102; 12375, PTRH1, 61910, 164360, 19-663; 12376, PTRH2, 61915, 164365, 1573-2115; 12376, PTRH2, 61914, 164364, 229-768; 12376, PTRH2, 61916, 164366, 3448-3987; 12377, PTRHD1, 61917, 164367, 6-428; 12378, PRF1, 61918, 164368, 120-1787; 12378, PRF1, 61919, 164369, 162-1829; 12379, PRX, 61920, 164370, 270-713; 12379, PRX, 61921, 164371, 272-4657; 12380, PCNT, 61923, 164373, 1-686; 12380, PCNT, 61922, 164372, 108-10118; 12381, PCM1, 61925, 164375, 423-6005; 12381, PCM1, 61926, 164376, 281-1873; 12381, PCM1, 61927, 164377, 290-2536; 12381, PCM1, 61928, 164378, 1-2294; 12381, PCM1, 61929, 164379, 202-1426; 12381, PCM1, 61930, 164380, 60-5642; 12381, PCM1, 61931, 164381, 252-6302; 12381, PCM1, 61924, 164374, 440-6514; 12382, PLIN1, 61934, 164384, 1-222; 12382, PLIN1, 61932, 164382, 167-1735; 12382, PLIN1, 61933, 164383, 121-1689; 12383, PLIN2, 61936, 164386, 95-427; 12383, PLIN2, 61937, 164387, 81-461; 12383, PLIN2, 61938, 164388, 249-623; 12383, PLIN2, 61935, 164385, 181-1494; 12384, PLIN3, 61940, 164390, 498-604; 12384, PLIN3, 61942, 164392, 57-574; 12384, PLIN3, 61944, 164394, 125-629; 12384, PLIN3, 61945, 164395, 1-878; 12384, PLIN3, 61939, 164389, 178-1482; 12384, PLIN3, 61941, 164391, 104-1405; 12384, PLIN3, 61943, 164393, 63-1331; 12385, PLIN4, 61947, 164397, 99-4217; 12385, PLIN4, 61946, 164396, 1-4074; 12386, PLIN5, 61949, 164399, 201-377; 12386, PLIN5, 61950, 164400, 82-258; 12386, PLIN5, 61948, 164398, 82-1473; 12387, PER1, 61953, 164403, 127-3930; 12387, PER1, 61954, 164404, 239-589; 12387, PER1, 61955, 164405, 148-2622; 12387, PER1, 61956, 164406, 1-507; 12387, PER1, 61957, 164407, 4-528; 12387, PER1, 61958, 164408, 240-576; 12387, PER1, 61959, 164409, 340-2058; 12387, PER1, 61951, 164401, 239-4111; 12387, PER1, 61952, 164402, 7-2586; 12388, PER2, 61962, 164412, 224-551; 12388, PER2, 61960, 164410, 281-4048; 12388, PER2, 61961, 164411, 1-1215; 12389, PER3, 61965, 164415, 282-1418; 12389, PER3, 61966, 164416, 265-3840; 12389, PER3, 61963, 164413, 176-3781; 12389, PER3, 61964, 164414, 225-3857; 12389, PER3, 61967, 164417, 265-3897; 12390, POSTN, 61971, 164421, 36-2462; 12390, POSTN, 61968, 164418, 33-2372; 12390, POSTN, 61969, 164419, 25-2454; 12390, POSTN, 61970, 164420, 119-2629; 12390, POSTN, 61972, 164422, 119-2368; 12390, POSTN, 61973, 164423, 119-2464; 12391, PMP2, 61975, 164425, 54-236; 12391, PMP2, 61974, 164424, 138-536; 12392, PMP22, 61977, 164427, 148-504; 12392, PMP22, 61979, 164429, 123-500; 12392, PMP22, 61980, 164430, 168-653; 12392, PMP22, 61981, 164431, 275-428; 12392, PMP22, 61976, 164426, 189-671; 12392, PMP22, 61978, 164428, 196-678; 12392, PMP22, 61982, 164432, 200-682; 12393, PRPH, 61984, 164434, 83-704; 12393, PRPH, 61985, 164435, 1-601; 12393, PRPH, 61983, 164433, 1500-2912; 12394, PRPH2, 61986, 164436, 241-1281; 12395, PPHLN1, 61987, 164437, 182-1273; 12395, PPHLN1, 61988, 164438, 99-1010; 12395, PPHLN1, 61989, 164439, 106-1128; 12395, PPHLN1, 61995, 164445, 182-1339; 12395, PPHLN1, 61996, 164446, 86-409; 12395, PPHLN1, 61997, 164447, 66-176; 12395, PPHLN1, 61999, 164449, 72-576; 12395, PPHLN1, 62000, 164450, 105-588; 12395, PPHLN1, 62001, 164451, 110-268; 12395, PPHLN1, 61990, 164440, 94-1197; 12395, PPHLN1, 61991, 164441, 85-1461; 12395, PPHLN1, 61992, 164442, 128-1252; 12395, PPHLN1, 61993, 164443, 83-1129; 12395, PPHLN1, 61994, 164444, 73-1377; 12395, PPHLN1, 61998, 164448, 102-1061; 12395, PPHLN1, 62002, 164452, 145-1449; 12395, PPHLN1, 62003, 164453, 145-1191; 12395, PPHLN1, 62004, 164454, 145-1521; 12396, PPL, 62006, 164456, 20-5284; 12396, PPL, 62007, 164457, 270-3615; 12396, PPL, 62005, 164455, 91-5361; 12397, PXDN, 62009, 164459, 48-720; 12397, PXDN, 62010, 164460, 1-2171; 12397, PXDN, 62011, 164461, 1-588; 12397, PXDN, 62012, 164462, 1-229; 12397, PXDN, 62008, 164458, 52-4491; 12398, PXDNL, 62014, 164464, 1-1613; 12398, PXDNL, 62015, 164465, 1-1749; 12398, PXDNL, 62013, 164463, 102-4493; 12399, PRDX1, 62017, 164467, 38-331; 12399, PRDX1, 62019, 164469, 282-795; 12399, PRDX1, 62020, 164470, 93-606; 12399, PRDX1, 62016, 164466, 342-941; 12399, PRDX1, 62018, 164468, 140-739; 12400, PRDX2, 62022, 164472, 58-468; 12400, PRDX2, 62021, 164471, 130-726; 12401, PRDX3, 62023, 164473, 44-814; 12402, PRDX4, 62024, 164474, 21-581; 12402, PRDX4, 62026, 164476, 259-815; 12402, PRDX4, 62027, 164477, 1-484; 12402, PRDX4, 62025, 164475, 126-941; 12403, PRDX5, 62028, 164478, 129-773; 12403, PRDX5, 62029, 164479, 35-547; 12403, PRDX5, 62030, 164480, 35-412; 12404, PRDX6, 62031, 164481, 133-807; 12405, PEX1, 62033, 164483, 1-590; 12405, PEX1, 62034, 164484, 1-3681; 12405, PEX1, 62032, 164482, 97-3948; 12405, PEX1, 62035, 164485, 7-2892; 12406, PEX10, 62038, 164488, 34-663; 12406, PEX10, 62039, 164489, 39-1013; 12406, PEX10, 62040, 164490, 13-234; 12406, PEX10, 62041, 164491, 1-78; 12406, PEX10, 62042, 164492, 522-611; 12406, PEX10, 62036, 164486, 29-1069; 12406, PEX10, 62037, 164487, 70-1050; 12407, PEX11A, 62045, 164495, 122-316; 12407, PEX11A, 62046, 164496, 152-250; 12407, PEX11A, 62043, 164493, 151-894; 12407, PEX11A, 62044, 164494, 31-681; 12408, PEX11B, 62048, 164498, 1-246; 12408, PEX11B, 62047, 164497, 150-929; 12408, PEX11B, 62049, 164499, 85-822; 12409, PEX11G, 62052, 164502, 1-505; 12409, PEX11G, 62050, 164500, 10-735; 12409, PEX11G, 62051, 164501, 504-1019; 12410, PEX12, 62054, 164504, 235-897; 12410, PEX12, 62055, 164505, 532-1607; 12410, PEX12, 62053, 164503, 609-1688; 12410, PEX12, 62056, 164506, 617-1696; 12411, PEX13, 62058, 164508, 119-229; 12411, PEX13, 62059, 164509, 536-727; 12411, PEX13, 62060, 164510, 31-195; 12411, PEX13, 62057, 164507, 39-1250; 12412, PEX14, 62062, 164512, 1-483; 12412, PEX14, 62061, 164511, 81-1214; 12413, PEX16, 62065, 164515, 18-176; 12413, PEX16, 62066, 164516, 422-903; 12413, PEX16, 62067, 164517, 268-450; 12413, PEX16, 62068, 164518, 15-563; 12413, PEX16, 62069, 164519, 270-464; 12413, PEX16, 62070, 164520, 865-1590; 12413, PEX16, 62063, 164513, 19-1059; 12413, PEX16, 62064, 164514, 245-1255; 12414, PEX19, 62072, 164522, 92-796; 12414, PEX19, 62073, 164523, 1-358; 12414, PEX19, 62074, 164524, 31-153; 12414, PEX19, 62075, 164525, 84-584; 12414, PEX19, 62076, 164526, 23-583; 12414, PEX19, 62071, 164521, 23-922; 12415, PEX2, 62080, 164530, 162-700; 12415, PEX2, 62081, 164531, 465-473; 12415, PEX2, 62077, 164527, 397-1314; 12415, PEX2, 62078, 164528, 226-1143; 12415, PEX2, 62079, 164529, 406-1323; 12416, PEX26, 62085, 164535, 363-932; 12416, PEX26, 62082, 164532, 207-1124; 12416, PEX26, 62083, 164533, 370-1287; 12416, PEX26, 62084, 164534, 1-771; 12416, PEX26, 62086, 164536, 210-980; 12417, PEX3, 62088, 164538, 237-784; 12417, PEX3, 62087, 164537, 64-1185; 12418, PEX5, 62091, 164541, 278-1508; 12418, PEX5, 62092, 164542, 90-2072; 12418, PEX5, 62096, 164546, 18-522; 12418, PEX5, 62097, 164547, 336-641; 12418, PEX5, 62098, 164548, 193-548; 12418, PEX5, 62099, 164549, 104-848; 12418, PEX5, 62100, 164550, 179-562; 12418, PEX5, 62101, 164551, 266-579; 12418, PEX5, 62102, 164552, 229-575; 12418, PEX5, 62103, 164553, 61-878; 12418, PEX5, 62104, 164554, 1-94; 12418, PEX5, 62105, 164555, 226-567; 12418, PEX5, 62089, 164539, 184-1992; 12418, PEX5, 62090, 164540, 18-1913; 12418, PEX5, 62093, 164543, 581-2500; 12418, PEX5, 62094, 164544, 81-2045; 12418, PEX5, 62095, 164545, 519-2438; 12419, PEXSL, 62109, 164559, 2-584; 12419, PEXSL, 62113, 164563, 262-472; 12419, PEXSL, 62115, 164565, 264-874; 12419, PEXSL, 62116, 164566, 460-563; 12419, PEXSL, 62106, 164556, 172-2046; 12419, PEXSL, 62107, 164557, 114-1670; 12419, PEXSL, 62108, 164558, 172-1728; 12419, PEXSL, 62110, 164560, 361-2064; 12419, PEXSL, 62111, 164561, 455-2230; 12419, PEXSL, 62112, 164562, 695-1999; 12419, PEXSL, 62114, 164564, 328-2136; 12419, PEXSL, 62117, 164567, 332-2212; 12419, PEXSL, 62118, 164568, 305-2056; 12420, PEX6, 62119, 164569, 1-2217; 12420, PEX6, 62120, 164570, 71-3013; 12421, PEX7, 62122, 164572, 88-456; 12421, PEX7, 62121, 164571, 82-1053; 12421, PEX7, 62123, 164573, 103-945; 12422, PXMP2, 62125, 164575, 1-682; 12422, PXMP2, 62126, 164576, 1-148; 12422, PXMP2, 62127, 164577, 30-512; 12422, PXMP2, 62128, 164578, 1-252; 12422, PXMP2, 62124, 164574, 66-653; 12423, PXMP4, 62129, 164579, 104-538; 12423, PXMP4, 62130, 164580, 113-328; 12423, PXMP4, 62131, 164581, 94-732; 12424, PECR, 62133, 164583, 50-523; 12424, PECR, 62132, 164582, 76-987; 12425, PXT1, 62135, 164585, 21-176; 12425, PXT1, 62134, 164584, 485-889; 12426, PPARA, 62139, 164589, 342-368; 12426, PPARA, 62140, 164590, 324-531; 12426, PPARA, 62141, 164591, 173-572; 12426, PPARA, 62136, 164586, 183-1589; 12426, PPARA, 62137, 164587, 129-1535; 12426, PPARA, 62138, 164588, 214-1620; 12427, PPARD, 62142, 164592, 350-1675; 12427, PPARD, 62143, 164593, 350-1435; 12427, PPARD, 62144, 164594, 310-1635; 12427, PPARD, 62145, 164595, 310-1341; 12427, PPARD, 62146, 164596, 196-1404; 12428, PPARG, 62150, 164600, 69-821; 12428, PPARG, 62154, 164604, 25-147; 12428, PPARG, 62155, 164605, 384-1835; 12428, PPARG, 62156, 164606, 291-686; 12428, PPARG, 62157, 164607, 264-560; 12428, PPARG, 62158, 164608, 300-428; 12428, PPARG, 62147, 164597, 122-1639; 12428, PPARG, 62148, 164598, 238-1671; 12428, PPARG, 62149, 164599, 1-561; 12428, PPARG, 62151, 164601, 385-1818; 12428, PPARG, 62152, 164602, 374-1807; 12428, PPARG, 62153, 164603, 123-1556; 12429, PPARGC1A, 62162, 164612, 79-378; 12429, PPARGC1A, 62163, 164613, 133-1026; 12429, PPARGC1A, 62164, 164614, 133-936; 12429, PPARGC1A, 62159, 164609, 121-2517; 12429, PPARGC1A, 62160, 164610, 79-984; 12429, PPARGC1A, 62161, 164611, 76-891; 12429, PPARGC1A, 62165, 164615, 712-2727; 12430, PPARGC1B, 62170, 164620, 1-2245; 12430, PPARGC1B, 62166, 164616, 33-3104; 12430, PPARGC1B, 62167, 164617, 46-3000; 12430, PPARGC1B, 62168, 164618, 43-3096; 12430, PPARGC1B, 62169, 164619, 198-3077; 12431, PPRC1, 62172, 164622, 117-2012; 12431, PPRC1, 62173, 164623, 76-4278; 12431, PPRC1, 62171, 164621, 40-5034; 12432, PERP, 62174, 164624, 172-753; 12433, PSPN, 62176, 164626, 3210-3704; 12433, PSPN, 62175, 164625, 1-471; 12434, PES1, 62179, 164629, 48-1763; 12434, PES1, 62180, 164630, 993-2342; 12434, PES1, 62181, 164631, 467-871; 12434, PES1, 62182, 164632, 945-2294; 12434, PES1, 62183, 164633, 1-583; 12434, PES1, 62177, 164627, 26-1777; 12434, PES1, 62178, 164628, 108-1874; 12435, PCNP, 62185, 164635, 31-153; 12435, PCNP, 62186, 164636, 27-200; 12435, PCNP, 62188, 164638, 14-136; 12435, PCNP, 62184, 164634, 122-658; 12435, PCNP, 62187, 164637, 177-344; 12436, PET100, 62189, 164639, 21-155; 12436, PET100, 62190, 164640, 1-139; 12436, PET100, 62192, 164642, 11-217; 12436, PET100, 62191, 164641, 98-319; 12437, PET117, 62193, 164643, 84-329; 12438, PPAN, 62195, 164645, 224-1486; 12438, PPAN, 62196, 164646, 214-844; 12438, PPAN, 62197, 164647, 1-626; 12438, PPAN, 62198, 164648, 304-594; 12438, PPAN, 62194, 164644, 107-1528; 12439, PGAM5, 62200, 164650, 362-784; 12439, PGAM5, 62202, 164652, 865-1287; 12439, PGAM5, 62199, 164649, 59-826; 12439, PGAM5, 62201, 164651, 59-928; 12440, PHLPP1, 62204, 164654, 1-591; 12440, PHLPP1, 62203, 164653, 235-5388; 12441, PHLPP2, 62206, 164656, 16-4092; 12441, PHLPP2, 62207, 164657, 1-959; 12441, PHLPP2, 62209, 164659, 1-2172; 12441, PHLPP2, 62205, 164655, 735-4505; 12441, PHLPP2, 62208, 164658, 380-4351; 12442, N/A, 62210, 164660, 1-693; 12442, N/A, 62211, 164661, 106-540; 12442, N/A, 62212, 164662, 1-792; 12442, N/A, 62213, 164663, 130-1584; 12442, N/A, 62214, 164664, 21-443; 12442, N/A, 62215, 164665, 29-1495; 12442, N/A, 62216, 164666, 184-1926; 12442, N/A, 62217, 164667, 178-687; 12443, PHRF1, 62219, 164669, 94-5037; 12443, PHRF1, 62221, 164671, 94-5031; 12443, PHRF1, 62224, 164674, 94-5031; 12443, PHRF1, 62225, 164675, 94-5040; 12443, PHRF1, 62226, 164676, 129-4613; 12443, PHRF1, 62227, 164677, 94-5037; 12443, PHRF1, 62218, 164668, 129-5078; 12443, PHRF1, 62220, 164670, 94-5040; 12443, PHRF1, 62222, 164672, 129-4613; 12443, PHRF1, 62223, 164673, 129-5078; 12444, PHF1, 62231, 164681, 154-836; 12444, PHF1, 62232, 164682, 174-609; 12444, PHF1, 62233, 164683, 154-836; 12444, PHF1, 62234, 164684, 1-546; 12444, PHF1, 62235, 164685, 1-112; 12444, PHF1, 62237, 164687, 174-609; 12444, PHF1, 62238, 164688, 1-728; 12444, PHF1, 62239, 164689, 543-1724; 12444, PHF1, 62240, 164690, 543-1724; 12444, PHF1, 62241, 164691, 107-1366; 12444, PHF1, 62242, 164692, 685-849; 12444, PHF1, 62243, 164693, 147-311; 12444, PHF1, 62228, 164678, 272-1645; 12444, PHF1, 62229, 164679, 272-1975; 12444, PHF1, 62230, 164680, 272-1975; 12444, PHF1, 62236, 164686, 272-1645; 12445, PHF10, 62246, 164696, 75-1208; 12445, PHF10, 62244, 164694, 125-1621; 12445, PHF10, 62245, 164695, 1-1491; 12445, PHF10, 62247, 164697, 201-1556; 12446, PHF11, 62250, 164700, 1-860; 12446, PHF11, 62251, 164701, 107-610; 12446, PHF11, 62253, 164703, 272-952; 12446, PHF11, 62254, 164704, 397-795; 12446, PHF11, 62255, 164705, 272-566; 12446, PHF11, 62256, 164706, 129-701; 12446, PHF11, 62257, 164707, 33-512; 12446, PHF11, 62248, 164698, 277-1155; 12446, PHF11, 62249, 164699, 42-1037; 12446, PHF11, 62252, 164702, 129-1007; 12447, PHF12, 62260, 164710, 398-2515; 12447, PHF12, 62261, 164711, 812-1201; 12447, PHF12, 62262, 164712, 3-649; 12447, PHF12, 62264, 164714, 1-241; 12447, PHF12, 62265, 164715, 1-164; 12447, PHF12, 62266, 164716, 466-555; 12447, PHF12, 62267, 164717, 280-555; 12447, PHF12, 62268, 164718, 1-820; 12447, PHF12, 62269, 164719, 297-648; 12447, PHF12, 62270, 164720, 116-574; 12447, PHF12, 62258, 164708, 531-2645; 12447, PHF12, 62259, 164709, 812-3826; 12447, PHF12, 62263, 164713, 348-2897; 12448, PHF13, 62271, 164721, 383-1285; 12449, PHF14, 62273, 164723, 436-564; 12449, PHF14, 62274, 164724, 453-581; 12449, PHF14, 62275, 164725, 421-3267; 12449, PHF14, 62272, 164722, 453-3119; 12450, PHF19, 62278, 164728, 45-565; 12450, PHF19, 62279, 164729, 569-888; 12450, PHF19, 62280, 164730, 377-556; 12450, PHF19, 62281, 164731, 118-1233; 12450, PHF19, 62282, 164732, 62-558; 12450, PHF19, 62283, 164733, 68-1867; 12450, PHF19, 62276, 164726, 114-737; 12450, PHF19, 62277, 164727, 254-1996; 12451, PHF2, 62285, 164735, 205-1134; 12451, PHF2, 62286, 164736, 28-1014; 12451, PHF2, 62284, 164734, 368-3658; 12452, PHF20, 62287, 164737, 369-1997; 12452, PHF20, 62288, 164738, 167-1814; 12452, PHF20, 62290, 164740, 77-539; 12452, PHF20, 62291, 164741, 373-684; 12452, PHF20, 62292, 164742, 34-1950; 12452, PHF20, 62293, 164743, 193-384; 12452, PHF20, 62289, 164739, 130-3168; 12453, PHF20L1, 62294, 164744, 322-3297; 12453, PHF20L1, 62296, 164746, 104-1054; 12453, PHF20L1, 62297, 164747, 309-1244; 12453, PHF20L1, 62299, 164749, 38-3016; 12453, PHF20L1, 62300, 164750, 363-621; 12453, PHF20L1, 62301, 164751, 1-338; 12453, PHF20L1, 62302, 164752, 7-801; 12453, PHF20L1, 62303, 164753, 1-281; 12453, PHF20L1, 62305, 164755, 282-764; 12453, PHF20L1, 62295, 164745, 272-1129; 12453, PHF20L1, 62298, 164748, 300-3353; 12453, PHF20L1, 62304, 164754, 322-3375; 12454, PHF21A, 62308, 164758, 154-555; 12454, PHF21A, 62309, 164759, 1-451; 12454, PHF21A, 62310, 164760, 1-280; 12454, PHF21A, 62311, 164761, 365-613; 12454, PHF21A, 62312, 164762, 314-466; 12454, PHF21A, 62313, 164763, 107-507; 12454, PHF21A, 62314, 164764, 457-490; 12454, PHF21A, 62315, 164765, 374-561; 12454, PHF21A, 62316, 164766, 520-546; 12454, PHF21A, 62317, 164767, 1-351; 12454, PHF21A, 62318, 164768, 254-557; 12454, PHF21A, 62319, 164769, 498-577; 12454, PHF21A, 62306, 164756, 369-2273; 12454, PHF21A, 62307, 164757, 201-2243; 12455, PHF21B, 62322, 164772, 679-1662; 12455, PHF21B, 62323, 164773, 145-557; 12455, PHF21B, 62324, 164774, 176-750; 12455, PHF21B, 62320, 164770, 152-1747; 12455, PHF21B, 62321, 164771, 183-1616; 12455, PHF21B, 62325, 164775, 101-1570; 12456, PHF23, 62328, 164778, 476-583; 12456, PHF23, 62329, 164779, 92-649; 12456, PHF23, 62330, 164780, 535-1356; 12456, PHF23, 62331, 164781, 480-497; 12456, PHF23, 62332, 164782, 398-575; 12456, PHF23, 62334, 164784, 404-1006; 12456, PHF23, 62335, 164785, 76-685; 12456, PHF23, 62336, 164786, 1-477; 12456, PHF23, 62326, 164776, 228-1439; 12456, PHF23, 62327, 164777, 124-1323; 12456, PHF23, 62333, 164783, 161-1171; 12457, PHF24, 62337, 164787, 83-1285; 12458, PHF3, 62340, 164790, 1-509; 12458, PHF3, 62341, 164791, 368-2578; 12458, PHF3, 62342, 164792, 390-2854; 12458, PHF3, 62343, 164793, 174-486; 12458, PHF3, 62344, 164794, 484-3700; 12458, PHF3, 62345, 164795, 66-314; 12458, PHF3, 62346, 164796, 349-2787; 12458, PHF3, 62347, 164797, 493-3074; 12458, PHF3, 62338, 164788, 341-6460; 12458, PHF3, 62339, 164789, 27-6146; 12459, PHFSA, 62348, 164798, 73-405; 12460, PHF6, 62350, 164800, 195-1169; 12460, PHF6, 62353, 164803, 203-1303; 12460, PHF6, 62349, 164799, 203-1300; 12460, PHF6, 62351, 164801, 142-1080; 12460, PHF6, 62352, 164802, 262-1359; 12461, PHF7, 62356, 164806, 1-980; 12461, PHF7, 62357, 164807, 1-191; 12461, PHF7, 62358, 164808, 757-1503; 12461, PHF7, 62360, 164810, 84-725; 12461, PHF7, 62354, 164804, 121-1149; 12461, PHF7, 62355, 164805, 661-1806; 12461, PHF7, 62359, 164809, 70-1098; 12462, PHF8, 62365, 164815, 1-2861; 12462, PHF8, 62366, 164816, 1-525; 12462, PHF8, 62367, 164817, 1-1978; 12462, PHF8, 62368, 164818, 211-555; 12462, PHF8, 62369, 164819, 344-687; 12462, PHF8, 62370, 164820, 91-534; 12462, PHF8, 62371, 164821, 188-565; 12462, PHF8, 62372, 164822, 263-555; 12462, PHF8, 62373, 164823, 1-403; 12462, PHF8, 62374, 164824, 183-475; 12462, PHF8, 62375, 164825, 865-1776; 12462, PHF8, 62361, 164811, 177-2813; 12462, PHF8, 62362, 164812, 506-3580; 12462, PHF8, 62363, 164813, 506-3352; 12462, PHF8, 62364, 164814, 360-3542; 12463, PBLD, 62377, 164827, 165-932; 12463, PBLD, 62379, 164829, 1-271; 12463, PBLD, 62376, 164826, 186-1052; 12463, PBLD, 62378, 164828, 204-1070; 12463, PBLD, 62380, 164830, 329-1171; 12464, PAH, 62381, 164831, 272-1615; 12464, PAH, 62382, 164832, 354-705; 12464, PAH, 62383, 164833, 268-675; 12464, PAH, 62385, 164835, 1-449; 12464, PAH, 62386, 164836, 1-429; 12464, PAH, 62384, 164834, 474-1832; 12465, FARS2, 62389, 164839, 1-306; 12465, FARS2, 62390, 164840, 421-562; 12465, FARS2, 62387, 164837, 157-1512; 12465, FARS2, 62388, 164838, 337-1692; 12466, FARSA, 62393, 164843, 16-521; 12466, FARSA, 62394, 164844, 1-1135; 12466, FARSA, 62395, 164845, 142-1788; 12466, FARSA, 62396, 164846, 1-708; 12466, FARSA, 62397, 164847, 1-478; 12466, FARSA, 62391, 164841, 20-1546; 12466, FARSA, 62392, 164842, 19-1452; 12467, FARSB, 62398, 164848, 265-2034; 12468, PNMT, 62400, 164850, 183-737; 12468, PNMT, 62401, 164851, 14-427; 12468, PNMT, 62399, 164849, 319-1167; 12469, PMAIP1, 62402, 164852, 163-573; 12469, PMAIP1, 62403, 164853, 231-395; 12470, PDC, 62404, 164854, 89-829; 12470, PDC, 62405, 164855, 193-777; 12471, PDCL, 62407, 164857, 1-328; 12471, PDCL, 62408, 164858, 1-274; 12471, PDCL, 62406, 164856, 167-1072; 12472, PDCL2, 62410, 164860, 104-856; 12472, PDCL2, 62409, 164859, 104-829; 12473, PDCL3, 62412, 164862, 1-452; 12473, PDCL3, 62413, 164863, 397-657; 12473, PDCL3, 62411, 164861, 379-1098; 12474, PHACTR1, 62415, 164865, 21-443; 12474, PHACTR1, 62416, 164866, 106-540; 12474, PHACTR1, 62417, 164867, 178-687; 12474, PHACTR1, 62419, 164869, 1-792; 12474, PHACTR1, 62420, 164870, 29-1495; 12474, PHACTR1, 62421, 164871, 1-693; 12474, PHACTR1, 62414, 164864, 184-1926; 12474, PHACTR1, 62418, 164868, 130-1584; 12475, PHACTR2, 62424, 164874, 147-2015; 12475, PHACTR2, 62425, 164875, 97-558; 12475, PHACTR2, 62427, 164877, 141-675; 12475, PHACTR2, 62429, 164879, 117-616; 12475, PHACTR2, 62422, 164872, 126-1790; 12475, PHACTR2, 62423, 164873, 182-1879; 12475, PHACTR2, 62426, 164876, 131-2035; 12475, PHACTR2, 62428, 164878, 200-2137; 12476, PHACTR3, 62435, 164885, 415-539; 12476, PHACTR3, 62430, 164880, 110-1666; 12476, PHACTR3, 62431, 164881, 1-1671; 12476, PHACTR3, 62432, 164882, 235-1581; 12476, PHACTR3, 62433, 164883, 468-2147; 12476, PHACTR3, 62434, 164884, 235-1791; 12476, PHACTR3, 62436, 164886, 214-1770; 12477, PHACTR4, 62439, 164889, 256-918; 12477, PHACTR4, 62440, 164890, 235-553; 12477, PHACTR4, 62442, 164892, 155-280; 12477, PHACTR4, 62437, 164887, 215-2353; 12477, PHACTR4, 62438, 164888, 262-2370; 12477, PHACTR4, 62441, 164891, 121-312; 12478, PTEN, 62444, 164894, 1135-1605; 12478, PTEN, 62445, 164895, 1-462; 12478, PTEN, 62443, 164893, 1358-2569; 12479, PALD1, 62446, 164896, 269-2839; 12480, PHOSPHO1, 62449, 164899, 339-837; 12480, PHOSPHO1, 62450, 164900, 258-868; 12480, PHOSPHO1, 62451, 164901, 400-733; 12480, PHOSPHO1, 62453, 164903, 133-391; 12480, PHOSPHO1, 62447, 164897, 129-932; 12480, PHOSPHO1, 62448, 164898, 419-1297; 12480, PHOSPHO1, 62452, 164902, 123-1001; 12481, PHOSPHO2, 62455, 164905, 302-468; 12481, PHOSPHO2, 62456, 164906, 502-908; 12481, PHOSPHO2, 62457, 164907, 485-631; 12481, PHOSPHO2, 62454, 164904, 389-1114; 12481, PHOSPHO2, 62458, 164908, 519-1244; 12481, PHOSPHO2, 62459, 164909, 518-1243; 12481, PHOSPHO2, 62460, 164910, 319-1044; 12482, PCYT1A, 62462, 164912, 1-411; 12482, PCYT1A, 62463, 164913, 11-1153; 12482, PCYT1A, 62464, 164914, 74-346; 12482, PCYT1A, 62465, 164915, 87-724; 12482, PCYT1A, 62466, 164916, 205-549; 12482, PCYT1A, 62468, 164918, 87-491; 12482, PCYT1A, 62469, 164919, 206-1084; 12482, PCYT1A, 62470, 164920, 99-499; 12482, PCYT1A, 62471, 164921, 1-606; 12482, PCYT1A, 62461, 164911, 174-1277; 12482, PCYT1A, 62467, 164917, 242-1345; 12483, PCYT1B, 62475, 164925, 12-545; 12483, PCYT1B, 62472, 164922, 54-1046; 12483, PCYT1B, 62473, 164923, 132-1241; 12483, PCYT1B, 62474, 164924, 46-1101; 12484, PCYT2, 62480, 164930, 23-157; 12484, PCYT2, 62481, 164931, 534-778; 12484, PCYT2, 62482, 164932, 472-575; 12484, PCYT2, 62483, 164933, 64-1006; 12484, PCYT2, 62484, 164934, 59-1162; 12484, PCYT2, 62485, 164935, 56-913; 12484, PCYT2, 62486, 164936, 1-622; 12484, PCYT2, 62488, 164938, 283-442; 12484, PCYT2, 62476, 164926, 705-1640; 12484, PCYT2, 62477, 164927, 110-1279; 12484, PCYT2, 62478, 164928, 52-1275; 12484, PCYT2, 62479, 164929, 518-1453; 12484, PCYT2, 62487, 164937, 375-1448; 12485, PHEX, 62489, 164939, 566-2815; 12486, PCTP, 62492, 164942, 449-643; 12486, PCTP, 62493, 164943, 44-655; 12486, PCTP, 62494, 164944, 11-670; 12486, PCTP, 62495, 164945, 1-441; 12486, PCTP, 62490, 164940, 126-770; 12486, PCTP, 62491, 164941, 154-582; 12487, PEBP1, 62496, 164946, 353-916; 12488, PEMT, 62501, 164951, 54-689; 12488, PEMT, 62502, 164952, 58-297; 12488, PEMT, 62503, 164953, 75-368; 12488, PEMT, 62497, 164947, 75-785; 12488, PEMT, 62498, 164948, 83-781; 12488, PEMT, 62499, 164949, 68-667; 12488, PEMT, 62500, 164950, 181-780; 12489, PEBP4, 62505, 164955, 179-459; 12489, PEBP4, 62504, 164954, 93-776; 12490, PGS1, 62507, 164957, 1-792; 12490, PGS1, 62509, 164959, 16-1168; 12490, PGS1, 62510, 164960, 1-988; 12490, PGS1, 62511, 164961, 1-398; 12490, PGS1, 62512, 164962, 1-345; 12490, PGS1, 62513, 164963, 5-259; 12490, PGS1, 62515, 164965, 18-470; 12490, PGS1, 62506, 164956, 27-1697; 12490, PGS1, 62508, 164958, 18-170; 12490, PGS1, 62514, 164964, 10-1374; 12491, N/A, 62516, 164966, 561-2747; 12492, PIK3C3, 62518, 164968, 39-2513; 12492, PIK3C3, 62519, 164969, 1-533; 12492, PIK3C3, 62520, 164970, 37-642; 12492, PIK3C3, 62521, 164971, 1-403; 12492, PIK3C3, 62522, 164972, 63-377; 12492, PIK3C3, 62523, 164973, 1-551; 12492, PIK3C3, 62524, 164974, 41-352; 12492, PIK3C3, 62517, 164967, 87-2750; 12493, PI4K2A, 62525, 164975, 58-1497; 12494, PI4K2B, 62526, 164976, 190-1635; 12495, PI4KA, 62527, 164977, 88-6396; 12495, PI4KA, 62528, 164978, 1-1308; 12495, PI4KA, 62529, 164979, 314-574; 12496, PI4KB, 62533, 164983, 582-3068; 12496, PI4KB, 62534, 164984, 1-221; 12496, PI4KB, 62535, 164985, 309-1150; 12496, PI4KB, 62536, 164986, 1-684; 12496, PI4KB, 62537, 164987, 391-965; 12496, PI4KB, 62538, 164988, 273-558; 12496, PI4KB, 62539, 164989, 1-552; 12496, PI4KB, 62530, 164980, 553-2958; 12496, PI4KB, 62531, 164981, 170-2620; 12496, PI4KB, 62532, 164982, 474-2879; 12496, PI4KB, 62540, 164990, 430-1884; 12497, PICALM, 62543, 164993, 120-563; 12497, PICALM, 62544, 164994, 166-483; 12497, PICALM, 62545, 164995, 1-734; 12497, PICALM, 62546, 164996, 1-793; 12497, PICALM, 62547, 164997, 205-351; 12497, PICALM, 62548, 164998, 148-703; 12497, PICALM, 62551, 165001, 1-403; 12497, PICALM, 62552, 165002, 18-164; 12497, PICALM, 62553, 165003, 1-905; 12497, PICALM, 62554, 165004, 1-925; 12497, PICALM, 62555, 165005, 106-548; 12497, PICALM, 62556, 165006, 1-647; 12497, PICALM, 62558, 165008, 150-467; 12497, PICALM, 62541, 164991, 1-1899; 12497, PICALM, 62542, 164992, 150-2108; 12497, PICALM, 62549, 164999, 318-2255; 12497, PICALM, 62550, 165000, 187-1842; 12497, PICALM, 62557, 165007, 280-2112; 12498, PIGA, 62561, 165011, 1-153; 12498, PIGA, 62562, 165012, 404-854; 12498, PIGA, 62563, 165013, 116-572; 12498, PIGA, 62564, 165014, 117-473; 12498, PIGA, 62565, 165015, 1-300; 12498, PIGA, 62566, 165016, 66-1013; 12498, PIGA, 62567, 165017, 32-784; 12498, PIGA, 62559, 165009, 143-1597; 12498, PIGA, 62560, 165010, 121-1575; 12499, PIGB, 62569, 165019, 1-1668; 12499, PIGB, 62570, 165020, 1-267; 12499, PIGB, 62571, 165021, 292-696; 12499, PIGB, 62572, 165022, 20-196; 12499, PIGB, 62573, 165023, 7-773; 12499, PIGB, 62568, 165018, 292-1956; 12500, PIGC, 62574, 165024, 282-1175; 12500, PIGC, 62575, 165025, 1465-2358; 12501, PIGF, 62578, 165028, 1-174; 12501, PIGF, 62579, 165029, 108-446; 12501, PIGF, 62580, 165030, 473-619; 12501, PIGF, 62576, 165026, 172-831; 12501, PIGF, 62577, 165027, 104-724; 12502, PIGG, 62584, 165034, 873-2315; 12502, PIGG, 62585, 165035, 680-752; 12502, PIGG, 62586, 165036, 94-675; 12502, PIGG, 62587, 165037, 79-1470; 12502, PIGG, 62588, 165038, 176-2860; 12502, PIGG, 62590, 165040, 127-687; 12502, PIGG, 62581, 165031, 116-3043; 12502, PIGG, 62582, 165032, 79-2631; 12502, PIGG, 62583, 165033, 107-3058; 12502, PIGG, 62589, 165039, 600-1499; 12503, PIGH, 62592, 165042, 1-410; 12503, PIGH, 62593, 165043, 63-314; 12503, PIGH, 62594, 165044, 44-445; 12503, PIGH, 62595, 165045, 66-476; 12503, PIGH, 62596, 165046, 1-412; 12503, PIGH, 62597, 165047, 66-629; 12503, PIGH, 62598, 165048, 65-616; 12503, PIGH, 62599, 165049, 1-548; 12503, PIGH, 62600, 165050, 80-331; 12503, PIGH, 62591, 165041, 85-651; 12504, PIGK, 62601, 165051, 28-1026; 12504, PIGK, 62603, 165053, 29-934; 12504, PIGK, 62604, 165054, 1-84; 12504, PIGK, 62602, 165052, 25-1212; 12505, PIGL, 62606, 165056, 18-752; 12505, PIGL, 62607, 165057, 19-471; 12505, PIGL, 62608, 165058, 18-582; 12505, PIGL, 62609, 165059, 12-449; 12505, PIGL, 62610, 165060, 8-313; 12505, PIGL, 62611, 165061, 1-309; 12505, PIGL, 62612, 165062, 1-278; 12505, PIGL, 62605, 165055, 18-776; 12506, PIGM, 62613, 165063, 253-1524; 12507, PIGN, 62616, 165066, 139-558; 12507, PIGN, 62617, 165067, 1-431; 12507, PIGN, 62618, 165068, 280-559; 12507, PIGN, 62619, 165069, 332-597; 12507, PIGN, 62620, 165070, 216-565; 12507, PIGN, 62621, 165071, 575-674; 12507, PIGN, 62622, 165072, 211-576; 12507, PIGN, 62623, 165073, 286-538; 12507, PIGN, 62624, 165074, 1-89; 12507, PIGN, 62625, 165075, 1-335; 12507, PIGN, 62626, 165076, 36-584; 12507, PIGN, 62627, 165077, 1-312; 12507, PIGN, 62628, 165078, 58-635; 12507, PIGN, 62629, 165079, 300-549; 12507, PIGN, 62630, 165080, 246-811; 12507, PIGN, 62614, 165064, 417-3212; 12507, PIGN, 62615, 165065, 354-3149; 12508, PIGO, 62631, 165081, 166-2184; 12508, PIGO, 62632, 165082, 43-2061; 12508, PIGO, 62633, 165083, 396-3665; 12509, PIGP, 62638, 165088, 727-803; 12509, PIGP, 62639, 165089, 225-701; 12509, PIGP, 62634, 165084, 182-586; 12509, PIGP, 62635, 165085, 438-764; 12509, PIGP, 62636, 165086, 76-480; 12509, PIGP, 62637, 165087, 44-448; 12510, PIGQ, 62641, 165091, 159-603; 12510, PIGQ, 62644, 165094, 252-586; 12510, PIGQ, 62645, 165095, 1-715; 12510, PIGQ, 62646, 165096, 64-1788; 12510, PIGQ, 62647, 165097, 131-1321; 12510, PIGQ, 62648, 165098, 1-420; 12510, PIGQ, 62650, 165100, 1-310; 12510, PIGQ, 62640, 165090, 89-2371; 12510, PIGQ, 62642, 165092, 160-1905; 12510, PIGQ, 62643, 165093, 170-1915; 12510, PIGQ, 62649, 165099, 45-944; 12511, PIGS, 62651, 165101, 33-158; 12511, PIGS, 62654, 165104, 45-170; 12511, PIGS, 62655, 165105, 43-393; 12511, PIGS, 62652, 165102, 377-2044; 12511, PIGS, 62653, 165103, 339-1982; 12512, PIGT, 62659, 165109, 17-388; 12512, PIGT, 62660, 165110, 1-326; 12512, PIGT, 62662, 165112, 1-517; 12512, PIGT, 62656, 165106, 48-1478; 12512, PIGT, 62657, 165107, 81-1817; 12512, PIGT, 62658, 165108, 21-1556; 12512, PIGT, 62661, 165111, 14-1582; 12513, PIGU, 62665, 165115, 1-509; 12513, PIGU, 62663, 165113, 1-1308; 12513, PIGU, 62664, 165114, 1-1248; 12514, PIGV, 62668, 165118, 355-716; 12514, PIGV, 62669, 165119, 393-608; 12514, PIGV, 62670, 165120, 161-707; 12514, PIGV, 62671, 165121, 84-308; 12514, PIGV, 62666, 165116, 332-1813; 12514, PIGV, 62667, 165117, 683-2164; 12515, PIGW, 62673, 165123, 44-876; 12515, PIGW, 62677, 165127, 44-876; 12515, PIGW, 62672, 165122, 56-1570; 12515, PIGW, 62674, 165124, 56-1570; 12515, PIGW, 62675, 165125, 560-2074; 12515, PIGW, 62676, 165126, 560-2074; 12516, PIGX, 62678, 165128, 123-953; 12516, PIGX, 62680, 165130, 456-838; 12516, PIGX, 62681, 165131, 1-192; 12516, PIGX, 62682, 165132, 1-336; 12516, PIGX, 62683, 165133, 234-744; 12516, PIGX, 62684, 165134, 466-705; 12516, PIGX, 62685, 165135, 54-506; 12516, PIGX, 62679, 165129, 176-952; 12517, PIGY, 62686, 165136, 1-216; 12518, PIGZ, 62687, 165137, 186-464; 12518, PIGZ, 62688, 165138, 1-148; 12518, PIGZ, 62689, 165139, 148-1887; 12519, PITPNA, 62691, 165141, 232-1044; 12519, PITPNA, 62692, 165142, 325-573; 12519, PITPNA, 62693, 165143, 373-504; 12519, PITPNA, 62694, 165144, 368-793; 12519, PITPNA, 62695, 165145, 187-483; 12519, PITPNA, 62696, 165146, 246-591; 12519, PITPNA, 62697, 165147, 1-627; 12519, PITPNA, 62698, 165148, 209-571; 12519, PITPNA, 62699, 165149, 392-589; 12519, PITPNA, 62690, 165140, 257-1069; 12520, PITPNB, 62702, 165152, 88-590; 12520, PITPNB, 62703, 165153, 116-931; 12520, PITPNB, 62704, 165154, 524-884; 12520, PITPNB, 62700, 165150, 65-883; 12520, PITPNB, 62701, 165151, 78-893; 12520, PITPNB, 62705, 165155, 73-894; 12521, PITPNC1, 62706, 165156, 875-1675; 12521, PITPNC1, 62707, 165157, 697-1503; 12521, PITPNC1, 62709, 165159, 440-735; 12521, PITPNC1, 62710, 165160, 449-713; 12521, PITPNC1, 62708, 165158, 1-999; 12522, PITPNM1, 62713, 165163, 287-550; 12522, PITPNM1, 62714, 165164, 78-540; 12522, PITPNM1, 62715, 165165, 73-561; 12522, PITPNM1, 62716, 165166, 130-584; 12522, PITPNM1, 62711, 165161, 227-3961; 12522, PITPNM1, 62712, 165162, 220-3951; 12522, PITPNM1, 62717, 165167, 190-3924; 12523, PITPNM2, 62721, 165171, 440-564; 12523, PITPNM2, 62722, 165172, 618-663; 12523, PITPNM2, 62723, 165173, 280-1716; 12523, PITPNM2, 62718, 165168, 207-4238; 12523, PITPNM2, 62719, 165169, 140-4189; 12523, PITPNM2, 62720, 165170, 65-4114; 12524, PREX1, 62725, 165175, 1-2651; 12524, PREX1, 62726, 165176, 1-39; 12524, PREX1, 62724, 165174, 24-5003; 12525, PREX2, 62727, 165177, 278-5098; 12526, PIK3CA, 62729, 165179, 267-620; 12526, PIK3CA, 62730, 165180, 183-245; 12526, PIK3CA, 62728, 165178, 158-3364; 12527, PIK3CB, 62732, 165182, 522-690; 12527, PIK3CB, 62733, 165183, 1-2108; 12527, PIK3CB, 62735, 165185, 1-542; 12527, PIK3CB, 62736, 165186, 1-738; 12527, PIK3CB, 62737, 165187, 1-105; 12527, PIK3CB, 62738, 165188, 328-721; 12527, PIK3CB, 62739, 165189, 240-644; 12527, PIK3CB, 62740, 165190, 366-667; 12527, PIK3CB, 62741, 165191, 249-1814; 12527, PIK3CB, 62731, 165181, 17-3229; 12527, PIK3CB, 62734, 165184, 75-3287; 12528, PIK3CD, 62742, 165192, 116-3322; 12528, PIK3CD, 62744, 165194, 116-3322; 12528, PIK3CD, 62745, 165195, 209-3415; 12528, PIK3CD, 62746, 165196, 209-3415; 12528, PIK3CD, 62743, 165193, 196-3330; 12529, PIK3CG, 62749, 165199, 275-821; 12529, PIK3CG, 62747, 165197, 311-3619; 12529, PIK3CG, 62748, 165198, 86-3394; 12529, PIK3CG, 62750, 165200, 144-3452; 12530, PIK3C2A, 62752, 165202, 166-1617; 12530, PIK3C2A, 62753, 165203, 195-584; 12530, PIK3C2A, 62751, 165201, 1-5061; 12531, PIK3C2B, 62754, 165204, 310-830; 12531, PIK3C2B, 62756, 165206, 480-5300; 12531, PIK3C2B, 62757, 165207, 454-846; 12531, PIK3C2B, 62758, 165208, 547-727; 12531, PIK3C2B, 62755, 165205, 558-5462; 12532, PIK3C2G, 62761, 165211, 39-734; 12532, PIK3C2G, 62762, 165212, 548-2299; 12532, PIK3C2G, 62763, 165213, 117-4577; 12532, PIK3C2G, 62764, 165214, 1-563; 12532, PIK3C2G, 62759, 165209, 39-4376; 12532, PIK3C2G, 62760, 165210, 117-4454; 12533, PIP5K1A, 62768, 165218, 446-2098; 12533, PIP5K1A, 62769, 165219, 444-567; 12533, PIP5K1A, 62770, 165220, 70-373; 12533, PIP5K1A, 62771, 165221, 94-353; 12533, PIP5K1A, 62773, 165223, 273-392; 12533, PIP5K1A, 62765, 165215, 447-2096; 12533, PIP5K1A, 62766, 165216, 423-2111; 12533, PIP5K1A, 62767, 165217, 445-1947; 12533, PIP5K1A, 62772, 165222, 445-2013; 12534, PIP5K1B, 62775, 165225, 302-612; 12534, PIP5K1B, 62776, 165226, 305-791; 12534, PIP5K1B, 62777, 165227, 343-813; 12534, PIP5K1B, 62774, 165224, 306-1928; 12534, PIP5K1B, 62778, 165228, 343-1992; 12534, PIP5K1B, 62779, 165229, 435-1943; 12535, PIP5K1C, 62780, 165230, 90-2096; 12535, PIP5K1C, 62781, 165231, 1-2103; 12535, PIP5K1C, 62782, 165232, 76-1998; 12535, PIP5K1C, 62783, 165233, 1-2124; 12536, PIP5KL1, 62784, 165234, 211-786; 12536, PIP5KL1, 62785, 165235, 46-1230; 12537, PIP4K2A, 62786, 165236, 56-856; 12537, PIP4K2A, 62789, 165239, 18-443; 12537, PIP4K2A, 62787, 165237, 230-1450; 12537, PIP4K2A, 62788, 165238, 207-1250; 12538, PIP4K2B, 62790, 165240, 334-547; 12538, PIP4K2B, 62793, 165243, 334-547; 12538, PIP4K2B, 62791, 165241, 482-1732; 12538, PIP4K2B, 62792, 165242, 482-1732; 12539, PIP4K2C, 62798, 165248, 25-540; 12539, PIP4K2C, 62799, 165249, 45-197; 12539, PIP4K2C, 62800, 165250, 1-403; 12539, PIP4K2C, 62801, 165251, 69-548; 12539, PIP4K2C, 62794, 165244, 17-1282; 12539, PIP4K2C, 62795, 165245, 117-1238; 12539, PIP4K2C, 62796, 165246, 88-1353; 12539, PIP4K2C, 62797, 165247, 48-1259; 12540, PLCXD1, 62805, 165255, 64-587; 12540, PLCXD1, 62806, 165256, 46-579; 12540, PLCXD1, 62807, 165257, 288-469; 12540, PLCXD1, 62808, 165258, 64-587; 12540, PLCXD1, 62809, 165259, 61-284; 12540, PLCXD1, 62810, 165260, 292-555; 12540, PLCXD1, 62811, 165261, 455-828; 12540, PLCXD1, 62802, 165252, 515-1486; 12540, PLCXD1, 62803, 165253, 245-1216; 12540, PLCXD1, 62804, 165254, 298-1269; 12541, PLCXD2, 62813, 165263, 311-529; 12541, PLCXD2, 62812, 165262, 571-1485; 12541, PLCXD2, 62814, 165264, 325-1242; 12542, PLCXD3, 62815, 165265, 103-1068; 12542, PLCXD3, 62816, 165266, 76-1041; 12543, PISD, 62819, 165269, 230-1018; 12543, PISD, 62821, 165271, 391-609; 12543, PISD, 62822, 165272, 14-184; 12543, PISD, 62823, 165273, 480-722; 12543, PISD, 62824, 165274, 242-460; 12543, PISD, 62825, 165275, 332-1015; 12543, PISD, 62826, 165276, 1-1088; 12543, PISD, 62817, 165267, 431-1558; 12543, PISD, 62818, 165268, 421-1548; 12543, PISD, 62820, 165270, 225-1454; 12544, PTDSS1, 62827, 165277, 129-

455; 12544, PTDSS1, 62828, 165278, 327-1748; 12544, PTDSS1, 62829, 165279, 75-980; 12545, PTDSS2, 62831, 165281, 6-188; 12545, PTDSS2, 62832, 165282, 161-406; 12545, PTDSS2, 62833, 165283, 1-1180; 12545, PTDSS2, 62830, 165280, 177-1640; 12546, PDE10A, 62836, 165286, 1217-1768; 12546, PDE10A, 62834, 165284, 156-2495; 12546, PDE10A, 62835, 165285, 57-2426; 12547, PDE11A, 62841, 165291, 362-472; 12547, PDE11A, 62842, 165292, 1-409; 12547, PDE11A, 62843, 165293, 1-1310; 12547, PDE11A, 62837, 165287, 319-3120; 12547, PDE11A, 62838, 165288, 100-2151; 12547, PDE11A, 62839, 165289, 151-1620; 12547, PDE11A, 62840, 165290, 92-1819; 12548, PDE12, 62845, 165295, 105-1523; 12548, PDE12, 62844, 165294, 104-1933; 12549, PDE1A, 62846, 165296, 419-1978; 12549, PDE1A, 62847, 165297, 150-1655; 12549, PDE1A, 62848, 165298, 402-1991; 12549, PDE1A, 62849, 165299, 85-1692; 12549, PDE1A, 62850, 165300, 202-1839; 12550, PDE1B, 62852, 165302, 137-1624; 12550, PDE1B, 62853, 165303, 119-694; 12550, PDE1B, 62855, 165305, 183-335; 12550, PDE1B, 62851, 165301, 437-2047; 12550, PDE1B, 62854, 165304, 129-1679; 12551, PDE1C, 62859, 165309, 466-605; 12551, PDE1C, 62861, 165311, 595-2904; 12551, PDE1C, 62856, 165306, 461-2590; 12551, PDE1C, 62857, 165307, 470-2374; 12551, PDE1C, 62858, 165308, 206-2110; 12551, PDE1C, 62860, 165310, 457-2586; 12552, PDE2A, 62864, 165314, 435-1027; 12552, PDE2A, 62865, 165315, 1-982; 12552, PDE2A, 62866, 165316, 202-2682; 12552, PDE2A, 62868, 165318, 85-363; 12552, PDE2A, 62869, 165319, 244-363; 12552, PDE2A, 62870, 165320, 36-356; 12552, PDE2A, 62871, 165321, 51-248; 12552, PDE2A, 62872, 165322, 1-1009; 12552, PDE2A, 62873, 165323, 216-332; 12552, PDE2A, 62874, 165324, 120-553; 12552, PDE2A, 62875, 165325, 106-639; 12552, PDE2A, 62876, 165326, 1-515; 12552, PDE2A, 62878, 165328, 47-244; 12552, PDE2A, 62879, 165329, 352-611; 12552, PDE2A, 62880, 165330, 1-226; 12552, PDE2A, 62881, 165331, 68-265; 12552, PDE2A, 62882, 165332, 67-344; 12552, PDE2A, 62862, 165312, 247-3072; 12552, PDE2A, 62863, 165313, 56-2113; 12552, PDE2A, 62867, 165317, 189-2951; 12552, PDE2A, 62877, 165327, 85-2889; 12552, PDE2A, 62883, 165333, 141-2939; 12553, PDE3A, 62884, 165334, 41-3466; 12554, PDE3B, 62885, 165335, 354-3692; 12554, PDE3B, 62886, 165336, 246-3431; 12555, PDE4A, 62891, 165341, 308-598; 12555, PDE4A, 62892, 165342, 1-836; 12555, PDE4A, 62887, 165337, 1-2583; 12555, PDE4A, 62888, 165338, 326-2269; 12555, PDE4A, 62889, 165339, 111-2771; 12555, PDE4A, 62890, 165340, 1-2478; 12555, PDE4A, 62893, 165343, 85-2679; 12556, PDE4B, 62898, 165348, 139-579; 12556, PDE4B, 62899, 165349, 136-546; 12556, PDE4B, 62900, 165350, 1-199; 12556, PDE4B, 62902, 165352, 95-550; 12556, PDE4B, 62903, 165353, 132-561; 12556, PDE4B, 62894, 165344, 188-2398; 12556, PDE4B, 62895, 165345, 139-2349; 12556, PDE4B, 62896, 165346, 387-2081; 12556, PDE4B, 62897, 165347, 486-2651; 12556, PDE4B, 62901, 165351, 466-1977; 12557, PDE4C, 62907, 165357, 156-1601; 12557, PDE4C, 62910, 165360, 249-528; 12557, PDE4C, 62911, 165361, 11-706; 12557, PDE4C, 62912, 165362, 1-35; 12557, PDE4C, 62913, 165363, 1-1284; 12557, PDE4C, 62914, 165364, 1-269; 12557, PDE4C, 62915, 165365, 111-1559; 12557, PDE4C, 62916, 165366, 338-583; 12557, PDE4C, 62904, 165354, 61-2103; 12557, PDE4C, 62905, 165355, 873-3011; 12557, PDE4C, 62906, 165356, 336-2156; 12557, PDE4C, 62908, 165358, 240-2378; 12557, PDE4C, 62909, 165359, 481-2619; 12558, PDE4DIP, 62917, 165367, 658-4056; 12558, PDE4DIP, 62919, 165369, 146-3055; 12558, PDE4DIP, 62920, 165370, 110-3076; 12558, PDE4DIP, 62921, 165371, 191-7231; 12558, PDE4DIP, 62922, 165372, 292-7380; 12558, PDE4DIP, 62923, 165373, 1-287; 12558, PDE4DIP, 62924, 165374, 56-211; 12558, PDE4DIP, 62925, 165375, 1-927; 12558, PDE4DIP, 62926, 165376, 441-3791; 12558, PDE4DIP, 62927, 165377, 195-341; 12558, PDE4DIP, 62928, 165378, 89-647; 12558, PDE4DIP, 62929, 165379, 1-262; 12558, PDE4DIP, 62930, 165380, 222-2444; 12558, PDE4DIP, 62931, 165381, 342-578; 12558, PDE4DIP, 62932, 165382, 21-7469; 12558, PDE4DIP, 62933, 165383, 394-7116; 12558, PDE4DIP, 62934, 165384, 28-687; 12558, PDE4DIP, 62935, 165385, 140-569; 12558, PDE4DIP, 62936, 165386, 178-426; 12558, PDE4DIP, 62937, 165387, 184-528; 12558, PDE4DIP, 62938, 165388, 40-7335; 12558, PDE4DIP, 62939, 165389, 89-619; 12558, PDE4DIP, 62941, 165391, 163-636; 12558, PDE4DIP, 62942, 165392, 1-199; 12558, PDE4DIP, 62943, 165393, 171-582; 12558, PDE4DIP, 62918, 165368, 179-700; 12558, PDE4DIP, 62940, 165390, 325-1257; 12559, PDE4D, 62950, 165400, 164-1430; 12559, PDE4D, 62951, 165401, 271-494; 12559, PDE4D, 62953, 165403, 252-305; 12559, PDE4D, 62954, 165404, 335-424; 12559, PDE4D, 62957, 165407, 335-577; 12559, PDE4D, 62959, 165409, 35-2071; 12559, PDE4D, 62944, 165394, 1-648; 12559, PDE4D, 62945, 165395, 397-1953; 12559, PDE4D, 62946, 165396, 177-2606; 12559, PDE4D, 62947, 165397, 554-2077; 12559, PDE4D, 62948, 165398, 125-2146; 12559, PDE4D, 62949, 165399, 130-2193; 12559, PDE4D, 62952, 165402, 225-2471; 12559, PDE4D, 62955, 165405, 137-2374; 12559, PDE4D, 62956, 165406, 718-2757; 12559, PDE4D, 62958, 165408, 128-787; 12560, PDE5A, 62962, 165412, 95-2566; 12560, PDE5A, 62963, 165413, 76-747; 12560, PDE5A, 62964, 165414, 1-557; 12560, PDE5A, 62960, 165410, 459-2960; 12560, PDE5A, 62961, 165411, 321-2948; 12561, PDE6A, 62966, 165416, 121-2460; 12561, PDE6A, 62967, 165417, 121-2460; 12561, PDE6A, 62965, 165415, 121-2703; 12562, PDE6B, 62970, 165420, 1-449; 12562, PDE6B, 62971, 165421, 1-435; 12562, PDE6B, 62972, 165422, 231-522; 12562, PDE6B, 62973, 165423, 326-450; 12562, PDE6B, 62974, 165424, 541-560; 12562, PDE6B, 62968, 165418, 44-2605; 12562, PDE6B, 62969, 165419, 267-1994; 12562, PDE6B, 62975, 165425, 22-2586; 12563, PDE6C, 62976, 165426, 139-2715; 12564, PDE6D, 62978, 165428, 178-459; 12564, PDE6D, 62979, 165429, 314-627; 12564, PDE6D, 62977, 165427, 196-648; 12565, PDE6G, 62982, 165432, 477-890; 12565, PDE6G, 62983, 165433, 1-213; 12565, PDE6G, 62980, 165430, 151-414; 12565, PDE6G, 62981, 165431, 114-377; 12565, PDE6G, 62984, 165434, 84-347; 12566, PDE6H, 62985, 165435, 107-358; 12567, PDE7A, 62989, 165439, 316-572; 12567, PDE7A, 62986, 165436, 144-1514; 12567, PDE7A, 62987, 165437, 1-1275; 12567, PDE7A, 62988, 165438, 445-1893; 12568, PDE7B, 62991, 165441, 1-601; 12568, PDE7B, 62992, 165442, 1-1509; 12568, PDE7B, 62990, 165440, 304-1656; 12569, PDE8A, 62996, 165446, 183-1001; 12569, PDE8A, 62998, 165448, 183-878; 12569, PDE8A, 63000, 165450, 1-381; 12569, PDE8A, 62993, 165443, 253-2742; 12569, PDE8A, 62994, 165444, 183-2534; 12569, PDE8A, 62995, 165445, 190-2679; 12569, PDE8A, 62997, 165447, 183-869; 12569, PDE8A, 62999, 165449, 204-2477; 12570, PDE8B, 63006, 165456, 218-574; 12570, PDE8B, 63008, 165458, 387-736; 12570, PDE8B, 63009, 165459, 200-535; 12570, PDE8B, 63001, 165451, 46-2703; 12570, PDE8B, 63002, 165452, 46-2412; 12570, PDE8B, 63003, 165453, 1-2493; 12570, PDE8B, 63004, 165454, 46-2562; 12570, PDE8B, 63005, 165455, 1-2598; 12570, PDE8B, 63007, 165457, 781-1833;

12571, PDE9A, 63010, 165460, 61-1842; 12571, PDE9A, 63011, 165461, 37-1740; 12571, PDE9A, 63012, 165462, 66-1667; 12571, PDE9A, 63013, 165463, 37-1512; 12571, PDE9A, 63014, 165464, 3-1400; 12571, PDE9A, 63015, 165465, 37-1659; 12571, PDE9A, 63016, 165466, 55-1455; 12571, PDE9A, 63017, 165467, 89-1747; 12571, PDE9A, 63018, 165468, 89-1390; 12571, PDE9A, 63019, 165469, 89-1468; 12571, PDE9A, 63020, 165470, 89-1669; 12571, PDE9A, 63021, 165471, 89-1567; 12571, PDE9A, 63022, 165472, 37-1560; 12572, PCK1, 63023, 165473, 165-2033; 12573, PCK2, 63025, 165475, 248-1573; 12573, PCK2, 63026, 165476, 919-2439; 12573, PCK2, 63027, 165477, 50-238; 12573, PCK2, 63028, 165478, 17-1546; 12573, PCK2, 63029, 165479, 1-367; 12573, PCK2, 63030, 165480, 843-2267; 12573, PCK2, 63031, 165481, 435-756; 12573, PCK2, 63032, 165482, 1-328; 12573, PCK2, 63033, 165483, 559-897; 12573, PCK2, 63034, 165484, 332-1852; 12573, PCK2, 63035, 165485, 126-254; 12573, PCK2, 63024, 165474, 269-2191; 12574, PFKL, 63037, 165487, 56-184; 12574, PFKL, 63038, 165488, 1-129; 12574, PFKL, 63036, 165486, 56-2398; 12575, PFKM, 63042, 165492, 56-585; 12575, PFKM, 63043, 165493, 1-125; 12575, PFKM, 63044, 165494, 89-571; 12575, PFKM, 63045, 165495, 137-594; 12575, PFKM, 63046, 165496, 199-452; 12575, PFKM, 63047, 165497, 65-244; 12575, PFKM, 63048, 165498, 42-572; 12575, PFKM, 63049, 165499, 125-571; 12575, PFKM, 63050, 165500, 158-582; 12575, PFKM, 63052, 165502, 108-526; 12575, PFKM, 63053, 165503, 64-372; 12575, PFKM, 63054, 165504, 152-373; 12575, PFKM, 63055, 165505, 178-626; 12575, PFKM, 63056, 165506, 25-492; 12575, PFKM, 63058, 165508, 76-570; 12575, PFKM, 63059, 165509, 245-594; 12575, PFKM, 63060, 165510, 1-289; 12575, PFKM, 63061, 165511, 215-590; 12575, PFKM, 63062, 165512, 290-762; 12575, PFKM, 63063, 165513, 73-381; 12575, PFKM, 63039, 165489, 40-2382; 12575, PFKM, 63040, 165490, 225-2780; 12575, PFKM, 63041, 165491, 190-2532; 12575, PFKM, 63051, 165501, 152-2401; 12575, PFKM, 63057, 165507, 129-2471; 12576, PFKP, 63064, 165514, 876-1484; 12576, PFKP, 63067, 165517, 74-705; 12576, PFKP, 63068, 165518, 1-496; 12576, PFKP, 63069, 165519, 420-1140; 12576, PFKP, 63070, 165520, 1-311; 12576, PFKP, 63071, 165521, 71-425; 12576, PFKP, 63072, 165522, 93-432; 12576, PFKP, 63065, 165515, 225-2555; 12576, PFKP, 63066, 165516, 77-2431; 12577, PACS1, 63074, 165524, 1-322; 12577, PACS1, 63075, 165525, 51-548; 12577, PACS1, 63076, 165526, 187-1686; 12577, PACS1, 63077, 165527, 315-590; 12577, PACS1, 63078, 165528, 388-617; 12577, PACS1, 63079, 165529, 1-270; 12577, PACS1, 63080, 165530, 610-846; 12577, PACS1, 63081, 165531, 259-578; 12577, PACS1, 63082, 165532, 1-356; 12577, PACS1, 63073, 165523, 34-2925; 12578, PACS2, 63086, 165536, 317-576; 12578, PACS2, 63087, 165537, 33-2612; 12578, PACS2, 63083, 165533, 505-3174; 12578, PACS2, 63084, 165534, 500-2944; 12578, PACS2, 63085, 165535, 176-2890; 12579, PGM1, 63088, 165538, 369-2111; 12579, PGM1, 63089, 165539, 214-1902; 12579, PGM1, 63090, 165540, 682-1779; 12580, PGM2, 63092, 165542, 1-180; 12580, PGM2, 63093, 165543, 15-602; 12580, PGM2, 63094, 165544, 13-273; 12580, PGM2, 63095, 165545, 26-613; 12580, PGM2, 63096, 165546, 74-661; 12580, PGM2, 63091, 165541, 101-1939; 12581, PGM2L1, 63097, 165547, 313-2181; 12582, PGM3, 63098, 165548, 128-1513; 12582, PGM3, 63099, 165549, 1-341; 12582, PGM3, 63101, 165551, 217-558; 12582, PGM3, 63102, 165552, 1-594; 12582, PGM3, 63103, 165553, 80-295; 12582, PGM3, 63104, 165554, 171-640; 12582, PGM3, 63106, 165556, 117-556; 12582, PGM3, 63108, 165558, 233-750; 12582, PGM3, 63109, 165559, 1-36; 12582, PGM3, 63110, 165560, 155-1480; 12582, PGM3, 63100, 165550, 56-1756; 12582, PGM3, 63105, 165555, 118-1746; 12582, PGM3, 63107, 165557, 148-1860; 12583, PGM5, 63113, 165563, 1-616; 12583, PGM5, 63111, 165561, 230-1393; 12583, PGM5, 63112, 165562, 230-1933; 12584, PGD, 63115, 165565, 46-237; 12584, PGD, 63116, 165566, 7-680; 12584, PGD, 63117, 165567, 192-806; 12584, PGD, 63118, 165568, 163-642; 12584, PGD, 63119, 165569, 1-767; 12584, PGD, 63114, 165564, 39-1490; 12585, PHGDH, 63120, 165570, 1508-3007; 12585, PHGDH, 63121, 165571, 137-1738; 12586, PGK1, 63122, 165572, 168-1421; 12587, PGK2, 63123, 165573, 121-1374; 12588, PGAM1, 63124, 165574, 149-913; 12589, PGAM2, 63125, 165575, 59-820; 12590, PGAM4, 63126, 165576, 1-765; 12591, PGP, 63128, 165578, 1-172; 12591, PGP, 63127, 165577, 31-996; 12592, PHPT1, 63129, 165579, 338-715; 12592, PHPT1, 63130, 165580, 378-752; 12593, PIKFYVE, 63135, 165585, 63-4214; 12593, PIKFYVE, 63136, 165586, 159-635; 12593, PIKFYVE, 63137, 165587, 69-792; 12593, PIKFYVE, 63131, 165581, 159-6455; 12593, PIKFYVE, 63132, 165582, 148-1536; 12593, PIKFYVE, 63133, 165583, 159-1514; 12593, PIKFYVE, 63134, 165584, 148-1794; 12594, PIK3AP1, 63138, 165588, 121-2538; 12594, PIK3AP1, 63139, 165589, 183-1397; 12594, PIK3AP1, 63140, 165590, 186-2069; 12595, PIK3IP1, 63143, 165593, 145-578; 12595, PIK3IP1, 63141, 165591, 185-976; 12595, PIK3IP1, 63142, 165592, 136-840; 12595, PIK3IP1, 63144, 165594, 191-712; 12596, PIK3R1, 63148, 165598, 1-395; 12596, PIK3R1, 63149, 165599, 1-567; 12596, PIK3R1, 63151, 165601, 398-705; 12596, PIK3R1, 63153, 165603, 201-552; 12596, PIK3R1, 63154, 165604, 48-164; 12596, PIK3R1, 63155, 165605, 128-540; 12596, PIK3R1, 63145, 165595, 369-1643; 12596, PIK3R1, 63146, 165596, 93-1457; 12596, PIK3R1, 63147, 165597, 617-2791; 12596, PIK3R1, 63150, 165600, 565-2739; 12596, PIK3R1, 63152, 165602, 233-1318; 12597, PIK3R2, 63157, 165607, 259-1704; 12597, PIK3R2, 63158, 165608, 1-373; 12597, PIK3R2, 63160, 165610, 1-1446; 12597, PIK3R2, 63156, 165606, 601-2787; 12597, PIK3R2, 63159, 165609, 1-2187; 12598, PIK3R3, 63165, 165615, 135-753; 12598, PIK3R3, 63161, 165611, 691-2076; 12598, PIK3R3, 63162, 165612, 101-1486; 12598, PIK3R3, 63163, 165613, 665-1873; 12598, PIK3R3, 63164, 165614, 258-1643; 12599, N/A, 63166, 165616, 18-1541; 12600, PIK3R4, 63168, 165618, 200-579; 12600, PIK3R4, 63169, 165619, 177-563; 12600, PIK3R4, 63170, 165620, 239-817; 12600, PIK3R4, 63167, 165617, 559-4635; 12601, PIK3R5, 63171, 165621, 122-757; 12601, PIK3R5, 63173, 165623, 495-628; 12601, PIK3R5, 63175, 165625, 14-2653; 12601, PIK3R5, 63176, 165626, 1-282; 12601, PIK3R5, 63172, 165622, 131-2773; 12601, PIK3R5, 63174, 165624, 68-2710; 12601, PIK3R5, 63177, 165627, 1135-2619; 12601, PIK3R5, 63178, 165628, 1173-2657; 12601, PIK3R5, 63179, 165629, 1114-2598; 12602, PIK3R6, 63181, 165631, 224-526; 12602, PIK3R6, 63183, 165633, 241-543; 12602, PIK3R6, 63180, 165630, 241-2505; 12602, PIK3R6, 63182, 165632, 1-2265; 12603, PIRT, 63184, 165634, 640-1053; 12604, PLN, 63185, 165635, 193-351; 12605, PLA1A, 63187, 165637, 1-675; 12605, PLA1A, 63189, 165639, 110-1432; 12605, PLA1A, 63186, 165636, 73-1443; 12605, PLA1A, 63188, 165638, 30-1352; 12605, PLA1A, 63190, 165640, 357-1208; 12606, PINLYP, 63191, 165641, 253-603; 12606, PINLYP, 63192, 165642, 110-460; 12606, PINLYP, 63193, 165643, 122-472; 12606, PINLYP, 63194, 165644, 1-615;

12606, PINLYP, 63195, 165645, 126-812; 12607, PLA2R1, 63196, 165646, 208-4599; 12607, PLA2R1, 63197, 165647, 208-4182; 12608, PLA2G1B, 63199, 165649, 27-239; 12608, PLA2G1B, 63200, 165650, 127-486; 12608, PLA2G1B, 63198, 165648, 37-483; 12609, PLA2G2A, 63201, 165651, 273-707; 12609, PLA2G2A, 63202, 165652, 271-705; 12610, PLA2G2C, 63203, 165653, 1-453; 12610, PLA2G2C, 63204, 165654, 62-511; 12611, PLA2G2D, 63206, 165656, 69-257; 12611, PLA2G2D, 63205, 165655, 60-497; 12612, PLA2G2E, 63207, 165657, 59-487; 12613, PLA2G2F, 63208, 165658, 103-738; 12614, PLA2G3, 63209, 165659, 254-1783; 12615, PLA2G4A, 63210, 165660, 153-2402; 12616, PLA2G4B, 63212, 165662, 1-92; 12616, PLA2G4B, 63211, 165661, 353-2698; 12617, PLA2G4C, 63214, 165664, 49-180; 12617, PLA2G4C, 63216, 165666, 1-391; 12617, PLA2G4C, 63217, 165667, 1-641; 12617, PLA2G4C, 63218, 165668, 398-516; 12617, PLA2G4C, 63219, 165669, 47-157; 12617, PLA2G4C, 63220, 165670, 153-293; 12617, PLA2G4C, 63222, 165672, 1-581; 12617, PLA2G4C, 63223, 165673, 1-104; 12617, PLA2G4C, 63213, 165663, 329-1912; 12617, PLA2G4C, 63215, 165665, 359-1984; 12617, PLA2G4C, 63221, 165671, 303-1958; 12618, PLA2G4D, 63224, 165674, 96-2552; 12619, PLA2G4E, 63225, 165675, 488-3094; 12620, PLA2G4F, 63226, 165676, 63-245; 12620, PLA2G4F, 63228, 165678, 70-960; 12620, PLA2G4F, 63229, 165679, 1-261; 12620, PLA2G4F, 63230, 165680, 88-300; 12620, PLA2G4F, 63231, 165681, 61-420; 12620, PLA2G4F, 63227, 165677, 88-2637; 12621, PLA2G5, 63232, 165682, 269-685; 12622, PLA2G6, 63236, 165686, 1-374; 12622, PLA2G6, 63237, 165687, 67-366; 12622, PLA2G6, 63238, 165688, 126-364; 12622, PLA2G6, 63239, 165689, 159-656; 12622, PLA2G6, 63240, 165690, 93-548; 12622, PLA2G6, 63241, 165691, 114-413; 12622, PLA2G6, 63242, 165692, 2-682; 12622, PLA2G6, 63243, 165693, 1-688; 12622, PLA2G6, 63244, 165694, 1-473; 12622, PLA2G6, 63245, 165695, 1-591; 12622, PLA2G6, 63246, 165696, 1-505; 12622, PLA2G6, 63247, 165697, 211-510; 12622, PLA2G6, 63248, 165698, 316-675; 12622, PLA2G6, 63249, 165699, 444-595; 12622, PLA2G6, 63233, 165683, 185-2605; 12622, PLA2G6, 63234, 165684, 137-2395; 12622, PLA2G6, 63235, 165685, 92-2350; 12623, PLA2G7, 63250, 165700, 198-1523; 12623, PLA2G7, 63251, 165701, 179-1504; 12624, PLA2G10, 63253, 165703, 48-440; 12624, PLA2G10, 63255, 165705, 48-440; 12624, PLA2G10, 63252, 165702, 441-938; 12624, PLA2G10, 63254, 165704, 441-938; 12625, PLA2G12A, 63257, 165707, 148-360; 12625, PLA2G12A, 63258, 165708, 166-729; 12625, PLA2G12A, 63256, 165706, 269-838; 12626, PLA2G12B, 63259, 165709, 94-681; 12627, PLA2G15, 63261, 165711, 55-693; 12627, PLA2G15, 63263, 165713, 87-577; 12627, PLA2G15, 63264, 165714, 36-929; 12627, PLA2G15, 63265, 165715, 55-781; 12627, PLA2G15, 63266, 165716, 55-765; 12627, PLA2G15, 63267, 165717, 57-317; 12627, PLA2G15, 63260, 165710, 84-1322; 12627, PLA2G15, 63262, 165712, 124-1080; 12628, PLA2G16, 63270, 165720, 161-243; 12628, PLA2G16, 63268, 165718, 356-844; 12628, PLA2G16, 63269, 165719, 140-628; 12629, PLAA, 63272, 165722, 1-730; 12629, PLM, 63273, 165723, 189-2018; 12629, PLAA, 63274, 165724, 1-868; 12629, PLAA, 63275, 165725, 1-409; 12629, PLAA, 63271, 165721, 419-2806; 12630, PLBD1, 63277, 165727, 120-553; 12630, PLBD1, 63278, 165728, 33-155; 12630, PLBD1, 63276, 165726, 654-2315; 12631, PLBD2, 63281, 165731, 1-159; 12631, PLBD2, 63279, 165729, 32-1801; 12631, PLBD2, 63280, 165730, 36-1709; 12632, PLB1, 63283, 165733, 1-4340; 12632, PLB1, 63284, 165734, 1-834; 12632, PLB1, 63285, 165735, 1-1533; 12632, PLB1, 63286, 165736, 1-484; 12632, PLB1, 63287, 165737, 1-187; 12632, PLB1, 63288, 165738, 167-716; 12632, PLB1, 63282, 165732, 45-4421; 12632, PLB1, 63289, 165739, 45-4388; 12633, PLCB1, 63293, 165743, 127-744; 12633, PLCB1, 63294, 165744, 1-126; 12633, PLCB1, 63295, 165745, 1-591; 12633, PLCB1, 63296, 165746, 1-2744; 12633, PLCB1, 63297, 165747, 1-3411; 12633, PLCB1, 63298, 165748, 1-3282; 12633, PLCB1, 63299, 165749, 326-3206; 12633, PLCB1, 63300, 165750, 1-80; 12633, PLCB1, 63301, 165751, 383-1129; 12633, PLCB1, 63302, 165752, 350-759; 12633, PLCB1, 63303, 165753, 114-2996; 12633, PLCB1, 63304, 165754, 1-695; 12633, PLCB1, 63290, 165740, 388-4038; 12633, PLCB1, 63291, 165741, 4-3525; 12633, PLCB1, 63292, 165742, 515-4036; 12634, PLCB2, 63307, 165757, 239-838; 12634, PLCB2, 63308, 165758, 1-262; 12634, PLCB2, 63310, 165760, 1-225; 12634, PLCB2, 63305, 165755, 251-3808; 12634, PLCB2, 63306, 165756, 154-3666; 12634, PLCB2, 63309, 165759, 166-3711; 12635, PLCB3, 63311, 165761, 128-3832; 12635, PLCB3, 63312, 165762, 76-3579; 12635, PLCB3, 63313, 165763, 104-3808; 12636, PLCB4, 63318, 165768, 276-614; 12636, PLCB4, 63320, 165770, 241-484; 12636, PLCB4, 63321, 165771, 417-595; 12636, PLCB4, 63322, 165772, 176-505; 12636, PLCB4, 63314, 165764, 79-3606; 12636, PLCB4, 63315, 165765, 232-3795; 12636, PLCB4, 63316, 165766, 16-3543; 12636, PLCB4, 63317, 165767, 16-3600; 12636, PLCB4, 63319, 165769, 16-3579; 12637, PLCD1, 63323, 165773, 224-2494; 12637, PLCD1, 63324, 165774, 355-2688; 12638, PLCD3, 63325, 165775, 166-546; 12638, PLCD3, 63326, 165776, 1-335; 12638, PLCD3, 63327, 165777, 11-595; 12638, PLCD3, 63328, 165778, 89-2458; 12639, PLCD4, 63330, 165780, 261-556; 12639, PLCD4, 63331, 165781, 243-2627; 12639, PLCD4, 63333, 165783, 1-370; 12639, PLCD4, 63334, 165784, 1-334; 12639, PLCD4, 63335, 165785, 206-415; 12639, PLCD4, 63336, 165786, 206-415; 12639, PLCD4, 63329, 165779, 340-2628; 12639, PLCD4, 63332, 165782, 186-2474; 12640, PLCE1, 63337, 165787, 635-7543; 12640, PLCE1, 63338, 165788, 1-5985; 12640, PLCE1, 63339, 165789, 236-7144; 12640, PLCE1, 63340, 165790, 70-6054; 12641, PLCH1, 63341, 165791, 75-5042; 12641, PLCH1, 63342, 165792, 1-5082; 12641, PLCH1, 63343, 165793, 1-3009; 12641, PLCH1, 63344, 165794, 359-5326; 12641, PLCH1, 63345, 165795, 378-3422; 12642, PLCH2, 63346, 165796, 1-3718; 12642, PLCH2, 63350, 165800, 236-568; 12642, PLCH2, 63347, 165797, 275-4525; 12642, PLCH2, 63348, 165798, 275-4525; 12642, PLCH2, 63349, 165799, 162-3551; 12642, PLCH2, 63351, 165801, 275-4525; 12642, PLCH2, 63352, 165802, 275-4525; 12642, PLCH2, 63353, 165803, 162-3551; 12643, PLCG1, 63356, 165806, 1-153; 12643, PLCG1, 63357, 165807, 1-660; 12643, PLCG1, 63358, 165808, 1-327; 12643, PLCG1, 63359, 165809, 1-400; 12643, PLCG1, 63360, 165810, 1-397; 12643, PLCG1, 63354, 165804, 198-4073; 12643, PLCG1, 63355, 165805, 406-4278; 12644, PLCG2, 63361, 165811, 1-3759; 12644, PLCG2, 63362, 165812, 1-136; 12644, PLCG2, 63363, 165813, 1-535; 12644, PLCG2, 63364, 165814, 434-912; 12644, PLCG2, 63365, 165815, 215-4012; 12645, PLCZ1, 63367, 165817, 223-360; 12645, PLCZ1, 63368, 165818, 156-653; 12645, PLCZ1, 63369, 165819, 1-304; 12645, PLCZ1, 63370, 165820, 199-468; 12645, PLCZ1, 63371, 165821, 217-378; 12645, PLCZ1, 63372, 165822, 1-1237; 12645, PLCZ1, 63373, 165823, 380-773; 12645, PLCZ1, 63374, 165824, 494-722; 12645, PLCZ1, 63375, 165825, 234-371; 12645, PLCZ1, 63377, 165827, 1-450; 12645,

PLCZ1, 63378, 165828, 383-1555; 12645, PLCZ1, 63379, 165829, 1-797; 12645, PLCZ1, 63366, 165816, 265-2091; 12645, PLCZ1, 63376, 165826, 99-1346; 12646, PLCL1, 63381, 165831, 399-683; 12646, PLCL1, 63382, 165832, 1-3057; 12646, PLCL1, 63383, 165833, 48-3083; 12646, PLCL1, 63380, 165830, 399-3686; 12647, PLCL2, 63384, 165834, 1-2114; 12647, PLCL2, 63385, 165835, 254-3259; 12647, PLCL2, 63386, 165836, 82-3465; 12648, PLD3, 63388, 165838, 213-745; 12648, PLD3, 63389, 165839, 488-873; 12648, PLD3, 63394, 165844, 199-443; 12648, PLD3, 63395, 165845, 145-503; 12648, PLD3, 63396, 165846, 335-544; 12648, PLD3, 63397, 165847, 1-364; 12648, PLD3, 63398, 165848, 497-580; 12648, PLD3, 63399, 165849, 164-804; 12648, PLD3, 63400, 165850, 404-536; 12648, PLD3, 63401, 165851, 1-332; 12648, PLD3, 63402, 165852, 1-214; 12648, PLD3, 63387, 165837, 124-1596; 12648, PLD3, 63390, 165840, 192-1664; 12648, PLD3, 63391, 165841, 358-1830; 12648, PLD3, 63392, 165842, 333-1805; 12648, PLD3, 63393, 165843, 398-1870; 12649, PLD4, 63404, 165854, 193-1734; 12649, PLD4, 63405, 165855, 113-883; 12649, PLD4, 63406, 165856, 169-396; 12649, PLD4, 63403, 165853, 169-1689; 12650, PLD5, 63407, 165857, 101-244; 12650, PLD5, 63408, 165858, 228-557; 12650, PLD5, 63411, 165861, 70-490; 12650, PLD5, 63412, 165862, 396-989; 12650, PLD5, 63409, 165859, 127-1551; 12650, PLD5, 63410, 165860, 228-1838; 12650, PLD5, 63413, 165863, 243-1853; 12651, PLD6, 63414, 165864, 30-788; 12652, PLD1, 63415, 165865, 1888-2346; 12652, PLD1, 63418, 165868, 96-269; 12652, PLD1, 63419, 165869, 1-704; 12652, PLD1, 63420, 165870, 197-621; 12652, PLD1, 63421, 165871, 1-174; 12652, PLD1, 63416, 165866, 128-3352; 12652, PLD1, 63417, 165867, 72-3182; 12653, PLD2, 63423, 165873, 28-544; 12653, PLD2, 63424, 165874, 45-431; 12653, PLD2, 63426, 165876, 1-589; 12653, PLD2, 63427, 165877, 1-592; 12653, PLD2, 63428, 165878, 1-146; 12653, PLD2, 63422, 165872, 132-2933; 12653, PLD2, 63425, 165875, 59-2827; 12654, PLPP1, 63431, 165881, 323-655; 12654, PLPP1, 63429, 165879, 341-1198; 12654, PLPP1, 63430, 165880, 422-1276; 12655, PLPP2, 63435, 165885, 47-581; 12655, PLPP2, 63436, 165886, 1-410; 12655, PLPP2, 63437, 165887, 227-850; 12655, PLPP2, 63432, 165882, 185-883; 12655, PLPP2, 63433, 165883, 120-1049; 12655, PLPP2, 63434, 165884, 169-1035; 12656, PLPP3, 63438, 165888, 553-1488; 12657, PLPP4, 63439, 165889, 1-786; 12657, PLPP4, 63441, 165891, 85-885; 12657, PLPP4, 63440, 165890, 353-1168; 12658, PLPP5, 63445, 165895, 1-734; 12658, PLPP5, 63446, 165896, 1-738; 12658, PLPP5, 63447, 165897, 1-183; 12658, PLPP5, 63449, 165899, 431-829; 12658, PLPP5, 63442, 165892, 9-659; 12658, PLPP5, 63443, 165893, 22-816; 12658, PLPP5, 63444, 165894, 45-575; 12658, PLPP5, 63448, 165898, 200-871; 12659, PLPP6, 63450, 165900, 62-949; 12660, PLPP7, 63451, 165901, 187-642; 12660, PLPP7, 63452, 165902, 305-1120; 12661, PLPPR1, 63455, 165905, 164-472; 12661, PLPPR1, 63458, 165908, 164-472; 12661, PLPPR1, 63459, 165909, 64-748; 12661, PLPPR1, 63453, 165903, 440-1417; 12661, PLPPR1, 63454, 165904, 267-1244; 12661, PLPPR1, 63456, 165906, 267-1244; 12661, PLPPR1, 63457, 165907, 440-1417; 12662, PLPPR2, 63461, 165911, 338-535; 12662, PLPPR2, 63462, 165912, 265-1548; 12662, PLPPR2, 63463, 165913, 380-633; 12662, PLPPR2, 63460, 165910, 377-1408; 12662, PLPPR2, 63464, 165914, 65-2305; 12663, PLPPR3, 63466, 165916, 1-362; 12663, PLPPR3, 63467, 165917, 397-782; 12663, PLPPR3, 63468, 165918, 90-164; 12663, PLPPR3, 63469, 165919, 65-139; 12663, PLPPR3, 63470, 165920, 397-471; 12663, PLPPR3, 63465, 165915, 90-2246; 12664, PLPPR4, 63471, 165921, 108-1925; 12664, PLPPR4, 63473, 165923, 159-2276; 12664, PLPPR4, 63472, 165922, 498-2789; 12665, PLPPR5, 63475, 165925, 362-1312; 12665, PLPPR5, 63474, 165924, 223-1188; 12666, PLSCR1, 63478, 165928, 152-277; 12666, PLSCR1, 63479, 165929, 86-211; 12666, PLSCR1, 63480, 165930, 144-269; 12666, PLSCR1, 63481, 165931, 280-1215; 12666, PLSCR1, 63482, 165932, 118-862; 12666, PLSCR1, 63483, 165933, 188-701; 12666, PLSCR1, 63484, 165934, 78-203; 12666, PLSCR1, 63485, 165935, 103-228; 12666, PLSCR1, 63486, 165936, 165-290; 12666, PLSCR1, 63487, 165937, 1-514; 12666, PLSCR1, 63488, 165938, 451-1198; 12666, PLSCR1, 63476, 165926, 412-1368; 12666, PLSCR1, 63477, 165927, 193-906; 12667, PLSCR2, 63490, 165940, 277-759; 12667, PLSCR2, 63491, 165941, 171-287; 12667, PLSCR2, 63489, 165939, 334-1008; 12667, PLSCR2, 63492, 165942, 441-1334; 12667, PLSCR2, 63493, 165943, 299-973; 12667, PLSCR2, 63494, 165944, 70-951; 12668, PLSCR4, 63496, 165946, 242-961; 12668, PLSCR4, 63499, 165949, 301-593; 12668, PLSCR4, 63500, 165950, 269-1054; 12668, PLSCR4, 63501, 165951, 191-814; 12668, PLSCR4, 63502, 165952, 256-683; 12668, PLSCR4, 63504, 165954, 168-609; 12668, PLSCR4, 63495, 165945, 242-1231; 12668, PLSCR4, 63497, 165947, 333-1322; 12668, PLSCR4, 63498, 165948, 159-833; 12668, PLSCR4, 63503, 165953, 332-1321; 12669, PLSCR5, 63505, 165955, 1005-1820; 12669, PLSCR5, 63506, 165956, 28-843; 12669, PLSCR5, 63507, 165957, 28-807; 12670, PLTP, 63508, 165958, 86-1411; 12670, PLTP, 63509, 165959, 132-1349; 12670, PLTP, 63510, 165960, 81-1562; 12670, PLTP, 63511, 165961, 89-1285; 12670, PLTP, 63512, 165962, 596-2077; 12671, LHPP, 63515, 165965, 30-668; 12671, LHPP, 63513, 165963, 21-653; 12671, LHPP, 63514, 165964, 29-841; 12672, PMM1, 63517, 165967, 43-249; 12672, PMM1, 63516, 165966, 86-874; 12673, PMM2, 63519, 165969, 42-242; 12673, PMM2, 63520, 165970, 42-242; 12673, PMM2, 63521, 165971, 42-317; 12673, PMM2, 63522, 165972, 1-427; 12673, PMM2, 63523, 165973, 42-239; 12673, PMM2, 63524, 165974, 46-246; 12673, PMM2, 63525, 165975, 17-484; 12673, PMM2, 63527, 165977, 34-306; 12673, PMM2, 63528, 165978, 17-229; 12673, PMM2, 63529, 165979, 205-864; 12673, PMM2, 63518, 165968, 67-807; 12673, PMM2, 63526, 165976, 47-406; 12674, PMVK, 63530, 165980, 307-885; 12675, PPCDC, 63532, 165982, 272-464; 12675, PPCDC, 63533, 165983, 95-580; 12675, PPCDC, 63534, 165984, 71-589; 12675, PPCDC, 63535, 165985, 113-502; 12675, PPCDC, 63536, 165986, 148-334; 12675, PPCDC, 63537, 165987, 401-646; 12675, PPCDC, 63531, 165981, 145-759; 12676, PPCS, 63538, 165988, 6-176; 12676, PPCS, 63539, 165989, 28-669; 12676, PPCS, 63540, 165990, 8-943; 12676, PPCS, 63541, 165991, 395-811; 12677, PEA15, 63544, 165994, 146-472; 12677, PEA15, 63542, 165992, 189-581; 12677, PEA15, 63543, 165993, 349-804; 12678, PAG1, 63545, 165995, 712-2010; 12679, PPAT, 63547, 165997, 32-610; 12679, PPAT, 63548, 165998, 20-238; 12679, PPAT, 63546, 165996, 139-1692; 12680, PRPS1, 63549, 165999, 17-673; 12680, PRPS1, 63550, 166000, 100-606; 12680, PRPS1, 63551, 166001, 410-754; 12680, PRPS1, 63552, 166002, 123-1079; 12681, PRPS1L1, 63553, 166003, 82-1038; 12682, PRPS2, 63554, 166004, 144-584; 12682, PRPS2, 63557, 166007, 1-522; 12682, PRPS2, 63558, 166008, 11-613; 12682, PRPS2, 63555, 166005, 129-1085; 12682, PRPS2, 63556, 166006, 93-1058; 12683, PRPSAP1, 63559, 166009, 222-1070; 12683, PRPSAP1, 63560, 166010, 532-

1003; 12683, PRPSAP1, 63561, 166011, 227-916; 12683, PRPSAP1, 63562, 166012, 596-908; 12683, PRPSAP1, 63563, 166013, 281-549; 12683, PRPSAP1, 63564, 166014, 447-1604; 12684, PRPSAP2, 63566, 166016, 158-394; 12684, PRPSAP2, 63568, 166018, 280-700; 12684, PRPSAP2, 63569, 166019, 211-1014; 12684, PRPSAP2, 63570, 166020, 306-1038; 12684, PRPSAP2, 63571, 166021, 165-968; 12684, PRPSAP2, 63572, 166022, 423-950; 12684, PRPSAP2, 63573, 166023, 205-690; 12684, PRPSAP2, 63574, 166024, 204-787; 12684, PRPSAP2, 63577, 166027, 1-782; 12684, PRPSAP2, 63578, 166028, 250-561; 12684, PRPSAP2, 63579, 166029, 191-334; 12684, PRPSAP2, 63580, 166030, 490-556; 12684, PRPSAP2, 63581, 166031, 209-445; 12684, PRPSAP2, 63582, 166032, 288-567; 12684, PRPSAP2, 63583, 166033, 334-504; 12684, PRPSAP2, 63584, 166034, 248-484; 12684, PRPSAP2, 63585, 166035, 400-927; 12684, PRPSAP2, 63586, 166036, 1-430; 12684, PRPSAP2, 63587, 166037, 295-438; 12684, PRPSAP2, 63589, 166039, 49-192; 12684, PRPSAP2, 63565, 166015, 284-1393; 12684, PRPSAP2, 63567, 166017, 206-1195; 12684, PRPSAP2, 63575, 166025, 49-1011; 12684, PRPSAP2, 63576, 166026, 432-1283; 12684, PRPSAP2, 63588, 166038, 465-1316; 12685, PRTFDC1, 63590, 166040, 30-707; 12685, PRTFDC1, 63591, 166041, 18-539; 12685, PRTFDC1, 63592, 166042, 10-582; 12686, PAICS, 63596, 166046, 276-1514; 12686, PAICS, 63597, 166047, 516-1517; 12686, PAICS, 63593, 166043, 232-1509; 12686, PAICS, 63594, 166044, 176-1474; 12686, PAICS, 63595, 166045, 162-1439; 12687, PFAS, 63599, 166049, 1-1157; 12687, PFAS, 63600, 166050, 1-349; 12687, PFAS, 63601, 166051, 244-553; 12687, PFAS, 63602, 166052, 1-188; 12687, PFAS, 63603, 166053, 319-581; 12687, PFAS, 63604, 166054, 134-529; 12687, PFAS, 63605, 166055, 151-557; 12687, PFAS, 63606, 166056, 1-396; 12687, PFAS, 63598, 166048, 134-4150; 12688, GART, 63611, 166061, 344-1264; 12688, GART, 63612, 166062, 143-837; 12688, GART, 63613, 166063, 308-715; 12688, GART, 63614, 166064, 1-437; 12688, GART, 63615, 166065, 314-1036; 12688, GART, 63616, 166066, 282-697; 12688, GART, 63619, 166069, 1-672; 12688, GART, 63607, 166057, 92-1393; 12688, GART, 63608, 166058, 116-3148; 12688, GART, 63609, 166059, 265-3297; 12688, GART, 63610, 166060, 244-3276; 12688, GART, 63617, 166067, 1-926; 12688, GART, 63618, 166068, 1-926; 12688, GART, 63620, 166070, 1-926; 12689, PHKA1, 63622, 166072, 379-4101; 12689, PHKA1, 63624, 166074, 440-3985; 12689, PHKA1, 63621, 166071, 302-3934; 12689, PHKA1, 63623, 166073, 161-3832; 12689, PHKA1, 63625, 166075, 302-3757; 12690, PHKA2, 63626, 166076, 667-4374; 12691, PHKB, 63629, 166079, 345-1032; 12691, PHKB, 63631, 166081, 247-697; 12691, PHKB, 63632, 166082, 1-229; 12691, PHKB, 63633, 166083, 382-412; 12691, PHKB, 63634, 166084, 1-236; 12691, PHKB, 63635, 166085, 1-633; 12691, PHKB, 63636, 166086, 1273-1493; 12691, PHKB, 63637, 166087, 1-563; 12691, PHKB, 63627, 166077, 26-3307; 12691, PHKB, 63628, 166078, 25-3306; 12691, PHKB, 63630, 166080, 190-3450; 12692, PHKG1, 63639, 166089, 152-418; 12692, PHKG1, 63640, 166090, 132-483; 12692, PHKG1, 63641, 166091, 146-582; 12692, PHKG1, 63642, 166092, 196-1368; 12692, PHKG1, 63638, 166088, 196-1359; 12692, PHKG1, 63643, 166093, 196-1455; 12693, PHKG2, 63644, 166094, 70-1302; 12693, PHKG2, 63646, 166096, 239-502; 12693, PHKG2, 63647, 166097, 145-908; 12693, PHKG2, 63649, 166099, 1-241; 12693, PHKG2, 63650, 166100, 271-1068; 12693, PHKG2, 63645, 166095, 211-1335; 12693, PHKG2, 63648, 166098, 240-1460; 12694, PYGL, 63652, 166102, 54-2513; 12694, PYGL, 63651, 166101, 334-2877; 12694, PYGL, 63653, 166103, 81-2522; 12695, PYGM, 63654, 166104, 400-2928; 12695, PYGM, 63655, 166105, 77-2341; 12696, PYGB, 63657, 166107, 1-734; 12696, PYGB, 63656, 166106, 111-2642; 12697, PHAX, 63658, 166108, 696-1880; 12698, PSAT1, 63659, 166109, 69-1043; 12698, PSAT1, 63660, 166110, 69-1181; 12699, PSPH, 63663, 166113, 524-555; 12699, PSPH, 63664, 166114, 494-633; 12699, PSPH, 63665, 166115, 265-826; 12699, PSPH, 63666, 166116, 605-744; 12699, PSPH, 63668, 166118, 358-630; 12699, PSPH, 63669, 166119, 533-539; 12699, PSPH, 63670, 166120, 733-739; 12699, PSPH, 63661, 166111, 759-1436; 12699, PSPH, 63662, 166112, 807-1484; 12699, PSPH, 63667, 166117, 331-1008; 12700, PSTK, 63672, 166122, 1-1079; 12700, PSTK, 63671, 166121, 441-1487; 12700, PSTK, 63673, 166123, 1-1047; 12701, PTER, 63676, 166126, 121-723; 12701, PTER, 63674, 166124, 51-959; 12701, PTER, 63675, 166125, 247-1296; 12701, PTER, 63677, 166127, 154-1203; 12702, PID1, 63682, 166132, 197-322; 12702, PID1, 63678, 166128, 32-784; 12702, PID1, 63679, 166129, 341-1087; 12702, PID1, 63680, 166130, 243-896; 12702, PID1, 63681, 166131, 238-744; 12703, PHYH, 63685, 166135, 406-1371; 12703, PHYH, 63686, 166136, 356-883; 12703, PHYH, 63687, 166137, 11-642; 12703, PHYH, 63683, 166133, 60-1076; 12703, PHYH, 63684, 166134, 511-1227; 12704, PHYHIP, 63690, 166140, 26-769; 12704, PHYHIP, 63688, 166138, 458-1450; 12704, PHYHIP, 63689, 166139, 576-1568; 12705, PHYHIPL, 63691, 166141, 334-1386; 12705, PHYHIPL, 63692, 166142, 265-1395; 12705, PHYHIPL, 63693, 166143, 194-343; 12706, PHYHD1, 63697, 166147, 350-548; 12706, PHYHD1, 63698, 166148, 1-294; 12706, PHYHD1, 63699, 166149, 599-790; 12706, PHYHD1, 63700, 166150, 446-928; 12706, PHYHD1, 63701, 166151, 1-495; 12706, PHYHD1, 63703, 166153, 11-151; 12706, PHYHD1, 63704, 166154, 342-872; 12706, PHYHD1, 63705, 166155, 1-163; 12706, PHYHD1, 63694, 166144, 421-1314; 12706, PHYHD1, 63695, 166145, 237-1049; 12706, PHYHD1, 63696, 166146, 934-1809; 12706, PHYHD1, 63702, 166152, 42-854; 12707, POLO, 63708, 166158, 2-3655; 12707, POLO, 63709, 166159, 1-182; 12707, POLO, 63710, 166160, 1-140; 12707, POLO, 63706, 166156, 339-15767; 12707, POLO, 63707, 166157, 339-15146; 12707, POLO, 63711, 166161, 175-1245; 12708, PIEZO1, 63713, 166163, 1-1122; 12708, PIEZO1, 63714, 166164, 1-267; 12708, PIEZO1, 63715, 166165, 1-544; 12708, PIEZO1, 63716, 166166, 1-554; 12708, PIEZO1, 63717, 166167, 1-106; 12708, PIEZO1, 63712, 166162, 248-7813; 12709, PIEZO2, 63719, 166169, 328-8439; 12709, PIEZO2, 63722, 166172, 1-4422; 12709, PIEZO2, 63723, 166173, 1-279; 12709, PIEZO2, 63724, 166174, 444-1021; 12709, PIEZO2, 63726, 166176, 1-532; 12709, PIEZO2, 63727, 166177, 1-460; 12709, PIEZO2, 63718, 166168, 1-8070; 12709, PIEZO2, 63720, 166170, 1-8259; 12709, PIEZO2, 63721, 166171, 141-2270; 12709, PIEZO2, 63725, 166175, 1-8334; 12710, PIF1, 63728, 166178, 96-2021; 12710, PIF1, 63729, 166179, 96-2219; 12710, PIF1, 63730, 166180, 91-2016; 12711, PIGBOS1, 63731, 166181, 283-371; 12711, PIGBOS1, 63732, 166182, 331-495; 12711, PIGBOS1, 63733, 166183, 258-422; 12712, PGBD1, 63734, 166184, 406-2835; 12713, PGBD2, 63735, 166185, 148-1926; 12713, PGBD2, 63736, 166186, 271-1296; 12714, PGBD3, 63737, 166187, 203-1984; 12715, PGBD4, 63738, 166188, 460-2217; 12716, PGBD5, 63739, 166189, 147-1376; 12716, PGBD5, 63740, 166190, 25-1392; 12717, PYURF, 63741, 166191, 114-458; 12718, PIH1D1, 63743, 166193, 125-833; 12718, PIH1D1, 63744, 166194, 178-998; 12718, PIH1D1, 63745, 166195, 383-874; 12718, PIH1D1, 63746, 166196, 1-164; 12718, PIH1D1, 63748, 166198, 1-390; 12718, PIH1D1, 63749, 166199, 1-166; 12718, PIH1D1, 63750, 166200, 1-264; 12718, PIH1D1, 63751, 166201, 136-381; 12718, PIH1D1, 63752, 166202, 1-288; 12718, PIH1D1, 63753, 166203, 478-583; 12718, PIH1D1, 63754, 166204, 1-344; 12718, PIH1D1, 63755, 166205, 1-550; 12718, PIH1D1, 63756, 166206, 1-346; 12718, PIH1D1, 63742, 166192, 237-1109; 12718, PIH1D1, 63747, 166197, 107-979; 12719, PIH1D2, 63760, 166210, 1-755; 12719, PIH1D2, 63762, 166212, 1-487; 12719, PIH1D2, 63757, 166207, 224-1171; 12719, PIH1D2, 63758, 166208, 224-1090; 12719, PIH1D2, 63759, 166209, 327-1148; 12719, PIH1D2, 63761, 166211, 83-1030; 12719, PIH1D2, 63763, 166213, 1-867; 12720, PIH1D3, 63764, 166214, 283-927; 12720, PIH1D3, 63765, 166215, 63-707; 12720, PIH1D3, 63766, 166216, 338-982; 12721, PIANP, 63768, 166218, 61-290; 12721, PIANP, 63770, 166220, 246-577; 12721, PIANP, 63772, 166222, 100-614; 12721, PIANP, 63767, 166217, 231-1079; 12721, PIANP, 63769, 166219, 340-1188; 12721, PIANP, 63771, 166221, 231-1061; 12722, PIM1, 63773, 166223, 374-1315; 12723, PIM2, 63775, 166225, 458-892; 12723, PIM2, 63774, 166224, 191-1126; 12724, PIM3, 63776, 166226, 436-1416; 12725, PINX1, 63778, 166228, 121-525; 12725, PINX1, 63779, 166229, 16-610; 12725, PINX1, 63781, 166231, 1-59; 12725, PINX1, 63777, 166227, 121-1107; 12725, PINX1, 63780, 166230, 121-645; 12726, PNN, 63783, 166233, 98-472; 12726, PNN, 63784, 166234, 51-404; 12726, PNN, 63782, 166232, 68-2221; 12727, PIPDX, 63786, 166236, 147-760; 12727, PIPDX, 63787, 166237, 262-720; 12727, PIPDX, 63785, 166235, 327-1499; 12728, PIR, 63788, 166238, 205-1077; 12728, PIR, 63789, 166239, 462-1334; 12729, PITHD1, 63791, 166241, 140-436; 12729, PITHD1, 63792, 166242, 545-754; 12729, PITHD1, 63790, 166240, 112-747; 12730, PITPNM3, 63795, 166245, 1-349; 12730, PITPNM3, 63793, 166243, 89-3013; 12730, PITPNM3, 63794, 166244, 55-2871; 12731, PITRM1, 63798, 166248, 495-2282; 12731, PITRM1, 63799, 166249, 1-700; 12731, PITRM1, 63800, 166250, 1-555; 12731, PITRM1, 63802, 166252, 1-261; 12731, PITRM1, 63803, 166253, 1-778; 12731, PITRM1, 63796, 166246, 36-3149; 12731, PITRM1, 63797, 166247, 70-3186; 12731, PITRM1, 63801, 166251, 63-2882; 12732, PTTG1, 63807, 166257, 321-684; 12732, PTTG1, 63804, 166254, 82-690; 12732, PTTG1, 63805, 166255, 404-1012; 12732, PTTG1, 63806, 166256, 264-872; 12733, PTTG1IP, 63809, 166259, 102-581; 12733, PTTG1IP, 63810, 166260, 94-417; 12733, PTTG1IP, 63811, 166261, 288-716; 12733, PTTG1IP, 63808, 166258, 222-764; 12734, PTTG2, 63812, 166262, 1-576; 12735, PIWIL1, 63814, 166264, 362-879; 12735, PIWIL1, 63815, 166265, 95-545; 12735, PIWIL1, 63816, 166266, 101-467; 12735, PIWIL1, 63817, 166267, 77-571; 12735, PIWIL1, 63818, 166268, 215-566; 12735, PIWIL1, 63821, 166271, 77-571; 12735, PIWIL1, 63822, 166272, 101-467; 12735, PIWIL1, 63823, 166273, 362-879; 12735, PIWIL1, 63824, 166274, 215-566; 12735, PIWIL1, 63825, 166275, 95-545; 12735, PIWIL1, 63813, 166263, 273-2858; 12735, PIWIL1, 63819, 166269, 273-2858; 12735, PIWIL1, 63820, 166270, 54-2543; 12736, PIWIL2, 63826, 166276, 149-3070; 12736, PIWIL2, 63827, 166277, 510-3431; 12736, PIWIL2, 63828, 166278, 109-2922; 12736, PIWIL2, 63829, 166279, 26-2839; 12737, PIWIL3, 63831, 166281, 716-3010; 12737, PIWIL3, 63832, 166282, 589-2883; 12737, PIWIL3, 63830, 166280, 418-3066; 12737, PIWIL3, 63833, 166283, 25-2673; 12738, PIWIL4, 63836, 166286, 99-710; 12738, PIWIL4, 63837, 166287, 233-587; 12738, PIWIL4, 63834, 166284, 212-2770; 12738, PIWIL4, 63835, 166285, 528-2015; 12738, PIWIL4, 63838, 166288, 271-1632; 12739, PLAC8L1, 63840, 166290, 59-319; 12739, PLAC8L1, 63839, 166289, 59-592; 12740, PLET1, 63841, 166291, 272-895; 12741, PGF, 63842, 166292, 336-845; 12741, PGF, 63843, 166293, 1-666; 12741, PGF, 63844, 166294, 543-1055; 12741, PGF, 63845, 166295, 385-834; 12742, PLAC1, 63846, 166296, 287-925; 12743, PLAC8, 63851, 166301, 125-301; 12743, PLAC8, 63847, 166297, 167-514; 12743, PLAC8, 63848, 166298, 80-427; 12743, PLAC8, 63849, 166299, 146-493; 12743, PLAC8, 63850, 166300, 503-850; 12744, PLAC9, 63853, 166303, 173-436; 12744, PLAC9, 63854, 166304, 213-380; 12744, PLAC9, 63852, 166302, 43-336; 12745, PKP1, 63858, 166308, 192-2369; 12745, PKP1, 63855, 166305, 252-2495; 12745, PKP1, 63856, 166306, 1-2244; 12745, PKP1, 63857, 166307, 252-2432; 12746, PKP2, 63861, 166311, 1-2475; 12746, PKP2, 63862, 166312, 1-110; 12746, PKP2, 63859, 166309, 26-2671; 12746, PKP2, 63860, 166310, 110-2623; 12747, PKP3, 63864, 166314, 472-940; 12747, PKP3, 63865, 166315, 15-756; 12747, PKP3, 63866, 166316, 519-1111; 12747, PKP3, 63867, 166317, 51-687; 12747, PKP3, 63868, 166318, 488-847; 12747, PKP3, 63869, 166319, 1-347; 12747, PKP3, 63863, 166313, 77-2470; 12748, PKP4, 63872, 166322, 111-272; 12748, PKP4, 63873, 166323, 89-376; 12748, PKP4, 63874, 166324, 859-1509; 12748, PKP4, 63875, 166325, 261-911; 12748, PKP4, 63876, 166326, 92-232; 12748, PKP4, 63877, 166327, 1-500; 12748, PKP4, 63878, 166328, 128-3754; 12748, PKP4, 63879, 166329, 1-162; 12748, PKP4, 63870, 166320, 126-3575; 12748, PKP4, 63871, 166321, 113-3691; 12749, PLVAP, 63881, 166331, 1-160; 12749, PLVAP, 63882, 166332, 55-620; 12749, PLVAP, 63880, 166330, 63-1391; 12750, PLG, 63884, 166334, 68-478; 12750, PLG, 63885, 166335, 60-558; 12750, PLG, 63883, 166333, 64-2496; 12751, PLAT, 63889, 166339, 99-1409; 12751, PLAT, 63890, 166340, 135-670; 12751, PLAT, 63891, 166341, 99-1598; 12751, PLAT, 63892, 166342, 99-1520; 12751, PLAT, 63893, 166343, 1-290; 12751, PLAT, 63894, 166344, 78-549; 12751, PLAT, 63886, 166336, 258-1946; 12751, PLAT, 63887, 166337, 210-1760; 12751, PLAT, 63888, 166338, 151-1839; 12752, PLAU, 63896, 166346, 483-1727; 12752, PLAU, 63897, 166347, 150-468; 12752, PLAU, 63895, 166345, 94-1389; 12753, PLAUR, 63901, 166351, 505-740; 12753, PLAUR, 63902, 166352, 65-742; 12753, PLAUR, 63903, 166353, 1-401; 12753, PLAUR, 63904, 166354, 222-679; 12753, PLAUR, 63905, 166355, 22-162; 12753, PLAUR, 63906, 166356, 1-555; 12753, PLAUR, 63907, 166357, 34-894; 12753, PLAUR, 63908, 166358, 441-897; 12753, PLAUR, 63909, 166359, 1-463; 12753, PLAUR, 63898, 166348, 428-1300; 12753, PLAUR, 63899, 166349, 231-1238; 12753, PLAUR, 63900, 166350, 47-892; 12754, PLGRKT, 63910, 166360, 223-666; 12755, PLGLB1, 63914, 166364, 70-339; 12755, PLGLB1, 63911, 166361, 70-360; 12755, PLGLB1, 63912, 166362, 70-360; 12755, PLGLB1, 63913, 166363, 70-360; 12756, PLGLB2, 63915, 166365, 68-358; 12756, PLGLB2, 63916, 166366, 55-345; 12757, PLLP, 63918, 166368, 133-507; 12757, PLLP, 63919, 166369, 176-449; 12757, PLLP, 63920, 166370, 122-607; 12757, PLLP, 63917, 166367, 148-696; 12758, PLS1, 63923, 166373, 222-580; 12758, PLS1, 63924, 166374, 240-1038; 12758, PLS1, 63925, 166375, 478-635; 12758, PLS1, 63927, 166377, 204-564; 12758, PLS1, 63928, 166378, 405-567; 12758, PLS1, 63929, 166379, 400-574; 12758, PLS1, 63930, 166380, 509-608; 12758, PLS1, 63921, 166371, 214-2103; 12758, PLS1, 63922, 166372, 160-2049; 12758, PLS1, 63926, 166376, 321-2210; 12759, PLS3, 63933, 166383, 1-1854; 12759, PLS3, 63934, 166384, 1-568; 12759, PLS3, 63935, 166385, 89-217; 12759, PLS3, 63936, 166386, 96-224; 12759, PLS3, 63938, 166388, 9-500; 12759, PLS3, 63939, 166389, 88-216; 12759, PLS3, 63931, 166381, 227-2080; 12759, PLS3, 63932, 166382, 88-1980; 12759, PLS3, 63937, 166387, 34-1926; 12760, PDGFC, 63940, 166390, 413-565; 12760, PDGFC, 63943, 166393, 1-161; 12760, PDGFC, 63941, 166391, 1-849; 12760, PDGFC, 63942, 166392, 492-1529; 12761, PDGFD, 63946, 166396, 1-620; 12761, PDGFD, 63944, 166394, 453-1547; 12761, PDGFD, 63945, 166395, 181-1293; 12762, PEAR1, 63949, 166399, 123-642; 12762, PEAR1, 63950, 166400, 150-383; 12762, PEAR1, 63947, 166397, 117-3230; 12762, PEAR1, 63948, 166398, 226-3339; 12763, PF4, 63951, 166401, 172-477; 12764, PF4V1, 63952, 166402, 175-489; 12765, PECAM1, 63953, 166403, 162-852; 12765, PECAM1, 63954, 166404, 29-579; 12765, PECAM1, 63955, 166405, 177-580; 12765, PECAM1, 63956, 166406, 214-2430; 12766, PAFAH1B2, 63957, 166407, 1-528; 12766, PAFAH1B2, 63958, 166408, 143-541; 12766, PAFAH1B2, 63959, 166409, 83-691; 12766, PAFAH1B2, 63960, 166410, 129-596; 12766, PAFAH1B2, 63961, 166411, 160-849; 12767, PAFAH1B3, 63964, 166414, 96-380; 12767, PAFAH1B3, 63965, 166415, 47-465; 12767, PAFAH1B3, 63966, 166416, 1-607; 12767, PAFAH1B3, 63967, 166417, 358-646; 12767, PAFAH1B3, 63968, 166418, 89-582; 12767, PAFAH1B3, 63962, 166412, 263-958; 12767, PAFAH1B3, 63963, 166413, 358-1053; 12768, PAFAH1B1, 63970, 166420, 364-408; 12768, PAFAH1B1, 63971, 166421, 1-627; 12768, PAFAH1B1, 63972, 166422, 312-557; 12768, PAFAH1B1, 63969, 166419, 452-1684; 12769, PAFAH2, 63975, 166425, 222-778; 12769, PAFAH2, 63976, 166426, 253-748; 12769, PAFAH2, 63973, 166423, 181-1359; 12769, PAFAH2, 63974, 166424, 126-1304; 12770, PTAFR, 63977, 166427, 191-1219; 12770, PTAFR, 63978, 166428, 636-1664; 12770, PTAFR, 63979, 166429, 336-1364; 12771, PDGFA, 63981, 166431, 1-618; 12771, PDGFA, 63983, 166433, 405-663; 12771, PDGFA, 63980, 166430, 394-1029; 12771, PDGFA, 63982, 166432, 409-999; 12772, PDGFB, 63986, 166436, 122-554; 12772, PDGFB, 63987, 166437, 149-556; 12772, PDGFB, 63984, 166434, 789-1514; 12772, PDGFB, 63985, 166435, 38-718; 12773, PDGFRA, 63990, 166440, 111-573; 12773, PDGFRA, 63991, 166441, 139-580; 12773, PDGFRA, 63993, 166443, 110-586; 12773, PDGFRA, 63994, 166444, 298-771; 12773, PDGFRA, 63988, 166438, 332-3601; 12773, PDGFRA, 63989, 166439, 118-2349; 12773, PDGFRA, 63992, 166442, 149-805; 12774, PDGFRB, 63996, 166446, 384-822; 12774, PDGFRB, 63997, 166447, 470-1189; 12774, PDGFRB, 63998, 166448, 45-568; 12774, PDGFRB, 63995, 166445, 471-3791; 12775, PDGFRL, 63999, 166449, 442-1569; 12775, PDGFRL, 64000, 166450, 446-1573; 12776, PLEK, 64001, 166451, 180-1232; 12777, PLEK2, 64003, 166453, 1-353; 12777, PLEK2, 64004, 166454, 1-612; 12777, PLEK2, 64005, 166455, 13-246; 12777, PLEK2, 64006, 166456, 1-384; 12777, PLEK2, 64002, 166452, 142-1203; 12778, PSD, 64007, 166457, 528-3602; 12778, PSD, 64008, 166458, 204-3278; 12778, PSD, 64009, 166459, 862-2799; 12779, PSD2, 64010, 166460, 206-2521; 12780, PSD3, 64013, 166463, 168-1298; 12780, PSD3, 64015, 166465, 1-358; 12780, PSD3, 64016, 166466, 202-627; 12780, PSD3, 64017, 166467, 47-550; 12780, PSD3, 64018, 166468, 321-815; 12780, PSD3, 64019, 166469, 82-423; 12780, PSD3, 64020, 166470, 165-3113; 12780, PSD3, 64021, 166471, 1-496; 12780, PSD3, 64022, 166472, 145-954; 12780, PSD3, 64023, 166473, 1-810; 12780, PSD3, 64011, 166461, 91-1632; 12780, PSD3, 64012, 166462, 104-3247; 12780, PSD3, 64014, 166464, 104-3250; 12781, PSD4, 64025, 166475, 1-126; 12781, PSD4, 64026, 166476, 1-537; 12781, PSD4, 64024, 166474, 196-3366; 12781, PSD4, 64027, 166477, 170-3253; 12782, PLEKHA1, 64029, 166479, 109-1260; 12782, PLEKHA1, 64033, 166483, 219-617; 12782, PLEKHA1, 64028, 166478, 97-1101; 12782, PLEKHA1, 64030, 166480, 132-1346; 12782, PLEKHA1, 64031, 166481, 1466-2680; 12782, PLEKHA1, 64032, 166482, 74-1288; 12783, PLEKHA2, 64034, 166484, 221-565; 12783, PLEKHA2, 64035, 166485, 235-984; 12783, PLEKHA2, 64036, 166486, 179-1456; 12783, PLEKHA2, 64037, 166487, 177-1304; 12783, PLEKHA2, 64038, 166488, 291-1421; 12784, PLEKHA3, 64040, 166490, 1-345; 12784, PLEKHA3, 64041, 166491, 138-323; 12784, PLEKHA3, 64039, 166489, 403-1305; 12785, PLEKHA4, 64044, 166494, 1-79; 12785, PLEKHA4, 64045, 166495, 590-766; 12785, PLEKHA4, 64046, 166496, 1-602; 12785, PLEKHA4, 64047, 166497, 1-358; 12785, PLEKHA4, 64048, 166498, 237-616; 12785, PLEKHA4, 64042, 166492, 557-2896; 12785, PLEKHA4, 64043, 166493, 379-2130; 12786, PLEKHA8, 64051, 166501, 323-1642; 12786, PLEKHA8, 64053, 166503, 1-1638; 12786, PLEKHA8, 64054, 166504, 403-1732; 12786, PLEKHA8, 64049, 166499, 402-1724; 12786, PLEKHA8, 64050, 166500, 339-1706; 12786, PLEKHA8, 64052, 166502, 403-1962; 12787, PLEKHA5, 64060, 166510, 209-3139; 12787, PLEKHA5, 64061, 166511, 660-3284; 12787, PLEKHA5, 64062, 166512, 1-406; 12787, PLEKHA5, 64063, 166513, 1-1194; 12787, PLEKHA5, 64064, 166514, 280-633; 12787, PLEKHA5, 64055, 166505, 7-3357; 12787, PLEKHA5, 64056, 166506, 217-3513; 12787, PLEKHA5, 64057, 166507, 33-3881; 12787, PLEKHA5, 64058, 166508, 49-279; 12787, PLEKHA5, 64059, 166509, 5-3529; 12788, PLEKHA6, 64066, 166516, 318-3524; 12788, PLEKHA6, 64065, 166515, 318-3464; 12789, PLEKHA7, 64068, 166518, 82-539; 12789, PLEKHA7, 64069, 166519, 1-2261; 12789, PLEKHA7, 64070, 166520, 76-309; 12789, PLEKHA7, 64071, 166521, 43-3858; 12789, PLEKHA7, 64072, 166522, 173-543; 12789, PLEKHA7, 64067, 166517, 12-3377; 12790, PLEKHB1, 64077, 166527, 217-567; 12790, PLEKHB1, 64078, 166528, 124-562; 12790, PLEKHB1, 64079, 166529, 138-618; 12790, PLEKHB1, 64080, 166530, 229-433; 12790, PLEKHB1, 64081, 166531, 153-569; 12790, PLEKHB1, 64082, 166532, 40-579; 12790, PLEKHB1, 64083, 166533, 196-685; 12790, PLEKHB1, 64085, 166535, 281-534; 12790, PLEKHB1, 64086, 166536, 193-656; 12790, PLEKHB1, 64087, 166537, 124-577; 12790, PLEKHB1, 64088, 166538, 124-586; 12790, PLEKHB1, 64073, 166523, 230-799; 12790, PLEKHB1, 64074, 166524, 432-1163; 12790, PLEKHB1, 64075, 166525, 432-1058; 12790, PLEKHB1, 64076, 166526, 170-844; 12790, PLEKHB1, 64084, 166534, 362-931; 12791, PLEKHB2, 64090, 166540, 55-984; 12791, PLEKHB2, 64091, 166541, 561-1271; 12791, PLEKHB2, 64095, 166545, 561-1076; 12791, PLEKHB2, 64089, 166539, 464-1129; 12791, PLEKHB2, 64092, 166542, 561-1253; 12791, PLEKHB2, 64093, 166543, 518-1186; 12791, PLEKHB2, 64094, 166544, 796-1464; 12791, PLEKHB2, 64096, 166546, 72-608; 12791, PLEKHB2, 64097, 166547, 106-618; 12792, PLEKHD1, 64098, 166548, 213-1733; 12793, PLEKHF1, 64100, 166550, 298-543; 12793, PLEKHF1, 64101, 166551, 324-707; 12793, PLEKHF1, 64099, 166549, 467-1306; 12793, PLEKHF1, 64102, 166552, 354-1193; 12794, PLEKHF2, 64103, 166553, 242-991; 12794, PLEKHF2, 64104, 166554, 271-1020; 12795, PLEKHG1, 64106, 166556, 339-478; 12795, PLEKHG1, 64108, 166558, 1-1179; 12795, PLEKHG1, 64105, 166555, 212-4369; 12795, PLEKHG1, 64107, 166557, 313-4470; 12796, PLEKHG2, 64109, 166559, 1-3764; 12796, PLEKHG2, 64112, 166562, 102-482; 12796, PLEKHG2, 64113, 166563, 127-3840; 12796, PLEKHG2, 64114, 166564, 276-871; 12796, PLEKHG2, 64115, 166565, 1-348; 12796, PLEKHG2, 64116, 166566, 1-462; 12796, PLEKHG2, 64117, 166567, 1-125; 12796, PLEKHG2, 64118, 166568, 1-254; 12796, PLEKHG2, 64119, 166569, 286-431; 12796, PLEKHG2, 64120, 166570, 1-287; 12796, PLEKHG2, 64121, 166571, 1-312; 12796, PLEKHG2, 64110, 166560, 250-1983; 12796, PLEKHG2, 64111, 166561, 851-5011; 12797, PLEKHG3, 64124, 166574, 70-635; 12797, PLEKHG3, 64125, 166575, 367-554; 12797, PLEKHG3, 64127, 166577, 185-2359; 12797, PLEKHG3, 64128, 166578, 174-658; 12797, PLEKHG3, 64129, 166579, 309-2118; 12797, PLEKHG3, 64122, 166572, 148-3807; 12797, PLEKHG3, 64123, 166573, 270-3761; 12797, PLEKHG3, 64126, 166576, 208-2466; 12798, PLEKHG4, 64134, 166584, 346-574; 12798, PLEKHG4, 64135, 166585, 1-319; 12798, PLEKHG4, 64136, 166586, 340-560; 12798, PLEKHG4, 64137, 166587, 300-491; 12798, PLEKHG4, 64138, 166588, 236-466; 12798, PLEKHG4, 64139, 166589, 219-542; 12798, PLEKHG4, 64140, 166590, 407-514; 12798, PLEKHG4, 64143, 166593, 1-378; 12798, PLEKHG4, 64130, 166580, 2536-6111; 12798, PLEKHG4, 64131, 166581, 273-3848; 12798, PLEKHG4, 64132, 166582, 457-3789; 12798, PLEKHG4, 64133, 166583, 209-3784; 12798, PLEKHG4, 64141, 166591, 2536-3117; 12798, PLEKHG4, 64142, 166592, 150-731; 12799, PLEKHG4B, 64145, 166595, 1-1266; 12799, PLEKHG4B, 64144, 166594, 51-3866; 12800, PLEKHG5, 64150, 166600, 551-3109; 12800, PLEKHG5, 64146, 166596, 224-3244; 12800, PLEKHG5, 64147, 166597, 214-3006; 12800, PLEKHG5, 64148, 166598, 152-3172; 12800, PLEKHG5, 64149, 166599, 181-3312; 12800, PLEKHG5, 64151, 166601, 499-3750; 12800, PLEKHG5, 64152, 166602, 207-3227; 12800, PLEKHG5, 64153, 166603, 68-3256; 12800, PLEKHG5, 64154, 166604, 66-3323; 12800, PLEKHG5, 64155, 166605, 27-3254; 12801, PLEKHG6, 64160, 166610, 180-1667; 12801, PLEKHG6, 64156, 166606, 149-2521; 12801, PLEKHG6, 64157, 166607, 101-1063; 12801, PLEKHG6, 64158, 166608, 231-2603; 12801, PLEKHG6, 64159, 166609, 495-2771; 12802, PLEKHG7, 64162, 166612, 426-806; 12802, PLEKHG7, 64161, 166611, 185-1324; 12803, PLEKHH1, 64164, 166614, 1-547; 12803, PLEKHH1, 64165, 166615, 1-104; 12803, PLEKHH1, 64166, 166616, 1-244; 12803, PLEKHH1, 64163, 166613, 133-4227; 12804, PLEKHH2, 64168, 166618, 45-314; 12804, PLEKHH2, 64169, 166619, 1-267; 12804, PLEKHH2, 64167, 166617, 111-4592; 12805, PLEKHH3, 64170, 166620, 432-2804; 12805, PLEKHH3, 64171, 166621, 430-1047; 12805, PLEKHH3, 64172, 166622, 71-2188; 12805, PLEKHH3, 64173, 166623, 389-2770; 12806, PLEKHJ1, 64175, 166625, 51-503; 12806, PLEKHJ1, 64176, 166626, 25-858; 12806, PLEKHJ1, 64178, 166628, 47-331; 12806, PLEKHJ1, 64179, 166629, 79-603; 12806, PLEKHJ1, 64174, 166624, 73-522; 12806, PLEKHJ1, 64177, 166627, 1115-1564; 12807, PLEKHM1, 64181, 166631, 173-364; 12807, PLEKHM1, 64182, 166632, 182-603; 12807, PLEKHM1, 64183, 166633, 120-1127; 12807, PLEKHM1, 64184, 166634, 119-310; 12807, PLEKHM1, 64185, 166635, 132-431; 12807, PLEKHM1, 64186, 166636, 1-138; 12807, PLEKHM1, 64187, 166637, 132-587; 12807, PLEKHM1, 64188, 166638, 1-341; 12807, PLEKHM1, 64191, 166641, 1-341; 12807, PLEKHM1, 64192, 166642, 173-364; 12807, PLEKHM1, 64193, 166643, 119-310; 12807, PLEKHM1, 64194, 166644, 182-603; 12807, PLEKHM1, 64195, 166645, 132-587; 12807, PLEKHM1, 64196, 166646, 1-138; 12807, PLEKHM1, 64197, 166647, 132-431; 12807, PLEKHM1, 64198, 166648, 120-1127; 12807, PLEKHM1, 64199, 166649, 173-364; 12807, PLEKHM1, 64200, 166650, 132-587; 12807, PLEKHM1, 64201, 166651, 182-603; 12807, PLEKHM1, 64202, 166652, 132-431; 12807, PLEKHM1, 64203, 166653, 119-310; 12807, PLEKHM1, 64204, 166654, 1-341; 12807, PLEKHM1, 64205, 166655, 120-1127; 12807, PLEKHM1, 64206, 166656, 1-138; 12807, PLEKHM1, 64180, 166630, 135-3305; 12807, PLEKHM1, 64189, 166639, 135-3305; 12807, PLEKHM1, 64190, 166640, 135-3305; 12808, PLEKHM2, 64207, 166657, 170-3169; 12808, PLEKHM2, 64208, 166658, 228-3287; 12809, PLEKHM3, 64209, 166659, 1-1408; 12809, PLEKHM3, 64210, 166660, 429-2447; 12809, PLEKHM3, 64211, 166661, 491-2776; 12810, PLEKHN1, 64215, 166665, 1-531; 12810, PLEKHN1, 64212, 166662, 31-1761; 12810, PLEKHN1, 64213, 166663, 31-2022; 12810, PLEKHN1, 64214, 166664, 36-1871; 12811, PLEKHO1, 64217, 166667, 1022-1702; 12811, PLEKHO1, 64216, 166666, 279-1508; 12812, PLEKHO2, 64218, 166668, 129-1601; 12812, PLEKHO2, 64219, 166669, 135-1457; 12813, PLEKHS1, 64220, 166670, 159-755; 12813, PLEKHS1, 64222, 166672, 34-882; 12813, PLEKHS1, 64225, 166675, 1-589; 12813, PLEKHS1, 64221, 166671, 328-1419; 12813, PLEKHS1, 64223, 166673, 563-1960; 12813, PLEKHS1, 64224, 166674, 692-1792; 12813, PLEKHS1, 64226, 166676, 496-1596; 12814, PHIP, 64227, 166677, 169-5634; 12815, PHLDA1, 64229, 166679, 287-1069; 12815, PHLDA1, 64228, 166678, 2192-3397; 12815, PHLDA1, 64230, 166680, 36-1241; 12816, PHLDA2, 64231, 166681, 92-550; 12816, PHLDA2, 64232, 166682, 92-550; 12817, PHLDA3, 64233, 166683, 230-613; 12817, PHLDA3, 64234, 166684, 399-782; 12818, PHLDB1, 64240, 166690, 432-737; 12818, PHLDB1, 64241, 166691, 122-748; 12818, PHLDB1, 64242, 166692, 131-874; 12818, PHLDB1, 64243, 166693, 1-1926; 12818, PHLDB1, 64235, 166685, 79-4038; 12818, PHLDB1, 64236, 166686, 412-4545; 12818, PHLDB1, 64237, 166687, 264-3251; 12818, PHLDB1, 64238, 166688, 106-3093; 12818, PHLDB1, 64239, 166689, 131-4264; 12819, PHLDB2, 64248, 166698, 144-1703; 12819, PHLDB2, 64249, 166699, 134-1879; 12819, PHLDB2, 64250, 166700, 301-3646; 12819, PHLDB2, 64252, 166702, 23-2257; 12819, PHLDB2, 64244, 166694, 256-3969; 12819, PHLDB2, 64245, 166695, 98-3859; 12819, PHLDB2, 64246, 166696, 412-4044; 12819, PHLDB2, 64247, 166697, 412-4173; 12819, PHLDB2, 64251, 166701, 116-3748; 12820, PHLDB3, 64254, 166704, 1-366; 12820, PHLDB3, 64255, 166705, 244-546; 12820, PHLDB3, 64257, 166707, 1-696; 12820, PHLDB3, 64258, 166708, 297-627; 12820, PHLDB3, 64253, 166703, 362-2284; 12820, PHLDB3, 64256, 166706, 362-1201; 12821, PLEC, 64267, 166717, 14-583; 12821, PLEC, 64268, 166718, 1-598; 12821, PLEC, 64269, 166719, 334-583; 12821, PLEC, 64271, 166721, 43-564; 12821, PLEC, 64272, 166722, 7-2115; 12821, PLEC, 64259, 166709, 171-14225; 12821, PLEC, 64260, 166710, 130-13773; 12821, PLEC, 64261, 166711, 69-13712; 12821, PLEC, 64262, 166712, 150-13727; 12821, PLEC, 64263, 166713, 58-13659; 12821, PLEC, 64264, 166714, 10-13665; 12821, PLEC, 64265, 166715, 75-13622; 12821, PLEC, 64266, 166716, 39-13763; 12821, PLEC, 64270, 166720, 1-13713; 12822, PLAG1, 64273, 166723, 481-1983; 12822, PLAG1, 64274, 166724, 284-1540; 12822,

PLAG1, 64275, 166725, 397-1899; 12823, PLAGL1, 64280, 166730, 4416-5174; 12823, PLAGL1, 64285, 166735, 369-588; 12823, PLAGL1, 64287, 166737, 257-563; 12823, PLAGL1, 64288, 166738, 298-333; 12823, PLAGL1, 64289, 166739, 364-587; 12823, PLAGL1, 64290, 166740, 532-723; 12823, PLAGL1, 64291, 166741, 354-593; 12823, PLAGL1, 64276, 166726, 1150-2541; 12823, PLAGL1, 64277, 166727, 1915-3306; 12823, PLAGL1, 64278, 166728, 1269-2660; 12823, PLAGL1, 64279, 166729, 175-1410; 12823, PLAGL1, 64281, 166731, 283-1518; 12823, PLAGL1, 64282, 166732, 410-1645; 12823, PLAGL1, 64283, 166733, 724-2115; 12823, PLAGL1, 64284, 166734, 684-2075; 12823, PLAGL1, 64286, 166736, 1147-2538; 12824, PLAGL2, 64292, 166742, 266-1756; 12825, PTN, 64294, 166744, 338-838; 12825, PTN, 64293, 166743, 429-935; 12826, PLRG1, 64296, 166746, 87-723; 12826, PLRG1, 64298, 166748, 85-480; 12826, PLRG1, 64299, 166749, 87-263; 12826, PLRG1, 64300, 166750, 1-470; 12826, PLRG1, 64301, 166751, 1-321; 12826, PLRG1, 64295, 166745, 90-1607; 12826, PLRG1, 64297, 166747, 128-1672; 12827, PLXNA1, 64302, 166752, 1-5691; 12828, PLXNA2, 64303, 166753, 759-6443; 12829, PLXNA3, 64304, 166754, 176-5791; 12830, PLXNA4, 64305, 166755, 230-5914; 12830, PLXNA4, 64306, 166756, 964-6648; 12830, PLXNA4, 64307, 166757, 378-1946; 12830, PLXNA4, 64308, 166758, 136-1614; 12831, PLXNB1, 64309, 166759, 104-6511; 12831, PLXNB1, 64310, 166760, 271-6678; 12831, PLXNB1, 64311, 166761, 1-2190; 12831, PLXNB1, 64312, 166762, 1-5859; 12832, PLXNB2, 64314, 166764, 125-609; 12832, PLXNB2, 64315, 166765, 190-1620; 12832, PLXNB2, 64316, 166766, 1-704; 12832, PLXNB2, 64317, 166767, 1-567; 12832, PLXNB2, 64319, 166769, 1-253; 12832, PLXNB2, 64320, 166770, 347-1387; 12832, PLXNB2, 64321, 166771, 1790-2272; 12832, PLXNB2, 64313, 166763, 94-5610; 12832, PLXNB2, 64318, 166768, 142-5658; 12833, PLXNB3, 64323, 166773, 1-774; 12833, PLXNB3, 64324, 166774, 1-489; 12833, PLXNB3, 64325, 166775, 1-526; 12833, PLXNB3, 64322, 166772, 115-5844; 12833, PLXNB3, 64326, 166776, 272-6070; 12834, PLXNC1, 64328, 166778, 577-1500; 12834, PLXNC1, 64329, 166779, 238-2085; 12834, PLXNC1, 64330, 166780, 60-1310; 12834, PLXNC1, 64331, 166781, 248-557; 12834, PLXNC1, 64332, 166782, 201-527; 12834, PLXNC1, 64327, 166777, 250-4956; 12835, PLXND1, 64334, 166784, 1-338; 12835, PLXND1, 64335, 166785, 88-255; 12835, PLXND1, 64336, 166786, 1-507; 12835, PLXND1, 64337, 166787, 1-1141; 12835, PLXND1, 64338, 166788, 1-691; 12835, PLXND1, 64333, 166783, 180-5957; 12836, PLXDC1, 64340, 166790, 211-876; 12836, PLXDC1, 64341, 166791, 20-1402; 12836, PLXDC1, 64342, 166792, 247-619; 12836, PLXDC1, 64344, 166794, 253-552; 12836, PLXDC1, 64345, 166795, 272-565; 12836, PLXDC1, 64346, 166796, 1-547; 12836, PLXDC1, 64339, 166789, 213-1715; 12836, PLXDC1, 64343, 166793, 83-1096; 12837, PLXDC2, 64347, 166797, 842-2284; 12837, PLXDC2, 64348, 166798, 842-2431; 12838, PMF1-BGLAP, 64349, 166799, 8-535; 12838, PMF1-BGLAP, 64350, 166800, 10-672; 12838, PMF1-BGLAP, 64351, 166801, 8-436; 12838, PMF1-BGLAP, 64352, 166802, 35-670; 12839, PRAM1, 64354, 166804, 44-583; 12839, PRAM1, 64353, 166803, 522-2534; 12840, PMS1, 64355, 166805, 126-452; 12840, PMS1, 64356, 166806, 107-604; 12840, PMS1, 64357, 166807, 165-710; 12840, PMS1, 64360, 166810, 21-2153; 12840, PMS1, 64361, 166811, 111-331; 12840, PMS1, 64362, 166812, 84-881; 12840, PMS1, 64363, 166813, 772-3042; 12840, PMS1, 64365, 166815, 530-2533; 12840, PMS1, 64366, 166816, 199-2178; 12840, PMS1, 64368, 166818, 249-831; 12840, PMS1, 64369, 166819, 50-193; 12840, PMS1, 64370, 166820, 429-560; 12840, PMS1, 64371, 166821, 530-1276; 12840, PMS1, 64372, 166822, 955-3225; 12840, PMS1, 64358, 166808, 114-2795; 12840, PMS1, 64359, 166809, 1-1668; 12840, PMS1, 64364, 166814, 71-2383; 12840, PMS1, 64367, 166817, 234-3032; 12841, PMS2, 64375, 166825, 303-2573; 12841, PMS2, 64373, 166823, 107-2695; 12841, PMS2, 64374, 166824, 1-1386; 12842, PNISR, 64376, 166826, 206-2623; 12842, PNISR, 64377, 166827, 149-2566; 12842, PNISR, 64378, 166828, 206-1447; 12843, POC1A, 64379, 166829, 41-1264; 12843, POC1A, 64380, 166830, 319-1398; 12843, POC1A, 64381, 166831, 218-1327; 12844, POC1B, 64383, 166833, 615-1661; 12844, POC1B, 64384, 166834, 106-258; 12844, POC1B, 64386, 166836, 106-381; 12844, POC1B, 64387, 166837, 126-278; 12844, POC1B, 64388, 166838, 103-255; 12844, POC1B, 64389, 166839, 205-486; 12844, POC1B, 64382, 166832, 130-1566; 12844, POC1B, 64385, 166835, 471-1781; 12845, POC1B-GALNT4, 64390, 166840, 368-496; 12845, POC1B-GALNT4, 64391, 166841, 304-2031; 12846, P005, 64394, 166844, 108-1751; 12846, P005, 64395, 166845, 411-896; 12846, P005, 64396, 166846, 347-443; 12846, P005, 64397, 166847, 250-401; 12846, P005, 64398, 166848, 134-310; 12846, P005, 64392, 166842, 72-1724; 12846, P005, 64393, 166843, 191-1918; 12846, P005, 64399, 166849, 321-1520; 12847, PODXL, 64402, 166852, 205-1179; 12847, PODXL, 64400, 166850, 251-1831; 12847, PODXL, 64401, 166851, 249-1925; 12848, PODXL2, 64403, 166853, 40-1857; 12849, PODN, 64404, 166854, 8-1993; 12849, PODN, 64405, 166855, 342-2270; 12849, PODN, 64406, 166856, 169-1728; 12849, PODN, 64407, 166857, 121-2049; 12850, PODNL1, 64408, 166858, 217-1509; 12850, PODNL1, 64412, 166862, 1-545; 12850, PODNL1, 64413, 166863, 167-537; 12850, PODNL1, 64414, 166864, 1-716; 12850, PODNL1, 64415, 166865, 466-562; 12850, PODNL1, 64416, 166866, 248-739; 12850, PODNL1, 64417, 166867, 1-454; 12850, PODNL1, 64418, 166868, 1-408; 12850, PODNL1, 64409, 166859, 275-1813; 12850, PODNL1, 64410, 166860, 246-1511; 12850, PODNL1, 64411, 166861, 257-1789; 12851, PDPN, 64422, 166872, 1-283; 12851, PDPN, 64423, 166873, 45-518; 12851, PDPN, 64426, 166876, 220-351; 12851, PDPN, 64427, 166877, 202-687; 12851, PDPN, 64419, 166869, 342-1058; 12851, PDPN, 64420, 166870, 45-755; 12851, PDPN, 64421, 166871, 135-497; 12851, PDPN, 64424, 166874, 290-652; 12851, PDPN, 64425, 166875, 157-513; 12851, PDPN, 64428, 166878, 239-601; 12851, PDPN, 64429, 166879, 204-692; 12851, PDPN, 64430, 166880, 50-766; 12852, POGK, 64433, 166883, 326-954; 12852, POGK, 64431, 166881, 361-2190; 12852, POGK, 64432, 166882, 151-1980; 12853, POGZ, 64438, 166888, 176-199; 12853, POGZ, 64439, 166889, 238-489; 12853, POGZ, 64440, 166890, 1-181; 12853, POGZ, 64443, 166893, 1-949; 12853, POGZ, 64444, 166894, 168-586; 12853, POGZ, 64445, 166895, 98-550; 12853, POGZ, 64446, 166896, 1-329; 12853, POGZ, 64434, 166884, 316-4548; 12853, POGZ, 64435, 166885, 30-3977; 12853, POGZ, 64436, 166886, 1-4074; 12853, POGZ, 64437, 166887, 30-4235; 12853, POGZ, 64441, 166891, 30-4130; 12853, POGZ, 64442, 166892, 66-4112; 12854, PVR, 64447, 166897, 184-318; 12854, PVR, 64449, 166899, 1-1179; 12854, PVR, 64451, 166901, 300-1553; 12854, PVR, 64452, 166902, 1-211; 12854, PVR, 64448, 166898, 300-1394; 12854, PVR, 64450, 166900, 188-1306; 12855, PVRIG, 64453, 166903, 364-1344; 12856, PVRL1, 64454, 166904, 532-2085; 12856, PVRL1, 64455, 166905, 1-1377; 12856, PVRL1, 64456, 166906, 1-1059; 12857, PVRL2, 64459, 166909, 1-171; 12857, PVRL2, 64460, 166910, 1-632; 12857, PVRL2, 64461, 166911, 1-163; 12857, PVRL2, 64457, 166907, 1-1617; 12857, PVRL2, 64458, 166908, 352-1791; 12858, PVRL3, 64463, 166913, 1-732; 12858, PVRL3, 64465, 166915, 197-586; 12858, PVRL3, 64466, 166916, 513-564; 12858, PVRL3, 64467, 166917, 1-96; 12858, PVRL3, 64468, 166918, 26-530; 12858, PVRL3, 64462, 166912, 151-1251; 12858, PVRL3, 64464, 166914, 276-1925; 12858, PVRL3, 64469, 166919, 253-1716; 12859, PVRL4, 64470, 166920, 304-1836; 12860, PLK1, 64472, 166922, 396-711; 12860, PLK1, 64473, 166923, 408-582; 12860, PLK1, 64474, 166924, 65-586; 12860, PLK1, 64471, 166921, 112-1923; 12861, PLK2, 64476, 166926, 181-2196; 12861, PLK2, 64475, 166925, 302-2359; 12862, PLK3, 64477, 166927, 240-2180; 12863, PLK4, 64479, 166929, 227-2905; 12863, PLK4, 64480, 166930, 207-2936; 12863, PLK4, 64483, 166933, 1-596; 12863, PLK4, 64478, 166928, 275-3187; 12863, PLK4, 64481, 166931, 233-3022; 12863, PLK4, 64482, 166932, 209-3025; 12864, PLK5, 64484, 166934, 1-900; 12864, PLK5, 64485, 166935, 890-1900; 12864, PLK5, 64486, 166936, 717-1727; 12865, PARG, 64488, 166938, 262-513; 12865, PARG, 64489, 166939, 274-507; 12865, PARG, 64487, 166937, 137-3067; 12865, PARG, 64490, 166940, 261-3191; 12866, PARP1, 64491, 166941, 54-521; 12866, PARP1, 64492, 166942, 147-473; 12866, PARP1, 64494, 166944, 151-477; 12866, PARP1, 64493, 166943, 145-3189; 12867, PARP2, 64497, 166947, 15-347; 12867, PARP2, 64498, 166948, 6-1601; 12867, PARP2, 64499, 166949, 1-532; 12867, PARP2, 64495, 166945, 28-1779; 12867, PARP2, 64496, 166946, 61-1773; 12868, PARP10, 64500, 166950, 72-1090; 12868, PARP10, 64502, 166952, 514-899; 12868, PARP10, 64503, 166953, 88-3138; 12868, PARP10, 64504, 166954, 170-685; 12868, PARP10, 64505, 166955, 146-578; 12868, PARP10, 64506, 166956, 64-2358; 12868, PARP10, 64507, 166957, 258-500; 12868, PARP10, 64508, 166958, 183-589; 12868, PARP10, 64509, 166959, 210-529; 12868, PARP10, 64510, 166960, 190-3303; 12868, PARP10, 64511, 166961, 233-481; 12868, PARP10, 64512, 166962, 126-564; 12868, PARP10, 64513, 166963, 405-939; 12868, PARP10, 64514, 166964, 323-588; 12868, PARP10, 64515, 166965, 265-696; 12868, PARP10, 64501, 166951, 96-3173; 12869, PARP11, 64517, 166967, 400-539; 12869, PARP11, 64518, 166968, 208-927; 12869, PARP11, 64519, 166969, 122-679; 12869, PARP11, 64521, 166971, 142-294; 12869, PARP11, 64516, 166966, 146-1162; 12869, PARP11, 64520, 166970, 371-1144; 12869, PARP11, 64522, 166972, 342-1115; 12870, PARP12, 64524, 166974, 1-522; 12870, PARP12, 64525, 166975, 87-1349; 12870, PARP12, 64526, 166976, 1-137; 12870, PARP12, 64527, 166977, 1-230; 12870, PARP12, 64523, 166973, 875-2980; 12871, PARP14, 64529, 166979, 1-581; 12871, PARP14, 64530, 166980, 1-4566; 12871, PARP14, 64528, 166978, 267-5672; 12872, PARP15, 64533, 166983, 41-1492; 12872, PARP15, 64534, 166984, 96-1223; 12872, PARP15, 64531, 166981, 96-1430; 12872, PARP15, 64532, 166982, 67-2103; 12873, PARP16, 64537, 166987, 1-217; 12873, PARP16, 64535, 166985, 447-1418; 12873, PARP16, 64536, 166986, 418-1041; 12874, PARP3, 64539, 166989, 489-2090; 12874, PARP3, 64540, 166990, 372-1973; 12874, PARP3, 64541, 166991, 320-481; 12874, PARP3, 64542, 166992, 46-1040; 12874, PARP3, 64538, 166988, 332-1954; 12875, PARP4, 64543, 166993, 107-5281; 12876, PARP6, 64546, 166996, 60-1718; 12876, PARP6, 64547, 166997, 388-1143; 12876, PARP6, 64548, 166998, 1-54; 12876, PARP6, 64549, 166999, 1-1694; 12876, PARP6, 64550, 167000, 1-220; 12876, PARP6, 64552, 167002, 224-1783; 12876, PARP6, 64553, 167003, 1-1354; 12876, PARP6, 64554, 167004, 1-242; 12876, PARP6, 64555, 167005, 1-230; 12876, PARP6, 64556, 167006, 751-829; 12876, PARP6, 64557, 167007, 1-373; 12876, PARP6, 64558, 167008, 376-596; 12876, PARP6, 64559, 167009, 47-1369; 12876, PARP6, 64544, 166994, 47-1603; 12876, PARP6, 64545, 166995, 460-2352; 12876, PARP6, 64551, 167001, 689-2581; 12877, PARP8, 64561, 167011, 109-246; 12877, PARP8, 64562, 167012, 116-464; 12877, PARP8, 64563, 167013, 181-330; 12877, PARP8, 64565, 167015, 92-367; 12877, PARP8, 64566, 167016, 130-531; 12877, PARP8, 64567, 167017, 322-513; 12877, PARP8, 64568, 167018, 18-2519; 12877, PARP8, 64569, 167019, 8-769; 12877, PARP8, 64571, 167021, 93-266; 12877, PARP8, 64572, 167022, 101-332; 12877, PARP8, 64573, 167023, 130-420; 12877, PARP8, 64574, 167024, 130-303; 12877, PARP8, 64575, 167025, 900-2384; 12877, PARP8, 64576, 167026, 758-2239; 12877, PARP8, 64560, 167010, 159-2723; 12877, PARP8, 64564, 167014, 183-2747; 12877, PARP8, 64570, 167020, 118-2556; 12878, PARP9, 64578, 167028, 233-1432; 12878, PARP9, 64582, 167032, 222-567; 12878, PARP9, 64577, 167027, 229-2793; 12878, PARP9, 64579, 167029, 295-2427; 12878, PARP9, 64580, 167030, 222-2681; 12878, PARP9, 64581, 167031, 229-2688; 12879, PAIP1, 64586, 167036, 208-1008; 12879, PAIP1, 64587, 167037, 232-1287; 12879, PAIP1, 64588, 167038, 442-726; 12879, PAIP1, 64589, 167039, 106-706; 12879, PAIP1, 64590, 167040, 248-752; 12879, PAIP1, 64591, 167041, 1-150; 12879, PAIP1, 64592, 167042, 473-501; 12879, PAIP1, 64583, 167033, 234-1673; 12879, PAIP1, 64584, 167034, 428-1531; 12879, PAIP1, 64585, 167035, 248-1450; 12880, PAIP2, 64596, 167046, 130-333; 12880, PAIP2, 64597, 167047, 498-776; 12880, PAIP2, 64593, 167043, 176-559; 12880, PAIP2, 64594, 167044, 992-1375; 12880, PAIP2, 64595, 167045, 193-576; 12881, PAIP2B, 64598, 167048, 168-539; 12882, PABPC1, 64600, 167050, 1-394; 12882, PABPC1, 64601, 167051, 1-851; 12882, PABPC1, 64602, 167052, 1-509; 12882, PABPC1, 64603, 167053, 1-411; 12882, PABPC1, 64604, 167054, 1-560; 12882, PABPC1, 64605, 167055, 363-493; 12882, PABPC1, 64606, 167056, 1-552; 12882, PABPC1, 64607, 167057, 310-492; 12882, PABPC1, 64608, 167058, 1-496; 12882, PABPC1, 64609, 167059, 339-453; 12882, PABPC1, 64610, 167060, 242-628; 12882, PABPC1, 64611, 167061, 317-2131; 12882, PABPC1, 64612, 167062, 364-2139; 12882, PABPC1, 64613, 167063, 369-593; 12882, PABPC1, 64614, 167064, 1-522; 12882, PABPC1, 64615, 167065, 401-754; 12882, PABPC1, 64616, 167066, 308-631; 12882, PABPC1, 64617, 167067, 1-128; 12882, PABPC1, 64618, 167068, 1-1569; 12882, PABPC1, 64599, 167049, 1130-3040; 12883, PABPC1L, 64621, 167071, 41-556; 12883, PABPC1L, 64623, 167073, 902-1351; 12883, PABPC1L, 64624, 167074, 1-405; 12883, PABPC1L, 64625, 167075, 1519-2025; 12883, PABPC1L, 64626, 167076, 1-458; 12883, PABPC1L, 64627, 167077, 391-915; 12883, PABPC1L, 64619, 167069, 1-1845; 12883, PABPC1L, 64620, 167070, 83-1075; 12883, PABPC1L, 64622, 167072, 83-1927; 12883, PABPC1L, 64628, 167078, 21-1013; 12884, PABPC1L2A, 64629, 167079, 127-729; 12885, PABPC1L2B, 64630, 167080, 127-729; 12886, PABPC3, 64631, 167081, 332-2227; 12887, PABPC4, 64635, 167085, 303-2150; 12887, PABPC4, 64636, 167086, 1-1652; 12887, PABPC4, 64637, 167087, 512-898; 12887, PABPC4, 64638, 167088, 1-587; 12887, PABPC4, 64639, 167089, 1-591; 12887, PABPC4, 64640, 167090, 1-337;

12887, PABPC4, 64641, 167091, 1-206; 12887, PABPC4, 64642, 167092, 1-746; 12887, PABPC4, 64643, 167093, 519-532; 12887, PABPC4, 64632, 167082, 801-2696; 12887, PABPC4, 64633, 167083, 794-2728; 12887, PABPC4, 64634, 167084, 451-2433; 12888, PABPC4L, 64644, 167094, 258-1370; 12889, PABPC5, 64646, 167096, 332-988; 12889, PABPC5, 64645, 167095, 215-1363; 12890, PABPN1, 64649, 167099, 193-699; 12890, PABPN1, 64650, 167100, 1-289; 12890, PABPN1, 64651, 167101, 672-1208; 12890, PABPN1, 64647, 167097, 182-1102; 12890, PABPN1, 64648, 167098, 14-904; 12891, PABPN1L, 64654, 167104, 55-854; 12891, PABPN1L, 64652, 167102, 55-822; 12891, PABPN1L, 64653, 167103, 13-849; 12892, PAPOLA, 64656, 167106, 36-2210; 12892, PAPOLA, 64658, 167108, 847-2272; 12892, PAPOLA, 64659, 167109, 1-611; 12892, PAPOLA, 64660, 167110, 153-869; 12892, PAPOLA, 64661, 167111, 52-584; 12892, PAPOLA, 64662, 167112, 196-531; 12892, PAPOLA, 64663, 167113, 1-542; 12892, PAPOLA, 64664, 167114, 1-221; 12892, PAPOLA, 64655, 167105, 221-2458; 12892, PAPOLA, 64657, 167107, 193-1050; 12893, PAPOLB, 64665, 167115, 185-2098; 12894, PAPOLG, 64667, 167117, 1-1149; 12894, PAPOLG, 64668, 167118, 200-904; 12894, PAPOLG, 64669, 167119, 1-507; 12894, PAPOLG, 64666, 167116, 250-2460; 12895, PARN, 64674, 167124, 94-717; 12895, PARN, 64675, 167125, 1-783; 12895, PARN, 64676, 167126, 249-577; 12895, PARN, 64677, 167127, 136-333; 12895, PARN, 64681, 167131, 94-717; 12895, PARN, 64682, 167132, 1-783; 12895, PARN, 64683, 167133, 136-333; 12895, PARN, 64684, 167134, 249-577; 12895, PARN, 64670, 167120, 252-1988; 12895, PARN, 64671, 167121, 143-2062; 12895, PARN, 64672, 167122, 135-1916; 12895, PARN, 64673, 167123, 114-1508; 12895, PARN, 64678, 167128, 143-2062; 12895, PARN, 64679, 167129, 135-1916; 12895, PARN, 64680, 167130, 252-1988; 12895, PARN, 64685, 167135, 114-1508; 12896, PNLDC1, 64686, 167136, 40-159; 12896, PNLDC1, 64689, 167139, 38-157; 12896, PNLDC1, 64690, 167140, 43-162; 12896, PNLDC1, 64687, 167137, 35-1630; 12896, PNLDC1, 64688, 167138, 192-1754; 12897, PCBP1, 64691, 167141, 291-1361; 12898, PCBP2, 64698, 167148, 208-681; 12898, PCBP2, 64699, 167149, 1-609; 12898, PCBP2, 64700, 167150, 327-1292; 12898, PCBP2, 64701, 167151, 543-734; 12898, PCBP2, 64702, 167152, 1-933; 12898, PCBP2, 64704, 167154, 274-753; 12898, PCBP2, 64708, 167158, 1-338; 12898, PCBP2, 64709, 167159, 1-904; 12898, PCBP2, 64710, 167160, 418-527; 12898, PCBP2, 64711, 167161, 1-554; 12898, PCBP2, 64692, 167142, 351-1346; 12898, PCBP2, 64693, 167143, 324-1424; 12898, PCBP2, 64694, 167144, 65-1021; 12898, PCBP2, 64695, 167145, 351-1307; 12898, PCBP2, 64696, 167146, 351-1358; 12898, PCBP2, 64697, 167147, 23-1120; 12898, PCBP2, 64703, 167153, 128-1216; 12898, PCBP2, 64705, 167155, 85-1170; 12898, PCBP2, 64706, 167156, 17-1024; 12898, PCBP2, 64707, 167157, 68-1036; 12899, PCBP3, 64712, 167162, 1-1086; 12899, PCBP3, 64713, 167163, 1-969; 12899, PCBP3, 64718, 167168, 193-1278; 12899, PCBP3, 64719, 167169, 228-243; 12899, PCBP3, 64714, 167164, 126-1163; 12899, PCBP3, 64715, 167165, 126-1238; 12899, PCBP3, 64716, 167166, 365-1420; 12899, PCBP3, 64717, 167167, 339-1454; 12900, PCBP4, 64722, 167172, 148-1281; 12900, PCBP4, 64726, 167176, 240-559; 12900, PCBP4, 64727, 167177, 252-510; 12900, PCBP4, 64728, 167178, 528-701; 12900, PCBP4, 64729, 167179, 204-1175; 12900, PCBP4, 64730, 167180, 340-563; 12900, PCBP4, 64731, 167181, 464-837; 12900, PCBP4, 64732, 167182, 425-562; 12900, PCBP4, 64733, 167183, 200-704; 12900, PCBP4, 64734, 167184, 265-539; 12900, PCBP4, 64720, 167170, 148-1359; 12900, PCBP4, 64721, 167171, 197-1408; 12900, PCBP4, 64723, 167173, 148-1230; 12900, PCBP4, 64724, 167174, 324-1406; 12900, PCBP4, 64725, 167175, 333-1544; 12901, PMFBP1, 64737, 167187, 235-540; 12901, PMFBP1, 64738, 167188, 1-1509; 12901, PMFBP1, 64739, 167189, 255-458; 12901, PMFBP1, 64740, 167190, 265-407; 12901, PMFBP1, 64741, 167191, 226-556; 12901, PMFBP1, 64742, 167192, 1-351; 12901, PMFBP1, 64743, 167193, 160-3228; 12901, PMFBP1, 64744, 167194, 90-559; 12901, PMFBP1, 64735, 167185, 263-3286; 12901, PMFBP1, 64736, 167186, 615-3263; 12902, PAOX, 64748, 167198, 142-480; 12902, PAOX, 64745, 167195, 84-1619; 12902, PAOX, 64746, 167196, 31-1008; 12902, PAOX, 64747, 167197, 57-1517; 12902, PAOX, 64749, 167199, 31-240; 12902, PAOX, 64750, 167200, 31-240; 12902, PAOX, 64751, 167201, 31-240; 12902, PAOX, 64752, 167202, 31-1008; 12903, PMF1, 64756, 167206, 1-281; 12903, PMF1, 64757, 167207, 12-275; 12903, PMF1, 64753, 167203, 11-634; 12903, PMF1, 64754, 167204, 10-627; 12903, PMF1, 64755, 167205, 24-566; 12904, PBRM1, 64766, 167216, 4-4385; 12904, PBRM1, 64767, 167217, 327-783; 12904, PBRM1, 64768, 167218, 380-457; 12904, PBRM1, 64769, 167219, 1-3256; 12904, PBRM1, 64771, 167221, 418-547; 12904, PBRM1, 64772, 167222, 118-809; 12904, PBRM1, 64773, 167223, 348-476; 12904, PBRM1, 64774, 167224, 163-517; 12904, PBRM1, 64775, 167225, 257-517; 12904, PBRM1, 64758, 167208, 3-5072; 12904, PBRM1, 64759, 167209, 4-4752; 12904, PBRM1, 64760, 167210, 4-4812; 12904, PBRM1, 64761, 167211, 101-4849; 12904, PBRM1, 64762, 167212, 4-4833; 12904, PBRM1, 64763, 167213, 4-4908; 12904, PBRM1, 64764, 167214, 4-4797; 12904, PBRM1, 64765, 167215, 4-4962; 12904, PBRM1, 64770, 167220, 4-2574; 12905, PCGF1, 64777, 167227, 197-910; 12905, PCGF1, 64776, 167226, 913-1692; 12906, PCGF2, 64778, 167228, 244-1278; 12906, PCGF2, 64780, 167230, 347-1120; 12906, PCGF2, 64783, 167233, 1-200; 12906, PCGF2, 64784, 167234, 317-1090; 12906, PCGF2, 64785, 167235, 209-820; 12906, PCGF2, 64786, 167236, 1-200; 12906, PCGF2, 64787, 167237, 209-820; 12906, PCGF2, 64788, 167238, 347-1120; 12906, PCGF2, 64789, 167239, 317-1090; 12906, PCGF2, 64790, 167240, 202-1236; 12906, PCGF2, 64791, 167241, 703-1737; 12906, PCGF2, 64779, 167229, 202-1236; 12906, PCGF2, 64781, 167231, 703-1737; 12906, PCGF2, 64782, 167232, 244-1278; 12907, PCGF3, 64793, 167243, 377-898; 12907, PCGF3, 64794, 167244, 313-639; 12907, PCGF3, 64795, 167245, 395-582; 12907, PCGF3, 64796, 167246, 329-673; 12907, PCGF3, 64797, 167247, 317-661; 12907, PCGF3, 64798, 167248, 468-589; 12907, PCGF3, 64801, 167251, 788-1186; 12907, PCGF3, 64792, 167242, 396-1124; 12907, PCGF3, 64799, 167249, 395-1123; 12907, PCGF3, 64800, 167250, 45-773; 12908, PCGF5, 64802, 167252, 233-1003; 12908, PCGF5, 64803, 167253, 361-1131; 12908, PCGF5, 64804, 167254, 254-1024; 12909, PCGF6, 64805, 167255, 14-841; 12909, PCGF6, 64806, 167256, 69-1121; 12910, PKHD1, 64807, 167257, 262-10452; 12910, PKHD1, 64808, 167258, 277-12501; 12911, PKHD1L1, 64810, 167260, 1-3516; 12911, PKHD1L1, 64809, 167259, 105-12836; 12912, PKD1, 64813, 167263, 1-275; 12912, PKD1, 64814, 167264, 1-465; 12912, PKD1, 64815, 167265, 1-737; 12912, PKD1, 64816, 167266, 1-3369; 12912, PKD1, 64817, 167267, 1-603; 12912, PKD1, 64818, 167268, 1-1822; 12912, PKD1, 64819, 167269, 1-137; 12912, PKD1, 64811, 167261, 210-13121; 12912, PKD1, 64812, 167262, 210-13118; 12913, PKD1L1, 64821, 167271, 1-493; 12913, PKD1L1, 64820, 167270, 52-8601; 12914, PKD1L2, 64824, 167274, 1-7379; 12914, PKD1L2, 64825, 167275, 112-5435; 12914, PKD1L2, 64827, 167277, 1-1558; 12914, PKD1L2, 64828, 167278, 1-7377; 12914, PKD1L2, 64822, 167272, 1-2976; 12914, PKD1L2, 64823, 167273, 115-837; 12914, PKD1L2, 64826, 167276, 117-1037; 12915, PKD1L3, 64829, 167279, 1-5199; 12916, PKD2, 64831, 167281, 51-1211; 12916, PKD2, 64832, 167282, 396-1556; 12916, PKD2, 64830, 167280, 67-2973; 12917, PKD2L1, 64834, 167284, 1-187; 12917, PKD2L1, 64835, 167285, 162-377; 12917, PKD2L1, 64836, 167286, 1-119; 12917, PKD2L1, 64833, 167283, 384-2801; 12918, PKD2L2, 64840, 167290, 579-830; 12918, PKD2L2, 64842, 167292, 1380-1927; 12918, PKD2L2, 64837, 167287, 24-1865; 12918, PKD2L2, 64838, 167288, 35-208; 12918, PKD2L2, 64839, 167289, 56-1627; 12918, PKD2L2, 64841, 167291, 27-1901; 12918, PKD2L2, 64843, 167293, 32-1840; 12919, PKDREJ, 64844, 167294, 34-6795; 12920, PQBP1, 64851, 167301, 1-451; 12920, PQBP1, 64852, 167302, 106-744; 12920, PQBP1, 64845, 167295, 258-1055; 12920, PQBP1, 64846, 167296, 94-606; 12920, PQBP1, 64847, 167297, 201-998; 12920, PQBP1, 64848, 167298, 190-702; 12920, PQBP1, 64849, 167299, 110-907; 12920, PQBP1, 64850, 167300, 171-968; 12921, PHC1, 64853, 167303, 146-3025; 12921, PHC1, 64854, 167304, 95-642; 12921, PHC1, 64855, 167305, 104-641; 12921, PHC1, 64856, 167306, 104-618; 12921, PHC1, 64859, 167309, 1-561; 12921, PHC1, 64860, 167310, 359-913; 12921, PHC1, 64861, 167311, 1-395; 12921, PHC1, 64862, 167312, 24-497; 12921, PHC1, 64863, 167313, 1-300; 12921, PHC1, 64857, 167307, 136-3150; 12921, PHC1, 64858, 167308, 333-3347; 12922, PHC2, 64866, 167316, 166-1560; 12922, PHC2, 64867, 167317, 55-2547; 12922, PHC2, 64864, 167314, 55-2631; 12922, PHC2, 64865, 167315, 340-1311; 12923, PHC3, 64868, 167318, 1-670; 12923, PHC3, 64869, 167319, 33-476; 12923, PHC3, 64870, 167320, 33-632; 12923, PHC3, 64871, 167321, 35-580; 12923, PHC3, 64872, 167322, 16-657; 12923, PHC3, 64873, 167323, 1-485; 12923, PHC3, 64874, 167324, 35-2521; 12923, PHC3, 64875, 167325, 31-772; 12923, PHC3, 64879, 167329, 60-233; 12923, PHC3, 64876, 167326, 70-3021; 12923, PHC3, 64877, 167327, 33-3020; 12923, PHC3, 64878, 167328, 19-474; 12924, POLI, 64880, 167330, 1-2037; 12924, POLI, 64881, 167331, 29-2014; 12924, POLI, 64882, 167332, 142-577; 12924, POLI, 64883, 167333, 1-258; 12924, POLI, 64885, 167335, 535-2448; 12924, POLI, 64886, 167336, 1-428; 12924, POLI, 64887, 167337, 538-1204; 12924, POLI, 64888, 167338, 1-159; 12924, POLI, 64889, 167339, 1-585; 12924, POLI, 64884, 167334, 144-2366; 12925, POLK, 64891, 167341, 1-273; 12925, POLK, 64892, 167342, 167-439; 12925, POLK, 64893, 167343, 134-1324; 12925, POLK, 64895, 167345, 14-1297; 12925, POLK, 64898, 167348, 1-273; 12925, POLK, 64900, 167350, 1029-1452; 12925, POLK, 64890, 167340, 173-2785; 12925, POLK, 64894, 167344, 274-1392; 12925, POLK, 64896, 167346, 1-1470; 12925, POLK, 64897, 167347, 14-1432; 12925, POLK, 64899, 167349, 1-1386; 12925, POLK, 64901, 167351, 1-2019; 12926, POLN, 64903, 167353, 1-1574; 12926, POLN, 64902, 167352, 1-2703; 12926, POLN, 64904, 167354, 355-3057; 12927, POLA1, 64906, 167356, 44-4450; 12927, POLA1, 64907, 167357, 16-4401; 12927, POLA1, 64905, 167355, 16-4404; 12928, POLA2, 64909, 167359, 374-487; 12928, POLA2, 64910, 167360, 143-580; 12928, POLA2, 64911, 167361, 1-785; 12928, POLA2, 64908, 167358, 532-2328; 12929, POLB, 64913, 167363, 21-149; 12929, POLB, 64914, 167364, 1-320; 12929, POLB, 64915, 167365, 1-90; 12929, POLB, 64916, 167366, 119-700; 12929, POLB, 64917, 167367, 1-712; 12929, POLB, 64918, 167368, 1-719; 12929, POLB, 64919, 167369, 571-725; 12929, POLB, 64920, 167370, 144-983; 12929, POLB, 64921, 167371, 471-635; 12929, POLB, 64922, 167372, 561-675; 12929, POLB, 64912, 167362, 171-1178; 12930, POLD1, 64924, 167374, 1-867; 12930, POLD1, 64925, 167375, 1-873; 12930, POLD1, 64926, 167376, 1-563; 12930, POLD1, 64927, 167377, 189-3218; 12930, POLD1, 64928, 167378, 1-3402; 12930, POLD1, 64929, 167379, 177-783; 12930, POLD1, 64930, 167380, 380-695; 12930, POLD1, 64932, 167382, 70-3471; 12930, POLD1, 64923, 167373, 54-3377; 12930, POLD1, 64931, 167381, 45-3368; 12931, POLD2, 64933, 167383, 144-1511; 12931, POLD2, 64935, 167385, 106-765; 12931, POLD2, 64937, 167387, 200-665; 12931, POLD2, 64938, 167388, 1-249; 12931, POLD2, 64939, 167389, 113-556; 12931, POLD2, 64940, 167390, 84-854; 12931, POLD2, 64941, 167391, 1-1515; 12931, POLD2, 64934, 167384, 651-2060; 12931, POLD2, 64936, 167386, 250-1659; 12932, POLE2, 64945, 167395, 1-291; 12932, POLE2, 64942, 167392, 101-1684; 12932, POLE2, 64943, 167393, 220-1725; 12932, POLE2, 64944, 167394, 8-1516; 12933, POLE3, 64946, 167396, 90-533; 12933, POLE3, 64947, 167397, 172-615; 12934, POLE, 64949, 167399, 33-965; 12934, POLE, 64950, 167400, 14-6793; 12934, POLE, 64951, 167401, 1-451; 12934, POLE, 64952, 167402, 1-464; 12934, POLE, 64948, 167398, 45-6905; 12935, POLH, 64955, 167405, 117-331; 12935, POLH, 64953, 167403, 149-1393; 12935, POLH, 64954, 167404, 296-2437; 12936, POLG, 64958, 167408, 1-207; 12936, POLG, 64959, 167409, 1-700; 12936, POLG, 64960, 167410, 1-591; 12936, POLG, 64961, 167411, 1-208; 12936, POLG, 64962, 167412, 1-154; 12936, POLG, 64963, 167413, 305-1078; 12936, POLG, 64956, 167406, 335-4054; 12936, POLG, 64957, 167407, 337-4056; 12937, POLG2, 64965, 167415, 1-456; 12937, POLG2, 64966, 167416, 1-246; 12937, POLG2, 64964, 167414, 69-1526; 12938, POLL, 64968, 167418, 822-1718; 12938, POLL, 64970, 167420, 219-965; 12938, POLL, 64972, 167422, 274-1737; 12938, POLL, 64973, 167423, 229-683; 12938, POLL, 64974, 167424, 50-855; 12938, POLL, 64975, 167425, 47-1457; 12938, POLL, 64976, 167426, 131-784; 12938, POLL, 64977, 167427, 46-1049; 12938, POLL, 64978, 167428, 458-1022; 12938, POLL, 64967, 167417, 372-2099; 12938, POLL, 64969, 167419, 496-2223; 12938, POLL, 64971, 167421, 62-1789; 12938, POLL, 64979, 167429, 482-1384; 12939, POLM, 64983, 167433, 53-520; 12939, POLM, 64984, 167434, 74-550; 12939, POLM, 64985, 167435, 46-747; 12939, POLM, 64986, 167436, 77-805; 12939, POLM, 64987, 167437, 63-569; 12939, POLM, 64988, 167438, 93-587; 12939, POLM, 64989, 167439, 1-406; 12939, POLM, 64990, 167440, 74-886; 12939, POLM, 64980, 167430, 103-1587; 12939, POLM, 64981, 167431, 27-1400; 12939, POLM, 64982, 167432, 48-1574; 12940, POLQ, 64992, 167442, 1-8178; 12940, POLQ, 64991, 167441, 130-7902; 12941, POLD3, 64994, 167444, 181-513; 12941, POLD3, 64995, 167445, 346-854; 12941, POLD3, 64997, 167447, 1-449; 12941, POLD3, 64999, 167449, 1-268; 12941, POLD3, 65000, 167450, 131-544; 12941, POLD3, 64993, 167443, 130-1530; 12941, POLD3, 64996, 167446, 491-1774; 12941, POLD3, 64998, 167448, 270-1352; 12942, POLD4, 65002, 167452, 300-398; 12942, POLD4, 65003, 167453, 354-452; 12942, POLD4, 65005, 167455, 359-457; 12942, POLD4, 65006, 167456, 170-268; 12942, POLD4, 65001, 167451, 148-471; 12942, POLD4, 65004, 167454, 116-355; 12943, POLDIP2, 65008, 167458, 16-1068; 12943, POLDIP2, 65007, 167457, 75-1181; 12944, POLDIP3, 65011, 167461, 1-558; 12944, POLDIP3, 65012, 167462, 106-1422; 12944, POLDIP3, 65013, 167463, 4-573; 12944, POLDIP3, 65014, 167464, 13-858; 12944, POLDIP3, 65015, 167465, 55-744; 12944, POLDIP3, 65009, 167459, 106-1371; 12944, POLDIP3, 65010, 167460, 75-1253; 12945, POLE4, 65016, 167466, 189-542; 12946, POLR1A, 65018, 167468, 380-5359; 12946, POLR1A, 65019, 167469, 99-227; 12946, POLR1A, 65020, 167470, 111-239; 12946, POLR1A, 65017, 167467, 380-5542; 12947, POLR1B, 65022, 167472, 307-528; 12947, POLR1B, 65024, 167474, 170-555; 12947, POLR1B, 65025, 167475, 222-539; 12947, POLR1B, 65026, 167476, 46-324; 12947, POLR1B, 65027, 167477, 1-923; 12947, POLR1B, 65028, 167478, 77-274; 12947, POLR1B, 65030, 167480, 231-572; 12947, POLR1B, 65021, 167471, 581-3988; 12947, POLR1B, 65023, 167473, 270-3128; 12947, POLR1B, 65029, 167479, 31-3270; 12947, POLR1B, 65031, 167481, 766-3540; 12947, POLR1B, 65032, 167482, 117-3638; 12948, POLR1C, 65034, 167484, 23-913; 12948, POLR1C, 65036, 167486, 204-576; 12948, POLR1C, 65037, 167487, 1-418; 12948, POLR1C, 65033, 167483, 22-1050; 12948, POLR1C, 65035, 167485, 89-1129; 12949, POLR1D, 65039, 167489, 116-466; 12949, POLR1D, 65041, 167491, 253-537; 12949, POLR1D, 65042, 167492, 115-243; 12949, POLR1D, 65043, 167493, 558-565; 12949, POLR1D, 65044, 167494, 110-211; 12949, POLR1D, 65045, 167495, 93-221; 12949, POLR1D, 65038, 167488, 563-964; 12949, POLR1D, 65040, 167490, 206-574; 12950, POLR1E, 65048, 167498, 101-526; 12950, POLR1E, 65046, 167496, 289-1734; 12950, POLR1E, 65047, 167497, 114-1373; 12951, POLR2A, 65050, 167500, 400-6342; 12951, POLR2A, 65051, 167501, 387-6299; 12951, POLR2A, 65049, 167499, 146-1846; 12952, POLR2B, 65054, 167504, 197-3496; 12952, POLR2B, 65055, 167505, 317-3820; 12952, POLR2B, 65056, 167506, 310-539; 12952, POLR2B, 65057, 167507, 417-608; 12952, POLR2B, 65052, 167502, 44-3568; 12952, POLR2B, 65053, 167503, 414-3938; 12953, POLR2C, 65059, 167509, 57-197; 12953, POLR2C, 65058, 167508, 339-1166; 12954, POLR2D, 65061, 167511, 226-540; 12954, POLR2D, 65062, 167512, 18-350; 12954, POLR2D, 65060, 167510, 58-486; 12955, POLR2E, 65063, 167513, 60-674; 12955, POLR2E, 65065, 167515, 22-228; 12955, POLR2E, 65066, 167516, 61-216; 12955, POLR2E, 65068, 167518, 1-252; 12955, POLR2E, 65069, 167519, 52-606; 12955, POLR2E, 65070, 167520, 1-404; 12955, POLR2E, 65064, 167514, 40-672; 12955, POLR2E, 65067, 167517, 43-675; 12955, POLR2E, 65071, 167521, 66-698; 12956, POLR2F, 65072, 167522, 1-436; 12956, POLR2F, 65073, 167523, 78-458; 12956, POLR2F, 65074, 167524, 92-568; 12956, POLR2F, 65075, 167525, 1-281; 12956, POLR2F, 65077, 167527, 90-425; 12956, POLR2F, 65078, 167528, 92-316; 12956, POLR2F, 65079, 167529, 90-320; 12956, POLR2F, 65080, 167530, 215-550; 12956, POLR2F, 65081, 167531, 130-498; 12956, POLR2F, 65082, 167532, 90-320; 12956, POLR2F, 65083, 167533, 78-374; 12956, POLR2F, 65076, 167526, 126-509; 12957, POLR2G, 65085, 167535, 67-192; 12957, POLR2G, 65086, 167536, 348-388; 12957, POLR2G, 65087, 167537, 70-264; 12957, POLR2G, 65088, 167538, 33-158; 12957, POLR2G, 65089, 167539, 1-183; 12957, POLR2G, 65084, 167534, 106-624; 12958, POLR2H, 65094, 167544, 802-836; 12958, POLR2H, 65095, 167545, 378-823; 12958, POLR2H, 65090, 167540, 1050-1502; 12958, POLR2H, 65091, 167541, 250-510; 12958, POLR2H, 65092, 167542, 394-738; 12958, POLR2H, 65093, 167543, 208-552; 12958, POLR2H, 65096, 167546, 492-860; 12958, POLR2H, 65097, 167547, 60-587; 12959, POLR2I, 65099, 167549, 5-145; 12959, POLR2I, 65100, 167550, 51-317; 12959, POLR2I, 65101, 167551, 358-531; 12959, POLR2I, 65098, 167548, 491-868; 12960, POLR2J, 65103, 167553, 47-523; 12960, POLR2J, 65102, 167552, 48-401; 12961, POLR2J2, 65105, 167555, 29-505; 12961, POLR2J2, 65104, 167554, 1-348; 12962, POLR2J3, 65107, 167557, 40-426; 12962, POLR2J3, 65108, 167558, 47-523; 12962, POLR2J3, 65109, 167559, 129-479; 12962, POLR2J3, 65110, 167560, 136-958; 12962, POLR2J3, 65111, 167561, 63-284; 12962, POLR2J3, 65112, 167562, 63-293; 12962, POLR2J3, 65113, 167563, 33-380; 12962, POLR2J3, 65114, 167564, 63-293; 12962, POLR2J3, 65115, 167565, 63-410; 12962, POLR2J3, 65116, 167566, 60-536; 12962, POLR2J3, 65117, 167567, 1-348; 12962, POLR2J3, 65106, 167556, 19-366; 12963, POLR2K, 65119, 167569, 97-300; 12963, POLR2K, 65118, 167568, 136-312; 12964, POLR2L, 65120, 167570, 38-241; 12964, POLR2L, 65121, 167571, 22-225; 12965, POLR2M, 65125, 167575, 149-265; 12965, POLR2M, 65126, 167576, 141-257; 12965, POLR2M, 65122, 167572, 215-1321; 12965, POLR2M, 65123, 167573, 119-754; 12965, POLR2M, 65124, 167574, 132-1223; 12966, POLR3A, 65128, 167578, 1-599; 12966, POLR3A, 65129, 167579, 392-880; 12966, POLR3A, 65127, 167577, 139-4311; 12967, POLR3B, 65132, 167582, 72-580; 12967, POLR3B, 65130, 167580, 223-3624; 12967, POLR3B, 65131, 167581, 244-3471; 12968, POLR3C, 65134, 167584, 215-1450; 12968, POLR3C, 65133, 167583, 162-1766; 12969, POLR3D, 65137, 167587, 61-683; 12969, POLR3D, 65138, 167588, 19-390; 12969, POLR3D, 65135, 167585, 86-1282; 12969, POLR3D, 65136, 167586, 216-1412; 12970, POLR3E, 65142, 167592, 1-191; 12970, POLR3E, 65143, 167593, 149-565; 12970, POLR3E, 65144, 167594, 392-662; 12970, POLR3E, 65145, 167595, 177-473; 12970, POLR3E, 65146, 167596, 16-294; 12970, POLR3E, 65147, 167597, 231-560; 12970, POLR3E, 65148, 167598, 143-331; 12970, POLR3E, 65150, 167600, 236-2254; 12970, POLR3E, 65139, 167589, 168-2294; 12970, POLR3E, 65140, 167590, 144-2144; 12970, POLR3E, 65141, 167591, 150-2168; 12970, POLR3E, 65149, 167599, 166-2229; 12971, POLR3F, 65151, 167601, 381-1331; 12972, POLR3G, 65154, 167604, 201-583; 12972, POLR3G, 65155, 167605, 102-763; 12972, POLR3G, 65156, 167606, 223-339; 12972, POLR3G, 65157, 167607, 170-472; 12972, POLR3G, 65158, 167608, 304-581; 12972, POLR3G, 65159, 167609, 156-857; 12972, POLR3G, 65152, 167602, 201-872; 12972, POLR3G, 65153, 167603, 166-837; 12973, POLR3GL, 65160, 167610, 108-695; 12973, POLR3GL, 65161, 167611, 108-764; 12974, POLR3H, 65166, 167616, 355-726; 12974, POLR3H, 65167, 167617, 54-266; 12974, POLR3H, 65168, 167618, 327-809; 12974, POLR3H, 65162, 167612, 362-889; 12974, POLR3H, 65163, 167613, 345-959; 12974, POLR3H, 65164, 167614, 83-697; 12974, POLR3H, 65165, 167615, 117-731; 12975, POLR3K, 65169, 167619, 43-369; 12976, POLRMT, 65171, 167621, 1-1043; 12976, POLRMT, 65172, 167622, 1-380; 12976, POLRMT, 65173, 167623, 14-184; 12976, POLRMT, 65170, 167620, 93-3785; 12977, PTRF, 65174, 167624, 421-1593; 12978, PIGR, 65175, 167625, 185-2479; 12979, PNKP, 65177, 167627, 31-186; 12979, PNKP, 65178, 167628, 122-1594; 12979, PNKP, 65179, 167629, 245-986; 12979, PNKP, 65180, 167630, 79-234; 12979, PNKP, 65181, 167631, 108-637; 12979, PNKP, 65182, 167632, 1-171; 12979, PNKP, 65184, 167634, 101-1468; 12979, PNKP, 65185, 167635, 1-525; 12979, PNKP, 65186, 167636, 1-767; 12979, PNKP, 65187, 167637, 55-1512; 12979, PNKP, 65188, 167638, 1-264; 12979, PNKP, 65176, 167626, 432-1997; 12979, PNKP, 65183, 167633, 83-1648; 12980, GALNT1, 65190, 167640, 160-1323; 12980, GALNT1, 65191, 167641, 8-160; 12980, GALNT1, 65189, 167639, 104-1783; 12980, GALNT1, 65192, 167642, 227-542; 12980, GALNT1, 65193, 167643, 92-409; 12981, GALNT10, 65197, 167647, 133-741; 12981, GALNT10, 65194, 167644, 138-1949; 12981, GALNT10, 65195, 167645, 94-1719; 12981, GALNT10, 65196, 167646, 138-1238; 12982, GALNT11, 65199, 167649, 1-196; 12982, GALNT11, 65200, 167650, 126-580; 12982, GALNT11, 65201, 167651, 332-626; 12982, GALNT11, 65202, 167652, 148-549; 12982, GALNT11, 65204, 167654, 157-716; 12982, GALNT11, 65206, 167656, 238-717; 12982, GALNT11, 65207, 167657, 182-521; 12982, GALNT11, 65198, 167648, 173-781; 12982, GALNT11, 65203, 167653, 231-2057; 12982, GALNT11, 65205, 167655, 356-964; 12982, GALNT11, 65208, 167658, 438-2264; 12983, GALNT12, 65210, 167660, 1-95; 12983, GALNT12, 65209, 167659, 1-1746; 12984, GALNT13, 65213, 167663, 1-169; 12984, GALNT13, 65214, 167664, 1-138; 12984, GALNT13, 65215, 167665, 1-321; 12984, GALNT13, 65216, 167666, 1-427; 12984, GALNT13, 65217, 167667, 453-510; 12984, GALNT13, 65211, 167661, 568-2238; 12984, GALNT13, 65212, 167662, 1-1686; 12985, GALNT14, 65221, 167671, 1-116; 12985, GALNT14, 65222, 167672, 1-212; 12985, GALNT14, 65223, 167673, 418-1619; 12985, GALNT14, 65218, 167668, 641-2299; 12985, GALNT14, 65219, 167669, 62-1735; 12985, GALNT14, 65220, 167670, 465-2063; 12986, GALNT15, 65225, 167675, 1-426; 12986, GALNT15, 65226, 167676, 444-2297; 12986, GALNT15, 65227, 167677, 22-612; 12986, GALNT15, 65224, 167674, 504-2423; 12987, GALNT16, 65228, 167678, 328-2004; 12987, GALNT16, 65229, 167679, 91-1767; 12987, GALNT16, 65230, 167680, 1-1629; 12987, GALNT16, 65231, 167681, 118-1746; 12988, GALNT18, 65232, 167682, 413-2236; 12989, GALNT2, 65233, 167683, 73-1788; 12990, GALNT3, 65235, 167685, 14-1129; 12990, GALNT3, 65236, 167686, 1-270; 12990, GALNT3, 65237, 167687, 271-540; 12990, GALNT3, 65238, 167688, 536-570; 12990, GALNT3, 65239, 167689, 563-1954; 12990, GALNT3, 65240, 167690, 388-559; 12990, GALNT3, 65241, 167691, 461-536; 12990, GALNT3, 65234, 167684, 777-2678; 12991, GALNT4, 65242, 167692, 258-1994; 12992, GALNT5, 65243, 167693, 486-3308; 12993, GALNT6, 65246, 167696, 377-582; 12993, GALNT6, 65247, 167697, 303-538; 12993, GALNT6, 65248, 167698, 532-697; 12993, GALNT6, 65249, 167699, 509-626; 12993, GALNT6, 65250, 167700, 394-581; 12993, GALNT6, 65251, 167701, 156-567; 12993, GALNT6, 65252, 167702, 505-574; 12993, GALNT6, 65253, 167703, 480-548; 12993, GALNT6, 65254, 167704, 186-554; 12993, GALNT6, 65255, 167705, 1-1098; 12993, GALNT6, 65244, 167694, 315-2183; 12993, GALNT6, 65245, 167695, 207-2075; 12994, GALNT7, 65257, 167707, 26-1177; 12994, GALNT7, 65258, 167708, 1-1364; 12994, GALNT7, 65259, 167709, 1-598; 12994, GALNT7, 65256, 167706, 84-2057; 12995, GALNT8, 65261, 167711, 867-2456; 12995, GALNT8, 65262, 167712, 1-485; 12995, GALNT8, 65263, 167713, 1-266; 12995, GALNT8, 65260, 167710, 338-2251; 12996, GALNT9, 65264, 167714, 1-1812; 12996, GALNT9, 65266, 167716, 1-1129; 12996, GALNT9, 65267, 167717, 462-624; 12996, GALNT9, 65269, 167719, 608-897; 12996, GALNT9, 65265, 167715, 279-992; 12996, GALNT9, 65268, 167718, 254-967; 12997, GALNTL5, 65272, 167722, 328-720; 12997, GALNTL5, 65274, 167724, 332-724; 12997, GALNTL5, 65276, 167726, 305-697; 12997, GALNTL5, 65270, 167720, 255-1586; 12997, GALNTL5, 65271, 167721, 222-1553; 12997, GALNTL5, 65273, 167723, 345-746; 12997, GALNTL5, 65275, 167725, 248-649; 12997, GALNTL5, 65277, 167727, 307-1638; 12998, GALNTL6, 65280, 167730, 1907-2092; 12998, GALNTL6, 65281, 167731, 1-1254; 12998, GALNTL6, 65278, 167728, 658-2463; 12998, GALNTL6, 65279, 167729, 1-1755; 12999, PTBP1, 65283, 167733, 90-1673; 12999, PTBP1, 65286, 167736, 1-767; 12999, PTBP1, 65287, 167737, 37-749; 12999, PTBP1, 65288, 167738, 105-273; 12999, PTBP1, 65289, 167739, 1-314; 12999, PTBP1, 65290, 167740, 131-578; 12999, PTBP1, 65291, 167741, 1-346; 12999, PTBP1, 65292, 167742, 1-683; 12999, PTBP1, 65293, 167743, 113-357; 12999, PTBP1, 65294, 167744, 107-700; 12999, PTBP1, 65295, 167745, 424-2190; 12999, PTBP1, 65282, 167732, 74-1669; 12999, PTBP1, 65284, 167734, 424-2097; 12999, PTBP1, 65285, 167735, 47-1699; 13000, PTBP2, 65296, 167746, 56-1669; 13000, PTBP2, 65297, 167747, 56-1666; 13000, PTBP2, 65298, 167748, 44-1639; 13000, PTBP2, 65299, 167749, 83-1681; 13001, PTBP3, 65300, 167750, 187-734; 13001, PTBP3, 65305, 167755, 138-368; 13001, PTBP3, 65301, 167751, 188-1855; 13001, PTBP3, 65302, 167752, 192-1565; 13001, PTBP3, 65303, 167753, 149-1807; 13001, PTBP3, 65304, 167754, 250-1824; 13001, PTBP3, 65306, 167756, 184-1860; 13002, PNPT1, 65307, 167757, 20-559; 13002, PNPT1, 65310, 167760, 1-418; 13002, PNPT1, 65311, 167761, 41-256; 13002, PNPT1, 65312, 167762, 1-216; 13002, PNPT1, 65308, 167758, 1-2352; 13002, PNPT1, 65309, 167759, 88-2439; 13003, PBDC1, 65313, 167763, 100-798; 13003, PBDC1, 65314, 167764, 204-905; 13004, PUF60, 65320, 167770, 1-819; 13004, PUF60, 65321, 167771, 36-1003; 13004, PUF60, 65322, 167772, 77-761; 13004, PUF60, 65324, 167774, 79-867; 13004, PUF60, 65325, 167775, 1-1007; 13004, PUF60, 65326, 167776, 43-785; 13004, PUF60, 65330, 167780, 1-1605; 13004, PUF60, 65331, 167781, 1-944; 13004, PUF60, 65332, 167782, 18-760; 13004, PUF60, 65335, 167785, 1-987; 13004, PUF60, 65336, 167786, 18-806; 13004, PUF60, 65337, 167787, 18-702; 13004, PUF60, 65338, 167788, 1-819; 13004, PUF60, 65339, 167789, 1-1569; 13004, PUF60, 65340, 167790, 1-1656; 13004, PUF60, 65341, 167791, 1-1518; 13004, PUF60, 65315, 167765, 162-1661; 13004, PUF60, 65316, 167766, 50-1678; 13004, PUF60, 65317, 167767, 1-1593; 13004, PUF60, 65318, 167768, 149-1699; 13004, PUF60, 65319, 167769, 18-1559; 13004, PUF60, 65323, 167773, 557-2236; 13004, PUF60, 65327, 167777, 1-1593; 13004, PUF60, 65328, 167778, 1-1629; 13004, PUF60, 65329, 167779, 1-1680; 13004, PUF60, 65333, 167783, 106-1605; 13004, PUF60, 65334, 167784, 106-1656; 13005, POMZP3, 65344, 167794, 64-815; 13005, POMZP3, 65345, 167795, 706-1170; 13005, POMZP3, 65346, 167796, 1-373; 13005, POMZP3, 65349, 167799, 64-815; 13005, POMZP3, 65350, 167800, 706-1170; 13005, POMZP3, 65351, 167801, 1-373; 13005, POMZP3, 65342, 167792, 685-1032; 13005, POMZP3, 65343, 167793, 686-1249; 13005, POMZP3, 65347, 167797, 686-1249; 13005, POMZP3, 65348, 167798, 685-1032; 13006, POM121, 65352, 167802, 301-3255; 13006, POM121, 65353, 167803, 1042-4041; 13006, POM121, 65354, 167804, 457-3456; 13006, POM121, 65355, 167805, 1-3750; 13006, POM121, 65356, 167806, 457-3411; 13007, POM121C, 65357, 167807, 589-715; 13007, POM121C, 65358, 167808, 254-575; 13007, POM121C, 65359, 167809, 1-3690; 13007, POM121C, 65360, 167810, 866-3829; 13008, POM121L12, 65361, 167811, 31-921; 13009, POM121L2, 65363, 167813, 1-279; 13009, POM121L2, 65362, 167812, 1-3108; 13010, POM121L7, 65364, 167814, 428-1816; 13011, POP1, 65367, 167817, 37-585; 13011, POP1, 65365, 167815, 29-3103; 13011, POP1, 65366, 167816, 82-3156; 13012, POP4, 65368, 167818, 174-464; 13012, POP4, 65370, 167820, 22-150; 13012, POP4, 65371, 167821, 76-527; 13012, POP4, 65372, 167822, 37-579; 13012, POP4, 65373, 167823, 37-159; 13012, POP4, 65369, 167819, 2303-2965; 13013, POP5, 65374, 167824, 18-359; 13013, POP5, 65375, 167825, 37-528; 13014, POP7, 65377, 167827, 72-483; 13014, POP7, 65376, 167826, 263-685; 13015, POPDC2, 65379, 167829, 222-1328; 13015, POPDC2, 65380, 167830, 461-1567; 13015, POPDC2, 65382, 167832, 1-77; 13015, POPDC2, 65378, 167828, 168-1262; 13015, POPDC2, 65381, 167831, 168-1250; 13016, POPDC3, 65384, 167834, 280-582; 13016, POPDC3, 65383, 167833, 280-1155; 13017, PORCN, 65386, 167836, 1-1218; 13017, PORCN, 65391, 167841, 146-406; 13017, PORCN, 65392, 167842, 266-558; 13017, PORCN, 65393, 167843, 150-302; 13017, PORCN, 65394, 167844, 172-624; 13017, PORCN, 65395, 167845, 131-391; 13017, PORCN, 65385, 167835, 44-1429; 13017, PORCN, 65387, 167837, 140-1510; 13017, PORCN, 65388, 167838, 180-1547; 13017, PORCN, 65389, 167839, 102-1454; 13017, PORCN, 65390, 167840, 1-1368; 13017, PORCN, 65396, 167846, 1-1371; 13018, HMBS, 65397, 167847, 154-399; 13018, HMBS, 65398, 167848, 150-507; 13018, HMBS, 65399, 167849, 195-755; 13018, HMBS, 65400, 167850, 595-1155; 13018, HMBS, 65401, 167851, 152-1237; 13018, HMBS, 65402, 167852, 292-1326; 13018, HMBS, 65403, 167853, 128-373; 13018, HMBS, 65404, 167854, 292-1206; 13018, HMBS, 65405, 167855, 135-708; 13018, HMBS, 65406, 167856, 121-1086; 13018, HMBS, 65407, 167857, 120-311; 13018, HMBS, 65408, 167858, 264-1298; 13018, HMBS, 65409, 167859, 105-1097; 13018, HMBS, 65410, 167860, 111-1145; 13019, PGAP1, 65412, 167862, 130-677; 13019, PGAP1, 65413, 167863, 186-1100; 13019, PGAP1, 65415, 167865, 1-480; 13019, PGAP1, 65416, 167866, 40-192; 13019, PGAP1, 65411, 167861, 116-2884; 13019, PGAP1, 65414, 167864, 115-1893; 13020, PGAP2, 65419, 167869, 26-961; 13020, PGAP2, 65420, 167870, 68-886; 13020, PGAP2, 65421, 167871, 407-703; 13020, PGAP2, 65423, 167873, 104-349; 13020, PGAP2, 65424, 167874, 53-223; 13020, PGAP2, 65425, 167875, 362-658; 13020, PGAP2, 65426, 167876, 133-681; 13020, PGAP2, 65427, 167877, 93-719; 13020, PGAP2, 65428, 167878, 91-795; 13020, PGAP2, 65429, 167879, 139-774; 13020, PGAP2, 65430, 167880, 77-247; 13020, PGAP2, 65431, 167881, 64-798; 13020, PGAP2, 65433, 167883, 385-669; 13020, PGAP2, 65435, 167885, 490-774; 13020, PGAP2, 65436, 167886, 384-620; 13020, PGAP2, 65437, 167887, 84-380; 13020, PGAP2, 65438, 167888, 69-314; 13020, PGAP2, 65439, 167889, 145-315; 13020, PGAP2, 65440, 167890, 175-345; 13020, PGAP2, 65417, 167867, 202-1149; 13020, PGAP2, 65418, 167868, 26-949; 13020, PGAP2, 65422, 167872, 79-777; 13020, PGAP2, 65432, 167882, 90-1037; 13020, PGAP2, 65434, 167884, 84-848; 13021, PGAP3, 65444, 167894, 1-452; 13021, PGAP3, 65445, 167895, 44-490; 13021, PGAP3, 65446, 167896, 328-538; 13021, PGAP3, 65447, 167897, 1-135; 13021, PGAP3, 65448, 167898, 526-1248; 13021, PGAP3, 65449, 167899, 12-971; 13021, PGAP3, 65441, 167891, 94-1056; 13021, PGAP3, 65442, 167892, 44-853; 13021, PGAP3, 65443, 167893, 44-943; 13022, KCMF1, 65451, 167901, 178-625; 13022, KCMF1, 65452, 167902, 420-560; 13022, KCMF1, 65453, 167903, 631-661; 13022, KCMF1, 65450, 167900, 360-1505; 13023, KCNRG, 65454, 167904, 241-1059; 13023, KCNRG, 65455, 167905, 241-930; 13024, KCNMB1, 65456, 167906, 444-1019; 13024, KCNMB1, 65457, 167907, 401-793; 13025, KCNMB2, 65459, 167909, 143-554; 13025, KCNMB2, 65461, 167911, 300-599; 13025, KCNMB2, 65464, 167914, 168-248; 13025, KCNMB2, 65465, 167915, 73-723; 13025, KCNMB2, 65458, 167908, 73-780; 13025, KCNMB2, 65460, 167910, 544-1251; 13025, KCNMB2, 65462, 167912, 353-1060; 13025, KCNMB2, 65463, 167913, 652-1359; 13026, KCNMB3, 65472, 167922, 1-195; 13026, KCNMB3, 65466, 167916, 513-1352; 13026, KCNMB3, 65467, 167917, 262-1095; 13026, KCNMB3, 65468, 167918, 641-1468; 13026, KCNMB3, 65469, 167919, 943-1716; 13026, KCNMB3, 65470, 167920, 293-814; 13026, KCNMB3, 65471, 167921, 260-1033; 13027, KCNMB4, 65474, 167924, 1-134; 13027, KCNMB4, 65473, 167923, 460-1092; 13028, KCTD1, 65478, 167928, 107-731; 13028, KCTD1, 65480, 167930, 288-588; 13028, KCTD1, 65482, 167932, 34-814; 13028, KCTD1, 65475, 167925, 112-885; 13028, KCTD1, 65476, 167926, 561-1334; 13028, KCTD1, 65477, 167927, 102-875; 13028, KCTD1, 65479, 167929, 407-1180; 13028, KCTD1, 65481, 167931, 141-914; 13029, KCTD10, 65484, 167934, 98-331; 13029, KCTD10, 65485, 167935, 44-554; 13029, KCTD10, 65486, 167936, 205-568; 13029, KCTD10, 65487, 167937, 1064-1462; 13029, KCTD10, 65488, 167938, 180-491; 13029, KCTD10, 65489, 167939, 215-574; 13029, KCTD10, 65490, 167940, 3-866; 13029, KCTD10, 65491, 167941, 39-564; 13029, KCTD10, 65492, 167942, 39-233; 13029, KCTD10, 65493, 167943, 28-141; 13029, KCTD10, 65483, 167933, 283-1224; 13030, KCTD11, 65494, 167944, 782-1480; 13031, KCTD12, 65495, 167945, 243-1220; 13032, KCTD13, 65497, 167947, 1-423; 13032, KCTD13, 65499, 167949, 204-833; 13032, KCTD13, 65500, 167950, 1-363; 13032, KCTD13, 65501, 167951, 1-245; 13032, KCTD13, 65496, 167946, 177-1166; 13032, KCTD13, 65498, 167948, 1003-1992; 13033, KCTD14, 65502, 167952, 46-813; 13033, KCTD14, 65503, 167953, 227-904; 13034, KCTD15, 65506, 167956, 393-577; 13034, KCTD15, 65508, 167958, 295-632; 13034, KCTD15, 65509, 167959, 237-622; 13034, KCTD15, 65510, 167960, 303-534; 13034, KCTD15, 65512, 167962, 324-571; 13034, KCTD15, 65513, 167963, 1-492; 13034, KCTD15, 65504, 167954, 253-957; 13034, KCTD15, 65505, 167955, 409-1260; 13034, KCTD15, 65507, 167957, 338-1189; 13034, KCTD15, 65511, 167961, 250-1101; 13035, KCTD16, 65514, 167964, 671-1957; 13035, KCTD16, 65515, 167965, 1092-2378; 13036, KCTD17, 65518, 167968, 371-559; 13036, KCTD17, 65519, 167969, 1-314; 13036, KCTD17, 65520, 167970, 1-542; 13036, KCTD17, 65521, 167971, 5-667; 13036, KCTD17, 65516, 167966, 2-895; 13036, KCTD17, 65517, 167967, 2-967; 13037, KCTD18, 65522, 167972, 512-1792; 13037, KCTD18, 65523, 167973, 134-1414; 13038, KCTD19, 65525, 167975, 125-528; 13038, KCTD19, 65526, 167976, 8-148; 13038, KCTD19, 65527, 167977, 196-423; 13038, KCTD19, 65528, 167978, 1-348; 13038, KCTD19, 65524, 167974, 57-2837; 13039, KCTD2, 65530, 167980, 68-292; 13039, KCTD2, 65531, 167981, 583-777; 13039, KCTD2, 65529, 167979, 7-798; 13040, KCTD20, 65532, 167982, 123-506; 13040, KCTD20, 65535, 167985, 337-597; 13040, KCTD20, 65536, 167986, 255-547; 13040, KCTD20, 65537, 167987, 138-416; 13040, KCTD20, 65538, 167988, 250-578; 13040, KCTD20, 65533, 167983, 392-1651; 13040, KCTD20, 65534, 167984, 131-892; 13040, KCTD20, 65539, 167989, 553-1377; 13041, KCTD21, 65541, 167991, 212-558; 13041, KCTD21, 65542, 167992, 231-726; 13041, KCTD21, 65543, 167993, 79-499; 13041, KCTD21, 65544, 167994, 427-538; 13041, KCTD21, 65545, 167995, 329-543; 13041, KCTD21, 65540, 167990, 280-1062; 13042, KCTD3, 65547, 167997, 1-640; 13042, KCTD3, 65548, 167998, 1-505; 13042, KCTD3, 65546, 167996, 295-2742; 13043, KCTD4, 65549, 167999, 151-930; 13044, KCTD5, 65551, 168001, 10-750; 13044, KCTD5, 65550, 168000, 75-779; 13045, KCTD6, 65555, 168005, 538-564; 13045, KCTD6, 65556, 168006, 187-408; 13045, KCTD6, 65552, 168002, 984-1697; 13045, KCTD6, 65553, 168003, 100-813; 13045, KCTD6, 65554, 168004, 351-1064; 13046, KCTD7, 65558, 168008, 108-504; 13046, KCTD7, 65560, 168010, 108-806; 13046, KCTD7, 65557, 168007, 185-1054; 13046, KCTD7, 65559, 168009, 123-989; 13047, KCTD8, 65562, 168012, 1-464; 13047, KCTD8, 65561, 168011, 285-1706; 13048, KCTD9, 65564, 168014, 231-404; 13048, KCTD9, 65565, 168015, 142-330; 13048, KCTD9, 65563, 168013, 222-1391; 13049, KCNN1, 65567, 168017, 26-499; 13049, KCNN1, 65568, 168018, 21-1652; 13049, KCNN1, 65566, 168016, 320-1951; 13050, KCNN2, 65570, 168020, 396-683; 13050, KCNN2, 65574, 168024, 39-1787; 13050, KCNN2, 65569, 168019, 458-2197; 13050, KCNN2, 65571, 168021, 444-1139; 13050, KCNN2, 65572, 168022, 1019-2758; 13050, KCNN2, 65573, 168023, 1083-1778; 13051, KCNN3, 65575, 168025, 317-2512; 13051, KCNN3, 65578, 168028, 315-2555; 13051, KCNN3, 65576, 168026, 378-1634; 13051, KCNN3, 65577, 168027, 132-1412; 13052, KCNN4, 65580, 168030, 1-180; 13052, KCNN4, 65581, 168031, 1-496; 13052, KCNN4, 65582, 168032, 1-342; 13052, KCNN4, 65583, 168033, 116-289; 13052, KCNN4, 65584, 168034, 582-1469; 13052, KCNN4, 65579, 168029, 397-1680; 13053, KCNMA1, 65587, 168037, 129-3344; 13053, KCNMA1, 65588, 168038, 1-3548; 13053, KCNMA1, 65589, 168039, 1-3504; 13053, KCNMA1, 65590, 168040, 1-3457; 13053, KCNMA1, 65591, 168041, 1-3516; 13053, KCNMA1, 65592, 168042, 352-3885; 13053, KCNMA1, 65593, 168043, 728-4345; 13053, KCNMA1, 65594, 168044, 129-3251; 13053, KCNMA1, 65595, 168045, 117-3983; 13053, KCNMA1, 65596, 168046, 129-3173; 13053, KCNMA1, 65597, 168047, 1-793; 13053, KCNMA1, 65598, 168048, 1-3630; 13053, KCNMA1, 65599, 168049, 1-2659; 13053, KCNMA1, 65600, 168050, 1-542; 13053, KCNMA1, 65601, 168051, 1-3129; 13053, KCNMA1, 65603, 168053, 148-534; 13053, KCNMA1, 65604, 168054, 178-819; 13053, KCNMA1, 65585, 168035, 954-4490; 13053, KCNMA1, 65586, 168036, 1-3711; 13053, KCNMA1, 65602, 168052, 352-858; 13053, KCNMA1, 65605, 168055, 167-3826; 13054, KCNJ1, 65606, 168056, 301-718; 13054, KCNJ1, 65607, 168057, 526-1644; 13054, KCNJ1, 65608, 168058, 118-1293; 13054, KCNJ1, 65609, 168059, 146-1264; 13054, KCNJ1, 65610, 168060, 393-1511; 13054, KCNJ1, 65611, 168061, 353-1471; 13055, KCNJ10, 65612, 168062, 228-1367; 13056, KCNJ11, 65614, 168064, 321-781; 13056, KCNJ11, 65616, 168066, 1-466; 13056, KCNJ11, 65613, 168063, 569-1741; 13056, KCNJ11, 65615, 168065, 175-1086; 13057, KCNJ12, 65617, 168067, 371-1672; 13057, KCNJ12, 65618, 168068, 896-2197; 13058, KCNJ13, 65622, 168072, 135-687; 13058, KCNJ13, 65623, 168073, 1-412; 13058, KCNJ13, 65619, 168069, 141-1223; 13058, KCNJ13, 65620, 168070, 44-1126; 13058, KCNJ13, 65621, 168071, 138-422; 13059, KCNJ14, 65624, 168074, 406-1716; 13059, KCNJ14, 65625, 168075, 477-1787; 13060, KCNJ15, 65627, 168077, 349-532; 13060, KCNJ15, 65628, 168078, 196-665; 13060, KCNJ15, 65629, 168079, 246-715; 13060, KCNJ15, 65634, 168084, 670-727; 13060, KCNJ15, 65635, 168085, 105-521; 13060, KCNJ15, 65636, 168086, 593-711; 13060, KCNJ15, 65637, 168087, 380-1115; 13060, KCNJ15, 65638, 168088, 451-595; 13060, KCNJ15, 65639, 168089, 411-555; 13060, KCNJ15, 65640, 168090, 596-740; 13060, KCNJ15, 65641, 168091, 160-304; 13060, KCNJ15, 65642, 168092, 551-626; 13060, KCNJ15, 65643, 168093, 269-413; 13060, KCNJ15, 65644, 168094, 169-313; 13060, KCNJ15, 65626, 168076, 304-1431; 13060, KCNJ15, 65630, 168080, 355-1482; 13060, KCNJ15, 65631, 168081, 519-1646; 13060, KCNJ15, 65632, 168082, 255-1382; 13060, KCNJ15, 65633, 168083, 355-1482; 13060, KCNJ15, 65645, 168095, 489-1616; 13060, KCNJ15, 65646, 168096, 486-1613; 13061, KCNJ16, 65650, 168100, 476-582; 13061, KCNJ16, 65651, 168101, 389-1750; 13061, KCNJ16, 65652, 168102, 464-569; 13061, KCNJ16, 65654, 168104, 397-589; 13061, KCNJ16, 65655, 168105, 264-1637; 13061, KCNJ16, 65647, 168097, 547-1803; 13061, KCNJ16, 65648, 168098, 494-1750; 13061, KCNJ16, 65649, 168099, 466-1722; 13061, KCNJ16, 65653, 168103, 164-1420; 13061, KCNJ16, 65656, 168106, 675-1931; 13062, KCNJ18, 65657, 168107, 371-1672; 13063, KCNJ2, 65658, 168108, 384-1667; 13063, KCNJ2, 65659, 168109, 402-1685; 13064, KCNJ3, 65660, 168110, 478-1983; 13064, KCNJ3, 65661, 168111, 196-903; 13065, KCNJ4, 65662, 168112, 260-1597; 13066, KCNJ5, 65663, 168113, 353-1612; 13066, KCNJ5, 65664, 168114, 377-1636; 13066, KCNJ5, 65665, 168115, 91-1350; 13067, KCNJ6, 65666, 168116, 591-1862; 13068, KCNJ8, 65668, 168118, 166-507; 13068, KCNJ8, 65667, 168117, 347-1621; 13069, KCNJ9, 65669, 168119, 243-1424; 13070, KCNT1, 65670, 168120, 117-3788; 13070, KCNT1, 65672, 168122, 107-3760; 13070, KCNT1, 65674, 168124, 1-3708; 13070, KCNT1, 65675, 168125, 47-415; 13070, KCNT1, 65677, 168127, 19-3669; 13070, KCNT1, 65678, 168128, 169-1024; 13070, KCNT1, 65679, 168129, 9-3722; 13070, KCNT1, 65681, 168131, 1-3606; 13070, KCNT1, 65682, 168132, 1-534; 13070, KCNT1, 65671, 168121, 68-3775; 13070, KCNT1, 65673, 168123, 75-3845; 13070, KCNT1, 65676, 168126, 4-3696; 13070, KCNT1, 65680, 168130, 75-3710; 13071, KCNT2, 65685, 168135, 671-1783; 13071, KCNT2, 65687, 168137, 1-508; 13071, KCNT2, 65683, 168133, 917-4324; 13071, KCNT2, 65684, 168134, 103-3438; 13071, KCNT2, 65686, 168136, 51-3257; 13072, KCNU1, 65689, 168139, 70-225; 13072, KCNU1, 65690, 168140, 29-2872; 13072, KCNU1, 65691, 168141, 13-354; 13072, KCNU1, 65692, 168142, 88-1013; 13072, KCNU1, 65688, 168138, 38-3487; 13073, KCNK1, 65694, 168144, 1-726; 13073, KCNK1, 65693, 168143, 169-1179; 13074, KCNK10, 65698, 168148, 79-548; 13074, KCNK10, 65695, 168145, 123-1754; 13074, KCNK10, 65696, 168146, 452-2083; 13074, KCNK10, 65697, 168147, 453-2069; 13075, KCNK12, 65699, 168149, 609-1901; 13076, KCNK13, 65700, 168150, 442-1668; 13077, KCNK15, 65701, 168151, 132-1124; 13078, KCNK16, 65706, 168156, 242-835; 13078, KCNK16, 65702, 168152, 1-789; 13078, KCNK16, 65703, 168153, 15-944; 13078, KCNK16, 65704, 168154, 1-969; 13078, KCNK16, 65705, 168155, 49-933; 13079, KCNK17, 65707, 168157, 234-1232; 13079, KCNK17, 65708, 168158, 142-957; 13080, KCNK18, 65709, 168159, 1-1155; 13081, KCNK2, 65713, 168163, 271-644; 13081, KCNK2, 65714, 168164, 148-606; 13081, KCNK2, 65715, 168165, 152-622; 13081, KCNK2, 65717, 168167, 73-726; 13081, KCNK2, 65718, 168168, 213-566; 13081, KCNK2, 65710, 168160, 184-1419; 13081, KCNK2, 65711, 168161, 68-1336; 13081, KCNK2, 65712, 168162, 151-1431; 13081, KCNK2, 65716, 168166, 73-759; 13082,

KCNK3, 65720, 168170, 454-1269; 13082, KCNK3, 65719, 168169, 126-1310; 13083, KCNK4, 65723, 168173, 132-608; 13083, KCNK4, 65725, 168175, 253-1185; 13083, KCNK4, 65721, 168171, 187-1368; 13083, KCNK4, 65722, 168172, 236-1417; 13083, KCNK4, 65724, 168174, 361-1542; 13084, KCNK5, 65726, 168176, 340-1839; 13085, KCNK6, 65727, 168177, 108-1049; 13086, KCNK7, 65732, 168182, 1-217; 13086, KCNK7, 65733, 168183, 1-85; 13086, KCNK7, 65728, 168178, 37-795; 13086, KCNK7, 65729, 168179, 225-1148; 13086, KCNK7, 65730, 168180, 225-998; 13086, KCNK7, 65731, 168181, 225-983; 13087, KCNK9, 65734, 168184, 7-1131; 13087, KCNK9, 65735, 168185, 50-1174; 13087, KCNK9, 65736, 168186, 65-1189; 13088, KCNH1, 65737, 168187, 29-2998; 13088, KCNH1, 65738, 168188, 171-3059; 13089, KCNH2, 65741, 168191, 330-2648; 13089, KCNH2, 65739, 168189, 403-3882; 13089, KCNH2, 65740, 168190, 404-2863; 13090, KCNH3, 65742, 168192, 261-3512; 13091, KCNH4, 65743, 168193, 334-3387; 13091, KCNH4, 65744, 168194, 137-3190; 13092, KCNH5, 65745, 168195, 270-3236; 13092, KCNH5, 65746, 168196, 169-2043; 13092, KCNH5, 65747, 168197, 1-1836; 13093, KCNH6, 65748, 168198, 54-2930; 13093, KCNH6, 65750, 168200, 56-253; 13093, KCNH6, 65749, 168199, 81-2798; 13093, KCNH6, 65751, 168201, 12-2996; 13093, KCNH6, 65752, 168202, 81-2798; 13093, KCNH6, 65753, 168203, 58-1566; 13094, KCNH7, 65756, 168206, 1-3291; 13094, KCNH7, 65757, 168207, 1-1893; 13094, KCNH7, 65754, 168204, 101-3691; 13094, KCNH7, 65755, 168205, 213-2411; 13095, KCNH8, 65759, 168209, 187-774; 13095, KCNH8, 65758, 168208, 267-3590; 13096, KCNQ1, 65762, 168212, 8-229; 13096, KCNQ1, 65763, 168213, 3-582; 13096, KCNQ1, 65764, 168214, 1-517; 13096, KCNQ1, 65765, 168215, 1-517; 13096, KCNQ1, 65760, 168210, 109-2139; 13096, KCNQ1, 65761, 168211, 275-1924; 13097, KCNQ2, 65768, 168218, 1-2187; 13097, KCNQ2, 65771, 168221, 136-2436; 13097, KCNQ2, 65772, 168222, 1-1139; 13097, KCNQ2, 65773, 168223, 1-1109; 13097, KCNQ2, 65774, 168224, 1-462; 13097, KCNQ2, 65775, 168225, 1-1145; 13097, KCNQ2, 65776, 168226, 93-2357; 13097, KCNQ2, 65777, 168227, 93-2030; 13097, KCNQ2, 65778, 168228, 1-1229; 13097, KCNQ2, 65779, 168229, 1-886; 13097, KCNQ2, 65780, 168230, 1-462; 13097, KCNQ2, 65781, 168231, 1-585; 13097, KCNQ2, 65782, 168232, 1-1145; 13097, KCNQ2, 65784, 168234, 1-1145; 13097, KCNQ2, 65785, 168235, 1-1175; 13097, KCNQ2, 65786, 168236, 1-1145; 13097, KCNQ2, 65787, 168237, 93-2285; 13097, KCNQ2, 65788, 168238, 1-540; 13097, KCNQ2, 65789, 168239, 1-133; 13097, KCNQ2, 65790, 168240, 1-688; 13097, KCNQ2, 65791, 168241, 1-1093; 13097, KCNQ2, 65792, 168242, 1-577; 13097, KCNQ2, 65766, 168216, 47-2572; 13097, KCNQ2, 65767, 168217, 178-1359; 13097, KCNQ2, 65769, 168219, 128-2746; 13097, KCNQ2, 65770, 168220, 43-2577; 13097, KCNQ2, 65783, 168233, 215-2779; 13098, KCNQ3, 65794, 168244, 47-2629; 13098, KCNQ3, 65796, 168246, 1-2256; 13098, KCNQ3, 65793, 168243, 422-3040; 13098, KCNQ3, 65795, 168245, 37-2295; 13099, KCNQ4, 65798, 168248, 1-1669; 13099, KCNQ4, 65797, 168247, 83-2170; 13099, KCNQ4, 65799, 168249, 1-1926; 13100, KCNQ5, 65801, 168251, 348-3146; 13100, KCNQ5, 65802, 168252, 348-3203; 13100, KCNQ5, 65805, 168255, 348-3119; 13100, KCNQ5, 65806, 168256, 348-3176; 13100, KCNQ5, 65807, 168257, 1-292; 13100, KCNQ5, 65808, 168258, 1-273; 13100, KCNQ5, 65809, 168259, 348-2816; 13100, KCNQ5, 65810, 168260, 1-207; 13100, KCNQ5, 65800, 168250, 399-3254; 13100, KCNQ5, 65803, 168253, 85-1368; 13100, KCNQ5, 65804, 168254, 110-2908; 13100, KCNQ5, 65811, 168261, 19-2790; 13100, KCNQ5, 65812, 168262, 348-2816; 13101, KCNF1, 65813, 168263, 491-1975; 13102, KCNG1, 65815, 168265, 323-1096; 13102, KCNG1, 65816, 168266, 426-967; 13102, KCNG1, 65817, 168267, 465-608; 13102, KCNG1, 65818, 168268, 513-802; 13102, KCNG1, 65814, 168264, 287-1828; 13103, KCNG2, 65819, 168269, 1-1401; 13104, KCNG3, 65820, 168270, 597-1907; 13104, KCNG3, 65821, 168271, 477-1754; 13105, KCNG4, 65822, 168272, 70-1629; 13105, KCNG4, 65823, 168273, 122-892; 13106, KCNV1, 65824, 168274, 343-1845; 13106, KCNV1, 65825, 168275, 1034-2536; 13107, KCNV2, 65826, 168276, 239-1876; 13108, KCNB1, 65828, 168278, 523-3099; 13108, KCNB1, 65827, 168277, 197-2773; 13109, KCNB2, 65829, 168279, 589-3324; 13110, KCNA1, 65830, 168280, 1108-2595; 13111, KCNA10, 65831, 168281, 52-1587; 13112, KCNA2, 65832, 168282, 622-2121; 13112, KCNA2, 65833, 168283, 576-1646; 13112, KCNA2, 65834, 168284, 746-2245; 13112, KCNA2, 65835, 168285, 675-2174; 13113, KCNA3, 65836, 168286, 225-1952; 13114, KCNA4, 65837, 168287, 1235-3196; 13115, KCNA5, 65838, 168288, 160-2001; 13116, KCNA7, 65839, 168289, 357-1727; 13117, KCND1, 65842, 168292, 1-397; 13117, KCND1, 65840, 168290, 1299-3242; 13117, KCND1, 65841, 168291, 1291-2103; 13118, KCND2, 65844, 168294, 1-530; 13118, KCND2, 65843, 168293, 966-2858; 13119, KCND3, 65845, 168295, 481-2391; 13119, KCND3, 65846, 168296, 481-2448; 13119, KCND3, 65847, 168297, 71-1981; 13120, KCNC1, 65848, 168298, 1192-2949; 13120, KCNC1, 65849, 168299, 31-1566; 13121, KCNC2, 65850, 168300, 562-2403; 13121, KCNC2, 65851, 168301, 545-2221; 13121, KCNC2, 65852, 168302, 249-2105; 13121, KCNC2, 65853, 168303, 273-2024; 13121, KCNC2, 65854, 168304, 22-1911; 13121, KCNC2, 65855, 168305, 682-2598; 13121, KCNC2, 65856, 168306, 22-1863; 13122, KCNC3, 65857, 168307, 165-2351; 13122, KCNC3, 65858, 168308, 122-256; 13122, KCNC3, 65859, 168309, 296-2569; 13123, KCNC4, 65861, 168311, 9-1883; 13123, KCNC4, 65860, 168310, 28-1935; 13123, KCNC4, 65862, 168312, 1-1881; 13123, KCNC4, 65863, 168313, 158-2065; 13124, KCNAB1, 65865, 168315, 1-1119; 13124, KCNAB1, 65866, 168316, 35-1207; 13124, KCNAB1, 65867, 168317, 1-246; 13124, KCNAB1, 65870, 168320, 21-552; 13124, KCNAB1, 65871, 168321, 146-531; 13124, KCNAB1, 65872, 168322, 1132-2046; 13124, KCNAB1, 65864, 168314, 872-2077; 13124, KCNAB1, 65868, 168318, 218-1444; 13124, KCNAB1, 65869, 168319, 65-1324; 13125, KCNAB2, 65879, 168329, 144-665; 13125, KCNAB2, 65880, 168330, 199-959; 13125, KCNAB2, 65882, 168332, 332-486; 13125, KCNAB2, 65883, 168333, 199-961; 13125, KCNAB2, 65884, 168334, 1-488; 13125, KCNAB2, 65885, 168335, 1-369; 13125, KCNAB2, 65873, 168323, 565-1668; 13125, KCNAB2, 65874, 168324, 486-1547; 13125, KCNAB2, 65875, 168325, 486-1589; 13125, KCNAB2, 65876, 168326, 290-1537; 13125, KCNAB2, 65877, 168327, 141-1202; 13125, KCNAB2, 65878, 168328, 479-1582; 13125, KCNAB2, 65881, 168331, 153-1055; 13125, KCNAB2, 65886, 168336, 179-1366; 13126, KCNAB3, 65888, 168338, 1-129; 13126, KCNAB3, 65889, 168339, 369-674; 13126, KCNAB3, 65887, 168337, 1-1215; 13127, KCNE1, 65890, 168340, 401-790; 13127, KCNE1, 65891, 168341, 277-666; 13127, KCNE1, 65892, 168342, 626-1015; 13127, KCNE1, 65893, 168343, 210-599; 13127, KCNE1, 65894, 168344, 238-627; 13127, KCNE1, 65895, 168345, 407-796; 13127, KCNE1, 65896, 168346, 276-665; 13127, KCNE1, 65897, 168347, 202-591; 13128, KCNE2, 65898, 168348, 141-512; 13129, KCNE3, 65900, 168350, 288-585; 13129, KCNE3, 65902, 168352, 450-607; 13129, KCNE3, 65903, 168353, 407-555; 13129, KCNE3, 65904, 168354, 514-550; 13129, KCNE3, 65899, 168349, 421-732; 13129, KCNE3, 65901, 168351, 454-765; 13130, KCNE4, 65905, 168355, 332-997; 13131, KCNE5, 65906, 168356, 153-581; 13132, N/A, 65907, 168357, 867-2456; 13133, KCNS1, 65908, 168358, 398-1978; 13133, KCNS1, 65909, 168359, 51-1631; 13134, KCNS2, 65910, 168360, 351-1784; 13134, KCNS2, 65911, 168361, 172-1605; 13135, KCNS3, 65914, 168364, 331-553; 13135, KCNS3, 65912, 168362, 381-1856; 13135, KCNS3, 65913, 168363, 452-1927; 13136, POTEB, 65915, 168365, 34-939; 13136, POTEB, 65916, 168366, 53-1687; 13137, POTEB2, 65917, 168367, 34-939; 13137, POTEB2, 65918, 168368, 34-1668; 13138, POTEB3, 65919, 168369, 49-1794; 13138, POTEB3, 65921, 168371, 372-1517; 13138, POTEB3, 65922, 168372, 372-1517; 13138, POTEB3, 65923, 168373, 441-1595; 13138, POTEB3, 65924, 168374, 441-1595; 13138, POTEB3, 65925, 168375, 1-799; 13138, POTEB3, 65920, 168370, 49-1794; 13139, POTEC, 65927, 168377, 440-1594; 13139, POTEC, 65928, 168378, 368-2128; 13139, POTEC, 65929, 168379, 372-1517; 13139, POTEC, 65926, 168376, 1-1629; 13140, POTED, 65931, 168381, 372-1517; 13140, POTED, 65930, 168380, 53-1807; 13141, POTEE, 65935, 168385, 53-1579; 13141, POTEE, 65932, 168382, 337-3564; 13141, POTEE, 65933, 168383, 53-1237; 13141, POTEE, 65934, 168384, 53-1183; 13141, POTEE, 65936, 168386, 53-1183; 13142, POTEF, 65938, 168388, 53-1579; 13142, POTEF, 65940, 168390, 53-1237; 13142, POTEF, 65937, 168387, 95-3322; 13142, POTEF, 65939, 168389, 401-3628; 13143, POTEG, 65941, 168391, 53-1021; 13143, POTEG, 65942, 168392, 53-1579; 13143, POTEG, 65943, 168393, 53-1513; 13144, POTEH, 65945, 168395, 1-912; 13144, POTEH, 65946, 168396, 1-1527; 13144, POTEH, 65944, 168394, 53-1690; 13145, POTEI, 65948, 168398, 53-1579; 13145, POTEI, 65949, 168399, 53-1183; 13145, POTEI, 65947, 168397, 432-3659; 13146, POTEJ, 65950, 168400, 53-3169; 13147, POTEM, 65952, 168402, 53-1021; 13147, POTEM, 65953, 168403, 53-1513; 13147, POTEM, 65951, 168401, 53-1579; 13148, POU1F1, 65956, 168406, 1-510; 13148, POU1F1, 65957, 168407, 1-650; 13148, POU1F1, 65954, 168404, 126-1001; 13148, POU1F1, 65955, 168405, 43-996; 13149, POU2AF1, 65959, 168409, 144-524; 13149, POU2AF1, 65958, 168408, 516-1286; 13150, POU2F1, 65960, 168410, 9-182; 13150, POU2F1, 65964, 168414, 8-190; 13150, POU2F1, 65965, 168415, 114-1896; 13150, POU2F1, 65966, 168416, 1-1686; 13150, POU2F1, 65968, 168418, 8-181; 13150, POU2F1, 65961, 168411, 236-2503; 13150, POU2F1, 65962, 168412, 70-2370; 13150, POU2F1, 65963, 168413, 8-2119; 13150, POU2F1, 65967, 168417, 171-2402; 13151, POU2F2, 65969, 168419, 66-1826; 13151, POU2F2, 65972, 168422, 46-399; 13151, POU2F2, 65975, 168425, 1-1857; 13151, POU2F2, 65976, 168426, 9-1466; 13151, POU2F2, 65977, 168427, 1-596; 13151, POU2F2, 65978, 168428, 9-1283; 13151, POU2F2, 65979, 168429, 1-373; 13151, POU2F2, 65980, 168430, 1-785; 13151, POU2F2, 65981, 168431, 1-660; 13151, POU2F2, 65982, 168432, 1-195; 13151, POU2F2, 65983, 168433, 33-371; 13151, POU2F2, 65970, 168420, 68-1459; 13151, POU2F2, 65971, 168421, 17-1456; 13151, POU2F2, 65973, 168423, 63-1466; 13151, POU2F2, 65974, 168424, 55-1257; 13152, POU2F3, 65985, 168435, 84-464; 13152, POU2F3, 65987, 168437, 1-482; 13152, POU2F3, 65984, 168434, 35-1351; 13152, POU2F3, 65986, 168436, 151-1461; 13153, POU3F1, 65988, 168438, 52-1407; 13154, POU3F2, 65989, 168439, 283-1614; 13155, POU3F3, 65990, 168440, 1-1503; 13156, POU3F4, 65991, 168441, 76-1161; 13157, POU4F1, 65992, 168442, 235-1494; 13158, POU4F2, 65993, 168443, 249-1478; 13159, POU4F3, 65994, 168444, 90-1106; 13160, POU5F1, 66001, 168451, 297-791; 13160, POU5F1, 66009, 168459, 975-1469; 13160, POU5F1, 66010, 168460, 489-983; 13160, POU5F1, 66011, 168461, 2-562; 13160, POU5F1, 66012, 168462, 2-562; 13160, POU5F1, 66013, 168463, 2-562; 13160, POU5F1, 66014, 168464, 2-562; 13160, POU5F1, 66015, 168465, 2-562; 13160, POU5F1, 66016, 168466, 2-562; 13160, POU5F1, 66017, 168467, 1532-2026; 13160, POU5F1, 66018, 168468, 411-983; 13160, POU5F1, 66019, 168469, 2-562; 13160, POU5F1, 66020, 168470, 743-1315; 13160, POU5F1, 65995, 168445, 74-1156; 13160, POU5F1, 65996, 168446, 102-899; 13160, POU5F1, 65997, 168447, 74-1156; 13160, POU5F1, 65998, 168448, 102-899; 13160, POU5F1, 65999, 168449, 102-899; 13160, POU5F1, 66000, 168450, 74-1156; 13160, POU5F1, 66002, 168452, 102-899; 13160, POU5F1, 66003, 168453, 74-1156; 13160, POU5F1, 66004, 168454, 74-1156; 13160, POU5F1, 66005, 168455, 74-1156; 13160, POU5F1, 66006, 168456, 74-1156; 13160, POU5F1, 66007, 168457, 102-899; 13160, POU5F1, 66008, 168458, 102-899; 13161, POU5F1B, 66021, 168471, 1158-2237; 13162, POU6F1, 66024, 168474, 120-207; 13162, POU6F1, 66022, 168472, 483-1388; 13162, POU6F1, 66023, 168473, 941-1846; 13162, POU6F1, 66025, 168475, 193-1098; 13163, POU6F2, 66027, 168477, 1-429; 13163, POU6F2, 66028, 168478, 137-570; 13163, POU6F2, 66030, 168480, 102-2012; 13163, POU6F2, 66031, 168481, 249-1485; 13163, POU6F2, 66032, 168482, 82-1290; 13163, POU6F2, 66026, 168476, 155-2230; 13163, POU6F2, 66029, 168479, 43-2010; 13164, POU5F2, 66033, 168483, 75-1061; 13165, PATZ1, 66034, 168484, 175-1788; 13165, PATZ1, 66035, 168485, 631-2694; 13165, PATZ1, 66036, 168486, 631-2556; 13165, PATZ1, 66037, 168487, 631-2244; 13166, PPAN-P2RY11, 66038, 168488, 1-2385; 13166, PPAN-P2RY11, 66039, 168489, 173-1735; 13167, PERM1, 66040, 168490, 37-2067; 13167, PERM1, 66041, 168491, 1-2373; 13168, PPP5D1, 66043, 168493, 1-377; 13168, PPP5D1, 66044, 168494, 1-394; 13168, PPP5D1, 66042, 168492, 232-747; 13169, PPT2-EGFL8, 66045, 168495, 1-389; 13169, PPT2-EGFL8, 66046, 168496, 569-1474; 13169, PPT2-EGFL8, 66047, 168497, 192-1097; 13169, PPT2-EGFL8, 66048, 168498, 9-302; 13169, PPT2-EGFL8, 66049, 168499, 344-637; 13170, PQLC1, 66050, 168500, 1-224; 13170, PQLC1, 66054, 168504, 177-380; 13170, PQLC1, 66055, 168505, 1-409; 13170, PQLC1, 66056, 168506, 149-394; 13170, PQLC1, 66057, 168507, 177-380; 13170, PQLC1, 66058, 168508, 123-521; 13170, PQLC1, 66051, 168501, 158-919; 13170, PQLC1, 66052, 168502, 184-999; 13170, PQLC1, 66053, 168503, 173-571; 13171, PQLC2, 66062, 168512, 1-384; 13171, PQLC2, 66063, 168513, 222-329; 13171, PQLC2, 66064, 168514, 240-542; 13171, PQLC2, 66059, 168509, 641-1516; 13171, PQLC2, 66060, 168510, 273-1148; 13171, PQLC2, 66061, 168511, 211-891; 13172, PQLC2L, 66068, 168518, 149-319; 13172, PQLC2L, 66069, 168519, 195-296; 13172, PQLC2L, 66065, 168515, 293-649; 13172, PQLC2L, 66066, 168516, 95-496; 13172, PQLC2L, 66067, 168517, 142-549; 13172, PQLC2L, 66070, 168520, 162-380; 13173, PQLC3, 66072, 168522, 13-375; 13173, PQLC3, 66074, 168524, 117-626; 13173, PQLC3, 66075, 168525, 21-565; 13173, PQLC3, 66076, 168526, 1-247; 13173, PQLC3, 66071, 168521, 176-784; 13173, PQLC3, 66073, 168523, 176-742; 13174, PRDM1, 66080, 168530, 395-583; 13174, PRDM1, 66081, 168531, 69-583; 13174, PRDM1, 66082, 168532, 277-

2643; 13174, PRDM1, 66077, 168527, 147-2222; 13174, PRDM1, 66078, 168528, 221-2590; 13174, PRDM1, 66079, 168529, 235-2712; 13175, PRDM10, 66087, 168537, 233-3586; 13175, PRDM10, 66088, 168538, 202-620; 13175, PRDM10, 66090, 168540, 49-2643; 13175, PRDM10, 66091, 168541, 183-528; 13175, PRDM10, 66083, 168533, 148-3219; 13175, PRDM10, 66084, 168534, 233-3715; 13175, PRDM10, 66085, 168535, 233-3703; 13175, PRDM10, 66086, 168536, 217-3402; 13175, PRDM10, 66089, 168539, 56-3280; 13176, PRDM11, 66093, 168543, 210-762; 13176, PRDM11, 66095, 168545, 1-1441; 13176, PRDM11, 66096, 168546, 246-3779; 13176, PRDM11, 66092, 168542, 246-1679; 13176, PRDM11, 66094, 168544, 1-1536; 13177, PRDM12, 66097, 168547, 61-1164; 13178, PRDM13, 66098, 168548, 262-627; 13178, PRDM13, 66099, 168549, 306-2429; 13179, PRDM14, 66101, 168551, 124-422; 13179, PRDM14, 66100, 168550, 203-1918; 13180, PRDM15, 66104, 168554, 214-1650; 13180, PRDM15, 66105, 168555, 16-3441; 13180, PRDM15, 66109, 168559, 78-3503; 13180, PRDM15, 66102, 168552, 112-4635; 13180, PRDM15, 66103, 168553, 103-3639; 13180, PRDM15, 66106, 168556, 103-1770; 13180, PRDM15, 66107, 168557, 103-3699; 13180, PRDM15, 66108, 168558, 112-4635; 13181, PRDM16, 66112, 168562, 50-3583; 13181, PRDM16, 66113, 168563, 1-3255; 13181, PRDM16, 66114, 168564, 93-3629; 13181, PRDM16, 66115, 168565, 1-162; 13181, PRDM16, 66110, 168560, 50-3880; 13181, PRDM16, 66111, 168561, 64-3837; 13182, PRDM2, 66120, 168570, 280-513; 13182, PRDM2, 66122, 168572, 169-628; 13182, PRDM2, 66123, 168573, 1-135; 13182, PRDM2, 66124, 168574, 202-390; 13182, PRDM2, 66125, 168575, 145-333; 13182, PRDM2, 66126, 168576, 582-646; 13182, PRDM2, 66116, 168566, 857-6013; 13182, PRDM2, 66117, 168567, 857-5905; 13182, PRDM2, 66118, 168568, 222-4667; 13182, PRDM2, 66119, 168569, 127-807; 13182, PRDM2, 66121, 168571, 178-4623; 13183, PRDM4, 66128, 168578, 399-1349; 13183, PRDM4, 66129, 168579, 414-640; 13183, PRDM4, 66130, 168580, 1-837; 13183, PRDM4, 66127, 168577, 461-2866; 13184, PRDM5, 66135, 168585, 1-437; 13184, PRDM5, 66131, 168581, 242-2134; 13184, PRDM5, 66132, 168582, 263-598; 13184, PRDM5, 66133, 168583, 251-2050; 13184, PRDM5, 66134, 168584, 258-1763; 13185, PRDM6, 66137, 168587, 1-220; 13185, PRDM6, 66136, 168586, 415-2202; 13186, PRDM7, 66139, 168589, 16-432; 13186, PRDM7, 66140, 168590, 21-242; 13186, PRDM7, 66138, 168588, 21-1499; 13187, PRDM8, 66144, 168594, 1232-2514; 13187, PRDM8, 66141, 168591, 1232-3301; 13187, PRDM8, 66142, 168592, 263-2332; 13187, PRDM8, 66143, 168593, 840-2909; 13188, PRDM9, 66146, 168596, 258-558; 13188, PRDM9, 66147, 168597, 305-1537; 13188, PRDM9, 66145, 168595, 183-2867; 13189, PRAF2, 66148, 168598, 3-485; 13189, PRAF2, 66149, 168599, 85-621; 13190, PJA1, 66154, 168604, 141-574; 13190, PJA1, 66155, 168605, 1-203; 13190, PJA1, 66150, 168600, 379-2310; 13190, PJA1, 66151, 168601, 490-2256; 13190, PJA1, 66152, 168602, 308-2239; 13190, PJA1, 66153, 168603, 295-1662; 13191, PJA2, 66156, 168606, 241-2367; 13191, PJA2, 66157, 168607, 1-2127; 13192, PRAMEF1, 66158, 168608, 104-1528; 13193, PRAMEF10, 66160, 168610, 81-1505; 13193, PRAMEF10, 66159, 168609, 81-1505; 13194, PRAMEF11, 66161, 168611, 72-1508; 13194, PRAMEF11, 66162, 168612, 72-1508; 13195, PRAMEF12, 66163, 168613, 28-1479; 13196, PRAMEF14, 66164, 168614, 104-1528; 13197, PRAMEF15, 66166, 168616, 100-1530; 13197, PRAMEF15, 66165, 168615, 95-1531; 13198, PRAMEF17, 66167, 168617, 27-1451; 13199, PRAMEF18, 66168, 168618, 1-1440; 13199, PRAMEF18, 66169, 168619, 22-1467; 13199, PRAMEF18, 66170, 168620, 22-1467; 13200, PRAMEF19, 66171, 168621, 1-1233; 13201, N/A, 66172, 168622, 1-702; 13201, N/A, 66173, 168623, 49-1488; 13202, PRAMEF2, 66174, 168624, 88-1512; 13202, PRAMEF2, 66175, 168625, 88-1512; 13203, PRAMEF20, 66176, 168626, 100-1527; 13203, PRAMEF20, 66177, 168627, 5-1432; 13204, PRAMEF25, 66178, 168628, 72-1508; 13204, PRAMEF25, 66179, 168629, 95-1531; 13205, N/A, 66181, 168631, 100-1530; 13205, N/A, 66182, 168632, 198-1508; 13205, N/A, 66183, 168633, 100-1530; 13205, N/A, 66186, 168636, 100-1530; 13205, N/A, 66180, 168630, 72-1508; 13205, N/A, 66184, 168634, 95-1531; 13205, N/A, 66185, 168635, 95-1531; 13205, N/A, 66187, 168637, 95-1531; 13205, N/A, 66188, 168638, 72-1508; 13206, PRAMEF26, 66189, 168639, 72-1508; 13206, PRAMEF26, 66190, 168640, 95-1531; 13207, PRAMEF27, 66191, 168641, 95-1531; 13207, PRAMEF27, 66192, 168642, 95-1531; 13208, PRAMEF33P, 66193, 168643, 81-1505; 13209, PRAMEF4, 66195, 168645, 72-1508; 13209, PRAMEF4, 66194, 168644, 72-1508; 13210, PRAMEF5, 66196, 168646, 81-1517; 13210, PRAMEF5, 66197, 168647, 87-1517; 13210, PRAMEF5, 66198, 168648, 101-1531; 13210, PRAMEF5, 66199, 168649, 87-1517; 13211, PRAMEF6, 66202, 168652, 100-1530; 13211, PRAMEF6, 66203, 168653, 87-1517; 13211, PRAMEF6, 66204, 168654, 100-1530; 13211, PRAMEF6, 66205, 168655, 87-1517; 13211, PRAMEF6, 66200, 168650, 87-1517; 13211, PRAMEF6, 66201, 168651, 87-1517; 13212, PRAMEF7, 66207, 168657, 99-1523; 13212, PRAMEF7, 66208, 168658, 99-1523; 13212, PRAMEF7, 66209, 168659, 69-1493; 13212, PRAMEF7, 66206, 168656, 69-1493; 13213, PRAMEF8, 66215, 168665, 99-1523; 13213, PRAMEF8, 66216, 168666, 79-1503; 13213, PRAMEF8, 66217, 168667, 84-1508; 13213, PRAMEF8, 66210, 168660, 84-1508; 13213, PRAMEF8, 66211, 168661, 69-1493; 13213, PRAMEF8, 66212, 168662, 67-1491; 13213, PRAMEF8, 66213, 168663, 99-1523; 13213, PRAMEF8, 66214, 168664, 79-1503; 13214, PRAMEF9, 66218, 168668, 95-1531; 13214, PRAMEF9, 66219, 168669, 95-1531; 13214, PRAMEF9, 66220, 168670, 95-1531; 13215, N/A, 66221, 168671, 95-1531; 13215, N/A, 66222, 168672, 100-1530; 13216, PTCRA, 66226, 168676, 82-972; 13216, PTCRA, 66223, 168673, 82-927; 13216, PTCRA, 66224, 168674, 82-606; 13216, PTCRA, 66225, 168675, 82-852; 13217, VPREB1, 66227, 168677, 24-458; 13217, VPREB1, 66228, 168678, 140-577; 13218, VPREB3, 66230, 168680, 47-370; 13218, VPREB3, 66229, 168679, 106-477; 13219, PBX1, 66231, 168681, 225-734; 13219, PBX1, 66234, 168684, 2-1030; 13219, PBX1, 66235, 168685, 402-1379; 13219, PBX1, 66236, 168686, 152-630; 13219, PBX1, 66237, 168687, 187-572; 13219, PBX1, 66238, 168688, 1-1020; 13219, PBX1, 66239, 168689, 162-454; 13219, PBX1, 66240, 168690, 162-577; 13219, PBX1, 66241, 168691, 432-644; 13219, PBX1, 66242, 168692, 2-781; 13219, PBX1, 66232, 168682, 1-1044; 13219, PBX1, 66233, 168683, 189-1481; 13219, PBX1, 66243, 168693, 80-1342; 13220, PBX2, 66244, 168694, 272-1564; 13220, PBX2, 66245, 168695, 272-1564; 13220, PBX2, 66246, 168696, 272-1564; 13220, PBX2, 66247, 168697, 272-1564; 13220, PBX2, 66248, 168698, 272-1564; 13220, PBX2, 66249, 168699, 272-1564; 13220, PBX2, 66250, 168700, 272-1564; 13221, PBX3, 66252, 168702, 1-282; 13221, PBX3, 66253, 168703, 81-1448; 13221, PBX3, 66255, 168705, 1-282; 13221, PBX3, 66257, 168707, 1-528; 13221, PBX3, 66258, 168708, 394-875; 13221, PBX3, 66251, 168701, 110-1165; 13221, PBX3, 66254, 168704, 17-1321; 13221, PBX3, 66256, 168706, 256-1335; 13222, PBX4, 66260, 168710, 53-403; 13222, PBX4, 66261, 168711, 65-415; 13222, PBX4, 66259, 168709, 288-1412; 13223, PBXIP1, 66262, 168712, 80-1027; 13223, PBXIP1, 66265, 168715, 92-535; 13223, PBXIP1, 66263, 168713, 73-2268; 13223, PBXIP1, 66264, 168714, 88-2196; 13224, PRAME, 66268, 168718, 384-731; 13224, PRAME, 66270, 168720, 309-567; 13224, PRAME, 66272, 168722, 147-341; 13224, PRAME, 66273, 168723, 1-566; 13224, PRAME, 66274, 168724, 287-891; 13224, PRAME, 66275, 168725, 248-705; 13224, PRAME, 66279, 168729, 287-891; 13224, PRAME, 66280, 168730, 309-567; 13224, PRAME, 66283, 168733, 248-705; 13224, PRAME, 66284, 168734, 119-566; 13224, PRAME, 66285, 168735, 384-727; 13224, PRAME, 66266, 168716, 308-1837; 13224, PRAME, 66267, 168717, 301-1830; 13224, PRAME, 66269, 168719, 287-1816; 13224, PRAME, 66271, 168721, 228-1757; 13224, PRAME, 66276, 168726, 308-1837; 13224, PRAME, 66277, 168727, 864-2393; 13224, PRAME, 66278, 168728, 301-1830; 13224, PRAME, 66281, 168731, 228-1757; 13224, PRAME, 66282, 168732, 287-1816; 13225, PFDN1, 66287, 168737, 41-148; 13225, PFDN1, 66288, 168738, 11-364; 13225, PFDN1, 66286, 168736, 49-417; 13226, PFDN2, 66289, 168739, 86-550; 13227, PFDN4, 66291, 168741, 7-417; 13227, PFDN4, 66290, 168740, 255-659; 13228, PFDN5, 66296, 168746, 27-116; 13228, PFDN5, 66297, 168747, 44-157; 13228, PFDN5, 66298, 168748, 13-102; 13228, PFDN5, 66299, 168749, 33-287; 13228, PFDN5, 66300, 168750, 1-457; 13228, PFDN5, 66301, 168751, 118-231; 13228, PFDN5, 66292, 168742, 27-227; 13228, PFDN5, 66293, 168743, 44-373; 13228, PFDN5, 66294, 168744, 17-481; 13228, PFDN5, 66295, 168745, 278-742; 13229, PFDN6, 66318, 168768, 83-394; 13229, PFDN6, 66319, 168769, 85-396; 13229, PFDN6, 66320, 168770, 83-394; 13229, PFDN6, 66321, 168771, 83-394; 13229, PFDN6, 66322, 168772, 83-394; 13229, PFDN6, 66302, 168752, 263-652; 13229, PFDN6, 66303, 168753, 120-509; 13229, PFDN6, 66304, 168754, 115-504; 13229, PFDN6, 66305, 168755, 115-504; 13229, PFDN6, 66306, 168756, 407-796; 13229, PFDN6, 66307, 168757, 263-652; 13229, PFDN6, 66308, 168758, 407-796; 13229, PFDN6, 66309, 168759, 263-652; 13229, PFDN6, 66310, 168760, 407-796; 13229, PFDN6, 66311, 168761, 263-652; 13229, PFDN6, 66312, 168762, 407-796; 13229, PFDN6, 66313, 168763, 407-796; 13229, PFDN6, 66314, 168764, 115-504; 13229, PFDN6, 66315, 168765, 115-504; 13229, PFDN6, 66316, 168766, 263-652; 13229, PFDN6, 66317, 168767, 115-504; 13229, PFDN6, 66323, 168773, 120-509; 13229, PFDN6, 66324, 168774, 120-509; 13229, PFDN6, 66325, 168775, 120-509; 13229, PFDN6, 66326, 168776, 120-509; 13230, PSG1, 66329, 168779, 91-1071; 13230, PSG1, 66331, 168781, 296-757; 13230, PSG1, 66332, 168782, 1-725; 13230, PSG1, 66333, 168783, 130-1104; 13230, PSG1, 66327, 168777, 139-1419; 13230, PSG1, 66328, 168778, 87-1373; 13230, PSG1, 66330, 168780, 118-1377; 13230, PSG1, 66334, 168784, 67-1320; 13231, PSG11, 66338, 168788, 77-1036; 13231, PSG11, 66339, 168789, 92-472; 13231, PSG11, 66335, 168785, 98-739; 13231, PSG11, 66336, 168786, 141-1148; 13231, PSG11, 66337, 168787, 95-736; 13232, PSG2, 66340, 168790, 1-353; 13232, PSG2, 66341, 168791, 100-1107; 13233, PSG3, 66343, 168793, 94-1521; 13233, PSG3, 66344, 168794, 202-477; 13233, PSG3, 66342, 168792, 186-1472; 13233, PSG3, 66345, 168795, 1-1287; 13234, PSG4, 66349, 168799, 240-996; 13234, PSG4, 66350, 168800, 1-731; 13234, PSG4, 66351, 168801, 292-526; 13234, PSG4, 66352, 168802, 98-256; 13234, PSG4, 66353, 168803, 100-976; 13234, PSG4, 66354, 168804, 77-199; 13234, PSG4, 66355, 168805, 1-775; 13234, PSG4, 66356, 168806, 1-289; 13234, PSG4, 66357, 168807, 16-555; 13234, PSG4, 66346, 168796, 28-1008; 13234, PSG4, 66347, 168797, 239-1498; 13234, PSG4, 66348, 168798, 239-1219; 13235, PSG5, 66360, 168810, 90-1091; 13235, PSG5, 66362, 168812, 90-563; 13235, PSG5, 66363, 168813, 97-1383; 13235, PSG5, 66358, 168808, 118-1125; 13235, PSG5, 66359, 168809, 132-1139; 13235, PSG5, 66361, 168811, 86-1093; 13236, PSG6, 66366, 168816, 91-1086; 13236, PSG6, 66367, 168817, 1285-1506; 13236, PSG6, 66368, 168818, 96-568; 13236, PSG6, 66369, 168819, 1-245; 13236, PSG6, 66364, 168814, 67-1341; 13236, PSG6, 66365, 168815, 46-1353; 13237, PSG7, 66370, 168820, 98-1357; 13237, PSG7, 66371, 168821, 91-1371; 13237, PSG7, 66372, 168822, 103-1362; 13237, PSG7, 66373, 168823, 99-1379; 13237, PSG7, 66374, 168824, 23-916; 13238, PSG8, 66378, 168828, 73-1053; 13238, PSG8, 66379, 168829, 89-211; 13238, PSG8, 66375, 168825, 99-1379; 13238, PSG8, 66376, 168826, 82-975; 13238, PSG8, 66377, 168827, 98-1357; 13239, PSG9, 66382, 168832, 7-729; 13239, PSG9, 66383, 168833, 98-1099; 13239, PSG9, 66384, 168834, 100-1080; 13239, PSG9, 66385, 168835, 91-1020; 13239, PSG9, 66386, 168836, 98-1099; 13239, PSG9, 66387, 168837, 93-1352; 13239, PSG9, 66380, 168830, 68-1276; 13239, PSG9, 66381, 168831, 98-1378; 13240, PNCK, 66392, 168842, 1-244; 13240, PNCK, 66393, 168843, 47-295; 13240, PNCK, 66394, 168844, 99-771; 13240, PNCK, 66395, 168845, 321-448; 13240, PNCK, 66396, 168846, 53-311; 13240, PNCK, 66397, 168847, 23-322; 13240, PNCK, 66398, 168848, 141-268; 13240, PNCK, 66399, 168849, 199-326; 13240, PNCK, 66401, 168851, 498-625; 13240, PNCK, 66402, 168852, 283-566; 13240, PNCK, 66403, 168853, 77-754; 13240, PNCK, 66388, 168838, 69-1100; 13240, PNCK, 66389, 168839, 55-1155; 13240, PNCK, 66390, 168840, 19-1101; 13240, PNCK, 66391, 168841, 180-1211; 13240, PNCK, 66400, 168850, 187-1467; 13241, PAPPA, 66404, 168854, 370-5253; 13242, PZP, 66406, 168856, 25-459; 13242, PZP, 66405, 168855, 30-4478; 13243, PRELID1, 66408, 168858, 172-501; 13243, PRELID1, 66409, 168859, 176-289; 13243, PRELID1, 66410, 168860, 1-608; 13243, PRELID1, 66407, 168857, 213-872; 13243, PRELID1, 66411, 168861, 166-792; 13244, PRELID2, 66414, 168864, 54-548; 13244, PRELID2, 66412, 168862, 54-623; 13244, PRELID2, 66413, 168863, 376-822; 13244, PRELID2, 66415, 168865, 35-568; 13245, PRELID3A, 66418, 168868, 324-572; 13245, PRELID3A, 66419, 168869, 38-580; 13245, PRELID3A, 66421, 168871, 182-430; 13245, PRELID3A, 66422, 168872, 130-273; 13245, PRELID3A, 66423, 168873, 88-488; 13245, PRELID3A, 66424, 168874, 32-529; 13245, PRELID3A, 66416, 168866, 81-599; 13245, PRELID3A, 66417, 168867, 81-599; 13245, PRELID3A, 66420, 168870, 424-879; 13246, PRELID3B, 66427, 168877, 3-209; 13246, PRELID3B, 66425, 168875, 180-764; 13246, PRELID3B, 66426, 168876, 76-570; 13247, POF1B, 66428, 168878, 147-1916; 13247, POF1B, 66429, 168879, 121-1908; 13248, PMEL, 66431, 168881, 116-568; 13248, PMEL, 66432, 168882, 16-912; 13248, PMEL, 66434, 168884, 8-895; 13248, PMEL, 66435, 168885, 15-887; 13248, PMEL, 66437, 168887, 16-1047; 13248, PMEL, 66438, 168888, 170-573; 13248, PMEL, 66439, 168889, 1-1355; 13248, PMEL, 66430, 168880, 12-2018; 13248, PMEL, 66433, 168883, 111-2096; 13248, PMEL, 66436, 168886, 664-2649; 13248, PMEL, 66440, 168890, 422-2407; 13248, PMEL, 66441, 168891, 32-1759; 13249, PRPF18, 66442, 168892, 286-788; 13249, PRPF18, 66444, 168894, 315-1062; 13249, PRPF18, 66443, 168893, 161-1189; 13250, PRPF19, 66446, 168896, 188-943; 13250, PRPF19, 66447, 168897, 1-138; 13250, PRPF19, 66448, 168898, 1-360; 13250, PRPF19, 66449, 168899, 503-814; 13250, PRPF19, 66445, 168895, 207-1721; 13251, PRPF3, 66450, 168900, 166-2217; 13252, PRPF31, 66452, 168902, 9-1490; 13252, PRPF31, 66453, 168903, 73-854; 13252, PRPF31, 66454, 168904, 76-928; 13252, PRPF31, 66456, 168906, 58-886; 13252, PRPF31, 66457, 168907, 397-1872; 13252, PRPF31, 66458, 168908, 58-886; 13252, PRPF31, 66459, 168909, 70-851; 13252, PRPF31, 66461, 168911, 9-1490; 13252, PRPF31, 66462, 168912, 397-1872; 13252, PRPF31, 66463, 168913, 397-1896; 13252, PRPF31, 66465, 168915, 397-1896; 13252, PRPF31, 66466, 168916, 397-1896; 13252, PRPF31, 66467, 168917, 397-1896; 13252, PRPF31, 66468, 168918, 397-1896; 13252, PRPF31, 66470, 168920, 397-1896; 13252, PRPF31, 66471, 168921, 397-1872; 13252, PRPF31, 66472, 168922, 76-928; 13252, PRPF31, 66474, 168924, 397-1872; 13252, PRPF31, 66475, 168925, 397-1872; 13252, PRPF31, 66476, 168926, 397-1872; 13252, PRPF31, 66451, 168901, 350-1849; 13252, PRPF31, 66455, 168905, 397-1872; 13252, PRPF31, 66460, 168910, 397-1872; 13252, PRPF31, 66464, 168914, 397-1872; 13252, PRPF31, 66469, 168919, 397-1872; 13252, PRPF31, 66473, 168923, 350-1849; 13252, PRPF31, 66477, 168927, 397-1896; 13252, PRPF31, 66478, 168928, 397-1896; 13253, PRPF38A, 66479, 168929, 187-1125; 13254, PRPF38B, 66480, 168930, 638-1945; 13254, PRPF38B, 66481, 168931, 269-841; 13254, PRPF38B, 66482, 168932, 270-1910; 13255, PRPF39, 66484, 168934, 142-600; 13255, PRPF39, 66485, 168935, 2-460; 13255, PRPF39, 66486, 168936, 20-478; 13255, PRPF39, 66487, 168937, 1-52; 13255, PRPF39, 66488, 168938, 163-582; 13255, PRPF39, 66489, 168939, 1-272; 13255, PRPF39, 66483, 168933, 171-2180; 13256, PRPF4, 66490, 168940, 103-1671; 13256, PRPF4, 66491, 168941, 402-1967; 13257, PRPF4B, 66494, 168944, 1-1764; 13257, PRPF4B, 66492, 168942, 101-3124; 13257, PRPF4B, 66493, 168943, 160-3183; 13258, PRPF6, 66495, 168945, 112-2937; 13259, PRPF8, 66497, 168947, 237-3274; 13259, PRPF8, 66498, 168948, 1-350; 13259, PRPF8, 66500, 168950, 1-749; 13259, PRPF8, 66502, 168952, 237-3274; 13259, PRPF8, 66496, 168946, 115-7122; 13259, PRPF8, 66499, 168949, 267-7274; 13259, PRPF8, 66501, 168951, 115-7122; 13259, PRPF8, 66503, 168953, 267-7274; 13260, PDSS1, 66505, 168955, 1-476; 13260, PDSS1, 66504, 168954, 54-1301; 13261, PDSS2, 66508, 168958, 1-241; 13261, PDSS2, 66506, 168956, 280-1002; 13261, PDSS2, 66507, 168957, 279-1478; 13262, PCYOX1, 66509, 168959, 17-898; 13262, PCYOX1, 66511, 168961, 168-556; 13262, PCYOX1, 66512, 168962, 186-648; 13262, PCYOX1, 66513, 168963, 330-957; 13262, PCYOX1, 66510, 168960, 29-1546; 13263, PCYOX1L, 66515, 168965, 33-368; 13263, PCYOX1L, 66518, 168968, 580-1794; 13263, PCYOX1L, 66514, 168964, 63-1547; 13263, PCYOX1L, 66516, 168966, 1-249; 13263, PCYOX1L, 66517, 168967, 1-249; 13264, PNOC, 66520, 168970, 92-554; 13264, PNOC, 66519, 168969, 209-739; 13264, PNOC, 66521, 168971, 208-546; 13265, PSEN1, 66526, 168976, 1823-2950; 13265, PSEN1, 66527, 168977, 280-552; 13265, PSEN1, 66528, 168978, 288-754; 13265, PSEN1, 66530, 168980, 368-555; 13265, PSEN1, 66532, 168982, 167-571; 13265, PSEN1, 66533, 168983, 384-574; 13265, PSEN1, 66534, 168984, 315-442; 13265, PSEN1, 66535, 168985, 272-712; 13265, PSEN1, 66536, 168986, 279-576; 13265, PSEN1, 66537, 168987, 265-591; 13265, PSEN1, 66538, 168988, 274-550; 13265, PSEN1, 66540, 168990, 439-612; 13265, PSEN1, 66541, 168991, 317-591; 13265, PSEN1, 66542, 168992, 371-699; 13265, PSEN1, 66543, 168993, 198-371; 13265, PSEN1, 66522, 168972, 273-1676; 13265, PSEN1, 66523, 168973, 273-1664; 13265, PSEN1, 66524, 168974, 273-827; 13265, PSEN1, 66525, 168975, 543-1934; 13265, PSEN1, 66529, 168979, 1-1125; 13265, PSEN1, 66531, 168981, 1-1230; 13265, PSEN1, 66539, 168989, 1-1137; 13266, PSEN2, 66544, 168994, 501-1946; 13266, PSEN2, 66547, 168997, 137-1051; 13266, PSEN2, 66548, 168998, 349-782; 13266, PSEN2, 66549, 168999, 672-734; 13266, PSEN2, 66550, 169000, 241-627; 13266, PSEN2, 66551, 169001, 1-1446; 13266, PSEN2, 66545, 168995, 437-1783; 13266, PSEN2, 66546, 168996, 380-1723; 13267, PARL, 66554, 169004, 1-338; 13267, PARL, 66555, 169005, 1-476; 13267, PARL, 66556, 169006, 1-514; 13267, PARL, 66557, 169007, 10-897; 13267, PARL, 66558, 169008, 1-192; 13267, PARL, 66559, 169009, 63-584; 13267, PARL, 66552, 169002, 43-1032; 13267, PARL, 66553, 169003, 62-1201; 13268, PSENEN, 66562, 169012, 198-491; 13268, PSENEN, 66560, 169010, 141-446; 13268, PSENEN, 66561, 169011, 684-989; 13269, PAM16, 66564, 169014, 37-450; 13269, PAM16, 66565, 169015, 109-393; 13269, PAM16, 66566, 169016, 32-421; 13269, PAM16, 66567, 169017, 82-267; 13269, PAM16, 66568, 169018, 217-654; 13269, PAM16, 66569, 169019, 1-179; 13269, PAM16, 66570, 169020, 169-606; 13269, PAM16, 66573, 169023, 82-267; 13269, PAM16, 66575, 169025, 32-421; 13269, PAM16, 66576, 169026, 217-654; 13269, PAM16, 66577, 169027, 169-606; 13269, PAM16, 66578, 169028, 37-450; 13269, PAM16, 66579, 169029, 109-393; 13269, PAM16, 66580, 169030, 1-179; 13269, PAM16, 66563, 169013, 139-516; 13269, PAM16, 66571, 169021, 48-425; 13269, PAM16, 66572, 169022, 139-516; 13269, PAM16, 66574, 169024, 33-410; 13270, N/A, 66581, 169031, 342-1139; 13270, N/A, 66582, 169032, 342-1139; 13271, PRICKLE1, 66586, 169036, 128-456; 13271, PRICKLE1, 66587, 169037, 337-693; 13271, PRICKLE1, 66588, 169038, 108-585; 13271, PRICKLE1, 66583, 169033, 261-2756; 13271, PRICKLE1, 66584, 169034, 131-2626; 13271, PRICKLE1, 66585, 169035, 287-2782; 13271, PRICKLE1, 66589, 169039, 231-2726; 13271, PRICKLE1, 66590, 169040, 288-2783; 13272, PRICKLE2, 66592, 169042, 122-573; 13272, PRICKLE2, 66593, 169043, 11-2713; 13272, PRICKLE2, 66594, 169044, 105-524; 13272, PRICKLE2, 66591, 169041, 587-3121; 13273, PRICKLE3, 66595, 169045, 232-574; 13273, PRICKLE3, 66596, 169046, 242-1885; 13273, PRICKLE3, 66597, 169047, 236-990; 13273, PRICKLE3, 66598, 169048, 231-527; 13273, PRICKLE3, 66599, 169049, 96-1943; 13274, PRICKLE4, 66602, 169052, 1-939; 13274, PRICKLE4, 66603, 169053, 1-1035; 13274, PRICKLE4, 66604, 169054, 1-1155; 13274, PRICKLE4, 66605, 169055, 662-874; 13274, PRICKLE4, 66607, 169057, 1-844; 13274, PRICKLE4, 66600, 169050, 588-1742; 13274, PRICKLE4, 66601, 169051, 821-1855; 13274, PRICKLE4, 66606, 169056, 249-1403; 13275, PIFO, 66608, 169058, 34-510; 13275, PIFO, 66609, 169059, 366-941; 13276, PRIMPOL, 66612, 169062, 528-1823; 13276, PRIMPOL, 66613, 169063, 263-601; 13276, PRIMPOL, 66614, 169064, 309-590; 13276, PRIMPOL, 66615, 169065, 270-608; 13276, PRIMPOL, 66616, 169066, 1-518; 13276, PRIMPOL, 66617, 169067, 322-2001; 13276, PRIMPOL, 66610, 169060, 434-2116; 13276, PRIMPOL, 66611, 169061, 349-2031; 13277, PRIM1, 66619, 169069, 76-633; 13277,

PRIM1, 66620, 169070, 1-456; 13277, PRIM1, 66621, 169071, 26-1008; 13277, PRIM1, 66618, 169068, 38-1300; 13278, PRIM2, 66625, 169075, 1-280; 13278, PRIM2, 66622, 169072, 126-602; 13278, PRIM2, 66623, 169073, 88-1617; 13278, PRIM2, 66624, 169074, 88-564; 13279, PRNP, 66628, 169078, 60-806; 13279, PRNP, 66629, 169079, 205-855; 13279, PRNP, 66626, 169076, 288-1049; 13279, PRNP, 66627, 169077, 170-931; 13280, PRNT, 66630, 169080, 939-1223; 13280, PRNT, 66631, 169081, 702-986; 13280, PRNT, 66632, 169082, 479-763; 13281, PRND, 66633, 169083, 72-602; 13282, PAWR, 66635, 169085, 268-494; 13282, PAWR, 66636, 169086, 1-219; 13282, PAWR, 66637, 169087, 1-583; 13282, PAWR, 66638, 169088, 174-364; 13282, PAWR, 66634, 169084, 374-1396; 13283, PRKRIP1, 66641, 169091, 71-454; 13283, PRKRIP1, 66639, 169089, 50-604; 13283, PRKRIP1, 66640, 169090, 1311-1865; 13284, PANO1, 66642, 169092, 116-763; 13285, PCOLCE, 66643, 169093, 281-1630; 13286, PCOLCE2, 66645, 169095, 1-304; 13286, PCOLCE2, 66646, 169096, 1-423; 13286, PCOLCE2, 66647, 169097, 4-915; 13286, PCOLCE2, 66644, 169094, 308-1555; 13287, PLOD1, 66649, 169099, 38-886; 13287, PLOD1, 66650, 169100, 87-762; 13287, PLOD1, 66648, 169098, 28-2211; 13288, PLOD2, 66654, 169104, 3-299; 13288, PLOD2, 66655, 169105, 36-723; 13288, PLOD2, 66656, 169106, 261-2372; 13288, PLOD2, 66651, 169101, 179-2455; 13288, PLOD2, 66652, 169102, 179-2392; 13288, PLOD2, 66653, 169103, 510-1766; 13289, PLOD3, 66658, 169108, 1-200; 13289, PLOD3, 66659, 169109, 1-378; 13289, PLOD3, 66660, 169110, 26-539; 13289, PLOD3, 66661, 169111, 1-794; 13289, PLOD3, 66662, 169112, 1-809; 13289, PLOD3, 66663, 169113, 337-563; 13289, PLOD3, 66657, 169107, 400-2616; 13290, PDYN, 66664, 169114, 227-991; 13290, PDYN, 66665, 169115, 395-1159; 13290, PDYN, 66666, 169116, 142-906; 13291, PENK, 66669, 169119, 151-467; 13291, PENK, 66670, 169120, 133-372; 13291, PENK, 66671, 169121, 1-267; 13291, PENK, 66672, 169122, 155-433; 13291, PENK, 66667, 169117, 78-881; 13291, PENK, 66668, 169118, 226-1029; 13292, PFN1, 66674, 169124, 43-539; 13292, PFN1, 66675, 169125, 626-940; 13292, PFN1, 66673, 169123, 621-1043; 13293, PFN2, 66677, 169127, 67-633; 13293, PFN2, 66679, 169129, 70-447; 13293, PFN2, 66680, 169130, 140-415; 13293, PFN2, 66681, 169131, 49-186; 13293, PFN2, 66682, 169132, 49-186; 13293, PFN2, 66683, 169133, 133-408; 13293, PFN2, 66684, 169134, 64-339; 13293, PFN2, 66685, 169135, 43-210; 13293, PFN2, 66686, 169136, 27-194; 13293, PFN2, 66687, 169137, 208-483; 13293, PFN2, 66688, 169138, 77-352; 13293, PFN2, 66689, 169139, 85-417; 13293, PFN2, 66690, 169140, 113-388; 13293, PFN2, 66691, 169141, 188-463; 13293, PFN2, 66676, 169126, 254-676; 13293, PFN2, 66678, 169128, 95-517; 13294, PFN3, 66692, 169142, 61-474; 13295, PFN4, 66694, 169144, 442-470; 13295, PFN4, 66693, 169143, 373-762; 13296, PGC, 66695, 169145, 62-480; 13296, PGC, 66697, 169147, 142-399; 13296, PGC, 66696, 169146, 64-1230; 13296, PGC, 66698, 169148, 68-1015; 13297, PAEP, 66701, 169151, 1-394; 13297, PAEP, 66702, 169152, 1-100; 13297, PAEP, 66703, 169153, 1-399; 13297, PAEP, 66704, 169154, 1-379; 13297, PAEP, 66706, 169156, 47-556; 13297, PAEP, 66707, 169157, 45-476; 13297, PAEP, 66699, 169149, 26-568; 13297, PAEP, 66700, 169150, 36-578; 13297, PAEP, 66705, 169155, 45-587; 13298, PIBF1, 66709, 169159, 258-2354; 13298, PIBF1, 66708, 169158, 339-2612; 13298, PIBF1, 66710, 169160, 387-1037; 13299, PGR, 66713, 169163, 1-2412; 13299, PGR, 66714, 169164, 1-2295; 13299, PGR, 66716, 169166, 1-2088; 13299, PGR, 66717, 169167, 744-2816; 13299, PGR, 66718, 169168, 744-3038; 13299, PGR, 66719, 169169, 40-551; 13299, PGR, 66711, 169161, 1-2496; 13299, PGR, 66712, 169162, 1455-4256; 13299, PGR, 66715, 169165, 446-1465; 13300, PGRMC1, 66720, 169170, 112-699; 13300, PGRMC1, 66721, 169171, 120-551; 13301, PGRMC2, 66724, 169174, 664-798; 13301, PGRMC2, 66725, 169175, 283-417; 13301, PGRMC2, 66726, 169176, 306-440; 13301, PGRMC2, 66727, 169177, 1-180; 13301, PGRMC2, 66728, 169178, 98-373; 13301, PGRMC2, 66722, 169172, 22-693; 13301, PGRMC2, 66723, 169173, 968-1711; 13301, PGRMC2, 66729, 169179, 961-1704; 13302, PAQR3, 66730, 169180, 171-1046; 13302, PAQR3, 66732, 169182, 8-214; 13302, PAQR3, 66731, 169181, 180-989; 13302, PAQR3, 66733, 169183, 215-1150; 13302, PAQR3, 66734, 169184, 1-267; 13302, PAQR3, 66735, 169185, 2-937; 13302, PAQR3, 66736, 169186, 136-402; 13303, PAQR4, 66739, 169189, 215-835; 13303, PAQR4, 66740, 169190, 118-717; 13303, PAQR4, 66741, 169191, 139-759; 13303, PAQR4, 66737, 169187, 406-1110; 13303, PAQR4, 66738, 169188, 431-1252; 13304, PAQR9, 66743, 169193, 1-439; 13304, PAQR9, 66744, 169194, 1-117; 13304, PAQR9, 66742, 169192, 347-1480; 13305, PAQR5, 66747, 169197, 348-728; 13305, PAQR5, 66745, 169195, 132-1124; 13305, PAQR5, 66746, 169196, 387-1379; 13305, PAQR5, 66748, 169198, 673-1665; 13306, PAQR6, 66751, 169201, 1-1092; 13306, PAQR6, 66754, 169204, 554-1189; 13306, PAQR6, 66755, 169205, 424-1059; 13306, PAQR6, 66756, 169206, 646-1497; 13306, PAQR6, 66757, 169207, 786-1421; 13306, PAQR6, 66749, 169199, 160-1194; 13306, PAQR6, 66750, 169200, 617-1672; 13306, PAQR6, 66752, 169202, 310-1335; 13306, PAQR6, 66753, 169203, 97-1059; 13307, PAQR7, 66758, 169208, 668-1708; 13308, PAQR8, 66761, 169211, 247-582; 13308, PAQR8, 66759, 169209, 178-1242; 13308, PAQR8, 66760, 169210, 175-1239; 13309, PDCD1, 66763, 169213, 1-366; 13309, PDCD1, 66764, 169214, 28-228; 13309, PDCD1, 66766, 169216, 28-228; 13309, PDCD1, 66767, 169217, 1-366; 13309, PDCD1, 66762, 169212, 71-937; 13309, PDCD1, 66765, 169215, 71-937; 13310, PDCD1LG2, 66768, 169218, 249-1070; 13311, PDCD10, 66770, 169220, 242-849; 13311, PDCD10, 66772, 169222, 171-620; 13311, PDCD10, 66773, 169223, 196-756; 13311, PDCD10, 66774, 169224, 349-585; 13311, PDCD10, 66776, 169226, 285-686; 13311, PDCD10, 66778, 169228, 141-701; 13311, PDCD10, 66779, 169229, 1-367; 13311, PDCD10, 66780, 169230, 276-715; 13311, PDCD10, 66781, 169231, 248-427; 13311, PDCD10, 66769, 169219, 419-1057; 13311, PDCD10, 66771, 169221, 336-974; 13311, PDCD10, 66775, 169225, 324-962; 13311, PDCD10, 66777, 169227, 230-868; 13311, PDCD10, 66782, 169232, 242-880; 13312, PDCD11, 66784, 169234, 93-209; 13312, PDCD11, 66783, 169233, 95-5710; 13313, PDCD2, 66785, 169235, 65-730; 13313, PDCD2, 66789, 169239, 1-123; 13313, PDCD2, 66791, 169241, 32-928; 13313, PDCD2, 66792, 169242, 1-140; 13313, PDCD2, 66794, 169244, 1-108; 13313, PDCD2, 66795, 169245, 25-324; 13313, PDCD2, 66796, 169246, 496-560; 13313, PDCD2, 66797, 169247, 112-411; 13313, PDCD2, 66798, 169248, 112-777; 13313, PDCD2, 66786, 169236, 1-936; 13313, PDCD2, 66787, 169237, 74-661; 13313, PDCD2, 66788, 169238, 32-718; 13313, PDCD2, 66790, 169240, 80-1114; 13313, PDCD2, 66793, 169243, 35-601; 13314, PDCD2L, 66800, 169250, 274-444; 13314, PDCD2L, 66799, 169249, 48-1124; 13315, PDCD4, 66803, 169253, 127-819; 13315, PDCD4, 66801, 169251, 275-1684; 13315, PDCD4, 66802, 169252, 404-1780; 13316,

PDCD5, 66804, 169254, 61-228; 13316, PDCD5, 66805, 169255, 6-128; 13316, PDCD5, 66807, 169257, 224-487; 13316, PDCD5, 66808, 169258, 31-228; 13316, PDCD5, 66806, 169256, 195-572; 13316, PDCD5, 66809, 169259, 62-451; 13317, PDCD6, 66812, 169262, 65-232; 13317, PDCD6, 66814, 169264, 61-180; 13317, PDCD6, 66815, 169265, 1-315; 13317, PDCD6, 66816, 169266, 52-273; 13317, PDCD6, 66817, 169267, 101-472; 13317, PDCD6, 66818, 169268, 226-591; 13317, PDCD6, 66819, 169269, 101-220; 13317, PDCD6, 66810, 169260, 101-676; 13317, PDCD6, 66811, 169261, 75-284; 13317, PDCD6, 66813, 169263, 65-634; 13318, PDCD6IP, 66821, 169271, 119-337; 13318, PDCD6IP, 66822, 169272, 109-345; 13318, PDCD6IP, 66823, 169273, 107-566; 13318, PDCD6IP, 66825, 169275, 55-342; 13318, PDCD6IP, 66820, 169270, 378-2984; 13318, PDCD6IP, 66824, 169274, 159-2780; 13319, PDCD7, 66827, 169277, 1-309; 13319, PDCD7, 66826, 169276, 56-1513; 13320, PROD, 66828, 169278, 53-217; 13320, PROD, 66829, 169279, 110-274; 13321, PHB, 66831, 169281, 170-907; 13321, PHB, 66832, 169282, 129-732; 13321, PHB, 66833, 169283, 161-534; 13321, PHB, 66834, 169284, 89-694; 13321, PHB, 66836, 169286, 147-796; 13321, PHB, 66830, 169280, 74-892; 13321, PHB, 66835, 169285, 99-566; 13321, PHB, 66837, 169287, 191-1009; 13321, PHB, 66838, 169288, 147-965; 13322, PHB2, 66839, 169289, 81-977; 13322, PHB2, 66841, 169291, 138-476; 13322, PHB2, 66842, 169292, 209-472; 13322, PHB2, 66843, 169293, 100-739; 13322, PHB2, 66844, 169294, 107-910; 13322, PHB2, 66845, 169295, 125-908; 13322, PHB2, 66847, 169297, 1-309; 13322, PHB2, 66840, 169290, 211-996; 13322, PHB2, 66846, 169296, 283-1182; 13323, PROK1, 66848, 169298, 18-335; 13324, PROK2, 66849, 169299, 155-481; 13324, PROK2, 66850, 169300, 10-399; 13325, PROKR1, 66851, 169301, 421-1602; 13326, PROKR2, 66852, 169302, 1-1155; 13327, PRL, 66854, 169304, 520-1110; 13327, PRL, 66855, 169305, 520-1206; 13327, PRL, 66853, 169303, 520-1203; 13328, PRLR, 66859, 169309, 18-122; 13328, PRLR, 66860, 169310, 479-581; 13328, PRLR, 66861, 169311, 261-568; 13328, PRLR, 66863, 169313, 398-583; 13328, PRLR, 66865, 169315, 228-588; 13328, PRLR, 66868, 169318, 246-579; 13328, PRLR, 66869, 169319, 248-349; 13328, PRLR, 66871, 169321, 18-122; 13328, PRLR, 66856, 169306, 18-1148; 13328, PRLR, 66857, 169307, 1-1050; 13328, PRLR, 66858, 169308, 18-824; 13328, PRLR, 66862, 169312, 1-1566; 13328, PRLR, 66864, 169314, 106-912; 13328, PRLR, 66866, 169316, 18-884; 13328, PRLR, 66867, 169317, 106-972; 13328, PRLR, 66870, 169320, 106-1236; 13328, PRLR, 66872, 169322, 106-1671; 13328, PRLR, 66873, 169323, 428-2296; 13328, PRLR, 66874, 169324, 106-1155; 13329, PREB, 66876, 169326, 192-1271; 13329, PREB, 66877, 169327, 1-69; 13329, PREB, 66878, 169328, 1-529; 13329, PREB, 66879, 169329, 1-319; 13329, PREB, 66880, 169330, 195-347; 13329, PREB, 66875, 169325, 255-1508; 13330, PRLH, 66881, 169331, 1-264; 13331, PRLHR, 66882, 169332, 191-1303; 13332, PIP, 66883, 169333, 41-481; 13333, PCNA, 66884, 169334, 229-1014; 13333, PCNA, 66885, 169335, 244-1029; 13334, PA2G4, 66887, 169337, 501-694; 13334, PA2G4, 66888, 169338, 126-687; 13334, PA2G4, 66889, 169339, 202-1056; 13334, PA2G4, 66886, 169336, 420-1604; 13335, PROSER1, 66891, 169341, 596-898; 13335, PROSER1, 66890, 169340, 835-3669; 13335, PROSER1, 66892, 169342, 835-3603; 13336, PROSER2, 66894, 169344, 44-763; 13336, PROSER2, 66895, 169345, 222-476; 13336, PROSER2, 66893, 169343, 155-1462; 13336, PROSER2, 66896, 169346, 155-1180; 13337, PROSER3, 66897, 169347, 61-826; 13337, PROSER3, 66899, 169349, 321-579; 13337, PROSER3, 66900, 169350, 1-158; 13337, PROSER3, 66902, 169352, 332-612; 13337, PROSER3, 66904, 169354, 19-303; 13337, PROSER3, 66905, 169355, 1-503; 13337, PROSER3, 66906, 169356, 1-273; 13337, PROSER3, 66907, 169357, 33-1007; 13337, PROSER3, 66898, 169348, 64-1506; 13337, PROSER3, 66901, 169351, 23-607; 13337, PROSER3, 66903, 169353, 38-619; 13338, PRODH, 66908, 169358, 114-1592; 13338, PRODH, 66910, 169360, 190-594; 13338, PRODH, 66911, 169361, 1-553; 13338, PRODH, 66912, 169362, 162-1640; 13338, PRODH, 66913, 169363, 1-491; 13338, PRODH, 66914, 169364, 205-2007; 13338, PRODH, 66909, 169359, 267-2069; 13339, PRODH2, 66916, 169366, 1-359; 13339, PRODH2, 66917, 169367, 1-222; 13339, PRODH2, 66915, 169365, 19-1629; 13340, PRR11, 66919, 169369, 103-536; 13340, PRR11, 66921, 169371, 1-160; 13340, PRR11, 66922, 169372, 264-860; 13340, PRR11, 66924, 169374, 133-199; 13340, PRR11, 66918, 169368, 313-1395; 13340, PRR11, 66920, 169370, 55-1137; 13340, PRR11, 66923, 169373, 66-1148; 13340, PRR11, 66925, 169375, 55-1137; 13341, PRR12, 66926, 169376, 13-6123; 13341, PRR12, 66927, 169377, 1-3648; 13342, PRR13, 66930, 169380, 97-261; 13342, PRR13, 66931, 169381, 41-529; 13342, PRR13, 66933, 169383, 67-522; 13342, PRR13, 66935, 169385, 82-432; 13342, PRR13, 66937, 169387, 69-245; 13342, PRR13, 66938, 169388, 66-224; 13342, PRR13, 66928, 169378, 52-348; 13342, PRR13, 66929, 169379, 209-655; 13342, PRR13, 66932, 169382, 53-499; 13342, PRR13, 66934, 169384, 65-361; 13342, PRR13, 66936, 169386, 144-590; 13343, PRR14, 66941, 169391, 129-856; 13343, PRR14, 66942, 169392, 215-528; 13343, PRR14, 66939, 169389, 312-2069; 13343, PRR14, 66940, 169390, 457-2214; 13344, PRR14L, 66944, 169394, 1-1357; 13344, PRR14L, 66945, 169395, 1-2028; 13344, PRR14L, 66946, 169396, 1-625; 13344, PRR14L, 66947, 169397, 121-661; 13344, PRR14L, 66943, 169393, 191-6646; 13345, PRR15, 66949, 169399, 450-503; 13345, PRR15, 66948, 169398, 713-1102; 13346, PRR15L, 66950, 169400, 252-563; 13347, PRR16, 66953, 169403, 181-936; 13347, PRR16, 66954, 169404, 133-559; 13347, PRR16, 66951, 169401, 358-1203; 13347, PRR16, 66952, 169402, 210-1124; 13347, PRR16, 66955, 169405, 373-1077; 13348, PRR18, 66957, 169407, 231-580; 13348, PRR18, 66956, 169406, 242-1129; 13349, PRR19, 66960, 169410, 128-746; 13349, PRR19, 66958, 169408, 379-1449; 13349, PRR19, 66959, 169409, 812-1882; 13349, PRR19, 66961, 169411, 413-1120; 13350, PRR20A, 66962, 169412, 234-899; 13351, PRR20B, 66963, 169413, 234-899; 13352, PRR20C, 66964, 169414, 234-899; 13352, PRR20C, 66965, 169415, 234-899; 13353, PRR20D, 66966, 169416, 234-899; 13354, PRR20E, 66967, 169417, 234-899; 13355, PRR21, 66968, 169418, 1-1170; 13356, PRR22, 66970, 169420, 1-248; 13356, PRR22, 66969, 169419, 106-1374; 13357, PRR23D1, 66971, 169421, 178-1017; 13357, PRR23D1, 66972, 169422, 178-1017; 13358, PRR23D2, 66973, 169423, 178-1017; 13359, PRR23A, 66974, 169424, 1-801; 13360, PRR23B, 66975, 169425, 266-1063; 13361, PRR23C, 66976, 169426, 273-1061; 13362, PRR25, 66977, 169427, 1-1209; 13363, PRR26, 66978, 169428, 35-631; 13363, PRR26, 66979, 169429, 164-829; 13364, PRR27, 66981, 169431, 134-214; 13364, PRR27, 66982, 169432, 1-185; 13364, PRR27, 66984, 169434, 74-733; 13364, PRR27, 66985, 169435, 190-849; 13364, PRR27, 66986, 169436, 1-185; 13364, PRR27, 66987, 169437, 134-214; 13364, PRR27, 66980, 169430, 190-849; 13364, PRR27, 66983, 169433, 74-733; 13365, PRR29, 66990, 169440, 11-124; 13365, PRR29, 66992, 169442, 11-478; 13365, PRR29, 66994, 169444, 92-508; 13365, PRR29, 66988, 169438, 15-725; 13365, PRR29, 66989, 169439, 15-584; 13365, PRR29, 66991, 169441, 15-563; 13365, PRR29, 66993, 169443, 15-311; 13366, PRR3, 66995, 169445, 66-569; 13366, PRR3, 66996, 169446, 460-1026; 13366, PRR3, 66997, 169447, 460-1026; 13366, PRR3, 66998, 169448, 460-1026; 13366, PRR3, 66999, 169449, 66-569; 13366, PRR3, 67000, 169450, 460-1026; 13366, PRR3, 67001, 169451, 460-1026; 13366, PRR3, 67002, 169452, 66-569; 13366, PRR3, 67003, 169453, 66-569; 13366, PRR3, 67004, 169454, 460-1026; 13366, PRR3, 67005, 169455, 66-569; 13366, PRR3, 67006, 169456, 66-569; 13366, PRR3, 67007, 169457, 66-569; 13366, PRR3, 67008, 169458, 460-1026; 13367, PRR30, 67010, 169460, 520-832; 13367, PRR30, 67009, 169459, 527-1765; 13368, PRR32, 67011, 169461, 81-977; 13369, PRR33, 67012, 169462, 271-1710; 13370, PRR34, 67013, 169463, 52-468; 13371, PRR35, 67014, 169464, 280-1995; 13372, PRR36, 67016, 169466, 1-826; 13372, PRR36, 67015, 169465, 102-4142; 13373, PRR4, 67019, 169469, 39-275; 13373, PRR4, 67021, 169471, 39-275; 13373, PRR4, 67024, 169474, 326-769; 13373, PRR4, 67025, 169475, 39-539; 13373, PRR4, 67027, 169477, 326-769; 13373, PRR4, 67028, 169478, 39-275; 13373, PRR4, 67017, 169467, 39-443; 13373, PRR4, 67018, 169468, 34-231; 13373, PRR4, 67020, 169470, 39-443; 13373, PRR4, 67022, 169472, 34-231; 13373, PRR4, 67023, 169473, 39-443; 13373, PRR4, 67026, 169476, 34-231; 13374, PRR5, 67031, 169481, 258-789; 13374, PRR5, 67033, 169483, 17-358; 13374, PRR5, 67034, 169484, 104-905; 13374, PRR5, 67035, 169485, 257-625; 13374, PRR5, 67036, 169486, 203-881; 13374, PRR5, 67029, 169479, 195-1334; 13374, PRR5, 67030, 169480, 278-1444; 13374, PRR5, 67032, 169482, 610-1845; 13374, PRR5, 67037, 169487, 411-1292; 13374, PRR5, 67038, 169488, 270-1409; 13374, PRR5, 67039, 169489, 585-1466; 13375, PRRSL, 67041, 169491, 429-577; 13375, PRRSL, 67042, 169492, 366-592; 13375, PRRSL, 67043, 169493, 329-554; 13375, PRRSL, 67044, 169494, 404-548; 13375, PRRSL, 67045, 169495, 402-544; 13375, PRRSL, 67046, 169496, 324-572; 13375, PRRSL, 67049, 169499, 542-783; 13375, PRRSL, 67050, 169500, 616-805; 13375, PRRSL, 67040, 169490, 356-1462; 13375, PRRSL, 67047, 169497, 277-1383; 13375, PRRSL, 67048, 169498, 58-675; 13376, PRR7, 67054, 169504, 458-993; 13376, PRR7, 67051, 169501, 491-1315; 13376, PRR7, 67052, 169502, 374-1198; 13376, PRR7, 67053, 169503, 314-1138; 13377, PRR9, 67055, 169505, 57-407; 13378, PRRG1, 67058, 169508, 182-628; 13378, PRRG1, 67060, 169510, 239-582; 13378, PRRG1, 67056, 169506, 163-819; 13378, PRRG1, 67057, 169507, 157-813; 13378, PRRG1, 67059, 169509, 59-307; 13378, PRRG1, 67061, 169511, 182-838; 13378, PRRG1, 67062, 169512, 273-929; 13379, PRRG2, 67064, 169514, 140-435; 13379, PRRG2, 67065, 169515, 148-438; 13379, PRRG2, 67063, 169513, 170-778; 13380, PRRG3, 67067, 169517, 98-406; 13380, PRRG3, 67068, 169518, 1-276; 13380, PRRG3, 67069, 169519, 184-339; 13380, PRRG3, 67066, 169516, 391-1086; 13380, PRRG3, 67070, 169520, 50-745; 13381, PRRG4, 67071, 169521, 254-934; 13382, PRIMA1, 67072, 169522, 42-416; 13382, PRIMA1, 67073, 169523, 104-565; 13382, PRIMA1, 67074, 169524, 42-503; 13382, PRIMA1, 67075, 169525, 43-417; 13382, PRIMA1, 67076, 169526, 42-503; 13382, PRIMA1, 67077, 169527, 42-416; 13382, PRIMA1, 67078, 169528, 43-417; 13382, PRIMA1, 67079, 169529, 104-565; 13383, PROL1, 67081, 169531, 81-683; 13383, PROL1, 67080, 169530, 175-921; 13384, PRORY, 67082, 169532, 98-646; 13385, PROSC, 67084, 169534, 61-516; 13385, PROSC, 67085, 169535, 159-569; 13385, PROSC, 67086, 169536, 51-275; 13385, PROSC, 67087, 169537, 1-384; 13385, PROSC, 67083, 169533, 68-895; 13386, PELP1, 67088, 169538, 77-3619; 13386, PELP1, 67089, 169539, 750-3470; 13386, PELP1, 67090, 169540, 1-442; 13386, PELP1, 67091, 169541, 65-3607; 13386, PELP1, 67092, 169542, 1-902; 13386, PELP1, 67093, 169543, 1-469; 13386, PELP1, 67094, 169544, 269-567; 13386, PELP1, 67095, 169545, 19-3411; 13387, PRELP, 67096, 169546, 128-1276; 13388, PHGR1, 67097, 169547, 57-305; 13389, PSRC1, 67103, 169553, 141-835; 13389, PSRC1, 67104, 169554, 425-1040; 13389, PSRC1, 67106, 169556, 1-366; 13389, PSRC1, 67098, 169548, 141-1142; 13389, PSRC1, 67099, 169549, 87-1019; 13389, PSRC1, 67100, 169550, 119-1120; 13389, PSRC1, 67101, 169551, 145-1146; 13389, PSRC1, 67102, 169552, 132-1133; 13389, PSRC1, 67105, 169555, 147-1238; 13390, PRAP1, 67107, 169557, 23-955; 13390, PRAP1, 67108, 169558, 273-728; 13390, PRAP1, 67109, 169559, 51-479; 13391, PROB1, 67110, 169560, 633-3680; 13392, PRRC1, 67111, 169561, 189-1526; 13392, PRRC1, 67112, 169562, 147-1403; 13392, PRRC1, 67113, 169563, 142-1530; 13393, PRRC2A, 67114, 169564, 203-6676; 13393, PRRC2A, 67115, 169565, 235-6708; 13393, PRRC2A, 67116, 169566, 235-6708; 13393, PRRC2A, 67117, 169567, 203-6676; 13393, PRRC2A, 67118, 169568, 203-6676; 13393, PRRC2A, 67119, 169569, 235-6708; 13393, PRRC2A, 67120, 169570, 203-6676; 13393, PRRC2A, 67121, 169571, 203-6676; 13393, PRRC2A, 67122, 169572, 235-6708; 13393, PRRC2A, 67123, 169573, 235-6708; 13393, PRRC2A, 67124, 169574, 203-6676; 13393, PRRC2A, 67125, 169575, 203-6676; 13393, PRRC2A, 67126, 169576, 235-6708; 13393, PRRC2A, 67127, 169577, 235-6708; 13394, PRRC2B, 67128, 169578, 1-535; 13394, PRRC2B, 67131, 169581, 1-1762; 13394, PRRC2B, 67132, 169582, 1-535; 13394, PRRC2B, 67134, 169584, 1-525; 13394, PRRC2B, 67129, 169579, 56-6745; 13394, PRRC2B, 67130, 169580, 227-4834; 13394, PRRC2B, 67133, 169583, 1-807; 13395, PRRC2C, 67136, 169586, 243-8702; 13395, PRRC2C, 67137, 169587, 968-1864; 13395, PRRC2C, 67139, 169589, 1-3902; 13395, PRRC2C, 67135, 169585, 238-8691; 13395, PRRC2C, 67138, 169588, 58-8511; 13396, PNRC1, 67141, 169591, 916-1344; 13396, PNRC1, 67142, 169592, 239-667; 13396, PNRC1, 67140, 169590, 118-1101; 13397, PNRC2, 67145, 169595, 1-171; 13397, PNRC2, 67146, 169596, 373-380; 13397, PNRC2, 67143, 169593, 412-831; 13397, PNRC2, 67144, 169594, 392-811; 13398, PRB1, 67147, 169597, 39-635; 13398, PRB1, 67148, 169598, 38-1030; 13398, PRB1, 67149, 169599, 34-570; 13398, PRB1, 67150, 169600, 36-1286; 13398, PRB1, 67151, 169601, 38-1030; 13398, PRB1, 67152, 169602, 38-1039; 13398, PRB1, 67153, 169603, 34-570; 13398, PRB1, 67154, 169604, 38-493; 13398, PRB1, 67155, 169605, 38-1780; 13398, PRB1, 67156, 169606, 26-622; 13398, PRB1, 67157, 169607, 34-570; 13398, PRB1, 67158, 169608, 39-635; 13399, PRB2, 67160, 169610, 37-100; 13399, PRB2, 67159, 169609, 37-1287; 13400, PRB3, 67162, 169612, 137-1192; 13400, PRB3, 67163, 169613, 39-968; 13400, PRB3, 67164, 169614, 39-968; 13400, PRB3, 67165, 169615, 137-1192; 13400, PRB3, 67161, 169611, 39-968; 13401, PRB4, 67166, 169616, 38-781; 13401, PRB4, 67167, 169617, 38-574; 13401, PRB4, 67168, 169618, 35-778; 13401, PRB4, 67169, 169619, 38-781; 13401, PRB4, 67170, 169620, 38-574; 13401, PRB4, 67171, 169621, 23-829; 13401, PRB4, 67172, 169622, 35-778; 13401, PRB4, 67173, 169623, 38-574; 13402, PRH1, 67174, 169624, 39-539; 13402, PRH1, 67175, 169625, 37-600; 13402, PRH1, 67176, 169626, 39-539; 13402, PRH1, 67177, 169627, 1-423; 13402, PRH1, 67178, 169628, 297-824; 13402, PRH1, 67179, 169629, 1-423; 13402, PRH1, 67180, 169630, 297-824; 13402, PRH1, 67181, 169631, 37-600; 13403, PRH2, 67182, 169632, 39-539; 13403, PRH2, 67183, 169633, 39-539; 13403, PRH2, 67184, 169634, 39-539; 13403, PRH2, 67185, 169635, 39-539; 13403, PRH2, 67186, 169636, 39-539; 13403, PRH2, 67187, 169637, 39-539; 13404, PRRT1, 67192, 169642, 310-497; 13404, PRRT1, 67193, 169643, 310-497; 13404, PRRT1, 67194, 169644, 310-497; 13404, PRRT1, 67196, 169646, 310-497; 13404, PRRT1, 67197, 169647, 310-497; 13404, PRRT1, 67207, 169657, 310-497; 13404, PRRT1, 67209, 169659, 310-497; 13404, PRRT1, 67211, 169661, 310-497; 13404, PRRT1, 67188, 169638, 126-1046; 13404, PRRT1, 67189, 169639, 186-863; 13404, PRRT1, 67190, 169640, 186-863; 13404, PRRT1, 67191, 169641, 126-1046; 13404, PRRT1, 67195, 169645, 186-863; 13404, PRRT1, 67198, 169648, 186-863; 13404, PRRT1, 67199, 169649, 126-1046; 13404, PRRT1, 67200, 169650, 126-1046; 13404, PRRT1, 67201, 169651, 126-1046; 13404, PRRT1, 67202, 169652, 126-1046; 13404, PRRT1, 67203, 169653, 126-1046; 13404, PRRT1, 67204, 169654, 186-863; 13404, PRRT1, 67205, 169655, 186-863; 13404, PRRT1, 67206, 169656, 186-863; 13404, PRRT1, 67208, 169658, 126-1046; 13404, PRRT1, 67210, 169660, 186-863; 13405, PRRT2, 67214, 169664, 247-564; 13405, PRRT2, 67212, 169662, 177-1076; 13405, PRRT2, 67213, 169663, 302-1324; 13405, PRRT2, 67215, 169665, 199-1383; 13405, PRRT2, 67216, 169666, 127-1149; 13406, PRRT3, 67217, 169667, 111-3056; 13406, PRRT3, 67218, 169668, 131-3076; 13406, PRRT3, 67219, 169669, 127-1392; 13407, PRRT4, 67221, 169671, 1-1258; 13407, PRRT4, 67222, 169672, 198-814; 13407, PRRT4, 67223, 169673, 449-1887; 13407, PRRT4, 67225, 169675, 259-883; 13407, PRRT4, 67220, 169670, 315-3014; 13407, PRRT4, 67224, 169674, 117-1406; 13407, PRRT4, 67226, 169676, 198-2897; 13408, PSTPIP1, 67227, 169677, 444-1685; 13408, PSTPIP1, 67230, 169680, 1-400; 13408, PSTPIP1, 67231, 169681, 111-1364; 13408, PSTPIP1, 67232, 169682, 177-611; 13408, PSTPIP1, 67233, 169683, 130-656; 13408, PSTPIP1, 67234, 169684, 156-781; 13408, PSTPIP1, 67235, 169685, 1-756; 13408, PSTPIP1, 67236, 169686, 403-813; 13408, PSTPIP1, 67237, 169687, 453-569; 13408, PSTPIP1, 67238, 169688, 419-724; 13408, PSTPIP1, 67228, 169678, 1-1194; 13408, PSTPIP1, 67229, 169679, 490-1740; 13409, PSTPIP2, 67239, 169689, 73-1077; 13409, PSTPIP2, 67240, 169690, 70-1008; 13410, P3H1, 67243, 169693, 32-654; 13410, P3H1, 67245, 169695, 1-667; 13410, P3H1, 67241, 169691, 42-2456; 13410, P3H1, 67242, 169692, 53-2263; 13410, P3H1, 67244, 169694, 114-2207; 13411, P3H2, 67247, 169697, 133-544; 13411, P3H2, 67248, 169698, 206-609; 13411, P3H2, 67246, 169696, 199-2325; 13411, P3H2, 67249, 169699, 299-1882; 13412, P3H3, 67250, 169700, 32-2242; 13413, P3H4, 67253, 169703, 1-221; 13413, P3H4, 67254, 169704, 251-505; 13413, P3H4, 67255, 169705, 1-662; 13413, P3H4, 67251, 169701, 468-1781; 13413, P3H4, 67252, 169702, 285-1598; 13414, P4HA1, 67256, 169706, 242-1846; 13414, P4HA1, 67257, 169707, 118-1722; 13414, P4HA1, 67258, 169708, 118-1722; 13414, P4HA1, 67259, 169709, 242-1846; 13414, P4HA1, 67260, 169710, 242-1792; 13415, P4HA2, 67266, 169716, 66-568; 13415, P4HA2, 67268, 169718, 411-1023; 13415, P4HA2, 67269, 169719, 17-724; 13415, P4HA2, 67270, 169720, 278-582; 13415, P4HA2, 67271, 169721, 276-427; 13415, P4HA2, 67272, 169722, 312-751; 13415, P4HA2, 67273, 169723, 225-568; 13415, P4HA2, 67274, 169724, 315-866; 13415, P4HA2, 67275, 169725, 359-819; 13415, P4HA2, 67261, 169711, 223-1830; 13415, P4HA2, 67262, 169712, 312-1913; 13415, P4HA2, 67263, 169713, 222-1823; 13415, P4HA2, 67264, 169714, 565-2166; 13415, P4HA2, 67265, 169715, 565-2172; 13415, P4HA2, 67267, 169717, 570-2177; 13416, P4HA3, 67278, 169728, 14-328; 13416, P4HA3, 67279, 169729, 1-186; 13416, P4HA3, 67276, 169726, 47-1681; 13416, P4HA3, 67277, 169727, 30-1844; 13416, P4HA3, 67280, 169730, 21-794; 13417, P4HB, 67282, 169732, 1-823; 13417, P4HB, 67283, 169733, 90-1484; 13417, P4HB, 67284, 169734, 62-505; 13417, P4HB, 67285, 169735, 96-260; 13417, P4HB, 67286, 169736, 65-688; 13417, P4HB, 67287, 169737, 343-943; 13417, P4HB, 67288, 169738, 103-571; 13417, P4HB, 67289, 169739, 8-571; 13417, P4HB, 67290, 169740, 3-353; 13417, P4HB, 67291, 169741, 65-385; 13417, P4HB, 67292, 169742, 63-562; 13417, P4HB, 67281, 169731, 224-1750; 13418, P4HTM, 67295, 169745, 1-678; 13418, P4HTM, 67296, 169746, 1-473; 13418, P4HTM, 67297, 169747, 1-267; 13418, P4HTM, 67298, 169748, 1-420; 13418, P4HTM, 67293, 169743, 369-2060; 13418, P4HTM, 67294, 169744, 372-1880; 13419, PREP, 67300, 169750, 1-137; 13419, PREP, 67299, 169749, 194-2326; 13420, PREPL, 67309, 169759, 1-213; 13420, PREPL, 67311, 169761, 208-660; 13420, PREPL, 67312, 169762, 1-362; 13420, PREPL, 67301, 169751, 960-3143; 13420, PREPL, 67302, 169752, 35-2032; 13420, PREPL, 67303, 169753, 35-2020; 13420, PREPL, 67304, 169754, 463-2646; 13420, PREPL, 67305, 169755, 439-2622; 13420, PREPL, 67306, 169756, 318-2501; 13420, PREPL, 67307, 169757, 216-2132; 13420, PREPL, 67308, 169758, 194-2110; 13420, PREPL, 67310, 169760, 960-3143; 13420, PREPL, 67313, 169763, 960-3143; 13420, PREPL, 67314, 169764, 388-2304; 13421, PROP, 67317, 169767, 104-546; 13421, PROP, 67318, 169768, 226-354; 13421, PROP, 67319, 169769, 206-783; 13421, PROP, 67320, 169770, 236-936; 13421, PROP, 67321, 169771, 302-737; 13421, PROP, 67322, 169772, 121-611; 13421, PROP, 67323, 169773, 193-491; 13421, PROP, 67324, 169774, 496-574; 13421, PROP, 67325, 169775, 296-845; 13421, PROP, 67326, 169776, 177-525; 13421, PROP, 67315, 169765, 196-1686; 13421, PROP, 67316, 169766, 29-1582; 13422, PARS2, 67327, 169777, 84-1511; 13423, PMCH, 67328, 169778, 76-573; 13424, PROM1, 67330, 169780, 447-567; 13424, PROM1, 67331, 169781, 526-568; 13424, PROM1, 67332, 169782, 1-197; 13424, PROM1, 67333, 169783, 1-163; 13424, PROM1, 67334, 169784, 1-280; 13424, PROM1, 67335, 169785, 379-551; 13424, PROM1, 67329, 169779, 213-2810; 13424, PROM1, 67336, 169786, 614-3184; 13424, PROM1, 67337, 169787, 250-2847; 13424, PROM1, 67338, 169788, 281-2851; 13424, PROM1, 67339, 169789, 213-2741; 13424, PROM1, 67340, 169790, 213-2717; 13425, PROM2, 67344, 169794, 86-595; 13425, PROM2, 67341, 169791, 134-2638; 13425, PROM2, 67342, 169792, 134-2638; 13425, PROM2, 67343, 169793, 134-2638; 13426, PML, 67356, 169806, 1-333; 13426, PML, 67358, 169808, 1-721; 13426, PML, 67360, 169810, 11-1717; 13426, PML, 67361, 169811, 1-784; 13426, PML, 67362, 169812, 1-653; 13426, PML, 67345, 169795, 97-2745; 13426, PML, 67346, 169796, 97-2586; 13426, PML, 67347, 169797, 97-2442; 13426, PML, 67348, 169798, 70-1341; 13426, PML, 67349, 169799, 97-1404; 13426, PML, 67350, 169800, 141-2042; 13426, PML, 67351, 169801, 70-1752; 13426, PML, 67352, 169802, 70-1905; 13426, PML, 67353, 169803, 83-2008; 13426, PML, 67354, 169804, 85-2589; 13426, PML, 67355, 169805, 70-1341; 13426, PML, 67357, 169807, 81-1763; 13426, PML, 67359, 169809, 70-1827; 13427, POMC, 67367, 169817, 145-883; 13427, POMC, 67363, 169813, 175-978; 13427, POMC, 67364, 169814, 264-1067; 13427, POMC, 67365, 169815, 128-931; 13427, POMC, 67366, 169816, 457-1260; 13428, PROP1, 67369, 169819, 179-859; 13428, PROP1, 67370, 169820, 1-339; 13428, PROP1, 67368, 169818, 310-990; 13429, PCCA, 67374, 169824, 1-403; 13429, PCCA, 67375, 169825, 1-447; 13429, PCCA, 67376, 169826, 1-336; 13429, PCCA, 67377, 169827, 1-418; 13429, PCCA, 67378, 169828, 1-253; 13429, PCCA, 67371, 169821, 107-2152; 13429, PCCA, 67372, 169822, 39-2225; 13429, PCCA, 67373, 169823, 107-2215; 13430, PCCB, 67380, 169830, 22-1293; 13430, PCCB, 67381, 169831, 19-1671; 13430, PCCB, 67382, 169832, 22-1239; 13430, PCCB, 67383, 169833, 294-547; 13430, PCCB, 67384, 169834, 22-1470; 13430, PCCB, 67386, 169836, 22-1734; 13430, PCCB, 67387, 169837, 8-582; 13430, PCCB, 67388, 169838, 134-534; 13430, PCCB, 67389, 169839, 1-488; 13430, PCCB, 67390, 169840, 22-1701; 13430, PCCB, 67391, 169841, 22-1572; 13430, PCCB, 67392, 169842, 22-1584; 13430, PCCB, 67393, 169843, 2-913; 13430, PCCB, 67379, 169829, 71-1690; 13430, PCCB, 67385, 169835, 18-1697; 13431, PPBP, 67394, 169844, 95-481; 13432, PCSK1, 67397, 169847, 93-565; 13432, PCSK1, 67395, 169845, 239-2500; 13432, PCSK1, 67396, 169846, 40-2160; 13433, PCSK1N, 67398, 169848, 102-884; 13434, PCSK2, 67399, 169849, 316-2232; 13434, PCSK2, 67400, 169850, 307-2166; 13434, PCSK2, 67401, 169851, 251-2062; 13435, PCSK4, 67403, 169853, 1-955; 13435, PCSK4, 67404, 169854, 32-720; 13435, PCSK4, 67402, 169852, 63-2330; 13436, PCSK5, 67406, 169856, 513-2585; 13436, PCSK5, 67407, 169857, 1-306; 13436, PCSK5, 67408, 169858, 1-4683; 13436, PCSK5, 67405, 169855, 478-3219; 13436, PCSK5, 67409, 169859, 539-6121; 13437, PCSK6, 67410, 169860, 315-2309; 13437, PCSK6, 67411, 169861, 1-2394; 13437, PCSK6, 67412, 169862, 1-232; 13437, PCSK6, 67413, 169863, 1-1035; 13437, PCSK6, 67414, 169864, 1-379; 13437, PCSK6, 67415, 169865, 1-378; 13437, PCSK6, 67419, 169869, 75-3002; 13437, PCSK6, 67421, 169871, 75-2963; 13437, PCSK6, 67422, 169872, 1-428; 13437, PCSK6, 67423, 169873, 151-1077; 13437, PCSK6, 67416, 169866, 28-1986; 13437, PCSK6, 67417, 169867, 28-1899; 13437, PCSK6, 67418, 169868, 75-2945; 13437, PCSK6, 67420, 169870, 170-3079; 13438, PCSK7, 67425, 169875, 397-1312; 13438, PCSK7, 67426, 169876, 309-583; 13438, PCSK7, 67427, 169877, 215-553; 13438, PCSK7, 67428, 169878, 272-549; 13438, PCSK7, 67429, 169879, 202-1977; 13438, PCSK7, 67424, 169874, 632-2989; 13439, PCSK9, 67430, 169880, 291-2369; 13440, PSAP, 67431, 169881, 105-1688; 13440, PSAP, 67433, 169883, 105-827; 13440, PSAP, 67434, 169884, 1-500; 13440, PSAP, 67432, 169882, 155-1729; 13441, PSAPL1, 67435, 169885, 67-1632; 13442, PROX1, 67439, 169889, 211-900; 13442, PROX1, 67441, 169891, 132-560; 13442, PROX1, 67436, 169886, 289-2502; 13442, PROX1, 67437, 169887, 609-2822; 13442, PROX1, 67438, 169888, 273-2486; 13442, PROX1, 67440, 169890, 617-2830; 13443, PROX2, 67442, 169892, 1-1779; 13443, PROX2, 67444, 169894, 527-550; 13443, PROX2, 67443, 169893, 1-1098; 13444, PTGDR, 67445, 169895, 103-1182; 13444, PTGDR, 67446, 169896, 4-894; 13445, PTGDR2, 67447, 169897, 113-1300; 13446, PTGDS, 67449, 169899, 75-661; 13446, PTGDS, 67450, 169900, 1-187; 13446, PTGDS, 67451, 169901, 1-375; 13446, PTGDS, 67448, 169898, 75-647; 13446, PTGDS, 67452, 169902, 62-634; 13447, PTGER1, 67453, 169903, 119-1327; 13448, PTGER2, 67455, 169905, 277-588; 13448, PTGER2, 67454, 169904, 155-1231; 13449, PTGER3, 67458, 169908, 232-1470; 13449, PTGER3, 67462, 169912, 232-1398; 13449, PTGER3, 67465, 169915, 212-1489; 13449, PTGER3, 67466, 169916, 232-1440; 13449, PTGER3, 67456, 169906, 232-1404; 13449, PTGER3, 67457, 169907, 212-1384; 13449, PTGER3, 67459, 169909, 212-1468; 13449, PTGER3, 67460, 169910, 232-1398; 13449, PTGER3, 67461, 169911, 212-1384; 13449, PTGER3, 67463, 169913, 57-1181; 13449, PTGER3, 67464, 169914, 232-1413; 13449, PTGER3, 67467, 169917, 232-1329; 13450, PTGER4, 67468, 169918, 1025-2491; 13451, PTGES, 67469, 169919, 36-494; 13452, PTGES2, 67470, 169920, 603-1163; 13452, PTGES2, 67472, 169922, 8-803; 13452, PTGES2, 67473, 169923, 333-893; 13452, PTGES2, 67471, 169921, 746-1879; 13453, PTGES3, 67475, 169925, 377-751; 13453, PTGES3, 67479, 169929, 447-941; 13453, PTGES3, 67474, 169924, 302-784; 13453, PTGES3, 67476, 169926, 164-547; 13453, PTGES3, 67477, 169927, 289-681; 13453, PTGES3, 67478, 169928, 286-705; 13454, PTGES3L, 67480, 169930, 252-737; 13454, PTGES3L, 67481, 169931, 1-386; 13454, PTGES3L, 67482, 169932, 1-399; 13454, PTGES3L, 67483, 169933, 1-494; 13455, PTGFR, 67487, 169937, 238-1131; 13455, PTGFR, 67484, 169934, 238-1131; 13455, PTGFR, 67485, 169935, 238-1317; 13455, PTGFR, 67486, 169936, 196-1275; 13456, PTGFRN, 67488, 169938, 148-2787; 13457, PTGIR, 67490, 169940, 54-944; 13457, PTGIR, 67491, 169941, 155-586; 13457, PTGIR, 67492, 169942, 315-662; 13457, PTGIR, 67493, 169943, 87-611; 13457, PTGIR, 67489, 169939, 135-1295; 13458, PTGIS, 67494, 169944, 31-1533; 13459, PTGR1, 67496, 169946, 11-232; 13459, PTGR1, 67498, 169948, 104-461; 13459, PTGR1, 67499, 169949, 1-357; 13459, PTGR1, 67495, 169945, 80-1069; 13459, PTGR1, 67497, 169947, 264-1253; 13459, PTGR1, 67500, 169950, 264-1169; 13460, PTGR2, 67502, 169952, 296-949; 13460, PTGR2, 67501, 169951, 222-1277; 13460, PTGR2, 67503, 169953, 209-1264; 13460, PTGR2, 67504, 169954, 146-1201; 13461, PTGS1, 67508, 169958, 1-468; 13461, PTGS1, 67511, 169961, 81-1736; 13461, PTGS1, 67505, 169955, 6-1694; 13461, PTGS1, 67506, 169956, 6-1805; 13461, PTGS1, 67507, 169957, 357-1829; 13461, PTGS1, 67509, 169959, 604-2217; 13461, PTGS1, 67510, 169960, 1-1893; 13462, PTGS2, 67513, 169963, 1-492; 13462, PTGS2, 67512, 169962, 138-1952; 13463, PBOV1, 67514, 169964, 97-504; 13464, PATE1, 67515, 169965, 13-393; 13464, PATE1, 67516, 169966, 9-353; 13465, PATE2, 67517, 169967, 47-388; 13465, PATE2, 67518, 169968, 38-250; 13466, PATE3, 67519, 169969, 42-338; 13467, PATE4, 67521, 169971, 45-224; 13467, PATE4, 67520, 169970, 45-341; 13468, PARM1, 67523, 169973, 234-440; 13468, PARM1, 67522, 169972, 213-1145; 13469, PRAC1, 67524, 169974, 131-304; 13470, PRAC2, 67526, 169976, 14-436; 13470, PRAC2, 67525, 169975, 230-502; 13471, PSCA, 67528, 169978, 83-247; 13471, PSCA, 67527, 169977, 84-428; 13472, PMEPA1, 67534, 169984, 179-859; 13472, PMEPA1, 67535, 169985, 207-831; 13472, PMEPA1, 67529, 169979, 255-968; 13472, PMEPA1, 67530, 169980, 127-885; 13472, PMEPA1, 67531, 169981, 321-1184; 13472, PMEPA1, 67532, 169982, 71-784; 13472, PMEPA1, 67533, 169983, 145-858; 13473, PTOV1, 67537, 169987, 1-129; 13473, PTOV1, 67539, 169989, 54-1208; 13473, PTOV1, 67540, 169990, 1-336; 13473, PTOV1, 67541, 169991, 147-995; 13473, PTOV1, 67542, 169992, 147-860; 13473, PTOV1, 67543, 169993, 1-426; 13473, PTOV1, 67544, 169994, 128-1252; 13473, PTOV1, 67536, 169986, 171-1421; 13473, PTOV1, 67538, 169988, 139-1389; 13473, PTOV1, 67545, 169995, 105-1355; 13474, PRM1, 67546, 169996, 113-268; 13475, PRM2, 67547, 169997, 111-419; 13475, PRM2, 67548, 169998, 111-533; 13476, PRM3, 67549, 169999, 47-358; 13477, PRSS22, 67550, 170000, 1-936; 13477, PRSS22, 67551, 170001, 1-972; 13477, PRSS22, 67552, 170002, 39-992; 13478, PRSS27, 67554, 170004, 392-514; 13478, PRSS27, 67555, 170005, 392-514; 13478, PRSS27, 67553, 170003, 56-928; 13479, PRSS1, 67557, 170007, 18-803; 13479, PRSS1, 67558, 170008, 1-429; 13479, PRSS1, 67559, 170009, 18-731; 13479, PRSS1, 67561, 170011, 7-750; 13479, PRSS1, 67562, 170012, 18-731; 13479, PRSS1, 67563, 170013, 18-803; 13479, PRSS1, 67564, 170014, 1-429; 13479, PRSS1, 67556, 170006, 7-750; 13479, PRSS1, 67560, 170010, 7-750; 13480, PRSS12, 67565, 170015, 284-2911; 13481, PRSS16, 67567, 170017, 38-475; 13481, PRSS16, 67568, 170018, 38-811; 13481, PRSS16, 67569, 170019, 8-286; 13481, PRSS16, 67570, 170020, 1-414; 13481, PRSS16, 67571, 170021, 8-307; 13481, PRSS16, 67572, 170022, 8-508; 13481, PRSS16, 67573, 170023, 1-492; 13481, PRSS16, 67566, 170016, 16-1560; 13482, PRSS2, 67574, 170024, 7-756; 13482, PRSS2, 67576, 170026, 17-757; 13482, PRSS2, 67578, 170028, 17-802; 13482, PRSS2, 67579, 170029, 49-834; 13482, PRSS2, 67580, 170030, 18-761; 13482, PRSS2, 67575, 170025, 1-744; 13482, PRSS2, 67577, 170027, 1-744; 13483, PRSS21, 67583, 170033, 1-656; 13483, PRSS21, 67584, 170034, 1-244; 13483, PRSS21, 67585, 170035, 1-770; 13483, PRSS21, 67586, 170036, 1-246; 13483, PRSS21, 67587, 170037, 90-992; 13483, PRSS21, 67588, 170038, 1-656; 13483, PRSS21, 67589, 170039, 43-987; 13483, PRSS21, 67590, 170040, 1-246; 13483, PRSS21, 67591, 170041, 1-244; 13483, PRSS21, 67592, 170042, 1-770; 13483, PRSS21, 67581, 170031, 43-987; 13483, PRSS21, 67582, 170032, 90-992; 13484, PRSS22, 67594, 170044, 51-674; 13484, PRSS22, 67595, 170045, 1-350; 13484, PRSS22, 67593, 170043, 67-1020; 13485, PRSS23, 67597, 170047, 151-613; 13485, PRSS23, 67598, 170048, 143-391; 13485, PRSS23, 67599, 170049, 143-418; 13485, PRSS23, 67596, 170046, 426-1577; 13486, PRSS3, 67603, 170053, 91-623; 13486, PRSS3, 67600, 170050, 309-1094; 13486, PRSS3, 67601, 170051, 1-915; 13486, PRSS3, 67602, 170052, 40-783; 13486, PRSS3, 67604, 170054, 14-736; 13487, PRSS33, 67607, 170057, 295-642; 13487, PRSS33, 67608, 170058, 59-767; 13487, PRSS33, 67609, 170059, 65-919; 13487, PRSS33, 67605, 170055, 161-1003; 13487, PRSS33, 67606, 170056, 143-985; 13488, PRSS35, 67610, 170060, 178-1419; 13489, PRSS36, 67614, 170064, 1-86; 13489, PRSS36, 67611, 170061, 60-2627; 13489, PRSS36, 67612, 170062, 32-2290; 13489, PRSS36, 67613, 170063, 27-2579; 13490, PRSS37, 67616, 170066, 163-360; 13490, PRSS37, 67617, 170067, 51-257; 13490, PRSS37, 67615, 170065, 373-1080; 13490, PRSS37, 67618, 170068, 53-760; 13491, PRSS38, 67619, 170069, 25-1005; 13492, PRSS42, 67620, 170070, 55-357; 13492, PRSS42, 67621, 170071, 1-882; 13493, PRSS45, 67623, 170073, 2180-2512; 13493, PRSS45, 67622, 170072, 1-687; 13493, PRSS45, 67624, 170074, 1-783; 13494, PRSS46, 67625, 170075, 42-566; 13495, PRSS48, 67626, 170076, 3-989; 13495, PRSS48, 67627, 170077, 3-560; 13496, PRSS50, 67628, 170078, 60-1217; 13496, PRSS50, 67629, 170079, 1672-2829; 13497, PRSS53, 67630, 170080, 155-1816; 13498, PRSS54, 67632, 170082, 444-1334; 13498, PRSS54, 67634, 170084, 396-954; 13498, PRSS54, 67635, 170085, 448-1057; 13498, PRSS54, 67631, 170081, 396-1583; 13498, PRSS54, 67633, 170083, 385-1572; 13499, PRSS55, 67637, 170087, 1-547; 13499, PRSS55, 67636, 170086, 41-1099; 13499, PRSS55, 67638, 170088, 41-871; 13500, PRSS56, 67639, 170089, 137-1951; 13500, PRSS56, 67640, 170090, 137-1948; 13501, PRSS57, 67641, 170091, 32-880; 13501, PRSS57, 67642, 170092, 69-920; 13502, PRSS58, 67643, 170093, 321-1046; 13502, PRSS58, 67644, 170094, 110-835; 13502, PRSS58, 67645, 170095, 110-835; 13502, PRSS58, 67646, 170096, 321-1046; 13503, PRSS8, 67648, 170098, 143-729; 13503, PRSS8, 67650, 170100, 230-552; 13503, PRSS8, 67647, 170097, 265-1296; 13503, PRSS8, 67649, 170099, 230-1099; 13504, PRADC1, 67651, 170101, 69-635; 13505, PAAF1, 67654, 170104, 258-1439; 13505, PAAF1, 67657, 170107, 142-882; 13505, PAAF1, 67658, 170108, 367-667; 13505, PAAF1, 67659, 170109, 265-975; 13505, PAAF1, 67660, 170110, 323-805; 13505, PAAF1, 67663, 170113, 1-349; 13505, PAAF1, 67664, 170114, 132-582; 13505, PAAF1, 67652, 170102, 54-1232; 13505, PAAF1, 67653, 170103, 1-1128; 13505, PAAF1, 67655, 170105, 146-1273; 13505, PAAF1, 67656, 170106, 611-1444; 13505, PAAF1, 67661, 170111, 342-1175; 13505, PAAF1, 67662, 170112, 102-1229; 13506, PSMG1, 67667, 170117, 1-192; 13506, PSMG1, 67668, 170118, 1-40; 13506, PSMG1, 67665, 170115, 467-1333; 13506, PSMG1, 67666, 170116, 104-907; 13507, PSMG2, 67670, 170120, 86-808; 13507, PSMG2, 67671, 170121, 83-379; 13507, PSMG2, 67673, 170123, 20-646; 13507, PSMG2, 67669, 170119, 683-1477; 13507, PSMG2, 67672, 170122, 73-774; 13508, PSMG3, 67674, 170124, 554-922; 13508, PSMG3, 67675, 170125, 655-1023; 13508, PSMG3, 67676, 170126, 59-427; 13509, PSMG4, 67677, 170127, 127-375; 13509, PSMG4, 67678, 170128, 283-657; 13509, PSMG4, 67680, 170130, 40-270; 13509, PSMG4, 67682, 170132, 1-353; 13509, PSMG4, 67684, 170134, 687-794; 13509, PSMG4, 67685, 170135, 47-373; 13509, PSMG4, 67679, 170129, 72-560; 13509, PSMG4, 67681, 170131, 130-501; 13509, PSMG4, 67683, 170133, 63-377; 13510, PSMB11, 67686, 170136, 60-962; 13511, PSMC1, 67689, 170139, 138-390; 13511, PSMC1, 67687, 170137, 104-1426; 13511, PSMC1, 67688, 170138, 143-1246; 13512, PSMC2, 67692, 170142, 266-656; 13512, PSMC2, 67693, 170143, 292-682; 13512, PSMC2, 67690, 170140, 1-1302; 13512, PSMC2, 67691, 170141, 412-1713; 13513, PSMC3, 67695, 170145, 1-905; 13513, PSMC3, 67696, 170146, 25-138; 13513, PSMC3, 67697, 170147, 5-777; 13513, PSMC3, 67698, 170148, 164-1357; 13513, PSMC3, 67699, 170149, 1-935; 13513, PSMC3, 67700, 170150, 28-580; 13513, PSMC3, 67701, 170151, 1-159; 13513, PSMC3, 67702, 170152, 36-1307; 13513, PSMC3, 67694, 170144, 159-1478; 13513, PSMC3, 67703, 170153, 195-1514; 13514, PSMC4, 67706, 170156, 34-1197; 13514, PSMC4, 67707, 170157, 199-1455; 13514, PSMC4, 67704, 170154, 199-1455; 13514, PSMC4, 67705, 170155, 34-1197; 13515, PSMC5, 67710, 170160, 80-804; 13515, PSMC5, 67712, 170162, 13-171; 13515, PSMC5, 67713, 170163, 165-809; 13515, PSMC5, 67714, 170164, 39-828; 13515, PSMC5, 67716, 170166, 1-383; 13515, PSMC5, 67717, 170167, 129-558; 13515, PSMC5, 67718, 170168, 129-899; 13515, PSMC5, 67719, 170169, 20-529; 13515, PSMC5, 67708, 170158, 309-1529; 13515, PSMC5, 67709, 170159, 241-1437; 13515, PSMC5, 67711, 170161, 306-1502; 13515, PSMC5, 67715, 170165, 261-1457; 13516, PSMC6, 67720, 170170, 7-1218; 13516, PSMC6, 67721, 170171, 1-785; 13516, PSMC6, 67722, 170172, 1-100; 13516, PSMC6, 67723, 170173, 12-224; 13516, PSMC6, 67724, 170174, 2-583; 13516, PSMC6, 67725, 170175, 29-322; 13516, PSMC6, 67726, 170176, 1-44; 13516, PSMC6, 67727, 170177, 1-202; 13516, PSMC6, 67728, 170178, 19-129; 13516, PSMC6, 67730, 170180, 1-1212; 13516, PSMC6, 67729, 170179, 17-1186; 13517, PSMD1, 67734, 170184, 1-491; 13517, PSMD1, 67735, 170185, 160-306; 13517, PSMD1, 67736, 170186, 152-761; 13517, PSMD1, 67737, 170187, 1-578; 13517, PSMD1, 67738, 170188, 1-2862; 13517, PSMD1, 67731, 170181, 163-3024; 13517, PSMD1, 67732, 170182, 163-2931; 13517, PSMD1, 67733, 170183, 133-2901; 13518, PSMD10, 67740, 170190, 1-582; 13518, PSMD10, 67742, 170192, 23-580; 13518, PSMD10, 67743, 170193, 23-355; 13518, PSMD10, 67739, 170189, 99-779; 13518, PSMD10, 67741, 170191, 23-478; 13519, PSMD11, 67746, 170196, 344-480; 13519, PSMD11, 67747, 170197, 525-540; 13519, PSMD11, 67748, 170198, 20-582; 13519, PSMD11, 67749, 170199, 1-271; 13519, PSMD11, 67744, 170194, 264-1532; 13519, PSMD11, 67745, 170195, 51-1319; 13520, PSMD12, 67752, 170202, 29-157; 13520, PSMD12, 67753, 170203, 59-175; 13520, PSMD12, 67750, 170200, 109-1479; 13520, PSMD12, 67751, 170201, 87-1397; 13521, PSMD13, 67754, 170204, 25-1074; 13521, PSMD13, 67755, 170205, 13-231; 13521, PSMD13, 67757, 170207, 1-665; 13521, PSMD13, 67758, 170208, 70-858; 13521, PSMD13, 67759, 170209, 51-263; 13521, PSMD13, 67761, 170211, 85-426; 13521, PSMD13, 67762, 170212, 55-1188; 13521, PSMD13, 67756, 170206, 74-1210; 13521, PSMD13, 67760, 170210, 505-1635; 13522, PSMD14, 67764, 170214, 325-577; 13522, PSMD14, 67763, 170213, 705-1637; 13523, PSMD2, 67766, 170216, 1-609; 13523, PSMD2, 67768, 170218, 1-430; 13523, PSMD2, 67769, 170219, 14-193; 13523, PSMD2, 67770, 170220, 70-721; 13523, PSMD2, 67765, 170215, 559-3285; 13523, PSMD2, 67767, 170217, 215-2464; 13523, PSMD2, 67771, 170221, 139-2475; 13524, PSMD3, 67773, 170223, 136-396; 13524, PSMD3, 67774, 170224, 1-353; 13524, PSMD3, 67772, 170222, 175-1779; 13525, PSMD4, 67775, 170225, 75-1217; 13525, PSMD4, 67777, 170227, 1-580; 13525, PSMD4, 67778, 170228, 1-254; 13525, PSMD4, 67779, 170229, 1-119; 13525, PSMD4, 67780, 170230, 179-787; 13525, PSMD4, 67776, 170226, 81-1214; 13526, PSMD5, 67783, 170233, 1-342; 13526, PSMD5, 67784, 170234, 3-221; 13526, PSMD5, 67785, 170235, 1-219; 13526, PSMD5, 67781, 170231, 76-1590; 13526, PSMD5, 67782, 170232, 43-1428; 13527, PSMD6, 67788, 170238, 38-469; 13527, PSMD6, 67790, 170240, 1-415; 13527, PSMD6, 67791, 170241, 40-717; 13527, PSMD6, 67786, 170236, 142-1311; 13527, PSMD6, 67787, 170237, 176-1231; 13527, PSMD6, 67789, 170239, 54-1382; 13527, PSMD6, 67792, 170242, 40-1092; 13528, PSMD7, 67794, 170244, 87-620; 13528, PSMD7, 67795, 170245, 96-227; 13528, PSMD7, 67796, 170246, 95-691; 13528, PSMD7, 67793, 170243, 141-1115; 13529, PSMD8, 67798, 170248, 643-1161; 13529, PSMD8, 67799, 170249, 20-771; 13529, PSMD8, 67800, 170250, 1-192; 13529, PSMD8, 67801, 170251, 34-423; 13529, PSMD8, 67802, 170252, 378-578; 13529, PSMD8, 67803, 170253, 33-896; 13529, PSMD8, 67797, 170247, 67-1119; 13529, PSMD8, 67804, 170254, 53-1105; 13530, PSMD9, 67805, 170255, 87-755; 13530, PSMD9, 67807, 170257, 13-552; 13530, PSMD9, 67808, 170258, 96-353; 13530, PSMD9, 67809, 170259, 74-534; 13530, PSMD9, 67811, 170261, 938-1324; 13530, PSMD9, 67806, 170256, 127-798; 13530, PSMD9, 67810, 170260, 72-428; 13530, PSMD9, 67812, 170262, 126-755; 13531, PSME1, 67815, 170265, 618-890; 13531, PSME1, 67816, 170266, 1-345; 13531, PSME1, 67813, 170263, 106-855; 13531, PSME1, 67814, 170264, 64-816; 13531, PSME1, 67817, 170267, 37-738; 13532, PSME2, 67819, 170269, 258-512; 13532, PSME2, 67820, 170270, 11-157; 13532, PSME2, 67821, 170271, 655-774; 13532, PSME2, 67822, 170272, 25-711; 13532, PSME2, 67823, 170273, 66-830; 13532, PSME2, 67824, 170274, 66-185; 13532, PSME2, 67818, 170268, 641-1360; 13533, PSME3, 67827, 170277, 188-580; 13533, PSME3, 67828, 170278, 491-1186; 13533, PSME3, 67829, 170279, 840-1421; 13533, PSME3, 67830, 170280, 84-212; 13533, PSME3, 67831, 170281, 663-1018; 13533, PSME3, 67832, 170282, 1075-1364; 13533, PSME3, 67834, 170284, 196-733; 13533, PSME3, 67835, 170285, 249-580; 13533, PSME3, 67836, 170286, 137-733; 13533, PSME3, 67837, 170287, 491-1003; 13533, PSME3, 67825, 170275, 162-965; 13533, PSME3, 67826, 170276, 509-1306; 13533, PSME3, 67833, 170283, 234-998; 13534, PSME4, 67838, 170288, 57-1772; 13534, PSME4, 67839, 170289, 57-5588; 13535, PSMF1, 67840, 170290, 177-968; 13535, PSMF1, 67843, 170293, 1-384; 13535, PSMF1, 67844, 170294, 154-704; 13535, PSMF1, 67845, 170295, 1-319; 13535, PSMF1, 67841, 170291, 169-984; 13535, PSMF1, 67842, 170292, 177-992; 13536, POMP, 67846, 170296, 82-507; 13537, PSMA1, 67849, 170299, 583-588; 13537, PSMA1, 67850, 170300, 529-571; 13537, PSMA1, 67851, 170301, 532-1248; 13537, PSMA1, 67847, 170297, 398-1189; 13537, PSMA1, 67848, 170298, 329-1138; 13538, PSMA2, 67853, 170303, 15-83; 13538, PSMA2, 67854, 170304, 28-522; 13538, PSMA2, 67855, 170305, 1-56; 13538, PSMA2, 67856, 170306, 1-111; 13538, PSMA2, 67852, 170302, 66-770; 13539, PSMA3, 67859, 170309, 1-252; 13539, PSMA3, 67860, 170310, 56-166; 13539, PSMA3, 67861, 170311, 160-702; 13539, PSMA3, 67862, 170312, 49-213; 13539, PSMA3, 67857, 170307, 91-858; 13539, PSMA3, 67858, 170308, 45-791; 13540, PSMA4, 67865, 170315, 271-637; 13540, PSMA4, 67866, 170316, 166-710; 13540, PSMA4, 67867, 170317, 106-815; 13540, PSMA4, 67868, 170318, 86-610; 13540, PSMA4, 67869, 170319, 46-423; 13540, PSMA4, 67870, 170320, 128-756; 13540, PSMA4, 67871, 170321, 124-674; 13540, PSMA4, 67872, 170322, 202-462; 13540, PSMA4, 67873, 170323, 125-786; 13540, PSMA4, 67874, 170324, 159-851; 13540, PSMA4, 67863, 170313, 151-936; 13540, PSMA4, 67864, 170314, 187-759; 13540, PSMA4, 67875, 170325, 67-852; 13541, PSMA5, 67876, 170326, 22-747; 13541, PSMA5, 67877, 170327, 953-1504; 13542, PSMA6, 67880, 170330, 5-616; 13542, PSMA6, 67881, 170331, 35-238; 13542, PSMA6, 67882, 170332, 1-257; 13542, PSMA6, 67883, 170333, 85-531; 13542, PSMA6, 67884, 170334, 85-408; 13542, PSMA6, 67885, 170335, 129-254; 13542, PSMA6, 67887, 170337, 80-838; 13542, PSMA6, 67889, 170339, 161-364; 13542, PSMA6, 67890, 170340, 161-484; 13542, PSMA6, 67878, 170328, 121-861; 13542, PSMA6, 67879, 170329, 68-751; 13542, PSMA6, 67886, 170336, 312-815; 13542, PSMA6, 67888, 170338, 303-806; 13543, PSMA7, 67894, 170344, 1-563; 13543, PSMA7, 67891, 170341, 128-577; 13543, PSMA7, 67892, 170342, 237-773; 13543, PSMA7, 67893, 170343, 128-874; 13544, PSMA8, 67898, 170348, 115-306; 13544, PSMA8, 67899, 170349, 1-675; 13544, PSMA8, 67895, 170345, 90-860; 13544, PSMA8, 67896, 170346, 93-731; 13544, PSMA8, 67897, 170347, 115-867; 13545, PSMB1, 67900, 170350, 100-825; 13546, PSMB10, 67902, 170352, 1-417; 13546, PSMB10, 67901, 170351, 339-1160; 13547, PSMB2, 67904, 170354, 240-494; 13547, PSMB2, 67903, 170353, 413-1018; 13548, PSMB3, 67905, 170355, 74-510; 13548, PSMB3, 67906, 170356, 64-387; 13548, PSMB3, 67907, 170357, 55-393; 13548, PSMB3, 67910, 170360, 74-510; 13548, PSMB3, 67911, 170361, 64-387; 13548, PSMB3, 67912, 170362, 55-393; 13548, PSMB3, 67908, 170358, 92-709; 13548, PSMB3, 67909, 170359, 92-709; 13549, PSMB4, 67913, 170363, 55-849; 13550, PSMB5, 67914, 170364, 5-238; 13550, PSMB5, 67917, 170367, 14-268; 13550, PSMB5, 67918, 170368, 1-356; 13550, PSMB5, 67915, 170365, 265-1056; 13550, PSMB5, 67916, 170366, 231-713; 13550, PSMB5, 67919, 170369, 10-621; 13551, PSMB6, 67921, 170371, 1-309; 13551, PSMB6, 67922, 170372, 52-693; 13551, PSMB6, 67920, 170370, 52-771; 13552, PSMB7, 67924, 170374, 20-650; 13552, PSMB7, 67923, 170373, 15-848; 13553, PSMB8, 67929, 170379, 25-783; 13553, PSMB8, 67930, 170380, 25-783; 13553, PSMB8, 67932, 170382, 25-783; 13553, PSMB8, 67934, 170384, 25-783; 13553, PSMB8, 67936, 170386, 25-783; 13553, PSMB8, 67939, 170389, 25-783; 13553, PSMB8, 67941, 170391, 52-882; 13553, PSMB8, 67942, 170392, 25-783; 13553, PSMB8, 67945, 170395, 25-783; 13553, PSMB8, 67925, 170375, 291-1109; 13553, PSMB8, 67926, 170376, 52-882; 13553, PSMB8, 67927, 170377, 52-882; 13553, PSMB8, 67928, 170378, 291-1109; 13553, PSMB8, 67931, 170381, 291-1109; 13553, PSMB8, 67933, 170383, 52-882; 13553, PSMB8, 67935, 170385, 291-1109; 13553, PSMB8, 67937, 170387, 52-882; 13553, PSMB8, 67938, 170388, 52-882; 13553, PSMB8, 67940, 170390, 52-882; 13553, PSMB8, 67943, 170393, 291-1109; 13553, PSMB8, 67944, 170394, 291-1109; 13553, PSMB8, 67946, 170396, 291-1109; 13553, PSMB8, 67947, 170397, 239-1057; 13553, PSMB8, 67948, 170398, 52-882; 13554, PSMB9, 67952, 170402, 149-739; 13554, PSMB9, 67953, 170403, 149-739; 13554, PSMB9, 67954, 170404, 3-539; 13554, PSMB9, 67955, 170405, 149-739; 13554, PSMB9, 67956, 170406, 3-539; 13554, PSMB9, 67957, 170407, 3-539; 13554, PSMB9, 67959, 170409, 45-439; 13554, PSMB9, 67960, 170410, 45-439; 13554, PSMB9, 67962, 170412, 149-739; 13554, PSMB9, 67963, 170413, 149-739; 13554, PSMB9, 67964, 170414, 45-439; 13554, PSMB9, 67965, 170415, 149-739; 13554, PSMB9, 67966, 170416, 25-561; 13554, PSMB9, 67967, 170417, 149-739; 13554, PSMB9, 67968, 170418, 45-439; 13554, PSMB9, 67969, 170419, 149-739; 13554, PSMB9, 67970, 170420, 45-439; 13554, PSMB9, 67973, 170423, 3-539; 13554, PSMB9, 67974, 170424, 45-439; 13554, PSMB9, 67975, 170425, 25-561; 13554, PSMB9, 67976, 170426, 45-439; 13554, PSMB9, 67977, 170427, 45-439; 13554, PSMB9, 67979, 170429, 25-561; 13554, PSMB9, 67949, 170399, 70-729; 13554, PSMB9, 67950, 170400, 70-729; 13554, PSMB9, 67951, 170401, 70-729; 13554, PSMB9, 67958, 170408, 70-729; 13554, PSMB9, 67961, 170411, 70-729; 13554, PSMB9, 67971, 170421, 70-729; 13554, PSMB9, 67972, 170422, 70-729; 13554, PSMB9, 67978, 170428, 70-729; 13555, POT1, 67981, 170431, 864-2375; 13555, POT1, 67982, 170432, 560-806; 13555, POT1, 67983, 170433, 1-256; 13555, POT1, 67984, 170434, 30-167; 13555, POT1, 67985, 170435, 1-415; 13555, POT1, 67986, 170436, 1-234; 13555, POT1, 67987, 170437, 12-1034; 13555, POT1, 67988, 170438, 12-1568; 13555, POT1, 67989, 170439, 1-358; 13555, POT1, 67990, 170440, 757-2499; 13555, POT1, 67991, 170441, 373-593; 13555, POT1, 67992, 170442, 1-261; 13555, POT1, 67980, 170430, 600-2504; 13556, PRMT1, 67994, 170444, 10-1125; 13556, PRMT1, 67995, 170445, 159-779; 13556, PRMT1, 67996, 170446, 109-273; 13556, PRMT1, 67997, 170447, 703-1182; 13556, PRMT1, 67998, 170448, 84-699; 13556, PRMT1, 67999, 170449, 97-578; 13556, PRMT1, 68000, 170450, 1-713; 13556, PRMT1, 68001, 170451, 507-1484; 13556, PRMT1, 68002, 170452, 354-543; 13556, PRMT1, 68003, 170453, 251-580; 13556, PRMT1, 68004, 170454, 130-987; 13556, PRMT1, 67993, 170443, 130-1191; 13557, PRMT2, 68008, 170458, 147-908; 13557, PRMT2, 68012, 170462, 1-581; 13557, PRMT2, 68015, 170465, 305-790; 13557, PRMT2, 68005, 170455, 226-912; 13557, PRMT2, 68006, 170456, 168-1022; 13557, PRMT2, 68007, 170457, 763-2064; 13557, PRMT2, 68009, 170459, 955-2256; 13557, PRMT2, 68010, 170460, 206-1507; 13557, PRMT2, 68011, 170461, 140-1135; 13557, PRMT2, 68013, 170463, 226-1131; 13557, PRMT2, 68014, 170464, 226-1095; 13558, PRMT3, 68016, 170466, 190-330; 13558, PRMT3, 68018, 170468, 32-1441; 13558, PRMT3, 68019, 170469, 1-165; 13558, PRMT3, 68020, 170470, 108-248; 13558, PRMT3, 68017, 170467, 218-1813; 13559, PRMT5, 68025, 170475, 1-538; 13559, PRMT5, 68026, 170476, 8-565; 13559, PRMT5, 68027, 170477, 32-292; 13559, PRMT5, 68028, 170478, 32-580; 13559, PRMT5, 68029, 170479, 16-571; 13559, PRMT5, 68030, 170480, 1-414; 13559, PRMT5, 68031, 170481, 141-350; 13559, PRMT5, 68032, 170482, 1-534; 13559, PRMT5, 68033, 170483, 13-141; 13559, PRMT5, 68034, 170484, 16-555; 13559, PRMT5, 68035, 170485, 1-837; 13559, PRMT5, 68036, 170486, 69-577; 13559, PRMT5, 68037, 170487, 1-185; 13559, PRMT5, 68038, 170488, 292-603; 13559, PRMT5, 68040, 170490, 1-129; 13559, PRMT5, 68021, 170471, 167-1897; 13559, PRMT5, 68022, 170472, 225-2138; 13559, PRMT5, 68023, 170473, 132-1532; 13559, PRMT5, 68024, 170474, 177-2039; 13559, PRMT5, 68039, 170489, 48-1829; 13560, PRMT6, 68041, 170491, 38-1165; 13561, PRMT7, 68045, 170495, 786-2489; 13561, PRMT7, 68046, 170496, 345-584; 13561, PRMT7, 68047, 170497, 291-959; 13561, PRMT7, 68048, 170498, 146-247; 13561, PRMT7, 68049, 170499, 225-440; 13561, PRMT7, 68050, 170500, 210-534; 13561, PRMT7, 68051, 170501, 140-648; 13561, PRMT7, 68052, 170502, 116-217; 13561, PRMT7, 68042, 170492, 831-2909; 13561, PRMT7, 68043, 170493, 85-2163; 13561, PRMT7, 68044, 170494, 128-2056; 13562, PRMT8, 68053, 170503, 391-1575; 13562, PRMT8, 68054, 170504, 47-1204; 13563, PRMT9, 68056, 170506, 139-339; 13563, PRMT9, 68055, 170505, 244-2781; 13564, PATL1, 68057, 170507, 86-2398; 13565, PATL2, 68059, 170509, 581-1645; 13565, PATL2, 68060, 170510, 1-477; 13565, PATL2, 68061, 170511, 390-765; 13565, PATL2, 68063, 170513, 1-566; 13565, PATL2, 68058, 170508, 99-1730; 13565, PATL2, 68062, 170512, 61-1692; 13566, PROC, 68065, 170515, 1-710; 13566, PROC, 68066, 170516, 62-1549; 13566, PROC, 68067, 170517, 247-405; 13566, PROC, 68068, 170518, 84-242; 13566, PROC, 68069, 170519, 251-598; 13566, PROC, 68070, 170520, 76-600; 13566, PROC, 68071, 170521, 203-581; 13566, PROC, 68064, 170514, 88-1473; 13567, PROCR, 68073, 170523, 1-641; 13567, PROCR, 68074, 170524, 1-105; 13567, PROCR, 68072, 170522, 83-799; 13568, PDIA2, 68077, 170527, 1-680; 13568, PDIA2, 68078, 170528, 1-465; 13568, PDIA2, 68075, 170525, 19-1596; 13568, PDIA2, 68076, 170526, 6-1574; 13569, PDIA3, 68080, 170530, 1-372; 13569, PDIA3, 68081, 170531, 88-315; 13569, PDIA3, 68082, 170532, 88-303; 13569, PDIA3, 68079, 170529, 149-1666; 13570, PDIA4, 68084, 170534, 61-550; 13570, PDIA4, 68083, 170533, 234-2171; 13571, PDIA5, 68086, 170536, 1-250; 13571, PDIA5, 68088, 170538, 475-667; 13571, PDIA5, 68085, 170535, 96-1655; 13571, PDIA5, 68087, 170537, 104-892; 13572, PDIA6, 68093, 170543, 953-986; 13572, PDIA6, 68089, 170539, 149-1471; 13572, PDIA6, 68090, 170540, 332-1669; 13572, PDIA6, 68091, 170541, 373-1839; 13572, PDIA6, 68092, 170542, 339-1817; 13572, PDIA6, 68094, 170544, 331-1644; 13572, PDIA6, 68095, 170545, 1-1479; 13573, PDILT, 68097, 170547, 69-600; 13573, PDILT, 68096, 170546, 250-2004; 13574, PGGT1B, 68098, 170548, 1-903; 13574, PGGT1B, 68099, 170549, 22-1155; 13575, PIAS1, 68102, 170552, 1-194; 13575, PIAS1, 68103, 170553, 19-501; 13575, PIAS1, 68104, 170554, 10-72; 13575, PIAS1, 68100, 170550, 149-2104; 13575, PIAS1, 68101, 170551, 742-2703; 13576, PIAS2, 68106, 170556, 110-658; 13576, PIAS2, 68107, 170557, 556-1404; 13576, PIAS2, 68108, 170558, 196-561; 13576, PIAS2, 68110, 170560, 234-502; 13576, PIAS2, 68111, 170561, 161-447; 13576, PIAS2, 68112, 170562, 234-497; 13576, PIAS2, 68113, 170563, 1-1611; 13576, PIAS2, 68105, 170555, 159-1877; 13576, PIAS2, 68109, 170559, 1-1866; 13577, PIAS3, 68114, 170564, 56-1837; 13577, PIAS3, 68116, 170566, 176-952; 13577, PIAS3, 68117, 170567, 154-429; 13577, PIAS3, 68115, 170565, 91-1977; 13578, PIAS4, 68118, 170568, 116-1648; 13579, PROCA1, 68120, 170570, 1-1095; 13579, PROCA1, 68121, 170571, 23-481; 13579, PROCA1, 68122, 170572, 88-213; 13579, PROCA1, 68123, 170573, 482-811; 13579, PROCA1, 68119, 170569, 195-1205; 13580, PICK1, 68126, 170576, 155-310; 13580, PICK1, 68127, 170577, 158-559; 13580, PICK1, 68128, 170578, 267-954; 13580, PICK1, 68129, 170579, 153-544; 13580, PICK1, 68130, 170580, 242-397; 13580, PICK1, 68131, 170581, 518-631; 13580, PICK1, 68124, 170574, 239-1486; 13580, PICK1, 68125, 170575, 348-1595; 13581, PKIA, 68132, 170582, 142-372; 13581, PKIA, 68133, 170583, 487-717; 13581, PKIA, 68134, 170584, 81-311; 13582, PKIB, 68137, 170587, 207-470; 13582, PKIB, 68135, 170585, 160-417; 13582, PKIB, 68136, 170586, 110-346; 13582, PKIB, 68138, 170588, 628-864; 13582, PKIB, 68139, 170589, 465-701; 13582, PKIB, 68140, 170590, 398-634; 13582, PKIB, 68141, 170591, 448-684; 13582, PKIB, 68142, 170592, 502-759; 13583, PKIG, 68145, 170595, 304-498; 13583, PKIG, 68143, 170593, 250-480; 13583, PKIG, 68144, 170594, 277-507; 13583, PKIG, 68146, 170596, 586-816; 13583, PKIG, 68147, 170597, 540-770; 13583, PKIG, 68148, 170598, 435-665; 13583, PKIG, 68149, 170599, 288-518; 13584, PACSIN1, 68151, 170601, 322-1530; 13584, PACSIN1, 68150, 170600, 196-1530; 13584, PACSIN1, 68152, 170602, 261-1595; 13584, PACSIN1, 68153, 170603, 274-1608; 13585, PACSIN2, 68159, 170609, 167-622; 13585, PACSIN2, 68160, 170610, 354-818; 13585, PACSIN2, 68161, 170611, 406-505; 13585, PACSIN2, 68162, 170612, 209-664; 13585, PACSIN2, 68163, 170613, 1-178; 13585, PACSIN2, 68164, 170614, 78-1431; 13585, PACSIN2, 68154, 170604, 203-1663; 13585, PACSIN2, 68155, 170605, 223-1560; 13585, PACSIN2, 68156, 170606, 194-1654; 13585, PACSIN2, 68157, 170607, 223-1683; 13585, PACSIN2, 68158, 170608, 161-1498; 13586, PACSIN3, 68166, 170616, 347-554; 13586, PACSIN3, 68167, 170617, 768-912; 13586, PACSIN3, 68168, 170618, 196-1158; 13586, PACSIN3, 68169, 170619, 1-229; 13586, PACSIN3, 68170, 170620, 757-864; 13586, PACSIN3, 68171, 170621, 210-654; 13586, PACSIN3, 68172, 170622, 258-683; 13586, PACSIN3, 68173, 170623, 356-563; 13586, PACSIN3, 68174, 170624, 344-1560; 13586, PACSIN3, 68165, 170615, 163-1437; 13586, PACSIN3, 68175, 170625, 344-1618; 13587, PRKCSH, 68176, 170626, 384-569; 13587, PRKCSH, 68177, 170627, 147-578; 13587, PRKCSH, 68180, 170630, 124-545; 13587, PRKCSH, 68181, 170631, 161-557; 13587, PRKCSH, 68182, 170632, 1-603; 13587, PRKCSH, 68184, 170634, 154-1761; 13587, PRKCSH, 68185, 170635, 121-625; 13587, PRKCSH, 68178, 170628, 1-1587; 13587, PRKCSH, 68179, 170629, 296-1873; 13587, PRKCSH, 68183, 170633, 374-1951; 13588, PRKCA, 68186, 170636, 1-451; 13588, PRKCA, 68188, 170638, 217-1143; 13588, PRKCA, 68187, 170637, 27-2045; 13589, PRKCB, 68191, 170641, 95-268; 13589, PRKCB, 68192, 170642, 166-556; 13589, PRKCB, 68193, 170643, 1-367; 13589, PRKCB, 68194, 170644, 211-569; 13589, PRKCB, 68189, 170639, 153-2174; 13589, PRKCB, 68190, 170640, 176-2191; 13590, PRKCD, 68197, 170647, 187-562; 13590, PRKCD, 68198, 170648, 107-777; 13590, PRKCD, 68199, 170649, 357-589; 13590, PRKCD, 68195, 170645, 362-2392; 13590, PRKCD, 68196, 170646, 329-2359; 13591, PRKCDBP, 68201, 170651, 57-938; 13591, PRKCDBP, 68200, 170650, 172-957; 13592, PRKCE, 68203, 170653, 110-769; 13592, PRKCE, 68204, 170654, 557-939; 13592, PRKCE, 68202, 170652, 328-2541; 13593, PRKCH, 68206, 170656, 296-545; 13593, PRKCH, 68208, 170658, 241-459; 13593, PRKCH, 68209, 170659, 477-521; 13593, PRKCH, 68210, 170660, 387-545; 13593, PRKCH, 68211, 170661, 129-582; 13593, PRKCH, 68212, 170662, 266-938; 13593, PRKCH, 68213, 170663, 290-552; 13593, PRKCH, 68214, 170664, 157-545; 13593, PRKCH, 68215, 170665, 209-562; 13593, PRKCH, 68216, 170666, 216-429; 13593, PRKCH, 68217, 170667, 249-567; 13593, PRKCH, 68218, 170668, 81-514; 13593, PRKCH, 68205, 170655, 386-2437; 13593, PRKCH, 68207, 170657, 219-1787; 13594, PRKCG, 68220, 170670, 454-560; 13594, PRKCG, 68221, 170671, 380-678; 13594, PRKCG, 68222, 170672, 514-571; 13594, PRKCG, 68219, 170669, 283-2376; 13595, PRKCI, 68223, 170673, 306-2096; 13596, PRKCQ, 68227, 170677, 1-2013; 13596, PRKCQ, 68224, 170674, 101-2221; 13596, PRKCQ, 68225, 170675, 101-2032; 13596, PRKCQ, 68226, 170676, 415-2160; 13597, PRKCZ, 68231, 170681, 380-706; 13597, PRKCZ, 68232, 170682, 322-567; 13597, PRKCZ, 68233, 170683, 273-468; 13597, PRKCZ, 68234, 170684, 352-563; 13597, PRKCZ, 68235, 170685, 579-716; 13597, PRKCZ, 68236, 170686, 448-763; 13597, PRKCZ, 68237, 170687, 495-788; 13597, PRKCZ, 68238, 170688, 135-1178; 13597, PRKCZ, 68239, 170689, 559-966; 13597, PRKCZ, 68240, 170690, 147-690; 13597, PRKCZ, 68241, 170691, 396-614; 13597, PRKCZ, 68242, 170692, 74-295; 13597, PRKCZ, 68244, 170694, 636-698; 13597, PRKCZ, 68245, 170695, 490-564; 13597, PRKCZ, 68246, 170696, 296-480; 13597, PRKCZ, 68228, 170678, 162-1940; 13597, PRKCZ, 68229, 170679, 396-1625; 13597, PRKCZ, 68230, 170680, 684-1913; 13597, PRKCZ, 68243, 170693, 269-1735; 13598, PRKD1, 68248, 170698, 131-2893; 13598, PRKD1, 68249, 170699, 231-582; 13598, PRKD1, 68250, 170700, 1-474; 13598, PRKD1, 68251, 170701, 1-243; 13598, PRKD1, 68247, 170697, 231-2969; 13598, PRKD1, 68252, 170702, 1-2739; 13599, PRKD2, 68255, 170705, 1-222; 13599, PRKD2, 68257, 170707, 422-624; 13599, PRKD2, 68258, 170708, 254-536; 13599, PRKD2, 68259, 170709, 331-2997; 13599, PRKD2, 68260, 170710, 486-541; 13599, PRKD2, 68262, 170712, 1-461; 13599, PRKD2, 68263, 170713, 464-669; 13599, PRKD2, 68253, 170703, 227-2863; 13599, PRKD2, 68254, 170704, 479-3115; 13599, PRKD2, 68256, 170706, 493-2658; 13599, PRKD2, 68261, 170711, 555-2720; 13600, PRKD3, 68266, 170716, 1-518; 13600, PRKD3, 68267, 170717, 1-555; 13600, PRKD3, 68268, 170718, 153-695; 13600, PRKD3, 68264, 170714, 556-3228; 13600, PRKD3, 68265, 170715, 764-3436; 13601, PKDCC, 68270, 170720, 157-702; 13601, PKDCC, 68269, 170719, 181-1662; 13602, PKN1, 68273, 170723, 133-899; 13602, PKN1, 68274, 170724, 1-597; 13602, PKN1, 68275, 170725, 59-848; 13602, PKN1, 68276, 170726, 1-454; 13602, PKN1, 68277, 170727, 539-582; 13602, PKN1, 68278, 170728, 1-677; 13602, PKN1, 68271, 170721, 166-2994; 13602, PKN1, 68272, 170722, 32-2878;

13603, PKN2, 68279, 170729, 360-2174; 13603, PKN2, 68280, 170730, 502-1464; 13603, PKN2, 68283, 170733, 1-196; 13603, PKN2, 68284, 170734, 1-632; 13603, PKN2, 68281, 170731, 9-2819; 13603, PKN2, 68282, 170732, 360-3314; 13604, PKN3, 68285, 170735, 394-3063; 13605, PRKAA1, 68286, 170736, 13-636; 13605, PRKAA1, 68287, 170737, 186-1910; 13605, PRKAA1, 68288, 170738, 10-1689; 13606, PRKAA2, 68290, 170740, 1-1659; 13606, PRKAA2, 68289, 170739, 67-1725; 13607, PRKAB1, 68292, 170742, 397-583; 13607, PRKAB1, 68293, 170743, 843-1157; 13607, PRKAB1, 68295, 170745, 96-272; 13607, PRKAB1, 68296, 170746, 82-258; 13607, PRKAB1, 68291, 170741, 493-1305; 13607, PRKAB1, 68294, 170744, 192-1004; 13608, PRKAB2, 68297, 170747, 140-958; 13609, PRKAG1, 68299, 170749, 1-282; 13609, PRKAG1, 68301, 170751, 48-296; 13609, PRKAG1, 68302, 170752, 81-688; 13609, PRKAG1, 68303, 170753, 403-778; 13609, PRKAG1, 68304, 170754, 397-604; 13609, PRKAG1, 68305, 170755, 306-553; 13609, PRKAG1, 68306, 170756, 68-910; 13609, PRKAG1, 68308, 170758, 484-568; 13609, PRKAG1, 68309, 170759, 1-756; 13609, PRKAG1, 68310, 170760, 129-612; 13609, PRKAG1, 68311, 170761, 228-663; 13609, PRKAG1, 68312, 170762, 397-527; 13609, PRKAG1, 68298, 170748, 40-1062; 13609, PRKAG1, 68300, 170750, 458-1453; 13609, PRKAG1, 68307, 170757, 313-1212; 13610, PRKAG2, 68316, 170766, 79-237; 13610, PRKAG2, 68317, 170767, 635-1123; 13610, PRKAG2, 68318, 170768, 322-1659; 13610, PRKAG2, 68319, 170769, 5-361; 13610, PRKAG2, 68320, 170770, 229-918; 13610, PRKAG2, 68313, 170763, 506-2215; 13610, PRKAG2, 68314, 170764, 444-2021; 13610, PRKAG2, 68315, 170765, 255-1241; 13611, PRKAG3, 68323, 170773, 32-331; 13611, PRKAG3, 68324, 170774, 34-1095; 13611, PRKAG3, 68321, 170771, 47-1516; 13611, PRKAG3, 68322, 170772, 22-1491; 13611, PRKAG3, 68325, 170775, 317-1786; 13612, PRKACA, 68327, 170777, 1-624; 13612, PRKACA, 68329, 170779, 327-403; 13612, PRKACA, 68330, 170780, 186-560; 13612, PRKACA, 68331, 170781, 1-755; 13612, PRKACA, 68326, 170776, 198-1253; 13612, PRKACA, 68328, 170778, 34-1065; 13613, PRKACB, 68332, 170782, 313-1107; 13613, PRKACB, 68334, 170784, 97-834; 13613, PRKACB, 68338, 170788, 32-1105; 13613, PRKACB, 68340, 170790, 91-648; 13613, PRKACB, 68341, 170791, 20-662; 13613, PRKACB, 68342, 170792, 327-944; 13613, PRKACB, 68343, 170793, 104-730; 13613, PRKACB, 68344, 170794, 96-686; 13613, PRKACB, 68346, 170796, 1-1017; 13613, PRKACB, 68333, 170783, 32-1099; 13613, PRKACB, 68335, 170785, 92-1288; 13613, PRKACB, 68336, 170786, 183-956; 13613, PRKACB, 68337, 170787, 265-1320; 13613, PRKACB, 68339, 170789, 42-1007; 13613, PRKACB, 68345, 170795, 32-1108; 13613, PRKACB, 68347, 170797, 42-1115; 13613, PRKACB, 68348, 170798, 32-1051; 13614, PRKACG, 68349, 170799, 22-1077; 13615, PRKAR1A, 68351, 170801, 106-480; 13615, PRKAR1A, 68354, 170804, 120-622; 13615, PRKAR1A, 68355, 170805, 87-557; 13615, PRKAR1A, 68357, 170807, 37-583; 13615, PRKAR1A, 68358, 170808, 503-1116; 13615, PRKAR1A, 68359, 170809, 1-106; 13615, PRKAR1A, 68360, 170810, 1-460; 13615, PRKAR1A, 68362, 170812, 211-549; 13615, PRKAR1A, 68363, 170813, 130-525; 13615, PRKAR1A, 68364, 170814, 104-995; 13615, PRKAR1A, 68365, 170815, 271-407; 13615, PRKAR1A, 68366, 170816, 358-553; 13615, PRKAR1A, 68350, 170800, 118-1263; 13615, PRKAR1A, 68352, 170802, 208-1353; 13615, PRKAR1A, 68353, 170803, 239-1384; 13615, PRKAR1A, 68356, 170806, 129-1274; 13615, PRKAR1A, 68361, 170811, 580-1725; 13615, PRKAR1A, 68367, 170817, 1-1014; 13616, PRKAR1B, 68369, 170819, 1-728; 13616, PRKAR1B, 68372, 170822, 244-752; 13616, PRKAR1B, 68373, 170823, 116-1006; 13616, PRKAR1B, 68374, 170824, 155-651; 13616, PRKAR1B, 68375, 170825, 171-518; 13616, PRKAR1B, 68368, 170818, 182-1327; 13616, PRKAR1B, 68370, 170820, 84-1229; 13616, PRKAR1B, 68371, 170821, 176-1321; 13616, PRKAR1B, 68376, 170826, 155-1300; 13616, PRKAR1B, 68377, 170827, 116-1261; 13617, PRKAR2A, 68381, 170831, 1-602; 13617, PRKAR2A, 68382, 170832, 1-277; 13617, PRKAR2A, 68383, 170833, 238-581; 13617, PRKAR2A, 68384, 170834, 1-298; 13617, PRKAR2A, 68378, 170828, 251-1465; 13617, PRKAR2A, 68379, 170829, 233-1381; 13617, PRKAR2A, 68380, 170830, 209-1423; 13618, PRKAR2B, 68385, 170835, 260-1516; 13619, PRKG1, 68386, 170836, 1-546; 13619, PRKG1, 68389, 170839, 95-1474; 13619, PRKG1, 68387, 170837, 418-2478; 13619, PRKG1, 68388, 170838, 22-2037; 13620, PRKG2, 68392, 170842, 486-1514; 13620, PRKG2, 68390, 170840, 196-2484; 13620, PRKG2, 68391, 170841, 118-2406; 13620, PRKG2, 68393, 170843, 143-2344; 13621, PRKDC, 68396, 170846, 327-537; 13621, PRKDC, 68397, 170847, 1-271; 13621, PRKDC, 68394, 170844, 58-12444; 13621, PRKDC, 68395, 170845, 53-12346; 13622, PRKRA, 68399, 170849, 42-329; 13622, PRKRA, 68401, 170851, 122-439; 13622, PRKRA, 68402, 170852, 617-942; 13622, PRKRA, 68398, 170848, 202-1143; 13622, PRKRA, 68400, 170850, 315-1223; 13622, PRKRA, 68403, 170853, 214-1080; 13623, PKMYT1, 68405, 170855, 331-1674; 13623, PKMYT1, 68406, 170856, 387-2093; 13623, PKMYT1, 68408, 170858, 268-1091; 13623, PKMYT1, 68409, 170859, 439-880; 13623, PKMYT1, 68412, 170862, 1-181; 13623, PKMYT1, 68413, 170863, 361-1006; 13623, PKMYT1, 68415, 170865, 471-979; 13623, PKMYT1, 68416, 170866, 344-495; 13623, PKMYT1, 68404, 170854, 510-2009; 13623, PKMYT1, 68407, 170857, 362-1804; 13623, PKMYT1, 68410, 170860, 286-1758; 13623, PKMYT1, 68411, 170861, 317-1789; 13623, PKMYT1, 68414, 170864, 410-1702; 13624, PRKX, 68417, 170867, 356-1432; 13625, POFUT1, 68418, 170868, 50-634; 13625, POFUT1, 68419, 170869, 63-1229; 13626, POFUT2, 68423, 170873, 1-795; 13626, POFUT2, 68424, 170874, 26-664; 13626, POFUT2, 68425, 170875, 191-616; 13626, POFUT2, 68420, 170870, 28-1302; 13626, POFUT2, 68421, 170871, 28-1170; 13626, POFUT2, 68422, 170872, 28-1317; 13627, POGLUT1, 68427, 170877, 60-623; 13627, POGLUT1, 68428, 170878, 1-567; 13627, POGLUT1, 68429, 170879, 60-551; 13627, POGLUT1, 68430, 170880, 23-358; 13627, POGLUT1, 68426, 170876, 85-1263; 13628, POMGNT1, 68433, 170883, 638-1240; 13628, POMGNT1, 68431, 170881, 159-2141; 13628, POMGNT1, 68432, 170882, 652-2898; 13629, POMGNT2, 68434, 170884, 347-2089; 13629, POMGNT2, 68435, 170885, 332-2074; 13630, PPP1CA, 68439, 170889, 7-765; 13630, PPP1CA, 68440, 170890, 50-588; 13630, PPP1CA, 68441, 170891, 48-554; 13630, PPP1CA, 68436, 170886, 12-1037; 13630, PPP1CA, 68437, 170887, 90-950; 13630, PPP1CA, 68438, 170888, 150-1142; 13631, PPP1CB, 68445, 170895, 1-249; 13631, PPP1CB, 68446, 170896, 214-721; 13631, PPP1CB, 68447, 170897, 108-302; 13631, PPP1CB, 68448, 170898, 196-570; 13631, PPP1CB, 68449, 170899, 170-584; 13631, PPP1CB, 68442, 170892, 199-1182; 13631, PPP1CB, 68443, 170893, 161-1144; 13631, PPP1CB, 68444, 170894, 273-1256; 13632, PPP1CC, 68452, 170902, 1-252; 13632, PPP1CC, 68453, 170903, 1001-1999; 13632, PPP1CC, 68454, 170904, 1-163; 13632, PPP1CC, 68455, 170905, 133-945; 13632, PPP1CC, 68456, 170906, 167-1081; 13632, PPP1CC, 68457, 170907, 161-582; 13632, PPP1CC, 68450, 170900, 192-1163; 13632, PPP1CC, 68451, 170901, 233-1246; 13633, PPP1R11, 68458, 170908, 472-696; 13633, PPP1R11, 68459, 170909, 213-437; 13633, PPP1R11, 68460, 170910, 285-509; 13633, PPP1R11, 68461, 170911, 438-662; 13633, PPP1R11, 68463, 170913, 389-613; 13633, PPP1R11, 68465, 170915, 472-696; 13633, PPP1R11, 68466, 170916, 213-437; 13633, PPP1R11, 68467, 170917, 288-512; 13633, PPP1R11, 68468, 170918, 438-662; 13633, PPP1R11, 68469, 170919, 389-613; 13633, PPP1R11, 68470, 170920, 472-696; 13633, PPP1R11, 68471, 170921, 285-509; 13633, PPP1R11, 68472, 170922, 438-662; 13633, PPP1R11, 68473, 170923, 389-613; 13633, PPP1R11, 68474, 170924, 389-613; 13633, PPP1R11, 68475, 170925, 472-696; 13633, PPP1R11, 68477, 170927, 213-437; 13633, PPP1R11, 68478, 170928, 389-613; 13633, PPP1R11, 68479, 170929, 438-662; 13633, PPP1R11, 68480, 170930, 472-696; 13633, PPP1R11, 68481, 170931, 389-613; 13633, PPP1R11, 68482, 170932, 472-696; 13633, PPP1R11, 68483, 170933, 213-437; 13633, PPP1R11, 68484, 170934, 285-509; 13633, PPP1R11, 68485, 170935, 438-662; 13633, PPP1R11, 68486, 170936, 213-437; 13633, PPP1R11, 68488, 170938, 213-437; 13633, PPP1R11, 68489, 170939, 389-613; 13633, PPP1R11, 68490, 170940, 285-509; 13633, PPP1R11, 68491, 170941, 472-696; 13633, PPP1R11, 68492, 170942, 213-437; 13633, PPP1R11, 68494, 170944, 438-662; 13633, PPP1R11, 68495, 170945, 472-696; 13633, PPP1R11, 68496, 170946, 285-509; 13633, PPP1R11, 68498, 170948, 389-613; 13633, PPP1R11, 68499, 170949, 285-509; 13633, PPP1R11, 68501, 170951, 438-662; 13633, PPP1R11, 68502, 170952, 438-662; 13633, PPP1R11, 68504, 170954, 213-437; 13633, PPP1R11, 68505, 170955, 285-509; 13633, PPP1R11, 68462, 170912, 324-704; 13633, PPP1R11, 68464, 170914, 324-704; 13633, PPP1R11, 68476, 170926, 324-704; 13633, PPP1R11, 68487, 170937, 324-704; 13633, PPP1R11, 68493, 170943, 200-580; 13633, PPP1R11, 68497, 170947, 207-587; 13633, PPP1R11, 68500, 170950, 324-704; 13633, PPP1R11, 68503, 170953, 324-704; 13634, PPP1R14A, 68508, 170958, 194-559; 13634, PPP1R14A, 68509, 170959, 293-526; 13634, PPP1R14A, 68510, 170960, 34-405; 13634, PPP1R14A, 68506, 170956, 253-696; 13634, PPP1R14A, 68507, 170957, 194-556; 13635, PPP1R14B, 68512, 170962, 497-715; 13635, PPP1R14B, 68513, 170963, 189-326; 13635, PPP1R14B, 68511, 170961, 269-712; 13636, PPP1R14C, 68514, 170964, 118-615; 13637, PPP1R14D, 68516, 170966, 69-671; 13637, PPP1R14D, 68515, 170965, 69-506; 13638, PPP1R1A, 68518, 170968, 28-222; 13638, PPP1R1A, 68519, 170969, 1-272; 13638, PPP1R1A, 68520, 170970, 29-490; 13638, PPP1R1A, 68517, 170967, 172-687; 13639, PPP1R1B, 68525, 170975, 442-875; 13639, PPP1R1B, 68526, 170976, 194-709; 13639, PPP1R1B, 68521, 170971, 470-1084; 13639, PPP1R1B, 68522, 170972, 153-659; 13639, PPP1R1B, 68523, 170973, 237-743; 13639, PPP1R1B, 68524, 170974, 289-903; 13640, PPP1R1C, 68527, 170977, 235-585; 13640, PPP1R1C, 68528, 170978, 244-573; 13640, PPP1R1C, 68529, 170979, 90-419; 13641, PPP1R2, 68530, 170980, 329-839; 13641, PPP1R2, 68531, 170981, 134-376; 13641, PPP1R2, 68532, 170982, 1-165; 13641, PPP1R2, 68534, 170984, 3-245; 13641, PPP1R2, 68533, 170983, 362-979; 13642, PPP1R10, 68535, 170985, 554-3376; 13642, PPP1R10, 68536, 170986, 554-3376; 13642, PPP1R10, 68537, 170987, 554-3376; 13642, PPP1R10, 68538, 170988, 554-3376; 13642, PPP1R10, 68539, 170989, 554-3376; 13642, PPP1R10, 68540, 170990, 554-3376; 13642, PPP1R10, 68541, 170991, 554-3376; 13643, PPP1R12A, 68545, 170995, 200-2275; 13643, PPP1R12A, 68547, 170997, 1-1101; 13643, PPP1R12A, 68548, 170998, 1-631; 13643, PPP1R12A, 68550, 171000, 1-486; 13643, PPP1R12A, 68551, 171001, 1-566; 13643, PPP1R12A, 68552, 171002, 292-582; 13643, PPP1R12A, 68553, 171003, 1-703; 13643, PPP1R12A, 68554, 171004, 1-897; 13643, PPP1R12A, 68555, 171005, 1-303; 13643, PPP1R12A, 68542, 170992, 124-3216; 13643, PPP1R12A, 68543, 170993, 268-3360; 13643, PPP1R12A, 68544, 170994, 129-3116; 13643, PPP1R12A, 68546, 170996, 1-2925; 13643, PPP1R12A, 68549, 170999, 140-2971; 13644, PPP1R12B, 68557, 171007, 154-3285; 13644, PPP1R12B, 68559, 171009, 125-553; 13644, PPP1R12B, 68560, 171010, 1-635; 13644, PPP1R12B, 68564, 171014, 301-861; 13644, PPP1R12B, 68565, 171015, 1-63; 13644, PPP1R12B, 68566, 171016, 1-25; 13644, PPP1R12B, 68556, 171006, 125-1285; 13644, PPP1R12B, 68558, 171008, 133-1680; 13644, PPP1R12B, 68561, 171011, 154-3102; 13644, PPP1R12B, 68562, 171012, 828-1454; 13644, PPP1R12B, 68563, 171013, 828-1502; 13645, PPP1R12C, 68569, 171019, 1-2213; 13645, PPP1R12C, 68570, 171020, 1-704; 13645, PPP1R12C, 68567, 171017, 17-2365; 13645, PPP1R12C, 68568, 171018, 129-2252; 13646, PPP1R13L, 68573, 171023, 1-273; 13646, PPP1R13L, 68574, 171024, 141-525; 13646, PPP1R13L, 68575, 171025, 1-89; 13646, PPP1R13L, 68576, 171026, 213-392; 13646, PPP1R13L, 68577, 171027, 906-1952; 13646, PPP1R13L, 68571, 171021, 62-2548; 13646, PPP1R13L, 68572, 171022, 80-2566; 13647, PPP1R13B, 68579, 171029, 181-611; 13647, PPP1R13B, 68580, 171030, 106-474; 13647, PPP1R13B, 68581, 171031, 1-320; 13647, PPP1R13B, 68582, 171032, 1-1906; 13647, PPP1R13B, 68583, 171033, 57-504; 13647, PPP1R13B, 68578, 171028, 284-3556; 13648, PPP1R15A, 68585, 171035, 1-776; 13648, PPP1R15A, 68584, 171034, 270-2294; 13649, PPP1R15B, 68586, 171036, 381-2522; 13650, PPP1R16A, 68589, 171039, 462-657; 13650, PPP1R16A, 68587, 171037, 918-2504; 13650, PPP1R16A, 68588, 171038, 470-2056; 13651, PPP1R16B, 68590, 171040, 190-1893; 13651, PPP1R16B, 68591, 171041, 171-1748; 13652, PPP1R17, 68592, 171042, 629-1096; 13652, PPP1R17, 68593, 171043, 129-443; 13653, PPP1R18, 68598, 171048, 132-1973; 13653, PPP1R18, 68600, 171050, 1878-3719; 13653, PPP1R18, 68605, 171055, 1-231; 13653, PPP1R18, 68608, 171058, 1-231; 13653, PPP1R18, 68594, 171044, 1878-3719; 13653, PPP1R18, 68595, 171045, 132-1973; 13653, PPP1R18, 68596, 171046, 132-1973; 13653, PPP1R18, 68597, 171047, 1878-3719; 13653, PPP1R18, 68599, 171049, 132-1973; 13653, PPP1R18, 68601, 171051, 132-1973; 13653, PPP1R18, 68602, 171052, 132-1973; 13653, PPP1R18, 68603, 171053, 1878-3719; 13653, PPP1R18, 68604, 171054, 1878-3719; 13653, PPP1R18, 68606, 171056, 1878-3719; 13653, PPP1R18, 68607, 171057, 1878-3719; 13653, PPP1R18, 68609, 171059, 132-1973; 13653, PPP1R18, 68610, 171060, 1878-3719; 13653, PPP1R18, 68611, 171061, 71-568; 13654, PPP1R21, 68614, 171064, 1-349; 13654, PPP1R21, 68615, 171065, 183-344; 13654, PPP1R21, 68616, 171066, 424-545; 13654, PPP1R21, 68617, 171067, 186-350; 13654, PPP1R21, 68612, 171062, 186-2495; 13654, PPP1R21, 68613, 171063, 158-2500; 13654, PPP1R21, 68618, 171068, 186-2402; 13655, PPP1R26, 68619, 171069, 550-4179; 13655, PPP1R26, 68620, 171070, 387-4016; 13655, PPP1R26, 68621, 171071, 258-3887; 13655, PPP1R26, 68622, 171072, 120-3749; 13655, PPP1R26, 68623, 171073, 362-

3991; 13656, PPP1R27, 68625, 171075, 98-442; 13656, PPP1R27, 68624, 171074, 81-545; 13657, PPP1R32, 68628, 171078, 1-414; 13657, PPP1R32, 68629, 171079, 189-356; 13657, PPP1R32, 68630, 171080, 1-531; 13657, PPP1R32, 68631, 171081, 671-979; 13657, PPP1R32, 68626, 171076, 126-1403; 13657, PPP1R32, 68627, 171077, 126-1343; 13658, PPP1R35, 68632, 171082, 192-953; 13659, PPP1R36, 68634, 171084, 59-196; 13659, PPP1R36, 68635, 171085, 79-303; 13659, PPP1R36, 68636, 171086, 463-596; 13659, PPP1R36, 68633, 171083, 97-1365; 13660, PPP1R37, 68638, 171088, 153-712; 13660, PPP1R37, 68637, 171087, 365-2440; 13661, PPP1R3A, 68641, 171091, 477-1049; 13661, PPP1R3A, 68639, 171089, 70-3438; 13661, PPP1R3A, 68640, 171090, 1-225; 13662, PPP1R3B, 68642, 171092, 152-1009; 13662, PPP1R3B, 68643, 171093, 246-1103; 13663, PPP1R3C, 68644, 171094, 86-1039; 13664, PPP1R3D, 68645, 171095, 367-1266; 13665, PPP1R3E, 68647, 171097, 1-148; 13665, PPP1R3E, 68648, 171098, 1-57; 13665, PPP1R3E, 68649, 171099, 1-90; 13665, PPP1R3E, 68650, 171100, 1-40; 13665, PPP1R3E, 68651, 171101, 1-104; 13665, PPP1R3E, 68646, 171096, 273-1112; 13666, PPP1R3F, 68655, 171105, 1-485; 13666, PPP1R3F, 68652, 171102, 17-2416; 13666, PPP1R3F, 68653, 171103, 662-2023; 13666, PPP1R3F, 68654, 171104, 96-1457; 13666, PPP1R3F, 68656, 171106, 389-1750; 13667, PPP1R3G, 68657, 171107, 906-1982; 13668, PPP1R42, 68659, 171109, 186-1115; 13668, PPP1R42, 68658, 171108, 146-832; 13669, PPP1R7, 68665, 171115, 79-903; 13669, PPP1R7, 68667, 171117, 1-1007; 13669, PPP1R7, 68668, 171118, 130-976; 13669, PPP1R7, 68669, 171119, 1-421; 13669, PPP1R7, 68670, 171120, 30-583; 13669, PPP1R7, 68671, 171121, 93-959; 13669, PPP1R7, 68672, 171122, 1-325; 13669, PPP1R7, 68660, 171110, 475-1557; 13669, PPP1R7, 68661, 171111, 839-1792; 13669, PPP1R7, 68662, 171112, 114-779; 13669, PPP1R7, 68663, 171113, 17-859; 13669, PPP1R7, 68664, 171114, 1-714; 13669, PPP1R7, 68666, 171116, 309-1391; 13670, PPP1R8, 68676, 171126, 414-1029; 13670, PPP1R8, 68673, 171123, 949-1332; 13670, PPP1R8, 68674, 171124, 59-1114; 13670, PPP1R8, 68675, 171125, 796-1425; 13671, PPP1R9A, 68679, 171129, 389-512; 13671, PPP1R9A, 68683, 171133, 337-555; 13671, PPP1R9A, 68677, 171127, 32-3922; 13671, PPP1R9A, 68678, 171128, 283-3579; 13671, PPP1R9A, 68680, 171130, 533-3829; 13671, PPP1R9A, 68681, 171131, 217-3978; 13671, PPP1R9A, 68682, 171132, 283-4407; 13671, PPP1R9A, 68684, 171134, 245-4006; 13672, PPP1R9B, 68685, 171135, 118-2571; 13673, PPP2CA, 68687, 171137, 75-510; 13673, PPP2CA, 68688, 171138, 208-585; 13673, PPP2CA, 68686, 171136, 282-1211; 13674, PPP2CB, 68690, 171140, 177-320; 13674, PPP2CB, 68691, 171141, 26-577; 13674, PPP2CB, 68692, 171142, 381-755; 13674, PPP2CB, 68693, 171143, 1-157; 13674, PPP2CB, 68694, 171144, 1-375; 13674, PPP2CB, 68689, 171139, 452-1381; 13675, PPP2R1A, 68696, 171146, 1-397; 13675, PPP2R1A, 68697, 171147, 47-1233; 13675, PPP2R1A, 68698, 171148, 50-166; 13675, PPP2R1A, 68699, 171149, 1062-2294; 13675, PPP2R1A, 68700, 171150, 7-207; 13675, PPP2R1A, 68701, 171151, 1-117; 13675, PPP2R1A, 68695, 171145, 59-1828; 13676, PPP2R1B, 68706, 171156, 7-258; 13676, PPP2R1B, 68707, 171157, 1-670; 13676, PPP2R1B, 68708, 171158, 197-553; 13676, PPP2R1B, 68709, 171159, 8-415; 13676, PPP2R1B, 68702, 171152, 22-2025; 13676, PPP2R1B, 68703, 171153, 8-1678; 13676, PPP2R1B, 68704, 171154, 22-1446; 13676, PPP2R1B, 68705, 171155, 26-1837; 13676, PPP2R1B, 68710, 171160, 67-1872; 13677, PPP2R2A, 68713, 171163, 293-448; 13677, PPP2R2A, 68714, 171164, 560-601; 13677, PPP2R2A, 68715, 171165, 293-394; 13677, PPP2R2A, 68716, 171166, 644-653; 13677, PPP2R2A, 68717, 171167, 514-529; 13677, PPP2R2A, 68718, 171168, 207-605; 13677, PPP2R2A, 68719, 171169, 193-784; 13677, PPP2R2A, 68720, 171170, 1-99; 13677, PPP2R2A, 68711, 171161, 32-1405; 13677, PPP2R2A, 68712, 171162, 330-1673; 13678, PPP2R5A, 68721, 171171, 575-2035; 13678, PPP2R5A, 68722, 171172, 278-1567; 13679, PPP2R3A, 68725, 171175, 1-574; 13679, PPP2R3A, 68723, 171173, 618-4070; 13679, PPP2R3A, 68724, 171174, 336-1925; 13679, PPP2R3A, 68726, 171176, 320-1564; 13680, PPP2R2B, 68733, 171183, 379-553; 13680, PPP2R2B, 68735, 171185, 217-330; 13680, PPP2R2B, 68736, 171186, 189-338; 13680, PPP2R2B, 68737, 171187, 298-420; 13680, PPP2R2B, 68738, 171188, 1-236; 13680, PPP2R2B, 68739, 171189, 511-645; 13680, PPP2R2B, 68741, 171191, 164-298; 13680, PPP2R2B, 68742, 171192, 210-344; 13680, PPP2R2B, 68727, 171177, 232-1572; 13680, PPP2R2B, 68728, 171178, 572-1903; 13680, PPP2R2B, 68729, 171179, 300-1631; 13680, PPP2R2B, 68730, 171180, 202-1707; 13680, PPP2R2B, 68731, 171181, 290-1819; 13680, PPP2R2B, 68732, 171182, 833-2131; 13680, PPP2R2B, 68734, 171184, 226-1575; 13680, PPP2R2B, 68740, 171190, 301-1599; 13681, PPP2R5B, 68744, 171194, 454-786; 13681, PPP2R5B, 68745, 171195, 307-887; 13681, PPP2R5B, 68743, 171193, 623-2116; 13682, PPP2R3B, 68746, 171196, 274-782; 13682, PPP2R3B, 68748, 171198, 20-1747; 13682, PPP2R3B, 68749, 171199, 20-1747; 13682, PPP2R3B, 68750, 171200, 274-782; 13682, PPP2R3B, 68751, 171201, 274-782; 13682, PPP2R3B, 68747, 171197, 20-1747; 13683, PPP2R2D, 68753, 171203, 1-451; 13683, PPP2R2D, 68754, 171204, 119-352; 13683, PPP2R2D, 68755, 171205, 1-174; 13683, PPP2R2D, 68752, 171202, 506-1867; 13684, PPP2R5D, 68756, 171206, 79-414; 13684, PPP2R5D, 68759, 171209, 1-1513; 13684, PPP2R5D, 68760, 171210, 1-462; 13684, PPP2R5D, 68761, 171211, 125-1909; 13684, PPP2R5D, 68757, 171207, 126-1838; 13684, PPP2R5D, 68758, 171208, 180-1988; 13684, PPP2R5D, 68762, 171212, 27-1517; 13685, PPP2R5E, 68763, 171213, 604-2007; 13685, PPP2R5E, 68764, 171214, 186-1361; 13685, PPP2R5E, 68765, 171215, 528-1916; 13686, PPP2R2C, 68770, 171220, 22-150; 13686, PPP2R2C, 68766, 171216, 25-1368; 13686, PPP2R2C, 68767, 171217, 218-1561; 13686, PPP2R2C, 68768, 171218, 284-1576; 13686, PPP2R2C, 68769, 171219, 100-1422; 13686, PPP2R2C, 68771, 171221, 204-1526; 13687, PPP2R5C, 68777, 171227, 33-407; 13687, PPP2R5C, 68778, 171228, 1-137; 13687, PPP2R5C, 68779, 171229, 1-216; 13687, PPP2R5C, 68780, 171230, 1-455; 13687, PPP2R5C, 68781, 171231, 110-759; 13687, PPP2R5C, 68782, 171232, 1-1662; 13687, PPP2R5C, 68783, 171233, 39-1193; 13687, PPP2R5C, 68784, 171234, 1-462; 13687, PPP2R5C, 68785, 171235, 107-247; 13687, PPP2R5C, 68786, 171236, 1-210; 13687, PPP2R5C, 68787, 171237, 75-284; 13687, PPP2R5C, 68788, 171238, 1-439; 13687, PPP2R5C, 68789, 171239, 1-90; 13687, PPP2R5C, 68790, 171240, 1-270; 13687, PPP2R5C, 68791, 171241, 25-231; 13687, PPP2R5C, 68792, 171242, 109-432; 13687, PPP2R5C, 68772, 171222, 141-1598; 13687, PPP2R5C, 68773, 171223, 10-1632; 13687, PPP2R5C, 68774, 171224, 49-1623; 13687, PPP2R5C, 68775, 171225, 49-1398; 13687, PPP2R5C, 68776, 171226, 97-1764; 13688, PPP2R3C, 68794, 171244, 28-96; 13688, PPP2R3C, 68795, 171245, 1-125; 13688, PPP2R3C, 68796, 171246, 7-684; 13688, PPP2R3C, 68797, 171247, 395-896; 13688, PPP2R3C, 68798, 171248, 183-

251; 13688, PPP2R3C, 68799, 171249, 1-676; 13688, PPP2R3C, 68800, 171250, 369-437; 13688, PPP2R3C, 68801, 171251, 30-191; 13688, PPP2R3C, 68802, 171252, 26-115; 13688, PPP2R3C, 68803, 171253, 355-927; 13688, PPP2R3C, 68804, 171254, 1-59; 13688, PPP2R3C, 68805, 171255, 1-387; 13688, PPP2R3C, 68806, 171256, 56-460; 13688, PPP2R3C, 68807, 171257, 16-84; 13688, PPP2R3C, 68808, 171258, 32-100; 13688, PPP2R3C, 68809, 171259, 559-627; 13688, PPP2R3C, 68810, 171260, 12-332; 13688, PPP2R3C, 68793, 171243, 355-1716; 13689, PPP2R4, 68811, 171261, 266-1255; 13689, PPP2R4, 68812, 171262, 193-507; 13689, PPP2R4, 68818, 171268, 125-310; 13689, PPP2R4, 68819, 171269, 145-270; 13689, PPP2R4, 68820, 171270, 161-548; 13689, PPP2R4, 68821, 171271, 35-490; 13689, PPP2R4, 68822, 171272, 299-490; 13689, PPP2R4, 68823, 171273, 274-459; 13689, PPP2R4, 68824, 171274, 179-1045; 13689, PPP2R4, 68825, 171275, 199-949; 13689, PPP2R4, 68826, 171276, 1-361; 13689, PPP2R4, 68827, 171277, 285-681; 13689, PPP2R4, 68828, 171278, 39-567; 13689, PPP2R4, 68829, 171279, 179-967; 13689, PPP2R4, 68830, 171280, 1-656; 13689, PPP2R4, 68831, 171281, 189-949; 13689, PPP2R4, 68832, 171282, 269-454; 13689, PPP2R4, 68833, 171283, 145-330; 13689, PPP2R4, 68834, 171284, 154-339; 13689, PPP2R4, 68835, 171285, 53-286; 13689, PPP2R4, 68836, 171286, 130-315; 13689, PPP2R4, 68813, 171263, 288-1364; 13689, PPP2R4, 68814, 171264, 188-1033; 13689, PPP2R4, 68815, 171265, 288-1172; 13689, PPP2R4, 68816, 171266, 213-1184; 13689, PPP2R4, 68817, 171267, 284-1255; 13690, PP2D1, 68837, 171287, 196-1326; 13690, PP2D1, 68838, 171288, 259-2151; 13691, PPP3CA, 68843, 171293, 140-1411; 13691, PPP3CA, 68844, 171294, 1-51; 13691, PPP3CA, 68845, 171295, 139-579; 13691, PPP3CA, 68846, 171296, 174-569; 13691, PPP3CA, 68839, 171289, 676-2085; 13691, PPP3CA, 68840, 171290, 532-2067; 13691, PPP3CA, 68841, 171291, 685-2250; 13691, PPP3CA, 68842, 171292, 682-1551; 13692, PPP3CB, 68847, 171297, 108-1598; 13692, PPP3CB, 68851, 171301, 1-564; 13692, PPP3CB, 68848, 171298, 113-1687; 13692, PPP3CB, 68849, 171299, 136-1683; 13692, PPP3CB, 68850, 171300, 136-1713; 13693, PPP3CC, 68855, 171305, 1-460; 13693, PPP3CC, 68856, 171306, 1-608; 13693, PPP3CC, 68857, 171307, 592-1572; 13693, PPP3CC, 68858, 171308, 217-619; 13693, PPP3CC, 68859, 171309, 1-626; 13693, PPP3CC, 68852, 171302, 328-1866; 13693, PPP3CC, 68853, 171303, 287-1795; 13693, PPP3CC, 68854, 171304, 275-1840; 13694, PPP3R1, 68861, 171311, 186-668; 13694, PPP3R1, 68862, 171312, 123-692; 13694, PPP3R1, 68860, 171310, 405-917; 13695, PPP3R2, 68863, 171313, 72-593; 13696, PPP4C, 68865, 171315, 181-333; 13696, PPP4C, 68867, 171317, 141-941; 13696, PPP4C, 68868, 171318, 133-742; 13696, PPP4C, 68869, 171319, 154-324; 13696, PPP4C, 68870, 171320, 142-504; 13696, PPP4C, 68871, 171321, 136-288; 13696, PPP4C, 68864, 171314, 169-1092; 13696, PPP4C, 68866, 171316, 154-1077; 13697, PPP4R1, 68872, 171322, 22-276; 13697, PPP4R1, 68875, 171325, 89-379; 13697, PPP4R1, 68876, 171326, 148-578; 13697, PPP4R1, 68877, 171327, 50-103; 13697, PPP4R1, 68878, 171328, 50-355; 13697, PPP4R1, 68879, 171329, 129-535; 13697, PPP4R1, 68880, 171330, 172-625; 13697, PPP4R1, 68881, 171331, 9-578; 13697, PPP4R1, 68882, 171332, 76-303; 13697, PPP4R1, 68873, 171323, 86-2887; 13697, PPP4R1, 68874, 171324, 75-2927; 13698, PPP4R2, 68884, 171334, 236-586; 13698, PPP4R2, 68885, 171335, 62-271; 13698, PPP4R2, 68886, 171336, 200-877; 13698, PPP4R2, 68887, 171337, 1-431; 13698, PPP4R2, 68888, 171338, 136-323; 13698, PPP4R2, 68883, 171333, 254-1507; 13699, PPP4R3A, 68889, 171339, 84-534; 13699, PPP4R3A, 68890, 171340, 1-1630; 13699, PPP4R3A, 68894, 171344, 1-595; 13699, PPP4R3A, 68895, 171345, 284-580; 13699, PPP4R3A, 68896, 171346, 1-571; 13699, PPP4R3A, 68897, 171347, 834-2953; 13699, PPP4R3A, 68891, 171341, 498-2960; 13699, PPP4R3A, 68892, 171342, 117-2618; 13699, PPP4R3A, 68893, 171343, 832-2616; 13700, PPP4R3B, 68898, 171348, 330-2624; 13700, PPP4R3B, 68899, 171349, 304-2853; 13700, PPP4R3B, 68900, 171350, 324-2777; 13701, PPP4R4, 68903, 171353, 394-564; 13701, PPP4R4, 68904, 171354, 251-589; 13701, PPP4R4, 68905, 171355, 377-564; 13701, PPP4R4, 68908, 171358, 251-589; 13701, PPP4R4, 68909, 171359, 377-564; 13701, PPP4R4, 68910, 171360, 394-564; 13701, PPP4R4, 68901, 171351, 155-2776; 13701, PPP4R4, 68902, 171352, 129-491; 13701, PPP4R4, 68906, 171356, 155-2776; 13701, PPP4R4, 68907, 171357, 129-491; 13702, PPPSC, 68912, 171362, 308-1423; 13702, PPPSC, 68913, 171363, 1-1457; 13702, PPPSC, 68911, 171361, 104-1603; 13703, PPP6C, 68917, 171367, 195-569; 13703, PPP6C, 68914, 171364, 101-1018; 13703, PPP6C, 68915, 171365, 222-1250; 13703, PPP6C, 68916, 171366, 222-1073; 13704, PPP6R1, 68919, 171369, 102-574; 13704, PPP6R1, 68918, 171368, 568-3213; 13704, PPP6R1, 68920, 171370, 270-2915; 13705, PPP6R2, 68925, 171375, 1-2056; 13705, PPP6R2, 68926, 171376, 1-1687; 13705, PPP6R2, 68921, 171371, 371-3271; 13705, PPP6R2, 68922, 171372, 395-3178; 13705, PPP6R2, 68923, 171373, 376-3177; 13705, PPP6R2, 68924, 171374, 368-3166; 13705, PPP6R2, 68927, 171377, 382-3261; 13706, PPP6R3, 68929, 171379, 83-2566; 13706, PPP6R3, 68933, 171383, 406-826; 13706, PPP6R3, 68934, 171384, 129-687; 13706, PPP6R3, 68936, 171386, 377-603; 13706, PPP6R3, 68937, 171387, 153-2669; 13706, PPP6R3, 68938, 171388, 435-551; 13706, PPP6R3, 68939, 171389, 1-155; 13706, PPP6R3, 68940, 171390, 1-337; 13706, PPP6R3, 68941, 171391, 278-2203; 13706, PPP6R3, 68942, 171392, 1-1743; 13706, PPP6R3, 68943, 171393, 1-329; 13706, PPP6R3, 68944, 171394, 514-538; 13706, PPP6R3, 68928, 171378, 278-2659; 13706, PPP6R3, 68930, 171380, 255-2876; 13706, PPP6R3, 68931, 171381, 216-2855; 13706, PPP6R3, 68932, 171382, 237-2771; 13706, PPP6R3, 68935, 171385, 231-2834; 13706, PPP6R3, 68945, 171395, 278-2653; 13707, PPME1, 68948, 171398, 1051-1458; 13707, PPME1, 68946, 171396, 324-1484; 13707, PPME1, 68947, 171397, 101-1303; 13708, PPEF1, 68951, 171401, 230-765; 13708, PPEF1, 68952, 171402, 1-348; 13708, PPEF1, 68953, 171403, 270-557; 13708, PPEF1, 68949, 171399, 482-2257; 13708, PPEF1, 68950, 171400, 495-2456; 13709, PPEF2, 68955, 171405, 274-693; 13709, PPEF2, 68954, 171404, 358-2619; 13709, PPEF2, 68956, 171406, 1-1797; 13710, PPM1A, 68960, 171410, 179-564; 13710, PPM1A, 68961, 171411, 292-854; 13710, PPM1A, 68962, 171412, 126-569; 13710, PPM1A, 68963, 171413, 64-558; 13710, PPM1A, 68964, 171414, 92-373; 13710, PPM1A, 68957, 171407, 360-1334; 13710, PPM1A, 68958, 171408, 97-1464; 13710, PPM1A, 68959, 171409, 431-1579; 13711, PPM1B, 68968, 171418, 15-923; 13711, PPM1B, 68970, 171420, 951-2084; 13711, PPM1B, 68965, 171415, 413-1852; 13711, PPM1B, 68966, 171416, 381-959; 13711, PPM1B, 68967, 171417, 413-1576; 13711, PPM1B, 68969, 171419, 413-1555; 13712, PPM1D, 68973, 171423, 113-489; 13712, PPM1D, 68971, 171421, 233-2050; 13712, PPM1D, 68972, 171422, 147-1439; 13712, PPM1D, 68974, 171424, 233-1525; 13713, PPM1E, 68975, 171425, 130-2397; 13714, PPM1F, 68977, 171427, 101-1186; 13714, PPM1F, 68978, 171428, 1062-1922; 13714, PPM1F, 68979, 171429, 331-576; 13714,

PPM1F, 68980, 171430, 382-650; 13714, PPM1F, 68976, 171426, 107-1471; 13715, PPM1G, 68981, 171431, 266-1906; 13716, PPM1H, 68982, 171432, 302-1846; 13717, PPM1J, 68984, 171434, 3-455; 13717, PPM1J, 68985, 171435, 1-896; 13717, PPM1J, 68983, 171433, 177-1694; 13717, PPM1J, 68986, 171436, 1410-2309; 13718, PPM1K, 68987, 171437, 233-1216; 13718, PPM1K, 68988, 171438, 444-905; 13718, PPM1K, 68989, 171439, 510-572; 13718, PPM1K, 68990, 171440, 176-566; 13718, PPM1K, 68991, 171441, 547-563; 13718, PPM1K, 68992, 171442, 424-972; 13718, PPM1K, 68993, 171443, 391-1509; 13719, PPM1L, 68994, 171444, 49-750; 13719, PPM1L, 68995, 171445, 102-1184; 13719, PPM1L, 68996, 171446, 708-1292; 13719, PPM1L, 68997, 171447, 319-864; 13720, PPM1M, 68999, 171449, 33-1412; 13720, PPM1M, 69001, 171451, 1-364; 13720, PPM1M, 69002, 171452, 1-770; 13720, PPM1M, 68998, 171448, 405-1217; 13720, PPM1M, 69000, 171450, 264-1007; 13721, PPM1N, 69004, 171454, 4-417; 13721, PPM1N, 69007, 171457, 16-438; 13721, PPM1N, 69008, 171458, 124-516; 13721, PPM1N, 69010, 171460, 1-1123; 13721, PPM1N, 69003, 171453, 132-470; 13721, PPM1N, 69005, 171455, 109-447; 13721, PPM1N, 69006, 171456, 219-557; 13721, PPM1N, 69009, 171459, 1-1293; 13722, PTAR1, 69012, 171462, 4-1056; 13722, PTAR1, 69013, 171463, 1-505; 13722, PTAR1, 69014, 171464, 22-111; 13722, PTAR1, 69011, 171461, 5-1213; 13723, N/A, 69015, 171465, 48-1616; 13723, N/A, 69016, 171466, 189-1757; 13724, PRC1, 69020, 171470, 1-716; 13724, PRC1, 69021, 171471, 1-584; 13724, PRC1, 69022, 171472, 84-414; 13724, PRC1, 69023, 171473, 109-571; 13724, PRC1, 69024, 171474, 1-194; 13724, PRC1, 69025, 171475, 1-141; 13724, PRC1, 69017, 171467, 1213-3033; 13724, PRC1, 69018, 171468, 79-1941; 13724, PRC1, 69019, 171469, 109-1686; 13725, PROS1, 69026, 171476, 114-806; 13725, PROS1, 69028, 171478, 562-2199; 13725, PROS1, 69029, 171479, 395-562; 13725, PROS1, 69027, 171477, 318-2348; 13726, PSKH1, 69031, 171481, 171-1232; 13726, PSKH1, 69030, 171480, 171-1445; 13727, PSKH2, 69032, 171482, 76-1233; 13728, N/A, 69034, 171484, 1-874; 13728, N/A, 69035, 171485, 1-292; 13728, N/A, 69033, 171483, 512-3355; 13729, PTK2, 69038, 171488, 459-1547; 13729, PTK2, 69039, 171489, 398-574; 13729, PTK2, 69040, 171490, 171-569; 13729, PTK2, 69041, 171491, 186-542; 13729, PTK2, 69042, 171492, 80-280; 13729, PTK2, 69043, 171493, 180-545; 13729, PTK2, 69044, 171494, 1-219; 13729, PTK2, 69045, 171495, 71-576; 13729, PTK2, 69046, 171496, 69-287; 13729, PTK2, 69047, 171497, 63-437; 13729, PTK2, 69048, 171498, 1-2175; 13729, PTK2, 69049, 171499, 288-488; 13729, PTK2, 69050, 171500, 1-387; 13729, PTK2, 69051, 171501, 101-570; 13729, PTK2, 69052, 171502, 169-535; 13729, PTK2, 69053, 171503, 1-959; 13729, PTK2, 69054, 171504, 461-504; 13729, PTK2, 69055, 171505, 307-3597; 13729, PTK2, 69056, 171506, 313-3603; 13729, PTK2, 69057, 171507, 173-2215; 13729, PTK2, 69058, 171508, 436-630; 13729, PTK2, 69059, 171509, 274-477; 13729, PTK2, 69061, 171511, 389-750; 13729, PTK2, 69062, 171512, 380-581; 13729, PTK2, 69063, 171513, 134-334; 13729, PTK2, 69064, 171514, 220-540; 13729, PTK2, 69066, 171516, 1-3052; 13729, PTK2, 69067, 171517, 3-242; 13729, PTK2, 69068, 171518, 322-475; 13729, PTK2, 69069, 171519, 252-602; 13729, PTK2, 69070, 171520, 193-558; 13729, PTK2, 69072, 171521, 1-2262; 13729, PTK2, 69072, 171522, 270-629; 13729, PTK2, 69073, 171523, 1943-2290; 13729, PTK2, 69074, 171524, 219-571; 13729, PTK2, 69075, 171525, 407-430; 13729, PTK2, 69076, 171526, 283-678; 13729, PTK2, 69036, 171486, 156-3353; 13729, PTK2, 69037, 171487, 311-3331; 13729, PTK2, 69060, 171510, 183-3341; 13729, PTK2, 69065, 171515, 231-3389; 13730, PTK2B, 69078, 171528, 452-2242; 13730, PTK2B, 69081, 171531, 180-818; 13730, PTK2B, 69083, 171533, 99-651; 13730, PTK2B, 69084, 171534, 1-582; 13730, PTK2B, 69085, 171535, 335-539; 13730, PTK2B, 69086, 171536, 244-554; 13730, PTK2B, 69077, 171527, 241-3270; 13730, PTK2B, 69079, 171529, 809-3838; 13730, PTK2B, 69080, 171530, 156-3059; 13730, PTK2B, 69082, 171532, 134-3037; 13731, PTK6, 69087, 171537, 57-461; 13731, PTK6, 69088, 171538, 41-1396; 13732, PTK7, 69094, 171544, 183-602; 13732, PTK7, 69095, 171545, 97-351; 13732, PTK7, 69096, 171546, 1-76; 13732, PTK7, 69097, 171547, 1-78; 13732, PTK7, 69099, 171549, 151-1530; 13732, PTK7, 69100, 171550, 1-78; 13732, PTK7, 69101, 171551, 1-807; 13732, PTK7, 69102, 171552, 98-870; 13732, PTK7, 69103, 171553, 157-630; 13732, PTK7, 69104, 171554, 1-1097; 13732, PTK7, 69089, 171539, 148-2598; 13732, PTK7, 69090, 171540, 222-3434; 13732, PTK7, 69091, 171541, 148-2970; 13732, PTK7, 69092, 171542, 148-3240; 13732, PTK7, 69093, 171543, 148-3192; 13732, PTK7, 69098, 171548, 71-3307; 13733, PTPDC1, 69107, 171557, 103-2529; 13733, PTPDC1, 69105, 171555, 68-2488; 13733, PTPDC1, 69106, 171556, 341-2605; 13734, PTP4A1, 69109, 171559, 1-135; 13734, PTP4A1, 69111, 171561, 1-447; 13734, PTP4A1, 69108, 171558, 1154-1675; 13734, PTP4A1, 69110, 171560, 394-915; 13735, PTP4A2, 69114, 171564, 295-495; 13735, PTP4A2, 69115, 171565, 835-900; 13735, PTP4A2, 69116, 171566, 400-609; 13735, PTP4A2, 69117, 171567, 59-280; 13735, PTP4A2, 69118, 171568, 642-830; 13735, PTP4A2, 69121, 171571, 406-615; 13735, PTP4A2, 69122, 171572, 406-606; 13735, PTP4A2, 69112, 171562, 995-1498; 13735, PTP4A2, 69113, 171563, 304-714; 13735, PTP4A2, 69119, 171569, 419-922; 13735, PTP4A2, 69120, 171570, 45-473; 13736, PTP4A3, 69125, 171575, 348-558; 13736, PTP4A3, 69128, 171578, 224-487; 13736, PTP4A3, 69133, 171583, 348-558; 13736, PTP4A3, 69123, 171573, 854-1300; 13736, PTP4A3, 69124, 171574, 854-1375; 13736, PTP4A3, 69126, 171576, 944-1390; 13736, PTP4A3, 69127, 171577, 946-1467; 13736, PTP4A3, 69129, 171579, 854-1300; 13736, PTP4A3, 69130, 171580, 854-1375; 13736, PTP4A3, 69131, 171581, 946-1467; 13736, PTP4A3, 69132, 171582, 944-1390; 13737, PTPMT1, 69137, 171587, 166-672; 13737, PTPMT1, 69134, 171584, 25-438; 13737, PTPMT1, 69135, 171585, 23-628; 13737, PTPMT1, 69136, 171586, 194-649; 13738, PTPN1, 69139, 171589, 336-1424; 13738, PTPN1, 69138, 171588, 175-1482; 13739, PTPN11, 69142, 171592, 1-326; 13739, PTPN11, 69143, 171593, 1-588; 13739, PTPN11, 69144, 171594, 1-1794; 13739, PTPN11, 69140, 171590, 199-1980; 13739, PTPN11, 69141, 171591, 204-1586; 13740, PTPN12, 69146, 171596, 1-704; 13740, PTPN12, 69148, 171598, 305-564; 13740, PTPN12, 69149, 171599, 73-414; 13740, PTPN12, 69151, 171601, 418-552; 13740, PTPN12, 69152, 171602, 107-159; 13740, PTPN12, 69153, 171603, 1-131; 13740, PTPN12, 69154, 171604, 1-642; 13740, PTPN12, 69145, 171595, 273-2615; 13740, PTPN12, 69147, 171597, 331-2316; 13740, PTPN12, 69150, 171600, 234-2186; 13741, PTPN13, 69159, 171609, 100-516; 13741, PTPN13, 69160, 171610, 479-1162; 13741, PTPN13, 69155, 171605, 64-6948; 13741, PTPN13, 69156, 171606, 481-7953; 13741, PTPN13, 69157, 171607, 64-7521; 13741, PTPN13, 69158, 171608, 481-7881; 13741, PTPN13, 69161, 171611, 6-7478; 13742, PTPN14, 69163, 171613, 196-831; 13742, PTPN14, 69162, 171612, 196-3759; 13743, PTPN18, 69166, 171616, 1-808; 13743, PTPN18, 69167, 171617, 43-189; 13743, PTPN18, 69164, 171614, 102-1484; 13743, PTPN18, 69165, 171615, 64-1125; 13744, PTPN2, 69171, 171621, 1-454; 13744, PTPN2, 69172, 171622, 1-338; 13744, PTPN2, 69173, 171623, 374-577; 13744, PTPN2, 69175, 171625, 1-439; 13744, PTPN2, 69176, 171626, 254-1414; 13744, PTPN2, 69177, 171627, 82-210; 13744, PTPN2, 69178, 171628, 137-634; 13744, PTPN2, 69179, 171629, 58-186; 13744, PTPN2, 69168, 171618, 95-1342; 13744, PTPN2, 69169, 171619, 198-1361; 13744, PTPN2, 69170, 171620, 141-1202; 13744, PTPN2, 69174, 171624, 74-1306; 13745, PTPN20, 69182, 171632, 123-317; 13745, PTPN20, 69185, 171635, 189-383; 13745, PTPN20, 69188, 171638, 189-567; 13745, PTPN20, 69189, 171639, 251-439; 13745, PTPN20, 69194, 171644, 254-457; 13745, PTPN20, 69203, 171653, 420-608; 13745, PTPN20, 69205, 171655, 177-371; 13745, PTPN20, 69206, 171656, 368-562; 13745, PTPN20, 69207, 171657, 313-507; 13745, PTPN20, 69180, 171630, 274-1293; 13745, PTPN20, 69181, 171631, 78-1340; 13745, PTPN20, 69183, 171633, 191-871; 13745, PTPN20, 69184, 171634, 179-1198; 13745, PTPN20, 69186, 171636, 179-616; 13745, PTPN20, 69187, 171637, 56-742; 13745, PTPN20, 69190, 171640, 186-806; 13745, PTPN20, 69191, 171641, 84-521; 13745, PTPN20, 69192, 171642, 177-491; 13745, PTPN20, 69193, 171643, 334-1353; 13745, PTPN20, 69195, 171645, 177-770; 13745, PTPN20, 69196, 171646, 177-614; 13745, PTPN20, 69197, 171647, 56-1291; 13745, PTPN20, 69198, 171648, 226-663; 13745, PTPN20, 69199, 171649, 186-866; 13745, PTPN20, 69200, 171650, 56-709; 13745, PTPN20, 69201, 171651, 56-865; 13745, PTPN20, 69202, 171652, 177-1196; 13745, PTPN20, 69204, 171654, 56-466; 13746, PTPN21, 69209, 171659, 114-299; 13746, PTPN21, 69210, 171660, 1-387; 13746, PTPN21, 69211, 171661, 428-1014; 13746, PTPN21, 69208, 171658, 206-3730; 13746, PTPN21, 69212, 171662, 286-3810; 13747, PTPN22, 69213, 171663, 137-2560; 13747, PTPN22, 69214, 171664, 90-2477; 13747, PTPN22, 69215, 171665, 86-493; 13747, PTPN22, 69216, 171666, 90-2096; 13747, PTPN22, 69218, 171668, 131-409; 13747, PTPN22, 69219, 171669, 76-2334; 13747, PTPN22, 69220, 171670, 131-2482; 13747, PTPN22, 69217, 171667, 90-629; 13748, PTPN23, 69222, 171672, 84-592; 13748, PTPN23, 69223, 171673, 87-281; 13748, PTPN23, 69221, 171671, 78-4988; 13749, PTPN3, 69224, 171674, 113-2632; 13749, PTPN3, 69225, 171675, 106-2847; 13749, PTPN3, 69226, 171676, 2555-4768; 13749, PTPN3, 69227, 171677, 2555-4903; 13750, PTPN4, 69229, 171679, 1-594; 13750, PTPN4, 69230, 171680, 1-658; 13750, PTPN4, 69231, 171681, 1-407; 13750, PTPN4, 69232, 171682, 344-568; 13750, PTPN4, 69233, 171683, 1-366; 13750, PTPN4, 69234, 171684, 179-662; 13750, PTPN4, 69228, 171678, 772-3552; 13751, PTPN5, 69236, 171686, 780-1295; 13751, PTPN5, 69239, 171689, 711-1820; 13751, PTPN5, 69235, 171685, 432-2129; 13751, PTPN5, 69237, 171687, 169-1794; 13751, PTPN5, 69238, 171688, 1266-2867; 13752, PTPN6, 69243, 171693, 85-579; 13752, PTPN6, 69244, 171694, 139-570; 13752, PTPN6, 69245, 171695, 141-323; 13752, PTPN6, 69246, 171696, 259-650; 13752, PTPN6, 69247, 171697, 153-329; 13752, PTPN6, 69248, 171698, 141-592; 13752, PTPN6, 69249, 171699, 77-247; 13752, PTPN6, 69250, 171700, 142-360; 13752, PTPN6, 69240, 171690, 245-2032; 13752, PTPN6, 69241, 171691, 150-1943; 13752, PTPN6, 69242, 171692, 243-2117; 13753, PTPN7, 69253, 171703, 117-575; 13753, PTPN7, 69254, 171704, 132-551; 13753, PTPN7, 69255, 171705, 255-560; 13753, PTPN7, 69256, 171706, 308-673; 13753, PTPN7, 69257, 171707, 1-1326; 13753, PTPN7, 69258, 171708, 117-577; 13753, PTPN7, 69259, 171709, 117-467; 13753, PTPN7, 69260, 171710, 117-539; 13753, PTPN7, 69261, 171711, 124-354; 13753, PTPN7, 69262, 171712, 61-550; 13753, PTPN7, 69263, 171713, 79-542; 13753, PTPN7, 69265, 171715, 87-437; 13753, PTPN7, 69251, 171701, 775-2172; 13753, PTPN7, 69252, 171702, 473-1672; 13753, PTPN7, 69264, 171714, 103-1185; 13754, PTPN9, 69266, 171716, 469-2220; 13754, PTPN9, 69267, 171717, 1-525; 13754, PTPN9, 69268, 171718, 514-2295; 13755, PTPRA, 69274, 171724, 293-707; 13755, PTPRA, 69275, 171725, 207-733; 13755, PTPRA, 69276, 171726, 348-1107; 13755, PTPRA, 69269, 171719, 401-2782; 13755, PTPRA, 69270, 171720, 297-2678; 13755, PTPRA, 69271, 171721, 219-2600; 13755, PTPRA, 69272, 171722, 687-3095; 13755, PTPRA, 69273, 171723, 394-2802; 13756, PTPRB, 69279, 171729, 27-2786; 13756, PTPRB, 69281, 171731, 1-310; 13756, PTPRB, 69282, 171732, 17-4237; 13756, PTPRB, 69284, 171734, 27-6410; 13756, PTPRB, 69285, 171735, 26-4777; 13756, PTPRB, 69277, 171727, 31-6024; 13756, PTPRB, 69278, 171728, 46-6693; 13756, PTPRB, 69280, 171730, 30-5753; 13756, PTPRB, 69283, 171733, 30-5753; 13757, PTPRC, 69286, 171736, 87-3524; 13757, PTPRC, 69287, 171737, 85-195; 13757, PTPRC, 69288, 171738, 87-2291; 13757, PTPRC, 69289, 171739, 72-517; 13757, PTPRC, 69290, 171740, 108-462; 13757, PTPRC, 69291, 171741, 85-348; 13757, PTPRC, 69292, 171742, 142-4062; 13757, PTPRC, 69293, 171743, 163-1962; 13757, PTPRC, 69294, 171744, 91-195; 13757, PTPRC, 69296, 171746, 91-348; 13757, PTPRC, 69297, 171747, 93-1608; 13757, PTPRC, 69298, 171748, 78-517; 13757, PTPRC, 69300, 171750, 169-1540; 13757, PTPRC, 69301, 171751, 114-462; 13757, PTPRC, 69302, 171752, 78-2336; 13757, PTPRC, 69303, 171753, 84-1653; 13757, PTPRC, 69304, 171754, 1-275; 13757, PTPRC, 69295, 171745, 148-1861; 13757, PTPRC, 69299, 171749, 93-1323; 13758, PTPRCAP, 69305, 171755, 449-1069; 13759, PTPRD, 69311, 171761, 104-4621; 13759, PTPRD, 69313, 171763, 816-1424; 13759, PTPRD, 69314, 171764, 243-521; 13759, PTPRD, 69316, 171766, 107-4597; 13759, PTPRD, 69306, 171756, 104-4624; 13759, PTPRD, 69307, 171757, 107-5845; 13759, PTPRD, 69308, 171758, 545-6283; 13759, PTPRD, 69309, 171759, 52-4569; 13759, PTPRD, 69310, 171760, 107-4615; 13759, PTPRD, 69312, 171762, 52-4569; 13759, PTPRD, 69315, 171765, 107-5845; 13760, PTPRE, 69319, 171769, 360-779; 13760, PTPRE, 69320, 171770, 1844-2304; 13760, PTPRE, 69321, 171771, 19-1629; 13760, PTPRE, 69322, 171772, 60-509; 13760, PTPRE, 69323, 171773, 1-324; 13760, PTPRE, 69324, 171774, 21-377; 13760, PTPRE, 69317, 171767, 280-2382; 13760, PTPRE, 69318, 171768, 80-2008; 13761, PTPRF, 69326, 171776, 1-2940; 13761, PTPRF, 69327, 171777, 1-3874; 13761, PTPRF, 69329, 171779, 1-4661; 13761, PTPRF, 69330, 171780, 1-788; 13761, PTPRF, 69331, 171781, 1-3997; 13761, PTPRF, 69332, 171782, 341-1129; 13761, PTPRF, 69325, 171775, 341-6064; 13761, PTPRF, 69328, 171778, 327-6023; 13762, PPFIA1, 69335, 171785, 267-563; 13762, PPFIA1, 69336, 171786, 101-575; 13762, PPFIA1, 69337, 171787, 1-100; 13762, PPFIA1, 69338, 171788, 1-710; 13762, PPFIA1, 69339, 171789, 143-1894; 13762, PPFIA1, 69340, 171790, 1-1168; 13762, PPFIA1, 69341, 171791, 1-296; 13762, PPFIA1, 69342, 171792, 1-1163; 13762, PPFIA1, 69343, 171793, 1-141; 13762, PPFIA1, 69344, 171794, 1-292; 13762, PPFIA1, 69333, 171783, 216-3824; 13762, PPFIA1, 69334, 171784, 199-3756; 13763, PPFIA2, 69350, 171800, 1-852; 13763, PPFIA2, 69351, 171801, 1-563; 13763, PPFIA2, 69352, 171802, 236-3550; 13763, PPFIA2, 69353, 171803, 245-617; 13763, PPFIA2, 69355, 171805, 211-574; 13763, PPFIA2, 69356, 171806, 122-917; 13763, PPFIA2, 69358, 171808, 385-825; 13763, PPFIA2, 69359, 171809, 1-564; 13763, PPFIA2, 69360, 171810, 297-4040; 13763, PPFIA2, 69361, 171811, 94-339; 13763, PPFIA2, 69345, 171795, 340-3798; 13763, PPFIA2, 69346, 171796, 340-3810; 13763, PPFIA2, 69347, 171797, 309-3767; 13763, PPFIA2, 69348, 171798, 159-2510; 13763, PPFIA2, 69349, 171799, 1142-2473; 13763, PPFIA2, 69354, 171804, 251-3961; 13763, PPFIA2, 69357, 171807, 257-4012; 13763, PPFIA2, 69362, 171812, 274-3972; 13763, PPFIA2, 69363, 171813, 162-3935; 13764, PPFIA3, 69365, 171815, 1-834; 13764, PPFIA3, 69366, 171816, 1-732; 13764, PPFIA3, 69367, 171817, 75-2033; 13764, PPFIA3, 69368, 171818, 108-547; 13764, PPFIA3, 69364, 171814, 350-3934; 13764, PPFIA3, 69369, 171819, 1-3558; 13765, PPFIA4, 69372, 171822, 528-4088; 13765, PPFIA4, 69374, 171824, 1-2860; 13765, PPFIA4, 69376, 171826, 1-573; 13765, PPFIA4, 69370, 171820, 594-2699; 13765, PPFIA4, 69371, 171821, 1972-4050; 13765, PPFIA4, 69373, 171823, 442-3999; 13765, PPFIA4, 69375, 171825, 537-2615; 13766, PTPRG, 69379, 171829, 1-4065; 13766, PTPRG, 69380, 171830, 1-4152; 13766, PTPRG, 69377, 171827, 378-4628; 13766, PTPRG, 69378, 171828, 378-4715; 13767, PTPRH, 69381, 171831, 24-2837; 13767, PTPRH, 69382, 171832, 24-3371; 13768, PTPRJ, 69385, 171835, 187-546; 13768, PTPRJ, 69386, 171836, 187-626; 13768, PTPRJ, 69387, 171837, 356-4372; 13768, PTPRJ, 69388, 171838, 345-4373; 13768, PTPRJ, 69383, 171833, 353-4366; 13768, PTPRJ, 69384, 171834, 334-1953; 13769, PTPRK, 69389, 171839, 226-4644; 13769, PTPRK, 69390, 171840, 259-4635; 13769, PTPRK, 69394, 171844, 208-441; 13769, PTPRK, 69395, 171845, 1-1029; 13769, PTPRK, 69396, 171846, 1-782; 13769, PTPRK, 69397, 171847, 1-63; 13769, PTPRK, 69399, 171849, 1-612; 13769, PTPRK, 69400, 171850, 230-976; 13769, PTPRK, 69401, 171851, 242-361; 13769, PTPRK, 69403, 171853, 208-441; 13769, PTPRK, 69406, 171856, 1-941; 13769, PTPRK, 69407, 171857, 242-361; 13769, PTPRK, 69408, 171858, 1-63; 13769, PTPRK, 69410, 171860, 230-976; 13769, PTPRK, 69411, 171861, 226-4644; 13769, PTPRK, 69412, 171862, 259-4635; 13769, PTPRK, 69413, 171863, 1-612; 13769, PTPRK, 69414, 171864, 1-782; 13769, PTPRK, 69391, 171841, 226-4566; 13769, PTPRK, 69392, 171842, 1-4320; 13769, PTPRK, 69393, 171843, 317-4639; 13769, PTPRK, 69398, 171848, 119-4507; 13769, PTPRK, 69402, 171852, 119-4507; 13769, PTPRK, 69404, 171854, 317-4639; 13769, PTPRK, 69405, 171855, 226-4566; 13769, PTPRK, 69409, 171859, 1-4320; 13770, PTPRM, 69416, 171866, 426-4598; 13770, PTPRM, 69417, 171867, 3495-4334; 13770, PTPRM, 69418, 171868, 1-792; 13770, PTPRM, 69419, 171869, 1-713; 13770, PTPRM, 69421, 171871, 85-604; 13770, PTPRM, 69422, 171872, 1-624; 13770, PTPRM, 69415, 171865, 1038-5396; 13770, PTPRM, 69420, 171870, 1038-5435; 13771, PTPRN, 69425, 171875, 188-563; 13771, PTPRN, 69427, 171877, 233-606; 13771, PTPRN, 69428, 171878, 282-541; 13771, PTPRN, 69429, 171879, 1-413; 13771, PTPRN, 69430, 171880, 266-466; 13771, PTPRN, 69431, 171881, 82-579; 13771, PTPRN, 69432, 171882, 50-208; 13771, PTPRN, 69423, 171873, 242-3181; 13771, PTPRN, 69424, 171874, 167-3019; 13771, PTPRN, 69426, 171876, 259-2928; 13772, PTPRN2, 69436, 171886, 1-1374; 13772, PTPRN2, 69437, 171887, 120-3053; 13772, PTPRN2, 69438, 171888, 1-114; 13772, PTPRN2, 69439, 171889, 1-114; 13772, PTPRN2, 69440, 171890, 1-114; 13772, PTPRN2, 69433, 171883, 105-3065; 13772, PTPRN2, 69434, 171884, 43-3039; 13772, PTPRN2, 69435, 171885, 11-3058; 13773, PTPRO, 69448, 171898, 1-265; 13773, PTPRO, 69449, 171899, 1-351; 13773, PTPRO, 69441, 171891, 331-3981; 13773, PTPRO, 69442, 171892, 175-3741; 13773, PTPRO, 69443, 171893, 487-1704; 13773, PTPRO, 69444, 171894, 487-1704; 13773, PTPRO, 69445, 171895, 487-1620; 13773, PTPRO, 69446, 171896, 487-1620; 13773, PTPRO, 69447, 171897, 185-1978; 13774, PTPRQ, 69450, 171900, 1341-2336; 13774, PTPRQ, 69451, 171901, 640-1700; 13774, PTPRQ, 69452, 171902, 247-1097; 13774, PTPRQ, 69453, 171903, 1-439; 13774, PTPRQ, 69454, 171904, 179-7078; 13774, PTPRQ, 69455, 171905, 1-6999; 13775, PTPRR, 69461, 171911, 680-1105; 13775, PTPRR, 69462, 171912, 429-1024; 13775, PTPRR, 69456, 171906, 454-2427; 13775, PTPRR, 69457, 171907, 147-1784; 13775, PTPRR, 69458, 171908, 167-1522; 13775, PTPRR, 69459, 171909, 469-1707; 13775, PTPRR, 69460, 171910, 241-1479; 13776, PTPRS, 69463, 171913, 24-4529; 13776, PTPRS, 69465, 171915, 235-4752; 13776, PTPRS, 69467, 171917, 249-635; 13776, PTPRS, 69471, 171921, 152-388; 13776, PTPRS, 69472, 171922, 207-478; 13776, PTPRS, 69464, 171914, 235-5967; 13776, PTPRS, 69466, 171916, 235-6081; 13776, PTPRS, 69468, 171918, 24-5756; 13776, PTPRS, 69469, 171919, 24-4529; 13776, PTPRS, 69470, 171920, 101-5947; 13777, PTPRT, 69473, 171923, 1-4353; 13777, PTPRT, 69474, 171924, 1-4356; 13777, PTPRT, 69476, 171926, 110-4432; 13777, PTPRT, 69478, 171928, 237-4619; 13777, PTPRT, 69479, 171929, 238-4533; 13777, PTPRT, 69480, 171930, 1-940; 13777, PTPRT, 69481, 171931, 1-3180; 13777, PTPRT, 69482, 171932, 185-328; 13777, PTPRT, 69483, 171933, 1-3230; 13777, PTPRT, 69475, 171925, 1-4326; 13777, PTPRT, 69477, 171927, 185-4576; 13778, PTPRU, 69484, 171934, 130-4470; 13778, PTPRU, 69485, 171935, 130-4440; 13778, PTPRU, 69486, 171936, 97-4398; 13778, PTPRU, 69487, 171937, 7-4329; 13779, PTPRZ1, 69488, 171938, 412-7359; 13779, PTPRZ1, 69489, 171939, 140-4486; 13780, PROZ, 69490, 171940, 8-1276; 13780, PROZ, 69491, 171941, 8-1210; 13781, N/A, 69492, 171942, 29-412; 13781, N/A, 69493, 171943, 27-2018; 13782, N/A, 69494, 171944, 51-2135; 13783, PRTN3, 69496, 171946, 183-830; 13783, PRTN3, 69497, 171947, 183-830; 13783, PRTN3, 69495, 171945, 50-820; 13783, PRTN3, 69498, 171948, 50-820; 13784, N/A, 69499, 171949, 284-532; 13784, N/A, 69502, 171952, 246-797; 13784, N/A, 69505, 171955, 99-721; 13784, N/A, 69500, 171950, 228-1709; 13784, N/A, 69501, 171951, 196-1677; 13784, N/A, 69503, 171953, 106-1590; 13784, N/A, 69504, 171954, 177-1247; 13784, N/A, 69506, 171956, 177-1658; 13784, N/A, 69507, 171957, 243-1529; 13785, PRKRIR, 69509, 171959, 136-375; 13785, PRKRIR, 69508, 171958, 107-2392; 13786, PCMT1, 69510, 171960, 285-1142; 13786, PCMT1, 69512, 171962, 286-1146; 13786, PCMT1, 69513, 171963, 2-394; 13786, PCMT1, 69514, 171964, 285-659; 13786, PCMT1, 69515, 171965, 1-203; 13786, PCMT1, 69516, 171966, 261-548; 13786, PCMT1, 69517, 171967, 2-364; 13786, PCMT1, 69518, 171968, 285-1142; 13786, PCMT1, 69519, 171969, 34-786; 13786, PCMT1, 69511, 171961, 34-786; 13787, PCMTD1, 69522, 171972, 280-597; 13787, PCMTD1, 69523, 171973, 1-392; 13787, PCMTD1, 69524, 171974, 76-921; 13787, PCMTD1, 69520, 171970, 408-1481; 13787, PCMTD1, 69521, 171971, 203-1276; 13788, PCMTD2, 69525, 171975, 201-1049; 13788, PCMTD2, 69528, 171978, 1-551; 13788, PCMTD2, 69529, 171979, 194-476; 13788, PCMTD2, 69530, 171980, 136-541; 13788, PCMTD2, 69531, 171981, 1-214; 13788, PCMTD2, 69532, 171982, 168-572; 13788, PCMTD2, 69533, 171983, 147-782; 13788, PCMTD2, 69534, 171984, 292-1080; 13788, PCMTD2, 69535, 171985, 136-541; 13788, PCMTD2, 69537, 171987, 491-584; 13788, PCMTD2, 69538, 171988, 168-572; 13788, PCMTD2, 69540, 171990, 194-476; 13788, PCMTD2, 69541, 171991, 147-782; 13788, PCMTD2, 69526, 171976, 128-1213; 13788, PCMTD2, 69527, 171977, 155-1159; 13788, PCMTD2, 69536, 171986, 155-1159; 13788, PCMTD2, 69539, 171989, 128-1213; 13789, N/A, 69543, 171993, 1-2490; 13789, N/A, 69542, 171992, 1-1086; 13790, POMK, 69545, 171995, 163-564; 13790, POMK, 69544, 171994, 256-1308; 13790, POMK, 69546, 171996, 172-1224; 13791, POMT1, 69548, 171998, 1-1041; 13791, POMT1, 69552, 172002, 386-812; 13791, POMT1, 69553, 172003, 279-1168; 13791, POMT1, 69554, 172004, 188-691; 13791, POMT1, 69555, 172005, 137-791; 13791, POMT1, 69557, 172007, 378-847; 13791, POMT1, 69547, 171997, 197-2212; 13791, POMT1, 69549, 171999, 180-2423; 13791, POMT1, 69550, 172000, 295-2121; 13791, POMT1, 69551, 172001, 161-2338; 13791, POMT1, 69556, 172006, 443-2620; 13792, POMT2, 69560, 172010, 1-159; 13792, POMT2, 69561, 172011, 1-580; 13792, POMT2, 69562, 172012, 1-228; 13792, POMT2, 69563, 172013, 1-308; 13792, POMT2, 69564, 172014, 155-565; 13792, POMT2, 69565, 172015, 1-658; 13792, POMT2, 69558, 172008, 204-2456; 13792, POMT2, 69559, 172009, 180-428; 13793, PRG2, 69566, 172016, 75-743; 13793, PRG2, 69567, 172017, 167-835; 13793, PRG2, 69568, 172018, 55-690; 13794, PRG3, 69569, 172019, 111-788; 13795, PRG4, 69570, 172020, 46-2606; 13795, PRG4, 69574, 172024, 46-531; 13795, PRG4, 69575, 172025, 46-4131; 13795, PRG4, 69571, 172021, 46-4137; 13795, PRG4, 69572, 172022, 46-3981; 13795, PRG4, 69573, 172023, 46-4260; 13796, PLP1, 69576, 172026, 274-608; 13796, PLP1, 69577, 172027, 286-587; 13796, PLP1, 69578, 172028, 419-786; 13796, PLP1, 69579, 172029, 172-580; 13796, PLP1, 69580, 172030, 207-588; 13796, PLP1, 69582, 172032, 215-624; 13796, PLP1, 69581, 172031, 147-875; 13796, PLP1, 69583, 172033, 281-1114; 13796, PLP1, 69584, 172034, 147-980; 13797, PLP2, 69585, 172035, 76-513; 13797, PLP2, 69586, 172036, 76-534; 13798, PTMA, 69588, 172038, 172-495; 13798, PTMA, 69589, 172039, 83-478; 13798, PTMA, 69591, 172041, 399-809; 13798, PTMA, 69592, 172042, 1-222; 13798, PTMA, 69593, 172043, 137-268; 13798, PTMA, 69594, 172044, 1-446; 13798, PTMA, 69595, 172045, 1-408; 13798, PTMA, 69587, 172037, 192-527; 13798, PTMA, 69590, 172040, 199-531; 13799, PCDH1, 69598, 172048, 1-380; 13799, PCDH1, 69599, 172049, 102-553; 13799, PCDH1, 69600, 172050, 1-52; 13799, PCDH1, 69601, 172051, 148-1296; 13799, PCDH1, 69596, 172046, 149-3862; 13799, PCDH1, 69597, 172047, 149-3331; 13800, PCDH10, 69602, 172052, 827-3949; 13800, PCDH10, 69603, 172053, 827-3517; 13801, PCDH11X, 69608, 172058, 590-3637; 13801, PCDH11X, 69604, 172054, 1-3990; 13801, PCDH11X, 69605, 172055, 1-3933; 13801, PCDH11X, 69606, 172056, 846-4889; 13801, PCDH11X, 69607, 172057, 846-4859; 13801, PCDH11X, 69609, 172059, 1-4020; 13801, PCDH11X, 69610, 172060, 1-3198; 13802, PCDH11Y, 69615, 172065, 305-536; 13802, PCDH11Y, 69611, 172061, 737-3898; 13802, PCDH11Y, 69612, 172062, 514-3627; 13802, PCDH11Y, 69613, 172063, 735-3881; 13802, PCDH11Y, 69614, 172064, 735-4757; 13802, PCDH11Y, 69616, 172066, 613-3726; 13803, PCDH12, 69618, 172068, 502-572; 13803, PCDH12, 69617, 172067, 1212-4766; 13804, PCDH17, 69621, 172071, 1-1640; 13804, PCDH17, 69622, 172072, 1-552; 13804, PCDH17, 69619, 172069, 736-4215; 13804, PCDH17, 69620, 172070, 738-3407; 13805, PCDH18, 69625, 172075, 252-1292; 13805, PCDH18, 69626, 172076, 193-1140; 13805, PCDH18, 69627, 172077, 555-3299; 13805, PCDH18, 69628, 172078, 211-501; 13805, PCDH18, 69623, 172073, 388-3795; 13805, PCDH18, 69624, 172074, 372-3776; 13806, PCDH19, 69632, 172082, 1-24; 13806, PCDH19, 69629, 172079, 1-3306; 13806, PCDH19, 69630, 172080, 1677-5123; 13806, PCDH19, 69631, 172081, 1-3303; 13807, PCDH20, 69633, 172083, 365-3220; 13808, PCDH7, 69635, 172085, 1-2813; 13808, PCDH7, 69637, 172087, 1-376; 13808, PCDH7, 69638, 172088, 1-1753; 13808, PCDH7, 69634, 172084, 1009-4218; 13808, PCDH7, 69636, 172086, 571-3789; 13809, PCDH8, 69639, 172089, 206-3127; 13809, PCDH8, 69640, 172090, 205-3417; 13810, PCDH9, 69641, 172091, 802-3900; 13810, PCDH9, 69643, 172093, 175-3762; 13810, PCDH9, 69645, 172095, 1-135; 13810, PCDH9, 69642, 172092, 175-3888; 13810, PCDH9, 69644, 172094, 802-4413; 13811, PCDHA1, 69646, 172096, 156-2579; 13811, PCDHA1, 69647, 172097, 1-2061; 13811, PCDHA1, 69648, 172098, 1-2853; 13812, PCDHA10, 69649, 172099, 1-2847; 13812, PCDHA10, 69650, 172100, 40-2097; 13812, PCDHA10, 69651, 172101, 167-2701; 13813, PCDHA11, 69653, 172103, 1-598; 13813, PCDHA11, 69652, 172102, 859-3708; 13813, PCDHA11, 69654, 172104, 922-3354; 13814, PCDHA12, 69655, 172105, 1-2826; 13814, PCDHA12, 69656, 172106, 172-2550; 13815, PCDHA13, 69658, 172108, 62-2776; 13815, PCDHA13, 69657, 172107, 1-2853; 13815, PCDHA13, 69659, 172109, 1-2424; 13816, PCDHA2, 69660, 172110, 114-2588; 13816, PCDHA2, 69661, 172111, 107-2533; 13816, PCDHA2, 69662, 172112, 1-2847; 13817, PCDHA3, 69663, 172113, 1-2853; 13817, PCDHA3, 69664, 172114, 171-2645; 13818, PCDHA4, 69665, 172115, 1-2328; 13818, PCDHA4, 69666, 172116, 115-2820; 13818, PCDHA4, 69667, 172117, 1-2844; 13818, PCDHA4, 69668, 172118, 152-2548; 13819, PCDHA5, 69669, 172119, 140-2812; 13819, PCDHA5, 69670, 172120, 1-2811; 13819, PCDHA5, 69671, 172121, 173-2623; 13820, PCDHA6, 69672, 172122, 135-2546; 13820, PCDHA6, 69673, 172123, 115-2967; 13820, PCDHA6, 69674, 172124, 28-2088; 13821, PCDHA7, 69675, 172125, 137-2506; 13821, PCDHA7, 69676, 172126, 1-2814; 13822, PCDHA8, 69677, 172127, 136-2580; 13822, PCDHA8, 69678, 172128, 1-2853; 13823, PCDHA9, 69679, 172129, 725-3253; 13823, PCDHA9, 69680, 172130, 1034-3886; 13824, PCDHAC1, 69681, 172131, 1-2892; 13824, PCDHAC1, 69682, 172132, 525-2981; 13825, PCDHAC2, 69683, 172133, 533-3556; 13825, PCDHAC2, 69684, 172134, 298-2952; 13826, PCDHB1, 69685, 172135, 337-2793; 13827, PCDHB10, 69687, 172137, 1-2397; 13827, PCDHB10, 69686, 172136, 201-2603; 13828, PCDHB11, 69688, 172138, 194-2587; 13828, PCDHB11, 69689, 172139, 564-1862; 13829, PCDHB12, 69692, 172142, 190-393; 13829, PCDHB12, 69690, 172140, 190-2577; 13829, PCDHB12, 69691, 172141, 345-1721; 13830, PCDHB13, 69693, 172143, 206-2602; 13831, PCDHB14, 69694, 172144, 575-2971; 13831, PCDHB14, 69695, 172145, 239-2176; 13832, PCDHB15, 69697, 172147, 185-572; 13832, PCDHB15, 69696, 172146, 231-2594; 13833, PCDHB16, 69699, 172149, 229-894; 13833, PCDHB16, 69698, 172148, 1162-3492; 13834, PCDHB2, 69701, 172151, 186-305; 13834, PCDHB2, 69702, 172152, 170-322; 13834, PCDHB2, 69703, 172153, 165-275; 13834, PCDHB2, 69704, 172154, 1-162; 13834, PCDHB2, 69700, 172150, 214-2610; 13835, PCDHB3, 69706, 172156, 1-162; 13835, PCDHB3, 69705, 172155, 178-2568; 13836, PCDHB4, 69707, 172157, 201-2588; 13837, PCDHB5, 69709, 172159, 127-869; 13837, PCDHB5, 69708, 172158, 218-2605; 13838, PCDHB6, 69711, 172161, 360-2336; 13838, PCDHB6, 69710, 172160, 237-2621; 13839, PCDHB7, 69712, 172162, 218-2599; 13840, PCDHB8, 69713, 172163, 246-2651; 13841, PCDHB9, 69715, 172165, 397-616; 13841, PCDHB9, 69714, 172164, 193-2586; 13842, PCDHGA1, 69716, 172166, 115-2586; 13842, PCDHGA1, 69717, 172167, 1-2796; 13843, PCDHGA10, 69718, 172168, 1-2811; 13843, PCDHGA10, 69719, 172169, 190-2742; 13844, PCDHGA11, 69720, 172170, 34-2841; 13844, PCDHGA11, 69721, 172171, 1-2253; 13844, PCDHGA11, 69722, 172172, 182-2695; 13845, PCDHGA12, 69723, 172173, 143-2941; 13845, PCDHGA12, 69724, 172174, 172-2634; 13846, PCDHGA2, 69725, 172175, 1-2799; 13846, PCDHGA2, 69726, 172176, 213-2684; 13847, PCDHGA3, 69729, 172179, 1-324; 13847, PCDHGA3, 69727, 172177, 167-2965; 13847, PCDHGA3, 69728, 172178, 206-2695; 13848, PCDHGA4, 69730, 172180, 84-2972; 13848, PCDHGA4, 69731, 172181, 69-2624; 13849, PCDHGA5, 69732, 172182, 1-2796; 13849, PCDHGA5, 69733, 172183, 100-2541; 13850, PCDHGA6, 69734, 172184, 171-2969; 13850, PCDHGA6, 69735, 172185, 92-2548; 13851, PCDHGA7, 69736, 172186, 1-2799; 13851, PCDHGA7, 69737, 172187, 162-2615; 13852, PCDHGA8, 69738, 172188, 1-2799; 13852, PCDHGA8, 69739, 172189, 2658-5120; 13853, PCDHGA9, 69740, 172190, 1-2799; 13853, PCDHGA9, 69741, 172191, 22-2508; 13854, PCDHGB1, 69742, 172192, 1-2784; 13854, PCDHGB1, 69743, 172193, 160-2592; 13855, PCDHGB2, 69744, 172194, 1-2796; 13855, PCDHGB2, 69745, 172195, 95-2530; 13856, PCDHGB3, 69747, 172197, 1-2445; 13856, PCDHGB3, 69746, 172196, 132-2921; 13857, PCDHGB4, 69748, 172198, 1-2772; 13857, PCDHGB4, 69749, 172199, 188-2599; 13858, PCDHGB5, 69750, 172200, 1-2772; 13858, PCDHGB5, 69751, 172201, 142-2598; 13859, PCDHGB6, 69752, 172202, 1-2793; 13859, PCDHGB6, 69753, 172203, 183-2645; 13860, PCDHGB7, 69754, 172204, 170-2959; 13860, PCDHGB7, 69755, 172205, 216-2642; 13861, PCDHGC3, 69758, 172208, 117-674; 13861, PCDHGC3, 69759, 172209, 138-542; 13861, PCDHGC3, 69760, 172210, 119-845; 13861, PCDHGC3, 69756, 172206, 115-2919; 13861, PCDHGC3, 69757, 172207, 171-2762; 13862, PCDHGC4, 69762, 172212, 333-581; 13862, PCDHGC4, 69763, 172213, 103-489; 13862, PCDHGC4, 69761, 172211, 1-2817; 13862, PCDHGC4, 69764, 172214, 178-2793; 13863, PCDHGC5, 69765, 172215, 121-2955; 13863, PCDHGC5, 69766, 172216, 75-2711; 13864, N/A, 69767, 172217, 2107-4962; 13865, PCDH15, 69769, 172219, 396-6269; 13865, PCDH15, 69771, 172221, 396-2360; 13865, PCDH15, 69772, 172222, 396-6284; 13865, PCDH15, 69773, 172223, 396-5429; 13865, PCDH15, 69774, 172224, 396-6254; 13865, PCDH15, 69775, 172225, 396-6143; 13865, PCDH15, 69776, 172226, 396-6194; 13865, PCDH15, 69777, 172227, 396-5018; 13865, PCDH15, 69778, 172228, 396-2555; 13865, PCDH15, 69779, 172229, 396-2348; 13865, PCDH15, 69781, 172231, 396-3341; 13865, PCDH15, 69782, 172232, 577-4029; 13865, PCDH15, 69783, 172233, 172-448; 13865, PCDH15, 69784, 172234, 396-5426; 13865, PCDH15, 69785, 172235, 396-2360; 13865, PCDH15, 69786, 172236, 396-1385; 13865, PCDH15, 69787, 172237, 396-6056; 13865, PCDH15, 69788, 172238, 396-5015; 13865, PCDH15, 69789, 172239, 396-5441; 13865, PCDH15, 69790, 172240, 1-113; 13865, PCDH15, 69791, 172241, 392-1642; 13865, PCDH15, 69792, 172242, 363-580; 13865, PCDH15, 69793, 172243, 396-6062; 13865, PCDH15, 69794, 172244, 1-1383; 13865, PCDH15, 69795, 172245, 396-5768; 13865, PCDH15, 69796, 172246, 396-5765; 13865, PCDH15, 69798, 172248, 396-5444; 13865, PCDH15, 69799, 172249, 396-6290; 13865, PCDH15, 69768, 172218, 396-6263; 13865, PCDH15, 69770, 172220, 293-3178; 13865, PCDH15, 69780, 172230, 396-5747; 13865, PCDH15, 69797, 172247, 396-5423; 13866, PRTG, 69801, 172251, 510-576; 13866, PRTG, 69802, 172252, 1-657; 13866, PRTG, 69803, 172253, 160-573; 13866, PRTG, 69800, 172250, 49-3501; 13867, PPDX, 69806, 172256, 1-485; 13867, PPDX, 69807, 172257, 1-692; 13867, PPDX, 69808, 172258, 230-571; 13867, PPDX, 69809, 172259, 184-654; 13867, PPDX, 69810, 172260, 212-769; 13867, PPDX, 69804, 172254, 211-1644; 13867, PPDX, 69805, 172255, 267-1700; 13868, PRPF40B, 69813, 172263, 156-2834; 13868, PRPF40B, 69814, 172264, 1-414; 13868, PRPF40B, 69815, 172265, 514-531; 13868, PRPF40B, 69811, 172261, 552-3128; 13868, PRPF40B, 69812, 172262, 65-2680; 13869, PRPF40A, 69816, 172266, 1-328; 13869, PRPF40A, 69818, 172268, 1-490; 13869, PRPF40A, 69819, 172269, 1-1041; 13869, PRPF40A, 69820, 172270, 14-1358; 13869, PRPF40A, 69817, 172267, 543-3335; 13870, PRR5-ARHGAP8, 69821, 172271, 1-1932; 13870, PRR5-ARHGAP8, 69822, 172272, 243-1937; 13870, PRR5-ARHGAP8, 69823, 172273, 1-1514; 13871, PRUNE, 69829, 172279, 407-825; 13871, PRUNE, 69830, 172280, 310-845; 13871, PRUNE, 69824, 172274, 157-1518; 13871, PRUNE, 69825, 172275, 81-737; 13871, PRUNE, 69826, 172276, 253-759; 13871, PRUNE, 69827, 172277, 494-1309; 13871, PRUNE, 69828, 172278, 221-877; 13872, PRUNE2, 69831, 172281, 150-725; 13872, PRUNE2, 69832, 172282, 123-1019; 13872, PRUNE2, 69833, 172283, 53-1114; 13872, PRUNE2, 69835, 172285, 1-7153; 13872, PRUNE2, 69836, 172286, 1-783; 13872, PRUNE2, 69837, 172287, 79-9267; 13872, PRUNE2, 69838, 172288, 1156-9348; 13872, PRUNE2, 69834, 172284, 125-9391; 13873, PEAK1, 69841, 172291, 537-3686; 13873, PEAK1, 69842, 172292, 379-558; 13873, PEAK1, 69843, 172293, 355-2323; 13873, PEAK1, 69839, 172289, 280-5520; 13873, PEAK1, 69840, 172290, 477-5717; 13874, PUDP, 69847, 172297, 13-586; 13874, PUDP, 69844, 172294, 78-764; 13874, PUDP, 69845, 172295, 46-801; 13874, PUDP, 69846, 172296, 41-598; 13874, PUDP, 69848, 172298, 78-704; 13875, PUS1, 69849, 172299, 55-1206; 13875, PUS1, 69852, 172302, 109-577; 13875, PUS1, 69853, 172303, 754-1878; 13875, PUS1, 69854, 172304, 43-642; 13875, PUS1, 69855, 172305, 172-631; 13875, PUS1, 69856, 172306, 163-567; 13875, PUS1, 69857, 172307, 135-687; 13875, PUS1, 69850, 172300, 501-1784; 13875, PUS1, 69851, 172301, 192-1391; 13876, PUS10, 69859, 172309, 61-249; 13876, PUS10, 69861, 172311, 211-571; 13876, PUS10, 69862, 172312, 65-253; 13876, PUS10, 69858, 172308, 263-1852; 13876, PUS10, 69860, 172310, 61-1650; 13877, PUS3, 69864, 172314, 99-605; 13877, PUS3, 69866, 172316, 265-579; 13877, PUS3, 69867, 172317, 299-1120; 13877, PUS3, 69863, 172313, 99-1544; 13877, PUS3, 69865, 172315, 47-1492; 13878, PUS7, 69870, 172320, 1-395; 13878, PUS7, 69871, 172321, 249-1595; 13878, PUS7, 69868, 172318, 216-2201; 13878, PUS7, 69869, 172319, 240-2225; 13879, PUS7L, 69875, 172325, 55-1149; 13879, PUS7L, 69877, 172327, 196-677; 13879, PUS7L, 69878, 172328, 406-784; 13879, PUS7L, 69879, 172329, 105-566; 13879, PUS7L, 69872, 172322, 105-2210; 13879, PUS7L, 69873, 172323, 94-1260; 13879, PUS7L, 69874, 172324, 490-2595; 13879, PUS7L, 69876, 172326, 90-2195; 13880, PUSL1, 69881, 172331, 501-877; 13880, PUSL1, 69880, 172330, 78-989; 13881, PSMC3IP, 69884, 172334, 110-367; 13881, PSMC3IP, 69885, 172335, 3-257; 13881, PSMC3IP, 69887, 172337, 110-460; 13881, PSMC3IP, 69888, 172338, 292-756; 13881, PSMC3IP, 69882, 172332, 146-763; 13881, PSMC3IP, 69883, 172333, 110-763; 13881, PSMC3IP, 69886, 172336, 380-658; 13882, PSORS1C1, 69890, 172340, 290-481; 13882, PSORS1C1, 69895, 172345, 126-395; 13882, PSORS1C1, 69896, 172346, 236-550; 13882, PSORS1C1, 69889, 172339, 290-748; 13882, PSORS1C1, 69891, 172341, 290-748; 13882, PSORS1C1, 69892, 172342, 290-748; 13882, PSORS1C1, 69893, 172343, 290-748; 13882, PSORS1C1, 69894, 172344, 290-748; 13883, PSORS1C2, 69897, 172347, 325-735; 13883, PSORS1C2, 69898, 172348, 325-735; 13883, PSORS1C2, 69899, 172349, 325-735; 13883, PSORS1C2, 69900, 172350, 325-735; 13883, PSORS1C2, 69901, 172351, 325-735; 13883, PSORS1C2, 69902, 172352, 325-735; 13884, PPTC7, 69903, 172353, 290-1204; 13885, PINK1, 69904, 172354, 95-1840; 13886, PCBD1, 69905, 172355, 252-566; 13887, PCBD2, 69908, 172358, 1-360; 13887, PCBD2, 69906, 172356, 235-627; 13887, PCBD2, 69907, 172357, 21-413; 13888, PTGES3L-AARSD1, 69910, 172360, 136-1623; 13888, PTGES3L-AARSD1, 69912, 172362, 1-566; 13888, PTGES3L-AARSD1, 69913, 172363, 1-160; 13888, PTGES3L-AARSD1, 69914, 172364, 198-594; 13888, PTGES3L-AARSD1, 69909, 172359, 146-1723; 13888, PTGES3L-AARSD1, 69911, 172361, 219-1979; 13888, PTGES3L-AARSD1, 69915, 172365, 347-2107; 13889, PRY, 69916, 172366, 228-671; 13889, PRY, 69917, 172367, 228-443; 13890, PRY2, 69918, 172368, 228-671; 13890, PRY2, 69919, 172369, 228-443; 13891, N/A, 69920, 172370, 52-4569; 13891, N/A, 69921, 172371, 104-4624; 13891, N/A, 69922, 172372, 243-521; 13891, N/A, 69923, 172373, 545-6283; 13891, N/A, 69924, 172374, 107-4615; 13891, N/A, 69925, 172375, 104-4621; 13891, N/A, 69926, 172376, 107-5845; 13891, N/A, 69927, 172377, 107-4597; 13891, N/A, 69928, 172378, 107-5845; 13891, N/A, 69929, 172379, 52-4569; 13891, N/A, 69930, 172380, 816-1424; 13892, PPFIBP1, 69933, 172383, 301-559; 13892, PPFIBP1, 69934, 172384, 332-661; 13892, PPFIBP1, 69935, 172385, 1-728; 13892, PPFIBP1, 69936, 172386, 555-609; 13892, PPFIBP1, 69937, 172387, 1-616; 13892, PPFIBP1, 69940, 172390, 414-2645; 13892, PPFIBP1, 69941, 172391, 129-585; 13892, PPFIBP1, 69943, 172393, 348-1191; 13892, PPFIBP1, 69944, 172394, 1-261; 13892, PPFIBP1, 69931, 172381, 234-3251; 13892, PPFIBP1, 69932, 172382, 284-3319; 13892, PPFIBP1, 69938, 172388, 266-3208; 13892, PPFIBP1, 69939, 172389, 270-782; 13892, PPFIBP1, 69942, 172392, 462-3038; 13893, PPFIBP2, 69946, 172396, 547-814; 13893, PPFIBP2, 69947, 172397, 325-534; 13893, PPFIBP2, 69948, 172398, 1-673; 13893, PPFIBP2, 69949, 172399, 318-577; 13893, PPFIBP2, 69950, 172400, 1-407; 13893, PPFIBP2, 69951, 172401, 217-484; 13893, PPFIBP2, 69952, 172402, 114-625; 13893, PPFIBP2, 69954, 172404, 314-780; 13893, PPFIBP2, 69955, 172405, 1-448; 13893, PPFIBP2, 69956, 172406, 305-2461; 13893, PPFIBP2, 69957, 172407, 1-545; 13893, PPFIBP2, 69945, 172395, 389-3019; 13893, PPFIBP2, 69953, 172403, 153-2447; 13893, PPFIBP2, 69958, 172408, 222-2423; 13894, PUM1, 69960, 172410, 207-3881; 13894, PUM1, 69962, 172412, 101-3670; 13894, PUM1, 69964, 172414, 92-2926; 13894, PUM1, 69966, 172416, 1-683; 13894, PUM1, 69967, 172417, 262-549; 13894, PUM1, 69968, 172418, 1-273; 13894, PUM1, 69969, 172419, 92-376; 13894, PUM1, 69970, 172420, 1-650; 13894, PUM1, 69971, 172421, 1-2701; 13894, PUM1, 69972, 172422, 1-231; 13894, PUM1, 69973, 172423, 1-793; 13894, PUM1, 69974, 172424, 1-3376; 13894, PUM1, 69975, 172425, 73-357; 13894, PUM1, 69976, 172426, 80-454; 13894, PUM1, 69959, 172409, 95-3655; 13894, PUM1, 69961, 172411, 1-3384; 13894, PUM1, 69963, 172413, 92-3658; 13894, PUM1, 69965, 172415, 81-3569; 13895, PUM2, 69977, 172427, 320-3109; 13895, PUM2, 69981, 172431, 76-955; 13895, PUM2, 69982, 172432, 443-546; 13895, PUM2, 69983, 172433, 44-166; 13895, PUM2, 69984, 172434, 88-195; 13895, PUM2, 69985, 172435, 1-2631; 13895, PUM2, 69986, 172436, 116-223; 13895, PUM2, 69978, 172428, 24-3218; 13895, PUM2, 69979, 172429, 332-3358; 13895, PUM2, 69980, 172430, 125-3319; 13896, PUM3, 69988, 172438, 1-150; 13896, PUM3, 69987, 172437, 208-2154; 13897, PNP, 69990, 172440, 277-557; 13897, PNP, 69991, 172441, 371-554; 13897, PNP, 69992, 172442, 108-770; 13897, PNP, 69989, 172439, 147-1016; 13898, P2RX1, 69994, 172444, 252-425; 13898, P2RX1, 69993, 172443, 276-1475; 13899, P2RX2, 70002, 172452, 1-1050; 13899, P2RX2, 69995, 172445, 1-1200; 13899, P2RX2, 69996, 172446, 1-1494; 13899, P2RX2, 69997, 172447, 1-1344; 13899, P2RX2, 69998, 172448, 1-1140; 13899, P2RX2, 69999, 172449, 1-1215; 13899, P2RX2, 70000, 172450, 38-1453; 13899, P2RX2, 70001, 172451, 1-1113; 13900, P2RX3, 70004, 172454, 1-153; 13900, P2RX3, 70005, 172455, 77-1267; 13900, P2RX3, 70003, 172453, 35-1228; 13901, P2RX4, 70008, 172458, 1-371; 13901, P2RX4, 70009, 172459, 305-1330; 13901, P2RX4, 70011, 172461, 37-195; 13901, P2RX4, 70012, 172462, 15-451; 13901, P2RX4, 70013, 172463, 37-483; 13901, P2RX4, 70006, 172456, 309-1475; 13901, P2RX4, 70007, 172457, 101-1315; 13901, P2RX4, 70010, 172460, 1-1084; 13902, P2RX5, 70017, 172467, 1-89; 13902, P2RX5, 70019, 172469, 1-858; 13902, P2RX5, 70020, 172470, 180-1268; 13902, P2RX5, 70021, 172471, 92-1387; 13902, P2RX5, 70014, 172464, 400-1668; 13902, P2RX5, 70015, 172465, 212-1408; 13902, P2RX5, 70016, 172466, 29-1222; 13902, P2RX5, 70018, 172468, 92-1357; 13903, P2RX6, 70023, 172473, 1-361; 13903, P2RX6, 70024, 172474, 23-265; 13903, P2RX6, 70025, 172475, 1-393; 13903, P2RX6, 70026, 172476, 1-306; 13903, P2RX6, 70022, 172472, 6-1253; 13903, P2RX6, 70027, 172477, 149-1474; 13904, P2RX7, 70028, 172478, 42-491; 13904, P2RX7, 70031, 172481, 153-296; 13904, P2RX7, 70032, 172482, 1-384; 13904, P2RX7, 70033, 172483, 120-263; 13904, P2RX7, 70037, 172487, 1-777; 13904, P2RX7, 70038, 172488, 1-384; 13904, P2RX7, 70039, 172489, 43-186; 13904, P2RX7, 70029, 172479, 144-1931; 13904, P2RX7, 70030, 172480, 1-387; 13904, P2RX7, 70034, 172484, 1-387; 13904, P2RX7, 70035, 172485, 1-828; 13904, P2RX7, 70036, 172486, 1-1095; 13905, P2RY1, 70040, 172490, 1091-2212; 13906, P2RY10, 70041, 172491, 281-1300; 13906, P2RY10, 70042, 172492, 178-1197; 13907, P2RY11, 70043, 172493, 185-1309; 13908, P2RY12, 70044, 172494, 301-1329; 13909, P2RY13, 70045, 172495, 21-1085; 13910, P2RY14, 70048, 172498, 268-554; 13910, P2RY14, 70046, 172496, 314-1330; 13910, P2RY14, 70047, 172497, 383-1399; 13911, P2RY2, 70049, 172499, 468-1601; 13911, P2RY2, 70050, 172500, 400-1533; 13911, P2RY2, 70051, 172501, 335-1468; 13912, P2RY8, 70052, 172502, 212-1291; 13913, PURA, 70053, 172503, 60-1028; 13914, PURB, 70054, 172504, 14-952; 13915, PURG, 70057, 172507, 124-614; 13915, PURG, 70055, 172505, 934-1902; 13915, PURG, 70056, 172506, 934-1977; 13916, PCP2, 70058, 172508, 292-702; 13916, PCP2, 70059, 172509, 17-379; 13917, PCP4, 70061, 172511, 64-159; 13917, PCP4, 70060, 172510, 186-374; 13918, PCP4L1, 70062, 172512, 249-455; 13919, N/A, 70063, 172513, 302-1702; 13919, N/A, 70064, 172514, 14-1432; 13920, PHTF1, 70066, 172516, 347-2500; 13920, PHTF1, 70067, 172517, 446-2575; 13920, PHTF1, 70070, 172520, 456-770; 13920, PHTF1, 70071, 172521, 1-995; 13920, PHTF1, 70065, 172515, 600-2513; 13920, PHTF1, 70068, 172518, 485-2773; 13920, PHTF1, 70069, 172519, 453-2741; 13921, PHTF2, 70072, 172522, 77-2434; 13921, PHTF2, 70073, 172523, 107-2194; 13921, PHTF2, 70074, 172524, 203-2446; 13921, PHTF2, 70075, 172525, 127-1197; 13921, PHTF2, 70076, 172526, 216-2573; 13921, PHTF2, 70077, 172527, 203-2458; 13921, PHTF2, 70078, 172528, 195-1835; 13921, PHTF2, 70079, 172529, 120-1178; 13922, N/A, 70081, 172531, 33-1295; 13922, N/A, 70082, 172532, 1-207; 13922, N/A, 70083, 172533, 319-570; 13922, N/A, 70084, 172534, 63-212; 13922, N/A, 70085, 172535, 257-379; 13922, N/A, 70086, 172536, 55-807; 13922, N/A, 70080, 172530, 76-3492; 13923, N/A, 70088, 172538, 651-757; 13923, N/A, 70089, 172539, 1-921; 13923, N/A, 70090, 172540, 55-807; 13923, N/A, 70087, 172537, 1-1194; 13924, N/A, 70092, 172542, 188-2419; 13924, N/A, 70093, 172543, 287-924; 13924, N/A, 70094, 172544, 280-586; 13924, N/A, 70095, 172545, 290-720; 13924, N/A, 70096, 172546, 1-617; 13924, N/A, 70097, 172547, 82-566; 13924, N/A, 70098, 172548, 62-328; 13924, N/A, 70099, 172549, 213-470; 13924, N/A, 70100, 172550, 389-624; 13924, N/A, 70101, 172551, 247-563; 13924, N/A, 70103, 172553, 65-580; 13924, N/A, 70104, 172554, 382-813; 13924, N/A, 70091, 172541, 210-2534; 13924, N/A, 70102, 172552, 123-2447; 13925, N/A, 70106, 172556, 10-631; 13925, N/A, 70107, 172557, 196-600; 13925, N/A, 70108, 172558, 299-564; 13925, N/A, 70109, 172559, 441-588; 13925, N/A, 70110, 172560, 334-580; 13925, N/A, 70111, 172561, 1-426; 13925, N/A, 70105, 172555, 413-841; 13926, N/A, 70112, 172562, 1-1026; 13927, PWP1, 70114, 172564, 211-1530; 13927, PWP1, 70115, 172565, 275-569; 13927, PWP1, 70113, 172563, 169-1674; 13927, PWP1, 70116, 172566, 99-542; 13928, PWP2, 70118, 172568, 45-604; 13928, PWP2, 70117, 172567, 128-2887; 13929, PWWP2A, 70122, 172572, 1-106; 13929, PWWP2A, 70123, 172573, 1-210; 13929, PWWP2A, 70124, 172574, 1-150; 13929, PWWP2A, 70119, 172569, 36-2303; 13929, PWWP2A, 70120, 172570, 36-1718; 13929, PWWP2A, 70121, 172571, 35-1597; 13930, PWWP2B, 70125, 172575, 60-1832; 13930, PWWP2B, 70126, 172576, 60-1559; 13931, PXDC1, 70127, 172577, 1-539; 13931, PXDC1, 70128, 172578, 496-1191; 13932, PXK, 70129, 172579, 110-1783; 13932, PXK, 70131, 172581, 87-1583; 13932, PXK, 70133, 172583, 105-275; 13932, PXK, 70134, 172584, 92-1540; 13932, PXK, 70136, 172586, 1-938; 13932, PXK, 70137, 172587, 1-257; 13932, PXK, 70138, 172588, 245-583; 13932, PXK, 70139, 172589, 1-153; 13932, PXK, 70140, 172590, 42-1733; 13932, PXK, 70141, 172591, 3-428; 13932, PXK, 70142, 172592, 1-612; 13932, PXK, 70130, 172580, 110-1846; 13932, PXK, 70132, 172582, 100-1647; 13932, PXK, 70135, 172585, 79-1626; 13933, PYDC1, 70143, 172593, 332-601; 13934, PYCARD, 70146, 172596, 761-1137; 13934, PYCARD, 70144, 172594, 303-890; 13934, PYCARD, 70145, 172595, 67-597; 13935, PYGO1, 70147, 172597, 96-1355; 13935, PYGO1, 70148, 172598, 58-1317; 13936, PYGO2, 70149, 172599, 158-1267; 13936, PYGO2, 70150, 172600, 173-1393; 13937, PYM1, 70153, 172603, 191-424; 13937, PYM1, 70154, 172604, 13-150; 13937, PYM1, 70155, 172605, 1-113; 13937, PYM1, 70156, 172606, 222-356; 13937, PYM1, 70151, 172601, 4-615; 13937, PYM1, 70152, 172602, 153-767; 13938, PYROXD1, 70158, 172608, 87-254; 13938, PYROXD1, 70160, 172610, 27-446; 13938, PYROXD1, 70161, 172611, 117-536; 13938, PYROXD1, 70162, 172612, 1-182; 13938, PYROXD1, 70157, 172607, 55-1557; 13938, PYROXD1, 70159, 172609, 754-2043; 13939, PYROXD2, 70163, 172613, 50-1795; 13940, PDXK, 70165, 172615, 351-797; 13940, PDXK, 70166, 172616, 202-465; 13940, PDXK, 70168, 172618, 132-950; 13940, PDXK, 70169, 172619, 257-745; 13940, PDXK, 70164, 172614, 184-1122; 13940, PDXK, 70167, 172617, 199-1053; 13941, PDXP, 70171, 172621, 271-510; 13941, PDXP, 70170, 172620, 57-947; 13942, PDXDC1, 70172, 172622, 1-1113; 13942, PDXDC1, 70176, 172626, 189-1685; 13942, PDXDC1, 70177, 172627, 49-294; 13942, PDXDC1, 70178, 172628, 140-2560; 13942, PDXDC1, 70179, 172629, 167-980; 13942, PDXDC1, 70181, 172631, 112-306; 13942, PDXDC1, 70182, 172632, 1-554; 13942, PDXDC1, 70183, 172633, 211-283; 13942, PDXDC1, 70184, 172634, 196-556; 13942, PDXDC1, 70185, 172635, 1-1113; 13942, PDXDC1, 70190, 172640, 189-1685; 13942, PDXDC1, 70191, 172641, 865-1479; 13942, PDXDC1, 70192, 172642, 1-1113; 13942, PDXDC1, 70193, 172643, 189-1685; 13942, PDXDC1, 70194, 172644, 865-1479; 13942, PDXDC1, 70196, 172646, 140-2560; 13942, PDXDC1, 70198, 172648, 112-306; 13942, PDXDC1, 70199, 172649, 1-554; 13942, PDXDC1, 70200, 172650, 180-474; 13942, PDXDC1, 70173, 172623, 98-2464; 13942, PDXDC1, 70174, 172624, 30-2123; 13942, PDXDC1, 70175, 172625, 121-1410; 13942, PDXDC1, 70180, 172630, 78-2363; 13942, PDXDC1, 70186, 172636, 78-2363; 13942, PDXDC1, 70187, 172637, 121-1410; 13942, PDXDC1, 70188, 172638, 30-2123; 13942, PDXDC1, 70189, 172639, 121-1410; 13942, PDXDC1, 70195, 172645, 98-2464; 13942, PDXDC1, 70197, 172647, 72-2354; 13942, PDXDC1, 70201, 172651, 72-2354; 13943, PNPO, 70204, 172654, 59-268; 13943, PNPO, 70205, 172655, 106-324; 13943, PNPO, 70206, 172656, 200-560; 13943, PNPO, 70207, 172657, 106-246; 13943, PNPO, 70208, 172658, 52-261; 13943, PNPO, 70202, 172652, 106-891; 13943, PNPO, 70203, 172653, 106-762; 13944, P2RY4, 70209, 172659, 141-1238; 13945, P2RY6, 70214, 172664, 65-800; 13945, P2RY6, 70215, 172665, 357-741; 13945, P2RY6, 70216, 172666, 168-335; 13945, P2RY6, 70210, 172660, 414-1400; 13945, P2RY6, 70211, 172661, 300-1286; 13945, P2RY6, 70212, 172662, 543-1529; 13945, P2RY6, 70213, 172663, 232-1218; 13945, P2RY6, 70217, 172667, 1066-2052; 13945, P2RY6, 70218, 172668, 174-1160; 13945, P2RY6, 70219, 172669, 340-1326; 13945, P2RY6, 70220, 172670, 388-1374; 13945, P2RY6, 70221, 172671, 351-1337; 13946, PYHIN1, 70227, 172677, 320-771; 13946, PYHIN1, 70222, 172672, 230-967; 13946, PYHIN1, 70223, 172673, 239-1690; 13946, PYHIN1, 70224, 172674, 246-1724; 13946, PYHIN1, 70225, 172675, 238-1596; 13946, PYHIN1, 70226, 172676, 238-1623; 13947, PYDC2, 70228, 172678, 1-294; 13948, QRFP, 70229, 172679, 1-411; 13948, QRFP, 70230, 172680, 522-932; 13949, QRFPR, 70231, 172681, 33-809; 13949, QRFPR, 70233, 172683, 1-573; 13949, QRFPR, 70232, 172682, 413-1708; 13950, PGPEP1, 70236, 172686, 69-338; 13950, PGPEP1, 70237, 172687, 72-341; 13950, PGPEP1, 70238, 172688, 1-264; 13950, PGPEP1, 70239, 172689, 1-331; 13950, PGPEP1, 70240, 172690, 85-600; 13950, PGPEP1, 70241, 172691, 44-379; 13950, PGPEP1, 70242, 172692, 84-524; 13950, PGPEP1, 70234, 172684, 252-650; 13950, PGPEP1, 70235, 172685, 96-725; 13951, PGPEP1L, 70243, 172693, 207-797; 13951, PGPEP1L, 70244, 172694, 807-1235; 13952, PPA1, 70245, 172695, 11-547; 13952, PPA1, 70247, 172697, 108-644; 13952, PPA1, 70246, 172696, 101-970; 13952, PPA1, 70248, 172698, 18-185; 13953, PPA2, 70253, 172703, 10-596; 13953, PPA2, 70254, 172704, 1-129; 13953, PPA2, 70255, 172705, 10-351; 13953, PPA2, 70256, 172706, 10-582; 13953, PPA2, 70257, 172707, 58-249; 13953, PPA2, 70258, 172708, 1-677; 13953, PPA2, 70259, 172709, 10-177; 13953, PPA2, 70260, 172710, 451-714; 13953, PPA2, 70261, 172711, 1-208; 13953, PPA2, 70249, 172699, 15-932; 13953, PPA2, 70250, 172700, 1-507; 13953, PPA2, 70251, 172701, 32-1036; 13953, PPA2, 70252, 172702, 1-699; 13954, PYCR1, 70265, 172715, 115-981; 13954, PYCR1, 70266, 172716, 83-841; 13954, PYCR1, 70267, 172717, 354-681; 13954, PYCR1, 70268, 172718, 327-578; 13954, PYCR1, 70269, 172719, 95-377; 13954, PYCR1, 70270, 172720, 141-868; 13954, PYCR1, 70271, 172721, 1-522; 13954, PYCR1, 70272, 172722, 91-767; 13954, PYCR1, 70273, 172723, 56-709; 13954, PYCR1, 70274, 172724, 78-572; 13954, PYCR1, 70275, 172725, 114-510; 13954, PYCR1, 70276, 172726, 183-528; 13954, PYCR1, 70278, 172728, 115-768; 13954, PYCR1, 70262, 172712, 66-1025; 13954, PYCR1, 70263, 172713, 444-1394; 13954, PYCR1, 70264, 172714, 27-1067; 13954, PYCR1, 70277, 172727, 115-1074; 13955, PYCR2, 70280, 172730, 231-971; 13955, PYCR2, 70281, 172731, 162-422; 13955, PYCR2, 70282, 172732, 125-597; 13955, PYCR2, 70283, 172733, 1-960; 13955, PYCR2, 70279, 172729, 150-1112; 13956, PYCRL, 70284, 172734, 31-891; 13956, PYCRL, 70285, 172735, 419-832; 13956, PYCRL, 70286, 172736, 22-156; 13956, PYCRL, 70288, 172738, 403-579; 13956, PYCRL, 70290, 172740, 31-891; 13956, PYCRL, 70291, 172741, 419-832; 13956, PYCRL, 70293, 172743, 22-156; 13956, PYCRL, 70294, 172744, 403-579; 13956, PYCRL, 70287, 172737, 22-786; 13956, PYCRL, 70289, 172739, 27-851; 13956, PYCRL, 70292, 172742, 27-851; 13956, PYCRL, 70295, 172745, 22-786; 13957, PC, 70299, 172749, 215-1684; 13957, PC, 70300, 172750, 45-941; 13957, PC, 70301, 172751, 1-1470; 13957, PC, 70296, 172746, 82-3618; 13957, PC, 70297, 172747, 95-3631; 13957, PC, 70298, 172748, 283-3819; 13958, PDHA1, 70302, 172752, 89-699; 13958, PDHA1, 70303, 172753, 189-518; 13958, PDHA1, 70304, 172754, 71-613; 13958, PDHA1, 70307, 172757, 109-471; 13958, PDHA1, 70308, 172758, 117-731; 13958, PDHA1, 70305, 172755, 146-1432; 13958, PDHA1, 70306, 172756, 106-1278; 13958, PDHA1, 70309, 172759, 146-1339; 13958, PDHA1, 70310, 172760, 146-1225; 13959, PDHA2, 70311, 172761, 133-1299; 13960, PDHB, 70315, 172765, 6-1058; 13960, PDHB, 70316, 172766, 12-767; 13960, PDHB, 70312, 172762, 44-1123; 13960, PDHB, 70313, 172763, 49-1074; 13960, PDHB, 70314, 172764, 10-1035; 13961, PDHX, 70320, 172770, 131-584; 13961, PDHX, 70321, 172771, 16-561; 13961, PDHX, 70322, 172772, 1-569; 13961, PDHX, 70317, 172767, 85-1590; 13961, PDHX, 70318, 172768, 243-1703; 13961, PDHX, 70319, 172769, 25-849; 13962, PDK1, 70326, 172776, 96-558; 13962, PDK1, 70327, 172777, 13-699; 13962, PDK1, 70328, 172778, 380-842; 13962, PDK1, 70329, 172779, 126-314; 13962, PDK1, 70330, 172780, 50-544; 13962, PDK1, 70323, 172773, 183-1493; 13962, PDK1, 70324, 172774, 145-1515; 13962, PDK1, 70325, 172775, 101-1411; 13963, PDK2, 70333, 172783, 296-590; 13963, PDK2, 70334, 172784, 96-576; 13963, PDK2, 70335, 172785, 171-947; 13963, PDK2, 70336, 172786, 191-615; 13963, PDK2, 70337, 172787, 190-578; 13963, PDK2, 70331, 172781, 392-1423; 13963, PDK2, 70332, 172782, 162-1385; 13963, PDK2, 70338, 172788, 191-1222; 13964, PDK3, 70339, 172789, 236-1456; 13964, PDK3, 70340, 172790, 1-1248; 13965, PDK4, 70341, 172791, 199-1434; 13966, PDPR, 70343, 172793, 143-2482; 13966, PDPR, 70344, 172794, 363-1838; 13966, PDPR, 70345, 172795, 99-212; 13966, PDPR, 70346, 172796, 139-852; 13966, PDPR, 70347, 172797, 390-690; 13966, PDPR, 70348, 172798, 7-598; 13966, PDPR, 70350, 172800, 103-551; 13966, PDPR, 70342, 172792, 958-3597; 13966, PDPR, 70349, 172799, 163-2802; 13967, PDP1, 70354, 172804, 213-596; 13967, PDP1, 70355, 172805, 104-544; 13967, PDP1, 70356, 172806, 352-581; 13967, PDP1, 70358, 172808, 587-1284; 13967, PDP1, 70359, 172809, 126-341; 13967, PDP1, 70351, 172801, 270-1883; 13967, PDP1, 70352, 172802, 277-1965; 13967, PDP1, 70353, 172803, 226-1839; 13967, PDP1, 70357, 172807, 244-1857; 13968, PDP2, 70361, 172811, 122-848; 13968, PDP2, 70362, 172812, 281-362; 13968, PDP2, 70363, 172813, 134-598; 13968, PDP2, 70364, 172814, 106-560; 13968, PDP2, 70365, 172815, 265-574; 13968, PDP2, 70360, 172810, 335-1924; 13969, PKLR, 70368, 172818, 1-141; 13969, PKLR, 70369, 172819, 1-141; 13969, PKLR, 70366, 172816, 40-1764; 13969, PKLR, 70367, 172817, 115-1746; 13969, PKLR, 70370, 172820, 40-1764; 13969, PKLR, 70371, 172821, 115-1746; 13970, PKM, 70374, 172824, 285-1658; 13970, PKM, 70376, 172826, 303-457; 13970, PKM, 70377, 172827, 124-969; 13970, PKM, 70380, 172830, 206-415; 13970, PKM, 70381, 172831, 145-1245; 13970, PKM, 70383, 172833, 96-550; 13970, PKM, 70384, 172834, 50-554; 13970, PKM, 70385, 172835, 114-1568; 13970, PKM, 70386, 172836, 315-560; 13970, PKM, 70387, 172837, 96-582; 13970, PKM, 70372, 172822, 501-2096; 13970, PKM, 70373, 172823, 105-1700; 13970, PKM, 70375, 172825, 355-1905; 13970, PKM, 70378, 172828, 290-1885; 13970, PKM, 70379, 172829, 349-1944; 13970, PKM, 70382, 172832, 190-1785; 13971, QKI, 70395, 172845, 1-103; 13971, QKI, 70396, 172846, 87-597; 13971, QKI, 70397, 172847, 104-583; 13971, QKI, 70398, 172848, 47-172; 13971, QKI, 70399, 172849, 1-715; 13971, QKI, 70400, 172850, 1-556; 13971, QKI, 70401, 172851, 409-551; 13971, QKI, 70402, 172852, 196-495; 13971, QKI, 70388, 172838, 552-1529; 13971, QKI, 70389, 172839, 25-1026; 13971, QKI, 70390, 172840, 1195-2154; 13971, QKI, 70391, 172841, 552-1577; 13971, QKI, 70392, 172842, 552-1511; 13971, QKI, 70393, 172843, 1-954; 13971, QKI, 70394, 172844, 552-1511; 13972, QTRT1, 70405, 172855, 1-610; 13972, QTRT1, 70406, 172856, 1-411; 13972, QTRT1, 70407, 172857, 1-370; 13972, QTRT1, 70408, 172858, 1-539; 13972, QTRT1, 70403, 172853, 11-1222; 13972, QTRT1, 70404, 172854, 8-685; 13973, QTRTD1, 70411, 172861, 1-30; 13973, QTRTD1, 70413, 172863, 15-449; 13973, QTRTD1, 70415, 172865, 180-680; 13973, QTRTD1, 70409, 172859, 258-1505; 13973, QTRTD1, 70410, 172860, 243-1121; 13973, QTRTD1, 70412, 172862, 69-998; 13973, QTRTD1, 70414, 172864, 116-1399; 13974, QSOX1, 70418, 172868, 39-506; 13974, QSOX1, 70419, 172869, 1-218; 13974, QSOX1, 70416, 172866, 12-1826; 13974, QSOX1, 70417, 172867, 75-2318; 13975, QSOX2, 70421, 172871, 1-851; 13975, QSOX2, 70422, 172872, 39-2129; 13975, QSOX2, 70420, 172870, 39-2135; 13976, QDPR, 70425, 172875, 1-386; 13976, QDPR, 70426, 172876, 36-494; 13976, QDPR, 70427, 172877, 16-474; 13976, QDPR, 70428, 172878, 153-263; 13976, QDPR, 70429, 172879, 34-522; 13976, QDPR, 70423, 172873, 181-915; 13976, QDPR, 70424, 172874, 33-674; 13977, QPRT, 70431, 172881, 17-466; 13977, QPRT, 70430, 172880, 162-1055; 13978, R3HCC1, 70432, 172882, 269-1591; 13978, R3HCC1, 70434, 172884, 103-953; 13978, R3HCC1, 70435, 172885, 53-985; 13978, R3HCC1, 70436, 172886, 111-781; 13978, R3HCC1, 70437, 172887, 1-447; 13978, R3HCC1, 70438, 172888, 269-1465; 13978, R3HCC1, 70439, 172889, 143-271; 13978, R3HCC1, 70440, 172890, 269-874; 13978, R3HCC1, 70433, 172883, 1-1443; 13979, R3HCC1L, 70446, 172896, 223-2601; 13979, R3HCC1L, 70441, 172891, 304-2640; 13979, R3HCC1L, 70442, 172892, 126-2462; 13979, R3HCC1L, 70443, 172893, 300-2636; 13979, R3HCC1L, 70444, 172894, 196-750; 13979, R3HCC1L, 70445, 172895, 109-663; 13980, R3HDM1, 70451, 172901, 1-581; 13980, R3HDM1, 70452, 172902, 1-556; 13980, R3HDM1, 70453, 172903, 1-2470; 13980, R3HDM1, 70454, 172904, 433-582; 13980, R3HDM1, 70455, 172905, 1-851; 13980, R3HDM1, 70456, 172906, 1-670; 13980, R3HDM1, 70457, 172907, 405-601; 13980, R3HDM1, 70447, 172897, 371-3670; 13980, R3HDM1, 70448, 172898, 383-3298; 13980, R3HDM1, 70449, 172899, 332-3466; 13980, R3HDM1, 70450, 172900, 320-3622; 13980, R3HDM1, 70458, 172908, 434-3349; 13981, R3HDM2, 70461, 172911, 298-3330; 13981, R3HDM2, 70462, 172912, 392-3364; 13981, R3HDM2, 70463, 172913, 1-2226; 13981, R3HDM2, 70464, 172914, 107-195; 13981, R3HDM2, 70466, 172916, 1-840; 13981, R3HDM2, 70467, 172917, 195-3095; 13981, R3HDM2, 70459, 172909, 392-3322; 13981, R3HDM2, 70460, 172910, 36-2966; 13981, R3HDM2, 70465, 172915, 1053-3068; 13982, R3HDM4, 70469, 172919, 89-832; 13982, R3HDM4, 70470, 172920, 89-382; 13982, R3HDM4, 70471, 172921, 48-185; 13982, R3HDM4, 70472, 172922, 1-138; 13982, R3HDM4, 70468, 172918, 75-881; 13983, R3HDML, 70473, 172923, 173-934; 13984, RABAC1, 70475, 172925, 1-330; 13984, RABAC1, 70476, 172926, 388-663; 13984, RABAC1, 70477, 172927, 1-448; 13984, RABAC1, 70478, 172928, 8-463; 13984, RABAC1, 70474, 172924, 99-656; 13985, RABGGTA, 70481, 172931, 107-328; 13985, RABGGTA, 70482, 172932, 1-411; 13985, RABGGTA, 70483, 172933, 620-1150; 13985, RABGGTA, 70484, 172934, 118-1392; 13985, RABGGTA, 70485, 172935, 1-527; 13985, RABGGTA, 70486, 172936, 197-1471; 13985, RABGGTA, 70479, 172929, 308-2011; 13985, RABGGTA, 70480, 172930, 485-2188; 13986, RABGGTB, 70488, 172938, 42-500; 13986, RABGGTB, 70487, 172937, 72-1067; 13987, RABGAP1, 70490, 172940, 207-543; 13987, RABGAP1, 70492, 172942, 54-254; 13987, RABGAP1, 70493, 172943, 497-1546; 13987, RABGAP1, 70489, 172939, 135-3344; 13987, RABGAP1, 70491, 172941, 607-2406; 13988, RABGAP1L, 70500, 172950, 56-982; 13988, RABGAP1L, 70501, 172951, 102-1847; 13988, RABGAP1L, 70504, 172954, 190-483; 13988, RABGAP1L, 70506, 172956, 140-710; 13988, RABGAP1L, 70507, 172957, 389-722; 13988, RABGAP1L, 70508, 172958, 190-483; 13988, RABGAP1L, 70509, 172959, 1-264; 13988, RABGAP1L, 70510, 172960, 1-501; 13988, RABGAP1L, 70511, 172961, 111-848; 13988, RABGAP1L, 70512, 172962, 97-855; 13988, RABGAP1L, 70499, 172949, 180-941; 13988, RABGAP1L, 70494, 172944, 175-2622; 13988, RABGAP1L, 70495, 172945, 96-1232; 13988, RABGAP1L, 70496, 172946, 396-1472; 13988, RABGAP1L, 70497, 172947, 282-2099; 13988, RABGAP1L, 70498, 172948, 124-1257; 13988, RABGAP1L, 70502, 172952, 402-1514; 13988, RABGAP1L, 70503, 172953, 272-490; 13988, RABGAP1L, 70505, 172955, 153-371; 13989, RABGEF1, 70515, 172965, 1245-2144; 13989, RABGEF1, 70516, 172966, 168-1682; 13989, RABGEF1, 70517, 172967, 418-553; 13989, RABGEF1, 70519, 172969, 155-1378; 13989, RABGEF1, 70520, 172970, 968-1327; 13989, RABGEF1, 70513, 172963, 78-1553; 13989, RABGEF1, 70514, 172964, 172-1689; 13989, RABGEF1, 70518, 172968, 273-1748; 13990, RABIF, 70521, 172971, 38-409; 13991, RILP, 70523, 172973, 1-681; 13991, RILP, 70525, 172975, 1-681; 13991, RILP, 70522, 172972, 274-1479; 13991, RILP, 70524, 172974, 274-1479; 13992, RILPL1, 70526, 172976, 1068-1919; 13992, RILPL1, 70528, 172978, 168-398; 13992, RILPL1, 70527, 172977, 237-1448; 13993, RILPL2, 70529, 172979, 298-933; 13994, RABL2A, 70530, 172980, 68-565; 13994, RABL2A, 70534, 172984, 219-716; 13994, RABL2A, 70536, 172986, 215-556; 13994, RABL2A, 70537, 172987, 195-500; 13994, RABL2A, 70538, 172988, 172-336; 13994, RABL2A, 70531, 172981, 211-900; 13994, RABL2A, 70532, 172982, 148-834; 13994, RABL2A, 70533, 172983, 226-912; 13994, RABL2A, 70535, 172985, 303-1019; 13995, RABL2B, 70540, 172990, 184-483; 13995, RABL2B, 70541, 172991, 220-717; 13995, RABL2B, 70545, 172995, 196-501; 13995, RABL2B, 70546, 172996, 21-326; 13995, RABL2B, 70548, 172998, 331-391; 13995, RABL2B, 70549, 172999, 158-277; 13995, RABL2B, 70539, 172989, 179-868; 13995, RABL2B, 70542, 172992, 355-1071; 13995, RABL2B, 70543, 172993, 469-1158; 13995, RABL2B, 70544, 172994, 213-899; 13995, RABL2B, 70547, 172997, 216-902; 13996, RABL3, 70551, 173001, 8-169; 13996, RABL3, 70552, 173002, 1-160; 13996, RABL3, 70553, 173003, 487-876; 13996, RABL3, 70554, 173004, 14-652; 13996, RABL3, 70555, 173005, 4-411; 13996, RABL3, 70550, 173000, 31-741; 13997, RABL6, 70560, 173010, 1-646; 13997, RABL6, 70561, 173011, 2345-2917; 13997, RABL6, 70562, 173012, 713-2128; 13997, RABL6, 70563, 173013, 237-1691; 13997, RABL6, 70564, 173014, 1-1416; 13997, RABL6, 70556, 173006, 237-2426; 13997, RABL6, 70557, 173007, 39-1601; 13997, RABL6, 70558, 173008, 231-2379; 13997, RABL6, 70559, 173009, 255-1199; 13998, N/A, 70565, 173015, 1-2193; 13999, RAB10, 70566, 173016, 500-1102; 14000, RAB11FIP1, 70569, 173019, 225-1730; 14000, RAB11FIP1, 70567, 173017, 27-1976; 14000, RAB11FIP1, 70568, 173018, 14-3865; 14000, RAB11FIP1, 70570, 173020, 640-1959; 14001, RAB11FIP2, 70571, 173021, 441-1979; 14001, RAB11FIP2, 70572, 173022, 441-2039; 14002, RAB11FIP3, 70574, 173024, 258-804; 14002, RAB11FIP3, 70575, 173025, 1-2034; 14002, RAB11FIP3, 70576, 173026, 108-580; 14002, RAB11FIP3, 70577, 173027, 1-411; 14002, RAB11FIP3, 70581, 173031, 108-580; 14002, RAB11FIP3, 70582, 173032, 1-2034; 14002, RAB11FIP3, 70583, 173033, 1-411; 14002, RAB11FIP3, 70584, 173034, 258-804; 14002, RAB11FIP3, 70573, 173023, 389-2659; 14002, RAB11FIP3, 70578, 173028, 182-1564; 14002, RAB11FIP3, 70579, 173029, 389-2659; 14002, RAB11FIP3, 70580, 173030, 182-1564; 14003, RAB11FIP4, 70586, 173036, 108-596; 14003, RAB11FIP4, 70587, 173037, 52-204; 14003, RAB11FIP4, 70588, 173038, 188-567; 14003, RAB11FIP4, 70589, 173039, 126-278; 14003, RAB11FIP4, 70585, 173035, 244-1851; 14003, RAB11FIP4, 70590, 173040, 230-2143; 14004, RAB11FIP5, 70591, 173041, 242-2203; 14005, RAB11A, 70593, 173043, 123-588; 14005, RAB11A, 70594, 173044, 391-635; 14005, RAB11A, 70595, 173045, 131-571; 14005, RAB11A, 70597, 173047, 96-692; 14005, RAB11A, 70592, 173042, 129-777; 14005, RAB11A, 70596, 173046, 46-513; 14006, RAB11B, 70600, 173050, 190-372; 14006, RAB11B, 70601, 173051, 394-532; 14006, RAB11B, 70598, 173048, 219-875; 14006, RAB11B, 70599, 173049, 25-564; 14007, RAB12, 70602, 173052, 284-1018; 14008, RAB13, 70604, 173054, 503-871; 14008, RAB13, 70603, 173053, 117-728; 14009, RAB14, 70606, 173056, 167-711; 14009, RAB14, 70605, 173055, 239-886; 14010, REP15, 70607, 173057, 45-755; 14011, RAB15, 70609, 173059, 64-564; 14011, RAB15, 70611, 173061, 82-533; 14011, RAB15, 70612, 173062, 1-422; 14011, RAB15, 70608, 173058, 82-708; 14011, RAB15, 70610, 173060, 339-977; 14012, RAB17, 70614, 173064, 609-767; 14012, RAB17, 70616, 173066, 198-359; 14012, RAB17, 70617, 173067, 253-417; 14012, RAB17, 70618, 173068, 272-663; 14012, RAB17, 70619, 173069, 1-421; 14012, RAB17, 70613, 173063, 631-1269; 14012, RAB17, 70615, 173065, 539-796; 14013, RAB18, 70621, 173071, 43-528; 14013, RAB18, 70622, 173072, 1-873; 14013, RAB18, 70625, 173075, 197-745; 14013, RAB18, 70620, 173070, 103-723; 14013, RAB18, 70623, 173073, 197-625; 14013, RAB18, 70624, 173074, 1-708; 14014, RAB19, 70627, 173077, 199-645; 14014, RAB19, 70626, 173076, 69-722; 14014, RAB19, 70628, 173078, 199-852; 14015, RAB1A, 70631, 173081, 190-711; 14015, RAB1A, 70629, 173079, 187-576; 14015, RAB1A, 70630, 173080, 191-616; 14015, RAB1A, 70632, 173082, 192-809; 14016, RAB1B, 70634, 173084, 91-600; 14016, RAB1B, 70635, 173085, 96-584; 14016, RAB1B, 70633, 173083, 148-753; 14017, RAB20, 70636, 173086, 215-919; 14018, RAB21, 70637, 173087, 257-934; 14019, RAB22A, 70638, 173088, 282-866; 14020, RAB23, 70639, 173089, 155-868; 14020, RAB23, 70640, 173090, 655-1368; 14021, RAB24, 70641, 173091, 604-1128; 14021, RAB24, 70644, 173094, 367-563; 14021, RAB24, 70642, 173092, 421-1032; 14021, RAB24, 70643, 173093, 333-944; 14022, RAB25, 70646, 173096, 211-981; 14022, RAB25, 70645, 173095, 242-883; 14023, RAB26, 70649, 173099, 151-345; 14023, RAB26, 70650, 173100, 1-409; 14023, RAB26, 70647, 173097, 161-931; 14023, RAB26, 70648, 173098, 372-944; 14024, RAB27A, 70653, 173103, 107-663; 14024, RAB27A, 70656, 173106, 402-809; 14024, RAB27A, 70657, 173107, 218-432; 14024, RAB27A, 70658, 173108, 417-702; 14024, RAB27A, 70659, 173109, 262-701; 14024, RAB27A, 70651, 173101, 243-908; 14024, RAB27A, 70652, 173102, 253-918; 14024, RAB27A, 70654, 173104, 234-899; 14024, RAB27A, 70655, 173105, 194-859; 14025, RAB27B, 70661, 173111, 1-394; 14025, RAB27B, 70662, 173112, 171-432; 14025, RAB27B, 70660, 173110, 522-1178; 14026, RAB28, 70666, 173116, 1-224; 14026, RAB28, 70667, 173117, 182-469; 14026, RAB28, 70668, 173118, 1-155; 14026, RAB28, 70669, 173119, 1-430; 14026, RAB28, 70670, 173120, 216-503; 14026, RAB28, 70663, 173113, 216-878; 14026, RAB28, 70664, 173114, 216-881; 14026, RAB28, 70665, 173115, 216-830; 14027, RAB29, 70676, 173126, 319-447; 14027, RAB29, 70671, 173121, 207-818; 14027, RAB29, 70672, 173122, 305-916; 14027, RAB29, 70673, 173123, 278-817; 14027, RAB29, 70674, 173124, 504-1115; 14027, RAB29, 70675, 173125, 272-667; 14028, RAB2A, 70678, 173128, 1-313; 14028, RAB2A, 70679, 173129, 28-573; 14028, RAB2A, 70681, 173131, 537-566; 14028, RAB2A, 70682, 173132, 1-407; 14028, RAB2A, 70683, 173133, 1-209; 14028, RAB2A, 70677, 173127, 352-990; 14028, RAB2A, 70680, 173130, 273-839; 14029, RAB2B, 70685, 173135, 87-275; 14029, RAB2B, 70686, 173136, 63-692; 14029, RAB2B, 70684, 173134, 102-752; 14030, RAB3GAP1, 70688, 173138, 10-186; 14030, RAB3GAP1, 70687, 173137, 44-2989; 14030, RAB3GAP1, 70689, 173139, 11-2977; 14030, RAB3GAP1, 70690, 173140, 1-2808; 14031, RAB3GAP2, 70692, 173142, 1-515; 14031, RAB3GAP2, 70693, 173143, 34-282; 14031, RAB3GAP2, 70691, 173141, 118-4299; 14032, RAB30, 70695, 173145, 163-580; 14032, RAB30, 70696, 173146, 250-591; 14032, RAB30, 70697, 173147, 98-382; 14032, RAB30, 70698, 173148, 1-504; 14032, RAB30, 70699, 173149, 392-558; 14032, RAB30, 70700, 173150, 372-548; 14032, RAB30, 70701, 173151, 84-588; 14032, RAB30, 70705, 173155, 374-673; 14032, RAB30, 70706, 173156, 471-582; 14032, RAB30, 70707, 173157, 269-495; 14032, RAB30, 70708, 173158, 98-466; 14032, RAB30, 70694, 173144, 407-1018; 14032, RAB30, 70702, 173152, 242-736; 14032, RAB30, 70703, 173153, 173-784; 14032, RAB30, 70704, 173154, 286-897; 14032, RAB30, 70709, 173159, 140-751; 14033, RAB31, 70711, 173161, 132-209; 14033, RAB31, 70712, 173162, 84-263; 14033, RAB31, 70713, 173163, 100-324; 14033, RAB31, 70710, 173160, 242-829; 14034, RAB32, 70714, 173164, 180-857; 14035, RAB33A, 70715, 173165, 415-1128; 14036, RAB33B, 70716, 173166, 390-1079; 14037, RAB34, 70717, 173167, 429-1060; 14037, RAB34, 70719, 173169, 586-1368; 14037, RAB34, 70723, 173173, 128-643; 14037, RAB34, 70724, 173174, 86-717; 14037, RAB34, 70726, 173176, 139-914; 14037, RAB34, 70728, 173178, 2-808; 14037, RAB34, 70729, 173179, 1-467; 14037, RAB34, 70730, 173180, 179-626; 14037, RAB34, 70731, 173181, 428-582; 14037, RAB34, 70732, 173182, 401-546; 14037, RAB34, 70733, 173183, 71-706; 14037, RAB34, 70718, 173168, 454-1233; 14037, RAB34, 70720, 173170, 483-1238; 14037, RAB34, 70721, 173171, 628-1407; 14037, RAB34, 70722, 173172, 71-826; 14037, RAB34, 70725, 173175, 66-845; 14037, RAB34, 70727, 173177, 222-935; 14038, RAB35, 70736, 173186, 853-1296; 14038, RAB35, 70737, 173187, 87-643; 14038, RAB35, 70734, 173184, 190-795; 14038, RAB35, 70735, 173185, 118-576; 14039, RAB36, 70740, 173190, 1-397; 14039, RAB36, 70738, 173188, 41-1042; 14039, RAB36, 70739, 173189, 1-936; 14040, RAB37, 70741, 173191, 1010-1558; 14040, RAB37, 70742, 173192, 42-611; 14040, RAB37, 70746, 173196, 191-766; 14040, RAB37, 70748, 173198, 123-713; 14040, RAB37, 70743, 173193, 44-604; 14040, RAB37, 70744, 173194, 57-728; 14040, RAB37, 70745, 173195, 94-780; 14040, RAB37, 70747, 173197, 447-1097; 14040, RAB37, 70749, 173199, 3-674; 14040, RAB37, 70750, 173200, 3-674; 14041, RAB38, 70752, 173202, 1-631; 14041, RAB38, 70753, 173203, 1-268; 14041, RAB38, 70751, 173201, 84-719; 14042, RAB39A, 70754, 173204, 67-720; 14043, RAB39B, 70755, 173205, 302-943; 14044, RAB3IP, 70758, 173208, 448-1557; 14044, RAB3IP, 70761, 173211, 1-569; 14044, RAB3IP, 70764, 173214, 1-64; 14044, RAB3IP, 70766, 173216, 63-566; 14044, RAB3IP, 70767, 173217, 1-712; 14044, RAB3IP, 70768, 173218, 1-276; 14044, RAB3IP, 70771, 173221, 84-580; 14044, RAB3IP, 70756, 173206, 377-1759; 14044, RAB3IP, 70757, 173207, 448-1683; 14044, RAB3IP, 70759, 173209, 196-1143; 14044, RAB3IP, 70760, 173210, 196-1383; 14044, RAB3IP, 70762, 173212, 196-1110; 14044, RAB3IP, 70763, 173213, 458-1888; 14044, RAB3IP, 70765, 173215, 239-1003; 14044, RAB3IP, 70769, 173219, 341-1105; 14044, RAB3IP, 70770, 173220, 440-1402; 14045, RAB3IL1, 70774, 173224, 1-198; 14045, RAB3IL1, 70775, 173225, 76-866; 14045, RAB3IL1, 70772, 173222, 78-1148; 14045, RAB3IL1, 70773, 173223, 159-1307; 14046, RAB3A, 70777, 173227, 233-579; 14046, RAB3A, 70778, 173228, 205-582; 14046, RAB3A, 70776, 173226, 180-842; 14047, RAB3B, 70779, 173229, 214-873; 14048, RAB3C, 70780, 173230, 170-853; 14049, RAB3D, 70781, 173231, 262-921; 14049, RAB3D, 70782, 173232, 206-865; 14050, RAB40A, 70783, 173233, 343-1176;

14050, RAB40A, 70784, 173234, 2120-2953; 14051, RAB40AL, 70785, 173235, 70-906; 14052, RAB40B, 70786, 173236, 1094-1393; 14052, RAB40B, 70787, 173237, 67-486; 14052, RAB40B, 70788, 173238, 1-129; 14052, RAB40B, 70789, 173239, 133-969; 14053, RAB40C, 70794, 173244, 223-692; 14053, RAB40C, 70795, 173245, 808-921; 14053, RAB40C, 70796, 173246, 115-753; 14053, RAB40C, 70797, 173247, 1-710; 14053, RAB40C, 70798, 173248, 1-149; 14053, RAB40C, 70799, 173249, 84-648; 14053, RAB40C, 70800, 173250, 51-443; 14053, RAB40C, 70790, 173240, 204-1049; 14053, RAB40C, 70791, 173241, 75-920; 14053, RAB40C, 70792, 173242, 223-1068; 14053, RAB40C, 70793, 173243, 115-960; 14054, RAB41, 70803, 173253, 470-573; 14054, RAB41, 70801, 173251, 47-712; 14054, RAB41, 70802, 173252, 47-715; 14055, RAB42, 70804, 173254, 307-624; 14056, RAB43, 70810, 173260, 316-574; 14056, RAB43, 70805, 173255, 302-940; 14056, RAB43, 70806, 173256, 65-703; 14056, RAB43, 70807, 173257, 50-688; 14056, RAB43, 70808, 173258, 38-676; 14056, RAB43, 70809, 173259, 28-666; 14056, RAB43, 70811, 173261, 293-760; 14056, RAB43, 70812, 173262, 316-783; 14057, RAB44, 70814, 173264, 78-3143; 14057, RAB44, 70813, 173263, 1-2761; 14058, RAB4A, 70816, 173266, 360-701; 14058, RAB4A, 70815, 173265, 209-865; 14059, RAB4B, 70818, 173268, 68-433; 14059, RAB4B, 70820, 173270, 1-577; 14059, RAB4B, 70817, 173267, 111-752; 14059, RAB4B, 70819, 173269, 161-802; 14060, RAB4B-EGLN2, 70821, 173271, 106-747; 14061, RABSA, 70823, 173273, 217-414; 14061, RABSA, 70824, 173274, 708-753; 14061, RABSA, 70825, 173275, 237-425; 14061, RABSA, 70822, 173272, 537-1184; 14061, RABSA, 70826, 173276, 211-816; 14062, RABSB, 70829, 173279, 252-596; 14062, RABSB, 70830, 173280, 269-569; 14062, RABSB, 70831, 173281, 258-494; 14062, RABSB, 70833, 173283, 159-380; 14062, RABSB, 70834, 173284, 1-222; 14062, RABSB, 70827, 173277, 222-869; 14062, RABSB, 70828, 173278, 132-656; 14062, RABSB, 70832, 173282, 181-828; 14063, RABSC, 70838, 173288, 278-500; 14063, RABSC, 70839, 173289, 180-551; 14063, RABSC, 70840, 173290, 309-583; 14063, RABSC, 70841, 173291, 1-453; 14063, RABSC, 70835, 173285, 214-864; 14063, RABSC, 70836, 173286, 457-1107; 14063, RABSC, 70837, 173287, 302-1051; 14064, RAB6A, 70844, 173294, 440-703; 14064, RAB6A, 70845, 173295, 485-699; 14064, RAB6A, 70846, 173296, 4-267; 14064, RAB6A, 70847, 173297, 24-287; 14064, RAB6A, 70842, 173292, 503-1129; 14064, RAB6A, 70843, 173293, 457-1083; 14064, RAB6A, 70848, 173298, 78-605; 14064, RAB6A, 70849, 173299, 440-754; 14065, RAB6B, 70851, 173301, 358-506; 14065, RAB6B, 70852, 173302, 168-383; 14065, RAB6B, 70854, 173304, 474-723; 14065, RAB6B, 70855, 173305, 215-586; 14065, RAB6B, 70850, 173300, 351-977; 14065, RAB6B, 70853, 173303, 158-745; 14065, RAB6B, 70856, 173306, 130-756; 14066, RAB6C, 70857, 173307, 453-1217; 14067, RAB7A, 70859, 173309, 10-414; 14067, RAB7A, 70860, 173310, 10-306; 14067, RAB7A, 70861, 173311, 176-658; 14067, RAB7A, 70862, 173312, 126-576; 14067, RAB7A, 70863, 173313, 10-285; 14067, RAB7A, 70864, 173314, 10-359; 14067, RAB7A, 70858, 173308, 247-870; 14068, RAB7B, 70867, 173317, 226-699; 14068, RAB7B, 70869, 173319, 1-275; 14068, RAB7B, 70865, 173315, 305-904; 14068, RAB7B, 70866, 173316, 178-777; 14068, RAB7B, 70868, 173318, 289-888; 14069, RAB8A, 70870, 173320, 274-897; 14069, RAB8A, 70871, 173321, 6-629; 14070, RAB8B, 70873, 173323, 23-169; 14070, RAB8B, 70874, 173324, 66-209; 14070, RAB8B, 70875, 173325, 32-310; 14070, RAB8B, 70876, 173326, 20-584; 14070, RAB8B, 70872, 173322, 157-780; 14071, RABEPK, 70879, 173329, 167-631; 14071, RABEPK, 70881, 173331, 1-733; 14071, RABEPK, 70882, 173332, 170-634; 14071, RABEPK, 70877, 173327, 170-1135; 14071, RABEPK, 70878, 173328, 311-1429; 14071, RABEPK, 70880, 173330, 170-1288; 14072, RAB9A, 70883, 173333, 280-885; 14072, RAB9A, 70884, 173334, 195-800; 14073, RAB9B, 70885, 173335, 286-891; 14074, RABEP1, 70888, 173338, 223-551; 14074, RABEP1, 70889, 173339, 1-578; 14074, RABEP1, 70890, 173340, 1-460; 14074, RABEP1, 70891, 173341, 1-304; 14074, RABEP1, 70886, 173336, 1-2490; 14074, RABEP1, 70887, 173337, 188-2776; 14075, RABEP2, 70894, 173344, 34-1530; 14075, RABEP2, 70895, 173345, 166-309; 14075, RABEP2, 70896, 173346, 311-1045; 14075, RABEP2, 70897, 173347, 413-545; 14075, RABEP2, 70898, 173348, 1-841; 14075, RABEP2, 70899, 173349, 322-538; 14075, RABEP2, 70892, 173342, 52-1653; 14075, RABEP2, 70893, 173343, 590-2299; 14076, RBSN, 70901, 173351, 454-720; 14076, RBSN, 70902, 173352, 1-470; 14076, RBSN, 70903, 173353, 600-767; 14076, RBSN, 70905, 173355, 460-582; 14076, RBSN, 70900, 173350, 615-2969; 14076, RBSN, 70904, 173354, 474-2828; 14077, RPH3A, 70909, 173359, 313-561; 14077, RPH3A, 70910, 173360, 259-570; 14077, RPH3A, 70911, 173361, 196-740; 14077, RPH3A, 70912, 173362, 416-534; 14077, RPH3A, 70913, 173363, 203-579; 14077, RPH3A, 70914, 173364, 275-557; 14077, RPH3A, 70915, 173365, 193-538; 14077, RPH3A, 70916, 173366, 456-492; 14077, RPH3A, 70917, 173367, 354-595; 14077, RPH3A, 70919, 173369, 36-218; 14077, RPH3A, 70920, 173370, 170-660; 14077, RPH3A, 70921, 173371, 213-572; 14077, RPH3A, 70922, 173372, 250-531; 14077, RPH3A, 70923, 173373, 162-562; 14077, RPH3A, 70924, 173374, 95-2032; 14077, RPH3A, 70925, 173375, 181-561; 14077, RPH3A, 70906, 173356, 498-2582; 14077, RPH3A, 70907, 173357, 267-2351; 14077, RPH3A, 70908, 173358, 363-2447; 14077, RPH3A, 70918, 173368, 216-2288; 14078, RPH3AL, 70929, 173379, 375-487; 14078, RPH3AL, 70930, 173380, 189-566; 14078, RPH3AL, 70931, 173381, 1-474; 14078, RPH3AL, 70932, 173382, 141-586; 14078, RPH3AL, 70933, 173383, 235-814; 14078, RPH3AL, 70934, 173384, 345-593; 14078, RPH3AL, 70935, 173385, 95-531; 14078, RPH3AL, 70936, 173386, 217-820; 14078, RPH3AL, 70937, 173387, 250-579; 14078, RPH3AL, 70938, 173388, 81-537; 14078, RPH3AL, 70939, 173389, 308-571; 14078, RPH3AL, 70940, 173390, 250-579; 14078, RPH3AL, 70944, 173394, 95-531; 14078, RPH3AL, 70945, 173395, 1-474; 14078, RPH3AL, 70948, 173398, 168-518; 14078, RPH3AL, 70950, 173400, 375-487; 14078, RPH3AL, 70951, 173401, 375-487; 14078, RPH3AL, 70952, 173402, 599-949; 14078, RPH3AL, 70953, 173403, 250-579; 14078, RPH3AL, 70954, 173404, 235-814; 14078, RPH3AL, 70955, 173405, 217-820; 14078, RPH3AL, 70956, 173406, 308-571; 14078, RPH3AL, 70957, 173407, 308-571; 14078, RPH3AL, 70958, 173408, 189-566; 14078, RPH3AL, 70959, 173409, 217-654; 14078, RPH3AL, 70960, 173410, 95-531; 14078, RPH3AL, 70961, 173411, 141-586; 14078, RPH3AL, 70962, 173412, 189-566; 14078, RPH3AL, 70963, 173413, 141-491; 14078, RPH3AL, 70964, 173414, 81-518; 14078, RPH3AL, 70965, 173415, 345-593; 14078, RPH3AL, 70966, 173416, 81-537; 14078, RPH3AL, 70967, 173417, 235-672; 14078, RPH3AL, 70968, 173418, 309-746; 14078, RPH3AL, 70969, 173419, 345-593; 14078, RPH3AL, 70926, 173376, 599-1459; 14078, RPH3AL, 70927, 173377, 309-1256; 14078, RPH3AL, 70928, 173378, 168-1028; 14078, RPH3AL, 70941, 173391, 38-898; 14078, RPH3AL, 70942, 173392, 168-1115; 14078, RPH3AL, 70943, 173393, 38-985; 14078, RPH3AL, 70946, 173396, 309-1256; 14078, RPH3AL, 70947, 173397, 599-1459; 14078, RPH3AL, 70949, 173399, 168-1028; 14079, RACGAP1, 70973, 173423, 104-570; 14079, RACGAP1, 70974, 173424, 7-360; 14079, RACGAP1, 70975, 173425, 165-581; 14079, RACGAP1, 70976, 173426, 112-563; 14079, RACGAP1, 70977, 173427, 160-568; 14079, RACGAP1, 70978, 173428, 208-530; 14079, RACGAP1, 70979, 173429, 451-554; 14079, RACGAP1, 70980, 173430, 52-932; 14079, RACGAP1, 70981, 173431, 184-570; 14079, RACGAP1, 70982, 173432, 64-234; 14079, RACGAP1, 70983, 173433, 136-386; 14079, RACGAP1, 70984, 173434, 63-586; 14079, RACGAP1, 70985, 173435, 150-539; 14079, RACGAP1, 70988, 173438, 1-841; 14079, RACGAP1, 70989, 173439, 69-218; 14079, RACGAP1, 70990, 173440, 93-624; 14079, RACGAP1, 70991, 173441, 110-574; 14079, RACGAP1, 70992, 173442, 218-551; 14079, RACGAP1, 70993, 173443, 179-634; 14079, RACGAP1, 70994, 173444, 211-584; 14079, RACGAP1, 70995, 173445, 362-564; 14079, RACGAP1, 70970, 173420, 69-1967; 14079, RACGAP1, 70971, 173421, 225-2123; 14079, RACGAP1, 70972, 173422, 78-1976; 14079, RACGAP1, 70986, 173436, 292-2190; 14079, RACGAP1, 70987, 173437, 6-1904; 14080, ARHGEF6, 70996, 173446, 1207-3537; 14080, ARHGEF6, 70997, 173447, 414-2282; 14080, ARHGEF6, 70998, 173448, 429-2297; 14081, RAD1, 71002, 173452, 270-524; 14081, RAD1, 71003, 173453, 172-426; 14081, RAD1, 71004, 173454, 1424-1678; 14081, RAD1, 70999, 173449, 203-409; 14081, RAD1, 71000, 173450, 900-1748; 14081, RAD1, 71001, 173451, 1421-2269; 14082, RAD17, 71013, 173463, 435-496; 14082, RAD17, 71014, 173464, 1-498; 14082, RAD17, 71015, 173465, 352-859; 14082, RAD17, 71016, 173466, 1-555; 14082, RAD17, 71018, 173468, 817-966; 14082, RAD17, 71023, 173473, 435-496; 14082, RAD17, 71025, 173475, 624-2141; 14082, RAD17, 71026, 173476, 817-966; 14082, RAD17, 71027, 173477, 679-2724; 14082, RAD17, 71028, 173478, 738-2255; 14082, RAD17, 71029, 173479, 1-498; 14082, RAD17, 71031, 173481, 1-555; 14082, RAD17, 71033, 173483, 313-2067; 14082, RAD17, 71034, 173484, 352-859; 14082, RAD17, 71035, 173485, 63-2108; 14082, RAD17, 71005, 173455, 313-2067; 14082, RAD17, 71006, 173456, 643-2655; 14082, RAD17, 71007, 173457, 268-2280; 14082, RAD17, 71008, 173458, 422-2434; 14082, RAD17, 71009, 173459, 539-2551; 14082, RAD17, 71010, 173460, 624-2141; 14082, RAD17, 71011, 173461, 481-2493; 14082, RAD17, 71012, 173462, 63-2108; 14082, RAD17, 71017, 173467, 679-2724; 14082, RAD17, 71019, 173469, 738-2255; 14082, RAD17, 71020, 173470, 422-2434; 14082, RAD17, 71021, 173471, 643-2655; 14082, RAD17, 71022, 173472, 539-2551; 14082, RAD17, 71024, 173474, 268-2280; 14082, RAD17, 71030, 173480, 481-2493; 14082, RAD17, 71032, 173482, 538-2550; 14082, RAD17, 71036, 173486, 538-2550; 14083, RAD18, 71038, 173488, 1-240; 14083, RAD18, 71039, 173489, 86-247; 14083, RAD18, 71040, 173490, 86-466; 14083, RAD18, 71041, 173491, 47-979; 14083, RAD18, 71042, 173492, 1-394; 14083, RAD18, 71043, 173493, 307-581; 14083, RAD18, 71037, 173487, 118-1605; 14084, RAD21, 71045, 173495, 199-874; 14084, RAD21, 71046, 173496, 200-730; 14084, RAD21, 71047, 173497, 188-548; 14084, RAD21, 71048, 173498, 1504-1911; 14084, RAD21, 71049, 173499, 148-831; 14084, RAD21, 71050, 173500, 521-730; 14084, RAD21, 71051, 173501, 144-515; 14084, RAD21, 71044, 173494, 289-2184; 14085, RAD21L1, 71052, 173502, 297-492; 14085, RAD21L1, 71053, 173503, 118-1683; 14085, RAD21L1, 71054, 173504, 94-1764; 14086, RAD23A, 71056, 173506, 1-188; 14086, RAD23A, 71057, 173507, 95-523; 14086, RAD23A, 71058, 173508, 56-475; 14086, RAD23A, 71060, 173510, 1-453; 14086, RAD23A, 71055, 173505, 74-1162; 14086, RAD23A, 71059, 173509, 62-1153; 14086, RAD23A, 71061, 173511, 58-984; 14087, RAD23B, 71063, 173513, 1-344; 14087, RAD23B, 71065, 173515, 217-456; 14087, RAD23B, 71066, 173516, 277-716; 14087, RAD23B, 71062, 173512, 352-1581; 14087, RAD23B, 71064, 173514, 286-1299; 14088, RAD50, 71068, 173518, 624-923; 14088, RAD50, 71069, 173519, 95-1750; 14088, RAD50, 71070, 173520, 1-475; 14088, RAD50, 71071, 173521, 1-472; 14088, RAD50, 71072, 173522, 95-2076; 14088, RAD50, 71073, 173523, 388-696; 14088, RAD50, 71067, 173517, 388-4326; 14089, RINT1, 71075, 173525, 136-261; 14089, RINT1, 71076, 173526, 133-563; 14089, RINT1, 71077, 173527, 148-312; 14089, RINT1, 71078, 173528, 105-278; 14089, RINT1, 71074, 173524, 232-2610; 14090, RAD51AP1, 71081, 173531, 51-263; 14090, RAD51AP1, 71082, 173532, 72-287; 14090, RAD51AP1, 71083, 173533, 51-266; 14090, RAD51AP1, 71084, 173534, 1-207; 14090, RAD51AP1, 71085, 173535, 58-270; 14090, RAD51AP1, 71086, 173536, 34-258; 14090, RAD51AP1, 71087, 173537, 143-355; 14090, RAD51AP1, 71088, 173538, 1-773; 14090, RAD51AP1, 71089, 173539, 58-270; 14090, RAD51AP1, 71090, 173540, 11-718; 14090, RAD51AP1, 71079, 173529, 51-1109; 14090, RAD51AP1, 71080, 173530, 51-1058; 14091, RAD51AP2, 71091, 173541, 25-3504; 14092, RAD51B, 71092, 173542, 45-884; 14092, RAD51B, 71093, 173543, 78-404; 14092, RAD51B, 71094, 173544, 169-568; 14092, RAD51B, 71097, 173547, 78-1355; 14092, RAD51B, 71099, 173549, 1-108; 14092, RAD51B, 71100, 173550, 25-249; 14092, RAD51B, 71095, 173545, 49-1101; 14092, RAD51B, 71096, 173546, 49-1203; 14092, RAD51B, 71098, 173548, 28-1128; 14093, RAD51C, 71103, 173553, 1-772; 14093, RAD51C, 71104, 173554, 1-639; 14093, RAD51C, 71105, 173555, 39-443; 14093, RAD51C, 71106, 173556, 43-201; 14093, RAD51C, 71107, 173557, 30-434; 14093, RAD51C, 71108, 173558, 39-197; 14093, RAD51C, 71109, 173559, 72-1112; 14093, RAD51C, 71110, 173560, 1-143; 14093, RAD51C, 71111, 173561, 1-324; 14093, RAD51C, 71112, 173562, 320-726; 14093, RAD51C, 71113, 173563, 1-396; 14093, RAD51C, 71101, 173551, 72-1202; 14093, RAD51C, 71102, 173552, 17-424; 14094, RAD51D, 71117, 173567, 483-938; 14094, RAD51D, 71118, 173568, 1-260; 14094, RAD51D, 71119, 173569, 488-561; 14094, RAD51D, 71122, 173572, 104-427; 14094, RAD51D, 71124, 173574, 254-676; 14094, RAD51D, 71126, 173576, 15-762; 14094, RAD51D, 71127, 173577, 1-289; 14094, RAD51D, 71128, 173578, 1-260; 14094, RAD51D, 71129, 173579, 302-583; 14094, RAD51D, 71114, 173564, 133-783; 14094, RAD51D, 71115, 173565, 257-1243; 14094, RAD51D, 71116, 173566, 140-1126; 14094, RAD51D, 71120, 173570, 107-256; 14094, RAD51D, 71121, 173571, 134-283; 14094, RAD51D, 71123, 173573, 201-1247; 14094, RAD51D, 71125, 173575, 226-582; 14095, RAD51, 71133, 173583, 242-697; 14095, RAD51, 71134, 173584, 401-625; 14095, RAD51, 71135, 173585, 50-566; 14095, RAD51, 71136, 173586, 1-197; 14095, RAD51, 71138, 173588, 3-305; 14095, RAD51, 71130, 173580, 269-1288; 14095, RAD51, 71131, 173581, 151-1173; 14095, RAD51, 71132, 173582, 300-1142; 14095, RAD51, 71137, 173587, 255-1277; 14095, RAD51, 71139, 173589, 257-985; 14096, N/A, 71140, 173590, 176-787; 14096, N/A, 71141, 173591, 201-

1019; 14096, N/A, 71142, 173592, 293-676; 14097, RAD52, 71144, 173594, 136-530; 14097, RAD52, 71149, 173599, 83-382; 14097, RAD52, 71151, 173601, 85-990; 14097, RAD52, 71152, 173602, 245-633; 14097, RAD52, 71154, 173604, 79-441; 14097, RAD52, 71143, 173593, 140-1396; 14097, RAD52, 71145, 173595, 264-1520; 14097, RAD52, 71146, 173596, 135-554; 14097, RAD52, 71147, 173597, 79-498; 14097, RAD52, 71148, 173598, 167-523; 14097, RAD52, 71150, 173600, 1-681; 14097, RAD52, 71153, 173603, 63-419; 14098, RDM1, 71171, 173621, 472-1113; 14098, RDM1, 71178, 173628, 472-1113; 14098, RDM1, 71155, 173605, 1-414; 14098, RDM1, 71156, 173606, 1-345; 14098, RDM1, 71157, 173607, 1-240; 14098, RDM1, 71158, 173608, 1-501; 14098, RDM1, 71159, 173609, 1-756; 14098, RDM1, 71160, 173610, 488-1273; 14098, RDM1, 71161, 173611, 1-432; 14098, RDM1, 71162, 173612, 18-368; 14098, RDM1, 71163, 173613, 47-901; 14098, RDM1, 71164, 173614, 1-351; 14098, RDM1, 71165, 173615, 18-368; 14098, RDM1, 71166, 173616, 14-724; 14098, RDM1, 71167, 173617, 1-420; 14098, RDM1, 71168, 173618, 1-501; 14098, RDM1, 71169, 173619, 47-901; 14098, RDM1, 71170, 173620, 1-756; 14098, RDM1, 71172, 173622, 1-687; 14098, RDM1, 71173, 173623, 1-420; 14098, RDM1, 71174, 173624, 1-351; 14098, RDM1, 71175, 173625, 1-240; 14098, RDM1, 71176, 173626, 14-724; 14098, RDM1, 71177, 173627, 1-345; 14098, RDM1, 71179, 173629, 1-414; 14098, RDM1, 71180, 173630, 1-687; 14098, RDM1, 71181, 173631, 1-432; 14098, RDM1, 71182, 173632, 488-1273; 14099, RAD54B, 71184, 173634, 96-472; 14099, RAD54B, 71186, 173636, 71-229; 14099, RAD54B, 71187, 173637, 99-464; 14099, RAD54B, 71188, 173638, 699-2879; 14099, RAD54B, 71183, 173633, 126-2858; 14099, RAD54B, 71185, 173635, 79-432; 14100, RAD54L, 71191, 173641, 1-964; 14100, RAD54L, 71192, 173642, 41-648; 14100, RAD54L, 71193, 173643, 1-767; 14100, RAD54L, 71194, 173644, 1-337; 14100, RAD54L, 71195, 173645, 1-207; 14100, RAD54L, 71196, 173646, 585-810; 14100, RAD54L, 71197, 173647, 402-627; 14100, RAD54L, 71198, 173648, 629-718; 14100, RAD54L, 71199, 173649, 1-182; 14100, RAD54L, 71189, 173639, 675-2918; 14100, RAD54L, 71190, 173640, 115-2358; 14101, RAD54L2, 71201, 173651, 1-3889; 14101, RAD54L2, 71200, 173650, 126-4529; 14102, RAD9A, 71203, 173653, 88-237; 14102, RAD9A, 71204, 173654, 88-829; 14102, RAD9A, 71205, 173655, 70-426; 14102, RAD9A, 71206, 173656, 883-912; 14102, RAD9A, 71202, 173652, 94-1269; 14103, RAD9B, 71207, 173657, 217-480; 14103, RAD9B, 71208, 173658, 100-1389; 14103, RAD9B, 71209, 173659, 48-1301; 14103, RAD9B, 71211, 173661, 25-1050; 14103, RAD9B, 71210, 173660, 257-1294; 14103, RAD9B, 71212, 173662, 326-1363; 14104, RHNO1, 71215, 173665, 189-583; 14104, RHNO1, 71216, 173666, 145-324; 14104, RHNO1, 71217, 173667, 326-517; 14104, RHNO1, 71218, 173668, 266-580; 14104, RHNO1, 71213, 173663, 153-869; 14104, RHNO1, 71214, 173664, 169-843; 14104, RHNO1, 71219, 173669, 290-1006; 14105, RSPH3, 71221, 173671, 638-1894; 14105, RSPH3, 71222, 173672, 232-1200; 14105, RSPH3, 71220, 173670, 191-1873; 14106, RSPH1, 71223, 173673, 169-1098; 14106, RSPH1, 71224, 173674, 1-816; 14107, RSPH10B, 71228, 173678, 436-448; 14107, RSPH10B, 71229, 173679, 607-646; 14107, RSPH10B, 71230, 173680, 135-977; 14107, RSPH10B, 71225, 173675, 89-2701; 14107, RSPH10B, 71226, 173676, 272-2884; 14107, RSPH10B, 71227, 173677, 388-3000; 14108, RSPH10B2, 71234, 173684, 420-596; 14108, RSPH10B2, 71235, 173685, 599-627; 14108, RSPH10B2, 71236, 173686, 1-972; 14108, RSPH10B2, 71231, 173681, 89-2701; 14108, RSPH10B2, 71232, 173682, 388-3000; 14108, RSPH10B2, 71233, 173683, 272-2884; 14109, RSPH14, 71238, 173688, 93-419; 14109, RSPH14, 71239, 173689, 1-204; 14109, RSPH14, 71240, 173690, 1-202; 14109, RSPH14, 71241, 173691, 1-222; 14109, RSPH14, 71237, 173687, 198-1244; 14110, RSPH4A, 71242, 173692, 138-2288; 14110, RSPH4A, 71243, 173693, 1-1410; 14110, RSPH4A, 71244, 173694, 146-1948; 14111, RSPH6A, 71246, 173696, 234-1595; 14111, RSPH6A, 71247, 173697, 53-2083; 14111, RSPH6A, 71245, 173695, 144-2297; 14112, RSPH9, 71248, 173698, 54-884; 14112, RSPH9, 71249, 173699, 54-974; 14113, RSAD1, 71251, 173701, 1-588; 14113, RSAD1, 71253, 173703, 1-258; 14113, RSAD1, 71254, 173704, 457-554; 14113, RSAD1, 71250, 173700, 86-1414; 14113, RSAD1, 71252, 173702, 26-613; 14114, RSAD2, 71256, 173706, 77-499; 14114, RSAD2, 71255, 173705, 137-1222; 14115, RDX, 71259, 173709, 328-482; 14115, RDX, 71261, 173711, 196-544; 14115, RDX, 71262, 173712, 213-371; 14115, RDX, 71264, 173714, 196-348; 14115, RDX, 71265, 173715, 217-351; 14115, RDX, 71267, 173717, 92-536; 14115, RDX, 71257, 173707, 321-2072; 14115, RDX, 71258, 173708, 311-2125; 14115, RDX, 71260, 173710, 311-2125; 14115, RDX, 71263, 173713, 405-1178; 14115, RDX, 71266, 173716, 311-913; 14115, RDX, 71268, 173718, 311-2125; 14115, RDX, 71269, 173719, 348-1691; 14116, RAF1, 71271, 173721, 340-549; 14116, RAF1, 71272, 173722, 1-1584; 14116, RAF1, 71273, 173723, 340-549; 14116, RAF1, 71270, 173720, 441-2387; 14116, RAF1, 71274, 173724, 363-2369; 14117, RFTN2, 71276, 173726, 1-582; 14117, RFTN2, 71277, 173727, 236-584; 14117, RFTN2, 71275, 173725, 538-2043; 14118, RFTN1, 71279, 173729, 151-599; 14118, RFTN1, 71280, 173730, 213-555; 14118, RFTN1, 71281, 173731, 84-1712; 14118, RFTN1, 71282, 173732, 313-1137; 14118, RFTN1, 71283, 173733, 130-578; 14118, RFTN1, 71284, 173734, 90-443; 14118, RFTN1, 71285, 173735, 1-267; 14118, RFTN1, 71278, 173728, 274-2010; 14119, RALGPS1, 71287, 173737, 252-770; 14119, RALGPS1, 71292, 173742, 1-461; 14119, RALGPS1, 71286, 173736, 268-1941; 14119, RALGPS1, 71288, 173738, 66-1655; 14119, RALGPS1, 71289, 173739, 228-1145; 14119, RALGPS1, 71290, 173740, 273-599; 14119, RALGPS1, 71291, 173741, 293-1447; 14119, RALGPS1, 71293, 173743, 305-1918; 14120, RALGPS2, 71294, 173744, 108-906; 14120, RALGPS2, 71295, 173745, 1-438; 14120, RALGPS2, 71298, 173748, 1-298; 14120, RALGPS2, 71296, 173746, 357-2030; 14120, RALGPS2, 71297, 173747, 339-2090; 14121, RALGAPA1, 71302, 173752, 1-1070; 14121, RALGAPA1, 71303, 173753, 1-2169; 14121, RALGAPA1, 71299, 173749, 470-6721; 14121, RALGAPA1, 71300, 173750, 100-6249; 14121, RALGAPA1, 71301, 173751, 392-6502; 14121, RALGAPA1, 71304, 173754, 1-6252; 14122, RALGAPA2, 71306, 173756, 1-752; 14122, RALGAPA2, 71307, 173757, 1-5222; 14122, RALGAPA2, 71308, 173758, 127-840; 14122, RALGAPA2, 71305, 173755, 9-5630; 14123, RALGAPB, 71312, 173762, 1-3972; 14123, RALGAPB, 71313, 173763, 1-2599; 14123, RALGAPB, 71309, 173759, 285-4769; 14123, RALGAPB, 71310, 173760, 59-4543; 14123, RALGAPB, 71311, 173761, 285-4760; 14124, RALGDS, 71319, 173769, 1-926; 14124, RALGDS, 71320, 173770, 3-2477; 14124, RALGDS, 71314, 173764, 23-2731; 14124, RALGDS, 71315, 173765, 23-2767; 14124, RALGDS, 71316, 173766, 75-2732; 14124, RALGDS, 71317, 173767, 84-2825; 14124, RALGDS, 71318, 173768, 355-2934; 14125, RGL1, 71321, 173771, 450-2861; 14125, RGL1, 71322, 173772, 179-2485; 14126, RGL2, 71324, 173774, 201-640; 14126, RGL2, 71326, 173776, 201-640; 14126, RGL2, 71327, 173777, 201-640; 14126, RGL2, 71328, 173778, 201-640; 14126, RGL2, 71331, 173781, 201-640; 14126, RGL2, 71323, 173773, 497-2830; 14126, RGL2, 71325, 173775, 497-2830; 14126, RGL2, 71329, 173779, 497-2830; 14126, RGL2, 71330, 173780, 497-2830; 14126, RGL2, 71332, 173782, 497-2830; 14127, RGL3, 71333, 173783, 65-2197; 14127, RGL3, 71335, 173785, 1-751; 14127, RGL3, 71336, 173786, 33-578; 14127, RGL3, 71337, 173787, 37-537; 14127, RGL3, 71338, 173788, 29-557; 14127, RGL3, 71339, 173789, 1-232; 14127, RGL3, 71334, 173784, 51-2201; 14128, RGL4, 71341, 173791, 1114-2127; 14128, RGL4, 71342, 173792, 1-466; 14128, RGL4, 71343, 173793, 1609-2916; 14128, RGL4, 71344, 173794, 726-2333; 14128, RGL4, 71345, 173795, 1579-2811; 14128, RGL4, 71346, 173796, 1579-2649; 14128, RGL4, 71340, 173790, 1171-2592; 14129, RALBP1, 71349, 173799, 216-836; 14129, RALBP1, 71350, 173800, 493-503; 14129, RALBP1, 71351, 173801, 220-777; 14129, RALBP1, 71347, 173797, 224-2191; 14129, RALBP1, 71348, 173798, 78-2045; 14130, REPS1, 71356, 173806, 39-2252; 14130, REPS1, 71357, 173807, 530-1192; 14130, REPS1, 71358, 173808, 1-444; 14130, REPS1, 71359, 173809, 1-307; 14130, REPS1, 71360, 173810, 1-365; 14130, REPS1, 71361, 173811, 1-458; 14130, REPS1, 71362, 173812, 1-2265; 14130, REPS1, 71363, 173813, 1-439; 14130, REPS1, 71364, 173814, 1-185; 14130, REPS1, 71365, 173815, 320-982; 14130, REPS1, 71366, 173816, 580-1242; 14130, REPS1, 71352, 173802, 580-2967; 14130, REPS1, 71353, 173803, 94-2403; 14130, REPS1, 71354, 173804, 200-2317; 14130, REPS1, 71355, 173805, 576-2966; 14131, REPS2, 71367, 173817, 1-1980; 14131, REPS2, 71368, 173818, 172-2154; 14132, RALY, 71370, 173820, 272-786; 14132, RALY, 71372, 173822, 499-766; 14132, RALY, 71373, 173823, 662-1204; 14132, RALY, 71374, 173824, 160-871; 14132, RALY, 71369, 173819, 503-1423; 14132, RALY, 71371, 173821, 579-1451; 14133, RALYL, 71375, 173825, 340-595; 14133, RALYL, 71376, 173826, 89-529; 14133, RALYL, 71378, 173828, 256-511; 14133, RALYL, 71380, 173830, 317-459; 14133, RALYL, 71381, 173831, 915-1757; 14133, RALYL, 71377, 173827, 329-1204; 14133, RALYL, 71379, 173829, 98-754; 14133, RALYL, 71382, 173832, 125-1039; 14133, RALYL, 71383, 173833, 1106-1981; 14133, RALYL, 71384, 173834, 368-1243; 14134, RANBP1, 71387, 173837, 248-469; 14134, RANBP1, 71388, 173838, 94-584; 14134, RANBP1, 71389, 173839, 174-333; 14134, RANBP1, 71390, 173840, 248-1084; 14134, RANBP1, 71391, 173841, 486-645; 14134, RANBP1, 71392, 173842, 219-832; 14134, RANBP1, 71393, 173843, 248-744; 14134, RANBP1, 71394, 173844, 497-932; 14134, RANBP1, 71385, 173835, 103-708; 14134, RANBP1, 71386, 173836, 227-829; 14135, RANBP10, 71397, 173847, 25-273; 14135, RANBP10, 71398, 173848, 25-1977; 14135, RANBP10, 71399, 173849, 22-471; 14135, RANBP10, 71400, 173850, 25-405; 14135, RANBP10, 71401, 173851, 117-1979; 14135, RANBP10, 71395, 173845, 117-1979; 14135, RANBP10, 71396, 173846, 25-1809; 14136, RANBP17, 71404, 173854, 1-143; 14136, RANBP17, 71406, 173856, 429-542; 14136, RANBP17, 71407, 173857, 1-1664; 14136, RANBP17, 71409, 173859, 1-525; 14136, RANBP17, 71411, 173861, 17-1759; 14136, RANBP17, 71412, 173862, 1-1557; 14136, RANBP17, 71402, 173852, 103-1833; 14136, RANBP17, 71403, 173853, 165-3431; 14136, RANBP17, 71405, 173855, 17-1747; 14136, RANBP17, 71408, 173858, 17-1747; 14136, RANBP17, 71410, 173860, 17-1747; 14137, RANBP2, 71414, 173864, 55-210; 14137, RANBP2, 71415, 173865, 1-156; 14137, RANBP2, 71413, 173863, 127-9801; 14138, RANBP3, 71419, 173869, 12-233; 14138, RANBP3, 71420, 173870, 83-547; 14138, RANBP3, 71421, 173871, 33-278; 14138, RANBP3, 71422, 173872, 12-1496; 14138, RANBP3, 71423, 173873, 634-786; 14138, RANBP3, 71424, 173874, 139-557; 14138, RANBP3, 71425, 173875, 59-573; 14138, RANBP3, 71426, 173876, 4-228; 14138, RANBP3, 71427, 173877, 59-247; 14138, RANBP3, 71428, 173878, 12-338; 14138, RANBP3, 71429, 173879, 12-128; 14138, RANBP3, 71430, 173880, 38-271; 14138, RANBP3, 71431, 173881, 453-818; 14138, RANBP3, 71416, 173866, 5-1504; 14138, RANBP3, 71417, 173867, 59-1762; 14138, RANBP3, 71418, 173868, 27-1715; 14139, RANBP3L, 71435, 173885, 247-572; 14139, RANBP3L, 71432, 173882, 487-1884; 14139, RANBP3L, 71433, 173883, 485-1450; 14139, RANBP3L, 71434, 173884, 485-1957; 14140, RANBP6, 71437, 173887, 6-212; 14140, RANBP6, 71438, 173888, 19-704; 14140, RANBP6, 71436, 173886, 12-3329; 14141, RANBP9, 71439, 173889, 60-2249; 14142, RANGAP1, 71442, 173892, 1-759; 14142, RANGAP1, 71443, 173893, 204-603; 14142, RANGAP1, 71445, 173895, 835-946; 14142, RANGAP1, 71446, 173896, 351-650; 14142, RANGAP1, 71440, 173890, 305-2068; 14142, RANGAP1, 71441, 173891, 714-2477; 14142, RANGAP1, 71444, 173894, 1471-3234; 14143, RANGRF, 71447, 173897, 293-853; 14143, RANGRF, 71448, 173898, 136-576; 14143, RANGRF, 71449, 173899, 112-609; 14143, RANGRF, 71450, 173900, 119-475; 14144, RAN, 71451, 173901, 42-743; 14144, RAN, 71453, 173903, 1-705; 14144, RAN, 71454, 173904, 1-311; 14144, RAN, 71455, 173905, 282-668; 14144, RAN, 71456, 173906, 62-657; 14144, RAN, 71458, 173908, 56-217; 14144, RAN, 71452, 173902, 525-1175; 14144, RAN, 71457, 173907, 259-909; 14145, RGPD1, 71459, 173909, 39-5309; 14145, RGPD1, 71461, 173911, 1-95; 14145, RGPD1, 71460, 173910, 17-5263; 14145, RGPD1, 71462, 173912, 17-5263; 14146, RGPD2, 71463, 173913, 224-5494; 14147, RGPD3, 71464, 173914, 39-5321; 14147, RGPD3, 71465, 173915, 89-5365; 14148, RGPD4, 71466, 173916, 78-5354; 14149, RGPD5, 71470, 173920, 162-563; 14149, RGPD5, 71471, 173921, 399-568; 14149, RGPD5, 71472, 173922, 1-297; 14149, RGPD5, 71473, 173923, 86-541; 14149, RGPD5, 71467, 173917, 159-5456; 14149, RGPD5, 71468, 173918, 193-2907; 14149, RGPD5, 71469, 173919, 534-3248; 14150, RGPD6, 71476, 173926, 1-606; 14150, RGPD6, 71477, 173927, 399-568; 14150, RGPD6, 71478, 173928, 162-566; 14150, RGPD6, 71479, 173929, 1-297; 14150, RGPD6, 71474, 173924, 78-2792; 14150, RGPD6, 71475, 173925, 78-5375; 14151, RGPD8, 71481, 173931, 78-2792; 14151, RGPD8, 71482, 173932, 581-5458; 14151, RGPD8, 71483, 173933, 1-297; 14151, RGPD8, 71484, 173934, 86-541; 14151, RGPD8, 71480, 173930, 193-5490; 14152, RBCK1, 71487, 173937, 650-1672; 14152, RBCK1, 71488, 173938, 709-1719; 14152, RBCK1, 71489, 173939, 397-588; 14152, RBCK1, 71490, 173940, 612-961; 14152, RBCK1, 71491, 173941, 1-765; 14152, RBCK1, 71492, 173942, 706-1524; 14152, RBCK1, 71493, 173943, 242-593; 14152, RBCK1, 71494, 173944, 681-998; 14152, RBCK1, 71485, 173935, 569-1975; 14152, RBCK1, 71486, 173936, 706-2238; 14153, RAPGEF1, 71498, 173948, 1-683; 14153, RAPGEF1, 71499, 173949, 1-957; 14153, RAPGEF1, 71500, 173950, 115-588; 14153, RAPGEF1, 71495, 173945, 125-3358; 14153, RAPGEF1, 71496, 173946, 39-3326; 14153, RAPGEF1, 71497, 173947, 245-3529;

14154, RAPGEF2, 71502, 173952, 1-796; 14154, RAPGEF2, 71503, 173953, 235-582; 14154, RAPGEF2, 71504, 173954, 1-568; 14154, RAPGEF2, 71505, 173955, 96-562; 14154, RAPGEF2, 71506, 173956, 1-545; 14154, RAPGEF2, 71507, 173957, 135-596; 14154, RAPGEF2, 71508, 173958, 1-838; 14154, RAPGEF2, 71509, 173959, 1-970; 14154, RAPGEF2, 71501, 173951, 420-4919; 14155, RAPGEF3, 71514, 173964, 188-855; 14155, RAPGEF3, 71515, 173965, 1-554; 14155, RAPGEF3, 71516, 173966, 305-2749; 14155, RAPGEF3, 71518, 173968, 226-648; 14155, RAPGEF3, 71519, 173969, 1-327; 14155, RAPGEF3, 71520, 173970, 17-256; 14155, RAPGEF3, 71510, 173960, 213-2984; 14155, RAPGEF3, 71511, 173961, 90-1886; 14155, RAPGEF3, 71512, 173962, 211-2856; 14155, RAPGEF3, 71513, 173963, 90-2861; 14155, RAPGEF3, 71517, 173967, 299-2944; 14156, RAPGEF4, 71522, 173972, 1-564; 14156, RAPGEF4, 71524, 173974, 18-2849; 14156, RAPGEF4, 71525, 173975, 212-2587; 14156, RAPGEF4, 71521, 173971, 144-3179; 14156, RAPGEF4, 71523, 173973, 391-2994; 14156, RAPGEF4, 71526, 173976, 278-2800; 14156, RAPGEF4, 71527, 173977, 278-2854; 14157, RAPGEF5, 71528, 173978, 314-2506; 14157, RAPGEF5, 71530, 173980, 85-1287; 14157, RAPGEF5, 71531, 173981, 194-660; 14157, RAPGEF5, 71532, 173982, 84-458; 14157, RAPGEF5, 71533, 173983, 444-869; 14157, RAPGEF5, 71529, 173979, 249-1991; 14157, RAPGEF5, 71534, 173984, 75-1409; 14158, RAPGEF6, 71538, 173988, 94-560; 14158, RAPGEF6, 71540, 173990, 184-3798; 14158, RAPGEF6, 71541, 173991, 86-552; 14158, RAPGEF6, 71543, 173993, 1-3345; 14158, RAPGEF6, 71544, 173994, 94-542; 14158, RAPGEF6, 71535, 173985, 82-4911; 14158, RAPGEF6, 71536, 173986, 1-4176; 14158, RAPGEF6, 71537, 173987, 207-5012; 14158, RAPGEF6, 71539, 173989, 202-2685; 14158, RAPGEF6, 71542, 173992, 183-4712; 14158, RAPGEF6, 71545, 173995, 130-4644; 14159, RAPGEFL1, 71548, 173998, 160-1677; 14159, RAPGEFL1, 71549, 173999, 479-540; 14159, RAPGEFL1, 71550, 174000, 114-560; 14159, RAPGEFL1, 71551, 174001, 476-779; 14159, RAPGEFL1, 71552, 174002, 196-382; 14159, RAPGEFL1, 71553, 174003, 1-1989; 14159, RAPGEFL1, 71554, 174004, 368-1744; 14159, RAPGEFL1, 71546, 173996, 191-1561; 14159, RAPGEFL1, 71547, 173997, 47-1582; 14160, RAP1GAP, 71555, 174005, 259-2337; 14160, RAP1GAP, 71556, 174006, 311-600; 14160, RAP1GAP, 71557, 174007, 156-2240; 14160, RAP1GAP, 71558, 174008, 10-2256; 14160, RAP1GAP, 71560, 174010, 323-429; 14160, RAP1GAP, 71561, 174011, 191-1999; 14160, RAP1GAP, 71559, 174009, 202-2193; 14160, RAP1GAP, 71562, 174012, 15-2198; 14160, RAP1GAP, 71563, 174013, 304-2349; 14161, RAP1GAP2, 71564, 174014, 91-2283; 14161, RAP1GAP2, 71565, 174015, 91-2238; 14161, RAP1GAP2, 71566, 174016, 237-2372; 14161, RAP1GAP2, 71567, 174017, 47-2239; 14162, RAP1GDS1, 71574, 174024, 1-757; 14162, RAP1GDS1, 71575, 174025, 81-555; 14162, RAP1GDS1, 71576, 174026, 171-290; 14162, RAP1GDS1, 71577, 174027, 144-260; 14162, RAP1GDS1, 71578, 174028, 81-437; 14162, RAP1GDS1, 71579, 174029, 106-579; 14162, RAP1GDS1, 71580, 174030, 183-549; 14162, RAP1GDS1, 71581, 174031, 116-558; 14162, RAP1GDS1, 71582, 174032, 1-304; 14162, RAP1GDS1, 71568, 174018, 136-1686; 14162, RAP1GDS1, 71569, 174019, 49-1875; 14162, RAP1GDS1, 71570, 174020, 150-1829; 14162, RAP1GDS1, 71571, 174021, 114-1937; 14162, RAP1GDS1, 71572, 174022, 49-1725; 14162, RAP1GDS1, 71573, 174023, 98-1921; 14163, RAP1A, 71585, 174035, 280-666; 14163, RAP1A, 71583, 174033, 320-874; 14163, RAP1A, 71584, 174034, 180-734; 14164, RAP1B, 71587, 174037, 135-491; 14164, RAP1B, 71589, 174039, 371-468; 14164, RAP1B, 71591, 174041, 384-855; 14164, RAP1B, 71592, 174042, 274-640; 14164, RAP1B, 71593, 174043, 340-633; 14164, RAP1B, 71594, 174044, 299-552; 14164, RAP1B, 71597, 174047, 155-571; 14164, RAP1B, 71598, 174048, 391-550; 14164, RAP1B, 71599, 174049, 132-542; 14164, RAP1B, 71601, 174051, 345-606; 14164, RAP1B, 71602, 174052, 201-509; 14164, RAP1B, 71603, 174053, 46-585; 14164, RAP1B, 71604, 174054, 148-530; 14164, RAP1B, 71605, 174055, 223-587; 14164, RAP1B, 71606, 174056, 288-591; 14164, RAP1B, 71608, 174058, 167-312; 14164, RAP1B, 71609, 174059, 141-497; 14164, RAP1B, 71610, 174060, 283-561; 14164, RAP1B, 71611, 174061, 448-480; 14164, RAP1B, 71612, 174062, 529-561; 14164, RAP1B, 71586, 174036, 232-786; 14164, RAP1B, 71588, 174038, 222-776; 14164, RAP1B, 71590, 174040, 163-591; 14164, RAP1B, 71595, 174045, 366-920; 14164, RAP1B, 71596, 174046, 142-555; 14164, RAP1B, 71600, 174050, 156-710; 14164, RAP1B, 71607, 174057, 151-579; 14164, RAP1B, 71613, 174063, 146-643; 14165, RAP2A, 71615, 174065, 1-327; 14165, RAP2A, 71614, 174064, 250-801; 14166, RAP2B, 71616, 174066, 425-976; 14167, RAP2C, 71619, 174069, 390-743; 14167, RAP2C, 71617, 174067, 748-1299; 14167, RAP2C, 71618, 174068, 810-1361; 14168, RORA, 71621, 174071, 71-1717; 14168, RORA, 71623, 174073, 125-1531; 14168, RORA, 71624, 174074, 1-188; 14168, RORA, 71625, 174075, 118-577; 14168, RORA, 71626, 174076, 1-117; 14168, RORA, 71620, 174070, 90-1760; 14168, RORA, 71622, 174072, 102-1673; 14169, RORB, 71627, 174077, 613-1992; 14169, RORB, 71628, 174078, 1-1413; 14170, RORC, 71629, 174079, 109-1665; 14170, RORC, 71630, 174080, 156-1649; 14171, REM2, 71631, 174081, 124-1146; 14171, REM2, 71632, 174082, 67-732; 14172, REM1, 71633, 174083, 294-1190; 14173, RASEF, 71634, 174084, 311-880; 14173, RASEF, 71635, 174085, 262-2484; 14174, RIN1, 71637, 174087, 35-277; 14174, RIN1, 71638, 174088, 1-221; 14174, RIN1, 71639, 174089, 216-2069; 14174, RIN1, 71640, 174090, 1-243; 14174, RIN1, 71636, 174086, 128-2479; 14175, RIN2, 71642, 174092, 37-1425; 14175, RIN2, 71641, 174091, 150-2984; 14176, RIN3, 71644, 174094, 141-620; 14176, RIN3, 71645, 174095, 1-1261; 14176, RIN3, 71646, 174096, 130-366; 14176, RIN3, 71647, 174097, 141-2882; 14176, RIN3, 71643, 174093, 160-3117; 14177, RINL, 71648, 174098, 366-1724; 14177, RINL, 71649, 174099, 88-1788; 14177, RINL, 71650, 174100, 183-346; 14177, RINL, 71651, 174101, 1-520; 14178, RINL, 71653, 174103, 1-520; 14178, RINL, 71655, 174105, 183-346; 14178, RINL, 71652, 174102, 88-1788; 14178, RINL, 71654, 174104, 366-1724; 14179, RAPH1, 71658, 174108, 1-3909; 14179, RAPH1, 71660, 174110, 153-1937; 14179, RAPH1, 71665, 174115, 226-492; 14179, RAPH1, 71666, 174116, 70-585; 14179, RAPH1, 71667, 174117, 226-4134; 14179, RAPH1, 71656, 174106, 226-2160; 14179, RAPH1, 71657, 174107, 301-4053; 14179, RAPH1, 71659, 174109, 1-1779; 14179, RAPH1, 71661, 174111, 1-1794; 14179, RAPH1, 71662, 174112, 1-1860; 14179, RAPH1, 71663, 174113, 226-2175; 14179, RAPH1, 71664, 174114, 1-1854; 14180, RASSF10, 71668, 174118, 1-1524; 14181, RASSF7, 71673, 174123, 71-433; 14181, RASSF7, 71674, 174124, 223-473; 14181, RASSF7, 71675, 174125, 1-584; 14181, RASSF7, 71676, 174126, 86-1099; 14181, RASSF7, 71678, 174128, 434-1555; 14181, RASSF7, 71679, 174129, 119-1132; 14181, RASSF7, 71680, 174130, 223-473; 14181, RASSF7, 71681, 174131, 1-584; 14181, RASSF7, 71682, 174132, 71-433; 14181, RASSF7, 71669, 174119, 86-1099; 14181, RASSF7, 71670, 174120, 434-1555; 14181, RASSF7, 71671, 174121, 119-1132; 14181, RASSF7, 71672, 174122, 36-998; 14181, RASSF7, 71677, 174127, 36-998; 14182, RASSF8, 71687, 174137, 188-555; 14182, RASSF8, 71688, 174138, 251-523; 14182, RASSF8, 71689, 174139, 1-627; 14182, RASSF8, 71690, 174140, 195-853; 14182, RASSF8, 71692, 174142, 100-577; 14182, RASSF8, 71693, 174143, 499-587; 14182, RASSF8, 71694, 174144, 148-772; 14182, RASSF8, 71695, 174145, 109-438; 14182, RASSF8, 71683, 174133, 542-1801; 14182, RASSF8, 71684, 174134, 323-1501; 14182, RASSF8, 71685, 174135, 200-1459; 14182, RASSF8, 71686, 174136, 293-1552; 14182, RASSF8, 71691, 174141, 193-1452; 14182, RASSF8, 71696, 174146, 150-1328; 14183, RASSF9, 71697, 174147, 370-1677; 14184, RASSF1, 71698, 174148, 146-958; 14184, RASSF1, 71699, 174149, 37-1071; 14184, RASSF1, 71700, 174150, 108-1130; 14184, RASSF1, 71701, 174151, 37-315; 14184, RASSF1, 71702, 174152, 295-864; 14184, RASSF1, 71703, 174153, 108-566; 14184, RASSF1, 71704, 174154, 478-1047; 14185, RASSF2, 71705, 174155, 55-1035; 14185, RASSF2, 71706, 174156, 197-1177; 14186, RASSF3, 71707, 174157, 121-393; 14186, RASSF3, 71708, 174158, 44-760; 14186, RASSF3, 71709, 174159, 121-837; 14187, RASSF4, 71711, 174161, 75-528; 14187, RASSF4, 71712, 174162, 1-372; 14187, RASSF4, 71713, 174163, 67-216; 14187, RASSF4, 71714, 174164, 1-253; 14187, RASSF4, 71710, 174160, 114-1079; 14188, RASSF5, 71718, 174168, 9-1061; 14188, RASSF5, 71719, 174169, 1-558; 14188, RASSF5, 71715, 174165, 74-1330; 14188, RASSF5, 71716, 174166, 58-1068; 14188, RASSF5, 71717, 174167, 410-1207; 14189, RASSF6, 71720, 174170, 296-1309; 14189, RASSF6, 71721, 174171, 1-978; 14189, RASSF6, 71722, 174172, 132-1241; 14189, RASSF6, 71723, 174173, 160-1071; 14190, RADIL, 71725, 174175, 166-567; 14190, RADIL, 71726, 174176, 124-1347; 14190, RADIL, 71724, 174174, 189-3416; 14191, RCE1, 71728, 174178, 217-837; 14191, RCE1, 71729, 174179, 6-314; 14191, RCE1, 71730, 174180, 20-946; 14191, RCE1, 71727, 174177, 45-1034; 14192, RASGRP1, 71734, 174184, 179-2572; 14192, RASGRP1, 71736, 174186, 87-2633; 14192, RASGRP1, 71737, 174187, 208-304; 14192, RASGRP1, 71738, 174188, 1-2436; 14192, RASGRP1, 71739, 174189, 1-372; 14192, RASGRP1, 71740, 174190, 260-547; 14192, RASGRP1, 71741, 174191, 377-548; 14192, RASGRP1, 71742, 174192, 1-654; 14192, RASGRP1, 71731, 174181, 179-2572; 14192, RASGRP1, 71732, 174182, 8-2296; 14192, RASGRP1, 71733, 174183, 8-1453; 14192, RASGRP1, 71735, 174185, 8-1801; 14192, RASGRP1, 71743, 174193, 8-1648; 14193, RASGRP2, 71745, 174195, 137-429; 14193, RASGRP2, 71746, 174196, 215-661; 14193, RASGRP2, 71747, 174197, 190-636; 14193, RASGRP2, 71748, 174198, 131-577; 14193, RASGRP2, 71751, 174201, 72-263; 14193, RASGRP2, 71752, 174202, 72-272; 14193, RASGRP2, 71753, 174203, 1724-2170; 14193, RASGRP2, 71755, 174205, 360-400; 14193, RASGRP2, 71756, 174206, 81-461; 14193, RASGRP2, 71757, 174207, 162-539; 14193, RASGRP2, 71758, 174208, 240-935; 14193, RASGRP2, 71759, 174209, 348-598; 14193, RASGRP2, 71760, 174210, 192-383; 14193, RASGRP2, 71744, 174194, 254-2083; 14193, RASGRP2, 71749, 174199, 924-2756; 14193, RASGRP2, 71750, 174200, 165-1994; 14193, RASGRP2, 71754, 174204, 248-2077; 14194, RASGRP3, 71764, 174214, 218-557; 14194, RASGRP3, 71765, 174215, 346-861; 14194, RASGRP3, 71766, 174216, 218-554; 14194, RASGRP3, 71767, 174217, 439-540; 14194, RASGRP3, 71768, 174218, 366-596; 14194, RASGRP3, 71769, 174219, 1-417; 14194, RASGRP3, 71761, 174211, 273-2342; 14194, RASGRP3, 71762, 174212, 741-2813; 14194, RASGRP3, 71763, 174213, 653-2725; 14195, RASGRP4, 71782, 174232, 215-2068; 14195, RASGRP4, 71770, 174220, 215-1945; 14195, RASGRP4, 71771, 174221, 215-1960; 14195, RASGRP4, 71772, 174222, 215-2134; 14195, RASGRP4, 71773, 174223, 215-1669; 14195, RASGRP4, 71774, 174224, 215-2236; 14195, RASGRP4, 71775, 174225, 72-2093; 14195, RASGRP4, 71776, 174226, 215-2194; 14195, RASGRP4, 71777, 174227, 97-2076; 14195, RASGRP4, 71778, 174228, 215-2029; 14195, RASGRP4, 71779, 174229, 215-1960; 14195, RASGRP4, 71780, 174230, 215-2236; 14195, RASGRP4, 71781, 174231, 215-1945; 14195, RASGRP4, 71783, 174233, 215-1669; 14196, RHEB, 71785, 174235, 443-501; 14196, RHEB, 71786, 174236, 341-484; 14196, RHEB, 71787, 174237, 487-726; 14196, RHEB, 71788, 174238, 416-655; 14196, RHEB, 71784, 174234, 414-968; 14197, RHEBL1, 71790, 174240, 163-291; 14197, RHEBL1, 71792, 174242, 53-380; 14197, RHEBL1, 71789, 174239, 241-792; 14197, RHEBL1, 71791, 174241, 241-447; 14198, RHOA, 71793, 174243, 112-384; 14198, RHOA, 71795, 174245, 247-633; 14198, RHOA, 71796, 174246, 154-717; 14198, RHOA, 71794, 174244, 386-967; 14199, RHOB, 71797, 174247, 393-983; 14200, RHOC, 71802, 174252, 51-650; 14200, RHOC, 71806, 174256, 301-866; 14200, RHOC, 71807, 174257, 196-470; 14200, RHOC, 71808, 174258, 135-517; 14200, RHOC, 71809, 174259, 57-257; 14200, RHOC, 71810, 174260, 90-290; 14200, RHOC, 71811, 174261, 133-333; 14200, RHOC, 71812, 174262, 134-521; 14200, RHOC, 71813, 174263, 67-574; 14200, RHOC, 71798, 174248, 1211-1792; 14200, RHOC, 71799, 174249, 403-984; 14200, RHOC, 71800, 174250, 425-1006; 14200, RHOC, 71801, 174251, 301-882; 14200, RHOC, 71803, 174253, 80-661; 14200, RHOC, 71804, 174254, 182-763; 14200, RHOC, 71805, 174255, 365-946; 14201, RHOD, 71815, 174265, 15-449; 14201, RHOD, 71814, 174264, 86-718; 14202, RHOF, 71817, 174267, 332-670; 14202, RHOF, 71818, 174268, 284-619; 14202, RHOF, 71819, 174269, 1536-1626; 14202, RHOF, 71820, 174270, 994-1219; 14202, RHOF, 71816, 174266, 630-1265; 14202, RHOF, 71821, 174271, 630-1142; 14203, RHOG, 71822, 174272, 159-734; 14203, RHOG, 71823, 174273, 344-919; 14203, RHOG, 71824, 174274, 133-708; 14203, RHOG, 71825, 174275, 193-768; 14204, RHOH, 71827, 174277, 553-571; 14204, RHOH, 71828, 174278, 827-874; 14204, RHOH, 71829, 174279, 488-814; 14204, RHOH, 71831, 174281, 481-789; 14204, RHOH, 71826, 174276, 725-1300; 14204, RHOH, 71830, 174280, 617-1192; 14204, RHOH, 71832, 174282, 737-1312; 14204, RHOH, 71833, 174283, 891-1466; 14204, RHOH, 71834, 174284, 779-1354; 14204, RHOH, 71835, 174285, 488-1063; 14204, RHOH, 71836, 174286, 850-1425; 14204, RHOH, 71837, 174287, 853-1428; 14204, RHOH, 71838, 174288, 877-1452; 14204, RHOH, 71839, 174289, 495-1070; 14205, RHOJ, 71841, 174291, 12-548; 14205, RHOJ, 71842, 174292, 757-1218; 14205, RHOJ, 71840, 174290, 463-1107; 14206, RHOQ, 71844, 174294, 312-464; 14206, RHOQ, 71845, 174295, 450-674; 14206, RHOQ, 71846, 174296, 1-276; 14206, RHOQ, 71847, 174297, 1-103; 14206, RHOQ, 71848, 174298, 1-642; 14206, RHOQ, 71843, 174293, 320-937; 14207, RHOT1, 71850, 174300, 193-1986; 14207, RHOT1, 71854, 174304, 1-174; 14207, RHOT1, 71855, 174305, 21-176; 14207, RHOT1, 71857, 174307, 219-374; 14207, RHOT1, 71858, 174308, 1-403; 14207, RHOT1, 71860, 174310, 1-123; 14207, RHOT1, 71861, 174311, 1-570; 14207, RHOT1, 71862, 174312, 1-471; 14207, RHOT1, 71849, 174299, 240-2096; 14207, RHOT1, 71851, 174301, 228-2303; 14207, RHOT1, 71852, 174302, 14-1966; 14207, RHOT1, 71853, 174303, 157-2136; 14207, RHOT1, 71856, 174306, 64-1806; 14207, RHOT1, 71859, 174309, 126-2003; 14208, RHOT2, 71864, 174314, 96-503; 14208, RHOT2, 71865, 174315, 48-215; 14208, RHOT2, 71866, 174316, 50-292; 14208, RHOT2, 71867, 174317, 1-625; 14208, RHOT2, 71868, 174318, 1-467; 14208, RHOT2, 71869, 174319, 14-421; 14208, RHOT2, 71870, 174320, 50-268; 14208, RHOT2, 71871, 174321, 95-736; 14208, RHOT2, 71863, 174313, 115-1971; 14209, RHOU, 71872, 174322, 667-1443; 14210, RHOV, 71873, 174323, 151-861; 14211, RASIP1, 71875, 174325, 1-546; 14211, RASIP1, 71876, 174326, 66-2954; 14211, RASIP1, 71874, 174324, 206-3097; 14212, RASA1, 71879, 174329, 118-2763; 14212, RASA1, 71877, 174327, 565-3708; 14212, RASA1, 71878, 174328, 116-2728; 14212, RASA1, 71880, 174330, 202-2844; 14212, RASA1, 71881, 174331, 565-2184; 14213, RASA2, 71883, 174333, 1-2562; 14213, RASA2, 71884, 174334, 38-181; 14213, RASA2, 71882, 174332, 36-2585; 14214, RASA3, 71886, 174336, 123-2627; 14214, RASA3, 71885, 174335, 123-2627; 14215, RASA4, 71889, 174339, 359-2554; 14215, RASA4, 71890, 174340, 601-2796; 14215, RASA4, 71891, 174341, 322-485; 14215, RASA4, 71892, 174342, 1-817; 14215, RASA4, 71893, 174343, 223-516; 14215, RASA4, 71894, 174344, 1-412; 14215, RASA4, 71895, 174345, 50-967; 14215, RASA4, 71896, 174346, 1-483; 14215, RASA4, 71887, 174337, 69-2480; 14215, RASA4, 71888, 174338, 68-2341; 14216, RASA4B, 71897, 174347, 364-2559; 14216, RASA4B, 71899, 174349, 68-2341; 14216, RASA4B, 71898, 174348, 72-2483; 14217, RASAL1, 71900, 174350, 317-2731; 14217, RASAL1, 71901, 174351, 289-2619; 14217, RASAL1, 71902, 174352, 43-2460; 14217, RASAL1, 71903, 174353, 287-2707; 14218, RASAL2, 71905, 174355, 1-2080; 14218, RASAL2, 71904, 174354, 353-4195; 14218, RASAL2, 71906, 174356, 126-3545; 14219, RASAL3, 71908, 174358, 1-1336; 14219, RASAL3, 71909, 174359, 1-687; 14219, RASAL3, 71907, 174357, 87-3122; 14220, RASGRF1, 71910, 174360, 1179-2648; 14220, RASGRF1, 71911, 174361, 276-4097; 14220, RASGRF1, 71912, 174362, 267-4040; 14221, RASGRF2, 71914, 174364, 51-3506; 14221, RASGRF2, 71913, 174363, 68-3781; 14222, RREB1, 71919, 174369, 500-2833; 14222, RREB1, 71920, 174370, 529-1021; 14222, RREB1, 71921, 174371, 590-998; 14222, RREB1, 71922, 174372, 232-243; 14222, RREB1, 71923, 174373, 252-2519; 14222, RREB1, 71915, 174365, 315-5378; 14222, RREB1, 71916, 174366, 315-4745; 14222, RREB1, 71917, 174367, 457-5520; 14222, RREB1, 71918, 174368, 538-5766; 14223, RSU1, 71924, 174374, 218-1051; 14223, RSU1, 71925, 174375, 303-1136; 14223, RSU1, 71926, 174376, 191-865; 14224, RASD1, 71927, 174377, 213-1058; 14224, RASD1, 71928, 174378, 215-583; 14225, RASD2, 71929, 174379, 643-1443; 14226, RASGEF1A, 71930, 174380, 1-632; 14226, RASGEF1A, 71931, 174381, 86-1555; 14226, RASGEF1A, 71932, 174382, 2508-3953; 14226, RASGEF1A, 71933, 174383, 82-1527; 14227, RASGEF1B, 71936, 174386, 128-760; 14227, RASGEF1B, 71938, 174388, 163-860; 14227, RASGEF1B, 71939, 174389, 487-516; 14227, RASGEF1B, 71940, 174390, 128-760; 14227, RASGEF1B, 71934, 174384, 153-1574; 14227, RASGEF1B, 71935, 174385, 142-1437; 14227, RASGEF1B, 71937, 174387, 223-1641; 14228, RASGEF1C, 71944, 174394, 217-933; 14228, RASGEF1C, 71945, 174395, 578-1294; 14228, RASGEF1C, 71941, 174391, 133-1533; 14228, RASGEF1C, 71942, 174392, 298-1698; 14228, RASGEF1C, 71943, 174393, 415-1362; 14229, RIT1, 71949, 174399, 146-424; 14229, RIT1, 71950, 174400, 121-574; 14229, RIT1, 71946, 174396, 31-741; 14229, RIT1, 71947, 174397, 206-865; 14229, RIT1, 71948, 174398, 163-714; 14230, RIT2, 71952, 174402, 131-640; 14230, RIT2, 71951, 174401, 173-826; 14230, RIT2, 71953, 174403, 173-634; 14231, RERG, 71956, 174406, 235-574; 14231, RERG, 71957, 174407, 540-655; 14231, RERG, 71959, 174409, 327-539; 14231, RERG, 71954, 174404, 338-937; 14231, RERG, 71955, 174405, 242-841; 14231, RERG, 71958, 174408, 141-740; 14231, RERG, 71960, 174410, 338-880; 14232, RASL10A, 71961, 174411, 511-1122; 14232, RASL10A, 71962, 174412, 447-794; 14233, RASL10B, 71963, 174413, 378-989; 14234, RASL11A, 71964, 174414, 619-1347; 14235, RASL11B, 71965, 174415, 219-965; 14236, RASL12, 71966, 174416, 278-1078; 14236, RASL12, 71967, 174417, 109-852; 14236, RASL12, 71968, 174418, 93-860; 14237, RRAD, 71971, 174421, 1-409; 14237, RRAD, 71972, 174422, 1-484; 14237, RRAD, 71969, 174419, 252-1178; 14237, RRAD, 71970, 174420, 153-1079; 14238, RAC1, 71973, 174423, 214-792; 14238, RAC1, 71974, 174424, 198-833; 14239, RAC2, 71976, 174426, 257-703; 14239, RAC2, 71977, 174427, 285-842; 14239, RAC2, 71978, 174428, 101-361; 14239, RAC2, 71979, 174429, 207-705; 14239, RAC2, 71975, 174425, 123-701; 14240, RAC3, 71981, 174431, 341-730; 14240, RAC3, 71982, 174432, 424-831; 14240, RAC3, 71980, 174430, 139-717; 14241, RRAGA, 71983, 174433, 266-1207; 14242, RRAGB, 71986, 174436, 63-644; 14242, RRAGB, 71984, 174434, 444-1568; 14242, RRAGB, 71985, 174435, 590-1630; 14243, RRAGC, 71987, 174437, 178-1377; 14244, RRAGD, 71988, 174438, 235-984; 14244, RRAGD, 71989, 174439, 278-1480; 14245, N/A, 71990, 174440, 1-495; 14245, N/A, 71991, 174441, 149-703; 14246, RB1CC1, 71994, 174444, 312-440; 14246, RB1CC1, 71995, 174445, 462-507; 14246, RB1CC1, 71996, 174446, 554-711; 14246, RB1CC1, 71997, 174447, 334-551; 14246, RB1CC1, 71998, 174448, 1-328; 14246, RB1CC1, 71999, 174449, 1-383; 14246, RB1CC1, 71992, 174442, 525-5309; 14246, RB1CC1, 71993, 174443, 516-5291; 14247, RBAK-RBAKDN, 72000, 174450, 93-434; 14247, RBAK-RBAKDN, 72001, 174451, 267-998; 14248, RBAK, 72002, 174452, 325-2469; 14248, RBAK, 72003, 174453, 520-2664; 14249, RBBP8NL, 72004, 174454, 158-2152; 14250, RBM14-RBM4, 72005, 174455, 96-1115; 14250, RBM14-RBM4, 72006, 174456, 91-534; 14250, RBM14-RBM4, 72007, 174457, 52-408; 14251, RITA1, 72011, 174461, 1-117; 14251, RITA1, 72008, 174458, 685-1494; 14251, RITA1, 72009, 174459, 473-1354; 14251, RITA1, 72010, 174460, 693-1502; 14252, RCAN3, 72017, 174467, 1-326; 14252, RCAN3, 72012, 174462, 1-348; 14252, RCAN3, 72013, 174463, 314-1039; 14252, RCAN3, 72014, 174464, 54-575; 14252, RCAN3, 72015, 174465, 222-917; 14252, RCAN3, 72016, 174466, 281-832; 14252, RCAN3, 72018, 174468, 173-898; 14252, RCAN3, 72019, 174469, 435-785; 14252, RCAN3, 72020, 174470, 195-920; 14252, RCAN3, 72021, 174471, 294-644; 14252, RCAN3, 72022, 174472, 27-578; 14253, RCCD1, 72024, 174474, 192-1316; 14253, RCCD1, 72025, 174475, 1-235; 14253, RCCD1, 72023, 174473, 203-1333; 14253, RCCD1, 72026, 174476, 123-1253; 14254, RQCD1, 72029, 174479, 97-324; 14254, RQCD1, 72030, 174480, 1-186; 14254, RQCD1, 72031, 174481, 141-266; 14254, RQCD1, 72027, 174477, 376-1275; 14254, RQCD1, 72028, 174478, 81-857; 14254, RQCD1, 72032, 174482, 248-1147; 14254, RQCD1, 72033, 174483, 376-

1371; 14255, RCSD1, 72034, 174484, 232-822; 14255, RCSD1, 72036, 174486, 332-1492; 14255, RCSD1, 72035, 174485, 332-1582; 14256, REST, 72038, 174488, 34-1056; 14256, REST, 72039, 174489, 130-1074; 14256, REST, 72040, 174490, 348-1370; 14256, REST, 72041, 174491, 348-1376; 14256, REST, 72037, 174487, 315-3608; 14256, REST, 72042, 174492, 137-3430; 14257, ROMO1, 72043, 174493, 183-422; 14257, ROMO1, 72044, 174494, 16-195; 14257, ROMO1, 72045, 174495, 105-344; 14257, ROMO1, 72046, 174496, 181-420; 14257, ROMO1, 72047, 174497, 45-284; 14258, RLF, 72048, 174498, 28-5772; 14259, REC114, 72050, 174500, 23-739; 14259, REC114, 72049, 174499, 29-829; 14260, REC8, 72051, 174501, 1-1007; 14260, REC8, 72052, 174502, 374-653; 14260, REC8, 72053, 174503, 413-635; 14260, REC8, 72054, 174504, 529-2172; 14260, REC8, 72055, 174505, 600-2243; 14261, RTP1, 72056, 174506, 31-822; 14262, RTP2, 72057, 174507, 430-1107; 14263, RTP3, 72058, 174508, 573-1271; 14264, RTP4, 72059, 174509, 111-851; 14265, RTP5, 72061, 174511, 158-325; 14265, RTP5, 72063, 174513, 158-325; 14265, RTP5, 72060, 174510, 29-1747; 14265, RTP5, 72062, 174512, 29-1747; 14266, RAMP1, 72065, 174515, 250-630; 14266, RAMP1, 72066, 174516, 43-423; 14266, RAMP1, 72067, 174517, 181-561; 14266, RAMP1, 72064, 174514, 133-579; 14267, RAMP2, 72069, 174519, 5-343; 14267, RAMP2, 72071, 174521, 400-548; 14267, RAMP2, 72072, 174522, 367-669; 14267, RAMP2, 72068, 174518, 69-596; 14267, RAMP2, 72070, 174520, 5-547; 14268, RAMP3, 72074, 174524, 1-456; 14268, RAMP3, 72073, 174523, 39-485; 14268, RAMP3, 72075, 174525, 1-447; 14269, RIPK1, 72076, 174526, 299-2314; 14269, RIPK1, 72077, 174527, 1-2016; 14270, REEP1, 72079, 174529, 8-578; 14270, REEP1, 72080, 174530, 126-546; 14270, REEP1, 72081, 174531, 80-440; 14270, REEP1, 72085, 174535, 1-443; 14270, REEP1, 72078, 174528, 145-750; 14270, REEP1, 72082, 174532, 153-677; 14270, REEP1, 72083, 174533, 8-634; 14270, REEP1, 72084, 174534, 145-576; 14271, REEP2, 72088, 174538, 297-941; 14271, REEP2, 72089, 174539, 99-221; 14271, REEP2, 72090, 174540, 1-572; 14271, REEP2, 72091, 174541, 83-538; 14271, REEP2, 72086, 174536, 123-881; 14271, REEP2, 72087, 174537, 193-957; 14272, REEP3, 72093, 174543, 1-255; 14272, REEP3, 72092, 174542, 184-951; 14273, REEP4, 72096, 174546, 59-814; 14273, REEP4, 72097, 174547, 470-635; 14273, REEP4, 72094, 174544, 470-1243; 14273, REEP4, 72095, 174545, 372-893; 14274, REEP5, 72098, 174548, 188-683; 14274, REEP5, 72100, 174550, 1-436; 14274, REEP5, 72101, 174551, 100-399; 14274, REEP5, 72102, 174552, 38-406; 14274, REEP5, 72099, 174549, 350-919; 14275, REEP6, 72104, 174554, 1-452; 14275, REEP6, 72105, 174555, 1-420; 14275, REEP6, 72103, 174553, 524-1078; 14276, ROR1, 72108, 174558, 77-2725; 14276, ROR1, 72106, 174556, 376-3189; 14276, ROR1, 72107, 174557, 397-1578; 14277, ROR2, 72110, 174560, 598-2712; 14277, ROR2, 72109, 174559, 200-3031; 14278, RAPSN, 72113, 174563, 173-1234; 14278, RAPSN, 72114, 174564, 173-1252; 14278, RAPSN, 72111, 174561, 180-1241; 14278, RAPSN, 72112, 174562, 215-1453; 14279, RIPK2, 72116, 174566, 245-457; 14279, RIPK2, 72117, 174567, 256-462; 14279, RIPK2, 72115, 174565, 315-1937; 14280, RIPK3, 72119, 174569, 1-488; 14280, RIPK3, 72118, 174568, 220-1776; 14280, RIPK3, 72120, 174570, 164-859; 14281, RIPK4, 72121, 174571, 49-2547; 14281, RIPK4, 72122, 174572, 66-2420; 14282, RYK, 72123, 174573, 1-280; 14282, RYK, 72124, 174574, 1-1647; 14282, RYK, 72125, 174575, 91-1923; 14282, RYK, 72126, 174576, 91-1914; 14282, RYK, 72127, 174577, 1-474; 14283, RAG1, 72128, 174578, 113-3244; 14283, RAG1, 72129, 174579, 637-3432; 14284, RAG2, 72131, 174581, 137-139; 14284, RAG2, 72132, 174582, 121-572; 14284, RAG2, 72133, 174583, 358-569; 14284, RAG2, 72130, 174580, 163-1746; 14284, RAG2, 72134, 174584, 595-2178; 14285, RBPJ, 72141, 174591, 1-405; 14285, RBPJ, 72142, 174592, 136-607; 14285, RBPJ, 72143, 174593, 252-572; 14285, RBPJ, 72144, 174594, 131-698; 14285, RBPJ, 72145, 174595, 248-578; 14285, RBPJ, 72146, 174596, 261-795; 14285, RBPJ, 72147, 174597, 177-1325; 14285, RBPJ, 72149, 174599, 302-731; 14285, RBPJ, 72150, 174600, 327-609; 14285, RBPJ, 72151, 174601, 409-555; 14285, RBPJ, 72152, 174602, 196-340; 14285, RBPJ, 72153, 174603, 231-569; 14285, RBPJ, 72154, 174604, 276-566; 14285, RBPJ, 72155, 174605, 674-758; 14285, RBPJ, 72156, 174606, 28-716; 14285, RBPJ, 72157, 174607, 23-184; 14285, RBPJ, 72135, 174585, 166-1623; 14285, RBPJ, 72136, 174586, 230-1693; 14285, RBPJ, 72137, 174587, 177-1637; 14285, RBPJ, 72138, 174588, 237-1739; 14285, RBPJ, 72139, 174589, 409-1869; 14285, RBPJ, 72140, 174590, 195-1697; 14285, RBPJ, 72148, 174598, 116-1513; 14286, RBPJL, 72159, 174609, 73-1488; 14286, RBPJL, 72161, 174611, 1-554; 14286, RBPJL, 72158, 174608, 73-1626; 14286, RBPJL, 72160, 174610, 73-1623; 14287, RCVRN, 72162, 174612, 442-1044; 14288, RECQL, 72163, 174613, 456-1054; 14288, RECQL, 72164, 174614, 299-932; 14288, RECQL, 72167, 174617, 247-565; 14288, RECQL, 72168, 174618, 362-579; 14288, RECQL, 72169, 174619, 207-600; 14288, RECQL, 72170, 174620, 289-578; 14288, RECQL, 72165, 174615, 231-2180; 14288, RECQL, 72166, 174616, 470-2419; 14289, RECQL4, 72171, 174621, 1-47; 14289, RECQL4, 72172, 174622, 1-112; 14289, RECQL4, 72173, 174623, 1-1055; 14289, RECQL4, 72174, 174624, 1-686; 14289, RECQL4, 72175, 174625, 1-1165; 14289, RECQL4, 72176, 174626, 1-882; 14289, RECQL4, 72177, 174627, 43-3669; 14289, RECQL4, 72178, 174628, 1198-3753; 14290, RECQL5, 72183, 174633, 1-356; 14290, RECQL5, 72185, 174635, 1-709; 14290, RECQL5, 72186, 174636, 1-596; 14290, RECQL5, 72187, 174637, 1-619; 14290, RECQL5, 72188, 174638, 532-1972; 14290, RECQL5, 72189, 174639, 377-948; 14290, RECQL5, 72179, 174629, 161-3136; 14290, RECQL5, 72180, 174630, 161-1468; 14290, RECQL5, 72181, 174631, 114-3008; 14290, RECQL5, 72182, 174632, 161-1393; 14290, RECQL5, 72184, 174634, 337-1644; 14291, RMI1, 72191, 174641, 307-1553; 14291, RMI1, 72192, 174642, 149-1561; 14291, RMI1, 72190, 174640, 333-2210; 14292, RMI2, 72194, 174644, 23-106; 14292, RMI2, 72193, 174643, 42-485; 14292, RMI2, 72195, 174645, 646-900; 14293, RELN, 72197, 174647, 161-10543; 14293, RELN, 72199, 174649, 1-206; 14293, RELN, 72196, 174646, 161-10537; 14293, RELN, 72198, 174648, 161-10543; 14294, REG1A, 72200, 174650, 104-604; 14295, REG1B, 72202, 174652, 1-450; 14295, REG1B, 72201, 174651, 82-582; 14296, REG3A, 72203, 174653, 57-584; 14296, REG3A, 72204, 174654, 349-876; 14296, REG3A, 72205, 174655, 38-565; 14297, REG3G, 72206, 174656, 185-712; 14297, REG3G, 72207, 174657, 100-627; 14297, REG3G, 72208, 174658, 159-548; 14298, REG4, 72212, 174662, 37-348; 14298, REG4, 72209, 174659, 347-823; 14298, REG4, 72210, 174660, 441-917; 14298, REG4, 72211, 174661, 267-671; 14299, RGN, 72213, 174663, 346-1245; 14299, RGN, 72214, 174664, 94-993; 14299, RGN, 72215, 174665, 991-1890; 14299, RGN, 72216, 174666, 991-1674; 14300, RESP18, 72218, 174668, 247-522; 14300, RESP18, 72217, 174667, 1-687; 14301, RIMS1, 72220, 174670, 1-2223; 14301,

RIMS1, 72222, 174672, 241-2500; 14301, RIMS1, 72228, 174678, 1-1832; 14301, RIMS1, 72231, 174681, 1-3115; 14301, RIMS1, 72219, 174669, 1-4626; 14301, RIMS1, 72221, 174671, 313-3351; 14301, RIMS1, 72223, 174673, 191-850; 14301, RIMS1, 72224, 174674, 341-2623; 14301, RIMS1, 72225, 174675, 231-2684; 14301, RIMS1, 72226, 174676, 430-2910; 14301, RIMS1, 72227, 174677, 1-5079; 14301, RIMS1, 72229, 174679, 1-4428; 14301, RIMS1, 72230, 174680, 322-4767; 14301, RIMS1, 72232, 174682, 1-4116; 14301, RIMS1, 72233, 174683, 1-4029; 14301, RIMS1, 72234, 174684, 1-3876; 14302, RIMS2, 72237, 174687, 371-1783; 14302, RIMS2, 72238, 174688, 122-3880; 14302, RIMS2, 72239, 174689, 242-4345; 14302, RIMS2, 72241, 174691, 289-2285; 14302, RIMS2, 72243, 174693, 289-1062; 14302, RIMS2, 72244, 174694, 1-3181; 14302, RIMS2, 72245, 174695, 137-3500; 14302, RIMS2, 72246, 174696, 1-1112; 14302, RIMS2, 72235, 174685, 249-3815; 14302, RIMS2, 72236, 174686, 318-1175; 14302, RIMS2, 72240, 174690, 237-3728; 14302, RIMS2, 72242, 174692, 140-4189; 14303, RIMS3, 72247, 174697, 179-1105; 14303, RIMS3, 72248, 174698, 471-1397; 14304, RIMS4, 72249, 174699, 68-877; 14304, RIMS4, 72250, 174700, 1-813; 14305, RPRD1A, 72254, 174704, 1-370; 14305, RPRD1A, 72255, 174705, 173-394; 14305, RPRD1A, 72257, 174707, 1-150; 14305, RPRD1A, 72258, 174708, 1-13; 14305, RPRD1A, 72259, 174709, 154-1022; 14305, RPRD1A, 72251, 174701, 153-1091; 14305, RPRD1A, 72252, 174702, 173-1111; 14305, RPRD1A, 72253, 174703, 323-1153; 14305, RPRD1A, 72256, 174706, 294-1124; 14306, RPRD1B, 72261, 174711, 1-591; 14306, RPRD1B, 72262, 174712, 117-458; 14306, RPRD1B, 72263, 174713, 224-406; 14306, RPRD1B, 72264, 174714, 1-103; 14306, RPRD1B, 72265, 174715, 1-190; 14306, RPRD1B, 72260, 174710, 403-1383; 14307, RPRD2, 72266, 174716, 8-466; 14307, RPRD2, 72267, 174717, 5-4390; 14307, RPRD2, 72268, 174718, 66-4373; 14308, RCAN1, 72271, 174721, 54-887; 14308, RCAN1, 72274, 174724, 488-1216; 14308, RCAN1, 72277, 174727, 76-693; 14308, RCAN1, 72269, 174719, 132-890; 14308, RCAN1, 72270, 174720, 215-808; 14308, RCAN1, 72272, 174722, 49-564; 14308, RCAN1, 72273, 174723, 323-676; 14308, RCAN1, 72275, 174725, 567-920; 14308, RCAN1, 72276, 174726, 733-1086; 14308, RCAN1, 72278, 174728, 265-618; 14309, RCAN2, 72282, 174732, 194-868; 14309, RCAN2, 72279, 174729, 106-837; 14309, RCAN2, 72280, 174730, 190-783; 14309, RCAN2, 72281, 174731, 193-924; 14310, RGCC, 72283, 174733, 150-563; 14311, RCBTB1, 72284, 174734, 45-1640; 14311, RCBTB1, 72285, 174735, 262-1857; 14312, RCBTB2, 72287, 174737, 368-2038; 14312, RCBTB2, 72288, 174738, 648-1481; 14312, RCBTB2, 72286, 174736, 425-2080; 14312, RCBTB2, 72289, 174739, 260-1843; 14313, RCC1, 72294, 174744, 273-1121; 14313, RCC1, 72295, 174745, 181-997; 14313, RCC1, 72296, 174746, 214-903; 14313, RCC1, 72297, 174747, 253-1070; 14313, RCC1, 72298, 174748, 53-1169; 14313, RCC1, 72299, 174749, 36-481; 14313, RCC1, 72290, 174740, 62-1420; 14313, RCC1, 72291, 174741, 183-1448; 14313, RCC1, 72292, 174742, 286-1551; 14313, RCC1, 72293, 174743, 261-1526; 14314, RCC2, 72300, 174750, 48-1616; 14314, RCC2, 72301, 174751, 189-1757; 14315, RGS9BP, 72302, 174752, 858-1565; 14316, RGS1, 72303, 174753, 67-696; 14316, RGS1, 72304, 174754, 21-530; 14317, RGS10, 72305, 174755, 29-550; 14317, RGS10, 72306, 174756, 71-616; 14317, RGS10, 72307, 174757, 64-567; 14318, RGS11, 72308, 174758, 104-358; 14318, RGS11, 72309, 174759, 78-1418; 14318, RGS11, 72310, 174760, 1-1371; 14318, RGS11, 72311, 174761, 19-1422; 14319, RGS12, 72316, 174766, 104-2107; 14319, RGS12, 72312, 174762, 104-4447; 14319, RGS12, 72313, 174763, 905-5248; 14319, RGS12, 72314, 174764, 390-2789; 14319, RGS12, 72315, 174765, 104-4234; 14320, RGS13, 72317, 174767, 289-768; 14320, RGS13, 72318, 174768, 256-735; 14321, RGS14, 72320, 174770, 1-1313; 14321, RGS14, 72319, 174769, 189-1889; 14322, RGS16, 72321, 174771, 150-758; 14323, RGS17, 72322, 174772, 152-784; 14323, RGS17, 72323, 174773, 26-658; 14324, RGS18, 72324, 174774, 182-889; 14325, RGS19, 72325, 174775, 185-838; 14325, RGS19, 72326, 174776, 268-921; 14326, RGS2, 72327, 174777, 32-667; 14327, RGS20, 72331, 174781, 1-177; 14327, RGS20, 72332, 174782, 1-213; 14327, RGS20, 72333, 174783, 353-721; 14327, RGS20, 72328, 174778, 123-848; 14327, RGS20, 72329, 174779, 93-1259; 14327, RGS20, 72330, 174780, 1-822; 14328, RGS21, 72334, 174784, 175-633; 14329, RGS22, 72336, 174786, 1-809; 14329, RGS22, 72338, 174788, 319-564; 14329, RGS22, 72340, 174790, 105-513; 14329, RGS22, 72341, 174791, 591-3842; 14329, RGS22, 72342, 174792, 1-336; 14329, RGS22, 72343, 174793, 486-750; 14329, RGS22, 72344, 174794, 196-3951; 14329, RGS22, 72335, 174785, 196-3990; 14329, RGS22, 72337, 174787, 80-1594; 14329, RGS22, 72339, 174789, 42-3800; 14330, RGS3, 72348, 174798, 418-924; 14330, RGS3, 72350, 174800, 406-1428; 14330, RGS3, 72353, 174803, 350-571; 14330, RGS3, 72354, 174804, 172-913; 14330, RGS3, 72355, 174805, 1-641; 14330, RGS3, 72358, 174808, 149-727; 14330, RGS3, 72345, 174795, 1-3597; 14330, RGS3, 72346, 174796, 72-1880; 14330, RGS3, 72347, 174797, 151-2904; 14330, RGS3, 72349, 174799, 518-2077; 14330, RGS3, 72351, 174801, 210-3806; 14330, RGS3, 72352, 174802, 151-1926; 14330, RGS3, 72356, 174806, 416-1975; 14330, RGS3, 72357, 174807, 435-1370; 14330, RGS3, 72359, 174809, 1-936; 14331, RGS4, 72364, 174814, 121-551; 14331, RGS4, 72366, 174816, 125-466; 14331, RGS4, 72360, 174810, 111-674; 14331, RGS4, 72361, 174811, 125-406; 14331, RGS4, 72362, 174812, 341-958; 14331, RGS4, 72363, 174813, 161-1069; 14331, RGS4, 72365, 174815, 59-622; 14332, RGS5, 72368, 174818, 43-648; 14332, RGS5, 72371, 174821, 64-278; 14332, RGS5, 72367, 174817, 279-824; 14332, RGS5, 72369, 174819, 152-373; 14332, RGS5, 72370, 174820, 69-626; 14332, RGS5, 72372, 174822, 548-769; 14333, RGS6, 72373, 174823, 24-1280; 14333, RGS6, 72375, 174825, 25-1338; 14333, RGS6, 72379, 174829, 32-1651; 14333, RGS6, 72386, 174836, 24-1391; 14333, RGS6, 72374, 174824, 1-1383; 14333, RGS6, 72376, 174826, 1-1428; 14333, RGS6, 72377, 174827, 1-1434; 14333, RGS6, 72378, 174828, 1-1443; 14333, RGS6, 72380, 174830, 179-1576; 14333, RGS6, 72381, 174831, 346-1764; 14333, RGS6, 72382, 174832, 524-1996; 14333, RGS6, 72383, 174833, 92-1564; 14333, RGS6, 72384, 174834, 66-1106; 14333, RGS6, 72385, 174835, 208-1626; 14334, RGS7, 72388, 174838, 177-1412; 14334, RGS7, 72392, 174842, 1-1197; 14334, RGS7, 72393, 174843, 177-1358; 14334, RGS7, 72394, 174844, 1-981; 14334, RGS7, 72387, 174837, 1-1275; 14334, RGS7, 72389, 174839, 68-1501; 14334, RGS7, 72390, 174840, 238-1647; 14334, RGS7, 72391, 174841, 383-1846; 14335, RGS7BP, 72395, 174845, 327-1100; 14336, RGS8, 72400, 174850, 393-563; 14336, RGS8, 72396, 174846, 91-687; 14336, RGS8, 72397, 174847, 301-843; 14336, RGS8, 72398, 174848, 268-810; 14336, RGS8, 72399, 174849, 259-801; 14337, RGS9, 72403, 174853, 94-1980; 14337, RGS9, 72404, 174854, 88-1572; 14337, RGS9, 72401, 174851, 68-2092; 14337, RGS9, 72402, 174852, 73-2088; 14338,

RGSL1, 72405, 174855, 1-90; 14338, RGSL1, 72406, 174856, 576-767; 14338, RGSL1, 72407, 174857, 467-555; 14338, RGSL1, 72408, 174858, 23-487; 14338, RGSL1, 72409, 174859, 21-2975; 14338, RGSL1, 72411, 174861, 18-500; 14338, RGSL1, 72412, 174862, 238-481; 14338, RGSL1, 72413, 174863, 9-149; 14338, RGSL1, 72414, 174864, 438-532; 14338, RGSL1, 72415, 174865, 224-723; 14338, RGSL1, 72416, 174866, 1-173; 14338, RGSL1, 72417, 174867, 465-577; 14338, RGSL1, 72410, 174860, 21-3251; 14339, RMDN1, 72420, 174870, 1-392; 14339, RMDN1, 72421, 174871, 120-314; 14339, RMDN1, 72422, 174872, 1-498; 14339, RMDN1, 72424, 174874, 318-602; 14339, RMDN1, 72425, 174875, 1-676; 14339, RMDN1, 72426, 174876, 182-310; 14339, RMDN1, 72427, 174877, 1-479; 14339, RMDN1, 72428, 174878, 101-847; 14339, RMDN1, 72429, 174879, 65-391; 14339, RMDN1, 72430, 174880, 1-323; 14339, RMDN1, 72431, 174881, 1-455; 14339, RMDN1, 72418, 174868, 161-1105; 14339, RMDN1, 72419, 174869, 56-910; 14339, RMDN1, 72423, 174873, 62-877; 14340, RMDN2, 72432, 174882, 117-1838; 14340, RMDN2, 72434, 174884, 148-1863; 14340, RMDN2, 72435, 174885, 79-1155; 14340, RMDN2, 72438, 174888, 198-724; 14340, RMDN2, 72439, 174889, 96-578; 14340, RMDN2, 72440, 174890, 1-451; 14340, RMDN2, 72441, 174891, 116-830; 14340, RMDN2, 72433, 174883, 124-1356; 14340, RMDN2, 72436, 174886, 195-1427; 14340, RMDN2, 72437, 174887, 127-924; 14341, RMDN3, 72444, 174894, 146-1008; 14341, RMDN3, 72445, 174895, 172-522; 14341, RMDN3, 72446, 174896, 1-919; 14341, RMDN3, 72447, 174897, 179-931; 14341, RMDN3, 72442, 174892, 1069-2481; 14341, RMDN3, 72443, 174893, 186-1598; 14342, RTEL1, 72449, 174899, 271-1339; 14342, RTEL1, 72453, 174903, 1-664; 14342, RTEL1, 72455, 174905, 1-951; 14342, RTEL1, 72448, 174898, 1218-4208; 14342, RTEL1, 72450, 174900, 326-4228; 14342, RTEL1, 72451, 174901, 246-1883; 14342, RTEL1, 72452, 174902, 828-4487; 14342, RTEL1, 72454, 174904, 347-4078; 14343, RPTOR, 72458, 174908, 812-1099; 14343, RPTOR, 72460, 174910, 1-708; 14343, RPTOR, 72456, 174906, 363-4370; 14343, RPTOR, 72457, 174907, 163-3696; 14343, RPTOR, 72459, 174909, 754-1893; 14344, RFX1, 72462, 174912, 413-886; 14344, RFX1, 72461, 174911, 236-3175; 14345, RFX2, 72465, 174915, 162-589; 14345, RFX2, 72466, 174916, 239-337; 14345, RFX2, 72467, 174917, 236-534; 14345, RFX2, 72468, 174918, 1-538; 14345, RFX2, 72469, 174919, 271-565; 14345, RFX2, 72470, 174920, 255-535; 14345, RFX2, 72472, 174922, 97-537; 14345, RFX2, 72473, 174923, 63-569; 14345, RFX2, 72474, 174924, 246-577; 14345, RFX2, 72475, 174925, 131-446; 14345, RFX2, 72463, 174913, 151-2322; 14345, RFX2, 72464, 174914, 106-2277; 14345, RFX2, 72471, 174921, 149-2245; 14346, RFX3, 72478, 174928, 1-258; 14346, RFX3, 72480, 174930, 454-869; 14346, RFX3, 72481, 174931, 293-814; 14346, RFX3, 72482, 174932, 174-822; 14346, RFX3, 72483, 174933, 1-408; 14346, RFX3, 72484, 174934, 189-740; 14346, RFX3, 72485, 174935, 1-375; 14346, RFX3, 72486, 174936, 1-471; 14346, RFX3, 72476, 174926, 248-1489; 14346, RFX3, 72477, 174927, 9-2132; 14346, RFX3, 72479, 174929, 313-2562; 14346, RFX3, 72487, 174937, 264-2513; 14347, RFX4, 72491, 174941, 112-855; 14347, RFX4, 72492, 174942, 289-522; 14347, RFX4, 72493, 174943, 297-473; 14347, RFX4, 72494, 174944, 30-798; 14347, RFX4, 72495, 174945, 7-126; 14347, RFX4, 72496, 174946, 618-1053; 14347, RFX4, 72488, 174938, 119-2044; 14347, RFX4, 72489, 174939, 141-2375; 14347, RFX4, 72490, 174940, 415-2622; 14348, RFX5, 72499, 174949, 267-2056; 14348, RFX5, 72500, 174950, 217-585; 14348, RFX5, 72502, 174952, 257-545; 14348, RFX5, 72503, 174953, 1-708; 14348, RFX5, 72504, 174954, 210-562; 14348, RFX5, 72505, 174955, 351-903; 14348, RFX5, 72506, 174956, 214-902; 14348, RFX5, 72507, 174957, 188-322; 14348, RFX5, 72508, 174958, 213-365; 14348, RFX5, 72509, 174959, 42-537; 14348, RFX5, 72510, 174960, 222-374; 14348, RFX5, 72511, 174961, 281-597; 14348, RFX5, 72512, 174962, 196-324; 14348, RFX5, 72497, 174947, 180-2030; 14348, RFX5, 72498, 174948, 252-2102; 14348, RFX5, 72501, 174951, 279-2129; 14349, RFX6, 72513, 174963, 17-2803; 14350, RFX7, 72515, 174965, 49-3879; 14350, RFX7, 72516, 174966, 290-518; 14350, RFX7, 72514, 174964, 273-4364; 14351, RFXANK, 72518, 174968, 199-912; 14351, RFXANK, 72520, 174970, 607-856; 14351, RFXANK, 72522, 174972, 1-126; 14351, RFXANK, 72523, 174973, 269-832; 14351, RFXANK, 72524, 174974, 1-144; 14351, RFXANK, 72525, 174975, 1-546; 14351, RFXANK, 72526, 174976, 431-865; 14351, RFXANK, 72517, 174967, 475-1257; 14351, RFXANK, 72519, 174969, 347-1129; 14351, RFXANK, 72521, 174971, 462-1178; 14352, RFXAP, 72527, 174977, 135-953; 14353, RSC1A1, 72528, 174978, 1-1854; 14354, RIIAD1, 72530, 174980, 1288-1596; 14354, RIIAD1, 72529, 174979, 1-279; 14355, RRAS, 72531, 174981, 104-760; 14356, RRAS2, 72535, 174985, 290-497; 14356, RRAS2, 72538, 174988, 235-732; 14356, RRAS2, 72539, 174989, 278-421; 14356, RRAS2, 72540, 174990, 286-444; 14356, RRAS2, 72543, 174993, 1-612; 14356, RRAS2, 72532, 174982, 315-929; 14356, RRAS2, 72533, 174983, 128-511; 14356, RRAS2, 72534, 174984, 372-755; 14356, RRAS2, 72536, 174986, 240-623; 14356, RRAS2, 72537, 174987, 353-736; 14356, RRAS2, 72541, 174991, 212-595; 14356, RRAS2, 72542, 174992, 114-623; 14357, RLN1, 72544, 174994, 128-685; 14358, RLN2, 72546, 174996, 1-206; 14358, RLN2, 72545, 174995, 390-947; 14359, RLN3, 72548, 174998, 1-330; 14359, RLN3, 72547, 174997, 58-486; 14360, RXFP1, 72551, 175001, 264-2618; 14360, RXFP1, 72552, 175002, 744-2549; 14360, RXFP1, 72554, 175004, 548-2578; 14360, RXFP1, 72555, 175005, 2-475; 14360, RXFP1, 72557, 175007, 579-2459; 14360, RXFP1, 72549, 174999, 252-2525; 14360, RXFP1, 72550, 175000, 1-2130; 14360, RXFP1, 72553, 175003, 1-2175; 14360, RXFP1, 72556, 175006, 1-570; 14361, RXFP2, 72558, 175008, 72-2336; 14361, RXFP2, 72559, 175009, 72-2264; 14362, RXFP3, 72560, 175010, 356-1765; 14362, RXFP3, 72561, 175011, 356-1765; 14363, RXFP4, 72562, 175012, 1-1125; 14364, RELT, 72565, 175015, 283-586; 14364, RELT, 72566, 175016, 118-429; 14364, RELT, 72563, 175013, 262-1554; 14364, RELT, 72564, 175014, 228-1520; 14365, RELL1, 72569, 175019, 29-771; 14365, RELL1, 72567, 175017, 90-905; 14365, RELL1, 72568, 175018, 90-905; 14366, RELL2, 72572, 175022, 322-1035; 14366, RELL2, 72573, 175023, 752-1450; 14366, RELL2, 72570, 175020, 1201-2112; 14366, RELL2, 72571, 175021, 849-1760; 14367, RSG1, 72575, 175025, 1-336; 14367, RSG1, 72574, 175024, 421-1197; 14368, RSF1, 72577, 175027, 1-604; 14368, RSF1, 72578, 175028, 1-2409; 14368, RSF1, 72579, 175029, 1-830; 14368, RSF1, 72581, 175031, 1-2107; 14368, RSF1, 72582, 175032, 1-495; 14368, RSF1, 72576, 175026, 304-4629; 14368, RSF1, 72580, 175030, 1062-4631; 14369, RNLS, 72585, 175035, 1-525; 14369, RNLS, 72583, 175033, 24-1052; 14369, RNLS, 72584, 175034, 1341-2288; 14370, REN, 72586, 175036, 30-1250; 14371, RENBP, 72587, 175037, 78-1319; 14371, RENBP, 72589, 175039, 17-199; 14371, RENBP, 72590, 175040, 1-480; 14371, RENBP, 72591, 175041, 1-349; 14371, RENBP, 72592, 175042, 1-376; 14371, RENBP, 72588, 175038, 82-1365; 14372, RPTN, 72593, 175043, 66-2420; 14373, RFC1, 72596, 175046, 1-561; 14373, RFC1, 72597, 175047, 99-491; 14373, RFC1, 72598, 175048, 109-504; 14373, RFC1, 72599, 175049, 1-304; 14373, RFC1, 72594, 175044, 111-3554; 14373, RFC1, 72595, 175045, 135-3581; 14374, RFC2, 72602, 175052, 25-258; 14374, RFC2, 72603, 175053, 1-361; 14374, RFC2, 72604, 175054, 1-263; 14374, RFC2, 72605, 175055, 1-306; 14374, RFC2, 72606, 175056, 1-158; 14374, RFC2, 72607, 175057, 1-595; 14374, RFC2, 72608, 175058, 1-226; 14374, RFC2, 72609, 175059, 7-120; 14374, RFC2, 72610, 175060, 1-87; 14374, RFC2, 72611, 175061, 278-1033; 14374, RFC2, 72600, 175050, 62-1126; 14374, RFC2, 72601, 175051, 7-969; 14375, RFC3, 72614, 175064, 1-312; 14375, RFC3, 72612, 175062, 131-1201; 14375, RFC3, 72613, 175063, 111-1028; 14376, RFC4, 72617, 175067, 181-474; 14376, RFC4, 72618, 175068, 430-560; 14376, RFC4, 72619, 175069, 12-1022; 14376, RFC4, 72620, 175070, 1-336; 14376, RFC4, 72621, 175071, 117-485; 14376, RFC4, 72622, 175072, 59-701; 14376, RFC4, 72623, 175073, 283-785; 14376, RFC4, 72624, 175074, 168-453; 14376, RFC4, 72615, 175065, 224-1315; 14376, RFC4, 72616, 175066, 283-1374; 14377, RFC5, 72626, 175076, 247-559; 14377, RFC5, 72627, 175077, 276-572; 14377, RFC5, 72629, 175079, 385-574; 14377, RFC5, 72630, 175080, 509-820; 14377, RFC5, 72631, 175081, 214-631; 14377, RFC5, 72625, 175075, 534-1493; 14377, RFC5, 72628, 175078, 119-1141; 14378, REPIN1, 72636, 175086, 69-332; 14378, REPIN1, 72637, 175087, 172-582; 14378, REPIN1, 72638, 175088, 64-207; 14378, REPIN1, 72639, 175089, 112-279; 14378, REPIN1, 72640, 175090, 95-1192; 14378, REPIN1, 72641, 175091, 82-1262; 14378, REPIN1, 72642, 175092, 89-499; 14378, REPIN1, 72643, 175093, 7-150; 14378, REPIN1, 72644, 175094, 33-443; 14378, REPIN1, 72645, 175095, 145-583; 14378, REPIN1, 72632, 175082, 490-2193; 14378, REPIN1, 72633, 175083, 79-1782; 14378, REPIN1, 72634, 175084, 167-1870; 14378, REPIN1, 72635, 175085, 184-2058; 14379, RPA1, 72647, 175097, 171-630; 14379, RPA1, 72648, 175098, 1-942; 14379, RPA1, 72649, 175099, 206-577; 14379, RPA1, 72646, 175096, 111-1961; 14380, RPA2, 72653, 175103, 146-682; 14380, RPA2, 72654, 175104, 1-369; 14380, RPA2, 72650, 175100, 71-1147; 14380, RPA2, 72651, 175101, 87-923; 14380, RPA2, 72652, 175102, 301-1113; 14381, RPA3, 72657, 175107, 113-361; 14381, RPA3, 72658, 175108, 141-389; 14381, RPA3, 72655, 175105, 1173-1538; 14381, RPA3, 72656, 175106, 414-779; 14382, RPA4, 72659, 175109, 404-1189; 14383, RTFDC1, 72660, 175110, 114-1124; 14383, RTFDC1, 72662, 175112, 85-777; 14383, RTFDC1, 72663, 175113, 21-852; 14383, RTFDC1, 72661, 175111, 108-1028; 14384, RIF1, 72666, 175116, 1-2534; 14384, RIF1, 72667, 175117, 1-2240; 14384, RIF1, 72664, 175114, 484-7902; 14384, RIF1, 72665, 175115, 162-7580; 14384, RIF1, 72668, 175118, 162-7502; 14384, RIF1, 72669, 175119, 65-7405; 14384, RIF1, 72670, 175120, 335-7675; 14385, RPRM, 72671, 175121, 244-573; 14386, RPRML, 72672, 175122, 242-604; 14387, RGMA, 72677, 175127, 132-317; 14387, RGMA, 72678, 175128, 278-547; 14387, RGMA, 72679, 175129, 373-1749; 14387, RGMA, 72680, 175130, 149-289; 14387, RGMA, 72681, 175131, 290-320; 14387, RGMA, 72682, 175132, 822-1847; 14387, RGMA, 72673, 175123, 273-1625; 14387, RGMA, 72674, 175124, 182-1486; 14387, RGMA, 72675, 175125, 152-1456; 14387, RGMA, 72676, 175126, 278-1582; 14388, RGMB, 72683, 175133, 403-1839; 14388, RGMB, 72684, 175134, 437-1750; 14389, RMND1, 72687, 175137, 111-743; 14389, RMND1, 72688, 175138, 173-1012; 14389, RMND1, 72685, 175135, 316-1032; 14389, RMND1, 72686, 175136, 124-1473; 14390, RMND5A, 72689, 175139, 496-1671; 14391, RMND5B, 72692, 175142, 191-424; 14391, RMND5B, 72693, 175143, 13-201; 14391, RMND5B, 72694, 175144, 312-653; 14391, RMND5B, 72695, 175145, 365-808; 14391, RMND5B, 72696, 175146, 393-562; 14391, RMND5B, 72697, 175147, 1-1143; 14391, RMND5B, 72690, 175140, 212-1393; 14391, RMND5B, 72691, 175141, 352-1533; 14392, RERGL, 72699, 175149, 2-190; 14392, RERGL, 72700, 175150, 50-664; 14392, RERGL, 72698, 175148, 208-825; 14393, RETN, 72701, 175151, 89-415; 14393, RETN, 72702, 175152, 1-249; 14393, RETN, 72703, 175153, 47-295; 14394, RETNLB, 72704, 175154, 200-535; 14395, RCOR1, 72705, 175155, 227-1684; 14395, RCOR1, 72706, 175156, 1-108; 14396, RCOR2, 72707, 175157, 389-1960; 14397, RCOR3, 72712, 175162, 166-1290; 14397, RCOR3, 72713, 175163, 1-427; 14397, RCOR3, 72714, 175164, 1-224; 14397, RCOR3, 72715, 175165, 170-304; 14397, RCOR3, 72716, 175166, 306-564; 14397, RCOR3, 72717, 175167, 92-540; 14397, RCOR3, 72718, 175168, 1-720; 14397, RCOR3, 72708, 175158, 142-1629; 14397, RCOR3, 72709, 175159, 283-1593; 14397, RCOR3, 72710, 175160, 174-1523; 14397, RCOR3, 72711, 175161, 129-1790; 14398, RFPL1, 72719, 175169, 210-1163; 14399, RFPL2, 72723, 175173, 121-351; 14399, RFPL2, 72724, 175174, 61-345; 14399, RFPL2, 72720, 175170, 206-1159; 14399, RFPL2, 72721, 175171, 1-1137; 14399, RFPL2, 72722, 175172, 937-2073; 14400, RFPL3, 72725, 175175, 206-1159; 14400, RFPL3, 72726, 175176, 19-885; 14401, RFPL4A, 72727, 175177, 172-1035; 14402, RFPL4AL1, 72728, 175178, 45-908; 14403, RFPL4B, 72729, 175179, 313-1104; 14404, RET, 72732, 175182, 186-729; 14404, RET, 72733, 175183, 191-1567; 14404, RET, 72730, 175180, 181-3399; 14404, RET, 72731, 175181, 233-3577; 14405, RTBDN, 72737, 175187, 51-692; 14405, RTBDN, 72738, 175188, 83-641; 14405, RTBDN, 72739, 175189, 58-637; 14405, RTBDN, 72741, 175191, 75-465; 14405, RTBDN, 72742, 175192, 71-592; 14405, RTBDN, 72743, 175193, 49-620; 14405, RTBDN, 72744, 175194, 650-861; 14405, RTBDN, 72745, 175195, 331-948; 14405, RTBDN, 72746, 175196, 318-658; 14405, RTBDN, 72734, 175184, 319-1104; 14405, RTBDN, 72735, 175185, 83-772; 14405, RTBDN, 72736, 175186, 154-843; 14405, RTBDN, 72740, 175190, 77-796; 14406, RER1, 72747, 175197, 165-695; 14406, RER1, 72748, 175198, 77-640; 14406, RER1, 72749, 175199, 192-545; 14406, RER1, 72750, 175200, 139-492; 14406, RER1, 72751, 175201, 66-540; 14406, RER1, 72754, 175204, 134-778; 14406, RER1, 72752, 175202, 1787-2377; 14406, RER1, 72753, 175203, 134-724; 14407, RCN1, 72756, 175206, 1-87; 14407, RCN1, 72757, 175207, 436-494; 14407, RCN1, 72759, 175209, 1-172; 14407, RCN1, 72760, 175210, 352-527; 14407, RCN1, 72755, 175205, 294-1289; 14407, RCN1, 72758, 175208, 156-998; 14408, RCN2, 72762, 175212, 88-738; 14408, RCN2, 72764, 175214, 1-466; 14408, RCN2, 72761, 175211, 105-1112; 14408, RCN2, 72763, 175213, 224-1177; 14409, RCN3, 72766, 175216, 99-549; 14409, RCN3, 72767, 175217, 1-510; 14409, RCN3, 72768, 175218, 1-175; 14409, RCN3, 72765, 175215, 448-1434; 14410, RTN1, 72771, 175221, 260-841; 14410, RTN1, 72772, 175222, 122-2230; 14410, RTN1, 72769, 175219, 337-2667; 14410, RTN1, 72770, 175220, 309-935; 14411, RTN2, 72776, 175226, 1128-1943; 14411, RTN2, 72777, 175227, 231-1061; 14411, RTN2, 72778, 175228, 231-1616; 14411, RTN2, 72773, 175223, 237-

1874; 14411, RTN2, 72774, 175224, 231-1649; 14411, RTN2, 72775, 175225, 96-713; 14412, RTN3, 72784, 175234, 180-735; 14412, RTN3, 72786, 175236, 138-509; 14412, RTN3, 72787, 175237, 138-545; 14412, RTN3, 72788, 175238, 138-529; 14412, RTN3, 72779, 175229, 192-917; 14412, RTN3, 72780, 175230, 155-3196; 14412, RTN3, 72781, 175231, 65-709; 14412, RTN3, 72782, 175232, 188-955; 14412, RTN3, 72783, 175233, 155-3253; 14412, RTN3, 72785, 175235, 138-848; 14412, RTN3, 72789, 175239, 142-2904; 14413, RTN4, 72797, 175247, 77-1114; 14413, RTN4, 72799, 175249, 1-610; 14413, RTN4, 72800, 175250, 316-589; 14413, RTN4, 72801, 175251, 1-384; 14413, RTN4, 72790, 175240, 245-1366; 14413, RTN4, 72791, 175241, 245-3823; 14413, RTN4, 72792, 175242, 183-3143; 14413, RTN4, 72793, 175243, 245-1423; 14413, RTN4, 72794, 175244, 330-929; 14413, RTN4, 72795, 175245, 234-3194; 14413, RTN4, 72796, 175246, 134-3094; 14413, RTN4, 72798, 175248, 175-3135; 14414, RTN4IP1, 72803, 175253, 1-681; 14414, RTN4IP1, 72802, 175252, 467-1657; 14415, RTN4R, 72805, 175255, 1-1481; 14415, RTN4R, 72806, 175256, 1-1679; 14415, RTN4R, 72804, 175254, 440-1861; 14416, RTN4RL1, 72807, 175257, 481-1806; 14417, RTN4RL2, 72810, 175260, 10-624; 14417, RTN4RL2, 72808, 175258, 318-1580; 14417, RTN4RL2, 72809, 175259, 1-582; 14418, RAX, 72813, 175263, 252-473; 14418, RAX, 72811, 175261, 180-494; 14418, RAX, 72812, 175262, 188-1228; 14419, RAX2, 72814, 175264, 328-882; 14419, RAX2, 72815, 175265, 59-613; 14420, RD3, 72816, 175266, 1165-1752; 14421, RD3L, 72817, 175267, 225-821; 14422, RGR, 72820, 175270, 6-368; 14422, RGR, 72818, 175268, 39-800; 14422, RGR, 72819, 175269, 39-926; 14423, ROM1, 72822, 175272, 174-491; 14423, ROM1, 72823, 175273, 286-587; 14423, ROM1, 72824, 175274, 409-584; 14423, ROM1, 72821, 175271, 542-1597; 14424, RRH, 72825, 175275, 35-1048; 14425, RPE65, 72826, 175276, 55-1656; 14426, RLBP1, 72828, 175278, 1-326; 14426, RLBP1, 72829, 175279, 245-460; 14426, RLBP1, 72827, 175277, 441-1394; 14427, RP1, 72830, 175280, 149-6619; 14428, RP1L1, 72831, 175281, 225-7427; 14429, RP2, 72832, 175282, 162-1214; 14430, RP9, 72834, 175284, 131-629; 14430, RP9, 72833, 175283, 19-684; 14431, RPGR, 72838, 175288, 1-426; 14431, RPGR, 72839, 175289, 1-389; 14431, RPGR, 72835, 175285, 198-2645; 14431, RPGR, 72836, 175286, 169-3231; 14431, RPGR, 72837, 175287, 178-3636; 14431, RPGR, 72840, 175290, 140-1582; 14431, RPGR, 72841, 175291, 56-1996; 14432, RPGRIP1, 72844, 175294, 1-429; 14432, RPGRIP1, 72845, 175295, 39-2870; 14432, RPGRIP1, 72846, 175296, 1-80; 14432, RPGRIP1, 72847, 175297, 1-180; 14432, RPGRIP1, 72848, 175298, 39-3785; 14432, RPGRIP1, 72849, 175299, 1-2286; 14432, RPGRIP1, 72850, 175300, 1-402; 14432, RPGRIP1, 72851, 175301, 67-566; 14432, RPGRIP1, 72842, 175292, 81-1919; 14432, RPGRIP1, 72843, 175293, 1-3861; 14433, RB1, 72853, 175303, 139-300; 14433, RB1, 72852, 175302, 139-2925; 14434, RBBP4, 72856, 175306, 319-580; 14434, RBBP4, 72859, 175309, 1-543; 14434, RBBP4, 72860, 175310, 30-344; 14434, RBBP4, 72861, 175311, 130-318; 14434, RBBP4, 72862, 175312, 1-788; 14434, RBBP4, 72863, 175313, 91-354; 14434, RBBP4, 72864, 175314, 1-504; 14434, RBBP4, 72865, 175315, 91-354; 14434, RBBP4, 72866, 175316, 1-619; 14434, RBBP4, 72867, 175317, 428-632; 14434, RBBP4, 72854, 175304, 74-1306; 14434, RBBP4, 72855, 175305, 160-1437; 14434, RBBP4, 72857, 175307, 167-1339; 14434, RBBP4, 72858, 175308, 166-1440; 14435, RBBP5, 72868, 175318, 143-1759; 14435, RBBP5, 72869, 175319, 143-1645; 14436, RBBP6, 72874, 175324, 338-3361; 14436, RBBP6, 72875, 175325, 238-1138; 14436, RBBP6, 72876, 175326, 220-695; 14436, RBBP6, 72877, 175327, 1-415; 14436, RBBP6, 72870, 175320, 45-5321; 14436, RBBP6, 72871, 175321, 433-5811; 14436, RBBP6, 72872, 175322, 108-2966; 14436, RBBP6, 72873, 175323, 132-488; 14437, RBBP7, 72880, 175330, 309-1559; 14437, RBBP7, 72881, 175331, 1-857; 14437, RBBP7, 72882, 175332, 1-528; 14437, RBBP7, 72883, 175333, 1-258; 14437, RBBP7, 72884, 175334, 101-212; 14437, RBBP7, 72885, 175335, 428-630; 14437, RBBP7, 72878, 175328, 246-1655; 14437, RBBP7, 72879, 175329, 362-1639; 14438, RBBP8, 72887, 175337, 124-2832; 14438, RBBP8, 72888, 175338, 488-2229; 14438, RBBP8, 72891, 175341, 351-543; 14438, RBBP8, 72892, 175342, 1-480; 14438, RBBP8, 72893, 175343, 322-574; 14438, RBBP8, 72894, 175344, 142-369; 14438, RBBP8, 72895, 175345, 404-1019; 14438, RBBP8, 72896, 175346, 490-578; 14438, RBBP8, 72897, 175347, 533-564; 14438, RBBP8, 72898, 175348, 1-975; 14438, RBBP8, 72899, 175349, 1-136; 14438, RBBP8, 72886, 175336, 349-3042; 14438, RBBP8, 72889, 175339, 352-3045; 14438, RBBP8, 72890, 175340, 418-3021; 14439, RBBP9, 72901, 175351, 1-522; 14439, RBBP9, 72900, 175350, 77-637; 14440, RBL1, 72904, 175354, 1-763; 14440, RBL1, 72905, 175355, 68-409; 14440, RBL1, 72902, 175352, 62-3106; 14440, RBL1, 72903, 175353, 68-3274; 14441, RBL2, 72907, 175357, 109-2025; 14441, RBL2, 72908, 175358, 1-2550; 14441, RBL2, 72909, 175359, 454-838; 14441, RBL2, 72906, 175356, 138-3557; 14442, RAET1E, 72912, 175362, 32-385; 14442, RAET1E, 72914, 175364, 403-643; 14442, RAET1E, 72910, 175360, 134-925; 14442, RAET1E, 72911, 175361, 134-817; 14442, RAET1E, 72913, 175363, 1-630; 14442, RAET1E, 72915, 175365, 348-986; 14443, RAET1G, 72918, 175368, 112-777; 14443, RAET1G, 72916, 175366, 69-1073; 14443, RAET1G, 72917, 175367, 1-642; 14444, RAET1L, 72919, 175369, 62-802; 14444, RAET1L, 72920, 175370, 1-741; 14445, RAI1, 72922, 175372, 101-2928; 14445, RAI1, 72923, 175373, 376-570; 14445, RAI1, 72924, 175374, 1-469; 14445, RAI1, 72921, 175371, 470-6190; 14446, RAI14, 72927, 175377, 164-542; 14446, RAI14, 72928, 175378, 170-548; 14446, RAI14, 72929, 175379, 222-542; 14446, RAI14, 72931, 175381, 289-630; 14446, RAI14, 72934, 175384, 308-508; 14446, RAI14, 72935, 175385, 263-575; 14446, RAI14, 72936, 175386, 124-294; 14446, RAI14, 72937, 175387, 243-660; 14446, RAI14, 72938, 175388, 105-554; 14446, RAI14, 72939, 175389, 160-222; 14446, RAI14, 72940, 175390, 131-301; 14446, RAI14, 72941, 175391, 164-539; 14446, RAI14, 72925, 175375, 288-3230; 14446, RAI14, 72926, 175376, 276-3218; 14446, RAI14, 72930, 175380, 86-2941; 14446, RAI14, 72932, 175382, 357-3299; 14446, RAI14, 72933, 175383, 153-3071; 14446, RAI14, 72942, 175392, 493-3444; 14447, RAI2, 72948, 175398, 219-463; 14447, RAI2, 72943, 175393, 358-1950; 14447, RAI2, 72944, 175394, 418-2010; 14447, RAI2, 72945, 175395, 226-1668; 14447, RAI2, 72946, 175396, 265-1857; 14447, RAI2, 72947, 175397, 462-2054; 14448, RARRES1, 72949, 175399, 282-1166; 14448, RARRES1, 72950, 175400, 28-714; 14449, RARRES2, 72952, 175402, 106-583; 14449, RARRES2, 72951, 175401, 118-609; 14449, RARRES2, 72953, 175403, 1035-1526; 14449, RARRES2, 72954, 175404, 72-563; 14450, RARRES3, 72956, 175406, 1-495; 14450, RARRES3, 72955, 175405, 49-543; 14450, RARRES3, 72957, 175407, 54-524; 14451, RARA, 72960, 175410, 3-1439; 14451, RARA, 72963, 175413, 256-813; 14451, RARA, 72964, 175414, 535-733; 14451, RARA, 72958, 175408, 456-1844; 14451, RARA, 72959, 175409, 343-1716; 14451, RARA, 72961, 175411, 531-1919; 14451, RARA, 72962, 175412, 527-1624; 14452, RARB, 72966, 175416, 67-1273; 14452, RARB, 72965, 175415, 422-1768; 14452, RARB, 72967, 175417, 264-1274; 14452, RARB, 72968, 175418, 449-1459; 14453, RARG, 72973, 175423, 899-944; 14453, RARG, 72974, 175424, 384-555; 14453, RARG, 72975, 175425, 489-586; 14453, RARG, 72969, 175419, 160-1491; 14453, RARG, 72970, 175420, 383-1531; 14453, RARG, 72971, 175421, 489-1853; 14453, RARG, 72972, 175422, 198-1496; 14454, RXRA, 72976, 175426, 53-1441; 14455, RXRB, 72981, 175431, 1-287; 14455, RXRB, 72982, 175432, 1-287; 14455, RXRB, 72988, 175438, 1-287; 14455, RXRB, 72989, 175439, 1-287; 14455, RXRB, 72992, 175442, 1-287; 14455, RXRB, 72994, 175444, 162-401; 14455, RXRB, 72995, 175445, 162-401; 14455, RXRB, 72996, 175446, 162-401; 14455, RXRB, 72997, 175447, 162-401; 14455, RXRB, 72998, 175448, 162-401; 14455, RXRB, 72999, 175449, 72-1115; 14455, RXRB, 73000, 175450, 162-401; 14455, RXRB, 72977, 175427, 213-1814; 14455, RXRB, 72978, 175428, 139-1752; 14455, RXRB, 72979, 175429, 139-1752; 14455, RXRB, 72980, 175430, 213-1814; 14455, RXRB, 72983, 175433, 139-1752; 14455, RXRB, 72984, 175434, 139-1752; 14455, RXRB, 72985, 175435, 139-1752; 14455, RXRB, 72986, 175436, 213-1814; 14455, RXRB, 72987, 175437, 139-1752; 14455, RXRB, 72990, 175440, 213-1814; 14455, RXRB, 72991, 175441, 213-1814; 14455, RXRB, 72993, 175443, 213-1814; 14456, RXRG, 73002, 175452, 890-1912; 14456, RXRG, 73001, 175451, 304-1695; 14457, RBP1, 73003, 175453, 112-705; 14457, RBP1, 73004, 175454, 188-463; 14457, RBP1, 73005, 175455, 157-453; 14457, RBP1, 73006, 175456, 112-585; 14457, RBP1, 73007, 175457, 112-573; 14457, RBP1, 73008, 175458, 56-463; 14458, RBP2, 73010, 175460, 108-180; 14458, RBP2, 73011, 175461, 179-489; 14458, RBP2, 73009, 175459, 58-462; 14459, RBP3, 73012, 175462, 115-3858; 14460, RBP4, 73015, 175465, 29-628; 14460, RBP4, 73016, 175466, 52-651; 14460, RBP4, 73017, 175467, 1-600; 14460, RBP4, 73013, 175463, 75-680; 14460, RBP4, 73014, 175464, 321-926; 14461, RBP5, 73019, 175469, 99-392; 14461, RBP5, 73020, 175470, 88-297; 14461, RBP5, 73018, 175468, 168-575; 14462, RBP7, 73022, 175472, 54-233; 14462, RBP7, 73021, 175471, 44-448; 14463, RDH10, 73024, 175474, 385-915; 14463, RDH10, 73025, 175475, 251-436; 14463, RDH10, 73023, 175473, 679-1704; 14464, RDH11, 73028, 175478, 62-621; 14464, RDH11, 73029, 175479, 28-562; 14464, RDH11, 73030, 175480, 1-615; 14464, RDH11, 73031, 175481, 64-249; 14464, RDH11, 73033, 175483, 72-260; 14464, RDH11, 73026, 175476, 112-1068; 14464, RDH11, 73027, 175477, 31-777; 14464, RDH11, 73032, 175482, 52-969; 14465, RDH12, 73034, 175484, 281-1231; 14465, RDH12, 73035, 175485, 325-1275; 14466, RDH13, 73036, 175486, 802-1464; 14466, RDH13, 73039, 175489, 55-717; 14466, RDH13, 73040, 175490, 475-601; 14466, RDH13, 73041, 175491, 117-224; 14466, RDH13, 73042, 175492, 523-610; 14466, RDH13, 73043, 175493, 45-152; 14466, RDH13, 73045, 175495, 45-152; 14466, RDH13, 73047, 175497, 399-1181; 14466, RDH13, 73048, 175498, 117-224; 14466, RDH13, 73049, 175499, 475-601; 14466, RDH13, 73050, 175500, 399-1181; 14466, RDH13, 73052, 175502, 55-717; 14466, RDH13, 73053, 175503, 399-1181; 14466, RDH13, 73054, 175504, 523-610; 14466, RDH13, 73055, 175505, 399-1181; 14466, RDH13, 73056, 175506, 399-1181; 14466, RDH13, 73057, 175507, 802-1464; 14466, RDH13, 73058, 175508, 399-1181; 14466, RDH13, 73059, 175509, 399-1181; 14466, RDH13, 73037, 175487, 474-1256; 14466, RDH13, 73038, 175488, 145-1140; 14466, RDH13, 73044, 175494, 145-1140; 14466, RDH13, 73046, 175496, 399-1181; 14466, RDH13, 73051, 175501, 399-1181; 14466, RDH13, 73060, 175510, 474-1256; 14467, RDH14, 73061, 175511, 109-1119; 14468, RDH16, 73062, 175512, 858-1811; 14469, RDH5, 73065, 175515, 1-311; 14469, RDH5, 73066, 175516, 361-527; 14469, RDH5, 73067, 175517, 328-993; 14469, RDH5, 73063, 175513, 153-1109; 14469, RDH5, 73064, 175514, 143-1099; 14470, RDH8, 73068, 175518, 1-238; 14470, RDH8, 73069, 175519, 190-1185; 14471, RETSAT, 73071, 175521, 1-765; 14471, RETSAT, 73072, 175522, 1-961; 14471, RETSAT, 73073, 175523, 1-1199; 14471, RETSAT, 73074, 175524, 1-421; 14471, RETSAT, 73070, 175520, 114-1946; 14472, RS1, 73075, 175525, 42-716; 14473, RGAG1, 73077, 175527, 269-532; 14473, RGAG1, 73076, 175526, 247-4413; 14473, RGAG1, 73078, 175528, 54-4220; 14474, RGAG4, 73079, 175529, 362-2071; 14474, RGAG4, 73080, 175530, 289-1998; 14475, RTL1, 73081, 175531, 60-4136; 14476, REV1, 73084, 175534, 1-292; 14476, REV1, 73085, 175535, 1-577; 14476, REV1, 73086, 175536, 230-439; 14476, REV1, 73082, 175532, 230-3985; 14476, REV1, 73083, 175533, 168-3920; 14477, REV3L, 73090, 175540, 32-175; 14477, REV3L, 73091, 175541, 459-602; 14477, REV3L, 73092, 175542, 1-555; 14477, REV3L, 73094, 175544, 1-969; 14477, REV3L, 73087, 175537, 459-9851; 14477, REV3L, 73088, 175538, 324-9716; 14477, REV3L, 73089, 175539, 84-9476; 14477, REV3L, 73093, 175543, 821-9979; 14478, RECK, 73095, 175545, 567-3482; 14479, REXO1, 73097, 175547, 1-485; 14479, REXO1, 73098, 175548, 1-369; 14479, REXO1, 73099, 175549, 1-193; 14479, REXO1, 73096, 175546, 106-3771; 14480, REXO4, 73100, 175550, 201-1469; 14480, REXO4, 73101, 175551, 134-833; 14480, REXO4, 73102, 175552, 294-860; 14480, REXO4, 73103, 175553, 253-1005; 14481, REXO4, 73106, 175556, 294-860; 14481, REXO4, 73107, 175557, 134-833; 14481, REXO4, 73104, 175554, 253-1005; 14481, REXO4, 73105, 175555, 201-1469; 14482, RFNG, 73109, 175559, 204-821; 14482, RFNG, 73110, 175560, 468-649; 14482, RFNG, 73108, 175558, 9-1004; 14483, RFPL3S, 73111, 175561, 60-269; 14483, RFPL3S, 73112, 175562, 74-304; 14483, RFPL3S, 73113, 175563, 151-447; 14483, RFPL3S, 73114, 175564, 281-489; 14483, RFPL3S, 73115, 175565, 53-376; 14484, RFT1, 73117, 175567, 54-1562; 14484, RFT1, 73118, 175568, 12-886; 14484, RFT1, 73116, 175566, 63-1688; 14485, RFX8, 73120, 175570, 121-582; 14485, RFX8, 73121, 175571, 119-361; 14485, RFX8, 73119, 175569, 121-1542; 14486, RLTPR, 73124, 175574, 1-373; 14486, RLTPR, 73125, 175575, 260-427; 14486, RLTPR, 73122, 175572, 329-4636; 14486, RLTPR, 73123, 175573, 1-4119; 14487, RGP1, 73126, 175576, 142-1317; 14488, RHCE, 73127, 175577, 87-1283; 14488, RHCE, 73129, 175579, 390-1595; 14488, RHCE, 73130, 175580, 20-1084; 14488, RHCE, 73131, 175581, 7-807; 14488, RHCE, 73132, 175582, 10-813; 14488, RHCE, 73133, 175583, 1-909; 14488, RHCE, 73134, 175584, 21-1139; 14488, RHCE, 73135, 175585, 1-233; 14488, RHCE, 73136, 175586, 11-178; 14488, RHCE, 73128, 175578, 60-1313; 14489, RHD, 73141, 175591, 1-1296; 14489, RHD, 73143, 175593, 1-1392; 14489, RHD, 73144, 175594, 63-1358; 14489, RHD, 73145, 175595, 1-909; 14489, RHD, 73137, 175587, 156-1409; 14489, RHD, 73138, 175588, 1-1482; 14489, RHD, 73139, 175589, 1-1191; 14489, RHD, 73140, 175590, 1-1137; 14489, RHD, 73142, 175592, 51-1016; 14490, RHBG, 73146, 175596, 39-332; 14490, RHBG, 73148, 175598, 39-500; 14490, RHBG, 73149, 175599, 1-293; 14490, RHBG, 73150, 175600, 39-332; 14490, RHBG, 73147, 175597, 39-1415; 14491, RHCG, 73152, 175602, 39-740; 14491, RHCG, 73153, 175603, 1-712; 14491, RHCG, 73154, 175604, 28-1023; 14491, RHCG, 73155, 175605, 46-456; 14491, RHCG, 73151, 175601, 70-1509; 14492, RHAG, 73156, 175606, 28-1260; 14492, RHAG, 73158, 175608, 28-1173; 14492, RHAG, 73157, 175607, 28-1257; 14493, RND1, 73160, 175610, 1-381; 14493, RND1, 73161, 175611, 89-379; 14493, RND1, 73159, 175609, 132-830; 14494, RND2, 73162, 175612, 108-791; 14495, RND3, 73165, 175615, 247-594; 14495, RND3, 73166, 175616, 158-505; 14495, RND3, 73167, 175617, 134-481; 14495, RND3, 73163, 175613, 185-919; 14495, RND3, 73164, 175614, 251-985; 14496, ARHGDIA, 73171, 175621, 55-444; 14496, ARHGDIA, 73172, 175622, 68-815; 14496, ARHGDIA, 73173, 175623, 57-335; 14496, ARHGDIA, 73174, 175624, 57-637; 14496, ARHGDIA, 73175, 175625, 56-334; 14496, ARHGDIA, 73176, 175626, 60-767; 14496, ARHGDIA, 73168, 175618, 137-751; 14496, ARHGDIA, 73169, 175619, 107-589; 14496, ARHGDIA, 73170, 175620, 367-981; 14496, ARHGDIA, 73177, 175627, 77-691; 14497, ARHGDIB, 73179, 175629, 126-463; 14497, ARHGDIB, 73182, 175632, 1-586; 14497, ARHGDIB, 73183, 175633, 248-723; 14497, ARHGDIB, 73184, 175634, 90-354; 14497, ARHGDIB, 73178, 175628, 146-751; 14497, ARHGDIB, 73180, 175630, 240-845; 14497, ARHGDIB, 73181, 175631, 114-719; 14498, ARHGDIG, 73186, 175636, 111-519; 14498, ARHGDIG, 73187, 175637, 232-765; 14498, ARHGDIG, 73188, 175638, 111-339; 14498, ARHGDIG, 73189, 175639, 331-680; 14498, ARHGDIG, 73185, 175635, 76-753; 14499, ARHGAP1, 73191, 175641, 314-890; 14499, ARHGAP1, 73192, 175642, 1-1000; 14499, ARHGAP1, 73190, 175640, 99-1418; 14500, ARHGAP10, 73194, 175644, 1-1240; 14500, ARHGAP10, 73193, 175643, 240-2600; 14501, ARHGAP11A, 73198, 175648, 1-620; 14501, ARHGAP11A, 73200, 175650, 648-2069; 14501, ARHGAP11A, 73204, 175654, 723-3794; 14501, ARHGAP11A, 73195, 175645, 723-3794; 14501, ARHGAP11A, 73196, 175646, 590-3094; 14501, ARHGAP11A, 73197, 175647, 674-2179; 14501, ARHGAP11A, 73199, 175649, 549-3053; 14501, ARHGAP11A, 73201, 175651, 723-3794; 14501, ARHGAP11A, 73202, 175652, 671-3175; 14501, ARHGAP11A, 73203, 175653, 549-3053; 14502, ARHGAP11B, 73205, 175655, 146-949; 14502, ARHGAP11B, 73206, 175656, 622-1425; 14502, ARHGAP11B, 73207, 175657, 622-1425; 14503, ARHGAP12, 73210, 175660, 305-2704; 14503, ARHGAP12, 73213, 175663, 1-586; 14503, ARHGAP12, 73208, 175658, 20-2404; 14503, ARHGAP12, 73209, 175659, 236-2776; 14503, ARHGAP12, 73211, 175661, 243-2693; 14503, ARHGAP12, 73212, 175662, 305-2830; 14504, ARHGAP15, 73215, 175665, 178-594; 14504, ARHGAP15, 73216, 175666, 1-170; 14504, ARHGAP15, 73214, 175664, 168-1595; 14505, ARHGAP17, 73219, 175669, 178-810; 14505, ARHGAP17, 73220, 175670, 77-451; 14505, ARHGAP17, 73221, 175671, 1-287; 14505, ARHGAP17, 73222, 175672, 1-706; 14505, ARHGAP17, 73223, 175673, 40-255; 14505, ARHGAP17, 73224, 175674, 345-574; 14505, ARHGAP17, 73225, 175675, 1-385; 14505, ARHGAP17, 73217, 175667, 71-2716; 14505, ARHGAP17, 73218, 175668, 71-2482; 14506, ARHGAP18, 73226, 175676, 90-2081; 14507, ARHGAP19, 73230, 175680, 1-902; 14507, ARHGAP19, 73231, 175681, 9-601; 14507, ARHGAP19, 73227, 175677, 47-1444; 14507, ARHGAP19, 73228, 175678, 30-1514; 14507, ARHGAP19, 73229, 175679, 31-1488; 14508, ARHGAP20, 73237, 175687, 331-2526; 14508, ARHGAP20, 73232, 175682, 286-3861; 14508, ARHGAP20, 73233, 175683, 215-3682; 14508, ARHGAP20, 73234, 175684, 358-3864; 14508, ARHGAP20, 73235, 175685, 97-3564; 14508, ARHGAP20, 73236, 175686, 253-3750; 14509, ARHGAP21, 73238, 175688, 29-3526; 14509, ARHGAP21, 73241, 175691, 1-590; 14509, ARHGAP21, 73242, 175692, 1-540; 14509, ARHGAP21, 73243, 175693, 1-340; 14509, ARHGAP21, 73244, 175694, 465-3859; 14509, ARHGAP21, 73245, 175695, 491-4711; 14509, ARHGAP21, 73239, 175689, 95-4318; 14509, ARHGAP21, 73240, 175690, 488-6364; 14510, ARHGAP22, 73247, 175697, 133-1752; 14510, ARHGAP22, 73248, 175698, 256-2025; 14510, ARHGAP22, 73252, 175702, 869-1654; 14510, ARHGAP22, 73253, 175703, 1-1596; 14510, ARHGAP22, 73246, 175696, 298-2394; 14510, ARHGAP22, 73249, 175699, 160-1986; 14510, ARHGAP22, 73250, 175700, 157-2301; 14510, ARHGAP22, 73251, 175701, 332-2446; 14511, ARHGAP23, 73254, 175704, 1-407; 14511, ARHGAP23, 73256, 175706, 1-488; 14511, ARHGAP23, 73258, 175708, 1-252; 14511, ARHGAP23, 73259, 175709, 663-969; 14511, ARHGAP23, 73261, 175711, 1-390; 14511, ARHGAP23, 73262, 175712, 1-193; 14511, ARHGAP23, 73263, 175713, 1-390; 14511, ARHGAP23, 73264, 175714, 1-193; 14511, ARHGAP23, 73265, 175715, 1-407; 14511, ARHGAP23, 73267, 175717, 1-252; 14511, ARHGAP23, 73268, 175718, 1-488; 14511, ARHGAP23, 73269, 175719, 663-969; 14511, ARHGAP23, 73255, 175705, 69-4544; 14511, ARHGAP23, 73257, 175707, 69-4544; 14511, ARHGAP23, 73260, 175710, 1-3435; 14511, ARHGAP23, 73266, 175716, 1-3435; 14512, ARHGAP24, 73274, 175724, 219-572; 14512, ARHGAP24, 73275, 175725, 71-1936; 14512, ARHGAP24, 73276, 175726, 322-567; 14512, ARHGAP24, 73270, 175720, 659-2626; 14512, ARHGAP24, 73271, 175721, 278-2239; 14512, ARHGAP24, 73272, 175722, 467-2713; 14512, ARHGAP24, 73273, 175723, 343-1083; 14513, ARHGAP25, 73281, 175731, 341-1192; 14513, ARHGAP25, 73282, 175732, 278-535; 14513, ARHGAP25, 73283, 175733, 275-1294; 14513, ARHGAP25, 73284, 175734, 1-1517; 14513, ARHGAP25, 73285, 175735, 125-544; 14513, ARHGAP25, 73277, 175727, 381-2300; 14513, ARHGAP25, 73278, 175728, 381-2297; 14513, ARHGAP25, 73279, 175729, 366-2306; 14513, ARHGAP25, 73280, 175730, 242-1618; 14513, ARHGAP25, 73286, 175736, 319-2139; 14514, ARHGAP26, 73289, 175739, 65-564; 14514, ARHGAP26, 73290, 175740, 1-463; 14514, ARHGAP26, 73291, 175741, 1-294; 14514, ARHGAP26, 73292, 175742, 1-1166; 14514, ARHGAP26, 73293, 175743, 1-384; 14514, ARHGAP26, 73294, 175744, 1-296; 14514, ARHGAP26, 73295, 175745, 253-527; 14514, ARHGAP26, 73296, 175746, 1-384; 14514, ARHGAP26, 73297, 175747, 1-884; 14514, ARHGAP26, 73287, 175737, 379-2823; 14514, ARHGAP26, 73288, 175738, 356-2635; 14515, ARHGAP27, 73301, 175751, 218-1783; 14515, ARHGAP27, 73302, 175752, 420-653; 14515, ARHGAP27, 73303, 175753, 137-2140; 14515, ARHGAP27, 73304, 175754, 1-2604; 14515, ARHGAP27, 73306, 175756, 139-780; 14515, ARHGAP27, 73311, 175761, 19-2688; 14515, ARHGAP27, 73312, 175762, 450-1241; 14515, ARHGAP27, 73313, 175763, 137-2140;

14515, ARHGAP27, 73314, 175764, 420-653; 14515, ARHGAP27, 73315, 175765, 139-780; 14515, ARHGAP27, 73316, 175766, 1-2604; 14515, ARHGAP27, 73317, 175767, 218-1783; 14515, ARHGAP27, 73318, 175768, 1349-2140; 14515, ARHGAP27, 73319, 175769, 420-653; 14515, ARHGAP27, 73321, 175771, 137-2140; 14515, ARHGAP27, 73322, 175772, 1-2604; 14515, ARHGAP27, 73323, 175773, 139-780; 14515, ARHGAP27, 73324, 175774, 218-1783; 14515, ARHGAP27, 73298, 175748, 450-1241; 14515, ARHGAP27, 73299, 175749, 435-2081; 14515, ARHGAP27, 73300, 175750, 19-2688; 14515, ARHGAP27, 73305, 175755, 1392-2183; 14515, ARHGAP27, 73307, 175757, 19-2688; 14515, ARHGAP27, 73308, 175758, 435-2081; 14515, ARHGAP27, 73309, 175759, 435-2081; 14515, ARHGAP27, 73310, 175760, 450-1241; 14515, ARHGAP27, 73320, 175770, 1392-2183; 14516, ARHGAP28, 73329, 175779, 359-709; 14516, ARHGAP28, 73331, 175781, 213-1910; 14516, ARHGAP28, 73332, 175782, 31-443; 14516, ARHGAP28, 73333, 175783, 296-629; 14516, ARHGAP28, 73334, 175784, 1-608; 14516, ARHGAP28, 73335, 175785, 153-326; 14516, ARHGAP28, 73336, 175786, 243-462; 14516, ARHGAP28, 73337, 175787, 153-326; 14516, ARHGAP28, 73325, 175775, 3212-5224; 14516, ARHGAP28, 73326, 175776, 157-1869; 14516, ARHGAP28, 73327, 175777, 105-2294; 14516, ARHGAP28, 73328, 175778, 218-1930; 14516, ARHGAP28, 73330, 175780, 75-1712; 14517, ARHGAP29, 73340, 175790, 90-3197; 14517, ARHGAP29, 73338, 175788, 184-3969; 14517, ARHGAP29, 73339, 175789, 252-1433; 14518, ARHGAP30, 73342, 175792, 347-3121; 14518, ARHGAP30, 73343, 175793, 43-2715; 14518, ARHGAP30, 73344, 175794, 52-243; 14518, ARHGAP30, 73345, 175795, 180-389; 14518, ARHGAP30, 73346, 175796, 292-417; 14518, ARHGAP30, 73341, 175791, 322-3627; 14519, ARHGAP31, 73348, 175798, 55-551; 14519, ARHGAP31, 73347, 175797, 533-4867; 14520, ARHGAP32, 73351, 175801, 184-719; 14520, ARHGAP32, 73352, 175802, 25-2865; 14520, ARHGAP32, 73349, 175799, 1-6264; 14520, ARHGAP32, 73350, 175800, 380-5596; 14520, ARHGAP32, 73353, 175803, 35-5251; 14521, ARHGAP33, 73354, 175804, 58-2304; 14521, ARHGAP33, 73357, 175807, 117-413; 14521, ARHGAP33, 73358, 175808, 1-2590; 14521, ARHGAP33, 73359, 175809, 1-1987; 14521, ARHGAP33, 73355, 175805, 85-3465; 14521, ARHGAP33, 73356, 175806, 455-3826; 14522, ARHGAP35, 73361, 175811, 1-2250; 14522, ARHGAP35, 73360, 175810, 1-4500; 14522, ARHGAP35, 73362, 175812, 1-4500; 14523, ARHGAP36, 73367, 175817, 75-728; 14523, ARHGAP36, 73363, 175813, 346-1989; 14523, ARHGAP36, 73364, 175814, 114-1349; 14523, ARHGAP36, 73365, 175815, 31-1638; 14523, ARHGAP36, 73366, 175816, 38-1588; 14524, ARHGAP39, 73368, 175818, 203-3454; 14524, ARHGAP39, 73369, 175819, 86-3430; 14525, ARHGAP4, 73371, 175821, 43-2820; 14525, ARHGAP4, 73373, 175823, 53-2359; 14525, ARHGAP4, 73374, 175824, 104-757; 14525, ARHGAP4, 73375, 175825, 43-1920; 14525, ARHGAP4, 73376, 175826, 1-642; 14525, ARHGAP4, 73377, 175827, 96-625; 14525, ARHGAP4, 73378, 175828, 1-880; 14525, ARHGAP4, 73379, 175829, 1-586; 14525, ARHGAP4, 73380, 175830, 1-747; 14525, ARHGAP4, 73381, 175831, 48-570; 14525, ARHGAP4, 73382, 175832, 171-1123; 14525, ARHGAP4, 73383, 175833, 128-960; 14525, ARHGAP4, 73370, 175820, 43-2883; 14525, ARHGAP4, 73372, 175822, 59-3019; 14526, ARHGAP40, 73384, 175834, 1-1777; 14526, ARHGAP40, 73386, 175836, 1-463; 14526, ARHGAP40, 73387, 175837, 1-218; 14526, ARHGAP40, 73385, 175835, 169-2037; 14527, ARHGAP42, 73389, 175839, 27-2549; 14527, ARHGAP42, 73390, 175840, 1-690; 14527, ARHGAP42, 73391, 175841, 1-1331; 14527, ARHGAP42, 73388, 175838, 4-2628; 14528, ARHGAP44, 73392, 175842, 80-2404; 14528, ARHGAP44, 73395, 175845, 80-1855; 14528, ARHGAP44, 73396, 175846, 300-836; 14528, ARHGAP44, 73397, 175847, 156-730; 14528, ARHGAP44, 73398, 175848, 1-548; 14528, ARHGAP44, 73399, 175849, 48-398; 14528, ARHGAP44, 73393, 175843, 301-2739; 14528, ARHGAP44, 73394, 175844, 301-2757; 14529, ARHGAP5, 73402, 175852, 317-4813; 14529, ARHGAP5, 73405, 175855, 133-543; 14529, ARHGAP5, 73406, 175856, 235-654; 14529, ARHGAP5, 73408, 175858, 473-583; 14529, ARHGAP5, 73409, 175859, 1-445; 14529, ARHGAP5, 73400, 175850, 316-4824; 14529, ARHGAP5, 73401, 175851, 293-1006; 14529, ARHGAP5, 73403, 175853, 191-916; 14529, ARHGAP5, 73404, 175854, 238-4746; 14529, ARHGAP5, 73407, 175857, 256-4761; 14530, ARHGAP6, 73412, 175862, 1-1806; 14530, ARHGAP6, 73410, 175860, 312-2627; 14530, ARHGAP6, 73411, 175861, 874-3798; 14530, ARHGAP6, 73413, 175863, 874-3171; 14530, ARHGAP6, 73414, 175864, 248-2563; 14530, ARHGAP6, 73415, 175865, 874-2946; 14531, ARHGAP8, 73418, 175868, 72-158; 14531, ARHGAP8, 73420, 175870, 182-573; 14531, ARHGAP8, 73421, 175871, 236-581; 14531, ARHGAP8, 73422, 175872, 114-605; 14531, ARHGAP8, 73416, 175866, 97-1014; 14531, ARHGAP8, 73417, 175867, 94-1395; 14531, ARHGAP8, 73419, 175869, 142-1536; 14532, ARHGAP9, 73424, 175874, 194-2659; 14532, ARHGAP9, 73427, 175877, 12-533; 14532, ARHGAP9, 73428, 175878, 143-568; 14532, ARHGAP9, 73429, 175879, 1-470; 14532, ARHGAP9, 73430, 175880, 1-504; 14532, ARHGAP9, 73431, 175881, 231-624; 14532, ARHGAP9, 73432, 175882, 78-967; 14532, ARHGAP9, 73433, 175883, 381-563; 14532, ARHGAP9, 73434, 175884, 108-565; 14532, ARHGAP9, 73435, 175885, 152-2362; 14532, ARHGAP9, 73423, 175873, 140-2335; 14532, ARHGAP9, 73425, 175875, 227-2149; 14532, ARHGAP9, 73426, 175876, 433-2076; 14533, ARHGEF1, 73440, 175890, 1-206; 14533, ARHGEF1, 73441, 175891, 1-2108; 14533, ARHGEF1, 73442, 175892, 1-919; 14533, ARHGEF1, 73443, 175893, 1-826; 14533, ARHGEF1, 73444, 175894, 126-3032; 14533, ARHGEF1, 73445, 175895, 1-385; 14533, ARHGEF1, 73446, 175896, 1-872; 14533, ARHGEF1, 73447, 175897, 1-265; 14533, ARHGEF1, 73436, 175886, 21-2804; 14533, ARHGEF1, 73437, 175887, 85-2724; 14533, ARHGEF1, 73438, 175888, 149-2887; 14533, ARHGEF1, 73439, 175889, 99-2945; 14534, ARHGEF10, 73449, 175899, 488-1630; 14534, ARHGEF10, 73451, 175901, 1-2967; 14534, ARHGEF10, 73454, 175904, 488-1630; 14534, ARHGEF10, 73458, 175908, 1-2967; 14534, ARHGEF10, 73448, 175898, 186-4220; 14534, ARHGEF10, 73450, 175900, 1-4110; 14534, ARHGEF10, 73452, 175902, 174-4094; 14534, ARHGEF10, 73453, 175903, 164-4270; 14534, ARHGEF10, 73455, 175905, 186-4220; 14534, ARHGEF10, 73456, 175906, 1-4110; 14534, ARHGEF10, 73457, 175907, 174-4094; 14534, ARHGEF10, 73459, 175909, 164-4270; 14535, ARHGEF10L, 73462, 175912, 39-3197; 14535, ARHGEF10L, 73460, 175910, 1-1836; 14535, ARHGEF10L, 73461, 175911, 160-3999; 14535,

ARHGEF10L, 73463, 175913, 44-3766; 14536, ARHGEF11, 73464, 175914, 744-5312; 14536, ARHGEF11, 73465, 175915, 1041-5729; 14537, ARHGEF12, 73468, 175918, 471-4796; 14537, ARHGEF12, 73466, 175916, 331-4908; 14537, ARHGEF12, 73467, 175917, 167-4801; 14538, ARHGEF15, 73471, 175921, 189-537; 14538, ARHGEF15, 73472, 175922, 1-276; 14538, ARHGEF15, 73473, 175923, 92-714; 14538, ARHGEF15, 73469, 175919, 111-2636; 14538, ARHGEF15, 73470, 175920, 92-2617; 14539, ARHGEF16, 73477, 175927, 35-576; 14539, ARHGEF16, 73478, 175928, 397-836; 14539, ARHGEF16, 73474, 175924, 428-1693; 14539, ARHGEF16, 73475, 175925, 420-1685; 14539, ARHGEF16, 73476, 175926, 406-2535; 14540, ARHGEF17, 73480, 175930, 1-579; 14540, ARHGEF17, 73479, 175929, 351-6542; 14541, ARHGEF19, 73482, 175932, 1-921; 14541, ARHGEF19, 73483, 175933, 1-504; 14541, ARHGEF19, 73481, 175931, 138-2546; 14542, ARHGEF25, 73484, 175934, 461-2203; 14542, ARHGEF25, 73485, 175935, 38-1897; 14542, ARHGEF25, 73486, 175936, 331-1755; 14543, ARHGEF26, 73487, 175937, 285-2900; 14543, ARHGEF26, 73488, 175938, 132-1472; 14543, ARHGEF26, 73489, 175939, 212-2827; 14543, ARHGEF26, 73490, 175940, 156-2531; 14543, ARHGEF26, 73491, 175941, 167-2782; 14543, ARHGEF26, 73492, 175942, 285-2900; 14543, ARHGEF26, 73493, 175943, 132-1472; 14543, ARHGEF26, 73494, 175944, 156-2531; 14544, ARHGEF28, 73499, 175949, 1-1956; 14544, ARHGEF28, 73500, 175950, 311-560; 14544, ARHGEF28, 73495, 175945, 177-5132; 14544, ARHGEF28, 73496, 175946, 72-4250; 14544, ARHGEF28, 73497, 175947, 21-5216; 14544, ARHGEF28, 73498, 175948, 21-5138; 14544, ARHGEF28, 73501, 175951, 177-5294; 14544, ARHGEF28, 73502, 175952, 177-5372; 14545, ARHGEF3, 73506, 175956, 115-667; 14545, ARHGEF3, 73507, 175957, 1-709; 14545, ARHGEF3, 73508, 175958, 152-1402; 14545, ARHGEF3, 73509, 175959, 215-514; 14545, ARHGEF3, 73510, 175960, 455-1948; 14545, ARHGEF3, 73511, 175961, 132-284; 14545, ARHGEF3, 73512, 175962, 81-669; 14545, ARHGEF3, 73513, 175963, 113-1711; 14545, ARHGEF3, 73514, 175964, 81-293; 14545, ARHGEF3, 73503, 175953, 170-1750; 14545, ARHGEF3, 73504, 175954, 111-1787; 14545, ARHGEF3, 73505, 175955, 545-2143; 14546, ARHGEF33, 73517, 175967, 1-328; 14546, ARHGEF33, 73518, 175968, 1-327; 14546, ARHGEF33, 73515, 175965, 86-2698; 14546, ARHGEF33, 73516, 175966, 266-2878; 14547, ARHGEF35, 73519, 175969, 131-1585; 14548, ARHGEF37, 73521, 175971, 189-498; 14548, ARHGEF37, 73520, 175970, 164-2191; 14549, ARHGEF38, 73522, 175972, 147-806; 14549, ARHGEF38, 73523, 175973, 145-2478; 14550, ARHGEF39, 73524, 175974, 119-1126; 14550, ARHGEF39, 73525, 175975, 24-584; 14550, ARHGEF39, 73526, 175976, 2152-3051; 14551, ARHGEF4, 73529, 175979, 619-2781; 14551, ARHGEF4, 73530, 175980, 1199-4243; 14551, ARHGEF4, 73531, 175981, 1-1893; 14551, ARHGEF4, 73532, 175982, 1-1119; 14551, ARHGEF4, 73533, 175983, 520-1098; 14551, ARHGEF4, 73535, 175985, 1-862; 14551, ARHGEF4, 73536, 175986, 520-2412; 14551, ARHGEF4, 73527, 175977, 520-2592; 14551, ARHGEF4, 73528, 175978, 13-1872; 14551, ARHGEF4, 73534, 175984, 75-2087; 14552, ARHGEF40, 73538, 175988, 125-1796; 14552, ARHGEF40, 73539, 175989, 107-1615; 14552, ARHGEF40, 73540, 175990, 81-1943; 14552, ARHGEF40, 73537, 175987, 128-4687; 14553, ARHGEF5, 73542, 175992, 227-771; 14553, ARHGEF5, 73544, 175994, 1-2393; 14553, ARHGEF5, 73541, 175991, 175-4968; 14553, ARHGEF5, 73543, 175993, 303-1862; 14554, ARHGEF7, 73545, 175995, 498-2615; 14554, ARHGEF7, 73551, 176001, 53-481; 14554, ARHGEF7, 73553, 176003, 484-682; 14554, ARHGEF7, 73554, 176004, 64-1707; 14554, ARHGEF7, 73555, 176005, 463-581; 14554, ARHGEF7, 73556, 176006, 340-1681; 14554, ARHGEF7, 73557, 176007, 209-664; 14554, ARHGEF7, 73558, 176008, 508-691; 14554, ARHGEF7, 73559, 176009, 1-391; 14554, ARHGEF7, 73546, 175996, 909-3257; 14554, ARHGEF7, 73547, 175997, 220-2097; 14554, ARHGEF7, 73548, 175998, 474-2414; 14554, ARHGEF7, 73549, 175999, 251-2512; 14554, ARHGEF7, 73550, 176000, 251-2662; 14554, ARHGEF7, 73552, 176002, 357-2297; 14555, ARHGEF18, 73562, 176012, 1-2437; 14555, ARHGEF18, 73563, 176013, 323-582; 14555, ARHGEF18, 73560, 176010, 207-3254; 14555, ARHGEF18, 73561, 176011, 254-3775; 14556, ARHGEF2, 73567, 176017, 1-795; 14556, ARHGEF2, 73568, 176018, 400-420; 14556, ARHGEF2, 73569, 176019, 321-571; 14556, ARHGEF2, 73570, 176020, 1-791; 14556, ARHGEF2, 73571, 176021, 158-692; 14556, ARHGEF2, 73572, 176022, 122-764; 14556, ARHGEF2, 73573, 176023, 256-3351; 14556, ARHGEF2, 73574, 176024, 206-892; 14556, ARHGEF2, 73575, 176025, 1-180; 14556, ARHGEF2, 73564, 176014, 1-2958; 14556, ARHGEF2, 73565, 176015, 113-2989; 14556, ARHGEF2, 73566, 176016, 101-3061; 14557, ROCK1, 73577, 176027, 1-300; 14557, ROCK1, 73578, 176028, 111-3524; 14557, ROCK1, 73576, 176026, 942-5006; 14558, ROCK2, 73579, 176029, 6-1346; 14558, ROCK2, 73581, 176031, 474-3911; 14558, ROCK2, 73582, 176032, 119-729; 14558, ROCK2, 73583, 176033, 2505-4616; 14558, ROCK2, 73580, 176030, 450-4616; 14559, RHO, 73584, 176034, 95-1141; 14560, RHBDF1, 73586, 176036, 25-435; 14560, RHBDF1, 73587, 176037, 1-698; 14560, RHBDF1, 73588, 176038, 128-615; 14560, RHBDF1, 73589, 176039, 25-591; 14560, RHBDF1, 73590, 176040, 23-289; 14560, RHBDF1, 73585, 176035, 144-2711; 14561, RHBDF2, 73592, 176042, 392-613; 14561, RHBDF2, 73593, 176043, 489-574; 14561, RHBDF2, 73594, 176044, 506-545; 14561, RHBDF2, 73595, 176045, 371-589; 14561, RHBDF2, 73596, 176046, 231-568; 14561, RHBDF2, 73597, 176047, 656-734; 14561, RHBDF2, 73598, 176048, 431-572; 14561, RHBDF2, 73600, 176050, 1-261; 14561, RHBDF2, 73601, 176051, 381-935; 14561, RHBDF2, 73602, 176052, 361-629; 14561, RHBDF2, 73603, 176053, 414-554; 14561, RHBDF2, 73591, 176041, 275-2845; 14561, RHBDF2, 73599, 176049, 552-3035; 14562, RHBDD1, 73606, 176056, 14-487; 14562, RHBDD1, 73607, 176057, 205-576; 14562, RHBDD1, 73608, 176058, 615-777; 14562, RHBDD1, 73609, 176059, 103-556; 14562, RHBDD1, 73610, 176060, 174-577; 14562, RHBDD1, 73611, 176061, 446-596; 14562, RHBDD1, 73612, 176062, 354-371; 14562, RHBDD1, 73604, 176054, 243-1190; 14562, RHBDD1, 73605, 176055, 525-1472; 14563, RHBDD2, 73616, 176066, 80-319; 14563, RHBDD2, 73613, 176063, 136-1230; 14563, RHBDD2, 73614, 176064, 630-1301; 14563, RHBDD2, 73615, 176065, 31-702; 14564, RHBDD3, 73618, 176068, 346-755; 14564, RHBDD3, 73619, 176069, 393-662; 14564, RHBDD3, 73620, 176070, 316-900; 14564, RHBDD3, 73617, 176067, 426-1586; 14565, RHBDL1, 73623, 176073, 109-796; 14565, RHBDL1, 73621, 176071, 28-1344; 14565, RHBDL1, 73622, 176072, 126-1247; 14566, RHBDL2, 73624, 176074, 1010-1921; 14566, RHBDL2, 73625, 176075, 229-

1140; 14566, RHBDL2, 73626, 176076, 244-642; 14567, RHBDL3, 73628, 176078, 15-1262; 14567, RHBDL3, 73630, 176080, 15-170; 14567, RHBDL3, 73627, 176077, 15-1229; 14567, RHBDL3, 73629, 176079, 14-1204; 14567, RHBDL3, 73631, 176081, 123-1043; 14568, ROPN1, 73634, 176084, 295-683; 14568, ROPN1, 73636, 176086, 316-548; 14568, ROPN1, 73638, 176088, 379-727; 14568, ROPN1, 73632, 176082, 342-980; 14568, ROPN1, 73633, 176083, 229-867; 14568, ROPN1, 73635, 176085, 312-488; 14568, ROPN1, 73637, 176087, 390-566; 14568, ROPN1, 73639, 176089, 250-426; 14568, ROPN1, 73640, 176090, 103-279; 14568, ROPN1, 73641, 176091, 247-885; 14569, ROPN1B, 73644, 176094, 448-755; 14569, ROPN1B, 73646, 176096, 250-426; 14569, ROPN1B, 73647, 176097, 379-769; 14569, ROPN1B, 73642, 176092, 254-892; 14569, ROPN1B, 73643, 176093, 220-582; 14569, ROPN1B, 73645, 176095, 286-648; 14569, ROPN1B, 73648, 176098, 316-954; 14570, ROPN1L, 73649, 176099, 293-985; 14570, ROPN1L, 73650, 176100, 522-1214; 14571, RHPN1, 73651, 176101, 102-2114; 14571, RHPN1, 73652, 176102, 134-2221; 14572, RHPN2, 73654, 176104, 37-423; 14572, RHPN2, 73653, 176103, 37-2097; 14573, RHOBTB1, 73655, 176105, 339-2429; 14573, RHOBTB1, 73656, 176106, 205-2295; 14574, RHOBTB2, 73660, 176110, 256-803; 14574, RHOBTB2, 73657, 176107, 538-2721; 14574, RHOBTB2, 73658, 176108, 284-2533; 14574, RHOBTB2, 73659, 176109, 32-2236; 14575, RHOBTB3, 73662, 176112, 1-310; 14575, RHOBTB3, 73663, 176113, 83-811; 14575, RHOBTB3, 73664, 176114, 1-219; 14575, RHOBTB3, 73665, 176115, 6-547; 14575, RHOBTB3, 73666, 176116, 1-112; 14575, RHOBTB3, 73667, 176117, 1-518; 14575, RHOBTB3, 73668, 176118, 1-229; 14575, RHOBTB3, 73669, 176119, 1-352; 14575, RHOBTB3, 73670, 176120, 538-852; 14575, RHOBTB3, 73661, 176111, 509-2344; 14576, RTKN, 73671, 176121, 319-1860; 14576, RTKN, 73672, 176122, 84-1775; 14576, RTKN, 73673, 176123, 587-2239; 14577, RTKN2, 73674, 176124, 170-1096; 14577, RTKN2, 73675, 176125, 98-1927; 14577, RTKN2, 73676, 176126, 98-589; 14578, RHOXF1, 73677, 176127, 76-630; 14579, RHOXF2, 73678, 176128, 191-1057; 14580, RHOXF2B, 73679, 176129, 154-1020; 14581, RIBC1, 73680, 176130, 321-864; 14581, RIBC1, 73681, 176131, 154-1293; 14581, RIBC1, 73682, 176132, 239-955; 14581, RIBC1, 73683, 176133, 205-783; 14582, RIBC2, 73684, 176134, 197-1345; 14583, RFK, 73686, 176136, 1-363; 14583, RFK, 73685, 176135, 335-802; 14584, RBKS, 73688, 176138, 1-442; 14584, RBKS, 73689, 176139, 22-213; 14584, RBKS, 73690, 176140, 337-447; 14584, RBKS, 73691, 176141, 1-54; 14584, RBKS, 73687, 176137, 754-1722; 14585, RNASEH1, 73693, 176143, 30-161; 14585, RNASEH1, 73694, 176144, 73-204; 14585, RNASEH1, 73692, 176142, 357-1217; 14586, RNASEH2A, 73695, 176145, 95-994; 14587, RNASEH2B, 73698, 176148, 271-1269; 14587, RNASEH2B, 73699, 176149, 1-253; 14587, RNASEH2B, 73696, 176146, 400-1338; 14587, RNASEH2B, 73697, 176147, 276-1049; 14588, RNASEH2C, 73701, 176151, 479-724; 14588, RNASEH2C, 73702, 176152, 1-389; 14588, RNASEH2C, 73703, 176153, 44-787; 14588, RNASEH2C, 73704, 176154, 1-374; 14588, RNASEH2C, 73705, 176155, 1-476; 14588, RNASEH2C, 73700, 176150, 190-684; 14589, RNASEL, 73706, 176156, 255-2480; 14589, RNASEL, 73707, 176157, 255-2213; 14590, RPP14, 73708, 176158, 165-539; 14590, RPP14, 73709, 176159, 412-786; 14590, RPP14, 73710, 176160, 149-523; 14591, RPP21, 73712, 176162, 14-547; 14591, RPP21, 73713, 176163, 14-547; 14591, RPP21, 73714, 176164, 14-547; 14591, RPP21, 73719, 176169, 42-530; 14591, RPP21, 73722, 176172, 14-478; 14591, RPP21, 73724, 176174, 14-547; 14591, RPP21, 73725, 176175, 4-438; 14591, RPP21, 73727, 176177, 42-530; 14591, RPP21, 73731, 176181, 4-438; 14591, RPP21, 73733, 176183, 44-532; 14591, RPP21, 73734, 176184, 4-438; 14591, RPP21, 73738, 176188, 42-530; 14591, RPP21, 73711, 176161, 14-478; 14591, RPP21, 73715, 176165, 14-547; 14591, RPP21, 73716, 176166, 4-438; 14591, RPP21, 73717, 176167, 14-478; 14591, RPP21, 73718, 176168, 14-478; 14591, RPP21, 73720, 176170, 4-438; 14591, RPP21, 73721, 176171, 14-478; 14591, RPP21, 73723, 176173, 14-478; 14591, RPP21, 73726, 176176, 42-530; 14591, RPP21, 73728, 176178, 4-438; 14591, RPP21, 73729, 176179, 42-530; 14591, RPP21, 73730, 176180, 42-530; 14591, RPP21, 73732, 176182, 4-438; 14591, RPP21, 73735, 176185, 14-547; 14591, RPP21, 73736, 176186, 14-478; 14591, RPP21, 73737, 176187, 14-547; 14592, RPP25, 73739, 176189, 882-1481; 14593, RPP25L, 73740, 176190, 282-773; 14593, RPP25L, 73741, 176191, 78-569; 14594, RPP30, 73742, 176192, 5-767; 14594, RPP30, 73745, 176195, 1-639; 14594, RPP30, 73743, 176193, 272-1078; 14594, RPP30, 73744, 176194, 36-1004; 14595, RPP38, 73747, 176197, 325-762; 14595, RPP38, 73750, 176200, 358-863; 14595, RPP38, 73746, 176196, 515-1366; 14595, RPP38, 73748, 176198, 90-941; 14595, RPP38, 73749, 176199, 360-1211; 14595, RPP38, 73751, 176201, 598-1449; 14596, RPP40, 73754, 176204, 17-358; 14596, RPP40, 73755, 176205, 131-1042; 14596, RPP40, 73756, 176206, 62-1027; 14596, RPP40, 73752, 176202, 35-1057; 14596, RPP40, 73753, 176203, 46-1137; 14597, RNASET2, 73757, 176207, 403-618; 14597, RNASET2, 73760, 176210, 677-1333; 14597, RNASET2, 73761, 176211, 203-963; 14597, RNASET2, 73763, 176213, 408-1124; 14597, RNASET2, 73764, 176214, 408-1328; 14597, RNASET2, 73758, 176208, 362-727; 14597, RNASET2, 73759, 176209, 69-839; 14597, RNASET2, 73762, 176212, 521-1291; 14598, RNASE1, 73769, 176219, 101-451; 14598, RNASE1, 73765, 176215, 156-626; 14598, RNASE1, 73766, 176216, 508-978; 14598, RNASE1, 73767, 176217, 161-631; 14598, RNASE1, 73768, 176218, 184-654; 14599, RNASE10, 73770, 176220, 20-670; 14599, RNASE10, 73771, 176221, 405-1139; 14600, RNASE11, 73775, 176225, 315-850; 14600, RNASE11, 73776, 176226, 364-791; 14600, RNASE11, 73778, 176228, 119-527; 14600, RNASE11, 73780, 176230, 146-681; 14600, RNASE11, 73781, 176231, 189-703; 14600, RNASE11, 73772, 176222, 189-788; 14600, RNASE11, 73773, 176223, 256-855; 14600, RNASE11, 73774, 176224, 347-946; 14600, RNASE11, 73777, 176227, 186-785; 14600, RNASE11, 73779, 176229, 108-707; 14600, RNASE11, 73782, 176232, 106-705; 14601, RNASE12, 73783, 176233, 101-544; 14602, RNASE13, 73784, 176234, 139-609; 14603, RNASE2, 73785, 176235, 91-576; 14604, RNASE3, 73786, 176236, 59-541; 14605, RNASE4, 73787, 176237, 132-575; 14605, RNASE4, 73788, 176238, 111-554; 14605, RNASE4, 73789, 176239, 677-1120; 14606, RNASE7, 73790, 176240, 258-728; 14606, RNASE7, 73791, 176241, 168-638; 14607, RNASE8, 73792, 176242, 72-536; 14608, RNASE9, 73793, 176243, 73-690; 14608, RNASE9, 73794, 176244, 256-888; 14608, RNASE9, 73795, 176245, 108-725; 14608, RNASE9, 73796, 176246, 181-813; 14608, RNASE9, 73797, 176247, 125-742; 14608, RNASE9, 73798, 176248, 1692-2309; 14608, RNASE9, 73799, 176249, 146-778; 14608, RNASE9, 73800, 176250, 221-853; 14608, RNASE9, 73801, 176251, 160-777; 14608,

RNASE9, 73802, 176252, 1727-2344; 14608, RNASE9, 73803, 176253, 118-750; 14609, RNASE6, 73804, 176254, 294-746; 14610, RNASEK, 73805, 176255, 107-304; 14610, RNASEK, 73806, 176256, 130-345; 14610, RNASEK, 73808, 176258, 39-179; 14610, RNASEK, 73809, 176259, 149-550; 14610, RNASEK, 73810, 176260, 123-290; 14610, RNASEK, 73811, 176261, 166-381; 14610, RNASEK, 73812, 176262, 74-370; 14610, RNASEK, 73807, 176257, 151-564; 14611, RNH1, 73819, 176269, 135-368; 14611, RNH1, 73820, 176270, 1-858; 14611, RNH1, 73821, 176271, 455-480; 14611, RNH1, 73822, 176272, 172-678; 14611, RNH1, 73824, 176274, 304-870; 14611, RNH1, 73825, 176275, 584-704; 14611, RNH1, 73826, 176276, 146-727; 14611, RNH1, 73828, 176278, 276-873; 14611, RNH1, 73829, 176279, 167-709; 14611, RNH1, 73830, 176280, 233-340; 14611, RNH1, 73836, 176286, 304-870; 14611, RNH1, 73839, 176289, 146-727; 14611, RNH1, 73840, 176290, 135-368; 14611, RNH1, 73841, 176291, 455-480; 14611, RNH1, 73842, 176292, 584-704; 14611, RNH1, 73843, 176293, 1-858; 14611, RNH1, 73844, 176294, 276-873; 14611, RNH1, 73846, 176296, 233-340; 14611, RNH1, 73813, 176263, 370-1755; 14611, RNH1, 73814, 176264, 276-1661; 14611, RNH1, 73815, 176265, 161-1546; 14611, RNH1, 73816, 176266, 301-1686; 14611, RNH1, 73817, 176267, 453-1838; 14611, RNH1, 73818, 176268, 197-1582; 14611, RNH1, 73823, 176273, 1409-2794; 14611, RNH1, 73827, 176277, 299-1684; 14611, RNH1, 73831, 176281, 301-1686; 14611, RNH1, 73832, 176282, 370-1755; 14611, RNH1, 73833, 176283, 453-1838; 14611, RNH1, 73834, 176284, 1409-2794; 14611, RNH1, 73835, 176285, 276-1661; 14611, RNH1, 73837, 176287, 161-1546; 14611, RNH1, 73838, 176288, 299-1684; 14611, RNH1, 73845, 176295, 197-1582; 14612, RAE1, 73850, 176300, 177-588; 14612, RAE1, 73851, 176301, 69-480; 14612, RAE1, 73852, 176302, 430-691; 14612, RAE1, 73853, 176303, 179-1492; 14612, RAE1, 73854, 176304, 157-810; 14612, RAE1, 73847, 176297, 144-1250; 14612, RAE1, 73848, 176298, 384-1490; 14612, RAE1, 73849, 176299, 421-1527; 14613, RAVER1, 73855, 176305, 83-2353; 14613, RAVER1, 73856, 176306, 1-290; 14613, RAVER1, 73857, 176307, 1-393; 14613, RAVER1, 73859, 176309, 40-2259; 14613, RAVER1, 73860, 176310, 81-2351; 14613, RAVER1, 73858, 176308, 132-1952; 14614, RAVER2, 73863, 176313, 124-624; 14614, RAVER2, 73861, 176311, 79-2154; 14614, RAVER2, 73862, 176312, 79-2115; 14615, RRM1, 73865, 176315, 300-2012; 14615, RRM1, 73866, 176316, 1-392; 14615, RRM1, 73867, 176317, 171-284; 14615, RRM1, 73868, 176318, 215-424; 14615, RRM1, 73869, 176319, 135-362; 14615, RRM1, 73864, 176314, 205-2583; 14616, RRM2, 73872, 176322, 193-1060; 14616, RRM2, 73870, 176320, 70-1239; 14616, RRM2, 73871, 176321, 292-1641; 14616, RRM2, 73873, 176323, 52-1401; 14617, RRM2B, 73876, 176326, 66-263; 14617, RRM2B, 73877, 176327, 1-1225; 14617, RRM2B, 73881, 176331, 332-1225; 14617, RRM2B, 73874, 176324, 245-1300; 14617, RRM2B, 73875, 176325, 1-900; 14617, RRM2B, 73878, 176328, 1-201; 14617, RRM2B, 73879, 176329, 1-132; 14617, RRM2B, 73880, 176330, 1-420; 14618, RPN1, 73883, 176333, 578-1885; 14618, RPN1, 73884, 176334, 21-386; 14618, RPN1, 73882, 176332, 50-1873; 14619, RPN2, 73887, 176337, 40-1073; 14619, RPN2, 73888, 176338, 292-791; 14619, RPN2, 73889, 176339, 1-442; 14619, RPN2, 73890, 176340, 1-417; 14619, RPN2, 73891, 176341, 227-712; 14619, RPN2, 73885, 176335, 312-2207; 14619, RPN2, 73886, 176336, 197-2044; 14620, RPIA, 73892, 176342, 56-991; 14621, RSL1D1, 73893, 176343, 33-1323; 14621, RSL1D1, 73894, 176344, 69-188; 14621, RSL1D1, 73895, 176345, 1-281; 14621, RSL1D1, 73896, 176346, 7-150; 14621, RSL1D1, 73897, 176347, 225-520; 14621, RSL1D1, 73898, 176348, 31-162; 14621, RSL1D1, 73899, 176349, 36-509; 14621, RSL1D1, 73900, 176350, 5-894; 14621, RSL1D1, 73902, 176352, 7-147; 14621, RSL1D1, 73901, 176351, 74-1546; 14622, RSL24D1, 73904, 176354, 244-442; 14622, RSL24D1, 73905, 176355, 25-276; 14622, RSL24D1, 73903, 176353, 178-669; 14623, RIMKLA, 73906, 176356, 574-864; 14623, RIMKLA, 73907, 176357, 130-1305; 14624, RIMKLB, 73910, 176360, 197-481; 14624, RIMKLB, 73912, 176362, 213-555; 14624, RIMKLB, 73913, 176363, 51-560; 14624, RIMKLB, 73908, 176358, 1263-2423; 14624, RIMKLB, 73909, 176359, 185-1108; 14624, RIMKLB, 73911, 176361, 826-1986; 14624, RIMKLB, 73914, 176364, 455-1615; 14624, RIMKLB, 73915, 176365, 125-1048; 14625, RPL10, 73918, 176368, 202-693; 14625, RPL10, 73919, 176369, 56-657; 14625, RPL10, 73920, 176370, 41-585; 14625, RPL10, 73921, 176371, 1-276; 14625, RPL10, 73922, 176372, 1-396; 14625, RPL10, 73923, 176373, 1-327; 14625, RPL10, 73924, 176374, 1-87; 14625, RPL10, 73926, 176376, 189-725; 14625, RPL10, 73916, 176366, 149-793; 14625, RPL10, 73917, 176367, 577-1221; 14625, RPL10, 73925, 176375, 189-833; 14626, RPL10A, 73927, 176377, 28-681; 14627, RPL10L, 73928, 176378, 86-730; 14628, RPL11, 73930, 176380, 1-396; 14628, RPL11, 73931, 176381, 1-525; 14628, RPL11, 73929, 176379, 46-582; 14629, RPL12, 73932, 176382, 89-586; 14629, RPL12, 73933, 176383, 57-455; 14630, RPL13, 73938, 176388, 52-243; 14630, RPL13, 73939, 176389, 391-554; 14630, RPL13, 73940, 176390, 1-235; 14630, RPL13, 73941, 176391, 150-528; 14630, RPL13, 73934, 176384, 77-712; 14630, RPL13, 73935, 176385, 250-885; 14630, RPL13, 73936, 176386, 51-545; 14630, RPL13, 73937, 176387, 39-674; 14631, RPL13A, 73943, 176393, 1-632; 14631, RPL13A, 73944, 176394, 23-163; 14631, RPL13A, 73945, 176395, 184-612; 14631, RPL13A, 73946, 176396, 28-174; 14631, RPL13A, 73942, 176392, 77-688; 14632, RPL14, 73949, 176399, 119-493; 14632, RPL14, 73950, 176400, 110-268; 14632, RPL14, 73947, 176397, 70-717; 14632, RPL14, 73948, 176398, 133-780; 14633, RPL15, 73953, 176403, 189-588; 14633, RPL15, 73957, 176407, 128-650; 14633, RPL15, 73958, 176408, 14-193; 14633, RPL15, 73959, 176409, 38-562; 14633, RPL15, 73951, 176401, 640-1254; 14633, RPL15, 73952, 176402, 156-770; 14633, RPL15, 73954, 176404, 170-784; 14633, RPL15, 73955, 176405, 159-773; 14633, RPL15, 73956, 176406, 381-818; 14633, RPL15, 73960, 176410, 120-734; 14633, RPL15, 73961, 176411, 394-1008; 14634, RPL17, 73962, 176412, 439-827; 14634, RPL17, 73964, 176414, 237-758; 14634, RPL17, 73966, 176416, 314-481; 14634, RPL17, 73968, 176418, 180-704; 14634, RPL17, 73970, 176420, 172-684; 14634, RPL17, 73971, 176421, 163-576; 14634, RPL17, 73972, 176422, 256-650; 14634, RPL17, 73974, 176424, 289-795; 14634, RPL17, 73975, 176425, 294-586; 14634, RPL17, 73963, 176413, 201-755; 14634, RPL17, 73965, 176415, 80-634; 14634, RPL17, 73967, 176417, 109-549; 14634, RPL17, 73969, 176419, 270-824; 14634, RPL17, 73973, 176423, 264-818; 14634, RPL17, 73976, 176426, 127-681; 14635, RPL18, 73977, 176427, 1-571; 14635, RPL18, 73978, 176428, 1-502; 14635, RPL18, 73980, 176430, 722-1111; 14635, RPL18, 73981, 176431, 21-422; 14635, RPL18, 73982, 176432, 34-288; 14635, RPL18, 73984, 176434, 35-529; 14635, RPL18, 73985, 176435, 26-440; 14635, RPL18, 73979, 176429, 394-960; 14635, RPL18, 73983, 176433, 39-518; 14636, RPL18A, 73987, 176437, 26-439; 14636, RPL18A, 73988, 176438, 37-501; 14636, RPL18A, 73989, 176439, 600-1043; 14636, RPL18A, 73990, 176440, 260-683; 14636, RPL18A, 73986, 176436, 82-612; 14637, RPL19, 73992, 176442, 136-720; 14637, RPL19, 73993, 176443, 17-402; 14637, RPL19, 73994, 176444, 30-611; 14637, RPL19, 73995, 176445, 404-988; 14637, RPL19, 73991, 176441, 63-653; 14638, RPL21, 74000, 176450, 38-301; 14638, RPL21, 74001, 176451, 73-438; 14638, RPL21, 74002, 176452, 13-192; 14638, RPL21, 73996, 176446, 290-772; 14638, RPL21, 73997, 176447, 91-573; 14638, RPL21, 73998, 176448, 116-598; 14638, RPL21, 73999, 176449, 281-763; 14639, RPL22, 74004, 176454, 664-806; 14639, RPL22, 74005, 176455, 89-250; 14639, RPL22, 74006, 176456, 272-508; 14639, RPL22, 74007, 176457, 257-524; 14639, RPL22, 74008, 176458, 455-600; 14639, RPL22, 74009, 176459, 442-729; 14639, RPL22, 74003, 176453, 40-426; 14640, RPL22L1, 74011, 176461, 29-223; 14640, RPL22L1, 74012, 176462, 29-394; 14640, RPL22L1, 74013, 176463, 1-429; 14640, RPL22L1, 74014, 176464, 42-233; 14640, RPL22L1, 74010, 176460, 317-685; 14641, RPL23, 74015, 176465, 118-392; 14641, RPL23, 74017, 176467, 26-370; 14641, RPL23, 74019, 176469, 28-396; 14641, RPL23, 74020, 176470, 292-537; 14641, RPL23, 74021, 176471, 231-333; 14641, RPL23, 74016, 176466, 13-435; 14641, RPL23, 74018, 176468, 134-556; 14642, RPL23A, 74022, 176472, 1-476; 14642, RPL23A, 74023, 176473, 49-633; 14642, RPL23A, 74025, 176475, 1-511; 14642, RPL23A, 74026, 176476, 372-584; 14642, RPL23A, 74027, 176477, 369-581; 14642, RPL23A, 74028, 176478, 1-528; 14642, RPL23A, 74024, 176474, 614-1084; 14643, RPL24, 74030, 176480, 30-395; 14643, RPL24, 74031, 176481, 20-472; 14643, RPL24, 74029, 176479, 107-580; 14644, RPL26, 74033, 176483, 1-192; 14644, RPL26, 74035, 176485, 6-197; 14644, RPL26, 74036, 176486, 245-534; 14644, RPL26, 74039, 176489, 43-375; 14644, RPL26, 74040, 176490, 1-407; 14644, RPL26, 74041, 176491, 425-747; 14644, RPL26, 74032, 176482, 43-480; 14644, RPL26, 74034, 176484, 86-523; 14644, RPL26, 74037, 176487, 311-748; 14644, RPL26, 74038, 176488, 393-830; 14645, RPL26L1, 74045, 176495, 118-233; 14645, RPL26L1, 74047, 176497, 110-493; 14645, RPL26L1, 74042, 176492, 55-492; 14645, RPL26L1, 74043, 176493, 83-520; 14645, RPL26L1, 74044, 176494, 125-562; 14645, RPL26L1, 74046, 176496, 65-502; 14646, RPL27, 74050, 176500, 1-434; 14646, RPL27, 74052, 176502, 299-541; 14646, RPL27, 74053, 176503, 39-161; 14646, RPL27, 74048, 176498, 41-451; 14646, RPL27, 74049, 176499, 275-685; 14646, RPL27, 74051, 176501, 146-556; 14647, RPL27A, 74055, 176505, 202-477; 14647, RPL27A, 74056, 176506, 242-517; 14647, RPL27A, 74057, 176507, 561-836; 14647, RPL27A, 74058, 176508, 27-353; 14647, RPL27A, 74059, 176509, 488-763; 14647, RPL27A, 74060, 176510, 23-364; 14647, RPL27A, 74061, 176511, 23-148; 14647, RPL27A, 74062, 176512, 1-128; 14647, RPL27A, 74054, 176504, 404-850; 14648, RPL28, 74066, 176516, 39-551; 14648, RPL28, 74069, 176519, 9-278; 14648, RPL28, 74071, 176521, 2-340; 14648, RPL28, 74063, 176513, 630-1043; 14648, RPL28, 74064, 176514, 43-252; 14648, RPL28, 74065, 176515, 43-306; 14648, RPL28, 74067, 176517, 43-552; 14648, RPL28, 74068, 176518, 41-532; 14648, RPL28, 74070, 176520, 398-811; 14649, RPL29, 74076, 176526, 34-216; 14649, RPL29, 74078, 176528, 34-147; 14649, RPL29, 74072, 176522, 95-574; 14649, RPL29, 74073, 176523, 46-525; 14649, RPL29, 74074, 176524, 71-550; 14649, RPL29, 74075, 176525, 59-537; 14649, RPL29, 74077, 176527, 142-621; 14649, RPL29, 74079, 176529, 114-593; 14650, RPL3, 74081, 176531, 388-1205; 14650, RPL3, 74082, 176532, 176-1231; 14650, RPL3, 74083, 176533, 1-782; 14650, RPL3, 74084, 176534, 1-916; 14650, RPL3, 74085, 176535, 27-569; 14650, RPL3, 74080, 176530, 175-1386; 14651, RPL30, 74087, 176537, 70-360; 14651, RPL30, 74089, 176539, 788-1129; 14651, RPL30, 74090, 176540, 118-273; 14651, RPL30, 74091, 176541, 71-241; 14651, RPL30, 74086, 176536, 116-463; 14651, RPL30, 74088, 176538, 148-495; 14652, RPL31, 74093, 176543, 24-386; 14652, RPL31, 74096, 176546, 24-416; 14652, RPL31, 74097, 176547, 12-251; 14652, RPL31, 74098, 176548, 88-327; 14652, RPL31, 74100, 176550, 6-245; 14652, RPL31, 74101, 176551, 1-326; 14652, RPL31, 74102, 176552, 12-357; 14652, RPL31, 74092, 176542, 602-979; 14652, RPL31, 74094, 176544, 410-787; 14652, RPL31, 74095, 176545, 34-420; 14652, RPL31, 74099, 176549, 24-389; 14653, RPL32, 74103, 176553, 59-520; 14653, RPL32, 74107, 176557, 156-555; 14653, RPL32, 74108, 176558, 254-439; 14653, RPL32, 74104, 176554, 1293-1700; 14653, RPL32, 74105, 176555, 194-601; 14653, RPL32, 74106, 176556, 169-576; 14653, RPL32, 74109, 176559, 101-508; 14654, RPL34, 74110, 176560, 133-486; 14654, RPL34, 74111, 176561, 45-398; 14654, RPL34, 74112, 176562, 67-420; 14654, RPL34, 74113, 176563, 156-509; 14654, RPL34, 74114, 176564, 42-395; 14655, RPL35, 74116, 176566, 4-294; 14655, RPL35, 74117, 176567, 24-314; 14655, RPL35, 74118, 176568, 50-340; 14655, RPL35, 74115, 176565, 50-421; 14656, RPL35A, 74119, 176569, 236-517; 14656, RPL35A, 74121, 176571, 49-216; 14656, RPL35A, 74122, 176572, 15-188; 14656, RPL35A, 74120, 176570, 139-471; 14656, RPL35A, 74123, 176573, 268-600; 14657, RPL36, 74127, 176577, 36-239; 14657, RPL36, 74129, 176579, 25-309; 14657, RPL36, 74124, 176574, 135-452; 14657, RPL36, 74125, 176575, 193-510; 14657, RPL36, 74126, 176576, 86-403; 14657, RPL36, 74128, 176578, 545-862; 14658, RPL36A, 74130, 176580, 29-241; 14658, RPL36A, 74131, 176581, 56-394; 14658, RPL36A, 74132, 176582, 113-541; 14658, RPL36A, 74134, 176584, 275-352; 14658, RPL36A, 74135, 176585, 47-475; 14658, RPL36A, 74133, 176583, 62-382; 14659, RPL36AL, 74136, 176586, 161-481; 14660, RPL37, 74138, 176588, 28-252; 14660, RPL37, 74139, 176589, 28-276; 14660, RPL37, 74137, 176587, 151-444; 14661, RPL37A, 74140, 176590, 21-248; 14661, RPL37A, 74141, 176591, 14-190; 14661, RPL37A, 74142, 176592, 136-342; 14661, RPL37A, 74144, 176594, 254-436; 14661, RPL37A, 74145, 176595, 26-244; 14661, RPL37A, 74146, 176596, 111-293; 14661, RPL37A, 74147, 176597, 254-520; 14661, RPL37A, 74143, 176593, 687-965; 14662, RPL38, 74151, 176601, 106-169; 14662, RPL38, 74152, 176602, 91-285; 14662, RPL38, 74153, 176603, 92-295; 14662, RPL38, 74148, 176598, 132-344; 14662, RPL38, 74149, 176599, 168-380; 14662, RPL38, 74150, 176600, 253-465; 14663, RPL39, 74154, 176604, 68-223; 14664, RPL39L, 74155, 176605, 404-559; 14664, RPL39L, 74156, 176606, 397-552; 14664, RPL39L, 74157, 176607, 301-456; 14665, RPL3L, 74159, 176609, 447-575; 14665, RPL3L, 74158, 176608, 96-1319; 14666, RPL4, 74161, 176611, 779-1780; 14666, RPL4, 74162, 176612, 56-565; 14666, RPL4, 74163, 176613, 57-569; 14666, RPL4, 74160, 176610, 94-1377; 14667, RPL41, 74164, 176614, 84-161; 14667, RPL41, 74165, 176615, 203-280; 14668, RPL5, 74166, 176616, 291-681; 14668, RPL5, 74168, 176618, 52-243; 14668, RPL5, 74167, 176617, 91-984; 14669, RPL6, 74171, 176621, 297-612; 14669, RPL6, 74172, 176622, 110-588; 14669, RPL6, 74173, 176623, 340-700; 14669, RPL6, 74174, 176624, 148-338; 14669, RPL6, 74175, 176625, 83-438; 14669, RPL6, 74176, 176626, 535-1014; 14669, RPL6, 74169, 176619, 56-922; 14669, RPL6, 74170, 176620, 187-1053; 14670, RPL7, 74178, 176628, 680-1306; 14670, RPL7, 74179, 176629, 132-758; 14670, RPL7, 74180, 176630, 140-766; 14670, RPL7, 74181, 176631, 299-563; 14670, RPL7, 74182, 176632, 148-445; 14670, RPL7, 74177, 176627, 287-1033; 14671, RPL7A, 74183, 176633, 165-620; 14671, RPL7A, 74185, 176635, 483-1057; 14671, RPL7A, 74184, 176634, 31-831; 14672, RPL7L1, 74188, 176638, 6-596; 14672, RPL7L1, 74186, 176636, 257-997; 14672, RPL7L1, 74187, 176637, 304-1044; 14673, RPL8, 74192, 176642, 15-518; 14673, RPL8, 74193, 176643, 131-745; 14673, RPL8, 74194, 176644, 25-730; 14673, RPL8, 74195, 176645, 70-516; 14673, RPL8, 74196, 176646, 1-331; 14673, RPL8, 74189, 176639, 234-1007; 14673, RPL8, 74190, 176640, 157-930; 14673, RPL8, 74191, 176641, 223-996; 14674, RPL9, 74199, 176649, 27-571; 14674, RPL9, 74200, 176650, 192-689; 14674, RPL9, 74201, 176651, 1-274; 14674, RPL9, 74202, 176652, 1-568; 14674, RPL9, 74197, 176647, 60-638; 14674, RPL9, 74198, 176648, 450-1028; 14675, RPS10, 74204, 176654, 1-519; 14675, RPS10, 74203, 176653, 95-592; 14675, RPS10, 74205, 176655, 247-744; 14676, RPS11, 74207, 176657, 1-249; 14676, RPS11, 74208, 176658, 26-382; 14676, RPS11, 74209, 176659, 282-521; 14676, RPS11, 74210, 176660, 4-270; 14676, RPS11, 74206, 176656, 84-560; 14677, RPS12, 74211, 176661, 211-609; 14678, RPS13, 74212, 176662, 26-472; 14678, RPS13, 74213, 176663, 7-355; 14678, RPS13, 74214, 176664, 147-602; 14679, RPS14, 74219, 176669, 1-362; 14679, RPS14, 74220, 176670, 3-407; 14679, RPS14, 74215, 176665, 208-663; 14679, RPS14, 74216, 176666, 274-729; 14679, RPS14, 74217, 176667, 48-503; 14679, RPS14, 74218, 176668, 84-539; 14680, RPS15, 74221, 176671, 6-395; 14680, RPS15, 74222, 176672, 139-597; 14680, RPS15, 74223, 176673, 97-435; 14680, RPS15, 74225, 176675, 192-530; 14680, RPS15, 74226, 176676, 22-447; 14680, RPS15, 74227, 176677, 146-502; 14680, RPS15, 74228, 176678, 485-841; 14680, RPS15, 74229, 176679, 341-679; 14680, RPS15, 74230, 176680, 115-522; 14680, RPS15, 74231, 176681, 232-436; 14680, RPS15, 74232, 176682, 318-338; 14680, RPS15, 74224, 176674, 41-478; 14681, RPS15A, 74235, 176685, 31-183; 14681, RPS15A, 74236, 176686, 31-180; 14681, RPS15A, 74237, 176687, 1-176; 14681, RPS15A, 74240, 176690, 59-394; 14681, RPS15A, 74241, 176691, 25-360; 14681, RPS15A, 74242, 176692, 59-217; 14681, RPS15A, 74243, 176693, 7-309; 14681, RPS15A, 74233, 176683, 97-489; 14681, RPS15A, 74234, 176684, 80-472; 14681, RPS15A, 74238, 176688, 370-762; 14681, RPS15A, 74239, 176689, 31-423; 14682, RPS16, 74245, 176695, 42-500; 14682, RPS16, 74246, 176696, 1-153; 14682, RPS16, 74247, 176697, 1-258; 14682, RPS16, 74248, 176698, 47-436; 14682, RPS16, 74249, 176699, 21-323; 14682, RPS16, 74244, 176694, 54-494; 14683, RPS17, 74251, 176701, 10-583; 14683, RPS17, 74252, 176702, 1-179; 14683, RPS17, 74253, 176703, 32-442; 14683, RPS17, 74255, 176705, 1-179; 14683, RPS17, 74256, 176706, 32-442; 14683, RPS17, 74250, 176700, 137-544; 14683, RPS17, 74254, 176704, 137-544; 14684, RPS18, 74258, 176708, 111-212; 14684, RPS18, 74263, 176713, 393-641; 14684, RPS18, 74264, 176714, 393-641; 14684, RPS18, 74265, 176715, 393-641; 14684, RPS18, 74266, 176716, 297-545; 14684, RPS18, 74267, 176717, 297-545; 14684, RPS18, 74268, 176718, 362-610; 14684, RPS18, 74269, 176719, 1-99; 14684, RPS18, 74257, 176707, 111-569; 14684, RPS18, 74259, 176709, 111-569; 14684, RPS18, 74260, 176710, 111-569; 14684, RPS18, 74261, 176711, 111-569; 14684, RPS18, 74262, 176712, 111-569; 14685, RPS19, 74270, 176720, 246-461; 14685, RPS19, 74271, 176721, 192-420; 14685, RPS19, 74272, 176722, 7-307; 14685, RPS19, 74275, 176725, 36-342; 14685, RPS19, 74276, 176726, 1-216; 14685, RPS19, 74273, 176723, 50-487; 14685, RPS19, 74274, 176724, 373-810; 14686, RPS19BP1, 74278, 176728, 24-233; 14686, RPS19BP1, 74277, 176727, 118-528; 14687, RPS2, 74280, 176730, 66-719; 14687, RPS2, 74281, 176731, 188-817; 14687, RPS2, 74282, 176732, 1-191; 14687, RPS2, 74283, 176733, 1-588; 14687, RPS2, 74284, 176734, 7-600; 14687, RPS2, 74285, 176735, 179-886; 14687, RPS2, 74286, 176736, 39-170; 14687, RPS2, 74287, 176737, 1-468; 14687, RPS2, 74279, 176729, 58-939; 14688, RPS20, 74290, 176740, 193-387; 14688, RPS20, 74291, 176741, 101-286; 14688, RPS20, 74292, 176742, 116-301; 14688, RPS20, 74293, 176743, 510-704; 14688, RPS20, 74294, 176744, 124-264; 14688, RPS20, 74288, 176738, 124-483; 14688, RPS20, 74289, 176739, 255-614; 14688, RPS20, 74295, 176745, 127-555; 14688, RPS20, 74296, 176746, 199-627; 14689, RPS21, 74298, 176748, 43-243; 14689, RPS21, 74299, 176749, 15-287; 14689, RPS21, 74300, 176750, 22-267; 14689, RPS21, 74297, 176747, 40-291; 14690, RPS23, 74302, 176752, 33-200; 14690, RPS23, 74303, 176753, 32-403; 14690, RPS23, 74304, 176754, 74-331; 14690, RPS23, 74305, 176755, 29-433; 14690, RPS23, 74306, 176756, 19-423; 14690, RPS23, 74301, 176751, 255-686; 14691, RPS24, 74310, 176760, 143-538; 14691, RPS24, 74311, 176761, 143-538; 14691, RPS24, 74307, 176757, 20-412; 14691, RPS24, 74308, 176758, 38-439; 14691, RPS24, 74309, 176759, 143-1012; 14692, RPS25, 74312, 176762, 47-166; 14692, RPS25, 74314, 176764, 395-514; 14692, RPS25, 74315, 176765, 395-514; 14692, RPS25, 74317, 176767, 47-166; 14692, RPS25, 74313, 176763, 407-784; 14692, RPS25, 74316, 176766, 407-784; 14693, RPS26, 74318, 176768, 315-662; 14693, RPS26, 74319, 176769, 207-554; 14694, RPS27, 74321, 176771, 36-236; 14694, RPS27, 74320, 176770, 39-293; 14695, RPS27A, 74325, 176775, 105-422; 14695, RPS27A, 74322, 176772, 325-795; 14695, RPS27A, 74323, 176773, 224-694; 14695, RPS27A, 74324, 176774, 148-618; 14696, RPS27L, 74327, 176777, 95-388; 14696, RPS27L, 74328, 176778, 197-355; 14696, RPS27L, 74329, 176779, 586-744; 14696, RPS27L, 74330, 176780, 200-502; 14696, RPS27L, 74331, 176781, 356-514; 14696, RPS27L, 74326, 176776, 398-652; 14697, RPS28, 74332, 176782, 32-241; 14698, RPS29, 74335, 176785, 239-400; 14698, RPS29, 74333, 176783, 31-201; 14698, RPS29, 74334, 176784, 31-234; 14698, RPS29, 74336, 176786, 71-238; 14699, RPS3, 74338, 176788, 276-586; 14699, RPS3, 74339, 176789, 1-408; 14699, RPS3, 74340, 176790, 19-366; 14699, RPS3, 74341, 176791, 30-164; 14699, RPS3, 74342, 176792, 31-306; 14699, RPS3, 74343, 176793, 30-383; 14699, RPS3, 74344, 176794, 12-707; 14699, RPS3, 74347, 176797, 7-390; 14699, RPS3, 74348, 176798, 531-639; 14699, RPS3, 74349, 176799, 18-494; 14699, RPS3, 74350, 176800, 1-101; 14699, RPS3, 74351, 176801, 1-515; 14699, RPS3, 74353, 176803, 1-371; 14699, RPS3, 74337, 176787, 19-798; 14699, RPS3, 74345, 176795, 6-737; 14699, RPS3, 74346, 176796, 63-794; 14699, RPS3, 74352, 176802, 18-749; 14700, RPS3A, 74355, 176805, 286-480; 14700, RPS3A, 74356, 176806, 1-573; 14700, RPS3A, 74357, 176807, 258-941; 14700, RPS3A, 74358, 176808, 211-587; 14700, RPS3A, 74359, 176809, 95-532; 14700, RPS3A, 74360, 176810, 15-632; 14700, RPS3A, 74361, 176811, 94-674; 14700, RPS3A, 74362, 176812, 310-614; 14700, RPS3A, 74363, 176813, 1-627; 14700, RPS3A, 74364, 176814, 25-312; 14700, RPS3A, 74365, 176815, 149-832; 14700, RPS3A, 74366, 176816, 93-762; 14700, RPS3A, 74354, 176804, 81-875; 14701, RPS4X, 74367, 176817, 106-897; 14702, RPS4Y1, 74369, 176819, 25-811; 14702, RPS4Y1, 74368, 176818, 140-931; 14703, RPS4Y2, 74370, 176820, 1-792; 14704, RPS5, 74373, 176823, 78-482; 14704, RPS5, 74374, 176824, 118-718; 14704, RPS5, 74375, 176825, 73-750; 14704, RPS5, 74371, 176821, 73-687; 14704, RPS5, 74372, 176822, 533-1147; 14704, RPS5, 74376, 176826, 850-1464; 14705, RPS6, 74377, 176827, 42-317; 14705, RPS6, 74378, 176828, 199-855; 14705, RPS6, 74379, 176829, 676-1332; 14705, RPS6, 74380, 176830, 60-809; 14706, RPS6KC1, 74383, 176833, 595-3252; 14706, RPS6KC1, 74384, 176834, 833-3397; 14706, RPS6KC1, 74385, 176835, 794-3358; 14706, RPS6KC1, 74386, 176836, 1387-3192; 14706, RPS6KC1, 74381, 176831, 151-3315; 14706, RPS6KC1, 74382, 176832, 151-3351; 14707, RPS6KB1, 74391, 176841, 436-622; 14707, RPS6KB1, 74392, 176842, 48-206; 14707, RPS6KB1, 74393, 176843, 100-522; 14707, RPS6KB1, 74387, 176837, 22-1599; 14707, RPS6KB1, 74388, 176838, 428-1846; 14707, RPS6KB1, 74389, 176839, 41-1396; 14707, RPS6KB1, 74390, 176840, 56-1564; 14708, RPS6KB2, 74395, 176845, 402-461; 14708, RPS6KB2, 74397, 176847, 53-466; 14708, RPS6KB2, 74398, 176848, 64-525; 14708, RPS6KB2, 74399, 176849, 1-324; 14708, RPS6KB2, 74394, 176844, 46-1494; 14708, RPS6KB2, 74396, 176846, 43-507; 14709, RPS6KA1, 74400, 176850, 33-368; 14709, RPS6KA1, 74401, 176851, 60-674; 14709, RPS6KA1, 74402, 176852, 144-2318; 14709, RPS6KA1, 74404, 176854, 1-498; 14709, RPS6KA1, 74405, 176855, 1-348; 14709, RPS6KA1, 74408, 176858, 208-544; 14709, RPS6KA1, 74409, 176859, 161-331; 14709, RPS6KA1, 74411, 176861, 161-319; 14709, RPS6KA1, 74412, 176862, 161-331; 14709, RPS6KA1, 74413, 176863, 144-2318; 14709, RPS6KA1, 74414, 176864, 161-319; 14709, RPS6KA1, 74415, 176865, 1-498; 14709, RPS6KA1, 74416, 176866, 60-674; 14709, RPS6KA1, 74418, 176868, 33-368; 14709, RPS6KA1, 74420, 176870, 1-348; 14709, RPS6KA1, 74421, 176871, 208-544; 14709, RPS6KA1, 74403, 176853, 155-2362; 14709, RPS6KA1, 74406, 176856, 435-2366; 14709, RPS6KA1, 74407, 176857, 51-2210; 14709, RPS6KA1, 74410, 176860, 50-2284; 14709, RPS6KA1, 74417, 176867, 155-2362; 14709, RPS6KA1, 74419, 176869, 435-2366; 14709, RPS6KA1, 74422, 176872, 50-2284; 14709, RPS6KA1, 74423, 176873, 51-2210; 14710, RPS6KA2, 74425, 176875, 334-2268; 14710, RPS6KA2, 74426, 176876, 220-596; 14710, RPS6KA2, 74427, 176877, 342-2618; 14710, RPS6KA2, 74428, 176878, 260-2194; 14710, RPS6KA2, 74429, 176879, 335-759; 14710, RPS6KA2, 74430, 176880, 74-587; 14710, RPS6KA2, 74431, 176881, 506-614; 14710, RPS6KA2, 74433, 176883, 263-552; 14710, RPS6KA2, 74424, 176874, 225-2426; 14710, RPS6KA2, 74432, 176882, 382-2607; 14711, RPS6KA3, 74435, 176885, 132-530; 14711, RPS6KA3, 74436, 176886, 122-804; 14711, RPS6KA3, 74434, 176884, 209-2431; 14712, RPS6KA4, 74438, 176888, 1-2114; 14712, RPS6KA4, 74439, 176889, 55-201; 14712, RPS6KA4, 74440, 176890, 89-2386; 14712, RPS6KA4, 74437, 176887, 66-2384; 14713, RPS6KA5, 74441, 176891, 161-2584; 14713, RPS6KA5, 74444, 176894, 203-862; 14713, RPS6KA5, 74445, 176895, 1-239; 14713, RPS6KA5, 74446, 176896, 152-403; 14713, RPS6KA5, 74442, 176892, 167-1816; 14713, RPS6KA5, 74443, 176893, 252-2423; 14713, RPS6KA5, 74447, 176897, 175-2583; 14714, RPS6KA6, 74448, 176898, 9-2246; 14714, RPS6KA6, 74449, 176899, 1-2238; 14715, RPS6KL1, 74453, 176903, 1-474; 14715, RPS6KL1, 74454, 176904, 1-138; 14715, RPS6KL1, 74455, 176905, 1-313; 14715, RPS6KL1, 74456, 176906, 558-583; 14715, RPS6KL1, 74457, 176907, 1-224; 14715, RPS6KL1, 74458, 176908, 1-146; 14715, RPS6KL1, 74450, 176900, 486-2135; 14715, RPS6KL1, 74451, 176901, 746-2395; 14715, RPS6KL1, 74452, 176902, 218-1843; 14715, RPS6KL1, 74459, 176909, 289-1938; 14716, RPS7, 74463, 176913, 48-611; 14716, RPS7, 74460, 176910, 165-749; 14716, RPS7, 74461, 176911, 143-727; 14716, RPS7, 74462, 176912, 101-685; 14717, RPS8, 74464, 176914, 25-591; 14717, RPS8, 74465, 176915, 161-787; 14718, RPS9, 74467, 176917, 41-280; 14718, RPS9, 74470, 176920, 116-535; 14718, RPS9, 74471, 176921, 116-535; 14718, RPS9, 74472, 176922, 57-290; 14718, RPS9, 74473, 176923, 49-468; 14718, RPS9, 74474, 176924, 26-496; 14718, RPS9, 74475, 176925, 116-535; 14718, RPS9, 74478, 176928, 26-496; 14718, RPS9, 74479, 176929, 57-290; 14718, RPS9, 74484, 176934, 41-280; 14718, RPS9, 74487, 176937, 49-468; 14718, RPS9, 74489, 176939, 116-535; 14718, RPS9, 74490, 176940, 57-476; 14718, RPS9, 74491, 176941, 57-476; 14718, RPS9, 74492, 176942, 57-476; 14718, RPS9, 74493, 176943, 57-476; 14718, RPS9, 74466, 176916, 173-757; 14718, RPS9, 74468, 176918, 116-700; 14718, RPS9, 74469, 176919, 53-637; 14718, RPS9, 74476, 176926, 53-637; 14718, RPS9, 74477, 176927, 53-637; 14718, RPS9, 74480, 176930, 57-641; 14718, RPS9, 74481, 176931, 53-637; 14718, RPS9, 74482, 176932, 116-700; 14718, RPS9, 74483, 176933, 116-700; 14718, RPS9, 74485, 176935, 173-757; 14718, RPS9, 74486, 176936, 57-641; 14718, RPS9, 74488, 176938, 115-699; 14719, RPSA, 74495, 176945, 64-966; 14719, RPSA, 74496, 176946, 354-701; 14719, RPSA, 74497, 176947, 84-874; 14719, RPSA, 74494, 176944, 110-997; 14720, RPLP0, 74501, 176951, 326-649; 14720, RPLP0, 74502, 176952, 33-770; 14720, RPLP0, 74503, 176953, 262-1003; 14720, RPLP0, 74504, 176954, 38-402; 14720, RPLP0, 74505, 176955, 64-534; 14720, RPLP0, 74506, 176956, 77-250; 14720, RPLP0, 74507, 176957, 77-922; 14720, RPLP0, 74509, 176959, 228-561; 14720, RPLP0, 74510, 176960, 50-781; 14720, RPLP0, 74511, 176961, 43-543; 14720, RPLP0, 74512, 176962, 222-680; 14720, RPLP0, 74513, 176963, 42-470; 14720, RPLP0, 74498, 176948, 238-1191; 14720, RPLP0, 74499, 176949, 74-841; 14720, RPLP0, 74500, 176950, 178-1131; 14720, RPLP0, 74508, 176958, 317-1270; 14721, RPLP1, 74516, 176966, 66-230; 14721, RPLP1, 74514, 176964, 166-510; 14721, RPLP1, 74515, 176965, 136-405; 14722, RPLP2, 74519, 176969, 1-278; 14722, RPLP2, 74517, 176967, 395-742; 14722, RPLP2, 74518, 176968, 252-599; 14723, RRNAD1, 74522, 176972, 408-709; 14723, RRNAD1, 74523, 176973, 146-430; 14723, RRNAD1, 74524, 176974, 157-1191; 14723, RRNAD1, 74525, 176975, 1-416; 14723, RRNAD1, 74526, 176976, 327-791; 14723, RRNAD1, 74520, 176970, 631-2058; 14723, RRNAD1, 74521, 176971, 664-1497; 14724, RRP1, 74528, 176978, 72-209; 14724, RRP1, 74527, 176977, 118-1503; 14725, RRP12, 74531, 176981, 353-545; 14725, RRP12, 74534, 176984, 446-543; 14725, RRP12, 74535, 176985, 1-321; 14725, RRP12, 74536, 176986, 304-833; 14725, RRP12, 74529, 176979, 53-3646; 14725, RRP12, 74530, 176980, 140-4033; 14725, RRP12, 74532, 176982, 140-3850; 14725, RRP12, 74533, 176983, 190-4083; 14726, RRP15, 74537, 176987, 31-879; 14727, RRP1B, 74538, 176988, 118-2394; 14728, RRP36, 74540, 176990, 1-90; 14728, RRP36, 74539, 176989, 11-790; 14729, RRP7A, 74542, 176992, 9-170; 14729, RRP7A, 74541, 176991, 17-859; 14730, RRP8, 74544, 176994, 96-332; 14730, RRP8, 74545, 176995, 103-1023; 14730, RRP8, 74546, 176996, 78-500; 14730, RRP8, 74543, 176993, 119-1489; 14731, RRP9, 74547, 176997, 75-1502; 14732, RBFA, 74548, 176998, 31-759; 14732, RBFA, 74549, 176999, 139-1170; 14733, RRBP1, 74550, 177000, 1-4233; 14733, RRBP1, 74553, 177003, 305-4537; 14733, RRBP1, 74554, 177004, 290-1191; 14733, RRBP1, 74555, 177005, 176-2431; 14733, RRBP1, 74556, 177006, 1-690; 14733, RRBP1, 74557, 177007, 526-1566; 14733, RRBP1, 74558, 177008, 1-2805; 14733, RRBP1, 74551, 177001, 290-3223; 14733, RRBP1, 74552, 177002, 355-3288; 14734, RRS1, 74559, 177009, 105-1202; 14735, RPF1, 74561, 177011, 24-413; 14735, RPF1, 74560, 177010, 16-1065; 14736, RPF2, 74562, 177012, 93-323; 14736, RPF2, 74564, 177014, 265-906; 14736, RPF2, 74565, 177015, 58-237; 14736, RPF2, 74563, 177013, 93-1013; 14737, RPE, 74568, 177018, 261-737; 14737, RPE, 74570, 177020, 225-650; 14737, RPE, 74572, 177022, 228-668; 14737, RPE, 74573, 177023, 20-697; 14737, RPE, 74577, 177027, 144-617; 14737, RPE, 74578, 177028, 6-581; 14737, RPE, 74579, 177029, 13-195; 14737, RPE, 74580, 177030, 264-546; 14737, RPE, 74581, 177031, 175-496; 14737, RPE, 74566, 177016, 98-697; 14737, RPE, 74567, 177017, 98-784; 14737, RPE, 74569, 177019, 140-622; 14737, RPE, 74571, 177021, 159-695; 14737, RPE, 74574, 177024, 190-726; 14737, RPE, 74575, 177025, 144-626; 14737, RPE, 74576, 177026, 283-819; 14738, RPEL1, 74582, 177032, 111-797; 14739, RIC1, 74586, 177036, 1-444; 14739, RIC1, 74587, 177037, 1-3946; 14739, RIC1, 74588, 177038, 1-490; 14739, RIC1, 74583, 177033, 286-3783; 14739, RIC1, 74584, 177034, 192-4352; 14739, RIC1, 74585, 177035, 192-4463; 14740, RIC3, 74594, 177044, 33-1017; 14740, RIC3, 74595, 177045, 52-189; 14740, RIC3, 74596, 177046, 20-151; 14740, RIC3, 74589, 177039, 1-1110; 14740, RIC3, 74590, 177040, 55-618; 14740, RIC3, 74591, 177041, 67-1173; 14740, RIC3, 74592, 177042, 1-867; 14740, RIC3, 74593, 177043, 37-423; 14741, RIC8A, 74598, 177048, 1-440; 14741, RIC8A, 74600, 177050, 438-571; 14741, RIC8A, 74601, 177051, 15-563; 14741, RIC8A, 74603, 177053, 1-442; 14741, RIC8A, 74604, 177054, 56-214; 14741, RIC8A, 74605, 177055, 1-859; 14741, RIC8A, 74606, 177056, 56-500; 14741, RIC8A, 74607, 177057, 1-159; 14741, RIC8A, 74597, 177047, 326-1939; 14741, RIC8A, 74599, 177049, 1345-2940; 14741, RIC8A, 74602, 177052, 225-1802; 14742, RIC8B, 74609, 177059, 152-1834; 14742, RIC8B, 74613, 177063, 1-829; 14742, RIC8B, 74614, 177064, 126-251; 14742, RIC8B, 74615, 177065, 65-419; 14742, RIC8B, 74616, 177066, 313-405; 14742, RIC8B, 74617, 177067, 1-139; 14742, RIC8B, 74608, 177058, 289-1779; 14742, RIC8B, 74610, 177060, 107-1669; 14742, RIC8B, 74611, 177061, 33-1643; 14742, RIC8B, 74612, 177062, 1170-1946; 14743, RFESD, 74621, 177071, 261-615; 14743, RFESD, 74622, 177072, 2-184; 14743, RFESD, 74618, 177068, 1418-1891; 14743, RFESD, 74619, 177069, 182-814; 14743, RFESD, 74620, 177070, 1332-1964; 14744, RIMBP2, 74624, 177074, 524-994; 14744, RIMBP2, 74626, 177076, 1-187; 14744, RIMBP2, 74623, 177073, 165-3323; 14744, RIMBP2, 74625, 177075, 1328-3265; 14744, RIMBP2, 74627, 177077, 1133-3070; 14745, RIMBP3, 74628, 177078, 486-5405; 14746, RIMBP3B, 74629, 177079, 486-5405; 14747, RIMBP3C, 74630, 177080, 138-4775; 14747, RIMBP3C, 74631, 177081, 486-5405; 14748, RC3H1, 74632, 177082, 80-3481; 14748, RC3H1, 74633, 177083, 88-3465; 14748, RC3H1, 74634, 177084, 353-3754; 14749, RC3H2, 74635, 177085, 174-1694; 14749, RC3H2, 74638, 177088, 1-336; 14749, RC3H2, 74639, 177089, 1-566; 14749, RC3H2, 74636, 177086, 242-3817; 14749, RC3H2, 74637, 177087, 602-4177; 14749, RC3H2, 74640, 177090, 300-3494; 14749, RC3H2, 74641, 177091, 26-682; 14749, RC3H2, 74642, 177092, 181-1617; 14750, RCHY1, 74646, 177096, 118-441; 14750, RCHY1, 74650, 177100, 1-336; 14750, RCHY1, 74643, 177093, 400-1185; 14750, RCHY1, 74644, 177094, 1-666; 14750, RCHY1, 74645, 177095, 1-759; 14750, RCHY1, 74647, 177097, 167-886; 14750, RCHY1, 74648, 177098, 12-650; 14750, RCHY1, 74649, 177099, 27-593; 14751, RFFL, 74654, 177104, 104-559; 14751, RFFL, 74657, 177107, 16-398; 14751, RFFL, 74658, 177108, 1-424; 14751, RFFL, 74660, 177110, 99-281; 14751, RFFL, 74651, 177101, 224-1315; 14751, RFFL, 74652, 177102, 286-1377; 14751, RFFL, 74653, 177103, 585-1676; 14751, RFFL, 74655, 177105, 91-1158; 14751, RFFL, 74656, 177106, 326-1417; 14751, RFFL, 74659, 177109, 200-1183; 14752, RSPRY1, 74663, 177113, 63-579; 14752, RSPRY1, 74664, 177114, 413-548; 14752, RSPRY1, 74665, 177115, 292-654; 14752, RSPRY1, 74666, 177116, 305-743; 14752, RSPRY1, 74667, 177117, 255-692; 14752, RSPRY1, 74661, 177111, 317-2047; 14752, RSPRY1, 74662, 177112, 874-2604; 14753, RFWD2, 74669, 177119, 1-1701; 14753, RFWD2, 74670, 177120, 1-340; 14753, RFWD2, 74673, 177123, 50-617; 14753, RFWD2, 74674, 177124, 1-741; 14753, RFWD2, 74675, 177125, 109-315; 14753, RFWD2, 74668, 177118, 1-2124; 14753, RFWD2, 74671, 177121, 516-2711; 14753, RFWD2, 74672, 177122, 106-579; 14754, RFWD3, 74677, 177127, 513-586; 14754, RFWD3, 74678, 177128, 161-528; 14754, RFWD3, 74679, 177129, 148-599; 14754, RFWD3, 74681, 177131, 358-706; 14754, RFWD3, 74676, 177126, 99-2423; 14754, RFWD3, 74680, 177130, 210-2534; 14755, RNF6, 74682, 177132, 163-2220; 14755, RNF6, 74683, 177133, 292-2349; 14755, RNF6, 74684, 177134, 593-2650; 14756, RING1, 74685, 177135, 209-1429; 14756, RING1, 74686, 177136, 209-1429; 14756, RING1, 74687, 177137, 209-1429; 14756, RING1, 74688, 177138, 209-1429; 14756, RING1, 74689, 177139, 209-1429; 14756, RING1, 74690, 177140, 207-1427; 14757, RNF10, 74693, 177143, 1-412; 14757, RNF10, 74694, 177144, 297-321; 14757, RNF10, 74695, 177145, 478-776; 14757, RNF10, 74696, 177146, 1-548; 14757, RNF10, 74697, 177147, 1-635; 14757, RNF10, 74698, 177148, 1-441; 14757, RNF10, 74699, 177149, 225-479; 14757, RNF10, 74700, 177150, 212-583; 14757, RNF10, 74701, 177151, 1-315; 14757, RNF10, 74702, 177152, 207-562; 14757, RNF10, 74703, 177153, 1-786; 14757, RNF10, 74691, 177141, 462-2897; 14757, RNF10, 74692, 177142, 1-2451; 14758, RNF103, 74704, 177154, 970-3027; 14759, RNF11, 74705, 177155, 487-951; 14760, RNF111, 74708, 177158, 516-900; 14760, RNF111, 74709, 177159, 148-541; 14760, RNF111, 74711, 177161, 1-573; 14760, RNF111, 74706, 177156, 434-3394; 14760, RNF111, 74707, 177157, 288-3272; 14760, RNF111, 74710, 177160, 1-3012; 14760, RNF111, 74712, 177162, 137-3124; 14761, RNF112, 74714, 177164, 171-540; 14761, RNF112, 74713, 177163, 216-2111; 14762, RNF113A, 74715, 177165, 215-1246; 14763, RNF113B, 74716, 177166, 30-998; 14764, RNF114, 74718, 177168, 78-290; 14764, RNF114, 74719, 177169, 37-186; 14764, RNF114, 74720, 177170, 15-580; 14764, RNF114, 74721, 177171, 7-627; 14764, RNF114, 74722, 177172, 15-266; 14764, RNF114, 74717, 177167, 66-752; 14765, RNF115, 74723, 177173, 205-1119; 14766, RNF121, 74725, 177175, 36-377; 14766, RNF121, 74726, 177176, 87-704; 14766, RNF121, 74727, 177177, 39-926; 14766, RNF121, 74728, 177178, 45-290; 14766, RNF121, 74729, 177179, 94-252; 14766, RNF121, 74730, 177180, 89-592; 14766, RNF121, 74731, 177181, 70-219; 14766, RNF121, 74732, 177182, 1-439; 14766, RNF121, 74724, 177174, 362-1345; 14767, RNF122, 74733, 177183, 403-870; 14768, RNF123, 74735, 177185, 87-293; 14768, RNF123, 74736, 177186, 261-2549; 14768, RNF123, 74737, 177187, 100-2265; 14768, RNF123, 74738, 177188, 303-531; 14768, RNF123, 74739, 177189, 1-78; 14768, RNF123, 74740, 177190, 54-1334; 14768, RNF123, 74741, 177191, 1-207; 14768, RNF123, 74734, 177184, 145-4089; 14769, RNF125, 74743, 177193, 1-121; 14769, RNF125, 74742, 177192, 493-1191; 14770, RNF126, 74745, 177195, 113-963; 14770, RNF126, 74746, 177196, 74-298; 14770, RNF126, 74744, 177194, 157-1092; 14771, RNF128, 74749, 177199, 92-839; 14771, RNF128, 74747, 177197, 251-1537; 14771, RNF128, 74748, 177198, 166-1374; 14772, RNF13, 74753, 177203, 8-583; 14772, RNF13, 74754, 177204, 97-586; 14772, RNF13, 74755, 177205, 312-761; 14772, RNF13, 74756, 177206, 82-777; 14772, RNF13, 74757, 177207, 512-1008; 14772, RNF13, 74758, 177208, 378-593; 14772, RNF13, 74759, 177209, 343-396; 14772, RNF13, 74760, 177210, 461-701; 14772, RNF13, 74761, 177211, 224-570; 14772, RNF13, 74762, 177212, 143-565; 14772, RNF13, 74763, 177213, 1-550; 14772, RNF13, 74764, 177214, 404-1104; 14772, RNF13, 74750, 177200, 703-1848; 14772, RNF13, 74751, 177201, 129-917; 14772, RNF13, 74752, 177202, 663-1808; 14773, RNF130, 74766, 177216, 20-1279; 14773, RNF130, 74768, 177218, 412-837; 14773, RNF130, 74765, 177215, 400-1554; 14773, RNF130, 74767, 177217, 417-1676; 14774, RNF133, 74769, 177219, 239-1369; 14775, RNF135, 74772, 177222, 91-579; 14775, RNF135, 74774, 177224, 1-475; 14775, RNF135, 74775, 177225, 1-257; 14775, RNF135, 74770, 177220, 52-684; 14775, RNF135, 74771, 177221, 874-2172; 14775, RNF135, 74773, 177223, 15-875; 14776, RNF138, 74778, 177228, 374-613; 14776, RNF138, 74779, 177229, 168-493; 14776, RNF138, 74780, 177230, 76-503; 14776, RNF138, 74781, 177231, 1-201; 14776, RNF138, 74776, 177226, 88-543; 14776, RNF138, 74777, 177227, 459-1196; 14777, RNF139, 74783, 177233, 264-467; 14777, RNF139, 74782, 177232, 373-2367; 14778, RNF14, 74789, 177239, 70-582; 14778, RNF14, 74790, 177240, 266-563; 14778, RNF14, 74791, 177241, 259-815; 14778, RNF14, 74792, 177242, 198-392; 14778, RNF14, 74793, 177243, 270-667; 14778, RNF14, 74794, 177244, 290-473; 14778, RNF14, 74795, 177245, 105-938; 14778, RNF14, 74796, 177246, 530-575; 14778, RNF14, 74797, 177247, 213-670; 14778, RNF14, 74784, 177234, 289-1713; 14778, RNF14, 74785, 177235, 75-1499; 14778, RNF14, 74786, 177236, 464-1510; 14778, RNF14, 74787, 177237, 249-1673; 14778, RNF14, 74788, 177238, 310-1734; 14779, RNF141, 74799, 177249, 117-662; 14779, RNF141, 74800, 177250, 202-743; 14779, RNF141, 74801, 177251, 157-315; 14779, RNF141, 74798, 177248, 144-836; 14780, RNF144A, 74803, 177253, 228-392; 14780, RNF144A, 74804, 177254, 1-794; 14780, RNF144A, 74805, 177255, 400-564; 14780, RNF144A, 74802, 177252, 443-1321; 14781, RNF144B, 74806, 177256, 318-1229; 14782, RNF145, 74807, 177257, 28-2103; 14782, RNF145, 74808, 177258, 361-2352; 14782, RNF145, 74809, 177259, 158-2191; 14782, RNF145, 74810, 177260, 226-2217; 14782, RNF145, 74811, 177261, 237-2279; 14782, RNF145, 74812, 177262, 151-2232; 14782, RNF145, 74813, 177263, 376-2367; 14783, RNF146, 74815, 177265, 186-308; 14783, RNF146, 74817, 177267, 420-548; 14783, RNF146, 74819, 177269, 393-521; 14783, RNF146, 74820, 177270, 542-568; 14783, RNF146, 74821, 177271, 298-426; 14783, RNF146, 74823, 177273, 479-601; 14783, RNF146, 74824, 177274, 474-516; 14783, RNF146, 74814, 177264, 687-1763; 14783, RNF146, 74816, 177266, 425-1504; 14783, RNF146, 74818, 177268, 322-1401; 14783, RNF146, 74822, 177272, 424-1500; 14783, RNF146, 74825, 177275, 137-1216; 14784, RNF148, 74827, 177277, 163-468; 14784, RNF148, 74826, 177276, 218-1135; 14785, RNF149, 74829, 177279, 114-1310; 14785, RNF149, 74828, 177278, 109-1311; 14786, RNF150, 74834, 177284, 103-793; 14786, RNF150, 74830, 177280, 655-1845; 14786, RNF150, 74831, 177281, 90-983; 14786, RNF150, 74832, 177282, 242-1459; 14786, RNF150, 74833, 177283, 35-1351; 14787, RNF151, 74835, 177285, 2-736; 14787, RNF151, 74836, 177286, 60-332; 14787, RNF151, 74837, 177287, 9-746; 14788, RNF152, 74839, 177289, 341-682; 14788, RNF152, 74838, 177288, 1101-1712; 14789, RNF157, 74842, 177292, 62-280; 14789, RNF157, 74843, 177293, 1-245; 14789, RNF157, 74844, 177294, 1-484; 14789, RNF157, 74840, 177290, 134-2173; 14789, RNF157, 74841, 177291, 69-2042; 14790, RNF165, 74847, 177297, 191-259; 14790, RNF165, 74848, 177298, 248-316; 14790, RNF165, 74849, 177299, 52-258; 14790, RNF165, 74850, 177300, 280-747; 14790, RNF165, 74851, 177301, 52-138; 14790, RNF165, 74845, 177295, 52-1092; 14790, RNF165, 74846, 177296, 204-668; 14791, RNF166, 74855, 177305, 1-447; 14791, RNF166, 74856, 177306, 1-139; 14791, RNF166, 74858, 177308, 340-837; 14791, RNF166, 74852, 177302, 97-810; 14791, RNF166, 74853, 177303, 1001-1387; 14791, RNF166, 74854, 177304, 73-459; 14791, RNF166, 74857, 177307, 74-544; 14792, RNF167, 74860, 177310, 333-1280; 14792, RNF167, 74861, 177311, 299-589; 14792, RNF167, 74863, 177313, 84-298; 14792, RNF167, 74865, 177315, 186-552; 14792, RNF167, 74866, 177316, 1-627; 14792, RNF167, 74868, 177318, 252-653; 14792, RNF167, 74869, 177319, 1-224; 14792, RNF167, 74859, 177309, 657-1709; 14792, RNF167, 74862, 177312, 305-1357; 14792, RNF167, 74864, 177314, 501-1553; 14792, RNF167, 74867, 177317, 530-1582; 14793, RNF168, 74871, 177321, 505-855; 14793, RNF168, 74870, 177320, 596-2311; 14794, RNF169, 74873, 177323, 1-239; 14794, RNF169, 74872, 177322, 14-2140; 14795, RNF17, 74876, 177326, 107-2008; 14795, RNF17, 74877, 177327, 260-2826; 14795, RNF17, 74874, 177324, 53-4924; 14795, RNF17, 74875, 177325, 4-1965; 14796, RNF170, 74883, 177333, 235-580; 14796, RNF170, 74884, 177334, 59-195; 14796, RNF170, 74878, 177328, 410-760; 14796, RNF170, 74879, 177329, 113-463; 14796, RNF170, 74880, 177330, 110-712; 14796, RNF170, 74881, 177331, 246-1022; 14796, RNF170, 74882, 177332, 362-886; 14796, RNF170, 74885, 177335, 478-1254; 14797, RNF175, 74887, 177337, 109-219; 14797, RNF175, 74888, 177338, 149-514; 14797, RNF175, 74889, 177339, 12-218; 14797, RNF175, 74890, 177340, 136-585; 14797, RNF175, 74886, 177336, 374-1360; 14798, RNF180, 74893, 177343, 101-421; 14798, RNF180, 74891, 177341, 111-1361; 14798, RNF180, 74892, 177342, 73-1851; 14799, RNF181, 74895, 177345, 9-245; 14799, RNF181, 74896, 177346, 17-327; 14799, RNF181, 74897, 177347, 40-459; 14799, RNF181, 74898, 177348, 1-511; 14799, RNF181, 74894, 177344, 31-492; 14800, RNF182, 74899, 177349, 494-646; 14800, RNF182, 74900, 177350, 519-557; 14800, RNF182, 74901, 177351, 386-633; 14800, RNF182, 74902, 177352, 340-826; 14800, RNF182, 74903, 177353, 524-1267; 14800, RNF182, 74904, 177354, 386-1129; 14800, RNF182, 74905, 177355, 607-1350; 14800,

RNF182, 74906, 177356, 494-1237; 14801, RNF183, 74907, 177357, 275-853; 14801, RNF183, 74908, 177358, 1100-1678; 14801, RNF183, 74909, 177359, 1582-2160; 14801, RNF183, 74910, 177360, 108-686; 14802, RNF185, 74913, 177363, 142-615; 14802, RNF185, 74911, 177361, 110-520; 14802, RNF185, 74912, 177362, 160-738; 14802, RNF185, 74914, 177364, 142-720; 14803, RNF186, 74915, 177365, 178-861; 14804, RNF187, 74916, 177366, 429-1136; 14805, RNF19A, 74918, 177368, 165-432; 14805, RNF19A, 74920, 177370, 143-317; 14805, RNF19A, 74921, 177371, 323-792; 14805, RNF19A, 74922, 177372, 273-612; 14805, RNF19A, 74923, 177373, 504-547; 14805, RNF19A, 74924, 177374, 321-817; 14805, RNF19A, 74917, 177367, 555-3071; 14805, RNF19A, 74919, 177369, 318-2834; 14805, RNF19A, 74925, 177375, 111-2627; 14806, RNF19B, 74926, 177376, 1-2196; 14806, RNF19B, 74927, 177377, 1-1764; 14806, RNF19B, 74928, 177378, 1-2199; 14807, RNF2, 74931, 177381, 203-939; 14807, RNF2, 74929, 177379, 127-921; 14807, RNF2, 74930, 177380, 289-1299; 14808, RNF20, 74932, 177382, 54-596; 14808, RNF20, 74934, 177384, 349-784; 14808, RNF20, 74935, 177385, 91-387; 14808, RNF20, 74933, 177383, 91-3018; 14809, RNF207, 74936, 177386, 128-2032; 14810, RNF208, 74937, 177387, 112-897; 14810, RNF208, 74938, 177388, 170-955; 14811, RNF212, 74942, 177392, 52-210; 14811, RNF212, 74943, 177393, 78-425; 14811, RNF212, 74944, 177394, 77-235; 14811, RNF212, 74939, 177389, 67-888; 14811, RNF212, 74940, 177390, 99-797; 14811, RNF212, 74941, 177391, 63-956; 14811, RNF212, 74945, 177395, 63-434; 14812, RNF212B, 74946, 177396, 143-394; 14812, RNF212B, 74949, 177399, 234-484; 14812, RNF212B, 74950, 177400, 1-226; 14812, RNF212B, 74947, 177397, 254-1156; 14812, RNF212B, 74948, 177398, 1-903; 14813, RNF213, 74952, 177402, 146-15916; 14813, RNF213, 74953, 177403, 1-319; 14813, RNF213, 74954, 177404, 144-15767; 14813, RNF213, 74951, 177401, 142-3333; 14814, RNF214, 74957, 177407, 11-1552; 14814, RNF214, 74958, 177408, 109-548; 14814, RNF214, 74955, 177405, 109-2220; 14814, RNF214, 74956, 177406, 47-2158; 14814, RNF214, 74959, 177409, 47-1693; 14815, RNF215, 74960, 177410, 1-1030; 14815, RNF215, 74962, 177412, 1-105; 14815, RNF215, 74963, 177413, 237-535; 14815, RNF215, 74964, 177414, 1-93; 14815, RNF215, 74965, 177415, 85-492; 14815, RNF215, 74966, 177416, 1-93; 14815, RNF215, 74967, 177417, 1-177; 14815, RNF215, 74961, 177411, 76-1209; 14816, RNF216, 74968, 177418, 70-1050; 14816, RNF216, 74970, 177420, 512-570; 14816, RNF216, 74972, 177422, 176-325; 14816, RNF216, 74969, 177419, 269-3040; 14816, RNF216, 74971, 177421, 226-2826; 14817, RNF217, 74974, 177424, 672-986; 14817, RNF217, 74975, 177425, 1-196; 14817, RNF217, 74976, 177426, 322-327; 14817, RNF217, 74978, 177428, 1-236; 14817, RNF217, 74979, 177429, 784-1704; 14817, RNF217, 74973, 177423, 339-1166; 14817, RNF217, 74977, 177427, 1-1629; 14818, RNF219, 74980, 177430, 60-2240; 14819, RNF220, 74981, 177431, 424-1203; 14819, RNF220, 74985, 177435, 424-1200; 14819, RNF220, 74986, 177436, 1-361; 14819, RNF220, 74987, 177437, 172-309; 14819, RNF220, 74982, 177432, 451-2151; 14819, RNF220, 74983, 177433, 361-2061; 14819, RNF220, 74984, 177434, 361-2061; 14820, RNF222, 74988, 177438, 29-691; 14820, RNF222, 74989, 177439, 310-972; 14821, RNF223, 74990, 177440, 302-1051; 14822, RNF224, 74991, 177441, 776-1246; 14823, RNF225, 74992, 177442, 1-990; 14824, RNF24, 74993, 177443, 253-699; 14824, RNF24, 74994, 177444, 154-600; 14824, RNF24, 74995, 177445, 1-510; 14824, RNF24, 74996, 177446, 123-632; 14825, RNF25, 74998, 177448, 1-477; 14825, RNF25, 74997, 177447, 442-1821; 14826, RNF26, 74999, 177449, 597-1898; 14827, RNF31, 75001, 177451, 1-497; 14827, RNF31, 75002, 177452, 1-2753; 14827, RNF31, 75003, 177453, 69-578; 14827, RNF31, 75004, 177454, 402-559; 14827, RNF31, 75005, 177455, 198-606; 14827, RNF31, 75007, 177457, 200-562; 14827, RNF31, 75008, 177458, 1-459; 14827, RNF31, 75009, 177459, 456-551; 14827, RNF31, 75010, 177460, 1-431; 14827, RNF31, 75011, 177461, 395-576; 14827, RNF31, 75012, 177462, 382-550; 14827, RNF31, 75013, 177463, 442-889; 14827, RNF31, 75014, 177464, 1-422; 14827, RNF31, 75000, 177450, 321-3539; 14827, RNF31, 75006, 177456, 347-3112; 14828, RNF32, 75015, 177465, 155-1087; 14828, RNF32, 75021, 177471, 131-793; 14828, RNF32, 75022, 177472, 253-308; 14828, RNF32, 75016, 177466, 119-1207; 14828, RNF32, 75017, 177467, 89-796; 14828, RNF32, 75018, 177468, 189-1277; 14828, RNF32, 75019, 177469, 78-365; 14828, RNF32, 75020, 177470, 410-1498; 14828, RNF32, 75023, 177473, 336-1424; 14829, RNF34, 75025, 177475, 70-1593; 14829, RNF34, 75027, 177477, 319-431; 14829, RNF34, 75028, 177478, 424-913; 14829, RNF34, 75029, 177479, 67-204; 14829, RNF34, 75030, 177480, 238-459; 14829, RNF34, 75031, 177481, 131-673; 14829, RNF34, 75024, 177474, 173-1291; 14829, RNF34, 75026, 177476, 158-1279; 14830, RNF38, 75032, 177482, 109-1656; 14830, RNF38, 75033, 177483, 192-1589; 14830, RNF38, 75034, 177484, 458-1756; 14830, RNF38, 75035, 177485, 608-1906; 14830, RNF38, 75036, 177486, 484-1803; 14830, RNF38, 75037, 177487, 339-1637; 14830, RNF38, 75038, 177488, 518-1837; 14831, RNF39, 75042, 177492, 63-1325; 14831, RNF39, 75043, 177493, 99-1361; 14831, RNF39, 75039, 177489, 99-1361; 14831, RNF39, 75040, 177490, 61-1125; 14831, RNF39, 75041, 177491, 61-1125; 14831, RNF39, 75044, 177494, 61-1125; 14831, RNF39, 75045, 177495, 61-1125; 14831, RNF39, 75046, 177496, 99-1361; 14831, RNF39, 75047, 177497, 99-1361; 14831, RNF39, 75048, 177498, 99-1361; 14831, RNF39, 75049, 177499, 61-1125; 14831, RNF39, 75050, 177500, 61-1125; 14831, RNF39, 75051, 177501, 61-1125; 14831, RNF39, 75052, 177502, 99-1361; 14831, RNF39, 75053, 177503, 99-1361; 14831, RNF39, 75054, 177504, 61-1125; 14832, RNF4, 75056, 177506, 311-580; 14832, RNF4, 75057, 177507, 253-416; 14832, RNF4, 75058, 177508, 312-616; 14832, RNF4, 75059, 177509, 249-392; 14832, RNF4, 75060, 177510, 291-855; 14832, RNF4, 75061, 177511, 544-558; 14832, RNF4, 75063, 177513, 357-560; 14832, RNF4, 75064, 177514, 310-441; 14832, RNF4, 75067, 177517, 1-320; 14832, RNF4, 75055, 177505, 480-1052; 14832, RNF4, 75062, 177512, 871-1443; 14832, RNF4, 75065, 177515, 1516-2088; 14832, RNF4, 75066, 177516, 277-618; 14832, RNF4, 75068, 177518, 349-690; 14833, RNF40, 75071, 177521, 111-2996; 14833, RNF40, 75072, 177522, 379-711; 14833, RNF40, 75073, 177523, 64-586; 14833, RNF40, 75074, 177524, 182-569; 14833, RNF40, 75075, 177525, 50-481; 14833, RNF40, 75076, 177526, 1-45; 14833, RNF40, 75077, 177527, 1-534; 14833, RNF40, 75069, 177519, 436-3441; 14833, RNF40, 75070, 177520, 111-2816; 14834, RNF41, 75080, 177530, 320-890; 14834, RNF41, 75082, 177532, 108-713; 14834, RNF41, 75083, 177533, 202-387; 14834, RNF41, 75084, 177534, 672-1064; 14834, RNF41, 75085, 177535, 144-582; 14834, RNF41, 75078, 177528, 371-1324; 14834, RNF41, 75079, 177529, 715-1455; 14834, RNF41, 75081, 177531, 240-1193; 14834, RNF41, 75086, 177536, 320-1273; 14835, RNF43, 75088, 177538, 199-2427; 14835, RNF43, 75087

177537, 722-3073; 14835, RNF43, 75089, 177539, 65-2293; 14835, RNF43, 75090, 177540, 749-3100; 14835, RNF43, 75091, 177541, 1957-4308; 14835, RNF43, 75092, 177542, 212-2182; 14836, RNF44, 75094, 177544, 402-539; 14836, RNF44, 75095, 177545, 1-679; 14836, RNF44, 75096, 177546, 340-480; 14836, RNF44, 75093, 177543, 526-1824; 14837, RNF5, 75104, 177554, 76-351; 14837, RNF5, 75097, 177547, 159-701; 14837, RNF5, 75098, 177548, 159-701; 14837, RNF5, 75099, 177549, 153-695; 14837, RNF5, 75100, 177550, 159-701; 14837, RNF5, 75101, 177551, 159-701; 14837, RNF5, 75102, 177552, 159-701; 14837, RNF5, 75103, 177553, 159-701; 14838, RNF7, 75109, 177559, 24-230; 14838, RNF7, 75105, 177555, 139-480; 14838, RNF7, 75106, 177556, 46-318; 14838, RNF7, 75107, 177557, 66-359; 14838, RNF7, 75108, 177558, 39-365; 14839, RNF8, 75112, 177562, 1-625; 14839, RNF8, 75113, 177563, 116-731; 14839, RNF8, 75115, 177565, 93-362; 14839, RNF8, 75116, 177566, 187-336; 14839, RNF8, 75110, 177560, 151-447; 14839, RNF8, 75111, 177561, 194-1651; 14839, RNF8, 75114, 177564, 75-1421; 14840, RLIM, 75117, 177567, 282-2156; 14840, RLIM, 75118, 177568, 220-2094; 14841, RNFT1, 75120, 177570, 75-671; 14841, RNFT1, 75122, 177572, 99-617; 14841, RNFT1, 75123, 177573, 1-215; 14841, RNFT1, 75124, 177574, 72-740; 14841, RNFT1, 75119, 177569, 57-1364; 14841, RNFT1, 75121, 177571, 72-809; 14842, RNFT2, 75126, 177576, 214-1179; 14842, RNFT2, 75129, 177579, 187-312; 14842, RNFT2, 75130, 177580, 484-1179; 14842, RNFT2, 75125, 177575, 234-1568; 14842, RNFT2, 75127, 177577, 234-1568; 14842, RNFT2, 75128, 177578, 234-1496; 14843, RYBP, 75132, 177582, 199-879; 14843, RYBP, 75131, 177581, 1-952; 14844, RBX1, 75133, 177583, 41-367; 14845, RIOK1, 75135, 177585, 211-498; 14845, RIOK1, 75134, 177584, 508-2214; 14846, RIOK2, 75138, 177588, 1-478; 14846, RIOK2, 75139, 177589, 1-422; 14846, RIOK2, 75140, 177590, 52-165; 14846, RIOK2, 75136, 177586, 70-1728; 14846, RIOK2, 75137, 177587, 32-1456; 14847, RIOK3, 75143, 177593, 1-270; 14847, RIOK3, 75144, 177594, 154-1665; 14847, RIOK3, 75145, 177595, 1-406; 14847, RIOK3, 75141, 177591, 618-2177; 14847, RIOK3, 75142, 177592, 133-1683; 14848, RIPPLY1, 75146, 177596, 31-486; 14848, RIPPLY1, 75147, 177597, 49-363; 14849, RIPPLY2, 75148, 177598, 183-395; 14849, RIPPLY2, 75149, 177599, 152-538; 14850, RIPPLY3, 75150, 177600, 211-783; 14851, RNMT, 75156, 177606, 181-1077; 14851, RNMT, 75157, 177607, 269-572; 14851, RNMT, 75158, 177608, 1-344; 14851, RNMT, 75151, 177601, 45-1475; 14851, RNMT, 75152, 177602, 241-1671; 14851, RNMT, 75153, 177603, 113-1543; 14851, RNMT, 75154, 177604, 198-1712; 14851, RNMT, 75155, 177605, 361-1791; 14852, RTCB, 75159, 177609, 100-1617; 14853, RTCA, 75161, 177611, 88-237; 14853, RTCA, 75160, 177610, 128-1267; 14853, RTCA, 75162, 177612, 170-1270; 14854, RBM3, 75163, 177613, 288-755; 14854, RBM3, 75164, 177614, 230-703; 14854, RBM3, 75165, 177615, 64-537; 14855, RBM10, 75166, 177616, 1-2988; 14855, RBM10, 75167, 177617, 333-2894; 14855, RBM10, 75168, 177618, 743-3535; 14855, RBM10, 75169, 177619, 333-2891; 14856, RBM11, 75170, 177620, 10-855; 14857, RBM12, 75174, 177624, 154-583; 14857, RBM12, 75175, 177625, 196-1068; 14857, RBM12, 75176, 177626, 164-565; 14857, RBM12, 75171, 177621, 152-2950; 14857, RBM12, 75172, 177622, 217-3015; 14857, RBM12, 75173, 177623, 265-3063; 14858, RBM12B, 75178, 177628, 215-2860; 14858, RBM12B, 75179, 177629, 150-579; 14858, RBM12B, 75180, 177630, 222-588; 14858, RBM12B, 75181, 177631, 205-452; 14858, RBM12B, 75182, 177632, 168-615; 14858, RBM12B, 75183, 177633, 1-2646; 14858, RBM12B, 75177, 177627, 215-3220; 14859, RBM14, 75186, 177636, 92-571; 14859, RBM14, 75188, 177638, 76-465; 14859, RBM14, 75184, 177634, 140-2149; 14859, RBM14, 75185, 177635, 96-566; 14859, RBM14, 75187, 177637, 7-366; 14860, RBM15, 75192, 177642, 73-2874; 14860, RBM15, 75189, 177639, 901-3834; 14860, RBM15, 75190, 177640, 84-2993; 14860, RBM15, 75191, 177641, 84-2957; 14860, RBM15, 75193, 177643, 84-3017; 14861, RBM15B, 75194, 177644, 133-2805; 14862, RBM17, 75197, 177647, 114-833; 14862, RBM17, 75198, 177648, 157-792; 14862, RBM17, 75199, 177649, 1-676; 14862, RBM17, 75200, 177650, 142-805; 14862, RBM17, 75195, 177645, 226-1431; 14862, RBM17, 75196, 177646, 645-1850; 14863, RBM18, 75201, 177651, 142-714; 14864, RBM19, 75205, 177655, 1-333; 14864, RBM19, 75202, 177652, 145-3027; 14864, RBM19, 75203, 177653, 84-2966; 14864, RBM19, 75204, 177654, 80-2962; 14865, RBM20, 75206, 177656, 59-3742; 14866, RBM22, 75209, 177659, 30-566; 14866, RBM22, 75210, 177660, 3-731; 14866, RBM22, 75207, 177657, 123-1385; 14866, RBM22, 75208, 177658, 39-1154; 14867, RBM23, 75214, 177664, 540-1349; 14867, RBM23, 75215, 177665, 490-552; 14867, RBM23, 75216, 177666, 451-602; 14867, RBM23, 75217, 177667, 280-582; 14867, RBM23, 75218, 177668, 89-267; 14867, RBM23, 75219, 177669, 284-583; 14867, RBM23, 75220, 177670, 260-457; 14867, RBM23, 75221, 177671, 362-588; 14867, RBM23, 75222, 177672, 1-643; 14867, RBM23, 75223, 177673, 1-249; 14867, RBM23, 75224, 177674, 483-826; 14867, RBM23, 75225, 177675, 301-573; 14867, RBM23, 75226, 177676, 400-571; 14867, RBM23, 75227, 177677, 292-569; 14867, RBM23, 75228, 177678, 150-581; 14867, RBM23, 75229, 177679, 624-1193; 14867, RBM23, 75211, 177661, 191-1408; 14867, RBM23, 75212, 177662, 197-1516; 14867, RBM23, 75213, 177663, 195-1466; 14868, RBM24, 75233, 177683, 1-605; 14868, RBM24, 75234, 177684, 1-243; 14868, RBM24, 75230, 177680, 72-647; 14868, RBM24, 75231, 177681, 237-947; 14868, RBM24, 75232, 177682, 163-699; 14869, RBM25, 75237, 177687, 160-541; 14869, RBM25, 75238, 177688, 311-1039; 14869, RBM25, 75240, 177690, 1-221; 14869, RBM25, 75235, 177685, 286-2817; 14869, RBM25, 75236, 177686, 258-2789; 14869, RBM25, 75239, 177689, 6-500; 14869, RBM25, 75241, 177691, 173-1057; 14869, RBM25, 75242, 177692, 175-1077; 14870, RBM26, 75246, 177696, 1-516; 14870, RBM26, 75247, 177697, 448-3477; 14870, RBM26, 75243, 177693, 15-2957; 14870, RBM26, 75244, 177694, 442-3465; 14870, RBM26, 75245, 177695, 448-3399; 14871, RBM27, 75248, 177698, 167-3349; 14872, RBM28, 75251, 177701, 82-932; 14872, RBM28, 75252, 177702, 1-560; 14872, RBM28, 75253, 177703, 116-728; 14872, RBM28, 75249, 177699, 116-2395; 14872, RBM28, 75250, 177700, 78-1934; 14873, RBM33, 75255, 177705, 1-855; 14873, RBM33, 75256, 177706, 294-614; 14873, RBM33, 75257, 177707, 1-253; 14873, RBM33, 75258, 177708, 176-1102; 14873, RBM33, 75259, 177709, 1-2729; 14873, RBM33, 75261, 177711, 1-1027; 14873, RBM33, 75262, 177712, 464-547; 14873, RBM33, 75254, 177704, 427-1233; 14873, RBM33, 75260, 177710, 199-3711; 14874, RBM34, 75264, 177714, 1-1227; 14874, RBM34, 75265, 177715, 33-667; 14874, RBM34, 75266, 177716, 1-260; 14874, RBM34, 75263, 177713, 232-1524; 14875, RBM38, 75267, 177717, 130-363; 14875, RBM38, 75268, 177718, 15-386; 14875, RBM38, 75270, 177720, 270-746; 14875, RBM38, 75269, 177719, 176-895; 14875, RBM38, 75271, 177721, 155-520; 14876, RBM39, 75273, 177723, 295-1566; 14876, RBM39, 75275, 177725, 332-1026; 14876, RBM39, 75276, 177726, 306-593; 14876, RBM39, 75277, 177727, 348-470; 14876, RBM39, 75278, 177728, 1-72; 14876, RBM39, 75279, 177729, 14-136; 14876, RBM39, 75280, 177730, 136-716; 14876, RBM39, 75281, 177731, 322-444; 14876, RBM39, 75282, 177732, 1-1008; 14876, RBM39, 75283, 177733, 330-473; 14876, RBM39, 75284, 177734, 32-154; 14876, RBM39, 75285, 177735, 332-454; 14876, RBM39, 75286, 177736, 187-309; 14876, RBM39, 75287, 177737, 1-260; 14876, RBM39, 75288, 177738, 153-275; 14876, RBM39, 75289, 177739, 53-241; 14876, RBM39, 75290, 177740, 293-412; 14876, RBM39, 75292, 177742, 1-180; 14876, RBM39, 75293, 177743, 1-738; 14876, RBM39, 75294, 177744, 1-490; 14876, RBM39, 75272, 177722, 25-1617; 14876, RBM39, 75274, 177724, 386-1960; 14876, RBM39, 75291, 177741, 312-1838; 14877, RBM4, 75300, 177750, 61-782; 14877, RBM4, 75301, 177751, 48-500; 14877, RBM4, 75305, 177755, 75-542; 14877, RBM4, 75295, 177745, 149-1243; 14877, RBM4, 75296, 177746, 68-499; 14877, RBM4, 75297, 177747, 235-1329; 14877, RBM4, 75298, 177748, 778-1872; 14877, RBM4, 75299, 177749, 99-620; 14877, RBM4, 75302, 177752, 180-713; 14877, RBM4, 75303, 177753, 187-618; 14877, RBM4, 75304, 177754, 68-601; 14878, RBM41, 75308, 177758, 1-610; 14878, RBM41, 75306, 177756, 32-1273; 14878, RBM41, 75307, 177757, 28-1245; 14878, RBM41, 75309, 177759, 51-986; 14879, RBM42, 75312, 177762, 87-641; 14879, RBM42, 75313, 177763, 24-1400; 14879, RBM42, 75314, 177764, 88-1368; 14879, RBM42, 75315, 177765, 78-1238; 14879, RBM42, 75310, 177760, 106-1548; 14879, RBM42, 75311, 177761, 125-1477; 14880, RBM43, 75317, 177767, 52-258; 14880, RBM43, 75316, 177766, 153-1226; 14881, RBM44, 75318, 177768, 133-3291; 14881, RBM44, 75319, 177769, 255-3413; 14881, RBM44, 75320, 177770, 118-1374; 14882, RBM45, 75322, 177772, 1-220; 14882, RBM45, 75323, 177773, 1-407; 14882, RBM45, 75321, 177771, 93-1517; 14882, RBM45, 75324, 177774, 93-1523; 14883, RBM46, 75328, 177778, 128-526; 14883, RBM46, 75325, 177775, 236-1837; 14883, RBM46, 75326, 177776, 180-1592; 14883, RBM46, 75327, 177777, 236-1693; 14884, RBM47, 75332, 177782, 304-882; 14884, RBM47, 75333, 177783, 449-1100; 14884, RBM47, 75334, 177784, 709-1890; 14884, RBM47, 75335, 177785, 260-1927; 14884, RBM47, 75336, 177786, 212-582; 14884, RBM47, 75337, 177787, 381-856; 14884, RBM47, 75338, 177788, 496-836; 14884, RBM47, 75339, 177789, 479-656; 14884, RBM47, 75340, 177790, 564-741; 14884, RBM47, 75341, 177791, 386-797; 14884, RBM47, 75329, 177779, 709-2490; 14884, RBM47, 75330, 177780, 398-2179; 14884, RBM47, 75331, 177781, 262-1836; 14885, RBM48, 75343, 177793, 441-715; 14885, RBM48, 75345, 177795, 1-1083; 14885, RBM48, 75342, 177792, 42-1145; 14885, RBM48, 75344, 177794, 42-1172; 14886, RBM4B, 75348, 177798, 87-530; 14886, RBM4B, 75349, 177799, 1-62; 14886, RBM4B, 75350, 177800, 74-505; 14886, RBM4B, 75351, 177801, 127-582; 14886, RBM4B, 75346, 177796, 171-1250; 14886, RBM4B, 75347, 177797, 670-1749; 14887, RBM5, 75353, 177803, 1-171; 14887, RBM5, 75354, 177804, 165-580; 14887, RBM5, 75355, 177805, 158-569; 14887, RBM5, 75356, 177806, 268-582; 14887, RBM5, 75357, 177807, 66-427; 14887, RBM5, 75358, 177808, 129-374; 14887, RBM5, 75352, 177802, 176-2623; 14887, RBM5, 75359, 177809, 165-596; 14888, RBM6, 75361, 177811, 354-582; 14888, RBM6, 75362, 177812, 209-568; 14888, RBM6, 75365, 177815, 228-695; 14888, RBM6, 75366, 177816, 230-337; 14888, RBM6, 75367, 177817, 920-3895; 14888, RBM6, 75368, 177818, 320-919; 14888, RBM6, 75369, 177819, 113-473; 14888, RBM6, 75370, 177820, 821-2914; 14888, RBM6, 75360, 177810, 260-3631; 14888, RBM6, 75363, 177813, 404-2209; 14888, RBM6, 75364, 177814, 339-2144; 14888, RBM6, 75371, 177821, 142-1704; 14889, RBM7, 75372, 177822, 144-947; 14889, RBM7, 75373, 177823, 60-272; 14889, RBM7, 75374, 177824, 7-378; 14889, RBM7, 75376, 177826, 7-669; 14889, RBM7, 75377, 177827, 66-515; 14889, RBM7, 75378, 177828, 111-551; 14889, RBM7, 75379, 177829, 344-784; 14889, RBM7, 75375, 177825, 643-1443; 14890, RBM8A, 75382, 177832, 1-320; 14890, RBM8A, 75384, 177834, 1-320; 14890, RBM8A, 75380, 177830, 35-556; 14890, RBM8A, 75381, 177831, 111-635; 14890, RBM8A, 75383, 177833, 22-546; 14891, RBMX, 75386, 177836, 1-877; 14891, RBMX, 75388, 177838, 156-269; 14891, RBMX, 75389, 177839, 156-392; 14891, RBMX, 75390, 177840, 156-1046; 14891, RBMX, 75391, 177841, 153-389; 14891, RBMX, 75392, 177842, 337-1128; 14891, RBMX, 75385, 177835, 156-1331; 14891, RBMX, 75387, 177837, 156-746; 14892, RBMX2, 75394, 177844, 29-205; 14892, RBMX2, 75395, 177845, 65-892; 14892, RBMX2, 75393, 177843, 65-1033; 14893, RBMXL1, 75396, 177846, 429-1601; 14893, RBMXL1, 75397, 177847, 717-1889; 14894, RBMXL2, 75398, 177848, 95-1273; 14895, RBMXL3, 75399, 177849, 16-3219; 14896, RBMY1A1, 75401, 177851, 128-373; 14896, RBMY1A1, 75400, 177850, 66-1445; 14896, RBMY1A1, 75402, 177852, 153-1643; 14896, RBMY1A1, 75403, 177853, 119-1609; 14897, RBMY1B, 75404, 177854, 128-373; 14897, RBMY1B, 75406, 177856, 66-1445; 14897, RBMY1B, 75405, 177855, 153-1643; 14898, RBMY1D, 75407, 177857, 128-373; 14898, RBMY1D, 75408, 177858, 153-1643; 14898, RBMY1D, 75409, 177859, 66-1445; 14899, RBMY1E, 75410, 177860, 128-373; 14899, RBMY1E, 75411, 177861, 118-1497; 14899, RBMY1E, 75413, 177863, 113-1603; 14899, RBMY1E, 75412, 177862, 153-1643; 14900, RBMY1F, 75415, 177865, 153-1532; 14900, RBMY1F, 75414, 177864, 119-1609; 14901, RBMY1J, 75417, 177867, 153-1532; 14901, RBMY1J, 75416, 177866, 118-1608; 14901, RBMY1J, 75418, 177868, 153-1643; 14902, RBMS1, 75420, 177870, 1-1161; 14902, RBMS1, 75421, 177871, 126-1238; 14902, RBMS1, 75422, 177872, 66-1178; 14902, RBMS1, 75423, 177873, 451-1563; 14902, RBMS1, 75424, 177874, 201-583; 14902, RBMS1, 75419, 177869, 432-1652; 14903, RBMS2, 75426, 177876, 234-1022; 14903, RBMS2, 75427, 177877, 67-1101; 14903, RBMS2, 75428, 177878, 36-218; 14903, RBMS2, 75429, 177879, 234-1082; 14903, RBMS2, 75430, 177880, 35-289; 14903, RBMS2, 75425, 177875, 96-1319; 14904, RBMS3, 75434, 177884, 310-1104; 14904, RBMS3, 75435, 177885, 701-2011; 14904, RBMS3, 75431, 177881, 231-1493; 14904, RBMS3, 75432, 177882, 231-1490; 14904, RBMS3, 75433, 177883, 337-1650; 14904, RBMS3, 75436, 177886, 131-1396; 14904, RBMS3, 75437, 177887, 67-1368; 14905, RNPS1, 75441, 177891, 240-1092; 14905, RNPS1, 75442, 177892, 16-789; 14905, RNPS1, 75443, 177893, 225-479; 14905, RNPS1, 75444, 177894, 155-625; 14905, RNPS1, 75445, 177895, 281-574; 14905, RNPS1, 75446, 177896, 595-981; 14905, RNPS1, 75447, 177897, 461-847; 14905, RNPS1, 75448, 177898, 227-314; 14905, RNPS1, 75450, 177900, 608-1514; 14905, RNPS1, 75451, 177901, 202-582; 14905, RNPS1, 75452, 177902, 532-666; 14905, RNPS1, 75453, 177903, 190-639; 14905, RNPS1, 75454, 177904, 396-814; 14905, RNPS1, 75455, 177905, 396-903; 14905, RNPS1, 75458, 177908, 159-794; 14905, RNPS1, 75438, 177888, 241-1158; 14905, RNPS1, 75439, 177889, 476-1393; 14905, RNPS1, 75440, 177890, 304-1221; 14905, RNPS1, 75449, 177899, 342-1190; 14905, RNPS1, 75456, 177906, 547-1464; 14905, RNPS1, 75457, 177907, 739-1656; 14906, RBPMS, 75463, 177913, 435-782; 14906, RBPMS, 75464, 177914, 9-683; 14906, RBPMS, 75465, 177915, 302-449; 14906, RBPMS, 75466, 177916, 364-711; 14906, RBPMS, 75467, 177917, 1-359; 14906, RBPMS, 75468, 177918, 431-793; 14906, RBPMS, 75469, 177919, 1-342; 14906, RBPMS, 75459, 177909, 567-1181; 14906, RBPMS, 75460, 177910, 583-1173; 14906, RBPMS, 75461, 177911, 583-1242; 14906, RBPMS, 75462, 177912, 615-1205; 14907, RBPMS2, 75470, 177920, 269-898; 14907, RBPMS2, 75471, 177921, 334-630; 14908, RBFOX1, 75473, 177923, 298-1506; 14908, RBFOX1, 75475, 177925, 197-1474; 14908, RBFOX1, 75477, 177927, 322-1464; 14908, RBFOX1, 75478, 177928, 307-1707; 14908, RBFOX1, 75479, 177929, 186-974; 14908, RBFOX1, 75482, 177932, 115-1290; 14908, RBFOX1, 75484, 177934, 1026-1811; 14908, RBFOX1, 75485, 177935, 1-224; 14908, RBFOX1, 75486, 177936, 159-725; 14908, RBFOX1, 75487, 177937, 298-1425; 14908, RBFOX1, 75472, 177922, 253-1509; 14908, RBFOX1, 75474, 177924, 253-1440; 14908, RBFOX1, 75476, 177926, 253-1431; 14908, RBFOX1, 75480, 177930, 253-1414; 14908, RBFOX1, 75481, 177931, 989-2101; 14908, RBFOX1, 75483, 177933, 989-2182; 14909, RBFOX2, 75489, 177939, 85-1197; 14909, RBFOX2, 75490, 177940, 34-1107; 14909, RBFOX2, 75491, 177941, 376-759; 14909, RBFOX2, 75493, 177943, 63-663; 14909, RBFOX2, 75498, 177948, 1-692; 14909, RBFOX2, 75499, 177949, 88-789; 14909, RBFOX2, 75503, 177953, 34-1107; 14909, RBFOX2, 75505, 177955, 88-789; 14909, RBFOX2, 75506, 177956, 1-1170; 14909, RBFOX2, 75507, 177957, 1-684; 14909, RBFOX2, 75508, 177958, 376-759; 14909, RBFOX2, 75509, 177959, 85-1197; 14909, RBFOX2, 75511, 177961, 1-559; 14909, RBFOX2, 75488, 177938, 190-1266; 14909, RBFOX2, 75492, 177942, 370-1473; 14909, RBFOX2, 75494, 177944, 190-1332; 14909, RBFOX2, 75495, 177945, 67-1197; 14909, RBFOX2, 75496, 177946, 1-1113; 14909, RBFOX2, 75497, 177947, 1-1356; 14909, RBFOX2, 75500, 177950, 190-1332; 14909, RBFOX2, 75501, 177951, 370-1473; 14909, RBFOX2, 75502, 177952, 190-1266; 14909, RBFOX2, 75504, 177954, 1-1113; 14909, RBFOX2, 75510, 177960, 67-1197; 14910, RBFOX3, 75514, 177964, 74-1060; 14910, RBFOX3, 75515, 177965, 320-1396; 14910, RBFOX3, 75516, 177966, 142-154; 14910, RBFOX3, 75517, 177967, 1-227; 14910, RBFOX3, 75518, 177968, 105-260; 14910, RBFOX3, 75519, 177969, 1-394; 14910, RBFOX3, 75512, 177962, 418-1395; 14910, RBFOX3, 75513, 177963, 514-1452; 14911, REXO2, 75521, 177971, 1-204; 14911, REXO2, 75522, 177972, 64-321; 14911, REXO2, 75523, 177973, 59-727; 14911, REXO2, 75524, 177974, 1-271; 14911, REXO2, 75525, 177975, 27-593; 14911, REXO2, 75526, 177976, 19-222; 14911, REXO2, 75527, 177977, 31-396; 14911, REXO2, 75528, 177978, 46-285; 14911, REXO2, 75529, 177979, 1-577; 14911, REXO2, 75520, 177970, 144-857; 14911, REXO2, 75530, 177980, 144-857; 14912, RNGTT, 75531, 177981, 1-1725; 14912, RNGTT, 75532, 177982, 313-2106; 14912, RNGTT, 75533, 177983, 1-1374; 14913, RNMTL1, 75535, 177985, 13-345; 14913, RNMTL1, 75536, 177986, 1-532; 14913, RNMTL1, 75534, 177984, 107-1369; 14914, RPAP1, 75539, 177989, 415-955; 14914, RPAP1, 75540, 177990, 160-545; 14914, RPAP1, 75541, 177991, 116-3502; 14914, RPAP1, 75542, 177992, 1-601; 14914, RPAP1, 75537, 177987, 118-4299; 14914, RPAP1, 75538, 177988, 104-4051; 14915, RPAP2, 75543, 177993, 110-1948; 14916, RPAP3, 75544, 177994, 117-2114; 14916, RPAP3, 75545, 177995, 42-1937; 14916, RPAP3, 75546, 177996, 400-1920; 14917, RPUSD1, 75548, 177998, 375-917; 14917, RPUSD1, 75550, 178000, 348-899; 14917, RPUSD1, 75551, 178001, 82-587; 14917, RPUSD1, 75552, 178002, 93-386; 14917, RPUSD1, 75553, 178003, 422-940; 14917, RPUSD1, 75554, 178004, 86-511; 14917, RPUSD1, 75555, 178005, 124-519; 14917, RPUSD1, 75556, 178006, 1-536; 14917, RPUSD1, 75547, 177997, 136-1074; 14917, RPUSD1, 75549, 177999, 245-1183; 14918, RPUSD2, 75559, 178009, 1-519; 14918, RPUSD2, 75557, 178007, 39-1676; 14918, RPUSD2, 75558, 178008, 7-1461; 14919, RPUSD3, 75561, 178011, 1-456; 14919, RPUSD3, 75562, 178012, 1-110; 14919, RPUSD3, 75563, 178013, 1-307; 14919, RPUSD3, 75565, 178015, 1-842; 14919, RPUSD3, 75566, 178016, 1-434; 14919, RPUSD3, 75567, 178017, 190-828; 14919, RPUSD3, 75568, 178018, 1-741; 14919, RPUSD3, 75560, 178010, 3-1058; 14919, RPUSD3, 75564, 178014, 1-1011; 14920, RPUSD4, 75571, 178021, 55-582; 14920, RPUSD4, 75569, 178019, 55-1188; 14920, RPUSD4, 75570, 178020, 9-1049; 14921, RCL1, 75574, 178024, 117-644; 14921, RCL1, 75577, 178027, 411-1058; 14921, RCL1, 75578, 178028, 85-497; 14921, RCL1, 75572, 178022, 178-741; 14921, RCL1, 75573, 178023, 41-604; 14921, RCL1, 75575, 178025, 224-1345; 14921, RCL1, 75576, 178026, 96-659; 14922, RNPC3, 75580, 178030, 132-686; 14922, RNPC3, 75582, 178032, 1-57; 14922, RNPC3, 75583, 178033, 1-547; 14922, RNPC3, 75584, 178034, 353-768; 14922, RNPC3, 75579, 178029, 101-1654; 14922, RNPC3, 75581, 178031, 237-1790; 14922, RNPC3, 75585, 178035, 381-1931; 14923, RNASEK-C17orf49, 75586, 178036, 1-701; 14924, RNF103-CHMP3, 75587, 178037, 143-805; 14924, RNF103-CHMP3, 75588, 178038, 244-999; 14925, ROGDI, 75590, 178040, 1-366; 14925, ROGDI, 75591, 178041, 1-651; 14925, ROGDI, 75592, 178042, 63-269; 14925, ROGDI, 75593, 178043, 103-462; 14925, ROGDI, 75594, 178044, 57-570; 14925, ROGDI, 75595, 178045, 51-811; 14925, ROGDI, 75596, 178046, 1-220; 14925, ROGDI, 75597, 178047, 45-737; 14925, ROGDI, 75589, 178039, 380-1243; 14926, ROS1, 75598, 178048, 200-7225; 14926, ROS1, 75600, 178050, 1-294; 14926, ROS1, 75599, 178049, 200-7243; 14927, RTTN, 75602, 178052, 1-554; 14927, RTTN, 75603, 178053, 1-2010; 14927, RTTN, 75604, 178054, 43-1545; 14927, RTTN, 75601, 178051, 288-6968; 14928, RSBN1, 75606, 178056, 26-1261; 14928, RSBN1, 75607, 178057, 8-2065; 14928, RSBN1, 75609, 178059, 22-2286; 14928, RSBN1, 75605, 178055, 65-2473; 14928, RSBN1, 75608, 178058, 37-2445; 14929, RSBN1L, 75612, 178062, 1-534; 14929, RSBN1L, 75613, 178063, 187-784; 14929, RSBN1L, 75614, 178064, 28-2559; 14929, RSBN1L, 75610, 178060, 28-2568; 14929, RSBN1L, 75611, 178061, 423-2153; 14930, ROBO1, 75615, 178065, 1239-5834; 14930, ROBO1, 75617, 178067, 1-577; 14930, ROBO1, 75618, 178068, 1-569; 14930, ROBO1, 75619, 178069, 32-157; 14930, ROBO1, 75622, 178072, 999-5819; 14930, ROBO1, 75623, 178073, 1239-5816; 14930, ROBO1, 75616, 178066, 84-4739; 14930, ROBO1, 75620, 178070, 115-5070; 14930, ROBO1, 75621, 178071, 555-5375; 14931, ROBO2, 75624, 178074, 57-4376; 14931, ROBO2, 75627, 178077, 1-595; 14931, ROBO2, 75628, 178078, 57-1751; 14931, ROBO2, 75629, 178079, 1-642; 14931, ROBO2, 75630, 178080, 1-1028; 14931, ROBO2, 75631, 178081, 1-625; 14931, ROBO2, 75632, 178082, 173-3382; 14931, ROBO2, 75633, 178083, 1-3753; 14931, ROBO2, 75625, 178075, 901-5037; 14931, ROBO2, 75626, 178076, 280-4464; 14932, ROBO3, 75635, 178085, 858-1307; 14932, ROBO3, 75636, 178086, 241-4335; 14932, ROBO3, 75634, 178084, 193-4353; 14933, ROBO4, 75638, 178088, 303-2891; 14933, ROBO4, 75637, 178087, 487-3510; 14934, N/A, 75639, 178089, 1-356; 14934, N/A, 75640, 178090, 1-274; 14935, N/A, 75641, 178091, 57-378; 14936, N/A, 75642, 178092, 145-498; 14936, N/A, 75643, 178093, 1-293; 14936, N/A, 75644, 178094, 1-362; 14936, N/A, 75645, 178095, 1-362; 14936, N/A, 75646, 178096, 1-293; 14936, N/A, 75647, 178097, 145-498; 14937, N/A, 75648, 178098, 54-764; 14938, N/A, 75649, 178099, 10-693; 14939, N/A, 75650, 178100, 73-1518; 14940, N/A, 75651, 178101, 4-5106; 14940, N/A, 75652, 178102, 1571-3787; 14940, N/A, 75653, 178103, 36-4943; 14941, N/A, 75654, 178104, 256-1275; 14942, N/A, 75655, 178105, 1-641; 14942, N/A, 75656, 178106, 1-432; 14942, N/A, 75657, 178107, 294-2828; 14943, N/A, 75658, 178108, 1-17; 14944, N/A, 75659, 178109, 637-1212; 14945, N/A, 75660, 178110, 17-721; 14945, N/A, 75661, 178111, 14-160; 14946, N/A, 75663, 178113, 25-588; 14946, N/A, 75664, 178114, 514-1146; 14946, N/A, 75662, 178112, 505-1269; 14947, N/A, 75665, 178115, 1-131; 14947, N/A, 75666, 178116, 1-194; 14948, N/A, 75667, 178117, 1-462; 14948, N/A, 75668, 178118, 412-1521; 14948, N/A, 75669, 178119, 1-699; 14948, N/A, 75670, 178120, 1-671; 14948, N/A, 75671, 178121, 308-1006; 14949, N/A, 75672, 178122, 1-240; 14950, N/A, 75673, 178123, 1-195; 14951, N/A, 75674, 178124, 1-284; 14951, N/A, 75675, 178125, 1-190; 14951, N/A, 75676, 178126, 1-236; 14951, N/A, 75677, 178127, 1-291; 14951, N/A, 75678, 178128, 1-270; 14952, N/A, 75679, 178129, 1-605; 14953, N/A, 75680, 178130, 111-431; 14953, N/A, 75681, 178131, 252-554; 14954, N/A, 75682, 178132, 46-540; 14955, N/A, 75683, 178133, 1-819; 14956, N/A, 75684, 178134, 114-545; 14957, N/A, 75685, 178135, 153-2594; 14958, N/A, 75686, 178136, 1-258; 14958, N/A, 75687, 178137, 291-578; 14959, N/A, 75688, 178138, 1-880; 14959, N/A, 75689, 178139, 1-880; 14960, N/A, 75690, 178140, 61-759; 14961, N/A, 75691, 178141, 320-508; 14962, N/A, 75692, 178142, 994-1671; 14963, N/A, 75693, 178143, 6-784; 14964, N/A, 75694, 178144, 1-206; 14964, N/A, 75695, 178145, 1-148; 14964, N/A, 75696, 178146, 1-218; 14965, N/A, 75697, 178147, 49-252; 14965, N/A, 75698, 178148, 15-218; 14965, N/A, 75699, 178149, 1-190; 14966, N/A, 75700, 178150, 1-165; 14967, N/A, 75701, 178151, 1-713; 14968, N/A, 75702, 178152, 1-135; 14968, N/A, 75703, 178153, 1-174; 14968, N/A, 75704, 178154, 1-186; 14969, N/A, 75705, 178155, 25-1033; 14969, N/A, 75706, 178156, 23-538; 14969, N/A, 75707, 178157, 21-389; 14969, N/A, 75708, 178158, 37-552; 14970, N/A, 75709, 178159, 61-902; 14971, N/A, 75710, 178160, 73-336; 14971, N/A, 75711, 178161, 73-183; 14971, N/A, 75712, 178162, 85-195; 14971, N/A, 75713, 178163, 391-654; 14972, N/A, 75714, 178164, 228-725; 14972, N/A, 75715, 178165, 1-365; 14972, N/A, 75716, 178166, 188-499; 14973, N/A, 75717, 178167, 1-85; 14974, N/A, 75718, 178168, 118-1248; 14975, N/A, 75719, 178169, 140-596; 14976, N/A, 75720, 178170, 1-446; 14977, N/A, 75721, 178171, 1-392; 14978, N/A, 75722, 178172, 1-296; 14979, N/A, 75723, 178173, 1-462; 14980, N/A, 75724, 178174, 1-121; 14981, N/A, 75725, 178175, 86-2263; 14981, N/A, 75726, 178176, 141-4418; 14982, N/A, 75727, 178177, 1-327; 14982, N/A, 75728, 178178, 1-232; 14983, N/A, 75729, 178179, 33-1295; 14983, N/A, 75730, 178180, 76-1861; 14983, N/A, 75731, 178181, 1-74; 14983, N/A, 75732, 178182, 245-394; 14983, N/A, 75733, 178183, 62-184; 14983, N/A, 75734, 178184, 1-236; 14983, N/A, 75735, 178185, 1-207; 14983, N/A, 75736, 178186, 55-807; 14984, N/A, 75737, 178187, 1-2550; 14985, N/A, 75738, 178188, 1-252; 14986, N/A, 75739, 178189, 31-1467; 14987, N/A, 75740, 178190, 101-2170; 14988, N/A, 75741, 178191, 186-2357; 14989, N/A, 75742, 178192, 1-200; 14990, N/A, 75743, 178193, 59-199; 14991, N/A, 75744, 178194, 437-952; 14992, N/A, 75745, 178195, 323-1159; 14993, N/A, 75746, 178196, 16-738; 14994, N/A, 75747, 178197, 34-498; 14994, N/A, 75748, 178198, 23-424; 14994, N/A, 75749, 178199, 22-423; 14994, N/A, 75750, 178200, 92-580; 14995, N/A, 75751, 178201, 1-576; 14996, N/A, 75752, 178202, 1-2362; 14997, N/A, 75753, 178203, 1-255; 14998, N/A, 75754, 178204, 99-1040; 14999, N/A, 75755, 178205, 1-353; 15000, N/A, 75756, 178206, 92-1042; 15000, N/A, 75757, 178207, 1-634; 15001, N/A, 75758, 178208, 1-353; 15002, N/A, 75759, 178209, 213-997; 15003, N/A, 75760, 178210, 1-104; 15003, N/A, 75761, 178211, 1-57; 15003, N/A, 75762, 178212, 1-610; 15004, N/A, 75763, 178213, 1-329; 15005, N/A, 75764, 178214, 1-580; 15006, N/A, 75765, 178215, 1-9162; 15007, N/A, 75766, 178216, 150-782; 15008, N/A, 75767, 178217, 188-346; 15009, N/A, 75768, 178218, 579-3896; 15010, N/A, 75769, 178219, 1-732; 15010, N/A, 75770, 178220, 1-702; 15010, N/A, 75771, 178221, 1-1443; 15010, N/A, 75772, 178222, 1-702; 15010, N/A, 75773, 178223, 1-699; 15011, N/A, 75774, 178224, 54-680; 15012, N/A, 75775, 178225, 99-449; 15013, N/A, 75776, 178226, 135-413; 15014, N/A, 75777, 178227, 1-303; 15015, N/A, 75778, 178228, 1-293; 15016, N/A, 75779, 178229, 67-438; 15017, N/A, 75780, 178230, 8-295; 15018, N/A, 75781, 178231, 1-3559; 15018, N/A, 75782, 178232, 1-167; 15019, N/A, 75783, 178233, 4-315; 15020, N/A, 75784, 178234, 1-1284; 15021, N/A, 75785, 178235, 1-495; 15022, N/A, 75786, 178236, 1-517; 15022, N/A, 75787, 178237, 1-327; 15023, N/A, 75788, 178238, 97-564; 15024, N/A, 75789, 178239, 1-397; 15024, N/A, 75790, 178240, 1-432; 15024, N/A, 75791, 178241, 120-1439; 15025, N/A, 75792, 178242, 1-268; 15025, N/A, 75793, 178243, 201-575; 15025, N/A, 75794, 178244, 1-748; 15026, N/A, 75795, 178245, 1-432; 15026, N/A, 75796, 178246, 120-1439; 15026, N/A, 75797, 178247, 1-464; 15027, N/A, 75798, 178248, 1-101; 15028, N/A, 75799, 178249, 77-349; 15028, N/A, 75800, 178250, 57-554; 15028, N/A, 75801, 178251, 77-349; 15028, N/A, 75802, 178252, 57-554; 15029, N/A, 75803, 178253, 45-2906; 15030, N/A, 75804, 178254, 321-1028; 15031, N/A, 75805, 178255, 1-228; 15032, N/A, 75806, 178256, 208-603; 15033, N/A, 75807, 178257, 95-478; 15033, N/A, 75808, 178258, 52-390; 15034, N/A, 75809, 178259, 1-1005; 15035, N/A, 75810, 178260, 1-220; 15036, N/A, 75811, 178261, 151-378; 15037, N/A, 75812, 178262, 214-4233; 15038, N/A, 75813, 178263, 1-1044; 15039, N/A, 75814, 178264, 21-344; 15039, N/A, 75815, 178265, 21-500; 15039, N/A, 75816, 178266, 27-242; 15039, N/A, 75817, 178267, 14-229; 15039, N/A, 75818, 178268, 31-549; 15040, N/A, 75819, 178269, 1-744; 15040, N/A, 75820, 178270, 1-100; 15040, N/A, 75821, 178271, 1-813; 15041, N/A, 75822, 178272, 187-3033; 15042, N/A, 75823, 178273, 1-400; 15043, N/A, 75824, 178274, 337-1419; 15044, N/A, 75825, 178275, 428-808; 15045, N/A, 75826, 178276, 1-336; 15045, N/A, 75827, 178277, 1-1998; 15046, N/A, 75828, 178278, 1-406; 15047, N/A, 75829, 178279, 321-533; 15048, N/A, 75830, 178280, 71-391; 15049, N/A, 75831, 178281, 217-3300; 15050, N/A, 75832, 178282, 337-1053; 15051, N/A, 75833, 178283, 502-789; 15052, N/A, 75834, 178284, 104-277; 15053, N/A, 75835, 178285, 33-518; 15054, N/A, 75836, 178286, 35-2482; 15055, N/A, 75837, 178287, 1-431; 15055, N/A, 75838, 178288, 1-297; 15056, N/A, 75839, 178289, 1-1644; 15057, N/A, 75840, 178290, 1-850; 15058, N/A, 75841, 178291, 220-1215; 15059, N/A, 75842, 178292, 11-557; 15060, N/A, 75843, 178293, 1-437; 15061, N/A, 75844, 178294, 43-246; 15062, N/A, 75845, 178295, 5-253; 15062, N/A, 75846, 178296, 4-126; 15062, N/A, 75847, 178297, 4-126; 15063, N/A, 75848, 178298, 1-1641; 15064, N/A, 75849, 178299, 88-621; 15065, N/A, 75850, 178300, 1-155; 15066, N/A, 75851, 178301, 1-297; 15066, N/A, 75852, 178302, 1-276; 15066, N/A, 75853, 178303, 1-526; 15067, N/A, 75854, 178304, 843-1052; 15067, N/A, 75855, 178305, 462-567; 15067, N/A, 75856, 178306, 509-894; 15068, N/A, 75857, 178307, 90-728; 15069, N/A, 75858, 178308, 197-808; 15069, N/A, 75859, 178309, 66-350; 15069, N/A, 75860, 178310, 201-812; 15070, N/A, 75861, 178311, 16-1632; 15071, N/A, 75862, 178312, 1-557; 15072, N/A, 75863, 178313, 129-1019; 15073, N/A, 75864, 178314, 83-911; 15074, N/A, 75865, 178315, 1-164; 15075, N/A, 75866, 178316, 32-241; 15076, N/A, 75867, 178317, 222-638; 15076, N/A, 75868, 178318, 222-638; 15077, N/A, 75869, 178319, 75-1514; 15077, N/A, 75870, 178320, 85-867; 15077, N/A, 75871, 178321, 105-197; 15078, N/A, 75872, 178322, 77-778; 15079, N/A, 75873, 178323, 1-995; 15079, N/A, 75874, 178324, 1-1217; 15080, N/A, 75875, 178325, 56-241; 15080, N/A, 75876, 178326, 74-181; 15081, N/A, 75877, 178327, 66-2129; 15081, N/A, 75878, 178328, 66-2312; 15082, N/A, 75879, 178329, 126-401; 15083, N/A, 75880, 178330, 331-1680; 15084, N/A, 75881, 178331, 1-228; 15084, N/A, 75882, 178332, 1-372; 15085, N/A, 75883, 178333, 382-2133; 15086, N/A, 75884, 178334, 1-156; 15086, N/A, 75885, 178335, 91-541; 15087, N/A, 75886, 178336, 95-2488; 15088, N/A, 75887, 178337, 1-484; 15088, N/A, 75888, 178338, 1-373; 15089, N/A, 75889, 178339, 1-914; 15089, N/A, 75890, 178340, 252-2507; 15090, N/A, 75891, 178341, 625-3072; 15090, N/A, 75892, 178342, 1-131; 15091, N/A, 75893, 178343, 1-162; 15092, N/A, 75894, 178344, 1-97; 15093, N/A, 75895, 178345, 97-460; 15094, N/A, 75896, 178346, 1-436; 15094, N/A, 75897, 178347, 1-113; 15094, N/A, 75898, 178348, 1-137; 15095, N/A, 75899, 178349, 10-489; 15096, N/A, 75900, 178350, 1-195; 15097, N/A, 75901, 178351, 43-936; 15098, N/A, 75902, 178352, 1-625; 15098, N/A, 75903, 178353, 257-653; 15099, N/A, 75904, 178354, 140-406; 15099, N/A, 75905, 178355, 111-644; 15099, N/A, 75906, 178356, 75-338; 15099, N/A, 75907, 178357, 88-465; 15099, N/A, 75908, 178358, 69-356; 15100, N/A, 75909, 178359, 133-261; 15101, N/A, 75911, 178361, 145-279; 15101, N/A, 75912, 178362, 17-385; 15101, N/A, 75913, 178363, 17-181; 15101, N/A, 75910, 178360, 1-343; 15102, N/A, 75914, 178364, 1-472; 15103, N/A, 75915, 178365, 1-55; 15104, N/A, 75916, 178366, 1-314; 15105, N/A, 75917, 178367, 265-918; 15106, N/A, 75918, 178368, 112-1269; 15107, N/A, 75919, 178369, 91-228; 15107, N/A, 75920, 178370, 73-315; 15108, N/A, 75921, 178371, 75-1709; 15109, N/A, 75922, 178372, 105-365; 15110, N/A, 75923, 178373, 176-502; 15111, N/A, 75924, 178374, 2-2200; 15112, N/A, 75925, 178375, 35-541; 15113, N/A, 75926, 178376, 1-131; 15114, N/A, 75927, 178377, 1-1570; 15114, N/A, 75928, 178378, 1-336; 15114, N/A, 75929, 178379, 1-518; 15114, N/A, 75930, 178380, 1-366; 15115, N/A, 75931, 178381, 1-5382; 15116, N/A, 75932, 178382, 107-530; 15116, N/A, 75933, 178383, 1-254; 15117, N/A, 75934, 178384, 1-173; 15118, N/A, 75935, 178385, 51-1442; 15119, N/A, 75936, 178386, 112-285; 15119, N/A, 75937, 178387, 1-174; 15119, N/A, 75938, 178388, 151-324; 15120, N/A, 75939, 178389, 1-930; 15121, N/A, 75940, 178390, 1-349; 15122, N/A, 75941, 178391, 10-309; 15123, N/A, 75942, 178392, 1-381; 15124, N/A, 75943, 178393, 52-375; 15125, N/A, 75944, 178394, 47-1624; 15126, N/A, 75945, 178395, 1-88; 15126, N/A, 75946, 178396, 1-681; 15127, N/A, 75947, 178397, 49-306; 15128, N/A, 75948, 178398, 1-516; 15129, N/A, 75949, 178399, 1-371; 15129, N/A, 75950, 178400, 1-77; 15129, N/A, 75951, 178401, 1-101; 15130, N/A, 75952, 178402, 191-286; 15131, N/A, 75953, 178403, 1-771; 15132, N/A, 75954, 178404, 5-196; 15132, N/A, 75955, 178405, 81-272; 15132, N/A, 75956, 178406, 161-352; 15133, N/A, 75957, 178407, 83-439; 15133, N/A, 75958, 178408, 83-643; 15134, N/A, 75959, 178409, 193-1060; 15135, N/A, 75960, 178410, 250-566; 15135, N/A, 75961, 178411, 149-937; 15135, N/A, 75962, 178412, 265-512; 15136, N/A, 75963, 178413, 92-1042; 15136, N/A, 75964, 178414, 1-634; 15137, N/A, 75965, 178415, 91-1629; 15138, N/A, 75966, 178416, 1-421; 15138, N/A, 75967, 178417, 1-175; 15138, N/A, 75968, 178418, 1-485; 15139, N/A, 75969, 178419, 132-1460; 15140, N/A, 75970, 178420, 1-132; 15141, N/A, 75971, 178421, 1-125; 15142, N/A, 75972, 178422, 1-889; 15143, N/A, 75973, 178423, 1-975; 15144, N/A, 75974, 178424, 51-560; 15144, N/A, 75975, 178425, 51-563; 15145, N/A, 75976, 178426, 1-105; 15146, N/A, 75977, 178427, 792-1391; 15147, N/A, 75978, 178428, 204-567; 15148, N/A, 75979, 178429, 1-621; 15149, N/A, 75980, 178430, 47-298; 15150, N/A, 75981, 178431, 68-547; 15151, N/A, 75982, 178432, 1-183; 15152, N/A, 75983, 178433, 1-654; 15152, N/A, 75984, 178434, 1-672; 15153, N/A, 75985, 178435, 1-58; 15154, N/A, 75986, 178436, 117-539; 15155, N/A, 75987, 178437, 1-434; 15155, N/A, 75988, 178438, 1-1017; 15155, N/A, 75989, 178439, 1-223; 15156, N/A, 75990, 178440, 169-1248; 15157, N/A, 75991, 178441, 38-568; 15157, N/A, 75992, 178442, 1-422; 15157, N/A, 75993, 178443, 66-584; 15158, N/A, 75994, 178444, 1-252; 15159, N/A, 75995, 178445, 1-1253; 15159, N/A, 75996, 178446, 1-507; 15159, N/A, 75997, 178447, 1-871; 15160, N/A, 75998, 178448, 106-357; 15161, N/A, 75999, 178449, 1-333; 15162, N/A, 76000, 178450, 1-184; 15162, N/A, 76001, 178451, 1-51; 15162, N/A, 76002, 178452, 1-268; 15162, N/A, 76003, 178453, 95-991; 15163, N/A, 76004, 178454, 264-605; 15164, N/A, 76005, 178455, 361-672; 15165, N/A, 76006, 178456, 194-1057; 15166, N/A, 76007, 178457, 1-173; 15166, N/A, 76008, 178458, 1-171; 15167, N/A, 76009, 178459, 74-985; 15168, N/A, 76010, 178460, 200-484; 15169, N/A, 76011, 178461, 84-848; 15170, N/A, 76012, 178462, 282-1826; 15170, N/A, 76013, 178463, 136-468; 15171, N/A, 76014, 178464, 160-414; 15172, N/A, 76015, 178465, 1-1348; 15173, N/A, 76016, 178466, 782-1072; 15174, N/A, 76017, 178467, 108-947; 15175, N/A, 76018, 178468, 1-114; 15176, RPAIN, 76019, 178469, 324-770; 15176, RPAIN, 76020, 178470, 571-1089; 15176, RPAIN, 76021, 178471, 571-1230; 15176, RPAIN, 76022, 178472, 12-707; 15176, RPAIN, 76025, 178475, 571-891; 15176, RPAIN, 76026, 178476, 571-894; 15176, RPAIN, 76027, 178477, 571-894; 15176, RPAIN, 76028, 178478, 27-350; 15176, RPAIN, 76029, 178479, 10-330; 15176, RPAIN, 76023, 178473, 571-891; 15176, RPAIN, 76024, 178474, 571-1008; 15177, RPGRIP1L, 76032, 178482, 46-1107; 15177, RPGRIP1L, 76033, 178483, 53-430; 15177, RPGRIP1L, 76034, 178484, 95-3856; 15177, RPGRIP1L, 76035, 178485, 53-3898; 15177, RPGRIP1L, 76036, 178486, 144-380; 15177, RPGRIP1L, 76037, 178487, 284-651; 15177, RPGRIP1L, 76038, 178488, 298-465; 15177, RPGRIP1L, 76039, 178489, 65-3874; 15177, RPGRIP1L, 76030, 178480, 95-3802; 15177, RPGRIP1L, 76031, 178481, 52-3999; 15178, RPL17-C18orf32, 76040, 178490, 109-681; 15178, RPL17-C18orf32, 76041, 178491, 16-570; 15178, RPL17-

C18orf32, 76042, 178492, 16-702; 15179, RPL36A-HNRNPH2, 76043, 178493, 33-389; 15179, RPL36A-HNRNPH2, 76044, 178494, 34-267; 15180, RPS10-NUDT3, 76045, 178495, 18-876; 15181, RICTOR, 76049, 178499, 13-686; 15181, RICTOR, 76046, 178496, 23-5221; 15181, RICTOR, 76047, 178497, 32-5158; 15181, RICTOR, 76048, 178498, 13-786; 15182, RRN3, 76052, 178502, 17-1882; 15182, RRN3, 76054, 178504, 79-1995; 15182, RRN3, 76056, 178506, 79-1995; 15182, RRN3, 76058, 178508, 17-1882; 15182, RRN3, 76050, 178500, 85-2040; 15182, RRN3, 76051, 178501, 68-1924; 15182, RRN3, 76053, 178503, 21-938; 15182, RRN3, 76055, 178505, 85-2040; 15182, RRN3, 76057, 178507, 21-938; 15182, RRN3, 76059, 178509, 68-1924; 15183, RSPO1, 76060, 178510, 714-1505; 15183, RSPO1, 76061, 178511, 586-1377; 15183, RSPO1, 76062, 178512, 456-1058; 15183, RSPO1, 76063, 178513, 216-926; 15184, RSPO2, 76066, 178516, 171-674; 15184, RSPO2, 76068, 178518, 334-602; 15184, RSPO2, 76069, 178519, 199-562; 15184, RSPO2, 76070, 178520, 313-579; 15184, RSPO2, 76071, 178521, 339-568; 15184, RSPO2, 76064, 178514, 622-1353; 15184, RSPO2, 76065, 178515, 450-989; 15184, RSPO2, 76067, 178517, 198-728; 15185, RSPO3, 76072, 178522, 590-1408; 15185, RSPO3, 76073, 178523, 156-1034; 15186, RSPO4, 76074, 178524, 98-802; 15186, RSPO4, 76075, 178525, 101-619; 15187, RTEL1-TNFRSF6B, 76076, 178526, 104-2461; 15187, RTEL1-TNFRSF6B, 76077, 178527, 1-4203; 15188, RTF1, 76079, 178529, 1-515; 15188, RTF1, 76078, 178528, 13-2145; 15189, RUFY1, 76082, 178532, 1-973; 15189, RUFY1, 76084, 178534, 1-658; 15189, RUFY1, 76085, 178535, 1-984; 15189, RUFY1, 76086, 178536, 1-812; 15189, RUFY1, 76080, 178530, 13-2139; 15189, RUFY1, 76081, 178531, 159-1961; 15189, RUFY1, 76083, 178533, 348-2150; 15190, RUFY2, 76087, 178537, 820-1410; 15190, RUFY2, 76088, 178538, 89-787; 15190, RUFY2, 76092, 178542, 1-1862; 15190, RUFY2, 76094, 178544, 1-392; 15190, RUFY2, 76089, 178539, 328-2253; 15190, RUFY2, 76090, 178540, 106-1317; 15190, RUFY2, 76091, 178541, 106-1245; 15190, RUFY2, 76093, 178543, 102-1922; 15191, RUFY3, 76098, 178548, 1-173; 15191, RUFY3, 76099, 178549, 1-437; 15191, RUFY3, 76101, 178551, 263-867; 15191, RUFY3, 76102, 178552, 189-482; 15191, RUFY3, 76103, 178553, 67-531; 15191, RUFY3, 76095, 178545, 564-1973; 15191, RUFY3, 76096, 178546, 580-2442; 15191, RUFY3, 76097, 178547, 137-1657; 15191, RUFY3, 76100, 178550, 196-1899; 15192, RUFY4, 76105, 178555, 411-2234; 15192, RUFY4, 76104, 178554, 111-1826; 15192, RUFY4, 76106, 178556, 1433-1951; 15193, RUSC1, 76112, 178562, 138-934; 15193, RUSC1, 76113, 178563, 254-1156; 15193, RUSC1, 76114, 178564, 116-930; 15193, RUSC1, 76115, 178565, 1-676; 15193, RUSC1, 76116, 178566, 112-429; 15193, RUSC1, 76117, 178567, 823-1206; 15193, RUSC1, 76118, 178568, 906-1541; 15193, RUSC1, 76107, 178557, 319-1620; 15193, RUSC1, 76108, 178558, 482-1960; 15193, RUSC1, 76109, 178559, 126-1427; 15193, RUSC1, 76110, 178560, 152-2860; 15193, RUSC1, 76111, 178561, 183-2573; 15194, RUSC2, 76119, 178569, 139-4689; 15194, RUSC2, 76120, 178570, 570-5120; 15195, RUBCN, 76123, 178573, 190-1497; 15195, RUBCN, 76124, 178574, 1-2803; 15195, RUBCN, 76125, 178575, 1-2042; 15195, RUBCN, 76126, 178576, 1-442; 15195, RUBCN, 76127, 178577, 542-615; 15195, RUBCN, 76121, 178571, 547-3330; 15195, RUBCN, 76122, 178572, 1-2919; 15196, RUNDC1, 76129, 178579, 1-791; 15196, RUNDC1, 76128, 178578, 13-1854; 15197, RUNDC3A, 76133, 178583, 1-1212; 15197, RUNDC3A, 76130, 178580, 238-1455; 15197, RUNDC3A, 76131, 178581, 275-1615; 15197, RUNDC3A, 76132, 178582, 251-1453; 15198, RUNDC3B, 76134, 178584, 412-1833; 15198, RUNDC3B, 76135, 178585, 210-1580; 15198, RUNDC3B, 76136, 178586, 371-1594; 15199, RUNX1, 76140, 178590, 54-822; 15199, RUNX1, 76141, 178591, 72-1241; 15199, RUNX1, 76142, 178592, 191-610; 15199, RUNX1, 76143, 178593, 250-346; 15199, RUNX1, 76145, 178595, 181-297; 15199, RUNX1, 76146, 178596, 1435-1582; 15199, RUNX1, 76137, 178587, 446-1888; 15199, RUNX1, 76138, 178588, 1579-2940; 15199, RUNX1, 76139, 178589, 1579-2331; 15199, RUNX1, 76144, 178594, 191-1633; 15200, RUNX1T1, 76151, 178601, 188-2179; 15200, RUNX1T1, 76152, 178602, 72-585; 15200, RUNX1T1, 76153, 178603, 300-574; 15200, RUNX1T1, 76154, 178604, 380-553; 15200, RUNX1T1, 76155, 178605, 319-556; 15200, RUNX1T1, 76158, 178608, 143-349; 15200, RUNX1T1, 76159, 178609, 366-574; 15200, RUNX1T1, 76160, 178610, 1-92; 15200, RUNX1T1, 76161, 178611, 195-553; 15200, RUNX1T1, 76162, 178612, 465-730; 15200, RUNX1T1, 76163, 178613, 310-564; 15200, RUNX1T1, 76164, 178614, 377-782; 15200, RUNX1T1, 76165, 178615, 223-690; 15200, RUNX1T1, 76166, 178616, 282-392; 15200, RUNX1T1, 76167, 178617, 190-300; 15200, RUNX1T1, 76168, 178618, 316-596; 15200, RUNX1T1, 76169, 178619, 24-656; 15200, RUNX1T1, 76170, 178620, 347-491; 15200, RUNX1T1, 76171, 178621, 454-591; 15200, RUNX1T1, 76172, 178622, 188-548; 15200, RUNX1T1, 76173, 178623, 213-573; 15200, RUNX1T1, 76174, 178624, 387-548; 15200, RUNX1T1, 76175, 178625, 197-307; 15200, RUNX1T1, 76176, 178626, 538-1044; 15200, RUNX1T1, 76177, 178627, 467-544; 15200, RUNX1T1, 76178, 178628, 268-572; 15200, RUNX1T1, 76180, 178630, 1-383; 15200, RUNX1T1, 76181, 178631, 1-96; 15200, RUNX1T1, 76182, 178632, 289-976; 15200, RUNX1T1, 76184, 178634, 343-2097; 15200, RUNX1T1, 76147, 178597, 195-2009; 15200, RUNX1T1, 76148, 178598, 212-1915; 15200, RUNX1T1, 76149, 178599, 412-2145; 15200, RUNX1T1, 76150, 178600, 298-2001; 15200, RUNX1T1, 76156, 178606, 456-2270; 15200, RUNX1T1, 76157, 178607, 145-1992; 15200, RUNX1T1, 76179, 178629, 720-2453; 15200, RUNX1T1, 76183, 178633, 393-2126; 15200, RUNX1T1, 76185, 178635, 538-2352; 15200, RUNX1T1, 76186, 178636, 394-2208; 15200, RUNX1T1, 76187, 178637, 598-2412; 15201, RUNX2, 76193, 178643, 1-1629; 15201, RUNX2, 76194, 178644, 542-1372; 15201, RUNX2, 76195, 178645, 371-484; 15201, RUNX2, 76196, 178646, 1-1458; 15201, RUNX2, 76188, 178638, 93-1616; 15201, RUNX2, 76189, 178639, 211-1710; 15201, RUNX2, 76190, 178640, 1-1500; 15201, RUNX2, 76191, 178641, 359-1924; 15201, RUNX2, 76192, 178642, 205-1770; 15202, RUNX3, 76197, 178647, 10-1257; 15202, RUNX3, 76198, 178648, 247-1536; 15202, RUNX3, 76199, 178649, 440-1729; 15203, RUVBL1, 76201, 178651, 1-804; 15203, RUVBL1, 76202, 178652, 1-667; 15203, RUVBL1, 76203, 178653, 752-1699; 15203, RUVBL1, 76204, 178654, 1-396; 15203, RUVBL1, 76200, 178650, 101-1471; 15204, RUVBL2, 76205, 178655, 14-793; 15204, RUVBL2, 76206, 178656, 356-682; 15204, RUVBL2, 76207, 178657, 3-122; 15204, RUVBL2, 76208, 178658, 24-158; 15204, RUVBL2, 76209, 178659, 465-1529; 15204, RUVBL2, 76210, 178660, 15-167; 15204, RUVBL2, 76212, 178662, 1-1065; 15204, RUVBL2, 76211, 178661, 465-1856; 15205, RWDD1, 76214, 178664, 304-505; 15205, RWDD1, 76216, 178666, 705-857; 15205, RWDD1, 76217, 178667, 366-581; 15205, RWDD1, 76213, 178663, 217-948; 15205, RWDD1, 76215, 178665, 497-940; 15206, RWDD2A, 76218, 178668, 206-1084; 15207, RWDD2B, 76219, 178669, 102-1061; 15208, RWDD3, 76220, 178670, 21-608; 15208, RWDD3, 76221, 178671, 77-880; 15209, RWDD4, 76222, 178672, 227-790; 15209, RWDD4, 76224, 178674, 252-413; 15209, RWDD4, 76225, 178675, 136-264; 15209, RWDD4, 76226, 178676, 309-686; 15209, RWDD4, 76228, 178678, 250-384; 15209, RWDD4, 76223, 178673, 274-840; 15209, RWDD4, 76227, 178677, 294-575; 15210, RYR1, 76231, 178681, 108-15206; 15210, RYR1, 76232, 178682, 1-515; 15210, RYR1, 76233, 178683, 1-2659; 15210, RYR1, 76234, 178684, 1-239; 15210, RYR1, 76235, 178685, 1-2200; 15210, RYR1, 76236, 178686, 1-432; 15210, RYR1, 76237, 178687, 1-863; 15210, RYR1, 76229, 178679, 132-15233; 15210, RYR1, 76230, 178680, 1-15117; 15211, RYR2, 76238, 178688, 1-14850; 15211, RYR2, 76239, 178689, 318-15221; 15212, RYR3, 76242, 178692, 71-14692; 15212, RYR3, 76243, 178693, 102-14714; 15212, RYR3, 76244, 178694, 1-137; 15212, RYR3, 76245, 178695, 1-1848; 15212, RYR3, 76246, 178696, 1-14580; 15212, RYR3, 76240, 178690, 71-14680; 15212, RYR3, 76241, 178691, 85-14682; 15213, SRBD1, 76247, 178697, 64-3051; 15214, S100A1, 76249, 178699, 89-250; 15214, S100A1, 76250, 178700, 148-591; 15214, S100A1, 76251, 178701, 133-236; 15214, S100A1, 76248, 178698, 114-398; 15215, S100A10, 76252, 178702, 78-371; 15215, S100A10, 76253, 178703, 661-954; 15216, S100A11, 76254, 178704, 121-438; 15217, S100A12, 76255, 178705, 119-397; 15218, S100A13, 76256, 178706, 122-418; 15218, S100A13, 76257, 178707, 160-456; 15218, S100A13, 76258, 178708, 192-488; 15218, S100A13, 76259, 178709, 297-593; 15219, S100A14, 76260, 178710, 117-431; 15219, S100A14, 76261, 178711, 136-450; 15219, S100A14, 76262, 178712, 274-588; 15219, S100A14, 76263, 178713, 81-395; 15220, S100A16, 76264, 178714, 76-387; 15220, S100A16, 76265, 178715, 187-498; 15220, S100A16, 76266, 178716, 473-784; 15220, S100A16, 76267, 178717, 159-470; 15221, S100A2, 76268, 178718, 51-338; 15221, S100A2, 76273, 178723, 404-598; 15221, S100A2, 76269, 178719, 374-667; 15221, S100A2, 76270, 178720, 68-361; 15221, S100A2, 76271, 178721, 61-354; 15221, S100A2, 76272, 178722, 360-653; 15222, S100A3, 76274, 178724, 105-410; 15222, S100A3, 76275, 178725, 198-503; 15223, S100A4, 76276, 178726, 115-420; 15223, S100A4, 76277, 178727, 88-393; 15223, S100A4, 76278, 178728, 122-427; 15223, S100A4, 76279, 178729, 149-454; 15224, S100A5, 76280, 178730, 89-367; 15224, S100A5, 76281, 178731, 283-561; 15225, S100A6, 76284, 178734, 225-479; 15225, S100A6, 76282, 178732, 296-568; 15225, S100A6, 76283, 178733, 304-576; 15225, S100A6, 76285, 178735, 304-576; 15226, S100A7, 76286, 178736, 75-380; 15226, S100A7, 76287, 178737, 112-417; 15227, S100A7A, 76288, 178738, 140-445; 15227, S100A7A, 76289, 178739, 74-379; 15227, S100A7A, 76290, 178740, 58-363; 15228, S100A7L2, 76291, 178741, 1-339; 15229, S100A8, 76292, 178742, 143-424; 15229, S100A8, 76293, 178743, 171-452; 15230, S100A9, 76294, 178744, 44-388; 15231, S100B, 76296, 178746, 198-482; 15231, S100B, 76295, 178745, 198-476; 15231, S100B, 76297, 178747, 479-757; 15232, S100G, 76298, 178748, 55-294; 15233, S100P, 76299, 178749, 865-1152; 15234, S100Z, 76300, 178750, 233-532; 15234, S100Z, 76301, 178751, 331-630; 15234, S100Z, 76302, 178752, 60-359; 15235, S100PBP, 76305, 178755, 268-706; 15235, S100PBP, 76306, 178756, 306-429; 15235, S100PBP, 76307, 178757, 213-573; 15235, S100PBP, 76308, 178758, 536-551; 15235, S100PBP, 76309, 178759, 336-725; 15235, S100PBP, 76310, 178760, 38-551; 15235, S100PBP, 76303, 178753, 255-1481; 15235, S100PBP, 76304, 178754, 278-1504; 15236, SAA2-SAA4, 76311, 178761, 38-664; 15237, SACM1L, 76313, 178763, 1480-2343; 15237, SACM1L, 76314, 178764, 575-2029; 15237, SACM1L, 76315, 178765, 112-327; 15237, SACM1L, 76316, 178766, 205-542; 15237, SACM1L, 76317, 178767, 117-678; 15237, SACM1L, 76312, 178762, 205-1968; 15238, SAC3D1, 76318, 178768, 390-1466; 15238, SAC3D1, 76319, 178769, 214-1290; 15238, SAC3D1, 76320, 178770, 1-720; 15238, SAC3D1, 76321, 178771, 1-1215; 15239, SCCPDH, 76322, 178772, 377-1666; 15240, SACS, 76326, 178776, 1-1125; 15240, SACS, 76327, 178777, 1-2197; 15240, SACS, 76323, 178773, 275-14014; 15240, SACS, 76324, 178774, 616-14355; 15240, SACS, 76325, 178775, 2335-13824; 15241, SUN1, 76331, 178781, 25-2493; 15241, SUN1, 76332, 178782, 154-676; 15241, SUN1, 76334, 178784, 1-513; 15241, SUN1, 76335, 178785, 201-540; 15241, SUN1, 76336, 178786, 368-633; 15241, SUN1, 76338, 178788, 272-537; 15241, SUN1, 76339, 178789, 208-563; 15241, SUN1, 76340, 178790, 1-1283; 15241, SUN1, 76341, 178791, 1-1903; 15241, SUN1, 76342, 178792, 1-2133; 15241, SUN1, 76343, 178793, 220-626; 15241, SUN1, 76345, 178795, 1-473; 15241, SUN1, 76328, 178778, 133-2241; 15241, SUN1, 76329, 178779, 23-796; 15241, SUN1, 76330, 178780, 25-2382; 15241, SUN1, 76333, 178783, 171-2279; 15241, SUN1, 76337, 178787, 237-1073; 15241, SUN1, 76344, 178794, 80-2128; 15242, SUN2, 76349, 178799, 1-597; 15242, SUN2, 76350, 178800, 245-546; 15242, SUN2, 76351, 178801, 1-431; 15242, SUN2, 76352, 178802, 341-1012; 15242, SUN2, 76353, 178803, 157-538; 15242, SUN2, 76354, 178804, 115-444; 15242, SUN2, 76355, 178805, 172-545; 15242, SUN2, 76356, 178806, 188-621; 15242, SUN2, 76357, 178807, 390-1074; 15242, SUN2, 76346, 178796, 214-2367; 15242, SUN2, 76347, 178797, 275-2491; 15242, SUN2, 76348, 178798, 360-2513; 15243, SUN3, 76360, 178810, 1-801; 15243, SUN3, 76361, 178811, 1-845; 15243, SUN3, 76362, 178812, 111-380; 15243, SUN3, 76363, 178813, 1-513; 15243, SUN3, 76358, 178808, 161-1234; 15243, SUN3, 76359, 178809, 98-1171; 15243, SUN3, 76364, 178814, 1-810; 15243, SUN3, 76365, 178815, 232-1269; 15244, SUNS, 76367, 178817, 20-388; 15244, SUNS, 76368, 178818, 68-1132; 15244, SUNS, 76369, 178819, 1-459; 15244, SUNS, 76366, 178816, 94-1233; 15245, SLTM, 76370, 178820, 15-1373; 15245, SLTM, 76372, 178822, 1-1803; 15245, SLTM, 76373, 178823, 1-303; 15245, SLTM, 76374, 178824, 1-616; 15245, SLTM, 76375, 178825, 30-717; 15245, SLTM, 76376, 178826, 10-585; 15245, SLTM, 76377, 178827, 12-200; 15245, SLTM, 76378, 178828, 1-334; 15245, SLTM, 76379, 178829, 15-548; 15245, SLTM, 76380, 178830, 36-305; 15245, SLTM, 76381, 178831, 12-495; 15245, SLTM, 76382, 178832, 35-223; 15245, SLTM, 76383, 178833, 34-222; 15245, SLTM, 76371, 178821, 89-3193; 15246, SGF29, 76385, 178835, 1-272; 15246, SGF29, 76386, 178836, 142-540; 15246, SGF29, 76384, 178834, 188-1069; 15247, STH, 76388, 178838, 31-417; 15247, STH, 76387, 178837, 31-417; 15248, SIK1, 76389, 178839, 134-2485; 15249, SIK2, 76390, 178840, 174-2954; 15250, SAV1, 76392, 178842, 1-204; 15250, SAV1, 76393, 178843, 1-939; 15250, SAV1, 76394, 178844, 331-562; 15250, SAV1, 76395, 178845, 1-268; 15250, SAV1, 76391, 178841, 365-1516; 15251, SASH1, 76397, 178847, 54-308; 15251, SASH1, 76398, 178848, 1304-3277; 15251, SASH1, 76396, 178846, 476-4219; 15252, SASH3, 76399, 178849, 115-1257; 15253, SAMHD1, 76400, 178850, 201-2081; 15254, SAMSN1, 76404, 178854, 431-1345; 15254, SAMSN1, 76401, 178851, 176-1501; 15254, SAMSN1, 76402, 178852, 81-698; 15254, SAMSN1, 76403, 178853, 83-1204; 15255, SPDEF, 76405, 178855, 416-1423; 15255, SPDEF, 76406, 178856, 435-1394; 15256, SAMM50, 76407, 178857, 158-1567; 15257, SAG, 76409, 178859, 127-234; 15257, SAG, 76410, 178860, 285-791; 15257, SAG, 76411, 178861, 167-556; 15257, SAG, 76412, 178862, 167-556; 15257, SAG, 76413, 178863, 127-234; 15257, SAG, 76415, 178865, 285-791; 15257, SAG, 76408, 178858, 231-1448; 15257, SAG, 76414, 178864, 231-1448; 15258, SARNP, 76417, 178867, 9-650; 15258, SARNP, 76418, 178868, 22-180; 15258, SARNP, 76416, 178866, 56-688; 15258, SARNP, 76419, 178869, 24-656; 15259, SAP30BP, 76420, 178870, 8-715; 15259, SAP30BP, 76422, 178872, 18-524; 15259, SAP30BP, 76424, 178874, 212-538; 15259, SAP30BP, 76425, 178875, 3-542; 15259, SAP30BP, 76426, 178876, 1-314; 15259, SAP30BP, 76427, 178877, 123-233; 15259, SAP30BP, 76428, 178878, 8-118; 15259, SAP30BP, 76429, 178879, 1-746; 15259, SAP30BP, 76430, 178880, 554-834; 15259, SAP30BP, 76431, 178881, 1-976; 15259, SAP30BP, 76432, 178882, 12-125; 15259, SAP30BP, 76421, 178871, 28-906; 15259, SAP30BP, 76423, 178873, 258-1184; 15260, SAP30L, 76433, 178883, 649-1200; 15260, SAP30L, 76434, 178884, 61-489; 15260, SAP30L, 76435, 178885, 61-474; 15261, SRL, 76437, 178887, 176-1471; 15261, SRL, 76438, 178888, 9-1469; 15261, SRL, 76436, 178886, 14-1435; 15262, SGCA, 76441, 178891, 1-481; 15262, SGCA, 76442, 178892, 33-218; 15262, SGCA, 76443, 178893, 57-254; 15262, SGCA, 76444, 178894, 1-591; 15262, SGCA, 76445, 178895, 38-934; 15262, SGCA, 76446, 178896, 1-176; 15262, SGCA, 76439, 178889, 37-1200; 15262, SGCA, 76440, 178890, 37-828; 15263, SGCB, 76448, 178898, 1-301; 15263, SGCB, 76449, 178899, 1-282; 15263, SGCB, 76447, 178897, 224-1180; 15264, SGCD, 76453, 178903, 329-577; 15264, SGCD, 76450, 178900, 520-1392; 15264, SGCD, 76451, 178901, 488-1357; 15264, SGCD, 76452, 178902, 363-1133; 15265, SGCE, 76455, 178905, 69-1355; 15265, SGCE, 76456, 178906, 76-207; 15265, SGCE, 76457, 178907, 69-1259; 15265, SGCE, 76459, 178909, 30-161; 15265, SGCE, 76461, 178911, 89-1504; 15265, SGCE, 76462, 178912, 1-126; 15265, SGCE, 76454, 178904, 112-1425; 15265, SGCE, 76458, 178908, 1-1356; 15265, SGCE, 76460, 178910, 27-1415; 15266, SGCG, 76463, 178913, 125-1000; 15267, SGCZ, 76465, 178915, 1-798; 15267, SGCZ, 76466, 178916, 165-710; 15267, SGCZ, 76464, 178914, 717-1655; 15268, SLMAP, 76470, 178920, 1-1300; 15268, SLMAP, 76471, 178921, 1-949; 15268, SLMAP, 76473, 178923, 1-1229; 15268, SLMAP, 76475, 178925, 261-565; 15268, SLMAP, 76476, 178926, 152-1108; 15268, SLMAP, 76477, 178927, 223-1311; 15268, SLMAP, 76478, 178928, 1-511; 15268, SLMAP, 76479, 178929, 260-587; 15268, SLMAP, 76480, 178930, 1-197; 15268, SLMAP, 76467, 178917, 1218-3653; 15268, SLMAP, 76468, 178918, 206-2641; 15268, SLMAP, 76469, 178919, 99-1619; 15268, SLMAP, 76472, 178922, 95-2581; 15268, SLMAP, 76474, 178924, 95-2467; 15269, SLN, 76481, 178931, 175-270; 15269, SLN, 76482, 178932, 118-213; 15269, SLN, 76483, 178933, 354-449; 15270, SAGE1, 76486, 178936, 75-1661; 15270, SAGE1, 76484, 178934, 75-2789; 15270, SAGE1, 76485, 178935, 1-2715; 15271, SARDH, 76487, 178937, 294-1484; 15271, SARDH, 76488, 178938, 138-989; 15271, SARDH, 76489, 178939, 835-1941; 15271, SARDH, 76491, 178941, 133-1957; 15271, SARDH, 76493, 178943, 127-1935; 15271, SARDH, 76494, 178944, 133-1557; 15271, SARDH, 76490, 178940, 259-3015; 15271, SARDH, 76492, 178942, 135-2891; 15272, SSPN, 76497, 178947, 1-387; 15272, SSPN, 76499, 178949, 193-553; 15272, SSPN, 76495, 178945, 178-909; 15272, SSPN, 76496, 178946, 223-645; 15272, SSPN, 76498, 178948, 95-517; 15273, SASS6, 76500, 178950, 142-2115; 15274, SATB1, 76502, 178952, 96-594; 15274, SATB1, 76503, 178953, 368-579; 15274, SATB1, 76504, 178954, 441-464; 15274, SATB1, 76505, 178955, 176-564; 15274, SATB1, 76508, 178958, 302-975; 15274, SATB1, 76509, 178959, 422-939; 15274, SATB1, 76510, 178960, 236-583; 15274, SATB1, 76511, 178961, 292-540; 15274, SATB1, 76512, 178962, 417-833; 15274, SATB1, 76513, 178963, 59-558; 15274, SATB1, 76501, 178951, 1736-4027; 15274, SATB1, 76506, 178956, 972-3359; 15274, SATB1, 76507, 178957, 234-2525; 15275, SATB2, 76516, 178966, 1467-3491; 15275, SATB2, 76519, 178969, 334-714; 15275, SATB2, 76514, 178964, 414-2615; 15275, SATB2, 76515, 178965, 52-1899; 15275, SATB2, 76517, 178967, 818-3019; 15275, SATB2, 76518, 178968, 394-2595; 15275, SATB2, 76520, 178970, 414-2261; 15276, SAYSD1, 76521, 178971, 101-652; 15276, SAYSD1, 76522, 178972, 254-604; 15277, SAFB, 76525, 178975, 1-459; 15277, SAFB, 76528, 178978, 172-492; 15277, SAFB, 76523, 178973, 108-2855; 15277, SAFB, 76524, 178974, 68-2614; 15277, SAFB, 76526, 178976, 89-2839; 15277, SAFB, 76527, 178977, 54-2807; 15278, SAFB2, 76530, 178980, 1-264; 15278, SAFB2, 76531, 178981, 193-564; 15278, SAFB2, 76529, 178979, 266-3127; 15278, SAFB2, 76532, 178982, 62-409; 15279, SPIDR, 76534, 178984, 58-335; 15279, SPIDR, 76535, 178985, 215-1387; 15279, SPIDR, 76536, 178986, 47-184; 15279, SPIDR, 76537, 178987, 5-550; 15279, SPIDR, 76538, 178988, 1-1493; 15279, SPIDR, 76539, 178989, 1-288; 15279, SPIDR, 76541, 178991, 4-234; 15279, SPIDR, 76542, 178992, 4-633; 15279, SPIDR, 76543, 178993, 513-970; 15279, SPIDR, 76544, 178994, 5-385; 15279, SPIDR, 76545, 178995, 7-552; 15279, SPIDR, 76546, 178996, 18-416; 15279, SPIDR, 76533, 178983, 385-3132; 15279, SPIDR, 76540, 178990, 172-2802; 15279, SPIDR, 76547, 178997, 225-2762; 15280, SCAND1, 76548, 178998, 235-774; 15280, SCAND1, 76549, 178999, 1072-1611; 15280, SCAND1, 76550, 179000, 704-1243; 15281, SCARA3, 76551, 179001, 21-1841; 15281, SCARA3, 76552, 179002, 334-1734; 15282, SCARA5, 76553, 179003, 487-1974; 15282, SCARA5, 76554, 179004, 424-1236; 15282, SCARA5, 76555, 179005, 384-1586; 15282, SCARA5, 76556, 179006, 1-1074; 15283, SCARB1, 76560, 179010, 64-1509; 15283, SCARB1, 76561, 179011, 144-581; 15283, SCARB1, 76562, 179012, 37-1536; 15283, SCARB1, 76557, 179007, 128-1657; 15283, SCARB1, 76558, 179008, 198-1718; 15283, SCARB1, 76559, 179009, 127-1785; 15284, SCARB2, 76565, 179015, 58-378; 15284, SCARB2, 76563, 179013, 351-1787; 15284, SCARB2, 76564, 179014, 61-1068; 15285, SCARF1, 76567, 179017, 17-2251; 15285, SCARF1, 76570, 179020, 16-165; 15285, SCARF1, 76571, 179021, 17-2251; 15285, SCARF1, 76574, 179024, 16-165; 15285, SCARF1, 76566, 179016, 51-2543; 15285, SCARF1, 76568, 179018, 27-1055; 15285, SCARF1, 76569, 179019, 48-1757; 15285, SCARF1, 76572, 179022, 51-2543; 15285, SCARF1, 76573, 179023, 27-1055; 15285, SCARF1, 76575, 179025, 48-1757; 15286, SCARF2, 76577, 179027, 106-2718; 15286, SCARF2, 76578, 179028, 73-2688; 15286, SCARF2, 76576, 179026, 72-2672; 15287, SSC4D, 76579, 179029, 349-2076; 15288, SSC5D, 76582, 179032, 1-354; 15288, SSC5D, 76583, 179033, 187-457; 15288, SSC5D, 76584, 179034, 24-2885; 15288, SSC5D, 76580, 179030, 24-4745; 15288, SSC5D, 76581, 179031, 24-2879; 15289, SLFN11, 76587, 179037, 457-791; 15289, SLFN11, 76588, 179038, 444-714; 15289, SLFN11, 76589, 179039, 335-606; 15289, SLFN11, 76590, 179040, 266-634; 15289, SLFN11, 76591, 179041, 1-152; 15289, SLFN11, 76592, 179042, 443-588; 15289, SLFN11, 76593, 179043, 284-584; 15289, SLFN11, 76594, 179044, 336-575; 15289, SLFN11, 76585, 179035, 154-2859; 15289, SLFN11, 76586, 179036, 274-2979; 15290, SLFN12, 76598, 179048, 406-751; 15290, SLFN12, 76599, 179049, 495-702; 15290, SLFN12, 76595, 179045, 378-2114; 15290, SLFN12, 76596, 179046, 525-2261; 15290, SLFN12, 76597, 179047, 420-2156; 15291, SLFN12L, 76602, 179052, 1-1767; 15291, SLFN12L, 76600, 179050, 880-2733; 15291, SLFN12L, 76601, 179051, 119-1885; 15292, SLFN13, 76604, 179054, 258-576; 15292, SLFN13, 76606, 179056, 205-596; 15292, SLFN13, 76608, 179058, 277-636; 15292, SLFN13, 76611, 179061, 318-550; 15292, SLFN13, 76603, 179053, 277-2970; 15292, SLFN13, 76605, 179055, 259-2952; 15292, SLFN13, 76607, 179057, 204-1943; 15292, SLFN13, 76609, 179059, 178-2871; 15292, SLFN13, 76610, 179060, 331-3024; 15293, SLFN14, 76612, 179062, 37-2775; 15294, SLFN5, 76614, 179064, 114-1283; 15294, SLFN5, 76613, 179063, 149-2824; 15294, SLFN5, 76615, 179065, 96-1112; 15295, SLFNL1, 76616, 179066, 219-1442; 15295, SLFNL1, 76617, 179067, 2578-3801; 15295, SLFNL1, 76618, 179068, 310-1356; 15295, SLFNL1, 76619, 179069, 1066-2145; 15295, SLFNL1, 76620, 179070, 385-1608; 15296, SCHIP1, 76622, 179072, 442-1224; 15296, SCHIP1, 76623, 179073, 246-404; 15296, SCHIP1, 76621, 179071, 325-1059; 15297, SCEL, 76626, 179076, 121-972; 15297, SCEL, 76624, 179074, 85-2151; 15297, SCEL, 76625, 179075, 86-2092; 15297, SCEL, 76627, 179077, 171-2111; 15298, SCIN, 76630, 179080, 69-549; 15298, SCIN, 76631, 179081, 67-375; 15298, SCIN, 76632, 179082, 264-536; 15298, SCIN, 76633, 179083, 261-585; 15298, SCIN, 76628, 179078, 102-2249; 15298, SCIN, 76629, 179079, 211-1953; 15298, SCIN, 76634, 179084, 367-1773; 15299, STIL, 76635, 179085, 365-4090; 15299, STIL, 76638, 179088, 232-4044; 15299, STIL, 76639, 179089, 1-633; 15299, STIL, 76640, 179090, 230-2984; 15299, STIL, 76641, 179091, 266-542; 15299, STIL, 76636, 179086, 365-4228; 15299, STIL, 76637, 179087, 149-4015; 15300, SCX, 76642, 179092, 55-660; 15301, SOST, 76643, 179093, 48-689; 15302, SOSTDC1, 76644, 179094, 182-802; 15302, SOSTDC1, 76645, 179095, 714-1406; 15303, SFMBT1, 76647, 179097, 487-850; 15303, SFMBT1, 76648, 179098, 335-617; 15303, SFMBT1, 76649, 179099, 549-699; 15303, SFMBT1, 76646, 179096, 384-2984; 15304, SFMBT2, 76651, 179101, 65-547; 15304, SFMBT2, 76652, 179102, 194-754; 15304, SFMBT2, 76650, 179100, 92-2776; 15304, SFMBT2, 76653, 179103, 194-2878; 15305, 5001, 76655, 179105, 24-836; 15305, SCO1, 76656, 179106, 26-301; 15305, SCO1, 76654, 179104, 62-967; 15306, SCO2, 76659, 179109, 208-617; 15306, SCO2, 76660, 179110, 159-568; 15306, SCO2, 76657, 179107, 177-977; 15306, SCO2, 76658, 179108, 149-949; 15306, SCO2, 76661, 179111, 159-959; 15306, SCO2, 76662, 179112, 208-1008; 15307, SSPO, 76663, 179113, 1-15453; 15308, SCP2D1, 76664, 179114, 91-561; 15309, SCRT1, 76665, 179115, 113-1159; 15310, SCRT2, 76666, 179116, 579-1502; 15311, SCRIB, 76670, 179120, 1-1951; 15311, SCRIB, 76671, 179121, 1-421; 15311, SCRIB, 76672, 179122, 222-4871; 15311, SCRIB, 76673, 179123, 8-4900; 15311, SCRIB, 76674, 179124, 8-4975; 15311, SCRIB, 76675, 179125, 1-1951; 15311, SCRIB, 76676, 179126, 1-421; 15311, SCRIB, 76667, 179117, 8-4900; 15311, SCRIB, 76668, 179118, 8-4975; 15311, SCRIB, 76669, 179119, 222-4871; 15312, SCYL1, 76678, 179128, 210-1022; 15312, SCYL1, 76680, 179130, 78-2420; 15312, SCYL1, 76681, 179131, 1-526; 15312, SCYL1, 76682, 179132, 34-2361; 15312, SCYL1, 76683, 179133, 1-843; 15312, SCYL1, 76684, 179134, 480-2477; 15312, SCYL1, 76677, 179127, 78-2504; 15312, SCYL1, 76679, 179129, 70-2445; 15312, SCYL1, 76685, 179135, 43-2406; 15313, SCYL2, 76687, 179137, 286-2328; 15313, SCYL2, 76688, 179138, 1-182; 15313, SCYL2, 76689, 179139, 1-345; 15313, SCYL2, 76690, 179140, 563-790; 15313, SCYL2, 76691, 179141, 180-2981; 15313, SCYL2, 76686, 179136, 438-3227; 15314, SCYL3, 76695, 179145, 312-2077; 15314, SCYL3, 76692, 179142, 49-2277; 15314, SCYL3, 76693, 179143, 216-2282; 15314, SCYL3, 76694, 179144, 223-2451; 15315, SDAD1, 76697, 179147, 98-316; 15315, SDAD1, 76698, 179148, 97-2049; 15315, SDAD1, 76699, 179149, 91-357; 15315, SDAD1, 76700, 179150, 236-379; 15315, SDAD1, 76696, 179146, 120-2183; 15316, SDE2, 76701, 179151, 20-1375; 15317, SUDS3, 76702, 179152, 313-1299; 15318, SEBOX, 76704, 179154, 94-666; 15318, SEBOX, 76703, 179153, 15-665; 15319, SCFD1, 76705, 179155, 13-504; 15319, SCFD1, 76709, 179159, 1-108; 15319, SCFD1, 76710, 179160, 150-743; 15319, SCFD1, 76711, 179161, 158-436; 15319, SCFD1, 76712, 179162, 21-167; 15319, SCFD1, 76713, 179163, 21-248; 15319, SCFD1, 76714, 179164, 1-308; 15319, SCFD1, 76715, 179165, 151-318; 15319, SCFD1, 76716, 179166, 237-490; 15319, SCFD1, 76717, 179167, 29-394; 15319, SCFD1, 76718, 179168, 1-435; 15319, SCFD1, 76706, 179156, 187-1839; 15319, SCFD1, 76707, 179157, 228-2156; 15319, SCFD1, 76708, 179158, 151-1878; 15320, SCFD2, 76721, 179171, 444-529; 15320, SCFD2, 76722, 179172, 1-1320; 15320, SCFD2, 76719, 179169, 121-2040; 15320, SCFD2, 76720, 179170, 135-2189; 15321, SEC11A, 76727, 179177, 386-775; 15321, SEC11A, 76728, 179178, 1-408; 15321, SEC11A, 76729, 179179, 53-544; 15321, SEC11A, 76730, 179180, 222-540; 15321, SEC11A, 76723, 179173, 642-1181; 15321, SEC11A, 76724, 179174, 303-764; 15321, SEC11A, 76725, 179175, 37-531; 15321, SEC11A, 76726, 179176, 15-572; 15322, SEC11C, 76731, 179181, 75-374; 15322, SEC11C, 76732, 179182, 51-536; 15322, SEC11C, 76734, 179184, 84-554; 15322, SEC11C, 76733, 179183, 473-1051; 15323, SEC13, 76736, 179186, 56-1033; 15323, SEC13, 76739, 179189, 593-1447; 15323, SEC13, 76740, 179190, 588-669; 15323, SEC13, 76741, 179191, 484-567; 15323, SEC13, 76742, 179192, 575-832; 15323, SEC13, 76743, 179193, 521-594; 15323, SEC13, 76735, 179185, 127-1095; 15323, SEC13, 76737, 179187, 73-1179; 15323, SEC13, 76738, 179188, 211-1137; 15324, SESTD1, 76744, 179194, 1-320; 15324, SESTD1, 76745, 179195, 153-434; 15324, SESTD1, 76746, 179196, 1-678; 15324, SESTD1, 76747, 179197, 253-681; 15324, SESTD1, 76748, 179198, 1-632; 15324, SESTD1, 76750, 179200, 182-619; 15324, SESTD1, 76749, 179199, 318-2408; 15325, SEC14L1, 76756, 179206, 1-357; 15325, SEC14L1, 76757, 179207, 456-1791; 15325, SEC14L1, 76758, 179208, 508-553; 15325, SEC14L1, 76759, 179209, 596-637; 15325, SEC14L1, 76760, 179210, 150-578; 15325, SEC14L1, 76761, 179211, 363-575; 15325, SEC14L1, 76763, 179213, 1-471; 15325, SEC14L1, 76764, 179214, 472-652; 15325, SEC14L1, 76766, 179216, 1-252; 15325, SEC14L1, 76767, 179217, 1-270; 15325, SEC14L1, 76751, 179201, 560-2719; 15325, SEC14L1, 76752, 179202, 211-2256; 15325, SEC14L1, 76753, 179203, 265-2412; 15325, SEC14L1, 76754, 179204, 212-2371; 15325, SEC14L1, 76755, 179205, 357-2504; 15325, SEC14L1, 76762, 179212, 259-2406; 15325, SEC14L1, 76765, 179215, 446-2491; 15326, SEC14L2, 76770, 179220, 263-871; 15326, SEC14L2, 76771, 179221, 100-354; 15326, SEC14L2, 76772, 179222, 100-261; 15326, SEC14L2, 76773, 179223, 111-485; 15326, SEC14L2, 76774, 179224, 312-565; 15326, SEC14L2, 76776, 179226, 212-1201; 15326, SEC14L2, 76768, 179218, 73-1035; 15326, SEC14L2, 76769, 179219, 81-1259; 15326, SEC14L2, 76775, 179225, 261-1472; 15327, SEC14L3, 76780, 179230, 285-1346; 15327, SEC14L3, 76781, 179231, 1-693; 15327, SEC14L3, 76782, 179232, 29-184; 15327, SEC14L3, 76777, 179227, 92-1294; 15327, SEC14L3, 76778, 179228, 254-1279; 15327, SEC14L3, 76779, 179229, 478-1449; 15327, SEC14L3, 76783, 179233, 351-1322; 15328, SEC14L4, 76785, 179235, 101-217; 15328, SEC14L4, 76786, 179236, 101-382; 15328, SEC14L4, 76784, 179234, 85-1305; 15328, SEC14L4, 76787, 179237, 40-1122; 15329, SEC14L5, 76789, 179239, 70-576; 15329, SEC14L5, 76788, 179238, 181-2271; 15330, SEC14L6, 76791, 179241, 1-367; 15330, SEC14L6, 76790, 179240, 1-1194; 15331, SEC16A, 76792, 179242, 1-2256; 15331, SEC16A, 76793, 179243, 320-7324; 15331, SEC16A, 76794, 179244, 264-1421; 15331, SEC16A, 76795, 179245, 75-7148; 15331, SEC16A, 76798, 179248, 1-3180; 15331, SEC16A, 76796, 179246, 35-6439; 15331, SEC16A, 76797, 179247, 1-6465; 15332, SEC16B, 76800, 179250, 83-1960; 15332, SEC16B, 76801, 179251, 1-525; 15332, SEC16B, 76802, 179252, 157-1107; 15332, SEC16B, 76799, 179249, 91-3273; 15333, SEC22A, 76804, 179254, 78-293; 15333, SEC22A, 76805, 179255, 179-482; 15333, SEC22A, 76807, 179257, 247-572; 15333, SEC22A, 76808, 179258, 217-870; 15333, SEC22A, 76809, 179259, 38-337; 15333, SEC22A, 76810, 179260, 146-1011; 15333, SEC22A, 76811, 179261, 136-550; 15333, SEC22A, 76803, 179253, 897-1820; 15333, SEC22A, 76806, 179256, 49-972; 15334, SEC22B, 76813, 179263, 1-240; 15334, SEC22B, 76812, 179262, 135-782; 15335, SEC22C, 76816, 179266, 134-352; 15335, SEC22C, 76817, 179267, 145-576; 15335, SEC22C, 76818, 179268, 163-872; 15335, SEC22C, 76819, 179269, 206-527; 15335, SEC22C, 76820, 179270, 294-721; 15335, SEC22C, 76821, 179271, 170-388; 15335, SEC22C, 76823, 179273, 328-553; 15335, SEC22C, 76824, 179274, 133-318; 15335, SEC22C, 76826, 179276, 1-676; 15335, SEC22C, 76814, 179264, 145-1056; 15335, SEC22C, 76815, 179265, 211-963; 15335, SEC22C, 76822, 179272, 149-901; 15335, SEC22C, 76825, 179275, 125-811; 15336, SEC23A, 76829, 179279, 226-2436; 15336, SEC23A, 76830, 179280, 203-529; 15336, SEC23A, 76831, 179281, 82-588; 15336, SEC23A, 76832, 179282, 150-571; 15336, SEC23A, 76833, 179283, 234-494; 15336, SEC23A, 76834, 179284, 267-547; 15336, SEC23A, 76835, 179285, 456-575; 15336, SEC23A, 76836, 179286, 224-481; 15336, SEC23A, 76837, 179287, 1-261; 15336, SEC23A, 76827, 179277, 519-2816; 15336, SEC23A, 76828, 179278, 1204-2895; 15337, SEC23B, 76842, 179292, 192-1184; 15337, SEC23B, 76843, 179293, 1-741; 15337, SEC23B, 76838, 179288, 491-2794; 15337, SEC23B, 76839, 179289, 433-2736; 15337, SEC23B, 76840, 179290, 251-2554; 15337, SEC23B, 76841, 179291, 427-2730; 15338, SEC23IP, 76845, 179295, 1-582; 15338, SEC23IP, 76846, 179296, 1-460; 15338, SEC23IP, 76847, 179297, 1-1461; 15338, SEC23IP, 76844, 179294, 73-3075; 15339, SEC24A, 76850, 179300, 1-452; 15339, SEC24A, 76848, 179298, 254-2095; 15339, SEC24A, 76849, 179299, 289-3570; 15340, SEC24B, 76851, 179301, 56-3862; 15340, SEC24B, 76852, 179302, 58-3759; 15340, SEC24B, 76853, 179303, 99-3995; 15341, SEC24C, 76856, 179306, 83-3211; 15341, SEC24C, 76857, 179307, 1-549; 15341, SEC24C, 76858, 179308, 67-609; 15341, SEC24C, 76854, 179304, 83-3367; 15341, SEC24C, 76855, 179305, 163-3447; 15342, SEC24D, 76860, 179310, 1605-2786; 15342, SEC24D, 76861, 179311, 159-362; 15342, SEC24D, 76862, 179312, 161-796; 15342, SEC24D, 76863, 179313, 144-2135; 15342, SEC24D, 76864, 179314, 106-602; 15342, SEC24D, 76865, 179315, 172-1089; 15342, SEC24D, 76859, 179309, 240-3338; 15343, SEC31A, 76866, 179316, 486-3395; 15343, SEC31A, 76873, 179323, 123-401; 15343, SEC31A, 76875, 179325, 2-3757; 15343, SEC31A, 76876, 179326, 1-857; 15343, SEC31A, 76877, 179327, 1-1151; 15343, SEC31A, 76878, 179328, 310-553; 15343, SEC31A, 76879, 179329, 158-364; 15343, SEC31A, 76880, 179330, 1-710; 15343, SEC31A, 76883, 179333, 1-706; 15343, SEC31A, 76884, 179334, 462-541; 15343, SEC31A, 76885, 179335, 372-569; 15343, SEC31A, 76886, 179336, 1-657; 15343, SEC31A, 76887, 179337, 350-847; 15343, SEC31A, 76888, 179338, 71-2704; 15343, SEC31A, 76889, 179339, 1-1329; 15343, SEC31A, 76892, 179342, 1-544; 15343, SEC31A, 76893, 179343, 329-822; 15343, SEC31A, 76894, 179344, 357-551; 15343, SEC31A, 76895, 179345, 424-458; 15343, SEC31A, 76867, 179317, 177-3497; 15343, SEC31A, 76868, 179318, 54-3599; 15343, SEC31A, 76869, 179319, 379-4041; 15343, SEC31A, 76870, 179320, 184-3846; 15343, SEC31A, 76871, 179321, 181-3843; 15343, SEC31A, 76872, 179322, 28-3630; 15343, SEC31A, 76874, 179324, 5-3208; 15343, SEC31A, 76881, 179331, 66-3566; 15343, SEC31A, 76882, 179332, 121-3738; 15343, SEC31A, 76890, 179340, 129-3449; 15343, SEC31A, 76891, 179341, 71-3274; 15344, SEC31B, 76897, 179347, 146-403; 15344, SEC31B, 76898, 179348, 44-1093; 15344, SEC31B, 76899, 179349, 129-386; 15344, SEC31B, 76900, 179350, 124-381; 15344, SEC31B, 76896, 179346, 99-3638; 15344, SEC31B, 76901, 179351, 66-1112; 15345, SEC61A1, 76904, 179354, 246-1694; 15345, SEC61A1, 76905, 179355, 219-521; 15345, SEC61A1, 76902, 179352, 185-1615; 15345, SEC61A1, 76903, 179353, 153-1223; 15346, SEC61A2, 76908, 179358, 56-562; 15346, SEC61A2, 76909, 179359, 62-1294; 15346, SEC61A2, 76911, 179361, 152-631; 15346, SEC61A2, 76912, 179362, 1-434; 15346, SEC61A2, 76913, 179363, 1-284; 15346, SEC61A2, 76914, 179364, 1-685; 15346, SEC61A2, 76915, 179365, 123-691; 15346, SEC61A2, 76916, 179366, 87-575; 15346, SEC61A2, 76917, 179367, 95-1351; 15346, SEC61A2, 76906, 179356, 90-1520; 15346, SEC61A2, 76907, 179357, 88-1401; 15346, SEC61A2, 76910, 179360, 148-1512; 15347, SEC61B, 76919, 179369, 268-396; 15347, SEC61B, 76918, 179368, 64-354; 15348, SEC61G, 76920, 179370, 96-302; 15348, SEC61G, 76921, 179371, 92-298; 15348, SEC61G, 76922, 179372, 368-574; 15348, SEC61G, 76923, 179373, 152-358; 15349, SEC62, 76925, 179375, 9-314; 15349, SEC62, 76926, 179376, 23-280; 15349, SEC62, 76927, 179377, 10-153; 15349, SEC62, 76924, 179374, 59-1258; 15349, SEC62, 76928, 179378, 16-1215; 15350, SEC63, 76930, 179380, 164-647; 15350, SEC63, 76931, 179381, 103-345; 15350, SEC63, 76929, 179379, 181-2463; 15351, SCRN1, 76934, 179384, 91-513; 15351, SCRN1, 76936, 179386, 137-560; 15351, SCRN1, 76938, 179388, 265-1001; 15351, SCRN1, 76940, 179390, 1-423; 15351, SCRN1, 76932, 179382, 159-1403; 15351, SCRN1, 76933, 179383, 205-1449; 15351, SCRN1, 76935, 179385, 50-1354; 15351, SCRN1, 76937, 179387, 178-1422; 15351, SCRN1, 76939, 179389, 117-1157; 15352, SCRN2, 76943, 179393, 59-352; 15352, SCRN2, 76944, 179394, 8-391; 15352, SCRN2, 76945, 179395, 307-1608; 15352, SCRN2, 76946, 179396, 1-808; 15352, SCRN2, 76947, 179397, 84-624; 15352, SCRN2, 76948, 179398, 262-555; 15352, SCRN2, 76949, 179399, 41-856; 15352, SCRN2, 76941, 179391, 127-1404; 15352, SCRN2, 76942, 179392, 83-1219; 15353, SCRN3, 76952, 179402, 552-582; 15353, SCRN3, 76953, 179403, 156-804; 15353, SCRN3, 76954, 179404, 98-451; 15353, SCRN3, 76955, 179405, 208-548; 15353, SCRN3, 76956, 179406, 434-839; 15353, SCRN3, 76957, 179407, 90-718; 15353, SCRN3, 76958, 179408, 98-451; 15353, SCRN3, 76959, 179409, 50-1339; 15353, SCRN3, 76950, 179400, 83-1357; 15353, SCRN3, 76951, 179401, 13-1266; 15354, SECISBP2, 76962, 179412, 367-547; 15354, SECISBP2, 76963, 179413, 1-826; 15354, SECISBP2, 76960, 179410, 157-2502; 15354, SECISBP2, 76961, 179411, 72-2636; 15354, SECISBP2, 76964, 179414, 386-2746; 15355, SECISBP2L, 76966, 179416, 660-2551; 15355, SECISBP2L, 76967, 179417, 149-1084; 15355, SECISBP2L, 76969, 179419, 1-287; 15355, SECISBP2L, 76965, 179415, 135-3305; 15355, SECISBP2L, 76968, 179418, 265-3570; 15356, SCGN, 76970, 179420, 1-150; 15356, SCGN, 76972, 179422, 204-353; 15356, SCGN, 76971, 179421, 169-999; 15357, SECTM1, 76974, 179424, 328-583; 15357, SECTM1, 76975, 179425, 117-556; 15357, SECTM1, 76976, 179426, 306-841; 15357, SECTM1, 76977, 179427, 128-637; 15357, SECTM1, 76978, 179428, 116-565; 15357, SECTM1, 76979, 179429, 102-233; 15357, SECTM1, 76980, 179430, 430-561; 15357, SECTM1, 76973, 179423, 352-1098; 15358, SFRP1, 76982, 179432, 134-670; 15358, SFRP1, 76981, 179431, 339-1283; 15359, SFRP2, 76983, 179433, 286-1173; 15360, SFRP4, 76984, 179434, 439-849; 15360, SFRP4, 76985, 179435, 379-1419; 15361, SFRP5, 76986, 179436, 120-1073; 15362, SLURP1, 76987, 179437, 27-338; 15363, SPP1, 76991, 179441, 102-825; 15363, SPP1, 76988, 179438, 149-1051; 15363, SPP1, 76989, 179439, 102-965; 15363, SPP1, 76990, 179440, 128-1072; 15363, SPP1, 76992, 179442, 166-1044; 15364, SPP2, 76995, 179445, 116-508; 15364, SPP2, 76993, 179443, 89-724; 15364, SPP2, 76994, 179444, 109-744; 15365, SPARC, 76997, 179447, 258-602; 15365, SPARC, 76998, 179448, 339-497; 15365, SPARC, 76999, 179449, 128-576; 15365, SPARC, 77000, 179450, 179-511; 15365, SPARC, 76996, 179446, 315-1226; 15366, SCT, 77001, 179451, 1-366; 15366, SCT, 77002, 179452, 1-366; 15367, SCTR, 77004, 179454, 471-920; 15367, SCTR, 77005, 179455, 42-770; 15367, SCTR, 77003, 179453, 269-1591; 15368, SAR1A, 77006, 179456, 1-366; 15368, SAR1A, 77008, 179458, 317-468; 15368, SAR1A, 77011, 179461, 1-346; 15368, SAR1A, 77007, 179457, 359-955; 15368, SAR1A, 77009, 179459, 128-724; 15368, SAR1A, 77010, 179460, 198-794; 15368, SAR1A, 77012, 179462, 1-597; 15369, SAR1B, 77015, 179465, 240-548; 15369, SAR1B, 77016, 179466, 151-506; 15369, SAR1B, 77017, 179467, 62-454; 15369, SAR1B, 77018, 179468, 1374-1766; 15369, SAR1B, 77019, 179469, 19-453; 15369, SAR1B, 77020, 179470, 161-670; 15369, SAR1B, 77021, 179471, 104-496; 15369, SAR1B, 77013, 179463, 280-876; 15369, SAR1B, 77014, 179464, 185-781; 15370, SERGEF, 77023, 179473, 386-910; 15370, SERGEF, 77024, 179474, 331-507; 15370, SERGEF, 77025, 179475, 1-381; 15370, SERGEF, 77026, 179476, 1-135; 15370, SERGEF, 77027, 179477, 357-572; 15370, SERGEF, 77028, 179478, 3-125; 15370, SERGEF, 77030, 179480, 27-1091; 15370, SERGEF, 77031, 179481, 1-433; 15370, SERGEF, 77032, 179482, 422-833; 15370, SERGEF, 77033, 179483, 400-893; 15370, SERGEF, 77034, 179484, 1-898; 15370, SERGEF, 77035, 179485, 1-318; 15370, SERGEF, 77036, 179486, 711-1396; 15370, SERGEF, 77022, 179472, 153-1529; 15370, SERGEF, 77029, 179479, 19-885; 15371, SCGB1A1, 77038, 179488, 192-362; 15371, SCGB1A1, 77037, 179487, 62-337; 15372, SCGB1C1, 77039, 179489, 21-308; 15373, SCGB1C2, 77040, 179490, 66-353; 15373, SCGB1C2, 77041, 179491, 66-353; 15374, SCGB1D1, 77042, 179492, 70-342; 15375, SCGB1D2, 77043, 179493, 99-371; 15376, SCGB1D4, 77044, 179494, 55-306; 15377, SCGB2A1, 77045, 179495, 65-352; 15378, SCGB2A2, 77047, 179497, 60-422; 15378, SCGB2A2, 77046, 179496, 63-344; 15379, SCGB2B2, 77048, 179498, 23-313; 15379, SCGB2B2, 77049, 179499, 2102-2392; 15380, SCGB3A1, 77050, 179500, 79-393; 15381, SCGB3A2, 77052, 179502, 154-300; 15381, SCGB3A2, 77051, 179501, 94-375; 15382, SCG2, 77054, 179504, 158-589; 15382, SCG2, 77055, 179505, 168-544; 15382, SCG2, 77053, 179503, 234-2087; 15383, SCG3, 77058, 179508, 725-896; 15383, SCG3, 77056, 179506, 404-1810; 15383, SCG3, 77057, 179507, 908-1618; 15384, SCG5, 77061, 179511, 88-669; 15384, SCG5, 77062, 179512, 1-651; 15384, SCG5, 77063, 179513, 85-669; 15384, SCG5, 77064, 179514, 118-756; 15384, SCG5, 77065, 179515, 1-651; 15384, SCG5, 77066, 179516, 111-749; 15384, SCG5, 77067, 179517, 111-746; 15384, SCG5, 77068, 179518, 85-669; 15384, SCG5, 77069, 179519, 88-669; 15384, SCG5, 77059, 179509, 111-749; 15384, SCG5, 77060, 179510, 111-746; 15385, SCAMP1, 77071, 179521, 352-477; 15385, SCAMP1, 77072, 179522, 1-619; 15385, SCAMP1, 77073, 179523, 62-1000; 15385, SCAMP1, 77075, 179525, 201-559; 15385, SCAMP1, 77070, 179520, 62-535; 15385, SCAMP1, 77074, 179524, 90-1106; 15386, SCAMP2, 77077, 179527, 511-790; 15386, SCAMP2, 77078, 179528, 48-758; 15386, SCAMP2, 77079, 179529, 1-837; 15386, SCAMP2, 77080, 179530, 101-274; 15386, SCAMP2, 77081, 179531, 104-866; 15386, SCAMP2, 77082, 179532, 56-638; 15386, SCAMP2, 77076, 179526, 111-1100; 15387, SCAMP3, 77083, 179533, 109-1152; 15387, SCAMP3, 77084, 179534, 280-1245; 15387, SCAMP3, 77085, 179535, 280-1245; 15387, SCAMP3, 77086, 179536, 109-1152; 15388, SCAMP4, 77089, 179539, 414-783; 15388, SCAMP4, 77090, 179540, 400-570; 15388, SCAMP4, 77091, 179541, 481-547; 15388, SCAMP4, 77093, 179543, 188-609; 15388, SCAMP4, 77094, 179544, 91-198; 15388, SCAMP4, 77087, 179537, 268-957; 15388, SCAMP4, 77088, 179538, 78-665; 15388, SCAMP4, 77092, 179542, 66-755; 15389, SCAMP5, 77097, 179547, 126-632; 15389, SCAMP5, 77098, 179548, 276-561; 15389, SCAMP5, 77099, 179549, 218-588; 15389, SCAMP5, 77100, 179550, 72-516; 15389, SCAMP5, 77101, 179551, 34-171; 15389, SCAMP5, 77103, 179553, 150-287; 15389, SCAMP5, 77104, 179554, 231-579; 15389, SCAMP5, 77105, 179555, 308-600; 15389, SCAMP5, 77106, 179556, 347-554; 15389, SCAMP5, 77107, 179557, 418-557; 15389, SCAMP5, 77108, 179558, 298-435; 15389, SCAMP5, 77109, 179559, 175-312; 15389, SCAMP5, 77095, 179545, 208-915; 15389, SCAMP5, 77096, 179546, 191-898; 15389, SCAMP5, 77102, 179552, 159-890; 15390, SLPI, 77110, 179560, 22-420; 15391, SHPK, 77111, 179561, 104-1540; 15392, SEH1L, 77114, 179564, 75-863; 15392, SEH1L, 77115, 179565, 109-582; 15392, SEH1L, 77116, 179566, 87-655; 15392, SEH1L, 77117, 179567, 556-787; 15392, SEH1L, 77112, 179562, 128-1210; 15392, SEH1L, 77113, 179563, 102-1367; 15393, SEZ6, 77119, 179569, 180-3164; 15393, SEZ6, 77121, 179571, 45-2987; 15393, SEZ6, 77122, 179572, 1-2760; 15393, SEZ6, 77123, 179573, 1-304; 15393, SEZ6, 77124, 179574, 1-1364; 15393, SEZ6, 77125, 179575, 1-395; 15393, SEZ6, 77126, 179576, 406-575; 15393, SEZ6, 77118, 179568, 430-3414;

15393, SEZ6, 77120, 179570, 277-3258; 15394, SEZ6L, 77130, 179580, 743-3133; 15394, SEZ6L, 77132, 179582, 743-2905; 15394, SEZ6L, 77133, 179583, 197-3232; 15394, SEZ6L, 77127, 179577, 96-3170; 15394, SEZ6L, 77128, 179578, 13-2859; 15394, SEZ6L, 77129, 179579, 157-3006; 15394, SEZ6L, 77131, 179581, 197-3268; 15394, SEZ6L, 77134, 179584, 96-3137; 15395, SEZ6L2, 77139, 179589, 1-909; 15395, SEZ6L2, 77140, 179590, 91-332; 15395, SEZ6L2, 77141, 179591, 246-3017; 15395, SEZ6L2, 77135, 179585, 72-2633; 15395, SEZ6L2, 77136, 179586, 529-3261; 15395, SEZ6L2, 77137, 179587, 46-2475; 15395, SEZ6L2, 77138, 179588, 246-2885; 15396, SZT2, 77143, 179593, 6-512; 15396, SZT2, 77145, 179595, 1-10299; 15396, SZT2, 77142, 179592, 88-624; 15396, SZT2, 77144, 179594, 1-10128; 15397, SEL1L, 77148, 179598, 106-594; 15397, SEL1L, 77146, 179596, 118-2502; 15397, SEL1L, 77147, 179597, 90-995; 15398, SEL1L2, 77151, 179601, 79-615; 15398, SEL1L2, 77152, 179602, 1-134; 15398, SEL1L2, 77153, 179603, 403-535; 15398, SEL1L2, 77149, 179599, 76-2142; 15398, SEL1L2, 77150, 179600, 83-1810; 15399, SEL1L3, 77156, 179606, 452-558; 15399, SEL1L3, 77157, 179607, 420-605; 15399, SEL1L3, 77158, 179608, 1-392; 15399, SEL1L3, 77159, 179609, 329-553; 15399, SEL1L3, 77160, 179610, 1-234; 15399, SEL1L3, 77162, 179612, 1-393; 15399, SEL1L3, 77154, 179604, 84-3377; 15399, SEL1L3, 77155, 179605, 124-3522; 15399, SEL1L3, 77161, 179611, 402-3341; 15400, SELF, 77164, 179614, 49-1503; 15400, SELF, 77165, 179615, 48-1505; 15400, SELF, 77166, 179616, 49-1692; 15400, SELF, 77167, 179617, 49-1692; 15400, SELF, 77168, 179618, 525-560; 15400, SELF, 77163, 179613, 141-1973; 15401, SELL, 77169, 179619, 162-1319; 15402, SELP, 77171, 179621, 3-2309; 15402, SELP, 77172, 179622, 120-2426; 15402, SELP, 77173, 179623, 13-1345; 15402, SELP, 77174, 179624, 1-2370; 15402, SELP, 77175, 179625, 4-1944; 15402, SELP, 77170, 179620, 39-2531; 15403, SELPLG, 77177, 179627, 24-1232; 15403, SELPLG, 77176, 179626, 178-1464; 15403, SELPLG, 77178, 179628, 226-1464; 15404, SELENBP1, 77180, 179630, 65-208; 15404, SELENBP1, 77181, 179631, 51-422; 15404, SELENBP1, 77182, 179632, 1-916; 15404, SELENBP1, 77184, 179634, 136-377; 15404, SELENBP1, 77185, 179635, 67-438; 15404, SELENBP1, 77186, 179636, 43-929; 15404, SELENBP1, 77187, 179637, 67-438; 15404, SELENBP1, 77189, 179639, 135-632; 15404, SELENBP1, 77179, 179629, 93-1511; 15404, SELENBP1, 77183, 179633, 146-1690; 15404, SELENBP1, 77188, 179638, 60-1292; 15405, SCLY, 77190, 179640, 143-1504; 15405, SCLY, 77192, 179642, 36-257; 15405, SCLY, 77193, 179643, 13-228; 15405, SCLY, 77194, 179644, 1-368; 15405, SCLY, 77195, 179645, 1-506; 15405, SCLY, 77196, 179646, 1-754; 15405, SCLY, 77197, 179647, 1-456; 15405, SCLY, 77198, 179648, 1-179; 15405, SCLY, 77199, 179649, 1-330; 15405, SCLY, 77200, 179650, 1-726; 15405, SCLY, 77201, 179651, 31-542; 15405, SCLY, 77202, 179652, 1-585; 15405, SCLY, 77191, 179641, 25-978; 15406, SEPHS1, 77205, 179655, 109-383; 15406, SEPHS1, 77206, 179656, 161-660; 15406, SEPHS1, 77203, 179653, 360-1325; 15406, SEPHS1, 77204, 179654, 377-1555; 15406, SEPHS1, 77207, 179657, 308-1285; 15407, SEPHS2, 77208, 179658, 455-1801; 15408, N/A, 77209, 179659, 78-296; 15408, N/A, 77210, 179660, 201-485; 15408, N/A, 77211, 179661, 175-456; 15409, N/A, 77212, 179662, 64-501; 15409, N/A, 77213, 179663, 419-856; 15409, N/A, 77214, 179664, 64-498; 15410, SEPN1, 77215, 179665, 56-1726; 15410, SEPN1, 77218, 179668, 293-493; 15410, SEPN1, 77216, 179666, 56-1828; 15410, SEPN1, 77217, 179667, 39-1709; 15411, N/A, 77219, 179669, 59-2068; 15411, N/A, 77220, 179670, 59-2065; 15412, SEPP1, 77222, 179672, 116-1047; 15412, SEPP1, 77224, 179674, 160-787; 15412, SEPP1, 77226, 179676, 71-586; 15412, SEPP1, 77221, 179671, 258-1403; 15412, SEPP1, 77223, 179673, 470-1615; 15412, SEPP1, 77225, 179675, 100-1245; 15413, N/A, 77227, 179677, 36-173; 15413, N/A, 77228, 179678, 168-581; 15413, N/A, 77229, 179679, 467-880; 15413, N/A, 77230, 179680, 76-663; 15413, N/A, 77231, 179681, 389-802; 15413, N/A, 77232, 179682, 85-672; 15414, N/A, 77233, 179683, 101-1141; 15414, N/A, 77234, 179684, 101-1138; 15414, N/A, 77235, 179685, 1-221; 15414, N/A, 77236, 179686, 101-1141; 15415, SEPW1, 77237, 179687, 202-468; 15415, SEPW1, 77238, 179688, 86-343; 15415, SEPW1, 77242, 179692, 202-462; 15415, SEPW1, 77239, 179689, 86-349; 15415, SEPW1, 77240, 179690, 110-373; 15415, SEPW1, 77241, 179691, 215-478; 15416, SEMA3A, 77244, 179694, 107-553; 15416, SEMA3A, 77245, 179695, 423-534; 15416, SEMA3A, 77246, 179696, 511-568; 15416, SEMA3A, 77243, 179693, 316-2631; 15416, SEMA3A, 77247, 179697, 165-2480; 15417, SEMA3B, 77248, 179698, 28-2292; 15417, SEMA3B, 77250, 179700, 293-934; 15417, SEMA3B, 77252, 179702, 57-1430; 15417, SEMA3B, 77253, 179703, 375-1595; 15417, SEMA3B, 77255, 179705, 542-1762; 15417, SEMA3B, 77249, 179699, 243-2492; 15417, SEMA3B, 77251, 179701, 236-2485; 15417, SEMA3B, 77254, 179704, 73-2319; 15418, SEMA3C, 77257, 179707, 395-517; 15418, SEMA3C, 77258, 179708, 168-359; 15418, SEMA3C, 77259, 179709, 395-586; 15418, SEMA3C, 77256, 179706, 563-2818; 15418, SEMA3C, 77260, 179710, 134-2389; 15419, SEMA3D, 77262, 179712, 351-1235; 15419, SEMA3D, 77261, 179711, 45-2378; 15420, SEMA3E, 77265, 179715, 137-626; 15420, SEMA3E, 77266, 179716, 269-388; 15420, SEMA3E, 77263, 179713, 469-2796; 15420, SEMA3E, 77264, 179714, 166-2313; 15421, SEMA3F, 77268, 179718, 193-2253; 15421, SEMA3F, 77269, 179719, 144-936; 15421, SEMA3F, 77270, 179720, 555-1693; 15421, SEMA3F, 77271, 179721, 482-757; 15421, SEMA3F, 77273, 179723, 1-442; 15421, SEMA3F, 77267, 179717, 485-2842; 15421, SEMA3F, 77272, 179722, 319-2583; 15422, SEMA3G, 77275, 179725, 59-616; 15422, SEMA3G, 77276, 179726, 1-299; 15422, SEMA3G, 77274, 179724, 1-2349; 15423, SEMA4A, 77281, 179731, 218-2389; 15423, SEMA4A, 77282, 179732, 188-897; 15423, SEMA4A, 77283, 179733, 315-975; 15423, SEMA4A, 77284, 179734, 95-1057; 15423, SEMA4A, 77285, 179735, 232-531; 15423, SEMA4A, 77277, 179727, 105-2390; 15423, SEMA4A, 77278, 179728, 209-2494; 15423, SEMA4A, 77279, 179729, 346-2235; 15423, SEMA4A, 77280, 179730, 268-2553; 15424, SEMA4B, 77286, 179736, 241-2754; 15424, SEMA4B, 77287, 179737, 261-2774; 15424, SEMA4B, 77288, 179738, 240-395; 15424, SEMA4B, 77289, 179739, 219-559; 15424, SEMA4B, 77290, 179740, 159-350; 15424, SEMA4B, 77291, 179741, 221-585; 15424, SEMA4B, 77292, 179742, 261-533; 15424, SEMA4B, 77293, 179743, 1-1384; 15424, SEMA4B, 77294, 179744, 1-758; 15424, SEMA4B, 77295, 179745, 238-582; 15424, SEMA4B, 77296, 179746, 1-362; 15425, SEMA4C, 77298, 179748, 421-839; 15425, SEMA4C, 77299, 179749, 214-817; 15425, SEMA4C, 77297, 179747, 134-2635; 15426, SEMA4D, 77303, 179753, 469-907; 15426, SEMA4D, 77305, 179755, 692-2338; 15426, SEMA4D, 77306, 179756, 665-1036; 15426, SEMA4D, 77308, 179758, 91-93; 15426, SEMA4D, 77310, 179760, 376-602; 15426, SEMA4D, 77312, 179762, 386-

563; 15426, SEMA4D, 77313, 179763, 629-826; 15426, SEMA4D, 77314, 179764, 767-2413; 15426, SEMA4D, 77300, 179750, 427-2643; 15426, SEMA4D, 77301, 179751, 448-3036; 15426, SEMA4D, 77302, 179752, 481-3069; 15426, SEMA4D, 77304, 179754, 448-2664; 15426, SEMA4D, 77307, 179757, 767-3355; 15426, SEMA4D, 77309, 179759, 585-2801; 15426, SEMA4D, 77311, 179761, 778-3366; 15427, SEMA4F, 77317, 179767, 67-273; 15427, SEMA4F, 77318, 179768, 85-578; 15427, SEMA4F, 77319, 179769, 67-602; 15427, SEMA4F, 77320, 179770, 101-250; 15427, SEMA4F, 77321, 179771, 16-399; 15427, SEMA4F, 77322, 179772, 126-608; 15427, SEMA4F, 77323, 179773, 150-2363; 15427, SEMA4F, 77315, 179765, 98-1945; 15427, SEMA4F, 77316, 179766, 150-2462; 15428, SEMA4G, 77326, 179776, 459-2024; 15428, SEMA4G, 77327, 179777, 1-393; 15428, SEMA4G, 77328, 179778, 85-596; 15428, SEMA4G, 77331, 179781, 68-451; 15428, SEMA4G, 77324, 179774, 79-2610; 15428, SEMA4G, 77325, 179775, 374-2890; 15428, SEMA4G, 77329, 179779, 202-2310; 15428, SEMA4G, 77330, 179780, 787-3303; 15429, SEMA5A, 77333, 179783, 173-935; 15429, SEMA5A, 77332, 179782, 667-3891; 15430, SEMA5B, 77334, 179784, 400-3573; 15430, SEMA5B, 77336, 179786, 528-3791; 15430, SEMA5B, 77338, 179788, 1-593; 15430, SEMA5B, 77339, 179789, 307-558; 15430, SEMA5B, 77340, 179790, 290-716; 15430, SEMA5B, 77341, 179791, 198-3482; 15430, SEMA5B, 77335, 179785, 388-3843; 15430, SEMA5B, 77337, 179787, 12-3629; 15430, SEMA5B, 77342, 179792, 528-3983; 15431, SEMA6A, 77343, 179793, 250-3393; 15431, SEMA6A, 77345, 179795, 85-563; 15431, SEMA6A, 77346, 179796, 1-1637; 15431, SEMA6A, 77347, 179797, 1788-3161; 15431, SEMA6A, 77349, 179799, 300-1529; 15431, SEMA6A, 77350, 179800, 197-538; 15431, SEMA6A, 77344, 179794, 789-3881; 15431, SEMA6A, 77348, 179798, 200-3292; 15432, SEMA6B, 77351, 179801, 1-2034; 15432, SEMA6B, 77352, 179802, 312-2978; 15433, SEMA6C, 77357, 179807, 337-1950; 15433, SEMA6C, 77358, 179808, 77-1690; 15433, SEMA6C, 77353, 179803, 1693-4485; 15433, SEMA6C, 77354, 179804, 130-2898; 15433, SEMA6C, 77355, 179805, 130-3018; 15433, SEMA6C, 77356, 179806, 301-3093; 15434, SEMA6D, 77368, 179818, 480-545; 15434, SEMA6D, 77369, 179819, 152-155; 15434, SEMA6D, 77370, 179820, 1-163; 15434, SEMA6D, 77371, 179821, 145-588; 15434, SEMA6D, 77373, 179823, 1-592; 15434, SEMA6D, 77374, 179824, 77-734; 15434, SEMA6D, 77359, 179809, 440-3661; 15434, SEMA6D, 77360, 179810, 440-3493; 15434, SEMA6D, 77361, 179811, 440-2233; 15434, SEMA6D, 77362, 179812, 440-3475; 15434, SEMA6D, 77363, 179813, 468-1898; 15434, SEMA6D, 77364, 179814, 440-3436; 15434, SEMA6D, 77365, 179815, 242-3277; 15434, SEMA6D, 77366, 179816, 385-3606; 15434, SEMA6D, 77367, 179817, 557-3592; 15434, SEMA6D, 77372, 179822, 291-2084; 15435, SEMA7A, 77377, 179827, 389-1894; 15435, SEMA7A, 77378, 179828, 433-674; 15435, SEMA7A, 77375, 179825, 550-2550; 15435, SEMA7A, 77376, 179826, 38-1996; 15436, SEMG1, 77379, 179829, 58-1446; 15437, SEMG2, 77380, 179830, 91-1839; 15438, SETX, 77382, 179832, 1-2847; 15438, SETX, 77381, 179831, 184-8217; 15439, SENP3-EIF4A1, 77383, 179833, 1-1623; 15440, SNTN, 77385, 179835, 3-350; 15440, SNTN, 77386, 179836, 10-508; 15440, SNTN, 77384, 179834, 21-464; 15441, SEPSECS, 77387, 179837, 26-364; 15441, SEPSECS, 77390, 179840, 30-561; 15441, SEPSECS, 77391, 179841, 1-286; 15441, SEPSECS, 77388, 179838, 74-1579; 15441, SEPSECS, 77389, 179839, 63-206; 15442, SPR, 77392, 179842, 74-859; 15443, SEPT1, 77393, 179843, 47-1291; 15443, SEPT1, 77394, 179844, 10-150; 15443, SEPT1, 77395, 179845, 6-218; 15444, SEPT10, 77396, 179846, 317-1951; 15444, SEPT10, 77399, 179849, 100-272; 15444, SEPT10, 77400, 179850, 9-1361; 15444, SEPT10, 77401, 179851, 95-241; 15444, SEPT10, 77402, 179852, 233-1654; 15444, SEPT10, 77403, 179853, 397-581; 15444, SEPT10, 77404, 179854, 267-557; 15444, SEPT10, 77405, 179855, 503-581; 15444, SEPT10, 77406, 179856, 288-583; 15444, SEPT10, 77407, 179857, 267-383; 15444, SEPT10, 77397, 179847, 380-1744; 15444, SEPT10, 77398, 179848, 101-1396; 15445, SEPT11, 77409, 179859, 755-1870; 15445, SEPT11, 77410, 179860, 202-610; 15445, SEPT11, 77412, 179862, 1-482; 15445, SEPT11, 77413, 179863, 1-249; 15445, SEPT11, 77414, 179864, 96-1394; 15445, SEPT11, 77415, 179865, 171-548; 15445, SEPT11, 77416, 179866, 154-1431; 15445, SEPT11, 77408, 179858, 202-1491; 15445, SEPT11, 77411, 179861, 258-1577; 15446, SEPT12, 77419, 179869, 1-55; 15446, SEPT12, 77420, 179870, 91-927; 15446, SEPT12, 77421, 179871, 361-554; 15446, SEPT12, 77422, 179872, 96-269; 15446, SEPT12, 77417, 179867, 265-1341; 15446, SEPT12, 77418, 179868, 90-1028; 15447, SEPT14, 77423, 179873, 118-1416; 15448, SEPT2, 77427, 179877, 212-1177; 15448, SEPT2, 77430, 179880, 368-650; 15448, SEPT2, 77431, 179881, 494-644; 15448, SEPT2, 77432, 179882, 80-599; 15448, SEPT2, 77433, 179883, 121-561; 15448, SEPT2, 77434, 179884, 453-1005; 15448, SEPT2, 77435, 179885, 100-342; 15448, SEPT2, 77436, 179886, 196-558; 15448, SEPT2, 77437, 179887, 165-480; 15448, SEPT2, 77438, 179888, 1-88; 15448, SEPT2, 77439, 179889, 156-380; 15448, SEPT2, 77440, 179890, 657-724; 15448, SEPT2, 77441, 179891, 359-575; 15448, SEPT2, 77442, 179892, 331-775; 15448, SEPT2, 77443, 179893, 1-567; 15448, SEPT2, 77444, 179894, 1-484; 15448, SEPT2, 77445, 179895, 384-539; 15448, SEPT2, 77446, 179896, 182-574; 15448, SEPT2, 77447, 179897, 158-372; 15448, SEPT2, 77424, 179874, 441-1526; 15448, SEPT2, 77425, 179875, 140-1225; 15448, SEPT2, 77426, 179876, 529-1614; 15448, SEPT2, 77428, 179878, 447-1562; 15448, SEPT2, 77429, 179879, 158-1243; 15448, SEPT2, 77448, 179898, 169-1359; 15449, SEPT3, 77452, 179902, 221-1105; 15449, SEPT3, 77453, 179903, 342-876; 15449, SEPT3, 77449, 179899, 16-267; 15449, SEPT3, 77450, 179900, 132-1184; 15449, SEPT3, 77451, 179901, 256-1332; 15450, SEPT4, 77460, 179910, 140-307; 15450, SEPT4, 77461, 179911, 103-213; 15450, SEPT4, 77462, 179912, 130-1269; 15450, SEPT4, 77463, 179913, 113-789; 15450, SEPT4, 77464, 179914, 104-724; 15450, SEPT4, 77466, 179916, 460-676; 15450, SEPT4, 77467, 179917, 106-1104; 15450, SEPT4, 77468, 179918, 92-619; 15450, SEPT4, 77454, 179904, 84-1463; 15450, SEPT4, 77455, 179905, 178-1614; 15450, SEPT4, 77456, 179906, 1-1380; 15450, SEPT4, 77457, 179907, 146-1627; 15450, SEPT4, 77458, 179908, 88-912; 15450, SEPT4, 77459, 179909, 118-1530; 15450, SEPT4, 77465, 179915, 538-1533; 15451, SEPT5, 77469, 179919, 307-1443; 15451, SEPT5, 77470, 179920, 255-794; 15451, SEPT5, 77471, 179921, 86-1099; 15451, SEPT5, 77472, 179922, 61-807; 15451, SEPT5, 77474, 179924, 1519-2655; 15451, SEPT5, 77476, 179926, 191-1159; 15451, SEPT5, 77477, 179927, 1-318; 15451, SEPT5, 77478, 179928, 205-1108; 15451, SEPT5, 77479, 179929, 9-920; 15451, SEPT5, 77480, 179930, 126-662; 15451, SEPT5, 77473, 179923, 126-1235; 15451, SEPT5, 77475, 179925, 281-1321; 15452, SEPT6, 77483, 179933, 266-1561; 15452, SEPT6, 77481, 179931, 266-1570; 15452, SEPT6, 77482, 179932, 266-1555; 15452, SEPT6, 77484, 179934, 266-1549; 15452, SEPT6, 77485, 179935, 266-1549; 15452, SEPT6, 77486, 179936, 266-1549; 15452, SEPT6, 77487, 179937, 266-1069; 15453, SEPT7, 77488, 179938, 225-1538; 15453, SEPT7, 77490, 179940, 1-1254; 15453, SEPT7, 77491, 179941, 172-1377; 15453, SEPT7, 77492, 179942, 84-350; 15453, SEPT7, 77493, 179943, 279-506; 15453, SEPT7, 77494, 179944, 1-141; 15453, SEPT7, 77495, 179945, 279-509; 15453, SEPT7, 77496, 179946, 290-760; 15453, SEPT7, 77497, 179947, 143-583; 15453, SEPT7, 77498, 179948, 1-333; 15453, SEPT7, 77489, 179939, 433-1587; 15454, SEPT8, 77500, 179950, 327-562; 15454, SEPT8, 77502, 179952, 125-1447; 15454, SEPT8, 77503, 179953, 208-1500; 15454, SEPT8, 77505, 179955, 102-1484; 15454, SEPT8, 77508, 179958, 383-773; 15454, SEPT8, 77509, 179959, 403-693; 15454, SEPT8, 77510, 179960, 239-1519; 15454, SEPT8, 77499, 179949, 285-1574; 15454, SEPT8, 77501, 179951, 502-1611; 15454, SEPT8, 77504, 179954, 239-1690; 15454, SEPT8, 77506, 179956, 84-1412; 15454, SEPT8, 77507, 179957, 345-1454; 15455, SEPT9, 77519, 179969, 253-879; 15455, SEPT9, 77520, 179970, 167-569; 15455, SEPT9, 77521, 179971, 208-582; 15455, SEPT9, 77522, 179972, 164-749; 15455, SEPT9, 77524, 179974, 45-116; 15455, SEPT9, 77525, 179975, 191-817; 15455, SEPT9, 77526, 179976, 133-565; 15455, SEPT9, 77527, 179977, 193-670; 15455, SEPT9, 77528, 179978, 279-601; 15455, SEPT9, 77529, 179979, 205-611; 15455, SEPT9, 77531, 179981, 267-580; 15455, SEPT9, 77533, 179983, 100-234; 15455, SEPT9, 77534, 179984, 97-552; 15455, SEPT9, 77535, 179985, 456-1025; 15455, SEPT9, 77536, 179986, 317-490; 15455, SEPT9, 77537, 179987, 411-906; 15455, SEPT9, 77538, 179988, 406-752; 15455, SEPT9, 77539, 179989, 112-582; 15455, SEPT9, 77540, 179990, 177-449; 15455, SEPT9, 77541, 179991, 115-569; 15455, SEPT9, 77543, 179993, 450-554; 15455, SEPT9, 77545, 179995, 174-555; 15455, SEPT9, 77546, 179996, 100-553; 15455, SEPT9, 77548, 179998, 208-238; 15455, SEPT9, 77549, 179999, 127-145; 15455, SEPT9, 77550, 180000, 100-234; 15455, SEPT9, 77551, 180001, 86-104; 15455, SEPT9, 77511, 179961, 813-2519; 15455, SEPT9, 77512, 179962, 127-1887; 15455, SEPT9, 77513, 179963, 794-2062; 15455, SEPT9, 77514, 179964, 733-2001; 15455, SEPT9, 77515, 179965, 309-2048; 15455, SEPT9, 77516, 179966, 798-2066; 15455, SEPT9, 77517, 179967, 277-1701; 15455, SEPT9, 77518, 179968, 83-1090; 15455, SEPT9, 77523, 179973, 813-2519; 15455, SEPT9, 77530, 179980, 318-1325; 15455, SEPT9, 77532, 179982, 404-1411; 15455, SEPT9, 77542, 179992, 16-1104; 15455, SEPT9, 77544, 179994, 86-1789; 15455, SEPT9, 77547, 179997, 478-1746; 15456, SQSTM1, 77554, 180004, 208-628; 15456, SQSTM1, 77555, 180005, 33-254; 15456, SQSTM1, 77556, 180006, 60-269; 15456, SQSTM1, 77557, 180007, 17-1153; 15456, SQSTM1, 77558, 180008, 33-602; 15456, SQSTM1, 77559, 180009, 341-842; 15456, SQSTM1, 77560, 180010, 53-274; 15456, SQSTM1, 77552, 180002, 521-1591; 15456, SQSTM1, 77553, 180003, 179-1501; 15457, SRGN, 77561, 180011, 41-517; 15458, SERAC1, 77564, 180014, 1-489; 15458, SERAC1, 77565, 180015, 109-237; 15458, SERAC1, 77567, 180017, 34-1263; 15458, SERAC1, 77568, 180018, 1269-1397; 15458, SERAC1, 77562, 180012, 122-1717; 15458, SERAC1, 77563, 180013, 133-2097; 15458, SERAC1, 77566, 180016, 936-1439; 15459, SCPEP1, 77571, 180021, 32-241; 15459, SCPEP1, 77572, 180022, 30-473; 15459, SCPEP1, 77573, 180023, 27-555; 15459, SCPEP1, 77574, 180024, 1-407; 15459, SCPEP1, 77575, 180025, 286-572; 15459, SCPEP1, 77576, 180026, 1-444; 15459, SCPEP1, 77569, 180019, 56-1414; 15459, SCPEP1, 77570, 180020, 13-903; 15460, SDS, 77578, 180028, 30-736; 15460, SDS, 77579, 180029, 122-412; 15460, SDS, 77577, 180027, 124-1110; 15461, SDSL, 77582, 180032, 457-544; 15461, SDSL, 77583, 180033, 74-589; 15461, SDSL, 77584, 180034, 1-183; 15461, SDSL, 77585, 180035, 1-677; 15461, SDSL, 77580, 180030, 211-1200; 15461, SDSL, 77581, 180031, 263-1252; 15462, SERHL2, 77588, 180038, 160-771; 15462, SERHL2, 77590, 180040, 265-563; 15462, SERHL2, 77591, 180041, 104-499; 15462, SERHL2, 77592, 180042, 163-792; 15462, SERHL2, 77586, 180036, 103-1047; 15462, SERHL2, 77587, 180037, 1-753; 15462, SERHL2, 77589, 180039, 7-411; 15463, SHMT1, 77596, 180046, 330-332; 15463, SHMT1, 77597, 180047, 144-530; 15463, SHMT1, 77598, 180048, 379-879; 15463, SHMT1, 77599, 180049, 1-378; 15463, SHMT1, 77593, 180043, 100-1434; 15463, SHMT1, 77594, 180044, 136-1587; 15463, SHMT1, 77595, 180045, 510-1547; 15464, SHMT2, 77603, 180053, 117-542; 15464, SHMT2, 77604, 180054, 1-793; 15464, SHMT2, 77605, 180055, 245-403; 15464, SHMT2, 77606, 180056, 21-536; 15464, SHMT2, 77607, 180057, 100-579; 15464, SHMT2, 77608, 180058, 173-370; 15464, SHMT2, 77609, 180059, 262-964; 15464, SHMT2, 77610, 180060, 207-467; 15464, SHMT2, 77611, 180061, 308-886; 15464, SHMT2, 77612, 180062, 131-572; 15464, SHMT2, 77613, 180063, 31-291; 15464, SHMT2, 77614, 180064, 338-535; 15464, SHMT2, 77615, 180065, 152-600; 15464, SHMT2, 77616, 180066, 56-768; 15464, SHMT2, 77617, 180067, 93-569; 15464, SHMT2, 77618, 180068, 121-562; 15464, SHMT2, 77619, 180069, 100-678; 15464, SHMT2, 77621, 180071, 84-281; 15464, SHMT2, 77622, 180072, 134-780; 15464, SHMT2, 77600, 180050, 453-1967; 15464, SHMT2, 77601, 180051, 190-1641; 15464, SHMT2, 77602, 180052, 332-1783; 15464, SHMT2, 77620, 180070, 69-1553; 15464, SHMT2, 77623, 180073, 124-1575; 15465, SERINC1, 77624, 180074, 86-1447; 15466, SERINC2, 77625, 180075, 151-1518; 15466, SERINC2, 77626, 180076, 274-1668; 15466, SERINC2, 77627, 180077, 202-1581; 15466, SERINC2, 77628, 180078, 212-1591; 15467, SERINC3, 77631, 180081, 1-639; 15467, SERINC3, 77629, 180079, 135-1556; 15467, SERINC3, 77630, 180080, 159-1580; 15468, SERINC4, 77632, 180082, 147-1427; 15468, SERINC4, 77634, 180084, 1-710; 15468, SERINC4, 77635, 180085, 112-402; 15468, SERINC4, 77636, 180086, 1-269; 15468, SERINC4, 77633, 180083, 236-1792; 15469, SERINC5, 77637, 180087, 93-1343; 15469, SERINC5, 77641, 180091, 98-1468; 15469, SERINC5, 77638, 180088, 98-1351; 15469, SERINC5, 77639, 180089, 98-1360; 15469, SERINC5, 77640, 180090, 158-1543; 15470, SPTLC1, 77642, 180092, 7-1428; 15470, SPTLC1, 77643, 180093, 14-445; 15471, SPTLC2, 77645, 180095, 1-123; 15471, SPTLC2, 77646, 180096, 1-1222; 15471, SPTLC2, 77644, 180094, 195-1883; 15472, SPTLC3, 77648, 180098, 154-572; 15472, SPTLC3, 77649, 180099, 1-645; 15472, SPTLC3, 77650, 180100, 1-365; 15472, SPTLC3, 77647, 180097, 275-1933; 15473, SPTSSA, 77651, 180101, 150-365; 15474, SPTSSB, 77655, 180105, 89-781; 15474, SPTSSB, 77652, 180102, 1572-1802; 15474, SPTSSB, 77653, 180103, 332-562; 15474, SPTSSB, 77654, 180104, 1-231; 15475, SPINK1, 77657, 180107, 59-256; 15475, SPINK1, 77656, 180106, 210-449; 15476, SPINK13, 77658, 180108, 63-347; 15476, SPINK13, 77659, 180109, 532-816; 15476, SPINK13, 77660, 180110, 335-499; 15477, SPINK14, 77662, 180112, 1-144; 15477, SPINK14, 77661, 180111, 1-294; 15478, SPINK2, 77664, 180114, 33-392; 15478, SPINK2, 77665, 180115, 81-485; 15478, SPINK2, 77666, 180116, 81-485; 15478, SPINK2, 77667, 180117, 81-347;

15478, SPINK2, 77668, 180118, 81-392; 15478, SPINK2, 77663, 180113, 81-335; 15479, SPINK4, 77670, 180120, 123-452; 15479, SPINK4, 77669, 180119, 46-306; 15480, SPINK5, 77674, 180124, 66-2674; 15480, SPINK5, 77675, 180125, 66-671; 15480, SPINK5, 77676, 180126, 287-492; 15480, SPINK5, 77671, 180121, 43-3237; 15480, SPINK5, 77672, 180122, 74-3358; 15480, SPINK5, 77673, 180123, 74-2824; 15481, SPINK6, 77678, 180128, 177-300; 15481, SPINK6, 77677, 180127, 257-499; 15481, SPINK6, 77679, 180129, 177-419; 15482, SPINK7, 77681, 180131, 18-197; 15482, SPINK7, 77680, 180130, 62-319; 15483, SPINK8, 77682, 180132, 1-294; 15484, SPINK9, 77684, 180134, 271-594; 15484, SPINK9, 77683, 180133, 56-316; 15485, SPINT1, 77686, 180136, 1-883; 15485, SPINT1, 77687, 180137, 1-611; 15485, SPINT1, 77688, 180138, 1-720; 15485, SPINT1, 77689, 180139, 1-940; 15485, SPINT1, 77691, 180141, 168-1072; 15485, SPINT1, 77692, 180142, 1-1417; 15485, SPINT1, 77685, 180135, 235-1824; 15485, SPINT1, 77690, 180140, 235-1776; 15486, SPINT4, 77693, 180143, 18-317; 15487, SPINT2, 77696, 180146, 145-301; 15487, SPINT2, 77697, 180147, 354-540; 15487, SPINT2, 77698, 180148, 226-749; 15487, SPINT2, 77699, 180149, 193-801; 15487, SPINT2, 77700, 180150, 1-319; 15487, SPINT2, 77701, 180151, 1-392; 15487, SPINT2, 77694, 180144, 436-1194; 15487, SPINT2, 77695, 180145, 318-905; 15488, SPINT3, 77702, 180152, 17-286; 15489, SRR, 77704, 180154, 100-298; 15489, SRR, 77705, 180155, 287-586; 15489, SRR, 77706, 180156, 73-522; 15489, SRR, 77707, 180157, 344-577; 15489, SRR, 77708, 180158, 184-382; 15489, SRR, 77709, 180159, 287-566; 15489, SRR, 77710, 180160, 153-497; 15489, SRR, 77703, 180153, 319-1341; 15490, STK39, 77711, 180161, 707-2344; 15491, SRRM1, 77713, 180163, 29-2770; 15491, SRRM1, 77714, 180164, 6-2468; 15491, SRRM1, 77715, 180165, 259-563; 15491, SRRM1, 77716, 180166, 271-2314; 15491, SRRM1, 77717, 180167, 40-279; 15491, SRRM1, 77712, 180162, 316-3030; 15492, SRRM2, 77719, 180169, 235-579; 15492, SRRM2, 77720, 180170, 186-2870; 15492, SRRM2, 77721, 180171, 180-461; 15492, SRRM2, 77722, 180172, 256-1146; 15492, SRRM2, 77723, 180173, 1-126; 15492, SRRM2, 77724, 180174, 1-553; 15492, SRRM2, 77725, 180175, 261-3314; 15492, SRRM2, 77726, 180176, 1-235; 15492, SRRM2, 77727, 180177, 43-798; 15492, SRRM2, 77718, 180168, 550-8808; 15492, SRRM2, 77728, 180178, 219-1154; 15493, SRRM3, 77729, 180179, 208-2169; 15493, SRRM3, 77730, 180180, 1-330; 15494, SRRM4, 77731, 180181, 389-2224; 15495, SRRM5, 77732, 180182, 16-2163; 15495, SRRM5, 77733, 180183, 323-2470; 15496, SRSF1, 77736, 180186, 1-431; 15496, SRSF1, 77737, 180187, 137-358; 15496, SRSF1, 77738, 180188, 125-886; 15496, SRSF1, 77740, 180190, 125-322; 15496, SRSF1, 77734, 180184, 210-956; 15496, SRSF1, 77735, 180185, 125-730; 15496, SRSF1, 77739, 180189, 96-701; 15497, SRSF10, 77744, 180194, 40-558; 15497, SRSF10, 77748, 180198, 17-226; 15497, SRSF10, 77749, 180199, 77-199; 15497, SRSF10, 77741, 180191, 77-628; 15497, SRSF10, 77742, 180192, 73-858; 15497, SRSF10, 77743, 180193, 54-575; 15497, SRSF10, 77745, 180195, 42-590; 15497, SRSF10, 77746, 180196, 102-599; 15497, SRSF10, 77747, 180197, 65-853; 15498, SRSF11, 77750, 180200, 564-1838; 15498, SRSF11, 77753, 180203, 242-1408; 15498, SRSF11, 77754, 180204, 169-411; 15498, SRSF11, 77755, 180205, 54-440; 15498, SRSF11, 77751, 180201, 83-1537; 15498, SRSF11, 77752, 180202, 122-1573; 15499, SRSF12, 77757, 180207, 89-214; 15499, SRSF12, 77758, 180208, 119-247; 15499, SRSF12, 77756, 180206, 195-980; 15500, SRSF2, 77759, 180209, 172-572; 15500, SRSF2, 77765, 180215, 172-561; 15500, SRSF2, 77760, 180210, 215-880; 15500, SRSF2, 77761, 180211, 174-839; 15500, SRSF2, 77762, 180212, 172-837; 15500, SRSF2, 77763, 180213, 172-801; 15500, SRSF2, 77764, 180214, 149-814; 15501, SRSF3, 77769, 180219, 132-419; 15501, SRSF3, 77766, 180216, 117-611; 15501, SRSF3, 77767, 180217, 94-468; 15501, SRSF3, 77768, 180218, 167-661; 15502, SRSF4, 77771, 180221, 139-621; 15502, SRSF4, 77772, 180222, 131-1264; 15502, SRSF4, 77773, 180223, 1-136; 15502, SRSF4, 77770, 180220, 236-1720; 15503, SRSF5, 77775, 180225, 68-484; 15503, SRSF5, 77778, 180228, 68-442; 15503, SRSF5, 77780, 180230, 164-463; 15503, SRSF5, 77781, 180231, 164-578; 15503, SRSF5, 77782, 180232, 90-506; 15503, SRSF5, 77774, 180224, 308-1126; 15503, SRSF5, 77776, 180226, 152-970; 15503, SRSF5, 77777, 180227, 115-924; 15503, SRSF5, 77779, 180229, 1454-2272; 15504, SRSF6, 77783, 180233, 107-1141; 15504, SRSF6, 77784, 180234, 107-514; 15505, SRSF7, 77786, 180236, 103-810; 15505, SRSF7, 77787, 180237, 1-331; 15505, SRSF7, 77789, 180239, 160-573; 15505, SRSF7, 77790, 180240, 1-213; 15505, SRSF7, 77793, 180243, 540-695; 15505, SRSF7, 77794, 180244, 108-521; 15505, SRSF7, 77785, 180235, 239-955; 15505, SRSF7, 77788, 180238, 27-425; 15505, SRSF7, 77791, 180241, 239-919; 15505, SRSF7, 77792, 180242, 97-495; 15506, SRSF8, 77795, 180245, 31-879; 15507, SRSF9, 77797, 180247, 1-327; 15507, SRSF9, 77798, 180248, 31-390; 15507, SRSF9, 77796, 180246, 185-850; 15508, STK10, 77800, 180250, 1-845; 15508, STK10, 77799, 180249, 345-3251; 15509, STK11, 77802, 180252, 99-404; 15509, STK11, 77803, 180253, 961-2259; 15509, STK11, 77804, 180254, 46-505; 15509, STK11, 77805, 180255, 682-746; 15509, STK11, 77801, 180251, 451-1752; 15510, STK11IP, 77807, 180257, 91-3357; 15510, STK11IP, 77808, 180258, 27-359; 15510, STK11IP, 77809, 180259, 1-598; 15510, STK11IP, 77810, 180260, 1-500; 15510, STK11IP, 77811, 180261, 1-290; 15510, STK11IP, 77806, 180256, 44-3343; 15511, STK16, 77813, 180263, 145-708; 15511, STK16, 77814, 180264, 105-926; 15511, STK16, 77816, 180266, 109-1161; 15511, STK16, 77812, 180262, 423-1340; 15511, STK16, 77815, 180265, 173-1090; 15512, STK17A, 77817, 180267, 180-1424; 15513, STK17B, 77820, 180270, 306-507; 15513, STK17B, 77821, 180271, 548-567; 15513, STK17B, 77822, 180272, 1-210; 15513, STK17B, 77818, 180268, 288-1406; 15513, STK17B, 77819, 180269, 323-1441; 15514, STK19, 77826, 180276, 129-1223; 15514, STK19, 77835, 180285, 238-575; 15514, STK19, 77836, 180286, 1-211; 15514, STK19, 77837, 180287, 1-211; 15514, STK19, 77838, 180288, 1-211; 15514, STK19, 77839, 180289, 443-1408; 15514, STK19, 77840, 180290, 443-1408; 15514, STK19, 77841, 180291, 443-1408; 15514, STK19, 77842, 180292, 443-1408; 15514, STK19, 77843, 180293, 443-1408; 15514, STK19, 77844, 180294, 1-211; 15514, STK19, 77845, 180295, 1-204; 15514, STK19, 77823, 180273, 167-1261; 15514, STK19, 77824, 180274, 54-1160; 15514, STK19, 77825, 180275, 54-1160; 15514, STK19, 77827, 180277, 129-1223; 15514, STK19, 77828, 180278, 54-1160; 15514, STK19, 77829, 180279, 129-1223; 15514, STK19, 77830, 180280, 129-1223; 15514, STK19, 77831, 180281, 54-1160; 15514, STK19, 77832, 180282, 129-1223; 15514, STK19, 77833, 180283, 54-1160; 15514, STK19, 77834, 180284, 54-1160; 15515, STK24, 77847, 180297, 1-630; 15515, STK24, 77848, 180298, 366-1604; 15515, STK24, 77849, 180299, 1-1108; 15515, STK24, 77850, 180300, 1-429; 15515, STK24, 77846, 180296, 147-1478; 15515, STK24, 77851, 180301, 78-1373; 15516, STK25, 77857, 180307, 357-801; 15516, STK25, 77858, 180308, 352-882; 15516, STK25, 77859, 180309, 425-570; 15516, STK25, 77860, 180310, 435-923; 15516, STK25, 77861, 180311, 761-935; 15516, STK25, 77862, 180312, 1-743; 15516, STK25, 77863, 180313, 129-395; 15516, STK25, 77864, 180314, 344-580; 15516, STK25, 77865, 180315, 722-779; 15516, STK25, 77866, 180316, 146-600; 15516, STK25, 77867, 180317, 230-575; 15516, STK25, 77868, 180318, 299-781; 15516, STK25, 77852, 180302, 351-1631; 15516, STK25, 77853, 180303, 285-1565; 15516, STK25, 77854, 180304, 215-1264; 15516, STK25, 77855, 180305, 181-1230; 15516, STK25, 77856, 180306, 328-1608; 15516, STK25, 77869, 180319, 603-1601; 15516, STK25, 77870, 180320, 506-1504; 15517, STK3, 77872, 180322, 132-817; 15517, STK3, 77873, 180323, 127-633; 15517, STK3, 77874, 180324, 30-32; 15517, STK3, 77875, 180325, 107-355; 15517, STK3, 77877, 180327, 132-1274; 15517, STK3, 77871, 180321, 142-1617; 15517, STK3, 77876, 180326, 401-1960; 15518, STK31, 77880, 180330, 93-570; 15518, STK31, 77881, 180331, 381-661; 15518, STK31, 77883, 180333, 153-573; 15518, STK31, 77884, 180334, 436-563; 15518, STK31, 77878, 180328, 465-3455; 15518, STK31, 77879, 180329, 120-3179; 15518, STK31, 77882, 180332, 12-3002; 15519, STK32A, 77886, 180336, 172-1395; 15519, STK32A, 77885, 180335, 334-1524; 15519, STK32A, 77887, 180337, 191-691; 15520, STK32B, 77890, 180340, 269-424; 15520, STK32B, 77891, 180341, 348-1361; 15520, STK32B, 77888, 180338, 423-1667; 15520, STK32B, 77889, 180339, 233-1336; 15521, STK32C, 77893, 180343, 96-536; 15521, STK32C, 77894, 180344, 112-830; 15521, STK32C, 77896, 180346, 102-410; 15521, STK32C, 77892, 180342, 108-1568; 15521, STK32C, 77895, 180345, 383-1492; 15522, STK33, 77898, 180348, 369-1352; 15522, STK33, 77900, 180350, 300-946; 15522, STK33, 77901, 180351, 568-758; 15522, STK33, 77902, 180352, 450-562; 15522, STK33, 77903, 180353, 196-709; 15522, STK33, 77904, 180354, 194-767; 15522, STK33, 77905, 180355, 1-612; 15522, STK33, 77907, 180357, 496-582; 15522, STK33, 77908, 180358, 151-1572; 15522, STK33, 77909, 180359, 1-635; 15522, STK33, 77897, 180347, 524-2068; 15522, STK33, 77899, 180349, 375-1919; 15522, STK33, 77906, 180356, 920-2464; 15523, STK35, 77911, 180361, 1-1188; 15523, STK35, 77910, 180360, 272-1876; 15524, STK36, 77915, 180365, 357-583; 15524, STK36, 77916, 180366, 43-878; 15524, STK36, 77917, 180367, 1-445; 15524, STK36, 77918, 180368, 1-320; 15524, STK36, 77919, 180369, 1-199; 15524, STK36, 77912, 180362, 280-4227; 15524, STK36, 77913, 180363, 237-4121; 15524, STK36, 77914, 180364, 160-4107; 15525, STK38, 77920, 180370, 287-1684; 15526, STK38L, 77922, 180372, 1-269; 15526, STK38L, 77923, 180373, 153-545; 15526, STK38L, 77924, 180374, 112-752; 15526, STK38L, 77925, 180375, 134-526; 15526, STK38L, 77926, 180376, 156-548; 15526, STK38L, 77927, 180377, 37-207; 15526, STK38L, 77928, 180378, 181-463; 15526, STK38L, 77929, 180379, 1-264; 15526, STK38L, 77930, 180380, 90-284; 15526, STK38L, 77921, 180371, 170-1564; 15527, STK4, 77933, 180383, 91-1389; 15527, STK4, 77934, 180384, 258-722; 15527, STK4, 77935, 180385, 17-211; 15527, STK4, 77931, 180381, 48-1436; 15527, STK4, 77932, 180382, 96-1559; 15528, STK40, 77936, 180386, 9-1262; 15528, STK40, 77937, 180387, 408-1715; 15528, STK40, 77938, 180388, 175-1497; 15528, STK40, 77939, 180389, 183-1490; 15529, STRAP, 77942, 180392, 324-464; 15529, STRAP, 77943, 180393, 1-286; 15529, STRAP, 77940, 180390, 315-1406; 15529, STRAP, 77941, 180391, 314-1366; 15530, STKLD1, 77945, 180395, 108-2150; 15530, STKLD1, 77944, 180394, 108-2150; 15531, STK26, 77946, 180396, 217-1395; 15531, STK26, 77949, 180399, 217-1533; 15531, STK26, 77947, 180397, 254-1504; 15531, STK26, 77948, 180398, 214-1233; 15531, STK26, 77950, 180400, 11-1075; 15532, STYX, 77951, 180401, 294-965; 15532, STYX, 77952, 180402, 48-719; 15533, STYXL1, 77958, 180408, 1-205; 15533, STYXL1, 77959, 180409, 1-205; 15533, STYXL1, 77960, 180410, 1-663; 15533, STYXL1, 77961, 180411, 171-1019; 15533, STYXL1, 77953, 180403, 344-1285; 15533, STYXL1, 77954, 180404, 174-827; 15533, STYXL1, 77955, 180405, 307-1248; 15533, STYXL1, 77956, 180406, 344-997; 15533, STYXL1, 77957, 180407, 147-1088; 15534, STYK1, 77963, 180413, 1-249; 15534, STYK1, 77964, 180414, 325-520; 15534, STYK1, 77965, 180415, 422-543; 15534, STYK1, 77966, 180416, 338-586; 15534, STYK1, 77967, 180417, 321-582; 15534, STYK1, 77962, 180412, 522-1790; 15535, SERTM1, 77968, 180418, 447-770; 15536, SSMEM1, 77969, 180419, 52-786; 15537, SDCCAG3, 77972, 180422, 197-865; 15537, SDCCAG3, 77974, 180424, 1-503; 15537, SDCCAG3, 77975, 180425, 134-459; 15537, SDCCAG3, 77970, 180420, 213-1451; 15537, SDCCAG3, 77971, 180421, 131-1438; 15537, SDCCAG3, 77973, 180423, 204-1292; 15538, SDCCAG8, 77977, 180427, 1-1245; 15538, SDCCAG8, 77978, 180428, 1-467; 15538, SDCCAG8, 77980, 180430, 153-1730; 15538, SDCCAG8, 77981, 180431, 1-1230; 15538, SDCCAG8, 77982, 180432, 187-1893; 15538, SDCCAG8, 77976, 180426, 119-2260; 15538, SDCCAG8, 77979, 180429, 119-2260; 15539, SERPINA1, 77992, 180442, 130-446; 15539, SERPINA1, 77993, 180443, 221-571; 15539, SERPINA1, 77995, 180445, 517-583; 15539, SERPINA1, 77996, 180446, 175-643; 15539, SERPINA1, 77997, 180447, 518-951; 15539, SERPINA1, 77998, 180448, 304-581; 15539, SERPINA1, 77999, 180449, 382-1638; 15539, SERPINA1, 78000, 180450, 574-1830; 15539, SERPINA1, 78001, 180451, 278-1534; 15539, SERPINA1, 78002, 180452, 303-1559; 15539, SERPINA1, 78003, 180453, 186-1442; 15539, SERPINA1, 78004, 180454, 221-571; 15539, SERPINA1, 78005, 180455, 312-1568; 15539, SERPINA1, 78006, 180456, 304-581; 15539, SERPINA1, 78007, 180457, 518-951; 15539, SERPINA1, 78008, 180458, 35-1114; 15539, SERPINA1, 78009, 180459, 556-1812; 15539, SERPINA1, 78010, 180460, 175-643; 15539, SERPINA1, 78011, 180461, 517-583; 15539, SERPINA1, 78012, 180462, 266-1522; 15539, SERPINA1, 77983, 180433, 278-1534; 15539, SERPINA1, 77984, 180434, 266-1522; 15539, SERPINA1, 77985, 180435, 556-1812; 15539, SERPINA1, 77986, 180436, 312-1568; 15539, SERPINA1, 77987, 180437, 35-1114; 15539, SERPINA1, 77988, 180438, 186-1442; 15539, SERPINA1, 77989, 180439, 382-1638; 15539, SERPINA1, 77990, 180440, 574-1830; 15539, SERPINA1, 77991, 180441, 303-1559; 15539, SERPINA1, 77994, 180444, 10-930; 15540, SERPINA10, 78015, 180465, 420-1874; 15540, SERPINA10, 78017, 180467, 420-1874; 15540, SERPINA10, 78013, 180463, 134-1468; 15540, SERPINA10, 78014, 180464, 467-1801; 15540, SERPINA10, 78016, 180466, 56-1390; 15540, SERPINA10, 78018, 180468, 134-1468; 15541, SERPINA11, 78019, 180469, 66-1334; 15542, SERPINA12, 78020, 180470, 797-2041; 15542, SERPINA12, 78021, 180471, 224-1468; 15543, SERPINA2, 78022, 180472, 144-1409; 15543, SERPINA2, 78023, 180473, 1-1266; 15543, SERPINA2, 78024, 180474, 1-931; 15543, SERPINA2, 78025, 180475, 1-195; 15544, SERPINA3, 78028, 180478, 1565-2182; 15544, SERPINA3, 78029, 180479, 65-981; 15544,

SERPINA3, 78031, 180481, 1-140; 15544, SERPINA3, 78026, 180476, 69-1340; 15544, SERPINA3, 78027, 180477, 1149-2420; 15544, SERPINA3, 78030, 180480, 52-702; 15545, N/A, 78032, 180482, 80-1351; 15545, N/A, 78033, 180483, 1-137; 15546, SERPINA4, 78034, 180484, 226-1509; 15546, SERPINA4, 78035, 180485, 422-1705; 15546, SERPINA4, 78036, 180486, 386-1669; 15547, SERPINA5, 78038, 180488, 71-586; 15547, SERPINA5, 78039, 180489, 137-607; 15547, SERPINA5, 78040, 180490, 136-829; 15547, SERPINA5, 78043, 180493, 303-574; 15547, SERPINA5, 78044, 180494, 390-462; 15547, SERPINA5, 78046, 180496, 186-618; 15547, SERPINA5, 78047, 180497, 276-533; 15547, SERPINA5, 78048, 180498, 211-1113; 15547, SERPINA5, 78037, 180487, 236-1456; 15547, SERPINA5, 78041, 180491, 294-1514; 15547, SERPINA5, 78042, 180492, 115-1335; 15547, SERPINA5, 78045, 180495, 114-1334; 15548, SERPINA6, 78050, 180500, 73-909; 15548, SERPINA6, 78051, 180501, 311-719; 15548, SERPINA6, 78053, 180503, 73-909; 15548, SERPINA6, 78054, 180504, 311-719; 15548, SERPINA6, 78049, 180499, 148-1365; 15548, SERPINA6, 78052, 180502, 148-1365; 15549, SERPINA7, 78055, 180505, 337-1584; 15549, SERPINA7, 78056, 180506, 59-1306; 15550, SERPINA9, 78057, 180507, 40-1047; 15550, SERPINA9, 78058, 180508, 76-1383; 15550, SERPINA9, 78059, 180509, 80-1333; 15550, SERPINA9, 78060, 180510, 226-1086; 15550, SERPINA9, 78061, 180511, 131-1144; 15550, SERPINA9, 78062, 180512, 80-685; 15550, SERPINA9, 78063, 180513, 80-1084; 15551, SERPINB1, 78064, 180514, 204-1343; 15552, SERPINB10, 78066, 180516, 1-840; 15552, SERPINB10, 78067, 180517, 1-759; 15552, SERPINB10, 78065, 180515, 60-1253; 15552, SERPINB10, 78068, 180518, 1-1194; 15553, SERPINB11, 78070, 180520, 174-1352; 15553, SERPINB11, 78071, 180521, 63-470; 15553, SERPINB11, 78072, 180522, 700-1242; 15553, SERPINB11, 78073, 180523, 1-573; 15553, SERPINB11, 78074, 180524, 1-918; 15553, SERPINB11, 78069, 180519, 246-1424; 15554, SERPINB12, 78075, 180525, 1-1218; 15554, SERPINB12, 78076, 180526, 1-1278; 15555, SERPINB13, 78077, 180527, 169-1371; 15555, SERPINB13, 78079, 180529, 106-580; 15555, SERPINB13, 78080, 180530, 1-375; 15555, SERPINB13, 78081, 180531, 40-537; 15555, SERPINB13, 78078, 180528, 103-1278; 15556, SERPINB2, 78083, 180533, 377-717; 15556, SERPINB2, 78084, 180534, 354-751; 15556, SERPINB2, 78086, 180536, 280-762; 15556, SERPINB2, 78082, 180532, 81-1328; 15556, SERPINB2, 78085, 180535, 334-1581; 15557, SERPINB3, 78089, 180539, 1-1173; 15557, SERPINB3, 78087, 180537, 145-1317; 15557, SERPINB3, 78088, 180538, 66-1082; 15558, SERPINB4, 78091, 180541, 1-1115; 15558, SERPINB4, 78092, 180542, 75-709; 15558, SERPINB4, 78090, 180540, 117-1289; 15559, SERPINB5, 78094, 180544, 174-560; 15559, SERPINB5, 78093, 180543, 293-1420; 15559, SERPINB5, 78095, 180545, 96-791; 15560, SERPINB6, 78102, 180552, 767-1909; 15560, SERPINB6, 78103, 180553, 245-1432; 15560, SERPINB6, 78096, 180546, 335-1465; 15560, SERPINB6, 78097, 180547, 1996-3126; 15560, SERPINB6, 78098, 180548, 226-1356; 15560, SERPINB6, 78099, 180549, 101-1231; 15560, SERPINB6, 78100, 180550, 69-1199; 15560, SERPINB6, 78101, 180551, 106-1236; 15561, SERPINB7, 78106, 180556, 177-560; 15561, SERPINB7, 78107, 180557, 205-587; 15561, SERPINB7, 78108, 180558, 68-561; 15561, SERPINB7, 78104, 180554, 93-1235; 15561, SERPINB7, 78105, 180555, 326-1468; 15561, SERPINB7, 78109, 180559, 361-1452; 15561, SERPINB7, 78110, 180560, 68-1210; 15562, SERPINB8, 78111, 180561, 1-569; 15562, SERPINB8, 78115, 180565, 72-564; 15562, SERPINB8, 78116, 180566, 209-580; 15562, SERPINB8, 78118, 180568, 1-130; 15562, SERPINB8, 78112, 180562, 170-1294; 15562, SERPINB8, 78113, 180563, 257-1381; 15562, SERPINB8, 78114, 180564, 63-791; 15562, SERPINB8, 78117, 180567, 521-1099; 15563, SERPINB9, 78119, 180569, 91-1221; 15564, SERPINC1, 78121, 180571, 120-899; 15564, SERPINC1, 78120, 180570, 120-1514; 15565, SERPIND1, 78122, 180572, 284-1783; 15565, SERPIND1, 78123, 180573, 133-1632; 15566, SERPINE1, 78124, 180574, 158-1366; 15567, SERPINE2, 78128, 180578, 455-581; 15567, SERPINE2, 78129, 180579, 287-546; 15567, SERPINE2, 78130, 180580, 162-988; 15567, SERPINE2, 78125, 180575, 244-1440; 15567, SERPINE2, 78126, 180576, 213-1406; 15567, SERPINE2, 78127, 180577, 662-1855; 15567, SERPINE2, 78131, 180581, 302-1531; 15568, SERPINE3, 78132, 180582, 214-356; 15568, SERPINE3, 78133, 180583, 61-1335; 15568, SERPINE3, 78134, 180584, 626-1840; 15568, SERPINE3, 78135, 180585, 4-1218; 15569, SERPINF1, 78137, 180587, 276-573; 15569, SERPINF1, 78138, 180588, 55-399; 15569, SERPINF1, 78139, 180589, 64-459; 15569, SERPINF1, 78140, 180590, 397-731; 15569, SERPINF1, 78141, 180591, 171-431; 15569, SERPINF1, 78142, 180592, 524-795; 15569, SERPINF1, 78143, 180593, 316-729; 15569, SERPINF1, 78144, 180594, 94-478; 15569, SERPINF1, 78145, 180595, 397-480; 15569, SERPINF1, 78146, 180596, 164-247; 15569, SERPINF1, 78147, 180597, 126-254; 15569, SERPINF1, 78148, 180598, 64-147; 15569, SERPINF1, 78136, 180586, 164-1420; 15570, SERPINF2, 78151, 180601, 45-838; 15570, SERPINF2, 78152, 180602, 78-842; 15570, SERPINF2, 78156, 180606, 71-1354; 15570, SERPINF2, 78157, 180607, 45-838; 15570, SERPINF2, 78158, 180608, 78-842; 15570, SERPINF2, 78149, 180599, 78-1553; 15570, SERPINF2, 78150, 180600, 56-1531; 15570, SERPINF2, 78153, 180603, 71-1354; 15570, SERPINF2, 78154, 180604, 78-1553; 15570, SERPINF2, 78155, 180605, 56-1531; 15571, SERPING1, 78160, 180610, 63-1454; 15571, SERPING1, 78163, 180613, 367-1998; 15571, SERPING1, 78164, 180614, 168-648; 15571, SERPING1, 78165, 180615, 203-569; 15571, SERPING1, 78166, 180616, 1-261; 15571, SERPING1, 78167, 180617, 39-170; 15571, SERPING1, 78168, 180618, 1-132; 15571, SERPING1, 78169, 180619, 1-402; 15571, SERPING1, 78159, 180609, 228-1730; 15571, SERPING1, 78161, 180611, 58-1575; 15571, SERPING1, 78162, 180612, 139-1485; 15572, SERPINH1, 78171, 180621, 218-474; 15572, SERPINH1, 78172, 180622, 131-582; 15572, SERPINH1, 78173, 180623, 93-587; 15572, SERPINH1, 78174, 180624, 979-1584; 15572, SERPINH1, 78176, 180626, 102-529; 15572, SERPINH1, 78178, 180628, 134-882; 15572, SERPINH1, 78179, 180629, 232-974; 15572, SERPINH1, 78180, 180630, 161-660; 15572, SERPINH1, 78181, 180631, 112-998; 15572, SERPINH1, 78182, 180632, 146-1120; 15572, SERPINH1, 78183, 180633, 1-170; 15572, SERPINH1, 78184, 180634, 164-773; 15572, SERPINH1, 78170, 180620, 269-1525; 15572, SERPINH1, 78175, 180625, 1436-2692; 15572, SERPINH1, 78177, 180627, 343-1599; 15573, SERPINI1, 78187, 180637, 102-582; 15573, SERPINI1, 78188, 180638, 107-842; 15573, SERPINI1, 78189, 180639, 1-358; 15573, SERPINI1, 78185, 180635, 432-1664; 15573, SERPINI1, 78186, 180636, 413-1645; 15574, SERPINI2, 78192, 180642, 126-743; 15574, SERPINI2, 78193, 180643, 6-477; 15574, SERPINI2, 78196, 180646, 202-1449; 15574, SERPINI2, 78190, 180640, 141-1358; 15574, SERPINI2, 78191, 180641, 102-

1319; 15574, SERPINI2, 78194, 180644, 70-1287; 15574, SERPINI2, 78195, 180645, 300-1517; 15575, SERBP1, 78197, 180647, 100-1281; 15575, SERBP1, 78198, 180648, 73-1281; 15575, SERBP1, 78199, 180649, 116-1279; 15575, SERBP1, 78200, 180650, 87-1313; 15576, SRRT, 78201, 180651, 1-232; 15576, SRRT, 78202, 180652, 1-446; 15576, SRRT, 78203, 180653, 1-142; 15576, SRRT, 78204, 180654, 62-397; 15576, SRRT, 78205, 180655, 1-1500; 15576, SRRT, 78209, 180659, 185-337; 15576, SRRT, 78206, 180656, 222-2840; 15576, SRRT, 78207, 180657, 160-2790; 15576, SRRT, 78208, 180658, 222-2849; 15576, SRRT, 78210, 180660, 163-2778; 15577, SERTAD1, 78211, 180661, 160-870; 15578, SERTAD2, 78212, 180662, 299-1243; 15579, SERTAD3, 78215, 180665, 215-747; 15579, SERTAD3, 78216, 180666, 261-535; 15579, SERTAD3, 78213, 180663, 498-1088; 15579, SERTAD3, 78214, 180664, 279-869; 15580, SERTAD4, 78217, 180667, 231-1301; 15580, SERTAD4, 78218, 180668, 231-1301; 15581, SAA1, 78221, 180671, 103-471; 15581, SAA1, 78219, 180669, 128-496; 15581, SAA1, 78220, 180670, 185-553; 15582, SAA2, 78224, 180674, 9-251; 15582, SAA2, 78225, 180675, 38-379; 15582, SAA2, 78222, 180672, 46-414; 15582, SAA2, 78223, 180673, 46-297; 15582, SAA2, 78226, 180676, 185-553; 15582, SAA2, 78227, 180677, 103-471; 15583, SAA4, 78228, 180678, 182-574; 15584, SAAL1, 78229, 180679, 42-1463; 15584, SAAL1, 78230, 180680, 47-1108; 15584, SAAL1, 78231, 180681, 29-657; 15584, SAAL1, 78232, 180682, 1-450; 15584, SAAL1, 78233, 180683, 47-1477; 15584, SAAL1, 78235, 180685, 1-401; 15584, SAAL1, 78236, 180686, 1-795; 15584, SAAL1, 78234, 180684, 51-1475; 15585, SDPR, 78237, 180687, 331-1608; 15586, SRF, 78238, 180688, 359-1885; 15587, SRFBP1, 78239, 180689, 73-1362; 15588, SGK1, 78244, 180694, 1-166; 15588, SGK1, 78245, 180695, 58-1221; 15588, SGK1, 78247, 180697, 122-553; 15588, SGK1, 78248, 180698, 170-631; 15588, SGK1, 78249, 180699, 381-560; 15588, SGK1, 78240, 180690, 90-1385; 15588, SGK1, 78241, 180691, 234-1499; 15588, SGK1, 78242, 180692, 599-2179; 15588, SGK1, 78243, 180693, 331-1668; 15588, SGK1, 78246, 180696, 84-1463; 15589, SGK2, 78251, 180701, 157-1233; 15589, SGK2, 78255, 180705, 83-676; 15589, SGK2, 78257, 180707, 142-999; 15589, SGK2, 78258, 180708, 525-554; 15589, SGK2, 78250, 180700, 554-1837; 15589, SGK2, 78252, 180702, 142-1245; 15589, SGK2, 78253, 180703, 461-1564; 15589, SGK2, 78254, 180704, 196-1299; 15589, SGK2, 78256, 180706, 1-1182; 15590, SGK3, 78261, 180711, 99-477; 15590, SGK3, 78262, 180712, 193-577; 15590, SGK3, 78263, 180713, 18-517; 15590, SGK3, 78264, 180714, 218-666; 15590, SGK3, 78267, 180717, 212-537; 15590, SGK3, 78259, 180709, 124-1614; 15590, SGK3, 78260, 180710, 261-1751; 15590, SGK3, 78265, 180715, 357-1847; 15590, SGK3, 78266, 180716, 538-2028; 15590, SGK3, 78268, 180718, 215-1609; 15591, SARS, 78270, 180720, 12-1622; 15591, SARS, 78269, 180719, 76-1620; 15592, SARS2, 78272, 180722, 23-1579; 15592, SARS2, 78273, 180723, 25-735; 15592, SARS2, 78274, 180724, 1-564; 15592, SARS2, 78275, 180725, 24-296; 15592, SARS2, 78276, 180726, 308-1294; 15592, SARS2, 78277, 180727, 24-431; 15592, SARS2, 78279, 180729, 24-431; 15592, SARS2, 78280, 180730, 23-1579; 15592, SARS2, 78281, 180731, 1-564; 15592, SARS2, 78282, 180732, 308-1294; 15592, SARS2, 78283, 180733, 24-296; 15592, SARS2, 78284, 180734, 26-1588; 15592, SARS2, 78285, 180735, 25-735; 15592, SARS2, 78286, 180736, 161-1717; 15592, SARS2, 78271, 180721, 161-1717; 15592, SARS2, 78278, 180728, 26-1588; 15593, SESN1, 78287, 180737, 336-1616; 15593, SESN1, 78288, 180738, 96-1574; 15593, SESN1, 78289, 180739, 747-2402; 15594, SESN2, 78290, 180740, 322-1764; 15595, SESN3, 78293, 180743, 396-607; 15595, SESN3, 78295, 180745, 575-825; 15595, SESN3, 78291, 180741, 542-1603; 15595, SESN3, 78292, 180742, 187-1152; 15595, SESN3, 78294, 180744, 338-1816; 15596, SMYD1, 78296, 180746, 4-315; 15596, SMYD1, 78298, 180748, 41-1474; 15596, SMYD1, 78297, 180747, 86-1558; 15597, SMYD2, 78300, 180750, 1-296; 15597, SMYD2, 78299, 180749, 23-1324; 15598, SMYD3, 78301, 180751, 290-732; 15598, SMYD3, 78302, 180752, 96-644; 15598, SMYD3, 78303, 180753, 345-566; 15598, SMYD3, 78304, 180754, 169-562; 15598, SMYD3, 78305, 180755, 41-1327; 15598, SMYD3, 78306, 180756, 128-1237; 15599, SMYD4, 78308, 180758, 98-316; 15599, SMYD4, 78309, 180759, 124-793; 15599, SMYD4, 78310, 180760, 1-1677; 15599, SMYD4, 78311, 180761, 55-586; 15599, SMYD4, 78307, 180757, 169-2583; 15600, SBF1, 78312, 180762, 103-5709; 15600, SBF1, 78314, 180764, 1-1246; 15600, SBF1, 78313, 180763, 185-5866; 15601, SBF2, 78316, 180766, 1-1188; 15601, SBF2, 78317, 180767, 1-993; 15601, SBF2, 78318, 180768, 1-399; 15601, SBF2, 78319, 180769, 1-5409; 15601, SBF2, 78315, 180765, 139-5688; 15602, SETBP1, 78322, 180772, 352-762; 15602, SETBP1, 78320, 180770, 297-5087; 15602, SETBP1, 78321, 180771, 396-1124; 15603, SETMAR, 78323, 180773, 65-701; 15603, SETMAR, 78325, 180775, 40-555; 15603, SETMAR, 78326, 180776, 35-238; 15603, SETMAR, 78324, 180774, 68-2122; 15603, SETMAR, 78327, 180777, 11-1108; 15603, SETMAR, 78328, 180778, 1-1638; 15604, SETD7, 78330, 180780, 225-434; 15604, SETD7, 78331, 180781, 633-1040; 15604, SETD7, 78332, 180782, 102-1190; 15604, SETD7, 78333, 180783, 308-448; 15604, SETD7, 78334, 180784, 211-492; 15604, SETD7, 78329, 180779, 638-1738; 15605, SETD8, 78335, 180785, 517-1485; 15605, SETD8, 78337, 180787, 34-309; 15605, SETD8, 78338, 180788, 5-901; 15605, SETD8, 78336, 180786, 427-1485; 15606, SETD1A, 78340, 180790, 186-926; 15606, SETD1A, 78339, 180789, 687-5810; 15607, SETD1B, 78341, 180791, 1-5772; 15607, SETD1B, 78342, 180792, 69-5840; 15607, SETD1B, 78343, 180793, 69-5969; 15607, SETD1B, 78344, 180794, 1-5901; 15608, SETD2, 78345, 180795, 1-4097; 15608, SETD2, 78347, 180797, 1-3871; 15608, SETD2, 78348, 180798, 1-5026; 15608, SETD2, 78349, 180799, 211-4231; 15608, SETD2, 78346, 180796, 44-7738; 15609, SETD3, 78352, 180802, 119-364; 15609, SETD3, 78353, 180803, 83-328; 15609, SETD3, 78354, 180804, 142-387; 15609, SETD3, 78355, 180805, 72-950; 15609, SETD3, 78356, 180806, 171-416; 15609, SETD3, 78350, 180800, 161-1945; 15609, SETD3, 78351, 180801, 70-960; 15610, SETD4, 78358, 180808, 288-1139; 15610, SETD4, 78359, 180809, 284-1135; 15610, SETD4, 78364, 180814, 507-707; 15610, SETD4, 78365, 180815, 222-431; 15610, SETD4, 78366, 180816, 69-745; 15610, SETD4, 78367, 180817, 103-796; 15610, SETD4, 78368, 180818, 383-754; 15610, SETD4, 78357, 180807, 241-1563; 15610, SETD4, 78360, 180810, 176-1099; 15610, SETD4, 78361, 180811, 169-1092; 15610, SETD4, 78362, 180812, 432-1682; 15610, SETD4, 78363, 180813, 1374-2696; 15611, SETD5, 78370, 180820, 1-2734; 15611, SETD5, 78372, 180822, 15-4400; 15611, SETD5, 78374, 180824, 255-413; 15611, SETD5, 78375, 180825, 282-479; 15611, SETD5, 78376, 180826, 540-698; 15611, SETD5, 78377, 180827, 1-1323; 15611, SETD5, 78378, 180828, 1-532; 15611, SETD5, 78379, 180829, 390-900; 15611, SETD5, 78380, 180830, 436-921; 15611, SETD5, 78369, 180819, 365-4399; 15611,

SETD5, 78371, 180821, 191-4519; 15611, SETD5, 78373, 180823, 436-4764; 15612, SETD6, 78383, 180833, 57-1271; 15612, SETD6, 78384, 180834, 26-576; 15612, SETD6, 78385, 180835, 43-831; 15612, SETD6, 78386, 180836, 1-792; 15612, SETD6, 78381, 180831, 51-1472; 15612, SETD6, 78382, 180832, 60-1409; 15613, SETD9, 78388, 180838, 32-151; 15613, SETD9, 78389, 180839, 271-417; 15613, SETD9, 78387, 180837, 387-1286; 15613, SETD9, 78390, 180840, 295-1110; 15614, SETDB1, 78393, 180843, 106-855; 15614, SETDB1, 78394, 180844, 43-378; 15614, SETDB1, 78396, 180846, 139-590; 15614, SETDB1, 78397, 180847, 199-668; 15614, SETDB1, 78398, 180848, 76-3854; 15614, SETDB1, 78399, 180849, 98-587; 15614, SETDB1, 78400, 180850, 135-2043; 15614, SETDB1, 78391, 180841, 191-4066; 15614, SETDB1, 78392, 180842, 127-1320; 15614, SETDB1, 78395, 180845, 118-3990; 15615, SETDB2, 78401, 180851, 441-2087; 15615, SETDB2, 78404, 180854, 1-2160; 15615, SETDB2, 78402, 180852, 343-2466; 15615, SETDB2, 78403, 180853, 826-2985; 15616, SET, 78407, 180857, 1-801; 15616, SET, 78410, 180860, 140-235; 15616, SET, 78405, 180855, 358-1191; 15616, SET, 78406, 180856, 2-799; 15616, SET, 78408, 180858, 242-1114; 15616, SET, 78409, 180859, 86-892; 15617, SETSIP, 78412, 180862, 1-879; 15617, SETSIP, 78411, 180861, 1-909; 15618, SCMH1, 78424, 180874, 1-426; 15618, SCMH1, 78413, 180863, 301-2283; 15618, SCMH1, 78414, 180864, 170-2116; 15618, SCMH1, 78415, 180865, 179-1912; 15618, SCMH1, 78416, 180866, 346-2121; 15618, SCMH1, 78417, 180867, 440-2239; 15618, SCMH1, 78418, 180868, 598-2331; 15618, SCMH1, 78419, 180869, 485-2260; 15618, SCMH1, 78420, 180870, 459-2192; 15618, SCMH1, 78421, 180871, 1-1983; 15618, SCMH1, 78422, 180872, 411-2210; 15618, SCMH1, 78423, 180873, 142-1584; 15619, SCML1, 78429, 180879, 375-817; 15619, SCML1, 78425, 180875, 329-1318; 15619, SCML1, 78426, 180876, 329-1237; 15619, SCML1, 78427, 180877, 460-1086; 15619, SCML1, 78428, 180878, 482-1108; 15620, SCML2, 78432, 180882, 1-377; 15620, SCML2, 78430, 180880, 161-2263; 15620, SCML2, 78431, 180881, 44-460; 15621, SCML4, 78436, 180886, 467-985; 15621, SCML4, 78437, 180887, 180-695; 15621, SCML4, 78438, 180888, 106-700; 15621, SCML4, 78433, 180883, 247-1491; 15621, SCML4, 78434, 180884, 106-1023; 15621, SCML4, 78435, 180885, 211-1281; 15622, SRY, 78439, 180889, 97-711; 15623, SHBG, 78440, 180890, 247-1281; 15623, SHBG, 78444, 180894, 110-817; 15623, SHBG, 78445, 180895, 22-567; 15623, SHBG, 78446, 180896, 110-1144; 15623, SHBG, 78447, 180897, 247-526; 15623, SHBG, 78448, 180898, 110-358; 15623, SHBG, 78449, 180899, 1-639; 15623, SHBG, 78450, 180900, 110-799; 15623, SHBG, 78452, 180902, 110-655; 15623, SHBG, 78453, 180903, 1-342; 15623, SHBG, 78454, 180904, 110-982; 15623, SHBG, 78455, 180905, 1-783; 15623, SHBG, 78456, 180906, 110-637; 15623, SHBG, 78457, 180907, 22-195; 15623, SHBG, 78458, 180908, 1-621; 15623, SHBG, 78441, 180891, 32-1240; 15623, SHBG, 78442, 180892, 22-903; 15623, SHBG, 78443, 180893, 80-943; 15623, SHBG, 78451, 180901, 22-1176; 15624, SFI1, 78461, 180911, 1-448; 15624, SFI1, 78462, 180912, 150-458; 15624, SFI1, 78463, 180913, 1-1817; 15624, SFI1, 78464, 180914, 282-3551; 15624, SFI1, 78466, 180916, 1-1468; 15624, SFI1, 78467, 180917, 212-449; 15624, SFI1, 78468, 180918, 1-173; 15624, SFI1, 78469, 180919, 31-1200; 15624, SFI1, 78471, 180921, 1-309; 15624, SFI1, 78459, 180909, 106-3834; 15624, SFI1, 78460, 180910, 127-3609; 15624, SFI1, 78465, 180915, 394-4029; 15624, SFI1, 78470, 180920, 530-4093; 15625, SFT2D1, 78472, 180922, 111-590; 15626, SFT2D2, 78474, 180924, 131-457; 15626, SFT2D2, 78475, 180925, 73-399; 15626, SFT2D2, 78473, 180923, 73-555; 15627, SFT2D3, 78476, 180926, 22-669; 15628, SUGT1, 78477, 180927, 56-1057; 15628, SUGT1, 78478, 180928, 83-1180; 15629, SH2D1A, 78479, 180929, 119-496; 15629, SH2D1A, 78480, 180930, 300-686; 15629, SH2D1A, 78481, 180931, 55-285; 15630, SH2D1B, 78482, 180932, 111-509; 15631, SH2D2A, 78483, 180933, 150-1265; 15631, SH2D2A, 78484, 180934, 155-1324; 15631, SH2D2A, 78485, 180935, 141-1340; 15632, SH2D3A, 78488, 180938, 146-859; 15632, SH2D3A, 78486, 180936, 271-2001; 15632, SH2D3A, 78487, 180937, 134-1585; 15633, SH2D3C, 78494, 180944, 573-976; 15633, SH2D3C, 78495, 180945, 190-778; 15633, SH2D3C, 78489, 180939, 115-2697; 15633, SH2D3C, 78490, 180940, 245-2623; 15633, SH2D3C, 78491, 180941, 210-2321; 15633, SH2D3C, 78492, 180942, 146-2254; 15633, SH2D3C, 78493, 180943, 846-2366; 15633, SH2D3C, 78496, 180946, 116-2218; 15634, SH2D4A, 78498, 180948, 1-567; 15634, SH2D4A, 78497, 180947, 412-1776; 15634, SH2D4A, 78499, 180949, 309-1673; 15634, SH2D4A, 78500, 180950, 83-1312; 15635, SH2D4B, 78501, 180951, 79-1086; 15635, SH2D4B, 78502, 180952, 431-1504; 15636, SH2D5, 78505, 180955, 141-544; 15636, SH2D5, 78506, 180956, 117-511; 15636, SH2D5, 78507, 180957, 187-564; 15636, SH2D5, 78508, 180958, 313-524; 15636, SH2D5, 78503, 180953, 626-1645; 15636, SH2D5, 78504, 180954, 399-1670; 15637, SH2D6, 78509, 180959, 162-689; 15637, SH2D6, 78510, 180960, 1315-1746; 15638, SH2D7, 78512, 180962, 360-1307; 15638, SH2D7, 78511, 180961, 1-1356; 15639, SH2B1, 78517, 180967, 167-1174; 15639, SH2B1, 78518, 180968, 188-1309; 15639, SH2B1, 78519, 180969, 247-613; 15639, SH2B1, 78520, 180970, 431-484; 15639, SH2B1, 78521, 180971, 1-546; 15639, SH2B1, 78522, 180972, 364-533; 15639, SH2B1, 78523, 180973, 1-342; 15639, SH2B1, 78524, 180974, 1-602; 15639, SH2B1, 78525, 180975, 399-588; 15639, SH2B1, 78513, 180963, 440-2710; 15639, SH2B1, 78514, 180964, 3292-5307; 15639, SH2B1, 78515, 180965, 225-2276; 15639, SH2B1, 78516, 180966, 372-2387; 15639, SH2B1, 78526, 180976, 273-2543; 15640, SH2B2, 78527, 180977, 237-965; 15640, SH2B2, 78528, 180978, 5-2032; 15640, SH2B2, 78529, 180979, 69-212; 15641, SH2B3, 78531, 180981, 41-1162; 15641, SH2B3, 78532, 180982, 1-648; 15641, SH2B3, 78530, 180980, 358-2085; 15642, STAC, 78534, 180984, 142-1167; 15642, STAC, 78535, 180985, 117-272; 15642, STAC, 78536, 180986, 72-827; 15642, STAC, 78533, 180983, 301-1509; 15643, STAC2, 78538, 180988, 167-613; 15643, STAC2, 78537, 180987, 371-1606; 15644, STAC3, 78541, 180991, 321-635; 15644, STAC3, 78543, 180993, 291-795; 15644, STAC3, 78539, 180989, 203-1297; 15644, STAC3, 78540, 180990, 320-856; 15644, STAC3, 78542, 180992, 244-1221; 15645, SHANK1, 78547, 180997, 89-6598; 15645, SHANK1, 78548, 180998, 1-552; 15645, SHANK1, 78544, 180994, 20-6505; 15645, SHANK1, 78545, 180995, 1-6459; 15645, SHANK1, 78546, 180996, 1-4647; 15646, SHANK2, 78549, 180999, 52-3837; 15646, SHANK2, 78550, 181000, 35-769; 15646, SHANK2, 78551, 181001, 434-4195; 15646, SHANK2, 78553, 181003, 1-635; 15646, SHANK2, 78554, 181004, 1-460; 15646, SHANK2, 78555, 181005, 1-557; 15646, SHANK2, 78557, 181007, 74-889; 15646, SHANK2, 78558, 181008, 52-3837; 15646, SHANK2, 78559, 181009, 1-3387; 15646, SHANK2, 78560, 181010, 1-772; 15646, SHANK2, 78562, 181012, 371-751; 15646, SHANK2, 78563, 181013, 1-326; 15646, SHANK2, 78564, 181014, 1-223; 15646, SHANK2, 78552, 181002, 74-919; 15646, SHANK2, 78556, 181006, 1-4413; 15646, SHANK2, 78561, 181011, 79-5628; 15647, SHANK3, 78565, 181015, 1-5193; 15647, SHANK3, 78566, 181016, 1-5175; 15648, SH3PXD2A, 78569, 181019, 1-3181; 15648, SH3PXD2A, 78567, 181017, 141-3458; 15648, SH3PXD2A, 78568, 181018, 278-3679; 15649, SH3PXD2B, 78571, 181021, 1-245; 15649, SH3PXD2B, 78572, 181022, 7-1299; 15649, SH3PXD2B, 78570, 181020, 172-2907; 15650, SH3YL1, 78579, 181029, 1-693; 15650, SH3YL1, 78580, 181030, 343-494; 15650, SH3YL1, 78581, 181031, 405-581; 15650, SH3YL1, 78582, 181032, 1-768; 15650, SH3YL1, 78583, 181033, 1046-1513; 15650, SH3YL1, 78584, 181034, 1-295; 15650, SH3YL1, 78573, 181023, 82-1110; 15650, SH3YL1, 78574, 181024, 451-1134; 15650, SH3YL1, 78575, 181025, 378-1406; 15650, SH3YL1, 78576, 181026, 49-1020; 15650, SH3YL1, 78577, 181027, 185-529; 15650, SH3YL1, 78578, 181028, 2197-2880; 15650, SH3YL1, 78585, 181035, 571-1311; 15651, SH3TC1, 78587, 181037, 71-412; 15651, SH3TC1, 78588, 181038, 335-617; 15651, SH3TC1, 78589, 181039, 193-509; 15651, SH3TC1, 78590, 181040, 1-304; 15651, SH3TC1, 78591, 181041, 64-294; 15651, SH3TC1, 78592, 181042, 131-739; 15651, SH3TC1, 78593, 181043, 1-551; 15651, SH3TC1, 78594, 181044, 1-77; 15651, SH3TC1, 78595, 181045, 1-124; 15651, SH3TC1, 78586, 181036, 68-4078; 15652, SH3TC2, 78596, 181046, 23-706; 15652, SH3TC2, 78598, 181048, 41-328; 15652, SH3TC2, 78599, 181049, 1-426; 15652, SH3TC2, 78601, 181051, 26-709; 15652, SH3TC2, 78603, 181053, 1-113; 15652, SH3TC2, 78604, 181054, 142-3921; 15652, SH3TC2, 78597, 181047, 1471-1923; 15652, SH3TC2, 78600, 181050, 68-3913; 15652, SH3TC2, 78602, 181052, 103-3969; 15653, SH3BGR, 78609, 181059, 268-585; 15653, SH3BGR, 78610, 181060, 1-165; 15653, SH3BGR, 78611, 181061, 302-595; 15653, SH3BGR, 78612, 181062, 1-412; 15653, SH3BGR, 78613, 181063, 1-246; 15653, SH3BGR, 78605, 181055, 79-798; 15653, SH3BGR, 78606, 181056, 240-626; 15653, SH3BGR, 78607, 181057, 128-514; 15653, SH3BGR, 78608, 181058, 175-561; 15654, SH3BGRL, 78614, 181064, 259-603; 15655, SH3BGRL2, 78615, 181065, 180-503; 15656, SH3BGRL3, 78617, 181067, 35-301; 15656, SH3BGRL3, 78618, 181068, 580-1260; 15656, SH3BGRL3, 78616, 181066, 981-1262; 15657, SBK1, 78619, 181069, 790-2064; 15658, SBK2, 78620, 181070, 10-1056; 15658, SBK2, 78621, 181071, 39-1085; 15659, SBK3, 78622, 181072, 1-480; 15659, SBK3, 78623, 181073, 1-1080; 15660, SH3D19, 78629, 181079, 281-3424; 15660, SH3D19, 78630, 181080, 1-700; 15660, SH3D19, 78624, 181074, 1091-3463; 15660, SH3D19, 78625, 181075, 709-3081; 15660, SH3D19, 78626, 181076, 1169-3472; 15660, SH3D19, 78627, 181077, 190-2385; 15660, SH3D19, 78628, 181078, 1000-3303; 15661, SH3D21, 78631, 181081, 35-1168; 15661, SH3D21, 78634, 181084, 158-565; 15661, SH3D21, 78632, 181082, 29-2299; 15661, SH3D21, 78633, 181083, 165-2102; 15662, SH3RF1, 78636, 181086, 355-591; 15662, SH3RF1, 78637, 181087, 1-911; 15662, SH3RF1, 78638, 181088, 189-487; 15662, SH3RF1, 78635, 181085, 343-3009; 15663, SH3RF2, 78639, 181089, 223-2412; 15663, SH3RF2, 78640, 181090, 53-2242; 15664, SH3RF3, 78641, 181091, 194-2842; 15665, SH3BP5L, 78642, 181092, 1231-2412; 15666, SH3BP1, 78644, 181094, 96-158; 15666, SH3BP1, 78643, 181093, 314-2419; 15666, SH3BP1, 78645, 181095, 939-2297; 15667, SH3BP2, 78652, 181102, 124-551; 15667, SH3BP2, 78653, 181103, 41-557; 15667, SH3BP2, 78654, 181104, 200-609; 15667, SH3BP2, 78656, 181106, 107-688; 15667, SH3BP2, 78658, 181108, 313-876; 15667, SH3BP2, 78659, 181109, 300-727; 15667, SH3BP2, 78660, 181110, 1-571; 15667, SH3BP2, 78646, 181096, 262-1947; 15667, SH3BP2, 78647, 181097, 180-1949; 15667, SH3BP2, 78648, 181098, 179-1864; 15667, SH3BP2, 78649, 181099, 121-1806; 15667, SH3BP2, 78650, 181100, 40-1896; 15667, SH3BP2, 78651, 181101, 262-555; 15667, SH3BP2, 78655, 181105, 242-535; 15667, SH3BP2, 78657, 181107, 211-1896; 15668, SH3BP4, 78664, 181114, 403-570; 15668, SH3BP4, 78665, 181115, 228-593; 15668, SH3BP4, 78666, 181116, 328-500; 15668, SH3BP4, 78667, 181117, 311-829; 15668, SH3BP4, 78661, 181111, 321-3212; 15668, SH3BP4, 78662, 181112, 405-3296; 15668, SH3BP4, 78663, 181113, 508-3399; 15669, SH3BP5, 78671, 181121, 69-278; 15669, SH3BP5, 78672, 181122, 520-903; 15669, SH3BP5, 78673, 181123, 149-322; 15669, SH3BP5, 78674, 181124, 674-826; 15669, SH3BP5, 78668, 181118, 222-1589; 15669, SH3BP5, 78669, 181119, 548-1444; 15669, SH3BP5, 78670, 181120, 797-1693; 15670, SGIP1, 78678, 181128, 656-1657; 15670, SGIP1, 78679, 181129, 172-951; 15670, SGIP1, 78675, 181125, 139-2718; 15670, SGIP1, 78676, 181126, 78-2564; 15670, SGIP1, 78677, 181127, 195-2090; 15671, SH3GL1, 78682, 181132, 192-577; 15671, SH3GL1, 78684, 181134, 620-1036; 15671, SH3GL1, 78685, 181135, 540-619; 15671, SH3GL1, 78680, 181130, 180-1286; 15671, SH3GL1, 78681, 181131, 158-1120; 15671, SH3GL1, 78683, 181133, 51-965; 15672, SH3GL2, 78686, 181136, 121-1179; 15673, SH3GL3, 78689, 181139, 159-356; 15673, SH3GL3, 78687, 181137, 493-1560; 15673, SH3GL3, 78688, 181138, 307-1350; 15674, SH3GLB1, 78693, 181143, 331-1515; 15674, SH3GLB1, 78690, 181140, 6-1166; 15674, SH3GLB1, 78691, 181141, 489-1286; 15674, SH3GLB1, 78692, 181142, 325-1422; 15675, SH3GLB2, 78697, 181147, 57-1181; 15675, SH3GLB2, 78698, 181148, 150-224; 15675, SH3GLB2, 78699, 181149, 45-428; 15675, SH3GLB2, 78700, 181150, 32-1234; 15675, SH3GLB2, 78701, 181151, 1-180; 15675, SH3GLB2, 78694, 181144, 126-1340; 15675, SH3GLB2, 78695, 181145, 61-1248; 15675, SH3GLB2, 78696, 181146, 147-1334; 15676, SH3KBP1, 78702, 181152, 150-1811; 15676, SH3KBP1, 78705, 181155, 1-1938; 15676, SH3KBP1, 78707, 181157, 38-663; 15676, SH3KBP1, 78708, 181158, 70-518; 15676, SH3KBP1, 78703, 181153, 68-1954; 15676, SH3KBP1, 78704, 181154, 126-1409; 15676, SH3KBP1, 78706, 181156, 292-2289; 15677, SHKBP1, 78710, 181160, 142-255; 15677, SHKBP1, 78711, 181161, 160-552; 15677, SHKBP1, 78712, 181162, 1-752; 15677, SHKBP1, 78713, 181163, 36-461; 15677, SHKBP1, 78714, 181164, 1-494; 15677, SHKBP1, 78715, 181165, 48-356; 15677, SHKBP1, 78716, 181166, 1-897; 15677, SHKBP1, 78717, 181167, 1-789; 15677, SHKBP1, 78718, 181168, 1-527; 15677, SHKBP1, 78719, 181169, 1-1832; 15677, SHKBP1, 78720, 181170, 1-834; 15677, SHKBP1, 78721, 181171, 1-431; 15677, SHKBP1, 78722, 181172, 1-389; 15677, SHKBP1, 78723, 181173, 46-2094; 15677, SHKBP1, 78724, 181174, 34-300; 15677, SHKBP1, 78709, 181159, 50-2173; 15678, SPRN, 78725, 181175, 113-568; 15679, SHARPIN, 78728, 181178, 1-288; 15679, SHARPIN, 78726, 181176, 485-1465; 15679, SHARPIN, 78727, 181177, 438-1601; 15680, SHC4, 78731, 181181, 221-1255; 15680, SHC4, 78732, 181182, 81-515; 15680, SHC4, 78733, 181183, 502-885; 15680, SHC4, 78729, 181179, 430-2322; 15680, SHC4, 78730, 181180, 832-1995; 15681, SHC1, 78735, 181185, 310-1374; 15681, SHC1, 78738, 181188, 368-780; 15681, SHC1, 78739, 181189, 1-892; 15681, SHC1, 78740, 181190, 93-692;

15681, SHC1, 78741, 181191, 162-550; 15681, SHC1, 78743, 181193, 181-780; 15681, SHC1, 78734, 181184, 216-1967; 15681, SHC1, 78736, 181186, 133-1554; 15681, SHC1, 78737, 181187, 133-1557; 15681, SHC1, 78742, 181192, 222-1976; 15682, SHC2, 78745, 181195, 1-416; 15682, SHC2, 78746, 181196, 1-208; 15682, SHC2, 78744, 181194, 1-1749; 15683, SHC3, 78747, 181197, 109-426; 15683, SHC3, 78748, 181198, 308-2092; 15684, SHCBP1, 78750, 181200, 1-465; 15684, SHCBP1, 78749, 181199, 268-2286; 15685, SHCBP1L, 78752, 181202, 1-2175; 15685, SHCBP1L, 78751, 181201, 238-2199; 15686, SHISA2, 78753, 181203, 57-944; 15687, SHISA3, 78754, 181204, 219-935; 15688, SHISA4, 78755, 181205, 288-881; 15689, SHISA5, 78759, 181209, 61-246; 15689, SHISA5, 78760, 181210, 1-142; 15689, SHISA5, 78763, 181213, 239-575; 15689, SHISA5, 78764, 181214, 72-443; 15689, SHISA5, 78765, 181215, 47-181; 15689, SHISA5, 78766, 181216, 304-816; 15689, SHISA5, 78756, 181206, 338-1060; 15689, SHISA5, 78757, 181207, 195-608; 15689, SHISA5, 78758, 181208, 36-737; 15689, SHISA5, 78761, 181211, 215-844; 15689, SHISA5, 78762, 181212, 391-1020; 15689, SHISA5, 78767, 181217, 447-1076; 15690, SHISA6, 78771, 181221, 1-403; 15690, SHISA6, 78768, 181218, 1-1503; 15690, SHISA6, 78769, 181219, 161-1759; 15690, SHISA6, 78770, 181220, 161-1816; 15691, SHISA7, 78773, 181223, 1-461; 15691, SHISA7, 78772, 181222, 1-1617; 15692, SHISA8, 78775, 181225, 1-1194; 15692, SHISA8, 78774, 181224, 1-486; 15693, SHISA9, 78776, 181226, 309-974; 15693, SHISA9, 78777, 181227, 446-1720; 15694, SHOC2, 78780, 181230, 1-1119; 15694, SHOC2, 78778, 181228, 235-1845; 15694, SHOC2, 78779, 181229, 346-2094; 15695, SHTN1, 78781, 181231, 626-2341; 15695, SHTN1, 78782, 181232, 499-2394; 15695, SHTN1, 78783, 181233, 469-1965; 15695, SHTN1, 78784, 181234, 499-2175; 15695, SHTN1, 78785, 181235, 287-1657; 15696, SDR16C5, 78788, 181238, 733-1689; 15696, SDR16C5, 78786, 181236, 639-1568; 15696, SDR16C5, 78787, 181237, 132-929; 15697, SDR39U1, 78791, 181241, 105-740; 15697, SDR39U1, 78792, 181242, 1-556; 15697, SDR39U1, 78793, 181243, 549-934; 15697, SDR39U1, 78794, 181244, 536-735; 15697, SDR39U1, 78795, 181245, 483-769; 15697, SDR39U1, 78796, 181246, 415-795; 15697, SDR39U1, 78797, 181247, 173-681; 15697, SDR39U1, 78798, 181248, 509-1066; 15697, SDR39U1, 78799, 181249, 515-1021; 15697, SDR39U1, 78789, 181239, 230-1189; 15697, SDR39U1, 78790, 181240, 35-916; 15698, SDR42E1, 78801, 181251, 248-832; 15698, SDR42E1, 78800, 181250, 129-1310; 15699, SDR42E2, 78802, 181252, 1-1269; 15700, SDR9C7, 78803, 181253, 145-1086; 15701, SCOC, 78805, 181255, 126-374; 15701, SCOC, 78808, 181258, 409-657; 15701, SCOC, 78809, 181259, 122-370; 15701, SCOC, 78810, 181260, 500-748; 15701, SCOC, 78812, 181262, 263-511; 15701, SCOC, 78804, 181254, 46-414; 15701, SCOC, 78806, 181256, 179-547; 15701, SCOC, 78807, 181257, 144-512; 15701, SCOC000, 78811, 181261, 2-397; 15701, SCOC, 78813, 181263, 28-507; 15701, SCOC, 78814, 181264, 28-507; 15702, SHOX, 78815, 181265, 692-1369; 15702, SHOX, 78816, 181266, 92-769; 15702, SHOX, 78817, 181267, 692-1570; 15702, SHOX, 78818, 181268, 92-970; 15703, SHOX2, 78821, 181271, 43-615; 15703, SHOX2, 78823, 181273, 1-439; 15703, SHOX2, 78819, 181269, 137-1204; 15703, SHOX2, 78820, 181270, 27-1022; 15703, SHOX2, 78822, 181272, 480-1439; 15704, SHQ1, 78825, 181275, 76-228; 15704, SHQ1, 78827, 181277, 133-324; 15704, SHQ1, 78828, 181278, 171-502; 15704, SHQ1, 78824, 181274, 141-1874; 15704, SHQ1, 78826, 181276, 91-1740; 15705, SHROOM1, 78830, 181280, 1-2352; 15705, SHROOM1, 78832, 181282, 109-1080; 15705, SHROOM1, 78829, 181279, 171-2714; 15705, SHROOM1, 78831, 181281, 806-3364; 15705, SHROOM1, 78833, 181283, 445-3003; 15706, SHROOM2, 78835, 181285, 1150-2276; 15706, SHROOM2, 78836, 181286, 759-2111; 15706, SHROOM2, 78834, 181284, 91-4941; 15707, SHROOM3, 78837, 181287, 954-6944; 15708, SHROOM4, 78838, 181288, 285-4766; 15708, SHROOM4, 78839, 181289, 27-4508; 15708, SHROOM4, 78840, 181290, 456-4589; 15709, SGOL1, 78847, 181297, 6-260; 15709, SGOL1, 78841, 181291, 141-1826; 15709, SGOL1, 78842, 181292, 141-1019; 15709, SGOL1, 78843, 181293, 141-968; 15709, SGOL1, 78844, 181294, 188-1015; 15709, SGOL1, 78845, 181295, 141-1070; 15709, SGOL1, 78846, 181296, 267-1043; 15709, SGOL1, 78848, 181298, 353-1936; 15709, SGOL1, 78849, 181299, 188-1066; 15709, SGOL1, 78850, 181300, 188-835; 15709, SGOL1, 78851, 181301, 188-1873; 15709, SGOL1, 78852, 181302, 188-1117; 15710, SGOL2, 78855, 181305, 379-640; 15710, SGOL2, 78853, 181303, 99-3896; 15710, SGOL2, 78854, 181304, 89-832; 15711, SBDS, 78857, 181307, 160-420; 15711, SBDS, 78858, 181308, 171-923; 15711, SBDS, 78856, 181306, 185-937; 15712, SIAH1, 78863, 181313, 294-589; 15712, SIAH1, 78859, 181309, 425-1366; 15712, SIAH1, 78860, 181310, 1455-2303; 15712, SIAH1, 78861, 181311, 250-1098; 15712, SIAH1, 78862, 181312, 1596-2444; 15713, SIAH2, 78865, 181315, 178-427; 15713, SIAH2, 78864, 181314, 529-1503; 15714, SIAH3, 78866, 181316, 108-917; 15715, SIAE, 78867, 181317, 174-1745; 15715, SIAE, 78868, 181318, 293-1759; 15715, SIAE, 78869, 181319, 410-1876; 15716, SIGLEC1, 78871, 181321, 1-1390; 15716, SIGLEC1, 78870, 181320, 1-5130; 15717, SIGLEC10, 78878, 181328, 62-1600; 15717, SIGLEC10, 78879, 181329, 3-561; 15717, SIGLEC10, 78880, 181330, 131-596; 15717, SIGLEC10, 78872, 181322, 223-2031; 15717, SIGLEC10, 78873, 181323, 118-2211; 15717, SIGLEC10, 78874, 181324, 157-2076; 15717, SIGLEC10, 78875, 181325, 1-1365; 15717, SIGLEC10, 78876, 181326, 56-1690; 15717, SIGLEC10, 78877, 181327, 62-1726; 15718, SIGLEC11, 78882, 181332, 1-181; 15718, SIGLEC11, 78881, 181331, 1-1809; 15718, SIGLEC11, 78883, 181333, 92-2188; 15719, SIGLEC12, 78885, 181335, 40-504; 15719, SIGLEC12, 78884, 181334, 57-1844; 15719, SIGLEC12, 78886, 181336, 1-1434; 15720, SIGLEC14, 78887, 181337, 43-1233; 15721, SIGLEC15, 78890, 181340, 1-523; 15721, SIGLEC15, 78888, 181338, 218-1204; 15721, SIGLEC15, 78889, 181339, 493-1017; 15722, SIGLEC5, 78891, 181341, 1-1656; 15722, SIGLEC5, 78892, 181342, 401-2056; 15723, SIGLEC6, 78893, 181343, 70-1383; 15723, SIGLEC6, 78894, 181344, 209-1270; 15723, SIGLEC6, 78895, 181345, 147-1316; 15723, SIGLEC6, 78896, 181346, 156-1184; 15723, SIGLEC6, 78897, 181347, 156-1517; 15723, SIGLEC6, 78898, 181348, 156-1361; 15724, SIGLEC7, 78902, 181352, 72-627; 15724, SIGLEC7, 78899, 181349, 64-1188; 15724, SIGLEC7, 78900, 181350, 70-1473; 15724, SIGLEC7, 78901, 181351, 1-438; 15724, SIGLEC7, 78903, 181353, 1-438; 15725, SIGLEC8, 78906, 181356, 66-1238; 15725, SIGLEC8, 78904, 181354, 68-1567; 15725, SIGLEC8, 78905, 181355, 70-1290; 15726, SIGLEC9, 78909, 181359, 1-614; 15726, SIGLEC9, 78907, 181357, 68-1459; 15726, SIGLEC9, 78908, 181358, 68-1507; 15727, NEU1, 78918, 181368, 47-850; 15727, NEU1, 78919, 181369, 47-850; 15727, NEU1, 78920, 181370, 47-850; 15727, NEU1, 78921, 181371, 41-259; 15727, NEU1, 78922, 181372, 47-850; 15727, NEU1, 78923, 181373, 41-259; 15727, NEU1, 78924, 181374, 41-259; 15727, NEU1, 78925, 181375, 47-850; 15727, NEU1, 78926, 181376, 47-850; 15727, NEU1, 78927, 181377, 47-850; 15727, NEU1, 78928, 181378, 41-259; 15727, NEU1, 78929, 181379, 41-259; 15727, NEU1, 78930, 181380, 41-259; 15727, NEU1, 78931, 181381, 41-259; 15727, NEU1, 78932, 181382, 47-850; 15727, NEU1, 78910, 181360, 131-1378; 15727, NEU1, 78911, 181361, 131-1378; 15727, NEU1, 78912, 181362, 157-1404; 15727, NEU1, 78913, 181363, 131-1378; 15727, NEU1, 78914, 181364, 131-1378; 15727, NEU1, 78915, 181365, 131-1378; 15727, NEU1, 78916, 181366, 131-1378; 15727, NEU1, 78917, 181367, 131-1378; 15728, NEU2, 78933, 181383, 1-1143; 15729, NEU3, 78936, 181386, 72-377; 15729, NEU3, 78937, 181387, 118-630; 15729, NEU3, 78938, 181388, 128-433; 15729, NEU3, 78939, 181389, 119-538; 15729, NEU3, 78940, 181390, 137-313; 15729, NEU3, 78934, 181384, 928-2313; 15729, NEU3, 78935, 181385, 491-1876; 15730, NEU4, 78946, 181396, 65-845; 15730, NEU4, 78947, 181397, 86-562; 15730, NEU4, 78948, 181398, 73-505; 15730, NEU4, 78949, 181399, 217-860; 15730, NEU4, 78950, 181400, 188-753; 15730, NEU4, 78951, 181401, 254-484; 15730, NEU4, 78952, 181402, 34-676; 15730, NEU4, 78953, 181403, 296-451; 15730, NEU4, 78958, 181408, 188-753; 15730, NEU4, 78959, 181409, 34-676; 15730, NEU4, 78960, 181410, 73-505; 15730, NEU4, 78961, 181411, 296-451; 15730, NEU4, 78962, 181412, 217-860; 15730, NEU4, 78964, 181414, 65-845; 15730, NEU4, 78965, 181415, 86-562; 15730, NEU4, 78966, 181416, 254-484; 15730, NEU4, 78941, 181391, 430-1923; 15730, NEU4, 78942, 181392, 712-2166; 15730, NEU4, 78943, 181393, 95-1549; 15730, NEU4, 78944, 181394, 498-1988; 15730, NEU4, 78945, 181395, 454-1908; 15730, NEU4, 78954, 181404, 95-1549; 15730, NEU4, 78955, 181405, 498-1988; 15730, NEU4, 78956, 181406, 712-2166; 15730, NEU4, 78957, 181407, 430-1923; 15730, NEU4, 78963, 181413, 454-1908; 15731, SPN, 78969, 181419, 133-1197; 15731, SPN, 78967, 181417, 133-1335; 15731, SPN, 78968, 181418, 137-1339; 15731, SPN, 78970, 181420, 97-1299; 15732, SIDT1, 78971, 181421, 727-3210; 15732, SIDT1, 78972, 181422, 40-2538; 15733, SIDT2, 78973, 181423, 84-2651; 15733, SIDT2, 78975, 181425, 42-2531; 15733, SIDT2, 78976, 181426, 211-540; 15733, SIDT2, 78977, 181427, 556-930; 15733, SIDT2, 78978, 181428, 291-583; 15733, SIDT2, 78979, 181429, 1-402; 15733, SIDT2, 78980, 181430, 323-834; 15733, SIDT2, 78982, 181432, 42-2609; 15733, SIDT2, 78974, 181424, 532-3030; 15733, SIDT2, 78981, 181431, 51-2549; 15734, SDK1, 78983, 181433, 1-6582; 15734, SDK1, 78985, 181435, 1-323; 15734, SDK1, 78986, 181436, 1-6642; 15734, SDK1, 78984, 181434, 140-6781; 15735, SDK2, 78988, 181438, 1-3990; 15735, SDK2, 78987, 181437, 2-6520; 15736, SFXN1, 78990, 181440, 139-572; 15736, SFXN1, 78991, 181441, 216-796; 15736, SFXN1, 78992, 181442, 88-258; 15736, SFXN1, 78993, 181443, 1-68; 15736, SFXN1, 78994, 181444, 75-608; 15736, SFXN1, 78989, 181439, 255-1223; 15737, SFXN2, 78996, 181446, 77-415; 15737, SFXN2, 78997, 181447, 79-639; 15737, SFXN2, 78998, 181448, 168-371; 15737, SFXN2, 78999, 181449, 138-642; 15737, SFXN2, 79000, 181450, 527-583; 15737, SFXN2, 79001, 181451, 204-665; 15737, SFXN2, 79002, 181452, 178-582; 15737, SFXN2, 79003, 181453, 268-770; 15737, SFXN2, 79004, 181454, 141-554; 15737, SFXN2, 78995, 181445, 168-1136; 15738, SFXN3, 79006, 181456, 474-1439; 15738, SFXN3, 79007, 181457, 4-537; 15738, SFXN3, 79005, 181455, 457-1434; 15739, SFXN4, 79009, 181459, 600-1133; 15739, SFXN4, 79010, 181460, 552-739; 15739, SFXN4, 79008, 181458, 21-1034; 15740, SFXN5, 79012, 181462, 20-781; 15740, SFXN5, 79013, 181463, 21-489; 15740, SFXN5, 79014, 181464, 5-271; 15740, SFXN5, 79015, 181465, 1-757; 15740, SFXN5, 79011, 181461, 132-1154; 15741, SIGLECL1, 79017, 181467, 240-660; 15741, SIGLECL1, 79018, 181468, 659-912; 15741, SIGLECL1, 79019, 181469, 465-503; 15741, SIGLECL1, 79020, 181470, 163-474; 15741, SIGLECL1, 79016, 181466, 382-975; 15741, SIGLECL1, 79021, 181471, 192-785; 15742, SIGMAR1, 79023, 181473, 429-833; 15742, SIGMAR1, 79022, 181472, 75-746; 15742, SIGMAR1, 79024, 181474, 113-691; 15742, SIGMAR1, 79025, 181475, 48-368; 15743, SPCS1, 79026, 181476, 206-715; 15743, SPCS1, 79027, 181477, 235-477; 15743, SPCS1, 79029, 181479, 411-920; 15743, SPCS1, 79028, 181478, 170-478; 15744, SPCS2, 79031, 181481, 26-499; 15744, SPCS2, 79032, 181482, 204-467; 15744, SPCS2, 79033, 181483, 1-498; 15744, SPCS2, 79034, 181484, 22-795; 15744, SPCS2, 79035, 181485, 40-723; 15744, SPCS2, 79030, 181480, 40-720; 15745, SPCS3, 79036, 181486, 114-656; 15746, SPPL2A, 79038, 181488, 1-1070; 15746, SPPL2A, 79039, 181489, 116-564; 15746, SPPL2A, 79037, 181487, 276-1838; 15747, SPPL2B, 79040, 181490, 1-495; 15747, SPPL2B, 79043, 181493, 52-297; 15747, SPPL2B, 79045, 181495, 234-1109; 15747, SPPL2B, 79046, 181496, 38-457; 15747, SPPL2B, 79041, 181491, 81-1859; 15747, SPPL2B, 79042, 181492, 18-1553; 15747, SPPL2B, 79044, 181494, 15-974; 15748, SPPL2C, 79048, 181498, 73-2127; 15748, SPPL2C, 79049, 181499, 73-2127; 15748, SPPL2C, 79047, 181497, 73-2127; 15749, SPPL3, 79051, 181501, 144-636; 15749, SPPL3, 79052, 181502, 202-508; 15749, SPPL3, 79053, 181503, 215-763; 15749, SPPL3, 79054, 181504, 333-531; 15749, SPPL3, 79055, 181505, 308-663; 15749, SPPL3, 79050, 181500, 505-1659; 15750, SCUBE1, 79056, 181506, 63-1106; 15750, SCUBE1, 79058, 181508, 1-524; 15750, SCUBE1, 79059, 181509, 23-1114; 15750, SCUBE1, 79057, 181507, 128-3094; 15751, SCUBE2, 79062, 181512, 72-2987; 15751, SCUBE2, 79063, 181513, 1-359; 15751, SCUBE2, 79064, 181514, 1-514; 15751, SCUBE2, 79065, 181515, 1-575; 15751, SCUBE2, 79066, 181516, 1-337; 15751, SCUBE2, 79060, 181510, 74-3073; 15751, SCUBE2, 79061, 181511, 19-2442; 15752, SCUBE3, 79067, 181517, 1-2982; 15753, SRP14, 79069, 181519, 208-378; 15753, SRP14, 79070, 181520, 38-385; 15753, SRP14, 79071, 181521, 319-489; 15753, SRP14, 79068, 181518, 73-483; 15754, SRP19, 79075, 181525, 46-360; 15754, SRP19, 79076, 181526, 53-415; 15754, SRP19, 79072, 181522, 73-405; 15754, SRP19, 79073, 181523, 156-590; 15754, SRP19, 79074, 181524, 68-304; 15755, SRP54, 79079, 181529, 442-572; 15755, SRP54, 79080, 181530, 145-312; 15755, SRP54, 79081, 181531, 337-558; 15755, SRP54, 79082, 181532, 325-1647; 15755, SRP54, 79084, 181534, 1-162; 15755, SRP54, 79077, 181527, 352-1866; 15755, SRP54, 79078, 181528, 407-1774; 15755, SRP54, 79083, 181533, 398-1912; 15756, SRP68, 79087, 181537, 7-171; 15756, SRP68, 79088, 181538, 17-208; 15756, SRP68, 79090, 181540, 1-165; 15756, SRP68, 79085, 181535, 163-2046; 15756, SRP68, 79086, 181536, 17-1786; 15756, SRP68, 79089, 181539, 240-1106; 15757, SRP72, 79093, 181543, 1-1071; 15757, SRP72, 79094, 181544, 19-681; 15757, SRP72, 79091, 181541, 722-2737; 15757, SRP72, 79092, 181542, 20-1852; 15758, SRP9, 79096, 181546, 7-207; 15758, SRP9, 79099, 181549, 129-329; 15758, SRP9, 79095, 181545, 113-373; 15758, SRP9, 79097, 181547, 105-353; 15758, SRP9, 79098, 181548, 129-377;

15759, SRPR, 79100, 181550, 156-2072; 15759, SRPR, 79101, 181551, 179-2011; 15760, SRPRB, 79102, 181552, 235-512; 15760, SRPRB, 79103, 181553, 1-482; 15760, SRPRB, 79104, 181554, 286-1101; 15761, SSR1, 79106, 181556, 79-954; 15761, SSR1, 79107, 181557, 69-866; 15761, SSR1, 79108, 181558, 63-863; 15761, SSR1, 79109, 181559, 88-984; 15761, SSR1, 79110, 181560, 1-312; 15761, SSR1, 79111, 181561, 55-711; 15761, SSR1, 79105, 181555, 88-948; 15762, SSR2, 79113, 181563, 26-298; 15762, SSR2, 79114, 181564, 60-248; 15762, SSR2, 79116, 181566, 8-351; 15762, SSR2, 79117, 181567, 31-312; 15762, SSR2, 79118, 181568, 45-446; 15762, SSR2, 79119, 181569, 47-307; 15762, SSR2, 79120, 181570, 115-555; 15762, SSR2, 79121, 181571, 28-429; 15762, SSR2, 79112, 181562, 73-624; 15762, SSR2, 79115, 181565, 164-715; 15763, SSR4, 79123, 181573, 15-461; 15763, SSR4, 79122, 181572, 1085-1606; 15763, SSR4, 79124, 181574, 50-571; 15763, SSR4, 79125, 181575, 159-680; 15764, SSR3, 79127, 181577, 133-534; 15764, SSR3, 79128, 181578, 37-561; 15764, SSR3, 79129, 181579, 157-558; 15764, SSR3, 79126, 181576, 96-653; 15764, SSR3, 79130, 181580, 61-657; 15765, STAT1, 79133, 181583, 413-2557; 15765, STAT1, 79135, 181585, 1-121; 15765, STAT1, 79136, 181586, 1-175; 15765, STAT1, 79137, 181587, 367-948; 15765, STAT1, 79138, 181588, 196-736; 15765, STAT1, 79139, 181589, 123-572; 15765, STAT1, 79140, 181590, 359-567; 15765, STAT1, 79141, 181591, 389-970; 15765, STAT1, 79131, 181581, 389-2641; 15765, STAT1, 79132, 181582, 307-2445; 15765, STAT1, 79134, 181584, 433-2685; 15766, STAT2, 79143, 181593, 77-1459; 15766, STAT2, 79145, 181595, 58-255; 15766, STAT2, 79142, 181592, 25-2580; 15766, STAT2, 79144, 181594, 77-2620; 15767, STAT3, 79147, 181597, 320-2338; 15767, STAT3, 79150, 181600, 320-571; 15767, STAT3, 79146, 181596, 314-2626; 15767, STAT3, 79148, 181598, 138-2447; 15767, STAT3, 79149, 181599, 166-2334; 15767, STAT3, 79151, 181601, 206-2518; 15768, STAT4, 79154, 181604, 27-380; 15768, STAT4, 79155, 181605, 258-548; 15768, STAT4, 79156, 181606, 333-569; 15768, STAT4, 79157, 181607, 399-474; 15768, STAT4, 79152, 181602, 259-2505; 15768, STAT4, 79153, 181603, 316-2562; 15769, STAT5A, 79159, 181609, 141-515; 15769, STAT5A, 79161, 181611, 411-835; 15769, STAT5A, 79162, 181612, 67-2358; 15769, STAT5A, 79163, 181613, 135-824; 15769, STAT5A, 79158, 181608, 643-3027; 15769, STAT5A, 79160, 181610, 534-2828; 15769, STAT5A, 79164, 181614, 743-3127; 15770, STAT5B, 79166, 181616, 91-559; 15770, STAT5B, 79165, 181615, 170-2533; 15771, STAT6, 79172, 181622, 1-465; 15771, STAT6, 79173, 181623, 235-351; 15771, STAT6, 79174, 181624, 252-565; 15771, STAT6, 79175, 181625, 477-670; 15771, STAT6, 79176, 181626, 422-644; 15771, STAT6, 79177, 181627, 160-623; 15771, STAT6, 79178, 181628, 141-603; 15771, STAT6, 79179, 181629, 336-644; 15771, STAT6, 79180, 181630, 1-868; 15771, STAT6, 79182, 181632, 247-363; 15771, STAT6, 79183, 181633, 120-553; 15771, STAT6, 79184, 181634, 125-548; 15771, STAT6, 79185, 181635, 184-661; 15771, STAT6, 79167, 181617, 327-2870; 15771, STAT6, 79168, 181618, 287-2830; 15771, STAT6, 79169, 181619, 252-2795; 15771, STAT6, 79170, 181620, 446-2659; 15771, STAT6, 79171, 181621, 294-2507; 15771, STAT6, 79181, 181631, 150-2693; 15772, STAP1, 79186, 181636, 83-970; 15772, STAP1, 79187, 181637, 83-970; 15773, STAP2, 79189, 181639, 1-319; 15773, STAP2, 79190, 181640, 558-875; 15773, STAP2, 79192, 181642, 1-478; 15773, STAP2, 79193, 181643, 57-837; 15773, STAP2, 79188, 181638, 69-1418; 15773, STAP2, 79191, 181641, 125-1336; 15774, STAM, 79194, 181644, 209-729; 15774, STAM, 79196, 181646, 133-261; 15774, STAM, 79195, 181645, 216-1838; 15775, STAM2, 79197, 181647, 351-1928; 15776, SIPA1, 79200, 181650, 248-3070; 15776, SIPA1, 79201, 181651, 361-379; 15776, SIPA1, 79203, 181653, 255-562; 15776, SIPA1, 79204, 181654, 123-2945; 15776, SIPA1, 79198, 181648, 297-3425; 15776, SIPA1, 79199, 181649, 123-3251; 15776, SIPA1, 79202, 181652, 178-3306; 15777, SIPA1L1, 79207, 181657, 176-3949; 15777, SIPA1L1, 79209, 181659, 648-744; 15777, SIPA1L1, 79210, 181660, 1-785; 15777, SIPA1L1, 79205, 181655, 951-6299; 15777, SIPA1L1, 79206, 181656, 349-5700; 15777, SIPA1L1, 79208, 181658, 349-5763; 15778, SIPA1L2, 79211, 181661, 228-5396; 15778, SIPA1L2, 79212, 181662, 184-2520; 15778, SIPA1L2, 79213, 181663, 360-5528; 15779, SIPA1L3, 79215, 181665, 1-496; 15779, SIPA1L3, 79216, 181666, 19-572; 15779, SIPA1L3, 79214, 181664, 510-5855; 15780, SLAMF1, 79217, 181667, 351-785; 15780, SLAMF1, 79219, 181669, 14-1087; 15780, SLAMF1, 79218, 181668, 351-1358; 15781, SIT1, 79221, 181671, 98-772; 15781, SIT1, 79220, 181670, 88-678; 15782, SIRPA, 79222, 181672, 24-1538; 15782, SIRPA, 79223, 181673, 153-1667; 15782, SIRPA, 79224, 181674, 361-1875; 15782, SIRPA, 79225, 181675, 20-1546; 15783, SIRPB1, 79226, 181676, 1-543; 15783, SIRPB1, 79230, 181680, 1-711; 15783, SIRPB1, 79231, 181681, 116-583; 15783, SIRPB1, 79232, 181682, 1-234; 15783, SIRPB1, 79233, 181683, 1-395; 15783, SIRPB1, 79235, 181685, 1-177; 15783, SIRPB1, 79236, 181686, 1-234; 15783, SIRPB1, 79237, 181687, 1-549; 15783, SIRPB1, 79238, 181688, 1-234; 15783, SIRPB1, 79228, 181678, 53-598; 15783, SIRPB1, 79229, 181679, 66-1262; 15783, SIRPB1, 79227, 181677, 66-1262; 15783, SIRPB1, 79234, 181684, 66-1262; 15784, SIRPB2, 79241, 181691, 160-1029; 15784, SIRPB2, 79242, 181692, 229-1098; 15784, SIRPB2, 79243, 181693, 55-315; 15784, SIRPB2, 79239, 181689, 38-1066; 15784, SIRPB2, 79240, 181690, 123-857; 15785, SIRPD, 79244, 181694, 53-649; 15785, SIRPD, 79246, 181696, 1-242; 15785, SIRPD, 79245, 181695, 1191-1784; 15786, SIRPG, 79247, 181697, 1-831; 15786, SIRPG, 79248, 181698, 66-1229; 15786, SIRPG, 79249, 181699, 43-555; 15786, SIRPG, 79250, 181700, 181-1245; 15786, SIRPG, 79251, 181701, 66-896; 15787, SIK3, 79252, 181702, 7-3972; 15787, SIK3, 79253, 181703, 23-3808; 15787, SIK3, 79254, 181704, 1-4090; 15787, SIK3, 79255, 181705, 1-456; 15787, SIK3, 79256, 181706, 1-214; 15787, SIK3, 79257, 181707, 1-1519; 15788, SIL1, 79260, 181710, 207-581; 15788, SIL1, 79261, 181711, 159-442; 15788, SIL1, 79262, 181712, 203-572; 15788, SIL1, 79263, 181713, 1-250; 15788, SIL1, 79264, 181714, 126-496; 15788, SIL1, 79265, 181715, 214-1620; 15788, SIL1, 79266, 181716, 187-675; 15788, SIL1, 79258, 181708, 147-1532; 15788, SIL1, 79259, 181709, 141-1526; 15789, SIN3A, 79270, 181720, 456-510; 15789, SIN3A, 79271, 181721, 175-565; 15789, SIN3A, 79272, 181722, 165-590; 15789, SIN3A, 79273, 181723, 89-617; 15789, SIN3A, 79274, 181724, 229-549; 15789, SIN3A, 79275, 181725, 185-554; 15789, SIN3A, 79276, 181726, 276-746; 15789, SIN3A, 79277, 181727, 274-567; 15789, SIN3A, 79267, 181717, 183-4004; 15789, SIN3A, 79268, 181718, 316-4137; 15789, SIN3A, 79269, 181719, 260-4081; 15790, SIN3B, 79280, 181730, 371-2533; 15790, SIN3B, 79281, 181731, 1-929; 15790, SIN3B, 79278, 181728, 22-3414; 15790, SIN3B, 79279, 181729, 15-3503; 15790, SIN3B, 79282, 181732, 15-1076; 15791, SAP130, 79283, 181733, 188-3358; 15791, SAP130, 79286, 181736, 63-849; 15791, SAP130, 79287, 181737, 127-559; 15791, SAP130, 79284, 181734, 131-3277; 15791, SAP130, 79285, 181735, 133-3384; 15792, SAP18, 79288, 181738, 40-558; 15792, SAP18, 79289, 181739, 50-479; 15792, SAP18, 79290, 181740, 1-237; 15792, SAP18, 79291, 181741, 1-178; 15792, SAP18, 79293, 181743, 40-558; 15792, SAP18, 79292, 181742, 33-494; 15793, SAP25, 79296, 181746, 79-972; 15793, SAP25, 79294, 181744, 179-778; 15793, SAP25, 79295, 181745, 357-956; 15794, SAP30, 79297, 181747, 241-903; 15795, SOBP, 79299, 181749, 14-463; 15795, SOBP, 79298, 181748, 660-3281; 15796, SIGIRR, 79303, 181753, 387-557; 15796, SIGIRR, 79304, 181754, 104-1618; 15796, SIGIRR, 79305, 181755, 1-428; 15796, SIGIRR, 79306, 181756, 280-709; 15796, SIGIRR, 79307, 181757, 1-393; 15796, SIGIRR, 79308, 181758, 367-933; 15796, SIGIRR, 79300, 181750, 227-1459; 15796, SIGIRR, 79301, 181751, 186-1418; 15796, SIGIRR, 79302, 181752, 308-1540; 15797, SSBP3, 79312, 181762, 1-471; 15797, SSBP3, 79313, 181763, 331-1167; 15797, SSBP3, 79314, 181764, 399-701; 15797, SSBP3, 79315, 181765, 412-1494; 15797, SSBP3, 79309, 181759, 216-1322; 15797, SSBP3, 79310, 181760, 1-1086; 15797, SSBP3, 79311, 181761, 412-1578; 15798, SSBP4, 79318, 181768, 26-187; 15798, SSBP4, 79319, 181769, 1-619; 15798, SSBP4, 79320, 181770, 162-865; 15798, SSBP4, 79321, 181771, 438-606; 15798, SSBP4, 79322, 181772, 270-622; 15798, SSBP4, 79323, 181773, 44-208; 15798, SSBP4, 79324, 181774, 262-477; 15798, SSBP4, 79325, 181775, 1-162; 15798, SSBP4, 79316, 181766, 314-1405; 15798, SSBP4, 79317, 181767, 295-1452; 15799, SIM1, 79326, 181776, 210-2510; 15799, SIM1, 79327, 181777, 784-3084; 15800, SIM2, 79329, 181779, 1-1441; 15800, SIM2, 79330, 181780, 1-222; 15800, SIM2, 79328, 181778, 614-2617; 15801, SMDT1, 79332, 181782, 79-252; 15801, SMDT1, 79335, 181785, 79-252; 15801, SMDT1, 79337, 181787, 79-252; 15801, SMDT1, 79338, 181788, 79-252; 15801, SMDT1, 79331, 181781, 75-398; 15801, SMDT1, 79333, 181783, 75-398; 15801, SMDT1, 79334, 181784, 75-398; 15801, SMDT1, 79336, 181786, 75-398; 15802, SMCO1, 79340, 181790, 138-248; 15802, SMCO1, 79339, 181789, 158-802; 15803, SMCO2, 79341, 181791, 177-1058; 15803, SMCO2, 79342, 181792, 177-1208; 15803, SMCO2, 79343, 181793, 1-1032; 15804, SMCO3, 79344, 181794, 74-751; 15805, SMCO4, 79347, 181797, 200-355; 15805, SMCO4, 79349, 181799, 234-374; 15805, SMCO4, 79345, 181795, 387-566; 15805, SMCO4, 79346, 181796, 172-351; 15805, SMCO4, 79348, 181798, 224-403; 15805, SMCO4, 79350, 181800, 1-180; 15806, SSBP1, 79352, 181802, 224-630; 15806, SSBP1, 79353, 181803, 386-470; 15806, SSBP1, 79356, 181806, 237-600; 15806, SSBP1, 79359, 181809, 386-470; 15806, SSBP1, 79364, 181814, 224-626; 15806, SSBP1, 79365, 181815, 237-600; 15806, SSBP1, 79351, 181801, 134-580; 15806, SSBP1, 79354, 181804, 123-569; 15806, SSBP1, 79355, 181805, 190-636; 15806, SSBP1, 79357, 181807, 436-882; 15806, SSBP1, 79358, 181808, 55-501; 15806, SSBP1, 79360, 181810, 55-457; 15806, SSBP1, 79361, 181811, 436-838; 15806, SSBP1, 79362, 181812, 190-592; 15806, SSBP1, 79363, 181813, 134-536; 15806, SSBP1, 79366, 181816, 123-525; 15806, SSBP1, 79367, 181817, 304-750; 15807, SSBP2, 79369, 181819, 84-709; 15807, SSBP2, 79372, 181822, 1-795; 15807, SSBP2, 79374, 181824, 1-828; 15807, SSBP2, 79376, 181826, 212-1321; 15807, SSBP2, 79377, 181827, 185-1129; 15807, SSBP2, 79368, 181818, 212-1297; 15807, SSBP2, 79370, 181820, 7-903; 15807, SSBP2, 79371, 181821, 6-1031; 15807, SSBP2, 79373, 181823, 56-1075; 15807, SSBP2, 79375, 181825, 209-1204; 15808, SMUG1, 79383, 181833, 184-470; 15808, SMUG1, 79384, 181834, 124-504; 15808, SMUG1, 79385, 181835, 235-751; 15808, SMUG1, 79386, 181836, 142-465; 15808, SMUG1, 79389, 181839, 296-541; 15808, SMUG1, 79390, 181840, 50-529; 15808, SMUG1, 79391, 181841, 1-431; 15808, SMUG1, 79392, 181842, 302-572; 15808, SMUG1, 79393, 181843, 165-650; 15808, SMUG1, 79378, 181828, 46-579; 15808, SMUG1, 79379, 181829, 131-943; 15808, SMUG1, 79380, 181830, 128-940; 15808, SMUG1, 79381, 181831, 327-860; 15808, SMUG1, 79382, 181832, 113-646; 15808, SMUG1, 79387, 181837, 425-958; 15808, SMUG1, 79388, 181838, 64-876; 15809, SIRT1, 79395, 181845, 206-1540; 15809, SIRT1, 79396, 181846, 164-1498; 15809, SIRT1, 79397, 181847, 433-1791; 15809, SIRT1, 79394, 181844, 54-2297; 15810, SIRT2, 79399, 181849, 406-1110; 15810, SIRT2, 79401, 181851, 383-890; 15810, SIRT2, 79402, 181852, 320-555; 15810, SIRT2, 79403, 181853, 222-557; 15810, SIRT2, 79404, 181854, 459-848; 15810, SIRT2, 79405, 181855, 539-1251; 15810, SIRT2, 79406, 181856, 146-265; 15810, SIRT2, 79407, 181857, 359-578; 15810, SIRT2, 79408, 181858, 125-283; 15810, SIRT2, 79409, 181859, 191-481; 15810, SIRT2, 79410, 181860, 1-1170; 15810, SIRT2, 79411, 181861, 406-1464; 15810, SIRT2, 79412, 181862, 406-1110; 15810, SIRT2, 79413, 181863, 1-1170; 15810, SIRT2, 79414, 181864, 222-557; 15810, SIRT2, 79415, 181865, 459-848; 15810, SIRT2, 79416, 181866, 359-578; 15810, SIRT2, 79417, 181867, 125-283; 15810, SIRT2, 79418, 181868, 146-265; 15810, SIRT2, 79419, 181869, 320-555; 15810, SIRT2, 79420, 181870, 539-1251; 15810, SIRT2, 79421, 181871, 383-890; 15810, SIRT2, 79422, 181872, 191-481; 15810, SIRT2, 79423, 181873, 303-1472; 15810, SIRT2, 79398, 181848, 303-1472; 15810, SIRT2, 79400, 181850, 406-1464; 15811, SIRT3, 79425, 181875, 484-763; 15811, SIRT3, 79426, 181876, 27-1088; 15811, SIRT3, 79427, 181877, 25-1062; 15811, SIRT3, 79428, 181878, 295-365; 15811, SIRT3, 79429, 181879, 16-156; 15811, SIRT3, 79430, 181880, 10-414; 15811, SIRT3, 79431, 181881, 18-158; 15811, SIRT3, 79432, 181882, 27-983; 15811, SIRT3, 79433, 181883, 3-290; 15811, SIRT3, 79434, 181884, 377-430; 15811, SIRT3, 79435, 181885, 12-152; 15811, SIRT3, 79424, 181874, 104-1303; 15811, SIRT3, 79436, 181886, 365-1138; 15812, SIRT4, 79438, 181888, 212-531; 15812, SIRT4, 79437, 181887, 60-1004; 15813, SIRT5, 79440, 181890, 236-475; 15813, SIRT5, 79443, 181893, 221-346; 15813, SIRT5, 79439, 181889, 226-1104; 15813, SIRT5, 79441, 181891, 219-1118; 15813, SIRT5, 79442, 181892, 481-1089; 15813, SIRT5, 79444, 181894, 297-1229; 15814, SIRT6, 79447, 181897, 9-572; 15814, SIRT6, 79448, 181898, 1-827; 15814, SIRT6, 79449, 181899, 27-158; 15814, SIRT6, 79450, 181900, 1-561; 15814, SIRT6, 79451, 181901, 220-750; 15814, SIRT6, 79452, 181902, 6-137; 15814, SIRT6, 79445, 181895, 12-998; 15814, SIRT6, 79446, 181896, 66-1133; 15815, SIRT7, 79454, 181904, 6-356; 15815, SIRT7, 79455, 181905, 460-909; 15815, SIRT7, 79453, 181903, 64-1266; 15816, SIVA1, 79458, 181908, 32-541; 15816, SIVA1, 79459, 181909, 43-550; 15816, SIVA1, 79460, 181910, 309-581; 15816, SIVA1, 79461, 181911, 56-529; 15816, SIVA1, 79456, 181906, 103-630; 15816, SIVA1, 79457, 181907, 44-376; 15817, SIX1, 79463, 181913, 37-372; 15817, SIX1, 79462, 181912, 274-1128; 15818, SIX2, 79464, 181914, 321-1196; 15819, SIX3, 79465, 181915, 208-1206; 15820, SIX4, 79467, 181917, 91-1573; 15820, SIX4, 79466, 181916, 61-2406; 15821, SIX5, 79469, 181919, 12-221; 15821, SIX5, 79470, 181920, 1-767; 15821, SIX5, 79471, 181921, 210-686; 15821, SIX5, 79468, 181918, 383-2602; 15822, SIX6, 79472, 181922, 449-1189;

15823, STEAP1, 79474, 181924, 1-304; 15823, STEAP1, 79473, 181923, 201-1220; 15824, SSB, 79477, 181927, 108-512; 15824, SSB, 79478, 181928, 186-545; 15824, SSB, 79479, 181929, 1910-2463; 15824, SSB, 79475, 181925, 175-1401; 15824, SSB, 79476, 181926, 248-1474; 15825, SSNA1, 79481, 181931, 22-267; 15825, SSNA1, 79480, 181930, 81-440; 15826, SSSCA1, 79483, 181933, 6-251; 15826, SSSCA1, 79484, 181934, 212-394; 15826, SSSCA1, 79485, 181935, 237-725; 15826, SSSCA1, 79486, 181936, 1-582; 15826, SSSCA1, 79487, 181937, 1-323; 15826, SSSCA1, 79482, 181932, 63-662; 15827, SKOR1, 79490, 181940, 115-2895; 15827, SKOR1, 79491, 181941, 88-2901; 15827, SKOR1, 79488, 181938, 1-2607; 15827, SKOR1, 79489, 181939, 59-2956; 15828, SKOR2, 79494, 181944, 1-3048; 15828, SKOR2, 79492, 181942, 1-891; 15828, SKOR2, 79493, 181943, 1-3006; 15829, SKI, 79495, 181945, 73-2259; 15830, SKIDA1, 79496, 181946, 2254-4980; 15830, SKIDA1, 79497, 181947, 98-2587; 15831, SKIV2L, 79504, 181954, 1-547; 15831, SKIV2L, 79505, 181955, 37-729; 15831, SKIV2L, 79506, 181956, 1-469; 15831, SKIV2L, 79507, 181957, 23-232; 15831, SKIV2L, 79508, 181958, 1-210; 15831, SKIV2L, 79509, 181959, 1-210; 15831, SKIV2L, 79510, 181960, 1-210; 15831, SKIV2L, 79511, 181961, 1-210; 15831, SKIV2L, 79512, 181962, 1-210; 15831, SKIV2L, 79513, 181963, 1-210; 15831, SKIV2L, 79498, 181948, 114-3854; 15831, SKIV2L, 79499, 181949, 114-3854; 15831, SKIV2L, 79500, 181950, 114-3854; 15831, SKIV2L, 79501, 181951, 114-3854; 15831, SKIV2L, 79502, 181952, 114-3854; 15831, SKIV2L, 79503, 181953, 114-3854; 15832, SKIL, 79518, 181968, 239-607; 15832, SKIL, 79519, 181969, 1-335; 15832, SKIL, 79514, 181964, 672-2726; 15832, SKIL, 79515, 181965, 710-2626; 15832, SKIL, 79516, 181966, 233-2227; 15832, SKIL, 79517, 181967, 710-2764; 15833, SLAIN1, 79520, 181970, 32-1081; 15833, SLAIN1, 79522, 181972, 458-1372; 15833, SLAIN1, 79524, 181974, 335-572; 15833, SLAIN1, 79525, 181975, 139-472; 15833, SLAIN1, 79526, 181976, 215-829; 15833, SLAIN1, 79527, 181977, 61-1833; 15833, SLAIN1, 79528, 181978, 215-899; 15833, SLAIN1, 79529, 181979, 312-1033; 15833, SLAIN1, 79530, 181980, 496-531; 15833, SLAIN1, 79532, 181982, 129-570; 15833, SLAIN1, 79534, 181984, 325-622; 15833, SLAIN1, 79535, 181985, 171-576; 15833, SLAIN1, 79521, 181971, 521-1096; 15833, SLAIN1, 79523, 181973, 151-1068; 15833, SLAIN1, 79531, 181981, 44-1324; 15833, SLAIN1, 79533, 181983, 27-1733; 15834, SLAIN2, 79537, 181987, 1-508; 15834, SLAIN2, 79538, 181988, 37-1281; 15834, SLAIN2, 79539, 181989, 10-186; 15834, SLAIN2, 79536, 181986, 419-2164; 15835, SLAMF6, 79540, 181990, 51-716; 15835, SLAMF6, 79541, 181991, 62-1060; 15835, SLAMF6, 79542, 181992, 71-1066; 15836, SLAMF7, 79546, 181996, 246-695; 15836, SLAMF7, 79550, 182000, 1-708; 15836, SLAMF7, 79551, 182001, 246-971; 15836, SLAMF7, 79543, 181993, 12-902; 15836, SLAMF7, 79544, 181994, 35-721; 15836, SLAMF7, 79545, 181995, 38-1045; 15836, SLAMF7, 79547, 181997, 246-860; 15836, SLAMF7, 79548, 181998, 246-812; 15836, SLAMF7, 79549, 181999, 246-743; 15837, SLAMF8, 79552, 182002, 150-1007; 15837, SLAMF8, 79553, 182003, 89-619; 15838, SLAMF9, 79554, 182004, 84-680; 15838, SLAMF9, 79555, 182005, 118-987; 15839, SLC2A4RG, 79556, 182006, 53-1216; 15840, SSH1, 79559, 182009, 122-583; 15840, SSH1, 79560, 182010, 1-287; 15840, SSH1, 79561, 182011, 18-131; 15840, SSH1, 79557, 182007, 95-3244; 15840, SSH1, 79558, 182008, 147-2258; 15840, SSH1, 79562, 182012, 95-2173; 15841, SSH2, 79564, 182014, 94-4446; 15841, SSH2, 79565, 182015, 159-305; 15841, SSH2, 79566, 182016, 174-511; 15841, SSH2, 79567, 182017, 1-350; 15841, SSH2, 79568, 182018, 229-375; 15841, SSH2, 79569, 182019, 214-574; 15841, SSH2, 79570, 182020, 63-191; 15841, SSH2, 79563, 182013, 153-4424; 15842, SSH3, 79571, 182021, 147-1331; 15842, SSH3, 79575, 182025, 97-222; 15842, SSH3, 79576, 182026, 1-656; 15842, SSH3, 79577, 182027, 1-948; 15842, SSH3, 79572, 182022, 179-2158; 15842, SSH3, 79573, 182023, 731-2272; 15842, SSH3, 79574, 182024, 1-1416; 15843, SLITRK1, 79578, 182028, 887-2977; 15844, SLITRK2, 79579, 182029, 988-3159; 15844, SLITRK2, 79580, 182030, 4256-6793; 15845, SLITRK3, 79582, 182032, 98-585; 15845, SLITRK3, 79581, 182031, 283-3216; 15845, SLITRK3, 79583, 182033, 445-3378; 15846, SLITRK4, 79584, 182034, 377-2890; 15846, SLITRK4, 79585, 182035, 94-2607; 15846, SLITRK4, 79586, 182036, 227-2740; 15847, SLITRK5, 79587, 182037, 220-3096; 15848, SLITRK6, 79588, 182038, 600-3125; 15849, SLIT1, 79590, 182040, 1-2345; 15849, SLIT1, 79591, 182041, 247-1476; 15849, SLIT1, 79592, 182042, 85-4470; 15849, SLIT1, 79589, 182039, 247-4851; 15850, SLIT2, 79593, 182043, 227-4855; 15850, SLIT2, 79594, 182044, 130-767; 15850, SLIT2, 79597, 182047, 1-248; 15850, SLIT2, 79598, 182048, 1-589; 15850, SLIT2, 79599, 182049, 95-532; 15850, SLIT2, 79601, 182051, 511-4830; 15850, SLIT2, 79595, 182045, 1-4578; 15850, SLIT2, 79596, 182046, 253-4842; 15850, SLIT2, 79600, 182050, 557-5122; 15851, SLIT3, 79603, 182053, 1-4182; 15851, SLIT3, 79602, 182052, 74-4666; 15851, SLIT3, 79604, 182054, 421-4992; 15852, SRGAP1, 79606, 182056, 1476-4544; 15852, SRGAP1, 79607, 182057, 177-3245; 15852, SRGAP1, 79605, 182055, 525-3782; 15853, SRGAP2, 79608, 182058, 449-1366; 15853, SRGAP2, 79609, 182059, 145-498; 15853, SRGAP2, 79610, 182060, 63-3278; 15853, SRGAP2, 79611, 182061, 299-2668; 15853, SRGAP2, 79612, 182062, 849-1108; 15853, SRGAP2, 79613, 182063, 1-1353; 15853, SRGAP2, 79614, 182064, 1-673; 15853, SRGAP2, 79615, 182065, 1-884; 15853, SRGAP2, 79616, 182066, 63-3275; 15854, SRGAP2B, 79618, 182068, 449-1366; 15854, SRGAP2B, 79619, 182069, 1-131; 15854, SRGAP2B, 79617, 182067, 849-2225; 15855, SRGAP2C, 79621, 182071, 449-1366; 15855, SRGAP2C, 79620, 182070, 858-2237; 15856, SRGAP3, 79624, 182074, 344-1361; 15856, SRGAP3, 79622, 182072, 263-3490; 15856, SRGAP3, 79623, 182073, 429-3728; 15857, SCIMP, 79626, 182076, 106-498; 15857, SCIMP, 79625, 182075, 106-522; 15857, SCIMP, 79627, 182077, 69-440; 15857, SCIMP, 79628, 182078, 106-543; 15858, SLU7, 79630, 182080, 503-807; 15858, SLU7, 79631, 182081, 138-568; 15858, SLU7, 79632, 182082, 206-577; 15858, SLU7, 79629, 182079, 389-2149; 15859, SLX1A, 79635, 182085, 137-382; 15859, SLX1A, 79633, 182083, 169-996; 15859, SLX1A, 79634, 182084, 182-667; 15860, SLX1B, 79638, 182088, 136-400; 15860, SLX1B, 79636, 182086, 243-1070; 15860, SLX1B, 79637, 182087, 182-667; 15861, SLX4IP, 79640, 182090, 1-236; 15861, SLX4IP, 79639, 182089, 181-1407; 15862, SLX4, 79641, 182091, 642-6146; 15863, SMAD1, 79644, 182094, 392-421; 15863, SMAD1, 79645, 182095, 399-573; 15863, SMAD1, 79646, 182096, 272-558; 15863, SMAD1, 79647, 182097, 298-616; 15863, SMAD1, 79648, 182098, 232-569; 15863, SMAD1, 79650, 182100, 448-847; 15863, SMAD1, 79642, 182092, 424-1821; 15863, SMAD1, 79643, 182093, 241-1638; 15863, SMAD1, 79649, 182099, 543-1940; 15864, SMAD2, 79654, 182104, 178-828; 15864, SMAD2, 79655, 182105, 200-527; 15864, SMAD2, 79657, 182107, 391-

1042; 15864, SMAD2, 79658, 182108, 97-1392; 15864, SMAD2, 79659, 182109, 165-575; 15864, SMAD2, 79660, 182110, 338-663; 15864, SMAD2, 79651, 182101, 253-1656; 15864, SMAD2, 79652, 182102, 401-1714; 15864, SMAD2, 79653, 182103, 396-1799; 15864, SMAD2, 79656, 182106, 56-1369; 15865, SMAD3, 79665, 182115, 215-552; 15865, SMAD3, 79666, 182116, 292-568; 15865, SMAD3, 79667, 182117, 398-586; 15865, SMAD3, 79668, 182118, 293-583; 15865, SMAD3, 79669, 182119, 302-554; 15865, SMAD3, 79670, 182120, 200-542; 15865, SMAD3, 79671, 182121, 1-470; 15865, SMAD3, 79672, 182122, 159-797; 15865, SMAD3, 79661, 182111, 311-1588; 15865, SMAD3, 79662, 182112, 27-1172; 15865, SMAD3, 79663, 182113, 379-1341; 15865, SMAD3, 79664, 182114, 229-921; 15866, SMAD4, 79675, 182125, 124-544; 15866, SMAD4, 79676, 182126, 1-1371; 15866, SMAD4, 79677, 182127, 221-582; 15866, SMAD4, 79678, 182128, 400-779; 15866, SMAD4, 79679, 182129, 1-249; 15866, SMAD4, 79680, 182130, 305-576; 15866, SMAD4, 79681, 182131, 539-992; 15866, SMAD4, 79682, 182132, 1-963; 15866, SMAD4, 79683, 182133, 1-661; 15866, SMAD4, 79673, 182123, 539-2197; 15866, SMAD4, 79674, 182124, 259-1917; 15867, SMAD5, 79684, 182134, 307-548; 15867, SMAD5, 79685, 182135, 445-847; 15867, SMAD5, 79686, 182136, 286-669; 15867, SMAD5, 79687, 182137, 59-61; 15867, SMAD5, 79688, 182138, 59-61; 15867, SMAD5, 79689, 182139, 1-523; 15867, SMAD5, 79690, 182140, 1-182; 15867, SMAD5, 79691, 182141, 363-1760; 15867, SMAD5, 79692, 182142, 286-1683; 15868, SMAD6, 79694, 182144, 1-168; 15868, SMAD6, 79696, 182146, 1-189; 15868, SMAD6, 79693, 182143, 1032-2522; 15868, SMAD6, 79695, 182145, 1-1017; 15869, SMAD7, 79698, 182148, 101-574; 15869, SMAD7, 79697, 182147, 288-1568; 15869, SMAD7, 79699, 182149, 138-773; 15869, SMAD7, 79700, 182150, 1-1278; 15870, SMAD9, 79701, 182151, 310-1602; 15870, SMAD9, 79702, 182152, 344-1747; 15870, SMAD9, 79703, 182153, 141-1544; 15871, SNIP1, 79704, 182154, 74-1264; 15872, SMURF1, 79705, 182155, 321-2594; 15872, SMURF1, 79706, 182156, 240-2435; 15873, SMURF2, 79708, 182158, 18-185; 15873, SMURF2, 79709, 182159, 33-1716; 15873, SMURF2, 79710, 182160, 49-255; 15873, SMURF2, 79707, 182157, 189-2435; 15874, SMAP1, 79714, 182164, 1-376; 15874, SMAP1, 79715, 182165, 393-578; 15874, SMAP1, 79716, 182166, 100-1473; 15874, SMAP1, 79711, 182161, 249-1571; 15874, SMAP1, 79712, 182162, 249-1559; 15874, SMAP1, 79713, 182163, 249-1652; 15875, SMAP2, 79719, 182169, 144-666; 15875, SMAP2, 79721, 182171, 73-1347; 15875, SMAP2, 79717, 182167, 49-1248; 15875, SMAP2, 79718, 182168, 425-1714; 15875, SMAP2, 79720, 182170, 229-1278; 15876, SMAGP, 79722, 182172, 43-156; 15876, SMAGP, 79724, 182174, 461-610; 15876, SMAGP, 79725, 182175, 415-543; 15876, SMAGP, 79727, 182177, 165-293; 15876, SMAGP, 79729, 182179, 130-381; 15876, SMAGP, 79723, 182173, 179-472; 15876, SMAGP, 79726, 182176, 672-965; 15876, SMAGP, 79728, 182178, 674-967; 15877, SERF1A, 79732, 182182, 107-352; 15877, SERF1A, 79733, 182183, 97-324; 15877, SERF1A, 79734, 182184, 208-354; 15877, SERF1A, 79735, 182185, 267-328; 15877, SERF1A, 79736, 182186, 265-532; 15877, SERF1A, 79737, 182187, 192-482; 15877, SERF1A, 79739, 182189, 179-325; 15877, SERF1A, 79740, 182190, 97-324; 15877, SERF1A, 79741, 182191, 208-354; 15877, SERF1A, 79742, 182192, 265-532; 15877, SERF1A, 79743, 182193, 238-528; 15877, SERF1A, 79745, 182195, 107-352; 15877, SERF1A, 79730, 182180, 206-394; 15877, SERF1A, 79731, 182181, 184-516; 15877, SERF1A, 79738, 182188, 184-516; 15877, SERF1A, 79744, 182194, 206-394; 15877, SERF1A, 79746, 182196, 1-333; 15878, SERF1B, 79749, 182199, 80-325; 15878, SERF1B, 79750, 182200, 97-324; 15878, SERF1B, 79751, 182201, 234-524; 15878, SERF1B, 79752, 182202, 80-325; 15878, SERF1B, 79753, 182203, 234-524; 15878, SERF1B, 79756, 182206, 265-338; 15878, SERF1B, 79758, 182208, 181-327; 15878, SERF1B, 79760, 182210, 179-325; 15878, SERF1B, 79761, 182211, 97-324; 15878, SERF1B, 79762, 182212, 267-328; 15878, SERF1B, 79763, 182213, 107-352; 15878, SERF1B, 79764, 182214, 208-354; 15878, SERF1B, 79765, 182215, 97-324; 15878, SERF1B, 79766, 182216, 265-532; 15878, SERF1B, 79767, 182217, 192-482; 15878, SERF1B, 79747, 182197, 184-516; 15878, SERF1B, 79748, 182198, 206-394; 15878, SERF1B, 79754, 182204, 184-516; 15878, SERF1B, 79755, 182205, 206-394; 15878, SERF1B, 79757, 182207, 206-394; 15878, SERF1B, 79759, 182209, 184-516; 15879, SERF2, 79773, 182223, 24-146; 15879, SERF2, 79774, 182224, 48-299; 15879, SERF2, 79776, 182226, 73-201; 15879, SERF2, 79778, 182228, 24-350; 15879, SERF2, 79779, 182229, 271-483; 15879, SERF2, 79781, 182231, 536-862; 15879, SERF2, 79768, 182218, 536-715; 15879, SERF2, 79769, 182219, 31-432; 15879, SERF2, 79770, 182220, 930-1109; 15879, SERF2, 79771, 182221, 280-417; 15879, SERF2, 79772, 182222, 247-384; 15879, SERF2, 79775, 182225, 172-309; 15879, SERF2, 79777, 182227, 48-560; 15879, SERF2, 79780, 182230, 41-220; 15880, SGSM1, 79784, 182234, 158-3421; 15880, SGSM1, 79782, 182232, 58-3339; 15880, SGSM1, 79783, 182233, 8-3454; 15881, SGSM2, 79788, 182238, 192-281; 15881, SGSM2, 79789, 182239, 107-392; 15881, SGSM2, 79790, 182240, 1-110; 15881, SGSM2, 79791, 182241, 1-343; 15881, SGSM2, 79792, 182242, 1-213; 15881, SGSM2, 79793, 182243, 184-1134; 15881, SGSM2, 79785, 182235, 178-3333; 15881, SGSM2, 79786, 182236, 176-3196; 15881, SGSM2, 79787, 182237, 68-3031; 15882, SGSM3, 79795, 182245, 328-1086; 15882, SGSM3, 79796, 182246, 1-639; 15882, SGSM3, 79797, 182247, 1-307; 15882, SGSM3, 79794, 182244, 190-2439; 15883, SGTA, 79799, 182249, 151-637; 15883, SGTA, 79800, 182250, 637-841; 15883, SGTA, 79798, 182248, 163-1104; 15884, SGTB, 79802, 182252, 302-887; 15884, SGTB, 79801, 182251, 237-1151; 15885, SMIM1, 79803, 182253, 195-308; 15885, SMIM1, 79805, 182255, 433-447; 15885, SMIM1, 79804, 182254, 249-485; 15886, SMIM10, 79806, 182256, 159-410; 15887, SMIM10L1, 79807, 182257, 136-342; 15888, SMIM10L2A, 79808, 182258, 190-426; 15889, SMIM10L2B, 79809, 182259, 2-238; 15890, SMIM11A, 79812, 182262, 146-352; 15890, SMIM11A, 79810, 182260, 146-322; 15890, SMIM11A, 79811, 182261, 371-547; 15891, SMIM11B, 79814, 182264, 134-340; 15891, SMIM11B, 79813, 182263, 142-318; 15891, SMIM11B, 79815, 182265, 146-322; 15891, SMIM11B, 79816, 182266, 690-866; 15891, SMIM11B, 79817, 182267, 371-547; 15891, SMIM11B, 79818, 182268, 78-254; 15892, SMIM12, 79822, 182272, 65-289; 15892, SMIM12, 79819, 182269, 396-674; 15892, SMIM12, 79820, 182270, 146-424; 15892, SMIM12, 79821, 182271, 269-547; 15892, SMIM12, 79823, 182273, 110-388; 15892, SMIM12, 79824, 182274, 1890-2168; 15893, SMIM13, 79825, 182275, 282-557; 15893, SMIM13, 79826, 182276, 84-359; 15894, SMIM14, 79828, 182278, 191-355; 15894, SMIM14, 79829, 182279, 345-612; 15894, SMIM14, 79830, 182280, 143-259; 15894, SMIM14, 79827, 182277, 388-687; 15895, SMIM15, 79831, 182281, 427-651; 15895, SMIM15, 79832, 182282, 335-559; 15896, SMIM17, 79834, 182284, 149-460; 15896, SMIM17, 79833, 182283, 167-523; 15897, SMIM18, 79836, 182286, 1-114; 15897, SMIM18, 79835, 182285, 151-438; 15898, SMIM19, 79842, 182292, 125-233; 15898, SMIM19, 79843, 182293, 53-313; 15898, SMIM19, 79837, 182287, 368-691; 15898, SMIM19, 79838, 182288, 50-373; 15898, SMIM19, 79839, 182289, 771-1094; 15898, SMIM19, 79840, 182290, 98-421; 15898, SMIM19, 79841, 182291, 46-369; 15899, SMIM2, 79844, 182294, 190-447; 15899, SMIM2, 79845, 182295, 1-255; 15900, SMIM20, 79847, 182297, 6-152; 15900, SMIM20, 79846, 182296, 111-314; 15900, SMIM20, 79848, 182298, 1-507; 15901, SMIM21, 79849, 182299, 72-305; 15901, SMIM21, 79851, 182301, 120-383; 15901, SMIM21, 79850, 182300, 141-446; 15902, SMIM22, 79852, 182302, 93-344; 15902, SMIM22, 79853, 182303, 50-316; 15902, SMIM22, 79854, 182304, 33-440; 15902, SMIM22, 79855, 182305, 23-289; 15902, SMIM22, 79856, 182306, 521-772; 15902, SMIM22, 79857, 182307, 56-307; 15902, SMIM22, 79858, 182308, 313-579; 15902, SMIM22, 79859, 182309, 521-787; 15902, SMIM22, 79860, 182310, 521-928; 15903, SMIM23, 79862, 182312, 1-366; 15903, SMIM23, 79861, 182311, 1-468; 15904, SMIM24, 79864, 182314, 303-485; 15904, SMIM24, 79865, 182315, 42-224; 15904, SMIM24, 79863, 182313, 80-472; 15905, SMIM3, 79866, 182316, 1039-1221; 15906, SMIM4, 79867, 182317, 155-268; 15906, SMIM4, 79869, 182319, 152-331; 15906, SMIM4, 79868, 182318, 152-364; 15907, SMIM5, 79870, 182320, 806-1039; 15907, SMIM5, 79871, 182321, 3608-3841; 15908, SMIM6, 79872, 182322, 268-456; 15908, SMIM6, 79873, 182323, 357-545; 15909, SMIM7, 79874, 182324, 33-344; 15909, SMIM7, 79876, 182326, 21-170; 15909, SMIM7, 79878, 182328, 5-175; 15909, SMIM7, 79879, 182329, 5-148; 15909, SMIM7, 79880, 182330, 21-332; 15909, SMIM7, 79884, 182334, 35-184; 15909, SMIM7, 79885, 182335, 35-184; 15909, SMIM7, 79886, 182336, 77-268; 15909, SMIM7, 79888, 182338, 97-288; 15909, SMIM7, 79889, 182339, 29-178; 15909, SMIM7, 79890, 182340, 21-332; 15909, SMIM7, 79875, 182325, 48-275; 15909, SMIM7, 79877, 182327, 21-248; 15909, SMIM7, 79881, 182331, 21-248; 15909, SMIM7, 79882, 182332, 333-560; 15909, SMIM7, 79883, 182333, 5-232; 15909, SMIM7, 79887, 182337, 35-262; 15910, SMIM8, 79893, 182343, 48-278; 15910, SMIM8, 79894, 182344, 52-228; 15910, SMIM8, 79891, 182341, 64-357; 15910, SMIM8, 79892, 182342, 90-383; 15910, SMIM8, 79895, 182345, 292-585; 15910, SMIM8, 79896, 182346, 333-626; 15911, SMIM9, 79897, 182347, 198-497; 15912, SMLR1, 79898, 182348, 9-332; 15913, SMKR1, 79899, 182349, 347-544; 15914, SMPX, 79900, 182350, 235-501; 15915, SNRNP200, 79902, 182352, 389-2176; 15915, SNRNP200, 79901, 182351, 79-6489; 15916, SNRNP25, 79903, 182353, 1008-1379; 15916, SNRNP25, 79905, 182355, 131-409; 15916, SNRNP25, 79906, 182356, 119-408; 15916, SNRNP25, 79904, 182354, 162-560; 15917, SNRNP27, 79908, 182358, 27-503; 15917, SNRNP27, 79910, 182360, 1-55; 15917, SNRNP27, 79907, 182357, 426-893; 15917, SNRNP27, 79909, 182359, 22-489; 15918, SNRNP35, 79911, 182361, 93-833; 15918, SNRNP35, 79912, 182362, 367-1122; 15918, SNRNP35, 79913, 182363, 580-1320; 15919, SNRNP40, 79915, 182365, 342-725; 15919, SNRNP40, 79914, 182364, 20-1093; 15920, SNRNP48, 79917, 182367, 33-482; 15920, SNRNP48, 79916, 182366, 60-1079; 15921, SNRNP70, 79920, 182370, 278-377; 15921, SNRNP70, 79922, 182372, 266-547; 15921, SNRNP70, 79918, 182368, 197-1483; 15921, SNRNP70, 79919, 182369, 197-697; 15921, SNRNP70, 79921, 182371, 229-729; 15921, SNRNP70, 79923, 182373, 153-653; 15921, SNRNP70, 79924, 182374, 225-1538; 15922, SNRPD1, 79926, 182376, 155-382; 15922, SNRPD1, 79927, 182377, 117-251; 15922, SNRPD1, 79925, 182375, 164-523; 15923, SNRPD2, 79930, 182380, 122-286; 15923, SNRPD2, 79934, 182384, 30-266; 15923, SNRPD2, 79928, 182378, 446-802; 15923, SNRPD2, 79929, 182379, 199-525; 15923, SNRPD2, 79931, 182381, 256-612; 15923, SNRPD2, 79932, 182382, 179-505; 15923, SNRPD2, 79933, 182383, 389-715; 15924, SNRPD3, 79938, 182388, 59-247; 15924, SNRPD3, 79935, 182385, 588-968; 15924, SNRPD3, 79936, 182386, 84-446; 15924, SNRPD3, 79937, 182387, 82-462; 15925, SNRPA, 79940, 182390, 134-519; 15925, SNRPA, 79941, 182391, 143-695; 15925, SNRPA, 79942, 182392, 112-375; 15925, SNRPA, 79943, 182393, 130-555; 15925, SNRPA, 79944, 182394, 201-969; 15925, SNRPA, 79945, 182395, 93-538; 15925, SNRPA, 79939, 182389, 551-1399; 15926, SNRPA1, 79947, 182397, 27-491; 15926, SNRPA1, 79948, 182398, 558-824; 15926, SNRPA1, 79949, 182399, 1-429; 15926, SNRPA1, 79950, 182400, 78-539; 15926, SNRPA1, 79946, 182396, 74-841; 15927, SNRPB2, 79951, 182401, 217-894; 15927, SNRPB2, 79952, 182402, 140-817; 15928, SNRPC, 79954, 182404, 288-830; 15928, SNRPC, 79955, 182405, 100-456; 15928, SNRPC, 79953, 182403, 139-618; 15929, SNRPE, 79956, 182406, 78-236; 15929, SNRPE, 79957, 182407, 46-324; 15930, SNRPF, 79959, 182409, 106-489; 15930, SNRPF, 79960, 182410, 110-313; 15930, SNRPF, 79958, 182408, 147-407; 15931, SNRPG, 79962, 182412, 107-301; 15931, SNRPG, 79963, 182413, 63-353; 15931, SNRPG, 79964, 182414, 192-386; 15931, SNRPG, 79965, 182415, 65-271; 15931, SNRPG, 79966, 182416, 769-963; 15931, SNRPG, 79961, 182411, 123-353; 15932, SNRPN, 79972, 182422, 731-908; 15932, SNRPN, 79974, 182424, 364-871; 15932, SNRPN, 79967, 182417, 443-1165; 15932, SNRPN, 79968, 182418, 527-1249; 15932, SNRPN, 79969, 182419, 745-1467; 15932, SNRPN, 79970, 182420, 891-1613; 15932, SNRPN, 79971, 182421, 934-1668; 15932, SNRPN, 79973, 182423, 472-1194; 15933, SNRPB, 79975, 182425, 130-996; 15933, SNRPB, 79978, 182428, 43-255; 15933, SNRPB, 79976, 182426, 164-859; 15933, SNRPB, 79977, 182427, 164-886; 15934, SNAPC1, 79979, 182429, 105-1211; 15935, SNAPC2, 79981, 182431, 1-838; 15935, SNAPC2, 79982, 182432, 634-927; 15935, SNAPC2, 79980, 182430, 52-1056; 15936, SNAPC3, 79983, 182433, 11-385; 15936, SNAPC3, 79985, 182435, 2-730; 15936, SNAPC3, 79984, 182434, 177-1412; 15936, SNAPC3, 79986, 182436, 12-1247; 15936, SNAPC3, 79987, 182437, 147-1382; 15936, SNAPC3, 79988, 182438, 147-1382; 15937, SNAPC4, 79989, 182439, 370-4779; 15938, SNAPC5, 79994, 182444, 29-232; 15938, SNAPC5, 79995, 182445, 50-301; 15938, SNAPC5, 79996, 182446, 8-211; 15938, SNAPC5, 79990, 182440, 32-238; 15938, SNAPC5, 79991, 182441, 83-379; 15938, SNAPC5, 79992, 182442, 20-316; 15938, SNAPC5, 79993, 182443, 50-346; 15938, SNAPC5, 79997, 182447, 20-316; 15939, SPRR1A, 79998, 182448, 1-270; 15940, SPRR1B, 79999, 182449, 66-335; 15941, SPRR2A, 80000, 182450, 87-305; 15942, SPRR2B, 80001, 182451, 2-220; 15943, SPRR2D, 80002, 182452, 61-279; 15943, SPRR2D, 80003, 182453, 290-508; 15943, SPRR2D, 80004, 182454, 282-500; 15943, SPRR2D, 80005, 182455, 180-398; 15944, SPRR2E, 80006, 182456, 62-280; 15944, SPRR2E, 80007, 182457, 76-294; 15945, SPRR2F, 80008, 182458, 62-280; 15946, SPRR2G, 80009, 182459, 40-261; 15947, SPRR3, 80012, 182462, 147-622; 15947, SPRR3, 80010, 182460, 43-552; 15947, SPRR3, 80011, 182461, 151-660; 15948, SPRR4, 80013, 182463, 50-289; 15949, SUMO1, 80017, 182467, 124-312; 15949, SUMO1, 80018, 182468, 126-359; 15949, SUMO1, 80019, 182469, 346-534; 15949, SUMO1, 80020, 182470, 116-337; 15949, SUMO1, 80021, 182471, 119-295; 15949, SUMO1, 80022, 182472, 144-584; 15949, SUMO1, 80014, 182464, 116-346; 15949, SUMO1, 80015, 182465, 149-454; 15949, SUMO1, 80016, 182466, 158-463; 15950, SUMO2, 80025, 182475, 291-449; 15950, SUMO2, 80023, 182473, 123-338; 15950, SUMO2, 80024, 182474, 150-437; 15951, SUMO3, 80027, 182477, 1-444; 15951, SUMO3, 80028, 182478, 84-491; 15951, SUMO3, 80026, 182476, 162-473; 15951, SUMO3, 80029, 182479, 162-587; 15952, SUMO4, 80030, 182480, 166-453; 15953, SVBP, 80031, 182481, 100-300; 15953, SVBP, 80032, 182482, 88-288; 15954, SVIP, 80033, 182483, 118-351; 15955, SLF1, 80036, 182486, 187-578; 15955, SLF1, 80037, 182487, 1-388; 15955, SLF1, 80034, 182484, 420-3596; 15955, SLF1, 80035, 182485, 89-628; 15956, SLF2, 80040, 182490, 149-2425; 15956, SLF2, 80038, 182488, 543-4064; 15956, SLF2, 80039, 182489, 133-3693; 15956, SLF2, 80041, 182491, 116-307; 15957, SMG1, 80043, 182493, 254-1259; 15957, SMG1, 80044, 182494, 377-562; 15957, SMG1, 80045, 182495, 1-2561; 15957, SMG1, 80046, 182496, 396-565; 15957, SMG1, 80047, 182497, 1-10656; 15957, SMG1, 80048, 182498, 45-1868; 15957, SMG1, 80049, 182499, 1-964; 15957, SMG1, 80050, 182500, 1-1654; 15957, SMG1, 80051, 182501, 267-860; 15957, SMG1, 80052, 182502, 1-257; 15957, SMG1, 80042, 182492, 414-11399; 15958, SMG5, 80053, 182503, 146-3196; 15959, SMG6, 80057, 182507, 88-574; 15959, SMG6, 80058, 182508, 95-588; 15959, SMG6, 80059, 182509, 204-572; 15959, SMG6, 80060, 182510, 29-652; 15959, SMG6, 80061, 182511, 191-547; 15959, SMG6, 80062, 182512, 104-592; 15959, SMG6, 80063, 182513, 274-689; 15959, SMG6, 80064, 182514, 186-557; 15959, SMG6, 80065, 182515, 205-551; 15959, SMG6, 80054, 182504, 52-4311; 15959, SMG6, 80055, 182505, 296-1831; 15959, SMG6, 80056, 182506, 243-1778; 15960, SMG7, 80067, 182517, 196-3708; 15960, SMG7, 80068, 182518, 214-2483; 15960, SMG7, 80069, 182519, 120-341; 15960, SMG7, 80070, 182520, 406-960; 15960, SMG7, 80072, 182522, 398-566; 15960, SMG7, 80073, 182523, 311-760; 15960, SMG7, 80066, 182516, 120-3533; 15960, SMG7, 80071, 182521, 95-3370; 15960, SMG7, 80074, 182524, 119-3655; 15960, SMG7, 80075, 182525, 216-3653; 15961, SMG8, 80079, 182529, 1-816; 15961, SMG8, 80080, 182530, 1-97; 15961, SMG8, 80076, 182526, 43-3018; 15961, SMG8, 80077, 182527, 265-3240; 15961, SMG8, 80078, 182528, 186-1952; 15962, SMG9, 80082, 182532, 78-438; 15962, SMG9, 80083, 182533, 105-550; 15962, SMG9, 80084, 182534, 100-650; 15962, SMG9, 80085, 182535, 231-576; 15962, SMG9, 80087, 182537, 1-473; 15962, SMG9, 80088, 182538, 230-697; 15962, SMG9, 80081, 182531, 344-1906; 15962, SMG9, 80086, 182536, 316-1803; 15963, SMCR8, 80089, 182539, 481-3294; 15964, SMTN, 80093, 182543, 91-1407; 15964, SMTN, 80094, 182544, 456-566; 15964, SMTN, 80095, 182545, 1-648; 15964, SMTN, 80096, 182546, 61-534; 15964, SMTN, 80097, 182547, 294-567; 15964, SMTN, 80098, 182548, 151-574; 15964, SMTN, 80099, 182549, 145-599; 15964, SMTN, 80100, 182550, 164-545; 15964, SMTN, 80101, 182551, 530-823; 15964, SMTN, 80102, 182552, 78-2993; 15964, SMTN, 80103, 182553, 62-3070; 15964, SMTN, 80104, 182554, 1-934; 15964, SMTN, 80105, 182555, 575-589; 15964, SMTN, 80090, 182540, 219-2972; 15964, SMTN, 80091, 182541, 219-2966; 15964, SMTN, 80092, 182542, 219-3041; 15965, SMTNL1, 80107, 182557, 3-1487; 15965, SMTNL1, 80106, 182556, 1-1374; 15966, SMTNL2, 80110, 182560, 40-286; 15966, SMTNL2, 80108, 182558, 134-1087; 15966, SMTNL2, 80109, 182559, 68-1453; 15967, SMO, 80112, 182562, 1-454; 15967, SMO, 80113, 182563, 1-213; 15967, SMO, 80111, 182561, 281-2644; 15968, SMU1, 80114, 182564, 52-1593; 15969, SMYD5, 80115, 182565, 30-242; 15969, SMYD5, 80117, 182567, 46-291; 15969, SMYD5, 80118, 182568, 169-584; 15969, SMYD5, 80119, 182569, 1-246; 15969, SMYD5, 80116, 182566, 46-1302; 15970, SNAI1, 80120, 182570, 62-856; 15971, SNAI2, 80121, 182571, 176-982; 15971, SNAI2, 80122, 182572, 359-1165; 15972, SNAI3, 80123, 182573, 88-966; 15973, SNAPIN, 80124, 182574, 91-501; 15974, SNRK, 80127, 182577, 120-1799; 15974, SNRK, 80125, 182575, 305-2602; 15974, SNRK, 80126, 182576, 383-2680; 15974, SNRK, 80128, 182578, 245-2542; 15975, SHPRH, 80130, 182580, 300-2282; 15975, SHPRH, 80132, 182582, 1-390; 15975, SHPRH, 80133, 182583, 1-1350; 15975, SHPRH, 80135, 182585, 1-292; 15975, SHPRH, 80137, 182587, 400-5463; 15975, SHPRH, 80129, 182579, 400-5451; 15975, SHPRH, 80131, 182581, 266-5317; 15975, SHPRH, 80134, 182584, 400-5379; 15975, SHPRH, 80136, 182586, 300-3089; 15976, SRCAP, 80139, 182589, 211-9126; 15976, SRCAP, 80140, 182590, 537-836; 15976, SRCAP, 80141, 182591, 1-4832; 15976, SRCAP, 80138, 182588, 386-10078; 15977, SNF8, 80144, 182594, 73-576; 15977, SNF8, 80145, 182595, 1-245; 15977, SNF8, 80146, 182596, 14-325; 15977, SNF8, 80147, 182597, 98-523; 15977, SNF8, 80148, 182598, 92-253; 15977, SNF8, 80149, 182599, 78-188; 15977, SNF8, 80150, 182600, 1-49; 15977, SNF8, 80142, 182592, 77-850; 15977, SNF8, 80143, 182593, 384-1160; 15978, SNURF, 80151, 182601, 36-251; 15978, SNURF, 80152, 182602, 64-279; 15978, SNURF, 80153, 182603, 46-261; 15979, N/A, 80155, 182605, 16-129; 15979, N/A, 80154, 182604, 16-231; 15980, SNU13, 80159, 182609, 56-454; 15980, SNU13, 80156, 182606, 265-651; 15980, SNU13, 80157, 182607, 114-500; 15980, SNU13, 80158, 182608, 318-704; 15981, SNUPN, 80162, 182612, 401-406; 15981, SNUPN, 80163, 182613, 471-661; 15981, SNUPN, 80165, 182615, 395-1023; 15981, SNUPN, 80166, 182616, 237-644; 15981, SNUPN, 80167, 182617, 458-759; 15981, SNUPN, 80168, 182618, 1-603; 15981, SNUPN, 80160, 182610, 156-1238; 15981, SNUPN, 80161, 182611, 580-1662; 15981, SNUPN, 80164, 182614, 284-1366; 15981, SNUPN, 80169, 182619, 364-1446; 15982, SNW1, 80171, 182621, 30-1745; 15982, SNW1, 80172, 182622, 81-224; 15982, SNW1, 80173, 182623, 103-1227; 15982, SNW1, 80174, 182624, 30-584; 15982, SNW1, 80170, 182620, 64-1674; 15983, SCLT1, 80178, 182628, 379-1233; 15983, SCLT1, 80179, 182629, 275-670; 15983, SCLT1, 80180, 182630, 457-627; 15983, SCLT1, 80175, 182625, 505-2571; 15983, SCLT1, 80176, 182626, 308-835; 15983, SCLT1, 80177, 182627, 443-682; 15984, SCNM1, 80181, 182631, 229-816; 15984, SCNM1, 80182, 182632, 112-804; 15984, SCNM1, 80183, 182633, 114-701; 15985, SCNN1A, 80185, 182635, 21-758; 15985, SCNN1A, 80187, 182637, 21-1556; 15985, SCNN1A, 80189, 182639, 905-2014; 15985, SCNN1A, 80190, 182640, 56-533; 15985, SCNN1A, 80184, 182634, 100-2109; 15985, SCNN1A, 80186, 182636, 265-2451; 15985, SCNN1A, 80188, 182638, 94-2172; 15986, SCNN1B, 80193, 182643, 9-1823; 15986, SCNN1B, 80194, 182644, 9-1850; 15986, SCNN1B, 80195, 182645, 9-899; 15986, SCNN1B, 80196, 182646, 1-566; 15986, SCNN1B, 80191, 182641, 28-2085; 15986, SCNN1B, 80192, 182642, 177-2099; 15987, SCNN1D, 80199, 182649, 1-923; 15987, SCNN1D, 80200, 182650, 227-2635; 15987, SCNN1D, 80202, 182652, 229-

645; 15987, SCNN1D, 80203, 182653, 191-1177; 15987, SCNN1D, 80204, 182654, 41-2452; 15987, SCNN1D, 80197, 182647, 151-2265; 15987, SCNN1D, 80198, 182648, 1145-3061; 15987, SCNN1D, 80201, 182651, 396-2312; 15988, SCNN1G, 80205, 182655, 144-2093; 15989, SCN1A, 80206, 182656, 419-6448; 15989, SCN1A, 80207, 182657, 19-6015; 15989, SCN1A, 80208, 182658, 1-5946; 15989, SCN1A, 80209, 182659, 77-6106; 15990, SCN1B, 80212, 182662, 89-532; 15990, SCN1B, 80210, 182660, 138-794; 15990, SCN1B, 80211, 182661, 1-807; 15991, SCN2A, 80216, 182666, 291-1807; 15991, SCN2A, 80218, 182668, 1-537; 15991, SCN2A, 80213, 182663, 157-6174; 15991, SCN2A, 80214, 182664, 52-6069; 15991, SCN2A, 80215, 182665, 291-6308; 15991, SCN2A, 80217, 182667, 205-6222; 15992, SCN2B, 80219, 182669, 243-890; 15993, SCN3A, 80223, 182673, 616-1216; 15993, SCN3A, 80224, 182674, 55-4146; 15993, SCN3A, 80220, 182670, 469-6471; 15993, SCN3A, 80221, 182671, 493-6495; 15993, SCN3A, 80222, 182672, 312-6167; 15994, SCN3B, 80228, 182678, 163-443; 15994, SCN3B, 80229, 182679, 143-566; 15994, SCN3B, 80225, 182675, 408-1055; 15994, SCN3B, 80226, 182676, 804-1451; 15994, SCN3B, 80227, 182677, 408-1055; 15995, SCN4A, 80231, 182681, 78-5588; 15995, SCN4A, 80230, 182680, 78-5588; 15996, SCN4B, 80232, 182682, 148-834; 15996, SCN4B, 80233, 182683, 216-500; 15997, SCN9A, 80237, 182687, 1-1618; 15997, SCN9A, 80238, 182688, 1-1585; 15997, SCN9A, 80234, 182684, 342-6308; 15997, SCN9A, 80235, 182685, 348-6281; 15997, SCN9A, 80236, 182686, 1-5967; 15998, SCN5A, 80240, 182690, 139-335; 15998, SCN5A, 80241, 182691, 196-6084; 15998, SCN5A, 80243, 182693, 43-6039; 15998, SCN5A, 80244, 182694, 26-5977; 15998, SCN5A, 80245, 182695, 43-5931; 15998, SCN5A, 80246, 182696, 195-6245; 15998, SCN5A, 80247, 182697, 10-5898; 15998, SCN5A, 80248, 182698, 195-6191; 15998, SCN5A, 80249, 182699, 43-714; 15998, SCN5A, 80239, 182689, 151-6201; 15998, SCN5A, 80242, 182692, 56-6103; 15999, SCN7A, 80251, 182701, 128-2416; 15999, SCN7A, 80252, 182702, 253-1459; 15999, SCN7A, 80253, 182703, 408-2996; 15999, SCN7A, 80250, 182700, 128-5176; 15999, SCN7A, 80254, 182704, 131-5179; 15999, SCN7A, 80255, 182705, 131-5179; 16000, SCN8A, 80259, 182709, 1-1627; 16000, SCN8A, 80261, 182711, 159-161; 16000, SCN8A, 80256, 182706, 179-6121; 16000, SCN8A, 80257, 182707, 1-5820; 16000, SCN8A, 80258, 182708, 179-5998; 16000, SCN8A, 80260, 182710, 1-5976; 16000, SCN8A, 80262, 182712, 1-5943; 16001, SCN10A, 80263, 182713, 1-5871; 16002, SCN11A, 80264, 182714, 200-5575; 16002, SCN11A, 80265, 182715, 200-4534; 16002, SCN11A, 80266, 182716, 1-5262; 16003, NALCN, 80267, 182717, 83-5299; 16003, NALCN, 80268, 182718, 29-685; 16004, SOGA3, 80269, 182719, 679-709; 16004, SOGA3, 80271, 182721, 447-3281; 16004, SOGA3, 80270, 182720, 747-3590; 16005, SLC1A2, 80275, 182725, 87-685; 16005, SLC1A2, 80276, 182726, 1-276; 16005, SLC1A2, 80277, 182727, 1-597; 16005, SLC1A2, 80272, 182722, 284-2008; 16005, SLC1A2, 80273, 182723, 172-1869; 16005, SLC1A2, 80274, 182724, 323-2020; 16005, SLC1A2, 80278, 182728, 105-1796; 16006, SLC1A3, 80281, 182731, 247-566; 16006, SLC1A3, 80282, 182732, 221-540; 16006, SLC1A3, 80283, 182733, 481-784; 16006, SLC1A3, 80284, 182734, 477-1967; 16006, SLC1A3, 80285, 182735, 477-1769; 16006, SLC1A3, 80279, 182729, 477-2105; 16006, SLC1A3, 80280, 182730, 96-1589; 16007, SLC1A7, 80288, 182738, 184-2043; 16007, SLC1A7, 80289, 182739, 173-649; 16007, SLC1A7, 80290, 182740, 184-1602; 16007, SLC1A7, 80286, 182736, 169-645; 16007, SLC1A7, 80287, 182737, 129-1811; 16008, SLC1A4, 80291, 182741, 244-1842; 16008, SLC1A4, 80292, 182742, 265-969; 16009, SLC1A6, 80294, 182744, 131-1633; 16009, SLC1A6, 80296, 182746, 95-424; 16009, SLC1A6, 80297, 182747, 275-1735; 16009, SLC1A6, 80298, 182748, 345-566; 16009, SLC1A6, 80299, 182749, 214-695; 16009, SLC1A6, 80301, 182751, 388-493; 16009, SLC1A6, 80302, 182752, 154-592; 16009, SLC1A6, 80293, 182743, 9-1703; 16009, SLC1A6, 80295, 182745, 794-1732; 16009, SLC1A6, 80300, 182750, 1361-2299; 16010, SLC1A1, 80304, 182754, 1-726; 16010, SLC1A1, 80303, 182753, 237-1811; 16011, SLC1A5, 80308, 182758, 1-774; 16011, SLC1A5, 80309, 182759, 309-1406; 16011, SLC1A5, 80310, 182760, 190-276; 16011, SLC1A5, 80305, 182755, 223-1164; 16011, SLC1A5, 80306, 182756, 228-1247; 16011, SLC1A5, 80307, 182757, 630-2255; 16012, SLC10A1, 80311, 182761, 135-1184; 16013, SLC10A2, 80312, 182762, 598-1644; 16014, SLC10A6, 80313, 182763, 149-1282; 16015, SLC10A3, 80316, 182766, 99-1697; 16015, SLC10A3, 80318, 182768, 514-1167; 16015, SLC10A3, 80314, 182764, 527-1960; 16015, SLC10A3, 80315, 182765, 216-1562; 16015, SLC10A3, 80317, 182767, 265-1698; 16016, SLC10A4, 80319, 182769, 220-1533; 16017, SLC10A5, 80320, 182770, 1203-2519; 16018, SLC10A7, 80321, 182771, 217-1239; 16018, SLC10A7, 80322, 182772, 179-658; 16018, SLC10A7, 80323, 182773, 248-1231; 16018, SLC10A7, 80324, 182774, 1-1077; 16018, SLC10A7, 80325, 182775, 114-371; 16018, SLC10A7, 80326, 182776, 206-400; 16019, SLC11A1, 80328, 182778, 122-613; 16019, SLC11A1, 80329, 182779, 167-415; 16019, SLC11A1, 80330, 182780, 97-222; 16019, SLC11A1, 80331, 182781, 201-473; 16019, SLC11A1, 80327, 182777, 341-1993; 16020, SLC11A2, 80337, 182787, 123-344; 16020, SLC11A2, 80339, 182789, 287-1735; 16020, SLC11A2, 80340, 182790, 145-587; 16020, SLC11A2, 80341, 182791, 253-546; 16020, SLC11A2, 80342, 182792, 304-565; 16020, SLC11A2, 80343, 182793, 132-581; 16020, SLC11A2, 80344, 182794, 522-530; 16020, SLC11A2, 80345, 182795, 109-351; 16020, SLC11A2, 80348, 182798, 130-576; 16020, SLC11A2, 80349, 182799, 1-380; 16020, SLC11A2, 80350, 182800, 109-569; 16020, SLC11A2, 80332, 182782, 89-1795; 16020, SLC11A2, 80333, 182783, 114-1799; 16020, SLC11A2, 80334, 182784, 51-1823; 16020, SLC11A2, 80335, 182785, 112-1785; 16020, SLC11A2, 80336, 182786, 406-2091; 16020, SLC11A2, 80338, 182788, 63-1769; 16020, SLC11A2, 80346, 182796, 93-1799; 16020, SLC11A2, 80347, 182797, 243-2015; 16021, SLC12A4, 80356, 182806, 64-228; 16021, SLC12A4, 80357, 182807, 81-3194; 16021, SLC12A4, 80358, 182808, 1-59; 16021, SLC12A4, 80359, 182809, 358-891; 16021, SLC12A4, 80360, 182810, 1-271; 16021, SLC12A4, 80351, 182801, 142-3399; 16021, SLC12A4, 80352, 182802, 41-3304; 16021, SLC12A4, 80353, 182803, 105-3269; 16021, SLC12A4, 80354, 182804, 39-3278; 16021, SLC12A4, 80355, 182805, 1-3207; 16022, SLC12A5, 80363, 182813, 122-682; 16022, SLC12A5, 80364, 182814, 202-571; 16022, SLC12A5, 80365, 182815, 164-952; 16022, SLC12A5, 80366, 182816, 164-1033; 16022, SLC12A5, 80367, 182817, 164-1543; 16022, SLC12A5, 80368, 182818, 164-706; 16022, SLC12A5, 80369, 182819, 68-229; 16022, SLC12A5, 80370, 182820, 1-203; 16022, SLC12A5, 80371, 182821, 55-417; 16022, SLC12A5, 80372, 182822, 162-338; 16022, SLC12A5, 80361, 182811, 164-3514; 16022, SLC12A5, 80362, 182812, 77-3496; 16023, SLC12A6, 80378, 182828, 237-3125; 16023, SLC12A6, 80379, 182829, 112-567; 16023, SLC12A6, 80381, 182831, 170-576; 16023, SLC12A6, 80382, 182832, 367-548; 16023, SLC12A6, 80383, 182833, 528-3356; 16023, SLC12A6, 80385, 182835, 1107-3827; 16023, SLC12A6, 80386, 182836, 170-490; 16023, SLC12A6, 80387, 182837, 1378-4098; 16023, SLC12A6, 80373, 182823, 102-3401; 16023, SLC12A6, 80374, 182824, 494-3946; 16023, SLC12A6, 80375, 182825, 199-3474; 16023, SLC12A6, 80376, 182826, 165-3572; 16023, SLC12A6, 80377, 182827, 528-3803; 16023, SLC12A6, 80380, 182830, 441-3866; 16023, SLC12A6, 80384, 182834, 104-3556; 16023, SLC12A6, 80388, 182838, 165-3617; 16024, SLC12A7, 80390, 182840, 1-1066; 16024, SLC12A7, 80391, 182841, 45-3296; 16024, SLC12A7, 80392, 182842, 1-1041; 16024, SLC12A7, 80393, 182843, 1-192; 16024, SLC12A7, 80394, 182844, 1-2968; 16024, SLC12A7, 80389, 182839, 45-3296; 16025, SLC12A3, 80395, 182845, 26-3088; 16025, SLC12A3, 80396, 182846, 30-3122; 16025, SLC12A3, 80397, 182847, 26-3091; 16025, SLC12A3, 80398, 182848, 30-3119; 16026, SLC12A1, 80399, 182849, 187-1479; 16026, SLC12A1, 80402, 182852, 231-2176; 16026, SLC12A1, 80404, 182854, 324-664; 16026, SLC12A1, 80405, 182855, 1-311; 16026, SLC12A1, 80406, 182856, 1-654; 16026, SLC12A1, 80400, 182850, 217-3516; 16026, SLC12A1, 80401, 182851, 216-3515; 16026, SLC12A1, 80403, 182853, 15-3314; 16027, SLC12A2, 80409, 182859, 165-3617; 16027, SLC12A2, 80410, 182860, 165-3617; 16027, SLC12A2, 80407, 182857, 190-3828; 16027, SLC12A2, 80408, 182858, 108-3698; 16028, SLC12A8, 80413, 182863, 156-493; 16028, SLC12A8, 80415, 182865, 1-481; 16028, SLC12A8, 80416, 182866, 1-622; 16028, SLC12A8, 80411, 182861, 51-2195; 16028, SLC12A8, 80412, 182862, 30-1577; 16028, SLC12A8, 80414, 182864, 112-2256; 16029, SLC12A9, 80418, 182868, 156-293; 16029, SLC12A9, 80419, 182869, 448-916; 16029, SLC12A9, 80420, 182870, 204-589; 16029, SLC12A9, 80421, 182871, 106-840; 16029, SLC12A9, 80417, 182867, 126-2870; 16029, SLC12A9, 80422, 182872, 146-1762; 16029, SLC12A9, 80423, 182873, 160-2055; 16030, SLC13A1, 80425, 182875, 27-137; 16030, SLC13A1, 80426, 182876, 26-148; 16030, SLC13A1, 80427, 182877, 139-624; 16030, SLC13A1, 80424, 182874, 41-1828; 16031, SLC13A4, 80429, 182879, 241-578; 16031, SLC13A4, 80430, 182880, 343-572; 16031, SLC13A4, 80428, 182878, 691-2571; 16032, SLC13A5, 80435, 182885, 1-283; 16032, SLC13A5, 80436, 182886, 37-312; 16032, SLC13A5, 80437, 182887, 27-272; 16032, SLC13A5, 80438, 182888, 37-538; 16032, SLC13A5, 80431, 182881, 37-1692; 16032, SLC13A5, 80432, 182882, 34-1611; 16032, SLC13A5, 80433, 182883, 235-1941; 16032, SLC13A5, 80434, 182884, 45-1613; 16033, SLC13A2, 80441, 182891, 200-1276; 16033, SLC13A2, 80442, 182892, 1-83; 16033, SLC13A2, 80443, 182893, 22-129; 16033, SLC13A2, 80444, 182894, 1-83; 16033, SLC13A2, 80439, 182889, 421-2199; 16033, SLC13A2, 80440, 182890, 421-2346; 16034, SLC13A3, 80447, 182897, 103-848; 16034, SLC13A3, 80448, 182898, 1-707; 16034, SLC13A3, 80449, 182899, 1-906; 16034, SLC13A3, 80450, 182900, 128-685; 16034, SLC13A3, 80452, 182902, 372-1597; 16034, SLC13A3, 80445, 182895, 20-1828; 16034, SLC13A3, 80446, 182896, 128-1795; 16034, SLC13A3, 80451, 182901, 39-1697; 16034, SLC13A3, 80453, 182903, 192-1859; 16034, SLC13A3, 80454, 182904, 128-1690; 16035, SLC14A1, 80456, 182906, 319-1173; 16035, SLC14A1, 80459, 182909, 210-983; 16035, SLC14A1, 80460, 182910, 301-1146; 16035, SLC14A1, 80461, 182911, 488-572; 16035, SLC14A1, 80462, 182912, 1-909; 16035, SLC14A1, 80463, 182913, 1-521; 16035, SLC14A1, 80464, 182914, 263-569; 16035, SLC14A1, 80465, 182915, 215-602; 16035, SLC14A1, 80466, 182916, 146-652; 16035, SLC14A1, 80467, 182917, 154-798; 16035, SLC14A1, 80468, 182918, 210-557; 16035, SLC14A1, 80469, 182919, 145-552; 16035, SLC14A1, 80471, 182921, 233-1141; 16035, SLC14A1, 80455, 182905, 233-1402; 16035, SLC14A1, 80457, 182907, 548-1885; 16035, SLC14A1, 80458, 182908, 166-1503; 16035, SLC14A1, 80470, 182920, 1293-2462; 16036, SLC14A2, 80473, 182923, 101-808; 16036, SLC14A2, 80472, 182922, 817-3579; 16036, SLC14A2, 80474, 182924, 125-2887; 16036, SLC14A2, 80475, 182925, 322-3084; 16037, SLC15A1, 80477, 182927, 57-2177; 16037, SLC15A1, 80478, 182928, 67-693; 16037, SLC15A1, 80476, 182926, 57-2183; 16038, SLC15A2, 80481, 182931, 116-572; 16038, SLC15A2, 80479, 182929, 38-2134; 16038, SLC15A2, 80480, 182930, 389-2578; 16039, SLC15A3, 80483, 182933, 1-743; 16039, SLC15A3, 80484, 182934, 49-676; 16039, SLC15A3, 80485, 182935, 245-691; 16039, SLC15A3, 80486, 182936, 1-132; 16039, SLC15A3, 80487, 182937, 96-1466; 16039, SLC15A3, 80488, 182938, 235-1176; 16039, SLC15A3, 80489, 182939, 96-1037; 16039, SLC15A3, 80482, 182932, 235-1980; 16040, SLC15A4, 80491, 182941, 1-467; 16040, SLC15A4, 80492, 182942, 1-715; 16040, SLC15A4, 80493, 182943, 186-749; 16040, SLC15A4, 80490, 182940, 41-1774; 16041, SLC15A5, 80494, 182944, 1-1740; 16042, SLC16A10, 80495, 182945, 487-1092; 16042, SLC16A10, 80497, 182947, 1-620; 16042, SLC16A10, 80498, 182948, 1-635; 16042, SLC16A10, 80499, 182949, 251-1231; 16042, SLC16A10, 80496, 182946, 176-1723; 16043, SLC16A1, 80501, 182951, 220-865; 16043, SLC16A1, 80502, 182952, 210-1099; 16043, SLC16A1, 80503, 182953, 833-2201; 16043, SLC16A1, 80506, 182956, 220-865; 16043, SLC16A1, 80508, 182958, 210-1099; 16043, SLC16A1, 80509, 182959, 833-2201; 16043, SLC16A1, 80500, 182950, 364-1866; 16043, SLC16A1, 80504, 182954, 833-2335; 16043, SLC16A1, 80505, 182955, 833-2335; 16043, SLC16A1, 80507, 182957, 364-1866; 16044, SLC16A3, 80513, 182963, 152-808; 16044, SLC16A3, 80514, 182964, 1-921; 16044, SLC16A3, 80515, 182965, 74-545; 16044, SLC16A3, 80516, 182966, 129-535; 16044, SLC16A3, 80517, 182967, 155-859; 16044, SLC16A3, 80518, 182968, 76-866; 16044, SLC16A3, 80520, 182970, 204-872; 16044, SLC16A3, 80521, 182971, 41-279; 16044, SLC16A3, 80522, 182972, 96-586; 16044, SLC16A3, 80523, 182973, 160-1033; 16044, SLC16A3, 80510, 182960, 155-1552; 16044, SLC16A3, 80511, 182961, 167-1564; 16044, SLC16A3, 80512, 182962, 102-1499; 16044, SLC16A3, 80519, 182969, 2323-3720; 16044, SLC16A3, 80524, 182974, 96-1493; 16044, SLC16A3, 80525, 182975, 129-1526; 16045, SLC16A5, 80529, 182979, 130-738; 16045, SLC16A5, 80530, 182980, 403-562; 16045, SLC16A5, 80531, 182981, 325-1688; 16045, SLC16A5, 80533, 182983, 282-989; 16045, SLC16A5, 80526, 182976, 288-1805; 16045, SLC16A5, 80527, 182977, 416-1933; 16045, SLC16A5, 80528, 182978, 129-1631; 16045, SLC16A5, 80532, 182982, 373-1890; 16046, SLC16A7, 80535, 182985, 298-1603; 16046, SLC16A7, 80536, 182986, 149-574; 16046, SLC16A7, 80537, 182987, 205-441; 16046, SLC16A7, 80538, 182988, 403-797; 16046, SLC16A7, 80541, 182991, 131-385; 16046, SLC16A7, 80542, 182992, 132-386; 16046, SLC16A7, 80543, 182993, 154-408; 16046, SLC16A7, 80545, 182995, 140-391; 16046, SLC16A7, 80546, 182996, 77-370; 16046, SLC16A7, 80534, 182984, 165-1601; 16046, SLC16A7, 80539, 182989, 223-1659; 16046, SLC16A7, 80540

182990, 373-1809; 16046, SLC16A7, 80544, 182994, 280-1716; 16047, SLC16A8, 80548, 182998, 435-726; 16047, SLC16A8, 80547, 182997, 110-1624; 16048, SLC16A11, 80550, 183000, 411-1730; 16048, SLC16A11, 80551, 183001, 150-430; 16048, SLC16A11, 80549, 182999, 339-1754; 16049, SLC16A12, 80552, 183002, 302-1852; 16049, SLC16A12, 80553, 183003, 265-340; 16050, SLC16A13, 80554, 183004, 309-1589; 16051, SLC16A14, 80556, 183006, 412-537; 16051, SLC16A14, 80557, 183007, 217-1672; 16051, SLC16A14, 80558, 183008, 593-646; 16051, SLC16A14, 80559, 183009, 368-1836; 16051, SLC16A14, 80555, 183005, 460-1992; 16052, SLC16A2, 80561, 183011, 1-688; 16052, SLC16A2, 80560, 183010, 178-1797; 16053, SLC16A4, 80565, 183015, 230-403; 16053, SLC16A4, 80567, 183017, 217-390; 16053, SLC16A4, 80568, 183018, 216-344; 16053, SLC16A4, 80569, 183019, 1-660; 16053, SLC16A4, 80562, 183012, 251-1714; 16053, SLC16A4, 80563, 183013, 217-1176; 16053, SLC16A4, 80564, 183014, 304-1452; 16053, SLC16A4, 80566, 183016, 195-1514; 16053, SLC16A4, 80570, 183020, 304-1581; 16054, SLC16A6, 80572, 183022, 330-584; 16054, SLC16A6, 80574, 183024, 190-577; 16054, SLC16A6, 80575, 183025, 13-1581; 16054, SLC16A6, 80571, 183021, 166-1737; 16054, SLC16A6, 80573, 183023, 189-1760; 16055, SLC16A9, 80576, 183026, 110-1639; 16055, SLC16A9, 80577, 183027, 638-2167; 16056, SLC17A5, 80578, 183028, 270-1757; 16057, SLC17A1, 80580, 183030, 54-683; 16057, SLC17A1, 80579, 183029, 117-1520; 16057, SLC17A1, 80581, 183031, 1-1242; 16057, SLC17A1, 80582, 183032, 99-1502; 16058, SLC17A3, 80586, 183036, 69-407; 16058, SLC17A3, 80587, 183037, 1-299; 16058, SLC17A3, 80588, 183038, 1-156; 16058, SLC17A3, 80589, 183039, 103-441; 16058, SLC17A3, 80583, 183033, 287-1549; 16058, SLC17A3, 80584, 183034, 80-1342; 16058, SLC17A3, 80585, 183035, 111-1607; 16059, SLC17A6, 80590, 183040, 438-2186; 16060, SLC17A7, 80593, 183043, 1-350; 16060, SLC17A7, 80591, 183041, 173-1855; 16060, SLC17A7, 80592, 183042, 223-1704; 16061, SLC17A8, 80594, 183044, 314-2083; 16061, SLC17A8, 80595, 183045, 25-1644; 16062, SLC17A9, 80598, 183048, 109-565; 16062, SLC17A9, 80596, 183046, 205-1497; 16062, SLC17A9, 80597, 183047, 185-1495; 16063, SLC17A2, 80599, 183049, 22-1341; 16063, SLC17A2, 80600, 183050, 419-1729; 16063, SLC17A2, 80601, 183051, 534-1970; 16064, SLC17A4, 80602, 183052, 120-1613; 16064, SLC17A4, 80603, 183053, 303-968; 16064, SLC17A4, 80604, 183054, 382-1713; 16065, SLC18A3, 80605, 183055, 441-2039; 16066, SLC18A1, 80611, 183061, 187-1344; 16066, SLC18A1, 80612, 183062, 179-952; 16066, SLC18A1, 80606, 183056, 381-1862; 16066, SLC18A1, 80607, 183057, 268-1845; 16066, SLC18A1, 80608, 183058, 1-1419; 16066, SLC18A1, 80609, 183059, 472-2049; 16066, SLC18A1, 80610, 183060, 472-1890; 16066, SLC18A1, 80613, 183063, 234-1715; 16067, SLC18A2, 80614, 183064, 144-1688; 16068, SLC18B1, 80616, 183066, 67-390; 16068, SLC18B1, 80615, 183065, 98-1468; 16069, SLC19A1, 80619, 183069, 1-809; 16069, SLC19A1, 80620, 183070, 102-648; 16069, SLC19A1, 80621, 183071, 314-777; 16069, SLC19A1, 80622, 183072, 399-580; 16069, SLC19A1, 80624, 183074, 325-1962; 16069, SLC19A1, 80617, 183067, 154-1929; 16069, SLC19A1, 80618, 183068, 154-1623; 16069, SLC19A1, 80623, 183073, 101-1756; 16070, SLC19A2, 80625, 183075, 238-1731; 16070, SLC19A2, 80626, 183076, 166-1056; 16071, SLC19A3, 80628, 183078, 71-349; 16071, SLC19A3, 80629, 183079, 433-594; 16071, SLC19A3, 80631, 183081, 660-852; 16071, SLC19A3, 80632, 183082, 167-563; 16071, SLC19A3, 80633, 183083, 60-230; 16071, SLC19A3, 80627, 183077, 73-1563; 16071, SLC19A3, 80630, 183080, 71-1561; 16072, SLC2A1, 80634, 183084, 186-533; 16072, SLC2A1, 80635, 183085, 1-135; 16072, SLC2A1, 80637, 183087, 198-719; 16072, SLC2A1, 80638, 183088, 1-427; 16072, SLC2A1, 80636, 183086, 523-2001; 16073, SLC2A10, 80640, 183090, 39-80; 16073, SLC2A10, 80639, 183089, 251-1876; 16074, SLC2A11, 80641, 183091, 15-311; 16074, SLC2A11, 80645, 183095, 38-577; 16074, SLC2A11, 80646, 183096, 218-886; 16074, SLC2A11, 80647, 183097, 109-423; 16074, SLC2A11, 80648, 183098, 20-166; 16074, SLC2A11, 80649, 183099, 106-447; 16074, SLC2A11, 80650, 183100, 74-391; 16074, SLC2A11, 80651, 183101, 491-2098; 16074, SLC2A11, 80652, 183102, 218-886; 16074, SLC2A11, 80655, 183105, 491-2098; 16074, SLC2A11, 80657, 183107, 74-391; 16074, SLC2A11, 80658, 183108, 38-577; 16074, SLC2A11, 80659, 183109, 106-447; 16074, SLC2A11, 80660, 183110, 20-166; 16074, SLC2A11, 80661, 183111, 15-311; 16074, SLC2A11, 80642, 183092, 38-1537; 16074, SLC2A11, 80643, 183093, 269-1759; 16074, SLC2A11, 80644, 183094, 190-1701; 16074, SLC2A11, 80653, 183103, 190-1701; 16074, SLC2A11, 80654, 183104, 269-1759; 16074, SLC2A11, 80656, 183106, 38-1537; 16075, SLC2A12, 80662, 183112, 157-2010; 16076, SLC2A13, 80664, 183114, 282-1355; 16076, SLC2A13, 80663, 183113, 52-1998; 16077, SLC2A14, 80668, 183118, 174-533; 16077, SLC2A14, 80669, 183119, 226-682; 16077, SLC2A14, 80671, 183121, 482-548; 16077, SLC2A14, 80672, 183122, 348-854; 16077, SLC2A14, 80673, 183123, 155-578; 16077, SLC2A14, 80676, 183126, 113-229; 16077, SLC2A14, 80677, 183127, 328-580; 16077, SLC2A14, 80678, 183128, 524-665; 16077, SLC2A14, 80679, 183129, 139-561; 16077, SLC2A14, 80681, 183131, 402-440; 16077, SLC2A14, 80665, 183115, 402-1895; 16077, SLC2A14, 80666, 183116, 258-1820; 16077, SLC2A14, 80667, 183117, 168-1661; 16077, SLC2A14, 80670, 183120, 378-863; 16077, SLC2A14, 80674, 183124, 761-2323; 16077, SLC2A14, 80675, 183125, 201-1436; 16077, SLC2A14, 80680, 183130, 82-1317; 16077, SLC2A14, 80682, 183132, 22-1629; 16077, SLC2A14, 80683, 183133, 1-1563; 16078, SLC2A2, 80685, 183135, 74-343; 16078, SLC2A2, 80686, 183136, 51-458; 16078, SLC2A2, 80687, 183137, 117-425; 16078, SLC2A2, 80684, 183134, 81-1655; 16079, SLC2A3, 80689, 183139, 153-577; 16079, SLC2A3, 80690, 183140, 154-300; 16079, SLC2A3, 80688, 183138, 242-1732; 16080, SLC2A4, 80692, 183142, 298-1653; 16080, SLC2A4, 80693, 183143, 128-787; 16080, SLC2A4, 80694, 183144, 200-1585; 16080, SLC2A4, 80691, 183141, 269-1798; 16080, SLC2A4, 80695, 183145, 201-1448; 16081, SLC2A6, 80698, 183148, 151-588; 16081, SLC2A6, 80699, 183149, 69-727; 16081, SLC2A6, 80700, 183150, 38-1375; 16081, SLC2A6, 80701, 183151, 69-727; 16081, SLC2A6, 80702, 183152, 79-1602; 16081, SLC2A6, 80703, 183153, 151-588; 16081, SLC2A6, 80696, 183146, 38-1375; 16081, SLC2A6, 80697, 183147, 79-1602; 16082, SLC2A7, 80704, 183154, 1-1539; 16083, SLC2A8, 80705, 183155, 228-872; 16083, SLC2A8, 80706, 183156, 1-1236; 16083, SLC2A8, 80708, 183158, 132-933; 16083, SLC2A8, 80709, 183159, 1-831; 16083, SLC2A8, 80710, 183160, 196-992; 16083, SLC2A8, 80711, 183161, 132-854; 16083, SLC2A8, 80712, 183162, 25-793; 16083, SLC2A8, 80713, 183163, 1-506; 16083, SLC2A8, 80714, 183164, 213-1157; 16083, SLC2A8, 80707, 183157, 90-1523; 16084, SLC2A9, 80718, 183168, 145-738; 16084, SLC2A9, 80715, 183165, 55-1677; 16084, SLC2A9, 80716, 183166, 160-1695;

16084, SLC2A9, 80717, 183167, 219-1754; 16085, SLC2A5, 80721, 183171, 276-846; 16085, SLC2A5, 80722, 183172, 213-455; 16085, SLC2A5, 80723, 183173, 258-755; 16085, SLC2A5, 80724, 183174, 319-889; 16085, SLC2A5, 80725, 183175, 114-684; 16085, SLC2A5, 80726, 183176, 260-676; 16085, SLC2A5, 80727, 183177, 188-758; 16085, SLC2A5, 80719, 183169, 69-803; 16085, SLC2A5, 80720, 183170, 181-1686; 16086, SLC20A1, 80729, 183179, 1-638; 16086, SLC20A1, 80730, 183180, 1-269; 16086, SLC20A1, 80731, 183181, 1-296; 16086, SLC20A1, 80732, 183182, 1-348; 16086, SLC20A1, 80728, 183178, 540-2579; 16087, SLC20A2, 80734, 183184, 322-533; 16087, SLC20A2, 80735, 183185, 610-751; 16087, SLC20A2, 80738, 183188, 391-708; 16087, SLC20A2, 80739, 183189, 340-573; 16087, SLC20A2, 80740, 183190, 473-557; 16087, SLC20A2, 80733, 183183, 371-2329; 16087, SLC20A2, 80736, 183186, 326-2284; 16087, SLC20A2, 80737, 183187, 695-2653; 16088, SLC22A6, 80745, 183195, 135-920; 16088, SLC22A6, 80741, 183191, 294-1946; 16088, SLC22A6, 80742, 183192, 268-1959; 16088, SLC22A6, 80743, 183193, 1-1521; 16088, SLC22A6, 80744, 183194, 1-1560; 16089, SLC22A7, 80749, 183199, 25-658; 16089, SLC22A7, 80750, 183200, 99-933; 16089, SLC22A7, 80751, 183201, 404-846; 16089, SLC22A7, 80752, 183202, 99-806; 16089, SLC22A7, 80746, 183196, 1-1620; 16089, SLC22A7, 80747, 183197, 96-1742; 16089, SLC22A7, 80748, 183198, 96-1736; 16090, SLC22A8, 80753, 183203, 1-1602; 16090, SLC22A8, 80754, 183204, 137-1765; 16090, SLC22A8, 80755, 183205, 116-1744; 16090, SLC22A8, 80756, 183206, 113-1468; 16090, SLC22A8, 80757, 183207, 119-1378; 16091, SLC22A9, 80758, 183208, 250-1911; 16091, SLC22A9, 80759, 183209, 269-985; 16092, SLC22A11, 80761, 183211, 45-1490; 16092, SLC22A11, 80763, 183213, 1-220; 16092, SLC22A11, 80764, 183214, 1-462; 16092, SLC22A11, 80760, 183210, 375-2027; 16092, SLC22A11, 80762, 183212, 311-1639; 16093, SLC22A12, 80765, 183215, 295-1854; 16093, SLC22A12, 80766, 183216, 465-1802; 16093, SLC22A12, 80767, 183217, 748-2085; 16093, SLC22A12, 80768, 183218, 748-2409; 16093, SLC22A12, 80769, 183219, 727-1725; 16094, SLC22A13, 80771, 183221, 1-696; 16094, SLC22A13, 80770, 183220, 50-1705; 16095, SLC22A1, 80776, 183226, 509-653; 16095, SLC22A1, 80777, 183227, 38-460; 16095, SLC22A1, 80772, 183222, 1-1521; 16095, SLC22A1, 80773, 183223, 148-1812; 16095, SLC22A1, 80774, 183224, 1-1452; 16095, SLC22A1, 80775, 183225, 1-1062; 16096, SLC22A18AS, 80778, 183228, 127-579; 16096, SLC22A18AS, 80779, 183229, 498-1259; 16096, SLC22A18AS, 80780, 183230, 162-614; 16097, SLC22A2, 80781, 183231, 1483-2487; 16097, SLC22A2, 80782, 183232, 260-1927; 16098, SLC22A3, 80783, 183233, 153-1823; 16099, SLC22A16, 80786, 183236, 1-1299; 16099, SLC22A16, 80787, 183237, 216-737; 16099, SLC22A16, 80788, 183238, 221-1021; 16099, SLC22A16, 80789, 183239, 160-1213; 16099, SLC22A16, 80784, 183234, 285-1916; 16099, SLC22A16, 80785, 183235, 68-1801; 16100, SLC22A5, 80791, 183241, 1-720; 16100, SLC22A5, 80792, 183242, 1-112; 16100, SLC22A5, 80793, 183243, 74-499; 16100, SLC22A5, 80794, 183244, 1-410; 16100, SLC22A5, 80790, 183240, 222-1895; 16100, SLC22A5, 80795, 183245, 1-1746; 16101, SLC22A4, 80796, 183246, 175-1830; 16102, SLC22A10, 80798, 183248, 167-1285; 16102, SLC22A10, 80799, 183249, 24-818; 16102, SLC22A10, 80800, 183250, 15-632; 16102, SLC22A10, 80797, 183247, 3-1628; 16103, SLC22A14, 80803, 183253, 166-523; 16103, SLC22A14, 80801, 183251, 92-1876; 16103, SLC22A14, 80802, 183252, 43-1827; 16104, SLC22A15, 80804, 183254, 15-752; 16104, SLC22A15, 80805, 183255, 131-1774; 16105, SLC22A17, 80808, 183258, 682-1911; 16105, SLC22A17, 80806, 183256, 338-1954; 16105, SLC22A17, 80807, 183257, 505-2067; 16105, SLC22A17, 80809, 183259, 505-2121; 16106, SLC22A18, 80813, 183263, 215-1195; 16106, SLC22A18, 80814, 183264, 233-635; 16106, SLC22A18, 80815, 183265, 305-1579; 16106, SLC22A18, 80816, 183266, 434-1708; 16106, SLC22A18, 80817, 183267, 219-1493; 16106, SLC22A18, 80818, 183268, 133-1113; 16106, SLC22A18, 80819, 183269, 233-635; 16106, SLC22A18, 80810, 183260, 219-1493; 16106, SLC22A18, 80811, 183261, 305-1579; 16106, SLC22A18, 80812, 183262, 432-1706; 16107, SLC22A23, 80823, 183273, 464-2548; 16107, SLC22A23, 80824, 183274, 341-619; 16107, SLC22A23, 80825, 183275, 1-1323; 16107, SLC22A23, 80826, 183276, 63-1221; 16107, SLC22A23, 80820, 183270, 1-1086; 16107, SLC22A23, 80821, 183271, 385-1602; 16107, SLC22A23, 80822, 183272, 1-2061; 16107, SLC22A23, 80827, 183277, 601-1818; 16108, SLC22A24, 80829, 183279, 443-2098; 16108, SLC22A24, 80830, 183280, 443-2101; 16108, SLC22A24, 80828, 183278, 443-1411; 16109, SLC22A25, 80832, 183282, 1-607; 16109, SLC22A25, 80833, 183283, 1-1198; 16109, SLC22A25, 80834, 183284, 1-471; 16109, SLC22A25, 80831, 183281, 1-1644; 16110, SLC22A31, 80835, 183285, 1-1671; 16110, SLC22A31, 80836, 183286, 606-1622; 16111, SLC23A1, 80839, 183289, 1-406; 16111, SLC23A1, 80840, 183290, 1-509; 16111, SLC23A1, 80837, 183287, 48-1844; 16111, SLC23A1, 80838, 183288, 40-1848; 16112, SLC23A2, 80843, 183293, 1-911; 16112, SLC23A2, 80841, 183291, 376-2328; 16112, SLC23A2, 80842, 183292, 394-2346; 16113, SLC23A3, 80846, 183296, 7-785; 16113, SLC23A3, 80847, 183297, 21-559; 16113, SLC23A3, 80848, 183298, 1-34; 16113, SLC23A3, 80844, 183294, 112-1593; 16113, SLC23A3, 80845, 183295, 34-1866; 16113, SLC23A3, 80849, 183299, 49-1905; 16114, SLC24A1, 80854, 183304, 625-3663; 16114, SLC24A1, 80855, 183305, 211-3168; 16114, SLC24A1, 80856, 183306, 1-170; 16114, SLC24A1, 80850, 183300, 288-3587; 16114, SLC24A1, 80851, 183301, 288-3497; 16114, SLC24A1, 80852, 183302, 83-3292; 16114, SLC24A1, 80853, 183303, 1-3246; 16115, SLC24A2, 80857, 183307, 63-1997; 16115, SLC24A2, 80858, 183308, 63-2048; 16116, SLC24A3, 80859, 183309, 198-2132; 16116, SLC24A3, 80860, 183310, 1-1935; 16117, SLC24A4, 80863, 183313, 1-1393; 16117, SLC24A4, 80865, 183315, 143-334; 16117, SLC24A4, 80861, 183311, 118-1794; 16117, SLC24A4, 80862, 183312, 227-2095; 16117, SLC24A4, 80864, 183314, 97-1908; 16118, SLC24A5, 80868, 183318, 42-410; 16118, SLC24A5, 80866, 183316, 74-1576; 16118, SLC24A5, 80867, 183317, 22-1344; 16119, SLC25A12, 80869, 183319, 10-273; 16119, SLC25A12, 80871, 183321, 31-663; 16119, SLC25A12, 80872, 183322, 1-528; 16119, SLC25A12, 80870, 183320, 39-2075; 16120, SLC25A13, 80875, 183325, 181-402; 16120, SLC25A13, 80873, 183323, 138-2165; 16120, SLC25A13, 80874, 183324, 192-2222; 16121, SLC25A20, 80877, 183327, 99-329; 16121, SLC25A20, 80878, 183328, 111-797; 16121, SLC25A20, 80876, 183326, 200-1105; 16122, SLC25A18, 80879, 183329, 539-1486; 16122, SLC25A18, 80880, 183330, 465-1412; 16123, SLC25A29, 80884, 183334, 316-423; 16123, SLC25A29, 80885, 183335, 259-674; 16123, SLC25A29, 80886, 183336, 286-654; 16123, SLC25A29, 80887, 183337, 284-391; 16123, SLC25A29, 80889, 183339, 181-569; 16123, SLC25A29, 80881, 183331, 302-1213; 16123, SLC25A29, 80882, 183332, 210-647; 16123, SLC25A29, 80883, 183333, 3289-4002; 16123, SLC25A29, 80888, 183338, 194-907; 16123, SLC25A29, 80890, 183340, 230-943; 16124, SLC25A16, 80891, 183341, 64-237; 16124, SLC25A16, 80892, 183342, 42-320; 16124, SLC25A16, 80893, 183343, 1-198; 16124, SLC25A16, 80895, 183345, 1-197; 16124, SLC25A16, 80894, 183344, 100-1098; 16125, SLC25A14, 80899, 183349, 237-831; 16125, SLC25A14, 80901, 183351, 120-992; 16125, SLC25A14, 80896, 183346, 228-1205; 16125, SLC25A14, 80897, 183347, 1-1062; 16125, SLC25A14, 80898, 183348, 1-969; 16125, SLC25A14, 80900, 183350, 262-1239; 16125, SLC25A14, 80902, 183352, 262-1323; 16126, SLC25A22, 80904, 183354, 263-606; 16126, SLC25A22, 80905, 183355, 270-839; 16126, SLC25A22, 80906, 183356, 170-1108; 16126, SLC25A22, 80907, 183357, 551-769; 16126, SLC25A22, 80908, 183358, 260-569; 16126, SLC25A22, 80909, 183359, 324-558; 16126, SLC25A22, 80910, 183360, 219-437; 16126, SLC25A22, 80911, 183361, 218-436; 16126, SLC25A22, 80912, 183362, 263-746; 16126, SLC25A22, 80913, 183363, 264-666; 16126, SLC25A22, 80914, 183364, 540-736; 16126, SLC25A22, 80915, 183365, 357-824; 16126, SLC25A22, 80916, 183366, 214-802; 16126, SLC25A22, 80917, 183367, 184-565; 16126, SLC25A22, 80918, 183368, 211-741; 16126, SLC25A22, 80920, 183370, 226-816; 16126, SLC25A22, 80922, 183372, 288-579; 16126, SLC25A22, 80923, 183373, 281-1021; 16126, SLC25A22, 80924, 183374, 357-709; 16126, SLC25A22, 80903, 183353, 385-1356; 16126, SLC25A22, 80919, 183369, 548-1519; 16126, SLC25A22, 80921, 183371, 281-1252; 16127, SLC25A31, 80925, 183375, 169-1116; 16128, SLC25A4, 80927, 183377, 96-722; 16128, SLC25A4, 80926, 183376, 133-1029; 16129, SLC25A5, 80928, 183378, 117-1013; 16130, SLC25A6, 80929, 183379, 716-1612; 16131, SLC25A1, 80931, 183381, 351-977; 16131, SLC25A1, 80930, 183380, 158-1093; 16132, SLC25A10, 80934, 183384, 192-1412; 16132, SLC25A10, 80935, 183385, 1-340; 16132, SLC25A10, 80936, 183386, 164-283; 16132, SLC25A10, 80932, 183382, 121-1011; 16132, SLC25A10, 80933, 183383, 87-950; 16133, SLC25A15, 80938, 183388, 70-468; 16133, SLC25A15, 80939, 183389, 70-243; 16133, SLC25A15, 80937, 183387, 237-1142; 16134, SLC25A2, 80940, 183390, 181-1086; 16135, SLC25A11, 80943, 183393, 4-893; 16135, SLC25A11, 80941, 183391, 342-1286; 16135, SLC25A11, 80942, 183392, 144-935; 16136, SLC25A17, 80944, 183394, 83-274; 16136, SLC25A17, 80945, 183395, 982-1659; 16136, SLC25A17, 80946, 183396, 152-289; 16136, SLC25A17, 80947, 183397, 85-531; 16136, SLC25A17, 80948, 183398, 103-234; 16136, SLC25A17, 80950, 183400, 79-798; 16136, SLC25A17, 80951, 183401, 142-288; 16136, SLC25A17, 80952, 183402, 290-565; 16136, SLC25A17, 80953, 183403, 69-218; 16136, SLC25A17, 80954, 183404, 99-236; 16136, SLC25A17, 80955, 183405, 90-227; 16136, SLC25A17, 80956, 183406, 133-270; 16136, SLC25A17, 80957, 183407, 120-290; 16136, SLC25A17, 80958, 183408, 152-856; 16136, SLC25A17, 80949, 183399, 135-1058; 16137, SLC25A23, 80962, 183412, 1-709; 16137, SLC25A23, 80963, 183413, 1-300; 16137, SLC25A23, 80964, 183414, 1-834; 16137, SLC25A23, 80965, 183415, 1-649; 16137, SLC25A23, 80966, 183416, 327-557; 16137, SLC25A23, 80967, 183417, 1-272; 16137, SLC25A23, 80968, 183418, 1-395; 16137, SLC25A23, 80959, 183409, 124-1572; 16137, SLC25A23, 80960, 183410, 108-1514; 16137, SLC25A23, 80961, 183411, 108-1424; 16138, SLC25A24, 80969, 183419, 142-474; 16138, SLC25A24, 80971, 183421, 712-921; 16138, SLC25A24, 80970, 183420, 198-1574; 16138, SLC25A24, 80972, 183422, 221-1654; 16139, SLC25A25, 80978, 183428, 1-496; 16139, SLC25A25, 80979, 183429, 31-258; 16139, SLC25A25, 80973, 183423, 264-1673; 16139, SLC25A25, 80974, 183424, 408-1913; 16139, SLC25A25, 80975, 183425, 120-1631; 16139, SLC25A25, 80976, 183426, 28-1575; 16139, SLC25A25, 80977, 183427, 408-1877; 16140, SLC25A3, 80984, 183434, 90-550; 16140, SLC25A3, 80987, 183437, 56-424; 16140, SLC25A3, 80988, 183438, 46-360; 16140, SLC25A3, 80989, 183439, 255-1229; 16140, SLC25A3, 80990, 183440, 294-756; 16140, SLC25A3, 80991, 183441, 60-530; 16140, SLC25A3, 80980, 183430, 355-1440; 16140, SLC25A3, 80981, 183431, 121-1209; 16140, SLC25A3, 80982, 183432, 151-1236; 16140, SLC25A3, 80983, 183433, 92-1180; 16140, SLC25A3, 80985, 183435, 54-1139; 16140, SLC25A3, 80986, 183436, 86-1171; 16141, SLC25A32, 80993, 183443, 235-606; 16141, SLC25A32, 80994, 183444, 133-504; 16141, SLC25A32, 80995, 183445, 253-702; 16141, SLC25A32, 80992, 183442, 168-1115; 16142, SLC25A28, 80997, 183447, 1-678; 16142, SLC25A28, 80996, 183446, 30-1124; 16143, SLC25A37, 80999, 183449, 48-527; 16143, SLC25A37, 81000, 183450, 1-462; 16143, SLC25A37, 80998, 183448, 48-515; 16143, SLC25A37, 81001, 183451, 199-1215; 16144, SLC25A21, 81004, 183454, 131-835; 16144, SLC25A21, 81002, 183452, 517-1416; 16144, SLC25A21, 81003, 183453, 74-970; 16145, SLC25A19, 81010, 183460, 146-693; 16145, SLC25A19, 81011, 183461, 296-748; 16145, SLC25A19, 81012, 183462, 1-202; 16145, SLC25A19, 81013, 183463, 257-513; 16145, SLC25A19, 81014, 183464, 329-582; 16145, SLC25A19, 81015, 183465, 401-717; 16145, SLC25A19, 81016, 183466, 397-855; 16145, SLC25A19, 81018, 183468, 452-569; 16145, SLC25A19, 81005, 183455, 231-1193; 16145, SLC25A19, 81006, 183456, 225-1016; 16145, SLC25A19, 81007, 183457, 911-1873; 16145, SLC25A19, 81008, 183458, 166-1128; 16145, SLC25A19, 81009, 183459, 76-1038; 16145, SLC25A19, 81017, 183467, 171-1133; 16146, SLC25A33, 81019, 183469, 211-1176; 16147, SLC25A36, 81021, 183471, 155-1012; 16147, SLC25A36, 81023, 183473, 169-567; 16147, SLC25A36, 81024, 183474, 378-578; 16147, SLC25A36, 81026, 183476, 10-279; 16147, SLC25A36, 81027, 183477, 112-372; 16147, SLC25A36, 81020, 183470, 169-1104; 16147, SLC25A36, 81022, 183472, 226-1158; 16147, SLC25A36, 81025, 183475, 161-559; 16147, SLC25A36, 81028, 183478, 62-460; 16148, SLC25A26, 81030, 183480, 729-1553; 16148, SLC25A26, 81031, 183481, 75-707; 16148, SLC25A26, 81032, 183482, 139-399; 16148, SLC25A26, 81033, 183483, 1-275; 16148, SLC25A26, 81034, 183484, 139-399; 16148, SLC25A26, 81035, 183485, 1-275; 16148, SLC25A26, 81036, 183486, 75-707; 16148, SLC25A26, 81037, 183487, 729-1553; 16148, SLC25A26, 81038, 183488, 191-751; 16148, SLC25A26, 81029, 183479, 191-751; 16149, SLC25A27, 81041, 183491, 1-296; 16149, SLC25A27, 81042, 183492, 1-433; 16149, SLC25A27, 81043, 183493, 212-659; 16149, SLC25A27, 81044, 183494, 1-436; 16149, SLC25A27, 81039, 183489, 253-1224; 16149, SLC25A27, 81040, 183490, 279-1016; 16150, SLC25A30, 81045, 183495, 341-454; 16150, SLC25A30, 81046, 183496, 137-250; 16150, SLC25A30, 81048, 183498, 171-582; 16150, SLC25A30, 81049, 183499, 170-453; 16150, SLC25A30, 81051, 183501, 1-359; 16150, SLC25A30, 81047, 183497, 1-1012; 16150, SLC25A30, 81050, 183500, 246-968; 16151, SLC25A34, 81052, 183502, 82-996; 16152, SLC25A35, 81053, 183503, 46-933; 16152, SLC25A35, 81054, 183504, 537-1424; 16152, SLC25A35, 81055, 183505, 32-919; 16152, SLC25A35, 81056, 183506, 30-905; 16152, SLC25A35, 81057, 183507, 512-1414; 16152, SLC25A35, 81058, 183508, 1-864; 16153, SLC25A38, 81060, 183510, 377-820; 16153, SLC25A38, 81059, 183509, 378-1292; 16154, SLC25A39, 81063, 183513, 133-1143; 16154, SLC25A39, 81064, 183514, 347-839; 16154, SLC25A39, 81065, 183515, 133-561; 16154, SLC25A39, 81066, 183516, 270-566; 16154, SLC25A39, 81067, 183517, 359-574; 16154, SLC25A39, 81068, 183518, 1-801; 16154, SLC25A39, 81069, 183519, 145-828; 16154, SLC25A39, 81071, 183521, 558-837; 16154, SLC25A39, 81072, 183522, 1-186; 16154, SLC25A39, 81061, 183511, 176-1231; 16154, SLC25A39, 81062, 183512, 121-1200; 16154, SLC25A39, 81070, 183520, 128-1183; 16155, SLC25A40, 81074, 183524, 4-117; 16155, SLC25A40, 81075, 183525, 52-162; 16155, SLC25A40, 81076, 183526, 454-564; 16155, SLC25A40, 81073, 183523, 348-1364; 16156, SLC25A41, 81077, 183527, 70-1182; 16156, SLC25A41, 81078, 183528, 70-798; 16156, SLC25A41, 81079, 183529, 87-1199; 16157, SLC25A42, 81080, 183530, 152-1108; 16158, SLC25A43, 81081, 183531, 345-1370; 16159, SLC25A44, 81083, 183533, 330-1298; 16159, SLC25A44, 81082, 183532, 173-1117; 16160, SLC25A45, 81086, 183536, 208-561; 16160, SLC25A45, 81088, 183538, 165-275; 16160, SLC25A45, 81089, 183539, 207-350; 16160, SLC25A45, 81090, 183540, 28-138; 16160, SLC25A45, 81091, 183541, 812-955; 16160, SLC25A45, 81092, 183542, 179-331; 16160, SLC25A45, 81094, 183544, 1-681; 16160, SLC25A45, 81084, 183534, 243-983; 16160, SLC25A45, 81085, 183535, 205-1071; 16160, SLC25A45, 81087, 183537, 423-1217; 16160, SLC25A45, 81093, 183543, 57-923; 16161, SLC25A46, 81097, 183547, 291-1061; 16161, SLC25A46, 81099, 183549, 548-1165; 16161, SLC25A46, 81095, 183545, 127-1383; 16161, SLC25A46, 81096, 183546, 80-1093; 16161, SLC25A46, 81098, 183548, 525-1343; 16162, SLC25A47, 81101, 183551, 573-1061; 16162, SLC25A47, 81100, 183550, 79-1005; 16163, SLC25A48, 81103, 183553, 297-1070; 16163, SLC25A48, 81104, 183554, 200-415; 16163, SLC25A48, 81106, 183556, 43-246; 16163, SLC25A48, 81102, 183552, 173-1048; 16163, SLC25A48, 81105, 183555, 122-595; 16164, SLC25A51, 81107, 183557, 231-1124; 16164, SLC25A51, 81108, 183558, 745-1638; 16164, SLC25A51, 81109, 183559, 45-938; 16165, SLC25A52, 81110, 183560, 190-1113; 16166, SLC25A53, 81111, 183561, 182-1105; 16167, SLC26A1, 81112, 183562, 379-2484; 16167, SLC26A1, 81113, 183563, 168-2273; 16167, SLC26A1, 81114, 183564, 104-778; 16167, SLC26A1, 81115, 183565, 383-1057; 16168, SLC26A11, 81119, 183569, 1-591; 16168, SLC26A11, 81120, 183570, 304-762; 16168, SLC26A11, 81121, 183571, 216-845; 16168, SLC26A11, 81122, 183572, 1-176; 16168, SLC26A11, 81123, 183573, 73-472; 16168, SLC26A11, 81125, 183575, 331-523; 16168, SLC26A11, 81126, 183576, 315-547; 16168, SLC26A11, 81116, 183566, 281-2101; 16168, SLC26A11, 81117, 183567, 270-2090; 16168, SLC26A11, 81118, 183568, 203-2023; 16168, SLC26A11, 81124, 183574, 42-1862; 16169, SLC26A2, 81128, 183578, 501-570; 16169, SLC26A2, 81129, 183579, 1-375; 16169, SLC26A2, 81127, 183577, 269-2488; 16170, SLC26A3, 81131, 183581, 204-362; 16170, SLC26A3, 81132, 183582, 193-552; 16170, SLC26A3, 81130, 183580, 186-2480; 16171, SLC26A4, 81134, 183584, 208-600; 16171, SLC26A4, 81133, 183583, 225-2567; 16172, SLC26A5, 81137, 183587, 263-2503; 16172, SLC26A5, 81140, 183590, 9-2249; 16172, SLC26A5, 81141, 183591, 166-2289; 16172, SLC26A5, 81144, 183594, 168-1589; 16172, SLC26A5, 81146, 183596, 166-801; 16172, SLC26A5, 81147, 183597, 168-914; 16172, SLC26A5, 81148, 183598, 168-1511; 16172, SLC26A5, 81135, 183585, 263-2497; 16172, SLC26A5, 81136, 183586, 237-2294; 16172, SLC26A5, 81138, 183588, 237-1244; 16172, SLC26A5, 81139, 183589, 9-2153; 16172, SLC26A5, 81142, 183592, 168-2306; 16172, SLC26A5, 81143, 183593, 237-1787; 16172, SLC26A5, 81145, 183595, 263-2401; 16173, SLC26A6, 81149, 183599, 62-424; 16173, SLC26A6, 81150, 183600, 101-2056; 16173, SLC26A6, 81151, 183601, 252-2468; 16173, SLC26A6, 81154, 183604, 1-267; 16173, SLC26A6, 81155, 183605, 1-583; 16173, SLC26A6, 81156, 183606, 1-910; 16173, SLC26A6, 81158, 183608, 49-588; 16173, SLC26A6, 81159, 183609, 1-654; 16173, SLC26A6, 81161, 183611, 49-555; 16173, SLC26A6, 81162, 183612, 101-2362; 16173, SLC26A6, 81152, 183602, 62-2284; 16173, SLC26A6, 81153, 183603, 49-2328; 16173, SLC26A6, 81157, 183607, 49-2220; 16173, SLC26A6, 81160, 183610, 91-2367; 16174, SLC26A7, 81165, 183615, 199-1008; 16174, SLC26A7, 81166, 183616, 1-713; 16174, SLC26A7, 81168, 183618, 198-818; 16174, SLC26A7, 81170, 183620, 972-2039; 16174, SLC26A7, 81163, 183613, 240-2210; 16174, SLC26A7, 81164, 183614, 221-2212; 16174, SLC26A7, 81167, 183617, 273-2243; 16174, SLC26A7, 81169, 183619, 232-2202; 16175, SLC26A8, 81174, 183624, 1-961; 16175, SLC26A8, 81175, 183625, 1-554; 16175, SLC26A8, 81176, 183626, 13-582; 16175, SLC26A8, 81171, 183621, 172-3084; 16175, SLC26A8, 81172, 183622, 167-2764; 16175, SLC26A8, 81173, 183623, 355-3267; 16176, SLC26A9, 81177, 183627, 3-2666; 16176, SLC26A9, 81178, 183628, 115-2778; 16176, SLC26A9, 81179, 183629, 115-2490; 16177, SLC26A10, 81181, 183631, 1-1237; 16177, SLC26A10, 81182, 183632, 10-1572; 16177, SLC26A10, 81180, 183630, 312-2003; 16178, SLC27A1, 81184, 183634, 14-304; 16178, SLC27A1, 81185, 183635, 4-678; 16178, SLC27A1, 81186, 183636, 1-500; 16178, SLC27A1, 81187, 183637, 244-918; 16178, SLC27A1, 81183, 183633, 98-2038; 16178, SLC27A1, 81188, 183638, 904-2307; 16179, SLC27A2, 81191, 183641, 580-1737; 16179, SLC27A2, 81189, 183639, 233-2095; 16179, SLC27A2, 81190, 183640, 196-1899; 16180, SLC27A3, 81192, 183642, 761-3196; 16180, SLC27A3, 81194, 183644, 1-1202; 16180, SLC27A3, 81195, 183645, 1-433; 16180, SLC27A3, 81196, 183646, 1-457; 16180, SLC27A3, 81197, 183647, 761-3196; 16180, SLC27A3, 81198, 183648, 1-457; 16180, SLC27A3, 81199, 183649, 1-1202; 16180, SLC27A3, 81200, 183650, 1-433; 16180, SLC27A3, 81193, 183643, 66-2258; 16180, SLC27A3, 81201, 183651, 66-2258; 16180, SLC27A3, 81202, 183652, 66-2258; 16181, SLC27A4, 81203, 183653, 118-2049; 16181, SLC27A4, 81204, 183654, 118-831; 16182, SLC27A5, 81206, 183656, 162-449; 16182, SLC27A5, 81208, 183658, 174-461; 16182, SLC27A5, 81205, 183655, 111-2183; 16182, SLC27A5, 81207, 183657, 38-1858; 16183, SLC27A6, 81212, 183662, 326-811; 16183, SLC27A6, 81209, 183659, 1011-2870; 16183, SLC27A6, 81210, 183660, 397-2256; 16183, SLC27A6, 81211, 183661, 435-2294; 16184, SLC28A1, 81216, 183666, 108-1559; 16184, SLC28A1, 81213, 183663, 91-2040; 16184, SLC28A1, 81214, 183664, 231-758; 16184, SLC28A1, 81215, 183665, 224-2173; 16185, SLC28A2, 81218, 183668, 1-215; 16185, SLC28A2, 81219, 183669, 1-581; 16185, SLC28A2, 81217, 183667, 66-2042; 16186, SLC28A3, 81220, 183670, 51-2126; 16187, SLC29A1, 81221, 183671, 176-1546; 16187, SLC29A1, 81222, 183672, 185-1555; 16187,

SLC29A1, 81223, 183673, 292-1662; 16187, SLC29A1, 81224, 183674, 275-1645; 16187, SLC29A1, 81225, 183675, 236-1606; 16187, SLC29A1, 81226, 183676, 129-1499; 16187, SLC29A1, 81227, 183677, 492-1862; 16187, SLC29A1, 81228, 183678, 333-1703; 16187, SLC29A1, 81229, 183679, 179-1549; 16188, SLC29A2, 81230, 183680, 111-1196; 16188, SLC29A2, 81236, 183686, 230-1315; 16188, SLC29A2, 81231, 183681, 230-1600; 16188, SLC29A2, 81232, 183682, 221-1591; 16188, SLC29A2, 81233, 183683, 226-1596; 16188, SLC29A2, 81234, 183684, 57-665; 16188, SLC29A2, 81235, 183685, 230-1135; 16189, SLC29A3, 81237, 183687, 53-1480; 16190, SLC29A4, 81241, 183691, 135-623; 16190, SLC29A4, 81242, 183692, 133-585; 16190, SLC29A4, 81238, 183688, 126-1718; 16190, SLC29A4, 81239, 183689, 162-1754; 16190, SLC29A4, 81240, 183690, 63-1613; 16191, SLC3A1, 81247, 183697, 69-623; 16191, SLC3A1, 81249, 183699, 73-1767; 16191, SLC3A1, 81251, 183701, 146-574; 16191, SLC3A1, 81252, 183702, 79-1737; 16191, SLC3A1, 81243, 183693, 77-2134; 16191, SLC3A1, 81244, 183694, 1-1695; 16191, SLC3A1, 81245, 183695, 309-1259; 16191, SLC3A1, 81246, 183696, 1019-2242; 16191, SLC3A1, 81248, 183698, 1-1509; 16191, SLC3A1, 81250, 183700, 1-1176; 16192, SLC3A2, 81256, 183706, 160-2055; 16192, SLC3A2, 81257, 183707, 129-565; 16192, SLC3A2, 81258, 183708, 1098-1300; 16192, SLC3A2, 81259, 183709, 1-741; 16192, SLC3A2, 81260, 183710, 1-367; 16192, SLC3A2, 81261, 183711, 185-589; 16192, SLC3A2, 81262, 183712, 103-1902; 16192, SLC3A2, 81263, 183713, 129-269; 16192, SLC3A2, 81264, 183714, 807-1334; 16192, SLC3A2, 81265, 183715, 1-75; 16192, SLC3A2, 81253, 183703, 153-1742; 16192, SLC3A2, 81254, 183704, 127-1833; 16192, SLC3A2, 81255, 183705, 169-2061; 16193, SLC30A1, 81266, 183716, 131-1654; 16194, SLC30A2, 81267, 183717, 238-1356; 16194, SLC30A2, 81268, 183718, 218-1189; 16195, SLC30A3, 81270, 183720, 1-904; 16195, SLC30A3, 81271, 183721, 295-590; 16195, SLC30A3, 81272, 183722, 308-997; 16195, SLC30A3, 81273, 183723, 209-540; 16195, SLC30A3, 81274, 183724, 324-834; 16195, SLC30A3, 81275, 183725, 180-899; 16195, SLC30A3, 81269, 183719, 354-1520; 16196, SLC30A4, 81276, 183726, 316-1605; 16197, SLC30A5, 81280, 183730, 1-254; 16197, SLC30A5, 81281, 183731, 168-382; 16197, SLC30A5, 81282, 183732, 1-196; 16197, SLC30A5, 81283, 183733, 1469-2551; 16197, SLC30A5, 81277, 183727, 266-622; 16197, SLC30A5, 81278, 183728, 611-2908; 16197, SLC30A5, 81279, 183729, 59-292; 16198, SLC30A6, 81287, 183737, 40-1203; 16198, SLC30A6, 81288, 183738, 38-133; 16198, SLC30A6, 81289, 183739, 38-573; 16198, SLC30A6, 81290, 183740, 20-388; 16198, SLC30A6, 81292, 183742, 38-217; 16198, SLC30A6, 81284, 183734, 38-1423; 16198, SLC30A6, 81285, 183735, 61-1359; 16198, SLC30A6, 81286, 183736, 38-1543; 16198, SLC30A6, 81291, 183741, 61-1377; 16199, SLC30A7, 81294, 183744, 1-262; 16199, SLC30A7, 81293, 183743, 10-1140; 16199, SLC30A7, 81295, 183745, 188-1318; 16200, SLC30A8, 81298, 183748, 287-549; 16200, SLC30A8, 81301, 183751, 479-587; 16200, SLC30A8, 81302, 183752, 668-823; 16200, SLC30A8, 81296, 183746, 435-1397; 16200, SLC30A8, 81297, 183747, 1-1110; 16200, SLC30A8, 81299, 183749, 321-1283; 16200, SLC30A8, 81300, 183750, 247-1209; 16201, SLC30A9, 81304, 183754, 151-510; 16201, SLC30A9, 81303, 183753, 181-1887; 16202, SLC30A10, 81305, 183755, 212-883; 16202, SLC30A10, 81306, 183756, 163-1620; 16203, SLC31A1, 81307, 183757, 153-725; 16204, SLC31A2, 81309, 183759, 46-267; 16204, SLC31A2, 81308, 183758, 134-565; 16205, SLC32A1, 81310, 183760, 264-1841; 16206, SLC33A1, 81313, 183763, 1-328; 16206, SLC33A1, 81314, 183764, 1-808; 16206, SLC33A1, 81315, 183765, 1-555; 16206, SLC33A1, 81311, 183761, 433-2082; 16206, SLC33A1, 81312, 183762, 382-2031; 16207, SLC34A1, 81318, 183768, 204-532; 16207, SLC34A1, 81316, 183766, 92-2011; 16207, SLC34A1, 81317, 183767, 102-1124; 16208, SLC34A2, 81321, 183771, 61-549; 16208, SLC34A2, 81322, 183772, 100-582; 16208, SLC34A2, 81319, 183769, 51-2123; 16208, SLC34A2, 81320, 183770, 105-2174; 16208, SLC34A2, 81323, 183773, 73-2142; 16209, SLC34A3, 81324, 183774, 187-1986; 16209, SLC34A3, 81325, 183775, 225-2024; 16210, SLC35B2, 81326, 183776, 145-429; 16210, SLC35B2, 81327, 183777, 145-1443; 16210, SLC35B2, 81328, 183778, 212-1111; 16210, SLC35B2, 81329, 183779, 286-1305; 16210, SLC35B2, 81330, 183780, 259-1410; 16210, SLC35B2, 81331, 183781, 308-1459; 16211, SLC35B3, 81332, 183782, 451-1656; 16212, SLC35A1, 81335, 183785, 80-649; 16212, SLC35A1, 81336, 183786, 1-198; 16212, SLC35A1, 81337, 183787, 42-611; 16212, SLC35A1, 81333, 183783, 28-1041; 16212, SLC35A1, 81334, 183784, 80-916; 16213, SLC35C1, 81340, 183790, 367-582; 16213, SLC35C1, 81341, 183791, 200-695; 16213, SLC35C1, 81338, 183788, 1397-2491; 16213, SLC35C1, 81339, 183789, 478-1533; 16214, SLC35C2, 81346, 183796, 1-588; 16214, SLC35C2, 81347, 183797, 259-731; 16214, SLC35C2, 81342, 183792, 484-1581; 16214, SLC35C2, 81343, 183793, 127-1311; 16214, SLC35C2, 81344, 183794, 542-1639; 16214, SLC35C2, 81345, 183795, 283-1380; 16214, SLC35C2, 81348, 183798, 292-1326; 16215, SLC35A2, 81350, 183800, 42-533; 16215, SLC35A2, 81351, 183801, 82-738; 16215, SLC35A2, 81353, 183803, 11-685; 16215, SLC35A2, 81356, 183806, 351-877; 16215, SLC35A2, 81358, 183808, 11-1231; 16215, SLC35A2, 81359, 183809, 11-541; 16215, SLC35A2, 81360, 183810, 11-1009; 16215, SLC35A2, 81361, 183811, 1-526; 16215, SLC35A2, 81362, 183812, 11-355; 16215, SLC35A2, 81363, 183813, 34-342; 16215, SLC35A2, 81364, 183814, 16-1197; 16215, SLC35A2, 81365, 183815, 11-584; 16215, SLC35A2, 81366, 183816, 11-193; 16215, SLC35A2, 81349, 183799, 224-1414; 16215, SLC35A2, 81352, 183802, 323-1504; 16215, SLC35A2, 81354, 183804, 1-607; 16215, SLC35A2, 81355, 183805, 34-762; 16215, SLC35A2, 81357, 183807, 11-1276; 16216, SLC35D1, 81367, 183817, 87-1154; 16217, SLC35D2, 81369, 183819, 49-540; 16217, SLC35D2, 81368, 183818, 64-1077; 16217, SLC35D2, 81370, 183820, 77-826; 16218, SLC35A3, 81373, 183823, 75-748; 16218, SLC35A3, 81377, 183827, 310-563; 16218, SLC35A3, 81371, 183821, 102-1205; 16218, SLC35A3, 81372, 183822, 393-1370; 16218, SLC35A3, 81374, 183824, 302-1279; 16218, SLC35A3, 81375, 183825, 393-1055; 16218, SLC35A3, 81376, 183826, 228-1205; 16219, SLC35B4, 81379, 183829, 153-551; 16219, SLC35B4, 81378, 183828, 301-1296; 16219, SLC35B4, 81380, 183830, 147-842; 16220, SLC35A4, 81384, 183834, 17-328; 16220, SLC35A4, 81381, 183831, 1108-2082; 16220, SLC35A4, 81382, 183832, 1687-2661; 16220, SLC35A4, 81383, 183833, 729-1703; 16221, SLC35A5, 81385, 183835, 222-929; 16221, SLC35A5, 81387, 183837, 223-486; 16221, SLC35A5, 81388, 183838, 134-575; 16221, SLC35A5, 81389, 183839, 392-751; 16221, SLC35A5, 81386, 183836, 284-1558; 16222, SLC35B1, 81391, 183841, 1-581; 16222, SLC35B1, 81392, 183842, 263-943; 16222, SLC35B1, 81393, 183843, 84-845; 16222, SLC35B1, 81394, 183844, 1-114; 16222, SLC35B1, 81395, 183845, 147-620; 16222, SLC35B1, 81396, 183846, 320-548; 16222, SLC35B1, 81397, 183847, 72-633; 16222, SLC35B1, 81398, 183848, 6-862; 16222, SLC35B1, 81390, 183840, 256-1335; 16223, SLC35D3, 81399, 183849, 166-1416; 16224, SLC35E1, 81400, 183850, 1-316; 16224, SLC35E1, 81401, 183851, 205-552; 16224, SLC35E1, 81402, 183852, 1-1035; 16224, SLC35E1, 81404, 183854, 219-542; 16224, SLC35E1, 81403, 183853, 19-1251; 16225, SLC35E2, 81405, 183855, 417-1217; 16225, SLC35E2, 81406, 183856, 762-1502; 16226, SLC35E2B, 81407, 183857, 842-1582; 16226, SLC35E2B, 81408, 183858, 762-1979; 16226, SLC35E2B, 81409, 183859, 428-1645; 16227, SLC35E3, 81411, 183861, 1-378; 16227, SLC35E3, 81410, 183860, 273-1214; 16228, SLC35E4, 81414, 183864, 1-612; 16228, SLC35E4, 81412, 183862, 800-1852; 16228, SLC35E4, 81413, 183863, 129-833; 16229, SLC35F1, 81415, 183865, 202-1428; 16229, SLC35F1, 81416, 183866, 8-1057; 16230, SLC35F2, 81418, 183868, 33-143; 16230, SLC35F2, 81419, 183869, 1-798; 16230, SLC35F2, 81420, 183870, 42-158; 16230, SLC35F2, 81417, 183867, 93-1076; 16230, SLC35F2, 81421, 183871, 590-1663; 16230, SLC35F2, 81422, 183872, 422-1546; 16231, SLC35F3, 81423, 183873, 229-1494; 16231, SLC35F3, 81424, 183874, 146-1618; 16232, SLC35F4, 81426, 183876, 1430-1885; 16232, SLC35F4, 81428, 183878, 238-1695; 16232, SLC35F4, 81429, 183879, 1-140; 16232, SLC35F4, 81425, 183875, 1-1566; 16232, SLC35F4, 81427, 183877, 363-1451; 16233, SLC35F5, 81431, 183881, 818-2371; 16233, SLC35F5, 81432, 183882, 745-1491; 16233, SLC35F5, 81433, 183883, 1-725; 16233, SLC35F5, 81434, 183884, 1-116; 16233, SLC35F5, 81430, 183880, 415-1986; 16234, SLC35F6, 81436, 183886, 26-181; 16234, SLC35F6, 81437, 183887, 67-234; 16234, SLC35F6, 81435, 183885, 63-1178; 16235, SLC35G1, 81440, 183890, 44-184; 16235, SLC35G1, 81441, 183891, 13-204; 16235, SLC35G1, 81442, 183892, 33-224; 16235, SLC35G1, 81443, 183893, 34-225; 16235, SLC35G1, 81438, 183888, 62-1156; 16235, SLC35G1, 81439, 183889, 62-1159; 16236, SLC35G2, 81444, 183894, 150-1388; 16236, SLC35G2, 81445, 183895, 629-1867; 16237, SLC35G3, 81446, 183896, 217-1233; 16238, SLC35G5, 81447, 183897, 220-1236; 16239, SLC35G6, 81448, 183898, 186-1202; 16240, SLC36A1, 81451, 183901, 342-552; 16240, SLC36A1, 81453, 183903, 274-488; 16240, SLC36A1, 81454, 183904, 1-438; 16240, SLC36A1, 81455, 183905, 289-587; 16240, SLC36A1, 81456, 183906, 1-268; 16240, SLC36A1, 81457, 183907, 193-1359; 16240, SLC36A1, 81449, 183899, 224-1654; 16240, SLC36A1, 81450, 183900, 100-831; 16240, SLC36A1, 81452, 183902, 139-1569; 16240, SLC36A1, 81458, 183908, 144-1304; 16241, SLC36A2, 81460, 183910, 69-512; 16241, SLC36A2, 81461, 183911, 1-323; 16241, SLC36A2, 81462, 183912, 69-512; 16241, SLC36A2, 81463, 183913, 131-1318; 16241, SLC36A2, 81459, 183909, 131-1582; 16242, SLC36A4, 81465, 183915, 49-888; 16242, SLC36A4, 81466, 183916, 133-468; 16242, SLC36A4, 81464, 183914, 132-1646; 16242, SLC36A4, 81467, 183917, 586-1695; 16243, SLC36A3, 81468, 183918, 413-1825; 16243, SLC36A3, 81469, 183919, 143-1678; 16244, SLC37A1, 81472, 183922, 439-494; 16244, SLC37A1, 81473, 183923, 513-568; 16244, SLC37A1, 81470, 183920, 983-2584; 16244, SLC37A1, 81471, 183921, 413-2014; 16245, SLC37A2, 81476, 183926, 103-552; 16245, SLC37A2, 81474, 183924, 33-1550; 16245, SLC37A2, 81475, 183925, 302-1807; 16246, SLC37A4, 81477, 183927, 758-2047; 16246, SLC37A4, 81478, 183928, 403-1473; 16246, SLC37A4, 81479, 183929, 442-1797; 16246, SLC37A4, 81480, 183930, 254-1543; 16247, SLC37A3, 81484, 183934, 501-544; 16247, SLC37A3, 81485, 183935, 145-819; 16247, SLC37A3, 81486, 183936, 1-296; 16247, SLC37A3, 81487, 183937, 1-244; 16247, SLC37A3, 81488, 183938, 1-451; 16247, SLC37A3, 81489, 183939, 1-452; 16247, SLC37A3, 81490, 183940, 1-369; 16247, SLC37A3, 81491, 183941, 1-486; 16247, SLC37A3, 81492, 183942, 137-301; 16247, SLC37A3, 81493, 183943, 1-171; 16247, SLC37A3, 81494, 183944, 188-647; 16247, SLC37A3, 81495, 183945, 1-578; 16247, SLC37A3, 81496, 183946, 134-334; 16247, SLC37A3, 81497, 183947, 1-378; 16247, SLC37A3, 81498, 183948, 1-534; 16247, SLC37A3, 81481, 183931, 205-1689; 16247, SLC37A3, 81482, 183932, 113-1444; 16247, SLC37A3, 81483, 183933, 158-1594; 16248, SLC38A1, 81503, 183953, 657-891; 16248, SLC38A1, 81504, 183954, 686-2197; 16248, SLC38A1, 81505, 183955, 96-1607; 16248, SLC38A1, 81499, 183949, 696-2159; 16248, SLC38A1, 81500, 183950, 804-2267; 16248, SLC38A1, 81501, 183951, 464-1927; 16248, SLC38A1, 81502, 183952, 564-2027; 16249, SLC38A10, 81508, 183958, 1-896; 16249, SLC38A10, 81509, 183959, 172-528; 16249, SLC38A10, 81510, 183960, 1-211; 16249, SLC38A10, 81511, 183961, 1-774; 16249, SLC38A10, 81506, 183956, 347-2689; 16249, SLC38A10, 81507, 183957, 385-3744; 16250, SLC38A11, 81515, 183965, 231-1544; 16250, SLC38A11, 81516, 183966, 1-452; 16250, SLC38A11, 81512, 183962, 332-1486; 16250, SLC38A11, 81513, 183963, 293-1513; 16250, SLC38A11, 81514, 183964, 259-1479; 16251, SLC38A2, 81518, 183968, 350-616; 16251, SLC38A2, 81519, 183969, 42-1076; 16251, SLC38A2, 81517, 183967, 446-1966; 16251, SLC38A2, 81520, 183970, 1-1221; 16252, SLC38A3, 81521, 183971, 297-584; 16252, SLC38A3, 81522, 183972, 233-880; 16252, SLC38A3, 81524, 183974, 133-447; 16252, SLC38A3, 81525, 183975, 337-635; 16252, SLC38A3, 81523, 183973, 155-1669; 16253, SLC38A4, 81528, 183978, 1-423; 16253, SLC38A4, 81529, 183979, 190-764; 16253, SLC38A4, 81530, 183980, 276-933; 16253, SLC38A4, 81526, 183976, 400-2043; 16253, SLC38A4, 81527, 183977, 208-1851; 16254, SLC38A5, 81531, 183981, 135-708; 16254, SLC38A5, 81532, 183982, 73-910; 16254, SLC38A5, 81533, 183983, 86-741; 16254, SLC38A5, 81534, 183984, 55-871; 16254, SLC38A5, 81535, 183985, 166-656; 16254, SLC38A5, 81539, 183989, 1-88; 16254, SLC38A5, 81540, 183990, 132-622; 16254, SLC38A5, 81541, 183991, 691-1902; 16254, SLC38A5, 81536, 183986, 845-2263; 16254, SLC38A5, 81537, 183987, 441-1706; 16254, SLC38A5, 81538, 183988, 179-1597; 16255, SLC38A6, 81544, 183994, 1-1551; 16255, SLC38A6, 81545, 183995, 2-328; 16255, SLC38A6, 81546, 183996, 53-274; 16255, SLC38A6, 81547, 183997, 1-583; 16255, SLC38A6, 81548, 183998, 1-63; 16255, SLC38A6, 81549, 183999, 1-56; 16255, SLC38A6, 81550, 184000, 1-690; 16255, SLC38A6, 81551, 184001, 1-66; 16255, SLC38A6, 81552, 184002, 201-580; 16255, SLC38A6, 81553, 184003, 1-270; 16255, SLC38A6, 81554, 184004, 1-173; 16255, SLC38A6, 81555, 184005, 1-128; 16255, SLC38A6, 81542, 183992, 117-1487; 16255, SLC38A6, 81543, 183993, 165-1730; 16256, SLC38A7, 81557, 184007, 869-1933; 16256, SLC38A7, 81559, 184009, 299-582; 16256, SLC38A7, 81560, 184010, 343-1125; 16256, SLC38A7, 81561, 184011, 293-1414; 16256, SLC38A7, 81562, 184012, 143-564; 16256, SLC38A7, 81563, 184013, 352-546; 16256, SLC38A7, 81564, 184014, 215-622; 16256, SLC38A7, 81565, 184015, 1-511; 16256, SLC38A7, 81556, 184006, 728-2116; 16256, SLC38A7, 81558, 184008, 885-2273; 16257, SLC38A8, 81567, 184017, 441-578; 16257, SLC38A8, 81568, 184018, 76-861; 16257, SLC38A8, 81566, 184016, 1-1308; 16258, SLC38A9, 81571, 184021, 276-1589; 16258, SLC38A9, 81573, 184023, 356-468; 16258, SLC38A9, 81574, 184024, 282-571; 16258, SLC38A9, 81575, 184025, 35-1399; 16258, SLC38A9, 81576, 184026, 157-288; 16258, SLC38A9, 81577, 184027, 320-625; 16258, SLC38A9, 81578, 184028, 149-541; 16258, SLC38A9, 81579, 184029, 258-370; 16258, SLC38A9, 81580, 184030, 429-508; 16258, SLC38A9, 81581, 184031, 170-731; 16258, SLC38A9, 81582, 184032, 182-313; 16258, SLC38A9, 81584, 184034, 449-556; 16258, SLC38A9, 81585, 184035, 214-1407; 16258, SLC38A9, 81569, 184019, 37-1722; 16258, SLC38A9, 81570, 184020, 593-2278; 16258, SLC38A9, 81572, 184022, 541-2037; 16258, SLC38A9, 81583, 184033, 177-1673; 16259, SLC39A1, 81590, 184040, 311-1030; 16259, SLC39A1, 81591, 184041, 179-1141; 16259, SLC39A1, 81592, 184042, 294-912; 16259, SLC39A1, 81593, 184043, 180-530; 16259, SLC39A1, 81586, 184036, 467-1441; 16259, SLC39A1, 81587, 184037, 111-1085; 16259, SLC39A1, 81588, 184038, 437-1411; 16259, SLC39A1, 81589, 184039, 761-1735; 16259, SLC39A1, 81594, 184044, 241-1215; 16259, SLC39A1, 81595, 184045, 349-1323; 16260, SLC39A10, 81598, 184048, 216-593; 16260, SLC39A10, 81599, 184049, 112-231; 16260, SLC39A10, 81600, 184050, 166-285; 16260, SLC39A10, 81601, 184051, 222-337; 16260, SLC39A10, 81602, 184052, 173-563; 16260, SLC39A10, 81596, 184046, 166-2661; 16260, SLC39A10, 81597, 184047, 276-2771; 16261, SLC39A12, 81603, 184053, 274-2349; 16261, SLC39A12, 81604, 184054, 199-2271; 16261, SLC39A12, 81605, 184055, 221-2185; 16261, SLC39A12, 81606, 184056, 329-2002; 16262, SLC39A13, 81609, 184059, 67-720; 16262, SLC39A13, 81610, 184060, 82-827; 16262, SLC39A13, 81611, 184061, 411-1388; 16262, SLC39A13, 81612, 184062, 44-819; 16262, SLC39A13, 81613, 184063, 154-568; 16262, SLC39A13, 81614, 184064, 88-510; 16262, SLC39A13, 81615, 184065, 11-976; 16262, SLC39A13, 81607, 184057, 62-1156; 16262, SLC39A13, 81608, 184058, 43-1158; 16263, SLC39A14, 81620, 184070, 235-839; 16263, SLC39A14, 81621, 184071, 108-377; 16263, SLC39A14, 81622, 184072, 419-578; 16263, SLC39A14, 81623, 184073, 95-560; 16263, SLC39A14, 81624, 184074, 304-570; 16263, SLC39A14, 81625, 184075, 195-576; 16263, SLC39A14, 81626, 184076, 100-467; 16263, SLC39A14, 81616, 184066, 138-1583; 16263, SLC39A14, 81617, 184067, 217-1695; 16263, SLC39A14, 81618, 184068, 176-1654; 16263, SLC39A14, 81619, 184069, 120-1598; 16264, SLC39A2, 81627, 184077, 158-1087; 16264, SLC39A2, 81628, 184078, 193-450; 16265, SLC39A3, 81631, 184081, 196-1167; 16265, SLC39A3, 81632, 184082, 117-524; 16265, SLC39A3, 81633, 184083, 169-491; 16265, SLC39A3, 81629, 184079, 331-1275; 16265, SLC39A3, 81630, 184080, 207-524; 16266, SLC39A4, 81634, 184084, 305-2173; 16266, SLC39A4, 81636, 184086, 31-583; 16266, SLC39A4, 81635, 184085, 107-2050; 16267, SLC39A5, 81638, 184088, 155-871; 16267, SLC39A5, 81639, 184089, 146-613; 16267, SLC39A5, 81640, 184090, 189-559; 16267, SLC39A5, 81642, 184092, 211-588; 16267, SLC39A5, 81643, 184093, 184-569; 16267, SLC39A5, 81637, 184087, 294-1916; 16267, SLC39A5, 81641, 184091, 231-1853; 16268, SLC39A6, 81647, 184097, 5-823; 16268, SLC39A6, 81644, 184094, 215-2482; 16268, SLC39A6, 81645, 184095, 309-1610; 16268, SLC39A6, 81646, 184096, 291-2558; 16269, SLC39A7, 81653, 184103, 354-1015; 16269, SLC39A7, 81655, 184105, 354-1015; 16269, SLC39A7, 81657, 184107, 354-1015; 16269, SLC39A7, 81658, 184108, 354-1015; 16269, SLC39A7, 81661, 184111, 354-1015; 16269, SLC39A7, 81665, 184115, 354-1015; 16269, SLC39A7, 81666, 184116, 286-1575; 16269, SLC39A7, 81667, 184117, 286-1575; 16269, SLC39A7, 81668, 184118, 286-1575; 16269, SLC39A7, 81669, 184119, 286-1575; 16269, SLC39A7, 81670, 184120, 286-1575; 16269, SLC39A7, 81671, 184121, 286-1575; 16269, SLC39A7, 81648, 184098, 118-1527; 16269, SLC39A7, 81649, 184099, 374-1783; 16269, SLC39A7, 81650, 184100, 374-1783; 16269, SLC39A7, 81651, 184101, 118-1527; 16269, SLC39A7, 81652, 184102, 118-1527; 16269, SLC39A7, 81654, 184104, 374-1783; 16269, SLC39A7, 81656, 184106, 118-1527; 16269, SLC39A7, 81659, 184109, 118-1527; 16269, SLC39A7, 81660, 184110, 374-1783; 16269, SLC39A7, 81662, 184112, 118-1527; 16269, SLC39A7, 81663, 184113, 374-1783; 16269, SLC39A7, 81664, 184114, 374-1783; 16270, SLC39A8, 81672, 184122, 384-1766; 16270, SLC39A8, 81673, 184123, 478-1860; 16270, SLC39A8, 81674, 184124, 317-1651; 16271, SLC39A11, 81677, 184127, 498-574; 16271, SLC39A11, 81678, 184128, 194-794; 16271, SLC39A11, 81679, 184129, 1-374; 16271, SLC39A11, 81680, 184130, 407-526; 16271, SLC39A11, 81681, 184131, 1-189; 16271, SLC39A11, 81682, 184132, 63-532; 16271, SLC39A11, 81683, 184133, 11-567; 16271, SLC39A11, 81684, 184134, 1-205; 16271, SLC39A11, 81685, 184135, 10-255; 16271, SLC39A11, 81686, 184136, 83-766; 16271, SLC39A11, 81687, 184137, 1-73; 16271, SLC39A11, 81688, 184138, 1-171; 16271, SLC39A11, 81689, 184139, 1-171; 16271, SLC39A11, 81690, 184140, 1-171; 16271, SLC39A11, 81691, 184141, 1-254; 16271, SLC39A11, 81692, 184142, 1-143; 16271, SLC39A11, 81693, 184143, 1-171; 16271, SLC39A11, 81694, 184144, 1-19; 16271, SLC39A11, 81695, 184145, 1-171; 16271, SLC39A11, 81675, 184125, 95-1102; 16271, SLC39A11, 81676, 184126, 90-1118; 16272, SLC39A9, 81700, 184150, 679-1404; 16272, SLC39A9, 81701, 184151, 679-957; 16272, SLC39A9, 81696, 184146, 679-1602; 16272, SLC39A9, 81697, 184147, 633-1556; 16272, SLC39A9, 81698, 184148, 1-855; 16272, SLC39A9, 81699, 184149, 681-1379; 16273, SLC4A1, 81703, 184153, 150-1787; 16273, SLC4A1, 81704, 184154, 619-729; 16273, SLC4A1, 81702, 184152, 157-2892; 16274, SLC4A1AP, 81706, 184156, 1-474; 16274, SLC4A1AP, 81708, 184158, 1-819; 16274, SLC4A1AP, 81709, 184159, 27-2255; 16274, SLC4A1AP, 81705, 184155, 283-2673; 16274, SLC4A1AP, 81707, 184157, 283-2673; 16275, SLC4A2, 81710, 184160, 335-3814; 16275, SLC4A2, 81713, 184163, 400-610; 16275, SLC4A2, 81714, 184164, 136-571; 16275, SLC4A2, 81715, 184165, 196-702; 16275, SLC4A2, 81716, 184166, 342-793; 16275, SLC4A2, 81718, 184168, 118-500; 16275, SLC4A2, 81711, 184161, 94-3792; 16275, SLC4A2, 81712, 184162, 257-3982; 16275, SLC4A2, 81717, 184167, 548-4231; 16275, SLC4A2, 81719, 184169, 1041-4766; 16276, SLC4A3, 81724, 184174, 213-1769; 16276, SLC4A3, 81725, 184175, 1-223; 16276, SLC4A3, 81726, 184176, 1-622; 16276, SLC4A3, 81727, 184177, 110-792; 16276, SLC4A3, 81720, 184170, 215-3994; 16276, SLC4A3, 81721, 184171, 119-3817; 16276, SLC4A3, 81722, 184172, 513-4211; 16276, SLC4A3, 81723, 184173, 193-3891; 16277, SLC4A4, 81728, 184178, 118-3357; 16277, SLC4A4, 81729, 184179, 77-3064; 16277, SLC4A4, 81730, 184180, 197-3304; 16277, SLC4A4, 81731, 184181, 118-3402; 16277, SLC4A4, 81732, 184182, 197-2137; 16278, SLC4A5, 81739, 184189, 339-727; 16278, SLC4A5, 81740, 184190, 183-3073; 16278, SLC4A5, 81741, 184191, 119-552; 16278, SLC4A5, 81742, 184192, 540-905; 16278,

SLC4A5, 81733, 184183, 237-3650; 16278, SLC4A5, 81734, 184184, 50-3109; 16278, SLC4A5, 81735, 184185, 1-3123; 16278, SLC4A5, 81736, 184186, 401-3814; 16278, SLC4A5, 81737, 184187, 399-3764; 16278, SLC4A5, 81738, 184188, 237-3602; 16279, SLC4A7, 81744, 184194, 72-3224; 16279, SLC4A7, 81747, 184197, 322-3927; 16279, SLC4A7, 81749, 184199, 271-3903; 16279, SLC4A7, 81754, 184204, 1-2406; 16279, SLC4A7, 81743, 184193, 72-3716; 16279, SLC4A7, 81745, 184195, 222-4001; 16279, SLC4A7, 81746, 184196, 222-3509; 16279, SLC4A7, 81748, 184198, 222-3842; 16279, SLC4A7, 81750, 184200, 222-1946; 16279, SLC4A7, 81751, 184201, 222-3617; 16279, SLC4A7, 81752, 184202, 222-1613; 16279, SLC4A7, 81753, 184203, 295-1686; 16279, SLC4A7, 81755, 184205, 222-3962; 16279, SLC4A7, 81756, 184206, 72-3344; 16280, SLC4A8, 81757, 184207, 284-3406; 16280, SLC4A8, 81758, 184208, 218-3499; 16280, SLC4A8, 81759, 184209, 284-2200; 16280, SLC4A8, 81760, 184210, 410-2653; 16281, SLC4A9, 81761, 184211, 28-2865; 16281, SLC4A9, 81762, 184212, 28-2718; 16281, SLC4A9, 81763, 184213, 36-2915; 16281, SLC4A9, 81764, 184214, 23-2974; 16282, SLC4A10, 81765, 184215, 94-3414; 16282, SLC4A10, 81767, 184217, 59-1468; 16282, SLC4A10, 81770, 184220, 59-3223; 16282, SLC4A10, 81766, 184216, 288-3587; 16282, SLC4A10, 81768, 184218, 94-3450; 16282, SLC4A10, 81769, 184219, 182-3448; 16283, SLC4A11, 81773, 184223, 181-494; 16283, SLC4A11, 81775, 184225, 226-1950; 16283, SLC4A11, 81771, 184221, 49-2724; 16283, SLC4A11, 81772, 184222, 103-2859; 16283, SLC4A11, 81774, 184224, 54-2681; 16284, SLC40A1, 81777, 184227, 224-824; 16284, SLC40A1, 81778, 184228, 224-299; 16284, SLC40A1, 81779, 184229, 134-209; 16284, SLC40A1, 81780, 184230, 427-592; 16284, SLC40A1, 81776, 184226, 428-2143; 16285, SLC41A1, 81781, 184231, 1016-2557; 16286, SLC41A2, 81783, 184233, 1-447; 16286, SLC41A2, 81784, 184234, 458-685; 16286, SLC41A2, 81785, 184235, 426-563; 16286, SLC41A2, 81786, 184236, 272-702; 16286, SLC41A2, 81787, 184237, 374-590; 16286, SLC41A2, 81788, 184238, 206-571; 16286, SLC41A2, 81789, 184239, 529-564; 16286, SLC41A2, 81790, 184240, 291-574; 16286, SLC41A2, 81782, 184232, 129-1850; 16287, SLC41A3, 81795, 184245, 123-726; 16287, SLC41A3, 81796, 184246, 71-526; 16287, SLC41A3, 81797, 184247, 244-500; 16287, SLC41A3, 81798, 184248, 176-588; 16287, SLC41A3, 81799, 184249, 89-544; 16287, SLC41A3, 81800, 184250, 105-986; 16287, SLC41A3, 81801, 184251, 75-530; 16287, SLC41A3, 81802, 184252, 59-580; 16287, SLC41A3, 81803, 184253, 155-569; 16287, SLC41A3, 81804, 184254, 212-409; 16287, SLC41A3, 81805, 184255, 59-923; 16287, SLC41A3, 81806, 184256, 60-338; 16287, SLC41A3, 81791, 184241, 240-1655; 16287, SLC41A3, 81792, 184242, 240-1763; 16287, SLC41A3, 81793, 184243, 45-1508; 16287, SLC41A3, 81794, 184244, 287-1672; 16287, SLC41A3, 81807, 184257, 208-1320; 16287, SLC41A3, 81808, 184258, 43-1545; 16288, SLC43A1, 81810, 184260, 67-243; 16288, SLC43A1, 81811, 184261, 351-527; 16288, SLC43A1, 81812, 184262, 85-600; 16288, SLC43A1, 81813, 184263, 359-690; 16288, SLC43A1, 81814, 184264, 222-999; 16288, SLC43A1, 81816, 184266, 1-556; 16288, SLC43A1, 81809, 184259, 357-2036; 16288, SLC43A1, 81815, 184265, 119-1798; 16289, SLC43A2, 81820, 184270, 116-286; 16289, SLC43A2, 81821, 184271, 94-282; 16289, SLC43A2, 81823, 184273, 38-367; 16289, SLC43A2, 81826, 184276, 38-367; 16289, SLC43A2, 81827, 184277, 116-286; 16289, SLC43A2, 81829, 184279, 94-282; 16289, SLC43A2, 81817, 184267, 90-1799; 16289, SLC43A2, 81818, 184268, 257-1555; 16289, SLC43A2, 81819, 184269, 257-1555; 16289, SLC43A2, 81822, 184272, 308-2029; 16289, SLC43A2, 81824, 184274, 308-2029; 16289, SLC43A2, 81825, 184275, 90-1811; 16289, SLC43A2, 81828, 184278, 90-1799; 16290, SLC43A3, 81833, 184283, 249-494; 16290, SLC43A3, 81834, 184284, 261-589; 16290, SLC43A3, 81835, 184285, 441-573; 16290, SLC43A3, 81836, 184286, 1-413; 16290, SLC43A3, 81837, 184287, 332-397; 16290, SLC43A3, 81838, 184288, 203-560; 16290, SLC43A3, 81839, 184289, 162-541; 16290, SLC43A3, 81840, 184290, 502-506; 16290, SLC43A3, 81842, 184292, 235-539; 16290, SLC43A3, 81843, 184293, 372-562; 16290, SLC43A3, 81844, 184294, 210-653; 16290, SLC43A3, 81845, 184295, 295-587; 16290, SLC43A3, 81846, 184296, 259-581; 16290, SLC43A3, 81847, 184297, 249-648; 16290, SLC43A3, 81848, 184298, 337-571; 16290, SLC43A3, 81849, 184299, 441-1434; 16290, SLC43A3, 81850, 184300, 295-801; 16290, SLC43A3, 81830, 184280, 284-1759; 16290, SLC43A3, 81831, 184281, 306-1781; 16290, SLC43A3, 81832, 184282, 306-1781; 16290, SLC43A3, 81841, 184291, 343-1857; 16290, SLC43A3, 81851, 184301, 346-1821; 16291, SLC44A1, 81852, 184302, 248-2221; 16291, SLC44A1, 81853, 184303, 248-2206; 16291, SLC44A1, 81854, 184304, 248-2212; 16291, SLC44A1, 81855, 184305, 248-2221; 16292, SLC44A2, 81858, 184308, 543-574; 16292, SLC44A2, 81859, 184309, 1-374; 16292, SLC44A2, 81860, 184310, 41-169; 16292, SLC44A2, 81862, 184312, 115-553; 16292, SLC44A2, 81863, 184313, 41-328; 16292, SLC44A2, 81864, 184314, 75-586; 16292, SLC44A2, 81865, 184315, 1-445; 16292, SLC44A2, 81856, 184306, 377-2497; 16292, SLC44A2, 81857, 184307, 22-2136; 16292, SLC44A2, 81861, 184311, 110-2245; 16293, SLC44A3, 81868, 184318, 196-684; 16293, SLC44A3, 81871, 184321, 1-330; 16293, SLC44A3, 81873, 184323, 1-251; 16293, SLC44A3, 81874, 184324, 84-1805; 16293, SLC44A3, 81866, 184316, 103-2064; 16293, SLC44A3, 81867, 184317, 111-1964; 16293, SLC44A3, 81869, 184319, 52-1914; 16293, SLC44A3, 81870, 184320, 113-1930; 16293, SLC44A3, 81872, 184322, 56-1813; 16294, SLC44A4, 81879, 184329, 1-1233; 16294, SLC44A4, 81881, 184331, 1-1233; 16294, SLC44A4, 81883, 184333, 1-1233; 16294, SLC44A4, 81885, 184335, 1-1233; 16294, SLC44A4, 81886, 184336, 1-1233; 16294, SLC44A4, 81888, 184338, 1-1233; 16294, SLC44A4, 81889, 184339, 1-1233; 16294, SLC44A4, 81891, 184341, 298-2202; 16294, SLC44A4, 81895, 184345, 298-2202; 16294, SLC44A4, 81902, 184352, 298-2202; 16294, SLC44A4, 81875, 184325, 22-2154; 16294, SLC44A4, 81876, 184326, 67-2073; 16294, SLC44A4, 81877, 184327, 22-2154; 16294, SLC44A4, 81878, 184328, 22-2154; 16294, SLC44A4, 81880, 184330, 22-2154; 16294, SLC44A4, 81882, 184332, 22-2154; 16294, SLC44A4, 81884, 184334, 22-2154; 16294, SLC44A4, 81887, 184337, 22-2154; 16294, SLC44A4, 81890, 184340, 298-2202; 16294, SLC44A4, 81892, 184342, 298-2202; 16294, SLC44A4, 81893, 184343, 67-2073; 16294, SLC44A4, 81894, 184344, 67-2073; 16294, SLC44A4, 81896, 184346, 67-2073; 16294, SLC44A4, 81897, 184347, 298-2202; 16294, SLC44A4, 81898, 184348, 298-2202; 16294, SLC44A4, 81899, 184349, 67-2073; 16294, SLC44A4, 81900, 184350, 67-2073; 16294, SLC44A4, 81901, 184351, 67-2073; 16295, SLC44A5, 81903, 184353, 115-2274; 16295, SLC44A5, 81904, 184354, 147-2300; 16296, SLC45A1, 81906, 184356, 284-2632; 16296, SLC45A1, 81905, 184355, 1-2247; 16297, SLC45A2, 81909, 184359, 62-793; 16297, SLC45A2, 81910, 184360, 3-740; 16297, SLC45A2, 81911, 184361, 1-495; 16297, SLC45A2, 81912, 184362, 1-170; 16297, SLC45A2, 81913, 184363, 1-375; 16297, SLC45A2, 81914, 184364, 1-705; 16297, SLC45A2, 81907, 184357, 148-1740; 16297, SLC45A2, 81908, 184358, 59-1441; 16298, SLC45A3, 81915, 184365, 297-1958; 16299, SLC45A4, 81917, 184367, 1-2427; 16299, SLC45A4, 81918, 184368, 549-835; 16299, SLC45A4, 81920, 184370, 237-542; 16299, SLC45A4, 81916, 184366, 309-2705; 16299, SLC45A4, 81919, 184369, 305-2458; 16300, SLC46A1, 81921, 184371, 747-844; 16300, SLC46A1, 81922, 184372, 1-373; 16300, SLC46A1, 81923, 184373, 280-1030; 16300, SLC46A1, 81924, 184374, 180-564; 16300, SLC46A1, 81925, 184375, 97-1476; 16300, SLC46A1, 81926, 184376, 88-1383; 16301, SLC46A2, 81928, 184378, 130-1155; 16301, SLC46A2, 81927, 184377, 233-1660; 16302, SLC46A3, 81929, 184379, 371-1756; 16302, SLC46A3, 81930, 184380, 500-1891; 16303, SLC47A1, 81933, 184383, 113-1444; 16303, SLC47A1, 81934, 184384, 65-871; 16303, SLC47A1, 81935, 184385, 1-298; 16303, SLC47A1, 81936, 184386, 421-1371; 16303, SLC47A1, 81931, 184381, 87-1799; 16303, SLC47A1, 81932, 184382, 61-1821; 16304, SLC47A2, 81939, 184389, 176-1264; 16304, SLC47A2, 81937, 184387, 52-1860; 16304, SLC47A2, 81938, 184388, 176-1918; 16304, SLC47A2, 81940, 184390, 19-678; 16305, SLC48A1, 81943, 184393, 529-577; 16305, SLC48A1, 81945, 184395, 91-249; 16305, SLC48A1, 81946, 184396, 510-618; 16305, SLC48A1, 81941, 184391, 213-482; 16305, SLC48A1, 81942, 184392, 98-538; 16305, SLC48A1, 81944, 184394, 456-725; 16306, SLC5A4, 81947, 184397, 13-1992; 16307, SLC5A7, 81948, 184398, 277-2019; 16307, SLC5A7, 81949, 184399, 290-2032; 16308, SLC5A1, 81950, 184400, 251-2245; 16308, SLC5A1, 81951, 184401, 350-1963; 16309, SLC5A2, 81954, 184404, 71-516; 16309, SLC5A2, 81952, 184402, 20-2038; 16309, SLC5A2, 81953, 184403, 20-1396; 16310, SLC5A11, 81960, 184410, 319-591; 16310, SLC5A11, 81964, 184414, 382-570; 16310, SLC5A11, 81955, 184405, 623-2650; 16310, SLC5A11, 81956, 184406, 415-1974; 16310, SLC5A11, 81957, 184407, 382-2304; 16310, SLC5A11, 81958, 184408, 382-2199; 16310, SLC5A11, 81959, 184409, 233-2155; 16310, SLC5A11, 81961, 184411, 233-2050; 16310, SLC5A11, 81962, 184412, 266-1825; 16310, SLC5A11, 81963, 184413, 289-2124; 16311, SLC5A5, 81965, 184415, 348-2279; 16312, SLC5A12, 81968, 184418, 363-814; 16312, SLC5A12, 81969, 184419, 347-1180; 16312, SLC5A12, 81966, 184416, 286-1476; 16312, SLC5A12, 81967, 184417, 311-2167; 16313, SLC5A8, 81970, 184420, 560-2392; 16313, SLC5A8, 81971, 184421, 364-2196; 16314, SLC5A6, 81973, 184423, 291-732; 16314, SLC5A6, 81975, 184425, 484-599; 16314, SLC5A6, 81976, 184426, 330-676; 16314, SLC5A6, 81977, 184427, 395-570; 16314, SLC5A6, 81978, 184428, 339-917; 16314, SLC5A6, 81979, 184429, 506-741; 16314, SLC5A6, 81980, 184430, 247-708; 16314, SLC5A6, 81981, 184431, 327-725; 16314, SLC5A6, 81982, 184432, 462-542; 16314, SLC5A6, 81972, 184422, 475-2382; 16314, SLC5A6, 81974, 184424, 323-2230; 16315, SLC5A3, 81983, 184433, 513-2669; 16316, SLC5A10, 81984, 184434, 572-2272; 16316, SLC5A10, 81985, 184435, 19-1728; 16316, SLC5A10, 81986, 184436, 19-1809; 16316, SLC5A10, 81987, 184437, 42-1880; 16316, SLC5A10, 81988, 184438, 42-1724; 16317, SLC5A9, 81990, 184440, 1-520; 16317, SLC5A9, 81992, 184442, 53-904; 16317, SLC5A9, 81993, 184443, 1-229; 16317, SLC5A9, 81989, 184439, 51-2171; 16317, SLC5A9, 81991, 184441, 53-2098; 16317, SLC5A9, 81994, 184444, 53-2161; 16318, SLC50A1, 81998, 184448, 329-799; 16318, SLC50A1, 81999, 184449, 142-669; 16318, SLC50A1, 81995, 184445, 63-566; 16318, SLC50A1, 81996, 184446, 96-596; 16318, SLC50A1, 81997, 184447, 63-728; 16319, SLC51A, 82001, 184451, 180-356; 16319, SLC51A, 82002, 184452, 374-572; 16319, SLC51A, 82003, 184453, 1-72; 16319, SLC51A, 82004, 184454, 1-636; 16319, SLC51A, 82000, 184450, 210-1232; 16320, SLC51B, 82005, 184455, 322-708; 16321, SLC52A1, 82008, 184458, 1413-2465; 16321, SLC52A1, 82006, 184456, 674-2020; 16321, SLC52A1, 82007, 184457, 714-2060; 16322, SLC52A2, 82011, 184461, 419-935; 16322, SLC52A2, 82012, 184462, 145-655; 16322, SLC52A2, 82013, 184463, 112-447; 16322, SLC52A2, 82014, 184464, 288-495; 16322, SLC52A2, 82018, 184468, 165-428; 16322, SLC52A2, 82009, 184459, 302-1639; 16322, SLC52A2, 82010, 184460, 185-1522; 16322, SLC52A2, 82015, 184465, 447-1784; 16322, SLC52A2, 82016, 184466, 165-1502; 16322, SLC52A2, 82017, 184467, 584-1921; 16323, SLC52A3, 82019, 184469, 299-1708; 16323, SLC52A3, 82020, 184470, 243-1490; 16323, SLC52A3, 82021, 184471, 340-1749; 16324, SLC6A14, 82022, 184472, 89-2017; 16325, SLC6A1, 82024, 184474, 357-472; 16325, SLC6A1, 82023, 184473, 422-2221; 16326, SLC6A11, 82025, 184475, 67-1965; 16326, SLC6A11, 82026, 184476, 66-692; 16327, SLC6A12, 82030, 184480, 140-577; 16327, SLC6A12, 82032, 184482, 312-554; 16327, SLC6A12, 82027, 184477, 330-2174; 16327, SLC6A12, 82028, 184478, 459-2303; 16327, SLC6A12, 82029, 184479, 556-2400; 16327, SLC6A12, 82031, 184481, 257-2101; 16328, SLC6A13, 82036, 184486, 34-405; 16328, SLC6A13, 82037, 184487, 204-413; 16328, SLC6A13, 82038, 184488, 91-541; 16328, SLC6A13, 82033, 184483, 54-1862; 16328, SLC6A13, 82034, 184484, 54-347; 16328, SLC6A13, 82035, 184485, 91-1623; 16329, SLC6A2, 82041, 184491, 112-1797; 16329, SLC6A2, 82042, 184492, 78-1892; 16329, SLC6A2, 82043, 184493, 151-750; 16329, SLC6A2, 82044, 184494, 41-1759; 16329, SLC6A2, 82045, 184495, 136-1022; 16329, SLC6A2, 82048, 184498, 1-176; 16329, SLC6A2, 82039, 184489, 52-1938; 16329, SLC6A2, 82040, 184490, 256-2109; 16329, SLC6A2, 82046, 184496, 177-1715; 16329, SLC6A2, 82047, 184497, 618-2471; 16330, SLC6A3, 82049, 184499, 129-1991; 16330, SLC6A3, 82050, 184500, 129-1991; 16331, SLC6A4, 82052, 184502, 307-2160; 16331, SLC6A4, 82054, 184504, 1-217; 16331, SLC6A4, 82051, 184501, 577-2469; 16331, SLC6A4, 82053, 184503, 514-2406; 16332, SLC6A5, 82055, 184505, 80-643; 16332, SLC6A5, 82056, 184506, 274-2667; 16333, SLC6A6, 82057, 184507, 1-284; 16333, SLC6A6, 82058, 184508, 130-458; 16333, SLC6A6, 82060, 184510, 19-2184; 16333, SLC6A6, 82061, 184511, 19-1401; 16333, SLC6A6, 82062, 184512, 1-368; 16333, SLC6A6, 82063, 184513, 19-417; 16333, SLC6A6, 82059, 184509, 326-2188; 16333, SLC6A6, 82064, 184514, 282-884; 16334, SLC6A7, 82066, 184516, 244-2244; 16334, SLC6A7, 82065, 184515, 372-2282; 16335, SLC6A8, 82068, 184518, 1-266; 16335, SLC6A8, 82069, 184519, 1-468; 16335, SLC6A8, 82071, 184521, 1-523; 16335, SLC6A8, 82072, 184522, 1-334; 16335, SLC6A8, 82067, 184517, 477-2384; 16335, SLC6A8, 82070, 184520, 217-1779; 16336, SLC6A9, 82075, 184525, 141-1880; 16336, SLC6A9, 82076, 184526, 329-2053; 16336, SLC6A9, 82078, 184528, 243-591; 16336, SLC6A9, 82079, 184529, 211-1779; 16336, SLC6A9, 82080, 184530, 122-524; 16336, SLC6A9, 82073, 184523, 193-2151; 16336, SLC6A9, 82074, 184524, 193-2313; 16336, SLC6A9, 82077, 184527, 167-2068; 16337,

SLC6A15, 82082, 184532, 12-962; 16337, SLC6A15, 82084, 184534, 276-563; 16337, SLC6A15, 82085, 184535, 368-582; 16337, SLC6A15, 82087, 184537, 488-546; 16337, SLC6A15, 82081, 184531, 543-2735; 16337, SLC6A15, 82083, 184533, 460-1329; 16337, SLC6A15, 82086, 184536, 312-2183; 16338, SLC6A17, 82088, 184538, 486-2669; 16339, SLC6A18, 82089, 184539, 124-2010; 16340, SLC6A19, 82091, 184541, 57-1121; 16340, SLC6A19, 82090, 184540, 57-1961; 16341, SLC6A20, 82094, 184544, 117-910; 16341, SLC6A20, 82095, 184545, 65-1708; 16341, SLC6A20, 82092, 184542, 52-1719; 16341, SLC6A20, 82093, 184543, 117-1895; 16342, SLC6A16, 82098, 184548, 305-794; 16342, SLC6A16, 82099, 184549, 1-102; 16342, SLC6A16, 82100, 184550, 1-410; 16342, SLC6A16, 82101, 184551, 1-442; 16342, SLC6A16, 82096, 184546, 243-2453; 16342, SLC6A16, 82097, 184547, 203-2182; 16343, SLC7A9, 82104, 184554, 6-125; 16343, SLC7A9, 82105, 184555, 163-282; 16343, SLC7A9, 82102, 184552, 193-1656; 16343, SLC7A9, 82103, 184553, 178-1641; 16343, SLC7A9, 82106, 184556, 105-1568; 16344, SLC7A5, 82108, 184558, 311-1036; 16344, SLC7A5, 82107, 184557, 67-1590; 16345, SLC7A8, 82110, 184560, 1-692; 16345, SLC7A8, 82114, 184564, 254-536; 16345, SLC7A8, 82115, 184565, 728-1597; 16345, SLC7A8, 82116, 184566, 237-386; 16345, SLC7A8, 82117, 184567, 425-658; 16345, SLC7A8, 82118, 184568, 1356-2267; 16345, SLC7A8, 82119, 184569, 1356-1988; 16345, SLC7A8, 82120, 184570, 384-1016; 16345, SLC7A8, 82109, 184559, 727-2334; 16345, SLC7A8, 82111, 184561, 245-1243; 16345, SLC7A8, 82112, 184562, 203-1138; 16345, SLC7A8, 82113, 184563, 101-1393; 16346, SLC7A6, 82122, 184572, 195-884; 16346, SLC7A6, 82123, 184573, 168-812; 16346, SLC7A6, 82125, 184575, 426-510; 16346, SLC7A6, 82126, 184576, 240-514; 16346, SLC7A6, 82127, 184577, 1-383; 16346, SLC7A6, 82128, 184578, 326-547; 16346, SLC7A6, 82129, 184579, 422-493; 16346, SLC7A6, 82130, 184580, 213-581; 16346, SLC7A6, 82131, 184581, 280-573; 16346, SLC7A6, 82132, 184582, 1-153; 16346, SLC7A6, 82133, 184583, 227-916; 16346, SLC7A6, 82121, 184571, 213-1760; 16346, SLC7A6, 82124, 184574, 270-1817; 16347, SLC7A7, 82138, 184588, 424-847; 16347, SLC7A7, 82139, 184589, 220-569; 16347, SLC7A7, 82140, 184590, 227-720; 16347, SLC7A7, 82141, 184591, 1201-2133; 16347, SLC7A7, 82142, 184592, 253-572; 16347, SLC7A7, 82143, 184593, 1-505; 16347, SLC7A7, 82144, 184594, 610-741; 16347, SLC7A7, 82146, 184596, 153-519; 16347, SLC7A7, 82147, 184597, 384-1121; 16347, SLC7A7, 82148, 184598, 386-476; 16347, SLC7A7, 82149, 184599, 253-596; 16347, SLC7A7, 82134, 184584, 340-1875; 16347, SLC7A7, 82135, 184585, 243-1778; 16347, SLC7A7, 82136, 184586, 202-1737; 16347, SLC7A7, 82137, 184587, 527-2062; 16347, SLC7A7, 82145, 184595, 349-1884; 16348, SLC7A11, 82151, 184601, 1-228; 16348, SLC7A11, 82150, 184600, 281-1786; 16349, SLC7A13, 82152, 184602, 105-1517; 16349, SLC7A13, 82153, 184603, 84-1385; 16350, SLC7A1, 82155, 184605, 183-547; 16350, SLC7A1, 82154, 184604, 388-2277; 16351, SLC7A2, 82156, 184606, 49-2145; 16351, SLC7A2, 82157, 184607, 49-2142; 16351, SLC7A2, 82158, 184608, 219-2195; 16351, SLC7A2, 82159, 184609, 118-2211; 16351, SLC7A2, 82160, 184610, 170-2146; 16352, SLC7A3, 82161, 184611, 151-2010; 16352, SLC7A3, 82162, 184612, 146-2005; 16353, SLC7A10, 82164, 184614, 96-1265; 16353, SLC7A10, 82165, 184615, 96-311; 16353, SLC7A10, 82166, 184616, 96-311; 16353, SLC7A10, 82163, 184613, 148-1719; 16354, SLC7A14, 82167, 184617, 317-2632; 16355, SLC7A4, 82170, 184620, 172-416; 16355, SLC7A4, 82168, 184618, 69-1976; 16355, SLC7A4, 82169, 184619, 63-1970; 16356, SLC7A6OS, 82172, 184622, 1-360; 16356, SLC7A6OS, 82173, 184623, 1-118; 16356, SLC7A6OS, 82174, 184624, 26-742; 16356, SLC7A6OS, 82175, 184625, 1-628; 16356, SLC7A6OS, 82171, 184621, 20-949; 16357, SLC8A1, 82184, 184634, 1-1995; 16357, SLC8A1, 82185, 184635, 303-563; 16357, SLC8A1, 82186, 184636, 301-561; 16357, SLC8A1, 82187, 184637, 364-583; 16357, SLC8A1, 82176, 184626, 1-2922; 16357, SLC8A1, 82177, 184627, 191-3004; 16357, SLC8A1, 82178, 184628, 35-2956; 16357, SLC8A1, 82179, 184629, 1-2898; 16357, SLC8A1, 82180, 184630, 112-2925; 16357, SLC8A1, 82181, 184631, 149-2962; 16357, SLC8A1, 82182, 184632, 25-2931; 16357, SLC8A1, 82183, 184633, 1-2814; 16358, SLC8A2, 82189, 184639, 142-2175; 16358, SLC8A2, 82190, 184640, 136-570; 16358, SLC8A2, 82191, 184641, 104-581; 16358, SLC8A2, 82188, 184638, 397-3162; 16359, SLC8A3, 82200, 184650, 240-872; 16359, SLC8A3, 82192, 184642, 328-1224; 16359, SLC8A3, 82193, 184643, 755-3520; 16359, SLC8A3, 82194, 184644, 755-3532; 16359, SLC8A3, 82195, 184645, 755-3538; 16359, SLC8A3, 82196, 184646, 240-1094; 16359, SLC8A3, 82197, 184647, 63-2840; 16359, SLC8A3, 82198, 184648, 755-2617; 16359, SLC8A3, 82199, 184649, 63-2837; 16360, SLC8B1, 82203, 184653, 254-415; 16360, SLC8B1, 82204, 184654, 1198-1497; 16360, SLC8B1, 82205, 184655, 247-555; 16360, SLC8B1, 82206, 184656, 232-925; 16360, SLC8B1, 82207, 184657, 213-374; 16360, SLC8B1, 82208, 184658, 1-1214; 16360, SLC8B1, 82209, 184659, 603-996; 16360, SLC8B1, 82210, 184660, 182-613; 16360, SLC8B1, 82201, 184651, 211-1965; 16360, SLC8B1, 82202, 184652, 517-2271; 16360, SLC8B1, 82211, 184661, 70-1656; 16361, SLC9C2, 82212, 184662, 424-3798; 16362, SLC9A1, 82214, 184664, 290-695; 16362, SLC9A1, 82213, 184663, 577-3024; 16362, SLC9A1, 82215, 184665, 265-1932; 16363, SLC9A2, 82216, 184666, 143-2581; 16364, SLC9A3, 82219, 184669, 9-219; 16364, SLC9A3, 82220, 184670, 11-221; 16364, SLC9A3, 82217, 184667, 11-2515; 16364, SLC9A3, 82218, 184668, 9-2486; 16365, SLC9A3R1, 82222, 184672, 1-107; 16365, SLC9A3R1, 82223, 184673, 196-841; 16365, SLC9A3R1, 82221, 184671, 196-1272; 16365, SLC9A3R1, 82224, 184674, 37-645; 16366, SLC9A3R2, 82227, 184677, 126-578; 16366, SLC9A3R2, 82228, 184678, 89-759; 16366, SLC9A3R2, 82229, 184679, 161-856; 16366, SLC9A3R2, 82231, 184681, 1-500; 16366, SLC9A3R2, 82225, 184675, 79-1059; 16366, SLC9A3R2, 82226, 184676, 139-1152; 16366, SLC9A3R2, 82230, 184680, 82-762; 16367, SLC9A4, 82232, 184682, 458-2854; 16368, SLC9A5, 82234, 184684, 144-671; 16368, SLC9A5, 82235, 184685, 1-819; 16368, SLC9A5, 82236, 184686, 406-920; 16368, SLC9A5, 82237, 184687, 1-535; 16368, SLC9A5, 82233, 184683, 66-2756; 16369, SLC9A6, 82241, 184691, 97-648; 16369, SLC9A6, 82242, 184692, 1-619; 16369, SLC9A6, 82238, 184688, 69-2174; 16369, SLC9A6, 82239, 184689, 77-2086; 16369, SLC9A6, 82240, 184690, 111-2060; 16370, SLC9A7, 82244, 184694, 144-2324; 16370, SLC9A7, 82243, 184693, 27-2204; 16371, SLC9A8, 82245, 184695, 43-1788; 16371, SLC9A8, 82246, 184696, 211-2004; 16372, SLC9A9, 82248, 184698, 137-579; 16372, SLC9A9, 82249, 184699, 164-349; 16372, SLC9A9, 82247, 184697, 210-2147; 16373, SLC9B1, 82252, 184702, 70-216; 16373, SLC9B1, 82253, 184703, 1-384; 16373, SLC9B1, 82255, 184705, 2-763; 16373, SLC9B1, 82256, 184706, 420-568; 16373, SLC9B1, 82257, 184707, 65-667; 16373, SLC9B1, 82250, 184700, 143-

1690; 16373, SLC9B1, 82251, 184701, 123-1550; 16373, SLC9B1, 82254, 184704, 2-223; 16373, SLC9B1, 82258, 184708, 54-275; 16374, SLC9B2, 82261, 184711, 1-1065; 16374, SLC9B2, 82262, 184712, 178-1620; 16374, SLC9B2, 82263, 184713, 92-430; 16374, SLC9B2, 82264, 184714, 192-1445; 16374, SLC9B2, 82265, 184715, 220-648; 16374, SLC9B2, 82259, 184709, 163-1776; 16374, SLC9B2, 82260, 184710, 633-2246; 16375, SLC9C1, 82267, 184717, 267-521; 16375, SLC9C1, 82268, 184718, 89-814; 16375, SLC9C1, 82266, 184716, 254-3787; 16375, SLC9C1, 82269, 184719, 223-3612; 16376, SLCO1A2, 82271, 184721, 150-448; 16376, SLCO1A2, 82272, 184722, 550-702; 16376, SLCO1A2, 82273, 184723, 318-356; 16376, SLCO1A2, 82274, 184724, 258-1874; 16376, SLCO1A2, 82275, 184725, 299-562; 16376, SLCO1A2, 82276, 184726, 447-543; 16376, SLCO1A2, 82277, 184727, 297-569; 16376, SLCO1A2, 82278, 184728, 308-717; 16376, SLCO1A2, 82279, 184729, 346-559; 16376, SLCO1A2, 82280, 184730, 19-23; 16376, SLCO1A2, 82281, 184731, 139-580; 16376, SLCO1A2, 82282, 184732, 414-701; 16376, SLCO1A2, 82283, 184733, 239-520; 16376, SLCO1A2, 82270, 184720, 722-2734; 16377, SLCO1B1, 82284, 184734, 97-2172; 16378, SLCO1B3, 82287, 184737, 129-1002; 16378, SLCO1B3, 82288, 184738, 1-1440; 16378, SLCO1B3, 82285, 184735, 68-2176; 16378, SLCO1B3, 82286, 184736, 220-2328; 16379, SLCO1B7, 82290, 184740, 1-300; 16379, SLCO1B7, 82289, 184739, 1-1923; 16380, SLCO1C1, 82292, 184742, 280-420; 16380, SLCO1C1, 82291, 184741, 369-2507; 16380, SLCO1C1, 82293, 184743, 249-2240; 16380, SLCO1C1, 82294, 184744, 231-2423; 16380, SLCO1C1, 82295, 184745, 295-2133; 16381, SLCO2A1, 82297, 184747, 113-1816; 16381, SLCO2A1, 82298, 184748, 122-1369; 16381, SLCO2A1, 82296, 184746, 275-2206; 16382, SLCO2B1, 82299, 184749, 396-2525; 16382, SLCO2B1, 82302, 184752, 243-373; 16382, SLCO2B1, 82303, 184753, 144-274; 16382, SLCO2B1, 82304, 184754, 316-578; 16382, SLCO2B1, 82305, 184755, 197-577; 16382, SLCO2B1, 82306, 184756, 401-2182; 16382, SLCO2B1, 82307, 184757, 1-444; 16382, SLCO2B1, 82308, 184758, 94-224; 16382, SLCO2B1, 82309, 184759, 268-1965; 16382, SLCO2B1, 82310, 184760, 96-546; 16382, SLCO2B1, 82300, 184750, 168-2231; 16382, SLCO2B1, 82301, 184751, 249-1697; 16383, SLCO3A1, 82313, 184763, 176-567; 16383, SLCO3A1, 82314, 184764, 67-330; 16383, SLCO3A1, 82315, 184765, 1-328; 16383, SLCO3A1, 82311, 184761, 215-2347; 16383, SLCO3A1, 82312, 184762, 54-2132; 16384, SLCO4A1, 82318, 184768, 1-456; 16384, SLCO4A1, 82319, 184769, 131-1993; 16384, SLCO4A1, 82316, 184766, 206-2374; 16384, SLCO4A1, 82317, 184767, 97-2265; 16385, SLCO4C1, 82320, 184770, 288-2462; 16386, SLCO5A1, 82323, 184773, 503-1441; 16386, SLCO5A1, 82321, 184771, 708-3254; 16386, SLCO5A1, 82322, 184772, 43-2424; 16386, SLCO5A1, 82324, 184774, 718-2781; 16387, SLCO6A1, 82328, 184778, 1-78; 16387, SLCO6A1, 82329, 184779, 70-1470; 16387, SLCO6A1, 82325, 184775, 136-2295; 16387, SLCO6A1, 82326, 184776, 173-2146; 16387, SLCO6A1, 82327, 184777, 173-2332; 16388, SBSPON, 82330, 184780, 206-1000; 16389, SST, 82331, 184781, 109-459; 16390, SSTR1, 82332, 184782, 618-1793; 16391, SSTR2, 82333, 184783, 370-1479; 16392, SSTR3, 82334, 184784, 535-1791; 16392, SSTR3, 82335, 184785, 458-1714; 16393, SSTR4, 82336, 184786, 99-1265; 16394, SSTR5, 82337, 184787, 89-1183; 16395, SON, 82341, 184791, 42-1406; 16395, SON, 82343, 184793, 1-4364; 16395, SON, 82344, 184794, 1-279; 16395, SON, 82345, 184795, 1-293; 16395, SON, 82346, 184796, 1-1032; 16395, SON, 82338, 184788, 30-6941; 16395, SON, 82339, 184789, 476-7756; 16395, SON, 82340, 184790, 29-6355; 16395, SON, 82342, 184792, 30-7007; 16396, SOS1, 82347, 184797, 29-3985; 16396, SOS1, 82350, 184800, 272-579; 16396, SOS1, 82348, 184798, 42-4043; 16396, SOS1, 82349, 184799, 88-4089; 16397, SOS2, 82353, 184803, 80-292; 16397, SOS2, 82354, 184804, 1-1259; 16397, SOS2, 82351, 184801, 276-4274; 16397, SOS2, 82352, 184802, 27-3926; 16398, SHH, 82356, 184806, 171-677; 16398, SHH, 82357, 184807, 171-551; 16398, SHH, 82358, 184808, 171-542; 16398, SHH, 82355, 184805, 152-1540; 16399, SORBS1, 82364, 184814, 1-558; 16399, SORBS1, 82371, 184821, 1-575; 16399, SORBS1, 82372, 184822, 284-720; 16399, SORBS1, 82374, 184824, 1-1523; 16399, SORBS1, 82359, 184809, 28-3483; 16399, SORBS1, 82360, 184810, 1-3015; 16399, SORBS1, 82361, 184811, 227-2572; 16399, SORBS1, 82362, 184812, 28-3906; 16399, SORBS1, 82363, 184813, 191-3991; 16399, SORBS1, 82365, 184815, 1-2436; 16399, SORBS1, 82366, 184816, 1-2055; 16399, SORBS1, 82367, 184817, 28-2745; 16399, SORBS1, 82368, 184818, 191-3646; 16399, SORBS1, 82369, 184819, 191-4069; 16399, SORBS1, 82370, 184820, 191-2641; 16399, SORBS1, 82373, 184823, 168-4052; 16400, SORBS2, 82376, 184826, 103-2011; 16400, SORBS2, 82379, 184829, 815-842; 16400, SORBS2, 82381, 184831, 498-543; 16400, SORBS2, 82382, 184832, 1-871; 16400, SORBS2, 82383, 184833, 323-534; 16400, SORBS2, 82384, 184834, 1-759; 16400, SORBS2, 82385, 184835, 29-574; 16400, SORBS2, 82387, 184837, 312-611; 16400, SORBS2, 82390, 184840, 372-575; 16400, SORBS2, 82391, 184841, 396-573; 16400, SORBS2, 82392, 184842, 246-546; 16400, SORBS2, 82393, 184843, 1-873; 16400, SORBS2, 82394, 184844, 271-525; 16400, SORBS2, 82395, 184845, 243-590; 16400, SORBS2, 82396, 184846, 229-582; 16400, SORBS2, 82397, 184847, 267-594; 16400, SORBS2, 82398, 184848, 266-553; 16400, SORBS2, 82399, 184849, 143-499; 16400, SORBS2, 82400, 184850, 322-562; 16400, SORBS2, 82401, 184851, 348-572; 16400, SORBS2, 82402, 184852, 320-582; 16400, SORBS2, 82403, 184853, 497-835; 16400, SORBS2, 82404, 184854, 287-565; 16400, SORBS2, 82406, 184856, 252-572; 16400, SORBS2, 82407, 184857, 494-760; 16400, SORBS2, 82408, 184858, 408-574; 16400, SORBS2, 82409, 184859, 359-571; 16400, SORBS2, 82410, 184860, 248-487; 16400, SORBS2, 82411, 184861, 387-626; 16400, SORBS2, 82412, 184862, 266-629; 16400, SORBS2, 82413, 184863, 349-567; 16400, SORBS2, 82414, 184864, 188-549; 16400, SORBS2, 82375, 184825, 511-3813; 16400, SORBS2, 82377, 184827, 307-2502; 16400, SORBS2, 82378, 184828, 715-4317; 16400, SORBS2, 82380, 184830, 739-2739; 16400, SORBS2, 82386, 184836, 585-3059; 16400, SORBS2, 82388, 184838, 794-2728; 16400, SORBS2, 82389, 184839, 332-3346; 16400, SORBS2, 82405, 184855, 188-2173; 16401, SORBS3, 82416, 184866, 1-456; 16401, SORBS3, 82417, 184867, 1-560; 16401, SORBS3, 82418, 184868, 1-680; 16401, SORBS3, 82419, 184869, 320-601; 16401, SORBS3, 82420, 184870, 152-1138; 16401, SORBS3, 82422, 184872, 149-670; 16401, SORBS3, 82415, 184865, 384-2399; 16401, SORBS3, 82421, 184871, 272-1261; 16402, SORD, 82424, 184874, 90-443; 16402, SORD, 82425, 184875, 107-1117; 16402, SORD, 82423, 184873, 181-1254; 16402, SORD, 82426, 184876, 104-406; 16403, SRI, 82430, 184880, 11-487; 16403, SRI, 82431, 184881, 40-258; 16403, SRI, 82432, 184882, 63-530; 16403, SRI, 82427, 184877, 54-650; 16403, SRI, 82428, 184878, 80-631; 16403, SRI, 82429, 184879, 63-605; 16404, SORT1, 82435, 184885, 1-314; 16404, SORT1, 82436, 184886, 434-615; 16404, SORT1, 82437, 184887, 228-583; 16404, SORT1, 82438, 184888, 501-561; 16404, SORT1, 82433, 184883, 60-2555; 16404, SORT1, 82434, 184884, 434-2518; 16405, SORL1, 82440, 184890, 382-3564; 16405, SORL1, 82441, 184891, 239-3715; 16405, SORL1, 82442, 184892, 422-2911; 16405, SORL1, 82443, 184893, 12-3386; 16405, SORL1, 82439, 184889, 130-6774; 16406, SORCS1, 82445, 184895, 172-3009; 16406, SORCS1, 82446, 184896, 128-2272; 16406, SORCS1, 82447, 184897, 1-641; 16406, SORCS1, 82448, 184898, 172-2952; 16406, SORCS1, 82449, 184899, 172-2985; 16406, SORCS1, 82444, 184894, 9-3515; 16407, SORCS2, 82450, 184900, 47-3010; 16407, SORCS2, 82452, 184902, 1-306; 16407, SORCS2, 82451, 184901, 110-3589; 16408, SORCS3, 82455, 184905, 1-458; 16408, SORCS3, 82453, 184903, 1-3669; 16408, SORCS3, 82454, 184904, 228-3896; 16409, SNX1, 82457, 184907, 24-332; 16409, SNX1, 82458, 184908, 567-1481; 16409, SNX1, 82459, 184909, 494-550; 16409, SNX1, 82460, 184910, 1-387; 16409, SNX1, 82461, 184911, 11-334; 16409, SNX1, 82462, 184912, 1-334; 16409, SNX1, 82463, 184913, 1-213; 16409, SNX1, 82466, 184916, 1-324; 16409, SNX1, 82456, 184906, 22-1695; 16409, SNX1, 82464, 184914, 1-1374; 16409, SNX1, 82465, 184915, 15-1583; 16410, SNX10, 82470, 184920, 225-710; 16410, SNX10, 82471, 184921, 271-429; 16410, SNX10, 82473, 184923, 233-823; 16410, SNX10, 82474, 184924, 1-606; 16410, SNX10, 82467, 184917, 188-793; 16410, SNX10, 82468, 184918, 129-734; 16410, SNX10, 82469, 184919, 219-572; 16410, SNX10, 82472, 184922, 263-868; 16411, SNX11, 82477, 184927, 594-974; 16411, SNX11, 82479, 184929, 96-627; 16411, SNX11, 82480, 184930, 250-423; 16411, SNX11, 82481, 184931, 160-922; 16411, SNX11, 82483, 184933, 47-563; 16411, SNX11, 82484, 184934, 337-477; 16411, SNX11, 82475, 184925, 268-1080; 16411, SNX11, 82476, 184926, 355-1167; 16411, SNX11, 82478, 184928, 112-900; 16411, SNX11, 82482, 184932, 115-903; 16412, SNX12, 82488, 184938, 143-661; 16412, SNX12, 82485, 184935, 98-574; 16412, SNX12, 82486, 184936, 118-606; 16412, SNX12, 82487, 184937, 167-655; 16413, SNX13, 82489, 184939, 190-759; 16413, SNX13, 82490, 184940, 157-621; 16413, SNX13, 82491, 184941, 207-338; 16413, SNX13, 82493, 184943, 174-2840; 16413, SNX13, 82492, 184942, 200-3073; 16414, SNX14, 82497, 184947, 68-619; 16414, SNX14, 82498, 184948, 1-636; 16414, SNX14, 82499, 184949, 88-2085; 16414, SNX14, 82500, 184950, 1-536; 16414, SNX14, 82501, 184951, 69-505; 16414, SNX14, 82502, 184952, 154-863; 16414, SNX14, 82503, 184953, 790-3288; 16414, SNX14, 82504, 184954, 41-316; 16414, SNX14, 82494, 184944, 196-2877; 16414, SNX14, 82495, 184945, 178-3018; 16414, SNX14, 82496, 184946, 133-2946; 16414, SNX14, 82505, 184955, 340-3024; 16415, SNX15, 82508, 184958, 52-627; 16415, SNX15, 82509, 184959, 67-411; 16415, SNX15, 82510, 184960, 115-312; 16415, SNX15, 82511, 184961, 53-704; 16415, SNX15, 82506, 184956, 1-771; 16415, SNX15, 82507, 184957, 131-1159; 16416, SNX16, 82515, 184965, 524-742; 16416, SNX16, 82516, 184966, 439-691; 16416, SNX16, 82517, 184967, 604-880; 16416, SNX16, 82518, 184968, 182-669; 16416, SNX16, 82519, 184969, 194-804; 16416, SNX16, 82520, 184970, 159-682; 16416, SNX16, 82521, 184971, 469-577; 16416, SNX16, 82522, 184972, 113-1144; 16416, SNX16, 82512, 184962, 69-1116; 16416, SNX16, 82513, 184963, 280-1314; 16416, SNX16, 82514, 184964, 508-1542; 16417, SNX17, 82524, 184974, 128-289; 16417, SNX17, 82525, 184975, 80-289; 16417, SNX17, 82526, 184976, 117-380; 16417, SNX17, 82523, 184973, 223-1635; 16417, SNX17, 82527, 184977, 249-1586; 16418, SNX18, 82528, 184978, 195-2081; 16418, SNX18, 82529, 184979, 195-1970; 16418, SNX18, 82530, 184980, 191-2065; 16419, SNX19, 82532, 184982, 35-517; 16419, SNX19, 82533, 184983, 415-1533; 16419, SNX19, 82534, 184984, 494-1192; 16419, SNX19, 82535, 184985, 359-1477; 16419, SNX19, 82531, 184981, 571-3549; 16419, SNX19, 82536, 184986, 511-2922; 16420, SNX2, 82539, 184989, 23-819; 16420, SNX2, 82540, 184990, 26-256; 16420, SNX2, 82537, 184987, 109-1668; 16420, SNX2, 82538, 184988, 804-2012; 16421, SNX20, 82545, 184995, 27-485; 16421, SNX20, 82541, 184991, 174-563; 16421, SNX20, 82542, 184992, 173-1123; 16421, SNX20, 82543, 184993, 133-441; 16421, SNX20, 82544, 184994, 123-512; 16422, SNX22, 82546, 184996, 60-641; 16422, SNX22, 82547, 184997, 38-400; 16423, SNX24, 82549, 184999, 30-638; 16423, SNX24, 82550, 185000, 1-67; 16423, SNX24, 82553, 185003, 1-207; 16423, SNX24, 82548, 184998, 186-695; 16423, SNX24, 82551, 185001, 9-488; 16423, SNX24, 82552, 185002, 117-596; 16424, SNX25, 82555, 185005, 1-428; 16424, SNX25, 82554, 185004, 241-2763; 16424, SNX25, 82556, 185006, 295-2817; 16424, SNX25, 82557, 185007, 982-2652; 16425, SNX29, 82558, 185008, 1-210; 16425, SNX29, 82559, 185009, 1-527; 16425, SNX29, 82561, 185011, 1-849; 16425, SNX29, 82562, 185012, 71-361; 16425, SNX29, 82560, 185010, 70-2511; 16426, SNX3, 82563, 185013, 340-828; 16426, SNX3, 82564, 185014, 324-746; 16426, SNX3, 82565, 185015, 326-667; 16426, SNX3, 82566, 185016, 44-436; 16427, SNX31, 82569, 185019, 332-705; 16427, SNX31, 82570, 185020, 263-563; 16427, SNX31, 82571, 185021, 79-489; 16427, SNX31, 82572, 185022, 1-146; 16427, SNX31, 82567, 185017, 152-1474; 16427, SNX31, 82568, 185018, 40-1065; 16428, SNX32, 82573, 185023, 426-1637; 16429, SNX33, 82575, 185025, 1-850; 16429, SNX33, 82574, 185024, 1198-2922; 16430, SNX4, 82577, 185027, 1-468; 16430, SNX4, 82578, 185028, 10-159; 16430, SNX4, 82576, 185026, 26-1378; 16431, SNX5, 82581, 185031, 34-840; 16431, SNX5, 82582, 185032, 87-778; 16431, SNX5, 82584, 185034, 141-236; 16431, SNX5, 82585, 185035, 370-465; 16431, SNX5, 82586, 185036, 361-528; 16431, SNX5, 82587, 185037, 1-512; 16431, SNX5, 82579, 185029, 296-1510; 16431, SNX5, 82580, 185030, 314-1528; 16431, SNX5, 82583, 185033, 350-730; 16432, SNX6, 82588, 185038, 32-1288; 16432, SNX6, 82590, 185040, 2-400; 16432, SNX6, 82591, 185041, 1-452; 16432, SNX6, 82592, 185042, 3-512; 16432, SNX6, 82593, 185043, 7-105; 16432, SNX6, 82594, 185044, 72-467; 16432, SNX6, 82595, 185045, 7-725; 16432, SNX6, 82589, 185039, 498-1370; 16433, SNX7, 82597, 185047, 173-497; 16433, SNX7, 82598, 185048, 32-1222; 16433, SNX7, 82599, 185049, 60-170; 16433, SNX7, 82596, 185046, 10-1365; 16434, SNX8, 82601, 185051, 91-762; 16434, SNX8, 82602, 185052, 289-415; 16434, SNX8, 82603, 185053, 329-583; 16434, SNX8, 82604, 185054, 154-634; 16434, SNX8, 82605, 185055, 159-686; 16434, SNX8, 82600, 185050, 44-1441; 16435, SNX9, 82607, 185057, 364-553; 16435, SNX9, 82608, 185058, 1-1785; 16435, SNX9, 82609, 185059, 291-542; 16435, SNX9, 82606, 185056, 172-1959; 16436, SNX21, 82611, 185061, 72-521; 16436, SNX21, 82612, 185062, 313-1407; 16436, SNX21, 82615, 185065, 90-587; 16436, SNX21, 82610, 185060, 69-668; 16436, SNX21, 82613, 185063, 69-1190; 16436, SNX21, 82614, 185064, 90-566; 16437, SNX27, 82616, 185066, 1-1308; 16437, SNX27, 82617, 185067, 138-335; 16437, SNX27, 82618, 185068, 121-1707; 16437, SNX27, 82619, 185069, 121-1746; 16438, SNX30, 82621, 185071, 1-374; 16438, SNX30, 82620, 185070, 165-1478; 16439, SOWAHA, 82622, 185072, 36-1685; 16440, SOWAHB, 82623, 185073, 299-2680; 16441, SOWAHC, 82624, 185074, 157-1734; 16442, SOWAHD, 82625, 185075, 56-1003; 16443, SP1, 82628, 185078, 117-602; 16443, SP1, 82629, 185079, 372-1061; 16443, SP1, 82626, 185076, 99-2456; 16443, SP1, 82627, 185077, 61-2397; 16444, SP100, 82635, 185085, 58-1425; 16444, SP100, 82636, 185086, 77-654; 16444, SP100, 82637, 185087, 1-778; 16444, SP100, 82639, 185089, 1-377; 16444, SP100, 82640, 185090, 1-580; 16444, SP100, 82630, 185080, 356-2995; 16444, SP100, 82631, 185081, 32-2689; 16444, SP100, 82632, 185082, 51-1493; 16444, SP100, 82633, 185083, 32-2098; 16444, SP100, 82634, 185084, 282-1619; 16444, SP100, 82638, 185088, 142-1500; 16445, SP110, 82644, 185094, 102-1745; 16445, SP110, 82645, 185095, 149-813; 16445, SP110, 82646, 185096, 121-600; 16445, SP110, 82647, 185097, 277-580; 16445, SP110, 82641, 185091, 79-2220; 16445, SP110, 82642, 185092, 241-1890; 16445, SP110, 82643, 185093, 80-2149; 16446, SP140, 82653, 185103, 493-580; 16446, SP140, 82648, 185098, 101-2524; 16446, SP140, 82649, 185099, 82-600; 16446, SP140, 82650, 185100, 115-2718; 16446, SP140, 82651, 185101, 104-2365; 16446, SP140, 82652, 185102, 116-2638; 16447, SP140L, 82654, 185104, 1-1668; 16447, SP140L, 82655, 185105, 1-1563; 16447, SP140L, 82656, 185106, 87-1403; 16447, SP140L, 82657, 185107, 259-648; 16447, SP140L, 82658, 185108, 87-1829; 16448, SP2, 82660, 185110, 159-908; 16448, SP2, 82659, 185109, 138-1979; 16449, SP3, 82662, 185112, 385-2526; 16449, SP3, 82663, 185113, 1-2216; 16449, SP3, 82661, 185111, 532-2877; 16450, SP4, 82665, 185115, 209-358; 16450, SP4, 82666, 185116, 210-377; 16450, SP4, 82664, 185114, 219-2573; 16451, SP5, 82667, 185117, 163-1359; 16452, SP6, 82668, 185118, 279-1409; 16452, SP6, 82669, 185119, 333-1463; 16453, SP7, 82673, 185123, 236-1042; 16453, SP7, 82670, 185120, 109-1404; 16453, SP7, 82671, 185121, 231-1472; 16453, SP7, 82672, 185122, 285-1580; 16454, SP8, 82676, 185126, 89-1489; 16454, SP8, 82674, 185124, 239-1711; 16454, SP8, 82675, 185125, 89-1615; 16455, SP9, 82677, 185127, 148-1602; 16456, SALL1, 82680, 185130, 1-105; 16456, SALL1, 82681, 185131, 433-3896; 16456, SALL1, 82678, 185128, 35-4009; 16456, SALL1, 82679, 185129, 433-4116; 16457, SALL2, 82682, 185132, 101-2821; 16457, SALL2, 82683, 185133, 87-659; 16457, SALL2, 82684, 185134, 257-553; 16457, SALL2, 82685, 185135, 1-2708; 16457, SALL2, 82686, 185136, 14-616; 16457, SALL2, 82688, 185138, 374-970; 16457, SALL2, 82687, 185137, 296-3319; 16458, SALL3, 82692, 185142, 1-3673; 16458, SALL3, 82693, 185143, 1-452; 16458, SALL3, 82694, 185144, 1-3903; 16458, SALL3, 82695, 185145, 1-452; 16458, SALL3, 82697, 185147, 1-2883; 16458, SALL3, 82698, 185148, 1-2883; 16458, SALL3, 82699, 185149, 1-2880; 16458, SALL3, 82700, 185150, 1-452; 16458, SALL3, 82689, 185139, 710-3997; 16458, SALL3, 82690, 185140, 1-3903; 16458, SALL3, 82691, 185141, 1-3687; 16458, SALL3, 82696, 185146, 1-3903; 16458, SALL3, 82701, 185151, 1-3687; 16458, SALL3, 82702, 185152, 710-3997; 16459, SALL4, 82704, 185154, 102-932; 16459, SALL4, 82703, 185153, 113-3274; 16459, SALL4, 82705, 185155, 68-1918; 16460, SPANXA2, 82706, 185156, 334-627; 16461, SPANXB1, 82707, 185157, 104-415; 16462, SPANXC, 82708, 185158, 40-333; 16463, SPANXD, 82709, 185159, 335-628; 16464, SPANXN1, 82710, 185160, 760-978; 16465, SPANXN2, 82711, 185161, 756-1298; 16466, SPANXN3, 82712, 185162, 85-510; 16467, SPANXN4, 82713, 185163, 84-554; 16467, SPANXN4, 82714, 185164, 98-397; 16468, SPANXN5, 82715, 185165, 754-972; 16469, SMOC1, 82716, 185166, 264-1571; 16469, SMOC1, 82717, 185167, 254-1558; 16470, SMOC2, 82720, 185170, 1-204; 16470, SMOC2, 82721, 185171, 1-255; 16470, SMOC2, 82722, 185172, 1036-1446; 16470, SMOC2, 82718, 185168, 221-1594; 16470, SMOC2, 82719, 185169, 221-1561; 16471, SPOCK1, 82723, 185173, 1-1134; 16471, SPOCK1, 82725, 185175, 371-571; 16471, SPOCK1, 82726, 185176, 37-453; 16471, SPOCK1, 82724, 185174, 171-1490; 16472, SPOCK2, 82730, 185180, 199-1470; 16472, SPOCK2, 82727, 185177, 329-1603; 16472, SPOCK2, 82728, 185178, 446-1720; 16472, SPOCK2, 82729, 185179, 329-562; 16473, SPOCK3, 82735, 185185, 114-482; 16473, SPOCK3, 82736, 185186, 46-240; 16473, SPOCK3, 82737, 185187, 114-482; 16473, SPOCK3, 82738, 185188, 46-563; 16473, SPOCK3, 82739, 185189, 74-556; 16473, SPOCK3, 82742, 185192, 160-505; 16473, SPOCK3, 82743, 185193, 74-313; 16473, SPOCK3, 82744, 185194, 44-259; 16473, SPOCK3, 82745, 185195, 44-235; 16473, SPOCK3, 82746, 185196, 160-505; 16473, SPOCK3, 82749, 185199, 74-313; 16473, SPOCK3, 82750, 185200, 1-252; 16473, SPOCK3, 82754, 185204, 44-313; 16473, SPOCK3, 82755, 185205, 199-1233; 16473, SPOCK3, 82731, 185181, 139-1449; 16473, SPOCK3, 82732, 185182, 101-1402; 16473, SPOCK3, 82733, 185183, 367-1524; 16473, SPOCK3, 82734, 185184, 104-1414; 16473, SPOCK3, 82740, 185190, 65-1375; 16473, SPOCK3, 82741, 185191, 134-1444; 16473, SPOCK3, 82747, 185197, 94-1395; 16473, SPOCK3, 82748, 185198, 65-1366; 16473, SPOCK3, 82751, 185201, 104-1045; 16473, SPOCK3, 82752, 185202, 43-1059; 16473, SPOCK3, 82753, 185203, 46-1227; 16473, SPOCK3, 82756, 185206, 310-1260; 16474, SPARCL1, 82758, 185208, 400-568; 16474, SPARCL1, 82760, 185210, 527-950; 16474, SPARCL1, 82762, 185212, 228-587; 16474, SPARCL1, 82763, 185213, 153-583; 16474, SPARCL1, 82764, 185214, 179-561; 16474, SPARCL1, 82765, 185215, 317-583; 16474, SPARCL1, 82766, 185216, 763-818; 16474, SPARCL1, 82757, 185207, 472-2466; 16474, SPARCL1, 82759, 185209, 573-2567; 16474, SPARCL1, 82761, 185211, 544-2163; 16475, SPG11, 82758, 185218, 1-6798; 16475, SPG11, 82770, 185220, 1-132; 16475, SPG11, 82771, 185221, 1-394; 16475, SPG11, 82772, 185222, 1-300; 16475, SPG11, 82773, 185223, 1-468; 16475, SPG11, 82774, 185224, 1-309; 16475, SPG11, 82775, 185225, 1-1703; 16475, SPG11, 82776, 185226, 1-750; 16475, SPG11, 82777, 185227, 1-323; 16475, SPG11, 82779, 185229, 12-2351; 16475, SPG11, 82780, 185230, 1-417; 16475, SPG11, 82767, 185217, 18-7349; 16475, SPG11, 82769, 185219, 29-7021; 16475, SPG11, 82778, 185228, 32-6271; 16476, SPG20, 82781, 185231, 95-2095; 16476, SPG20, 82782, 185232, 62-2062; 16476, SPG20, 82783, 185233, 219-2219; 16476, SPG20, 82784, 185234, 255-2255; 16477, SPG21, 82788, 185238, 173-624; 16477, SPG21, 82789, 185239, 176-565; 16477, SPG21, 82790, 185240, 404-562; 16477, SPG21, 82791, 185241, 246-553; 16477, SPG21, 82792, 185242, 330-544; 16477, SPG21, 82793, 185243, 324-747; 16477, SPG21, 82794, 185244, 422-541; 16477, SPG21, 82795, 185245, 1002-1466; 16477, SPG21, 82785, 185235, 297-1223; 16477, SPG21, 82786, 185236, 272-1117; 16477, SPG21, 82787, 185237, 94-1020; 16478, SPG7, 82798, 185248, 189-581; 16478, SPG7, 82799, 185249, 1-212; 16478, SPG7, 82800, 185250, 1-320; 16478, SPG7, 82801, 185251, 1-633; 16478, SPG7, 82802, 185252, 1-544; 16478, SPG7, 82803, 185253, 1-464; 16478, SPG7, 82804, 185254, 1598-2314; 16478, SPG7, 82805, 185255, 1-328; 16478, SPG7, 82796, 185246, 16-2403; 16478, SPG7, 82797, 185247, 8-1477; 16479, SPAST, 82806, 185256, 126-1976; 16479, SPAST, 82807, 185257, 222-1976; 16479, SPAST, 82808, 185258, 222-2072; 16479, SPAST, 82809, 185259, 123-1715; 16480, SPATA31A1, 82810, 185260, 21-4106; 16481, SPATA31A3, 82811, 185261, 63-4106; 16482, SPATA31A5, 82812, 185262, 63-4106; 16483, SPATA31A6, 82813, 185263, 30-4061; 16484, SPATA31A7, 82814, 185264, 63-4106; 16485, SPATA31D1, 82815, 185265, 48-4778; 16486, SPATA31D3, 82816, 185266, 1-2754; 16486, SPATA31D3, 82817, 185267, 87-2840; 16487, SPATA31D4, 82818, 185268, 1-2754; 16488, SPATA31E1, 82819, 185269, 67-4404; 16489, SPC24, 82820, 185270, 32-436; 16489, SPC24, 82822, 185272, 1-506; 16489, SPC24, 82823, 185273, 1-517; 16489, SPC24, 82824, 185274, 1-516; 16489, SPC24, 82825, 185275, 1-378; 16489, SPC24, 82826, 185276, 7-633; 16489, SPC24, 82821, 185271, 33-626; 16490, SPC25, 82828, 185278, 251-596; 16490, SPC25, 82829, 185279, 251-596; 16490, SPC25, 82827, 185277, 143-817; 16490, SPC25, 82830, 185280, 1-675; 16490, SPC25, 82831, 185281, 132-806; 16491, SPECC1L-ADORA2A, 82832, 185282, 228-2963; 16491, SPECC1L-ADORA2A, 82833, 185283, 631-1869; 16491, SPECC1L-ADORA2A, 82834, 185284, 525-1763; 16491, SPECC1L-ADORA2A, 82835, 185285, 307-1545; 16492, SPOP, 82839, 185289, 271-984; 16492, SPOP, 82840, 185290, 190-324; 16492, SPOP, 82841, 185291, 355-450; 16492, SPOP, 82842, 185292, 1-217; 16492, SPOP, 82843, 185293, 459-873; 16492, SPOP, 82844, 185294, 574-773; 16492, SPOP, 82845, 185295, 241-375; 16492, SPOP, 82847, 185297, 363-919; 16492, SPOP, 82848, 185298, 212-563; 16492, SPOP, 82849, 185299, 348-1134; 16492, SPOP, 82850, 185300, 308-428; 16492, SPOP, 82836, 185286, 349-1473; 16492, SPOP, 82837, 185287, 367-1491; 16492, SPOP, 82838, 185288, 633-1757; 16492, SPOP, 82846, 185296, 369-1493; 16493, SPOPL, 82852, 185302, 61-633; 16493, SPOPL, 82853, 185303, 249-467; 16493, SPOPL, 82851, 185301, 380-1558; 16494, SYNE1, 82854, 185304, 654-25832; 16494, SYNE1, 82855, 185305, 148-3075; 16494, SYNE1, 82856, 185306, 470-4771; 16494, SYNE1, 82857, 185307, 1-4965; 16494, SYNE1, 82860, 185310, 1-4068; 16494, SYNE1, 82861, 185311, 1-1533; 16494, SYNE1, 82862, 185312, 3265-4407; 16494, SYNE1, 82863, 185313, 438-26687; 16494, SYNE1, 82865, 185315, 49-776; 16494, SYNE1, 82866, 185316, 10-1848; 16494, SYNE1, 82867, 185317, 1-188; 16494, SYNE1, 82868, 185318, 161-3019; 16494, SYNE1, 82869, 185319, 1005-2850; 16494, SYNE1, 82870, 185320, 1-622; 16494, SYNE1, 82871, 185321, 62-647; 16494, SYNE1, 82872, 185322, 153-2417; 16494, SYNE1, 82873, 185323, 321-1754; 16494, SYNE1, 82858, 185308, 1-5178; 16494, SYNE1, 82859, 185309, 603-26996; 16494, SYNE1, 82864, 185314, 1-4332; 16495, SYNE2, 82876, 185326, 213-20687; 16495, SYNE2, 82881, 185331, 367-2373; 16495, SYNE2, 82882, 185332, 61-183; 16495, SYNE2, 82883, 185333, 1-10626; 16495, SYNE2, 82885, 185335, 110-1822; 16495, SYNE2, 82886, 185336, 41-557; 16495, SYNE2, 82887, 185337, 42-3383; 16495, SYNE2, 82888, 185338, 89-574; 16495, SYNE2, 82889, 185339, 1-645; 16495, SYNE2, 82890, 185340, 52-20508; 16495, SYNE2, 82874, 185324, 213-20870; 16495, SYNE2, 82875, 185325, 204-1061; 16495, SYNE2, 82877, 185327, 213-20936; 16495, SYNE2, 82878, 185328, 379-10191; 16495, SYNE2, 82879, 185329, 93-1763; 16495, SYNE2, 82880, 185330, 891-2180; 16495, SYNE2, 82884, 185334, 201-2492; 16496, SYNE3, 82894, 185344, 406-2604; 16496, SYNE3, 82891, 185341, 16-2943; 16496, SYNE3, 82892, 185342, 16-2928; 16496, SYNE3, 82893, 185343, 16-1806; 16497, SYNE4, 82897, 185347, 28-382; 16497, SYNE4, 82898, 185348, 113-1175; 16497, SYNE4, 82899, 185349, 1-453; 16497, SYNE4, 82895, 185345, 113-1327; 16497, SYNE4, 82896, 185346, 102-977; 16498, SPTA1, 82901, 185351, 92-465; 16498, SPTA1, 82902, 185352, 182-7474; 16498, SPTA1, 82900, 185350, 182-7441; 16499, SPTAN1, 82906, 185356, 114-7487; 16499, SPTAN1, 82907, 185357, 126-585; 16499, SPTAN1, 82908, 185358, 1-205; 16499, SPTAN1, 82909, 185359, 1-7497; 16499, SPTAN1, 82903, 185353, 108-7466; 16499, SPTAN1, 82904, 185354, 143-7561; 16499, SPTAN1, 82905, 185355, 111-7544; 16500, SPTB, 82913, 185363, 1-3087; 16500, SPTB, 82910, 185360, 1-6321; 16500, SPTB, 82911, 185361, 34-6447; 16500, SPTB, 82912, 185362, 55-7041; 16500, SPTB, 82914, 185364, 144-7130; 16501, SPTBN1, 82917, 185367, 95-2164; 16501, SPTBN1, 82918, 185368, 250-7350; 16501, SPTBN1, 82915, 185365, 386-6853; 16501, SPTBN1, 82916, 185366, 282-7376; 16502, SPTBN2, 82922, 185372, 509-859; 16502, SPTBN2, 82923, 185373, 44-2848; 16502, SPTBN2, 82924, 185374, 73-2877; 16502, SPTBN2, 82919, 185369, 73-7245; 16502, SPTBN2, 82920, 185370, 333-7505; 16502, SPTBN2, 82921, 185371, 1-7098; 16503, SPTBN4, 82926, 185376, 103-7797; 16503, SPTBN4, 82928, 185378, 87-7781; 16503, SPTBN4, 82930, 185380, 87-6095; 16503, SPTBN4, 82931, 185381, 1-2106; 16503, SPTBN4, 82925, 185375, 87-7781; 16503, SPTBN4, 82927, 185377, 128-2164; 16503, SPTBN4, 82929, 185379, 103-7797; 16504, SPTBN5, 82932, 185382, 229-11253; 16505, SPDYA, 82935, 185385, 1-173; 16505, SPDYA, 82936, 185386, 376-758; 16505, SPDYA, 82933, 185383, 190-1131; 16505, SPDYA, 82934, 185384, 148-1089; 16506, SPDYC, 82937, 185387, 83-964; 16507, SPDYE1, 82938, 185388, 138-1148; 16508, SPDYE16, 82939, 185389, 1-858; 16508, SPDYE16, 82941, 185391, 138-1076; 16508, SPDYE16, 82942, 185392, 1-1059; 16508, SPDYE16, 82943, 185393, 1-1059; 16508, SPDYE16, 82944, 185394, 1-858; 16508, SPDYE16, 82940, 185390, 138-1076; 16509, SPDYE2, 82945, 185395, 145-921; 16509, SPDYE2, 82946, 185396, 1-1209; 16509, SPDYE2, 82947, 185397, 475-1683; 16510, SPDYE2B, 82948, 185398, 145-921; 16510, SPDYE2B, 82949, 185399, 475-1683; 16510, SPDYE2B, 82950, 185400, 1-1209; 16511, SPDYE3, 82951, 185401, 185-1834; 16512, SPDYE4, 82953, 185403, 1-275; 16512, SPDYE4, 82954, 185404, 178-303; 16512, SPDYE4, 82952, 185402, 178-891; 16513, SPDYE5, 82955, 185405, 424-1632; 16513, SPDYE5, 82956, 185406, 137-1150; 16513, SPDYE5, 82957, 185407, 1-1209; 16514, SPDYE6, 82958, 185408, 422-1630; 16515, SPEG, 82963, 185413, 7-2583; 16515, SPEG, 82964, 185414, 36-197; 16515, SPEG, 82965, 185415, 1-130; 16515, SPEG, 82966, 185416, 1-1030; 16515, SPEG, 82967, 185417, 43-605; 16515, SPEG, 82968, 185418, 3-164; 16515, SPEG, 82969, 185419, 5-259; 16515, SPEG, 82970, 185420, 29-926; 16515, SPEG, 82971, 185421, 1-551; 16515, SPEG, 82972, 185422, 1-717; 16515, SPEG, 82959, 185409, 133-9936; 16515, SPEG, 82960, 185410, 154-495; 16515, SPEG, 82961, 185411, 339-680; 16515, SPEG, 82962, 185412, 135-476; 16516, SPEN, 82974, 185424, 614-1733; 16516, SPEN, 82975, 185425, 1-891; 16516, SPEN, 82973, 185423, 205-11199; 16517, SPACA1, 82976, 185426, 118-1002; 16518, SPACA3, 82978, 185428, 71-409; 16518,

SPACA3, 82977, 185427, 71-718; 16518, SPACA3, 82979, 185429, 410-850; 16519, SPACA4, 82980, 185430, 237-611; 16520, SPACA5, 82981, 185431, 169-648; 16520, SPACA5, 82982, 185432, 8-487; 16521, SPACA5B, 82983, 185433, 32-511; 16522, SPACA7, 82985, 185435, 173-667; 16522, SPACA7, 82986, 185436, 130-464; 16522, SPACA7, 82987, 185437, 387-699; 16522, SPACA7, 82989, 185439, 387-699; 16522, SPACA7, 82990, 185440, 130-464; 16522, SPACA7, 82991, 185441, 173-667; 16522, SPACA7, 82984, 185434, 68-655; 16522, SPACA7, 82988, 185438, 68-655; 16523, SPAM1, 82995, 185445, 520-760; 16523, SPAM1, 82992, 185442, 408-1937; 16523, SPAM1, 82993, 185443, 358-1893; 16523, SPAM1, 82994, 185444, 325-1860; 16523, SPAM1, 82996, 185446, 614-2143; 16523, SPAM1, 82997, 185447, 548-2077; 16524, SPECC1, 83004, 185454, 338-571; 16524, SPECC1, 83005, 185455, 242-462; 16524, SPECC1, 83006, 185456, 1-503; 16524, SPECC1, 83007, 185457, 377-433; 16524, SPECC1, 83008, 185458, 1-1604; 16524, SPECC1, 83009, 185459, 1-140; 16524, SPECC1, 83010, 185460, 268-570; 16524, SPECC1, 83011, 185461, 204-281; 16524, SPECC1, 83012, 185462, 1-609; 16524, SPECC1, 83013, 185463, 368-674; 16524, SPECC1, 83014, 185464, 184-581; 16524, SPECC1, 83015, 185465, 599-662; 16524, SPECC1, 82998, 185448, 52-3258; 16524, SPECC1, 82999, 185449, 115-2226; 16524, SPECC1, 83000, 185450, 109-2238; 16524, SPECC1, 83001, 185451, 84-3290; 16524, SPECC1, 83002, 185452, 53-2425; 16524, SPECC1, 83003, 185453, 209-3172; 16525, SPECC1L, 83018, 185468, 200-2565; 16525, SPECC1L, 83019, 185469, 88-612; 16525, SPECC1L, 83016, 185466, 286-3639; 16525, SPECC1L, 83017, 185467, 205-3558; 16525, SPECC1L, 83020, 185470, 139-3375; 16526, SPAG1, 83021, 185471, 87-2867; 16526, SPAG1, 83022, 185472, 192-2972; 16526, SPAG1, 83023, 185473, 216-1466; 16526, SPAG1, 83024, 185474, 285-1535; 16527, SPAG11A, 83026, 185476, 24-350; 16527, SPAG11A, 83027, 185477, 54-296; 16527, SPAG11A, 83028, 185478, 172-513; 16527, SPAG11A, 83029, 185479, 54-206; 16527, SPAG11A, 83030, 185480, 168-479; 16527, SPAG11A, 83031, 185481, 1-162; 16527, SPAG11A, 83032, 185482, 1-320; 16527, SPAG11A, 83025, 185475, 24-272; 16528, SPAG11B, 83035, 185485, 24-350; 16528, SPAG11B, 83036, 185486, 24-272; 16528, SPAG11B, 83037, 185487, 152-553; 16528, SPAG11B, 83040, 185490, 1-162; 16528, SPAG11B, 83041, 185491, 1-321; 16528, SPAG11B, 83042, 185492, 172-513; 16528, SPAG11B, 83043, 185493, 152-553; 16528, SPAG11B, 83044, 185494, 168-479; 16528, SPAG11B, 83046, 185496, 24-350; 16528, SPAG11B, 83048, 185498, 24-272; 16528, SPAG11B, 83049, 185499, 1-162; 16528, SPAG11B, 83050, 185500, 1-311; 16528, SPAG11B, 83033, 185483, 168-479; 16528, SPAG11B, 83034, 185484, 172-513; 16528, SPAG11B, 83038, 185488, 53-295; 16528, SPAG11B, 83039, 185489, 53-205; 16528, SPAG11B, 83045, 185495, 53-205; 16528, SPAG11B, 83047, 185497, 53-295; 16529, SPAG16, 83051, 185501, 106-1059; 16529, SPAG16, 83053, 185503, 96-269; 16529, SPAG16, 83054, 185504, 247-1002; 16529, SPAG16, 83055, 185505, 30-224; 16529, SPAG16, 83056, 185506, 4-1128; 16529, SPAG16, 83057, 185507, 48-332; 16529, SPAG16, 83058, 185508, 48-344; 16529, SPAG16, 83060, 185510, 1-768; 16529, SPAG16, 83052, 185502, 96-1991; 16529, SPAG16, 83059, 185509, 93-644; 16530, SPAG17, 83062, 185512, 1-1983; 16530, SPAG17, 83061, 185511, 67-6738; 16531, SPAG4, 83064, 185514, 184-827; 16531, SPAG4, 83065, 185515, 1-426; 16531, SPAG4, 83063, 185513, 113-1426; 16532, SPAG5, 83067, 185517, 54-870; 16532, SPAG5, 83068, 185518, 60-278; 16532, SPAG5, 83069, 185519, 1-715; 16532, SPAG5, 83070, 185520, 1-174; 16532, SPAG5, 83071, 185521, 52-273; 16532, SPAG5, 83072, 185522, 1-390; 16532, SPAG5, 83073, 185523, 1-559; 16532, SPAG5, 83074, 185524, 1-556; 16532, SPAG5, 83066, 185516, 334-3915; 16533, SPAG6, 83076, 185526, 320-1774; 16533, SPAG6, 83078, 185528, 115-853; 16533, SPAG6, 83079, 185529, 126-700; 16533, SPAG6, 83075, 185525, 116-1492; 16533, SPAG6, 83077, 185527, 143-1672; 16533, SPAG6, 83080, 185530, 1-1455; 16534, SPAG7, 83082, 185532, 19-282; 16534, SPAG7, 83083, 185533, 860-1390; 16534, SPAG7, 83084, 185534, 20-604; 16534, SPAG7, 83081, 185531, 69-752; 16535, SPAG8, 83087, 185537, 1-1451; 16535, SPAG8, 83088, 185538, 42-1475; 16535, SPAG8, 83089, 185539, 3-293; 16535, SPAG8, 83091, 185541, 29-238; 16535, SPAG8, 83092, 185542, 27-236; 16535, SPAG8, 83085, 185535, 126-1631; 16535, SPAG8, 83086, 185536, 24-1481; 16535, SPAG8, 83090, 185540, 116-1396; 16536, SPAG9, 83096, 185546, 1-459; 16536, SPAG9, 83097, 185547, 219-686; 16536, SPAG9, 83099, 185549, 1-522; 16536, SPAG9, 83100, 185550, 1-750; 16536, SPAG9, 83101, 185551, 210-4148; 16536, SPAG9, 83093, 185543, 210-4175; 16536, SPAG9, 83094, 185544, 210-4133; 16536, SPAG9, 83095, 185545, 219-3752; 16536, SPAG9, 83098, 185548, 79-4014; 16537, SPA17, 83102, 185552, 183-638; 16537, SPA17, 83103, 185553, 1422-1877; 16538, SPESP1, 83104, 185554, 155-1207; 16539, SPEF1, 83105, 185555, 162-872; 16540, SPEF2, 83109, 185559, 1-348; 16540, SPEF2, 83110, 185560, 155-2986; 16540, SPEF2, 83111, 185561, 335-1500; 16540, SPEF2, 83112, 185562, 1-363; 16540, SPEF2, 83113, 185563, 1-346; 16540, SPEF2, 83114, 185564, 110-547; 16540, SPEF2, 83115, 185565, 79-800; 16540, SPEF2, 83116, 185566, 1-455; 16540, SPEF2, 83106, 185556, 155-1699; 16540, SPEF2, 83107, 185557, 155-5623; 16540, SPEF2, 83108, 185558, 1-5457; 16541, SMCP, 83117, 185567, 151-501; 16542, SPANXA1, 83118, 185568, 334-627; 16542, SPANXA1, 83119, 185569, 40-333; 16543, SSFA2, 83121, 185571, 113-2419; 16543, SSFA2, 83122, 185572, 83-3796; 16543, SSFA2, 83123, 185573, 1-606; 16543, SSFA2, 83125, 185575, 144-284; 16543, SSFA2, 83126, 185576, 194-334; 16543, SSFA2, 83127, 185577, 419-559; 16543, SSFA2, 83120, 185570, 113-3883; 16543, SSFA2, 83124, 185574, 180-3959; 16544, SPERT, 83130, 185580, 72-551; 16544, SPERT, 83128, 185578, 81-1427; 16544, SPERT, 83129, 185579, 417-1655; 16544, SPERT, 83131, 185581, 81-1319; 16545, SPEM1, 83132, 185582, 26-955; 16546, STRBP, 83135, 185585, 294-578; 16546, STRBP, 83137, 185587, 1-270; 16546, STRBP, 83138, 185588, 609-832; 16546, STRBP, 83139, 185589, 1-174; 16546, STRBP, 83140, 185590, 1-254; 16546, STRBP, 83133, 185583, 431-2449; 16546, STRBP, 83134, 185584, 456-2432; 16546, STRBP, 83136, 185586, 177-2195; 16547, SPATC1, 83141, 185591, 103-1878; 16547, SPATC1, 83142, 185592, 91-1416; 16548, SPATC1L, 83143, 185593, 1063-2085; 16548, SPATC1L, 83144, 185594, 391-951; 16548, SPATC1L, 83145, 185595, 391-951; 16548, SPATC1L, 83146, 185596, 1063-2085; 16549, SOHLH1, 83147, 185597, 62-1048; 16549, SOHLH1, 83148, 185598, 62-1225; 16550, SOHLH2, 83149, 185599, 63-740; 16550, SOHLH2, 83150, 185600, 90-1367; 16551, SPATA12, 83151, 185601, 676-1248; 16552, SPATA13, 83156, 185606, 140-1678; 16552, SPATA13, 83157, 185607, 160-597; 16552, SPATA13, 83159, 185609, 1-1653; 16552, SPATA13, 83160, 185610, 233-301; 16552, SPATA13, 83161, 185611, 537-605; 16552, SPATA13, 83152, 185602, 314-2104; 16552, SPATA13, 83153, 185603, 408-2366;

16552, SPATA13, 83154, 185604, 329-4162; 16552, SPATA13, 83155, 185605, 171-1895; 16552, SPATA13, 83158, 185608, 474-4307; 16553, SPATA16, 83162, 185612, 185-1894; 16554, SPATA17, 83164, 185614, 56-298; 16554, SPATA17, 83163, 185613, 56-1141; 16555, SPATA18, 83167, 185617, 245-1795; 16555, SPATA18, 83168, 185618, 164-478; 16555, SPATA18, 83169, 185619, 245-511; 16555, SPATA18, 83170, 185620, 290-385; 16555, SPATA18, 83165, 185615, 375-1991; 16555, SPATA18, 83166, 185616, 290-1810; 16556, SPATA19, 83171, 185621, 56-559; 16556, SPATA19, 83172, 185622, 93-596; 16557, SPATA2, 83173, 185623, 232-1794; 16557, SPATA2, 83174, 185624, 351-1913; 16558, SPATA20, 83177, 185627, 57-227; 16558, SPATA20, 83178, 185628, 49-180; 16558, SPATA20, 83179, 185629, 796-927; 16558, SPATA20, 83180, 185630, 1-742; 16558, SPATA20, 83181, 185631, 1-332; 16558, SPATA20, 83182, 185632, 5-136; 16558, SPATA20, 83183, 185633, 83-214; 16558, SPATA20, 83184, 185634, 26-157; 16558, SPATA20, 83185, 185635, 81-284; 16558, SPATA20, 83187, 185637, 87-1652; 16558, SPATA20, 83188, 185638, 37-2397; 16558, SPATA20, 83175, 185625, 121-2529; 16558, SPATA20, 83176, 185626, 84-2444; 16558, SPATA20, 83186, 185636, 353-2581; 16559, SPATA21, 83190, 185640, 341-943; 16559, SPATA21, 83191, 185641, 1-483; 16559, SPATA21, 83193, 185643, 1-603; 16559, SPATA21, 83189, 185639, 484-1893; 16559, SPATA21, 83192, 185642, 335-1675; 16560, SPATA22, 83197, 185647, 515-1558; 16560, SPATA22, 83198, 185648, 323-577; 16560, SPATA22, 83199, 185649, 232-240; 16560, SPATA22, 83201, 185651, 330-834; 16560, SPATA22, 83204, 185654, 670-818; 16560, SPATA22, 83205, 185655, 506-997; 16560, SPATA22, 83206, 185656, 45-672; 16560, SPATA22, 83207, 185657, 121-566; 16560, SPATA22, 83194, 185644, 383-1192; 16560, SPATA22, 83195, 185645, 126-1088; 16560, SPATA22, 83196, 185646, 238-1329; 16560, SPATA22, 83200, 185650, 155-1246; 16560, SPATA22, 83202, 185652, 485-1576; 16560, SPATA22, 83203, 185653, 180-1271; 16561, SPATA24, 83208, 185658, 29-909; 16561, SPATA24, 83211, 185661, 1-558; 16561, SPATA24, 83212, 185662, 1-451; 16561, SPATA24, 83213, 185663, 28-528; 16561, SPATA24, 83214, 185664, 1-462; 16561, SPATA24, 83209, 185659, 8-574; 16561, SPATA24, 83210, 185660, 9-626; 16562, SPATA25, 83215, 185665, 46-729; 16563, SPATA2L, 83218, 185668, 152-692; 16563, SPATA2L, 83216, 185666, 70-1344; 16563, SPATA2L, 83217, 185667, 80-538; 16564, SPATA3, 83221, 185671, 65-178; 16564, SPATA3, 83224, 185674, 1-315; 16564, SPATA3, 83225, 185675, 1-262; 16564, SPATA3, 83226, 185676, 1-19; 16564, SPATA3, 83227, 185677, 81-626; 16564, SPATA3, 83219, 185669, 1-579; 16564, SPATA3, 83220, 185670, 109-687; 16564, SPATA3, 83222, 185672, 114-692; 16564, SPATA3, 83223, 185673, 97-675; 16565, SPATA32, 83229, 185679, 79-201; 16565, SPATA32, 83230, 185680, 75-188; 16565, SPATA32, 83228, 185678, 97-1251; 16566, SPATA33, 83232, 185682, 1-207; 16566, SPATA33, 83233, 185683, 1-145; 16566, SPATA33, 83234, 185684, 1-441; 16566, SPATA33, 83235, 185685, 1-82; 16566, SPATA33, 83236, 185686, 203-331; 16566, SPATA33, 83237, 185687, 1-115; 16566, SPATA33, 83239, 185689, 258-587; 16566, SPATA33, 83231, 185681, 1-420; 16566, SPATA33, 83238, 185688, 109-531; 16567, SPATA4, 83241, 185691, 1597-1995; 16567, SPATA4, 83242, 185692, 1-231; 16567, SPATA4, 83240, 185690, 110-1027; 16568, SPATA45, 83243, 185693, 109-405; 16569, SPATA5, 83244, 185694, 70-2751; 16570, SPATA5L1, 83246, 185696, 1-776; 16570, SPATA5L1, 83248, 185698, 1-59; 16570, SPATA5L1, 83245, 185695, 100-2361; 16570, SPATA5L1, 83247, 185697, 56-1918; 16571, SPATA6, 83249, 185699, 70-818; 16571, SPATA6, 83252, 185702, 201-1625; 16571, SPATA6, 83253, 185703, 78-338; 16571, SPATA6, 83254, 185704, 96-590; 16571, SPATA6, 83250, 185700, 3-1421; 16571, SPATA6, 83251, 185701, 166-1632; 16572, SPATA6L, 83255, 185705, 98-973; 16572, SPATA6L, 83260, 185710, 81-653; 16572, SPATA6L, 83256, 185706, 200-697; 16572, SPATA6L, 83257, 185707, 239-1243; 16572, SPATA6L, 83258, 185708, 99-596; 16572, SPATA6L, 83259, 185709, 174-1352; 16573, SPATA7, 83264, 185714, 171-428; 16573, SPATA7, 83265, 185715, 122-805; 16573, SPATA7, 83266, 185716, 147-287; 16573, SPATA7, 83267, 185717, 1-275; 16573, SPATA7, 83268, 185718, 142-387; 16573, SPATA7, 83269, 185719, 1-231; 16573, SPATA7, 83271, 185721, 147-275; 16573, SPATA7, 83272, 185722, 182-322; 16573, SPATA7, 83273, 185723, 81-341; 16573, SPATA7, 83274, 185724, 176-337; 16573, SPATA7, 83275, 185725, 147-287; 16573, SPATA7, 83276, 185726, 130-545; 16573, SPATA7, 83277, 185727, 76-225; 16573, SPATA7, 83261, 185711, 1-1377; 16573, SPATA7, 83262, 185712, 152-1855; 16573, SPATA7, 83263, 185713, 290-2089; 16573, SPATA7, 83270, 185720, 560-2263; 16574, SPATA8, 83279, 185729, 150-356; 16574, SPATA8, 83278, 185728, 268-585; 16575, SPATA9, 83280, 185730, 143-907; 16575, SPATA9, 83281, 185731, 143-907; 16575, SPATA9, 83282, 185732, 157-564; 16575, SPATA9, 83283, 185733, 157-693; 16576, SPATS1, 83284, 185734, 102-455; 16576, SPATS1, 83286, 185736, 157-372; 16576, SPATS1, 83285, 185735, 348-1250; 16576, SPATS1, 83287, 185737, 102-1004; 16577, SPATS2, 83289, 185739, 535-643; 16577, SPATS2, 83290, 185740, 522-546; 16577, SPATS2, 83291, 185741, 371-570; 16577, SPATS2, 83292, 185742, 424-527; 16577, SPATS2, 83294, 185744, 435-465; 16577, SPATS2, 83296, 185746, 990-1877; 16577, SPATS2, 83297, 185747, 497-720; 16577, SPATS2, 83298, 185748, 357-558; 16577, SPATS2, 83299, 185749, 381-675; 16577, SPATS2, 83300, 185750, 135-326; 16577, SPATS2, 83301, 185751, 528-552; 16577, SPATS2, 83302, 185752, 435-662; 16577, SPATS2, 83303, 185753, 555-570; 16577, SPATS2, 83304, 185754, 407-505; 16577, SPATS2, 83288, 185738, 357-1994; 16577, SPATS2, 83293, 185743, 385-2022; 16577, SPATS2, 83295, 185745, 514-2151; 16578, SPATS2L, 83309, 185759, 26-1822; 16578, SPATS2L, 83310, 185760, 124-920; 16578, SPATS2L, 83313, 185763, 535-1962; 16578, SPATS2L, 83314, 185764, 272-835; 16578, SPATS2L, 83315, 185765, 57-637; 16578, SPATS2L, 83317, 185767, 353-771; 16578, SPATS2L, 83318, 185768, 503-541; 16578, SPATS2L, 83319, 185769, 138-600; 16578, SPATS2L, 83320, 185770, 535-605; 16578, SPATS2L, 83321, 185771, 1-353; 16578, SPATS2L, 83322, 185772, 303-584; 16578, SPATS2L, 83323, 185773, 216-561; 16578, SPATS2L, 83324, 185774, 158-678; 16578, SPATS2L, 83325, 185775, 174-887; 16578, SPATS2L, 83305, 185755, 248-1924; 16578, SPATS2L, 83306, 185756, 151-1620; 16578, SPATS2L, 83307, 185757, 101-1801; 16578, SPATS2L, 83308, 185758, 473-2149; 16578, SPATS2L, 83311, 185761, 288-1964; 16578, SPATS2L, 83312, 185762, 524-2200; 16578, SPATS2L, 83316, 185766, 503-2179; 16578, SPATS2L, 83326, 185776, 124-1890; 16579, SPZ1, 83328, 185778, 157-859; 16579, SPZ1, 83327, 185777, 242-1534; 16580, SRM, 83330, 185780, 78-359; 16580, SRM, 83331, 185781, 1-250; 16580, SRM, 83332, 185782, 1-402; 16580, SRM, 83333, 185783, 253-611; 16580, SRM, 83329, 185779, 82-990; 16581, SATL1, 83334, 185784, 562-2088; 16581, SATL1, 83335, 185785, 81-1979; 16582, SAT1, 83336, 185786, 180-632; 16582, SAT1, 83337, 185787, 180-542; 16582, SAT1, 83338, 185788, 180-611; 16582, SAT1, 83339, 185789, 180-695; 16583, SAT2, 83341, 185791, 171-581; 16583, SAT2, 83342, 185792, 162-287; 16583, SAT2, 83343, 185793, 225-350; 16583, SAT2, 83340, 185790, 221-733; 16584, SMOX, 83349, 185799, 1-1329; 16584, SMOX, 83344, 185794, 226-1824; 16584, SMOX, 83345, 185795, 226-1893; 16584, SMOX, 83346, 185796, 70-642; 16584, SMOX, 83347, 185797, 226-1734; 16584, SMOX, 83348, 185798, 223-1890; 16584, SMOX, 83350, 185800, 226-1983; 16585, SMS, 83353, 185803, 1-931; 16585, SMS, 83351, 185801, 111-1052; 16585, SMS, 83352, 185802, 253-1353; 16586, STPG1, 83357, 185807, 1-434; 16586, STPG1, 83358, 185808, 1-507; 16586, STPG1, 83354, 185804, 143-1006; 16586, STPG1, 83355, 185805, 168-1172; 16586, STPG1, 83356, 185806, 256-1260; 16587, STPG2, 83360, 185810, 1-561; 16587, STPG2, 83359, 185809, 91-1470; 16588, SPX, 83362, 185812, 41-151; 16588, SPX, 83361, 185811, 167-517; 16589, SCAPER, 83366, 185816, 307-641; 16589, SCAPER, 83367, 185817, 147-2388; 16589, SCAPER, 83368, 185818, 277-504; 16589, SCAPER, 83369, 185819, 111-572; 16589, SCAPER, 83370, 185820, 199-544; 16589, SCAPER, 83371, 185821, 206-2507; 16589, SCAPER, 83372, 185822, 1-574; 16589, SCAPER, 83373, 185823, 1-298; 16589, SCAPER, 83374, 185824, 395-576; 16589, SCAPER, 83375, 185825, 1-189; 16589, SCAPER, 83363, 185813, 60-4262; 16589, SCAPER, 83364, 185814, 941-4405; 16589, SCAPER, 83365, 185815, 97-4299; 16590, SKP1, 83377, 185827, 97-572; 16590, SKP1, 83378, 185828, 693-748; 16590, SKP1, 83379, 185829, 266-692; 16590, SKP1, 83383, 185833, 97-222; 16590, SKP1, 83384, 185834, 305-610; 16590, SKP1, 83385, 185835, 158-277; 16590, SKP1, 83386, 185836, 67-558; 16590, SKP1, 83376, 185826, 185-676; 16590, SKP1, 83380, 185830, 111-593; 16590, SKP1, 83381, 185831, 150-641; 16590, SKP1, 83382, 185832, 160-651; 16591, SKP2, 83389, 185839, 142-795; 16591, SKP2, 83390, 185840, 136-901; 16591, SKP2, 83391, 185841, 1-243; 16591, SKP2, 83392, 185842, 136-444; 16591, SKP2, 83393, 185843, 95-403; 16591, SKP2, 83394, 185844, 141-1448; 16591, SKP2, 83387, 185837, 275-1507; 16591, SKP2, 83388, 185838, 197-1471; 16591, SKP2, 83395, 185845, 616-1248; 16592, SPHAR, 83396, 185846, 279-470; 16593, SMPD1, 83398, 185848, 290-447; 16593, SMPD1, 83399, 185849, 18-533; 16593, SMPD1, 83400, 185850, 127-1335; 16593, SMPD1, 83402, 185852, 97-1197; 16593, SMPD1, 83403, 185853, 1-953; 16593, SMPD1, 83397, 185847, 169-2064; 16593, SMPD1, 83401, 185851, 125-2017; 16594, SMPD2, 83405, 185855, 1-613; 16594, SMPD2, 83404, 185854, 360-1631; 16595, SMPD3, 83408, 185858, 347-627; 16595, SMPD3, 83409, 185859, 78-1994; 16595, SMPD3, 83410, 185860, 1-622; 16595, SMPD3, 83406, 185856, 605-2572; 16595, SMPD3, 83407, 185857, 78-2021; 16596, SMPD4, 83411, 185861, 1-2514; 16596, SMPD4, 83412, 185862, 1150-3750; 16596, SMPD4, 83413, 185863, 330-596; 16596, SMPD4, 83414, 185864, 1-940; 16596, SMPD4, 83415, 185865, 116-286; 16596, SMPD4, 83416, 185866, 1-2225; 16596, SMPD4, 83417, 185867, 110-283; 16596, SMPD4, 83418, 185868, 1-635; 16596, SMPD4, 83420, 185870, 1-796; 16596, SMPD4, 83421, 185871, 1-820; 16596, SMPD4, 83422, 185872, 293-699; 16596, SMPD4, 83423, 185873, 96-248; 16596, SMPD4, 83424, 185874, 113-283; 16596, SMPD4, 83419, 185869, 157-2451; 16597, SMPDL3A, 83425, 185875, 178-1539; 16597, SMPDL3A, 83426, 185876, 478-1446; 16598, SMPDL3B, 83429, 185879, 146-953; 16598, SMPDL3B, 83430, 185880, 156-464; 16598, SMPDL3B, 83431, 185881, 75-1298; 16598, SMPDL3B, 83427, 185877, 146-1267; 16598, SMPDL3B, 83428, 185878, 192-1559; 16599, SGMS1, 83432, 185882, 961-2202; 16599, SGMS1, 83433, 185883, 133-858; 16599, SGMS1, 83434, 185884, 955-1614; 16599, SGMS1, 83435, 185885, 355-461; 16599, SGMS1, 83436, 185886, 1-39; 16599, SGMS1, 83437, 185887, 955-1680; 16599, SGMS1, 83438, 185888, 133-858; 16600, SGMS2, 83442, 185892, 193-567; 16600, SGMS2, 83443, 185893, 467-570; 16600, SGMS2, 83444, 185894, 448-581; 16600, SGMS2, 83439, 185889, 390-1487; 16600, SGMS2, 83440, 185890, 558-1655; 16600, SGMS2, 83441, 185891, 630-1727; 16601, SPHK1, 83448, 185898, 254-588; 16601, SPHK1, 83450, 185900, 403-858; 16601, SPHK1, 83451, 185901, 525-541; 16601, SPHK1, 83445, 185895, 457-1869; 16601, SPHK1, 83446, 185896, 354-1508; 16601, SPHK1, 83447, 185897, 810-1964; 16601, SPHK1, 83449, 185899, 393-1547; 16601, SPHK1, 83452, 185902, 381-1577; 16602, SPHK2, 83454, 185904, 513-1859; 16602, SPHK2, 83455, 185905, 1-150; 16602, SPHK2, 83457, 185907, 167-565; 16602, SPHK2, 83459, 185909, 498-713; 16602, SPHK2, 83460, 185910, 495-1542; 16602, SPHK2, 83461, 185911, 257-1024; 16602, SPHK2, 83463, 185913, 992-2983; 16602, SPHK2, 83453, 185903, 367-2331; 16602, SPHK2, 83456, 185906, 270-2234; 16602, SPHK2, 83458, 185908, 206-1993; 16602, SPHK2, 83462, 185912, 195-2051; 16603, SGPL1, 83464, 185914, 1-609; 16603, SGPL1, 83466, 185916, 1-407; 16603, SGPL1, 83465, 185915, 201-1907; 16604, SGPP1, 83467, 185917, 96-1421; 16605, SGPP2, 83468, 185918, 87-1286; 16606, S1PR1, 83469, 185919, 376-1524; 16607, S1PR2, 83470, 185920, 112-1173; 16608, S1PR3, 83471, 185921, 397-1533; 16608, S1PR3, 83472, 185922, 4696-5832; 16609, S1PR4, 83473, 185923, 26-1180; 16610, S1PR5, 83476, 185926, 340-565; 16610, S1PR5, 83477, 185927, 11-775; 16610, S1PR5, 83474, 185924, 72-1268; 16610, S1PR5, 83475, 185925, 127-1323; 16611, SPHKAP, 83478, 185928, 29-5044; 16611, SPHKAP, 83479, 185929, 48-5150; 16612, SPI1, 83482, 185932, 135-872; 16612, SPI1, 83483, 185933, 171-278; 16612, SPI1, 83480, 185930, 39-854; 16612, SPI1, 83481, 185931, 224-1036; 16613, SPIB, 83486, 185936, 23-436; 16613, SPIB, 83487, 185937, 23-256; 16613, SPIB, 83489, 185939, 10-391; 16613, SPIB, 83484, 185934, 6-539; 16613, SPIB, 83485, 185935, 84-599; 16613, SPIB, 83488, 185938, 26-814; 16614, SPIC, 83490, 185940, 160-906; 16615, SPICE1, 83492, 185942, 500-556; 16615, SPICE1, 83493, 185943, 49-568; 16615, SPICE1, 83494, 185944, 109-590; 16615, SPICE1, 83495, 185945, 1-569; 16615, SPICE1, 83491, 185941, 261-2828; 16616, SKA1, 83500, 185950, 351-665; 16616, SKA1, 83501, 185951, 474-746; 16616, SKA1, 83503, 185953, 351-665; 16616, SKA1, 83504, 185954, 474-746; 16616, SKA1, 83496, 185946, 212-979; 16616, SKA1, 83497, 185947, 212-979; 16616, SKA1, 83498, 185948, 164-793; 16616, SKA1, 83499, 185949, 212-979; 16616, SKA1, 83502, 185952, 212-979; 16616, SKA1, 83505, 185955, 164-793; 16617, SKA2, 83508, 185958, 102-242; 16617, SKA2, 83509, 185959, 86-274; 16617, SKA2, 83510, 185960, 12-341; 16617, SKA2, 83511, 185961, 22-300; 16617, SKA2, 83512, 185962, 95-331; 16617, SKA2, 83513, 185963, 31-229; 16617, SKA2, 83514, 185964, 20-205; 16617, SKA2, 83506, 185956, 107-472; 16617, SKA2, 83507, 185957, 112-339; 16618, SKA3, 83518, 185968, 75-185; 16618, SKA3, 83519, 185965, 72-179; 16618, SKA3, 83516, 185966, 126-1364; 16618, SKA3, 83517, 185967, 71-1237; 16619, SPDL1, 83521, 185971, 452-711; 16619, SPDL1, 83522, 185972, 206-896; 16619, SPDL1, 83523, 185973, 288-552; 16619, SPDL1, 83524, 185974, 164-298; 16619, SPDL1, 83525, 185975, 175-623; 16619, SPDL1, 83526, 185976, 1-68; 16619, SPDL1, 83527, 185977, 126-308; 16619, SPDL1, 83528, 185978, 300-482; 16619, SPDL1, 83529, 185979, 162-637; 16619, SPDL1, 83530, 185980, 1-936; 16619, SPDL1, 83531, 185981, 158-340; 16619, SPDL1, 83520, 185970, 280-2097; 16620, SPIN1, 83532, 185982, 279-1067; 16621, SPIN2A, 83535, 185985, 322-795; 16621, SPIN2A, 83533, 185983, 372-1148; 16621, SPIN2A, 83534, 185984, 401-1177; 16622, SPIN2B, 83538, 185988, 81-554; 16622, SPIN2B, 83540, 185990, 309-1050; 16622, SPIN2B, 83536, 185986, 205-981; 16622, SPIN2B, 83537, 185987, 312-1088; 16622, SPIN2B, 83539, 185989, 258-1034; 16623, SPIN3, 83541, 185991, 324-1100; 16623, SPIN3, 83542, 185992, 287-520; 16623, SPIN3, 83543, 185993, 325-558; 16624, SPIN4, 83545, 185995, 580-1275; 16624, SPIN4, 83544, 185994, 521-1270; 16625, SPNS1, 83550, 186000, 9-1730; 16625, SPNS1, 83551, 186001, 332-759; 16625, SPNS1, 83552, 186002, 1-824; 16625, SPNS1, 83553, 186003, 1-539; 16625, SPNS1, 83554, 186004, 1-1615; 16625, SPNS1, 83555, 186005, 296-829; 16625, SPNS1, 83546, 185996, 340-1704; 16625, SPNS1, 83547, 185997, 378-1964; 16625, SPNS1, 83548, 185998, 491-1858; 16625, SPNS1, 83549, 185999, 352-1782; 16626, SPNS2, 83557, 186007, 1-846; 16626, SPNS2, 83556, 186006, 211-1860; 16627, SPNS3, 83559, 186009, 6-614; 16627, SPNS3, 83558, 186008, 281-1819; 16628, SPIRE1, 83560, 186010, 106-1743; 16628, SPIRE1, 83563, 186013, 109-701; 16628, SPIRE1, 83566, 186016, 1-367; 16628, SPIRE1, 83567, 186017, 105-546; 16628, SPIRE1, 83568, 186018, 170-536; 16628, SPIRE1, 83569, 186019, 1-1869; 16628, SPIRE1, 83561, 186011, 180-2408; 16628, SPIRE1, 83562, 186012, 269-2539; 16628, SPIRE1, 83564, 186014, 202-1578; 16628, SPIRE1, 83565, 186015, 110-1978; 16629, SPIRE2, 83572, 186022, 5-304; 16629, SPIRE2, 83573, 186023, 1-123; 16629, SPIRE2, 83570, 186020, 44-2188; 16629, SPIRE2, 83571, 186021, 53-2053; 16630, SPSB1, 83577, 186027, 217-822; 16630, SPSB1, 83574, 186024, 342-1163; 16630, SPSB1, 83575, 186025, 330-1151; 16630, SPSB1, 83576, 186026, 186-1007; 16631, SPSB2, 83579, 186029, 433-679; 16631, SPSB2, 83578, 186028, 188-979; 16631, SPSB2, 83580, 186030, 157-948; 16631, SPSB2, 83581, 186031, 188-991; 16632, SPSB3, 83583, 186033, 77-580; 16632, SPSB3, 83582, 186032, 34-1101; 16632, SPSB3, 83584, 186034, 332-1399; 16633, SPSB4, 83586, 186036, 1-271; 16633, SPSB4, 83585, 186035, 745-1566; 16634, SYK, 83587, 186037, 134-2041; 16634, SYK, 83588, 186038, 121-1959; 16634, SYK, 83589, 186039, 149-1987; 16634, SYK, 83590, 186040, 149-2056; 16635, SF1, 83596, 186046, 116-271; 16635, SF1, 83597, 186047, 1-603; 16635, SF1, 83598, 186048, 1-541; 16635, SF1, 83600, 186050, 289-475; 16635, SF1, 83601, 186051, 356-688; 16635, SF1, 83602, 186052, 1-875; 16635, SF1, 83603, 186053, 372-704; 16635, SF1, 83591, 186041, 356-2002; 16635, SF1, 83592, 186042, 395-2311; 16635, SF1, 83593, 186043, 78-2099; 16635, SF1, 83594, 186044, 339-2258; 16635, SF1, 83595, 186045, 356-2071; 16635, SF1, 83599, 186049, 310-2151; 16636, SF3A1, 83605, 186055, 128-319; 16636, SF3A1, 83606, 186056, 1-777; 16636, SF3A1, 83607, 186057, 93-209; 16636, SF3A1, 83604, 186054, 156-2537; 16637, SF3A2, 83609, 186059, 139-543; 16637, SF3A2, 83608, 186058, 436-1830; 16638, SF3A3, 83610, 186060, 957-2462; 16639, SF3B1, 83612, 186062, 18-131; 16639, SF3B1, 83614, 186064, 1-723; 16639, SF3B1, 83615, 186065, 81-545; 16639, SF3B1, 83611, 186061, 93-4007; 16639, SF3B1, 83613, 186063, 81-515; 16639, SF3B1, 83616, 186066, 29-463; 16640, SF3B2, 83618, 186068, 1-1163; 16640, SF3B2, 83619, 186069, 21-1081; 16640, SF3B2, 83620, 186070, 55-2691; 16640, SF3B2, 83621, 186071, 21-841; 16640, SF3B2, 83622, 186072, 191-432; 16640, SF3B2, 83623, 186073, 1-947; 16640, SF3B2, 83624, 186074, 49-2664; 16640, SF3B2, 83617, 186067, 50-2737; 16641, SF3B3, 83626, 186076, 363-453; 16641, SF3B3, 83627, 186077, 314-529; 16641, SF3B3, 83628, 186078, 539-551; 16641, SF3B3, 83629, 186079, 1-276; 16641, SF3B3, 83630, 186080, 162-334; 16641, SF3B3, 83631, 186081, 240-333; 16641, SF3B3, 83625, 186075, 212-3865; 16642, SF3B4, 83633, 186083, 256-826; 16642, SF3B4, 83632, 186082, 586-1860; 16643, SF3B5, 83634, 186084, 77-337; 16644, SF3B6, 83635, 186085, 215-592; 16645, SFPQ, 83637, 186087, 1-672; 16645, SFPQ, 83638, 186088, 1-265; 16645, SFPQ, 83636, 186086, 100-2223; 16646, SFSWAP, 83641, 186091, 1-961; 16646, SFSWAP, 83642, 186092, 141-506; 16646, SFSWAP, 83639, 186089, 142-2997; 16646, SFSWAP, 83640, 186090, 94-3105; 16647, SREK1, 83645, 186095, 63-461; 16647, SREK1, 83646, 186096, 353-580; 16647, SREK1, 83647, 186097, 63-191; 16647, SREK1, 83648, 186098, 1-181; 16647, SREK1, 83649, 186099, 160-462; 16647, SREK1, 83643, 186093, 160-2034; 16647, SREK1, 83644, 186094, 661-2187; 16648, SHFM1, 83652, 186102, 96-284; 16648, SHFM1, 83653, 186103, 118-387; 16648, SHFM1, 83654, 186104, 89-358; 16648, SHFM1, 83655, 186105, 99-296; 16648, SHFM1, 83656, 186106, 89-181; 16648, SHFM1, 83657, 186107, 13-198; 16648, SHFM1, 83658, 186108, 48-404; 16648, SHFM1, 83659, 186109, 50-235; 16648, SHFM1, 83660, 186110, 13-213; 16648, SHFM1, 83661, 186111, 13-282; 16648, SHFM1, 83662, 186112, 13-189; 16648, SHFM1, 83663, 186113, 64-237; 16648, SHFM1, 83664, 186114, 18-380; 16648, SHFM1, 83650, 186100, 129-341; 16648, SHFM1, 83651, 186101, 48-434; 16649, SPO11, 83666, 186116, 10-1074; 16649, SPO11, 83668, 186118, 1-810; 16649, SPO11, 83669, 186119, 1-372; 16649, SPO11, 83665, 186115, 56-1132; 16649, SPO11, 83667, 186117, 110-1300; 16650, SPOCD1, 83672, 186122, 60-1979; 16650, SPOCD1, 83673, 186123, 226-487; 16650, SPOCD1, 83675, 186125, 416-477; 16650, SPOCD1, 83676, 186126, 1-765; 16650, SPOCD1, 83677, 186127, 434-563; 16650, SPOCD1, 83670, 186120, 201-2291; 16650, SPOCD1, 83671, 186121, 131-3781; 16650, SPOCD1, 83674, 186124, 43-3654; 16651, SPON1, 83678, 186128, 217-2640; 16652, SPON2, 83681, 186131, 500-549; 16652, SPON2, 83682, 186132, 236-307; 16652, SPON2, 83683, 186133, 535-557; 16652, SPON2, 83684, 186134, 389-571; 16652, SPON2, 83685, 186135, 510-556; 16652, SPON2, 83686, 186136, 272-597; 16652, SPON2, 83687, 186137, 379-571; 16652, SPON2, 83679, 186129, 334-1329; 16652, SPON2, 83680, 186130, 272-1267; 16652, SPON2, 83688, 186138, 626-1621; 16653, SPRY1, 83691, 186141, 385-1012; 16653, SPRY1, 83692, 186142, 440-641; 16653, SPRY1, 83693, 186143, 469-573; 16653, SPRY1, 83689, 186139, 188-1147; 16653, SPRY1, 83690, 186140, 341-1300; 16653, SPRY1, 83694, 186144, 184-1143; 16653, SPRY1, 83695, 186145, 440-1399; 16654, SPRY2, 83698, 186148, 157-1218; 16654, SPRY2, 83696, 186146, 979-1926; 16654, SPRY2, 83697, 186147, 382-1329; 16655, SPRY3, 83699, 186149, 432-1298; 16656, SPRY4, 83700, 186150, 188-1156; 16656, SPRY4, 83702, 186152, 403-553; 16656, SPRY4, 83701, 186151, 245-1144; 16657, SPRED1, 83704, 186154, 133-527; 16657, SPRED1, 83703, 186153, 861-2195; 16658, SPRED2, 83706, 186156, 68-1365; 16658, SPRED2, 83707, 186157, 1-143; 16658, SPRED2, 83709, 186159, 207-555; 16658, SPRED2, 83710, 186160, 1-701; 16658, SPRED2, 83711, 186161, 1-312; 16658, SPRED2, 83705, 186155, 191-1447; 16658, SPRED2, 83708, 186158, 45-1292; 16659, SPRED3, 83713, 186163, 5-370; 16659, SPRED3, 83715, 186165, 103-646; 16659, SPRED3, 83716, 186166, 79-1443; 16659, SPRED3, 83712, 186162, 104-1336; 16659, SPRED3, 83714, 186164, 131-1363; 16660, SPRTN, 83719, 186169, 235-795; 16660, SPRTN, 83717, 186167, 129-752; 16660, SPRTN, 83718, 186168, 337-1806; 16660, SPRTN, 83720, 186170, 1281-2033; 16661, SPRYD3, 83722, 186172, 72-569; 16661, SPRYD3, 83723, 186173, 1-181; 16661, SPRYD3, 83724, 186174, 45-1484; 16661, SPRYD3, 83721, 186171, 88-1416; 16662, SPRYD4, 83726, 186176, 823-1200; 16662, SPRYD4, 83725, 186175, 26-649; 16663, SPRYD7, 83727, 186177, 106-696; 16663, SPRYD7, 83728, 186178, 256-729; 16663, SPRYD7, 83729, 186179, 73-546; 16664, SUPT16H, 83731, 186181, 55-306; 16664, SUPT16H, 83732, 186182, 69-314; 16664, SUPT16H, 83733, 186183, 20-220; 16664, SUPT16H, 83730, 186180, 340-3483; 16665, SPTY2D1, 83734, 186184, 237-2294; 16666, SUPT20H, 83740, 186190, 1-1135; 16666, SUPT20H, 83741, 186191, 165-734; 16666, SUPT20H, 83742, 186192, 157-2367; 16666, SUPT20H, 83743, 186193, 222-1718; 16666, SUPT20H, 83744, 186194, 184-1752; 16666, SUPT20H, 83735, 186185, 222-2561; 16666, SUPT20H, 83736, 186186, 265-2466; 16666, SUPT20H, 83737, 186187, 249-2450; 16666, SUPT20H, 83738, 186188, 185-2620; 16666, SUPT20H, 83739, 186189, 332-2533; 16667, SUPT3H, 83745, 186195, 274-771; 16667, SUPT3H, 83746, 186196, 358-684; 16667, SUPT3H, 83747, 186197, 167-1120; 16667, SUPT3H, 83748, 186198, 319-1305; 16667, SUPT3H, 83749, 186199, 187-1140; 16668, SUPT4H1, 83751, 186201, 414-644; 16668, SUPT4H1, 83752, 186202, 2-130; 16668, SUPT4H1, 83754, 186204, 33-212; 16668, SUPT4H1, 83755, 186205, 112-438; 16668, SUPT4H1, 83750, 186200, 68-421; 16668, SUPT4H1, 83753, 186203, 187-540; 16669, SUPT5H, 83760, 186210, 1-493; 16669, SUPT5H, 83762, 186212, 58-364; 16669, SUPT5H, 83763, 186213, 397-558; 16669, SUPT5H, 83764, 186214, 90-396; 16669, SUPT5H, 83756, 186206, 248-3499; 16669, SUPT5H, 83757, 186207, 180-3431; 16669, SUPT5H, 83758, 186208, 180-3443; 16669, SUPT5H, 83759, 186209, 208-3471; 16669, SUPT5H, 83761, 186211, 368-3631; 16670, SUPT6H, 83767, 186217, 356-505; 16670, SUPT6H, 83768, 186218, 1-162; 16670, SUPT6H, 83765, 186215, 284-5464; 16670, SUPT6H, 83766, 186216, 279-5459; 16671, SUPT7L, 83769, 186219, 571-1815; 16671, SUPT7L, 83770, 186220, 620-1858; 16671, SUPT7L, 83771, 186221, 602-1441; 16671, SUPT7L, 83772, 186222, 1198-2436; 16671, SUPT7L, 83773, 186223, 1011-2249; 16672, SPTY2D1-AS1, 83774, 186224, 126-305; 16672, SPTY2D1-AS1, 83775, 186225, 141-311; 16672, SPTY2D1-AS1, 83776, 186226, 138-260; 16672, SPTY2D1-AS1, 83777, 186227, 143-373; 16672, SPTY2D1-AS1, 83778, 186228, 143-322; 16673, SQLE, 83780, 186230, 159-711; 16673, SQLE, 83781, 186231, 1-492; 16673, SQLE, 83782, 186232, 104-1543; 16673, SQLE, 83779, 186229, 899-2623; 16674, SART1, 83784, 186234, 53-547; 16674, SART1, 83783, 186233, 93-2495; 16675, SART3, 83787, 186237, 7-924; 16675, SART3, 83788, 186238, 114-582; 16675, SART3, 83789, 186239, 1-435; 16675, SART3, 83791, 186241, 6-2318; 16675, SART3, 83792, 186242, 216-548; 16675, SART3, 83785, 186235, 236-3127; 16675, SART3, 83786, 186236, 6-2789; 16675, SART3, 83790, 186240, 247-636; 16675, SART3, 83793, 186243, 8-1102; 16676, SLIRP, 83795, 186245, 1-171; 16676, SLIRP, 83796, 186246, 1-290; 16676, SLIRP, 83797, 186247, 10-384; 16676, SLIRP, 83799, 186249, 1-121; 16676, SLIRP, 83800, 186250, 10-306; 16676, SLIRP, 83801, 186251, 1-219; 16676, SLIRP, 83802, 186252, 1-231; 16676, SLIRP, 83803, 186253, 42-320; 16676, SLIRP, 83794, 186244, 34-357; 16676, SLIRP, 83798, 186248, 42-371; 16677, SHB, 83804, 186254, 567-2096; 16678, SHE, 83806, 186256, 1-397; 16678, SHE, 83807, 186257, 1-124; 16678, SHE, 83805, 186255, 88-1575; 16679, SHF, 83809, 186259, 210-929; 16679, SHF, 83810, 186260, 1-599; 16679, SHF, 83811, 186261, 2-874; 16679, SHF, 83812, 186262, 5-1249; 16679, SHF, 83813, 186263, 6-1109; 16679, SHF, 83814, 186264, 1-484; 16679, SHF, 83815, 186265, 1-440; 16679, SHF, 83816, 186266, 499-578; 16679, SHF, 83817, 186267, 1-491; 16679, SHF, 83808, 186258, 496-1767; 16680, SHD, 83819, 186269, 769-1671; 16680, SHD, 83820, 186270, 1-117; 16680, SHD, 83818, 186268, 1464-2486; 16681, SKAP1, 83822, 186272, 1-277; 16681, SKAP1, 83823, 186273, 1-117; 16681, SKAP1, 83824, 186274, 156-467; 16681, SKAP1, 83825, 186275, 380-678; 16681, SKAP1, 83827, 186277, 1-99; 16681, SKAP1, 83821, 186271, 71-1150; 16681, SKAP1, 83826, 186276, 100-1179; 16682, SKAP2, 83829, 186279, 199-577; 16682, SKAP2, 83828, 186278, 315-1394; 16683, SRCIN1, 83830, 186280, 1-919; 16683, SRCIN1, 83831, 186281, 11-1431; 16683, SRCIN1, 83832, 186282, 1-2785; 16683, SRCIN1, 83834, 186284, 138-3791; 16683, SRCIN1, 83836, 186286, 11-1431; 16683, SRCIN1, 83837, 186287, 138-3791; 16683, SRCIN1, 83838, 186288, 1-919; 16683, SRCIN1, 83839, 186289, 1-2785; 16683, SRCIN1, 83833, 186283, 226-3777; 16683, SRCIN1, 83835, 186285, 226-3777; 16684, SRC, 83840, 186290, 188-1798; 16684, SRC, 83841, 186291, 5-1633; 16684, SRC, 83842, 186292, 40-1650; 16684, SRC, 83843, 186293, 349-1959; 16685, SLA, 83848, 186298, 462-582; 16685, SLA, 83850, 186300, 477-561; 16685, SLA, 83851, 186301, 521-563; 16685, SLA, 83852, 186302, 553-826; 16685, SLA, 83853, 186303, 224-391; 16685, SLA, 83854, 186304, 441-586; 16685, SLA, 83855, 186305, 119-594; 16685, SLA, 83844, 186294, 821-1651; 16685, SLA, 83845, 186295, 350-1231; 16685, SLA, 83846, 186296, 79-1029; 16685, SLA, 83847, 186297, 340-846; 16685, SLA, 83849, 186299, 50-799; 16686, SLA2, 83856, 186306, 424-1209; 16686, SLA2, 83857, 186307, 89-721; 16687, SRMS, 83858, 186308, 42-1508; 16688, SOAP, 83860, 186310, 238-735; 16688, SOAP, 83861, 186311, 1177-2235; 16688, SOAP, 83862, 186312, 274-683; 16688, SOAP, 83863, 186313, 238-495; 16688, SOAP, 83864, 186314, 287-550; 16688, SOAP, 83865, 186315, 256-621; 16688, SOAP, 83866, 186316, 310-706; 16688, SOAP, 83867, 186317, 100-2817; 16688, SOAP, 83859, 186309, 414-4253; 16689, SREK1IP1, 83869, 186319, 83-379; 16689, SREK1IP1, 83868, 186318, 169-636; 16690, SRRD, 83871, 186321, 12-1019; 16690, SRRD, 83870, 186320, 15-1034; 16691, SCAF1, 83873, 186323, 105-463; 16691, SCAF1, 83874, 186324, 198-491; 16691, SCAF1, 83875, 186325, 54-662; 16691, SCAF1, 83872, 186322, 125-4063; 16692, SCAF11, 83876, 186326, 1732-2084; 16692, SCAF11, 83878, 186328, 250-483; 16692, SCAF11, 83879, 186329, 254-487; 16692, SCAF11, 83880, 186330, 467-3271; 16692, SCAF11, 83881, 186331, 119-3934; 16692, SCAF11, 83883, 186333, 1-457; 16692, SCAF11, 83884, 186334, 1-215; 16692, SCAF11, 83877, 186327, 235-4626; 16692, SCAF11, 83882, 186332, 1211-4657; 16693, SCAF4, 83885, 186335, 384-3827; 16693, SCAF4, 83886, 186336, 384-3761; 16693, SCAF4, 83887, 186337, 277-3675; 16694, SCAF8, 83890, 186340, 46-4095; 16694, SCAF8, 83888, 186338, 577-4392; 16694, SCAF8, 83889, 186339, 46-4059; 16695, SRPK1, 83891, 186341, 1-2016; 16695, SRPK1, 83892, 186342, 10-2490; 16695, SRPK1, 83895, 186345, 1-129; 16695, SRPK1, 83896, 186346, 93-559; 16695, SRPK1, 83897, 186347, 182-621; 16695, SRPK1, 83898, 186348, 227-581; 16695, SRPK1, 83899, 186349, 363-593; 16695, SRPK1, 83893, 186343, 287-2254; 16695, SRPK1, 83894, 186344, 168-2087; 16696, SRPK2, 83902, 186352, 186-666; 16696, SRPK2, 83903, 186353, 93-299; 16696, SRPK2, 83904, 186354, 1-444; 16696, SRPK2, 83905, 186355, 1-614; 16696, SRPK2, 83906, 186356, 22-715; 16696, SRPK2, 83908, 186358, 1-886; 16696, SRPK2, 83900, 186350, 173-2239; 16696, SRPK2, 83901, 186351, 89-2188; 16696, SRPK2, 83907, 186357, 182-2248; 16697, SRPK3, 83909, 186359, 31-1509; 16697, SRPK3, 83912, 186362, 49-1653; 16697, SRPK3, 83914, 186364, 1-614; 16697, SRPK3, 83915, 186365, 1-386; 16697, SRPK3, 83916, 186366, 2367-4271; 16697, SRPK3, 83910, 186360, 47-1750; 16697, SRPK3, 83911, 186361, 49-1749; 16697, SRPK3, 83913, 186363, 87-1688; 16698, SOX1, 83917, 186367, 13-1188; 16699, SOX10, 83920, 186370, 1-539; 16699, SOX10, 83921, 186371, 233-873; 16699, SOX10, 83918, 186368, 266-1666; 16699, SOX10, 83919, 186369, 284-1684; 16700, SOX11, 83922, 186372, 56-1381; 16701, SOX12, 83923, 186373, 525-1472; 16702, SOX13, 83925, 186375, 366-538; 16702, SOX13, 83926, 186376, 1-386; 16702, SOX13, 83927, 186377, 59-597; 16702, SOX13, 83924, 186374, 110-1978; 16702, SOX13, 83928, 186378, 1-1869; 16703, SOX14, 83929, 186379, 502-1224; 16704, SOX15, 83930, 186380, 495-1196; 16704, SOX15, 83931, 186381, 149-850; 16704, SOX15, 83932, 186382, 416-952; 16705, SOX17, 83933, 186383, 205-1449; 16706, SOX18, 83934, 186384, 126-1280; 16707, SOX2, 83935, 186385, 438-1391; 16708, SOX21, 83936, 186386, 351-1181; 16709, SOX3, 83937, 186387, 444-1784; 16710, SOX30, 83940, 186390, 155-1501; 16710, SOX30, 83938, 186388, 343-2604; 16710, SOX30, 83939, 186389, 287-1792; 16711, SOX4, 83941, 186391, 1767-3191; 16712, SOX5, 83942, 186392, 45-1574; 16712, SOX5, 83945, 186395, 140-526; 16712, SOX5, 83948, 186398, 47-2233; 16712, SOX5, 83949, 186399, 184-617; 16712, SOX5, 83951, 186401, 32-757; 16712, SOX5, 83943, 186393, 142-2070; 16712, SOX5, 83944, 186394, 61-1194; 16712, SOX5, 83946, 186396, 103-2394; 16712, SOX5, 83947, 186397, 4-2256; 16712, SOX5, 83950, 186400, 5-1933; 16712, SOX5, 83952, 186402, 157-2418; 16713, SOX6, 83956, 186406, 688-1167; 16713, SOX6, 83957, 186407, 312-549; 16713, SOX6, 83960, 186410, 116-534; 16713, SOX6, 83961, 186411, 110-586; 16713, SOX6, 83953, 186403, 22-2448; 16713, SOX6, 83954, 186404, 79-2505; 16713, SOX6, 83955, 186405, 192-2597; 16713, SOX6, 83958, 186408, 69-2555; 16713, SOX6, 83959, 186409, 184-2598; 16714, SOX7, 83962, 186412, 80-1246; 16715, SOX8, 83963, 186413, 116-1456; 16716, SOX9, 83964, 186414, 373-1902; 16717, SSUH2, 83967, 186417, 37-507; 16717, SSUH2, 83968, 186418, 334-588; 16717, SSUH2, 83969, 186419, 148-267; 16717, SSUH2, 83970, 186420, 41-559; 16717, SSUH2, 83971, 186421, 227-1174; 16717, SSUH2, 83972, 186422, 268-525; 16717, SSUH2, 83965, 186415, 1227-2288; 16717, SSUH2, 83966, 186416, 270-1331; 16717, SSUH2, 83973, 186423, 41-1168; 16718, SSU72, 83974, 186424, 313-897; 16718, SSU72, 83975, 186425, 28-489; 16719, ST20-MTHFS, 83976, 186426, 305-844; 16719, ST20-MTHFS, 83977, 186427, 265-632; 16719, ST20-MTHFS, 83978, 186428, 80-619; 16720, ST3GAL1, 83980, 186430, 526-665; 16720, ST3GAL1, 83981, 186431, 601-741; 16720, ST3GAL1, 83983, 186433, 334-626; 16720, ST3GAL1, 83984, 186434, 680-895; 16720, ST3GAL1, 83985, 186435, 537-684; 16720, ST3GAL1, 83979, 186429, 826-1848; 16720, ST3GAL1, 83982, 186432, 1018-2040; 16720, ST3GAL1, 83986, 186436, 739-1761; 16721, ST3GAL2, 83987, 186437, 1144-2196; 16721, ST3GAL2, 83988, 186438, 2109-3161; 16722, ST3GAL3, 84009, 186459, 204-461; 16722, ST3GAL3, 84011, 186461, 167-424; 16722, ST3GAL3, 84014, 186464, 82-384; 16722, ST3GAL3, 84016, 186466, 178-498; 16722, ST3GAL3, 84021, 186471, 1-592; 16722, ST3GAL3, 83989, 186439, 192-1526; 16722, ST3GAL3, 83990, 186440, 192-1433; 16722, ST3GAL3, 83991, 186441, 152-1324; 16722, ST3GAL3, 83992, 186442, 1-1035; 16722, ST3GAL3, 83993, 186443, 192-1025; 16722, ST3GAL3, 83994, 186444, 192-497; 16722, ST3GAL3, 83995, 186445, 192-749; 16722, ST3GAL3, 83996, 186446, 1-1335; 16722, ST3GAL3, 83997, 186447, 178-1257; 16722, ST3GAL3, 83998, 186448, 1-513; 16722, ST3GAL3, 83999, 186449, 178-1305; 16722, ST3GAL3, 84000, 186450, 1-468; 16722, ST3GAL3, 84001, 186451, 1-561; 16722, ST3GAL3, 84002, 186452, 1-558; 16722, ST3GAL3, 84003, 186453, 1-606; 16722, ST3GAL3, 84004, 186454, 1-1290; 16722, ST3GAL3, 84005, 186455, 1-1038; 16722, ST3GAL3, 84006, 186456, 1-1242; 16722, ST3GAL3, 84007, 186457, 192-1226; 16722, ST3GAL3, 84008, 186458, 1-570; 16722, ST3GAL3, 84010, 186460, 1-348; 16722, ST3GAL3, 84012, 186462, 1-786; 16722, ST3GAL3, 84013, 186463, 1-834; 16722, ST3GAL3, 84015, 186465, 1-306; 16722, ST3GAL3, 84017, 186467, 1-561; 16722, ST3GAL3, 84018, 186468, 1-222; 16722, ST3GAL3, 84019, 186469, 1-420; 16722, ST3GAL3, 84020, 186470, 1-456; 16722, ST3GAL3, 84022, 186472, 180-545; 16722, ST3GAL3, 84023, 186473, 1-687; 16722, ST3GAL3, 84024, 186474, 192-704; 16723, ST3GAL4, 84030, 186480, 553-1012; 16723, ST3GAL4, 84031, 186481, 137-763; 16723, ST3GAL4, 84032, 186482, 241-574; 16723, ST3GAL4, 84033, 186483, 244-624; 16723, ST3GAL4, 84035, 186485, 214-355; 16723, ST3GAL4, 84039, 186489, 271-550; 16723, ST3GAL4, 84025, 186475, 244-1233; 16723, ST3GAL4, 84026, 186476, 132-1151; 16723, ST3GAL4, 84027, 186477, 132-1133; 16723, ST3GAL4, 84028, 186478, 220-1221; 16723, ST3GAL4, 84029, 186479, 142-1110; 16723, ST3GAL4, 84034, 186484, 390-1391; 16723, ST3GAL4, 84036, 186486, 470-1459; 16723, ST3GAL4, 84037, 186487, 266-1264; 16723, ST3GAL4, 84038, 186488, 1-987; 16723, ST3GAL4, 84040, 186490, 375-1376; 16724, ST3GAL5, 84041, 186491, 7-345; 16724, ST3GAL5, 84045, 186495, 113-530; 16724, ST3GAL5, 84046, 186496, 82-225; 16724, ST3GAL5, 84042, 186492, 110-1366; 16724, ST3GAL5, 84043, 186493, 146-1318; 16724, ST3GAL5, 84044, 186494, 38-1225; 16725, ST3GAL6, 84049, 186499, 135-407; 16725, ST3GAL6, 84050, 186500, 22-809; 16725, ST3GAL6, 84052, 186502, 70-564; 16725, ST3GAL6, 84053, 186503, 151-348; 16725, ST3GAL6, 84054, 186504, 112-767; 16725, ST3GAL6, 84055, 186505, 56-750; 16725, ST3GAL6, 84056, 186506, 228-700; 16725, ST3GAL6, 84057, 186507, 280-582; 16725, ST3GAL6, 84058, 186508, 279-551; 16725, ST3GAL6, 84059, 186509, 127-489; 16725, ST3GAL6, 84060, 186510, 95-367; 16725, ST3GAL6, 84061, 186511, 127-567; 16725, ST3GAL6, 84062, 186512, 104-376; 16725, ST3GAL6, 84063, 186513, 161-1315; 16725, ST3GAL6, 84047, 186497, 637-1278; 16725, ST3GAL6, 84048, 186498, 492-1487; 16725, ST3GAL6, 84051, 186501, 290-1285; 16726, ST6GALNAC1, 84065, 186515, 56-1471; 16726,

ST6GALNAC1, 84066, 186516, 149-340; 16726, ST6GALNAC1, 84067, 186517, 23-166; 16726, ST6GALNAC1, 84068, 186518, 1-179; 16726, ST6GALNAC1, 84069, 186519, 1-458; 16726, ST6GALNAC1, 84070, 186520, 23-214; 16726, ST6GALNAC1, 84064, 186514, 201-2003; 16727, ST6GALNAC2, 84072, 186522, 1-115; 16727, ST6GALNAC2, 84073, 186523, 49-303; 16727, ST6GALNAC2, 84074, 186524, 223-447; 16727, ST6GALNAC2, 84075, 186525, 1-637; 16727, ST6GALNAC2, 84076, 186526, 897-1748; 16727, ST6GALNAC2, 84071, 186521, 321-1445; 16728, ST6GALNAC3, 84078, 186528, 201-617; 16728, ST6GALNAC3, 84077, 186527, 149-1066; 16729, ST6GALNAC4, 84080, 186530, 412-1013; 16729, ST6GALNAC4, 84079, 186529, 277-1185; 16730, ST6GALNAC5, 84082, 186532, 197-907; 16730, ST6GALNAC5, 84081, 186531, 236-1246; 16731, ST6GALNAC6, 84088, 186538, 201-802; 16731, ST6GALNAC6, 84089, 186539, 248-508; 16731, ST6GALNAC6, 84083, 186533, 1-1002; 16731, ST6GALNAC6, 84084, 186534, 248-1147; 16731, ST6GALNAC6, 84085, 186535, 174-1298; 16731, ST6GALNAC6, 84086, 186536, 230-1129; 16731, ST6GALNAC6, 84087, 186537, 181-1182; 16731, ST6GALNAC6, 84090, 186540, 219-1118; 16732, ST6GAL1, 84092, 186542, 315-588; 16732, ST6GAL1, 84093, 186543, 433-568; 16732, ST6GAL1, 84095, 186545, 711-1005; 16732, ST6GAL1, 84096, 186546, 532-596; 16732, ST6GAL1, 84097, 186547, 377-504; 16732, ST6GAL1, 84098, 186548, 431-507; 16732, ST6GAL1, 84099, 186549, 224-570; 16732, ST6GAL1, 84100, 186550, 368-707; 16732, ST6GAL1, 84101, 186551, 222-602; 16732, ST6GAL1, 84103, 186553, 388-544; 16732, ST6GAL1, 84104, 186554, 354-577; 16732, ST6GAL1, 84105, 186555, 1-537; 16732, ST6GAL1, 84106, 186556, 317-608; 16732, ST6GAL1, 84091, 186541, 675-1895; 16732, ST6GAL1, 84094, 186544, 332-1552; 16732, ST6GAL1, 84102, 186552, 670-1197; 16733, ST6GAL2, 84108, 186558, 1-286; 16733, ST6GAL2, 84111, 186561, 205-308; 16733, ST6GAL2, 84107, 186557, 190-1779; 16733, ST6GAL2, 84109, 186559, 612-2201; 16733, ST6GAL2, 84110, 186560, 191-1591; 16734, ST8SIA1, 84113, 186563, 440-691; 16734, ST8SIA1, 84115, 186565, 469-831; 16734, ST8SIA1, 84116, 186566, 1-519; 16734, ST8SIA1, 84117, 186567, 1-572; 16734, ST8SIA1, 84118, 186568, 1-75; 16734, ST8SIA1, 84112, 186562, 483-890; 16734, ST8SIA1, 84114, 186564, 483-1553; 16735, ST8SIA2, 84120, 186570, 25-1089; 16735, ST8SIA2, 84121, 186571, 1-998; 16735, ST8SIA2, 84119, 186569, 238-1365; 16736, ST8SIA3, 84123, 186573, 1-377; 16736, ST8SIA3, 84122, 186572, 2035-3177; 16737, ST8SIA4, 84125, 186575, 270-410; 16737, ST8SIA4, 84124, 186574, 312-1391; 16737, ST8SIA4, 84126, 186576, 260-766; 16738, ST8SIA5, 84128, 186578, 303-1340; 16738, ST8SIA5, 84130, 186580, 158-280; 16738, ST8SIA5, 84131, 186581, 43-207; 16738, ST8SIA5, 84127, 186577, 662-1792; 16738, ST8SIA5, 84129, 186579, 302-1540; 16739, ST8SIA6, 84133, 186583, 1-385; 16739, ST8SIA6, 84132, 186582, 76-1272; 16740, STAB1, 84135, 186585, 1-532; 16740, STAB1, 84134, 186584, 77-7789; 16741, STAB2, 84137, 186587, 1-408; 16741, STAB2, 84138, 186588, 1-102; 16741, STAB2, 84136, 186586, 205-7860; 16742, SAXO1, 84139, 186589, 346-567; 16742, SAXO1, 84141, 186591, 304-1533; 16742, SAXO1, 84140, 186590, 281-1705; 16743, SAXO2, 84143, 186593, 71-160; 16743, SAXO2, 84144, 186594, 460-551; 16743, SAXO2, 84145, 186595, 55-180; 16743, SAXO2, 84146, 186596, 228-542; 16743, SAXO2, 84142, 186592, 70-1266; 16744, STAMBP, 84151, 186601, 94-583; 16744, STAMBP, 84152, 186602, 149-560; 16744, STAMBP, 84153, 186603, 203-1156; 16744, STAMBP, 84154, 186604, 159-788; 16744, STAMBP, 84147, 186597, 94-1368; 16744, STAMBP, 84148, 186598, 504-1778; 16744, STAMBP, 84149, 186599, 203-1477; 16744, STAMBP, 84150, 186600, 48-1322; 16745, STAMBPL1, 84155, 186605, 824-1636; 16745, STAMBPL1, 84156, 186606, 635-1945; 16745, STAMBPL1, 84157, 186607, 959-2269; 16745, STAMBPL1, 84158, 186608, 959-2344; 16746, SNN, 84159, 186609, 213-479; 16747, STC1, 84160, 186610, 285-1028; 16747, STC1, 84161, 186611, 356-892; 16748, STC2, 84163, 186613, 314-473; 16748, STC2, 84164, 186614, 1-370; 16748, STC2, 84162, 186612, 1311-2219; 16749, SND1, 84166, 186616, 1-695; 16749, SND1, 84165, 186615, 195-2927; 16750, STBD1, 84167, 186617, 745-1821; 16751, STARD3NL, 84170, 186620, 217-867; 16751, STARD3NL, 84171, 186621, 343-859; 16751, STARD3NL, 84172, 186622, 240-857; 16751, STARD3NL, 84173, 186623, 232-784; 16751, STARD3NL, 84168, 186618, 258-962; 16751, STARD3NL, 84169, 186619, 185-889; 16752, STARD10, 84175, 186625, 1-509; 16752, STARD10, 84177, 186627, 405-798; 16752, STARD10, 84178, 186628, 883-1620; 16752, STARD10, 84179, 186629, 524-558; 16752, STARD10, 84180, 186630, 286-460; 16752, STARD10, 84181, 186631, 266-511; 16752, STARD10, 84182, 186632, 1-451; 16752, STARD10, 84183, 186633, 172-438; 16752, STARD10, 84184, 186634, 293-1081; 16752, STARD10, 84185, 186635, 267-839; 16752, STARD10, 84186, 186636, 1-364; 16752, STARD10, 84187, 186637, 344-1100; 16752, STARD10, 84188, 186638, 1-426; 16752, STARD10, 84189, 186639, 208-620; 16752, STARD10, 84190, 186640, 281-1360; 16752, STARD10, 84174, 186624, 921-1796; 16752, STARD10, 84176, 186626, 470-1345; 16753, STARD13, 84194, 186644, 218-2037; 16753, STARD13, 84195, 186645, 212-403; 16753, STARD13, 84191, 186641, 58-3375; 16753, STARD13, 84192, 186642, 118-3459; 16753, STARD13, 84193, 186643, 374-3361; 16754, STARD3, 84198, 186648, 86-673; 16754, STARD3, 84200, 186650, 228-560; 16754, STARD3, 84201, 186651, 295-558; 16754, STARD3, 84202, 186652, 236-591; 16754, STARD3, 84203, 186653, 102-571; 16754, STARD3, 84204, 186654, 131-1558; 16754, STARD3, 84205, 186655, 95-579; 16754, STARD3, 84206, 186656, 198-550; 16754, STARD3, 84207, 186657, 1-187; 16754, STARD3, 84208, 186658, 142-930; 16754, STARD3, 84196, 186646, 219-1556; 16754, STARD3, 84197, 186647, 140-1423; 16754, STARD3, 84199, 186649, 143-1480; 16755, STARD4, 84210, 186660, 138-344; 16755, STARD4, 84211, 186661, 161-328; 16755, STARD4, 84212, 186662, 161-328; 16755, STARD4, 84213, 186663, 155-322; 16755, STARD4, 84209, 186659, 136-753; 16755, STARD4, 84214, 186664, 182-799; 16755, STARD4, 84215, 186665, 216-695; 16756, STARD5, 84218, 186668, 43-375; 16756, STARD5, 84216, 186666, 27-668; 16756, STARD5, 84217, 186667, 85-276; 16757, STARD6, 84221, 186671, 238-465; 16757, STARD6, 84222, 186672, 146-373; 16757, STARD6, 84219, 186669, 1-663; 16757, STARD6, 84220, 186670, 375-1037; 16758, STARD7, 84224, 186674, 301-742; 16758, STARD7, 84223, 186673, 385-1497; 16759, STARD8, 84228, 186678, 215-373; 16759, STARD8, 84225, 186675, 373-3444; 16759, STARD8, 84226, 186676, 338-3409; 16759, STARD8, 84227, 186677, 116-3427; 16760, STARD9, 84230, 186680, 1-666; 16760,

STARD9, 84231, 186681, 1-4761; 16760, STARD9, 84229, 186679, 58-14160; 16761, STATH, 84235, 186685, 76-234; 16761, STATH, 84236, 186686, 112-300; 16761, STATH, 84237, 186687, 111-299; 16761, STATH, 84232, 186682, 112-300; 16761, STATH, 84233, 186683, 76-234; 16761, STATH, 84234, 186684, 111-299; 16762, STMN1, 84242, 186692, 409-665; 16762, STMN1, 84238, 186688, 267-716; 16762, STMN1, 84239, 186689, 143-592; 16762, STMN1, 84240, 186690, 365-814; 16762, STMN1, 84241, 186691, 141-590; 16762, STMN1, 84243, 186693, 141-665; 16763, STMN2, 84246, 186696, 72-578; 16763, STMN2, 84244, 186694, 383-922; 16763, STMN2, 84245, 186695, 45-608; 16764, STMND1, 84247, 186697, 330-930; 16764, STMND1, 84248, 186698, 1-831; 16765, STMN3, 84251, 186701, 262-519; 16765, STMN3, 84252, 186702, 1-718; 16765, STMN3, 84253, 186703, 348-605; 16765, STMN3, 84249, 186699, 83-625; 16765, STMN3, 84250, 186700, 209-718; 16766, STMN4, 84258, 186708, 133-909; 16766, STMN4, 84259, 186709, 133-828; 16766, STMN4, 84254, 186704, 138-707; 16766, STMN4, 84255, 186705, 115-765; 16766, STMN4, 84256, 186706, 149-760; 16766, STMN4, 84257, 186707, 66-569; 16767, STAU1, 84263, 186713, 291-1775; 16767, STAU1, 84267, 186717, 257-643; 16767, STAU1, 84268, 186718, 489-1085; 16767, STAU1, 84269, 186719, 36-1517; 16767, STAU1, 84260, 186710, 291-1781; 16767, STAU1, 84261, 186711, 489-1979; 16767, STAU1, 84262, 186712, 366-1856; 16767, STAU1, 84264, 186714, 291-1799; 16767, STAU1, 84265, 186715, 366-1874; 16767, STAU1, 84266, 186716, 412-2145; 16768, STAU2, 84270, 186720, 220-1659; 16768, STAU2, 84271, 186721, 371-1810; 16768, STAU2, 84272, 186722, 283-687; 16768, STAU2, 84273, 186723, 27-1643; 16768, STAU2, 84274, 186724, 378-1253; 16768, STAU2, 84275, 186725, 32-1204; 16768, STAU2, 84276, 186726, 308-685; 16768, STAU2, 84277, 186727, 360-550; 16768, STAU2, 84278, 186728, 165-1361; 16768, STAU2, 84279, 186729, 352-2064; 16768, STAU2, 84280, 186730, 116-727; 16768, STAU2, 84281, 186731, 187-1146; 16768, STAU2, 84282, 186732, 276-1790; 16768, STAU2, 84283, 186733, 258-1733; 16768, STAU2, 84284, 186734, 1-489; 16768, STAU2, 84286, 186736, 79-1614; 16768, STAU2, 84287, 186737, 98-1519; 16768, STAU2, 84285, 186735, 220-537; 16769, SLK, 84288, 186738, 546-4160; 16769, SLK, 84289, 186739, 546-4253; 16770, STRADA, 84290, 186740, 211-915; 16770, STRADA, 84295, 186745, 388-604; 16770, STRADA, 84296, 186746, 533-563; 16770, STRADA, 84297, 186747, 282-803; 16770, STRADA, 84299, 186749, 328-563; 16770, STRADA, 84300, 186750, 390-525; 16770, STRADA, 84301, 186751, 1-396; 16770, STRADA, 84302, 186752, 135-257; 16770, STRADA, 84303, 186753, 432-582; 16770, STRADA, 84304, 186754, 1-167; 16770, STRADA, 84305, 186755, 1-504; 16770, STRADA, 84306, 186756, 1-705; 16770, STRADA, 84291, 186741, 114-1409; 16770, STRADA, 84292, 186742, 233-1354; 16770, STRADA, 84293, 186743, 275-1321; 16770, STRADA, 84294, 186744, 183-1082; 16770, STRADA, 84298, 186748, 101-1045; 16771, STRADB, 84309, 186759, 301-414; 16771, STRADB, 84310, 186760, 191-772; 16771, STRADB, 84311, 186761, 1-268; 16771, STRADB, 84307, 186757, 366-1622; 16771, STRADB, 84308, 186758, 239-1372; 16772, STEAP1B, 84314, 186764, 148-797; 16772, STEAP1B, 84315, 186765, 243-1004; 16772, STEAP1B, 84312, 186762, 417-1445; 16772, STEAP1B, 84313, 186763, 96-833; 16773, STEAP2, 84322, 186772, 149-1360; 16773, STEAP2, 84323, 186773, 358-902; 16773, STEAP2, 84324, 186774, 316-579; 16773, STEAP2, 84316, 186766, 394-1866; 16773, STEAP2, 84317, 186767, 507-1979; 16773, STEAP2, 84318, 186768, 170-1642; 16773, STEAP2, 84319, 186769, 336-1700; 16773, STEAP2, 84320, 186770, 188-1552; 16773, STEAP2, 84321, 186771, 170-1429; 16774, STEAP3, 84328, 186778, 45-1418; 16774, STEAP3, 84325, 186775, 135-1601; 16774, STEAP3, 84326, 186776, 45-1511; 16774, STEAP3, 84327, 186777, 452-1948; 16775, STEAP4, 84331, 186781, 191-1210; 16775, STEAP4, 84329, 186779, 100-951; 16775, STEAP4, 84330, 186780, 103-1482; 16776, SCD, 84332, 186782, 382-1461; 16777, SCD5, 84333, 186783, 236-1006; 16777, SCD5, 84334, 186784, 321-1313; 16778, SLBP, 84335, 186785, 63-896; 16778, SLBP, 84337, 186787, 1-558; 16778, SLBP, 84339, 186789, 130-837; 16778, SLBP, 84340, 186790, 1-677; 16778, SLBP, 84336, 186786, 131-826; 16778, SLBP, 84338, 186788, 368-1180; 16779, STRC, 84341, 186791, 1-359; 16779, STRC, 84342, 186792, 77-1132; 16779, STRC, 84344, 186794, 1-1992; 16779, STRC, 84345, 186795, 77-2986; 16779, STRC, 84346, 186796, 2188-5196; 16779, STRC, 84343, 186793, 79-5406; 16780, SARM1, 84347, 186797, 1-323; 16780, SARM1, 84348, 186798, 1-772; 16780, SARM1, 84349, 186799, 1-355; 16780, SARM1, 84350, 186800, 372-2546; 16781, SAMD1, 84351, 186801, 364-750; 16781, SAMD1, 84352, 186802, 289-1587; 16782, SAMD10, 84354, 186804, 176-493; 16782, SAMD10, 84353, 186803, 176-784; 16783, SAMD11, 84356, 186806, 1-1769; 16783, SAMD11, 84357, 186807, 61-387; 16783, SAMD11, 84358, 186808, 90-626; 16783, SAMD11, 84359, 186809, 1-1625; 16783, SAMD11, 84360, 186810, 81-1118; 16783, SAMD11, 84361, 186811, 81-1046; 16783, SAMD11, 84362, 186812, 81-1751; 16783, SAMD11, 84363, 186813, 81-1886; 16783, SAMD11, 84364, 186814, 81-2129; 16783, SAMD11, 84365, 186815, 81-1940; 16783, SAMD11, 84366, 186816, 81-1802; 16783, SAMD11, 84367, 186817, 81-761; 16783, SAMD11, 84355, 186805, 84-2129; 16784, SAMD12, 84369, 186819, 130-615; 16784, SAMD12, 84370, 186820, 78-284; 16784, SAMD12, 84371, 186821, 1-445; 16784, SAMD12, 84372, 186822, 130-592; 16784, SAMD12, 84373, 186823, 1-507; 16784, SAMD12, 84374, 186824, 1-462; 16784, SAMD12, 84368, 186818, 138-743; 16785, SAMD13, 84381, 186831, 1-153; 16785, SAMD13, 84375, 186825, 73-381; 16785, SAMD13, 84376, 186826, 328-636; 16785, SAMD13, 84377, 186827, 101-409; 16785, SAMD13, 84378, 186828, 60-428; 16785, SAMD13, 84379, 186829, 193-543; 16785, SAMD13, 84380, 186830, 229-537; 16786, SAMD14, 84382, 186832, 1-1290; 16786, SAMD14, 84384, 186834, 521-560; 16786, SAMD14, 84383, 186833, 319-1572; 16786, SAMD14, 84385, 186835, 379-1716; 16787, SAMD15, 84387, 186837, 122-388; 16787, SAMD15, 84386, 186836, 287-2311; 16788, SAMD3, 84393, 186843, 49-545; 16788, SAMD3, 84394, 186844, 73-592; 16788, SAMD3, 84395, 186845, 1-233; 16788, SAMD3, 84396, 186846, 131-958; 16788, SAMD3, 84397, 186847, 49-679; 16788, SAMD3, 84398, 186848, 18-131; 16788, SAMD3, 84388, 186838, 18-683; 16788, SAMD3, 84389, 186839, 610-2172; 16788, SAMD3, 84390, 186840, 327-1889; 16788, SAMD3, 84391, 186841, 41-1675; 16788, SAMD3, 84392, 186842, 329-1891; 16789, SAMD4A, 84401, 186851, 117-1154; 16789, SAMD4A, 84403, 186853, 1269-2306; 16789, SAMD4A, 84399, 186849, 306-2198; 16789, SAMD4A, 84400, 186850, 306-2462; 16789, SAMD4A, 84402, 186852, 664-2820; 16790, SAMD4B, 84405, 186855, 1-283; 16790, SAMD4B, 84406, 186856, 448-672; 16790, SAMD4B, 84407, 186857, 269-925; 16790, SAMD4B, 84408, 186858, 341-2419; 16790, SAMD4B, 84409, 186859, 1-144; 16790, SAMD4B, 84410, 186860, 79-1056; 16790, SAMD4B, 84411, 186861, 284-2275; 16790, SAMD4B, 84412, 186862, 212-2203; 16790, SAMD4B, 84404, 186854, 1036-3120; 16790, SAMD4B, 84413, 186863, 212-2296; 16791, SAMD5, 84415, 186865, 1-294; 16791, SAMD5, 84414, 186864, 3-524; 16792, SAMD7, 84418, 186868, 73-369; 16792, SAMD7, 84416, 186866, 367-1707; 16792, SAMD7, 84417, 186867, 390-1730; 16793, SAMD8, 84420, 186870, 79-1515; 16793, SAMD8, 84421, 186871, 159-919; 16793, SAMD8, 84419, 186869, 86-1066; 16793, SAMD8, 84422, 186872, 104-1351; 16794, SAMD9, 84424, 186874, 109-3957; 16794, SAMD9, 84423, 186873, 271-5040; 16794, SAMD9, 84425, 186875, 170-4939; 16795, SAMD9L, 84427, 186877, 423-631; 16795, SAMD9L, 84428, 186878, 555-763; 16795, SAMD9L, 84429, 186879, 173-381; 16795, SAMD9L, 84432, 186882, 990-1198; 16795, SAMD9L, 84426, 186876, 1218-5972; 16795, SAMD9L, 84430, 186880, 623-5377; 16795, SAMD9L, 84431, 186881, 819-5573; 16795, SAMD9L, 84433, 186883, 1-1221; 16796, SRD5A3, 84435, 186885, 1-549; 16796, SRD5A3, 84434, 186884, 229-1185; 16797, SRA1, 84437, 186887, 1-226; 16797, SRA1, 84436, 186886, 823-1533; 16798, STS, 84438, 186888, 221-1972; 16799, SRD5A1, 84440, 186890, 151-558; 16799, SRD5A1, 84441, 186891, 151-531; 16799, SRD5A1, 84439, 186889, 235-1014; 16800, SRD5A2, 84442, 186892, 168-932; 16801, STAR, 84444, 186894, 1-748; 16801, STAR, 84445, 186895, 258-402; 16801, STAR, 84443, 186893, 448-1305; 16802, SCP2, 84453, 186903, 1-720; 16802, SCP2, 84454, 186904, 1-235; 16802, SCP2, 84456, 186906, 121-1221; 16802, SCP2, 84458, 186908, 1-97; 16802, SCP2, 84459, 186909, 1-421; 16802, SCP2, 84446, 186896, 112-1623; 16802, SCP2, 84447, 186897, 80-1048; 16802, SCP2, 84448, 186898, 169-1812; 16802, SCP2, 84449, 186899, 112-1683; 16802, SCP2, 84450, 186900, 84-263; 16802, SCP2, 84451, 186901, 54-485; 16802, SCP2, 84452, 186902, 94-516; 16802, SCP2, 84455, 186905, 297-1697; 16802, SCP2, 84457, 186907, 48-227; 16803, SOAT1, 84461, 186911, 91-870; 16803, SOAT1, 84460, 186910, 144-1796; 16803, SOAT1, 84462, 186912, 301-1758; 16803, SOAT1, 84463, 186913, 347-1825; 16804, SOAT2, 84466, 186916, 61-570; 16804, SOAT2, 84464, 186914, 61-1629; 16804, SOAT2, 84465, 186915, 48-980; 16805, SREBF1, 84469, 186919, 1379-2029; 16805, SREBF1, 84470, 186920, 466-3147; 16805, SREBF1, 84471, 186921, 83-1058; 16805, SREBF1, 84472, 186922, 339-536; 16805, SREBF1, 84473, 186923, 1-492; 16805, SREBF1, 84474, 186924, 1-95; 16805, SREBF1, 84475, 186925, 1-473; 16805, SREBF1, 84476, 186926, 1-333; 16805, SREBF1, 84477, 186927, 1-340; 16805, SREBF1, 84467, 186917, 186-3629; 16805, SREBF1, 84468, 186918, 171-3704; 16806, SREBF2, 84479, 186929, 108-2162; 16806, SREBF2, 84480, 186930, 1-770; 16806, SREBF2, 84481, 186931, 283-2247; 16806, SREBF2, 84478, 186928, 167-3592; 16807, SCSD, 84484, 186934, 57-743; 16807, SCSD, 84485, 186935, 57-589; 16807, SCSD, 84482, 186932, 375-1274; 16807, SCSD, 84483, 186933, 238-1137; 16808, STRA13, 84489, 186939, 1-228; 16808, STRA13, 84490, 186940, 1-199; 16808, STRA13, 84491, 186941, 19-414; 16808, STRA13, 84486, 186936, 58-249; 16808, STRA13, 84487, 186937, 58-303; 16808, STRA13, 84488, 186938, 32-208; 16809, STRA6, 84494, 186944, 157-2136; 16809, STRA6, 84500, 186950, 184-449; 16809, STRA6, 84501, 186951, 70-333; 16809, STRA6, 84503, 186953, 1-797; 16809, STRA6, 84504, 186954, 106-1539; 16809, STRA6, 84492, 186942, 247-2250; 16809, STRA6, 84493, 186943, 183-2186; 16809, STRA6, 84495, 186945, 195-674; 16809, STRA6, 84496, 186946, 115-2118; 16809, STRA6, 84497, 186947, 186-2162; 16809, STRA6, 84498, 186948, 252-2366; 16809, STRA6, 84499, 186949, 340-2460; 16809, STRA6, 84502, 186952, 329-2377; 16809, STRA6, 84505, 186955, 229-2232; 16810, STRA8, 84506, 186956, 1-993; 16811, SCRG1, 84508, 186958, 869-1147; 16811, SCRG1, 84507, 186957, 484-780; 16812, STUB1, 84510, 186960, 103-743; 16812, STUB1, 84512, 186962, 1-472; 16812, STUB1, 84514, 186964, 1-557; 16812, STUB1, 84515, 186965, 1-74; 16812, STUB1, 84509, 186959, 251-1162; 16812, STUB1, 84511, 186961, 173-868; 16812, STUB1, 84513, 186963, 608-1303; 16813, STOM, 84518, 186968, 118-624; 16813, STOM, 84516, 186966, 19-885; 16813, STOM, 84517, 186967, 67-438; 16814, STOML1, 84523, 186973, 265-539; 16814, STOML1, 84524, 186974, 202-614; 16814, STOML1, 84526, 186976, 201-1133; 16814, STOML1, 84527, 186977, 235-512; 16814, STOML1, 84519, 186969, 383-1450; 16814, STOML1, 84520, 186970, 126-1172; 16814, STOML1, 84521, 186971, 1-984; 16814, STOML1, 84522, 186972, 126-1322; 16814, STOML1, 84525, 186975, 75-1118; 16815, STOML2, 84530, 186980, 57-362; 16815, STOML2, 84531, 186981, 102-1034; 16815, STOML2, 84528, 186978, 64-1134; 16815, STOML2, 84529, 186979, 102-1037; 16816, STOML3, 84532, 186982, 346-1221; 16816, STOML3, 84533, 186983, 250-1098; 16817, STON1-GTF2A1L, 84534, 186984, 28-3435; 16817, STON1-GTF2A1L, 84535, 186985, 115-3663; 16817, STON1-GTF2A1L, 84536, 186986, 112-3660; 16817, STON1-GTF2A1L, 84537, 186987, 112-3588; 16818, STON1, 84540, 186990, 1-282; 16818, STON1, 84538, 186988, 196-2403; 16818, STON1, 84539, 186989, 94-2301; 16819, STON2, 84542, 186992, 1-320; 16819, STON2, 84544, 186994, 455-603; 16819, STON2, 84545, 186995, 430-439; 16819, STON2, 84541, 186991, 202-2919; 16819, STON2, 84543, 186993, 414-3176; 16819, STON2, 84546, 186996, 202-2964; 16820, SARAF, 84548, 186998, 1-655; 16820, SARAF, 84549, 186999, 116-226; 16820, SARAF, 84550, 187000, 1-642; 16820, SARAF, 84551, 187001, 126-566; 16820, SARAF, 84552, 187002, 205-318; 16820, SARAF, 84553, 187003, 1-1043; 16820, SARAF, 84554, 187004, 202-808; 16820, SARAF, 84555, 187005, 17-130; 16820, SARAF, 84556, 187006, 176-298; 16820, SARAF, 84547, 186997, 259-1278; 16820, SARAF, 84557, 187007, 597-1100; 16821, STOX1, 84558, 187008, 84-3053; 16821, STOX1, 84559, 187009, 1-510; 16821, STOX1, 84560, 187010, 1-684; 16821, STOX1, 84561, 187011, 84-3053; 16822, STOX2, 84563, 187013, 1-224; 16822, STOX2, 84564, 187014, 53-518; 16822, STOX2, 84565, 187015, 1-658; 16822, STOX2, 84562, 187012, 1436-4216; 16823, SFN, 84566, 187016, 76-822; 16824, SBNO1, 84567, 187017, 144-4322; 16824, SBNO1, 84568, 187018, 1-4182; 16824, SBNO1, 84569, 187019, 129-4310; 16825, SBNO2, 84572, 187022, 178-561; 16825, SBNO2, 84573, 187023, 580-914; 16825, SBNO2, 84574, 187024, 212-4282; 16825, SBNO2, 84575, 187025, 178-562; 16825, SBNO2, 84578, 187028, 127-461; 16825, SBNO2, 84579, 187029, 127-510; 16825, SBNO2, 84580, 187030, 127-4197; 16825, SBNO2, 84582, 187032, 178-562; 16825, SBNO2, 84570, 187020, 239-4339; 16825, SBNO2, 84571, 187021, 25-3954; 16825, SBNO2, 84576, 187026, 1-4101; 16825, SBNO2, 84577, 187027, 25-3954; 16825, SBNO2, 84581, 187031, 127-4227; 16826, SERP1, 84584, 187034, 365-601; 16826, SERP1, 84585, 187035, 367-534; 16826, SERP1, 84583, 187033, 507-707; 16826, SERP1, 84586, 187036, 1274-1474; 16827, SERP2, 84588, 187038, 121-360; 16827,

SERP2, 84589, 187039, 145-399; 16827, SERP2, 84590, 187040, 1-126; 16827, SERP2, 84587, 187037, 185-382; 16828, STIP1, 84593, 187043, 78-494; 16828, STIP1, 84594, 187044, 38-748; 16828, STIP1, 84595, 187045, 1-414; 16828, STIP1, 84591, 187041, 148-1779; 16828, STIP1, 84592, 187042, 554-2326; 16828, STIP1, 84596, 187046, 59-1618; 16829, STRIP1, 84597, 187047, 23-2536; 16829, STRIP1, 84598, 187048, 170-2398; 16829, STRIP1, 84599, 187049, 7-645; 16830, STRIP2, 84600, 187050, 41-2545; 16830, STRIP2, 84601, 187051, 28-2304; 16831, STRN, 84602, 187052, 10-2352; 16831, STRN, 84603, 187053, 9-2204; 16832, STRN3, 84606, 187056, 135-1133; 16832, STRN3, 84607, 187057, 231-567; 16832, STRN3, 84608, 187058, 1-514; 16832, STRN3, 84609, 187059, 1-417; 16832, STRN3, 84604, 187054, 217-2358; 16832, STRN3, 84605, 187055, 198-2591; 16833, STRN4, 84612, 187062, 370-2274; 16833, STRN4, 84613, 187063, 342-560; 16833, STRN4, 84614, 187064, 227-570; 16833, STRN4, 84615, 187065, 1-951; 16833, STRN4, 84616, 187066, 258-675; 16833, STRN4, 84617, 187067, 1-542; 16833, STRN4, 84618, 187068, 274-582; 16833, STRN4, 84619, 187069, 1-595; 16833, STRN4, 84620, 187070, 1-950; 16833, STRN4, 84610, 187060, 51-2312; 16833, STRN4, 84611, 187061, 452-2734; 16833, STRN4, 84621, 187071, 298-1071; 16834, STAG1, 84624, 187074, 971-3967; 16834, STAG1, 84625, 187075, 267-752; 16834, STAG1, 84626, 187076, 268-573; 16834, STAG1, 84627, 187077, 1-570; 16834, STAG1, 84628, 187078, 256-954; 16834, STAG1, 84629, 187079, 262-747; 16834, STAG1, 84622, 187072, 268-3933; 16834, STAG1, 84623, 187073, 258-4034; 16835, STAG2, 84635, 187085, 175-385; 16835, STAG2, 84636, 187086, 330-676; 16835, STAG2, 84637, 187087, 176-798; 16835, STAG2, 84638, 187088, 446-2089; 16835, STAG2, 84639, 187089, 216-392; 16835, STAG2, 84640, 187090, 177-296; 16835, STAG2, 84641, 187091, 281-742; 16835, STAG2, 84642, 187092, 172-678; 16835, STAG2, 84630, 187080, 511-4317; 16835, STAG2, 84631, 187081, 281-3976; 16835, STAG2, 84632, 187082, 282-4088; 16835, STAG2, 84633, 187083, 237-3932; 16835, STAG2, 84634, 187084, 291-3986; 16836, STAG3, 84645, 187095, 1-519; 16836, STAG3, 84646, 187096, 1-555; 16836, STAG3, 84647, 187097, 135-699; 16836, STAG3, 84649, 187099, 199-534; 16836, STAG3, 84650, 187100, 172-605; 16836, STAG3, 84651, 187101, 328-4008; 16836, STAG3, 84643, 187093, 155-3832; 16836, STAG3, 84644, 187094, 295-3798; 16836, STAG3, 84648, 187098, 408-4085; 16836, STAG3, 84652, 187102, 328-3831; 16837, SDF4, 84655, 187105, 1-728; 16837, SDF4, 84656, 187106, 294-1058; 16837, SDF4, 84653, 187103, 294-1340; 16837, SDF4, 84654, 187104, 264-1352; 16838, SDF2, 84658, 187108, 1-151; 16838, SDF2, 84659, 187109, 1-315; 16838, SDF2, 84657, 187107, 300-935; 16839, SDF2L1, 84660, 187110, 77-742; 16840, STIM1, 84662, 187112, 336-583; 16840, STIM1, 84663, 187113, 311-552; 16840, STIM1, 84664, 187114, 294-625; 16840, STIM1, 84665, 187115, 231-581; 16840, STIM1, 84666, 187116, 466-668; 16840, STIM1, 84667, 187117, 1-1214; 16840, STIM1, 84668, 187118, 163-580; 16840, STIM1, 84669, 187119, 253-415; 16840, STIM1, 84670, 187120, 214-1752; 16840, STIM1, 84671, 187121, 127-524; 16840, STIM1, 84673, 187123, 569-2944; 16840, STIM1, 84661, 187111, 570-2627; 16840, STIM1, 84672, 187122, 90-1712; 16841, STIM2, 84674, 187124, 379-2643; 16841, STIM2, 84676, 187126, 426-2225; 16841, STIM2, 84677, 187127, 1-666; 16841, STIM2, 84678, 187128, 1-1044; 16841, STIM2, 84679, 187129, 429-1072; 16841, STIM2, 84680, 187130, 249-726; 16841, STIM2, 84681, 187131, 322-583; 16841, STIM2, 84675, 187125, 529-2769; 16842, SMC1A, 84683, 187133, 341-3976; 16842, SMC1A, 84684, 187134, 81-868; 16842, SMC1A, 84685, 187135, 1-838; 16842, SMC1A, 84686, 187136, 70-234; 16842, SMC1A, 84682, 187132, 129-3830; 16843, SMC1B, 84687, 187137, 1-3708; 16843, SMC1B, 84688, 187138, 53-3538; 16844, SMC2, 84692, 187142, 271-705; 16844, SMC2, 84693, 187143, 84-584; 16844, SMC2, 84689, 187139, 305-3898; 16844, SMC2, 84690, 187140, 337-3930; 16844, SMC2, 84691, 187141, 214-3807; 16845, SMC3, 84694, 187144, 127-3780; 16846, SMC4, 84697, 187147, 159-629; 16846, SMC4, 84698, 187148, 106-3897; 16846, SMC4, 84699, 187149, 165-582; 16846, SMC4, 84700, 187150, 105-257; 16846, SMC4, 84701, 187151, 190-708; 16846, SMC4, 84702, 187152, 340-849; 16846, SMC4, 84703, 187153, 210-566; 16846, SMC4, 84704, 187154, 284-1553; 16846, SMC4, 84705, 187155, 65-583; 16846, SMC4, 84707, 187157, 281-821; 16846, SMC4, 84695, 187145, 346-4212; 16846, SMC4, 84696, 187146, 452-4318; 16846, SMC4, 84706, 187156, 1160-4852; 16847, SMC5, 84708, 187158, 118-3423; 16848, SMC6, 84710, 187160, 467-1803; 16848, SMC6, 84713, 187163, 241-2460; 16848, SMC6, 84714, 187164, 1-69; 16848, SMC6, 84715, 187165, 374-544; 16848, SMC6, 84716, 187166, 273-500; 16848, SMC6, 84709, 187159, 211-3486; 16848, SMC6, 84711, 187161, 402-3677; 16848, SMC6, 84712, 187162, 271-3546; 16849, SMCHD1, 84718, 187168, 1-148; 16849, SMCHD1, 84719, 187169, 1-146; 16849, SMCHD1, 84720, 187170, 1-4167; 16849, SMCHD1, 84721, 187171, 1-452; 16849, SMCHD1, 84717, 187167, 339-6356; 16850, SSRP1, 84723, 187173, 430-948; 16850, SSRP1, 84724, 187174, 382-648; 16850, SSRP1, 84725, 187175, 1-675; 16850, SSRP1, 84722, 187172, 268-2397; 16851, STT3A, 84728, 187178, 190-542; 16851, STT3A, 84729, 187179, 300-607; 16851, STT3A, 84730, 187180, 1-582; 16851, STT3A, 84731, 187181, 212-569; 16851, STT3A, 84726, 187176, 160-2277; 16851, STT3A, 84727, 187177, 241-2082; 16851, STT3A, 84732, 187182, 207-2324; 16852, STT3B, 84733, 187183, 210-2690; 16853, STX16-NPEPL1, 84734, 187184, 574-1722; 16854, SUB1, 84738, 187188, 69-323; 16854, SUB1, 84739, 187189, 384-580; 16854, SUB1, 84735, 187185, 129-512; 16854, SUB1, 84736, 187186, 286-669; 16854, SUB1, 84737, 187187, 185-568; 16854, SUB1, 84740, 187190, 190-573; 16854, SUB1, 84741, 187191, 113-496; 16855, SMR3A, 84742, 187192, 97-501; 16856, SMR3B, 84743, 187193, 150-389; 16856, SMR3B, 84744, 187194, 192-431; 16856, SMR3B, 84745, 187195, 150-389; 16857, SDHAF1, 84746, 187196, 77-424; 16858, SDHAF2, 84748, 187198, 23-412; 16858, SDHAF2, 84749, 187199, 106-303; 16858, SDHAF2, 84750, 187200, 4-270; 16858, SDHAF2, 84751, 187201, 43-129; 16858, SDHAF2, 84752, 187202, 23-424; 16858, SDHAF2, 84753, 187203, 24-449; 16858, SDHAF2, 84754, 187204, 17-214; 16858, SDHAF2, 84747, 187197, 75-575; 16859, SDHAF3, 84755, 187205, 2-208; 16859, SDHAF3, 84756, 187206, 1135-1512; 16860, SDHAF4, 84757, 187207, 25-351; 16861, SDHA, 84759, 187209, 1-306; 16861, SDHA, 84760, 187210, 1-380; 16861, SDHA, 84761, 187211, 30-299; 16861, SDHA, 84762, 187212, 54-1805; 16861, SDHA, 84764, 187214, 116-1675; 16861, SDHA, 84758, 187208, 116-2110; 16861, SDHA, 84763, 187213, 39-1889; 16862, SDHB, 84766, 187216, 50-649; 16862, SDHB, 84767, 187217, 334-702; 16862, SDHB, 84765, 187215, 152-994; 16863, SDHC, 84773, 187223, 16-219; 16863, SDHC, 84774, 187224, 1-97; 16863, SDHC, 84768, 187218, 26-478; 16863, SDHC, 84769, 187219, 150-659; 16863, SDHC, 84770, 187220, 19-369; 16863, SDHC, 84771, 187221, 25-432; 16863, SDHC, 84772, 187222, 19-369; 16864, SDHD, 84777, 187227, 36-350; 16864, SDHD, 84778, 187228, 1-305; 16864, SDHD, 84779, 187229, 1-167; 16864, SDHD, 84780, 187230, 37-432; 16864, SDHD, 84775, 187225, 136-615; 16864, SDHD, 84776, 187226, 10-441; 16864, SDHD, 84781, 187231, 36-293; 16864, SDHD, 84782, 187232, 10-372; 16864, SDHD, 84783, 187233, 85-516; 16865, SUCNR1, 84784, 187234, 106-1110; 16866, SUCLA2, 84786, 187236, 1-894; 16866, SUCLA2, 84787, 187237, 5-467; 16866, SUCLA2, 84788, 187238, 5-580; 16866, SUCLA2, 84789, 187239, 1-243; 16866, SUCLA2, 84790, 187240, 1-411; 16866, SUCLA2, 84791, 187241, 1-314; 16866, SUCLA2, 84785, 187235, 86-1477; 16867, SUCLG1, 84793, 187243, 1-316; 16867, SUCLG1, 84792, 187242, 212-1252; 16868, SUCLG2, 84795, 187245, 1-571; 16868, SUCLG2, 84796, 187246, 22-1161; 16868, SUCLG2, 84794, 187244, 29-1327; 16868, SUCLG2, 84797, 187247, 25-1347; 16869, SUGCT, 84800, 187250, 1-1265; 16869, SUGCT, 84801, 187251, 1-539; 16869, SUGCT, 84802, 187252, 1-149; 16869, SUGCT, 84798, 187248, 24-1361; 16869, SUGCT, 84799, 187249, 24-1217; 16869, SUGCT, 84803, 187253, 24-1439; 16870, SI, 84805, 187255, 64-204; 16870, SI, 84804, 187254, 64-5547; 16871, SULF1, 84810, 187260, 425-593; 16871, SULF1, 84811, 187261, 115-630; 16871, SULF1, 84812, 187262, 332-585; 16871, SULF1, 84813, 187263, 1-394; 16871, SULF1, 84814, 187264, 718-806; 16871, SULF1, 84815, 187265, 231-460; 16871, SULF1, 84816, 187266, 1372-3381; 16871, SULF1, 84806, 187256, 718-3333; 16871, SULF1, 84807, 187257, 756-3371; 16871, SULF1, 84808, 187258, 562-3177; 16871, SULF1, 84809, 187259, 556-3171; 16872, SULF2, 84818, 187268, 248-814; 16872, SULF2, 84819, 187269, 1-623; 16872, SULF2, 84817, 187267, 853-3465; 16872, SULF2, 84820, 187270, 670-3282; 16872, SULF2, 84821, 187271, 608-3211; 16873, SUMF1, 84825, 187275, 17-1297; 16873, SUMF1, 84826, 187276, 25-753; 16873, SUMF1, 84822, 187272, 37-1161; 16873, SUMF1, 84823, 187273, 20-1069; 16873, SUMF1, 84824, 187274, 29-1093; 16874, SUMF2, 84828, 187278, 1-1077; 16874, SUMF2, 84829, 187279, 2-712; 16874, SUMF2, 84830, 187280, 254-1171; 16874, SUMF2, 84831, 187281, 5-457; 16874, SUMF2, 84832, 187282, 3-554; 16874, SUMF2, 84833, 187283, 32-994; 16874, SUMF2, 84834, 187284, 24-1082; 16874, SUMF2, 84835, 187285, 12-509; 16874, SUMF2, 84836, 187286, 36-344; 16874, SUMF2, 84837, 187287, 1-912; 16874, SUMF2, 84838, 187288, 1-881; 16874, SUMF2, 84839, 187289, 48-203; 16874, SUMF2, 84840, 187290, 29-727; 16874, SUMF2, 84827, 187277, 196-837; 16875, SQRDL, 84842, 187292, 1-545; 16875, SQRDL, 84843, 187293, 1-373; 16875, SQRDL, 84845, 187295, 192-613; 16875, SQRDL, 84846, 187296, 454-567; 16875, SQRDL, 84847, 187297, 309-527; 16875, SQRDL, 84848, 187298, 146-569; 16875, SQRDL, 84841, 187291, 387-1739; 16875, SQRDL, 84844, 187294, 190-1542; 16876, SRXN1, 84849, 187299, 186-599; 16877, SUOX, 84854, 187304, 429-556; 16877, SUOX, 84855, 187305, 120-434; 16877, SUOX, 84856, 187306, 468-952; 16877, SUOX, 84857, 187307, 181-543; 16877, SUOX, 84850, 187300, 229-1866; 16877, SUOX, 84851, 187301, 171-1808; 16877, SUOX, 84852, 187302, 725-2362; 16877, SUOX, 84853, 187303, 298-1935; 16877, SUOX, 84858, 187308, 217-1854; 16877, SUOX, 84859, 187309, 9-1646; 16878, SULT1E1, 84861, 187311, 1-383; 16878, SULT1E1, 84860, 187310, 114-998; 16879, SULT4A1, 84864, 187314, 25-252; 16879, SULT4A1, 84862, 187312, 122-976; 16879, SULT4A1, 84863, 187313, 89-871; 16880, SULT1A1, 84869, 187319, 56-226; 16880, SULT1A1, 84870, 187320, 107-615; 16880, SULT1A1, 84871, 187321, 357-527; 16880, SULT1A1, 84872, 187322, 96-939; 16880, SULT1A1, 84873, 187323, 429-686; 16880, SULT1A1, 84865, 187315, 82-969; 16880, SULT1A1, 84866, 187316, 390-1043; 16880, SULT1A1, 84867, 187317, 275-1162; 16880, SULT1A1, 84868, 187318, 760-1647; 16880, SULT1A1, 84874, 187324, 66-953; 16881, SULT1A2, 84877, 187327, 445-1110; 16881, SULT1A2, 84878, 187328, 1118-1906; 16881, SULT1A2, 84879, 187329, 198-773; 16881, SULT1A2, 84875, 187325, 118-1005; 16881, SULT1A2, 84876, 187326, 352-1239; 16882, SULT1A3, 84883, 187333, 1-405; 16882, SULT1A3, 84884, 187334, 1-152; 16882, SULT1A3, 84880, 187330, 102-989; 16882, SULT1A3, 84881, 187331, 49-936; 16882, SULT1A3, 84882, 187332, 1-906; 16883, SULT1A4, 84886, 187336, 5-268; 16883, SULT1A4, 84887, 187337, 1-906; 16883, SULT1A4, 84888, 187338, 1-152; 16883, SULT1A4, 84885, 187335, 102-989; 16884, SULT1B1, 84890, 187340, 228-694; 16884, SULT1B1, 84891, 187341, 353-572; 16884, SULT1B1, 84889, 187339, 299-1189; 16885, SULT1C2, 84894, 187344, 178-957; 16885, SULT1C2, 84895, 187345, 1-679; 16885, SULT1C2, 84896, 187346, 178-1110; 16885, SULT1C2, 84897, 187347, 187-576; 16885, SULT1C2, 84898, 187348, 1-349; 16885, SULT1C2, 84892, 187342, 454-1344; 16885, SULT1C2, 84893, 187343, 454-1377; 16886, SULT1C3, 84899, 187349, 1-915; 16887, SULT1C4, 84900, 187350, 327-1235; 16887, SULT1C4, 84901, 187351, 154-837; 16888, SULT2A1, 84902, 187352, 141-998; 16889, SULT2B1, 84903, 187353, 179-1276; 16889, SULT2B1, 84904, 187354, 376-1428; 16890, SULT6B1, 84905, 187355, 105-902; 16890, SULT6B1, 84906, 187356, 113-162; 16890, SULT6B1, 84907, 187357, 85-134; 16890, SULT6B1, 84908, 187358, 174-223; 16890, SULT6B1, 84909, 187359, 1-912; 16891, SENP8, 84912, 187362, 330-550; 16891, SENP8, 84913, 187363, 488-599; 16891, SENP8, 84914, 187364, 312-703; 16891, SENP8, 84910, 187360, 217-855; 16891, SENP8, 84911, 187361, 334-972; 16892, SAE1, 84916, 187366, 73-972; 16892, SAE1, 84919, 187369, 129-744; 16892, SAE1, 84920, 187370, 172-570; 16892, SAE1, 84921, 187371, 271-483; 16892, SAE1, 84922, 187372, 94-891; 16892, SAE1, 84923, 187373, 253-723; 16892, SAE1, 84924, 187374, 415-709; 16892, SAE1, 84925, 187375, 43-195; 16892, SAE1, 84915, 187365, 69-1109; 16892, SAE1, 84917, 187367, 103-1002; 16892, SAE1, 84918, 187368, 37-837; 16893, SENP1, 84928, 187378, 478-870; 16893, SENP1, 84929, 187379, 136-562; 16893, SENP1, 84926, 187376, 397-2331; 16893, SENP1, 84927, 187377, 326-2260; 16893, SENP1, 84930, 187380, 1-1932; 16894, SENP5, 84933, 187383, 147-884; 16894, SENP5, 84934, 187384, 1-296; 16894, SENP5, 84935, 187385, 1-233; 16894, SENP5, 84931, 187381, 250-2517; 16894, SENP5, 84932, 187382, 250-2379; 16895, SENP6, 84936, 187386, 599-2656; 16895, SENP6, 84938, 187388, 1-1749; 16895, SENP6, 84940, 187390, 1-1166; 16895, SENP6, 84941, 187391, 302-526; 16895, SENP6, 84942, 187392, 354-1013; 16895, SENP6, 84937, 187387, 1017-4334; 16895, SENP6, 84939, 187389, 479-3817; 16896, SENP7, 84947, 187397, 76-3033; 16896, SENP7, 84949, 187399, 1-152; 16896, SENP7, 84943, 187393, 112-3066; 16896, SENP7, 84944, 187394, 143-3196; 16896, SENP7, 84945, 187395, 364-1080; 16896, SENP7, 84946, 187396, 104-2764; 16896, SENP7, 84948, 187398, 55-3207; 16897, SENP2, 84951, 187401, 120-434; 16897, SENP2, 84952, 187402, 120-302; 16897, SENP2, 84953, 187403, 174-491; 16897, SENP2, 84954, 187404, 60-878; 16897, SENP2, 84955, 187405, 1-610; 16897, SENP2, 84956, 187406, 117-281;

16897, SENP2, 84950, 187400, 241-2010; 16898, SENP3, 84959, 187409, 1-249; 16898, SENP3, 84960, 187410, 1-714; 16898, SENP3, 84961, 187411, 1-333; 16898, SENP3, 84962, 187412, 1-534; 16898, SENP3, 84963, 187413, 1-190; 16898, SENP3, 84957, 187407, 401-2125; 16898, SENP3, 84958, 187408, 50-1774; 16899, SIMC1, 84968, 187418, 19-2694; 16899, SIMC1, 84964, 187414, 346-1347; 16899, SIMC1, 84965, 187415, 143-1516; 16899, SIMC1, 84966, 187416, 408-3026; 16899, SIMC1, 84967, 187417, 143-1516; 16900, SUCO, 84971, 187421, 254-2905; 16900, SUCO, 84973, 187423, 1848-3923; 16900, SUCO, 84969, 187419, 220-3984; 16900, SUCO, 84970, 187420, 125-4342; 16900, SUCO, 84972, 187422, 1-4218; 16901, SKIV2L2, 84975, 187425, 1-265; 16901, SKIV2L2, 84976, 187426, 14-283; 16901, SKIV2L2, 84977, 187427, 1-217; 16901, SKIV2L2, 84974, 187424, 255-3383; 16902, SOD1, 84979, 187429, 105-512; 16902, SOD1, 84978, 187428, 149-613; 16903, SOD2, 84980, 187430, 112-663; 16903, SOD2, 84981, 187431, 62-613; 16903, SOD2, 84982, 187432, 68-736; 16903, SOD2, 84983, 187433, 341-523; 16903, SOD2, 84984, 187434, 75-563; 16903, SOD2, 84985, 187435, 78-500; 16903, SOD2, 84986, 187436, 173-507; 16903, SOD2, 84987, 187437, 75-500; 16903, SOD2, 84988, 187438, 1-571; 16903, SOD2, 84990, 187440, 2-551; 16903, SOD2, 84991, 187441, 162-830; 16903, SOD2, 84989, 187439, 1829-2359; 16904, SOD3, 84993, 187443, 115-276; 16904, SOD3, 84992, 187442, 206-928; 16905, SVIL, 84997, 187447, 1-2889; 16905, SVIL, 84994, 187444, 754-7398; 16905, SVIL, 84995, 187445, 754-7302; 16905, SVIL, 84996, 187446, 454-5820; 16906, ST13, 84999, 187449, 63-549; 16906, ST13, 85000, 187450, 77-193; 16906, ST13, 85001, 187451, 1-439; 16906, ST13, 85002, 187452, 26-661; 16906, ST13, 85003, 187453, 420-1184; 16906, ST13, 84998, 187448, 483-1592; 16907, ST14, 85004, 187454, 419-2986; 16908, ST18, 85006, 187456, 592-629; 16908, ST18, 85007, 187457, 718-2579; 16908, ST18, 85008, 187458, 78-203; 16908, ST18, 85009, 187459, 77-361; 16908, ST18, 85010, 187460, 78-1172; 16908, ST18, 85005, 187455, 685-3828; 16909, ST5, 85013, 187463, 515-887; 16909, ST5, 85014, 187464, 12-560; 16909, ST5, 85015, 187465, 82-547; 16909, ST5, 85016, 187466, 150-595; 16909, ST5, 85017, 187467, 402-940; 16909, ST5, 85018, 187468, 239-573; 16909, ST5, 85019, 187469, 347-631; 16909, ST5, 85020, 187470, 182-588; 16909, ST5, 85021, 187471, 197-564; 16909, ST5, 85023, 187473, 333-751; 16909, ST5, 85024, 187474, 1-334; 16909, ST5, 85025, 187475, 461-580; 16909, ST5, 85026, 187476, 98-523; 16909, ST5, 85027, 187477, 169-1155; 16909, ST5, 85029, 187479, 276-1309; 16909, ST5, 85030, 187480, 99-560; 16909, ST5, 85031, 187481, 4-1074; 16909, ST5, 85032, 187482, 1-438; 16909, ST5, 85033, 187483, 454-822; 16909, ST5, 85034, 187484, 159-571; 16909, ST5, 85035, 187485, 335-556; 16909, ST5, 85036, 187486, 206-638; 16909, ST5, 85037, 187487, 1-296; 16909, ST5, 85039, 187489, 417-576; 16909, ST5, 85040, 187490, 265-514; 16909, ST5, 85041, 187491, 356-583; 16909, ST5, 85042, 187492, 394-550; 16909, ST5, 85043, 187493, 419-590; 16909, ST5, 85044, 187494, 220-299; 16909, ST5, 85045, 187495, 570-659; 16909, ST5, 85046, 187496, 272-502; 16909, ST5, 85047, 187497, 313-534; 16909, ST5, 85048, 187498, 343-559; 16909, ST5, 85050, 187500, 104-2056; 16909, ST5, 85051, 187501, 460-600; 16909, ST5, 85052, 187502, 210-862; 16909, ST5, 85053, 187503, 1-1071; 16909, ST5, 85011, 187461, 350-3763; 16909, ST5, 85012, 187462, 161-3574; 16909, ST5, 85022, 187472, 824-2653; 16909, ST5, 85028, 187478, 387-3800; 16909, ST5, 85038, 187488, 121-2274; 16909, ST5, 85049, 187499, 526-2679; 16910, ST7, 85055, 187505, 163-1896; 16910, ST7, 85057, 187507, 332-1867; 16910, ST7, 85058, 187508, 304-1875; 16910, ST7, 85059, 187509, 332-1936; 16910, ST7, 85060, 187510, 163-1881; 16910, ST7, 85062, 187512, 134-549; 16910, ST7, 85063, 187513, 195-353; 16910, ST7, 85064, 187514, 392-577; 16910, ST7, 85065, 187515, 75-269; 16910, ST7, 85066, 187516, 507-579; 16910, ST7, 85067, 187517, 21-1694; 16910, ST7, 85068, 187518, 115-1710; 16910, ST7, 85069, 187519, 282-542; 16910, ST7, 85070, 187520, 115-1641; 16910, ST7, 85071, 187521, 295-531; 16910, ST7, 85072, 187522, 6-1689; 16910, ST7, 85073, 187523, 488-780; 16910, ST7, 85074, 187524, 382-1137; 16910, ST7, 85054, 187504, 215-1972; 16910, ST7, 85056, 187506, 615-2114; 16910, ST7, 85061, 187511, 200-1864; 16911, ST7L, 85078, 187528, 175-862; 16911, ST7L, 85081, 187531, 1-860; 16911, ST7L, 85075, 187525, 77-1744; 16911, ST7L, 85076, 187526, 306-2033; 16911, ST7L, 85077, 187527, 77-1711; 16911, ST7L, 85079, 187529, 77-1693; 16911, ST7L, 85080, 187530, 435-1613; 16911, ST7L, 85082, 187532, 77-1753; 16911, ST7L, 85083, 187533, 32-1699; 16911, ST7L, 85084, 187534, 167-1834; 16912, SAPCD1, 85085, 187535, 257-700; 16912, SAPCD1, 85091, 187541, 257-607; 16912, SAPCD1, 85092, 187542, 257-700; 16912, SAPCD1, 85094, 187544, 257-700; 16912, SAPCD1, 85096, 187546, 257-700; 16912, SAPCD1, 85097, 187547, 257-700; 16912, SAPCD1, 85086, 187536, 60-596; 16912, SAPCD1, 85087, 187537, 60-596; 16912, SAPCD1, 85088, 187538, 60-596; 16912, SAPCD1, 85089, 187539, 60-596; 16912, SAPCD1, 85090, 187540, 60-596; 16912, SAPCD1, 85093, 187543, 60-596; 16912, SAPCD1, 85095, 187545, 60-506; 16912, SAPCD1, 85098, 187548, 60-506; 16913, SAPCD2, 85099, 187549, 129-1313; 16914, SCAI, 85102, 187552, 1-265; 16914, SCAI, 85103, 187553, 1-99; 16914, SCAI, 85104, 187554, 51-1523; 16914, SCAI, 85100, 187550, 60-1880; 16914, SCAI, 85101, 187551, 60-1949; 16915, SOCS1, 85105, 187555, 152-787; 16916, SOCS2, 85109, 187559, 317-744; 16916, SOCS2, 85110, 187560, 501-984; 16916, SOCS2, 85111, 187561, 425-733; 16916, SOCS2, 85114, 187564, 455-462; 16916, SOCS2, 85115, 187565, 1-350; 16916, SOCS2, 85116, 187566, 1-140; 16916, SOCS2, 85106, 187556, 599-1195; 16916, SOCS2, 85107, 187557, 451-1047; 16916, SOCS2, 85108, 187558, 768-1364; 16916, SOCS2, 85112, 187562, 481-1077; 16916, SOCS2, 85113, 187563, 993-1589; 16916, SOCS2, 85117, 187567, 720-1316; 16917, SOCS3, 85119, 187569, 315-361; 16917, SOCS3, 85118, 187568, 417-1094; 16918, SOCS4, 85120, 187570, 223-1545; 16918, SOCS4, 85121, 187571, 333-1655; 16918, SOCS4, 85122, 187572, 444-1766; 16919, SOCS5, 85123, 187573, 173-1783; 16919, SOCS5, 85124, 187574, 276-1886; 16920, SOCS6, 85126, 187576, 212-894; 16920, SOCS6, 85125, 187575, 317-1924; 16920, SOCS6, 85127, 187577, 178-1785; 16921, SOCS7, 85130, 187580, 1-480; 16921, SOCS7, 85131, 187581, 18-1661; 16921, SOCS7, 85132, 187582, 1-480; 16921, SOCS7, 85133, 187583, 18-1661; 16921, SOCS7, 85128, 187578, 1-1746; 16921, SOCS7, 85129, 187579, 1-1746; 16922, SUFU, 85134, 187584, 147-1448; 16922, SUFU, 85135, 187585, 167-1621; 16922, SUFU, 85136, 187586, 75-1520; 16923, SOGA1, 85138, 187588, 328-3378; 16923, SOGA1, 85139, 187589, 1-3826; 16923, SOGA1, 85137, 187587, 343-5328; 16924, SIKE1, 85140, 187590, 71-694; 16924, SIKE1, 85141, 187591, 79-714; 16925, ST20, 85142, 187592, 681-920; 16925, ST20, 85143, 187593, 263-502; 16925, ST20, 85144, 187594, 364-603; 16926, SUV39H1, 85145, 187595, 267-1538; 16926, SUV39H1, 85146, 187596, 191-1429; 16927, SUV39H2, 85149, 187599, 1-530; 16927, SUV39H2, 85151, 187601, 70-207; 16927, SUV39H2, 85152, 187602, 402-688; 16927, SUV39H2, 85153, 187603, 263-719; 16927, SUV39H2, 85154, 187604, 43-704; 16927, SUV39H2, 85147, 187597, 232-1284; 16927, SUV39H2, 85148, 187598, 1-1233; 16927, SUV39H2, 85150, 187600, 27-719; 16928, SUV420H1, 85156, 187606, 1-311; 16928, SUV420H1, 85157, 187607, 202-1314; 16928, SUV420H1, 85158, 187608, 196-1404; 16928, SUV420H1, 85161, 187611, 355-834; 16928, SUV420H1, 85162, 187612, 232-585; 16928, SUV420H1, 85163, 187613, 256-556; 16928, SUV420H1, 85164, 187614, 234-594; 16928, SUV420H1, 85165, 187615, 6-842; 16928, SUV420H1, 85155, 187605, 355-3012; 16928, SUV420H1, 85159, 187609, 429-1610; 16928, SUV420H1, 85160, 187610, 226-1407; 16928, SUV420H1, 85166, 187616, 1-2658; 16929, SUV420H2, 85170, 187620, 323-1366; 16929, SUV420H2, 85167, 187617, 249-1637; 16929, SUV420H2, 85168, 187618, 184-477; 16929, SUV420H2, 85169, 187619, 97-390; 16930, SBSN, 85173, 187623, 1-450; 16930, SBSN, 85171, 187621, 71-814; 16930, SBSN, 85172, 187622, 30-1802; 16931, SFTA2, 85179, 187629, 80-316; 16931, SFTA2, 85180, 187630, 522-689; 16931, SFTA2, 85174, 187624, 80-316; 16931, SFTA2, 85175, 187625, 80-316; 16931, SFTA2, 85176, 187626, 80-316; 16931, SFTA2, 85177, 187627, 80-316; 16931, SFTA2, 85178, 187628, 80-316; 16932, SFTA3, 85181, 187631, 379-609; 16932, SFTA3, 85182, 187632, 83-313; 16932, SFTA3, 85183, 187633, 18-305; 16932, SFTA3, 85185, 187635, 238-468; 16932, SFTA3, 85184, 187634, 677-961; 16933, SFTPA1, 85187, 187637, 54-527; 16933, SFTPA1, 85189, 187639, 123-596; 16933, SFTPA1, 85186, 187636, 139-885; 16933, SFTPA1, 85188, 187638, 77-868; 16933, SFTPA1, 85190, 187640, 68-814; 16934, SFTPA2, 85193, 187643, 253-726; 16934, SFTPA2, 85194, 187644, 352-644; 16934, SFTPA2, 85191, 187641, 86-832; 16934, SFTPA2, 85192, 187642, 47-793; 16935, SFTPB, 85196, 187646, 101-1282; 16935, SFTPB, 85197, 187647, 1-1123; 16935, SFTPB, 85199, 187649, 1-277; 16935, SFTPB, 85195, 187645, 137-1282; 16935, SFTPB, 85198, 187648, 21-1166; 16936, SFTPC, 85201, 187651, 32-517; 16936, SFTPC, 85202, 187652, 25-477; 16936, SFTPC, 85203, 187653, 23-457; 16936, SFTPC, 85204, 187654, 22-395; 16936, SFTPC, 85205, 187655, 30-497; 16936, SFTPC, 85206, 187656, 33-608; 16936, SFTPC, 85200, 187650, 175-768; 16937, SFTPD, 85208, 187658, 5-659; 16937, SFTPD, 85207, 187657, 42-1169; 16938, SURF1, 85210, 187660, 308-883; 16938, SURF1, 85211, 187661, 308-883; 16938, SURF1, 85212, 187662, 33-935; 16938, SURF1, 85209, 187659, 33-935; 16939, SURF2, 85214, 187664, 42-812; 16939, SURF2, 85213, 187663, 42-812; 16940, SURF4, 85216, 187666, 75-635; 16940, SURF4, 85219, 187669, 425-1105; 16940, SURF4, 85220, 187670, 477-1157; 16940, SURF4, 85215, 187665, 131-940; 16940, SURF4, 85217, 187667, 131-610; 16940, SURF4, 85218, 187668, 198-584; 16941, SURF6, 85221, 187671, 267-1352; 16942, N/A, 85222, 187672, 267-1352; 16943, SUGP1, 85224, 187674, 14-571; 16943, SUGP1, 85226, 187676, 14-403; 16943, SUGP1, 85227, 187677, 1-235; 16943, SUGP1, 85228, 187678, 14-124; 16943, SUGP1, 85229, 187679, 14-223; 16943, SUGP1, 85230, 187680, 39-764; 16943, SUGP1, 85223, 187673, 349-2286; 16943, SUGP1, 85225, 187675, 14-682; 16944, SUGP2, 85235, 187685, 399-732; 16944, SUGP2, 85236, 187686, 1-161; 16944, SUGP2, 85237, 187687, 1-511; 16944, SUGP2, 85239, 187689, 1-197; 16944, SUGP2, 85240, 187690, 21-3311; 16944, SUGP2, 85241, 187691, 72-2597; 16944, SUGP2, 85231, 187681, 66-3158; 16944, SUGP2, 85232, 187682, 135-3383; 16944, SUGP2, 85233, 187683, 75-3323; 16944, SUGP2, 85234, 187684, 67-3189; 16944, SUGP2, 85238, 187688, 299-3547; 16945, SMNDC1, 85242, 187692, 306-1022; 16945, SMNDC1, 85243, 187693, 205-921; 16946, SMN1, 85246, 187696, 30-914; 16946, SMN1, 85247, 187697, 49-732; 16946, SMN1, 85250, 187700, 1-240; 16946, SMN1, 85251, 187701, 1-885; 16946, SMN1, 85254, 187704, 1-448; 16946, SMN1, 85255, 187705, 1-885; 16946, SMN1, 85257, 187707, 1-430; 16946, SMN1, 85258, 187708, 1-541; 16946, SMN1, 85259, 187709, 1-240; 16946, SMN1, 85261, 187711, 49-732; 16946, SMN1, 85244, 187694, 1-885; 16946, SMN1, 85245, 187695, 75-959; 16946, SMN1, 85248, 187698, 10-858; 16946, SMN1, 85249, 187699, 75-863; 16946, SMN1, 85252, 187702, 1-789; 16946, SMN1, 85253, 187703, 1-885; 16946, SMN1, 85256, 187706, 33-881; 16946, SMN1, 85260, 187710, 48-932; 16947, SMN2, 85265, 187715, 49-732; 16947, SMN2, 85266, 187716, 30-914; 16947, SMN2, 85267, 187717, 1-139; 16947, SMN2, 85268, 187718, 1-240; 16947, SMN2, 85269, 187719, 1-885; 16947, SMN2, 85270, 187720, 30-914; 16947, SMN2, 85271, 187721, 49-732; 16947, SMN2, 85274, 187724, 1-139; 16947, SMN2, 85276, 187726, 1-240; 16947, SMN2, 85281, 187731, 1-240; 16947, SMN2, 85282, 187732, 1-885; 16947, SMN2, 85283, 187733, 30-914; 16947, SMN2, 85285, 187735, 1-885; 16947, SMN2, 85286, 187736, 49-732; 16947, SMN2, 85262, 187712, 1-885; 16947, SMN2, 85263, 187713, 23-811; 16947, SMN2, 85264, 187714, 75-959; 16947, SMN2, 85272, 187722, 1-789; 16947, SMN2, 85273, 187723, 1-885; 16947, SMN2, 85275, 187725, 75-863; 16947, SMN2, 85277, 187727, 31-915; 16947, SMN2, 85278, 187728, 1-789; 16947, SMN2, 85279, 187729, 1-885; 16947, SMN2, 85280, 187730, 23-811; 16947, SMN2, 85284, 187734, 33-881; 16947, SMN2, 85287, 187737, 10-858; 16947, SMN2, 85288, 187738, 75-959; 16948, SUSD1, 85289, 187739, 1-2119; 16948, SUSD1, 85290, 187740, 63-2231; 16948, SUSD1, 85293, 187743, 1-842; 16948, SUSD1, 85294, 187744, 1-138; 16948, SUSD1, 85291, 187741, 33-2306; 16948, SUSD1, 85292, 187742, 174-2417; 16949, SUSD2, 85295, 187745, 262-2730; 16950, SUSD3, 85298, 187748, 1-359; 16950, SUSD3, 85299, 187749, 1-463; 16950, SUSD3, 85300, 187750, 56-691; 16950, SUSD3, 85296, 187746, 1-729; 16950, SUSD3, 85297, 187747, 37-804; 16951, SUSD4, 85304, 187754, 158-1624; 16951, SUSD4, 85305, 187755, 110-1375; 16951, SUSD4, 85306, 187756, 1-1391; 16951, SUSD4, 85301, 187751, 147-1019; 16951, SUSD4, 85302, 187752, 635-2107; 16951, SUSD4, 85303, 187753, 182-1654; 16952, SUSD5, 85308, 187758, 1-729; 16952, SUSD5, 85307, 187757, 419-2308; 16953, SUSD6, 85309, 187759, 314-1225; 16954, SNED1, 85311, 187761, 134-1930; 16954, SNED1, 85312, 187762, 1-900; 16954, SNED1, 85315, 187765, 1-201; 16954, SNED1, 85316, 187766, 1-816; 16954, SNED1, 85310, 187760, 1-4242; 16954, SNED1, 85313, 187763, 1-3975; 16954, SNED1, 85314, 187764, 1-4059; 16955, SVEP1, 85319, 187769, 338-11062; 16955, SVEP1, 85317, 187767, 338-2944; 16955, SVEP1, 85318, 187768, 196-10911; 16956, SRPX, 85320, 187770, 108-1502; 16956, SRPX, 85321, 187771, 133-1350; 16956, SRPX, 85322, 187772, 133-1467; 16956, SRPX, 85323, 187773, 133-1272; 16957, SRPX2, 85324, 187774, 429-1826; 16958, SUPV3L1, 85326, 187776, 5-794; 16958, SUPV3L1, 85325, 187775, 61-2421; 16959, SZRD1, 85331, 187781, 23-277; 16959, SZRD1, 85327, 187777, 176-634; 16959, SZRD1, 85328, 187778, 41-442;

16959, SZRD1, 85329, 187779, 1-399; 16959, SZRD1, 85330, 187780, 171-626; 16960, SUZ12, 85333, 187783, 181-2331; 16960, SUZ12, 85332, 187782, 230-2449; 16961, SVOP, 85334, 187784, 173-639; 16961, SVOP, 85335, 187785, 156-470; 16961, SVOP, 85336, 187786, 373-2019; 16962, SVOPL, 85338, 187788, 3980-4681; 16962, SVOPL, 85340, 187790, 210-1328; 16962, SVOPL, 85337, 187787, 66-1088; 16962, SVOPL, 85339, 187789, 35-1513; 16962, SVOPL, 85341, 187791, 74-1096; 16963, SWAP70, 85343, 187793, 104-1687; 16963, SWAP70, 85344, 187794, 100-549; 16963, SWAP70, 85345, 187795, 1-71; 16963, SWAP70, 85346, 187796, 452-1131; 16963, SWAP70, 85342, 187792, 104-1861; 16964, SMARCA1, 85347, 187797, 36-3248; 16964, SMARCA1, 85349, 187799, 116-3292; 16964, SMARCA1, 85348, 187798, 131-3295; 16965, SMARCA2, 85351, 187801, 521-1357; 16965, SMARCA2, 85352, 187802, 200-946; 16965, SMARCA2, 85354, 187804, 165-875; 16965, SMARCA2, 85355, 187805, 106-936; 16965, SMARCA2, 85356, 187806, 178-942; 16965, SMARCA2, 85359, 187809, 131-961; 16965, SMARCA2, 85360, 187810, 223-4767; 16965, SMARCA2, 85361, 187811, 203-750; 16965, SMARCA2, 85362, 187812, 110-755; 16965, SMARCA2, 85363, 187813, 56-633; 16965, SMARCA2, 85364, 187814, 150-834; 16965, SMARCA2, 85365, 187815, 158-736; 16965, SMARCA2, 85366, 187816, 1-683; 16965, SMARCA2, 85367, 187817, 136-432; 16965, SMARCA2, 85368, 187818, 239-424; 16965, SMARCA2, 85369, 187819, 158-758; 16965, SMARCA2, 85370, 187820, 26-712; 16965, SMARCA2, 85371, 187821, 10-744; 16965, SMARCA2, 85372, 187822, 349-4635; 16965, SMARCA2, 85373, 187823, 106-711; 16965, SMARCA2, 85374, 187824, 312-1094; 16965, SMARCA2, 85375, 187825, 1-176; 16965, SMARCA2, 85376, 187826, 8-740; 16965, SMARCA2, 85377, 187827, 76-840; 16965, SMARCA2, 85378, 187828, 451-897; 16965, SMARCA2, 85379, 187829, 1-115; 16965, SMARCA2, 85380, 187830, 123-630; 16965, SMARCA2, 85381, 187831, 1-810; 16965, SMARCA2, 85382, 187832, 413-616; 16965, SMARCA2, 85383, 187833, 1-174; 16965, SMARCA2, 85384, 187834, 146-442; 16965, SMARCA2, 85385, 187835, 98-792; 16965, SMARCA2, 85350, 187800, 154-4926; 16965, SMARCA2, 85353, 187803, 113-4831; 16965, SMARCA2, 85357, 187807, 123-2841; 16965, SMARCA2, 85358, 187808, 210-4982; 16966, SMARCA4, 85389, 187839, 1-5040; 16966, SMARCA4, 85390, 187840, 1-5046; 16966, SMARCA4, 85394, 187844, 1-409; 16966, SMARCA4, 85395, 187845, 1-340; 16966, SMARCA4, 85386, 187836, 206-5149; 16966, SMARCA4, 85387, 187837, 97-4938; 16966, SMARCA4, 85388, 187838, 282-5225; 16966, SMARCA4, 85391, 187841, 286-5139; 16966, SMARCA4, 85392, 187842, 331-5181; 16966, SMARCA4, 85393, 187843, 438-5282; 16967, SMARCA5, 85396, 187846, 463-3621; 16968, SMARCAL1, 85399, 187849, 1-2391; 16968, SMARCAL1, 85400, 187850, 115-538; 16968, SMARCAL1, 85401, 187851, 1-977; 16968, SMARCAL1, 85402, 187852, 253-310; 16968, SMARCAL1, 85403, 187853, 321-711; 16968, SMARCAL1, 85404, 187854, 1-484; 16968, SMARCAL1, 85405, 187855, 268-544; 16968, SMARCAL1, 85406, 187856, 286-722; 16968, SMARCAL1, 85397, 187847, 331-3195; 16968, SMARCAL1, 85398, 187848, 152-3016; 16969, SMARCB1, 85408, 187858, 208-1392; 16969, SMARCB1, 85410, 187860, 160-1179; 16969, SMARCB1, 85411, 187861, 208-889; 16969, SMARCB1, 85413, 187863, 208-1392; 16969, SMARCB1, 85415, 187865, 160-1179; 16969, SMARCB1, 85416, 187866, 208-889; 16969, SMARCB1, 85417, 187867, 1-242; 16969, SMARCB1, 85418, 187868, 1-269; 16969, SMARCB1, 85407, 187857, 197-1354; 16969, SMARCB1, 85409, 187859, 177-1307; 16969, SMARCB1, 85412, 187862, 197-1354; 16969, SMARCB1, 85414, 187864, 177-1307; 16970, SMARCC1, 85420, 187870, 85-486; 16970, SMARCC1, 85419, 187869, 121-3438; 16971, SMARCC2, 85424, 187874, 13-330; 16971, SMARCC2, 85425, 187875, 16-3753; 16971, SMARCC2, 85426, 187876, 83-400; 16971, SMARCC2, 85421, 187871, 88-3732; 16971, SMARCC2, 85422, 187872, 88-3480; 16971, SMARCC2, 85423, 187873, 107-3565; 16972, SMARCD1, 85429, 187879, 46-881; 16972, SMARCD1, 85430, 187880, 1-346; 16972, SMARCD1, 85431, 187881, 43-911; 16972, SMARCD1, 85432, 187882, 5-946; 16972, SMARCD1, 85433, 187883, 198-536; 16972, SMARCD1, 85427, 187877, 171-1595; 16972, SMARCD1, 85428, 187878, 399-1946; 16973, SMARCD2, 85434, 187884, 96-1466; 16973, SMARCD2, 85437, 187887, 1-694; 16973, SMARCD2, 85438, 187888, 241-449; 16973, SMARCD2, 85439, 187889, 1-330; 16973, SMARCD2, 85440, 187890, 25-267; 16973, SMARCD2, 85441, 187891, 1-1485; 16973, SMARCD2, 85435, 187885, 48-1499; 16973, SMARCD2, 85436, 187886, 267-1862; 16974, SMARCD3, 85445, 187895, 1-206; 16974, SMARCD3, 85446, 187896, 70-291; 16974, SMARCD3, 85447, 187897, 197-613; 16974, SMARCD3, 85442, 187892, 412-1863; 16974, SMARCD3, 85443, 187893, 130-1542; 16974, SMARCD3, 85444, 187894, 476-1888; 16975, SMARCE1, 85450, 187900, 1-474; 16975, SMARCE1, 85452, 187902, 71-1252; 16975, SMARCE1, 85453, 187903, 105-272; 16975, SMARCE1, 85455, 187905, 145-449; 16975, SMARCE1, 85456, 187906, 225-1090; 16975, SMARCE1, 85457, 187907, 235-621; 16975, SMARCE1, 85458, 187908, 88-321; 16975, SMARCE1, 85459, 187909, 94-554; 16975, SMARCE1, 85460, 187910, 115-273; 16975, SMARCE1, 85462, 187912, 1-532; 16975, SMARCE1, 85448, 187898, 782-2017; 16975, SMARCE1, 85449, 187899, 92-1078; 16975, SMARCE1, 85451, 187901, 153-1034; 16975, SMARCE1, 85454, 187904, 92-1222; 16975, SMARCE1, 85461, 187911, 153-1178; 16976, SMARCAD1, 85465, 187915, 209-421; 16976, SMARCAD1, 85468, 187918, 255-989; 16976, SMARCAD1, 85463, 187913, 74-3154; 16976, SMARCAD1, 85464, 187914, 175-3261; 16976, SMARCAD1, 85466, 187916, 276-3362; 16976, SMARCAD1, 85467, 187917, 388-2178; 16977, SWI5, 85470, 187920, 1-437; 16977, SWI5, 85471, 187921, 98-490; 16977, SWI5, 85472, 187922, 30-449; 16977, SWI5, 85473, 187923, 120-632; 16977, SWI5, 85474, 187924, 100-555; 16977, SWI5, 85469, 187919, 1-708; 16978, SFR1, 85475, 187925, 20-757; 16978, SFR1, 85476, 187926, 124-822; 16979, SWSAP1, 85477, 187927, 60-749; 16980, SWT1, 85480, 187930, 155-633; 16980, SWT1, 85478, 187928, 166-2868; 16980, SWT1, 85479, 187929, 95-2797; 16981, SYF2, 85481, 187931, 27-758; 16981, SYF2, 85482, 187932, 20-625; 16982, SYMPK, 85484, 187934, 78-503; 16982, SYMPK, 85485, 187935, 1-286; 16982, SYMPK, 85486, 187936, 410-560; 16982, SYMPK, 85487, 187937, 199-611; 16982, SYMPK, 85488, 187938, 278-623; 16982, SYMPK, 85489, 187939, 1313-3334; 16982, SYMPK, 85490, 187940, 1216-4392; 16982, SYMPK, 85491, 187941, 86-3262; 16982, SYMPK, 85483, 187933, 246-4070; 16983, SYAP1, 85492, 187942, 94-1152; 16984, SYDE1, 85494, 187944, 1643-2821; 16984, SYDE1, 85496, 187946, 1-571; 16984, SYDE1, 85497, 187947, 30-539; 16984, SYDE1, 85493, 187943, 32-2239; 16984, SYDE1, 85495, 187945, 30-2036; 16985, SYDE2, 85498, 187948, 51-3635; 16986, SYNDIG1, 85499, 187949, 634-

1410; 16987, SYNDIG1L, 85502, 187952, 249-488; 16987, SYNDIG1L, 85500, 187950, 249-965; 16987, SYNDIG1L, 85501, 187951, 63-779; 16988, SYN1, 85503, 187953, 126-2243; 16988, SYN1, 85504, 187954, 126-2135; 16989, SYN2, 85505, 187955, 1-664; 16989, SYN2, 85506, 187956, 151-1899; 16989, SYN2, 85507, 187957, 147-1583; 16990, SYN3, 85508, 187958, 1-972; 16990, SYN3, 85510, 187960, 292-632; 16990, SYN3, 85511, 187961, 487-855; 16990, SYN3, 85512, 187962, 1-561; 16990, SYN3, 85509, 187959, 244-1986; 16991, SYNGAP1, 85513, 187963, 1-3855; 16991, SYNGAP1, 85514, 187964, 1-1461; 16991, SYNGAP1, 85520, 187970, 11-3930; 16991, SYNGAP1, 85515, 187965, 1-3900; 16991, SYNGAP1, 85516, 187966, 1-3858; 16991, SYNGAP1, 85517, 187967, 181-4035; 16991, SYNGAP1, 85518, 187968, 181-4035; 16991, SYNGAP1, 85519, 187969, 102-4133; 16991, SYNGAP1, 85521, 187971, 1-3900; 16991, SYNGAP1, 85522, 187972, 196-4227; 16992, SV2A, 85523, 187973, 451-2499; 16992, SV2A, 85524, 187974, 492-2720; 16993, SV2B, 85525, 187975, 395-2446; 16993, SV2B, 85526, 187976, 471-2522; 16993, SV2B, 85527, 187977, 417-2015; 16993, SV2B, 85528, 187978, 529-2580; 16994, SV2C, 85529, 187979, 201-2231; 16994, SV2C, 85530, 187980, 443-2626; 16995, SYNGR1, 85531, 187981, 63-419; 16995, SYNGR1, 85535, 187985, 21-530; 16995, SYNGR1, 85536, 187986, 25-459; 16995, SYNGR1, 85532, 187982, 87-662; 16995, SYNGR1, 85533, 187983, 16-717; 16995, SYNGR1, 85534, 187984, 26-604; 16996, SYNGR2, 85538, 187988, 142-648; 16996, SYNGR2, 85540, 187990, 14-211; 16996, SYNGR2, 85541, 187991, 1-407; 16996, SYNGR2, 85542, 187992, 16-357; 16996, SYNGR2, 85537, 187987, 60-734; 16996, SYNGR2, 85539, 187989, 24-698; 16996, SYNGR2, 85543, 187993, 7-834; 16997, SYNGR3, 85545, 187995, 1-533; 16997, SYNGR3, 85546, 187996, 142-860; 16997, SYNGR3, 85547, 187997, 1017-1247; 16997, SYNGR3, 85548, 187998, 105-542; 16997, SYNGR3, 85544, 187994, 159-848; 16998, SYNGR4, 85550, 188000, 163-387; 16998, SYNGR4, 85551, 188001, 93-365; 16998, SYNGR4, 85552, 188002, 168-608; 16998, SYNGR4, 85549, 187999, 251-955; 16999, SYNJ1, 85554, 188004, 118-3912; 16999, SYNJ1, 85555, 188005, 1-4053; 16999, SYNJ1, 85556, 188006, 1-395; 16999, SYNJ1, 85557, 188007, 1-562; 16999, SYNJ1, 85558, 188008, 9-4847; 16999, SYNJ1, 85559, 188009, 48-583; 16999, SYNJ1, 85560, 188010, 126-2212; 16999, SYNJ1, 85561, 188011, 87-4667; 16999, SYNJ1, 85553, 188003, 126-4013; 17000, SYNJ2, 85563, 188013, 1856-3601; 17000, SYNJ2, 85564, 188014, 1-410; 17000, SYNJ2, 85565, 188015, 411-2930; 17000, SYNJ2, 85566, 188016, 271-547; 17000, SYNJ2, 85567, 188017, 1-497; 17000, SYNJ2, 85562, 188012, 76-4566; 17001, SYNJ2BP, 85568, 188018, 83-520; 17002, SYCE1, 85569, 188019, 55-1011; 17002, SYCE1, 85572, 188022, 604-978; 17002, SYCE1, 85570, 188020, 106-1161; 17002, SYCE1, 85571, 188021, 140-988; 17003, SYCE1L, 85574, 188024, 1-75; 17003, SYCE1L, 85573, 188023, 56-784; 17004, SYCE2, 85576, 188026, 1-163; 17004, SYCE2, 85575, 188025, 20-676; 17005, SYCE3, 85577, 188027, 28-294; 17005, SYCE3, 85578, 188028, 49-315; 17006, SYCP1, 85581, 188031, 179-2554; 17006, SYCP1, 85583, 188033, 179-3034; 17006, SYCP1, 85579, 188029, 174-3104; 17006, SYCP1, 85580, 188030, 241-3171; 17006, SYCP1, 85582, 188032, 179-3109; 17007, SYCP2, 85586, 188036, 134-488; 17007, SYCP2, 85587, 188037, 271-3341; 17007, SYCP2, 85588, 188038, 1-625; 17007, SYCP2, 85584, 188034, 227-4819; 17007, SYCP2, 85585, 188035, 140-4732; 17008, SYCP2L, 85591, 188041, 1-330; 17008, SYCP2L, 85592, 188042, 1-2436; 17008, SYCP2L, 85589, 188039, 297-2735; 17008, SYCP2L, 85590, 188040, 297-1172; 17009, SYCP3, 85593, 188043, 79-789; 17009, SYCP3, 85594, 188044, 81-791; 17009, SYCP3, 85595, 188045, 133-843; 17010, SYP, 85597, 188047, 8-130; 17010, SYP, 85599, 188049, 1-611; 17010, SYP, 85600, 188050, 8-364; 17010, SYP, 85601, 188051, 8-364; 17010, SYP, 85596, 188046, 74-1015; 17010, SYP, 85598, 188048, 14-955; 17011, SYPL1, 85604, 188054, 1-446; 17011, SYPL1, 85605, 188055, 14-688; 17011, SYPL1, 85606, 188056, 1-408; 17011, SYPL1, 85602, 188052, 48-827; 17011, SYPL1, 85603, 188053, 124-849; 17012, SYPL2, 85607, 188057, 217-1035; 17013, SYNPO, 85608, 188058, 530-3241; 17013, SYNPO, 85609, 188059, 375-3164; 17013, SYNPO, 85610, 188060, 308-3097; 17013, SYNPO, 85611, 188061, 510-2567; 17014, SYNPO2, 85615, 188065, 197-568; 17014, SYNPO2, 85616, 188066, 1-3466; 17014, SYNPO2, 85612, 188062, 197-3982; 17014, SYNPO2, 85613, 188063, 1-3330; 17014, SYNPO2, 85614, 188064, 183-3464; 17014, SYNPO2, 85617, 188067, 242-3934; 17015, SYNPO2L, 85620, 188070, 207-551; 17015, SYNPO2L, 85618, 188068, 23-2284; 17015, SYNPO2L, 85619, 188069, 151-3084; 17016, SYNPR, 85622, 188072, 217-321; 17016, SYNPR, 85623, 188073, 110-715; 17016, SYNPR, 85624, 188074, 114-944; 17016, SYNPR, 85625, 188075, 119-727; 17016, SYNPR, 85627, 188077, 207-434; 17016, SYNPR, 85628, 188078, 333-500; 17016, SYNPR, 85629, 188079, 137-292; 17016, SYNPR, 85621, 188071, 370-1167; 17016, SYNPR, 85626, 188076, 412-1269; 17017, SNAP23, 85633, 188083, 191-565; 17017, SNAP23, 85634, 188084, 131-424; 17017, SNAP23, 85635, 188085, 51-185; 17017, SNAP23, 85636, 188086, 1-449; 17017, SNAP23, 85637, 188087, 95-478; 17017, SNAP23, 85638, 188088, 87-380; 17017, SNAP23, 85639, 188089, 85-378; 17017, SNAP23, 85640, 188090, 1-464; 17017, SNAP23, 85641, 188091, 238-565; 17017, SNAP23, 85642, 188092, 1-271; 17017, SNAP23, 85643, 188093, 90-251; 17017, SNAP23, 85644, 188094, 143-568; 17017, SNAP23, 85645, 188095, 76-210; 17017, SNAP23, 85646, 188096, 76-237; 17017, SNAP23, 85630, 188080, 423-899; 17017, SNAP23, 85631, 188081, 469-1104; 17017, SNAP23, 85632, 188082, 1-477; 17018, SNAP25, 85649, 188099, 212-492; 17018, SNAP25, 85647, 188097, 212-832; 17018, SNAP25, 85648, 188098, 209-829; 17019, SNAP29, 85651, 188101, 201-681; 17019, SNAP29, 85650, 188100, 129-905; 17020, SNAP47, 85655, 188105, 1-778; 17020, SNAP47, 85656, 188106, 1-1315; 17020, SNAP47, 85657, 188107, 1-667; 17020, SNAP47, 85658, 188108, 93-1352; 17020, SNAP47, 85659, 188109, 1-771; 17020, SNAP47, 85652, 188102, 415-1809; 17020, SNAP47, 85653, 188103, 415-1809; 17020, SNAP47, 85654, 188104, 225-893; 17021, SNAP91, 85660, 188110, 315-3023; 17021, SNAP91, 85661, 188111, 100-546; 17021, SNAP91, 85662, 188112, 1-429; 17021, SNAP91, 85665, 188115, 387-735; 17021, SNAP91, 85667, 188117, 176-307; 17021, SNAP91, 85670, 188120, 75-251; 17021, SNAP91, 85671, 188121, 386-842; 17021, SNAP91, 85672, 188122, 66-428; 17021, SNAP91, 85673, 188123, 397-3105; 17021, SNAP91, 85674, 188124, 101-277; 17021, SNAP91, 85675, 188125, 87-263; 17021, SNAP91, 85676, 188126, 1-1745; 17021, SNAP91, 85677, 188127, 1-669; 17021, SNAP91, 85678, 188128, 140-591; 17021, SNAP91, 85679, 188129, 328-525; 17021, SNAP91, 85663, 188113, 315-3038; 17021, SNAP91, 85664, 188114, 318-3041; 17021, SNAP91, 85666, 188116, 99-1901; 17021, SNAP91, 85668, 188118, 135-2858; 17021, SNAP91, 85669, 188119, 98-2731; 17022, SYNCRIP, 85682, 188132, 56-610; 17022, SYNCRIP, 85683, 188133, 273-1667;

17022, SYNCRIP, 85680, 188130, 208-1896; 17022, SYN-CRIP, 85681, 188131, 502-2373; 17023, SYT1, 85686, 188136, 449-1708; 17023, SYT1, 85687, 188137, 218-762; 17023, SYT1, 85688, 188138, 419-702; 17023, SYT1, 85690, 188140, 362-579; 17023, SYT1, 85691, 188141, 206-726; 17023, SYT1, 85692, 188142, 333-506; 17023, SYT1, 85693, 188143, 494-710; 17023, SYT1, 85684, 188134, 658-1926; 17023, SYT1, 85685, 188135, 672-1940; 17023, SYT1, 85689, 188139, 280-1548; 17024, SYT2, 85694, 188144, 194-1453; 17024, SYT2, 85695, 188145, 178-1437; 17025, SYT3, 85700, 188150, 298-586; 17025, SYT3, 85701, 188151, 1-240; 17025, SYT3, 85696, 188146, 635-2407; 17025, SYT3, 85697, 188147, 560-2332; 17025, SYT3, 85698, 188148, 556-2328; 17025, SYT3, 85699, 188149, 183-1955; 17026, SYT4, 85704, 188154, 257-565; 17026, SYT4, 85705, 188155, 130-560; 17026, SYT4, 85702, 188152, 370-1647; 17026, SYT4, 85703, 188153, 210-1433; 17027, SYT9, 85707, 188157, 91-1050; 17027, SYT9, 85708, 188158, 18-539; 17027, SYT9, 85706, 188156, 238-1713; 17028, SYT5, 85711, 188161, 350-499; 17028, SYT5, 85712, 188162, 185-640; 17028, SYT5, 85713, 188163, 129-329; 17028, SYT5, 85715, 188165, 117-580; 17028, SYT5, 85716, 188166, 1-68; 17028, SYT5, 85709, 188159, 371-1531; 17028, SYT5, 85710, 188160, 1064-2224; 17028, SYT5, 85714, 188164, 186-1334; 17029, SYT6, 85718, 188168, 237-611; 17029, SYT6, 85721, 188171, 97-312; 17029, SYT6, 85722, 188172, 202-843; 17029, SYT6, 85723, 188173, 308-572; 17029, SYT6, 85724, 188174, 79-294; 17029, SYT6, 85717, 188167, 251-1528; 17029, SYT6, 85719, 188169, 148-1680; 17029, SYT6, 85720, 188170, 233-1510; 17029, SYT6, 85725, 188175, 305-1582; 17030, SYT7, 85727, 188177, 53-1621; 17030, SYT7, 85728, 188178, 1-369; 17030, SYT7, 85729, 188179, 1-2061; 17030, SYT7, 85730, 188180, 1-369; 17030, SYT7, 85731, 188181, 53-578; 17030, SYT7, 85732, 188182, 52-1887; 17030, SYT7, 85734, 188184, 19-1362; 17030, SYT7, 85726, 188176, 329-1540; 17030, SYT7, 85733, 188183, 7-1443; 17031, SYT8, 85735, 188185, 303-1466; 17031, SYT8, 85737, 188187, 1-1201; 17031, SYT8, 85738, 188188, 184-482; 17031, SYT8, 85739, 188189, 269-575; 17031, SYT8, 85740, 188190, 236-625; 17031, SYT8, 85736, 188186, 129-1334; 17032, SYT10, 85742, 188192, 125-709; 17032, SYT10, 85741, 188191, 298-1869; 17033, SYT11, 85743, 188193, 254-1549; 17034, SYT12, 85746, 188196, 300-593; 17034, SYT12, 85744, 188194, 1163-2428; 17034, SYT12, 85745, 188195, 231-1496; 17034, SYT12, 85747, 188197, 140-1405; 17035, SYT13, 85749, 188199, 1-557; 17035, SYT13, 85750, 188200, 1-61; 17035, SYT13, 85748, 188198, 113-1393; 17036, SYT14, 85755, 188205, 1-1513; 17036, SYT14, 85751, 188201, 292-1845; 17036, SYT14, 85752, 188202, 92-1816; 17036, SYT14, 85753, 188203, 15-1682; 17036, SYT14, 85754, 188204, 411-1964; 17036, SYT14, 85756, 188206, 325-1122; 17036, SYT14, 85757, 188207, 1-1860; 17037, SYT15, 85759, 188209, 589-2013; 17037, SYT15, 85760, 188210, 1-543; 17037, SYT15, 85761, 188211, 86-495; 17037, SYT15, 85758, 188208, 68-1333; 17037, SYT15, 85762, 188212, 37-1209; 17038, SYT16, 85763, 188213, 416-1027; 17038, SYT16, 85764, 188214, 187-1338; 17038, SYT16, 85765, 188215, 198-2135; 17039, SYT17, 85767, 188217, 272-551; 17039, SYT17, 85768, 188218, 259-1671; 17039, SYT17, 85769, 188219, 539-1717; 17039, SYT17, 85770, 188220, 3799-5040; 17039, SYT17, 85771, 188221, 343-580; 17039, SYT17, 85772, 188222, 1-427; 17039, SYT17, 85773, 188223, 264-770; 17039, SYT17, 85766, 188216, 399-1823; 17040, N/A, 85774, 188224, 1-1333; 17040, N/A, 85775, 188225, 154-1326; 17040, N/A, 85776, 188226, 589-2013; 17041, SYTL1, 85778, 188228, 84-312; 17041, SYTL1, 85781, 188231, 170-1663; 17041, SYTL1, 85777, 188227, 168-1820; 17041, SYTL1, 85779, 188229, 463-2151; 17041, SYTL1, 85780, 188230, 149-1837; 17042, SYTL2, 85787, 188237, 375-583; 17042, SYTL2, 85788, 188238, 444-633; 17042, SYTL2, 85789, 188239, 246-711; 17042, SYTL2, 85793, 188243, 431-740; 17042, SYTL2, 85794, 188244, 565-585; 17042, SYTL2, 85797, 188247, 328-699; 17042, SYTL2, 85798, 188248, 394-696; 17042, SYTL2, 85799, 188249, 204-683; 17042, SYTL2, 85800, 188250, 1-1956; 17042, SYTL2, 85801, 188251, 1-3831; 17042, SYTL2, 85802, 188252, 1-6672; 17042, SYTL2, 85803, 188253, 1-2601; 17042, SYTL2, 85782, 188232, 566-3373; 17042, SYTL2, 85783, 188233, 345-3152; 17042, SYTL2, 85784, 188234, 377-1474; 17042, SYTL2, 85785, 188235, 596-3328; 17042, SYTL2, 85786, 188236, 279-3083; 17042, SYTL2, 85790, 188240, 271-1281; 17042, SYTL2, 85791, 188241, 690-1820; 17042, SYTL2, 85792, 188242, 232-2940; 17042, SYTL2, 85795, 188245, 1-2733; 17042, SYTL2, 85796, 188246, 311-1441; 17043, SYTL3, 85804, 188254, 195-2027; 17043, SYTL3, 85805, 188255, 400-2232; 17043, SYTL3, 85806, 188256, 792-2420; 17043, SYTL3, 85807, 188257, 792-2624; 17044, SYTL4, 85808, 188258, 189-2204; 17044, SYTL4, 85809, 188259, 188-2203; 17044, SYTL4, 85810, 188260, 188-1237; 17044, SYTL4, 85811, 188261, 333-2348; 17045, SYTL5, 85812, 188262, 444-2636; 17045, SYTL5, 85813, 188263, 357-2615; 17046, SYNC, 85816, 188266, 342-552; 17046, SYNC, 85817, 188267, 301-569; 17046, SYNC, 85814, 188264, 97-1527; 17046, SYNC, 85815, 188265, 460-1908; 17047, SYCN, 85818, 188268, 13-417; 17048, SDC1, 85821, 188271, 230-739; 17048, SDC1, 85822, 188272, 228-314; 17048, SDC1, 85823, 188273, 1-646; 17048, SDC1, 85819, 188269, 246-1178; 17048, SDC1, 85820, 188270, 392-1324; 17049, SDC2, 85825, 188275, 64-582; 17049, SDC2, 85826, 188276, 248-766; 17049, SDC2, 85827, 188277, 460-957; 17049, SDC2, 85828, 188278, 97-507; 17049, SDC2, 85829, 188279, 186-621; 17049, SDC2, 85824, 188274, 922-1527; 17050, SDC3, 85830, 188280, 1494-2648; 17050, SDC3, 85831, 188281, 176-1504; 17051, SDC4, 85832, 188282, 41-637; 17052, SDCBP, 85835, 188285, 19-753; 17052, SDCBP, 85838, 188288, 1515-2471; 17052, SDCBP, 85839, 188289, 65-784; 17052, SDCBP, 85840, 188290, 1-957; 17052, SDCBP, 85833, 188283, 151-1047; 17052, SDCBP, 85834, 188284, 83-961; 17052, SDCBP, 85836, 188286, 104-997; 17052, SDCBP, 85837, 188287, 100-996; 17053, SDCBP2, 85841, 188291, 60-938; 17053, SDCBP2, 85842, 188292, 175-1053; 17053, SDCBP2, 85843, 188293, 172-795; 17053, SDCBP2, 85844, 188294, 140-1018; 17054, SYNM, 85845, 188295, 121-1140; 17054, SYNM, 85847, 188297, 470-3373; 17054, SYNM, 85848, 188298, 121-3882; 17054, SYNM, 85846, 188296, 166-4863; 17055, SYNRG, 85851, 188301, 1-323; 17055, SYNRG, 85855, 188305, 110-485; 17055, SYNRG, 85856, 188306, 1-709; 17055, SYNRG, 85863, 188313, 110-485; 17055, SYNRG, 85865, 188315, 1-323; 17055, SYNRG, 85849, 188299, 27-3734; 17055, SYNRG, 85850, 188300, 27-3353; 17055, SYNRG, 85852, 188302, 142-4086; 17055, SYNRG, 85853, 188303, 27-3353; 17055, SYNRG, 85854, 188304, 57-3731; 17055, SYNRG, 85857, 188307, 32-3571; 17055, SYNRG, 85858, 188308, 27-3806; 17055, SYNRG, 85859, 188309, 27-3806; 17055, SYNRG, 85860, 188310, 142-4086; 17055, SYNRG, 85861, 188311, 57-3731; 17055, SYNRG, 85862, 188312, 32-3571; 17055, SYNRG, 85864, 188314, 27-3734; 17056,

SYNJ2BP-COX16, 85866, 188316, 22-144; 17056, SYNJ2BP-COX16, 85867, 188317, 22-580; 17056, SYNJ2BP-COX16, 85868, 188318, 158-318; 17056, SYNJ2BP-COX16, 85869, 188319, 112-660; 17056, SYNJ2BP-COX16, 85870, 188320, 22-479; 17057, SYVN1, 85874, 188324, 117-826; 17057, SYVN1, 85875, 188325, 63-775; 17057, SYVN1, 85876, 188326, 1-448; 17057, SYVN1, 85877, 188327, 16-465; 17057, SYVN1, 85871, 188321, 95-1945; 17057, SYVN1, 85872, 188322, 43-1740; 17057, SYVN1, 85873, 188323, 96-1949; 17057, SYVN1, 85878, 188328, 194-2044; 17058, SS18L1, 85881, 188331, 397-781; 17058, SS18L1, 85882, 188332, 1-635; 17058, SS18L1, 85879, 188329, 27-1217; 17058, SS18L1, 85880, 188330, 34-978; 17059, SS18L2, 85883, 188333, 93-326; 17059, SS18L2, 85884, 188334, 209-442; 17060, SS18, 85886, 188336, 30-215; 17060, SS18, 85888, 188338, 123-1310; 17060, SS18, 85889, 188339, 45-170; 17060, SS18, 85890, 188340, 57-233; 17060, SS18, 85891, 188341, 42-218; 17060, SS18, 85892, 188342, 190-646; 17060, SS18, 85893, 188343, 29-283; 17060, SS18, 85894, 188344, 379-588; 17060, SS18, 85895, 188345, 57-263; 17060, SS18, 85896, 188346, 29-313; 17060, SS18, 85897, 188347, 98-265; 17060, SS18, 85898, 188348, 273-663; 17060, SS18, 85899, 188349, 57-239; 17060, SS18, 85900, 188350, 40-222; 17060, SS18, 85901, 188351, 98-205; 17060, SS18, 85902, 188352, 84-266; 17060, SS18, 85903, 188353, 122-259; 17060, SS18, 85885, 188335, 333-1496; 17060, SS18, 85887, 188337, 57-1313; 17061, SSX1, 85904, 188354, 137-703; 17062, SSX2, 85907, 188357, 90-656; 17062, SSX2, 85905, 188355, 99-665; 17062, SSX2, 85906, 188356, 71-742; 17063, SSX2IP, 85910, 188360, 220-759; 17063, SSX2IP, 85912, 188362, 191-454; 17063, SSX2IP, 85914, 188364, 224-1738; 17063, SSX2IP, 85908, 188358, 265-2109; 17063, SSX2IP, 85909, 188359, 354-2117; 17063, SSX2IP, 85911, 188361, 241-1923; 17063, SSX2IP, 85913, 188363, 113-1876; 17064, SSX2B, 85915, 188365, 99-665; 17064, SSX2B, 85916, 188366, 71-742; 17064, SSX2B, 85917, 188367, 164-730; 17065, SSX3, 85920, 188370, 24-632; 17065, SSX3, 85918, 188368, 54-620; 17065, SSX3, 85919, 188369, 95-607; 17066, SSX4, 85921, 188371, 59-625; 17066, SSX4, 85922, 188372, 70-531; 17067, SSX4B, 85923, 188373, 59-625; 17067, SSX4B, 85924, 188374, 70-531; 17068, SSX5, 85928, 188378, 1-387; 17068, SSX5, 85929, 188379, 1-567; 17068, SSX5, 85925, 188375, 54-620; 17068, SSX5, 85926, 188376, 54-743; 17068, SSX5, 85927, 188377, 1-567; 17069, SSX7, 85930, 188380, 160-726; 17070, SYBU, 85939, 188389, 271-2277; 17070, SYBU, 85940, 188390, 88-575; 17070, SYBU, 85941, 188391, 161-594; 17070, SYBU, 85942, 188392, 331-559; 17070, SYBU, 85943, 188393, 272-582; 17070, SYBU, 85945, 188395, 515-1126; 17070, SYBU, 85948, 188398, 129-1730; 17070, SYBU, 85949, 188399, 354-582; 17070, SYBU, 85950, 188400, 319-558; 17070, SYBU, 85951, 188401, 414-516; 17070, SYBU, 85952, 188402, 339-559; 17070, SYBU, 85954, 188404, 159-613; 17070, SYBU, 85955, 188405, 624-1997; 17070, SYBU, 85956, 188406, 337-748; 17070, SYBU, 85957, 188407, 440-545; 17070, SYBU, 85960, 188410, 281-565; 17070, SYBU, 85961, 188411, 188-564; 17070, SYBU, 85962, 188412, 54-197; 17070, SYBU, 85963, 188413, 334-573; 17070, SYBU, 85931, 188381, 159-2150; 17070, SYBU, 85932, 188382, 729-2711; 17070, SYBU, 85933, 188383, 274-2265; 17070, SYBU, 85934, 188384, 424-2058; 17070, SYBU, 85935, 188385, 395-2386; 17070, SYBU, 85936, 188386, 363-2354; 17070, SYBU, 85937, 188387, 517-2508; 17070, SYBU, 85938, 188388, 207-2195; 17070, SYBU, 85944, 188394, 287-2275; 17070, SYBU, 85946, 188396, 311-1945; 17070, SYBU, 85947, 188397, 328-2316; 17070, SYBU, 85953, 188403, 353-2344; 17070, SYBU, 85958, 188408, 278-1912; 17070, SYBU, 85959, 188409, 248-2035; 17071, SNPH, 85964, 188414, 643-2259; 17071, SNPH, 85965, 188415, 237-1721; 17071, SNPH, 85966, 188416, 467-2083; 17072, STX10, 85967, 188417, 6-668; 17072, STX10, 85969, 188419, 169-390; 17072, STX10, 85970, 188420, 1-685; 17072, STX10, 85971, 188421, 734-907; 17072, STX10, 85972, 188422, 54-794; 17072, STX10, 85973, 188423, 115-456; 17072, STX10, 85974, 188424, 1-606; 17072, STX10, 85976, 188426, 798-1164; 17072, STX10, 85977, 188427, 1-291; 17072, STX10, 85968, 188418, 174-776; 17072, STX10, 85975, 188425, 66-815; 17073, STX11, 85978, 188428, 184-1047; 17074, STX12, 85980, 188430, 74-718; 17074, STX12, 85979, 188429, 126-956; 17075, STX16, 85981, 188431, 173-785; 17075, STX16, 85986, 188436, 1-924; 17075, STX16, 85989, 188439, 186-553; 17075, STX16, 85990, 188440, 1-660; 17075, STX16, 85991, 188441, 199-560; 17075, STX16, 85992, 188442, 1-609; 17075, STX16, 85993, 188443, 162-401; 17075, STX16, 85995, 188445, 292-432; 17075, STX16, 85996, 188446, 1-380; 17075, STX16, 85997, 188447, 281-520; 17075, STX16, 85982, 188432, 736-1662; 17075, STX16, 85983, 188433, 129-1094; 17075, STX16, 85984, 188434, 246-1064; 17075, STX16, 85985, 188435, 267-1085; 17075, STX16, 85987, 188437, 403-1317; 17075, STX16, 85988, 188438, 725-1702; 17075, STX16, 85994, 188444, 142-489; 17076, STX17, 86000, 188450, 255-377; 17076, STX17, 86001, 188451, 92-298; 17076, STX17, 86002, 188452, 99-236; 17076, STX17, 86003, 188453, 420-542; 17076, STX17, 86005, 188455, 74-499; 17076, STX17, 85998, 188448, 137-1045; 17076, STX17, 85999, 188449, 649-1557; 17076, STX17, 86004, 188454, 748-1656; 17077, STX18, 86007, 188457, 263-771; 17077, STX18, 86008, 188458, 47-973; 17077, STX18, 86006, 188456, 65-1072; 17078, STX19, 86009, 188459, 258-1142; 17079, STX1A, 86011, 188461, 27-869; 17079, STX1A, 86012, 188462, 1-783; 17079, STX1A, 86010, 188460, 28-894; 17079, STX1A, 86013, 188463, 29-784; 17080, STX1B, 86016, 188466, 1-615; 17080, STX1B, 86014, 188464, 233-1099; 17080, STX1B, 86015, 188465, 1-834; 17081, STX2, 86018, 188468, 1-337; 17081, STX2, 86017, 188467, 168-1031; 17081, STX2, 86019, 188469, 96-962; 17082, STX3, 86020, 188470, 576-1352; 17082, STX3, 86022, 188472, 1-615; 17082, STX3, 86024, 188474, 1-231; 17082, STX3, 86025, 188475, 231-362; 17082, STX3, 86026, 188476, 209-1072; 17082, STX3, 86021, 188471, 548-1417; 17082, STX3, 86023, 188473, 155-988; 17083, STX4, 86029, 188479, 46-571; 17083, STX4, 86030, 188480, 260-454; 17083, STX4, 86031, 188481, 260-454; 17083, STX4, 86032, 188482, 1-346; 17083, STX4, 86027, 188477, 316-1209; 17083, STX4, 86028, 188478, 344-1231; 17084, STX5, 86036, 188486, 1-476; 17084, STX5, 86037, 188487, 109-861; 17084, STX5, 86038, 188488, 98-343; 17084, STX5, 86039, 188489, 1-202; 17084, STX5, 86040, 188490, 118-354; 17084, STX5, 86033, 188483, 155-1222; 17084, STX5, 86034, 188484, 108-1073; 17084, STX5, 86035, 188485, 119-1024; 17085, STX6, 86041, 188491, 239-1006; 17085, STX6, 86042, 188492, 487-951; 17086, STX7, 86043, 188493, 251-970; 17086, STX7, 86044, 188494, 115-900; 17087, STX8, 86046, 188496, 157-494; 17087, STX8, 86047, 188497, 28-162; 17087, STX8, 86048, 188498, 263-640; 17087, STX8, 86049, 188499, 4-159; 17087, STX8, 86045, 188495, 429-1139; 17088, STXBP1, 86052, 188502, 1-226; 17088, STXBP1, 86053, 188503, 1-360; 17088, STXBP1, 86054, 188504, 265-572;

17088, STXBP1, 86055, 188505, 237-538; 17088, STXBP1, 86056, 188506, 227-667; 17088, STXBP1, 86057, 188507, 103-550; 17088, STXBP1, 86058, 188508, 150-578; 17088, STXBP1, 86050, 188500, 122-1906; 17088, STXBP1, 86051, 188501, 198-2009; 17089, STXBP2, 86062, 188512, 215-549; 17089, STXBP2, 86063, 188513, 46-552; 17089, STXBP2, 86064, 188514, 29-1255; 17089, STXBP2, 86065, 188515, 1-516; 17089, STXBP2, 86066, 188516, 1-661; 17089, STXBP2, 86067, 188517, 1-448; 17089, STXBP2, 86068, 188518, 330-716; 17089, STXBP2, 86069, 188519, 1-1188; 17089, STXBP2, 86070, 188520, 50-1789; 17089, STXBP2, 86059, 188509, 32-1813; 17089, STXBP2, 86060, 188510, 24-1796; 17089, STXBP2, 86061, 188511, 38-1852; 17090, STXBP3, 86071, 188521, 51-1829; 17091, STXBP4, 86074, 188524, 120-1082; 17091, STXBP4, 86075, 188525, 197-1792; 17091, STXBP4, 86076, 188526, 1-246; 17091, STXBP4, 86072, 188522, 208-1869; 17091, STXBP4, 86073, 188523, 276-1013; 17092, STXBP5, 86078, 188528, 1-521; 17092, STXBP5, 86081, 188531, 1-791; 17092, STXBP5, 86082, 188532, 109-1035; 17092, STXBP5, 86077, 188527, 1-3456; 17092, STXBP5, 86079, 188529, 1-3297; 17092, STXBP5, 86080, 188530, 109-3456; 17093, STXBP5L, 86084, 188534, 99-479; 17093, STXBP5L, 86085, 188535, 55-3063; 17093, STXBP5L, 86086, 188536, 139-3627; 17093, STXBP5L, 86087, 188537, 9-3396; 17093, STXBP5L, 86088, 188538, 30-3032; 17093, STXBP5L, 86090, 188540, 30-3110; 17093, STXBP5L, 86083, 188533, 272-3832; 17093, STXBP5L, 86089, 188539, 108-332; 17094, STXBP6, 86094, 188544, 137-334; 17094, STXBP6, 86091, 188541, 453-1085; 17094, STXBP6, 86092, 188542, 336-968; 17094, STXBP6, 86093, 188543, 716-1348; 17094, STXBP6, 86095, 188545, 139-465; 17094, STXBP6, 86096, 188546, 270-902; 17094, STXBP6, 86097, 188547, 74-706; 17095, SNTA1, 86098, 188548, 273-1790; 17096, SNTB1, 86100, 188550, 475-559; 17096, SNTB1, 86099, 188549, 416-2032; 17096, SNTB1, 86101, 188551, 301-1917; 17097, SNTB2, 86103, 188553, 1-415; 17097, SNTB2, 86104, 188554, 1-488; 17097, SNTB2, 86106, 188556, 1-149; 17097, SNTB2, 86107, 188557, 1-186; 17097, SNTB2, 86108, 188558, 21-600; 17097, SNTB2, 86109, 188559, 39-618; 17097, SNTB2, 86110, 188560, 1-194; 17097, SNTB2, 86111, 188561, 1-186; 17097, SNTB2, 86102, 188552, 39-1661; 17097, SNTB2, 86105, 188555, 21-824; 17098, SNTG1, 86113, 188563, 103-1149; 17098, SNTG1, 86115, 188565, 272-548; 17098, SNTG1, 86117, 188567, 1-361; 17098, SNTG1, 86112, 188562, 42-1484; 17098, SNTG1, 86114, 188564, 372-1925; 17098, SNTG1, 86116, 188566, 662-2215; 17098, SNTG1, 86118, 188568, 223-1665; 17098, SNTG1, 86119, 188569, 42-1595; 17099, SNTG2, 86122, 188572, 130-519; 17099, SNTG2, 86123, 188573, 130-519; 17099, SNTG2, 86124, 188574, 1-243; 17099, SNTG2, 86125, 188575, 1-693; 17099, SNTG2, 86126, 188576, 1-243; 17099, SNTG2, 86120, 188570, 130-1749; 17099, SNTG2, 86121, 188571, 59-1297; 17100, SNCA, 86135, 188585, 188-387; 17100, SNCA, 86136, 188586, 29-376; 17100, SNCA, 86138, 188588, 1-297; 17100, SNCA, 86127, 188577, 90-512; 17100, SNCA, 86128, 188578, 14-352; 17100, SNCA, 86129, 188579, 423-845; 17100, SNCA, 86130, 188580, 264-644; 17100, SNCA, 86131, 188581, 293-715; 17100, SNCA, 86132, 188582, 260-598; 17100, SNCA, 86133, 188583, 19-399; 17100, SNCA, 86134, 188584, 97-519; 17100, SNCA, 86137, 188587, 113-535; 17100, SNCA, 86139, 188589, 113-493; 17101, SNCAIP, 86143, 188593, 1-267; 17101, SNCAIP, 86145, 188595, 1-189; 17101, SNCAIP, 86146, 188596, 234-2807; 17101, SNCAIP, 86147, 188597, 126-420; 17101, SNCAIP, 86148, 188598, 1-342; 17101, SNCAIP, 86149, 188599, 83-283; 17101, SNCAIP, 86150, 188600, 266-468; 17101, SNCAIP, 86151, 188601, 207-407; 17101, SNCAIP, 86152, 188602, 139-339; 17101, SNCAIP, 86153, 188603, 105-586; 17101, SNCAIP, 86154, 188604, 1-267; 17101, SNCAIP, 86155, 188605, 95-283; 17101, SNCAIP, 86156, 188606, 319-723; 17101, SNCAIP, 86157, 188607, 1-201; 17101, SNCAIP, 86158, 188608, 518-559; 17101, SNCAIP, 86159, 188609, 207-548; 17101, SNCAIP, 86140, 188590, 1429-4479; 17101, SNCAIP, 86141, 188591, 263-3022; 17101, SNCAIP, 86142, 188592, 253-2064; 17101, SNCAIP, 86144, 188594, 1-1767; 17102, SNOB, 86164, 188614, 444-806; 17102, SNOB, 86160, 188610, 252-656; 17102, SNOB, 86161, 188611, 260-664; 17102, SNOB, 86162, 188612, 122-526; 17102, SNOB, 86163, 188613, 196-600; 17103, SNCG, 86165, 188615, 69-449; 17103, SNCG, 86166, 188616, 43-426; 17104, SYS1, 86169, 188619, 90-263; 17104, SYS1, 86170, 188620, 278-685; 17104, SYS1, 86171, 188621, 79-433; 17104, SYS1, 86167, 188617, 292-762; 17104, SYS1, 86168, 188618, 244-714; 17104, SYS1, 86172, 188622, 181-411; 17105, SYS1-DBNDD2, 86173, 188623, 120-356; 17105, SYS1-DBNDD2, 86174, 188624, 23-259; 17105, SYS1-DBNDD2, 86175, 188625, 31-324; 17106, T, 86178, 188628, 287-1497; 17106, T, 86179, 188629, 174-902; 17106, T, 86176, 188626, 470-1777; 17106, T, 86177, 188627, 458-1591; 17107, TCAIM, 86187, 188637, 120-467; 17107, TCAIM, 86180, 188630, 428-1918; 17107, TCAIM, 86181, 188631, 246-458; 17107, TCAIM, 86182, 188632, 428-640; 17107, TCAIM, 86183, 188633, 104-451; 17107, TCAIM, 86184, 188634, 123-470; 17107, TCAIM, 86185, 188635, 246-1736; 17107, TCAIM, 86186, 188636, 74-421; 17108, TIGIT, 86189, 188639, 80-587; 17108, TIGIT, 86191, 188641, 70-559; 17108, TIGIT, 86192, 188642, 2616-3551; 17108, TIGIT, 86188, 188638, 77-811; 17108, TIGIT, 86190, 188640, 258-992; 17109, TRAC, 86193, 188643, 1-425; 17109, TRAC, 86194, 188644, 109-597; 17110, TRAJ1, 86195, 188645, 1-62; 17111, TRAJ10, 86196, 188646, 1-64; 17112, TRAJ11, 86197, 188647, 1-60; 17113, TRAJ12, 86198, 188648, 1-60; 17114, TRAJ13, 86199, 188649, 1-63; 17115, TRAJ14, 86200, 188650, 1-52; 17116, TRAJ16, 86201, 188651, 1-60; 17117, TRAJ17, 86202, 188652, 1-63; 17118, TRAJ18, 86203, 188653, 1-66; 17119, TRAJ19, 86204, 188654, 1-60; 17120, TRAJ2, 86205, 188655, 1-66; 17121, TRAJ20, 86206, 188656, 1-57; 17122, TRAJ21, 86207, 188657, 1-55; 17123, TRAJ22, 86208, 188658, 1-63; 17124, TRAJ23, 86209, 188659, 1-63; 17125, TRAJ24, 86210, 188660, 1-63; 17126, TRAJ25, 86211, 188661, 1-60; 17127, TRAJ26, 86212, 188662, 1-60; 17128, TRAJ27, 86213, 188663, 1-59; 17129, TRAJ28, 86214, 188664, 1-66; 17130, TRAJ29, 86215, 188665, 1-60; 17131, TRAJ3, 86216, 188666, 1-62; 17132, TRAJ30, 86217, 188667, 1-57; 17133, TRAJ31, 86218, 188668, 1-57; 17134, TRAJ32, 86219, 188669, 1-66; 17135, TRAJ33, 86220, 188670, 1-57; 17136, TRAJ34, 86221, 188671, 1-58; 17137, TRAJ35, 86222, 188672, 1-59; 17138, TRAJ36, 86223, 188673, 1-58; 17139, TRAJ37, 86224, 188674, 1-65; 17140, TRAJ38, 86225, 188675, 1-62; 17141, TRAJ39, 86226, 188676, 1-63; 17142, TRAJ4, 86227, 188677, 1-63; 17143, TRAJ40, 86228, 188678, 1-61; 17144, TRAJ41, 86229, 188679, 1-62; 17145, TRAJ42, 86230, 188680, 1-66; 17146, TRAJ43, 86231, 188681, 1-54; 17147, TRAJ44, 86232, 188682, 1-63; 17148, TRAJ45, 86233, 188683, 1-66; 17149, TRAJ46, 86234, 188684, 1-63; 17150, TRAJ47, 86235, 188685, 1-57; 17151, TRAJ48, 86236, 188686, 1-63; 17152, TRAJ49, 86237, 188687, 1-56; 17153, TRAJ5, 86238, 188688, 1-60; 17154, TRAJ50, 86239, 188689, 1-60; 17155, TRAJ52, 86240, 188690, 1-69; 17156, TRAJ53, 86241, 188691, 1-66; 17157, TRAJ54, 86242, 188692, 1-60; 17158, TRAJ56, 86243, 188693, 1-62; 17159, TRAJ57, 86244, 188694, 1-63; 17160, TRAJ58, 86245, 188695, 1-63; 17161, TRAJ59, 86246, 188696, 1-54; 17162, TRAJ6, 86247, 188697, 1-62; 17163, TRAJ61, 86248, 188698, 1-60; 17164, TRAJ7, 86249, 188699, 1-59; 17165, TRAJ9, 86250, 188700, 1-61; 17166, TRAV10, 86251, 188701, 37-379; 17167, TRAV1-1, 86252, 188702, 67-392; 17168, TRAV1-2, 86253, 188703, 85-402; 17169, TRAV12-1, 86254, 188704, 4-340; 17170, TRAV12-2, 86255, 188705, 106-445; 17171, TRAV12-3, 86256, 188706, 57-399; 17172, TRAV13-1, 86257, 188707, 24-360; 17173, TRAV13-2, 86258, 188708, 71-410; 17174, TRAV14DV4, 86259, 188709, 76-425; 17175, TRAV16, 86260, 188710, 1-329; 17176, TRAV17, 86261, 188711, 148-484; 17177, TRAV18, 86262, 188712, 106-440; 17178, TRAV19, 86263, 188713, 118-467; 17179, TRAV2, 86264, 188714, 11-348; 17180, TRAV20, 86265, 188715, 70-406; 17181, TRAV21, 86266, 188716, 8-343; 17182, TRAV22, 86267, 188717, 134-464; 17183, TRAV23DV6, 86268, 188718, 46-409; 17184, TRAV24, 86269, 188719, 1-343; 17185, TRAV25, 86270, 188720, 77-403; 17186, TRAV26-1, 86271, 188721, 210-537; 17187, TRAV26-2, 86272, 188722, 1-327; 17188, TRAV27, 86273, 188723, 98-425; 17189, TRAV29DV5, 86274, 188724, 112-469; 17190, TRAV3, 86275, 188725, 177-519; 17191, TRAV30, 86276, 188726, 1-337; 17192, TRAV34, 86277, 188727, 13-349; 17193, TRAV36DV7, 86278, 188728, 17-356; 17194, TRAV38-1, 86279, 188729, 4-353; 17195, TRAV38-2DV8, 86280, 188730, 47-395; 17196, TRAV39, 86281, 188731, 1-331; 17197, TRAV4, 86282, 188732, 68-395; 17198, TRAV40, 86283, 188733, 1-317; 17199, TRAV41, 86284, 188734, 1-336; 17200, TRAV5, 86285, 188735, 13-352; 17201, TRAV6, 86286, 188736, 8-404; 17202, TRAV7, 86287, 188737, 1-337; 17203, TRAV8-1, 86288, 188738, 133-473; 17204, TRAV8-2, 86289, 188739, 226-566; 17205, TRAV8-3, 86290, 188740, 1-341; 17206, TRAV8-4, 86291, 188741, 129-469; 17207, TRAV8-6, 86292, 188742, 221-561; 17208, TRAV8-7, 86293, 188743, 1-341; 17209, TRAV9-1, 86294, 188744, 1-338; 17210, TRAV9-2, 86295, 188745, 57-394; 17211, TRAT1, 86297, 188747, 157-606; 17211, TRAT1, 86296, 188746, 231-791; 17212, TRBC1, 86298, 188748, 11-940; 17212, TRBC1, 86299, 188749, 11-940; 17212, TRBC1, 86300, 188750, 1-933; 17212, TRBC1, 86301, 188751, 1-533; 17212, TRBC1, 86302, 188752, 1-533; 17213, TRBC2, 86303, 188753, 1-539; 17213, TRBC2, 86304, 188754, 1-933; 17213, TRBC2, 86305, 188755, 1-936; 17213, TRBC2, 86306, 188756, 1-539; 17213, TRBC2, 86307, 188757, 1-945; 17213, TRBC2, 86308, 188758, 1-948; 17213, TRBC2, 86309, 188759, 1-942; 17214, TRBD1, 86310, 188760, 1-12; 17214, TRBD1, 86311, 188761, 1-12; 17215, TRBJ1-1, 86312, 188762, 1-48; 17215, TRBJ1-1, 86313, 188763, 1-48; 17216, TRBJ1-2, 86314, 188764, 1-48; 17216, TRBJ1-2, 86315, 188765, 1-48; 17217, TRBJ1-3, 86316, 188766, 1-50; 17217, TRBJ1-3, 86317, 188767, 1-50; 17218, TRBJ1-4, 86318, 188768, 1-51; 17218, TRBJ1-4, 86319, 188769, 1-51; 17219, TRBJ1-5, 86320, 188770, 1-50; 17219, TRBJ1-5, 86321, 188771, 1-50; 17220, TRBJ1-6, 86322, 188772, 1-53; 17220, TRBJ1-6, 86323, 188773, 1-53; 17221, TRBJ2-1, 86324, 188774, 1-50; 17221, TRBJ2-1, 86325, 188775, 1-50; 17222, TRBJ2-2, 86326, 188776, 1-51; 17222, TRBJ2-2, 86327, 188777, 1-51; 17223, TRBJ2-2P, 86328, 188778, 1-46; 17223, TRBJ2-2P, 86329, 188779, 1-46; 17224, TRBJ2-3, 86330, 188780, 1-49; 17224, TRBJ2-3, 86331, 188781, 1-49; 17225, TRBJ2-4, 86332, 188782, 1-50; 17225, TRBJ2-4, 86333, 188783, 1-50; 17226, TRBJ2-5, 86334, 188784, 1-48; 17226, TRBJ2-5, 86335, 188785, 1-48; 17227, TRBJ2-6, 86336, 188786, 1-53; 17227, TRBJ2-6, 86337, 188787, 1-53; 17228, TRBJ2-7, 86338, 188788, 1-47; 17228, TRBJ2-7, 86339, 188789, 1-47; 17229, TRBV10-1, 86340, 188790, 69-412; 17229, TRBV10-1, 86341, 188791, 69-412; 17230, TRBV10-2, 86342, 188792, 52-395; 17230, TRBV10-2, 86343, 188793, 52-395; 17231, TRBV10-3, 86344, 188794, 25-368; 17231, TRBV10-3, 86345, 188795, 1-344; 17232, TRBV11-1, 86346, 188796, 18-364; 17232, TRBV11-1, 86347, 188797, 18-364; 17233, TRBV11-3, 86348, 188798, 46-392; 17233, TRBV11-3, 86349, 188799, 46-392; 17234, TRBV12-3, 86350, 188800, 63-409; 17234, TRBV12-3, 86351, 188801, 63-409; 17235, TRBV12-4, 86352, 188802, 60-406; 17235, TRBV12-4, 86353, 188803, 60-406; 17236, TRBV12-5, 86354, 188804, 65-411; 17236, TRBV12-5, 86355, 188805, 65-411; 17237, TRBV13, 86356, 188806, 1-374; 17237, TRBV13, 86357, 188807, 1-374; 17238, TRBV14, 86358, 188808, 60-406; 17238, TRBV14, 86359, 188809, 60-406; 17239, TRBV15, 86360, 188810, 78-421; 17239, TRBV15, 86361, 188811, 78-421; 17240, TRBV16, 86362, 188812, 1-347; 17240, TRBV16, 86363, 188813, 1-347; 17241, TRBV17, 86364, 188814, 1-344; 17241, TRBV17, 86365, 188815, 1-344; 17242, TRBV18, 86366, 188816, 82-428; 17242, TRBV18, 86367, 188817, 82-428; 17243, TRBV19, 86368, 188818, 209-552; 17243, TRBV19, 86369, 188819, 209-552; 17244, TRBV2, 86370, 188820, 75-421; 17244, TRBV2, 86371, 188821, 75-421; 17245, TRBV20OR9-2, 86372, 188822, 27-416; 17246, TRBV20-1, 86373, 188823, 79-413; 17246, TRBV20-1, 86374, 188824, 79-413; 17247, TRBV21OR9-2, 86375, 188825, 1-367; 17248, TRBV23OR9-2, 86376, 188826, 1-335; 17249, TRBV23-1, 86377, 188827, 1-347; 17249, TRBV23-1, 86378, 188828, 1-347; 17250, TRBV24-1, 86379, 188829, 37-381; 17250, TRBV24-1, 86380, 188830, 37-381; 17251, TRBV25-1, 86381, 188831, 38-381; 17251, TRBV25-1, 86382, 188832, 38-381; 17252, TRBV27, 86383, 188833, 44-387; 17252, TRBV27, 86384, 188834, 44-387; 17253, TRBV28, 86385, 188835, 21-364; 17253, TRBV28, 86386, 188836, 21-364; 17254, TRBV29-1, 86387, 188837, 68-402; 17254, TRBV29-1, 86388, 188838, 68-402; 17255, TRBV30, 86389, 188839, 113-447; 17255, TRBV30, 86390, 188840, 113-447; 17256, TRBV3-1, 86391, 188841, 48-391; 17256, TRBV3-1, 86392, 188842, 48-391; 17257, TRBV4-1, 86393, 188843, 30-373; 17257, TRBV4-1, 86394, 188844, 30-373; 17258, TRBV4-2, 86395, 188845, 112-455; 17258, TRBV4-2, 86396, 188846, 112-455; 17259, TRBV4-3, 86397, 188847, 112-455; 17260, TRBV5-1, 86398, 188848, 310-652; 17260, TRBV5-1, 86399, 188849, 310-652; 17261, TRBV5-3, 86400, 188850, 1-343; 17261, TRBV5-3, 86401, 188851, 1-343; 17262, TRBV5-4, 86402, 188852, 202-544; 17262, TRBV5-4, 86403, 188853, 202-544; 17263, TRBV5-5, 86404, 188854, 8-350; 17263, TRBV5-5, 86405, 188855, 8-350; 17264, TRBV5-6, 86406, 188856, 42-384; 17264, TRBV5-6, 86407, 188857, 42-384; 17265, TRBV5-7, 86408, 188858, 1-343; 17265, TRBV5-7, 86409, 188859, 1-343; 17266, TRBV5-8, 86410, 188860, 136-478; 17267, TRBV6-1, 86411, 188861, 58-401; 17267, TRBV6-1, 86412, 188862, 58-401; 17268, TRBV6-2, 86413, 188863, 49-392; 17268, TRBV6-2, 86414, 188864, 81-424; 17269, TRBV6-3, 86415, 188865, 81-424; 17270, TRBV6-4, 86416, 188866, 22-365; 17270, TRBV6-4, 86417, 188867, 22-365; 17271, TRBV6-5, 86418, 188868, 67-410; 17271, TRBV6-5, 86419, 188869, 58-432; 17271, TRBV6-5, 86420, 188870, 67-410; 17272, TRBV6-6, 86421, 188871, 45-388; 17272, TRBV6-6, 86422, 188872, 47-390; 17273, TRBV6-7, 86423, 188873, 1-344; 17273, TRBV6-7, 86424, 188874, 43-386; 17274, TRBV6-8, 86425, 188875, 1-341; 17274, TRBV6-8, 86426, 188876, 67-407; 17275, TRBV6-9, 86427, 188877, 1-344; 17276, TRBV7-1, 86428, 188878, 34-380; 17276, TRBV7-1, 86429, 188879, 34-380; 17277, TRBV7-2, 86430, 188880, 40-386; 17277, TRBV7-2, 86431, 188881, 48-394; 17278, TRBV7-3, 86432, 188882, 51-397; 17278, TRBV7-3, 86433, 188883, 51-397; 17279, TRBV7-4, 86434, 188884, 1-347; 17279, TRBV7-4, 86435, 188885, 1-347; 17280, TRBV7-6, 86436, 188886, 46-392; 17280, TRBV7-6, 86437, 188887, 46-392; 17281, TRBV7-7, 86438, 188888, 1-347; 17281, TRBV7-7, 86439, 188889, 1-347; 17282, TRBV7-8, 86440, 188890, 1-347; 17283, TRBV7-9, 86441, 188891, 1-347; 17283, TRBV7-9, 86442, 188892, 1-347; 17284, TRBV9, 86443, 188893, 48-390; 17284, TRBV9, 86444, 188894, 48-390; 17285, TRDC, 86445, 188895, 1-464; 17286, TRDD1, 86446, 188896, 1-8; 17287, TRDD2, 86447, 188897, 1-9; 17288, TRDD3, 86448, 188898, 1-13; 17289, TRDJ1, 86449, 188899, 1-51; 17290, TRDJ2, 86450, 188900, 1-54; 17291, TRDJ3, 86451, 188901, 1-59; 17292, TRDJ4, 86452, 188902, 1-48; 17293, TRDV1, 86453, 188903, 19-365; 17293, TRDV1, 86454, 188904, 1-102; 17294, TRDV2, 86455, 188905, 176-520; 17295, TRDV3, 86456, 188906, 85-425; 17296, TRGC1, 86457, 188907, 1-521; 17297, TRGC2, 86458, 188908, 1-569; 17297, TRGC2, 86459, 188909, 37-1002; 17298, TRGJ1, 86460, 188910, 1-50; 17299, TRGJ2, 86461, 188911, 1-50; 17300, TRGJP, 86462, 188912, 1-61; 17301, TRGJP1, 86463, 188913, 1-60; 17302, TRGJP2, 86464, 188914, 1-60; 17303, TRGV1, 86465, 188915, 115-465; 17304, TRGV10, 86466, 188916, 160-512; 17305, TRGV11, 86467, 188917, 155-463; 17306, TRGV2, 86468, 188918, 191-544; 17307, TRGV3, 86469, 188919, 184-537; 17308, TRGV4, 86470, 188920, 335-688; 17309, TRGV5, 86471, 188921, 199-552; 17309, TRGV5, 86472, 188922, 188-544; 17310, TRGV8, 86473, 188923, 115-468; 17311, TRGV9, 86474, 188924, 1370-1735; 17312, TARM1, 86477, 188927, 26-841; 17312, TARM1, 86478, 188928, 26-841; 17312, TARM1, 86479, 188929, 26-841; 17312, TARM1, 86481, 188931, 26-841; 17312, TARM1, 86482, 188932, 26-841; 17312, TARM1, 86485, 188935, 26-841; 17312, TARM1, 86486, 188936, 271-1110; 17312, TARM1, 86475, 188925, 26-841; 17312, TARM1, 86476, 188926, 287-1126; 17312, TARM1, 86480, 188930, 26-841; 17312, TARM1, 86483, 188933, 26-841; 17312, TARM1, 86484, 188934, 26-841; 17313, TAC3, 86487, 188937, 140-505; 17313, TAC3, 86488, 188938, 158-565; 17313, TAC3, 86489, 188939, 140-451; 17313, TAC3, 86490, 188940, 140-547; 17313, TAC3, 86491, 188941, 222-587; 17313, TAC3, 86492, 188942, 161-526; 17313, TAC3, 86493, 188943, 140-547; 17313, TAC3, 86494, 188944, 140-451; 17313, TAC3, 86495, 188945, 140-451; 17313, TAC3, 86496, 188946, 140-505; 17314, TAC4, 86502, 188952, 1-162; 17314, TAC4, 86497, 188947, 1-264; 17314, TAC4, 86498, 188948, 1-342; 17314, TAC4, 86499, 188949, 1-231; 17314, TAC4, 86500, 188950, 1-291; 17314, TAC4, 86501, 188951, 1-324; 17315, TACR1, 86503, 188953, 767-1990; 17315, TACR1, 86504, 188954, 124-1059; 17316, TACR2, 86506, 188956, 257-817; 17316, TACR2, 86507, 188957, 1-1089; 17316, TACR2, 86505, 188955, 545-1741; 17317, TACR3, 86508, 188958, 142-1539; 17318, TAC1, 86509, 188959, 122-466; 17318, TAC1, 86510, 188960, 122-457; 17318, TAC1, 86511, 188961, 298-687; 17319, TAF1L, 86512, 188962, 91-5571; 17320, TAF1, 86514, 188964, 1-1376; 17320, TAF1, 86516, 188966, 1-1472; 17320, TAF1, 86518, 188968, 1-452; 17320, TAF1, 86519, 188969, 1-836; 17320, TAF1, 86513, 188963, 11-5692; 17320, TAF1, 86515, 188965, 52-5670; 17320, TAF1, 86517, 188967, 77-5764; 17321, TAF10, 86521, 188971, 1-348; 17321, TAF10, 86520, 188970, 479-1135; 17322, TAF11, 86522, 188972, 133-768; 17322, TAF11, 86523, 188973, 115-579; 17323, TAF12, 86524, 188974, 436-921; 17323, TAF12, 86525, 188975, 160-645; 17324, TAF13, 86526, 188976, 56-430; 17324, TAF13, 86527, 188977, 25-399; 17325, TAF15, 86528, 188978, 1-309; 17325, TAF15, 86530, 188980, 452-547; 17325, TAF15, 86531, 188981, 530-1879; 17325, TAF15, 86533, 188983, 400-765; 17325, TAF15, 86534, 188984, 90-808; 17325, TAF15, 86535, 188985, 1-644; 17325, TAF15, 86537, 188987, 452-547; 17325, TAF15, 86538, 188988, 400-765; 17325, TAF15, 86539, 188989, 1-309; 17325, TAF15, 86540, 188990, 1-644; 17325, TAF15, 86541, 188991, 90-808; 17325, TAF15, 86543, 188993, 530-1879; 17325, TAF15, 86529, 188979, 116-1894; 17325, TAF15, 86532, 188982, 82-1851; 17325, TAF15, 86536, 188986, 116-1894; 17325, TAF15, 86542, 188992, 82-1851; 17326, TAF2, 86545, 188995, 271-453; 17326, TAF2, 86546, 188996, 1-202; 17326, TAF2, 86547, 188997, 1-855; 17326, TAF2, 86548, 188998, 1-1128; 17326, TAF2, 86544, 188994, 300-3899; 17327, TAF3, 86549, 188999, 207-2996; 17328, TAF4, 86551, 189001, 1-238; 17328, TAF4, 86552, 189002, 1-645; 17328, TAF4, 86553, 189003, 1-645; 17328, TAF4, 86554, 189004, 1-238; 17328, TAF4, 86555, 189005, 1-1374; 17328, TAF4, 86550, 189000, 1-3258; 17329, TAF4B, 86557, 189007, 490-3087; 17329, TAF4B, 86559, 189009, 449-3052; 17329, TAF4B, 86556, 189006, 999-3587; 17329, TAF4B, 86558, 189008, 52-1908; 17330, TAF5, 86560, 189010, 24-2426; 17331, TAF5L, 86562, 189012, 167-421; 17331, TAF5L, 86561, 189011, 167-1936; 17331, TAF5L, 86563, 189013, 90-1067; 17331, TAF5L, 86564, 189014, 1-1770; 17332, TAF6, 86567, 189017, 211-612; 17332, TAF6, 86568, 189018, 309-537; 17332, TAF6, 86569, 189019, 281-321; 17332, TAF6, 86571, 189021, 361-703; 17332, TAF6, 86572, 189022, 174-871; 17332, TAF6, 86573, 189023, 96-563; 17332, TAF6, 86574, 189024, 540-884; 17332, TAF6, 86576, 189026, 169-934; 17332, TAF6, 86577, 189027, 179-2383; 17332, TAF6, 86578, 189028, 444-471; 17332, TAF6, 86579, 189029, 206-546; 17332, TAF6, 86580, 189030, 328-751; 17332, TAF6, 86565, 189015, 527-2560; 17332, TAF6, 86566, 189016, 255-2288; 17332, TAF6, 86570, 189020, 96-2240; 17332, TAF6, 86575, 189025, 96-2129; 17333, TAF6L, 86582, 189032, 93-528; 17333, TAF6L, 86583, 189033, 269-419; 17333, TAF6L, 86584, 189034, 138-329; 17333, TAF6L, 86581, 189031, 202-2070; 17334, TAF7, 86586, 189036, 459-603; 17334, TAF7, 86585, 189035, 778-1827; 17335, TAF7L, 86587, 189037, 263-1171; 17335, TAF7L, 86588, 189038, 116-1246; 17335, TAF7L, 86589, 189039, 13-1401; 17336, TAF8, 86591, 189041, 30-554; 17336, TAF8, 86594, 189044, 373-555; 17336, TAF8, 86595, 189045, 19-390; 17336, TAF8, 86597, 189047, 421-1125; 17336, TAF8, 86590, 189040, 19-951; 17336, TAF8, 86592, 189042, 21-1037; 17336, TAF8, 86593, 189043, 21-956; 17336, TAF8, 86596, 189046, 21-1037; 17337, TAF9, 86601, 189051, 202-582; 17337, TAF9, 86602, 189052, 374-966; 17337, TAF9, 86603, 189053, 182-588; 17337, TAF9, 86604, 189054, 263-761; 17337, TAF9, 86605, 189055, 752-1057; 17337, TAF9, 86606, 189056, 339-848; 17337, TAF9, 86607, 189057, 31-456; 17337, TAF9, 86608, 189058, 53-571; 17337, TAF9, 86609, 189059, 14-157; 17337, TAF9, 86610, 189060, 1-330; 17337, TAF9, 86598, 189048, 291-1085;

17337, TAF9, 86599, 189049, 468-1262; 17337, TAF9, 86600, 189050, 337-1131; 17338, TAF9B, 86611, 189061, 96-851; 17339, TAZ, 86612, 189062, 86-874; 17339, TAZ, 86613, 189063, 15-567; 17339, TAZ, 86614, 189064, 1-104; 17339, TAZ, 86618, 189068, 271-558; 17339, TAZ, 86619, 189069, 284-571; 17339, TAZ, 86621, 189071, 283-570; 17339, TAZ, 86622, 189072, 289-877; 17339, TAZ, 86623, 189073, 304-815; 17339, TAZ, 86615, 189065, 304-1140; 17339, TAZ, 86616, 189066, 289-1167; 17339, TAZ, 86617, 189067, 304-1050; 17339, TAZ, 86620, 189070, 289-1077; 17340, TLN1, 86624, 189074, 355-7980; 17341, TLN2, 86627, 189077, 1-4416; 17341, TLN2, 86628, 189078, 254-1246; 17341, TLN2, 86625, 189075, 1-7629; 17341, TLN2, 86626, 189076, 231-7859; 17342, TAMM41, 86631, 189081, 250-573; 17342, TAMM41, 86632, 189082, 257-712; 17342, TAMM41, 86634, 189084, 1-167; 17342, TAMM41, 86635, 189085, 246-701; 17342, TAMM41, 86636, 189086, 257-712; 17342, TAMM41, 86637, 189087, 246-701; 17342, TAMM41, 86638, 189088, 250-573; 17342, TAMM41, 86639, 189089, 1-167; 17342, TAMM41, 86640, 189090, 137-844; 17342, TAMM41, 86641, 189091, 144-851; 17342, TAMM41, 86642, 189092, 284-991; 17342, TAMM41, 86643, 189093, 284-607; 17342, TAMM41, 86629, 189079, 284-1234; 17342, TAMM41, 86630, 189080, 144-1502; 17342, TAMM41, 86633, 189083, 137-1150; 17343, TC2N, 86647, 189097, 1-729; 17343, TC2N, 86652, 189102, 1-729; 17343, TC2N, 86644, 189094, 315-1787; 17343, TC2N, 86645, 189095, 134-1606; 17343, TC2N, 86646, 189096, 325-1797; 17343, TC2N, 86648, 189098, 213-1493; 17343, TC2N, 86649, 189099, 315-1787; 17343, TC2N, 86650, 189100, 57-1529; 17343, TC2N, 86651, 189101, 134-1606; 17343, TC2N, 86653, 189103, 213-1493; 17344, TBK1, 86655, 189105, 275-419; 17344, TBK1, 86656, 189106, 220-513; 17344, TBK1, 86657, 189107, 238-547; 17344, TBK1, 86654, 189104, 340-2529; 17345, TNKS1BP1, 86659, 189109, 179-910; 17345, TNKS1BP1, 86660, 189110, 165-594; 17345, TNKS1BP1, 86658, 189108, 154-5343; 17345, TNKS1BP1, 86661, 189111, 313-5502; 17346, TNKS, 86663, 189113, 1-186; 17346, TNKS, 86664, 189114, 27-1880; 17346, TNKS, 86665, 189115, 432-3704; 17346, TNKS, 86666, 189116, 9-740; 17346, TNKS, 86667, 189117, 1-207; 17346, TNKS, 86662, 189112, 27-4010; 17347, TNKS2, 86668, 189118, 380-3880; 17348, TAOK1, 86671, 189121, 289-526; 17348, TAOK1, 86669, 189119, 520-3525; 17348, TAOK1, 86670, 189120, 189-2750; 17349, TAOK2, 86672, 189122, 404-3553; 17349, TAOK2, 86673, 189123, 1044-4751; 17349, TAOK2, 86674, 189124, 1174-4362; 17349, TAOK2, 86675, 189125, 503-3871; 17350, TAOK3, 86678, 189128, 1-555; 17350, TAOK3, 86679, 189129, 539-594; 17350, TAOK3, 86680, 189130, 603-881; 17350, TAOK3, 86681, 189131, 556-597; 17350, TAOK3, 86682, 189132, 442-613; 17350, TAOK3, 86683, 189133, 534-641; 17350, TAOK3, 86684, 189134, 408-689; 17350, TAOK3, 86685, 189135, 527-590; 17350, TAOK3, 86686, 189136, 190-597; 17350, TAOK3, 86687, 189137, 466-580; 17350, TAOK3, 86688, 189138, 791-2107; 17350, TAOK3, 86689, 189139, 394-578; 17350, TAOK3, 86676, 189126, 492-3188; 17350, TAOK3, 86677, 189127, 409-3105; 17351, TAPBP, 86690, 189140, 211-1611; 17351, TAPBP, 86692, 189142, 172-1686; 17351, TAPBP, 86694, 189144, 211-1611; 17351, TAPBP, 86698, 189148, 347-817; 17351, TAPBP, 86699, 189149, 211-1611; 17351, TAPBP, 86700, 189150, 6-612; 17351, TAPBP, 86702, 189152, 6-612; 17351, TAPBP, 86704, 189154, 211-1611; 17351, TAPBP, 86705, 189155, 172-1686; 17351, TAPBP, 86707, 189157, 6-612; 17351, TAPBP, 86708, 189158, 6-612; 17351, TAPBP, 86709, 189159, 175-751; 17351, TAPBP, 86710, 189160, 211-1611; 17351, TAPBP, 86711, 189161, 214-1299; 17351, TAPBP, 86712, 189162, 204-674; 17351, TAPBP, 86713, 189163, 347-1432; 17351, TAPBP, 86714, 189164, 130-1476; 17351, TAPBP, 86715, 189165, 347-817; 17351, TAPBP, 86716, 189166, 130-1476; 17351, TAPBP, 86717, 189167, 130-1476; 17351, TAPBP, 86691, 189141, 347-1693; 17351, TAPBP, 86693, 189143, 347-1693; 17351, TAPBP, 86695, 189145, 172-1686; 17351, TAPBP, 86696, 189146, 347-1693; 17351, TAPBP, 86697, 189147, 172-1686; 17351, TAPBP, 86701, 189151, 347-1693; 17351, TAPBP, 86703, 189153, 347-1693; 17351, TAPBP, 86706, 189156, 172-1686; 17352, TAPBPL, 86719, 189169, 178-735; 17352, TAPBPL, 86718, 189168, 166-1572; 17353, TPRN, 86720, 189170, 1-1614; 17353, TPRN, 86721, 189171, 88-2223; 17354, TARBP1, 86722, 189172, 1-4866; 17355, TARBP2, 86726, 189176, 129-407; 17355, TARBP2, 86727, 189177, 1-682; 17355, TARBP2, 86728, 189178, 104-388; 17355, TARBP2, 86729, 189179, 171-759; 17355, TARBP2, 86730, 189180, 115-381; 17355, TARBP2, 86731, 189181, 116-679; 17355, TARBP2, 86732, 189182, 136-633; 17355, TARBP2, 86733, 189183, 489-830; 17355, TARBP2, 86734, 189184, 187-668; 17355, TARBP2, 86723, 189173, 484-1584; 17355, TARBP2, 86724, 189174, 101-1138; 17355, TARBP2, 86725, 189175, 55-1092; 17356, TARDBP, 86736, 189186, 13-900; 17356, TARDBP, 86737, 189187, 104-358; 17356, TARDBP, 86738, 189188, 13-909; 17356, TARDBP, 86739, 189189, 103-345; 17356, TARDBP, 86740, 189190, 98-701; 17356, TARDBP, 86741, 189191, 1-196; 17356, TARDBP, 86742, 189192, 103-929; 17356, TARDBP, 86743, 189193, 1-51; 17356, TARDBP, 86744, 189194, 1-107; 17356, TARDBP, 86745, 189195, 1-638; 17356, TARDBP, 86746, 189196, 1-347; 17356, TARDBP, 86747, 189197, 1-415; 17356, TARDBP, 86748, 189198, 87-816; 17356, TARDBP, 86749, 189199, 1-448; 17356, TARDBP, 86750, 189200, 1-602; 17356, TARDBP, 86751, 189201, 1-528; 17356, TARDBP, 86752, 189202, 1-915; 17356, TARDBP, 86753, 189203, 1-384; 17356, TARDBP, 86754, 189204, 1-236; 17356, TARDBP, 86755, 189205, 1-906; 17356, TARDBP, 86756, 189206, 135-1031; 17356, TARDBP, 86735, 189185, 357-1601; 17357, TOE1, 86757, 189207, 584-2116; 17358, TOM1L1, 86759, 189209, 115-1512; 17358, TOM1L1, 86761, 189211, 14-205; 17358, TOM1L1, 86763, 189213, 1-754; 17358, TOM1L1, 86765, 189215, 248-567; 17358, TOM1L1, 86766, 189216, 145-261; 17358, TOM1L1, 86767, 189217, 21-708; 17358, TOM1L1, 86768, 189218, 4-282; 17358, TOM1L1, 86769, 189219, 133-810; 17358, TOM1L1, 86771, 189221, 1-596; 17358, TOM1L1, 86772, 189222, 31-1440; 17358, TOM1L1, 86773, 189223, 191-556; 17358, TOM1L1, 86774, 189224, 100-1080; 17358, TOM1L1, 86775, 189225, 1-377; 17358, TOM1L1, 86758, 189208, 207-1406; 17358, TOM1L1, 86760, 189210, 81-1280; 17358, TOM1L1, 86762, 189212, 1320-2360; 17358, TOM1L1, 86764, 189214, 10-1050; 17358, TOM1L1, 86770, 189220, 354-1784; 17359, TOM1L2, 86779, 189229, 85-1254; 17359, TOM1L2, 86781, 189231, 88-1254; 17359, TOM1L2, 86784, 189234, 1-120; 17359, TOM1L2, 86785, 189235, 204-453; 17359, TOM1L2, 86776, 189226, 85-1473; 17359, TOM1L2, 86777, 189227, 85-1608; 17359, TOM1L2, 86778, 189228, 92-1480; 17359, TOM1L2, 86780, 189230, 108-1559; 17359, TOM1L2, 86782, 189232, 566-1288; 17359, TOM1L2, 86783, 189233, 98-1471; 17360, TOM1, 86786, 189236, 61-690; 17360, TOM1, 86787, 189237, 40-441; 17360, TOM1, 86788, 189238, 74-283; 17360, TOM1, 86789, 189239, 114-567; 17360, TOM1, 86790, 189240, 36-329; 17360,

TOM1, 86791, 189241, 130-1133; 17360, TOM1, 86794, 189244, 56-307; 17360, TOM1, 86795, 189245, 46-123; 17360, TOM1, 86798, 189248, 152-553; 17360, TOM1, 86799, 189249, 167-541; 17360, TOM1, 86792, 189242, 126-1604; 17360, TOM1, 86793, 189243, 126-1469; 17360, TOM1, 86796, 189246, 152-1534; 17360, TOM1, 86797, 189247, 126-1607; 17361, TASP1, 86801, 189251, 1-332; 17361, TASP1, 86802, 189252, 85-1000; 17361, TASP1, 86800, 189250, 122-1384; 17362, TAS1R1, 86804, 189254, 12-926; 17362, TAS1R1, 86806, 189256, 1-740; 17362, TAS1R1, 86807, 189257, 1-1220; 17362, TAS1R1, 86803, 189253, 66-1829; 17362, TAS1R1, 86805, 189255, 194-2719; 17363, TAS1R2, 86808, 189258, 23-2542; 17364, TAS1R3, 86809, 189259, 33-2591; 17365, TAS2R1, 86811, 189261, 271-454; 17365, TAS2R1, 86812, 189262, 288-754; 17365, TAS2R1, 86810, 189260, 324-1223; 17366, TAS2R10, 86813, 189263, 90-1013; 17366, TAS2R10, 86814, 189264, 90-1013; 17366, TAS2R10, 86815, 189265, 90-1013; 17367, TAS2R13, 86816, 189266, 265-1176; 17367, TAS2R13, 86817, 189267, 265-1176; 17367, TAS2R13, 86818, 189268, 265-1176; 17368, TAS2R14, 86819, 189269, 57-1010; 17368, TAS2R14, 86820, 189270, 57-1010; 17368, TAS2R14, 86821, 189271, 57-1010; 17369, TAS2R16, 86822, 189272, 67-942; 17370, TAS2R19, 86825, 189275, 1-960; 17370, TAS2R19, 86826, 189276, 50-949; 17370, TAS2R19, 86823, 189273, 50-949; 17370, TAS2R19, 86824, 189274, 50-949; 17371, TAS2R20, 86829, 189279, 1-930; 17371, TAS2R20, 86827, 189277, 1-930; 17371, TAS2R20, 86828, 189278, 1-930; 17372, TAS2R3, 86830, 189280, 63-1013; 17373, TAS2R30, 86833, 189283, 1-927; 17373, TAS2R30, 86834, 189284, 1-927; 17373, TAS2R30, 86835, 189285, 1-960; 17373, TAS2R30, 86831, 189281, 401-1360; 17373, TAS2R30, 86832, 189282, 401-1360; 17374, TAS2R31, 86838, 189288, 57-956; 17374, TAS2R31, 86839, 189289, 73-1002; 17374, TAS2R31, 86836, 189286, 73-1002; 17374, TAS2R31, 86837, 189287, 73-1002; 17375, TAS2R38, 86840, 189290, 85-1086; 17376, TAS2R39, 86841, 189291, 1-1017; 17377, TAS2R4, 86842, 189292, 48-947; 17378, TAS2R40, 86843, 189293, 43-1014; 17379, TAS2R41, 86844, 189294, 1-924; 17380, TAS2R42, 86846, 189296, 1-945; 17380, TAS2R42, 86845, 189295, 1-945; 17381, TAS2R43, 86849, 189299, 1-930; 17381, TAS2R43, 86850, 189300, 1-930; 17381, TAS2R43, 86851, 189301, 1-900; 17381, TAS2R43, 86847, 189297, 85-1014; 17381, TAS2R43, 86848, 189298, 85-1014; 17382, TAS2R46, 86854, 189304, 1-933; 17382, TAS2R46, 86855, 189305, 1-960; 17382, TAS2R46, 86856, 189306, 73-999; 17382, TAS2R46, 86857, 189307, 1-750; 17382, TAS2R46, 86852, 189302, 1-930; 17382, TAS2R46, 86853, 189303, 1-930; 17383, TAS2R5, 86858, 189308, 146-1045; 17384, TAS2R50, 86859, 189309, 53-952; 17384, TAS2R50, 86860, 189310, 53-952; 17384, TAS2R50, 86861, 189311, 53-952; 17385, TAS2R60, 86862, 189312, 1-957; 17386, TAS2R7, 86863, 189313, 58-1014; 17386, TAS2R7, 86864, 189314, 58-1014; 17386, TAS2R7, 86865, 189315, 58-1014; 17387, TAS2R8, 86866, 189316, 314-1243; 17387, TAS2R8, 86867, 189317, 314-1243; 17387, TAS2R8, 86868, 189318, 314-1243; 17388, TAS2R9, 86869, 189319, 94-1032; 17388, TAS2R9, 86870, 189320, 94-1032; 17388, TAS2R9, 86871, 189321, 94-1032; 17389, TBP, 86874, 189324, 311-935; 17389, TBP, 86875, 189325, 1-304; 17389, TBP, 86876, 189326, 252-703; 17389, TBP, 86878, 189328, 280-1146; 17389, TBP, 86872, 189322, 237-1256; 17389, TBP, 86873, 189323, 280-1299; 17389, TBP, 86877, 189327, 138-1097; 17390, TAF1A, 86882, 189332, 36-894; 17390, TAF1A, 86879, 189329, 190-1542; 17390, TAF1A, 86880, 189330, 210-1562; 17390, TAF1A, 86881, 189331, 234-1244; 17391, TAF1B, 86884, 189334, 16-189; 17391, TAF1B, 86885, 189335, 18-602; 17391, TAF1B, 86886, 189336, 1-649; 17391, TAF1B, 86887, 189337, 100-273; 17391, TAF1B, 86883, 189333, 189-1955; 17392, TAF1C, 86890, 189340, 218-376; 17392, TAF1C, 86891, 189341, 165-602; 17392, TAF1C, 86894, 189344, 289-465; 17392, TAF1C, 86896, 189346, 290-570; 17392, TAF1C, 86897, 189347, 1-1140; 17392, TAF1C, 86898, 189348, 154-783; 17392, TAF1C, 86899, 189349, 184-396; 17392, TAF1C, 86900, 189350, 147-555; 17392, TAF1C, 86888, 189338, 262-2589; 17392, TAF1C, 86889, 189339, 795-2408; 17392, TAF1C, 86892, 189342, 643-2256; 17392, TAF1C, 86893, 189343, 184-2793; 17392, TAF1C, 86895, 189345, 212-2743; 17393, TAF1D, 86902, 189352, 1-135; 17393, TAF1D, 86904, 189354, 1-332; 17393, TAF1D, 86905, 189355, 312-335; 17393, TAF1D, 86906, 189356, 186-833; 17393, TAF1D, 86908, 189358, 187-297; 17393, TAF1D, 86909, 189359, 1-129; 17393, TAF1D, 86910, 189360, 1-79; 17393, TAF1D, 86901, 189351, 201-1037; 17393, TAF1D, 86903, 189353, 652-1488; 17393, TAF1D, 86907, 189357, 200-1036; 17394, TBPL2, 86912, 189362, 493-559; 17394, TBPL2, 86911, 189361, 72-1199; 17395, TMF1, 86914, 189364, 205-2532; 17395, TMF1, 86915, 189365, 1-3279; 17395, TMF1, 86913, 189363, 218-3499; 17396, TATDN1, 86917, 189367, 413-692; 17396, TATDN1, 86918, 189368, 262-591; 17396, TATDN1, 86920, 189370, 49-171; 17396, TATDN1, 86921, 189371, 43-666; 17396, TATDN1, 86922, 189372, 27-197; 17396, TATDN1, 86923, 189373, 64-186; 17396, TATDN1, 86924, 189374, 178-810; 17396, TATDN1, 86925, 189375, 25-990; 17396, TATDN1, 86926, 189376, 1-604; 17396, TATDN1, 86927, 189377, 188-376; 17396, TATDN1, 86928, 189378, 33-260; 17396, TATDN1, 86929, 189379, 37-669; 17396, TATDN1, 86930, 189380, 91-822; 17396, TATDN1, 86916, 189366, 39-932; 17396, TATDN1, 86919, 189369, 56-808; 17397, TATDN2, 86932, 189382, 1-549; 17397, TATDN2, 86931, 189381, 1052-3337; 17397, TATDN2, 86933, 189383, 163-2448; 17398, TATDN3, 86937, 189387, 1-433; 17398, TATDN3, 86938, 189388, 1-125; 17398, TATDN3, 86939, 189389, 72-257; 17398, TATDN3, 86940, 189390, 1-182; 17398, TATDN3, 86942, 189392, 64-547; 17398, TATDN3, 86943, 189393, 12-317; 17398, TATDN3, 86945, 189395, 17-592; 17398, TATDN3, 86946, 189396, 1-95; 17398, TATDN3, 86934, 189384, 39-860; 17398, TATDN3, 86935, 189385, 95-919; 17398, TATDN3, 86936, 189386, 95-940; 17398, TATDN3, 86941, 189391, 39-761; 17398, TATDN3, 86944, 189394, 53-814; 17399, TTBK1, 86948, 189398, 163-2168; 17399, TTBK1, 86947, 189397, 84-4049; 17400, TTBK2, 86950, 189400, 269-520; 17400, TTBK2, 86951, 189401, 392-743; 17400, TTBK2, 86953, 189403, 128-556; 17400, TTBK2, 86954, 189404, 393-1724; 17400, TTBK2, 86955, 189405, 499-5448; 17400, TTBK2, 86949, 189399, 110-3844; 17400, TTBK2, 86952, 189402, 440-1876; 17401, TAX1BP1, 86958, 189408, 136-2577; 17401, TAX1BP1, 86959, 189409, 131-406; 17401, TAX1BP1, 86961, 189411, 275-570; 17401, TAX1BP1, 86962, 189412, 228-641; 17401, TAX1BP1, 86963, 189413, 1-981; 17401, TAX1BP1, 86965, 189415, 1-429; 17401, TAX1BP1, 86956, 189406, 183-2426; 17401, TAX1BP1, 86957, 189407, 89-2458; 17401, TAX1BP1, 86960, 189410, 466-2238; 17401, TAX1BP1, 86964, 189414, 186-2429; 17402, TAX1BP3, 86967, 189417, 154-450; 17402, TAX1BP3, 86966, 189416, 157-531; 17403, TXLNA, 86968, 189418, 282-1922; 17403, TXLNA, 86969, 189419, 124-1764; 17404, TXLNB, 86971, 189421, 1-398; 17404, TXLNB, 86970, 189420, 234-2288; 17405, TXLNG, 86972, 189422, 62-1648; 17405, TXLNG, 86973, 189423, 57-1247; 17406, TLDC1, 86975, 189425, 263-844; 17406, TLDC1, 86976, 189426, 116-289; 17406, TLDC1, 86977, 189427, 417-552; 17406, TLDC1, 86978, 189428, 309-557; 17406, TLDC1, 86979, 189429, 114-557; 17406, TLDC1, 86974, 189424, 184-1554; 17407, TLDC2, 86981, 189431, 1-84; 17407, TLDC2, 86980, 189430, 45-692; 17407, TLDC2, 86982, 189432, 55-702; 17408, TBC1D1, 86984, 189434, 344-778; 17408, TBC1D1, 86985, 189435, 191-1987; 17408, TBC1D1, 86986, 189436, 1-755; 17408, TBC1D1, 86987, 189437, 1-679; 17408, TBC1D1, 86988, 189438, 1-2569; 17408, TBC1D1, 86990, 189440, 1-530; 17408, TBC1D1, 86991, 189441, 677-1975; 17408, TBC1D1, 86983, 189433, 356-3862; 17408, TBC1D1, 86989, 189439, 356-3835; 17409, TBCK, 86997, 189447, 370-848; 17409, TBCK, 86998, 189448, 309-770; 17409, TBCK, 86999, 189449, 1-419; 17409, TBCK, 87000, 189450, 1-256; 17409, TBCK, 87001, 189451, 376-579; 17409, TBCK, 87002, 189452, 433-601; 17409, TBCK, 87003, 189453, 286-600; 17409, TBCK, 87004, 189454, 1-73; 17409, TBCK, 86992, 189442, 449-3130; 17409, TBCK, 86993, 189443, 330-2822; 17409, TBCK, 86994, 189444, 306-2870; 17409, TBCK, 86995, 189445, 366-3047; 17409, TBCK, 86996, 189446, 187-2868; 17410, TBC1D10A, 87006, 189456, 116-578; 17410, TBC1D10A, 87008, 189458, 204-1466; 17410, TBC1D10A, 87009, 189459, 67-354; 17410, TBC1D10A, 87010, 189460, 170-1060; 17410, TBC1D10A, 87005, 189455, 166-1692; 17410, TBC1D10A, 87007, 189457, 21-1568; 17411, TBC1D10B, 87012, 189462, 1-555; 17411, TBC1D10B, 87011, 189461, 82-2508; 17412, TBC1D10C, 87015, 189465, 75-734; 17412, TBC1D10C, 87013, 189463, 17-949; 17412, TBC1D10C, 87014, 189464, 39-971; 17412, TBC1D10C, 87016, 189466, 15-1355; 17413, TBC1D12, 87017, 189467, 111-2438; 17414, TBC1D13, 87018, 189468, 6-833; 17414, TBC1D13, 87019, 189469, 151-1353; 17415, TBC1D14, 87020, 189470, 82-1479; 17415, TBC1D14, 87023, 189473, 1-602; 17415, TBC1D14, 87025, 189475, 235-1296; 17415, TBC1D14, 87026, 189476, 372-541; 17415, TBC1D14, 87027, 189477, 282-663; 17415, TBC1D14, 87021, 189471, 125-2206; 17415, TBC1D14, 87022, 189472, 186-1427; 17415, TBC1D14, 87024, 189474, 80-2161; 17416, TBC1D15, 87029, 189479, 24-173; 17416, TBC1D15, 87030, 189480, 390-1223; 17416, TBC1D15, 87031, 189481, 24-398; 17416, TBC1D15, 87032, 189482, 24-281; 17416, TBC1D15, 87033, 189483, 20-238; 17416, TBC1D15, 87036, 189486, 504-863; 17416, TBC1D15, 87028, 189478, 92-2140; 17416, TBC1D15, 87034, 189484, 24-2048; 17416, TBC1D15, 87035, 189485, 65-2140; 17417, TBC1D16, 87039, 189489, 119-683; 17417, TBC1D16, 87040, 189490, 74-913; 17417, TBC1D16, 87042, 189492, 176-567; 17417, TBC1D16, 87043, 189493, 116-685; 17417, TBC1D16, 87045, 189495, 1-770; 17417, TBC1D16, 87037, 189487, 117-2420; 17417, TBC1D16, 87038, 189488, 76-1293; 17417, TBC1D16, 87041, 189491, 68-904; 17417, TBC1D16, 87044, 189494, 97-1275; 17418, TBC1D17, 87048, 189498, 23-250; 17418, TBC1D17, 87049, 189499, 1-1035; 17418, TBC1D17, 87050, 189500, 1-1441; 17418, TBC1D17, 87051, 189501, 1347-1973; 17418, TBC1D17, 87046, 189496, 300-2246; 17418, TBC1D17, 87047, 189497, 59-1906; 17419, TBC1D19, 87053, 189503, 106-774; 17419, TBC1D19, 87054, 189504, 364-567; 17419, TBC1D19, 87055, 189505, 229-580; 17419, TBC1D19, 87057, 189507, 111-912; 17419, TBC1D19, 87052, 189502, 279-1859; 17419, TBC1D19, 87056, 189506, 1-1386; 17420, TBC1D2, 87058, 189508, 562-2694; 17420, TBC1D2, 87059, 189509, 339-1745; 17420, TBC1D2, 87060, 189510, 40-2622; 17420, TBC1D2, 87061, 189511, 93-2846; 17420, TBC1D2, 87062, 189512, 181-2967; 17421, TBC1D20, 87063, 189513, 149-1360; 17421, TBC1D20, 87064, 189514, 127-1338; 17422, TBC1D21, 87067, 189517, 65-964; 17422, TBC1D21, 87065, 189515, 84-1094; 17422, TBC1D21, 87066, 189516, 103-1005; 17423, TBC1D22A, 87070, 189520, 398-1861; 17423, TBC1D22A, 87071, 189521, 105-818; 17423, TBC1D22A, 87072, 189522, 116-1492; 17423, TBC1D22A, 87074, 189524, 137-313; 17423, TBC1D22A, 87068, 189518, 167-1720; 17423, TBC1D22A, 87069, 189519, 107-1426; 17423, TBC1D22A, 87073, 189523, 389-1801; 17423, TBC1D22A, 87075, 189525, 755-1729; 17424, TBC1D22B, 87076, 189526, 147-1664; 17425, TBC1D23, 87079, 189529, 20-587; 17425, TBC1D23, 87080, 189530, 363-2051; 17425, TBC1D23, 87081, 189531, 47-559; 17425, TBC1D23, 87077, 189527, 19-2073; 17425, TBC1D23, 87078, 189528, 8-2107; 17426, TBC1D24, 87084, 189534, 1-60; 17426, TBC1D24, 87085, 189535, 1-208; 17426, TBC1D24, 87086, 189536, 184-344; 17426, TBC1D24, 87088, 189538, 195-1214; 17426, TBC1D24, 87082, 189532, 134-1813; 17426, TBC1D24, 87083, 189533, 141-1802; 17426, TBC1D24, 87087, 189537, 226-1887; 17427, TBC1D25, 87090, 189540, 1-691; 17427, TBC1D25, 87089, 189539, 342-2408; 17427, TBC1D25, 87091, 189541, 62-364; 17428, TBC1D26, 87093, 189543, 251-1003; 17428, TBC1D26, 87097, 189547, 413-570; 17428, TBC1D26, 87098, 189548, 451-648; 17428, TBC1D26, 87099, 189549, 499-539; 17428, TBC1D26, 87100, 189550, 507-553; 17428, TBC1D26, 87094, 189544, 245-997; 17428, TBC1D26, 87096, 189546, 245-877; 17428, TBC1D26, 87101, 189551, 413-1045; 17428, TBC1D26, 87092, 189542, 80-1615; 17428, TBC1D26, 87095, 189545, 320-1885; 17429, TBC1D28, 87104, 189554, 451-647; 17429, TBC1D28, 87105, 189555, 499-539; 17429, TBC1D28, 87106, 189556, 413-570; 17429, TBC1D28, 87107, 189557, 507-553; 17429, TBC1D28, 87102, 189552, 701-1333; 17429, TBC1D28, 87103, 189553, 413-1045; 17430, TBC1D29, 87109, 189559, 150-395; 17430, TBC1D29, 87108, 189558, 2498-2950; 17430, TBC1D29, 87110, 189560, 150-602; 17431, TBC1D2B, 87113, 189563, 75-948; 17431, TBC1D2B, 87114, 189564, 1-368; 17431, TBC1D2B, 87111, 189561, 1-2892; 17431, TBC1D2B, 87112, 189562, 73-2817; 17432, TBC1D3, 87115, 189565, 99-1748; 17433, TBC1D30, 87116, 189566, 214-582; 17433, TBC1D30, 87118, 189568, 246-2189; 17433, TBC1D30, 87119, 189569, 72-510; 17433, TBC1D30, 87120, 189570, 448-721; 17433, TBC1D30, 87117, 189567, 309-2594; 17434, TBC1D31, 87123, 189573, 401-605; 17434, TBC1D31, 87124, 189574, 521-653; 17434, TBC1D31, 87125, 189575, 137-879; 17434, TBC1D31, 87126, 189576, 257-3142; 17434, TBC1D31, 87127, 189577, 125-1987; 17434, TBC1D31, 87128, 189578, 211-3042; 17434, TBC1D31, 87129, 189579, 130-569; 17434, TBC1D31, 87130, 189580, 1-235; 17434, TBC1D31, 87131, 189581, 1-467; 17434, TBC1D31, 87132, 189582, 5-247; 17434, TBC1D31, 87121, 189571, 91-3291; 17434, TBC1D31, 87122, 189572, 58-2970; 17435, TBC1D32, 87135, 189585, 130-770; 17435, TBC1D32, 87137, 189587, 1-204; 17435, TBC1D32, 87133, 189583, 1-3897; 17435, TBC1D32, 87134, 189584, 51-3824; 17435, TBC1D32, 87136, 189586, 49-375; 17436, TBC1D3B, 87138, 189588, 151-1800; 17436, TBC1D3B, 87139, 189589, 423-569; 17436, TBC1D3B, 87141, 189591, 118-1767; 17436, TBC1D3B, 87142, 189592, 1-1650; 17436, TBC1D3B, 87143, 189593, 115-462; 17436, TBC1D3B, 87145, 189595, 115-462; 17436, TBC1D3B, 87146, 189596, 118-1767; 17436, TBC1D3B, 87147, 189597, 423-569; 17436, TBC1D3B, 87148, 189598, 115-462; 17436, TBC1D3B, 87149, 189599, 423-569; 17436, TBC1D3B, 87140, 189590, 118-1767; 17436, TBC1D3B, 87144, 189594, 115-1764; 17437, TBC1D3C, 87150, 189600, 1-1650; 17437, TBC1D3C, 87151, 189601, 99-1748; 17438, TBC1D3D, 87152, 189602, 158-1807; 17438, TBC1D3D, 87153, 189603, 158-1807; 17439, TBC1D3E, 87155, 189605, 1-1650; 17439, TBC1D3E, 87154, 189604, 118-1767; 17440, TBC1D3F, 87156, 189606, 158-1645; 17440, TBC1D3F, 87158, 189608, 1-1650; 17440, TBC1D3F, 87159, 189609, 158-1645; 17440, TBC1D3F, 87157, 189607, 151-1800; 17441, TBC1D3G, 87160, 189610, 101-1750; 17441, TBC1D3G, 87161, 189611, 101-1750; 17442, TBC1D3H, 87163, 189613, 158-1807; 17442, TBC1D3H, 87162, 189612, 151-1800; 17442, TBC1D3H, 87164, 189614, 101-1750; 17442, TBC1D3H, 87165, 189615, 101-1750; 17443, TBC1D31, 87166, 189616, 158-1807; 17443, TBC1D31, 87167, 189617, 141-1790; 17443, TBC1D31, 87168, 189618, 158-1033; 17443, TBC1D31, 87169, 189619, 102-977; 17443, TBC1D31, 87170, 189620, 115-990; 17443, TBC1D31, 87171, 189621, 102-977; 17443, TBC1D31, 87173, 189623, 1-876; 17443, TBC1D31, 87174, 189624, 147-1796; 17443, TBC1D31, 87175, 189625, 102-977; 17443, TBC1D31, 87172, 189622, 141-1790; 17444, TBC1D3K, 87177, 189627, 158-1807; 17444, TBC1D3K, 87176, 189626, 158-1807; 17445, TBC1D3L, 87181, 189631, 158-1807; 17445, TBC1D3L, 87178, 189628, 101-1750; 17445, TBC1D3L, 87179, 189629, 158-1807; 17445, TBC1D3L, 87180, 189630, 1-1650; 17446, TBC1D4, 87185, 189635, 1-847; 17446, TBC1D4, 87182, 189632, 348-4055; 17446, TBC1D4, 87183, 189633, 348-4244; 17446, TBC1D4, 87184, 189634, 348-4220; 17447, TBC1D5, 87187, 189637, 330-757; 17447, TBC1D5, 87188, 189638, 356-687; 17447, TBC1D5, 87189, 189639, 302-852; 17447, TBC1D5, 87190, 189640, 584-680; 17447, TBC1D5, 87192, 189642, 171-591; 17447, TBC1D5, 87194, 189644, 163-285; 17447, TBC1D5, 87195, 189645, 382-471; 17447, TBC1D5, 87196, 189646, 236-623; 17447, TBC1D5, 87197, 189647, 160-282; 17447, TBC1D5, 87198, 189648, 172-1953; 17447, TBC1D5, 87199, 189649, 165-386; 17447, TBC1D5, 87200, 189650, 222-344; 17447, TBC1D5, 87201, 189651, 320-557; 17447, TBC1D5, 87202, 189652, 315-578; 17447, TBC1D5, 87186, 189636, 1666-4053; 17447, TBC1D5, 87191, 189641, 178-2565; 17447, TBC1D5, 87193, 189643, 265-2718; 17448, TBC1D7, 87205, 189655, 302-693; 17448, TBC1D7, 87208, 189658, 225-972; 17448, TBC1D7, 87209, 189659, 307-714; 17448, TBC1D7, 87210, 189660, 98-637; 17448, TBC1D7, 87211, 189661, 245-958; 17448, TBC1D7, 87212, 189662, 207-790; 17448, TBC1D7, 87213, 189663, 364-832; 17448, TBC1D7, 87214, 189664, 225-938; 17448, TBC1D7, 87215, 189665, 142-762; 17448, TBC1D7, 87216, 189666, 152-751; 17448, TBC1D7, 87217, 189667, 109-603; 17448, TBC1D7, 87218, 189668, 509-569; 17448, TBC1D7, 87220, 189670, 15-471; 17448, TBC1D7, 87221, 189671, 277-537; 17448, TBC1D7, 87203, 189653, 137-880; 17448, TBC1D7, 87204, 189654, 85-966; 17448, TBC1D7, 87206, 189656, 245-1126; 17448, TBC1D7, 87207, 189657, 137-937; 17448, TBC1D7, 87219, 189669, 15-896; 17449, TBC1D8, 87223, 189673, 132-3599; 17449, TBC1D8, 87222, 189672, 1-3423; 17450, TBC1D8B, 87224, 189674, 42-3386; 17450, TBC1D8B, 87227, 189677, 1-654; 17450, TBC1D8B, 87228, 189678, 150-1409; 17450, TBC1D8B, 87229, 189679, 431-496; 17450, TBC1D8B, 87225, 189675, 166-2064; 17450, TBC1D8B, 87226, 189676, 175-3537; 17451, TBC1D9, 87230, 189680, 76-3876; 17452, TBC1D9B, 87233, 189683, 1-499; 17452, TBC1D9B, 87234, 189684, 1-197; 17452, TBC1D9B, 87235, 189685, 32-334; 17452, TBC1D9B, 87236, 189686, 144-1373; 17452, TBC1D9B, 87237, 189687, 1-303; 17452, TBC1D9B, 87231, 189681, 36-3737; 17452, TBC1D9B, 87232, 189682, 39-3791; 17453, TBCCD1, 87239, 189689, 481-1158; 17453, TBCCD1, 87241, 189691, 17-460; 17453, TBCCD1, 87238, 189688, 130-1803; 17453, TBCCD1, 87240, 189690, 165-1550; 17453, TBCCD1, 87242, 189692, 481-2154; 17454, TBKBP1, 87244, 189694, 80-705; 17454, TBKBP1, 87245, 189695, 149-733; 17454, TBKBP1, 87243, 189693, 850-2697; 17454, TBKBP1, 87246, 189696, 429-1097; 17455, TBX1, 87247, 189697, 130-1326; 17455, TBX1, 87248, 189698, 130-1617; 17455, TBX1, 87249, 189699, 130-1248; 17455, TBX1, 87250, 189700, 130-1248; 17456, TBX10, 87251, 189701, 89-1246; 17457, TBX15, 87254, 189704, 1-993; 17457, TBX15, 87252, 189702, 316-1806; 17457, TBX15, 87253, 189703, 11-1819; 17458, TBX18, 87256, 189706, 213-742; 17458, TBX18, 87257, 189707, 213-911; 17458, TBX18, 87258, 189708, 621-717; 17458, TBX18, 87255, 189705, 339-2162; 17459, TBX19, 87260, 189710, 1-844; 17459, TBX19, 87261, 189711, 1-955; 17459, TBX19, 87259, 189709, 52-1398; 17460, TBX2, 87263, 189713, 268-708; 17460, TBX2, 87262, 189712, 282-2420; 17461, TBX20, 87264, 189714, 528-1871; 17462, TBX21, 87265, 189715, 212-1819; 17463, TBX22, 87269, 189719, 135-518; 17463, TBX22, 87270, 189720, 1-215; 17463, TBX22, 87272, 189722, 135-518; 17463, TBX22, 87266, 189716, 29-1591; 17463, TBX22, 87267, 189717, 135-1697; 17463, TBX22, 87268, 189718, 135-1697; 17463, TBX22, 87271, 189721, 29-1591; 17464, TBX3, 87275, 189725, 262-2430; 17464, TBX3, 87273, 189723, 391-2622; 17464, TBX3, 87274, 189724, 965-3136; 17465, TBX4, 87278, 189728, 180-584; 17465, TBX4, 87276, 189726, 46-1683; 17465, TBX4, 87277, 189727, 164-1804; 17466, TBX5, 87279, 189729, 668-2224; 17466, TBX5, 87280, 189730, 578-1984; 17466, TBX5, 87281, 189731, 496-2052; 17466, TBX5, 87282, 189732, 1-1050; 17467, TBX6, 87287, 189737, 57-1367; 17467, TBX6, 87283, 189733, 57-1367; 17467, TBX6, 87284, 189734, 61-1371; 17467, TBX6, 87285, 189735, 21-908; 17467, TBX6, 87286, 189736, 695-1582; 17468, TBR1, 87290, 189740, 1-698; 17468, TBR1, 87288, 189738, 318-2366; 17468, TBR1, 87289, 189739, 208-1395; 17469, TBPL1, 87292, 189742, 350-623; 17469, TBPL1, 87293, 189743, 276-767; 17469, TBPL1, 87294, 189744, 731-865; 17469, TBPL1, 87295, 189745, 606-991; 17469, TBPL1, 87291, 189741, 276-836; 17469, TBPL1, 87296, 189746, 606-1166; 17470, TIPARP, 87299, 189749, 73-2035; 17470, TIPARP, 87300, 189750, 252-1770; 17470, TIPARP, 87301, 189751, 1-1081; 17470, TIPARP, 87297, 189747, 497-2470; 17470, TIPARP, 87298, 189748, 169-2142; 17470, TIPARP, 87302, 189752, 589-2562; 17470, TIPARP, 87303, 189753, 73-2046; 17471, TAGAP, 87304, 189754, 700-2361; 17471, TAGAP, 87305, 189755, 199-999; 17471, TAGAP, 87306, 189756, 333-2528; 17472, TAL1, 87307, 189757, 578-1573; 17472, TAL1, 87308, 189758, 217-1212; 17473, TAL2, 87309, 189759, 41-367; 17474, TIMD4, 87311, 189761, 237-479; 17474, TIMD4, 87310, 189760, 58-1194; 17474, TIMD4, 87312, 189762, 25-1077; 17475, TLX1, 87314, 189764, 1-469; 17475, TLX1, 87313, 189763, 1038-2030; 17475, TLX1, 87315, 189765, 239-1012; 17476, TLX2, 87317, 189767, 415-1122; 17476, TLX2, 87316, 189766, 324-1178; 17477,

TLX3, 87318, 189768, 83-958; 17478, TCTA, 87319, 189769, 222-533; 17479, TCL1A, 87323, 189773, 24-164; 17479, TCL1A, 87324, 189774, 39-179; 17479, TCL1A, 87326, 189776, 62-202; 17479, TCL1A, 87327, 189777, 107-268; 17479, TCL1A, 87320, 189770, 131-475; 17479, TCL1A, 87321, 189771, 65-409; 17479, TCL1A, 87322, 189772, 33-377; 17479, TCL1A, 87325, 189775, 131-475; 17480, TCL1B, 87328, 189778, 52-438; 17481, TIAM1, 87330, 189780, 511-1187; 17481, TIAM1, 87331, 189781, 1-398; 17481, TIAM1, 87329, 189779, 473-5248; 17481, TIAM1, 87332, 189782, 473-5068; 17482, TIAM2, 87337, 189787, 115-583; 17482, TIAM2, 87339, 189789, 304-4404; 17482, TIAM2, 87340, 189790, 143-3280; 17482, TIAM2, 87342, 189792, 387-642; 17482, TIAM2, 87343, 189793, 291-877; 17482, TIAM2, 87344, 189794, 390-550; 17482, TIAM2, 87345, 189795, 348-506; 17482, TIAM2, 87346, 189796, 1-194; 17482, TIAM2, 87333, 189783, 512-2392; 17482, TIAM2, 87334, 189784, 209-5314; 17482, TIAM2, 87335, 189785, 53-5230; 17482, TIAM2, 87336, 189786, 155-3196; 17482, TIAM2, 87338, 189788, 1-5193; 17482, TIAM2, 87341, 189791, 1274-6379; 17483, TCIRG1, 87348, 189798, 96-620; 17483, TCIRG1, 87349, 189799, 1-868; 17483, TCIRG1, 87350, 189800, 43-940; 17483, TCIRG1, 87351, 189801, 1-186; 17483, TCIRG1, 87353, 189803, 190-842; 17483, TCIRG1, 87354, 189804, 1-314; 17483, TCIRG1, 87347, 189797, 109-2601; 17483, TCIRG1, 87352, 189802, 537-2381; 17484, TFPT, 87355, 189805, 20-601; 17484, TFPT, 87356, 189806, 40-774; 17484, TFPT, 87358, 189808, 17-334; 17484, TFPT, 87359, 189809, 407-1168; 17484, TFPT, 87361, 189811, 407-1168; 17484, TFPT, 87362, 189812, 407-1168; 17484, TFPT, 87363, 189813, 407-1168; 17484, TFPT, 87364, 189814, 17-334; 17484, TFPT, 87365, 189815, 407-1168; 17484, TFPT, 87366, 189816, 165-602; 17484, TFPT, 87367, 189817, 407-1168; 17484, TFPT, 87368, 189818, 20-601; 17484, TFPT, 87369, 189819, 407-1168; 17484, TFPT, 87370, 189820, 40-774; 17484, TFPT, 87371, 189821, 407-1168; 17484, TFPT, 87357, 189807, 407-1168; 17484, TFPT, 87360, 189810, 407-1168; 17485, TCP1, 87373, 189823, 615-1820; 17485, TCP1, 87374, 189824, 105-1406; 17485, TCP1, 87375, 189825, 358-691; 17485, TCP1, 87376, 189826, 324-1322; 17485, TCP1, 87377, 189827, 299-706; 17485, TCP1, 87378, 189828, 117-314; 17485, TCP1, 87379, 189829, 118-780; 17485, TCP1, 87380, 189830, 381-557; 17485, TCP1, 87381, 189831, 262-535; 17485, TCP1, 87382, 189832, 135-437; 17485, TCP1, 87372, 189822, 282-1952; 17486, TCP10, 87384, 189834, 169-1149; 17486, TCP10, 87385, 189835, 88-374; 17486, TCP10, 87386, 189836, 1-624; 17486, TCP10, 87387, 189837, 152-475; 17486, TCP10, 87388, 189838, 132-1190; 17486, TCP10, 87383, 189833, 213-1109; 17487, TCP10L, 87390, 189840, 63-636; 17487, TCP10L, 87391, 189841, 228-617; 17487, TCP10L, 87392, 189842, 134-460; 17487, TCP10L, 87389, 189839, 115-762; 17488, TCP10L2, 87393, 189843, 77-1000; 17488, TCP10L2, 87395, 189845, 284-416; 17488, TCP10L2, 87394, 189844, 132-1193; 17489, TCP11X2, 87397, 189847, 52-420; 17489, TCP11X2, 87396, 189846, 330-1553; 17490, TCP11, 87402, 189852, 121-285; 17490, TCP11, 87406, 189856, 125-256; 17490, TCP11, 87407, 189857, 173-837; 17490, TCP11, 87408, 189858, 366-574; 17490, TCP11, 87409, 189859, 158-283; 17490, TCP11, 87410, 189860, 83-307; 17490, TCP11, 87411, 189861, 25-189; 17490, TCP11, 87412, 189862, 1-736; 17490, TCP11, 87413, 189863, 111-380; 17490, TCP11, 87414, 189864, 306-615; 17490, TCP11, 87415, 189865, 83-325; 17490, TCP11, 87416, 189866, 404-657; 17490, TCP11, 87417, 189867, 36-200; 17490, TCP11, 87418, 189868, 88-219; 17490, TCP11, 87419, 189869, 83-247; 17490, TCP11, 87420, 189870, 36-143; 17490, TCP11, 87398, 189848, 501-1826; 17490, TCP11, 87399, 189849, 419-1969; 17490, TCP11, 87400, 189850, 143-1555; 17490, TCP11, 87401, 189851, 359-1684; 17490, TCP11, 87403, 189853, 95-1492; 17490, TCP11, 87404, 189854, 111-1646; 17490, TCP11, 87405, 189855, 253-1575; 17490, TCP11, 87421, 189871, 158-1669; 17490, TCP11, 87422, 189872, 616-1938; 17491, TCP11L1, 87425, 189875, 1556-2020; 17491, TCP11L1, 87427, 189877, 246-2033; 17491, TCP11L1, 87428, 189878, 385-547; 17491, TCP11L1, 87429, 189879, 474-905; 17491, TCP11L1, 87430, 189880, 1-475; 17491, TCP11L1, 87431, 189881, 430-747; 17491, TCP11L1, 87423, 189873, 401-1930; 17491, TCP11L1, 87424, 189874, 217-1746; 17491, TCP11L1, 87426, 189876, 197-1726; 17492, TCP11L2, 87433, 189883, 231-625; 17492, TCP11L2, 87434, 189884, 101-153; 17492, TCP11L2, 87435, 189885, 775-1067; 17492, TCP11L2, 87436, 189886, 125-307; 17492, TCP11L2, 87437, 189887, 284-985; 17492, TCP11L2, 87439, 189889, 160-978; 17492, TCP11L2, 87440, 189890, 492-544; 17492, TCP11L2, 87432, 189882, 175-1734; 17492, TCP11L2, 87438, 189888, 175-975; 17493, TCTE1, 87441, 189891, 4-600; 17493, TCTE1, 87442, 189892, 124-1629; 17494, TCTE3, 87443, 189893, 102-698; 17494, TCTE3, 87444, 189894, 102-698; 17495, TCTEX1D1, 87446, 189896, 94-324; 17495, TCTEX1D1, 87445, 189895, 129-668; 17496, TCTEX1D2, 87448, 189898, 148-546; 17496, TCTEX1D2, 87449, 189899, 63-200; 17496, TCTEX1D2, 87447, 189897, 137-565; 17497, TCTEX1D4, 87450, 189900, 8-673; 17498, TGDS, 87451, 189901, 122-1174; 17499, TEAD1, 87453, 189903, 350-1435; 17499, TEAD1, 87454, 189904, 1-477; 17499, TEAD1, 87455, 189905, 452-1732; 17499, TEAD1, 87456, 189906, 224-1216; 17499, TEAD1, 87457, 189907, 114-1220; 17499, TEAD1, 87452, 189902, 159-1232; 17500, TEAD2, 87463, 189913, 1-223; 17500, TEAD2, 87465, 189915, 231-579; 17500, TEAD2, 87458, 189908, 92-1435; 17500, TEAD2, 87459, 189909, 364-1716; 17500, TEAD2, 87460, 189910, 243-1202; 17500, TEAD2, 87461, 189911, 57-1412; 17500, TEAD2, 87462, 189912, 86-1438; 17500, TEAD2, 87464, 189914, 107-1462; 17501, TEAD3, 87467, 189917, 155-1282; 17501, TEAD3, 87468, 189918, 1-657; 17501, TEAD3, 87466, 189916, 229-1536; 17502, TEAD4, 87469, 189919, 275-1450; 17502, TEAD4, 87470, 189920, 191-1495; 17502, TEAD4, 87472, 189922, 127-459; 17502, TEAD4, 87473, 189923, 354-570; 17502, TEAD4, 87474, 189924, 512-578; 17502, TEAD4, 87475, 189925, 1-567; 17502, TEAD4, 87476, 189926, 275-801; 17502, TEAD4, 87471, 189921, 286-1203; 17503, TSHZ1, 87478, 189928, 316-551; 17503, TSHZ1, 87479, 189929, 193-1022; 17503, TSHZ1, 87477, 189927, 585-3683; 17503, TSHZ1, 87480, 189930, 349-3582; 17504, TSHZ2, 87483, 189933, 1-585; 17504, TSHZ2, 87485, 189935, 23-247; 17504, TSHZ2, 87481, 189931, 1-3093; 17504, TSHZ2, 87482, 189932, 888-3992; 17504, TSHZ2, 87484, 189934, 364-3459; 17505, TSHZ3, 87487, 189937, 37-138; 17505, TSHZ3, 87486, 189936, 329-3574; 17506, TEC, 87489, 189939, 113-268; 17506, TEC, 87490, 189940, 46-348; 17506, TEC, 87488, 189938, 159-2054; 17507, TCTN1, 87491, 189941, 1-1452; 17507, TCTN1, 87493, 189943, 78-617; 17507, TCTN1, 87495, 189945, 19-321; 17507, TCTN1, 87496, 189946, 82-333; 17507, TCTN1, 87497, 189947, 77-379; 17507, TCTN1, 87498, 189948, 16-807; 17507, TCTN1, 87499, 189949, 1-285; 17507, TCTN1, 87501, 189951, 241-458; 17507, TCTN1, 87502, 189952, 60-326; 17507, TCTN1, 87503, 189953, 157-894; 17507, TCTN1, 87504, 189954, 58-546; 17507, TCTN1, 87505, 189955, 58-360; 17507, TCTN1, 87506, 189956, 71-391; 17507, TCTN1, 87507, 189957, 121-387; 17507, TCTN1, 87508, 189958, 82-309; 17507, TCTN1, 87509, 189959, 157-1878; 17507, TCTN1, 87492, 189942, 71-1792; 17507, TCTN1, 87494, 189944, 20-1798; 17507, TCTN1, 87500, 189950, 157-1920; 17508, TCTN2, 87512, 189962, 129-311; 17508, TCTN2, 87510, 189960, 129-2222; 17508, TCTN2, 87511, 189961, 129-2219; 17509, TCTN3, 87513, 189963, 191-2068; 17509, TCTN3, 87514, 189964, 1-1332; 17509, TCTN3, 87515, 189965, 25-1848; 17509, TCTN3, 87516, 189966, 28-1407; 17509, TCTN3, 87517, 189967, 245-2068; 17510, TECPR1, 87518, 189968, 367-655; 17510, TECPR1, 87520, 189970, 288-590; 17510, TECPR1, 87521, 189971, 256-552; 17510, TECPR1, 87519, 189969, 301-3798; 17511, TECPR2, 87522, 189972, 227-4462; 17511, TECPR2, 87523, 189973, 111-3914; 17512, TECTA, 87524, 189974, 1-6468; 17512, TECTA, 87525, 189975, 272-6739; 17513, TECTB, 87526, 189976, 1-990; 17514, TEK, 87529, 189979, 139-1543; 17514, TEK, 87531, 189981, 443-1849; 17514, TEK, 87527, 189977, 443-3817; 17514, TEK, 87528, 189978, 176-3421; 17514, TEK, 87530, 189980, 451-3381; 17515, TEKT1, 87533, 189983, 1-433; 17515, TEKT1, 87534, 189984, 1-195; 17515, TEKT1, 87535, 189985, 131-373; 17515, TEKT1, 87532, 189982, 131-1387; 17516, TEKT2, 87537, 189987, 1-289; 17516, TEKT2, 87538, 189988, 226-552; 17516, TEKT2, 87536, 189986, 128-1420; 17517, TEKT3, 87541, 189991, 110-787; 17517, TEKT3, 87542, 189992, 145-564; 17517, TEKT3, 87543, 189993, 391-970; 17517, TEKT3, 87544, 189994, 238-483; 17517, TEKT3, 87545, 189995, 141-583; 17517, TEKT3, 87539, 189989, 36-1508; 17517, TEKT3, 87540, 189990, 188-1660; 17518, TEKT4, 87546, 189996, 138-1445; 17519, TEKT5, 87548, 189998, 212-771; 17519, TEKT5, 87547, 189997, 73-1530; 17520, TTI1, 87552, 190002, 1-98; 17520, TTI1, 87549, 189999, 107-3376; 17520, TTI1, 87550, 190000, 240-3509; 17520, TTI1, 87551, 190001, 88-3357; 17521, TTI2, 87555, 190005, 100-1533; 17521, TTI2, 87556, 190006, 183-485; 17521, TTI2, 87553, 190003, 497-2023; 17521, TTI2, 87554, 190004, 620-2146; 17521, TTI2, 87557, 190007, 326-1852; 17522, TERT, 87558, 190008, 59-3457; 17522, TERT, 87559, 190009, 1-3210; 17522, TERT, 87560, 190010, 1-2388; 17522, TERT, 87561, 190011, 1-2424; 17523, TEP1, 87563, 190013, 1-753; 17523, TEP1, 87564, 190014, 1-602; 17523, TEP1, 87565, 190015, 1-5715; 17523, TEP1, 87566, 190016, 1-212; 17523, TEP1, 87567, 190017, 1-309; 17523, TEP1, 87568, 190018, 40-4485; 17523, TEP1, 87569, 190019, 1-235; 17523, TEP1, 87570, 190020, 84-581; 17523, TEP1, 87571, 190021, 41-7600; 17523, TEP1, 87562, 190012, 42-7925; 17524, TELO2, 87573, 190023, 264-1544; 17524, TELO2, 87574, 190024, 1-479; 17524, TELO2, 87572, 190022, 280-2793; 17525, TERF1, 87577, 190027, 11-516; 17525, TERF1, 87578, 190028, 69-627; 17525, TERF1, 87575, 190025, 24-1283; 17525, TERF1, 87576, 190026, 24-1343; 17526, TERF2, 87581, 190031, 69-917; 17526, TERF2, 87582, 190032, 1-182; 17526, TERF2, 87583, 190033, 52-669; 17526, TERF2, 87584, 190034, 1-300; 17526, TERF2, 87585, 190035, 1-431; 17526, TERF2, 87586, 190036, 1-148; 17526, TERF2, 87587, 190037, 1-734; 17526, TERF2, 87588, 190038, 297-554; 17526, TERF2, 87579, 190029, 18-1646; 17526, TERF2, 87580, 190030, 18-899; 17527, TERF2IP, 87590, 190040, 1-300; 17527, TERF2IP, 87591, 190041, 1-369; 17527, TERF2IP, 87589, 190039, 98-1297; 17528, TEN1, 87593, 190043, 261-563; 17528, TEN1, 87594, 190044, 389-555; 17528, TEN1, 87595, 190045, 278-499; 17528, TEN1, 87592, 190042, 299-670; 17529, TEN1-CDK3, 87596, 190046, 77-994; 17530, TNC, 87598, 190048, 130-6189; 17530, TNC, 87599, 190049, 284-6070; 17530, TNC, 87600, 190050, 413-5929; 17530, TNC, 87601, 190051, 1-5517; 17530, TNC, 87602, 190052, 459-734; 17530, TNC, 87604, 190054, 1-1844; 17530, TNC, 87605, 190055, 1-69; 17530, TNC, 87597, 190047, 413-7018; 17530, TNC, 87603, 190053, 124-4818; 17531, TNN, 87607, 190057, 1-3369; 17531, TNN, 87608, 190058, 31-3399; 17531, TNN, 87606, 190056, 114-4013; 17532, TNR, 87611, 190061, 1-540; 17532, TNR, 87609, 190059, 556-4632; 17532, TNR, 87610, 190060, 710-4786; 17533, TNXB, 87613, 190063, 203-12871; 17533, TNXB, 87614, 190064, 1-9890; 17533, TNXB, 87615, 190065, 203-12871; 17533, TNXB, 87616, 190066, 350-372; 17533, TNXB, 87617, 190067, 1-1902; 17533, TNXB, 87618, 190068, 350-372; 17533, TNXB, 87619, 190069, 9-6849; 17533, TNXB, 87620, 190070, 203-12871; 17533, TNXB, 87621, 190071, 350-372; 17533, TNXB, 87622, 190072, 9-31; 17533, TNXB, 87623, 190073, 1-6449; 17533, TNXB, 87625, 190075, 298-320; 17533, TNXB, 87626, 190076, 350-372; 17533, TNXB, 87627, 190077, 142-2670; 17533, TNXB, 87629, 190079, 203-12931; 17533, TNXB, 87630, 190080, 203-12931; 17533, TNXB, 87632, 190082, 203-12931; 17533, TNXB, 87633, 190083, 1-4635; 17533, TNXB, 87634, 190084, 1-5889; 17533, TNXB, 87612, 190062, 203-12937; 17533, TNXB, 87624, 190074, 910-2931; 17533, TNXB, 87628, 190078, 856-2463; 17533, TNXB, 87631, 190081, 1050-2657; 17534, TENM1, 87635, 190085, 65-8242; 17534, TENM1, 87636, 190086, 65-8263; 17535, TENM2, 87637, 190087, 1-7797; 17535, TENM2, 87638, 190088, 52-7659; 17535, TENM2, 87639, 190089, 119-8080; 17535, TENM2, 87641, 190091, 1-7824; 17535, TENM2, 87640, 190090, 40-8364; 17536, TENM3, 87642, 190092, 1-7590; 17536, TENM3, 87643, 190093, 141-651; 17536, TENM3, 87645, 190095, 1-548; 17536, TENM3, 87644, 190094, 124-8223; 17537, TENM4, 87647, 190097, 1-2856; 17537, TENM4, 87648, 190098, 1-453; 17537, TENM4, 87649, 190099, 54-524; 17537, TENM4, 87650, 190100, 31-33; 17537, TENM4, 87646, 190096, 464-8773; 17537, TENM4, 87651, 190101, 267-8576; 17538, TNMD, 87652, 190102, 218-1171; 17539, TNS1, 87655, 190105, 510-582; 17539, TNS1, 87656, 190106, 82-2622; 17539, TNS1, 87657, 190107, 360-667; 17539, TNS1, 87658, 190108, 17-1478; 17539, TNS1, 87659, 190109, 355-538; 17539, TNS1, 87660, 190110, 124-2464; 17539, TNS1, 87661, 190111, 163-5307; 17539, TNS1, 87662, 190112, 163-5328; 17539, TNS1, 87663, 190113, 183-548; 17539, TNS1, 87664, 190114, 1-448; 17539, TNS1, 87665, 190115, 1378-5475; 17539, TNS1, 87666, 190116, 331-5496; 17539, TNS1, 87653, 190103, 454-5661; 17539, TNS1, 87654, 190104, 173-1423; 17540, TNS2, 87671, 190121, 1-103; 17540, TNS2, 87672, 190122, 1-4035; 17540, TNS2, 87674, 190124, 1-590; 17540, TNS2, 87667, 190117, 291-4520; 17540, TNS2, 87668, 190118, 196-4455; 17540, TNS2, 87669, 190119, 393-4250; 17540, TNS2, 87670, 190120, 1-4224; 17540, TNS2, 87673, 190123, 1-3939; 17541, TNS3, 87676, 190126, 1-64; 17541, TNS3, 87677, 190127, 375-698; 17541, TNS3, 87680, 190130, 201-1832; 17541, TNS3, 87681, 190131, 219-560; 17541, TNS3, 87682, 190132, 156-570; 17541, TNS3, 87683, 190133, 88-3836; 17541, TNS3, 87675, 190125, 359-4696; 17541, TNS3, 87678, 190128, 368-1120; 17541, TNS3, 87679, 190129, 368-1120; 17542, TNS4, 87685, 190135, 1-100; 17542, TNS4, 87684, 190134, 160-2307; 17543, TDGF1, 87687, 190137, 43-561; 17543, TDGF1, 87686, 190136, 734-1300; 17544, TINF2, 87690, 190140, 456-894; 17544,

TINF2, 87691, 190141, 1-823; 17544, TINF2, 87692, 190142, 282-704; 17544, TINF2, 87693, 190143, 1-258; 17544, TINF2, 87694, 190144, 227-499; 17544, TINF2, 87695, 190145, 301-516; 17544, TINF2, 87696, 190146, 343-765; 17544, TINF2, 87688, 190138, 343-1698; 17544, TINF2, 87689, 190139, 332-1396; 17545, TUT1, 87697, 190147, 39-533; 17545, TUT1, 87698, 190148, 39-2777; 17545, TUT1, 87700, 190150, 39-341; 17545, TUT1, 87701, 190151, 270-699; 17545, TUT1, 87699, 190149, 693-3317; 17546, TESC, 87703, 190153, 127-534; 17546, TESC, 87706, 190156, 1-246; 17546, TESC, 87702, 190152, 188-832; 17546, TESC, 87704, 190154, 198-689; 17546, TESC, 87705, 190155, 165-728; 17547, TES, 87709, 190159, 1-578; 17547, TES, 87710, 190160, 339-577; 17547, TES, 87711, 190161, 160-294; 17547, TES, 87707, 190157, 216-1481; 17547, TES, 87708, 190158, 224-1462; 17548, TOPAZ1, 87712, 190162, 169-5247; 17549, TDRP, 87713, 190163, 242-799; 17549, TDRP, 87714, 190164, 89-685; 17549, TDRP, 87715, 190165, 257-853; 17549, TDRP, 87716, 190166, 257-814; 17550, TEX10, 87718, 190168, 311-824; 17550, TEX10, 87717, 190167, 178-2967; 17550, TEX10, 87719, 190169, 151-2892; 17551, TEX101, 87720, 190170, 443-1246; 17551, TEX101, 87721, 190171, 167-916; 17552, TEX11, 87722, 190172, 1-2823; 17552, TEX11, 87723, 190173, 223-2070; 17552, TEX11, 87724, 190174, 100-2877; 17552, TEX11, 87725, 190175, 157-2979; 17553, TEX12, 87726, 190176, 133-504; 17553, TEX12, 87727, 190177, 68-439; 17554, TEX13A, 87728, 190178, 113-1342; 17554, TEX13A, 87729, 190179, 87-1316; 17555, TEX13B, 87730, 190180, 94-1032; 17556, TEX14, 87734, 190184, 1-457; 17556, TEX14, 87735, 190185, 109-309; 17556, TEX14, 87731, 190181, 87-4580; 17556, TEX14, 87732, 190182, 87-4442; 17556, TEX14, 87733, 190183, 119-4594; 17557, TEX15, 87736, 190186, 76-8445; 17558, TEX19, 87737, 190187, 311-805; 17559, TEX2, 87739, 190189, 331-458; 17559, TEX2, 87740, 190190, 1-1880; 17559, TEX2, 87743, 190193, 407-563; 17559, TEX2, 87744, 190194, 174-3557; 17559, TEX2, 87738, 190188, 86-3490; 17559, TEX2, 87741, 190191, 174-3557; 17559, TEX2, 87742, 190192, 160-3543; 17560, TEX22, 87746, 190196, 97-288; 17560, TEX22, 87745, 190195, 93-545; 17561, TEX26, 87748, 190198, 1-186; 17561, TEX26, 87747, 190197, 14-883; 17562, TEX261, 87750, 190200, 76-231; 17562, TEX261, 87749, 190199, 189-779; 17563, TEX264, 87753, 190203, 178-596; 17563, TEX264, 87756, 190206, 131-583; 17563, TEX264, 87757, 190207, 509-1155; 17563, TEX264, 87759, 190209, 219-531; 17563, TEX264, 87760, 190210, 224-873; 17563, TEX264, 87762, 190212, 149-868; 17563, TEX264, 87751, 190201, 92-1033; 17563, TEX264, 87752, 190202, 309-1250; 17563, TEX264, 87754, 190204, 1082-2023; 17563, TEX264, 87755, 190205, 71-1012; 17563, TEX264, 87758, 190208, 201-1142; 17563, TEX264, 87761, 190211, 241-1182; 17564, TEX28, 87763, 190213, 167-1399; 17564, TEX28, 87764, 190214, 1-1233; 17564, TEX28, 87765, 190215, 145-1377; 17565, TEX29, 87767, 190217, 28-282; 17565, TEX29, 87766, 190216, 130-585; 17566, TEX30, 87768, 190218, 838-1398; 17566, TEX30, 87769, 190219, 187-747; 17566, TEX30, 87770, 190220, 183-401; 17566, TEX30, 87771, 190221, 218-559; 17566, TEX30, 87772, 190222, 191-532; 17566, TEX30, 87773, 190223, 191-874; 17567, TEX33, 87777, 190227, 1-418; 17567, TEX33, 87774, 190224, 113-955; 17567, TEX33, 87775, 190225, 345-932; 17567, TEX33, 87776, 190226, 253-1095; 17568, TEX35, 87781, 190231, 72-371; 17568, TEX35, 87783, 190233, 1-153; 17568, TEX35, 87784, 190234, 57-323; 17568, TEX35, 87778, 190228, 113-814; 17568, TEX35, 87779, 190229, 46-693; 17568, TEX35, 87780, 190230, 60-665; 17568, TEX35, 87782, 190232, 78-716; 17569, TEX36, 87786, 190236, 118-507; 17569, TEX36, 87787, 190237, 142-438; 17569, TEX36, 87785, 190235, 156-716; 17570, TEX37, 87788, 190238, 143-685; 17571, TEX38, 87790, 190240, 141-599; 17571, TEX38, 87791, 190241, 154-546; 17571, TEX38, 87792, 190242, 585-1003; 17571, TEX38, 87789, 190239, 108-728; 17572, TEX40, 87793, 190243, 317-793; 17573, TEX43, 87794, 190244, 14-418; 17574, TEX9, 87797, 190247, 377-689; 17574, TEX9, 87798, 190248, 331-957; 17574, TEX9, 87799, 190249, 5-244; 17574, TEX9, 87800, 190250, 19-327; 17574, TEX9, 87801, 190251, 6-857; 17574, TEX9, 87795, 190245, 25-1200; 17574, TEX9, 87796, 190246, 462-1412; 17575, TSPY1, 87804, 190254, 1-666; 17575, TSPY1, 87805, 190255, 47-973; 17575, TSPY1, 87802, 190252, 47-931; 17575, TSPY1, 87803, 190253, 47-973; 17576, TSPY10, 87806, 190256, 1-885; 17576, TSPY10, 87807, 190257, 47-973; 17577, TSPY2, 87809, 190259, 1-885; 17577, TSPY2, 87810, 190260, 47-712; 17577, TSPY2, 87808, 190258, 47-973; 17578, TSPY3, 87812, 190262, 1-885; 17578, TSPY3, 87811, 190261, 47-973; 17579, TSPY4, 87813, 190263, 1-903; 17579, TSPY4, 87814, 190264, 47-991; 17580, TSPY8, 87816, 190266, 1-885; 17580, TSPY8, 87817, 190267, 47-973; 17580, TSPY8, 87815, 190265, 47-973; 17581, TSPY9P, 87818, 190268, 28-972; 17582, TSGA10, 87820, 190270, 389-2460; 17582, TSGA10, 87822, 190272, 529-2390; 17582, TSGA10, 87819, 190269, 630-2726; 17582, TSGA10, 87821, 190271, 846-2942; 17582, TSGA10, 87823, 190273, 629-2725; 17583, TSGA10IP, 87825, 190275, 33-377; 17583, TSGA10IP, 87826, 190276, 1-150; 17583, TSGA10IP, 87824, 190274, 33-1244; 17583, TSGA10IP, 87827, 190277, 232-1902; 17584, TSGA13, 87830, 190280, 394-567; 17584, TSGA13, 87831, 190281, 320-548; 17584, TSGA13, 87828, 190278, 458-1285; 17584, TSGA13, 87829, 190279, 853-1680; 17585, TEPP, 87832, 190282, 38-934; 17585, TEPP, 87833, 190283, 38-853; 17586, TESK1, 87834, 190284, 251-2131; 17586, TESK1, 87835, 190285, 268-2148; 17587, TESK2, 87836, 190286, 15-1643; 17587, TESK2, 87837, 190287, 402-2117; 17588, TSSK1B, 87838, 190288, 193-1296; 17589, TSSK2, 87839, 190289, 593-1669; 17590, TSSK3, 87841, 190291, 169-273; 17590, TSSK3, 87840, 190290, 506-1312; 17591, TSSK4, 87844, 190294, 67-474; 17591, TSSK4, 87845, 190295, 1-326; 17591, TSSK4, 87846, 190296, 1-430; 17591, TSSK4, 87842, 190292, 169-1155; 17591, TSSK4, 87843, 190293, 205-1221; 17591, TSSK4, 87847, 190297, 81-839; 17592, TSSK6, 87850, 190300, 1-330; 17592, TSSK6, 87848, 190298, 122-943; 17592, TSSK6, 87849, 190299, 259-1080; 17593, TSKS, 87852, 190302, 170-1348; 17593, TSKS, 87851, 190301, 84-1862; 17594, TET1, 87853, 190303, 210-6620; 17595, TET2, 87857, 190307, 104-2017; 17595, TET2, 87858, 190308, 141-3644; 17595, TET2, 87859, 190309, 798-6869; 17595, TET2, 87860, 190310, 536-865; 17595, TET2, 87854, 190304, 387-3971; 17595, TET2, 87855, 190305, 405-3902; 17595, TET2, 87856, 190306, 387-6395; 17595, TET2, 87861, 190311, 861-6869; 17596, TET3, 87862, 190312, 66-5174; 17596, TET3, 87863, 190313, 1-5388; 17597, TPRX1, 87865, 190315, 26-1231; 17597, TPRX1, 87866, 190316, 1-1527; 17597, TPRX1, 87864, 190314, 157-1392; 17598, TPRXL, 87867, 190317, 223-642; 17598, TPRXL, 87868, 190318, 409-828; 17598, TPRXL, 87869, 190319, 309-728; 17598, TPRXL, 87870, 190320, 345-764; 17598, TPRXL, 87871, 190321, 259-549; 17598, TPRXL, 87872, 190322, 330-597; 17598, TPRXL, 87873, 190323, 200-563; 17598,

TPRXL, 87874, 190324, 308-508; 17598, TPRXL, 87875, 190325, 359-533; 17598, TPRXL, 87876, 190326, 286-539; 17598, TPRXL, 87877, 190327, 572-771; 17599, TSPAN1, 87878, 190328, 465-1190; 17600, TSPAN10, 87879, 190329, 202-1383; 17600, TSPAN10, 87880, 190330, 78-785; 17600, TSPAN10, 87881, 190331, 1-1068; 17601, TSPAN11, 87884, 190334, 381-506; 17601, TSPAN11, 87885, 190335, 232-780; 17601, TSPAN11, 87882, 190332, 60-821; 17601, TSPAN11, 87883, 190333, 61-822; 17602, TSPAN12, 87887, 190337, 409-693; 17602, TSPAN12, 87888, 190338, 1-129; 17602, TSPAN12, 87890, 190340, 192-551; 17602, TSPAN12, 87891, 190341, 232-569; 17602, TSPAN12, 87892, 190342, 110-551; 17602, TSPAN12, 87886, 190336, 609-1526; 17602, TSPAN12, 87889, 190339, 360-1277; 17603, TSPAN13, 87893, 190343, 434-1048; 17604, TSPAN14, 87894, 190344, 35-676; 17604, TSPAN14, 87896, 190346, 187-855; 17604, TSPAN14, 87895, 190345, 503-1315; 17604, TSPAN14, 87897, 190347, 218-1030; 17604, TSPAN14, 87898, 190348, 60-821; 17604, TSPAN14, 87899, 190349, 224-1036; 17604, TSPAN14, 87900, 190350, 125-568; 17604, TSPAN14, 87901, 190351, 23-784; 17605, TSPAN15, 87903, 190353, 1-483; 17605, TSPAN15, 87902, 190352, 123-1007; 17606, TSPAN16, 87906, 190356, 1-117; 17606, TSPAN16, 87904, 190354, 151-888; 17606, TSPAN16, 87905, 190355, 130-612; 17606, TSPAN16, 87907, 190357, 139-798; 17606, TSPAN16, 87908, 190358, 132-866; 17606, TSPAN16, 87909, 190359, 160-642; 17607, TSPAN17, 87911, 190361, 230-1228; 17607, TSPAN17, 87913, 190363, 1-611; 17607, TSPAN17, 87914, 190364, 112-884; 17607, TSPAN17, 87915, 190365, 56-985; 17607, TSPAN17, 87916, 190366, 115-291; 17607, TSPAN17, 87910, 190360, 150-716; 17607, TSPAN17, 87912, 190362, 115-1104; 17607, TSPAN17, 87917, 190367, 49-840; 17608, TSPAN18, 87919, 190369, 401-871; 17608, TSPAN18, 87920, 190370, 1-814; 17608, TSPAN18, 87922, 190372, 338-565; 17608, TSPAN18, 87923, 190373, 425-840; 17608, TSPAN18, 87924, 190374, 289-726; 17608, TSPAN18, 87925, 190375, 311-549; 17608, TSPAN18, 87918, 190368, 240-986; 17608, TSPAN18, 87921, 190371, 416-1162; 17609, TSPAN19, 87926, 190376, 102-263; 17609, TSPAN19, 87928, 190378, 1-209; 17609, TSPAN19, 87929, 190379, 200-463; 17609, TSPAN19, 87930, 190380, 77-556; 17609, TSPAN19, 87927, 190377, 82-828; 17610, TSPAN2, 87931, 190381, 69-659; 17610, TSPAN2, 87933, 190383, 1-564; 17610, TSPAN2, 87932, 190382, 33-698; 17611, TSPAN3, 87937, 190387, 81-575; 17611, TSPAN3, 87938, 190388, 680-817; 17611, TSPAN3, 87939, 190389, 700-837; 17611, TSPAN3, 87934, 190384, 275-1036; 17611, TSPAN3, 87935, 190385, 156-842; 17611, TSPAN3, 87936, 190386, 156-725; 17612, TSPAN31, 87941, 190391, 117-503; 17612, TSPAN31, 87942, 190392, 133-513; 17612, TSPAN31, 87943, 190393, 230-488; 17612, TSPAN31, 87944, 190394, 90-473; 17612, TSPAN31, 87945, 190395, 365-582; 17612, TSPAN31, 87946, 190396, 106-447; 17612, TSPAN31, 87940, 190390, 275-907; 17613, TSPAN32, 87948, 190398, 104-535; 17613, TSPAN32, 87949, 190399, 1-798; 17613, TSPAN32, 87952, 190402, 154-567; 17613, TSPAN32, 87953, 190403, 89-1018; 17613, TSPAN32, 87954, 190404, 228-1025; 17613, TSPAN32, 87947, 190397, 138-1100; 17613, TSPAN32, 87950, 190400, 1-762; 17613, TSPAN32, 87951, 190401, 138-914; 17614, TSPAN33, 87955, 190405, 90-941; 17615, TSPAN4, 87956, 190406, 122-736; 17615, TSPAN4, 87957, 190407, 322-846; 17615, TSPAN4, 87964, 190414, 85-858; 17615, TSPAN4, 87965, 190415, 264-788; 17615, TSPAN4, 87966, 190416, 561-860; 17615, TSPAN4, 87967, 190417, 122-518; 17615, TSPAN4, 87968, 190418, 490-968; 17615, TSPAN4, 87969, 190419, 564-818; 17615, TSPAN4, 87958, 190408, 226-942; 17615, TSPAN4, 87959, 190409, 260-976; 17615, TSPAN4, 87960, 190410, 224-940; 17615, TSPAN4, 87961, 190411, 228-944; 17615, TSPAN4, 87962, 190412, 122-838; 17615, TSPAN4, 87963, 190413, 88-804; 17616, TSPAN5, 87971, 190421, 345-926; 17616, TSPAN5, 87972, 190422, 1-263; 17616, TSPAN5, 87973, 190423, 241-357; 17616, TSPAN5, 87974, 190424, 244-574; 17616, TSPAN5, 87975, 190425, 286-879; 17616, TSPAN5, 87976, 190426, 531-710; 17616, TSPAN5, 87970, 190420, 404-1210; 17617, TSPAN6, 87978, 190428, 490-879; 17617, TSPAN6, 87979, 190429, 490-900; 17617, TSPAN6, 87977, 190427, 113-850; 17618, TSPAN7, 87980, 190430, 4-804; 17618, TSPAN7, 87982, 190432, 4-141; 17618, TSPAN7, 87983, 190433, 6-197; 17618, TSPAN7, 87984, 190434, 4-135; 17618, TSPAN7, 87981, 190431, 178-927; 17619, TSPAN8, 87985, 190435, 280-993; 17619, TSPAN8, 87986, 190436, 554-1267; 17619, TSPAN8, 87987, 190437, 222-935; 17620, TSPAN9, 87989, 190439, 20-835; 17620, TSPAN9, 87990, 190440, 162-341; 17620, TSPAN9, 87988, 190438, 162-881; 17620, TSPAN9, 87991, 190441, 117-836; 17621, TRANK1, 87993, 190443, 66-476; 17621, TRANK1, 87992, 190442, 249-9026; 17622, TTC1, 87995, 190445, 1-492; 17622, TTC1, 87994, 190444, 111-989; 17622, TTC1, 87996, 190446, 108-986; 17623, TTC12, 87998, 190448, 406-2415; 17623, TTC12, 87999, 190449, 159-764; 17623, TTC12, 88000, 190450, 329-830; 17623, TTC12, 88001, 190451, 348-669; 17623, TTC12, 88002, 190452, 18-2153; 17623, TTC12, 88003, 190453, 52-594; 17623, TTC12, 88004, 190454, 1-253; 17623, TTC12, 88006, 190456, 54-566; 17623, TTC12, 88008, 190458, 44-807; 17623, TTC12, 88009, 190459, 1-249; 17623, TTC12, 88010, 190460, 165-433; 17623, TTC12, 88011, 190461, 615-1067; 17623, TTC12, 87997, 190447, 20-2218; 17623, TTC12, 88005, 190455, 106-2223; 17623, TTC12, 88007, 190457, 28-2226; 17624, TTC13, 88014, 190464, 1-372; 17624, TTC13, 88015, 190465, 32-529; 17624, TTC13, 88016, 190466, 46-813; 17624, TTC13, 88017, 190467, 1-558; 17624, TTC13, 88018, 190468, 6-458; 17624, TTC13, 88012, 190462, 9-2591; 17624, TTC13, 88013, 190463, 30-2450; 17625, TTC14, 88022, 190472, 306-706; 17625, TTC14, 88023, 190473, 185-741; 17625, TTC14, 88025, 190475, 46-624; 17625, TTC14, 88026, 190476, 74-601; 17625, TTC14, 88027, 190477, 68-595; 17625, TTC14, 88019, 190469, 133-2445; 17625, TTC14, 88020, 190470, 52-2013; 17625, TTC14, 88021, 190471, 70-1389; 17625, TTC14, 88024, 190474, 52-1371; 17626, TTC16, 88028, 190478, 81-2702; 17627, TTC17, 88031, 190481, 1-518; 17627, TTC17, 88032, 190482, 2-166; 17627, TTC17, 88033, 190483, 1-419; 17627, TTC17, 88029, 190479, 15-3440; 17627, TTC17, 88030, 190480, 24-2894; 17628, TTC19, 88035, 190485, 1-450; 17628, TTC19, 88036, 190486, 1-300; 17628, TTC19, 88037, 190487, 1-500; 17628, TTC19, 88038, 190488, 1-518; 17628, TTC19, 88039, 190489, 1-191; 17628, TTC19, 88034, 190484, 470-1612; 17629, TTC21A, 88040, 190490, 109-441; 17629, TTC21A, 88042, 190492, 110-3541; 17629, TTC21A, 88043, 190493, 33-419; 17629, TTC21A, 88041, 190491, 135-4097; 17629, TTC21A, 88044, 190494, 32-3850; 17630, TTC21B, 88046, 190496, 1-851; 17630, TTC21B, 88045, 190495, 139-4089; 17631, TTC22, 88049, 190499, 1-513; 17631, TTC22, 88047, 190497, 36-1154; 17631, TTC22, 88048, 190498, 105-1814; 17632, TTC23, 88053, 190503, 1-790; 17632, TTC23, 88055, 190505, 1-220; 17632, TTC23, 88056, 190506, 422-581; 17632, TTC23, 88058, 190508, 205-549;

17632, TTC23, 88059, 190509, 407-574; 17632, TTC23, 88060, 190510, 337-585; 17632, TTC23, 88061, 190511, 212-666; 17632, TTC23, 88062, 190512, 90-560; 17632, TTC23, 88050, 190500, 219-1400; 17632, TTC23, 88051, 190501, 819-2162; 17632, TTC23, 88052, 190502, 719-2062; 17632, TTC23, 88054, 190504, 440-1621; 17632, TTC23, 88057, 190507, 268-1611; 17632, TTC23, 88063, 190513, 579-1754; 17633, TTC23L, 88065, 190515, 102-251; 17633, TTC23L, 88064, 190514, 104-1189; 17633, TTC23L, 88066, 190516, 1-864; 17633, TTC23L, 88067, 190517, 1-864; 17634, TTC24, 88068, 190518, 37-1785; 17634, TTC24, 88069, 190519, 1-1749; 17635, TTC25, 88070, 190520, 80-1228; 17635, TTC25, 88072, 190522, 1-63; 17635, TTC25, 88073, 190523, 61-2055; 17635, TTC25, 88074, 190524, 90-347; 17635, TTC25, 88071, 190521, 69-2087; 17636, TTC26, 88077, 190527, 95-1366; 17636, TTC26, 88078, 190528, 81-1424; 17636, TTC26, 88080, 190530, 71-478; 17636, TTC26, 88081, 190531, 81-896; 17636, TTC26, 88075, 190525, 76-1647; 17636, TTC26, 88076, 190526, 115-1578; 17636, TTC26, 88079, 190529, 81-1745; 17637, TTC27, 88083, 190533, 138-263; 17637, TTC27, 88084, 190534, 165-509; 17637, TTC27, 88085, 190535, 1-141; 17637, TTC27, 88086, 190536, 1-216; 17637, TTC27, 88087, 190537, 1-302; 17637, TTC27, 88082, 190532, 232-2763; 17638, TTC28, 88089, 190539, 1-327; 17638, TTC28, 88090, 190540, 1-905; 17638, TTC28, 88091, 190541, 3-7067; 17638, TTC28, 88088, 190538, 143-7588; 17639, TTC29, 88093, 190543, 174-1133; 17639, TTC29, 88094, 190544, 179-1270; 17639, TTC29, 88095, 190545, 201-1706; 17639, TTC29, 88096, 190546, 285-565; 17639, TTC29, 88097, 190547, 479-557; 17639, TTC29, 88098, 190548, 228-1652; 17639, TTC29, 88092, 190542, 228-1655; 17640, TTC3, 88101, 190551, 87-989; 17640, TTC3, 88103, 190553, 1-893; 17640, TTC3, 88104, 190554, 110-3606; 17640, TTC3, 88105, 190555, 1-952; 17640, TTC3, 88106, 190556, 235-3771; 17640, TTC3, 88107, 190557, 110-2451; 17640, TTC3, 88108, 190558, 1-831; 17640, TTC3, 88109, 190559, 170-2008; 17640, TTC3, 88099, 190549, 1469-7546; 17640, TTC3, 88100, 190550, 106-6183; 17640, TTC3, 88102, 190552, 2748-8825; 17641, TTC30A, 88110, 190560, 266-2263; 17642, TTC30B, 88111, 190561, 252-2249; 17643, TTC31, 88113, 190563, 10-1032; 17643, TTC31, 88114, 190564, 1-740; 17643, TTC31, 88115, 190565, 15-365; 17643, TTC31, 88116, 190566, 10-360; 17643, TTC31, 88112, 190562, 8-1567; 17643, TTC31, 88117, 190567, 10-867; 17644, TTC32, 88119, 190569, 103-261; 17644, TTC32, 88120, 190570, 521-779; 17644, TTC32, 88118, 190568, 133-588; 17645, TTC33, 88121, 190571, 154-942; 17646, TTC34, 88122, 190572, 165-1865; 17646, TTC34, 88123, 190573, 125-1825; 17647, TTC36, 88125, 190575, 24-170; 17647, TTC36, 88126, 190576, 24-170; 17647, TTC36, 88124, 190574, 24-593; 17648, TTC37, 88128, 190578, 1-102; 17648, TTC37, 88129, 190579, 1-393; 17648, TTC37, 88130, 190580, 270-2102; 17648, TTC37, 88131, 190581, 292-577; 17648, TTC37, 88127, 190577, 300-4994; 17649, TTC38, 88133, 190583, 80-241; 17649, TTC38, 88134, 190584, 1-359; 17649, TTC38, 88135, 190585, 1-629; 17649, TTC38, 88136, 190586, 33-821; 17649, TTC38, 88137, 190587, 1-162; 17649, TTC38, 88132, 190582, 77-1486; 17650, TTC39A, 88138, 190588, 176-1828; 17650, TTC39A, 88140, 190590, 86-1366; 17650, TTC39A, 88142, 190592, 205-769; 17650, TTC39A, 88143, 190593, 74-547; 17650, TTC39A, 88144, 190594, 169-850; 17650, TTC39A, 88146, 190596, 88-978; 17650, TTC39A, 88148, 190598, 93-931; 17650, TTC39A, 88150, 190600, 74-577; 17650, TTC39A, 88151, 190601, 146-519; 17650, TTC39A, 88152, 190602, 92-429; 17650, TTC39A, 88139, 190589, 162-1424; 17650, TTC39A, 88141, 190591, 98-1834; 17650, TTC39A, 88145, 190595, 50-1891; 17650, TTC39A, 88147, 190597, 74-1819; 17650, TTC39A, 88149, 190599, 216-881; 17651, TTC39B, 88158, 190608, 1-210; 17651, TTC39B, 88153, 190603, 38-1879; 17651, TTC39B, 88154, 190604, 38-2047; 17651, TTC39B, 88155, 190605, 38-2086; 17651, TTC39B, 88156, 190606, 324-1877; 17651, TTC39B, 88157, 190607, 600-2153; 17652, TTC39C, 88161, 190611, 251-1081; 17652, TTC39C, 88162, 190612, 189-389; 17652, TTC39C, 88163, 190613, 40-171; 17652, TTC39C, 88159, 190609, 283-1851; 17652, TTC39C, 88160, 190610, 237-1988; 17652, TTC39C, 88164, 190614, 453-683; 17653, TTC4, 88165, 190615, 88-1251; 17654, TTC5, 88167, 190617, 5-391; 17654, TTC5, 88168, 190618, 702-748; 17654, TTC5, 88166, 190616, 58-1380; 17655, TTC6, 88170, 190620, 113-1915; 17655, TTC6, 88172, 190622, 62-1723; 17655, TTC6, 88173, 190623, 1-237; 17655, TTC6, 88174, 190624, 397-511; 17655, TTC6, 88175, 190625, 1-5661; 17655, TTC6, 88176, 190626, 127-1449; 17655, TTC6, 88169, 190619, 62-1624; 17655, TTC6, 88171, 190621, 288-1850; 17656, TTC7A, 88179, 190629, 434-2908; 17656, TTC7A, 88180, 190630, 1-199; 17656, TTC7A, 88181, 190631, 1-992; 17656, TTC7A, 88182, 190632, 1-326; 17656, TTC7A, 88177, 190627, 369-2945; 17656, TTC7A, 88178, 190628, 257-2905; 17657, TTC7B, 88184, 190634, 1-317; 17657, TTC7B, 88185, 190635, 487-630; 17657, TTC7B, 88186, 190636, 95-708; 17657, TTC7B, 88187, 190637, 1-993; 17657, TTC7B, 88188, 190638, 1-1254; 17657, TTC7B, 88189, 190639, 1-525; 17657, TTC7B, 88190, 190640, 1-814; 17657, TTC7B, 88191, 190641, 1-642; 17657, TTC7B, 88183, 190633, 123-2654; 17658, TTC8, 88192, 190642, 53-1480; 17658, TTC8, 88193, 190643, 53-1648; 17658, TTC8, 88196, 190646, 759-1712; 17658, TTC8, 88198, 190648, 197-1624; 17658, TTC8, 88199, 190649, 115-240; 17658, TTC8, 88200, 190650, 37-597; 17658, TTC8, 88201, 190651, 24-599; 17658, TTC8, 88202, 190652, 197-832; 17658, TTC8, 88203, 190653, 1-794; 17658, TTC8, 88204, 190654, 1-1313; 17658, TTC8, 88205, 190655, 197-1792; 17658, TTC8, 88206, 190656, 85-1602; 17658, TTC8, 88194, 190644, 197-1744; 17658, TTC8, 88195, 190645, 49-801; 17658, TTC8, 88197, 190647, 47-1594; 17659, TTC9, 88207, 190657, 344-1012; 17660, TTC9B, 88208, 190658, 19-738; 17661, TTC9C, 88209, 190659, 652-900; 17661, TTC9C, 88211, 190661, 1-210; 17661, TTC9C, 88213, 190663, 186-606; 17661, TTC9C, 88210, 190660, 311-826; 17661, TTC9C, 88212, 190662, 122-637; 17662, TANC1, 88215, 190665, 593-1981; 17662, TANC1, 88214, 190664, 238-5823; 17663, TANC2, 88218, 190668, 1-3764; 17663, TANC2, 88219, 190669, 1-456; 17663, TANC2, 88220, 190670, 1-331; 17663, TANC2, 88221, 190671, 1-408; 17663, TANC2, 88222, 190672, 95-3397; 17663, TANC2, 88216, 190666, 1-6003; 17663, TANC2, 88217, 190667, 5-5977; 17664, TEX13C, 88223, 190673, 1-2982; 17665, TEX13D, 88224, 190674, 259-2403; 17666, TIAF1, 88225, 190675, 4659-5006; 17667, TAB1, 88226, 190676, 63-1577; 17667, TAB1, 88227, 190677, 20-1408; 17668, TAB2, 88231, 190681, 578-677; 17668, TAB2, 88232, 190682, 257-648; 17668, TAB2, 88228, 190678, 578-2659; 17668, TAB2, 88229, 190679, 111-1721; 17668, TAB2, 88230, 190680, 267-2348; 17669, TAB3, 88233, 190683, 664-805; 17669, TAB3, 88237, 190687, 384-2210; 17669, TAB3, 88234, 190684, 133-2271; 17669, TAB3, 88235, 190685, 548-2602; 17669, TAB3, 88236, 190686, 548-2686; 17670, TGIF1, 88245, 190695, 152-564; 17670, TGIF1, 88246, 190696, 314-712; 17670, TGIF1, 88248, 190698, 144-801; 17670, TGIF1, 88249, 190699, 201-554; 17670, TGIF1, 88250, 190700, 765-1267; 17670, TGIF1, 88252, 190702, 314-706; 17670, TGIF1, 88253, 190703, 84-820; 17670, TGIF1, 88254, 190704, 128-526; 17670, TGIF1, 88255, 190705, 289-563; 17670, TGIF1, 88257, 190707, 279-533; 17670, TGIF1, 88238, 190688, 304-1509; 17670, TGIF1, 88239, 190689, 787-1605; 17670, TGIF1, 88240, 190690, 147-905; 17670, TGIF1, 88241, 190691, 128-886; 17670, TGIF1, 88242, 190692, 358-1176; 17670, TGIF1, 88243, 190693, 465-1223; 17670, TGIF1, 88244, 190694, 446-1204; 17670, TGIF1, 88247, 190697, 312-1070; 17670, TGIF1, 88251, 190701, 985-1743; 17670, TGIF1, 88256, 190706, 228-986; 17670, TGIF1, 88258, 190708, 132-992; 17671, TGIF2, 88261, 190711, 117-638; 17671, TGIF2, 88263, 190713, 1-108; 17671, TGIF2, 88264, 190714, 1-277; 17671, TGIF2, 88265, 190715, 1-335; 17671, TGIF2, 88259, 190709, 174-887; 17671, TGIF2, 88260, 190710, 200-913; 17671, TGIF2, 88262, 190712, 212-923; 17671, TGIF2, 88266, 190716, 117-830; 17672, TGIF2LX, 88269, 190719, 65-622; 17672, TGIF2LX, 88267, 190717, 109-834; 17672, TGIF2LX, 88268, 190718, 131-856; 17673, TGIF2LY, 88270, 190720, 109-666; 17673, TGIF2LY, 88271, 190721, 131-688; 17674, TGIF2-C20orf24, 88272, 190722, 118-585; 17675, THAP10, 88274, 190724, 1-383; 17675, THAP10, 88273, 190723, 514-1287; 17676, THAP11, 88275, 190725, 474-1418; 17677, THAP4, 88276, 190726, 76-654; 17677, THAP4, 88279, 190729, 184-693; 17677, THAP4, 88277, 190727, 433-2166; 17677, THAP4, 88278, 190728, 87-584; 17678, THAP5, 88282, 190732, 182-349; 17678, THAP5, 88280, 190730, 402-1463; 17678, THAP5, 88281, 190731, 155-1342; 17679, THAP6, 88285, 190735, 74-313; 17679, THAP6, 88287, 190737, 92-451; 17679, THAP6, 88288, 190738, 121-390; 17679, THAP6, 88289, 190739, 446-543; 17679, THAP6, 88290, 190740, 92-325; 17679, THAP6, 88291, 190741, 86-382; 17679, THAP6, 88292, 190742, 92-427; 17679, THAP6, 88283, 190733, 69-737; 17679, THAP6, 88284, 190734, 69-611; 17679, THAP6, 88286, 190736, 493-1161; 17679, THAP6, 88293, 190743, 69-551; 17680, THAP7, 88294, 190744, 176-1105; 17680, THAP7, 88295, 190745, 112-1041; 17681, THAP8, 88297, 190747, 161-358; 17681, THAP8, 88298, 190748, 185-310; 17681, THAP8, 88296, 190746, 546-1370; 17682, THAP9, 88300, 190750, 120-212; 17682, THAP9, 88301, 190751, 1-366; 17682, THAP9, 88302, 190752, 101-409; 17682, THAP9, 88303, 190753, 35-343; 17682, THAP9, 88304, 190754, 38-367; 17682, THAP9, 88299, 190749, 52-2763; 17683, THAP1, 88307, 190757, 108-461; 17683, THAP1, 88305, 190755, 232-873; 17683, THAP1, 88306, 190756, 212-373; 17684, THAP2, 88309, 190759, 274-577; 17684, THAP2, 88310, 190760, 254-584; 17684, THAP2, 88311, 190761, 30-188; 17684, THAP2, 88308, 190758, 1502-2188; 17685, THAP3, 88315, 190765, 1-375; 17685, THAP3, 88316, 190766, 1-694; 17685, THAP3, 88312, 190762, 159-878; 17685, THAP3, 88313, 190763, 39-755; 17685, THAP3, 88314, 190764, 28-555; 17686, THEG, 88319, 190769, 237-650; 17686, THEG, 88317, 190767, 1-1068; 17686, THEG, 88318, 190768, 701-1840; 17687, THEGL, 88320, 190770, 69-1466; 17688, TPK1, 88322, 190772, 104-469; 17688, TPK1, 88323, 190773, 104-688; 17688, TPK1, 88324, 190774, 72-641; 17688, TPK1, 88325, 190775, 82-581; 17688, TPK1, 88326, 190776, 209-448; 17688, TPK1, 88327, 190777, 211-339; 17688, TPK1, 88321, 190771, 104-835; 17689, THTPA, 88332, 190782, 1-182; 17689, THTPA, 88333, 190783, 214-581; 17689, THTPA, 88334, 190784, 89-511; 17689, THTPA, 88328, 190778, 737-1429; 17689, THTPA, 88329, 190779, 353-1045; 17689, THTPA, 88330, 190780, 465-782; 17689, THTPA, 88331, 190781, 89-406; 17690, THOP1, 88337, 190787, 164-671; 17690, THOP1, 88338, 190788, 232-761; 17690, THOP1, 88339, 190789, 1-781; 17690, THOP1, 88340, 190790, 1-651; 17690, THOP1, 88341, 190791, 1-613; 17690, THOP1, 88342, 190792, 60-1766; 17690, THOP1, 88335, 190785, 204-2273; 17690, THOP1, 88336, 190786, 779-1555; 17691, THEM4, 88344, 190794, 45-368; 17691, THEM4, 88345, 190795, 180-512; 17691, THEM4, 88343, 190793, 351-1073; 17692, THEM5, 88347, 190797, 1-355; 17692, THEM5, 88346, 190796, 133-876; 17693, THEM6, 88349, 190799, 1-251; 17693, THEM6, 88348, 190798, 145-771; 17694, TPMT, 88350, 190800, 87-824; 17695, TXN, 88351, 190801, 32-289; 17695, TXN, 88352, 190802, 206-523; 17696, TXN2, 88355, 190805, 34-474; 17696, TXN2, 88356, 190806, 328-522; 17696, TXN2, 88353, 190803, 468-968; 17696, TXN2, 88354, 190804, 199-699; 17697, TXNDC11, 88359, 190809, 1-615; 17697, TXNDC11, 88360, 190810, 1-444; 17697, TXNDC11, 88361, 190811, 1-76; 17697, TXNDC11, 88357, 190807, 149-3025; 17697, TXNDC11, 88358, 190808, 109-3066; 17698, TXNDC12, 88363, 190813, 96-263; 17698, TXNDC12, 88364, 190814, 81-251; 17698, TXNDC12, 88362, 190812, 1076-1594; 17699, TXNDC15, 88366, 190816, 1-346; 17699, TXNDC15, 88367, 190817, 1-1034; 17699, TXNDC15, 88368, 190818, 58-192; 17699, TXNDC15, 88369, 190819, 53-517; 17699, TXNDC15, 88370, 190820, 42-579; 17699, TXNDC15, 88371, 190821, 32-166; 17699, TXNDC15, 88365, 190815, 626-1708; 17700, TXNDC16, 88373, 190823, 485-542; 17700, TXNDC16, 88374, 190824, 1-323; 17700, TXNDC16, 88372, 190822, 373-2850; 17701, TXNDC17, 88376, 190826, 50-277; 17701, TXNDC17, 88377, 190827, 68-364; 17701, TXNDC17, 88378, 190828, 41-283; 17701, TXNDC17, 88375, 190825, 326-697; 17702, TXNDC2, 88381, 190831, 408-740; 17702, TXNDC2, 88382, 190832, 322-571; 17702, TXNDC2, 88379, 190829, 200-1861; 17702, TXNDC2, 88380, 190830, 236-1696; 17702, TXNDC2, 88383, 190833, 450-2066; 17703, TXNDC5, 88384, 190834, 39-1337; 17703, TXNDC5, 88385, 190835, 327-1301; 17704, TXNDC8, 88386, 190836, 52-378; 17704, TXNDC8, 88389, 190839, 13-300; 17704, TXNDC8, 88387, 190837, 13-360; 17704, TXNDC8, 88388, 190838, 89-472; 17705, TXNDC9, 88391, 190841, 162-568; 17705, TXNDC9, 88393, 190843, 33-227; 17705, TXNDC9, 88394, 190844, 128-352; 17705, TXNDC9, 88395, 190845, 180-548; 17705, TXNDC9, 88390, 190840, 257-937; 17705, TXNDC9, 88392, 190842, 128-694; 17706, TXNIP, 88396, 190846, 203-1213; 17706, TXNIP, 88397, 190847, 335-1510; 17707, TXNRD1, 88398, 190848, 702-2198; 17707, TXNRD1, 88399, 190849, 747-2393; 17707, TXNRD1, 88400, 190850, 566-1948; 17707, TXNRD1, 88401, 190851, 25-1971; 17707, TXNRD1, 88403, 190853, 368-577; 17707, TXNRD1, 88404, 190854, 312-728; 17707, TXNRD1, 88405, 190855, 424-557; 17707, TXNRD1, 88406, 190856, 79-1785; 17707, TXNRD1, 88408, 190858, 339-554; 17707, TXNRD1, 88409, 190859, 260-786; 17707, TXNRD1, 88410, 190860, 342-629; 17707, TXNRD1, 88411, 190861, 90-400; 17707, TXNRD1, 88412, 190862, 360-1808; 17707, TXNRD1, 88417, 190867, 449-607; 17707, TXNRD1, 88402, 190852, 575-2074; 17707, TXNRD1, 88407, 190857, 211-1710; 17707, TXNRD1, 88413, 190863, 25-1974; 17707, TXNRD1, 88414, 190864, 226-1611; 17707, TXNRD1, 88415, 190865, 324-1955; 17707, TXNRD1, 88416, 190866, 457-2112; 17708, TXNRD2, 88418, 190868, 2-1018; 17708, TXNRD2, 88419, 190869, 185-1669; 17708, TXNRD2, 88420, 190870, 1-1572; 17708, TXNRD2, 88422, 190872, 18-1523; 17708, TXNRD2, 88423, 190873, 383-1669; 17708, TXNRD2, 88424, 190874, 1-514; 17708, TXNRD2, 88425, 190875, 174-810; 17708, TXNRD2, 88426, 190876, 76-618; 17708, TXNRD2, 88427, 190877, 87-1007; 17708, TXNRD2, 88428, 190878, 281-778; 17708, TXNRD2, 88429, 190879, 5-1396; 17708, TXNRD2, 88430, 190880, 1-1086; 17708, TXNRD2, 88421, 190871, 190-1764; 17709, TXNRD3, 88431, 190881, 480-881; 17709, TXNRD3, 88432, 190882, 1-126; 17709, TXNRD3, 88433, 190883, 112-1935; 17709, TXNRD3, 88434, 190884, 166-2097; 17709, TXNRD3, 88435, 190885, 58-309; 17710, TXNRD3NB, 88436, 190886, 94-495; 17711, TXNL1, 88439, 190889, 815-896; 17711, TXNL1, 88440, 190890, 1-311; 17711, TXNL1, 88441, 190891, 519-934; 17711, TXNL1, 88442, 190892, 858-1067; 17711, TXNL1, 88443, 190893, 1-845; 17711, TXNL1, 88437, 190887, 206-1075; 17711, TXNL1, 88438, 190888, 265-1134; 17712, TXNL4A, 88445, 190895, 145-420; 17712, TXNL4A, 88446, 190896, 150-323; 17712, TXNL4A, 88447, 190897, 159-374; 17712, TXNL4A, 88448, 190898, 160-375; 17712, TXNL4A, 88449, 190899, 190-354; 17712, TXNL4A, 88450, 190900, 146-406; 17712, TXNL4A, 88451, 190901, 111-275; 17712, TXNL4A, 88452, 190902, 146-457; 17712, TXNL4A, 88453, 190903, 277-492; 17712, TXNL4A, 88444, 190894, 202-630; 17713, TXNL4B, 88457, 190907, 229-581; 17713, TXNL4B, 88458, 190908, 224-397; 17713, TXNL4B, 88459, 190909, 263-546; 17713, TXNL4B, 88454, 190904, 323-772; 17713, TXNL4B, 88455, 190905, 276-725; 17713, TXNL4B, 88456, 190906, 263-712; 17714, TMX1, 88461, 190911, 44-361; 17714, TMX1, 88460, 190910, 126-968; 17715, TMX2, 88464, 190914, 6-317; 17715, TMX2, 88465, 190915, 8-355; 17715, TMX2, 88466, 190916, 6-260; 17715, TMX2, 88467, 190917, 13-273; 17715, TMX2, 88468, 190918, 6-353; 17715, TMX2, 88469, 190919, 20-331; 17715, TMX2, 88462, 190912, 13-903; 17715, TMX2, 88463, 190913, 17-793; 17716, TMX3, 88471, 190921, 77-670; 17716, TMX3, 88472, 190922, 89-475; 17716, TMX3, 88473, 190923, 85-276; 17716, TMX3, 88474, 190924, 97-366; 17716, TMX3, 88475, 190925, 196-405; 17716, TMX3, 88477, 190927, 55-324; 17716, TMX3, 88470, 190920, 318-1682; 17716, TMX3, 88476, 190926, 78-665; 17717, TMX4, 88479, 190929, 34-273; 17717, TMX4, 88480, 190930, 193-787; 17717, TMX4, 88478, 190928, 217-1266; 17718, TST, 88483, 190933, 80-451; 17718, TST, 88481, 190931, 150-1043; 17718, TST, 88482, 190932, 736-1629; 17718, TST, 88484, 190934, 44-937; 17719, TSTD1, 88489, 190939, 206-394; 17719, TSTD1, 88485, 190935, 49-378; 17719, TSTD1, 88486, 190936, 62-430; 17719, TSTD1, 88487, 190937, 89-313; 17719, TSTD1, 88488, 190938, 102-449; 17720, TSTD2, 88491, 190941, 1-22; 17720, TSTD2, 88492, 190942, 110-289; 17720, TSTD2, 88490, 190940, 384-1934; 17721, THOC1, 88494, 190944, 27-287; 17721, THOC1, 88495, 190945, 4-759; 17721, THOC1, 88496, 190946, 32-397; 17721, THOC1, 88497, 190947, 1-815; 17721, THOC1, 88498, 190948, 1-286; 17721, THOC1, 88499, 190949, 1-1974; 17721, THOC1, 88500, 190950, 1-1083; 17721, THOC1, 88501, 190951, 1-366; 17721, THOC1, 88493, 190943, 9-1982; 17722, THOC2, 88504, 190954, 1-569; 17722, THOC2, 88505, 190955, 1-255; 17722, THOC2, 88506, 190956, 1-1166; 17722, THOC2, 88507, 190957, 1-543; 17722, THOC2, 88508, 190958, 16-378; 17722, THOC2, 88509, 190959, 1-497; 17722, THOC2, 88510, 190960, 1-1137; 17722, THOC2, 88511, 190961, 1-4437; 17722, THOC2, 88502, 190952, 33-4814; 17722, THOC2, 88503, 190953, 35-4816; 17722, THOC2, 88512, 190962, 80-1324; 17723, THOC3, 88514, 190964, 1-227; 17723, THOC3, 88515, 190965, 61-378; 17723, THOC3, 88517, 190967, 1-169; 17723, THOC3, 88518, 190968, 42-542; 17723, THOC3, 88519, 190969, 1-174; 17723, THOC3, 88520, 190970, 1-168; 17723, THOC3, 88521, 190971, 1-42; 17723, THOC3, 88522, 190972, 108-425; 17723, THOC3, 88513, 190963, 92-1147; 17723, THOC3, 88516, 190966, 73-1056; 17724, THOC5, 88526, 190976, 459-738; 17724, THOC5, 88527, 190977, 1-786; 17724, THOC5, 88528, 190978, 199-330; 17724, THOC5, 88529, 190979, 336-1006; 17724, THOC5, 88530, 190980, 52-579; 17724, THOC5, 88531, 190981, 712-1743; 17724, THOC5, 88532, 190982, 245-729; 17724, THOC5, 88534, 190984, 11-394; 17724, THOC5, 88523, 190973, 220-2271; 17724, THOC5, 88524, 190974, 336-2387; 17724, THOC5, 88525, 190975, 224-2275; 17724, THOC5, 88533, 190983, 124-2175; 17725, THOC6, 88535, 190985, 264-1154; 17725, THOC6, 88536, 190986, 297-1322; 17725, THOC6, 88537, 190987, 249-1202; 17725, THOC6, 88538, 190988, 342-1295; 17726, THOC7, 88540, 190990, 117-575; 17726, THOC7, 88541, 190991, 280-459; 17726, THOC7, 88542, 190992, 1-92; 17726, THOC7, 88539, 190989, 114-728; 17727, TREX1, 88543, 190993, 57-584; 17727, TREX1, 88544, 190994, 533-1060; 17727, TREX1, 88545, 190995, 243-1157; 17727, TREX1, 88546, 190996, 482-1426; 17727, TREX1, 88547, 190997, 629-1738; 17728, TREX2, 88548, 190998, 1552-2262; 17728, TREX2, 88549, 190999, 1143-1982; 17728, TREX2, 88550, 191000, 1406-2116; 17728, TREX2, 88551, 191001, 22-861; 17728, TREX2, 88552, 191002, 545-1255; 17728, TREX2, 88553, 191003, 1025-1864; 17728, TREX2, 88554, 191004, 197-907; 17729, THNSL1, 88555, 191005, 251-2482; 17729, THNSL1, 88556, 191006, 348-2579; 17730, THNSL2, 88559, 191009, 219-899; 17730, THNSL2, 88560, 191010, 198-577; 17730, THNSL2, 88561, 191011, 182-958; 17730, THNSL2, 88557, 191007, 1692-3146; 17730, THNSL2, 88558, 191008, 72-1289; 17731, TARS, 88564, 191014, 111-506; 17731, TARS, 88565, 191015, 80-466; 17731, TARS, 88566, 191016, 93-449; 17731, TARS, 88567, 191017, 605-755; 17731, TARS, 88569, 191019, 92-292; 17731, TARS, 88570, 191020, 95-262; 17731, TARS, 88571, 191021, 124-294; 17731, TARS, 88572, 191022, 1-171; 17731, TARS, 88573, 191023, 1-201; 17731, TARS, 88562, 191012, 312-2483; 17731, TARS, 88563, 191013, 123-2393; 17731, TARS, 88568, 191018, 138-2309; 17732, TARS2, 88574, 191024, 17-424; 17732, TARS2, 88577, 191027, 312-1643; 17732, TARS2, 88578, 191028, 1-432; 17732, TARS2, 88579, 191029, 32-1942; 17732, TARS2, 88575, 191025, 38-1804; 17732, TARS2, 88576, 191026, 35-2191; 17733, TARSL2, 88581, 191031, 24-2324; 17733, TARSL2, 88582, 191032, 1-447; 17733, TARSL2, 88583, 191033, 56-2356; 17733, TARSL2, 88580, 191030, 218-2626; 17734, THBD, 88584, 191034, 238-1965; 17735, THPO, 88587, 191037, 1-861; 17735, THPO, 88585, 191035, 216-1277; 17735, THPO, 88586, 191036, 212-1261; 17736, THBS1, 88589, 191039, 301-582; 17736, THBS1, 88588, 191038, 166-3678; 17737, THBS2, 88591, 191041, 187-437; 17737, THBS2, 88590, 191040, 251-3769; 17737, THBS2, 88592, 191042, 132-3650; 17738, THBS3, 88595, 191045, 24-1226; 17738, THBS3, 88596, 191046, 1421-2878; 17738, THBS3, 88597, 191047, 106-2949; 17738, THBS3, 88593, 191043, 22-2892; 17738, THBS3, 88594, 191044, 42-2552; 17739, THBS4, 88599, 191049, 341-2953; 17739, THBS4, 88598, 191048, 191-3076; 17740, THSD1, 88600, 191050, 180-2738; 17740, THSD1, 88601, 191051, 546-2945; 17741, THSD4, 88605, 191055, 114-416; 17741, THSD4, 88602, 191052, 129-788; 17741, THSD4, 88603, 191053, 135-3191; 17741, THSD4, 88604, 191054, 175-2151; 17742, THSD7A, 88607, 191057, 253-5226; 17742, THSD7A, 88606, 191056, 253-5226; 17743, THSD7B, 88609, 191059, 179-4999; 17743, THSD7B, 88610, 191060, 1-4734; 17743, THSD7B, 88611, 191061, 179-331; 17743, THSD7B, 88608, 191058, 1-4827; 17744, TSPEAR, 88613, 191063, 160-1752; 17744, TSPEAR, 88614, 191064, 67-1635; 17744, TSPEAR, 88615, 191065, 333-2138; 17744, TSPEAR, 88612, 191062, 67-2076; 17745, TBXAS1, 88616, 191066, 539-2143; 17745, TBXAS1, 88618, 191068, 303-752; 17745, TBXAS1, 88620, 191070, 539-2281; 17745, TBXAS1, 88621, 191071, 138-593; 17745, TBXAS1, 88622, 191072, 236-1618; 17745, TBXAS1, 88626, 191076, 90-332; 17745, TBXAS1, 88627, 191077, 145-384; 17745, TBXAS1, 88617, 191067, 390-1991; 17745, TBXAS1, 88619, 191069, 490-1890; 17745, TBXAS1, 88623, 191073, 168-1769; 17745, TBXAS1, 88624, 191074, 138-1877; 17745, TBXAS1, 88625, 191075, 128-1507; 17746, TBXA2R, 88630, 191080, 36-815; 17746, TBXA2R, 88628, 191078, 395-1426; 17746, TBXA2R, 88629, 191079, 215-1438; 17747, THUMPD1, 88633, 191083, 65-502; 17747, THUMPD1, 88631, 191081, 346-1407; 17747, THUMPD1, 88632, 191082, 58-1119; 17748, THUMPD2, 88636, 191086, 1-876; 17748, THUMPD2, 88637, 191087, 1-267; 17748, THUMPD2, 88634, 191084, 29-940; 17748, THUMPD2, 88635, 191085, 29-1540; 17749, THUMPD3, 88640, 191090, 1-698; 17749, THUMPD3, 88641, 191091, 609-730; 17749, THUMPD3, 88642, 191092, 335-704; 17749, THUMPD3, 88643, 191093, 1-807; 17749, THUMPD3, 88638, 191088, 335-1858; 17749, THUMPD3, 88639, 191089, 340-1863; 17749, THUMPD3, 88644, 191094, 685-2208; 17750, THY1, 88647, 191097, 85-198; 17750, THY1, 88648, 191098, 85-581; 17750, THY1, 88649, 191099, 113-570; 17750, THY1, 88650, 191100, 111-545; 17750, THY1, 88645, 191095, 1041-1526; 17750, THY1, 88646, 191096, 977-1462; 17751, TSLP, 88652, 191102, 1423-1902; 17751, TSLP, 88651, 191101, 200-679; 17751, TSLP, 88653, 191103, 270-461; 17752, TK1, 88655, 191105, 45-308; 17752, TK1, 88656, 191106, 70-631; 17752, TK1, 88657, 191107, 240-1043; 17752, TK1, 88658, 191108, 43-585; 17752, TK1, 88654, 191104, 240-944; 17753, TK2, 88660, 191110, 4-873; 17753, TK2, 88661, 191111, 226-1149; 17753, TK2, 88667, 191117, 46-894; 17753, TK2, 88668, 191118, 27-389; 17753, TK2, 88669, 191119, 363-753; 17753, TK2, 88670, 191120, 1-68; 17753, TK2, 88671, 191121, 288-553; 17753, TK2, 88673, 191123, 1-428; 17753, TK2, 88659, 191109, 352-1149; 17753, TK2, 88662, 191112, 957-1463; 17753, TK2, 88663, 191113, 417-923; 17753, TK2, 88664, 191114, 9-713; 17753, TK2, 88665, 191115, 62-784; 17753, TK2, 88666, 191116, 55-852; 17753, TK2, 88672, 191122, 362-868; 17753, TK2, 88674, 191124, 352-1095; 17754, TYMP, 88679, 191129, 98-1432; 17754, TYMP, 88675, 191125, 164-1612; 17754, TYMP, 88676, 191126, 152-1600; 17754, TYMP, 88677, 191127, 142-1590; 17754, TYMP, 88678, 191128, 123-1586; 17755, TYMS, 88680, 191130, 1-840; 17755, TYMS, 88681, 191131, 1-693; 17755, TYMS, 88682, 191132, 140-1081; 17756, TDG, 88683, 191133, 280-1500; 17756, TDG, 88685, 191135, 410-824; 17756, TDG, 88686, 191136, 153-923; 17756, TDG, 88687, 191137, 1-334; 17756, TDG, 88688, 191138, 480-1283; 17756, TDG, 88684, 191134, 235-1467; 17757, TESPA1, 88693, 191143, 341-582; 17757, TESPA1, 88694, 191144, 381-523; 17757, TESPA1, 88695, 191145, 1-242; 17757, TESPA1, 88696, 191146, 316-519; 17757, TESPA1, 88698, 191148, 381-562; 17757, TESPA1, 88699, 191149, 291-592; 17757, TESPA1, 88700, 191150, 538-783; 17757, TESPA1, 88701, 191151, 1-450; 17757, TESPA1, 88702, 191152, 295-1479; 17757, TESPA1, 88689, 191139, 111-1676; 17757, TESPA1, 88690, 191140, 134-1699; 17757, TESPA1, 88691, 191141, 537-1688; 17757, TESPA1, 88692, 191142, 328-1479; 17757, TESPA1, 88697, 191147, 663-1814; 17758, THYN1, 88703, 191153, 159-659; 17758, THYN1, 88704, 191154, 463-1140; 17758, THYN1, 88705, 191155, 107-784; 17758, THYN1, 88706, 191156, 57-734; 17759, THEMIS, 88709, 191159, 1-631; 17759, THEMIS, 88714, 191164, 1-631; 17759, THEMIS, 88715, 191165, 317-2005; 17759, THEMIS, 88707, 191157, 150-2075; 17759, THEMIS, 88708, 191158, 263-2188; 17759, THEMIS, 88710, 191160, 219-2039; 17759, THEMIS, 88711, 191161, 263-2188; 17759, THEMIS, 88712, 191162, 150-2075; 17759, THEMIS, 88713, 191163, 185-2005; 17759, THEMIS, 88716, 191166, 142-2184; 17760, THEMIS2, 88721, 191171, 17-415; 17760, THEMIS2, 88722, 191172, 1-1175; 17760, THEMIS2, 88723, 191173, 15-754; 17760, THEMIS2, 88717, 191167, 30-1574; 17760, THEMIS2, 88718, 191168, 5-1936; 17760, THEMIS2, 88719, 191169, 29-811; 17760, THEMIS2, 88720, 191170, 24-395; 17761, TOX, 88724, 191174, 222-1802; 17762, TMPO, 88727, 191177, 251-1495; 17762, TMPO, 88730, 191180, 1-713; 17762, TMPO, 88726, 191176, 239-2323; 17762, TMPO, 88725, 191175, 17-763; 17762, TMPO, 88728, 191178, 238-1275; 17762, TMPO, 88729, 191179, 357-1721; 17763, TMSB10, 88731, 191181, 110-244; 17764, TMSB15A, 88732, 191182, 137-274; 17765, TMSB15B, 88737, 191187, 101-238; 17765, TMSB15B, 88733, 191183, 115-252; 17765, TMSB15B, 88734, 191184, 1644-1781; 17765, TMSB15B, 88735, 191185, 1118-1255; 17765, TMSB15B, 88736, 191186, 134-271; 17766, TMSB4X, 88738, 191188, 91-225; 17766, TMSB4X, 88739, 191189, 217-351; 17766, TMSB4X, 88740, 191190, 1153-1287; 17766, TMSB4X, 88741, 191191, 78-212; 17767, TMSB4Y, 88742, 191192, 770-904; 17768, TBATA, 88744, 191194, 391-1449; 17768, TBATA, 88743, 191193, 391-1446; 17769, TG, 88746, 191196, 44-223; 17769, TG, 88747, 191197, 1-442; 17769, TG, 88748, 191198, 1-185; 17769, TG, 88749, 191199, 1-678; 17769, TG, 88750, 191200, 1-581; 17769, TG, 88751, 191201, 1-223; 17769, TG, 88752, 191202, 1-519; 17769, TG, 88753, 191203, 318-3023; 17769, TG, 88754, 191204, 1-3673; 17769, TG, 88745, 191195, 41-8347; 17770, THADA, 88755, 191205, 133-1026; 17770, THADA, 88756, 191206, 133-1026; 17770, THADA, 88758, 191208, 1-1227; 17770, THADA, 88760, 191210, 149-2761; 17770, THADA, 88763, 191213, 1-3581; 17770, THADA, 88764, 191214, 25-1071; 17770, THADA, 88757, 191207, 118-2802; 17770, THADA, 88759, 191209, 29-2842; 17770, THADA, 88761, 191211, 353-6214; 17770, THADA, 88762, 191212, 141-6002; 17771, THRAP3, 88766, 191216, 260-380; 17771, THRAP3, 88765, 191215, 225-3092; 17771, THRAP3, 88767, 191217, 341-3208; 17772, TRIP10, 88770, 191220, 1-1782; 17772, TRIP10, 88771, 191221, 336-586; 17772, TRIP10, 88772, 191222, 647-1960; 17772, TRIP10, 88773, 191223, 49-1080; 17772, TRIP10, 88768, 191218, 36-1841; 17772, TRIP10, 88769, 191219, 83-1720; 17773, TRIP11, 88775, 191225, 1-5086; 17773, TRIP11, 88776, 191226, 1-531; 17773, TRIP11, 88777, 191227, 362-564; 17773, TRIP11, 88774, 191224, 375-6314; 17773, TRIP12, 88779, 191229, 287-583; 17774, TRIP12, 88782, 191232, 123-1415; 17774, TRIP12, 88783, 191233, 149-719; 17774, TRIP12, 88784, 191234, 1-652; 17774, TRIP12, 88785, 191235, 1-562; 17774, TRIP12, 88786, 191236, 142-603; 17774, TRIP12, 88787, 191237, 138-584; 17774, TRIP12, 88778, 191228, 180-6158; 17774, TRIP12, 88780, 191230, 170-6292; 17774, TRIP12, 88781, 191231, 74-5242; 17775, TRIP13, 88789, 191239, 1-746; 17775, TRIP13, 88788, 191238, 357-1655; 17776, TRIP4, 88791, 191241, 10-141; 17776, TRIP4, 88792, 191242, 1-334; 17776, TRIP4, 88793, 191243, 6-1112; 17776, TRIP4, 88794, 191244, 3-383; 17776, TRIP4, 88795, 191245, 1-184; 17776, TRIP4, 88790, 191240, 61-1806; 17777, TRIP6, 88797, 191247, 1-646; 17777, TRIP6, 88801, 191251, 147-1163; 17777, TRIP6, 88796, 191246, 361-1791; 17777, TRIP6, 88798, 191248, 105-347; 17777, TRIP6, 88799, 191249, 112-432; 17777, TRIP6, 88800, 191250, 1-243; 17778, THRA, 88806, 191256, 357-574; 17778, THRA, 88808, 191258, 487-581; 17778, THRA, 88809, 191259, 654-907; 17778, THRA, 88810, 191260, 392-563; 17778, THRA, 88802, 191252, 581-2053; 17778, THRA, 88803, 191253, 557-2029; 17778, THRA, 88804, 191254, 492-1724; 17778, THRA, 88805, 191255, 403-1635; 17778, THRA, 88807, 191257, 581-1936; 17779, THRB, 88814, 191264, 389-754; 17779, THRB, 88815, 191265, 404-592; 17779, THRB, 88816, 191266, 226-568; 17779, THRB, 88817, 191267, 265-575; 17779, THRB, 88818, 191268, 337-539; 17779, THRB, 88819, 191269, 306-671; 17779, THRB, 88820, 191270, 501-896; 17779, THRB, 88822, 191272, 340-703; 17779, THRB, 88811, 191261, 242-1672; 17779, THRB, 88812, 191262, 286-1671; 17779, THRB, 88813, 191263, 397-1782; 17779, THRB, 88821, 191271, 510-1895; 17780, THRSP, 88823, 191273, 22-462; 17781, TPO, 88829, 191279, 87-611; 17781, TPO, 88830, 191280, 28-542; 17781, TPO, 88831, 191281, 1-1214; 17781, TPO, 88832, 191282, 1-2595; 17781, TPO, 88833, 191283, 1-1092; 17781, TPO, 88834, 191284, 92-616; 17781, TPO, 88835, 191285, 92-616; 17781, TPO, 88836, 191286, 92-2761; 17781, TPO, 88837, 191287, 92-2893; 17781, TPO, 88838, 191288, 73-2649; 17781, TPO, 88839, 191289, 1-2595; 17781, TPO, 88840, 191290, 1-2229; 17781, TPO, 88841, 191291, 28-542; 17781, TPO, 88842, 191292, 1-1042; 17781, TPO, 88843, 191293, 84-2831; 17781, TPO, 88844, 191294, 1-1038; 17781, TPO, 88845, 191295, 87-611; 17781, TPO, 88824, 191274, 2-2671; 17781, TPO, 88825, 191275, 92-2893; 17781, TPO, 88826, 191276, 84-2885; 17781, TPO, 88827, 191277, 1-2283; 17781, TPO, 88828, 191278, 73-2703; 17782, TSHR, 88846, 191296, 157-2451; 17782, TSHR, 88848, 191298, 323-2617; 17782, TSHR, 88850, 191300, 53-391; 17782, TSHR, 88851, 191301, 27-722; 17782, TSHR, 88847, 191297, 251-1012; 17782, TSHR, 88849, 191299, 27-851; 17783, TSHB, 88852, 191302, 39-455; 17783, TSHB, 88853, 191303, 1-417; 17784, TEF, 88856, 191306, 1-551; 17784, TEF, 88854, 191304, 117-1028; 17784, TEF, 88855, 191305, 201-1022; 17785, TRH, 88858, 191308, 145-861; 17785, TRH, 88857, 191307, 528-1256; 17786, TRHDE, 88860, 191310, 1-582; 17786, TRHDE, 88859, 191309, 97-3171; 17787, TRHR, 88861, 191311, 90-1286; 17787, TRHR, 88862, 191312, 352-1548; 17788, TIA1, 88863, 191313, 151-1308; 17788, TIA1, 88864, 191314, 1-457; 17788, TIA1, 88865, 191315, 181-1038; 17788, TIA1, 88867, 191317, 568-911; 17788, TIA1, 88870, 191320, 182-667; 17788, TIA1, 88871, 191321, 229-663; 17788, TIA1, 88866, 191316, 212-1372; 17788, TIA1, 88868, 191318, 231-1358; 17788, TIA1, 88869, 191319, 25-669; 17789, TIAL1, 88872, 191322, 48-305; 17789, TIAL1, 88875, 191325, 118-515; 17789, TIAL1, 88876, 191326, 565-972; 17789, TIAL1, 88877, 191327, 168-254; 17789, TIAL1, 88873, 191323, 31-1209; 17789, TIAL1, 88874, 191324, 46-1173; 17790, TIGD1, 88878, 191328, 711-2486; 17791, TIGD2, 88879, 191329, 159-1736; 17791, TIGD2, 88880, 191330, 1293-2870; 17792, TIGD3, 88881, 191331, 208-1623; 17793, TIGD4, 88882, 191332, 822-2360; 17794, TIGD5, 88883, 191333, 70-1998; 17794, TIGD5, 88884, 191334, 70-1998; 17795, TIGD6, 88885, 191335, 776-2341; 17795, TIGD6, 88886, 191336, 809-2374; 17796, TIGD7, 88888, 191338, 208-555; 17796, TIGD7, 88887, 191337, 1830-3479; 17797, TJAP1, 88894, 191344, 281-581; 17797, TJAP1, 88895, 191345, 331-909; 17797, TJAP1, 88896, 191346, 1-718; 17797, TJAP1, 88889, 191339, 379-2022; 17797, TJAP1, 88890, 191340, 434-2077; 17797, TJAP1, 88891, 191341, 377-2050; 17797, TJAP1, 88892, 191342, 324-1997; 17797, TJAP1, 88893, 191343, 324-1967; 17797, TJAP1, 88897, 191347, 228-1871; 17797, TJAP1, 88898, 191348, 342-2015; 17797, TJAP1, 88899, 191349, 1015-1146; 17798, TJP1, 88901, 191351, 1-5307; 17798, TJP1, 88902, 191352, 1-682; 17798, TJP1, 88903, 191353, 243-5321; 17798, TJP1, 88905, 191355, 475-1626; 17798, TJP1, 88906, 191356, 27-720; 17798, TJP1, 88907, 191357, 524-5554; 17798, TJP1, 88908, 191358, 243-5321; 17798, TJP1, 88909, 191359, 512-5542; 17798, TJP1, 88911, 191361, 488-1636; 17798, TJP1, 88900, 191350, 476-5722; 17798, TJP1, 88904, 191354, 1-5007; 17798, TJP1, 88910, 191360, 488-5794; 17799, TJP2, 88915, 191365, 136-441; 17799, TJP2, 88917, 191367, 132-614; 17799, TJP2, 88920, 191370, 189-591; 17799, TJP2, 88912, 191362, 80-3061; 17799, TJP2, 88913, 191363, 97-3228; 17799, TJP2, 88914, 191364, 209-3781; 17799, TJP2, 88916, 191366, 233-3295; 17799, TJP2, 88918, 191368, 1-3666; 17799, TJP2, 88919, 191369, 152-3625; 17800, TJP3, 88923, 191373, 1-178; 17800, TJP3, 88926, 191376, 210-580; 17800, TJP3, 88921, 191371, 463-3222; 17800, TJP3, 88922, 191372, 120-2771; 17800, TJP3, 88924, 191374, 157-2943; 17800, TJP3, 88925, 191375, 1-2817; 17801, TIMELESS, 88927, 191377, 156-3779; 17801, TIMELESS, 88928, 191378, 152-3778; 17802, TIPIN, 88930, 191380, 56-280; 17802, TIPIN, 88931, 191381, 72-495; 17802, TIPIN, 88932, 191382, 127-1009; 17802, TIPIN, 88933, 191383, 336-685; 17802, TIPIN, 88929, 191379, 87-992; 17803, TIMP1, 88935, 191385, 97-528; 17803, TIMP1, 88936, 191386, 55-341; 17803, TIMP1, 88937, 191387, 76-486; 17803, TIMP1, 88938, 191388, 1-497; 17803, TIMP1, 88934, 191384, 171-794; 17804, TIMP2, 88940, 191390, 294-725; 17804, TIMP2, 88941, 191391, 319-648; 17804, TIMP2, 88942, 191392, 224-655; 17804, TIMP2, 88943, 191393, 272-703; 17804, TIMP2, 88939, 191389, 300-962; 17805, TIMP3, 88944, 191394, 302-937; 17806, TIMP4, 88945, 191395, 512-1186; 17807, TFPI, 88950, 191400, 227-545; 17807, TFPI, 88951, 191401, 418-733; 17807, TFPI, 88952, 191402, 296-1161; 17807, TFPI, 88953, 191403, 327-554; 17807, TFPI, 88954, 191404, 502-685; 17807, TFPI, 88955, 191405, 486-804; 17807, TFPI, 88956, 191406, 41-687; 17807, TFPI, 88946, 191396, 296-1210; 17807, TFPI, 88947, 191397, 242-997; 17807, TFPI, 88948, 191398, 29-943; 17807, TFPI, 88949, 191399, 266-1021; 17808, TFPI2, 88958, 191408, 1-324; 17808, TFPI2, 88957, 191407, 314-1021; 17809, TSTA3, 88960, 191410, 65-869; 17809, TSTA3, 88961, 191411, 1-195; 17809, TSTA3, 88962, 191412, 133-488; 17809, TSTA3, 88963, 191413, 312-412; 17809, TSTA3, 88965, 191415, 50-397; 17809, TSTA3, 88966, 191416, 276-871; 17809, TSTA3, 88969, 191419, 50-397; 17809, TSTA3, 88970, 191420, 1-195; 17809, TSTA3, 88971, 191421, 207-871; 17809, TSTA3, 88972, 191422, 133-488; 17809, TSTA3, 88973, 191423, 312-412; 17809, TSTA3, 88974, 191424, 65-869; 17809, TSTA3, 88959, 191409, 105-1070; 17809, TSTA3, 88964, 191414, 67-1032; 17809, TSTA3, 88967, 191417, 105-1070; 17809, TSTA3, 88968, 191418, 67-1032; 17810, TTN, 88975, 191425, 226-81582; 17810, TTN, 88979, 191429, 1-766; 17810, TTN, 88980, 191430, 490-635; 17810, TTN, 88981, 191431, 1-723; 17810, TTN, 88982, 191432, 1-519; 17810, TTN, 88983, 191433, 1-2887; 17810, TTN, 88984, 191434, 1-641; 17810, TTN, 88985, 191435, 1-1118; 17810, TTN, 88988, 191438, 226-108201; 17810, TTN, 88990, 191440, 1-1063; 17810, TTN, 88976, 191426, 224-100495; 17810, TTN, 88977, 191427, 226-81381; 17810, TTN, 88978, 191428, 224-17038; 17810, TTN, 88986, 191436, 226-81006; 17810, TTN, 88987, 191437, 226-103278; 17810, TTN, 88989, 191439, 226-103278; 17811, TCAP, 88992, 191442, 12-443; 17811, TCAP, 88991, 191441, 1174-1677; 17812, TLCD1, 88995, 191445, 137-578; 17812, TLCD1, 88996, 191446, 1-161; 17812, TLCD1, 88993, 191443, 112-855; 17812, TLCD1, 88994, 191444, 125-727; 17813, TLCD2, 88997, 191447, 197-991; 17813, TLCD2, 88998, 191448, 197-991; 17814, TRIL, 88999, 191449, 247-2682; 17815, TM2D1, 89001, 191451, 118-927; 17815, TM2D1, 89002, 191452, 1-160; 17815, TM2D1, 89003, 191453, 14-574; 17815, TM2D1, 89004, 191454, 25-255; 17815, TM2D1, 89006, 191456, 1-233; 17815, TM2D1, 89007, 191457, 1-314; 17815, TM2D1, 89000, 191450, 304-927; 17815, TM2D1, 89005, 191455, 22-645; 17816, TM2D2, 89011, 191461, 415-549; 17816, TM2D2, 89012, 191462, 524-885; 17816, TM2D2, 89013, 191463, 383-570; 17816, TM2D2, 89008, 191458, 589-1104; 17816, TM2D2, 89009, 191459, 256-771; 17816, TM2D2, 89010, 191460, 95-739; 17817, TM2D3, 89016, 191466, 16-567; 17817, TM2D3, 89017, 191467, 558-1106; 17817, TM2D3, 89018, 191468, 31-159; 17817, TM2D3, 89019, 191469, 1-485; 17817, TM2D3, 89020, 191470, 24-653; 17817, TM2D3, 89021, 191471, 1-65; 17817, TM2D3, 89014, 191464, 31-696; 17817, TM2D3, 89015, 191465, 7-750; 17818, TM4SF19-TCTEX1D2, 89022, 191472, 112-741; 17819, TMED7-TICAM2, 89023, 191473, 370-1584; 17819, TMED7-TICAM2, 89024, 191474, 223-789; 17820, TMEM110-MUSTN1, 89025, 191475, 1-446; 17820, TMEM110-MUSTN1, 89026, 191476, 113-1231; 17821, TMEM189-UBE2V1, 89027, 191477, 1-1113; 17822, N/A, 89028, 191478, 14-220; 17822, N/A, 89029, 191479, 14-139; 17822, N/A, 89030, 191480, 14-220; 17822, N/A, 89031, 191481, 1-87; 17823, TMEM256-PLSCR3, 89034, 191484, 215-724; 17823, TMEM256-PLSCR3, 89035, 191485, 227-581; 17823, TMEM256-PLSCR3, 89037, 191487, 416-862; 17823, TMEM256-PLSCR3, 89039, 191489, 159-974; 17823, TMEM256-PLSCR3, 89040, 191490, 477-583; 17823, TMEM256-PLSCR3, 89041, 191491, 1-516; 17823, TMEM256-PLSCR3, 89042, 191492, 525-1196; 17823, TMEM256-PLSCR3, 89032, 191482, 144-1031; 17823, TMEM256-PLSCR3, 89033, 191483, 525-1412; 17823, TMEM256-PLSCR3, 89036, 191486, 493-1380; 17823, TMEM256-PLSCR3, 89038, 191488, 426-1313; 17824, TMEM56-RWDD3, 89043, 191493, 1-325; 17824, TMEM56-RWDD3, 89044, 191494, 181-786; 17825, TMEM9B, 89047, 191497, 220-507; 17825, TMEM9B, 89049, 191499, 466-625; 17825, TMEM9B, 89045, 191495, 259-633; 17825, TMEM9B, 89046, 191496, 240-614; 17825, TMEM9B, 89048, 191498, 461-1057; 17826, TRNP1, 89051, 191501, 1-152; 17826, TRNP1, 89050, 191500, 81-764; 17827, TMX2-CTNND1, 89052, 191502, 15-326; 17828, TRAF1, 89053, 191503, 2447-3697; 17828, TRAF1, 89054, 191504, 204-1088; 17828, TRAF1, 89055, 191505, 426-1676; 17829, TRAF2, 89057, 191507, 318-680; 17829, TRAF2, 89058, 191508, 195-709; 17829, TRAF2, 89059, 191509, 244-823; 17829, TRAF2, 89056, 191506, 53-1558; 17830, TRAF3, 89060, 191510, 354-1985; 17830, TRAF3, 89061, 191511, 137-1768; 17830, TRAF3, 89064, 191514, 1-624; 17830, TRAF3, 89065, 191515, 1-870; 17830, TRAF3, 89066, 191516, 420-701; 17830, TRAF3, 89062, 191512, 276-1982; 17830, TRAF3, 89063, 191513, 92-1549; 17830, TRAF3, 89067, 191517, 218-1924; 17831, TRAF3IP1, 89070, 191520, 128-286; 17831, TRAF3IP1, 89068, 191518, 223-2298; 17831, TRAF3IP1, 89069, 191519, 223-2100; 17832, TRAF4, 89072, 191522, 29-616; 17832, TRAF4, 89073, 191523, 1-339; 17832, TRAF4, 89074, 191524, 84-631; 17832, TRAF4, 89075, 191525, 74-1387; 17832, TRAF4, 89076, 191526, 96-245; 17832, TRAF4, 89077, 191527, 1-277; 17832, TRAF4, 89078, 191528, 682-825; 17832, TRAF4, 89079, 191529, 78-239; 17832, TRAF4, 89080, 191530, 316-585; 17832, TRAF4, 89081, 191531, 109-543; 17832, TRAF4, 89071, 191521, 130-1542; 17833, TRAF5, 89082, 191532, 55-1728; 17833, TRAF5, 89083, 191533, 61-1734; 17833, TRAF5, 89084, 191534, 61-1734; 17834, TRAF6, 89085, 191535, 325-1893; 17834, TRAF6, 89086, 191536, 248-1816; 17835, TRAF7, 89088, 191538, 297-737; 17835, TRAF7, 89089, 191539, 69-233; 17835, TRAF7, 89090, 191540, 94-354; 17835, TRAF7, 89091, 191541, 200-364; 17835, TRAF7, 89087, 191537, 133-2145; 17836, TRAP1, 89094, 191544, 731-2218; 17836, TRAP1, 89095, 191545, 481-587; 17836, TRAP1, 89096, 191546, 1-645; 17836, TRAP1, 89097, 191547, 1-179; 17836, TRAP1, 89098, 191548, 1-326; 17836, TRAP1, 89099, 191549, 17-277; 17836, TRAP1, 89100, 191550, 5-118; 17836, TRAP1, 89101, 191551, 9-122; 17836, TRAP1, 89092, 191542, 90-2204; 17836, TRAP1, 89093, 191543, 6-1961; 17837, TNIP1, 89103, 191553, 242-2101; 17837, TNIP1, 89104, 191554, 24-1502; 17837, TNIP1, 89107, 191557, 177-575; 17837, TNIP1, 89108, 191558, 106-877; 17837, TNIP1, 89111, 191561, 228-658; 17837, TNIP1, 89112, 191562, 1-441; 17837, TNIP1, 89102, 191552, 111-2021; 17837, TNIP1, 89105, 191555, 107-2017; 17837, TNIP1, 89106, 191556, 111-2018; 17837, TNIP1, 89109, 191559, 161-1912; 17837, TNIP1, 89110, 191560, 1-1671; 17837, TNIP1, 89113, 191563, 232-2142; 17837, TNIP1, 89114, 191564, 232-2139; 17837, TNIP1, 89115, 191565, 1-1719; 17837, TNIP1, 89116, 191566, 242-1960; 17837, TNIP1, 89117, 191567, 242-1912; 17838, TNIP2, 89119, 191569, 54-1094; 17838, TNIP2, 89118, 191568, 88-1377; 17838, TNIP2, 89120, 191570, 429-1397; 17839, TNIP3, 89122, 191572, 1-261; 17839, TNIP3, 89121, 191571, 216-1193; 17839, TNIP3, 89123, 191573, 80-1210; 17839, TNIP3, 89124, 191574, 61-1170; 17840, TRADD, 89125, 191575, 470-1408; 17840, TRADD, 89126, 191576, 625-1383; 17841, TNFSF12-TNFSF13, 89127, 191577, 56-1048; 17842, TNNI3K, 89129, 191579, 1-452; 17842, TNNI3K, 89130, 191580, 1-341; 17842, TNNI3K, 89131, 191581, 1-566; 17842, TNNI3K, 89128, 191578, 52-2559; 17843, TTPA, 89132, 191582, 33-869; 17844, TTPAL, 89135, 191585, 121-585; 17844, TTPAL, 89136, 191586, 88-926; 17844, TTPAL, 89133, 191583, 122-1150; 17844, TTPAL, 89134, 191584, 144-1172; 17845, TOLLIP, 89137, 191587, 157-897; 17845, TOLLIP, 89139, 191589, 122-763; 17845, TOLLIP, 89140, 191590, 126-368; 17845, TOLLIP, 89142, 191592, 126-684; 17845, TOLLIP, 89143, 191593, 86-625; 17845, TOLLIP, 89138, 191588, 125-949; 17845, TOLLIP, 89141, 191591, 382-999; 17846, TIRAP, 89148, 191598, 467-616; 17846, TIRAP, 89144, 191594, 430-1137; 17846, TIRAP, 89145, 191595, 284-949; 17846, TIRAP, 89146, 191596, 406-1071; 17846, TIRAP, 89147, 191597, 40-705; 17847, TLR1, 89151, 191601, 166-648; 17847, TLR1, 89152, 191602, 308-578; 17847, TLR1, 89153, 191603, 410-555; 17847, TLR1, 89154, 191604, 535-605; 17847, TLR1, 89149, 191599, 275-2635; 17847, TLR1, 89150, 191600, 231-2591; 17848, TLR10, 89159, 191609, 394-676; 17848, TLR10, 89155, 191605, 607-3042; 17848, TLR10, 89156, 191606, 133-2568; 17848, TLR10, 89157, 191607, 485-2920; 17848, TLR10, 89158, 191608, 151-2586; 17848, TLR10, 89160, 191610, 450-2885; 17848, TLR10, 89161, 191611, 322-2757; 17849, TLR2, 89162, 191612, 1409-3763; 17850, TLR3, 89164, 191614, 102-1156; 17850, TLR3, 89163, 191613, 105-2819; 17850, TLR3, 89165, 191615, 411-2294; 17851, TLR4, 89166, 191616, 102-2621; 17851, TLR4, 89167, 191617, 382-2781; 17852, TLR5, 89169, 191619, 396-459; 17852, TLR5, 89168, 191618, 642-3218; 17852, TLR5, 89170, 191620, 463-3039; 17853, TLR6, 89173, 191623, 275-548; 17853, TLR6, 89174, 191624, 122-572; 17853, TLR6, 89171, 191621, 67-2457; 17853, TLR6, 89172, 191622, 122-2512; 17853, TLR6, 89175, 191625, 1-1443; 17854, TLR7, 89176, 191626, 140-3289; 17855, TLR8, 89177, 191627, 88-3213; 17855, TLR8, 89178, 191628, 152-3331; 17856, TLR9, 89179, 191629, 635-3733; 17857, TICAM1, 89181, 191631, 6-1646; 17857, TICAM1, 89180, 191630, 231-2369; 17858, TICAM2, 89182, 191632, 443-1150; 17859, TLL1, 89184, 191634, 220-393; 17859, TLL1, 89185, 191635, 558-950; 17859, TLL1, 89187, 191637, 227-558; 17859, TLL1, 89188, 191638, 558-3668; 17859, TLL1, 89183, 191633, 648-3689; 17859, TLL1, 89186, 191636, 166-1344; 17860, TLL2, 89189, 191639, 227-3274; 17861, TONSL, 89191, 191641, 240-1673; 17861, TONSL, 89190, 191640, 31-4167; 17862, TICRR, 89194, 191644, 1-644; 17862, TICRR, 89192, 191642, 106-5838; 17862, TICRR, 89193, 191643, 1-5730; 17863, TOP1, 89195, 191645, 251-2548; 17864, TOP1MT, 89197, 191647, 1-334; 17864, TOP1MT, 89198, 191648, 242-906; 17864, TOP1MT, 89200, 191650, 434-1561; 17864, TOP1MT, 89201, 191651, 121-613; 17864, TOP1MT, 89202, 191652, 3-506; 17864, TOP1MT, 89203, 191653, 6-499; 17864, TOP1MT, 89205, 191655, 403-1007; 17864, TOP1MT, 89207, 191657, 1-150; 17864, TOP1MT, 89208, 191658, 108-509; 17864, TOP1MT, 89209, 191659, 466-564; 17864, TOP1MT, 89210, 191660, 1-370; 17864, TOP1MT, 89196, 191646, 36-1841; 17864, TOP1MT, 89199, 191649, 364-1875; 17864, TOP1MT, 89204, 191654, 276-1787; 17864, TOP1MT, 89206, 191656, 407-1918; 17865, TOP2A, 89212, 191662, 138-579; 17865, TOP2A, 89213, 191663, 1-84; 17865, TOP2A, 89211, 191661, 160-4755; 17866, TOP2B, 89215, 191665, 1-213; 17866, TOP2B, 89216, 191666, 76-3525; 17866, TOP2B, 89214, 191664, 76-4956; 17866, TOP2B, 89217, 191667, 203-5068; 17867, TOPBP1, 89219, 191669, 1-618; 17867, TOPBP1, 89220, 191670, 1-153; 17867, TOPBP1, 89218, 191668, 133-4701; 17868, TOP3A, 89223, 191673, 216-425; 17868, TOP3A, 89224, 191674, 230-499; 17868, TOP3A, 89226, 191676, 167-586; 17868, TOP3A, 89227, 191677, 197-484; 17868, TOP3A, 89228, 191678, 1-157; 17868, TOP3A, 89229, 191679, 1-76; 17868, TOP3A, 89230, 191680, 1-402; 17868, TOP3A, 89231, 191681, 1-490; 17868, TOP3A, 89221, 191671, 216-3221; 17868, TOP3A, 89222, 191672, 230-3235; 17868, TOP3A, 89225, 191675, 1-2929; 17869, TOP3B, 89234, 191684, 446-571; 17869, TOP3B, 89235, 191685, 261-400; 17869, TOP3B, 89236, 191686, 673-736; 17869, TOP3B, 89237, 191687, 87-824; 17869, TOP3B, 89238, 191688, 379-561; 17869, TOP3B, 89239, 191689, 160-549; 17869, TOP3B, 89240, 191690, 160-549; 17869, TOP3B, 89241, 191691, 185-550; 17869, TOP3B, 89242, 191692, 364-543; 17869, TOP3B, 89243, 191693, 1-1577; 17869, TOP3B, 89244, 191694, 219-582; 17869, TOP3B, 89245, 191695, 1-507; 17869, TOP3B, 89232, 191682, 186-2774; 17869, TOP3B, 89233, 191683, 436-3024; 17870, TOPORS, 89246, 191696, 118-3255; 17870, TOPORS, 89247, 191697, 118-3060; 17871, TIPRL, 89248, 191698, 24-560; 17871, TIPRL, 89249, 191699, 146-964; 17872, TOR1AIP1, 89250, 191700, 207-2006; 17872, TOR1AIP1, 89251, 191701, 171-1559; 17872, TOR1AIP1, 89252, 191702, 1-888; 17872, TOR1AIP1, 89253, 191703, 1-593; 17872, TOR1AIP1, 89254, 191704, 1-191; 17872, TOR1AIP1, 89255, 191705, 1-579; 17872, TOR1AIP1, 89256, 191706, 462-2216; 17872, TOR1AIP1, 89257, 191707, 192-1943; 17873, TOR1AIP2, 89260, 191710, 777-888; 17873, TOR1AIP2, 89258, 191708, 389-1801; 17873, TOR1AIP2, 89259, 191709, 812-2224; 17873, TOR1AIP2, 89261, 191711, 921-1316; 17874, TOR1A, 89262, 191712, 50-1048; 17875, TOR1B, 89264, 191714, 1-425; 17875, TOR1B, 89263, 191713, 61-1071; 17876, TOR2A, 89266, 191716, 25-786; 17876, TOR2A, 89267, 191717, 48-1013; 17876, TOR2A, 89268, 191718, 25-243; 17876, TOR2A, 89269, 191719, 6-224; 17876, TOR2A, 89270, 191720, 44-262; 17876, TOR2A, 89271, 191721, 6-224; 17876, TOR2A, 89265, 191715, 23-751; 17877, TOR3A, 89273, 191723, 60-519; 17877, TOR3A, 89275, 191725, 208-730; 17877, TOR3A, 89276, 191726, 52-345; 17877, TOR3A, 89272, 191722, 44-1054; 17877, TOR3A, 89274, 191724, 753-1946; 17878, TOR4A, 89277, 191727, 197-1468; 17879, TLK1, 89278, 191728, 68-418; 17879, TLK1, 89280, 191730, 473-1714; 17879, TLK1, 89281, 191731, 54-539; 17879, TLK1, 89279, 191729, 406-2769; 17879, TLK1, 89282, 191732, 91-2103; 17879, TLK1, 89283, 191733, 406-2706; 17879, TLK1, 89284, 191734, 176-2332; 17880, TLK2, 89288, 191738, 6-1784; 17880, TLK2, 89289, 191739, 246-512; 17880, TLK2, 89290, 191740, 1-530; 17880, TLK2, 89291, 191741, 704-2509; 17880, TLK2, 89292, 191742, 646-767; 17880, TLK2, 89293, 191743, 54-209; 17880, TLK2, 89294, 191744, 22-550; 17880, TLK2, 89295, 191745, 342-559; 17880, TLK2, 89285, 191735, 272-2524; 17880, TLK2, 89286, 191736, 269-2587; 17880, TLK2, 89287, 191737, 147-2303; 17881, TOX2, 89300, 191750, 1-591; 17881, TOX2, 89296, 191746, 29-1549; 17881, TOX2, 89297, 191747, 209-1675; 17881, TOX2, 89298, 191748, 195-1589; 17881, TOX2, 89299, 191749, 87-1481; 17882, TOX3, 89303, 191753, 74-572; 17882, TOX3, 89304, 191754, 118-300; 17882, TOX3, 89301, 191751, 286-2016; 17882, TOX3, 89302, 191752, 189-1904; 17883, TOX4, 89305, 191755, 42-170; 17883, TOX4, 89306, 191756, 77-322; 17883, TOX4, 89307, 191757, 56-187; 17883, TOX4, 89309, 191759, 59-724; 17883, TOX4, 89310, 191760, 56-565; 17883, TOX4, 89308, 191758, 104-1969; 17883, TOX4, 89311, 191761, 277-2142; 17884, TIGAR, 89313, 191763, 1140-1775; 17884, TIGAR, 89312, 191762, 68-880; 17885, TRIAP1, 89314, 191764, 41-271; 17886, TP53RK, 89315, 191765, 27-392; 17886, TP53RK, 89316, 191766, 366-1127; 17887, TP53TG3, 89320, 191770, 1-429; 17887, TP53TG3, 89317, 191767, 636-1010; 17887, TP53TG3, 89318, 191768, 33-431; 17887, TP53TG3, 89319, 191769, 31-339; 17888, TP53TG3E, 89321, 191771, 31-339; 17888, TP53TG3E, 89322, 191772, 636-1010; 17889, TP53TG3F, 89323, 191773, 31-339; 17889, TP53TG3F, 89324, 191774, 636-1010; 17890, TP53TG3B, 89328, 191778, 1-22; 17890, TP53TG3B, 89325, 191775, 636-1010; 17890, TP53TG3B, 89326, 191776, 31-339; 17890, TP53TG3B, 89327, 191777, 33-431; 17891, TP53TG3C, 89329, 191779, 31-339; 17891, TP53TG3C, 89330, 191780, 31-339; 17891, TP53TG3C, 89331, 191781, 11-319; 17891, TP53TG3C, 89332, 191782, 636-1010; 17891, TP53TG3C, 89333, 191783, 33-431; 17892, TP53TG3D, 89336, 191786, 31-339; 17892, TP53TG3D, 89337, 191787, 11-319; 17892, TP53TG3D, 89338, 191788, 1-22; 17892, TP53TG3D, 89334, 191784, 33-431; 17892, TP53TG3D, 89335, 191785, 636-1010; 17893, TP53TG5, 89339, 191789, 158-1030; 17894, TPRKB, 89340, 191790, 108-635; 17894, TPRKB, 89341, 191791, 122-766; 17894, TPRKB, 89342, 191792, 119-763; 17895, TPX2, 89343, 191793, 529-2772; 17895, TPX2, 89344, 191794, 529-2880; 17896, TRABD, 89348, 191798, 48-1187; 17896, TRABD, 89345, 191795, 120-1250; 17896, TRABD, 89346, 191796, 97-1227; 17896, TRABD, 89347, 191797, 86-1216; 17897, TRABD2A, 89351, 191801, 112-1113; 17897, TRABD2A, 89349, 191799, 207-1577; 17897, TRABD2A, 89350, 191800, 207-1724; 17898, TRABD2B, 89352, 191802, 107-1660; 17899, TAAR1, 89353, 191803, 1-1020; 17900, TAAR2, 89354, 191804, 109-1029; 17900, TAAR2, 89355, 191805, 1-1056; 17901, TAAR5, 89356, 191806, 1-1014; 17902, TAAR6, 89357, 191807, 1-1038; 17903, TAAR8, 89358, 191808, 1-1029; 17904, TAAR9, 89359, 191809, 1-1047; 17905, TANK, 89362, 191812, 142-861; 17905, TANK, 89363, 191813, 142-858; 17905, TANK, 89364, 191814, 98-1324; 17905, TANK, 89366, 191816, 1-597; 17905, TANK, 89367, 191817, 129-515; 17905, TANK, 89368, 191818, 69-564; 17905, TANK, 89369, 191819, 187-600; 17905, TANK, 89370, 191820, 236-550; 17905, TANK, 89371, 191821, 109-219; 17905, TANK, 89372, 191822, 193-762; 17905, TANK, 89373, 191823, 1-828; 17905, TANK, 89374, 191824, 109-486; 17905, TANK, 89360, 191810, 206-1483; 17905, TANK, 89361, 191811, 240-1517; 17905, TANK, 89365, 191815, 43-402; 17906, TRAIP, 89376, 191826, 22-820; 17906, TRAIP, 89377, 191827, 112-577; 17906, TRAIP, 89378, 191828, 97-396; 17906, TRAIP, 89379, 191829, 122-976; 17906, TRAIP, 89375, 191825, 115-1524; 17907, TNIK, 89384, 191834, 77-1128; 17907, TNIK, 89388, 191838, 343-480; 17907, TNIK, 89380, 191830, 1-4059; 17907, TNIK, 89381, 191831, 346-4176; 17907, TNIK, 89382, 191832, 1-3996; 17907, TNIK, 89383, 191833, 346-4428; 17907, TNIK, 89385, 191835, 1-3807; 17907, TNIK, 89386, 191836, 1-3918; 17907, TNIK, 89387, 191837, 1-3894; 17907, TNIK, 89389, 191839, 1-3972; 17908, TRAF3IP2, 89390, 191840, 596-2320; 17908, TRAF3IP2, 89391, 191841, 105-1799; 17908, TRAF3IP2, 89392, 191842, 155-484; 17908, TRAF3IP2, 89393, 191843, 480-2177; 17908, TRAF3IP2, 89394, 191844, 1-1725; 17909, TRAF3IP3, 89395, 191845, 264-812; 17909, TRAF3IP3, 89399, 191849, 438-1652; 17909, TRAF3IP3, 89400, 191850, 137-607; 17909, TRAF3IP3, 89402, 191852, 206-499; 17909, TRAF3IP3, 89403, 191853, 463-540; 17909, TRAF3IP3, 89404, 191854, 1-210; 17909, TRAF3IP3, 89396, 191846, 517-2172; 17909, TRAF3IP3, 89397, 191847, 421-2076; 17909, TRAF3IP3, 89398, 191848, 291-1886; 17909, TRAF3IP3, 89401, 191851, 404-1465; 17910, TRAPPC1, 89407, 191857, 24-152; 17910, TRAPPC1, 89408, 191858, 22-306; 17910, TRAPPC1, 89409, 191859, 93-221; 17910, TRAPPC1, 89410, 191860, 185-409; 17910, TRAPPC1, 89405, 191855, 117-554; 17910, TRAPPC1, 89406, 191856, 61-498; 17911, TRAPPC10, 89413, 191863, 170-967; 17911, TRAPPC10, 89411, 191861, 176-3955; 17911, TRAPPC10, 89412, 191862, 176-1006; 17912, TRAPPC11, 89416, 191866, 102-2321; 17912, TRAPPC11, 89417, 191867, 94-468; 17912, TRAPPC11, 89414, 191864, 203-3604; 17912, TRAPPC11, 89415, 191865, 203-3463; 17913, TRAPPC12, 89420, 191870, 1-367; 17913, TRAPPC12, 89421, 191871, 1-328; 17913, TRAPPC12, 89422, 191872, 1-705; 17913, TRAPPC12, 89423, 191873, 1-191; 17913, TRAPPC12, 89424, 191874, 1-637; 17913, TRAPPC12, 89425, 191875, 470-579; 17913, TRAPPC12, 89426, 191876, 1-667; 17913, TRAPPC12, 89427, 191877, 1-168; 17913, TRAPPC12, 89428, 191878, 108-683; 17913, TRAPPC12, 89429, 191879, 1-1161; 17913, TRAPPC12, 89430, 191880, 1-1095; 17913, TRAPPC12, 89431, 191881, 4-1143; 17913, TRAPPC12, 89418, 191868, 196-2403; 17913, TRAPPC12, 89419, 191869, 170-2377; 17914, TRAPPC13, 89436, 191886, 17-262; 17914, TRAPPC13, 89437, 191887, 1-161; 17914, TRAPPC13, 89432, 191882, 22-1257; 17914, TRAPPC13, 89433, 191883, 346-1599; 17914, TRAPPC13, 89434, 191884, 28-1284; 17914, TRAPPC13, 89435, 191885, 17-1255; 17915, TRAPPC2, 89441, 191891, 341-562; 17915, TRAPPC2, 89442, 191892, 71-412; 17915, TRAPPC2, 89438, 191888, 131-553; 17915, TRAPPC2, 89439, 191889, 194-616; 17915, TRAPPC2, 89440, 191890, 105-629; 17916, TRAPPC2L, 89444, 191894, 21-248; 17916, TRAPPC2L, 89445, 191895, 25-750; 17916, TRAPPC2L, 89446, 191896, 17-346; 17916, TRAPPC2L, 89447, 191897, 25-138; 17916, TRAPPC2L, 89448, 191898, 8-235; 17916, TRAPPC2L, 89449, 191899, 425-604; 17916, TRAPPC2L, 89450, 191900, 79-468; 17916, TRAPPC2L, 89451, 191901, 133-462; 17916, TRAPPC2L, 89452, 191902, 11-451; 17916, TRAPPC2L, 89453, 191903, 54-281; 17916, TRAPPC2L, 89443, 191893, 66-488; 17917, TRAPPC3, 89454, 191904, 119-475; 17917, TRAPPC3, 89458, 191908, 137-703; 17917, TRAPPC3, 89460, 191910, 137-481; 17917, TRAPPC3, 89455, 191905, 503-907; 17917, TRAPPC3, 89456, 191906, 289-693; 17917, TRAPPC3, 89457, 191907, 92-634; 17917, TRAPPC3, 89459, 191909, 268-672; 17918, TRAPPC3L, 89463, 191913, 1-504; 17918, TRAPPC3L, 89461, 191911, 163-456; 17918, TRAPPC3L, 89462, 191912, 97-642; 17919, TRAPPC4, 89464, 191914, 31-576; 17919, TRAPPC4, 89466, 191916, 31-804; 17919, TRAPPC4, 89467, 191917, 7-360; 17919, TRAPPC4, 89468, 191918, 31-411; 17919, TRAPPC4, 89470, 191920, 2-382; 17919, TRAPPC4, 89471, 191921, 31-561; 17919, TRAPPC4, 89472, 191922, 31-576; 17919, TRAPPC4, 89473, 191923, 31-804; 17919, TRAPPC4, 89474, 191924, 31-411; 17919, TRAPPC4, 89475, 191925, 7-360; 17919, TRAPPC4, 89477, 191927, 31-561; 17919, TRAPPC4, 89479, 191929, 2-382; 17919, TRAPPC4, 89465, 191915, 31-528; 17919, TRAPPC4, 89469, 191919, 365-1024; 17919, TRAPPC4, 89476, 191926, 31-528; 17919, TRAPPC4, 89478, 191928, 365-1024; 17920, TRAPPC5, 89483, 191933, 12-377; 17920, TRAPPC5, 89480, 191930, 188-754; 17920, TRAPPC5, 89481, 191931, 161-727; 17920, TRAPPC5, 89482, 191932, 49-615; 17921, TRAPPC6A, 89484, 191934, 20-541; 17921, TRAPPC6A, 89485, 191935, 10-393; 17921, TRAPPC6A, 89486, 191936, 20-361; 17921, TRAPPC6A, 89487, 191937, 20-499; 17922, TRAPPC6B, 89490, 191940, 235-541; 17922, TRAPPC6B, 89491, 191941, 336-488; 17922, TRAPPC6B, 89492, 191942, 259-411; 17922, TRAPPC6B, 89488, 191938, 228-704; 17922, TRAPPC6B, 89489, 191939, 299-691; 17923, TRAPPC8, 89494, 191944, 152-2932; 17923, TRAPPC8, 89495, 191945, 81-4226; 17923, TRAPPC8, 89496, 191946, 1-288; 17923, TRAPPC8, 89497, 191947, 1-563; 17923, TRAPPC8, 89498, 191948, 343-2343; 17923, TRAPPC8, 89493, 191943, 337-4644; 17924, TRAPPC9, 89501, 191951, 1-2977; 17924, TRAPPC9, 89502, 191952, 1-275; 17924, TRAPPC9, 89499, 191949, 16-3756; 17924, TRAPPC9, 89500, 191950, 135-3581; 17925, N/A, 89503, 191953, 213-635; 17925, N/A, 89504, 191954, 1268-1690;

17926, TRAK1, 89507, 191957, 194-2881; 17926, TRAK1, 89508, 191958, 178-312; 17926, TRAK1, 89510, 191960, 1-900; 17926, TRAK1, 89511, 191961, 302-2314; 17926, TRAK1, 89512, 191962, 835-3384; 17926, TRAK1, 89513, 191963, 423-2003; 17926, TRAK1, 89505, 191955, 401-3262; 17926, TRAK1, 89506, 191956, 194-2254; 17926, TRAK1, 89509, 191959, 302-1972; 17927, TRAK2, 89515, 191965, 291-381; 17927, TRAK2, 89517, 191967, 744-3083; 17927, TRAK2, 89514, 191964, 430-3174; 17927, TRAK2, 89516, 191966, 351-1286; 17928, TIFA, 89518, 191968, 283-837; 17928, TIFA, 89519, 191969, 112-666; 17929, TIFAB, 89520, 191970, 202-687; 17930, TRAFD1, 89524, 191974, 78-362; 17930, TRAFD1, 89525, 191975, 128-532; 17930, TRAFD1, 89526, 191976, 134-983; 17930, TRAFD1, 89527, 191977, 367-584; 17930, TRAFD1, 89521, 191971, 618-2366; 17930, TRAFD1, 89522, 191972, 131-1879; 17930, TRAFD1, 89523, 191973, 72-566; 17931, TECR, 89529, 191979, 147-541; 17931, TECR, 89530, 191980, 606-735; 17931, TECR, 89531, 191981, 728-868; 17931, TECR, 89532, 191982, 634-1095; 17931, TECR, 89533, 191983, 103-282; 17931, TECR, 89534, 191984, 603-1064; 17931, TECR, 89535, 191985, 1-453; 17931, TECR, 89536, 191986, 112-228; 17931, TECR, 89537, 191987, 62-379; 17931, TECR, 89528, 191978, 138-1064; 17932, TECRL, 89539, 191989, 48-484; 17932, TECRL, 89540, 191990, 1-84; 17932, TECRL, 89541, 191991, 118-1098; 17932, TECRL, 89538, 191988, 112-1203; 17933, TALDO1, 89543, 191993, 29-310; 17933, TALDO1, 89544, 191994, 68-220; 17933, TALDO1, 89545, 191995, 55-1011; 17933, TALDO1, 89542, 191992, 154-1167; 17934, TCN1, 89546, 191996, 106-1407; 17935, TCN2, 89549, 191999, 181-1452; 17935, TCN2, 89550, 192000, 426-1634; 17935, TCN2, 89547, 191997, 495-1778; 17935, TCN2, 89548, 191998, 129-1331; 17936, TCEANC, 89552, 192002, 1-818; 17936, TCEANC, 89551, 192001, 88-1143; 17936, TCEANC, 89553, 192003, 1-1146; 17937, TCEANC2, 89555, 192005, 200-916; 17937, TCEANC2, 89556, 192006, 174-566; 17937, TCEANC2, 89554, 192004, 201-827; 17938, TCEA1, 89558, 192008, 24-359; 17938, TCEA1, 89560, 192010, 190-333; 17938, TCEA1, 89561, 192011, 35-307; 17938, TCEA1, 89562, 192012, 145-498; 17938, TCEA1, 89563, 192013, 202-339; 17938, TCEA1, 89557, 192007, 324-1166; 17938, TCEA1, 89559, 192009, 405-1310; 17939, TCEA2, 89564, 192014, 216-953; 17939, TCEA2, 89567, 192017, 156-884; 17939, TCEA2, 89568, 192018, 479-726; 17939, TCEA2, 89569, 192019, 346-1083; 17939, TCEA2, 89570, 192020, 132-941; 17939, TCEA2, 89565, 192015, 170-1069; 17939, TCEA2, 89566, 192016, 443-1261; 17940, TCEA3, 89573, 192023, 1-237; 17940, TCEA3, 89574, 192024, 290-643; 17940, TCEA3, 89575, 192025, 75-539; 17940, TCEA3, 89576, 192026, 1-237; 17940, TCEA3, 89577, 192027, 290-643; 17940, TCEA3, 89578, 192028, 108-1154; 17940, TCEA3, 89571, 192021, 75-539; 17940, TCEA3, 89572, 192022, 108-1154; 17941, TCEAL1, 89579, 192029, 128-607; 17941, TCEAL1, 89580, 192030, 165-644; 17941, TCEAL1, 89581, 192031, 191-670; 17942, TCEAL2, 89582, 192032, 200-883; 17942, TCEAL2, 89583, 192033, 220-903; 17943, TCEAL3, 89584, 192034, 263-865; 17943, TCEAL3, 89585, 192035, 251-853; 17943, TCEAL3, 89586, 192036, 359-961; 17944, TCEAL4, 89588, 192038, 165-338; 17944, TCEAL4, 89589, 192039, 742-891; 17944, TCEAL4, 89593, 192043, 506-779; 17944, TCEAL4, 89595, 192045, 452-681; 17944, TCEAL4, 89596, 192046, 179-566; 17944, TCEAL4, 89598, 192048, 204-764; 17944, TCEAL4, 89587, 192037, 240-1316; 17944, TCEAL4, 89590, 192040, 133-780; 17944, TCEAL4, 89591, 192041, 213-860; 17944, TCEAL4, 89592, 192042, 293-940; 17944, TCEAL4, 89594, 192044, 553-1200; 17944, TCEAL4, 89597, 192047, 158-805; 17945, TCEAL5, 89599, 192049, 296-916; 17946, TCEAL6, 89602, 192052, 145-744; 17946, TCEAL6, 89600, 192050, 362-913; 17946, TCEAL6, 89601, 192051, 251-802; 17947, TCEAL7, 89603, 192053, 255-557; 17947, TCEAL7, 89604, 192054, 168-470; 17948, TCEAL8, 89607, 192057, 227-449; 17948, TCEAL8, 89605, 192055, 147-500; 17948, TCEAL8, 89606, 192056, 238-591; 17949, TCEB1, 89613, 192063, 366-634; 17949, TCEB1, 89616, 192066, 196-393; 17949, TCEB1, 89608, 192058, 116-454; 17949, TCEB1, 89609, 192059, 285-623; 17949, TCEB1, 89610, 192060, 222-560; 17949, TCEB1, 89611, 192061, 94-432; 17949, TCEB1, 89612, 192062, 110-448; 17949, TCEB1, 89614, 192064, 321-659; 17949, TCEB1, 89615, 192065, 139-429; 17949, TCEB1, 89617, 192067, 146-484; 17950, TCEB2, 89620, 192070, 81-422; 17950, TCEB2, 89621, 192071, 1-423; 17950, TCEB2, 89622, 192072, 34-234; 17950, TCEB2, 89618, 192068, 39-524; 17950, TCEB2, 89619, 192069, 59-415; 17951, TCEB3, 89624, 192074, 33-2351; 17951, TCEB3, 89623, 192073, 272-2668; 17951, TCEB3, 89625, 192075, 61-2457; 17952, TCEB3B, 89627, 192077, 1-1641; 17952, TCEB3B, 89626, 192076, 358-2619; 17953, TCEB3C, 89628, 192078, 237-1877; 17954, TCEB3CL, 89630, 192080, 1-1218; 17954, TCEB3CL, 89629, 192079, 1-1641; 17955, TCEB3CL2, 89631, 192081, 1-1641; 17956, TEFM, 89634, 192084, 38-718; 17956, TEFM, 89632, 192082, 38-553; 17956, TEFM, 89633, 192083, 623-1705; 17957, TCERG1, 89637, 192087, 5-3103; 17957, TCERG1, 89635, 192085, 39-3335; 17957, TCERG1, 89636, 192086, 19-3252; 17958, TCERG1L, 89638, 192088, 87-1847; 17959, TCF12, 89643, 192093, 93-1703; 17959, TCF12, 89645, 192095, 51-1001; 17959, TCF12, 89646, 192096, 398-574; 17959, TCF12, 89648, 192098, 255-2252; 17959, TCF12, 89649, 192099, 26-1045; 17959, TCF12, 89650, 192100, 104-575; 17959, TCF12, 89651, 192101, 1-145; 17959, TCF12, 89652, 192102, 1-133; 17959, TCF12, 89639, 192089, 305-2353; 17959, TCF12, 89640, 192090, 236-2356; 17959, TCF12, 89641, 192091, 57-1595; 17959, TCF12, 89642, 192092, 297-2417; 17959, TCF12, 89644, 192094, 146-1486; 17959, TCF12, 89647, 192097, 88-2136; 17960, TCF15, 89654, 192104, 30-626; 17960, TCF15, 89653, 192103, 162-761; 17961, TCF19, 89657, 192107, 504-1541; 17961, TCF19, 89658, 192108, 755-1792; 17961, TCF19, 89659, 192109, 457-1494; 17961, TCF19, 89660, 192110, 504-1541; 17961, TCF19, 89661, 192111, 755-1792; 17961, TCF19, 89662, 192112, 745-1782; 17961, TCF19, 89663, 192113, 504-1541; 17961, TCF19, 89664, 192114, 755-1792; 17961, TCF19, 89665, 192115, 755-1792; 17961, TCF19, 89666, 192116, 504-1541; 17961, TCF19, 89667, 192117, 457-1494; 17961, TCF19, 89668, 192118, 745-1782; 17961, TCF19, 89669, 192119, 1-654; 17961, TCF19, 89655, 192105, 504-1541; 17961, TCF19, 89656, 192106, 755-1792; 17962, TCF20, 89672, 192122, 1-753; 17962, TCF20, 89673, 192123, 175-633; 17962, TCF20, 89674, 192124, 1-753; 17962, TCF20, 89677, 192127, 37-495; 17962, TCF20, 89680, 192130, 1-753; 17962, TCF20, 89681, 192131, 175-633; 17962, TCF20, 89683, 192133, 1-753; 17962, TCF20, 89684, 192134, 37-495; 17962, TCF20, 89685, 192135, 175-633; 17962, TCF20, 89689, 192139, 1-753; 17962, TCF20, 89690, 192140, 175-633; 17962, TCF20, 89691, 192141, 1-753; 17962, TCF20, 89692, 192142, 136-5952; 17962, TCF20, 89693, 192143, 136-5952; 17962, TCF20, 89694, 192144, 138-6020; 17962, TCF20, 89695, 192145, 1-753; 17962,

TCF20, 89696, 192146, 175-633; 17962, TCF20, 89697, 192147, 138-6020; 17962, TCF20, 89670, 192120, 136-5952; 17962, TCF20, 89671, 192121, 138-6020; 17962, TCF20, 89675, 192125, 138-6020; 17962, TCF20, 89676, 192126, 136-5952; 17962, TCF20, 89678, 192128, 136-5952; 17962, TCF20, 89679, 192129, 138-6020; 17962, TCF20, 89682, 192132, 136-5952; 17962, TCF20, 89686, 192136, 138-6020; 17962, TCF20, 89687, 192137, 138-6020; 17962, TCF20, 89688, 192138, 136-5952; 17963, TCF21, 89698, 192148, 64-603; 17963, TCF21, 89699, 192149, 261-800; 17964, TCF23, 89700, 192150, 131-775; 17965, TCF24, 89701, 192151, 397-900; 17966, TCF25, 89703, 192153, 788-2209; 17966, TCF25, 89704, 192154, 25-655; 17966, TCF25, 89705, 192155, 1-352; 17966, TCF25, 89706, 192156, 1-1711; 17966, TCF25, 89707, 192157, 25-255; 17966, TCF25, 89708, 192158, 1-627; 17966, TCF25, 89709, 192159, 1-440; 17966, TCF25, 89710, 192160, 63-763; 17966, TCF25, 89711, 192161, 1-857; 17966, TCF25, 89712, 192162, 1-797; 17966, TCF25, 89713, 192163, 28-678; 17966, TCF25, 89702, 192152, 57-2087; 17967, TCF3, 89715, 192165, 70-1872; 17967, TCF3, 89717, 192167, 335-2374; 17967, TCF3, 89718, 192168, 1-156; 17967, TCF3, 89719, 192169, 1-249; 17967, TCF3, 89720, 192170, 1-480; 17967, TCF3, 89721, 192171, 1-540; 17967, TCF3, 89722, 192172, 346-986; 17967, TCF3, 89723, 192173, 1-662; 17967, TCF3, 89724, 192174, 1-944; 17967, TCF3, 89725, 192175, 347-631; 17967, TCF3, 89726, 192176, 1-288; 17967, TCF3, 89727, 192177, 1-498; 17967, TCF3, 89728, 192178, 1-156; 17967, TCF3, 89729, 192179, 1-614; 17967, TCF3, 89714, 192164, 70-2034; 17967, TCF3, 89716, 192166, 345-2321; 17967, TCF3, 89730, 192180, 498-2453; 17967, TCF3, 89731, 192181, 31-1995; 17968, TCF4, 89734, 192184, 131-2452; 17968, TCF4, 89741, 192191, 164-568; 17968, TCF4, 89742, 192192, 1-373; 17968, TCF4, 89744, 192194, 1-184; 17968, TCF4, 89745, 192195, 177-805; 17968, TCF4, 89747, 192197, 429-597; 17968, TCF4, 89748, 192198, 112-602; 17968, TCF4, 89750, 192200, 55-550; 17968, TCF4, 89753, 192203, 74-561; 17968, TCF4, 89754, 192204, 511-2439; 17968, TCF4, 89756, 192206, 181-598; 17968, TCF4, 89760, 192210, 547-1084; 17968, TCF4, 89761, 192211, 46-401; 17968, TCF4, 89762, 192212, 107-969; 17968, TCF4, 89763, 192213, 52-555; 17968, TCF4, 89764, 192214, 422-897; 17968, TCF4, 89765, 192215, 251-653; 17968, TCF4, 89766, 192216, 564-2597; 17968, TCF4, 89767, 192217, 30-870; 17968, TCF4, 89769, 192219, 133-570; 17968, TCF4, 89771, 192221, 226-583; 17968, TCF4, 89772, 192222, 168-362; 17968, TCF4, 89773, 192223, 1-500; 17968, TCF4, 89775, 192225, 153-826; 17968, TCF4, 89777, 192227, 43-579; 17968, TCF4, 89778, 192228, 99-807; 17968, TCF4, 89779, 192229, 130-737; 17968, TCF4, 89780, 192230, 171-635; 17968, TCF4, 89782, 192232, 656-1277; 17968, TCF4, 89783, 192233, 51-735; 17968, TCF4, 89784, 192234, 98-340; 17968, TCF4, 89785, 192235, 61-306; 17968, TCF4, 89786, 192236, 134-601; 17968, TCF4, 89787, 192237, 271-882; 17968, TCF4, 89788, 192238, 74-1018; 17968, TCF4, 89789, 192239, 202-606; 17968, TCF4, 89790, 192240, 171-833; 17968, TCF4, 89791, 192241, 446-831; 17968, TCF4, 89792, 192242, 1-246; 17968, TCF4, 89793, 192243, 76-480; 17968, TCF4, 89732, 192182, 216-2231; 17968, TCF4, 89733, 192183, 613-2616; 17968, TCF4, 89735, 192185, 485-2020; 17968, TCF4, 89736, 192186, 176-2053; 17968, TCF4, 89737, 192187, 197-1810; 17968, TCF4, 89738, 192188, 541-2484; 17968, TCF4, 89739, 192189, 282-2084; 17968, TCF4, 89740, 192190, 296-2227; 17968, TCF4, 89743, 192193, 1-1824; 17968, TCF4, 89746, 192196, 208-1821; 17968, TCF4, 89749, 192199, 99-2042; 17968, TCF4, 89751, 192201, 400-2013; 17968, TCF4, 89752, 192202, 1-1791; 17968, TCF4, 89755, 192205, 1-1995; 17968, TCF4, 89757, 192207, 249-1772; 17968, TCF4, 89758, 192208, 482-2233; 17968, TCF4, 89759, 192209, 169-2004; 17968, TCF4, 89768, 192218, 198-2201; 17968, TCF4, 89770, 192220, 143-1666; 17968, TCF4, 89774, 192224, 685-2436; 17968, TCF4, 89776, 192226, 346-1701; 17968, TCF4, 89781, 192231, 532-2547; 17969, TCF7, 89797, 192247, 196-1641; 17969, TCF7, 89798, 192248, 280-582; 17969, TCF7, 89799, 192249, 98-539; 17969, TCF7, 89800, 192250, 98-557; 17969, TCF7, 89801, 192251, 1-444; 17969, TCF7, 89802, 192252, 1-613; 17969, TCF7, 89804, 192254, 119-547; 17969, TCF7, 89805, 192255, 1-216; 17969, TCF7, 89806, 192256, 1-317; 17969, TCF7, 89807, 192257, 98-600; 17969, TCF7, 89809, 192259, 217-584; 17969, TCF7, 89810, 192260, 64-366; 17969, TCF7, 89794, 192244, 197-1351; 17969, TCF7, 89795, 192245, 98-904; 17969, TCF7, 89796, 192246, 80-889; 17969, TCF7, 89803, 192253, 329-1138; 17969, TCF7, 89808, 192258, 80-889; 17970, TCF7L1, 89812, 192262, 474-559; 17970, TCF7L1, 89811, 192261, 276-2042; 17971, TCF7L2, 89813, 192263, 1-620; 17971, TCF7L2, 89814, 192264, 306-1172; 17971, TCF7L2, 89816, 192266, 1-667; 17971, TCF7L2, 89819, 192269, 112-474; 17971, TCF7L2, 89820, 192270, 186-716; 17971, TCF7L2, 89821, 192271, 86-1039; 17971, TCF7L2, 89823, 192273, 1-327; 17971, TCF7L2, 89824, 192274, 508-1938; 17971, TCF7L2, 89825, 192275, 508-1734; 17971, TCF7L2, 89826, 192276, 826-2430; 17971, TCF7L2, 89827, 192277, 508-2331; 17971, TCF7L2, 89829, 192279, 508-2247; 17971, TCF7L2, 89831, 192281, 1-1755; 17971, TCF7L2, 89815, 192265, 508-1887; 17971, TCF7L2, 89817, 192267, 508-1977; 17971, TCF7L2, 89818, 192268, 508-2367; 17971, TCF7L2, 89822, 192272, 306-2096; 17971, TCF7L2, 89828, 192278, 508-1956; 17971, TCF7L2, 89830, 192280, 351-2159; 17972, TFAM, 89833, 192283, 1-658; 17972, TFAM, 89832, 192282, 115-759; 17972, TFAM, 89834, 192284, 527-1267; 17973, TFAP2A, 89837, 192287, 258-1577; 17973, TFAP2A, 89838, 192288, 1-987; 17973, TFAP2A, 89839, 192289, 1-244; 17973, TFAP2A, 89840, 192290, 99-617; 17973, TFAP2A, 89842, 192292, 1-656; 17973, TFAP2A, 89843, 192293, 216-581; 17973, TFAP2A, 89844, 192294, 10-417; 17973, TFAP2A, 89845, 192295, 580-921; 17973, TFAP2A, 89835, 192285, 189-1490; 17973, TFAP2A, 89836, 192286, 779-2074; 17973, TFAP2A, 89841, 192291, 354-1667; 17974, TFAP2B, 89846, 192296, 203-797; 17974, TFAP2B, 89847, 192297, 170-1552; 17975, TFAP2D, 89848, 192298, 229-1587; 17976, TFAP2E, 89849, 192299, 209-1537; 17977, TFAP2C, 89851, 192301, 128-482; 17977, TFAP2C, 89850, 192300, 244-1596; 17978, TFAP4, 89853, 192303, 163-507; 17978, TFAP4, 89854, 192304, 86-589; 17978, TFAP4, 89855, 192305, 149-283; 17978, TFAP4, 89852, 192302, 330-1346; 17979, TFB1M, 89856, 192306, 57-1097; 17980, TFB2M, 89857, 192307, 187-1377; 17981, TFE3, 89858, 192308, 261-1988; 17981, TFE3, 89859, 192309, 185-514; 17982, TFCP2, 89862, 192312, 366-1508; 17982, TFCP2, 89863, 192313, 95-1369; 17982, TFCP2, 89860, 192310, 460-1968; 17982, TFCP2, 89861, 192311, 491-1843; 17983, TFCP2L1, 89864, 192314, 99-1538; 17984, TFDP3, 89865, 192315, 90-1307; 17985, TFDP1, 89867, 192317, 160-866; 17985, TFDP1, 89868, 192318, 317-792; 17985, TFDP1, 89869, 192319, 220-579; 17985, TFDP1, 89866, 192316, 213-1445; 17986, TFDP2, 89870, 192320, 441-578; 17986, TFDP2, 89871, 192321, 218-878; 17986, TFDP2, 89872, 192322, 9-221; 17986, TFDP2, 89874, 192324, 121-865; 17986, TFDP2, 89875, 192325, 129-746; 17986, TFDP2, 89879, 192329, 1-343; 17986, TFDP2, 89880, 192330, 315-571; 17986, TFDP2, 89881, 192331, 149-416; 17986, TFDP2, 89884, 192334, 497-578; 17986, TFDP2, 89886, 192336, 1-202; 17986, TFDP2, 89873, 192323, 27-1184; 17986, TFDP2, 89876, 192326, 661-1821; 17986, TFDP2, 89877, 192327, 101-1033; 17986, TFDP2, 89878, 192328, 156-1205; 17986, TFDP2, 89882, 192332, 189-1349; 17986, TFDP2, 89883, 192333, 432-1772; 17986, TFDP2, 89885, 192335, 1-1257; 17987, TFEB, 89888, 192338, 6-1694; 17987, TFEB, 89889, 192339, 95-1567; 17987, TFEB, 89891, 192341, 1228-2034; 17987, TFEB, 89892, 192342, 1-1005; 17987, TFEB, 89894, 192344, 153-365; 17987, TFEB, 89895, 192345, 188-223; 17987, TFEB, 89896, 192346, 141-377; 17987, TFEB, 89897, 192347, 317-984; 17987, TFEB, 89898, 192348, 289-1022; 17987, TFEB, 89899, 192349, 112-914; 17987, TFEB, 89901, 192351, 184-281; 17987, TFEB, 89902, 192352, 133-168; 17987, TFEB, 89887, 192337, 303-1733; 17987, TFEB, 89890, 192340, 282-1712; 17987, TFEB, 89893, 192343, 112-1542; 17987, TFEB, 89900, 192350, 201-1376; 17988, TFEC, 89907, 192357, 176-1126; 17988, TFEC, 89903, 192353, 182-1225; 17988, TFEC, 89904, 192354, 254-1210; 17988, TFEC, 89905, 192355, 185-778; 17988, TFEC, 89906, 192356, 64-906; 17989, TCFL5, 89908, 192358, 238-1689; 17989, TCFL5, 89909, 192359, 94-1596; 17990, TTF1, 89911, 192361, 241-1413; 17990, TTF1, 89910, 192360, 41-2758; 17991, TTF2, 89913, 192363, 1-432; 17991, TTF2, 89912, 192362, 45-3533; 17992, TADA1, 89914, 192364, 95-1102; 17993, TADA2A, 89915, 192365, 371-1702; 17993, TADA2A, 89916, 192366, 222-804; 17993, TADA2A, 89917, 192367, 158-1489; 17993, TADA2A, 89918, 192368, 162-561; 17993, TADA2A, 89919, 192369, 109-1026; 17993, TADA2A, 89920, 192370, 174-1505; 17993, TADA2A, 89922, 192372, 1-253; 17993, TADA2A, 89924, 192374, 158-445; 17993, TADA2A, 89925, 192375, 429-598; 17993, TADA2A, 89926, 192376, 1-253; 17993, TADA2A, 89929, 192379, 158-445; 17993, TADA2A, 89930, 192380, 222-804; 17993, TADA2A, 89931, 192381, 162-561; 17993, TADA2A, 89932, 192382, 429-598; 17993, TADA2A, 89921, 192371, 371-1702; 17993, TADA2A, 89923, 192373, 158-1489; 17993, TADA2A, 89927, 192377, 109-1026; 17993, TADA2A, 89928, 192378, 174-1505; 17994, TADA2B, 89934, 192384, 195-558; 17994, TADA2B, 89937, 192387, 156-544; 17994, TADA2B, 89933, 192383, 190-1452; 17994, TADA2B, 89935, 192385, 1245-2231; 17994, TADA2B, 89936, 192386, 46-1083; 17995, TADA3, 89941, 192391, 588-873; 17995, TADA3, 89938, 192388, 560-1858; 17995, TADA3, 89939, 192389, 549-1658; 17995, TADA3, 89940, 192390, 218-1516; 17996, TRERF1, 89946, 192396, 570-4232; 17996, TRERF1, 89942, 192392, 589-3978; 17996, TRERF1, 89943, 192393, 589-3942; 17996, TRERF1, 89944, 192394, 825-3695; 17996, TRERF1, 89945, 192395, 564-4166; 17997, TOB1, 89947, 192397, 430-1467; 17997, TOB1, 89948, 192398, 435-1472; 17998, TOB2, 89950, 192400, 474-777; 17998, TOB2, 89949, 192399, 708-1742; 17999, TBL1XR1, 89951, 192401, 178-611; 17999, TBL1XR1, 89952, 192402, 348-564; 17999, TBL1XR1, 89953, 192403, 349-575; 17999, TBL1XR1, 89954, 192404, 130-565; 17999, TBL1XR1, 89955, 192405, 337-580; 17999, TBL1XR1, 89956, 192406, 271-559; 17999, TBL1XR1, 89957, 192407, 345-604; 17999, TBL1XR1, 89958, 192408, 370-554; 17999, TBL1XR1, 89959, 192409, 385-550; 17999, TBL1XR1, 89960, 192410, 374-592; 17999, TBL1XR1, 89962, 192412, 229-588; 17999, TBL1XR1, 89964, 192414, 494-592; 17999, TBL1XR1, 89965, 192415, 252-567; 17999, TBL1XR1, 89966, 192416, 290-656; 17999, TBL1XR1, 89967, 192417, 74-1498; 17999, TBL1XR1, 89968, 192418, 1-202; 17999, TBL1XR1, 89969, 192419, 232-568; 17999, TBL1XR1, 89961, 192411, 261-1805; 17999, TBL1XR1, 89963, 192413, 398-1942; 18000, TBL1Y, 89970, 192420, 553-2121; 18000, TBL1Y, 89971, 192421, 617-2185; 18000, TBL1Y, 89972, 192422, 648-2216; 18001, TBL1X, 89977, 192427, 149-387; 18001, TBL1X, 89978, 192428, 344-520; 18001, TBL1X, 89979, 192429, 341-565; 18001, TBL1X, 89980, 192430, 363-496; 18001, TBL1X, 89973, 192423, 641-2374; 18001, TBL1X, 89974, 192424, 478-2058; 18001, TBL1X, 89975, 192425, 369-2102; 18001, TBL1X, 89976, 192426, 377-1957; 18002, TBL2, 89982, 192432, 28-168; 18002, TBL2, 89983, 192433, 61-180; 18002, TBL2, 89984, 192434, 51-374; 18002, TBL2, 89985, 192435, 51-182; 18002, TBL2, 89986, 192436, 6-137; 18002, TBL2, 89987, 192437, 128-292; 18002, TBL2, 89988, 192438, 42-572; 18002, TBL2, 89989, 192439, 71-298; 18002, TBL2, 89990, 192440, 26-1261; 18002, TBL2, 89991, 192441, 44-238; 18002, TBL2, 89992, 192442, 205-494; 18002, TBL2, 89993, 192443, 12-1352; 18002, TBL2, 89981, 192431, 243-1586; 18003, TBL3, 89994, 192444, 1-2091; 18003, TBL3, 89995, 192445, 95-328; 18003, TBL3, 89997, 192447, 399-1955; 18003, TBL3, 89996, 192446, 129-2555; 18004, TLE1, 89998, 192448, 79-513; 18004, TLE1, 89999, 192449, 27-2336; 18004, TLE1, 90000, 192450, 59-442; 18004, TLE1, 90002, 192452, 209-936; 18004, TLE1, 90001, 192451, 1066-3378; 18005, TLE2, 90007, 192457, 1-841; 18005, TLE2, 90008, 192458, 18-377; 18005, TLE2, 90009, 192459, 110-2344; 18005, TLE2, 90010, 192460, 1-393; 18005, TLE2, 90011, 192461, 140-559; 18005, TLE2, 90013, 192463, 66-600; 18005, TLE2, 90003, 192453, 264-2495; 18005, TLE2, 90004, 192454, 207-2072; 18005, TLE2, 90005, 192455, 1-2121; 18005, TLE2, 90006, 192456, 179-2044; 18005, TLE2, 90012, 192462, 85-2205; 18006, TLE3, 90017, 192467, 70-2169; 18006, TLE3, 90018, 192468, 774-2111; 18006, TLE3, 90019, 192469, 17-478; 18006, TLE3, 90021, 192471, 135-2471; 18006, TLE3, 90022, 192472, 399-2723; 18006, TLE3, 90023, 192473, 54-2402; 18006, TLE3, 90026, 192476, 1-1835; 18006, TLE3, 90027, 192477, 1120-2466; 18006, TLE3, 90030, 192480, 253-1314; 18006, TLE3, 90031, 192481, 353-2503; 18006, TLE3, 90032, 192482, 1-120; 18006, TLE3, 90033, 192483, 186-495; 18006, TLE3, 90034, 192484, 1120-3438; 18006, TLE3, 90014, 192464, 1103-3385; 18006, TLE3, 90015, 192465, 47-2356; 18006, TLE3, 90016, 192466, 74-2362; 18006, TLE3, 90020, 192470, 1379-3697; 18006, TLE3, 90024, 192474, 1091-3385; 18006, TLE3, 90025, 192475, 1-2295; 18006, TLE3, 90028, 192478, 1-2304; 18006, TLE3, 90029, 192479, 302-2620; 18007, TLE4, 90039, 192489, 181-565; 18007, TLE4, 90040, 192490, 1-632; 18007, TLE4, 90041, 192491, 1-967; 18007, TLE4, 90042, 192492, 71-656; 18007, TLE4, 90043, 192493, 200-873; 18007, TLE4, 90044, 192494, 1-1028; 18007, TLE4, 90045, 192495, 217-489; 18007, TLE4, 90046, 192496, 167-946; 18007, TLE4, 90047, 192497, 1-717; 18007, TLE4, 90048, 192498, 851-1156; 18007, TLE4, 90049, 192499, 1-497; 18007, TLE4, 90035, 192485, 47-2293; 18007, TLE4, 90036, 192486, 177-2594; 18007, TLE4, 90037, 192487, 1019-3133; 18007, TLE4, 90038, 192488, 1019-3340; 18008, TLE6, 90052, 192502, 119-582; 18008, TLE6, 90053, 192503, 98-235; 18008, TLE6, 90054, 192504, 359-1609; 18008, TLE6, 90050, 192500, 202-1920; 18008, TLE6, 90051, 192501, 359-1708; 18009, TF, 90056, 192506, 49-396; 18009, TF, 90057, 192507, 300-526; 18009, TF, 90058, 192508, 49-411; 18009, TF, 90059, 192509, 49-357; 18009, TF, 90060, 192510, 257-659; 18009, TF, 90061, 192511, 1-431; 18009, TF, 90055, 192505, 486-2582; 18010, TFRC, 90064, 192514, 117-2156; 18010, TFRC, 90065, 192515, 78-323; 18010, TFRC, 90066, 192516, 1-354; 18010, TFRC, 90062, 192512, 171-2453; 18010, TFRC, 90063, 192513, 284-2566; 18011, TFR2, 90068, 192518, 42-1109; 18011, TFR2, 90069, 192519, 1-509; 18011, TFR2, 90067, 192517, 42-2447; 18011, TFR2, 90070, 192520, 289-2694; 18012, TRRAP, 90073, 192523, 1-10766; 18012, TRRAP, 90074, 192524, 336-550; 18012, TRRAP, 90075, 192525, 62-11608; 18012, TRRAP, 90076, 192526, 210-11756; 18012, TRRAP, 90071, 192521, 210-11702; 18012, TRRAP, 90072, 192522, 210-11789; 18013, TRA2A, 90079, 192529, 200-391; 18013, TRA2A, 90077, 192527, 218-1066; 18013, TRA2A, 90078, 192528, 912-1454; 18013, TRA2A, 90080, 192530, 822-1367; 18013, TRA2A, 90081, 192531, 611-1156; 18014, TRA2B, 90082, 192532, 1-383; 18014, TRA2B, 90085, 192535, 1-323; 18014, TRA2B, 90083, 192533, 154-270; 18014, TRA2B, 90084, 192534, 410-976; 18014, TRA2B, 90086, 192536, 170-286; 18014, TRA2B, 90087, 192537, 277-1143; 18015, TGFB1I1, 90091, 192541, 40-384; 18015, TGFB1I1, 90092, 192542, 35-684; 18015, TGFB1I1, 90093, 192543, 160-318; 18015, TGFB1I1, 90094, 192544, 400-668; 18015, TGFB1I1, 90095, 192545, 78-573; 18015, TGFB1I1, 90097, 192547, 36-221; 18015, TGFB1I1, 90088, 192538, 55-1389; 18015, TGFB1I1, 90089, 192539, 85-1419; 18015, TGFB1I1, 90090, 192540, 131-1516; 18015, TGFB1I1, 90096, 192546, 54-1388; 18016, TBRG1, 90098, 192548, 210-692; 18016, TBRG1, 90100, 192550, 215-552; 18016, TBRG1, 90101, 192551, 224-706; 18016, TBRG1, 90102, 192552, 91-396; 18016, TBRG1, 90099, 192549, 205-1440; 18017, TBRG4, 90106, 192556, 239-548; 18017, TBRG4, 90107, 192557, 196-579; 18017, TBRG4, 90108, 192558, 112-856; 18017, TBRG4, 90109, 192559, 177-530; 18017, TBRG4, 90110, 192560, 1-822; 18017, TBRG4, 90111, 192561, 96-945; 18017, TBRG4, 90103, 192553, 123-2018; 18017, TBRG4, 90104, 192554, 127-1692; 18017, TBRG4, 90105, 192555, 435-2000; 18017, TBRG4, 90112, 192562, 71-1966; 18018, TGFA, 90114, 192564, 207-568; 18018, TGFA, 90117, 192567, 398-898; 18018, TGFA, 90118, 192568, 1-395; 18018, TGFA, 90119, 192569, 250-747; 18018, TGFA, 90113, 192563, 249-731; 18018, TGFA, 90115, 192565, 6-491; 18018, TGFA, 90116, 192566, 60-539; 18019, TGFB1, 90121, 192571, 1-362; 18019, TGFB1, 90120, 192570, 868-2040; 18020, TGFB2, 90122, 192572, 468-1796; 18020, TGFB2, 90123, 192573, 468-1712; 18021, TGFB3, 90124, 192574, 299-1537; 18021, TGFB3, 90125, 192575, 101-1030; 18022, TGFBR1, 90128, 192578, 57-1208; 18022, TGFBR1, 90129, 192579, 148-526; 18022, TGFBR1, 90131, 192581, 199-565; 18022, TGFBR1, 90132, 192582, 240-582; 18022, TGFBR1, 90133, 192583, 339-680; 18022, TGFBR1, 90134, 192584, 180-533; 18022, TGFBR1, 90135, 192585, 198-1502; 18022, TGFBR1, 90126, 192576, 96-1376; 18022, TGFBR1, 90127, 192577, 118-1629; 18022, TGFBR1, 90130, 192580, 57-1580; 18023, TGFBRAP1, 90136, 192586, 21-2603; 18023, TGFBRAP1, 90137, 192587, 428-3010; 18023, TGFBRAP1, 90138, 192588, 21-2603; 18024, TGFBR2, 90139, 192589, 383-2086; 18024, TGFBR2, 90140, 192590, 284-2062; 18025, TGFBR3, 90143, 192593, 446-551; 18025, TGFBR3, 90145, 192595, 516-785; 18025, TGFBR3, 90146, 192596, 169-318; 18025, TGFBR3, 90141, 192591, 516-3071; 18025, TGFBR3, 90142, 192592, 685-3237; 18025, TGFBR3, 90144, 192594, 346-2898; 18025, TGFBR3, 90147, 192597, 63-2618; 18026, TGFBR3L, 90148, 192598, 124-1074; 18027, TGFBI, 90150, 192600, 1-1099; 18027, TGFBI, 90151, 192601, 1-385; 18027, TGFBI, 90152, 192602, 1-582; 18027, TGFBI, 90153, 192603, 248-445; 18027, TGFBI, 90154, 192604, 1-179; 18027, TGFBI, 90155, 192605, 1-236; 18027, TGFBI, 90156, 192606, 1-660; 18027, TGFBI, 90149, 192599, 162-2213; 18028, TACC1, 90159, 192609, 554-967; 18028, TACC1, 90160, 192610, 1-1688; 18028, TACC1, 90162, 192612, 95-493; 18028, TACC1, 90163, 192613, 911-2740; 18028, TACC1, 90165, 192615, 57-491; 18028, TACC1, 90166, 192616, 504-685; 18028, TACC1, 90167, 192617, 324-1052; 18028, TACC1, 90168, 192618, 1-1364; 18028, TACC1, 90169, 192619, 53-1724; 18028, TACC1, 90170, 192620, 90-476; 18028, TACC1, 90171, 192621, 566-656; 18028, TACC1, 90172, 192622, 566-2311; 18028, TACC1, 90173, 192623, 133-1875; 18028, TACC1, 90157, 192607, 321-1508; 18028, TACC1, 90158, 192608, 380-2797; 18028, TACC1, 90161, 192611, 907-2739; 18028, TACC1, 90164, 192614, 707-2902; 18029, TACC2, 90178, 192628, 336-3452; 18029, TACC2, 90180, 192630, 1472-3199; 18029, TACC2, 90182, 192632, 47-8674; 18029, TACC2, 90183, 192633, 232-2239; 18029, TACC2, 90184, 192634, 1-554; 18029, TACC2, 90185, 192635, 1-1229; 18029, TACC2, 90186, 192636, 152-3178; 18029, TACC2, 90187, 192637, 1-547; 18029, TACC2, 90188, 192638, 1-461; 18029, TACC2, 90189, 192639, 329-8956; 18029, TACC2, 90191, 192641, 1-497; 18029, TACC2, 90192, 192642, 1-567; 18029, TACC2, 90193, 192643, 329-8809; 18029, TACC2, 90194, 192644, 1-527; 18029, TACC2, 90174, 192624, 82-3162; 18029, TACC2, 90175, 192625, 47-8893; 18029, TACC2, 90176, 192626, 47-3331; 18029, TACC2, 90177, 192627, 500-3490; 18029, TACC2, 90179, 192629, 1610-3325; 18029, TACC2, 90181, 192631, 341-9187; 18029, TACC2, 90190, 192640, 341-3625; 18030, TACC3, 90196, 192646, 115-778; 18030, TACC3, 90197, 192647, 134-825; 18030, TACC3, 90198, 192648, 111-302; 18030, TACC3, 90199, 192649, 146-726; 18030, TACC3, 90200, 192650, 1-650; 18030, TACC3, 90201, 192651, 156-593; 18030, TACC3, 90202, 192652, 101-538; 18030, TACC3, 90195, 192645, 107-2623; 18031, TAGLN, 90205, 192655, 101-375; 18031, TAGLN, 90209, 192659, 1-455; 18031, TAGLN, 90203, 192653, 449-1054; 18031, TAGLN, 90204, 192654, 125-730; 18031, TAGLN, 90206, 192656, 205-810; 18031, TAGLN, 90207, 192657, 261-866; 18031, TAGLN, 90208, 192658, 1142-1747; 18032, TAGLN2, 90213, 192663, 240-801; 18032, TAGLN2, 90210, 192660, 87-686; 18032, TAGLN2, 90211, 192661, 248-910; 18032, TAGLN2, 90212, 192662, 312-911; 18033, TAGLN3, 90217, 192667, 243-590; 18033, TAGLN3, 90219, 192669, 1-237; 18033, TAGLN3, 90220, 192670, 76-566; 18033, TAGLN3, 90221, 192671, 247-912; 18033, TAGLN3, 90214, 192664, 418-1017; 18033, TAGLN3, 90215, 192665, 553-1152; 18033, TAGLN3, 90216, 192666, 235-834; 18033, TAGLN3, 90218, 192668, 454-1053; 18034, TGM1, 90224, 192674, 442-469; 18034, TGM1, 90225, 192675, 334-527; 18034, TGM1, 90226, 192676, 412-562; 18034, TGM1, 90227, 192677, 271-898; 18034, TGM1, 90228, 192678, 1-387; 18034, TGM1, 90229, 192679, 151-555; 18034, TGM1, 90230, 192680, 455-580; 18034, TGM1, 90222, 192672, 125-2578; 18034, TGM1, 90223, 192673, 349-1476; 18035, TGM2, 90232, 192682, 177-1018; 18035, TGM2, 90233, 192683, 215-693; 18035, TGM2, 90231, 192681, 175-2238; 18036, TGM3, 90234, 192684, 64-2145; 18037, TGM4, 90236, 192686, 45-320; 18037, TGM4, 90237, 192687, 69-2123; 18037,

TGM4, 90238, 192688, 45-320; 18037, TGM4, 90235, 192685, 69-2123; 18038, TGM5, 90241, 192691, 4-2169; 18038, TGM5, 90242, 192692, 1-2160; 18038, TGM5, 90243, 192693, 1-1914; 18038, TGM5, 90239, 192689, 9-1925; 18038, TGM5, 90240, 192690, 9-2171; 18039, TGM6, 90244, 192694, 62-2182; 18039, TGM6, 90245, 192695, 62-1939; 18040, TGM7, 90246, 192696, 6-2138; 18041, TGOLN2, 90247, 192697, 335-1774; 18041, TGOLN2, 90251, 192701, 63-1427; 18041, TGOLN2, 90248, 192698, 464-1777; 18041, TGOLN2, 90249, 192699, 290-1429; 18041, TGOLN2, 90250, 192700, 63-1424; 18041, TGOLN2, 90252, 192702, 24-1367; 18042, TVP23A, 90255, 192705, 159-272; 18042, TVP23A, 90257, 192707, 1-453; 18042, TVP23A, 90258, 192708, 1-189; 18042, TVP23A, 90259, 192709, 1-461; 18042, TVP23A, 90253, 192703, 293-934; 18042, TVP23A, 90254, 192704, 108-674; 18042, TVP23A, 90256, 192706, 108-749; 18042, TVP23A, 90260, 192710, 108-749; 18043, TVP23B, 90262, 192712, 184-345; 18043, TVP23B, 90263, 192713, 152-265; 18043, TVP23B, 90264, 192714, 140-751; 18043, TVP23B, 90265, 192715, 1417-1842; 18043, TVP23B, 90266, 192716, 198-623; 18043, TVP23B, 90267, 192717, 302-697; 18043, TVP23B, 90261, 192711, 300-917; 18044, TVP23C, 90269, 192719, 148-765; 18044, TVP23C, 90270, 192720, 208-537; 18044, TVP23C, 90271, 192721, 89-706; 18044, TVP23C, 90272, 192722, 25-138; 18044, TVP23C, 90273, 192723, 1-162; 18044, TVP23C, 90274, 192724, 1417-1842; 18044, TVP23C, 90276, 192726, 1-183; 18044, TVP23C, 90268, 192718, 97-927; 18044, TVP23C, 90275, 192725, 140-751; 18045, TRPA1, 90278, 192728, 1-2751; 18045, TRPA1, 90277, 192727, 209-3568; 18046, TRPC1, 90280, 192730, 1-196; 18046, TRPC1, 90279, 192729, 392-2671; 18046, TRPC1, 90281, 192731, 487-2868; 18046, TRPC1, 90282, 192732, 56-2335; 18047, TRPC3, 90285, 192735, 341-619; 18047, TRPC3, 90286, 192736, 76-906; 18047, TRPC3, 90287, 192737, 1-2382; 18047, TRPC3, 90283, 192733, 420-2966; 18047, TRPC3, 90284, 192734, 75-2840; 18048, TRPC4, 90294, 192744, 157-1539; 18048, TRPC4, 90288, 192738, 236-2650; 18048, TRPC4, 90289, 192739, 236-2746; 18048, TRPC4, 90290, 192740, 236-2917; 18048, TRPC4, 90291, 192741, 236-2722; 18048, TRPC4, 90292, 192742, 1-2415; 18048, TRPC4, 90293, 192743, 859-3792; 18048, TRPC4, 90295, 192745, 1-972; 18048, TRPC4, 90296, 192746, 1-2949; 18049, TRPC4AP, 90297, 192747, 91-2484; 18049, TRPC4AP, 90298, 192748, 27-2396; 18050, TRPC5, 90299, 192749, 920-3841; 18051, TRPC6, 90303, 192753, 4-2565; 18051, TRPC6, 90300, 192750, 426-3221; 18051, TRPC6, 90301, 192751, 1-2448; 18051, TRPC6, 90302, 192752, 1-2631; 18052, TRPC7, 90306, 192756, 1-1143; 18052, TRPC7, 90307, 192757, 1-2424; 18052, TRPC7, 90309, 192759, 1-786; 18052, TRPC7, 90304, 192754, 1-2241; 18052, TRPC7, 90305, 192755, 1-2406; 18052, TRPC7, 90308, 192758, 284-2872; 18053, TRPM1, 90313, 192763, 113-4282; 18053, TRPM1, 90314, 192764, 1-4581; 18053, TRPM1, 90315, 192765, 113-1627; 18053, TRPM1, 90316, 192766, 1-690; 18053, TRPM1, 90319, 192769, 134-4945; 18053, TRPM1, 90320, 192770, 154-5031; 18053, TRPM1, 90321, 192771, 315-5243; 18053, TRPM1, 90322, 192772, 1-690; 18053, TRPM1, 90323, 192773, 1-4812; 18053, TRPM1, 90310, 192760, 149-5026; 18053, TRPM1, 90311, 192761, 115-4926; 18053, TRPM1, 90312, 192762, 315-5243; 18053, TRPM1, 90317, 192767, 135-545; 18053, TRPM1, 90318, 192768, 114-1016; 18054, TRPM2, 90327, 192777, 14-4675; 18054, TRPM2, 90328, 192778, 152-582; 18054, TRPM2, 90329, 192779, 99-842; 18054, TRPM2, 90324, 192774, 14-4363; 18054, TRPM2, 90325, 192775, 214-4725; 18054, TRPM2, 90326, 192776, 446-4957; 18055, TRPM3, 90330, 192780, 1-5136; 18055, TRPM3, 90331, 192781, 1-4710; 18055, TRPM3, 90332, 192782, 356-5065; 18055, TRPM3, 90334, 192784, 129-500; 18055, TRPM3, 90335, 192785, 350-1321; 18055, TRPM3, 90336, 192786, 356-5056; 18055, TRPM3, 90339, 192789, 1-4671; 18055, TRPM3, 90340, 192790, 321-1148; 18055, TRPM3, 90341, 192791, 1-4701; 18055, TRPM3, 90342, 192792, 1-4740; 18055, TRPM3, 90343, 192793, 1-4701; 18055, TRPM3, 90333, 192783, 327-1019; 18055, TRPM3, 90337, 192787, 245-5368; 18055, TRPM3, 90338, 192788, 245-4222; 18056, TRPM4, 90346, 192796, 102-413; 18056, TRPM4, 90347, 192797, 76-309; 18056, TRPM4, 90348, 192798, 36-686; 18056, TRPM4, 90349, 192799, 1-155; 18056, TRPM4, 90350, 192800, 127-594; 18056, TRPM4, 90351, 192801, 76-171; 18056, TRPM4, 90344, 192794, 127-3771; 18056, TRPM4, 90345, 192795, 53-3262; 18057, TRPM5, 90353, 192803, 7-3528; 18057, TRPM5, 90354, 192804, 1-3480; 18057, TRPM5, 90355, 192805, 7-3507; 18057, TRPM5, 90352, 192802, 10-3507; 18058, TRPM6, 90356, 192806, 239-1150; 18058, TRPM6, 90357, 192807, 239-6307; 18058, TRPM6, 90358, 192808, 100-6153; 18058, TRPM6, 90359, 192809, 73-6126; 18059, TRPM7, 90361, 192811, 1-1608; 18059, TRPM7, 90362, 192812, 239-5833; 18059, TRPM7, 90363, 192813, 1-703; 18059, TRPM7, 90360, 192810, 283-5880; 18060, TRPM8, 90365, 192815, 115-693; 18060, TRPM8, 90367, 192817, 1-420; 18060, TRPM8, 90368, 192818, 34-1011; 18060, TRPM8, 90369, 192819, 764-3025; 18060, TRPM8, 90370, 192820, 1-1131; 18060, TRPM8, 90364, 192814, 41-3355; 18060, TRPM8, 90366, 192816, 124-621; 18061, TRPV1, 90371, 192821, 1-2340; 18061, TRPV1, 90374, 192824, 18-2570; 18061, TRPV1, 90375, 192825, 34-2523; 18061, TRPV1, 90372, 192822, 528-3047; 18061, TRPV1, 90373, 192823, 202-2721; 18061, TRPV1, 90376, 192826, 276-2795; 18061, TRPV1, 90377, 192827, 215-2734; 18062, TRPV2, 90379, 192829, 1-796; 18062, TRPV2, 90380, 192830, 1-232; 18062, TRPV2, 90381, 192831, 1-417; 18062, TRPV2, 90382, 192832, 1-289; 18062, TRPV2, 90383, 192833, 1-273; 18062, TRPV2, 90378, 192828, 400-2694; 18063, TRPV3, 90385, 192835, 1-1019; 18063, TRPV3, 90386, 192836, 95-262; 18063, TRPV3, 90387, 192837, 95-262; 18063, TRPV3, 90389, 192839, 1-440; 18063, TRPV3, 90391, 192841, 1-2328; 18063, TRPV3, 90384, 192834, 133-2508; 18063, TRPV3, 90388, 192838, 133-2430; 18063, TRPV3, 90390, 192840, 323-2695; 18064, TRPV4, 90394, 192844, 84-1742; 18064, TRPV4, 90392, 192842, 84-2699; 18064, TRPV4, 90393, 192843, 96-2711; 18064, TRPV4, 90395, 192845, 1-2475; 18064, TRPV4, 90396, 192846, 1-2436; 18064, TRPV4, 90397, 192847, 1-2295; 18064, TRPV4, 90398, 192848, 1-2514; 18065, TRPV5, 90399, 192849, 350-2539; 18065, TRPV5, 90400, 192850, 1-2025; 18065, TRPV5, 90402, 192852, 350-2539; 18065, TRPV5, 90403, 192853, 1-2025; 18065, TRPV5, 90404, 192854, 265-1410; 18065, TRPV5, 90401, 192851, 265-1410; 18066, TRPV6, 90406, 192856, 167-532; 18066, TRPV6, 90407, 192857, 78-247; 18066, TRPV6, 90408, 192858, 790-2370; 18066, TRPV6, 90409, 192859, 247-2424; 18066, TRPV6, 90410, 192860, 1-62; 18066, TRPV6, 90411, 192861, 263-532; 18066, TRPV6, 90405, 192855, 127-2424; 18067, TNP1, 90412, 192862, 31-198; 18068, TNP2, 90413, 192863, 71-487; 18069, TKT, 90414, 192864, 461-1834; 18069, TKT, 90417, 192867, 81-542; 18069, TKT, 90418, 192868, 46-291; 18069, TKT, 90420, 192870, 33-1037; 18069, TKT, 90415, 192865, 81-1976; 18069, TKT, 90416, 192866, 59-1930; 18069, TKT, 90419, 192869, 90-1961; 18070,

TKTL1, 90423, 192873, 62-445; 18070, TKTL1, 90424, 192874, 31-622; 18070, TKTL1, 90425, 192875, 1-525; 18070, TKTL1, 90421, 192871, 282-1904; 18070, TKTL1, 90422, 192872, 190-1980; 18071, TKTL2, 90426, 192876, 13-1893; 18072, TMA16, 90428, 192878, 95-529; 18072, TMA16, 90429, 192879, 115-420; 18072, TMA16, 90430, 192880, 1-727; 18072, TMA16, 90431, 192881, 136-402; 18072, TMA16, 90427, 192877, 342-953; 18073, TMA7, 90432, 192882, 41-235; 18074, TACO1, 90433, 192883, 213-1106; 18075, TSN, 90435, 192885, 471-1142; 18075, TSN, 90436, 192886, 1-555; 18075, TSN, 90438, 192888, 118-396; 18075, TSN, 90439, 192889, 122-232; 18075, TSN, 90440, 192890, 121-231; 18075, TSN, 90441, 192891, 121-231; 18075, TSN, 90434, 192884, 248-934; 18075, TSN, 90437, 192887, 236-682; 18076, TSNAX, 90443, 192893, 157-646; 18076, TSNAX, 90442, 192892, 159-1031; 18077, TSNAXIP1, 90445, 192895, 1-1284; 18077, TSNAXIP1, 90446, 192896, 386-2317; 18077, TSNAXIP1, 90447, 192897, 43-555; 18077, TSNAXIP1, 90448, 192898, 51-344; 18077, TSNAXIP1, 90449, 192899, 243-668; 18077, TSNAXIP1, 90450, 192900, 46-2184; 18077, TSNAXIP1, 90451, 192901, 273-458; 18077, TSNAXIP1, 90452, 192902, 596-834; 18077, TSNAXIP1, 90453, 192903, 1-370; 18077, TSNAXIP1, 90454, 192904, 448-547; 18077, TSNAXIP1, 90444, 192894, 378-2354; 18078, TIMM10, 90455, 192905, 154-426; 18078, TIMM10, 90456, 192906, 182-454; 18078, TIMM10, 90457, 192907, 123-395; 18079, TIMM10B, 90459, 192909, 12-227; 18079, TIMM10B, 90460, 192910, 17-232; 18079, TIMM10B, 90458, 192908, 71-382; 18079, TIMM10B, 90461, 192911, 10-321; 18080, TIMM13, 90463, 192913, 6-248; 18080, TIMM13, 90462, 192912, 362-649; 18081, TIMM17A, 90464, 192914, 37-552; 18082, TIMM17B, 90467, 192917, 23-193; 18082, TIMM17B, 90468, 192918, 85-663; 18082, TIMM17B, 90470, 192920, 190-666; 18082, TIMM17B, 90465, 192915, 150-668; 18082, TIMM17B, 90466, 192916, 150-818; 18082, TIMM17B, 90469, 192919, 14-682; 18083, TIMM21, 90472, 192922, 287-805; 18083, TIMM21, 90473, 192923, 1-383; 18083, TIMM21, 90471, 192921, 299-1045; 18084, TIMM22, 90474, 192924, 27-611; 18084, TIMM22, 90475, 192925, 27-611; 18084, TIMM22, 90476, 192926, 27-611; 18085, TIMM23, 90477, 192927, 177-806; 18086, TIMM23B, 90479, 192929, 115-537; 18086, TIMM23B, 90480, 192930, 115-231; 18086, TIMM23B, 90481, 192931, 147-446; 18086, TIMM23B, 90478, 192928, 163-729; 18087, TIMM44, 90483, 192933, 1-402; 18087, TIMM44, 90484, 192934, 1-819; 18087, TIMM44, 90485, 192935, 17-436; 18087, TIMM44, 90486, 192936, 1-380; 18087, TIMM44, 90482, 192932, 270-1628; 18088, TIMM50, 90489, 192939, 1-335; 18088, TIMM50, 90490, 192940, 1-770; 18088, TIMM50, 90491, 192941, 1-680; 18088, TIMM50, 90492, 192942, 1-313; 18088, TIMM50, 90493, 192943, 2-769; 18088, TIMM50, 90494, 192944, 371-796; 18088, TIMM50, 90495, 192945, 14-487; 18088, TIMM50, 90496, 192946, 5-604; 18088, TIMM50, 90497, 192947, 1-349; 18088, TIMM50, 90498, 192948, 1-352; 18088, TIMM50, 90487, 192937, 134-1504; 18088, TIMM50, 90488, 192938, 134-1504; 18088, TIMM50, 90499, 192949, 23-1084; 18089, TIMM8A, 90500, 192950, 533-826; 18090, TIMM8B, 90501, 192951, 76-174; 18090, TIMM8B, 90503, 192953, 31-327; 18090, TIMM8B, 90502, 192952, 73-324; 18091, TIMM9, 90505, 192955, 245-377; 18091, TIMM9, 90509, 192959, 176-376; 18091, TIMM9, 90504, 192954, 527-796; 18091, TIMM9, 90506, 192956, 169-438; 18091, TIMM9, 90507, 192957, 141-410; 18091, TIMM9, 90508, 192958, 161-430; 18092, TIMMDC1, 90510, 192960, 183-710; 18092, TIMMDC1, 90511, 192961, 168-383; 18092, TIMMDC1, 90512, 192962, 152-349; 18092, TIMMDC1, 90514, 192964, 160-432; 18092, TIMMDC1, 90515, 192965, 188-643; 18092, TIMMDC1, 90516, 192966, 154-605; 18092, TIMMDC1, 90517, 192967, 1-115; 18092, TIMMDC1, 90513, 192963, 203-1060; 18093, TOMM20, 90518, 192968, 222-659; 18094, TOMM20L, 90520, 192970, 31-255; 18094, TOMM20L, 90519, 192969, 43-501; 18095, TOMM22, 90521, 192971, 32-460; 18096, TOMM34, 90522, 192972, 154-1083; 18097, TOMM40, 90526, 192976, 88-731; 18097, TOMM40, 90527, 192977, 1-506; 18097, TOMM40, 90528, 192978, 98-207; 18097, TOMM40, 90523, 192973, 102-1187; 18097, TOMM40, 90524, 192974, 105-1190; 18097, TOMM40, 90525, 192975, 181-1266; 18097, TOMM40, 90529, 192979, 94-1083; 18098, TOMM40L, 90530, 192980, 187-1113; 18098, TOMM40L, 90531, 192981, 270-1196; 18098, TOMM40L, 90532, 192982, 334-1158; 18099, TOMM5, 90535, 192985, 73-369; 18099, TOMM5, 90537, 192987, 1-216; 18099, TOMM5, 90533, 192983, 111-266; 18099, TOMM5, 90534, 192984, 66-323; 18099, TOMM5, 90536, 192986, 65-343; 18100, TOMM6, 90538, 192988, 34-258; 18100, TOMM6, 90539, 192989, 37-261; 18101, TOMM7, 90541, 192991, 13-390; 18101, TOMM7, 90542, 192992, 101-256; 18101, TOMM7, 90543, 192993, 74-241; 18101, TOMM7, 90540, 192990, 73-240; 18102, TOMM70A, 90544, 192994, 450-2276; 18103, TPR, 90546, 192996, 66-515; 18103, TPR, 90545, 192995, 298-7389; 18103, TPR, 90547, 192997, 298-2478; 18104, TRAM1, 90549, 192999, 199-535; 18104, TRAM1, 90550, 193000, 1038-1904; 18104, TRAM1, 90548, 192998, 171-1295; 18105, TRAM1L1, 90551, 193001, 184-1293; 18106, TRAM2, 90552, 193002, 1-1113; 18107, TSPO, 90556, 193006, 352-672; 18107, TSPO, 90557, 193007, 189-386; 18107, TSPO, 90553, 193003, 227-736; 18107, TSPO, 90554, 193004, 121-630; 18107, TSPO, 90555, 193005, 316-825; 18108, TSPO2, 90558, 193008, 229-441; 18108, TSPO2, 90559, 193009, 246-758; 18108, TSPO2, 90560, 193010, 112-624; 18109, TMPRSS12, 90562, 193012, 46-1008; 18109, TMPRSS12, 90561, 193011, 33-1079; 18110, TM4SF1, 90564, 193014, 125-478; 18110, TM4SF1, 90565, 193015, 103-414; 18110, TM4SF1, 90566, 193016, 146-451; 18110, TM4SF1, 90567, 193017, 196-894; 18110, TM4SF1, 90563, 193013, 319-927; 18111, TM4SF18, 90569, 193019, 184-662; 18111, TM4SF18, 90568, 193018, 267-872; 18111, TM4SF18, 90570, 193020, 101-706; 18112, TM4SF19, 90573, 193023, 127-1026; 18112, TM4SF19, 90574, 193024, 1-332; 18112, TM4SF19, 90571, 193021, 127-756; 18112, TM4SF19, 90572, 193022, 242-793; 18113, TM4SF20, 90576, 193026, 500-542; 18113, TM4SF20, 90575, 193025, 39-728; 18114, TM4SF4, 90578, 193028, 180-422; 18114, TM4SF4, 90577, 193027, 905-1513; 18115, TM4SF5, 90579, 193029, 32-625; 18116, TM6SF1, 90580, 193030, 24-461; 18116, TM6SF1, 90582, 193032, 34-435; 18116, TM6SF1, 90583, 193033, 110-676; 18116, TM6SF1, 90584, 193034, 358-856; 18116, TM6SF1, 90585, 193035, 1-92; 18116, TM6SF1, 90581, 193031, 275-1387; 18116, TM6SF1, 90586, 193036, 1-1020; 18117, TM6SF2, 90587, 193037, 74-1207; 18118, TM7SF2, 90590, 193040, 132-945; 18118, TM7SF2, 90591, 193041, 1-544; 18118, TM7SF2, 90592, 193042, 172-829; 18118, TM7SF2, 90593, 193043, 145-913; 18118, TM7SF2, 90594, 193044, 19-365; 18118, TM7SF2, 90595, 193045, 127-749; 18118, TM7SF2, 90596, 193046, 139-1014; 18118, TM7SF2, 90597, 193047, 126-570; 18118, TM7SF2, 90598, 193048, 1-280; 18118, TM7SF2, 90599, 193049, 139-408; 18118, TM7SF2, 90600, 193050, 60-729; 18118, TM7SF2, 90601, 193051, 1-626; 18118, TM7SF2, 90602, 193052, 128-535; 18118, TM7SF2, 90588, 193038, 163-1419; 18118, TM7SF2, 90589, 193039, 133-1308; 18119, TM7SF3, 90604, 193054, 427-537; 18119, TM7SF3, 90605, 193055, 1-601; 18119, TM7SF3, 90606, 193056, 231-579; 18119, TM7SF3, 90607, 193057, 1-434; 18119, TM7SF3, 90608, 193058, 278-623; 18119, TM7SF3, 90609, 193059, 206-355; 18119, TM7SF3, 90610, 193060, 1-459; 18119, TM7SF3, 90611, 193061, 314-573; 18119, TM7SF3, 90612, 193062, 160-568; 18119, TM7SF3, 90613, 193063, 192-577; 18119, TM7SF3, 90614, 193064, 1-244; 18119, TM7SF3, 90615, 193065, 402-601; 18119, TM7SF3, 90616, 193066, 380-788; 18119, TM7SF3, 90617, 193067, 1-666; 18119, TM7SF3, 90603, 193053, 227-1939; 18120, TM9SF1, 90620, 193070, 60-961; 18120, TM9SF1, 90621, 193071, 126-1388; 18120, TM9SF1, 90622, 193072, 156-882; 18120, TM9SF1, 90623, 193073, 390-2159; 18120, TM9SF1, 90624, 193074, 275-904; 18120, TM9SF1, 90625, 193075, 365-1924; 18120, TM9SF1, 90626, 193076, 294-1065; 18120, TM9SF1, 90627, 193077, 105-505; 18120, TM9SF1, 90628, 193078, 99-721; 18120, TM9SF1, 90618, 193068, 360-2180; 18120, TM9SF1, 90619, 193069, 291-1760; 18121, TM9SF2, 90629, 193079, 191-2182; 18122, TM9SF3, 90631, 193081, 108-868; 18122, TM9SF3, 90630, 193080, 218-1987; 18123, TM9SF4, 90632, 193082, 341-2218; 18123, TM9SF4, 90634, 193084, 14-271; 18123, TM9SF4, 90635, 193085, 310-516; 18123, TM9SF4, 90636, 193086, 25-282; 18123, TM9SF4, 90633, 193083, 236-2164; 18124, TMCC1, 90638, 193088, 178-1797; 18124, TMCC1, 90639, 193089, 953-1942; 18124, TMCC1, 90640, 193090, 153-402; 18124, TMCC1, 90641, 193091, 157-208; 18124, TMCC1, 90642, 193092, 186-203; 18124, TMCC1, 90637, 193087, 342-2303; 18125, TMCC2, 90643, 193093, 190-1599; 18125, TMCC2, 90644, 193094, 1-1455; 18125, TMCC2, 90646, 193096, 125-892; 18125, TMCC2, 90645, 193095, 390-2519; 18125, TMCC2, 90647, 193097, 226-2121; 18126, TMCC3, 90649, 193099, 155-1495; 18126, TMCC3, 90650, 193100, 87-483; 18126, TMCC3, 90648, 193098, 133-1566; 18127, TMCO1, 90651, 193101, 277-996; 18127, TMCO1, 90653, 193103, 323-752; 18127, TMCO1, 90654, 193104, 704-1018; 18127, TMCO1, 90655, 193105, 15-473; 18127, TMCO1, 90656, 193106, 301-615; 18127, TMCO1, 90657, 193107, 1-287; 18127, TMCO1, 90658, 193108, 19-738; 18127, TMCO1, 90659, 193109, 19-477; 18127, TMCO1, 90652, 193102, 152-718; 18128, TMCO2, 90660, 193110, 94-642; 18129, TMCO3, 90663, 193113, 1-437; 18129, TMCO3, 90664, 193114, 1-285; 18129, TMCO3, 90665, 193115, 1-491; 18129, TMCO3, 90666, 193116, 1-381; 18129, TMCO3, 90668, 193118, 1-255; 18129, TMCO3, 90661, 193111, 312-1556; 18129, TMCO3, 90662, 193112, 360-2393; 18129, TMCO3, 90667, 193117, 259-1833; 18130, TMCO4, 90670, 193120, 272-2014; 18130, TMCO4, 90669, 193119, 243-2147; 18131, TMCO5A, 90672, 193122, 155-727; 18131, TMCO5A, 90673, 193123, 368-579; 18131, TMCO5A, 90674, 193124, 407-839; 18131, TMCO5A, 90675, 193125, 333-575; 18131, TMCO5A, 90676, 193126, 142-714; 18131, TMCO5A, 90671, 193121, 103-969; 18131, TMCO5A, 90677, 193127, 172-858; 18132, TMCO6, 90680, 193130, 372-542; 18132, TMCO6, 90681, 193131, 39-344; 18132, TMCO6, 90682, 193132, 81-212; 18132, TMCO6, 90683, 193133, 34-165; 18132, TMCO6, 90684, 193134, 60-191; 18132, TMCO6, 90685, 193135, 66-197; 18132, TMCO6, 90678, 193128, 25-1524; 18132, TMCO6, 90679, 193129, 102-1583; 18133, TMIGD1, 90686, 193136, 74-862; 18133, TMIGD1, 90687, 193137, 86-742; 18134, TMIGD2, 90689, 193139, 1-489; 18134, TMIGD2, 90691, 193141, 1-333; 18134, TMIGD2, 90688, 193138, 47-895; 18134, TMIGD2, 90690, 193140, 9-845; 18135, TMIGD3, 90692, 193142, 135-1178; 18135, TMIGD3, 90694, 193144, 1-519; 18135, TMIGD3, 90695, 193145, 1-477; 18135, TMIGD3, 90696, 193146, 1-324; 18135, TMIGD3, 90693, 193143, 11-811; 18136, TMTC1, 90699, 193149, 147-2981; 18136, TMTC1, 90700, 193150, 48-2768; 18136, TMTC1, 90701, 193151, 1-393; 18136, TMTC1, 90697, 193147, 475-2799; 18136, TMTC1, 90698, 193148, 60-2708; 18137, TMTC2, 90703, 193153, 1806-4298; 18137, TMTC2, 90704, 193154, 587-2500; 18137, TMTC2, 90705, 193155, 107-214; 18137, TMTC2, 90702, 193152, 708-3218; 18138, TMTC3, 90707, 193157, 130-574; 18138, TMTC3, 90708, 193158, 210-646; 18138, TMTC3, 90709, 193159, 221-1441; 18138, TMTC3, 90706, 193156, 221-2965; 18139, TMTC4, 90713, 193163, 107-451; 18139, TMTC4, 90714, 193164, 478-639; 18139, TMTC4, 90715, 193165, 362-580; 18139, TMTC4, 90710, 193160, 260-2542; 18139, TMTC4, 90711, 193161, 191-2416; 18139, TMTC4, 90712, 193162, 86-1978; 18140, TMUB1, 90721, 193171, 95-550; 18140, TMUB1, 90722, 193172, 73-584; 18140, TMUB1, 90716, 193166, 144-884; 18140, TMUB1, 90717, 193167, 359-1099; 18140, TMUB1, 90718, 193168, 346-1086; 18140, TMUB1, 90719, 193169, 94-834; 18140, TMUB1, 90720, 193170, 89-829; 18141, TMUB2, 90725, 193175, 424-1218; 18141, TMUB2, 90728, 193178, 191-376; 18141, TMUB2, 90730, 193180, 224-409; 18141, TMUB2, 90731, 193181, 1-583; 18141, TMUB2, 90735, 193185, 197-490; 18141, TMUB2, 90737, 193187, 582-809; 18141, TMUB2, 90723, 193173, 651-1556; 18141, TMUB2, 90724, 193174, 150-1055; 18141, TMUB2, 90726, 193176, 154-1119; 18141, TMUB2, 90727, 193177, 86-370; 18141, TMUB2, 90729, 193179, 115-399; 18141, TMUB2, 90732, 193182, 688-972; 18141, TMUB2, 90733, 193183, 154-1119; 18141, TMUB2, 90734, 193184, 165-1070; 18141, TMUB2, 90736, 193186, 203-748; 18142, TAPT1, 90739, 193189, 15-368; 18142, TAPT1, 90740, 193190, 1-155; 18142, TAPT1, 90741, 193191, 1-637; 18142, TAPT1, 90738, 193188, 85-1788; 18143, TMBIM1, 90744, 193194, 246-464; 18143, TMBIM1, 90745, 193195, 283-534; 18143, TMBIM1, 90746, 193196, 68-569; 18143, TMBIM1, 90747, 193197, 165-677; 18143, TMBIM1, 90748, 193198, 369-782; 18143, TMBIM1, 90749, 193199, 302-571; 18143, TMBIM1, 90750, 193200, 79-726; 18143, TMBIM1, 90751, 193201, 379-580; 18143, TMBIM1, 90752, 193202, 138-589; 18143, TMBIM1, 90753, 193203, 211-348; 18143, TMBIM1, 90755, 193205, 208-526; 18143, TMBIM1, 90756, 193206, 287-561; 18143, TMBIM1, 90757, 193207, 338-659; 18143, TMBIM1, 90758, 193208, 338-361; 18143, TMBIM1, 90759, 193209, 41-463; 18143, TMBIM1, 90742, 193192, 153-1088; 18143, TMBIM1, 90743, 193193, 213-1148; 18143, TMBIM1, 90754, 193204, 727-1662; 18144, TMBIM4, 90760, 193210, 12-869; 18144, TMBIM4, 90762, 193212, 48-533; 18144, TMBIM4, 90763, 193213, 54-197; 18144, TMBIM4, 90764, 193214, 19-150; 18144, TMBIM4, 90765, 193215, 30-161; 18144, TMBIM4, 90766, 193216, 49-537; 18144, TMBIM4, 90767, 193217, 1032-1217; 18144, TMBIM4, 90768, 193218, 122-610; 18144, TMBIM4, 90769, 193219, 13-645; 18144, TMBIM4, 90770, 193220, 62-193; 18144, TMBIM4, 90771, 193221, 77-217; 18144, TMBIM4, 90761, 193211, 122-838; 18145, N/A, 90772, 193222, 1-624; 18146, TMBIM6, 90776, 193226, 214-538; 18146, TMBIM6, 90778, 193228, 65-667; 18146, TMBIM6, 90779, 193229, 325-373; 18146, TMBIM6, 90780, 193230, 383-669; 18146, TMBIM6, 90781, 193231, 521-551;

18146, TMBIM6, 90783, 193233, 226-640; 18146, TMBIM6, 90784, 193234, 235-521; 18146, TMBIM6, 90785, 193235, 437-469; 18146, TMBIM6, 90786, 193236, 401-533; 18146, TMBIM6, 90787, 193237, 473-759; 18146, TMBIM6, 90788, 193238, 325-761; 18146, TMBIM6, 90789, 193239, 86-427; 18146, TMBIM6, 90791, 193241, 121-556; 18146, TMBIM6, 90792, 193242, 192-582; 18146, TMBIM6, 90793, 193243, 180-446; 18146, TMBIM6, 90794, 193244, 301-423; 18146, TMBIM6, 90773, 193223, 86-799; 18146, TMBIM6, 90774, 193224, 39-752; 18146, TMBIM6, 90775, 193225, 329-1216; 18146, TMBIM6, 90777, 193227, 236-1123; 18146, TMBIM6, 90782, 193232, 228-941; 18146, TMBIM6, 90790, 193240, 117-830; 18147, TMC1, 90795, 193245, 541-2823; 18147, TMC1, 90796, 193246, 408-2690; 18148, TMC2, 90797, 193247, 16-2736; 18149, TMC3, 90799, 193249, 137-3442; 18149, TMC3, 90798, 193248, 137-3439; 18150, TMC4, 90800, 193250, 231-757; 18150, TMC4, 90801, 193251, 134-2272; 18150, TMC4, 90802, 193252, 133-2271; 18150, TMC4, 90803, 193253, 133-2271; 18150, TMC4, 90805, 193255, 55-2175; 18150, TMC4, 90806, 193256, 56-2176; 18150, TMC4, 90807, 193257, 56-2176; 18150, TMC4, 90808, 193258, 1-718; 18150, TMC4, 90809, 193259, 133-2271; 18150, TMC4, 90810, 193260, 1-168; 18150, TMC4, 90814, 193264, 134-2272; 18150, TMC4, 90815, 193265, 1-168; 18150, TMC4, 90816, 193266, 134-2272; 18150, TMC4, 90804, 193254, 133-2271; 18150, TMC4, 90811, 193261, 54-2174; 18150, TMC4, 90812, 193262, 133-2271; 18150, TMC4, 90813, 193263, 133-2271; 18150, TMC4, 90817, 193267, 133-2271; 18151, TMC5, 90821, 193271, 543-3407; 18151, TMC5, 90823, 193273, 191-2260; 18151, TMC5, 90825, 193275, 1-98; 18151, TMC5, 90826, 193276, 1-128; 18151, TMC5, 90818, 193268, 258-2540; 18151, TMC5, 90819, 193269, 762-3608; 18151, TMC5, 90820, 193270, 750-3770; 18151, TMC5, 90822, 193272, 705-3725; 18151, TMC5, 90824, 193274, 292-2235; 18152, TMC6, 90833, 193283, 472-597; 18152, TMC6, 90834, 193284, 283-743; 18152, TMC6, 90835, 193285, 122-551; 18152, TMC6, 90836, 193286, 243-1099; 18152, TMC6, 90827, 193277, 94-1458; 18152, TMC6, 90828, 193278, 142-2559; 18152, TMC6, 90829, 193279, 189-2606; 18152, TMC6, 90830, 193280, 1-1155; 18152, TMC6, 90831, 193281, 161-2578; 18152, TMC6, 90832, 193282, 700-1596; 18153, TMC7, 90839, 193289, 131-2407; 18153, TMC7, 90837, 193287, 131-2302; 18153, TMC7, 90838, 193288, 559-2400; 18154, TMC8, 90841, 193291, 383-971; 18154, TMC8, 90842, 193292, 427-433; 18154, TMC8, 90840, 193290, 375-2555; 18154, TMC8, 90843, 193293, 561-2072; 18155, TEDDM1, 90844, 193294, 132-953; 18156, TMIE, 90845, 193295, 156-626; 18157, TMED1, 90847, 193297, 283-531; 18157, TMED1, 90848, 193298, 1-197; 18157, TMED1, 90849, 193299, 5-578; 18157, TMED1, 90850, 193300, 11-235; 18157, TMED1, 90851, 193301, 128-685; 18157, TMED1, 90852, 193302, 59-346; 18157, TMED1, 90846, 193296, 100-783; 18158, TMED10, 90854, 193304, 19-480; 18158, TMED10, 90853, 193303, 53-712; 18159, TMED2, 90856, 193306, 105-603; 18159, TMED2, 90857, 193307, 1261-1611; 18159, TMED2, 90855, 193305, 107-712; 18160, TMED3, 90860, 193310, 92-532; 18160, TMED3, 90861, 193311, 95-562; 18160, TMED3, 90858, 193308, 189-842; 18160, TMED3, 90859, 193309, 106-627; 18161, TMED4, 90862, 193312, 82-618; 18161, TMED4, 90863, 193313, 54-737; 18161, TMED4, 90864, 193314, 26-586; 18162, TMED5, 90865, 193315, 20-508; 18162, TMED5, 90868, 193318, 275-637; 18162, TMED5, 90866, 193316, 487-1176; 18162, TMED5, 90867, 193317, 120-701; 18163, TMED6, 90869, 193319, 57-779; 18164, TMED7, 90871, 193321, 328-572; 18164, TMED7, 90870, 193320, 382-1056; 18165, TMED9, 90872, 193322, 58-765; 18166, TMED8, 90873, 193323, 57-1034; 18167, TPTE, 90877, 193327, 334-755; 18167, TPTE, 90874, 193324, 353-1954; 18167, TPTE, 90875, 193325, 331-1872; 18167, TPTE, 90876, 193326, 469-1710; 18167, TPTE, 90878, 193328, 331-1986; 18168, TPTE2, 90884, 193334, 1-1014; 18168, TPTE2, 90879, 193329, 46-1383; 18168, TPTE2, 90880, 193330, 44-1492; 18168, TPTE2, 90881, 193331, 211-1548; 18168, TPTE2, 90882, 193332, 238-1473; 18168, TPTE2, 90883, 193333, 46-1614; 18169, TMPRSS11A, 90885, 193335, 748-2013; 18169, TMPRSS11A, 90886, 193336, 81-1253; 18169, TMPRSS11A, 90888, 193338, 1-1158; 18169, TMPRSS11A, 90887, 193337, 34-1290; 18170, TMPRSS11B, 90889, 193339, 163-1413; 18171, TMPRSS11D, 90891, 193341, 1-194; 18171, TMPRSS11D, 90890, 193340, 100-1356; 18172, TMPRSS11E, 90893, 193343, 1-376; 18172, TMPRSS11E, 90894, 193344, 65-1336; 18172, TMPRSS11E, 90895, 193345, 1-376; 18172, TMPRSS11E, 90892, 193342, 65-1336; 18173, TMPRSS11F, 90896, 193346, 61-1377; 18174, TMPRSS13, 90898, 193348, 75-1835; 18174, TMPRSS13, 90899, 193349, 59-1762; 18174, TMPRSS13, 90901, 193351, 124-246; 18174, TMPRSS13, 90903, 193353, 75-1763; 18174, TMPRSS13, 90897, 193347, 89-1780; 18174, TMPRSS13, 90900, 193350, 75-1673; 18174, TMPRSS13, 90902, 193352, 153-1628; 18175, TMPRSS15, 90905, 193355, 72-754; 18175, TMPRSS15, 90906, 193356, 438-452; 18175, TMPRSS15, 90904, 193354, 35-3094; 18176, TMPRSS2, 90909, 193359, 435-1901; 18176, TMPRSS2, 90911, 193361, 217-454; 18176, TMPRSS2, 90912, 193362, 69-726; 18176, TMPRSS2, 90907, 193357, 136-1614; 18176, TMPRSS2, 90908, 193358, 62-1651; 18176, TMPRSS2, 90910, 193360, 90-1568; 18177, TMPRSS3, 90915, 193365, 527-1882; 18177, TMPRSS3, 90913, 193363, 957-2321; 18177, TMPRSS3, 90914, 193364, 202-1236; 18177, TMPRSS3, 90916, 193366, 170-1531; 18178, TMPRSS4, 90918, 193368, 1-188; 18178, TMPRSS4, 90919, 193369, 174-692; 18178, TMPRSS4, 90920, 193370, 584-1456; 18178, TMPRSS4, 90922, 193372, 1-445; 18178, TMPRSS4, 90923, 193373, 233-1240; 18178, TMPRSS4, 90925, 193375, 226-405; 18178, TMPRSS4, 90928, 193378, 292-1491; 18178, TMPRSS4, 90929, 193379, 251-1519; 18178, TMPRSS4, 90917, 193367, 215-1528; 18178, TMPRSS4, 90921, 193371, 227-1420; 18178, TMPRSS4, 90924, 193374, 210-1508; 18178, TMPRSS4, 90926, 193376, 266-1573; 18178, TMPRSS4, 90927, 193377, 292-1605; 18179, TMPRSS5, 90931, 193381, 695-1291; 18179, TMPRSS5, 90932, 193382, 658-1101; 18179, TMPRSS5, 90933, 193383, 79-1245; 18179, TMPRSS5, 90934, 193384, 85-219; 18179, TMPRSS5, 90935, 193385, 254-1600; 18179, TMPRSS5, 90936, 193386, 531-581; 18179, TMPRSS5, 90937, 193387, 553-584; 18179, TMPRSS5, 90938, 193388, 152-1393; 18179, TMPRSS5, 90939, 193389, 114-1148; 18179, TMPRSS5, 90930, 193380, 150-1523; 18180, TMPRSS6, 90944, 193394, 1-216; 18180, TMPRSS6, 90945, 193395, 118-1503; 18180, TMPRSS6, 90946, 193396, 102-526; 18180, TMPRSS6, 90940, 193390, 118-2553; 18180, TMPRSS6, 90941, 193391, 142-2616; 18180, TMPRSS6, 90942, 193392, 63-2537; 18180, TMPRSS6, 90943, 193393, 73-2481; 18181, TMPRSS7, 90949, 193399, 169-558; 18181, TMPRSS7, 90950, 193400, 70-617; 18181, TMPRSS7, 90947, 193397, 4-2535; 18181, TMPRSS7, 90948, 193398, 83-2236; 18181, TMPRSS7, 90951, 193401, 39-2192; 18182, TMPRSS9, 90953, 193403, 1-2568; 18182,

TMPRSS9, 90952, 193402, 1-3180; 18183, TMEM100, 90955, 193405, 333-720; 18183, TMEM100, 90954, 193404, 304-708; 18183, TMEM100, 90956, 193406, 810-1214; 18184, TMEM101, 90958, 193408, 583-593; 18184, TMEM101, 90959, 193409, 1-516; 18184, TMEM101, 90960, 193410, 392-682; 18184, TMEM101, 90961, 193411, 420-573; 18184, TMEM101, 90963, 193413, 311-576; 18184, TMEM101, 90957, 193407, 26-799; 18184, TMEM101, 90962, 193412, 317-1090; 18185, TMEM102, 90964, 193414, 274-1800; 18185, TMEM102, 90965, 193415, 419-1945; 18186, TMEM104, 90967, 193417, 147-1130; 18186, TMEM104, 90970, 193420, 146-534; 18186, TMEM104, 90966, 193416, 163-1653; 18186, TMEM104, 90968, 193418, 123-1613; 18186, TMEM104, 90969, 193419, 146-1090; 18187, TMEM105, 90972, 193422, 292-513; 18187, TMEM105, 90971, 193421, 551-940; 18188, TMEM106A, 90973, 193423, 70-717; 18188, TMEM106A, 90976, 193426, 190-913; 18188, TMEM106A, 90974, 193424, 238-882; 18188, TMEM106A, 90975, 193425, 260-1048; 18188, TMEM106A, 90977, 193427, 238-1026; 18189, TMEM106B, 90980, 193430, 159-473; 18189, TMEM106B, 90981, 193431, 422-496; 18189, TMEM106B, 90982, 193432, 255-584; 18189, TMEM106B, 90978, 193428, 323-1147; 18189, TMEM106B, 90979, 193429, 188-1012; 18190, TMEM106C, 90986, 193436, 392-579; 18190, TMEM106C, 90988, 193438, 141-581; 18190, TMEM106C, 90989, 193439, 67-264; 18190, TMEM106C, 90990, 193440, 94-354; 18190, TMEM106C, 90991, 193441, 1-352; 18190, TMEM106C, 90992, 193442, 56-595; 18190, TMEM106C, 90993, 193443, 1-326; 18190, TMEM106C, 90994, 193444, 25-279; 18190, TMEM106C, 90995, 193445, 29-241; 18190, TMEM106C, 90997, 193447, 1-226; 18190, TMEM106C, 90998, 193448, 99-644; 18190, TMEM106C, 90983, 193433, 79-774; 18190, TMEM106C, 90984, 193434, 114-866; 18190, TMEM106C, 90985, 193435, 99-794; 18190, TMEM106C, 90987, 193437, 58-810; 18190, TMEM106C, 90996, 193446, 54-749; 18191, TMEM107, 91000, 193450, 31-255; 18191, TMEM107, 91002, 193452, 88-195; 18191, TMEM107, 91003, 193453, 88-411; 18191, TMEM107, 90999, 193449, 114-554; 18191, TMEM107, 91001, 193451, 89-511; 18191, TMEM107, 91004, 193454, 103-522; 18192, TMEM108, 91007, 193457, 96-555; 18192, TMEM108, 91008, 193458, 556-823; 18192, TMEM108, 91009, 193459, 296-510; 18192, TMEM108, 91010, 193460, 124-1590; 18192, TMEM108, 91011, 193461, 370-687; 18192, TMEM108, 91012, 193462, 236-681; 18192, TMEM108, 91013, 193463, 510-874; 18192, TMEM108, 91005, 193455, 211-1938; 18192, TMEM108, 91006, 193456, 196-1923; 18193, TMEM109, 91014, 193464, 404-1135; 18193, TMEM109, 91015, 193465, 17-748; 18194, TMEM11, 91016, 193466, 473-1051; 18195, TMEM110, 91018, 193468, 1-269; 18195, TMEM110, 91019, 193469, 1-120; 18195, TMEM110, 91020, 193470, 94-291; 18195, TMEM110, 91017, 193467, 147-1031; 18196, TMEM114, 91021, 193471, 198-626; 18196, TMEM114, 91023, 193473, 1-534; 18196, TMEM114, 91022, 193472, 1-672; 18197, TMEM115, 91024, 193474, 548-1603; 18198, TMEM116, 91026, 193476, 198-455; 18198, TMEM116, 91027, 193477, 116-640; 18198, TMEM116, 91028, 193478, 96-319; 18198, TMEM116, 91029, 193479, 175-417; 18198, TMEM116, 91031, 193481, 164-406; 18198, TMEM116, 91032, 193482, 523-978; 18198, TMEM116, 91033, 193483, 297-615; 18198, TMEM116, 91034, 193484, 418-571; 18198, TMEM116, 91036, 193486, 407-718; 18198, TMEM116, 91025, 193475, 172-1080; 18198, TMEM116, 91030, 193480, 144-1157; 18198, TMEM116, 91035, 193485, 370-1107; 18199, TMEM117, 91038, 193488, 73-495; 18199, TMEM117, 91039, 193489, 143-949; 18199, TMEM117, 91040, 193490, 101-576; 18199, TMEM117, 91037, 193487, 128-1672; 18200, TMEM119, 91042, 193492, 436-567; 18200, TMEM119, 91043, 193493, 403-486; 18200, TMEM119, 91044, 193494, 155-575; 18200, TMEM119, 91041, 193491, 170-1021; 18201, TMEM120A, 91046, 193496, 1-690; 18201, TMEM120A, 91047, 193497, 1-300; 18201, TMEM120A, 91048, 193498, 47-1015; 18201, TMEM120A, 91049, 193499, 87-1055; 18201, TMEM120A, 91050, 193500, 69-590; 18201, TMEM120A, 91051, 193501, 1-307; 18201, TMEM120A, 91052, 193502, 5-1114; 18201, TMEM120A, 91045, 193495, 90-1121; 18202, TMEM120B, 91055, 193505, 1-744; 18202, TMEM120B, 91056, 193506, 397-675; 18202, TMEM120B, 91053, 193503, 145-1164; 18202, TMEM120B, 91054, 193504, 102-1121; 18203, TMEM121, 91057, 193507, 165-1124; 18203, TMEM121, 91058, 193508, 152-1111; 18204, TMEM123, 91061, 193511, 503-568; 18204, TMEM123, 91062, 193512, 195-557; 18204, TMEM123, 91063, 193513, 338-700; 18204, TMEM123, 91064, 193514, 329-467; 18204, TMEM123, 91059, 193509, 217-786; 18204, TMEM123, 91060, 193510, 422-1048; 18205, TMEM125, 91065, 193515, 521-567; 18205, TMEM125, 91066, 193516, 571-1230; 18205, TMEM125, 91067, 193517, 507-1166; 18206, TMEM126A, 91069, 193519, 131-250; 18206, TMEM126A, 91072, 193522, 111-398; 18206, TMEM126A, 91068, 193518, 110-697; 18206, TMEM126A, 91070, 193520, 224-601; 18206, TMEM126A, 91071, 193521, 238-615; 18207, TMEM126B, 91075, 193525, 1-376; 18207, TMEM126B, 91076, 193526, 12-134; 18207, TMEM126B, 91077, 193527, 5-181; 18207, TMEM126B, 91079, 193529, 12-143; 18207, TMEM126B, 91080, 193530, 1-121; 18207, TMEM126B, 91081, 193531, 16-138; 18207, TMEM126B, 91082, 193532, 16-147; 18207, TMEM126B, 91083, 193533, 4-126; 18207, TMEM126B, 91073, 193523, 24-716; 18207, TMEM126B, 91074, 193524, 298-900; 18207, TMEM126B, 91078, 193528, 7-519; 18208, TMEM127, 91085, 193535, 110-574; 18208, TMEM127, 91084, 193534, 258-974; 18208, TMEM127, 91086, 193536, 235-951; 18209, TMEM128, 91088, 193538, 11-508; 18209, TMEM128, 91087, 193537, 588-1013; 18210, TMEM129, 91091, 193541, 1-277; 18210, TMEM129, 91092, 193542, 1-85; 18210, TMEM129, 91089, 193539, 522-1220; 18210, TMEM129, 91090, 193540, 495-1583; 18210, TMEM129, 91093, 193543, 411-1499; 18211, TMEM130, 91096, 193546, 541-679; 18211, TMEM130, 91097, 193547, 1317-2336; 18211, TMEM130, 91094, 193544, 97-1062; 18211, TMEM130, 91095, 193545, 176-1447; 18211, TMEM130, 91098, 193548, 6-1313; 18212, TMEM131, 91100, 193550, 1-426; 18212, TMEM131, 91101, 193551, 1-998; 18212, TMEM131, 91102, 193552, 182-565; 18212, TMEM131, 91099, 193549, 230-5881; 18213, TMEM132A, 91105, 193555, 1-341; 18213, TMEM132A, 91106, 193556, 1-312; 18213, TMEM132A, 91107, 193557, 1-454; 18213, TMEM132A, 91108, 193558, 761-990; 18213, TMEM132A, 91103, 193553, 154-3228; 18213, TMEM132A, 91104, 193554, 159-3230; 18214, TMEM132B, 91109, 193559, 9-3245; 18214, TMEM132B, 91110, 193560, 220-1992; 18215, TMEM132C, 91111, 193561, 1-3327; 18216, TMEM132D, 91114, 193564, 1-3240; 18216, TMEM132D, 91112, 193562, 1242-3155; 18216, TMEM132D, 91113, 193563, 328-3627; 18217, TMEM132E, 91116, 193566, 69-3293; 18217, TMEM132E, 91115, 193565, 329-3283; 18218,

TMEM133, 91117, 193567, 321-710; 18219, TMEM134, 91121, 193571, 77-409; 18219, TMEM134, 91122, 193572, 42-401; 18219, TMEM134, 91123, 193573, 1-295; 18219, TMEM134, 91124, 193574, 1-125; 18219, TMEM134, 91118, 193568, 43-630; 18219, TMEM134, 91119, 193569, 59-601; 18219, TMEM134, 91120, 193570, 48-626; 18220, TMEM135, 91127, 193577, 126-496; 18220, TMEM135, 91128, 193578, 62-753; 18220, TMEM135, 91129, 193579, 134-1123; 18220, TMEM135, 91125, 193575, 40-1416; 18220, TMEM135, 91126, 193576, 203-1513; 18221, TMEM136, 91130, 193580, 328-1131; 18221, TMEM136, 91131, 193581, 242-979; 18221, TMEM136, 91132, 193582, 317-763; 18222, TMEM138, 91134, 193584, 389-703; 18222, TMEM138, 91133, 193583, 560-1048; 18222, TMEM138, 91135, 193585, 200-517; 18223, TMEM139, 91136, 193586, 514-1164; 18223, TMEM139, 91137, 193587, 140-790; 18223, TMEM139, 91138, 193588, 245-895; 18223, TMEM139, 91139, 193589, 109-759; 18223, TMEM139, 91140, 193590, 39-689; 18224, TMEM140, 91141, 193591, 224-781; 18225, TMEM141, 91142, 193592, 17-343; 18226, TMEM143, 91145, 193595, 140-1414; 18226, TMEM143, 91146, 193596, 166-571; 18226, TMEM143, 91147, 193597, 19-327; 18226, TMEM143, 91148, 193598, 30-541; 18226, TMEM143, 91149, 193599, 2-283; 18226, TMEM143, 91143, 193593, 318-1697; 18226, TMEM143, 91144, 193594, 19-1098; 18227, TMEM144, 91151, 193601, 215-799; 18227, TMEM144, 91152, 193602, 204-535; 18227, TMEM144, 91153, 193603, 504-764; 18227, TMEM144, 91154, 193604, 164-576; 18227, TMEM144, 91155, 193605, 516-546; 18227, TMEM144, 91156, 193606, 570-1070; 18227, TMEM144, 91157, 193607, 253-525; 18227, TMEM144, 91158, 193608, 471-731; 18227, TMEM144, 91159, 193609, 344-575; 18227, TMEM144, 91160, 193610, 285-506; 18227, TMEM144, 91161, 193611, 411-642; 18227, TMEM144, 91150, 193600, 521-1558; 18227, TMEM144, 91162, 193612, 1797-2306; 18228, TMEM145, 91164, 193614, 1-237; 18228, TMEM145, 91165, 193615, 1-1467; 18228, TMEM145, 91163, 193613, 42-1523; 18229, TMEM147, 91168, 193618, 60-614; 18229, TMEM147, 91169, 193619, 242-337; 18229, TMEM147, 91166, 193616, 146-820; 18229, TMEM147, 91167, 193617, 329-856; 18230, TMEM14A, 91170, 193620, 154-453; 18231, TMEM14B, 91173, 193623, 166-273; 18231, TMEM14B, 91174, 193624, 168-275; 18231, TMEM14B, 91175, 193625, 122-427; 18231, TMEM14B, 91176, 193626, 122-529; 18231, TMEM14B, 91177, 193627, 1-144; 18231, TMEM14B, 91178, 193628, 126-233; 18231, TMEM14B, 91179, 193629, 168-275; 18231, TMEM14B, 91180, 193630, 1-178; 18231, TMEM14B, 91181, 193631, 116-223; 18231, TMEM14B, 91182, 193632, 96-449; 18231, TMEM14B, 91183, 193633, 110-271; 18231, TMEM14B, 91184, 193634, 96-551; 18231, TMEM14B, 91185, 193635, 124-435; 18231, TMEM14B, 91171, 193621, 116-358; 18231, TMEM14B, 91172, 193622, 168-512; 18232, TMEM14C, 91186, 193636, 312-650; 18232, TMEM14C, 91187, 193637, 386-724; 18233, TMEM14EP, 91188, 193638, 1-378; 18234, TMEM150A, 91192, 193642, 235-372; 18234, TMEM150A, 91193, 193643, 228-428; 18234, TMEM150A, 91194, 193644, 165-344; 18234, TMEM150A, 91195, 193645, 27-164; 18234, TMEM150A, 91189, 193639, 300-956; 18234, TMEM150A, 91190, 193640, 189-1004; 18234, TMEM150A, 91191, 193641, 469-1284; 18235, TMEM150B, 91197, 193647, 1-457; 18235, TMEM150B, 91198, 193648, 49-303; 18235, TMEM150B, 91199, 193649, 174-576; 18235, TMEM150B, 91200, 193650, 188-379; 18235, TMEM150B, 91201, 193651, 139-330; 18235, TMEM150B, 91196, 193646, 184-885; 18236, TMEM150C, 91203, 193653, 202-403; 18236, TMEM150C, 91205, 193655, 61-423; 18236, TMEM150C, 91202, 193652, 320-1069; 18236, TMEM150C, 91204, 193654, 206-955; 18237, TMEM151A, 91206, 193656, 145-1551; 18238, TMEM151B, 91207, 193657, 278-1978; 18238, TMEM151B, 91208, 193658, 1-669; 18239, TMEM154, 91210, 193660, 80-457; 18239, TMEM154, 91211, 193661, 1-486; 18239, TMEM154, 91209, 193659, 233-784; 18240, TMEM155, 91215, 193665, 362-573; 18240, TMEM155, 91212, 193662, 560-952; 18240, TMEM155, 91213, 193663, 431-823; 18240, TMEM155, 91214, 193664, 279-671; 18241, TMEM156, 91216, 193666, 412-949; 18241, TMEM156, 91217, 193667, 109-999; 18242, TMEM158, 91218, 193668, 252-1154; 18243, TMEM159, 91222, 193672, 185-457; 18243, TMEM159, 91223, 193673, 1-295; 18243, TMEM159, 91225, 193675, 167-305; 18243, TMEM159, 91226, 193676, 469-960; 18243, TMEM159, 91219, 193669, 469-954; 18243, TMEM159, 91220, 193670, 274-759; 18243, TMEM159, 91221, 193671, 157-714; 18243, TMEM159, 91224, 193674, 172-657; 18244, TMEM160, 91227, 193677, 17-583; 18245, TMEM161A, 91230, 193680, 26-148; 18245, TMEM161A, 91231, 193681, 1-582; 18245, TMEM161A, 91232, 193682, 20-1384; 18245, TMEM161A, 91233, 193683, 120-1065; 18245, TMEM161A, 91234, 193684, 106-540; 18245, TMEM161A, 91235, 193685, 35-1012; 18245, TMEM161A, 91236, 193686, 345-528; 18245, TMEM161A, 91228, 193678, 66-1505; 18245, TMEM161A, 91229, 193679, 39-1169; 18246, TMEM161B, 91238, 193688, 272-1702; 18246, TMEM161B, 91239, 193689, 504-1157; 18246, TMEM161B, 91240, 193690, 77-442; 18246, TMEM161B, 91242, 193692, 412-948; 18246, TMEM161B, 91243, 193693, 132-968; 18246, TMEM161B, 91244, 193694, 108-1616; 18246, TMEM161B, 91245, 193695, 97-558; 18246, TMEM161B, 91237, 193687, 126-1589; 18246, TMEM161B, 91241, 193691, 403-825; 18247, TMEM163, 91246, 193696, 66-935; 18248, TMEM164, 91247, 193697, 339-1115; 18248, TMEM164, 91248, 193698, 340-1233; 18248, TMEM164, 91249, 193699, 337-1230; 18248, TMEM164, 91250, 193700, 196-642; 18249, TMEM165, 91252, 193702, 228-458; 18249, TMEM165, 91253, 193703, 234-623; 18249, TMEM165, 91254, 193704, 1-476; 18249, TMEM165, 91255, 193705, 1-82; 18249, TMEM165, 91251, 193701, 234-1208; 18250, TMEM167A, 91256, 193706, 174-392; 18251, TMEM167B, 91257, 193707, 1071-1295; 18252, TMEM168, 91260, 193710, 1-777; 18252, TMEM168, 91261, 193711, 403-775; 18252, TMEM168, 91263, 193713, 234-570; 18252, TMEM168, 91258, 193708, 562-2655; 18252, TMEM168, 91259, 193709, 454-2547; 18252, TMEM168, 91262, 193712, 289-1230; 18253, TMEM169, 91266, 193716, 235-584; 18253, TMEM169, 91269, 193719, 274-578; 18253, TMEM169, 91264, 193714, 208-1101; 18253, TMEM169, 91265, 193715, 441-1334; 18253, TMEM169, 91267, 193717, 218-1111; 18253, TMEM169, 91268, 193718, 327-1220; 18254, TMEM17, 91270, 193720, 213-809; 18255, TMEM170A, 91274, 193724, 167-487; 18255, TMEM170A, 91275, 193725, 73-414; 18255, TMEM170A, 91276, 193726, 69-299; 18255, TMEM170A, 91277, 193727, 79-378; 18255, TMEM170A, 91271, 193721, 90-455; 18255, TMEM170A, 91272, 193722, 99-533; 18255, TMEM170A, 91273, 193723, 90-455; 18256, TMEM170B, 91278, 193728, 1-399; 18257,

TMEM171, 91279, 193729, 197-1168; 18257, TMEM171, 91280, 193730, 474-1448; 18258, TMEM173, 91282, 193732, 143-901; 18258, TMEM173, 91281, 193731, 335-1474; 18259, TMEM174, 91283, 193733, 50-781; 18260, TMEM175, 91285, 193735, 136-621; 18260, TMEM175, 91286, 193736, 118-1386; 18260, TMEM175, 91287, 193737, 127-345; 18260, TMEM175, 91288, 193738, 155-1006; 18260, TMEM175, 91289, 193739, 186-525; 18260, TMEM175, 91290, 193740, 147-683; 18260, TMEM175, 91291, 193741, 219-619; 18260, TMEM175, 91292, 193742, 149-784; 18260, TMEM175, 91294, 193744, 169-387; 18260, TMEM175, 91295, 193745, 111-344; 18260, TMEM175, 91284, 193734, 186-1700; 18260, TMEM175, 91293, 193743, 269-1435; 18260, TMEM175, 91296, 193746, 645-1811; 18261, TMEM176A, 91299, 193749, 1-534; 18261, TMEM176A, 91300, 193750, 116-469; 18261, TMEM176A, 91301, 193751, 37-567; 18261, TMEM176A, 91297, 193747, 302-1009; 18261, TMEM176A, 91298, 193748, 582-1289; 18262, TMEM176B, 91302, 193752, 73-885; 18262, TMEM176B, 91303, 193753, 164-976; 18262, TMEM176B, 91304, 193754, 76-777; 18262, TMEM176B, 91305, 193755, 374-1186; 18262, TMEM176B, 91306, 193756, 252-1064; 18262, TMEM176B, 91307, 193757, 207-1019; 18263, TMEM177, 91310, 193760, 97-423; 18263, TMEM177, 91312, 193762, 450-791; 18263, TMEM177, 91308, 193758, 130-1065; 18263, TMEM177, 91309, 193759, 82-1017; 18263, TMEM177, 91311, 193761, 474-1409; 18264, TMEM178A, 91313, 193763, 57-950; 18264, TMEM178A, 91314, 193764, 9-344; 18265, TMEM178B, 91316, 193766, 80-958; 18265, TMEM178B, 91315, 193765, 80-964; 18266, TMEM179, 91318, 193768, 19-588; 18266, TMEM179, 91320, 193770, 1-235; 18266, TMEM179, 91321, 193771, 332-880; 18266, TMEM179, 91322, 193772, 332-880; 18266, TMEM179, 91323, 193773, 19-586; 18266, TMEM179, 91324, 193774, 1-636; 18266, TMEM179, 91325, 193775, 1-636; 18266, TMEM179, 91327, 193777, 1-235; 18266, TMEM179, 91317, 193767, 907-1500; 18266, TMEM179, 91319, 193769, 243-944; 18266, TMEM179, 91326, 193776, 243-944; 18266, TMEM179, 91328, 193778, 907-1500; 18267, TMEM179B, 91330, 193780, 18-452; 18267, TMEM179B, 91331, 193781, 1-286; 18267, TMEM179B, 91329, 193779, 6-665; 18268, TMEM18, 91334, 193784, 66-497; 18268, TMEM18, 91335, 193785, 62-262; 18268, TMEM18, 91336, 193786, 15-194; 18268, TMEM18, 91332, 193782, 95-517; 18268, TMEM18, 91333, 193783, 388-771; 18269, TMEM180, 91338, 193788, 220-681; 18269, TMEM180, 91337, 193787, 238-1791; 18270, TMEM181, 91339, 193789, 12-1850; 18271, TMEM182, 91340, 193790, 186-746; 18271, TMEM182, 91342, 193792, 316-555; 18271, TMEM182, 91341, 193791, 263-664; 18271, TMEM182, 91343, 193793, 206-895; 18272, TMEM183A, 91344, 193794, 81-1211; 18273, TMEM184A, 91346, 193796, 125-866; 18273, TMEM184A, 91347, 193797, 71-571; 18273, TMEM184A, 91348, 193798, 165-640; 18273, TMEM184A, 91349, 193799, 48-574; 18273, TMEM184A, 91350, 193800, 161-579; 18273, TMEM184A, 91351, 193801, 161-553; 18273, TMEM184A, 91345, 193795, 318-1559; 18274, TMEM184B, 91354, 193804, 114-332; 18274, TMEM184B, 91355, 193805, 181-408; 18274, TMEM184B, 91356, 193806, 186-404; 18274, TMEM184B, 91357, 193807, 1-1045; 18274, TMEM184B, 91352, 193802, 225-1448; 18274, TMEM184B, 91353, 193803, 210-1433; 18275, TMEM184C, 91359, 193809, 1-219; 18275, TMEM184C, 91360, 193810, 572-1357; 18275, TMEM184C, 91358, 193808, 575-1891; 18276, TMEM185A, 91361, 193811, 119-640; 18276, TMEM185A, 91362, 193812, 1-671; 18276, TMEM185A, 91363, 193813, 103-283; 18276, TMEM185A, 91364, 193814, 141-380; 18276, TMEM185A, 91365, 193815, 1-181; 18276, TMEM185A, 91367, 193817, 19-537; 18276, TMEM185A, 91368, 193818, 140-277; 18276, TMEM185A, 91369, 193819, 333-1208; 18276, TMEM185A, 91366, 193816, 333-1385; 18277, TMEM185B, 91370, 193820, 433-1485; 18278, TMEM186, 91371, 193821, 35-676; 18279, TMEM187, 91373, 193823, 243-440; 18279, TMEM187, 91374, 193824, 232-330; 18279, TMEM187, 91372, 193822, 748-1533; 18280, TMEM189, 91377, 193827, 98-685; 18280, TMEM189, 91378, 193828, 4-279; 18280, TMEM189, 91379, 193829, 98-235; 18280, TMEM189, 91375, 193825, 98-901; 18280, TMEM189, 91376, 193826, 98-910; 18281, TMEM19, 91381, 193831, 1-457; 18281, TMEM19, 91382, 193832, 233-661; 18281, TMEM19, 91383, 193833, 229-739; 18281, TMEM19, 91385, 193835, 1-501; 18281, TMEM19, 91380, 193830, 595-1605; 18281, TMEM19, 91384, 193834, 186-1082; 18282, TMEM190, 91386, 193836, 19-552; 18283, TMEM191B, 91387, 193837, 1-366; 18283, TMEM191B, 91389, 193839, 1-354; 18283, TMEM191B, 91388, 193838, 180-1220; 18284, TMEM192, 91391, 193841, 536-789; 18284, TMEM192, 91390, 193840, 147-962; 18284, TMEM192, 91392, 193842, 184-987; 18285, TMEM196, 91394, 193844, 697-1236; 18285, TMEM196, 91396, 193846, 90-425; 18285, TMEM196, 91393, 193843, 698-1216; 18285, TMEM196, 91395, 193845, 90-359; 18285, TMEM196, 91397, 193847, 151-465; 18286, TMEM198, 91400, 193850, 377-1057; 18286, TMEM198, 91401, 193851, 38-505; 18286, TMEM198, 91398, 193848, 586-1668; 18286, TMEM198, 91399, 193849, 395-1477; 18287, TMEM199, 91403, 193853, 25-294; 18287, TMEM199, 91404, 193854, 30-407; 18287, TMEM199, 91405, 193855, 664-768; 18287, TMEM199, 91402, 193852, 91-717; 18288, TMEM2, 91406, 193856, 1-531; 18288, TMEM2, 91408, 193858, 1-537; 18288, TMEM2, 91410, 193860, 166-1296; 18288, TMEM2, 91411, 193861, 43-1785; 18288, TMEM2, 91412, 193862, 479-533; 18288, TMEM2, 91407, 193857, 541-4692; 18288, TMEM2, 91409, 193859, 43-4005; 18289, TMEM200A, 91413, 193863, 872-2347; 18289, TMEM200A, 91414, 193864, 2379-3854; 18289, TMEM200A, 91415, 193865, 280-1755; 18289, TMEM200A, 91416, 193866, 261-1736; 18290, TMEM200B, 91417, 193867, 101-1024; 18290, TMEM200B, 91418, 193868, 159-1082; 18291, TMEM200C, 91419, 193869, 42-1907; 18291, TMEM200C, 91420, 193870, 647-2512; 18292, TMEM201, 91423, 193873, 1-1657; 18292, TMEM201, 91424, 193874, 1-499; 18292, TMEM201, 91421, 193871, 10-2010; 18292, TMEM201, 91422, 193872, 10-1188; 18293, TMEM202, 91426, 193876, 19-204; 18293, TMEM202, 91427, 193877, 23-208; 18293, TMEM202, 91425, 193875, 55-876; 18294, TMEM203, 91428, 193878, 225-635; 18295, TMEM204, 91429, 193879, 452-1132; 18295, TMEM204, 91430, 193880, 704-1384; 18296, TMEM205, 91434, 193884, 308-628; 18296, TMEM205, 91437, 193887, 108-619; 18296, TMEM205, 91438, 193888, 204-563; 18296, TMEM205, 91440, 193890, 58-428; 18296, TMEM205, 91442, 193892, 168-554; 18296, TMEM205, 91443, 193893, 130-393; 18296, TMEM205, 91431, 193881, 428-997; 18296, TMEM205, 91432, 193882, 308-877; 18296, TMEM205, 91433, 193883, 83-652; 18296, TMEM205, 91435, 193885, 397-966; 18296, TMEM205, 91436, 193886, 183-752; 18296,

TMEM205, 91439, 193889, 241-810; 18296, TMEM205, 91441, 193891, 71-640; 18296, TMEM205, 91444, 193894, 184-753; 18297, TMEM206, 91445, 193895, 139-1191; 18297, TMEM206, 91446, 193896, 145-1380; 18298, TMEM207, 91447, 193897, 68-508; 18299, TMEM208, 91449, 193899, 52-474; 18299, TMEM208, 91451, 193901, 427-738; 18299, TMEM208, 91452, 193902, 7-117; 18299, TMEM208, 91448, 193898, 107-628; 18299, TMEM208, 91450, 193900, 63-365; 18300, TMEM209, 91455, 193905, 417-585; 18300, TMEM209, 91457, 193907, 3-571; 18300, TMEM209, 91453, 193903, 124-1809; 18300, TMEM209, 91454, 193904, 29-1588; 18300, TMEM209, 91456, 193906, 267-1949; 18301, TMEM210, 91458, 193908, 20-181; 18301, TMEM210, 91459, 193909, 383-826; 18302, TMEM211, 91460, 193910, 254-643; 18302, TMEM211, 91461, 193911, 1-603; 18303, TMEM212, 91463, 193913, 1-453; 18303, TMEM212, 91464, 193914, 1-568; 18303, TMEM212, 91462, 193912, 36-620; 18303, TMEM212, 91465, 193915, 1-585; 18304, TMEM213, 91466, 193916, 154-474; 18304, TMEM213, 91467, 193917, 154-477; 18304, TMEM213, 91468, 193918, 99-350; 18304, TMEM213, 91469, 193919, 94-411; 18305, TMEM214, 91473, 193923, 1-421; 18305, TMEM214, 91474, 193924, 1-919; 18305, TMEM214, 91475, 193925, 1-740; 18305, TMEM214, 91476, 193926, 1-678; 18305, TMEM214, 91470, 193920, 63-2132; 18305, TMEM214, 91471, 193921, 63-2132; 18305, TMEM214, 91472, 193922, 40-1974; 18306, TMEM215, 91477, 193927, 366-1073; 18307, TMEM216, 91479, 193929, 437-691; 18307, TMEM216, 91478, 193928, 273-719; 18307, TMEM216, 91480, 193930, 946-1383; 18308, TMEM217, 91481, 193931, 41-730; 18308, TMEM217, 91482, 193932, 68-703; 18309, TMEM218, 91484, 193934, 663-873; 18309, TMEM218, 91485, 193935, 270-407; 18309, TMEM218, 91486, 193936, 291-428; 18309, TMEM218, 91488, 193938, 699-910; 18309, TMEM218, 91491, 193941, 427-584; 18309, TMEM218, 91494, 193944, 157-582; 18309, TMEM218, 91483, 193933, 325-672; 18309, TMEM218, 91487, 193937, 381-728; 18309, TMEM218, 91489, 193939, 394-741; 18309, TMEM218, 91490, 193940, 198-545; 18309, TMEM218, 91492, 193942, 283-630; 18309, TMEM218, 91493, 193943, 345-692; 18309, TMEM218, 91495, 193945, 420-767; 18310, TMEM219, 91498, 193948, 1-299; 18310, TMEM219, 91501, 193951, 81-721; 18310, TMEM219, 91502, 193952, 1-695; 18310, TMEM219, 91503, 193953, 1-510; 18310, TMEM219, 91504, 193954, 141-588; 18310, TMEM219, 91496, 193946, 141-863; 18310, TMEM219, 91497, 193947, 168-890; 18310, TMEM219, 91499, 193949, 67-789; 18310, TMEM219, 91500, 193950, 468-1190; 18311, TMEM220, 91507, 193957, 1-260; 18311, TMEM220, 91508, 193958, 136-528; 18311, TMEM220, 91509, 193959, 1-353; 18311, TMEM220, 91505, 193955, 466-948; 18311, TMEM220, 91506, 193956, 173-625; 18312, TMEM221, 91510, 193960, 106-981; 18313, TMEM222, 91512, 193962, 13-477; 18313, TMEM222, 91513, 193963, 44-262; 18313, TMEM222, 91514, 193964, 17-460; 18313, TMEM222, 91515, 193965, 1-600; 18313, TMEM222, 91516, 193966, 51-269; 18313, TMEM222, 91517, 193967, 44-286; 18313, TMEM222, 91518, 193968, 50-577; 18313, TMEM222, 91511, 193961, 39-665; 18313, TMEM222, 91519, 193969, 54-680; 18314, TMEM223, 91521, 193971, 1-412; 18314, TMEM223, 91522, 193972, 4-324; 18314, TMEM223, 91520, 193970, 28-636; 18315, TMEM225, 91524, 193974, 209-659; 18315, TMEM225, 91523, 193973, 218-895; 18316, TMEM229A, 91525, 193975, 21-1163; 18317, TMEM229B, 91527, 193977, 417-655; 18317, TMEM229B, 91529, 193979, 536-701; 18317, TMEM229B, 91530, 193980, 354-523; 18317, TMEM229B, 91532, 193982, 296-699; 18317, TMEM229B, 91526, 193976, 411-914; 18317, TMEM229B, 91528, 193978, 284-787; 18317, TMEM229B, 91531, 193981, 233-736; 18318, TMEM230, 91535, 193985, 85-306; 18318, TMEM230, 91541, 193991, 182-565; 18318, TMEM230, 91542, 193992, 143-526; 18318, TMEM230, 91533, 193983, 159-521; 18318, TMEM230, 91534, 193984, 60-611; 18318, TMEM230, 91536, 193986, 223-585; 18318, TMEM230, 91537, 193987, 323-685; 18318, TMEM230, 91538, 193988, 347-709; 18318, TMEM230, 91539, 193989, 422-784; 18318, TMEM230, 91540, 193990, 329-691; 18319, TMEM231, 91544, 193994, 60-380; 18319, TMEM231, 91545, 193995, 25-606; 18319, TMEM231, 91546, 193996, 32-838; 18319, TMEM231, 91548, 193998, 1-164; 18319, TMEM231, 91543, 193993, 78-1028; 18319, TMEM231, 91547, 193997, 40-1077; 18320, TMEM232, 91550, 194000, 533-1024; 18320, TMEM232, 91551, 194001, 80-822; 18320, TMEM232, 91552, 194002, 225-582; 18320, TMEM232, 91553, 194003, 58-237; 18320, TMEM232, 91549, 193999, 52-2025; 18321, TMEM233, 91554, 194004, 391-720; 18322, TMEM234, 91558, 194008, 38-241; 18322, TMEM234, 91555, 194005, 4-426; 18322, TMEM234, 91556, 194006, 17-511; 18322, TMEM234, 91557, 194007, 22-564; 18322, TMEM234, 91559, 194009, 26-520; 18322, TMEM234, 91560, 194010, 14-508; 18322, TMEM234, 91561, 194011, 12-302; 18322, TMEM234, 91562, 194012, 27-521; 18323, TMEM235, 91567, 194017, 1-766; 18323, TMEM235, 91563, 194013, 625-1215; 18323, TMEM235, 91564, 194014, 625-1296; 18323, TMEM235, 91565, 194015, 122-793; 18323, TMEM235, 91566, 194016, 1-591; 18323, TMEM235, 91568, 194018, 625-1077; 18324, TMEM236, 91569, 194019, 45-1100; 18325, TMEM237, 91570, 194020, 159-515; 18325, TMEM237, 91573, 194023, 3-293; 18325, TMEM237, 91574, 194024, 171-461; 18325, TMEM237, 91575, 194025, 67-1269; 18325, TMEM237, 91571, 194021, 118-1344; 18325, TMEM237, 91572, 194022, 319-1521; 18326, TMEM238, 91576, 194026, 340-870; 18327, TMEM239, 91577, 194027, 34-621; 18327, TMEM239, 91578, 194028, 95-553; 18328, TMEM240, 91581, 194031, 5-172; 18328, TMEM240, 91579, 194029, 12-533; 18328, TMEM240, 91580, 194030, 44-565; 18329, TMEM241, 91584, 194034, 81-311; 18329, TMEM241, 91585, 194035, 95-247; 18329, TMEM241, 91586, 194036, 88-348; 18329, TMEM241, 91588, 194038, 18-467; 18329, TMEM241, 91589, 194039, 81-311; 18329, TMEM241, 91590, 194040, 81-311; 18329, TMEM241, 91591, 194041, 62-625; 18329, TMEM241, 91592, 194042, 1-309; 18329, TMEM241, 91593, 194043, 104-692; 18329, TMEM241, 91582, 194032, 54-944; 18329, TMEM241, 91583, 194033, 110-589; 18329, TMEM241, 91587, 194037, 108-479; 18330, TMEM242, 91594, 194044, 103-489; 18330, TMEM242, 91595, 194045, 103-528; 18331, TMEM243, 91598, 194048, 530-544; 18331, TMEM243, 91599, 194049, 128-487; 18331, TMEM243, 91596, 194046, 231-587; 18331, TMEM243, 91597, 194047, 443-799; 18332, TMEM244, 91600, 194050, 84-470; 18332, TMEM244, 91601, 194051, 182-565; 18333, TMEM245, 91603, 194053, 1-1417; 18333, TMEM245, 91604, 194054, 90-851; 18333, TMEM245, 91602, 194052, 33-2672; 18334, TMEM246, 91605, 194055, 302-1513; 18334, TMEM246, 91606, 194056, 323-1534; 18334, TMEM246, 91607, 194057, 1149-2360; 18335, TMEM247, 91608, 194058, 22-680; 18336, TMEM248, 91610, 194060, 119-536; 18336, TMEM248, 91612, 194062, 422-637; 18336, TMEM248, 91613, 194063, 264-545; 18336, TMEM248, 91614, 194064, 347-690; 18336, TMEM248, 91609, 194059, 256-1200; 18336, TMEM248, 91611, 194061, 219-830; 18337, TMEM249, 91616, 194066, 79-725; 18337, TMEM249, 91615, 194065, 148-855; 18338, TMEM25, 91623, 194073, 1-601; 18338, TMEM25, 91625, 194075, 61-1206; 18338, TMEM25, 91626, 194076, 71-220; 18338, TMEM25, 91627, 194077, 71-573; 18338, TMEM25, 91628, 194078, 68-181; 18338, TMEM25, 91629, 194079, 1-583; 18338, TMEM25, 91630, 194080, 61-565; 18338, TMEM25, 91631, 194081, 61-570; 18338, TMEM25, 91632, 194082, 445-565; 18338, TMEM25, 91633, 194083, 134-548; 18338, TMEM25, 91617, 194067, 61-717; 18338, TMEM25, 91618, 194068, 54-1154; 18338, TMEM25, 91619, 194069, 64-1119; 18338, TMEM25, 91620, 194070, 175-1143; 18338, TMEM25, 91621, 194071, 219-1187; 18338, TMEM25, 91622, 194072, 175-1095; 18338, TMEM25, 91624, 194074, 413-1381; 18339, TMEM251, 91634, 194084, 99-494; 18339, TMEM251, 91635, 194085, 376-885; 18339, TMEM251, 91636, 194086, 376-885; 18339, TMEM251, 91637, 194087, 99-494; 18340, TMEM252, 91638, 194088, 54-566; 18341, TMEM253, 91640, 194090, 406-786; 18341, TMEM253, 91639, 194089, 119-772; 18341, TMEM253, 91641, 194091, 407-1060; 18342, TMEM254, 91642, 194092, 1-434; 18342, TMEM254, 91647, 194097, 1-304; 18342, TMEM254, 91648, 194098, 55-360; 18342, TMEM254, 91643, 194093, 9-320; 18342, TMEM254, 91644, 194094, 19-273; 18342, TMEM254, 91645, 194095, 55-366; 18342, TMEM254, 91646, 194096, 31-402; 18343, TMEM255A, 91653, 194103, 248-695; 18343, TMEM255A, 91649, 194099, 125-1174; 18343, TMEM255A, 91650, 194100, 103-660; 18343, TMEM255A, 91651, 194101, 228-1205; 18343, TMEM255A, 91652, 194102, 228-953; 18344, TMEM255B, 91655, 194105, 31-531; 18344, TMEM255B, 91656, 194106, 28-73; 18344, TMEM255B, 91657, 194107, 31-76; 18344, TMEM255B, 91654, 194104, 28-1008; 18345, TMEM256, 91659, 194109, 1-81; 18345, TMEM256, 91658, 194108, 54-395; 18346, TMEM257, 91660, 194110, 269-604; 18347, TMEM258, 91662, 194112, 59-208; 18347, TMEM258, 91663, 194113, 23-172; 18347, TMEM258, 91665, 194115, 1353-1577; 18347, TMEM258, 91666, 194116, 37-186; 18347, TMEM258, 91661, 194111, 44-283; 18347, TMEM258, 91664, 194114, 53-292; 18348, TMEM259, 91669, 194119, 1-626; 18348, TMEM259, 91670, 194120, 8-1273; 18348, TMEM259, 91671, 194121, 1-616; 18348, TMEM259, 91672, 194122, 1-418; 18348, TMEM259, 91667, 194117, 120-1346; 18348, TMEM259, 91668, 194118, 184-2046; 18349, TMEM26, 91673, 194123, 1-510; 18349, TMEM26, 91674, 194124, 370-1476; 18349, TMEM26, 91675, 194125, 158-1264; 18349, TMEM26, 91676, 194126, 87-758; 18350, TMEM260, 91678, 194128, 32-1261; 18350, TMEM260, 91679, 194129, 75-1049; 18350, TMEM260, 91680, 194130, 363-1124; 18350, TMEM260, 91681, 194131, 440-662; 18350, TMEM260, 91682, 194132, 1-125; 18350, TMEM260, 91683, 194133, 90-437; 18350, TMEM260, 91684, 194134, 1-304; 18350, TMEM260, 91685, 194135, 1-62; 18350, TMEM260, 91677, 194127, 123-2246; 18351, TMEM261, 91686, 194136, 334-672; 18352, TMEM262, 91688, 194138, 118-436; 18352, TMEM262, 91689, 194139, 1-339; 18352, TMEM262, 91690, 194140, 61-391; 18352, TMEM262, 91687, 194137, 61-411; 18353, TMEM263, 91696, 194146, 297-467; 18353, TMEM263, 91691, 194141, 419-769; 18353, TMEM263, 91692, 194142, 411-761; 18353, TMEM263, 91693, 194143, 390-740; 18353, TMEM263, 91694, 194144, 372-722; 18353, TMEM263, 91695, 194145, 354-704; 18353, TMEM263, 91697, 194147, 183-533; 18354, TMEM265, 91698, 194148, 331-657; 18355, TMEM266, 91700, 194150, 156-461; 18355, TMEM266, 91701, 194151, 129-494; 18355, TMEM266, 91699, 194149, 277-1872; 18356, TMEM27, 91702, 194152, 257-925; 18357, TMEM30A, 91705, 194155, 213-445; 18357, TMEM30A, 91703, 194153, 331-1416; 18357, TMEM30A, 91704, 194154, 558-1286; 18357, TMEM30A, 91706, 194156, 311-1288; 18358, TMEM30B, 91707, 194157, 694-1749; 18359, TMEM30C, 91708, 194158, 1-205; 18360, TMEM31, 91709, 194159, 192-698; 18361, TMEM33, 91710, 194160, 357-563; 18361, TMEM33, 91711, 194161, 1-467; 18361, TMEM33, 91713, 194163, 42-248; 18361, TMEM33, 91714, 194164, 201-867; 18361, TMEM33, 91712, 194162, 366-1109; 18361, TMEM33, 91715, 194165, 153-896; 18361, TMEM33, 91716, 194166, 334-1077; 18362, TMEM35, 91717, 194167, 284-787; 18363, TMEM37, 91719, 194169, 27-635; 18363, TMEM37, 91720, 194170, 323-522; 18363, TMEM37, 91718, 194168, 36-608; 18364, TMEM38A, 91722, 194172, 1-347; 18364, TMEM38A, 91721, 194171, 92-991; 18365, TMEM38B, 91723, 194173, 711-1424; 18365, TMEM38B, 91725, 194175, 396-502; 18365, TMEM38B, 91726, 194176, 1-488; 18365, TMEM38B, 91727, 194177, 1-244; 18365, TMEM38B, 91724, 194174, 118-993; 18366, TMEM39A, 91730, 194180, 351-491; 18366, TMEM39A, 91731, 194181, 361-935; 18366, TMEM39A, 91732, 194182, 253-588; 18366, TMEM39A, 91733, 194183, 171-590; 18366, TMEM39A, 91734, 194184, 356-852; 18366, TMEM39A, 91735, 194185, 1-57; 18366, TMEM39A, 91728, 194178, 422-1888; 18366, TMEM39A, 91729, 194179, 337-777; 18367, TMEM39B, 91737, 194187, 106-687; 18367, TMEM39B, 91738, 194188, 114-690; 18367, TMEM39B, 91736, 194186, 147-1625; 18368, TMEM40, 91741, 194191, 1-294; 18368, TMEM40, 91739, 194189, 216-917; 18368, TMEM40, 91740, 194190, 358-1059; 18368, TMEM40, 91742, 194192, 96-569; 18368, TMEM40, 91743, 194193, 78-689; 18369, TMEM41A, 91744, 194194, 27-305; 18369, TMEM41A, 91745, 194195, 75-374; 18369, TMEM41A, 91746, 194196, 97-891; 18370, TMEM41B, 91750, 194200, 190-780; 18370, TMEM41B, 91747, 194197, 127-1002; 18370, TMEM41B, 91748, 194198, 196-774; 18370, TMEM41B, 91749, 194199, 340-1215; 18370, TMEM41B, 91751, 194201, 193-576; 18370, TMEM41B, 91752, 194202, 127-1002; 18371, TMEM42, 91754, 194204, 57-536; 18371, TMEM42, 91753, 194203, 57-536; 18372, TMEM43, 91756, 194206, 180-380; 18372, TMEM43, 91755, 194205, 255-1457; 18373, TMEM44, 91757, 194207, 300-641; 18373, TMEM44, 91761, 194211, 135-500; 18373, TMEM44, 91762, 194212, 1-360; 18373, TMEM44, 91763, 194213, 1-594; 18373, TMEM44, 91764, 194214, 255-707; 18373, TMEM44, 91765, 194215, 1-786; 18373, TMEM44, 91758, 194208, 111-1397; 18373, TMEM44, 91759, 194209, 67-1257; 18373, TMEM44, 91760, 194210, 207-1634; 18373, TMEM44, 91766, 194216, 111-1427; 18374, TMEM45A, 91768, 194218, 621-1496; 18374, TMEM45A, 91769, 194219, 301-874; 18374, TMEM45A, 91767, 194217, 314-1141; 18375, TMEM45B, 91770, 194220, 89-916; 18375, TMEM45B, 91771, 194221, 282-1109; 18376, TMEM47, 91772, 194222, 260-805; 18377, TMEM5, 91774, 194224, 949-1500; 18377, TMEM5, 91775, 194225, 96-458; 18377, TMEM5, 91773, 194223, 159-1490; 18378, TMEM50A, 91776, 194226, 554-1027; 18379, TMEM50B, 91777, 194227, 376-619; 18379,

TMEM50B, 91779, 194229, 42-176; 18379, TMEM50B, 91780, 194230, 141-596; 18379, TMEM50B, 91783, 194233, 376-619; 18379, TMEM50B, 91785, 194235, 141-596; 18379, TMEM50B, 91786, 194236, 42-176; 18379, TMEM50B, 91778, 194228, 148-624; 18379, TMEM50B, 91781, 194231, 216-692; 18379, TMEM50B, 91782, 194232, 148-624; 18379, TMEM50B, 91784, 194234, 216-692; 18380, TMEM51, 91791, 194241, 454-861; 18380, TMEM51, 91792, 194242, 402-766; 18380, TMEM51, 91787, 194237, 433-1194; 18380, TMEM51, 91788, 194238, 486-1247; 18380, TMEM51, 91789, 194239, 416-1177; 18380, TMEM51, 91790, 194240, 447-1208; 18381, TMEM52, 91794, 194244, 1-375; 18381, TMEM52, 91796, 194246, 5-313; 18381, TMEM52, 91797, 194247, 6-137; 18381, TMEM52, 91793, 194243, 9-638; 18381, TMEM52, 91795, 194245, 242-826; 18382, TMEM52B, 91800, 194250, 273-542; 18382, TMEM52B, 91798, 194248, 579-1070; 18382, TMEM52B, 91799, 194249, 405-956; 18383, TMEM53, 91801, 194251, 53-796; 18383, TMEM53, 91803, 194253, 69-674; 18383, TMEM53, 91804, 194254, 72-407; 18383, TMEM53, 91805, 194255, 87-323; 18383, TMEM53, 91806, 194256, 12-415; 18383, TMEM53, 91802, 194252, 165-998; 18384, TMEM54, 91807, 194257, 152-661; 18384, TMEM54, 91808, 194258, 121-789; 18385, TMEM55A, 91810, 194260, 87-838; 18385, TMEM55A, 91811, 194261, 124-294; 18385, TMEM55A, 91812, 194262, 63-563; 18385, TMEM55A, 91813, 194263, 103-276; 18385, TMEM55A, 91814, 194264, 1-171; 18385, TMEM55A, 91809, 194259, 316-1089; 18386, TMEM55B, 91817, 194267, 1-337; 18386, TMEM55B, 91818, 194268, 147-277; 18386, TMEM55B, 91815, 194265, 288-1121; 18386, TMEM55B, 91816, 194266, 141-995; 18387, TMEM56, 91820, 194270, 531-992; 18387, TMEM56, 91821, 194271, 181-609; 18387, TMEM56, 91819, 194269, 292-1083; 18388, TMEM57, 91822, 194272, 180-2174; 18388, TMEM57, 91823, 194273, 242-1555; 18389, TMEM59, 91825, 194275, 5-442; 18389, TMEM59, 91826, 194276, 354-932; 18389, TMEM59, 91827, 194277, 1421-1999; 18389, TMEM59, 91828, 194278, 846-1424; 18389, TMEM59, 91829, 194279, 218-1074; 18389, TMEM59, 91830, 194280, 185-618; 18389, TMEM59, 91831, 194281, 295-728; 18389, TMEM59, 91824, 194274, 251-1222; 18390, TMEM59L, 91834, 194284, 1-403; 18390, TMEM59L, 91832, 194282, 88-1116; 18390, TMEM59L, 91833, 194283, 186-1214; 18391, TMEM60, 91835, 194285, 378-779; 18392, TMEM61, 91836, 194286, 275-907; 18393, TMEM62, 91838, 194288, 358-480; 18393, TMEM62, 91839, 194289, 85-273; 18393, TMEM62, 91840, 194290, 183-571; 18393, TMEM62, 91841, 194291, 1-150; 18393, TMEM62, 91842, 194292, 1-66; 18393, TMEM62, 91843, 194293, 452-566; 18393, TMEM62, 91844, 194294, 1-149; 18393, TMEM62, 91845, 194295, 1-1622; 18393, TMEM62, 91837, 194287, 280-2211; 18394, TMEM63A, 91847, 194297, 100-454; 18394, TMEM63A, 91848, 194298, 638-886; 18394, TMEM63A, 91846, 194296, 272-2695; 18395, TMEM63B, 91851, 194301, 1-2285; 18395, TMEM63B, 91852, 194302, 1-1561; 18395, TMEM63B, 91853, 194303, 1-83; 18395, TMEM63B, 91854, 194304, 150-828; 18395, TMEM63B, 91849, 194299, 184-2682; 18395, TMEM63B, 91850, 194300, 65-2563; 18396, TMEM63C, 91856, 194306, 512-582; 18396, TMEM63C, 91857, 194307, 308-457; 18396, TMEM63C, 91858, 194308, 362-515; 18396, TMEM63C, 91859, 194309, 419-527; 18396, TMEM63C, 91860, 194310, 512-1004; 18396, TMEM63C, 91855, 194305, 145-2565; 18397, TMEM64, 91861, 194311, 1-594; 18397, TMEM64, 91865, 194315, 434-587; 18397, TMEM64, 91862, 194312, 1-987; 18397, TMEM64, 91863, 194313, 179-1321; 18397, TMEM64, 91864, 194314, 514-873; 18398, TMEM65, 91866, 194316, 536-1258; 18399, TMEM67, 91867, 194317, 19-2976; 18399, TMEM67, 91869, 194319, 271-1461; 18399, TMEM67, 91871, 194321, 21-561; 18399, TMEM67, 91872, 194322, 7-450; 18399, TMEM67, 91873, 194323, 1-262; 18399, TMEM67, 91874, 194324, 1-715; 18399, TMEM67, 91875, 194325, 10-369; 18399, TMEM67, 91876, 194326, 463-480; 18399, TMEM67, 91877, 194327, 456-571; 18399, TMEM67, 91878, 194328, 1-518; 18399, TMEM67, 91868, 194318, 203-2947; 18399, TMEM67, 91870, 194320, 59-3046; 18400, TMEM68, 91881, 194331, 505-510; 18400, TMEM68, 91882, 194332, 1-326; 18400, TMEM68, 91883, 194333, 1-204; 18400, TMEM68, 91884, 194334, 147-578; 18400, TMEM68, 91885, 194335, 84-518; 18400, TMEM68, 91886, 194336, 219-710; 18400, TMEM68, 91888, 194338, 162-707; 18400, TMEM68, 91889, 194339, 261-639; 18400, TMEM68, 91890, 194340, 270-1000; 18400, TMEM68, 91891, 194341, 50-481; 18400, TMEM68, 91892, 194342, 1-405; 18400, TMEM68, 91895, 194345, 2871-3146; 18400, TMEM68, 91879, 194329, 254-1027; 18400, TMEM68, 91880, 194330, 201-1175; 18400, TMEM68, 91887, 194337, 214-621; 18400, TMEM68, 91893, 194343, 267-674; 18400, TMEM68, 91894, 194344, 115-1089; 18401, TMEM69, 91896, 194346, 1158-1901; 18402, TMEM70, 91898, 194348, 88-423; 18402, TMEM70, 91897, 194347, 74-856; 18402, TMEM70, 91899, 194349, 76-399; 18403, TMEM71, 91902, 194352, 123-1064; 18403, TMEM71, 91903, 194353, 422-545; 18403, TMEM71, 91904, 194354, 1-302; 18403, TMEM71, 91905, 194355, 260-556; 18403, TMEM71, 91906, 194356, 222-496; 18403, TMEM71, 91907, 194357, 407-596; 18403, TMEM71, 91900, 194350, 144-974; 18403, TMEM71, 91901, 194351, 144-842; 18404, TMEM72, 91908, 194358, 314-1141; 18404, TMEM72, 91909, 194359, 485-958; 18405, TMEM74, 91910, 194360, 180-1097; 18406, TMEM74B, 91912, 194362, 522-983; 18406, TMEM74B, 91911, 194361, 673-1443; 18407, TMEM78, 91913, 194363, 60-470; 18408, TMEM79, 91915, 194365, 157-684; 18408, TMEM79, 91917, 194367, 129-524; 18408, TMEM79, 91914, 194364, 162-1346; 18408, TMEM79, 91916, 194366, 172-1356; 18409, TMEM80, 91918, 194368, 182-832; 18409, TMEM80, 91920, 194370, 1-665; 18409, TMEM80, 91921, 194371, 1-287; 18409, TMEM80, 91922, 194372, 19-408; 18409, TMEM80, 91919, 194369, 111-593; 18410, TMEM81, 91923, 194373, 141-908; 18411, TMEM82, 91924, 194374, 139-1170; 18412, TMEM86A, 91925, 194375, 97-819; 18413, TMEM86B, 91926, 194376, 524-1204; 18414, TMEM87A, 91930, 194380, 465-581; 18414, TMEM87A, 91931, 194381, 396-905; 18414, TMEM87A, 91932, 194382, 536-867; 18414, TMEM87A, 91933, 194383, 35-208; 18414, TMEM87A, 91934, 194384, 470-592; 18414, TMEM87A, 91935, 194385, 1-583; 18414, TMEM87A, 91936, 194386, 266-528; 18414, TMEM87A, 91927, 194377, 39-584; 18414, TMEM87A, 91928, 194378, 266-1933; 18414, TMEM87A, 91929, 194379, 309-1793; 18415, TMEM87B, 91938, 194388, 1-552; 18415, TMEM87B, 91939, 194389, 1-337; 18415, TMEM87B, 91937, 194387, 370-2037; 18416, TMEM88, 91941, 194391, 10-390; 18416, TMEM88, 91940, 194390, 11-490; 18417, TMEM88B, 91942, 194392, 1-492; 18418, TMEM89, 91943, 194393, 100-579; 18419, TMEM8A, 91944, 194394, 487-2223; 18419, TMEM8A, 91945, 194395, 1-719; 18419, TMEM8A, 91947, 194397, 1-732; 18419, TMEM8A, 91948, 194398, 525-587; 18419, TMEM8A, 91946, 194396, 162-2477; 18420, TMEM8B, 91949, 194399, 1307-2725; 18420, TMEM8B, 91950, 194400, 1016-2434; 18420, TMEM8B, 91951, 194401, 1416-2432; 18420, TMEM8B, 91952, 194402, 1092-2108; 18421, TMEM8C, 91953, 194403, 103-768; 18422, TMEM9, 91955, 194405, 94-654; 18422, TMEM9, 91958, 194408, 94-507; 18422, TMEM9, 91959, 194409, 57-545; 18422, TMEM9, 91960, 194410, 35-487; 18422, TMEM9, 91961, 194411, 516-812; 18422, TMEM9, 91954, 194404, 518-1069; 18422, TMEM9, 91956, 194406, 122-673; 18422, TMEM9, 91957, 194407, 87-638; 18422, TMEM9, 91962, 194412, 323-874; 18423, TMEM91, 91963, 194413, 87-454; 18423, TMEM91, 91970, 194420, 108-450; 18423, TMEM91, 91971, 194421, 112-510; 18423, TMEM91, 91972, 194422, 1-192; 18423, TMEM91, 91973, 194423, 1-262; 18423, TMEM91, 91974, 194424, 322-720; 18423, TMEM91, 91975, 194425, 1-181; 18423, TMEM91, 91976, 194426, 6-578; 18423, TMEM91, 91964, 194414, 62-481; 18423, TMEM91, 91965, 194415, 661-1179; 18423, TMEM91, 91966, 194416, 152-535; 18423, TMEM91, 91967, 194417, 307-678; 18423, TMEM91, 91968, 194418, 70-471; 18423, TMEM91, 91969, 194419, 145-546; 18424, TMEM92, 91977, 194427, 111-590; 18424, TMEM92, 91978, 194428, 76-555; 18425, TMEM94, 91980, 194430, 193-4293; 18425, TMEM94, 91981, 194431, 1-384; 18425, TMEM94, 91982, 194432, 393-564; 18425, TMEM94, 91983, 194433, 1-489; 18425, TMEM94, 91984, 194434, 460-565; 18425, TMEM94, 91985, 194435, 1-528; 18425, TMEM94, 91986, 194436, 1-905; 18425, TMEM94, 91987, 194437, 171-545; 18425, TMEM94, 91988, 194438, 209-3232; 18425, TMEM94, 91989, 194439, 257-522; 18425, TMEM94, 91990, 194440, 1-220; 18425, TMEM94, 91991, 194441, 1-888; 18425, TMEM94, 91992, 194442, 192-554; 18425, TMEM94, 91993, 194443, 1-169; 18425, TMEM94, 91994, 194444, 1-769; 18425, TMEM94, 91979, 194429, 395-4465; 18426, TMEM95, 91995, 194445, 28-582; 18426, TMEM95, 91996, 194446, 83-694; 18426, TMEM95, 91997, 194447, 28-558; 18427, TMEM97, 91999, 194449, 35-313; 18427, TMEM97, 92000, 194450, 1-357; 18427, TMEM97, 92001, 194451, 287-496; 18427, TMEM97, 92002, 194452, 474-683; 18427, TMEM97, 91998, 194448, 146-676; 18428, TMEM98, 92003, 194453, 222-826; 18428, TMEM98, 92005, 194455, 396-808; 18428, TMEM98, 92006, 194456, 231-896; 18428, TMEM98, 92008, 194458, 496-776; 18428, TMEM98, 92009, 194459, 165-581; 18428, TMEM98, 92004, 194454, 383-1063; 18428, TMEM98, 92007, 194457, 432-1112; 18429, TMEM99, 92010, 194460, 305-1081; 18429, TMEM99, 92011, 194461, 286-854; 18429, TMEM99, 92012, 194462, 316-1092; 18430, TMEFF1, 92013, 194463, 433-1575; 18431, TMEFF2, 92014, 194464, 1186-2310; 18431, TMEFF2, 92015, 194465, 393-1433; 18431, TMEFF2, 92016, 194466, 1-528; 18432, TMPPE, 92017, 194467, 192-1553; 18432, TMPPE, 92018, 194468, 88-1038; 18433, TPRA1, 92023, 194473, 231-841; 18433, TPRA1, 92025, 194475, 312-989; 18433, TPRA1, 92026, 194476, 589-713; 18433, TPRA1, 92027, 194477, 399-1007; 18433, TPRA1, 92028, 194478, 269-767; 18433, TPRA1, 92019, 194469, 316-1197; 18433, TPRA1, 92020, 194470, 378-1499; 18433, TPRA1, 92021, 194471, 343-1062; 18433, TPRA1, 92022, 194472, 292-1413; 18433, TPRA1, 92024, 194474, 407-1528; 18434, TANGO2, 92031, 194481, 203-655; 18434, TANGO2, 92034, 194484, 218-823; 18434, TANGO2, 92036, 194486, 41-370; 18434, TANGO2, 92037, 194487, 106-429; 18434, TANGO2, 92039, 194489, 180-545; 18434, TANGO2, 92040, 194490, 160-489; 18434, TANGO2, 92042, 194492, 184-862; 18434, TANGO2, 92043, 194493, 321-585; 18434, TANGO2, 92044, 194494, 73-568; 18434, TANGO2, 92029, 194479, 179-1009; 18434, TANGO2, 92030, 194480, 103-747; 18434, TANGO2, 92032, 194482, 265-1218; 18434, TANGO2, 92033, 194483, 219-863; 18434, TANGO2, 92035, 194485, 223-819; 18434, TANGO2, 92038, 194488, 285-821; 18434, TANGO2, 92041, 194491, 223-1176; 18435, TANGO6, 92046, 194496, 1-112; 18435, TANGO6, 92047, 194497, 1-83; 18435, TANGO6, 92045, 194495, 13-3297; 18436, TAP1, 92053, 194503, 163-2589; 18436, TAP1, 92048, 194498, 163-2589; 18436, TAP1, 92049, 194499, 163-2589; 18436, TAP1, 92050, 194500, 163-2589; 18436, TAP1, 92051, 194501, 163-2589; 18436, TAP1, 92052, 194502, 163-2589; 18436, TAP1, 92054, 194504, 163-2589; 18436, TAP1, 92055, 194505, 163-2589; 18437, TAP2, 92065, 194515, 133-2244; 18437, TAP2, 92069, 194519, 133-2244; 18437, TAP2, 92070, 194520, 80-2041; 18437, TAP2, 92071, 194521, 133-2244; 18437, TAP2, 92072, 194522, 123-2231; 18437, TAP2, 92073, 194523, 123-2231; 18437, TAP2, 92074, 194524, 123-2231; 18437, TAP2, 92075, 194525, 123-2231; 18437, TAP2, 92076, 194526, 123-2231; 18437, TAP2, 92056, 194506, 133-2193; 18437, TAP2, 92057, 194507, 80-2041; 18437, TAP2, 92058, 194508, 133-2193; 18437, TAP2, 92059, 194509, 80-2041; 18437, TAP2, 92060, 194510, 133-2193; 18437, TAP2, 92061, 194511, 80-2041; 18437, TAP2, 92062, 194512, 80-2041; 18437, TAP2, 92063, 194513, 133-2193; 18437, TAP2, 92064, 194514, 80-2041; 18437, TAP2, 92066, 194516, 133-2193; 18437, TAP2, 92067, 194517, 80-2041; 18437, TAP2, 92068, 194518, 80-2041; 18438, TNPO1, 92080, 194530, 90-500; 18438, TNPO1, 92081, 194531, 1-582; 18438, TNPO1, 92077, 194527, 427-3123; 18438, TNPO1, 92078, 194528, 78-2750; 18438, TNPO1, 92079, 194529, 67-2613; 18439, TNPO2, 92086, 194536, 1-358; 18439, TNPO2, 92087, 194537, 379-547; 18439, TNPO2, 92088, 194538, 168-497; 18439, TNPO2, 92089, 194539, 286-541; 18439, TNPO2, 92090, 194540, 63-2362; 18439, TNPO2, 92092, 194542, 75-404; 18439, TNPO2, 92093, 194543, 1-354; 18439, TNPO2, 92094, 194544, 1-156; 18439, TNPO2, 92082, 194532, 236-2899; 18439, TNPO2, 92083, 194533, 739-3402; 18439, TNPO2, 92084, 194534, 359-3052; 18439, TNPO2, 92085, 194535, 374-3037; 18439, TNPO2, 92091, 194541, 110-2803; 18440, TNPO3, 92096, 194546, 114-2987; 18440, TNPO3, 92098, 194548, 683-3256; 18440, TNPO3, 92099, 194549, 404-3277; 18440, TNPO3, 92095, 194545, 145-2916; 18440, TNPO3, 92097, 194547, 375-2954; 18441, TTR, 92101, 194551, 137-694; 18441, TTR, 92102, 194552, 137-556; 18441, TTR, 92100, 194550, 178-621; 18442, TCOF1, 92106, 194556, 29-4272; 18442, TCOF1, 92110, 194560, 1-203; 18442, TCOF1, 92111, 194561, 1-567; 18442, TCOF1, 92112, 194562, 1-445; 18442, TCOF1, 92113, 194563, 1-4467; 18442, TCOF1, 92103, 194553, 76-4311; 18442, TCOF1, 92104, 194554, 109-4575; 18442, TCOF1, 92105, 194555, 30-2906; 18442, TCOF1, 92107, 194557, 34-4389; 18442, TCOF1, 92108, 194558, 82-4320; 18442, TCOF1, 92109, 194559, 1-4467; 18443, TFF1, 92114, 194564, 100-354; 18444, TFF2, 92115, 194565, 172-561; 18445, TFF3, 92116, 194566, 1-225; 18445, TFF3, 92117, 194567, 1-376; 18445, TFF3, 92118, 194568, 236-520; 18446, TREH, 92121, 194571, 24-137; 18446, TREH, 92119, 194569, 47-1798; 18446, TREH, 92120, 194570, 40-1698; 18447, TRDN, 92123, 194573, 1-455; 18447, TRDN, 92124, 194574, 1-134; 18447, TRDN, 92126, 194576, 319-1179; 18447, TRDN, 92122, 194572, 319-2508; 18447, TRDN, 92125, 194575, 198-701; 18447, TRDN, 92127, 194577, 135-1028; 18448, TRIB1, 92129, 194579, 264-689; 18448, TRIB1, 92128, 194578, 583-1701; 18448, TRIB1, 92130, 194580, 255-875; 18449, TRIB2, 92132, 194582, 215-838; 18449, TRIB2, 92133, 194583, 71-829; 18449, TRIB2, 92131, 194581, 1420-2451; 18450, TRIB3, 92135, 194585, 256-1070; 18450, TRIB3, 92136, 194586, 318-1475; 18450, TRIB3, 92137, 194587, 487-877; 18450, TRIB3, 92134, 194584, 554-1630; 18451, TCHH, 92138, 194588, 1-5832; 18451, TCHH, 92139, 194589, 96-5927; 18452, TCHHL1, 92140, 194590, 66-2780; 18453, TCHP, 92144, 194594, 452-973; 18453, TCHP, 92141, 194591, 215-1711; 18453, TCHP, 92142, 194592, 148-1644; 18453, TCHP, 92143, 194593, 154-1650; 18454, TRPS1, 92146, 194596, 231-581; 18454, TRPS1, 92148, 194598, 543-569; 18454, TRPS1, 92149, 194599, 397-581; 18454, TRPS1, 92150, 194600, 1-813; 18454, TRPS1, 92152, 194602, 13-3120; 18454, TRPS1, 92153, 194603, 362-3070; 18454, TRPS1, 92154, 194604, 261-584; 18454, TRPS1, 92155, 194605, 99-2171; 18454, TRPS1, 92145, 194595, 161-4006; 18454, TRPS1, 92147, 194597, 579-4463; 18454, TRPS1, 92151, 194601, 125-3982; 18455, TREM1, 92159, 194609, 11-763; 18455, TREM1, 92156, 194606, 65-769; 18455, TREM1, 92157, 194607, 28-480; 18455, TREM1, 92158, 194608, 28-705; 18456, TREM2, 92160, 194610, 105-764; 18456, TREM2, 92161, 194611, 95-787; 18456, TREM2, 92162, 194612, 22-690; 18457, TREML1, 92163, 194613, 50-649; 18457, TREML1, 92164, 194614, 45-647; 18457, TREML1, 92165, 194615, 45-980; 18458, TREML2, 92166, 194616, 187-1152; 18459, TREML4, 92169, 194619, 1-215; 18459, TREML4, 92167, 194617, 105-707; 18459, TREML4, 92168, 194618, 90-692; 18460, TRIM39-RPP21, 92170, 194620, 143-1654; 18461, TRIM6-TRIM34, 92171, 194621, 174-2702; 18462, TGS1, 92173, 194623, 150-311; 18462, TGS1, 92172, 194622, 478-3039; 18463, TMLHE, 92174, 194624, 147-1412; 18463, TMLHE, 92175, 194625, 88-1218; 18464, TNRC18, 92176, 194626, 1-1220; 18464, TNRC18, 92177, 194627, 160-552; 18464, TNRC18, 92178, 194628, 350-9256; 18464, TNRC18, 92180, 194630, 1-757; 18464, TNRC18, 92181, 194631, 1-577; 18464, TNRC18, 92182, 194632, 281-577; 18464, TNRC18, 92183, 194633, 1-925; 18464, TNRC18, 92179, 194629, 350-9256; 18465, TNRC6A, 92186, 194636, 1-2721; 18465, TNRC6A, 92187, 194637, 1-483; 18465, TNRC6A, 92188, 194638, 1-609; 18465, TNRC6A, 92189, 194639, 1-290; 18465, TNRC6A, 92190, 194640, 1-122; 18465, TNRC6A, 92184, 194634, 148-5889; 18465, TNRC6A, 92185, 194635, 130-6018; 18466, TNRC6B, 92194, 194644, 303-415; 18466, TNRC6B, 92196, 194646, 1-4175; 18466, TNRC6B, 92191, 194641, 303-3392; 18466, TNRC6B, 92192, 194642, 195-5366; 18466, TNRC6B, 92193, 194643, 236-3325; 18466, TNRC6B, 92195, 194645, 212-5713; 18467, TNRC6C, 92199, 194649, 290-576; 18467, TNRC6C, 92200, 194650, 333-682; 18467, TNRC6C, 92197, 194647, 570-5642; 18467, TNRC6C, 92198, 194648, 570-5750; 18467, TNRC6C, 92201, 194651, 728-5908; 18467, TNRC6C, 92202, 194652, 728-5800; 18468, TRIOBP, 92203, 194653, 137-451; 18468, TRIOBP, 92207, 194657, 150-919; 18468, TRIOBP, 92208, 194658, 145-939; 18468, TRIOBP, 92209, 194659, 1-931; 18468, TRIOBP, 92210, 194660, 1-309; 18468, TRIOBP, 92211, 194661, 337-586; 18468, TRIOBP, 92204, 194654, 11-1306; 18468, TRIOBP, 92205, 194655, 256-7353; 18468, TRIOBP, 92206, 194656, 6-1964; 18469, TRIO, 92214, 194664, 67-6996; 18469, TRIO, 92215, 194665, 1-7641; 18469, TRIO, 92216, 194666, 153-4679; 18469, TRIO, 92217, 194667, 50-817; 18469, TRIO, 92212, 194662, 494-2284; 18469, TRIO, 92213, 194663, 25-9318; 18470, TKFC, 92219, 194669, 320-805; 18470, TKFC, 92220, 194670, 1-1602; 18470, TKFC, 92221, 194671, 388-558; 18470, TKFC, 92222, 194672, 1-660; 18470, TKFC, 92223, 194673, 74-1804; 18470, TKFC, 92218, 194668, 230-957; 18471, TPI1, 92227, 194677, 259-374; 18471, TPI1, 92228, 194678, 501-839; 18471, TPI1, 92230, 194680, 527-820; 18471, TPI1, 92224, 194674, 338-1198; 18471, TPI1, 92225, 194675, 37-786; 18471, TPI1, 92226, 194676, 528-1031; 18471, TPI1, 92229, 194679, 288-791; 18471, TPI1, 92231, 194681, 37-897; 18472, TRIM10, 92232, 194682, 77-1264; 18472, TRIM10, 92233, 194683, 77-1522; 18472, TRIM10, 92234, 194684, 77-1264; 18472, TRIM10, 92235, 194685, 77-1522; 18472, TRIM10, 92236, 194686, 77-1522; 18472, TRIM10, 92237, 194687, 77-1264; 18472, TRIM10, 92238, 194688, 77-1264; 18472, TRIM10, 92239, 194689, 77-1264; 18472, TRIM10, 92240, 194690, 77-1522; 18472, TRIM10, 92241, 194691, 77-1522; 18472, TRIM10, 92242, 194692, 77-1522; 18472, TRIM10, 92243, 194693, 77-1264; 18472, TRIM10, 92244, 194694, 77-1522; 18472, TRIM10, 92245, 194695, 76-1263; 18472, TRIM10, 92246, 194696, 77-1522; 18472, TRIM10, 92247, 194697, 77-1264; 18473, TRIM11, 92250, 194700, 3711-4742; 18473, TRIM11, 92251, 194701, 1-682; 18473, TRIM11, 92252, 194702, 1-165; 18473, TRIM11, 92248, 194698, 280-1686; 18473, TRIM11, 92249, 194699, 240-1397; 18474, TRIM13, 92255, 194705, 452-1251; 18474, TRIM13, 92257, 194707, 306-692; 18474, TRIM13, 92253, 194703, 389-1621; 18474, TRIM13, 92254, 194704, 739-1962; 18474, TRIM13, 92256, 194706, 262-1485; 18474, TRIM13, 92258, 194708, 217-1440; 18475, TRIM14, 92262, 194712, 25-357; 18475, TRIM14, 92259, 194709, 11-1339; 18475, TRIM14, 92260, 194710, 11-1339; 18475, TRIM14, 92261, 194711, 23-1351; 18476, TRIM15, 92266, 194716, 1-491; 18476, TRIM15, 92267, 194717, 1-491; 18476, TRIM15, 92268, 194718, 1-491; 18476, TRIM15, 92269, 194719, 470-1867; 18476, TRIM15, 92270, 194720, 1-491; 18476, TRIM15, 92271, 194721, 1-491; 18476, TRIM15, 92272, 194722, 1-491; 18476, TRIM15, 92274, 194724, 1-491; 18476, TRIM15, 92275, 194725, 470-1867; 18476, TRIM15, 92277, 194727, 1-491; 18476, TRIM15, 92280, 194730, 687-1877; 18476, TRIM15, 92281, 194731, 687-1877; 18476, TRIM15, 92283, 194733, 687-1877; 18476, TRIM15, 92284, 194734, 687-1877; 18476, TRIM15, 92285, 194735, 687-1877; 18476, TRIM15, 92286, 194736, 687-1877; 18476, TRIM15, 92289, 194739, 687-1877; 18476, TRIM15, 92290, 194740, 687-1877; 18476, TRIM15, 92263, 194713, 470-1867; 18476, TRIM15, 92264, 194714, 1-348; 18476, TRIM15, 92265, 194715, 470-1867; 18476, TRIM15, 92273, 194723, 470-1867; 18476, TRIM15, 92276, 194726, 470-1867; 18476, TRIM15, 92278, 194728, 470-1867; 18476, TRIM15, 92279, 194729, 470-1867; 18476, TRIM15, 92282, 194732, 1-348; 18476, TRIM15, 92287, 194737, 1-348; 18476, TRIM15, 92288, 194738, 1-348; 18477, TRIM16, 92292, 194742, 1225-2529; 18477, TRIM16, 92295, 194745, 216-560; 18477, TRIM16, 92296, 194746, 198-486; 18477, TRIM16, 92297, 194747, 248-670; 18477, TRIM16, 92298, 194748, 246-580; 18477, TRIM16, 92299, 194749, 1-168; 18477, TRIM16, 92300, 194750, 1-552; 18477, TRIM16, 92301, 194751, 1-699; 18477, TRIM16, 92291, 194741, 558-2252; 18477, TRIM16, 92293, 194743, 278-1324; 18477, TRIM16, 92294, 194744, 857-2551; 18478, TRIM16L, 92303, 194753, 246-588; 18478, TRIM16L, 92305, 194755, 216-560; 18478, TRIM16L, 92306, 194756, 1-699; 18478, TRIM16L, 92308, 194758, 311-984; 18478, TRIM16L, 92310, 194760, 120-281; 18478, TRIM16L, 92302, 194752, 344-1390; 18478, TRIM16L, 92304, 194754, 248-670; 18478, TRIM16L, 92307, 194757, 556-1602; 18478, TRIM16L, 92309, 194759, 1485-2531; 18478, TRIM16L, 92311, 194761, 627-1673; 18479, TRIM17, 92313, 194763, 283-808; 18479, TRIM17, 92316, 194766, 484-575; 18479, TRIM17, 92318, 194768, 400-551; 18479, TRIM17, 92319, 194769, 124-925; 18479, TRIM17, 92312, 194762, 132-1565; 18479, TRIM17, 92314, 194764, 958-2391; 18479, TRIM17, 92315, 194765, 150-1583; 18479, TRIM17, 92317, 194767, 377-1408; 18480, TRIM2, 92321, 194771, 323-654; 18480, TRIM2, 92322, 194772, 169-583; 18480, TRIM2, 92324, 194774, 257-667; 18480, TRIM2, 92325, 194775, 147-557; 18480, TRIM2, 92326, 194776, 167-1747; 18480, TRIM2, 92327, 194777, 437-570; 18480, TRIM2, 92328, 194778, 1-343; 18480, TRIM2, 92320, 194770, 66-2381; 18480, TRIM2, 92323, 194773, 202-2436; 18481, TRIM21, 92330, 194780, 1-271; 18481, TRIM21, 92329, 194779, 114-1541; 18482, TRIM22, 92332, 194782, 1-430; 18482, TRIM22, 92333, 194783, 87-1002; 18482, TRIM22, 92334, 194784, 217-897; 18482, TRIM22, 92335, 194785, 202-812; 18482, TRIM22, 92336, 194786, 1-116; 18482, TRIM22, 92337, 194787, 1-192; 18482, TRIM22, 92338, 194788, 1-113; 18482, TRIM22, 92331, 194781, 278-1774; 18483, TRIM23, 92342, 194792, 470-574; 18483, TRIM23, 92343, 194793, 87-467; 18483, TRIM23, 92344, 194794, 47-151; 18483, TRIM23, 92339, 194789, 373-2097; 18483, TRIM23, 92340, 194790, 26-1666; 18483, TRIM23, 92341, 194791, 23-1732; 18484, TRIM24, 92347, 194797, 1-3039; 18484, TRIM24, 92345, 194795, 216-3368; 18484, TRIM24, 92346, 194796, 115-3165; 18485, TRIM25, 92350, 194800, 1-132; 18485, TRIM25, 92348, 194798, 51-1943; 18485, TRIM25, 92349, 194799, 45-1937; 18486, TRIM26, 92354, 194804, 132-603; 18486, TRIM26, 92355, 194805, 217-582; 18486, TRIM26, 92357, 194807, 297-1041; 18486, TRIM26, 92359, 194809, 380-1124; 18486, TRIM26, 92360, 194810, 132-603; 18486, TRIM26, 92361, 194811, 380-1124; 18486, TRIM26, 92365, 194815, 206-682; 18486, TRIM26, 92366, 194816, 217-582; 18486, TRIM26, 92370, 194820, 380-1124; 18486, TRIM26, 92371, 194821, 217-582; 18486, TRIM26, 92373, 194823, 380-1124; 18486, TRIM26, 92375, 194825, 206-682; 18486, TRIM26, 92376, 194826, 217-582; 18486, TRIM26, 92377, 194827, 380-1124; 18486, TRIM26, 92379, 194829, 206-682; 18486, TRIM26, 92380, 194830, 132-603; 18486, TRIM26, 92381, 194831, 206-682; 18486, TRIM26, 92382, 194832, 187-552; 18486, TRIM26, 92383, 194833, 217-582; 18486, TRIM26, 92384, 194834, 217-582; 18486, TRIM26, 92385, 194835, 83-554; 18486, TRIM26, 92386, 194836, 206-682; 18486, TRIM26, 92387, 194837, 217-582; 18486, TRIM26, 92389, 194839, 132-603; 18486, TRIM26, 92395, 194845, 132-603; 18486, TRIM26, 92396, 194846, 132-603; 18486, TRIM26, 92397, 194847, 380-1124; 18486, TRIM26, 92398, 194848, 380-1124; 18486, TRIM26, 92402, 194852, 206-682; 18486, TRIM26, 92403, 194853, 132-603; 18486, TRIM26, 92351, 194801, 438-2057; 18486, TRIM26, 92352, 194802, 207-1826; 18486, TRIM26, 92353, 194803, 278-1897; 18486, TRIM26, 92356, 194806, 438-2057; 18486, TRIM26, 92358, 194808, 278-1897; 18486, TRIM26, 92362, 194812, 278-1897; 18486, TRIM26, 92363, 194813, 438-2057; 18486, TRIM26, 92364, 194814, 278-1897; 18486, TRIM26, 92367, 194817, 187-1806; 18486, TRIM26, 92368, 194818, 210-1829; 18486, TRIM26, 92369, 194819, 210-1829; 18486, TRIM26, 92372, 194822, 210-1829; 18486, TRIM26, 92374, 194824, 278-1897; 18486, TRIM26, 92378, 194828, 210-1829; 18486, TRIM26, 92388, 194838, 278-1897; 18486, TRIM26, 92390, 194840, 438-2057; 18486, TRIM26, 92391, 194841, 408-2027; 18486, TRIM26, 92392, 194842, 438-2057; 18486, TRIM26, 92393, 194843, 210-1829; 18486, TRIM26, 92394, 194844, 438-2057; 18486, TRIM26, 92399, 194849, 278-1897; 18486, TRIM26, 92400, 194850, 210-1829; 18486, TRIM26, 92401, 194851, 438-2057; 18486, TRIM26, 92404, 194854, 210-1829; 18487, TRIM27, 92410, 194860, 1-745; 18487, TRIM27, 92411, 194861, 357-1103; 18487, TRIM27, 92412, 194862, 1-745; 18487, TRIM27, 92413, 194863, 1-623; 18487, TRIM27, 92414, 194864, 1-745; 18487, TRIM27, 92415, 194865, 1-745; 18487, TRIM27, 92416, 194866, 358-1104; 18487, TRIM27, 92418, 194868, 1-695; 18487, TRIM27, 92419, 194869, 358-1104; 18487, TRIM27, 92420, 194870, 1-158; 18487, TRIM27, 92424, 194874, 1-744; 18487, TRIM27, 92426, 194876, 357-1103; 18487, TRIM27, 92405, 194855, 357-1433; 18487, TRIM27, 92406, 194856, 358-1899; 18487, TRIM27, 92407, 194857, 358-1899; 18487, TRIM27, 92408, 194858, 357-1433; 18487, TRIM27, 92409, 194859, 358-1899; 18487, TRIM27, 92417, 194867, 358-1899; 18487, TRIM27, 92421, 194871, 357-1433; 18487, TRIM27, 92422, 194872, 357-1433; 18487, TRIM27, 92423, 194873, 292-1833; 18487, TRIM27, 92425, 194875, 357-1433; 18488, TRIM28, 92429, 194879, 321-504; 18488, TRIM28, 92430, 194880, 1-1383; 18488, TRIM28, 92431, 194881, 46-533; 18488, TRIM28, 92432, 194882, 328-861; 18488, TRIM28, 92427, 194877, 290-2797; 18488, TRIM28, 92428, 194878, 286-2547; 18489, TRIM29, 92434, 194884, 435-549; 18489, TRIM29, 92435, 194885, 1-358; 18489, TRIM29, 92436, 194886, 267-551; 18489, TRIM29, 92437, 194887, 84-593; 18489, TRIM29, 92438, 194888, 256-547; 18489, TRIM29, 92439, 194889, 1848-2213; 18489, TRIM29, 92440, 194890, 246-1229; 18489, TRIM29, 92441, 194891, 103-385; 18489, TRIM29, 92442, 194892, 289-555; 18489, TRIM29, 92443, 194893, 1-510; 18489, TRIM29, 92444, 194894, 1-510; 18489, TRIM29, 92433, 194883, 423-2189; 18490, TRIM3, 92447, 194897, 336-1117; 18490, TRIM3, 92449, 194899, 496-785; 18490, TRIM3, 92445, 194895, 232-2466; 18490, TRIM3, 92446, 194896, 397-2631; 18490, TRIM3, 92448, 194898, 396-2630; 18490, TRIM3, 92450, 194900, 416-2293; 18491, TRIM31, 92456, 194906, 127-870; 18491, TRIM31, 92458, 194908, 127-1404; 18491, TRIM31, 92451, 194901, 127-1404; 18491, TRIM31, 92452, 194902, 127-1404; 18491, TRIM31, 92453, 194903, 127-1404; 18491, TRIM31, 92454, 194904, 127-1404; 18491, TRIM31, 92455, 194905, 127-1404; 18491, TRIM31, 92457, 194907, 127-1404; 18492, TRIM32, 92461, 194911, 182-699; 18492, TRIM32, 92459, 194909, 131-2092; 18492, TRIM32, 92460, 194910, 162-2123; 18493, TRIM33, 92464, 194914, 1-2666; 18493, TRIM33, 92465, 194915, 85-3444; 18493, TRIM33, 92462, 194912, 85-3468; 18493, TRIM33, 92463, 194913, 85-3417; 18494, TRIM34, 92466, 194916, 156-1622; 18494, TRIM34, 92467, 194917, 338-1804; 18495, TRIM35, 92469, 194919, 4-804; 18495, TRIM35, 92470, 194920, 1-302; 18495, TRIM35, 92468, 194918, 85-1566; 18496, TRIM36, 92475, 194925, 231-1952; 18496, TRIM36, 92476, 194926, 276-786; 18496, TRIM36, 92471, 194921, 123-2309; 18496, TRIM36, 92472, 194922, 510-695; 18496, TRIM36, 92473, 194923, 510-692; 18496, TRIM36, 92474, 194924, 328-2478; 18497, TRIM37, 92480, 194930, 280-483; 18497, TRIM37, 92481, 194931, 1-163; 18497, TRIM37, 92482, 194932, 1-584; 18497, TRIM37, 92483, 194933, 8-319; 18497, TRIM37, 92484, 194934, 255-431; 18497, TRIM37, 92485, 194935, 1-354; 18497, TRIM37, 92486, 194936, 1-340; 18497, TRIM37, 92487, 194937, 1-204; 18497, TRIM37, 92477, 194927, 261-3155; 18497, TRIM37, 92478, 194928, 366-3158; 18497, TRIM37, 92479, 194929, 461-3355; 18498, TRIM38, 92488, 194938, 477-1874; 18499, TRIM39, 92499, 194949, 1-683; 18499, TRIM39, 92500, 194950, 1-683; 18499, TRIM39, 92501, 194951, 315-459; 18499, TRIM39, 92502, 194952, 232-1013; 18499, TRIM39, 92504, 194954, 232-1013; 18499, TRIM39, 92505, 194955, 367-588; 18499, TRIM39, 92507, 194957, 1-683; 18499, TRIM39, 92508, 194958, 250-427; 18499, TRIM39, 92511, 194961, 250-427; 18499, TRIM39, 92513, 194963, 570-1003; 18499, TRIM39, 92514, 194964, 367-588; 18499, TRIM39, 92515, 194965, 367-588; 18499, TRIM39, 92518, 194968, 250-427; 18499, TRIM39, 92519, 194969, 315-459; 18499, TRIM39, 92521, 194971, 315-459; 18499, TRIM39, 92522, 194972, 250-427; 18499, TRIM39, 92524, 194974, 367-588; 18499, TRIM39, 92525, 194975, 1-683; 18499, TRIM39, 92526, 194976, 1-683; 18499, TRIM39, 92527, 194977, 570-1003; 18499, TRIM39, 92528, 194978, 232-1013; 18499, TRIM39, 92530, 194980, 367-588; 18499, TRIM39, 92532, 194982, 367-588; 18499, TRIM39, 92533, 194983, 315-459; 18499, TRIM39, 92534, 194984, 250-427; 18499, TRIM39, 92537, 194987, 315-459; 18499, TRIM39, 92538, 194988, 250-427; 18499, TRIM39, 92539, 194989, 570-1003; 18499, TRIM39, 92540, 194990, 232-1013; 18499, TRIM39, 92541, 194991, 570-1003; 18499, TRIM39, 92542, 194992, 1-683; 18499, TRIM39, 92543, 194993, 367-588; 18499, TRIM39, 92544, 194994, 570-1003; 18499, TRIM39, 92545, 194995, 315-459; 18499, TRIM39, 92546, 194996, 232-1013; 18499, TRIM39, 92547, 194997, 1-683; 18499, TRIM39, 92549, 194999, 570-1003; 18499, TRIM39, 92553, 195003, 250-427; 18499, TRIM39, 92556, 195006, 232-1013; 18499, TRIM39, 92557, 195007, 570-1003; 18499, TRIM39, 92558, 195008, 315-459; 18499, TRIM39, 92559, 195009, 232-1013; 18499, TRIM39, 92560, 195010, 8-1519; 18499, TRIM39, 92561, 195011, 8-1519; 18499, TRIM39, 92562, 195012, 8-1519; 18499, TRIM39, 92564, 195014, 8-1519; 18499, TRIM39, 92566, 195016, 8-1519; 18499, TRIM39, 92569, 195019, 8-1519; 18499, TRIM39, 92489, 194939, 313-1869; 18499, TRIM39, 92490, 194940, 599-2065; 18499, TRIM39, 92491, 194941, 262-1728; 18499, TRIM39, 92492, 194942, 161-1717; 18499, TRIM39, 92493, 194943, 599-2065; 18499, TRIM39, 92494, 194944, 161-1717; 18499, TRIM39, 92495, 194945, 262-1728; 18499, TRIM39, 92496, 194946, 313-1779; 18499, TRIM39, 92497, 194947, 313-1779; 18499, TRIM39, 92498, 194948, 599-2065; 18499, TRIM39, 92503, 194953, 313-1779; 18499, TRIM39, 92506, 194956, 599-2065; 18499, TRIM39, 92509, 194959, 161-1717; 18499, TRIM39, 92510, 194960, 313-1779; 18499, TRIM39, 92512, 194962, 262-1728; 18499, TRIM39, 92516, 194966, 599-2065; 18499, TRIM39, 92517, 194967, 161-1717; 18499, TRIM39, 92520, 194970, 161-1717; 18499, TRIM39, 92523, 194973, 262-1728; 18499, TRIM39, 92529, 194979, 599-2065; 18499, TRIM39, 92531, 194981, 599-2065; 18499, TRIM39, 92535, 194985, 313-1779; 18499, TRIM39, 92536, 194986, 262-1728; 18499, TRIM39, 92548, 194998, 161-1717; 18499, TRIM39, 92550, 195000, 313-1779; 18499, TRIM39, 92551, 195001, 161-1717; 18499, TRIM39, 92552, 195002, 262-1728; 18499, TRIM39, 92554, 195004, 262-1728; 18499, TRIM39, 92555, 195005, 313-1779; 18499, TRIM39, 92563, 195013, 313-1869; 18499, TRIM39, 92565, 195015, 313-1869; 18499, TRIM39, 92567, 195017, 313-1869; 18499, TRIM39, 92568, 195018, 313-1869; 18499, TRIM39, 92570, 195020, 313-1869; 18499, TRIM39, 92571, 195021, 313-1869; 18500, TRIM4, 92575, 195025, 1-607; 18500, TRIM4, 92572, 195022, 200-1624; 18500, TRIM4, 92573, 195023, 93-977; 18500, TRIM4, 92574, 195024, 131-1633; 18501, TRIM40, 92584, 195034, 28-717; 18501, TRIM40, 92585, 195035, 28-717; 18501, TRIM40, 92586, 195036, 387-1163; 18501, TRIM40, 92588, 195038, 387-1163; 18501, TRIM40, 92589, 195039, 387-1163; 18501, TRIM40, 92590, 195040, 28-717; 18501, TRIM40, 92595, 195045, 307-1083; 18501, TRIM40, 92597, 195047, 307-1083; 18501, TRIM40, 92598, 195048, 307-1083; 18501, TRIM40, 92576, 195026, 28-717; 18501, TRIM40, 92577, 195027, 307-1083; 18501, TRIM40, 92578, 195028, 387-1163; 18501, TRIM40, 92579, 195029, 387-1163; 18501, TRIM40, 92580, 195030, 28-717; 18501, TRIM40, 92581, 195031, 387-1163; 18501, TRIM40, 92582, 195032, 367-1143; 18501, TRIM40, 92583, 195033, 28-717; 18501, TRIM40, 92587, 195037, 28-717; 18501, TRIM40, 92591, 195041, 28-717; 18501, TRIM40, 92592, 195042, 387-1163; 18501, TRIM40, 92593, 195043, 307-1083; 18501, TRIM40, 92594, 195044, 307-1083; 18501, TRIM40, 92596, 195046, 307-1083; 18501, TRIM40, 92599, 195049, 307-1083; 18502, TRIM41, 92602, 195052, 1-1088; 18502, TRIM41, 92603, 195053, 1-349; 18502, TRIM41, 92604, 195054, 341-914; 18502, TRIM41, 92605, 195055, 1-450; 18502, TRIM41, 92600, 195050, 711-2603; 18502, TRIM41, 92601, 195051, 711-2267; 18503, TRIM42, 92606, 195056, 192-2363; 18504, TRIM43, 92607, 195057, 137-1477; 18505, TRIM44, 92608, 195058, 308-1342; 18506, TRIM45, 92610, 195060, 724-2295; 18506, TRIM45, 92612, 195062, 1-314; 18506, TRIM45, 92613, 195063, 200-1109; 18506, TRIM45, 92609, 195059, 528-2270; 18506, TRIM45, 92611, 195061, 562-2250; 18507, TRIM46, 92616, 195066, 68-2002; 18507, TRIM46, 92618, 195068, 261-2414; 18507, TRIM46, 92619, 195069, 297-2198; 18507, TRIM46, 92621, 195071, 61-2301; 18507, TRIM46, 92614, 195064, 1-2280; 18507, TRIM46, 92615, 195065, 138-2348; 18507, TRIM46, 92617, 195067, 90-1745; 18507, TRIM46, 92620, 195070, 77-1573; 18508, TRIM47, 92623, 195073, 1-368; 18508, TRIM47, 92624, 195074, 491-605; 18508, TRIM47, 92625, 195075, 1-551; 18508, TRIM47, 92622, 195072, 28-1944; 18509, TRIM48, 92626, 195076, 87-761; 18510, TRIM49, 92628, 195078, 127-1254; 18510, TRIM49, 92627, 195077, 330-1688; 18511, TRIM49B, 92629, 195079, 124-1482; 18511, TRIM49B, 92630, 195080, 330-1688; 18512, TRIM49C, 92631, 195081, 330-1688; 18513, TRIM49D1, 92634, 195084, 135-1262; 18513, TRIM49D1, 92632, 195082, 115-1473; 18513, TRIM49D1, 92633, 195083, 330-1688; 18514, TRIM49D2, 92635, 195085, 115-1473; 18514, TRIM49D2, 92636, 195086, 1-1359; 18515, TRIM5, 92640, 195090, 427-1054; 18515, TRIM5, 92641, 195091, 392-607; 18515, TRIM5, 92643, 195093, 1-563; 18515, TRIM5, 92637, 195087, 785-1765; 18515, TRIM5, 92638, 195088, 258-1739; 18515, TRIM5, 92639, 195089, 237-1280; 18515, TRIM5, 92642, 195092, 56-871; 18516, TRIM50, 92644, 195094, 202-1665; 18516, TRIM50, 92645, 195095, 126-1589; 18517, TRIM52, 92646, 195096, 306-1199; 18518, TRIM54, 92647, 195097, 271-1473; 18518, TRIM54, 92648, 195098, 341-1417; 18519, TRIM55, 92649, 195099, 227-1849; 18519, TRIM55, 92650, 195100, 374-1732; 18519, TRIM55, 92651, 195101, 374-2020; 18519, TRIM55, 92652, 195102, 227-952; 18520, TRIM56, 92654, 195104, 215-1129; 18520, TRIM56, 92655, 195105, 386-581; 18520, TRIM56, 92653, 195103, 298-2565; 18521, TRIM58, 92656, 195106, 49-1509; 18522, TRIM59, 92658, 195108, 328-860; 18522, TRIM59, 92659, 195109, 243-577; 18522, TRIM59, 92660, 195110, 234-576; 18522, TRIM59, 92661, 195111, 67-603;

18522, TRIM59, 92662, 195112, 398-601; 18522, TRIM59, 92663, 195113, 84-548; 18522, TRIM59, 92664, 195114, 216-1187; 18522, TRIM59, 92657, 195107, 187-1398; 18523, TRIM6, 92667, 195117, 121-1509; 18523, TRIM6, 92669, 195119, 175-468; 18523, TRIM6, 92673, 195123, 153-1340; 18523, TRIM6, 92674, 195124, 1-1389; 18523, TRIM6, 92665, 195115, 141-1607; 18523, TRIM6, 92666, 195116, 243-1793; 18523, TRIM6, 92668, 195118, 400-1341; 18523, TRIM6, 92670, 195120, 212-1153; 18523, TRIM6, 92671, 195121, 116-1057; 18523, TRIM6, 92672, 195122, 468-1409; 18524, TRIM60, 92677, 195127, 118-389; 18524, TRIM60, 92675, 195125, 196-1611; 18524, TRIM60, 92676, 195126, 217-1632; 18524, TRIM60, 92678, 195128, 234-1649; 18525, TRIM61, 92679, 195129, 614-1243; 18525, TRIM61, 92680, 195130, 1-630; 18526, TRIM62, 92681, 195131, 235-1662; 18526, TRIM62, 92682, 195132, 99-1163; 18527, TRIM63, 92683, 195133, 140-1201; 18528, TRIM64, 92684, 195134, 3-1352; 18529, TRIM64B, 92685, 195135, 1-1350; 18530, TRIM64C, 92686, 195136, 1-1344; 18530, TRIM64C, 92687, 195137, 1-1353; 18531, TRIM65, 92689, 195139, 1-865; 18531, TRIM65, 92690, 195140, 1-733; 18531, TRIM65, 92691, 195141, 1-412; 18531, TRIM65, 92692, 195142, 1-273; 18531, TRIM65, 92688, 195138, 67-1620; 18532, TRIM66, 92694, 195144, 442-4179; 18532, TRIM66, 92695, 195145, 1-858; 18532, TRIM66, 92693, 195143, 196-3846; 18533, TRIM67, 92698, 195148, 859-3204; 18533, TRIM67, 92696, 195146, 1-2352; 18533, TRIM67, 92697, 195147, 1-2166; 18534, TRIM68, 92700, 195150, 236-799; 18534, TRIM68, 92701, 195151, 449-874; 18534, TRIM68, 92702, 195152, 170-764; 18534, TRIM68, 92699, 195149, 291-1748; 18535, TRIM69, 92705, 195155, 1-391; 18535, TRIM69, 92706, 195156, 171-962; 18535, TRIM69, 92711, 195161, 344-1846; 18535, TRIM69, 92712, 195162, 171-962; 18535, TRIM69, 92714, 195164, 929-2431; 18535, TRIM69, 92716, 195166, 1-391; 18535, TRIM69, 92703, 195153, 344-1846; 18535, TRIM69, 92704, 195154, 140-1165; 18535, TRIM69, 92707, 195157, 929-2431; 18535, TRIM69, 92708, 195158, 319-1158; 18535, TRIM69, 92709, 195159, 319-1209; 18535, TRIM69, 92710, 195160, 140-1165; 18535, TRIM69, 92713, 195163, 319-1209; 18535, TRIM69, 92715, 195165, 319-1158; 18536, TRIM7, 92717, 195167, 63-1598; 18536, TRIM7, 92718, 195168, 184-849; 18536, TRIM7, 92719, 195169, 699-1610; 18536, TRIM7, 92720, 195170, 778-1767; 18536, TRIM7, 92721, 195171, 490-1401; 18537, TRIM71, 92722, 195172, 64-2670; 18538, TRIM72, 92723, 195173, 285-1718; 18538, TRIM72, 92724, 195174, 215-1024; 18539, TRIM73, 92726, 195176, 661-1020; 18539, TRIM73, 92727, 195177, 140-889; 18539, TRIM73, 92728, 195178, 74-922; 18539, TRIM73, 92725, 195175, 201-953; 18539, TRIM73, 92729, 195179, 20-772; 18540, TRIM74, 92730, 195180, 201-953; 18540, TRIM74, 92731, 195181, 140-889; 18541, TRIM77, 92733, 195183, 1-705; 18541, TRIM77, 92732, 195182, 1-1353; 18542, TRIM8, 92735, 195185, 1-891; 18542, TRIM8, 92734, 195184, 123-1778; 18543, TRIM9, 92736, 195186, 1123-3255; 18543, TRIM9, 92737, 195187, 391-2799; 18543, TRIM9, 92738, 195188, 138-1790; 18544, TRIML1, 92739, 195189, 141-1547; 18545, TRIML2, 92740, 195190, 1-1269; 18545, TRIML2, 92741, 195191, 1-357; 18545, TRIML2, 92743, 195193, 1-357; 18545, TRIML2, 92742, 195192, 226-1539; 18546, TRIM51, 92744, 195194, 222-1151; 18546, TRIM51, 92745, 195195, 93-1451; 18547, TPP1, 92747, 195197, 30-560; 18547, TPP1, 92748, 195198, 23-142; 18547, TPP1, 92749, 195199, 23-115; 18547, TPP1, 92751, 195201, 31-1701; 18547, TPP1, 92746, 195196, 62-1753; 18547, TPP1, 92750, 195200, 800-1762; 18548, TPP2, 92752, 195202, 17-3805; 18548, TPP2, 92753, 195203, 37-3786; 18549, TRIQK, 92755, 195205, 284-448; 18549, TRIQK, 92756, 195206, 318-482; 18549, TRIQK, 92757, 195207, 417-581; 18549, TRIQK, 92759, 195209, 534-556; 18549, TRIQK, 92764, 195214, 318-559; 18549, TRIQK, 92765, 195215, 581-805; 18549, TRIQK, 92767, 195217, 136-300; 18549, TRIQK, 92754, 195204, 428-688; 18549, TRIQK, 92758, 195208, 282-542; 18549, TRIQK, 92760, 195210, 266-526; 18549, TRIQK, 92761, 195211, 320-580; 18549, TRIQK, 92762, 195212, 410-670; 18549, TRIQK, 92763, 195213, 246-506; 18549, TRIQK, 92766, 195216, 316-576; 18549, TRIQK, 92768, 195218, 127-387; 18549, TRIQK, 92769, 195219, 160-420; 18550, TFG, 92773, 195223, 253-723; 18550, TFG, 92774, 195224, 392-776; 18550, TFG, 92776, 195226, 370-913; 18550, TFG, 92777, 195227, 435-1535; 18550, TFG, 92770, 195220, 341-1543; 18550, TFG, 92771, 195221, 115-1305; 18550, TFG, 92772, 195222, 160-1350; 18550, TFG, 92775, 195225, 98-1300; 18550, TFG, 92778, 195228, 1-855; 18550, TFG, 92779, 195229, 435-1289; 18551, TRMU, 92782, 195232, 341-640; 18551, TRMU, 92783, 195233, 365-664; 18551, TRMU, 92784, 195234, 341-640; 18551, TRMU, 92786, 195236, 341-640; 18551, TRMU, 92780, 195230, 341-1606; 18551, TRMU, 92781, 195231, 21-1151; 18551, TRMU, 92785, 195235, 341-841; 18552, TRDMT1, 92787, 195237, 1-682; 18552, TRDMT1, 92788, 195238, 39-248; 18552, TRDMT1, 92790, 195240, 1-162; 18552, TRDMT1, 92791, 195241, 1-257; 18552, TRDMT1, 92793, 195243, 24-788; 18552, TRDMT1, 92794, 195244, 1-410; 18552, TRDMT1, 92789, 195239, 49-1224; 18552, TRDMT1, 92792, 195242, 218-409; 18553, TRIT1, 92799, 195249, 258-515; 18553, TRIT1, 92800, 195250, 1-422; 18553, TRIT1, 92801, 195251, 6-437; 18553, TRIT1, 92802, 195252, 14-1063; 18553, TRIT1, 92803, 195253, 1-245; 18553, TRIT1, 92804, 195254, 21-212; 18553, TRIT1, 92805, 195255, 1-513; 18553, TRIT1, 92795, 195245, 16-1419; 18553, TRIT1, 92796, 195246, 16-1341; 18553, TRIT1, 92797, 195247, 1-1158; 18553, TRIT1, 92798, 195248, 813-1304; 18554, TRMT1, 92809, 195259, 240-813; 18554, TRMT1, 92810, 195260, 1-306; 18554, TRMT1, 92811, 195261, 130-447; 18554, TRMT1, 92813, 195263, 93-985; 18554, TRMT1, 92814, 195264, 117-552; 18554, TRMT1, 92815, 195265, 117-374; 18554, TRMT1, 92816, 195266, 129-470; 18554, TRMT1, 92806, 195256, 259-2151; 18554, TRMT1, 92807, 195257, 130-2109; 18554, TRMT1, 92808, 195258, 251-2230; 18554, TRMT1, 92812, 195262, 572-2551; 18555, TRMT10A, 92820, 195270, 186-802; 18555, TRMT10A, 92821, 195271, 190-788; 18555, TRMT10A, 92817, 195267, 314-1333; 18555, TRMT10A, 92818, 195268, 144-1163; 18555, TRMT10A, 92819, 195269, 118-1137; 18556, TRMT10B, 92826, 195276, 66-491; 18556, TRMT10B, 92828, 195278, 66-284; 18556, TRMT10B, 92829, 195279, 66-284; 18556, TRMT10B, 92822, 195272, 66-1016; 18556, TRMT10B, 92823, 195273, 80-769; 18556, TRMT10B, 92824, 195274, 242-907; 18556, TRMT10B, 92825, 195275, 66-590; 18556, TRMT10B, 92827, 195277, 80-850; 18557, TRMT10C, 92831, 195281, 82-1017; 18557, TRMT10C, 92830, 195280, 155-1366; 18558, TRMT11, 92834, 195284, 339-617; 18558, TRMT11, 92835, 195285, 1-393; 18558, TRMT11, 92836, 195286, 256-657; 18558, TRMT11, 92838, 195288, 1-258; 18558, TRMT11, 92839, 195289, 1-14; 18558, TRMT11, 92840, 195290, 26-718; 18558, TRMT11, 92841, 195291, 73-321; 18558, TRMT11, 92832, 195282, 122-1513; 18558, TRMT11, 92833, 195283, 73-1449; 18558, TRMT11, 92837, 195287, 73-846;

18559, TRMT112, 92844, 195294, 28-348; 18559, TRMT112, 92845, 195295, 177-422; 18559, TRMT112, 92846, 195296, 19-210; 18559, TRMT112, 92842, 195292, 33-395; 18559, TRMT112, 92843, 195293, 559-936; 18560, TRMT12, 92848, 195298, 12-464; 18560, TRMT12, 92847, 195297, 109-1455; 18561, TRMT13, 92849, 195299, 48-440; 18561, TRMT13, 92851, 195301, 20-349; 18561, TRMT13, 92850, 195300, 7-1452; 18561, TRMT13, 92852, 195302, 5-532; 18562, TRMT1L, 92854, 195304, 1-639; 18562, TRMT1L, 92853, 195303, 270-2471; 18563, TRMT2A, 92858, 195308, 1-426; 18563, TRMT2A, 92859, 195309, 224-582; 18563, TRMT2A, 92860, 195310, 317-2248; 18563, TRMT2A, 92861, 195311, 1-477; 18563, TRMT2A, 92855, 195305, 390-2267; 18563, TRMT2A, 92856, 195306, 340-2028; 18563, TRMT2A, 92857, 195307, 363-2240; 18564, TRMT2B, 92862, 195312, 368-1882; 18564, TRMT2B, 92863, 195313, 774-2288; 18564, TRMT2B, 92864, 195314, 468-1847; 18564, TRMT2B, 92865, 195315, 357-1871; 18565, TRMT44, 92868, 195318, 1-660; 18565, TRMT44, 92866, 195316, 1-2274; 18565, TRMT44, 92867, 195317, 250-1485; 18566, TRMT5, 92870, 195320, 117-572; 18566, TRMT5, 92871, 195321, 53-560; 18566, TRMT5, 92869, 195319, 386-1915; 18567, TRMT6, 92872, 195322, 132-1625; 18567, TRMT6, 92873, 195323, 554-1537; 18568, TRMT61A, 92874, 195324, 1-575; 18568, TRMT61A, 92875, 195325, 108-977; 18569, TRMT61B, 92877, 195327, 19-1119; 18569, TRMT61B, 92878, 195328, 1-307; 18569, TRMT61B, 92876, 195326, 25-1458; 18570, TRMO, 92879, 195329, 1-480; 18570, TRMO, 92880, 195330, 1885-2772; 18570, TRMO, 92882, 195332, 1-519; 18570, TRMO, 92883, 195333, 2439-2996; 18570, TRMO, 92881, 195331, 78-1403; 18571, TRNT1, 92887, 195337, 2-199; 18571, TRNT1, 92889, 195339, 298-483; 18571, TRNT1, 92884, 195334, 103-1407; 18571, TRNT1, 92885, 195335, 67-1311; 18571, TRNT1, 92886, 195336, 68-241; 18571, TRNT1, 92888, 195338, 1027-1200; 18571, TRNT1, 92890, 195340, 411-584; 18571, TRNT1, 92891, 195341, 54-1358; 18572, TRPT1, 92895, 195345, 158-661; 18572, TRPT1, 92897, 195347, 1-336; 18572, TRPT1, 92898, 195348, 109-681; 18572, TRPT1, 92899, 195349, 1-346; 18572, TRPT1, 92892, 195342, 170-931; 18572, TRPT1, 92893, 195343, 215-982; 18572, TRPT1, 92894, 195344, 174-788; 18572, TRPT1, 92896, 195346, 215-865; 18573, TRNAU1AP, 92900, 195350, 27-890; 18574, THG1L, 92902, 195352, 22-396; 18574, THG1L, 92903, 195353, 1-103; 18574, THG1L, 92901, 195351, 245-1141; 18575, TYW1, 92906, 195356, 160-563; 18575, TYW1, 92907, 195357, 160-2166; 18575, TYW1, 92904, 195354, 165-2363; 18575, TYW1, 92905, 195355, 127-1281; 18576, TYW1B, 92908, 195358, 100-1515; 18576, TYW1B, 92909, 195359, 124-2130; 18576, TYW1B, 92910, 195360, 112-1086; 18577, TYW3, 92913, 195363, 540-708; 18577, TYW3, 92914, 195364, 424-843; 18577, TYW3, 92911, 195361, 90-869; 18577, TYW3, 92912, 195362, 94-774; 18578, TYW5, 92916, 195366, 34-399; 18578, TYW5, 92917, 195367, 267-632; 18578, TYW5, 92915, 195365, 267-1214; 18579, TRO, 92923, 195373, 764-976; 18579, TRO, 92924, 195374, 505-1196; 18579, TRO, 92925, 195375, 210-578; 18579, TRO, 92926, 195376, 123-626; 18579, TRO, 92927, 195377, 89-594; 18579, TRO, 92928, 195378, 93-2138; 18579, TRO, 92929, 195379, 590-599; 18579, TRO, 92931, 195381, 199-562; 18579, TRO, 92932, 195382, 145-672; 18579, TRO, 92933, 195383, 99-405; 18579, TRO, 92934, 195384, 293-868; 18579, TRO, 92935, 195385, 531-722; 18579, TRO, 92936, 195386, 93-1166; 18579, TRO, 92918, 195368, 113-4408; 18579, TRO, 92919, 195369, 113-2233; 18579, TRO, 92920, 195370, 93-2213; 18579, TRO, 92921, 195371, 145-3249; 18579, TRO, 92922, 195372, 93-1022; 18579, TRO, 92930, 195380, 488-3376; 18580, TROAP, 92939, 195389, 101-262; 18580, TROAP, 92940, 195390, 46-915; 18580, TROAP, 92941, 195391, 236-577; 18580, TROAP, 92942, 195392, 188-1561; 18580, TROAP, 92943, 195393, 112-2718; 18580, TROAP, 92944, 195394, 99-260; 18580, TROAP, 92946, 195396, 83-241; 18580, TROAP, 92947, 195397, 77-340; 18580, TROAP, 92948, 195398, 100-640; 18580, TROAP, 92949, 195399, 120-326; 18580, TROAP, 92950, 195400, 99-479; 18580, TROAP, 92951, 195401, 73-549; 18580, TROAP, 92937, 195387, 77-2413; 18580, TROAP, 92938, 195388, 101-535; 18580, TROAP, 92945, 195395, 101-481; 18581, TPBG, 92955, 195405, 426-1688; 18581, TPBG, 92956, 195406, 618-1880; 18581, TPBG, 92957, 195407, 937-2199; 18581, TPBG, 92952, 195402, 618-1880; 18581, TPBG, 92953, 195403, 426-1688; 18581, TPBG, 92954, 195404, 937-2199; 18582, TPBGL, 92958, 195408, 146-1294; 18583, TMOD1, 92959, 195409, 214-1293; 18583, TMOD1, 92960, 195410, 262-960; 18583, TMOD1, 92961, 195411, 137-1216; 18584, TMOD2, 92964, 195414, 400-1323; 18584, TMOD2, 92965, 195415, 1-331; 18584, TMOD2, 92962, 195412, 222-1277; 18584, TMOD2, 92963, 195413, 116-1063; 18585, TMOD3, 92968, 195418, 1-563; 18585, TMOD3, 92969, 195419, 380-1021; 18585, TMOD3, 92970, 195420, 349-447; 18585, TMOD3, 92966, 195416, 282-1340; 18585, TMOD3, 92967, 195417, 48-1106; 18586, TMOD4, 92972, 195422, 68-493; 18586, TMOD4, 92973, 195423, 1-371; 18586, TMOD4, 92974, 195424, 73-204; 18586, TMOD4, 92971, 195421, 136-1173; 18587, TPM1, 92977, 195427, 1-738; 18587, TPM1, 92979, 195429, 80-1060; 18587, TPM1, 92981, 195431, 110-856; 18587, TPM1, 92983, 195433, 1395-1673; 18587, TPM1, 92984, 195434, 1-747; 18587, TPM1, 92985, 195435, 1-100; 18587, TPM1, 92987, 195437, 76-549; 18587, TPM1, 92988, 195438, 1-429; 18587, TPM1, 92989, 195439, 84-296; 18587, TPM1, 92990, 195440, 247-570; 18587, TPM1, 92991, 195441, 1-797; 18587, TPM1, 92992, 195442, 1-207; 18587, TPM1, 92993, 195443, 269-292; 18587, TPM1, 92994, 195444, 80-202; 18587, TPM1, 92995, 195445, 15-842; 18587, TPM1, 92996, 195446, 77-226; 18587, TPM1, 92998, 195448, 1-671; 18587, TPM1, 92999, 195449, 144-464; 18587, TPM1, 92975, 195425, 73-927; 18587, TPM1, 92976, 195426, 199-1053; 18587, TPM1, 92978, 195428, 211-948; 18587, TPM1, 92980, 195430, 146-1000; 18587, TPM1, 92982, 195432, 81-935; 18587, TPM1, 92986, 195436, 73-927; 18587, TPM1, 92997, 195447, 73-927; 18588, TPM2, 93001, 195451, 97-951; 18588, TPM2, 93003, 195453, 87-1055; 18588, TPM2, 93004, 195454, 1-336; 18588, TPM2, 93000, 195450, 106-960; 18588, TPM2, 93002, 195452, 1204-2058; 18589, TPM3, 93005, 195455, 41-898; 18589, TPM3, 93008, 195458, 63-734; 18589, TPM3, 93009, 195459, 90-788; 18589, TPM3, 93015, 195465, 90-377; 18589, TPM3, 93016, 195466, 362-587; 18589, TPM3, 93017, 195467, 109-258; 18589, TPM3, 93018, 195468, 131-814; 18589, TPM3, 93006, 195456, 209-685; 18589, TPM3, 93007, 195457, 87-833; 18589, TPM3, 93010, 195460, 194-1051; 18589, TPM3, 93011, 195461, 12-755; 18589, TPM3, 93012, 195462, 46-789; 18589, TPM3, 93013, 195463, 1-747; 18589, TPM3, 93014, 195464, 54-800; 18590, TPM4, 93021, 195471, 752-801; 18590, TPM4, 93022, 195472, 378-586; 18590, TPM4, 93023, 195473, 329-635; 18590, TPM4, 93024, 195474, 22-558; 18590, TPM4, 93025, 195475, 149-563; 18590, TPM4, 93026, 195476, 1-331; 18590,

TPM4, 93027, 195477, 78-367; 18590, TPM4, 93028, 195478, 1-180; 18590, TPM4, 93029, 195479, 198-708; 18590, TPM4, 93019, 195469, 261-1007; 18590, TPM4, 93020, 195470, 119-973; 18591, TNNC1, 93031, 195481, 430-727; 18591, TNNC1, 93030, 195480, 56-541; 18592, TNNC2, 93033, 195483, 209-646; 18592, TNNC2, 93032, 195482, 94-576; 18593, TNNI1, 93037, 195487, 77-394; 18593, TNNI1, 93038, 195488, 173-565; 18593, TNNI1, 93039, 195489, 223-633; 18593, TNNI1, 93040, 195490, 94-657; 18593, TNNI1, 93034, 195484, 798-1361; 18593, TNNI1, 93035, 195485, 94-657; 18593, TNNI1, 93036, 195486, 66-629; 18594, TNNI2, 93045, 195495, 25-573; 18594, TNNI2, 93041, 195491, 1-549; 18594, TNNI2, 93042, 195492, 31-579; 18594, TNNI2, 93043, 195493, 70-618; 18594, TNNI2, 93044, 195494, 68-616; 18595, TNNI3, 93047, 195497, 116-286; 18595, TNNI3, 93048, 195498, 49-606; 18595, TNNI3, 93046, 195496, 144-776; 18596, TNNT1, 93051, 195501, 240-818; 18596, TNNT1, 93052, 195502, 407-985; 18596, TNNT1, 93053, 195503, 1-203; 18596, TNNT1, 93054, 195504, 1-442; 18596, TNNT1, 93055, 195505, 83-562; 18596, TNNT1, 93057, 195507, 58-489; 18596, TNNT1, 93059, 195509, 1-632; 18596, TNNT1, 93060, 195510, 367-945; 18596, TNNT1, 93061, 195511, 1-313; 18596, TNNT1, 93062, 195512, 190-800; 18596, TNNT1, 93063, 195513, 152-604; 18596, TNNT1, 93049, 195499, 58-846; 18596, TNNT1, 93050, 195500, 58-813; 18596, TNNT1, 93056, 195506, 206-1042; 18596, TNNT1, 93058, 195508, 140-895; 18597, TNNT2, 93066, 195516, 13-888; 18597, TNNT2, 93067, 195517, 1-849; 18597, TNNT2, 93071, 195521, 301-981; 18597, TNNT2, 93072, 195522, 45-386; 18597, TNNT2, 93073, 195523, 26-565; 18597, TNNT2, 93074, 195524, 213-893; 18597, TNNT2, 93075, 195525, 57-349; 18597, TNNT2, 93076, 195526, 57-870; 18597, TNNT2, 93064, 195514, 1-897; 18597, TNNT2, 93065, 195515, 1-768; 18597, TNNT2, 93068, 195518, 54-920; 18597, TNNT2, 93069, 195519, 54-821; 18597, TNNT2, 93070, 195520, 73-930; 18597, TNNT2, 93077, 195527, 288-1154; 18598, TNNT3, 93080, 195530, 76-810; 18598, TNNT3, 93086, 195536, 1-720; 18598, TNNT3, 93087, 195537, 1-720; 18598, TNNT3, 93088, 195538, 76-699; 18598, TNNT3, 93078, 195528, 220-996; 18598, TNNT3, 93079, 195529, 57-794; 18598, TNNT3, 93081, 195531, 280-1032; 18598, TNNT3, 93082, 195532, 59-844; 18598, TNNT3, 93083, 195533, 76-828; 18598, TNNT3, 93084, 195534, 76-846; 18598, TNNT3, 93085, 195535, 9-818; 18599, TROVE2, 93095, 195545, 180-377; 18599, TROVE2, 93096, 195546, 1-581; 18599, TROVE2, 93097, 195547, 489-613; 18599, TROVE2, 93098, 195548, 569-1360; 18599, TROVE2, 93089, 195539, 40-1656; 18599, TROVE2, 93090, 195540, 188-1744; 18599, TROVE2, 93091, 195541, 188-1765; 18599, TROVE2, 93092, 195542, 188-1792; 18599, TROVE2, 93093, 195543, 211-1827; 18599, TROVE2, 93094, 195544, 377-1993; 18600, TCAF1, 93100, 195550, 185-634; 18600, TCAF1, 93101, 195551, 353-577; 18600, TCAF1, 93103, 195553, 140-576; 18600, TCAF1, 93104, 195554, 340-840; 18600, TCAF1, 93099, 195549, 115-2874; 18600, TCAF1, 93102, 195552, 210-2975; 18601, TCAF2, 93109, 195559, 1-1981; 18601, TCAF2, 93105, 195555, 70-2607; 18601, TCAF2, 93106, 195556, 128-2575; 18601, TCAF2, 93107, 195557, 67-2826; 18601, TCAF2, 93108, 195558, 86-2623; 18601, TCAF2, 93110, 195560, 1-2448; 18602, TRUB1, 93111, 195561, 62-1111; 18603, TRUB2, 93112, 195562, 335-1330; 18604, TYSND1, 93113, 195563, 1-1701; 18604, TYSND1, 93114, 195564, 71-1267; 18605, TPSAB1, 93116, 195566, 195-1043; 18605, TPSAB1, 93117, 195567, 1-642; 18605, TPSAB1, 93115, 195565, 34-861; 18606, TPSB2, 93118, 195568, 191-1039; 18606, TPSB2, 93120, 195570, 24-902; 18606, TPSB2, 93119, 195569, 24-851; 18607, TPSD1, 93122, 195572, 34-741; 18607, TPSD1, 93121, 195571, 149-877; 18608, TPSG1, 93123, 195573, 6-971; 18609, TDO2, 93124, 195574, 470-665; 18609, TDO2, 93125, 195575, 410-557; 18609, TDO2, 93128, 195578, 410-557; 18609, TDO2, 93129, 195579, 470-665; 18609, TDO2, 93126, 195576, 65-1285; 18609, TDO2, 93127, 195577, 65-1285; 18610, TPH1, 93131, 195581, 1-621; 18610, TPH1, 93132, 195582, 60-556; 18610, TPH1, 93130, 195580, 564-1898; 18611, TPH2, 93133, 195583, 142-1614; 18612, WRB, 93136, 195586, 420-768; 18612, WRB, 93138, 195588, 436-541; 18612, WRB, 93139, 195589, 1-245; 18612, WRB, 93140, 195590, 1-46; 18612, WRB, 93141, 195591, 66-275; 18612, WRB, 93142, 195592, 32-550; 18612, WRB, 93134, 195584, 142-666; 18612, WRB, 93135, 195585, 92-514; 18612, WRB, 93137, 195587, 100-522; 18613, WARS2, 93143, 195593, 28-1110; 18613, WARS2, 93144, 195594, 5-667; 18614, WARS, 93149, 195599, 183-640; 18614, WARS, 93150, 195600, 211-848; 18614, WARS, 93151, 195601, 281-538; 18614, WARS, 93152, 195602, 494-658; 18614, WARS, 93153, 195603, 147-677; 18614, WARS, 93154, 195604, 357-560; 18614, WARS, 93155, 195605, 354-564; 18614, WARS, 93156, 195606, 177-847; 18614, WARS, 93157, 195607, 258-707; 18614, WARS, 93158, 195608, 344-517; 18614, WARS, 93159, 195609, 241-584; 18614, WARS, 93161, 195611, 190-562; 18614, WARS, 93162, 195612, 122-801; 18614, WARS, 93163, 195613, 127-547; 18614, WARS, 93164, 195614, 359-821; 18614, WARS, 93165, 195615, 120-230; 18614, WARS, 93166, 195616, 301-591; 18614, WARS, 93167, 195617, 378-553; 18614, WARS, 93169, 195619, 1-557; 18614, WARS, 93170, 195620, 248-563; 18614, WARS, 93171, 195621, 248-560; 18614, WARS, 93172, 195622, 267-389; 18614, WARS, 93173, 195623, 221-410; 18614, WARS, 93174, 195624, 496-572; 18614, WARS, 93175, 195625, 432-530; 18614, WARS, 93176, 195626, 68-528; 18614, WARS, 93177, 195627, 247-568; 18614, WARS, 93178, 195628, 1-123; 18614, WARS, 93145, 195595, 351-1643; 18614, WARS, 93146, 195596, 620-2035; 18614, WARS, 93147, 195597, 101-1393; 18614, WARS, 93148, 195598, 436-1851; 18614, WARS, 93160, 195610, 269-1684; 18614, WARS, 93168, 195618, 834-2126; 18615, TSFM, 93181, 195631, 184-689; 18615, TSFM, 93182, 195632, 169-589; 18615, TSFM, 93183, 195633, 22-291; 18615, TSFM, 93186, 195636, 16-708; 18615, TSFM, 93187, 195637, 16-618; 18615, TSFM, 93179, 195629, 27-1067; 18615, TSFM, 93180, 195630, 214-1191; 18615, TSFM, 93184, 195634, 4-651; 18615, TSFM, 93185, 195635, 42-545; 18616, TSC22D1, 93190, 195640, 1-448; 18616, TSC22D1, 93191, 195641, 264-690; 18616, TSC22D1, 93192, 195642, 225-349; 18616, TSC22D1, 93194, 195644, 134-394; 18616, TSC22D1, 93195, 195645, 129-389; 18616, TSC22D1, 93188, 195638, 218-652; 18616, TSC22D1, 93189, 195639, 492-3713; 18616, TSC22D1, 93193, 195643, 492-2204; 18617, TSC22D2, 93197, 195647, 1-613; 18617, TSC22D2, 93198, 195648, 1-350; 18617, TSC22D2, 93199, 195649, 1-245; 18617, TSC22D2, 93196, 195646, 1017-3359; 18618, TSC22D3, 93201, 195651, 365-697; 18618, TSC22D3, 93204, 195654, 281-514; 18618, TSC22D3, 93206, 195656, 139-537; 18618, TSC22D3, 93207, 195657, 252-551; 18618, TSC22D3, 93208, 195658, 330-503; 18618, TSC22D3, 93209, 195659, 223-581; 18618, TSC22D3, 93210, 195660, 220-567; 18618, TSC22D3, 93211, 195661, 179-546; 18618, TSC22D3, 93212, 195662, 173-425;

18618, TSC22D3, 93213, 195663, 501-576; 18618, TSC22D3, 93214, 195664, 220-521; 18618, TSC22D3, 93215, 195665, 430-802; 18618, TSC22D3, 93200, 195650, 313-915; 18618, TSC22D3, 93202, 195652, 369-971; 18618, TSC22D3, 93203, 195653, 302-904; 18618, TSC22D3, 93205, 195655, 325-729; 18618, TSC22D3, 93216, 195666, 205-807; 18619, TSC22D4, 93219, 195669, 1-635; 18619, TSC22D4, 93220, 195670, 1-503; 18619, TSC22D4, 93217, 195667, 756-1943; 18619, TSC22D4, 93218, 195668, 578-1048; 18620, TSEN15, 93223, 195673, 1-410; 18620, TSEN15, 93224, 195674, 78-437; 18620, TSEN15, 93225, 195675, 31-435; 18620, TSEN15, 93221, 195671, 80-595; 18620, TSEN15, 93222, 195672, 11-400; 18621, TSEN2, 93229, 195679, 104-1239; 18621, TSEN2, 93231, 195681, 1-306; 18621, TSEN2, 93232, 195682, 1-245; 18621, TSEN2, 93226, 195676, 388-1785; 18621, TSEN2, 93227, 195677, 156-1553; 18621, TSEN2, 93228, 195678, 93-1313; 18621, TSEN2, 93230, 195680, 388-1596; 18621, TSEN2, 93233, 195683, 22-1341; 18622, TSEN34, 93237, 195687, 100-1047; 18622, TSEN34, 93238, 195688, 230-956; 18622, TSEN34, 93239, 195689, 100-853; 18622, TSEN34, 93240, 195690, 188-1120; 18622, TSEN34, 93241, 195691, 230-956; 18622, TSEN34, 93243, 195693, 100-1047; 18622, TSEN34, 93244, 195694, 100-1047; 18622, TSEN34, 93246, 195696, 230-956; 18622, TSEN34, 93247, 195697, 81-1028; 18622, TSEN34, 93248, 195698, 100-1047; 18622, TSEN34, 93251, 195701, 188-1120; 18622, TSEN34, 93255, 195705, 188-1120; 18622, TSEN34, 93256, 195706, 312-1244; 18622, TSEN34, 93257, 195707, 99-856; 18622, TSEN34, 93258, 195708, 99-852; 18622, TSEN34, 93259, 195709, 312-1244; 18622, TSEN34, 93260, 195710, 312-1244; 18622, TSEN34, 93261, 195711, 230-956; 18622, TSEN34, 93262, 195712, 312-1244; 18622, TSEN34, 93263, 195713, 100-1047; 18622, TSEN34, 93264, 195714, 100-1047; 18622, TSEN34, 93265, 195715, 100-1047; 18622, TSEN34, 93266, 195716, 312-1244; 18622, TSEN34, 93267, 195717, 188-1120; 18622, TSEN34, 93269, 195719, 100-1047; 18622, TSEN34, 93270, 195720, 188-1120; 18622, TSEN34, 93271, 195721, 100-1047; 18622, TSEN34, 93273, 195723, 188-1120; 18622, TSEN34, 93274, 195724, 312-1244; 18622, TSEN34, 93234, 195684, 188-1120; 18622, TSEN34, 93235, 195685, 312-1244; 18622, TSEN34, 93236, 195686, 113-1045; 18622, TSEN34, 93242, 195692, 312-1244; 18622, TSEN34, 93245, 195695, 113-1045; 18622, TSEN34, 93249, 195699, 113-1045; 18622, TSEN34, 93250, 195700, 312-1244; 18622, TSEN34, 93252, 195702, 188-1120; 18622, TSEN34, 93253, 195703, 110-1042; 18622, TSEN34, 93254, 195704, 312-1244; 18622, TSEN34, 93268, 195718, 188-1120; 18622, TSEN34, 93272, 195722, 92-1024; 18623, TSEN54, 93276, 195726, 410-627; 18623, TSEN54, 93277, 195727, 1-778; 18623, TSEN54, 93278, 195728, 1-429; 18623, TSEN54, 93279, 195729, 1-537; 18623, TSEN54, 93280, 195730, 1-502; 18623, TSEN54, 93275, 195725, 37-1617; 18624, TSNARE1, 93281, 195731, 119-1663; 18624, TSNARE1, 93282, 195732, 40-1584; 18624, TSNARE1, 93284, 195734, 139-589; 18624, TSNARE1, 93285, 195735, 105-938; 18624, TSNARE1, 93286, 195736, 178-583; 18624, TSNARE1, 93283, 195733, 177-1718; 18625, TSNAX-DISC1, 93287, 195737, 159-575; 18625, TSNAX-DISC1, 93288, 195738, 159-719; 18625, TSNAX-DISC1, 93289, 195739, 159-719; 18625, TSNAX-DISC1, 93290, 195740, 159-281; 18625, TSNAX-DISC1, 93291, 195741, 159-725; 18626, TSPYL1, 93292, 195742, 74-1387; 18627, TSPYL2, 93294, 195744, 119-869; 18627, TSPYL2, 93295, 195745, 1-370; 18627, TSPYL2, 93293, 195743, 133-2214; 18628, TSPYL4, 93296, 195746, 133-1377; 18629, TSPYL5, 93297, 195747, 121-1374; 18630, TSPYL6, 93298, 195748, 122-1354; 18631, TSR1, 93300, 195750, 31-1137; 18631, TSR1, 93301, 195751, 1-161; 18631, TSR1, 93302, 195752, 231-443; 18631, TSR1, 93299, 195749, 1081-3495; 18632, TSR2, 93303, 195753, 22-597; 18633, TSR3, 93305, 195755, 1-329; 18633, TSR3, 93304, 195754, 108-1046; 18634, TSACC, 93311, 195761, 362-664; 18634, TSACC, 93312, 195762, 101-403; 18634, TSACC, 93313, 195763, 224-526; 18634, TSACC, 93306, 195756, 48-425; 18634, TSACC, 93307, 195757, 101-478; 18634, TSACC, 93308, 195758, 127-504; 18634, TSACC, 93309, 195759, 208-585; 18634, TSACC, 93310, 195760, 361-738; 18635, TSKU, 93316, 195766, 227-542; 18635, TSKU, 93317, 195767, 192-643; 18635, TSKU, 93314, 195764, 175-1236; 18635, TSKU, 93315, 195765, 1027-2088; 18635, TSKU, 93318, 195768, 130-1191; 18636, TTK, 93321, 195771, 67-306; 18636, TTK, 93322, 195772, 98-549; 18636, TTK, 93324, 195774, 125-541; 18636, TTK, 93325, 195775, 43-569; 18636, TTK, 93326, 195776, 1-240; 18636, TTK, 93319, 195769, 582-3152; 18636, TTK, 93320, 195770, 112-2685; 18636, TTK, 93323, 195773, 830-3400; 18637, TUFM, 93328, 195778, 62-367; 18637, TUFM, 93327, 195777, 140-1507; 18638, TUB, 93331, 195781, 60-1598; 18638, TUB, 93329, 195779, 150-1670; 18638, TUB, 93330, 195780, 242-1927; 18639, TULP1, 93334, 195784, 9-492; 18639, TULP1, 93335, 195785, 12-1634; 18639, TULP1, 93332, 195782, 81-1709; 18639, TULP1, 93333, 195783, 19-1488; 18640, TULP2, 93337, 195787, 149-840; 18640, TULP2, 93338, 195788, 89-649; 18640, TULP2, 93339, 195789, 1-243; 18640, TULP2, 93340, 195790, 106-736; 18640, TULP2, 93336, 195786, 146-1708; 18641, TULP3, 93343, 195793, 58-177; 18641, TULP3, 93344, 195794, 1-328; 18641, TULP3, 93345, 195795, 1-400; 18641, TULP3, 93346, 195796, 58-177; 18641, TULP3, 93347, 195797, 138-548; 18641, TULP3, 93349, 195799, 45-1367; 18641, TULP3, 93341, 195791, 42-1547; 18641, TULP3, 93342, 195792, 52-1380; 18641, TULP3, 93348, 195798, 77-589; 18642, TULP4, 93352, 195802, 1-650; 18642, TULP4, 93350, 195800, 1358-3394; 18642, TULP4, 93351, 195801, 1530-6161; 18643, TSC1, 93354, 195804, 235-1335; 18643, TSC1, 93353, 195803, 223-3717; 18643, TSC1, 93355, 195805, 84-3578; 18643, TSC1, 93356, 195806, 84-3425; 18644, TSC2, 93361, 195811, 1-374; 18644, TSC2, 93363, 195813, 63-389; 18644, TSC2, 93364, 195814, 69-5324; 18644, TSC2, 93365, 195815, 1-590; 18644, TSC2, 93366, 195816, 1-1606; 18644, TSC2, 93367, 195817, 1-93; 18644, TSC2, 93368, 195818, 1-97; 18644, TSC2, 93369, 195819, 1-108; 18644, TSC2, 93357, 195807, 631-6054; 18644, TSC2, 93358, 195808, 76-5430; 18644, TSC2, 93359, 195809, 96-5174; 18644, TSC2, 93360, 195810, 107-5329; 18644, TSC2, 93362, 195812, 82-5196; 18645, TBCA, 93372, 195822, 18-98; 18645, TBCA, 93373, 195823, 9-368; 18645, TBCA, 93374, 195824, 37-276; 18645, TBCA, 93375, 195825, 167-421; 18645, TBCA, 93376, 195826, 5-400; 18645, TBCA, 93370, 195820, 31-420; 18645, TBCA, 93371, 195821, 105-431; 18646, TBCB, 93378, 195828, 43-618; 18646, TBCB, 93379, 195829, 1-399; 18646, TBCB, 93380, 195830, 268-776; 18646, TBCB, 93382, 195832, 259-396; 18646, TBCB, 93383, 195833, 9-191; 18646, TBCB, 93384, 195834, 276-413; 18646, TBCB, 93377, 195827, 576-1310; 18646, TBCB, 93381, 195831, 131-712; 18647, TBCC, 93385, 195835, 24-1064; 18648, TBCD, 93387, 195837, 37-3729; 18648, TBCD, 93388, 195838, 1-714; 18648, TBCD, 93389, 195839, 1-783; 18648, TBCD, 93390, 195840, 518-942; 18648,

TBCD, 93391, 195841, 69-702; 18648, TBCD, 93392, 195842, 147-879; 18648, TBCD, 93393, 195843, 1-206; 18648, TBCD, 93394, 195844, 498-850; 18648, TBCD, 93395, 195845, 425-827; 18648, TBCD, 93396, 195846, 290-1059; 18648, TBCD, 93397, 195847, 355-682; 18648, TBCD, 93398, 195848, 113-867; 18648, TBCD, 93399, 195849, 1-1515; 18648, TBCD, 93400, 195850, 1-278; 18648, TBCD, 93401, 195851, 1-1401; 18648, TBCD, 93402, 195852, 1-206; 18648, TBCD, 93403, 195853, 1-783; 18648, TBCD, 93404, 195854, 1-200; 18648, TBCD, 93405, 195855, 1-241; 18648, TBCD, 93386, 195836, 131-3709; 18649, TBCE, 93409, 195859, 177-1760; 18649, TBCE, 93410, 195860, 225-1808; 18649, TBCE, 93411, 195861, 177-1913; 18649, TBCE, 93406, 195856, 177-1760; 18649, TBCE, 93407, 195857, 225-1808; 18649, TBCE, 93408, 195858, 177-1913; 18650, TBCEL, 93412, 195862, 217-573; 18650, TBCEL, 93414, 195864, 166-522; 18650, TBCEL, 93415, 195865, 305-553; 18650, TBCEL, 93416, 195866, 1200-1913; 18650, TBCEL, 93417, 195867, 509-814; 18650, TBCEL, 93418, 195868, 638-966; 18650, TBCEL, 93413, 195863, 189-1463; 18650, TBCEL, 93419, 195869, 101-1375; 18651, TPGS1, 93420, 195870, 11-883; 18652, TPGS2, 93424, 195874, 220-348; 18652, TPGS2, 93425, 195875, 258-485; 18652, TPGS2, 93426, 195876, 38-784; 18652, TPGS2, 93427, 195877, 270-419; 18652, TPGS2, 93428, 195878, 222-579; 18652, TPGS2, 93430, 195880, 7-99; 18652, TPGS2, 93431, 195881, 1-626; 18652, TPGS2, 93433, 195883, 16-108; 18652, TPGS2, 93434, 195884, 1-565; 18652, TPGS2, 93435, 195885, 450-1148; 18652, TPGS2, 93436, 195886, 1-250; 18652, TPGS2, 93437, 195887, 1-488; 18652, TPGS2, 93438, 195888, 1-179; 18652, TPGS2, 93439, 195889, 450-842; 18652, TPGS2, 93421, 195871, 429-1331; 18652, TPGS2, 93422, 195872, 220-993; 18652, TPGS2, 93423, 195873, 76-990; 18652, TPGS2, 93429, 195879, 15-698; 18652, TPGS2, 93432, 195882, 197-994; 18653, TPPP, 93440, 195890, 123-782; 18654, TPPP2, 93442, 195892, 1-360; 18654, TPPP2, 93443, 195893, 104-514; 18654, TPPP2, 93444, 195894, 125-538; 18654, TPPP2, 93446, 195896, 1-332; 18654, TPPP2, 93447, 195897, 1-191; 18654, TPPP2, 93441, 195891, 149-661; 18654, TPPP2, 93445, 195895, 117-629; 18655, TPPP3, 93448, 195898, 237-767; 18655, TPPP3, 93449, 195899, 163-693; 18655, TPPP3, 93450, 195900, 552-1082; 18655, TPPP3, 93451, 195901, 843-1373; 18656, TTL, 93452, 195902, 192-1325; 18657, TTLL1, 93453, 195903, 242-1513; 18657, TTLL1, 93454, 195904, 1-1185; 18657, TTLL1, 93455, 195905, 152-331; 18657, TTLL1, 93456, 195906, 233-412; 18658, TTLL10, 93460, 195910, 1-137; 18658, TTLL10, 93457, 195907, 178-1392; 18658, TTLL10, 93458, 195908, 152-2173; 18658, TTLL10, 93459, 195909, 174-2195; 18659, TTLL11, 93463, 195913, 1-368; 18659, TTLL11, 93464, 195914, 1-200; 18659, TTLL11, 93465, 195915, 1-718; 18659, TTLL11, 93461, 195911, 189-2591; 18659, TTLL11, 93462, 195912, 189-1805; 18660, TTLL12, 93467, 195917, 286-483; 18660, TTLL12, 93466, 195916, 65-1999; 18661, TTLL2, 93469, 195919, 70-222; 18661, TTLL2, 93468, 195918, 89-1867; 18661, TTLL2, 93470, 195920, 77-1855; 18662, TTLL3, 93471, 195921, 1-1561; 18662, TTLL3, 93473, 195923, 190-756; 18662, TTLL3, 93474, 195924, 20-2767; 18662, TTLL3, 93475, 195925, 151-497; 18662, TTLL3, 93476, 195926, 728-1339; 18662, TTLL3, 93477, 195927, 1-355; 18662, TTLL3, 93478, 195928, 1-1860; 18662, TTLL3, 93479, 195929, 190-540; 18662, TTLL3, 93480, 195930, 1-579; 18662, TTLL3, 93481, 195931, 183-603; 18662, TTLL3, 93482, 195932, 214-549; 18662, TTLL3, 93483, 195933, 174-540; 18662, TTLL3, 93484, 195934, 265-591; 18662, TTLL3, 93485, 195935, 91-536; 18662, TTLL3, 93487, 195937, 86-565; 18662, TTLL3, 93489, 195939, 1351-2331; 18662, TTLL3, 93490, 195940, 61-545; 18662, TTLL3, 93491, 195941, 86-540; 18662, TTLL3, 93492, 195942, 2093-2419; 18662, TTLL3, 93493, 195943, 1-543; 18662, TTLL3, 93494, 195944, 1-211; 18662, TTLL3, 93495, 195945, 1-84; 18662, TTLL3, 93472, 195922, 2282-3340; 18662, TTLL3, 93486, 195936, 360-1664; 18662, TTLL3, 93488, 195938, 360-1418; 18663, TTLL4, 93498, 195948, 225-747; 18663, TTLL4, 93499, 195949, 1-583; 18663, TTLL4, 93500, 195950, 412-3333; 18663, TTLL4, 93501, 195951, 260-3667; 18663, TTLL4, 93502, 195952, 1-488; 18663, TTLL4, 93503, 195953, 287-588; 18663, TTLL4, 93504, 195954, 1-302; 18663, TTLL4, 93505, 195955, 410-712; 18663, TTLL4, 93506, 195956, 1-539; 18663, TTLL4, 93507, 195957, 1-738; 18663, TTLL4, 93496, 195946, 104-3703; 18663, TTLL4, 93497, 195947, 341-3940; 18664, TTLL5, 93510, 195960, 216-4061; 18664, TTLL5, 93511, 195961, 260-634; 18664, TTLL5, 93512, 195962, 120-2447; 18664, TTLL5, 93514, 195964, 1-183; 18664, TTLL5, 93508, 195958, 206-1015; 18664, TTLL5, 93509, 195959, 206-4051; 18664, TTLL5, 93513, 195963, 71-2524; 18665, TTLL6, 93515, 195965, 1-557; 18665, TTLL6, 93518, 195968, 60-143; 18665, TTLL6, 93519, 195969, 70-216; 18665, TTLL6, 93520, 195970, 100-726; 18665, TTLL6, 93516, 195966, 143-2818; 18665, TTLL6, 93517, 195967, 55-1809; 18666, TTLL7, 93522, 195972, 346-2007; 18666, TTLL7, 93523, 195973, 278-1711; 18666, TTLL7, 93525, 195975, 397-2028; 18666, TTLL7, 93521, 195971, 379-3042; 18666, TTLL7, 93524, 195974, 171-2180; 18667, TTLL8, 93527, 195977, 1-2549; 18667, TTLL8, 93526, 195976, 1-2505; 18668, TTLL9, 93528, 195978, 197-514; 18668, TTLL9, 93529, 195979, 249-566; 18668, TTLL9, 93530, 195980, 55-894; 18668, TTLL9, 93533, 195983, 1-554; 18668, TTLL9, 93534, 195984, 47-724; 18668, TTLL9, 93535, 195985, 1-119; 18668, TTLL9, 93536, 195986, 67-1092; 18668, TTLL9, 93537, 195987, 78-755; 18668, TTLL9, 93531, 195981, 254-1573; 18668, TTLL9, 93532, 195982, 1-1320; 18669, TUBA1A, 93540, 195990, 88-783; 18669, TUBA1A, 93542, 195992, 293-628; 18669, TUBA1A, 93543, 195993, 572-650; 18669, TUBA1A, 93544, 195994, 288-946; 18669, TUBA1A, 93538, 195988, 346-1701; 18669, TUBA1A, 93539, 195989, 481-1836; 18669, TUBA1A, 93541, 195991, 134-1384; 18670, TUBA1B, 93546, 195996, 96-245; 18670, TUBA1B, 93547, 195997, 427-574; 18670, TUBA1B, 93548, 195998, 96-835; 18670, TUBA1B, 93549, 195999, 322-565; 18670, TUBA1B, 93550, 196000, 359-584; 18670, TUBA1B, 93545, 195995, 96-1451; 18671, TUBA1C, 93552, 196002, 29-1588; 18671, TUBA1C, 93553, 196003, 28-294; 18671, TUBA1C, 93554, 196004, 1-247; 18671, TUBA1C, 93555, 196005, 102-494; 18671, TUBA1C, 93556, 196006, 25-291; 18671, TUBA1C, 93551, 196001, 276-1625; 18672, TUBA3C, 93557, 196007, 106-1458; 18672, TUBA3C, 93558, 196008, 49-1305; 18673, TUBA3D, 93559, 196009, 108-1460; 18674, TUBA3E, 93560, 196010, 102-1454; 18675, TUBA4A, 93563, 196013, 189-648; 18675, TUBA4A, 93564, 196014, 148-615; 18675, TUBA4A, 93565, 196015, 207-565; 18675, TUBA4A, 93566, 196016, 400-940; 18675, TUBA4A, 93567, 196017, 79-673; 18675, TUBA4A, 93561, 196011, 175-1521; 18675, TUBA4A, 93562, 196012, 557-1858; 18676, TUBA4B, 93568, 196018, 166-891; 18677, TUBA8, 93571, 196021, 442-582; 18677, TUBA8, 93572, 196022, 298-1700; 18677, TUBA8, 93573, 196023, 1-826; 18677, TUBA8, 93569, 196019, 349-1500; 18677, TUBA8, 93570, 196020, 74-1423; 18678, TUBAL3, 93574, 196024, 39-1379; 18678, TUBAL3, 93575, 196025, 37-1257; 18679, TUBB1, 93576, 196026, 270-1625; 18680, TUBB2A, 93577, 196027, 64-1401; 18681, TUBB2B, 93578, 196028, 193-1530; 18682, TUBB3, 93580, 196030, 200-767; 18682, TUBB3, 93581, 196031, 37-531; 18682, TUBB3, 93582, 196032, 49-405; 18682, TUBB3, 93583, 196033, 44-211; 18682, TUBB3, 93584, 196034, 61-507; 18682, TUBB3, 93585, 196035, 58-321; 18682, TUBB3, 93587, 196037, 58-213; 18682, TUBB3, 93588, 196038, 65-220; 18682, TUBB3, 93589, 196039, 428-566; 18682, TUBB3, 93590, 196040, 58-351; 18682, TUBB3, 93591, 196041, 124-570; 18682, TUBB3, 93579, 196029, 124-1476; 18682, TUBB3, 93586, 196036, 555-1691; 18683, TUBB4A, 93594, 196044, 98-430; 18683, TUBB4A, 93595, 196045, 98-427; 18683, TUBB4A, 93596, 196046, 221-543; 18683, TUBB4A, 93597, 196047, 98-579; 18683, TUBB4A, 93598, 196048, 93-565; 18683, TUBB4A, 93599, 196049, 98-530; 18683, TUBB4A, 93600, 196050, 127-408; 18683, TUBB4A, 93601, 196051, 98-409; 18683, TUBB4A, 93602, 196052, 324-545; 18683, TUBB4A, 93603, 196053, 134-636; 18683, TUBB4A, 93604, 196054, 98-562; 18683, TUBB4A, 93605, 196055, 126-440; 18683, TUBB4A, 93592, 196042, 373-1707; 18683, TUBB4A, 93593, 196043, 82-1416; 18684, TUBB4B, 93606, 196056, 149-1486; 18685, TUBB6, 93608, 196058, 60-374; 18685, TUBB6, 93609, 196059, 41-388; 18685, TUBB6, 93610, 196060, 1-95; 18685, TUBB6, 93611, 196061, 133-524; 18685, TUBB6, 93612, 196062, 32-442; 18685, TUBB6, 93613, 196063, 53-478; 18685, TUBB6, 93614, 196064, 47-361; 18685, TUBB6, 93615, 196065, 53-385; 18685, TUBB6, 93616, 196066, 138-485; 18685, TUBB6, 93617, 196067, 62-1075; 18685, TUBB6, 93618, 196068, 53-343; 18685, TUBB6, 93607, 196057, 235-1575; 18686, TUBB8, 93619, 196069, 56-415; 18686, TUBB8, 93620, 196070, 134-403; 18686, TUBB8, 93622, 196072, 32-259; 18686, TUBB8, 93623, 196073, 40-1263; 18686, TUBB8, 93624, 196074, 1041-2273; 18686, TUBB8, 93621, 196071, 352-1686; 18687, TUBB, 93626, 196076, 485-1603; 18687, TUBB, 93628, 196078, 676-1794; 18687, TUBB, 93629, 196079, 594-1874; 18687, TUBB, 93630, 196080, 676-1794; 18687, TUBB, 93631, 196081, 485-1603; 18687, TUBB, 93632, 196082, 594-1874; 18687, TUBB, 93633, 196083, 485-1603; 18687, TUBB, 93634, 196084, 676-1794; 18687, TUBB, 93635, 196085, 676-1794; 18687, TUBB, 93636, 196086, 676-1794; 18687, TUBB, 93637, 196087, 676-1794; 18687, TUBB, 93638, 196088, 676-1794; 18687, TUBB, 93639, 196089, 485-1603; 18687, TUBB, 93641, 196091, 594-1874; 18687, TUBB, 93642, 196092, 594-1874; 18687, TUBB, 93645, 196095, 594-1874; 18687, TUBB, 93646, 196096, 485-1603; 18687, TUBB, 93647, 196097, 594-1874; 18687, TUBB, 93649, 196099, 676-1794; 18687, TUBB, 93650, 196100, 485-1603; 18687, TUBB, 93651, 196101, 594-1874; 18687, TUBB, 93654, 196104, 594-1874; 18687, TUBB, 93655, 196105, 485-1603; 18687, TUBB, 93656, 196106, 485-1603; 18687, TUBB, 93625, 196075, 307-1641; 18687, TUBB, 93627, 196077, 307-1641; 18687, TUBB, 93640, 196090, 307-1641; 18687, TUBB, 93643, 196093, 307-1641; 18687, TUBB, 93644, 196094, 307-1641; 18687, TUBB, 93648, 196098, 307-1641; 18687, TUBB, 93652, 196102, 307-1641; 18687, TUBB, 93653, 196103, 307-1641; 18688, TUBD1, 93663, 196113, 269-560; 18688, TUBD1, 93664, 196114, 227-352; 18688, TUBD1, 93665, 196115, 384-544; 18688, TUBD1, 93666, 196116, 285-662; 18688, TUBD1, 93657, 196107, 289-1650; 18688, TUBD1, 93658, 196108, 264-1460; 18688, TUBD1, 93659, 196109, 59-658; 18688, TUBD1, 93660, 196110, 2-1057; 18688, TUBD1, 93661, 196111, 202-1392; 18688, TUBD1, 93662, 196112, 309-1022; 18688, TUBD1, 93667, 196117, 2-1363; 18688, TUBD1, 93668, 196118, 289-1344; 18689, TUBE1, 93670, 196120, 76-738; 18689, TUBE1, 93671, 196121, 33-197; 18689, TUBE1, 93672, 196122, 65-226; 18689, TUBE1, 93669, 196119, 80-1507; 18690, TUBG1, 93674, 196124, 53-847; 18690, TUBG1, 93675, 196125, 50-457; 18690, TUBG1, 93673, 196123, 63-1418; 18691, TUBG2, 93676, 196126, 200-1555; 18692, TUBGCP2, 93678, 196128, 1073-2560; 18692, TUBGCP2, 93681, 196131, 758-2923; 18692, TUBGCP2, 93683, 196133, 78-314; 18692, TUBGCP2, 93677, 196127, 41-2749; 18692, TUBGCP2, 93679, 196129, 374-3082; 18692, TUBGCP2, 93680, 196130, 575-2893; 18692, TUBGCP2, 93682, 196132, 374-3166; 18693, TUBGCP3, 93686, 196136, 156-1475; 18693, TUBGCP3, 93687, 196137, 156-1469; 18693, TUBGCP3, 93688, 196138, 1-389; 18693, TUBGCP3, 93689, 196139, 1-389; 18693, TUBGCP3, 93690, 196140, 1-638; 18693, TUBGCP3, 93684, 196134, 188-2911; 18693, TUBGCP3, 93685, 196135, 146-2620; 18694, TUBGCP4, 93692, 196142, 283-531; 18694, TUBGCP4, 93693, 196143, 1-516; 18694, TUBGCP4, 93694, 196144, 1-1193; 18694, TUBGCP4, 93695, 196145, 1-201; 18694, TUBGCP4, 93696, 196146, 1-312; 18694, TUBGCP4, 93697, 196147, 1-318; 18694, TUBGCP4, 93691, 196141, 255-2258; 18694, TUBGCP4, 93698, 196148, 241-2241; 18695, TUBGCP5, 93699, 196149, 1-582; 18695, TUBGCP5, 93700, 196150, 1-500; 18695, TUBGCP5, 93703, 196153, 1-676; 18695, TUBGCP5, 93704, 196154, 131-3205; 18695, TUBGCP5, 93705, 196155, 27-3107; 18695, TUBGCP5, 93706, 196156, 1-676; 18695, TUBGCP5, 93707, 196157, 1-446; 18695, TUBGCP5, 93708, 196158, 1-582; 18695, TUBGCP5, 93709, 196159, 1-68; 18695, TUBGCP5, 93710, 196160, 1-52; 18695, TUBGCP5, 93711, 196161, 30-3104; 18695, TUBGCP5, 93712, 196162, 30-338; 18695, TUBGCP5, 93713, 196163, 27-335; 18695, TUBGCP5, 93714, 196164, 24-461; 18695, TUBGCP5, 93715, 196165, 131-439; 18695, TUBGCP5, 93716, 196166, 1-500; 18695, TUBGCP5, 93717, 196167, 27-3107; 18695, TUBGCP5, 93701, 196151, 131-3205; 18695, TUBGCP5, 93702, 196152, 30-3104; 18696, TUBGCP6, 93719, 196169, 513-4994; 18696, TUBGCP6, 93720, 196170, 1-1467; 18696, TUBGCP6, 93721, 196171, 1-830; 18696, TUBGCP6, 93718, 196168, 106-5565; 18697, TINAG, 93723, 196173, 33-644; 18697, TINAG, 93724, 196174, 101-718; 18697, TINAG, 93722, 196172, 97-1527; 18698, TINAGL1, 93727, 196177, 50-1138; 18698, TINAGL1, 93725, 196175, 77-1480; 18698, TINAGL1, 93726, 196176, 127-1437; 18699, TDRKH, 93729, 196179, 118-1791; 18699, TDRKH, 93734, 196184, 171-1988; 18699, TDRKH, 93735, 196185, 176-568; 18699, TDRKH, 93736, 196186, 82-258; 18699, TDRKH, 93737, 196187, 54-476; 18699, TDRKH, 93738, 196188, 137-559; 18699, TDRKH, 93728, 196178, 635-2320; 18699, TDRKH, 93730, 196180, 171-1856; 18699, TDRKH, 93731, 196181, 128-1678; 18699, TDRKH, 93732, 196182, 171-1856; 18699, TDRKH, 93733, 196183, 129-1814; 18700, TDRD1, 93740, 196190, 461-3775; 18700, TDRD1, 93741, 196191, 154-3495; 18700, TDRD1, 93739, 196189, 154-3723; 18701, TDRD10, 93742, 196192, 86-1186; 18701, TDRD10, 93743, 196193, 839-1894; 18702, TDRD12, 93746, 196196, 1-338; 18702, TDRD12, 93744, 196194, 1-1188; 18702, TDRD12, 93745, 196195, 321-3854; 18703, TDRD15, 93747, 196197, 331-6135; 18703, TDRD15, 93748, 196198, 1-5805; 18704,

TDRD3, 93751, 196201, 272-660; 18704, TDRD3, 93753, 196203, 245-595; 18704, TDRD3, 93749, 196199, 789-2744; 18704, TDRD3, 93750, 196200, 311-2266; 18704, TDRD3, 93752, 196202, 258-2213; 18704, TDRD3, 93754, 196204, 73-2307; 18704, TDRD3, 93755, 196205, 278-2230; 18705, TDRD5, 93759, 196209, 1-1476; 18705, TDRD5, 93756, 196206, 251-3196; 18705, TDRD5, 93757, 196207, 360-3305; 18705, TDRD5, 93758, 196208, 519-3626; 18706, TDRD6, 93761, 196211, 1-526; 18706, TDRD6, 93760, 196210, 1-6291; 18706, TDRD6, 93762, 196212, 255-6455; 18707, TDRD7, 93763, 196213, 296-3592; 18708, TDRD9, 93764, 196214, 25-2658; 18708, TDRD9, 93766, 196216, 1-2755; 18708, TDRD9, 93765, 196215, 49-4197; 18709, TUFT1, 93767, 196217, 45-644; 18709, TUFT1, 93770, 196220, 63-1070; 18709, TUFT1, 93768, 196218, 60-1157; 18709, TUFT1, 93769, 196219, 63-1235; 18710, TFIP11, 93775, 196225, 1-571; 18710, TFIP11, 93776, 196226, 266-525; 18710, TFIP11, 93777, 196227, 275-638; 18710, TFIP11, 93778, 196228, 300-563; 18710, TFIP11, 93779, 196229, 468-595; 18710, TFIP11, 93771, 196221, 375-2888; 18710, TFIP11, 93772, 196222, 356-2869; 18710, TFIP11, 93773, 196223, 285-2798; 18710, TFIP11, 93774, 196224, 190-2703; 18710, TFIP11, 93780, 196230, 101-2614; 18711, TNF, 93783, 196233, 1-516; 18711, TNF, 93781, 196231, 176-877; 18711, TNF, 93782, 196232, 176-877; 18711, TNF, 93784, 196234, 176-877; 18711, TNF, 93785, 196235, 176-877; 18711, TNF, 93786, 196236, 176-877; 18711, TNF, 93787, 196237, 176-877; 18711, TNF, 93788, 196238, 176-877; 18712, TNFSF10, 93791, 196241, 1-223; 18712, TNFSF10, 93789, 196239, 124-969; 18712, TNFSF10, 93790, 196240, 92-397; 18713, TNFSF11, 93792, 196242, 99-911; 18713, TNFSF11, 93793, 196243, 530-1264; 18713, TNFSF11, 93794, 196244, 152-1105; 18713, TNFSF11, 93795, 196245, 306-1040; 18713, TNFSF11, 93796, 196246, 84-818; 18714, TNFSF12, 93798, 196248, 97-501; 18714, TNFSF12, 93797, 196247, 264-1013; 18715, TNFSF13, 93801, 196251, 749-1420; 18715, TNFSF13, 93804, 196254, 100-549; 18715, TNFSF13, 93805, 196255, 98-573; 18715, TNFSF13, 93806, 196256, 156-500; 18715, TNFSF13, 93799, 196249, 565-1269; 18715, TNFSF13, 93800, 196250, 444-1196; 18715, TNFSF13, 93802, 196252, 107-724; 18715, TNFSF13, 93803, 196253, 254-997; 18715, TNFSF13, 93807, 196257, 282-950; 18716, TNFSF13B, 93808, 196258, 179-1036; 18716, TNFSF13B, 93809, 196259, 268-1068; 18716, TNFSF13B, 93810, 196260, 1-495; 18717, TNFSF14, 93811, 196261, 49-663; 18717, TNFSF14, 93812, 196262, 383-1105; 18718, TNFSF15, 93813, 196263, 1133-1657; 18718, TNFSF15, 93814, 196264, 115-870; 18719, TNFSF18, 93815, 196265, 2-601; 18720, TNFSF4, 93816, 196266, 138-689; 18720, TNFSF4, 93817, 196267, 246-647; 18721, TNFSF8, 93819, 196269, 293-787; 18721, TNFSF8, 93818, 196268, 115-819; 18722, TNFSF9, 93820, 196270, 39-803; 18723, TNFRSF10A, 93822, 196272, 469-693; 18723, TNFRSF10A, 93823, 196273, 1-933; 18723, TNFRSF10A, 93821, 196271, 66-1472; 18724, TNFRSF10B, 93826, 196276, 138-410; 18724, TNFRSF10B, 93824, 196274, 286-1608; 18724, TNFRSF10B, 93825, 196275, 128-1363; 18725, TNFRSF10C, 93828, 196278, 686-1153; 18725, TNFRSF10C, 93829, 196279, 202-405; 18725, TNFRSF10C, 93827, 196277, 533-1312; 18726, TNFRSF10D, 93830, 196280, 96-1256; 18727, TNFRSF11A, 93831, 196281, 67-966; 18727, TNFRSF11A, 93832, 196282, 39-1889; 18727, TNFRSF11A, 93833, 196283, 67-858; 18727, TNFRSF11A, 93834, 196284, 67-1080; 18728, TNFRSF11B, 93836, 196286, 63-500; 18728, TNFRSF11B, 93835, 196285, 380-1585; 18729, TNFRSF12A, 93839, 196289, 31-315; 18729, TNFRSF12A, 93840, 196290, 146-388; 18729, TNFRSF12A, 93841, 196291, 24-704; 18729, TNFRSF12A, 93842, 196292, 20-161; 18729, TNFRSF12A, 93837, 196287, 87-476; 18729, TNFRSF12A, 93838, 196288, 40-324; 18730, TNFRSF13B, 93845, 196295, 13-759; 18730, TNFRSF13B, 93846, 196296, 44-514; 18730, TNFRSF13B, 93843, 196293, 14-895; 18730, TNFRSF13B, 93844, 196294, 13-756; 18731, TNFRSF13C, 93847, 196297, 46-600; 18732, TNFRSF14, 93849, 196299, 121-702; 18732, TNFRSF14, 93850, 196300, 532-1225; 18732, TNFRSF14, 93851, 196301, 134-827; 18732, TNFRSF14, 93852, 196302, 110-660; 18732, TNFRSF14, 93853, 196303, 141-834; 18732, TNFRSF14, 93855, 196305, 121-702; 18732, TNFRSF14, 93856, 196306, 134-827; 18732, TNFRSF14, 93857, 196307, 1-76; 18732, TNFRSF14, 93858, 196308, 110-660; 18732, TNFRSF14, 93859, 196309, 1-76; 18732, TNFRSF14, 93860, 196310, 532-1225; 18732, TNFRSF14, 93861, 196311, 141-834; 18732, TNFRSF14, 93848, 196298, 300-1151; 18732, TNFRSF14, 93854, 196304, 300-1151; 18733, TNFRSF17, 93864, 196314, 1-401; 18733, TNFRSF17, 93862, 196312, 219-773; 18733, TNFRSF17, 93863, 196313, 113-520; 18734, TNFRSF18, 93868, 196318, 218-727; 18734, TNFRSF18, 93865, 196315, 1-768; 18734, TNFRSF18, 93866, 196316, 1-705; 18734, TNFRSF18, 93867, 196317, 121-846; 18735, TNFRSF19, 93869, 196319, 514-1767; 18735, TNFRSF19, 93870, 196320, 205-1476; 18735, TNFRSF19, 93871, 196321, 185-1438; 18735, TNFRSF19, 93872, 196322, 696-1553; 18736, TNFRSF1A, 93875, 196325, 272-1034; 18736, TNFRSF1A, 93876, 196326, 214-1452; 18736, TNFRSF1A, 93877, 196327, 191-406; 18736, TNFRSF1A, 93878, 196328, 301-669; 18736, TNFRSF1A, 93879, 196329, 169-1063; 18736, TNFRSF1A, 93880, 196330, 191-409; 18736, TNFRSF1A, 93881, 196331, 228-581; 18736, TNFRSF1A, 93873, 196323, 301-1668; 18736, TNFRSF1A, 93874, 196324, 35-691; 18737, TNFRSF1B, 93883, 196333, 90-557; 18737, TNFRSF1B, 93882, 196332, 90-1475; 18738, TNFRSF21, 93884, 196334, 395-2362; 18739, TNFRSF25, 93895, 196345, 69-830; 18739, TNFRSF25, 93896, 196346, 629-764; 18739, TNFRSF25, 93885, 196335, 1-1119; 18739, TNFRSF25, 93886, 196336, 1-705; 18739, TNFRSF25, 93887, 196337, 69-1211; 18739, TNFRSF25, 93888, 196338, 89-1342; 18739, TNFRSF25, 93889, 196339, 69-1349; 18739, TNFRSF25, 93890, 196340, 1-657; 18739, TNFRSF25, 93891, 196341, 1-381; 18739, TNFRSF25, 93892, 196342, 1-411; 18739, TNFRSF25, 93893, 196343, 1-546; 18739, TNFRSF25, 93894, 196344, 69-902; 18740, TNFRSF4, 93897, 196347, 6-839; 18741, TNFRSF6B, 93898, 196348, 101-1003; 18742, TNFRSF8, 93902, 196352, 130-297; 18742, TNFRSF8, 93899, 196349, 223-2010; 18742, TNFRSF8, 93900, 196350, 468-1919; 18742, TNFRSF8, 93901, 196351, 289-687; 18743, TNFRSF9, 93904, 196354, 1-228; 18743, TNFRSF9, 93905, 196355, 1-264; 18743, TNFRSF9, 93903, 196353, 168-935; 18743, TNFRSF9, 93906, 196356, 262-1029; 18744, TNFAIP1, 93909, 196359, 205-579; 18744, TNFAIP1, 93910, 196360, 215-536; 18744, TNFAIP1, 93911, 196361, 11-482; 18744, TNFAIP1, 93907, 196357, 268-1218; 18744, TNFAIP1, 93908, 196358, 363-1001; 18745, TNFAIP2, 93914, 196364, 70-363; 18745, TNFAIP2, 93915, 196365, 1-731; 18745, TNFAIP2, 93916, 196366, 70-216; 18745, TNFAIP2, 93917, 196367, 304-421; 18745, TNFAIP2, 93918, 196368, 1-1044; 18745, TNFAIP2, 93919, 196369, 1-200; 18745, TNFAIP2, 93912, 196362, 132-2096; 18745, TNFAIP2, 93913, 196363, 640-2604; 18746, TNFAIP3, 93921, 196371, 345-421; 18746, TNFAIP3, 93922, 196372, 213-698; 18746, TNFAIP3, 93923, 196373, 171-465; 18746, TNFAIP3, 93924, 196374, 18-2267; 18746, TNFAIP3, 93925, 196375, 18-662; 18746, TNFAIP3, 93926, 196376, 18-1430; 18746, TNFAIP3, 93927, 196377, 18-2027; 18746, TNFAIP3, 93929, 196379, 18-1613; 18746, TNFAIP3, 93920, 196370, 67-2439; 18746, TNFAIP3, 93928, 196378, 371-2743; 18747, TNFAIP6, 93930, 196380, 76-909; 18748, TNFAIP8, 93932, 196382, 57-176; 18748, TNFAIP8, 93935, 196385, 44-646; 18748, TNFAIP8, 93937, 196387, 338-541; 18748, TNFAIP8, 93931, 196381, 216-782; 18748, TNFAIP8, 93933, 196383, 689-1285; 18748, TNFAIP8, 93934, 196384, 1778-2374; 18748, TNFAIP8, 93936, 196386, 391-1023; 18749, TNFAIP8L1, 93938, 196388, 116-676; 18749, TNFAIP8L1, 93939, 196389, 147-707; 18750, TNFAIP8L2, 93940, 196390, 127-681; 18751, TNFAIP8L3, 93941, 196391, 101-979; 18752, TPD52, 93945, 196395, 603-785; 18752, TPD52, 93950, 196400, 66-182; 18752, TPD52, 93951, 196401, 131-466; 18752, TPD52, 93952, 196402, 29-145; 18752, TPD52, 93953, 196403, 114-299; 18752, TPD52, 93954, 196404, 1-445; 18752, TPD52, 93942, 196392, 116-670; 18752, TPD52, 93943, 196393, 364-1038; 18752, TPD52, 93944, 196394, 379-1095; 18752, TPD52, 93946, 196396, 364-1107; 18752, TPD52, 93947, 196397, 364-1065; 18752, TPD52, 93948, 196398, 364-819; 18752, TPD52, 93949, 196399, 217-840; 18753, TPD52L1, 93955, 196405, 304-933; 18753, TPD52L1, 93961, 196411, 409-684; 18753, TPD52L1, 93963, 196413, 53-553; 18753, TPD52L1, 93965, 196415, 160-735; 18753, TPD52L1, 93956, 196406, 188-583; 18753, TPD52L1, 93957, 196407, 220-654; 18753, TPD52L1, 93958, 196408, 208-516; 18753, TPD52L1, 93959, 196409, 221-529; 18753, TPD52L1, 93960, 196410, 302-610; 18753, TPD52L1, 93962, 196412, 297-911; 18753, TPD52L1, 93964, 196414, 413-940; 18754, TPD52L2, 93973, 196423, 139-807; 18754, TPD52L2, 93974, 196424, 139-597; 18754, TPD52L2, 93966, 196416, 73-762; 18754, TPD52L2, 93967, 196417, 73-702; 18754, TPD52L2, 93968, 196418, 77-697; 18754, TPD52L2, 93969, 196419, 77-637; 18754, TPD52L2, 93970, 196420, 77-739; 18754, TPD52L2, 93971, 196421, 73-675; 18754, TPD52L2, 93972, 196422, 124-615; 18755, TPD52L3, 93975, 196425, 193-603; 18755, TPD52L3, 93976, 196426, 222-644; 18755, TPD52L3, 93977, 196427, 222-620; 18756, TP53, 93979, 196429, 1-1032; 18756, TP53, 93983, 196433, 1-858; 18756, TP53, 93984, 196434, 80-546; 18756, TP53, 93985, 196435, 139-634; 18756, TP53, 93986, 196436, 133-729; 18756, TP53, 93987, 196437, 183-565; 18756, TP53, 93988, 196438, 1-95; 18756, TP53, 93989, 196439, 140-568; 18756, TP53, 93990, 196440, 360-923; 18756, TP53, 93995, 196445, 360-908; 18756, TP53, 94000, 196450, 1-1149; 18756, TP53, 94001, 196451, 360-1064; 18756, TP53, 94003, 196453, 261-1493; 18756, TP53, 93978, 196428, 191-1372; 18756, TP53, 93980, 196430, 134-1159; 18756, TP53, 93981, 196431, 137-1318; 18756, TP53, 93982, 196432, 134-1174; 18756, TP53, 93991, 196441, 368-1432; 18756, TP53, 93992, 196442, 279-908; 18756, TP53, 93993, 196443, 251-1174; 18756, TP53, 93994, 196444, 279-1064; 18756, TP53, 93996, 196446, 308-1372; 18756, TP53, 93997, 196447, 251-1159; 18756, TP53, 93998, 196448, 203-1228; 18756, TP53, 93999, 196449, 254-1318; 18756, TP53, 94002, 196452, 279-923; 18757, TP53BP1, 94005, 196455, 63-5846; 18757, TP53BP1, 94007, 196457, 44-3143; 18757, TP53BP1, 94008, 196458, 1-492; 18757, TP53BP1, 94010, 196460, 1-145; 18757, TP53BP1, 94011, 196461, 1-577; 18757, TP53BP1, 94012, 196462, 1-446; 18757, TP53BP1, 94013, 196463, 1-434; 18757, TP53BP1, 94004, 196454, 254-6172; 18757, TP53BP1, 94006, 196456, 129-6062; 18757, TP53BP1, 94009, 196459, 85-6012; 18758, TP53BP2, 94016, 196466, 1-194; 18758, TP53BP2, 94017, 196467, 1-194; 18758, TP53BP2, 94018, 196468, 275-418; 18758, TP53BP2, 94019, 196469, 1-701; 18758, TP53BP2, 94014, 196464, 293-3697; 18758, TP53BP2, 94015, 196465, 770-3787; 18759, TP53INP1, 94020, 196470, 409-1131; 18759, TP53INP1, 94021, 196471, 364-858; 18760, TP53INP2, 94024, 196474, 213-477; 18760, TP53INP2, 94025, 196475, 211-442; 18760, TP53INP2, 94022, 196472, 224-886; 18760, TP53INP2, 94023, 196473, 390-1052; 18761, TP53I11, 94027, 196477, 445-1155; 18761, TP53I11, 94029, 196479, 314-533; 18761, TP53I11, 94030, 196480, 366-602; 18761, TP53I11, 94031, 196481, 384-571; 18761, TP53I11, 94032, 196482, 185-658; 18761, TP53I11, 94034, 196484, 263-556; 18761, TP53I11, 94035, 196485, 129-499; 18761, TP53I11, 94036, 196486, 193-573; 18761, TP53I11, 94038, 196488, 134-328; 18761, TP53I11, 94039, 196489, 230-502; 18761, TP53I11, 94040, 196490, 363-642; 18761, TP53I11, 94041, 196491, 273-737; 18761, TP53I11, 94043, 196493, 1-195; 18761, TP53I11, 94026, 196476, 578-1147; 18761, TP53I11, 94028, 196478, 276-845; 18761, TP53I11, 94033, 196483, 230-799; 18761, TP53I11, 94037, 196487, 606-1175; 18761, TP53I11, 94042, 196492, 462-1031; 18762, TP53I13, 94045, 196495, 1-339; 18762, TP53I13, 94046, 196496, 1-278; 18762, TP53I13, 94047, 196497, 431-900; 18762, TP53I13, 94048, 196498, 280-805; 18762, TP53I13, 94049, 196499, 507-726; 18762, TP53I13, 94050, 196500, 269-824; 18762, TP53I13, 94051, 196501, 466-1050; 18762, TP53I13, 94044, 196494, 116-1297; 18763, TP5313, 94055, 196505, 1-651; 18763, TP5313, 94052, 196502, 856-1854; 18763, TP5313, 94053, 196503, 491-1489; 18763, TP5313, 94054, 196504, 1-747; 18764, TP53AIP1, 94056, 196506, 211-471; 18764, TP53AIP1, 94057, 196507, 211-585; 18764, TP53AIP1, 94058, 196508, 1-363; 18764, TP53AIP1, 94059, 196509, 369-695; 18764, TP53AIP1, 94060, 196510, 683-1009; 18764, TP53AIP1, 94061, 196511, 683-940; 18765, TP63, 94072, 196522, 127-676; 18765, TP63, 94062, 196512, 90-2132; 18765, TP63, 94063, 196513, 29-1561; 18765, TP63, 94064, 196514, 142-1902; 18765, TP63, 94065, 196515, 1-1668; 18765, TP63, 94066, 196516, 1-1251; 18765, TP63, 94067, 196517, 1-1386; 18765, TP63, 94068, 196518, 1-1506; 18765, TP63, 94069, 196519, 1-1749; 18765, TP63, 94070, 196520, 1-1182; 18765, TP63, 94071, 196521, 1-2031; 18765, TP63, 94073, 196523, 29-1492; 18766, TPRG1, 94075, 196525, 12-411; 18766, TPRG1, 94076, 196526, 1-451; 18766, TPRG1, 94078, 196528, 828-1129; 18766, TPRG1, 94074, 196524, 168-995; 18766, TPRG1, 94077, 196527, 1228-2055; 18767, TPRG1L, 94079, 196529, 24-665; 18767, TPRG1L, 94080, 196530, 72-890; 18768, TP73, 94084, 196534, 235-1515; 18768, TP73, 94081, 196531, 111-1733; 18768, TP73, 94082, 196532, 111-1610; 18768, TP73, 94083, 196533, 111-1778; 18768, TP73, 94085, 196535, 235-1587; 18768, TP73, 94086, 196536, 235-1998; 18768, TP73, 94087, 196537, 122-1819; 18768, TP73, 94088, 196538, 156-2066; 18768, TP73, 94089, 196539, 1-1623; 18768, TP73, 94090, 196540, 1-1668; 18768, TP73, 94091, 196541, 156-1367; 18769, TPT1, 94092, 196542, 18-584; 18769, TPT1, 94095, 196545, 94-576; 18769, TPT1, 94097, 196547, 1-232; 18769, TPT1, 94098, 196548, 1-232; 18769,

TPT1, 94099, 196549, 128-613; 18769, TPT1, 94100, 196550, 216-809; 18769, TPT1, 94093, 196543, 448-864; 18769, TPT1, 94094, 196544, 172-588; 18769, TPT1, 94096, 196546, 302-820; 18770, TSSC1, 94102, 196552, 142-1386; 18770, TSSC1, 94103, 196553, 105-368; 18770, TSSC1, 94104, 196554, 102-1046; 18770, TSSC1, 94105, 196555, 100-276; 18770, TSSC1, 94106, 196556, 112-647; 18770, TSSC1, 94107, 196557, 129-594; 18770, TSSC1, 94108, 196558, 93-491; 18770, TSSC1, 94101, 196551, 194-1357; 18771, TSSC4, 94110, 196560, 524-907; 18771, TSSC4, 94112, 196562, 365-974; 18771, TSSC4, 94113, 196563, 526-863; 18771, TSSC4, 94115, 196565, 229-851; 18771, TSSC4, 94116, 196566, 649-979; 18771, TSSC4, 94117, 196567, 339-912; 18771, TSSC4, 94109, 196559, 444-1433; 18771, TSSC4, 94111, 196561, 492-1289; 18771, TSSC4, 94114, 196564, 182-1171; 18772, TUSC1, 94118, 196568, 120-758; 18773, TUSC2, 94120, 196570, 97-270; 18773, TUSC2, 94121, 196571, 108-305; 18773, TUSC2, 94122, 196572, 153-350; 18773, TUSC2, 94119, 196569, 145-477; 18774, TUSC3, 94124, 196574, 205-1035; 18774, TUSC3, 94125, 196575, 151-1020; 18774, TUSC3, 94127, 196577, 199-1143; 18774, TUSC3, 94128, 196578, 1-909; 18774, TUSC3, 94129, 196579, 153-983; 18774, TUSC3, 94123, 196573, 209-1252; 18774, TUSC3, 94126, 196576, 149-1195; 18775, TUSC5, 94131, 196581, 1-14; 18775, TUSC5, 94130, 196580, 340-873; 18776, TSG101, 94133, 196583, 136-1233; 18776, TSG101, 94134, 196584, 1-232; 18776, TSG101, 94135, 196585, 1-192; 18776, TSG101, 94132, 196582, 417-1589; 18777, TACSTD2, 94136, 196586, 618-1589; 18778, TVP23C-CDRT4, 94137, 196587, 25-138; 18778, TVP23C-CDRT4, 94138, 196588, 114-608; 18778, TVP23C-CDRT4, 94139, 196589, 1-162; 18778, TVP23C-CDRT4, 94140, 196590, 112-225; 18779, TTYH1, 94144, 196594, 1-115; 18779, TTYH1, 94145, 196595, 35-505; 18779, TTYH1, 94146, 196596, 89-929; 18779, TTYH1, 94147, 196597, 44-385; 18779, TTYH1, 94152, 196602, 63-380; 18779, TTYH1, 94154, 196604, 42-182; 18779, TTYH1, 94157, 196607, 488-1459; 18779, TTYH1, 94141, 196591, 123-1478; 18779, TTYH1, 94142, 196592, 104-1456; 18779, TTYH1, 94143, 196593, 28-1410; 18779, TTYH1, 94148, 196598, 123-1478; 18779, TTYH1, 94149, 196599, 123-1478; 18779, TTYH1, 94150, 196600, 104-1456; 18779, TTYH1, 94151, 196601, 104-1456; 18779, TTYH1, 94153, 196603, 123-1478; 18779, TTYH1, 94155, 196605, 92-811; 18779, TTYH1, 94156, 196606, 488-1450; 18779, TTYH1, 94158, 196608, 92-811; 18779, TTYH1, 94159, 196609, 28-1410; 18779, TTYH1, 94160, 196610, 128-1480; 18779, TTYH1, 94161, 196611, 28-1410; 18779, TTYH1, 94162, 196612, 28-1410; 18780, TTYH2, 94165, 196615, 32-1573; 18780, TTYH2, 94166, 196616, 1-415; 18780, TTYH2, 94167, 196617, 1-414; 18780, TTYH2, 94163, 196613, 75-1679; 18780, TTYH2, 94164, 196614, 1213-1854; 18781, TTYH3, 94169, 196619, 212-560; 18781, TTYH3, 94172, 196622, 1-561; 18781, TTYH3, 94168, 196618, 206-1777; 18781, TTYH3, 94170, 196620, 144-1202; 18781, TTYH3, 94171, 196621, 1-1476; 18782, TWF1, 94174, 196624, 18-377; 18782, TWF1, 94175, 196625, 56-396; 18782, TWF1, 94176, 196626, 52-925; 18782, TWF1, 94177, 196627, 538-582; 18782, TWF1, 94178, 196628, 84-263; 18782, TWF1, 94173, 196623, 131-1183; 18782, TWF1, 94179, 196629, 392-1150; 18782, TWF1, 94180, 196630, 5-1078; 18783, TWF2, 94182, 196632, 127-891; 18783, TWF2, 94181, 196631, 245-1294; 18784, TWIST1, 94184, 196634, 1-406; 18784, TWIST1, 94185, 196635, 1-212; 18784, TWIST1, 94183, 196633, 352-960; 18785, TWIST2, 94186, 196636, 185-667; 18785, TWIST2, 94187, 196637, 185-667; 18786, TWISTNB, 94188, 196638, 72-1088; 18787, TWSG1, 94191, 196641, 109-663; 18787, TWSG1, 94189, 196639, 192-863; 18787, TWSG1, 94190, 196640, 192-419; 18788, TPCN1, 94193, 196643, 194-2440; 18788, TPCN1, 94195, 196645, 469-828; 18788, TPCN1, 94196, 196646, 273-527; 18788, TPCN1, 94197, 196647, 272-570; 18788, TPCN1, 94198, 196648, 158-530; 18788, TPCN1, 94199, 196649, 118-762; 18788, TPCN1, 94200, 196650, 148-526; 18788, TPCN1, 94201, 196651, 1-313; 18788, TPCN1, 94203, 196653, 159-593; 18788, TPCN1, 94204, 196654, 246-544; 18788, TPCN1, 94205, 196655, 124-564; 18788, TPCN1, 94206, 196656, 1-610; 18788, TPCN1, 94207, 196657, 274-596; 18788, TPCN1, 94192, 196642, 315-2765; 18788, TPCN1, 94194, 196644, 1-2667; 18788, TPCN1, 94202, 196652, 170-2836; 18789, TPCN2, 94209, 196659, 38-1750; 18789, TPCN2, 94208, 196658, 102-2360; 18790, TXK, 94211, 196661, 18-266; 18790, TXK, 94212, 196662, 128-542; 18790, TXK, 94213, 196663, 129-677; 18790, TXK, 94214, 196664, 130-276; 18790, TXK, 94210, 196660, 87-1670; 18791, TYROBP, 94216, 196666, 68-373; 18791, TYROBP, 94218, 196668, 68-175; 18791, TYROBP, 94219, 196669, 68-175; 18791, TYROBP, 94221, 196671, 20-454; 18791, TYROBP, 94215, 196665, 68-409; 18791, TYROBP, 94217, 196667, 48-356; 18791, TYROBP, 94220, 196670, 68-406; 18792, TYRO3, 94223, 196673, 1-66; 18792, TYRO3, 94224, 196674, 1-365; 18792, TYRO3, 94225, 196675, 810-3347; 18792, TYRO3, 94226, 196676, 1-856; 18792, TYRO3, 94222, 196672, 225-2897; 18793, TYR, 94227, 196677, 503-2092; 18794, TYRP1, 94228, 196678, 76-819; 18794, TYRP1, 94230, 196680, 243-549; 18794, TYRP1, 94229, 196679, 130-1743; 18795, YWHAB, 94233, 196683, 334-556; 18795, YWHAB, 94234, 196684, 349-648; 18795, YWHAB, 94235, 196685, 189-638; 18795, YWHAB, 94236, 196686, 1-244; 18795, YWHAB, 94231, 196681, 215-955; 18795, YWHAB, 94232, 196682, 275-1015; 18796, YWHAE, 94238, 196688, 72-188; 18796, YWHAE, 94239, 196689, 105-428; 18796, YWHAE, 94241, 196691, 97-381; 18796, YWHAE, 94242, 196692, 1-329; 18796, YWHAE, 94243, 196693, 1-348; 18796, YWHAE, 94245, 196695, 97-381; 18796, YWHAE, 94246, 196696, 72-188; 18796, YWHAE, 94247, 196697, 1-329; 18796, YWHAE, 94249, 196699, 1-348; 18796, YWHAE, 94250, 196700, 105-428; 18796, YWHAE, 94237, 196687, 269-1036; 18796, YWHAE, 94240, 196690, 210-911; 18796, YWHAE, 94244, 196694, 210-911; 18796, YWHAE, 94248, 196698, 269-1036; 18797, YWHAH, 94252, 196702, 213-431; 18797, YWHAH, 94253, 196703, 17-502; 18797, YWHAH, 94254, 196704, 213-332; 18797, YWHAH, 94251, 196701, 274-1014; 18798, YWHAG, 94255, 196705, 224-967; 18799, YWHAQ, 94258, 196708, 217-665; 18799, YWHAQ, 94256, 196706, 157-894; 18799, YWHAQ, 94257, 196707, 165-902; 18800, YWHAZ, 94260, 196710, 216-722; 18800, YWHAZ, 94266, 196716, 426-701; 18800, YWHAZ, 94269, 196719, 703-996; 18800, YWHAZ, 94270, 196720, 341-567; 18800, YWHAZ, 94271, 196721, 331-708; 18800, YWHAZ, 94272, 196722, 1-393; 18800, YWHAZ, 94273, 196723, 100-511; 18800, YWHAZ, 94274, 196724, 158-535; 18800, YWHAZ, 94275, 196725, 12-750; 18800, YWHAZ, 94277, 196727, 472-626; 18800, YWHAZ, 94259, 196709, 85-822; 18800, YWHAZ, 94261, 196711, 164-901; 18800, YWHAZ, 94262, 196712, 151-888; 18800, YWHAZ, 94263, 196713, 227-964; 18800, YWHAZ, 94264, 196714, 343-1080; 18800, YWHAZ, 94265, 196715, 213-950; 18800, YWHAZ, 94267, 196717, 103-840; 18800, YWHAZ, 94268, 196718, 156-893; 18800, YWHAZ, 94276, 196726, 18-530; 18801, TAT, 94278, 196728, 135-1499; 18802, TH, 94279, 196729, 20-154; 18802, TH, 94282, 196732, 20-166; 18802, TH, 94285, 196735, 1-136; 18802, TH, 94286, 196736, 1-347; 18802, TH, 94280, 196730, 92-1585; 18802, TH, 94281, 196731, 20-1231; 18802, TH, 94283, 196733, 20-1594; 18802, TH, 94284, 196734, 20-1606; 18803, TYK2, 94289, 196739, 1-247; 18803, TYK2, 94290, 196740, 332-3097; 18803, TYK2, 94291, 196741, 147-3155; 18803, TYK2, 94292, 196742, 1-194; 18803, TYK2, 94293, 196743, 1-583; 18803, TYK2, 94294, 196744, 456-842; 18803, TYK2, 94295, 196745, 289-644; 18803, TYK2, 94296, 196746, 317-720; 18803, TYK2, 94297, 196747, 1-429; 18803, TYK2, 94298, 196748, 1-407; 18803, TYK2, 94299, 196749, 58-368; 18803, TYK2, 94287, 196737, 103-3666; 18803, TYK2, 94288, 196738, 483-4046; 18804, TIE1, 94300, 196750, 80-3496; 18804, TIE1, 94301, 196751, 1-1140; 18805, TNK1, 94304, 196754, 1-253; 18805, TNK1, 94305, 196755, 1-11; 18805, TNK1, 94306, 196756, 116-349; 18805, TNK1, 94302, 196752, 447-2432; 18805, TNK1, 94303, 196753, 370-2370; 18806, TNK2, 94309, 196759, 113-541; 18806, TNK2, 94310, 196760, 1-726; 18806, TNK2, 94311, 196761, 1-870; 18806, TNK2, 94312, 196762, 297-3419; 18806, TNK2, 94313, 196763, 210-470; 18806, TNK2, 94314, 196764, 288-580; 18806, TNK2, 94316, 196766, 1-1824; 18806, TNK2, 94317, 196767, 1-432; 18806, TNK2, 94318, 196768, 1-600; 18806, TNK2, 94307, 196757, 619-3735; 18806, TNK2, 94308, 196758, 146-3406; 18806, TNK2, 94315, 196765, 58-1644; 18807, N/A, 94319, 196769, 1-4221; 18807, N/A, 94320, 196770, 266-4486; 18808, TDP1, 94322, 196772, 300-2069; 18808, TDP1, 94324, 196774, 244-1140; 18808, TDP1, 94325, 196775, 11-1747; 18808, TDP1, 94326, 196776, 218-876; 18808, TDP1, 94327, 196777, 1-844; 18808, TDP1, 94328, 196778, 72-910; 18808, TDP1, 94329, 196779, 473-910; 18808, TDP1, 94330, 196780, 1-156; 18808, TDP1, 94331, 196781, 970-1545; 18808, TDP1, 94332, 196782, 113-597; 18808, TDP1, 94333, 196783, 294-748; 18808, TDP1, 94334, 196784, 286-728; 18808, TDP1, 94335, 196785, 237-1016; 18808, TDP1, 94321, 196771, 251-2077; 18808, TDP1, 94323, 196773, 41-1867; 18809, TDP2, 94336, 196786, 397-1311; 18809, TDP2, 94337, 196787, 172-1260; 18810, TPST1, 94339, 196789, 141-562; 18810, TPST1, 94340, 196790, 436-560; 18810, TPST1, 94338, 196788, 426-1538; 18811, TPST2, 94344, 196794, 223-582; 18811, TPST2, 94345, 196795, 369-514; 18811, TPST2, 94346, 196796, 1-507; 18811, TPST2, 94347, 196797, 162-586; 18811, TPST2, 94348, 196798, 404-544; 18811, TPST2, 94349, 196799, 353-544; 18811, TPST2, 94341, 196791, 272-1405; 18811, TPST2, 94342, 196792, 306-1439; 18811, TPST2, 94343, 196793, 422-1555; 18812, YARS, 94351, 196801, 1-1167; 18812, YARS, 94350, 196800, 910-2496; 18813, YARS2, 94353, 196803, 1-876; 18813, YARS2, 94352, 196802, 29-1462; 18814, U2AF1, 94354, 196804, 94-816; 18814, U2AF1, 94355, 196805, 72-794; 18814, U2AF1, 94356, 196806, 371-874; 18814, U2AF1, 94357, 196807, 1026-1529; 18814, U2AF1, 94358, 196808, 31-258; 18815, U2AF1L4, 94362, 196812, 24-143; 18815, U2AF1L4, 94363, 196813, 28-183; 18815, U2AF1L4, 94364, 196814, 234-263; 18815, U2AF1L4, 94365, 196815, 26-226; 18815, U2AF1L4, 94366, 196816, 1-102; 18815, U2AF1L4, 94367, 196817, 1-111; 18815, U2AF1L4, 94368, 196818, 1-214; 18815, U2AF1L4, 94369, 196819, 1-123; 18815, U2AF1L4, 94359, 196809, 55-663; 18815, U2AF1L4, 94360, 196810, 15-560; 18815, U2AF1L4, 94361, 196811, 52-714; 18816, U2AF1L5, 94370, 196820, 31-258; 18816, U2AF1L5, 94371, 196821, 31-753; 18816, U2AF1L5, 94372, 196822, 29-751; 18816, U2AF1L5, 94373, 196823, 1026-1529; 18817, U2AF2, 94376, 196826, 1-259; 18817, U2AF2, 94377, 196827, 10-933; 18817, U2AF2, 94378, 196828, 1-155; 18817, U2AF2, 94374, 196824, 41-1468; 18817, U2AF2, 94375, 196825, 960-2375; 18818, U2SURP, 94379, 196829, 1-871; 18818, U2SURP, 94380, 196830, 106-588; 18818, U2SURP, 94382, 196832, 1-1320; 18818, U2SURP, 94383, 196833, 180-571; 18818, U2SURP, 94384, 196834, 9-3095; 18818, U2SURP, 94385, 196835, 462-1739; 18818, U2SURP, 94386, 196836, 350-725; 18818, U2SURP, 94381, 196831, 91-3180; 18819, UHMK1, 94387, 196837, 159-1418; 18819, UHMK1, 94388, 196838, 1-1038; 18819, UHMK1, 94389, 196839, 197-1231; 18820, N/A, 94390, 196840, 31-564; 18821, USB1, 94394, 196844, 65-556; 18821, USB1, 94395, 196845, 194-838; 18821, USB1, 94396, 196846, 64-351; 18821, USB1, 94397, 196847, 124-671; 18821, USB1, 94391, 196841, 112-909; 18821, USB1, 94392, 196842, 78-638; 18821, USB1, 94393, 196843, 80-823; 18822, N/A, 94398, 196848, 221-1330; 18822, N/A, 94399, 196849, 249-2192; 18823, UBAC1, 94400, 196850, 219-1436; 18824, UBAC2, 94401, 196851, 136-748; 18824, UBAC2, 94404, 196854, 221-627; 18824, UBAC2, 94405, 196855, 1-132; 18824, UBAC2, 94402, 196852, 504-1433; 18824, UBAC2, 94403, 196853, 136-1170; 18825, UBALD1, 94407, 196857, 172-525; 18825, UBALD1, 94408, 196858, 80-281; 18825, UBALD1, 94410, 196860, 77-445; 18825, UBALD1, 94411, 196861, 504-659; 18825, UBALD1, 94412, 196862, 78-362; 18825, UBALD1, 94413, 196863, 76-534; 18825, UBALD1, 94414, 196864, 85-555; 18825, UBALD1, 94406, 196856, 130-663; 18825, UBALD1, 94409, 196859, 1253-1891; 18826, UBALD2, 94416, 196866, 265-579; 18826, UBALD2, 94417, 196867, 94-286; 18826, UBALD2, 94415, 196865, 305-799; 18827, UBE2F-SCLY, 94418, 196868, 75-470; 18827, UBE2F-SCLY, 94419, 196869, 136-357; 18828, UBIAD1, 94422, 196872, 1-234; 18828, UBIAD1, 94423, 196873, 1-357; 18828, UBIAD1, 94420, 196870, 5-544; 18828, UBIAD1, 94421, 196871, 327-1343; 18829, UBN1, 94426, 196876, 1-937; 18829, UBN1, 94427, 196877, 1769-2305; 18829, UBN1, 94428, 196878, 1-216; 18829, UBN1, 94430, 196880, 1-169; 18829, UBN1, 94424, 196874, 620-4024; 18829, UBN1, 94425, 196875, 704-4108; 18829, UBN1, 94429, 196879, 54-3368; 18830, UBN2, 94431, 196881, 1-1334; 18830, UBN2, 94432, 196882, 177-589; 18830, UBN2, 94433, 196883, 1-4044; 18831, UBQLN1, 94436, 196886, 1-471; 18831, UBQLN1, 94437, 196887, 1-475; 18831, UBQLN1, 94434, 196884, 256-1941; 18831, UBQLN1, 94435, 196885, 525-2294; 18832, UBQLN2, 94438, 196888, 236-2110; 18833, UBQLN3, 94440, 196890, 155-817; 18833, UBQLN3, 94439, 196889, 149-2116; 18834, UBQLN4, 94441, 196891, 94-1899; 18835, UBQLNL, 94442, 196892, 265-1692; 18836, UQCRB, 94444, 196894, 17-502; 18836, UQCRB, 94445, 196895, 70-300; 18836, UQCRB, 94447, 196897, 17-502; 18836, UQCRB, 94448, 196898, 14-94; 18836, UQCRB, 94443, 196893, 105-440; 18836, UQCRB, 94446, 196896, 10-432; 18837, UQCC1, 94450, 196900, 8-667; 18837, UQCC1, 94454, 196904, 11-79; 18837, UQCC1, 94455, 196905, 11-160; 18837, UQCC1, 94456, 196906, 12-677; 18837, UQCC1, 94457, 196907, 122-802; 18837, UQCC1, 94458, 196908, 1-381; 18837, UQCC1, 94459, 196909, 7-736; 18837, UQCC1, 94460, 196910, 11-758; 18837, UQCC1, 94461, 196911, 1-166; 18837, UQCC1, 94462, 196912, 8-382; 18837, UQCC1, 94463, 196913, 11-145; 18837, UQCC1, 94449, 196899, 1-819; 18837, UQCC1, 94451, 196901, 69-764; 18837, UQCC1, 94452, 196902, 11-832; 18837, UQCC1, 94453, 196903, 179-1078; 18838, UQCC2, 94464, 196914, 42-347; 18838,

UQCC2, 94465, 196915, 1-379; 18838, UQCC2, 94466, 196916, 42-422; 18839, UQCC3, 94467, 196917, 93-374; 18839, UQCC3, 94468, 196918, 544-825; 18840, UQCRC1, 94470, 196920, 17-223; 18840, UQCRC1, 94471, 196921, 7-372; 18840, UQCRC1, 94469, 196919, 418-1860; 18841, UQCRC2, 94473, 196923, 38-565; 18841, UQCRC2, 94474, 196924, 54-1292; 18841, UQCRC2, 94475, 196925, 38-1048; 18841, UQCRC2, 94476, 196926, 22-372; 18841, UQCRC2, 94477, 196927, 127-525; 18841, UQCRC2, 94478, 196928, 1-211; 18841, UQCRC2, 94479, 196929, 137-535; 18841, UQCRC2, 94472, 196922, 765-2126; 18842, UQCRH, 94481, 196931, 59-367; 18842, UQCRH, 94482, 196932, 70-246; 18842, UQCRH, 94480, 196930, 137-412; 18843, UQCRHL, 94483, 196933, 1700-1975; 18844, UQCRQ, 94484, 196934, 237-485; 18844, UQCRQ, 94485, 196935, 76-324; 18844, UQCRQ, 94486, 196936, 142-390; 18845, UQCR10, 94489, 196939, 1-399; 18845, UQCR10, 94487, 196937, 31-222; 18845, UQCR10, 94488, 196938, 26-214; 18846, UQCR11, 94490, 196940, 65-235; 18846, UQCR11, 94491, 196941, 82-252; 18846, UQCR11, 94492, 196942, 28-198; 18847, UQCRFS1, 94493, 196943, 424-1248; 18848, UBA52, 94501, 196951, 1-345; 18848, UBA52, 94502, 196952, 738-927; 18848, UBA52, 94505, 196955, 1-417; 18848, UBA52, 94494, 196944, 59-445; 18848, UBA52, 94495, 196945, 95-481; 18848, UBA52, 94496, 196946, 301-687; 18848, UBA52, 94497, 196947, 230-616; 18848, UBA52, 94498, 196948, 299-685; 18848, UBA52, 94499, 196949, 17-403; 18848, UBA52, 94500, 196950, 273-659; 18848, UBA52, 94503, 196953, 116-502; 18848, UBA52, 94504, 196954, 262-648; 18848, UBA52, 94506, 196956, 37-423; 18849, UBASH3A, 94510, 196960, 61-567; 18849, UBASH3A, 94511, 196961, 30-1385; 18849, UBASH3A, 94512, 196962, 66-233; 18849, UBASH3A, 94513, 196963, 35-151; 18849, UBASH3A, 94514, 196964, 66-1631; 18849, UBASH3A, 94507, 196957, 85-1956; 18849, UBASH3A, 94508, 196958, 32-2017; 18849, UBASH3A, 94509, 196959, 30-1610; 18850, UBASH3B, 94515, 196965, 376-2325; 18851, UBAP1, 94520, 196970, 1-1587; 18851, UBAP1, 94516, 196966, 236-1744; 18851, UBAP1, 94517, 196967, 37-1545; 18851, UBAP1, 94518, 196968, 211-1536; 18851, UBAP1, 94519, 196969, 11-1711; 18852, UBAP1L, 94522, 196972, 27-380; 18852, UBAP1L, 94521, 196971, 145-1290; 18852, UBAP1L, 94523, 196973, 222-1367; 18853, UBAP2, 94527, 196977, 1-833; 18853, UBAP2, 94528, 196978, 114-1349; 18853, UBAP2, 94529, 196979, 1-354; 18853, UBAP2, 94530, 196980, 114-1859; 18853, UBAP2, 94531, 196981, 79-609; 18853, UBAP2, 94524, 196974, 114-3473; 18853, UBAP2, 94525, 196975, 119-3478; 18853, UBAP2, 94526, 196976, 626-1702; 18854, UBAP2L, 94532, 196982, 168-3407; 18854, UBAP2L, 94535, 196985, 70-1120; 18854, UBAP2L, 94536, 196986, 139-980; 18854, UBAP2L, 94538, 196988, 115-911; 18854, UBAP2L, 94539, 196989, 1-1150; 18854, UBAP2L, 94540, 196990, 132-678; 18854, UBAP2L, 94541, 196991, 1-1198; 18854, UBAP2L, 94542, 196992, 110-812; 18854, UBAP2L, 94533, 196983, 107-3058; 18854, UBAP2L, 94534, 196984, 43-3306; 18854, UBAP2L, 94537, 196987, 168-3431; 18854, UBAP2L, 94543, 196993, 168-3098; 18855, UBB, 94547, 196997, 101-562; 18855, UBB, 94548, 196998, 106-724; 18855, UBB, 94549, 196999, 222-500; 18855, UBB, 94550, 197000, 246-376; 18855, UBB, 94544, 196994, 393-1082; 18855, UBB, 94545, 196995, 182-871; 18855, UBB, 94546, 196996, 180-869; 18855, UBB, 94551, 197001, 222-911; 18856, UBC, 94553, 197003, 215-582; 18856, UBC, 94554, 197004, 150-559; 18856, UBC, 94555, 197005, 19-708; 18856, UBC, 94556, 197006, 115-563; 18856, UBC, 94557, 197007, 74-582; 18856, UBC, 94558, 197008, 226-627; 18856, UBC, 94560, 197010, 333-517; 18856, UBC, 94561, 197011, 141-622; 18856, UBC, 94562, 197012, 318-1235; 18856, UBC, 94563, 197013, 83-548; 18856, UBC, 94552, 197002, 565-2622; 18856, UBC, 94559, 197009, 1578-3635; 18857, UCHL1, 94566, 197016, 46-516; 18857, UCHL1, 94567, 197017, 33-758; 18857, UCHL1, 94568, 197018, 67-276; 18857, UCHL1, 94569, 197019, 272-445; 18857, UCHL1, 94570, 197020, 38-661; 18857, UCHL1, 94564, 197014, 145-816; 18857, UCHL1, 94565, 197015, 63-734; 18858, UCHL3, 94572, 197022, 1-687; 18858, UCHL3, 94573, 197023, 258-842; 18858, UCHL3, 94571, 197021, 31-723; 18859, UCHL5, 94576, 197026, 1-1107; 18859, UCHL5, 94577, 197027, 90-1157; 18859, UCHL5, 94580, 197030, 61-834; 18859, UCHL5, 94581, 197031, 1-550; 18859, UCHL5, 94582, 197032, 1-298; 18859, UCHL5, 94583, 197033, 1-346; 18859, UCHL5, 94584, 197034, 1-656; 18859, UCHL5, 94585, 197035, 83-577; 18859, UCHL5, 94574, 197024, 102-1082; 18859, UCHL5, 94575, 197025, 150-1100; 18859, UCHL5, 94578, 197028, 237-1223; 18859, UCHL5, 94579, 197029, 237-1226; 18860, UBD, 94588, 197038, 225-722; 18860, UBD, 94590, 197040, 225-722; 18860, UBD, 94591, 197041, 225-722; 18860, UBD, 94586, 197036, 225-722; 18860, UBD, 94587, 197037, 225-722; 18860, UBD, 94589, 197039, 225-722; 18860, UBD, 94592, 197042, 225-722; 18861, UBTD1, 94593, 197043, 337-1020; 18862, UBTD2, 94594, 197044, 407-1111; 18863, UBFD1, 94596, 197046, 28-930; 18863, UBFD1, 94597, 197047, 17-589; 18863, UBFD1, 94595, 197045, 382-1311; 18864, UFD1L, 94600, 197050, 118-596; 18864, UFD1L, 94601, 197051, 101-670; 18864, UFD1L, 94602, 197052, 86-293; 18864, UFD1L, 94603, 197053, 182-588; 18864, UFD1L, 94598, 197048, 131-1054; 18864, UFD1L, 94599, 197049, 88-888; 18865, UIMC1, 94606, 197056, 155-249; 18865, UIMC1, 94608, 197058, 148-619; 18865, UIMC1, 94609, 197059, 159-425; 18865, UIMC1, 94610, 197060, 75-575; 18865, UIMC1, 94604, 197054, 134-2293; 18865, UIMC1, 94605, 197055, 111-2270; 18865, UIMC1, 94607, 197057, 69-1118; 18865, UIMC1, 94611, 197061, 52-1713; 18866, UBR1, 94613, 197063, 86-274; 18866, UBR1, 94614, 197064, 1-219; 18866, UBR1, 94615, 197065, 1-447; 18866, UBR1, 94616, 197066, 67-162; 18866, UBR1, 94617, 197067, 1-517; 18866, UBR1, 94618, 197068, 1-214; 18866, UBR1, 94619, 197069, 92-3304; 18866, UBR1, 94620, 197070, 1-189; 18866, UBR1, 94612, 197062, 80-5329; 18867, UBR2, 94621, 197071, 259-5526; 18867, UBR2, 94622, 197072, 259-5526; 18867, UBR2, 94623, 197073, 259-1578; 18868, UBR3, 94625, 197075, 1-2852; 18868, UBR3, 94626, 197076, 1-1767; 18868, UBR3, 94628, 197078, 1-234; 18868, UBR3, 94629, 197079, 1-1153; 18868, UBR3, 94624, 197074, 51-5717; 18868, UBR3, 94627, 197077, 1-5667; 18869, UBR4, 94631, 197081, 485-3157; 18869, UBR4, 94632, 197082, 435-1211; 18869, UBR4, 94634, 197084, 1-2954; 18869, UBR4, 94635, 197085, 1-6175; 18869, UBR4, 94630, 197080, 1154-1792; 18869, UBR4, 94633, 197083, 29-15580; 18870, UBR5, 94637, 197087, 526-8904; 18870, UBR5, 94638, 197088, 64-563; 18870, UBR5, 94639, 197089, 1-602; 18870, UBR5, 94640, 197090, 244-1827; 18870, UBR5, 94642, 197092, 1-582; 18870, UBR5, 94636, 197086, 456-8852; 18870, UBR5, 94641, 197091, 608-9007; 18871, UBR7, 94644, 197094, 331-1413; 18871, UBR7, 94645, 197095, 50-214; 18871, UBR7, 94646, 197096, 52-587; 18871, UBR7, 94647, 197097, 50-507; 18871, UBR7, 94648, 197098, 1-490; 18871, UBR7, 94649, 197099, 1-522; 18871, UBR7, 94650, 197100, 1-373; 18871, UBR7, 94651, 197101, 331-1413; 18871, UBR7, 94653, 197103, 1-490; 18871, UBR7, 94654, 197104, 1-522; 18871, UBR7, 94655, 197105, 1-373; 18871, UBR7, 94656, 197106, 50-507; 18871, UBR7, 94657, 197107, 52-587; 18871, UBR7, 94643, 197093, 237-1514; 18871, UBR7, 94652, 197102, 237-1514; 18872, UBE3A, 94663, 197113, 1-570; 18872, UBE3A, 94665, 197115, 306-424; 18872, UBE3A, 94666, 197116, 445-889; 18872, UBE3A, 94667, 197117, 371-394; 18872, UBE3A, 94669, 197119, 146-706; 18872, UBE3A, 94670, 197120, 612-654; 18872, UBE3A, 94671, 197121, 966-1112; 18872, UBE3A, 94672, 197122, 204-436; 18872, UBE3A, 94673, 197123, 1-430; 18872, UBE3A, 94674, 197124, 604-2901; 18872, UBE3A, 94675, 197125, 61-772; 18872, UBE3A, 94676, 197126, 1688-1873; 18872, UBE3A, 94677, 197127, 631-779; 18872, UBE3A, 94658, 197108, 609-3167; 18872, UBE3A, 94659, 197109, 246-2873; 18872, UBE3A, 94660, 197110, 397-2955; 18872, UBE3A, 94661, 197111, 100-2658; 18872, UBE3A, 94662, 197112, 587-3145; 18872, UBE3A, 94664, 197114, 714-3332; 18872, UBE3A, 94668, 197118, 627-3185; 18873, UBE3B, 94682, 197132, 238-981; 18873, UBE3B, 94684, 197134, 149-2763; 18873, UBE3B, 94686, 197136, 1-528; 18873, UBE3B, 94678, 197128, 596-3802; 18873, UBE3B, 94679, 197129, 586-1320; 18873, UBE3B, 94680, 197130, 491-3697; 18873, UBE3B, 94681, 197131, 585-2711; 18873, UBE3B, 94683, 197133, 258-992; 18873, UBE3B, 94685, 197135, 252-986; 18874, UBE3C, 94689, 197139, 1-171; 18874, UBE3C, 94687, 197137, 361-3612; 18874, UBE3C, 94688, 197138, 79-1293; 18874, UBE3C, 94690, 197140, 317-1531; 18875, UBE3D, 94691, 197141, 124-234; 18875, UBE3D, 94692, 197142, 1-551; 18875, UBE3D, 94694, 197144, 122-490; 18875, UBE3D, 94695, 197145, 106-219; 18875, UBE3D, 94696, 197146, 34-888; 18875, UBE3D, 94697, 197147, 1-114; 18875, UBE3D, 94693, 197143, 124-1293; 18876, URM1, 94698, 197148, 11-202; 18876, URM1, 94702, 197152, 21-212; 18876, URM1, 94699, 197149, 21-212; 18876, URM1, 94700, 197150, 63-368; 18876, URM1, 94701, 197151, 1-441; 18877, USP1, 94705, 197155, 240-502; 18877, USP1, 94706, 197156, 336-893; 18877, USP1, 94703, 197153, 816-3173; 18877, USP1, 94704, 197154, 329-2686; 18878, USP10, 94708, 197158, 97-285; 18878, USP10, 94709, 197159, 52-502; 18878, USP10, 94710, 197160, 88-195; 18878, USP10, 94711, 197161, 84-275; 18878, USP10, 94712, 197162, 1-229; 18878, USP10, 94713, 197163, 146-569; 18878, USP10, 94714, 197164, 1-330; 18878, USP10, 94716, 197166, 97-570; 18878, USP10, 94717, 197167, 107-730; 18878, USP10, 94707, 197157, 114-2510; 18878, USP10, 94715, 197165, 197-2605; 18879, USP11, 94719, 197169, 656-1077; 18879, USP11, 94720, 197170, 657-804; 18879, USP11, 94721, 197171, 355-3117; 18879, USP11, 94718, 197168, 50-2941; 18880, USP12, 94723, 197173, 63-119; 18880, USP12, 94724, 197174, 1-271; 18880, USP12, 94722, 197172, 258-1370; 18881, USP13, 94727, 197177, 1-228; 18881, USP13, 94728, 197178, 1-899; 18881, USP13, 94725, 197175, 472-3063; 18881, USP13, 94726, 197176, 86-2482; 18882, USP14, 94730, 197180, 109-1455; 18882, USP14, 94732, 197182, 419-503; 18882, USP14, 94733, 197183, 413-474; 18882, USP14, 94735, 197185, 1-100; 18882, USP14, 94729, 197179, 92-1576; 18882, USP14, 94731, 197181, 164-1615; 18882, USP14, 94734, 197184, 317-1696; 18883, USP15, 94739, 197189, 1-150; 18883, USP15, 94740, 197190, 161-579; 18883, USP15, 94741, 197191, 1-263; 18883, USP15, 94742, 197192, 60-584; 18883, USP15, 94743, 197193, 1-474; 18883, USP15, 94744, 197194, 1-722; 18883, USP15, 94745, 197195, 480-799; 18883, USP15, 94736, 197186, 78-2936; 18883, USP15, 94737, 197187, 59-3004; 18883, USP15, 94738, 197188, 19-726; 18884, USP16, 94747, 197197, 259-581; 18884, USP16, 94746, 197196, 232-2703; 18884, USP16, 94748, 197198, 191-2659; 18884, USP16, 94749, 197199, 191-2662; 18885, USP17L1, 94750, 197200, 1-1593; 18886, USP17L10, 94751, 197201, 1-1677; 18886, USP17L10, 94752, 197202, 1-1593; 18887, USP17L11, 94754, 197204, 1-1677; 18887, USP17L11, 94753, 197203, 1-1593; 18888, USP17L12, 94755, 197205, 1-1593; 18889, USP17L13, 94757, 197207, 1-1677; 18889, USP17L13, 94756, 197206, 1-1593; 18890, USP17L15, 94759, 197209, 1-1680; 18890, USP17L15, 94760, 197210, 1-1680; 18890, USP17L15, 94758, 197208, 1-1590; 18891, USP17L17, 94762, 197212, 1-1677; 18891, USP17L17, 94761, 197211, 1-1593; 18892, USP17L18, 94764, 197214, 1-1677; 18892, USP17L18, 94763, 197213, 1-1593; 18893, USP17L19, 94766, 197216, 1-1677; 18893, USP17L19, 94765, 197215, 1-1593; 18894, USP17L2, 94767, 197217, 318-1910; 18895, USP17L20, 94769, 197219, 1-1677; 18895, USP17L20, 94768, 197218, 1-1593; 18896, USP17L21, 94771, 197221, 1-1677; 18896, USP17L21, 94770, 197220, 1-1593; 18897, USP17L22, 94773, 197223, 1-1677; 18897, USP17L22, 94772, 197222, 1-1593; 18898, USP17L23, 94774, 197224, 1-551; 18899, USP17L24, 94776, 197226, 1-1677; 18899, USP17L24, 94775, 197225, 1-1593; 18900, USP17L25, 94778, 197228, 1-1677; 18900, USP17L25, 94777, 197227, 1-1593; 18901, USP17L26, 94780, 197230, 1-1677; 18901, USP17L26, 94779, 197229, 1-1593; 18902, USP17L27, 94781, 197231, 1-1593; 18903, USP17L28, 94782, 197232, 1-1593; 18904, USP17L29, 94783, 197233, 1-1593; 18905, USP17L3, 94784, 197234, 1-1593; 18906, USP17L30, 94785, 197235, 1-1593; 18907, USP17L4, 94786, 197236, 1-1593; 18908, USP17L5, 94787, 197237, 1-1593; 18909, USP17L7, 94788, 197238, 436-2028; 18910, USP17L8, 94789, 197239, 1-1593; 18910, USP17L8, 94790, 197240, 1-1593; 18911, USP18, 94791, 197241, 431-1549; 18912, USP19, 94792, 197242, 200-1905; 18912, USP19, 94794, 197244, 261-4337; 18912, USP19, 94795, 197245, 1-3541; 18912, USP19, 94796, 197246, 143-4108; 18912, USP19, 94800, 197250, 1-360; 18912, USP19, 94793, 197243, 320-4276; 18912, USP19, 94797, 197247, 190-4344; 18912, USP19, 94798, 197248, 320-4438; 18912, USP19, 94799, 197249, 213-4472; 18913, USP2, 94803, 197253, 151-563; 18913, USP2, 94804, 197254, 175-677; 18913, USP2, 94801, 197251, 296-2113; 18913, USP2, 94802, 197252, 195-1283; 18913, USP2, 94805, 197255, 213-1403; 18914, USP20, 94806, 197256, 159-2903; 18914, USP20, 94807, 197257, 249-2993; 18914, USP20, 94808, 197258, 183-2927; 18915, USP21, 94812, 197262, 392-1150; 18915, USP21, 94813, 197263, 358-709; 18915, USP21, 94809, 197259, 222-1919; 18915, USP21, 94810, 197260, 164-1819; 18915, USP21, 94811, 197261, 378-2075; 18916, USP22, 94816, 197266, 1-585; 18916, USP22, 94817, 197267, 1-306; 18916, USP22, 94818, 197268, 199-573; 18916, USP22, 94819, 197269, 234-554; 18916, USP22, 94814, 197264, 205-1782; 18916, USP22, 94815, 197265, 1-1542; 18917, USP24, 94821, 197271, 1-453; 18917, USP24, 94822, 197272, 1-105; 18917, USP24, 94820, 197270, 1-7863; 18918, USP25, 94825, 197275, 370-1722; 18918, USP25, 94827, 197277, 1-687; 18918, USP25, 94828, 197278, 1-611; 18918, USP25, 94823, 197273, 370-3537; 18918, USP25, 94824, 197274, 370-3633; 18918, USP25, 94826, 197276, 370-3747; 18919, USP26, 94829, 197279, 53-2794; 18919, USP26, 94830, 197280, 471-3212; 18920, USP27X, 94831, 197281, 361-1677; 18921, USP28, 94833, 197283, 405-542; 18921, USP28, 94834, 197284, 1-122; 18921, USP28, 94835, 197285, 1-154; 18921, USP28, 94836, 197286, 1-582; 18921, USP28, 94837, 197287, 1-732; 18921, USP28, 94838, 197288, 66-650; 18921, USP28, 94839, 197289, 1-1081; 18921, USP28, 94840, 197290, 89-2350; 18921, USP28, 94841, 197291, 234-2996; 18921, USP28, 94842, 197292, 1-274; 18921, USP28, 94844, 197294, 329-561; 18921, USP28, 94832, 197282, 70-3303; 18921, USP28, 94843, 197293, 28-1779; 18922, USP29, 94846, 197296, 346-437; 18922, USP29, 94848, 197298, 495-533; 18922, USP29, 94845, 197295, 455-3223; 18922, USP29, 94847, 197297, 34-2802; 18923, USP3, 94849, 197299, 1-1497; 18923, USP3, 94851, 197301, 1-20; 18923, USP3, 94853, 197303, 106-276; 18923, USP3, 94854, 197304, 1-1331; 18923, USP3, 94855, 197305, 184-561; 18923, USP3, 94856, 197306, 88-1383; 18923, USP3, 94857, 197307, 146-545; 18923, USP3, 94858, 197308, 7-174; 18923, USP3, 94859, 197309, 1-321; 18923, USP3, 94860, 197310, 102-1613; 18923, USP3, 94861, 197311, 147-542; 18923, USP3, 94862, 197312, 67-306; 18923, USP3, 94863, 197313, 129-299; 18923, USP3, 94864, 197314, 437-554; 18923, USP3, 94850, 197300, 130-1692; 18923, USP3, 94852, 197302, 230-1660; 18924, USP30, 94866, 197316, 577-2037; 18924, USP30, 94867, 197317, 38-476; 18924, USP30, 94868, 197318, 249-534; 18924, USP30, 94869, 197319, 295-826; 18924, USP30, 94870, 197320, 76-183; 18924, USP30, 94871, 197321, 1-276; 18924, USP30, 94865, 197315, 94-1647; 18925, USP31, 94873, 197323, 138-2075; 18925, USP31, 94874, 197324, 1-799; 18925, USP31, 94872, 197322, 1-4059; 18926, USP32, 94877, 197327, 1-739; 18926, USP32, 94878, 197328, 292-691; 18926, USP32, 94879, 197329, 22-2563; 18926, USP32, 94880, 197330, 1-264; 18926, USP32, 94881, 197331, 1-524; 18926, USP32, 94882, 197332, 120-578; 18926, USP32, 94883, 197333, 1-262; 18926, USP32, 94884, 197334, 71-3895; 18926, USP32, 94875, 197325, 196-5010; 18926, USP32, 94876, 197326, 37-1209; 18927, USP33, 94889, 197339, 1-1370; 18927, USP33, 94890, 197340, 1-419; 18927, USP33, 94891, 197341, 218-549; 18927, USP33, 94892, 197342, 343-949; 18927, USP33, 94893, 197343, 172-389; 18927, USP33, 94885, 197335, 1-2829; 18927, USP33, 94886, 197336, 348-2834; 18927, USP33, 94887, 197337, 348-3176; 18927, USP33, 94888, 197338, 262-2997; 18928, USP34, 94895, 197345, 1-136; 18928, USP34, 94896, 197346, 1-1275; 18928, USP34, 94897, 197347, 1-3670; 18928, USP34, 94898, 197348, 1-2433; 18928, USP34, 94894, 197344, 78-10718; 18929, USP35, 94901, 197351, 446-2206; 18929, USP35, 94902, 197352, 315-1209; 18929, USP35, 94903, 197353, 1-325; 18929, USP35, 94899, 197349, 262-3318; 18929, USP35, 94900, 197350, 627-2876; 18930, USP36, 94905, 197355, 1-1647; 18930, USP36, 94907, 197357, 1-304; 18930, USP36, 94908, 197358, 1-73; 18930, USP36, 94909, 197359, 389-546; 18930, USP36, 94910, 197360, 1-215; 18930, USP36, 94911, 197361, 1-209; 18930, USP36, 94912, 197362, 220-924; 18930, USP36, 94913, 197363, 355-594; 18930, USP36, 94914, 197364, 184-960; 18930, USP36, 94916, 197366, 362-898; 18930, USP36, 94917, 197367, 311-1168; 18930, USP36, 94918, 197368, 218-696; 18930, USP36, 94919, 197369, 480-679; 18930, USP36, 94920, 197370, 1-36; 18930, USP36, 94921, 197371, 303-3187; 18930, USP36, 94922, 197372, 225-410; 18930, USP36, 94904, 197354, 326-3697; 18930, USP36, 94906, 197356, 445-3816; 18930, USP36, 94915, 197365, 219-3590; 18931, USP37, 94924, 197374, 379-1287; 18931, USP37, 94923, 197373, 414-3353; 18931, USP37, 94925, 197375, 418-3357; 18931, USP37, 94926, 197376, 299-3238; 18931, USP37, 94927, 197377, 430-3087; 18932, USP38, 94929, 197379, 1-1044; 18932, USP38, 94928, 197378, 507-3635; 18932, USP38, 94930, 197380, 535-3549; 18933, USP39, 94932, 197382, 54-1664; 18933, USP39, 94935, 197385, 222-561; 18933, USP39, 94937, 197387, 224-610; 18933, USP39, 94938, 197388, 10-474; 18933, USP39, 94939, 197389, 1-186; 18933, USP39, 94940, 197390, 224-1687; 18933, USP39, 94931, 197381, 11-1708; 18933, USP39, 94933, 197383, 3-1469; 18933, USP39, 94934, 197384, 28-1725; 18933, USP39, 94936, 197386, 224-1612; 18934, USP4, 94943, 197393, 1-1864; 18934, USP4, 94945, 197395, 13-1104; 18934, USP4, 94941, 197391, 48-2939; 18934, USP4, 94942, 197392, 10-2760; 18934, USP4, 94944, 197394, 13-954; 18935, USP40, 94949, 197399, 1-740; 18935, USP40, 94950, 197400, 1-348; 18935, USP40, 94951, 197401, 71-367; 18935, USP40, 94952, 197402, 1-292; 18935, USP40, 94953, 197403, 1-297; 18935, USP40, 94946, 197396, 119-3826; 18935, USP40, 94947, 197397, 744-1235; 18935, USP40, 94948, 197398, 37-3744; 18935, USP40, 94954, 197404, 1-3744; 18936, USP41, 94955, 197405, 1-920; 18936, USP41, 94956, 197406, 1-1077; 18937, USP42, 94958, 197408, 93-617; 18937, USP42, 94959, 197409, 481-3611; 18937, USP42, 94960, 197410, 66-362; 18937, USP42, 94961, 197411, 66-1490; 18937, USP42, 94962, 197412, 21-680; 18937, USP42, 94957, 197407, 159-4109; 18938, USP43, 94965, 197415, 1-2731; 18938, USP43, 94966, 197416, 1-1947; 18938, USP43, 94963, 197413, 97-3468; 18938, USP43, 94964, 197414, 97-3453; 18939, USP44, 94970, 197420, 174-666; 18939, USP44, 94971, 197421, 71-1561; 18939, USP44, 94972, 197422, 344-677; 18939, USP44, 94967, 197417, 290-2428; 18939, USP44, 94968, 197418, 145-2283; 18939, USP44, 94969, 197419, 361-2499; 18940, USP45, 94973, 197423, 109-978; 18940, USP45, 94975, 197425, 42-2342; 18940, USP45, 94976, 197426, 1-628; 18940, USP45, 94977, 197427, 1-446; 18940, USP45, 94978, 197428, 11-1048; 18940, USP45, 94979, 197429, 1-408; 18940, USP45, 94980, 197430, 534-1403; 18940, USP45, 94982, 197432, 1-575; 18940, USP45, 94983, 197433, 313-469; 18940, USP45, 94974, 197424, 534-2978; 18940, USP45, 94981, 197431, 45-2489; 18941, USP46, 94984, 197434, 141-1160; 18941, USP46, 94986, 197436, 126-248; 18941, USP46, 94988, 197438, 217-387; 18941, USP46, 94989, 197439, 149-271; 18941, USP46, 94985, 197435, 186-1286; 18941, USP46, 94987, 197437, 281-1360; 18942, USP47, 94990, 197440, 764-4627; 18942, USP47, 94991, 197441, 121-4248; 18942, USP47, 94992, 197442, 212-4279; 18943, USP48, 94994, 197444, 1-346; 18943, USP48, 94995, 197445, 958-2523; 18943, USP48, 94998, 197448, 144-549; 18943, USP48, 95000, 197450, 411-554; 18943, USP48, 95001, 197451, 127-566; 18943, USP48, 95002, 197452, 565-680; 18943, USP48, 94993, 197443, 650-3757; 18943, USP48, 94996, 197446, 239-3190; 18943, USP48, 94997, 197447, 650-2107; 18943, USP48, 94999, 197449, 35-3178; 18944, USP49, 95005, 197455, 496-2253; 18944, USP49, 95007, 197457, 1-157; 18944, USP49, 95008, 197458, 708-752; 18944, USP49, 95003, 197453, 223-2145; 18944, USP49, 95004, 197454, 103-2169; 18944, USP49, 95006, 197456, 331-2397; 18945, USP5, 95011, 197461, 28-438; 18945, USP5, 95009, 197459, 53-2629; 18945, USP5, 95010, 197460, 33-2540; 18946, USP50, 95012, 197462, 1-258; 18946, USP50, 95014, 197464, 142-327; 18946, USP50, 95015, 197465, 181-1212; 18946, USP50, 95013, 197463, 175-1179; 18947, USP51, 95016, 197466, 84-2219; 18948, USP53, 95019, 197469, 1-195; 18948, USP53, 95020, 197470, 121-1104; 18948, USP53, 95017, 197467, 1180-4401; 18948, USP53, 95018, 197468, 545-3766; 18949, USP54, 95023, 197473, 1-1906; 18949, USP54, 95024, 197474, 79-509; 18949, USP54, 95025, 197475, 1-1075; 18949, USP54, 95026, 197476, 83-543; 18949, USP54, 95027, 197477, 361-600; 18949, USP54, 95029, 197479, 1-1238; 18949, USP54, 95021, 197471, 102-5156; 18949, USP54, 95022, 197472, 18-5072; 18949, USP54, 95028, 197478, 338-2515; 18950, USP6, 95033, 197483, 1700-2830; 18950, USP6, 95030, 197480, 1700-5920; 18950, USP6, 95031, 197481, 2231-6451; 18950, USP6, 95032, 197482, 1700-4060; 18951, USP7, 95036, 197486, 196-1725; 18951, USP7, 95037, 197487, 138-413; 18951, USP7, 95038, 197488, 467-3194; 18951, USP7, 95039, 197489, 101-577; 18951, USP7, 95040, 197490, 169-559; 18951, USP7, 95041, 197491, 61-204; 18951, USP7, 95042, 197492, 217-569; 18951, USP7, 95043, 197493, 152-479; 18951, USP7, 95044, 197494, 1-52; 18951, USP7, 95045, 197495, 1-207; 18951, USP7, 95034, 197484, 200-3508; 18951, USP7, 95035, 197485, 117-3377; 18952, USP8, 95049, 197499, 166-576; 18952, USP8, 95050, 197500, 363-652; 18952, USP8, 95051, 197501, 49-237; 18952, USP8, 95052, 197502, 192-410; 18952, USP8, 95053, 197503, 32-409; 18952, USP8, 95054, 197504, 478-1917; 18952, USP8, 95055, 197505, 93-498; 18952, USP8, 95056, 197506, 87-275; 18952, USP8, 95057, 197507, 294-482; 18952, USP8, 95046, 197496, 199-3555; 18952, USP8, 95047, 197497, 339-3695; 18952, USP8, 95048, 197498, 194-3232; 18953, USP9X, 95060, 197510, 1-139; 18953, USP9X, 95058, 197508, 634-8346; 18953, USP9X, 95059, 197509, 634-8298; 18954, USP9Y, 95062, 197512, 1-713; 18954, USP9Y, 95061, 197511, 946-8613; 18955, USPL1, 95063, 197513, 343-3621; 18955, USPL1, 95064, 197514, 369-2660; 18956, UBE4A, 95067, 197517, 466-2082; 18956, UBE4A, 95065, 197515, 132-3332; 18956, UBE4A, 95066, 197516, 73-3294; 18957, UBE4B, 95070, 197520, 398-700; 18957, UBE4B, 95071, 197521, 1-827; 18957, UBE4B, 95072, 197522, 1-295; 18957, UBE4B, 95068, 197518, 840-4361; 18957, UBE4B, 95069, 197519, 76-3984; 18958, UBE2V1, 95077, 197527, 1-312; 18958, UBE2V1, 95079, 197529, 383-652; 18958, UBE2V1, 95080, 197530, 297-614; 18958, UBE2V1, 95081, 197531, 471-788; 18958, UBE2V1, 95082, 197532, 336-653; 18958, UBE2V1, 95073, 197523, 380-892; 18958, UBE2V1, 95074, 197524, 12-329; 18958, UBE2V1, 95075, 197525, 46-489; 18958, UBE2V1, 95076, 197526, 303-815; 18958, UBE2V1, 95078, 197528, 432-743; 18959, UBE2V2, 95084, 197534, 353-670; 18959, UBE2V2, 95085, 197535, 1391-1708; 18959, UBE2V2, 95086, 197536, 226-543; 18959, UBE2V2, 95087, 197537, 1-329; 18959, UBE2V2, 95088, 197538, 1-463; 18959, UBE2V2, 95089, 197539, 1-158; 18959, UBE2V2, 95083, 197533, 56-493; 18960, UBE2J1, 95090, 197540, 280-1236; 18961, UBE2J2, 95092, 197542, 475-1098; 18961, UBE2J2, 95094, 197544, 216-839; 18961, UBE2J2, 95096, 197546, 469-1056; 18961, UBE2J2, 95097, 197547, 340-643; 18961, UBE2J2, 95098, 197548, 189-320; 18961, UBE2J2, 95099, 197549, 151-285; 18961, UBE2J2, 95100, 197550, 190-492; 18961, UBE2J2, 95101, 197551, 200-517; 18961, UBE2J2, 95102, 197552, 318-530; 18961, UBE2J2, 95103, 197553, 292-472; 18961, UBE2J2, 95104, 197554, 169-303; 18961, UBE2J2, 95105, 197555, 185-319; 18961, UBE2J2, 95106, 197556, 620-750; 18961, UBE2J2, 95091, 197541, 221-1000; 18961, UBE2J2, 95093, 197543, 229-1008; 18961, UBE2J2, 95095, 197545, 169-996; 18962, UBE2A, 95107, 197557, 177-626; 18962, UBE2A, 95109, 197559, 150-521; 18962, UBE2A, 95110, 197560, 135-329; 18962, UBE2A, 95113, 197563, 209-568; 18962, UBE2A, 95108, 197558, 246-704; 18962, UBE2A, 95111, 197561, 368-601; 18962, UBE2A, 95112, 197562, 167-535; 18963, UBE2B, 95115, 197565, 1-424; 18963, UBE2B, 95116, 197566, 128-262; 18963, UBE2B, 95117, 197567, 1-417; 18963, UBE2B, 95114, 197564, 418-876; 18964, UBE2C, 95118, 197568, 39-191; 18964, UBE2C, 95123, 197573, 121-360; 18964, UBE2C, 95124, 197574, 121-519; 18964, UBE2C, 95119, 197569, 23-475; 18964, UBE2C, 95120, 197570, 62-547; 18964, UBE2C, 95121, 197571, 121-660; 18964, UBE2C, 95122, 197572, 302-724; 18965, UBE2D1, 95126, 197576, 306-635; 18965, UBE2D1, 95125, 197575, 228-671; 18966, UBE2D2, 95127, 197577, 1-444; 18966, UBE2D2, 95131, 197581, 877-1170; 18966, UBE2D2, 95128, 197578, 627-1070; 18966, UBE2D2, 95129, 197579, 67-510; 18966, UBE2D2, 95130, 197580, 443-799; 18966, UBE2D2, 95132, 197582, 246-602; 18967, UBE2D3, 95135, 197585, 118-543; 18967, UBE2D3, 95143, 197593, 458-604; 18967, UBE2D3, 95144, 197594, 360-467; 18967, UBE2D3, 95145, 197595, 202-558; 18967, UBE2D3, 95146, 197596, 225-332; 18967, UBE2D3, 95147, 197597, 254-400; 18967, UBE2D3, 95148, 197598, 203-370; 18967, UBE2D3, 95149, 197599, 259-547; 18967, UBE2D3, 95150, 197600, 217-363; 18967, UBE2D3, 95151, 197601, 373-519; 18967, UBE2D3, 95152, 197602, 191-547; 18967, UBE2D3, 95153, 197603, 385-601; 18967, UBE2D3, 95154, 197604, 365-599; 18967, UBE2D3, 95155, 197605, 123-479; 18967, UBE2D3, 95156, 197606, 129-485; 18967, UBE2D3, 95157, 197607, 127-186; 18967, UBE2D3, 95158, 197608, 1-447; 18967, UBE2D3, 95133, 197583, 464-907; 18967, UBE2D3, 95134, 197584, 290-733; 18967, UBE2D3, 95136, 197586, 244-687; 18967, UBE2D3, 95137, 197587, 615-1061; 18967, UBE2D3, 95138, 197588, 153-602; 18967, UBE2D3, 95139, 197589, 486-929; 18967, UBE2D3, 95140, 197590, 345-788; 18967, UBE2D3, 95141, 197591, 694-1137; 18967, UBE2D3, 95142, 197592, 515-958; 18968, UBE2D4, 95160, 197610, 96-224; 18968, UBE2D4, 95161, 197611, 18-386; 18968, UBE2D4, 95162, 197612, 92-211; 18968, UBE2D4, 95163, 197613, 90-218; 18968, UBE2D4, 95164, 197614, 64-192; 18968, UBE2D4, 95165, 197615, 44-172; 18968, UBE2D4, 95166, 197616, 44-268; 18968, UBE2D4, 95167, 197617, 1-96; 18968, UBE2D4, 95159, 197609, 90-533; 18969, UBE2E1, 95170, 197620, 1-456; 18969, UBE2E1, 95171, 197621, 182-622; 18969, UBE2E1, 95173, 197623, 34-537; 18969, UBE2E1, 95168, 197618, 220-801; 18969, UBE2E1, 95169, 197619, 158-688; 18969, UBE2E1, 95172, 197622, 34-516; 18970, UBE2E2, 95174, 197624, 110-388; 18970, UBE2E2, 95176, 197626, 172-665; 18970, UBE2E2, 95178, 197628, 144-413; 18970, UBE2E2, 95179, 197629, 1-282; 18970, UBE2E2, 95180, 197630, 1-267; 18970, UBE2E2, 95175, 197625, 181-786; 18970, UBE2E2, 95177, 197627, 252-857; 18971, UBE2E3, 95183, 197633, 193-528; 18971, UBE2E3, 95184, 197634, 229-752; 18971, UBE2E3, 95185, 197635, 376-744; 18971, UBE2E3, 95186, 197636, 129-654; 18971, UBE2E3, 95187, 197637, 182-705; 18971, UBE2E3, 95190, 197640, 21-413; 18971, UBE2E3, 95181, 197631, 188-811; 18971, UBE2E3, 95182, 197632, 394-1017; 18971, UBE2E3, 95188, 197638, 380-1003; 18971, UBE2E3, 95189, 197639, 145-768; 18972, UBE2F, 95193, 197643, 68-559; 18972, UBE2F, 95195, 197645, 132-437; 18972, UBE2F, 95196, 197646, 136-552; 18972, UBE2F, 95197, 197648, 136-561; 18972, UBE2F, 95199, 197649, 60-296; 18972, UBE2F, 95200, 197650, 90-461; 18972, UBE2F, 95202, 197652, 134-648; 18972, UBE2F, 95203, 197653, 75-218; 18972, UBE2F, 95204, 197654, 124-267; 18972, UBE2F, 95206, 197656, 110-301; 18972, UBE2F, 95207, 197657, 136-396; 18972, UBE2F, 95208, 197658, 323-469; 18972, UBE2F, 95209, 197659, 14-472; 18972, UBE2F, 95191, 197641, 195-752; 18972, UBE2F, 95192, 197642, 7-492; 18972, UBE2F, 95194, 197644, 136-630; 18972, UBE2F, 95197, 197647, 70-432; 18972, UBE2F, 95201, 197651, 195-656; 18972, UBE2F, 95205, 197655, 205-513; 18972, UBE2F, 95210, 197660, 134-691; 18973, UBE2G1, 95212, 197662, 310-459; 18973, UBE2G1, 95213, 197663, 552-569; 18973, UBE2G1, 95214, 197664, 641-940; 18973, UBE2G1, 95215, 197665, 313-465; 18973, UBE2G1, 95216, 197666, 318-553; 18973, UBE2G1, 95211, 197661, 167-679; 18974, UBE2G2, 95219, 197669, 76-222; 18974, UBE2G2, 95220, 197670, 79-378; 18974, UBE2G2, 95217, 197667, 226-639; 18974, UBE2G2, 95218, 197668, 272-769; 18975, UBE2H, 95222, 197672, 113-561; 18975, UBE2H, 95223, 197673, 1-189; 18975, UBE2H, 95225, 197675, 389-758; 18975, UBE2H, 95226, 197676, 264-572; 18975, UBE2H, 95221, 197671, 395-946; 18975, UBE2H, 95224, 197674, 77-535; 18976, UBE2I, 95231, 197681, 37-591; 18976, UBE2I, 95234, 197684, 1-211; 18976, UBE2I, 95235, 197685, 472-884; 18976, UBE2I, 95236, 197686, 451-538; 18976, UBE2I, 95227, 197677, 131-607; 18976, UBE2I, 95228, 197678, 552-1028; 18976, UBE2I, 95229, 197679, 276-752; 18976, UBE2I, 95230, 197680, 408-884; 18976, UBE2I, 95232, 197682, 809-1285; 18976, UBE2I, 95233, 197683, 320-796; 18976, UBE2I, 95237, 197687, 463-939; 18977, UBE2K, 95241, 197691, 1-135; 18977, UBE2K, 95242, 197692, 220-589; 18977, UBE2K, 95238, 197688, 285-887; 18977, UBE2K, 95239, 197689, 153-626; 18977, UBE2K, 95240, 197690, 166-615; 18978, UBE2L3, 95243, 197693, 199-663; 18978, UBE2L3, 95244, 197694, 4-642; 18978, UBE2L3, 95245, 197695, 199-567; 18979, UBE2L6, 95248, 197698, 247-628; 18979, UBE2L6, 95249, 197699, 472-668; 18979, UBE2L6, 95246, 197696, 197-658; 18979, UBE2L6, 95247, 197697, 608-871; 18980, UBE2M, 95251, 197701, 526-734; 18980, UBE2M, 95252, 197702, 1-345; 18980, UBE2M, 95250, 197700, 580-1131; 18981, UBE2N, 95254, 197704, 15-278; 18981, UBE2N, 95255, 197705, 52-369; 18981, UBE2N, 95256, 197706, 60-518; 18981, UBE2N, 95257, 197707, 394-663; 18981, UBE2N, 95253, 197703, 379-837; 18982, UBE2NL, 95258, 197708, 31-492; 18983, UBE2O, 95260, 197710, 1-567; 18983, UBE2O, 95261, 197711, 1-2423; 18983, UBE2O, 95259, 197709, 66-3944; 18984, UBE2Q1, 95262, 197712, 81-1349; 18985, UBE2Q2, 95264, 197714, 1-601; 18985, UBE2Q2, 95265, 197715, 1-276; 18985, UBE2Q2, 95268, 197718, 100-456; 18985, UBE2Q2, 95263, 197713, 383-1510; 18985, UBE2Q2, 95266, 197716, 311-1390; 18985, UBE2Q2, 95267, 197717, 361-1383; 18986, UBE2Q2L, 95269, 197719, 13-408; 18987, UBE2QL1, 95270, 197720, 272-757; 18988, UBE2R2, 95271, 197721, 192-908; 18989, UBE2S, 95273, 197723, 183-422; 18989, UBE2S, 95274, 197724, 131-743; 18989, UBE2S, 95272, 197722, 189-857; 18990, UBE2T, 95275, 197725, 151-744; 18991, UBE2U, 95277, 197727, 425-1193; 18991, UBE2U, 95278, 197728, 1-403; 18991, UBE2U, 95279, 197729, 1-615; 18991, UBE2U, 95276, 197726, 245-925; 18991, UBE2U, 95280, 197730, 425-1390; 18992, UBE2W, 95281, 197731, 1-576; 18992, UBE2W, 95282, 197732, 54-236; 18992, UBE2W, 95284, 197734, 1-467; 18992, UBE2W, 95285, 197735, 39-221; 18992, UBE2W, 95286, 197736, 33-215; 18992, UBE2W, 95283, 197733, 2-544; 18992, UBE2W, 95287, 197737, 4-459; 18993, UBE2Z, 95289, 197739, 32-573; 18993, UBE2Z, 95290, 197740, 1-388; 18993, UBE2Z, 95291, 197741, 1-213; 18993, UBE2Z, 95292, 197742, 126-269; 18993, UBE2Z, 95293, 197743, 468-769; 18993, UBE2Z, 95288, 197738, 136-1200; 18994, UFM1, 95296, 197746, 1-244; 18994, UFM1, 95294, 197744, 40-297; 18994, UFM1, 95295, 197745, 188-499; 18995, UFC1, 95297, 197747, 247-750; 18996, UBL3, 95298, 197748, 1147-1500; 18997, UBL4A, 95299, 197749, 32-574; 18997, UBL4A, 95301, 197751, 29-130; 18997, UBL4A, 95302, 197752, 3-314; 18997, UBL4A, 95303, 197753, 1-102; 18997, UBL4A, 95300, 197750, 87-560; 18998, UBL4B, 95304, 197754, 68-592; 18999, UBL5, 95307, 197757, 82-192; 18999, UBL5, 95305, 197755, 185-406; 18999, UBL5, 95306, 197756, 62-283; 18999, UBL5, 95308, 197758, 105-326; 19000, UBL7, 95312, 197762, 1-345; 19000, UBL7, 95313, 197763, 1-548; 19000, UBL7, 95316, 197766, 119-792; 19000, UBL7, 95317, 197767, 135-621; 19000, UBL7, 95309, 197759, 105-1247; 19000, UBL7, 95310, 197760, 172-1314; 19000, UBL7, 95311, 197761, 223-1365; 19000, UBL7, 95314, 197764, 465-1607; 19000, UBL7, 95315, 197765, 159-1301; 19001, UBLCP1, 95318, 197768, 327-1283; 19002, UBA1, 95320, 197770, 780-2300; 19002, UBA1, 95322, 197772, 202-1054; 19002, UBA1, 95323, 197773, 151-671; 19002, UBA1, 95324, 197774, 1005-1706; 19002, UBA1, 95325, 197775, 225-809; 19002, UBA1, 95326, 197776, 337-1148; 19002, UBA1, 95319, 197769, 184-3360; 19002, UBA1, 95321, 197771, 91-3267; 19003, UBA2, 95329, 197779, 61-847; 19003, UBA2, 95330, 197780, 75-299; 19003, UBA2, 95331, 197781, 1-646; 19003, UBA2, 95332, 197782, 82-246; 19003, UBA2, 95333, 197783, 233-733; 19003, UBA2, 95327, 197777, 71-1993; 19003, UBA2, 95328, 197778, 499-2133; 19004, UBA3, 95336, 197786, 29-1297; 19004, UBA3, 95337, 197787, 25-219; 19004, UBA3, 95338, 197788, 25-414; 19004, UBA3, 95339, 197789, 1-123; 19004, UBA3, 95340, 197790, 1-390; 19004, UBA3, 95334, 197784, 56-1405; 19004, UBA3, 95335, 197785, 56-1447; 19005, UBA5, 95343, 197793, 593-1726; 19005, UBA5, 95344, 197794, 92-417; 19005, UBA5, 95345, 197795, 424-662; 19005, UBA5, 95347, 197797, 326-657; 19005, UBA5, 95348, 197798, 179-1222; 19005, UBA5, 95349, 197799, 143-337; 19005, UBA5, 95341, 197791, 233-1279; 19005, UBA5, 95342, 197792, 1073-2287; 19005, UBA5, 95346, 197796, 695-1741; 19006, UBA6, 95352, 197802, 1-812; 19006, UBA6, 95353, 197803, 1-267; 19006, UBA6, 95350, 197800, 61-3219; 19006, UBA6, 95351, 197801, 35-1204; 19007, UBA7, 95354, 197804, 160-3198; 19008, UHRF1, 95355, 197805, 45-2618; 19008, UHRF1, 95358, 197808, 481-2901; 19008, UHRF1, 95359, 197809, 1-1491; 19008, UHRF1, 95356, 197806, 131-2512; 19008, UHRF1, 95357, 197807, 112-2493; 19008, UHRF1, 95360, 197810, 577-2958; 19008, UHRF1, 95361, 197811, 169-2550; 19009, UHRF2, 95363, 197813, 74-484; 19009, UHRF2, 95364, 197814, 138-474; 19009, UHRF2, 95362, 197812, 169-2577; 19009, UHRF2, 95365, 197815, 341-1852; 19010, UTY, 95369, 197819, 314-937; 19010, UTY, 95371, 197821, 1006-5013; 19010, UTY, 95372, 197822, 1006-5175; 19010, UTY, 95373, 197823, 1006-5340; 19010, UTY, 95374, 197824, 1006-5097; 19010, UTY, 95375, 197825, 1006-5205; 19010, UTY, 95376, 197826, 1006-4800; 19010, UTY, 95377, 197827, 1006-5109; 19010, UTY, 95366, 197816, 1009-5052; 19010, UTY, 95367, 197817, 1006-4245; 19010, UTY, 95368, 197818, 1006-4728; 19010, UTY, 95370, 197820, 1006-5184; 19010, UTY, 95378, 197828, 1-3636; 19011, UXT, 95380, 197830, 155-664; 19011, UXT, 95381, 197831, 145-444; 19011, UXT, 95379, 197829, 57-530; 19012, UBOX5, 95384, 197834, 260-524; 19012, UBOX5, 95382, 197832, 473-2098; 19012, UBOX5, 95383, 197833, 473-1936; 19013, UBXN1, 95387, 197837, 2-304; 19013,

UBXN1, 95388, 197838, 73-943; 19013, UBXN1, 95389, 197839, 143-1024; 19013, UBXN1, 95390, 197840, 195-911; 19013, UBXN1, 95385, 197835, 133-1071; 19013, UBXN1, 95386, 197836, 168-1061; 19014, UBXN10, 95391, 197841, 85-927; 19015, UBXN11, 95394, 197844, 197-938; 19015, UBXN11, 95398, 197848, 462-1295; 19015, UBXN11, 95399, 197849, 349-793; 19015, UBXN11, 95400, 197850, 325-728; 19015, UBXN11, 95401, 197851, 134-688; 19015, UBXN11, 95402, 197852, 161-782; 19015, UBXN11, 95403, 197853, 303-649; 19015, UBXN11, 95392, 197842, 81-1283; 19015, UBXN11, 95393, 197843, 77-1540; 19015, UBXN11, 95395, 197845, 368-1831; 19015, UBXN11, 95396, 197846, 215-1777; 19015, UBXN11, 95397, 197847, 466-2028; 19016, UBXN2A, 95404, 197854, 245-1024; 19016, UBXN2A, 95405, 197855, 442-1221; 19016, UBXN2A, 95406, 197856, 247-867; 19017, UBXN2B, 95408, 197858, 6-320; 19017, UBXN2B, 95409, 197859, 1-427; 19017, UBXN2B, 95410, 197860, 6-596; 19017, UBXN2B, 95407, 197857, 123-1118; 19018, UBXN4, 95412, 197862, 63-350; 19018, UBXN4, 95413, 197863, 197-548; 19018, UBXN4, 95414, 197864, 145-342; 19018, UBXN4, 95411, 197861, 312-1838; 19019, UBXN6, 95417, 197867, 15-403; 19019, UBXN6, 95418, 197868, 1-203; 19019, UBXN6, 95419, 197869, 1-1114; 19019, UBXN6, 95415, 197865, 126-1451; 19019, UBXN6, 95416, 197866, 155-1321; 19020, UBXN7, 95421, 197871, 1-375; 19020, UBXN7, 95422, 197872, 29-256; 19020, UBXN7, 95423, 197873, 123-1106; 19020, UBXN7, 95424, 197874, 146-374; 19020, UBXN7, 95420, 197870, 76-1545; 19021, UBXN8, 95425, 197875, 50-982; 19021, UBXN8, 95426, 197876, 2-691; 19021, UBXN8, 95427, 197877, 26-838; 19021, UBXN8, 95428, 197878, 1-283; 19021, UBXN8, 95430, 197880, 17-145; 19021, UBXN8, 95431, 197881, 69-813; 19021, UBXN8, 95429, 197879, 1-702; 19022, UGT1A1, 95432, 197882, 41-1642; 19022, UGT1A1, 95433, 197883, 1-1335; 19023, UGT1A10, 95434, 197884, 70-1662; 19023, UGT1A10, 95435, 197885, 22-1347; 19024, UGT1A3, 95436, 197886, 20-1624; 19025, UGT1A4, 95437, 197887, 44-1648; 19025, UGT1A4, 95438, 197888, 1-1338; 19026, UGT1A5, 95439, 197889, 1-1605; 19027, UGT1A6, 95442, 197892, 115-645; 19027, UGT1A6, 95443, 197893, 179-745; 19027, UGT1A6, 95444, 197894, 119-649; 19027, UGT1A6, 95445, 197895, 1-204; 19027, UGT1A6, 95440, 197890, 140-1738; 19027, UGT1A6, 95441, 197891, 222-1019; 19028, UGT1A7, 95447, 197897, 1-473; 19028, UGT1A7, 95446, 197896, 1-1593; 19029, UGT1A8, 95448, 197898, 64-1656; 19030, UGT1A9, 95449, 197899, 83-1675; 19031, UGT2A1, 95451, 197901, 118-1569; 19031, UGT2A1, 95454, 197904, 112-586; 19031, UGT2A1, 95450, 197900, 115-1698; 19031, UGT2A1, 95452, 197902, 57-1640; 19031, UGT2A1, 95453, 197903, 117-2198; 19032, UGT2A2, 95455, 197905, 3-1481; 19032, UGT2A2, 95456, 197906, 3-1613; 19033, UGT2A3, 95458, 197908, 4-522; 19033, UGT2A3, 95460, 197910, 1-522; 19033, UGT2A3, 95457, 197907, 32-1615; 19033, UGT2A3, 95459, 197909, 32-1615; 19034, UGT2B10, 95461, 197911, 28-1614; 19034, UGT2B10, 95462, 197912, 26-1360; 19034, UGT2B10, 95463, 197913, 28-1614; 19034, UGT2B10, 95464, 197914, 26-1360; 19035, UGT2B11, 95467, 197917, 3-1010; 19035, UGT2B11, 95465, 197915, 10-1599; 19035, UGT2B11, 95466, 197916, 3-1592; 19036, UGT2B15, 95469, 197919, 605-1603; 19036, UGT2B15, 95468, 197918, 11-1603; 19036, UGT2B15, 95470, 197920, 1-1593; 19037, UGT2B17, 95471, 197921, 44-1636; 19038, UGT2B28, 95474, 197924, 15-1604; 19038, UGT2B28, 95472, 197922, 3-1592; 19038, UGT2B28, 95473, 197923, 3-1010; 19039, UGT2B4, 95476, 197926, 434-596; 19039, UGT2B4, 95475, 197925, 48-1634; 19039, UGT2B4, 95477, 197927, 1-1110; 19040, UGT2B7, 95479, 197929, 399-866; 19040, UGT2B7, 95480, 197930, 28-1137; 19040, UGT2B7, 95481, 197931, 3-1010; 19040, UGT2B7, 95478, 197928, 47-1636; 19041, UGT3A1, 95484, 197934, 194-1402; 19041, UGT3A1, 95485, 197935, 158-1468; 19041, UGT3A1, 95486, 197936, 366-539; 19041, UGT3A1, 95482, 197932, 359-1930; 19041, UGT3A1, 95483, 197933, 356-1114; 19041, UGT3A1, 95487, 197937, 221-979; 19042, UGT3A2, 95489, 197939, 158-572; 19042, UGT3A2, 95490, 197940, 94-456; 19042, UGT3A2, 95488, 197938, 103-1674; 19042, UGT3A2, 95491, 197941, 94-1563; 19043, UGT8, 95494, 197944, 311-735; 19043, UGT8, 95492, 197942, 523-2148; 19043, UGT8, 95493, 197943, 515-2140; 19044, B3GALT6, 95495, 197945, 15-1004; 19045, B3GALT1, 95496, 197946, 93-1073; 19046, B3GALT2, 95497, 197947, 757-2025; 19047, B3GALT4, 95498, 197948, 289-1425; 19047, B3GALT4, 95499, 197949, 289-1425; 19047, B3GALT4, 95500, 197950, 289-1425; 19047, B3GALT4, 95501, 197951, 289-1425; 19047, B3GALT4, 95502, 197952, 289-1425; 19048, B3GALT5, 95506, 197956, 1-945; 19048, B3GALT5, 95503, 197953, 278-1210; 19048, B3GALT5, 95504, 197954, 434-1366; 19048, B3GALT5, 95505, 197955, 593-1525; 19048, B3GALT5, 95507, 197957, 289-1221; 19049, B4GALT1, 95509, 197959, 188-865; 19049, B4GALT1, 95508, 197958, 188-1384; 19050, B4GALT2, 95510, 197960, 77-1282; 19050, B4GALT2, 95511, 197961, 791-1909; 19050, B4GALT2, 95512, 197962, 363-1481; 19050, B4GALT2, 95513, 197963, 283-1203; 19051, B4GALT3, 95514, 197964, 224-1405; 19051, B4GALT3, 95515, 197965, 186-1367; 19051, B4GALT3, 95516, 197966, 728-1909; 19052, B4GALT4, 95519, 197969, 476-884; 19052, B4GALT4, 95520, 197970, 393-1298; 19052, B4GALT4, 95521, 197971, 96-284; 19052, B4GALT4, 95522, 197972, 260-615; 19052, B4GALT4, 95523, 197973, 575-582; 19052, B4GALT4, 95524, 197974, 464-588; 19052, B4GALT4, 95525, 197975, 592-611; 19052, B4GALT4, 95526, 197976, 496-560; 19052, B4GALT4, 95527, 197977, 489-563; 19052, B4GALT4, 95529, 197979, 478-641; 19052, B4GALT4, 95530, 197980, 365-1105; 19052, B4GALT4, 95517, 197967, 544-1578; 19052, B4GALT4, 95518, 197968, 618-1652; 19052, B4GALT4, 95528, 197978, 643-1677; 19053, B4GALT5, 95531, 197981, 189-1355; 19054, B4GALT6, 95532, 197982, 146-1177; 19054, B4GALT6, 95535, 197985, 125-339; 19054, B4GALT6, 95533, 197983, 298-1446; 19054, B4GALT6, 95534, 197984, 79-1110; 19055, GALE, 95537, 197987, 293-876; 19055, GALE, 95538, 197988, 1-327; 19055, GALE, 95539, 197989, 211-792; 19055, GALE, 95540, 197990, 240-957; 19055, GALE, 95541, 197991, 202-882; 19055, GALE, 95536, 197986, 93-1139; 19055, GALE, 95542, 197992, 170-1216; 19056, B3GNT2, 95543, 197993, 253-1446; 19056, B3GNT2, 95544, 197994, 108-1301; 19057, B3GNT3, 95546, 197996, 89-470; 19057, B3GNT3, 95547, 197997, 107-856; 19057, B3GNT3, 95545, 197995, 148-1266; 19057, B3GNT3, 95548, 197998, 120-1238; 19058, B3GNT4, 95549, 197999, 357-1493; 19058, B3GNT4, 95550, 198000, 131-1192; 19058, B3GNT4, 95551, 198001, 1728-2789; 19059, B3GNT5, 95553, 198003, 465-614; 19059, B3GNT5, 95555, 198005, 441-684; 19059, B3GNT5, 95556, 198006, 423-608; 19059, B3GNT5, 95552, 198002, 531-1667; 19059, B3GNT5, 95554, 198004, 524-1660; 19059, B3GNT5, 95557, 198007, 741-1877; 19060, B3GNT6, 95558, 198008, 205-568; 19060, B3GNT6, 95559, 198009, 82-1236; 19061, B3GNT7, 95560, 198010, 262-1467; 19062, B3GNT8, 95561, 198011, 455-1648; 19063, B3GNT9, 95562, 198012, 537-1745; 19064, B3GNTL1, 95564, 198014, 14-175; 19064, B3GNTL1, 95565, 198015, 1135-1686; 19064, B3GNTL1, 95566, 198016, 752-1504; 19064, B3GNTL1, 95568, 198018, 14-175; 19064, B3GNTL1, 95569, 198019, 1135-1686; 19064, B3GNTL1, 95570, 198020, 752-1504; 19064, B3GNTL1, 95563, 198013, 15-1100; 19064, B3GNTL1, 95567, 198017, 15-1100; 19065, UGDH, 95573, 198023, 318-861; 19065, UGDH, 95574, 198024, 180-433; 19065, UGDH, 95575, 198025, 188-577; 19065, UGDH, 95577, 198027, 125-292; 19065, UGDH, 95578, 198028, 163-330; 19065, UGDH, 95579, 198029, 110-568; 19065, UGDH, 95581, 198031, 374-534; 19065, UGDH, 95571, 198021, 344-1828; 19065, UGDH, 95572, 198022, 182-1666; 19065, UGDH, 95576, 198026, 163-1446; 19065, UGDH, 95580, 198030, 287-1480; 19066, UGCG, 95582, 198032, 451-1635; 19067, UGGT1, 95584, 198034, 148-288; 19067, UGGT1, 95585, 198035, 1-394; 19067, UGGT1, 95586, 198036, 151-315; 19067, UGGT1, 95587, 198037, 159-335; 19067, UGGT1, 95583, 198033, 48-4715; 19068, UGGT2, 95588, 198038, 82-924; 19068, UGGT2, 95591, 198041, 89-1207; 19068, UGGT2, 95592, 198042, 27-812; 19068, UGGT2, 95589, 198039, 171-1007; 19068, UGGT2, 95590, 198040, 72-4622; 19069, UGP2, 95595, 198045, 68-1621; 19069, UGP2, 95596, 198046, 392-505; 19069, UGP2, 95597, 198047, 46-204; 19069, UGP2, 95598, 198048, 244-390; 19069, UGP2, 95599, 198049, 277-507; 19069, UGP2, 95600, 198050, 238-384; 19069, UGP2, 95601, 198051, 407-553; 19069, UGP2, 95602, 198052, 296-454; 19069, UGP2, 95603, 198053, 1-90; 19069, UGP2, 95604, 198054, 266-496; 19069, UGP2, 95605, 198055, 107-558; 19069, UGP2, 95606, 198056, 49-560; 19069, UGP2, 95607, 198057, 379-784; 19069, UGP2, 95608, 198058, 332-645; 19069, UGP2, 95609, 198059, 116-274; 19069, UGP2, 95610, 198060, 81-605; 19069, UGP2, 95611, 198061, 116-753; 19069, UGP2, 95612, 198062, 12-125; 19069, UGP2, 95614, 198064, 1-1527; 19069, UGP2, 95615, 198065, 118-264; 19069, UGP2, 95616, 198066, 118-276; 19069, UGP2, 95593, 198043, 477-2003; 19069, UGP2, 95594, 198044, 308-1801; 19069, UGP2, 95613, 198063, 340-1833; 19070, UXS1, 95620, 198070, 345-502; 19070, UXS1, 95621, 198071, 111-682; 19070, UXS1, 95622, 198072, 298-701; 19070, UXS1, 95623, 198073, 438-800; 19070, UXS1, 95624, 198074, 59-570; 19070, UXS1, 95617, 198067, 99-1376; 19070, UXS1, 95618, 198068, 59-1321; 19070, UXS1, 95619, 198069, 755-1513; 19071, UAP1, 95625, 198075, 330-1898; 19071, UAP1, 95626, 198076, 33-1598; 19071, UAP1, 95627, 198077, 33-1601; 19071, UAP1, 95628, 198078, 303-1820; 19072, UAP1L1, 95631, 198081, 8-307; 19072, UAP1L1, 95629, 198079, 237-1391; 19072, UAP1L1, 95630, 198080, 33-1556; 19073, UEVLD, 95635, 198085, 64-261; 19073, UEVLD, 95632, 198082, 28-675; 19073, UEVLD, 95633, 198083, 33-1106; 19073, UEVLD, 95634, 198084, 53-1402; 19073, UEVLD, 95636, 198086, 30-1445; 19073, UEVLD, 95637, 198087, 64-663; 19073, UEVLD, 95638, 198088, 164-1189; 19073, UEVLD, 95639, 198089, 93-1232; 19074, UFL1, 95640, 198090, 67-2451; 19075, UFSP1, 95641, 198091, 448-876; 19076, UFSP2, 95643, 198093, 102-1265; 19076, UFSP2, 95644, 198094, 119-490; 19076, UFSP2, 95645, 198095, 112-375; 19076, UFSP2, 95646, 198096, 1-592; 19076, UFSP2, 95647, 198097, 63-401; 19076, UFSP2, 95648, 198098, 1-1105; 19076, UFSP2, 95642, 198092, 118-1527; 19077, UHRF1BP1, 95650, 198100, 237-4439; 19077, UHRF1BP1, 95649, 198099, 172-4494; 19078, UHRF1BP1L, 95653, 198103, 251-3595; 19078, UHRF1BP1L, 95654, 198104, 380-581; 19078, UHRF1BP1L, 95655, 198105, 1-614; 19078, UHRF1BP1L, 95656, 198106, 273-664; 19078, UHRF1BP1L, 95657, 198107, 190-327; 19078, UHRF1BP1L, 95658, 198108, 234-542; 19078, UHRF1BP1L, 95659, 198109, 380-560; 19078, UHRF1BP1L, 95651, 198101, 214-4608; 19078, UHRF1BP1L, 95652, 198102, 213-1781; 19079, ULBP1, 95660, 198110, 44-778; 19080, ULBP2, 95661, 198111, 74-814; 19081, ULBP3, 95662, 198112, 30-764; 19081, ULBP3, 95663, 198113, 1-735; 19082, UNCX, 95664, 198114, 112-1707; 19083, UNC119, 95667, 198117, 53-676; 19083, UNC119, 95668, 198118, 1-259; 19083, UNC119, 95669, 198119, 760-1137; 19083, UNC119, 95670, 198120, 3163-3600; 19083, UNC119, 95665, 198115, 75-737; 19083, UNC119, 95666, 198116, 112-834; 19084, UNC119B, 95671, 198121, 41-796; 19085, UNC13A, 95672, 198122, 1-5112; 19085, UNC13A, 95674, 198124, 167-5197; 19085, UNC13A, 95675, 198125, 151-5319; 19085, UNC13A, 95676, 198126, 128-5221; 19085, UNC13A, 95673, 198123, 1-5112; 19086, UNC13B, 95678, 198128, 1449-5042; 19086, UNC13B, 95679, 198129, 283-5151; 19086, UNC13B, 95681, 198131, 1538-5131; 19086, UNC13B, 95682, 198132, 1-569; 19086, UNC13B, 95683, 198133, 181-1578; 19086, UNC13B, 95677, 198127, 223-4998; 19086, UNC13B, 95680, 198130, 293-5125; 19087, UNC13C, 95685, 198135, 235-642; 19087, UNC13C, 95686, 198136, 1-535; 19087, UNC13C, 95687, 198137, 302-362; 19087, UNC13C, 95684, 198134, 1-6645; 19088, UNC13D, 95690, 198140, 67-575; 19088, UNC13D, 95691, 198141, 1-207; 19088, UNC13D, 95692, 198142, 1-443; 19088, UNC13D, 95693, 198143, 24-589; 19088, UNC13D, 95694, 198144, 1-439; 19088, UNC13D, 95695, 198145, 1-930; 19088, UNC13D, 95696, 198146, 48-848; 19088, UNC13D, 95688, 198138, 381-3653; 19088, UNC13D, 95689, 198139, 14-3442; 19089, UNC45A, 95697, 198147, 836-3625; 19089, UNC45A, 95698, 198148, 41-2875; 19090, UNC45B, 95699, 198149, 98-2893; 19090, UNC45B, 95700, 198150, 71-2860; 19090, UNC45B, 95701, 198151, 1-2553; 19091, UNCSCL, 95702, 198152, 118-1674; 19091, UNCSCL, 95703, 198153, 62-1618; 19092, UNCSA, 95705, 198155, 1-1031; 19092, UNCSA, 95706, 198156, 1-254; 19092, UNCSA, 95704, 198154, 275-2803; 19093, UNCSB, 95707, 198157, 417-3254; 19093, UNCSB, 95708, 198158, 60-2864; 19094, UNCSC, 95710, 198160, 344-1126; 19094, UNCSC, 95712, 198162, 116-2350; 19094, UNCSC, 95713, 198163, 1-2673; 19094, UNCSC, 95709, 198159, 350-3145; 19094, UNCSC, 95711, 198161, 350-2143; 19095, UNCSD, 95714, 198164, 21-2675; 19095, UNCSD, 95716, 198166, 21-2681; 19095, UNCSD, 95718, 198168, 112-1701; 19095, UNCSD, 95719, 198169, 11-2887; 19095, UNCSD, 95715, 198165, 329-3190; 19095, UNCSD, 95717, 198167, 57-2903; 19096, UNC50, 95721, 198171, 1-386; 19096, UNC50, 95722, 198172, 235-1065; 19096, UNC50, 95723, 198173, 1131-1961; 19096, UNC50, 95724, 198174, 1-278; 19096, UNC50, 95720, 198170, 153-932; 19097, ULK1, 95725, 198175, 352-3504; 19098, ULK2, 95728, 198178, 1-594; 19098, ULK2, 95729, 198179, 1-64; 19098, ULK2, 95730, 198180, 1-148; 19098, ULK2, 95726, 198176, 520-3630; 19098, ULK2, 95727, 198177, 501-3611; 19099, ULK3, 95732, 198182, 4-156; 19099, ULK3, 95733, 198183, 20-145; 19099, ULK3, 95734, 198184, 37-291; 19099, ULK3, 95736, 198186, 4-156; 19099, ULK3, 95737, 198187, 4-189; 19099, ULK3, 95738, 198188, 20-430; 19099, ULK3, 95739, 198189, 26-154; 19099, ULK3, 95741, 198191, 4-153; 19099, ULK3, 95742, 198192, 1-126; 19099, ULK3, 95731, 198181, 93-1511; 19099, ULK3, 95735, 198185, 89-1501; 19099, ULK3, 95740, 198190, 4-1455; 19100, ULK4, 95744, 198194, 136-390; 19100, ULK4, 95745, 198195, 164-418; 19100, ULK4, 95746, 198196, 149-403; 19100, ULK4, 95747, 198197, 118-1860; 19100, ULK4, 95743, 198193, 464-4291; 19101, UNC79, 95750, 198200, 694-8484; 19101, UNC79, 95757, 198207, 694-8484; 19101, UNC79, 95748, 198198, 656-8032; 19101, UNC79, 95749, 198199, 1-7908; 19101, UNC79, 95751, 198201, 155-8128; 19101, UNC79, 95752, 198202, 1-7377; 19101, UNC79, 95753, 198203, 1-7377; 19101, UNC79, 95754, 198204, 656-8032; 19101, UNC79, 95755, 198205, 155-8128; 19101, UNC79, 95756, 198206, 1-7908; 19102, UNC80, 95759, 198209, 1-1641; 19102, UNC80, 95758, 198208, 35-9739; 19102, UNC80, 95760, 198210, 81-9857; 19103, UNC93A, 95763, 198213, 342-775; 19103, UNC93A, 95761, 198211, 176-1549; 19103, UNC93A, 95762, 198212, 27-1274; 19104, UNC93B1, 95765, 198215, 4-648; 19104, UNC93B1, 95766, 198216, 294-833; 19104, UNC93B1, 95764, 198214, 81-1874; 19105, N/A, 95767, 198217, 229-528; 19105, N/A, 95768, 198218, 172-654; 19105, N/A, 95769, 198219, 23-448; 19105, N/A, 95770, 198220, 197-646; 19106, N/A, 95771, 198221, 1-348; 19107, N/A, 95772, 198222, 145-532; 19107, N/A, 95773, 198223, 148-1866; 19108, N/A, 95774, 198224, 373-1518; 19108, N/A, 95775, 198225, 369-2123; 19109, N/A, 95776, 198226, 1-1086; 19109, N/A, 95778, 198228, 1-453; 19109, N/A, 95777, 198227, 537-1196; 19110, N/A, 95779, 198229, 48-410; 19111, N/A, 95780, 198230, 624-1097; 19112, N/A, 95781, 198231, 1-1233; 19112, N/A, 95782, 198232, 23-581; 19112, N/A, 95783, 198233, 1-441; 19112, N/A, 95784, 198234, 40-559; 19112, N/A, 95785, 198235, 1-278; 19113, USE1, 95787, 198237, 9-779; 19113, USE1, 95788, 198238, 61-177; 19113, USE1, 95789, 198239, 104-587; 19113, USE1, 95790, 198240, 32-433; 19113, USE1, 95791, 198241, 9-125; 19113, USE1, 95786, 198236, 48-827; 19113, USE1, 95792, 198242, 19-426; 19113, USE1, 95793, 198243, 17-457; 19114, UCP1, 95794, 198244, 77-1000; 19115, UCP2, 95796, 198246, 367-464; 19115, UCP2, 95797, 198247, 1-389; 19115, UCP2, 95798, 198248, 1-849; 19115, UCP2, 95799, 198249, 367-1044; 19115, UCP2, 95795, 198245, 844-1773; 19116, UCP3, 95802, 198252, 263-551; 19116, UCP3, 95800, 198250, 554-1492; 19116, UCP3, 95801, 198251, 204-1031; 19117, UTF1, 95803, 198253, 16-1041; 19118, UNK, 95805, 198255, 33-146; 19118, UNK, 95806, 198256, 1-208; 19118, UNK, 95807, 198257, 20-145; 19118, UNK, 95808, 198258, 1-660; 19118, UNK, 95809, 198259, 27-146; 19118, UNK, 95804, 198254, 111-2543; 19119, UNKL, 95812, 198262, 7-357; 19119, UNKL, 95813, 198263, 30-2081; 19119, UNKL, 95815, 198265, 327-669; 19119, UNKL, 95816, 198266, 353-511; 19119, UNKL, 95817, 198267, 1-2202; 19119, UNKL, 95818, 198268, 355-582; 19119, UNKL, 95810, 198260, 596-1285; 19119, UNKL, 95811, 198261, 61-894; 19119, UNKL, 95814, 198264, 391-939; 19120, N/A, 95819, 198269, 84-1952; 19121, UPF1, 95820, 198270, 273-3629; 19121, UPF1, 95821, 198271, 210-3599; 19122, UPF2, 95822, 198272, 475-4293; 19122, UPF2, 95823, 198273, 99-3917; 19122, UPF2, 95824, 198274, 276-4094; 19123, UPF3A, 95827, 198277, 38-355; 19123, UPF3A, 95825, 198275, 13-1344; 19123, UPF3A, 95826, 198276, 57-1487; 19124, UPF3B, 95830, 198280, 44-697; 19124, UPF3B, 95828, 198278, 71-1483; 19124, UPF3B, 95829, 198279, 71-1522; 19125, UCMA, 95832, 198282, 77-427; 19125, UCMA, 95831, 198281, 74-490; 19126, USMG5, 95833, 198283, 68-244; 19126, USMG5, 95834, 198284, 264-440; 19126, USMG5, 95835, 198285, 339-515; 19126, USMG5, 95836, 198286, 330-506; 19126, USMG5, 95837, 198287, 484-660; 19127, URGCP, 95840, 198290, 396-885; 19127, URGCP, 95842, 198292, 225-591; 19127, URGCP, 95844, 198294, 53-343; 19127, URGCP, 95845, 198295, 50-592; 19127, URGCP, 95838, 198288, 2238-4904; 19127, URGCP, 95839, 198289, 41-2809; 19127, URGCP, 95841, 198291, 176-2842; 19127, URGCP, 95843, 198293, 495-3290; 19128, UBP1, 95848, 198298, 275-769; 19128, UBP1, 95850, 198300, 138-581; 19128, UBP1, 95846, 198296, 255-1877; 19128, UBP1, 95847, 198297, 531-2153; 19128, UBP1, 95849, 198299, 163-1677; 19129, UBTF, 95855, 198305, 92-674; 19129, UBTF, 95856, 198306, 183-2420; 19129, UBTF, 95858, 198308, 274-721; 19129, UBTF, 95859, 198309, 1-110; 19129, UBTF, 95851, 198301, 494-2788; 19129, UBTF, 95852, 198302, 292-2475; 19129, UBTF, 95853, 198303, 374-2557; 19129, UBTF, 95854, 198304, 122-2416; 19129, UBTF, 95857, 198307, 274-2457; 19129, UBTF, 95860, 198310, 274-2568; 19129, UBTF, 95861, 198311, 181-2364; 19130, UBTFL1, 95862, 198312, 1-1182; 19131, USF1, 95863, 198313, 85-933; 19131, USF1, 95866, 198316, 294-610; 19131, USF1, 95867, 198317, 1-496; 19131, USF1, 95868, 198318, 68-720; 19131, USF1, 95869, 198319, 191-337; 19131, USF1, 95864, 198314, 116-1048; 19131, USF1, 95865, 198315, 206-1138; 19132, USF2, 95873, 198323, 1-762; 19132, USF2, 95874, 198324, 1-510; 19132, USF2, 95875, 198325, 1-446; 19132, USF2, 95876, 198326, 1-259; 19132, USF2, 95878, 198328, 1-1050; 19132, USF2, 95879, 198329, 122-550; 19132, USF2, 95880, 198330, 1-339; 19132, USF2, 95870, 198320, 38-1078; 19132, USF2, 95871, 198321, 125-964; 19132, USF2, 95872, 198322, 1-648; 19132, USF2, 95877, 198327, 38-1054; 19133, USF3, 95883, 198333, 412-678; 19133, USF3, 95881, 198331, 412-7149; 19133, USF3, 95882, 198332, 19-6756; 19134, UNG, 95886, 198336, 177-602; 19134, UNG, 95887, 198337, 180-956; 19134, UNG, 95884, 198334, 107-1048; 19134, UNG, 95885, 198335, 210-1124; 19135, UPRT, 95888, 198338, 129-557; 19135, UPRT, 95889, 198339, 166-1011; 19135, UPRT, 95892, 198342, 54-575; 19135, UPRT, 95890, 198340, 168-1097; 19135, UPRT, 95891, 198341, 140-670; 19136, URB1, 95893, 198343, 117-6932; 19137, URB2, 95895, 198345, 392-643; 19137, URB2, 95894, 198344, 137-4711; 19138, URAD, 95896, 198346, 18-539; 19139, UPB1, 95898, 198348, 163-723; 19139, UPB1, 95899, 198349, 1298-1426; 19139, UPB1, 95897, 198347, 345-1499; 19140, URGCP-MRPS24, 95900, 198350, 15-347; 19141, URI1, 95903, 198353, 1-121; 19141, URI1, 95904, 198354, 272-486; 19141, URI1, 95905, 198355, 238-390; 19141, URI1, 95906, 198356, 1-685; 19141, URI1, 95907, 198357, 416-514; 19141, URI1, 95908, 198358, 288-419; 19141, URI1, 95909, 198359, 212-578; 19141, URI1, 95910, 198360, 1-54; 19141, URI1, 95901, 198351, 49-1476; 19141, URI1, 95902, 198352, 298-1905; 19142, UMPS, 95912, 198362, 40-213; 19142, UMPS, 95913, 198363, 21-194; 19142, UMPS, 95914, 198364, 28-228; 19142, UMPS, 95915, 198365, 21-449; 19142, UMPS, 95916, 198366, 21-221; 19142, UMPS, 95917, 198367, 21-1049; 19142, UMPS, 95918, 198368, 28-228; 19142, UMPS, 95911, 198361, 107-1549; 19143, UPP1, 95922, 198372, 594-682; 19143, UPP1, 95923, 198373, 481-918; 19143, UPP1, 95924, 198374, 336-593; 19143, UPP1, 95925, 198375, 433-864; 19143, UPP1, 95928, 198378, 329-844; 19143, UPP1, 95919, 198369, 624-1556; 19143, UPP1, 95920, 198370, 353-463; 19143, UPP1, 95921, 198371, 381-1313; 19143, UPP1, 95926, 198376, 528-638; 19143, UPP1, 95927, 198377, 180-290; 19144, UPP2, 95929, 198379, 195-1148; 19144, UPP2, 95930, 198380, 47-1171; 19145, UCK1, 95935, 198385, 64-720; 19145, UCK1, 95931, 198381, 86-691; 19145, UCK1, 95932, 198382, 6-812; 19145, UCK1, 95933, 198383, 27-875; 19145, UCK1, 95934, 198384, 95-928; 19146, UCKL1, 95939, 198389, 484-888; 19146, UCKL1, 95936, 198386, 44-1690; 19146, UCKL1, 95937, 198387, 14-1273; 19146, UCKL1, 95938, 198388, 301-1902; 19147, UCK2, 95940, 198390, 304-1089; 19147, UCK2, 95941, 198391, 700-1035; 19147, UCK2, 95942, 198392, 167-502; 19148, UROC1, 95943, 198393, 55-2085; 19148, UROC1, 95944, 198394, 35-2245; 19149, UCN, 95945, 198395, 300-674; 19150, UCN2, 95946, 198396, 84-422; 19151, UCN3, 95947, 198397, 229-714; 19152, UMOD, 95950, 198400, 68-2137; 19152, UMOD, 95951, 198401, 459-546; 19152, UMOD, 95952, 198402, 214-589; 19152, UMOD, 95953, 198403, 273-537; 19152, UMOD, 95954, 198404, 146-559; 19152, UMOD, 95955, 198405, 62-545; 19152, UMOD, 95957, 198407, 255-737; 19152, UMOD, 95958, 198408, 286-543; 19152, UMOD, 95959, 198409, 219-526; 19152, UMOD, 95948, 198398, 293-2215; 19152, UMOD, 95949, 198399, 125-2146; 19152, UMOD, 95956, 198406, 148-2070; 19153, UMODL1, 95960, 198410, 1-728; 19153, UMODL1, 95965, 198415, 1-236; 19153, UMODL1, 95966, 198416, 1-329; 19153, UMODL1, 95967, 198417, 1-524; 19153, UMODL1, 95968, 198418, 1-341; 19153, UMODL1, 95969, 198419, 1-416; 19153, UMODL1, 95961, 198411, 397-4137; 19153, UMODL1, 95962, 198412, 397-4521; 19153, UMODL1, 95963, 198413, 1-4341; 19153, UMODL1, 95964, 198414, 1-3957; 19154, UST, 95970, 198420, 104-1324; 19155, UPK1A, 95971, 198421, 1-777; 19155, UPK1A, 95972, 198422, 1-822; 19155, UPK1A, 95973, 198423, 28-849; 19155, UPK1A, 95974, 198424, 28-804; 19156, UPK1B, 95976, 198426, 5-763; 19156, UPK1B, 95977, 198427, 180-687; 19156, UPK1B, 95978, 198428, 103-670; 19156, UPK1B, 95979, 198429, 294-836; 19156, UPK1B, 95975, 198425, 150-932; 19157, UPK2, 95980, 198430, 36-590; 19158, UPK3A, 95981, 198431, 33-896; 19158, UPK3A, 95982, 198432, 24-524; 19159, UPK3B, 95988, 198438, 39-836; 19159, UPK3B, 95983, 198433, 129-1091; 19159, UPK3B, 95984, 198434, 226-1056; 19159, UPK3B, 95985, 198435, 39-836; 19159, UPK3B, 95986, 198436, 129-1091; 19159, UPK3B, 95987, 198437, 226-1056; 19160, UPK3BL, 95989, 198439, 51-842; 19161, UROD, 95991, 198441, 1-682; 19161, UROD, 95992, 198442, 21-600; 19161, UROD, 95990, 198440, 120-1223; 19162, UROS, 95993, 198443, 88-489; 19162, UROS, 95994, 198444, 195-614; 19162, UROS, 95997, 198447, 247-802; 19162, UROS, 95998, 198448, 1-331; 19162, UROS, 95999, 198449, 1-205; 19162, UROS, 96000, 198450, 1-369; 19162, UROS, 95995, 198445, 134-931; 19162, UROS, 95996, 198446, 226-1023; 19163, UTS2, 96003, 198453, 322-741; 19163, UTS2, 96001, 198451, 1-420; 19163, UTS2, 96002, 198452, 33-407; 19164, UTS2R, 96004, 198454, 96-1265; 19165, UTS2B, 96006, 198456, 143-388; 19165, UTS2B, 96008, 198458, 892-1005; 19165, UTS2B, 96009, 198459, 122-367; 19165, UTS2B, 96010, 198460, 73-471; 19165, UTS2B, 96005, 198455, 788-1147; 19165, UTS2B, 96007, 198457, 215-574; 19166, USH1C, 96016, 198466, 88-1040; 19166, USH1C, 96011, 198461, 1-2700; 19166, USH1C, 96012, 198462, 110-1768; 19166, USH1C, 96013, 198463, 96-1307; 19166, USH1C, 96014, 198464, 246-1811; 19166, USH1C, 96015, 198465, 94-1695; 19167, USHBP1, 96018, 198468, 107-1258; 19167, USHBP1, 96019, 198469, 146-2065; 19167, USHBP1, 96021, 198471, 452-549; 19167, USHBP1, 96022, 198472, 213-577; 19167, USHBP1, 96017, 198467, 175-2286; 19167, USHBP1, 96020, 198470, 93-299; 19168, USH1G, 96023, 198473, 184-531; 19168, USH1G, 96024, 198474, 184-1569; 19169, USH2A, 96025, 198475, 388-15996; 19169, USH2A, 96026, 198476, 388-5028; 19170, USO1, 96027, 198477, 223-3144; 19170, USO1, 96028, 198478, 228-3116; 19171, USP6NL, 96030, 198480, 60-2615; 19171, USP6NL, 96032, 198482, 164-310; 19171, USP6NL, 96029, 198479, 44-2581; 19171, USP6NL, 96031, 198481, 396-2882; 19172, UTP11L, 96033, 198483, 62-823; 19173, UTP14C, 96034, 198484, 734-3034; 19174, UTP14A, 96037, 198487, 20-979; 19174, UTP14A, 96035, 198485, 29-2344; 19174, UTP14A, 96036, 198486, 91-2250; 19175, UTP15, 96039, 198489, 1-1637; 19175, UTP15, 96040, 198490, 517-538; 19175, UTP15, 96042, 198492, 382-577; 19175, UTP15, 96038, 198488, 256-1812; 19175, UTP15, 96041, 198491, 224-1723; 19175, UTP15, 96043, 198493, 653-1639; 19176, UTP18, 96045, 198495, 1-130; 19176, UTP18, 96046, 198496, 1-534; 19176, UTP18, 96047, 198497, 1-348; 19176, UTP18, 96048, 198498, 1-432; 19176, UTP18, 96049, 198499, 1-371; 19176, UTP18, 96044, 198494, 58-1728; 19177, UTP20, 96050, 198500, 175-8532; 19178, UTP23, 96052, 198502, 33-350; 19178, UTP23, 96053, 198503, 100-342; 19178, UTP23, 96054, 198504, 133-327; 19178, UTP23, 96055, 198505, 97-563; 19178, UTP23, 96056, 198506, 96-305; 19178, UTP23, 96057, 198507, 133-336; 19178, UTP23, 96051, 198501, 102-851; 19179, UTP3, 96058, 198508, 200-1639; 19180, UTP6, 96060, 198510, 1-184; 19180, UTP6, 96061, 198511, 1-88; 19180, UTP6, 96059, 198509, 139-1932; 19181, UTRN, 96062, 198512, 1-753; 19181, UTRN, 96063, 198513, 382-579; 19181, UTRN, 96064, 198514, 248-3214; 19181, UTRN, 96066, 198516, 74-633; 19181, UTRN, 96067, 198517, 214-354; 19181, UTRN, 96068, 198518, 111-572; 19181, UTRN, 96069, 198519, 125-666; 19181, UTRN, 96070, 198520, 125-678; 19181, UTRN, 96071, 198521, 148-597; 19181, UTRN, 96065, 198515, 1-10302; 19182, UVRAG, 96074, 198524, 1-273; 19182, UVRAG, 96075, 198525, 116-511; 19182, UVRAG, 96077, 198527, 286-2082; 19182, UVRAG, 96072, 198522, 242-2341; 19182, UVRAG, 96073, 198523, 753-1736; 19182, UVRAG, 96076, 198526, 931-1914; 19182, UVRAG, 96078, 198528, 478-1461; 19183, UACA, 96081, 198531, 24-3947; 19183, UACA, 96082, 198532, 73-749; 19183, UACA, 96083, 198533, 367-2060; 19183, UACA, 96084, 198534, 394-4599; 19183, UACA, 96079, 198529, 187-4437; 19183, UACA, 96080, 198530, 394-4605; 19184, UVSSA, 96087, 198537, 1-409; 19184, UVSSA, 96085, 198535, 448-2577; 19184, UVSSA, 96086, 198536, 185-2314; 19184, UVSSA, 96088, 198538, 415-1197; 19184, UVSSA, 96089, 198539, 347-2476; 19184, UVSSA, 96090, 198540, 433-1215; 19185, VAC14, 96093, 198543, 261-383; 19185, VAC14, 96094, 198544, 1-780; 19185, VAC14, 96095, 198545, 83-688; 19185, VAC14, 96096, 198546, 1-52; 19185, VAC14, 96097, 198547, 1-554; 19185, VAC14, 96091, 198541, 262-2610; 19185, VAC14, 96092, 198542, 1031-1675; 19186, VRK1, 96099, 198549, 1-697; 19186, VRK1, 96100, 198550, 1-196; 19186, VRK1, 96101, 198551, 1-529; 19186, VRK1, 96098, 198548, 150-1340; 19187, VRK2, 96104, 198554, 116-295; 19187, VRK2, 96107, 198557, 306-553; 19187, VRK2, 96102, 198552, 184-1710; 19187, VRK2, 96103, 198553, 128-1585; 19187, VRK2, 96105, 198555, 628-1818; 19187, VRK2, 96106, 198556, 517-1689; 19187, VRK2, 96108, 198558, 746-2272; 19188, VRK3, 96111, 198561, 290-822; 19188, VRK3, 96112, 198562, 334-840; 19188, VRK3, 96113, 198563, 89-307; 19188, VRK3, 96114, 198564, 122-572;

19188, VRK3, 96115, 198565, 92-1312; 19188, VRK3, 96116, 198566, 67-810; 19188, VRK3, 96119, 198569, 215-552; 19188, VRK3, 96120, 198570, 290-836; 19188, VRK3, 96121, 198571, 67-1155; 19188, VRK3, 96122, 198572, 65-283; 19188, VRK3, 96123, 198573, 89-682; 19188, VRK3, 96126, 198576, 1-354; 19188, VRK3, 96109, 198559, 185-1609; 19188, VRK3, 96110, 198560, 171-1445; 19188, VRK3, 96117, 198567, 666-2090; 19188, VRK3, 96118, 198568, 122-1396; 19188, VRK3, 96124, 198574, 126-1364; 19188, VRK3, 96125, 198575, 89-1513; 19189, VPS11, 96128, 198578, 133-2958; 19189, VPS11, 96129, 198579, 249-3044; 19189, VPS11, 96130, 198580, 1-542; 19189, VPS11, 96127, 198577, 1206-2660; 19190, VPS13A, 96135, 198585, 311-643; 19190, VPS13A, 96136, 198586, 1-1151; 19190, VPS13A, 96137, 198587, 1-534; 19190, VPS13A, 96138, 198588, 1-125; 19190, VPS13A, 96139, 198589, 436-768; 19190, VPS13A, 96131, 198581, 172-9459; 19190, VPS13A, 96132, 198582, 261-9785; 19190, VPS13A, 96133, 198583, 353-9562; 19190, VPS13A, 96134, 198584, 261-9668; 19191, VPS13B, 96144, 198594, 1-466; 19191, VPS13B, 96140, 198590, 112-2703; 19191, VPS13B, 96141, 198591, 112-12105; 19191, VPS13B, 96142, 198592, 112-12180; 19191, VPS13B, 96143, 198593, 104-1351; 19191, VPS13B, 96145, 198595, 112-4395; 19192, VPS13C, 96146, 198596, 100-11232; 19192, VPS13C, 96147, 198597, 75-11336; 19192, VPS13C, 96148, 198598, 75-10961; 19192, VPS13C, 96149, 198599, 75-10832; 19193, VPS13D, 96150, 198600, 1-9632; 19193, VPS13D, 96151, 198601, 681-815; 19193, VPS13D, 96152, 198602, 1-138; 19193, VPS13D, 96153, 198603, 131-13297; 19193, VPS13D, 96154, 198604, 131-13222; 19194, VPS16, 96157, 198607, 140-819; 19194, VPS16, 96158, 198608, 143-966; 19194, VPS16, 96155, 198605, 73-2592; 19194, VPS16, 96156, 198606, 73-2160; 19195, VPS18, 96160, 198610, 318-710; 19195, VPS18, 96161, 198611, 303-668; 19195, VPS18, 96159, 198609, 340-3261; 19196, VPS25, 96163, 198613, 1-334; 19196, VPS25, 96164, 198614, 345-668; 19196, VPS25, 96165, 198615, 8-307; 19196, VPS25, 96162, 198612, 41-571; 19197, VPS28, 96168, 198618, 95-650; 19197, VPS28, 96169, 198619, 403-561; 19197, VPS28, 96170, 198620, 39-146; 19197, VPS28, 96172, 198622, 90-573; 19197, VPS28, 96174, 198624, 39-146; 19197, VPS28, 96166, 198616, 110-775; 19197, VPS28, 96167, 198617, 110-811; 19197, VPS28, 96171, 198621, 39-704; 19197, VPS28, 96173, 198623, 39-740; 19198, VPS33A, 96176, 198626, 106-567; 19198, VPS33A, 96177, 198627, 32-160; 19198, VPS33A, 96178, 198628, 9-569; 19198, VPS33A, 96175, 198625, 114-1904; 19199, VPS33B, 96180, 198630, 348-2120; 19199, VPS33B, 96181, 198631, 265-507; 19199, VPS33B, 96179, 198629, 355-2208; 19200, VPS36, 96182, 198632, 29-1189; 19200, VPS36, 96183, 198633, 393-1379; 19201, VPS37A, 96186, 198636, 312-1265; 19201, VPS37A, 96187, 198637, 315-476; 19201, VPS37A, 96189, 198639, 1-513; 19201, VPS37A, 96190, 198640, 308-655; 19201, VPS37A, 96191, 198641, 2-232; 19201, VPS37A, 96184, 198634, 675-1868; 19201, VPS37A, 96185, 198635, 152-709; 19201, VPS37A, 96188, 198638, 123-1241; 19202, VPS37B, 96193, 198643, 1536-2088; 19202, VPS37B, 96194, 198644, 66-879; 19202, VPS37B, 96192, 198642, 383-1240; 19203, VPS37C, 96196, 198646, 63-506; 19203, VPS37C, 96195, 198645, 234-1301; 19204, VPS37D, 96198, 198648, 67-567; 19204, VPS37D, 96197, 198647, 135-890; 19205, VPS39, 96201, 198651, 1-144; 19205, VPS39, 96199, 198649, 164-2791; 19205, VPS39, 96200, 198650, 1-2661; 19206, VPS4A, 96202, 198652, 157-1470; 19207, VPS4B, 96204, 198654, 132-518; 19207, VPS4B, 96205, 198655, 205-540; 19207, VPS4B, 96203, 198653, 205-1539; 19208, VPS41, 96206, 198656, 18-647; 19208, VPS41, 96209, 198659, 1-451; 19208, VPS41, 96210, 198660, 1-330; 19208, VPS41, 96211, 198661, 247-465; 19208, VPS41, 96212, 198662, 219-532; 19208, VPS41, 96213, 198663, 18-548; 19208, VPS41, 96214, 198664, 108-575; 19208, VPS41, 96207, 198657, 56-2620; 19208, VPS41, 96208, 198658, 1-2490; 19209, VPS45, 96217, 198667, 31-977; 19209, VPS45, 96219, 198669, 191-1534; 19209, VPS45, 96220, 198670, 275-871; 19209, VPS45, 96215, 198665, 241-1857; 19209, VPS45, 96216, 198666, 547-2259; 19209, VPS45, 96218, 198668, 674-2290; 19210, VPS51, 96222, 198672, 205-534; 19210, VPS51, 96223, 198673, 1-300; 19210, VPS51, 96224, 198674, 8-253; 19210, VPS51, 96225, 198675, 137-837; 19210, VPS51, 96226, 198676, 1-217; 19210, VPS51, 96227, 198677, 25-1027; 19210, VPS51, 96228, 198678, 1-599; 19210, VPS51, 96229, 198679, 90-854; 19210, VPS51, 96230, 198680, 228-723; 19210, VPS51, 96231, 198681, 25-516; 19210, VPS51, 96221, 198671, 93-2441; 19211, VPS52, 96235, 198685, 1-378; 19211, VPS52, 96239, 198689, 202-468; 19211, VPS52, 96240, 198690, 202-468; 19211, VPS52, 96241, 198691, 202-468; 19211, VPS52, 96242, 198692, 1-378; 19211, VPS52, 96243, 198693, 202-468; 19211, VPS52, 96244, 198694, 202-468; 19211, VPS52, 96232, 198682, 220-2391; 19211, VPS52, 96233, 198683, 220-2391; 19211, VPS52, 96234, 198684, 220-2391; 19211, VPS52, 96236, 198686, 220-2391; 19211, VPS52, 96237, 198687, 220-2391; 19211, VPS52, 96238, 198688, 220-2391; 19212, VPS53, 96246, 198696, 1-1644; 19212, VPS53, 96247, 198697, 1-1269; 19212, VPS53, 96249, 198699, 148-798; 19212, VPS53, 96250, 198700, 1-714; 19212, VPS53, 96251, 198701, 122-559; 19212, VPS53, 96253, 198703, 410-613; 19212, VPS53, 96245, 198695, 135-2147; 19212, VPS53, 96248, 198698, 148-2646; 19212, VPS53, 96252, 198702, 138-2237; 19213, VPS54, 96257, 198707, 1-245; 19213, VPS54, 96254, 198704, 156-3089; 19213, VPS54, 96255, 198705, 591-3065; 19213, VPS54, 96256, 198706, 156-3053; 19214, VPS72, 96258, 198708, 38-1165; 19214, VPS72, 96259, 198709, 93-1187; 19215, VPS8, 96260, 198710, 172-4458; 19215, VPS8, 96261, 198711, 89-583; 19215, VPS8, 96262, 198712, 1-173; 19215, VPS8, 96263, 198713, 440-661; 19215, VPS8, 96264, 198714, 89-295; 19215, VPS8, 96265, 198715, 1-180; 19215, VPS8, 96268, 198718, 1-326; 19215, VPS8, 96269, 198719, 128-549; 19215, VPS8, 96270, 198720, 206-811; 19215, VPS8, 96271, 198721, 1-185; 19215, VPS8, 96272, 198722, 228-592; 19215, VPS8, 96273, 198723, 1-207; 19215, VPS8, 96266, 198716, 144-4424; 19215, VPS8, 96267, 198717, 132-4142; 19215, VPS8, 96274, 198724, 108-4394; 19216, VMP1, 96276, 198726, 330-606; 19216, VMP1, 96277, 198727, 1-176; 19216, VMP1, 96278, 198728, 125-352; 19216, VMP1, 96279, 198729, 128-352; 19216, VMP1, 96280, 198730, 80-580; 19216, VMP1, 96281, 198731, 450-583; 19216, VMP1, 96282, 198732, 387-800; 19216, VMP1, 96283, 198733, 126-260; 19216, VMP1, 96284, 198734, 108-341; 19216, VMP1, 96285, 198735, 1-678; 19216, VMP1, 96275, 198725, 311-1531; 19217, AKT1, 96289, 198739, 1-553; 19217, AKT1, 96292, 198742, 1-511; 19217, AKT1, 96293, 198743, 279-553; 19217, AKT1, 96295, 198745, 1-441; 19217, AKT1, 96286, 198736, 432-1874; 19217, AKT1, 96287, 198737, 276-1718; 19217, AKT1, 96288, 198738, 1482-2924; 19217, AKT1, 96290, 198740, 654-2096; 19217, AKT1, 96291, 198741, 153-1595; 19217, AKT1, 96294, 198744, 1482-2924; 19218, AKT2, 96297, 198747, 170-546; 19218, AKT2, 96298, 198748, 324-533;

19218, AKT2, 96299, 198749, 281-681; 19218, AKT2, 96301, 198751, 618-904; 19218, AKT2, 96302, 198752, 261-582; 19218, AKT2, 96303, 198753, 423-974; 19218, AKT2, 96305, 198755, 440-798; 19218, AKT2, 96306, 198756, 354-554; 19218, AKT2, 96307, 198757, 176-577; 19218, AKT2, 96308, 198758, 577-974; 19218, AKT2, 96309, 198759, 174-564; 19218, AKT2, 96310, 198760, 386-595; 19218, AKT2, 96311, 198761, 270-567; 19218, AKT2, 96312, 198762, 243-452; 19218, AKT2, 96313, 198763, 1-158; 19218, AKT2, 96314, 198764, 1-154; 19218, AKT2, 96315, 198765, 1-877; 19218, AKT2, 96316, 198766, 1-321; 19218, AKT2, 96317, 198767, 136-606; 19218, AKT2, 96318, 198768, 239-525; 19218, AKT2, 96319, 198769, 129-583; 19218, AKT2, 96320, 198770, 1-170; 19218, AKT2, 96321, 198771, 303-1655; 19218, AKT2, 96322, 198772, 1-390; 19218, AKT2, 96323, 198773, 1-352; 19218, AKT2, 96296, 198746, 46-1362; 19218, AKT2, 96300, 198750, 300-1745; 19218, AKT2, 96304, 198754, 300-1616; 19219, AKT3, 96328, 198778, 144-560; 19219, AKT3, 96332, 198782, 144-560; 19219, AKT3, 96324, 198774, 113-1552; 19219, AKT3, 96325, 198775, 67-1464; 19219, AKT3, 96326, 198776, 202-1641; 19219, AKT3, 96327, 198777, 154-1551; 19219, AKT3, 96329, 198779, 1-1440; 19219, AKT3, 96330, 198780, 67-1464; 19219, AKT3, 96331, 198781, 154-1551; 19220, VCP, 96334, 198784, 470-950; 19220, VCP, 96335, 198785, 377-722; 19220, VCP, 96333, 198783, 897-3317; 19221, VCPIP1, 96336, 198786, 260-3928; 19222, VCPKMT, 96337, 198787, 49-633; 19222, VCPKMT, 96338, 198788, 6-695; 19222, VCPKMT, 96339, 198789, 49-483; 19223, VARS, 96342, 198792, 1-284; 19223, VARS, 96343, 198793, 1-863; 19223, VARS, 96344, 198794, 1-3551; 19223, VARS, 96345, 198795, 442-1541; 19223, VARS, 96346, 198796, 1-863; 19223, VARS, 96349, 198799, 283-804; 19223, VARS, 96350, 198800, 1-863; 19223, VARS, 96351, 198801, 1-863; 19223, VARS, 96352, 198802, 283-804; 19223, VARS, 96353, 198803, 283-804; 19223, VARS, 96354, 198804, 283-804; 19223, VARS, 96355, 198805, 283-804; 19223, VARS, 96357, 198807, 1-863; 19223, VARS, 96358, 198808, 283-804; 19223, VARS, 96359, 198809, 1-863; 19223, VARS, 96340, 198790, 442-4236; 19223, VARS, 96341, 198791, 442-4236; 19223, VARS, 96347, 198797, 442-4236; 19223, VARS, 96348, 198798, 442-4236; 19223, VARS, 96356, 198806, 442-4236; 19224, VARS2, 96361, 198811, 633-3824; 19224, VARS2, 96362, 198812, 633-3824; 19224, VARS2, 96363, 198813, 126-1103; 19224, VARS2, 96364, 198814, 116-460; 19224, VARS2, 96365, 198815, 633-3824; 19224, VARS2, 96366, 198816, 633-3824; 19224, VARS2, 96367, 198817, 116-460; 19224, VARS2, 96368, 198818, 126-1103; 19224, VARS2, 96369, 198819, 126-1103; 19224, VARS2, 96370, 198820, 633-3824; 19224, VARS2, 96371, 198821, 116-460; 19224, VARS2, 96372, 198822, 116-460; 19224, VARS2, 96373, 198823, 116-460; 19224, VARS2, 96374, 198824, 126-1103; 19224, VARS2, 96375, 198825, 126-1103; 19224, VARS2, 96376, 198826, 126-1103; 19224, VARS2, 96377, 198827, 116-460; 19224, VARS2, 96378, 198828, 633-3818; 19224, VARS2, 96380, 198830, 633-3818; 19224, VARS2, 96381, 198831, 82-3363; 19224, VARS2, 96382, 198832, 82-3363; 19224, VARS2, 96383, 198833, 82-3363; 19224, VARS2, 96384, 198834, 633-3818; 19224, VARS2, 96385, 198835, 633-3818; 19224, VARS2, 96386, 198836, 633-3818; 19224, VARS2, 96387, 198837, 82-3363; 19224, VARS2, 96388, 198838, 633-3818; 19224, VARS2, 96389, 198839, 82-3363; 19224, VARS2, 96360, 198810, 633-3824; 19224, VARS2, 96379, 198829, 82-3363; 19224, VARS2, 96390, 198840, 345-3116; 19225, VAPA, 96393, 198843, 195-284; 19225, VAPA, 96391, 198841, 196-1080; 19225, VAPA, 96392, 198842, 256-1005; 19226, VAPB, 96396, 198846, 95-310; 19226, VAPB, 96394, 198844, 148-447; 19226, VAPB, 96395, 198845, 339-1070; 19227, VANGL1, 96397, 198847, 216-1790; 19227, VANGL1, 96398, 198848, 272-1846; 19227, VANGL1, 96399, 198849, 13-1587; 19227, VANGL1, 96400, 198850, 234-1802; 19228, VANGL2, 96401, 198851, 475-2040; 19229, VNN1, 96402, 198852, 15-1556; 19230, VNN2, 96404, 198854, 88-960; 19230, VNN2, 96405, 198855, 1-660; 19230, VNN2, 96406, 198856, 1-651; 19230, VNN2, 96407, 198857, 97-594; 19230, VNN2, 96408, 198858, 241-543; 19230, VNN2, 96409, 198859, 22-576; 19230, VNN2, 96410, 198860, 84-479; 19230, VNN2, 96411, 198861, 1-360; 19230, VNN2, 96413, 198863, 281-587; 19230, VNN2, 96403, 198853, 126-1688; 19230, VNN2, 96412, 198862, 1-579; 19230, VNN2, 96414, 198864, 101-1504; 19230, VNN2, 96415, 198865, 1-588; 19230, VNN2, 96416, 198866, 1-900; 19231, VNN3, 96420, 198870, 1-181; 19231, VNN3, 96421, 198871, 74-583; 19231, VNN3, 96422, 198872, 46-1548; 19231, VNN3, 96417, 198867, 74-898; 19231, VNN3, 96418, 198868, 1-354; 19231, VNN3, 96419, 198869, 74-427; 19231, VNN3, 96423, 198873, 74-517; 19231, VNN3, 96424, 198874, 1-354; 19231, VNN3, 96425, 198875, 1-390; 19231, VNN3, 96426, 198876, 1-624; 19231, VNN3, 96427, 198877, 1-402; 19231, VNN3, 96428, 198878, 1-486; 19231, VNN3, 96429, 198879, 1-390; 19232, VCX, 96430, 198880, 117-677; 19232, VCX, 96432, 198882, 308-724; 19232, VCX, 96431, 198881, 220-840; 19233, VCX2, 96433, 198883, 308-727; 19234, VCX3A, 96435, 198885, 308-808; 19234, VCX3A, 96436, 198886, 308-724; 19234, VCX3A, 96434, 198884, 308-868; 19235, VCX3B, 96437, 198887, 26-670; 19235, VCX3B, 96439, 198889, 308-868; 19235, VCX3B, 96440, 198890, 308-724; 19235, VCX3B, 96438, 198888, 308-1048; 19236, VCY, 96441, 198891, 74-451; 19237, VCY1B, 96442, 198892, 74-451; 19238, VCAM1, 96445, 198895, 98-1720; 19238, VCAM1, 96443, 198893, 102-2321; 19238, VCAM1, 96444, 198894, 107-2050; 19238, VCAM1, 96446, 198896, 120-2153; 19239, VEGFA, 96447, 198897, 129-620; 19239, VEGFA, 96448, 198898, 1-954; 19239, VEGFA, 96449, 198899, 1-1239; 19239, VEGFA, 96450, 198900, 1-984; 19239, VEGFA, 96451, 198901, 495-1610; 19239, VEGFA, 96453, 198903, 1-1188; 19239, VEGFA, 96454, 198904, 1-1065; 19239, VEGFA, 96455, 198905, 1-1170; 19239, VEGFA, 96457, 198907, 1-1116; 19239, VEGFA, 96460, 198910, 1-336; 19239, VEGFA, 96464, 198914, 1-970; 19239, VEGFA, 96466, 198916, 499-1482; 19239, VEGFA, 96467, 198917, 499-1737; 19239, VEGFA, 96468, 198918, 499-1614; 19239, VEGFA, 96469, 198919, 499-1452; 19239, VEGFA, 96452, 198902, 466-909; 19239, VEGFA, 96456, 198906, 1-414; 19239, VEGFA, 96458, 198908, 165-812; 19239, VEGFA, 96459, 198909, 1-525; 19239, VEGFA, 96461, 198911, 39-614; 19239, VEGFA, 96462, 198912, 1-576; 19239, VEGFA, 96463, 198913, 39-737; 19239, VEGFA, 96465, 198915, 1-630; 19240, VEGFB, 96472, 198922, 1-98; 19240, VEGFB, 96470, 198920, 297-920; 19240, VEGFB, 96471, 198921, 15-581; 19241, VEGFC, 96473, 198923, 417-1676; 19242, VEZF1, 96474, 198924, 1-1022; 19242, VEZF1, 96476, 198926, 777-825; 19242, VEZF1, 96477, 198927, 90-1628; 19242, VEZF1, 96475, 198925, 42-1607; 19243, VIP, 96480, 198930, 1-358; 19243, VIP, 96478, 198928, 173-682; 19243, VIP, 96479, 198929, 173-685; 19244, VIPR1, 96482, 198932, 125-262; 19244, VIPR1, 96483, 198933, 125-262; 19244, VIPR1, 96485, 198935, 73-210; 19244, VIPR1, 96486, 198936, 114-770; 19244, VIPR1, 96487, 198937, 120-257; 19244, VIPR1, 96488, 198938, 364-743; 19244, VIPR1, 96481, 198931, 114-1487; 19244, VIPR1, 96484, 198934, 625-1875; 19244, VIPR1, 96489, 198939, 392-1135; 19244, VIPR1, 96490, 198940, 160-1389; 19245, VIPR2, 96493, 198943, 89-1828; 19245, VIPR2, 96494, 198944, 82-315; 19245, VIPR2, 96491, 198941, 187-1503; 19245, VIPR2, 96492, 198942, 62-1330; 19246, VASP, 96496, 198946, 285-424; 19246, VASP, 96497, 198947, 1-551; 19246, VASP, 96498, 198948, 267-578; 19246, VASP, 96499, 198949, 520-696; 19246, VASP, 96500, 198950, 282-388; 19246, VASP, 96495, 198945, 357-1499; 19247, VASH1, 96503, 198953, 456-731; 19247, VASH1, 96501, 198951, 634-1731; 19247, VASH1, 96502, 198952, 494-1108; 19248, VASH2, 96507, 198957, 507-581; 19248, VASH2, 96504, 198954, 328-837; 19248, VASH2, 96505, 198955, 311-1246; 19248, VASH2, 96506, 198956, 351-1223; 19248, VASH2, 96508, 198958, 1-1068; 19248, VASH2, 96509, 198959, 111-866; 19248, VASH2, 96510, 198960, 383-1255; 19249, VASN, 96511, 198961, 156-2177; 19249, VASN, 96512, 198962, 156-2177; 19250, VAV1, 96513, 198963, 95-2566; 19250, VAV1, 96514, 198964, 1-2370; 19250, VAV1, 96516, 198966, 86-2458; 19250, VAV1, 96515, 198965, 81-2522; 19250, VAV1, 96517, 198967, 83-2620; 19251, VAV2, 96518, 198968, 33-2669; 19251, VAV2, 96519, 198969, 327-2933; 19251, VAV2, 96520, 198970, 4-2523; 19252, VAV3, 96523, 198973, 1-546; 19252, VAV3, 96525, 198975, 74-232; 19252, VAV3, 96526, 198976, 1-1850; 19252, VAV3, 96527, 198977, 74-232; 19252, VAV3, 96521, 198971, 276-2819; 19252, VAV3, 96522, 198972, 74-937; 19252, VAV3, 96524, 198974, 141-2768; 19253, VIMP, 96530, 198980, 28-528; 19253, VIMP, 96531, 198981, 1-655; 19253, VIMP, 96528, 198978, 34-603; 19253, VIMP, 96529, 198979, 30-599; 19254, CRK, 96534, 198984, 33-704; 19254, CRK, 96532, 198982, 142-1056; 19254, CRK, 96533, 198983, 107-721; 19255, CRKL, 96535, 198985, 510-1421; 19255, CRKL, 96536, 198986, 502-1413; 19256, VENTX, 96537, 198987, 512-1288; 19257, VAX1, 96538, 198988, 246-806; 19257, VAX1, 96539, 198989, 1-1005; 19258, VAX2, 96540, 198990, 33-905; 19259, VEPH1, 96544, 198994, 543-730; 19259, VEPH1, 96546, 198996, 392-557; 19259, VEPH1, 96547, 198997, 261-419; 19259, VEPH1, 96548, 198998, 254-463; 19259, VEPH1, 96549, 198999, 306-665; 19259, VEPH1, 96551, 199001, 252-746; 19259, VEPH1, 96541, 198991, 309-2810; 19259, VEPH1, 96542, 198992, 318-2819; 19259, VEPH1, 96543, 198993, 221-2587; 19259, VEPH1, 96545, 198995, 314-955; 19259, VEPH1, 96550, 199000, 524-1165; 19259, VEPH1, 96552, 199002, 158-691; 19260, VCAN, 96557, 199007, 411-5195; 19260, VCAN, 96558, 199008, 254-3973; 19260, VCAN, 96559, 199009, 240-1304; 19260, VCAN, 96553, 199003, 566-10756; 19260, VCAN, 96554, 199004, 357-7586; 19260, VCAN, 96555, 199005, 357-5285; 19260, VCAN, 96556, 199006, 106-2073; 19261, VRTN, 96561, 199011, 272-521; 19261, VRTN, 96560, 199010, 242-2350; 19262, VLDLR, 96562, 199012, 216-736; 19262, VLDLR, 96563, 199013, 91-2628; 19262, VLDLR, 96564, 199014, 357-2978; 19263, VTA1, 96565, 199015, 111-860; 19263, VTA1, 96568, 199018, 127-969; 19263, VTA1, 96566, 199016, 59-982; 19263, VTA1, 96567, 199017, 206-874; 19264, VAT1, 96571, 199021, 1-91; 19264, VAT1, 96573, 199023, 151-613; 19264, VAT1, 96574, 199024, 118-570; 19264, VAT1, 96575, 199025, 244-521; 19264, VAT1, 96576, 199026, 163-600; 19264, VAT1, 96577, 199027, 1-378; 19264, VAT1, 96569, 199019, 97-1278; 19264, VAT1, 96570, 199020, 147-926; 19264, VAT1, 96572, 199022, 35-1012; 19265, VAT1L, 96578, 199028, 154-1413; 19266, VTI1A, 96579, 199029, 117-770; 19266, VTI1A, 96580, 199030, 117-728; 19267, VTI1B, 96581, 199031, 122-256; 19267, VTI1B, 96583, 199033, 1-385; 19267, VTI1B, 96584, 199034, 1-310; 19267, VTI1B, 96585, 199035, 332-511; 19267, VTI1B, 96582, 199032, 343-1041; 19268, VAMP1, 96589, 199039, 115-465; 19268, VAMP1, 96586, 199036, 457-810; 19268, VAMP1, 96587, 199037, 147-503; 19268, VAMP1, 96588, 199038, 123-473; 19269, VAMP2, 96591, 199041, 482-838; 19269, VAMP2, 96592, 199042, 214-420; 19269, VAMP2, 96593, 199043, 70-411; 19269, VAMP2, 96590, 199040, 97-447; 19270, VAMP3, 96595, 199045, 575-793; 19270, VAMP3, 96594, 199044, 116-418; 19271, VAMP4, 96596, 199046, 388-813; 19271, VAMP4, 96597, 199047, 215-637; 19271, VAMP4, 96598, 199048, 201-626; 19272, VAMP5, 96599, 199049, 84-434; 19273, VAMP7, 96603, 199053, 99-278; 19273, VAMP7, 96600, 199050, 84-866; 19273, VAMP7, 96601, 199051, 166-828; 19273, VAMP7, 96602, 199052, 81-620; 19274, VAMP8, 96605, 199055, 55-354; 19274, VAMP8, 96606, 199056, 159-383; 19274, VAMP8, 96604, 199054, 157-459; 19275, VOPP1, 96608, 199058, 436-753; 19275, VOPP1, 96610, 199060, 231-548; 19275, VOPP1, 96611, 199061, 42-554; 19275, VOPP1, 96612, 199062, 287-574; 19275, VOPP1, 96613, 199063, 421-485; 19275, VOPP1, 96614, 199064, 135-464; 19275, VOPP1, 96615, 199065, 434-591; 19275, VOPP1, 96616, 199066, 308-625; 19275, VOPP1, 96618, 199068, 284-539; 19275, VOPP1, 96607, 199057, 202-720; 19275, VOPP1, 96609, 199059, 198-665; 19275, VOPP1, 96617, 199067, 168-659; 19275, VOPP1, 96619, 199069, 4-513; 19276, VGLL1, 96621, 199071, 1-183; 19276, VGLL1, 96622, 199072, 1-486; 19276, VGLL1, 96620, 199070, 171-947; 19277, VGLL2, 96623, 199073, 207-638; 19277, VGLL2, 96624, 199074, 191-1144; 19278, VGLL3, 96627, 199077, 1-624; 19278, VGLL3, 96625, 199075, 377-1339; 19278, VGLL3, 96626, 199076, 365-1345; 19279, VGLL4, 96628, 199078, 367-1239; 19279, VGLL4, 96629, 199079, 193-437; 19279, VGLL4, 96630, 199080, 74-581; 19279, VGLL4, 96631, 199081, 363-544; 19279, VGLL4, 96632, 199082, 197-766; 19279, VGLL4, 96633, 199083, 192-792; 19279, VGLL4, 96634, 199084, 85-466; 19279, VGLL4, 96636, 199086, 407-1297; 19279, VGLL4, 96637, 199087, 372-1067; 19279, VGLL4, 96638, 199088, 454-894; 19279, VGLL4, 96639, 199089, 56-726; 19279, VGLL4, 96640, 199090, 461-1348; 19279, VGLL4, 96642, 199092, 552-728; 19279, VGLL4, 96635, 199085, 319-939; 19279, VGLL4, 96641, 199091, 93-725; 19280, ERG, 96645, 199095, 63-1430; 19280, ERG, 96646, 199096, 63-1433; 19280, ERG, 96647, 199097, 187-1578; 19280, ERG, 96651, 199101, 155-1318; 19280, ERG, 96653, 199103, 390-1052; 19280, ERG, 96643, 199093, 104-1543; 19280, ERG, 96644, 199094, 184-1275; 19280, ERG, 96648, 199098, 150-1538; 19280, ERG, 96649, 199099, 296-1756; 19280, ERG, 96650, 199100, 273-1661; 19280, ERG, 96652, 199102, 187-1647; 19281, ETS1, 96659, 199109, 407-545; 19281, ETS1, 96654, 199104, 311-1636; 19281, ETS1, 96655, 199105, 86-1543; 19281, ETS1, 96656, 199106, 208-1272; 19281, ETS1, 96657, 199107, 271-1089; 19281, ETS1, 96658, 199108, 317-994; 19282, ETS2, 96662, 199112, 529-1033; 19282, ETS2, 96663, 199113, 162-972; 19282, ETS2, 96660, 199110, 461-1870; 19282, ETS2, 96661, 199111, 291-1700; 19283, VEZT, 96664, 199114, 1-1383; 19283, VEZT, 96665, 199115, 316-2484; 19283, VEZT, 96667, 199117, 40-339; 19283, VEZT, 96671, 199121, 267-562; 19283, VEZT, 96672, 199122, 10-207; 19283, VEZT, 96673, 199123, 26-482; 19283, VEZT, 96675, 199125, 99-296; 19283, VEZT, 96676, 199126, 40-336; 19283, VEZT, 96678, 199128, 34-213; 19283, VEZT, 96679, 199129, 34-138; 19283, VEZT, 96680, 199130, 53-250; 19283, VEZT, 96683, 199133, 90-566; 19283, VEZT, 96684, 199134, 42-608; 19283, VEZT, 96685, 199135, 298-565; 19283, VEZT, 96666, 199116, 106-2445; 19283, VEZT, 96668, 199118, 44-283; 19283, VEZT, 96669, 199119, 41-280; 19283, VEZT, 96670, 199120, 88-327; 19283, VEZT, 96674, 199124, 40-279; 19283, VEZT, 96677, 199127, 40-279; 19283, VEZT, 96681, 199131, 106-345; 19283, VEZT, 96682, 199132, 91-330; 19284, VGF, 96688, 199138, 206-1339; 19284, VGF, 96686, 199136, 241-2088; 19284, VGF, 96687, 199137, 150-1997; 19285, VIL1, 96690, 199140, 230-1780; 19285, VIL1, 96691, 199141, 1-639; 19285, VIL1, 96693, 199143, 60-532; 19285, VIL1, 96689, 199139, 89-2572; 19285, VIL1, 96692, 199142, 15-1280; 19286, VILL, 96696, 199146, 1-305; 19286, VILL, 96697, 199147, 191-582; 19286, VILL, 96698, 199148, 27-1751; 19286, VILL, 96699, 199149, 126-686; 19286, VILL, 96694, 199144, 267-2837; 19286, VILL, 96695, 199145, 87-2657; 19287, VIM, 96701, 199151, 1-522; 19287, VIM, 96702, 199152, 630-1316; 19287, VIM, 96703, 199153, 146-1441; 19287, VIM, 96700, 199150, 146-1546; 19287, VIM, 96704, 199154, 414-1814; 19288, VMAC, 96705, 199155, 34-543; 19289, VOL, 96708, 199158, 1-2421; 19289, VOL, 96709, 199159, 95-268; 19289, VOL, 96706, 199156, 95-3499; 19289, VOL, 96707, 199157, 95-3295; 19290, VSNL1, 96713, 199163, 250-562; 19290, VSNL1, 96714, 199164, 222-576; 19290, VSNL1, 96710, 199160, 272-847; 19290, VSNL1, 96711, 199161, 283-858; 19290, VSNL1, 96712, 199162, 526-1101; 19291, VSX1, 96715, 199165, 36-755; 19291, VSX1, 96716, 199166, 270-1367; 19291, VSX1, 96717, 199167, 36-878; 19291, VSX1, 96718, 199168, 36-692; 19291, VSX1, 96719, 199169, 36-746; 19291, VSX1, 96720, 199170, 36-941; 19292, VSX2, 96721, 199171, 91-1176; 19293, VDR, 96725, 199175, 187-937; 19293, VDR, 96726, 199176, 71-220; 19293, VDR, 96727, 199177, 245-562; 19293, VDR, 96729, 199179, 292-596; 19293, VDR, 96722, 199172, 283-1566; 19293, VDR, 96723, 199173, 270-1553; 19293, VDR, 96724, 199174, 374-1807; 19293, VDR, 96728, 199178, 152-1435; 19294, VKORC1, 96730, 199180, 32-481; 19294, VKORC1, 96733, 199183, 49-531; 19294, VKORC1, 96735, 199185, 323-808; 19294, VKORC1, 96736, 199186, 1-278; 19294, VKORC1, 96737, 199187, 333-461; 19294, VKORC1, 96731, 199181, 212-682; 19294, VKORC1, 96732, 199182, 228-506; 19294, VKORC1, 96734, 199184, 229-720; 19295, VKORC1L1, 96738, 199188, 106-636; 19295, VKORC1L1, 96739, 199189, 4-537; 19296, VMO1, 96740, 199190, 81-689; 19296, VMO1, 96741, 199191, 82-294; 19296, VMO1, 96742, 199192, 47-355; 19296, VMO1, 96743, 199193, 20-364; 19297, VIT, 96747, 199197, 167-2059; 19297, VIT, 96750, 199200, 1181-2224; 19297, VIT, 96751, 199201, 1-404; 19297, VIT, 96744, 199194, 127-2097; 19297, VIT, 96745, 199195, 303-2384; 19297, VIT, 96746, 199196, 303-2339; 19297, VIT, 96748, 199198, 116-2089; 19297, VIT, 96749, 199199, 229-840; 19298, VTN, 96753, 199203, 148-501; 19298, VTN, 96752, 199202, 620-2056; 19299, KIT, 96754, 199204, 98-3028; 19299, KIT, 96755, 199205, 98-3016; 19300, VMA21, 96756, 199206, 106-411; 19300, VMA21, 96757, 199207, 124-594; 19301, MAF, 96760, 199210, 1-1152; 19301, MAF, 96758, 199208, 813-2024; 19301, MAF, 96759, 199209, 813-1934; 19302, MAFA, 96761, 199211, 1-1062; 19303, MAFB, 96762, 199212, 391-1362; 19304, MAFF, 96766, 199216, 269-548; 19304, MAFF, 96767, 199217, 321-697; 19304, MAFF, 96763, 199213, 363-857; 19304, MAFF, 96764, 199214, 204-698; 19304, MAFF, 96765, 199215, 97-591; 19304, MAFF, 96768, 199218, 333-740; 19304, MAFF, 96769, 199219, 339-833; 19305, MAFG, 96772, 199222, 275-570; 19305, MAFG, 96770, 199220, 217-705; 19305, MAFG, 96771, 199221, 210-698; 19306, MAFK, 96773, 199223, 230-700; 19306, MAFK, 96774, 199224, 164-632; 19306, MAFK, 96775, 199225, 1016-1486; 19307, MOS, 96776, 199226, 1-1041; 19308, MYB, 96777, 199227, 200-2380; 19308, MYB, 96779, 199229, 200-1549; 19308, MYB, 96782, 199232, 1-834; 19308, MYB, 96783, 199233, 94-993; 19308, MYB, 96785, 199235, 1-1665; 19308, MYB, 96786, 199236, 1-261; 19308, MYB, 96787, 199237, 1-1167; 19308, MYB, 96790, 199240, 1-1167; 19308, MYB, 96791, 199241, 1-1125; 19308, MYB, 96792, 199242, 134-1969; 19308, MYB, 96793, 199243, 1-1341; 19308, MYB, 96794, 199244, 1-1746; 19308, MYB, 96795, 199245, 1-1158; 19308, MYB, 96796, 199246, 1-1746; 19308, MYB, 96798, 199248, 1-240; 19308, MYB, 96800, 199250, 1-1260; 19308, MYB, 96801, 199251, 1-1269; 19308, MYB, 96802, 199252, 1-1125; 19308, MYB, 96805, 199255, 1-981; 19308, MYB, 96807, 199257, 1-1095; 19308, MYB, 96809, 199259, 1-1044; 19308, MYB, 96810, 199260, 200-1243; 19308, MYB, 96812, 199262, 1-312; 19308, MYB, 96815, 199265, 200-2182; 19308, MYB, 96816, 199266, 200-2038; 19308, MYB, 96778, 199228, 200-2485; 19308, MYB, 96780, 199230, 200-2200; 19308, MYB, 96781, 199231, 187-2109; 19308, MYB, 96784, 199234, 200-2113; 19308, MYB, 96788, 199238, 1-1209; 19308, MYB, 96789, 199239, 1-2238; 19308, MYB, 96797, 199247, 200-1408; 19308, MYB, 96799, 199249, 1-2277; 19308, MYB, 96803, 199253, 1-1812; 19308, MYB, 96804, 199254, 1-1209; 19308, MYB, 96806, 199256, 1-1053; 19308, MYB, 96808, 199258, 7-1674; 19308, MYB, 96811, 199261, 1-1818; 19308, MYB, 96813, 199263, 200-1252; 19308, MYB, 96814, 199264, 1-1053; 19309, MYBL1, 96818, 199268, 457-1689; 19309, MYBL1, 96817, 199267, 70-2148; 19309, MYBL1, 96819, 199269, 412-2670; 19310, MYBL2, 96820, 199270, 128-2230; 19310, MYBL2, 96821, 199271, 266-2296; 19311, MYC, 96822, 199272, 1206-1979; 19311, MYC, 96824, 199274, 472-1023; 19311, MYC, 96825, 199275, 399-577; 19311, MYC, 96826, 199276, 375-1736; 19311, MYC, 96827, 199277, 526-1890; 19311, MYC, 96828, 199278, 526-1890; 19311, MYC, 96823, 199273, 556-1875; 19312, MYCL, 96832, 199282, 126-426; 19312, MYCL, 96829, 199279, 32-742; 19312, MYCL, 96830, 199280, 449-1543; 19312, MYCL, 96831, 199281, 126-1310; 19313, MYCN, 96833, 199283, 298-1692; 19314, VDAC1, 96837, 199287, 153-703; 19314, VDAC1, 96834, 199284, 246-1097; 19314, VDAC1, 96835, 199285, 100-951; 19314, VDAC1, 96836, 199286, 203-1054; 19315, VDAC2, 96838, 199288, 85-931; 19315, VDAC2, 96839, 199289, 98-681; 19315, VDAC2, 96842, 199292, 129-457; 19315, VDAC2, 96843, 199293, 126-738; 19315, VDAC2, 96840, 199290, 250-1179; 19315, VDAC2, 96841, 199291, 214-1098; 19315, VDAC2, 96844, 199294, 85-969; 19316, VDAC3, 96846, 199296, 108-512; 19316, VDAC3, 96847, 199297, 86-580; 19316, VDAC3, 96849, 199299, 394-719; 19316, VDAC3, 96850, 199300, 150-625; 19316, VDAC3, 96851, 199301, 70-243; 19316, VDAC3, 96852, 199302, 3-305; 19316, VDAC3, 96845, 199295, 69-920; 19316, VDAC3, 96848, 199298, 69-923; 19317, VN1R1, 96853, 199303, 657-1718; 19318, VN1R2, 96854, 199304, 85-1272; 19319, VN1R4, 96855, 199305, 59-964; 19320, VBP1, 96857, 199307, 164-742; 19320, VBP1, 96858, 199308, 1-579; 19320, VBP1, 96856, 199306, 118-

711; 19321, VHL, 96859, 199309, 841-1482; 19321, VHL, 96860, 199310, 61-579; 19322, VHLL, 96861, 199311, 111-530; 19323, VWF, 96863, 199313, 251-433; 19323, VWF, 96864, 199314, 251-433; 19323, VWF, 96862, 199312, 256-8697; 19324, VWA1, 96867, 199317, 319-819; 19324, VWA1, 96868, 199318, 15-458; 19324, VWA1, 96865, 199315, 79-1416; 19324, VWA1, 96866, 199316, 227-421; 19325, VWA2, 96869, 199319, 251-2518; 19325, VWA2, 96870, 199320, 1007-2272; 19326, VWA3A, 96871, 199321, 1-1288; 19326, VWA3A, 96874, 199324, 1-444; 19326, VWA3A, 96875, 199325, 499-593; 19326, VWA3A, 96876, 199326, 97-2336; 19326, VWA3A, 96872, 199322, 97-3651; 19326, VWA3A, 96873, 199323, 1-861; 19327, VWA3B, 96878, 199328, 161-535; 19327, VWA3B, 96879, 199329, 281-586; 19327, VWA3B, 96880, 199330, 207-1118; 19327, VWA3B, 96881, 199331, 161-1432; 19327, VWA3B, 96883, 199333, 1-313; 19327, VWA3B, 96884, 199334, 1-246; 19327, VWA3B, 96885, 199335, 1-2170; 19327, VWA3B, 96886, 199336, 1-316; 19327, VWA3B, 96877, 199327, 220-2094; 19327, VWA3B, 96882, 199332, 205-4089; 19327, VWA3B, 96887, 199337, 129-1379; 19328, VWA5A, 96889, 199339, 1329-2624; 19328, VWA5A, 96888, 199338, 95-1342; 19328, VWA5A, 96890, 199340, 95-2455; 19328, VWA5A, 96891, 199341, 210-1457; 19328, VWA5A, 96892, 199342, 252-2612; 19329, VWA5B1, 96895, 199345, 197-751; 19329, VWA5B1, 96896, 199346, 159-541; 19329, VWA5B1, 96897, 199347, 1-1333; 19329, VWA5B1, 96898, 199348, 296-541; 19329, VWA5B1, 96899, 199349, 179-1075; 19329, VWA5B1, 96893, 199343, 197-3844; 19329, VWA5B1, 96894, 199344, 197-3859; 19330, VWA5B2, 96900, 199350, 167-3241; 19330, VWA5B2, 96901, 199351, 101-3829; 19331, VWA7, 96905, 199355, 202-2877; 19331, VWA7, 96902, 199352, 202-2877; 19331, VWA7, 96903, 199353, 202-2877; 19331, VWA7, 96904, 199354, 202-2877; 19331, VWA7, 96906, 199356, 202-2877; 19331, VWA7, 96907, 199357, 202-2877; 19332, VWA8, 96908, 199358, 106-3225; 19332, VWA8, 96909, 199359, 70-5787; 19333, VWA9, 96911, 199361, 255-1703; 19333, VWA9, 96914, 199364, 76-584; 19333, VWA9, 96915, 199365, 352-564; 19333, VWA9, 96916, 199366, 9-182; 19333, VWA9, 96917, 199367, 30-494; 19333, VWA9, 96918, 199368, 80-1486; 19333, VWA9, 96919, 199369, 376-492; 19333, VWA9, 96920, 199370, 374-2038; 19333, VWA9, 96921, 199371, 389-618; 19333, VWA9, 96922, 199372, 18-191; 19333, VWA9, 96923, 199373, 6-179; 19333, VWA9, 96910, 199360, 211-1767; 19333, VWA9, 96912, 199362, 318-1637; 19333, VWA9, 96913, 199363, 95-1480; 19334, VWCE, 96926, 199376, 59-580; 19334, VWCE, 96927, 199377, 124-1386; 19334, VWCE, 96928, 199378, 634-2646; 19334, VWCE, 96924, 199374, 55-714; 19334, VWCE, 96925, 199375, 388-3255; 19335, VWC2, 96929, 199379, 557-1534; 19336, VWC2L, 96931, 199381, 803-1222; 19336, VWC2L, 96930, 199380, 803-1471; 19337, VWDE, 96933, 199383, 9-521; 19337, VWDE, 96934, 199384, 226-4134; 19337, VWDE, 96935, 199385, 226-1284; 19337, VWDE, 96936, 199386, 1301-4135; 19337, VWDE, 96932, 199382, 190-4962; 19338, VPRBP, 96937, 199387, 11-3187; 19338, VPRBP, 96938, 199388, 131-4654; 19338, VPRBP, 96939, 199389, 139-4659; 19339, VPS11, 96940, 199390, 133-2958; 19339, VPS11, 96941, 199391, 249-3044; 19339, VPS11, 96942, 199392, 1-542; 19339, VPS11, 96943, 199393, 1206-2660; 19340, VPS26A, 96947, 199397, 123-314; 19340, VPS26A, 96948, 199398, 73-753; 19340, VPS26A, 96944, 199394, 127-1110; 19340, VPS26A, 96945, 199395, 654-1637; 19340, VPS26A, 96946, 199396, 127-882; 19341, VPS26B, 96950, 199400, 1-217; 19341, VPS26B, 96952, 199402, 1-147; 19341, VPS26B, 96949, 199399, 479-1489; 19341, VPS26B, 96951, 199401, 409-1419; 19342, VPS29, 96954, 199404, 353-616; 19342, VPS29, 96956, 199406, 436-699; 19342, VPS29, 96957, 199407, 101-745; 19342, VPS29, 96958, 199408, 413-676; 19342, VPS29, 96959, 199409, 1-645; 19342, VPS29, 96953, 199403, 49-609; 19342, VPS29, 96955, 199405, 67-615; 19343, VIPAS39, 96963, 199413, 171-1730; 19343, VIPAS39, 96964, 199414, 398-533; 19343, VIPAS39, 96960, 199410, 339-1673; 19343, VIPAS39, 96961, 199411, 339-1820; 19343, VIPAS39, 96962, 199412, 93-1427; 19343, VIPAS39, 96965, 199415, 512-1993; 19343, VIPAS39, 96966, 199416, 147-1628; 19344, VPS35, 96968, 199418, 15-161; 19344, VPS35, 96969, 199419, 62-205; 19344, VPS35, 96970, 199420, 19-144; 19344, VPS35, 96967, 199417, 60-2450; 19345, VPS50, 96973, 199423, 1-466; 19345, VPS50, 96974, 199424, 103-216; 19345, VPS50, 96975, 199425, 100-667; 19345, VPS50, 96976, 199426, 93-212; 19345, VPS50, 96977, 199427, 1-1409; 19345, VPS50, 96978, 199428, 103-222; 19345, VPS50, 96971, 199421, 129-1112; 19345, VPS50, 96972, 199422, 129-3023; 19345, VPS50, 96979, 199429, 247-3051; 19346, VPS9D1, 96981, 199431, 379-2064; 19346, VPS9D1, 96982, 199432, 25-183; 19346, VPS9D1, 96983, 199433, 1-698; 19346, VPS9D1, 96984, 199434, 74-1390; 19346, VPS9D1, 96980, 199430, 126-2021; 19347, RALA, 96986, 199436, 580-882; 19347, RALA, 96987, 199437, 1-494; 19347, RALA, 96985, 199435, 381-1001; 19348, RALB, 96989, 199439, 179-319; 19348, RALB, 96990, 199440, 481-981; 19348, RALB, 96991, 199441, 44-558; 19348, RALB, 96992, 199442, 332-667; 19348, RALB, 96994, 199444, 171-311; 19348, RALB, 96988, 199438, 271-891; 19348, RALB, 96993, 199443, 227-847; 19349, REL, 96995, 199445, 321-2180; 19349, REL, 96996, 199446, 186-1949; 19350, RELA, 96999, 199449, 84-567; 19350, RELA, 97000, 199450, 1-215; 19350, RELA, 97001, 199451, 64-1197; 19350, RELA, 97002, 199452, 77-481; 19350, RELA, 97003, 199453, 77-271; 19350, RELA, 97004, 199454, 87-1341; 19350, RELA, 97005, 199455, 489-575; 19350, RELA, 97006, 199456, 84-233; 19350, RELA, 97007, 199457, 171-456; 19350, RELA, 97008, 199458, 68-692; 19350, RELA, 97009, 199459, 77-334; 19350, RELA, 97010, 199460, 64-777; 19350, RELA, 97011, 199461, 310-578; 19350, RELA, 97012, 199462, 215-771; 19350, RELA, 97013, 199463, 129-590; 19350, RELA, 97014, 199464, 141-881; 19350, RELA, 97015, 199465, 141-1487; 19350, RELA, 96997, 199447, 259-1905; 19350, RELA, 96998, 199448, 263-1918; 19351, RELB, 97017, 199467, 120-1850; 19351, RELB, 97018, 199468, 120-296; 19351, RELB, 97019, 199469, 1-428; 19351, RELB, 97016, 199466, 151-1890; 19351, RELB, 97020, 199470, 132-1871; 19352, VSIG1, 97023, 199473, 67-570; 19352, VSIG1, 97021, 199471, 118-1281; 19352, VSIG1, 97022, 199472, 162-1433; 19353, VSIG10, 97025, 199475, 234-802; 19353, VSIG10, 97024, 199474, 278-1900; 19354, VSIG10L, 97027, 199477, 90-680; 19354, VSIG10L, 97026, 199476, 1-2604; 19355, VSIG2, 97028, 199478, 102-1085; 19355, VSIG2, 97029, 199479, 57-911; 19356, VSIG4, 97031, 199481, 1-823; 19356, VSIG4, 97030, 199480, 110-1309; 19356, VSIG4, 97032, 199482, 63-980; 19356, VSIG4, 97033, 199483, 128-1093; 19357, VSIG8, 97034, 199484, 137-1381; 19358, VSTM1, 97038, 199488, 1-381; 19358, VSTM1, 97039, 199489, 177-608; 19358, VSTM1, 97040, 199490, 177-527; 19358, VSTM1, 97041, 199491, 12-362; 19358, VSTM1, 97042, 199492, 177-608; 19358, VSTM1, 97043, 199493, 177-887; 19358, VSTM1, 97044, 199494, 177-794; 19358, VSTM1, 97045, 199495, 177-608; 19358, VSTM1, 97046, 199496, 177-527; 19358, VSTM1, 97047, 199497, 1-447; 19358, VSTM1, 97048, 199498, 177-794; 19358, VSTM1, 97049, 199499, 177-527; 19358, VSTM1, 97050, 199500, 177-527; 19358, VSTM1, 97051, 199501, 177-794; 19358, VSTM1, 97052, 199502, 177-608; 19358, VSTM1, 97053, 199503, 177-887; 19358, VSTM1, 97054, 199504, 177-887; 19358, VSTM1, 97055, 199505, 177-527; 19358, VSTM1, 97056, 199506, 177-608; 19358, VSTM1, 97057, 199507, 177-608; 19358, VSTM1, 97058, 199508, 177-794; 19358, VSTM1, 97059, 199509, 1-447; 19358, VSTM1, 97060, 199510, 1-447; 19358, VSTM1, 97062, 199512, 177-887; 19358, VSTM1, 97063, 199513, 177-527; 19358, VSTM1, 97064, 199514, 177-887; 19358, VSTM1, 97065, 199515, 177-608; 19358, VSTM1, 97066, 199516, 177-608; 19358, VSTM1, 97068, 199518, 177-794; 19358, VSTM1, 97069, 199519, 177-527; 19358, VSTM1, 97070, 199520, 177-794; 19358, VSTM1, 97071, 199521, 177-887; 19358, VSTM1, 97072, 199522, 177-527; 19358, VSTM1, 97073, 199523, 1-447; 19358, VSTM1, 97074, 199524, 177-794; 19358, VSTM1, 97075, 199525, 177-608; 19358, VSTM1, 97076, 199526, 1-447; 19358, VSTM1, 97077, 199527, 1-447; 19358, VSTM1, 97078, 199528, 1-447; 19358, VSTM1, 97079, 199529, 1-447; 19358, VSTM1, 97080, 199530, 177-608; 19358, VSTM1, 97082, 199532, 177-527; 19358, VSTM1, 97084, 199534, 177-887; 19358, VSTM1, 97035, 199485, 177-887; 19358, VSTM1, 97036, 199486, 177-794; 19358, VSTM1, 97037, 199487, 177-701; 19358, VSTM1, 97061, 199511, 177-701; 19358, VSTM1, 97067, 199517, 177-887; 19358, VSTM1, 97081, 199531, 154-771; 19358, VSTM1, 97083, 199533, 177-887; 19358, VSTM1, 97085, 199535, 177-794; 19359, VSTM2L, 97086, 199536, 241-639; 19359, VSTM2L, 97087, 199537, 248-862; 19359, VSTM2L, 97088, 199538, 210-656; 19360, VSTM2A, 97090, 199540, 127-849; 19360, VSTM2A, 97091, 199541, 316-1245; 19360, VSTM2A, 97089, 199539, 407-1141; 19360, VSTM2A, 97092, 199542, 407-1117; 19361, VSTM2B, 97093, 199543, 86-943; 19362, VSTM4, 97094, 199544, 25-600; 19362, VSTM4, 97095, 199545, 25-987; 19363, VSTM5, 97096, 199546, 1-61; 19363, VSTM5, 97097, 199547, 30-632; 19364, VTCN1, 97099, 199549, 40-897; 19364, VTCN1, 97102, 199552, 73-336; 19364, VTCN1, 97098, 199548, 106-606; 19364, VTCN1, 97100, 199550, 80-928; 19364, VTCN1, 97101, 199551, 473-1036; 19365, WFDC1, 97105, 199555, 29-229; 19365, WFDC1, 97103, 199553, 327-989; 19365, WFDC1, 97104, 199554, 127-789; 19366, WFDC10A, 97106, 199556, 289-528; 19367, WFDC10B, 97107, 199557, 232-453; 19367, WFDC10B, 97108, 199558, 29-298; 19368, WFDC11, 97109, 199559, 196-459; 19368, WFDC11, 97110, 199560, 223-486; 19368, WFDC11, 97111, 199561, 142-405; 19369, WFDC12, 97112, 199562, 19-354; 19370, WFDC13, 97113, 199563, 109-390; 19371, WFDC2, 97118, 199568, 27-266; 19371, WFDC2, 97114, 199564, 27-335; 19371, WFDC2, 97115, 199565, 27-257; 19371, WFDC2, 97116, 199566, 434-655; 19371, WFDC2, 97117, 199567, 77-451; 19372, WFDC3, 97120, 199570, 1-677; 19372, WFDC3, 97121, 199571, 98-382; 19372, WFDC3, 97122, 199572, 76-489; 19372, WFDC3, 97119, 199569, 85-780; 19373, WFDC5, 97123, 199573, 80-754; 19373, WFDC5, 97124, 199574, 90-461; 19374, WFDC6, 97125, 199575, 1-394; 19374, WFDC6, 97126, 199576, 89-349; 19375, WFDC7, 97127, 199577, 80-805; 19375, WFDC8, 97128, 199578, 80-805; 19376, WFDC9, 97129, 199579, 219-488; 19377, WFIKKN1, 97130, 199580, 323-1969; 19378, WFIKKN2, 97132, 199582, 453-1904; 19378, WFIKKN2, 97131, 199581, 529-2259; 19379, WAPL, 97133, 199583, 2493-3701; 19379, WAPL, 97135, 199585, 60-1268; 19379, WAPL, 97134, 199584, 474-4046; 19379, WAPL, 97136, 199586, 294-3866; 19380, WASH1, 97137, 199587, 144-1541; 19381, WASF1, 97138, 199588, 483-904; 19381, WASF1, 97140, 199590, 257-678; 19381, WASF1, 97145, 199595, 385-652; 19381, WASF1, 97146, 199596, 473-740; 19381, WASF1, 97147, 199597, 359-898; 19381, WASF1, 97139, 199589, 693-2372; 19381, WASF1, 97141, 199591, 433-2112; 19381, WASF1, 97142, 199592, 293-1972; 19381, WASF1, 97143, 199593, 740-2419; 19381, WASF1, 97144, 199594, 838-2517; 19382, WASF2, 97148, 199598, 110-955; 19382, WASF2, 97149, 199599, 217-1713; 19383, WASF3, 97150, 199600, 179-1687; 19383, WASF3, 97151, 199601, 226-1725; 19384, WHAMM, 97152, 199602, 100-2529; 19385, WIPF1, 97158, 199608, 208-603; 19385, WIPF1, 97159, 199609, 137-1348; 19385, WIPF1, 97160, 199610, 75-373; 19385, WIPF1, 97161, 199611, 17-488; 19385, WIPF1, 97162, 199612, 204-1682; 19385, WIPF1, 97153, 199603, 165-1697; 19385, WIPF1, 97154, 199604, 149-1660; 19385, WIPF1, 97155, 199605, 333-1844; 19385, WIPF1, 97156, 199606, 101-1612; 19385, WIPF1, 97157, 199607, 204-1685; 19386, WIPF2, 97164, 199614, 206-754; 19386, WIPF2, 97166, 199616, 393-581; 19386, WIPF2, 97168, 199618, 263-572; 19386, WIPF2, 97169, 199619, 237-476; 19386, WIPF2, 97163, 199613, 241-1563; 19386, WIPF2, 97165, 199615, 201-1523; 19386, WIPF2, 97167, 199617, 239-1561; 19387, WIPF3, 97171, 199621, 251-1702; 19387, WIPF3, 97170, 199620, 183-1634; 19387, WIPF3, 97172, 199622, 1-1452; 19388, WBP2NL, 97175, 199625, 95-916; 19388, WBP2NL, 97176, 199626, 27-278; 19388, WBP2NL, 97178, 199628, 1-708; 19388, WBP2NL, 97173, 199623, 95-1024; 19388, WBP2NL, 97174, 199624, 32-961; 19388, WBP2NL, 97177, 199627, 48-977; 19389, WDTC1, 97182, 199632, 1-378; 19389, WDTC1, 97179, 199629, 536-2569; 19389, WDTC1, 97180, 199630, 384-2414; 19389, WDTC1, 97181, 199631, 8-1855; 19390, WDFY1, 97184, 199634, 74-719; 19390, WDFY1, 97183, 199633, 104-1336; 19391, WDFY2, 97186, 199636, 234-422; 19391, WDFY2, 97185, 199635, 181-1383; 19392, WDFY3, 97188, 199638, 398-425; 19392, WDFY3, 97189, 199639, 1-1918; 19392, WDFY3, 97190, 199640, 274-453; 19392, WDFY3, 97191, 199641, 1-240; 19392, WDFY3, 97187, 199637, 409-10989; 19393, WDHD1, 97194, 199644, 265-768; 19393, WDHD1, 97195, 199645, 1-194; 19393, WDHD1, 97192, 199642, 67-3456; 19393, WDHD1, 97193, 199643, 371-3391; 19394, WSB1, 97198, 199648, 283-924; 19394, WSB1, 97199, 199649, 294-590; 19394, WSB1, 97200, 199650, 310-544; 19394, WSB1, 97201, 199651, 285-449; 19394, WSB1, 97202, 199652, 321-943; 19394, WSB1, 97203, 199653, 51-479; 19394, WSB1, 97204, 199654, 208-432; 19394, WSB1, 97205, 199655, 283-1026; 19394, WSB1, 97196, 199646, 317-1582; 19394, WSB1, 97197, 199647, 266-1093; 19395, WSB2, 97208, 199658, 67-252; 19395, WSB2, 97209, 199659, 108-1328; 19395, WSB2, 97210, 199660, 60-795; 19395, WSB2, 97212, 199662, 110-280; 19395, WSB2, 97206, 199656, 143-1357; 19395, WSB2, 97207, 199657, 13-1278; 19395, WSB2, 97211, 199661, 417-1001; 19396, WDPCP, 97215, 199665, 198-1862; 19396, WDPCP, 97216, 199666, 3552-5216; 19396, WDPCP, 97217, 199667, 1-1209; 19396, WDPCP, 97219, 199669, 529-782; 19396, WDPCP, 97220, 199670, 1-397; 19396, WDPCP, 97221, 199671, 248-388; 19396, WDPCP, 97222, 199672, 510-534; 19396, WDPCP, 97213, 199663, 529-2769; 19396, WDPCP, 97214, 199664, 125-1888; 19396, WDPCP, 97218, 199668, 248-2104; 19397, WRAP53, 97227, 199677, 964-1827; 19397,

WRAP53, 97228, 199678, 173-1720; 19397, WRAP53, 97229, 199679, 1-141; 19397, WRAP53, 97223, 199673, 2349-3995; 19397, WRAP53, 97224, 199674, 243-1889; 19397, WRAP53, 97225, 199675, 156-1802; 19397, WRAP53, 97226, 199676, 166-1812; 19398, WRAP73, 97231, 199681, 60-1367; 19398, WRAP73, 97232, 199682, 65-603; 19398, WRAP73, 97233, 199683, 28-940; 19398, WRAP73, 97234, 199684, 179-779; 19398, WRAP73, 97230, 199680, 75-1457; 19399, WDR1, 97237, 199687, 78-812; 19399, WDR1, 97235, 199685, 284-1684; 19399, WDR1, 97236, 199686, 284-2104; 19399, WDR1, 97238, 199688, 62-1462; 19399, WDR1, 97239, 199689, 195-2015; 19400, WDR11, 97241, 199691, 600-1199; 19400, WDR11, 97242, 199692, 846-1781; 19400, WDR11, 97243, 199693, 60-347; 19400, WDR11, 97240, 199690, 247-3921; 19401, WDR12, 97244, 199694, 751-2022; 19402, WDR13, 97247, 199697, 115-437; 19402, WDR13, 97248, 199698, 483-614; 19402, WDR13, 97249, 199699, 1-562; 19402, WDR13, 97250, 199700, 148-279; 19402, WDR13, 97245, 199695, 506-1963; 19402, WDR13, 97246, 199696, 177-1634; 19403, WDR17, 97252, 199702, 36-3929; 19403, WDR17, 97254, 199704, 1-677; 19403, WDR17, 97255, 199705, 1-1672; 19403, WDR17, 97256, 199706, 11-316; 19403, WDR17, 97251, 199701, 157-4125; 19403, WDR17, 97253, 199703, 253-4104; 19404, WDR18, 97257, 199707, 1-1289; 19404, WDR18, 97258, 199708, 23-1252; 19404, WDR18, 97259, 199709, 10-468; 19404, WDR18, 97260, 199710, 1-806; 19404, WDR18, 97261, 199711, 1-1184; 19404, WDR18, 97262, 199712, 1-145; 19404, WDR18, 97264, 199714, 1-435; 19404, WDR18, 97263, 199713, 84-1382; 19405, WDR19, 97266, 199716, 1-407; 19405, WDR19, 97267, 199717, 302-429; 19405, WDR19, 97268, 199718, 11-1456; 19405, WDR19, 97269, 199719, 55-354; 19405, WDR19, 97270, 199720, 30-332; 19405, WDR19, 97271, 199721, 30-266; 19405, WDR19, 97272, 199722, 115-540; 19405, WDR19, 97265, 199715, 155-4183; 19406, WDR20, 97277, 199727, 73-1911; 19406, WDR20, 97282, 199732, 10-81; 19406, WDR20, 97283, 199733, 1-217; 19406, WDR20, 97284, 199734, 28-558; 19406, WDR20, 97285, 199735, 333-532; 19406, WDR20, 97273, 199723, 14-274; 19406, WDR20, 97274, 199724, 50-637; 19406, WDR20, 97275, 199725, 81-1826; 19406, WDR20, 97276, 199726, 32-1741; 19406, WDR20, 97278, 199728, 11-1813; 19406, WDR20, 97279, 199729, 32-1594; 19406, WDR20, 97280, 199730, 1-1527; 19406, WDR20, 97281, 199731, 32-292; 19407, WDR24, 97286, 199736, 1-2763; 19407, WDR24, 97287, 199737, 761-3133; 19408, WDR25, 97292, 199742, 180-1004; 19408, WDR25, 97293, 199743, 16-885; 19408, WDR25, 97294, 199744, 1-365; 19408, WDR25, 97288, 199738, 227-1861; 19408, WDR25, 97289, 199739, 73-1707; 19408, WDR25, 97290, 199740, 102-965; 19408, WDR25, 97291, 199741, 88-1722; 19409, WDR26, 97295, 199745, 408-784; 19409, WDR26, 97297, 199747, 1-627; 19409, WDR26, 97298, 199748, 1-886; 19409, WDR26, 97296, 199746, 195-2180; 19410, WDR27, 97300, 199750, 1-587; 19410, WDR27, 97302, 199752, 688-951; 19410, WDR27, 97299, 199749, 44-2236; 19410, WDR27, 97301, 199751, 111-2798; 19411, WDR3, 97304, 199754, 96-218; 19411, WDR3, 97303, 199753, 48-2879; 19412, WDR31, 97308, 199758, 111-533; 19412, WDR31, 97309, 199759, 220-375; 19412, WDR31, 97305, 199755, 235-1335; 19412, WDR31, 97306, 199756, 248-1351; 19412, WDR31, 97307, 199757, 238-1338; 19413, WDR33, 97312, 199762, 229-583; 19413, WDR33, 97314, 199764, 207-822; 19413, WDR33, 97310, 199760, 160-4170; 19413, WDR33, 97311, 199761, 184-957; 19413, WDR33, 97313, 199763, 184-1164; 19414, WDR34, 97316, 199766, 1-819; 19414, WDR34, 97317, 199767, 1-420; 19414, WDR34, 97315, 199765, 62-1672; 19415, WDR35, 97320, 199770, 1-752; 19415, WDR35, 97321, 199771, 34-2655; 19415, WDR35, 97322, 199772, 1-1221; 19415, WDR35, 97318, 199768, 108-3620; 19415, WDR35, 97319, 199769, 117-3662; 19416, WDR36, 97324, 199774, 144-2831; 19416, WDR36, 97323, 199773, 574-3429; 19416, WDR36, 97325, 199775, 118-2973; 19417, WDR37, 97328, 199778, 202-951; 19417, WDR37, 97329, 199779, 88-714; 19417, WDR37, 97330, 199780, 202-993; 19417, WDR37, 97326, 199776, 152-1636; 19417, WDR37, 97327, 199777, 145-1629; 19418, WDR38, 97332, 199782, 116-1063; 19418, WDR38, 97333, 199783, 210-1010; 19418, WDR38, 97331, 199781, 57-1001; 19419, WDR4, 97334, 199784, 37-1275; 19419, WDR4, 97335, 199785, 61-1299; 19420, WDR41, 97337, 199787, 70-654; 19420, WDR41, 97338, 199788, 258-341; 19420, WDR41, 97339, 199789, 268-805; 19420, WDR41, 97340, 199790, 92-543; 19420, WDR41, 97341, 199791, 1-186; 19420, WDR41, 97342, 199792, 68-429; 19420, WDR41, 97344, 199794, 4-459; 19420, WDR41, 97345, 199795, 277-750; 19420, WDR41, 97346, 199796, 1-491; 19420, WDR41, 97347, 199797, 1-201; 19420, WDR41, 97348, 199798, 67-516; 19420, WDR41, 97349, 199799, 1-1185; 19420, WDR41, 97350, 199800, 3-570; 19420, WDR41, 97351, 199801, 1-181; 19420, WDR41, 97352, 199802, 141-562; 19420, WDR41, 97353, 199803, 1-531; 19420, WDR41, 97336, 199786, 377-1756; 19420, WDR41, 97343, 199793, 97-1311; 19421, WDR43, 97354, 199804, 227-787; 19421, WDR43, 97356, 199806, 311-386; 19421, WDR43, 97357, 199807, 101-541; 19421, WDR43, 97355, 199805, 57-2090; 19422, WDR44, 97361, 199811, 1-2419; 19422, WDR44, 97358, 199808, 396-3137; 19422, WDR44, 97359, 199809, 432-2906; 19422, WDR44, 97360, 199810, 362-3079; 19423, WDR45, 97363, 199813, 1-862; 19423, WDR45, 97364, 199814, 155-1033; 19423, WDR45, 97368, 199818, 170-1135; 19423, WDR45, 97369, 199819, 18-643; 19423, WDR45, 97370, 199820, 233-816; 19423, WDR45, 97371, 199821, 140-910; 19423, WDR45, 97372, 199822, 1-369; 19423, WDR45, 97373, 199823, 175-699; 19423, WDR45, 97374, 199824, 148-872; 19423, WDR45, 97375, 199825, 155-569; 19423, WDR45, 97376, 199826, 1-259; 19423, WDR45, 97377, 199827, 179-1156; 19423, WDR45, 97378, 199828, 336-811; 19423, WDR45, 97379, 199829, 88-728; 19423, WDR45, 97380, 199830, 302-1384; 19423, WDR45, 97381, 199831, 160-1029; 19423, WDR45, 97382, 199832, 646-822; 19423, WDR45, 97383, 199833, 135-1016; 19423, WDR45, 97384, 199834, 118-947; 19423, WDR45, 97385, 199835, 431-918; 19423, WDR45, 97386, 199836, 149-1189; 19423, WDR45, 97387, 199837, 85-327; 19423, WDR45, 97388, 199838, 131-268; 19423, WDR45, 97389, 199839, 168-757; 19423, WDR45, 97362, 199812, 440-1525; 19423, WDR45, 97365, 199815, 166-1281; 19423, WDR45, 97366, 199816, 197-1282; 19423, WDR45, 97367, 199817, 183-1265; 19424, WDR45B, 97391, 199841, 105-629; 19424, WDR45B, 97392, 199842, 1-373; 19424, WDR45B, 97393, 199843, 109-366; 19424, WDR45B, 97394, 199844, 1-605; 19424, WDR45B, 97390, 199840, 196-1230; 19425, WDR46, 97399, 199849, 1-968; 19425, WDR46, 97401, 199851, 1-968; 19425, WDR46, 97402, 199852, 1-968; 19425, WDR46, 97403, 199853, 1-968; 19425, WDR46, 97404, 199854, 1-968; 19425, WDR46, 97395, 199845, 358-2190; 19425, WDR46, 97396, 199846, 358-2190; 19425, WDR46, 97397, 199847, 358-2190; 19425, WDR46, 97398, 199848, 358-2190; 19425, WDR46, 97400, 199850, 358-2190; 19426, WDR47, 97405, 199855, 251-2932; 19426, WDR47, 97410, 199860, 263-580; 19426, WDR47, 97411, 199861, 38-556; 19426,

WDR47, 97412, 199862, 300-469; 19426, WDR47, 97413, 199863, 306-586; 19426, WDR47, 97406, 199856, 224-2899; 19426, WDR47, 97407, 199857, 224-2983; 19426, WDR47, 97408, 199858, 262-3024; 19426, WDR47, 97409, 199859, 135-2918; 19427, WDR48, 97415, 199865, 11-202; 19427, WDR48, 97416, 199866, 14-418; 19427, WDR48, 97417, 199867, 8-232; 19427, WDR48, 97418, 199868, 7-369; 19427, WDR48, 97419, 199869, 464-949; 19427, WDR48, 97414, 199864, 29-2062; 19428, WDR49, 97421, 199871, 167-352; 19428, WDR49, 97422, 199872, 1-416; 19428, WDR49, 97423, 199873, 220-575; 19428, WDR49, 97424, 199874, 1-2024; 19428, WDR49, 97425, 199875, 225-1781; 19428, WDR49, 97426, 199876, 182-521; 19428, WDR49, 97420, 199870, 307-2400; 19429, WDR5, 97428, 199878, 537-705; 19429, WDR5, 97429, 199879, 288-577; 19429, WDR5, 97427, 199877, 172-1176; 19430, WDR53, 97431, 199881, 519-980; 19430, WDR53, 97432, 199882, 67-660; 19430, WDR53, 97433, 199883, 137-616; 19430, WDR53, 97434, 199884, 271-870; 19430, WDR53, 97430, 199880, 569-1645; 19431, WDR54, 97436, 199886, 23-757; 19431, WDR54, 97437, 199887, 89-576; 19431, WDR54, 97435, 199885, 89-1093; 19432, WDR55, 97439, 199889, 46-459; 19432, WDR55, 97440, 199890, 293-961; 19432, WDR55, 97438, 199888, 238-1389; 19433, WDR59, 97442, 199892, 1-901; 19433, WDR59, 97443, 199893, 1-652; 19433, WDR59, 97444, 199894, 115-583; 19433, WDR59, 97445, 199895, 15-122; 19433, WDR59, 97446, 199896, 1-144; 19433, WDR59, 97447, 199897, 234-1610; 19433, WDR59, 97441, 199891, 132-3056; 19433, WDR59, 97448, 199898, 67-1782; 19434, WDR5B, 97449, 199899, 524-1516; 19435, WDR6, 97450, 199900, 281-3736; 19435, WDR6, 97451, 199901, 40-852; 19435, WDR6, 97452, 199902, 242-538; 19435, WDR6, 97453, 199903, 30-215; 19435, WDR6, 97454, 199904, 37-1746; 19435, WDR6, 97455, 199905, 106-3318; 19435, WDR6, 97456, 199906, 36-242; 19435, WDR6, 97457, 199907, 190-564; 19435, WDR6, 97459, 199909, 470-563; 19435, WDR6, 97460, 199910, 387-491; 19435, WDR6, 97461, 199911, 423-1292; 19435, WDR6, 97462, 199912, 139-3594; 19435, WDR6, 97463, 199913, 1-207; 19435, WDR6, 97458, 199908, 40-3405; 19436, WDR60, 97464, 199914, 169-457; 19436, WDR60, 97466, 199916, 1-1569; 19436, WDR60, 97467, 199917, 1-591; 19436, WDR60, 97465, 199915, 159-3359; 19437, WDR61, 97469, 199919, 70-708; 19437, WDR61, 97470, 199920, 1-219; 19437, WDR61, 97471, 199921, 80-226; 19437, WDR61, 97472, 199922, 76-645; 19437, WDR61, 97474, 199924, 155-1036; 19437, WDR61, 97475, 199925, 1-490; 19437, WDR61, 97468, 199918, 273-1190; 19437, WDR61, 97473, 199923, 152-1069; 19438, WDR62, 97478, 199928, 1-955; 19438, WDR62, 97476, 199926, 1-4557; 19438, WDR62, 97477, 199927, 36-4607; 19438, WDR62, 97479, 199929, 10-1461; 19439, WDR63, 97483, 199933, 116-1222; 19439, WDR63, 97484, 199934, 175-548; 19439, WDR63, 97485, 199935, 1-387; 19439, WDR63, 97480, 199930, 181-2856; 19439, WDR63, 97481, 199931, 190-2748; 19439, WDR63, 97482, 199932, 207-2765; 19440, WDR64, 97487, 199937, 154-2058; 19440, WDR64, 97488, 199938, 1-1682; 19440, WDR64, 97489, 199939, 1-2058; 19440, WDR64, 97490, 199940, 1-1569; 19440, WDR64, 97486, 199936, 208-3453; 19441, WDR66, 97491, 199941, 855-4304; 19441, WDR66, 97492, 199942, 138-2963; 19442, WDR7, 97495, 199945, 144-650; 19442, WDR7, 97496, 199946, 1-122; 19442, WDR7, 97497, 199947, 235-438; 19442, WDR7, 97498, 199948, 1-188; 19442, WDR7, 97499, 199949, 212-2659; 19442, WDR7, 97493, 199943, 212-4684; 19442, WDR7, 97494, 199944, 236-4609; 19443, WDR70, 97501, 199951, 84-1247; 19443, WDR70, 97500, 199950, 157-2121; 19444, WDR72, 97504, 199954, 35-3373; 19444, WDR72, 97505, 199955, 61-3360; 19444, WDR72, 97506, 199956, 248-2572; 19444, WDR72, 97507, 199957, 1-267; 19444, WDR72, 97502, 199952, 43-3351; 19444, WDR72, 97503, 199953, 241-3549; 19445, WDR73, 97509, 199959, 1-395; 19445, WDR73, 97510, 199960, 1-536; 19445, WDR73, 97511, 199961, 1-256; 19445, WDR73, 97508, 199958, 62-1198; 19446, WDR74, 97514, 199964, 738-1724; 19446, WDR74, 97517, 199967, 13-138; 19446, WDR74, 97518, 199968, 1-116; 19446, WDR74, 97519, 199969, 378-548; 19446, WDR74, 97512, 199962, 92-1249; 19446, WDR74, 97513, 199963, 12-1112; 19446, WDR74, 97515, 199965, 539-1696; 19446, WDR74, 97516, 199966, 169-1326; 19447, WDR75, 97521, 199971, 12-305; 19447, WDR75, 97522, 199972, 48-317; 19447, WDR75, 97523, 199973, 1-270; 19447, WDR75, 97520, 199970, 61-2553; 19448, WDR76, 97525, 199975, 272-1960; 19448, WDR76, 97526, 199976, 128-813; 19448, WDR76, 97524, 199974, 71-1951; 19449, WDR77, 97528, 199978, 1-875; 19449, WDR77, 97527, 199977, 208-1236; 19450, WDR78, 97529, 199979, 16-978; 19450, WDR78, 97532, 199982, 1-168; 19450, WDR78, 97533, 199983, 1-367; 19450, WDR78, 97534, 199984, 1-504; 19450, WDR78, 97535, 199985, 1-1746; 19450, WDR78, 97536, 199986, 143-292; 19450, WDR78, 97537, 199987, 1-478; 19450, WDR78, 97538, 199988, 1-189; 19450, WDR78, 97530, 199980, 10-1647; 19450, WDR78, 97531, 199981, 57-2603; 19451, WDR81, 97542, 199992, 186-582; 19451, WDR81, 97543, 199993, 54-570; 19451, WDR81, 97544, 199994, 423-2165; 19451, WDR81, 97546, 199996, 1-590; 19451, WDR81, 97547, 199997, 50-562; 19451, WDR81, 97548, 199998, 1-371; 19451, WDR81, 97552, 200002, 423-2165; 19451, WDR81, 97553, 200003, 186-582; 19451, WDR81, 97554, 200004, 1-371; 19451, WDR81, 97555, 200005, 1-590; 19451, WDR81, 97556, 200006, 1-5823; 19451, WDR81, 97557, 200007, 54-570; 19451, WDR81, 97558, 200008, 50-562; 19451, WDR81, 97539, 199989, 222-2894; 19451, WDR81, 97540, 199990, 1-5826; 19451, WDR81, 97541, 199991, 54-2270; 19451, WDR81, 97545, 199995, 262-2406; 19451, WDR81, 97549, 199999, 54-2270; 19451, WDR81, 97550, 200000, 262-2406; 19451, WDR81, 97551, 200001, 219-2891; 19452, WDR82, 97560, 200010, 434-574; 19452, WDR82, 97561, 200011, 364-587; 19452, WDR82, 97559, 200009, 283-1224; 19453, WDR83, 97562, 200012, 1-225; 19453, WDR83, 97564, 200014, 37-498; 19453, WDR83, 97565, 200015, 336-551; 19453, WDR83, 97566, 200016, 1-632; 19453, WDR83, 97567, 200017, 320-535; 19453, WDR83, 97563, 200013, 350-1297; 19454, WDR83OS, 97568, 200018, 1-315; 19454, WDR83OS, 97570, 200020, 1-256; 19454, WDR83OS, 97569, 200019, 1954-2274; 19455, WDR86, 97574, 200024, 335-1081; 19455, WDR86, 97571, 200021, 432-1562; 19455, WDR86, 97572, 200022, 357-1190; 19455, WDR86, 97573, 200023, 43-1491; 19455, WDR86, 97575, 200025, 834-1667; 19456, WDR87, 97577, 200027, 162-8900; 19456, WDR87, 97578, 200028, 726-2765; 19456, WDR87, 97576, 200026, 226-8847; 19457, WDR88, 97581, 200031, 81-575; 19457, WDR88, 97579, 200029, 77-1495; 19457, WDR88, 97580, 200030, 79-1359; 19458, WDR89, 97584, 200034, 297-976; 19458, WDR89, 97582, 200032, 247-1410; 19458, WDR89, 97583, 200033, 90-1253; 19458, WDR89, 97585, 200035, 33-1196; 19459, WDR90, 97588, 200038, 1-399; 19459, WDR90, 97589, 200039, 1-348; 19459, WDR90, 97590, 200040, 93-5345; 19459, WDR90, 97591, 200041, 1-1428; 19459, WDR90, 97592, 200042, 388-1431; 19459, WDR90, 97593, 200043, 1-235; 19459, WDR90, 97594, 200044, 65-2251; 19459, WDR90, 97586, 200036, 1-5247; 19459, WDR90, 97587, 200037, 314-1213; 19460, WDR91, 97596, 200046, 50-2188; 19460, WDR91, 97595, 200045, 33-2276; 19461, WDR92, 97598, 200048, 221-784; 19461, WDR92, 97600, 200050, 1-278; 19461, WDR92, 97597, 200047, 118-1191; 19461, WDR92, 97599, 200049, 40-906; 19462, WDR93, 97602, 200052, 55-576; 19462, WDR93, 97601, 200051, 102-2162; 19462, WDR93, 97603, 200053, 70-2046; 19463, WDR97, 97605, 200055, 26-2539; 19463, WDR97, 97604, 200054, 26-4894; 19464, WIPI1, 97607, 200057, 222-1316; 19464, WIPI1, 97608, 200058, 79-1188; 19464, WIPI1, 97609, 200059, 1-163; 19464, WIPI1, 97610, 200060, 1-247; 19464, WIPI1, 97611, 200061, 1-618; 19464, WIPI1, 97606, 200056, 1-1341; 19465, WIPI2, 97612, 200062, 233-1597; 19465, WIPI2, 97613, 200063, 148-1425; 19465, WIPI2, 97614, 200064, 225-1535; 19465, WIPI2, 97615, 200065, 175-1506; 19465, WIPI2, 97616, 200066, 233-1387; 19466, WDSUB1, 97620, 200070, 112-1401; 19466, WDSUB1, 97617, 200067, 146-1300; 19466, WDSUB1, 97618, 200068, 242-1672; 19466, WDSUB1, 97619, 200069, 150-1580; 19466, WDSUB1, 97621, 200071, 258-1688; 19467, WDFY4, 97622, 200072, 1-3815; 19467, WDFY4, 97625, 200075, 1-1657; 19467, WDFY4, 97623, 200073, 28-9582; 19467, WDFY4, 97624, 200074, 144-2108; 19468, WDYHV1, 97627, 200077, 38-628; 19468, WDYHV1, 97628, 200078, 101-274; 19468, WDYHV1, 97629, 200079, 1-191; 19468, WDYHV1, 97631, 200081, 80-341; 19468, WDYHV1, 97626, 200076, 126-743; 19468, WDYHV1, 97630, 200080, 229-666; 19469, WEE1, 97634, 200084, 1-300; 19469, WEE1, 97635, 200085, 347-990; 19469, WEE1, 97636, 200086, 87-573; 19469, WEE1, 97637, 200087, 1-437; 19469, WEE1, 97632, 200082, 756-2054; 19469, WEE1, 97633, 200083, 254-2194; 19470, WEE2, 97639, 200089, 1-610; 19470, WEE2, 97640, 200090, 1-610; 19470, WEE2, 97638, 200088, 407-2110; 19470, WEE2, 97641, 200091, 407-2110; 19471, WRNIP1, 97642, 200092, 249-1094; 19471, WRNIP1, 97643, 200093, 232-1569; 19471, WRNIP1, 97644, 200094, 210-2132; 19471, WRNIP1, 97645, 200095, 210-2207; 19471, WRNIP1, 97646, 200096, 192-2189; 19472, WRN, 97647, 200097, 250-4548; 19473, WIZ, 97649, 200099, 1-2499; 19473, WIZ, 97651, 200101, 150-3056; 19473, WIZ, 97652, 200102, 203-603; 19473, WIZ, 97648, 200098, 215-2599; 19473, WIZ, 97650, 200100, 1-2898; 19473, WIZ, 97653, 200103, 148-2655; 19474, WBSCR22, 97655, 200105, 20-442; 19474, WBSCR22, 97656, 200106, 56-478; 19474, WBSCR22, 97657, 200107, 48-419; 19474, WBSCR22, 97658, 200108, 270-538; 19474, WBSCR22, 97659, 200109, 54-632; 19474, WBSCR22, 97660, 200110, 1-196; 19474, WBSCR22, 97661, 200111, 29-232; 19474, WBSCR22, 97662, 200112, 1-385; 19474, WBSCR22, 97664, 200114, 54-356; 19474, WBSCR22, 97665, 200115, 1-119; 19474, WBSCR22, 97654, 200104, 59-904; 19474, WBSCR22, 97663, 200113, 1-897; 19475, WBSCR27, 97667, 200117, 32-304; 19475, WBSCR27, 97666, 200116, 51-788; 19476, WBSCR16, 97668, 200118, 132-592; 19476, WBSCR16, 97669, 200119, 145-1509; 19476, WBSCR16, 97670, 200120, 57-1451; 19476, WBSCR16, 97671, 200121, 145-1221; 19477, WBSCR17, 97673, 200123, 1-566; 19477, WBSCR17, 97674, 200124, 1-1560; 19477, WBSCR17, 97672, 200122, 635-2431; 19478, WBSCR28, 97675, 200125, 37-834; 19478, WBSCR28, 97676, 200126, 24-206; 19479, WT1, 97677, 200127, 286-1839; 19479, WT1, 97678, 200128, 43-996; 19479, WT1, 97680, 200130, 191-1735; 19479, WT1, 97681, 200131, 1-1494; 19479, WT1, 97683, 200133, 186-578; 19479, WT1, 97684, 200134, 1-535; 19479, WT1, 97685, 200135, 643-718; 19479, WT1, 97679, 200129, 275-1183; 19479, WT1, 97682, 200132, 275-1141; 19480, WTAP, 97689, 200139, 345-857; 19480, WTAP, 97690, 200140, 147-659; 19480, WTAP, 97686, 200136, 125-580; 19480, WTAP, 97687, 200137, 1758-2948; 19480, WTAP, 97688, 200138, 213-1403; 19481, WTIP, 97691, 200141, 1-602; 19481, WTIP, 97692, 200142, 338-1630; 19482, WNT2, 97694, 200144, 126-458; 19482, WNT2, 97695, 200145, 53-513; 19482, WNT2, 97693, 200143, 301-1383; 19483, WNT1, 97697, 200147, 199-1278; 19483, WNT1, 97696, 200146, 37-1149; 19484, WNT10A, 97699, 200149, 1-636; 19484, WNT10A, 97698, 200148, 634-1887; 19485, WNT10B, 97702, 200152, 305-826; 19485, WNT10B, 97703, 200153, 228-623; 19485, WNT10B, 97704, 200154, 254-559; 19485, WNT10B, 97700, 200150, 350-1519; 19485, WNT10B, 97701, 200151, 85-660; 19486, WNT11, 97706, 200156, 438-453; 19486, WNT11, 97707, 200157, 1-789; 19486, WNT11, 97705, 200155, 126-1190; 19487, WNT16, 97709, 200159, 50-1117; 19487, WNT16, 97708, 200158, 291-1388; 19488, WNT2B, 97710, 200160, 1146-2045; 19488, WNT2B, 97711, 200161, 486-1661; 19488, WNT2B, 97712, 200162, 105-1223; 19489, WNT3, 97714, 200164, 164-1231; 19489, WNT3, 97713, 200163, 164-1231; 19489, WNT3, 97715, 200165, 164-1231; 19490, WNT3A, 97716, 200166, 79-1137; 19491, WNT4, 97718, 200168, 327-482; 19491, WNT4, 97719, 200169, 1-451; 19491, WNT4, 97717, 200167, 45-1100; 19492, WNT5A, 97722, 200172, 318-959; 19492, WNT5A, 97724, 200174, 440-829; 19492, WNT5A, 97720, 200170, 658-1800; 19492, WNT5A, 97721, 200171, 523-1665; 19492, WNT5A, 97723, 200173, 103-1200; 19493, WNT5B, 97727, 200177, 177-530; 19493, WNT5B, 97729, 200179, 41-379; 19493, WNT5B, 97730, 200180, 544-1304; 19493, WNT5B, 97731, 200181, 190-661; 19493, WNT5B, 97725, 200175, 146-1225; 19493, WNT5B, 97726, 200176, 233-1312; 19493, WNT5B, 97728, 200178, 243-1322; 19494, WNT6, 97732, 200182, 218-1315; 19495, WNT7A, 97733, 200183, 306-1355; 19496, WNT7B, 97735, 200185, 479-1540; 19496, WNT7B, 97736, 200186, 456-1457; 19496, WNT7B, 97737, 200187, 52-669; 19496, WNT7B, 97738, 200188, 351-521; 19496, WNT7B, 97734, 200184, 376-1425; 19497, WNT8A, 97741, 200191, 114-1193; 19497, WNT8A, 97742, 200192, 237-1346; 19497, WNT8A, 97739, 200189, 101-1168; 19497, WNT8A, 97740, 200190, 6-1061; 19498, WNT8B, 97743, 200193, 129-1184; 19499, WNT9A, 97744, 200194, 12-1109; 19500, WNT9B, 97746, 200196, 54-1043; 19500, WNT9B, 97747, 200197, 146-543; 19500, WNT9B, 97749, 200199, 146-543; 19500, WNT9B, 97750, 200200, 54-1043; 19500, WNT9B, 97745, 200195, 54-1127; 19500, WNT9B, 97748, 200198, 54-1127; 19501, WAS, 97752, 200202, 284-933; 19501, WAS, 97751, 200201, 76-1584; 19502, WASL, 97753, 200203, 334-1851; 19503, WNK1, 97756, 200206, 511-1692; 19503, WNK1, 97758, 200208, 1-226; 19503, WNK1, 97759, 200209, 1-653; 19503, WNK1, 97760, 200210, 1-201; 19503, WNK1, 97761, 200211, 1-736; 19503, WNK1, 97762, 200212, 974-7378; 19503, WNK1, 97764, 200214, 1-584; 19503, WNK1, 97765, 200215, 1-528; 19503, WNK1, 97766, 200216, 1-722; 19503, WNK1, 97767, 200217, 37-1341; 19503, WNK1, 97754, 200204, 644-7792; 19503, WNK1, 97755, 200205, 644-8548; 19503, WNK1, 97757, 200207, 644-9145; 19503, WNK1, 97763, 200213, 644-8572; 19504, WNK2, 97769, 200219, 1-6654; 19504, WNK2, 97770, 200220, 1-3044; 19504, WNK2, 97771, 200221, 5017-6108; 19504, WNK2, 97772, 200222, 15-2385; 19504, WNK2, 97773, 200223, 1-1937; 19504, WNK2, 97774, 200224, 1-5320; 19504,

WNK2, 97775, 200225, 1-6662; 19504, WNK2, 97768, 200218, 1-6894; 19505, WNK3, 97779, 200229, 220-715; 19505, WNK3, 97780, 200230, 1-5400; 19505, WNK3, 97776, 200226, 440-5842; 19505, WNK3, 97777, 200227, 1-5403; 19505, WNK3, 97778, 200228, 440-5671; 19506, WNK4, 97782, 200232, 19-1428; 19506, WNK4, 97783, 200233, 1-188; 19506, WNK4, 97781, 200231, 22-3753; 19507, WIF1, 97785, 200235, 1-387; 19507, WIF1, 97786, 200236, 169-568; 19507, WIF1, 97784, 200234, 376-1515; 19508, WISP1, 97789, 200239, 107-217; 19508, WISP1, 97787, 200237, 9-851; 19508, WISP1, 97788, 200238, 107-1210; 19508, WISP1, 97790, 200240, 62-529; 19508, WISP1, 97791, 200241, 77-445; 19509, WISP2, 97792, 200242, 147-899; 19509, WISP2, 97793, 200243, 509-1165; 19509, WISP2, 97794, 200244, 344-1096; 19510, WISP3, 97797, 200247, 3-695; 19510, WISP3, 97798, 200248, 85-798; 19510, WISP3, 97800, 200250, 523-915; 19510, WISP3, 97801, 200251, 111-770; 19510, WISP3, 97795, 200245, 111-1175; 19510, WISP3, 97796, 200246, 100-1164; 19510, WISP3, 97799, 200249, 233-1351; 19510, WISP3, 97802, 200252, 120-1184; 19511, WLS, 97805, 200255, 225-608; 19511, WLS, 97806, 200256, 206-572; 19511, WLS, 97808, 200258, 1-600; 19511, WLS, 97809, 200259, 389-1056; 19511, WLS, 97810, 200260, 223-339; 19511, WLS, 97811, 200261, 121-524; 19511, WLS, 97812, 200262, 1-458; 19511, WLS, 97813, 200263, 98-555; 19511, WLS, 97803, 200253, 255-1880; 19511, WLS, 97804, 200254, 247-1878; 19511, WLS, 97807, 200257, 246-1598; 19512, WHSC1, 97823, 200273, 417-528; 19512, WHSC1, 97825, 200275, 37-1212; 19512, WHSC1, 97827, 200277, 1-492; 19512, WHSC1, 97828, 200278, 1-851; 19512, WHSC1, 97830, 200280, 220-816; 19512, WHSC1, 97814, 200264, 432-2375; 19512, WHSC1, 97815, 200265, 495-2438; 19512, WHSC1, 97816, 200266, 519-2660; 19512, WHSC1, 97817, 200267, 140-4237; 19512, WHSC1, 97818, 200268, 315-4412; 19512, WHSC1, 97819, 200269, 432-4529; 19512, WHSC1, 97820, 200270, 30-1973; 19512, WHSC1, 97821, 200271, 432-2321; 19512, WHSC1, 97822, 200272, 14-835; 19512, WHSC1, 97824, 200274, 112-2001; 19512, WHSC1, 97826, 200276, 149-4246; 19512, WHSC1, 97829, 200279, 208-2151; 19512, WHSC1, 97831, 200281, 6-827; 19513, WHSC1L1, 97835, 200285, 257-301; 19513, WHSC1L1, 97836, 200286, 502-577; 19513, WHSC1L1, 97838, 200288, 1-234; 19513, WHSC1L1, 97839, 200289, 187-1032; 19513, WHSC1L1, 97832, 200282, 519-2456; 19513, WHSC1L1, 97833, 200283, 519-4832; 19513, WHSC1L1, 97834, 200284, 492-4658; 19513, WHSC1L1, 97837, 200287, 93-4373; 19514, WFS1, 97842, 200292, 1-755; 19514, WFS1, 97840, 200290, 171-2843; 19514, WFS1, 97841, 200291, 168-2840; 19515, WSCD1, 97845, 200295, 1-410; 19515, WSCD1, 97847, 200297, 416-677; 19515, WSCD1, 97848, 200298, 518-1059; 19515, WSCD1, 97849, 200299, 117-1496; 19515, WSCD1, 97850, 200300, 416-494; 19515, WSCD1, 97852, 200302, 435-570; 19515, WSCD1, 97853, 200303, 626-759; 19515, WSCD1, 97843, 200293, 328-2055; 19515, WSCD1, 97844, 200294, 353-2080; 19515, WSCD1, 97846, 200296, 353-2080; 19515, WSCD1, 97851, 200301, 391-2118; 19516, WSCD2, 97855, 200305, 199-569; 19516, WSCD2, 97854, 200304, 819-2516; 19516, WSCD2, 97856, 200306, 1-1758; 19516, WSCD2, 97857, 200307, 1008-2705; 19517, WWC1, 97859, 200309, 1-3241; 19517, WWC1, 97861, 200311, 1-1335; 19517, WWC1, 97862, 200312, 1-2668; 19517, WWC1, 97863, 200313, 1-1014; 19517, WWC1, 97858, 200308, 503-3844; 19517, WWC1, 97860, 200310, 4-3363; 19518, WWC2, 97865, 200315, 148-381; 19518, WWC2, 97869, 200319, 154-399; 19518, WWC2, 97864, 200314, 200-3778; 19518, WWC2, 97866, 200316, 1-3651; 19518, WWC2, 97867, 200317, 142-2280; 19518, WWC2, 97868, 200318, 34-996; 19518, WWC2, 97870, 200320, 1-3432; 19518, WWC2, 97871, 200321, 49-2673; 19519, WBP1, 97873, 200323, 204-1115; 19519, WBP1, 97874, 200324, 135-935; 19519, WBP1, 97875, 200325, 241-989; 19519, WBP1, 97872, 200322, 275-1084; 19520, WBP11, 97877, 200327, 336-494; 19520, WBP11, 97878, 200328, 46-630; 19520, WBP11, 97876, 200326, 235-2160; 19521, WBP1L, 97879, 200329, 143-1171; 19521, WBP1L, 97880, 200330, 85-1176; 19522, WBP2, 97882, 200332, 39-689; 19522, WBP2, 97883, 200333, 110-610; 19522, WBP2, 97884, 200334, 1-617; 19522, WBP2, 97885, 200335, 139-480; 19522, WBP2, 97886, 200336, 13-120; 19522, WBP2, 97887, 200337, 10-783; 19522, WBP2, 97888, 200338, 12-707; 19522, WBP2, 97890, 200340, 151-870; 19522, WBP2, 97891, 200341, 112-568; 19522, WBP2, 97892, 200342, 124-819; 19522, WBP2, 97881, 200331, 124-909; 19522, WBP2, 97889, 200339, 426-1211; 19523, WBP4, 97893, 200343, 401-1531; 19524, WBP5, 97894, 200344, 226-540; 19524, WBP5, 97895, 200345, 312-626; 19525, WAC, 97898, 200348, 319-1806; 19525, WAC, 97900, 200350, 330-506; 19525, WAC, 97901, 200351, 281-727; 19525, WAC, 97902, 200352, 240-759; 19525, WAC, 97903, 200353, 41-145; 19525, WAC, 97904, 200354, 172-784; 19525, WAC, 97905, 200355, 118-816; 19525, WAC, 97907, 200357, 478-585; 19525, WAC, 97908, 200358, 346-792; 19525, WAC, 97896, 200346, 268-1902; 19525, WAC, 97897, 200347, 162-2105; 19525, WAC, 97899, 200349, 610-2418; 19525, WAC, 97906, 200356, 354-1664; 19526, WWP1, 97911, 200361, 1-696; 19526, WWP1, 97912, 200362, 1-168; 19526, WWP1, 97909, 200359, 11-2779; 19526, WWP1, 97910, 200360, 308-3076; 19527, WWP2, 97916, 200366, 377-561; 19527, WWP2, 97918, 200368, 254-574; 19527, WWP2, 97919, 200369, 254-604; 19527, WWP2, 97913, 200363, 162-2426; 19527, WWP2, 97914, 200364, 102-2714; 19527, WWP2, 97915, 200365, 71-1078; 19527, WWP2, 97917, 200367, 579-1874; 19528, WWOX, 97924, 200374, 126-767; 19528, WWOX, 97925, 200375, 124-261; 19528, WWOX, 97927, 200377, 154-291; 19528, WWOX, 97929, 200379, 1-450; 19528, WWOX, 97930, 200380, 350-487; 19528, WWOX, 97920, 200370, 101-670; 19528, WWOX, 97921, 200371, 126-1061; 19528, WWOX, 97922, 200372, 126-830; 19528, WWOX, 97923, 200373, 86-1177; 19528, WWOX, 97926, 200376, 105-215; 19528, WWOX, 97928, 200378, 367-1611; 19529, WWTR1, 97932, 200382, 215-955; 19529, WWTR1, 97933, 200383, 1-89; 19529, WWTR1, 97934, 200384, 542-604; 19529, WWTR1, 97935, 200385, 130-697; 19529, WWTR1, 97936, 200386, 1-128; 19529, WWTR1, 97939, 200389, 88-503; 19529, WWTR1, 97940, 200390, 250-578; 19529, WWTR1, 97931, 200381, 341-1543; 19529, WWTR1, 97937, 200387, 206-1408; 19529, WWTR1, 97938, 200388, 258-1460; 19530, WWC3, 97942, 200392, 1-3651; 19530, WWC3, 97941, 200391, 392-3670; 19531, XAGE1A, 97943, 200393, 125-334; 19531, XAGE1A, 97944, 200394, 281-526; 19532, XAGE1B, 97945, 200395, 125-334; 19532, XAGE1B, 97946, 200396, 281-526; 19532, XAGE1B, 97947, 200397, 142-387; 19533, XAGE2, 97948, 200398, 194-529; 19534, XAGE3, 97949, 200399, 72-407; 19534, XAGE3, 97950, 200400, 61-396; 19535, XAGE5, 97953, 200403, 364-591; 19535, XAGE5, 97951, 200401, 67-393; 19535, XAGE5, 97952, 200402, 1-327; 19536, XDH, 97954, 200404, 50-4051; 19537, XBP1, 97957, 200407, 98-733; 19537, XBP1, 97958, 200408, 35-835; 19537,

XBP1, 97955, 200405, 74-859; 19537, XBP1, 97956, 200406, 1-1131; 19537, XBP1, 97959, 200409, 49-1179; 19538, XPR1, 97960, 200410, 171-2066; 19538, XPR1, 97961, 200411, 199-2289; 19539, XPA, 97963, 200413, 2-796; 19539, XPA, 97962, 200412, 66-887; 19540, XPC, 97965, 200415, 54-557; 19540, XPC, 97964, 200414, 216-3038; 19540, XPC, 97966, 200416, 34-456; 19541, XG, 97969, 200419, 131-574; 19541, XG, 97967, 200417, 226-768; 19541, XG, 97968, 200418, 224-811; 19542, XAF1, 97973, 200423, 25-519; 19542, XAF1, 97974, 200424, 18-242; 19542, XAF1, 97975, 200425, 13-583; 19542, XAF1, 97976, 200426, 176-576; 19542, XAF1, 97977, 200427, 13-204; 19542, XAF1, 97979, 200429, 3-389; 19542, XAF1, 97980, 200430, 34-471; 19542, XAF1, 97981, 200431, 632-1018; 19542, XAF1, 97970, 200420, 242-1090; 19542, XAF1, 97971, 200421, 240-1145; 19542, XAF1, 97972, 200422, 1-426; 19542, XAF1, 97978, 200428, 1-369; 19543, XIRP1, 97982, 200432, 230-5761; 19543, XIRP1, 97983, 200433, 232-3597; 19543, XIRP1, 97984, 200434, 318-1898; 19544, XIRP2, 97985, 200435, 423-3314; 19544, XIRP2, 97986, 200436, 90-2906; 19544, XIRP2, 97987, 200437, 90-3005; 19544, XIRP2, 97988, 200438, 90-10739; 19544, XIRP2, 97989, 200439, 354-2504; 19544, XIRP2, 97990, 200440, 354-10337; 19544, XIRP2, 97991, 200441, 126-10250; 19545, XKR3, 97992, 200442, 104-1483; 19546, XKR4, 97993, 200443, 101-2053; 19546, XKR4, 97994, 200444, 33-1985; 19547, XKR5, 97995, 200445, 152-2212; 19547, XKR5, 97996, 200446, 6-266; 19548, XKR6, 97997, 200447, 1-864; 19548, XKR6, 97998, 200448, 1-1256; 19548, XKR6, 98000, 200450, 1-278; 19548, XKR6, 97999, 200449, 28-1953; 19549, XKR7, 98001, 200451, 175-1914; 19550, XKR5, 98002, 200452, 609-1796; 19551, XKR9, 98004, 200454, 450-716; 19551, XKR9, 98005, 200455, 535-912; 19551, XKR9, 98003, 200453, 535-1656; 19551, XKR9, 98006, 200456, 612-1733; 19552, XKRX, 98008, 200458, 1130-1549; 19552, XKRX, 98007, 200457, 606-1955; 19553, XIAP, 98012, 200462, 61-528; 19553, XIAP, 98013, 200463, 342-390; 19553, XIAP, 98009, 200459, 307-1800; 19553, XIAP, 98010, 200460, 300-1793; 19553, XIAP, 98011, 200461, 127-1620; 19554, XK, 98014, 200464, 204-1538; 19555, XAB2, 98015, 200465, 39-2606; 19556, XPNPEP1, 98017, 200467, 268-1926; 19556, XPNPEP1, 98018, 200468, 98-1006; 19556, XPNPEP1, 98019, 200469, 13-712; 19556, XPNPEP1, 98016, 200466, 121-2049; 19556, XPNPEP1, 98020, 200470, 121-2121; 19557, XPNPEP2, 98021, 200471, 241-792; 19557, XPNPEP2, 98022, 200472, 193-2217; 19558, XPNPEP3, 98024, 200474, 52-261; 19558, XPNPEP3, 98025, 200475, 63-230; 19558, XPNPEP3, 98023, 200473, 85-1608; 19559, XRRA1, 98028, 200478, 1-191; 19559, XRRA1, 98029, 200479, 903-1250; 19559, XRRA1, 98030, 200480, 632-690; 19559, XRRA1, 98031, 200481, 851-1016; 19559, XRRA1, 98033, 200483, 1101-1826; 19559, XRRA1, 98034, 200484, 98-986; 19559, XRRA1, 98026, 200476, 852-2405; 19559, XRRA1, 98027, 200477, 333-2711; 19559, XRRA1, 98032, 200482, 262-2058; 19560, XRCC1, 98036, 200486, 106-1914; 19560, XRCC1, 98037, 200487, 38-913; 19560, XRCC1, 98038, 200488, 1-496; 19560, XRCC1, 98039, 200489, 70-586; 19560, XRCC1, 98040, 200490, 1-628; 19560, XRCC1, 98035, 200485, 549-2450; 19561, XRCC2, 98041, 200491, 87-929; 19562, XRCC3, 98043, 200493, 437-572; 19562, XRCC3, 98044, 200494, 418-560; 19562, XRCC3, 98045, 200495, 297-746; 19562, XRCC3, 98046, 200496, 257-562; 19562, XRCC3, 98047, 200497, 464-801; 19562, XRCC3, 98048, 200498, 91-516; 19562, XRCC3, 98051, 200501, 351-535; 19562, XRCC3, 98053, 200503, 378-830; 19562, XRCC3, 98042, 200492, 342-1382; 19562, XRCC3, 98049, 200499, 310-1350; 19562, XRCC3, 98050, 200500, 798-1838; 19562, XRCC3, 98052, 200502, 364-1404; 19563, XRCC4, 98054, 200504, 176-1180; 19563, XRCC4, 98055, 200505, 100-1110; 19563, XRCC4, 98056, 200506, 57-1061; 19563, XRCC4, 98057, 200507, 81-1091; 19564, XRCC5, 98060, 200510, 1-59; 19564, XRCC5, 98061, 200511, 211-605; 19564, XRCC5, 98058, 200508, 141-2339; 19564, XRCC5, 98059, 200509, 462-2660; 19565, XRCC6, 98064, 200514, 60-1739; 19565, XRCC6, 98067, 200517, 236-1915; 19565, XRCC6, 98062, 200512, 656-2485; 19565, XRCC6, 98063, 200513, 243-2072; 19565, XRCC6, 98065, 200515, 147-1976; 19565, XRCC6, 98066, 200516, 67-1773; 19566, XRCC6BP1, 98069, 200519, 1-113; 19566, XRCC6BP1, 98071, 200521, 1-113; 19566, XRCC6BP1, 98068, 200518, 126-866; 19566, XRCC6BP1, 98070, 200520, 126-866; 19567, N/A, 98072, 200522, 1-196; 19568, N/A, 98073, 200523, 192-1097; 19568, N/A, 98074, 200524, 569-1474; 19568, N/A, 98075, 200525, 1-383; 19569, N/A, 98076, 200526, 56-3856; 19569, N/A, 98077, 200527, 30-3377; 19570, N/A, 98078, 200528, 87-612; 19571, N/A, 98079, 200529, 175-2705; 19572, N/A, 98080, 200530, 4-1152; 19573, N/A, 98081, 200531, 261-452; 19574, N/A, 98082, 200532, 119-805; 19574, N/A, 98083, 200533, 1-639; 19574, N/A, 98084, 200534, 13-927; 19575, N/A, 98085, 200535, 119-271; 19576, XXYLT1, 98088, 200538, 20-274; 19576, XXYLT1, 98089, 200539, 84-827; 19576, XXYLT1, 98090, 200540, 1-343; 19576, XXYLT1, 98086, 200536, 110-1291; 19576, XXYLT1, 98087, 200537, 1-564; 19576, XXYLT1, 98091, 200541, 463-1035; 19577, B4GALT7, 98093, 200543, 437-544; 19577, B4GALT7, 98094, 200544, 426-552; 19577, B4GALT7, 98095, 200545, 1-234; 19577, B4GALT7, 98096, 200546, 50-562; 19577, B4GALT7, 98092, 200542, 112-1095; 19578, XYLT1, 98097, 200547, 86-2965; 19579, XYLT2, 98099, 200549, 6-1925; 19579, XYLT2, 98100, 200550, 11-145; 19579, XYLT2, 98101, 200551, 7-2037; 19579, XYLT2, 98102, 200552, 1-354; 19579, XYLT2, 98103, 200553, 1-141; 19579, XYLT2, 98098, 200548, 50-2647; 19580, XYLB, 98105, 200555, 62-247; 19580, XYLB, 98106, 200556, 110-310; 19580, XYLB, 98104, 200554, 91-1701; 19581, YBX1, 98108, 200558, 1-1124; 19581, YBX1, 98109, 200559, 127-776; 19581, YBX1, 98110, 200560, 140-1102; 19581, YBX1, 98107, 200557, 140-1114; 19582, YBX2, 98112, 200562, 1-493; 19582, YBX2, 98111, 200561, 65-1159; 19583, YBX3, 98115, 200565, 1-277; 19583, YBX3, 98113, 200563, 202-1320; 19583, YBX3, 98114, 200564, 197-1108; 19584, YAE1D1, 98118, 200568, 26-289; 19584, YAE1D1, 98116, 200566, 44-724; 19584, YAE1D1, 98117, 200567, 14-634; 19585, YBEY, 98119, 200569, 399-902; 19585, YBEY, 98120, 200570, 399-773; 19585, YBEY, 98121, 200571, 144-647; 19585, YBEY, 98122, 200572, 77-316; 19585, YBEY, 98123, 200573, 77-445; 19585, YBEY, 98124, 200574, 124-627; 19586, YDJC, 98125, 200575, 51-1022; 19586, YDJC, 98126, 200576, 22-471; 19586, YDJC, 98127, 200577, 51-461; 19587, YEATS2, 98129, 200579, 1-658; 19587, YEATS2, 98128, 200578, 196-4464; 19588, YEATS4, 98131, 200581, 195-827; 19588, YEATS4, 98132, 200582, 264-785; 19588, YEATS4, 98133, 200583, 545-884; 19588, YEATS4, 98130, 200580, 271-954; 19589, YES1, 98136, 200586, 72-1718; 19589, YES1, 98134, 200584, 134-1765; 19589, YES1, 98135, 200585, 172-1803; 19590, YAP1, 98140, 200590, 1-776; 19590, YAP1, 98137, 200587, 389-1903; 19590, YAP1, 98138, 200588, 389-1801; 19590, YAP1, 98139, 200589, 1-1467; 19590, YAP1, 98141, 200591, 389-1741;

19590, YAP1, 98142, 200592, 446-1426; 19590, YAP1, 98143, 200593, 389-1867; 19590, YAP1, 98144, 200594, 389-1915; 19590, YAP1, 98145, 200595, 1-1365; 19591, YIPF1, 98148, 200598, 392-1042; 19591, YIPF1, 98146, 200596, 372-1292; 19591, YIPF1, 98147, 200597, 586-957; 19591, YIPF1, 98149, 200599, 71-991; 19592, YIPF2, 98151, 200601, 97-656; 19592, YIPF2, 98152, 200602, 1-240; 19592, YIPF2, 98153, 200603, 543-796; 19592, YIPF2, 98155, 200605, 622-932; 19592, YIPF2, 98156, 200606, 106-939; 19592, YIPF2, 98157, 200607, 1-620; 19592, YIPF2, 98158, 200608, 1-509; 19592, YIPF2, 98159, 200609, 103-753; 19592, YIPF2, 98150, 200600, 128-1078; 19592, YIPF2, 98154, 200604, 174-1124; 19593, YIPF3, 98161, 200611, 136-327; 19593, YIPF3, 98162, 200612, 113-250; 19593, YIPF3, 98163, 200613, 127-318; 19593, YIPF3, 98164, 200614, 239-566; 19593, YIPF3, 98165, 200615, 147-933; 19593, YIPF3, 98166, 200616, 1-406; 19593, YIPF3, 98167, 200617, 166-360; 19593, YIPF3, 98168, 200618, 135-1205; 19593, YIPF3, 98169, 200619, 179-370; 19593, YIPF3, 98160, 200610, 184-1236; 19594, YIPF4, 98171, 200621, 1-177; 19594, YIPF4, 98172, 200622, 1-101; 19594, YIPF4, 98170, 200620, 247-981; 19595, YIPF5, 98176, 200626, 349-653; 19595, YIPF5, 98177, 200627, 154-684; 19595, YIPF5, 98173, 200623, 136-909; 19595, YIPF5, 98174, 200624, 358-1131; 19595, YIPF5, 98175, 200625, 400-1011; 19596, YIPF6, 98179, 200629, 506-1070; 19596, YIPF6, 98178, 200628, 286-867; 19596, YIPF6, 98180, 200630, 745-1455; 19597, YIPF7, 98182, 200632, 77-847; 19597, YIPF7, 98183, 200633, 368-484; 19597, YIPF7, 98181, 200631, 18-860; 19598, YIF1A, 98184, 200634, 161-886; 19598, YIF1A, 98186, 200636, 23-619; 19598, YIF1A, 98187, 200637, 144-305; 19598, YIF1A, 98188, 200638, 53-532; 19598, YIF1A, 98189, 200639, 371-610; 19598, YIF1A, 98190, 200640, 256-732; 19598, YIF1A, 98191, 200641, 1-354; 19598, YIF1A, 98185, 200635, 186-1067; 19599, YIF1B, 98197, 200647, 158-466; 19599, YIF1B, 98200, 200650, 36-782; 19599, YIF1B, 98201, 200651, 1-575; 19599, YIF1B, 98202, 200652, 40-734; 19599, YIF1B, 98192, 200642, 65-964; 19599, YIF1B, 98193, 200643, 7-882; 19599, YIF1B, 98194, 200644, 47-991; 19599, YIF1B, 98195, 200645, 316-1167; 19599, YIF1B, 98196, 200646, 89-940; 19599, YIF1B, 98198, 200648, 4-888; 19599, YIF1B, 98199, 200649, 82-933; 19600, YPEL1, 98204, 200654, 306-440; 19600, YPEL1, 98203, 200653, 385-744; 19601, YPEL2, 98205, 200655, 319-678; 19601, YPEL2, 98206, 200656, 336-695; 19602, YPEL3, 98209, 200659, 267-575; 19602, YPEL3, 98210, 200660, 1-95; 19602, YPEL3, 98211, 200661, 212-376; 19602, YPEL3, 98213, 200663, 531-944; 19602, YPEL3, 98214, 200664, 141-368; 19602, YPEL3, 98207, 200657, 215-574; 19602, YPEL3, 98208, 200658, 719-1192; 19602, YPEL3, 98212, 200662, 364-723; 19602, YPEL3, 98215, 200665, 238-597; 19603, YPEL4, 98219, 200669, 321-561; 19603, YPEL4, 98220, 200670, 405-572; 19603, YPEL4, 98216, 200666, 445-828; 19603, YPEL4, 98217, 200667, 318-701; 19603, YPEL4, 98218, 200668, 2724-3107; 19604, YPEL5, 98221, 200671, 127-492; 19604, YPEL5, 98222, 200672, 444-809; 19604, YPEL5, 98223, 200673, 505-870; 19604, YPEL5, 98224, 200674, 142-507; 19604, YPEL5, 98225, 200675, 662-1027; 19605, YJEFN3, 98228, 200678, 52-348; 19605, YJEFN3, 98226, 200676, 73-822; 19605, YJEFN3, 98227, 200677, 39-938; 19606, YKT6, 98230, 200680, 1-90; 19606, YKT6, 98229, 200679, 88-684; 19606, YKT6, 98231, 200681, 169-663; 19607, YLPM1, 98233, 200683, 125-4447; 19607, YLPM1, 98234, 200684, 1-1401; 19607, YLPM1, 98235, 200685, 1-4788; 19607, YLPM1, 98236, 200686, 1-331; 19607, YLPM1, 98232, 200682, 125-6565; 19608, YME1L1, 98238, 200688, 147-2369; 19608, YME1L1, 98240, 200690, 241-986; 19608, YME1L1, 98241, 200691, 17-775; 19608, YME1L1, 98242, 200692, 1057-1467; 19608, YME1L1, 98243, 200693, 183-912; 19608, YME1L1, 98237, 200687, 150-2471; 19608, YME1L1, 98239, 200689, 183-2333; 19608, YME1L1, 98244, 200694, 211-2262; 19609, YOD1, 98245, 200695, 48-1094; 19609, YOD1, 98246, 200696, 206-1120; 19610, YRDC, 98247, 200697, 6-845; 19611, YTHDC1, 98250, 200700, 1-281; 19611, YTHDC1, 98251, 200701, 478-515; 19611, YTHDC1, 98252, 200702, 154-265; 19611, YTHDC1, 98253, 200703, 1-2208; 19611, YTHDC1, 98256, 200706, 478-515; 19611, YTHDC1, 98257, 200707, 1-281; 19611, YTHDC1, 98258, 200708, 1-2208; 19611, YTHDC1, 98259, 200709, 154-265; 19611, YTHDC1, 98248, 200698, 337-2520; 19611, YTHDC1, 98249, 200699, 337-2466; 19611, YTHDC1, 98254, 200704, 337-2520; 19611, YTHDC1, 98255, 200705, 337-2466; 19612, YTHDC2, 98261, 200711, 124-536; 19612, YTHDC2, 98262, 200712, 188-2407; 19612, YTHDC2, 98263, 200713, 203-499; 19612, YTHDC2, 98260, 200710, 214-4506; 19613, YTHDF1, 98264, 200714, 248-406; 19613, YTHDF1, 98265, 200715, 343-2022; 19614, YTHDF2, 98269, 200719, 264-864; 19614, YTHDF2, 98270, 200720, 157-879; 19614, YTHDF2, 98271, 200721, 151-1860; 19614, YTHDF2, 98266, 200716, 363-2102; 19614, YTHDF2, 98267, 200717, 307-1896; 19614, YTHDF2, 98268, 200718, 264-2003; 19615, YTHDF3, 98273, 200723, 225-383; 19615, YTHDF3, 98274, 200724, 162-420; 19615, YTHDF3, 98275, 200725, 239-545; 19615, YTHDF3, 98276, 200726, 355-2121; 19615, YTHDF3, 98277, 200727, 231-1835; 19615, YTHDF3, 98278, 200728, 259-593; 19615, YTHDF3, 98279, 200729, 198-1964; 19615, YTHDF3, 98280, 200730, 393-1997; 19615, YTHDF3, 98281, 200731, 224-349; 19615, YTHDF3, 98282, 200732, 227-1978; 19615, YTHDF3, 98283, 200733, 206-563; 19615, YTHDF3, 98284, 200734, 510-2114; 19615, YTHDF3, 98272, 200722, 326-2083; 19616, YAF2, 98288, 200738, 124-258; 19616, YAF2, 98289, 200739, 168-269; 19616, YAF2, 98290, 200740, 1-204; 19616, YAF2, 98291, 200741, 84-254; 19616, YAF2, 98292, 200742, 170-373; 19616, YAF2, 98293, 200743, 69-287; 19616, YAF2, 98294, 200744, 44-406; 19616, YAF2, 98295, 200745, 42-332; 19616, YAF2, 98285, 200735, 57-671; 19616, YAF2, 98286, 200736, 108-524; 19616, YAF2, 98287, 200737, 69-611; 19616, YAF2, 98296, 200746, 170-523; 19617, YY1AP1, 98300, 200750, 180-770; 19617, YY1AP1, 98303, 200753, 242-739; 19617, YY1AP1, 98308, 200758, 12-1499; 19617, YY1AP1, 98311, 200761, 65-211; 19617, YY1AP1, 98312, 200762, 315-932; 19617, YY1AP1, 98313, 200763, 228-810; 19617, YY1AP1, 98297, 200747, 25-2415; 19617, YY1AP1, 98298, 200748, 312-2471; 19617, YY1AP1, 98299, 200749, 61-2313; 19617, YY1AP1, 98301, 200751, 200-2452; 19617, YY1AP1, 98302, 200752, 260-2479; 19617, YY1AP1, 98304, 200754, 313-2532; 19617, YY1AP1, 98305, 200755, 92-2344; 19617, YY1AP1, 98306, 200756, 193-2859; 19617, YY1AP1, 98307, 200757, 110-2716; 19617, YY1AP1, 98309, 200759, 251-2443; 19617, YY1AP1, 98310, 200760, 335-2494; 19618, YY1, 98315, 200765, 535-636; 19618, YY1, 98316, 200766, 1-370; 19618, YY1, 98317, 200767, 1-572; 19618, YY1, 98314, 200764, 261-1505; 19619, YY2, 98318, 200768, 499-1617; 19620, ZBED6CL, 98319, 200769, 617-1327; 19621, ZBP1, 98322, 200772, 1-357; 19621, ZBP1, 98320, 200770, 179-1468; 19621, ZBP1, 98321, 200771, 282-1346; 19621,

ZBP1, 98323, 200773, 100-846; 19622, ZAP70, 98324, 200774, 216-2075; 19622, ZAP70, 98325, 200775, 147-1085; 19623, ZFP1, 98326, 200776, 195-1319; 19623, ZFP1, 98328, 200778, 194-280; 19623, ZFP1, 98329, 200779, 261-491; 19623, ZFP1, 98331, 200781, 161-391; 19623, ZFP1, 98327, 200777, 125-1348; 19623, ZFP1, 98330, 200780, 196-1419; 19624, ZFP14, 98333, 200783, 82-327; 19624, ZFP14, 98332, 200782, 117-1718; 19625, ZFP2, 98335, 200785, 530-598; 19625, ZFP2, 98338, 200788, 507-532; 19625, ZFP2, 98334, 200784, 531-1916; 19625, ZFP2, 98336, 200786, 415-1800; 19625, ZFP2, 98337, 200787, 304-1689; 19626, ZFP28, 98340, 200790, 1-441; 19626, ZFP28, 98339, 200789, 72-2678; 19626, ZFP28, 98341, 200791, 67-1116; 19627, ZFP3, 98342, 200792, 337-1845; 19628, ZFP30, 98346, 200796, 414-583; 19628, ZFP30, 98347, 200797, 200-572; 19628, ZFP30, 98348, 200798, 548-557; 19628, ZFP30, 98349, 200799, 96-374; 19628, ZFP30, 98350, 200800, 515-521; 19628, ZFP30, 98343, 200793, 559-2118; 19628, ZFP30, 98344, 200794, 588-2147; 19628, ZFP30, 98345, 200795, 388-1947; 19629, ZFP36, 98351, 200801, 75-1073; 19629, ZFP36, 98352, 200802, 1-444; 19629, ZFP36, 98353, 200803, 1-1030; 19629, ZFP36, 98354, 200804, 31-246; 19630, ZFP36L1, 98357, 200807, 49-577; 19630, ZFP36L1, 98358, 200808, 105-727; 19630, ZFP36L1, 98359, 200809, 57-266; 19630, ZFP36L1, 98360, 200810, 66-633; 19630, ZFP36L1, 98355, 200805, 1799-2815; 19630, ZFP36L1, 98356, 200806, 303-1319; 19631, ZFP36L2, 98362, 200812, 65-1543; 19631, ZFP36L2, 98361, 200811, 295-1779; 19632, ZFP37, 98363, 200813, 29-1921; 19632, ZFP37, 98364, 200814, 72-1967; 19632, ZFP37, 98365, 200815, 1-1938; 19633, ZFP41, 98366, 200816, 367-966; 19633, ZFP41, 98367, 200817, 1081-1680; 19634, ZFP42, 98368, 200818, 409-1341; 19634, ZFP42, 98369, 200819, 243-1175; 19634, ZFP42, 98370, 200820, 101-1033; 19635, ZFP57, 98375, 200825, 1-634; 19635, ZFP57, 98371, 200821, 1-1359; 19635, ZFP57, 98372, 200822, 413-1963; 19635, ZFP57, 98373, 200823, 413-1963; 19635, ZFP57, 98374, 200824, 413-1963; 19635, ZFP57, 98376, 200826, 413-1963; 19635, ZFP57, 98377, 200827, 413-1963; 19635, ZFP57, 98378, 200828, 413-1963; 19635, ZFP57, 98379, 200829, 413-1963; 19635, ZFP57, 98380, 200830, 152-1762; 19635, ZFP57, 98381, 200831, 1-1359; 19635, ZFP57, 98382, 200832, 152-1762; 19635, ZFP57, 98383, 200833, 1-1359; 19635, ZFP57, 98384, 200834, 152-1762; 19635, ZFP57, 98385, 200835, 1-1359; 19635, ZFP57, 98386, 200836, 152-1762; 19635, ZFP57, 98387, 200837, 1-1359; 19635, ZFP57, 98388, 200838, 152-1762; 19635, ZFP57, 98389, 200839, 152-1762; 19635, ZFP57, 98390, 200840, 1-1359; 19635, ZFP57, 98391, 200841, 152-1762; 19635, ZFP57, 98392, 200842, 1-1359; 19636, ZFP62, 98393, 200843, 269-749; 19636, ZFP62, 98394, 200844, 234-544; 19636, ZFP62, 98396, 200846, 308-542; 19636, ZFP62, 98395, 200845, 59-2761; 19636, ZFP62, 98397, 200847, 230-2833; 19637, ZFP64, 98404, 200854, 27-422; 19637, ZFP64, 98405, 200855, 100-762; 19637, ZFP64, 98406, 200856, 1-361; 19637, ZFP64, 98398, 200848, 351-2396; 19637, ZFP64, 98399, 200849, 125-2008; 19637, ZFP64, 98400, 200850, 62-1999; 19637, ZFP64, 98401, 200851, 133-2172; 19637, ZFP64, 98402, 200852, 144-1391; 19637, ZFP64, 98403, 200853, 408-1688; 19638, ZFP69, 98407, 200857, 295-1875; 19638, ZFP69, 98408, 200858, 1007-2587; 19639, ZFP69B, 98411, 200861, 367-762; 19639, ZFP69B, 98409, 200859, 298-1902; 19639, ZFP69B, 98410, 200860, 376-1980; 19640, ZFP82, 98413, 200863, 1-148; 19640, ZFP82, 98412, 200862, 244-1842; 19641, ZFP90, 98415, 200865, 91-273; 19641, ZFP90, 98417, 200867, 219-401; 19641, ZFP90, 98418, 200868, 175-485; 19641, ZFP90, 98419, 200869, 201-383; 19641, ZFP90, 98420, 200870, 439-538; 19641, ZFP90, 98421, 200871, 1-309; 19641, ZFP90, 98422, 200872, 581-717; 19641, ZFP90, 98423, 200873, 1-159; 19641, ZFP90, 98424, 200874, 233-543; 19641, ZFP90, 98426, 200876, 439-579; 19641, ZFP90, 98427, 200877, 152-334; 19641, ZFP90, 98428, 200878, 215-496; 19641, ZFP90, 98414, 200864, 36-1946; 19641, ZFP90, 98416, 200866, 232-2142; 19641, ZFP90, 98425, 200875, 293-2203; 19641, ZFP90, 98429, 200879, 190-531; 19642, ZFP91, 98430, 200880, 172-1884; 19643, ZFP91-CNTF, 98431, 200881, 111-1700; 19643, ZFP91-CNTF, 98432, 200882, 1-1065; 19644, ZFP92, 98433, 200883, 2-1252; 19645, ZHX1-C8orf76, 98434, 200884, 95-973; 19645, ZHX1-C8orf76, 98435, 200885, 162-581; 19646, ZIC1, 98437, 200887, 1-410; 19646, ZIC1, 98436, 200886, 730-2073; 19647, ZIC2, 98439, 200889, 1-1596; 19647, ZIC2, 98438, 200888, 294-1892; 19648, ZIC3, 98440, 200890, 551-1954; 19648, ZIC3, 98441, 200891, 175-1548; 19649, ZIC4, 98446, 200896, 268-500; 19649, ZIC4, 98447, 200897, 361-565; 19649, ZIC4, 98448, 200898, 242-929; 19649, ZIC4, 98442, 200892, 514-1518; 19649, ZIC4, 98443, 200893, 50-1168; 19649, ZIC4, 98444, 200894, 337-1341; 19649, ZIC4, 98445, 200895, 444-830; 19649, ZIC4, 98449, 200899, 164-1168; 19649, ZIC4, 98450, 200900, 187-1341; 19650, ZIC5, 98451, 200901, 235-2226; 19651, ZACN, 98452, 200902, 84-1322; 19651, ZACN, 98453, 200903, 38-418; 19651, ZACN, 98454, 200904, 84-884; 19652, ZNRF1, 98458, 200908, 328-957; 19652, ZNRF1, 98459, 200909, 1-236; 19652, ZNRF1, 98460, 200910, 328-485; 19652, ZNRF1, 98455, 200905, 636-1472; 19652, ZNRF1, 98456, 200906, 643-1326; 19652, ZNRF1, 98457, 200907, 328-1011; 19653, ZNRF2, 98461, 200911, 1052-1780; 19654, ZNRF3, 98462, 200912, 94-2604; 19654, ZNRF3, 98463, 200913, 25-2535; 19654, ZNRF3, 98464, 200914, 176-2986; 19655, ZNRF4, 98465, 200915, 62-1351; 19656, ZADH2, 98468, 200918, 208-671; 19656, ZADH2, 98469, 200919, 218-520; 19656, ZADH2, 98466, 200916, 291-1424; 19656, ZADH2, 98467, 200917, 482-1246; 19657, ZRSR1, 98470, 200920, 219-1658; 19658, ZRSR2, 98472, 200922, 25-468; 19658, ZRSR2, 98471, 200921, 25-1473; 19659, ZFAT, 98474, 200924, 146-3616; 19659, ZFAT, 98476, 200926, 142-3579; 19659, ZFAT, 98477, 200927, 144-594; 19659, ZFAT, 98479, 200929, 176-352; 19659, ZFAT, 98481, 200931, 1-492; 19659, ZFAT, 98482, 200932, 187-3183; 19659, ZFAT, 98483, 200933, 97-684; 19659, ZFAT, 98484, 200934, 1-296; 19659, ZFAT, 98473, 200923, 176-3907; 19659, ZFAT, 98475, 200925, 301-3996; 19659, ZFAT, 98478, 200928, 142-3837; 19659, ZFAT, 98480, 200930, 100-3645; 19660, ZBTB1, 98486, 200936, 119-509; 19660, ZBTB1, 98488, 200938, 528-629; 19660, ZBTB1, 98489, 200939, 117-582; 19660, ZBTB1, 98485, 200935, 392-2326; 19660, ZBTB1, 98487, 200937, 432-2573; 19661, ZBTB10, 98490, 200940, 166-1905; 19661, ZBTB10, 98491, 200941, 780-3395; 19661, ZBTB10, 98492, 200942, 599-3214; 19661, ZBTB10, 98493, 200943, 599-3142; 19661, ZBTB10, 98494, 200944, 130-2226; 19662, ZBTB11, 98496, 200946, 205-852; 19662, ZBTB11, 98495, 200945, 582-3743; 19663, ZBTB12, 98497, 200947, 179-1558; 19663, ZBTB12, 98498, 200948, 177-1556; 19663, ZBTB12, 98499, 200949, 177-1556; 19663, ZBTB12, 98500, 200950, 177-1556; 19663, ZBTB12, 98501, 200951, 177-1556; 19663, ZBTB12, 98502, 200952, 1-1380; 19664, ZBTB14, 98505, 200955, 136-442; 19664, ZBTB14, 98506, 200956, 154-649; 19664, ZBTB14, 98507, 200957, 163-825; 19664, ZBTB14, 98503, 200953, 340-

1689; 19664, ZBTB14, 98504, 200954, 465-1814; 19664, ZBTB14, 98508, 200958, 163-1512; 19664, ZBTB14, 98509, 200959, 154-1503; 19665, ZBTB16, 98512, 200962, 428-773; 19665, ZBTB16, 98513, 200963, 129-572; 19665, ZBTB16, 98514, 200964, 1-167; 19665, ZBTB16, 98510, 200960, 381-2402; 19665, ZBTB16, 98511, 200961, 169-2190; 19666, ZBTB17, 98517, 200967, 1-631; 19666, ZBTB17, 98518, 200968, 1-722; 19666, ZBTB17, 98515, 200965, 240-2672; 19666, ZBTB17, 98516, 200966, 234-2645; 19666, ZBTB17, 98519, 200969, 248-2413; 19667, ZBTB18, 98520, 200970, 150-1745; 19667, ZBTB18, 98521, 200971, 70-1638; 19668, ZBTB2, 98522, 200972, 142-1686; 19669, ZBTB20, 98528, 200978, 494-551; 19669, ZBTB20, 98531, 200981, 415-587; 19669, ZBTB20, 98523, 200973, 615-2621; 19669, ZBTB20, 98524, 200974, 419-2425; 19669, ZBTB20, 98525, 200975, 489-2495; 19669, ZBTB20, 98526, 200976, 441-2447; 19669, ZBTB20, 98527, 200977, 180-2405; 19669, ZBTB20, 98529, 200979, 774-2780; 19669, ZBTB20, 98530, 200980, 823-2829; 19670, ZBTB21, 98533, 200983, 408-555; 19670, ZBTB21, 98537, 200987, 252-607; 19670, ZBTB21, 98538, 200988, 316-463; 19670, ZBTB21, 98532, 200982, 185-3385; 19670, ZBTB21, 98534, 200984, 348-3548; 19670, ZBTB21, 98535, 200985, 185-2782; 19670, ZBTB21, 98536, 200986, 150-3350; 19671, ZBTB22, 98541, 200991, 134-581; 19671, ZBTB22, 98543, 200993, 134-581; 19671, ZBTB22, 98545, 200995, 134-581; 19671, ZBTB22, 98548, 200998, 134-581; 19671, ZBTB22, 98549, 200999, 134-581; 19671, ZBTB22, 98539, 200989, 153-2057; 19671, ZBTB22, 98540, 200990, 153-2057; 19671, ZBTB22, 98542, 200992, 153-2057; 19671, ZBTB22, 98544, 200994, 153-2057; 19671, ZBTB22, 98546, 200996, 135-2039; 19671, ZBTB22, 98547, 200997, 153-2057; 19672, ZBTB24, 98550, 201000, 169-2262; 19673, ZBTB25, 98552, 201002, 735-995; 19673, ZBTB25, 98553, 201003, 1-285; 19673, ZBTB25, 98551, 201001, 703-2010; 19673, ZBTB25, 98554, 201004, 193-1500; 19674, ZBTB26, 98555, 201005, 213-1538; 19674, ZBTB26, 98556, 201006, 75-1400; 19675, ZBTB3, 98558, 201008, 86-432; 19675, ZBTB3, 98559, 201009, 1-10; 19675, ZBTB3, 98557, 201007, 127-1851; 19676, ZBTB32, 98562, 201012, 127-1035; 19676, ZBTB32, 98563, 201013, 257-469; 19676, ZBTB32, 98560, 201010, 211-1674; 19676, ZBTB32, 98561, 201011, 319-1782; 19677, ZBTB33, 98564, 201014, 229-2247; 19677, ZBTB33, 98565, 201015, 328-2346; 19678, ZBTB34, 98566, 201016, 86-1600; 19678, ZBTB34, 98567, 201017, 65-1567; 19679, ZBTB37, 98571, 201021, 467-1702; 19679, ZBTB37, 98568, 201018, 192-1703; 19679, ZBTB37, 98569, 201019, 238-1323; 19679, ZBTB37, 98570, 201020, 400-1326; 19679, ZBTB37, 98572, 201022, 277-1788; 19680, ZBTB38, 98575, 201025, 238-593; 19680, ZBTB38, 98576, 201026, 476-578; 19680, ZBTB38, 98577, 201027, 228-859; 19680, ZBTB38, 98578, 201028, 309-590; 19680, ZBTB38, 98579, 201029, 441-649; 19680, ZBTB38, 98580, 201030, 522-855; 19680, ZBTB38, 98581, 201031, 347-2659; 19680, ZBTB38, 98582, 201032, 207-644; 19680, ZBTB38, 98583, 201033, 267-591; 19680, ZBTB38, 98585, 201035, 983-1434; 19680, ZBTB38, 98573, 201023, 1-3588; 19680, ZBTB38, 98574, 201024, 51-3638; 19680, ZBTB38, 98584, 201034, 280-3867; 19681, ZBTB39, 98586, 201036, 87-2225; 19682, ZBTB4, 98587, 201037, 341-3382; 19682, ZBTB4, 98588, 201038, 251-3292; 19683, ZBTB40, 98589, 201039, 224-3607; 19683, ZBTB40, 98591, 201041, 496-1855; 19683, ZBTB40, 98590, 201040, 208-3927; 19683, ZBTB40, 98592, 201042, 512-4231; 19684, ZBTB41, 98593, 201043, 70-2799; 19685, ZBTB42, 98594, 201044, 286-1554; 19685, ZBTB42, 98595, 201045, 123-1391; 19686, ZBTB43, 98599, 201049, 124-710; 19686, ZBTB43, 98596, 201046, 1102-2505; 19686, ZBTB43, 98597, 201047, 265-1668; 19686, ZBTB43, 98598, 201048, 151-1554; 19687, ZBTB44, 98600, 201050, 274-1986; 19687, ZBTB44, 98601, 201051, 295-2007; 19687, ZBTB44, 98603, 201053, 1-986; 19687, ZBTB44, 98606, 201056, 1-539; 19687, ZBTB44, 98607, 201057, 1-1786; 19687, ZBTB44, 98608, 201058, 371-979; 19687, ZBTB44, 98602, 201052, 295-1698; 19687, ZBTB44, 98604, 201054, 369-1730; 19687, ZBTB44, 98605, 201055, 17-1441; 19688, ZBTB45, 98611, 201061, 212-576; 19688, ZBTB45, 98612, 201062, 542-592; 19688, ZBTB45, 98609, 201059, 293-1828; 19688, ZBTB45, 98610, 201060, 482-2017; 19688, ZBTB45, 98613, 201063, 136-1671; 19689, ZBTB46, 98614, 201064, 152-1921; 19689, ZBTB46, 98615, 201065, 182-1951; 19689, ZBTB46, 98616, 201066, 167-1936; 19690, ZBTB47, 98618, 201068, 319-1200; 19690, ZBTB47, 98617, 201067, 282-2525; 19691, ZBTB48, 98619, 201069, 119-1050; 19691, ZBTB48, 98621, 201071, 124-1001; 19691, ZBTB48, 98622, 201072, 95-784; 19691, ZBTB48, 98623, 201073, 1-387; 19691, ZBTB48, 98624, 201074, 531-926; 19691, ZBTB48, 98620, 201070, 159-2225; 19692, ZBTB49, 98626, 201076, 1-523; 19692, ZBTB49, 98627, 201077, 122-1483; 19692, ZBTB49, 98628, 201078, 122-556; 19692, ZBTB49, 98629, 201079, 65-502; 19692, ZBTB49, 98630, 201080, 1-368; 19692, ZBTB49, 98625, 201075, 122-2419; 19693, ZBTB5, 98631, 201081, 190-2223; 19694, ZBTB6, 98632, 201082, 90-1364; 19695, ZBTB7A, 98633, 201083, 280-2034; 19695, ZBTB7A, 98634, 201084, 319-2073; 19696, ZBTB7B, 98635, 201085, 214-1833; 19696, ZBTB7B, 98636, 201086, 138-1757; 19696, ZBTB7B, 98637, 201087, 459-2180; 19696, ZBTB7B, 98638, 201088, 321-1940; 19697, ZBTB7C, 98640, 201090, 526-600; 19697, ZBTB7C, 98641, 201091, 519-574; 19697, ZBTB7C, 98642, 201092, 444-518; 19697, ZBTB7C, 98643, 201093, 586-630; 19697, ZBTB7C, 98644, 201094, 630-704; 19697, ZBTB7C, 98645, 201095, 522-566; 19697, ZBTB7C, 98646, 201096, 323-397; 19697, ZBTB7C, 98647, 201097, 492-566; 19697, ZBTB7C, 98648, 201098, 530-585; 19697, ZBTB7C, 98649, 201099, 266-321; 19697, ZBTB7C, 98650, 201100, 388-462; 19697, ZBTB7C, 98651, 201101, 347-546; 19697, ZBTB7C, 98652, 201102, 847-891; 19697, ZBTB7C, 98653, 201103, 423-467; 19697, ZBTB7C, 98654, 201104, 375-430; 19697, ZBTB7C, 98656, 201106, 651-725; 19697, ZBTB7C, 98657, 201107, 606-680; 19697, ZBTB7C, 98658, 201108, 521-565; 19697, ZBTB7C, 98660, 201110, 498-572; 19697, ZBTB7C, 98661, 201111, 522-596; 19697, ZBTB7C, 98662, 201112, 273-347; 19697, ZBTB7C, 98663, 201113, 496-570; 19697, ZBTB7C, 98664, 201114, 504-548; 19697, ZBTB7C, 98666, 201116, 510-565; 19697, ZBTB7C, 98639, 201089, 372-2231; 19697, ZBTB7C, 98655, 201105, 501-2360; 19697, ZBTB7C, 98659, 201109, 453-2312; 19697, ZBTB7C, 98665, 201115, 503-2362; 19698, ZBTB8OS, 98667, 201117, 1-231; 19698, ZBTB8OS, 98669, 201119, 1-442; 19698, ZBTB8OS, 98670, 201120, 20-559; 19698, ZBTB8OS, 98671, 201121, 1-237; 19698, ZBTB8OS, 98672, 201122, 339-509; 19698, ZBTB8OS, 98673, 201123, 1-171; 19698, ZBTB8OS, 98674, 201124, 1-218; 19698, ZBTB8OS, 98675, 201125, 212-544; 19698, ZBTB8OS, 98676, 201126, 1-508; 19698, ZBTB8OS, 98677, 201127, 1-266; 19698, ZBTB8OS, 98668, 201118, 171-566; 19699, ZBTB8A, 98678, 201128, 228-1250; 19699, ZBTB8A, 98679, 201129, 230-1555; 19700, ZBTB8B, 98680, 201130, 79-1566; 19701, ZBTB9, 98683, 201133, 1-349; 19701, ZBTB9, 98684, 201134, 161-575; 19701, ZBTB9, 98685, 201135, 334-570; 19701, ZBTB9, 98681, 201131, 269-1690; 19701, ZBTB9, 98682, 201132, 269-1690; 19702, ZSCAN1, 98687, 201137, 345-881; 19702, ZSCAN1, 98688, 201138, 208-744; 19702, ZSCAN1, 98686, 201136, 248-1474; 19703, ZSCAN10, 98691, 201141, 264-747; 19703, ZSCAN10, 98692, 201142, 196-2538; 19703, ZSCAN10, 98694, 201144, 558-575; 19703, ZSCAN10, 98695, 201145, 140-475; 19703, ZSCAN10, 98689, 201139, 89-2266; 19703, ZSCAN10, 98690, 201140, 317-2248; 19703, ZSCAN10, 98693, 201143, 890-2050; 19704, ZSCAN12, 98696, 201146, 147-1961; 19704, ZSCAN12, 98697, 201147, 144-1958; 19705, ZSCAN16, 98698, 201148, 150-1196; 19706, ZSCAN18, 98701, 201151, 1-1224; 19706, ZSCAN18, 98703, 201153, 524-558; 19706, ZSCAN18, 98705, 201155, 1-155; 19706, ZSCAN18, 98706, 201156, 32-151; 19706, ZSCAN18, 98707, 201157, 209-761; 19706, ZSCAN18, 98708, 201158, 391-946; 19706, ZSCAN18, 98709, 201159, 2-342; 19706, ZSCAN18, 98699, 201149, 401-1933; 19706, ZSCAN18, 98700, 201150, 117-1241; 19706, ZSCAN18, 98702, 201152, 310-1842; 19706, ZSCAN18, 98704, 201154, 31-1731; 19707, ZSCAN2, 98710, 201160, 195-2036; 19707, ZSCAN2, 98712, 201162, 161-1555; 19707, ZSCAN2, 98715, 201165, 499-581; 19707, ZSCAN2, 98716, 201166, 28-744; 19707, ZSCAN2, 98717, 201167, 481-578; 19707, ZSCAN2, 98718, 201168, 28-630; 19707, ZSCAN2, 98719, 201169, 28-660; 19707, ZSCAN2, 98721, 201171, 300-460; 19707, ZSCAN2, 98723, 201173, 259-579; 19707, ZSCAN2, 98711, 201161, 227-679; 19707, ZSCAN2, 98713, 201163, 195-635; 19707, ZSCAN2, 98714, 201164, 293-2137; 19707, ZSCAN2, 98720, 201170, 28-1872; 19707, ZSCAN2, 98722, 201172, 230-2074; 19708, ZSCAN20, 98724, 201174, 154-3285; 19708, ZSCAN20, 98725, 201175, 152-1453; 19709, ZSCAN21, 98727, 201177, 165-1517; 19709, ZSCAN21, 98728, 201178, 278-820; 19709, ZSCAN21, 98729, 201179, 140-1450; 19709, ZSCAN21, 98726, 201176, 165-1586; 19710, ZSCAN22, 98730, 201180, 148-1623; 19711, ZSCAN23, 98732, 201182, 160-600; 19711, ZSCAN23, 98731, 201181, 147-1316; 19712, ZSCAN25, 98733, 201183, 4-1401; 19712, ZSCAN25, 98737, 201187, 385-594; 19712, ZSCAN25, 98734, 201184, 58-1692; 19712, ZSCAN25, 98735, 201185, 301-789; 19712, ZSCAN25, 98736, 201186, 328-1962; 19713, ZSCAN26, 98738, 201188, 155-967; 19713, ZSCAN26, 98739, 201189, 162-1196; 19713, ZSCAN26, 98740, 201190, 138-588; 19713, ZSCAN26, 98741, 201191, 271-1710; 19713, ZSCAN26, 98742, 201192, 162-1601; 19713, ZSCAN26, 98743, 201193, 223-1257; 19713, ZSCAN26, 98744, 201194, 128-1564; 19714, ZSCAN29, 98745, 201195, 392-1342; 19714, ZSCAN29, 98747, 201197, 1-993; 19714, ZSCAN29, 98748, 201198, 1-1671; 19714, ZSCAN29, 98749, 201199, 1-1389; 19714, ZSCAN29, 98750, 201200, 150-749; 19714, ZSCAN29, 98751, 201201, 581-643; 19714, ZSCAN29, 98746, 201196, 136-2694; 19715, ZSCAN30, 98754, 201204, 218-883; 19715, ZSCAN30, 98755, 201205, 407-549; 19715, ZSCAN30, 98756, 201206, 382-588; 19715, ZSCAN30, 98757, 201207, 195-632; 19715, ZSCAN30, 98758, 201208, 1-276; 19715, ZSCAN30, 98759, 201209, 33-188; 19715, ZSCAN30, 98760, 201210, 124-1047; 19715, ZSCAN30, 98752, 201202, 229-1713; 19715, ZSCAN30, 98753, 201203, 457-1941; 19716, ZSCAN31, 98763, 201213, 149-799; 19716, ZSCAN31, 98765, 201215, 391-1005; 19716, ZSCAN31, 98766, 201216, 529-580; 19716, ZSCAN31, 98767, 201217, 311-574; 19716, ZSCAN31, 98769, 201219, 256-575; 19716, ZSCAN31, 98770, 201220, 259-571; 19716, ZSCAN31, 98771, 201221, 397-706; 19716, ZSCAN31, 98772, 201222, 117-583; 19716, ZSCAN31, 98774, 201224, 485-557; 19716, ZSCAN31, 98775, 201225, 139-581; 19716, ZSCAN31, 98776, 201226, 351-584; 19716, ZSCAN31, 98761, 201211, 180-1400; 19716, ZSCAN31, 98762, 201212, 527-1747; 19716, ZSCAN31, 98764, 201214, 905-2125; 19716, ZSCAN31, 98768, 201218, 402-1145; 19716, ZSCAN31, 98773, 201223, 401-1621; 19716, ZSCAN31, 98777, 201227, 500-1243; 19717, ZSCAN32, 98782, 201232, 295-942; 19717, ZSCAN32, 98783, 201233, 321-879; 19717, ZSCAN32, 98784, 201234, 239-799; 19717, ZSCAN32, 98785, 201235, 189-1472; 19717, ZSCAN32, 98786, 201236, 162-578; 19717, ZSCAN32, 98787, 201237, 208-1482; 19717, ZSCAN32, 98788, 201238, 189-841; 19717, ZSCAN32, 98789, 201239, 220-906; 19717, ZSCAN32, 98778, 201228, 803-2260; 19717, ZSCAN32, 98779, 201229, 309-2402; 19717, ZSCAN32, 98780, 201230, 309-2402; 19717, ZSCAN32, 98781, 201231, 167-1393; 19717, ZSCAN32, 98790, 201240, 791-2017; 19718, ZSCAN4, 98791, 201241, 698-1999; 19718, ZSCAN4, 98792, 201242, 432-1733; 19719, ZSCAN5A, 98794, 201244, 280-849; 19719, ZSCAN5A, 98795, 201245, 402-1454; 19719, ZSCAN5A, 98796, 201246, 809-923; 19719, ZSCAN5A, 98797, 201247, 63-1550; 19719, ZSCAN5A, 98799, 201249, 323-576; 19719, ZSCAN5A, 98800, 201250, 450-576; 19719, ZSCAN5A, 98801, 201251, 274-589; 19719, ZSCAN5A, 98793, 201243, 167-1657; 19719, ZSCAN5A, 98798, 201248, 697-2187; 19720, ZSCAN5B, 98803, 201253, 63-570; 19720, ZSCAN5B, 98805, 201255, 145-555; 19720, ZSCAN5B, 98802, 201252, 1-1488; 19720, ZSCAN5B, 98804, 201254, 315-1802; 19721, ZSCAN5CP, 98806, 201256, 1-1491; 19721, ZSCAN5CP, 98807, 201257, 150-1640; 19722, ZSCAN9, 98810, 201260, 457-579; 19722, ZSCAN9, 98812, 201262, 102-887; 19722, ZSCAN9, 98813, 201263, 74-1182; 19722, ZSCAN9, 98814, 201264, 141-623; 19722, ZSCAN9, 98815, 201265, 165-757; 19722, ZSCAN9, 98808, 201258, 149-1333; 19722, ZSCAN9, 98809, 201259, 166-1503; 19722, ZSCAN9, 98811, 201261, 113-1297; 19723, ZC3H10, 98817, 201267, 884-1019; 19723, ZC3H10, 98818, 201268, 478-743; 19723, ZC3H10, 98819, 201269, 316-552; 19723, ZC3H10, 98816, 201266, 277-1581; 19724, ZC3H11A, 98824, 201274, 533-682; 19724, ZC3H11A, 98825, 201275, 347-1892; 19724, ZC3H11A, 98826, 201276, 4317-6275; 19724, ZC3H11A, 98820, 201270, 858-3290; 19724, ZC3H11A, 98821, 201271, 214-2646; 19724, ZC3H11A, 98822, 201272, 541-2973; 19724, ZC3H11A, 98823, 201273, 998-3430; 19724, ZC3H11A, 98827, 201277, 3828-6260; 19725, ZC3H12A, 98829, 201279, 1-395; 19725, ZC3H12A, 98828, 201278, 117-1916; 19726, ZC3H12B, 98830, 201280, 68-2578; 19727, ZC3H12C, 98832, 201282, 882-3440; 19727, ZC3H12C, 98831, 201281, 52-2703; 19727, ZC3H12C, 98833, 201283, 80-2734; 19728, ZC3H12D, 98835, 201285, 154-657; 19728, ZC3H12D, 98836, 201286, 1-319; 19728, ZC3H12D, 98834, 201284, 320-1903; 19729, ZC3H13, 98839, 201289, 350-695; 19729, ZC3H13, 98840, 201290, 1-350; 19729, ZC3H13, 98837, 201287, 350-5356; 19729, ZC3H13, 98838, 201288, 72-4766; 19730, ZC3H14, 98847, 201297, 298-580; 19730, ZC3H14, 98848, 201298, 125-1942; 19730, ZC3H14, 98849, 201299, 1-456; 19730, ZC3H14, 98850, 201300, 127-321; 19730, ZC3H14, 98851, 201301, 1-246; 19730, ZC3H14, 98852, 201302, 1-1955; 19730, ZC3H14, 98853, 201303, 221-849; 19730, ZC3H14, 98854, 201304, 168-813; 19730, ZC3H14, 98855, 201305, 313-1629; 19730, ZC3H14, 98856, 201306, 436-652;

19730, ZC3H14, 98857, 201307, 291-908; 19730, ZC3H14, 98858, 201308, 196-593; 19730, ZC3H14, 98859, 201309, 471-1733; 19730, ZC3H14, 98861, 201311, 1-447; 19730, ZC3H14, 98841, 201291, 226-2436; 19730, ZC3H14, 98842, 201292, 165-1904; 19730, ZC3H14, 98843, 201293, 329-1249; 19730, ZC3H14, 98844, 201294, 176-1891; 19730, ZC3H14, 98845, 201295, 1-2136; 19730, ZC3H14, 98846, 201296, 293-1141; 19730, ZC3H14, 98860, 201310, 97-2289; 19731, ZC3H15, 98863, 201313, 121-345; 19731, ZC3H15, 98864, 201314, 131-448; 19731, ZC3H15, 98865, 201315, 1-216; 19731, ZC3H15, 98862, 201312, 228-1508; 19732, ZC3H18, 98867, 201317, 179-3112; 19732, ZC3H18, 98868, 201318, 1-712; 19732, ZC3H18, 98869, 201319, 104-694; 19732, ZC3H18, 98870, 201320, 1-591; 19732, ZC3H18, 98871, 201321, 1-228; 19732, ZC3H18, 98866, 201316, 201-3062; 19733, ZC3H3, 98873, 201323, 1-240; 19733, ZC3H3, 98874, 201324, 33-1593; 19733, ZC3H3, 98872, 201322, 33-2879; 19734, ZC3H4, 98876, 201326, 1-2731; 19734, ZC3H4, 98875, 201325, 39-3950; 19735, ZC3H6, 98877, 201327, 395-3964; 19735, ZC3H6, 98878, 201328, 402-3971; 19736, ZC3H7A, 98881, 201331, 344-575; 19736, ZC3H7A, 98882, 201332, 1-279; 19736, ZC3H7A, 98884, 201334, 144-2343; 19736, ZC3H7A, 98885, 201335, 1-676; 19736, ZC3H7A, 98886, 201336, 1-986; 19736, ZC3H7A, 98887, 201337, 206-663; 19736, ZC3H7A, 98888, 201338, 355-564; 19736, ZC3H7A, 98889, 201339, 351-532; 19736, ZC3H7A, 98879, 201329, 179-3094; 19736, ZC3H7A, 98880, 201330, 199-3114; 19736, ZC3H7A, 98883, 201333, 1405-1908; 19737, ZC3H7B, 98890, 201340, 258-3191; 19738, ZC3H8, 98893, 201343, 45-938; 19738, ZC3H8, 98891, 201341, 107-982; 19738, ZC3H8, 98892, 201342, 131-1006; 19739, ZC3HAV1, 98895, 201345, 24-3098; 19739, ZC3HAV1, 98897, 201347, 1-793; 19739, ZC3HAV1, 98894, 201344, 318-3026; 19739, ZC3HAV1, 98896, 201346, 389-2488; 19740, ZC3HAV1L, 98898, 201348, 13-915; 19741, ZCRB1, 98900, 201350, 241-771; 19741, ZCRB1, 98901, 201351, 235-633; 19741, ZCRB1, 98899, 201349, 185-838; 19742, ZEB1, 98905, 201355, 20-181; 19742, ZEB1, 98906, 201356, 20-887; 19742, ZEB1, 98909, 201359, 679-1500; 19742, ZEB1, 98910, 201360, 375-1205; 19742, ZEB1, 98911, 201361, 23-886; 19742, ZEB1, 98902, 201352, 111-3485; 19742, ZEB1, 98903, 201353, 64-3441; 19742, ZEB1, 98904, 201354, 392-3718; 19742, ZEB1, 98907, 201357, 14-3187; 19742, ZEB1, 98908, 201358, 24-3338; 19743, ZEB2, 98912, 201362, 138-3779; 19743, ZEB2, 98913, 201363, 114-1514; 19743, ZEB2, 98915, 201365, 228-587; 19743, ZEB2, 98916, 201366, 234-896; 19743, ZEB2, 98917, 201367, 43-2236; 19743, ZEB2, 98918, 201368, 389-577; 19743, ZEB2, 98919, 201369, 281-554; 19743, ZEB2, 98922, 201372, 157-709; 19743, ZEB2, 98923, 201373, 80-343; 19743, ZEB2, 98924, 201374, 209-385; 19743, ZEB2, 98925, 201375, 464-640; 19743, ZEB2, 98926, 201376, 538-1809; 19743, ZEB2, 98927, 201377, 83-259; 19743, ZEB2, 98928, 201378, 91-216; 19743, ZEB2, 98929, 201379, 351-468; 19743, ZEB2, 98931, 201381, 184-309; 19743, ZEB2, 98932, 201382, 647-1071; 19743, ZEB2, 98914, 201364, 284-3928; 19743, ZEB2, 98920, 201370, 251-3823; 19743, ZEB2, 98921, 201371, 202-3846; 19743, ZEB2, 98930, 201380, 527-4171; 19744, ZNF783, 98936, 201386, 348-1094; 19744, ZNF783, 98933, 201383, 164-1009; 19744, ZNF783, 98934, 201384, 164-1804; 19744, ZNF783, 98935, 201385, 120-965; 19745, ZNF788, 98937, 201387, 1-777; 19745, ZNF788, 98938, 201388, 206-394; 19745, ZNF788, 98939, 201389, 88-336; 19746, ZFHX2, 98940, 201390, 520-1603; 19746, ZFHX2, 98942, 201392, 210-949; 19746, ZFHX2, 98943, 201393, 266-1492; 19746, ZFHX2, 98941, 201391, 357-8075; 19747, ZFHX3, 98944, 201394, 674-11785; 19747, ZFHX3, 98945, 201395, 1193-9562; 19748, ZFHX4, 98946, 201396, 142-561; 19748, ZFHX4, 98947, 201397, 148-613; 19748, ZFHX4, 98948, 201398, 153-618; 19748, ZFHX4, 98949, 201399, 222-524; 19748, ZFHX4, 98950, 201400, 1-259; 19748, ZFHX4, 98952, 201402, 45-10817; 19748, ZFHX4, 98953, 201403, 1-247; 19748, ZFHX4, 98951, 201401, 449-11299; 19749, ZNF10, 98955, 201405, 625-1944; 19749, ZNF10, 98957, 201407, 508-648; 19749, ZNF10, 98958, 201408, 255-472; 19749, ZNF10, 98959, 201409, 418-546; 19749, ZNF10, 98954, 201404, 223-1944; 19749, ZNF10, 98956, 201406, 448-2169; 19750, ZNF100, 98961, 201411, 357-1793; 19750, ZNF100, 98962, 201412, 121-588; 19750, ZNF100, 98963, 201413, 360-548; 19750, ZNF100, 98964, 201414, 70-1770; 19750, ZNF100, 98966, 201416, 357-1793; 19750, ZNF100, 98967, 201417, 121-588; 19750, ZNF100, 98968, 201418, 360-548; 19750, ZNF100, 98960, 201410, 200-1828; 19750, ZNF100, 98965, 201415, 98-1726; 19751, ZNF101, 98971, 201421, 114-299; 19751, ZNF101, 98972, 201422, 1-442; 19751, ZNF101, 98973, 201423, 402-575; 19751, ZNF101, 98969, 201419, 169-1479; 19751, ZNF101, 98970, 201420, 573-1523; 19751, ZNF101, 98974, 201424, 111-1421; 19752, ZNF106, 98976, 201426, 115-719; 19752, ZNF106, 98977, 201427, 744-3191; 19752, ZNF106, 98979, 201429, 1-654; 19752, ZNF106, 98980, 201430, 1-2552; 19752, ZNF106, 98981, 201431, 177-1470; 19752, ZNF106, 98982, 201432, 311-3517; 19752, ZNF106, 98983, 201433, 1-576; 19752, ZNF106, 98975, 201425, 328-5979; 19752, ZNF106, 98978, 201428, 159-3494; 19753, ZNF107, 98985, 201435, 787-1061; 19753, ZNF107, 98988, 201438, 201-2663; 19753, ZNF107, 98989, 201439, 201-2759; 19753, ZNF107, 98984, 201434, 453-2804; 19753, ZNF107, 98986, 201436, 1376-3727; 19753, ZNF107, 98987, 201437, 496-2847; 19754, ZNF112, 98992, 201442, 84-248; 19754, ZNF112, 98993, 201443, 117-569; 19754, ZNF112, 98994, 201444, 129-577; 19754, ZNF112, 98995, 201445, 121-558; 19754, ZNF112, 98990, 201440, 90-2831; 19754, ZNF112, 98991, 201441, 53-2776; 19755, ZNF114, 98997, 201447, 228-569; 19755, ZNF114, 98999, 201449, 276-457; 19755, ZNF114, 99000, 201450, 240-634; 19755, ZNF114, 98996, 201446, 225-1478; 19755, ZNF114, 98998, 201448, 495-1748; 19755, ZNF114, 99001, 201451, 297-1550; 19755, ZNF114, 99002, 201452, 256-1407; 19756, ZNF117, 99005, 201455, 101-1252; 19756, ZNF117, 99003, 201453, 1286-2737; 19756, ZNF117, 99004, 201454, 199-1650; 19757, ZNF12, 99007, 201457, 463-662; 19757, ZNF12, 99006, 201456, 543-2522; 19757, ZNF12, 99008, 201458, 188-2059; 19757, ZNF12, 99009, 201459, 543-2636; 19758, ZNF121, 99011, 201461, 94-546; 19758, ZNF121, 99010, 201460, 233-1405; 19758, ZNF121, 99012, 201462, 418-1590; 19759, ZNF124, 99016, 201466, 126-359; 19759, ZNF124, 99013, 201463, 140-1009; 19759, ZNF124, 99014, 201464, 91-1146; 19759, ZNF124, 99015, 201465, 129-350; 19760, ZNF131, 99019, 201469, 257-1050; 19760, ZNF131, 99020, 201470, 47-501; 19760, ZNF131, 99021, 201471, 1-205; 19760, ZNF131, 99023, 201473, 156-572; 19760, ZNF131, 99024, 201474, 44-295; 19760, ZNF131, 99025, 201475, 222-983; 19760, ZNF131, 99026, 201476, 16-216; 19760, ZNF131, 99028, 201478, 16-390; 19760, ZNF131, 99029, 201479, 346-583; 19760, ZNF131, 99017, 201467, 45-1814; 19760, ZNF131, 99018, 201468, 457-2226; 19760, ZNF131, 99022, 201472, 249-2018; 19760, ZNF131, 99027, 201477, 37-1908; 19761, ZNF132, 99030, 201480, 402-2522; 19762, ZNF133, 99032, 201482, 185-481; 19762, ZNF133, 99037, 201487, 96-523; 19762, ZNF133, 99038, 201488, 101-637; 19762, ZNF133, 99039, 201489, 160-2163; 19762, ZNF133, 99040, 201490, 160-2067; 19762, ZNF133, 99043, 201493, 65-208; 19762, ZNF133, 99031, 201481, 98-2062; 19762, ZNF133, 99033, 201483, 560-2521; 19762, ZNF133, 99034, 201484, 500-2464; 19762, ZNF133, 99035, 201485, 669-2444; 19762, ZNF133, 99036, 201486, 578-2539; 19762, ZNF133, 99041, 201491, 518-2482; 19762, ZNF133, 99042, 201492, 142-1821; 19762, ZNF133, 99044, 201494, 170-2143; 19763, ZNF134, 99046, 201496, 392-590; 19763, ZNF134, 99047, 201497, 324-464; 19763, ZNF134, 99045, 201495, 311-1594; 19763, ZNF134, 99048, 201498, 523-1569; 19764, ZNF135, 99052, 201502, 555-2405; 19764, ZNF135, 99054, 201504, 270-491; 19764, ZNF135, 99049, 201499, 102-2078; 19764, ZNF135, 99050, 201500, 4-1176; 19764, ZNF135, 99051, 201501, 72-2084; 19764, ZNF135, 99053, 201503, 4-2052; 19765, ZNF136, 99056, 201506, 212-478; 19765, ZNF136, 99057, 201507, 488-565; 19765, ZNF136, 99058, 201508, 347-474; 19765, ZNF136, 99055, 201505, 141-1763; 19766, ZNF138, 99059, 201509, 182-1141; 19766, ZNF138, 99060, 201510, 182-484; 19766, ZNF138, 99061, 201511, 249-1112; 19766, ZNF138, 99063, 201513, 142-330; 19766, ZNF138, 99064, 201514, 145-525; 19766, ZNF138, 99062, 201512, 145-1026; 19767, ZNF14, 99065, 201515, 140-2068; 19768, ZNF140, 99067, 201517, 157-390; 19768, ZNF140, 99068, 201518, 292-553; 19768, ZNF140, 99069, 201519, 190-495; 19768, ZNF140, 99070, 201520, 1462-1945; 19768, ZNF140, 99071, 201521, 190-534; 19768, ZNF140, 99072, 201522, 111-350; 19768, ZNF140, 99073, 201523, 378-726; 19768, ZNF140, 99066, 201516, 1284-2657; 19768, ZNF140, 99074, 201524, 401-1465; 19769, ZNF141, 99076, 201526, 151-492; 19769, ZNF141, 99077, 201527, 165-770; 19769, ZNF141, 99075, 201525, 150-1574; 19770, ZNF142, 99078, 201528, 771-813; 19770, ZNF142, 99079, 201529, 649-945; 19770, ZNF142, 99081, 201531, 294-373; 19770, ZNF142, 99082, 201532, 421-717; 19770, ZNF142, 99084, 201534, 1-880; 19770, ZNF142, 99080, 201530, 445-5508; 19770, ZNF142, 99083, 201533, 423-5486; 19771, ZNF143, 99085, 201535, 62-1894; 19771, ZNF143, 99089, 201539, 128-554; 19771, ZNF143, 99090, 201540, 47-265; 19771, ZNF143, 99091, 201541, 301-551; 19771, ZNF143, 99092, 201542, 1-502; 19771, ZNF143, 99093, 201543, 75-644; 19771, ZNF143, 99094, 201544, 73-333; 19771, ZNF143, 99096, 201546, 96-548; 19771, ZNF143, 99097, 201547, 51-575; 19771, ZNF143, 99098, 201548, 148-555; 19771, ZNF143, 99099, 201549, 103-627; 19771, ZNF143, 99100, 201550, 68-565; 19771, ZNF143, 99086, 201536, 98-1921; 19771, ZNF143, 99087, 201537, 120-2036; 19771, ZNF143, 99088, 201538, 342-2255; 19771, ZNF143, 99095, 201545, 109-2022; 19772, ZNF146, 99101, 201551, 993-1871; 19772, ZNF146, 99102, 201552, 1450-2328; 19773, ZNF148, 99104, 201554, 317-566; 19773, ZNF148, 99106, 201556, 538-763; 19773, ZNF148, 99107, 201557, 490-566; 19773, ZNF148, 99108, 201558, 309-743; 19773, ZNF148, 99111, 201561, 384-1748; 19773, ZNF148, 99103, 201553, 487-2871; 19773, ZNF148, 99105, 201555, 303-2687; 19773, ZNF148, 99109, 201559, 303-2687; 19773, ZNF148, 99110, 201560, 563-2947; 19774, ZNF154, 99112, 201562, 198-1511; 19774, ZNF154, 99113, 201563, 224-1537; 19775, ZNF155, 99116, 201566, 309-580; 19775, ZNF155, 99118, 201568, 214-559; 19775, ZNF155, 99119, 201569, 127-576; 19775, ZNF155, 99114, 201564, 129-1745; 19775, ZNF155, 99115, 201565, 194-1843; 19775, ZNF155, 99117, 201567, 192-1808; 19775, ZNF155, 99120, 201570, 265-1881; 19776, ZNF157, 99121, 201571, 87-1607; 19777, ZNF16, 99124, 201574, 204-575; 19777, ZNF16, 99125, 201575, 33-696; 19777, ZNF16, 99122, 201572, 188-2236; 19777, ZNF16, 99123, 201573, 102-2150; 19777, ZNF16, 99126, 201576, 102-2150; 19778, ZNF160, 99130, 201580, 259-1926; 19778, ZNF160, 99131, 201581, 316-668; 19778, ZNF160, 99132, 201582, 878-3226; 19778, ZNF160, 99134, 201584, 526-565; 19778, ZNF160, 99127, 201577, 410-853; 19778, ZNF160, 99128, 201578, 417-2873; 19778, ZNF160, 99129, 201579, 300-2756; 19778, ZNF160, 99133, 201583, 302-2758; 19779, ZNF165, 99135, 201585, 557-2014; 19780, ZNF169, 99136, 201586, 74-451; 19780, ZNF169, 99138, 201588, 56-436; 19780, ZNF169, 99139, 201589, 56-391; 19780, ZNF169, 99137, 201587, 91-1902; 19781, ZNF17, 99141, 201591, 219-374; 19781, ZNF17, 99143, 201593, 244-391; 19781, ZNF17, 99140, 201590, 264-2258; 19781, ZNF17, 99142, 201592, 214-2202; 19782, ZNF174, 99146, 201596, 32-781; 19782, ZNF174, 99144, 201594, 586-1809; 19782, ZNF174, 99145, 201595, 762-1466; 19782, ZNF174, 99147, 201597, 309-1532; 19782, ZNF174, 99148, 201598, 309-1013; 19783, ZNF175, 99150, 201600, 3-341; 19783, ZNF175, 99151, 201601, 359-514; 19783, ZNF175, 99152, 201602, 353-565; 19783, ZNF175, 99149, 201599, 359-2494; 19784, ZNF177, 99154, 201604, 44-424; 19784, ZNF177, 99155, 201605, 510-560; 19784, ZNF177, 99153, 201603, 457-1422; 19784, ZNF177, 99156, 201606, 67-1512; 19785, ZNF18, 99160, 201610, 1-698; 19785, ZNF18, 99161, 201611, 281-570; 19785, ZNF18, 99162, 201612, 1-729; 19785, ZNF18, 99157, 201607, 606-2255; 19785, ZNF18, 99158, 201608, 110-1756; 19785, ZNF18, 99159, 201609, 89-1738; 19785, ZNF18, 99163, 201613, 163-1812; 19786, ZNF180, 99165, 201615, 281-2284; 19786, ZNF180, 99166, 201616, 271-468; 19786, ZNF180, 99167, 201617, 265-417; 19786, ZNF180, 99168, 201618, 305-721; 19786, ZNF180, 99169, 201619, 287-837; 19786, ZNF180, 99170, 201620, 293-2290; 19786, ZNF180, 99171, 201621, 285-482; 19786, ZNF180, 99164, 201614, 283-2361; 19787, ZNF181, 99172, 201622, 169-2016; 19787, ZNF181, 99175, 201625, 167-498; 19787, ZNF181, 99176, 201626, 275-499; 19787, ZNF181, 99177, 201627, 134-567; 19787, ZNF181, 99173, 201623, 464-2176; 19787, ZNF181, 99174, 201624, 90-1805; 19788, ZNF182, 99178, 201628, 1-1920; 19788, ZNF182, 99179, 201629, 287-2149; 19788, ZNF182, 99180, 201630, 352-2271; 19789, ZNF184, 99181, 201631, 286-2541; 19789, ZNF184, 99182, 201632, 161-2416; 19790, ZNF185, 99188, 201638, 1-1659; 19790, ZNF185, 99191, 201641, 1-554; 19790, ZNF185, 99192, 201642, 1-1345; 19790, ZNF185, 99183, 201633, 49-1941; 19790, ZNF185, 99184, 201634, 265-1671; 19790, ZNF185, 99185, 201635, 41-1399; 19790, ZNF185, 99186, 201636, 38-2107; 19790, ZNF185, 99187, 201637, 1-2166; 19790, ZNF185, 99189, 201639, 9-992; 19790, ZNF185, 99190, 201640, 49-2121; 19790, ZNF185, 99193, 201643, 49-2214; 19790, ZNF185, 99194, 201644, 49-2127; 19791, ZNF189, 99198, 201648, 69-326; 19791, ZNF189, 99195, 201645, 350-2104; 19791, ZNF189, 99196, 201646, 130-2010; 19791, ZNF189, 99197, 201647, 285-2123; 19792, ZNF19, 99200, 201650, 111-302; 19792, ZNF19, 99201, 201651, 519-587; 19792, ZNF19, 99202, 201652, 571-1821; 19792, ZNF19, 99203, 201653, 314-532; 19792, ZNF19, 99204, 201654, 221-573; 19792, ZNF19, 99205, 201655, 55-192; 19792, ZNF19, 99206, 201656, 601-615; 19792, ZNF19, 99208, 201658, 1-243; 19792, ZNF19, 99209, 201659, 23-325; 19792, ZNF19, 99210, 201660, 135-1301; 19792, ZNF19, 99199, 201649, 257-1633; 19792, ZNF19, 99207, 201657, 469-1845; 19793, ZNF195, 99216, 201666, 202-560; 19793, ZNF195, 99218, 201668, 168-1001; 19793, ZNF195, 99219, 201669, 63-305; 19793, ZNF195, 99220, 201670, 94-333; 19793, ZNF195, 99221, 201671, 113-764; 19793, ZNF195, 99222, 201672, 107-546; 19793, ZNF195, 99223, 201673, 1-159; 19793, ZNF195, 99224, 201674, 187-579; 19793, ZNF195, 99225, 201675, 91-333; 19793, ZNF195, 99226, 201676, 247-519; 19793, ZNF195, 99227, 201677, 70-309; 19793, ZNF195, 99230, 201680, 338-682; 19793, ZNF195, 99231, 201681, 251-2152; 19793, ZNF195, 99211, 201661, 77-1897; 19793, ZNF195, 99212, 201662, 270-1955; 19793, ZNF195, 99213, 201663, 106-1779; 19793, ZNF195, 99214, 201664, 128-2017; 19793, ZNF195, 99215, 201665, 531-2216; 19793, ZNF195, 99217, 201667, 155-427; 19793, ZNF195, 99228, 201678, 175-2007; 19793, ZNF195, 99229, 201679, 167-439; 19793, ZNF195, 99232, 201682, 168-440; 19794, ZNF197, 99233, 201683, 131-652; 19794, ZNF197, 99238, 201688, 311-546; 19794, ZNF197, 99240, 201690, 131-652; 19794, ZNF197, 99243, 201693, 311-546; 19794, ZNF197, 99234, 201684, 186-3275; 19794, ZNF197, 99235, 201685, 207-1010; 19794, ZNF197, 99236, 201686, 186-989; 19794, ZNF197, 99237, 201687, 168-3257; 19794, ZNF197, 99239, 201689, 186-3275; 19794, ZNF197, 99241, 201691, 168-3257; 19794, ZNF197, 99242, 201692, 186-989; 19794, ZNF197, 99244, 201694, 207-1010; 19795, ZNF2, 99245, 201695, 489-1526; 19795, ZNF2, 99246, 201696, 523-1674; 19795, ZNF2, 99248, 201698, 84-1400; 19795, ZNF2, 99249, 201699, 112-1275; 19795, ZNF2, 99247, 201697, 463-1740; 19796, ZNF20, 99251, 201701, 134-642; 19796, ZNF20, 99252, 201702, 145-267; 19796, ZNF20, 99253, 201703, 160-555; 19796, ZNF20, 99250, 201700, 226-1824; 19797, ZNF200, 99260, 201710, 585-713; 19797, ZNF200, 99254, 201704, 331-1515; 19797, ZNF200, 99255, 201705, 633-1817; 19797, ZNF200, 99256, 201706, 428-1612; 19797, ZNF200, 99257, 201707, 614-1801; 19797, ZNF200, 99258, 201708, 552-1739; 19797, ZNF200, 99259, 201709, 166-1350; 19798, ZNF202, 99262, 201712, 477-855; 19798, ZNF202, 99263, 201713, 416-552; 19798, ZNF202, 99266, 201716, 534-564; 19798, ZNF202, 99261, 201711, 364-2310; 19798, ZNF202, 99264, 201714, 401-2347; 19798, ZNF202, 99265, 201715, 221-2167; 19799, ZNF205, 99269, 201719, 373-726; 19799, ZNF205, 99270, 201720, 171-1006; 19799, ZNF205, 99271, 201721, 1-766; 19799, ZNF205, 99267, 201717, 125-1789; 19799, ZNF205, 99268, 201718, 206-1870; 19799, ZNF205, 99272, 201722, 455-2119; 19800, ZNF207, 99274, 201724, 311-1804; 19800, ZNF207, 99277, 201727, 253-847; 19800, ZNF207, 99278, 201728, 294-572; 19800, ZNF207, 99279, 201729, 306-592; 19800, ZNF207, 99280, 201730, 1-1025; 19800, ZNF207, 99281, 201731, 358-580; 19800, ZNF207, 99282, 201732, 107-1588; 19800, ZNF207, 99283, 201733, 443-580; 19800, ZNF207, 99273, 201723, 155-1591; 19800, ZNF207, 99275, 201725, 170-1654; 19800, ZNF207, 99276, 201726, 149-1540; 19801, ZNF208, 99285, 201735, 156-539; 19801, ZNF208, 99286, 201736, 150-488; 19801, ZNF208, 99287, 201737, 422-536; 19801, ZNF208, 99288, 201738, 316-471; 19801, ZNF208, 99289, 201739, 1-230; 19801, ZNF208, 99290, 201740, 150-3653; 19801, ZNF208, 99284, 201734, 150-3992; 19802, ZNF211, 99296, 201746, 1-1705; 19802, ZNF211, 99297, 201747, 167-283; 19802, ZNF211, 99298, 201748, 181-2031; 19802, ZNF211, 99299, 201749, 132-269; 19802, ZNF211, 99291, 201741, 120-1853; 19802, ZNF211, 99292, 201742, 194-1861; 19802, ZNF211, 99293, 201743, 132-2021; 19802, ZNF211, 99294, 201744, 180-1874; 19802, ZNF211, 99295, 201745, 142-1653; 19803, ZNF212, 99301, 201751, 86-238; 19803, ZNF212, 99302, 201752, 118-270; 19803, ZNF212, 99303, 201753, 1-208; 19803, ZNF212, 99304, 201754, 1-581; 19803, ZNF212, 99300, 201750, 129-1616; 19804, ZNF213, 99308, 201758, 1-549; 19804, ZNF213, 99309, 201759, 1-813; 19804, ZNF213, 99310, 201760, 396-549; 19804, ZNF213, 99312, 201762, 345-782; 19804, ZNF213, 99305, 201755, 476-1855; 19804, ZNF213, 99306, 201756, 366-1745; 19804, ZNF213, 99307, 201757, 429-1808; 19804, ZNF213, 99311, 201761, 373-1752; 19805, ZNF214, 99313, 201763, 317-2137; 19805, ZNF214, 99314, 201764, 243-2063; 19806, ZNF215, 99315, 201765, 589-2142; 19806, ZNF215, 99316, 201766, 387-1940; 19806, ZNF215, 99317, 201767, 88-1002; 19806, ZNF215, 99318, 201768, 589-1503; 19807, ZNF217, 99321, 201771, 1-450; 19807, ZNF217, 99322, 201772, 495-779; 19807, ZNF217, 99319, 201769, 272-3418; 19807, ZNF217, 99320, 201770, 427-3573; 19808, ZNF219, 99326, 201776, 214-546; 19808, ZNF219, 99327, 201777, 165-798; 19808, ZNF219, 99328, 201778, 238-560; 19808, ZNF219, 99329, 201779, 72-545; 19808, ZNF219, 99330, 201780, 561-654; 19808, ZNF219, 99331, 201781, 132-567; 19808, ZNF219, 99332, 201782, 406-576; 19808, ZNF219, 99323, 201773, 413-2581; 19808, ZNF219, 99324, 201774, 296-2464; 19808, ZNF219, 99325, 201775, 288-2456; 19809, ZNF22, 99333, 201783, 594-1268; 19810, ZNF221, 99334, 201784, 329-2182; 19810, ZNF221, 99335, 201785, 191-581; 19810, ZNF221, 99336, 201786, 181-2034; 19810, ZNF221, 99337, 201787, 232-2085; 19810, ZNF221, 99338, 201788, 5-1858; 19811, ZNF222, 99341, 201791, 96-368; 19811, ZNF222, 99339, 201789, 163-1518; 19811, ZNF222, 99340, 201790, 38-1513; 19812, ZNF223, 99343, 201793, 224-493; 19812, ZNF223, 99344, 201794, 185-850; 19812, ZNF223, 99345, 201795, 203-481; 19812, ZNF223, 99342, 201792, 256-1704; 19813, ZNF224, 99347, 201797, 350-547; 19813, ZNF224, 99348, 201798, 455-614; 19813, ZNF224, 99349, 201799, 166-538; 19813, ZNF224, 99346, 201796, 255-2378; 19814, ZNF225, 99351, 201801, 186-552; 19814, ZNF225, 99352, 201802, 222-497; 19814, ZNF225, 99353, 201803, 389-541; 19814, ZNF225, 99350, 201800, 281-2401; 19814, ZNF225, 99354, 201804, 284-2404; 19815, ZNF226, 99359, 201809, 125-394; 19815, ZNF226, 99360, 201810, 238-579; 19815, ZNF226, 99362, 201812, 309-578; 19815, ZNF226, 99363, 201813, 308-524; 19815, ZNF226, 99364, 201814, 318-515; 19815, ZNF226, 99365, 201815, 309-576; 19815, ZNF226, 99366, 201816, 151-567; 19815, ZNF226, 99368, 201818, 349-530; 19815, ZNF226, 99369, 201819, 183-452; 19815, ZNF226, 99370, 201820, 158-616; 19815, ZNF226, 99371, 201821, 479-560; 19815, ZNF226, 99372, 201822, 168-548; 19815, ZNF226, 99355, 201805, 137-421; 19815, ZNF226, 99356, 201806, 145-2556; 19815, ZNF226, 99357, 201807, 181-2592; 19815, ZNF226, 99358, 201808, 307-591; 19815, ZNF226, 99361, 201811, 368-2779; 19815, ZNF226, 99367, 201817, 163-447; 19816, ZNF227, 99375, 201825, 299-545; 19816, ZNF227, 99376, 201826, 297-584; 19816, ZNF227, 99377, 201827, 270-383; 19816, ZNF227, 99378, 201828, 194-838; 19816, ZNF227, 99379, 201829, 206-454; 19816, ZNF227, 99373, 201823, 206-2605; 19816, ZNF227, 99374, 201824, 310-2556; 19816, ZNF227, 99380, 201830, 260-2506; 19816, ZNF227, 99381, 201831, 219-2618; 19817, ZNF229, 99382, 201832, 489-525; 19817, ZNF229, 99383, 201833, 324-2783; 19817, ZNF229, 99385, 201835, 404-655; 19817, ZNF229, 99384, 201834, 435-2912; 19818, ZNF23, 99387, 201837, 161-412; 19818, ZNF23, 99390, 201840, 245-555; 19818, ZNF23, 99391, 201841, 478-558; 19818, ZNF23, 99392, 201842, 246-497; 19818, ZNF23, 99386, 201836, 759-2690; 19818, ZNF23, 99388, 201838, 815-2746; 19818, ZNF23, 99389, 201839, 1-1932; 19818, ZNF23, 99393, 201843, 767-2524; 19819, ZNF230, 99395, 201845, 201-365; 19819, ZNF230, 99396, 201846, 199-462; 19819, ZNF230, 99397, 201847, 380-600; 19819, ZNF230, 99394, 201844, 229-1653; 19820, ZNF232, 99399, 201849, 670-822; 19820, ZNF232, 99400, 201850, 20-172; 19820, ZNF232, 99401, 201851, 24-176; 19820, ZNF232, 99402, 201852, 20-1327; 19820, ZNF232, 99398, 201848, 656-1990; 19821, ZNF233, 99404, 201854, 181-528; 19821, ZNF233, 99405, 201855, 49-300; 19821, ZNF233, 99406, 201856, 87-574; 19821, ZNF233, 99407, 201857, 107-529; 19821, ZNF233, 99403, 201853, 128-2140; 19822, ZNF234, 99410, 201860, 223-384; 19822, ZNF234, 99408, 201858, 259-2361; 19822, ZNF234, 99409, 201859, 190-2292; 19823, ZNF235, 99412, 201862, 29-274; 19823, ZNF235, 99413, 201863, 62-946; 19823, ZNF235, 99414, 201864, 125-388; 19823, ZNF235, 99415, 201865, 98-349; 19823, ZNF235, 99416, 201866, 1-1764; 19823, ZNF235, 99411, 201861, 104-2320; 19824, ZNF236, 99418, 201868, 2-5545; 19824, ZNF236, 99420, 201870, 279-1659; 19824, ZNF236, 99417, 201867, 199-5736; 19824, ZNF236, 99419, 201869, 199-4875; 19825, ZNF239, 99421, 201871, 654-2030; 19825, ZNF239, 99422, 201872, 302-1678; 19825, ZNF239, 99423, 201873, 295-1671; 19825, ZNF239, 99424, 201874, 172-1548; 19826, ZNF24, 99427, 201877, 341-756; 19826, ZNF24, 99428, 201878, 273-578; 19826, ZNF24, 99430, 201880, 282-569; 19826, ZNF24, 99425, 201875, 181-1287; 19826, ZNF24, 99426, 201876, 171-1277; 19826, ZNF24, 99429, 201879, 5-586; 19827, ZNF248, 99434, 201884, 399-698; 19827, ZNF248, 99435, 201885, 228-436; 19827, ZNF248, 99436, 201886, 395-730; 19827, ZNF248, 99437, 201887, 578-946; 19827, ZNF248, 99431, 201881, 206-1945; 19827, ZNF248, 99432, 201882, 500-859; 19827, ZNF248, 99433, 201883, 552-2291; 19827, ZNF248, 99438, 201888, 1327-1686; 19828, ZNF25, 99439, 201889, 214-1584; 19829, ZNF250, 99442, 201892, 136-441; 19829, ZNF250, 99443, 201893, 170-592; 19829, ZNF250, 99444, 201894, 122-490; 19829, ZNF250, 99445, 201895, 80-593; 19829, ZNF250, 99446, 201896, 145-672; 19829, ZNF250, 99447, 201897, 475-610; 19829, ZNF250, 99448, 201898, 122-505; 19829, ZNF250, 99440, 201890, 118-1800; 19829, ZNF250, 99441, 201891, 88-1755; 19830, ZNF251, 99450, 201900, 1-442; 19830, ZNF251, 99452, 201902, 1-442; 19830, ZNF251, 99449, 201899, 277-2292; 19830, ZNF251, 99451, 201901, 277-2292; 19831, ZNF253, 99454, 201904, 177-820; 19831, ZNF253, 99453, 201903, 96-1367; 19831, ZNF253, 99455, 201905, 93-1592; 19832, ZNF254, 99456, 201906, 125-400; 19832, ZNF254, 99458, 201908, 316-2040; 19832, ZNF254, 99459, 201909, 133-294; 19832, ZNF254, 99460, 201910, 56-283; 19832, ZNF254, 99461, 201911, 407-2263; 19832, ZNF254, 99462, 201912, 241-2001; 19832, ZNF254, 99463, 201913, 181-1905; 19832, ZNF254, 99457, 201907, 116-2095; 19833, ZNF256, 99465, 201915, 202-372; 19833, ZNF256, 99464, 201914, 198-2081; 19834, ZNF257, 99466, 201916, 182-289; 19834, ZNF257, 99467, 201917, 150-557; 19834, ZNF257, 99468, 201918, 98-346; 19834, ZNF257, 99470, 201920, 155-552; 19834, ZNF257, 99471, 201921, 125-232; 19834, ZNF257, 99469, 201919, 145-1836; 19835, ZNF26, 99473, 201923, 2666-4207; 19835, ZNF26, 99474, 201924, 399-639; 19835, ZNF26, 99475, 201925, 374-834; 19835, ZNF26, 99472, 201922, 378-1979; 19836, ZNF260, 99476, 201926, 1123-2361; 19836, ZNF260, 99477, 201927, 845-2083; 19836, ZNF260, 99478, 201928, 588-1826; 19836, ZNF260, 99479, 201929, 715-1953; 19837, ZNF263, 99481, 201931, 255-1250; 19837, ZNF263, 99482, 201932, 1-347; 19837, ZNF263, 99483, 201933, 310-990; 19837, ZNF263, 99484, 201934, 314-763; 19837, ZNF263, 99485, 201935, 1-347; 19837, ZNF263, 99486, 201936, 1-156; 19837, ZNF263, 99487, 201937, 335-759; 19837, ZNF263, 99480, 201930, 877-2928; 19838, ZNF264, 99490, 201940, 243-359; 19838, ZNF264, 99491, 201941, 392-681; 19838, ZNF264, 99492, 201942, 414-668; 19838, ZNF264, 99493, 201943, 378-572; 19838, ZNF264, 99488, 201938, 415-2298; 19838, ZNF264, 99489, 201939, 57-1940; 19839, ZNF266, 99498, 201948, 544-760; 19839, ZNF266, 99494, 201944, 2078-3727; 19839, ZNF266, 99495, 201945, 967-2616; 19839, ZNF266, 99496, 201946, 997-2646; 19839, ZNF266, 99497, 201947, 804-2453; 19839, ZNF266, 99499, 201949, 1177-2826; 19840, ZNF267, 99501, 201951, 1-149; 19840, ZNF267, 99502, 201952, 1-154; 19840, ZNF267, 99503, 201953, 293-567; 19840, ZNF267, 99504, 201954, 161-394; 19840, ZNF267, 99500, 201950, 210-2441; 19841, ZNF268, 99506, 201956, 331-897; 19841, ZNF268, 99507, 201957, 245-361; 19841, ZNF268, 99508, 201958, 229-531; 19841, ZNF268, 99509, 201959, 226-432; 19841, ZNF268, 99510, 201960, 181-762; 19841, ZNF268, 99511, 201961, 245-748; 19841, ZNF268, 99512, 201962, 226-762; 19841, ZNF268, 99514, 201964, 468-572; 19841, ZNF268, 99515, 201965, 1-334; 19841, ZNF268, 99517, 201967, 434-717; 19841, ZNF268, 99519, 201969, 120-500; 19841, ZNF268, 99520, 201970, 218-583; 19841, ZNF268, 99505, 201955, 207-3050; 19841, ZNF268, 99513, 201963, 331-3174; 19841, ZNF268, 99516, 201966, 120-254; 19841, ZNF268, 99518, 201968, 229-636; 19842, ZNF273, 99522, 201972, 31-231; 19842, ZNF273, 99521, 201971, 72-1781; 19843, ZNF274, 99524, 201974, 203-2038; 19843, ZNF274, 99526, 201976, 234-544; 19843, ZNF274, 99527, 201977, 473-709; 19843, ZNF274, 99523, 201973, 402-2267; 19843, ZNF274, 99525, 201975, 474-2120; 19843, ZNF274, 99528, 201978, 189-2150; 19843, ZNF274, 99529, 201979, 179-2140; 19844, ZNF275, 99531, 201981, 178-1167; 19844, ZNF275, 99530, 201980, 1372-2502; 19845, ZNF276, 99534, 201984, 1-283; 19845, ZNF276, 99535, 201985, 204-1046; 19845, ZNF276, 99536, 201986, 291-1592; 19845, ZNF276, 99537, 201987, 69-1136; 19845, ZNF276, 99532, 201982, 313-1932; 19845, ZNF276, 99533, 201983, 98-1942; 19846, ZNF277, 99539, 201989, 23-175; 19846, ZNF277, 99540, 201990, 20-617; 19846, ZNF277, 99541, 201991, 17-889; 19846, ZNF277, 99542, 201992, 21-344; 19846, ZNF277, 99543, 201993, 21-317; 19846, ZNF277, 99544, 201994, 1-357; 19846, ZNF277, 99538, 201988, 130-1482; 19847, ZNF28, 99545, 201995, 295-534; 19847, ZNF28, 99546, 201996, 190-1827; 19847, ZNF28, 99549, 201999, 103-492; 19847, ZNF28, 99550, 202000, 103-628; 19847, ZNF28, 99547, 201997, 121-2277; 19847, ZNF28, 99548, 201998, 895-2892; 19848, ZNF280A, 99552, 202002, 254-1882; 19848, ZNF280A, 99551, 202001, 254-1882; 19849, ZNF280B, 99553, 202003, 71-1702; 19849, ZNF280B, 99556, 202006, 744-2375; 19849, ZNF280B, 99557, 202007, 744-2375; 19849, ZNF280B, 99558, 202008, 323-1954; 19849, ZNF280B, 99554, 202004, 323-1954; 19849, ZNF280B, 99555, 202005, 71-1702; 19850, ZNF280C, 99560, 202010, 139-1970; 19850, ZNF280C, 99559, 202009, 155-2368; 19851, ZNF280D, 99562, 202012, 1801-4044; 19851, ZNF280D, 99563, 202013, 136-1743; 19851, ZNF280D, 99566, 202016, 188-428;

19851, ZNF280D, 99561, 202011, 218-3157; 19851, ZNF280D, 99564, 202014, 91-1869; 19851, ZNF280D, 99565, 202015, 116-592; 19851, ZNF280D, 99567, 202017, 685-3585; 19851, ZNF280D, 99568, 202018, 48-1313; 19852, ZNF281, 99569, 202019, 126-2813; 19852, ZNF281, 99570, 202020, 66-2645; 19852, ZNF281, 99571, 202021, 83-2770; 19853, ZNF282, 99572, 202022, 41-1432; 19853, ZNF282, 99573, 202023, 106-2121; 19854, ZNF283, 99575, 202025, 119-358; 19854, ZNF283, 99576, 202026, 163-298; 19854, ZNF283, 99577, 202027, 98-382; 19854, ZNF283, 99578, 202028, 151-474; 19854, ZNF283, 99579, 202029, 549-2171; 19854, ZNF283, 99574, 202024, 1-2040; 19854, ZNF283, 99580, 202030, 298-2337; 19855, ZNF284, 99581, 202031, 217-1998; 19856, ZNF285, 99583, 202033, 52-1845; 19856, ZNF285, 99584, 202034, 78-248; 19856, ZNF285, 99585, 202035, 423-540; 19856, ZNF285, 99582, 202032, 198-1970; 19856, ZNF285, 99586, 202036, 66-1838; 19857, ZNF286A, 99587, 202037, 198-623; 19857, ZNF286A, 99588, 202038, 322-672; 19857, ZNF286A, 99590, 202040, 221-402; 19857, ZNF286A, 99591, 202041, 33-353; 19857, ZNF286A, 99592, 202042, 255-437; 19857, ZNF286A, 99593, 202043, 28-541; 19857, ZNF286A, 99594, 202044, 229-579; 19857, ZNF286A, 99595, 202045, 32-184; 19857, ZNF286A, 99599, 202049, 1-279; 19857, ZNF286A, 99600, 202050, 218-574; 19857, ZNF286A, 99589, 202039, 484-2049; 19857, ZNF286A, 99596, 202046, 241-1806; 19857, ZNF286A, 99597, 202047, 554-2119; 19857, ZNF286A, 99598, 202048, 195-1730; 19858, ZNF286B, 99601, 202051, 221-418; 19858, ZNF286B, 99602, 202052, 168-504; 19858, ZNF286B, 99604, 202054, 252-640; 19858, ZNF286B, 99605, 202055, 208-525; 19858, ZNF286B, 99603, 202053, 252-1820; 19859, ZNF287, 99608, 202058, 521-692; 19859, ZNF287, 99606, 202056, 619-2904; 19859, ZNF287, 99607, 202057, 454-2739; 19860, ZNF292, 99609, 202059, 12-8168; 19860, ZNF292, 99611, 202061, 1-397; 19860, ZNF292, 99612, 202062, 1-770; 19860, ZNF292, 99613, 202063, 17-277; 19860, ZNF292, 99614, 202064, 238-438; 19860, ZNF292, 99610, 202060, 44-8215; 19861, ZNF296, 99616, 202066, 176-1531; 19861, ZNF296, 99615, 202065, 216-1643; 19862, ZNF3, 99617, 202067, 451-512; 19862, ZNF3, 99620, 202070, 446-999; 19862, ZNF3, 99621, 202071, 279-574; 19862, ZNF3, 99623, 202073, 182-735; 19862, ZNF3, 99625, 202075, 150-595; 19862, ZNF3, 99626, 202076, 231-543; 19862, ZNF3, 99618, 202068, 304-1644; 19862, ZNF3, 99619, 202069, 969-2309; 19862, ZNF3, 99622, 202072, 291-686; 19862, ZNF3, 99624, 202074, 207-1547; 19863, ZNF30, 99631, 202081, 438-696; 19863, ZNF30, 99627, 202077, 379-2253; 19863, ZNF30, 99628, 202078, 445-2319; 19863, ZNF30, 99629, 202079, 238-2109; 19863, ZNF30, 99630, 202080, 302-562; 19864, ZNF300, 99633, 202083, 417-2231; 19864, ZNF300, 99636, 202086, 228-500; 19864, ZNF300, 99632, 202082, 422-2236; 19864, ZNF300, 99634, 202084, 488-2194; 19864, ZNF300, 99635, 202085, 429-2291; 19865, ZNF302, 99638, 202088, 209-1540; 19865, ZNF302, 99641, 202091, 224-622; 19865, ZNF302, 99642, 202092, 146-572; 19865, ZNF302, 99643, 202093, 337-732; 19865, ZNF302, 99644, 202094, 219-578; 19865, ZNF302, 99645, 202095, 278-675; 19865, ZNF302, 99646, 202096, 279-365; 19865, ZNF302, 99647, 202097, 534-1736; 19865, ZNF302, 99648, 202098, 287-1723; 19865, ZNF302, 99637, 202087, 241-1440; 19865, ZNF302, 99639, 202089, 237-1436; 19865, ZNF302, 99640, 202090, 495-1694; 19866, ZNF304, 99651, 202101, 340-2460; 19866, ZNF304, 99652, 202102, 547-2400; 19866, ZNF304, 99649, 202099, 174-2153; 19866, ZNF304, 99650, 202100, 285-2264; 19867, ZNF311, 99653, 202103, 514-2514; 19867, ZNF311, 99654, 202104, 484-2484; 19867, ZNF311, 99655, 202105, 514-2514; 19867, ZNF311, 99656, 202106, 514-2514; 19867, ZNF311, 99657, 202107, 514-2514; 19867, ZNF311, 99658, 202108, 514-2514; 19867, ZNF311, 99659, 202109, 514-2514; 19868, ZNF316, 99661, 202111, 401-520; 19868, ZNF316, 99660, 202110, 557-3571; 19869, ZNF317, 99664, 202114, 271-591; 19869, ZNF317, 99665, 202115, 1-135; 19869, ZNF317, 99662, 202112, 306-2093; 19869, ZNF317, 99663, 202113, 289-1980; 19870, ZNF318, 99667, 202117, 1-239; 19870, ZNF318, 99666, 202116, 79-6918; 19870, ZNF318, 99668, 202118, 114-3467; 19871, ZNF319, 99670, 202120, 311-517; 19871, ZNF319, 99669, 202119, 624-2372; 19872, ZNF32, 99671, 202121, 125-946; 19872, ZNF32, 99672, 202122, 190-1011; 19873, ZNF320, 99674, 202124, 192-658; 19873, ZNF320, 99675, 202125, 333-590; 19873, ZNF320, 99676, 202126, 476-552; 19873, ZNF320, 99677, 202127, 412-583; 19873, ZNF320, 99678, 202128, 229-598; 19873, ZNF320, 99679, 202129, 238-591; 19873, ZNF320, 99673, 202123, 121-1650; 19873, ZNF320, 99680, 202130, 503-2032; 19874, ZNF322, 99683, 202133, 510-587; 19874, ZNF322, 99681, 202131, 647-1855; 19874, ZNF322, 99682, 202132, 413-1621; 19874, ZNF322, 99684, 202134, 558-1766; 19874, ZNF322, 99685, 202135, 722-1930; 19874, ZNF322, 99686, 202136, 577-1785; 19875, ZNF324, 99688, 202138, 146-1006; 19875, ZNF324, 99690, 202140, 1-1237; 19875, ZNF324, 99687, 202137, 95-1756; 19875, ZNF324, 99689, 202139, 710-2371; 19876, ZNF324B, 99693, 202143, 65-457; 19876, ZNF324B, 99694, 202144, 742-979; 19876, ZNF324B, 99695, 202145, 132-546; 19876, ZNF324B, 99696, 202146, 136-578; 19876, ZNF324B, 99691, 202141, 108-1742; 19876, ZNF324B, 99692, 202142, 181-1815; 19877, ZNF326, 99699, 202149, 122-1603; 19877, ZNF326, 99700, 202150, 147-308; 19877, ZNF326, 99697, 202147, 144-1892; 19877, ZNF326, 99698, 202148, 125-337; 19878, ZNF329, 99705, 202155, 342-469; 19878, ZNF329, 99701, 202151, 117-1742; 19878, ZNF329, 99702, 202152, 584-2209; 19878, ZNF329, 99703, 202153, 235-1860; 19878, ZNF329, 99704, 202154, 679-2304; 19879, ZNF330, 99707, 202157, 94-552; 19879, ZNF330, 99708, 202158, 216-323; 19879, ZNF330, 99709, 202159, 151-838; 19879, ZNF330, 99710, 202160, 155-573; 19879, ZNF330, 99711, 202161, 188-313; 19879, ZNF330, 99712, 202162, 182-415; 19879, ZNF330, 99706, 202156, 229-1191; 19880, ZNF331, 99718, 202168, 414-913; 19880, ZNF331, 99719, 202169, 317-573; 19880, ZNF331, 99721, 202171, 411-670; 19880, ZNF331, 99722, 202172, 481-670; 19880, ZNF331, 99723, 202173, 276-574; 19880, ZNF331, 99724, 202174, 496-688; 19880, ZNF331, 99725, 202175, 443-641; 19880, ZNF331, 99726, 202176, 226-540; 19880, ZNF331, 99727, 202177, 422-562; 19880, ZNF331, 99728, 202178, 200-496; 19880, ZNF331, 99730, 202180, 230-761; 19880, ZNF331, 99713, 202163, 1334-2725; 19880, ZNF331, 99714, 202164, 423-1814; 19880, ZNF331, 99715, 202165, 109-1500; 19880, ZNF331, 99716, 202166, 295-1686; 19880, ZNF331, 99717, 202167, 302-1693; 19880, ZNF331, 99720, 202170, 370-1761; 19880, ZNF331, 99729, 202179, 465-1856; 19881, ZNF333, 99733, 202183, 42-629; 19881, ZNF333, 99734, 202184, 144-464; 19881, ZNF333, 99735, 202185, 119-619; 19881, ZNF333, 99731, 202181, 92-2089; 19881, ZNF333, 99732, 202182, 124-1035; 19882, ZNF334, 99737, 202187, 1325-3253; 19882, ZNF334, 99738, 202188, 1724-2243; 19882, ZNF334, 99739, 202189, 296-

2407; 19882, ZNF334, 99740, 202190, 1-2040; 19882, ZNF334, 99741, 202191, 248-2287; 19882, ZNF334, 99736, 202186, 184-2226; 19883, ZNF335, 99742, 202192, 102-4130; 19884, ZNF337, 99743, 202193, 133-2388; 19884, ZNF337, 99744, 202194, 541-2796; 19885, ZNF33A, 99745, 202195, 204-2693; 19885, ZNF33A, 99746, 202196, 520-2619; 19885, ZNF33A, 99749, 202199, 143-559; 19885, ZNF33A, 99747, 202197, 159-2591; 19885, ZNF33A, 99748, 202198, 160-2595; 19885, ZNF33A, 99750, 202200, 100-2553; 19886, ZNF33B, 99752, 202202, 49-319; 19886, ZNF33B, 99753, 202203, 1-282; 19886, ZNF33B, 99754, 202204, 1-2337; 19886, ZNF33B, 99755, 202205, 1-111; 19886, ZNF33B, 99751, 202201, 116-2452; 19887, ZNF34, 99757, 202207, 155-1774; 19887, ZNF34, 99758, 202208, 110-903; 19887, ZNF34, 99759, 202209, 108-582; 19887, ZNF34, 99756, 202206, 67-1749; 19888, ZNF341, 99762, 202212, 13-1827; 19888, ZNF341, 99763, 202213, 21-239; 19888, ZNF341, 99760, 202210, 366-2909; 19888, ZNF341, 99761, 202211, 263-2827; 19889, ZNF343, 99767, 202217, 595-1028; 19889, ZNF343, 99768, 202218, 339-642; 19889, ZNF343, 99769, 202219, 415-2337; 19889, ZNF343, 99764, 202214, 489-2288; 19889, ZNF343, 99765, 202215, 415-771; 19889, ZNF343, 99766, 202216, 272-628; 19889, ZNF343, 99770, 202220, 433-1962; 19890, ZNF345, 99771, 202221, 195-533; 19890, ZNF345, 99774, 202224, 358-581; 19890, ZNF345, 99776, 202226, 98-651; 19890, ZNF345, 99777, 202227, 282-564; 19890, ZNF345, 99778, 202228, 196-423; 19890, ZNF345, 99779, 202229, 413-571; 19890, ZNF345, 99772, 202222, 789-2255; 19890, ZNF345, 99773, 202223, 201-1667; 19890, ZNF345, 99775, 202225, 379-1845; 19890, ZNF345, 99780, 202230, 360-1826; 19890, ZNF345, 99781, 202231, 195-1661; 19891, ZNF346, 99783, 202233, 44-400; 19891, ZNF346, 99785, 202235, 24-419; 19891, ZNF346, 99786, 202236, 44-634; 19891, ZNF346, 99787, 202237, 5-412; 19891, ZNF346, 99789, 202239, 8-940; 19891, ZNF346, 99782, 202232, 44-928; 19891, ZNF346, 99784, 202234, 36-824; 19891, ZNF346, 99788, 202238, 5-964; 19892, ZNF347, 99792, 202242, 136-511; 19892, ZNF347, 99793, 202243, 262-567; 19892, ZNF347, 99794, 202244, 142-246; 19892, ZNF347, 99796, 202246, 392-495; 19892, ZNF347, 99790, 202240, 70-2589; 19892, ZNF347, 99791, 202241, 428-2950; 19892, ZNF347, 99795, 202245, 92-2614; 19893, ZNF35, 99797, 202247, 221-532; 19893, ZNF35, 99799, 202249, 195-506; 19893, ZNF35, 99800, 202250, 195-506; 19893, ZNF35, 99801, 202251, 196-532; 19893, ZNF35, 99802, 202252, 219-620; 19893, ZNF35, 99803, 202253, 221-532; 19893, ZNF35, 99805, 202255, 195-506; 19893, ZNF35, 99806, 202256, 219-620; 19893, ZNF35, 99807, 202257, 196-532; 19893, ZNF35, 99808, 202258, 195-506; 19893, ZNF35, 99798, 202248, 236-1819; 19893, ZNF35, 99804, 202254, 236-1819; 19894, ZNF350, 99810, 202260, 352-553; 19894, ZNF350, 99811, 202261, 348-533; 19894, ZNF350, 99812, 202262, 381-869; 19894, ZNF350, 99813, 202263, 333-489; 19894, ZNF350, 99809, 202259, 229-1827; 19895, ZNF354A, 99815, 202265, 156-356; 19895, ZNF354A, 99816, 202266, 362-766; 19895, ZNF354A, 99814, 202264, 199-2016; 19896, ZNF354B, 99818, 202268, 362-763; 19896, ZNF354B, 99817, 202267, 227-2065; 19897, ZNF354C, 99819, 202269, 307-1971; 19898, ZNF358, 99822, 202272, 154-662; 19898, ZNF358, 99820, 202270, 42-1748; 19898, ZNF358, 99821, 202271, 171-1877; 19899, ZNF362, 99824, 202274, 112-712; 19899, ZNF362, 99823, 202273, 1-1263; 19899, ZNF362, 99825, 202275, 171-1433; 19900, ZNF365, 99826, 202276, 154-351; 19900, ZNF365, 99827, 202277, 154-351; 19900, ZNF365, 99828, 202278, 154-360; 19900, ZNF365, 99833, 202283, 331-489; 19900, ZNF365, 99829, 202279, 335-985; 19900, ZNF365, 99834, 202284, 154-804; 19900, ZNF365, 99830, 202280, 281-1504; 19900, ZNF365, 99831, 202281, 281-1282; 19900, ZNF365, 99832, 202282, 281-1669; 19901, ZNF366, 99836, 202286, 303-494; 19901, ZNF366, 99837, 202287, 202-399; 19901, ZNF366, 99835, 202285, 492-2726; 19902, ZNF367, 99838, 202288, 298-1350; 19903, ZNF37A, 99839, 202289, 831-2516; 19903, ZNF37A, 99840, 202290, 346-2031; 19904, ZNF382, 99842, 202292, 710-2215; 19904, ZNF382, 99845, 202295, 161-712; 19904, ZNF382, 99846, 202296, 481-556; 19904, ZNF382, 99841, 202291, 114-1766; 19904, ZNF382, 99843, 202293, 76-1725; 19904, ZNF382, 99844, 202294, 1496-3145; 19905, ZNF383, 99849, 202299, 240-582; 19905, ZNF383, 99851, 202301, 43-288; 19905, ZNF383, 99847, 202297, 259-1686; 19905, ZNF383, 99848, 202298, 584-2011; 19905, ZNF383, 99850, 202300, 225-1652; 19906, ZNF384, 99856, 202306, 154-1286; 19906, ZNF384, 99857, 202307, 266-1096; 19906, ZNF384, 99858, 202308, 409-912; 19906, ZNF384, 99859, 202309, 208-557; 19906, ZNF384, 99860, 202310, 219-572; 19906, ZNF384, 99861, 202311, 529-1140; 19906, ZNF384, 99862, 202312, 126-506; 19906, ZNF384, 99863, 202313, 1-478; 19906, ZNF384, 99852, 202302, 479-2029; 19906, ZNF384, 99853, 202303, 153-1538; 19906, ZNF384, 99854, 202304, 261-1994; 19906, ZNF384, 99855, 202305, 209-1942; 19907, ZNF385A, 99869, 202319, 75-568; 19907, ZNF385A, 99870, 202320, 81-775; 19907, ZNF385A, 99871, 202321, 1-761; 19907, ZNF385A, 99872, 202322, 196-477; 19907, ZNF385A, 99874, 202324, 111-545; 19907, ZNF385A, 99875, 202325, 38-572; 19907, ZNF385A, 99876, 202326, 1-342; 19907, ZNF385A, 99864, 202314, 38-955; 19907, ZNF385A, 99865, 202315, 55-1215; 19907, ZNF385A, 99866, 202316, 210-1310; 19907, ZNF385A, 99867, 202317, 291-1391; 19907, ZNF385A, 99868, 202318, 160-1017; 19907, ZNF385A, 99873, 202323, 146-1246; 19908, ZNF385B, 99881, 202331, 168-956; 19908, ZNF385B, 99882, 202332, 87-501; 19908, ZNF385B, 99883, 202333, 311-404; 19908, ZNF385B, 99884, 202334, 340-565; 19908, ZNF385B, 99877, 202327, 244-1353; 19908, ZNF385B, 99878, 202328, 306-1493; 19908, ZNF385B, 99879, 202329, 301-1410; 19908, ZNF385B, 99880, 202330, 605-2020; 19909, ZNF385C, 99885, 202335, 2-1380; 19909, ZNF385C, 99886, 202336, 1-1275; 19910, ZNF385D, 99888, 202338, 199-510; 19910, ZNF385D, 99887, 202337, 520-1707; 19911, ZNF391, 99890, 202340, 351-749; 19911, ZNF391, 99889, 202339, 546-1622; 19912, ZNF394, 99891, 202341, 205-1890; 19912, ZNF394, 99892, 202342, 172-660; 19913, ZNF395, 99894, 202344, 1-93; 19913, ZNF395, 99895, 202345, 212-584; 19913, ZNF395, 99896, 202346, 137-699; 19913, ZNF395, 99899, 202349, 83-224; 19913, ZNF395, 99900, 202350, 194-501; 19913, ZNF395, 99901, 202351, 234-703; 19913, ZNF395, 99893, 202343, 133-1674; 19913, ZNF395, 99897, 202347, 89-1630; 19913, ZNF395, 99898, 202348, 337-1878; 19914, ZNF396, 99903, 202353, 460-578; 19914, ZNF396, 99906, 202356, 277-670; 19914, ZNF396, 99902, 202352, 133-1134; 19914, ZNF396, 99904, 202354, 133-1140; 19914, ZNF396, 99905, 202355, 133-765; 19915, ZNF397, 99909, 202359, 136-873; 19915, ZNF397, 99910, 202360, 1-602; 19915, ZNF397, 99913, 202363, 82-648; 19915, ZNF397, 99914, 202364, 117-532; 19915, ZNF397, 99907, 202357, 136-963; 19915, ZNF397, 99908, 202358, 154-1758; 19915, ZNF397, 99911, 202361, 154-777; 19915, ZNF397, 99912, 202362, 715-1338; 19916, ZNF398, 99915, 202365, 852-2267; 19916, ZNF398, 99916, 202366, 624-2039; 19916, ZNF398, 99917, 202367, 680-2095; 19916, ZNF398, 99918, 202368, 268-2196; 19917, ZNF404, 99919, 202369, 1-1656; 19917, ZNF404, 99920, 202370, 1-1659; 19918, ZNF407, 99925, 202375, 1-413; 19918, ZNF407, 99926, 202376, 1-390; 19918, ZNF407, 99921, 202371, 1-6747; 19918, ZNF407, 99922, 202372, 58-5040; 19918, ZNF407, 99923, 202373, 122-5104; 19918, ZNF407, 99924, 202374, 1-5448; 19919, ZNF408, 99927, 202377, 231-2393; 19920, ZNF41, 99930, 202380, 78-613; 19920, ZNF41, 99928, 202378, 407-2746; 19920, ZNF41, 99929, 202379, 641-2980; 19921, ZNF410, 99932, 202382, 210-1487; 19921, ZNF410, 99936, 202386, 207-587; 19921, ZNF410, 99937, 202387, 265-555; 19921, ZNF410, 99938, 202388, 903-1232; 19921, ZNF410, 99939, 202389, 635-1138; 19921, ZNF410, 99940, 202390, 327-537; 19921, ZNF410, 99941, 202391, 618-841; 19921, ZNF410, 99942, 202392, 1-508; 19921, ZNF410, 99943, 202393, 488-769; 19921, ZNF410, 99945, 202395, 309-567; 19921, ZNF410, 99946, 202396, 258-548; 19921, ZNF410, 99947, 202397, 219-595; 19921, ZNF410, 99948, 202398, 184-571; 19921, ZNF410, 99931, 202381, 261-1556; 19921, ZNF410, 99933, 202383, 195-1013; 19921, ZNF410, 99934, 202384, 195-1745; 19921, ZNF410, 99935, 202385, 449-1666; 19921, ZNF410, 99944, 202394, 195-1631; 19921, ZNF410, 99949, 202399, 1-1551; 19922, ZNF414, 99952, 202402, 1-361; 19922, ZNF414, 99953, 202403, 1-462; 19922, ZNF414, 99954, 202404, 108-245; 19922, ZNF414, 99955, 202405, 1-512; 19922, ZNF414, 99950, 202400, 103-1041; 19922, ZNF414, 99951, 202401, 115-1287; 19923, ZNF415, 99959, 202409, 206-427; 19923, ZNF415, 99960, 202410, 220-447; 19923, ZNF415, 99961, 202411, 217-438; 19923, ZNF415, 99962, 202412, 244-465; 19923, ZNF415, 99963, 202413, 272-589; 19923, ZNF415, 99964, 202414, 228-557; 19923, ZNF415, 99965, 202415, 61-551; 19923, ZNF415, 99966, 202416, 51-362; 19923, ZNF415, 99967, 202417, 195-374; 19923, ZNF415, 99968, 202418, 117-296; 19923, ZNF415, 99969, 202419, 108-437; 19923, ZNF415, 99970, 202420, 260-589; 19923, ZNF415, 99971, 202421, 94-273; 19923, ZNF415, 99972, 202422, 17-337; 19923, ZNF415, 99974, 202424, 435-504; 19923, ZNF415, 99956, 202406, 105-1772; 19923, ZNF415, 99957, 202407, 238-1905; 19923, ZNF415, 99958, 202408, 335-2002; 19923, ZNF415, 99973, 202423, 657-1634; 19924, ZNF416, 99975, 202425, 224-2008; 19925, ZNF417, 99977, 202427, 522-566; 19925, ZNF417, 99978, 202428, 430-583; 19925, ZNF417, 99979, 202429, 487-550; 19925, ZNF417, 99980, 202430, 409-580; 19925, ZNF417, 99981, 202431, 181-1905; 19925, ZNF417, 99982, 202432, 1-272; 19925, ZNF417, 99976, 202426, 166-1893; 19926, ZNF418, 99984, 202434, 465-2558; 19926, ZNF418, 99985, 202435, 340-560; 19926, ZNF418, 99986, 202436, 346-2121; 19926, ZNF418, 99987, 202437, 245-540; 19926, ZNF418, 99988, 202438, 97-483; 19926, ZNF418, 99990, 202440, 265-543; 19926, ZNF418, 99983, 202433, 293-2323; 19926, ZNF418, 99989, 202439, 142-2172; 19926, ZNF418, 99991, 202441, 84-2114; 19927, ZNF419, 99994, 202444, 241-1569; 19927, ZNF419, 99999, 202449, 181-513; 19927, ZNF419, 100000, 202450, 234-577; 19927, ZNF419, 100001, 202451, 232-572; 19927, ZNF419, 100002, 202452, 199-561; 19927, ZNF419, 100003, 202453, 234-527; 19927, ZNF419, 100004, 202454, 202-462; 19927, ZNF419, 100005, 202455, 171-690; 19927, ZNF419, 100006, 202456, 418-567; 19927, ZNF419, 100007, 202457, 1-1281; 19927, ZNF419, 99992, 202442, 187-1719; 19927, ZNF419, 99993, 202443, 211-1647; 19927, ZNF419, 99995, 202445, 230-1765; 19927, ZNF419, 99996, 202446, 241-1737; 19927, ZNF419, 99997, 202447, 202-1596; 19927, ZNF419, 99998, 202448, 234-1727; 19928, ZNF420, 100010, 202460, 278-433; 19928, ZNF420, 100011, 202461, 349-612; 19928, ZNF420, 100012, 202462, 263-406; 19928, ZNF420, 100013, 202463, 206-695; 19928, ZNF420, 100014, 202464, 304-541; 19928, ZNF420, 100015, 202465, 1-268; 19928, ZNF420, 100008, 202458, 261-1871; 19928, ZNF420, 100009, 202459, 216-2282; 19929, ZNF423, 100017, 202467, 210-3713; 19929, ZNF423, 100018, 202468, 190-3693; 19929, ZNF423, 100023, 202473, 1-308; 19929, ZNF423, 100016, 202466, 54-3908; 19929, ZNF423, 100019, 202469, 302-4156; 19929, ZNF423, 100020, 202470, 566-4240; 19929, ZNF423, 100021, 202471, 344-4018; 19929, ZNF423, 100022, 202472, 170-3844; 19930, ZNF425, 100025, 202475, 94-541; 19930, ZNF425, 100024, 202474, 134-2392; 19931, ZNF426, 100028, 202478, 255-611; 19931, ZNF426, 100029, 202479, 479-2029; 19931, ZNF426, 100026, 202476, 265-1929; 19931, ZNF426, 100027, 202477, 338-2002; 19932, ZNF428, 100031, 202481, 173-827; 19932, ZNF428, 100030, 202480, 448-1014; 19933, ZNF429, 100033, 202483, 1-281; 19933, ZNF429, 100034, 202484, 169-537; 19933, ZNF429, 100035, 202485, 112-1869; 19933, ZNF429, 100032, 202482, 209-2233; 19934, ZNF43, 100037, 202487, 135-2591; 19934, ZNF43, 100038, 202488, 218-580; 19934, ZNF43, 100042, 202492, 287-447; 19934, ZNF43, 100043, 202493, 294-474; 19934, ZNF43, 100044, 202494, 306-560; 19934, ZNF43, 100045, 202495, 1-1426; 19934, ZNF43, 100046, 202496, 1-1426; 19934, ZNF43, 100047, 202497, 1-1426; 19934, ZNF43, 100048, 202498, 1-1426; 19934, ZNF43, 100036, 202486, 171-2600; 19934, ZNF43, 100039, 202489, 516-2927; 19934, ZNF43, 100040, 202490, 662-3073; 19934, ZNF43, 100041, 202491, 339-2750; 19935, ZNF430, 100050, 202500, 85-411; 19935, ZNF430, 100051, 202501, 1-220; 19935, ZNF430, 100052, 202502, 168-509; 19935, ZNF430, 100053, 202503, 152-536; 19935, ZNF430, 100054, 202504, 182-503; 19935, ZNF430, 100055, 202505, 168-489; 19935, ZNF430, 100056, 202506, 85-411; 19935, ZNF430, 100057, 202507, 152-473; 19935, ZNF430, 100058, 202508, 1-324; 19935, ZNF430, 100049, 202499, 182-1894; 19936, ZNF431, 100060, 202510, 148-270; 19936, ZNF431, 100061, 202511, 150-518; 19936, ZNF431, 100062, 202512, 161-595; 19936, ZNF431, 100063, 202513, 108-1082; 19936, ZNF431, 100059, 202509, 145-1875; 19937, ZNF432, 100065, 202515, 263-508; 19937, ZNF432, 100067, 202517, 228-764; 19937, ZNF432, 100068, 202518, 225-596; 19937, ZNF432, 100069, 202519, 497-604; 19937, ZNF432, 100064, 202514, 319-2277; 19937, ZNF432, 100066, 202516, 214-2172; 19938, ZNF433, 100072, 202522, 337-567; 19938, ZNF433, 100073, 202523, 224-721; 19938, ZNF433, 100074, 202524, 158-283; 19938, ZNF433, 100075, 202525, 236-467; 19938, ZNF433, 100076, 202526, 341-692; 19938, ZNF433, 100077, 202527, 165-785; 19938, ZNF433, 100078, 202528, 226-583; 19938, ZNF433, 100079, 202529, 293-449; 19938, ZNF433, 100070, 202520, 172-2193; 19938, ZNF433, 100071, 202521, 293-2209; 19939, ZNF436, 100082, 202532, 382-1794; 19939, ZNF436, 100083, 202533, 138-1550; 19939, ZNF436, 100080, 202530, 138-1550; 19939, ZNF436, 100081, 202531, 382-1794; 19940, ZNF438, 100086, 202536, 815-1993; 19940, ZNF438, 100092, 202542, 217-504; 19940, ZNF438, 100084, 202534, 460-2916; 19940, ZNF438, 100085, 202535, 331-2817; 19940, ZNF438, 100087, 202537, 297-2783; 19940, ZNF438, 100088, 202538, 355-2841; 19940, ZNF438, 100089, 202539, 436-2922; 19940, ZNF438, 100090, 202540, 565-3021; 19940, ZNF438, 100091, 202541, 756-3095; 19941, ZNF439, 100094, 202544, 252-605; 19941, ZNF439, 100095, 202545, 404-1495; 19941, ZNF439, 100093, 202543, 201-1700; 19942, ZNF44, 100096, 202546, 158-352; 19942, ZNF44, 100097, 202547, 194-2041; 19942, ZNF44, 100101, 202551, 129-593; 19942, ZNF44, 100098, 202548, 120-2111; 19942, ZNF44, 100099, 202549, 101-2014; 19942, ZNF44, 100100, 202550, 141-1910; 19943, ZNF440, 100103, 202553, 105-920; 19943, ZNF440, 100104, 202554, 401-559; 19943, ZNF440, 100105, 202555, 289-796; 19943, ZNF440, 100106, 202556, 409-556; 19943, ZNF440, 100102, 202552, 165-1952; 19944, ZNF441, 100108, 202558, 103-237; 19944, ZNF441, 100107, 202557, 103-2184; 19945, ZNF442, 100111, 202561, 106-567; 19945, ZNF442, 100109, 202559, 584-2467; 19945, ZNF442, 100110, 202560, 112-1788; 19945, ZNF442, 100112, 202562, 1-1884; 19946, ZNF443, 100114, 202564, 108-302; 19946, ZNF443, 100113, 202563, 199-2214; 19947, ZNF444, 100116, 202566, 265-562; 19947, ZNF444, 100117, 202567, 377-646; 19947, ZNF444, 100118, 202568, 452-585; 19947, ZNF444, 100119, 202569, 426-642; 19947, ZNF444, 100120, 202570, 363-574; 19947, ZNF444, 100122, 202572, 356-586; 19947, ZNF444, 100115, 202565, 368-1351; 19947, ZNF444, 100121, 202571, 234-1214; 19948, ZNF445, 100125, 202575, 152-973; 19948, ZNF445, 100126, 202576, 152-973; 19948, ZNF445, 100127, 202577, 152-3247; 19948, ZNF445, 100128, 202578, 349-3444; 19948, ZNF445, 100123, 202573, 349-3444; 19948, ZNF445, 100124, 202574, 152-3247; 19949, ZNF446, 100129, 202579, 118-1128; 19949, ZNF446, 100130, 202580, 147-569; 19949, ZNF446, 100131, 202581, 2221-3420; 19949, ZNF446, 100133, 202583, 103-1371; 19949, ZNF446, 100134, 202584, 118-1386; 19949, ZNF446, 100132, 202582, 382-1734; 19950, ZNF449, 100135, 202585, 141-1697; 19950, ZNF449, 100136, 202586, 141-635; 19951, ZNF45, 100138, 202588, 134-520; 19951, ZNF45, 100137, 202587, 1092-3140; 19951, ZNF45, 100139, 202589, 103-2151; 19951, ZNF45, 100140, 202590, 108-2156; 19952, ZNF451, 100142, 202592, 178-399; 19952, ZNF451, 100145, 202595, 48-275; 19952, ZNF451, 100146, 202596, 66-3191; 19952, ZNF451, 100147, 202597, 86-538; 19952, ZNF451, 100148, 202598, 44-262; 19952, ZNF451, 100149, 202599, 462-581; 19952, ZNF451, 100150, 202600, 30-191; 19952, ZNF451, 100151, 202601, 245-719; 19952, ZNF451, 100152, 202602, 116-343; 19952, ZNF451, 100141, 202591, 225-3266; 19952, ZNF451, 100143, 202593, 245-3430; 19952, ZNF451, 100144, 202594, 179-1858; 19953, ZNF454, 100153, 202603, 304-1872; 19953, ZNF454, 100154, 202604, 330-1898; 19954, ZNF460, 100157, 202607, 175-555; 19954, ZNF460, 100155, 202605, 323-2011; 19954, ZNF460, 100156, 202606, 168-1733; 19955, ZNF461, 100158, 202608, 233-1855; 19955, ZNF461, 100159, 202609, 211-336; 19955, ZNF461, 100160, 202610, 254-467; 19955, ZNF461, 100161, 202611, 229-369; 19955, ZNF461, 100162, 202612, 229-441; 19955, ZNF461, 100164, 202614, 288-713; 19955, ZNF461, 100165, 202615, 1-774; 19955, ZNF461, 100166, 202616, 1-1692; 19955, ZNF461, 100163, 202613, 229-1920; 19956, ZNF462, 100168, 202618, 1-4350; 19956, ZNF462, 100170, 202620, 1-625; 19956, ZNF462, 100171, 202621, 221-551; 19956, ZNF462, 100167, 202617, 290-7810; 19956, ZNF462, 100169, 202619, 1-4239; 19957, ZNF467, 100173, 202623, 155-595; 19957, ZNF467, 100172, 202622, 415-2202; 19958, ZNF468, 100174, 202624, 152-535; 19958, ZNF468, 100175, 202625, 1-384; 19958, ZNF468, 100176, 202626, 237-374; 19958, ZNF468, 100177, 202627, 122-533; 19958, ZNF468, 100179, 202629, 511-646; 19958, ZNF468, 100180, 202630, 122-355; 19958, ZNF468, 100178, 202628, 122-1690; 19959, ZNF469, 100182, 202632, 1-11862; 19959, ZNF469, 100181, 202631, 1-11778; 19960, ZNF470, 100185, 202635, 672-980; 19960, ZNF470, 100186, 202636, 1-140; 19960, ZNF470, 100183, 202633, 687-2840; 19960, ZNF470, 100184, 202634, 138-2291; 19961, ZNF471, 100189, 202639, 335-564; 19961, ZNF471, 100187, 202637, 134-2014; 19961, ZNF471, 100188, 202638, 127-870; 19962, ZNF473, 100192, 202642, 146-2725; 19962, ZNF473, 100193, 202643, 252-558; 19962, ZNF473, 100194, 202644, 382-605; 19962, ZNF473, 100195, 202645, 153-386; 19962, ZNF473, 100196, 202646, 93-287; 19962, ZNF473, 100190, 202640, 360-2975; 19962, ZNF473, 100191, 202641, 387-3002; 19962, ZNF473, 100197, 202647, 496-3111; 19963, ZNF474, 100199, 202649, 358-546; 19963, ZNF474, 100200, 202650, 464-572; 19963, ZNF474, 100198, 202648, 384-1478; 19964, ZNF479, 100203, 202653, 1-1239; 19964, ZNF479, 100201, 202651, 18-1592; 19964, ZNF479, 100202, 202652, 272-1846; 19965, ZNF48, 100205, 202655, 100-430; 19965, ZNF48, 100206, 202656, 483-912; 19965, ZNF48, 100207, 202657, 115-555; 19965, ZNF48, 100208, 202658, 388-1875; 19965, ZNF48, 100204, 202654, 377-2233; 19965, ZNF48, 100209, 202659, 483-2339; 19965, ZNF48, 100210, 202660, 115-1971; 19966, ZNF480, 100211, 202661, 65-1543; 19966, ZNF480, 100214, 202664, 65-250; 19966, ZNF480, 100216, 202666, 65-559; 19966, ZNF480, 100212, 202662, 124-1500; 19966, ZNF480, 100213, 202663, 67-1674; 19966, ZNF480, 100215, 202665, 67-1674; 19967, ZNF483, 100219, 202669, 176-712; 19967, ZNF483, 100220, 202670, 203-937; 19967, ZNF483, 100217, 202667, 159-2393; 19967, ZNF483, 100218, 202668, 233-1003; 19968, ZNF484, 100221, 202671, 150-2708; 19968, ZNF484, 100222, 202672, 227-2677; 19968, ZNF484, 100223, 202673, 199-2763; 19968, ZNF484, 100224, 202674, 384-2834; 19969, ZNF485, 100227, 202677, 178-529; 19969, ZNF485, 100225, 202675, 195-1520; 19969, ZNF485, 100226, 202676, 193-1518; 19970, ZNF486, 100229, 202679, 104-490; 19970, ZNF486, 100228, 202678, 58-1449; 19971, ZNF487, 100230, 202680, 1-568; 19971, ZNF487, 100232, 202682, 221-240; 19971, ZNF487, 100233, 202683, 228-567; 19971, ZNF487, 100231, 202681, 228-854; 19972, ZNF488, 100234, 202684, 163-1185; 19972, ZNF488, 100235, 202685, 366-1067; 19973, ZNF490, 100237, 202687, 124-306; 19973, ZNF490, 100238, 202688, 161-553; 19973, ZNF490, 100236, 202686, 124-1713; 19974, ZNF491, 100240, 202690, 160-578; 19974, ZNF491, 100239, 202689, 332-1645; 19975, ZNF492, 100241, 202691, 245-1840; 19976, ZNF493, 100245, 202695, 106-252; 19976, ZNF493, 100246, 202696, 120-407; 19976, ZNF493, 100247, 202697, 106-390; 19976, ZNF493, 100248, 202698, 73-219; 19976, ZNF493, 100242, 202692, 83-394; 19976, ZNF493, 100243, 202693, 267-2207; 19976, ZNF493, 100244, 202694, 110-2434; 19977, ZNF496, 100250, 202700, 1-1539; 19977, ZNF496, 100249, 202699, 466-2229; 19978, ZNF497, 100253, 202703, 467-792; 19978, ZNF497, 100251, 202701, 190-1686; 19978, ZNF497, 100252, 202702, 187-1683; 19979, ZNF500, 100256, 202706, 329-604; 19979, ZNF500, 100257, 202707, 1-220; 19979, ZNF500, 100258, 202708, 27-455; 19979, ZNF500, 100259, 202709, 145-507; 19979, ZNF500, 100260, 202710, 236-312; 19979, ZNF500, 100254, 202704, 301-1743; 19979, ZNF500, 100255, 202705, 299-1624; 19980, ZNF501, 100263, 202713, 721-1536; 19980, ZNF501, 100264, 202714, 438-1253; 19980, ZNF501, 100261, 202711, 438-1253; 19980, ZNF501, 100262, 202712, 721-1536; 19981, ZNF502, 100267, 202717, 129-593; 19981, ZNF502, 100269, 202719, 155-1789; 19981, ZNF502, 100270, 202720, 162-1796; 19981, ZNF502, 100271, 202721, 257-1891; 19981, ZNF502, 100272, 202722, 129-593; 19981, ZNF502, 100265, 202715, 257-1891; 19981, ZNF502, 100266, 202716, 162-1796; 19981, ZNF502, 100268, 202718, 155-1789; 19982, ZNF503, 100274, 202724, 337-1188; 19982, ZNF503, 100273, 202723, 488-2428; 19983, ZNF506, 100278, 202728, 120-356; 19983, ZNF506, 100279, 202729, 130-543; 19983, ZNF506, 100280, 202730, 108-386; 19983, ZNF506, 100281, 202731, 108-429; 19983, ZNF506, 100283, 202733, 126-571; 19983, ZNF506, 100284, 202734, 138-464; 19983, ZNF506, 100275, 202725, 107-1441; 19983, ZNF506, 100276, 202726, 147-1385; 19983, ZNF506, 100277, 202727, 90-1424; 19983, ZNF506, 100282, 202732, 149-1483; 19984, ZNF507, 100287, 202737, 209-3082; 19984, ZNF507, 100285, 202735, 193-3054; 19984, ZNF507, 100286, 202736, 162-3023; 19985, ZNF510, 100289, 202739, 273-675; 19985, ZNF510, 100288, 202738, 190-2241; 19985, ZNF510, 100290, 202740, 652-2703; 19986, ZNF511, 100291, 202741, 4-792; 19986, ZNF511, 100292, 202742, 470-1228; 19987, ZNF512, 100294, 202744, 84-1784; 19987, ZNF512, 100293, 202743, 84-1787; 19987, ZNF512, 100295, 202745, 477-1949; 19987, ZNF512, 100296, 202746, 145-1761; 19987, ZNF512, 100297, 202747, 317-1789; 19988, ZNF512B, 100298, 202748, 52-2730; 19988, ZNF512B, 100299, 202749, 55-2733; 19988, ZNF512B, 100300, 202750, 60-2738; 19989, ZNF513, 100303, 202753, 162-510; 19989, ZNF513, 100301, 202751, 200-1825; 19989, ZNF513, 100302, 202752, 328-1767; 19990, ZNF514, 100305, 202755, 342-554; 19990, ZNF514, 100304, 202754, 464-1666; 19990, ZNF514, 100306, 202756, 574-1776; 19991, ZNF516, 100308, 202758, 1-76; 19991, ZNF516, 100309, 202759, 257-482; 19991, ZNF516, 100310, 202760, 1-1553; 19991, ZNF516, 100307, 202757, 319-3810; 19992, ZNF517, 100312, 202762, 1-1379; 19992, ZNF517, 100313, 202763, 46-474; 19992, ZNF517, 100315, 202765, 67-456; 19992, ZNF517, 100311, 202761, 108-1586; 19992, ZNF517, 100314, 202764, 108-1586; 19992, ZNF517, 100316, 202766, 46-1524; 19993, ZNF518A, 100318, 202768, 565-1579; 19993, ZNF518A, 100317, 202767, 858-5309; 19993, ZNF518A, 100319, 202769, 482-4933; 19993, ZNF518A, 100320, 202770, 565-5016; 19994, ZNF518B, 100322, 202772, 301-527; 19994, ZNF518B, 100321, 202771, 440-3664; 19995, ZNF519, 100324, 202774, 152-394; 19995, ZNF519, 100325, 202775, 153-305; 19995, ZNF519, 100323, 202773, 154-1776; 19996, ZNF521, 100327, 202777, 69-3803; 19996, ZNF521, 100329, 202779, 21-694; 19996, ZNF521, 100330, 202780, 248-338; 19996, ZNF521, 100331, 202781, 765-4040; 19996, ZNF521, 100332, 202782, 1-552; 19996, ZNF521, 100333, 202783, 116-547; 19996, ZNF521, 100326, 202776, 150-4085; 19996, ZNF521, 100328, 202778, 199-4134; 19997, ZNF524, 100336, 202786, 99-489; 19997, ZNF524, 100334, 202784, 79-873; 19997, ZNF524, 100335, 202785, 235-1029; 19998, ZNF525, 100337, 202787, 135-1574; 19998, ZNF525, 100338, 202788, 115-267; 19998, ZNF525, 100339, 202789, 202-1533; 19998, ZNF525, 100340, 202790, 124-483; 19998, ZNF525, 100341, 202791, 99-257; 19998, ZNF525, 100342, 202792, 1-156; 19999, ZNF526, 100344, 202794, 368-573; 19999, ZNF526, 100343, 202793, 226-2238; 20000, ZNF527, 100345, 202795, 88-372; 20000, ZNF527, 100347, 202797, 75-515; 20000, ZNF527, 100348, 202798, 92-268; 20000, ZNF527, 100349, 202799, 110-484; 20000, ZNF527, 100350, 202800, 108-580; 20000, ZNF527, 100346, 202796, 108-1937; 20001, ZNF528, 100352, 202802, 340-582; 20001, ZNF528, 100353, 202803, 524-895; 20001, ZNF528, 100354, 202804, 1-256; 20001, ZNF528, 100355, 202805, 423-465; 20001, ZNF528, 100356, 202806, 566-590; 20001, ZNF528, 100357, 202807, 570-579; 20001, ZNF528, 100358, 202808, 21-341; 20001, ZNF528, 100359, 202809, 68-343; 20001, ZNF528, 100351, 202801, 427-2313; 20002, ZNF529, 100360, 202810, 612-1988; 20002, ZNF529, 100362, 202812, 332-587; 20002, ZNF529, 100363, 202813, 1-338; 20002, ZNF529, 100364, 202814, 260-535; 20002, ZNF529, 100365, 202815, 1-219; 20002, ZNF529, 100366, 202816, 252-582; 20002, ZNF529, 100361, 202811, 160-1851; 20003, ZNF530, 100368, 202818, 354-440; 20003, ZNF530, 100369, 202819, 372-469; 20003, ZNF530, 100367, 202817, 221-2020; 20003, ZNF530, 100370, 202820, 221-2020; 20004, ZNF532, 100372, 202822, 1-372; 20004, ZNF532, 100373, 202823, 396-676; 20004, ZNF532, 100375, 202825, 335-578; 20004, ZNF532, 100376, 202826, 294-649; 20004, ZNF532, 100377, 202827, 111-591; 20004, ZNF532, 100379, 202829, 1-355; 20004, ZNF532, 100380, 202830, 357-561; 20004, ZNF532, 100381, 202831, 1-351; 20004, ZNF532, 100382, 202832, 249-569; 20004, ZNF532, 100383, 202833, 309-672; 20004, ZNF532, 100384, 202834, 1-388; 20004, ZNF532, 100385, 202835, 210-583; 20004, ZNF532, 100386, 202836, 271-490; 20004, ZNF532, 100389, 202839, 155-562; 20004, ZNF532, 100371, 202821, 777-4682; 20004, ZNF532, 100374, 202824, 355-4260; 20004, ZNF532, 100378, 202828, 202-4107; 20004, ZNF532, 100387, 202837, 890-4795; 20004, ZNF532, 100388, 202838, 347-4252; 20005, ZNF534, 100390, 202840, 126-707; 20005, ZNF534, 100393, 202843, 62-514; 20005, ZNF534, 100394, 202844, 62-643; 20005, ZNF534, 100391, 202841, 62-2086; 20005, ZNF534, 100392, 202842, 62-2047; 20006, ZNF536, 100396, 202846, 240-655; 20006, ZNF536, 100397, 202847, 350-3198; 20006, ZNF536, 100398, 202848, 1-414; 20006, ZNF536, 100395, 202845, 148-4050; 20007, ZNF540, 100401, 202851, 383-2038; 20007, ZNF540, 100404, 202854, 264-563; 20007, ZNF540, 100405, 202855, 196-285; 20007, ZNF540, 100399, 202849, 283-2265; 20007, ZNF540, 100400, 202850, 259-2241; 20007, ZNF540, 100402, 202852, 333-2315; 20007, ZNF540, 100403, 202853, 339-2225; 20008, ZNF541, 100406, 202856, 1-2039; 20008, ZNF541, 100407, 202857, 1-4098; 20008, ZNF541, 100409, 202859, 1-2600; 20008, ZNF541, 100408, 202858, 1-4041; 20009, ZNF543, 100410, 202860, 346-2148; 20010, ZNF544, 100412, 202862, 265-555; 20010, ZNF544, 100413, 202863, 351-2072; 20010, ZNF544, 100415, 202865, 235-528; 20010, ZNF544, 100416, 202866, 232-651; 20010, ZNF544, 100417, 202867, 270-494; 20010, ZNF544, 100418, 202868, 585-812; 20010, ZNF544, 100419, 202869, 235-2298; 20010, ZNF544, 100420, 202870, 514-741; 20010, ZNF544, 100421, 202871, 265-492; 20010, ZNF544, 100422, 202872, 270-2333; 20010, ZNF544, 100423, 202873, 63-383; 20010, ZNF544, 100411, 202861, 62-2209; 20010, ZNF544, 100414, 202864, 235-2382; 20011, ZNF546, 100425, 202875, 184-561; 20011, ZNF546, 100426, 202876, 208-626; 20011, ZNF546, 100427, 202877, 230-2662; 20011, ZNF546, 100428, 202878, 257-370; 20011, ZNF546, 100429, 202879, 169-542; 20011, ZNF546, 100430, 202880, 208-626; 20011, ZNF546, 100431, 202881, 169-542; 20011, ZNF546, 100432, 202882, 184-561; 20011, ZNF546, 100433, 202883, 217-2727; 20011, ZNF546, 100434, 202884, 230-2662; 20011, ZNF546, 100435, 202885, 257-370; 20011, ZNF546, 100424, 202874, 217-2727; 20012, ZNF547, 100437, 202887, 478-602; 20012, ZNF547, 100438, 202888, 127-570; 20012, ZNF547, 100439, 202889, 240-377; 20012, ZNF547, 100436, 202886, 151-1359; 20013, ZNF548, 100442, 202892, 398-569; 20013, ZNF548, 100443, 202893, 217-480; 20013, ZNF548, 100444, 202894, 337-563; 20013, ZNF548, 100445, 202895, 96-266; 20013, ZNF548, 100446, 202896, 274-616; 20013, ZNF548, 100447, 202897, 96-287; 20013, ZNF548, 100448, 202898, 136-279; 20013, ZNF548, 100449, 202899, 419-552; 20013, ZNF548, 100450, 202900, 226-417; 20013, ZNF548, 100440, 202890, 204-1841; 20013, ZNF548, 100441, 202891, 251-1852; 20014, ZNF549, 100453, 202903, 149-463; 20014, ZNF549, 100454, 202904, 154-195; 20014, ZNF549, 100451, 202901, 250-2133; 20014, ZNF549, 100452, 202902, 182-2104; 20015, ZNF550, 100455, 202905, 4-1149; 20015, ZNF550, 100456, 202906, 1-1019; 20015, ZNF550, 100461, 202911, 131-508; 20015, ZNF550, 100457, 202907, 182-1450; 20015, ZNF550, 100458, 202908, 182-1450; 20015, ZNF550, 100459, 202909, 182-1450; 20015, ZNF550, 100460, 202910, 182-1450; 20016, ZNF551, 100463, 202913, 178-354; 20016, ZNF551, 100464, 202914, 158-1826; 20016, ZNF551, 100462, 202912, 186-2198; 20017, ZNF552, 100466, 202916, 171-320; 20017, ZNF552, 100467, 202917, 1-188; 20017, ZNF552, 100465, 202915, 171-1394; 20018, ZNF554, 100469, 202919, 154-360; 20018, ZNF554, 100470, 202920, 123-668; 20018, ZNF554, 100468, 202918, 199-1815; 20019, ZNF555, 100472, 202922, 141-475; 20019, ZNF555, 100471, 202921, 139-2025; 20019, ZNF555, 100473, 202923, 130-2013; 20020, ZNF556, 100475, 202925, 88-297; 20020, ZNF556, 100476, 202926, 88-1455; 20020, ZNF556, 100474, 202924, 88-1458; 20021, ZNF557, 100477, 202927, 502-1794; 20021, ZNF557, 100478, 202928, 241-1512; 20022, ZNF558, 100479, 202929, 231-1439; 20022, ZNF558, 100480, 202930, 713-1921; 20023, ZNF559, 100483, 202933, 455-571; 20023, ZNF559, 100484, 202934, 331-780; 20023, ZNF559, 100485, 202935, 559-801; 20023, ZNF559, 100486, 202936, 313-651; 20023, ZNF559, 100487, 202937, 1-159; 20023, ZNF559, 100489, 202939, 256-783; 20023, ZNF559, 100490, 202940, 408-2216; 20023, ZNF559, 100491, 202941, 385-588; 20023, ZNF559, 100492, 202942, 127-569; 20023, ZNF559, 100493, 202943, 1-1575; 20023, ZNF559, 100481, 202931, 263-517; 20023, ZNF559, 100482, 202932, 649-2265; 20023, ZNF559, 100488, 202938, 193-447; 20023, ZNF559, 100494, 202944, 663-2279; 20024, ZNF560, 100495, 202945, 215-2587; 20025, ZNF561, 100497, 202947, 196-468; 20025, ZNF561, 100498, 202948, 197-382; 20025, ZNF561, 100499, 202949, 169-1031; 20025, ZNF561, 100500, 202950, 292-1545; 20025, ZNF561, 100501, 202951, 334-561; 20025, ZNF561, 100502, 202952, 198-329; 20025, ZNF561, 100503, 202953, 197-313; 20025, ZNF561, 100504, 202954, 236-367; 20025, ZNF561, 100505, 202955, 443-566; 20025, ZNF561, 100496, 202946, 365-1825; 20026, ZNF562, 100508, 202958, 199-1476; 20026, ZNF562, 100509, 202959, 144-491; 20026, ZNF562, 100510, 202960, 197-328; 20026, ZNF562, 100511, 202961, 225-585; 20026, ZNF562, 100512, 202962, 169-444; 20026, ZNF562, 100513, 202963, 548-577; 20026, ZNF562, 100506, 202956, 175-1239; 20026, ZNF562, 100507, 202957, 161-1441; 20027, ZNF563, 100515, 202965, 239-928; 20027, ZNF563, 100516, 202966, 168-749; 20027, ZNF563, 100517, 202967, 178-564; 20027, ZNF563, 100514, 202964, 207-1637; 20028, ZNF564, 100519, 202969, 103-168; 20028, ZNF564, 100520, 202970, 136-345; 20028, ZNF564, 100521, 202971, 420-524; 20028, ZNF564, 100518, 202968, 198-1859; 20029, ZNF565, 100525, 202975, 439-1217; 20029, ZNF565, 100526, 202976, 415-583; 20029, ZNF565, 100522, 202972, 118-1617; 20029, ZNF565, 100523, 202973, 728-2347; 20029, ZNF565, 100524, 202974, 260-1759; 20030, ZNF566, 100528, 202978, 112-584; 20030, ZNF566, 100530, 202980, 93-793; 20030, ZNF566, 100532, 202982, 525-1469; 20030, ZNF566, 100533, 202983, 1-234; 20030, ZNF566, 100527, 202977, 148-1407; 20030, ZNF566, 100529, 202979, 93-1349; 20030, ZNF566, 100531, 202981, 83-1339; 20031, ZNF567, 100536, 202986, 1-195; 20031, ZNF567, 100538, 202988, 141-1919; 20031, ZNF567, 100539, 202989, 1-153; 20031, ZNF567, 100534, 202984, 183-2033; 20031, ZNF567, 100535, 202985, 223-2166; 20031, ZNF567, 100537, 202987, 1231-3081; 20032, ZNF568, 100541, 202991, 484-2232; 20032, ZNF568, 100543, 202993, 578-1725; 20032, ZNF568, 100544, 202994, 519-1034; 20032, ZNF568, 100545, 202995, 323-561; 20032, ZNF568, 100547, 202997, 580-699; 20032, ZNF568, 100548, 202998, 232-308; 20032, ZNF568, 100549, 202999, 341-516; 20032, ZNF568, 100550, 203000, 324-1914; 20032, ZNF568, 100551, 203001, 531-552; 20032, ZNF568, 100552, 203002, 149-1282; 20032, ZNF568, 100554, 203004, 201-2108; 20032, ZNF568, 100540, 202990, 507-2441; 20032, ZNF568, 100542, 202992, 377-2119; 20032, ZNF568, 100546, 202996, 330-2045; 20032, ZNF568, 100553, 203003, 210-2144; 20033, ZNF569, 100558, 203008, 576-789; 20033, ZNF569, 100559, 203009, 330-395; 20033, ZNF569, 100560, 203010, 936-1716; 20033, ZNF569, 100561, 203011, 214-528; 20033, ZNF569, 100555, 203005, 559-2619; 20033, ZNF569, 100556, 203006, 187-2247; 20033, ZNF569, 100557, 203007, 293-1876; 20034, ZNF57, 100563, 203013, 146-1717; 20034, ZNF57, 100564, 203014, 272-713; 20034, ZNF57, 100565, 203015, 171-623; 20034, ZNF57, 100566, 203016, 149-1822; 20034, ZNF57, 100562, 203012, 149-1816; 20035, ZNF570, 100568, 203018, 191-451; 20035, ZNF570, 100569, 203019, 296-430; 20035, ZNF570, 100570, 203020, 120-1898; 20035, ZNF570, 100571, 203021, 137-581; 20035, ZNF570, 100572, 203022, 307-441; 20035, ZNF570, 100567, 203017, 530-2140; 20036, ZNF571, 100576, 203026, 42-293; 20036, ZNF571, 100578, 203028, 185-613; 20036, ZNF571, 100573, 203023, 120-1949; 20036, ZNF571, 100574, 203024, 191-2020; 20036, ZNF571, 100575, 203025, 102-1931; 20036, ZNF571, 100577, 203027, 730-2559; 20037, ZNF572, 100579, 203029, 155-1744; 20038, ZNF573, 100582, 203032, 54-476; 20038, ZNF573, 100586, 203036, 65-379; 20038, ZNF573, 100587, 203037, 17-331; 20038, ZNF573, 100588, 203038, 33-365; 20038, ZNF573, 100589, 203039, 43-177; 20038, ZNF573, 100590, 203040, 40-417; 20038, ZNF573, 100591, 203041, 177-482; 20038, ZNF573, 100580, 203030, 1-1824; 20038, ZNF573, 100581, 203031, 201-1934; 20038, ZNF573, 100583, 203033, 340-2076; 20038, ZNF573, 100584, 203034, 70-2067; 20038, ZNF573, 100585, 203035, 23-2020; 20039, ZNF574, 100592, 203042, 236-3196; 20039, ZNF574, 100595, 203045, 483-858; 20039, ZNF574, 100596, 203046, 1292-2926; 20039, ZNF574, 100593, 203043, 142-2832; 20039, ZNF574, 100594, 203044, 656-3346; 20040, ZNF575, 100598, 203048, 808-1842; 20040, ZNF575, 100599, 203049, 234-536; 20040, ZNF575, 100597, 203047, 513-1250; 20040, ZNF575, 100600, 203050, 235-972; 20041, ZNF576, 100601, 203051, 155-667; 20041, ZNF576, 100602, 203052, 210-722; 20041, ZNF576, 100603, 203053, 162-674; 20041, ZNF576, 100604, 203054, 119-631; 20041, ZNF576, 100605, 203055, 80-592; 20041, ZNF576, 100606, 203056, 703-1215; 20042, ZNF577, 100609, 203059, 1350-1685; 20042, ZNF577, 100610, 203060, 1319-2758; 20042, ZNF577, 100611, 203061, 380-512; 20042, ZNF577, 100613, 203063, 337-523; 20042, ZNF577, 100614, 203064, 399-573; 20042, ZNF577, 100615, 203065, 266-444; 20042, ZNF577, 100616, 203066, 410-453; 20042, ZNF577, 100607, 203057, 367-1824; 20042, ZNF577, 100608, 203058, 416-1696; 20042, ZNF577, 100612, 203062, 1335-2615; 20043, ZNF578, 100618, 203068, 54-814; 20043, ZNF578, 100617, 203067, 245-2017; 20044, ZNF579, 100620, 203070, 452-497; 20044, ZNF579, 100619, 203069, 30-1718; 20045, ZNF580, 100624, 203074, 270-335; 20045, ZNF580, 100625, 203075, 65-377; 20045, ZNF580, 100626, 203076, 710-1019; 20045, ZNF580, 100621, 203071, 301-819; 20045, ZNF580, 100622, 203072, 747-1265; 20045, ZNF580, 100623, 203073, 65-583; 20046, ZNF581, 100629, 203079, 173-591; 20046, ZNF581, 100627, 203077, 248-841; 20046, ZNF581, 100628, 203078, 274-867; 20046, ZNF581, 100630, 203080, 51-644; 20047, ZNF582, 100633, 203083, 275-509; 20047, ZNF582, 100634, 203084, 178-712; 20047, ZNF582, 100635, 203085, 190-733; 20047, ZNF582, 100636, 203086, 118-427; 20047, ZNF582, 100631, 203081, 160-1713; 20047, ZNF582, 100632, 203082, 407-1960; 20047, ZNF582, 100637, 203087, 160-1713; 20048, ZNF583, 100639, 203089, 171-582; 20048, ZNF583, 100641, 203091, 166-554; 20048, ZNF583, 100638, 203088, 166-1875; 20048, ZNF583, 100640, 203090, 211-1920; 20049, ZNF584, 100643, 203093, 372-809; 20049, ZNF584, 100644, 203094, 467-748; 20049, ZNF584, 100645, 203095, 531-1661; 20049, ZNF584, 100646, 203096, 460-558; 20049, ZNF584, 100647, 203097, 475-562; 20049, ZNF584, 100642, 203092, 524-1789; 20050, ZNF585A, 100649, 203099, 527-2671; 20050, ZNF585A, 100650, 203100, 467-2611; 20050, ZNF585A, 100651, 203101, 213-290; 20050, ZNF585A, 100652, 203102, 245-586; 20050, ZNF585A, 100648, 203098, 260-2569; 20051, ZNF585B, 100653, 203103, 235-405; 20051, ZNF585B, 100655, 203105, 209-316; 20051, ZNF585B, 100656, 203106, 188-661; 20051, ZNF585B, 100657, 203107, 420-2564; 20051, ZNF585B, 100658, 203108, 137-548; 20051, ZNF585B, 100659, 203109, 217-399; 20051, ZNF585B, 100660, 203110, 44-298; 20051, ZNF585B, 100654, 203104, 253-2562; 20052, ZNF586, 100664, 203114, 183-488; 20052, ZNF586, 100665, 203115, 177-407; 20052, ZNF586, 100666, 203116, 174-245; 20052, ZNF586, 100661, 203111, 368-1447; 20052, ZNF586, 100662, 203112, 148-780; 20052, ZNF586, 100663, 203113, 174-1382; 20053, ZNF587, 100669, 203119, 232-1830; 20053, ZNF587, 100667, 203117, 183-1910; 20053, ZNF587, 100668, 203118, 180-1904; 20054, ZNF587B, 100671, 203121, 217-2118; 20054, ZNF587B, 100672, 203122, 376-1670; 20054, ZNF587B, 100670, 203120, 235-1443; 20055, ZNF589, 100674, 203124, 73-363; 20055, ZNF589, 100675, 203125, 18-287; 20055, ZNF589, 100676, 203126, 72-314; 20055, ZNF589, 100678, 203128, 67-600; 20055, ZNF589, 100673, 203123, 73-1167; 20055, ZNF589, 100677, 203127, 44-1138; 20056, ZNF592, 100681, 203131, 73-2649; 20056, ZNF592, 100679, 203129, 23-3826; 20056, ZNF592, 100680, 203130, 289-4092; 20057, ZNF593, 100682, 203132, 43-513; 20057, ZNF593, 100683, 203133, 114-518; 20058, ZNF594, 100686, 203136, 452-757; 20058, ZNF594, 100684, 203134, 142-2565; 20058, ZNF594, 100685, 203135, 157-2580; 20059, ZNF595, 100687, 203137, 186-443; 20059, ZNF595, 100688, 203138, 530-1927; 20059, ZNF595, 100689, 203139, 195-2045; 20059, ZNF595, 100690, 203140, 205-2151; 20060, ZNF596, 100694, 203144, 451-581; 20060, ZNF596, 100695, 203145, 204-643; 20060, ZNF596, 100696, 203146, 346-564; 20060, ZNF596, 100697, 203147, 251-484; 20060, ZNF596, 100698, 203148, 316-522; 20060, ZNF596, 100699, 203149, 314-714; 20060, ZNF596, 100691, 203141, 289-1803; 20060, ZNF596, 100692, 203142, 204-1718; 20060, ZNF596, 100693, 203143, 371-1885; 20061, ZNF597, 100700, 203150, 237-1511; 20062, ZNF598, 100702, 203152, 1-272; 20062, ZNF598, 100703, 203153, 168-2717; 20062, ZNF598, 100704, 203154, 244-2793; 20062, ZNF598, 100705, 203155, 1-611; 20062, ZNF598, 100701, 203151, 75-2789; 20063, ZNF599, 100707, 203157, 360-608; 20063, ZNF599, 100706, 203156, 375-2141; 20063, ZNF599, 100708, 203158, 389-676; 20064, ZNF600, 100710, 203160, 47-1573; 20064, ZNF600, 100709, 203159, 269-2437; 20065, ZNF605, 100711, 203161, 350-2275; 20065, ZNF605, 100712, 203162, 227-2245; 20066, ZNF606, 100714, 203164, 92-301; 20066, ZNF606, 100715, 203165, 92-268; 20066, ZNF606, 100716, 203166, 484-2009; 20066, ZNF606, 100717, 203167, 452-651; 20066, ZNF606, 100718, 203168, 90-356; 20066, ZNF606, 100719, 203169, 476-685; 20066, ZNF606, 100713, 203163, 622-3000; 20067, ZNF607, 100722, 203172, 186-494; 20067, ZNF607, 100723, 203173, 212-549; 20067, ZNF607, 100724, 203174, 530-741; 20067, ZNF607, 100720, 203170, 597-2687; 20067, ZNF607, 100721, 203171, 249-2336; 20068, ZNF608, 100726, 203176, 617-2737; 20068, ZNF608, 100727, 203177, 459-2605; 20068, ZNF608, 100728, 203178, 93-1436; 20068, ZNF608, 100730, 203180, 124-1467; 20068, ZNF608, 100725, 203175, 437-4975; 20068, ZNF608, 100729, 203179, 485-3742; 20069, ZNF609, 100732, 203182, 225-1220; 20069, ZNF609, 100731, 203181, 129-4364; 20070, ZNF610, 100736, 203186, 327-581; 20070, ZNF610, 100733, 203183, 407-1795; 20070, ZNF610, 100734, 203184, 376-1764; 20070, ZNF610, 100735, 203185, 457-1845; 20070, ZNF610, 100737, 203187, 453-1712; 20070, ZNF610, 100738, 203188, 29-1288; 20070, ZNF610, 100739, 203189, 29-1417; 20071, ZNF611, 100744, 203194, 266-412; 20071, ZNF611, 100745, 203195, 170-397; 20071, ZNF611, 100747, 203197, 144-531; 20071, ZNF611, 100748, 203198, 240-434; 20071, ZNF611, 100749, 203199, 383-577; 20071, ZNF611, 100750, 203200, 77-346; 20071, ZNF611, 100752, 203202, 156-398; 20071, ZNF611, 100753, 203203, 69-263; 20071, ZNF611, 100740, 203190, 318-2435; 20071, ZNF611, 100741, 203191, 276-2393; 20071, ZNF611, 100742, 203192, 176-2293; 20071, ZNF611, 100743, 203193, 346-2256; 20071, ZNF611, 100746, 203196, 280-2190; 20071, ZNF611, 100751, 203201, 62-1972; 20072, ZNF613, 100756, 203206, 261-542; 20072, ZNF613, 100757, 203207, 352-606; 20072, ZNF613, 100754, 203204, 680-2533; 20072, ZNF613, 100755, 203205, 465-2210; 20072, ZNF613, 100758, 203208, 228-2081; 20073, ZNF614, 100761, 203211, 602-718; 20073, ZNF614, 100762, 203212, 313-

555; 20073, ZNF614, 100759, 203209, 546-2303; 20073, ZNF614, 100760, 203210, 325-921; 20074, ZNF615, 100764, 203214, 61-2271; 20074, ZNF615, 100765, 203215, 265-561; 20074, ZNF615, 100766, 203216, 213-509; 20074, ZNF615, 100767, 203217, 32-343; 20074, ZNF615, 100769, 203219, 96-577; 20074, ZNF615, 100771, 203221, 273-561; 20074, ZNF615, 100772, 203222, 558-581; 20074, ZNF615, 100775, 203225, 39-2261; 20074, ZNF615, 100763, 203213, 318-2513; 20074, ZNF615, 100768, 203218, 290-2518; 20074, ZNF615, 100770, 203220, 246-2474; 20074, ZNF615, 100773, 203223, 351-2546; 20074, ZNF615, 100774, 203224, 1-2229; 20075, ZNF616, 100776, 203226, 92-316; 20075, ZNF616, 100777, 203227, 439-556; 20075, ZNF616, 100778, 203228, 268-477; 20075, ZNF616, 100780, 203230, 250-474; 20075, ZNF616, 100779, 203229, 263-2608; 20076, ZNF618, 100782, 203232, 32-1156; 20076, ZNF618, 100784, 203234, 32-942; 20076, ZNF618, 100781, 203231, 100-2685; 20076, ZNF618, 100783, 203233, 100-2964; 20076, ZNF618, 100785, 203235, 100-2865; 20077, ZNF619, 100789, 203239, 406-2109; 20077, ZNF619, 100791, 203241, 309-2012; 20077, ZNF619, 100792, 203242, 237-416; 20077, ZNF619, 100786, 203236, 406-2088; 20077, ZNF619, 100787, 203237, 1-1731; 20077, ZNF619, 100788, 203238, 257-1855; 20077, ZNF619, 100790, 203240, 308-2158; 20077, ZNF619, 100793, 203243, 1-1851; 20078, ZNF620, 100796, 203246, 184-533; 20078, ZNF620, 100797, 203247, 81-215; 20078, ZNF620, 100794, 203244, 150-1418; 20078, ZNF620, 100795, 203245, 250-1176; 20079, ZNF621, 100801, 203251, 108-565; 20079, ZNF621, 100802, 203252, 646-1632; 20079, ZNF621, 100798, 203248, 460-933; 20079, ZNF621, 100799, 203249, 453-1772; 20079, ZNF621, 100800, 203250, 224-1543; 20080, ZNF622, 100803, 203253, 128-1561; 20081, ZNF623, 100804, 203254, 350-1840; 20081, ZNF623, 100805, 203255, 229-1719; 20081, ZNF623, 100807, 203257, 350-1840; 20081, ZNF623, 100808, 203258, 229-1719; 20081, ZNF623, 100809, 203259, 214-1824; 20081, ZNF623, 100806, 203256, 214-1824; 20082, ZNF624, 100811, 203261, 274-605; 20082, ZNF624, 100812, 203262, 173-548; 20082, ZNF624, 100810, 203260, 93-2690; 20083, ZNF625, 100814, 203264, 157-342; 20083, ZNF625, 100815, 203265, 1-315; 20083, ZNF625, 100813, 203263, 172-1290; 20084, ZNF626, 100817, 203267, 97-501; 20084, ZNF626, 100819, 203269, 62-1684; 20084, ZNF626, 100816, 203266, 151-429; 20084, ZNF626, 100818, 203268, 148-1734; 20085, ZNF627, 100821, 203271, 491-541; 20085, ZNF627, 100822, 203272, 146-349; 20085, ZNF627, 100823, 203273, 418-591; 20085, ZNF627, 100820, 203270, 209-1594; 20086, ZNF628, 100824, 203274, 1-3177; 20086, ZNF628, 100825, 203275, 168-472; 20086, ZNF628, 100826, 203276, 554-3733; 20087, ZNF629, 100827, 203277, 209-2818; 20088, ZNF630, 100828, 203278, 936-2537; 20088, ZNF630, 100831, 203281, 253-519; 20088, ZNF630, 100832, 203282, 345-988; 20088, ZNF630, 100833, 203283, 420-541; 20088, ZNF630, 100834, 203284, 1-1932; 20088, ZNF630, 100835, 203285, 345-946; 20088, ZNF630, 100829, 203279, 228-2201; 20088, ZNF630, 100830, 203280, 568-2541; 20089, ZNF638, 100838, 203288, 341-931; 20089, ZNF638, 100839, 203289, 673-760; 20089, ZNF638, 100840, 203290, 409-595; 20089, ZNF638, 100841, 203291, 399-585; 20089, ZNF638, 100842, 203292, 623-731; 20089, ZNF638, 100843, 203293, 47-560; 20089, ZNF638, 100844, 203294, 321-590; 20089, ZNF638, 100845, 203295, 1-476; 20089, ZNF638, 100846, 203296, 333-626; 20089, ZNF638, 100847, 203297, 195-746; 20089, ZNF638, 100848, 203298, 365-3121; 20089, ZNF638, 100849, 203299, 411-871; 20089, ZNF638, 100850, 203300, 1-856; 20089, ZNF638, 100836, 203286, 315-6251; 20089, ZNF638, 100837, 203287, 631-6567; 20090, ZNF639, 100852, 203302, 175-564; 20090, ZNF639, 100854, 203304, 173-584; 20090, ZNF639, 100856, 203306, 580-1228; 20090, ZNF639, 100857, 203307, 253-1117; 20090, ZNF639, 100851, 203301, 446-1903; 20090, ZNF639, 100853, 203303, 384-1841; 20090, ZNF639, 100855, 203305, 83-1540; 20090, ZNF639, 100858, 203308, 1-1458; 20091, ZNF641, 100862, 203312, 326-556; 20091, ZNF641, 100863, 203313, 233-555; 20091, ZNF641, 100864, 203314, 1-154; 20091, ZNF641, 100865, 203315, 45-290; 20091, ZNF641, 100866, 203316, 166-575; 20091, ZNF641, 100859, 203309, 263-1579; 20091, ZNF641, 100860, 203310, 57-1304; 20091, ZNF641, 100861, 203311, 710-2026; 20091, ZNF641, 100867, 203317, 132-1406; 20092, ZNF644, 100872, 203322, 52-2004; 20092, ZNF644, 100868, 203318, 284-4267; 20092, ZNF644, 100869, 203319, 225-542; 20092, ZNF644, 100870, 203320, 323-640; 20092, ZNF644, 100871, 203321, 219-4202; 20093, ZNF645, 100873, 203323, 50-1327; 20094, ZNF646, 100876, 203326, 358-1077; 20094, ZNF646, 100877, 203327, 419-582; 20094, ZNF646, 100874, 203324, 290-5788; 20094, ZNF646, 100875, 203325, 424-5913; 20095, ZNF648, 100878, 203328, 209-1915; 20096, ZNF649, 100880, 203330, 286-1719; 20096, ZNF649, 100881, 203331, 442-564; 20096, ZNF649, 100882, 203332, 405-546; 20096, ZNF649, 100883, 203333, 601-730; 20096, ZNF649, 100879, 203329, 286-1803; 20097, ZNF652, 100886, 203336, 468-1748; 20097, ZNF652, 100884, 203334, 320-2140; 20097, ZNF652, 100885, 203335, 467-2287; 20098, ZNF653, 100888, 203338, 1-652; 20098, ZNF653, 100889, 203339, 1-104; 20098, ZNF653, 100890, 203340, 1-218; 20098, ZNF653, 100891, 203341, 1-508; 20098, ZNF653, 100887, 203337, 138-1985; 20099, ZNF654, 100892, 203342, 208-1953; 20100, ZNF655, 100897, 203347, 247-793; 20100, ZNF655, 100898, 203348, 90-242; 20100, ZNF655, 100899, 203349, 231-567; 20100, ZNF655, 100900, 203350, 103-414; 20100, ZNF655, 100901, 203351, 245-573; 20100, ZNF655, 100903, 203353, 147-542; 20100, ZNF655, 100905, 203355, 249-545; 20100, ZNF655, 100906, 203356, 250-561; 20100, ZNF655, 100907, 203357, 221-361; 20100, ZNF655, 100908, 203358, 245-616; 20100, ZNF655, 100909, 203359, 147-536; 20100, ZNF655, 100911, 203361, 394-705; 20100, ZNF655, 100893, 203343, 238-1713; 20100, ZNF655, 100894, 203344, 410-955; 20100, ZNF655, 100895, 203345, 394-726; 20100, ZNF655, 100896, 203346, 184-1659; 20100, ZNF655, 100902, 203352, 221-1801; 20100, ZNF655, 100904, 203354, 220-552; 20100, ZNF655, 100910, 203360, 98-1678; 20101, ZNF658, 100912, 203362, 238-2030; 20101, ZNF658, 100914, 203364, 294-584; 20101, ZNF658, 100917, 203367, 461-698; 20101, ZNF658, 100918, 203368, 176-642; 20101, ZNF658, 100913, 203363, 238-2091; 20101, ZNF658, 100915, 203365, 153-3332; 20101, ZNF658, 100916, 203366, 301-3480; 20102, ZNF66, 100919, 203369, 242-415; 20102, ZNF66, 100921, 203371, 139-756; 20102, ZNF66, 100922, 203372, 1-1806; 20102, ZNF66, 100923, 203373, 242-415; 20102, ZNF66, 100924, 203374, 139-462; 20102, ZNF66, 100920, 203370, 24-1745; 20103, ZNF660, 100926, 203376, 357-474; 20103, ZNF660, 100927, 203377, 455-556; 20103, ZNF660, 100928, 203378, 357-474; 20103, ZNF660, 100929, 203379, 455-556; 20103, ZNF660, 100925, 203375, 334-1329; 20103, ZNF660, 100930, 203380, 334-1329; 20104, ZNF662, 100933, 203383, 94-414; 20104, ZNF662, 100931, 203381, 187-1545; 20104, ZNF662, 100932, 203382, 532-1812; 20105, ZNF664, 100934, 203384, 950-1735; 20105, ZNF664, 100935, 203385, 981-1766; 20105, ZNF664, 100936, 203386, 1027-1812; 20105, ZNF664, 100937, 203387, 1831-2616; 20106, ZNF665, 100938, 203388, 91-2127; 20106, ZNF665, 100939, 203389, 117-1958; 20107, ZNF667, 100942, 203392, 270-522; 20107, ZNF667, 100943, 203393, 156-431; 20107, ZNF667, 100944, 203394, 93-567; 20107, ZNF667, 100945, 203395, 1430-1813; 20107, ZNF667, 100946, 203396, 408-1586; 20107, ZNF667, 100940, 203390, 163-1995; 20107, ZNF667, 100941, 203391, 721-2553; 20108, ZNF668, 100949, 203399, 111-386; 20108, ZNF668, 100951, 203401, 77-400; 20108, ZNF668, 100952, 203402, 312-802; 20108, ZNF668, 100947, 203397, 685-2544; 20108, ZNF668, 100948, 203398, 640-2499; 20108, ZNF668, 100950, 203400, 134-2062; 20108, ZNF668, 100953, 203403, 786-2645; 20108, ZNF668, 100954, 203404, 312-2171; 20108, ZNF668, 100955, 203405, 324-2252; 20109, ZNF669, 100957, 203407, 91-306; 20109, ZNF669, 100958, 203408, 80-265; 20109, ZNF669, 100960, 203410, 167-584; 20109, ZNF669, 100956, 203406, 174-1568; 20109, ZNF669, 100959, 203409, 170-1306; 20110, ZNF670, 100961, 203411, 160-1329; 20111, ZNF671, 100963, 203413, 47-1717; 20111, ZNF671, 100964, 203414, 88-258; 20111, ZNF671, 100965, 203415, 95-265; 20111, ZNF671, 100966, 203416, 86-409; 20111, ZNF671, 100962, 203412, 97-1701; 20112, ZNF672, 100968, 203418, 573-583; 20112, ZNF672, 100969, 203419, 773-883; 20112, ZNF672, 100970, 203420, 722-930; 20112, ZNF672, 100967, 203417, 747-2105; 20113, ZNF674, 100973, 203423, 195-493; 20113, ZNF674, 100971, 203421, 141-1868; 20113, ZNF674, 100972, 203422, 212-1957; 20114, ZNF675, 100975, 203425, 188-421; 20114, ZNF675, 100976, 203426, 165-518; 20114, ZNF675, 100977, 203427, 108-374; 20114, ZNF675, 100978, 203428, 180-536; 20114, ZNF675, 100979, 203429, 408-721; 20114, ZNF675, 100980, 203430, 156-461; 20114, ZNF675, 100981, 203431, 180-419; 20114, ZNF675, 100974, 203424, 170-1876; 20115, ZNF676, 100984, 203434, 70-1776; 20115, ZNF676, 100982, 203432, 319-2085; 20115, ZNF676, 100983, 203433, 319-2085; 20116, ZNF677, 100987, 203437, 154-387; 20116, ZNF677, 100988, 203438, 173-388; 20116, ZNF677, 100989, 203439, 140-346; 20116, ZNF677, 100990, 203440, 360-602; 20116, ZNF677, 100991, 203441, 186-622; 20116, ZNF677, 100992, 203442, 350-556; 20116, ZNF677, 100985, 203435, 81-1835; 20116, ZNF677, 100986, 203436, 152-1906; 20117, ZNF678, 100994, 203444, 116-798; 20117, ZNF678, 100996, 203446, 439-669; 20117, ZNF678, 100993, 203443, 346-1923; 20117, ZNF678, 100995, 203445, 1-1578; 20118, ZNF679, 100997, 203447, 1-1236; 20118, ZNF679, 100998, 203448, 270-1505; 20119, ZNF680, 100999, 203449, 153-1745; 20119, ZNF680, 101000, 203450, 88-459; 20120, ZNF681, 101002, 203452, 172-628; 20120, ZNF681, 101003, 203453, 148-526; 20120, ZNF681, 101001, 203451, 143-2080; 20121, ZNF682, 101007, 203457, 118-429; 20121, ZNF682, 101008, 203458, 1-157; 20121, ZNF682, 101009, 203459, 97-327; 20121, ZNF682, 101010, 203460, 23-1537; 20121, ZNF682, 101011, 203461, 198-609; 20121, ZNF682, 101013, 203463, 1-133; 20121, ZNF682, 101014, 203464, 121-369; 20121, ZNF682, 101004, 203454, 423-1823; 20121, ZNF682, 101005, 203455, 177-1577; 20121, ZNF682, 101006, 203456, 162-1658; 20121, ZNF682, 101012, 203462, 104-1372; 20122, ZNF683, 101018, 203468, 154-744; 20122, ZNF683, 101019, 203469, 288-853; 20122, ZNF683, 101020, 203470, 296-662; 20122, ZNF683, 101021, 203471, 233-1080; 20122, ZNF683, 101022, 203472, 128-936; 20122, ZNF683, 101023, 203473, 130-592; 20122, ZNF683, 101015, 203465, 82-1596; 20122, ZNF683, 101016, 203466, 79-1653; 20122, ZNF683, 101017, 203467, 122-1696; 20123, ZNF684, 101024, 203474, 150-428; 20123, ZNF684, 101025, 203475, 150-509; 20123, ZNF684, 101026, 203476, 252-1388; 20124, ZNF687, 101029, 203479, 453-893; 20124, ZNF687, 101030, 203480, 1-2120; 20124, ZNF687, 101031, 203481, 126-2483; 20124, ZNF687, 101032, 203482, 1-300; 20124, ZNF687, 101027, 203477, 971-4684; 20124, ZNF687, 101028, 203478, 147-3860; 20125, ZNF688, 101035, 203485, 1-427; 20125, ZNF688, 101036, 203486, 7-225; 20125, ZNF688, 101037, 203487, 24-356; 20125, ZNF688, 101033, 203483, 1106-1936; 20125, ZNF688, 101034, 203484, 460-1248; 20126, ZNF689, 101039, 203489, 334-1830; 20126, ZNF689, 101038, 203488, 339-1841; 20127, ZNF69, 101041, 203491, 107-569; 20127, ZNF69, 101040, 203490, 70-519; 20127, ZNF69, 101042, 203492, 141-1841; 20128, ZNF691, 101044, 203494, 105-993; 20128, ZNF691, 101045, 203495, 351-1271; 20128, ZNF691, 101049, 203499, 330-728; 20128, ZNF691, 101050, 203500, 1-921; 20128, ZNF691, 101043, 203493, 303-1250; 20128, ZNF691, 101046, 203496, 341-1195; 20128, ZNF691, 101047, 203497, 165-1019; 20128, ZNF691, 101048, 203498, 59-913; 20129, ZNF692, 101054, 203504, 164-481; 20129, ZNF692, 101055, 203505, 181-390; 20129, ZNF692, 101056, 203506, 114-356; 20129, ZNF692, 101057, 203507, 1-820; 20129, ZNF692, 101058, 203508, 261-656; 20129, ZNF692, 101059, 203509, 1-238; 20129, ZNF692, 101060, 203510, 84-293; 20129, ZNF692, 101061, 203511, 221-463; 20129, ZNF692, 101063, 203513, 1-494; 20129, ZNF692, 101064, 203514, 16-258; 20129, ZNF692, 101051, 203501, 168-1727; 20129, ZNF692, 101052, 203502, 84-1508; 20129, ZNF692, 101053, 203503, 347-1921; 20129, ZNF692, 101062, 203512, 405-695; 20130, ZNF695, 101067, 203517, 149-415; 20130, ZNF695, 101069, 203519, 149-514; 20130, ZNF695, 101065, 203515, 149-1696; 20130, ZNF695, 101066, 203516, 92-493; 20130, ZNF695, 101068, 203518, 186-704; 20131, ZNF696, 101071, 203521, 1031-1642; 20131, ZNF696, 101072, 203522, 240-576; 20131, ZNF696, 101073, 203523, 225-545; 20131, ZNF696, 101074, 203524, 395-508; 20131, ZNF696, 101075, 203525, 377-538; 20131, ZNF696, 101070, 203520, 410-1534; 20132, ZNF697, 101076, 203526, 121-1758; 20133, ZNF699, 101077, 203527, 1-1929; 20133, ZNF699, 101078, 203528, 230-2158; 20134, ZNF7, 101079, 203529, 96-575; 20134, ZNF7, 101081, 203531, 192-915; 20134, ZNF7, 101083, 203533, 47-451; 20134, ZNF7, 101084, 203534, 77-516; 20134, ZNF7, 101085, 203535, 77-545; 20134, ZNF7, 101087, 203537, 122-382; 20134, ZNF7, 101088, 203538, 299-2071; 20134, ZNF7, 101080, 203530, 97-2190; 20134, ZNF7, 101082, 203532, 241-2301; 20134, ZNF7, 101086, 203536, 97-543; 20135, ZNF70, 101089, 203539, 462-1802; 20136, ZNF700, 101091, 203541, 419-2593; 20136, ZNF700, 101092, 203542, 144-2381; 20136, ZNF700, 101090, 203540, 144-2372; 20137, ZNF701, 101096, 203546, 226-863; 20137, ZNF701, 101097, 203547, 144-579; 20137, ZNF701, 101093, 203543, 36-1631; 20137, ZNF701, 101094, 203544, 128-1525; 20137, ZNF701, 101095, 203545, 226-1821; 20138, ZNF703, 101098, 203548, 230-2002; 20139, ZNF704, 101100, 203550, 144-712; 20139, ZNF704, 101099, 203549, 233-1471; 20140, ZNF705A, 101102, 203552, 131-751; 20140, ZNF705A, 101103, 203553, 268-499; 20140, ZNF705A, 101104, 203554, 1-305; 20140, ZNF705A, 101101, 203551, 90-992; 20140, ZNF705A, 101105, 203555, 117-1019; 20141, ZNF70513, 101106, 203556, 283-1185; 20142, ZNF705D, 101107, 203557, 117-1019; 20142, ZNF705D, 101108, 203558, 23-925; 20143, ZNF705G, 101110, 203560, 283-1185; 20143, ZNF705G, 101109, 203559, 283-1185; 20144, ZNF706, 101113, 203563, 1-156; 20144, ZNF706, 101117, 203567, 367-493; 20144, ZNF706, 101118, 203568, 137-283; 20144, ZNF706, 101119, 203569, 463-488; 20144, ZNF706, 101122, 203572, 43-204; 20144, ZNF706, 101123, 203573, 1-92; 20144, ZNF706, 101111, 203561, 185-415; 20144, ZNF706, 101112, 203562, 30-260; 20144, ZNF706, 101114, 203564, 55-285; 20144, ZNF706, 101115, 203565, 214-444; 20144, ZNF706, 101116, 203566, 416-646; 20144, ZNF706, 101120, 203570, 410-640; 20144, ZNF706, 101121, 203571, 2958-3188; 20145, ZNF707, 101125, 203575, 287-454; 20145, ZNF707, 101127, 203577, 215-382; 20145, ZNF707, 101128, 203578, 140-307; 20145, ZNF707, 101129, 203579, 353-589; 20145, ZNF707, 101130, 203580, 144-311; 20145, ZNF707, 101131, 203581, 134-412; 20145, ZNF707, 101132, 203582, 215-382; 20145, ZNF707, 101133, 203583, 129-565; 20145, ZNF707, 101136, 203586, 123-525; 20145, ZNF707, 101137, 203587, 89-400; 20145, ZNF707, 101138, 203588, 421-562; 20145, ZNF707, 101139, 203589, 143-567; 20145, ZNF707, 101144, 203594, 129-565; 20145, ZNF707, 101145, 203595, 134-412; 20145, ZNF707, 101146, 203596, 215-382; 20145, ZNF707, 101147, 203597, 143-567; 20145, ZNF707, 101148, 203598, 140-307; 20145, ZNF707, 101149, 203599, 287-454; 20145, ZNF707, 101150, 203600, 215-382; 20145, ZNF707, 101151, 203601, 144-311; 20145, ZNF707, 101152, 203602, 89-400; 20145, ZNF707, 101153, 203603, 123-525; 20145, ZNF707, 101154, 203604, 353-589; 20145, ZNF707, 101155, 203605, 421-562; 20145, ZNF707, 101124, 203574, 213-1328; 20145, ZNF707, 101126, 203576, 696-1811; 20145, ZNF707, 101134, 203584, 900-2015; 20145, ZNF707, 101135, 203585, 276-1391; 20145, ZNF707, 101140, 203590, 696-1811; 20145, ZNF707, 101141, 203591, 213-1328; 20145, ZNF707, 101142, 203592, 900-2015; 20145, ZNF707, 101143, 203593, 276-1391; 20146, ZNF708, 101157, 203607, 190-567; 20146, ZNF708, 101158, 203608, 396-590; 20146, ZNF708, 101159, 203609, 214-330; 20146, ZNF708, 101160, 203610, 87-1673; 20146, ZNF708, 101156, 203606, 199-1890; 20147, ZNF709, 101162, 203612, 1-400; 20147, ZNF709, 101161, 203611, 173-2098; 20148, ZNF71, 101164, 203614, 398-783; 20148, ZNF71, 101163, 203613, 235-1704; 20149, ZNF710, 101166, 203616, 96-332; 20149, ZNF710, 101167, 203617, 1-482; 20149, ZNF710, 101168, 203618, 1-1164; 20149, ZNF710, 101165, 203615, 252-2246; 20150, ZNF711, 101169, 203619, 509-2794; 20150, ZNF711, 101170, 203620, 887-3310; 20150, ZNF711, 101171, 203621, 307-2592; 20151, ZNF713, 101172, 203622, 789-2120; 20151, ZNF713, 101173, 203623, 752-907; 20151, ZNF713, 101174, 203624, 39-1331; 20152, ZNF714, 101175, 203625, 323-577; 20152, ZNF714, 101176, 203626, 352-684; 20152, ZNF714, 101177, 203627, 317-1984; 20152, ZNF714, 101178, 203628, 326-1993; 20152, ZNF714, 101179, 203629, 492-577; 20152, ZNF714, 101180, 203630, 276-443; 20152, ZNF714, 101181, 203631, 323-577; 20152, ZNF714, 101182, 203632, 204-649; 20152, ZNF714, 101183, 203633, 231-647; 20153, ZNF716, 101184, 203634, 113-1600; 20154, ZNF717, 101185, 203635, 173-517; 20154, ZNF717, 101186, 203636, 278-608; 20154, ZNF717, 101187, 203637, 278-2872; 20154, ZNF717, 101188, 203638, 382-562; 20155, ZNF718, 101189, 203639, 853-2193; 20155, ZNF718, 101190, 203640, 192-1628; 20156, ZNF720, 101192, 203642, 165-413; 20156, ZNF720, 101193, 203643, 157-513; 20156, ZNF720, 101194, 203644, 189-347; 20156, ZNF720, 101195, 203645, 131-570; 20156, ZNF720, 101196, 203646, 128-518; 20156, ZNF720, 101197, 203647, 202-372; 20156, ZNF720, 101199, 203649, 205-363; 20156, ZNF720, 101191, 203641, 200-580; 20156, ZNF720, 101198, 203648, 161-697; 20157, ZNF721, 101201, 203651, 185-664; 20157, ZNF721, 101202, 203652, 160-558; 20157, ZNF721, 101204, 203654, 69-254; 20157, ZNF721, 101200, 203650, 50-2785; 20157, ZNF721, 101203, 203653, 195-2966; 20158, ZNF724P, 101206, 203656, 149-382; 20158, ZNF724P, 101207, 203657, 287-583; 20158, ZNF724P, 101205, 203655, 119-1978; 20159, ZNF726, 101208, 203658, 114-2330; 20159, ZNF726, 101209, 203659, 119-445; 20159, ZNF726, 101211, 203661, 120-389; 20159, ZNF726, 101212, 203662, 77-406; 20159, ZNF726, 101210, 203660, 114-347; 20159, ZNF726, 101213, 203663, 106-1956; 20160, ZNF727, 101214, 203664, 180-1679; 20161, ZNF728, 101215, 203665, 1-230; 20161, ZNF728, 101216, 203666, 147-2015; 20162, ZNF729, 101218, 203668, 119-148; 20162, ZNF729, 101217, 203667, 119-3877; 20163, ZNF730, 101219, 203669, 1-241; 20163, ZNF730, 101220, 203670, 272-409; 20163, ZNF730, 101221, 203671, 200-1711; 20164, ZNF732, 101223, 203673, 1-1755; 20164, ZNF732, 101222, 203672, 12-1769; 20165, ZNF735, 101224, 203674, 114-1352; 20166, ZNF736, 101226, 203676, 533-562; 20166, ZNF736, 101225, 203675, 323-1606; 20166, ZNF736, 101227, 203677, 123-1406; 20167, ZNF737, 101229, 203679, 140-271; 20167, ZNF737, 101230, 203680, 172-872; 20167, ZNF737, 101231, 203681, 170-565; 20167, ZNF737, 101232, 203682, 1-160; 20167, ZNF737, 101228, 203678, 96-1706; 20168, ZNF738, 101234, 203684, 150-503; 20168, ZNF738, 101235, 203685, 112-318; 20168, ZNF738, 101236, 203686, 131-520; 20168, ZNF738, 101237, 203687, 121-255; 20168, ZNF738, 101233, 203683, 212-625; 20169, ZNF74, 101238, 203688, 163-1881; 20169, ZNF74, 101239, 203689, 125-763; 20169, ZNF74, 101243, 203693, 227-436; 20169, ZNF74, 101244, 203694, 441-591; 20169, ZNF74, 101240, 203690, 515-2449; 20169, ZNF74, 101241, 203691, 502-1038; 20169, ZNF74, 101242, 203692, 1-1839; 20169, ZNF74, 101245, 203695, 287-2221; 20170, ZNF740, 101246, 203696, 446-1027; 20171, ZNF746, 101249, 203699, 198-761; 20171, ZNF746, 101247, 203697, 282-2216; 20171, ZNF746, 101248, 203698, 272-2209; 20172, ZNF747, 101252, 203702, 326-1318; 20172, ZNF747, 101250, 203700, 669-1244; 20172, ZNF747, 101251, 203701, 240-812; 20173, ZNF749, 101254, 203704, 371-568; 20173, ZNF749, 101253, 203703, 251-2587; 20174, ZNF750, 101256, 203706, 326-1300; 20174, ZNF750, 101255, 203705, 835-3006; 20175, ZNF75A, 101258, 203708, 449-561; 20175, ZNF75A, 101260, 203710, 98-559; 20175, ZNF75A, 101257, 203707, 474-1364; 20175, ZNF75A, 101259, 203709, 279-1169; 20176, ZNF75D, 101261, 203711, 385-1632; 20176, ZNF75D, 101262, 203712, 2711-4243; 20177, ZNF76, 101263, 203713, 502-957; 20177, ZNF76, 101266, 203716, 1-305; 20177, ZNF76, 101267, 203717, 354-1373; 20177, ZNF76, 101264, 203714, 165-1712; 20177, ZNF76, 101265, 203715, 267-1979; 20178, ZNF761, 101268, 203718, 308-2548; 20178, ZNF761, 101269, 203719, 33-245; 20178, ZNF761, 101270, 203720, 215-2455; 20178, ZNF761, 101271, 203721, 344-508; 20178, ZNF761, 101272, 203722, 1-58; 20179, ZNF763, 101275, 203725, 173-313; 20179, ZNF763, 101276, 203726, 334-573; 20179, ZNF763, 101277, 203727, 121-564; 20179, ZNF763, 101273, 203723, 156-1349; 20179, ZNF763, 101274, 203724, 128-1312; 20180, ZNF764, 101278, 203728, 82-1308; 20180, ZNF764, 101279, 203729, 317-1540; 20181, ZNF765, 101281, 203731, 139-522; 20181, ZNF765, 101283, 203733, 113-370; 20181, ZNF765, 101280, 203730, 118-1689; 20181, ZNF765, 101282, 203732, 124-306; 20181, ZNF765, 101284, 203734, 95-277; 20182, ZNF766, 101286, 203736, 378-1793; 20182, ZNF766, 101287, 203737, 78-554; 20182, ZNF766, 101288, 203738, 302-552; 20182, ZNF766, 101289, 203739, 22-339; 20182, ZNF766, 101290, 203740, 215-559; 20182, ZNF766, 101291, 203741, 236-538; 20182, ZNF766, 101292, 203742, 365-588; 20182, ZNF766, 101285, 203735, 44-1450; 20183, ZNF768, 101294, 203744, 86-1615; 20183, ZNF768, 101293, 203743, 177-1799; 20184, ZNF77, 101295, 203745, 94-1731; 20185, ZNF770, 101297, 203747, 167-563; 20185, ZNF770, 101296, 203746, 346-2421; 20186, ZNF771, 101300, 203750, 24-212; 20186, ZNF771, 101301, 203751, 46-204; 20186, ZNF771, 101298, 203748, 378-1331; 20186, ZNF771, 101299, 203749, 274-1227; 20187, ZNF772, 101305, 203755, 212-430; 20187, ZNF772, 101306, 203756, 258-386; 20187, ZNF772, 101307, 203757, 243-359; 20187, ZNF772, 101308, 203758, 196-273; 20187, ZNF772, 101309, 203759, 301-1554; 20187, ZNF772, 101310, 203760, 262-1506; 20187, ZNF772, 101302, 203752, 262-1731; 20187, ZNF772, 101303, 203753, 224-1570; 20187, ZNF772, 101304, 203754, 309-1442; 20188, ZNF773, 101312, 203762, 143-496; 20188, ZNF773, 101313, 203763, 125-478; 20188, ZNF773, 101315, 203765, 167-472; 20188, ZNF773, 101311, 203761, 141-1469; 20188, ZNF773, 101314, 203764, 147-1472; 20189, ZNF774, 101317, 203767, 92-355; 20189, ZNF774, 101318, 203768, 129-263; 20189, ZNF774, 101319, 203769, 49-284; 20189, ZNF774, 101316, 203766, 187-1638; 20190, ZNF775, 101321, 203771, 178-675; 20190, ZNF775, 101322, 203772, 202-635; 20190, ZNF775, 101320, 203770, 108-1721; 20191, ZNF776, 101324, 203774, 219-395; 20191, ZNF776, 101325, 203775, 1-116; 20191, ZNF776, 101323, 203773, 264-1820; 20192, ZNF777, 101326, 203776, 325-2820; 20193, ZNF778, 101328, 203778, 340-2613; 20193, ZNF778, 101329, 203779, 57-200; 20193, ZNF778, 101330, 203780, 326-568; 20193, ZNF778, 101327, 203777, 171-2234; 20193, ZNF778, 101331, 203781, 333-2522; 20194, ZNF780A, 101333, 203783, 313-2136; 20194, ZNF780A, 101336, 203786, 79-546; 20194, ZNF780A, 101337, 203787, 338-665; 20194, ZNF780A, 101339, 203789, 227-498; 20194, ZNF780A, 101340, 203790, 116-446; 20194, ZNF780A, 101342, 203792, 149-467; 20194, ZNF780A, 101343, 203793, 227-498; 20194, ZNF780A, 101344, 203794, 338-665; 20194, ZNF780A, 101345, 203795, 149-2077; 20194, ZNF780A, 101346, 203796, 256-732; 20194, ZNF780A, 101347, 203797, 149-467; 20194, ZNF780A, 101348, 203798, 313-2136; 20194, ZNF780A, 101349, 203799, 116-446; 20194, ZNF780A, 101350, 203800, 211-2136; 20194, ZNF780A, 101351, 203801, 116-2044; 20194, ZNF780A, 101352, 203802, 79-546; 20194, ZNF780A, 101353, 203803, 226-2151; 20194, ZNF780A, 101332, 203782, 226-2151; 20194, ZNF780A, 101334, 203784, 149-2077; 20194, ZNF780A, 101335, 203785, 256-732; 20194, ZNF780A, 101338, 203788, 116-2044; 20194, ZNF780A, 101341, 203791, 211-2136; 20195, ZNF780B, 101354, 203804, 703-2760; 20195, ZNF780B, 101356, 203806, 282-509; 20195, ZNF780B, 101357, 203807, 102-365; 20195, ZNF780B, 101358, 203808, 66-393; 20195, ZNF780B, 101360, 203810, 703-2760; 20195, ZNF780B, 101361, 203811, 66-393; 20195, ZNF780B, 101362, 203812, 102-365; 20195, ZNF780B, 101363, 203813, 282-509; 20195, ZNF780B, 101364, 203814, 66-2567; 20195, ZNF780B, 101365, 203815, 67-2568; 20195, ZNF780B, 101355, 203805, 67-2568; 20195, ZNF780B, 101359, 203809, 66-2567; 20196, ZNF781, 101366, 203816, 750-1733; 20196, ZNF781, 101367, 203817, 854-1837; 20197, ZNF782, 101368, 203818, 318-932; 20197, ZNF782, 101369, 203819, 1-2065; 20197, ZNF782, 101371, 203821, 24-158; 20197, ZNF782, 101370, 203820, 663-2762; 20197, ZNF782, 101372, 203822, 265-2364; 20198, ZNF784, 101374, 203824, 6-134; 20198, ZNF784, 101373, 203823, 41-1012; 20199, ZNF785, 101377, 203827, 1-245; 20199, ZNF785, 101378, 203828, 1-210; 20199, ZNF785, 101375, 203825, 161-1378; 20199, ZNF785, 101376, 203826, 159-1331; 20200, ZNF786, 101379, 203829, 274-2364; 20200, ZNF786, 101380, 203830, 231-1286; 20200, ZNF786, 101381, 203831, 66-2414; 20201, ZNF787, 101382, 203832, 90-470; 20201, ZNF787, 101383, 203833, 268-386; 20201, ZNF787, 101384, 203834, 120-1268; 20202, ZNF789, 101387, 203837, 305-472; 20202, ZNF789, 101388, 203838, 326-682; 20202, ZNF789, 101389, 203839, 326-496; 20202, ZNF789, 101390, 203840, 323-493; 20202, ZNF789, 101385, 203835, 271-1548; 20202, ZNF789, 101386, 203836, 200-388; 20203, ZNF79, 101392, 203842, 596-2020; 20203, ZNF79, 101393, 203843, 594-2018; 20203, ZNF79, 101394, 203844, 701-1795; 20203, ZNF79, 101391, 203841, 407-1903; 20204, ZNF790, 101396, 203846, 132-538; 20204, ZNF790, 101397, 203847, 430-578; 20204, ZNF790, 101398, 203848, 386-922; 20204, ZNF790, 101399, 203849, 162-581; 20204, ZNF790, 101395, 203845, 122-2032; 20204, ZNF790, 101400, 203850, 430-2340; 20204, ZNF790, 101401, 203851, 162-2072; 20204, ZNF790, 101402, 203852, 340-2250; 20205, ZNF791, 101404, 203854, 163-372; 20205, ZNF791, 101405, 203855, 164-271; 20205, ZNF791, 101406, 203856, 327-576; 20205, ZNF791, 101407, 203857, 161-295; 20205, ZNF791, 101403, 203853, 163-1893; 20206, ZNF792, 101409, 203859, 388-2085; 20206, ZNF792, 101408, 203858, 388-2286; 20207, ZNF793, 101411, 203861, 750-1667; 20207, ZNF793, 101412, 203862, 1-251; 20207, ZNF793, 101413, 203863, 1-179; 20207, ZNF793, 101414, 203864, 505-900; 20207, ZNF793, 101415, 203865, 416-832; 20207, ZNF793, 101416, 203866, 487-768; 20207, ZNF793, 101417, 203867, 465-625; 20207, ZNF793, 101419, 203869, 443-1525; 20207, ZNF793, 101410, 203860, 36-1256; 20207, ZNF793, 101418, 203868, 236-1456; 20208, ZNF799, 101421, 203871, 751-2586; 20208, ZNF799, 101422, 203872, 199-474; 20208, ZNF799, 101420, 203870, 202-2133; 20209, ZNF8, 101423, 203873, 132-1859; 20210, ZNF80, 101424, 203874, 505-1326; 20210, ZNF80, 101425, 203875, 28-849; 20210, ZNF80, 101426, 203876, 505-1326; 20211, ZNF800, 101430, 203880, 115-410; 20211, ZNF800, 101431, 203881, 113-502; 20211, ZNF800, 101432, 203882, 230-955; 20211, ZNF800, 101433, 203883, 694-1704; 20211, ZNF800, 101427, 203877, 694-2688; 20211, ZNF800, 101428, 203878, 167-2161; 20211, ZNF800, 101429, 203879, 593-2587; 20212, ZNF804A, 101435, 203885, 149-3523; 20212,

ZNF804A, 101434, 203884, 595-4224; 20213, ZNF804B, 101437, 203887, 143-3943; 20213, ZNF804B, 101436, 203886, 610-4659; 20214, ZNF805, 101438, 203888, 480-1964; 20214, ZNF805, 101439, 203889, 1-1884; 20215, ZNF808, 101441, 203891, 323-572; 20215, ZNF808, 101442, 203892, 246-553; 20215, ZNF808, 101443, 203893, 82-601; 20215, ZNF808, 101444, 203894, 69-608; 20215, ZNF808, 101446, 203896, 177-407; 20215, ZNF808, 101440, 203890, 181-2892; 20215, ZNF808, 101445, 203895, 160-2664; 20216, ZNF81, 101447, 203897, 345-554; 20216, ZNF81, 101449, 203899, 182-492; 20216, ZNF81, 101448, 203898, 250-2235; 20216, ZNF81, 101450, 203900, 369-2354; 20217, ZNF812, 101453, 203903, 469-565; 20217, ZNF812, 101454, 203904, 502-587; 20217, ZNF812, 101451, 203901, 520-1884; 20217, ZNF812, 101452, 203902, 647-2011; 20218, ZNF813, 101456, 203906, 121-559; 20218, ZNF813, 101457, 203907, 161-535; 20218, ZNF813, 101455, 203905, 129-1982; 20219, ZNF814, 101459, 203909, 168-356; 20219, ZNF814, 101460, 203910, 20-139; 20219, ZNF814, 101461, 203911, 218-424; 20219, ZNF814, 101462, 203912, 157-498; 20219, ZNF814, 101463, 203913, 119-373; 20219, ZNF814, 101464, 203914, 1-284; 20219, ZNF814, 101465, 203915, 236-475; 20219, ZNF814, 101466, 203916, 6-281; 20219, ZNF814, 101467, 203917, 16-291; 20219, ZNF814, 101468, 203918, 273-2006; 20219, ZNF814, 101458, 203908, 236-2803; 20220, ZNF816, 101469, 203919, 189-484; 20220, ZNF816, 101472, 203922, 211-553; 20220, ZNF816, 101473, 203923, 161-391; 20220, ZNF816, 101474, 203924, 178-471; 20220, ZNF816, 101475, 203925, 141-317; 20220, ZNF816, 101476, 203926, 161-454; 20220, ZNF816, 101470, 203920, 302-2257; 20220, ZNF816, 101471, 203921, 172-2127; 20221, ZNF821, 101477, 203927, 424-1536; 20221, ZNF821, 101479, 203929, 377-1489; 20221, ZNF821, 101480, 203930, 261-449; 20221, ZNF821, 101482, 203932, 438-854; 20221, ZNF821, 101483, 203933, 510-698; 20221, ZNF821, 101484, 203934, 206-406; 20221, ZNF821, 101485, 203935, 304-619; 20221, ZNF821, 101486, 203936, 120-871; 20221, ZNF821, 101487, 203937, 510-1719; 20221, ZNF821, 101488, 203938, 357-672; 20221, ZNF821, 101489, 203939, 307-495; 20221, ZNF821, 101490, 203940, 524-712; 20221, ZNF821, 101491, 203941, 132-320; 20221, ZNF821, 101492, 203942, 395-1032; 20221, ZNF821, 101493, 203943, 424-843; 20221, ZNF821, 101478, 203928, 424-1662; 20221, ZNF821, 101481, 203931, 409-1647; 20222, ZNF823, 101495, 203945, 191-394; 20222, ZNF823, 101496, 203946, 132-1540; 20222, ZNF823, 101497, 203947, 422-698; 20222, ZNF823, 101494, 203944, 155-1987; 20223, ZNF827, 101500, 203950, 83-2278; 20223, ZNF827, 101501, 203951, 1-536; 20223, ZNF827, 101502, 203952, 1-538; 20223, ZNF827, 101498, 203948, 65-3298; 20223, ZNF827, 101499, 203949, 229-3474; 20224, ZNF829, 101503, 203953, 68-1609; 20224, ZNF829, 101504, 203954, 366-1664; 20224, ZNF829, 101505, 203955, 803-1549; 20225, ZNF83, 101510, 203960, 399-491; 20225, ZNF83, 101511, 203961, 113-274; 20225, ZNF83, 101512, 203962, 128-505; 20225, ZNF83, 101513, 203963, 409-624; 20225, ZNF83, 101514, 203964, 113-280; 20225, ZNF83, 101515, 203965, 329-646; 20225, ZNF83, 101516, 203966, 284-661; 20225, ZNF83, 101518, 203968, 118-396; 20225, ZNF83, 101506, 203956, 402-1952; 20225, ZNF83, 101507, 203957, 1557-3107; 20225, ZNF83, 101508, 203958, 447-1997; 20225, ZNF83, 101509, 203959, 529-2079; 20225, ZNF83, 101517, 203967, 2255-3805; 20226, ZNF830, 101520, 203970, 1-321; 20226, ZNF830, 101519, 203969, 38-1156; 20227, ZNF831, 101521, 203971, 1-5034; 20228, ZNF835, 101523, 203973, 231-507; 20228, ZNF835, 101522, 203972, 233-1846; 20229, ZNF836, 101524, 203974, 1-2811; 20229, ZNF836, 101525, 203975, 242-558; 20229, ZNF836, 101527, 203977, 1-93; 20229, ZNF836, 101528, 203978, 523-789; 20229, ZNF836, 101526, 203976, 375-3185; 20230, ZNF837, 101529, 203979, 324-1919; 20230, ZNF837, 101530, 203980, 260-1855; 20231, ZNF839, 101532, 203982, 1-743; 20231, ZNF839, 101533, 203983, 413-583; 20231, ZNF839, 101535, 203985, 1-1428; 20231, ZNF839, 101537, 203987, 1-1582; 20231, ZNF839, 101538, 203988, 1-1482; 20231, ZNF839, 101539, 203989, 1-433; 20231, ZNF839, 101540, 203990, 1-571; 20231, ZNF839, 101531, 203981, 16-2799; 20231, ZNF839, 101534, 203984, 282-2717; 20231, ZNF839, 101536, 203986, 351-2786; 20232, ZNF84, 101543, 203993, 352-559; 20232, ZNF84, 101544, 203994, 529-546; 20232, ZNF84, 101545, 203995, 614-2827; 20232, ZNF84, 101546, 203996, 329-562; 20232, ZNF84, 101547, 203997, 184-621; 20232, ZNF84, 101548, 203998, 191-445; 20232, ZNF84, 101550, 204000, 251-960; 20232, ZNF84, 101551, 204001, 394-558; 20232, ZNF84, 101541, 203991, 581-2797; 20232, ZNF84, 101542, 203992, 438-2654; 20232, ZNF84, 101549, 203999, 347-2563; 20233, ZNF841, 101554, 204004, 451-721; 20233, ZNF841, 101556, 204006, 1-1538; 20233, ZNF841, 101552, 204002, 88-2862; 20233, ZNF841, 101553, 204003, 553-2979; 20233, ZNF841, 101555, 204005, 404-3178; 20234, ZNF843, 101558, 204008, 726-1607; 20234, ZNF843, 101557, 204007, 726-1772; 20234, ZNF843, 101559, 204009, 354-1400; 20235, ZNF844, 101561, 204011, 65-280; 20235, ZNF844, 101562, 204012, 427-716; 20235, ZNF844, 101560, 204010, 176-2176; 20236, ZNF845, 101565, 204015, 118-526; 20236, ZNF845, 101563, 204013, 118-3030; 20236, ZNF845, 101564, 204014, 220-3132; 20237, ZNF846, 101568, 204018, 250-548; 20237, ZNF846, 101569, 204019, 103-363; 20237, ZNF846, 101570, 204020, 157-683; 20237, ZNF846, 101571, 204021, 238-482; 20237, ZNF846, 101572, 204022, 415-675; 20237, ZNF846, 101566, 204016, 415-2016; 20237, ZNF846, 101567, 204017, 1012-1644; 20237, ZNF846, 101573, 204023, 520-1152; 20238, ZNF85, 101577, 204027, 117-556; 20238, ZNF85, 101578, 204028, 201-368; 20238, ZNF85, 101579, 204029, 80-773; 20238, ZNF85, 101580, 204030, 117-483; 20238, ZNF85, 101581, 204031, 163-549; 20238, ZNF85, 101582, 204032, 149-506; 20238, ZNF85, 101583, 204033, 180-368; 20238, ZNF85, 101584, 204034, 79-782; 20238, ZNF85, 101585, 204035, 135-1661; 20238, ZNF85, 101586, 204036, 151-574; 20238, ZNF85, 101587, 204037, 629-2239; 20238, ZNF85, 101591, 204041, 201-368; 20238, ZNF85, 101592, 204042, 180-368; 20238, ZNF85, 101593, 204043, 163-549; 20238, ZNF85, 101594, 204044, 117-556; 20238, ZNF85, 101595, 204045, 117-483; 20238, ZNF85, 101596, 204046, 149-506; 20238, ZNF85, 101574, 204024, 126-389; 20238, ZNF85, 101575, 204025, 114-1901; 20238, ZNF85, 101576, 204026, 1-1689; 20238, ZNF85, 101588, 204038, 126-389; 20238, ZNF85, 101589, 204039, 1-1689; 20238, ZNF85, 101590, 204040, 114-1901; 20239, ZNF850, 101598, 204048, 171-425; 20239, ZNF850, 101599, 204049, 160-3336; 20239, ZNF850, 101597, 204047, 160-3432; 20240, ZNF852, 101601, 204051, 166-1755; 20240, ZNF852, 101603, 204053, 166-1755; 20240, ZNF852, 101600, 204050, 162-1793; 20240, ZNF852, 101602, 204052, 162-1793; 20241, ZNF853, 101604, 204054, 559-2538; 20242, ZNF860, 101605, 204055, 550-

2448; 20243, ZNF862, 101607, 204057, 316-594; 20243, ZNF862, 101606, 204056, 246-3755; 20244, ZNF865, 101609, 204059, 1-99; 20244, ZNF865, 101608, 204058, 355-3534; 20245, ZNF878, 101610, 204060, 139-1734; 20246, ZNF879, 101612, 204062, 150-553; 20246, ZNF879, 101613, 204063, 137-460; 20246, ZNF879, 101614, 204064, 568-690; 20246, ZNF879, 101611, 204061, 189-1880; 20247, ZNF880, 101617, 204067, 50-427; 20247, ZNF880, 101618, 204068, 31-408; 20247, ZNF880, 101619, 204069, 21-374; 20247, ZNF880, 101615, 204065, 28-324; 20247, ZNF880, 101616, 204066, 16-1749; 20248, ZNF891, 101620, 204070, 354-1988; 20249, ZNF90, 101622, 204072, 129-359; 20249, ZNF90, 101623, 204073, 140-478; 20249, ZNF90, 101624, 204074, 47-436; 20249, ZNF90, 101621, 204071, 113-1918; 20250, ZNF91, 101627, 204077, 104-472; 20250, ZNF91, 101628, 204078, 139-695; 20250, ZNF91, 101625, 204075, 207-3782; 20250, ZNF91, 101626, 204076, 93-3572; 20251, ZNF92, 101632, 204082, 165-1697; 20251, ZNF92, 101629, 204079, 200-1960; 20251, ZNF92, 101630, 204080, 200-1864; 20251, ZNF92, 101631, 204081, 198-1751; 20252, ZNF93, 101634, 204084, 119-490; 20252, ZNF93, 101635, 204085, 209-570; 20252, ZNF93, 101636, 204086, 162-521; 20252, ZNF93, 101637, 204087, 144-398; 20252, ZNF93, 101633, 204083, 29-1891; 20253, ZNF98, 101639, 204089, 131-394; 20253, ZNF98, 101640, 204090, 205-595; 20253, ZNF98, 101641, 204091, 100-493; 20253, ZNF98, 101638, 204088, 123-1841; 20254, ZNF99, 101642, 204092, 1-3114; 20254, ZNF99, 101643, 204093, 92-2686; 20255, ZIK1, 101644, 204094, 98-187; 20255, ZIK1, 101645, 204095, 218-1642; 20255, ZIK1, 101647, 204097, 213-534; 20255, ZIK1, 101648, 204098, 493-584; 20255, ZIK1, 101649, 204099, 391-720; 20255, ZIK1, 101646, 204096, 447-1745; 20255, ZIK1, 101650, 204100, 216-1679; 20256, ZFPM1, 101652, 204102, 13-468; 20256, ZFPM1, 101653, 204103, 15-491; 20256, ZFPM1, 101654, 204104, 13-366; 20256, ZFPM1, 101651, 204101, 323-3343; 20257, ZFPM2, 101656, 204106, 517-594; 20257, ZFPM2, 101657, 204107, 182-3241; 20257, ZFPM2, 101658, 204108, 569-3628; 20257, ZFPM2, 101655, 204105, 251-3706; 20258, ZFX, 101660, 204110, 29-2296; 20258, ZFX, 101663, 204113, 195-600; 20258, ZFX, 101664, 204114, 206-300; 20258, ZFX, 101659, 204109, 255-2672; 20258, ZFX, 101661, 204111, 428-2845; 20258, ZFX, 101662, 204112, 100-2634; 20258, ZFX, 101665, 204115, 192-1922; 20259, ZFY, 101668, 204118, 294-567; 20259, ZFY, 101666, 204116, 322-2727; 20259, ZFY, 101667, 204117, 195-2600; 20259, ZFY, 101669, 204119, 137-2311; 20259, ZFY, 101670, 204120, 87-1919; 20260, ZFPL1, 101672, 204122, 153-482; 20260, ZFPL1, 101673, 204123, 1-158; 20260, ZFPL1, 101674, 204124, 59-576; 20260, ZFPL1, 101675, 204125, 80-277; 20260, ZFPL1, 101676, 204126, 165-362; 20260, ZFPL1, 101677, 204127, 128-692; 20260, ZFPL1, 101678, 204128, 1-32; 20260, ZFPL1, 101679, 204129, 158-400; 20260, ZFPL1, 101680, 204130, 181-802; 20260, ZFPL1, 101671, 204121, 153-1085; 20261, ZFR, 101682, 204132, 1-547; 20261, ZFR, 101681, 204131, 104-3328; 20262, ZFR2, 101686, 204136, 1-133; 20262, ZFR2, 101687, 204137, 13-147; 20262, ZFR2, 101688, 204138, 143-349; 20262, ZFR2, 101689, 204139, 233-439; 20262, ZFR2, 101683, 204133, 12-2831; 20262, ZFR2, 101684, 204134, 16-228; 20262, ZFR2, 101685, 204135, 12-1112; 20263, ZKSCAN1, 101691, 204141, 198-573; 20263, ZKSCAN1, 101692, 204142, 354-1937; 20263, ZKSCAN1, 101693, 204143, 215-1267; 20263, ZKSCAN1, 101694, 204144, 118-1701; 20263, ZKSCAN1, 101690, 204140, 235-1926; 20264, ZKSCAN2, 101696, 204146, 431-1129; 20264, ZKSCAN2, 101695, 204145, 805-3708; 20265, ZKSCAN3, 101697, 204147, 217-1833; 20265, ZKSCAN3, 101698, 204148, 161-1333; 20265, ZKSCAN3, 101699, 204149, 298-1914; 20266, ZKSCAN4, 101700, 204150, 245-1882; 20267, ZKSCAN5, 101704, 204154, 792-1460; 20267, ZKSCAN5, 101701, 204151, 124-2643; 20267, ZKSCAN5, 101702, 204152, 252-2771; 20267, ZKSCAN5, 101703, 204153, 162-2681; 20268, ZKSCAN7, 101707, 204157, 1-366; 20268, ZKSCAN7, 101709, 204159, 66-1187; 20268, ZKSCAN7, 101710, 204160, 372-980; 20268, ZKSCAN7, 101712, 204162, 66-1187; 20268, ZKSCAN7, 101717, 204167, 1-366; 20268, ZKSCAN7, 101718, 204168, 372-980; 20268, ZKSCAN7, 101705, 204155, 430-2694; 20268, ZKSCAN7, 101706, 204156, 435-1265; 20268, ZKSCAN7, 101708, 204158, 408-2672; 20268, ZKSCAN7, 101711, 204161, 408-1238; 20268, ZKSCAN7, 101713, 204163, 430-2694; 20268, ZKSCAN7, 101714, 204164, 408-2672; 20268, ZKSCAN7, 101715, 204165, 408-1238; 20268, ZKSCAN7, 101716, 204166, 435-1265; 20269, ZKSCAN8, 101719, 204169, 185-1921; 20269, ZKSCAN8, 101720, 204170, 279-2015; 20269, ZKSCAN8, 101721, 204171, 240-716; 20269, ZKSCAN8, 101722, 204172, 213-689; 20270, ZUFSP, 101723, 204173, 245-1087; 20270, ZUFSP, 101724, 204174, 245-1981; 20271, ZFAND1, 101726, 204176, 392-550; 20271, ZFAND1, 101727, 204177, 356-540; 20271, ZFAND1, 101728, 204178, 374-664; 20271, ZFAND1, 101730, 204180, 527-882; 20271, ZFAND1, 101731, 204181, 7-504; 20271, ZFAND1, 101732, 204182, 439-567; 20271, ZFAND1, 101733, 204183, 291-467; 20271, ZFAND1, 101735, 204185, 261-641; 20271, ZFAND1, 101737, 204187, 264-626; 20271, ZFAND1, 101738, 204188, 456-614; 20271, ZFAND1, 101739, 204189, 1-186; 20271, ZFAND1, 101740, 204190, 445-570; 20271, ZFAND1, 101725, 204175, 20-826; 20271, ZFAND1, 101729, 204179, 274-759; 20271, ZFAND1, 101734, 204184, 8-691; 20271, ZFAND1, 101736, 204186, 290-775; 20271, ZFAND1, 101741, 204191, 20-805; 20272, ZFAND2A, 101743, 204193, 236-852; 20272, ZFAND2A, 101744, 204194, 261-803; 20272, ZFAND2A, 101745, 204195, 1-272; 20272, ZFAND2A, 101742, 204192, 261-698; 20273, ZFAND2B, 101747, 204197, 174-848; 20273, ZFAND2B, 101750, 204200, 58-495; 20273, ZFAND2B, 101752, 204202, 58-735; 20273, ZFAND2B, 101753, 204203, 114-551; 20273, ZFAND2B, 101754, 204204, 107-397; 20273, ZFAND2B, 101755, 204205, 592-741; 20273, ZFAND2B, 101756, 204206, 64-705; 20273, ZFAND2B, 101758, 204208, 1-458; 20273, ZFAND2B, 101759, 204209, 84-725; 20273, ZFAND2B, 101746, 204196, 196-969; 20273, ZFAND2B, 101748, 204198, 196-726; 20273, ZFAND2B, 101749, 204199, 81-611; 20273, ZFAND2B, 101751, 204201, 59-832; 20273, ZFAND2B, 101757, 204207, 81-854; 20274, ZFAND3, 101761, 204211, 1-493; 20274, ZFAND3, 101762, 204212, 149-766; 20274, ZFAND3, 101763, 204213, 5-563; 20274, ZFAND3, 101760, 204210, 448-1131; 20275, ZFAND4, 101765, 204215, 925-2886; 20275, ZFAND4, 101766, 204216, 621-1295; 20275, ZFAND4, 101767, 204217, 202-837; 20275, ZFAND4, 101768, 204218, 144-425; 20275, ZFAND4, 101764, 204214, 217-2400; 20276, ZFAND5, 101771, 204221, 57-690; 20276, ZFAND5, 101769, 204219, 141-782; 20276, ZFAND5, 101770, 204220, 312-953; 20276, ZFAND5, 101772, 204222, 550-1191; 20276, ZFAND5, 101773, 204223, 649-1290; 20277, ZFAND6, 101775, 204225, 98-621; 20277, ZFAND6, 101776, 204226, 79-612; 20277, ZFAND6, 101779, 204229, 93-566; 20277, ZFAND6, 101780, 204230, 263-741; 20277, ZFAND6, 101781, 204231, 370-585; 20277, ZFAND6, 101783, 204233, 95-560; 20277, ZFAND6, 101787, 204237, 138-582; 20277, ZFAND6, 101788, 204238, 397-492; 20277, ZFAND6, 101789, 204239, 306-568; 20277, ZFAND6, 101790, 204240, 498-558; 20277, ZFAND6, 101791, 204241, 391-583; 20277, ZFAND6, 101774, 204224, 423-1049; 20277, ZFAND6, 101777, 204227, 215-841; 20277, ZFAND6, 101778, 204228, 88-714; 20277, ZFAND6, 101782, 204232, 246-872; 20277, ZFAND6, 101784, 204234, 100-726; 20277, ZFAND6, 101785, 204235, 114-740; 20277, ZFAND6, 101786, 204236, 237-827; 20277, ZFAND6, 101792, 204242, 263-889; 20277, ZFAND6, 101793, 204243, 339-965; 20277, ZFAND6, 101794, 204244, 269-895; 20278, ZBBX, 101800, 204250, 546-751; 20278, ZBBX, 101801, 204251, 1-136; 20278, ZBBX, 101802, 204252, 1-260; 20278, ZBBX, 101803, 204253, 1-149; 20278, ZBBX, 101804, 204254, 256-746; 20278, ZBBX, 101795, 204245, 88-2607; 20278, ZBBX, 101796, 204246, 373-2688; 20278, ZBBX, 101797, 204247, 342-2744; 20278, ZBBX, 101798, 204248, 292-2607; 20278, ZBBX, 101799, 204249, 285-2804; 20279, ZBED1, 101808, 204258, 133-947; 20279, ZBED1, 101805, 204255, 299-2383; 20279, ZBED1, 101806, 204256, 202-2286; 20279, ZBED1, 101807, 204257, 205-2289; 20280, ZBED2, 101809, 204259, 1010-1666; 20281, ZBED3, 101811, 204261, 91-542; 20281, ZBED3, 101810, 204260, 366-1070; 20282, ZBED4, 101812, 204262, 478-3993; 20283, ZBED5, 101815, 204265, 408-586; 20283, ZBED5, 101816, 204266, 1186-1512; 20283, ZBED5, 101817, 204267, 671-879; 20283, ZBED5, 101818, 204268, 512-789; 20283, ZBED5, 101813, 204263, 500-2581; 20283, ZBED5, 101814, 204264, 431-2512; 20284, ZBED6, 101819, 204269, 1215-4154; 20285, ZBED8, 101820, 204270, 509-2293; 20285, ZBED8, 101821, 204271, 522-2306; 20286, ZBED9, 101823, 204273, 619-3000; 20286, ZBED9, 101822, 204272, 619-4596; 20287, ZC2HC1A, 101825, 204275, 1-592; 20287, ZC2HC1A, 101824, 204274, 103-1080; 20288, ZC2HC1B, 101826, 204276, 105-773; 20289, ZC2HC1C, 101827, 204277, 193-1362; 20289, ZC2HC1C, 101829, 204279, 1-473; 20289, ZC2HC1C, 101830, 204280, 285-564; 20289, ZC2HC1C, 101832, 204282, 269-544; 20289, ZC2HC1C, 101833, 204283, 296-809; 20289, ZC2HC1C, 101834, 204284, 65-547; 20289, ZC2HC1C, 101828, 204278, 129-956; 20289, ZC2HC1C, 101831, 204281, 490-1860; 20290, ZFC3H1, 101837, 204287, 249-1325; 20290, ZFC3H1, 101835, 204285, 360-6329; 20290, ZFC3H1, 101836, 204286, 210-5942; 20290, ZFC3H1, 101838, 204288, 215-1255; 20291, ZC3HC1, 101842, 204292, 20-307; 20291, ZC3HC1, 101843, 204293, 9-158; 20291, ZC3HC1, 101844, 204294, 24-1403; 20291, ZC3HC1, 101845, 204295, 9-170; 20291, ZC3HC1, 101846, 204296, 12-164; 20291, ZC3HC1, 101839, 204289, 195-1640; 20291, ZC3HC1, 101840, 204290, 86-1594; 20291, ZC3HC1, 101841, 204291, 9-1304; 20292, ZC4H2, 101847, 204297, 357-962; 20292, ZC4H2, 101848, 204298, 108-782; 20292, ZC4H2, 101849, 204299, 157-687; 20293, ZGPAT, 101855, 204305, 137-427; 20293, ZGPAT, 101850, 204300, 128-1723; 20293, ZGPAT, 101851, 204301, 113-1648; 20293, ZGPAT, 101852, 204302, 165-1673; 20293, ZGPAT, 101853, 204303, 132-1667; 20293, ZGPAT, 101854, 204304, 124-1659; 20294, ZCCHC10, 101857, 204307, 13-573; 20294, ZCCHC10, 101858, 204308, 13-291; 20294, ZCCHC10, 101859, 204309, 13-357; 20294, ZCCHC10, 101861, 204311, 53-271; 20294, ZCCHC10, 101862, 204312, 35-505; 20294, ZCCHC10, 101856, 204306, 68-580; 20294, ZCCHC10, 101860, 204310, 9-587; 20295, ZCCHC11, 101863, 204313, 146-5083; 20295, ZCCHC11, 101864, 204314, 158-1087; 20295, ZCCHC11, 101866, 204316, 233-1264; 20295, ZCCHC11, 101867, 204317, 1-493; 20295, ZCCHC11, 101868, 204318, 246-3854; 20295, ZCCHC11, 101869, 204319, 1-1010; 20295, ZCCHC11, 101870, 204320, 623-883; 20295, ZCCHC11, 101871, 204321, 1-317; 20295, ZCCHC11, 101872, 204322, 192-2910; 20295, ZCCHC11, 101873, 204323, 309-539; 20295, ZCCHC11, 101874, 204324, 1-1016; 20295, ZCCHC11, 101875, 204325, 1-327; 20295, ZCCHC11, 101876, 204326, 1-455; 20295, ZCCHC11, 101865, 204315, 264-5198; 20296, ZCCHC12, 101877, 204327, 508-1716; 20297, ZCCHC13, 101878, 204328, 78-578; 20298, ZCCHC14, 101881, 204331, 1-2539; 20298, ZCCHC14, 101879, 204329, 219-3068; 20298, ZCCHC14, 101880, 204330, 33-2882; 20299, ZCCHC16, 101882, 204332, 230-1162; 20300, ZCCHC17, 101885, 204335, 193-831; 20300, ZCCHC17, 101887, 204337, 101-892; 20300, ZCCHC17, 101888, 204338, 150-590; 20300, ZCCHC17, 101889, 204339, 244-726; 20300, ZCCHC17, 101890, 204340, 235-774; 20300, ZCCHC17, 101891, 204341, 68-799; 20300, ZCCHC17, 101883, 204333, 137-862; 20300, ZCCHC17, 101884, 204334, 262-987; 20300, ZCCHC17, 101886, 204336, 244-945; 20301, ZCCHC18, 101892, 204342, 1415-2626; 20301, ZCCHC18, 101893, 204343, 1207-2418; 20302, ZCCHC2, 101896, 204346, 1-1135; 20302, ZCCHC2, 101897, 204347, 1-321; 20302, ZCCHC2, 101898, 204348, 1-3295; 20302, ZCCHC2, 101899, 204349, 118-704; 20302, ZCCHC2, 101894, 204344, 419-3955; 20302, ZCCHC2, 101895, 204345, 192-2765; 20303, ZCCHC24, 101900, 204350, 52-738; 20303, ZCCHC24, 101901, 204351, 188-913; 20304, ZCCHC3, 101902, 204352, 620-1831; 20305, ZCCHC4, 101905, 204355, 1-907; 20305, ZCCHC4, 101906, 204356, 65-448; 20305, ZCCHC4, 101903, 204353, 25-1566; 20305, ZCCHC4, 101904, 204354, 16-705; 20306, ZCCHC5, 101907, 204357, 297-1724; 20307, ZCCHC6, 101908, 204358, 2426-4780; 20307, ZCCHC6, 101909, 204359, 9-515; 20307, ZCCHC6, 101910, 204360, 50-424; 20307, ZCCHC6, 101911, 204361, 133-1320; 20307, ZCCHC6, 101912, 204362, 216-3995; 20307, ZCCHC6, 101913, 204363, 174-4661; 20308, ZCCHC7, 101914, 204364, 270-887; 20308, ZCCHC7, 101915, 204365, 107-1738; 20308, ZCCHC7, 101916, 204366, 319-1950; 20309, ZCCHC8, 101917, 204367, 698-1252; 20309, ZCCHC8, 101919, 204369, 1136-1250; 20309, ZCCHC8, 101920, 204370, 928-1561; 20309, ZCCHC8, 101918, 204368, 2357-3766; 20309, ZCCHC8, 101921, 204371, 868-2277; 20309, ZCCHC8, 101922, 204372, 234-2357; 20310, ZCCHC9, 101923, 204373, 3156-3971; 20310, ZCCHC9, 101924, 204374, 65-880; 20310, ZCCHC9, 101925, 204375, 105-920; 20310, ZCCHC9, 101926, 204376, 433-1248; 20311, ZCWPW1, 101929, 204379, 1-741; 20311, ZCWPW1, 101931, 204381, 503-617; 20311, ZCWPW1, 101927, 204377, 234-1808; 20311, ZCWPW1, 101928, 204378, 249-2195; 20311, ZCWPW1, 101930, 204380, 439-1872; 20312, ZCWPW2, 101933, 204383, 1-496; 20312, ZCWPW2, 101934, 204384, 1-575; 20312, ZCWPW2, 101935, 204385, 1-724; 20312, ZCWPW2, 101936, 204386, 437-816; 20312, ZCWPW2, 101932, 204382, 189-1259; 20313, ZDBF2, 101938, 204388, 1-7059; 20313, ZDBF2, 101937, 204387, 387-7451; 20314, ZDHHC1, 101940, 204390, 1-1056; 20314, ZDHHC1, 101939, 204389, 343-1800; 20315, ZDHHC11, 101942, 204392, 150-791; 20315, ZDHHC11, 101943, 204393, 1-666; 20315, ZDHHC11, 101944, 204394, 361-514; 20315, ZDHHC11, 101941, 204391, 385-

1623; 20315, ZDHHC11, 101945, 204395, 106-534; 20316, ZDHHC11B, 101946, 204396, 1-1149; 20316, ZDHHC11B, 101948, 204398, 106-534; 20316, ZDHHC11B, 101947, 204397, 1-1116; 20317, ZDHHC12, 101950, 204400, 31-876; 20317, ZDHHC12, 101951, 204401, 17-646; 20317, ZDHHC12, 101952, 204402, 29-644; 20317, ZDHHC12, 101949, 204399, 14-817; 20318, ZDHHC13, 101953, 204403, 350-1828; 20318, ZDHHC13, 101954, 204404, 122-1990; 20319, ZDHHC14, 101955, 204405, 1-328; 20319, ZDHHC14, 101958, 204408, 1-370; 20319, ZDHHC14, 101956, 204406, 890-2356; 20319, ZDHHC14, 101957, 204407, 890-2311; 20320, ZDHHC15, 101959, 204409, 232-1245; 20320, ZDHHC15, 101960, 204410, 479-1465; 20321, ZDHHC16, 101965, 204415, 163-1086; 20321, ZDHHC16, 101968, 204418, 1-905; 20321, ZDHHC16, 101969, 204419, 162-888; 20321, ZDHHC16, 101970, 204420, 349-989; 20321, ZDHHC16, 101971, 204421, 1-959; 20321, ZDHHC16, 101961, 204411, 150-1040; 20321, ZDHHC16, 101962, 204412, 156-1172; 20321, ZDHHC16, 101963, 204413, 158-1243; 20321, ZDHHC16, 101964, 204414, 317-1402; 20321, ZDHHC16, 101966, 204416, 190-1323; 20321, ZDHHC16, 101967, 204417, 409-1542; 20322, ZDHHC17, 101973, 204423, 1-134; 20322, ZDHHC17, 101974, 204424, 135-242; 20322, ZDHHC17, 101975, 204425, 1-108; 20322, ZDHHC17, 101976, 204426, 1-467; 20322, ZDHHC17, 101977, 204427, 1-605; 20322, ZDHHC17, 101978, 204428, 1-87; 20322, ZDHHC17, 101979, 204429, 82-564; 20322, ZDHHC17, 101980, 204430, 1-145; 20322, ZDHHC17, 101981, 204431, 217-596; 20322, ZDHHC17, 101972, 204422, 650-2548; 20323, ZDHHC18, 101984, 204434, 124-597; 20323, ZDHHC18, 101985, 204435, 1-484; 20323, ZDHHC18, 101982, 204432, 121-882; 20323, ZDHHC18, 101983, 204433, 96-1262; 20324, ZDHHC19, 101987, 204437, 123-971; 20324, ZDHHC19, 101986, 204436, 81-1010; 20324, ZDHHC19, 101988, 204438, 123-812; 20325, ZDHHC2, 101990, 204440, 97-487; 20325, ZDHHC2, 101991, 204441, 146-167; 20325, ZDHHC2, 101989, 204439, 696-1799; 20326, ZDHHC20, 101996, 204446, 362-1240; 20326, ZDHHC20, 101997, 204447, 1-60; 20326, ZDHHC20, 101992, 204442, 78-1040; 20326, ZDHHC20, 101993, 204443, 199-1263; 20326, ZDHHC20, 101994, 204444, 200-1297; 20326, ZDHHC20, 101995, 204445, 199-1296; 20327, ZDHHC21, 101998, 204448, 468-1265; 20328, ZDHHC22, 102000, 204450, 267-388; 20328, ZDHHC22, 102001, 204451, 217-545; 20328, ZDHHC22, 101999, 204449, 204-995; 20329, ZDHHC23, 102003, 204453, 1-228; 20329, ZDHHC23, 102004, 204454, 263-1474; 20329, ZDHHC23, 102005, 204455, 244-1482; 20329, ZDHHC23, 102006, 204456, 297-740; 20329, ZDHHC23, 102002, 204452, 300-1529; 20330, ZDHHC24, 102008, 204458, 233-1018; 20330, ZDHHC24, 102009, 204459, 34-642; 20330, ZDHHC24, 102007, 204457, 236-1090; 20331, ZDHHC3, 102011, 204461, 259-1260; 20331, ZDHHC3, 102013, 204463, 1-182; 20331, ZDHHC3, 102014, 204464, 1-588; 20331, ZDHHC3, 102015, 204465, 404-537; 20331, ZDHHC3, 102016, 204466, 1-335; 20331, ZDHHC3, 102017, 204467, 188-472; 20331, ZDHHC3, 102010, 204460, 275-1258; 20331, ZDHHC3, 102012, 204462, 270-1169; 20332, ZDHHC4, 102024, 204474, 312-807; 20332, ZDHHC4, 102018, 204468, 209-1243; 20332, ZDHHC4, 102019, 204469, 444-1478; 20332, ZDHHC4, 102020, 204470, 359-1393; 20332, ZDHHC4, 102021, 204471, 442-1476; 20332, ZDHHC4, 102022, 204472, 450-1484; 20332, ZDHHC4, 102023, 204473, 293-1327; 20333, ZDHHC5, 102026, 204476, 164-577; 20333, ZDHHC5, 102028, 204478, 132-440; 20333, ZDHHC5, 102029, 204479, 1-901; 20333, ZDHHC5, 102025, 204475, 1363-3510; 20333, ZDHHC5, 102027, 204477, 497-2485; 20334, ZDHHC6, 102032, 204482, 546-1697; 20334, ZDHHC6, 102030, 204480, 412-1641; 20334, ZDHHC6, 102031, 204481, 425-1666; 20335, ZDHHC7, 102035, 204485, 198-483; 20335, ZDHHC7, 102036, 204486, 160-582; 20335, ZDHHC7, 102033, 204483, 354-1280; 20335, ZDHHC7, 102034, 204484, 341-1378; 20335, ZDHHC7, 102037, 204487, 321-1358; 20336, ZDHHC8, 102041, 204491, 17-557; 20336, ZDHHC8, 102038, 204488, 1-2022; 20336, ZDHHC8, 102039, 204489, 142-2439; 20336, ZDHHC8, 102040, 204490, 1-2337; 20337, ZDHHC9, 102044, 204494, 226-737; 20337, ZDHHC9, 102045, 204495, 1-581; 20337, ZDHHC9, 102042, 204492, 393-1487; 20337, ZDHHC9, 102043, 204493, 338-1432; 20338, ZFYVE1, 102050, 204500, 616-2985; 20338, ZFYVE1, 102046, 204496, 641-2932; 20338, ZFYVE1, 102047, 204497, 91-1179; 20338, ZFYVE1, 102048, 204498, 722-3055; 20338, ZFYVE1, 102049, 204499, 137-1225; 20339, ZFYVE16, 102052, 204502, 1-154; 20339, ZFYVE16, 102053, 204503, 565-684; 20339, ZFYVE16, 102055, 204505, 1-112; 20339, ZFYVE16, 102056, 204506, 1-156; 20339, ZFYVE16, 102051, 204501, 181-4800; 20339, ZFYVE16, 102054, 204504, 298-4917; 20339, ZFYVE16, 102057, 204507, 222-4841; 20340, ZFYVE19, 102061, 204511, 1-812; 20340, ZFYVE19, 102062, 204512, 1-305; 20340, ZFYVE19, 102063, 204513, 204-1550; 20340, ZFYVE19, 102064, 204514, 1-922; 20340, ZFYVE19, 102065, 204515, 1-65; 20340, ZFYVE19, 102066, 204516, 1-154; 20340, ZFYVE19, 102068, 204518, 447-617; 20340, ZFYVE19, 102069, 204519, 1-144; 20340, ZFYVE19, 102058, 204508, 1-1212; 20340, ZFYVE19, 102059, 204509, 56-1441; 20340, ZFYVE19, 102060, 204510, 502-1917; 20340, ZFYVE19, 102067, 204517, 830-1720; 20341, ZFYVE21, 102072, 204522, 16-297; 20341, ZFYVE21, 102073, 204523, 4-192; 20341, ZFYVE21, 102074, 204524, 1-346; 20341, ZFYVE21, 102070, 204520, 113-871; 20341, ZFYVE21, 102071, 204521, 35-739; 20342, ZFYVE26, 102076, 204526, 131-1465; 20342, ZFYVE26, 102077, 204527, 138-6815; 20342, ZFYVE26, 102078, 204528, 1-984; 20342, ZFYVE26, 102075, 204525, 140-7759; 20343, ZFYVE27, 102079, 204529, 203-1321; 20343, ZFYVE27, 102080, 204530, 203-1159; 20343, ZFYVE27, 102081, 204531, 188-1402; 20343, ZFYVE27, 102082, 204532, 228-1163; 20343, ZFYVE27, 102083, 204533, 203-1063; 20343, ZFYVE27, 102084, 204534, 205-1440; 20343, ZFYVE27, 102085, 204535, 200-1450; 20344, ZFYVE28, 102092, 204542, 295-541; 20344, ZFYVE28, 102093, 204543, 2107-2685; 20344, ZFYVE28, 102086, 204536, 341-3004; 20344, ZFYVE28, 102087, 204537, 329-847; 20344, ZFYVE28, 102088, 204538, 287-1150; 20344, ZFYVE28, 102089, 204539, 314-2887; 20344, ZFYVE28, 102090, 204540, 491-982; 20344, ZFYVE28, 102091, 204541, 564-3017; 20345, ZFYVE9, 102094, 204544, 453-4730; 20345, ZFYVE9, 102095, 204545, 173-4273; 20345, ZFYVE9, 102096, 204546, 132-4409; 20346, ZGLP1, 102098, 204548, 449-1012; 20346, ZGLP1, 102097, 204547, 1200-2015; 20347, ZGRF1, 102101, 204551, 1-2046; 20347, ZGRF1, 102102, 204552, 235-420; 20347, ZGRF1, 102104, 204554, 206-322; 20347, ZGRF1, 102105, 204555, 271-794; 20347, ZGRF1, 102106, 204556, 120-2927; 20347, ZGRF1, 102099, 204549, 127-3315; 20347, ZGRF1, 102100, 204550, 1-6315; 20347, ZGRF1, 102103, 204553, 127-6441; 20347, ZGRF1, 102107, 204557, 1254-1973; 20348, ZNHIT1, 102108, 204558, 529-993; 20349,

ZNHIT2, 102110, 204560, 21-579; 20349, ZNHIT2, 102109, 204559, 56-1267; 20350, ZNHIT3, 102111, 204561, 7-129; 20350, ZNHIT3, 102114, 204564, 379-507; 20350, ZNHIT3, 102116, 204566, 1-272; 20350, ZNHIT3, 102117, 204567, 458-494; 20350, ZNHIT3, 102118, 204568, 1-272; 20350, ZNHIT3, 102119, 204569, 1-129; 20350, ZNHIT3, 102120, 204570, 418-505; 20350, ZNHIT3, 102122, 204572, 418-505; 20350, ZNHIT3, 102123, 204573, 379-507; 20350, ZNHIT3, 102124, 204574, 7-129; 20350, ZNHIT3, 102125, 204575, 458-494; 20350, ZNHIT3, 102126, 204576, 1-129; 20350, ZNHIT3, 102112, 204562, 6-452; 20350, ZNHIT3, 102113, 204563, 6-452; 20350, ZNHIT3, 102115, 204565, 66-533; 20350, ZNHIT3, 102121, 204571, 66-533; 20351, ZNHIT6, 102127, 204577, 135-1547; 20351, ZNHIT6, 102128, 204578, 150-1445; 20352, ZIM2, 102130, 204580, 38-238; 20352, ZIM2, 102131, 204581, 212-793; 20352, ZIM2, 102133, 204583, 288-776; 20352, ZIM2, 102129, 204579, 549-2132; 20352, ZIM2, 102132, 204582, 288-1871; 20352, ZIM2, 102134, 204584, 364-1947; 20352, ZIM2, 102135, 204585, 544-2127; 20353, ZIM3, 102136, 204586, 387-1805; 20354, ZMAT1, 102137, 204587, 49-1965; 20354, ZMAT1, 102138, 204588, 1-1917; 20355, ZMAT2, 102140, 204590, 363-521; 20355, ZMAT2, 102141, 204591, 1-390; 20355, ZMAT2, 102139, 204589, 128-727; 20356, ZMAT3, 102144, 204594, 298-743; 20356, ZMAT3, 102142, 204592, 743-1612; 20356, ZMAT3, 102143, 204593, 800-1666; 20357, ZMAT4, 102147, 204597, 133-273; 20357, ZMAT4, 102148, 204598, 56-690; 20357, ZMAT4, 102149, 204599, 130-270; 20357, ZMAT4, 102150, 204600, 147-332; 20357, ZMAT4, 102145, 204595, 148-837; 20357, ZMAT4, 102146, 204596, 156-617; 20358, ZMAT5, 102151, 204601, 118-630; 20359, ZMIZ1, 102153, 204603, 1-2907; 20359, ZMIZ1, 102154, 204604, 39-701; 20359, ZMIZ1, 102152, 204602, 573-3776; 20360, ZMIZ2, 102157, 204607, 63-2729; 20360, ZMIZ2, 102158, 204608, 93-281; 20360, ZMIZ2, 102161, 204611, 479-747; 20360, ZMIZ2, 102162, 204612, 1-2772; 20360, ZMIZ2, 102155, 204605, 46-2730; 20360, ZMIZ2, 102156, 204606, 124-2886; 20360, ZMIZ2, 102159, 204609, 114-2702; 20360, ZMIZ2, 102160, 204610, 72-2834; 20361, ZMYM1, 102165, 204615, 441-1825; 20361, ZMYM1, 102163, 204613, 151-3579; 20361, ZMYM1, 102164, 204614, 175-3603; 20361, ZMYM1, 102166, 204616, 441-3869; 20362, ZMYM2, 102170, 204620, 241-1069; 20362, ZMYM2, 102167, 204617, 186-4319; 20362, ZMYM2, 102168, 204618, 191-4324; 20362, ZMYM2, 102169, 204619, 252-4385; 20363, ZMYM3, 102172, 204622, 79-1128; 20363, ZMYM3, 102174, 204624, 132-1625; 20363, ZMYM3, 102175, 204625, 121-3963; 20363, ZMYM3, 102176, 204626, 613-4731; 20363, ZMYM3, 102171, 204621, 132-4244; 20363, ZMYM3, 102173, 204623, 115-1602; 20363, ZMYM3, 102177, 204627, 699-4775; 20364, ZMYM4, 102179, 204629, 173-466; 20364, ZMYM4, 102180, 204630, 1-3622; 20364, ZMYM4, 102178, 204628, 81-4727; 20365, ZMYM5, 102184, 204634, 1-1980; 20365, ZMYM5, 102181, 204631, 266-2275; 20365, ZMYM5, 102182, 204632, 154-1302; 20365, ZMYM5, 102183, 204633, 138-764; 20366, ZMYM6, 102188, 204638, 182-807; 20366, ZMYM6, 102185, 204635, 166-678; 20366, ZMYM6, 102186, 204636, 229-4206; 20366, ZMYM6, 102187, 204637, 206-718; 20367, ZMYND10, 102191, 204641, 143-256; 20367, ZMYND10, 102192, 204642, 225-1072; 20367, ZMYND10, 102193, 204643, 94-207; 20367, ZMYND10, 102189, 204639, 1274-2596; 20367, ZMYND10, 102190, 204640, 154-1461; 20368, ZMYND11, 102194, 204644, 429-2072; 20368, ZMYND11, 102195, 204645, 166-1923; 20368, ZMYND11, 102197, 204647, 462-1910; 20368, ZMYND11, 102199, 204649, 20-659; 20368, ZMYND11, 102202, 204652, 96-1664; 20368, ZMYND11, 102203, 204653, 71-1786; 20368, ZMYND11, 102204, 204654, 342-762; 20368, ZMYND11, 102208, 204658, 1-1758; 20368, ZMYND11, 102196, 204646, 254-2062; 20368, ZMYND11, 102198, 204648, 96-1742; 20368, ZMYND11, 102200, 204650, 429-1982; 20368, ZMYND11, 102201, 204651, 342-2150; 20368, ZMYND11, 102205, 204655, 210-1913; 20368, ZMYND11, 102206, 204656, 1-1707; 20368, ZMYND11, 102207, 204657, 24-1577; 20369, ZMYND12, 102210, 204660, 257-634; 20369, ZMYND12, 102211, 204661, 15-149; 20369, ZMYND12, 102209, 204659, 271-1368; 20370, ZMYND15, 102212, 204662, 67-2319; 20370, ZMYND15, 102213, 204663, 58-2286; 20370, ZMYND15, 102214, 204664, 31-2283; 20370, ZMYND15, 102215, 204665, 40-2151; 20371, ZMYND19, 102216, 204666, 228-911; 20372, ZMYND8, 102225, 204675, 103-175; 20372, ZMYND8, 102226, 204676, 215-341; 20372, ZMYND8, 102228, 204678, 146-670; 20372, ZMYND8, 102230, 204680, 1-3286; 20372, ZMYND8, 102234, 204684, 280-2583; 20372, ZMYND8, 102235, 204685, 1-3411; 20372, ZMYND8, 102236, 204686, 280-3543; 20372, ZMYND8, 102217, 204667, 285-3791; 20372, ZMYND8, 102218, 204668, 255-3815; 20372, ZMYND8, 102219, 204669, 30-3512; 20372, ZMYND8, 102220, 204670, 351-3995; 20372, ZMYND8, 102221, 204671, 37-3444; 20372, ZMYND8, 102222, 204672, 280-3597; 20372, ZMYND8, 102223, 204673, 404-3964; 20372, ZMYND8, 102224, 204674, 51-3215; 20372, ZMYND8, 102227, 204677, 280-3924; 20372, ZMYND8, 102229, 204679, 1-3567; 20372, ZMYND8, 102231, 204681, 28-3732; 20372, ZMYND8, 102232, 204682, 1-3726; 20372, ZMYND8, 102233, 204683, 1-3405; 20373, ZNFX1, 102237, 204687, 161-2964; 20373, ZNFX1, 102239, 204689, 455-4267; 20373, ZNFX1, 102241, 204691, 1-2122; 20373, ZNFX1, 102238, 204688, 86-5842; 20373, ZNFX1, 102240, 204690, 248-6004; 20374, ZRANB1, 102242, 204692, 372-2498; 20375, ZRANB2, 102245, 204695, 35-1048; 20375, ZRANB2, 102243, 204693, 17-979; 20375, ZRANB2, 102244, 204694, 303-1295; 20375, ZRANB2, 102246, 204696, 295-1257; 20376, ZRANB3, 102249, 204699, 123-1409; 20376, ZRANB3, 102250, 204700, 1698-3575; 20376, ZRANB3, 102247, 204697, 118-3357; 20376, ZRANB3, 102248, 204698, 214-3447; 20376, ZRANB3, 102251, 204701, 88-1884; 20377, ZSWIM1, 102252, 204702, 82-1539; 20377, ZSWIM1, 102253, 204703, 96-1553; 20378, ZSWIM2, 102255, 204705, 79-324; 20378, ZSWIM2, 102254, 204704, 41-1942; 20379, ZSWIM3, 102256, 204706, 210-2300; 20380, ZSWIM4, 102258, 204708, 1-719; 20380, ZSWIM4, 102259, 204709, 1-2697; 20380, ZSWIM4, 102257, 204707, 190-3159; 20381, ZSWIM5, 102260, 204710, 207-3764; 20382, ZSWIM6, 102261, 204711, 1-3648; 20383, ZSWIM7, 102264, 204714, 1-93; 20383, ZSWIM7, 102265, 204715, 95-193; 20383, ZSWIM7, 102266, 204716, 124-219; 20383, ZSWIM7, 102267, 204717, 76-171; 20383, ZSWIM7, 102268, 204718, 91-327; 20383, ZSWIM7, 102269, 204719, 43-123; 20383, ZSWIM7, 102270, 204720, 41-136; 20383, ZSWIM7, 102271, 204721, 41-241; 20383, ZSWIM7, 102272, 204722, 88-186; 20383, ZSWIM7, 102273, 204723, 46-141; 20383, ZSWIM7, 102274, 204724, 57-152; 20383, ZSWIM7, 102262, 204712, 99-521; 20383, ZSWIM7, 102263, 204713, 91-513; 20384, ZSWIM8, 102276, 204726, 197-4207; 20384, ZSWIM8, 102277, 204727, 1-3338; 20384, ZSWIM8, 102278, 204728, 1-2715; 20384, ZSWIM8, 102279, 204729, 256-5646; 20384, ZSWIM8, 102280, 204730, 1-3307; 20384, ZSWIM8, 102281, 204731, 224-5191; 20384, ZSWIM8, 102282, 204732, 1-613; 20384, ZSWIM8, 102284, 204734, 1-3697; 20384, ZSWIM8, 102285, 204735, 298-5802; 20384, ZSWIM8, 102275, 204725, 256-5784; 20384, ZSWIM8, 102283, 204733, 218-5731; 20385, ZXDA, 102286, 204736, 401-2800; 20386, ZXDB, 102287, 204737, 398-2809; 20387, ZZZ3, 102290, 204740, 453-561; 20387, ZZZ3, 102291, 204741, 431-603; 20387, ZZZ3, 102288, 204738, 487-1716; 20387, ZZZ3, 102289, 204739, 477-3188; 20388, ZZEF1, 102293, 204743, 1-2438; 20388, ZZEF1, 102294, 204744, 1-658; 20388, ZZEF1, 102295, 204745, 1-200; 20388, ZZEF1, 102296, 204746, 1-447; 20388, ZZEF1, 102292, 204742, 126-9011; 20389, ZHX1, 102300, 204750, 1-118; 20389, ZHX1, 102297, 204747, 706-3327; 20389, ZHX1, 102298, 204748, 619-3240; 20389, ZHX1, 102299, 204749, 542-3163; 20390, ZHX2, 102302, 204752, 375-873; 20390, ZHX2, 102301, 204751, 836-3349; 20391, ZHX3, 102304, 204754, 369-657; 20391, ZHX3, 102305, 204755, 334-688; 20391, ZHX3, 102306, 204756, 435-573; 20391, ZHX3, 102307, 204757, 570-712; 20391, ZHX3, 102308, 204758, 524-792; 20391, ZHX3, 102309, 204759, 1-2035; 20391, ZHX3, 102313, 204763, 1-384; 20391, ZHX3, 102314, 204764, 524-1471; 20391, ZHX3, 102316, 204766, 476-1423; 20391, ZHX3, 102303, 204753, 417-3287; 20391, ZHX3, 102310, 204760, 406-3276; 20391, ZHX3, 102311, 204761, 466-3375; 20391, ZHX3, 102312, 204762, 350-3220; 20391, ZHX3, 102315, 204765, 906-3776; 20392, ZMPSTE24, 102317, 204767, 166-1593; 20393, ZNRD1, 102318, 204768, 272-652; 20393, ZNRD1, 102319, 204769, 151-531; 20393, ZNRD1, 102320, 204770, 144-524; 20393, ZNRD1, 102321, 204771, 162-542; 20393, ZNRD1, 102322, 204772, 144-524; 20393, ZNRD1, 102323, 204773, 163-543; 20393, ZNRD1, 102324, 204774, 152-532; 20393, ZNRD1, 102325, 204775, 273-653; 20393, ZNRD1, 102326, 204776, 162-542; 20393, ZNRD1, 102327, 204777, 151-531; 20393, ZNRD1, 102328, 204778, 151-531; 20393, ZNRD1, 102329, 204779, 151-531; 20393, ZNRD1, 102330, 204780, 162-542; 20393, ZNRD1, 102331, 204781, 272-652; 20393, ZNRD1, 102332, 204782, 162-542; 20393, ZNRD1, 102333, 204783, 162-542; 20393, ZNRD1, 102334, 204784, 272-652; 20393, ZNRD1, 102335, 204785, 151-531; 20393, ZNRD1, 102336, 204786, 151-531; 20393, ZNRD1, 102337, 204787, 272-652; 20393, ZNRD1, 102338, 204788, 162-542; 20393, ZNRD1, 102339, 204789, 162-542; 20393, ZNRD1, 102340, 204790, 144-524; 20393, ZNRD1, 102341, 204791, 272-652; 20393, ZNRD1, 102342, 204792, 272-652; 20393, ZNRD1, 102343, 204793, 144-524; 20393, ZNRD1, 102344, 204794, 144-524; 20393, ZNRD1, 102345, 204795, 144-524; 20393, ZNRD1, 102346, 204796, 151-531; 20393, ZNRD1, 102347, 204797, 144-524; 20393, ZNRD1, 102348, 204798, 272-652; 20393, ZNRD1, 102349, 204799, 144-524; 20394, ZMYM6NB, 102350, 204800, 49-513; 20395, ZNF559-ZNF177, 102351, 204801, 533-895; 20395, ZNF559-ZNF177, 102352, 204802, 57-1502; 20395, ZNF559-ZNF177, 102353, 204803, 630-1595; 20395, ZNF559-ZNF177, 102354, 204804, 57-419; 20395, ZNF559-ZNF177, 102355, 204805, 189-524; 20395, ZNF559-ZNF177, 102356, 204806, 1-249; 20395, ZNF559-ZNF177, 102357, 204807, 1-144; 20395, ZNF559-ZNF177, 102358, 204808, 253-507; 20395, ZNF559-ZNF177, 102359, 204809, 1-204; 20395, ZNF559-ZNF177, 102360, 204810, 1-162; 20395, ZNF559-ZNF177, 102361, 204811, 449-827; 20395, ZNF559-ZNF177, 102362, 204812, 1-200; 20395, ZNF559-ZNF177, 102363, 204813, 1-139; 20395, ZNF559-ZNF177, 102364, 204814, 1-231; 20396, ZNF625-ZNF20, 102365, 204815, 174-551; 20396, ZNF625-ZNF20, 102366, 204816, 174-359; 20397, ZNF670-ZNF695, 102367, 204817, 216-572; 20397, ZNF670-ZNF695, 102368, 204818, 141-554; 20398, ZNF816-ZNF321P, 102369, 204819, 123-824; 20399, ZPBP, 102371, 204821, 373-589; 20399, ZPBP, 102373, 204823, 39-266; 20399, ZPBP, 102370, 204820, 71-1126; 20399, ZPBP, 102372, 204822, 43-1095; 20400, ZPBP2, 102376, 204826, 140-937; 20400, ZPBP2, 102377, 204827, 140-795; 20400, ZPBP2, 102374, 204824, 192-1208; 20400, ZPBP2, 102375, 204825, 140-1090; 20401, ZP1, 102379, 204829, 1-122; 20401, ZP1, 102380, 204830, 499-1491; 20401, ZP1, 102378, 204828, 1-1917; 20402, ZP2, 102381, 204831, 1-2211; 20402, ZP2, 102382, 204832, 484-2721; 20403, ZP3, 102385, 204835, 1-776; 20403, ZP3, 102386, 204836, 1094-1840; 20403, ZP3, 102383, 204833, 347-1468; 20403, ZP3, 102384, 204834, 59-1333; 20404, ZP4, 102387, 204837, 160-1782; 20404, ZP4, 102388, 204838, 288-1910; 20405, ZPLD1, 102389, 204839, 101-1396; 20405, ZPLD1, 102390, 204840, 245-1492; 20405, ZPLD1, 102391, 204841, 883-2130; 20406, ZAN, 102392, 204842, 166-7971; 20406, ZAN, 102393, 204843, 166-8235; 20406, ZAN, 102394, 204844, 166-8040; 20406, ZAN, 102395, 204845, 149-8314; 20406, ZAN, 102396, 204846, 149-8587; 20406, ZAN, 102397, 204847, 166-8604; 20406, ZAN, 102398, 204848, 166-8331; 20407, ZPR1, 102400, 204850, 1-1292; 20407, ZPR1, 102401, 204851, 1-229; 20407, ZPR1, 102402, 204852, 1-1159; 20407, ZPR1, 102403, 204853, 50-199; 20407, ZPR1, 102404, 204854, 1-309; 20407, ZPR1, 102399, 204849, 61-1440; 20408, ZWINT, 102405, 204855, 10-483; 20408, ZWINT, 102409, 204859, 30-176; 20408, ZWINT, 102406, 204856, 31-723; 20408, ZWINT, 102407, 204857, 40-873; 20408, ZWINT, 102408, 204858, 38-871; 20409, ZW10, 102411, 204861, 70-477; 20409, ZW10, 102410, 204860, 146-2485; 20409, ZW10, 102412, 204862, 26-2044; 20410, ZWILCH, 102417, 204867, 1-147; 20410, ZWILCH, 102418, 204868, 1-297; 20410, ZWILCH, 102419, 204869, 330-582; 20410, ZWILCH, 102413, 204863, 381-2156; 20410, ZWILCH, 102414, 204864, 660-2093; 20410, ZWILCH, 102415, 204865, 671-2104; 20410, ZWILCH, 102416, 204866, 386-1819; 20410, ZWILCH, 102420, 204870, 598-2031; 20411, ZXDC, 102423, 204873, 1-1255; 20411, ZXDC, 102421, 204871, 1-2133; 20411, ZXDC, 102422, 204872, 55-2631; 20412, ZYG11A, 102424, 204874, 149-2428; 20412, ZYG11A, 102425, 204875, 648-1901; 20412, ZYG11A, 102426, 204876, 648-1901; 20413, ZYG11B, 102428, 204878, 188-1888; 20413, ZYG11B, 102427, 204877, 146-2380; 20414, ZER1, 102430, 204880, 158-460; 20414, ZER1, 102431, 204881, 222-715; 20414, ZER1, 102429, 204879, 408-2708; 20415, ZAR1, 102432, 204882, 41-1315; 20416, ZAR1L, 102433, 204883, 30-995; 20416, ZAR1L, 102434, 204884, 420-1385; 20417, ZG16, 102435, 204885, 75-578; 20418, ZG16B, 102437, 204887, 1-209; 20418, ZG16B, 102438, 204888, 1-286; 20418, ZG16B, 102439, 204889, 57-593; 20418, ZG16B, 102440, 204890, 1-286; 20418, ZG16B, 102441, 204891, 80-706; 20418, ZG16B, 102442, 204892, 57-593; 20418, ZG16B, 102443, 204893, 1-209; 20418, ZG16B, 102436, 204886, 80-706; 20419, ZYX, 102445, 204895, 1-1623; 20419, ZYX, 102447, 204897, 212-703; 20419, ZYX, 102448, 204898, 413-926; 20419, ZYX, 102449, 204899, 1-530; 20419, ZYX, 102450, 204900, 1-533; 20419, ZYX, 102444, 204894, 346-2064; 20419, ZYX, 102446, 204896, 449-1696

Artificial peptides or polypeptide components of the payload may be derived from any known polypeptide which is not naturally occurring. In some embodiments, they are selected from the antibodies taught in Table 5 or any non-naturally occurring peptides or proteins taught in, for example, Tables 2 and 3, or fragments thereof.

As used herein, the phrase "derived from" as it relates to effector modules, SRE's or payloads means that the effector module, SRE or payload originates at least in part from the stated parent molecule or sequence. For example, in designing an SRE, such SRE may be derived from an epitope or region of a naturally occurring protein but then have been modified in any of the ways taught herein to optimize the SRE function.

Polypeptides of the present invention may comprise amino acid sequences similar to SEQ ID NO: 1-102450, or those in Tables 2, 3, or 5, but comprise additional or fewer amino acids than those listed. Such amino acid sequences may comprise about 1 more or fewer amino acids, about 2 more or fewer amino acids, about 3 more or fewer amino acids, about 4 more or fewer amino acids, about 5 more or fewer amino acids, about 6 more or fewer amino acids, about 7 more or fewer amino acids, about 8 more or fewer amino acids, about 9 more or fewer amino acids, about 10 more or fewer amino acids or greater than 10 more or fewer amino acids on N-terminal and/or C-terminal ends.

The stimuli, biocircuit components, effector modules, including their SREs and payloads of the present invention may exist as a whole polypeptide, a plurality of polypeptides or fragments of polypeptides, which independently may be encoded by one or more nucleic acids, a plurality of nucleic acids, fragments of nucleic acids or variants of any of the aforementioned.

As used herein, the term "polypeptide" refers to a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analogue of a corresponding naturally occurring amino acid.

As used herein, the term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants will possess at least about 50% identity (homology) to a native or reference sequence, and preferably, they will be at least about 80%, more preferably at least about 90% identical (homologous) to a native or reference sequence.

In some embodiments "variant mimics" are provided. As used herein, the term "variant mimic" refers to a variant which contains one or more amino acids which would mimic an activated sequence. For example, glutamate may serve as a mimic for phospho-threonine and/or phospho-serine. Alternatively, variant mimics may result in deactivation or in an inactivated product containing the mimic, e.g., phenylalanine may act as an inactivating substitution for tyrosine; or alanine may act as an inactivating substitution for serine. The amino acid sequences of the pharmaceutical compositions, biocircuits, biocircuit components, effector modules including their SREs or payloads of the invention may comprise naturally occurring amino acids and as such may be considered to be proteins, peptides, polypeptides, or fragments thereof. Alternatively, the pharmaceutical compositions, biocircuits, biocircuit components, effector modules including their SREs or payloads may comprise both naturally and non-naturally occurring amino acids.

As used herein, the term "amino acid sequence variant" refers to molecules with some differences in their amino acid sequences as compared to a native or starting sequence. The amino acid sequence variants may possess substitutions, deletions, and/or insertions at certain positions within the amino acid sequence. As used herein, the terms "native" or "starting" when referring to sequences are relative terms referring to an original molecule against which a comparison may be made. Native or starting sequences should not be confused with wild type sequences. Native sequences or molecules may represent the wild-type (that sequence found in nature) but do not have to be identical to the wild-type sequence.

Ordinarily, variants will possess at least about 70% homology to a native sequence, and preferably, they will be at least about 80%, more preferably at least about 90% homologous to a native sequence.

As used herein, the term "homology" as it applies to amino acid sequences is defined as the percentage of residues in the candidate amino acid sequence that are identical with the residues in the amino acid sequence of a second sequence after aligning the sequences and introducing gaps, if necessary, to achieve the maximum percent homology. Methods and computer programs for the alignment are well known in the art. It is understood that homology depends on a calculation of percent identity but may differ in value due to gaps and penalties introduced in the calculation.

As used herein, the term "homolog" as it applies to amino acid sequences is meant the corresponding sequence of other species having substantial identity to a second sequence of a second species.

As used herein, the term "analog" is meant to include polypeptide variants which differ by one or more amino acid alterations, e.g., substitutions, additions or deletions of amino acid residues that still maintain the properties of the parent polypeptide.

As used herein, the term "derivative" is used synonymously with the term "variant" and refers to a molecule that has been modified or changed in any way relative to a reference molecule or starting molecule.

The present invention contemplates several types of pharmaceutical compositions, biocircuits, biocircuit components, effector modules including their SREs or payloads which are amino acid based including variants and derivatives. These include substitutional, insertional, deletional and covalent variants and derivatives. As such, included within the scope of this invention are pharmaceutical compositions, biocircuits, biocircuit components, effector modules including their SREs or payloads comprising substitutions, insertions, additions, deletions and/or covalent modifications. For example, sequence tags or amino acids, such as one or more lysines, can be added to peptide sequences of the invention (e.g., at the N-terminal or C-terminal ends). Sequence tags can be used for peptide purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support.

"Substitutional variants" when referring to proteins are those that have at least one amino acid residue in a native or starting sequence removed and a different amino acid inserted in its place at the same position. The substitutions may be single, where only one amino acid in the molecule has been substituted, or they may be multiple, where two or more amino acids have been substituted in the same molecule.

As used herein, the term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine and leucine for another non-polar residue. Likewise, examples of conservative substitutions include the substitution of one polar (hydrophilic) residue for another such as between arginine and lysine, between glutamine and asparagine, and between glycine and serine. Additionally, the substitution of a basic residue such as lysine, arginine or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, methionine for a polar (hydrophilic) residue such as cysteine, glutamine, glutamic acid or lysine and/or a polar residue for a non-polar residue.

As used herein, the term "insertional variant" when referring to proteins are those with one or more amino acids inserted immediately adjacent to an amino acid at a particular position in a native or starting sequence. As used herein, the term "immediately adjacent" refers to an adjacent amino acid that is connected to either the alpha-carboxy or alpha-amino functional group of a starting or reference amino acid.

As used herein, the term "deletional variants" when referring to proteins, are those with one or more amino acids in the native or starting amino acid sequence removed. Ordinarily, deletional variants will have one or more amino acids deleted in a particular region of the molecule.

As used herein, the term "derivatives," as referred to herein includes variants of a native or starting protein comprising one or more modifications with organic proteinaceous or non-proteinaceous derivatizing agents, and post-translational modifications. Covalent modifications are traditionally introduced by reacting targeted amino acid residues of the protein with an organic derivatizing agent that is capable of reacting with selected side-chains or terminal residues, or by harnessing mechanisms of post-translational modifications that function in selected recombinant host cells. The resultant covalent derivatives are useful in programs directed at identifying residues important for biological activity, for immunoassays, or for the preparation of anti-protein antibodies for immunoaffinity purification of the recombinant glycoprotein. Such modifications are within the ordinary skill in the art and are performed without undue experimentation.

Features of the proteins of the present invention include surface manifestations, local conformational shape, folds, loops, half-loops, domains, half-domains, sites, termini or any combination thereof. As used herein, the term "features" when referring to proteins are defined as distinct amino acid sequence-based components of a molecule.

As used herein, the term "surface manifestation" when referring to proteins refers to a polypeptide based component of a protein appearing on an outermost surface.

As used herein, the term "local conformational shape" when referring to proteins refers to a polypeptide based structural manifestation of a protein which is located within a definable space of the protein.

As used herein, the term "fold," when referring to proteins, refers to the resultant conformation of an amino acid sequence upon energy minimization. A fold may occur at the secondary or tertiary level of the folding process. Examples of secondary level folds include beta sheets and alpha helices. Examples of tertiary folds include domains and regions formed due to aggregation or separation of energetic forces. Regions formed in this way include hydrophobic and hydrophilic pockets, and the like.

As used herein, the term "turn" as it relates to protein conformation, refers to a bend which alters the direction of the backbone of a peptide or polypeptide and may involve one, two, three or more amino acid residues.

As used herein, the term "loop," when referring to proteins, refers to a structural feature of a peptide or polypeptide which reverses the direction of the backbone of a peptide or polypeptide and comprises four or more amino acid residues. Oliva et al. have identified at least 5 classes of protein loops (Oliva, B. et al., An automated classification of the structure of protein loops. J Mol Biol. 1997. 266(4):814-30.)

As used herein, the term "half-loop," when referring to proteins, refers to a portion of an identified loop having at least half the number of amino acid resides as the loop from which it is derived. It is understood that loops may not always contain an even number of amino acid residues. Therefore, in those cases where a loop contains or is identified to comprise an odd number of amino acids, a half-loop of the odd-numbered loop will comprise the whole number portion or next whole number portion of the loop (number of amino acids of the loop/2+/−0.5 amino acids). For example, a loop identified as a 7 amino acid loop could produce half-loops of 3 amino acids or 4 amino acids (7/2=3.5+/−0.5 being 3 or 4).

As used herein, the term "domain," when referring to proteins, refers to a motif of a polypeptide having one or more identifiable structural or functional characteristics or properties (e.g., binding capacity, serving as a site for protein-protein interactions.)

As used herein, the term "half-domain," when referring to proteins, refers to a portion of an identified domain having at least half the number of amino acid resides as the domain from which it is derived. It is understood that domains may not always contain an even number of amino acid residues. Therefore, in those cases where a domain contains or is identified to comprise an odd number of amino acids, a half-domain of the odd-numbered domain will comprise the whole number portion or next whole number portion of the domain (number of amino acids of the domain/2+/−0.5 amino acids). For example, a domain identified as a 7 amino acid domain could produce half-domains of 3 amino acids or 4 amino acids (7/2=3.5+/−0.5 being 3 or 4). It is also understood that sub-domains may be identified within domains or half-domains, these subdomains possessing less than all of the structural or functional properties identified in the domains or half domains from which they were derived. It is also understood that the amino acids that comprise any of the domain types herein need not be contiguous along the backbone of the polypeptide (i.e., nonadjacent amino acids may fold structurally to produce a domain, half-domain or subdomain).

As used herein, the terms "site," as it pertains to amino acid based embodiments is used synonymously with "amino acid residue" and "amino acid side chain". A site represents a position within a peptide or polypeptide that may be modified, manipulated, altered, derivatized or varied within the polypeptide based molecules of the present invention.

As used herein, the terms "termini" or "terminus," when referring to proteins refers to an extremity of a peptide or polypeptide. Such extremity is not limited only to the first or final site of the peptide or polypeptide but may include additional amino acids in the terminal regions. The polypeptide based molecules of the present invention may be characterized as having both an N-terminus (terminated by an amino acid with a free amino group (NH2)) and a C-terminus (terminated by an amino acid with a free carboxyl group (COOH)).

Polypeptides or proteins of the invention are in some cases made up of multiple polypeptide chains brought together by disulfide bonds or by non-covalent forces (multimers, oligomers). These sorts of proteins will have multiple N- and C-termini. Alternatively, the termini of the polypeptides may be modified such that they begin or end, as the case may be, with a non-polypeptide based moiety such as an organic conjugate.

Once any of the features have been identified or defined as a component of a biocircuit system component, stimulus, effector module including the SREs or payloads of the invention, any of several manipulations and/or modifications of these features may be performed by moving, swapping, inverting, deleting, randomizing or duplicating. Furthermore, it is understood that manipulation of features may result in the same outcome as a modification to the compositions of the invention. For example, a manipulation which involved deleting a domain would result in the alteration of the length of a molecule just as modification of a nucleic acid to encode less than a full-length molecule would.

Modifications and manipulations can be accomplished by methods known in the art such as site directed mutagenesis. The resulting modified molecules may then be tested for activity using in vitro or in vivo assays such as those described herein or any other suitable screening assay known in the art.

In some embodiments, compositions of the present invention may comprise one or more atoms that are isotopes. As used herein, the term "Isotope" refers to a chemical element that has one or more additional neutrons. In some embodiments, compounds of the present invention may be deuterated. As used herein, the term "deuterate" refers to the process of replacing one or more hydrogen atoms in a substance with deuterium isotopes. Deuterium isotopes are isotopes of hydrogen. The nucleus of hydrogen contains one proton while deuterium nuclei contain both a proton and a neutron. The pharmaceutical compositions, biocircuits, biocircuit components, effector modules including their SREs or payloads of the present invention may be deuterated in order to change one or more physical property, such as stability, or to allow pharmaceutical compositions, biocircuits, biocircuit components, effector modules including their SREs or payloads to be used in diagnostic and/or experimental applications.

Effector modules may be designed to operate in groups of one, two, three, four or more modules. When more than one effector module is utilized in a biocircuit, it is known as an effector module system of that biocircuit.

At the protein level, any of the biocircuit components may comprise one or more post-translational modifications (PTM). Such PTMs may occur intracellularly after administration of a protein-based biocircuit component or upon or after translation of a biocircuit component administered as a nucleic acid encoding said biocircuit component.

Post translational modifications (PTMs) of the present invention include, but are not limited to acetylation, phosphorylation, ubiquitination, carboxylation, deamidation, deamination, deacetylation, dihydroxylation, dephosphorylation, formylation, gamma-carboxyglutamation, glutathionylation, glycation, hydroxylation, methylation, nitration, sumoylation, N- or O-transglutamination, glycosylation and farnesylation.

Effector modules, including their SREs and payloads, may independently have 1, 2, 3, 4, 5, 6, 7, 8, 9, 10 or more PTMs which are the same or different.

Effector modules may be designed to include one or more structural or functional domain, repeat, or motif of a protein family. Such domains, repeats and motifs are categorized by protein family; and representative families are given in the EMBL-EBI database, located at http://www.ebi.ac.uk/.

Polynucleotides of the Invention

Biocircuit components including effector modules, their SREs and payloads, may be nucleic acid-based. The term "nucleic acid," in its broadest sense, includes any compound and/or substance that comprise a polymer of nucleotides, e.g., linked nucleosides. These polymers are often referred to as polynucleotides. Exemplary nucleic acids or polynucleotides of the invention include, but are not limited to, ribonucleic acids (RNAs), deoxyribonucleic acids (DNAs), threose nucleic acids (TNAs), glycol nucleic acids (GNAs), peptide nucleic acids (PNAs), locked nucleic acids (LNAs, including LNA having a β-D-ribo configuration, α-LNA having an α-L-ribo configuration (a diastereomer of LNA), 2'-amino-LNA having a 2'-amino functionalization, and 2'-amino-α-LNA having a 2'-amino functionalization) or hybrids thereof.

In some embodiments, the nucleic acid molecule is a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Polynucleotides of the invention may be mRNA or any nucleic acid molecule and may or may not be chemically modified.

Traditionally, the basic components of an mRNA molecule include at least a coding region, a 5'UTR, a 3'UTR, a 5' cap and a poly-A tail. Building on this wild type modular structure, the present invention expands the scope of functionality of traditional mRNA molecules by providing payload constructs which maintain a modular organization, but which comprise one or more structural and/or chemical modifications or alterations which impart useful properties to the polynucleotide, for example tenability of function. As used herein, a "structural" feature or modification is one in which two or more linked nucleosides are inserted, deleted, duplicated, inverted or randomized in a polynucleotide without significant chemical modification to the nucleosides themselves. Because chemical bonds will necessarily be broken and reformed to effect a structural modification, structural modifications are of a chemical nature and hence are chemical modifications. However, structural modifications will result in a different sequence of nucleotides. For example, the polynucleotide "ATCG" may be chemically modified to "AT-5meC-G". The same polynucleotide may be structurally modified from "ATCG" to "ATCCCG". Here, the dinucleotide "CC" has been inserted, resulting in a structural modification to the polynucleotide.

In some embodiments, polynucleotides of the present invention may harbor 5'UTR sequences which play a role in translation initiation. 5'UTR sequences may include features such as Kozak sequences which are commonly known to be involved in the process by which the ribosome initiates translation of genes, Kozak sequences have the consensus XCCR(A/G) CCAUG, where R is a purine (adenine or guanine) three bases upstream of the start codon (AUG) and X is any nucleotide. In one embodiment, the Kozak sequence is ACCGCC. By engineering the features that are typically found in abundantly expressed genes of target cells or tissues, the stability and protein production of the polynucleotides of the invention can be enhanced.

Further provided are polynucleotides, which may contain an internal ribosome entry site (IRES) which play an important role in initiating protein synthesis in the absence of 5' cap structure in the polynucleotide. An IRES may act as the sole ribosome binding site, or may serve as one of the multiple binding sites. Polynucleotides of the invention containing more than one functional ribosome binding site may encode several peptides or polypeptides that are translated independently by the ribosomes giving rise to bicistronic and/or multicistronic nucleic acid molecules.

In some embodiments, regions of the polynucleotides of the invention which may encode a biocircuit component, effector module, SRE or peptide or protein may include from about 30 to about 100,000 nucleotides (e.g., from 30 to 50, from 30 to 100, from 30 to 250, from 30 to 500, from 30 to 1,000, from 30 to 1,500, from 30 to 3,000, from 30 to 5,000, from 30 to 7,000, from 30 to 10,000, from 30 to 25,000, from 30 to 50,000, from 30 to 70,000, from 100 to 250, from 100 to 500, from 100 to 1,000, from 100 to 1,500, from 100 to 3,000, from 100 to 5,000, from 100 to 7,000, from 100 to 10,000, from 100 to 25,000, from 100 to 50,000, from 100 to 70,000, from 100 to 100,000, from 500 to 1,000, from 500 to 1,500, from 500 to 2,000, from 500 to 3,000, from 500 to 5,000, from 500 to 7,000, from 500 to 10,000, from 500 to 25,000, from 500 to 50,000, from 500 to 70,000, from 500 to 100,000, from 1,000 to 1,500, from 1,000 to 2,000, from 1,000 to 3,000, from 1,000 to 5,000, from 1,000 to 7,000, from 1,000 to 10,000, from 1,000 to 25,000, from 1,000 to 50,000, from 1,000 to 70,000, from 1,000 to 100,000, from 1,500 to 3,000, from 1,500 to 5,000, from 1,500 to 7,000, from 1,500 to 10,000, from 1,500 to 25,000, from 1,500 to 50,000, from 1,500 to 70,000, from 1,500 to 100,000, from 2,000 to 3,000, from 2,000 to 5,000, from 2,000 to 7,000, from 2,000 to 10,000, from 2,000 to 25,000, from 2,000 to 50,000, from 2,000 to 70,000, and from 2,000 to 100,000 nucleotides).

Other regions of the polynucleotides which encode certain features such as for example cleavage sites, trafficking signals such as localization signals or smaller features may range independently from 15-1,000 nucleotides in length (e.g., greater than 30, 40, 45, 50, 55, 60, 70, 80, 90, 100, 120, 140, 160, 180, 200, 250, 300, 350, 400, 450, 500, 600, 700, 800, and 900 nucleotides or at least 30, 40, 45, 50, 55, 60, 70, 80, 90, 100, 120, 140, 160, 180, 200, 250, 300, 350, 400, 450, 500, 600, 700, 800, 900, and 1,000 nucleotides).

According to the present invention, multiple distinct biocircuit components, effector modules, their SREs or payloads may be linked together through the 3'-end using nucleotides which are modified at the 3-terminus. Chemical conjugation may be used to control the stoichiometry of delivery into cells. Polynucleotides encoding biocircuit components, effector modules, their SREs or payloads can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug. They may also be conjugated to, administered with, or further encode one or more of RNAI agents, siRNAs, shRNAs, miRNAs, miRNA binding sites, antisense RNAs, ribozymes, catalytic DNA, tRNA, RNAs that induce triple helix formation, aptamers or vectors, and the like.

Once any of the features have been identified or defined as a desired component of a biocircuit, effector modules, their SREs or payloads to be encoded by the polynucleotides the invention, any of several manipulations and/or modifications of these features may be performed by moving, swapping, inverting, deleting, randomizing or duplicating. Furthermore, it is understood that manipulation of features may result in the same outcome as a modification to the molecules of the invention. For example, a manipulation which involved deleting a domain would result in the alteration of the length of a molecule just as modification of a nucleic acid to encode less than a full-length molecule would.

Modifications and manipulations can be accomplished by methods known in the art such as, but not limited to, site directed mutagenesis. The resulting modified molecules may then be tested for activity using in vitro or in vivo assays such as those described herein or any other suitable screening assay known in the art.

In one embodiment, polynucleotides of the present invention may encode variant polypeptides which have a certain identity with a reference polypeptide sequence. As used herein, a "reference polypeptide sequence" refers to a starting polypeptide sequence. Reference sequences may be wild type sequences or any sequence to which reference is made in the design of another sequence. A "reference polypeptide sequence" may, e.g., be any one of the protein sequences SEQ ID NO: 1-102450, 212852-213270, or those listed in Tables 2, 4 or 5, or any starting polypeptide sequence or fragment thereof.

The term "identity" as known in the art, refers to a relationship between two or more sequences, as determined by comparing the sequences. In the art, identity also means the degree of sequence relatedness between sequences, as determined by the number of matches between strings of two or more residues (amino acid or nucleic acid). Identity measures the percent of identical matches between two or more sequences with gap alignments (if any) addressed by a particular mathematical model or computer program (i.e., "algorithms"). Identity of related sequences can be readily calculated by known methods. Such methods include, but are not limited to, those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; Sequence Analysis Primer, Gribskov, M. and Devereux, J., eds., M. Stockton Press, New York, 1991; and Carillo et al., SIAM J. Applied Math. 48, 1073 (1988).

In some embodiments, the variant sequence may have the same or a similar activity as the reference sequence. Alternatively, the variant may have an altered activity (e.g., increased or decreased) relative to a reference sequence. Generally, variants of a particular polynucleotide or polypeptide of the invention will have at least about 40%, 45%, 50%, 55%, 60%, 65%, 70%, 75%, 80%, 85%, 90%, 91%, 92%, 93%, 94%, 95%, 96%, 97%, 98%, 99% but less than 100% sequence identity to that particular reference polynucleotide or polypeptide as determined by sequence alignment programs and parameters described herein and known to those skilled in the art. Such tools for alignment include those of the BLAST suite (Stephen F. Altschul, Thomas L. Madden, Alejandro A. Schaffer, Jinghui Zhang, Zheng Zhang, Webb Miller, and David J. Lipman (1997), "Gapped BLAST and PSI-BLAST: a new generation of protein database search programs", Nucleic Acids Res. 25:3389-3402.)

RNA Binding Domains

In one embodiment, the polynucleotides of the invention comprise at least one RNA-binding motif such as, but not limited to a RNA-binding domain (RBD).

RNA binding proteins (RBPs) can regulate numerous aspects of co- and post-transcription gene expression such as, but not limited to, RNA splicing, localization, translation, turnover, polyadenylation, capping, modification, export and localization. RNA-binding domains (RBDs), such as, but not limited to, RNA recognition motif (RR) and hnRNP K-homology (KH) domains, typically regulate the sequence association between RBPs and their RNA targets (Ray et al. Nature 2013. 499:172-177; herein incorporated by reference in its entirety). In one embodiment, RBDs can bind short RNA sequences. In another embodiment, the RBDs can recognize structure RNAs.

Exosome Quantification

In one embodiment, the polynucleotides of the present invention may be quantified in exosomes derived from one or more bodily fluid. As used herein "bodily fluids" include peripheral blood, serum, plasma, ascites, urine, cerebrospinal fluid (CSF), sputum, saliva, bone marrow, synovial fluid, aqueous humor, amniotic fluid, cerumen, breast milk, broncheoalveolar lavage fluid, semen, prostatic fluid, cowper's fluid or pre-ejaculatory fluid, sweat, fecal matter, hair, tears, cyst fluid, pleural and peritoneal fluid, pericardial fluid, lymph, chyme, chyle, bile, interstitial fluid, menses, pus, sebum, vomit, vaginal secretions, mucosal secretion, stool water, pancreatic juice, lavage fluids from sinus cavities, bronchopulmonary aspirates, blastocyl cavity fluid, and umbilical cord blood. Alternatively, exosomes may be retrieved from an organ selected from the group consisting of lung, heart, pancreas, stomach, intestine, bladder, kidney, ovary, testis, skin, colon, breast, prostate, brain, esophagus, liver, and placenta.

It is advantageous to correlate the level of polynucleotides with one or more clinical phenotypes or with an assay for a human disease biomarker. The assay may be performed using construct specific probes, cytometry, qRT-PCR, real-time PCR, PCR, flow cytometry, electrophoresis, mass spectrometry, or combinations thereof while the exosomes may be isolated using immunohistochemical methods such as enzyme linked immunosorbent assay (ELISA) methods. Exosomes may also be isolated by size exclusion chromatography, density gradient centrifugation, differential centrifugation, nanomembrane ultrafiltration, immunoabsorbent capture, affinity purification, microfluidic separation, or combinations thereof.

Chemical Modifications to Polynucleotides

According to the present invention, the terms "modification" or, as appropriate, "modified" polynucleotides refer to modification with respect to A, G, U (T in DNA) or C nucleotides.

Modifications of the polynucleotides of the invention may be on the nucleoside base and/or sugar portion of the nucleosides which comprise the polynucleotide. In some embodiments, multiple modifications are included in the modified nucleic acid or in one or more individual nucleoside or nucleotide. For example, modifications to a nucleoside may include one or more modifications to the nucleobase and the sugar. Modifications to the polynucleotides of the present invention may include any of those taught in, for example, International Publication WO2013052523, the contents of which are incorporated herein by reference in its entirety.

As described herein "nucleoside" is defined as a compound containing a sugar molecule (e.g., a pentose or ribose) or a derivative thereof in combination with an organic base (e.g., a purine or pyrimidine) or a derivative thereof (also referred to herein as "nucleobase"). As described herein, "nucleotide" is defined as a nucleoside including a phosphate group.

The modified nucleotides, which may be incorporated into a polynucleotide can be modified on the internucleoside linkage (e.g., phosphate backbone). Herein, in the context of the polynucleotide backbone, the phrases "phosphate" and "phosphodiester" are used interchangeably. Backbone phosphate groups can be modified by replacing one or more of the oxygen atoms with a different substituent. Further, the modified nucleosides and nucleotides can include the wholesale replacement of an unmodified phosphate moiety with another internucleoside linkage. Examples of modified phosphate groups include, but are not limited to, phosphorothioate, phosphoroselenates, boranophosphates, boranophosphate esters, hydrogen phosphonates, phosphoramidates, phosphorodiamidates, alkyl or aryl phosphonates, and phosphotriesters. Phosphorodithioates have both non-linking oxygens replaced by sulfur. The phosphate linker can also be modified by the replacement of a linking oxygen with nitrogen (bridged phosphoramidates), sulfur (bridged phosphorothioates), and carbon (bridged methylene-phosphonates). Other modifications which may be used are taught in, for example, International Application WO2013052523, the contents of which are incorporated herein by reference in their entirety.

Nucleotide and Nucleosides Modifications

Chemical modifications and/or substitution of the nucleotides or nucleobases of the polynucleotides of the invention which are useful in the present invention include, but are not limited to: (±)1-(2-Hydroxypropyl)pseudouridine TP, (2R)-1-(2-Hydroxypropyl)pseudouridine TP, (2S)-1-(2-Hydroxypropyl)pseudouridine TP, (E)-5-(2-Bromo-vinyl)ara-uridine TP, (E)-5-(2-Bromo-vinyl)cytidine TP, (E)-5-(2-Bromo-vinyl)uridine TP, (Z)-5-(2-Bromo-vinyl)ara-uridine TP, (Z)-5-(2-Bromo-vinyl)uridine TP, 1 (aminoalkylamino-carbonylethylenyl)-2(thio)-pseudouracil, 1 (aminoalkylaminocarbonylethylenyl)-2,4-(dithio)pseudouracil, 1 (aminoalkylaminocarbonylethylenyl)-4 (thio) pseudouracil, 1 (aminoalkylaminocarbonylethylenyl)-pseudouracil, 1 (aminocarbonylethylenyl)-2(thio)-pseudouracil, 1 (aminocarbonylethylenyl)-2,4-(dithio) pseudouracil, 1 (aminocarbonylethylenyl)-4 (thio) pseudouracil, 1 (aminocarbonylethylenyl)-pseudouracil, 1 substituted 2(thio)-pseudouracil, 1 substituted 2,4-(dithio) pseudouracil, 1 substituted 4 (thio)pseudouracil, 1 substituted pseudouracil, 1-(2,2,2-Trifluoroethyl)-pseudo-UTP, 1-(2,2,3,3,3-Pentafluoropropyl)pseudouridine TP, 1-(2,2-Diethoxyethyl)pseudouridine TP, 1-(2,4,6-Trimethylbenzyl) pseudouridine TP, 1-(2,4,6-Trimethyl-benzyl)pseudo-UTP, 1-(2,4,6-Trimethyl-phenyl)pseudo-UTP, 1-(2-Amino-2-carboxyethyl)pseudo-UTP, 1-(2-Amino-ethyl)pseudo-UTP, 1-(2-Hydroxyethyl)pseudouridine TP, 1-(2-Methoxyethyl) pseudouridine TP, 1-(3,4-Bis-trifluoromethoxybenzyl) pseudouridine TP, 1-(3,4-Dimethoxybenzyl)pseudouridine TP, 1-(3-Amino-3-carboxypropyl)pseudo-UTP, 1-(3-Amino-propyl)pseudo-UTP, 1-(3-Cyclopropyl-prop-2-ynyl) pseudouridine TP, 1-(4-Amino-4-carboxybutyl)pseudo-UTP, 1-(4-Amino-benzyl)pseudo-UTP, 1-(4-Amino-butyl) pseudo-UTP, 1-(4-Amino-phenyl)pseudo-UTP, 1-(4-Azidobenzyl)pseudouridine TP, 1-(4-Bromobenzyl) pseudouridine TP, 1-(4-Chlorobenzyl)pseudouridine TP, 1-(4-Fluorobenzyl)pseudouridine TP, 1-(4-Iodobenzyl) pseudouridine TP, 1-(4-Methanesulfonylbenzyl)pseudouridine TP, 1-(4-Methoxybenzyl)pseudouridine TP, 1-(4-Methoxy-benzyl)pseudo-UTP, 1-(4-Methoxy-phenyl) pseudo-UTP, 1-(4-Methylbenzyl)pseudouridine TP, 1-(4-Methyl-benzyl)pseudo-UTP, 1-(4-Nitrobenzyl) pseudouridine TP, 1-(4-Nitro-benzyl)pseudo-UTP, 1(4-Nitro-phenyl)pseudo-UTP, 1-(4-Thiomethoxybenzyl) pseudouridine TP, 1-(4-Trifluoromethoxybenzyl) pseudouridine TP, 1-(4-Trifluoromethylbenzyl) pseudouridine TP, 1-(5-Amino-pentyl)pseudo-UTP, 1-(6-Amino-hexyl)pseudo-UTP, 1-(aminoalkylamino-carbonylethylenyl)-2-(thio)-pseudouracil, 1-(aza)-2-(thio)-3-(aza)-phenoxazin-1-yl, 1,2'-O-dimethyladenosine, 1,2'-O-dimethylguanosine, 1,2'-O-dimethylinosine, 1,3-(diaza)-2-(oxo)-phenthiazin-1-yl, 1,3-(diaza)-2-(oxo)-phenoxazin-1-yl, 1,3,5-(triaza)-2,6-(dioxa)-naphthalene, 1,6-Dimethyl-pseudo-UTP, 1-[3-(2-{2-[2-(2-Aminoethoxy)-ethoxy]-ethoxy}-ethoxy)-propionyl]pseudouridine TP, 1-{3-[2-(2-Aminoethoxy)-ethoxy]-propionyl}pseudouridine TP, 1-Acetylpseudouridine TP, 1-Alkyl-6-(1-propynyl)-pseudo-UTP, 1-Alkyl-6-(2-propynyl)-pseudo-UTP, 1-Alkyl-6-allyl-pseudo-UTP, 1-Alkyl-6-ethynyl-pseudo-UTP, 1-Alkyl-6-homoallyl-pseudo-UTP, 1-Alkyl-6-vinyl-pseudo-UTP, 1-Allylpseudouridine TP, 1-Aminomethyl-pseudo-UTP, 1-Benzoylpseudouridine TP, 1-Benzyloxymethylpseudouridine TP, 1-Benzyl-pseudo-UTP, 1-Biotinyl-PEG2-pseudouridine TP, 1-Biotinylpseudouridine TP, 1-Butyl-pseudo-UTP, 1-carboxymethyl-pseudouridine, 1-Cyanomethylpseudouridine TP, 1-Cyclobutylmethyl-pseudo-UTP, 1-Cyclobutyl-pseudo-UTP, 1-Cycloheptylmethyl-pseudo-UTP, 1-Cycloheptyl-pseudo-UTP, 1-Cyclohexylmethyl-pseudo-UTP, 1-Cyclohexyl-pseudo-UTP, 1-Cyclooctylmethyl-pseudo-UTP, 1-Cyclooctyl-pseudo-UTP, 1-Cyclopentylmethyl-pseudo-UTP, 1-Cyclopentyl-pseudo-UTP, 1-Cyclopropylmethyl-pseudo-UTP, 1-Cyclopropyl-pseudo-UTP, 1-Deazaadenosine TP, 1-Ethyl-pseudo-UTP, 1-Hexyl-pseudo-UTP, 1-Homoallylpseudouridine TP, 1-Hydroxymethylpseudouridine TP, 1-iso-propyl-pseudo-UTP, 1-Me-2-thio-pseudo-UTP, 1-Me-4-thio-pseudo-UTP, 1-Me-alpha-thio-pseudo-UTP, 1-Me-GTP, 1-Methanesulfonylmethylpseudouridine TP, 1-Methoxymethylpseudouridine TP, 1-methyl-1-deaza-pseudoisocytidine, 1-methyl-1-deaza-pseudouridine, 1-Methyl-3-(3-amino-3-carboxypropyl) pseudouridine TP, 1-Methyl-3-(3-amino-3-carboxypropyl)pseudo-UTP, 1-methyl-3-(3-amino-5-carboxypropyl)pseudouridine, 1-Methyl-6-(2,2,2-Trifluoroethyl)pseudo-UTP, 1-Methyl-6-(4-morpholino)-pseudo-UTP, 1-Methyl-6-(4-thiomorpholino)-pseudo-UTP, 1-Methyl-6-(substituted phenyl)pseudo-UTP, 1-Methyl-6-amino-pseudo-UTP, 1-Methyl-6-azido-pseudo-UTP, 1-Methyl-6-bromo-pseudo-UTP, 1-Methyl-6-butyl-pseudo-UTP, 1-Methyl-6-chloro-pseudo-UTP, 1-Methyl-6-cyano-pseudo-UTP, 1-Methyl-6-dimethylamino-pseudo-UTP, 1-Methyl-6-ethoxy-pseudo-UTP, 1-Methyl-6-ethylcarboxylate-pseudo-UTP, 1-Methyl-6-ethyl-pseudo-UTP, 1-Methyl-6-fluoro-pseudo-UTP, 1-Methyl-6-formyl-pseudo-UTP, 1-Methyl-6-hydroxyamino-pseudo-UTP, 1-Methyl-6-hydroxy-pseudo-UTP, 1-Methyl-6-iodo-pseudo-UTP, 1-Methyl-6-iso-propyl-pseudo-UTP, 1-Methyl-6-methoxy-pseudo-UTP, 1-Methyl-6-methylamino-pseudo-UTP, 1-Methyl-6-phenyl-pseudo-UTP, 1-Methyl-6-propyl-pseudo-UTP, 1-Methyl-6-tert-butyl-pseudo-UTP, 1-methyl-6-thio-guanosine, 1-Methyl-6-trifluoromethoxy-pseudo-UTP, 1-Methyl-6-trifluoromethyl-pseudo-UTP, 1-methyladenosine, 1-methylguanosine, 1-methylinosine, 1-methylpseduouridine, 1-methyl-pseudoisocytidine, 1-methyl-pseudouridine, 1-Methyl-pseudo-UTP, 1-Morpholinomethylpseudouridine TP, 1-Pentyl-pseudo-UTP, 1-Phenyl-pseudo-UTP, 1-Pivaloylpseudouridine TP, 1-Propargylpseudouridine TP, 1-Propyl-pseudo-UTP, 1-propynylpseudouridine, 1-propynyl-uridine, 1-p-tolyl-pseudo-UTP, 1-taurinomethyl-1-methyl-uridine, 1-taurinomethyl-4-thio-uridine, 1-taurinomethyl-pseudouridine, 1-tert-Butyl-pseudo-UTP, 1-Thiomethoxymethylpseudouridine TP, 1-Thiomorpholinomethylpseudouridine TP, 1-Trifluoroacetylpseudouridine TP, 1-Trifluoromethyl-pseudo-UTP, 1-Vinylpseudouridine TP, 2 (amino)adenine, 2 (amino)purine, 2 (aminopropyl)adenine, 2 (methylthio) N6 (isopentenyl)adenine, 2 (propyl)guanine, 2 (thio)pseudouracil, 2' deoxy uridine, 2' fluorouridine, 2-(alkyl)adenine, 2-(alkyl) guanine, 2-(aminoalkyl)adenine, 2-(aminopropyl)adenine, 2-(halo)adenine, 2-(propyl)adenine, 2-(thio)cytosine, 2-(thio)uracil, 2-, 6-, 7- or 8-position of the purine base (ANG/inosine), 2,2'-anhydro-cytidine TP hydrochloride, 2,2'-anhydro-uridine TP, 2,2-dimethyl-guanosine, 2,4-(dithio)psuedouracil, 2,4,5-(trimethyl)phenyl, 2,4-diaminopurine, 2,6-(diamino)purine, 2,6-diaminopurine, 2' methyl, 2'amino, 2'azido, 2'fluro-cytidine, 2' methyl, 2'amino, 2'azido, 2'fluro-adenine, 2' methyl, 2'amino, 2'azido, 2'fluroguanosine, 2'-Amino-2'-deoxy-ATP, 2'-Amino- 2'-deoxy-CTP, 2'-Amino-2'-deoxy-GTP, 2'-Amino-2'-deoxy-UTP, 2'-Azido-2'-deoxy-ATP, 2'-Azido-2'-deoxy-CTP, 2'-Azido-2'-deoxy-GTP, 2'-Azido-2'-deoxy-UTP, 2'-Azido-deoxyuridine TP, 2'-bromo-deoxyuridine TP, 2'-F-5-Methyl-2'-deoxy-UTP, 2'Fluor-N4-Bz-cytidine TP, 2'Fluoro-N2-isobutyl-guanosine TP, 2'Fluoro-N4-Acetyl-cytidine TP, 2'Fluoro-N6-Bz-deoxyadenosine TP, 2'Fluro-N2-isobutyl-guanosine TP, 2'methyl, 2'amino, 2'azido, 2'fluro-uridine, 2'-OMe-2-Amino-ATP, 2'-OMe-5-Me-UTP, 2'-OMe-6-Me-UTP, 2'-OMe-pseudo-UTP, 2-O- methyladenosine, 2'O-methyl-N2-isobutyl-guanosine TP, 2'-O-Methyl-N4-Acetyl-cytidine TP, 2'O-methyl-N4-Bz-cytidine TP, 2'O-methyl-N6-Bz-deoxyadenosine TP, 2'-O-methylpseudouridine, 2'-O-methyluridine, 2' deoxy uridine, 2' fluorouridine, 2'-O-methyladenosine, 2'-O-methylcytidine, 2'-O-methylguanosine, 2'-O-methyluridine, 2'-a-Ethynyladenosine TP, 2'-a-Ethynylcytidine TP, 2'-a-Ethynylguanosine TP, 2'-a-Ethynyluridine TP, 2'-amino-2'-deoxy-, 2'-amino-2'-deoxyadenosine, 2'-amino-2'-deoxycytidine, 2'-amino-2'- deoxyguanosine, 2'-amino-2'-deoxyribose, 2'-amino-2'-deoxyuridine, 2-amino-6-Chloro-purine, 2-Amino-A/U/G/C, 2-aminoadenine, 2-Aminoadenosine TP, 2-Amino-ATP, 2'-aminopropargyl, 2-aminopurine, 2-Amino-riboside-TP, 2'-araadenosine, 2'-aracytidine, 2'-arauridine, 2'-a-Trifluoromethyladenosine TP, 2'-a-Trifluoromethylcytidine TP, 2'-a-Trifluoromethylguanosine TP, 2'-a-Trifluoromethyluridine TP, 2-aza-inosinyl, 2'-azido-2'-deoxyuridine, 2'-Azido-2'-deoxyadenosine, 2'-azido-2'-deoxycytidine, 2'-azido-2'-deoxyguanosine, 2'-azido-2'-deoxyribose, 2'-azido-2'-deoxyuridine, 2'-Azido-2a-deoxyadenosine, 2-Azidoadenosine TP, 2'-b-Ethynyladenosine TP, 2'-b-Ethynylcytidine TP, 2'-b-Ethynylguanosine TP, 2'-b-Ethynyluridine TP, 2-Bromoadenosine TP, 2'-b-Trifluoromethyladenosine TP, 2'-b-Trifluoromethylcytidine TP, 2'-b-Trifluoromethylguanosine TP, 2'-b-Trifluoromethyluridine TP, 2'-C-alkyl oligoribonucleotide, 2-Chloroadenosine TP, 2'-deoxy-uridines, 2'-Deoxy-2',2'-difluoroadenosine TP, 2'-Deoxy-2',2'-difluorocytidine TP, 2'-Deoxy-2',2'-difluoroguanosine TP, 2'-Deoxy-2',2'-difluorouridine TP, 2'-Deoxy-2'-a-aminoadenosine TP, 2'-Deoxy-2'-a-aminocytidine TP, 2'-Deoxy-2'-a-aminoguanosine TP, 2'-Deoxy-2'-a-aminouridine TP, 2'-Deoxy-2'-a-azidoadenosine TP, 2'-Deoxy-2'-a-azidocytidine TP, 2'-Deoxy-2'-a-azidoguanosine TP, 2'-Deoxy-2'-a-azidouridine TP, 2'-Deoxy-2'-a-mercaptoadenosine TP, 2'-Deoxy-2'-a-mercaptocytidine TP, 2'-Deoxy-2'-a-mercaptoguanosine TP, 2'-Deoxy-2'-a-mercaptouridine TP, 2'-Deoxy-2'-a-thiomethoxyadenosine TP, 2'-Deoxy-2'-a-thiomethoxycytidine TP, 2'-Deoxy-2'-a-thiomethoxyguanosine TP, 2'-Deoxy-2'-a-thiomethoxyuridine TP, 2'-Deoxy-2'-b-aminoadenosine TP, 2'-Deoxy-2'-b-aminocytidine TP, 2'-Deoxy-2'-b-aminoguanosine TP, 2'-Deoxy-2'-b-aminouridine TP, 2'-Deoxy-2'-b-azidoadenosine TP, 2'-Deoxy-2'-b-azidocytidine TP, 2'-Deoxy-2'-b-azidoguanosine TP, 2'-Deoxy-2'-b-azidouridine TP, 2'-Deoxy-2'-b-bromoadenosine TP, 2'-Deoxy-2'-b-bromocytidine TP, 2'-Deoxy-2'-b-bromoguanosine TP, 2'-Deoxy-2'-b-bromouridine TP, 2'-Deoxy-2'-b-chloroadenosine TP, 2'-Deoxy-2'-b-chlorocytidine TP, 2'-Deoxy-2'-b-chloroguanosine TP, 2'-Deoxy-2'-b-chlorouridine TP, 2'-Deoxy-2'-b-fluoroadenosine TP, 2'-Deoxy-2'-b-fluorocytidine TP, 2'-Deoxy-2'-b-fluoroguanosine TP, 2'-Deoxy-2'-b-fluorouridine TP, 2'-Deoxy-2'-b-iodoadenosine TP, 2'-Deoxy-2'-b-iodocytidine TP, 2'-Deoxy-2'-b-iodoguanosine TP, 2'-Deoxy-2'-b-iodouridine TP, 2'-Deoxy-2'-b-mercaptoadenosine TP, 2'-Deoxy-2'-b-mercaptocytidine TP, 2'-Deoxy-2'-b-mercaptoguanosine TP, 2'-Deoxy-2'-b-mercaptouridine TP, 2'-Deoxy-2'-b-thiomethoxyadenosine TP, 2'-Deoxy-2'-b-thiomethoxycytidine TP, 2'-Deoxy-2'-b-thiomethoxyguanosine TP, 2'-Deoxy-2'-b-thiomethoxyuridine TP, 2'-deoxy-2'-C-alkyl oligoribonucleotide, 2'-deoxy-2'-deamine oligoribonucleotide, 2'-deoxy-2'-fluoro-oligoribonucleotide, 2'-deoxy-A/U/G/C, 2'-deoxyuridine, 2'-fluorouridines, 2'-fluoro-2'-deoxy, 2'-fluoro-2'-deoxyadenosine, 2'-fluoro-2'-deoxycytidine, 2'-fluoro-2'-deoxyguanosine, 2'fluoro-2'-deoxyribose, 2'-fluoro-2'-deoxyuridine, 2'-fluoro-A/U/G/C, 2-Fluoroadenosine TP, 2'fluoroC/2thioU, 2'-fluoro-modified bases, 2'-fluorothymidine, 2-Iodoadenosine TP, 2'MeA/2thioU, 2'MeC/2thioU, 2'MeG/2thioU, 2-Mercaptoadenosine TP, 2-methoxy-4-thio-pseudouridine, 2-methoxy-4-thio-uridine, 2-methoxy-5-methylcytidine, 2-methoxy-adenine, 2-methoxy-cytidine, 2'-methoxyethyl, 2-methoxyuridine, 2-methyladenosine, 2-methyl-guanosine, 2-methylpseudouridine, 2-methylthio-adenine, 2-methylthio-N6-(cis-hydroxyisopentenyl)adenosine, 2-methylthio-N6-hydroxynorvalyl carbamoyladenosine, 2-methylthio-N6-methyladenosine, 2-methylthio-N6-threonyl carbamoyladenosine, 2'-methyluridine, 2'-O-methyl-2'-deoxyguanosine, 2'-O-(3-aminopropyl), 2'-O-alkenyl-A/U/G/C, 2'-O-alkinyl-A/U/G/C, 2'-O-alkyl-oligoribonucleotide, 2'-O-allyl-A/U/G/C, 2'-O-butyl-A/U/G/C, 2'-O-fluoro (2'-OF), 2'-OH-ara-adenosine TP, 2'-OH-ara-cytidine TP, 2'-OH-ara-guanosine TP, 2'-OH-ara-uridine TP, 2'-O-methyl (2'-OMe), 2'-O-methyl adenosine, 2'-O-methyl guanosine, 2'-O-Methyl inosine, 2'-O-methyl uridine, 2'-O-methyl-2-aminoadenosine, 2'-O-methyl-2'-deoxy-, 2'-O-Methyl-2'-deoxyadenosine, 2'-O-methyl-2'-deoxycytidine, 2'-O-Methyl-2'-deoxyguanosine, 2'-O-methyl-2'-deoxyuridine, 2'-O-Methyl-5-(1-propynyl)cytidine TP, 2'-O-Methyl-5-(1-propynyl)uridine TP, 2'-O-methyl-5-methyluridine, 2'-O-methylinosine, 2'-O-methylpseudouridine, 2'-O-methyl-ribose, 2'-O-propyl-A/U/G/C, 2'-O-ribosyladenosine (phosphate), 2'-O-ribosylguanosine (phosphate), 2-oxo-7-aminopyridopyrimidin-3-yl, 2-oxo-pyridopyrimidine-3-yl, 2'-position of the sugar of adenosine, 2'-position of the sugar of cytidine, 2'-position of the sugar of guanosine, 2'-position of the sugar of inosine, 2'-position of the sugar of uridine, 2'-propinyl-A/U/G/C, 2-pyridinone, 2-thio-1-methyl-1-deaza-pseudouridine, 2-thio-1-methyl-pseudouridine, 2-thio-2'-O-methyluridine, 2-thio-5-aza-uridine, 2-thio-5-methylcytidine, 2-thiocytidine, 2-thio-dihydropseudouridine, 2-thio-dihydrouridine, 2-thio-pseudouridine, 2thioU/2'aminoC, 2thioU/2'azidoG, 2-thiouridine, 2-thio-zebularine, 2-Trifluoromethyladenosine TP, 3 (3 amino-3 carboxypropyl)uracil, 3 (deaza) 5 (aza)cytosine, 3 (methyl) cytosine, 3 nitropyrrole, 3-(3-amino-3-carboxypropyl)uridine, 3-(3-Amino-3-carboxypropyl)-Uridine TP, 3-(alkyl)cytosine, 3-(deaza) 5 (aza)cytosine, 3-(methyl)-7-(propynyl) isocarbostyrilyl, 3-(methyl)cytidine, 3-(methyl) isocarbostyrilyl, 3,2'-O-dimethyluridine, 3,2'-O-Dimethyluridine TP, 3-Alkyl-pseudo-UTP, 3-Deaza-3-bromoadenosine TP, 3-Deaza-3-chloroadenosine TP, 3-Deaza-3-fluoroadenosine TP, 3-Deaza-3-iodoadenosine TP, 3-Deazaadenosine TP, 3-Ethynylcytidine TP, 3-methylcytidine, 3-Methyl-pseudo-Uridine TP, 3-methyluridine, 4 (thio)pseudouracil, 4-(fluoro)-6-(methyl)benzimidazole, 4-(methyl)benzimidazole, 4-(methyl)indolyl, 4-(thio)pseudouracil, 4-(thio)uracil, 4-, 5- or 6-position of the pyrimidine base (C/U), 4,2'-O-dimethylcytidine, 4,6-(dimethyl)indolyl, 4-acetyl-cytosine, 4'-Azidoadenosine TP, 4'-Azidocytidine TP, 4'-Azidoguanosine TP, 4'-Azidouridine TP, 4'-Carbocyclic adenosine TP, 4'-Carbocyclic cytidine TP, 4'-Carbocyclic guanosine TP, 4'-Carbocyclic uridine TP, 4-demethylwyosine, 4'-Ethynyladenosine TP, 4'-Ethynylcytidine TP, 4'-Ethynylguanosine TP, 4'-Ethynyluridine TP, 4-methoxy-1-methyl-pseudoisocytidine, 4-methoxy-2-thio-pseudouridine, 4-methoxy-pseudoisocytidine, 4-methoxy-pseudouridine, 4-methylcytidine, 4-thio-1-methyl-1-deaza-pseudoisocytidine, 4-thio-1-methyl-pseudoisocytidine, 4-thio-1-methyl-pseudouridine, 4-thio-A/U/G/C, 4-thio-pseudoisocytidine, 4-thio-pseudouridine, 4-Thio-pseudo-UTP, 4thioU/2thioU, 4-thiouracil, 4-thiouridine, 5 (1,3-diazole-1-alkyl)uracil, 5 (2-aminopropyl)uracil, 5 (aminoalkyl)uracil, 5 (dimethylaminoalkyl)uracil, 5 (guanidiniumalkyl)uracil, 5 (halo)cytosine, 5 (methoxycarbonylmethyl)-2-(thio)uracil, 5 (methoxycarbonyl-methyl)uracil, 5 (methyl) 2 (thio)uracil, 5 (methyl) 2,4 (dithio)uracil, 5 (methyl) 4 (thio)uracil, 5 (methyl)cytosine, 5 (methylaminomethyl)-2 (thio)uracil, 5 (methylaminomethyl)-2,4 (dithio)uracil, 5 (methylaminomethyl)-4 (thio)uracil, 5 (propynyl)cytosine, 5 (propynyl)uracil, 5 (trifluoromethyl) cytosine, 5 (trifluoromethyl)uracil, 5 nitroindole, 5 substituted pyrimidines, 5-(1-Propynyl)ara-cytidine TP, 5-(1-Propynyl)ara-uridine TP, 5-(2-aminopropyl)uracil, 5-(2-carbomethoxyvinyl)uridine TP, 5-(2-Chloro-phenyl)-2-thiocytidine TP, 5-(2-Furanyl)uridine TP, 5-(4-Amino-phenyl)-2-thiocytidine TP, 5-(alkyl)-2-(thio)pseudouracil, 5-(alkyl)-2,4 (dithio)pseudouracil, 5-(alkyl)-4 (thio)pseudouracil, 5-(alkyl)cytosine, 5-(alkyl)pseudouracil, 5-(alkyl)uracil, 5-(alkynyl)cytosine, 5-(alkynyl)uracil, 5-(allylamino)uracil, 5-(C1-C6)-alkylcytosine, 5-(C1-C6)-alkyluracil, 5-(C2-C6)-alkenylcytosine, 5-(C2-C6)-alkenyluracil, 5-(C2-C6)-alkynylcytosine, 5-(C2-C6)-alkynyluracil, 5-(carboxyhydroxymethyl)pyrimidine methyl ester-, 5-(carboxyhydroxymethyl)uridine, 5-(carboxyhydroxymethyl)uridine methyl ester, 5-(cyanoalkyl)uracil, 5-(dialkylaminoalkyl)uracil, 5-(dimethylaminoalkyl)uracil, 5-(guanidiniumalkyl)uracil, 5-(halo)cytosine, 5-(halo)uracil, 5-(hydroxymethyl)uracil, 5-(iso-Pentenylaminomethyl)-2-thiouridine TP, 5-(iso-Pentenylaminomethyl)-2'-O-methyluridine TP, 5-(iso-Pentenylaminomethyl)uridine TP, 5-(1,3-diazole-1-alkyl)uracil, 5-(methoxy)uracil, 5-(methoxycarbonylmethyl)-2-(thio)uracil, 5-(methoxycarbonyl-methyl)uracil, 5-(methyl) 2(thio)uracil, 5-(methyl) 2,4 (dithio)uracil, 5-(methyl) 4 (thio)uracil, 5-(methyl)-2-(thio)pseudouracil, 5-(methyl)-2,4 (dithio)pseudouracil, 5-(methyl)-4 (thio)pseudouracil, 5-(methyl)isocarbostyrilyl, 5-(methyl)pseudouracil, 5-(methylaminomethyl)-2 (thio)uracil, 5-(methylaminomethyl)-2,4(dithio)uracil, 5-(methyl-aminomethyl)-4-(thio)uracil, 5-(propynyl)cytosine, 5-(propynyl)uracil, 5-(trifluoromethyl)cytosine, 5-(trifluoromethyl)uracil, 5,2'-O-dimethylcytidine, 5,2'-O-dimethyluridine, 5,6-dihydro-uridine, 5-aminoallyl-A/U/G/C, 5-Aminoallyl-CTP, 5-Aminoallyl-deoxy-uridine, 5-aminoallyl-uridine, 5-aminomethyl-2-seleno-A/U/G/C, 5-aminomethyl-2-thio-A/U/G/C, 5-aminomethyl-2-thiouridine, 5-aminomethyl-A/U/G/C, 5-aminopropyl-2'-amino-A/U/G/C, 5-aminopropyl-2'-deoxy-A/U/G/C, 5-aminopropyl-2'-fluoro-A/U/G/C, 5-aminopropyl-2'-O-methyl-A/U/G/C, 5-aminopropyl-A/U/G/C, 5-aminouracil, 5-aza-2-thio-zebularine, 5-aza-cytidine, 5-aza-uridine, 5-aza-zebularine, 5-Bromo-2'-deoxyuridine, 5-Bromo-2'-deoxycytidine, 5-bromo-A/U/G/C, 5-bromo-cytidine, 5-bromo-uridine, 5-carbamoylmethyl-2'-O-methyluridine, 5-carbamoylmethyl-A/U/G/C, 5-carbamoylmethyluridine, 5-Carbamoylmethyluridine TP, 5-carboxyhydroxymethyl-A/U/G/C, 5-carboxyhydroxymethyluridine, 5-carboxyhydroxymethyluridine methyl ester, 5-carboxymethyl-A/U/G/C, 5-carboxymethylaminomethyl-2'-O-methyluridine, 5-carboxymethylaminomethyl-2-thio-A/U/G/C, 5-carboxymethylaminomethyl-2-thiouridine, 5-carboxymethylaminomethyl-A/U/G/C, 5-carboxymethylaminomethyluridine, 5-carboxymethyluridine, 5-chloro-ara-cytosine, 5-chlorocytosine, 5-chlorouracil, 5-Carbamoylmethyluridine TP, 5-Cyanocytidine TP, 5-Cyanouridine TP, 5-Dimethylaminouridine TP, 5-Ethynylara-cytidine TP, 5-Ethynylcytidine TP, 5-fluoro-A/U/G/C, 5-fluorocytosine, 5-fluorouridine, 5-formyl-2'-O-methylcytidine, 5-formyl-A/U/G/C, 5-formylcytidine, 5'-Homo-adenosine TP, 5'-Homo-cytidine TP, 5'-Homo-guanosine TP, 5'-Homo-uridine TP, 5-hydro-A/U/G/C, 5-hydroxy-A/U/G/C, 5-hydroxycytosine, 5-hydroxydeoxycytidine, 5-hydroxymethyl-A/U/G/C, 5-hydroxymethylcytidine, 5-hydroxymethyldeoxycytidine, 5-hydroxyuridine, 5-iodo-2'-deoxycytidine, 5-iodo-2'-fluoro-deoxyuridine TP, 5-iodo-2'-deoxycytidine, 5-iodo-2'-deoxyuridine, 5-iodo-A/U/G/C, 5-iodo-cytidine, 5-iodoU/2thioU, 5-iodoU/4thioU, 5-iodo-uridine, 5-isopentenylaminomethyl-2'-amino-A/U/G/C, 5-isopentenylaminomethyl-2'-deoxy-A/U/G/C, 5-isopentenylaminomethyl-2'-fluoro-A/U/G/C, 5-isopentenylaminomethyl-2'-O-methyl-A/U/G/C, 5-isopentenylaminomethyl-2-thio-2'-amino-A/U/G/C, 5-isopentenylaminomethyl-2-thio-2'-deoxy-A/U/G/C, 5-isopentenylaminomethyl-2-thio-2'-fluoro-A/U/G/C, 5-isopentenylaminomethyl-2-thio-2'-O-methyl-A/U/G/C, 5-isopentenylaminomethyl-2-thio-A/U/G/C, 5-isopentenylaminomethyl-A/U/G/C, 5mC/2thioU, 5mC/2thioU/2'aminoC, 5mC/2thioU/2'azidoG, 5mC/4thioU, 5mC/pseudoU, 5-methoxy-A/U/G/C, 5-methoxyaminomethyl-2-thio-uridine, 5-methoxycarbonyl methyl-A/U/G/C, 5-methoxycarbonylmethyl-2'-O-methyluridine, 5-methoxycarbonylmethyl-2-thioA/U/G/C, 5-methoxycarbonylmethyl-2-thiouridine, 5-methoxycarbonylmethyluridine, 5-Methoxycytidine TP, 5-methoxy-ethoxy-methyl-2'-amino-A/U/G/C, 5-methoxy-ethoxy-methyl-2'-deoxy-A/U/G/C, 5-methoxy-ethoxy-methyl-2'-fluoro-A/U/G/C, 5-methoxy-ethoxy-methyl-2'-O-methyl-A/U/G/C, 5-methoxy-ethoxy-methyl-A/U/G/C, 5-methoxyuridine, 5-methyl-2-thio-A/U/G/C, 5-methyl-2-thiouridine, 5-methyl-A/U/G/C, 5-methylaminomethyl-2-selenouridine, 5-methylaminomethyl-2-thiouridine, 5-methylaminomethyl-A/U/G/C, 5-methylaminomethyluridine, 5-methylcytosine, 5-methyldihydro-A/U/G/C, 5-Methyldihydrouridine, 5-methyluridine, 5-methyl-zebularine, 5-nitro-A/U/G/C, 5-nitroindole, 5-oxyacetic acid methyl ester-A/U/G/C, 5-Oxyacetic acid-Uridine TP, 5-oxyacetic acid-A/U/G/C, 5-Oxyacetic acid-methyl ester-Uridine TP, 5-Phenylethynyluridine TP, 5-propynyl cytosine, 5-propynyl uracil, 5-Propynyl-2'-deoxyuridine, 5-Propynyl-2'-deoxycytidine, 5-propynyl-A/U/G/C, 5-taurinomethy)-2-thiouridine-2'-deoxy-A/U/G/C, 5-taurinomethyl-2'-amino-A/U/G/C, 5-taurinomethyl-2'-fluoro-A/U/G/C, 5-taurinomethyl-2'-O-methyl-A/U/G/C, 5-taurinomethyl-2-thiouridine, 5-taurinomethyl-2-thiouridine-2'-amino-A/U/G/C, 5-taurinomethyl-2-thiouridine-2'-fluoro-A/U/G/C, 5-taurinomethyl-2-thiouridine-2'-O-methyl-A/U/G/C, 5-taurinomethyl-A/U/G/C, 5-taurinomethyluridine, 5-Trideuteromethyl-6-deuterouridine TP, 5-Trifluoromethyl-Cytidine TP, 5-Trifluoromethyl-Uridine TP, 5-uracil, 5-Vinylarauridine TP, 6 (alkyl)adenine, 6 (azo)uracil, 6 (methyl)adenine, 6 (methyl)guanine, 6-(2,2,2-Trifluoroethyl)-pseudo-UTP, 6-(4-Morpholino)-pseudo-UTP, 6-(4-Thiomorpholino)-pseudo-UTP, 6-(alkyl)adenine, 6-(alkyl)guanine, 6-(aza)pyrimidine, 6-(azo)cytosine, 6-(azo)thymine, 6-(azo)uracil, 6-(methyl)-7-(aza)indolyl, 6-(methyl)adenine, 6-(methyl)guanine, 6-(Substituted-Phenyl)-pseudo-UTP, 6-Amino-pseudo-UTP, 6-aza-2'-amino-A/U/G/C, 6-aza-2'-deoxy-A/U/G/C, 6-aza-2'-fluoro-A/U/G/C, 6-aza-2'-O-methyl-A/U/G/C, 6-aza-A/U/G/C, 6-aza-cytidine, 6-azauridine, 6-aza-uridine, 6-Azido-pseudo-UTP, 6-Bromo-pseudo-UTP, 6-Butyl-pseudo-UTP, 6-chloro-7-deaza-guanosine, 6-Chloro-pseudo-UTP, 6-chloro-purine, 6-Cyano-pseudo-UTP, 6-Dimethylamino-pseudo-UTP, 6-Ethoxy-pseudo-UTP, 6-Ethylcarboxylate-pseudo-UTP, 6-Ethyl-pseudo-UTP, 6-Fluoro-pseudo-UTP, 6-Formyl-pseudo-UTP, 6-Hydroxyamino-pseudo-UTP, 6-Hydroxy-pseudo-UTP, 6-Iodo-pseudo-UTP, 6-iso-Propyl-pseudo-UTP, 6-mercaptoguanosine, 6-methoxy-guanosine, 6-Methoxy-pseudo-UTP, 6-methyladenosine, 6-Methylamino-pseudo-UTP, 6-methylguanosine, 6-methyl-mercaptopurine, 6-Methyl-pseudo-UTP, 6-Phenyl-pseudo-UTP, 6-Phenyl-pseudo-UTP, 6-phenyl-pyrrolo-pyrimidin-2-on-3-yl, 6-Propyl-pseudo-UTP, 6-tert-Butyl-pseudo-UTP, 6-thio-7-deaza-8-aza-guanosine, 6-thio-7-deaza-guanosine, 6-thio-7-methyl-guanosine, 6-thiodeoxyguanosine, 6-thio-guanosine, 6-Trifluoromethoxy-pseudo-UTP, 6-Trifluoromethyl-pseudo-UTP, 7 (alkyl)guanine, 7 (deaza)adenine, 7 (deaza)guanine, 7 (methyl)guanine, 7-(alkyl)guanine, 7-(aminoalkylhydroxy)-1-(aza)-2-(thio)-3-(aza)-phenthiazin-1-yl, 7-(aminoalkylhydroxy)-1-(aza)-2-(thio)-3-(aza)-phenoxazin-1-yl, 7-(aminoalkylhydroxy)-1,3-(diaza)-2-(oxo)-phenoxazin-1-yl, 7-(aminoalkylhydroxy)-1,3-(diaza)-2-(oxo)-phenthiazin-1-yl, 7-(aminoalkylhydroxy)-1,3-(diaza)-2-(oxo)-phenthiazin-1-yl, 7-(aminoalkylhydroxy)-1,3-(diaza)-2-(oxo)-phenoxazin-I-yl, 7-(aminoalkylhydroxy)-1,3-(diaza)-2-(oxo)-phenoxazin-1-yl, 7-(aza)indolyl, 7-(deaza)guanine, 7-(guanidiniumalkylhydroxy)-1-(aza)-2-(thio)-3-(aza)-phenoxazinkyl, 7-(guanidiniumalkylhydroxy)-1-(aza)-2-(thio)-3-(aza)-phenthiazin-I-yl, 7-(guanidiniumalkylhydroxy)-1-(aza)-2-(thio)-3-(aza)-phenoxazin-1-yl, 7-(guanidiniumalkylhydroxy)-1,3-(diaza)-2-(oxo)-phenoxazin-1-yl, 7-(guanidiniumalkyl-hydroxy)-1,3-(diaza)-2-(oxo)-phenthiazin-I-yl, 7-(guanidiniumalkyl-hydroxy)-1,3-(diaza)-2-(oxo)-phenthiazin-1-yl, 7-(guanidiniumalkylhydroxy)-1,3-(diaza)-2-(oxo)-phenoxazin-I-yl, 7-(methyl)guanine, 7-(propynyl)isocarbostyrilyl, 7-(propynyl)isocarbostyrilyl, propynyl-7-(aza)indolyl, 7-allyl-8-oxoguanosine, 7-aminomethyl-7-deazaguanosine, 7-cyano-7-deazaguanosine, 7-deaza-2,6-diaminopurine, 7-Deaza-2'-amino-A/U/G/C, 7-deaza-2-amino-purine, 7-Deaza-2'-deoxy-A/U/G/C, 7-deaza-2'-deoxy-guanosine, 7-Deaza-2'-fluoro-A/U/G/C, 7-Deaza-2'-O-methyl-A/U/G/C, 7-deaza-7-substituted purine, 7-deaza-8-aza-2,6-diaminopurine, 7-deaza-8-aza-2-aminopurine, 7-deaza-8-aza-adenine, 7-deaza-2-aminopurine, 7-deaza-8-aza-adenosine, 7-deaza-8-aza-guanosine, 7-deaza-8-substituted purine, 7-Deaza-A/U/G/C, 7-deaza-adenine, 7-deaza-adenosine, 7-deaza-guanosine, 7-deaza-inosinyl, 7-methyl-8-oxoguanosine, 7-methyladenine, 7-methylguanosine, 7-methylinosine, 7-substituted 1-(aza)-2-(thio)-3-(aza)-phenoxazin-1-yl, 7-substituted 1,3-(diaza)-2-(oxo)-phenoxazin-1-yl, 8 (alkenyl)adenine, 8 (alkyl)guanine, 8 (alkynyl)adenine, 8 (alkynyl)guanine, 8 (amino)adenine, 8 (halo)guanine, 8 (thioalkyl)adenine, 8 (thioalkyl)guanine, 8-(alkenyl)adenine, 8-(alkenyl)guanine, 8-(alkyl)adenine, 8-(alkyl)guanine, 8-(alkynyl)adenine, 8-(alkynyl)guanine, 8-(amino)adenine, 8-(amino)guanine, 8-(halo)adenine, 8-(halo)guanine, 8-(hydroxyl)adenine, 8-(hydroxyl)guanine, 8-(thioalkyl)adenine, 8-(thioalkyl)guanine, 8-(thiol)adenine, 8-(thiol)guanine, 8-Aza-2'-amino-A/U/G/C, 8-Aza-2'-deoxy-A/U/G/C, 8-Aza-2'-fluoro-A/U/G/C, 8-Aza-2'-O-methyl-A/U/G/C, 8-Aza-A/U/G/C, 8-Aza-ATP, 8-azapurine, 8-Azido-2'-amino-A/U/G/C, 8-Azido-2'-deoxy-A/U/G/C, 8-Azido-2'-fluoro-A/U/G/C, 8-Azido-2'-O-methyl-A/U/G/C, 8-Azido-A/U/G/C, 8-azidoadenosine, 8-bromo-adenosine TP, 8-bromo-guanosine TP, 8-mercapto-guanosine, 8-oxoguanosine, 8-Trifluoromethyladenosine TP, 9-(methyl)-imidizopyridinyl, 9-Deazaadenosine TP, 9-Deazaguanosine TP, allyamino-thymidine, allyamino-uracil, Alpha-thio-pseudo-UTP, aminoindolyl, anthracenyl, archaeosine, aza adenine, aza cytosine, aza guanine, aza thymidine, aza uracil, azidotriphosphate, benzimidazole, beta-D-mannosyl-queosine, bis-ortho-(aminoalkylhydroxy)-6-phenyl-pyrrolo-pyrimidin-2-on-3-yl, bis-ortho-substituted-6-phenyl-pyrrolo-pyrimidin-2-on-3-yl, cytidine 5'-O-(1-thiophosphate), deaza adenine, deaza cytosine, deaza guanine, deaza thymidine, deaza uracil, deoxy-cytosine, deoxy-inosine, deoxyribonucleotides of 05-propynylpyrimidines, deoxyribonucleotides of diaminopurine, deoxyribonucleotides of nitropyrrole, deoxy-thymidine, difluorotolyl, dihydropseudouridine, dihydrouridine, epoxyqueosine, Formycin A TP, Formycin B TP, galactosyl-queuosine, hydroxywybutosine, hypoxanthine, imidizopyridinyl, inosine, inosinyl, isocarbostyrilyl, isoguanisine, isopentenyladenosine, isowyosine, lysidine, mannosylqueuosine, methylphosphonates, methylphosphoramidates, methylwyosine, N (methyl)guanine, N-(methyl) guanine, N<2>-dimethylguanine, N1-methyl-adenosine, N1-methyl-guanosine, N1-methyl-pseudo-uridine, N2,7,2'-O-trimethylguanosine, N2,7-dimethylguanosine, N2,N2,7-trimethylguanosine, N2,N2-dimethyl-6-thio-guanosine, N2,N2-dimethylguanosine, N2-isobutyl-guanosine TP, N2-methyl-6-thio-guanosine, N2-methylguanosine, N2-substituted purines, N3 (methyl)uracil, N4 (acetyl)cytosine, N4,2'-O-dimethylcytidine, N4,N4-Dimethyl-2'-OMe-Cytidine TP, N4-acetyl-2'-O-methylcytidine, N4-acetylcytidine, N4-alkylcytosine, N4-alkyldeoxycytidine, N4-Aminocytidine TP, N4-Benzoyl-cytidine TP, N4-ethylcytosine, N4-ethyldeoxycytidine, N4-methylcytidine, N6 (methyl)adenine, N6-([6-aminohexyl]carbamoylmethyl)-adenosine, N6-(19-Amino-pentaoxanonadecyl)adenosine TP, N6-(cis-hydroxyisopentenyl)adenosine, N6-(isopentyl)adenine, N6,N6 (dimethyl)adenine, N6,2'-O-dimethyladenosine, N6,N6,2'-O-trimethyladenosine, N6,N6-dimethyladenosine, N6-acetyladenosine, N6-cis-hydroxy-isopentenyl-adenosine, N6-glycinylcarbamoyladenosine, N6-hydroxynorvalyl-carbamoyladenosine, N6-isopentenyladenosine, N6-methyl-2-amino-purine, N6-methyladenosine, N6-methyl-N6-threonylcarbamoyladenosine, N6-substituted purines, N6-threonylcarbamoyladenosine, N7-methylguanosine, N7-methylinosine, N7-methyl-xanthosine, N-alkylated derivative, napthalenyl, nitrobenzimidazolyl, nitroimidazolyl, nitroindazolyl, nitropyrazolyl, nubularine, N-uracil, N-uracil-5-oxyacetic acid, N-uracil-5-oxyacetic acid methyl ester, O6-methylguanosine, O6-substituted purines, O-alkylated derivative, ortho-(aminoalkylhydroxy)-6-phenyl-pyrrolo-pyrimidin-2-on-3-yl, ortho-substituted-6-phenyl-pyrrolo-pyrimidin-2-on-3-yl, Oxoformycin TP, Pseudo-UTP-1-2-ethanoic acid, para-(aminoalkylhydroxy)-6-phenyl-pyrrolo-pyrimidin-2-on-3-yl, para-substituted-6-phenyl-pyrrolo-pyrimidin-2-on-3-yl, pentacenyl, peroxywybutosine, phenanthracenyl, phenyl-A/U/G/C, propynyl-7-(aza)indolyl, pseudoisocytidine, Pseudo-iso-cytidine, pseudouracil, pseudouridine, Pseudouridine 1-(4-methylbenzenesulfonic acid) TP, Pseudouridine 1-(4-methylbenzoic acid) TP, Pseudouridine TP 1-[3-(2-ethoxy)] propionic acid, Pseudouridine TP 1-[3-{2-(2-[2-(2-ethoxy)-ethoxy]-ethoxy)-ethoxy}]propionic acid, Pseudouridine TP 1-[3-{2-(2-[2-{2(2-ethoxy)-ethoxy}-ethoxy]-ethoxy)-ethoxy}]propionic acid, Pseudouridine TP 1-[3-{2-(2-[2-ethoxy]-ethoxy)-ethoxy}]propionic acid, Pseudouridine TP 1-[3-{2-(2-ethoxy)-ethoxy}]propionic acid, Pseudouridine TP 1-methylphosphonic acid, Pseudouridine TP 1-methylphosphonic acid diethyl ester, Pseudo-UTP-N1-3-propionic acid, Pseudo-UTP-N1-4-butanoic acid, Pseudo-UTP-N1-5-pentanoic acid, Pseudo-UTP-N1-6-hexanoic acid, Pseudo-UTP-N1-7-heptanoic acid, Pseudo-UTP-N1-methyl-p-benzoic acid, Pseudo-UTP-N1-p-benzoic acid, puromycin, pyrenyl, pyridin-4-one ribonucleoside, pyridopyrimidin-3-yl, pyridopyrimidin-3-yl, 2-oxo-7-amino-pyridopyrimidin-3-yl, pyrrolo-cytidine, pyrrolo-pseudoisocytidine, pyrrolo-pyrimidin-2-on-3-yl, pyrrolopyrimidinyl, pyrrolopyrizinyl, Pyrrolosine TP, queuosine, Sp diasteriomers of ribonucleosid-5'-O-(1-thiotriphosphates), stilbenzyl, substituted 1,2,4-triazoles, substituted 7 deazapurine, tetracenyl, tubercidine, undermodified hydroxywybutosine, uridine 5-oxyacetic acid, uridine 5-oxyacetic acid methyl ester, wybutosine, wyosine, xanthine, Xanthosine-5'-TP, xylo-adenosine, zebularine, α-thio-adenosine, α-thio-cytidine, α-thio-guanosine, and/or α-thio-uridine. In the preceeding list, the abbreviation "TP" stands for triphosphate but it should be understood that the mono- and di-phosphates may also be utilized.

Polynucleotides of the present invention may comprise one or more of the modifications taught herein.

Different sugar modifications, nucleotide modifications, and/or internucleoside linkages (e.g., backbone structures) may exist at various positions in the polynucleotide. One of ordinary skill in the art will appreciate that the nucleotide analogs or other modification(s) may be located at any position(s) of a polynucleotide such that the function of the polynucleotide is not substantially decreased. A modification may also be a 5' or 3' terminal modification. The polynucleotide may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%).

In some embodiments, the polynucleotide includes a modified pyrimidine or purine. In some embodiments, the pyrimidine or purine in the polynucleotide molecule may be replaced with from about 1% to about 100% of a modified uracil or modified uridine (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100% of a modified pyrimidine or purine.

In some embodiments, the polynucleotides may comprise two or more effector module component sequences which are in a pattern such as ABABAB or AABBAABBAABB or ABCABCABC or variants thereof repeated once, twice, or more than three times. In these patterns, each letter, A, B, or C represent a different effector module component.

In yet another embodiment, the polynucleotides may comprise two or more effector module component sequences with each component having one or more sequences. As a non-limiting example, the sequences may be in a pattern such as ABABAB or AABBAABBAABB or ABCABCABC or variants thereof repeated once, twice, or more than three times in each of the regions. As another non-limiting example, the sequences may be in a pattern such as ABABAB or AABBAABBAABB or ABCABCABC or variants thereof repeated once, twice, or more than three times across the entire polynucleotide. In these patterns, each letter, A, B, or C represent a different sequence or component.

Codon Selection

In some embodiments, one or more codons of the polynucleotides of the present invention may be replaced with other codons encoding the native amino acid sequence to tune the expression of the SREs, through a process referred to as codon selection. Since mRNA codon, and tRNA anticodon pools tend to vary among organisms, cell types, sub cellular locations and over time, the codon selection described herein is a spatiotemporal (ST) codon selection.

In some embodiments of the invention, certain polynucleotide features may be codon optimized. Codon optimization refers to a process of modifying a nucleic acid sequence for enhanced expression in the host cell by replacing at least 1, 2, 3, 4, 5, 10, 15, 20, 25, 50 or more codons of the native sequence with codons that are most frequently used in the genes of that host cell while maintaining the native amino acid sequence. Codon usage may be measured using the Codon Adaptation Index (CAI) which measures the deviation of a coding polynucleotide sequence from a reference gene set. Codon usage tables are available at the Codon Usage Database (http://www.kazusa.or.jp/codon/) and the CAI can be calculated by EMBOSS CAI program (http://emboss.sourceforge.net/). Codon optimization methods are known in the art and may be useful in efforts to achieve one or more of several goals. These goals include to match codon frequencies in target and host organisms to ensure proper folding, bias nucleotide content to alter stability or reduce secondary structures, minimize tandem repeat codons or base runs that may impair gene construction or expression, customize transcriptional and translational control regions, insert or remove protein signaling sequences, remove/add post translation modification sites in encoded protein (e.g. glycosylation sites), add, remove or shuffle protein domains, insert or delete restriction sites, modify ribosome binding sites and degradation sites, to adjust translational rates to allow the various domains of the protein to fold properly, or to reduce or eliminate problem secondary structures within the polynucleotide. Codon optimization tools, algorithms and services are known in the art, and non-limiting examples include services from GeneArt (Life Technologies), DNA2.0 (Menlo Park Calif.), OptimumGene (GenScript, Piscataway, N.J.), algorithms such as but not limited to, DNAWorks v3.2.3 and/or proprietary methods. In one embodiment, a polynucleotide sequence or portion thereof is codon optimized using optimization algorithms. Codon options for each amino acid are well-known in the art as are various species table for optimizing for expression in that particular species.

In some embodiments of the invention, certain polynucleotide features may be codon optimized. For example, a preferred region for codon optimization may be upstream (5') or downstream (3') to a region which encodes a polypeptide. These regions may be incorporated into the polynucleotide before and/or after codon optimization of the payload encoding region or open reading frame (ORF).

After optimization (if desired), the polynucleotides components are reconstituted and transformed into a vector such as, but not limited to, plasmids, viruses, cosmids, and artificial chromosomes.

Spatiotemporal codon selection may impact the expression of the polynucleotides of the invention, since codon composition determines the rate of translation of the mRNA species and its stability. For example, tRNA anticodons to optimized codons are abundant, and thus translation may be enhanced. In contrast, tRNA anticodons to less common codons are fewer and thus translation may proceed at a slower rate. Presnyak et al. have shown that the stability of an mRNA species is dependent on the codon content, and higher stability and thus higher protein expression may be achieved by utilizing optimized codons (Presnyak et al. (2015) Cell 160, 1111-1124; the contents of which are incorporated herein by reference in their entirety). Thus, in some embodiments, ST codon selection may include the selection of optimized codons to enhance the expression of the SRES, effector modules and biocircuits of the invention. In other embodiments, spatiotemporal codon selection may involve the selection of codons that are less commonly used in the genes of the host cell to decrease the expression of the compositions of the invention. The ratio of optimized codons to codons less commonly used in the genes of the host cell may also be varied to tune expression.

In some embodiments, certain regions of the polynucleotide may be preferred for codon selection. For example, a preferred region for codon selection may be upstream (5') or downstream (3') to a region which encodes a polypeptide. These regions may be incorporated into the polynucleotide before and/or after codon selection of the payload encoding region or open reading frame (ORF).

The stop codon of the polynucleotides of the present invention may be modified to include sequences and motifs to alter the expression levels of the SREs, payloads and effector modules of the present invention. Such sequences may be incorporated to induce stop codon readthrough, wherein the stop codon may specify amino acids e.g. selenocysteine or pyrrolysine. In other instances, stop codons may be skipped altogether to resume translation through an alternate open reading frame. Stop codon read through may be utilized to tune the expression of components of the effector modules at a specific ratio (e.g. as dictated by the stop codon context). Examples of preferred stop codon motifs include UGAN, UAAN, and UAGN, where N is either C or U.

Conjugates

It is contemplated by the present invention that the compositions of the present invention may be complexed, conjugated or combined with one or more homologous or heterologous molecules. As used herein, the term "homologous molecule" refers to a molecule which is similar in at least one of structure or function relative to a starting molecule while a "heterologous molecule" is one that differs in at least one of structure or function relative to a starting molecule. Structural homologs are therefore molecules which may be substantially structurally similar. In some embodiments, such homologs may be identical. Functional homologs are molecules which may be substantially functionally similar. In some embodiments, such homologs may be identical.

Pharmaceutical compositions, biocircuits, biocircuit components, effector modules including their SREs or payloads of the present invention may comprise conjugates. Such conjugates of the invention may include naturally occurring substances or ligands, such as proteins (e.g., human serum albumin (HSA), low-density lipoprotein (LDL), high-density lipoprotein (HDL), or globulin); carbohydrates (e.g., a dextran, pullulan, chitin, chitosan, inulin, cyclodextrin or hyaluronic acid); or lipids. Conjugates may also be recombinant or synthetic molecules, such as synthetic polymers, e.g., synthetic polyamino acids, an oligonucleotide (e.g. an aptamer). Examples of polyamino acids may include polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl) methacrylamide copolymer (HMPA), polyethylene glycol (PEG), polyvinyl alcohol (PVA), polyurethane, poly (2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

In some embodiments, conjugates may also include targeting groups. As used herein, the term "targeting group" refers to a functional group or moiety attached to an agent that facilitates localization of the agent to a desired region, tissue, cell and/or protein. Such targeting groups may include, but are not limited to cell or tissue targeting agents or groups (e.g. lectins, glycoproteins, lipids, proteins, an antibody that binds to a specified cell type such as a kidney cell or other cell type). In some embodiments, targeting groups may comprise thyrotropins, melanotropins, lectins, glycoproteins, surfactant protein A, mucin carbohydrates, multivalent lactose, multivalent galactose, N-acetylgalactosamine, N-acetyl-gulucosamine, multivalent mannose, multivalent fucose, glycosylated polyaminoacids, multivalent galactose, transferrin, bisphosphonate, polyglutamate, polyaspartate, lipids, cholesterol, steroids, bile acids, folates, vitamin B12, biotin, an RGD peptide, an RGD peptide mimetic or an aptamer.

In some embodiments, targeting groups may be proteins, e.g., glycoproteins, or peptides, e.g., molecules having a specific affinity for a co-ligand, or antibodies e.g., an antibody, that binds to a specified cell type such as a cancer cell, endothelial cell, or bone cell. Targeting groups may also comprise hormones and/or hormone receptors.

In some embodiments, targeting groups may be any ligand capable of targeting specific receptors. Examples include, without limitation, folate, GalNAc, galactose, mannose, mannose-6-phosphate, apatamers, integrin receptor ligands, chemokine receptor ligands, transferrin, biotin, serotonin receptor ligands, PSMA, endothelin, GCPII, somatostatin, LDL, and HDL ligands. In some embodiments, targeting groups are aptamers. Such aptamers may be unmodified or comprise any combination of modifications disclosed herein.

In still other embodiments, pharmaceutical compositions, biocircuits, biocircuit components, effector modules including their SREs or payloads of the present invention may be covalently conjugated to cell penetrating polypeptides. In some embodiments, cell-penetrating peptides may also include signal sequences. In some embodiments, conjugates of the invention may be designed to have increased stability, increased cell transfection and/or altered biodistribution (e.g., targeted to specific tissues or cell types.)

In some embodiments, conjugating moieties may be added to pharmaceutical compositions, biocircuits, biocircuit components, effector modules including their SREs or payloads of the present invention such that they allow the attachment of detectable labels to targets for clearance. Such detectable labels include, but are not limited to biotin labels, ubiquitins, fluorescent molecules, human influenza hemagglutinin (HA), c-myc, histidine (His), flag, glutathione S-transferase (GST), V5 (a paramyxovirus of simian virus 5 epitope), biotin, avidin, streptavidin, horse radish peroxidase (HRP) and digoxigenin.

In some embodiments, pharmaceutical compositions, biocircuits, biocircuit components, effector modules including their SREs or payloads of the present invention may be combined with one another or other molecules in the treatment of diseases and/or conditions.

In one embodiment, the SREs or payloads of the present invention may be, but are not limited to, Payload No. 1-20419, fragments and variants thereof.

In one embodiment, the SREs or payloads of the present invention may be, but are not limited to, SEQ ID NOs: 1-204900 and 212852-213270, fragments and variants thereof.

In one embodiment, the SREs or payloads of the present invention may be, but are not limited to, SEQ ID NO: 1-102450 and 212852-213270, fragments and variants thereof.

In one embodiment, the SREs or payloads of the present invention may be, but are not limited to, SEQ ID NO: 102451-204900, fragments and variants thereof.

In one embodiment, the SREs or payloads of the present invention may be encoded by a sequence such as, but are not limited to, SEQ ID NO: 102451-204900, fragments and variants thereof.

In one embodiment, the SREs or payloads of the present invention may be encoded by a sequence such as, but not limited to, SEQ ID NO: 102451-204900.

In one embodiment, the SRE or payload of the present invention may be a conditionally active biologic protein. A wild type protein, such as SEQ ID NO: 1-204900 and 212852-213270, may be used to generate a conditionally active biologic protein which are reversibly or irreversibly inactivated at the wild type normal physiological conditions as well as to such conditionally active biologic proteins and uses of such conditional active biologic proteins are provided. Such methods and conditionally active proteins are taught in, for example, International Publication No. WO2015175375 and WO2016036916 and US Patent Publication No. US20140378660, the contents of each of which are incorporated herein by reference in their entirety.

Stimuli

Biocircuits of the present invention are triggered by one or more stimuli. Stimuli may be selected from a ligand, an externally added or endogenous metabolite, the presence or absence of a defined ligand, pH, temperature, light, ionic strength, radioactivity, cellular location, subject site, microenvironment, the presence or concentration of one or more cations or one or more anions, the presence or action of one or more effector modules, a concentration gradient of ions or biomolecules or the like, or the presence or concentration of one or more metal ions.

Ligands

In some embodiments, the stimulus is a ligand. Ligands may be nucleic acid-based, protein-based, lipid-based, organic, inorganic or any combination of the foregoing.

In some embodiments, the ligand is selected from the group consisting of a protein, peptide, nucleic acid, lipid, lipid derivative, sterol, steroid, metabolite, metabolite derivative, and small molecule.

Ligand Conjugates

In some embodiments, the ligand may be complexed or bound to another molecule such as for example, another ligand, a protein, peptide, nucleic acid, lipid, lipid derivative, sterol, steroid, metabolite, metabolite derivative or small molecule. In some embodiments, the ligand stimulus is complexed to or bound to one or more other molecules. In some embodiments, the ligand stimulus is complexed or bound to one or more different kinds and/or numbers of other molecules. In some embodiment, the ligand stimulus is a multimer of the same kind of ligand. In some embodiments, the ligand stimulus multimer comprises 2, 3, 4, 5, 6, or more monomers.

Small Molecules

In some embodiments, the stimulus is a small molecule. In some embodiments, the small molecules are cell permeable.

Cellular Location or Microenvironment

In some embodiments, the stimulus is a cellular location. In some embodiments, the cellular location is selected from the group consisting of the nucleus, the cytoplasm, a membrane, lysosome, mitochondria, endoplasmic reticulum, cellular organelle, cytoskeletal protein or subregion, intracellular membrane surface, a transmembrane region, and the extracellular matrix.

In some embodiments, the stimulus is a microenvironment or cellular niche. Microenvironments may be selected from the group consisting of a tumor microenvironment, the cell periphery, the cell membrane, the nuclear membrane, an endosome, a microenvironment characterized by an intracellular or extracellular gradient, and cytoskeletal structures or regions.

Subject Site

In some embodiments, the stimulus is a subject site. The subject site may be selected from a location in the subject selected from the blood, plasma, an organ selected from liver, kidney, brain, heart, lung, bone, and bone marrow.

Ion Concentration and Metals

In some embodiments, the stimuli is the presence of one or more cations and the cation is selected from the group consisting of Aluminum, Ammonium, Barium, Calcium, Chromium(II), Chromium(III), Copper(I), Copper(II), Iron (II), Iron(III), Hydrogen, Hydronium, Lead(II), Lithium, Magnesium, Manganese(II), Manganese(III), Mercury(I), Mercury(II), Nitronium, Potassium, Silver, Sodium, Strontium, Tin(II), Tin(IV), and Zinc.

In some embodiments, the stimuli is the presence of one or more anions or oxoanions selected from the group consisting of Chloride, Fluoride, Arsenate, Phosphate, Arsenite, Hydrogen phosphate, Dihydrogen phosphate, Sulfate, Nitrate, Hydrogen sulfate, Nitrite, Thiosulfate, Sulfite, Perchlorate, Iodate, Chlorate, Bromate, Chlorite, Hypochlorite, Hypobromite, Carbonate, Chromate, Hydrogen carbonate or Bicarbonate, Dichromate, Acetate, formate, Cyanide, Cyanate, Peroxide, Thiocyanate, Oxalate, Hydroxide, and Permanganate.

In some embodiments, the stimulus is the presence of one or more metal ions and the metal ion is selected from the group consisting of Magnesium, Manganese, Calcium and Zinc.

In some embodiments, stimulus is a ligand. A non-exhaustive listing of ligands which may be used as a stimulus in the present invention are described in Table 1. Table 1 provides the name of the ligand (Ligand Name) and the ligand number which may be referenced throughout the specification.

TABLE 1

| Ligands | |
|---|---|
| Ligand No. | Ligand Name |
| 1 | Abacavir |
| 2 | Abarelix |
| 3 | Abatacept |
| 4 | Abciximab |
| 5 | Abediterol |
| 6 | Abemaciclib |
| 7 | Abequose |
| 8 | Abiraterone |

TABLE 1-continued

Ligands

| Ligand No. | Ligand Name |
|---|---|
| 9 | Abiraterone Acetate |
| 10 | Abl-001 |
| 11 | Abobotulinumtoxina |
| 12 | ABT-089 |
| 13 | Abt-102 |
| 14 | Abt-107 |
| 15 | Abt-126 |
| 16 | ABT-263 |
| 17 | Abt-288 |
| 18 | Abt-414 |
| 19 | Abt-494 |
| 20 | ABT-510 |
| 21 | Abt-700 |
| 22 | ABT-869 |
| 23 | ABT-874 |
| 24 | ABX-PTH |
| 25 | A-98881 |
| 26 | AC-(D)PHE-PRO-BOROHOMOLYS-OH |
| 27 | AC-(D)PHE-PRO-BOROHOMOORNITHINE-OH |
| 28 | AC-(D)PHE-PRO-BOROLYS-OH |
| 29 | AC162352 |
| 30 | AC220 |
| 31 | Ac-430 |
| 32 | Ac-480 |
| 33 | ACA125 |
| 34 | Acalisib |
| 35 | Acamprosate |
| 36 | Acarbose |
| 37 | Acarbose Derived Hexasaccharide |
| 38 | ACCLAIM |
| 39 | Acebutolol |
| 40 | Acenocoumarol |
| 41 | Acepromazine |
| 42 | Aceprometazine |
| 43 | Acetamide |
| 44 | Acetaminophen |
| 45 | Acetazolamide |
| 46 | Acetic Acid Salicyloyl-Amino-Ester |
| 47 | Acetoacetic Acid |
| 48 | Acetoacetyl-Coenzyme A |
| 49 | Acetohexamide |
| 50 | Acetohydroxamic Acid |
| 51 | Acetophenazine |
| 52 | ACETOPHENONE |
| 53 | Acetyl Dithranol |
| 54 | Acetylamino-Acetic Acid |
| 55 | Acetylcholine |
| 56 | Acetylcysteine |
| 57 | Acetyldigitoxin |
| 58 | Acetylgalactosamine-4-Sulfate |
| 59 | Acetylphosphate |
| 60 | Acetylsalicylic acid |
| 61 | Aciclovir |
| 62 | Acitretin |
| 63 | Aclidinium |
| 64 | Acolbifene |
| 65 | Aconitate Ion |
| 66 | ACP-104 |
| 67 | Acp-196 |
| 68 | Acrisorcin |
| 69 | Acrivastine |
| 70 | Acrylic Acid |
| 71 | Actelion-1 |
| 72 | Acumapimod |
| 73 | Acyclovir |
| 74 | Acylated Ceftazidime |
| 75 | Adalimumab |
| 76 | Adamantane |
| 77 | Adamantane-1-Carboxylic Acid-5-Dimethylamino-Naphthalene-1-Sulfonylamino-Butyl-Amide |
| 78 | Adamantane-1-Carboxylic Acid-5-Dimethylamino-Naphthalene-1-Sulfonylamino-Octyl-Amide |
| 79 | Adamantanone |
| 80 | Adapalene |
| 81 | Adc3680 |
| 82 | Adefovir Dipivoxil |
| 83 | Adenine |
| 84 | Adenosine |
| 85 | Adenosine monophosphate |
| 86 | Adenosine Monotungstate |
| 87 | Adenosine Phosphonoacetic Acid |
| 88 | Adenosine triphosphate |
| 89 | Adenosine-2'-5'-Diphosphate |
| 90 | Adenosine-3'-5'-Diphosphate |
| 91 | Adenosine-5'-(Dithio)Phosphate |
| 92 | Adenosine-5'-[Beta, Gamma-Methylene]Tetraphosphate |
| 93 | Adenosine-5'-[Beta, Gamma-Methylene]Triphosphate |
| 94 | Adenosine-5'-Diphosphate Monothiophosphate |
| 95 | Adenosine-5'-Diphosphate-2',3'-Vanadate |
| 96 | Adenosine-5-Diphosphoribose |
| 97 | Adenosine-5'-Ditungstate |
| 98 | Adenosine-5'-Monophosphate Glucopyranosyl-Monophosphate Ester |
| 99 | Adenosine-5'-Pentaphosphate |
| 100 | Adenosine-5'-Phosphosulfate |
| 101 | Adenosine-5'-Propylphosphate |
| 102 | Adenosine-5'-Rp-Alpha-Thio-Triphosphate |
| 103 | Adenosyl-Ornithine |
| 104 | Adenylosuccinic Acid |
| 105 | Adenylyl-3'-5'-Phospho-Uridine-3'-Monophosphate |
| 106 | Adinazolam |
| 107 | ADL 10-0101 |
| 108 | ADL5859 |
| 109 | Ado-P-Ch2-P-Ps-Ado |
| 110 | ado-trastuzumab emtansine |
| 111 | ADX10059 |
| 112 | ADX-10061 |
| 113 | ADX-48621 |
| 114 | AE-941 |
| 115 | Aee-788 |
| 116 | AER001 |
| 117 | Aeruginosin 98-B |
| 118 | Aetiocholanolone |
| 119 | Aew-541 |
| 120 | Af-219 |
| 121 | Afacifenacin |
| 122 | Afatinib |
| 123 | Afelimomab |
| 124 | Afimoxifene |
| 125 | Aflibercept |
| 126 | Afuresertib |
| 127 | Ag-13958 |
| 128 | Ag-24322 |
| 129 | AG7088 |
| 130 | Agalsidase Beta |
| 131 | AGI-1067 |
| 132 | Agmatine |
| 133 | Agomelatine |
| 134 | AGRO100 |
| 135 | AHA047 |
| 136 | Aicar |
| 137 | Ajmaline |
| 138 | Akn-028 |
| 139 | AL4623 |
| 140 | AL5300 |
| 141 | AL5424 |
| 142 | AL5927 |
| 143 | AL6528 |
| 144 | Al-6619, [2h-Thieno[3,2-E]-1,2-Thiazine-6-Sulfonamide,2-(3-Hydroxyphenyl)-3-(4-Morpholinyl)-, 1,1-Dioxide] |
| 145 | Al-6629, [2h-Thieno[3,2-E]-1,2-Thiazine-6-Sulfonamide,2-(3-Methoxyphenyl)-3-(4-Morpholinyl)-, 1,1-Dioxide] |
| 146 | Al7089a |
| 147 | AL7099A |
| 148 | AL7182 |
| 149 | Alatrofloxacin |
| 150 | Albendazole |
| 151 | Albiglutide |

TABLE 1-continued

Ligands

| Ligand No. | Ligand Name |
|---|---|
| 152 | Albumin Human |
| 153 | Albuterol |
| 154 | Alcaftadine |
| 155 | Alclometasone |
| 156 | Alclometasone Dipropionate |
| 157 | Aldesleukin |
| 158 | Aldosterone |
| 159 | Alectinib |
| 160 | Alefacept |
| 161 | Aleglitazar |
| 162 | Alemtuzumab |
| 163 | Alendronate |
| 164 | Alendronic Acid |
| 165 | Alfacalcidol |
| 166 | Alfentanil |
| 167 | Alfimeprase |
| 168 | Alfuzosin |
| 169 | Alglucerase |
| 170 | Alglucosidase alfa |
| 171 | Alimemazine |
| 172 | Alirocumab |
| 173 | Alisertib |
| 174 | Aliskiren |
| 175 | Alitretinoin |
| 176 | Alizapride |
| 177 | Alkavervir |
| 178 | ALKS 27 |
| 179 | Allitinib |
| 180 | Allolactose |
| 181 | Allopurinol |
| 182 | Allosamidin |
| 183 | Allosamizoline |
| 184 | Allyl-{4-[3-(4-Bromo-Phenyl)-Benzofuran-6-Yloxy]-but-2-Enyl}-Methyl-Amine |
| 185 | Allyl-{6-[3-(4-Bromo-Phenyl)-1-Methyl-1h-Indazol-6-Yl]Oxy}Hexyl)-N-Methylamine |
| 186 | Allyl-{6-[3-(4-Bromo-Phenyl)-Benzofuran-6-Yloxy]-Hexyl-}-Methyl-Amin |
| 187 | Allylestrenol |
| 188 | Almitrine |
| 189 | Almotriptan |
| 190 | Alogliptin |
| 191 | Alosetron |
| 192 | Alpelisib |
| 193 | Alpha Chlorophyll A |
| 194 | ALPHA-(2,6-DICHLOROPHENYL)-ALPHA-(2-ACETYL-5-METHYLANILINO)ACETAMIDE |
| 195 | Alpha,Beta-Methyleneadenpsine-5'-Triphosphate |
| 196 | Alpha-1-proteinase inhibitcr |
| 197 | Alpha-Adenosine Monophosphate |
| 198 | Alpha-Aminobutyric Acid |
| 199 | Alpha-Aminoisobutyric Acid |
| 200 | Alpha-Benzyl-Aminobenzyl-Phosphonic Acid |
| 201 | Alpha-Cyclodextrin (Cyclohexa-Amylose) |
| 202 | Alpha-D-Fucose |
| 203 | Alpha-D-Galactose-1-Phosphate |
| 204 | Alpha-D-Glucppyranpsyl-2-Carboxylic Acid Amide |
| 205 | Alpha-D-Glucose 1,6-Bisphosphate |
| 206 | Alpha-D-Glucose-1-Phosphate |
| 207 | Alpha-D-Glucose-1-Phosphate-6-Vanadate |
| 208 | Alpha-D-Glucose-6-Phosphate |
| 209 | Alpha-Difluoromethylornithine |
| 210 | Alpha-D-Mannose-6-Phosphate |
| 211 | alpha-D-Xylopyranose |
| 212 | Alpha-Fluoro-Carboxymethyldethia Coenzyme a Complex |
| 213 | Alpha-Hydroxy-Beta-Phenyl-Propionic Acid |
| 214 | ALPHA-HYDROXYFARNESYLPHOSPHONIC ACID |
| 215 | Alpha-ketoisovalerate |
| 216 | Alpha-Ketomalonic Acid |
| 217 | Alpha-L-1-Methyl-Fucose |
| 218 | Alpha-L-Arabinose |
| 219 | Alpha-L-Fucose |
| 220 | Alpha-Linolenic Acid |
| 221 | Alpha-L-Methyl-Fucose |
| 222 | Alpha-Methylene Adenosine Monophosphate |
| 223 | Alpha-Methylisocitric Acid |
| 224 | Alpha-Methyl-N-Acetyl-D-Glucosamine |
| 225 | Alpha-N-Dichloroacetyl-P-Aminophenylserinol |
| 226 | Alpha-Phosphoribosylpyrophosphoric Acid |
| 227 | Alpha-Ribazole-5'-Phosphate |
| 228 | Alpha-Ribazole-5'-Phosphate Derivative |
| 229 | Alprazolam |
| 230 | Alprenolol |
| 231 | Alprostadil |
| 232 | Alrestatin |
| 233 | Alseroxylon |
| 234 | Alsterpaullone |
| 235 | Alteplase |
| 236 | Altiratinib |
| 237 | Altretamine |
| 238 | Altropane |
| 239 | Aluminium |
| 240 | Aluminum Acetate |
| 241 | Aluminum Hydroxide |
| 242 | Alverine |
| 243 | Alvimopan |
| 244 | Alvocidib |
| 245 | AM103 |
| 246 | Am-211 |
| 247 | Am-461 |
| 248 | Ama0076 |
| 249 | Amantadine |
| 250 | Ambenonium |
| 251 | Ambrisentan |
| 252 | Amcinonide |
| 253 | AMD-070 |
| 254 | Amdinocillin |
| 255 | AME-527 |
| 256 | Amelubant |
| 257 | Amg-208 |
| 258 | Amg-319 |
| 259 | Amg-337 |
| 260 | Amg-517 |
| 261 | Amg-548 |
| 262 | Amg-900 |
| 263 | Amibegron |
| 264 | Amido Phenyl Pyruvic Acid |
| 265 | Amifostine |
| 266 | Amikacin |
| 267 | Amiloride |
| 268 | Amineptine |
| 269 | Aminocaproic Acid |
| 270 | Aminodi(Ethyloxy)Ethylaminocarbonylbenzenesulfonamide |
| 271 | Aminoglutethimide |
| 272 | Aminoguanidine |
| 273 | Aminolevulinic acid |
| 274 | Aminomethylcyclohexane |
| 275 | Aminophosphonic Acid-Guanylate Ester |
| 276 | Aminophylline |
| 277 | Aminosalicylic Acid |
| 278 | Amiodarone |
| 279 | Amisulpride |
| 280 | Amitriptyline |
| 281 | Amlexanox |
| 282 | Amlodipine |
| 283 | Ammonium Lactate |
| 284 | Amobarbital |
| 285 | Amodiaquine |
| 286 | Amonafide |
| 287 | Amoxapine |
| 288 | Amoxicillin |
| 289 | Amp579 |
| 290 | AMPA |
| 291 | AMPCPR |
| 292 | Amperozide |
| 293 | Amphetamine |
| 294 | Amphotericin B |
| 295 | Ampicillin |

TABLE 1-continued

| Ligand No. | Ligand Name |
|---|---|
| 296 | Amprenavir |
| 297 | Amrinone |
| 298 | Amsacrine |
| 299 | Amuvatinib |
| 300 | Amyl Nitrite |
| 301 | Amylamine |
| 302 | Amylase |
| 303 | Amylotriose |
| 304 | AN2690 |
| 305 | AN2728 |
| 306 | ANA380 |
| 307 | ANA971 |
| 308 | Anagrelide |
| 309 | Anakinra |
| 310 | Analogue of Indinavir Drug |
| 311 | Anamorelin |
| 312 | Anastrozole |
| 313 | Anatibant |
| 314 | Ancrod |
| 315 | Andolast |
| 316 | ANDROSTA-1,4-DIENE-3,17-DIONE |
| 317 | Androstanedione |
| 318 | Anidulafungin |
| 319 | Anileridine |
| 320 | Aniracetam |
| 321 | Anisindione |
| 322 | ANISOMYCIN |
| 323 | Anisotropine |
| 324 | Anisotropine Methylbromide |
| 325 | Anistreplase |
| 326 | Anlotinib |
| 327 | Antazoline |
| 328 | Antihemophilic Factor (Recombinant) |
| 329 | Antiproliferative Agent A771726 |
| 330 | Antipyrine |
| 331 | Anti-thymocyte Globulin (Rabbit) |
| 332 | Antrafenine |
| 333 | ANX-510 |
| 334 | AP1081 |
| 335 | AP1903 |
| 336 | Apadenoson |
| 337 | Apatinib |
| 338 | Apc-100 |
| 339 | APD125 |
| 340 | Apd334 |
| 341 | Apd371 |
| 342 | APD668 |
| 343 | APD791 |
| 344 | Apitolisib |
| 345 | Apixaban |
| 346 | Aplaviroc |
| 347 | Aplindore |
| 348 | Aplyronine A |
| 349 | Apn1125 |
| 350 | Apomorphine |
| 351 | Apraclonidine |
| 352 | Apremilast |
| 353 | Aprepitant |
| 354 | Aprindine |
| 355 | Aprobarbital |
| 356 | Aprotinin |
| 357 | Apstatin |
| 358 | Aqw051 |
| 359 | Ar-12 |
| 360 | Ara-Alpha(1,3)-Xyl |
| 361 | Arabinose-5-Phosphate |
| 362 | Arachidonic Acid |
| 363 | Arbaclofen |
| 364 | Arbaclofen Placarbil |
| 365 | Arbekacin |
| 366 | Arbutamine |
| 367 | ARC1779 |
| 368 | Arcitumomab |
| 369 | Ardeparin |
| 370 | Ardeparin Sodium |
| 371 | Arecoline |
| 372 | Arformoterol |
| 373 | Argadin |
| 374 | Argatroban |
| 375 | Argifin |
| 376 | Arginineamide |
| 377 | Argininosuccinate |
| 378 | Arhalofenate |
| 379 | Arimoclomol |
| 380 | Aripiprazole |
| 381 | Aripiprazole Lauroxil |
| 382 | Armodafinil |
| 383 | Arn-509 |
| 384 | Arq-087 |
| 385 | Arq-092 |
| 386 | Arq-736 |
| 387 | Arry-300 |
| 388 | Arry-382 |
| 389 | Arry-502 |
| 390 | Arry-797 |
| 391 | Arsenic trioxide |
| 392 | ART-123 |
| 393 | Artemether |
| 394 | Artemisinin |
| 395 | Artemotil |
| 396 | Artenimol |
| 397 | Artesunate |
| 398 | Articaine |
| 399 | AS-3201 |
| 400 | As-602868 |
| 401 | As-703988 |
| 402 | AS-8112 |
| 403 | Asapiprant |
| 404 | Asenapine |
| 405 | Asfotase Alfa |
| 406 | Asimadoline |
| 407 | Asoprisnil |
| 408 | Asp-3026 |
| 409 | Asp7991 |
| 410 | Asparaginase |
| 411 | Asparaginase *Erwinia Chrysanthemi* |
| 412 | Aspartame |
| 413 | Aspartate Beryllium Trifluoride |
| 414 | Aspartate Semialdehyde |
| 415 | Aspartic Acid-4-Carboxymethyl Ester |
| 416 | Aspartyl-Adenosine-5'-Monophosphate |
| 417 | Aspirin |
| 418 | AST-120 |
| 419 | Ast-487 |
| 420 | Astemizole |
| 421 | At-13148 |
| 422 | AT1391 |
| 423 | AT2220 |
| 424 | AT7519 |
| 425 | At-7519 |
| 426 | AT9283 |
| 427 | At-9283 |
| 428 | atamestane-plus-toremifene |
| 429 | Atazanavir |
| 430 | Atenolol |
| 431 | ATG003 |
| 432 | Atilmotin |
| 433 | ATL1101 |
| 434 | ATL1102 |
| 435 | Atl146e |
| 436 | Atomoxetine |
| 437 | Atopaxar |
| 438 | Atorvastatin |
| 439 | Atovaquone |
| 440 | Atpenin A5 |
| 441 | Atracurium |
| 442 | Atracurium besylate |
| 443 | Atrasentan |

TABLE 1-continued

Ligands

| Ligand No. | Ligand Name |
|---|---|
| 444 | Atropine |
| 445 | Atx08-001 |
| 446 | Auranofin |
| 447 | Aurodox |
| 448 | AUROVERTIN B |
| 449 | Av-101 |
| 450 | AV411 |
| 451 | AV608 |
| 452 | Avanafil |
| 453 | Ave0847 |
| 454 | AVE-1625 |
| 455 | Ave8134 |
| 456 | Ave-9940 |
| 457 | AVI-4557 |
| 458 | Avibactam |
| 459 | Avl-3288 |
| 460 | Avosentan |
| 461 | Axelopran |
| 462 | Axitinib |
| 463 | Axomadol |
| 464 | Axp-107-11 |
| 465 | Azacitidine |
| 466 | Azatadine |
| 467 | Azathioprine |
| 468 | AZD 3355 |
| 469 | Azd0328 |
| 470 | Azd-0424 |
| 471 | Azd-1080 |
| 472 | Azd-1208 |
| 473 | Azd1305 |
| 474 | Azd1386 |
| 475 | Azd1446 |
| 476 | Azd-1480 |
| 477 | Azd-1775 |
| 478 | Azd1981 |
| 479 | Azd-2014 |
| 480 | Azd2066 |
| 481 | AZD2171 |
| 482 | Azd2207 |
| 483 | Azd2423 |
| 484 | Azd2516 |
| 485 | AZD2563 |
| 486 | Azd2624 |
| 487 | Azd3161 |
| 488 | Azd3199 |
| 489 | AZD3409 |
| 490 | Azd3514 |
| 491 | Azd-4547 |
| 492 | Azd-4769 |
| 493 | Azd4818 |
| 494 | Azd-5363 |
| 495 | Azd-5438 |
| 496 | Azd5672 |
| 497 | AZD6140 |
| 498 | Azd6280 |
| 499 | Azd-6482 |
| 500 | Azd-6703 |
| 501 | Azd-6738 |
| 502 | Azd-6842 |
| 503 | Azd-6918 |
| 504 | Azd7009 |
| 505 | Azd7325 |
| 506 | Azd-7451 |
| 507 | Azd-7624 |
| 508 | Azd-7762 |
| 509 | Azd-8055 |
| 510 | Azd-8186 |
| 511 | AZD-8330 |
| 512 | Azd8683 |
| 513 | Azd9056 |
| 514 | AZD-9684 |
| 515 | Azelaic Acid |
| 516 | Azelastine |
| 517 | Azidocillin |
| 518 | Azilsartan medoxomil |
| 519 | Azimilide |
| 520 | Azithromycin |
| 521 | Azlocillin |
| 522 | Azm-475271 |
| 523 | Aztreonam |
| 524 | B-2-Octylglucoside |
| 525 | Bacampicillin |
| 526 | Bacitracin |
| 527 | Baclofen |
| 528 | Bacteriochlorophyll A |
| 529 | Bafetinib |
| 530 | Bafilomycin A1 |
| 531 | Bafilomycin B1 |
| 532 | Balaglitazone |
| 533 | Balamapimod |
| 534 | Balanol |
| 535 | Balanol Analog 1 |
| 536 | Balanol Analog 2 |
| 537 | Balanol Analog 8 |
| 538 | Balsalazid |
| 539 | Balsalazide |
| 540 | Bambuterol |
| 541 | Banoxantrone |
| 542 | Barasertib |
| 543 | Barbital |
| 544 | Barbituric acid derivative |
| 545 | Bardoxolone Methyl |
| 546 | Baricitinib |
| 547 | Barusiban |
| 548 | Basiliximab |
| 549 | Basimglurant |
| 550 | Batefenterol |
| 551 | Batimastat |
| 552 | Bavisant |
| 553 | Bay1067197 |
| 554 | Bay-1082439 |
| 555 | Bay-1125976 |
| 556 | Bay-1161909 |
| 557 | Bay-1163877 |
| 558 | Bay-1217389 |
| 559 | Bazedoxifene |
| 560 | Bb-3497 |
| 561 | Bcx-1812 |
| 562 | Becaplermin |
| 563 | Beclomethasone |
| 564 | Beclomethasone Dipropionate |
| 565 | Becocalcidiol |
| 566 | Bedaquiline |
| 567 | Bedoradrine |
| 568 | Befiradol |
| 569 | Belatacept |
| 570 | Belimumab |
| 571 | Belinostat |
| 572 | Benazepril |
| 573 | Bendamustine |
| 574 | Bendroflumethiazide |
| 575 | Benoxinate |
| 576 | Bentamapimod |
| 577 | Bentiromide |
| 578 | Benzamidine |
| 579 | Benzatropine |
| 580 | Benzene Hexacarboxylic Acid |
| 581 | Benzenesulfonyl |
| 582 | Benzimidazole |
| 583 | Benzo[B]Thiophene-2-Boronic Acid |
| 584 | Benzo[B]Thiophene-2-Carboxamidine |
| 585 | Benzocaine |
| 586 | Benzofuran |
| 587 | Benzofuran-2-Carboxylic Acid {(S)-3-Methyl-1-[3-Oxo-1-(Pyridin-2-Ylsulfonyl)Azepan-4-Ylcarbamoyl]Butyl}Amide |
| 588 | Benzoic Acid |
| 589 | Benzonatate |
| 590 | BENZOTHIAZOLE |

TABLE 1-continued

Ligands

| Ligand No. | Ligand Name |
|---|---|
| 591 | Benzoxazinorifamycin |
| 592 | Benzoyl-Arginine-Alanine-Methyl Ketone |
| 593 | Benzoylformic Acid |
| 594 | BENZOYL-TYROSINE-ALANINE-METHYL KETONE |
| 595 | Benzphetamine |
| 596 | Benzquinamide |
| 597 | Benzthiazide |
| 598 | Benztropine |
| 599 | benzyl (2-oxopropyl)carbamate |
| 600 | BENZYL 6-BENZYL-5,7-DIOXO-6,7-DIHYDRO-5H-[1,3]THIAZOLO[3,2-C]PYRIMIDINE-2-CARBOXYLATE |
| 601 | Benzyl Alcohol |
| 602 | Benzyl Benzoate |
| 603 | BENZYL N-({(2S,3S)-3-[(PROPYLAMINO)CARBONYL]OXIRAN-2-YL}CARBONYL)-L-ISOLEUCYL-L-PROLINATE |
| 604 | Benzylamine |
| 605 | Benzylcysteine |
| 606 | Benzylpenicillin |
| 607 | Benzylpenicilloyl Polylysine |
| 608 | Benzylsulfinic Acid |
| 609 | Bepotastine |
| 610 | Bepridil |
| 611 | Beractant |
| 612 | Beraprost |
| 613 | Berberine |
| 614 | Besifloxacin |
| 615 | Bestatin |
| 616 | Beta-(2-Naphthyl)-Alanine |
| 617 | Beta(2-Thienyl)Alanine |
| 618 | Beta-1,4-Galactobioside |
| 619 | Beta-1,4-Galactotrioside |
| 620 | Beta-3-Cysteine |
| 621 | Beta-3-Serine |
| 622 | Beta-Alanine |
| 623 | Beta-Cyclohexyl-Alanine |
| 624 | Beta-Dadf, Msa, Multisubstrate Adduct Inhibitor |
| 625 | Beta-D-Arabinofuranose-5'-Phosphate |
| 626 | Beta-D-Fructopyranose |
| 627 | Beta-D-Fucose |
| 628 | Beta-D-Glucopyranose Spirohydantoin |
| 629 | Beta-D-Glucose |
| 630 | Beta-D-Glucose-6-Phosphate |
| 631 | beta-D-Ribopyranose |
| 632 | Beta-Galactose-6-Phosphate |
| 633 | Betahistine |
| 634 | Beta-Hydroxyasparagine |
| 635 | Beta-Hydroxyaspartic Acid |
| 636 | Betaine |
| 637 | Beta-L-Arabinose |
| 638 | beta-L-fucose |
| 639 | Beta-L-Methyl-Fucose |
| 640 | Beta-Mercaptoethanol |
| 641 | Betamethasone |
| 642 | Betamethasone Acetate |
| 643 | Betamethasone Benzoate |
| 644 | Betamethasone Dipropionate |
| 645 | Betamethasone Phosphoric Acid |
| 646 | Betamethasone Valerate |
| 647 | BETA-METHYLLACTOSIDE |
| 648 | beta-phenyl-D-phenylalanyl-N-propyl-L-prolinamide |
| 649 | Beta-Sialic Acid |
| 650 | Betaxolol |
| 651 | Betazole |
| 652 | Bethanechol |
| 653 | Bethanidine |
| 654 | Bevacizumab |
| 655 | Bevantolol |
| 656 | Bevenopran |
| 657 | Bevirimat |
| 658 | Bexarotene |
| 659 | Bezafibrate |
| 660 | Bgb-283 |
| 661 | Bgt-226 |
| 662 | Bi113823 |
| 663 | Bi-2536 |
| 664 | Bi-811283 |
| 665 | Bi-853520 |
| 666 | BIA |
| 667 | Bicalutamide |
| 668 | Bicifadine |
| 669 | Bicine |
| 670 | Bifeprunox |
| 671 | Bifonazole |
| 672 | Bilh 434 |
| 673 | Biliverdine Ix Alpha |
| 674 | BILN 2061 |
| 675 | Bimatoprost |
| 676 | Binimetinib |
| 677 | Binodenoson |
| 678 | Biopterin |
| 679 | Biotin |
| 680 | BIOTINOL-5-AMP |
| 681 | Biotinyl P-Nitroaniline |
| 682 | Biperiden |
| 683 | Biphenyl-2,3-Diol |
| 684 | BIPHENYL-4-YL-ACETALDEHYDE |
| 685 | Biphenylalanine |
| 686 | Biricodar dicitrate |
| 687 | bis(4-hydroxyphenyl)methanone |
| 688 | bis(4-nitrophenyl) hydrogen phosphate |
| 689 | Bis(5-Amidino-2-Benzimidazolyl)Methane Ketone |
| 690 | Bis(5-Amidino-2-Benzimidazolyl)Methane Ketone Hydrate |
| 691 | Bis(5-Amidino-2-Benzimidazolyl)Methanone |
| 692 | Bis(5-Amidino-Benzimidazolyl)Methane |
| 693 | Bis(5-Amidino-Benzimidazolyl)Methane Zinc |
| 694 | Bis(5-Amidino-Benzimidazolyl)Methanone Zinc |
| 695 | Bis(Adenosine)-5'-Pentaphosphate |
| 696 | Bis(Adenosine)-5'-Triphosphate |
| 697 | BIS-1,2-{[(Z)-2-CARBOXY-2-METHYL-1,3-DIOXANE]-5-YLOXYCARBAMOYL}-ETHANE |
| 698 | BIS-1,2-{[(Z)-2CARBOXY-2-METHYL-1,3-DIOXANE]-5-YLOXYCARBONYL}-PIPERAZINE |
| 699 | Bisacodyl |
| 700 | Bis-Benzamidine |
| 701 | Bishydroxy[2h-1-Benzopyran-2-One,1,2-Benzopyrone] |
| 702 | Bismuth Subsalicylate |
| 703 | Bis-Napthyl Beta-Ketophosphonic Acid |
| 704 | Bisoprolol |
| 705 | Bitolterol |
| 706 | Bivalirudin |
| 707 | Bkt140 |
| 708 | BL-1020 |
| 709 | Bleomycin |
| 710 | Blinatumomab |
| 711 | BMS068645 |
| 712 | BMS184394 |
| 713 | Bms-223131 |
| 714 | Bms-387032 |
| 715 | Bms-582949 |
| 716 | Bms-690514 |
| 717 | Bms-698769 |
| 718 | Bms-754807 |
| 719 | Bms-777607 |
| 720 | Bms-779788 |
| 721 | Bms-794833 |
| 722 | Bms-817378 |
| 723 | Bms-833923 |
| 724 | Bms-852927 |
| 725 | Bms-863233 |
| 726 | Bms-911543 |
| 727 | Bmsc-0013 |
| 728 | BNP 1350 |
| 729 | BNP-166 |
| 730 | Boceprevir |
| 731 | BOC-GAMMA-D-GLU-L-LYS(CBZ)-D-BOROALA |
| 732 | Boldenone |
| 733 | Bopindolol |

TABLE 1-continued

Ligands

| Ligand No. | Ligand Name |
|---|---|
| 734 | Bortezomib |
| 735 | Bosentan |
| 736 | Bosutinib |
| 737 | Botulinum Toxin Type A |
| 738 | Botulinum Toxin Type A Purified Neurotoxin Complex |
| 739 | Botulinum Toxin Type B |
| 740 | Bpi-9016 |
| 741 | Bradanicline |
| 742 | Brasofensine |
| 743 | Brecanavir |
| 744 | Bremelanotide |
| 745 | Brentuximab vedotin |
| 746 | Brequinar Analog |
| 747 | Bretylium |
| 748 | Brexpiprazole |
| 749 | Briciclib |
| 750 | Brigatinib |
| 751 | Brimonidine |
| 752 | Brinzolamide |
| 753 | Brivanib |
| 754 | Brivanib Alaninate |
| 755 | Brodimoprim-4,6-Dicarboxylate |
| 756 | BROMAMPHENICOL |
| 757 | Bromazepam |
| 758 | Bromfenac |
| 759 | Bromocriptine |
| 760 | Bromodiphenhydramine |
| 761 | Bromopride |
| 762 | Bromopurine |
| 763 | Bromo-Willardiine |
| 764 | Bromo-WR99210 |
| 765 | Brompheniramine |
| 766 | BTA9881 |
| 767 | Buclizine |
| 768 | Budesonide |
| 769 | Bufuralol |
| 770 | Bulgecin A |
| 771 | Bumetanide |
| 772 | Buparlisib |
| 773 | Bupivacaine |
| 774 | Bupranolol |
| 775 | Buprenorphine |
| 776 | Bupropion |
| 777 | Burapitant |
| 778 | Burixafor |
| 779 | Buserelin |
| 780 | Buspirone |
| 781 | Busulfan |
| 782 | BUT-3-ENYL-[5-(4-CHLORO-PHENYL)-3,6-DIHYDRO-[1,3,4]THIADIAZIN-2-YLIDENE]-AMINE |
| 783 | Butabarbital |
| 784 | Butalbital |
| 785 | Butan-1-Ol |
| 786 | Butanoic Acid |
| 787 | Butenafine |
| 788 | Butethal |
| 789 | Butoconazole |
| 790 | Butorphanol |
| 791 | Butriptyline |
| 792 | Butylamine |
| 793 | Butylphosphonate |
| 794 | Butyramide |
| 795 | Butyrylthiocholine |
| 796 | BV1 |
| 797 | BV2 |
| 798 | BV3 |
| 799 | BV4 |
| 800 | BVDU-MP |
| 801 | Bvt.115959 |
| 802 | C-(1-Azido-Alpha-D-Glucopyranosyl) Formamide |
| 803 | C-(1-Hydrogyl-Beta-D-Glucopyranosyl) Formamide |
| 804 | C1 Esterase Inhibitor (Human) |
| 805 | C-1027 Aromatized Chromophore |
| 806 | C-1311 |
| 807 | C16-Fatty-Acyl-Substrate-Mimic |
| 808 | C1-INH |
| 809 | C31G |
| 810 | CA4P |
| 811 | Cabazitaxel |
| 812 | Cabergoline |
| 813 | Cabozantinib |
| 814 | CAD106 |
| 815 | Caffeine |
| 816 | Cafusertib |
| 817 | Cal-263 |
| 818 | Calanolide A |
| 819 | Calcidiol |
| 820 | Calcipotriene |
| 821 | Calcipotriol |
| 822 | Calcitonin Human |
| 823 | Calcitonin Salmon |
| 824 | Calcitonin Salmon Recombinant |
| 825 | Calcitriol |
| 826 | Calcium |
| 827 | Calcium Acetate |
| 828 | Calfactant |
| 829 | Calusterone |
| 830 | Calyculin A |
| 831 | Camicinal |
| 832 | Camphane |
| 833 | Camphor |
| 834 | Camptothecin |
| 835 | Canagliflozin |
| 836 | Canakinumab |
| 837 | Canaline |
| 838 | Candesartan |
| 839 | Candesartan Cilexetil |
| 840 | Candicidin |
| 841 | Candoxatril |
| 842 | Canertinib |
| 843 | Canfosfamide |
| 844 | Cangrelor |
| 845 | Capadenoson |
| 846 | Capecitabine |
| 847 | Capeserod |
| 848 | Capmatinib |
| 849 | Capreomycine |
| 850 | Capromab |
| 851 | Caprylic acid |
| 852 | Capsaicin |
| 853 | Captodiame |
| 854 | Captopril |
| 855 | Carbachol |
| 856 | Carbachol Chloride |
| 857 | Carbamazepine |
| 858 | Carbamic Acid |
| 859 | Carba-Nicotinamide-Adenine-Dinucleotide |
| 860 | Carbaphosphonate |
| 861 | Carbenicillin |
| 862 | Carbenicillin Indanyl |
| 863 | Carbenoxolone |
| 864 | Carbetocin |
| 865 | Carbidopa |
| 866 | Carbimazole |
| 867 | Carbinoxamine |
| 868 | Carbobenzoxy-Pro-Lys-Phe-Y(Po2)-Ala-Pro-Ome |
| 869 | CARBOBENZYLOXY-(L)-LEUCINYL-(L)LEUCINYL METHOXYMETHYLKETONE |
| 870 | Carbocisteine |
| 871 | Carboplatin |
| 872 | Carboprost |
| 873 | Carboprost Tromethamine |
| 874 | Carboxin |
| 875 | Carboxyatractyloside |
| 876 | Carboxylic PRPP |
| 877 | Carboxymethylthio-3-(3-Chlorophenyl)-1,2,4-Oxadiazol |
| 878 | Carboxymycobactin S |
| 879 | Carboxymycobactin T |

TABLE 1-continued

Ligands

| Ligand No. | Ligand Name |
|---|---|
| 880 | Cardiolipin |
| 881 | Carfentanil |
| 882 | Carfilzomib |
| 883 | Carglumic Acid |
| 884 | Cariprazine |
| 885 | Carisoprodol |
| 886 | Carmoterol |
| 887 | Carmustine |
| 888 | Carphenazine |
| 889 | Carprofen |
| 890 | Carteolol |
| 891 | Carvedilol |
| 892 | Caspoitant |
| 893 | Caspofungin |
| 894 | CAT-213 |
| 895 | Cb-03-01 |
| 896 | CB1954 |
| 897 | CBZ-LEU-LEU-TYR-CH2F |
| 898 | Cc-115 |
| 899 | Cc-223 |
| 900 | Cc-401 |
| 901 | CC-8490 |
| 902 | Ccx140 |
| 903 | Ccx168 |
| 904 | CCX282 |
| 905 | Ccx354 |
| 906 | CCX915 |
| 907 | CD564 |
| 908 | CDB-2914 |
| 909 | CDP323 |
| 910 | CDX-110 |
| 911 | Ce-224535 |
| 912 | Ce-245677 |
| 913 | Cebranopadol |
| 914 | Cediranib |
| 915 | Cefacetrile |
| 916 | Cefaclor |
| 917 | Cefadroxil |
| 918 | Cefalotin |
| 919 | Cefamandole |
| 920 | Cefamandole Nafate |
| 921 | Cefapirin |
| 922 | Cefazolin |
| 923 | Cefdinir |
| 924 | Cefditoren |
| 925 | Cefditoren Pivoxil |
| 926 | Cefepime |
| 927 | Cefixime |
| 928 | Cefmenoxime |
| 929 | Cefmetazole |
| 930 | Cefonicid |
| 931 | Cefoperazone |
| 932 | Ceforanide |
| 933 | Cefotaxime |
| 934 | Cefotaxime Group |
| 935 | Cefotetan |
| 936 | Cefotiam |
| 937 | Cefoxitin |
| 938 | Cefpiramide |
| 939 | Cefpodoxime |
| 940 | Cefpodoxime Proxetil |
| 941 | Cefprozil |
| 942 | Cefradine |
| 943 | Ceftaroline Fosamil |
| 944 | Ceftazidime |
| 945 | Ceftibuten |
| 946 | Ceftizoxime |
| 947 | Ceftobiprole |
| 948 | Ceftolozane |
| 949 | Ceftriaxone |
| 950 | Cefuroxime |
| 951 | Cefuroxime Axetil |
| 952 | Celecoxib |
| 953 | Celiprolol |
| 954 | Cellobiose |
| 955 | Cellotetraose |
| 956 | Cenicriviroc |
| 957 | Cenisertib |
| 958 | Cep-11981 |
| 959 | CEP-1347 |
| 960 | Cep-2563 |
| 961 | Cep-2583 |
| 962 | Cep-32496 |
| 963 | Cep-37440 |
| 964 | Cep-5214 |
| 965 | Cep-7055 |
| 966 | Cephalexin |
| 967 | Cephaloglycin |
| 968 | Cephalosporin Analog |
| 969 | Cephalosporin C |
| 970 | Cephalothin |
| 971 | Cephalothin Group |
| 972 | Cephapirin |
| 973 | Cephradine |
| 974 | Cer-002 |
| 975 | Cerc-301 |
| 976 | Cerdulatinib |
| 977 | Ceritinib |
| 978 | Cerivastatin |
| 979 | Cerlapirdine |
| 980 | Certolizumab pegol |
| 981 | Cerulenin |
| 982 | Ceruletide |
| 983 | Cetirizine |
| 984 | Cetrorelix |
| 985 | Cetuximab |
| 986 | Cetyl Alcohol |
| 987 | Cetyl-Trimethyl-Ammonium |
| 988 | Cevimeline |
| 989 | CF-101 |
| 990 | Cf102 |
| 991 | Chenodeoxycholic acid |
| 992 | Chenodiol |
| 993 | CHF 4227 |
| 994 | CHF-1512 |
| 995 | Chf4227 |
| 996 | Chiauranib |
| 997 | Chir-265 |
| 998 | Chitotriose |
| 999 | Chlophedianol |
| 1000 | Chlorambucil |
| 1001 | Chloramphenicol |
| 1002 | Chloramphenicol Palmitate |
| 1003 | CHLORAMPHENICOL SUCCINATE |
| 1004 | Chloramphenicol Succinic Acid |
| 1005 | Chlorcyclizine |
| 1006 | Chlordiazepoxide |
| 1007 | Chlorhexidine |
| 1008 | Chlormerodrin |
| 1009 | Chlormezanone |
| 1010 | Chloroguanide |
| 1011 | Chloroprocaine |
| 1012 | Chloropyramine |
| 1013 | Chloroquine |
| 1014 | Chlorothiazide |
| 1015 | Chlorotrianisene |
| 1016 | Chloroxine |
| 1017 | Chlorphenamine |
| 1018 | Chlorphenesin Carbamate |
| 1019 | Chlorpheniramine |
| 1020 | Chlorphentermine |
| 1021 | Chlorpromazine |
| 1022 | Chlorpropamide |
| 1023 | Chlorprothixene |
| 1024 | Chlortetracycline |
| 1025 | Chlorthalidone |
| 1026 | Chlorzoxazone |
| 1027 | Cholecalciferol |

TABLE 1-continued

Ligands

| Ligand No. | Ligand Name |
|---|---|
| 1028 | Cholesterol |
| 1029 | Cholesterol-Sulfate |
| 1030 | Cholesteryl Linoleate |
| 1031 | Cholestyramine |
| 1032 | Cholic Acid |
| 1033 | Choline |
| 1034 | Choriogonadotropin alfa |
| 1035 | CHR-2797 |
| 1036 | Chromic Phosphate |
| 1037 | Chymopapain |
| 1038 | Chymostatin |
| 1039 | Chymotrypsin |
| 1040 | CI-1033 |
| 1041 | Ci-1040 |
| 1042 | Ci-988 |
| 1043 | Cibacron Blue |
| 1044 | Ciclesonide |
| 1045 | Ciclopirox |
| 1046 | Cidofovir |
| 1047 | Cilansetron |
| 1048 | Cilastatin |
| 1049 | Cilazapril |
| 1050 | Cilostazol |
| 1051 | Cimetidine |
| 1052 | Cimicoxib |
| 1053 | Cinacalcet |
| 1054 | Cinalukast |
| 1055 | Cinchocaine |
| 1056 | Cinitapride |
| 1057 | Cinnarizine |
| 1058 | Cinolazepam |
| 1059 | Cinoxacin |
| 1060 | Cintredekin Besudotox |
| 1061 | Cipralisant |
| 1062 | Ciprofloxacin |
| 1063 | Cirazoline |
| 1064 | CIS-(1R,2S)-2-AMINO-1,2,3,4-TETRAHYDRONAPHTHALEN-1-OL |
| 1065 | Cis-[4,5-Bis-(4-Bromophenyl)-2-(2-Ethoxy-4-Methoxyphenyl)-4,5-Dihydroimidazol-1-Yl]-[4-(2-Hydroxyethyl)Piperazin-1-Yl]Methanone |
| 1066 | Cis-[4,5-Bis-(4-Chlorophenyl)-2-(2-Isopropoxy-4-Methoxyphenyl)-4,5-Dihyd Roimidazol-1-Yl]-Piperazin-1-Yl-Methanone |
| 1067 | Cis-4-Cyano-4-[3-(Cyclopentyloxy)-4-Methoxyphenyl]Cyclohexanecarboxylic Acid |
| 1068 | CIS-4-METHYL-N-[(1S)-3-(METHYLSULFANYL)-1-(PYRIDIN-4-YLCARBAMOYL)PROPYL]CYCLOHEXANE-CARBOXAMIDE |
| 1069 | Cisapride |
| 1070 | Cisatracurium |
| 1071 | Cisatracurium besylate |
| 1072 | Cisplatin |
| 1073 | Cis-tetracosenoyl sulfatide |
| 1074 | Citalopram |
| 1075 | Citraconic acid |
| 1076 | Citric Acid |
| 1077 | Cladribine |
| 1078 | Clarithromycin |
| 1079 | Clavulanate |
| 1080 | Clavulanic Acid |
| 1081 | Clazosentan |
| 1082 | Clemastine |
| 1083 | Clenbuterol |
| 1084 | Clevidipine |
| 1085 | Clidinium |
| 1086 | Clindamycin |
| 1087 | Clindamycin Palmitate |
| 1088 | Clindamycin Phosphate |
| 1089 | Clioquinol |
| 1090 | Clobazam |
| 1091 | Clobetasol propionate |
| 1092 | Clocortolone |
| 1093 | Clocortolone Pivalate |
| 1094 | Clodronate |
| 1095 | Clofarabine |
| 1096 | Clofazimine |
| 1097 | Clofedanol |
| 1098 | Clofibrate |
| 1099 | Clomifene |
| 1100 | Clomipramine |
| 1101 | Clomocycline |
| 1102 | Clonazepam |
| 1103 | Clonidine |
| 1104 | Clopidogrel |
| 1105 | Clorazepate |
| 1106 | Clorazepic Acid |
| 1107 | Clorobiocin |
| 1108 | Clotiazepam |
| 1109 | Clotrimazole |
| 1110 | Cloxacillin |
| 1111 | Clozapine |
| 1112 | CLX-0921 |
| 1113 | Cm-082 |
| 1114 | CMLVAX100 |
| 1115 | Cmp-2-Keto-3-Deoxy-Octulosonic Acid |
| 1116 | CNF1010 |
| 1117 | CNS-5161 |
| 1118 | Cnv2197944 |
| 1119 | Coagulation Factor IX |
| 1120 | Coagulation factor VIIa |
| 1121 | Coa-S-Acetyl 5-Bromotryptamine |
| 1122 | Coa-S-Acetyl Tryptamine |
| 1123 | Coa-S-Trimethylene-Acetyl-Tryptamine |
| 1124 | Cobalt Hexammine Ion |
| 1125 | Cobicistat |
| 1126 | Cobimetinib |
| 1127 | Cobiprostone |
| 1128 | Cocaine |
| 1129 | Codeine |
| 1130 | Coenzyme A |
| 1131 | Coenzyme a Persulfide |
| 1132 | Colchicine |
| 1133 | Colesevelam Hydrochloride |
| 1134 | Colestipol Hydrochloride |
| 1135 | Colistimethate Sodium |
| 1136 | Colistin |
| 1137 | Collagenase Clostridium histolyticum |
| 1138 | Co-Methylcobalamin |
| 1139 | Compound 12, N-Acetyl-4-[(Carboxycarbonyl)(2-Carboxyphenyl)Amino]-N-Pentyl-1-Napthylalaniamide |
| 1140 | Compound 18 |
| 1141 | Compound 19 |
| 1142 | Compound 4-D |
| 1143 | Compound 5,2-(Naphthalen-1-Yl-Oxalyl-Amino)-Benzoicacid |
| 1144 | Compound 9 |
| 1145 | Conivaptan |
| 1146 | Conjugated Estrogens |
| 1147 | Copanlisib |
| 1148 | Coprogen |
| 1149 | Coproporphyrin I |
| 1150 | Coproporphyrin Iii |
| 1151 | Cordycepin Triphosphate |
| 1152 | Cort 108297 |
| 1153 | Cort 125134 |
| 1154 | Corticotropin |
| 1155 | Corticotropin Zinc Hydroxide |
| 1156 | Cortisone acetate |
| 1157 | Cosyntropin |
| 1158 | CP-122721 |
| 1159 | Cp-166572, 2-Hydroxymethyl-4-(4-N,N-Dimethylaminosulfonyl-1-Piperazino)-Pyrimidine |
| 1160 | CP-271485 |
| 1161 | Cp403700, (S)-1-{2-[(5-Chloro-1h-Indole-2-Carbonyl)-Amino]-3-Phenyl-Propionyl}-Azetidine-3-Carboxylate |
| 1162 | CP-4055 |

TABLE 1-continued

Ligands

| Ligand No. | Ligand Name |
|---|---|
| 1163 | Cp-459632 |
| 1164 | CP-526423 |
| 1165 | Cp-724714 |
| 1166 | Cp-778875 |
| 1167 | CP-945598 |
| 1168 | Cpad |
| 1169 | Cr 1447 |
| 1170 | CR002 |
| 1171 | Cr-3465 |
| 1172 | CR665 |
| 1173 | CRA_10433 |
| 1174 | CRA_10655 |
| 1175 | CRA_10656 |
| 1176 | CRA_10762 |
| 1177 | CRA_10950 |
| 1178 | CRA_10972 |
| 1179 | CRA_10991 |
| 1180 | CRA_11092 |
| 1181 | CRA_1144 |
| 1182 | CRA_16847 |
| 1183 | CRA_17312 |
| 1184 | CRA_17693 |
| 1185 | CRA_1801 |
| 1186 | CRA_1802 |
| 1187 | CRA_23653 |
| 1188 | CRA_7806 |
| 1189 | CRA_8696 |
| 1190 | CRA_9076 |
| 1191 | CRA_9334 |
| 1192 | CRA_9678 |
| 1193 | CRA_9785 |
| 1194 | CRA-024781 |
| 1195 | Crc200 (Chiron-Behring) |
| 1196 | Creatine |
| 1197 | Crenolanib |
| 1198 | Crizotinib |
| 1199 | Crofelemer |
| 1200 | Cromoglicic acid |
| 1201 | Cromolyn |
| 1202 | Crotamiton |
| 1203 | Crotonaldehyde |
| 1204 | CRx-119 |
| 1205 | CRx-139 |
| 1206 | Cryptenamine |
| 1207 | Cryptenamine Acetates |
| 1208 | Cryptenamine Tannates |
| 1209 | Crystal Violet |
| 1210 | Cs-8080 |
| 1211 | CT-011 |
| 1212 | Ct-1578 |
| 1213 | Ct-327 |
| 1214 | CTA018 |
| 1215 | Ctce-9908 |
| 1216 | CTI-01 |
| 1217 | CTS-21166 |
| 1218 | Cu-Bicyclam |
| 1219 | Cu-Cyclam |
| 1220 | Cudc-101 |
| 1221 | Cudc-907 |
| 1222 | Cupric Sulfate |
| 1223 | CX157 |
| 1224 | CX717 |
| 1225 | Cyanamide |
| 1226 | Cyanocobalamin |
| 1227 | CYC116 |
| 1228 | Cyc-116 |
| 1229 | Cyclacillin |
| 1230 | Cyclandelate |
| 1231 | cyclic 3',5'-thymidine monophosphate |
| 1232 | Cyclic Adenosine Monophosphate |
| 1233 | Cyclic Guanosine Monophosphate |
| 1234 | Cyclizine |
| 1235 | Cyclobenzaprine |
| 1236 | Cycloguanil |
| 1237 | Cyclo-Hepta-Amylose |
| 1238 | Cyclohexane Propionic Acid |
| 1239 | Cyclohexanol |
| 1240 | Cyclohexanone |
| 1241 | Cyclohexyl-{4-[5-(3,4-Dichlorophenyl)-2-Piperidin-4-Yl-3-Propyl-3h-Imidazol-4-Yl]-Pyrimidin-2-Yl}Amine |
| 1242 | Cyclohexylammonium Ion |
| 1243 | Cyclohexylformamide |
| 1244 | Cyclohexyl-Hexyl-Beta-D-Maltoside |
| 1245 | CYCLOHEXYLMETHYL-2,3-DIHYDROXY-5-METHYL-HEXYLAMIDE |
| 1246 | Cyclohexyl-pentyl-maltoside |
| 1247 | Cycloleucine |
| 1248 | Cyclopentolate |
| 1249 | Cyclophosphamide |
| 1250 | Cyclopropyl-{4-[5-(3,4-Dichlorophenyl)-2-[(1-Methyl)-Piperidin]-4-Yl-3-Propyl-3h-Imidazol-4-Yl]-Pyrimidin-2-Yl}Amine |
| 1251 | Cycloserine |
| 1252 | Cyclosporine |
| 1253 | Cyclo-Tetrametavanadate |
| 1254 | Cyclotheonamide A |
| 1255 | Cyclothiazide |
| 1256 | Cyclouridine |
| 1257 | Cycrimine |
| 1258 | Cyproheptadine |
| 1259 | Cyproterone acetate |
| 1260 | Cysteamine |
| 1261 | Cysteine-S-Acetamide |
| 1262 | Cysteinesulfonic Acid |
| 1263 | Cystein-S-Yl Cacodylate |
| 1264 | CYT006-AngQb |
| 1265 | CYT007-TNFQb |
| 1266 | CYT997 |
| 1267 | Cytarabine |
| 1268 | Cytidine |
| 1269 | Cytidine 5'-Diphosphoglycerol |
| 1270 | Cytidine-2'-Monophosphate |
| 1271 | Cytidine-3'-Monophosphate |
| 1272 | Cytidine-5'-Diphosphate |
| 1273 | Cytidine-5'-Diphospho-Beta-D-Xylose |
| 1274 | Cytidine-5'-Monophosphate |
| 1275 | Cytidine-5'-Monophosphate-5-N-Acetylneuraminic Acid |
| 1276 | Cytidine-5'-Triphosphate |
| 1277 | Cytisine |
| 1278 | Cytosine Arabinose-5'-Phosphate |
| 1279 | CZEN 002 |
| 1280 | D-[(Amino)Carbonyl]Phenylalanine |
| 1281 | D-[(N-Hydroxyamino)Carbonyl]Phenylalanine |
| 1282 | D-1-(4-CHLOROPHENYL)-2-(ACETAMIDO)ETHANE BORONIC ACID |
| 1283 | D-1-NAPHTHYL-2-ACETAMIDO-ETHANE BORONIC ACID |
| 1284 | D-2-Amino-3-Phosphono-Propionic Acid |
| 1285 | D-4-Phosphoerythronic Acid |
| 1286 | Dabigatran etexilate |
| 1287 | Dabrafenib |
| 1288 | Dabuzalgron |
| 1289 | Dacarbazine |
| 1290 | Daclatasvir |
| 1291 | Daclizumab |
| 1292 | Dacomitinib |
| 1293 | Dactinomycin |
| 1294 | Dactolisib |
| 1295 | Dagrocorat |
| 1296 | Daidzin |
| 1297 | D-Alanine |
| 1298 | Dalbavancin |
| 1299 | Dalfampridine |
| 1300 | Dalfopristin |
| 1301 | D-Allopyranose |
| 1302 | Dalteparin |
| 1303 | Dalteparin Sodium |
| 1304 | Danaparoid Sodium |

TABLE 1-continued

Ligands

| Ligand No. | Ligand Name |
|---|---|
| 1305 | Danazol |
| 1306 | Danirixin |
| 1307 | Dansylamide |
| 1308 | Dansyllysine |
| 1309 | Dantrolene |
| 1310 | Danusertib |
| 1311 | Dapagliflozin |
| 1312 | Dapiprazole |
| 1313 | Dapoxetine |
| 1314 | Dapsone |
| 1315 | Daptpmycin |
| 1316 | Daratumumab |
| 1317 | Darbeppetin alfa |
| 1318 | D-Arginine |
| 1319 | Darifenacin |
| 1320 | Darotropium |
| 1321 | Darunavir |
| 1322 | Darusentan |
| 1323 | DAS-431 IV |
| 1324 | Dasabuvir |
| 1325 | Dasatinib |
| 1326 | D-Aspartic Acid |
| 1327 | Daunorubicin |
| 1328 | Davalintide |
| 1329 | Dazoxiben |
| 1330 | Db959 |
| 1331 | Dcka, 5,7-Dichlorokynurenic Acid |
| 1332 | D-Cysteine |
| 1333 | D-Dethiobiotin |
| 1334 | DDP733 |
| 1335 | De-104 |
| 1336 | Deacetoxycephalosporin-C |
| 1337 | Deamido-Nad+ |
| 1338 | DEAMINO-METHYL-PHENYLALANINE |
| 1339 | Debrisoquin |
| 1340 | Debromhymenialdisine |
| 1341 | Decamethonium |
| 1342 | DECANE-1-THIOL |
| 1343 | Decanoic Acid |
| 1344 | Decernotinib |
| 1345 | Decitabine |
| 1346 | Decoglurant |
| 1347 | DECYL FORMATE |
| 1348 | DECYL(DIMETHYL)PHOSPHINE OXIDE |
| 1349 | Decylamine-N,N-Dimethyl-N-Oxide |
| 1350 | Decyloxy-Methanol |
| 1351 | Defactinib |
| 1352 | Deferasirox |
| 1353 | Deferiprone |
| 1354 | Deferoxamine |
| 1355 | Defibrotide |
| 1356 | Degarelix |
| 1357 | Degraded Cephaloridine |
| 1358 | DEHYDRO-2(S)-AMINO-6-BORONOHEXANOIC ACID |
| 1359 | Dehydroepiandrosterone |
| 1360 | Delavirdine |
| 1361 | Delcasertib |
| 1362 | Delta1-dihydrotestosterone |
| 1363 | Delta-2-Albomycin A1 |
| 1364 | Delta-Amino Valeric Acid |
| 1365 | Delta-Bis(2,2'-Bipyridine)-(5-Methyl-2-2'-Bipyridine)-C2-Adamantane Ruthenium (Ii) |
| 1366 | Delta-Bis(2,2'-Bipyridine)-(5-Methyl-2-2'-Bipyridine)-C9-Adamantane Ruthenium (Ii) |
| 1367 | Delta-Bis(2,2'-Bipyridine)Imidazole Osmium (Ii) |
| 1368 | Delta-Bis(2,2'-Bipyridine)Imidazole Ruthenium (Ii) |
| 1369 | Demecarium |
| 1370 | Demeclocycline |
| 1371 | Denileukin diftitox |
| 1372 | Denosumab |
| 1373 | Denufosol |
| 1374 | Deoxy-2-Fluoro-B-D-Cellotrioside |
| 1375 | Deoxy-Bigchap |
| 1376 | Deoxycholic Acid |
| 1377 | deoxycytidylyl-3',5'-guanosine |
| 1378 | Deoxyguanidinoproclavaminic acid |
| 1379 | Deoxythymidine |
| 1380 | Deoxyuridine-5'-Diphosphate |
| 1381 | Deoxyuridine-5'-Triphosphate |
| 1382 | Dephospho Coenzyme A |
| 1383 | Dequadin |
| 1384 | Derenofylline |
| 1385 | D-Eritadenine |
| 1386 | DERIVATIVE OF AKLANONIC ACID METHYL ESTER (AAME) |
| 1387 | Descarboxy-nor-N(Omega)-Hydroxy-L-Arginine |
| 1388 | Deserpidine |
| 1389 | Desflurane |
| 1390 | Desipramine |
| 1391 | Desirudin |
| 1392 | Deslanoside |
| 1393 | Desloratadine |
| 1394 | Desmopressin |
| 1395 | Desmoteplase |
| 1396 | Desogestrel |
| 1397 | Desonide |
| 1398 | Desoximetasone |
| 1399 | Desoxycorticosterone Acetate |
| 1400 | Desoxycorticosterone Pivalate |
| 1401 | Desoxyribonuclease |
| 1402 | Desulfo-Coenzyme A |
| 1403 | Desvancosaminyl Vancomycin |
| 1404 | Desvenlafaxine |
| 1405 | Dexamethasone |
| 1406 | Dexamethasone Acetate |
| 1407 | Dexamethasone Phosphoric Acid |
| 1408 | Dexbrompheniramine |
| 1409 | Dexchlorpheniramine |
| 1410 | Dexfenfluramine |
| 1411 | Dexlansoprazole |
| 1412 | Dexloxiglumide |
| 1413 | Dexmecamylamine |
| 1414 | Dexmedetomidine |
| 1415 | Dexmethylphenidate |
| 1416 | Dexrazoxane |
| 1417 | Dextroamphetamine |
| 1418 | Dextrofloxacine |
| 1419 | Dextromethorphan |
| 1420 | Dextropropoxyphene |
| 1421 | Dextrothyroxine |
| 1422 | Dezocine |
| 1423 | D-Fructose-6-Phosphate (Open Form) |
| 1424 | DG031 |
| 1425 | DG051 |
| 1426 | D-Galctopyranosyl-1-On |
| 1427 | D-Gluco-2,5-Anhydro-1-Deoxy-1-Phosphonohexitol-6-Phosphate |
| 1428 | D-Gluconhydroximo-1,5-Lactam |
| 1429 | D-Glucose in Linear Form |
| 1430 | D-Glucuronic Acid |
| 1431 | D-Glutamic Acid |
| 1432 | D-Glutamine |
| 1433 | D-Glycero-D-Mannopyranose-7-Phosphate |
| 1434 | DHA-paclitaxel |
| 1435 | Di(N-Acetyl-D-Glucosamine) |
| 1436 | Diazepam |
| 1437 | Diazoxide |
| 1438 | Dibromothymoquinone |
| 1439 | Dibucaine |
| 1440 | Dichloroacetic Acid |
| 1441 | Dichlorphenamide |
| 1442 | Diclofenac |
| 1443 | Diclofenamide |
| 1444 | Diclosan |
| 1445 | Dicloxacillin |
| 1446 | Dicoumarol |
| 1447 | Dicumarol |
| 1448 | Dicyclomine |

TABLE 1-continued

Ligands

| Ligand No. | Ligand Name |
|---|---|
| 1449 | Didanosine |
| 1450 | Didecyl-Dimethyl-Ammonium |
| 1451 | Dienestrol |
| 1452 | Dienogest |
| 1453 | DIETHYL (1R,2S,3R,4S)-5,6-BIS(4-HYDROXYPHENYL)-7-OXABICYCLO[2.2.1]HEPT-5-ENE-2,3-DICARBOXYLATE |
| 1454 | diethyl [(1R)-1,5-diaminopentyl]boronate |
| 1455 | DIETHYL 4-METHOXYPHENYL PHOSPHATE |
| 1456 | Diethyl 4-Methylbenzylphosphonate |
| 1457 | DIETHYL PROPANE-1,3-DIYLBISCARBAMATE |
| 1458 | Diethylcarbamazine |
| 1459 | Diethylphosphono Group |
| 1460 | Diethylpropion |
| 1461 | Diethylstilbestrol |
| 1462 | Diethylstilbestrol Diphosphate |
| 1463 | Difenoxin |
| 1464 | Diflorasone |
| 1465 | Diflorasone Diacetate |
| 1466 | Diflunisal |
| 1467 | difluoro(5-{2-[(5-octyl-1H-pyrrol-2-yl-kappaN)methylidene]-2H-pyrrol-5-yl-kappaN}pentanoato)boron |
| 1468 | Difluoromethionine |
| 1469 | Difluprednate |
| 1470 | Digitoxin |
| 1471 | Digoxin |
| 1472 | Diguanosine-5'-Triphosphate |
| 1473 | Dihomo-gamma-linolenic acid |
| 1474 | Dihydrocodeine |
| 1475 | Dihydroergotamine |
| 1476 | Dihydrofolic Acid |
| 1477 | Dihydrogenphosphate Ion |
| 1478 | Dihydrolipoic Acid |
| 1479 | Dihydromorphine |
| 1480 | Dihydroorotic Acid |
| 1481 | Dihydroquinidine barbiturate |
| 1482 | Dihydrotachysterol |
| 1483 | Dihydrotestosterone |
| 1484 | Dihydroxyacetone |
| 1485 | Dihydroxyaluminium |
| 1486 | Diisopropylphosphono Group |
| 1487 | Di-Linoleoyl-3-Sn-Phosphatidylcholine |
| 1488 | Dilmapimod |
| 1489 | Diltiazem |
| 1490 | Dimenhydrinate |
| 1491 | Dimercaprol |
| 1492 | Dimetacrine |
| 1493 | dimethyl (1R,4S)-5,6-bis(4-hydroxyphenyl)-7-oxabicyclo[2.2.1]hepta-2,5-diene-2,3-dicarboxylate |
| 1494 | Dimethyl fumarate |
| 1495 | Dimethyl Propionate Ester Heme |
| 1496 | Dimethyl Sulfoxide |
| 1497 | DIMETHYL THIOPHOSPHATE |
| 1498 | DIMETHYL-(4,5,6,7-TETRABROMO-1H-BENZOIMIDAZOL-2-YL)-AMINE |
| 1499 | Dimethylallyl Diphosphate |
| 1500 | Dimethylallyl S-Thiolodiphosphate |
| 1501 | Dimethylformamide |
| 1502 | Dimethylglycine |
| 1503 | Dimethylthiambutene |
| 1504 | Dimethyltryptamine |
| 1505 | Dimetindene |
| 1506 | Diminazene |
| 1507 | Dinaciclib |
| 1508 | Dinitrophenylene |
| 1509 | Dinoprost |
| 1510 | Dinoprost Tromethamine |
| 1511 | Dinoprostone |
| 1512 | Dinor-N(Omega)-Hydroxy-L-Arginine |
| 1513 | Dinutuximab |
| 1514 | dioxothiomolybdenum(VI) ion |
| 1515 | Dioxyselenocysteine |
| 1516 | Diphemanil |
| 1517 | Diphemanil Methylsulfate |
| 1518 | Diphenhydramine |
| 1519 | Diphenidol |
| 1520 | Diphenoxylate |
| 1521 | Diphenylacetic Acid |
| 1522 | Diphenylpyraline |
| 1523 | Diphosphate |
| 1524 | Diphthamide |
| 1525 | Dipicolinic Acid |
| 1526 | Dipivefrin |
| 1527 | Dipraglurant |
| 1528 | Diprenorphine |
| 1529 | Dipyridamole |
| 1530 | Dipyrromethane Cofactor |
| 1531 | Dirithromycin |
| 1532 | Disopyramide |
| 1533 | Di-Stearoyl-3-Sn-Phosphatidylcholine |
| 1534 | Di-Stearoyl-3-Sn-Phosphatidylethanolamine |
| 1535 | Disulfiram |
| 1536 | Dithiane Diol |
| 1537 | Dithioerythritol |
| 1538 | Diureido-Acetate |
| 1539 | D-Lactic Acid |
| 1540 | D-leucyl-N-(3-chlorobenzyl)-L-prolinamide |
| 1541 | D-leucyl-N-(4-carbamimidoylbenzyl)-L-prolinamide |
| 1542 | D-Limonene 1,2-Epoxide |
| 1543 | D-Lysine |
| 1544 | D-Mannose 1-Phosphate |
| 1545 | D-Mannuronic Acid |
| 1546 | D-Methionine |
| 1547 | DMP450 |
| 1548 | D-Myo-Inositol-1,4,5-Triphosphate |
| 1549 | D-Myo-Inositol-1,4-Bisphosphate |
| 1550 | D-Myo-Inositol-2,4,5-Trisphosphate |
| 1551 | D-Myo-Inositol-Hexasulphate |
| 1552 | DN-101 |
| 1553 | D-Naphthyl-1-Acetamido Boronic Acid Alanine |
| 1554 | Dnk333 |
| 1555 | Dnqx |
| 1556 | Dobutamine |
| 1557 | Docetaxel |
| 1558 | Docosanol |
| 1559 | DODECANESULFONATE ION |
| 1560 | Dodecane-Trimethylamine |
| 1561 | Dodecyl Sulfate |
| 1562 | Dodecyl-Alpha-D-Maltoside |
| 1563 | Dodecyl-Coa |
| 1564 | Dofetilide |
| 1565 | Dolasetron |
| 1566 | Dolutegravir |
| 1567 | Domoic Acid |
| 1568 | Domperidone |
| 1569 | Donepezil |
| 1570 | Donitriptan |
| 1571 | Dopamine |
| 1572 | Doramapimod |
| 1573 | Doripenem |
| 1574 | Dorzolamide |
| 1575 | Double Oxidized Cysteine |
| 1576 | Dovitinib |
| 1577 | Doxacurium |
| 1578 | Doxacurium chloride |
| 1579 | Doxapram |
| 1580 | Doxazosin |
| 1581 | Doxepin |
| 1582 | Doxercalciferol |
| 1583 | Doxorubicin |
| 1584 | Doxycycline |
| 1585 | Doxylamine |
| 1586 | Dp001 |
| 1587 | D-Para-Chlorophenyl-1-Acetamidoboronic Acid Alanine |
| 1588 | D-Para-Chlorophenyl-1-Acteamidoboronic Acid Alanine |
| 1589 | Dpb-T |
| 1590 | D-Phenylalanine |

TABLE 1-continued

Ligands

| Ligand No. | Ligand Name |
|---|---|
| 1591 | D-phenylalanyl-N-(3-chlorobenzyl)-L-prolinamide |
| 1592 | D-phenylalanyl-N-(3-fluorobenzyl)-L-prolinamide |
| 1593 | D-phenylalanyl-N-(3-methylbenzyl)-L-prolinamide |
| 1594 | D-phenylalanyl-N-[(1S)-4-{[amino(iminio)methyl]amino}-1-(chloroacetyl)butyl]-L-prolinamide |
| 1595 | D-phenylalanyl-N-{4-[amino(iminio)methyl]benzyl}-L-prolinamide |
| 1596 | D-phenylalanyl-N-benzyl-L-prolinamide |
| 1597 | DPI59 |
| 1598 | D-Pyridoxyl-N,O-Cycloserylamide-5-Monophosphate |
| 1599 | Drf-10945 |
| 1600 | Drinabant |
| 1601 | Droloxifene |
| 1602 | Dromostanolone Propionate |
| 1603 | Dronabinol |
| 1604 | Dronedarone |
| 1605 | Droperidol |
| 1606 | Drospirenone |
| 1607 | Drostanolone |
| 1608 | Drotaverine |
| 1609 | Drotrecogin alfa |
| 1610 | Drotrecogin Alfa (Activated) |
| 1611 | Droxidopa |
| 1612 | Ds-3078a |
| 1613 | Ds-7423 |
| 1614 | D-Serine |
| 1615 | D-Sorbitol |
| 1616 | Dsp-2230 |
| 1617 | D-tartaric acid |
| 1618 | D-Threonine |
| 1619 | D-Treitol |
| 1620 | D-Tryptophan |
| 1621 | Dulaglutide |
| 1622 | Duloxetine |
| 1623 | Duroquinone |
| 1624 | Dutasteride |
| 1625 | Duvelisib |
| 1626 | Dwp05195 |
| 1627 | D-Xylitol |
| 1628 | D-Xylulose |
| 1629 | Dyclonine |
| 1630 | Dydrogesterone |
| 1631 | Dyphylline |
| 1632 | E2012 |
| 1633 | E-6201 |
| 1634 | E7389 |
| 1635 | EC145 |
| 1636 | Ecabet |
| 1637 | Ecallantide |
| 1638 | ECGONINE METHYL ESTER |
| 1639 | Echothiophate |
| 1640 | Econazole |
| 1641 | Eculizumab |
| 1642 | ED-71 |
| 1643 | Edetate Calcium Disodium |
| 1644 | Edetate Disodium |
| 1645 | Edotecarin |
| 1646 | Edoxaban |
| 1647 | Edrophonium |
| 1648 | Efalizumab |
| 1649 | Efatutazone |
| 1650 | Efavirenz |
| 1651 | Efinaconazole |
| 1652 | Eflornithine |
| 1653 | Egf816 |
| 1654 | Elacridar |
| 1655 | Elafin |
| 1656 | Elagolix |
| 1657 | Elaidoylamide |
| 1658 | Eletriptan |
| 1659 | Eliglustat |
| 1660 | Elinogrel |
| 1661 | Ellagic Acid |
| 1662 | Elocalcitol |
| 1663 | Elosulfase Alfa |
| 1664 | Elotuzumab |
| 1665 | Elsamitrucin |
| 1666 | Elsiglutide |
| 1667 | Eltrombopag |
| 1668 | Elubrixin |
| 1669 | Eluxadoline |
| 1670 | Elvitegravir |
| 1671 | Elzasonan |
| 1672 | EM-1745 |
| 1673 | Emd-1204831 |
| 1674 | Emedastine |
| 1675 | Emicerfont |
| 1676 | Empagliflozin |
| 1677 | Emtricitabine |
| 1678 | Enalapril |
| 1679 | Enalaprilat |
| 1680 | Enalkiren |
| 1681 | Encainide |
| 1682 | Encenicline |
| 1683 | Enclomiphene |
| 1684 | Encorafenib |
| 1685 | Enflurane |
| 1686 | Enfuvirtide |
| 1687 | Eniluracil |
| 1688 | Enmd-2076 |
| 1689 | Enmd-981693 |
| 1690 | Enobosarm |
| 1691 | Enoxacin |
| 1692 | Enoxaparin |
| 1693 | Enoxaparin Sodium |
| 1694 | Enoximone |
| 1695 | Enprofylline |
| 1696 | Enrasentan |
| 1697 | Entacapone |
| 1698 | Entecavir |
| 1699 | Entospletinib |
| 1700 | Enzalutamide |
| 1701 | Enzastaurin |
| 1702 | EP-2104R |
| 1703 | Epelsiban |
| 1704 | Ephedra |
| 1705 | Ephedrine |
| 1706 | EPIBATIDINE |
| 1707 | Epicept NP-1 |
| 1708 | Epinastine |
| 1709 | Epinephrine |
| 1710 | Epirubicin |
| 1711 | Epitinib |
| 1712 | Eplerenone |
| 1713 | Epoetin alfa |
| 1714 | Epoetin Zeta |
| 1715 | Epoprostenol |
| 1716 | Epothilone B |
| 1717 | Epothilone D |
| 1718 | Epratuzumab |
| 1719 | Eprosartan |
| 1720 | Eprotirome |
| 1721 | EPT1647 |
| 1722 | Eptifibatide |
| 1723 | Equilenin |
| 1724 | Equilin |
| 1725 | Equol |
| 1726 | ERA-923 |
| 1727 | Ergocalciferol |
| 1728 | Ergoloid |
| 1729 | Ergoloid mesylate |
| 1730 | Ergonovine |
| 1731 | Ergotamine |
| 1732 | Eribulin |
| 1733 | Erismodegib |
| 1734 | Eritoran |
| 1735 | Erlotinib |
| 1736 | Ertapenem |

TABLE 1-continued

Ligands

| Ligand No. | Ligand Name |
|---|---|
| 1737 | Erteberel |
| 1738 | Erythose-4-Phosphate |
| 1739 | Erythrityl Tetranitrate |
| 1740 | Erythromycin |
| 1741 | Erythromycin Estolate |
| 1742 | Erythromycin Ethylsuccinate |
| 1743 | Escitalopram |
| 1744 | Eslicarbazepine Acetate |
| 1745 | Esmirtazapine |
| 1746 | Esmolol |
| 1747 | Esomeprazole |
| 1748 | Estazolam |
| 1749 | Estradiol |
| 1750 | Estradiol Acetate |
| 1751 | Estradiol Cypionate |
| 1752 | Estradiol Valerate |
| 1753 | Estramustine |
| 1754 | Estramustine Phosphate |
| 1755 | Estriol |
| 1756 | Estrogens, Conjugated |
| 1757 | Estrogens, Conjugated Synthetic A |
| 1758 | Estrogens, Esterified |
| 1759 | Estrone |
| 1760 | Estrone Sulfuric Acid |
| 1761 | Estropipate |
| 1762 | Esuberaprost |
| 1763 | Eszopiclone |
| 1764 | Etalocib |
| 1765 | Etanercept |
| 1766 | Ethacrynic acid |
| 1767 | Ethambutol |
| 1768 | Ethanesulfonic Acid |
| 1769 | Ethanol |
| 1770 | Ethanolamine |
| 1771 | Ethanolamine Oleate |
| 1772 | Ethchlorvynol |
| 1773 | Etheno-Nad |
| 1774 | Etheno-Nadp |
| 1775 | Ethinamate |
| 1776 | Ethinyl Estradiol |
| 1777 | Ethionamide |
| 1778 | Ethopropazine |
| 1779 | Ethosuximide |
| 1780 | Ethotoin |
| 1781 | Ethoxzolamide |
| 1782 | ETHYL (1E)-2-PHENYL-N-(SULFOOXY)ETHANIMIDOTHIOATE |
| 1783 | ethyl 3-[(E)-2-amino-1-cyanoethenyl]-6,7-dichloro-1-methyl-1H-indole-2-carboxylate |
| 1784 | ETHYL 3-[4-(AMINOSULFONYL)PHENYL]PROPANOATE |
| 1785 | ETHYL 4-[(4-CHLOROPYRIDIN-2-YL)AMINO]PIPERIDINE-1-CARBOXYLATE |
| 1786 | ETHYL 4-[(4-METHYLPYRIDIN-2-YL)AMINO]PIPERIDINE-1-CARBOXYLATE |
| 1787 | Ethyl Dihydrogen Phosphate |
| 1788 | ETHYL HYDROGEN DIETHYLAMIDOPHOSPHATE |
| 1789 | Ethyl Isocyanide |
| 1790 | Ethyl Oxo(Piperidin-1-Yl)Acetate |
| 1791 | Ethylaminobenzylmethylcarbonyl Group |
| 1792 | Ethyl-Carbamic Acid Methyl Ester |
| 1793 | Ethylene Dichloride |
| 1794 | Ethylestrenol |
| 1795 | Ethylisothiourea |
| 1796 | Ethylmorphine |
| 1797 | Ethyl-Trimethyl-Silane |
| 1798 | Ethynodiol |
| 1799 | Ethynodiol Diacetate |
| 1800 | Etidocaine |
| 1801 | Etidronic acid |
| 1802 | Etilevodopa |
| 1803 | Etodolac |
| 1804 | Etomidate |
| 1805 | Etonogestrel |
| 1806 | Etoposide |
| 1807 | Etoposide Phosphate |
| 1808 | Etoricoxib |
| 1809 | Etorphine |
| 1810 | Etravirine |
| 1811 | Etretinate |
| 1812 | Everolimus |
| 1813 | Evodenoson |
| 1814 | Evolocumab |
| 1815 | Evt-101 |
| 1816 | Exemestane |
| 1817 | Exenatide |
| 1818 | Ezetimibe |
| 1819 | Ezlopitant |
| 1820 | Ezogabine |
| 1821 | Factor IIIm |
| 1822 | Fadolmidine |
| 1823 | Falnidamol |
| 1824 | Famciclovir |
| 1825 | Famitinib |
| 1826 | Famotidine |
| 1827 | FAMOXADONE |
| 1828 | Farglitazar |
| 1829 | Farletuzumab |
| 1830 | Farnesol |
| 1831 | FARNESYL DIPHOSPHATE |
| 1832 | FARNESYL THIOPYROPHOSPHATE |
| 1833 | faropenem medoxomil |
| 1834 | Fasitibant |
| 1835 | Favld |
| 1836 | Faxeladol |
| 1837 | Fe 202767 |
| 1838 | Febuxostat |
| 1839 | Fedratinib |
| 1840 | Felbamate |
| 1841 | Felodipine |
| 1842 | Felypressin |
| 1843 | Fencamfamine |
| 1844 | Fenfluramine |
| 1845 | Fenofibrate |
| 1846 | Fenofibric Acid |
| 1847 | Fenoldopam |
| 1848 | Fenoprofen |
| 1849 | Fenoterol |
| 1850 | Fentanyl |
| 1851 | Ferric Citrate |
| 1852 | Ferricrocin-Iron |
| 1853 | Feruloyl Coenzyme A |
| 1854 | Ferumoxytol |
| 1855 | Fesoterodine |
| 1856 | Fevipiprant |
| 1857 | Fexaramine |
| 1858 | Fexofenadine |
| 1859 | FG-4592 |
| 1860 | Fgf401 |
| 1861 | Fibrinolysin, Human |
| 1862 | Fica |
| 1863 | Fidarestat |
| 1864 | Fidarestat(Stereoisomer) |
| 1865 | Fidaxomicin |
| 1866 | Figopitant |
| 1867 | Filaminast |
| 1868 | Filgotinib |
| 1869 | Filgrastim |
| 1870 | Finafloxacin |
| 1871 | Finasteride |
| 1872 | Finerenone |
| 1873 | Fingolimod |
| 1874 | Firocoxib |
| 1875 | Fispemifene |
| 1876 | Fk453 |
| 1877 | FKB-001 |
| 1878 | Flavin adenine dinucleotide |
| 1879 | Flavin-Adenine Dinucleotide-N5-Isobutyl Ketone |

TABLE 1-continued

Ligands

| Ligand No. | Ligand Name |
|---|---|
| 1880 | Flavin-N7 Protonated-Adenine Dinucleotide |
| 1881 | Flavopiridol |
| 1882 | Flavoxate |
| 1883 | Flecainide |
| 1884 | Fleroxacin |
| 1885 | Flibanserin |
| 1886 | Flindokalner |
| 1887 | F-Loop of Vitamin B12 |
| 1888 | Floxuridine |
| 1889 | Flucioxacillin |
| 1890 | Fluconazole |
| 1891 | Flucytosine |
| 1892 | Fludarabine |
| 1893 | Fludarabine Phosphate |
| 1894 | Fludiazepam |
| 1895 | Fludrocortisone |
| 1896 | Fludrocortisone Acetate |
| 1897 | Flufenamic Acid |
| 1898 | Flumatinib |
| 1899 | Flumazenil |
| 1900 | Flumethasone Pivalate |
| 1901 | Flunarizine |
| 1902 | Flunisolide |
| 1903 | Flunitrazepam |
| 1904 | Fluocinolone Acetonide |
| 1905 | Fluocinonide |
| 1906 | Fluorescein |
| 1907 | FLUORESCIN |
| 1908 | Fluorometholone |
| 1909 | Fluorometholone Acetate |
| 1910 | Fluoro-Phosphite Ion |
| 1911 | Fluorotryptophane |
| 1912 | Fluorouracil |
| 1913 | Fluoro-Willardiine |
| 1914 | Fluoxetine |
| 1915 | Fluoxymesterone |
| 1916 | Flupentixol |
| 1917 | Fluphenazine |
| 1918 | Fluphenazine Decanoate |
| 1919 | Fluphenazine Enanthate |
| 1920 | Flupirtine |
| 1921 | Fluprednisolone |
| 1922 | Flurandrenolide |
| 1923 | Flurazepam |
| 1924 | Flurbiprofen |
| 1925 | Flurbiprofen Methyl Ester |
| 1926 | Fluspirilene |
| 1927 | Flutamide |
| 1928 | Fluticasone furoate |
| 1929 | Fluticasone Propionate |
| 1930 | Fluvastatin |
| 1931 | Fluvoxamine |
| 1932 | FM-VP4 |
| 1933 | Folic Acid |
| 1934 | Follitropin beta |
| 1935 | Fomepizole |
| 1936 | Fomivirsen Sodium |
| 1937 | Fondaparinux |
| 1938 | Fondaparinux sodium |
| 1939 | Fontolizumab |
| 1940 | Forasartan |
| 1941 | Foretinib |
| 1942 | Formaldehyde |
| 1943 | Formic Acid |
| 1944 | Formic Acid Benzyl Ester |
| 1945 | Formoterol |
| 1946 | Formycin |
| 1947 | Formycin B |
| 1948 | Formycin-5'-Monophosphate |
| 1949 | Forskolin |
| 1950 | Fosamprenavir |
| 1951 | Fosaprepitant |
| 1952 | Foscarnet |
| 1953 | Fosdagrocorat |
| 1954 | Fosfomycin |
| 1955 | Fosinopril |
| 1956 | Fosmidomycin |
| 1957 | Fosphenytoin |
| 1958 | Fospropofol |
| 1959 | Fostamatinib |
| 1960 | Fotemustine |
| 1961 | FR117016 |
| 1962 | FR221647 |
| 1963 | FR230513 |
| 1964 | FR233623 |
| 1965 | FR236913 |
| 1966 | FR239087 |
| 1967 | Frakefamide |
| 1968 | Framycetin |
| 1969 | Frovatriptan |
| 1970 | Fructose |
| 1971 | Fructose-6-Phosphate |
| 1972 | Fructose-1,6-Diphosphate |
| 1973 | Fructose-6-Phosphate |
| 1974 | Fruquintinib |
| 1975 | Fucitol |
| 1976 | Fudp |
| 1977 | Fulvestrant |
| 1978 | Fumagillin |
| 1979 | Fumarate |
| 1980 | Furazolidone |
| 1981 | Furo[2,3d]Pyrimidine Antifolate |
| 1982 | Furosemide |
| 1983 | Furoyl-Leucine |
| 1984 | Fusicoccin |
| 1985 | Fusidic Acid |
| 1986 | Fx-005 |
| 1987 | FX06 |
| 1988 | G1t28-1 |
| 1989 | G418 |
| 1990 | Gabaculine |
| 1991 | Gabapentin |
| 1992 | Gabapentin Enacarbil |
| 1993 | Gadopentetate dimeglumine |
| 1994 | Gadoxetic Acid |
| 1995 | GALACTOSE GREASE |
| 1996 | Galantamine |
| 1997 | Galeterone |
| 1998 | Galiximab |
| 1999 | Gallamine |
| 2000 | Gallamine Triethiodide |
| 2001 | Gallichrome |
| 2002 | gallium maltolate |
| 2003 | Gallium nitrate |
| 2004 | Galsulfase |
| 2005 | Galunisertib |
| 2006 | Gamma Hydroxybutyric Acid |
| 2007 | Gamma(Amino)-Butyric Acid |
| 2008 | Gamma-Arsono-Beta, Gamma-Methyleneadenosine-5'-Diphosphate |
| 2009 | Gamma-Carboxy-Glutamic Acid |
| 2010 | Gamma-Glutamyl[S-(2-Iodobenzyl)Cysteinyl]Glycine |
| 2011 | Gamma-Glutamylcysteine |
| 2012 | Gamma-Phenyl-Butyric Acid |
| 2013 | Ganaxolone |
| 2014 | Ganciclovir |
| 2015 | Gandotinib |
| 2016 | Ganirelix |
| 2017 | Ganirelix Acetate |
| 2018 | Gatifloxacin |
| 2019 | Gavestinel |
| 2020 | GC-24 |
| 2021 | Gdc-0810 |
| 2022 | Gdc-0994 |
| 2023 | Ge2270a |
| 2024 | Gedatolisib |
| 2025 | Gefitinib |
| 2026 | Geldanamycin |

TABLE 1-continued

Ligands

| Ligand No. | Ligand Name |
|---|---|
| 2027 | GEM-231 |
| 2028 | Gemcitabine |
| 2029 | Gemfibrozil |
| 2030 | Gemifloxacin |
| 2031 | Gemtuzumab ozogamicin |
| 2032 | Genistein |
| 2033 | Gentamicin |
| 2034 | GENTAMICIN C1A |
| 2035 | Genz-10850 |
| 2036 | Genz-112638 |
| 2037 | Geranyl Diphosphate |
| 2038 | GERANYLGERANYL DIPHOSPHATE |
| 2039 | GFT505 |
| 2040 | Ghavamiol |
| 2041 | GIBBERELLIN A3 |
| 2042 | GIBBERELLIN A4 |
| 2043 | Gilteritinib |
| 2044 | *Ginkgo biloba* |
| 2045 | Ginseng |
| 2046 | Glasdegib |
| 2047 | Glatiramer Acetate |
| 2048 | Gliclazide |
| 2049 | Glimepiride |
| 2050 | Glipizide |
| 2051 | Gliquidone |
| 2052 | Glisoxepide |
| 2053 | Glpg-0259 |
| 2054 | Glpg0492 |
| 2055 | Glpg-0555 |
| 2056 | Glpg-0778 |
| 2057 | Glucagon |
| 2058 | Glucagon Hydrochloride |
| 2059 | Glucagon Hydrochloride Recombinant |
| 2060 | Glucagon recombinant |
| 2061 | Glucarate |
| 2062 | Glucarpidase |
| 2063 | Gluconic Acid |
| 2064 | Gluconolactone |
| 2065 | Glucosamine |
| 2066 | Glucosamine 1-Phosphate |
| 2067 | Glucosamine 4-Phosphate |
| 2068 | Glucosamine 6-Phosphate |
| 2069 | Glucosaminyl-(Alpha-6)-D-Myo-Inositol |
| 2070 | Glucose-6-Phosphate |
| 2071 | Glucose-Uridine-C1,5'-Diphosphate |
| 2072 | Glutamine Hydroxamate |
| 2073 | Glutamine t-butyl ester |
| 2074 | Glutaric Acid |
| 2075 | Glutathione |
| 2076 | Glutathione S-(2,4 Dinitrobenzene) |
| 2077 | GLUTATHIONE SULFINATE |
| 2078 | Glutathione Sulfonic Acid |
| 2079 | Glutathionylspermidine Disulfide |
| 2080 | Glutethimide |
| 2081 | Glyburide |
| 2082 | Glyceraldehyde-3-Phosphate |
| 2083 | Glycerol |
| 2084 | Glycerol Phenylbutyrate |
| 2085 | Glycerol-2-Phosphate |
| 2086 | Glycerylphosphorylcholine |
| 2087 | Glycinamid |
| 2088 | Glycinamide Ribonucleotide |
| 2089 | Glycine |
| 2090 | Glycochenodeoxycholic Acid |
| 2091 | Glycodiazine |
| 2092 | Glycoluril |
| 2093 | Glycopyrrolate |
| 2094 | GLYCYLALANYL-N-2-NAPHTHYL-L-PROLINEAMIDE |
| 2095 | Glycyl-L-a-Aminopimelyl-E-(D-2-Aminoethyl)Phosphonate |
| 2096 | Glycyl-L-Alpha-Amino-Epsilon-Pimelyl-D-Alanine |
| 2097 | Glycyl-L-Alpha-Amino-Epsilon-Pimelyl-D-Alanyl-D-Alanine |
| 2098 | Glyoxalate, Glyoxylate |
| 2099 | Glyphosate |
| 2100 | GM6001 |
| 2101 | GMX1777 |
| 2102 | golimumab |
| 2103 | Golvatinib |
| 2104 | Gonadorelin |
| 2105 | Gonadotropin, Chorionic |
| 2106 | Goserelin |
| 2107 | Gpi-1046 |
| 2108 | GPI-1485 |
| 2109 | Gramicidin |
| 2110 | Granisetron |
| 2111 | Grc-6211 |
| 2112 | Grepafloxacin |
| 2113 | Griseofulvin |
| 2114 | Grn1631 |
| 2115 | Gs 6201 |
| 2116 | Gs-4997 |
| 2117 | Gs-9667 |
| 2118 | GSHNA |
| 2119 | Gsk-1059615 |
| 2120 | Gsk-1070916 |
| 2121 | Gsk1482160 |
| 2122 | Gsk159802 |
| 2123 | Gsk163090 |
| 2124 | Gsk189254 |
| 2125 | Gsk-2256098 |
| 2126 | Gsk-2269557 |
| 2127 | Gsk239512 |
| 2128 | Gsk-2636771 |
| 2129 | Gsk2849466 |
| 2130 | Gsk2881078 |
| 2131 | Gsk-461364 |
| 2132 | Gsk-610677 |
| 2133 | Gsk-690693 |
| 2134 | GSK716155 |
| 2135 | GSK-923295 |
| 2136 | GTI 2040 |
| 2137 | GTS-21 |
| 2138 | Gtx-758 |
| 2139 | Guaifenesin |
| 2140 | Guanabenz |
| 2141 | Guanadrel |
| 2142 | Guanethidine |
| 2143 | Guanfacine |
| 2144 | Guanidine |
| 2145 | Guanidine-3-Propanol |
| 2146 | Guanidinoethylmercaptosuccinic acid |
| 2147 | Guanine |
| 2148 | Guanosine |
| 2149 | Guanosine 5'-(Trihydrogen Diphosphate), P'-D-Mannopyranosyl Ester |
| 2150 | Guanosine 5'-Diphosphate 2':3'-Cyclic Monophosphate |
| 2151 | Guanosine-2',3'-Cyclophosphorothioate |
| 2152 | GUANOSINE-2',3'-O-ETHYLIDENEPHOSPHONATE |
| 2153 | GUANOSINE-2',3'-O-METHYLIDENEPHOSPHONATE |
| 2154 | Guanosine-2'-Monophosphate |
| 2155 | Guanosine-3'-Monophosphate |
| 2156 | Guanosine-3'-Monophosphate-5'-Diphosphate |
| 2157 | Guanosine-5',3'-Tetraphosphate |
| 2158 | Guanosine-5'-Diphosphate |
| 2159 | Guanosine-5'-Diphosphate-Rhamnose |
| 2160 | Guanosine-5'-Monophosphate |
| 2161 | Guanosine-5'-Triphosphate |
| 2162 | Guvacine |
| 2163 | GV1001 |
| 2164 | GW 468816 |
| 2165 | GW 597599 |
| 2166 | Gw468816 |
| 2167 | Gw493838 |
| 2168 | Gw590735 |
| 2169 | Gw842166x |
| 2170 | H TYPE I TRISACCHARIDE |
| 2171 | H TYPE II TRISACCHARIDE |
| 2172 | Hadacidin |
| 2173 | Halazepam |

TABLE 1-continued

Ligands

| Ligand No. | Ligand Name |
|---|---|
| 2174 | Halcinonide |
| 2175 | Halobetasol Propionate |
| 2176 | Halofantrine |
| 2177 | Halofuginone |
| 2178 | Haloperidol |
| 2179 | Haloperidol Decanoate |
| 2180 | Haloprogin |
| 2181 | Halothane |
| 2182 | HE2000 |
| 2183 | He3235 |
| 2184 | HE3286 |
| 2185 | Hemay-022 |
| 2186 | Heme C |
| 2187 | Heme D |
| 2188 | Hemi-Babim |
| 2189 | Hemin |
| 2190 | Henatinib |
| 2191 | Heparin |
| 2192 | Heparin Calcium |
| 2193 | Heparin Disaccharide Iii-S |
| 2194 | Heparin Disaccharide I-S |
| 2195 | Heparin Sodium |
| 2196 | Hepatitis B immune globulin |
| 2197 | Heptabarbital |
| 2198 | Heptamolybdate |
| 2199 | Heptanamide |
| 2200 | Heptane-1,2,3-Triol |
| 2201 | HeptanoicAcid |
| 2202 | Heptulose-2-Phosphate |
| 2203 | Heptyl 1-Thiohexopyranoside |
| 2204 | Heptyl-Beta-D-Glucopyranoside |
| 2205 | Heroin |
| 2206 | Hesperetin |
| 2207 | HESPERIDIN |
| 2208 | Hetacillin |
| 2209 | Hexachlorophene |
| 2210 | Hexadecanal |
| 2211 | Hexadecyl Octanoate |
| 2212 | Hexafluorenium |
| 2213 | Hexafluronium |
| 2214 | Hexane-1,6-Diol |
| 2215 | Hexanoyl-Coenzyme A |
| 2216 | Hexatantalum Dodecabromide |
| 2217 | Hexobarbital |
| 2218 | Hexocyclium |
| 2219 | Hexylcaine |
| 2220 | HEXYLPHOSPHONIC ACID (R)-2-METHYL-3-PHENYLPROPYL ESTER |
| 2221 | HEXYLPHOSPHONIC ACID (S)-2-METHYL-3-PHENYLPROPYL ESTER |
| 2222 | Hg9a-9, Nonanoyl-N-Hydroxyethylglucamide |
| 2223 | HGS-TR2J |
| 2224 | Hirulog |
| 2225 | Histamine |
| 2226 | histamine dihydrochloride |
| 2227 | Histamine Phosphate |
| 2228 | Histidinol |
| 2229 | Histidyl-Adenosine Monophosphate |
| 2230 | Histrelin |
| 2231 | Hm-61713 |
| 2232 | Hm-71224 |
| 2233 | Hmn-214 |
| 2234 | HMPL-004 |
| 2235 | Hmpl-523 |
| 2236 | Homatropine Methylbromide |
| 2237 | Homoharringtonine |
| 2238 | HOMOPHENYLALANINYLMETHANE |
| 2239 | Homoserine Lactone |
| 2240 | HONH-BENZYLMALONYL-L-ALANYLGLYCINE-P-NITROANILIDE |
| 2241 | HspE7 |
| 2242 | Human Dnase-1 |
| 2243 | Human Fsh |
| 2244 | Human Interleukin-2 |
| 2245 | Human Lh |
| 2246 | Human Serum Albumin |
| 2247 | humanized SMART Anti-IL-12 Antibody |
| 2248 | HuMax-EGFr |
| 2249 | Huperaine A |
| 2250 | Huperzine A |
| 2251 | Huperzine B |
| 2252 | Huperzine-A |
| 2253 | HY10275 |
| 2254 | Hyaluronic acid |
| 2255 | Hyaluronidase |
| 2256 | Hyaluronidase (Human Recombinant) |
| 2257 | Hybrid Between B and C Type Hemes (Protoporphyrin Ixcontaining Fe) |
| 2258 | Hydantocidin-5'-Phosphate |
| 2259 | Hydralazine |
| 2260 | Hydrochlorothiazide |
| 2261 | Hydrocodone |
| 2262 | Hydrocortamate |
| 2263 | Hydrocortisone |
| 2264 | Hydrocortisone Acetate |
| 2265 | Hydrocortisone Butyrate |
| 2266 | Hydrocortisone Cypionate |
| 2267 | Hydrocortisone Hemisuccinate |
| 2268 | Hydrocortisone Phosphoric Acid |
| 2269 | Hydrocortisone Probutate |
| 2270 | Hydrocortisone Valerate |
| 2271 | Hydroflumethiazide |
| 2272 | Hydrogenobyrinic Acid |
| 2273 | Hydrolyzed Cephalothin |
| 2274 | Hydromorphone |
| 2275 | Hydroxocobalamin |
| 2276 | HYDROXY(OXO)(3-{[(2Z)-4-[3-(1H-1,2,4-TRIAZOL-1-YLMETHYL)PHENYL]PYRIMIDIN-2(5H)-YLIDENE]AMINO}PHENYL)AMMONIUM |
| 2277 | HYDROXY[3-(6-METHYLPYRIDIN-2-YL)PROPYL]FORMAMIDE |
| 2278 | Hydroxyacetic Acid |
| 2279 | Hydroxyaminovaline |
| 2280 | Hydroxyamphetamine |
| 2281 | Hydroxychloroquine |
| 2282 | Hydroxydimethylarsine Oxide |
| 2283 | Hydroxyethylcysteine |
| 2284 | HYDROXYFASUDIL |
| 2285 | Hydroxyphenyl Propionic Acid |
| 2286 | Hydroxy-Phenyl-Acetic Acid 8-Methyl-8-Aza-Bicyclo[3.2.1]Oct-3-Yl Ester |
| 2287 | Hydroxyprogesterone Caproate |
| 2288 | Hydroxystilbamidine |
| 2289 | Hydroxyurea |
| 2290 | Hydroxyzine |
| 2291 | Hymenialdisine |
| 2292 | Hyodeoxycholic_Acid |
| 2293 | Hyoscyamine |
| 2294 | Hyperforin |
| 2295 | Hypophosphite |
| 2296 | Hypoxanthine |
| 2297 | HZT-501 |
| 2298 | I-5 |
| 2299 | Ibandronate |
| 2300 | Ibandronic Acid |
| 2301 | Ibipinabant |
| 2302 | Ib-Meca |
| 2303 | Ibodutant |
| 2304 | Ibritumomab |
| 2305 | Ibrutinib |
| 2306 | Ibudilast |
| 2307 | Ibuprofen |
| 2308 | Ibutilide |
| 2309 | IC261 |
| 2310 | ICA-105665 |
| 2311 | Icatibant |
| 2312 | iCo-007 |
| 2313 | Icosapent |

TABLE 1-continued

Ligands

| Ligand No. | Ligand Name |
|---|---|
| 2314 | Icosapent Ethyl |
| 2315 | Idalopirdine |
| 2316 | Idarubicin |
| 2317 | Idarucizumab |
| 2318 | IDD552 |
| 2319 | IDD594 |
| 2320 | Idelalisib |
| 2321 | IDN-6556 |
| 2322 | Idoxifene |
| 2323 | Idoxuridine |
| 2324 | Idursulfase |
| 2325 | Ifenprodil |
| 2326 | Iferanserin |
| 2327 | Ifosfamide |
| 2328 | IGN311 |
| 2329 | Iloperidone |
| 2330 | Iloprost |
| 2331 | Ilorasertib |
| 2332 | Ilx23-7553 |
| 2333 | Imatinib |
| 2334 | IMC-11F8 |
| 2335 | IMC-1C11 |
| 2336 | IMC-A12 |
| 2337 | Imd-0354 |
| 2338 | Imd-1041 |
| 2339 | Imd-2560 |
| 2340 | Imexon |
| 2341 | IMIDAZO[2,1-A]ISOQUINOLINE-2-CARBOHYDRAZIDE |
| 2342 | Imidazole-Derived Cellobiose |
| 2343 | IMIDAZOPYRIDAZIN 1 |
| 2344 | Imiglitazar |
| 2345 | Imiglucerase |
| 2346 | Imino-Tryptophan |
| 2347 | Imipenem |
| 2348 | Imipramine |
| 2349 | Imiquimod |
| 2350 | Immucillin-G |
| 2351 | Implitapide |
| 2352 | Inamrinone |
| 2353 | Incb-039110 |
| 2354 | Incb-040093 |
| 2355 | Incb-047986 |
| 2356 | INCB13739 |
| 2357 | INCB3284 |
| 2358 | Incb-39110 |
| 2359 | Incb-40093 |
| 2360 | Incb-47986 |
| 2361 | INCB7839 |
| 2362 | INCB9471 |
| 2363 | Incb-9471 |
| 2364 | Incobotulinumtoxina |
| 2365 | Indacaterol |
| 2366 | indane-5-sulfonamide |
| 2367 | Indapamide |
| 2368 | Indecainide |
| 2369 | Indeglitazar |
| 2370 | Indinavir |
| 2371 | Indirubin Sulfate |
| 2372 | Indirubin-3'-Monoxime |
| 2373 | Indirubin-5-Sulphonate |
| 2374 | Indole |
| 2375 | Indole Naphthyridinone |
| 2376 | Indole-3-Glycerol Phosphate |
| 2377 | Indole-3-Propanol Phosphate |
| 2378 | Indolylpropionic Acid |
| 2379 | Indomethacin |
| 2380 | Inecalcitol |
| 2381 | Infigratinib |
| 2382 | Infliximab |
| 2383 | ING-1 |
| 2384 | Ingenol Mebutate |
| 2385 | inhaled insulin |
| 2386 | Inhibitor Bea322 |
| 2387 | Inhibitor BEA369 |
| 2388 | Inhibitor Bea388 |
| 2389 | Inhibitor Bea403 |
| 2390 | Inhibitor Bea409 |
| 2391 | Inhibitor Bea425 |
| 2392 | Inhibitor Bea428 |
| 2393 | Inhibitor Idd 384 |
| 2394 | Inhibitor Msa367 |
| 2395 | Inhibitor of P38 Kinase |
| 2396 | INHIBITOR Q8467 OF DUPONT MERCK |
| 2397 | Ink-1117 |
| 2398 | Ink-128 |
| 2399 | Inosine |
| 2400 | InosinicAcid |
| 2401 | Inositol 1,3,4,5-Tetrakisphosphate |
| 2402 | Inositol 1,3-Bisphosphate |
| 2403 | Inositol-(1,3,4,5,6)-Pentakisphosphate |
| 2404 | INS 316 |
| 2405 | INSM-18 |
| 2406 | Insulin Aspart |
| 2407 | Insulin Aspart Protamine Recombinant |
| 2408 | Insulin Degludec |
| 2409 | Insulin Detemir |
| 2410 | Insulin Glargine |
| 2411 | Insulin Glulisine |
| 2412 | Insulin Human |
| 2413 | Insulin Lispro |
| 2414 | Insulin Lispro Protamine Recombinant |
| 2415 | Insulin Pork |
| 2416 | Insulin Purified Beef |
| 2417 | Insulin Purified Pork |
| 2418 | Insulin Regular |
| 2419 | Insulin Susp Isophane Beef |
| 2420 | Insulin Susp Isophane Beef/Pork |
| 2421 | Insulin Susp Isophane Purified Beef |
| 2422 | Insulin Susp Isophane Purified Pork |
| 2423 | Insulin Susp Isophane Recombinant Human |
| 2424 | Insulin Susp Isophane Semisynthetic Purified Human |
| 2425 | Insulin Susp Protamine Zinc Beef/Pork |
| 2426 | Insulin Susp Protamine Zinc Purified Beef |
| 2427 | Insulin Susp Protamine Zinc Purified Pork |
| 2428 | Insulin Zinc Susp Beef |
| 2429 | Insulin Zinc Susp Extended Beef |
| 2430 | Insulin Zinc Susp Extended Purified Beef |
| 2431 | Insulin Zinc Susp Extended Recombinant Human |
| 2432 | Insulin Zinc Susp Prompt Beef |
| 2433 | Insulin Zinc Susp Prompt Purified Pork |
| 2434 | Insulin Zinc Susp Purified Beef |
| 2435 | Insulin Zinc Susp Purified Beef/Pork |
| 2436 | Insulin Zinc Susp Purified Pork |
| 2437 | Insulin Zinc Susp Recombinant Human |
| 2438 | Insulin Zinc Susp Semisynthetic Purified Human |
| 2439 | Insulin, isophane |
| 2440 | Insulin, porcine |
| 2441 | Int131 |
| 2442 | Interferon Alfa-2a |
| 2443 | Interferon Alfa-2a, Recombinant |
| 2444 | Interferon Alfa-2b |
| 2445 | Interferon Alfa-2b, Recombinant |
| 2446 | Interferon alfacon-1 |
| 2447 | Interferon alfa-n1 |
| 2448 | Interferon alfa-n3 |
| 2449 | Interferon beta-1a |
| 2450 | Interferon beta-1b |
| 2451 | Interferon Gama-1b |
| 2452 | Interferon gamma-1b |
| 2453 | intranasal apomorphine |
| 2454 | Intravenous Immunoglobulin |
| 2455 | Inulin |
| 2456 | Iodophenyl |
| 2457 | Iodo-Phenylalanine |
| 2458 | Iodo-Willardiine |
| 2459 | Ipafricept |
| 2460 | Ipatasertib |
| 2461 | Ipilimumab |

TABLE 1-continued

Ligands

| Ligand No. | Ligand Name |
|---|---|
| 2462 | Ipratropium |
| 2463 | Ipratropium bromide |
| 2464 | Irbesartan |
| 2465 | Irbinitinib |
| 2466 | Irdabisant |
| 2467 | Irinotecan |
| 2468 | Iron Dextran |
| 2469 | Irx-4204 |
| 2470 | Irx4310 |
| 2471 | ISA247 |
| 2472 | Isatin |
| 2473 | Isatoic Anhydride |
| 2474 | Isatoribine |
| 2475 | Isavuconazonium |
| 2476 | ISIS 113715 |
| 2477 | ISO24 |
| 2478 | Isobutyric Acid |
| 2479 | Isocarboxazid |
| 2480 | Isochorismic Acid |
| 2481 | Isocitrate Calcium Complex |
| 2482 | Isocitric Acid |
| 2483 | Isoetarine |
| 2484 | Isoetharine |
| 2485 | Isoflurane |
| 2486 | Isoflurophate |
| 2487 | Isometheptene |
| 2488 | Isoniazid |
| 2489 | ISOPENTENYL PYROPHOSPHATE |
| 2490 | Isopentyl Pyrophosphate |
| 2491 | Isoprenaline |
| 2492 | Isopropamide |
| 2493 | ISOPROPYL (2S)-2-ETHYL-7-FLUORO-3-OXO-3,4-DIHYDROQUINOXALINE-1(2H)-CARBOXYLATE |
| 2494 | Isopropyl Alcohol |
| 2495 | Isoproterenol |
| 2496 | ISOQUINOLINE-5-SULFONIC ACID (2-(2-(4-CHLOROBENZYLOXY)ETHYLAMINO)ETHYL)AMIDE |
| 2497 | Isosorbide |
| 2498 | Isosorbide Dinitrate |
| 2499 | Isosorbide Mononitrate |
| 2500 | ISOTHIAZOLIDINONE ANALOG |
| 2501 | Isothipendyl |
| 2502 | Isotretinoin |
| 2503 | Isovaleric Acid |
| 2504 | Ispronicline |
| 2505 | Isradipine |
| 2506 | ISS-1018 |
| 2507 | ITI-007 |
| 2508 | ITMN-191 |
| 2509 | Itopride |
| 2510 | Itraconazole |
| 2511 | Itriglumide |
| 2512 | Ivabradine |
| 2513 | Ivacaftor |
| 2514 | Ivermectin |
| 2515 | Ixabepilone |
| 2516 | Ixazomib Citrate |
| 2517 | Jaspisamide A |
| 2518 | Je-2147, Ag1776, Kni-764 |
| 2519 | Ji-101 |
| 2520 | Jnj-17216498 |
| 2521 | Jnj-26483327 |
| 2522 | Jnj-38877605 |
| 2523 | Jnj-39393406 |
| 2524 | Jnj-40346527 |
| 2525 | Jnj-42756493 |
| 2526 | Josamycin |
| 2527 | Jte-151 |
| 2528 | Jts-653 |
| 2529 | K201 |
| 2530 | K-252a |
| 2531 | K-877 |
| 2532 | Kabiramide C |
| 2533 | Kaempherol |
| 2534 | KAI-1455 |
| 2535 | Kanamycin |
| 2536 | KB001 |
| 2537 | KB002 |
| 2538 | KB2115 |
| 2539 | KC706 |
| 2540 | Kc-706 |
| 2541 | KD3010 |
| 2542 | KD7040 |
| 2543 | Ketamine |
| 2544 | Ketazolam |
| 2545 | Ketobemidone |
| 2546 | Ketoconazole |
| 2547 | Ketoprofen |
| 2548 | ketoprofen transdermal patch |
| 2549 | Ketorolac |
| 2550 | Ketotifen |
| 2551 | keyhole limpet hemocyanin |
| 2552 | Kifunensine |
| 2553 | Klh-2109 |
| 2554 | Krn-633 |
| 2555 | KRP-104 |
| 2556 | Krp203 |
| 2557 | Kw-2449 |
| 2558 | Kw-2450 |
| 2559 | KW-3902 |
| 2560 | Kx2-391 |
| 2561 | L-[(N-Hydroxyamino)Carbonyl]Phenylalanine |
| 2562 | L-1-(4-CHLOROPHENYL)-2-(ACETAMIDO)ETHANE BORONIC ACID |
| 2563 | L-1-NAPHTHYL-2-ACETAMIDO-ETHANE BORONIC ACID |
| 2564 | L-21649 |
| 2565 | L-2-amino-3-butynoic acid |
| 2566 | L-2-Amino-4-(Guanidinooxy)Butyric Acid |
| 2567 | L-2-Amino-4-Methoxy-Cis-but-3-Enoic Acid |
| 2568 | L-2-Amino-6-Methylene-Pimelic Acid |
| 2569 | L-709,587 |
| 2570 | L-756,423 |
| 2571 | Labetalol |
| 2572 | Labetuzumab |
| 2573 | Labradimil |
| 2574 | Lacosamide |
| 2575 | Lactic Acid |
| 2576 | Lactitol |
| 2577 | Lactose |
| 2578 | Lactose Sialic Acid |
| 2579 | Lactulose |
| 2580 | Ladarixin |
| 2581 | Laevulinic Acid |
| 2582 | L-Alanine |
| 2583 | L-alanyl-N-[(1S,2R)-1-benzyl-2-hydroxypropyl]-L-alaninamide |
| 2584 | L-Alpha-Glycerophospho-D-Myo-Inositol-4,5-Bis-Phosphate |
| 2585 | L-Alpha-Glycerophosphorylethanolamine |
| 2586 | L-Alpha-Glycerophosphorylserine |
| 2587 | Lambda-Bis(2,2'-Bipyridine)-(5-Methyl-2-2'-Bipyridine)-C9-Adamantane Ruthenium (Ii) |
| 2588 | Lambda-Bis(2,2'-Bipyridine)Imidazole Osmium (Ii) |
| 2589 | Lambda-Bis(2,2'-Bipyridine)Imidazole Ruthenium (Ii) |
| 2590 | Lamivudine |
| 2591 | Lamotrigine |
| 2592 | Lanicemine |
| 2593 | Lanosterol |
| 2594 | Lanreotide |
| 2595 | Lansoprazole |
| 2596 | Lanthanum Carbonate |
| 2597 | Lapatinib |
| 2598 | Lapyrium |
| 2599 | L-Arginine |
| 2600 | Laronidase |
| 2601 | Laropiprant |
| 2602 | Las101057 |
| 2603 | Las190792 |

TABLE 1-continued

Ligands

| Ligand No. | Ligand Name |
|---|---|
| 2604 | Lasmiditan |
| 2605 | L-Asparagine |
| 2606 | L-Aspartic Acid |
| 2607 | Latamoxef |
| 2608 | Latanoprost |
| 2609 | Latanoprostene Bunod |
| 2610 | Latrunculin A |
| 2611 | LATRUNCULIN B |
| 2612 | Lauryl Dimethylamine-N-Oxide |
| 2613 | LAX-101 |
| 2614 | L-BENZYLSUCCINIC ACID |
| 2615 | L-Carnitine |
| 2616 | L-Citrulline |
| 2617 | L-Cysteine |
| 2618 | L-CYSTEIN-S-1-(IMINOMETHYL)-L-ORNITHINE |
| 2619 | L-Cystine |
| 2620 | Lecozotan |
| 2621 | Ledipasvir |
| 2622 | Leflunomide |
| 2623 | Lefradafiban |
| 2624 | Lemborexant |
| 2625 | Lenalidomide |
| 2626 | Lenvatinib |
| 2627 | Leo-15520 |
| 2628 | Lepirudin |
| 2629 | Leptin |
| 2630 | Leq506 |
| 2631 | LErafAON |
| 2632 | Lercanidipine |
| 2633 | Lesinurad |
| 2634 | LE-SN38 |
| 2635 | Lesogaberan |
| 2636 | Lesopitron |
| 2637 | Lestaurtinib |
| 2638 | Letrozole |
| 2639 | Leucine - Reduced Carbonyl |
| 2640 | Leucine Phosphonic Acid |
| 2641 | Leucovorin |
| 2642 | Leuprolide |
| 2643 | Levallorphan |
| 2644 | Levamisole |
| 2645 | Levetiracetam |
| 2646 | Levobetaxolol |
| 2647 | Levobunolol |
| 2648 | Levobupivacaine |
| 2649 | Levocabastine |
| 2650 | Levocetirizine |
| 2651 | Levodopa |
| 2652 | Levofloxacin |
| 2653 | Levoleucovorin |
| 2654 | Levomefolic Acid |
| 2655 | Levomepromazine |
| 2656 | Levomethadyl Acetate |
| 2657 | Levomilnacipran |
| 2658 | Levonordefrin |
| 2659 | Levonorgestrel |
| 2660 | Levopropoxyphene |
| 2661 | Levorphanol |
| 2662 | Levosalbutamol |
| 2663 | Levosimendan |
| 2664 | Levothyroxine |
| 2665 | LFA703 |
| 2666 | LGD-1550 |
| 2667 | LGD2941 |
| 2668 | Lgd-2941 |
| 2669 | Lgh-447 |
| 2670 | L-Glucuronic Acid |
| 2671 | L-Glutamic Acid |
| 2672 | L-Glutamine |
| 2673 | L-Glycero-D-Manno-Heptopyranose |
| 2674 | L-Guluronic Acid 6-Phosphate |
| 2675 | Lgx-806 |
| 2676 | L-Histidine |
| 2677 | L-Histidine Beta Naphthylamide |
| 2678 | L-Homoarginine |
| 2679 | LI-301 |
| 2680 | Licofelone |
| 2681 | Lidocaine |
| 2682 | lidocaine patch |
| 2683 | L-Iduronic Acid |
| 2684 | Linaclotide |
| 2685 | Linagliptin |
| 2686 | Lincomycin |
| 2687 | Lindane |
| 2688 | Linezolid |
| 2689 | Linifanib |
| 2690 | Linsitinib |
| 2691 | Lintitript |
| 2692 | Liothyronine |
| 2693 | Liotrix |
| 2694 | Lipase |
| 2695 | Lipoic Acid |
| 2696 | liposomal prostaglandin E1 |
| 2697 | Liraglutide |
| 2698 | Lisdexamfetamine |
| 2699 | Lisinopril |
| 2700 | L-Iso-Aspartate |
| 2701 | L-Isoleucine |
| 2702 | Lisuride |
| 2703 | Lithium |
| 2704 | Lithium Carbonate |
| 2705 | Lithium Citrate |
| 2706 | Lixivaptan |
| 2707 | LJP 1082 |
| 2708 | L-Leucine |
| 2709 | L-Leucyl-Hydroxylamine |
| 2710 | LLL-3348 |
| 2711 | L-Lysine |
| 2712 | LM-609 |
| 2713 | L-Methionine |
| 2714 | L-Myo-Inositol-1-Phosphate |
| 2715 | L-N(Omega)-Nitroarginine-(4r)-Amino-L-Proline Amide |
| 2716 | L-N(Omega)-Nitroarginine-2,4-L-Diaminobutyric Amide |
| 2717 | L-Naphthyl-1-Acetamido Boronic Acid Alanine |
| 2718 | Lobeline |
| 2719 | Lodoxamide |
| 2720 | Lofexidine |
| 2721 | Lomefloxacin |
| 2722 | Lomitapide |
| 2723 | Lomustine |
| 2724 | Lonaprisan |
| 2725 | Loperamide |
| 2726 | Lopinavir |
| 2727 | Loracarbef |
| 2728 | Loratadine |
| 2729 | Lorazepam |
| 2730 | Lorcaserin |
| 2731 | L-Ornithine |
| 2732 | Lornoxicam |
| 2733 | Losartan |
| 2734 | Losmapimod |
| 2735 | Loteprednol |
| 2736 | Loteprednol Etabonate |
| 2737 | Lovastatin |
| 2738 | Loxapine |
| 2739 | Loxo-101 |
| 2740 | Lpc-Ether |
| 2741 | L-Phenylalanine |
| 2742 | L-Phospholactate |
| 2743 | L-Proline |
| 2744 | L-PROLINE, 1-[(2S)-3-MERCAPTO-2-METHYL-1-OXOPROPYL]-4-(PHENYLTHIO)-, 4S |
| 2745 | L-Pyridoxyl-N,O-Cycloserylamide-5-Monophosphate |
| 2746 | L-Rhamnitol |
| 2747 | L-Rhamnose |
| 2748 | Ls-104 |
| 2749 | L-Serine |
| 2750 | L-Thiocitrulline |

TABLE 1-continued

Ligands

| Ligand No. | Ligand Name |
|---|---|
| 2751 | L-Threonine |
| 2752 | L-Threonohydroxamate 4-Phosphate |
| 2753 | L-Tryptophan |
| 2754 | L-Tryptophanamide |
| 2755 | L-Tyrosinamide |
| 2756 | L-Tyrosine |
| 2757 | Lubiprostone |
| 2758 | Lucanthone |
| 2759 | Lucinactant |
| 2760 | Lucitanib |
| 2761 | Luliconazole |
| 2762 | Lumacaftor |
| 2763 | Lumefantrine |
| 2764 | Lumiracoxib |
| 2765 | Lunacalcipol |
| 2766 | Lurasidone |
| 2767 | Lutropin alfa |
| 2768 | L-Valine |
| 2769 | LX1031 |
| 2770 | Lxr-623 |
| 2771 | L-Xylitol 5-Phosphate |
| 2772 | L-Xylopyranose |
| 2773 | L-Xylulose 5-Phosphate |
| 2774 | Ly-2090314 |
| 2775 | LY2140023 |
| 2776 | LY2181308 |
| 2777 | Ly2245461 |
| 2778 | LY2275796 |
| 2779 | Ly231514 Tetra Glu |
| 2780 | Ly2409021 |
| 2781 | Ly2452473 |
| 2782 | LY249543 |
| 2783 | Ly-2584702 |
| 2784 | Ly2590443 |
| 2785 | Ly-2606368 |
| 2786 | Ly2623091 |
| 2787 | Ly2624803 |
| 2788 | Ly-2780301 |
| 2789 | Ly2828360 |
| 2790 | Ly-2874455 |
| 2791 | Ly2881835 |
| 2792 | Ly2940094 |
| 2793 | Ly2969822 |
| 2794 | Ly2979165 |
| 2795 | Ly-3007113 |
| 2796 | Ly-3009120 |
| 2797 | Ly-3023414 |
| 2798 | LY341770 |
| 2799 | LY374571 |
| 2800 | Ly377604 |
| 2801 | Ly404039 |
| 2802 | LY-517717 |
| 2803 | Ly-518674 |
| 2804 | Ly545694 |
| 2805 | Lymecycline |
| 2806 | Lypressin |
| 2807 | Lysergic Acid Diethylamide |
| 2808 | Lysine Nz-Carboxylic Acid |
| 2809 | Lysophosphotidylserine |
| 2810 | M-(N,N,N-Trimethylammonio)-2,2,2-Trifluoro-1,1-Dihydroxyethylbenzene |
| 2811 | M0002 |
| 2812 | Macimorelin |
| 2813 | MACITENTAN |
| 2814 | Mafenide |
| 2815 | Magnesium |
| 2816 | Magnesium salicylate |
| 2817 | Magnesium Sulfate |
| 2818 | Magnesium Sulfate Anhydrous |
| 2819 | Malachite Green |
| 2820 | Malate Ion |
| 2821 | Malate Like Intermediate |
| 2822 | Malathion |
| 2823 | Maleic Acid |
| 2824 | Malonaldehyde |
| 2825 | Malonate Ion |
| 2826 | Malonic acid |
| 2827 | Malonyl-Coenzyme A |
| 2828 | Maltose |
| 2829 | Maltosyl-Alpha (1,4)-D-Gluconhydroximo-1,5-Lactam |
| 2830 | Maltotetraose |
| 2831 | M-Aminophenylboronic Acid |
| 2832 | Mant-Adp |
| 2833 | MAP-0004 |
| 2834 | Mapracorat |
| 2835 | Maprotiline |
| 2836 | Maraviroc |
| 2837 | Marimastat |
| 2838 | Masitinib |
| 2839 | Masoprocol |
| 2840 | Matairesinol |
| 2841 | Matuzumab |
| 2842 | Mavoglurant |
| 2843 | Mazindol |
| 2844 | MB07803 |
| 2845 | MB07811 |
| 2846 | Mbx-2044 |
| 2847 | Mbx-8025 |
| 2848 | MCC |
| 2849 | M-Cresol |
| 2850 | Mdl 101,146 |
| 2851 | Mdl-29951 |
| 2852 | MDV3100 |
| 2853 | MDX-018 |
| 2854 | Me-344 |
| 2855 | Me-401 |
| 2856 | Mebendazole |
| 2857 | Mebutamate |
| 2858 | Mecamylamine |
| 2859 | Mecasermin |
| 2860 | Mecasermin Rinfabate |
| 2861 | Mechlorethamine |
| 2862 | Meclizine |
| 2863 | Meclocycline Sulfosalicylate |
| 2864 | Meclofenamic acid |
| 2865 | Medroxyprogesterone Acetate |
| 2866 | Medrysone |
| 2867 | Mefenamic acid |
| 2868 | Mefloquine |
| 2869 | Megestrol acetate |
| 2870 | Melatonin |
| 2871 | Meloxicam |
| 2872 | Melphalan |
| 2873 | MEM 1414 |
| 2874 | Memantine |
| 2875 | Menadione |
| 2876 | Menotropins |
| 2877 | Menthol |
| 2878 | Mepenzolate |
| 2879 | Meperidine |
| 2880 | Mephentermine |
| 2881 | Mephenytoin |
| 2882 | Mepivacaine |
| 2883 | Mepolizumab |
| 2884 | Meprednisone |
| 2885 | Meprobamate |
| 2886 | Mepyramine |
| 2887 | Mequinol |
| 2888 | Mequitazine |
| 2889 | Mercaptocarboxylate Inhibitor |
| 2890 | Mercaptomethyl Phosphonate |
| 2891 | Mercaptopurine |
| 2892 | Mercuribenzoic Acid |
| 2893 | Mercury Diiodide |
| 2894 | Merestinib |
| 2895 | Merethoxylline Procaine |
| 2896 | Merimepodib |
| 2897 | Meropenem |

TABLE 1-continued

Ligands

| Ligand No. | Ligand Name |
|---|---|
| 2898 | Mersalyl |
| 2899 | Mesalamine |
| 2900 | Mesalazine |
| 2901 | Mesobiliverdin Iv Alpha |
| 2902 | Meso-Erythritol |
| 2903 | Mesoridazine |
| 2904 | Mestranol |
| 2905 | Meta Vanadate |
| 2906 | Metamizole |
| 2907 | Metanitrophenyl-Alpha-D-Galactoside |
| 2908 | Meta-Nitro-Tyrosine |
| 2909 | Metaproterenol |
| 2910 | Metaraminol |
| 2911 | Meta-Tyrosine |
| 2912 | Metaxalone |
| 2913 | Metformin |
| 2914 | Methacholine |
| 2915 | Methacrylyl-Coenzyme A |
| 2916 | Methacycline |
| 2917 | Methadone |
| 2918 | Methadyl Acetate |
| 2919 | Methamphetamine |
| 2920 | Methantheline |
| 2921 | Metharbital |
| 2922 | Methazolamide |
| 2923 | Methdilazine |
| 2924 | Methenamine |
| 2925 | Methicillin |
| 2926 | Methicillin Acyl-Serine |
| 2927 | Methimazole |
| 2928 | Methionine Phosphinate |
| 2929 | Methionine Phosphonate |
| 2930 | Methionine Sulfoxide |
| 2931 | Methixene |
| 2932 | Methocarbamol |
| 2933 | Methohexital |
| 2934 | Methotrexate |
| 2935 | Methotrimeprazine |
| 2936 | Methoxamine |
| 2937 | Methoxsalen |
| 2938 | Methoxy arachidonyl fluorophosphonate |
| 2939 | Methoxyflurane |
| 2940 | METHOXYUNDECYLPHOSPHINIC ACID |
| 2941 | Methscopolamine |
| 2942 | Methsuximide |
| 2943 | Methyclothiazide |
| 2944 | methyl (1R,2S)-2-(hydroxycarbamoyl)-1-{4-[(2-methylquinolin-4-yl)methoxy]benzyl}cyclopropanecarboxylate |
| 2945 | METHYL (2Z)-2-(2-{[6-(2-CYANOPHENOXY)PYRIMIDIN-4-YL]OXY}PHENYL)-3-METHOXYACRYLATE |
| 2946 | METHYL (2Z)-3-METHOXY-2-{2-[(E)-2-PHENYLVINYL]PHENYL}ACRYLATE |
| 2947 | METHYL (3R)-3-{[(3R)-3-HYDROXYBUTANOYL]OXY}BUTANOYL]OXY}BUTANOATE |
| 2948 | methyl (3S)-3-[(tert-butoxycarbonyl)amino]-4-oxopentanoate |
| 2949 | methyl [(1E,5R)-5-{(3S)-3-[(2E,4E)-2,5-dimethylocta-2,4-dienoyl]-2,4-dioxo-3,4-dihydro-2H-pyran-6-yl}hexylidene]carbamate |
| 2950 | METHYL 1-(4-{[(2,4-DIAMINOPTERIDIN-6-YL)METHYL](METHYL)AMINO}BENZOYL)PIPERIDINE-4-CARBOXYLATE |
| 2951 | METHYL 1-(4-{[(2,4-DIAMINOPTERIDIN-6-YL)METHYL]AMINO}BENZOYL)PIPERIDINE-4-CARBOXYLATE |
| 2952 | METHYL 3-CHLORO-2-{3-[(2,5-DIHYDROXY-4-METHOXYPHENYL)AMINO]-3-OXOPROPYL}-4,6-DIHYDROXYBENZOATE |
| 2953 | methyl 4-(2,3-dihydroxy-5-methylphenoxy)-2-hydroxy-6-methylbenzoate |
| 2954 | Methyl 4,6-O-[(1r)-1-Carboxyethylidene]-Beta-D-Galactopyranoside |
| 2955 | METHYL 4-{[({[(2R,5S)-5-{[(2S)-2-(AMINOMETHYL)PYRROLIDIN-1-YL]CARBONYL}PYRROLIDIN-2-YL]METHYL}AMINO)CARBONYL]AMINO}BENZOATE |
| 2956 | methyl 4-bromo-N-[8-(hydroxyamino)-8-oxooctanoyl]-L-phenylalaninate |
| 2957 | Methyl alpha-D-mannoside |
| 2958 | Methyl aminolevulinate |
| 2959 | Methyl Isocyanide |
| 2960 | methyl L-phenylalaninate |
| 2961 | Methyl Methylsulfinylmethyl Sulfide |
| 2962 | METHYL N-({(2S,3S)-3-[(PROPYLAMINO)CARBONYL]OXIRAN-2-YL}CARBONYL)-L-ISOLEUCYL-L-PROLINATE |
| 2963 | METHYL N-[(2S,3R)-3-AMINO-2-HYDROXY-3-(4-ISOPROPYLPHENYL)PROPANOYL]-D-ALANYL-D-LEUCINATE |
| 2964 | METHYL N-[(2S,3R)-3-AMINO-2-HYDROXY-3-(4-METHYLPHENYL)PROPANOYL]-D-ALANYL-D-LEUCINATE |
| 2965 | Methyl Nonanoate (Ester) |
| 2966 | Methyl Salicylate |
| 2967 | METHYL(2-ACETOXY-2-(2-CARBOXY-4-AMINO-PHENYL))ACETATE |
| 2968 | Methyl(6s)-1-Thio-L-Manno-Hexodialdo-6,2-Pyranoside |
| 2969 | Methyl-[4-(4-Piperidine-1-Ylmethyl-Phenyl)-Cyclohexyl]-Carbaminic Acid-(4-Chlorophenyl)-Ester |
| 2970 | Methyl-2-S-(Alpha-D-Mannopyranosyl)-2-Thio-Alpha-D-Mannopyranoside |
| 2971 | Methylamine |
| 2972 | METHYLAMINO-PHENYLALANYL-LEUCYL-HYDROXAMIC ACID |
| 2973 | Methyl-Carbamic Acid Ethyl Ester |
| 2974 | Methyldopa |
| 2975 | Methyldopate |
| 2976 | Methylergometrine |
| 2977 | Methylergonovine |
| 2978 | Methylethylamine |
| 2979 | Methylhomatropine |
| 2980 | Methylhydrazine |
| 2981 | Methylmalonic Acid |
| 2982 | Methylmalonyl-Coenzyme A |
| 2983 | Methylnaltrexone |
| 2984 | Methylphenidate |
| 2985 | Methylphenobarbital |
| 2986 | Methylphenyl carbinol |
| 2987 | METHYL-PHE-PRO-AMINO-CYCLOHEXYLGLYCINE |
| 2988 | Methylphosphinic Acid |
| 2989 | Methylphosphonic Acid Diisopropyl Ester |
| 2990 | Methylphosphonic Acid Ester Group |
| 2991 | METHYL-PHOSPHONIC ACID MONO-(4-NITRO-PHENYL) ESTER |
| 2992 | Methylprednisolone |
| 2993 | Methylprednisolone Hemisuccinate |
| 2994 | Methylpromazine |
| 2995 | Methylsamidorphan |
| 2996 | Methylscopolamine bromide |
| 2997 | Methyltestosterone |
| 2998 | Methylthioinosine |
| 2999 | Methyltrienolone |
| 3000 | Methylumbelliferyl Chitotriose |
| 3001 | Methylumbelliferyl Sialic Acid |
| 3002 | Methyprylon |
| 3003 | Methysergide |
| 3004 | Metiamide |
| 3005 | Meticillin |
| 3006 | Metipranolol |
| 3007 | Metixene |
| 3008 | Metoclopramide |
| 3009 | Metocurine |
| 3010 | Metocurine Iodide |

TABLE 1-continued

Ligands

| Ligand No. | Ligand Name |
|---|---|
| 3011 | Metolazone |
| 3012 | METOPRINE, METHODICHLOROPHEN |
| 3013 | Metoprolol |
| 3014 | Metreleptin |
| 3015 | Metronidazole |
| 3016 | Metyrapone |
| 3017 | Metyrosine |
| 3018 | Mevastatin |
| 3019 | Mexiletine |
| 3020 | Mezlocillin |
| 3021 | MF101 |
| 3022 | MF268 |
| 3023 | MGCD-0103 |
| 3024 | Mgcd-265 |
| 3025 | MGl-114 |
| 3026 | Mgl-3196 |
| 3027 | Mianserin |
| 3028 | Mibefradil |
| 3029 | Micafungin |
| 3030 | Miconazole |
| 3031 | Midazolam |
| 3032 | Midodrine |
| 3033 | Midostaurin |
| 3034 | Mifepristone |
| 3035 | Migalastat |
| 3036 | Miglitol |
| 3037 | Miglustat |
| 3038 | Milciclib |
| 3039 | Milnacipran |
| 3040 | Milrinone |
| 3041 | Miltefosine |
| 3042 | Milveterol |
| 3043 | Mimosine |
| 3044 | Minaprine |
| 3045 | Minocycline |
| 3046 | Minopafant |
| 3047 | Minoxidil |
| 3048 | Mipomersen |
| 3049 | Mirabegron |
| 3050 | Mirtazapine |
| 3051 | Misoprostol |
| 3052 | Mitiglinide |
| 3053 | Mito-4509 |
| 3054 | Mitomycin |
| 3055 | Mitotane |
| 3056 | Mitoxantrone |
| 3057 | MIV-701 |
| 3058 | Mivacurium |
| 3059 | Mixed Carbamic Phosphoric Acid Anhydride of 7,8-Diaminononanic Acid |
| 3060 | Mk-0249 |
| 3061 | Mk-0533 |
| 3062 | Mk0686 |
| 3063 | Mk-0773 |
| 3064 | Mk-0893 |
| 3065 | MK-0974 |
| 3066 | Mk-1029 |
| 3067 | Mk-1496 |
| 3068 | Mk-2201 |
| 3069 | Mk-2206 |
| 3070 | Mk-2461 |
| 3071 | Mk3207 |
| 3072 | Mk-5108 |
| 3073 | Mk-6592 |
| 3074 | Mk-6913 |
| 3075 | Mk-7246 |
| 3076 | Mk-8033 |
| 3077 | Mk-8353 |
| 3078 | MK-8931 |
| 3079 | Mln-0128 |
| 3080 | MLN-02 |
| 3081 | MLN0415 |
| 3082 | Mln-0415 |
| 3083 | Mln-1117 |
| 3084 | MLN-1202 |
| 3085 | Mln-2480 |
| 3086 | Mln3126 |
| 3087 | MLN-518 |
| 3088 | Mln-8054 |
| 3089 | MLN8237 |
| 3090 | MLN-977 |
| 3091 | MMDA |
| 3092 | MMI-175 |
| 3093 | MN-305 |
| 3094 | Mo(Vi)(=O)(Oh)2 Cluster |
| 3095 | Moclobemide |
| 3096 | Modafinil |
| 3097 | Modified Acarbose Pentasaccharide |
| 3098 | Modified Ribosylated Glutamyl Ester |
| 3099 | Modimelanotide |
| 3100 | Moexipril |
| 3101 | Mofarotene |
| 3102 | molecular iodine |
| 3103 | Molindone |
| 3104 | Molybdenum Cofactor |
| 3105 | Momelotinib |
| 3106 | Mometasone |
| 3107 | Mometasone Furoate |
| 3108 | Monastrol |
| 3109 | Mono-[3,4-Dihydroxy-5-(5-Methyl-Benzoimidazol-1-Yl)-Tetrahydor-Furan-2-Ylmethyl] Ester |
| 3110 | Monobenzone |
| 3111 | Monoctanoin |
| 3112 | MONOGALACTOSYL-DIACYLGLYCEROL |
| 3113 | Monoisopropyl Ester Phosphonic Acid Group |
| 3114 | Monoisopropylphosphorylserine |
| 3115 | Monothioglycerol |
| 3116 | Montelukast |
| 3117 | Moricizine |
| 3118 | Morphine |
| 3119 | Morpholine-4-Carboxylic Acid (1-(3-Benzenesulfonyl-1-Phenethylallylcarbamoyl)-3-Methylbutyl)-Amide |
| 3120 | Morpholine-4-Carboxylic Acid [1-(2-Benzylsulfany 1-1-Formyl-Ethylcarbamoyl)-2-Phenyl-Ethyl]-Amide |
| 3121 | Morpholine-4-Carboxylic Acid [1s-(2-Benzyloxy-1r-Cyano-Ethylcarbamoyl)-3-Methyl-Butyl]Amide |
| 3122 | Motesanib |
| 3123 | motexafin gadolinium |
| 3124 | Motuporin |
| 3125 | Moxalactam |
| 3126 | MOXALACTAM (HYDROLYZED) |
| 3127 | Moxalactam Derivative |
| 3128 | Moxifloxacin |
| 3129 | Moxonidine |
| 3130 | Mp-412 |
| 3131 | MP470 |
| 3132 | MPC-7869 |
| 3133 | MPI-674 |
| 3134 | Msc-2363318a |
| 3135 | Msc-2364447 |
| 3136 | Msx-122 |
| 3137 | Mt-3995 |
| 3138 | MT-Immucillin-H |
| 3139 | Mubritinib |
| 3140 | Mupirocin |
| 3141 | Muraglitazar |
| 3142 | Muromonab |
| 3143 | Muromonab-Cd3 |
| 3144 | Mycophenolate mofetil |
| 3145 | Mycophenolic acid |
| 3146 | MYO-029 |
| 3147 | Myo-Inositol |
| 3148 | Myricetin |
| 3149 | MYRISTIC ACID |
| 3150 | Myristoyl-Coa |
| 3151 | Myxopyronin B |
| 3152 | Myxothiazol |

TABLE 1-continued

Ligands

| Ligand No. | Ligand Name |
|---|---|
| 3153 | N-((1R,2R)-2-(5-CHLORO-1H-INDOLE-2-CARBOXAMIDO)CYCLOHEXYL)-5-METHYL-4,5,6,7-TETRAHYDROTHIAZOLO[5,4-C]PYRIDINE-2-CARBOXAMIDE |
| 3154 | N-((1R,2S)-2-(5-CHLORO-1H-INDOLE-2-CARBOXAMIDO)CYCLOHEXYL)-5-METHYL-4,5,6,7-TETRAHYDROTHIAZOLO[5,4-C]PYRIDINE-2-CARBOXAMIDE |
| 3155 | N'-((2S,3R)-3-AMINO-2-HYDROXY-5-(ISOPROPYLSULFANYL)PENTANOYL)-N-3-CHLOROBENZOYL HYDRAZIDE |
| 3156 | N-({(1R)-1-carboxy-2-[(4-fluorobenzyl)sulfanyl]ethyl}carbamoyl)-L-glutamic acid |
| 3157 | N-({(2S)-1-[(3R)-3-AMINO-4-(2-FLUOROPHENYL)BUTANOYL]PYRROLIDIN-2-YL}METHYL)BENZAMIDE |
| 3158 | N-({(2S)-1-[(3R)-3-amino-4-(3-chlorophenyl)butanoyl]pyrrolidin-2-yl}methyl)-3-(methylsulfonyl)benzamide |
| 3159 | N-({(2S,3S)-3-[(BENZYLAMINO)CARBONYL]OXIRAN-2-YL}CARBONYL)-L-ISOLEUCYL-L-PROLINE |
| 3160 | N-({(3R,4R)-4-[(benzyloxy)methyl]pyrrolidin-3-yl}methyl)-N-(2-methylpropyl)benzenesulfonamide |
| 3161 | N-({[4-(AMINOSULFONYL)PHENYL]AMINO}CARBONYL)-4-METHYLBENZENESULFONAMIDE |
| 3162 | N-({4-[(2-aminopyridin-4-yl)oxy]-3-fluorophenyl}carbamoyl)-2-(4-fluorophenyl)acetamide |
| 3163 | N-({6-[(4-CYANO-2-FLUOROBENZYL)OXY]NAPHTHALEN-2-YL}SULFONYL)-D-GLUTAMIC ACID |
| 3164 | N-({6-[(4-CYANOBENZYL)OXY]NAPHTHALEN-2-YL}SULFONYL)-D-GLUTAMIC ACID |
| 3165 | N-(1,4-DIHYDRO-5H-TETRAZOL-5-YLIDENE)-9-OXO-9H-XANTHENE-2-SULFONAMIDE |
| 3166 | N-(1-Adamantyl)-N'-(4-Guanidinobenzyl)Urea |
| 3167 | N-(1-BENZYL-3,3,3-TRIFLUORO-2,2-DIHYDROXY-PROPYL)-ACETAMIDE |
| 3168 | N-(1-Benzyl-3-{[3-(1,3-Dioxo-1,3-Dihydro-Isoindol-2-Yl)-Propionyl]-[2-(Hexahydro-Benzo[1,3]Dioxol-5-Yl)-Ethyl]-Amino}-2-Hydroxy-Propyl)-4-Benzyloxy-3,5-Dimethoxy-Benzamide |
| 3169 | N-(1-benzylpiperidin-4-yl)-4-sulfanylbutanamide |
| 3170 | N-(1-Carboxy-3-Phenylpropyl)Phenylalanyl-Alpha-Asparagine |
| 3171 | N-(1-CYANOCYCLOPROPYL)-3-({[(2S)-5-OXOPYRROLIDIN-2-YL]METHYL}SULFONYL)-N~2~-[(1S)-2,2,2-TRIFLUORO-1-(4-FLUOROPHENYL)ETHYL]-L-ALANINAMIDE |
| 3172 | N-(1-ISOPROPYLPIPERIDIN-4-YL)-1-(3-METHOXYBENZYL)-1H-INDOLE-2-CARBOXAMIDE |
| 3173 | N-(1-PHENYL-PROPYL)-FORMAMIDE |
| 3174 | N-(2-(((5-CHLORO-2-PYRIDINYL)AMINO)SULFONYL)PHENYL)-4-(2-OXO-1(2H)-PYRIDINYL)BENZAMIDE |
| 3175 | N-(2,2,2-TRIFLUOROETHYL)-N-{4-[2,2,2-TRIFLUORO-1-HYDROXY-1-(TRIFLUOROMETHYL)ETHYL]PHENYL}BENZENESULFONAMIDE |
| 3176 | N-(2,3,4,5,6-Pentaflouro-Benzyl)-4-Sulfamoyl-Benzamide |
| 3177 | N-(2,3-DIFLUORO-BENZYL)-4-SULFAMOYL-BENZAMIDE |
| 3178 | N-(2,6-Diflouro-Benzyl)-4-Sulfamoyl-Benzamide |
| 3179 | N-(2,6-dimethylphenyl)-5-phenylimidazo[1,5-a]pyrazin-8-amine |
| 3180 | N-(2-Acetamido)Iminodiacetic Acid |
| 3181 | N-(2-AMINOETHYL)-2-{3-CHLORO-4-[(4-ISOPROPYLBENZYL)OXY]PHENYL} ACETAMIDE |
| 3182 | N-(2-Aminoethyl)-5-Chloroisoquinoline-8-Sulfonamide |
| 3183 | N-(2-AMINOETHYL)-N-2-{(1S)-1-[4'-(AMINOSULFONYL)BIPHENYL-4-YL]-2,2,2-TRIFLUOROETHYL}-L-LEUCINAMIDE |
| 3184 | N-(2-AMINOETHYL)-P-CHLOROBENZAMIDE |
| 3185 | N-(2-CHLORO-4-FLUOROBENZOYL)-N'-(5-HYDROXY-2-METHOXYPHENYL)UREA |
| 3186 | N-(2-chloro-6-methylphenyl)-8-[(3S)-3-methylpiperazin-1-yl]imidazo[1,5-a]quinoxalin-4-amine |
| 3187 | N-(2-chlorophenyl)-5-phenylimidazo[1,5-a]pyrazin-8-amine |
| 3188 | N-(2-Ferrocenylethyl)Maleimide |
| 3189 | N-[2-Flouro-Benzyl)-4-Sulfamoyl-Benzamide |
| 3190 | N-(2-hydroxy-1,1-dimethylethyl)-1-methyl-3-(1H-pyrrolo[2,3-b]pyridin-2-yl)-1H-indole-5-carboxamide |
| 3191 | N-(2-METHOXYETHYL)-4-({4-[2-METHYL-1-(1-METHYLETHYL)-1H-IMIDAZOL-5-YL]PYRIMIDIN-2-YL}AMINO)BENZENESULFONAMIDE |
| 3192 | N-(2-Morpholin-4-Yl-1-Morptiolin-4-Ylmethyl-Ethyl)-3-Nitro-5-(3,4,5-Trihydroxy-6-Hydroxymethyl-Tetrahydro-Pyran-2-Yloxy)-Benzamide |
| 3193 | N-(2-OXOTETRAHYDROFURAN-3-YL)OCTANAMIDE |
| 3194 | N'-(2s,3r)-3-Amino-4-Cyclohexyl-2-Hydroxy-Butano-N-(4-Methylphenyl)Hydrazide |
| 3195 | N-(2-Thienylmethyl)-2,5-Thiophenedisulfonamide |
| 3196 | N-(3-(8-CYANO-4-(PHENYLAMINO)PYRAZOLO[1,5-A][1,3,5]TRIAZIN-2-YLAMINO)PHENYL)ACETAMIDE |
| 3197 | N-(3-(Aminomethyl)Benzyl)Acetamidine |
| 3198 | N-(3,5-dimethoxyphenyl)imidodicarbonimidic diamide |
| 3199 | N-(3-AMINOPROPYL)-2-NITROBENZENAMINE |
| 3200 | N-(3-carboxypropanoyl)-L-norvaline |
| 3201 | N'-(3-CHLORO-4-METHOXY-PHENYL)-N-(3,4,5-TRIMETHOXYPHENYL)-1,3,5-TRIAZINE-2,4-DIAMINE |
| 3202 | N-(3-chlorobenzyl)-1-(4-methylpentanoyl)-L-prolinamide |
| 3203 | N-(3-chlorophenyl)-N-methyl-2-oxo-3-[(3,4,5-trimethyl-1H-pyrrol-2-yl)methyl]-2H-indole-5-sulfonamide |
| 3204 | N-(3-cyano-4,5,6,7-tetrahydro-1-benzothien-2-yl)-2-fluorobenzamide |
| 3205 | N-(3-cyanophenyl)-2'-methyl-5'-(5-methyl-1,3,4-oxadiazol-2-yl)-4-biphenylcarboxamide |
| 3206 | N-(3-Cyclopropyl(5,6,7,8,9,10-Hexahydro-2-Oxo-2h-Cycloocta[B]Pyran-3-Yl)Methyl)Phenylbenzensulfonamide |
| 3207 | N-(3-cyclopropyl-1H-pyrazol-5-yl)-2-(2-naphthyl)acetamide |
| 3208 | N-(3-MERCAPTOPROPANOYL)-D-ALANINE |
| 3209 | N-(3-Phenyl-2-Sulfanylpropanoyl)Phenylalanylalanine |
| 3210 | N-(3-Propylcarbamoyloxirane-2-Carbonyl)-Isoleucyl-Proline |
| 3211 | N-(3-TERT-BUTYL-1H-PYRAZOL-5-YL)-N'-{4-CHLORO-3-[(PYRIDIN-3-YLOXY)METHYL]PHENYL}UREA |
| 3212 | N-(4-(2-((3-Chlorophenylmethyl)Amino)Ethyl)Phenyl)-2-Thiophecarboxamidine |
| 3213 | N-(4-{[(3S)-3-(dimethylamino)pyrrolidin-1-yl]carbonyl}phenyl)-5-fluoro-4-[2-methyl-1-(1-methylethyl)-1H-imidazol-5-yl]pyrimidin-2-amine |
| 3214 | N-(4-{[amino(imino)methyl]amino}butyl)-2,4'-bi-1,3-thiazole-4-carboxamide |
| 3215 | N-(4-{4-AMINO-6-[4-(METHYLOXY)PHENYL]FURO[2,3-D]PYRIMIDIN-5-YL}PHENYL)-N'-[2-FLUORO-5-(TRIFLUOROMETHYL)PHENYL]UREA |
| 3216 | N-(4-ACETYLPHENYL)-5-(5-CHLORO-2,4-DIHYDROXYPHENYL)-1H-PYRAZOLE-4-CARBOXAMIDE |
| 3217 | N-(4-AMINO-5-CYANO-6-ETHOXYPYRIDIN-2-YL)-2-(4-BROMO-2,5-DIMETHOXYPHENYL)ACETAMIDE |
| 3218 | N-(4-Aminobutanoyl)-S-(4-Methoxybenzyl)-L-Cysteinylglycine |
| 3219 | N-(4-bromo-2-{[(3R,5S)-3,5-dimethylpiperidin-1-yl]carbonyl}phenyl)-4-morpholin-4-yl-4-oxobutanamide |
| 3220 | N-(4-CARBAMIMIDOYL-3-CHORO-PHENYL)-2-HYDROXY-3-IODO-5-METHYL-BENZAMIDE |
| 3221 | N-(4-carbamimidoylbenzyl)-1-(3-phenylpropanoyl)-L-prolinamide |
| 3222 | N-(4-carbamimidoylbenzyl)-1-(4-methylpentanoyl)-L-prolinamide |
| 3223 | N-(4-chlorobenzyl)-N-methylbenzene-1,4-disulfonamide |
| 3224 | N-(4-CHLOROPHENYL)-1,2,3,4-TETRAHYDROISOQUINOLINE-7-SULFONAMIDE |
| 3225 | N-(4-chlorophenyl)-2-[(pyridin-4-ylmethyl)amino]benzamide |
| 3226 | N-(4-CHLOROPHENYL)-3-(PHOSPHONOOXY)NAPHTHALENE-2-CARBOXAMIDE |

TABLE 1-continued

Ligands

| Ligand No. | Ligand Name |
|---|---|
| 3227 | N-(4-Methoxybenzyl)-N'-(5-Nitro-1,3-Thiazol-2-Yl)Urea |
| 3228 | N-(4-METHYLBENZOYL)-4-BENZYLPIPERIDINE |
| 3229 | N-(4-MORPHOLINE)CARBONYL-B-(1-NAPHTHYL)-L-ALANINE-L-LEUCINE BORONIC ACID |
| 3230 | N-(4-OXO-5,6,7,8-TETRAHYDRO-4H-[1,3]THIAZOLO[5,4-C]AZEPIN-2-YL)ACETAMIDE |
| 3231 | N-(4-phenoxyphenyl)-2-[(pyridin-4-ylmethyl)amino]nicotinamide |
| 3232 | N-(4-PHENYLAMINO-QUINAZOLIN-6-YL)-ACRYLAMIDE |
| 3233 | N-(4-sulfamoylphenyl)-1H-indazote-3-carboxamide |
| 3234 | N-(5-(4-CHLORO-3-(2-HYDROXY-ETHYLSULFAMOYL)-PHENYLTHIAZOLE-2-YL)-ACETAMIDE |
| 3235 | N-(5,6-DIPHENYLFURO[2,3-D]PYRIMIDIN-4-YL)GLYCINE |
| 3236 | N-(5-{[(2S)-4-amino-2-(3-chlorophenyl)butanoyl}amino)-1H-indazol-3-yl)benzamide |
| 3237 | N-(5-{3,4-difluoro-2-[(2-fluoro-4-iodophenyl)amino]phenyl}-1,3,4-oxadiazol-2-yl)ethane-1,2-diamine |
| 3238 | N-(5-Amino-5-Carboxypentyl)Glutamic Acid |
| 3239 | N-(5-chloro-1,3-benzodioxol-4-yl)-6-methoxy-7-(3-piperidin-1-ylpropoxy)quinazolin-4-amine |
| 3240 | N'-(5-CHLORO-1,3-BENZODIOXOL-4-YL)-N-(3,4,5-TRIMETHOXYPHENYL)PYRIMIDINE-2,4-DIAMINE |
| 3241 | N'-(5-chloro-1,3-benzodioxol-4-yl)-N-(3-methylsulfonylphenyl)pyrimidine-2,4-diamine |
| 3242 | N'-(5-CHLORO-1,3-BENZODIOXOL-4-YL)-N-(3-MORPHOLIN-4-YLPHENYL)PYRIMIDINE-2,4-DIAMINE |
| 3243 | N-(5-CHLORO-BENZO[B]THIOPHEN-3-YLMETHYL)-2-[6-CHLORO-OXO-3-(2-PYRIDIN-2-YL-ETHYLAMINO)-2H-PYRAZIN-1-YL]-ACETAMIDE |
| 3244 | N'-(5-CHLOROBENZOFURAN-2-CARBONYL)-2-(TRIFLUOROMETHYL)BENZENESULFONOHYDRAZIDE |
| 3245 | N-(5-Cyclopropyl-1h-Pyrazol-3-Yl)Benzamide |
| 3246 | N-(5-METHYL-1H-PYRAZOL-3-YL)-2-PHENYLQUINAZOLIN-4-AMINE |
| 3247 | N-(5'-Phosphopyridoxyl)-D-Alanine |
| 3248 | N-(6,7,9,10,17,18,20,21-octahydrodibenzo[b,k][1,4,7,10,13,16]hexaoxacyclooctadecin-2-yl)acetamide |
| 3249 | N-(6-{[3-(4-Bromophenyl)-1,2-Benzisothiazol-6-Yl]Oxy}Hexyl)-N-Methylprop-2-En-1-Amine |
| 3250 | N-(6-Aminohexyl)-5-Chloro-1-Naphthalenesulfonamide |
| 3251 | N'-(6-aminopyridin-3-yl)-N-(2-cyclopentylethyl)-4-methyl-benzene-1,3-dicarboxamide |
| 3252 | N-(7-CARBAMIMIDOYL-NAPHTHALEN-1-YL)-3-HYDROXY-2-METHYL-BENZAMIDE |
| 3253 | N-(8,9,10-Trihydroxy-7-Hydroxymethyl-2,4-Dioxo-6-Oxa-1,3-Diaza-Spiro[4,5]Dec-3-Yl-Acetamide |
| 3254 | N-(Allyloxycarbonyl)-4-[N-(Carboxy-Formyl)-2-(Benzoic Acid)-Amino]-L-Phenylalaninyl-Amino-Butyloxy-(6-Hydroxy-Benzoic Acid Methyl Ester) |
| 3255 | N-(biphenyl-4-ylsulfonyl)-D-leucine |
| 3256 | N-(carboxycarbonyl)-D-phenylalanine |
| 3257 | N-(Chlorophenyl)-N'-Hydroxyguanidine |
| 3258 | N-(cyclopropylmethyl)-2'-methyl-5'-(5-methyl-1,3,4-oxadiazol-2-yl)biphenyl-4-carboxamide |
| 3259 | N-(CYCLOPROPYLMETHYL)-4-(METHYLOXY)-3-({5-[3-(3-PYRIDINYL)PHENYL]-1,3-OXAZOL-2-YL}AMINO)BENZENESULFONAMIDE |
| 3260 | N-(dibenzo[b,d]thiophen-3-ylsulfonyl)-L-valine |
| 3261 | N-(PARA-GLUTARAMIDOPHENYL-ETHYL)-PIPERIDINIUM-N-OXIDE |
| 3262 | N-(P-CYANOPHENYL)-N'-DIPHENYLMETHYL-GUANIDINE-ACETIC ACID |
| 3263 | N-(phosphonacetyl)-L-aspartic acid |
| 3264 | N-(Phosphonoacetyl)-L-Ornithine |
| 3265 | N-(pyridin-3-ylmethyl)aniline |
| 3266 | N'-(Pyrrolidino[2,1-B]Isoindolin-4-On-8-Yl)-N-(Pyridin-2-Yl)Urea |
| 3267 | N-(QUINOLIN-8-YL)METHANESULFONAMIDE |
| 3268 | N-(R-Carboxy-Ethyl)-Alpha-(S)-(2-Phenylethyl) |
| 3269 | N-(Sulfanylacetyl)Tyrosylprolylmethioninamide |
| 3270 | N-(TERT-BUTYL)-3,5-DIMETHYL-N'-[(5-METHYL-2,3-DIHYDRO-1,4-BENZODIOXIN-6-YL)CARBONYL]BENZOHYDRAZIDE |
| 3271 | N-(tert-butyl)-4-[5-(pyridin-2-ylamino)quinolin-3-yl]benzenesulfonamide |
| 3272 | N-(TRANS-4-{(1S,2S)-2-AMINO-3-[(3S)-3-FLUOROPYRROLIDIN-1-YL]-1-METHYL-3-OXOPROPYL}CYCLOHEXYL)-N-METHYLACETAMIDE |
| 3273 | N-(TRANS-4'-NITRO-4-STILBENYL)-N-METHYL-5-AMINO-PENTANOIC ACID |
| 3274 | N,4-Dihydroxy-N-Oxo-3-(Sulfooxy)Benzenaminium |
| 3275 | N,4-dimethyl-3-[(1-phenyl-1H-pyrazolc[3,4]pyrmidin-4-yl)amino]benzamide |
| 3276 | N,N'-[biphenyl-4,4'-diyldi(2R)propane-2,1-diyl]dimethanesulfonamide |
| 3277 | N,N'-Bis(4-Amino-2-Methylquinolin-6-Yl)Urea |
| 3278 | N,N-Bis(4-Chlorobenzyl)-1h-1,2,3,4-Tetraazol-5-Amine |
| 3279 | N,N-DIETHYL-2-[(2-THIENYLCARBONYL)AMINO]-4,5,6,7-TETRAHYDRO-1-BENZOTHIOPHENE-3-CARBOXAMIDE |
| 3280 | N,N-DIMETHYL-5-(PYRIDIN-3-YL)FURAN-2-YL)METHANAMINE |
| 3281 | N,N-DIMETHYL-4-(4-PHENYL-1H-PYRAZOL-3-YL)-1H-PYRROLE-2-CARBOXAMIDE |
| 3282 | N,N-dimethylarginine |
| 3283 | N,N'-DIMETHYL-N-(ACETYL)-N'-(7-NITROBENZ-2-OXA-1,3-DIAZOL-4-YL)ETHYLENEDIAMINE |
| 3284 | N,N'-DIPHENYLPYRAZOLO[1,5-A][1,3,5]TRIAZINE-2,4-DIAMINE |
| 3285 | N,O6-Disulfo-Glucosamine |
| 3286 | N,O-Didansyl-L-Tyrosine |
| 3287 | N-[(13-CYCLOHEXYL-6,7-DIHYDROINDOLO[1,2-D][1,4]BENZOXAZEPIN-10-YL)CARBONYL]-2-METHYL-L-ALANINE |
| 3288 | N-[(1-CHLORO-4-HYDROXYISOQUINOLIN-3-YL)CARBONYL]GLYCINE |
| 3289 | N'-[(1E)-(3,5-DIBROMO-2,4-DIHYDROXYPHENYL)METHYLENE]NICOTINOHYDRAZIDE |
| 3290 | N'-[[1E)-(3,5-dibromo-2,4-dihydroxyphenyl)methylidene]-4-methoxybenzohydrazide |
| 3291 | N'-[(1E)-(3,5-dibromo-2,4-dihydraxyphenyl)methylidene]naphthalene-2-carbohydrazide |
| 3292 | N-[(1R)-3-(4-HYDROXYPHENYL)-1-METHYLPROPYL]-2-(2-PHENYL-1H-INDOL-3-YL)ACETAMIDE |
| 3293 | N-[(1R,2R,3E)-2-hydroxy-1-(hydroxymethyl)heptadec-3-en-1-yl]acetamide |
| 3294 | N-[(1S)-1-(AMINOCARBONYL)-4-(ETHANIMIDOYLAMINO)BUTYL]BENZAMIDE |
| 3295 | N-[(1S)-1-{1-[(1R,3E)-1-ACETYLPENT-3-EN-1-YL]-1H-1,2,3-TRIAZOL-4-YL}-1,2-DIMETHYLPROPYL]BENZAMIDE |
| 3296 | N-[(1S)-2-[(4-cyano-1-methylpiperidin-4-yl)amino]-1-(cyclohexylmethyl)-2-oxoethyl]morpholine-4-carboxamide |
| 3297 | N-[(1S)-2-{[(1R)-2-(benzyloxy)-1-cyano-1-methylethyl]amino}-1-(cyclohexylmethyl)-2-oxoethyl]morpholine-4-carboxamide |
| 3298 | N-[(1S)-1-AMINO-1-(2,4-DICHLOROBENZYL)ETHYL]-5-[2-(METHYLAMINO)PYRIMIDIN-4-YL]THIOPHENE-2-CARBOXAMIDE |
| 3299 | N-[(1S)-2-amino-1-phenylethyl]-5-(1H-pyrrolo[2,3-b]pyridin-4-yl)thiophene-2-carboxamide |
| 3300 | N-[(1 S)-2-methyl-1-(pyridin-4-ylcarbamoyl)propyl]cyclohexanecarboxamide |
| 3301 | N-[(1S)-5-amino-1-(chloroacetyl)pentyl]-4-methylbenzenesulfonamide |
| 3302 | N-[(2-AMINO-6-METHYLPYRIMIDIN-4-YL)METHYL]-3-{[(E)-(2-OXODIHYDROFURAN-3(2H)-YLIDENE)METHYL]AMINO}BENZENESULFONAMIDE |

TABLE 1-continued

Ligands

| Ligand No. | Ligand Name |
|---|---|
| 3303 | N-[(2R)-2-{[(2S)-2-(1,3-benzoxazol-2-yl)pyrrolidin-1-yl]carbonyl}hexyl]-N-hydroxyformamide |
| 3304 | N-[(2R)-2-benzyl-4-(hydroxyamino)-4-oxobutanoyl]-L-alanine |
| 3305 | N-[(2R)-5-(aminosulfonyl)-2,3-dihydro-1H-inden-2-yl]-2-propylpentanamide |
| 3306 | N-[(2R,3S)-1-((2S)-2-{[(CYCLOPENTYLAMINO)CARBONYL]AMINO}-3-METHYLBUTANOYL)-2-(1-FORMYL-1-CYCLOBUTYL)PYRROLIDINYL]CYCLOPROPANE-CARBOXAMIDE |
| 3307 | N-[(2R,3S)-3-AMINO-2-HYDROXY-4-PHENYLBUTYL]-4-METHOXY-2,3,6-TRIMETHYLBENZENESULFONAMIDE |
| 3308 | N-[(2R,3S)-3-AMINO-2-HYDROXY-4-PHENYLBUTYL]NAPHTHALENE-2-SULFONAMIDE |
| 3309 | N-[(2S,4S,6R)-2-(dihydroxymethyl)-4-hydroxy-3,3-dimethyl-7-oxo-4lambda~4~-thia-1-azabicyclo[3.2.0]hept-6-yl]-2-phenylacetamide |
| 3310 | N-[(3z)-5-Tert-Butyl-2-Phenyl-1,2-Dihydro-3h-Pyrazol-3-Ylidene]-N'-(4-Chlorophenyl)Urea |
| 3311 | N-[(4-HYDROXY-8-IODOISOQUINOLIN-3-YL)CARBONYL]GLYCINE |
| 3312 | N-[(4-methoxyphenyl)sulfonyl]-D-alanine |
| 3313 | N-[(5R,14R)-5-AMINO-5,14-DIMETHYL-4-OXO-3-OXA-18-AZATRICYCLO[15.3.1.1~7,11~]DOCOSA-1(21),7(22),8,10,17,19-HEXAEN-19-YL]-N-METHYLMETHANESULFONAMIDE |
| 3314 | N-[(6-BUTOXYNAPHTHALEN-2-YL)SULFONYL]-D-GLUTAMIC ACID |
| 3315 | N-[(6-BUTOXYNAPHTHALEN-2-YL)SULFONYL]-L-GLUTAMIC ACID |
| 3316 | N-[(Aminooxy)Carbonyl]Aniline |
| 3317 | N-[(BENZYLOXY)CARBONYL]-L-CYSTEINYLGLYCINE |
| 3318 | N-[(CYCLOHEXYLAMINO)CARBONYL]GLYCINE |
| 3319 | N-[(Furan-2-Yl)Carbonyl]-(S)-Leucyl-(R)-[1-Amino-2(1h-Indol-3-Yl)Ethyl]-Phosphonic Acid |
| 3320 | N-[[2-METHYL-4-HYDROXYCARBAMOYL]BUT-4-YL-N]-BENZYL-P-[PHENYL]-P-[METHYL]PHOSPHINAMID |
| 3321 | N-[[3-FLUORO-4-ETHOXY-PYRID-2-YL]ETHYL]-N'-[5-CHLORO-PYRIDYL]-THIOUREA |
| 3322 | N-[[3-FLUORO-4-ETHOXY-PYRID-2-YL]ETHYL]-N'-[5-NITRILOMETHYL-PYRIDYL]-THIOUREA |
| 3323 | N-[1-(2,6-dimethoxybenzyl)piperidin-4-yl]-4-sulfanylbutanamide |
| 3324 | N-[1-(4-CARBAMIMIDOYL-BENZYLCARBAMOYL)-3-METHYLSULFANYL-PROPYL]-3-HYDROXY-2-PROPOXYAMINO-BUTYRAMID |
| 3325 | N-[1-(5-bromo-2,3-dimethoxybenzyl)piperidin-4-yl]-4-sufanylbutanamide |
| 3325 | N-[1-(AMINOMETHYL)CYCLOPROPYL]-3-(BENZYLSULFONYL)-N~2~-[(1S)-2,2,2-TRIFLUORO-1-(4-HYDROXYPHENYL)ETHYL]-L-ALANINAMIDE |
| 3327 | N-[1-(AMINOMETHYL)CYCLOPROPYL]-3-(MORPHOLIN-4-YLSULFONYL)-N~2~-[(1S)-2,2,2-TRIFLUORO-1-(4-FLUOROPHENYL)ETHYL]-L-ALANINAMIDE |
| 3328 | N-[12-(1H-imidazol-1-yl)dodecanoyl]-L-leucine |
| 3329 | N-[1H-INDOL-3-YL-ACETYL]ASPARTIC ACID |
| 3330 | N-[1H-INDOL-3-YL-ACETYL]GLYCINE ACID |
| 3331 | N-[1H-INDOL-3-YL-ACETYL]VALINE ACID |
| 3332 | N-[1-Hydroxycarboxyethyl-Carbonyl]Leucylamino-2-Methyl-Butane |
| 3333 | N-[2-({[amino(imino)methyl]amino}oxy)ethyl]-2-{6-chloro-3-[(2,2-difluoro-2-phenylethyl)amino]-2-fluorophenyl}acetamide |
| 3334 | N-[2-(1,3-BENZODIOXOL-5-YL)ETHYL]-1-[2-(1H-IMIDAZOL-1-YL)-6-METHYLPYRIMIDIN-4-YL]-D-PROLINAMIDE |
| 3335 | N-[2-(1-Formyl-2-Methyl-Propyl)-1-(4-Piperidin-1-Yl-but-2-Enoyl)-Pyrrolidin-3-Yl]-Methanesulfonamide |
| 3335 | N-[2-(1h-Indol-5-Yl)-Butyl]-4-Sulfamoyl-Benzamide |
| 3337 | N-[2-(1-Maleimidyl)Ethyl]-7-Diethylaminocoumarin-3-Carboxamide |
| 3338 | N-[2-(2,4-diaminopyrido[2,3-d]pyrimidin-7-yl)-2-methylpropyl]-4-phenoxybenzamide |
| 3339 | N-[2-(2-iodo-5-methoxy-1H-indol-3-yl)ethyl]acetamide |
| 3340 | N-[2-(2-methyl-1H-indol-3-yl)ethyl]thiophene-2-carboxamide |
| 3341 | N-[2-(4-AMINO-5,8-DIFLUORO-1,2-DIHYDROQUINAZOLIN-2-YL)ETHYL]-3-FURAMIDE |
| 3342 | N-[2-(4-BROMOCINNAMYLAMINO)ETHYL]-5-ISOQUINOLINE SULFONAMIDE |
| 3343 | N-[2-(5-methyl-4H-1,2,4-triazol-3-yl)phenyl]-7H-pyrrolo[2,3-d]pyrimidin-4-annine |
| 3344 | N-[2-(6-AMINO-4-METHYLPYRIDIN-2-YL)ETHYL]-4-CYANOBENZAMIDE |
| 3345 | N-[2-(carbamimidamidooxy)ethyl]-2-{6-cyano-3-[(2,2-difluoro-2-pyridin-2-ylethyl)amino]-2-fluorophenyl}acetamide |
| 3346 | N-[2-(METHYLAMINO)ETHYL]-5-ISOQUINOLINESULFONAMIDE |
| 3347 | N-[2(S)-Cyclopentyl-1(R)-Hydroxy-3(R)Methyl]-5-[(2(S)-Tertiary-Butylamino-Carbonyl)-4-(N1-(2)-(N-Methylpiperazinyl)-3-Chloro-Pyrazinyl-5-Carbonyl)-Piperazino]-4(S)-Hydroxy-2(R)-Phenylmethyl-Pentanamide |
| 3348 | N-[2-chloro-5-(trifluoromethyl)phenyl]imidodicarbonimidic diamide |
| 3349 | N-[2-Hydroxy-2-(8-Isopropyl-6,9-Dioxo-2-Oxa-7,10-Diaza-Bicyclo[11.2.2]Heptadeca-1(16),13(17),14-Trien-11-Yl)-Ethyl]-N-(3-Methyl-Butyl)-Benzenesulfonamide,Inhibitor 3 |
| 3350 | N-[2-methyl-5-(methylcarbamoyl)phenyl]-2-{[(1R)-1-methylpropyl]amino}-1,3-thiazole-5-carboxamide |
| 3351 | N-[3-(1H-BENZIMIDAZOL-2-YL)-1H-PYRAZOL-4-YL]BENZAMIDE |
| 3352 | N-[3-(2-fluoroethoxy)phenyl]-N'-(1,3,4-trioxo-1,2,3,4-tetrahydroisoquinolin-6-yl)butanediamide |
| 3353 | N-[3-(N'-HYDROXYCARBOXAMIDO)-2-(2-METHYLPROPYL)-PROPANOYL]-O-TYROSINE-N-METHYLAMIDE |
| 3354 | N-[3-[(1-Aminoethyl)(Hydroxy)Phosphoryl]-2-(1,1'-Biphenyl-4-Ylmethyl)Propanoyl]Alanine |
| 3355 | N-[3-[[4-[(5-CHLORO-1,3-BENZODIOXOL-4-YL)AMINO]PYRIMIDIN-2-YL]AMINO]PHENYL]METHANESULFONAMIDE |
| 3356 | N-[4-({[5-(DIMETHYLAMINO)-1-NAPHTHYL]SULFONYL}AMINO)BUTYL]-3-SULFANYLPROPANAMIDE |
| 3357 | N-[4-(1-BENZOYLPIPERIDIN-4-YL)BUTYL]-3-PYRIDIN-3-YLPROPANAMIDE |
| 3358 | N-[4-(2,4-Dimethyl-1,3-Thiazol-5-Yl)Pyrimidin-2-Yl]-N'-Hydroxyimidoformamide |
| 3359 | N-[4-(2,4-DIMETHYL-THIAZOL-5-YL)-PYRIMIDIN-2-YL]-N',N'-DIMETHYL-BENZENE-1,4-DIAMINE |
| 3360 | N-[4-(2-{2-[3-(2-Bromo-Acetylamino)-Propionylamino]-3-Hydroxy-Propionylamino}-Ethyl)-Phenyl]-Oxalamic Acid |
| 3361 | N-[4-(2-CHLOROPHENYL)-1,3-DIOXO-1,2,3,6-TETRAHYDROPYRROLO[3,4-C]CARBAZOL-9-YL]FORMAMIDE |
| 3362 | N-[4-(2-Methylimidazo[1,2-a]Pyridin-3-Yl)-2-Pyrimidinyl]Acetamide |
| 3363 | N-[4-(3-BROMO-PHENYLAMINO)-QUINAZOLIN-6-YL]-ACRYLAMIDE |
| 3364 | N-[4-(5-fluoro-6-methylpyridin-2-yl)-5-quinoxalin-6-yl-1H-imidazol-2-yl]acetamide |
| 3365 | N-[4-(AMINOSULFONYL)BENZYL]-5-(5-CHLORO-2,4-DIHYDROXYPHENYL)-1H-PYRAZOLE-4-CARBOXAMIDE |
| 3366 | N-[4-(AMINOSULFONYL)PHENYL]-2-MERCAPTOBENZAMIDE |
| 3367 | N-[4-(benzyloxy)phenyl]glycinamide |
| 3368 | N-[4-CHLORO-3-(PYRIDIN-3-YLOXYMETHYL)-PHENYL]-3-FLUORO- |
| 3369 | N-[4-CLORO-3-(T-BUTYLOXOME)PHENYL-2-METHYL-3-FURAN-CARBOTHIAMIDE |
| 3370 | N-[4-(Hydroxymethyl-Cyclohexan-6-Yl-1,2,3-Triol]-4,6-Dideoxy-4-Aminoglucopyranoside |
| 3371 | N-[4-Methyl-3-[[4-(3-Pyridinyl)-2-Pyrimidinyl]Amino]Phenyl]-3-Pyridinecarboxamide |
| 3372 | N-[5-(1,1-DIOXIDOISOTHIAZOLIDIN-2-YL)-1H-INDAZOL-3-YL]-2-(4-PIPERIDIN-1-YLPHENYL)ACETAMIDE |

TABLE 1-continued

Ligands

| Ligand No. | Ligand Name |
|---|---|
| 3373 | N-[5-(ETHYLSULFONYL)-2-METHOXYPHENYL]-5-[3-(2-PYRIDINYL)PHENYL]-1,3-OXAZOL-2-AMINE |
| 3374 | N-[5'-O-Phosphono-Ribofuranosyl]-2-[2-Hydroxy-2-[4-[Glutamic Acid]-N-Carbonylphenyl]-3-[2-Amino-4-Hydroxy-Quinazolin-6-Yl]-Propanylamino]-Acetamide |
| 3375 | N-[7-(3-AMINOPHENYL)-5-METHOXY-1,3-BENZOXAZOL-2-YL]-2,5-DICHLOROBENZENESULFONAMIDE |
| 3376 | N-[amino(imino)methyl]-2-(2,5-diphenyl-1H-pyrrol-1-yl)acetamide |
| 3377 | N-[amino(imino)methyl]-2-[2-(2-chlorophenyl)-4-(4-propoxyphenyl)-3-thienyl]acetamide |
| 3378 | N-[Amino(Imino)Methyl]Glycine |
| 3379 | N-[Isoleucinyl]-N'-[Adenosyl]-Diaminosufone |
| 3380 | N-[N-[1-Hydroxycarboxyethyl-Carbonyl]Leucylamino-Butyl]-Guanidine |
| 3381 | N-[O-Phosphono-Pyridoxyl]-Isoleucine |
| 3382 | N-[Tosyl-D-Prolinyl]Amino-Ethanethiol |
| 3383 | N-{(1s)-4-[Bis(2-Chloroethyl)Amino]-1-Methylbutyl}-N-(6-Chloro-2-Methoxy-9-Acridinyl)Amine |
| 3384 | N-{(1S,2R)-2-hydroxy-1-[(hydroxyamino)carbonyl]propyl}-4-{[4-(morpholin-4-ylmethyl)phenyl]ethynyl}benzamide |
| 3385 | N-{(2S)-3-[(1R)-1-aminoethyl](hydroxy)phosphoryl-2-benzylpropanoyl}-L-phenylalanine |
| 3386 | N-{(3R,4S)-4-[(6-amino-4-methylpyridin-2-yl)methyl]pyrrolidin-3-yl}-N'-(3-chlorobenzyl)ethane-1,2-diamine |
| 3387 | N-{(3S,4S)-4-[(6-AMINO-4-METHYLPYRIDIN-2-YL)METHYL]PYRROLIDIN-3-YL}-N'-(4-CHLOROBENZYL)ETHANE-1,2-DIAMINE |
| 3388 | N-{(4s)-4-Amino-5-[(2-Aminoethyl)Amino]Pentyl}-N'-Nitroguanidine |
| 3389 | N-{[(2R)-2,3-dihydroxypropyl]oxy}-3,4-difluoro-2-[(2-fluoro-4-iodophenyl)amino]benzamide |
| 3390 | N-{[(2S,3S)-3-(ETHOXYCARBONYL)OXIRAN-2-YL]CARBONYL}- |
| 3391 | N-{[(2S,3S)-3-(ETHOXYCARBONYL)OXIRAN-2-YL]CARBONYL}-L-ISOLEUCINE |
| 3392 | N-{[(2S,3S)-3-(ETHOXYCARBONYL)OXIRAN-2-YL]CARBONYL}-L-ISOLEUCYL-L-ALANINE |
| 3393 | N-{[(2S,3S)-3-(ETHOXYCARBONYL)OXIRAN-2-YL]CARBONYL}-L-ISOLEUCYL-L-ISOLEUCINE |
| 3394 | N-{[2-({1-(4-CARBOXYBUTANOYL)AMINO]-2-PHENYLETHYL}-HYDROXYPHOSPHINYL)OXY]ACETYL}-2-PHENYLETHYLAMINE |
| 3395 | N-{[4-(but-2-yn-1-yloxy)phenyl]sulfonyl}-5-methyl-D-tryptophan |
| 3396 | N-{[6-(PENTYLOXY)NAPHTHALEN-2-YL]SULFONYL}-D-GLUTAMIC ACID |
| 3397 | N-{1-[(1-carbamoylcyclopropyl)methyl]piperidin-4-yl}-N-cyclopropyl-4-[(1S)-2,2,2-trifluoro-1-hydroxy-1-methylethyl]benzamide |
| 3398 | N-{1-[5-(1-Carbamoyl-2-Mercapto-Ethylcarbamoyl)-Pentylcarbamoyl]-2-[4-(Difluoro-Phosphono-Methyl)-Phenyl]-Ethyl}-3-{2-[4-(Difluoro-Phosphono-Methyl)-Phenyl]-Acetylamino}-Succinamic Acid |
| 3399 | N-{2,2-DIFLUORO-2-[(2R)-PIPERIDIN-2-YL]ETHYL}-2-[2-(1H-1,2,4-TRIAZOL-1-YL)BENZYL][1,3]OXAZOLO[4,5-C]PYRIDIN-4-AMINE |
| 3400 | N-{2,4-difluoro-3-[(5-pyridin-3-yl-1H-pyrrolo[2,3-b]pyridin-3-yl)carbonyl]phenyl}ethanesulfonamide |
| 3401 | N-{2-[(4'-CYANO-1,1'-BIPHENYL-4-YL)OXY]ETHYL}-N'-HYDROXY-N-METHYLUREA |
| 3402 | N-{2'-[(4-FLUOROPHENYL)AMINO]-4,4'-BIPYRIDIN-2-YL}-4-METHOXYCYCLOHEXANECARBOXAMIDE |
| 3403 | N-{2-[4-(AMINOSULFONYL)PHENYL]ETHYL}ACETAMIDE |
| 3404 | N-{2-[6-(2,4-DIAMINO-6-ETHYLPYRIMIDIN-5-YL)-2,2-DIMETHYL-3-OXO-2,3-DIHYDRO-4H-1,4-BENZOTHIAZIN-4-YL]ETHYL}ACETAMIDE |
| 3405 | N-{2-[6-(2,4-DIAMINO-6-ETHYLPYRIMIDIN-5-YL)-2,2-DIMETHYL-3-OXO-2,3-DIHYDRO-4H-1,4-BENZOXAZIN-4-YL]ETHYL}ACETAMIDE |
| 3406 | N-{2-methyl-5-[(6-phenylpyrimidin-4-yl)amino]phenyl}methanesulfonamide |
| 3407 | N''-{3-[(3s,8ar)-1,4-Dioxooctahydropyrrolo[1,2-a]Pyrazin-3-Yl]Propyl}Guanidine |
| 3408 | N-{3-[(4-{[3-(TRIFLUOROMETHYL)PHENYL]AMINO}PYRIMIDIN-2-YL)AMINO]PHENYL}CYCLOPROPANECARBOXAMIDE |
| 3409 | N-{3-[(5-chloro-1H-pyrrolo[2,3-b]pyridin-3-yl)carbonyl]-2,4-difluorophenyl}propane-1-sulfonamide |
| 3410 | N-{3-[(7ar,12as,12bs)-7-Oxo-1,3,4,6,7,7a,12a,12b-Octahydroindolo[2,3-a]Quinolizin-12(2h)-Yl]Propyl}Propane-2-Sulfonamide |
| 3411 | N-{3-[4-(3-Amino-Propyl)-Piperazin-1-Yl]-Propyl}-3-(2-Thiophen-2-Yl-Acetylamino)-5-(3,4,5-Trihydroxy-6-Hydroxymethyl-Tetrahydro-Pyran-2-Yloxy)-Benzamide |
| 3412 | N-{3-[4-(3-Amino-Propyl)-Piperazin-1-Yl]-Propyl}-3-Nitro-5-(Galactopyranosyl)-Alpha-Benzamide |
| 3413 | N-{3-[4-(3-Amino-Propyl)-Piperazin-1-Yl]-Propyl}-3-Nitro-5-(Galactopyranosyl)-Beta-Benzamide |
| 3414 | N-{3-[4-hydroxy-1-(3-methylbutyl)-2-oxo-1,2-dihydropyrrolo[1,2-b]pyridazin-3-yl]-1,1-dioxido-2H-1,2,4-benzothiadiazin-7-yl}methanesulfonamide |
| 3415 | N-{3-[5-(1H-1,2,4-triazol-3-yl)-1H-indazol-3-yl]phenyl}furan-2-carboxamide |
| 3416 | N-{3-[5-(6-Amino-Purin-9-Yl]-3,4-Dihydroxy-Tetrahydro-Furan-2-Yl]-Allyl}-2,3-Dihydroxy-5-Nitro-Benzamide |
| 3417 | N-{3-METHYL-5-[2-(PYRIDIN-4-YLAMINO)-ETHOXY]-PHENYL}-BENZENESULFONAMIDE |
| 3418 | N-{4-METHYL-3-[(3-PYRIMIDIN-4-YLPYRIDIN-2-YL)AMINO]PHENYL}-3-(TRIFLUOROMETHYL)BENZAMIDE |
| 3419 | N-{5-[4-(4-METHYLPIPERAZIN-1-YL)PHENYL]-1H-PYRROLO[2,3-B]PYRIDIN-3-YL}NICOTINAMIDE |
| 3420 | N~2~-(biphenyl-4-ylsulfonyl)-N-hydroxy-N~2~-(2-hydroxyethyl)glycinamide |
| 3421 | N~2~-,N~2~-DIMETHYL-N-1~-(6-OXO-5,6-DIHYDROPHENANTHRIDIN-2-YL)GLYCINAMIDE |
| 3422 | N~2~-[(BENZYLOXY)CARBONYL]-N-[(1S,2S)-2-HYDROXY-1-(4-HYDROXYBENZYL)PROPYL]-L-LEUCINAMIDE |
| 3423 | N~2~-1,3-BENZOXAZOL-2-YL-3-CYCLOHEXYL-N-{2-[(4-METHOXYPHENYL)AMINO]ETHYL}-L-ALANINAMIDE |
| 3424 | N~2~-1H-benzimidazol-5-yl-N~4~-(3-cyclopropyl-1H-pyrazol-5-yl)pyrimidine-2,4-diamine |
| 3425 | N~2~-Succinylarginine |
| 3426 | N~2~- Succinylornithine |
| 3427 | N~3~-(3-PYRIDIN-3-YLBENZYL)PYRIDINE-2,3-DIAMINE |
| 3428 | N~3~-[3-(1H-INDOL-6-YL)BENZYL]PYRIDINE-2,3-DIAMINE |
| 3429 | N~3~-[3-(5-METHOXYPYRIDIN-3-YL)BENZYL]PYRIDINE-2,3-DIAMINE |
| 3430 | N~3~-[5-(1H-INDOL-6-YL)-2-(PYRIDIN-2-YLMETHOXY)BENZYL]PYRIDINE-2,3-DIAMINE |
| 3431 | N~3~-BENZYLPYRIDINE-2,3-DIAMINE |
| 3432 | N~3~-cydopropyl-N~4~'-(cyclopropylmethyl)-6-methylbiphenyl-3,4'-dicarboxamide |
| 3433 | N~4~-(3-methyl-1H-indazol-6-yl)-N~2~-(3,4,5-trimethoxyphenyl)pyrimidine-2,4-diamine |
| 3434 | N~4~-methyl-N~4~-(3-methyl-1H-indazol-6-yl)-N~2~-(3,4,5-trimethoxyphenyl)pyrimidine-2,4-diamine |
| 3435 | N~6~-cyclohexyl-N~2~-(4-morpholin-4-ylphenyl)-9H-purine-2,6-diamine |
| 3436 | N1-(1-Dimethylcarbamoyl-2-Phenyl-Ethyl)-2-Oxo-N4-(2-Pyridin-2-Yl-Ethyl)-Succinamide |
| 3437 | N1-(2-AMINO-4-METHYLPENTYL)OCTAHYDRO-PYRROLO[1,2-A] PYRIMIDINE |
| 3438 | N-1,10-phenanthrolin-5-ylacetamide |
| 3439 | N-1,2,3,4-Tetrahydronaphth-1-Yl-2'-[3,5-Dimethoxybenzamido]-2'-Deoxy-Adenosine |
| 3440 | N1,N14-Bis((S-Methyl)Isothioureido)Tetradecane |
| 3441 | N1,N2-ETHYLENE-2-METHYLAMINO-4,5,6,7-TETRABROMO-BENZIMiDAZOLE |

TABLE 1-continued

Ligands

| Ligand No. | Ligand Name |
|---|---|
| 3442 | N1-CYCLOPENTYL-N2-(THIAZOL-2-YL)OXALAMIDE |
| 3443 | N-1H-imidazol-2-yl-N'-[4-(1H-imidazol-2-ylamino)phenyl]benzene-1,4-diamine |
| 3444 | N-1H-indazol-5-yl-2-(6-methylpyridin-2-yl)quinazolin-4-amine |
| 3445 | N-1-Methylheptylformamide |
| 3446 | N2-({[(4-Bromophenyl)Methyl]Oxy}Carbonyl)-N1-[(1s)-1-Formylpentyl]-L-Leucinamide |
| 3447 | N2-[(benzyloxy)carbonyl]-n1-[(3S)-1-cyanopyrrolidin-3-yl]-l-leucinamide |
| 3448 | N-2-Thiophen-2-Yl-Acetamide Boronic Acid |
| 3449 | N3,N4-Dimethylarginine |
| 3450 | N-3-OXO-DODECANOYL-L-HOMOSERINE LACTONE |
| 3451 | N4-(N,N-DIPHENYLCARBAMOYL)-AMINOGUANIDINE |
| 3452 | N4-HYDROXY-2-ISOBUTYL-N1-(9-OXO-1,8-DIAZA-TRICYCLO[10.6.1.013,18]NONADECA-12(19),13,15,17-TETRAEN-10-YL)-SUCCINAMIDE |
| 3453 | N5-(1-Imino-3-Butenyl)-L-Ornithine |
| 3454 | N5-Iminoethyl-L-Ornithine |
| 3455 | N5-Methylglutamine |
| 3456 | N6-(2,5-Dimethoxy-Benzyl)-N6-Methyl-Pyrido[2,3-D]Pyrimidine-2,4,6-Triamine |
| 3457 | N6-Benzyl Adenosine-5'-Diphosphate |
| 3458 | N6-ISOPENTENYL-ADENOSINE-5-MONOPHOSPHATE |
| 3459 | N6-METHYL-(R)-ROSCOVITINE, R-2-[6-(BENZYL-METHYL-AMINO)-9-ISOPROPYL-9H-PURIN-2-YLAMINO]-BUTAN-1-OL |
| 3460 | N7-BUTYL-N2-(5-CHLORO-2-METHYLPHENYL)-5-METHYL[1,2,4]TRIAZOLO[1,5-A]PYRIMIDINE-2,7-DIAMINE |
| 3461 | N7-Methyl-Formycin A |
| 3462 | N7-Methyl-Guanosine-5'-Monophosphate |
| 3463 | Nabilone |
| 3464 | Nabumetone |
| 3465 | N-Acetyl Serotonin |
| 3466 | N-Acetylalanine |
| 3467 | N-Acetyl-D-Allosamine |
| 3468 | N-Acetyl-D-Galactosamine 6-Sulfate |
| 3469 | N-Acetyl-D-glucosamine |
| 3470 | N-ACETYLHISTAMINE |
| 3471 | N-Acetyl-L-Citrulline |
| 3472 | N-Acetyl-L-Glutamate |
| 3473 | N-Acetyl-L-Glutamine |
| 3474 | N-ACETYL-L-PHENYLALANYL-4-[DIFLUORO(PHOSPHONO)METHYL]-L-PHENYLALANINAMIDE |
| 3475 | N-Acetylmannosaminitol |
| 3476 | N-Acetylmethionine |
| 3477 | N-Acetyl-N'-Beta-D-Glucopyranosyl Urea |
| 3478 | N-Acetyl-P-Nitrophenylserinol |
| 3479 | N-Acetylproline |
| 3480 | N-Acetyl-Serine |
| 3481 | NADH |
| 3482 | Nadolol |
| 3483 | Nadph Dihydro-Nicotinamide-Adenine-Dinucleotidephosphate |
| 3484 | Nadroparin |
| 3485 | Nafarelin |
| 3486 | Nafcillin |
| 3487 | Naftifine |
| 3488 | Nalbuphine |
| 3489 | Naldemedine |
| 3490 | Nalidixic Acid |
| 3491 | N-ALLYL-5-AMIDINOAMINOOXY-PROPYLOXY-3-CHLORO-N-CYCLOPENTYLBENZAMIDE |
| 3492 | N-Allyl-Aniline |
| 3493 | Nalmefene |
| 3494 | Naloxegol |
| 3495 | Naloxone |
| 3496 | N-Alpha-(2-Naphthylsulfonyl)-N(3-Amidino-L-Phenylalaninyl)-4-Acetyl-Piperazine |
| 3497 | N-Alpha-(2-Naphthylsulfonyl)-N-(3-Amidino-L-Phenylalaninyl)-D-Pipecolinic Acid |
| 3498 | N-Alpha-(2-Naphthylsulfonyl)-N(3-Amidino-L-Phenylalaninyl)Isopipecolinic Acid Methyl Ester |
| 3499 | Nalpha-(2-Naphthylsulfonylglycyl)-3-Amidino-D,L-Phenylalanine-Isopropylester |
| 3500 | NALPHA-[(BENZYLOXY)CARBONYL]-N-[(1R)-4-HYDROXY-1-METHYL-2-OXOBUTYL]-L-PHENYLALANINAMIDE |
| 3501 | N-Alpha-Acetyl-3,5-Diiodotyrosylglycine |
| 3502 | N-Alpha-L-Acetyl-Arginine |
| 3503 | Naltalimide |
| 3504 | Naltrexone |
| 3505 | Naluzotan |
| 3506 | NAM NAPTHYLAMINOALANINE |
| 3507 | Name: FDA, SrcID: label/2013/205552lbl.pdf, URL: http://www.accessdata.fda.gov/drugsatfda_docs/label/2013/205552lbl.pdf |
| 3508 | N-Aminoethylmorpholine |
| 3509 | Namn |
| 3510 | Nanaomycin D |
| 3511 | Nandrolone decanoate |
| 3512 | Nandrolone phenpropionate |
| 3513 | N-anthracen-2-yl-5-methyl[1,2,4]triazolo[1,5-a]pyrimidin-7-amine |
| 3514 | Naphazoline |
| 3515 | Naphthalen-1-Yl-Acetic Acid |
| 3516 | NAPHTHALEN-2-YL-3-ALANINE |
| 3517 | Naphthalene Trisulfonate |
| 3518 | NAPHTHALENE-1,2-DIOL |
| 3519 | Naphthalene-2,6-disulfonic acid |
| 3520 | NAPHTHYLOXYACETIC ACID |
| 3521 | Naphthyridine Inhibitor |
| 3522 | Naproxen |
| 3523 | Naratriptan |
| 3524 | Naringenin |
| 3525 | Naronapride |
| 3526 | Natalizumab |
| 3527 | Natamycin |
| 3528 | Nateglinide |
| 3529 | Natural alpha interferon |
| 3530 | Navarixin |
| 3531 | Naveglitazar |
| 3532 | Naxifylline |
| 3533 | NB1011 |
| 3534 | N-BENZOYL-D-ALANINE |
| 3535 | N-Benzoyl-N'-Beta-D-Glucopyranosyl Urea |
| 3536 | N-benzyl-4-[(2R)-pyrrolidin-2-ylmethoxy]aniline |
| 3537 | N-BENZYL-4-[4-(3-CHLOROPHENYL)-1H-PYRAZOL-3-YL]-1H-PYRROLE-2-CARBOXAMIDE |
| 3538 | N-Benzyl-4-Sulfamoyl-Benzamide |
| 3539 | N-Benzylformamide |
| 3540 | N-BENZYLOXYCARBONYL-ALA-PRO-3-AMINO-4-PHENYL-BUTAN-2-OL |
| 3541 | N-BENZYLOXYCARBONYL-L-SERINE-BETALACTONE |
| 3542 | NBI-56418 |
| 3543 | N-Bromoacetyl-Aminoethyl Phosphate |
| 3544 | N-Butyl Isocyanide |
| 3545 | N-Butyl-11-[(7r,8r,9s,13s,14s,17s)-3,17-Dihydroxy-13-Methyl-7,8,9,11,12,13,14,15,16,17-Decahydro-6h-Cyclopenta[a]Phenanthren-7-Yl]-N-Methylundecanamide |
| 3546 | N-butyl-3-{[6-(9H-purin-6-ylamino)hexanoyl]amino}benzamide |
| 3547 | N-Butyl-N'-Hydroxyguanidine |
| 3548 | N-Carbamoyl-Alanine |
| 3549 | N-Carbamoyl-L-Aspartate |
| 3550 | N-Carbamyl-D-Methionine |
| 3551 | N-Carbamyl-D-Valine |
| 3552 | N-Carboxymethionine |
| 3553 | N-Cholylglycine |
| 3554 | Ncs-Chromophore |
| 3555 | NCX 4016 |
| 3556 | NCX 950 |
| 3557 | N-cycloheptylglycyl-N-(4-carbamimidoylbenzyl)-L-prolinamide |

TABLE 1-continued

Ligands

| Ligand No. | Ligand Name |
|---|---|
| 3558 | N-cyclohexyl-3-[3-(trifluoromethyl)phenyl][1,2,4]triazolo[4,3-b]pyridazin-6-amine |
| 3559 | N-cyclohexyl-4-imidazo[1,2-a]pyridin-3-yl-N-methylpyrimidin-2-amine |
| 3560 | N-Cyclohexyl-N'-(4-Iodophenyl)Urea |
| 3561 | N-Cyclohexyl-N'-(Propyl)Phenyl Urea |
| 3562 | N-Cyclohexyl-N'-Decylurea |
| 3563 | N-Cyclohexyltaurine |
| 3564 | N-cyclooctylglycyl-N-(4-carbamimidoylbenzyl)-L-prolinamide |
| 3565 | N-Cyclopentyl-N-Cyclobutylformamide |
| 3566 | N-cyclopropyl-2',6-dimethyl-4'-(5-methyl-1,3,4-oxadiazol-2-yl)biphenyl-3-carboxamide |
| 3567 | N-cyclopropyl-3-{[1-(2,4-difluorophenyl)-7-methyl-6-oxo-6,7-dihydro-1H-pyrazolo[3,4-b]pyridin-4-yl]amino}-4-methylbenzamide |
| 3568 | N-cyclopropyl-4-methyl-3-[1-(2-methylphenyl)phthalazin-6-yl]benzamide |
| 3569 | N-cyclopropyl-4-methyl-3-{2-[(2-morpholin-4-ylethyl)amino]quinazolin-6-yl}benzamide |
| 3570 | N-cyclopropyl-4-pyrazolo[1,5-b]pyridazin-3-ylpyrimidin-2-amine |
| 3571 | N-cyclopropyl-6-[(6,7-dimethoxyquinolin-4-yl)oxy]naphthalene-1-carboxamide |
| 3572 | N-cyclopropyl-N-(trans-4-pyridin-3-ylcyclohexyl)-4-[(1S)-2,2,2-trifluoro-1-hydroxy-1-methylethyl]benzamide |
| 3573 | Nd1-Phosphonohistidine |
| 3574 | ND7001 |
| 3575 | Ndelta-(N'-Sulphodiaminophosphinyl)-L-Ornithine |
| 3576 | N-DODECANOYL-L-TYROSINE |
| 3577 | N-Dodecyl-N,N-Dimethyl-3-Ammonio-1-Propanesulfonate |
| 3578 | N-DODECYL-N,N-DIMETHYLGLYCINATE |
| 3579 | Nebentan |
| 3580 | Nebivolol |
| 3581 | Neboglamine |
| 3582 | Necitumumab |
| 3583 | Nedocromil |
| 3584 | Nefazodone |
| 3585 | Nelarabine |
| 3586 | Nelfinavir |
| 3587 | Nelivaptan |
| 3588 | Nelotanserin |
| 3589 | Neomycin |
| 3590 | Neostigmine |
| 3591 | Nepafenac |
| 3592 | Neramexane |
| 3593 | Neratinib |
| 3594 | Nesiritide |
| 3595 | Netazepide |
| 3596 | N-ethyl-4-{[5-(methoxycarbamoyl)-2-methylphenyl]amino}-5-methylpyrrolo[2,1-f][1,2,4]triazine-6-caiboxamide |
| 3597 | N-Ethyl-5'-Carboxamido Adenosine |
| 3598 | N-Ethylmaleimide |
| 3599 | N-ethyl-N-[3-(propylamino)propyl]propane-1,3-diamine |
| 3600 | N-ETHYL-N-ISOPROPYL-3-METHYL-5-{[(2S)-2-(PYRIDIN-4-YLAMINO)PROPYL]OXY}BENZAMIDE |
| 3601 | Netilmicin |
| 3602 | Netoglitazone |
| 3603 | Netupitant |
| 3604 | Nevirapine |
| 3605 | N-Formylmethionine |
| 3606 | N-Formylpiperidine |
| 3607 | Ngd-8243 |
| 3608 | NGX267 |
| 3609 | NGX-4010 |
| 3610 | N-Heptylformamide |
| 3611 | N-Hexadecanoylglycine |
| 3612 | N-Hydroxy 1n(4-Methoxyphenyl)Sulfonyl-4-(Z,E-N-Methoxyimino)Pyrrolidine-2r-Carboxamide |
| 3613 | N-Hydroxy-1-(4-Methoxyphenyl)Sulfonyl-4-Benzyloxycarbonyl-Piperazine-2-Carboxamide |
| 3614 | N-HYDROXY-2(R)-[[(4-METHOXY-PHENYL)SULFONYL](3-PICOLYL)AMINO]-3-METHYLBUTANAMIDE HYDROCHLORIDE |
| 3615 | N-HYDROXY-2-[4-(4-PHENOXY-BENZENESULFONYL)-TETRAHYDRO-PYRAN-4-YL]-ACETAMIDE |
| 3616 | N-hydroxy-4-({4-[4-(trifluoromethyl)phenoxy]phenyl}sulfonyl)tetrahydro-2H-pyran-4-carboxamide |
| 3617 | N-Hydroxy-4-(Methyl{[5-(2-Pyridinyl)-2-Thienyl]Sulfonyl}Amino)Benzamide |
| 3618 | N-Hydroxy-4-[(4-Methoxylphenyl)Sulfonyl]-2,2-Dimethyl-Hexahydro-1,4-Thiazepine-3(S)-Carboxamide |
| 3619 | N-Hydroxy-4-Phosphono-Butanamide |
| 3620 | N-hydroxy-5-[(3-phenyl-5,6-dihydroimidazo[1,2-a]pyrazin-7(8H)-yl)carbonyl]thiophene-2-carboxamide |
| 3621 | Niacin |
| 3622 | Nialamide |
| 3623 | Nicardipine |
| 3624 | Nicergoline |
| 3625 | Niclosamide |
| 3626 | Nicotinamide |
| 3627 | Nicotinamide 8-Bromo-Adenine Dinucleotide Phosphate |
| 3628 | Nicotinamide Mononucleotide |
| 3629 | Nicotine |
| 3630 | Nifedipine |
| 3631 | NiflumicAcid |
| 3632 | Nilotinib |
| 3633 | Nilutamide |
| 3634 | Nilvadipine |
| 3635 | Nimesulide |
| 3636 | Nimodipine |
| 3637 | Nintedanib |
| 3638 | N-ISOBUTYL-N-[4-METHOXYPHENYLSULFONYL]GLYCYL HYDROXAMIC ACID |
| 3639 | Nisoldipine |
| 3640 | N-Isopropyl-N'-Hydroxyguanidine |
| 3641 | Nitazoxanide |
| 3642 | Nitisinone |
| 3643 | Nitrazepam |
| 3644 | Nitrendipine |
| 3645 | Nitric Oxide |
| 3646 | Nitrilotriacetic Acid |
| 3647 | Nitroarginine |
| 3648 | NITROCEFIN |
| 3649 | Nitrocefin Acyl-Serine |
| 3650 | Nitrofural |
| 3651 | Nitrofurantoin |
| 3652 | Nitrofurazone |
| 3653 | Nitroglycerin |
| 3654 | Nitromethyldethia Coenzyme A |
| 3655 | Nitroprusside |
| 3656 | Nitrosoethane |
| 3657 | Nitroxoline |
| 3658 | Nivolumab |
| 3659 | Nizatidine |
| 3660 | Nktr-171 |
| 3661 | N'-L-Seryl-3'-Amino-(3'-Deoxy)-Adenosine |
| 3662 | NM100060 |
| 3663 | NM-702 |
| 3664 | N-METHYL O-NITROPHENYL AMINOETHYLDIPHOSPHATE BERYLLIUM TRIFLUORIDE |
| 3665 | N-METHYL(5-(PYRIDIN-3-YL)FURAN-2-YL)METHANAMINE |
| 3666 | N-METHYL-{4-[2-(7-OXO-6,7-DIHYDRO-8H-[1,3]THIAZOLO[5,4-E]INDOL-8-YLIDENE)HYDRAZINO]PHENYL} METHANESULFONAMIDE |
| 3667 | N-methyl-1-(2-thiophen-2-ylphenyl)methanamine |
| 3668 | N-METHYL-1-[4-(9H-PURIN-6-YL)PHENYL]METHANAMINE |

TABLE 1-continued

Ligands

| Ligand No. | Ligand Name |
|---|---|
| 3669 | N-METHYL-4-{[(2-OXO-1,2-DIHYDRO-3H-INDOL-3-YLIDENE)METHYL]AMINO}BENZENESULFONAMIDE |
| 3670 | N-METHYLALANYL-3-METHYLVALYL-4-PHENOXY-N-(1,2,3,4-TETRAHYDRONAPHTHALEN-1-YL)PROLINAMIDE |
| 3671 | N-Methylleucine |
| 3672 | N-Methylmesoporphyrin |
| 3673 | N-Methylmesoporphyrin Containing Copper |
| 3674 | N-Methyl-N-(10-Methylundecanoyl)-D-Seryl-L-Alanyl-N~1~-[(7s,10s,13s)-13-Carboxy-3,18-Dihydroxy-10-Methyl-8,11-Dioxo-9,12-Diazatricyclo [13.3.1.1~2,6~]Icosa-1(19),2(20),3,5,15,17-Hexaen-7-Yl]-N~1~-Methylglycinamide |
| 3675 | N-Methyl-N-(Methylbenzyl)Formamide |
| 3676 | N-METHYL-N-[(1R)-1-METHYL-2-PHENYLETHYL]PROP-2-EN-1-AMINE |
| 3677 | N-Methyl-N-[3-(6-Phenyl[1,2,4]Triazolo[4,3-B]Pyridazin-3-Yl)Phenyl]Acetamide |
| 3678 | N-Methylnaloxonium |
| 3679 | N-Methyl-N-Propargyl-1(R)-Aminoindan |
| 3680 | N-Methyl-N-Propargyl-3-(2,4-Dichlorophenoxy)Propylamine |
| 3681 | N-Methyl-Pyridoxal-5'-Phosphate |
| 3682 | Nms-1116354 |
| 3683 | Nms-1286937 |
| 3684 | NN344 |
| 3685 | N-Naphthalen-1-Ylmethyl-2'-[3,5-Dimethoxybenzamido]-2'-Deoxy-Adenosine |
| 3686 | nocodazole |
| 3687 | N-Octanoyl-B-D-Fructofuranosyl-a-D-Glucopyranoside, Sucrose Monocaproylate |
| 3688 | N-Octyl-2-Hydroxyethyl Sulfoxide |
| 3689 | Nogalaviketone |
| 3690 | Nojirimycine Tetrazole |
| 3691 | N-Omega-Hydroxy-L-Arginine |
| 3692 | N-Omega-Propyl-L-Arginine |
| 3693 | Nomifensine |
| 3694 | Nonabine |
| 3695 | Nonan-1-Ol |
| 3696 | Norcamphor |
| 3697 | Nordihydroguaiaretic Acid |
| 3698 | Norelgestromin |
| 3699 | Norepinephrine |
| 3700 | Norethindrone |
| 3701 | Norethindrone Acetate |
| 3702 | Norethynodrel |
| 3703 | Norfloxacin |
| 3704 | Norgestimate |
| 3705 | Norgestrel |
| 3706 | Norleucine |
| 3707 | Norleucine Phosphonate |
| 3708 | Nor-N-Omega-Hydroxy-L-Arginine |
| 3709 | Nortriptyline |
| 3710 | Norvaline |
| 3711 | Novo Nordisk a/S Compound |
| 3712 | Novobiocin |
| 3713 | NOX-700 |
| 3714 | N-oxo-2-(phenylsulfonylamino)ethanamide |
| 3715 | N-oxo-2-[(4-phenylphenyl)sulfonylamino]ethanamide |
| 3716 | NP-50301 |
| 3717 | N-phenyl-1H-pyrazole-3-carboxamide |
| 3718 | N-phenyl-1H-pyrrolo[2,3-b]pyridin-3-amine |
| 3719 | NPI 32101 |
| 3720 | N-Propargyl-1(S)-Aminoindan |
| 3721 | N-Propyl Isocyanide |
| 3722 | N-Propyl-Tartramic Acid |
| 3723 | N-Pyridoxyl-1-Amino-Cyclopropanecarboxylic Acid-5-Monophosphate |
| 3724 | N-Pyridoxyl-2-Methylalanine-5-Phosphate |
| 3725 | N-PYRIDOXYL-2-METHYL-L-GLUTAMIC ACID-5'-MONOPHOSPHATE |
| 3726 | N-Pyridoxyl-7-Keto-8-Aminopelargonic Acid-5'-Monophosphate |
| 3727 | N-PYRIDOXYL-D-GLUTAMIC ACID-5'-MONOPHOSPHATE |
| 3728 | N-Pyridoxyl-Glycine-5-Monophosphate |
| 3729 | N'-Pyridoxyl-Lysine-5'-Monophosphate |
| 3730 | N-Pyridoxyl-Threonine-5-Monophosphate |
| 3731 | NRP409 |
| 3732 | Nrx-1074 |
| 3733 | Nrx195183 |
| 3734 | Ns-018 |
| 3735 | N-Succinyl Methionine |
| 3736 | N-Succinyl Phenylglycine |
| 3737 | N-Sulfo-Flavin Mononucleotide |
| 3738 | N-Tridecanoic Acid |
| 3739 | N-Trimethyllysine |
| 3740 | NU1025 |
| 3741 | Nv-128 |
| 3742 | N-Valeric Acid |
| 3743 | Nw-3509 |
| 3744 | NXN-188 |
| 3745 | Nystatin |
| 3746 | Nz-(1-Carboxyethyl)-Lysine |
| 3747 | Nz-(Dicarboxymethyl)-Lysine |
| 3748 | Nz2-Tryptophan |
| 3749 | O-(((1R)-((N-(PHENYL-METHOXY-CARBONYL)-ALANYL)-AMINO)METHYL)HYDROXYPHOSPHINYL)3-L-PHENYLLACTATE |
| 3750 | O-(((1R)-((N-PHENYLMETHOXYCARBONYL-L-ALANYL)AMINO)ETHYL)HYDROXYPHOSPHONO)-L-BENZYLACETIC ACID |
| 3751 | O,O-DIETHYL HYDROGEN THIOPHOSPHATE |
| 3752 | O-[2-(1,3-dioxo-1,3-dihydro-2H-isoindol-2-yl)ethyl] (4-bromophenyl)thiocarbamate |
| 3753 | O-[2-(1,3-dioxo-1,3-dihydro-2H-isoindol-2-yl)ethyl] (4-chlorophenyl)thiocarbamate |
| 3754 | O-[2-(1,3-dioxo-1,3-dihydro-2H-isoindol-2-yl)ethyl] (4-iodophenyl)thiocarbamate |
| 3755 | O1-Methyl-Glucose |
| 3756 | O1-Pentyl-Mannose |
| 3757 | O2-Sulfo-Glucuronic Acid |
| 3758 | O3-Sulfonylgalactose |
| 3759 | O4-Sulfonylgalactose |
| 3760 | O5'-(4-(3-{2-[2-((R)-3-Hydroxy-4-(Trimethylammonio)-1-Oxo-Butyl)Sulfanyl-Ethylcarbamoyl]-Ethylcarbamoyl}-(R)-3-Hydroxy-2,2-Dimethyl-Propyl)-1-Hydroxy-3-Oxido-1,3-Dioxo-2,4-Dioxa-1,3-Diphosphabut-1-Yl) 3'-Phospho-Adenosine |
| 3761 | O6-(R)-ROSCOVITINE, R-2-(6-BENZYLOXY-9-ISOPROPYL-9H-PURIN-2-YLAMINO)-BUTAN-1-OL |
| 3762 | O6-CYCLOHEXYLMETHOXY-2-(4'-SULPHAMOYLANILINO) PURINE |
| 3763 | O-Acetylserine |
| 3764 | OBE101 |
| 3765 | O-Benzylsulfonyl-Serine |
| 3766 | Obeticholic Acid |
| 3767 | Obinutuzumab |
| 3768 | Oc000459 |
| 3769 | Ocriplasmin |
| 3770 | OCTANE-1,3,5,7-TETRACARBOXYLIC ACID |
| 3771 | Octanoyl-Coenzyme A |
| 3772 | Octreotide |
| 3773 | octyl 3-amino-3-deoxy-2-O-(2,6-dideoxy-alpha-L-lyxo-hexopyranosyl)-beta-D-galactopyranoside |
| 3774 | octyl 3-deoxy-2-O-(6-deoxy-alpha-L-galactopyranosyl)-beta-D-xylo-hexopyranoside |
| 3775 | octyl alpha-L-altropyranoside |
| 3776 | octyl beta-D-galactopyranoside |
| 3777 | Octylphenoxy polyethoxyethanol |
| 3778 | O-DECYL HYDROGEN THIOCARBONATE |
| 3779 | Odelepran |
| 3780 | Odm-201 |
| 3781 | Ofatumumab |
| 3782 | Ofloxacin |
| 3783 | OGX-427 |

TABLE 1-continued

Ligands

| Ligand No. | Ligand Name |
|---|---|
| 3784 | Olanzapine |
| 3785 | Olaparib |
| 3786 | Olcegepant |
| 3787 | Oleic Acid |
| 3788 | Olmesartan |
| 3789 | Olmesartan Medoxomil |
| 3790 | Olocrolimus |
| 3791 | Olodaterol |
| 3792 | Olomoucine |
| 3793 | OLOMOUCINE II |
| 3794 | Olopatadine |
| 3795 | Olsalazine |
| 3796 | Omacetaxine Mepesuccinate |
| 3797 | Omalizumab |
| 3798 | Omapatrilat |
| 3799 | Ombitasvir |
| 3800 | omega interferon |
| 3801 | Omega-3-Acid Ethyl Esters |
| 3802 | Omega-3-Carboxylic Acids |
| 3803 | Omeprazole |
| 3804 | Omipalisib |
| 3805 | OMS-103HP |
| 3806 | Oms405 |
| 3807 | Onapristone |
| 3808 | Ondansetron |
| 3809 | Ono-2333ms |
| 3810 | ONO-2506 |
| 3811 | Ono-4059 |
| 3812 | ONO-6818 |
| 3813 | OPC-14523 |
| 3814 | OPC-28326 |
| 3815 | OPC-51803 |
| 3816 | OPC-6535 |
| 3817 | Open Form of 2'-Deoxy-Ribofuranose-5'-Phosphate |
| 3818 | O-Phosphoethanolamine |
| 3819 | oportuzumab monatox |
| 3820 | Oprelvekin |
| 3821 | Orantinib |
| 3822 | Orciprenaline |
| 3823 | Ordopidine |
| 3824 | Oregovomab |
| 3825 | ORG-34517 |
| 3826 | Oritavancin |
| 3827 | Orlistat |
| 3828 | Orotic Acid |
| 3829 | Orphenadrine |
| 3830 | ORTHONITROPHENYL-BETA-D-FUCOPYRANOSIDE |
| 3831 | Orvepitant |
| 3832 | Osanetant |
| 3833 | Oseltamivir |
| 3834 | Osemozotan |
| 3835 | Osi-027 |
| 3836 | OSI-461 |
| 3837 | Osi-632 |
| 3838 | OSI-7904L |
| 3839 | OSI-930 |
| 3840 | O-Sialic Acid |
| 3841 | O-Sialic Acid (Chair Conformation) |
| 3842 | Osimertinib |
| 3843 | OspA lipoprotein |
| 3844 | Ospemifene |
| 3845 | O-Succinylbenzoate |
| 3846 | Otenabant |
| 3847 | Ouabain |
| 3848 | Ovalicin |
| 3849 | Oxacillin |
| 3850 | Oxalic Acid |
| 3851 | Oxaliplatin |
| 3852 | Oxaloacetate Ion |
| 3853 | Oxamic Acid |
| 3854 | Oxamniquine |
| 3855 | Oxandrolone |
| 3856 | Oxaprozin |
| 3857 | Oxazepam |
| 3858 | Oxcarbazepine |
| 3859 | Oxibendazole |
| 3860 | Oxiconazole |
| 3861 | Oxidized Acetyl Dithranol |
| 3862 | Oxidized Coenzyme A |
| 3863 | Oxidized Glutathione Disulfide |
| 3864 | Oxiglutatione |
| 3865 | Oxiranpseudoglucose |
| 3866 | Oxitriptan |
| 3867 | Oxprenolol |
| 3868 | Oxtriphylline |
| 3869 | Oxybate |
| 3870 | Oxybuprocaine |
| 3871 | Oxybutynin |
| 3872 | Oxycodone |
| 3873 | Oxymetazoline |
| 3874 | OxymethoIone |
| 3875 | Oxymorphone |
| 3876 | Oxyphenbutazone |
| 3877 | Oxyphencyclimine |
| 3878 | Oxyphenonium |
| 3879 | Oxypurinol |
| 3880 | Oxytetracycline |
| 3881 | Oxytocin |
| 3882 | Ozarelix |
| 3883 | P-(2'-Iodo-5'-Thenoyl)Hydrotropic Acid |
| 3884 | P1-(5'-Adenosyl)P5-(5'-(3'azido-3'-Deoxythymidyl))Pentaphosphate |
| 3885 | P1-(5'-Adenosyl)P5-(5'-Thymidyl)Pentaphosphate |
| 3886 | P1-(Adenosine-5'-P5-(Uridine-5')Pentaphosphate |
| 3887 | P-1037 |
| 3888 | P54 |
| 3889 | PA-1050040 |
| 3890 | Pa-799 |
| 3891 | Paclitaxel |
| 3892 | Pacritinib |
| 3893 | Pagoclone |
| 3894 | Palbociclib |
| 3895 | Palifermin |
| 3896 | Paliperidone |
| 3897 | Palivizumab |
| 3898 | Palmitic Acid |
| 3899 | Palmitoleic Acid |
| 3900 | Palmitoyl-Linoleoyl Phosphatidylcholine |
| 3901 | Palomid-529 |
| 3902 | Palonosetron |
| 3903 | Palosuran |
| 3904 | Palovarotene |
| 3905 | Pamapimod |
| 3906 | Pamidronate |
| 3907 | Pamidronic Acid |
| 3908 | P-Aminophenyl-Alpha-D-Galactopyranoside |
| 3909 | Pancrelipase |
| 3910 | Pancuronium |
| 3911 | P-Anisic Acid |
| 3912 | Panitumumab |
| 3913 | Panobinostat |
| 3914 | Pantoprazole |
| 3915 | Pantothenic acid |
| 3916 | Pantothenoylaminoethenethiol |
| 3917 | PANTOTHENYL-AMINOETHANOL-11-PIVALIC ACID |
| 3918 | Pantothenyl-Aminoethanol-Acetate Pivalic Acid |
| 3919 | Pantoyl Adenylate |
| 3920 | Panulisib |
| 3921 | Papaverine |
| 3922 | PARA-(BENZOYL)-PHENYLALANINE |
| 3923 | Para-Bromobenzyl Alcohol |
| 3924 | Para-Coumaric Acid |
| 3925 | Para-Iodo-D-Phenylalanine Hydroxamic Acid |
| 3926 | Para-Isopropylaniline |
| 3927 | Para-Mercury-Benzenesulfonic Acid |
| 3928 | Paramethadione |
| 3929 | Paramethasone |

TABLE 1-continued

Ligands

| Ligand No. | Ligand Name |
|---|---|
| 3930 | Paramethasone Acetate |
| 3931 | PARA-NITROBENZYL GLUTARYL GLYCINIC ACID |
| 3932 | PARA-NITROPHENYL 1-THIO-BETA-D-GLUCOPYRANOSIDE |
| 3933 | PARA-NITROPHENYL PHOSPHONOBUTANOYL D-ALANINE |
| 3934 | PARA-NITROPHENYL PHOSPHONOBUTANOYL L-ALANINE |
| 3935 | PARA-NITROPHENYLPHOSPHONOBUTANOYL-GLYCINE |
| 3936 | Parathyroid Hormone |
| 3937 | Para-Toluene Sulfonate |
| 3938 | Parecoxib |
| 3939 | Pargyline |
| 3940 | Paricalcitol |
| 3941 | Paritaprevir |
| 3942 | Paromomycin |
| 3943 | Paroxetine |
| 3944 | PAS219 |
| 3945 | PASBN |
| 3946 | Pasireotide |
| 3947 | Patidegib |
| 3948 | Patiromer Calcium |
| 3949 | Pazopanib |
| 3950 | Pbf-509 |
| 3951 | Pbf-680 |
| 3952 | Pbf-999 |
| 3953 | PCK3145 |
| 3954 | PCL-016 |
| 3955 | PCNOTAXIME GROUP |
| 3956 | P-Cresol |
| 3957 | Pd-0166285 |
| 3958 | Pd-0325901 |
| 3959 | PD150606 |
| 3960 | PD173955 |
| 3961 | PDE4 |
| 3962 | Pefcalcitol |
| 3963 | Peficitinib |
| 3964 | Pefloxacin |
| 3965 | Pegademase bovine |
| 3966 | Pegaptanib |
| 3967 | Pegaptanib Sodium |
| 3968 | Pegaspargase |
| 3969 | Pegfilgrastim |
| 3970 | Peginesatide |
| 3971 | Peginesatide Acetate |
| 3972 | Peginterferon alfa-2a |
| 3973 | Peginterferon alfa-2b |
| 3974 | Peginterferon Beta-1a |
| 3975 | Pegloticase |
| 3976 | PEG-uricase |
| 3977 | Pegvisomant |
| 3978 | Peldesine |
| 3979 | Pelitinib |
| 3980 | Pembrolizumab |
| 3981 | Pemetrexed |
| 3982 | Pemirolast |
| 3983 | Pemoline |
| 3984 | Penbutolol |
| 3985 | Penciclovir |
| 3986 | Penicillamine |
| 3987 | Penicillin G Acyl-Serine |
| 3988 | Penicillin V |
| 3989 | Pentagastrin |
| 3990 | Pentamidine |
| 3991 | Pentanal |
| 3992 | Pentane-1,5-Diamine |
| 3993 | Pentasulfide-Sulfur |
| 3994 | Pentazocine |
| 3995 | Pentetic Acid |
| 3996 | Pentobarbital |
| 3997 | Pentolinium |
| 3998 | Pentosan Polysulfate |
| 3999 | Pentosan Polysulfate Sodium |
| 4000 | Pentostatin |
| 4001 | Pentoxifylline |
| 4002 | Peramivir |
| 4003 | Perampanel |
| 4004 | Perchlorate Ion |
| 4005 | Pergolide |
| 4006 | Perhexiline |
| 4007 | Perindopril |
| 4008 | Permethrin |
| 4009 | Perphenazine |
| 4010 | Pertuzumab |
| 4011 | Pethidine |
| 4012 | Pexacerfont |
| 4013 | Pexmetinib |
| 4014 | Pf-00337210 |
| 4015 | PF-00356231 |
| 4016 | Pf-00446687 |
| 4017 | Pf-00477736 |
| 4018 | Pf-03446962 |
| 4019 | Pf-03654746 |
| 4020 | Pf-03654764 |
| 4021 | Pf-03715455 |
| 4022 | Pf-03758309 |
| 4023 | Pf-03814735 |
| 4024 | Pf-03882845 |
| 4025 | Pf-03893787 |
| 4026 | Pf-04217903 |
| 4027 | Pf-04531083 |
| 4028 | Pf-04634817 |
| 4029 | Pf-04691502 |
| 4030 | Pf-04965842 |
| 4031 | Pf-05019702 |
| 4032 | Pf-05089771 |
| 4033 | Pf-05212377 |
| 4034 | Pf-06291874 |
| 4035 | Pf-562271 |
| 4036 | PG-530742 |
| 4037 | Pg-760564 |
| 4038 | PH-284 |
| 4039 | Ph-797804 |
| 4040 | Pha-543613 |
| 4041 | Pha-793887 |
| 4042 | Phe377 |
| 4043 | Phenacemide |
| 4044 | Phenacetin |
| 4045 | Phenazopyridine |
| 4046 | Phencyclidine |
| 4047 | Phendimetrazine |
| 4048 | Phenelzine |
| 4049 | Phenformin |
| 4050 | Phenindamine |
| 4051 | Phenindione |
| 4052 | Pheniramine |
| 4053 | Phenmetrazine |
| 4054 | Phenobarbital |
| 4055 | Phenol |
| 4056 | Phenolphthalein |
| 4057 | Phenoxodiol |
| 4058 | Phenoxybenzamine |
| 4059 | Phenoxymethylpenicillin |
| 4060 | Phenprocoumon |
| 4061 | Phenserine |
| 4062 | Phensuximide |
| 4063 | Phentermine |
| 4064 | Phentolamine |
| 4065 | Phenyl Aminosalicylate |
| 4066 | Phenyl Boronic Acid |
| 4067 | phenyl ethenesulfonate |
| 4068 | PHENYL[1-(N-SUCCINYLAMINO)PENTYL]PHOSPHONATE |
| 4069 | PHENYL-5-(1H-PYRAZOL-3-YL)-1,3-THIAZOLE |
| 4070 | Phenylacetaldehyde |
| 4071 | PHENYLALANINDIOL |
| 4072 | Phenylalanine Amide |

TABLE 1-continued

| Ligand No. | Ligand Name |
|---|---|
| 4073 | PHENYLALANINE BORONIC ACID |
| 4074 | Phenylalanine-N-Sulfonamide |
| 4075 | PHENYLALANYLAMINODI(ETHYLOXY)ETHYL BENZENESULFONAMIDEAMINOCARBONYL-BENZENESULFONAMIDE |
| 4076 | Phenylalanylmethane |
| 4077 | PHENYLALANYLMETHYLCHLORIDE |
| 4078 | PHENYLAMINOIMIDAZO(1,2-ALPHA)PYRIDINE |
| 4079 | Phenylbutanoic Acid |
| 4080 | Phenylbutazone |
| 4081 | Phenylephrine |
| 4082 | Phenylethane Boronic Acid |
| 4083 | Phenylferricrocin-Iron |
| 4084 | Phenylphosphate |
| 4085 | Phenylpropanolamine |
| 4086 | Phenyl-Uridine-5'-Diphosphate |
| 4087 | Phenytoin |
| 4088 | Phosphatidyl ethanol |
| 4089 | Phosphatidylethanolamine |
| 4090 | Phosphatidylserine |
| 4091 | Phosphoaminophosphonic Acid Guanylate Ester |
| 4092 | Phosphoaminophosphonic Acid-Adenylate Ester |
| 4093 | Phosphoaspartate |
| 4094 | Phosphocholine |
| 4095 | Phosphoenolpyruvate |
| 4096 | Phosphoglycolohydroxamic Acid |
| 4097 | Phosphomethylphosphonic Acid Adenosyl Ester |
| 4098 | Phosphomethylphosphonic Acid Guanosyl Ester |
| 4099 | Phosphomethylphosphonic Acid Guanylate Ester |
| 4100 | Phosphomethylphosphonic Acid-Guanylate Ester |
| 4101 | PHOSPHONIC ACID 2-DODECANOYLAMINO-HEXYL ESTER PROPYL ESTER |
| 4102 | Phosphonoacetaldehyde |
| 4103 | Phosphonoacetic Acid |
| 4104 | Phosphonoacetohydroxamic Acid |
| 4105 | Phosphonopyruvate |
| 4106 | Phosphonoserine |
| 4107 | Phosphonothreonine |
| 4108 | Phosphonotyrosine |
| 4109 | Phosphoramidon |
| 4110 | Phosphoribosyl Atp |
| 4111 | Phosphoric Acid Mono-[2-Amino-3-(3h-Imidazol-4-Yl)-Propyl]Ester |
| 4112 | Phosphoric Acid Mono-[3,4-Dihydroxy-5-(5-Hydroxy-Benzoimidazol-1-Yl)Tetrahydro-Furan-2-Ylmethyl] Ester |
| 4113 | Phosphoric Acid Mono-[3-Amino-5-(5-Methyl-2,4-Dioxo-3,4-Dihydro-2h-Pyrimidin-1-Yl)-Tetrahydro-Furan-2-Ylmethyl] Ester |
| 4114 | Phosphoric Acid Mono-[3-Fluoro-5-(5-Methyl-2,4-Dioxo-3,4-Dihydro-2h-Pyrimidin-1-Yl)-Tetrahyro-Furan-2-Ylmethyl] Ester |
| 4115 | Phosphoric Acid-2'-[2'-Deoxy-Uridine]Ester-5'-Guanosine Ester |
| 4116 | Phosphorylated Dihydropteroate |
| 4117 | Phosphorylisopropane |
| 4118 | Phosphothiophosphoric Acid-Adenylate Ester |
| 4119 | Phosporic Acid Mono-[3,4-Dihydroxy-5-(5-Methoxy-Benzoimidazol-1-Yl)-Tetrahydro-Furan-2-Ylmethyl] Ester |
| 4120 | Phthalic Acid |
| 4121 | PHX1149 |
| 4122 | P-Hydroxybenzoic Acid |
| 4123 | Phylloquinone |
| 4124 | Physostigmine |
| 4125 | Piboserod |
| 4126 | PICEATANNOL |
| 4127 | Piclamilast |
| 4128 | Piclozotan |
| 4129 | Picropodophyllotoxin |
| 4130 | Picrotoxin |
| 4131 | Pictilisib |
| 4132 | Pilaralisib |
| 4133 | Pilocarpine |
| 4134 | pimagedine HCl |
| 4135 | Pimasertib |
| 4136 | Pimavanserin |
| 4137 | Pimecrolimus |
| 4138 | Pimelic Acid |
| 4139 | Pimozide |
| 4140 | Pinacidil |
| 4141 | Pinacol[[2-Amino-Alpha-(1-Carboxy-1-Methylethoxyimino)-4-Thiazoleacetyl]Amino]Methaneboronate |
| 4142 | Pindolol |
| 4143 | Pioglitazone |
| 4144 | Pipecuronium |
| 4145 | Piperacetazine |
| 4146 | Piperacillin |
| 4147 | Piperaquine |
| 4148 | Piperazine |
| 4149 | Piperazine Citrate |
| 4150 | PIPERIDINE-2-CARBOXYLIC ACID TERT-BUTYLAMIDE |
| 4151 | Piperonyl Butoxide |
| 4152 | Pipobroman |
| 4153 | Pipotiazine |
| 4154 | Pirbuterol |
| 4155 | Pirenzepine |
| 4156 | Piretanide |
| 4157 | Pirfenidone |
| 4158 | Piroxicam |
| 4159 | Pitavastatin |
| 4160 | Pivampicillin |
| 4161 | Pivmecillinam |
| 4162 | Pki-166 |
| 4163 | Pki-179 |
| 4164 | Pl-225b |
| 4165 | Plasmin |
| 4166 | Platelet Activating Factor |
| 4167 | PLATENSIMYCIN |
| 4168 | Pleconaril |
| 4169 | Plerixafor |
| 4170 | Plicamycin |
| 4171 | Plx-3397 |
| 4172 | PLX4032 |
| 4173 | Plx-5622 |
| 4174 | Plx-7486 |
| 4175 | Plx-8394 |
| 4176 | Pmp-Hydroxyisoxazole, Pyridoxamine-5-Phosphate-Hydroxyisoxazole |
| 4177 | PN0621 |
| 4178 | P-Nitrophenol |
| 4179 | PNU177836 |
| 4180 | Podofilox |
| 4181 | Pol6326 |
| 4182 | Polidocanol |
| 4183 | Polyestradiol Phosphate |
| 4184 | Polymyxin B |
| 4185 | Polythiazide |
| 4186 | Pomaglumetad Methionil |
| 4187 | Pomalidomide |
| 4188 | Ponatinib |
| 4189 | Poractant Alfa |
| 4190 | Porfimer |
| 4191 | Porfimer Sodium |
| 4192 | Porphobilinogen |
| 4193 | Porphyrin Fe(Iii) |
| 4194 | Posaconazole |
| 4195 | Potassium |
| 4196 | Potassium Chloride |
| 4197 | Potassium Iodide |
| 4198 | Potassium Sulfate |
| 4199 | Pozanicline |
| 4200 | Poziotinib |
| 4201 | PPI-2458 |
| 4202 | Practolol |
| 4203 | Pradefovir Mesylate |
| 4204 | Pralatrexate |
| 4205 | Pralidoxime |
| 4206 | Pralnacasan |

TABLE 1-continued

Ligands

| Ligand No. | Ligand Name |
|---|---|
| 4207 | Pramipexole |
| 4208 | Pramlintide |
| 4209 | Pramlintide Acetate |
| 4210 | Pramoxine |
| 4211 | Pranlukast |
| 4212 | Prasugrel |
| 4213 | Pratosartan |
| 4214 | Pravastatin |
| 4215 | Prazepam |
| 4216 | Praziquantel |
| 4217 | Prazosin |
| 4218 | Prednicarbate |
| 4219 | Prednisolone |
| 4220 | Prednisolone Acetate |
| 4221 | Prednisolone Phosphoric Acid |
| 4222 | Prednisolone Tebutate |
| 4223 | Prednisone |
| 4224 | Pregabalin |
| 4225 | Pregnenolone |
| 4226 | Preladenant |
| 4227 | Prenylamine |
| 4228 | Preotact |
| 4229 | PREPHENIC ACID |
| 4230 | Pridopidine |
| 4231 | Prilocaine |
| 4232 | Primaquine |
| 4233 | Primidone |
| 4234 | Prinaberel |
| 4235 | PRLX 93936 |
| 4236 | PRO-542 |
| 4237 | Probenecid |
| 4238 | Probucol |
| 4239 | Procainamide |
| 4240 | Procaine |
| 4241 | Procaine Benzylpenicillin |
| 4242 | Procarbazine |
| 4243 | Procaterol |
| 4244 | Prochlorperazine |
| 4245 | Procyclidine |
| 4246 | Proellex |
| 4247 | Proflavine |
| 4248 | Progabide |
| 4249 | Progesterone |
| 4250 | PROGESTERONE-11-ALPHA-OL-HEMISUCCINATE |
| 4251 | Proguanil |
| 4252 | Proline Betaine |
| 4253 | Promazine |
| 4254 | Promethazine |
| 4255 | Propafenone |
| 4256 | Propanoic Acid |
| 4257 | Propantheline |
| 4258 | Proparacaine |
| 4259 | Propericiazine |
| 4260 | Propidium |
| 4261 | Propiomazine |
| 4262 | Propionyl Coenzyme A |
| 4263 | Propofol |
| 4264 | Propoxycaine |
| 4265 | Propoxyphene |
| 4266 | Propranolol |
| 4267 | Propyl Acetate |
| 4268 | Propylhexedrine |
| 4269 | Propylthiouracil |
| 4270 | Prostaglandin G2 |
| 4271 | Protamine Sulfate |
| 4272 | Protease |
| 4273 | Protirelin |
| 4274 | Protokylol |
| 4275 | Protoporphyrin Ix |
| 4276 | Protoporphyrin Ix Containing Co |
| 4277 | Protoporphyrin Ix Containing Zn |
| 4278 | Protriptyline |
| 4279 | Prs-211375 |
| 4280 | Prt-2607 |
| 4281 | Prucalopride |
| 4282 | Prussian Blue Insoluble |
| 4283 | Pruvanserin |
| 4284 | PS433540 |
| 4285 | Ps-516895 |
| 4286 | Ps-540446 |
| 4287 | Pseudoephedrine |
| 4288 | PSN357 |
| 4289 | PSN9301 |
| 4290 | Pterin Cytosine Dinucleotide |
| 4291 | Pterin-6-Yl-Methyl-Monophosphate |
| 4292 | Pteroic Acid |
| 4293 | PTI-901 |
| 4294 | Puquitinib |
| 4295 | Purine Riboside |
| 4296 | Purine Riboside-5'-Monophosphate |
| 4297 | Puromycin |
| 4298 | PUROMYCIN AMINONUCLEOSIDE-5'-MONOPHOSPHATE |
| 4299 | Purvalanol |
| 4300 | Purvalanol A |
| 4301 | Putrescine |
| 4302 | Pwt-33579 |
| 4303 | Pwt-33587 |
| 4304 | Px-102 |
| 4305 | PX-12 |
| 4306 | Pyoverdine-Chromophore |
| 4307 | Pyrazinamide |
| 4308 | Pyrazole |
| 4309 | Pyrethrins |
| 4310 | Pyridostigmine |
| 4311 | Pyridoxal |
| 4312 | Pyridoxal Phosphate |
| 4313 | Pyridoxal-5'-Phosphate-N-Oxide |
| 4314 | Pyridoxamine-5'-Phosphate |
| 4315 | Pyridoxine |
| 4316 | Pyridoxine-5'-Phosphate |
| 4317 | Pyridoxyl-Alanine-5-Phosphate |
| 4318 | Pyridoxyl-Glutamic Acid-5'-Monophosphate |
| 4319 | Pyridoxyl-N,O-Cycloserylamide-5-Monophosphate |
| 4320 | Pyrilamine |
| 4321 | Pyrimethamine |
| 4322 | PYRIMIDINE-4,6-DICARBOXYLIC ACID BIS-(3-METHYL-BENZYLAMIDE) |
| 4323 | PYRIMIDINE-4,6-DICARBOXYLIC ACID BIS-(4-FLUORO-3-METHYL-BENZYLAMIDE) |
| 4324 | PYRIMIDINE-4,6-DICARBOXYLIC ACID BIS-[(PYRIDIN-3-YLMETHYL)-AMIDE] |
| 4325 | Pyrithiamine Pyrophosphate |
| 4326 | Pyrithione |
| 4327 | Pyroglutamic Acid |
| 4328 | Pyromellitic Acid |
| 4329 | Pyronaridine |
| 4330 | Pyrotinib |
| 4331 | Pyrrole-2-Carboxylate |
| 4332 | Pyrroloquinoline Quinone |
| 4333 | Pyruvic acid |
| 4334 | Pyruvoyl Group |
| 4335 | Pyrvinium |
| 4336 | Qaf805 |
| 4337 | Qav680 |
| 4338 | Qbw251 |
| 4339 | Qc-12 |
| 4340 | Quazepam |
| 4341 | Quercetin |
| 4342 | Quetiapine |
| 4343 | Quinacrine |
| 4344 | Quinaldic Acid |
| 4345 | Quinapril |
| 4346 | Quinestrol |
| 4347 | Quinethazone |
| 4348 | Quinidine |
| 4349 | Quinidine barbiturate |

TABLE 1-continued

Ligands

| Ligand No. | Ligand Name |
|---|---|
| 4350 | Quinidine Polygalacturonate |
| 4351 | Quinine |
| 4352 | Quinolinic Acid |
| 4353 | Quinonoid 7,8-Tetrahydrobiopterin |
| 4354 | Quinupristin |
| 4355 | Quisqualate |
| 4356 | Quizartinib |
| 4357 | R048-8071 |
| 4358 | R-1,2-Propanediol |
| 4359 | R-112 |
| 4360 | R115777 |
| 4361 | R1295 |
| 4362 | R-1487 |
| 4363 | R-1530 |
| 4364 | R1626 |
| 4365 | R-2-{[4'-Methoxy-(1,1'-Biphenyl)-4-Yl]-Sulfonyl}-Amino-6-Methoxy-Hex-4-Ynoic Acid |
| 4366 | R-333 |
| 4367 | R-343 |
| 4368 | R-348 |
| 4369 | R-3-FLUORO-4-[2-HYDROXY-2-(5,5,8,8-TETRAMETHYL-5,6,7,8,-TETRAHYDRO-NAPHTALEN-2-YL)-ACETYLAMINO]-BENZOIC ACID |
| 4370 | R411 |
| 4371 | R428 |
| 4372 | R450 |
| 4373 | R-547 |
| 4374 | R667 |
| 4375 | R673 |
| 4376 | Rabeprazole |
| 4377 | Rabusertib |
| 4378 | Rad1901 |
| 4379 | Radicicol |
| 4380 | Radiprodil |
| 4381 | Radium Dichloride |
| 4382 | Rafabegron |
| 4383 | Ralfinamide |
| 4384 | Ralimetinib |
| 4385 | Ralinepag |
| 4386 | Raloxifene |
| 4387 | RALOXIFENE CORE |
| 4388 | Raltegravir |
| 4389 | Raltitrexed |
| 4390 | Ramelteon |
| 4391 | Ramipril |
| 4392 | Ramucirumab |
| 4393 | Ranibizumab |
| 4394 | Ranitidine |
| 4395 | Ranolazine |
| 4396 | Rapacuronium |
| 4397 | Rapastinel |
| 4398 | Rasagiline |
| 4399 | Rasburicase |
| 4400 | Raseglurant |
| 4401 | *Rauwolfia Serpentina* |
| 4402 | Raxatrigine |
| 4403 | Raxibacumab |
| 4404 | RB106 |
| 4405 | Rbt205 Inhibitor |
| 4406 | RDEA806 |
| 4407 | Rebastinib |
| 4408 | Reboxetine |
| 4409 | Recilisib |
| 4410 | Recombinant alpha 1-antitrypsin |
| 4411 | recombinant human GM-CSF |
| 4412 | Refametinib |
| 4413 | Regadenoson |
| 4414 | Reglixane |
| 4415 | Regorafenib |
| 4416 | Regrelor |
| 4417 | Reidispongiolide A |
| 4418 | Reidispongiolide C |
| 4419 | REL-(9R,12S)-9,10,11,12-TETRAHYDRO-9,12-EPOXY-1H-DIINDOLO[1,2,3-FG:3',2',1'-KL]PYRROLO[3,4-l][1,6]BENZODIAZOCINE-1,3(2H)-DIONE |
| 4420 | Relcovaptan |
| 4421 | Relugolix |
| 4422 | Remifentanil |
| 4423 | Remikiren |
| 4424 | Reminertant |
| 4425 | Remoxipride |
| 4426 | Renzapride |
| 4427 | REP8839 |
| 4428 | Repaglinide |
| 4429 | Reparixin |
| 4430 | Rescinnamine |
| 4431 | Reserpine |
| 4432 | Resveratrol |
| 4433 | Retapamulin |
| 4434 | Reteplase |
| 4435 | Retosiban |
| 4436 | REV131 |
| 4437 | Revexepride |
| 4438 | Rg-1507 |
| 4439 | Rg-1530 |
| 4440 | Rg1662 |
| 4441 | Rg3487 |
| 4442 | Rg-547 |
| 4443 | Rg-7167 |
| 4444 | Rg7185 |
| 4445 | Rg-7256 |
| 4446 | Rg-7304 |
| 4447 | Rg7314 |
| 4448 | Rg7342 |
| 4449 | Rg-7376 |
| 4450 | Rg-7420 |
| 4451 | Rg-7602 |
| 4452 | Rg-7603 |
| 4453 | Rg-7666 |
| 4454 | Rg-7741 |
| 4455 | Rgb-286638 |
| 4456 | rhIGFBP-3 |
| 4457 | RHIIP |
| 4458 | Rhodamine 6g |
| 4459 | RI 624 |
| 4460 | Ribavirin |
| 4461 | Ribavirin Monophosphate |
| 4462 | Ribociclib |
| 4463 | Riboflavin |
| 4464 | Riboflavin 5'-Phosphate |
| 4465 | Riboflavin Monophosphate |
| 4466 | Ribose |
| 4467 | Ribose-1-Phosphate |
| 4468 | Ribose-5-Phosphate |
| 4469 | Ribostamycin |
| 4470 | Ribulose-5-Phosphate |
| 4471 | Ridogrel |
| 4472 | Rifabutin |
| 4473 | Rifampicin |
| 4474 | Rifamycin Cgp 4832 |
| 4475 | Rifapentine |
| 4476 | Rifaximin |
| 4477 | Rigosertib |
| 4478 | Rilonacept |
| 4479 | Rilpivirine |
| 4480 | Riluzole |
| 4481 | Rimantadine |
| 4482 | Rimegepant |
| 4483 | Rimexolone |
| 4484 | Rimonabant |
| 4485 | Riociguat |
| 4486 | Risedronate |
| 4487 | Risedronic Acid |
| 4488 | Risperidone |
| 4489 | Ritobegron |
| 4490 | Ritodrine |

TABLE 1-continued

Ligands

| Ligand No. | Ligand Name |
|---|---|
| 4491 | Ritonavir |
| 4492 | Rituximab |
| 4493 | Rivanicline |
| 4494 | Rivaroxaban |
| 4495 | Rivastigmine |
| 4496 | Rivenprost |
| 4497 | Riviciclib |
| 4498 | Rivoglitazone |
| 4499 | Rizatriptan |
| 4500 | Ro-3201195 |
| 4501 | Ro-4987655 |
| 4502 | Robalzotan |
| 4503 | Rociletinib |
| 4504 | Rocuronium |
| 4505 | Rofecoxib |
| 4506 | Roflumilast |
| 4507 | Rolapitant |
| 4508 | Rolicyclidine |
| 4509 | Rolitetracycline |
| 4510 | Rolofylline |
| 4511 | Romidepsin |
| 4512 | Romiplostim |
| 4513 | ronacaleret |
| 4514 | Roniciclib |
| 4515 | Ropinirole |
| 4516 | Ropivacaine |
| 4517 | Rosiglitazone |
| 4518 | Rosoxacin |
| 4519 | Rosuvastatin |
| 4520 | Rotigotine |
| 4521 | ROX-888 |
| 4522 | Roxatidine acetate |
| 4523 | Roxithromycin |
| 4524 | RP101 |
| 4525 | Rp-6530 |
| 4526 | RPI-78M |
| 4527 | RPR128515 |
| 4528 | RPR131247 |
| 4529 | Rpr749 |
| 4530 | R-Styrene Oxide |
| 4531 | RTA 744 |
| 4532 | RU78191 |
| 4533 | RU78262 |
| 4534 | RU78299 |
| 4535 | RU78300 |
| 4536 | RU78783 |
| 4537 | RU79072 |
| 4538 | RU79073 |
| 4539 | RU79256 |
| 4540 | RU81843 |
| 4541 | RU82129 |
| 4542 | RU82197 |
| 4543 | RU82209 |
| 4544 | RU83876 |
| 4545 | RU84687 |
| 4546 | RU85053 |
| 4547 | RU85493 |
| 4548 | RU90395 |
| 4549 | Ruboxistaurin |
| 4550 | Rufinamide |
| 4551 | Rutin |
| 4552 | Ruxolitinib |
| 4553 | RWJ-51084 |
| 4554 | Rwj-67657 |
| 4555 | Rxdx-101 |
| 4556 | Rxdx-103 |
| 4557 | S-(2-{[N-(2-HYDROXY-4-{[HYDROXY(OXIDO)PHOSPHINO]OXY}-3,3-DIMETHYLBUTANOYL)-BETA-ALANYL]AMINO}ETHYL) HEPTANETHIOATE |
| 4558 | S-(2-{[N-(2-HYDROXY-4-{[HYDROXY(OXIDO)PHOSPHINO]OXY}-3,3-DIMETHYLBUTANOYL)-BETA-ALANYL]AMINO} ETHYL)HEXANETHIOATE |
| 4559 | S-(2-Oxo)Pentadecylcoa |
| 4560 | S-(4-BROMOBENZYL)CYSTEINE |
| 4561 | S-(D-Carboxybutyl)-L-Homocysteine |
| 4562 | S-(Dimethylarsenic)Cysteine |
| 4563 | S-(Methylmercury)-L-Cysteine |
| 4564 | S-(N-Hydroxy-N-Bromophenylcarbamoyl)Glutathione |
| 4565 | S-(N-Hydroxy-N-Iodophenylcarbamoyl)Glutathione |
| 4566 | S-(P-Nitrobenzyl)Glutathione |
| 4567 | S,S'-(1,3-Phenylene-Bis(1,2-Ethanediyl))Bis-Isothiourea |
| 4568 | S,S'-(1,4-Phenylene-Bis(1,2-Ethanediyl))Bis-Isothiourea |
| 4569 | S,S-(2-Hydroxyethyl)Thiocysteine |
| 4570 | S,S-Propylthiocysteine |
| 4571 | S-[(2E)-3,7-DIMETHYLOCTA-2,6-DIENYL]TRIHYDROGENTHIODIPHOSPHATE |
| 4572 | S-[2-({N-[(2S)-2-hydroxy-3,3-dimethyl-4-(phosphonooxy)butanoyl]-beta-alanyl}amino)ethyl] hexanethioate |
| 4573 | S-[2-({N-[(2S)-2-hydroxy-3,3-dimethyl-4-(phosphonooxy)butanoyl]-beta-alanyl}amino)ethyl] octanethioate |
| 4574 | S-[3-(3,4-DICHLOROPHENYL)-3-OXOPROPYL]-L-CYSTEINE |
| 4575 | S-[5-(TRIFLUOROMETHYL)-4H-1,2,4-TRIAZOL-3-YL]5-(PHENYLETHYNYL)FURAN-2-CARBOTHIOATE |
| 4576 | S-{2-[(2-chloro-4-sulfamoylphenyl)amino]-2-oxoethyl} 6-methyl-3,4-dihydroquinoline-1(2H)-carbothioate |
| 4577 | S-{2-[Amino(Dihydroxy)-Lambda~4~-Sulfanyl]Ethyl}-D-Cysteine |
| 4578 | S-{3-[(4-ANILINOQUINAZOLIN-6-YL)AMINO]-3-OXOPROPYL}-L-CYSTEINE |
| 4579 | S-1,2-Propanediol |
| 4580 | S-2-(Boronoethyl)-L-Cysteine |
| 4581 | S-222611 |
| 4582 | S-237648 |
| 4583 | S-3-(4-FLUOROPHENOXY)-2-HYDROXY-2-METHYL-N-[4-NITRO-3-(TRIFLUOROMETHYL)PHENYL]PROPANAMIDE |
| 4584 | S-4-Nitrobutyryl-Coa |
| 4585 | S-8184 |
| 4586 | S-Acetyl-Cysteine |
| 4587 | Sacrosidase |
| 4588 | Sacubitril |
| 4589 | Sad448 |
| 4590 | S-Adenosyl-1,8-Diamino-3-Thiooctane |
| 4591 | S-Adenosyl-L-Homocysteine |
| 4592 | S-Adenosyl-L-Homoselenocysteine |
| 4593 | S-Adenosylmethionine |
| 4594 | Saf312 |
| 4595 | Safotibant |
| 4596 | Salbutamol |
| 4597 | Salicylate-sodium |
| 4598 | Salicylic acid |
| 4599 | Salmeterol |
| 4600 | Salmon Calcitonin |
| 4601 | Salophen iron chelate |
| 4602 | Salophen-10-carboxylate iron chelate |
| 4603 | SALOPHEN-10-PROPIONATE IRON CHELATE |
| 4604 | Salsalate |
| 4605 | Samarium(Ii) Lexidronam |
| 4606 | Samidorphan |
| 4607 | Sapitinib |
| 4608 | Saprisartan |
| 4609 | Sapropterin |
| 4610 | Saquinavir |
| 4611 | Sar-103168 |
| 4612 | Sar-113945 |
| 4613 | Sar-125844 |
| 4614 | Sar-260301 |
| 4615 | Sar-407899 |
| 4616 | Sar425899 |

TABLE 1-continued

Ligands

| Ligand No. | Ligand Name |
|---|---|
| 4617 | Saracatinib |
| 4618 | Saralasin |
| 4619 | Sargramostim |
| 4620 | Sarizotan |
| 4621 | S-Arsonocysteine |
| 4622 | Satavaptan |
| 4623 | S-Atrolactic Acid |
| 4624 | Savolitinib |
| 4625 | Saxagliptin |
| 4626 | SB220025 |
| 4627 | SB-559448 |
| 4628 | Sb-649868 |
| 4629 | Sb-705498 |
| 4630 | Sb-742457 |
| 4631 | Sb-773812 |
| 4632 | Sb-85635 |
| 4633 | SB939 |
| 4634 | S-Benzyl-Glutathione |
| 4635 | S-Butyryl-Cystein |
| 4636 | SC12267 |
| 4637 | SC-74020 |
| 4638 | Sc-80036 |
| 4639 | SCH-530348 |
| 4640 | Sch-900776 |
| 4641 | Scio-323 |
| 4642 | SCIO-469 |
| 4643 | Scopolamine |
| 4644 | SCV-07 |
| 4645 | Sd-0006 |
| 4646 | SD118 |
| 4647 | SD146 |
| 4648 | S-Dioxymethionine |
| 4649 | Sdx-101 |
| 4650 | SEBACIC ACID |
| 4651 | Sebelipase Alfa |
| 4652 | Secobarbital |
| 4653 | Secretin |
| 4654 | Secretin Synthetic Human |
| 4655 | Secretin Synthetic Porcine |
| 4656 | Secukinumab |
| 4657 | Se-Ethyl-Isoselenourea |
| 4658 | Selegiline |
| 4659 | Selenazole-4-Carboxyamide-Adenine Dinucleotide |
| 4660 | Selenium Sulfide |
| 4661 | Selenocysteine |
| 4662 | Selenoinosine |
| 4663 | Selepressin |
| 4664 | Selexipag |
| 4665 | Seliciclib |
| 4666 | Selodenoson |
| 4667 | Selumetinib |
| 4668 | Selurampanel |
| 4669 | Semaglutide |
| 4670 | Semapimod |
| 4671 | Semaxanib |
| 4672 | Senicapoc |
| 4673 | Seocalcitol |
| 4674 | Seractide Acetate |
| 4675 | Serelaxin |
| 4676 | Seridopidine |
| 4677 | Serine Vanadate |
| 4678 | Serlopitant |
| 4679 | Sermorelin |
| 4680 | Sermorelin Acetate |
| 4681 | Sertaconazole |
| 4682 | Sertindole |
| 4683 | Sertraline |
| 4684 | Serum albumin iodonated |
| 4685 | S-Ethylisothiourea |
| 4686 | S-Ethyl-N-[4-(Trifluoromethyl)Phenyl]Isothiourea |
| 4687 | S-Ethyl-N-Phenyl-Isothiourea |
| 4688 | Setipiprant |
| 4689 | Setmelanotide |
| 4690 | Sevelamer |
| 4691 | Sevelamer Hydrochloride |
| 4692 | Sevoflurane |
| 4693 | SF1126 |
| 4694 | Sf-1126 |
| 4695 | Sgi-1776 |
| 4696 | SGN-30 |
| 4697 | SGS518 |
| 4698 | SGS742 |
| 4699 | Sgx-523 |
| 4700 | S-Hexylglutathione |
| 4701 | Shikimate-3-Phosphate |
| 4702 | S-Hydroxycysteine |
| 4703 | S-Hydroxymethyl Glutathione |
| 4704 | Sibutramine |
| 4705 | Sildenafil |
| 4706 | Silmitasertib |
| 4707 | Silodosin |
| 4708 | Siltuximab |
| 4709 | Simeprevir |
| 4710 | Simethicone |
| 4711 | Simotinib |
| 4712 | Simvastatin |
| 4713 | SINAPINATE |
| 4714 | Sinapoyl Coenzyme A |
| 4715 | Sinecatechins |
| 4716 | Siponimod |
| 4717 | Sipuleucel-T |
| 4718 | Siroheme |
| 4719 | Sirolimus |
| 4720 | S-Isopropyl-Isothiourea |
| 4721 | Sitagliptin |
| 4722 | Sitaxentan |
| 4723 | Skf 107457 |
| 4724 | SLV306 |
| 4725 | SLV308 |
| 4726 | SLV319 |
| 4727 | Smc021 |
| 4728 | S-Mercaptocysteine |
| 4729 | S-Methyl Phosphocysteine |
| 4730 | S-Methyl Thiocysteine Group |
| 4731 | S-METHYL-4,5,6,7-TETRABROMO-BENZIMIDAZOLE |
| 4732 | S-Methylcysteine |
| 4733 | S-METHYL-GLUTATHIONE |
| 4734 | S-NONYL-CYSTEINE |
| 4735 | Sns-314 |
| 4736 | SNX-5422 |
| 4737 | SO-101 |
| 4738 | S-Octylglutathione |
| 4739 | Sodelglitazar |
| 4740 | Sodium Benzoate |
| 4741 | Sodium Phenylacetate |
| 4742 | Sodium Phosphate |
| 4743 | Sodium stibogluconate |
| 4744 | Sodium Tetradecyl Sulfate |
| 4745 | Sofinicline |
| 4746 | Sofosbuvir |
| 4747 | Solabegron |
| 4748 | Solcitinib |
| 4749 | Solifenacin |
| 4750 | Somatrem |
| 4751 | Somatropin |
| 4752 | Somatropin recombinant |
| 4753 | Sonedenoson |
| 4754 | Sonidegib |
| 4755 | Sonolisib |
| 4756 | Sorafenib |
| 4757 | Soraphen A |
| 4758 | Sorbinil |
| 4759 | Sorbitol 6-phosphate |
| 4760 | SOT-107 |
| 4761 | Sotalol |
| 4762 | Sotrastaurin |
| 4763 | S-Oxy Cysteine |
| 4764 | S-Oxymethionine |

TABLE 1-continued

Ligands

| Ligand No. | Ligand Name |
|---|---|
| 4765 | SP-01A |
| 4766 | SP1049C |
| 4767 | SP2456 |
| 4768 | SP4160 |
| 4769 | Sp-722 |
| 4770 | Sp7343-Sp7964 |
| 4771 | Sp-876 |
| 4772 | Sp-Adenosine-3',5'-Cyclic-Monophosphorothioate |
| 4773 | S-PALMITOYL-L-CYSTEINE |
| 4774 | Sparfloxacin |
| 4775 | Sparsentan |
| 4776 | Spebrutinib |
| 4777 | Spectinomycin |
| 4778 | Spermidine |
| 4779 | Spermine |
| 4780 | Sphingosine |
| 4781 | Sphinxolide B |
| 4782 | S-Phosphocysteine |
| 4783 | Spinosad |
| 4784 | Spirapril |
| 4785 | Spiro(2,4,6-Trinitrobenzene[1,2a]-2o',3o'-Methylene-Adenine-Triphosphate |
| 4786 | Spironolactone |
| 4787 | SPL-7013 |
| 4788 | S-P-Nitrobenzyloxycarbonylglutathione |
| 4789 | SPP 301 |
| 4790 | SPP1148 |
| 4791 | S-propylamine-L-cysteine |
| 4792 | SR 121463 |
| 4793 | SR 140333 |
| 4794 | SR 31747 |
| 4795 | SR 58611 |
| 4796 | SR11254 |
| 4797 | SR-123781A |
| 4798 | SR12813 |
| 4799 | Sr-13668 |
| 4800 | Sr16234 |
| 4801 | Sri-9439 |
| 4802 | Sri-9662 |
| 4803 | SRT501 |
| 4804 | Srx246 |
| 4805 | Srx251 |
| 4806 | S-Selanyl Cysteine |
| 4807 | Ssr125543 |
| 4808 | SSR-126517E |
| 4809 | Ssr180711 |
| 4810 | St1535 |
| 4811 | Stannsoporfin |
| 4812 | Stanozolol |
| 4813 | Staurosporine |
| 4814 | Stavudine |
| 4815 | Stearic acid |
| 4816 | Streptokinase |
| 4817 | Streptomycin |
| 4818 | Streptozocin |
| 4819 | Streptozotocin |
| 4820 | Strontium Chloride |
| 4821 | Stx107 |
| 4822 | Su-014813 |
| 4823 | Su-14813 |
| 4824 | SU4984 |
| 4825 | SU9516 |
| 4826 | Succimer |
| 4827 | Succinamide-Coa |
| 4828 | Succinic acid |
| 4829 | SUCCINIC ACID MONO-(13-METHYL-3-OXO-2,3,6,7,8,9,10,11,12,13,14,15,16,17-TETRADECAHYDRO-1H-CYCLOPENTA[A]PHENANTHREN-17-YL) ESTER |
| 4830 | Succinylcholine |
| 4831 | Succinyl-Coenzyme A |
| 4832 | Sucralfate |
| 4833 | Sucroferric Oxyhydroxide |
| 4834 | Sucrose |
| 4835 | Sucrose Octasulfate |
| 4836 | Sufentanil |
| 4837 | Sufugolix |
| 4838 | Sugammadex |
| 4839 | Sulbactam |
| 4840 | Sulconazole |
| 4841 | Sulfabenzamide |
| 4842 | Sulfacetamide |
| 4843 | Sulfacytine |
| 4844 | Sulfadiazine |
| 4845 | Sulfadoxine |
| 4846 | Sulfalene |
| 4847 | Sulfamerazine |
| 4848 | Sulfameter |
| 4849 | Sulfamethazine |
| 4850 | Sulfamethizole |
| 4851 | Sulfamethoxazole |
| 4852 | Sulfametopyrazine |
| 4853 | Sulfamic Acid 2,3-O-(1-Methylethylidene)-4,5-O-Sulfonyl-Beta-Fructopyranose Ester |
| 4854 | Sulfamoxole |
| 4855 | Sulfanilamide |
| 4856 | Sulfaphenazole |
| 4857 | Sulfapyridine |
| 4858 | Sulfasalazine |
| 4859 | Sulfathiazole |
| 4860 | Sulfatinib |
| 4861 | Sulfinpyrazone |
| 4862 | Sulfisoxazole |
| 4863 | Sulfisoxazole Acetyl |
| 4864 | Sulfoxone |
| 4865 | Sulindac |
| 4866 | Sulodexide |
| 4867 | Sulpiride |
| 4868 | SULTHIAME |
| 4869 | Sumatriptan |
| 4870 | Sunitinib |
| 4871 | Suprofen |
| 4872 | Suramin |
| 4873 | Surinabant |
| 4874 | Suvorexant |
| 4875 | Suxamethonium |
| 4876 | Swainsonine |
| 4877 | SYM001 |
| 4878 | Synthetic Conjugated Estrogens, B |
| 4879 | SYRINGATE |
| 4880 | T-1249 |
| 4881 | T131 |
| 4882 | Ta-5493 |
| 4883 | Tabimorelin |
| 4884 | Tacrine |
| 4885 | TACRINE(8)-4-AMINOQUINOLINE |
| 4886 | Tacrolimus |
| 4887 | Tadalafil |
| 4888 | Tafluprost |
| 4889 | Tagetitoxin |
| 4890 | Tak-285 |
| 4891 | TAK-390MR |
| 4892 | Tak-441 |
| 4893 | TAK-475 |
| 4894 | TAK-491 |
| 4895 | Tak-593 |
| 4896 | Tak-659 |
| 4897 | Tak-715 |
| 4898 | Tak-733 |
| 4899 | Tak-901 |
| 4900 | Tak-960 |
| 4901 | Taladegib |
| 4902 | Talampanel |
| 4903 | Talbutal |
| 4904 | Taliglucerase Alfa |
| 4905 | Talmapimod |
| 4906 | Talnetant |
| 4907 | Tamatinib |
| 4908 | Tamibarptene |

TABLE 1-continued

Ligands

| Ligand No. | Ligand Name |
|---|---|
| 4909 | Tamoxifen |
| 4910 | Tamsulosin |
| 4911 | Tanaproget |
| 4912 | Tandutinib |
| 4913 | Tanzisertib |
| 4914 | Tapentadol |
| 4915 | Tarafenacin |
| 4916 | Taranabant |
| 4917 | Tartronate |
| 4918 | Tas-115 |
| 4919 | Tas-119 |
| 4920 | Taselisib |
| 4921 | Tasimelteon |
| 4922 | Tasosartan |
| 4923 | Taspoglutide |
| 4924 | Tatp |
| 4925 | Taurocholic Acid |
| 4926 | Tavaborole |
| 4927 | Tazarotene |
| 4928 | Tazobactam |
| 4929 | Tazobactam Intermediate |
| 4930 | Tazobactam Trans-Enamine Intermediate |
| 4931 | TBC-3711 |
| 4932 | Tc-2216 |
| 4933 | TC-5619 |
| 4934 | Tc-6499 |
| 4935 | Tc-6987 |
| 4936 | Tcd-717 |
| 4937 | TD-2749 |
| 4938 | TD-5108 |
| 4939 | Tebanicline Tosylate |
| 4940 | Tecadenoson |
| 4941 | Tecalcet |
| 4942 | Tedalinab |
| 4943 | Tedatioxetine |
| 4944 | Tedizolid Phosphate |
| 4945 | Teduglutide |
| 4946 | Tegaserod |
| 4947 | Telaprevir |
| 4948 | Telapristone Acetate |
| 4949 | Telatinib |
| 4950 | Telavancin |
| 4951 | Telbivudine |
| 4952 | Telcagepant |
| 4953 | Telithromycin |
| 4954 | Telmisartan |
| 4955 | Temafloxacin |
| 4956 | Temanogrel |
| 4957 | Temazepam |
| 4958 | Temocapril |
| 4959 | Temozolomide |
| 4960 | Temsirolimus |
| 4961 | Tenecteplase |
| 4962 | Teniposide |
| 4963 | Tenocyclidine |
| 4964 | Tenofovir |
| 4965 | Tenofovir Alafenamide |
| 4966 | Tenofovir Disoproxil |
| 4967 | Tenoxicam |
| 4968 | Tepotinib |
| 4969 | Terazosin |
| 4970 | Terbinafine |
| 4971 | Terbutaline |
| 4972 | Terconazole |
| 4973 | Terfenadine |
| 4974 | Teriflunomide |
| 4975 | Teriparatide |
| 4976 | Teriparatide Acetate |
| 4977 | Terlipressin |
| 4978 | TERT-BUTYL [(1R)-2-METHYL-1-(1,3,4-OXADIAZOL-2-YL)PROPYL]CARBAMATE |
| 4979 | TERT-BUTYL [(1S)-2-METHYL-1-(1,3,4-OXADIAZOL-2-YL)PROPYL]CARBAMATE |
| 4980 | tert-butyl [(2-amino-4-oxo-4,7-dihydro-3H-pyrrolo[2,3-d]pyrimidin-5-yl)methyl]carbamate |
| 4981 | TERT-BUTYL {2-[(1,3-THIAZOL-2-YLAMINO)CARBONYL]PYRIDIN-3-YL}CARBAMATE |
| 4982 | TERT-BUTYL 2-CYANO-2-METHYLHYDRAZINECARBOXYLATE |
| 4983 | TERT-BUTYL 4-({[4-(BUT-2-YN-1-YLAMINO)PHENYL]SULFONYL}METHYL)-4-[(HYDROXYAMINO)CARBONYL]PIPERIDINE-1-CARBOXYLATE |
| 4984 | tert-butyl 4-(3-thiophen-2-yl-1,2,4-oxadiazol-5-yl)piperidine-1-carboxylate |
| 4985 | Tert-Butyl(1s)-1-Cyclohexyl-2-Oxoethylcarbamate |
| 4986 | Tert-Butyloxycarbonyl Group |
| 4987 | Terutroban |
| 4988 | Tesaglitazar |
| 4989 | Tesamorelin |
| 4990 | Tesevatinib |
| 4991 | Tesmilifene |
| 4992 | Testolactone |
| 4993 | Testosterone |
| 4994 | Testosterone Cypionate |
| 4995 | Testosterone Enanthate |
| 4996 | TESTOSTERONE HEMISUCCINATE |
| 4997 | Testosterone Propionate |
| 4998 | Testosterone Undecanoate |
| 4999 | Tetra(Imidazole)Diaquacopper (I) |
| 5000 | Tetra(Imidazole)Diaquacopper(Ii) |
| 5001 | Tetrabenazine |
| 5002 | Tetrabromo-2-Benzotriazole |
| 5003 | Tetrabutylammonium Ion |
| 5004 | Tetracaine |
| 5005 | Tetracycline |
| 5006 | Tetradecyl Sulfuric Acid |
| 5007 | Tetraethylammonium |
| 5008 | Tetrafluoroaluminate Ion |
| 5009 | TETRAHEDRAL INTERMEDIATE OF BLASTICIDIN S |
| 5010 | Tetrahydrobiopterin |
| 5011 | Tetrahydrodeoxyuridine |
| 5012 | Tetrahydrofolic acid |
| 5013 | Tetrahydrofuran-2-Carboxylic Acid |
| 5014 | Tetrahydrooxazine |
| 5015 | Tetrahydrozoline |
| 5016 | Tetramethylammonium Ion |
| 5017 | Tetrazolyl Histidine |
| 5018 | Tetrodotoxin |
| 5019 | Tetryzoline |
| 5020 | Tezacaftor |
| 5021 | Tezampanel |
| 5022 | Tezosentan |
| 5023 | Tg-02 |
| 5024 | Tg100-115 |
| 5025 | TG100801 |
| 5026 | Tg100-801 |
| 5027 | Tgr-1202 |
| 5028 | Thalidomide |
| 5029 | Theliatinib |
| 5030 | Thenoyltrifluoroacetone |
| 5031 | Theobromine |
| 5032 | Theophylline |
| 5033 | Theophylline Glycinate |
| 5034 | Thiabendazole |
| 5035 | Thiamin Diphosphate |
| 5036 | Thiamin Phosphate |
| 5037 | Thiamine |
| 5038 | Thiamphenicol |
| 5039 | Thiamylal |
| 5040 | Thiarsa Dihydroxy Cysteine |
| 5041 | Thiarsahydroxy-Cysteine |
| 5042 | Thieno[2,3-B]Pyridine-2-Carboxamidine |
| 5043 | THIENO[3,2-B]PYRIDINE-2-SULFONIC ACID [1-(1-AMINO-ISOQUINOLIN-7-YLMETHYL)-2-OXO-PYRROLDIN-3-YL]-AMIDE |

TABLE 1-continued

Ligands

| Ligand No. | Ligand Name |
|---|---|
| 5044 | THIENO[3,2-B]PYRIDINE-2-SULFONIC ACID [2-OXO-1-(1H-PYRROLO[2,3-C]PYRIDIN-2-YLMETHYL)-PYRROLIDIN-3-YL]-AMIDE |
| 5045 | Thiethylperazine |
| 5046 | Thimerosal |
| 5047 | THIO-ATPA |
| 5048 | Thiocamphor |
| 5049 | Thiocoumarin |
| 5050 | Thiodigalactoside |
| 5051 | Thioguanine |
| 5052 | Thio-Maltohexaose |
| 5053 | Thio-Maltopentaose |
| 5054 | Thionicotinamide-Adenine-Dinucleotide |
| 5055 | Thiopental |
| 5056 | THIOPHENE-2,5-DISULFONIC ACID 2-AMIDE-5-(4-METHYL-BENZYLAMIDE) |
| 5057 | Thioproline |
| 5058 | Thioproperazine |
| 5059 | Thioridazine |
| 5060 | Thiorphan |
| 5061 | Thiotepa |
| 5062 | Thiothixene |
| 5063 | Threonine Derivative |
| 5064 | Threonine-Aspartic Ester |
| 5065 | Thymidine-3',5'-Diphosphate |
| 5066 | Thymidine-5'- Diphosphate |
| 5067 | Thymidine-5'-(Dithio)Phosphate |
| 5068 | Thymidine-5'-Diphospho-Beta-D-Xylose |
| 5069 | Thymidine-5'-Phosphate |
| 5070 | THYMIDINE-5'-THIOPHOSPHATE |
| 5071 | Thymidine-5'-Triphosphate |
| 5072 | Thymine |
| 5073 | Thyroglobulin |
| 5074 | Thyrotropin |
| 5075 | Thyrotropin Alfa |
| 5076 | Tiagabine |
| 5077 | Tiaprofenic acid |
| 5078 | Ticagrelor |
| 5079 | Ticarcillin |
| 5080 | Ticlopidine |
| 5081 | Tideglusib |
| 5082 | Tigecycline |
| 5083 | Tiludronate |
| 5084 | Tiludronic Acid |
| 5085 | Timolol |
| 5086 | Tinidazole |
| 5087 | Tinzaparin |
| 5088 | Tinzaparin Sodium |
| 5089 | Tioconazole |
| 5090 | Tiopronin |
| 5091 | Tiotropium |
| 5092 | Tipiracil |
| 5093 | Tipranavir |
| 5094 | Tiprolisant |
| 5095 | Tirofiban |
| 5096 | Tivantinib |
| 5097 | Tivozanib |
| 5098 | Tizanidine |
| 5099 | TI-3-093 |
| 5100 | TLK-199 |
| 5101 | TM30338 |
| 5102 | Tm30339 |
| 5103 | Tmr |
| 5104 | TNX-355 |
| 5105 | TNX-901 |
| 5106 | Tobramycin |
| 5107 | Tocainide |
| 5108 | Tocilizumab |
| 5109 | Tofacitinib |
| 5110 | Tofisopam |
| 5111 | Tolazamide |
| 5112 | Tolazoline |
| 5113 | Tolbutamide |
| 5114 | Tolcapone |
| 5115 | Tolmetin |
| 5116 | Tolnaftate |
| 5117 | Tolrestat |
| 5118 | Tolterodine |
| 5119 | Tolvaptan |
| 5120 | Tonapofylline |
| 5121 | Topiramate |
| 5122 | Topotecan |
| 5123 | Torasemide |
| 5124 | Toreforant |
| 5125 | Toremifene |
| 5126 | Torsemide |
| 5127 | Tositumomab |
| 5128 | Tosyl-D-Proline |
| 5129 | Tozadenant |
| 5130 | Tozasertib |
| 5131 | TP-508 |
| 5132 | Trabectedin |
| 5133 | Trabodenoson |
| 5134 | Tradipitant |
| 5135 | Tramadol |
| 5136 | Trametinib |
| 5137 | Trandolapril |
| 5138 | Tranexamic Acid |
| 5139 | Tranilast |
| 5140 | TRANS-(1S,2S)-2-AMINO-1,2,3,4-TETRAHYDRONAPHTHALEN-1-OL |
| 5141 | TRANS-2-(DIMETHYLPHENYLSILYL)-PIPERIDINE-N-OXIDE |
| 5142 | trans-2-hydroxycinnamic acid |
| 5143 | Trans-2-Phenylcyclopropylamine |
| 5144 | trans-4-(7-carbamoyl-1H-benzimidazol-2-yl)-1-propylpiperidinium |
| 5145 | TRANS-4-(GUANIDINOMETHYL)-CYCLOHEXANE-L-YL-D-3-CYCLOHEXYLALANYL-L-AZETIDINE-2-YL-D-TYROSINYL-L-HOMOARGININAMIDE |
| 5146 | Trans-6-(2-Phenylcyclopropyl)-Naphthalene-2-Carboxamidine |
| 5147 | Trans-O-Hydroxy-Alpha-Methyl Cinnamate |
| 5148 | trans-urocanic acid |
| 5149 | Tranylcypromine |
| 5150 | Trastuzumab |
| 5151 | Trastuzumab Emtansine |
| 5152 | Travoprost |
| 5153 | Traxoprodil |
| 5154 | TRAZEOLIDE |
| 5155 | Trazodone |
| 5156 | Trehalose-6-Phosphate |
| 5157 | Trelanserin |
| 5158 | Trencam-3,2-Hopo |
| 5159 | Treprostinil |
| 5160 | Tretinoin |
| 5161 | Triamcinolone |
| 5162 | Triamcinolone Acetonide |
| 5163 | Triamcinolone Diacetate |
| 5164 | Triamcinolone Hexacetonide |
| 5165 | Triamterene |
| 5166 | Triazolam |
| 5167 | Triazolopyridine |
| 5168 | TRIAZOLOPYRIMIDINE |
| 5169 | tributylstannanyl |
| 5170 | Tricarballylic Acid |
| 5171 | Tricetamide |
| 5172 | Trichlormethiazide |
| 5173 | Triciribine Phosphate |
| 5174 | Triclofos |
| 5175 | Triclosan |
| 5176 | Tricosanoic Acid |
| 5177 | Tridihexethyl |
| 5178 | Trientine |
| 5179 | Triethyl Phosphate |
| 5180 | Trifluoperazine |
| 5181 | Trifluoroacetonyl Coenzyme A |
| 5182 | Trifluoroethanol |

TABLE 1-continued

Ligands

| Ligand No. | Ligand Name |
|---|---|
| 5183 | Trifluoromethionine |
| 5184 | Trifluoro-thiamin phosphate |
| 5185 | Triflupromazine |
| 5186 | Trifluridine |
| 5187 | Triflusal |
| 5188 | Triglu-5-Formyl-Tetrahydrofolate |
| 5189 | Trihexyphenidyl |
| 5190 | Trihydroxyantimonite(Iii) |
| 5191 | Trihydroxyarsenite(Iii) |
| 5192 | Trilostane |
| 5193 | Trimetazidine |
| 5194 | Trimethadione |
| 5195 | Trimethaphan |
| 5196 | Trimethobenzamide |
| 5197 | Trimethoprim |
| 5198 | Trimethyl Glycine |
| 5199 | Trimetrexate |
| 5200 | Trimipramine |
| 5201 | Trinitrotoluene |
| 5202 | Trioxsalen |
| 5203 | Tripelennamine |
| 5204 | Triphospate |
| 5205 | tripotassium (1R)-4-biphenyl-4-yl-1-phosphonatobutane-1-sulfonate |
| 5206 | Triprolidine |
| 5207 | Triptorelin |
| 5208 | Tris |
| 5209 | Tris(Hydroxyethyl)Aminomethane |
| 5210 | Trisalicylate-choline |
| 5211 | Tris-Hydroxymethyl-Methyl-Ammonium |
| 5212 | Troglitazone |
| 5213 | Troleandomycin |
| 5214 | Tromethamine |
| 5215 | Tropicamide |
| 5216 | Trospium |
| 5217 | Trovafloxacin |
| 5218 | TRW3-(2-AMINO-3-HYDROXY-PROPYL)-6-(N'-CYCLOHEXYL-HYDRAZINO)OCTAHYDRO-INDOL-7-OL |
| 5219 | Trypanothione |
| 5220 | Tryptophanyl-5'amp |
| 5221 | TTNPB |
| 5222 | Ttp-607 |
| 5223 | TTP889 |
| 5224 | Tu-514 |
| 5225 | Tubercidin |
| 5226 | Tubocurarine |
| 5227 | Turofexorate Isopropyl |
| 5228 | Tv-45070 |
| 5229 | Txa127 |
| 5230 | Tyloxapol |
| 5231 | Tyrosinal |
| 5232 | Tyrosyladenylate |
| 5233 | Tyvelose |
| 5234 | TZP-101 |
| 5235 | UBIQUINONE-1 |
| 5236 | UBIQUINONE-2 |
| 5237 | Ubrogepant |
| 5238 | UC-781 |
| 5239 | Udenafil |
| 5240 | Udp-Alpha-D-Xylopyranose |
| 5241 | Udp-GlucuronicAcid |
| 5242 | Uk432097 |
| 5243 | Ulapualide A |
| 5244 | Ularitide |
| 5245 | Ulimorelin |
| 5246 | Ulipristal |
| 5247 | Ulipristal Acetate |
| 5248 | Ulixertinib |
| 5249 | Umeclidinium |
| 5250 | UNDECA-3,7-DIENE-1,3,7,11-TETRACARBALDEHYDE |
| 5251 | undecan-2-one |
| 5252 | UNDECYLAMINE-N,N-DIMETHYL-N-OXIDE |
| 5253 | Undecyl-Beta-D-Maltopyranoside |
| 5254 | Undecyl-Phosphinic Acid Butyl Ester |
| 5255 | Unoprostone Isopropyl |
| 5256 | U-Pi-a-Pi |
| 5257 | Uprosertib |
| 5258 | Ur-63325 |
| 5259 | Uracil |
| 5260 | Uracil Mustard |
| 5261 | Urea |
| 5262 | Uric Acid |
| 5263 | Uridine |
| 5264 | Uridine 5'-Triphosphate |
| 5265 | Uridine Diphosphate Galactose |
| 5266 | Uridine Triacetate |
| 5267 | Uridine-2',3'-Vanadate |
| 5268 | Uridine-5'-Diphosphate |
| 5269 | Uridine-5'-Diphosphate-2-Deoxy-2-Fluoro-Alpha-D-Galactose |
| 5270 | Uridine-5'-Diphosphate-4-Deoxy-4-Fluoro-Alpha-D-Galactose |
| 5271 | Uridine-5'-Diphosphate-Mannose |
| 5272 | Uridine-5'-Diphosphate-N-Acetylmuramoyl-L-Alanine |
| 5273 | Uridine-5'-Diphosphate-N-Acetylmuramoyl-L-Alanine-D-Glutamate |
| 5274 | Uridine-5'-Monophosphate |
| 5275 | Uridine-5'-Monophosphate 2-Deoxy-2-Fluoro-Galactopyranosyl-Monophosphate Ester |
| 5276 | Uridine-5'-Monophosphate Glucopyranosyl-Monophosphateester |
| 5277 | Uridine-Diphosphate-N-Acetylgalactosamine |
| 5278 | Uridine-Diphosphate-N-Acetylglucosamine |
| 5279 | Uridylyl-2'-5'-Phospho-Adenosine |
| 5280 | Urofollitropin |
| 5281 | Urokinase |
| 5282 | Ursodeoxycholic acid |
| 5283 | Ursodiol |
| 5284 | Ustekinumab |
| 5285 | V1003 |
| 5286 | V24343 |
| 5287 | V81444 |
| 5288 | Vabicaserin |
| 5289 | Valaciclovir |
| 5290 | Valacyclovir |
| 5291 | Valdecoxib |
| 5292 | Valganciclovir |
| 5293 | Valproic Acid |
| 5294 | Valpromide |
| 5295 | Valrubicin |
| 5296 | Valsartan |
| 5297 | Vancomycin |
| 5298 | Vandetanib |
| 5299 | VANILLATE |
| 5300 | Vantictumab |
| 5301 | Vapitadine |
| 5302 | Vapreotide |
| 5303 | Vardenafil |
| 5304 | Varenicline |
| 5305 | Varlitinib |
| 5306 | Vasopressin |
| 5307 | Vasopressin Tannate |
| 5308 | Vatalanib |
| 5309 | VEC-162 |
| 5310 | Vecuronium |
| 5311 | Vedolizumab |
| 5312 | VEGF-AS |
| 5313 | Velaglucerase alfa |
| 5314 | Velcalcetide |
| 5315 | Velneperit |
| 5316 | Velusetrag |
| 5317 | Vemurafenib |
| 5318 | Venlafaxine |
| 5319 | Verapamil |
| 5320 | Veratrum Viride |
| 5321 | Verdoheme |
| 5322 | Verecimon |

TABLE 1-continued

Ligands

| Ligand No. | Ligand Name |
|---|---|
| 5323 | Verosudil |
| 5324 | Verteporfin |
| 5325 | Verucerfont |
| 5326 | Vestipitant |
| 5327 | VGV-1 |
| 5328 | Vgx-1027 |
| 5329 | Vibegron |
| 5330 | Vicriviroc |
| 5331 | Vidarabine |
| 5332 | Vidupiprant |
| 5333 | Vigabatrin |
| 5334 | Vilanterol |
| 5335 | Vilazodone |
| 5336 | Vildagliptin |
| 5337 | Vinblastine |
| 5338 | Vincristine |
| 5339 | Vindesine |
| 5340 | Vinorelbine |
| 5341 | Vinorelbine Base |
| 5342 | Vinylglycine |
| 5343 | Vinylsulphonic Acid |
| 5344 | Viomycin |
| 5345 | Vipadenant |
| 5346 | VIR201 |
| 5347 | Virginiamycin factor S1 |
| 5348 | Virginiamycin M1 |
| 5349 | Vismodegib |
| 5350 | Vitamin A |
| 5351 | Vitamin B6 Complexed with 2-Amino-Hexanoic Acid |
| 5352 | Vitamin B6 Complexed with 2-Amino-Pentanoic Acid |
| 5353 | Vitamin C |
| 5354 | Vitamin E |
| 5355 | Vk5211 |
| 5356 | Voacamine |
| 5357 | Vofopitant |
| 5358 | Voglibose |
| 5359 | Volasertib |
| 5360 | Volinanserin |
| 5361 | Vorapaxar |
| 5362 | Voriconazole |
| 5363 | Vorinostat |
| 5364 | Vortioxetine |
| 5365 | Voruciclib |
| 5366 | Voxtalisib |
| 5367 | VP025 |
| 5368 | Vs-4718 |
| 5369 | Vs-5584 |
| 5370 | VX-148 |
| 5371 | VX-702 |
| 5372 | Vx-745 |
| 5373 | VX-765 |
| 5374 | Vx-970 |
| 5375 | Warfarin |
| 5376 | WAY-151693 |
| 5377 | WF10 |
| 5378 | Whi-P131 |
| 5379 | Willardiine |
| 5380 | WRR-112 |
| 5381 | WRR-204 |
| 5382 | WRR-99 |
| 5383 | Wx-037 |
| 5384 | Wx-554 |
| 5385 | WX-G250 |
| 5386 | WX-UK1 |
| 5387 | X-396 |
| 5388 | X-82 |
| 5389 | Xanthine |
| 5390 | XEN2174 |
| 5391 | Xen403 |
| 5392 | Ximelagatran |
| 5393 | XL019 |
| 5394 | Xl-019 |
| 5395 | XL147 |
| 5396 | XL184 |
| 5397 | XL228 |
| 5398 | Xl-228 |
| 5399 | XL281 |
| 5400 | Xl-281 |
| 5401 | XL418 |
| 5402 | Xl-418 |
| 5403 | Xl550 |
| 5404 | XL647 |
| 5405 | XL765 |
| 5406 | XL784 |
| 5407 | XL820 |
| 5408 | Xl-820 |
| 5409 | XL844 |
| 5410 | Xl-844 |
| 5411 | XL880 |
| 5412 | XL999 |
| 5413 | Xl-999 |
| 5414 | XMT-1001 |
| 5415 | XOMA 052 |
| 5416 | XP13512 |
| 5417 | XTL-6865 |
| 5418 | XV638 |
| 5419 | Xylarohydroxamate |
| 5420 | Xylometazoline |
| 5421 | Xylose-Derived Imidazole |
| 5422 | Xylose-Derived Lactam Oxime |
| 5423 | Y-39983 |
| 5424 | Y-700 |
| 5425 | Yohimbine |
| 5426 | YSIL6 |
| 5427 | Ytterbium Pentetate |
| 5428 | Yttrium Y 90 Ibritumomab Tiuxetan |
| 5429 | Z160 |
| 5430 | Zafirlukast |
| 5431 | Z-Ala Prolinal |
| 5432 | Zalcitabine |
| 5433 | Zaleplon |
| 5434 | Zanamivir |
| 5435 | Zanapezil |
| 5436 | Zd-4190 |
| 5437 | Zebularine |
| 5438 | ZEN-012 |
| 5439 | Zibotentan |
| 5440 | Ziconotide Acetate |
| 5441 | Zidovudine |
| 5442 | Zileuton |
| 5443 | Zimelidine |
| 5444 | Zinc Substituted Heme C |
| 5445 | Zinc Trihydroxide |
| 5446 | Ziprasidone |
| 5447 | ZK-800270 |
| 5448 | ZK-805623 |
| 5449 | Zk-806450 |
| 5450 | ZK-806711 |
| 5451 | Zoledronate |
| 5452 | Zoledronic Acid |
| 5453 | Zolmitriptan |
| 5454 | Zolpidem |
| 5455 | Zomepirac |
| 5456 | Zonisamide |
| 5457 | Zopiclone |
| 5458 | Zoptarelin Doxorubicin |
| 5459 | Z-Pro-Prolinal |
| 5460 | Zstk-474 |
| 5461 | Zuclopenthixol |
| 5462 | Zyh7 |
| 5463 | ((2r,3s,5r)-3-Hydroxy-5-(4-Hydroxy-2-Oxo-3,4-Dihydropyrimidin-1(2h)-Yl)-Tetrahydrofuran-2-Yl)Methyldihydrogen Phosphate |
| 5464 | ({[(3E)-2'-OXO-2',7'-DIHYDRO-2,3'-BIINDOL-3(7H)-YLIDENE]AMINO}OXY)ACETIC ACID |
| 5465 | ({3-[1-(4-HYDROXY-2-OXO-2H-CHROMEN-3-YL)-PROPYL]-PHENYLCARBAMOYL}-METHYL)-CARBAMIC ACID TERT-BUTYL ESTER |

TABLE 1-continued

Ligands

| Ligand No. | Ligand Name |
|---|---|
| 5466 | (1,10 Phenanthroline)-(Tri-Carbon Monoxide) Rhenium (I) |
| 5467 | (10ALPHA,13ALPHA,14BETA,17ALPHA)-17-HYDROXYANDROST-4-EN-3-ONE |
| 5468 | (10E,12Z)-octadeca-10,12-dienoic acid |
| 5469 | (10R)-10-Formyl-5,8,10-Trideazafolic Acid |
| 5470 | (10R)-10-methyl-3-(6-methylpyridin-3-yl)-9,10,11,12-tetrahydro-8H-[1,4]diazepino[5',6':4,5]thieno[3,2-f]quinolin-8-one |
| 5471 | (10S)-10-Formyl-5,8,10-Trideazafolic Acid |
| 5472 | (11-BETA)-11,21-DIHYDROXY-PREGN-4-ENE-3,20-DIONE |
| 5473 | (11E)-OCTADEC-11-ENOIC ACID |
| 5474 | (11R)-10-acetyl-11-(2,4-dichlorophenyl)-6-hydroxy-3,3-dimethyl-2,3,4,5,10,11-hexahydro-1H-dibenzo[b,e][1,4]diazepin-1-one |
| 5475 | (11S)-8-CHLORO-11-[1-(METHYLSULFONYL)PIPERIDIN-4-YL]-6-PIPERAZIN-1-YL-11H-BENZO[5,6]CYCLOHEPTA[1,2-B]PYRIDINE |
| 5476 | (13R,15S)-13-METHYL-16-OXA-8,9,12,22,24-PENTAAZAHEXACYCLO[15.6.2.16,9.1,12,15.0,2,7.0,21,25]HEPTACOSA-1(24),2,4,6,17(25),18,20-HEPTAENE-23,26-DIONE |
| 5477 | (13S,4S)-13-METHYLDODECAHYDRO-1H-CYCLOPENTA[A]PHENANTHRENE-3,17(2H,4H)-DIONE |
| 5478 | (16ALPHA,17ALPHA)-ESTRA-1,3,5(10)-TRIENE-3,16,17-TRIOL |
| 5479 | (17beta)-17-(cyanomethyl)-2-methoxyestra-1(10),2,4-trien-3-yl sulfamate |
| 5480 | (1aR,8S,13S,14S,15aR)-5,13,14-trihydroxy-3-methoxy-8-methyl-8,9,13,14,15,15a-hexahydro-6H-oxireno[k][2]benzoxacyclotetradecine-6,12(1aH)-dione |
| 5481 | (1E)-5-(1-piperidin-4-yl-3-pyridin-4-yl-1H-pyrazol-4-yl)-2,3-dihydro-1H-inden-1-one oxime |
| 5482 | (1H-indol-3-yl)-(2-mercapto-ethoxyimino)-acetic acid |
| 5483 | (1-HYDROXY-1-PHOSPHONO-2-[1,1';3',1"]TERPHENYL-3-YL-ETHYL)-PHOSPHONIC ACID |
| 5484 | (1-HYDROXY-1-PHOSPHONO-2-[1,1';4',1"]TERPHENYL-3-YL-ETHYL)-PHOSPHONIC ACID |
| 5485 | (1-HYDROXYDODECANE-1,1-DIYL)BIS(PHOSPHONIC ACID) |
| 5486 | (1-HYDROXYHEPTANE-1,1-DIYL)BIS(PHOSPHONIC ACID) |
| 5487 | (1-HYDROXYNONANE-1,1-DIYL)BIS(PHOSPHONIC ACID) |
| 5488 | (1-Methyl-1h-Imidazol-2-Yl)-(3-Methyl-4-{3-[(Pyridin-3-Ylmethyl)-Amino]-Propoxy}-Benzofuran-2-Yl)-Methanone |
| 5489 | (1n)-4-N-Butoxyphenylsulfonyl-(2r)-N-Hydroxycarboxamido-(4s)-Methanesulfonylamino-Pyrrolidine |
| 5490 | (1R)-1-(2-THIENYLACETYLAMINO)-1-(3-CARBOXYPHENYL)METHYLBORONIC ACID |
| 5491 | (1R)-1-(2-thienylacetylamino)-1-phenylmethylboronic acid |
| 5492 | (1R)-1,2,2-TRIMETHYLPROPYL (R)-METHYLPHOSPHINATE |
| 5493 | (1R)-1,2,2-TRIMETHYLPROPYL (S)-METHYLPHOSPHINATE |
| 5494 | (1R)-1-{[(4'-METHOXY-1,1'-BIPHENYL-4-YL)SULFONYL]AMINO}-2-METHYLPROPYLPHOSPHONIC ACID |
| 5495 | (1R)-1-PHENYLETHYL4-(ACETYLAMINO)BENZYLPHOSPHONATE |
| 5496 | (1R)-2-[(CYANOMETHYL)AMINO]-1-({[2-(DIFLUOROMETHOXY)BENZYL]SULFONYL}METHYL)-2-OXOETHYL MORPHOLINE-4-CARBOXYLATE |
| 5497 | (1R)-2-{[AMINO(IMINO)METHYL]AMINO}-1-{4-[(4R)-4-(HYDROXYMETHYL)-1,3,2-DIOXABOROLAN-2-YL]PHENYL}ETHYL NICOTINATE |
| 5498 | (1R)-2-amino-1-[3-(trifluoromethyl)phenyl]ethanol |
| 5499 | (1R)-2-METHYL-1-(PHENYLMETHYL)PROPYL[(1S)-1-FORMYLPENTYL]CARBAMATE |
| 5500 | (1R)-2-PHENYLACETAMIDO-2-(3-CARBOXYPHENYL)ETHYL BORONIC ACID |
| 5501 | (1R)-3-chloro-1-phenylpropan-1-ol |
| 5502 | (1R)-4-(3-phenoxyphenyl)-1-phosphonobutane-1-sulfonic acid |
| 5503 | (1r)-4-[(1e,3e,5e,7z,9e,11z,13e,15e)-17-Hydroxy-3,7,12,16-Tetramethylheptadeca-1,3,5,7,9,11,13,15-Octaen-1-Yl]-3,5,5-Trimethylcyclohex-3-En-1-Ol |
| 5504 | (1R)-MENTHYL HEXYL PHOSPHONATE GROUP |
| 5505 | (1R)-N,6-DIHYDROXY-7-METHOXY-2-[(4-METHOXYPHENYL)SULFONYL]-1,2,3,4-TETRAHYDROISOQUINOLINE-1-CARBOXAMIDE |
| 5506 | (1R,2S)-cis 1,2 dihydroxy-1,2-dihydronaphthalene |
| 5507 | (1R,2R)-N-(2-AMINOETHYL)-2-{[(4-METHOXYPHENYL)SULFONYL]METHYL}CYCLOHEXANECARBOXAMIDE |
| 5508 | (1R,2R,3R,4S,5R)-4-(BENZYLAMINO)-5-(METHYLTHIO)CYCLOPENTANE-1,2,3-TRIOL |
| 5509 | (1R,2S)-2-(5-thioxo-4,5-dihydro-1H-1,2,4-triazol-3-yl)cyclohexanecarboxylic acid |
| 5510 | (1'r,2's)-9-(2-Hydroxy-3'-Keto-Cyclopenten-1-Yl)Adenine |
| 5511 | (1R,3R)-5-[(2E)-3-{(1S,3R)-2,2,3-trimethyl-3-[6,6,6-trifluoro-5-hydroxy-5-(trifluoromethyl)hex-3-yn-1-yl]cyclopentyl}prop-2-en-1-ylidene]cyclohexane-1,3-diol |
| 5512 | (1R,3S,5S,8R)-8-HYDROXY-2-OXABICYCLO[3.3.1]NON-6-ENE-3,5-DICARBOXYLIC ACID |
| 5513 | (1R,4S,7AS)-1-(1-FORMYLPROP-1-EN-1-YL)-4-METHOXY-1,4,6,7,7A-HEXAHYDRO-1H-ISOINDOLE-3-CARBOXYLIC ACID |
| 5514 | (1S)-1-(1H-INDOL-3-YLMETHYL)-2-(2-PYRIDIN-4-YL-[1,7]NAPHTYRIDIN-5-YLOXY)-EHYLAMINE |
| 5515 | (1S)-1-(3-chlorophenyl)-2-oxo-2-[(1,3,4-trioxo-1,2,3,4-tetrahydroisoquinolin-5-yl)amino]ethyl acetate |
| 5516 | (1s)-1-(9-Deazaadenin-9-Yl)-1,4,5-Trideoxy-1,4-Imino-5-Methylthio-D-Ribitol |
| 5517 | (1s)-1(9-Deazahypoxanthin-9yl)1,4-Dideoxy-1,4-Imino-D-Ribitol-5-Phosphate |
| 5518 | (1S)-1-(PHENOXYMETHYL)PROPYL METHYLPHOSPHONOCHLORIDOATE |
| 5519 | (1S)-1,2,3,4-TETRAHYDRO-BENZO[C]PHENANTHRENE-2,3,4-TRIOL |
| 5520 | (1S)-1-{[(4'-METHOXY-1,1'-BIPHENYL-4-YL)SULFONYL]AMINO}-2-METHYLPROPYLPHOSPHONIC ACID |
| 5521 | (1S)-1-AMINO-2-(1H-INDOL-3-YL)ETHANOL |
| 5522 | (1S)-1-CYCLOPROPYL-2-[(2S)-4-(2,5-DIFLUOROPHENYL)-2-PHENYL-2,5-DIHYDRO-1H-PYRROL-1-YL]-2-OXOETHANAMINE |
| 5523 | (1S)-2-(1H-INDOL-3-YL)-1-[({5-[(E)-2-PYRIDIN-4-YLVINYL]PYRIDIN-3-YL}OXY)METHYL]ETHYLAMINE |
| 5524 | (1S)-2-(1H-INDOL-3-YL)-1-{[(5-ISOQUINOLIN-6-YLPYRIDIN-3-YL)OXY]METHYL}ETHYLAMINE |
| 5525 | (1S)-2-[(2S,5R)-2-(AMINOMETHYL)-5-ETHYNYLPYRROLIDIN-1-YL]-1-CYCLOPENTYL-2-OXOETHANAMINE |
| 5526 | (1S)-2-[(2S,5R)-2-(AMINOMETHYL)-5-PROP-1-YN-1-YLPYRROLIDIN-1-YL]-1-CYCLOPENTYL-2-OXOETHANAMINE |
| 5527 | (1S)-2-{[{[(2S)-2,3-DIHYDROXYPROPYL]OXY}(HYDROXY)PHOSPHORYL]OXY}-1-[(PENTANOYLOXY)METHYL]ETHYL OCTANOATE |
| 5528 | (1S)-2-oxo-1-phenyl-2-[(1,3,4-trioxo-1,2,3,4-tetrahydroisoquinolin-5-yl)amino]ethyl acetate |
| 5529 | (1S)-MENTHYL HEXYL PHOSPHONATE GROUP |
| 5530 | (1S,2R)-2-[(2,5-difluorophenyl)carbamoyl]cyclopropanecarboxylic acid |
| 5531 | (1S,2R,3S,4R,5R)-2,3,4-trihydroxy-N-octyl-6-oxa-8-azabicyclo[3.2.1]octane-8-carbothioamide |
| 5532 | (1S,2R,3S,4R,5S)-8-AZABICYCLO[3.2.1]OCTANE-1,2,3,4-TETROL |
| 5533 | (1S,2R,5S)-5-[3-(TRIFLUOROMETHYL)-5,6-DIHYDRO[1,2,4]TRIAZOLO[4,3-A]PYRAZIN-7(8H)-YL]-2-(2,4,5-TRIFLUOROPHENYL)CYCLOHEXANAMINE |
| 5534 | (1S,2S,3R,4S,5S)-2,3,4-TRIHYDROXY-5-(HYDROXYMETHYL)CYCLOHEXYL (1E)-2-PHENYL-N-(SULFOOXY)ETHANIMIDOTHIOATE |
| 5535 | (1S,2S,3R,6R)-4-(hydroxymethyl)-6-(octylamino)cyclohex-4-ene-1,2,3-triol |

TABLE 1-continued

Ligands

| Ligand No. | Ligand Name |
|---|---|
| 5536 | (1S,2S,5S)2-(4-GLUTARIDYLBENZYL)-5-PHENYL-1-CYCLOHEXANOL |
| 5537 | (1S,3aS,5aR,8aS)-1,7,7-trimethyl-1,2,3,3a,5a,6,7,8-octahydrocyclopenta[c]pentalene-4-carboxylic acid |
| 5538 | (1S,3R,4S,5S,7S)-4-{[2-(4-METHOXYPHENOXY)-2-METHYLPROPANOYL]AMINO}ADAMANTANE-1-CARBOXAMIDE |
| 5539 | (1S,3R,6S)-4-oxo-6-{4-[(2-phenylquinolin-4-yl)methoxy]phenyl}-5-azaspiro[2.4]heptane-1-carboxylic acid |
| 5540 | (1S,3S,5S)-2-{(2S)-2-amino-2-[(1R,3S,5R,7S)-3-hydroxytricyclo[3.3.1.1~3,7~]dec-1-yl]acetyl}-2-azabicyclo[3.1.0]hexane-3-carbonitrile |
| 5541 | (1S,4R,7AR)-4-BUTOXY-1-[(1R)-1-FORMYLPROPYL]-2,4,5,6,7,7A-HEXAHYDRO-1H-ISOINDOLE-3-CARBOXYLIC ACID |
| 5542 | (1S,4R,9S)-5-(trifluoromethyl)-1,2,3,4-tetrahydro-1,4-methanonaphthalen-9-amine |
| 5543 | (1S,4S)-4-(3,4-dichlorophenyl)-N-methyl-1,2,3,4-tetrahydronaphthalen-1-amine |
| 5544 | (1S,4S,5S)-1,4,5-TRIHYDROXY-3-[3-(PHENYLTHIO)PHENYL]CYCLOHEX-2-ENE-1-CARBOXYLIC ACID |
| 5545 | (1S,5S,7R)-N~7~-(BIPHENYL-4-YLMETHYL)-N~3~-HYDROXY-6,8-DIOXA-3-AZABICYCLO[3.2.1]OCTANE-3,7-DICARBOXAMIDE |
| 5546 | (1S,6BR,9AS,11R,11BR)-9A,11B-DIMETHYL-1-[(METHYLOXY)METHYL]-3,6,9-TRIOXO-1,6,6B,7,8,9,9A,10,11,11B-DECAHYDRO-3H-FURO[4,3,2-DE]INDENO[4,5-H][2]BENZOPYRAN-11-YL ACETATE |
| 5547 | (1S,6R)-3-{[3-(TRIFLUOROMETHYL)-5,6-DIHYDRO[1,2,4]TRIAZOLO[4,3-A]PYRAZIN-7(8H)-YL]CARBONYL}-6-(2,4,5-TRIFLUOROPHENYL)CYCLOHEX-3-EN-1-AMINE |
| 5548 | (1s,6s,7r,8r,8ar)-1,6,7,8-Tetrahydroxyindolizidine |
| 5549 | (1S,7S,8S,8AR)-1,2,3,7,8,8A-HEXAHYDRO-7-METHYL-8-[2-[(2R,4R)-TETRAHYDRO-4-HY DROXY-6-OXO-2H-PYRAN-2-YL]ETHYL]-1-NAPHTHALENOL |
| 5550 | (1-Tert-Butyl-5-Hydroxy-1h-Pyrazol-4 -Yl)-(6-Methanesulfonyl-4'-Methoxy-2-Methyl-Biphenyl-3-Yl)-Methanone |
| 5551 | (1Z)-2-HYDROXY-3-OXOHEX-1-EN-1-YL DIHYDROGEN PHOSPHATE |
| 5552 | (1Z)-4-(4-FLUOROPHENYL)-2-METHYLIDENEBUTAN-1-IMINE |
| 5553 | (2,2-DIPHOSPHONOETHYL)(DODECYL)DIMETHYL-PHOSPHONIUM |
| 5554 | (2,6-DIMETHYL-PHENOXY)-ACETIC ACID |
| 5555 | (2-[2-Ketopropylthio]Ethanesulfonate |
| 5556 | (2-{[(4-BROMO-2-FLUOROBENZYL)AMINO]CARBONYL}-5-CHLOROPHENOXY)ACETIC ACID |
| 5557 | (20S)-19,20,21,22-TETRAHYDRO-19-OXO-5H-18,20-ETHANO-12,14-ETHENO-6,10-METHENO-18H-BENZ[D]IMIDAZO[4,3-K][1,6,9,12]OXATRIAZA-CYCLOOCTADECOSINE-9-CARBONITRILE |
| 5558 | (20S)-19,20,22,23-TETRAHYDRO-19-OXO-5H,21H-18,20-ETHANO-12,14-ETHENO-6,10-METHENOBENZ[D]IMIDAZO[4,3-L][1,6,9,13]OXATRIAZACYCLONOADECOSINE-9-CARBONITRILE |
| 5559 | (21S)-1AZA-4,4-DIMETHYL-6,19-DIOXA-2,3,7,20-TETRAOXOBICYCLO[19.4.0] PENTACOSANE |
| 5560 | (2-ACETYL-5-METHYLANILINO)(2,6-DIBROMOPHENYL)ACETAMIDE |
| 5561 | (2-AMINO-1,3-OXAZOL-5-YL)-(3-BROMOPHENYL)METHANONE |
| 5562 | (2-AMINO-3-PHENYL-BICYCLO[2.2.1]HEPT-2-YL)-PHENYL-METHANONE |
| 5563 | (2-BROMOETHYL)(2-'FORMYL-4'-AMINOPHENYL) ACETATE |
| 5564 | (2-CARBAMOYLMETHYL-5-PROPYL-OCTAHYDRO-INDOL-7-YL)ACETIC ACID |
| 5565 | (2E)-1-[(6-chloropyridin-3-yl)methyl]-N-nitroimidazolidin-2-imine |
| 5566 | (2E)-1-[2-hydroxy-4-methoxy-5-(3-methylbut-2-en-1-yl)phenyl]-3-(4-hydroxyphenyl)prop-2-en-1-one |
| 5567 | (2E)-2-({(2S)-2-CARBOXY-2-[(PHENOXYACETYL)AMINO]ETHOXY}IMINO) PENTANEDIOIC ACID |
| 5568 | (2E)-3-(2,4-DICHLOROPHENYL)-N-HYDROXYACRYLAMIDE |
| 5569 | (2E)-3-(2-OCT-1-YN-1-YLPHENYL)ACRYLIC ACID |
| 5570 | (2E)-3-(3,4-DIHYDROXYPHENYL)-2-IMINOPROPANOIC ACID |
| 5571 | (2E)-3-(3,4-DIHYDROXYPHENYL)-N-[2-(4-HYDROXYPHENYL)ETHYL]ACRYLAMIDE |
| 5572 | (2E)-3-(3-hydroxy-4-methoxyphenyl)prop-2-enoic acid |
| 5573 | (2E)-3-(4-CHLOROPHENYL)-N-HYDROXYACRYLAMIDE |
| 5574 | (2E)-3-{3-[(5-ETHYL-3-IODO-6-METHYL-2-OXO-1,2-DIHYDROPYRIDIN-4-YL)OXY]PHENYL}ACRYLONITRILE |
| 5575 | (2E)-N-{4-[(3-bromophenyl)amino]quinazolin-6-yl}-4-(dimethylamino)but-2-enamide |
| 5576 | (2e)-N-Allyl-4-{[3-(4-Bromophenyl)-5-Fluoro-1-Methyl-1h-Indazol-6-Yl]Oxy}-N-Methyl-2-Buten-1-Amine |
| 5577 | (2E)-N-hydroxy-3-[1-methyl-4-(phenylacetyl)-1H-pyrrol-2-yl]prop-2-enamide |
| 5578 | (2e,3s)-3-Hydroxy-5'-[(4-Hydroxypiperidin-1-Yl)Sulfonyl]-3-Methyl-1,3-Dihydro-2,3'-Biindol-2'(1'h)-One |
| 5579 | (2E,4E)-11-METHOXY-3,7,11-TRIMETHYLDODECA-2,4-DIENOIC ACID |
| 5580 | (2E,4E)-2-HYDROXY-6-OXO-6-PHENYLHEXA-2,4-DIENOIC ACID |
| 5581 | (2E,4R,5S)-2,3,4,5-TETRAHYDROXY-6-(PALMITOYLOXY)HEX-2-ENOIC ACID |
| 5582 | (2R)-({4-[AMINO(IMINO)METHYL]PHENYL}AMINO){5-ETHOXY-2-FLUORO-3-[(3R)-TETRAHYDROFURAN-3-YLOXY]PHENYL}ACETICACID |
| 5583 | (2R)-1-(2,6-dimethylphenoxy)propan-2-amine |
| 5584 | (2R)-1-(DIMETHYLAMINO)-3-{4-[(6-{[2-FLUORO-5-(TRIFLUOROMETHYL)PHENYL]AMINO}PYRIMIDIN-4-YL)AMINO]PHENOXY}PROPAN-2-OL |
| 5585 | (2R)-1-[(4-tert-butylsulfonyl)-2-methyl-4-(4-nitrophenyl)piperazine |
| 5586 | (2R)-1-[(5,6-DIPHENYL-7H-PYRROLO[2,3-D]PYRIMIDIN-4-YL)AMINO]PROPAN-2-OL |
| 5587 | (2R)-1-[4-({2,5-DICHLOROPHENYL)AMINO]PYRIMIDIN-2-YL}AMINO)PHENOXY]-3-(DIMETHYLAMINO)PROPAN-2-OL |
| 5588 | (2R)-1-[4-({6-[(2,6-DIFLUOROPHENYL)AMINO]PYRIMIDIN-4-YL}AMINO)PHENOXY]-3-(DIMETHYLAMINO)PROPAN-2-OL |
| 5589 | (2R)-1-{4-[(4-ANILINO-5-BROMOPYRIMIDIN-2-YL)AMINO]PHENOXY}-3-(DIMETHYLAMINO)PROPAN-2-OL |
| 5590 | (2R)-2-({9-(1-methylethyl)-6-[(4-pyridin-2-ylbenzyl)amino]-9H-purin-2-yl}amino)butan-1-ol |
| 5591 | (2R)-2-(4-CHLOROPHENYL)-2-[4-(1H-PYRAZOL-4-YL)PHENYL]ETHANAMINE |
| 5592 | (2R)-2-(4-CHLOROPHENYL)-2-PHENYLETHANAMINE |
| 5593 | (2R)-2-(5-CHLORO-2-THIENYL)-N-{(3S)-1-[(1S)-1-METHYL-2-MORPHOLIN-4-YL-2-OXOETHYL]-2-OXOPYRROLIDIN-3-YL}PROPENE-1-SULFONAMIDE |
| 5594 | (2R)-2-(7-carbamoyl-1H-benzimidazol-2-yl)-2-methylpyrrolidinium |
| 5595 | (2R)-2-{[(4-FLUORO-3-METHYLPHENYL)SULFONYL]AMINO}-N-HYDROXY-2-TETRAHYDRO-2H-PYRAN-4-YLACETAMIDE |
| 5596 | (2R)-2-{4-(benzylamino)-8-(1-methylethyl)pyrazolo[1,5-a][1,3,5]triazin-2-yl]amino}butan-1-ol |
| 5597 | (2r)-2-{[Formyl(Hydroxy)Amino]Methyl}Hexanoic Acid |
| 5598 | (2R)-2-AMINO-3,3,3-TRIFLUORO-N-HYDROXY-2-{[(4-PHENOXYPHENYL)SULFONYL]METHYL}PROPANAMIDE |
| 5599 | (2R)-2-benzyl-3-nitropropanoic acid |
| 5600 | (2R)-2-ETHYL-1-HEXANESULFONIC ACID |

TABLE 1-continued

Ligands

| Ligand No. | Ligand Name |
|---|---|
| 5601 | (2R)-2-PHENYL-N-PYRIDIN-4-YLBUTANAMIDE |
| 5602 | (2R)-3-(phosphonooxy)propane-1,2-diyl diheptanoate |
| 5603 | (2R)-3-([(4Z)-5,6-DIPHENYL-6,7-DIHYDRO-4H-PYRROLO[2,3-D]PYRIMIDIN-4-YLIDENE]AMINO}PROPANE-1,2-DIOL |
| 5604 | (2R)-3-{[(BENZYLAMINO)CARBONYL]AMINO}-2-HYDROXYPROPANOIC ACID |
| 5605 | (2R)-3-{[{[(2S)-2,3-DIHYDROXYPROPYL]OXY}(HYDROXY)PHOSPHORYL]OXY}-2-[(9E)-HEXADEC-9-ENOYLOXY]PROPYL (9E)-OCTADEC-9-ENOATE |
| 5606 | (2R)-4-(2-BENZOYL-1,2-DIAZEPAN-1-YL)-4-OXO-1-(2,4,5-TRIFLUOROPHENYL)BUTAN-2-AMINE |
| 5607 | (2R)-4,4-dihydroxy-5-nitro-2-(phenylmethyl)pentanoic acid |
| 5608 | (2R)-4-[(8R)-8-METHYL-2-(TRIFLUOROMETHYL)-5,6-DIHYDRO[1,2,4]TRIAZOLO[1,5-A]PYRAZIN-7(8H)-YL]-4-OXO-1-(2,4,5-TRIFLUOROPHENYL)BUTAN-2-AMINE |
| 5609 | (2R)-N-[(2R)-2-(DIHYDROXYBORYL)-1-L-PROLYLPYRROLIDIN-2-YL]-N-[(5R)-5-(DIHYDROXYBORYL)-1-L-PROLYLPYRROLIDIN-2-YL]-L-PROLINAMIDE |
| 5610 | (2r)-N-[4-Cyano-3-(Trifluoromethyl)Phenyl]-3-[(4-Fluorophenyl)Sulfonyl]-2-Hydroxy-2-Methylpropanamide |
| 5611 | (2R)-N~4~-hydroxy-2-(3-hydroxybenzyl)-N~1~-[(1S,2R)-2-hydroxy-2,3-dihydro-1H-inden-1-yl]butanediamide |
| 5612 | (2R)-N-HYDROXY-2-[(3S)-3-METHYL-3-{4-[(2-METHYLQUINOLIN-4-YL)METHOXY]PHENYL}-2-OXOPYRROLIDIN-1-YL]PROPANAMIDE |
| 5613 | (2R)-N-hydroxy-3-naphthalen-2-yl-2-[(naphthalen-2-ylsulfonyl)amino]propanamide |
| 5614 | (2R,3R)-3-{[3,5-BIS(TRIFLUOROMETHYL)PHENYL]AMINO}-2-CYANO-3-THIOXOPROPANAMIDE |
| 5615 | (2R,3R)-7-(methylsulfonyl)-3-(2,4,5-trifluorophenyl)-1,2,3,4-tetrahydropyrido[1,2-a]benzimidazol-2-amine |
| 5616 | (2R,3R)-N 1 -[(1S)-2,2-DIMETHYL-1-(METHYLCARBAMOYL)PROPYL]-N 4 -HYDROXY-2-(2-METHYLPROPYL)-3-{[(1,3-THIAZOL-2-YLCARBONYL)AMINO]METHYL}BUTANEDIAMIDE |
| 5617 | (2r,3r,4r,5r)-3,4-Dihydroxy-N,N'-Bis[(1s,2r)-2-Hydroxy-2,3-Dihydro-1h-Inden-1-Yl]-2,5-Bis(2-Phenylethyl)Hexanediamide |
| 5618 | (2R,3R,4R,5S)-2-(HYDROXYMETHYL)-1-NONYLPIPERIDINE-3,4,5-TRIOL |
| 5619 | (2R,3R,4S)-3-(4-HYDROXYPHENYL)-4-METHYL-2-[4-(2-PYRROLIDIN-1-YLETHOXY)PHENYL]CHROMAN-6-OL |
| 5620 | (2R,3R,4S,5R)-2-[6-amino-6-[(3,4-dichlorophenyl)methylamino]purin-9-yl]-5-(hydroxymethyl)oxolane-3,4-diol |
| 5621 | (2r,3r,4s,5r)-2-Acetamido-3,4-Dihydroxy-5-Hydroxymethyl-Piperidinium |
| 5622 | (2R,4R)-N~1~-(4-CHLOROPHENYL)-N~2~-[2-FLUORO-4-(2-OXOPYRIDIN-1(2H)-YL)PHENYL]-4-METHOXYPYRROLIDINE-1,2-DICARBOXAMIDE |
| 5623 | (2R,4S)-2-[(R)-BENZYLCARBAMOYL-PHENYLACETYL-METHYL]-5,5-DIMETHYL-THIAZOLIDINE-4-CARBOXYLIC ACID |
| 5624 | (2r,4s)-2-Methyl-2,3,3,4-Tetrahydroxytetrahydrofuran |
| 5625 | (2R,6S)-6-{[methyl(3,4,5-trimethoxyphenyl)amino]methyl}-1,2,5,6,7,8-hexahydroquinazoline-2,4-diamine |
| 5626 | (2S) N-ACETYL-L-ALANYL-ALPHAL-PHENYLALANYL-CHLOROETHYLKETONE |
| 5627 | (2S)-({(5Z)-5-[(5-ETHYL-2-FURYL)METHYLENE]-4-OXO-4,5-DIHYDRO-1,3-THIAZOL-2-YL}AMINO)(4-FLUOROPHENYL)ACETIC ACID |
| 5628 | (2S)-1-(1H-INDOL-3-YL)-3-{[5-(3-METHYL-1H-INDAZOL-5-YL)PYRIDIN-3-YL]OXY}PROPAN-2-AMINE |
| 5629 | (2S)-1-(2,5-dimethylphenoxy)-3-morpholin-4-ylpropan-2-ol |
| 5630 | (2S)-1-(6H-INDOL-3-YL)-3-{[5-(7H-PYRAZOLO[3,4-C]PYRIDIN-5-YL)PYRIDIN-3-YL]OXY}PROPAN-2-AMINE |
| 5631 | (2S)-1-(9H-Carbazol-4-yloxy)-3-(isopropylamino)propan-2-ol |
| 5632 | (2S)-1,3-benzothiazol-2-yl{2-[(2-pyridin-3-ylethyl)amino]pyrimidin-4-yl}ethanenitrile |
| 5633 | (2S)-1-[4-({4-[(2,5-DICHLOROPHENYL)AMINO]PYRIMIDIN-2-YL}AMINO)PHENOXY]-3-(DIMETHYLAMINO)PROPAN-2-OL |
| 5634 | (2S)-1-[4-({6-[(2,6-DIFLUOROPHENYL)AMINO]PYRIMIDIN-4-YL}AMINO)PHENOXY]-3-(DIMETHYLAMINO)PROPAN-2-OL |
| 5635 | (2S)-1-{[5-(1H-INDAZOL-5-YL)PYRIDIN-3-YL]OXY}-3-[(7AS)-7AH-INDOL-3-YL]PROPAN-2-AMINE |
| 5636 | (2S)-1-{[5-(3-METHYL-1H-INDAZOL-5-YL)PYRIDIN-3-YL]OXY}-3-PHENYLPROPAN-2-AMINE |
| 5637 | (2S)-1-{4-[(4-ANILINO-5-BROMOPYRIMIDIN-2-YL)AMINO]PHENOXY}-3-(DIMETHYLAMINO)PROPAN-2-OL |
| 5638 | (2S)-1-AMINO-3-[(5-NITROQUINOLIN-8-YL)AMINO]PROPAN-2-OL |
| 5639 | (2S)-1-methyl-2-[(2S,4R)-2-methyl-4-phenylpentyl]piperidine |
| 5640 | (2S)-2-({6-[(3-AMINO-5-CHLOROPHENYL)AMINO]-9-ISOPROPYL-9H-PURIN-2-YL}AMINO)-3-METHYLBUTAN-1-OL |
| 5641 | (2S)-2-(1H-indol-3-yl)hexanoic acid |
| 5642 | (2S)-2-(1H-indol-3-yl)pentanoic acid |
| 5643 | (2S)-2-(3-{[AMINO(IMINO)METHYL]AMINO}PHENYL)-3-[(S)-HYDROXY(3-PHENYLPROPYL)PHOSPHORYL]PROPANOIC ACID |
| 5644 | (2S)-2-(3-bromophenyl)-3-(5-chloro-2-hydroxyphenyl)-1,3-thiazolidin-4-one |
| 5645 | (2S)-2-(4-{[3-CHLORO-5-(TRIFLUOROMETHYL)PYRIDIN-2-YL]OXY}PHENOXY)PROPANOIC ACID |
| 5646 | (2S)-2-(4-chlorophenoxy)-3-phenylpropanoic acid |
| 5647 | (2S)-2-(4-CHLOROPHENYL)-2-[4-(1H-PYRAZOL-4-YL)PHENYL]ETHANAMINE |
| 5648 | (2S)-2-(4-ethylphenoxy)-3-phenylpropanoic acid |
| 5649 | (2S)-2-(6-methoxynaphthalen-2-yl)propanoic acid |
| 5650 | (2S)-2-(biphenyl-4-yloxy)-3-phenylpropanoic acid |
| 5651 | (2S)-2-(BUTYRYLOXY)-3-HYDROXYPROPYL NONANOATE |
| 5652 | (2S)-2-[(2,1,3-BENZOTHIADIAZOL-4-YLSULFONYL)AMINO]-2-PHENYL-N-PYRIDIN-4-YLACETAMIDE |
| 5653 | (2s)-2-[(2,4-Dichloro-Benzoyl)-(3-Trifluoromethyl-Benzyl)-Amino]-3-Phenyl-Propionic Acid |
| 5654 | (2S)-2-[(3aR,4R,7S,7aS)-1,3-dioxooctahydro-2H-4,7-methanoisoindol-2-yl]propanoic acid |
| 5655 | (2s)-2-[(5-Benzofuran-2-Yl-Thiophen-2-Ylmethyl)-(2,4-Dichloro-Benzoyl)-Amino]-3-Phenyl-Propionic Acid |
| 5656 | (2S)-2-[3-(AMINOMETHYL)PHENYL]-3-[(R)-[(1R)-1-{[(BENZYLOXY)CARBONYL]AMINO}-2-METHYLPROPYL](HYDROXY)PHOSPHORYL]PROPANOIC ACID |
| 5657 | (2S)-2-[3-(AMINOMETHYL)PHENYL]-3-[(R)-HYDROXY{(1R)-2-METHYL-1-[(PHENYLSULFONYL)AMINO]PROPYL}PHOSPHORYL]PROPANOIC ACID |
| 5658 | (2S)-2-[3-(AMINOMETHYL)PHENYL]-3-{(R)-HYDROXY[(1R)-2-METHYL-1-{[(3-PHENYLPROPYL)ULFONYL]AMINO}PROPYL]PHOSPHORYL}PROPANOIC ACID |
| 5659 | (2S)-2-[3-(AMINOMETHYL)PHENYL]-3-{(S)-HYDROXY[(1R)-2-METHYL-1-{[(2-PHENYLETHYL)SULFONYL]AMINO}PROPYL]PHOSPHORYL}PROPANOIC ACID |
| 5660 | (2S)-2-{[3-(3-aminophenyl)imidazo[1,2-b]pyridazin-6-yl]amino}-3-methylbutan-1-ol |
| 5661 | (2S)-2-{[HYDROXY(4-IODOBENZYL)PHOSPHORYL]METHYL}PENTANEDIOIC ACID |
| 5662 | (2S)-2-{3-[({[2-fluoro-4-(trifluoromethyl)phenyl]carbonyl}amino)methyl]-4-methoxybenzyl}butanoic acid |

TABLE 1-continued

Ligands

| Ligand No. | Ligand Name |
|---|---|
| 5663 | (2S)-2-AMINO-1-(5-TERT-BUTYL-1,3,4-OXADIAZOL-2-YL)PROPAN-1-ONE |
| 5664 | (2S)-2-AMINO-4-(METHYLSULFANYL)-1-(1,3-THIAZOL-2-YL)BUTANE-1,1-DIOL |
| 5665 | (2s)-2-Amino-4-(Methylsulfanyl)-1-Pyridin-2-Ylbutane-1,1-Diol |
| 5666 | (2S)-2-amino-5-oxo-5-[(4-phenylmethoxyphenyl)amino]pentanoic acid |
| 5667 | (2S)-2-ETHOXY-3-{4-[2-(10H-PHENOXAZIN-10-YL)ETHOXY]PHENYL}PROPANOIC ACID |
| 5668 | (2S)-2-HYDROXY-2H-CHROMENE-2-CARBOXYLIC ACID |
| 5669 | (2S)-2-hydroxy-2-methyl-N-[4-nitro-3-(trifluoromethyl)phenyl]-3-(pentafluorophenoxy)propanamide |
| 5670 | (2S)-2-HYDROXYOCTANOIC ACID |
| 5671 | (2S)-2-methyl-2,3-dihydrothieno[2,3-f][1,4]oxazepin-5-amine |
| 5672 | (2S)-3-(1-{[2-(2-CHLOROPHENYL)-5-METHYL-1,3-OXAZOL-4-YL]METHYL}-1H-INDOL-5-YL)-2-ETHOXYPROPANOIC ACID |
| 5673 | (2S)-3-(4-chloro-3-fluorophenoxy)-N-[4-cyano-3-(trifluoromethyl)phenyl]-2-hydroxy-2-methylpropanamide |
| 5674 | (2S)-3-[(R)-[(1S)-1-amino-3-phenylpropyl](hydroxy)phosphoryl]-2-benzylpropanoic acid |
| 5675 | (2S)-3-[4-(acetylamino)phenoxy]-2-hydroxy-2-methyl-N-[4-nitro-3-(trifluoromethyl)phenyl]propanamide |
| 5676 | (2S)-4-(2,5-DIFLUOROPHENYL)-N,N-DIMETHYL-2-PHENYL-2,5-DIHYDRO-1H-PYRROLE-1-CARBOXAMIDE |
| 5677 | (2S)-4-(2,5-difluorophenyl)-N-[(3R,4S)-3-fluoro-1-methylpiperidin-4-yl]-2-(hydroxymethyl)-N-methyl-2-phenyl-2,5-dihydro-1H-pyrrole-1-carboxamide |
| 5678 | (2S)-4-(2,5-DIFLUOROPHENYL)-N-METHYL-2-PHENYL-N-PIPERIDIN-4-YL-2,5-DIHYDRO-1H-PYRROLE-1-CARBOXAMIDE |
| 5679 | (2S)-4-(4-fluorobenzyl)-N-(2-sulfanylethyl)piperazine-2-carboxamide |
| 5680 | (2S)-4-(4-fluorobenzyl)-N-(3-sulfanylpropyl)piperazine-2-carboxamide |
| 5681 | (2S)-4-METHYL-2-(3-PHENYLTHIOUREIDO)-N-((3S)-TETRAHYDRO-2-HYDROXY-3-FURANYL)PENTANAMIDE |
| 5682 | (2S)-5-hydroxy-2-(4-hydroxyphenyl)-7-methoxy-2,3-dihydro-4H-chromen-4-one |
| 5683 | (2S)-6-(2,4-DIAMINO-6-ETHYLPYRIMIDIN-5-YL)-2-(3,5-DIFLUOROPHENYL)-4-(3-METHOXYPROPYL)-2H-1,4-BENZOXAZIN-3(4H)-ONE |
| 5684 | (2S)-8-[(tert-butoxycarbonyl)amino]-2-(1H-indol-3-yl)octanoic acid |
| 5685 | (2s)-Hydroxy(4-Hydroxyphenyl)Ethanenitrile |
| 5686 | (2S)-hydroxy(4-hydroxyphenyl)ethanoic acid |
| 5687 | (2S)-N-(4-cyano-3-iodophenyl)-3-(4-cyanophenoxy)-2-hydroxy-2-methylpropanamide |
| 5688 | (2S)-N-[(3S)-1-(2-AMINO-2-OXOETHYL)-2-OXO-1,2,3,4-TETRAHYDROQUINOLIN-3-YL]-2-CHLORO-2H-THIENO[2,3-B]PYRROLE-5-CARBOXAMIDE |
| 5689 | (2S)-N-[(3Z)-5-CYCLOPROPYL-3H-PYRAZOL-3-YLIDENE]-2-[4-(2-OXOIMIDAZOLIDIN-1-YL)PHENYL]PROPANAMIDE |
| 5690 | (2s)-Pyrrolidin-2-Ylmethylamine |
| 5691 | (2S,3R)-3-(6-amino-9H-purin-9-yl)nonan-2-ol |
| 5692 | (2s,3r)-3-Amino-2-Hydroxy-5-(Ethylsulfanyl)Pentanoyl-((S)-(−)-(1-Naphthyl)Ethyl)Amide |
| 5693 | (2s,3s)-1,4-Dimercaptobutane-2,3-Diol |
| 5694 | (2S,3S)-3-(4-fluorophenyl)-2,3-dihydroxypropanoic acid |
| 5695 | (2S,3S)-3-{3-[2-chloro-4-(methylsulfonyl)phenyl]-1,2,4-oxadiazol-5-yl}-1-cyclopentylidene-4-cyclopropyl-1-fluorobutan-2-amine |
| 5696 | (2S,3S)-3-{3-[4-(METHYLSULFONYL)PHENYL]-1,2,4-OXADIAZOL-5-YL}-1-OXO-1-PYRROLIDIN-1-YLBUTAN-2-AMINE |
| 5697 | (2S,3S)-3-AMINO-4-(3,3-DIFLUOROPYRROLIDIN-1-YL)-N,N-DIMETHYL-4-OXO-2-(TRANS-4-[1,2,4]TRIAZOLO[1,5-A]PYRIDIN-6-YLCYCLOHEXYL)BUTANAMIDE |
| 5698 | (2S,3S)-3-AMINO-4-[(3S)-3-FLUOROPYRROLIDIN-1-YL]-N,N-DIMETHYL-4-OXO-2-(TRANS-4-[1,2,4]TRIAZOLO[1,5-A]PYRIDIN-5-YLCYCLOHEXYL)BUTANAMIDE |
| 5699 | (2S,3S)-3-FORMYL-2-({[(4-METHYLPHENYL)SULFONYL]AMINO}METHYL)PENTANOIC ACID |
| 5700 | (2S,3S)-3-FORMYL-2-({[(4-NITROPHENYL)SULFONYL]AMINO}METHYL)PENTANOIC ACID |
| 5701 | (2S,3S)-4-cyclopropyl-3-{(3R,5R)-3-[2-fluoro-4-(methylsulfonyl)phenyl]-1,2,4-oxadiazolidin-5-yl}-1-[(3S)-3-fluoropyrrolidin-1-yl]-1-oxobutan-2-amine |
| 5702 | (2s,3s)-Trans-2,3-Dihydro-3-Hydroxyanthranilic Acid |
| 5703 | (2S,3S,4E,6E,8S,9S)-3-amino-9-methoxy-2,6,8-trimethyl-10-phenyldeca-4,6-dienoic acid |
| 5704 | (2s,4r)-1-Acetyl-N-[(1s)-4-[(Aminoiminomethyl)Amino]-1-(2-Benzothiazolylcarbonyl)Butyl]-4-Hydroxy-2-Pyrrolidinecarboxamide |
| 5705 | (2s,4s)-Alpha-Campholinic Acid |
| 5706 | (2S,4S,5R)-1-(4-TERT-BUTYLBENZOYL)-2-ISOBUTYL-5-(1,3-THIAZOL-2-YL)PYRROLIDINE-2,4-DICARBOXYLIC ACID |
| 5707 | (2S,4S,5R)-2-ISOBUTYL-5-(2-THIENYL)-1-[4-(TRIFLUOROMETHYL)BENZOYL]PYRROLIDINE-2,4-DICARBOXYLIC ACID |
| 5708 | (2s,5r,6r)-6-{[(6r)-6-(Glycylamino)-7-Oxido-7-Oxoheptanoyl]Amino}-3,3-Dimethyl-7-Oxo-4-Thia-1-Azabicyclo[3.2.0]Heptane-2-Carboxylate |
| 5709 | (2S,5R,8S,11R,12S,15S,18S,19S,E)-8-ISOBUTYL-18-((5S,6S)-6-METHOXY-3,5-DIMETHYL-7-PHENYLHEPTYL)-1,2,5,12,15,19-HEXAMETHYL-3,6,9,13,16,20,25-HEPTAOXO-1,4,7,10,14,17,21-HEPTAAZACYCLOPENTACOS-21-ENE-11,22-DICARBOXYLIC ACID |
| 5710 | (2s,5s)-5-Carboxymethylproline |
| 5711 | (2-Sulfanyl-3-Phenylpropanoyl)-Phe-Tyr |
| 5712 | (2z)-2-(Benzoylamino)-3-[4-(2-Bromophenoxy)Phenyl]-2-Propenoic Acid |
| 5713 | (2Z)-2-cyano-N-(2,2'-dichlorobiphenyl-4-yl)-3-hydroxybut-2-enamide |
| 5714 | (2Z)-2-cyano-N-(3'-ethoxybiphenyl-4-yl)-3-hydroxybut-2-enamide |
| 5715 | (2z)-3-{[Oxido(Oxo)Phosphino]Oxy}-2-Phenylacrylate |
| 5716 | (2Z)-5'-BROMO-2,3'-BIINDOLE-2',3(1H,1'H)-DIONE AMMONIATE |
| 5717 | (2Z)-N-(3-chloro-2'-methoxybiphenyl-4-yl)-2-cyano-3-hydroxybut-2-enamide |
| 5718 | (2Z)-N-biphenyl-4-yl-2-cyano-3-cyclopropyl-3-hydroxyprop-2-enamide |
| 5719 | (2Z)-N-biphenyl-4-yl-2-cyano-3-hydroxybut-2-enamide |
| 5720 | (2Z,3E)-2,3'-BIINDOLE-2',3(1H,1'H)-DIONE 3-{O-[(3R)-3,4-DIHYDROXYBUTYL]OXIME} |
| 5721 | (2Z,4E)-2-HYDROXY-6-OXO-6-PHENYLHEXA-2,4-DIENOIC ACID |
| 5722 | (2Z,4E)-3-chloro-2-hydroxy-6-oxo-6-phenylhexa-2,4-dienoic acid |
| 5723 | (3,3-dimethylpiperidin-1-yl)(6-(3-fluoro-4-methylphenyl)pyridin-2-yl)methanone |
| 5724 | (3,4,5-Trihydroxy-6-Hydroxymethyl-Tetrahydro-Pyran-2-Yl)-Phosphoramidic Acid Dimethyl Ester |
| 5725 | (3,4-DIHYDROXY-2-NITROPHENYL)(PHENYL)METHANONE |
| 5726 | (3,4-Dihydroxy-Phenyl)-Triphenyl-Arsonium |
| 5727 | (3-{[[2-Chloro-3-(Trifluoromethyl)Benzyl](2,2-Diphenylethyl)Amino]Propoxy}Phenyl)Acetic Acid |
| 5728 | (3AALPHA,4ALPHA,7ALPHA,7AALPHA)-3A,4,7,7A-TETRAHYDRO-2-(4-NITRO-1-NAPHTHALENYL)-4,7-ETHANO-1H-ISOINDOLE-1,3(2H)-DIONE |
| 5729 | (3ALPHA,5BETA,12ALPHA)-3,12-DIHYDROXYCHOLAN-24-OIC ACID |
| 5730 | (3AR,5R,6S,7R,7AR)-5-(HYDROXYMETHYL)-2-PROPYL-5,6,7,7A-TETRAHYDRO-3AH-PYRANO[3,2-D][1,3]THIAZOLE-6,7-DIOL |

TABLE 1-continued

Ligands

| Ligand No. | Ligand Name |
|---|---|
| 5731 | (3AR,6R,6AS)-6-((S)-((S)-CYCLOHEX-2-ENYL)(HYDROXY)METHYL)-6A-METHYL-4-OXO-HEXAHYDRO-2H-FURO[3,2-C]PYRROLE-6-CARBALDEHYDE |
| 5732 | (3aS)-3a-hydroxy-1-phenyl-1,2,3,3a-tetrahydro-4H-pyrrolo[2,3-b]quinolin-4-one |
| 5733 | (3aS)-3a-hydroxy-5-methyl-1-phenyl-1,2,3,3a-tetrahydro-4H-pyrrolo[2,3-b]quinolin-4-one |
| 5734 | (3aS)-3a-hydroxy-7-methyl-1-phenyl-1,2,3,3a-tetrahydro-4H-pyrrolo[2,3-b]quinolin-4-one |
| 5735 | (3AS,4R,9BR)-2,2-DIFLUORO-4-(4-HYDROXYPHENYL)-1,2,3,3A,4,9B-HEXAHYDROCYCLOPENTA[C]CHROMEN-8-OL |
| 5736 | (3aS,4R,9bR)-2,2-difluoro-4-(4-hydroxyphenyl)-6-(methoxymethyl)-1,2,3,3a,4,9b-hexahydrocyclopenta[c]chromen-8-ol |
| 5737 | (3AS,4R,9BR)-4-(4-HYDROXYPHENYL)-1,2,3,3A,4,9B-HEXAHYDROCYCLOPENTA[C]CHROMEN-8-OL |
| 5738 | (3AS,4R,9BR)-4-(4-HYDROXYPHENYL)-1,2,3,3A,4,9B-HEXAHYDROCYCLOPENTA[C]CHROMEN-9-OL |
| 5739 | (3AS,4R,9BR)-4-(4-HYDROXYPHENYL)-6-(METHOXYMETHYL)-1,2,3,3A,4,9B-HEXAHYDROCYCLOPENTA[C]CHROMEN-8-OL |
| 5740 | (3ASR,4RS,8ASR,8BRS)-4-(2-(4-FLUOROBENZYL)-1,3-DIOXODEACAHYDROPYRROLO[3,4-A] PYRROLIZIN-4-YL)BENZAMIDINE |
| 5741 | (3-Carboxy-2-(R)-Hydroxy-Propyl)-Trimethyl-Ammonium |
| 5742 | (3-Chloro-4-Propoxy-Phenyl)-Acetic Acid |
| 5743 | (3E)-2,6-DIOXO-6-PHENYLHEX-3-ENOATE |
| 5744 | (3e)-3-[(4-Hydroxyphenyl)Imino]-1h-Indol-2(3h)-One |
| 5745 | (3E)-3-[(phenylamino)methylidene]dihydrofuran-2(3H)-one |
| 5746 | (3E)-4-(1-METHYL-1H-INDOL-3-YL)BUT-3-EN-2-ONE |
| 5747 | (3E)-4-(2-HYDROXYPHENYL)-2-OXOBUT-3-ENOIC ACID |
| 5748 | (3E)-5-fluoro-1-[(6-fluoro-4H-1,3-benzodioxin-8-yl)methyl]-1H-indole-2,3-dione 3-oxime |
| 5749 | (3e)-6'-Bromo-2,3'-Biindole-2',3(1h,1'h)-Dione 3-Oxime |
| 5750 | (3-ENDO)-8-METHYL-8-AZABICYCLO[3.2.1]OCT-3-YL 1H-PYRROLO[2,3-B]PYRIDINE-3-CARBOXYLATE |
| 5751 | (3-EXO)-3-(10,11-DIHYDRO-5H-DIBENZO[A,D][7]ANNULEN-5-YLOXY)-8,8-DIMETHYL-8-AZONIABICYCLO[3.2.1]OCTANE |
| 5752 | (3-Formyl-but-3-Enyl)-Phosphonic Acid |
| 5753 | (3r)-1-Acetyl-3-Methylpiperidine |
| 5754 | (3R)-3-(aminomethyl)-9-methoxy-1,2,3,4-tetrahydro-5H-[1]benzothieno[3,2-e][1,4]diazepin-5-one |
| 5755 | (3R)-3-(FLUOROMETHYL)-7-(THIOMORPHOLIN-4-YLSULFONYL)-1,2,3,4-TETRAHYDROISOQUINOLINE |
| 5756 | (3R)-3-(FLUOROMETHYL)-N-(3,3,3-TRIFLUOROPROPYL)-1,2,3,4-TETRAHYDROISOQUINOLINE-7-SULFONAMIDE |
| 5757 | (3R)-3-[(1,2,3,4-tetrahydroisoquinolin-7-yloxy)methyl]-2,3-dihydrothieno[2,3-f][1,4]oxazepin-5-amine |
| 5758 | (3r)-3-{[(Benzyloxy)Carbonyl]Amino}-2-Oxo-4-Phenylbutane-1-Diazonium |
| 5759 | (3R)-3-cyclopentyl-6-methyl-7-[(4-methylpiperazin-1-yl)sulfonyl]-3,4-dihydro-2H-1,2-benzothiazine 1,1-dioxide |
| 5760 | (3R)-3-cyclopentyl-7-[(4-methylpiperazin-1-yl)sulfonyl]-3,4-dihydro-2H-1,2-benzothiazine 1,1-dioxide |
| 5761 | (3R)-3-ethyl-N-[(4-methylphenyl)sulfonyl]-L-aspartic acid |
| 5762 | (3R)-3-hydroxy-2,2-dimethyl-4-oxo-4-({3-oxo-3-[(2-sulfanylethyl)amino]propyl}amino)butyl 2,2-dimethylpropanoate |
| 5763 | (3R)-3-HYDROXYDODECANOIC ACID |
| 5764 | (3r)-4-(P-Toluenesulfonyl)-1,4-Thiazane-3-Carboxylicacid-L-Leucine |
| 5765 | (3r)-4-(P-Toluenesulfonyl)-1,4-Thiazane-3-Carboxylicacid-L-Phenylalanine Ethyl Ester |
| 5766 | (3R)-4,4-DIFLUORO-3-[(4-METHOXYPHENYL)SULFONYL]BUTANOIC ACID |
| 5767 | (3R)-4-[(3R)-3-AMINO-4-(2,4,5-TRIFLUOROPHENYL)BUTANOYL]-3-(2,2,2-TRIFLUOROETHYL)-1,4-DIAZEPAN-2-ONE |
| 5768 | (3R)-4-[(3R)-3-AMINO-4-(2,4,5-TRIFLUOROPHENYL)BUTANOYL]-3-METHYL-1,4-DIAZEPAN-2-ONE |
| 5769 | (3R)-4-{[(3,4-dihydroxyphenyl)acetyl]oxy}-N-(2-formylindolizin-3-yl)-3-sulfino-D-valine |
| 5770 | (3R)-8-(dioxidosulfanyl)-3-methyl-1,2,3,4-tetrahydroquinoline |
| 5771 | (3R)-METHYLCARBAMOYL-7-SULFOAMINO-3,4-DIHYDRO-1H-ISOQUINOLINE-2-CARBOXYLIC ACID BENZYL ESTER |
| 5772 | (3R)-N-(4-CHLOROPHENYL)-3-(HYDROXYMETHYL)-1,2,3,4-TETRAHYDROISOQUINOLINE-7-SULFONAMIDE |
| 5773 | (3R)-N-methyl-3-phenyl-3-[4-(trifluoromethyl)phenoxy]propan-1-amine |
| 5774 | (3R,4R)-1-{6-[3-(METHYLSULFONYL)PHENYL]PYRIMIDIN-4-YL}-4-(2,4,5-TRIFLUOROPHENYL)PIPERIDIN-3-AMINE |
| 5775 | (3R,4R)-4-(pyrrolidin-1-ylcarbonyl)-1-(quinoxalin-2-ylcarbonyl)pyrrolidin-3-amine |
| 5776 | (3R,4R,5R)-5-(HYDROXYMETHYL)-1-(3-PHENYLPROPYL)PIPERIDINE-3,4-DIOL |
| 5777 | (3r,4r,5r)-5-(Hydroxymethyl)Piperidine-3,4-Diol |
| 5778 | (3R,4S)-1-(3,4-DIMETHOXYPHENYL)-3-(3-METHYLPHENYL)PIPERIDIN-4-AMINE |
| 5779 | (3R,4S)-1-[(4-amino-5H-pyrrolo[3,2-d]pyrimidin-7-yl)methyl]-4-[(benzylsulfanyl)methyl]pyrrolidin-3-ol |
| 5780 | (3R,4S)-1-[(4-amino-5H-pyrrolo[3,2-d]pyrimidin-7-yl)methyl]-4-[(butylsulfanyl)methyl]pyrrolidin-3-ol |
| 5781 | (3R,4S)-1-[(4-AMINO-5H-PYRROLO[3,2-D]PYRIMIDIN-7-YL)METHYL]-4-[(METHYLSULFANYL)METHYL]PYRROLIDIN-3-OL |
| 5782 | (3R,4S)-1-[6-(6-METHOXYPYRIDIN-3-YL)PYRIMIDIN-4-YL]-4-(2,4,5-TRIFLUOROPHENYL)PYRROLIDIN-3-AMINE |
| 5783 | (3R,4S)-1-{6-[3-(METHYLSULFONYL)PHENYL]PYRIMIDIN-4-YL}-4-(2,4,5-TRIFLUOROPHENYL)PYRROLIDIN-3-AMINE |
| 5784 | (3R,4S,5S,7R,9E,11R,12R)-12-ETHYL-4-HYDROXY-3,5,7,11-TETRAMETHYLOXACYCLODODEC-9-ENE-2,8-DIONE |
| 5785 | (3r,5r)-7-((1r,2r,6s,8r,8as)-2,6-Dimethyl-8-{[(2r)-2-Methylbutanoyl]Oxy}-1,2,6,7,8,8a-Hexahydronaphthalen-1-Yl)-3,5-Dihydroxyheptanoic Acid |
| 5786 | (3R,5S,7R,12S,13R)-13-FORMYL-12,14-DIHYDROXY-3,5,7-TRIMETHYLTETRADECANOIC ACID |
| 5787 | (3R,5Z,8S,9S,11E)-8,9,16-TRIHYDROXY-14-METHOXY-3-METHYL-3,4,9,10-TETRAHYDRO-1H-2-BENZOXACYCLOTETRADECINE-1,7(8H)-DIONE |
| 5788 | (3S)-1-(1,3-BENZODIOXOL-5-YLMETHYL)-3-[4-(1H-IMIDAZOL-1-YL)PHENOXY]PIPERIDINE |
| 5789 | (3S)-1-(2-hydroxyphenyl)-5-oxopyrrolidine-3-carboxylic acid |
| 5790 | (3S)-1-(4-acetylphenyl)-5-oxopyrrolidine-3-carboxylic acid |
| 5791 | (3S)-1-{[4-(but-2-yn-1-yloxy)phenyl]sulfonyl}pyrrolidine-3-thiol |
| 5792 | (3S)-1-CYCLOHEXYL-5-OXO-N-PHENYLPYRROLIDINE-3-CARBOXAMIDE |
| 5793 | (3S)-1-CYCLOHEXYL-N-(3,5-DICHLOROPHENYL)-5-OXOPYRROLIDINE-3-CARBOXAMIDE |
| 5794 | (3s)-3,4-Di-N-Hexanoyloxybutyl-1-Phosphocholine |
| 5795 | (3s)-3-Amino-1-(Cyclopropylamino)Heptane-2,2-Diol |
| 5796 | (3S)-3-cyclopentyl-6-methyl-7-[(4-methylpiperazin-1-yl)sulfonyl]-3,4-dihydro-2H-1,2,4-benzothiadiazine 1,1-dioxide |
| 5797 | (3S)-3-hydroxy-1-methyl-2,3-dihydro-1H-indole-5,6-dione |
| 5798 | (3S)-4-{[4-(BUT-2-YNYLOXY)PHENYL]SULFONYL}-N-HYDROXY-2,2-DIMETHYLTHIOMORPHOLINE-3-CARBOXAMIDE |
| 5799 | (3S)-N-(3-BROMOPHENYL)-1-CYCLOHEXYL-5-OXOPYRROLIDINE-3-CARBOXAMIDE |
| 5800 | (3S)-N-(3-CHLORO-2-METHYLPHENYL)-1-CYCLOHEXYL-5-OXOPYRROLIDINE-3-CARBOXAMIDE |
| 5801 | (3S)-N-(5-CHLORO-2-METHYLPHENYL)-1-CYCLOHEXYL-5-OXOPYRROLIDINE-3-CARBOXAMIDE |
| 5802 | (3S)-N-methyl-3-phenyl-3-[4-(trifluoromethyl)phenoxy]propan-1-amine |

TABLE 1-continued

Ligands

| Ligand No. | Ligand Name |
|---|---|
| 5803 | (3s)-Tetrahydrofuran-3-Yl (1r,2s)-3-[4-((1r)-2-{[(S)-Amino(Hydroxy)Methyl]Oxy}-2,3-Dihydro-1h-Inden-1-Yl)-2-Benzyl-3-Oxopyrrolidin-2-Yl}-1-Benzyl-2-Hydroxypropylcarbamate |
| 5804 | (3S,5E)-3-propyl-3,4-dihydrothieno[2,3-f][1,4]oxazepin-5(2H)-imine |
| 5805 | (3S,5R,7R,8S,9S,10R)-7-(hydroxymethyl)-3-(2-naphthyl)-1,6-dioxa-2-azaspiro[4.5]decane-8,9,10-triol |
| 5806 | (3S,5R,7R,8S,9S,10R)-7-(hydroxymethyl)-3-(4-methylphenyl)-1,6-dioxa-2-azaspiro[4.5]decane-8,9,10-triol |
| 5807 | (3S,6S)-3,6-bis(4-hydroxybenzyl)piperazine-2,5-dione |
| 5808 | (3s,6s,9r,10r,11s,12s,13e,15e,18s,21s)-18-{(1e,3e,7s,8s)-9-[(2s,3r,4s,5s,6r,9s,11s)-9-Ethyl-4-Hydroxy-3,5,11-Trimethyl-8-Oxo-1-Oxa-7-Azaspiro[5.5]Undec-2-Yl]-8-Hydroxy-1,7-Dimethylnona-1,3-Dienyl}-10,12-Dihydroxy-3-(3-Hydroxybenzyl)-6-Isopropyl-11-Methyl- |
| 5809 | (3s,8ar)-3-(1h-Imidazol-5-Ylmethyl)Hexahydropyrrolo[1,2-a]Pyrazine-1,4-Dione |
| 5810 | (3s,8ar)-3-(4-Hydroxybenzyl)Hexahydropyrrolo[1,2-a]Pyrazine-1,4-Dione |
| 5811 | (3Z)-1-[(6-fluoro-4H-1,3-benzodioxin-8-yl)methyl]-4-[(E)-2-phenylethenyl]-1H-indole-2,3-dione 3-oxime |
| 5812 | (3Z)-1-[(6-fluoro-4H-1,3-benzodioxin-8-yl)methyl]-4-phenyl-1H-indole-2,3-dione 3-oxime |
| 5813 | (3Z)-6-(4-HYDROXY-3-METHOXYPHENYL)-3-(1H-PYRROL-2-YLMETHYLENE)-1,3-DIHYDRO-2H-INDOL-2-ONE |
| 5814 | (3Z)-N,N-DIMETHYL-2-OXO-3-(4,5,6,7-TETRAHYDRO-1H-INDOL-2-YLMETHYLIDENE)-2,3-DIHYDRO-1H-INDOLE-5-SULFONAMIDE |
| 5815 | (3Z,5S,6R,7S,8R,8aR)-3-(octylimino)hexahydro[1,3]oxazolo[3,4-a]pyridine-5,6,7,8-tetrol |
| 5816 | (3Z,5S,6R,7S,8R,8aS)-3-(octylimino)hexahydro[1,3]thiazolo[3,4-a]pyridine-5,6,7,8-tetrol |
| 5817 | (3Z,5S,6R,7S,8S,8aR)-3-(octylimino)hexahydro[1,3]oxazolo[3,4-a]pyridine-5,6,7,8-tetrol |
| 5818 | (4-{(2S)-2-[(tert-butoxycarbonyl)amino]-3-methoxy-3-oxopropyl}phenyl)methaneseleninic acid |
| 5819 | (4'-{[Allyl(Methyl)Amino]Methyl}-1,1'-Biphenyl-4-Yl)(4-Bromophenyl)Methanone |
| 5820 | (4-{2-Acetylamino-2-[1-(3-Carbamoyl-4-Cyclohexylmethoxy-Phenyl)-Ethylcarbamoyl]-Ethyl}-2-Phosphono-Phenoxy)-Acetic Acid |
| 5821 | (4-{4-[(TERT-BUTOXYCARBONYL)AMINO]-2,2-BIS(ETHOXYCARBONYL)BUTYL}PHENYL)SULFAMIC ACID |
| 5822 | (4-AMINO-2-{[1-(METHYLSULFONYL)PIPERIDIN-4-YL]AMINO}PYRIMIDIN-5-YL)(2,3-DIFLUORO-6-METHOXYPHENYL)METHANONE |
| 5823 | (4ar,6s,8ar)-11-[8-(1,3-Dioxo-1,3-Dihydro-2h-Isoindol-2-Yl)Octyl]-6-Hydroxy-3-Methoxy-5,6,9,10-Tetrahydro-4ah-[1]Benzofuro[3a,3,2-Ef][2]Benzazepin-11-Ium |
| 5824 | (4aS)-5-[(2,4-diaminopteridin-6-yl)methyl]-4a,5-dihydro-2H-dibenzo[b,f]azepin-8-ol |
| 5825 | (4aS,4bR,10bS,12aS)-12a-methyl-1,3-dioxo-2-(pyridin-3-ylmethyl)-1,2,3,4,4a,4b,5,6,10b,11,12,12a-dodecahydronaphtho[2,1-f]isoquinolin-8-yl sulfamate |
| 5826 | (4-BROMOPHENYL)[4-({(2E)-4-[CYCLOPROPYL(METHYL)AMINO]BUT-2-ENYL}OXY)PHENYL]METHANONE |
| 5827 | (4e)-4-Aminohex-4-Enoic Acid |
| 5828 | (4E)-N-(4-fluorophenyl)-4-[(phenylcarbonyl)imino]-4H-pyrazole-3-carboxamide |
| 5829 | (4e,8e,12z,16z)-N,N,4,8,13,17,21-Heptamethyldocosa-4,8,12,16,20-Pentaen-1-Amine |
| 5830 | (4-ETHYLPHENYL)SULFAMIC ACID |
| 5831 | (4-fluorophenyl)(pyridin-4-yl)methanone |
| 5832 | (4r)-2-Methylpentane-2,4-Diol |
| 5833 | (4R)-4-(3-butoxy-4-methoxybenzyl)imidazolidin-2-one |
| 5834 | (4R)-4-(3-HYDROXYPHENYL)-N,N,7,8-TETRAMETHYL-3,4-DIHYDROISOQUINOLINE-2(1H)-CARBOXAMIDE |
| 5835 | (4R)-7,8-dichloro-1',9-dimethyl-1-oxo-1,2,4,9-tetrahydrospiro[beta-carboline-3,4'-piperidine]-4-carbonitrile |
| 5836 | (4R)-7-chloro-9-methyl-1-oxo-1,2,4,9-tetrahydrospiro[beta-carboline-3,4'-piperidine]-4-carbonitrile |
| 5837 | (4R)-N-[4-({[2-(DIMETHYLAMINO)ETHYL]AMINO}CARBONYL)-1,3-THIAZOL-2-YL]-4-METHYL-1-OXO-2,3,4,9-TETRAHYDRO-1H-BETA-CARBOLINE-6-CARBOXAMIDE |
| 5838 | (4R,2S)-5'-(4-(4-CHLOROBENZYLOXY)PYRROLIDIN-2-YLMETHANESULFONYL)ISOQUINOLINE |
| 5839 | (4R,5R)-5-AMINO-1-[2-(1,3-BENZODIOXOL-5-YL)ETHYL]-4-(2,4,5-TRIFLUOROPHENYL)PIPERIDIN-2-ONE |
| 5840 | (4r,5s,6s,7r)-1,3-Dibenzyl-4,7-Bis(Phenoxymethyl)-5,6-Dihydroxy-1,3 Diazepan-2-One |
| 5841 | (4s)-2-[(1e)-1-Aminoprop-1-Enyl]-4,5-Dihydro-1,3-Thiazole-4-Carboxylic Acid |
| 5842 | (4S)-4-(2-NAPHTHYLMETHYL)-D-GLUTAMIC ACID |
| 5843 | (4s)-4-{[(2s)-2-Amino-3-Oxopropyl]Sulfanyl}-L-Homoserinate |
| 5844 | (4s)-5-Fluoro-L-Leucine |
| 5845 | (4S,5E,7Z,10Z,13Z,16Z,19Z)-4-hydroxydocosa-5,7,10,13,16,19-hexaenoic acid |
| 5846 | (4s,5s)-1,2-Dithiane-4,5-Diol |
| 5847 | (4s-Trans)-4-(Methylamino)-5,6-Dihydro-6-Methyl-4h-Thieno(2,3-B)Thiopyran-2-Sulfonamide-7,7-Dioxide |
| 5848 | (4-sulfamoyl-phenyl)-thiocarbamic acid O-(2-thiophen-3-yl-ethyl) ester |
| 5849 | (4Z)-2,8:7,12:11,15:14,18:17,22-PENTAANHYDRO-4,5,6,9,10,13,19,20,21-NONADEOXY-D-ARABINO-D-ALLO-D-ALLO-DOCOSA-4,9,20-TRIENITOL |
| 5850 | (4Z)-6-bromo-4-({[4-(pyrrolidin-1-ylmethyl)phenyl]amino}methylene)isoquinoline-1,3(2H,4H)-dione |
| 5851 | (5-(aminomethyl)-2H-spiro[benzofuran-3,4'-piperidine]-1'-yl)(5-(phenylethynyl)furan-2-yl)methanone |
| 5852 | (5-(PYRIDIN-3-YL)FURAN-2-YL)METHANAMINE |
| 5853 | (5,6-DIPHENYL-FURO[2,3-D]PYRIMIDIN-4-YLAMINO)-ACETIC |
| 5854 | (5-{3-[5-(PIPERIDIN-1-YLMETHYL)-1H-INDOL-2-YL]-1H-INDAZOL-6-YL}-2H-1,2,3-TRIAZOL-4-YL)METHANOL |
| 5855 | (5BETA)-PREGNANE-3,20-DIONE |
| 5856 | (5-CHLORO-2-{[(3-NITROBENZYL)AMINO]CARBONYL}PHENOXY)ACETIC ACID |
| 5857 | (5-Chloropyrazolo[1,5-a]Pyrimidin-7-Yl)-(4-Methanesulfonylphenyl)Amine |
| 5858 | (5E)-12-CHLORO-13,15-DIHYDROXY-4,7,8,9-TETRAHYDRO-2-BENZOXACYCLOTRIDECINE-1,10(3H,11H)-DIONE |
| 5859 | (5E)-14-CHLORO-15,17-DIHYDROXY-4,7,8,9,10,11-HEXAHYDRO-2-BENZOXACYCLOPENTADECINE-1,12(3H,13H)-DIONE |
| 5860 | (5E)-5-[(2,2-DIFLUORO-1,3-BENZODIOXOL-5-YL)METHYLENE]-1,3-THIAZOLIDINE-2,4-DIONE |
| 5861 | (5E,13E)-11-HYDROXY-9,15-DIOXOPROSTA-5,13-DIEN-1-OIC ACID |
| 5862 | (5e,13e)-9,15-Dihydroxy-11-Oxoprosta-5,13-Dien-1-Oicacid |
| 5863 | (5E,14E)-11-oxoprosta-5,9,12,14-tetraen-1-oic acid |
| 5864 | (5E,7S)-2-amino-7-(4-fluoro-2-pyridin-3-ylphenyl)-4-methyl-7,8-dihydroquinazolin-5(6H)-one oxime |
| 5865 | (5-Oxo-5,6-Dihydro-Indolo[1,2-a]Quinazolin-7-Yl)-Acetic Acid |
| 5866 | (5-phenyl-7-(pyridin-3-ylmethylamino)pyrazolo[1,5-a]pyrimidin-3-yl)methanol |
| 5867 | (5R)-2-[(2-fluorophenyl)amino]-5-(1-methylethyl)-1,3-thiazol-4(5H)-one |
| 5868 | (5R)-2-SULFANYL-5-[4-(TRIFLUOROMETHYL)BENZYL]-1,3-THIAZOL-4-ONE |
| 5869 | (5R)-4-HYDROXY-3,5-DIMETHYL-5-[(1E,3E)-2-METHYLPENTA-1,3-DIENYL]THIOPHEN-2(5H)-ONE |
| 5870 | (5R)-5-(4-{[(2R)-6-HYDROXY-2,5,7,8-TETRAMETHYL-3,4-DIHYDRO-2H-CHROMEN-2-YL]METHOXY}BENZYL)-1,3-THIAZOLIDINE-2,4-DIONE |

TABLE 1-continued

Ligands

| Ligand No. | Ligand Name |
|---|---|
| 5871 | (5R)-5-[(1E)-BUTA-1,3-DIENYL]-4-HYDROXY-3,5-DIMETHYLTHIOPHEN-2(5H)-ONE |
| 5872 | (5r)-5-Amino-6-Hydroxyhexylcarbamic Acid |
| 5873 | (5r)-6-(4-{[2-(3-Iodobenzyl)-3-Oxocyclohex-1-En-1-Yl]Amino}Phenyl)-5-Methyl-4,5-Dihydropyridazin-3(2h)-One |
| 5874 | (5R)-N,N-DIETHYL-5-METHYL-2-[(THIOPHEN-2-YLCARBONYL)AMINO]-4,5,6,7-TETRAHYDRO-1-BENZOTHIOPHENE-3-CARBOXAMIDE |
| 5875 | (5R,6E,8Z,11Z,14Z,17Z)-5-hydroxyicosa-6,8,11,14,17-pentaenoic acid |
| 5876 | (5r,6s,7s,8s)-5-Hydroxymethyl-6,7,8-Trihydroxy-Tetrazolo[1,5-a]Piperidine |
| 5877 | (5R,6S,8S)-8-[3-(AMINOMETHYL)PHENYL]-6-HYDROXY-5-ISOPROPYL-3-OXO-1-PHENYL-2,7-DIOXA-4-AZA-6-PHOSPHANONAN-9-OIC ACID 6-OXIDE |
| 5878 | (5R,7R,8S,9S,10R)-7-(hydroxymethyl)-3-phenyl-1,6-dioxa-2-azaspiro[4.5]dec-2-ene-8,9,10-triol |
| 5879 | (5S)-1-benzyl-3-(1,1-dioxido-1,2-benziso thiazol-3-yl)-4-hydroxy-5-(1-methylethyl)-1,5-dihydro-2H-pyrrol-2-one |
| 5880 | (5S)-2-(cyclooctylamino)-5-methyl-5-propyl-1,3-thiazol-4(5H)-one |
| 5881 | (5S)-2-{[(1S)-1-(2-fluorophenyl)ethyl]amino}-5-methyl-5-(trifluoromethyl)-1,3-thiazol-4(5H)-one |
| 5882 | (5S)-2-{[(1S)-1-(4-fluorophenyl)ethyl]amino}-5-(1-hydroxy-1-methylethyl)-5-methyl-1,3-thiazol-4(5H)-one |
| 5883 | (5S)-3-ANILINO-5-(2,4-DIFLUOROPHENYL)-5-METHYL-1,3-OXAZOLIDINE-2,4-DIONE |
| 5884 | (5S)-4,5-difluoro-6-[(2-fluoro-4-iodophenyl)imino]-N-(2-hydroxyethoxy)cyclohexa-1,3-diene-1-carboxamide |
| 5885 | (5S)-5-(2-amino-2-oxoethyl)-4-oxo-N-[(3-oxo-3,4-dihydro-2H-1,4-benzoxazin-6-yl)methyl]-3,4,5,6,7,8-hexahydro[1]benzothieno[2,3-d]pyrimidine-2-carboxamide |
| 5886 | (5S)-5-(3-AMINOPROPYL)-3-(2,5-DIFLUOROPHENYL)-N-ETHYL-5-PHENYL-4,5-DIHYDRO-1H-PYRAZOLE-1-CARBOXAMIDE |
| 5887 | (5s)-5-Iododihydro-2,4(1h,3h)-Pyrimidinedione |
| 5888 | (5S,6S)-6-[(R)ACETOXYETH-2-YL]-PENEM-3-CARBOXYLATEPROPANE |
| 5889 | (5S,8R,9S,10S,13R,14S,17S)-13-{2-[(3,5-DIFLUOROBENZYL)OXY]ETHYL}-17-HYDROXY-10-METHYLHEXADECAHYDRO-3H-CYCLOPENTA[A]PHENANTHREN-3-ONE |
| 5890 | (5Z)-12-CHLORO-13,15-DIHYDROXY-4,7,8,9-TETRAHYDRO-2-BENZOXACYCLOTRIDECINE-1,10(3H,11H)-DIONE |
| 5891 | (5Z)-13-CHLORO-14,16-DIHYDROXY-3,4,7,8,9,10-HEXAHYDRO-1H-2-BENZOXACYCLOTETRADECINE-1,11(12H)-DIONE |
| 5892 | (5Z)-3-(4-CHLOROPHENYL)-4-HYDROXY-5-(1-NAPHTHYLMETHYLENE)FURAN-2(5H)-ONE |
| 5893 | (5Z)-5-(3-BROMOCYCLOHEXA-2,5-DIEN-1-YLIDENE)-N-(PYRIDIN-4-YLMETHYL)-1,5-DIHYDROPYRAZOLO[1,5-A]PYRIMIDIN-7-AMINE |
| 5894 | (5Z)-5-[(5-ETHYL-2-FURYL)METHYLENE]-2-{[(S)-(4-FLUOROPHENYL)(1H-TETRAZOL-5-YL)METHYL]AMINO}-1,3-THIAZOL-4(5H)-ONE |
| 5895 | (6,7-Dihydro-5h-Cyclopenta[D]Imidazo[2,1-B]Thiazol-2-Yl]-4,7-Dihydro[1,4]Thiazepine-3,6-Dicarboxylic Acid |
| 5896 | (6-[4-(AMINOMETHYL)-2,6-DIMETHYLPHENOXY]-2-{[4-(AMINOMETHYL)PHENYL]AMINO}-5-BROMOPYRIMIDIN-4-YL)METHANOL |
| 5897 | (6AR,11AS,11BR)-10-ACETYL-9-HYDROXY-7,7-DIMETHYL-2,6,6A,7,11A,11B-HEXAHYDRO-11H-PYRROLO[1',2':2,3]ISOINDOLO[4,5,6-CD]INDOL-11-ONE |
| 5898 | (6E)-7-{6-[(1E)-OCT-1-ENYL]-2,3-DIAZABICYCLO[2.2.1]HEPT-2-EN-5-YL}HEPT-6-ENOIC ACID |
| 5899 | (6E,11E)-HEPTADECA-6,11-DIENE-9,9-DIYLBIS(PHOSPHONIC ACID) |
| 5900 | (6-METHYL-3,4-DIHYDRO-2H-CHROMEN-2-YL)METHYLPHOSPHINATE |
| 5901 | (6R)-2-amino-6-[2-(3'-methoxybiphenyl-3-yl)ethyl]-3,6-dimethyl-5,6-dihydropyrimidin-4(3H)-one |
| 5902 | (6r,1'r,2's)-5,6,7,8 Tetrahydrobiopterin |
| 5903 | (6r,7r)-3-[(Acetyloxy)Methyl]-7-{[(6s)-6-(Glycylamino)-7-Oxido-7-Oxoheptanoyl]Amino}-8-Oxp-5-Thia-1-Azabicyclo[4.2.0]Octane-2-Carboxylate |
| 5904 | (6S)-1-chloro-3-[(4-fluorobenzyl)oxy]-6-(pyrrolidin-1-ylcarbonyl)pyrrolo[1,2-a]pyrazin-4(6H)-one |
| 5905 | (6S)-2-amino-6-(3'-methoxybiphenyl-3-yl)-3,6-dimethyl-5,6-dihydropyrimidin-4(3H)-one |
| 5906 | (6s)-5,6,7,8-Tetrahydrofplate |
| 5907 | (6S)-6-CYCLOPENTYL-6-[2-(3-FLUORO-4-ISOPROPOXYPHENYL)ETHYL]-4-HYDROXY-5,6-DIHYDRO-2H-PYRAN-2-ONE |
| 5908 | (7as,12ar,12bs)-1,2,3,4,7a,12,12a,12b-Octahydroindolo[2,3-a]Quinolizin-7(6h)-One |
| 5909 | (7R,8R)-8-(2,4,5-trifluorophenyl)-6,7,8,9-tetrahydroimidazo[1,2-a:4,5-c']dipyridin-7-amine |
| 5910 | (7S)-2-(2-aminopyrimidin-4-yl)-7-(2-fluoroethyl)-1,5,6,7-tetrahydro-4H-pyrrolo[3,2-c]pyridin-4-one |
| 5911 | (7s)-Hydroxyl-Staurosporine |
| 5912 | (8alpha,10alpha,13alpha,17beta)-17-[(4-hydroxyphenyl)carbonyl]androsta-3,5-diene-3-carboxylic acid |
| 5913 | (8ar)-Hexahydropyrrolo[1,2-a]Pyrazine-1,4-Dione |
| 5914 | (8E,10S,12Z)-10-hydroxy-6-oxooctadeca-8,12-dienoic acid |
| 5915 | (8R,9Z,12Z)-8-hydroxy-6-oxooctadeca-9,12-dienoic acid |
| 5916 | (9ALPHA,13BETA,17BETA)-2-[(1Z)-BUT-1-EN-1-YL]ESTRA-1,3,5(10)-TRIENE-3,17-DIOL |
| 5917 | (9aS)-4-bromo-9a-butyl-7-hydroxy-1,2,9,9a-tetrahydro-3H-fluoren-3-one |
| 5918 | (9BETA,11ALPHA,13ALPHA,14BETA,17ALPHA)-11-(METHOXYMETHYL)ESTRA-1(10),2,4-TRIENE-3,17-DIOL |
| 5919 | (9BETA,13ALPHA,14BETA,17ALPHA)-2-METHOXYESTRA-1,3,5(10)-TRIENE-3,17-DIYL DISULFAMATE |
| 5920 | (9r,10r)-9-(S-Glutathionyl)-10-Hydroxy-9,10-Dihydrophenanthrene |
| 5921 | (9S)-9-[(8-AMMONIOOCTYL)AMINO]-1,2,3,4,9,10-HEXAHYDROACRIDINIUM |
| 5922 | (9S,10E,12Z)-9-hydroxyoctadeca-10,12-dienoic acid |
| 5923 | (9s,10s)-9-(S-Glutathionyl)-10-Hydroxy-9,10-Dihydrophenanthrene |
| 5924 | (9S,12S)-9-(1-methylethyl)-7,10-dioxo-2-oxa-8,11-diazabicyclo[12.2.2]octadeca-1(16),14,17-triene-12-carboxylic acid |
| 5925 | (9Z,11E,13S)-13-hydroxyoctadeca-9,11-diencic acid |
| 5926 | (Aminooxy)Acetic Acid |
| 5927 | (C8-R)-Hydantocidin 5'-Phosphate |
| 5928 | (C8-S)-Hydantocidin 5'-Phosphate |
| 5929 | (Carboxyhydroxyamino)Ethanoic Acid |
| 5930 | (CHLOROACETYL)CARBAMIC ACID (3R,4S,5S,5R)-5-METHOXY-4-[(2R,3R)-2-METHYL-3-(3-METHYL-2-BUTENYL)OXIRANYL]-1-OXASPIRO[2.5]OCT-6-YL ESTER |
| 5931 | (Diaminomethyl-Methyl-Amino)-Acetic Acid |
| 5932 | (Diphosphono)Aminophosphonic Acid |
| 5933 | (E)-(2r,3r,4s,5r)-3,4,5-Trihydroxy-2-Methoxy-8,8-Dimethyl-Non-6-Enoic Acid ((3s,6r)-6-Hydroxy-2-Oxo-Azepan-3-Yl)-Amide |
| 5934 | (E)-[4-(3,5-difluorophenyl)-3H-pyrrolo[2,3-b]pyridin-3-ylidene](3-methoxyphenyl)methanol |
| 5935 | (E)-2-Fluoro-P-Hydroxycinnamate |
| 5936 | (E)-3-(5((5-(4-CHLOROPHENYL)FURAN-2-YL)METHYLENE)-4-OXO-2-THIOXOTHIAZOLIDIN-3-YL)PROPANOIC ACID |
| 5937 | (E)-3,4-DIHYDROXY-N'-[(2-METHOXYNAPHTHALEN-1-YL)METHYLENE]BENZOHYDRAZIDE |
| 5938 | (Hydroxyethyloxy)Tri(Ethyloxy)Octane |
| 5939 | (METHYLPYRIDAZINE PIPERIDINE BUTYLOXYPHENYL)ETHYLACETATE |
| 5940 | (METHYLPYRIDAZINE PIPERIDINE ETHYLOXYPHENYL)ETHYLACETATE |
| 5941 | (METHYLPYRIDAZINE PIPERIDINE PROPYLOXYPHENYL)ETHYLACETATE |
| 5942 | (Molybdopterin-S,S)-Dioxo-Thio-Molybdenum(V) |
| 5943 | (Mu-4-Sulfido)-Tetra-Nuclear Copper Ion |

TABLE 1-continued

Ligands

| Ligand No. | Ligand Name |
|---|---|
| 5944 | (N-{4-[(ETHYLANILINO)SULFONYL]-2-METHYLPHENYL}-3,3,3-TRIFLUORO-2-HYDROXY-2-METHYLPROPANAMIDE |
| 5945 | (P-Iodophenylacetylamino)Methylphosphinic Acid |
| 5946 | (R)-(+)5(9BH)-OXO-9B-PHENYL-2,3-DIHYDROTHIAZOLO[2,3-A]ISOINDOL-3-CARBOXYLIC ACID METHYL ESTER |
| 5947 | (R)-(+)9B-(3-METHYL)PHENYL-2,3-DIHYDROTHIAZOLO[2,3-A]ISOINDOL-5(9BH)-ONE |
| 5948 | (R),AiN[2-[1-(aminoiminomethyl)-3-piperidinyl]-1-oxoethyl]-4-(phenylethynyl)-l-phenylalanine methylester |
| 5949 | (R)-1-(4-(4-(HYDROXYMETHYL)-1,3,2-DIOXABOROLAN-2-YL)BENZYL)GUANIDINE |
| 5950 | (R)-1-(4-(4-(HYDROXYMETHYL)-1,3,2-DIOXABOROLAN-2-YL)PHENETHYL)GUANIDINE |
| 5951 | (R)-1-(4-(4-(HYDROXYMETHYL)-1,3,2-DIOXABOROLAN-2-YL)PHENYL)GUANIDINE |
| 5952 | (R)-1-Para-Nitro-Phenyl-2-Azido-Ethanol |
| 5953 | (R)-2-(FORMYLOXY)-3-(PHOSPHONOOXY)PROPYL PENTANOATE |
| 5954 | (R)-2-Hydroxy-3-Sulfopropanoic Acid |
| 5955 | (R)-3-BROMO-2-HYDROXY-2-METHYL-N-[4-NITRO-3-(TRIFLUOROMETHYL)PHENYL]PROPANAMIDE |
| 5956 | (R)-4-Nitrostyrene oxide |
| 5957 | (R)-Mandelic Acid |
| 5958 | (R)-Mesopram |
| 5959 | (R)-Mevalonate |
| 5960 | (R)-N-(1-Methyl-Hexyl)-Formamide |
| 5961 | (R)-N-(3-Indol-1-Yl-2-Methyl-Propyl)-4-Sulfamoyl-Benzamide |
| 5962 | (R)-pyridin-4-yl[4-(2-pyrrolidin-1-ylethoxy)phenyl]methanol |
| 5963 | (R)-Rolipram |
| 5964 | (R)-tacrine(10)-hupyridone |
| 5965 | (R)-TRANS-4-(1-AMINOETHYL)-N-(4-PYRIDYL)CYCLOHEXANECARBOXAMIDE |
| 5966 | (R,R)-2,3-Butanediol |
| 5967 | (RP,SP)-O-(2R)-(1-PHENOXYBUT-2-YL)-METHYLPHOSPHONIC ACID CHLORIDE |
| 5968 | (S)-(+)-2-[4-(FLUOROBENZYLOXY-BENZYLAMINO)PROPIONAMIDE] |
| 5969 | (S)-1-PHENYL-1-[4-(9H-PURIN-6-YL)PHENYL]METHANAMINE |
| 5970 | (S)-2-((S)-3-ISOBUTYL-2,5-DIOXO-4-QUINOLIN-3-YLMETHYL-[1,4] DIAZEPAN-1YL)-N-METHYL-3-NAPHTALEN-2-YL-PROPIONAMIDE |
| 5971 | (S)-2-(MERCAPTOMETHYL)-5-PHENYLPENTANOIC ACID |
| 5972 | (S)-2-(Phosphonoxy)Caproyl-L-Leucyl-P-Nitroanilide |
| 5973 | (S)-2-[(R)-3-amino-4-(2-fluorophenyl)butyryl]-1,2,3,4-tetrahydroisoquinoline-3-carboxamide |
| 5974 | (S)-2-{Methyl-[2-(Naphthalene-2-Sulfonylamino)-5-(Naphthalene-2-Sulfonyloxy)-Benzoyl]-Amino}-Succinicacid |
| 5975 | (S)-2-Amino-3-(1,3,5,7-Pentahydro-2,4-Dioxo-Cyclopenta[E]Pyrimidin-1-Yl) Proionic Acid |
| 5976 | (S)-2-Amino-4-[(2s,3r)-2,3,5-Trihydroxy-4-Oxo-Pentyl]Mercapto-Butyric Acid |
| 5977 | (S)-2-CHLORO-N-(1-(2-(2-HYDROXYETHYLAMINO)-2-OXOETHYL)-2-OXO-1,2,3,4-TETRAHYDROQUINOLIN-3-YL)-6H-THIENO[2,3-B]PYRROLE-5-CARBOXAMIDE |
| 5978 | (S)-2-METHYL-1-[(4-METHYL-5-ISOQUINOLINE)SULFONYL]-HOMOPIPERAZINE |
| 5979 | (S)-3-(4-(2-Carbazol-9-Yl-Ethoxy)-Phenyl)-2-Ethoxy-Propionic Acid |
| 5980 | (S)-4-Bromo-3-Hydroxy-3-Methylbutyl Diphosphate |
| 5981 | (S)-4-ISOPROPOXYCARBONYL-6-METHOXY-3-METHYLTHIOMETHYL-3,4-DIHYDROQUINOXALIN-2(1H)-THIONE |
| 5982 | (S)-4-Nitrostyrene oxide |
| 5983 | (S)-5-(4-Benzyloxy-Phenyl)-4-(7-Phenyl-Heptanoylamino)-Pentanoic Acid |
| 5984 | (S)-ATPA |
| 5985 | (S)-blebbistatin |
| 5986 | (S)-Des-Me-Ampa |
| 5987 | (S)-Hmg-Coa |
| 5988 | (S)-Mandelic Acid |
| 5989 | (S)-N-(1-(3-CHLORO-4-FLUOROPHENYL)-2-HYDROXYETHYL)-4-(4-(3-CHLOROPHENYL)-1H-PYRAZOL-3-YL)-1H-PYRROLE-2-CARBOXAMIDE |
| 5990 | (S)-N-(3-Indol-1-Yl-2-Methyl-Propyl)-4-Sulfamoyl-Benzamide |
| 5991 | (S)-N-(4-carbamimidoylbenzyl)-1-(2-(cyclohexylamino)ethanoyl)pyrrolidine-2-carboxamide |
| 5992 | (S)-N-(4-carbamimidoylbenzyl)-1-(2-(cyclohexyloxy)ethanoyl)pyrrolidine-2-carboxamide |
| 5993 | (S)-N-(4-carbamimidoylbenzyl)-1-(2-(cyclopentylamino)ethanoyl)pyrrolidine-2-carboxamide |
| 5994 | (S)-N-(4-carbamimidoylbenzyl)-1-(2-(cyclopentyloxy)ethanoyl)pyrrolidine-2-carboxamide |
| 5995 | (S)-N-(4-carbamimidoylbenzyl)-1-(3-cyclohexylpropanoyl)pyrrolidine-2-carboxamide |
| 5996 | (S)-N-(4-carbamimidoylbenzyl)-1-(3-cyclopentylpropanoyl)pyrrolidine-2-carboxamide |
| 5997 | (S)-Rolipram |
| 5998 | (S)-tacrine(10)-hupyridone |
| 5999 | (S)-Wiskostatin |
| 6000 | (South)-Methanocarba-Thymidine |
| 6001 | (Tert-Butyloxycarbonyl)-Alanyl-Alanyl-Amine |
| 6002 | (TERT-BUTYLOXYCARBONYL)-ALANYL-AMINO ETHYL-FORMAMIDE |
| 6003 | (Z)-2-[2-(4-methylpiperazin-1-yl)benzyl]diazenecarbothioamide |
| 6004 | (Z)-3-BENZYL-5-(2-HYDROXY-3-NITROBENZYLIDENE)-2-THIOXOTHIAZOLIDIN-4-ONE |
| 6005 | (Z,Z)-4-Hydroxy-N,N,N-Trimethyl-10-Oxo-7-[(1-Oxo-9-Octadecenyl)Oxy]-3,5,9-Trioxa-4-Phosphaheptacos-18-En-1-Aminium-4-Oxide |
| 6006 | [(1-{2[(4-Carbamimidoyl-Phenylamino)-Methyl]-1-Methyl-1h-Benzoimidazol-5-Yl}-Cyclopropyl)-Pyridin-2-Yl-Methyleneaminooxy]-Acetic Acid Ethyl Ester |
| 6007 | [(1S)-1-(5-CHLORO-1-BENZOTHIEN-3-YL)-2-(2-NAPHTHYLAMINO)-2-OXOETHYL]PHOSPHONIC ACID |
| 6008 | [(2-AMINO-ALPHA-METHOXYIMINO-4-THIAZOLYLACETYL)AMINO]METHYLBORONIC ACID |
| 6009 | [(2-Ethoxy-1-Naphthoyl)Amino]Methylboronic Acid |
| 6010 | [(2r,3s,4s,5r)-3,4,5-Trihydroxytetrahydrofuran-2-Yl]Methyl Dihydrogen Phosphate |
| 6011 | [(2S)-4-methyl-3-oxo-2,3,4,5-tetrahydro-1H-1,4-benzodiazepin-2-yl]acetic acid |
| 6012 | [(3,7,11-TRIMETHYL-DODECA-2,6,10-TRIENYLOXYCARBAMOYL)-METHYL]-PHOSPHONIC ACID |
| 6013 | [(3R)-7-NITRO-1,2,3,4-TETRAHYDROISOQUINOLIN-3-YL]METHANOL |
| 6014 | [(3R,4S)-4-HYDROXY-3-METHYL-2-OXOHEXYL]PHOSPHONIC ACID |
| 6015 | [(3R,4S,5S,7R)-4,8-DIHYDROXY-3,5,7-TRIMETHYL-2-OXOOCTYL]PHOSPHONIC ACID |
| 6016 | [(3S)-9-hydroxy-1-methyl-10-oxo-4,10-dihydro-3H-benzo[g]isochromen-3-yl]acetic acid |
| 6017 | [(4-{4-[4-(Difluoro-Phosphono-Methyl)-Phenyl]-Butyl}-Phenyl)-Difluoro-Methy]-Phosphonic Acid |
| 6018 | [(4R)-2,2-DIMETHYL-1,3-DIOXOLAN-4-YL]METHYL HYDROGEN HEX-5-ENYLPHOSPHONATE |
| 6019 | [(4R)-4-(3-HYDROXYPHENYL)-1,6-DIMETHYL-2-THIOXO-1,2,3,4-TETRAHYDROPYRIMIDIN-5-YL](PHENYL)METHANONE |
| 6020 | [(4S)-2,2-DIMETHYL-1,3-DIOXOLAN-4-YL]METHYL HYDROGEN HEX-5-ENYLPHOSPHONATE |
| 6021 | [(5R)-5-(2,3-dibromo-5-ethoxy-4-hydroxybenzyl)-4-oxo-2-thioxo-1,3-thiazolidin-3-yl]acetic acid |
| 6022 | [[(3R,4R,5S,6R)-3-(butanoylamino)-4,5-dihydroxy-6-(hydroxymethyl)oxan-2-ylidene]amino] N-phenylcarbamate |
| 6023 | [[(3R,4R,5S,6R)-4,5-dihydroxy-6-(hydroxymethyl)-3-(pentanoylamino)oxan-2-ylidene]amino] N-phenylcarbamate |
| 6024 | [[1-[N-HYDROXY-ACETAMIDYL]-3-METHYL-BUTYL]-CARBONYL-LEUCINYL]-ALANINE ETHYL ESTER |

TABLE 1-continued

Ligands

| Ligand No. | Ligand Name |
|---|---|
| 6025 | [[4-(Aminomethyl)Phenyl]Amino]Oxo-Acetic Acid, |
| 6026 | [[CYCLOHEXANESULFONYL-GLYCYL]-3[PYRIDIN-4-YL-AMINOMETHYL]ALANYL]PIPERIDINE |
| 6027 | [[N-(Benzyloxycarbonyl)Amino]Methyl]Phosphate |
| 6028 | [{(5-Chloro-2-Pyridinyl)Amino} Methylene]-1,1-Bisphosphonate |
| 6029 | [{2-bromo-4-[(2R)-3-oxo-2,3-diphenylpropyl]phenyl}(difluoro)methyl]phosphonic acid |
| 6030 | [1-(1-Benzyl-3-Hydroxy-2-Oxo-Propylcarbamoyl)-2-Phenyl-Ethyl]-Carbamic Acid Benzyl Ester |
| 6031 | [1-(1-Methyl-4,5-Dioxo-Pent-2-Enylcarbamoyl)-2-Phenyl-Ethyl]-Carbamic Acid Benzyl Ester |
| 6032 | [1-(3-CHLORO-2-FORMYL-PHENYLCARBAMOYL)-2-METHYL-PROPYL]-CARBAMIC ACID TERT-BUTYL ESTER |
| 6033 | [1-(3-Hydroxy-2-Oxo-1-Phenethyl-Propylcarbamoyl)2-Phenyl-Ethyl]-Carbamic Acid Pyridin-4-Ylmethyl Ester |
| 6034 | [1-(4-Fluorobenzyl)Cyclobutyl]Methyl (1s)-1-[Oxo(1h-Pyrazol-5-Ylamino)Acetyl]Pentylcarbamate |
| 6035 | [1-(6-{6-[(1-methylethyl)amino]-1H-indazol-1-yl}pyrazin-2-yl)-1H-pyrrol-3-yl]acetic acid |
| 6036 | [1-HYDROXY-2-(1,1':3',1''-TERPHENYL-3-YLOXY)ETHANE-1,1-DIYL]BIS(PHOSPHONIC ACID) |
| 6037 | [2-(3-DIBENZOFURAN-4-YL-PHENYL)-1-HYDROXY-1-PHOSPHONO-ETHYL]-PHOSPHONIC ACID |
| 6038 | [2-(5-MERCAPTO-[1,3,4]THIADIAZOL-2-YLCARBAMOYL)-1-PHENYL-ETHYL]-CARBAMIC ACID BENZYL ESTER |
| 6039 | [2(Formyl-Hydroxy-Amino)-Ethyl]-Phosphonic Acid |
| 6040 | [2(R,S)-2-Sulfanylheptanoyl]-Phe-Ala |
| 6041 | [2,4,6-Triisopropyl-Phenylsulfonyl-L-[3-Amidino-Phenylalanine]]-Piperazine-N'-Beta-Alanine |
| 6042 | [2-Amino-6-(2,6-Difluoro-Benzoyl)-Imidazo[1,2-a]Pyridin-3-Yl]-Phenyl-Methanone |
| 6043 | [2-CARBOXYLETHYL]-10-METHYL-ANTHRACENE ENDOPEROXIDE |
| 6044 | [2-Cytidylate-O'-Phosphonyloxyl]-Ethyl-Trimethyl-Ammonium |
| 6045 | [2'-HYDROXY-3'-(1H-PYRROLO[3,2-C]PYRIDIN-2-YL)-BIPHENYL-3-YLMETHYL]-UREA |
| 6046 | [3-(1,3,2-Dioxaborolan-2-Yloxy)Propyl]Guanidine |
| 6047 | [3-(1-Benzyl-3-Carbamoylmethyl-2-Methyl-1h-Indol-5-Yloxy)-Propyl-]-Phosphonic Acid |
| 6048 | [3-(4-Bromo-2-Fluoro-Benzyl)-7-Chloro-2,4-Dioxo-3,4-Dihydro-2h-Quinazolin-1-Yl]-Acetic Acid |
| 6049 | [3-(Dodecanoylamino)Propyl](Hydroxy)Dimethylammonium |
| 6050 | [3,5-Dibromo-4-(4-Hydroxy-3-Phenethylcarbamoyl-Phenoxy)-Phenyl]-Acetic Acid |
| 6051 | [4-({[5-Benzyloxy-1-(3-Carbamimidoyl-Benzyl)-1h-Indole-2-Carbonyl]-Amino}-Methyl)-Phenyl]-Trimethyl-Ammonium |
| 6052 | [4-({4-[(5-cyclopropyl-1H-pyrazol-3-yl)amino]-6-(methylamino)pyrimidin-2-yl}amino)phenyl]acetonitrile |
| 6053 | [4-({4-[(5-cyclopropyl-1H-pyrazol-3-yl)amino]quinazolin-2-yl}amino)phenyl]acetonitrile |
| 6054 | [4-({4-[(5-CYCLOPROPYL-1H-PYRAZOL-3-YL)AMINO]QUINAZOLIN-2-YL}IMINO)CYCLOHEXA-2,5-DIEN-1-YL]ACETONITRILE |
| 6055 | [4-({5-(AMINOCARBONYL)-4-[(3-METHYLPHENYL)AMINO]PYRIMIDIN-2-YL}AMINO)PHENYL]ACETIC ACID |
| 6056 | [4-(1,3,2-Dioxaborolan-2-Yloxy)Methyl]Benzamidine |
| 6057 | [4-(2-Amino-4-Methyl-Thiazol-5-Yl)-Pyrimidin-2-Yl]-(3-Nitro-Phenyl)-Amine |
| 6058 | [4-(3-AMINOMETHYL-PHENYL)-PIPERIDIN-1-YL]-(5-PHENETHYL- PYRIDIN-3-YL)-METHANONE |
| 6059 | [4-(4-ACETYLAMINO-PHENYL)-3,5-DIOXO-4-AZA-TRICYCLO[5.2.2.0 2,6]UNDEC-1-YLCARBAMOYLOXY]-ACETIC ACID |
| 6060 | [4-(4-Hydroxy-3-Iodo-Phenoxy)-3,5-Diiodo-Phenyl]-Acetic Acid |
| 6061 | [4-(4-PHENYL-PIPERIDIN-1-YL)-BENZENESULFONYLAMINO]-ACETIC ACID |
| 6062 | [4-(5-naphthalen-2-yl-1H-pyrrolo[2,3-b]pyridin-3-yl)phenyl]acetic acid |
| 6063 | [4-(6-Chloro-Naphthalene-2-Sulfonyl)-Piperazin-1-Yl]-(3,4,5,6-Tetrahydro-2h-[1,4']Bipyridinyl-4-Yl)-Methanone |
| 6064 | [4,6-O-(1-CARBOXYETHYLIDENE)-BETA-D-MANNOSE] |
| 6065 | [4-amino-2-(tert-butylamino)-1,3-thiazol-5-yl](phenyl)methanone |
| 6066 | [4-R-(4-ALPHA,6-BETA,7-BETA]-HEXAHYDRO-5,6-DI(HYDROXY)-1,3-DI(ALLYL)-4,7-BISPHENYLMETHYL)-2H-1,3-DIAZEPINONE |
| 6067 | [5-(5-nitro-2-furyl)-1,3,4-oxadiazol-2-yl]thio}acetic acid |
| 6068 | [5-AMINO-1-(4-FLUOROPHENYL)-1H-PYRAZOL-4-YL](3-{[(2R)-2,3-DIHYDROXYPROPYL]OXY}PHENYL)METHANONE |
| 6069 | [5-AMINO-1-(4-FLUOROPHENYL)-1H-PYRAZOL-4-YL][3-(PIPERIDIN-4-YLOXY)PHENYL]METHANONE |
| 6070 | [5-HYDROXY-2-(4-HYDROXYPHENYL)-1-BENZOFURAN-7-YL]ACETONITRILE |
| 6071 | [Cyclohexylethyl]-[[[4-[2-Methyl-1-Imidazolyl)-Butyl]Phenyl]Acetyl]-Seryl]-Lysinyl]-Amine |
| 6072 | [Formylmethyl]Trimethyl-Ammonium, N,N,N-Trimethylammonium Acetaldehyde |
| 6073 | [HYDROXY(3-PHENYLPROPYL)AMINO]METHANOL |
| 6074 | [Methylseleno]Acetate |
| 6075 | [Methyltelluro]Acetate |
| 6076 | [Methylthio]Acetate |
| 6077 | [N-(2,4-DIAMINOPTERIDIN-6-YL)-METHYL]-DIBENZ[B,F]AZEPINE |
| 6078 | [N-(3-DIBENZYLCARBAMOYL-OXIRANECARBONYL)-HYDRAZINO]-ACETIC ACID |
| 6079 | [N-(BENZYLOXYCARBONYL)AMINO](4-AMIDINOPHENYL)METHANE-PHOSPHONATE |
| 6080 | [PHENYLALANINYL-PROLINYL]-[2-(PYRIDIN-4-YLAMINO)-ETHYL]-AMINE |
| 6081 | [Pterin-6-Yl Methanyl]-Phosphonophosphate |
| 6082 | {(1s)-1-Benzyl-4-[3-Carbamoyl-1-(1-Carbamoyl-2-Phenyl-Ethylcarbamoyl)-(S)-Propylcarbamoyl]-2-Oxo-5-Phenyl-Pentyl]-Carbamic Acid Tert-Butyl Ester |
| 6083 | {(2S)-1-[N-(tert-butoxycarbonyl)glycyl]pyrrolidin-2-yl}methyl (3-chlorophenyl)acetate |
| 6084 | {(2Z)-3-[(6-chloropyridin-3-yl)methyl]-1,3-thiazolidin-2-ylidene}cyanamide |
| 6085 | {(2Z)-4-AMINO-2-[(4-METHOXYPHENYL)IMINO]-2,3-DIHYDRO-1,3-THIAZOL-5-YL}(4-METHOXYPHENYL)METHANONE |
| 6086 | {[(2,2-Dihydroxy-Ethyl)-(2,3,4,5-Tetrahydroxy-6-Phosphonooxy-Hexyl)-Amino]-Methyl}-Phosphonic Acid |
| 6087 | {[(2,6-difluorophenyl)carbonyl]amino}-N-(4-fluorophenyl)-1H-pyrazole-3-carboxamide |
| 6088 | {[2-(1h-1,2,3-Benzotriazol-1-Yl)-2-(3,4-Difluorophenyl)Propane-1,3-Diyl]Bis[4,1-Phenylene(Difluoromethylene)]}Bis(Phosphonic Acid) |
| 6089 | {[4-AMINO-2-(3-CHLOROANILINO)-1,3-THIAZOL-5-YL](4-FLUOROPHENYL)METHANONE |
| 6090 | {[7-(Difluoro-Phosphono-Methyl)-Naphthalen-2-Yl]-Difluoro-Methyl}-Phosphonic Acid |
| 6091 | {1-[(3-Hydroxy-Methyl-5-Phosphonooxy-Methyl-Pyridin-4-Ylmethyl)-Amino]-Ethyl)-Phosphonic Acid |
| 6092 | {1-[2-(1-FORMYL-PROPYL)-3-METHANESULFONYLAMINO-PYRROLIDINE-1-CARBONYL]-2-METHYL-PROPYL}-CARBAMIC ACID TERT-BUTYL ESTER |
| 6093 | {3-[(3-Hydroxy-2-Methyl-5-Phosphonooxymethyl-Pyridin-4-Ylmethyl)-Amino]-2-Methyl-Propyl}-Phosphonic Acid |
| 6094 | {3-[(4,5,7-TRIFLUORO-1,3-BENZOTHIAZOL-2-YL)METHYL]-1H-INDOL-1-YL}ACETIC ACID |
| 6095 | {3-[(5-CHLORO-1,3-BENZOTHIAZOL-2-YL)METHYL]-2,4-DIOXO-3,4-DIHYDROPYRIMIDIN-1(2H)-YL}ACETIC ACID |
| 6096 | {3-[3-(3,4-Dimethoxy-Phenyl)-1-(1-{1-[2-(3,4,5-Trimethoxy-Phenyl)-Butyryl]-Piperidin-2yl}-Vinyloxy)-Propyl]-Phenoxy}-Acetic Acid |
| 6097 | {4-[(2R)-pyrrolidin-2-ylmethoxy]phenyl}(4-thiophen-3-ylphenyl)methanone |
| 6098 | {4-[(2s,4e)-2-(1,3-Benzothiazol-2-Yl)-2-(1h-1,2,3-Benzotriazol-1-Yl)-5-Phenylpent-4-Enyl]Phenyl}(Difluoro)Methylphosphonic Acid |

TABLE 1-continued

Ligands

| Ligand No. | Ligand Name |
|---|---|
| 6099 | {4-[(CARBOXYMETHOXY)CARBONYL]-3,3-DIOXIDO-1-OXONAPHTHO[1,2-D]ISOTHIAZOL-2(1H)-YL}ACETIC ACID |
| 6100 | {4-[2,2-BIS(5-METHYL-1,2,4-OXADIAZOL-3-YL)-3-PHENYLPROPYL]PHENYL}SULFAMIC ACID |
| 6101 | {4-[2-Acetylamino-2-(3-Carbamoyl-2-Cyclohexylmethoxy-6,7,8,9-Tetrahydro-5h-Benzocyclohepten-5ylcarbamoyl)-Ethyl]-2-Phosphono-Phenyl}-Phosphonic Acid |
| 6102 | {4-[2-BENZYL-3-METHOXY-2-(METHOXYCARBONYL)-3-OXOPROPYL]PHENYL}SULFAMIC ACID |
| 6103 | {4-[3-(4-acetyl-3-hydroxy-2-propylphenoxy)propoxy]phenoxy}acetic acid |
| 6104 | {4-[3-(6,7-Diethoxy-Quinazolin-4-Ylamino)-Phenyl]-Thiazol-2-Yl)-Methanol |
| 6105 | {4-[4-hydroxy-3-(1-methylethyl)benzyl]-3,5-dimethylphenoxy}acetic acid |
| 6106 | {5-(5-AMINO-1H-PYRROLO[3,2-B]PYRIDIN-2-YL)-6-HYDROXY-3'-NITRO-BIPHENYL-3-YL]-ACETIC ACID |
| 6107 | +/−METHYL 4-(AMINOIMINOMETHYL)-BETA-[3-INH(AMINOIMINO)PHENYL]BENZENE PENTANOATE |
| 6108 | 1-((1R)-1-(HYDROXYMETHYL)-3-{6-[(3-PHENYLPROPANOYL)AMINO]-1H-INDOL-1-YL}PROPYL)-1H-IMIDAZOLE-4-CARBOXAMIDE |
| 6109 | 1-((1R,2S)-1-{2-[2-(4-CHLOROPHENYL)-1,3-BENZOXAZOL-7-YL]ETHYL}-2-HYDROXYPROPYL)-1H-IMIDAZOLE-4-CARBOXAMIDE |
| 6110 | 1-((2-HYDROXYETHOXY)METHYL)-5-(3-(BENZYLOXY)BENZYL)-6-HYDROXYPYRIMIDINE-2,4(1H,3H)-DIONE |
| 6111 | 1-((2-HYDROXYETHOXY)METHYL)-5-(3-(BENZYLOXY)BENZYL)PYRIMIDINE-2,4(1H,3H)-DIONE |
| 6112 | 1-((2-HYDROXYETHOXY)METHYL)-5-(PHENYLTHIO)PYRIMIDINE-2,4(1H,3H)-DIONE |
| 6113 | 1-((2-HYDROXYETHOXY)METHYL)-5-BENZYLPYRIMIDINE-2,4(1H,3H)-DIONE |
| 6114 | 1-({2-[2-(4-CHLOROPHENYL)ETHYL]-1,3-DIOXOLAN-2-YL}METHYL)-1H-IMIDAZOLE |
| 6115 | 1-(1,4-dimethyl-1,2,3,4-tetrahydroquinoxalin-6-yl)methanamine |
| 6116 | 1-(1'-{[3-(methylsulfanyl)-2-benzothiophen-1-yl]carbonyl}spiro[1-benzofuran-3,4'-piperidin]-5-yl)methanamine |
| 6117 | 1-(1-HYDROXY-2,2,6,6-TETRAMETHYLPIPERIDIN-4-YL)PYRROLIDINE-2,5-DIONE |
| 6118 | 1-(1-methylethyl)-3-quinolin-6-yl-1H-pyrazolo[3,4-d]pyrimidin-4-amine |
| 6119 | 1-(1-phenylcyclopentyl)methylamine |
| 6120 | 1-(2,2'-bithiophen-5-yl)methanamine |
| 6121 | 1-(2,3-dihydro-1,4-benzodioxin-6-ylsulfonyl)-4-[(4-methoxyphenyl)sulfonyl]piperazine |
| 6122 | 1-(2,5-dideoxy-5-pyrrolidin-1-yl-beta-L-erythro-pentofuranosyl)-5-methylpyrimidine-2,4(1H,3H)-dione |
| 6123 | 1-(2,6-Dichlorophenyl)-5-(2,4-Difluorophenyl)-7-Piperazin-1-Yl-3,4-Dihydroquinazolin-2(1h)-One |
| 6124 | 1-(2,6-Dichlorophenyl)-5-(2,4-Difluorophenyl)-7-Piperidin-4-Yl-3,4-Dihydroquinolin-2(1h)-One |
| 6125 | 1-(2-{[(6-AMINO-2-METHYLPYRIDIN-3-YL)METHYL]AMINO}ETHYL)-6-CHLORO-3-[(2,2-DIFLUORO-2-PYRIDIN-2-YLETHYL)AMINO]-1,4-DIHYDROPYRAZIN-2-OL |
| 6126 | 1-(2-Amidinophenyl)-3-(Phenoxyphenyl)Urea |
| 6127 | 1-(2-Chlorophenyl)-3,5-Dimethyl-1h-Pyrazole-4-Carboxylic Acid Ethyl Ester |
| 6128 | 1-(2-CYCLOPROPYLETHYL)-3-(1,1-DIOXIDO-2H-1,2,4-BENZOTHIADIAZIN-3-YL)-6-FLUORO-4-HYDROXYQUINOLIN-2(1H)-ONE |
| 6129 | 1-(2-Deoxy-2-Fluoro-3-O-Phosphono-Beta-L-Ribofuranosyl)Pyrimidine-2,4(1h,3h)-Dione |
| 6130 | 1-(2-DEOXY-5-O-PHOSPHONO-BETA-D-ERYTHRO-PENTOFURANOSYL)-4-METHYL-1H-INDOLE |
| 6131 | 1-(2-DEOXY-5-O-PHOSPHONO-BETA-D-ERYTHRO-PENTOFURANOSYL)-5-NITRO-1H-INDOLE |
| 6132 | 1-(2-Fluorobenzyl)-3-Butyl-8-(N-Acetyl-4-Aminobenzyl)-Xanthine |
| 6133 | 1-(2-HYDROXYETHYLOXYMETHYL)-6-PHENYL THIOTHYMINE |
| 6134 | 1-(2-Methoxy-Ethoxy)-2-{2-[2-(2-Methoxy-Ethoxy]-Ethoxy}-Ethane |
| 6135 | 1-(2-nitrophenyl)-2,2,2-trifluoroethyl]-arsenocholine |
| 6136 | 1-(3-(2,4-DIMETHYLTHIAZOL-5-YL)-4-OXO-2,4-DIHYDROINDENO[1,2-C]PYRAZOL-5-YL)-3-(4-METHYLPIPERAZIN-1-YL)UREA |
| 6137 | 1-(3,5-DICHLOROPHENYL)-5-METHYL-1H-1,2,4-TRIAZOLE-3-CARBOXYLIC ACID |
| 6138 | 1-(3-bromophenyl)-7-chloro-6-methoxy-3,4-dihydroisoquinoline |
| 6139 | 1-(3-chloro-4-methylphenyl)-3-{2-[({5-[(dimethylamino)methyl]-2-furyl}methyl)thio]ethyl}urea |
| 6140 | 1-(3-chlorophenyl)-3-(5-[2-(thieno[3,2-d]pyrimidin-4-ylamino)ethyl]-1,3-thiazol-2-yl}urea |
| 6141 | 1-(3-HYDROXYPROPYL)-2-[(3-NITROBENZOYL)AMINO]-1H-BENZIMIDAZOL-5-YL PIVALATE |
| 6142 | 1-(3-Mercapto-2-Methyl-Propionyl)-Pyrrolidine-2-Carboxylic Acid |
| 6143 | 1-(3-METHYLPHENYL)-1H-BENZIMIDAZOL-5-AMINE |
| 6144 | 1-(3-O-Phosphono-Beta-L-Arabinofuranosyl)Pyrimidine-2,4(1h,3h)-Dione |
| 6145 | 1-(4-Amidinophenyl)-3-(4-Chlorophenyl)Urea |
| 6146 | 1-(4-Aminophenyl)-3,5-Dimethyl-1h-Pyrazole-4-Carboxylic Acid Ethyl Ester |
| 6147 | 1-(4-CYANO-PHENYL)-3-[2-(2,6-DICHLORO-PHENYL)-1-IMINO-ETHYL]-THIOUREA |
| 6148 | 1-(4-fluorophenyl)-N-[3-fluoro-4-(1H-pyrrolo[2,3-b]pyridin-4-yloxy)phenyl]-2-oxo-1,2-dihydropyridine-3-carboxamide |
| 6149 | 1-(4-HEXYLPHENYL)PROP-2-EN-1-ONE |
| 6150 | 1-(4-IODOBENZOYL)-5-METHOXY-2-METHYL INDOLE-3-ACETIC ACID |
| 6151 | 1-(4-Methoxyphenyl)-3,5-Dimethyl-1h-Pyrazole-4-Carboxylic Acid Ethyl Ester |
| 6152 | 1-(4-Tert-Butylcarbamoyl-Piperazine-1-Carbonyl)-3-(3-Guanidino-Propyl)-4-Oxo-Azetidine-2-Carboxylic Acid |
| 6153 | 1-(4-thiophen-2-ylphenyl)methanamine |
| 6154 | 1-(5-{2-[(1-methyl-1H-pyrazolo[4,3-d]pyrimidin-7-yl)amino]ethyl}-1,3-thiazol-2-yl)-3-[3-(trifluoromethyl)phenyl]urea |
| 6155 | 1-(5-BROMO-PYRIDIN-2-YL)-3-[2-(6-FLUORO-2-HYDROXY-3-PROPIONYL-PHENYL)-CYCLOPROPYL]-UREA |
| 6156 | 1-(5-Carboxypentyl)-5-[(2,6-Dichlorobenzyl)Oxy]-1 H-Indole-2-Carboxylic Acid |
| 6157 | 1-(5-CHLORO-2,4-DIMETHOXYPHENYL)-3-(5-CYANOPYRAZIN-2-YL)UREA |
| 6158 | 1-(5-CHLORO-2-METHOXYPHENYL)-3-{6-[2-(DIMETHYLAMINO)-1-METHYLETHOXY]PYRAZIN-2-YL}UREA |
| 6159 | 1-(5-Chloroindol-3-Yl)-3-Hydroxy-3-(2h-Tetrazol-5-Yl)-Propenone |
| 6160 | 1-(5-ISOQUINOLINESULFONYL)-2-METHYLPIPERAZINE |
| 6161 | 1-(5-OXO-2,3,5,9B-TETRAHYDRO-1H-PYRROLO[2,1-A]ISOINDOL-9-YL)-3-(5-PYRROLIDIN-2-YL-1H-PYRAZOL-3-YL)-UREA |
| 6162 | 1-(5'-Phospho-Beta-D-Ribofuranosyl)Barbituric Acid |
| 6163 | 1-(5-TERT-BUTYL-1,3,4-OXADIAZOL-2-YL)-2-(METHYLAMINO)ETHANONE |
| 6164 | 1-(5-Tert-Butyl-2-Methyl-2h-Pyrazol-3-Yl)-3-(4-Chloro-Phenyl)-Urea |
| 6165 | 1-(5-Tert-Butyl-2-P-Tolyl-2h-Pyrazol-3-Yl)-3-[4-(2-Morpholin-4-Yl-Ethoxy)-Naphthalen-1-Yl]-Urea |
| 6166 | 1-(6-CYANO-3-PYRIDYLCARBONYL)-5',8'-DIFLUOROSPIRO[PIPERIDINE-4,2'(1'H)-QUINAZOLINE]-4'-AMINE |
| 6167 | 1-(9-ethyl-9H-catbazol-3-yl)-N-methylmethanamine |
| 6168 | 1-(adamantan-1-yl)-2-(1H-imidazol-1-yl)ethanone |
| 6169 | 1-(biphenyl-4-ylmethyl)-1H-imidazole |
| 6170 | 1-(CYCLOHEXYLAMINO)-3-(6-METHYL-3,4-DIHYDRO-1H-CARBAZOL-9(2H)-YL)PROPAN-2-OL |

TABLE 1-continued

Ligands

| Ligand No. | Ligand Name |
|---|---|
| 6171 | 1-(DIMETHYLAMINO)-3-(4-{{4-(2-METHYLIMIDAZO[1,2-A]PYRIDIN-3-YL)PYRIMIDIN-2-YL]AMINO}PHENOXY)PROPAN-2-OL |
| 6172 | 1-(HYDROXYMETHYLENEAMINO)-8-HYDROXY-OCTANE |
| 6173 | 1-(Isopropylthio)-Beta-Galactopyranside |
| 6174 | 1-(N-Imidazolyl)-2-Hydroxy-2-(2,3-Dichlorophenyl)Octane |
| 6175 | 1-(O-Carboxy-Phenylamino)-1-Deoxy-D-Ribulose-5-Phosphate |
| 6176 | 1-(PHENYLMETHYL)CYCLOPENTYL[(1S)-1-FORMYLPENTYL]CARBAMATE |
| 6177 | 1(R)-1-ACETAMIDO-2-(3-CARBOXY-2-HYDROXYPHENYL)ETHYL BORONIC ACID |
| 6178 | 1(R)-1-Acetamido-2-(3-Carboxyphenyl)Ethyl Boronic Acid |
| 6179 | 1-(thiophen-2-ylacetyl)-4-(3-thiophen-2-yl-1,2,4-oxadiazol-5-yl)piperidine |
| 6180 | 1,1,1,3,3,3-HEXAFLUORO-2-{4-[(2,2,2-TRIFLUOROETHYL)AMINO]PHENYL}PROPAN-2-OL |
| 6181 | 1,1,1-TRIFLUORO-3-((N-ACETYL)-L-LEUCYLAMIDO)-4-PHENYL-BUTAN-2-ONE(N-ACETYL-L-LEUCYL-L-PHENYLALANYL TRIFLUOROMETHYL KETONE) |
| 6182 | 1,1,1-TRIFLUORO-3-(OCTYLTHIO)ACETONE |
| 6183 | 1,1,1-TRIFLUORO-3-ACETAMIDO-4-PHENYL BUTAN-2-ONE(N-ACETYL-L-PHENYLALANYL TRIFLUOROMETHYL KETONE) |
| 6184 | 1,10-Phenanthroline |
| 6185 | 1,1'-BIPHENYL-2-SULFINIC ACID |
| 6186 | 1,1'-BIPHENYL-3,4-DIOL |
| 6187 | 1,1'-HEXANE-1,6-DIYLBIS(1H-IMIDAZOLE) |
| 6188 | 1,2,3,4-Tetrahydro-Isoquinoline-7-Sulfonic Acid Amide |
| 6189 | 1,2,3-TRIHYDROXY-1,2,3,4-TETRAHYDROBENZO[A]PYRENE |
| 6190 | 1,2,4-Triazole |
| 6191 | 1,2,4-Triazole-Carboxamidine |
| 6192 | 1,2,5,8-tetrahydroxyanthracene-9,10-dione |
| 6193 | 1,2,5-THIADIAZOLIDIN-3-ONE-1,1-DIOXIDE |
| 6194 | 1,2-Diacyl-Sn-Glycero-3-Phosphoinositol |
| 6195 | 1,2-Dichloro-Propane |
| 6196 | 1,2-Dihydroxybenzene |
| 6197 | 1,2-Di-N-Pentanoyl-Sn-Glycero-3-Dithiophosphocholine |
| 6198 | 1,2-Dipalmitoyl-Phosphatidyl-Glycerole |
| 6199 | 1,2-Propanediol |
| 6200 | 1,3,2-Dioxaborolan-2-Ol |
| 6201 | 1,3,4,9-Tetrahydro-2-(Hydroxybenzoyl)-9-[(4-Hydroxyphenyl)Methyl]-6-Methoxy-2h-Pyrido[3,4-B]Indole |
| 6202 | 1,3,4-TRIHYDROXY-5-(3-PHENOXYPROPYL)-CYCLOHEXANE-1 -CARBOXYLIC A CID |
| 6203 | 1,3,5-BENZENETRICARBOXYLIC ACID |
| 6204 | 1,3,5-Trichloro-Benzene |
| 6205 | 1,3- CYCLOHEXANEDIOL, 4-METHYLENE-5-[(2E)-[(1S,3AS,7AS)-OCTAHYDRO-1-(5-HYDROXY-5-METHYL-1,3-HEXADIYNYL)-7A-METHYL-4H-INDEN-4-YLIDENE]ETHYLIDENE]-, (1R,3S,5Z) |
| 6206 | 1,3-Dihydroxyacetonephosphate |
| 6207 | 1,3-DIPHENYLUREA |
| 6208 | 1,3-Propandiol |
| 6209 | 1,4-Butanediol |
| 6210 | 1,4-Deoxy-1,4-Dithio-Beta-D-Glucopyranose |
| 6211 | 1,4-Deoxy-4-((5-Hydroxymethyl-2,3,4-Trihydroxycyclohex-5-Enyl)Amino)Fructose |
| 6212 | 1,4-Dideoxy-5-Dehydro-O2-Sulfo-Glucuronic Acid |
| 6213 | 1,4-Dideoxy-O2-Sulfo-Glucuronic Acid |
| 6214 | 1,4-Diethylene Dioxide |
| 6215 | 1,4-Dithio-Alpha-D-Mannose |
| 6216 | 1,4-Dithiothreitol |
| 6217 | 1,5-Bis(N-Benzyloxycarbonyl-L-Leucinyl)Carbohydrazide |
| 6218 | 1,5-Dideoxy-1,5-Imino-D-Mannitol |
| 6219 | 1,6,7,8,9,11A,12,13,14,14A-DECAHYDRO-1,13-DIHYDROXY-6-METHYL-4H-CYCLOPENT[F]OXACYCLOTRIDECIN-4-ONE |
| 6220 | 1,6-Diaminohexane |
| 6221 | 1,6-DIHYDROXY NAPHTHALENE |
| 6222 | 1,6-DI-O-PHOSPHONO-D-MANNITOL |
| 6223 | 1,6-Fructose Diphosphate (Linear Form) |
| 6224 | 1,8-Di-Hydroxy-4-Nitro-Anthraquinone |
| 6225 | 1,8-Di-Hydroxy-4-Nitro-Xanthen-9-One |
| 6226 | 1,N6-Ethenoadenine |
| 6227 | 1-[(2,6-difluorophenyl)sulfonyl]-4-(2,3-dihydro-1,4-benzodioxin-6-ylsulfonyl)piperazine |
| 6228 | 1-[(2-AMINO-4-CHLORO-5-METHYLPHENYL)SULFONYL]-L-PROLINE |
| 6229 | 1-[(2-Amino-6,9-Dihydro-1h-Purin-6-Yl)Oxy]-3-Methyl-2-Butanol |
| 6230 | 1-[(2-NITROPHENYL)SULFONYL]-1H-PYRROLO[3,2-B]PYRIDINE-6-CARBOXAMIDE |
| 6231 | 1-[(2R)-2-aminobutanoyl]-N-(3-chlorobenzyl)-L-prolinamide |
| 6232 | 1-[(2R)-2-aminobutanoyl]-N-(4-carbamimidoylbenzyl)-L-prolinamide |
| 6233 | 1-[(2S)-2-[(4-CHLOROBENZYL)OXY]-2-(2,4-DICHLOROPHENYL)ETHYL]-1H-IMIDAZOLE |
| 6234 | 1-[(2S)-4-(5-BROMO-1H-PYRAZOLO[3,4-B]PYRIDIN-4-YL)MORPHOLIN-2-YL]METHANAMINE |
| 6235 | 1-[(2S)-4-(5-phenyl-1H-pyrazolo[3,4-b]pyridin-4-yl)morpholin-2-yl]methanamine |
| 6236 | 1-[(3S)-5-PHENYL-3-THIOPHEN-2-YL-3H-1,4-BENZODIAZEPIN-2-YL]AZETIDIN-3-OL |
| 6237 | 1-[[(1E)-2-(4-CHLOROPHENYL)ETHENYL]SULFONYL]-4-[[1-(4-PYRIDINYL)-4-PIPERIDINYL]METHYL]PIPERAZINE |
| 6238 | 1-[1-(3-aminophenyl)-3-tert-butyl-1H-pyrazol-5-yl]-3-naphthalen-1-ylurea |
| 6239 | 1-[1-(3-aminophenyl)-3-tert-butyl-1H-pyrazol-5-yl]-3-phenylurea |
| 6240 | 1-[1'-(3-phenylacryloyl)spiro[1-benzofuran-3,4'-piperidin]-5-yl]methanamine |
| 6241 | 1-[2-(3-ACETYL-2-HYDROXY-6-METHOXY-PHENYL)-CYCLOPROPYL]-3-(5-CYANO-PYRIDIN-2-YL)-THIOUREA |
| 6242 | 1-[2-(3-Biphenyl)-4-Methylvaleryl)]Amino-3-(2-Pyridylsulfonyl)Amino-2-Propanone |
| 6243 | 1-[2-(4-ETHOXY-3-FLUOROPYRIDIN-2-YL)ETHYL]-3-(5-METHYLPYRIDIN-2-YL)THIOUREA |
| 6244 | 1-[2-(S)-AMINO-3-BIPHENYL-4-YL-PROPIONYL]-PYRROLIDINE-2-(S)-CARBONITRILE |
| 6245 | 1-[2-AMINO-2-CYCLOHEXYL-ACETYL]-PYRROLIDINE-3-CARBOXYLIC ACID 5-CHLORO-2-(2-ETHYLCARBAMOYL-ETHOXY)-BENZYLAMIDE |
| 6246 | 1-[2-DEOXYRIBOFURANOSYL]-2,4-DIFLUORO-5-METHYL-BENZENE-5'MONOPHOSPHATE |
| 6247 | 1-[2-HYDROXY-3-(4-CYCLOHEXYL-PHENOXY)-PROPYL]-4-(2-PYRIDYL)-PIPERAZINE |
| 6248 | 1-[3-({[(4-AMINO-5-FLUORO-2-METHYLQUINOLIN-3-YL)METHYL]THIO}METHYL)PHENYL]-2,2,2-TRIFLUOROETHANE-1,1-DIOL |
| 6249 | 1-[3,3-Dimethyl-2-(2-Methylamino-Propionylamino)-Butyryl]-Pyrrolidine-2-Carboxylic Acid(1,2,3,4-Tetrahydro-Naphthalen-1-Yl)-Amide |
| 6250 | 1-[4-(2-oxo-2-phenylethyl)phenyl]guanidine |
| 6251 | 1-[4-(4-chlorobenzyl)-1-(7H-pyrrolo[2,3-d]pyrimidin-4-yl)piperidin-4-yl]methanamine |
| 6252 | 1-[4-(4-chlorophenyl)-1-(7H-pyrrolo[2,3-d]pyrimidin-4-yl)piperidin-4-yl]methanamine |
| 6253 | 1-[4-(AMINOMETHYL)BENZOYL]-5'-FLUORO-1'H-SPIRO[PIPERIDINE-4,2'-QUINAZOLIN]-4'-AMINE |
| 6254 | 1-[4-(AMINOSULFONYL)PHENYL]-1,6-DIHYDROPYRAZOLO[3,4-E]INDAZOLE-3-CARBOXAMIDE |
| 6255 | 1-[4-(hydroxymethyl)phenyl]guanidine |
| 6256 | 1-[4-(Octahydro-Pyrido[1,2-a]Pyrazin-2-Yl)-Phenyl]-2-Phenyl-1,2,3,4-Tetrahydro-Isoquinolin-6-Ol |
| 6257 | 1-[4-(PYRIDIN-4-YLOXY)PHENYL]-3-[3-(TRIFLUOROMETHYL)PHENYL]UREA |
| 6258 | 1-[4-Carboxy-(3-Pentylamino)Phenyl]-5,5'-Di(Hydroxymethyl)Pyrrolidin-2-One |
| 6259 | 1-[5-methyl-2-(trifluoromethyl)furan-3-yl]-3-[(2Z)-5-(2-{[6-(1H-1,2,4-triazol-3-ylamino)pyrimidin-4-yl]amino}ethyl)-1,3-thiazol-2(3H)-ylidene]urea |
| 6260 | 1-[6-(2-CHLORO-4-METHYXPHENOXY)-HEXYL]-IMIDAZOLE |

TABLE 1-continued

Ligands

| Ligand No. | Ligand Name |
|---|---|
| 6261 | 1-[Glycerolylphosphonyl]-2-[8-(2-Hexyl-Cyclopropyl)-Octanal-1-Yl]-3-[Hexadecanal-1-Yl]-Glycerol |
| 6262 | 1-[N[(Phenylmethoxy)Carbonyl]-L-Leucyl-4-[[N/N-[(Phenylmethoxy)Carbonyl]-/Nl-Leucyl]Amino]-3-Pyrrolidinone/N |
| 6263 | 1-[N-4'-NITROBENZYL-N-4'-CARBOXYBUTYLAMINO]METHYLPHOSPHONIC ACID |
| 6264 | 1-[Pyrrol-1-Yl-2,5-Dione-Methoxymethyl]-Pyrrole-2,5-Dione |
| 6265 | 1-{(1R,2S)-2-HYDROXY-1-[2-(2-NAPHTHYLOXY)ETHYL]PROPYL}-1H-IMIDAZONE-4-CARBOXAMIDE |
| 6266 | 1-{(2S,5S)-4-FLUORO-5-[(TRITYLOXY)METHYL]TETRAHYDROFURAN-2-YL}PYRIMIDINE-2,4(1H,3H)-DIONE |
| 6267 | 1-{[(1E)-(3-HYDROXY-2-METHYL-5-{[(TRIHYDROXY-LAMBDA 5 -PHOSPHANYL)OXY]METHYL}PYRIDIN-4-YL)METHYLIDENE]AMINO}UNDECAN-2-ONE |
| 6268 | 1-{[(3R)-3-methyl-4-({4-[(1S)-2,2,2-trifluoro-1-hydroxy-1-methylethyl]phenyl}sulfonyl)piperazin-1-yl]methyl}cyclopropanecarboxamide |
| 6269 | 1-{[1-(2-AMINO-3-PHENYL-PROPIONYL)-PYRROLIDINE-2-CARBONYL]-AMINO}-2-(3-CYANO-PHENYL)-ETHANEBORONIC ACID |
| 6270 | 1-{[N-(1-IMINO-GUANIDINO-METHYL)]SULFANYLMETHYL}-3-TRIFLUOROMETHYL-BENZENE |
| 6271 | 1-{2-[(4-CHLOROPHENYL)AMINO]-2-OXOETHYL}-N-(1-ISOPROPYLPIPERIDIN-4-YL)-1H-INDOLE-2-CARBOXAMIDE |
| 6272 | 1-{2-[2-(2-Methoxyethoxy)Ethoxy]Ethoxy}-4-(1,1,3,3-Tetramethylbutyl)Benzene |
| 6273 | 1-{2-[3-(2-Chloro-4,5-difluoro-benzoyl)-ureido]-4-fluoro-phenyl}-piperidine-4-carboxylic acid |
| 6274 | 1-{2-OXO-3-[(1R)-1-(1H-PYRROL-2-YL)ETHYL]-2H-INDOL-5-YL}UREA |
| 6275 | 1-{3-[(4-pyridin-2-ylpiperazin-1-yl)sulfonyl]phenyl}-3-(1,3-thiazol-2-yl)urea |
| 6276 | 1-{3-oxo-3-[(2S)-2-(pyrrolidin-1-ylcarbonyl)pyrrolidin-1-yl]propyl}-3-phenylquinoxalin-2(1H)-one |
| 6277 | 1-{5-[2-(thieno[3,2-d]pyrimidin-4-ylamino)ethyl]-1,3-thiazol-2-yl}-3-[3-(trifluoromethyl)phenyl]urea |
| 6278 | 1-{7-cyclohexyl-6-[4-(4-methylpiperazin-1-yl)benzyl]-7H-pyrrolo[2,3-d]pyrimidin-2-yl}methanamine |
| 6279 | 10-(4-Dimethylamino-5-Hydroxy-6-Methyl-Tetrahydro-Pyran-2-Yloxy)-8-Ethyl-1,8,11-Trihydroxy-7,8,9,10-Tetrahydro-Naphthacene-5,12-Dione |
| 6280 | 10,11-dimethoxy-4-methyldibenzo[c,f]-2,7-naphthyridine-3,6-diamine |
| 6281 | 10-{4-Dimethylamino-5-[4-Hydroxy-6-Methyl-5-(6-Methyl-5-Oxo-Tetrahydro-Pyran-2-Yloxy)-Tetrahydro-Pyrane-2-Yloxy]-6-Methyl-Tetrahydro-Pyran-2-Yloxy}-8-Ethyl-1,8,11-Trihydroxy-7,8,9,10-Tetrahydro-Naphthacene-5,12-Dione |
| 6282 | 10-CF3C(OH)2-DDACTHF |
| 6283 | 10-Propargyl-5,8-Dideazafolic Acid |
| 6284 | 11-[(MERCAPTOCARBONYL)OXY]UNDECANOIC ACID |
| 6285 | 11-Deoxy-Beta-Rhodomycin |
| 6286 | 11-MERCAPTOUNDECANOIC ACID |
| 6287 | 11-TRANS-13-TRANS-15-CIS-OCTADECATRIENOIC ACID |
| 6288 | 12-(2-hydroxyethyl)-2-(1-methylethoxy)-13,14-dihydronaphtho[2,1-a]pyrrolo[3,4-c]carbazol-5(12H)-one |
| 6289 | 12-Bromododecanoic Acid |
| 6290 | 12-Hydroxydodecanoic Acid |
| 6291 | 12-Phenylheme |
| 6292 | 1-3 Sugar Ring of Pentamannosyl 6-Phosphate |
| 6293 | 13-Acetylphorbol |
| 6294 | 16,17-Androstene-3-Ol |
| 6295 | 16g |
| 6296 | 17-Dmag |
| 6297 | 17-HYDROXY-18A-HOMO-19-NOR-17ALPHA-PREGNA-4,9,11-TRIEN-3-ONE |
| 6298 | 17-METHYL-17-ALPHA-DIHYDROEQUILENIN |
| 6299 | 18-CHLORO-11,12,13,14-TETRAHYDRO-1H,10H-8,4-(AZENO)-9,15,1,3,6-BENZODIOXATRIAZACYCLOHEPTADECIN-2-ONE |
| 6300 | 19-(cyclopropylamino)-4,6,7,15-tetrahydro-5H-16,1-(azenometheno)-10,14-(metheno)pyrazolo[4,3-o][1,3,9]triazacyclohexadecin-8(9H)-one |
| 6301 | 1-ACETYL-2-CARBOXYPIPERIDINE |
| 6302 | 1-ACETYL-2-LYSO-SN-GLYCERO-3-PHOSPHOETHANOLAMINE |
| 6303 | 1-Acetyl-4-(4-{4-[(2-Ethoxyphenyl)Thio]-3-Nitrophenyl}Pyridin-2-Yl)Piperazine |
| 6304 | 1-Allyl-3-Butyl-8-(N-Acetyl-4-Aminobenzyl)-Xanthine |
| 6305 | 1-alpha, 25-dihydroxyl-20-epi-22-oxa-24,26,27-trihomovitamin D3 |
| 6306 | 1-Amino-1-Carbonyl Pentane |
| 6307 | 1-Amino-2,3-Dihydroxy-5-Hydroxymethyl Cyclohex-5-Ene |
| 6308 | 1-Amino-6-Cyclohex-3-Enylmethyloxypurine |
| 6309 | 1-Aminocyclopropanecarboxylic Acid |
| 6310 | 1-Aminocyclopropylphosphonate |
| 6311 | 1-Anilino-8-Naphthalene Sulfonate |
| 6312 | 1-Azepan-1-Yl-2-Phenyl-2-(4-Thioxo-1,4-Dihydro-Pyrazolo[3,4-D]Pyrimidin-5-Yl)Ethanone Adduct |
| 6313 | 1-Benzyl-(R)-Propylamine |
| 6314 | 1-Benzyl-3-(4-Methoxy-Benzenesulfonyl)-6-Oxo-Hexahydro-Pyrimidine-4-Carboxylic Acid Hydroxyamide |
| 6315 | 1-BENZYL-3-(4-METHOXYPHENYLAMINO)-4-PHENYLPYRROLE-2,5-DIONE |
| 6316 | 1-BENZYL-4-[(5,6-DIMETHOXY-1-INDANON-2-YL)METHYL]PIPERIDINE |
| 6317 | 1-Benzyl-5-Methoxy-2-Methyl-1h-Indol-3-Yl)-Acetic Acid |
| 6318 | 1-benzylimidazole |
| 6319 | 1-Benzyloxycarbonylamino-2-Phenyl-Ethyl)-{2-[1-Carbamoyl-2-(1H-Indol-3-Yl)-Ethylcarbamoyl]-5-Phenyl-Pentyl}-Phosphinic Acid |
| 6320 | 1-Beta-Ribofuranosyl-1,3-Diazepinone |
| 6321 | 1-biphenyl-2-ylmethanamine |
| 6322 | 1-Bromopropane-2-Ol |
| 6323 | 1-Butane Boronic Acid |
| 6324 | 1-butanoyl-N-(4-carbamimidoylbenzyl)-L-prolinamide |
| 6325 | 1-CHLORO-6-(4-HYDROXYPHENYL)-2-NAPHTHOL |
| 6326 | 1-cyclobutyl-3-(3,4-dimethoxyphenyl)-1H-pyrazolo[3,4-d]pyrimidin-4-amine |
| 6327 | 1-CYCLOHEXYL-N-{[1-(4-METHYLPHENYL)-1H-INDOL-3-YL]METHYL}METHANAMINE |
| 6328 | 1-cyclopentyl-3-(1H-pyrrolo[2,3-b]pyridin-5-yl)-1H-pyrazolo[3,4-d]pyrimidin-4-amine |
| 6329 | 1-Deaza-Adenosine |
| 6330 | 1-DECANE-SULFONIC-ACID |
| 6331 | 1-DECYL-3-TRIFLUORO ETHYL-SN-GLYCERO-2-PHOSPHOMETHANOL |
| 6332 | 1-Deoxy-1-Acetylamino-Beta-D-Gluco-2-Heptulopyranosonamide |
| 6333 | 1-Deoxy-1-Methoxycarbamido-Beta-D-Gluco-2-Heptulopyranosonamide |
| 6334 | 1-Deoxy-1-Methoxycarbamido-Beta-D-Glucopyranose |
| 6335 | 1-Deoxy-1-Thio-Heptaethylene Glycol |
| 6336 | 1-Deoxy-6-O-Phosphono-1-[(Phosphonomethyl)Amino]-L-Threo-Hexitol |
| 6337 | 1-Deoxy-D-xylulose 5-phosphate |
| 6338 | 1-Deoxynojirimycin |
| 6339 | 1-Deoxy-Ribofuranose-5'-Phosphate |
| 6340 | 1-DODECANOL |
| 6341 | 1-ETHOXY-2-(2-ETHOXYETHOXY)ETHANE |
| 6342 | 1-ETHOXYCARBONYL-D-PHE-PRO-2(4-AMINOBUTYL)HYDRAZINE |
| 6343 | 1-ethyl-N-(phenylmethyl)-4-(tetrahydro-2H-pyran-4-ylamino)-1H-pyrazolo[3,4-b]pyridine-5-carboxamide |
| 6344 | 1-Ethyl-Pyrrolidine-2,5-Dione |
| 6345 | 1-Guanidinium-7-Aminoheptane |
| 6346 | 1-GUANIDINO-4-(N-NITRO-BENZOYLAMINO-L-LEUCYL-L-PROLYLAMINO)BUTANE |
| 6347 | 1-GUANIDINO-4-(N-PHENYLMETHANESULFONYL-L-LEUCYL-L-PROLYLAMINO)BUTANE |
| 6348 | 1h-Benoximidazole-2-Carboxylic Acid |

TABLE 1-continued

Ligands

| Ligand No. | Ligand Name |
|---|---|
| 6349 | 1-Hexadecanosulfonic Acid |
| 6350 | 1-Hexadecanosulfonyl-O-L-Serine |
| 6351 | 1-Hexadecylsulfonyl Fluoride |
| 6352 | 1H-INDOL-3-YLACETIC ACID |
| 6353 | 1-Hydroxy-1-Thio-Glycerol |
| 6354 | 1-Hydroxy-2-Amino-3-Cyclohexylpropane |
| 6355 | 1-Hydroxy-2-S-Glutathionyl-3-Para-Nitrophenoxy-Propane |
| 6356 | 1-Hydroxy-3-Methylbutane |
| 6357 | 1-Hydroxyamine-2-Isobutylmalonic Acid |
| 6358 | 1-Methoxy-2-(2-Methoxyethoxy)Ethane |
| 6359 | 1-Methoxy-2-[2-(2-Methoxy-Ethoxy]-Ethane |
| 6360 | 1 -METHYL ETHYL 1-CHLORO-5-[[(5,6DIHYDRO-2-METHYL-1,4-OXATHIIN-3-YL)CARBONYL]AMINO]BENZOATE |
| 6361 | 1-METHYL ETHYL 2-CHLORO-5-[[[(1-METHYLETHOXY)THIOOXO]METHYL]AMINO]-BENZOATE |
| 6362 | 1-Methyl-2-Oxy-5,5-Dimethyl Pyrrolidine |
| 6363 | 1-Methyl-2-quinolone |
| 6364 | 1-methyl-3-naphthalen-2-yl-1H-pyrazolo[3,4-d]pyrimidin-4-amine |
| 6365 | 1-Methyl-3-Oxo-1,3-Dihydro-Benzo[C]lsothiazole-5-Sulfonic Acid Amide |
| 6366 | 1-METHYL-3-PHENYL-1H-PYRAZOL-5-YLSULFAMIC ACID |
| 6367 | 1-METHYL-3-TRIFLUOROMETHYL-1H-THIENO[2,3-C]PYRAZOLE-5-CARBOXYLIC ACID (2-MERCAPTO-ETHYL)-AMIDE |
| 6368 | 1-METHYL-5-(2-PHENOXYMETHYL-PYRROLIDINE-1-SULFONYL)-1H-INDOLE-2,3-DIONE |
| 6369 | 1-methyl-8-(phenylamino)-4,5-dihydro-1H-pyrazolo[4,3-h]quinazoline-3-carboxylic acid |
| 6370 | 1-Methylcytosine |
| 6371 | 1-Methylimidazole |
| 6372 | 1-Methyloxy-4-Sulfone-Benzene |
| 6373 | 1-Monohexanoyl-2-Hydroxy-Sn-Glycero-3-Phosphate |
| 6374 | 1-N-(4-SULFAMOYLPHENYL-ETHYL)-2,4,6-TRIMETHYLPYRIDINIUM |
| 6375 | 1-N-Acetyl-Beta-D-Glucosamine |
| 6376 | 1-O-[O-Nitrophenyl]-Beta-D-Galactopyranose |
| 6377 | 1-O-[P-Nitrophenyl]-Beta-D-Galactopyranose |
| 6378 | 1-Octadecyl-2-Acetamido-2-Deoxy-Sn-Glycerol-3-Phosphoethylmethyl Sulfide |
| 6379 | 1-O-Octyl-2-Heptylphosphonyl-Sn-Glycero-3-Phosphoethanolamine |
| 6380 | 1-PHENYL-1H-PYRAZOLE-4-CARBOXYLIC ACID |
| 6381 | 1-Phenylsulfonamide-3-Trifluoromethyl-5-Parabromophenylpyrazole |
| 6382 | 1-Proponol |
| 6383 | 1S,3AS,8AS-TRIMETHYL-1-OXIDO-1,2,3,3A,8,8A-HEXAHYDROPYRROLO[2,3-B]INDOL-5-YL 2-ETHYLPHENYLCARBAMATE |
| 6384 | 1-Ter-Butyl-3-P-Tolyl-1h-Pyrazolo[3,4-D]Pyrimidin-4-Ylamine |
| 6385 | 1-TERT-BUTYL-3-(2,5-DIMETHYLBENZYL)-1H-PYRAZOLO[3,4-D]PYRIMIDIN-4-AMINE |
| 6386 | 1-tert-butyl-3-(3-methylbenzyl)-1H-pyrazolo[3,4-d]pyrimidin-4-amine |
| 6387 | 1-Tert-Butyl-3-(4-Chloro-Phenyl)-1h-Pyrazolo[3,4-D]Pyrimidin-4-Ylamine |
| 6388 | 1-Thio-Beta-D-Glucopyranose |
| 6389 | 2-((3',5'-DIMETHOXY-4'-HYDROXYPHENYL)AZO)BENZOIC ACID |
| 6390 | 2-((3',5'-DIMETHYL-4'-HYDROXYPHENYL)AZO)BENZOIC ACID |
| 6391 | 2-((3'-METHYL-4'-HYDROXYPHENYL)AZO)BENZOIC ACID |
| 6392 | 2-((3'-TERTBUTYL-4'-HYDROXYPHENYL)AZO)BENZOIC ACID |
| 6393 | 2-((4'-HYDROXYNAPHTHYL)-AZO)BENZOIC ACID |
| 6394 | 2-((4'-HYDROXYPHENYL)-AZO)BENZOIC ACID |
| 6395 | 2-((9H-PURIN-6-YLTHIO)METHYL)-5-CHLORO-3-(2-METHOXYPHENYL)QUINAZOLIN-4(3H)-ONE |
| 6396 | 2-({[2,3,5,6-TETRAFLUORO-3'-(TRIFLUOROMETHOXY)BIPHENYL-4-YL]AMINO}CARBONYL)CYCLOPENTA-1,3-DIENE-1-CARBOXYLIC ACID |
| 6397 | 2-({[3-(3,4-dihydroisoquinolin-2(1H)-ylsulfonyl)phenyl]carbonyl}amino)benzoic acid |
| 6398 | 2-({[3,5-DIFLUORO-3'-(TRIFLUOROMETHOXY)BIPHENYL-4-YL]AMINO}CARBONYL)CYCLOPENT-1-ENE-1-CARBOXYLIC ACID |
| 6399 | 2-({[4-(TRIFLUOROMETHOXY)PHENYL]SULFONYL}AMINO)ETHYL DIHYDROGEN PHOSPHATE |
| 6400 | 2-({[4-bromo-3-(diethylsulfamoyl)phenyl]carbonyl}amino)benzoic acid |
| 6401 | 2-({2-[(3-HYDROXYPHENYL)AMINO]PYRIMIDIN-4-YL}AMINO)BENZAMIDE |
| 6402 | 2-({2-[(3R)-3-AMINOPIPERIDIN-1-YL]-4-OXOQUINAZOLIN-3(4H)-YL}METHYL)BENZONITRILE |
| 6403 | 2-({4-[(5-CHLORO-1H-INDOL-2-YL)SULFONYL]PIPERAZIN-1-YL}CARBONYL)THIENO[3,2-B]PYRIDINE4-OXIDE |
| 6404 | 2-({4-[4-(pyridin-4-ylmethyl)-1H-pyrazol-3-yl]phenoxy}methyl)quinoline |
| 6405 | 2-({5-CHLORO-2-[(2-METHOXY-4-MORPHOLIN-4-YLPHENYL)AMINO]PYRIMIDIN-4-YL}AMINO)-N-METHYLBENZAMIDE |
| 6406 | 2-({8-[(3R)-3-AMINOPIPERIDIN-1-YL]-1,3-DIMETHYL-2,6-DIOXO-1,2,3,6-TETRAHYDRO-7H-PURIN-7-YL}METHYL)BENZONITRILE |
| 6407 | 2-(1,1'-Biphenyl-4-Yl)Propanoic Acid |
| 6408 | 2-(1,1-DIMETHYLETHYL)9-FLUORO-3,6-DIHYDRO-7H-BENZ[H]-IMIDAZ[4,5-F]ISOQUINOLIN-7-ONE |
| 6409 | 2-(1,3-benzodioxol-5-yl)-5-[(3-fluoro-4-methoxybenzyl)sulfanyl]-1,3,4-oxadiazole |
| 6410 | 2-(1,3-thiazol-4-yl)-1H-benzimidazole-5-sulfonamide |
| 6411 | 2-(11-{2-[Benzenesulfonyl-(3-Methyl-Butyl)-Amino]-1-Hydroxy-Ethyl}-6,9-Dioxo-2-Oxa-7,10-Diaza-Bicyclo[11.2.2] Heptadeca-1(16),13(17),14-Trien-8-Yl)-Acetamide, Inhibitor 2 |
| 6412 | 2-(1H-imidazol-1-yl)-9-methoxy-8-(2-methoxyethoxy)benzo[c][2,7]naphthyridin-4-amine |
| 6413 | 2-(1H-INDOL-3-YL)ACETAMIDE |
| 6414 | 2-(1H-INDOL-3-YL)ETHANAMINE |
| 6415 | 2-(1H-pyrazol-3-yl)-1H-benzimidazole |
| 6416 | 2-(1H-pyrrol-1-ylcarbonyl)benzene-1,3,5-triol |
| 6417 | 2-(2,4-DICHLOROPHENOXY)-5-(PYRIDIN-2-YLMETHYL)PHENOL |
| 6418 | 2-(2,6-DIFLUOROPHENOXY)-N-(2-FLUOROPHENYL)-9-ISOPROPYL-9H-PURIN-8-AMINE |
| 6419 | 2-(2-{2-[(BIPHENYL-4-YLMETHYL)-AMINO]-3-MERCAPTO-PENTANOYLAMINO}-ACETYLAMINO)-3-METHYL-BUTYRIC ACID METHYL ESTER |
| 6420 | 2-(2-{2-[2-(2-{2-[2-(2-Ethoxy-Ethoxy)-Ethoxy]-Ethoxy}-Ethoxy)-Ethoxy]-Ethoxy}-Ethoxy)-Ethanol, Polyethyleneglycol Peg400 |
| 6421 | 2-(2-{2-[2-(2-Methoxy-Ethoxy)-Ethoxy]-Ethoxy}-Ethoxy)-Ethanol |
| 6422 | 2-(2-CHLORO-4-FLUOROPHENOXY)-2-METHYL-N-[(1R,2S,3S,5S,7S)-5-(METHYLSULFONYL)-2-ADAMANTYL]PROPANAMIDE |
| 6423 | 2-(2-chloropyridin-4-yl)-4-methyl-1H-isoindole-1,3(2H)-dione |
| 6424 | 2-(2f-Benzothiazolyl)-5-Styryl-3-(4f-Phthalhydrazidyl)Tetrazolium Chloride |
| 6425 | 2-(2-Hydroxy-1,1-Dihydroxymethyl-Ethylamino)-Ethanesulfonic Acid |
| 6426 | 2-(2-Hydroxy-5-Methoxy-Phenyl)-1h-Benzoimidazole-5-Carboxamidine |
| 6427 | 2-(2-HYDROXY-BIPHENYL)-1H-BENZOIMIDAZOLE-5-CARBOXAMIDINE |
| 6428 | 2-(2-HYDROXY-CYCLOPENTYL)-PENT-4-ENAL |
| 6429 | 2-(2-HYDROXYETHYLAMINO)-6-(3-CHLOROANILINO)-9-ISOPROPYLPURINE |

TABLE 1-continued

Ligands

| Ligand No. | Ligand Name |
|---|---|
| 6430 | 2-(2-Hydroxy-Phenyl)-1h-Benzoimidazole-5-Carboxamidine |
| 6431 | 2-(2-Hydroxy-Phenyl)-1h-Indole-5-Carboxamidine |
| 6432 | 2-(2-Hydroxy-Phenyl)-3h-Benzoimidazole-5-Carboxamidine |
| 6433 | 2-(2-METHYLPHENYL)-1H-INDOLE-5-CARBOXIMIDAMIDE |
| 6434 | 2-(2-METHYLPHENYL)-1H-INDOLE-6-CARBOXIMIDAMIDE |
| 6435 | 2-(2-Oxo-1,2-Dihydro-Pyridin-3-Yl)-1h-Benzoimidazole-5-Carboxamidine |
| 6436 | 2-(2-PHENYL-3-PYRIDIN-2-YL-4,5,6,7-TETRAHYDRO-2H-ISOPHOSPHINDOL-1-YL)PYRIDINE |
| 6437 | 2-(2-QUINOLIN-3-YLPYRIDIN-4-YL)-1,5,6,7-TETRAHYDRO-4H-PYRROLO[3,2-C]PYRIDIN-4-ONE |
| 6438 | 2-(3-((4,5,7-trifluorobenzo[d]thiazol-2-yl)methyl)-1H-pyrrolo[2,3-b]pyridin-1-yl)acetic acid |
| 6439 | 2-(3,4-Dihydro-3-Oxo-2h-Benzo[B][1,4]Thiazin-2-Yl)-N-Hydroxyacetamide |
| 6440 | 2-(3,4-DIHYDROXYPHENYL)-8-(1,1-DIOXIDOISOTHIAZOLIDIN-2-YL)-3-HYDROXY-6-METHYL-4H-CHROMEN-4-ONE |
| 6441 | 2-(3,4-Dihydroxyphenyl)Acetic Acid |
| 6442 | 2-(3,6-DIHYDROXYPHENYL)ACETIC ACID |
| 6443 | 2-(3-AMINO-2,5,6-TRIMETHOXYPHENYL)ETHYL 5-CHLORO-2,4-DIHYDROXYBENZOATE |
| 6444 | 2-(3-BENZOYLPHENOXY)ETHYL(HYDROXY)FORMAMIDE |
| 6445 | 2-(3-BROMOPHENYL)-6-[(2-HYDROXYETHYL)AMINO]-1H-BENZO[DE]ISOQUINOLINE-1,3(2H)-DIONE |
| 6446 | 2-(3-CARBOXYPROPIONYL)-6-HYDROXY-CYCLOHEXA-2,4-DIENE CARBOXYLIC ACID |
| 6447 | 2-(3-CHLORO-6-{[2,2-DIFLUORO-2-(1-OXIDOPYRIDIN-2-YL)ETHYL]AMINO}-1-OXIDOPYRIDIN-2-YL)-N-[1-(3-CHLOROPHENYL)ETHYL]ACETAMIDE |
| 6448 | 2-(3-FLUORO-4-HYDROXYPHENYL)-7-VINYL-1,3-BENZOXAZOL-5-OL |
| 6449 | 2-(3-GUANIDINOPHENYL)-3-MERCAPTOPROPANOIC ACID |
| 6450 | 2-(3'-Methoxyphenyl) Benzimidazole-4-Carboxamide |
| 6451 | 2-(3-METHYLPHENYL)-1H-INDOLE-5-CARBOXIMIDAMIDE |
| 6452 | 2-(3-NITROPHENYL)ACETIC ACID |
| 6453 | 2-(3-OXO-PROPYLSULFANYLCARBONYL)-ETHANETHIOLATE |
| 6454 | 2-(4-(2-((3-(5-(PYRIDIN-2-YLTHIO)THIAZOL-2-YL)UREIDO)METHYL)-1H-IMIDAZOL-4-YL)PHENOXY)ACETIC ACID |
| 6455 | 2-(4-(2-HYDROXY-3-(ISOPROPYLAMINO)PROPOXY)PHENYL)ETHANAMIDE |
| 6456 | 2-(4-(AMINOMETHYL)PIPERIDIN-1-YL)-N-(3_CYCLOHEXYL-4-OXO-2,4-DIHYDROINDENO[1,2-C]PYRAZOL-5-YL)ACETAMIDE |
| 6457 | 2-(4-{(3S,5S)-5-[(3,3-difluoropyrrolidin-1-yl)carbonyl]pyrrolidin-3-yl}piperazin-1-yl)pyrimidine |
| 6458 | 2-(4-CARCOXY-5-ISOPROPYLTHIAZOLYL)BENZOPIPERIDINE |
| 6459 | 2-(4-CHLOROBENZYLAMINO)-4-(PHENYLAMINO)PYRAZOLO[1,5-A][1,3,5]TRIAZINE-8-CARBONITRILE |
| 6460 | 2-(4-Chlorophenyl)-5-Quinoxalinecarboxamide |
| 6461 | 2-(4-CHLORO-PHENYLAMINO)-NICOTINIC ACID |
| 6462 | 2-(4-DIMETHYLAMINOPHENYL)DIAZENYLBENZOIC ACID |
| 6463 | 2-(4-ETHYLPIPERAZIN-1-YL)-4-(PHENYLAMINO)PYRAZOLO[1,5-A][1,3,5]TRIAZINE-8-CARBONITRILE |
| 6464 | 2-(4-fluorophenyl)-N-{[3-fluoro-4-(1H-pyrrolo[2,3-b]pyridin-4-yloxy)phenyl]carbamoyl}acetamide |
| 6465 | 2-(4-HYDROXY-3-NITROPHENYL)ACETIC ACID |
| 6466 | 2-(4-HYDROXY-5-PHENYL-1H-PYRAZOL-3-YL)-1H-BENZOIMIDAZOLE-5-CARBOXAMIDINE |
| 6467 | 2-(4-hydroxybiphenyl-3-yl)-4-methyl-1H-isoindole-1,3(2H)-dione |
| 6468 | 2-(4-HYDROXY-PHENYL)BENZOFURAN-5-OL |
| 6469 | 2-(4-METHOXYPHENYL)ACETAMIDE |
| 6470 | 2-(4-METHYLPHENOXY)ETHYLPHOSPHINATE |
| 6471 | 2-(4-Morpholinyl)-8-Phenyl-4h-1-Benzopyran-4-One |
| 6472 | 2-(4-NITROPHENYL)ACETIC ACID |
| 6473 | 2-(5-CHLORO-2-THIENYL)-N-{(3S)-1-[(1S)-1-METHYL-2-MORPHOLIN-4-YL-2-OXOETHYL]-2-OXOPYRROLIDIN-3-YL}ETHANESULFONAMIDE |
| 6474 | 2-(5-CHLORO-2-THIENYL)-N-{(3S)-1-[(1S)-1-METHYL-2-MORPHOLIN-4-YL-2-OXOETHYL]-2-OXOPYRROLIDIN-3-YL}ETHENESULFONAMIDE |
| 6475 | 2-(5-HYDROXY-NAPHTHALEN-1-YL)-1,3-BENZOOXAZOL-6-OL |
| 6476 | 2-(6-{[(3-chloro-2-methylphenyl)sulfonyl]amino}pyridin-2-yl)-N,N-diethylacetamide |
| 6477 | 2-(6-CHLORO-3-{[2,2-DIFLUORO-2-(1-OXIDO-2-PYRIDINYL)ETHYL]AMINO}-2-OXO-1(2H)-PYRAZINYL)-N-[(2-FLUOROPHENYL)METHYL]ACETAMIDE |
| 6478 | 2-(6-CHLORO-3-{[2,2-DIFLUORO-2-(2-PYRIDINYL)ETHYL]AMINO}-2-OXO-1(2H)-PYRAZINYL)-N-[(2-FLUORO-3-METHYL-6-PYRIDINYL)METHYL]ACETAMIDE |
| 6479 | 2-(6-CHLORO-3-{[2,2-DIFLUORO-2-(2-PYRIDINYL)ETHYL]AMINO}-2-OXO-1(2H)-PYRAZINYL)-N-[(2-FLUORO-6-PYRIDINYL)METHYL]ACETAMIDE |
| 6480 | 2-(6-HYDROXY-1,3-BENZOTHIAZOL-2-YL)-1,3-THIAZOL-4(5H)-ONE |
| 6481 | 2-(6-methylpyridin-2-yl)-N-pyridin-4-ylquinazolin-4-amine |
| 6482 | 2-(Acetylamino)-2-Deoxy-4-O-Sulfo-Alpha-D-Galactopyranose |
| 6483 | 2-(Acetylamino)-2-Deoxy-6-O-Methyl-Alpha-D-Allopyranose |
| 6484 | 2-(Acetylamino)-2-Deoxy-a-D-Glucopyranose |
| 6485 | 2-(ACETYL-HYDROXY-AMINO)-4-METHYL-PENTANOIC ACID METHYL ESTER |
| 6486 | 2-(Beta-D-Glucopyranosyl)-5-Methyl-1,2,3-Benzimidazole |
| 6487 | 2-(Beta-D-Glucopyranosyl)-5-Methyl-1,3,4-Benzothiazole |
| 6488 | 2-(Beta-D-Glucopyranosyl)-5-Methyl-1,3,4-Oxadiazole |
| 6489 | 2-(Biphenyl-4-Sulfonyl)-1,2,3,4-Tetrahydro-Isoquinoline-3-Carboxylic Acid |
| 6490 | 2-(BUTYRYLOXY)-1-{[(TETRAHYDROXYPHOSPHORANYL)OXY]METHYL}ETHYL BUTYRATE |
| 6491 | 2-(Carboxymethoxy)-5-[(2s)-2-({(2s)-2-[(3-Carboxypropanoyl)Amino] -3-Phenylpropanoyl}Amino)-3-Oxo-3-(Pentylamino)Propyl]Benzoic Acid |
| 6492 | 2-(CARBOXYMETHYL)-1-OXO-1,2-DIHYDRONAPHTHO[1,2-D]ISOTHIAZOLE-4-CARBOXYLIC ACID 3,3-DIOXIDE |
| 6493 | 2-(cycloheptylmethyl)-1,1-dioxido-1-benzothiophen-6-yl sulfamate |
| 6494 | 2-(cyclohexylamino)benzoic acid |
| 6495 | 2-(CYCLOHEXYLMETHYLAMINO)-4-(PHENYLAMINO)PYRAZOLO[1,5-A][1,3,5]TRIAZINE-8-CARBONITRILE |
| 6496 | 2-(ETHOXYMETHYL)-4-(4-FLUOROPHENYL)-3-[2-(2-HYDROXYPHENOXY)PYRIMIDIN-4-YL]ISOXAZOL-5(2H)-ONE |
| 6497 | 2-(hydrazinocarbonyl)-3-phenyl-1H-indole-5-sulfonamide |
| 6498 | 2-(methylamino)-N-(4-methyl-1,3-thiazol-2-yl)-5-[(4-methyl-4H-1,2,4-triazol-3-yl)sulfanyl]benzamide |
| 6499 | 2-(methylsulfanyl)-5-(thiophen-2-ylmethyl)-1H-imidazol-4-ol |
| 6500 | 2-(N-Morpholino)-Ethanesulfonic Acid |
| 6501 | 2-(Oxalyl-Amino)-4,5,6,7-Tetrahydro-Thieno[2,3-C]Pyridine-3-Carboxylic Acid |
| 6502 | 2-(Oxalyl-Amino)-4,7-Dihydro-5h-Thieno[2,3-C]Pyran-3-Carboxylic Acid |
| 6503 | 2-(Oxalyl-Amino)-4,7-Dihydro-5h-Thieno[2,3-C]Thiopyran-3-Carboxylic Acid |
| 6504 | 2-(Oxalyl-Amino)-Benzoic Acid |
| 6505 | 2-(Phosphonooxy)Butanoic Acid |
| 6506 | 2(S)-Amino-6-Boronohexanoic Acid |
| 6507 | 2-(Sec-Butyl)Thiazole |
| 6508 | 2-(Thiomethylene)-4-Methylpentanoic Acid |
| 6509 | 2-(TOLUENE-4-SULFONYL)-2H-BENZO[D][1,2,3]DIAZABORININ-1-OL |
| 6510 | 2-(Trimethylammonium)Ethyl Thiol |

TABLE 1-continued

Ligands

| Ligand No. | Ligand Name |
|---|---|
| 6511 | 2,2,2-TRIFLUORO-1-{5-[(3-PHENYL-5,6-DIHYDROIMIDAZO[1,2-A]PYRAZIN-7(8H)-YL)CARBONYL]THIOPHEN-2-YL}ETHANE-1,1-DIOL |
| 6512 | 2,2,5,5-TETRAMETHYL-3-(SULFANYLMETHYL)-2,5-DIHYDRO-1H-PYRROL-1-OL |
| 6513 | 2,2':6',2"-Terpyridine Platinum(Ii) |
| 6514 | 2,2'-{[9-(HYDROXYIMINO)-9H-FLUORENE-2,7-DIYL]BIS(OXY)}DIACETIC ACID |
| 6515 | 2,3 -Anhydro-Quinic Acid |
| 6516 | 2,3,17BETA-TRIHYDROXY-1,3,5(10)-ESTRATRIENE |
| 6517 | 2,3,4,5,6-Pentafluorobenzyl Alcohol |
| 6518 | 2,3,5,6-Tetrafluoro-4-Methoxy-Benzamide |
| 6519 | 2,3,6A,7,8,9-HEXAHYDRO-11H-[1,4]DIOXINO[2,3-G]PYRROLO[2,1-B][1,3]BENZOXAZIN-11-ONE |
| 6520 | 2,3,7,8-tetrahydroxychromeno[5,4,3-cde]chromene-5,10-dione |
| 6521 | 2,3,-Dihydroxybenzoylserine |
| 6522 | 2,3-Bis-Benzo[1,3]Dioxol-5-Ylmethyl-Succinic Acid |
| 6523 | 2',3'-Dehydro-2',3'-Deoxy-Thymidine 5'-Diphosphate |
| 6524 | 2',3'-Dehydro-2',3'-Deoxy-Thymidine 5'-Triphosphate |
| 6525 | 2,3-Dicarboxy-4-(2-Chloro-Phenyl)-1-Ethyl-5-Isopropoxycarbonyl-6-Methyl-Pyridinium |
| 6526 | 2,3-Didehydroalanine |
| 6527 | 2',3'-Dideoxyadenosine-5'-Triphosphate |
| 6528 | 2',3'-Dideoxycytidine-5'-Monophosphate |
| 6529 | 2',3'-Dideoxythymidine-5'-Monophosphate |
| 6530 | 2,3-Difluorobenzyl Alcohol |
| 6531 | 2,3-Dihydroxy-5-Oxo-Hexanedioate |
| 6532 | 2,3-Dihydroxy-Benzoic Acid |
| 6533 | 2,3-DIMETHOXY-12H-[1,3]DIOXOLO[5,6]INDENO[1,2-C]ISOQUINOLIN-6-IUM |
| 6534 | 2,3-DIMETHYL-1,4-NAPHTHOQUINONE |
| 6535 | 2,3-Di-O-Sulfo-Alpha-D-Glucopyranose |
| 6536 | 2,3-diphenyl-1H-indole-7-carboxylic acid |
| 6537 | 2,3-DIPHENYL-N-(2-PIPERAZIN-1-YLETHYL)FURO[2,3-B]PYRIDIN-4-AMINE |
| 6538 | 2,4,6-Triaminoquinazoline |
| 6539 | 2,4,6-Trinitrophenol |
| 6540 | 2,4-Deoxy-4-Guanidino-5-N-Acetyl-Neuraminic Acid |
| 6541 | 2,4-DIAMINO-1,5-DIPHENYL-3-HYDROXYPENTANE |
| 6542 | 2,4-Diamino-5-(3,4,5-Trimethoxy-Benzyl)-Pyrimidin-1-Ium |
| 6543 | 2,4-Diamino-5-Methyl-6-[(3,4,5-Trimethoxy-N-Methylanilino)Methyl]Pyrido[2,3-D]Pyrimidine |
| 6544 | 2,4-Diamino-6-[N-(2',5'-Dimethoxybenzyl)-N-Methylamino]Quinazoline |
| 6545 | 2,4-Diamino-6-[N-(3',4',5'-Trimethoxybenzyl)-N-Methylamino]Pyrido[2,3-D]Pyrimidine |
| 6546 | 2,4-Diamino-6-[N-(3',5'-Dimethoxybenzyl)-N-Methylamino]Pyrido[2,3-D]Pyrimidine |
| 6547 | 2,4-Diamino-6-Phenyl-5,6,7,8,-Tetrahydropteridine |
| 6548 | 2,4-Diaminobutyric Acid |
| 6549 | 2,4-Difluorobenzyl Alcohol 2,4-Difluoro-1-(Hydroxymethyl)Benzene |
| 6550 | 2,4-Dihydroxy-3,3-Dimethyl-Butyrate |
| 6551 | 2,4-Dihydroxy-7-(Methyloxy)-2h-1,4-Benzoxazin-3(4h)-One |
| 6552 | 2,4-Dihydroxybenzoic Acid |
| 6553 | 2,4-Dihydroxy-Trans Cinnamic Acid |
| 6554 | 2,4-Dinitro,5-[Bis(2-Bromoethyl)Amino]-N-(2',3'-Dioxopropyl)Benzamide |
| 6555 | 2,4-Dinitrophenol |
| 6556 | 2,4-Dinitrophenyl 2-Deoxy-2-Fluoro-Beta-D-Allopyranoside |
| 6557 | 2,4-DINITROPHENYL 2-DEOXY-2-FLUORO-BETA-D-MANNOPYRANOSIDE |
| 6558 | 2',4'-Dinitrophenyl-2deoxy-2-Fluro-B-D-Cellobioside |
| 6559 | 2,5,7-Trihydroxynaphthoquinone |
| 6560 | 2,5-Anhydroglucitol-1,6-Biphosphate |
| 6561 | 2,5-bis-o-{3-[amino(imino)methyl]phenyl}-1,4:3,6-dianhydro-d-glucitol |
| 6562 | 2,5-DI-(TERT-BUTYL)-1,4,BENZOHYDROQUINONE |
| 6563 | 2,5- Diaziridin-1-Yl-3-(Hydroxymethyl)-6-Methylcyclohexa-2,5-Diene-1,4-Dione |
| 6564 | 2,5-DICHLORO-N-(5-CHLORO-1,3-BENZOXAZOL-2-YL)BENZENESULFONAMIDE |
| 6565 | 2,5-DICHLORO-N-[5-METHOXY-7-(6-METHOXYPYRIDIN-3-YL)-1,3-BENZOXAZOL-2-YL]BENZENESULFONAMIDE |
| 6566 | 2,5-Dideoxy-2,5-Imino-D-Glucitol |
| 6567 | 2',5'-DIDEOXY-ADENOSINE 3'-MONOPHOSPHATE |
| 6568 | 2,5-DIPHENYLFURAN-3,4-DICARBOXYLIC ACID |
| 6569 | 2,5-O,O-BIS-{4',4"-AMIDINOPHENYL}-1,4:3,6-DIANHYDRO-D-SORBITOL |
| 6570 | 2,5-Xylidine |
| 6571 | 2,6,8-Trimethyl-3-Amino-9-Benzyl-9-Methoxynonanoic Acid |
| 6572 | 2,6-Anhydro-3-Deoxy-D-Erythro-Hex-2-Enonic Acid |
| 6573 | 2,6-Diamino-(S)-9-[2-(Phosphonomethoxy)Propyl]Purine |
| 6574 | 2,6-diamino-1,7-dihydro-8H-imidazo[4,5-g]quinazolin-8-one |
| 6575 | 2,6-Diamino-8-(1h-Imidazol-2-Ylsulfanylmethyl)-3h-Quinazoline-4-One |
| 6576 | 2,6-Diamino-8-(2-Dimethylaminoethylsulfanylmethyl)-3h-Quinazolin-4-One |
| 6577 | 2,6-Diamino-8-Propylsulfanylmethyl-3h-Quinazoline-4-One |
| 6578 | 2,6-Diamino-Hexanoic Acid Amide |
| 6579 | 2,6-Diaminopimelic Acid |
| 6580 | 2,6-Diaminoquinazolin-4(3h)-One |
| 6581 | 2,6-dicarboxynaphthalene |
| 6582 | 2',6'-Dichloro-Biphenyl-2,6-Diol |
| 6583 | 2,6-Difluorobenzenesulfonamide |
| 6584 | 2,6-Dihydroanthra/1,9-Cd/Pyrazol-6-One |
| 6585 | 2,6-DIMETHYL-1-(3-[3-METHYL-5-ISOXAZOLYL]-PROPANYL)-4-[2-METHYL-4-ISOXAZOLYL]-PHENOL |
| 6586 | 2,6-DIMETHYL-1-(3-[3-METHYL-5-ISOXAZOLYL]-PROPANYL)-4-[2N-METHYL-2H-TETRAZOL-5-YL]-PHENOL |
| 6587 | 2,6-DIMETHYL-1-(3-[3-METHYL-5-ISOXAZOLYL]-PROPANYL)-4-[4-METHYL-2H-TETRAZOL-2-YL]-PHENOL |
| 6588 | 2-[({2-[(1Z)-3-(DIMETHYLAMINO)PROP-1-ENYL]-4-FLUOROPHENYL}SULFONYL)AMINO]-5,6,7,8-TETRAHYDRONAPHTHALENE-1-CARBOXYLIC ACID |
| 6589 | 2-[(1R)-1-CARBOXY-2-(4-HYDROXYPHENYL)ETHYL]-1,3-DIOXOISOINDOLINE-5-CARBOXYLIC ACID |
| 6590 | 2-[(1R)-1-carboxy-2-naphthalen-1-ylethyl]-1,3-dioxo-2,3-dihydro-1H-isoindole-5-carboxylic acid |
| 6591 | 2-[(1R)-2-carboxy-1-(naphthalen-1-ylmethyl)ethyl]-1,3-dioxo-2,3-dihydro-1H-isoindole-5-carboxylic acid |
| 6592 | 2-[(1S)-1-BENZYL-2-SULFANYLETHYL]-1H-IMIDAZO[4,5-C]PYRIDIN-5-IUM |
| 6593 | 2-[(2',3',4'-TRIFLUOROBIPHENYL-2-YL)OXY]ETHANOL |
| 6594 | 2-[(2,4-DICHLORO-5-METHYLPHENYL)SULFONYL]-1,3-DINITRO-5-(TRIFLUOROMETHYL)BENZENE |
| 6595 | 2-[(2,4-DICHLOROBENZOYL)AMINO]-5-(PYRIMIDIN-2-YLOXY)BENZOIC ACID |
| 6596 | 2-[(2-chloro-4-iodophenyl)amino]-N-{[(2R)-2,3-dihydroxypropyl]oxy}-3,4-difluorobenzamide |
| 6597 | 2-[(2e,6e,10e,14e,18e,22e,26e)-3,7,11,15,19,23,27,31-Octamethyldotriaconta-2,6,10,14,18,22,26,30-Octaenyl]Phenol |
| 6598 | 2-[(2-methoxy-5-methylphenoxy)methyl]pyridine |
| 6599 | 2-[(2-methoxyethyl)amino]-4-(4-oxo-1,2,3,4-tetrahydro-9H-carbazol-9-yl)benzamide |
| 6600 | 2-[(2-NAPHTHYLSULFONYL)AMINO]ETHYL DIHYDROGEN PHOSPHATE |
| 6601 | 2-[(3-Hydroxy-2-Methyl-5-Phosphonooxymethyl-Pyridin-4-Ylmethyl)-Imino]-5-Phosphono-Pent-3-Enoic Acid |
| 6602 | 2-[(4-ETHYNYL-2-FLUOROPHENYL)AMINO]-3,4-DIFLUORO-N-(2-HYDROXYETHOXY)BENZAMIDE |
| 6603 | 2-[(4-fluorophenyl)sulfonylamino]-N-oxo-ethanamide |
| 6604 | 2-[(5,6-DIPHENYLFURO[2,3-D]PYRIMIDIN-4-YL)AMINO]ETHANOL |
| 6605 | 2-[(5-hex-1-yn-1-ylfuran-2-yl)carbonyl]-N-methylhydrazinecarbothioamide |
| 6606 | 2-[(7-HYDROXY-NAPHTHALEN-1-YL)-OXALYL-AMINO]-BENZOIC ACID |
| 6607 | 2-[(CYCLOPROPYLCARBONYL)AMINO]-4,5,6,7-TETRAHYDRO-1-BENZOTHIOPHENE-3-CARBOXAMIDE |
| 6608 | 2-[(Dioxidophosphino)Oxy]Benzoate |

TABLE 1-continued

Ligands

| Ligand No. | Ligand Name |
|---|---|
| 6609 | 2-[(Formyl-Hydroxy-Amino)-Methyl]-Heptanoic Acid [1-(2-Hydroxymethyl-Pyrrolidine-1-Carbonyl)-2-Methyl-Propyl]-Amide |
| 6610 | 2-[(PHENYLSULFONYL)AMINO]-5,6,7,8-TETRAHYDRONAPHTHALENE-1-CARBOXYLIC ACID |
| 6611 | 2-[1-(4-CHLOROBENZOYL)-5-METHOXY-2-METHYL-1H-INDOL-3-YL]-N-[(1R)-1-(HYDROXYMETHYL)PROPYL]ACETAMIDE |
| 6612 | 2-[1-(4-CHLOROBENZOYL)-5-METHOXY-2-METHYL-1H-INDOL-3-YL]-N-[(1S)-1-(HYDROXYMETHYL)PROPYL]ACETAMIDE |
| 6613 | 2-[1-(4-CHLORO-PHENYL)-ETHYL]-4,6-DINITRO-PHENOL |
| 6614 | 2-[1-METHYLHEXYL]-4,6-DINITROPHENOL |
| 6615 | 2-[2-(1,3-Dioxo-1,3-Dihydro-2h-Isoindol-2-Yl)Ethyl]-4-(4'-Ethoxy-1,1'-Biphenyl-4-Yl)-4-Oxobutanoic Acid |
| 6616 | 2-[2-(1H-tetrazol-5-yl)ethyl]-1H-isoindole-1,3(2H)-dione |
| 6617 | 2-[2-(2-Cyclohexyl-2-Guanidino-Acetylamino)-Acetylamino]-N-(3-Mercapto-Propyl)-Propionamide |
| 6618 | 2-[2-(2-FLUOROPHENYL)PYRIDIN-4-YL]-1,5,6,7-TETRAHYDRO-4H-PYRROLO[3,2-C]PYRIDIN-4-ONE |
| 6619 | 2-[2-(2-Hydroxy-Ethoxy)-Ethoxy]-Ethanol |
| 6620 | 2-[2-(4-CHLORO-PHENYLSULFANYL)-ACETYLAMINO]-3-(4-GUANIDINO-PHENYL)-PROPIONAMIDE |
| 6621 | 2-[2-ETHANESULFONYLAMINO-3-(1H-INDOL-3-YL)-PROPIONYLAMINO]-PENTANEDIOIC ACID 5-AMIDE 1-(4-CARBAMIM IDOYL-BENZYLAMIDE) |
| 6622 | 2-[2-ETHANESULFONYLAMINO-3-(5-PROPOXY-1H-INDOL-3-YL)-PROPIONYLAMINO]-PENTANEDIOIC ACID 5-AMIDE 1-(4-CARBAMIMIDOYL-BENZYLAMIDE) |
| 6623 | 2-[3-({Methyl[1-(2-Naphthoyl)Piperidin-4-Yl]Amino}Carbonyl)-2-Naphthyl]-1-(1-Naphthyl)-2-Oxoethylphosphonic Acid |
| 6624 | 2-[3-(2-Hydroxy-1,1-Dihydroxymethyl-Ethylamino)-Propylamino]-2-Hydroxymethyl-Propane-1,3-Diol |
| 6625 | 2-[3-(5-MERCAPTO-[1,3,4]THIADIAZOL-2YL)-UREIDO]-N-METHYL-3-PENTAFLUOROPHENYL-PROPIONAMIDE |
| 6626 | 2-[3-(5-MERCAPTO-[1,3,4]THIADIAZOL-2-YL)-UREIDO]-N-METHYL-3-PHENYL-PROPIONAMIDE |
| 6627 | 2-[3,4-Dihydroxy-2-Hydroxymethyl-5-(2-Hydroxy-Nonyl)-Tetrahydro-Furan-2-Yloxy]-6-Hydroxymethyl-Tetra Hydro-Pyran-3,4,5-Triol |
| 6628 | 2-[4-({[(3,5-DICHLOROPHENYL)AMINO]CARBONYL}AMINO)PHENOXY]-2-METHYLPROPANOIC ACID |
| 6629 | 2-[4-(2,4-Dichlorophenoxy)Phenoxy]Propanoic Acid |
| 6630 | 2-[4-(2H-1,4-BENZOTHIAZINE-3-YL)-PIPERAZINE-1-LY]-1,3-THIAZOLE-4-CARBOXYLIC ACID ETHYLESTER |
| 6631 | 2-[4-(3-METHYL-1H-PYRAZOL-4-YL)PHENYL]ETHANAMINE |
| 6632 | 2-[4-(4-Chlorophenyl)Cyclohexylidene]-3,4-Dihydroxy-1(2h)-Naphthalenone |
| 6633 | 2-[4-(4-Hydroxy-3-Isopropyl-Phenoxy)-3,5-Dimethyl-Phenyl]-2h-[1,2,4]Triazine-3,5-Dione |
| 6634 | 2-[4-(DIMETHYLAMINO)PHENYL]-6-HYDROXY-3-METHYL-1,3-BENZOTHIAZOL-3-IUM |
| 6635 | 2-[4-(Hydroxy-Methoxy-Methyl)-Benzyl]-7-(4-Hydroxymethyl-Benzyl)-1,1-Dioxo-3,6-Bis-Phenoxymethyl-1lambda6-[1,2,7]Thiadiazepane-4,5-Diol |
| 6636 | 2-[4-[[(S)-1-[[(S)-2-[[(Rs)-3,3,3-Trifluoro-1-Isopropyl-2-Oxopropyl]Aminocarbonyl]Pyrrolidin-1-Yl-]Carbonyl]-2-Methylpropyl]Aminocarbonyl]Benzoylamino]Acetic Acid |
| 6637 | 2[4-BROMO-2-FLUOROPHENYL)METHYL]-6-FLUOROSPIRO[ISOQUINOLINE-4-(1H),3'-PYRROLIDINE]-1,2',3,5'(2H)-TETRONE |
| 6638 | 2-[4-chloro-2-(phenylcarbonyl)phenoxy]-N-phenylacetamide |
| 6639 | 2-[5,6-BIS-(4-METHOXY-PHENYL)-FURO[2,3-D]PYRIMIDIN-4-YLAMINO]-ETHANOL |
| 6640 | 2-[5-Hydroxy-3-Methyl-1-(2-Methyl-4-Sulfo-Phenyl)-1h-Pyrazol-4-Ylazo]-4-Sulfo-Benzoic Acid |
| 6641 | 2-[5-Methanesulfonylamino-2-(4-Aminophenyl)-6-Oxo-1,6-Dihydro-1-Pyrimidinyl]-N-(3,3,3-Trifluoro-1-Isopropyl-2-Oxopropyl)Acetamide |
| 6642 | 2-[CARBOXY-(2-THIOPHEN-2-YL-ACETYLAMINO)-METHYL]-5-METHYLENE-5,6-DIHYDRO-2H-[1,3]THIAZINE-4-CARBOXYLIC ACID |
| 6643 | 2-[METHYL-(5-GERANYL-4-METHYL-PENT-3-ENYL)-AMINO]-ETHYL-DIPHOSPHATE |
| 6644 | 2-[N'-(4-AMINO-BUTYL)-HYDRAZINOCARBONYL]-PYRROLIDINE-1-CARBOXYLIC ACID BENZYL ESTER |
| 6645 | 2-[Trans-(4-Aminocyclohexyl)Amino]-6-(Benzyl-Amino)-9-Cyclopentylpurine |
| 6646 | 2-{(9as)-9a-[(1s)-1-Hydroxyethyl]-2,7-Dimethyl-9a,10-Dihydro-5h-Pyrimido[4,5-D][1,3]Thiazolo[3,2-a]Pyrimidin-8-Yl}Ethyl Trihydrogen Diphosphate |
| 6647 | 2-{[(1R,2S)-2-aminocyclohexyl]amino}-4-[(3-methylphenyl)amino]pyrimidine-5-carboxamide |
| 6648 | 2-{[(4-CHLOROPHENOXY)ACETYL]AMINO}BENZOIC ACID |
| 6649 | 2-{[(6-OXO-1,6-DIHYDROPYRIDIN-3-YL)METHYL]AMINO}-N-[4-PROPYL-3-(TRIFLUOROMETHYL)PHENYL]BENZAMIDE |
| 6650 | 2-{[4-(1-methyl-4-pyridin-4-yl-1H-pyrazol-3-yl)phenoxy]methyl}quinoline |
| 6651 | 2-{[4-(4-pyridin-4-yl-1H-pyrazol-3-yl)phenoxy]methyl}quinoline |
| 6652 | 2-{[4-(TRIFLUOROMETHOXY)BENZOYL]AMINO}ETHYL DIHYDROGEN PHOSPHATE |
| 6653 | 2-{[Formyl(Hydroxy)Amino]Methyl}-4-Methylpentanoic Acid |
| 6654 | 2-{[N-(2-ACETYL-5-CHLORO-4-FLUOROPHENYL)GLYCYL]AMINO}BENZOIC ACID |
| 6655 | 2-{1-[2-(2-Amino-Thiazol-4-Yl)-2-Methoxyimino-Acetylamino]-2-Oxo-Ethyl}-5,5-Dimethyl-Thiazolidine-4-Carboxylic Acid |
| 6656 | 2-{1-[2-Amino-2-(4-Hydroxy-Phenyl)-Acetylamino]-2-Oxo-Ethyl}-5,5-Dimethyl-Thiazolidine-4-Carboxylic Acid |
| 6657 | 2-{2-[(3,5-dimethylphenyl)amino]pyrimidin-4-yl}-N-[(1S)-2-hydroxy-1-methylethyl]-4-methyl-1,3-thiazole-5-carboxamide |
| 6658 | 2-{3-[(2S)-4,4-difluoro-2-(pyrrolidin-1-ylcarbonyl)pyrrolidin-1-yl]-3-oxopropyl}-isoindole-1,3(2H)-dione |
| 6659 | 2-{3-[4-(4-Fluorophenyl)-3,6-Dihydro-1(2h)-Pyridinyl]Propyl}-8-Methyl-4(3h)-Quinazolinone |
| 6660 | 2-{4-[(2s)-2-[({[(1s)-1-Carboxy-2-Phenylethyl]Amino}Carbonyl)Amino]-3-Oxo-3-(Pentylamino)Propyl]Phenoxy}Malonic Acid |
| 6661 | 2-{4-[(3,5-DIMETHYLANILINO)-CARBONYL-METHYL]-PHENOXY}-2-METHYLPROPIONIC ACID |
| 6662 | 2-{4-[(4-imidazo[1,2-a]pyridin-3-ylpyrimidin-2-yl)amino]piperidin-1-yl}-N-methylacetamide |
| 6663 | 2-{4-[2-(2-AMINO-4-OXO-4,7-DIHYDRO-3H-PYRROLO[2,3-D]PYRIMIDIN-5-YL)-ETHYL]-BENZOYLAMINO}-3-METHYL-BUTYRIC ACID |
| 6664 | 2-{4-[4-({4-[2-methyl-1-(1-methylethyl)-1H-imidazol-5-yl]pyrimidin-2-yl}amino)phenyl]piperazin-1-yl}-2-oxoethanol |
| 6665 | 2-{4-[4-(4-Chloro-Phenoxy)-Benzenesulfonyl]-Tetrahydro-Pyran-4-Yl}-N-Hydroxy-Acetamide |
| 6666 | 2-{4-[5-(4-chlorophenyl)-4-pyrimidin-4-yl-1H-pyrazol-3-yl]piperidin-1-yl}-2-oxoethanol |
| 6667 | 2-{5-[3-(6-BENZOYL-1-PROPYLNAPHTHALEN-2-YLOXY)PROPOXY]INDOL-1-YL}ETHANOIC ACID |
| 6668 | 2-{5-[3-(7-PROPYL-3-TRIFLUOROMETHYLBENZO[D]ISOXAZOL-6-YLOXY)PROPOXY]INDOL-1-YL}ETHANOIC ACID |
| 6669 | 2-{HYDROXY[2-NITRO-4-(TRIFLUOROMETHYL)PHENYL]METHYLENE}CYCLOHEXANE-1,3-DIONE |
| 6670 | 2-{N'-[2-(5-Amino-1-Phenylcarbamoyl-Pentylcarbamoyl)-Hexyl]-Hydrazinomethyl}-Hexanoic Acid(5-Amino-1-Phenylcarbamoyl-Pentyl)-Amide |
| 6671 | 2'-5'dideoxyuridine |
| 6672 | 25-Hydroxycholecalciferol |
| 6673 | 2-ACETAMIDO-2-DEOXY-BETA-D-GLUCOPYRANOSE(BETA1-4)-2-ACETAMIDO-1,6-ANHYDRO-3-O-[(R)-1-CARBOXYETHYL]-2-DEOXY-BETA-D-GLUCOPYRANOSE-L-ALANYL-GAMMA-D-GLUTAMYL-MESO-DIAMINOPIMELYL-D-ALANINE |

TABLE 1-continued

Ligands

| Ligand No. | Ligand Name |
|---|---|
| 6674 | 2-Acetamido-2-Deoxy-D-Glucono-1,5-Lactone |
| 6675 | 2-Acetyl-3-[(4-Amino-2-Methyl-5-Pyrimidinyl)Methyl]-4-Methyl-5-(4,6,6-Trihydroxy-3,5-Dioxa-4,6-Diphosphahex-1-Yl)Thiazolium Inner Salt P,P'-Dioxide |
| 6676 | 2-ACETYLAMINO-4-METHYL-PENTANOIC ACID (1-FORMYL-2-PHENYL-ETHYL)-AMIDE |
| 6677 | 2-ACETYLAMINO-4-METHYL-PENTANOIC ACID [1-(1-FORMYL-PENTYLCARBAMOYL)-3-METHYL-BUTYL]-AMIDE |
| 6678 | 2-Acetyl-Protoporphyrin Ix |
| 6679 | 2-Allyl-6-Methyl-Phenol |
| 6680 | 2-Allylphenol |
| 6681 | 2-AMINO-1-METHYL-6-PHENYLIMIDAZO[4,5-B]PYRIDINE |
| 6682 | 2-AMINO-3-(1-HYDROPEROXY-1H-INDOL-3-YL)PROPAN-1-OL |
| 6683 | 2-Amino-3-(3-Hydroxy-7,8-Dihydro-6h-Cyclohepta[D]-4-Isoxazolyl)Propionic Acid |
| 6684 | 2-Amino-3-(5-Tert-Butyl-3-(Phosphonomethoxy)-4-Isoxazolyl)Propionic Acid |
| 6685 | 2-Amino-3-(Diethoxy-Phosphoryloxy)-Propionic Acid |
| 6686 | 2-Amino-3-[4-Hydroxy-6-Oxo-3-(2-Phenyl-Cyclopropylimino)-Cyclohexa-1,4-Dienyl]-Propionic Acid |
| 6687 | 2-Amino-3-Hydroxy-3-Phosphonooxy-Propionic Acid |
| 6688 | 2-Amino-3-Ketobutyric Acid |
| 6689 | 2-Amino-3-Methyl-1-Pyrrolidin-1-Yl-Butan-1-One |
| 6690 | 2-Amino-3-Oxo-4-Sulfo-Butyric Acid |
| 6691 | 2-AMINO-4-(2,4-DICHLOROPHENYL)-N-ETHYLTHIENO[2,3-D]PYRIMIDINE-6-CARBOXAMIDE |
| 6692 | 2-Amino-4-(4-Amino-Cyclohexa-2,5-Dienyl)-Butyric Acid |
| 6693 | 2-Amino-4-(Hydroxymethyl-Phosphinyl)Butanoic Acid |
| 6694 | 2-amino-4-[2,4-dichloro-5-(2-pyrrolidin-1-ylethoxy)phenyl]-N-ethylthieno[2,3-d]pyrimidine-6-carboxamide |
| 6695 | 2-AMINO-4-CHLORO-3-HYDROXYBENZOIC ACID |
| 6696 | 2-AMINO-4-FLUORO-5-[(1-METHYL-1H-IMIDAZOL-2-YL)SULFANYL]-N-(1,3-THIAZOL-2-YL)BENZAMIDE |
| 6697 | 2-AMINO-4-HYDROXYPYRIMIDINE-5-CARBOXYLIC ACID ETHYL ESTER |
| 6698 | 2-Amino-4-Mercapto-Butyric Acid |
| 6699 | 2-amino-5-[3-(1-ethyl-1H-pyrazol-5-yl)-1H-pyrrolo[2,3-b]pyridin-5-yl]-N,N-dimethylbenzamide |
| 6700 | 2-Amino-5-Bromo-6-Phenylpyrimidin-4-Ol |
| 6701 | 2-Amino-5-Hydroxy-Benzimidazole |
| 6702 | 2-AMINO-6-(3,5-DIMETHYLPHENYL)SULFONYLBENZONITRILE |
| 6703 | 2-amino-6-[2-(1H-indol-6-yl)ethyl]pyrimidin-4(3H)-one |
| 6704 | 2-Amino-6-Aminomethyl-8-Phenylsulfanylmethyl-3h-Quinazolin-4-One |
| 6705 | 2-Amino-6-Chloropyrazine |
| 6706 | 2-Amino-6-Oxo-Hexanoic Acid |
| 6707 | 2-Amino-7-[2-(2-Hydroxy-1-Hydroxymethyl-Ethylamino)-Ethyl]-1,7-Dihydro-Purin-6-One |
| 6708 | 2-amino-7-fluoro-5-oxo-5H-chromeno[2,3-b]pyridine-3-carboxamide |
| 6709 | 2-Amino-8-Methylquinazolin-4(3h)-One |
| 6710 | 2-Aminobenzoic Acid |
| 6711 | 2-Aminoethanesulfonic Acid |
| 6712 | 2-Aminoethanimidic Acid |
| 6713 | 2-aminoethyl naphthalen-1-ylacetate |
| 6714 | 2-amino-N-(4-methyl-1,3-thiazol-2-yl)-5-[(4-methyl-4H-1,2,4-triazol-3-yl)sulfanyl]benzamide |
| 6715 | 2-Amino-N,3,3-Trimethylbutanamide |
| 6716 | 2-AMINO-N,N-BIS(PHENYLMETHYL)-1,3-OXAZOLE-5-CARBOXAMIDE |
| 6717 | 2-Amino-P-Cresol |
| 6718 | 2-Amino-Pentanoic Acid |
| 6719 | 2-Aminophenol |
| 6720 | 2-Aminopimelic Acid |
| 6721 | 2-Aminopropanedioic Acid |
| 6722 | 2-Aminoquinazolin-4(3h)-One |
| 6723 | 2-Aminothiazoline |
| 6724 | 2-Amino-Vinyl-Phosphate |
| 6725 | 2-Ammoniobut-3-Enoate, 2-Amino-3-Butenoate |
| 6726 | 2-Anhydro-3-Fluoro-Quinic Acid |
| 6727 | 2-ANILINO-6-CYCLOHEXYLMETHOXYPURINE |
| 6728 | 2-Benzo[1,3]Dioxol-5-Ylmethyl-3-Benzyl-Succinic Acid |
| 6729 | 2-Benzyl-3-Iodopropanoic Acid |
| 6730 | 2-Bromo-2-Propene-1-Ol |
| 6731 | 2-Bromoacetyl Group |
| 6732 | 2-bromophenol |
| 6733 | 2-Butanol |
| 6734 | 2-butoxy-9-(2,6-difluorobenzyl)-N-(2-morpholin-4-ylethyl)-9H-purin-6-amine |
| 6735 | 2-Butyl-5,6-Dihydro-1h-Imidazo[4,5-D]Pyridazine-4,7-Dione |
| 6736 | 2-Carboxyethylphosphonic Acid |
| 6737 | 2-Carboxypropyl-Coenzyme A |
| 6738 | 2-CHLORO-4-[(7R,7AS)-7-HYDROXY-1,3-DIOXOTETRAHYDRO-1H-PYRROLO[1,2-C]IMIDAZOL-2(3H)-YL]-3-METHYLBENZONITRILE |
| 6739 | 2-chloro-4-{[(1R,3Z,7S,7aS)-7-hydroxy-1-(trifluoromethyl)tetrahydro-1H-pyrrolo[1,2-c][1,3]oxazol-3-ylidene]amino}-3-methylbenzonitrile |
| 6740 | 2-CHLORO-4-ETHYLAMINO-6-(R(+)-2'-CYANO-4-BUTYLAMINO)-1,3,5-TRIAZINE |
| 6741 | 2-CHLORO-4-ETHYLAMINO-6-(S(−)-2'-CYANO-4-BUTYLAMINO)-1,3,5-TRIAZINE |
| 6742 | 2-CHLORO-4-ISOPROPYLAMINO-6-ETHYLAMINO-1,3,5-TRIAZINE |
| 6743 | 2-CHLORO-5-(3-CHLORO-PHENYL)-6-[(4-CYANO-PHENYL)-(3-METHYL-3H-IMIDAZOL-4-YL)-METHOXYMETHYL]-NICOTINONITRILE |
| 6744 | 2-chloro-5-[(1S)-1-hydroxy-3-oxo-2H-isoindol-1-yl]benzenesulfonamide |
| 6745 | 2-chloro-5-nitro-N-phenylbenzamide |
| 6746 | 2-Chloro-6-Methyl-Aniline |
| 6747 | 2'-Chloro-Biphenyl-2,3-Diol |
| 6748 | 2-Chlorodideoxyadenosine |
| 6749 | 2-CHLORO-N-(3-CYANO-5,6-DIHYDRO-4H-CYCLOPENTA[B]THIOPHEN-2-YL)-5-DIETHYLSULFAMOYL-BENZAMIDE |
| 6750 | 2-CHLORO-N-[(1R,2R)-1-HYDROXY-2,3-DIHYDRO-1H-INDEN-2-YL]-6H-THIENO[2,3-B]PYRROLE-5-CARBOXAMIDE |
| 6751 | 2-CHLORO-N-[(3R)-2-OXO-1,2,3,4-TETRAHYDROQUINOLIN-3-YL]-6H-THIENO[2,3-B]PYRROLE-5-CARBOXAMIDE |
| 6752 | 2-Chlorophenol |
| 6753 | 2c-Methyl-D-Erythritol 2,4-Cyclodiphosphate |
| 6754 | 2-Cyclopropylmethylenepropanal |
| 6755 | 2-Deamino-6-Deoxy-6thiophosphite-5'-Phosphate Guanosine |
| 6756 | 2-Deazo-6-Thiophosphate Guanosine-5'-Monophosphate |
| 6757 | 2-Decenoyl N-Acetyl Cysteamine |
| 6758 | 2-decyl-5,6-dimethoxy-3-methylcyclohexa-2,5-diene-1,4-dione |
| 6759 | 2-Dehydropantoate |
| 6760 | 2-Deoxy-2,3-Dehydro-N-Acetyl-Neuraminic Acid |
| 6761 | 2-Deoxy-2-Amino Glucitol-6-Phosphate |
| 6762 | 2-Deoxy-2-Aminogalactose |
| 6763 | 2-Deoxy-2-Fluoro-Alpha-D-Mannose |
| 6764 | 2-Deoxy-2-Fluoro-Alpha-D-Mannosyl Fluoride |
| 6765 | 2-Deoxy-2-Fluoro-Beta-D-Mannose |
| 6766 | 2-Deoxy-2fluoro-Glucose |
| 6767 | 2-DEOXY-3,4-BIS-O-[3-(4-HYDROXYPHENYL)PROPANOYL]-L-THREO-PENTARIC ACID |
| 6768 | 2'-Deoxyadenosine 5'-Triphosphate |
| 6769 | 2-Deoxy-Beta-D-Galactose |
| 6770 | 2'-Deoxycytidine |
| 6771 | 2'-Deoxycytidine-2'-Deoxyadenosine-3',5'-Monophosphate |
| 6772 | 2'-Deoxycytidine-5'-Monophosphate |
| 6773 | 2'-Deoxycytidine-5'-Triphosphate |
| 6774 | 2-Deoxy-D-Glucitol 6-(E)-Vinylhomophosphonate |
| 6775 | 2-Deoxy-Glucitol-6-Phosphate |
| 6776 | 2-Deoxy-Glucose-6-Phosphate |
| 6777 | 2'-Deoxyguanosine-5'-Diphosphate |
| 6778 | 2'-Deoxyguanosine-5'-Monophosphate |
| 6779 | 2'-Deoxyguanosine-5'-Triphosphate |

TABLE 1-continued

Ligands

| Ligand No. | Ligand Name |
|---|---|
| 6780 | 2'-deoxy-N-(naphthalen-1-ylmethyl)guanosine 5'-(dihydrogen phosphate) |
| 6781 | 2'deoxy-Thymidine-5'-Diphospho-Alpha-D-Glucose |
| 6782 | 2'-Deoxy-Thymidine-Beta-L-Rhamnose |
| 6783 | 2'-Deoxyuridine |
| 6784 | 2'-Deoxyuridine 3'-Monophosphate |
| 6785 | 2'-deoxyuridine 5'-alpha,beta-imido-diphosphate |
| 6786 | 2'-Deoxyuridine 5'-Alpha,Beta-Imido-Triphosphate |
| 6787 | 2'-deoxyuridylic acid |
| 6788 | 2-Dimethylamino-Ethyl-Diphosphate |
| 6789 | 2-Ethoxyethanol |
| 6790 | 2-ETHOXYETHYL (2S,3S)-4-((S)-2-BENZYL-3-OXO-4-((3AR,8R,8AS)-2-OXO-3,3A,8,8A-TETRAHYDRO-2H-INDENO[1,2-D]OXAZOL-8-YL)-2,3-DIHYDRO-1H-PYRROL-2-YL)-3-HYDROXY-1-PHENYLBUTAN-2-YLCARBAMATE |
| 6791 | 2-Fluoro-2'-Deoxyadenosine |
| 6792 | 2-Fluoro-2-Deoxy-Beta-D-Galactopyranose |
| 6793 | 2-Fluoro-2-Deoxy-Beta-D-Galactopyranosyl-Beta-D-Glucopyranose |
| 6794 | 2-fluoro-4-[4-(4-fluorophenyl)-1H-pyrazol-3-yl]pyridine |
| 6795 | 2-fluoro-6-{[2-({2-methoxy-4-[(methylsulfonyl)methyl]phenyl}amino)-7H-pyrrolo[2,3-d]pyrimidin-4-yl]amino}benzamide |
| 6796 | 2-Fluoroadenosine |
| 6797 | 2-Fluoroaniline |
| 6798 | 2-Formyl-Protoporphryn Ix |
| 6799 | 2H-1-BENZOPYRAN-2-ONE |
| 6800 | 2-HEPTYL-4-HYDROXY QUINOLINE N-OXIDE |
| 6801 | 2-Hexyloxy-6-Hydroxymethyl-Tetrahydro-Pyran-3,4,5-Triol |
| 6802 | 2-Hexyloxy-6-Hydroxymethyl-Tetrahydro-Pyran-3,5-Diol |
| 6803 | 2'-HYDROXY-1,1'-BIPHENYL-2-SULFINIC ACID |
| 6804 | 2-HYDROXY-3,5-DIIODOBENZOIC ACID |
| 6805 | 2-Hydroxy-3-Amino-4-Phenyl Butane |
| 6806 | 2-Hydroxy-5-({1-[(2-Naphthyloxy)Methyl]-3-Oxoprop-1-Enyl}Amino)Tyrosine |
| 6807 | 2-Hydroxy-5-({1-[(4-Methylphenoxy)Methyl]-3-Oxoprop-1-Enyl}Amino)-L-Tyrosine |
| 6808 | 2-HYDROXY-5-(2-MERCAPTO-ETHYLSULFAMOYL)-BENZOIC ACID |
| 6809 | 2-Hydroxy-5-[4-(2-Hydroxy-Ethyl)-Piperidin-1-Yl]-5-Phenyl-1h-Pyrimidine-4,6-Dione |
| 6810 | 2-HYDROXY-5-{[(1E)-2-PHENYLETHYLIDENE]AMINO}-L-TYROSINE |
| 6811 | 2-hydroxy-7-methoxy-5-methyl-naphthalene-1-carboxylic acid meso-2,5-dihydroxy-cyclopent-3-enyl ester |
| 6812 | 2-Hydroxyethyl Disulfide |
| 6813 | 2-HYDROXYMETHYL-6-OCTYLSULFANYL-TETRAHYDRO-PYRAN-3,4,5-TRIOL |
| 6814 | 2-Hydroxymethyl-Pyrrolidine-3,4-Diol |
| 6815 | 2-Hydroxy-Tryptophan |
| 6816 | 2-Iminiopropanoate |
| 6817 | 2-IMINO-5-(1-PYRIDIN-2-YL-METH-(E)-YLIDENE)-1,3-THIAZOLIDIN-4-ONE |
| 6818 | 2-Iminobiotin |
| 6819 | 2-Isobutyl-3-Methoxypyrazine |
| 6820 | 2-Keto-3-Deoxygluconate |
| 6821 | 2-Mercaptoethane |
| 6822 | 2-MERCAPTO-N-[1,2,3,10-TETRAMETHOXY-9-OXO-5,6,7,9-TETRAHYDRO-BENZO[A]HEPTALEN-7-YL]ACETAMIDE |
| 6823 | 2-Methoxy-3-Isopropylpyrazine |
| 6824 | 2-Methoxyestradiol |
| 6825 | 2-METHYL-2-(4-[[({4-METHYL-2-[4-(TRIFLUOROMETHYL)PHENYL]-1,3-THIAZOL-5-YL}CARBONYL)AMINO]METHYL}PHENOXY)PROPANOIC ACID |
| 6826 | 2-Methyl-2-Propanol |
| 6827 | 2-Methyl-3-(2-Aminothiazolo)Propanal |
| 6828 | 2-methyl-3,5,7,8-tetrahydro-4H-thiopyrano[4,3-d]pyrimidin-4-one |
| 6829 | 2-Methylbutanoic Acid |
| 6830 | 2-METHYLCARBAMOYL-3-(4-PHOSPHONOOXY-PHENYL)-CYCLOPROPANECARBOXYLIC ACID |
| 6831 | 2-METHYL-FURAN-3-CARBOTHIOIC ACID [4-CHLORO-3-(3-METHYL-BUT-2-ENYLOXY)-PHENYL]-AMIDE |
| 6832 | 2-Methylleucine |
| 6833 | 2-Methylpentane-1,2,4-Triol |
| 6834 | 2-METHYLTHIO-N6-ISOPENTENYL-ADENOSINE-5'-MONOPHOSPHATE |
| 6835 | 2'-Monophosphoadenosine 5'-Diphosphoribose |
| 6836 | 2'-Monophosphoadenosine-5'-Diphosphate |
| 6837 | 2-NAPHTHALENESULFONIC ACID |
| 6838 | 2-NONYL-4-HYDROXYQUINOLINE N-OXIDE |
| 6839 | 2-O-(3'-AMIDINOPHENYL)-5-O-(4''-AMIDINOPHENYL)-1,4:3,6-DIANHYDRO-D-SORBITOL |
| 6840 | 2-O-(4'-AMIDINOPHENYL)-5-O-(3''-AMIDINOPHENYL)-1,4:3,6-DIANHYDRO-D-SORBITOL |
| 6841 | 2'-O-Acetyl Adenosine-5-Diphosphoribose |
| 6842 | 2-O-Methyl Fucose |
| 6843 | 2-Oxalosuccinic Acid |
| 6844 | 2-Oxo-3-Pentenoic Acid |
| 6845 | 2-Oxo-4-Methylpentanoic Acid |
| 6846 | 2-Oxobutanoic Acid |
| 6847 | 2-OXOHEPTYLPHOSPHONIC ACID |
| 6848 | 2-OXOQUINOLINE |
| 6849 | 2-Oxy-4-Hydroxy-5-(2-Hydrazinopyridine)Phenylalanine |
| 6850 | 2-Phenethyl-2,3-Dihydro-Phthalazine-1,4-Dione |
| 6851 | 2-Phenyl-1-[4-(2-Piperidin-1-Yl-Ethoxy)-Phenyl]-1,2,3,4-Tetrahydro-Isoquinolin-6-Ol |
| 6852 | 2-phenyl-1H-im idazole-4-carboxylic acid |
| 6853 | 2-PHENYL-4H-BENZO[H]CHROMEN-4-ONE |
| 6854 | 2-PHENYL-4H-CHROMEN-4-ONE |
| 6855 | 2-PHENYLAMINO-4-METHYL-5-ACETYL THIAZOLE |
| 6856 | 2-Phenylamino-Ethanesulfonic Acid |
| 6857 | 2-Phenyl-Ethanol |
| 6858 | 2-Phenylethylamine |
| 6859 | 2-Phenylheme |
| 6860 | 2-Phospho-D-Glyceric Acid |
| 6861 | 2-Phosphoglyceric Acid |
| 6862 | 2-Phosphoglycolic Acid |
| 6863 | 2-Prolyl-5-Tert-Butyl-[1,3,4]Oxadiazole |
| 6864 | 2-Propyl-Aniline |
| 6865 | 2-Pyridinethiol |
| 6866 | 2s,3s-3-Methylaspartic Acid |
| 6867 | 2s,4r-4-Methylglutamate |
| 6868 | 2-T-BUTYLAMINO-4-ETHYLAMINO-6-METHYLTHIO-S-TRIAZINE |
| 6869 | 2-tert-butylbenzene-1,4-diol |
| 6870 | 2-Thioethenamine |
| 6871 | 2-Thiomethyl-3-Phenylpropanoic Acid |
| 6872 | 2-Tridecanoyloxy-Pentadecanoic Acid |
| 6873 | 3-((3-bromo-5-o-tolylpyrazolo[1,5-a]pyrimidin-7-ylamino)methyl)pyridine 1-oxide |
| 6874 | 3-({[(3S)-3,4-dihydroxybutyl]oxy}amino)-1H,2'H-2,3'-biindol-2'-one |
| 6875 | 3-({[3,5-DIFLUORO-3'-(TRIFLUOROMETHOXY)BIPHENYL-4-YL]AMINO}CARBONYL)THIOPHENE-2-CARBOXYLIC ACID |
| 6876 | 3-({1-[3-CARBAMIMIDOYL-1-(4-CARBAMIMIDOYL-BENZYLCARBAMOYL)-PROPYLCARBAMOYL]-2-METHYL-BUTYLSULFAMOYL}-METHYL)-BENZOIC ACID |
| 6877 | 3-({2-[(2-AMINO-6-METHYLPYRIMIDIN-4-YL)ETHYNYL]BENZYL}AMINO)-1,3-OXAZOL-2(3H)-ONE |
| 6878 | 3-({2-[(4-{[6-(CYCLOHEXYLMETHOXY)-9H-PURIN-2-YL]AMINO}PHENYL)SULFONYL]ETHYL}AMINO)PROPAN-1-OL |
| 6879 | 3-({3-[(1S,4aS,6S,7S,9S,9aR)-1,6-dimethyl-2-oxodecahydro-6,9-epoxy-4a,7-methanobenzo[7]annulen-1-yl]propanoyl}amino)-2,4-dihydroxybenzoic acid |
| 6880 | 3-({(1E)-3-morpholin-4-yl-3-oxoprop-1-en-1-yl]-2,3-bis(trifluoromethyl)phenyl}sulfanyl)aniline |
| 6881 | 3-({4-[(5-CHLORO-1,3-BENZODIOXOL-4-YL)AMINO]PYRIMIDIN-2-YL}AMINO)BENZAMIDE |
| 6882 | 3-({4-[(5-chloro-1,3-benzodioxol-4-yl)amino]pyrimidin-2-yl}amino)benzenesulfonamide |

TABLE 1-continued

Ligands

| Ligand No. | Ligand Name |
|---|---|
| 6883 | 3-({4-[(6-CHLORO-1-BENZOTHIEN-2-YL)SULFONYL]-2-OXOPIPERAZIN-1-YL}METHYL)BENZENECARBOXIMIDAMIDE |
| 6884 | 3-({5-Benzyl-6-Hydroxy-2,4-Bis-(4-Hydroxy-Benzyl)-3-Oxo-[1,2,4]-Triazepane-1-Sulfonyl)-Benzonitrile |
| 6885 | 3-(1,1-dioxido-4H-1,2,4-benzothiadiazin-3-yl)-4-hydroxy-1-(3-methylbutyl)quinolin-2(1H)-one |
| 6886 | 3-(10-METHYL-ANTHRACEN-9-YL)-PROPIONIC ACID |
| 6887 | 3-(1-Aminoethyl)Nonanedioic Acid |
| 6888 | 3-(1H-BENZIMIDAZOL-2-YL)-1H-INDAZOLE |
| 6889 | 3-(1h-Indol-3-Yl)-2-[4-(4-Phenyl-Piperidin-1-Yl)-Benzenesulfonylamino]-Propionic Acid |
| 6890 | 3-(1H-INDOL-3-YL)-4-(1-{2-[(2S)-1-METHYLPYRROLIDINYL]ETHYL}-1H-INDOL-3-YL)-1H-PYRROLE-2,5-DIONE |
| 6891 | 3-(1H-INDOL-3-YL)-4-{1-[2-(1-METHYLPYRROLIDIN-2-YL)ETHYL]-1H-INDOL-3-YL}-1H-PYRROLE-2,5-DIONE |
| 6892 | 3-(1H-tetrazol-5-ylamino)cyclohex- 2-en-1-one |
| 6893 | 3-(1H-tetrazol-5-ylmethyl)-5,6,7,8-tetrahydro[1]benzothieno[2,3-d]pyrimidin-4(3H)-one |
| 6894 | 3-(1-NAPHTHYLMETHOXY)PYRIDIN-2-AMINE |
| 6895 | 3-(2,6-difluorophenyl)-2-(methylthio)quinazolin-4(3H)-one |
| 6896 | 3-(2-AMINO-6-BENZOYLQUINAZOLIN-3(4H)-YL)-N-CYCLOHEXYL-N-METHYLPROPANAMIDE |
| 6897 | 3-(2-Aminoethyl)-4-(Aminomethyl)Heptanedioic Acid |
| 6898 | 3-(2-aminoquinazolin-6-yl)-1-(3,3-dimethylindolin-6-yl)-4-methylpyridin-2(1H)-one |
| 6899 | 3-(2-aminoquinazolin-6-yl)-4-methyl-1-[3-(trifluoromethyl)phenyl]pyridin-2(1H)-one |
| 6900 | 3-(2-AMINOQUINAZOLIN-6-YL)-4-METHYL-N-[3-(TRIFLUOROMETHYL)PHENYL]BENZAMIDE |
| 6901 | 3-(2-Benzothiazolylthio)-1-Propanesulfonic Acid |
| 6902 | 3-(2-CHLOROPHENYL)-1-(2-{[(1S)-2-HYDROXY-1,2-DIMETHYLPROPYL]AMINO}PYRIMIDIN-4-YL)-1-(4-METHOXYPHENYL)UREA |
| 6903 | 3-(3,4-Dimethoxyphenyl)Propionic Acid |
| 6904 | 3-(3,5-Dibromo-4-Hydroxy-Benzoyl)-2-Ethyl-Benzofuran-6-Sulfonic Acid (4-Sulfamoyl-Phenyl)-Amide |
| 6905 | 3-(3,5-Dibromo-4-Hydroxy-Benzoyl)-2-Ethyl-Benzofuran-6-Sulfonic Acid [4-(Thiazol-2-Ylsulfamoyl)-Phenyl]-Amide |
| 6906 | 3-(3,5-Dibromo-4-Hydroxy-Benzoyl)-2-Ethyl-Benzofuran-6-Sulfonic Acid Dimethylamide |
| 6907 | 3-(3-aminophenyl)-N-(3-chlorophenyl)pyrazolo[1,5-a]pyrimidin-5-amine |
| 6908 | 3-(3-FLUORO-4-HYDROXYPHENYL)-7-HYDROXY-1-NAPHTHONITRILE |
| 6909 | 3-(3-methoxybenzyl)-1H-pyrrolo[2,3-b]pyridine |
| 6910 | 3-(3-methylbut-2-en-1-yl)-3H-purin-6-amine |
| 6911 | 3-(4-Amino-1-Tert-Butyl-1h-Pyrazolo[3,4-D]Pyrimidin-3-Yl)Phenol |
| 6912 | 3-(4-Amino-2-Tert-Butyl-5-Methyl-Phenylsulfanyl)-6-Cyclopentyl-4-Hydroxy-6-[2-(4-Hydroxy-Phenyl)-Ethyl]-5,6-Dihydro-Pyran-2-One |
| 6913 | 3-(4-Benzenesulfonyl-Thiophene-2-Sulfonylamino)-Phenylboronic Acid |
| 6914 | 3-(4-Carbamoyl-1-Carboxy-2-Methylsulfonyl-Buta-1,3-Dienylamino)-Indolizine-2-Carboxylic Acid |
| 6915 | 3-(4-CHLOROPHENYL)-5-(METHYLTHIO)-4H-1,2,4-TRIAZOLE |
| 6916 | 3-(4-DIETHYLAMINO-2-HYDROXY-PHENYL)-2-METHYL-PROPIONIC ACID |
| 6917 | 3-(4-Fluorophenyl)-1-Hydroxy-2-(Pyridin-4-Yl)-1h-Pyrrolo[3,2-B]Pyridine |
| 6918 | 3-(4-Fluorophenyl)-2-(6-Methylpyridin-2-Yl)-5,6-Dihydro-4h-Pyrrolo[1,2-B]Pyrazole |
| 6919 | 3-(4-fluorophenyl)-5-phenyl-4H-1,2,4-triazole |
| 6920 | 3-(4-Hydroxy-3-Imino-6-Oxo-Cyclohexa-1,4-Dienyl)-Alanine |
| 6921 | 3-(4-HYDROXY-3-METHOXYPHENYL)-2-PROPENOIC ACID |
| 6922 | 3-(4-HYDROXYPHENYL)-1-(2,4,6-TRIHYDROXYPHENYL)PROPAN-1-ONE |
| 6923 | 3-(4-HYDROXYPHENYL)-4,5-DIHYDRO-5-ISOXAZOLE-ACETIC ACID METHYL ESTER |
| 6924 | 3-(4-HYDROXY-PHENYL)PYRUVIC ACID |
| 6925 | 3-(4-NITRO-PHENOXY)-PROPAN-1-OL |
| 6926 | 3-(4-nitrophenyl)-1H-pyrazole |
| 6927 | 3-(4-Phenylamino-Phenylamino)-2-(1h-Tetrazol-5-Yl)-Acrylonitrile |
| 6928 | 3-(5-{[4-(AMINOMETHYL)PIPERIDIN-1-YL]METHYL}-1H-INDOL-2-YL)-1H-INDAZOLE-6-CARBONITRILE |
| 6929 | 3-(5-{[4-(AMINOMETHYL)PIPERIDIN-1-YL]METHYL}-1H-INDOL-2-YL)QUINOLIN-2(1H)-ONE |
| 6930 | 3-(5-amino-3-imino-3H-pyrazol-4-ylazo)-benzoic acid |
| 6931 | 3-(5-Amino-7-Hydroxy-[1,2,3]Triazolo[4,5-D]Pyrimidin-2-Yl)-Benzoic Acid |
| 6932 | 3-(5-Amino-7-Hydroxy-[1,2,3]Triazolo[4,5-D]Pyrimidin-2-Yl)-N-(3,5-Dichlorobenzyl)-Benzamide |
| 6933 | 3-(5-Amino-7-Hydroxy-[1,2,3]Triazolo[4,5-D]Pyrimidin-2-Yl)-N-[2-(2-(Hydroxymethyl-Phenylsulfanyl)-Benzyl]-Benzamide |
| 6934 | 3-(5-methoxy-1H-indol-3-yl)propanoic acid |
| 6935 | 3-(6-Aminopyridin-3-Yl)-N-Methyl-N-[(1-Methyl-1h-Indol-2-Yl)Methyl]Acrylamide |
| 6936 | 3-(6-CYCLOHEXYLMETHOXY-9H-PURIN-2-YLAMINO)-BENZENESULFONAMIDE |
| 6937 | 3-(6-HYDROXY-NAPHTHALEN-2-YL)-BENZO[D]ISOOXAZOL-6-OL |
| 6938 | 3-(7-DIAMINOMETHYL-NAPHTHALEN-2-YL)-PROPIONIC ACID ETHYL ESTER |
| 6939 | 3-(7-Hydroxy-8-Ribityllumazine-6-Yl) Propionic Acid |
| 6940 | 3-(9-HYDROXY-1,3-DIOXO-4-PHENYL-2,3-DIHYDROPYRROLO[3,4-C]CARBAZOL-6(1H)-YL)PROPANOIC ACID |
| 6941 | 3-(Benzyloxy)Pyridin-2-Amine |
| 6942 | 3''-(Beta-Chloroethyl)-2'',4''-Dioxo-3,5''-Spiro-Oxazolidino-4-Deacetoxy-Vinblastine |
| 6943 | 3-(BUTYLSULPHONYL)-PROPANOIC ACID |
| 6944 | 3-(CARBOXYAMIDE(2-CARBOXYAMIDE-2-TERTBUTYLETHYL))PENTAN |
| 6945 | 3-(CARBOXYMETHOXY)THIENO[2,3-B]PYRIDINE-2-CARBOXYLIC ACID |
| 6946 | 3-(heptyloxy)benzoic acid |
| 6947 | 3-(HYDROXYMETHYL)-1-METHYL-5-(2-METHYLAZIRIDIN-1-YL)-2-PHENYL-1H-INDOLE-4,7-DIONE |
| 6948 | 3-(HYDROXY-PHENYL-PHOSPHINOYLOXY)-8-METHYL-8-AZA-BICYCLO[3.2.1]OCTANE-2-CARBOXYLIC ACID METHYL ESTER |
| 6949 | 3-(INDOL-3-YL) LACTATE |
| 6950 | 3-(Mercaptomethylene)Pyridine |
| 6951 | 3-(Oxalyl-Amino)-Naphthalene-2-Carboxylic Acid |
| 6952 | 3-(Prop-2-Ene-1-Sulfinyl)-Propene-1-Thiol |
| 6953 | 3-(P-Tolyl)Propionic Acid |
| 6954 | 3(R)-METHYLCARBAMOYL-7-SULFOAMINO-3,4-DIHYDRO-1H-ISOQUINOLINE-2-CARBOXYLIC ACID TERT-BUTYL ESTER |
| 6955 | 3(S)-AMINO-4-PHENYL-BUTAN-2(R)-OL |
| 6956 | 3(S)-AMINO-4-PHENYL-BUTAN-2(S)-OL |
| 6957 | 3(S)-METHYLCARBAMOYL-7-SULFOAMINO-3,4-DIHYDRO-1H-ISOQUINOLINE-2-CARBOXYLIC ACID TERT-BUTYL ESTER |
| 6958 | 3,3-Dichloro-2-Phosphonomethyl-Acrylic Acid |
| 6959 | 3,4-bis(7-chloro-1H-indol-3-yl)-1H-pyrrole-2,5-dicarboxylic acid |
| 6960 | 3,4-DI-1H-INDOL-3-YL-1H-PYRROLE-2,5-DICARBOXYLIC ACID |
| 6961 | 3,4-Dichloroisocoumarin |
| 6962 | 3,4-Dihydro-2h-Pyrrolium-5-Carboxylate |
| 6963 | 3,4-DIHYDRO-4-OXO-3-((5-TRIFLUOROMETHYL-2-BENZOTHIAZOLYL)METHYL)-1-PHTHALAZINE ACETIC ACID |
| 6964 | 3,4-Dihydro-5-Methyl-Isoquinolinone |
| 6965 | 3,4-Dihydroxy-1-Methylquinolin-2(1h)-One |
| 6966 | 3,4-dihydroxy-9,10-secoandrosta-1(10),2,4-triene-9,17-dione |
| 6967 | 3,4-Dihydroxycinnamic Acid |
| 6968 | 3,4-Dimethylaniline |
| 6969 | 3,4-Dimethylphenol |

TABLE 1-continued

Ligands

| Ligand No. | Ligand Name |
|---|---|
| 6970 | 3,4-Epoxybutyl-Alpha-D-Glucopyranoside |
| 6971 | 3,4-Methylenedioxymethamphetamine |
| 6972 | 3,5 DIBROMOTYROSINE |
| 6973 | 3,5,3',5'-Tetrachloro-Biphenyl-4,4'-Diol |
| 6974 | 3,5,6,8-Tetramethyl-N-Methyl Phenanthrolinium |
| 6975 | 3,5-Diaminophthalhydrazide |
| 6976 | 3,5-Dichloro-4-[(4-Hydroxy-3-Isopropylphenoxy)Phenylacetic Acid |
| 6977 | 3,5-Difluoroaniline |
| 6978 | 3,5-Difluorobenzenesulfonamide |
| 6979 | 3,5-Diiodotyrosine |
| 6980 | 3,5-Dimethyl-1-(3-Nitrophenyl)-1h-Pyrazole-4-Carboxylic Acid Ethyl Ester |
| 6981 | 3,5-Dimethyl-1h-Pyrazole-4-Carboxylic Acid Ethyl Ester |
| 6982 | 3,5-DIMETHYL-1-PHENYL-1H-PYRAZOLE-4-CARBOXYLIC ACID ETHYL ESTER |
| 6983 | 3,5-Dinitrocatechol |
| 6984 | 3,6,9,12,15,18-HEXAOXAICOSANE |
| 6985 | 3,6,9,12,15-PENTAOXAHEPTADECAN-1-OL |
| 6986 | 3,6,9,12,15-Pentaoxaheptadecane |
| 6987 | 3,6,9,12,15-PENTAOXATRICOSAN-1-OL |
| 6988 | 3,6-Anhydro-D-Galactose-2-Sulfate |
| 6989 | 3,6-DIAMINO-5-CYANO-4-(4-ETHOXYPHENYL)THIENO[2,3-B]PYRIDINE-2-CARBOXAMIDE |
| 6990 | 3,6-Dihydroxy-Xanthene-9-Propionic Acid |
| 6991 | 3,7,3',4'-TETRAHYDROXYFLAVONE |
| 6992 | 3,7-BIS(DIMETHYLAMINO)PHENOTHIAZIN-5-IUM |
| 6993 | 3,7-DIHYDROXYNAPHTHALENE-2-CARBOXYLIC ACID |
| 6994 | 3,8,9,10-Tetrahydroxy-7-Hydroxymethyl-6-Oxa-1,3-Diaza-Spiro[4.5]Decane-2,4-Dione |
| 6995 | 3,8-Diamino-6-Phenyl-5-[6-[1-[2-[(1,2,3,4-Tetrahydro-9-Acridinyl)Amino]Ethyl]-1h-1,2,3-Triazol-4-Yl]Hexyl]-Phenanthridinium |
| 6996 | 3,8-Diamino-6-Phenyl-5-[6-[1-[2-[(1,2,3,4-Tetrahydro-9-Acridinyl)Amino]Ethyl]-1h-1,2,3-Triazol-5-Yl]Hexyl]-Phenanthridinium |
| 6997 | 3,8-DIBROMO-7-HYDROXY-4-METHYL-2H-CHROMEN-2-ONE |
| 6998 | 3,9-Dimethyladenine |
| 6999 | 3-[(1-Amino-2-Carboxy-Ethyl)-Hydroxy-Phosphinoyl]-2-Methyl-Propionic Acid |
| 7000 | 3-[(1E,7E)-8-(2,6-dioxo-1,2,3,6-tetrahydropyrimidin-4-yl)-3,6-dioxa-2,7-diazaocta-1,7-dien-1-yl]benzoic acid |
| 7001 | 3-[(1R)-1-(2,6-dichloro-3-fluorophenyl)ethoxy]-5-(1-piperidin-4-yl-1H-pyrazol-4-yl)pyridin-2-amine |
| 7002 | 3-[(1s)-1-(Dimethylamino)Ethyl]Phenol |
| 7003 | 3-[(2,2-DIMETHYLPROPANOYL)AMINO]-N-1,3-THIAZOL-2-YLPYRIDINE-2-CARBOXAMIDE |
| 7004 | 3-[(2,4-Dichlorobenzoyl)(Isopropyl)Amino]-5-Phenylthiophene-2-Carboxylic Acid |
| 7005 | 3-[(3-(2-CARBOXYETHYL)-4-METHYLPYRROL-2-YL)METHYLENE]-2-INDOLINONE |
| 7006 | 3-[(4-AMINO-1-TERT-BUTYL-1H-PYRAZOLO[3,4-D]PYRIMIDIN-3-YL)METHYL]PHENOL |
| 7007 | 3-[(4-CHLOROANILINO)SULFONYL]THIOPHENE-2-CARBOXYLIC ACID |
| 7008 | 3-[(4'-cyanobiphenyl-4-yl)oxy]-N-hydroxypropanamide |
| 7009 | 3-[(4-fluorophenyl)sulfanyl]-N-(4-methyl-1,3-thiazol-2-yl)-6-[(4-methyl-4H-1,2,4-triazol-3-yl)sulfanyl]pyridine-2-carboxamide |
| 7010 | 3-[(5s)-1-Acetyl-3-(2-Chlorophenyl)-4,5-Dihydro-1h-Pyrazol-5-Yl]Phenol |
| 7011 | 3-[(Acetyl-Methyl-Amino)-Methyl]-4-Amino-N-Methyl-N-(1-Methyl-1h-Indol-2-Ylmethyl)-Benzamide |
| 7012 | 3-[[(METHYLAMINO)SULFONYL]AMINO]-2-OXO-6-PHENYL-N-[3,3,3-TRIFLUORO-1-(1-METHYLETHYL)-2-OXOPHENYL]-1(2H)-PYRIDINE ACETAMIDE |
| 7013 | 3-[[N-[4-Methyl-Piperazinyl]Carbonyl]-Phenylalaninyl-Amino]-5-Phenyl-Pentane-1-Sulfonic Acid Benzyloxy-Amide |
| 7014 | 3-[1-(3-AMINOPROPYL)-1H-INDOL-3-YL]-4-(1H-INDOL-3-YL)-1H-PYRROLE-2,5-DIONE |
| 7015 | 3-[1-(3-Aminopropyl)-1h-Indol-3-Yl]-4-(1-Methyl-1h-Indol-3-Yl)-1h-Pyrrole-2,5-Dione |
| 7016 | 3-[1-(4-BROMO-PHENYL)-2-METHYL-PROPYL]-4-HYDROXY-CHROMEN-2-ONE |
| 7017 | 3-[2-(2-BENZYLOXYCARBONYLAMINO-3-METHYL-BUTYRYLAMINO)-PROPIONYLAMINO]-4-OXO-PENTANOIC ACID |
| 7018 | 3-[2-bromo-4-(1H-pyrazolo[3,4-c]pyridazin-3-ylmethyl)phenoxy]-5-methylbenzonitrile |
| 7019 | 3-[3-(2,3-Dihydroxy-Propylamino)-Phenyl]-4-(5-Fluoro-1-Methyl-1h-Indol-3-Yl)-Pyrrole-2,5-Dione |
| 7020 | 3-[3-(3-methyl-6-{[(1S)-1-phenylethyl]amino}-1H-pyrazolo[4,3-c]pyridin-1-yl)phenyl]propanamide |
| 7021 | 3-[3-(4-methylpiperazin-1-yl)-7-(trifluoromethyl)quinoxalin-5-yl]phenol |
| 7022 | 3-[3-chloro-5-(5-{[(1S)-1-phenylethyl]amino}isoxazolo[5,4-c]pyridin-3-yl)phenyl]propan-1-ol |
| 7023 | 3-[4-(2,4-Dimethyl-Thiazol-5-Yl)-Pyrimidin-2-Ylamino]-Phenol |
| 7024 | 3-[4-(2-METHYL-IMIDAZO[4,5-C]PYRIDIN-1-YL)BENZYL]-3H-BENZOTHIAZOL-2-ONE |
| 7025 | 3-[4-(AMINOSULFONYL)PHENYL]PROPANOIC ACID |
| 7026 | 3-[4-AMINO-1-(1-METHYLETHYL)-1H-PYRAZOLO[3,4-D]PYRIMIDIN-3-YL]PHENOL |
| 7027 | 3-[5-(1H-IMIDAZOL-1-YL)-7-METHYL-1H-BENZIMIDAZOL-2-YL]-4-[(PYRIDIN-2-YLMETHYL)AMINO]PYRIDIN-2(1H)-ONE |
| 7028 | 3-[5-(2-nitropent-1-en-1-yl)furan-2-yl]benzoic acid |
| 7029 | 3-[5-(3-nitrophenyl)thiophen-2-yl]propanoic acid |
| 7030 | 3-[6-bromo-2-fluoro-3-(1H-pyrazolo[3,4-c]pyridazin-3-ylmethyl)phenoxy]-5-chlorobenzonitrile |
| 7031 | 3-[Aminoethylphosphoryl]-[1,2-Di-Palmitoyl]-Sn-Glycerol |
| 7032 | 3-[Isopropyl(4-Methylbenzoyl)Amino]-5-Phenylthiophene-2-Carboxylic Acid |
| 7033 | 3-[N-[Benzyloxycarbonyl]-Phenylalaninyl-Amino]-5-Phenyl-Pentane-1-Sulfonic Acid 4-Nitro-Phenyl Ester |
| 7034 | 3-[N-[Benzyloxycarbonyl]-Phenylalaninyl-Amino]-5-Phenyl-Pentane-1-Sulfonylmethylbenzene |
| 7035 | 3[N-Morpholino]Propane Sulfonic Acid |
| 7036 | 3-{(3R,4R)-4-methyl-3-[methyl(7H-pyrrolo[2,3-d]pyrimidin-4-yl)amino]piperidin-1-yl}-3-oxopropanenitrile |
| 7037 | 3-{[(1r)-1-Benzyl-2-Sulfanylethyl]Amino}-3-Oxopropanoic Acid |
| 7038 | 3-{[(1R)-1-phenylethyl]amino}-4-(pyridin-4-ylamino)cyclobut-3-ene-1,2-dione |
| 7039 | 3-{[(2,2,5,5-TETRAMETHYL-1-OXO-4-PHENYL-2,5-DIHYDRO-1H-PYRROLIUM-3-YL)METHYL]DISULFANYL}-D-ALANINE |
| 7040 | 3-{[(2,2-DIOXIDO-1,3-DIHYDRO-2-BENZOTHIEN-5-YL)AMINO]METHYLENE}-5-(1,3-OXAZOL-5-YL)-1,3-DIHYDRO-2H-INDOL-2-ONE |
| 7041 | 3-{[(3-FLUORO-3'-METHOXYBIPHENYL-4-YL)AMINO]CARBONYL}THIOPHENE-2-CARBOXYLIC ACID |
| 7042 | 3-{[(3-NITROANILINE]SULFONYL}THIOPHENE-2-CARBOXYLIC ACID |
| 7043 | 3-{[(4-CARBOXY-2-HYDROXYANILINE]SULFONYL}THIOPHENE-2-CARBOXYLIC ACID |
| 7044 | 3-{[(4-methylphenyl)sulfonyl]amino}propyl pyridin-4-ylcarbamate |
| 7045 | 3-{[(9-CYANO-9,10-DIHYDRO-10-METHYLACRIDIN-9-YL)CARBONYL]AMINO}PROPANOIC ACID |
| 7046 | 3-{[4-([AMINO(IMINO)METHYL]AMINOSULFONYL)ANILINO]METHYLENE}-2-OXO-2,3-DIHYDRO-1H-INDOLE |
| 7047 | 3-{[4-(but-2-yn-1-yloxy)phenyl]sulfonyl}propane-1-thiol |
| 7048 | 3-{2,6,8-Trioxo-9-[(2r,3r,4r)-2,3,4,5-Tetrahydroxypentyl]-1,2,3,6,8,9-Hexahydro-7h-Purin-7-Yl}Propyl Dihydrogen Phosphate |

TABLE 1-continued

Ligands

| Ligand No. | Ligand Name |
|---|---|
| 7049 | 3-{2,6,8-Trioxo-9-[(2r,3s,4r)-2,3,4,5-Tetrahydroxypentyl]-1,2,3,6,8,9-Hexahydro-7h-Purin-7-Yl}Propyl Dihydrogen Phosphate |
| 7050 | 3-{2,6,8-Trioxo-9-[(2s,3r,4r)-2,3,4,5-Tetrahydroxypentyl]-1,2,3,6,8,9-Hexahydro-7h-Purin-7-Yl}Propyl Dihydrogen Phosphate |
| 7051 | 3-{2,6,8-Trioxo-9-[(2s,3s,4r)-2,3,4,5-Tetrahydroxypentyl]-1,2,3,6,8,9-Hexahydro-7h-Purin-7-Yl}Propyl Dihydrogen Phosphate |
| 7052 | 3-{3-[(DIMETHYLAMINO)METHYL]-1H-INDOL-7-YL}PROPAN-1-OL |
| 7053 | 3-{3-bromo-4-[(2,4-difluorobenzyl)oxy]-6-methyl-2-oxopyridin-1(2H)-yl}-N,4-dimethylbenzamide |
| 7054 | 3-{5-[(6-amino-1H-pyrazolo[3,4-b]pyridin-3-yl)methoxy]-2-chlorophenoxy}-5-chlorobenzonitrile |
| 7055 | 3-{5-[AMINO(IMINO)METHYL]-1H-INDOL-2-YL}-5-METHOXY-1,1'-BIPHENYL-2-OLATE |
| 7056 | 3-{5-methoxy-1-[(4-methoxyphenyl)sulfonyl]-1H-indol-3-yl}propanoic acid |
| 7057 | 3-{6-[(8-HYDROXY-QUINOLINE-2-CARBONYL)-AMINO]-2-THIOPHEN-2-YL-HEXANOYLAMINO}-4-OXO-BUTYRI ACID |
| 7058 | 3-{ISOPROPYL[(TRANS-4-METHYLCYCLOHEXYL)CARBONYL]AMINO}-5-PHENYLTHIOPHENE-2-CARBOXYLIC ACID |
| 7059 | 3'-1-Carboxy-1-Phosphonooxy-Ethoxy-Uridine-Diphosphate-N-Acetylglucosamine |
| 7060 | 3-Acetyl Pyridine Adenine Dinucleotide |
| 7061 | 3-AMINO-3-BENZYL-[4.3.0]BICYCLO-1,6-DIAZANONAN-2-ONE |
| 7062 | 3-AMINO-3-BENZYL-9-CARBOXAMIDE[4.3.0]BICYCLO-1,6-DIAZANONAN-2-ONE |
| 7063 | 3-Amino-3-Oxopropanoic Acid |
| 7064 | 3-Amino-4,5-Dihydroxy-Cyclohex-1-Enecarboxylate |
| 7065 | 3-Amino-4-{3-[2-(2-Propoxy-Ethoxy)-Ethoxy]-Propylamino}-Cyclobut-3-Ene-1,2-Dione |
| 7066 | 3-Amino-4-Oxybenzyl-2-Butanone |
| 7067 | 3-amino-5-phenylpentane |
| 7068 | 3-Amino-6-Hydroxy-Tyrosine |
| 7069 | 3-Amino-8,9,10-Trihydroxy-7-Hydroxymethyl-6-Oxa-1,3-Diaza-Spiro[4.5]Decane-2,4-Dione |
| 7070 | 3-Amino-Alanine |
| 7071 | 3-AMINO-AZACYCLOTRIDECAN-2-ONE |
| 7072 | 3-Amino-N-{4-[2-(2,6-Dimethyl-Phenoxy)-Acetylamino]-3-Hydroxy-1-Isobutyl-5-Phenyl-Pentyl}-Benzamide |
| 7073 | 3-Aminosuccinimide |
| 7074 | 3ar,5r,6s,7r,7ar-5-Hydroxymethyl-2-Methyl-5,6,7,7a-Tetrahydro-3ah-Pyrano[3,2-D]Thiazole-6,7-Diol |
| 7075 | 3'-Azido-3'-Deoxythymidine-5'-Diphosphate |
| 7076 | 3'-Azido-3'-Deoxythymidine-5'-Monophosphate |
| 7077 | 3-Benzylaminocarbonylphenyl-Alpha-D-Galactoside |
| 7078 | 3-BENZYLOXYCARBONYLAMINO-2-HYDROXY-4-PHENYL-BUTYRIC ACID |
| 7079 | 3-Bromo-3-buten-1-ol |
| 7080 | 3-bromo-5-phenyl-N-(pyridin-4-ylmethyl)pyrazolo[1,5-a]pyrimidin-7-amine |
| 7081 | 3-BROMO-6-HYDROXY-2-(4-HYDROXYPHENYL)-1H-INDEN-1-ONE |
| 7082 | 3-Bromo-7-Nitroindazole |
| 7083 | 3-bromo-N'-[(1E)-(3,5-dibromo-2,4-dihydroxyphenyl)methylidene]benzohydrazide |
| 7084 | 3-Butylthiolane 1-Oxide |
| 7085 | 3-CARBOXAMIDO-1,3,5(10)-ESTRATRIEN-17(R)-SPIRO-2'(5',5'-DIMETHYL-6'OXO)TETRAHYDROPYRAN |
| 7086 | 3-Carboxy-N,N,N-Trimethyl-2-(Octanoyloxy)Propan-1-Aminium |
| 7087 | 3-CHLORO-2-(4-HYDROXYPHENYL)-2H-INDAZOL-5-OL |
| 7088 | 3-CHLORO-2,2-DIMETHYL-N-[4-(TRIFLUOROMETHYL)PHENYL]PROPANAMIDE |
| 7089 | 3-chloro-5-[2-chloro-5-(1H-indazol-3-ylmethoxy)phenoxy]benzonitrile |
| 7090 | 3-chloro-5-[2-chloro-5-(1H-pyrazolo[3,4-b]pyridin-3-ylmethoxy)phenoxy]benzonitrile |
| 7091 | 3-Chloro-9-Ethyl-6,7,8,9,10,11-Hexahydro-7,11-Methanocycloocta[B]Quinolin-12-Amine |
| 7092 | 3-Chloroalaninate |
| 7093 | 3-Chlorophenol |
| 7094 | 3-CYCLOHEXYL-1-(2-MORPHOLIN-4-YL-2-OXOETHYL)-2-PHENYL-1H-INDOLE-6-CARBOXYLIC ACID |
| 7095 | 3-cyclohexyl-D-alanyl-N-(3-chlorobenzyl)-L-prolinamide |
| 7096 | 3-Deaza-Adenosine |
| 7097 | 3-Deazacytidine |
| 7098 | 3-Decyl-2,5-Dioxo-4-Hydroxy-3-Pyrroline |
| 7099 | 3-Dehydroquinic Acid |
| 7100 | 3-Dehydroshikimate |
| 7101 | 3'-Deoxy 3'-Amino Adenosine-5'-Diphosphate |
| 7102 | 3-Deoxy-D-Glucosamine |
| 7103 | 3-Deoxy-D-Manno-Oct-2-Ulosonic Acid |
| 7104 | 3-Deoxyguanosine |
| 7105 | 3-DIPHENOL-6-NITRO-3H-BENZO[DE]ISOCHROMEN-1-ONE |
| 7106 | 3-ETHYL-2-(4-HYDROXYPHENYL)-2H-INDAZOL-5-OL |
| 7107 | 3-ETHYL-6-{[(4-FLUOROPHENYL)SULFONYL]AMINO}-2-METHYLBENZOIC ACID |
| 7108 | 3-Fluoro-2-(Phosphonooxy)Propanoic Acid |
| 7109 | 3-Fluoro-2-Methyl-Aniline |
| 7110 | 3-FLUORO-4-[2-HYDROXY-2-(5,5,8,8-TETRAMETHYL-5,6,7,8,-TETRAHYDRO-NAPHTALEN-2-YL)-ACETYLAMINO]-BENZOIC ACID |
| 7111 | 3-FLUORO-4-HYDROXYBENZALDEHYDE O-(CYCLOHEXYLCARBONYL)OXIME |
| 7112 | 3-FLUORO-5-MORPHOLIN-4-YL-N-[1-(2-PYRIDIN-4-YLETHYL)-1H-INDOL-6-YL]BENZAMIDE |
| 7113 | 3-FLUORO-5-MORPHOLIN-4-YL-N-[3-(2-PYRIDIN-4-YLETHYL)-1H-INDOL-5-YL]BENZAMIDE |
| 7114 | 3-fluoro-6-(4-fluorophenyl)-2-hydroxy-6-oxohexa-2,4-dienoic acid |
| 7115 | 3-FLUORO-N-[1-(4-FLUOROPHENYL)-3-(2-THIENYL)-1H-PYRAZOL-5-YL]BENZENESULFONAMIDE |
| 7116 | 3-fluoro-N-[3-(1H-tetrazol-5-yl)phenyl]benzamide |
| 7117 | 3-fluoro-N-1H-indol-5-yl-5-morpholin-4-ylbenzamide |
| 7118 | 3-Fluorotyrosine |
| 7119 | 3-FORMYL-2-HYDROXY-5-METHYL-HEXANOIC ACID HYDROXYAMIDE |
| 7120 | 3h-Indole-5,6-Diol |
| 7121 | 3h-Pyrazolo[4,3-D]Pyrimidin-7-Ol |
| 7122 | 3-Hydroxy-3-Methyl-Glutaric Acid |
| 7123 | 3-Hydroxy-4-(3,4,5-Trihydroxy-Tetrahydro-Pyran-2-Yloxy)-Piperidin-2-One |
| 7124 | 3-Hydroxyanthranilic Acid |
| 7125 | 3-Hydroxybutyryl-Coenzyme A |
| 7126 | 3-hydroxyglutaric acid |
| 7127 | 3-Hydroxyhippuric acid |
| 7128 | 3-Hydroxyimino Quinic Acid |
| 7129 | 3-Hydroxyisoxazole-4-Carboxylic Acid |
| 7130 | 3-Hydroxymethyl-5-Aziridinyl-1methyl-2-[1h-Indole-4,7-Dionel-Propanol |
| 7131 | 3-Hydroxy-Myristic Acid |
| 7132 | 3-Hydroxy-Propanoic Acid |
| 7133 | 3-HYDROXYPROPYL 3-[({7-[AMINO(IMINO)METHYL]-1-NAPHTHYL}AMINO)CARBONYL]BENZENESULFONATE |
| 7134 | 3-Hydroxypyruvic Acid |
| 7135 | 3-Indolebutyric Acid |
| 7136 | 3-Iodo-Tyrosine |
| 7137 | 3-ISOBUTYL-1-METHYLXANTHINE |
| 7138 | 3-Isopropylmalic Acid |
| 7139 | 3-Mercapto-1-(1,3,4,9-Tetrahydro-B-Carbolin-2-Yl)-Propan-1-One |
| 7140 | 3-Mercuri-4-Aminobenzenesulfonamide |
| 7141 | 3-METHOXY-6-[4-(3-METHYLPHENYL)-1-PIPERAZINYL]PYRIDAZINE |
| 7142 | 3-Methoxybenzamide |
| 7143 | 3-METHYL-1,6,8-TRIHYDROXYANTHRAQUINONE |
| 7144 | 3-Methyladenine |
| 7145 | 3-methyl-benzene-1,2-diol |
| 7146 | 3-Methylcytcsine |
| 7147 | 3-Methylfentanyl |

TABLE 1-continued

Ligands

| Ligand No. | Ligand Name |
|---|---|
| 7148 | 3-Methylphenylalanine |
| 7149 | 3-Methylpyridine |
| 7150 | 3-Methylthiofentanyl |
| 7151 | 3-Nitro-4-(2-Oxo-Pyrrolidin-1-Yl)-Benzenesulfonamide |
| 7152 | 3-Nitrophenylboronic Acid |
| 7153 | 3'-O-Acetylthymidine-5'-Diphosphate |
| 7154 | 3-O-Methylfructose in Linear Form |
| 7155 | 3'-O-N-Octanoyl-a-D-Glucopyranosyl-B-D-Fructofuranoside |
| 7156 | 3-Oxiran-2ylalanine |
| 7157 | 3'-Oxo-Adenosine |
| 7158 | 3-OXO-N-[(3S)-2-OXOPYRROLIDIN-3-YL]DODECANAMIDE |
| 7159 | 3-OXO-OCTANOIC ACID (2-OXO-TETRAHYDRO-FURAN-3-YL)-AMIDE |
| 7160 | 3-Oxo-Pentadecanoic Acid |
| 7161 | 3-Phenyl-1,2-Propandiol |
| 7162 | 3-phenyl-5-(1H-pyrazol-3-yl)isoxazole |
| 7163 | 3-phenylpropionic acid |
| 7164 | 3-Phenylpropylamine |
| 7165 | 3-Phenylpyruvic Acid |
| 7166 | 3'-Phosphate-Adenosine-5'-Diphosphate |
| 7167 | 3'-Phosphate-Adenosine-5'-Phosphate Sulfate |
| 7168 | 3-Phosphoglyceric Acid |
| 7169 | 3-Phosphoglycerol |
| 7170 | 3-pyridin-4-yl-1H-indazole |
| 7171 | 3-PYRIDIN-4-YL-2,4-DIHYDRO-INDENO[1,2-.C.]PYRAZOLE |
| 7172 | 3-Pyridin-4-Yl-2,4-Dihydro-Indeno[1,2-.C.]Pyrazole |
| 7173 | 3r-Hydroxydecanoyl-Coa |
| 7174 | 3-Sulfinoalanine |
| 7175 | 3-Thiaoctanoyl-Coenzyme A |
| 7176 | 3'-THIO-THYMIDINE-5'-PHOSPHATE |
| 7177 | 3-Trimethylsilylsuccinic Acid |
| 7178 | 3'-Uridinemonophosphate |
| 7179 | 4-((3r,4s,5r)-4-Amino-3,5-Dihydroxy-Hex-1-Ynyl)-5-Fluoro-3-[1-(3-Methoxy-1h-Pyrrol-2-Yl)-Meth-(Z)-Ylidene]-1,3-Dihydro-Indol-2-One |
| 7180 | 4-({(2R,5S)-2,5-DIMETHYL-4-[(2R)-3,3,3-TRIFLUORO-2-HYDROXY-2-METHYLPROPANOYL]PIPERAZIN-1-YL}CARBONYL)BENZONITRILE |
| 7181 | 4-({[(4-METHYLPIPERAZIN-1-YL)AMINO]CARBONOTHIOYL}AMINO)BENZENE-SULFONAMIDE |
| 7182 | 4-({[4-(3-METHYLBENZOYL)PYRIDIN-2-YL]AMINO}METHYL)BENZENECARBOXIMIDAMIDE |
| 7183 | 4-({4-[(4-AMINOBUT-2-YNYL)OXY]PHENYL}SULFONYL)-N-HYDROXY-2,2-DIMETHYLTHIOMORPHOLINE-3-CARBOXAMIDE |
| 7184 | 4-({4-[(4-methoxypyridin-2-yl)amino]piperidin-1-yl}carbonyl)benzonitrile |
| 7185 | 4-({4-[(6-CHLORO-1-BENZOTHIEN-2-YL)SULFONYL]-2-OXOPIPERAZIN-1-YL}METHYL)BENZENECARBOXIMIDAMIDE |
| 7186 | 4-({5-[(4-AMINOCYCLOHEXYL)AMINO][1,2,4]TRIAZOLO[1,5-A]PYRIMIDIN-7-YL}AMINO)BENZENESULFONAMIDE |
| 7187 | 4-({6-AMINO-5-BROMO-2-[(4-CYANOPHENYL)AMINO]PYRIMIDIN-4-YL}OXY)-3,5-DIMETHYLBENZONITRILE |
| 7188 | 4-(1,3,2-Dioxaborolan-2-Yloxy)Butan-1-Aminium |
| 7189 | 4-(1,3-Benzodioxol-5-Yl)-5-(5-Ethyl-2,4-Dihydroxyphenyl)-2h-Pyrazole-3-Carboxylic Acid |
| 7190 | 4-(1,3-BENZODIOXOL-5-YLOXY)-2-[4-(1H-IMIDAZOL-1-YL)PHENOXY]-6-METHYLPYRIMIDINE |
| 7191 | 4-(1,3-BENZODIOXOL-5-YLOXY)-2-[4-(1H-IMIDAZOL-1-YL)PHENOXY]PYRIMIDINE |
| 7192 | 4-(1-Amino-1-Carboxy-Ethyl)-Benzoic Acid |
| 7193 | 4-(1-Benzyl-3-Carbamoylmethyl-2-Methyl-1h-Indol-5-Yloxy)-Butyric Acid |
| 7194 | 4-(1H-IMIDAZOL-1-YL)PHENOL |
| 7195 | 4-(1h-Imidazol-4-Yl)-3-(5-Ethyl-2,4-Dihydroxy-Phenyl)-1h-Pyrazole |
| 7196 | 4-(1-methyl-1-phenylethyl)phenol |
| 7197 | 4-(1R,3AS,4R,8AS,8BR)-[1-DIFLUOROMETHYL-2-(4-FLUOROBENZYL)-3-OXODECAHYDROPYRROLO[3,4-A]PYRROLIZIN-4-YL]BENZAMIDINE |
| 7198 | 4-(2-(1H-IMIDAZOL-4-YL)ETHYLAMINO)-2-(PHENYLAMINO)PYRAZOLO[1,5-A][1,3,5]TRIAZINE-8-CARBONITRILE |
| 7199 | 4-(2,2,2-TRIFLUOROETHYL)-L-PHENYLALANINE |
| 7200 | 4-(2,4-dichlorophenyl)-5-phenyldiazenyl-pyrimidin-2-amine |
| 7201 | 4-(2,4-Dimethyl-Thiazol-5-Yl)-Pyrimidin-2-Yl]-(4-Trifluoromethyl-Phenyl)-Amine |
| 7202 | 4-(2,4-Dimethyl-Thiazol-5-Yl)-Pyrimidin-2-Ylamine |
| 7203 | 4-(2,5-DIAMINO-5-HYDROXY-PENTYL)-PHENOL |
| 7204 | 4-(2,5-Dichloro-Thiophen-3-Yl)-Pyrimidin-2-Ylamine |
| 7205 | 4-(2-{[4-{[3-(4-Chlorophenyl)Propyl]Sulfanyl}-6-(1-Piperazinyl)-1,3,5-Triazin-2-Yl]Amino}Ethyl)Phenol |
| 7206 | 4-(2-amino-1,3-thiazol-4-yl)phenol |
| 7207 | 4-(2-amino-1,3-thiazol-4-yl)pyrimidin-2-amine |
| 7208 | 4-(2-amino-1-methyl-1H-imidazo[4,5-b]pyridin-6-yl)phenol |
| 7209 | 4-(2-AMINOETHOXY)-3,5-DICHLORO-N-[3-(1-METHYLETHOXY)PHENYL]BENZAMIDE |
| 7210 | 4-(2-aminoethoxy)-N-(2,5-diethoxyphenyl)-3,5-dimethylbenzamide |
| 7211 | 4-(2-aminoethoxy)-N-(3-chloro-2-ethoxy-5-piperidin-1-ylphenyl)-3,5-dimethylbenzamide |
| 7212 | 4-(2-aminoethoxy)-N-(3-chloro-5-piperidin-1-ylphenyl)-3,5-dimethylbenzamide |
| 7213 | 4-(2-aminoethyl)-2-cyclohexylphenol |
| 7214 | 4-(2-aminoethyl)-2-ethylphenol |
| 7215 | 4-(2-AMINOETHYL)BENZENESULFONAMIDE |
| 7216 | 4-(2-AMINOETHYL)BENZENESULFONYL FLUORIDE |
| 7217 | 4-(2-AMINOPHENYL)-4-OXOBUTANOIC ACID |
| 7218 | 4-(2-chlorophenyl)-8-(2-hydroxyethyl)-6-methylpyrrolo[3,4-e]indole-1,3(2H,6H)-dione |
| 7219 | 4-(2-HYDROXY-4-FLUOROPHENYLTHIO)-BUTYLPHOSPHONIC ACID |
| 7220 | 4-(2-HYDROXYBENZYLAMINO)-N-(3-(4-FLUOROPHENOXY)PHENYL)PIPERIDINE-1-SULFONAMIDE |
| 7221 | 4-(2-HYDROXYPHENYLSULFINYL)-BUTYLPHOSPHONIC ACID |
| 7222 | 4-(2-HYDROXYPHENYLTHIO)-1-BUTENYLPHOSPHONIC ACID |
| 7223 | 4-(2-methoxyethoxy)-6-methylpyrimidin-2-amine |
| 7224 | 4-(2-METHOXYPHENYL)-2-OXOBUT-3-ENOIC ACID |
| 7225 | 4-(2-Oxo-Hexahydro-Thieno[3,4-D]Imidazol-4-Yl)-Butyricacid |
| 7226 | 4-(2-Thienyl)-1-(4-Methylbenzyl)-1h-Imidazole |
| 7227 | 4-(2-Thienyl)Butyric Acid |
| 7228 | 4-(3,5-DIMETHYLPHENOXY)-5-(FURAN-2-YLMETHYLSULFANYLMETHYL)-3-IODO-6-METHYLPYRIDIN-2(1H)-ONE |
| 7229 | 4-(3-{[5-(trifluoromethyl)pyridin-2-yl]oxy}benzyl)piperidine-1-carboxylic acid |
| 7230 | 4-(3-amino-1H-indazol-5-yl)-N-tert-butylbenzenesulfonamide |
| 7231 | 4-(3-ethylthiophen-2-yl)benzene-1,2-diol |
| 7232 | 4-(3-Pyridin-2-Yl-1h-Pyrazol-4-Yl)Quinoline |
| 7233 | 4-(4-chlorobenzyl)-1-(7H-pyrrolo[2,3-d]pyrimidin-4-yl)piperidin-4-aminium |
| 7234 | 4-(4-CHLORO-PHENYL)-1-{3-[2-(4-FLUORO-PHENYL)-[1,3]DITHIOLAN-2-YL]-PROPYL}-PIPERIDIN-4-OL |
| 7235 | 4-(4-CHLOROPHENYL)-4-[4-(1H-PYRAZOL-4-YL)PHENYL]PIPERIDINE |
| 7236 | 4-(4-Chlorophenyl)Imidazole |
| 7237 | 4-(4-FLUOROPHENYL)PIPERIDINE |
| 7238 | 4-(4-FLUOROPHENYL)-1-CYCLOROPROPYLMETHYL-5-(4-PYRIDYL)-IMIDAZOLE |
| 7239 | 4-(4-fluoro-phenylazo)-5-imino-5H-pyrazol-3-ylamine |
| 7240 | 4-(4-hydroxy-3-methylphenyl)-6-phenylpyrimidin-2(5H)-one |
| 7241 | 4-(4-HYDROXYPHENYL)-1-NAPHTHALDEHYDE OXIME |
| 7242 | 4-(4-methoxy-1H-pyrrolo[2,3-b]pyridin-3-yl)pyrimidin-2-amine |
| 7243 | 4-(4-methyl-1,3-dioxo-1,3-dihydro-2H-isoindol-2-yl)benzonitrile |

TABLE 1-continued

Ligands

| Ligand No. | Ligand Name |
|---|---|
| 7244 | 4-(4-METHYLPIPERAZIN-1-YL)-N-[5-(2-THIENYLACETYL)-1,5-DIHYDROPYRROLO[3,4-C]PYRAZOL-3-YL]BENZAMIDE |
| 7245 | 4-(4-propoxy-1H-pyrrolo[2,3-b]pyridin-3-yl)pyrimidin-2-amine |
| 7246 | 4-(4-STYRYL-PHENYLCARBAMOYL)-BUTYRIC ACID |
| 7247 | 4-(5,11-DIOXO-5H-INDENO[1,2-C]ISOQUINOLIN-6(11H)-YL)BUTANOATE |
| 7248 | 4-(5-BENZENESULFONYLAMINO-1-METHYL-1H-BENZOIMIDAZOL-2-YLMETHYL)-BENZAMIDINE |
| 7249 | 4-(5-Bromo-2-Oxo-2h-Indol-3-Ylazo)-Benzenesulfonamide |
| 7250 | 4-(5-phenyl-1H-pyrrolo[2,3-b]pyridin-3-yl)benzoic acid |
| 7251 | 4-(6-{[(1 R)-1-(hydroxymethyl)propyl]amino}imidazo[1,2-b]pyridazin-3-yl)benzoic acid |
| 7252 | 4-(6-{[(4-METHYLCYCLOHEXYL)AMINO]METHYL}-1,4-DIHYDROINDENO[1,2-C]PYRAZOL-3-YL)BENZOIC ACID |
| 7253 | 4-(6-CHLORO-2,4-DIOXO-1,2,3,4-TETRAHYDROPYRIMIDIN-5-YL) BUTYL PHOSPHATE |
| 7254 | 4-(6-CYCLOHEXYLMETHOXY-9H-PURIN-2-YLAMINO)--BENZAMIDE |
| 7255 | 4-(6-HYDROXY-1H-INDAZOL-3-YL) BENZENE-1,3-DIOL |
| 7256 | 4-(6-HYDROXY-BENZO[D]ISOXAZOL-3-YL)BENZENE-1,3-DIOL |
| 7257 | 4-(Acetylamino)-3-[(Aminoacetyl)Amino]Benzoic Acid |
| 7258 | 4-(Acetylamino)-3-[(Hydroxyacetyl)Amino]Benzoic Acid |
| 7259 | 4-(Acetylamino)-3-Amino Benzoic Acid |
| 7260 | 4-(Acetylamino)-3-Guanidinobenzoic Acid |
| 7261 | 4-(ACETYLAMINO)-3-HYDROXY-5-NITROBENZOIC ACID |
| 7262 | 4-(ACETYLAMINO)-5-AMINO-3-HYDROXYBENZOIC ACID |
| 7263 | 4-(acetylamino)-N-(4-fluorophenyl)-1H-pyrazole-3-carboxamide |
| 7264 | 4-(Aminosulfonyl)-N-[(2,3,4-Trifluorophenyl)Methyl]-Benzamide |
| 7265 | 4-(Aminosulfonyl)-N-[(2,4,6-Trifluorophenyl)Methyl]-Benzamide |
| 7266 | 4-(Aminosulfonyl)-N-[(2,4-Difluorophenyl)Methyl]-Benzamide |
| 7267 | 4-(Aminosulfonyl)-N-[(2,5-Difluorophenyl)Methyl]-Benzamide |
| 7268 | 4-(Aminosulfonyl)-N-[(3,4,5-Trifluorophenyl)Methyl]-Benzamide |
| 7269 | 4-(Aminosulfonyl)-N-[(4-Fluorophenyl)Methyl]-Benzamide |
| 7270 | 4-(BENZHYDRYLOXY)-1-[3-(1H-TETRAAZOL-5-YL)PROPYL]PIPERIDINE |
| 7271 | 4-(Carboxyvin-2-Yl)Phenylboronic Acid |
| 7272 | 4-(dihydroxyboranyl)-2-({[4-(phenylsulfonyl)thiophen-2-yl]sulfonyl}amino)benzoic acid |
| 7273 | 4-(DIMETHYLAMINO)BENZOIC ACID |
| 7274 | 4-(DIMETHYLAMINO)BUTYL IMIDOTHIOCARBAMATE |
| 7275 | 4-(Fluorophenyl)-1-Cyclopropylmethyl-5-(2-Amino-4-Pyrimidinyl)Imidazole |
| 7276 | 4-(Hydroxymercury)Benzoic Acid |
| 7277 | 4-(Hydroxymethyl)Benzamidine |
| 7278 | 4-(Methylsulfanyl)-2-Oxobutanoic Acid |
| 7279 | 4-(METHYLSULFONYL)BENZENECARBOXIMIDAMIDE |
| 7280 | 4-(N,N-Dimethylamino)Cinnamoyl-Coa |
| 7281 | 4-(N-ACETYLAMINO)-3-[N-(2-ETHYLBUTANOYLAMINO)]BENZOIC ACID |
| 7282 | 4-(quinolin-3-ylmethyl)piperidine-1-carboxylic acid |
| 7283 | 4,4'[1,6-Hexanediylbis(Oxy)]Bisbenzenecarboximidamide |
| 7284 | 4,4'-Biphenyldiboronic Acid |
| 7285 | 4,4'-BIS([H]METHYLSULFONYL)-2,2',5,5'-TETRACHLOROBIPHENYL |
| 7286 | 4,4'-cyclohexane-1,1-diyldiphenol |
| 7287 | 4,4'-DIPYRIDYL DISULFIDE |
| 7288 | 4,4'-PROPANE-2,2-DIYLDIPHENOL |
| 7289 | 4,5-bis(4-methoxyphenyl)-2-thiophen-2-yl-1H-imidazole |
| 7290 | 4,5-Dehydro-D-Glucuronic Acid |
| 7291 | 4,5-Dehydro-L-Iduronic Acid |
| 7292 | 4,5-Dihydroxy-Tetrahydro-Pyran-2-Carboxylic Acid |
| 7293 | 4,5-Dimethyl-1,2-Phenylenediamine |
| 7294 | 4,6-Dideoxy-4-{[4,5,6-Trihydroxy-3-(Hydroxymethyl)Cyclohex-2-En-1-Yl]Amino}-Alpha-D-Lyxo-Hexopyranosyl-(1->4)-Alpha-D-Threo-Hexopyranosyl-(1->6)-Alpha-L-Threo-Hexopyranose |
| 7295 | 4,6-DIDEOXY-4-([4-[(4-O-HEXOPYRANOSYLHEXOPYRANOSYL)OXY]-5,6-DIHYDROXY-3-(HYDROXYMETHYL) CYCLOHEX-2-EN-1-YL]AMINO}HEXOPYRANOSYL-(1->4)HEXOPYRANOSYL-(1->4)HEXOPYRANOSE |
| 7296 | 4,6-Dideoxy-4-Amino-Alpha-D-Glucose |
| 7297 | 4,6-Dideoxy-4-Amino-Beta-D-Glucopyranoside |
| 7298 | 4,6-Dideoxyglucose |
| 7299 | 4,6-O-(1-Carboxyethylidene)-Beta-D-Glucose |
| 7300 | 4,6-O-(1-CARBOXYETHYLIDENE)-BETA-D-MANNOSE-(1->4)-BETA-D-GLUCURONIC ACID |
| 7301 | 4,7-Dimethyl-[1,10]Phenanthroline |
| 7302 | 4,7-Dioxosebacic Acid |
| 7303 | 4-[(10s,14s,18s)-18-(2-Amino-2-Oxoethyl)-14-(1-Naphthylmethyl)-8,17,20-Trioxo-7,16,19-Triazaspiro[5.14]Icos-11-En-10-Yl]Benzylphosphonic Acid |
| 7304 | 4-[(1E,7E)-8-(2,6-DIOXO-1,2,3,6-TETRAHYDROPYRIMIDIN-4-YL)-3,6-DIOXA-2,7-DIAZAOCTA-1,7-DIEN-1-YL]BENZOIC ACID |
| 7305 | 4'-[(1R)-1-amino-2-(2,5-difluorophenyl)ethyl]biphenyl-3-carboxamide |
| 7306 | 4-[(1R,2S)-1-ethyl-2-(4-hydroxyphenyl)butyl]phenol |
| 7307 | 4-[(1S)-1-(3-fluoro-4-methoxyphenyl)-2-(2-methoxy-5-nitrophenyl)ethyl]-1H-imidazol-2-amine |
| 7308 | 4-[(1S,2R,5S)-4,4,8-TRIMETHYL-3-OXABICYCLO[3.3.1]NON-7-EN-2-YL]PHENOL |
| 7309 | 4-[(1S,2S,5S)-5-(HYDROXYMETHYL)-6,8,9-TRIMETHYL-3-OXABICYCLO[3.3.1]NON-7-EN-2-YL]PHENOL |
| 7310 | 4-[(1S,2S,5S)-5-(HYDROXYMETHYL)-8-METHYL-3-OXABICYCLO[3.3.1]NON-7-EN-2-YL]PHENOL |
| 7311 | 4-[(1S,2S,5S,9R)-5-(HYDROXYMETHYL)-8,9-DIMETHYL-3-OXABICYCLO[3.3.1]NON-7-EN-2-YL]PHENOL |
| 7312 | 4-[(2-{4-[(CYCLOPROPYLCARBAMOYL)AMINO]-1H-PYRAZOL-3-YL}-1H-BENZIMIDAZOL-6-YL)METHYL]MORPHOLIN-4-IUM |
| 7313 | 4-[(3AS,4R,7R,8AS,8BR)-2-(1,3-BENZODIOXOL-5-YLMETHYL)-7-HYDROXY-1,3-DIOXODECAHYDROPYRROLO[3,4-A]PYRROLIZIN-4-YL]BENZENECARBOXIMIDAMIDE |
| 7314 | 4-[(3-BROMO-4-O-SULFAMOYLBENZYL)(4-CYANOPHENYL)AMINO]-4H-[1,2,4]-TRIAZOLE |
| 7315 | 4-[(3-CHLORO-4-([(2R)-3,3,3-TRIFLUORO-2-HYDROXY-2-METHYLPROPANOYL]AMINO}PHENYL)SULFONYL]-N,N-DIMETHYLBENZAMIDE |
| 7316 | 4-[(3R)-3-{[2-(4-FLUOROPHENYL)-2-OXOETHYL]AMINO}BUTYL]BENZAMIDE |
| 7317 | 4-[(3S)-1-AZABICYCLO[2.2.2]OCT-3-YLAMINO]-3-(1H-BENZIMIDAZOL-2-YL)-6-CHLOROQUINOLIN-2(1H)-ONE |
| 7318 | 4-[(4-bromo-2-{[(3R,5S)-3,5-dimethylpiperidin-1-yl]carbonyl}phenyl)amino]-4-oxobutanoic acid |
| 7319 | 4-[(4-Imidazo[1,2-a]Pyridin-3-Ylpyrimidin-2-Yl)Amino]Benzenesulfonamide |
| 7320 | 4-[(4-METHYL-1-PIPERAZINYL)METHYL]-N-[3-[[4-(3-PYRIDINYL)-2-PYRIMIDINYL]AMINO]PHENYL]-BENZAMIDE |
| 7321 | 4-[(4-O-SULFAMOYLBENZYL)(4-CYANOPHENYL)AMINO]-4H-[1,2,4]-TRIAZOLE |
| 7322 | 4-[(5-{[4-(3-CHLOROPHENYL)-3-OXOPIPERAZIN-1-YL]METHYL}-1H-IMIDAZOL-1-YL)METHYL]BENZONITRILE |
| 7323 | 4-[(5-bromopyridin-2-yl)amino]-4-oxobutanoic acid |
| 7324 | 4-[(5-CHLOROINDOL-2-YL)SULFONYL]-2-(2-METHYLPROPYL)-1-[[5-(PYRIDIN-4-YL)PYRIMIDIN-2-YL]CARBONYL]PIPERAZINE |
| 7325 | 4-[(5-methoxy-2-methylphenoxy)methyl]pyridine |
| 7326 | 4-[(6-Amino-4-Pyrimidinyl)Amino]Benzenesulfonamide |
| 7327 | 4-[(6-chloropyrazin-2-yl)amino]benzenesulfonamide |
| 7328 | 4-[(6-phenyl[1,2,4]triazolo[4,3-b]pyridazin-3-yl)methyl]phenol |

TABLE 1-continued

Ligands

| Ligand No. | Ligand Name |
|---|---|
| 7329 | 4-[(7-OXO-7H-THIAZOLO[5,4-E]INDOL-8-YLMETHYL)-AMINO]-N-PYRIDIN-2-YL-BENZENESULFONAMIDE |
| 7330 | 4-[(7R,7AS)-7-HYDROXY-1,3-DIOXOTETRAHYDRO-1H-PYRROLO[1,2-C]IMIDAZOL-2(3H)-YL]-1-NAPHTHONITRILE |
| 7331 | 4-[(CYCLOPROPYLETHYNYL)OXY]-6-FLUORO-3-ISOPROPYLQUINOLIN-2(1H)-ONE |
| 7332 | 4-[(E)-(3,5-DIAMINO-1H-PYRAZOL-4-YL)DIAZENYL]PHENOL |
| 7333 | 4-[(METHYLSULFONYL)AMINO]BENZOIC ACID |
| 7334 | 4-[[(1E)-2-(4-CHLOROPHENYL)ETHENYL]SULFONYL]-1-[[1-(4-PYRIDINYL)-4-PIPERIDINYL]METHYL]PIPERAZINONE |
| 7335 | 4-[[2-[[4-chloro-3-(trifluoromethyl)phenyl]amino]-3H-benzimidazol-5-yl]oxy]-N-methyl-pyridine-2-carboxamide |
| 7336 | 4-[1-(2,6-dichlorobenzyl)-2-methyl-1H-imidazol-4-yl]pyrimidin-2-amine |
| 7337 | 4-[1-allyl-7-(trifluoromethyl)-1H-indazol-3-yl]benzene-1,3-diol |
| 7338 | 4-[3-(1,4-diazepan-1-ylcarbonyl)-4-fluorobenzyl]phthalazin-1(2H)-one |
| 7339 | 4-[3-(1H-BENZIMIDAZOL-2-YL)-1H-INDAZOL-6-YL]-2-METHOXYPHENOL |
| 7340 | 4-[3-(2-Chloro-4,5-difluoro-benzoyl)ureido]-3-trifluoromethoxybenzoic acid |
| 7341 | 4-[3-(3-NITROPHENYL)-1,2,4-OXADIAZOL-5-YL]BUTANOIC ACID |
| 7342 | 4-[3-(4-CHLOROPHENYL)-1H-PYRAZOL-5-YL]PIPERIDINE |
| 7343 | 4-[3-(4-chlorophenyl)-2,1-benzisoxazol-5-yl]pyrimidin-2-amine |
| 7344 | 4-[3-(4-FLUOROPHENYL)-1H-PYRAZOL-4-YL]PYRIDINE |
| 7345 | 4-[3-(Cyclopentyloxy)-4-Methoxyphenyl]-2-Pyrrolidinone |
| 7346 | 4-[3-(dibenzylamino)phenyl]-2,4-dioxobutanoic acid |
| 7347 | 4-[3-Carboxymethyl-3-(4-Phosphonooxy-Benzyl)-Ureido]-4-[(3-Cyclohexyl-Propyl)-Methyl-Carbamoyl]Butyric Acid |
| 7348 | 4-[3-Hydroxyanilino]-6,7-Dimethoxyquinazoline |
| 7349 | 4-[3-Methylsulfanylanilino]-6,7-Dimethoxyquinazoline |
| 7350 | 4-[3-Oxo-3-(5,5,8,8-Tetramethyl-5,6,7,8-Tetrahydro-Naphthalen-2-Yl)-Propenyl]-Benzoic Acid |
| 7351 | 4-[4-(1-Amino-1-Methylethyl)Phenyl]-5-Chloro-N-[4-(2-Morpholin-4-Ylethyl)Phenyl]Pyrimidin-2-Amine |
| 7352 | 4-[4-(2,3-DIHYDRO-1,4-BENZODIOXIN-6-YL)-3-METHYL-1H-PYRAZOL-5-YL]-6-ETHYLBENZENE-1,3-DIOL |
| 7353 | 4-[4-(2,4,6-TRIMETHYL-PHENYLAMINO)-PYRIMIDIN-2-YLAMINO]-BENZONITRILE |
| 7354 | 4-[4-(2,5-DIOXO-PYRROLIDIN-1-YL)-PHENYLAMINO]-4-HYDROXY-BUTYRIC ACID |
| 7355 | 4-[4-(4-CHLORO-PHENOXY)-BENZENESULFONYLMETHYL]-TETRAHYDRO-PYRAN-4-CARBOXYLIC ACID HYDROXYAMIDE |
| 7356 | 4-[4-(4-methoxyphenyl)-5-methyl-1H-pyrazol-3-yl]benzene-1,3-diol |
| 7357 | 4-[4-(4-Methyl-2-Methylamino-Thiazol-5-Yl)-Pyrimidin-2-Ylamino]-Phenol |
| 7358 | 4-[4-AMINO-6-(2,6-DICHLORO-PHENOXY)-[1,3,5]TRIAZIN-2-YLAMINO]-BENZONITRILE |
| 7359 | 4-[4-AMINO-6-(5-CHLORO-1H-INDOL-4-YLMETHYL)-[1,3,5]TRIAZIN-2-YLAMINO]-BENZONITRILE |
| 7360 | 4-[5-(2-CARBOXY-1-FORMYL-ETHYLCARBAMOYL)-PYRIDIN-3-YL]-BENZOIC ACID |
| 7361 | 4-[5-(3-IODO-PHENYL)-2-(4-METHANESULFINYL-PHENYL)-1H-IMIDAZOL-4-YL]-PYRIDINE |
| 7362 | 4-[5-(4-FLUORO-PHENYL)-2-(4-METHANESULFINYL-PHENYL)-3H-IMIDAZOL-4-YL]-PYRIDINE |
| 7363 | 4-[5-(Trans-4-Aminocyclohexylamino)-3-Isopropylpyrazolo[1,5-a]Pyrimidin-7-Ylamino]-N,N-Dimethylbenzenesulfonamide |
| 7364 | 4-[5-[2-(1-Phenyl-Ethylamino)-Pyrimidin-4-Yl]-1-Methyl-4-(3-Trifluoromethylphenyl)-1h-Imidazol-2-Yl]-Piperidine |
| 7365 | 4-[5-Pyridin-4-Yl-1h-[1,2,4]Triazol-3-Yl]-Pyridine-2-Carbonitrile |
| 7366 | 4-[8-(3-nitrophenyl)-1,7-naphthyridin-6-yl]benzoic acid |
| 7367 | 4-[Hydroxy-[Methyl-Phosphinoyl]]-3-Oxo-Butanoic Acid |
| 7368 | 4-{(1E)-3-OXO-3-[(2-PHENYLETHYL)AMINO]PROP-1-EN-1-YL}-1,2-PHENYLENE DIACETATE |
| 7369 | 4-{[(1R,2S)-1,2-dihydroxy-2-methyl-3-(4-nitrophenoxy)propyl]amino}-2-(trifluoromethyl)benzonitrile |
| 7370 | 4-{[(2,6-dichlorophenyl)carbonyl]amino}-N-piperidin-4-yl-1H-pyrazole-3-carboxamide |
| 7371 | 4-{[(2,6-difluorophenyl)carbonyl]amino}-N-[(3S)-piperidin-3-yl]-1H-pyrazole-3-carboxamide |
| 7372 | 4-{[(2-OXO-1,2-DIHYDRO-3H-INDOL-3-YLIDENE)METHYL]AMINO}-N-(1,3-THIAZOL-2-YL)BENZENESULFONAMIDE |
| 7373 | 4-{[(2R)-2-(2-methylphenyl)pyrrolidin-1-yl]carbonyl}benzene-1,3-diol |
| 7374 | 4-{[(2S)-3-(tert-butylamino)-2-hydroxypropyl]oxy}-3H-indole-2-carbonitrile |
| 7375 | 4-{[(CYCLOHEXYLAMINO)CARBONYL]AMINO}BUTANOIC ACID |
| 7376 | 4-{[(E)-2-(5-CHLOROTHIEN-2-YL)VINYL]SULFONYL}-1-(1H-PYRROLO[3,2-C]PYRIDIN-2-YLMETHYL)PIPERAZIN-2-ONE |
| 7377 | 4-{[(Z)-(5-OXO-2-PHENYL-1,3-OXAZOL-4(5H)-YLIDENE)METHYL]AMINO}BUTANOIC ACID |
| 7378 | 4-{[1-METHYL-2,4-DIOXO-6-(3-PHENYLPROP-1-YN-1-YL)-1,4-DIHYDROQUINAZOLIN-3(2H)-YL]METHYL}BENZOIC ACID |
| 7379 | 4-{[1-Methyl-5-(4-Methyl-Benzoimidazol-1-Ylmethyl)-1h-Benzoimidazol-2-Ylmethyl]-Amino}-Benzamidine |
| 7380 | 4-{[4-({4-[(E)-2-cyanoethenyl]-2,6-dimethylphenyl}amino)pyrimidin-2-yl]amino}benzonitrile |
| 7381 | 4-{[4-(1-CYCLOPROPYL-2-METHYL-1H-IMIDAZOL-5-YL)PYRIMIDIN-2-YL]AMINO}-N-METHYLBENZENESULFONAMIDE |
| 7382 | 4-{[4-(4-fluoro-3-methylphenyl)-1,3-thiazol-2-yl]amino}-2-hydroxybenzoic acid |
| 7383 | 4-{[4-{[(1R,2R)-2-(dimethylamino)cyclopentyl]amino}-5-(trifluoromethyl)pyrimidin-2-yl]amino}-N-methylbenzenesulfonamide |
| 7384 | 4-{[4-AMINO-6-(CYCLOHEXYLMETHOXY)-5-NITROSOPYRIMIDIN-2-YL]AMINO}BENZAMIDE |
| 7385 | 4-{[5-(CYCLOHEXYLAMINO)[1,2,4]TRIAZOLO[1,5-A]PYRIMIDIN-7-YL]AMINO}BENZENESULFONAMIDE |
| 7386 | 4-{[5-(CYCLOHEXYLMETHOXY)[1,2,4]TRIAZOLO[1,5-A]PYRIMIDIN-7-YL]AMINO}BENZENESULFONAMIDE |
| 7387 | 4-{[5-(CYCLOHEXYLOXY)[1,2,4]TRIAZOLO[1,5-A]PYRIMIDIN-7-YL]AMINO}BENZENESULFONAMIDE |
| 7388 | 4-{[5-chloro-4-(1H-indol-3-yl)pyrimidin-2-yl]amino}-N-ethylpiperidine-1-carboxamide |
| 7389 | 4-{2-(4-Fluoro-Benzyl)-6-Methyl-5-[(5-Methyl-Isoxazole-3-Carbonyl)-Amino]-4-Oxo-Heptanoylamino}-5-(2-Oxo-Pyrrolidin-3-Yl)-Pentanoic Acid Ethyl Ester |
| 7390 | 4-{2,4-Bis[(3-Nitrobenzoyl)Amino]Phenoxy}Phthalic Acid |
| 7391 | 4-{2,6,8-Trioxo-9-[(2r,3s,4r)-2,3,4,5-Tetrahydroxypentyl]-1,2,3,6,8,9-Hexahydro-7h-Purin-7-Yl}Butyl Dihydrogen Phosphate |
| 7392 | 4-{2,6,8-Trioxo-9-[(2s,3r,4r)-2,3,4,5-Tetrahydroxypentyl]-1,2,3,6,8,9-Hexahydro-7h-Purin-7-Yl}Butyl Dihydrogen Phosphate |
| 7393 | 4-{2-[(3-Nitrobenzoyl)Amino]Phenoxy}Phthalic Acid |
| 7394 | 4-{2-[(7-amino-2-furan-2-yl[1,2,4]triazolo[1,5-a][1,3,5]triazin-5-yl)amino]ethyl}phenol |
| 7395 | 4-{2-[4-(2-Aminoethyl)Piperazin-1-Yl]Pyridin-4-Yl}-N-(3-Chloro-4-Methylphenyl)Pyrimidin-2-Amine |
| 7396 | 4-{3-CHLORO-4-[3-(2,4-DICHLORO-BENZOYL)-UREIDO]-PHENOXY}-BUTYRIC ACID |
| 7397 | 4-{4-[(5-hydroxy-2-methylphenyl)amino]quinolin-7-yl}-1,3-thiazole-2-carbaldehyde |
| 7398 | 4-{4-[2-(1A,7A-DIMETHYL-4-OXY-OCTAHYDRO-1-OXA-4-AZA-CYCLOPROPA[A]NAPHTHALEN-4-YL)-ACETYLAMINO]-PHENYLCARBAMOYL}-BUTYRIC ACID |
| 7399 | 4-{4-[3-(2,4-DICHLORO-BENZOYL)-UREIDO]-2,3-DIMETHYL-PHENOXY}-BUTYRIC ACID |

TABLE 1-continued

Ligands

| Ligand No. | Ligand Name |
|---|---|
| 7400 | 4-{4-[4-(3-AMINOPROPOXY)PHENYL]-1H-PYRAZOL-5-YL}-6-CHLOROBENZENE-1,3-DIOL |
| 7401 | 4-{5-[(1Z)-1-(2-IMINO-4-OXO-1,3-THIAZOLIDIN-5-YLIDENE)ETHYL]-2-FURYL}BENZENESULFONAMIDE |
| 7402 | 4-{5-[(Z)-(2,4-DIOXO-1,3-THIAZOLIDIN-5-YLIDENE)METHYL]FURAN-2-YL}BENZENESULFONAMIDE |
| 7403 | 4-{5-[(Z)-(2-IMINO-4-OXO-1,3-THIAZOLIDIN-5-YLIDENE)METHYL]-2-FURYL}-N-METHYLBENZENESULFONAMIDE |
| 7404 | 4-{5-[(Z)-(2-IMINO-4-OXO-1,3-THIAZOLIDIN-5-YLIDENE)METHYL]FURAN-2-YL}-2-(TRIFLUOROMETHYL)BENZENESULFONAMIDE |
| 7405 | 4-{5-[(Z)-(2-IMINO-4-OXO-1,3-THIAZOLIDIN-5-YLIDENE)METHYL]FURAN-2-YL}BENZENESULFONAMIDE |
| 7406 | 4-{5-[(Z)-(2-IMINO-4-OXO-1,3-THIAZOLIDIN-5-YLIDENE)METHYL]FURAN-2-YL}BENZOIC ACID |
| 7407 | 4-Acetamido-2,4-Didexoy-D-Glycero-Beta-D-Galacto-Octopyranosylphosphonic Acid |
| 7408 | 4-Acetyl-4-Guanidino-6-Methyl(Propyl)Carboxamide-4,5-Dihydro-2h-Pyran-2-Carboxylic Acid |
| 7409 | 4-Amido-4-Carbamoyl-Butyric Acid |
| 7410 | 4-Amino Hexanoic Acid |
| 7411 | 4-Amino-2-Deoxy-2,3-Dehydro-N-Neuraminic Acid |
| 7412 | 4-AMINO-2-HEXYLOXY-6-HYDROXYMETHYL-TETRAHYDRO-PYRAN-3,5-DIOL |
| 7413 | 4-AMINO-2-OCTYLOXY-6-HYDROXYMETHYL-TETRAHYDRO-PYRAN-3,5-DIOL |
| 7414 | 4-AMINO-2-TRIFLUOROMETHYL-5-HYDROXYMETHYLPYRIMIDINE PYROPHOSPHATE |
| 7415 | 4-AMINO-5-(2-METHYLPHENYL)-2,4-DIHYDRO-3H-1,2,4-TRIAZOLE-3-THIONE |
| 7416 | 4-Amino-5-Hydroxymethyl-2-Methylpyrimidine |
| 7417 | 4-amino-7,7-dimethyl-7,8-dihydroquinazolin-5(6H)-one |
| 7418 | 4-Aminobenzoic Acid |
| 7419 | 4-Aminohydrocinnamic Acid |
| 7420 | 4-AMINO-N-[(2-SULFANYLETHYL)CARBAMOYL]BENZENESULFONAMIDE |
| 7421 | 4-amino-N-[4-(benzyloxy)phenyl]butanamide |
| 7422 | 4-Amino-N-{4-[2-(2,6-Dimethyl-Phenoxy)-Acetylamino]-3-Hydroxy-1-Isobutyl-5-Phenyl-Pentyl}-Benzamide |
| 7423 | 4-Aminophenylarsonic Acid |
| 7424 | 4-Aminophthalhydrazide |
| 7425 | 4-Androstenedione |
| 7426 | 4-Benzoylamino-4-{1-{1-Carbamoyl-2-[4-(Difluoro-Phosphono-Methyl)-Phenyl]-Ethylcarbamoyl}-2-[4-(Difluoro-Phosphono-Methyl)-Phenyl]-Ethylcarbamoyl}-Butyric Acid |
| 7427 | 4-bromo-2-{[(2R)-2-(2-chlorobenzyl)pyrrolidin-1-yl]carbonyl}aniline |
| 7428 | 4-bromo-2-{[(3R,5S)-3,5-dimethylpiperidin-1-yl]carbonyl}aniline |
| 7429 | 4-BROMO-2-FLUORO-N-[(4E)-6-METHOXY-7-[(1-METHYLPIPERIDIN-4-YL)METHOXY]QUINAZOLIN-4(1H)-YLIDENE]ANILINE |
| 7430 | 4-BROMO-3-(CARBOXYMETHOXY)-5-(4-HYDROXYPHENYL)THIOPHENE-2-CARBOXYLIC ACID |
| 7431 | 4-BROMO-3-(CARBOXYMETHOXY)-5-[3-(CYCLOHEXYLAMINO)PHENYL]THIOPHENE-2-CARBOXYLIC ACID |
| 7432 | 4-BROMO-3-(CARBOXYMETHOXY)-5-PHENYLTHIOPHENE-2-CARBOXYLIC ACID |
| 7433 | 4-Bromo-3-Hydroxy-3-Methyl Butyl Diphosphate |
| 7434 | 4-bromo-6-(6-hydroxy-1,2-benzisoxazol-3-yl)benzene-1,3-diol |
| 7435 | 4-bromo-N'-[(1E)-(3,5-dibromo-2,4-dihydroxyphenyl)methylidene]benzohydrazide |
| 7436 | 4-Butyrolactone |
| 7437 | 4-Carbamoyl-4-{[6-(Difluoro-Phosphono-Methyl)-Naphthalene-2-Carbonyl]-Amino}-Butyric Acid |
| 7438 | 4-Carboxy-4-Aminobutanal |
| 7439 | 4-Carboxy-5-(1-Pentyl)Hexylsulfanyl-1,2,3-Triazole |
| 7440 | 4-Carboxycinnamic Acid |
| 7441 | 4-Carboxyphenylboronic Acid |
| 7442 | 4-CHLORO-3',3''-DIBROMOPHENOL-1,8-NAPHTHALEIN |
| 7443 | 4-CHLORO-6-(4-[4-(METHYLSULFONYL)BENZYL]PIPERAZIN-1-YL}-1H-PYRAZOL-5-YL)BENZENE-1,3-DIOL |
| 7444 | 4-CHLORO-6-(4-PIPERAZIN-1-YL-1H-PYRAZOL-5-YL)BENZENE-1,3-DIOL |
| 7445 | 4-chloro-6-{5-[(2-morpholin-4-ylethyl)amino]-1,2-benzisoxazol-3-yl}benzene-1,3-diol |
| 7446 | 4-CHLORO-8-METHYL-7-(3-METHYL-BUT-2-ENYL)-6,7,8,9-TETRAHYDRO-2H-2,7,9A-TRIAZA-BENZO[CD]AZULENE-1-THIONE |
| 7447 | 4-Chlorobenzoic Acid |
| 7448 | 4-chloro-N-(3-methoxypropyl)-N-[(3S)-1-(2-phenylethyl)piperidin-3-yl]benzamide |
| 7449 | 4-chloro-N'-[(1E)-(3,5-dibromo-2,4-dihydroxyphenyl)methylidene]benzohydrazide |
| 7450 | 4-chloro-N-[(2S)-2-methyl-2,3-dihydro-1H-indol-1-yl]-3-sulfamoylbenzamide |
| 7451 | 4'-Deaza-1'-Aza-2'-Deoxy-1'-(9-Methylene)-Immucillin-H, (3r,4r)-N-[9-Deazahypoxanthin-9-Yl)Methyl]-4-Hydroxymethyl-Pyrrolidin-3-Ol |
| 7452 | 4'-Deoxy-4'-Acetylamino-Pyridoxal-5'-Phosphate |
| 7453 | 4-Deoxy-4-Thio-Beta-D-Glucopyranose |
| 7454 | 4-Deoxy-Alpha-D-Glucose |
| 7455 | 4-Deoxy-D-Glucuronic Acid |
| 7456 | 4-Deoxy-D-Mannuronic Acid |
| 7457 | 4-Deoxyglucarate |
| 7458 | 4-Deoxylactose |
| 7459 | 4-Dimethylamino-N-(6-Hydroxycarbamoyethyl)Benzamide-N-Hydroxy-7-(4-DimethylaMinobenzoyl)Aminoheptanamide |
| 7460 | 4-Diphosphocytidyl-2-C-Methyl-D-Erythritol |
| 7461 | 4-Diphosphocytidyl-2-C-Methyl-D-Erythritol 2-Phosphate |
| 7462 | 4-ethyl-5-methyl-2-(1H-tetrazol-5-yl)-1,2-dihydro-3H-pyrazol-3-one |
| 7463 | 4-Flourobenzenesulfonamide |
| 7464 | 4'-FLUORO-1,1'-BIPHENYL-4-CARBOXYLIC ACID |
| 7465 | 4-Fluorobenzylamine |
| 7466 | 4-Fluorophenethyl Alcohol |
| 7467 | 4-Guanidinobenzoic Acid |
| 7468 | 4-Hydroxy-1,2,5-Oxadiazole-3-Carboxylic Acid |
| 7469 | 4-Hydroxy-1,2,5-Thiadiazole-3-Carboxylic Acid |
| 7470 | 4-Hydroxy-2-Butanone |
| 7471 | 4-Hydroxy-3,4-Dihydro-1h-Pyrimidin-2-One |
| 7472 | 4-Hydroxy-3,5-Dimethyl-5-(2-Methyl-Buta-1,3-Dienyl)-5h-Thiophen-2-One |
| 7473 | 4-Hydroxy-3-[(1s)-3-Oxo-1-Phenylbutyl]-2h-Chromen-2-One |
| 7474 | 4-Hydroxy-3-Methoxybenzoate |
| 7475 | 4-Hydroxy-3-Methyl Butyl Diphosphate |
| 7476 | 4-HYDROXY-3-NITROPHENYLACETYL-EPSILON-AMINOCAPROIC ACID ANION |
| 7477 | 4-HYDROXY-5-IODO-3-NITROPHENYLACETYL-EPSILON-AMINOCAPROIC ACID ANION |
| 7478 | 4-HYDROXY-7-METHOXY-3-(1-PHENYL-PROPYL)-CHROMEN-2-ONE |
| 7479 | 4-Hydroxy-Aconitate Ion |
| 7480 | 4-HYDROXYBENZALDEHYDE O-(3,3-DIMETHYLBUTANOYL)OXIME |
| 7481 | 4-HYDROXYBENZALDEHYDE O-(CYCLOHEXYLCARBONYL)OXIME |
| 7482 | 4-Hydroxybenzoyl Coenzyme A |
| 7483 | 4-Hydroxybenzyl Coenzyme A |
| 7484 | 4-Hydroxybutan-1-Aminium |
| 7485 | 4-hydroxycoumarin |
| 7486 | 4-Hydroxy-L-Threonine-5-Monophosphate |
| 7487 | 4-HYDROXY-N'-(4-ISOPROPYLBENZYL)BENZOHYDRAZIDE |
| 7488 | 4-HYDROXY-N-PROPARGYL-1(R)-AMINOINDAN |
| 7489 | 4-Hydroxyphenacyl Coenzyme A |
| 7490 | 4-Imino-5-Methidyl-2-Methylpyrimidine |
| 7491 | 4-Imino-5-Methidyl-2-Trifluoromethylpyrimidine |
| 7492 | 4-iodo-acetamido phenylboronic acid |
| 7493 | 4-Iodobenzo[B]Thiophene-2-Carboxamidine |

TABLE 1-continued

Ligands

| Ligand No. | Ligand Name |
|---|---|
| 7494 | 4-IODOPHENYLALANINE |
| 7495 | 4-Iodopyrazole |
| 7496 | 4-Methoxyamphetamine |
| 7497 | 4-Methoxy-E-Rhodomycin T |
| 7498 | 4-Methyl Valeric Acid |
| 7499 | 4-Methyl-1,2-Benzenediol |
| 7500 | 4-METHYL-2H-CHROMEN-2-ONE |
| 7501 | 4-METHYL-5-{(2E)-2-[(4-MORPHOLIN-4-YLPHENYL)IMINO]-2,5-DIHYDROPYRIMIDIN-4-YL}-1,3-THIAZOL-2-AMINE |
| 7502 | 4-Methyl-5-Hydroxyethylthiazole |
| 7503 | 4-Methyl-5-Hydroxyethylthiazole Phosphate |
| 7504 | 4-methyl-7,8-dihydro-5H-thiopyrano[4,3-d]pyrimidin-2-amine |
| 7505 | 4-Methyl-Histidine |
| 7506 | 4-Methylimidazole |
| 7507 | 4-METHYL-N-({5E)-5-[(5-METHYL-2-FURYL)METHYLENE]-4-OXO-4,5-DIHYDRO-1,3-THIAZOL-2-YL}BENZENESULFONAMIDE |
| 7508 | 4-METHYL-N-METHYL-N-(2-PHENYL-2H-PYRAZOL-3-YL)BENZENESULFONAMIDE |
| 7509 | 4-METHYL-PENTANOIC ACID {1-[4-GUANIDINO-1-(THIAZOLE-2-CARBONYL)-BUTYLCARBAMOYL]-2-METHYL-PROPYL}-AMIDE |
| 7510 | 4-Methylpiperazin-1-Yl Carbonyl Group |
| 7511 | 4-Methylthio-Alpha-D-Mannose |
| 7512 | 4-Methylumbelliferyl Chitobiose |
| 7513 | 4-Morpholin-4-Yl-Piperidine-1-Carboxylic Acid [1-(3-Benzenesulfonyl-1-Propyl-Allylcarbamoyl)-2-Phenylethyl]-Amide |
| 7514 | 4-NITRO-BENZYLPHOSPHONOBUTANOYL-GLYCINE |
| 7515 | 4-Nitrophenyl Phosphate |
| 7516 | 4-NITROPHENYL-(6-S-ALPHA-D-XYLOPYRANOSYL)-BETA-D-GLUCOPYRANOSIDE |
| 7517 | 4-Nitrophenyl-Ara |
| 7518 | 4-O-(4,6-Dideoxy-4-([4,5,6-Trihydroxy-3-(Hydroxymethyl)Cyclohex-2-En-1-Yl]Amino}-Beta-D-Lyxo-Hexopyranosyl)-Alpha-D-Erythro-Hexopyranose |
| 7519 | 4-O-(4,6-Dideoxy-4-{[4-[(4-O-Hexopyranosylhexopyranosyl)Oxy]-5,6-Dihydroxy-3-(Hydroxymethyl)Cyclohex-2-En-1-Yl]Amino}Hexopyranosyl)Hexopyranose |
| 7520 | 4-O-Methyl-Alpha-D-Glucuronic Acid |
| 7521 | 4-O-Methyl-Beta-D-Glucuronic Acid |
| 7522 | 4-Oxo-2-Phenylmethanesulfonyl-Octahydro-Pyrrolo[1,2-a]Pyrazine-6-Carboxylic Acid [1-(N-Hydroxycarbamimidoyl)-Piperidin-4-Ylmethyl]-Amide |
| 7523 | 4-Oxo-Nicotinamide-Adenine Dinucleotide Phosphate |
| 7524 | 4-Oxosebacic Acid |
| 7525 | 4-PHENOXY-N-(PYRIDIN-2-YLMETHYL)BENZAMIDE |
| 7526 | 4-Phenyl-1h-Imidazole |
| 7527 | 4-Phenylbutylamine |
| 7528 | 4-Phospho-D-Erythronate |
| 7529 | 4-Phospho-D-Erythronohydroxamic Acid |
| 7530 | 4-PHOSPHONOOXY-PHENYL-METHYL-[4-PHOSPHONOOXY]BENZEN |
| 7531 | 4-Phosphopantetheine |
| 7532 | 4-PIPERIDIN-4-YLBUTANAL |
| 7533 | 4-Piperidino-Piperidine |
| 7534 | 4r-Fluoro-N6-Ethanimidoyl-L-Lysine |
| 7535 | 4sc-203 |
| 7536 | 4-Sulfonamide-[1-(4-Aminobutane)]Benzamide |
| 7537 | 4-Sulfonamide-[4-(Thiomethylaminobutane)]Benzamide |
| 7538 | 4-TERT-BUTYLBENZENESULFONIC ACID |
| 7539 | 4-tert-butyl-N'-[(1E)-(3,5-dibromo-2,4-dihydroxyphenyl)methylidene]benzohydrazide |
| 7540 | 4-Thio-Beta-D-Glucopyranose |
| 7541 | 4-Thio-D-Glucose |
| 7542 | 4-(14-DIAZEPAN-1-SULFONYL)ISOQUINOLINE |
| 7543 | 5-(1-Carboxy-1-Phosphonooxy-Ethoxyl)-Shikimate-3-Phosphate |
| 7544 | 5-(2,3-dichlorophenyl)-N-(pyridin-4-ylmethyl)-3-thiocyanatopyrazolo[1,5-a]pyrimidin-7-amine |
| 7545 | 5-(2,5-DICHLOROPHENYL)-2-FUROIC ACID |
| 7546 | 5-(2,6-dichlorophenyl)-2-[(2,4-difluorophenyl)sulfanyl]-6H-pyrimido[1,6-b]pyridazin-6-one |
| 7547 | 5-(2-CHLORO-4-NITROPHENYL)-2-FUROIC ACID |
| 7548 | 5-(2-CHLOROBENZYL)-2-FUROIC ACID |
| 7549 | 5-(2-chlorophenyl)-1,3,4-thiadiazole-2-sulfonamide |
| 7550 | 5-(2-chlorophenyl)furan-2-carbohydrazide |
| 7551 | 5-(2-Chlorophenyl)Furan-2-Carboxylic Acid |
| 7552 | 5-(2-ETHOXYETHYL)-5-[4-(4-FLUOROPHENOXY)PHENOXY]PYRIMIDINE-2,4,6(1H,3H,5H)-TRIONE |
| 7553 | 5-(2-hydroxyethyl)nonane-1,9-diol |
| 7554 | 5-(2-METHOXYPHENYL)-2-FUROIC ACID |
| 7555 | 5-(2-NITROPHENYL)-2-FUROIC ACID |
| 7556 | 5-(2-PHENYLPYRAZOLO[1,5-A]PYRIDIN-3-YL)-1H-PYRAZOLO[3,4-C]PYRIDAZIN-3-AMINE |
| 7557 | 5-(3-(2,6-dichloro-4-(4,5-dihydro-2-oxazolyl)phenoxy)propyl)-3-methyl isoxazole |
| 7558 | 5-(3,5-DICHLOROPHENYL)THIO-4-ISOPROPYL-1-(PYRIDIN-4-YL-METHYL)-1H-IMIDAZOL-2-YL-METHYL CARBAMATE |
| 7559 | 5-(3-{3-[3-HYDROXY-2-(METHOXYCARBONYL)PHENOXY]PROPENYL}PHENYL)-4-(HYDROXYMETHYL)ISOXAZOLE-3-CARBOXYLIC ACID |
| 7560 | 5-(3-Amino-4,4-Dihydroxy-Butylsulfanylmethyl)-Tetrahydro-Furan-2,3,4-Triol |
| 7561 | 5-(3-HYDROXYPHENYL)ISOTHIAZOL-3(2H)-ONE 1,1-DIOXIDE |
| 7562 | 5-(4'-AMINO-1'-ETHYL-5',8'-DIFLUORO-1'H-SPIRO[PIPERIDINE-4,2'-QUINAZOLINE]-1-YLCARBONYL)PICOLINONITRILE |
| 7563 | 5-(4-CHLORO-5-PHENYL-3-THIENYL)-1,2,5-THIADIAZOLIDIN-3-ONE 1,1-DIOXIDE |
| 7564 | 5-(4-CYANOPHENYL)-3-{[(2-METHYLPHENYL)SULFONYL]AMINO}THIOPHENE-2-CARBOXYLIC ACID |
| 7565 | 5-(4-FLUOROPHENYL)-3-{[(4-METHYLPHENYL)SULFONYL]AMINO}THIOPHENE-2-CARBOXYLIC ACID |
| 7566 | 5-(4-METHOXYBIPHENYL-3-YL)-1,2,5-THIADIAZOLIDIN-3-ONE 1,1-DIOXIDE |
| 7567 | 5-(4-Methoxyphenoxy)-2,4-Quinazolinediamine |
| 7568 | 5-(4-METHYL-BENZOYLAMINO)-BIPHENYL-3,4'-DICARBOXYLIC ACID 3-DIMETHYLAMIDE-4'-HYDROXYAMIDE |
| 7569 | 5-(4-Morpholin-4-Yl-Phenylsulfanyl)-2,4-Quinazolinediamine |
| 7570 | 5-(4-PHENOXYPHENYL)-5-(4-PYRIMIDIN-2-YLPIPERAZIN-1-YL)PYRIMIDINE-2,4,6(2H,3H)-TRIONE |
| 7571 | 5-(5-(2,6-DICHLORO-4-(4,5-DIHYDRO-2-OXAZOLY)PENTYL)-3-METHYL ISOXAZOLE |
| 7572 | 5-(5-(2,6-dichloro-4-(4,5-dihydro-2-oxazolyl)phenoxy)pentyl)-3-(hydroxyethyl oxymethyleneoxymethyl) isoxazole |
| 7573 | 5-(5-(4-(4,5-dihydro-2-oxazoly)phenoxy)pentyl)-3-methyl osoxazole |
| 7574 | 5-(5-(4-(5-hydro-4-methyl-2-oxazolyl)phenoxy)pentyl)-3-methyl isoxazole |
| 7575 | 5-(5-(6-CHLORO-4-(4,5-DIHYDRO-2-OXAZOLYL)PHENOXY)PENTYL)-3-METHYL ISOXAZOLE |
| 7576 | 5-(5-CHLORO-2,4-DIHYDROXYPHENYL)-N-ETHYL-4-(4-METHOXYPHENYL)-1H-PYRAZOLE-3-CARBOXAMIDE |
| 7577 | 5-(5-CHLORO-2,4-DIHYDROXYPHENYL)-N-ETHYL-4-(4-METHOXYPHENYL)ISOXAZOLE-3-CARBOXAMIDE |
| 7578 | 5-(5-chloro-2,4-dihydroxyphenyl)-N-ethyl-4-[4-(morpholin-4-ylmethyl)phenyl]isoxazole-3-carboxamide |
| 7579 | 5-(5-CHLORO-2,4-DIHYDROXYPHENYL)-N-ETHYL-4-PIPERAZIN-1-YL-1H-PYRAZOLE-3-CARBOXAMIDE |
| 7580 | 5-(5-CHLORO-2-THIENYL)-N-{(3S)-1-[(1S)-1-METHYL-2-MORPHOLIN-4-YL-2-OXOETHYL]-2-OXOPYRROLIDIN-3-YL}-1H-1,2,4-TRIAZOLE-3-SULFONAMIDE |

TABLE 1-continued

Ligands

| Ligand No. | Ligand Name |
|---|---|
| 7581 | 5-(5-chloro-7H-pyrrolo[2,3-d]pyrimidin-4-yl)-4,5,6,7-tetrahydro-1H-imidazo[4,5-c]pyridine |
| 7582 | 5-(7-(4-(4,5-dihydro-2-oxazolyl)phenoxy)heptyl)-3-methyl isoxazole |
| 7583 | 5-(7-(5-hydro-4-ethyl-2-oxazolyl)phenoxy)heptyl)-3-methyl isoxazole |
| 7584 | 5-(7-(5-hydro-4-methyl-2-oxazolyl)phenoxy)heptyl)-3-methyl isoxazole |
| 7585 | 5-(7-(6-chloro-4-(5-hydro-4-methyl-2-oxazolyl)phenoxy)heptyl)-3-methyl isoxazole |
| 7586 | 5-(AMINOCARBONYL)-1,1':4',1''-TERPHENYL-3-CARBOXYLICACID |
| 7587 | 5-(Aminomethyl)-6-(2,4-Dichlorophenyl)-2-(3,5-Dimethoxyphenyl)Pyrimidin-4-Amine |
| 7588 | 5-(DIMETHYLAMINO)-1-NAPHTHALENESULFONIC ACID(DANSYL ACID) |
| 7589 | 5-(DIMETHYLAMINO)-2-NAPHTHALENESULFONIC ACID |
| 7590 | 5-(dodecylthio)-1H-1,2,3-triazole-4-carboxylic acid |
| 7591 | 5-(HEXAHYDRO-2-OXO-1H-THIENO[3,4-D]IMIDAZOL-6-YL)PENTANAL |
| 7592 | 5-(PARA-NITROPHENYL PHOSPHONATE)-PENTANOIC ACID |
| 7593 | 5(R)-5-Fluoro-Beta-D-Xylopyranosyl-Enzyme Intermediate |
| 7594 | 5,10-Dideazatetrahydrofolic Acid |
| 7595 | 5,10-Dimethylene Tetrahydromethanopterin |
| 7596 | 5,10-Methylene-6-Hydrofolic Acid |
| 7597 | 5,5-dimethyl-2-morpholin-4-yl-5,6-dihydro-1,3-benzothiazol-7(4H)-one |
| 7598 | 5,6,7,8,9,10-HEXAHYDRO-4-HYDROXY-3-(1-PHENYLPROPYL)CYCLOOCTA[B]PYRAN-2-ONE |
| 7599 | 5,6,7,8-TETRAHYDRO[1]BENZOTHIENO[2,3-D]PYRIMIDIN-4(3H)-ONE |
| 7600 | 5,6-Cyclic-Tetrahydropteridine |
| 7601 | 5,6-dichloro-1-beta-D-ribofuranosyl-1H-benzimidazole |
| 7602 | 5,6-Dihydro-Benzo[H]Cinnolin-3-Ylamine |
| 7603 | 5,6-Dihydroxy-Nadp |
| 7604 | 5,6-Dimethylbenzimidazole |
| 7605 | 5,6-DIPHENYL-N-(2-PIPERAZIN-1-YLETHYL)FURO[2,3-D]PYRIMIDIN-4-AMINE |
| 7606 | 5,7-DIHYDROXY-2-(3,4,5-TRIHYDROXYPHENYL)-4H-CHROMEN-4-ONE |
| 7607 | 5,7-dihydroxy-2-(4-hydroxyphenyl)-4H-chromen-4-one |
| 7608 | 5,8-Di-Amino-1,4-Dihydroxy-Anthraquinone |
| 7609 | 5,8-dimethoxy-1,4-dimethylquinolin-2(1H)-one |
| 7610 | 5-[(1S)-1-(3-chlorophenyl)ethoxy]quinazoline-2,4-diamine |
| 7611 | 5-[(2-AMINOETHYL)AMINO]-6-FLUORO-3-(1H-PYRROL-2-YL)BENZO[CD]INDOL-2(1H)-ONE |
| 7612 | 5-[(2-methyl-5-{[3-(trifluoromethyl)phenyl]carbamoyl}phenyl)amino]pyridine-3-carboxamide |
| 7613 | 5-[(3AS,4R,6AR)-2-OXOHEXAHYDRO-1H-THIENO[3,4-D]IMIDAZOL-4-YL]PENTANOIC ACID |
| 7614 | 5-[(3R)-3-(5-methoxy-2',6'-dimethylbiphenyl-3-yl)but-1-yn-1-yl]-6-methylpyrimidine-2,4-diamine |
| 7615 | 5-[(3R)-3-(5-methoxy-3',5'-dimethylbiphenyl-3-yl)but-1-yn-1-yl]-6-methylpyrimidine-2,4-diamine |
| 7616 | 5-[(3R)-3-(5-methoxy-4'-methylbiphenyl-3-yl)but-1-yn-1-yl]-6-methylpyrimidine-2,4-diamine |
| 7617 | 5-[(3R)-3-(5-methoxybiphenyl-3-yl)but-1-yn-1-yl]-6-methylpyrimidine-2,4-diamine |
| 7618 | 5-[(3S)-3-(2-methoxybiphenyl-4-yl)but-1-yn-1-yl]-6-methylpyrimidine-2,4-diamine |
| 7619 | 5-[(4-AMINOCYCLOHEXYL)AMINO]-7-(PROPAN-2-YLAMINO)PYRAZOLO[1,5-A]PYRIMIDINE-3-CARBONITRILE |
| 7620 | 5-[(4-Methylphenyl)Sulfanyl]-2,4-Quinazolinediamine |
| 7621 | 5-[(5-fluoro-3-methyl-1H-indazol-4-yl)oxy]benzene-1,3-dicarbonitrile |
| 7622 | 5-[(E)-(5-CHLORO-2-OXO-1,2-DIHYDRO-3H-INDOL-3-YLIDENE)METHYL]-N-[2-(DIETHYLAMINO)ETHYL]-2,4-DIMETHYL-1H-PYRROLE-3-CARBOXAMIDE |
| 7623 | 5-[(phenylsulfonyl)amino]-1,3,4-thiadiazole-2-sulfonamide |
| 7624 | 5-[(Z)-(5-CHLORO-2-OXO-1,2-DIHYDRO-3H-INDOL-3-YLIDENE)METHYL]-N-(DIETHYLAMINO)ETHYL]-2,4-DIMETHYL-1H-PYRROLE-3-CARBOXAMIDE |
| 7625 | 5-[[(2R)-2-cyclopropyl-7,8-dimethoxy-2H-chromen-5-yl]methyl]pyrimidine-2,4-diamine |
| 7626 | 5-[[(2R)-2-cyclopropyl-7,8-dimethoxy-chroman-5-yl]methyl]pyrimidine-2,4-diamine |
| 7627 | 5-[1-(3,4-Dimethoxy-Benzoyl)-1,2,3,4-Tetrahydro-Quinolin-6-Yl]-6-Methyl-3,6-Dihydro-[1,3,4]Thiadiazin-2-One |
| 7628 | 5-[1-(4-methoxyphenyl)-1H-benzimidazol-6-yl]-1,3,4-oxadiazole-2(3H)-thione |
| 7629 | 5-[1-(Acetylamino)-3-Methylbutyl]-2,5-Anhydro-3,4-Dideoxy-4-(Methoxycarbonyl)Pentonic Acid |
| 7630 | 5-[2-(1H-pyrrol-1-yl)ethoxy]-1H-indole |
| 7631 | 5-[2-(4-hydroxyphenyl)ethyl]benzene-1,3-diol |
| 7632 | 5-[2-(TRIFLUOROMETHOXY)PHENYL]-2-FUROIC ACID |
| 7633 | 5-[2-(TRIFLUOROMETHYL)PHENYL]-2-FUROIC ACID |
| 7634 | 5-[2,3-Dichloro-4-(5-{1-[2-(2-Guanidino-4-Methyl-Pentanoylamino)-Acetyl]-Piperidin-4-Yl}-1-Methyl-1h-Pyrazol-3-Yl)-Phenoxymethyl]-Furan-2-Carboxylic Acid |
| 7635 | 5-[2-CHLORO-4-(TRIFLUOROMETHYL)PHENOXY]-2-NITROBENZOIC ACID |
| 7636 | 5-[3-(2,5-dimethoxyphenyl)prop-1-yn-1-yl]-6-ethylpyrimidine-2,4-diamine |
| 7637 | 5-[3-(2-METHOXYPHENYL)-1H-PYRROLO[2,3-B]PYRIDIN-5-YL]-N,N-DIMETHYLPYRIDINE-3-CARBOXAMIDE |
| 7638 | 5-[3-(BENZYLAMINO)PHENYL]-4-BROMO-3-(CARBOXYMETHOXY)THIOPHENE-2-CARBOXYLIC ACID |
| 7639 | 5-[4-(1-Carboxymethyl-2-Oxo-Propylcarbamoyl)-Benzylsulfamoyl]-2-Hydroxy-Benzoic Acid |
| 7640 | 5-[4-(DIMETHYLAMINO)PHENYL]-6-[(6-MORPHOLIN-4-YLPYRIDIN-3-YL)ETHYNYL]PYRIMIDIN-4-AMINE |
| 7641 | 5-[4-Tert-Butylphenylsulfanyl]-2,4-Quinazolinediamine |
| 7642 | 5-[5,6-BIS(METHYLOXY)-1H-BENZIMIDAZOL-1-YL]-3-{[1-(2-CHLOROPHENYL)ETHYL]OXY}-2-THIOPHENECARBOXAMIDE |
| 7643 | 5-[Bis-2(Chloro-Ethyl)-Amino]-2,4-Dintro-Benzamide |
| 7644 | 5-{[(2-Amino-9h-Purin-6-Yl)Oxy]Methyl}-2-Pyrrolidinone |
| 7645 | 5-{[(4-AMINO-3-CHLORO-5-FLUOROPHENYL)SULFONYL]AMINO}-1,3,4-THIADIAZOLE-2-SULFONAMIDE |
| 7646 | 5-{[1-(2,3-dichlorobenzyl)piperidin-4-yl]methoxy}quinazoline-2,4-diamine |
| 7647 | 5-{[1-(2-fluorobenzyl)piperidin-4-yl]methoxy}quinazoline-2,4-diamine |
| 7648 | 5'-{[4-(aminooxy)butyl](methyl)amino}-5'-deoxy-8-ethenyladenosine |
| 7649 | 5-{2-[1-(1-METHYL-PROPYL)-7A-METHYL-OCTAHYDRO-INDEN-4-YLIDENE]-ETHYLIDENE}-2-METHYLENE-CYCLOHEXANE-1,3-DIOL |
| 7650 | 5-{3-[3-(2,4-DICHLORO-BENZOYL)-UREIDO]-2-METHYL-PHENOXY}-PENTANOIC ACID |
| 7651 | 5-{4-[(3,5-DIFLUOROBENZYL)AMINO]PHENYL}-6-ETHYLPYRIMIDINE-2,4-DIAMINE |
| 7652 | 5-ACETAMIDO-5,6-DIHYDRO-4-HYDROXY-6-ISOBUTOXY-4H-PYRAN-2-CARBOXYLIC ACID |
| 7653 | 5'-ACETYL-4-{[(2,4-DIMETHYLPHENYL)SULFONYL]AMINO}-2,2'-BITHIOPHENE-5-CARBOXYLIC ACID |
| 7654 | 5-Alpha-Androstane-3-Beta,17beta-Diol |
| 7655 | 5-ALPHA-PREGNANE-3-BETA-OL-HEMISUCCINATE |
| 7656 | 5-Amidino-Benzimidazole |
| 7657 | 5-amino-1-(4-chlorophenyl)-1H-pyrazole-4-carbonitrile |
| 7658 | 5-Amino-1h-Pyrimidine-2,4-Dione |
| 7659 | 5-amino-2,4,6-tribromobenzene-1,3-dicarboxylic acid |
| 7660 | 5-AMINO-2-{4-[(4-AMINOPHENYL)SULFANYL]PHENYL}-1H-ISOINDOLE-1,3(2H)-DIONE |
| 7661 | 5-amino-2-methyl-N-[(1R)-1-naphthalen-1-ylethyl]benzamide |

TABLE 1-continued

Ligands

| Ligand No. | Ligand Name |
|---|---|
| 7662 | 5-AMINO-3-{[4-(AMINOSULFONYL)PHENYL]AMINO}-N-(2,6-DIFLUOROPHENYL)-1H-1,2,4-TRIAZOLE-1-CARBOTHIOAMIDE |
| 7663 | 5-AMINO-6-CYCLOHEXYL-4-HYDROXY-2-ISOBUTYL-HEXANOIC ACID |
| 7664 | 5-AMINO-6-CYCLOHEXYL-4-HYDROXY-2-ISOPROPYL-HEXANOIC ACID |
| 7665 | 5-Aminocarbonyl-3-Nitrophenyl-Alpha-D-Galactopyranose |
| 7666 | 5-Aminoimidazole Ribonucleoside |
| 7667 | 5-Aminoisoquinoline |
| 7668 | 5-AMINO-NAPHTALENE-2-MONOSULFONATE |
| 7669 | 5-benzyl-1,3-thiazol-2-amine |
| 7670 | 5-BETA-ANDROSTANE-3,17-DIONE |
| 7671 | 5-beta-DIHYDROTESTOSTERONE |
| 7672 | 5-Beta-D-Ribofuranosylnicotinamide Adenine Dinucleotide |
| 7673 | 5-BROMO-2-{[(4-CHLOROPHENYL)SULFONYL]AMINO)BENZOIC ACID |
| 7674 | 5-Bromo-2'-Deoxyuridine-5'-Monophosphate |
| 7675 | 5-bromo-3-(pyrrolidin-1-ylsulfonyl)-1H-indole-2-carboxamide |
| 7676 | 5-Bromo-N-(2,3-Dihydroxypropoxy)-3,4-Difluoro-2-[(2-Fluoro-4-Iodophenyl)Amino]Benzamide |
| 7677 | 5-bromo-N-(3-chloro-2-(4-(prop-2-ynyl)piperazin-1-yl)phenyl)furan-2-carboxamide |
| 7678 | 5-Bromonicotinamide |
| 7679 | 5-Bromothienyldeoxyuridine |
| 7680 | 5-Bromovinyldeoxyuridine |
| 7681 | 5-Chloro-1h-Indole-2-Carboxylic Acid [1-(4-Fluorobenzyl)-2-(4-Hydroxypiperidin-1yl)-2-Oxoethyl]Amide |
| 7682 | 5-Chloro-1h-Indole-2-Carboxylic Acid{[Cyclopentyl-(2-Hydroxy-Ethyl)-Carbamoyl]-Methyl}-Amide |
| 7683 | 5-Chloro-6-[(2-Iminopyrrolidin-1-Yl)Methyl]Pyrimidine-2,4(1h,3h)-Dione |
| 7684 | 5-CHLORO-6-METHYL-N-(2-PHENYLETHYL)-2-PYRIDIN-2-YLPYRIMIDIN-4-AMINE |
| 7685 | 5-chloro-7-[(1-methylethyl)amino]pyrazolo[1,5-a]pyrimidine-3-carbonitrile |
| 7686 | 5-CHLORO-8-METHYL-7-(3-METHYL-BUT-2-ENYL)-6,7,8,9-TETRAHYDRO-2H-2,7,9A-TRIAZA-BENZO[CD]AZULENE-1-THIONE |
| 7687 | 5-CHLORO-N-((1R,2S)-2-(4-(2-OXOPYRIDIN-1(2H)-YL)BENZAMIDO) CYCLOPENTYL)THIOPHENE-2-CARBOXAMIDE |
| 7688 | 5-chloro-N-({(5S)-2-oxo-3-[4-(3-oxomorpholin-4-yl)phenyl]-1,3-oxazolidin-5-yl}methyl)thiophene-2-carboxamide |
| 7689 | 5-CHLORO-N-(2-(4-(2-OXOPYRIDIN-1(2H)-YL)BENZAMIDO)ETHYL)THIOPHENE-2-CARBOXAMIDE |
| 7690 | 5-chloro-N-[(3R)-1-(2-{[2-fluoro-4-(2-oxopyridin-1(2H)-yl)phenyl]amino}-2-oxoethyl)pyrrolidin-3-yl]thiophene-2-carboxamide |
| 7691 | 5-CHLORO-N-((3S)-1-[(1S)-1-METHYL-2-MORPHOLIN-4-YL-2-5-CHLORO-N-{(3S)-1-[(1S)-1-METHYL-2-MORPHOLIN-4-YL-2-SULFONAMIDE |
| 7692 | 5-CHLORO-N-{(3S)-1-[(1S)-1-METHYL-2-MORPHOLIN-4-YL-2-OXOETHYL]-2-OXOPYRROLIDIN-3-YL}-1-BENZOTHIOPHENE-2-SULFONAMIDE |
| 7693 | 5-chloro-N-{4-[(1R)-1,2-dihydroxyethyl]phenyl}-1H-indole-2-carboxamide |
| 7694 | 5-Chloro-thiophene-2-carboxylic acid ((3S,4S)-1-{[2-fluoro-4-(2-oxo-2H-pyridin-1-yl)-phenylcarbamoyl]-methyl}-4-hydroxy-pyrrolidin-3-yl)-amide |
| 7695 | 5-CHLORO-THIOPHENE-2-CARBOXYLIC ACID ((3S,4S)-4-FLUORO- 1-{2-FLUORO-4-(2-OXO-2H-PYRIDIN-1-YL)-PHENYLCARBAMOYL]-METHYL}-PYRROLIDIN-3-YL)-AMIDE |
| 7696 | 5-Chloryl-2,4,6-Quinazolinetriamine |
| 7697 | 5-CYANO-FURAN-2-CARBOXYLIC ACID [5-HYDROXYMETHYL-2-(4-METHYL-PIPERIDIN-1-YL)-PHENYL]-AMIDE |
| 7698 | 5-CYANO-N-(2,5-DIMETHOXYBENZYL)-6-ETHOXYPYRIDINE-2-CARBOXAMIDE |
| 7699 | 5-cyclopropyl-2-(4-fluorophenyl)-6-[(2-hydroxyethyl)(methylsulfonyl)amino]-N-methyl-1-benzofuran-3-carboxamide |
| 7700 | 5'-Deoxy-5'-(Methylthio)-Tubercidin |
| 7701 | 5'-Deoxy-5'-Methylthioadenosine |
| 7702 | 5'-deoxy-5'-piperidin-1-ylthymidine |
| 7703 | 5-ethoxy-4-(1-methyl-7-oxo-3-propyl-6,7-dihydro-1H-pyrazolo[4,3-d]pyrimidin-5-yl)thiophene-2-sulfonamide |
| 7704 | 5-ETHYL-3-[(2-METHOXYETHYL)METHYLAMINO]-6-METHYL-4-(3-METHYLBENZYL)PYRIDIN-2(1H)-ONE |
| 7705 | 5-ETHYL-3-METHYL-1,5-DIHYDRO-4H-PYRAZOLO[4,3-C]QUINOLIN-4-ONE |
| 7706 | 5-Exo-Hydroxycamphor |
| 7707 | 5-FLUORO-1-[4-(4-PHENYL-3,6-DIHYDROPYRIDIN-1(2H)-YL)BUTYL]QUINAZOLINE-2,4(1H,3H)-DIONE |
| 7708 | 5'-FLUORO-2',5'-DIDEOXYADENOSINE |
| 7709 | 5-Fluoro-2'-Deoxyuridine-5'-Monophosphate |
| 7710 | 5-Fluoro-4-(S)-Hydroxy-3,4-Dihydropyrimidine |
| 7711 | 5'-Fluoro-5'-Deoxyadenosine |
| 7712 | 5-Fluoro-Beta-L-Gulosyl Fluoride |
| 7713 | 5-FLUOROINDOLE PROPANOL PHOSPHATE |
| 7714 | 5-Fluorolevulinic Acid |
| 7715 | 5-Fluorouridine |
| 7716 | 5-Formyl-5,6,7,8-Tetrahydrofolate |
| 7717 | 5-Formyl-6-Hydrofolic Acid |
| 7718 | 5'-Guanosine-Diphosphate-Monothiophosphate |
| 7719 | 5-HEPTYL-6-HYDROXY-1,3-BENZOTHIAZOLE-4,7-DIONE |
| 7720 | 5-HYDROXY-2-(4-HYDROXYPHENYL)-1-BENZOFURAN-7-CARBONITRILE |
| 7721 | 5-HYDROXY-3-[(1R)-1-(1H-PYRROL-2-YL)ETHYL]-2H-INDOL-2-ONE |
| 7722 | 5-hydroxy-4-(7-methoxy-1,1-dioxido-2H-1,2,4-benzothiadiazin-3-yl)-2-(3-methylbutyl)-6-phenylpyridazin-3(2H)-one |
| 7723 | 5-Hydroxymethyl-Chonduritol |
| 7724 | 5-Hydroxymethylene-6-Hydrofolic Acid |
| 7725 | 5-Hydroxymethyluridine-2'-Deoxy-5'-Monophosphate |
| 7726 | 5-hydroxynaphthalene-1-sulfonamide |
| 7727 | 5-Hydroxy-N-Propargyl-1(R)-Aminoindan |
| 7728 | 5-hydroxyvaleric acid |
| 7729 | 5-IMINO-4-(2-TRIFLUOROMETHYL-PHENYLAZO)-5H-PYRAZOL-3-YLAMINE |
| 7730 | 5-imino-4-(3-trifluoromethyl-phenylazo)-5H-pyrazol-3-ylamine |
| 7731 | 5-Iodo-2'-Deoxyuridine-5'-Monophosphate |
| 7732 | 5-iodotubercidin |
| 7733 | 5-Iodouracil |
| 7734 | 5-Mercapto-2-Nitro-Benzoic Acid |
| 7735 | 5-Mercaptoethanol-2-Decenoyl-Coenzyme A |
| 7736 | 5-Methoxy-1,2-Dimethyl-3-(4-Nitrophenoxymethyl)Indole-4,7-Dione |
| 7737 | 5-Methoxy-1,2-Dimethyl-3-(Phenoxymethyl)Indole-4,7-Dione |
| 7738 | 5-Methoxybenzimidazole |
| 7739 | 5-METHYL-2-[(PHENYLSULFONYL)AMINO]BENZOIC ACID |
| 7740 | 5-Methyl-2'-Deoxypseudouridine |
| 7741 | 5-METHYL-3-(9-OXO-1,8-DIAZA-TRICYCLO[10.6.1.013,18]NONADECA-12(19),13,15,17-TETRAEN-10-YLCARBAMOYL)-HEXANOIC ACID |
| 7742 | 5-Methyl-5-(4-Phenoxy-Phenyl)-Pyrimidine-2,4,6-Trione |
| 7743 | 5-Methyl-5,6,7,8-Tetrahydrofolic Acid |
| 7744 | 5-methyl-6-phenylquinazoline-2,4-diamine |
| 7745 | 5-methylbenzimidazole |
| 7746 | 5-methyl-N-[4-(trifluoromethyl)phenyl][1,2,4]triazolo[1,5-a]pyrimidin-7-amine |
| 7747 | 5-Methylpyrrole |
| 7748 | 5-methyltetrahydrofolate |
| 7749 | 5-Methyluridine 5'-Monophosphate |
| 7750 | 5-Monophosphate-9-Beta-D-Ribofuranosyl Xanthine |
| 7751 | 5-N-Acetyl-3-(1-Ethylpropyl)-1-Cyclohexene-1-Carboxylic Acid |
| 7752 | 5-N-Acetyl-4-Amino-6-Diethylcarboxamide-4,5-Dihydro-2h-Pyran-2-Carboxylic Acid |
| 7753 | 5-N-Acetyl-Alpha-D-Neuraminic Acid |
| 7754 | 5-N-Allyl-Arginine |

TABLE 1-continued

Ligands

| Ligand No. | Ligand Name |
|---|---|
| 7755 | 5-Nitro-6-Ribityl-Amino-2,4(1h,3h)-Pyrimidinedione |
| 7756 | 5-Nitroindazole |
| 7757 | 5-Nitroso-6-Ribityl-Amino-2,4(1h,3h)-Pyrimidinedione |
| 7758 | 5-n-undecyl-6-hydroxy-4,7-dioxobenzothiazole |
| 7759 | '5'-O-(N-(L-Alanyl)-Sulfamoyl)Adenosine |
| 7760 | 5'-O-(N-(L-Cysteinyl)-Sulfamoyl)Adenosine |
| 7761 | '5'-O-(N-(L-Prolyl)-Sulfamoyl)Adenosine |
| 7762 | 5'-O-(N-(L-Seryl)-Sulfamoyl)Adenosine |
| 7763 | 5'-O-(N-(L-Threonyl)-Sulfamoyl)Adenosine |
| 7764 | 5'-O-(N-Ethyl-Sulfamoyl)Adenosine |
| 7765 | 5'-O-[(L-Methionyl)-Sulphamoyl]Adenosine |
| 7766 | 5-Oxo-L-Norleucine |
| 7767 | 5-Oxo-Pyrrolidine-2-Carbaldehyde |
| 7768 | 5-PENTYL-2-PHENOXYPHENOL |
| 7769 | 5-phenyl-1H-indazol-3-amine |
| 7770 | 5-PHENYL-2-KETO-VALERIC ACID |
| 7771 | 5-Phenylsulfanyl-2,4-Quinazolinediamine |
| 7772 | 5-Phenylvaleric Acid |
| 7773 | 5-Phosphoarabinonic Acid |
| 7774 | 5-Phospho-D-Arabinohydroxamic Acid |
| 7775 | 5-Phosphoribosyl-1-(Beta-Methylene) Pyrophosphate |
| 7776 | 5-QUINOXALIN-6-YLMETHYLENE-THIAZOLIDINE-2,4-DIONE |
| 7777 | 5R-(3,4-DICHLOROPHENYLMETHYL)-3-(2-THIOPHENESULFONYLAMINO)-4-OXO-2-THIONOTHIAZOLIDINE |
| 7778 | 5'-S-[2-(decylamino)ethyl]-5'-thioadenosine |
| 7779 | 5'-S-ethyl-5'-thioadenosine |
| 7780 | 5-Thio-a/B-D-Mannopyranosylamine |
| 7781 | 6((S)-3-Benzylpiperazin-1-Yl)-3-(Naphthalen-2-Yl)-4-(Pyridin-4-Yl)Pyrazine |
| 7782 | 6-({5-fluoro-2-[(3,4,5-trimethoxyphenyl)amino]pyrimidin-4-yl}amino)-2,2-dimethyl-2H-pyrido[3,2-b][1,4]oxazin-3(4H)-one |
| 7783 | 6-(1,1-Dimethylallyl)-2-(1-Hydroxy-1-Methylethyl)-2,3-Dihydro-7h-Furo[3,2-G]Chromen-7-One |
| 7784 | 6-(2,4-DIAMINO-6-ETHYLPYRIMIDIN-5-YL)-4-(3-METHOXYPROPYL)-2,2-DIMETHYL-2H-1,4-BENZOXAZIN-3(4H)-ONE |
| 7785 | 6-(2,5-Dimethoxy-Benzyl)-5-Methyl-Pyrido[2,3-D]Pyrimidine-2,4-Diamine |
| 7786 | 6-(2,6-dibromophenyl)pyrido[2,3-d]pyrimidine-2,7-diamine |
| 7787 | 6-(2,6-DICHLOROPHENYL)-2-{[3-(HYDROXYMETHYL)PHENYL]AMINO}-8-METHYLPYRIDO[2,3-D]PYRIMIDIN-7(8H)-ONE |
| 7788 | 6-(2,6-DIMETHOXYPHENYL)PYRIDO[2,3-D]PYRIMIDINE-2,7-DIAMINE |
| 7789 | 6-(2-fluorobenzyl)-2,4-dimethyl-4,6-dihydro-5H-thieno[2',3':4,5]pyrrolo[2,3-d]pyridazin-5-one |
| 7790 | 6-(2-HYDROXY-CYCLOPENTYL)-7-OXO-HEPTANAMIDINE |
| 7791 | 6-(2-Oxo-Hexahydro-Thieno[3,4-D]Imidazol-4-Yl)-Hexanoic Acid |
| 7792 | 6-(2-phenoxyethoxy)-1,3,5-triazine-2,4-diamine |
| 7793 | 6-(3,4-DIHYDROXYBENZYL)-3-ETHYL-1-(2,4,6-TRICHLOROPHENYL)-1H-PYRAZOLO[3,4-D]PYRIMIDIN-4(5H)-ONE |
| 7794 | 6-(3',5'-DIMETHYLBENZYL)-1-ETHOXYMETHYL-5-ISOPROPYLURACIL |
| 7795 | 6-(3-AMINOPHENYL)-N-(TERT-BUTYL)-2-(TRIFLUOROMETHYL)QUINAZOLIN-4-AMINE |
| 7796 | 6-(3-AMINOPROPYL)-4,9-DIMETHYLPYRROLO[3,4-C]CARBAZOLE-1,3(2H,6H)-DIONE |
| 7797 | 6-(3-BROMO-2-NAPHTHYL)-1,3,5-TRIAZINE-2,4-DIAMINE |
| 7798 | 6-(3-METHYL-1,4-DIOXO-1,4-DIHYDRONAPHTHALEN-2-YL)HEXANOIC ACID |
| 7799 | 6-(4-{(1S,2S)-2-AMINO-1-[(DIMETHYLAMINO)CARBONYL]-3-[(3S)-3-FLUOROPYRROLIDIN-1-YL]-3-OXOPROPYL}PHENYL)-1H-[1,2,4]TRIAZOLO[1,5-A]PYRIDIN-4-IUM |
| 7800 | 6-(4-chloro-2-fluoro-3-phenoxybenzyl)pyridazin-3(2H)-one |
| 7801 | 6-(4-Difluoromethoxy-3-Methoxy-Phenyl)-2h-Pyridazin-3-One |
| 7802 | 6-(5-BROMO-2-HYDROXYPHENYL)-2-OXO-4-PHENYL-1,2-DIHYDROPYRIDINE-3-CARBONITRILE |
| 7803 | 6-(Adenosine Tetraphosphate-Methyl)-7,8-Dihydropterin |
| 7804 | 6-(CYCLOHEXYLAMINO)-9-[2-(4-METHYLPIPERAZIN-1-YL)-ETHYL]-9H-PURINE-2-CARBONITRILE |
| 7805 | 6-(cyclohexylsulfanyl)-1-(ethoxymethyl)-5-(1-methylethyl)pyrimidine-2,4(1H,3H)-dione |
| 7806 | 6-(DIFLUORO-PHOSPHONO-METHYL)-NAPHTHALENE-2-CARBOXYLIC ACID |
| 7807 | 6-(Dihydroxy-Isobutyl)-Thymine |
| 7808 | 6-(Hydroxyethyldithio)-8-(Aminomethylthio)Octanoic Acid |
| 7809 | 6-(N-Phenylcarbamyl)-2-Naphthalenecarboxamidine |
| 7810 | 6-(Octahydro-1h-Indol-1-Ylmethyl)Decahydroquinazoline-2,4-Diamine |
| 7811 | 6-(Oxalyl-Amino)-1h-Indole-5-Carboxylic Acid |
| 7812 | 6,11-DIHYDPO-11-ETHYL-6-METHYL-9-NITRO-5H-PYRIDO[2,3-B][1,5]BENZODIAZEPIN-5-ONE |
| 7813 | 6,6-DIMETHYL-1-[3-(2,4,5-TRICHLOROPHENOXY)PROPOXY]-1,6-DIHYDRO-1,3,5-TRIAZINE-2,4-DIAMINE |
| 7814 | 6,7,12,13-tetrahydro-5H-indolo[2,3-a]pyrrolo[3,4-c]carbazol-5-one |
| 7815 | 6,7,8,9-TETRAHYDRO-4-HYDROXY-3-(1-PHENYLPROPYL)CYCLOHEPTA[B]PYRAN-2-ONE |
| 7816 | 6,7-DIMETHOXY-4-[(3R)-3-(2-NAPHTHYLOXY)PYRROLIDIN-1-YL]QUINAZOLINE |
| 7817 | 6,7-DIMETHOXY-4-[(3R)-3-(QUINOXALIN-2-YLOXY)PYRROLIDIN-1-YL]QUINAZOLINE |
| 7818 | 6,7-Dioxo-5h-8-Ribitylaminolumazine |
| 7819 | 6,8-DIMERCAPTO-OCTANOIC ACID AMIDE |
| 7820 | 6-[(5-CHLORO-3-METHYL-1-BENZOFURAN-2-YL)SULFONYL]PYRIDAZIN-3(2H)-ONE |
| 7821 | 6-[(Z)-AMINO(IMINO)METHYL]-N-[3-(CYCLOPENTYLOXY)PHENYL]-2-NAPHTHAMIDE |
| 7822 | 6-[(Z)-Amino(Imino)Methyl]-N-[4-(Aminomethyl)Phenyl]-4-(Pyrimidin-2-Ylamino)-2-Naphthamide |
| 7823 | 6-[1-(3,5,5,8,8-Pentamethyl-5,6,7,8-Tetrahydronaphthalen-2-Yl)Cyclopropyl]Pyridine-3-Carboxylic Acid |
| 7824 | 6-[2-(1H-INDOL-6-YL)ETHYL]PYRIDIN-2-AMINE |
| 7825 | 6-[2-(3'-METHOXYBIPHENYL-3-YL)ETHYL]PYRIDIN-2-AMINE |
| 7826 | 6-[3-(4-Morpholinyl)Propyl]-2-(3-Nitrophenyl)-5-Thioxo-5,6,-Dihydro-7h-Thienol[2',3':4,5]Pyrrolo[1,2-C]Imidazol-7-One |
| 7827 | 6-[4-(2-fluorophenyl)-1,3-oxazol-5-yl]-N-(1-methylethyl)-1,3-benzothiazol-2-amine |
| 7828 | 6-[4-(2-piperidin-1-ylethoxy)phenyl]-3-pyridin-4-ylpyrazolo[1,5-a]pyrimidine |
| 7829 | 6-[5-(2-Oxo-Hexahydro-Thieno[3,4-D]Imidazol-4-Yl)-Pentanoylamino]-Hexanoic Acid |
| 7830 | 6-[BIS(2,2,2-TRIFLUOROETHYL)AMINO]-4-(TRIFLUOROMETHYL)QUINOLIN-2(1H)-ONE |
| 7831 | 6-[N-(1-Isopropyl-1,2,3,4-Tetrahydro-7-Isoquinolinyl)Carbamyl]-2-Naphthalenecarboxamidine |
| 7832 | 6-[N-(1-Isopropyl-3,4-Dihydro-7-Isoquinolinyl)Carbamyl]-2-Naphthalenecarboxamidine |
| 7833 | 6-[N-(4-(Aminomethyl)Phenyl)Carbamyl]-2-Naphthalenecarboxamidine |
| 7834 | 6-[N-(4-Ethyl-1,2,3,4-Tetrahydro-6-Isoquinolinyl)Carbamyl]-2-Naphthalenecarboxamidine |
| 7835 | 6-{[(CYCLOHEXYLAMINO)CARBONYL]AMINO}HEXANOIC ACID |
| 7836 | 6-{[6-(1-methyl-1H-pyrazol-4-yl)[1,2,4]triazolo[4,3-b]pyridazin-3-yl]sulfanyl}quinoline |
| 7837 | 6-{4-[4-(4-CHLOROPHENYL)PIPERIDIN-4-YL]PHENYL}-9H-PURINE |
| 7838 | 6-{4-[HYDROXY-(4-NITRO-PHENOXY)-PHOSPHORYL]-BUTYRYLAMINO}-HEXANOIC ACID |
| 7839 | 6-Amino-1-Methylpurine |
| 7840 | 6-amino-2-[(1-naphthylmethyl)amino]-3,7-dihydro-8H-imidazo[4,5-g]quinazolin-8-one |
| 7841 | 6-amino-2-[(2-morpholin-4-ylethyl)amino]-3,7-dihydro-8H-imidazo[4,5-g]quinazolin-8-one |

TABLE 1-continued

Ligands

| Ligand No. | Ligand Name |
|---|---|
| 7842 | 6-amino-2-[(thiophen-2-ylmethyl)amino]-1,7-dihydro-8H-imidazo[4,5-g]quinazolin-8-one |
| 7843 | 6-amino-2-methyl-1,7-dihydro-8H-imidazo[4,5-g]quinazolin-8-one |
| 7844 | 6-AMINO-3,7-DIHYDRO-IMIDAZO[4,5-G]QUINAZOLIN-8-ONE |
| 7845 | 6-amino-4-(2-phenylethyl)-1,7-dihydro-8H-imidazo[4,5-g]quinazolin-8-one |
| 7846 | 6-AMINO-4-[2-(4-METHOXYPHENYL)ETHYL]-1,7-DIHYDRO-8H-IMIDAZO[4,5-G]QUINAZOLIN-8-ONE |
| 7847 | 6-AMINO-4-[2-(4-METHYLPHENYL)ETHYL]-1,7-DIHYDRO-8H-IMIDAZO[4,5-G]QUINAZOLIN-8-ONE |
| 7848 | 6-Amino-4-Hydroxymethyl-Cyclohex-4-Ene-1,2,3-Triol |
| 7849 | 6-AMINO-BENZO[DE]ISOQUINOLINE-1,3-DIONE |
| 7850 | 6-Aminohexyl-Uridine-C1,5'-Diphosphate |
| 7851 | 6-BENZYL-1-BENZYLOXYMETHYL-5-ISOPROPYL URACIL |
| 7852 | 6-BENZYL-1-ETHOXYMETHYL-5-ISOPROPYL URACIL |
| 7853 | 6-Bromo-1-hexanol |
| 7854 | 6-CARBAMIMIDOYL-2-[2-HYDROXY-5-(3-METHOXY-PHENYL)-INDAN-1-YL]-HEXANOIC ACID |
| 7855 | 6-CARBAMIMIDOYL-2-[2-HYDROXY-6-(4-HYDROXY-PHENYL)-INDAN-1-YL]-HEXANOIC ACID |
| 7856 | 6-CARBAMIMIDOYL-4-(3-HYDROXY-2-METHYL-BENZOYLAMINO)-NAPHTHALENE-2-CARBOXYLIC ACID METHYL ESTER |
| 7857 | 6-Carboxymethyluracil |
| 7858 | 6-CHLORO-1-(2-{[(5-CHLORO-1-BENZOTHIEN-3-YL)METHYL]AMINO}ETHYL)-3-[(2-PYRIDIN-2-YLETHYL)AMINO]-1,4-DIHYDROPYRAZIN-2-OL |
| 7859 | 6-CHLORO-2-(1-FURO[2,3-C]PYRIDIN-5-YL-ETHYLSULFANYL)-PYRIMIDIN-4-YLAMINE |
| 7860 | 6-Chloro-2-(2-Hydroxy-Biphenyl-3-Yl)-1h-Indole-5-Carboxamidine |
| 7861 | 6-CHLORO-3-(3-METHYLISOXAZOL-5-YL)-4-PHENYLQUINOLIN-2(1H)-ONE |
| 7862 | 6-CHLORO-3-(DICHLOROMETHYL)-3,4-DIHYDRO-2H-1,2,4-BENZOTHIADIAZINE-7-SULFONAMIDE 1,1-DIOXIDE |
| 7863 | 6-CHLORO-4-(CYCLOHEXYLOXY)-3-ISOPROPYLQUINOLIN-2(1H)-ONE |
| 7864 | 6-CHLORO-4-(CYCLOHEXYLOXY)-3-PROPYLQUINOLIN-2(1H)-ONE |
| 7865 | 6-CHLORO-4-(CYCLOHEXYLSULFANYL)-3-PROPYLQUINOLIN-2(1H)-ONE |
| 7866 | 6-CHLORO-4-(CYCLOHEXYLSULFINYL)-3-PROPYLQUINOLIN-2(1H)-ONE |
| 7867 | 6-CHLORO-9-HYDROXY-1,3-DIMETHYL-1,9-DIHYDRO-4H-PYRAZOLO[3,4-B]QUINOLIN-4-ONE |
| 7868 | 6-CHLORO-N-{(3S)-1-[(1S)-1-METHYL-2-(4-MORPHOLINYL)-2-OXO ETHYL]-2-OXO-3-PYRROLIDINYL}-2-NAPHTHALENESULFONAMIDE |
| 7869 | 6-CHLORO-N-{(3S)-1-[(1S)-1-METHYL-2-MORPHOLIN-4-YL-2-OXOETHYL]-2-OXOPYRROLIDIN-3-YL}-1-BENZOTHIOPHENE-2-SULFONAMIDE |
| 7870 | 6-chloro-N-pyrimidin-5-yl-3-{[3-(trifluoromethyl)phenyl]amino}-1,2-benzisoxazole-7-carboxamide |
| 7871 | 6-Chloropurine Riboside, 5'-Monophosphate |
| 7872 | 6-CYCLOHEXYLMETHOXY-2-(3'-CHLOROANILINO) PURINE |
| 7873 | 6-CYCLOHEXYLMETHYLOXY-2-(4'-HYDROXYANILINO)PURINE |
| 7874 | 6-Deoxy-2-O-Methyl-Alpha-L-Galactopyranose |
| 7875 | 6-Deoxy-Alpha-D-Glucose |
| 7876 | 6-Deoxyerythronolide B |
| 7877 | 6-Deoxyglucose |
| 7878 | 6-ethyl-5-[(2S)-1-(3-methoxypropyl)-2-phenyl-1,2,3,4-tetrahydroquinolin-7-yl]pyrimidine-2,4-diamine |
| 7879 | 6-ETHYL-5-[9-(3-METHOXYPROPYL)-9H-CARBAZOL-2-YL]PYRIMIDINE-2,4-DIAMINE |
| 7880 | 6-ETHYL-5-PHENYLPYRIMIDINE-2,4-DIAMINE |
| 7881 | 6-Fluoro-2-(2'-Fluoro-1,1'-Biphenyl-4-Yl)-3-Methylquinoline-4-Carboxylic Acid |
| 7882 | 6-FLUORO-2-(2-HYDROXY-3-ISOBUTOXY-PHENYL)-1H-BENZOIMIDAZOLE-5-CARBOXAMIDINE |
| 7883 | 6-FLUORO-2-[2-HYDROXY-3-(2-METHYL-CYCLOHEXYLOXY)-PHENYL]-1H-INDOLE-5-CARBOXAMIDINE |
| 7884 | 6-HYDROXY-1,3-BENZOTHIAZOLE-2-SULFONAMIDE |
| 7885 | 6-Hydroxy-1,6-Dihydro Purine Nucleoside |
| 7886 | 6-Hydroxy-6-Methyl-Heptan-3-One |
| 7887 | 6-Hydroxy-7,8-Dihydro Purine Nucleoside |
| 7888 | 6-Hydroxy-D-Norleucine |
| 7889 | 6-hydroxydopa quinone |
| 7890 | 6-Hydroxy-L-Norleucine |
| 7891 | 6-Hydroxymethyl-7,8-Dihydropterin |
| 7892 | 6-Hydroxymethylpterin |
| 7893 | 6-Hydroxypropylthymine |
| 7894 | 6-Hydroxyuridine-5'-Phosphate |
| 7895 | 6-methoxy-9-methyl[1,3]dioxolo[4,5-h]quinolin-8(9H)-one |
| 7896 | 6-METHYL-2(PROPANE-1-SULFONYL)-2H-THIENO[3,2-D][1,2,3]DIAZABORININ-1-OL |
| 7897 | 6-methyl-5-[3-methyl-3-(3,4,5-trimethoxyphenyl)but-1-yn-1-yl]pyrimidine-2,4-diamine |
| 7898 | 6-Methylamino-5-Nitroisocytosine |
| 7899 | 6-Methyl-Formycin A |
| 7900 | 6-Methylpurine |
| 7901 | 6-MORPHOLIN-4-YL-9H-PURINE |
| 7902 | 6-Nitroindazole |
| 7903 | 6-O-Cyclohexylmethyl Guanine |
| 7904 | 6-O-Phosphoryl Inosine Monophosphate |
| 7905 | 6-Oxo-8,9,10,11-Tetrahydro-7h-Cyclohepta[C][1]Benzopyran-3-O-Sulfamate |
| 7906 | 6-PHENYL[5H]PYRROLO[2,3-B]PYRAZINE |
| 7907 | 6-Phenyl-4(R)-(7-Phenyl-Heptanoylamino)-Hexanoic Acid |
| 7908 | 6-Phosphogluconic Acid |
| 7909 | 6s-5,6,7,8-Tetrahydrobiopterin |
| 7910 | 7-((Carboxy(4-Hydroxyphenyl)Acetyl)Amino)-7-Methoxy-(3-((1-Methyl-1h-Tetrazol-5-Yl)Thio)Methyl)-8-Oxo-5-Oxa-1-Azabicyclo[4.2.0]Oct-2-Ene-2-Carboxylic Acid |
| 7911 | 7-(1,1-Dioxo-1h-Benzo[D]Isothiazol-3-Yloxymethyl)-2-(Oxalyl-Amino)-4,7-Dihydro-5h-Thieno[2,3-C]Pyran-3-Carboxylic Acid |
| 7912 | 7-(1-ETHYL-PROPYL)-7H-PYRROLO-[3,2-F]QUINAZOLINE-1,3-DIAMINE |
| 7913 | 7-(1-Methyl-1,2,3-Triazol-4-Yl)-6-Formyl-2,7-Dihydro-[1,4]Thiazepine-3-Carboxylic Acid, Brl42715, C6-(N1-Methyl-1,2,3-Triazolylmethylene)Penem |
| 7914 | 7-(2,5-dihydropyrrol-1-yl)-6-phenyl-pyrido[6,5-d]pyrimidin-2-amine |
| 7915 | 7-(2-Amino-2-Phenyl-Acetylamino)-3-Chloro-8-Oxo-1-Aza-Bicyclo[4.2.0]Oct-2-Ene-2-Carboxylic Acid |
| 7916 | 7-(5-DEOXY-BETA-D-RIBOFURANOSYL)-5-IODO-7H-PYRROLO[2,3-D]PYRIMIDIN-4-AMINE |
| 7917 | 7-(aminomethyl)-6-(2-chlorophenyl)-1-methyl-1H-benzimidazole-5-carbonitrile |
| 7918 | 7-(Carboxyamino)-8-Amino-Nonanoic Acid |
| 7919 | 7,10,13-Tri(Carboxymethyl)-5,15-Dioxo-4,7,10,13,16-Pentaaza-1,19-Dithianonadecane |
| 7920 | 7,8-Diamino-Nonanoic Acid |
| 7921 | 7,8-DICHLORO-1,2,3,4-TETRAHYDROISOQUINOLINE |
| 7922 | 7,8-dihydro-6-hydroxymethyl-7-methyl-7-[2-phenylethyl]-pterin |
| 7923 | 7,8-Dihydro-7,7-Dimethyl-6-Hydroxypterin |
| 7924 | 7,8-Dihydrobiopterin |
| 7925 | 7,8-Dihydro-L-Biopterin |
| 7926 | 7,8-Dihydroneopterin |
| 7927 | 7,8-Dihydroxy-1-Methoxy-3-Methyl-10-Oxo-4,10-Dihydro-1h,3h-Pyrano[4,3-B]Chromene-9-Carboxylic Acid |
| 7928 | 7,8-dihydroxy-4-phenyl-2H-chromen-2-one |
| 7929 | 7,8-dimethylalloxazine |
| 7930 | 7,9-Dihydro-1h-Purine-2,6,8(3h)-Trione |
| 7931 | 7,9-Dimethylguanine |
| 7932 | 7-[(3-CHLOROBENZYL)OXY]-2-OXO-2H-CHROMENE-4-CARBALDEHYDE |
| 7933 | 7-[(3-CHLOROBENZYL)OXY]-4-[(METHYLAMINO)METHYL]-2H-CHROMEN-2-ONE |

TABLE 1-continued

Ligands

| Ligand No. | Ligand Name |
|---|---|
| 7934 | 7-[2-METHOXY-1-(METHOXYMETHYL)ETHYL]-7H-PYRROLO[3,2-F] QUINAZOLINE-1,3-DIAMINE |
| 7935 | 7-[3-(4-FLUORO-PHENYL)-1-ISOPROPYL-1H-INDOL-2-YL]-3,5-DIHYDROXY-HEPTANOIC ACID |
| 7936 | 7-[4-(Dimethylamino)Phenyl]-N-Hydroxy-4,6-Dimethyl-7-Oxo-2,4-Heptadienamide |
| 7937 | 7-{[(CYCLOHEXYLAMINO)CARBONYL]AMINO} HEPTANOIC ACID |
| 7938 | 7-{2,6-DICHLORO-4-[3-(2-CHLORO-BENZOYL)-UREIDO]-PHENOXY}-HEPTANOIC ACID |
| 7939 | 7A-[(4-cyanophenyl)methyl]-6-(3,5-dichlorophenyl)-5-oxo-2,3,5,7A-tetrahydro-1H-pyrrolo[1,2-A]pyrrole-7-carbonitrile |
| 7940 | 7-Alpha-D-Ribofuranosyl-2-Aminopurine-5'-Phosphate |
| 7941 | 7-Alpha-D-Ribofuranosyl-Purine-5'-Phosphate |
| 7942 | 7-amino-2-tert-butyl-4-(4-pyrimidin-2-ylpiperazin-1-yl)pyrido[2,3-d]pyrimidine-6-carboxamide |
| 7943 | 7-amino-2-tert-butyl-4-{[2-(1H-imidazol-4-yl)ethyl]amino}pyrido[2,3-d]pyrimidine-6-carboxamide |
| 7944 | 7-AMINO-4-METHYL-CHROMEN-2-ONE |
| 7945 | 7-BENZYL-1,3-DIMETHYL-8-PIPERAZIN-1-YL-3,7-DIHYDRO-PURINE-2,6-DIONE |
| 7946 | 7-carboxy-5-hydroxy-12,13-dihydro-6H-indolo[2,3-a]pyrrolo[3,4-c]carbazole |
| 7947 | 7-Deaza-7-Aminomethyl-Guanine |
| 7948 | 7-Deaza-7-Cyano-Guanine |
| 7949 | 7-Hydroxy-2-Oxo-Chromene-3-Carboxylic Acid Ethyl Ester |
| 7950 | 7-hydroxy-4-methyl-2H-chromen-2-one |
| 7951 | 7-HYDROXY-4-METHYL-3-(2-HYDROXY-ETHYL)COUMARIN |
| 7952 | 7-Hydroxystaurosporine |
| 7953 | 7-Iodo-1,2,3,4-Tetrahydro-Isoquinoline |
| 7954 | 7-Keto-8-Aminopelargonic Acid |
| 7955 | 7-METHOXY-1-METHYL-9H-BETA-CARBOLINE |
| 7956 | 7-methoxy-4-[(6-phenyl[1,2,4]triazolo[4,3-b]pyridazin-3-yl)methoxy]quinoline |
| 7957 | 7-Methoxy-8-[1-(Methylsulfonyl)-1h-Pyrazol-4-Yl]Naphthalene-2-Carboximidamide |
| 7958 | 7-Methyl-Gpppa |
| 7959 | 7-Methylguanosine |
| 7960 | 7-Methyl-Guanosine-5'-Triphosphate |
| 7961 | 7-methyl-guanosine-5'-triphosphate-5'-guanosine |
| 7962 | 7-Nitroindazole |
| 7963 | 7-Nitroindazole-2-Carboxamidine |
| 7964 | 7n-Methyl-8-Hydroguanosine-5'-Diphosphate |
| 7965 | 7n-Methyl-8-Hydroguanosine-5'-Triphosphate |
| 7966 | 7-PYRIDIN-2-YL-N-(3,4,5-TRIMETHOXYPHENYL)-7H-PYRROLO[2,3-D]PYRIMIDIN-2-AMINE |
| 7967 | 8-(2,5-Dimethoxy-Benzyl)-2-Fluoro-9h-Purin-6-Ylamine |
| 7968 | 8-(2,5-Dimethoxy-Benzyl)-2-Fluoro-9-Pent-9h-Purin-6-Ylamine |
| 7969 | 8-(2-Chloro-3,4,5-Trimethoxy-Benzyl)-2-Fluoro-9-Pent-4-Ylnyl-9h-Purin-6-Ylamine |
| 7970 | 8-(2-Chloro-3,4,5-Trimethoxy-Benzyl)-9-Pent-4-Ylnyl-9h-Purin-6-Ylamine |
| 7971 | 8-(2-CHLOROPHENYLAMINO)-2-(2,6-DIFLUOROPHENYLAMINO)-9-ETHYL-9H-PURINE-1,7-DIIUM |
| 7972 | 8-(6-BROMO-BENZO[1,3]DIOXOL-5-YLSULFANYL)-9-(3-ISOPROPYLAMINO-PROPYL)-ADENINE |
| 7973 | 8-(Pyrimidin-2-Ylamino)Naphthalene-2-Carboximidamide |
| 7974 | 8,9,10-Trihydroxy-7-Hydroxymethyl-2-Thioxo-6-Oxa-1,3-Diaza-Spiro[4.5]Decan-4-One |
| 7975 | 8,9,10-Trihydroxy-7-Hydroxymethyl-3-Methyl-6-Oxa-1,3-Diaza-Spiro[4.5]Decane-2,4-Dione |
| 7976 | 8,9-Dichloro-2,3,4,5-Tetrahydro-1h-Benzo[C]Azepine |
| 7977 | 8-Amino-1,3-Dimethyl-3,7-Dihydropurine-2,6-Dione |
| 7978 | 8-azaguanine |
| 7979 | 8-Azaxanthine |
| 7980 | 8-Benzo[1,3]Dioxol-,5-Ylmethyl-9-Butyl-2-Fluoro-9h-Purin-6-Ylamine |
| 7981 | 8-BENZO[1,3]DIOXOL-,5-YLMETHYL-9-BUTYL-9H- |
| 7982 | 8-bromo-4-(2-chlorophenyl)-N-(2-hydroxyethyl)-6-methyl-1,3-dioxo-1,2,3,6-tetrahydropyrrolo[3,4-e]indole-7-carboxamide |
| 7983 | 8-Bromoadenosine-5'-Diphosphate |
| 7984 | 8-Bromo-Adenosine-5'-Monophosphate |
| 7985 | 8-Demethyl-8-Dimethylamino-Flavin-Adenine-Dinucleotide |
| 7986 | 8-ethyl-3,10,10-trimethyl-4,5,6,8,10,12-hexahydropyrazolo[4',3':6,7]cyclohepta[1,2-b]pyrrolo[2,3-f]indol-9(1H)-one |
| 7987 | 8-HYDROXY-2-OXA-BICYCLO[3.3.1]NON-6-ENE-3,5-DICARBOXYLIC ACID |
| 7988 | 8-Hydroxy-4-(1-Hydroxyethyl)Quinoline-2-Carboxylic Acid |
| 7989 | 8-Iodo-Guanine |
| 7990 | 8-Oxo-2'-Deoxy-Guanosine-5'-Monophosphate |
| 7991 | 9-(2-Deoxy-Beta-D-Ribofuranosyl)-6-Methylpurine |
| 7992 | 9-(3-IODOBENZYLAMINO)-1,2,3,4-TETRAHYDROACRIDINE |
| 7993 | 9-(4-hydroxybutyl)-N2-phenylguanine |
| 7994 | 9-(4-Hydroxyphenyl)-2,7-Phenanthroline |
| 7995 | 9-(5,5-Difluoro-5-Phosphonopentyl)Guanine |
| 7996 | 9-(6-Deoxy-Alpha-L-Talofuranosyl)-6-Methylpurine |
| 7997 | 9-(6-Deoxy-Beta-D-Allofuranosyl)-6-Methylpurine |
| 7998 | 9,10-Deepithio-9,10-Didehydroacanthifolicin |
| 7999 | 9,9,9-TRIFLUORO-8-OXO-N-PHENYLNONANAMIDE |
| 8000 | 99mTc-14 F7 Mab |
| 8001 | 99mTc-ciprofloxacin |
| 8002 | 9-ACETYL-2,3,4,9-TETRAHYDRO-1H-CARBAZOL-1-ONE |
| 8003 | 9-Amino-2-Deoxy-2,3-Dehydro-N-Acetyl-Neuraminic Acid |
| 8004 | 9-amino-5-(2-aminopyrimidin-4-yl)pyrido[3',2':4,5]pyrrolo[1,2-c]pyrimidin-4-ol |
| 8005 | 9-Aminophenanthrene |
| 8006 | 9-Beta-D-Xylofuranosyl-Adenine |
| 8007 | 9-Butyl-8-(2,5-Dimethoxy-Benzyl)-2-Fluoro-9h-Purin-6-Ylamine |
| 8008 | 9-Butyl-8-(2,5-Dimethoxy-Benzyl)-9h-Purin-6-Ylamine |
| 8009 | 9-Butyl-8-(2-Chloro-3,4,5-Trimethoxy-Benzyl)-9h-Purin-6-Ylamine |
| 8010 | 9-Butyl-8-(3,4,5-Trimethoxybenzyl)-9h-Purin-6-Amine |
| 8011 | 9-Butyl-8-(3-Methoxybenzyl)-9h-Purin-6-Amine |
| 8012 | 9-Butyl-8-(4-Methoxybenzyl)-9h-Purin-6-Amine |
| 8013 | 9-CYCLOPENTYL-6-[2-(3-IMIDAZOL-1-YL-PROPOXY)-PHENYLAMINO]-9H-PURINE-2-CARBONITRILE |
| 8014 | 9-Deazaadenine |
| 8015 | 9-Deazaguanine |
| 8016 | 9-Deazahypoxanthine |
| 8017 | 9-Deazainosine |
| 8018 | 9-DEAZAINOSINE-2',3'-O-ETHYLIDENEPHOSPHONATE |
| 8019 | 9H-CARBAZOLE |
| 8020 | 9-HYDROXY-4-PHENYL-6H-PYRROLO[3,4-C]CARBAZOLE-1,3-DIONE |
| 8021 | 9-HYDROXY-6-(3-HYDROXYPROPYL)-4-(2-METHOXYPHENYL)PYRROLO[3,4-C]CARBAZOLE-1,3(2H,6H)-DIONE |
| 8022 | 9-Hydroxy-8-Methoxy-6-Nitro-Phenanthrol[3,4-D][1,3]Dioxole-5-Carboxylic Acid |
| 8023 | 9-Hydroxypropyladenine, R-Isomer |
| 8024 | 9-Hydroxypropyladenine, S-Isomer |
| 8025 | 9-Methylguanine |
| 8026 | 9-N-Phenylmethylamino-Tacrine |
| 8027 | Disubstituted Succinyl Caprolactam Hydroxymate Mmp3inhibitor |
| 8028 | 659032 |
| 8029 | 681323 |
| 8030 | Shield-1 |

Design of SREs from Ligand-Ligand Binding Partner Pairs

In some embodiments, the ligand and ligand binding pairs taught in Tables 2 and 3, may be used as the starting point or reference sequence for the design of one or more SRE's which are responsive to the ligand of the pair. Such design is taught herein and in the Examples.

Given in Tables 2 and 3, are ligand and binding partner pairs (known targets of the ligands).

A non-exhaustive listing of sets of ligands useful in the present invention are given in Table 2. Table 2 provides the ligand number (as described in Table 1), synonyms for the ligand (Ligand Synonym), the name of the target (Target Name) and the identification number of the payload (Payload ID). Additional ligand sets similar to those listed in Table 2 and additional information regarding the ligand sets listed in Table 2 may be found in the Drugbank database.

Lengthy table referenced here

US11446398-20220920-T00001

Please refer to the end of the specification for access instructions.

A non-exhaustive listing of sets of ligands useful in the present invention are given in Table 3. Table 3 provides the ligand number (as described in Table 1), the name of the target (Target Name), the Target ChEMBL ID from the ChEMBL database (www.ebi.ac.uk/chembl/), and the identification number of the payload (Payload ID) and the type of action of the ligand set. Additional ligand sets similar to those listed in Table 3 and additional information regarding the ligand sets listed in Table 3 may be found in the ChEMBL database (www.ebi.ac.uk/chembl/).

TABLE 3

Ligand sets

| Ligand No. | Target Name | Target ChEMBL ID | Payload ID | Action type |
|---|---|---|---|---|
| 2 | Gonadotropin-releasing hormone receptor | CHEMBL1855 | 7145 | Antagonist |
| 3 | T-lymphocyte activation antigen CD80 | CHEMBL2364157 | 2585 | Inhibitor |
| 3 | T-lymphocyte activation antigen CD86 | CHEMBL2364156 | 2590 | Inhibitor |
| 4 | Integrin alpha-IIb/beta-3 | CHEMBL2093869 | 8296, 8312 | Inhibitor |
| 4 | Integrin alpha-V/beta-3 | CHEMBL1907598 | 8308, 8312 | Inhibitor |
| 5 | Beta-2 adrenergic receptor | CHEMBL210 | 773 | Agonist |
| 6 | Cyclin-dependent kinase 4 | CHEMBL331 | 4287 | Inhibitor |
| 6 | Cyclin-dependent kinase 6 | CHEMBL2508 | 4291 | Inhibitor |
| 9 | Cytochrome P450 17A1 | CHEMBL3522 | 4423 | Inhibitor |
| 10 | Tyrosine-protein kinase ABL | CHEMBL1862 | 149 | Inhibitor |
| 11 | Synaptosomal-associated protein 25 | CHEMBL2364159 | 17018 | Inhibitor |
| 13 | Vanilloid receptor | CHEMBL4794 | 18061 | Antagonist |
| 14 | Neuronal acetylcholine receptor protein alpha-7 subunit | CHEMBL2492 | 2940 | Agonist |
| 15 | Neuronal acetylcholine receptor protein alpha-7 subunit | CHEMBL2492 | 2940 | Agonist |
| 17 | Histamine H3 receptor | CHEMBL264 | 7622 | Antagonist |
| 18 | Epidermal growth factor receptor erbB1 | CHEMBL203 | 5466 | Inhibitor |
| 19 | Janus Kinase (JAK) | CHEMBL2363062 | 8595-8597, 18803 | Inhibitor |
| 21 | Hepatocyte growth factor receptor | CHEMBL3717 | 10107 | Inhibitor |
| 31 | Tyrosine-protein kinase JAK2 | CHEMBL2971 | 8596 | Inhibitor |
| 32 | Epidermal growth factor receptor erbB1 | CHEMBL203 | 5466 | Inhibitor |
| 32 | Receptor protein-tyrosine kinase erbB-2 | CHEMBL1824 | 5520 | Inhibitor |
| 32 | Receptor protein-tyrosine kinase erbB-4 | CHEMBL3009 | 5522 | Inhibitor |
| 34 | PI3-kinase p110-delta subunit | CHEMBL3130 | 12528 | Inhibitor |
| 35 | GABA-A receptor; anion channel | CHEMBL2093872 | 6682-6696, 6700 | Positive modulator |
| 35 | Glutamate [NMDA] receptor | CHEMBL2094124 | 6917-6921, 6923, 6924 | Antagonist |
| 36 | Maltase-glucoamylase | CHEMBL2074 | 9808 | Inhibitor |
| 36 | Pancreatic alpha-amylase | CHEMBL2045 | 1004 | Inhibitor |
| 39 | Beta-1 adrenergic receptor | CHEMBL213 | 772 | Antagonist |
| 44 | Anandamide amidohydrolase | CHEMBL2243 | 6052 | Inhibitor |
| 44 | Cyclooxygenase | CHEMBL2094253 | 13461, 13462 | Inhibitor |
| 44 | Vanilloid receptor | CHEMBL4794 | 18061 | Opener |
| 45 | Carbonic anhydrase I | CHEMBL261 | 2310 | Inhibitor |
| 45 | Carbonic anhydrase II | CHEMBL205 | 2311 | Inhibitor |
| 45 | Carbonic anhydrase IV | CHEMBL3729 | 2313 | Inhibitor |
| 45 | Carbonic anhydrase XII | CHEMBL3242 | 2322 | Inhibitor |
| 49 | Sulfonylurea receptor 1, Kir6.2 | CHEMBL2096972 | 1628, 13056 | Blocker |
| 51 | Dopamine D2 receptor | CHEMBL217 | 5041 | Antagonist |
| 55 | Muscarinic acetylcholine receptor M3 | CHEMBL245 | 2937 | Agonist |
| 57 | Sodium/potassium-transporting ATPase | CHEMBL2095186 | 1590-1596, 6506 | Inhibitor |

TABLE 3-continued

Ligand sets

| Ligand No. | Target Name | Target ChEMBL ID | Payload ID | Action type |
|---|---|---|---|---|
| 62 | Retinoid receptor | CHEMBL2363071 | 14451-14456 | Agonist |
| 63 | Muscarinic acetylcholine receptor M3 | CHEMBL245 | 2937 | Antagonist |
| 64 | Estrogen receptor | CHEMBL2093866 | 5551, 5552 | Modulator |
| 67 | Tyrosine-protein kinase BTK | CHEMBL5251 | 1989 | Inhibitor |
| 69 | Histamine H1 receptor | CHEMBL231 | 7620 | Antagonist |
| 72 | MAP kinase p38 alpha | CHEMBL260 | 10445 | Inhibitor |
| 75 | TNF-alpha | CHEMBL1825 | 18711 | Inhibitor |
| 80 | Retinoic acid receptor | CHEMBL2363069 | 14451-14453 | Agonist |
| 81 | G protein-coupled receptor 44 | CHEMBL5071 | 13445 | Antagonist |
| 84 | Adenosine receptor | CHEMBL2111329 | 624-627 | Agonist |
| 115 | Epidermal growth factor receptor erbB1 | CHEMBL203 | 5466 | Inhibitor |
| 115 | Receptor protein-tyrosine kinase erbB-2 | CHEMBL1824 | 5520 | Inhibitor |
| 115 | Vascular endothelial growth factor receptor 1 | CHEMBL1868 | 6336 | Inhibitor |
| 115 | Vascular endothelial growth factor receptor 2 | CHEMBL279 | 9005 | Inhibitor |
| 119 | Insulin-like growth factor I receptor | CHEMBL1957 | 8256 | Inhibitor |
| 120 | P2X purinoceptor 2 | CHEMBL2531 | 13899 | Antagonist |
| 120 | P2X purinoceptor 3 | CHEMBL2998 | 13900 | Antagonist |
| 121 | Muscarinic acetylcholine receptor | CHEMBL2094109 | 2935-2939 | Antagonist |
| 121 | Sodium channel protein type X alpha subunit | CHEMBL5451 | 16001 | Blocker |
| 121 | Sodium channel protein type XI alpha subunit | CHEMBL5167 | 16002 | Blocker |
| 122 | Epidermal growth factor receptor erbB1 | CHEMBL203 | 5466 | Inhibitor |
| 122 | Receptor protein-tyrosine kinase erbB-2 | CHEMBL1824 | 5520 | Inhibitor |
| 122 | Receptor protein-tyrosine kinase erbB-4 | CHEMBL3009 | 5522 | Inhibitor |
| 124 | Estrogen receptor | CHEMBL2093866 | 5551, 5552 | Modulator |
| 124 | Estrogen-related receptor gamma | CHEMBL4245 | 5556 | Antagonist |
| 125 | Placenta growth factor | CHEMBL1697671 | 12741 | Inhibitor |
| 125 | Vascular endothelial growth factor A | CHEMBL1783 | 19239 | Inhibitor |
| 126 | Serine/threonine-protein kinase AKT | CHEMBL2111353 | 19217-19219 | Inhibitor |
| 127 | Vascular endothelial growth factor receptor | CHEMBL2095227 | 6336, 6339, 9005 | Inhibitor |
| 128 | Cyclin-dependent kinase 1 | CHEMBL308 | 4269 | Inhibitor |
| 128 | Cyclin-dependent kinase 2 | CHEMBL301 | 4281 | Inhibitor |
| 128 | Cyclin-dependent kinase 4 | CHEMBL331 | 4287 | Inhibitor |
| 130 | Globotriosylceramide | CHEMBL2366040 | | Hydrolytic enzyme |
| 138 | Tyrosine-protein kinase receptor FLT3 | CHEMBL1974 | 6337 | Inhibitor |
| 151 | Glucagon-like peptide 1 receptor | CHEMBL1784 | 6862 | Agonist |
| 152 | Bilirubin | CHEMBL2364174 | | Sequestering agent |
| 153 | Beta-2 adrenergic receptor | CHEMBL210 | 773 | Agonist |
| 154 | Histamine H1 receptor | CHEMBL231 | 7620 | Antagonist |
| 156 | Glucocorticoid receptor | CHEMBL2034 | 11442 | Agonist |
| 159 | ALK tyrosine kinase receptor | CHEMBL4247 | 1032 | Inhibitor |
| 159 | Tyrosine-protein kinase receptor RET | CHEMBL2041 | 14404 | Inhibitor |
| 160 | T-cell surface antigen CD2 | CHEMBL2040 | 2526 | Inhibitor |
| 161 | Peroxisome proliferator-activated receptor alpha | CHEMBL239 | 12426 | Agonist |
| 161 | Peroxisome proliferator-activated receptor gamma | CHEMBL235 | 12428 | Agonist |
| 162 | CAMPATH-1 antigen | CHEMBL1912 | 2570 | Inhibitor |
| 164 | Farnesyl diphosphate synthase | CHEMBL1782 | 6021 | Inhibitor |
| 166 | Mu opioid receptor | CHEMBL233 | 12037 | Agonist |
| 168 | Adrenergic receptor alpha-1 | CHEMBL2094251 | 766-768 | Agonist |
| 169 | Glucocerebroside | CHEMBL2364176 | | Hydrolytic enzyme |
| 170 | Starch | CHEMBL2364180 | | Hydrolytic enzyme |
| 172 | Subtilisin/kexin type 9 | CHEMBL2929 | 13439 | Inhibitor |
| 173 | Serine/threonine-protein kinase Aurora-A | CHEMBL4722 | 1654 | Inhibitor |
| 174 | Renin | CHEMBL286 | 14370 | Inhibitor |
| 175 | Retinoid receptor | CHEMBL2363071 | 14451-14456 | Agonist |

TABLE 3-continued

Ligand sets

| Ligand No. | Target Name | Target ChEMBL ID | Payload ID | Action type |
|---|---|---|---|---|
| 179 | Epidermal growth factor receptor erbB1 | CHEMBL203 | 5466 | Inhibitor |
| 179 | Receptor protein-tyrosine kinase erbB-2 | CHEMBL1824 | 5520 | Inhibitor |
| 181 | Xanthine dehydrogenase | CHEMBL1929 | 19536 | Inhibitor |
| 189 | Serotonin 1b (5-HT1b) receptor | CHEMBL1898 | 62 | Agonist |
| 189 | Serotonin 1d (5-HT1d) receptor | CHEMBL1983 | 63 | Agonist |
| 189 | Serotonin 1f (5-HT1f) receptor | CHEMBL1805 | 65 | Agonist |
| 190 | Dipeptidyl peptidase IV | CHEMBL284 | 4887 | Inhibitor |
| 191 | Serotonin 3a (5-HT3a) receptor | CHEMBL1899 | 69 | Antagonist |
| 192 | PI3-kinase p110-alpha subunit | CHEMBL4005 | 12526 | Inhibitor |
| 229 | GABA-A receptor; anion channel | CHEMBL2093872 | 6682-6696, 6700 | Positive allosteric modulator |
| 231 | Prostanoid EP1 receptor | CHEMBL1811 | 13447 | Agonist |
| 231 | Prostanoid EP2 receptor | CHEMBL1881 | 13448 | Agonist |
| 233 | Adrenergic receptor alpha | CHEMBL2095203 | 766-771 | Antagonist |
| 235 | Plasminogen | CHEMBL1801 | 12750 | Activator |
| 236 | Hepatocyte growth factor receptor | CHEMBL3717 | 10107 | Inhibitor |
| 236 | Neurotrophic tyrosine kinase receptor | CHEMBL3559684 | 11145-11147 | Inhibitor |
| 236 | Tyrosine-protein kinase TIE-2 | CHEMBL4128 | 17514 | Inhibitor |
| 236 | Vascular endothelial growth factor receptor 2 | CHEMBL279 | 9005 | Inhibitor |
| 237 | DNA | CHEMBL2311221 | | Inhibitor |
| 243 | Mu opioid receptor | CHEMBL233 | 12037 | Antagonist |
| 244 | Cyclin-dependent kinase 1 | CHEMBL308 | 4269 | Inhibitor |
| 244 | Cyclin-dependent kinase 2 | CHEMBL301 | 4281 | Inhibitor |
| 244 | Cyclin-dependent kinase 4 | CHEMBL331 | 4287 | Inhibitor |
| 244 | Cyclin-dependent kinase 6 | CHEMBL2508 | 4291 | Inhibitor |
| 244 | Cyclin-dependent kinase 7 | CHEMBL3055 | 4292 | Inhibitor |
| 244 | Cyclin-dependent kinase 9 | CHEMBL3116 | 4294 | Inhibitor |
| 246 | G protein-coupled receptor 44 | CHEMBL5071 | 13445 | Antagonist |
| 247 | G protein-coupled receptor 44 | CHEMBL5071 | 13445 | Antagonist |
| 248 | Rho-associated protein kinase | CHEMBL2111459 | 14557, 14558 | Inhibitor |
| 249 | Glutamate [NMDA] receptor | CHEMBL2094124 | 6917-6921, 6923, 6924 | Antagonist |
| 250 | Acetylcholinesterase | CHEMBL220 | 380 | Inhibitor |
| 251 | Endothelin receptor, ET-A/ET-B | CHEMBL2096678 | 5399, 5400 | Antagonist |
| 252 | Glucocorticoid receptor | CHEMBL2034 | 11442 | Agonist |
| 256 | Leukotriene B4 receptor 1 | CHEMBL3911 | 9429 | Antagonist |
| 257 | Hepatocyte growth factor receptor | CHEMBL3717 | 10107 | Inhibitor |
| 258 | PI3-kinase p110-delta subunit | CHEMBL3130 | 12528 | Inhibitor |
| 259 | Hepatocyte growth factor receptor | CHEMBL3717 | 10107 | Inhibitor |
| 260 | Vanilloid receptor | CHEMBL4794 | 18061 | Antagonist |
| 261 | MAP kinase p38 alpha | CHEMBL260 | 10445 | Inhibitor |
| 262 | Serine/threonine-protein kinase Aurora | CHEMBL3430911 | 1654, 1657, 1658 | Inhibitor |
| 263 | Beta-3 adrenergic receptor | CHEMBL246 | 774 | Agonist |
| 267 | Amiloride-sensitive sodium channel, ENaC | CHEMBL2107836 | 15985, 15986, 15988 | Blocker |
| 269 | Plasminogen | CHEMBL1801 | 12750 | Inhibitor |
| 269 | Tissue-type plasminogen activator | CHEMBL1873 | 12751 | Inhibitor |
| 271 | Cytochrome P450 11A1 | CHEMBL2033 | 4420 | Inhibitor |
| 271 | Cytochrome P450 19A1 | CHEMBL1978 | 4424 | Inhibitor |
| 273 | DNA | CHEMBL2311221 | | Inhibitor |
| 277 | Cyclooxygenase | CHEMBL2094253 | 13461, 13462 | Inhibitor |
| 278 | HERG | CHEMBL240 | 13089 | Blocker |
| 280 | Norepinephrine transporter | CHEMBL222 | 16329 | Inhibitor |
| 280 | Serotonin transporter | CHEMBL228 | 16331 | Inhibitor |
| 281 | Phosphodiesterase 4 | CHEMBL2093863 | 12555-12557, 12559 | Inhibitor |
| 282 | Voltage-gated L-type calcium channel | CHEMBL2095229 | 2138-2141 | Blocker |
| 287 | Dopamine receptor | CHEMBL2096905 | 5040-5044 | Antagonist |
| 287 | Norepinephrine transporter | CHEMBL222 | 16329 | Inhibitor |
| 287 | Serotonin transporter | CHEMBL228 | 16331 | Inhibitor |
| 289 | Adenosine A1 receptor | CHEMBL226 | 624 | Agonist |
| 289 | Adenosine A2a receptor | CHEMBL251 | 625 | Agonist |
| 293 | Dopamine transporter | CHEMBL238 | 16330 | Releasing agent |
| 293 | Norepinephrine transporter | CHEMBL222 | 16329 | Releasing agent |
| 299 | Hepatocyte growth factor receptor | CHEMBL3717 | 10107 | Inhibitor |
| 299 | Platelet-derived growth factor receptor alpha | CHEMBL2007 | 12773 | Inhibitor |

TABLE 3-continued

Ligand sets

| Ligand No. | Target Name | Target ChEMBL ID | Payload ID | Action type |
|---|---|---|---|---|
| 299 | Stem cell growth factor receptor | CHEMBL1936 | 19299 | Inhibitor |
| 299 | Tyrosine-protein kinase receptor FLT3 | CHEMBL1974 | 6337 | Inhibitor |
| 302 | Starch | CHEMBL2364180 | | Hydrolytic enzyme |
| 308 | Phosphodiesterase 3 | CHEMBL2094125 | 12553, 12554 | Inhibitor |
| 309 | Interleukin-1 receptor | CHEMBL1959 | 8406 | Antagonist |
| 311 | Ghrelin receptor | CHEMBL4616 | 7232 | Agonist |
| 312 | Cytochrome P450 19A1 | CHEMBL1978 | 4424 | Inhibitor |
| 313 | Bradykinin B2 receptor | CHEMBL3157 | 1923 | Antagonist |
| 315 | Calcium-activated potassium channel subunit alpha-1 | CHEMBL4304 | 13053 | Activator |
| 319 | Kappa opioid receptor | CHEMBL237 | 12036 | Agonist |
| 319 | Mu opioid receptor | CHEMBL233 | 12037 | Agonist |
| 321 | Vitamin K-dependent gamma-carboxylase | CHEMBL2012 | 6703 | Inhibitor |
| 323 | Muscarinic acetylcholine receptor M1 | CHEMBL216 | 2935 | Antagonist |
| 323 | Muscarinic acetylcholine receptor M3 | CHEMBL245 | 2937 | Antagonist |
| 326 | Platelet-derived growth factor receptor beta | CHEMBL1913 | 12774 | Inhibitor |
| 326 | Stem cell growth factor receptor | CHEMBL1936 | 19299 | Inhibitor |
| 326 | Vascular endothelial growth factor receptor 2 | CHEMBL279 | 9005 | Inhibitor |
| 326 | Vascular endothelial growth factor receptor 3 | CHEMBL1955 | 6339 | Inhibitor |
| 327 | Histamine H1 receptor | CHEMBL231 | 7620 | Antagonist |
| 336 | Adenosine A2a receptor | CHEMBL251 | 625 | Agonist |
| 337 | Vascular endothelial growth factor receptor 2 | CHEMBL279 | 9005 | Inhibitor |
| 338 | Androgen Receptor | CHEMBL1871 | 1034 | Antagonist |
| 340 | Sphingosine 1-phosphate receptor Edg-1 | CHEMBL4333 | 16606 | Agonist |
| 341 | Cannabinoid CB2 receptor | CHEMBL253 | 2271 | Agonist |
| 344 | PI3-kinase class I | CHEMBL3559703 | 12526-12529, 12596-12598, 12601 | Inhibitor |
| 344 | Serine/threonine-protein kinase mTOR | CHEMBL2842 | 9934 | Inhibitor |
| 345 | Coagulation factor X | CHEMBL244 | 3596 | Inhibitor |
| 346 | C-C chemokine receptor type 5 | CHEMBL274 | 2864 | Antagonist |
| 347 | Dopamine D2 receptor | CHEMBL217 | 5041 | Partial agonist |
| 349 | Neuronal acetylcholine receptor protein alpha-7 subunit | CHEMBL2492 | 2940 | Partial agonist |
| 350 | D2-like dopamine receptor | CHEMBL2331075 | 5041-5043 | Agonist |
| 351 | Adrenergic receptor alpha-2 | CHEMBL2095158 | 769-771 | Agonist |
| 352 | Phosphodiesterase 4 | CHEMBL2093863 | 12555-12557, 12559 | Inhibitor |
| 353 | Neurokinin 1 receptor | CHEMBL249 | 17315 | Antagonist |
| 356 | Plasma kallikrein | CHEMBL2000 | 8638 | Inhibitor |
| 356 | Plasminogen | CHEMBL1801 | 12750 | Inhibitor |
| 358 | Neuronal acetylcholine receptor protein alpha-7 subunit | CHEMBL2492 | 2940 | Partial agonist |
| 359 | 3-phosphoinositide dependent protein kinase-1 | CHEMBL2534 | 46 | Inhibitor |
| 370 | Antithrombin-III | CHEMBL1950 | 15564 | Activator |
| 372 | Beta-2 adrenergic receptor | CHEMBL210 | 773 | Agonist |
| 374 | Thrombin | CHEMBL204 | 3583 | Inhibitor |
| 378 | Peroxisome proliferator-activated receptor gamma | CHEMBL235 | 12428 | Modulator |
| 378 | Solute carrier family 22 member 12 | CHEMBL6120 | 16093 | Inhibitor |
| 380 | Dopamine D2 receptor | CHEMBL217 | 5041 | Partial agonist |
| 380 | Serotonin 1a (5-HT1a) receptor | CHEMBL214 | 61 | Partial agonist |
| 380 | Serotonin 2a (5-HT2a) receptor | CHEMBL224 | 66 | Antagonist |
| 381 | Dopamine D2 receptor | CHEMBL217 | 5041 | Partial agonist |
| 381 | Serotonin 1a (5-HT1a) receptor | CHEMBL214 | 61 | Partial agonist |
| 381 | Serotonin 2a (5-HT2a) receptor | CHEMBL224 | 66 | Antagonist |
| 382 | Dopamine transporter | CHEMBL238 | 16330 | Inhibitor |
| 383 | Androgen Receptor | CHEMBL1871 | 1034 | Antagonist |
| 384 | Fibroblast growth factor receptor | CHEMBL2095217 | 6253-6256 | Inhibitor |
| 385 | Serine/threonine-protein kinase AKT | CHEMBL2111353 | 19217-19219 | Inhibitor |
| 386 | Serine/threonine-protein kinase B-raf | CHEMBL5145 | 1924 | Inhibitor |
| 386 | Serine/threonine-protein kinase RAF | CHEMBL1906 | 14116 | Inhibitor |

TABLE 3-continued

Ligand sets

| Ligand No. | Target Name | Target ChEMBL ID | Payload ID | Action type |
|---|---|---|---|---|
| 387 | Hepatocyte growth factor receptor | CHEMBL3717 | 10107 | Inhibitor |
| 388 | Macrophage colony stimulating factor receptor | CHEMBL1844 | 3854 | Inhibitor |
| 389 | G protein-coupled receptor 44 | CHEMBL5071 | 13445 | Antagonist |
| 390 | MAP kinase p38 alpha | CHEMBL260 | 10445 | Inhibitor |
| 391 | Thioredoxin reductase 1 | CHEMBL1927 | 17707 | Inhibitor |
| 398 | Sodium channel alpha subunit | CHEMBL2331043 | 15989, 15991, 15993, 15995, 15997-16001, 16002 | Blocker |
| 400 | Inhibitor of nuclear factor kappa B kinase beta subunit | CHEMBL1991 | 8194 | Inhibitor |
| 400 | Tyrosine-protein kinase receptor FLT3 | CHEMBL1974 | 6337 | Inhibitor |
| 401 | Dual specificity mitogen-activated protein kinase kinase 1 | CHEMBL3587 | 10458 | Inhibitor |
| 401 | Dual specificity mitogen-activated protein kinase kinase 2 | CHEMBL2964 | 10459 | Inhibitor |
| 403 | Prostanoid DP receptor | CHEMBL4427 | 13444 | Antagonist |
| 404 | Dopamine D2 receptor | CHEMBL217 | 5041 | Antagonist |
| 404 | Serotonin 2a (5-HT2a) receptor | CHEMBL224 | 66 | Antagonist |
| 405 | Sphingosine 1-phosphate receptor Edg-1 | CHEMBL4333 | 16606 | Agonist |
| 407 | Progesterone receptor | CHEMBL208 | 13299 | Modulator |
| 408 | ALK tyrosine kinase receptor | CHEMBL4247 | 1032 | Inhibitor |
| 409 | Calcium sensing receptor | CHEMBL1878 | 2171 | Positive allosteric modulator |
| 410 | Asparagine | CHEMBL2364706 | | Hydrolytic enzyme |
| 411 | Asparagine | CHEMBL2364706 | | Hydrolytic enzyme |
| 417 | Cyclooxygenase | CHEMBL2094253 | 13461, 13462 | Inhibitor |
| 419 | Tyrosine-protein kinase receptor FLT3 | CHEMBL1974 | 6337 | Inhibitor |
| 419 | Tyrosine-protein kinase receptor RET | CHEMBL2041 | 14404 | Inhibitor |
| 420 | Histamine H1 receptor | CHEMBL231 | 7620 | Antagonist |
| 421 | MAP kinase-activated protein kinase 2 | CHEMBL2208 | 10488 | Inhibitor |
| 421 | Rho-associated protein kinase | CHEMBL2111459 | 14557, 14558 | Inhibitor |
| 425 | Cyclin-dependent kinase | CHEMBL3559691 | 4269, 4270, 4272-4281, 4285-4288, 4291-4294 | Inhibitor |
| 427 | Serine/threonine-protein kinase Aurora-A | CHEMBL4722 | 1654 | Inhibitor |
| 427 | Serine/threonine-protein kinase Aurora-B | CHEMBL2185 | 1657 | Inhibitor |
| 427 | Tyrosine-protein kinase ABL | CHEMBL1862 | 149 | Inhibitor |
| 427 | Tyrosine-protein kinase JAK2 | CHEMBL2971 | 8596 | Inhibitor |
| 427 | Tyrosine-protein kinase JAK3 | CHEMBL2148 | 8597 | Inhibitor |
| 427 | Tyrosine-protein kinase receptor FLT3 | CHEMBL1974 | 6337 | Inhibitor |
| 430 | Beta-1 adrenergic receptor | CHEMBL213 | 772 | Antagonist |
| 432 | Motilin receptor | CHEMBL2203 | 10550 | Agonist |
| 436 | Norepinephrine transporter | CHEMBL222 | 16329 | Inhibitor |
| 437 | Proteinase-activated receptor 1 | CHEMBL3974 | 3584 | Antagonist |
| 438 | HMG-CoA reductase | CHEMBL402 | 26 | Inhibitor |
| 441 | Muscle-type nicotinic acetylcholine receptor | CHEMBL2362997 | 2941, 2950, 2954, 2955 2956 | Antagonist |
| 443 | Endothelin receptor ET-A | CHEMBL252 | 5399 | Antagonist |
| 444 | Muscarinic acetylcholine receptor M1 | CHEMBL216 | 2935 | Antagonist |
| 444 | Muscarinic acetylcholine receptor M2 | CHEMBL211 | 2936 | Antagonist |
| 444 | Muscarinic acetylcholine receptor M3 | CHEMBL245 | 2937 | Antagonist |
| 445 | Peroxisome proliferator-activated receptor gamma | CHEMBL235 | 12428 | Modulator |
| 449 | Glutamate (NMDA) receptor subunit zeta 1 | CHEMBL2015 | 6917 | Antagonist |
| 449 | Glutamate [NMDA] receptor subunit epsilon 1 | CHEMBL1972 | 6918 | Antagonist |
| 449 | Glutamate [NMDA] receptor subunit epsilon 3 | CHEMBL4109 | 6920 | Antagonist |
| 449 | Glutamate [NMDA] receptor subunit epsilon 4 | CHEMBL2591 | 6921 | Antagonist |
| 449 | Glutamate NMDA receptor; GRIN1/GRIN2B | CHEMBL1907603 | 6917, 6919 | Antagonist |
| 452 | Phosphodiesterase 5A | CHEMBL1827 | 12560 | Inhibitor |

TABLE 3-continued

Ligand sets

| Ligand No. | Target Name | Target ChEMBL ID | Payload ID | Action type |
|---|---|---|---|---|
| 453 | Peroxisome proliferator-activated receptor delta | CHEMBL3979 | 12427 | Agonist |
| 453 | Peroxisome proliferator-activated receptor gamma | CHEMBL235 | 12428 | Agonist |
| 455 | Peroxisome proliferator-activated receptor alpha | CHEMBL239 | 12426 | Agonist |
| 456 | MAP kinase p38 alpha | CHEMBL260 | 10445 | Inhibitor |
| 459 | Neuronal acetylcholine receptor protein alpha-7 subunit | CHEMBL2492 | 2940 | Positive allosteric modulator |
| 460 | Endothelin receptor ET-A | CHEMBL252 | 5399 | Antagonist |
| 461 | Mu opioid receptor | CHEMBL233 | 12037 | Antagonist |
| 462 | Vascular endothelial growth factor receptor | CHEMBL2095227 | 6336, 6339, 9005 | Inhibitor |
| 463 | Delta opioid receptor | CHEMBL236 | 12035 | Agonist |
| 463 | Kappa opioid receptor | CHEMBL237 | 12036 | Agonist |
| 463 | Mu opioid receptor | CHEMBL233 | 12037 | Agonist |
| 465 | DNA | CHEMBL2311221 | | Inhibitor |
| 465 | DNA (cytosine-5)-methyltransferase 1 | CHEMBL1993 | 4953 | Inhibitor |
| 465 | DNA (cytosine-5)-methyltransferase 3A | CHEMBL1992 | 4954 | Inhibitor |
| 465 | RNA | CHEMBL2311222 | | Inhibitor |
| 466 | Histamine H1 receptor | CHEMBL231 | 7620 | Antagonist |
| 467 | Amidophosphoribosyltransferase | CHEMBL2362992 | 12679 | Inhibitor |
| 467 | DNA | CHEMBL2311221 | | Inhibitor |
| 469 | Neuronal acetylcholine receptor protein alpha-7 subunit | CHEMBL2492 | 2940 | Agonist |
| 470 | Tyrosine-protein kinase ABL | CHEMBL1862 | 149 | Inhibitor |
| 470 | Tyrosine-protein kinase SRC | CHEMBL267 | 16684 | Inhibitor |
| 471 | Glycogen synthase kinase-3 | CHEMBL2095188 | 7039, 7040 | Inhibitor |
| 472 | Serine/threonine-protein kinase PIM | CHEMBL3559682 | 12722-12724 | Inhibitor |
| 473 | HERG | CHEMBL240 | 13089 | Blocker |
| 473 | Sodium channel protein type V alpha subunit | CHEMBL1980 | 15998 | Blocker |
| 473 | Voltage-gated L-type calcium channel alpha-1C subunit | CHEMBL1940 | 2138 | Blocker |
| 473 | Voltage-gated L-type calcium channel alpha-1D subunit | CHEMBL4138 | 2139 | Blocker |
| 473 | Voltage-gated L-type calcium channel alpha-1F subunit | CHEMBL5593 | 2140 | Blocker |
| 473 | Voltage-gated L-type calcium channel alpha-1S subunit | CHEMBL3805 | 2141 | Blocker |
| 474 | Vanilloid receptor | CHEMBL4794 | 18061 | Antagonist |
| 475 | Neuronal acetylcholine receptor; alpha4/beta2 | CHEMBL1907589 | 2945, 2951 | Agonist |
| 476 | Tyrosine-protein kinase JAK2 | CHEMBL2971 | 8596 | Inhibitor |
| 477 | Serine/threonine-protein kinase WEE1 | CHEMBL5491 | 19469 | Inhibitor |
| 478 | G protein-coupled receptor 44 | CHEMBL5071 | 13445 | Antagonist |
| 479 | Serine/threonine-protein kinase mTOR | CHEMBL2842 | 9934 | Inhibitor |
| 480 | Metabotropic glutamate receptor 5 | CHEMBL3227 | 6929 | Modulator |
| 482 | Cannabinoid CB1 receptor | CHEMBL218 | 2270 | Antagonist |
| 483 | C-C chemokine receptor type 2 | CHEMBL4015 | 2861 | Antagonist |
| 484 | Metabotropic glutamate receptor 5 | CHEMBL3227 | 6929 | Negative allosteric modulator |
| 486 | Neurokinin 3 receptor | CHEMBL4429 | 17317 | Antagonist |
| 487 | Sodium channel protein type IX alpha subunit | CHEMBL4296 | 15997 | Blocker |
| 488 | Beta-2 adrenergic receptor | CHEMBL210 | 773 | Agonist |
| 490 | Androgen Receptor | CHEMBL1871 | 1034 | Modulator |
| 491 | Fibroblast growth factor receptor | CHEMBL2095217 | 6253-6256 | Inhibitor |
| 492 | Epidermal growth factor receptor erbB1 | CHEMBL203 | 5466 | Inhibitor |
| 493 | C-C chemokine receptor type 1 | CHEMBL2413 | 2859 | Antagonist |
| 494 | Serine/threonine-protein kinase AKT | CHEMBL2111353 | 19217-19219 | Inhibitor |
| 495 | Cyclin-dependent kinase | CHEMBL3559691 | 4269, 4270, 4272-4281, 4285-4288, 4291-4294 | Inhibitor |
| 496 | C-C chemokine receptor type 5 | CHEMBL274 | 2864 | Antagonist |
| 498 | GABA receptor alpha-2 subunit | CHEMBL4956 | 6683 | Positive allosteric modulator |
| 499 | PI3-kinase class I | CHEMBL3559703 | 12526-12529, 12596-12598, 12601 | Inhibitor |
| 500 | MAP kinase p38 alpha | CHEMBL260 | 10445 | Inhibitor |

TABLE 3-continued

Ligand sets

| Ligand No. | Target Name | Target ChEMBL ID | Payload ID | Action type |
|---|---|---|---|---|
| 501 | Serine-protein kinase ATR | CHEMBL5024 | 1645 | Inhibitor |
| 502 | PI3-kinase p110-beta subunit | CHEMBL3145 | 12527 | |
| 503 | Neurotrophic tyrosine kinase receptor | CHEMBL3559684 | 11145-11147 | Inhibitor |
| 504 | HERG | CHEMBL240 | 13089 | Blocker |
| 505 | GABA receptor alpha-2 subunit | CHEMBL4956 | 6683 | Positive allosteric modulator |
| 506 | Nerve growth factor receptor Trk-A | CHEMBL2815 | 11145 | Inhibitor |
| 506 | Neurotrophic tyrosine kinase receptor type 2 | CHEMBL4898 | 11146 | Inhibitor |
| 506 | NT-3 growth factor receptor | CHEMBL5608 | 11147 | Inhibitor |
| 507 | MAP kinase p38 alpha | CHEMBL260 | 10445 | Inhibitor |
| 508 | Serine/threonine-protein kinase Chk1 | CHEMBL4630 | 2825 | Inhibitor |
| 509 | Serine/threonine-protein kinase mTOR | CHEMBL2842 | 9934 | Inhibitor |
| 510 | PI3-kinase p110-beta subunit | CHEMBL3145 | 12527 | Inhibitor |
| 510 | PI3-kinase p110-delta subunit | CHEMBL3130 | 12528 | Inhibitor |
| 511 | Dual specificity mitogen-activated protein kinase kinase 1 | CHEMBL3587 | 10458 | Inhibitor |
| 511 | Dual specificity mitogen-activated protein kinase kinase 2 | CHEMBL2964 | 10459 | Inhibitor |
| 512 | Muscarinic acetylcholine receptor M3 | CHEMBL245 | 2937 | Antagonist |
| 513 | P2X purinoceptor 7 | CHEMBL4805 | 13904 | Antagonist |
| 516 | Histamine H1 receptor | CHEMBL231 | 7620 | Antagonist |
| 518 | Type-1 angiotensin II receptor | CHEMBL227 | 1058 | Antagonist |
| 522 | Tyrosine-protein kinase ABL | CHEMBL1862 | 149 | |
| 522 | Tyrosine-protein kinase SRC | CHEMBL267 | 16684 | |
| 527 | GABA-B receptor | CHEMBL2111463 | 6688, 6689 | Agonist |
| 529 | Tyrosine-protein kinase ABL | CHEMBL1862 | 149 | Inhibitor |
| 529 | Tyrosine-protein kinase Lyn | CHEMBL3905 | 9637 | Inhibitor |
| 532 | Peroxisome proliferator-activated receptor gamma | CHEMBL235 | 12428 | Partial agonist |
| 533 | MAP kinase p38 alpha | CHEMBL260 | 10445 | Inhibitor |
| 538 | Arachidonate 5-lipoxygenase | CHEMBL215 | 1310 | Inhibitor |
| 538 | Cyclooxygenase | CHEMBL2094253 | 13461, 13462 | Inhibitor |
| 538 | Peroxisome proliferator-activated receptor gamma | CHEMBL235 | 12428 | Agonist |
| 542 | Serine/threonine-protein kinase Aurora-B | CHEMBL2185 | 1657 | Inhibitor |
| 545 | Inhibitor of nuclear factor kappa B kinase beta subunit | CHEMBL1991 | 8194 | Inhibitor |
| 545 | Keap1/Nrf2 | CHEMBL3038498 | 8699, 11381 | Inhibitor |
| 545 | Peroxisome proliferator-activated receptor gamma | CHEMBL235 | 12428 | Antagonist |
| 546 | Tyrosine-protein kinase JAK1 | CHEMBL2835 | 8595 | Inhibitor |
| 546 | Tyrosine-protein kinase JAK2 | CHEMBL2971 | 8596 | Inhibitor |
| 547 | Oxytocin receptor | CHEMBL2049 | 12157 | Antagonist |
| 548 | Interleukin-2 receptor | CHEMBL2364167 | 8444-8446 | Inhibitor |
| 549 | Metabotropic glutamate receptor 5 | CHEMBL3227 | 6929 | Modulator |
| 550 | Beta-2 adrenergic receptor | CHEMBL210 | 773 | Agonist |
| 550 | Muscarinic acetylcholine receptor M2 | CHEMBL211 | 2936 | Antagonist |
| 550 | Muscarinic acetylcholine receptor M3 | CHEMBL245 | 2937 | Antagonist |
| 552 | Histamine H3 receptor | CHEMBL264 | 7622 | Antagonist |
| 553 | Adenosine A1 receptor | CHEMBL226 | 624 | Agonist |
| 554 | PI3-kinase p110-alpha subunit | CHEMBL4005 | 12526 | Inhibitor |
| 554 | PI3-kinase p110-beta subunit | CHEMBL3145 | 12527 | Inhibitor |
| 555 | Serine/threonine-protein kinase AKT | CHEMBL4282 | 19217 | Inhibitor |
| 555 | Serine/threonine-protein kinase AKT2 | CHEMBL2431 | 19218 | Inhibitor |
| 556 | Dual specificity protein kinase TTK | CHEMBL3983 | 18636 | Inhibitor |
| 557 | Fibroblast growth factor receptor | CHEMBL2095217 | 6253-6256 | Inhibitor |
| 558 | Dual specificity protein kinase TTK | CHEMBL3983 | 18636 | Inhibitor |
| 559 | Estrogen receptor | CHEMBL2093866 | 5551, 5552 | Modulator |
| 562 | Platelet-derived growth factor receptor | CHEMBL2095189 | 12773, 12774 | Agonist |
| 564 | Glucocorticoid receptor | CHEMBL2034 | 11442 | Agonist |
| 565 | Vitamin D receptor | CHEMBL1977 | 19293 | Agonist |
| 567 | Beta-2 adrenergic receptor | CHEMBL210 | 773 | Agonist |

TABLE 3-continued

Ligand sets

| Ligand No. | Target Name | Target ChEMBL ID | Payload ID | Action type |
|---|---|---|---|---|
| 568 | Serotonin 1a (5-HT1a) receptor | CHEMBL214 | 61 | Agonist |
| 569 | T-lymphocyte activation antigen CD80 | CHEMBL2364157 | 2585 | Inhibitor |
| 569 | T-lymphocyte activation antigen CD86 | CHEMBL2364156 | 2590 | Inhibitor |
| 570 | Tumor necrosis factor ligand superfamily member 13B | CHEMBL2364158 | 18716 | Inhibitor |
| 571 | Histone deacetylase | CHEMBL2093865 | 7713-7723 | Inhibitor |
| 572 | Angiotensin-converting enzyme | CHEMBL1808 | 1056 | Inhibitor |
| 573 | DNA | CHEMBL2311221 | | Inhibitor |
| 574 | Thiazide-sensitive sodium-chloride cotransporter | CHEMBL1876 | 16025 | Inhibitor |
| 575 | Sodium channel alpha subunit | CHEMBL2331043 | 15989, 15991, 15993, 15995, 15997-16001, 16002 | Blocker |
| 576 | c-Jun N-terminal kinase, JNK | CHEMBL2096667 | 10441, 10451, 10455 | Inhibitor |
| 589 | Slowly adapting pulmonary stretch receptor | CHEMBL2364682 | | Inhibitor |
| 595 | Norepinephrine transporter | CHEMBL222 | 16329 | Releasing agent |
| 595 | Synaptic vesicular amine transporter | CHEMBL1893 | 16067 | Inhibitor |
| 596 | Dopamine D2 receptor | CHEMBL217 | 5041 | Modulator |
| 597 | Thiazide-sensitive sodium-chloride cotransporter | CHEMBL1876 | 16025 | Inhibitor |
| 598 | Muscarinic acetylcholine receptor M1 | CHEMBL216 | 2935 | Antagonist |
| 609 | Histamine H1 receptor | CHEMBL231 | 7620 | Antagonist |
| 610 | Voltage-gated calcium channel | CHEMBL2363032 | 2121-2128, 2130-2147 | Blocker |
| 636 | Betaine-homocysteine S-methyltransferase | CHEMBL3391661 | 1834, 1835 | Substrate |
| 641 | Glucocorticoid receptor | CHEMBL2034 | 11442 | Agonist |
| 642 | Glucocorticoid receptor | CHEMBL2034 | 11442 | Agonist |
| 643 | Glucocorticoid receptor | CHEMBL2034 | 11442 | Agonist |
| 644 | Glucocorticoid receptor | CHEMBL2034 | 11442 | Agonist |
| 645 | Glucocorticoid receptor | CHEMBL2034 | 11442 | Agonist |
| 646 | Glucocorticoid receptor | CHEMBL2034 | 11442 | Agonist |
| 650 | Beta-1 adrenergic receptor | CHEMBL213 | 772 | Antagonist |
| 651 | Histamine H2 receptor | CHEMBL1941 | 7621 | Agonist |
| 652 | Muscarinic acetylcholine receptor M2 | CHEMBL211 | 2936 | Agonist |
| 652 | Muscarinic acetylcholine receptor M3 | CHEMBL245 | 2937 | Agonist |
| 653 | Norepinephrine transporter | CHEMBL222 | 16329 | Substrate |
| 654 | Vascular endothelial growth factor A | CHEMBL1783 | 19239 | Inhibitor |
| 656 | Mu opioid receptor | CHEMBL233 | 12037 | Antagonist |
| 658 | Retinoid X receptor | CHEMBL2363070 | 14454-14456 | Agonist |
| 660 | Serine/threonine-protein kinase B-raf | CHEMBL5145 | 1924 | Inhibitor |
| 661 | PI3-kinase class I | CHEMBL3559703 | 12526-12529, 12596-12598, 12601 | Inhibitor |
| 661 | Serine/threonine-protein kinase mTOR | CHEMBL2842 | 9934 | Inhibitor |
| 662 | Bradykinin B1 receptor | CHEMBL4308 | 1922 | Antagonist |
| 663 | Serine/threonine-protein kinase PLK1 | CHEMBL3024 | 12860 | Inhibitor |
| 664 | Serine/threonine-protein kinase Aurora-B | CHEMBL2185 | 1657 | Inhibitor |
| 665 | Focal adhesion kinase 1 | CHEMBL2695 | 13729 | Inhibitor |
| 667 | Androgen Receptor | CHEMBL1871 | 1034 | Antagonist |
| 675 | Prostanoid FP receptor | CHEMBL1987 | 13455 | Agonist |
| 676 | Dual specificity mitogen-activated protein kinase kinase 1 | CHEMBL3587 | 10458 | Inhibitor |
| 676 | Dual specificity mitogen-activated protein kinase kinase 2 | CHEMBL2964 | 10459 | Inhibitor |
| 677 | Adenosine A2a receptor | CHEMBL251 | 625 | Agonist |
| 682 | Muscarinic acetylcholine receptor M1 | CHEMBL216 | 2935 | Antagonist |
| 702 | Cyclooxygenase | CHEMBL2094253 | 13461, 13462 | Inhibitor |
| 704 | Beta-1 adrenergic receptor | CHEMBL213 | 772 | Antagonist |
| 705 | Beta-2 adrenergic receptor | CHEMBL210 | 773 | Agonist |
| 706 | Thrombin | CHEMBL204 | 3583 | Inhibitor |
| 707 | C—X—C chemokine receptor type 4 | CHEMBL2107 | 2889 | Antagonist |
| 709 | DNA | CHEMBL2311221 | | Inhibitor |
| 710 | B-lymphocyte antigen CD19 | CHEMBL3390821 | 2519 | Cross-linking agent |
| 710 | T cell surface glycoprotein CD3 | CHEMBL2364168 | 2557, 2558, 2560 | Cross-linking agent |

TABLE 3-continued

Ligand sets

| Ligand No. | Target Name | Target ChEMBL ID | Payload ID | Action type |
|---|---|---|---|---|
| 713 | Calcium-activated potassium channel subunit alpha-1 | CHEMBL4304 | 13053 | Activator |
| 714 | Cyclin-dependent kinase 2 | CHEMBL301 | 4281 | Inhibitor |
| 714 | Cyclin-dependent kinase 7 | CHEMBL3055 | 4292 | Inhibitor |
| 714 | Cyclin-dependent kinase 9 | CHEMBL3116 | 4294 | Inhibitor |
| 715 | MAP kinase p38 alpha | CHEMBL260 | 10445 | Inhibitor |
| 716 | Epidermal growth factor receptor erbB1 | CHEMBL203 | 5466 | Inhibitor |
| 716 | Receptor protein-tyrosine kinase erbB-2 | CHEMBL1824 | 5520 | Inhibitor |
| 716 | Receptor protein-tyrosine kinase erbB-4 | CHEMBL3009 | 5522 | Inhibitor |
| 716 | Vascular endothelial growth factor receptor | CHEMBL2095227 | 6336, 6339, 9005 | Inhibitor |
| 717 | Hepatocyte growth factor receptor | CHEMBL3717 | 10107 | Inhibitor |
| 718 | Insulin receptor | CHEMBL1981 | 8245 | Inhibitor |
| 718 | Insulin-like growth factor I receptor | CHEMBL1957 | 8256 | Inhibitor |
| 719 | Hepatocyte growth factor receptor | CHEMBL3717 | 10107 | Inhibitor |
| 720 | LXR-beta | CHEMBL4093 | 11430 | Agonist |
| 721 | Hepatocyte growth factor receptor | CHEMBL3717 | 10107 | Inhibitor |
| 721 | Vascular endothelial growth factor receptor 2 | CHEMBL279 | 9005 | Inhibitor |
| 722 | Hepatocyte growth factor receptor | CHEMBL3717 | 10107 | Inhibitor |
| 722 | Vascular endothelial growth factor receptor 2 | CHEMBL279 | 9005 | Inhibitor |
| 723 | Smoothened homolog | CHEMBL5971 | 15967 | Antagonist |
| 724 | LXR-alpha | CHEMBL2808 | 11431 | Modulator |
| 724 | LXR-beta | CHEMBL4093 | 11430 | Modulator |
| 725 | Cell division cycle 7-related protein kinase | CHEMBL5443 | 2667 | Inhibitor |
| 726 | Tyrosine-protein kinase JAK2 | CHEMBL2971 | 8596 | Inhibitor |
| 734 | 26S proteosome | CHEMBL2364701 | 13506-13509 | Inhibitor |
| 735 | Endothelin receptor, ET-A/ET-B | CHEMBL2096678 | 5399, 5400 | Antagonist |
| 736 | Tyrosine-protein kinase ABL | CHEMBL1862 | 149 | Inhibitor |
| 736 | Tyrosine-protein kinase HCK | CHEMBL3234 | 7387 | Inhibitor |
| 736 | Tyrosine-protein kinase Lyn | CHEMBL3905 | 9637 | Inhibitor |
| 736 | Tyrosine-protein kinase SRC | CHEMBL267 | 16684 | Inhibitor |
| 738 | Synaptosomal-associated protein 25 | CHEMBL2364159 | 17018 | Inhibitor |
| 739 | Vesicle-associated membrane protein 2 | CHEMBL2364160 | 19269 | Inhibitor |
| 740 | Hepatocyte growth factor receptor | CHEMBL3717 | 10107 | Inhibitor |
| 740 | Tyrosine-protein kinase receptor UFO | CHEMBL4895 | 1685 | Inhibitor |
| 741 | Neuronal acetylcholine receptor protein alpha-7 subunit | CHEMBL2492 | 2940 | Agonist |
| 744 | Melanocortin receptor 1 | CHEMBL3795 | 9987 | Agonist |
| 744 | Melanocortin receptor 3 | CHEMBL4644 | 9991 | Agonist |
| 744 | Melanocortin receptor 4 | CHEMBL259 | 9992 | Agonist |
| 745 | Tubulin | CHEMBL2095182 | 18669-18675, 18679-18687 | Inhibitor |
| 745 | Tumor necrosis factor receptor superfamily member 8 | CHEMBL2364161 | 18742 | Inhibitor |
| 747 | Norepinephrine transporter | CHEMBL222 | 16329 | Substrate |
| 748 | Dopamine D2 receptor | CHEMBL217 | 5041 | Partial agonist |
| 748 | Serotonin 1a (5-HT1a) receptor | CHEMBL214 | 61 | Partial agonist |
| 748 | Serotonin 2a (5-HT2a) receptor | CHEMBL224 | 66 | Antagonist |
| 749 | G1/S-specific cyclin D1 | CHEMBL3610 | 4243 | Inhibitor |
| 750 | ALK tyrosine kinase receptor | CHEMBL4247 | 1032 | Inhibitor |
| 750 | Epidermal growth factor receptor erbB1 | CHEMBL203 | 5466 | Inhibitor |
| 751 | Adrenergic receptor alpha-2 | CHEMBL2095158 | 769-771 | Agonist |
| 752 | Carbonic anhydrase II | CHEMBL205 | 2311 | Inhibitor |
| 753 | Fibroblast growth factor receptor | CHEMBL2095217 | 6253-6256 | Inhibitor |
| 753 | Vascular endothelial growth factor receptor | CHEMBL2095227 | 6336, 6339, 9005 | Inhibitor |
| 754 | Fibroblast growth factor receptor | CHEMBL2095217 | 6253-6256 | Inhibitor |
| 754 | Vascular endothelial growth factor receptor | CHEMBL2095227 | 6336, 6339, 9005 | Inhibitor |
| 758 | Cyclooxygenase | CHEMBL2094253 | 13461, 13462 | Inhibitor |
| 759 | D2-like dopamine receptor | CHEMBL2331075 | 5041-5043 | Agonist |

TABLE 3-continued

Ligand sets

| Ligand No. | Target Name | Target ChEMBL ID | Payload ID | Action type |
|---|---|---|---|---|
| 760 | Histamine H1 receptor | CHEMBL231 | 7620 | Antagonist |
| 765 | Histamine H1 receptor | CHEMBL231 | 7620 | Antagonist |
| 767 | Histamine H1 receptor | CHEMBL231 | 7620 | Antagonist |
| 768 | Glucocorticoid receptor | CHEMBL2034 | 11442 | Agonist |
| 771 | Sodium-(potassium)-chloride cotransporter 2 | CHEMBL1874 | 16026 | Inhibitor |
| 772 | PI3-kinase class I | CHEMBL3559703 | 12526-12529, 12596-12598, 12601 | Inhibitor |
| 773 | Sodium channel protein type IV alpha subunit | CHEMBL2072 | 15995 | Blocker |
| 775 | Kappa opioid receptor | CHEMBL237 | 12036 | Agonist |
| 775 | Mu opioid receptor | CHEMBL233 | 12037 | Agonist |
| 776 | Dopamine transporter | CHEMBL238 | 16330 | Inhibitor |
| 776 | Norepinephrine transporter | CHEMBL222 | 16329 | Inhibitor |
| 777 | Neurokinin 1 receptor | CHEMBL249 | 17315 | Antagonist |
| 778 | C—X—C chemokine receptor type 4 | CHEMBL2107 | 2889 | Antagonist |
| 780 | Serotonin 1a (5-HT1a) receptor | CHEMBL214 | 61 | Partial agonist |
| 781 | DNA | CHEMBL2311221 | | Inhibitor |
| 783 | GABA-A receptor; anion channel | CHEMBL2093872 | 6682-6696, 6700 | Positive allosteric modulator |
| 784 | GABA-A receptor; anion channel | CHEMBL2093872 | 6682-6696, 6700 | Positive allosteric modulator |
| 790 | Kappa opioid receptor | CHEMBL237 | 12036 | Partial agonist |
| 790 | Mu opioid receptor | CHEMBL233 | 12037 | Partial agonist |
| 801 | Adenosine A2a receptor | CHEMBL251 | 625 | Agonist |
| 806 | DNA topoisomerase II | CHEMBL2094255 | 17865, 12866 | Inhibitor |
| 806 | Tyrosine-protein kinase receptor FLT3 | CHEMBL1974 | 6337 | Inhibitor |
| 811 | Tubulin | CHEMBL2095182 | 18669-18675, 18679-18687 | Inhibitor |
| 812 | Dopamine D2 receptor | CHEMBL217 | 5041 | Agonist |
| 813 | Hepatocyte growth factor receptor | CHEMBL3717 | 10107 | Inhibitor |
| 813 | Vascular endothelial growth factor receptor 2 | CHEMBL279 | 9005 | Inhibitor |
| 815 | Adenosine receptor | CHEMBL2111329 | 624-627 | Antagonist |
| 816 | Serine/threonine-protein kinase PLK1 | CHEMBL3024 | 12860 | Inhibitor |
| 817 | PI3-kinase p110-delta subunit | CHEMBL3130 | 12528 | Inhibitor |
| 817 | PI3-kinase p110-gamma subunit | CHEMBL3267 | 12529 | Inhibitor |
| 820 | Vitamin D receptor | CHEMBL1977 | 19293 | Agonist |
| 822 | Calcitonin receptor | CHEMBL1832 | 2101 | Agonist |
| 823 | Calcitonin receptor | CHEMBL1832 | 2101 | Agonist |
| 824 | Calcitonin receptor | CHEMBL1832 | 2101 | Agonist |
| 825 | Vitamin D receptor | CHEMBL1977 | 19293 | Agonist |
| 827 | Phosphate | CHEMBL2364184 | | Sequestering agent |
| 831 | Motilin receptor | CHEMBL2203 | 10550 | Agonist |
| 835 | Sodium/glucose cotransporter 2 | CHEMBL3884 | 16309 | Inhibitor |
| 836 | Interleukin-1 beta | CHEMBL1909490 | 8411 | Inhibitor |
| 839 | Type-1 angiotensin II receptor | CHEMBL227 | 1058 | Antagonist |
| 842 | Epidermal growth factor receptor erbB1 | CHEMBL203 | 5466 | Inhibitor |
| 842 | Receptor protein-tyrosine kinase erbB-2 | CHEMBL1824 | 5520 | Inhibitor |
| 842 | Receptor protein-tyrosine kinase erbB-4 | CHEMBL3009 | 5522 | Inhibitor |
| 844 | Purinergic receptor P2Y12 | CHEMBL2001 | 13908 | Antagonist |
| 845 | Adenosine A1 receptor | CHEMBL226 | 624 | Partial agonist |
| 846 | DNA | CHEMBL2311221 | | Inhibitor |
| 846 | RNA | CHEMBL2311222 | | Inhibitor |
| 846 | Thymidylate synthase | CHEMBL1952 | 17755 | Inhibitor |
| 847 | Serotonin 4 (5-HT4) receptor | CHEMBL1875 | 74 | Partial agonist |
| 848 | Hepatocyte growth factor receptor | CHEMBL3717 | 10107 | Inhibitor |
| 852 | Vanilloid receptor | CHEMBL4794 | 18061 | Opener |
| 854 | Angiotensin-converting enzyme | CHEMBL1808 | 1056 | Inhibitor |
| 856 | Muscarinic acetylcholine receptor M3 | CHEMBL245 | 2937 | Agonist |
| 857 | Sodium channel alpha subunit | CHEMBL2331043 | 15989, 15991, 15993, 15995, 15997-16001, 16002 | Blocker |
| 865 | DOPA decarboxylase | CHEMBL1843 | 5037 | Inhibitor |
| 867 | Histamine H1 receptor | CHEMBL231 | 7620 | Antagonist |
| 871 | DNA | CHEMBL2311221 | | Inhibitor |
| 872 | Prostanoid FP receptor | CHEMBL1987 | 13455 | Agonist |
| 882 | 26S proteosome | CHEMBL2364701 | 13506-13509 | Inhibitor |

TABLE 3-continued

Ligand sets

| Ligand No. | Target Name | Target ChEMBL ID | Payload ID | Action type |
|---|---|---|---|---|
| 883 | Carbamoyl-phosphate synthase [ammonia], mitochondrial | CHEMBL2362990 | 2292 | Positive allosteric modulator |
| 884 | Dopamine D2 receptor | CHEMBL217 | 5041 | Modulator |
| 884 | Dopamine D3 receptor | CHEMBL234 | 5042 | Modulator |
| 886 | Beta-2 adrenergic receptor | CHEMBL210 | 773 | Agonist |
| 887 | DNA | CHEMBL2311221 | | Inhibitor |
| 887 | Glutathione reductase | CHEMBL2755 | 6980 | Inhibitor |
| 887 | RNA | CHEMBL2311222 | | Inhibitor |
| 888 | Dopamine D2 receptor | CHEMBL217 | 5041 | Antagonist |
| 888 | Serotonin 2a (5-HT2a) receptor | CHEMBL224 | 66 | Antagonist |
| 888 | Serotonin 2c (5-HT2c) receptor | CHEMBL225 | 68 | Antagonist |
| 889 | Cyclooxygenase-2 | CHEMBL230 | 13462 | Inhibitor |
| 890 | Adrenergic receptor beta | CHEMBL2094118 | 772-774 | Antagonist |
| 891 | Adrenergic receptor alpha-1 | CHEMBL2094251 | 766-768 | Antagonist |
| 891 | Adrenergic receptor beta | CHEMBL2094118 | 772-774 | Antagonist |
| 892 | Neurokinin 1 receptor | CHEMBL249 | 17315 | Antagonist |
| 895 | Androgen Receptor | CHEMBL1871 | 1034 | Antagonist |
| 898 | DNA-dependent protein kinase | CHEMBL3142 | 13621 | Inhibitor |
| 898 | Serine/threonine-protein kinase mTOR | CHEMBL2842 | 9934 | Inhibitor |
| 899 | Serine/threonine-protein kinase mTOR | CHEMBL2842 | 9934 | Inhibitor |
| 900 | c-Jun N-terminal kinase 1 | CHEMBL2276 | 10451 | Inhibitor |
| 900 | c-Jun N-terminal kinase 2 | CHEMBL4179 | 10455 | Inhibitor |
| 900 | c-Jun N-terminal kinase 3 | CHEMBL2637 | 10441 | Inhibitor |
| 902 | C-C chemokine receptor type 2 | CHEMBL4015 | 2861 | Antagonist |
| 903 | C5a anaphylatoxin chemotactic receptor | CHEMBL2373 | 3894 | Antagonist |
| 905 | C-C chemokine receptor type 1 | CHEMBL2413 | 2859 | Antagonist |
| 911 | P2X purinoceptor 7 | CHEMBL4805 | 13904 | Antagonist |
| 912 | Tyrosine-protein kinase TIE-2 | CHEMBL4128 | 17514 | Inhibitor |
| 913 | Delta opioid receptor | CHEMBL236 | 12035 | Agonist |
| 913 | Kappa opioid receptor | CHEMBL237 | 12036 | Agonist |
| 913 | Mu opioid receptor | CHEMBL233 | 12037 | Agonist |
| 913 | Nociceptin receptor | CHEMBL2014 | 12031 | Agonist |
| 914 | Platelet-derived growth factor receptor | CHEMBL2095189 | 12773, 12774 | Inhibitor |
| 914 | Stem cell growth factor receptor | CHEMBL1936 | 19299 | Inhibitor |
| 914 | Vascular endothelial growth factor receptor | CHEMBL2095227 | 6336, 6339, 9005 | Inhibitor |
| 952 | Cyclooxygenase-2 | CHEMBL230 | 13462 | Inhibitor |
| 956 | C-C chemokine receptor type 2 | CHEMBL4015 | 2861 | Antagonist |
| 956 | C-C chemokine receptor type 5 | CHEMBL274 | 2864 | Antagonist |
| 957 | Serine/threonine-protein kinase Aurora | CHEMBL3430911 | 1654, 1657, 1658 | Inhibitor |
| 958 | Tyrosine-protein kinase TIE-2 | CHEMBL4128 | 17514 | Inhibitor |
| 958 | Vascular endothelial growth factor receptor | CHEMBL2095227 | 6336, 6339, 9005 | Inhibitor |
| 959 | c-Jun N-terminal kinase 1 | CHEMBL2276 | 10451 | Inhibitor |
| 959 | c-Jun N-terminal kinase 2 | CHEMBL4179 | 10455 | Inhibitor |
| 959 | c-Jun N-terminal kinase 3 | CHEMBL2637 | 10441 | Inhibitor |
| 959 | Mitogen-activated protein kinase kinase kinase 10 | CHEMBL2873 | 10466 | Inhibitor |
| 959 | Mitogen-activated protein kinase kinase kinase 11 | CHEMBL2708 | 10467 | Inhibitor |
| 959 | Mitogen-activated protein kinase kinase kinase 9 | CHEMBL2872 | 10480 | Inhibitor |
| 960 | Neurotrophic tyrosine kinase receptor | CHEMBL3559684 | 11145-11147 | Inhibitor |
| 960 | Platelet-derived growth factor receptor beta | CHEMBL1913 | 12774 | Inhibitor |
| 960 | Protein kinase C (PKC) | CHEMBL2093867 | 13588-13590, 13592-13598, 13600 | Inhibitor |
| 960 | Tyrosine-protein kinase receptor FLT3 | CHEMBL1974 | 6337 | Inhibitor |
| 960 | Tyrosine-protein kinase receptor RET | CHEMBL2041 | 14404 | Inhibitor |
| 961 | Nerve growth factor receptor Trk-A | CHEMBL2815 | 11145 | |
| 962 | Epidermal growth factor receptor erbB1 | CHEMBL203 | 5466 | Inhibitor |
| 962 | Serine/threonine-protein kinase B-raf | CHEMBL5145 | 1924 | Inhibitor |
| 962 | Tyrosine-protein kinase receptor RET | CHEMBL2041 | 14404 | Inhibitor |

TABLE 3-continued

Ligand sets

| Ligand No. | Target Name | Target ChEMBL ID | Payload ID | Action type |
|---|---|---|---|---|
| 963 | ALK tyrosine kinase receptor | CHEMBL4247 | 1032 | Inhibitor |
| 963 | Focal adhesion kinase 1 | CHEMBL2695 | 13729 | Inhibitor |
| 964 | Vascular endothelial growth factor receptor | CHEMBL2095227 | 6336, 6339, 9005 | |
| 965 | Vascular endothelial growth factor receptor | CHEMBL2095227 | 6336, 6339, 9005 | Inhibitor |
| 974 | Peroxisome proliferator-activated receptor delta | CHEMBL3979 | 12427 | Agonist |
| 975 | Glutamate NMDA receptor; GRIN1/GRIN2B | CHEMBL1907603 | 6917, 6919 | Antagonist |
| 976 | Tyrosine-protein kinase JAK1 | CHEMBL2835 | 8595 | Inhibitor |
| 976 | Tyrosine-protein kinase JAK3 | CHEMBL2148 | 8597 | Inhibitor |
| 976 | Tyrosine-protein kinase SYK | CHEMBL2599 | 16634 | Inhibitor |
| 976 | Tyrosine-protein kinase TYK2 | CHEMBL3553 | 18803 | Inhibitor |
| 977 | ALK tyrosine kinase receptor | CHEMBL4247 | 1032 | Inhibitor |
| 978 | HMG-CoA reductase | CHEMBL402 | 26 | Inhibitor |
| 979 | Serotonin 6 (5-HT6) receptor | CHEMBL3371 | 76 | Antagonist |
| 980 | TNF-alpha | CHEMBL1825 | 18711 | Inhibitor |
| 982 | Cholecystokinin A receptor | CHEMBL1901 | 2925 | Agonist |
| 983 | Histamine H1 receptor | CHEMBL231 | 7620 | Antagonist |
| 984 | Gonadotropin-releasing hormone receptor | CHEMBL1855 | 7145 | Antagonist |
| 985 | Epidermal growth factor receptor erbB1 | CHEMBL203 | 5466 | Inhibitor |
| 988 | Muscarinic acetylcholine receptor M1 | CHEMBL216 | 2935 | Agonist |
| 988 | Muscarinic acetylcholine receptor M3 | CHEMBL245 | 2937 | Agonist |
| 990 | Adenosine A3 receptor | CHEMBL256 | 627 | Agonist |
| 992 | Bile acid receptor FXR | CHEMBL2047 | 11432 | Agonist |
| 995 | Estrogen receptor | CHEMBL2093866 | 5551, 5552 | Modulator |
| 996 | Serine/threonine-protein kinase Aurora-B | CHEMBL2185 | 1657 | Inhibitor |
| 996 | Vascular endothelial growth factor receptor | CHEMBL2095227 | 6336, 6339, 9005 | Inhibitor |
| 997 | Serine/threonine-protein kinase B-raf | CHEMBL5145 | 1924 | Inhibitor |
| 997 | Vascular endothelial growth factor receptor 2 | CHEMBL279 | 9005 | Inhibitor |
| 1000 | DNA | CHEMBL2311221 | | Inhibitor |
| 1006 | GABA-A receptor; anion channel | CHEMBL2093872 | 6682-6696, 6700 | Positive allosteric modulator |
| 1011 | Sodium channel alpha subunit | CHEMBL2331043 | 15989, 15991, 15993, 15995, 15997-16001, 16002 | Blocker |
| 1014 | Thiazide-sensitive sodium-chloride cotransporter | CHEMBL1876 | 16025 | Inhibitor |
| 1015 | Estrogen receptor beta | CHEMBL242 | 5552 | Modulator |
| 1019 | Histamine H1 receptor | CHEMBL231 | 7620 | Antagonist |
| 1020 | Serotonin transporter | CHEMBL228 | 16331 | Substrate |
| 1021 | D2-like dopamine receptor | CHEMBL2331075 | 5041-5043 | Antagonist |
| 1021 | Serotonin 2a (5-HT2a) receptor | CHEMBL224 | 66 | Antagonist |
| 1022 | Sulfonylurea receptor 1, Kir6.2 | CHEMBL2096972 | 1628, 13056 | Blocker |
| 1023 | Dopamine D2 receptor | CHEMBL217 | 5041 | Antagonist |
| 1023 | Dopamine D3 receptor | CHEMBL234 | 5042 | Antagonist |
| 1023 | Serotonin 2a (5-HT2a) receptor | CHEMBL224 | 66 | Antagonist |
| 1023 | Serotonin 2c (5-HT2c) receptor | CHEMBL225 | 68 | Antagonist |
| 1025 | Thiazide-sensitive sodium-chloride cotransporter | CHEMBL1876 | 16025 | Inhibitor |
| 1026 | Intermediate conductance calcium-activated potassium channel protein 4 | CHEMBL4305 | 13052 | Opener |
| 1027 | Vitamin D receptor | CHEMBL1977 | 19293 | Agonist |
| 1031 | Bile acids | CHEMBL2364175 | | Sequestering agent |
| 1034 | Luteinizing hormone/Choriogonadotropin receptor | CHEMBL1854 | 9598 | Agonist |
| 1037 | Polypeptides | CHEMBL2364181 | | Proteolytic enzyme |
| 1039 | Polypeptides | CHEMBL2364181 | | Proteolytic enzyme |
| 1041 | Dual specificity mitogen-activated protein kinase kinase 1 | CHEMBL3587 | 10458 | Inhibitor |
| 1041 | Dual specificity mitogen-activated protein kinase kinase 2 | CHEMBL2964 | 10459 | Inhibitor |
| 1042 | Cholecystokinin B receptor | CHEMBL298 | 2926 | Antagonist |
| 1044 | Glucocorticoid receptor | CHEMBL2034 | 11442 | Agonist |
| 1048 | Renal dipeptidase | CHEMBL1989 | 4882 | Inhibitor |

TABLE 3-continued

Ligand sets

| Ligand No. | Target Name | Target ChEMBL ID | Payload ID | Action type |
|---|---|---|---|---|
| 1050 | Phosphodiesterase 3A | CHEMBL241 | 12553 | Inhibitor |
| 1051 | Histamine H2 receptor | CHEMBL1941 | 7621 | Antagonist |
| 1053 | Calcium sensing receptor | CHEMBL1878 | 2171 | Positive allosteric modulator |
| 1061 | Histamine H3 receptor | CHEMBL264 | 7622 | Modulator |
| 1069 | Serotonin 4 (5-HT4) receptor | CHEMBL1875 | 74 | Agonist |
| 1070 | Muscle-type nicotinic acetylcholine receptor | CHEMBL2362997 | 2941, 2950, 2954, 2955 2956 | Antagonist |
| 1072 | DNA | CHEMBL2311221 | | Inhibitor |
| 1074 | Serotonin transporter | CHEMBL228 | 16331 | Inhibitor |
| 1077 | DNA | CHEMBL2311221 | | Inhibitor |
| 1081 | Endothelin receptor ET-A | CHEMBL252 | 5399 | Antagonist |
| 1082 | Histamine H1 receptor | CHEMBL231 | 7620 | Antagonist |
| 1084 | Voltage-gated L-type calcium channel | CHEMBL2095229 | 2138-2141 | Blocker |
| 1085 | Muscarinic acetylcholine receptor M1 | CHEMBL216 | 2935 | Antagonist |
| 1085 | Muscarinic acetylcholine receptor M3 | CHEMBL245 | 2937 | Antagonist |
| 1090 | GABA-A receptor; anion channel | CHEMBL2093872 | 6682-6696, 6700 | Positive allosteric modulator |
| 1091 | Glucocorticoid receptor | CHEMBL2034 | 11442 | Agonist |
| 1093 | Glucocorticoid receptor | CHEMBL2034 | 11442 | Agonist |
| 1095 | DNA | CHEMBL2311221 | | Inhibitor |
| 1095 | DNA polymerase (alpha/delta/epsilon) | CHEMBL2363042 | 12927, 12930, 12934 | Inhibitor |
| 1095 | Ribonucleoside-diphosphate reductase RR1 | CHEMBL2095215 | 14615-14617 | Inhibitor |
| 1098 | Peroxisome proliferator-activated receptor alpha | CHEMBL239 | 12426 | Agonist |
| 1100 | Serotonin transporter | CHEMBL228 | 16331 | Inhibitor |
| 1102 | GABA-A receptor; anion channel | CHEMBL2093872 | 6682-6696, 6700 | Positive allosteric modulator |
| 1103 | Adrenergic receptor alpha-2 | CHEMBL2095158 | 769-771 | Agonist |
| 1104 | Purinergic receptor P2Y12 | CHEMBL2001 | 13908 | Antagonist |
| 1106 | GABA-A receptor; anion channel | CHEMBL2093872 | 6682-6696, 6700 | Positive allosteric modulator |
| 1111 | Dopamine D2 receptor | CHEMBL217 | 5041 | Antagonist |
| 1111 | Serotonin 2a (5-HT2a) receptor | CHEMBL224 | 66 | Antagonist |
| 1112 | Peroxisome proliferator-activated receptor gamma | CHEMBL235 | 12428 | Agonist |
| 1113 | Platelet-derived growth factor receptor beta | CHEMBL1913 | 12774 | Inhibitor |
| 1113 | Stem cell growth factor receptor | CHEMBL1936 | 19299 | Inhibitor |
| 1113 | Tyrosine-protein kinase receptor FLT3 | CHEMBL1974 | 6337 | Inhibitor |
| 1113 | Vascular endothelial growth factor receptor 2 | CHEMBL279 | 9005 | Inhibitor |
| 1118 | Voltage-gated N-type calcium channel alpha-1B subunit | CHEMBL4478 | 2142 | Blocker |
| 1125 | Cytochrome P450 3A | CHEMBL2364675 | 4451, 4453, 4454, 4452 | Inhibitor |
| 1126 | Dual specificity mitogen-activated protein kinase kinase 1 | CHEMBL3587 | 10458 | Inhibitor |
| 1126 | Dual specificity mitogen-activated protein kinase kinase 1 | CHEMBL3587 | 10458 | Inhibitor |
| 1126 | Dual specificity mitogen-activated protein kinase kinase 2 | CHEMBL2964 | 10459 | Inhibitor |
| 1126 | Dual specificity mitogen-activated protein kinase kinase 2 | CHEMBL2964 | 10459 | Inhibitor |
| 1127 | Chloride channel protein 2 | CHEMBL1628478 | 2910 | Activator |
| 1129 | Opioid receptors; mu/kappa/delta | CHEMBL2095181 | 12035-12037 | Agonist |
| 1132 | Tubulin | CHEMBL2095182 | 18669-18675, 18679-18687 | Inhibitor |
| 1133 | Bile acids | CHEMBL2364175 | | Sequestering agent |
| 1134 | Bile acids | CHEMBL2364175 | | Sequestering agent |
| 1137 | Collagen | CHEMBL2364188 | 3083-3809, 3811-3813, 3817-3819, 3820-3824, 3829, 3830, 3835, 3838, 3843, 3846, 3847 | Hydrolytic enzyme |
| 1145 | Vasopressin V1a receptor | CHEMBL1889 | 1343 | Antagonist |
| 1145 | Vasopressin V2 receptor | CHEMBL1790 | 1345 | Antagonist |
| 1147 | PI3-kinase class I | CHEMBL3559703 | 12526-12529, 12596-12598, 12601 | Inhibitor |
| 1152 | Glucocorticoid receptor | CHEMBL2034 | 11442 | Antagonist |
| 1153 | Glucocorticoid receptor | CHEMBL2034 | 11442 | Antagonist |
| 1154 | Melanocortin receptor 2 | CHEMBL1965 | 9988 | Agonist |

TABLE 3-continued

Ligand sets

| Ligand No. | Target Name | Target ChEMBL ID | Payload ID | Action type |
|---|---|---|---|---|
| 1155 | Melanocortin receptor 2 | CHEMBL1965 | 9988 | Agonist |
| 1156 | Glucocorticoid receptor | CHEMBL2034 | 11442 | Agonist |
| 1157 | Melanocortin receptor 2 | CHEMBL1965 | 9988 | Agonist |
| 1163 | Fibroblast growth factor receptor | CHEMBL2095217 | 6253-6256 | Inhibitor |
| 1163 | Tyrosine-protein kinase receptor Tie-1 | CHEMBL5274 | 18804 | Inhibitor |
| 1163 | Vascular endothelial growth factor receptor | CHEMBL2095227 | 6336, 6339, 9005 | Inhibitor |
| 1165 | Receptor protein-tyrosine kinase erbB-2 | CHEMBL1824 | 5520 | Inhibitor |
| 1166 | Peroxisome proliferator-activated receptor alpha | CHEMBL239 | 12426 | Agonist |
| 1169 | Androgen Receptor | CHEMBL1871 | 1034 | Agonist |
| 1169 | Estrogen receptor beta | CHEMBL242 | 5552 | Agonist |
| 1171 | Cysteinyl leukotriene receptor 1 | CHEMBL1798 | 4363 | Antagonist |
| 1197 | Platelet-derived growth factor receptor | CHEMBL2095189 | 12773, 12774 | Inhibitor |
| 1197 | Tyrosine-protein kinase receptor FLT3 | CHEMBL1974 | 6337 | Inhibitor |
| 1198 | ALK tyrosine kinase receptor | CHEMBL4247 | 1032 | Inhibitor |
| 1198 | Hepatocyte growth factor receptor | CHEMBL3717 | 10107 | Inhibitor |
| 1199 | Anoctamin-1 | CHEMBL2046267 | 1183 | Blocker |
| 1199 | Cystic fibrosis transmembrane conductance regulator | CHEMBL4051 | 4367 | Inhibitor |
| 1210 | LXR-alpha | CHEMBL2808 | 11431 | Agonist |
| 1210 | LXR-beta | CHEMBL4093 | 11430 | Agonist |
| 1212 | Macrophage colony stimulating factor receptor | CHEMBL1844 | 3854 | Inhibitor |
| 1212 | Tyrosine-protein kinase JAK2 | CHEMBL2971 | 8596 | Inhibitor |
| 1212 | Tyrosine-protein kinase receptor FLT3 | CHEMBL1974 | 6337 | Inhibitor |
| 1213 | Nerve growth factor receptor Trk-A | CHEMBL2815 | 11145 | Inhibitor |
| 1215 | C—X—C chemokine receptor type 4 | CHEMBL2107 | 2889 | Antagonist |
| 1220 | Epidermal growth factor receptor erbB1 | CHEMBL203 | 5466 | Inhibitor |
| 1220 | Histone deacetylase | CHEMBL2093865 | 7713-7723 | Inhibitor |
| 1220 | Receptor protein-tyrosine kinase erbB-2 | CHEMBL1824 | 5520 | Inhibitor |
| 1221 | Histone deacetylase | CHEMBL2093865 | 7713-7723 | Inhibitor |
| 1221 | PI3-kinase p110-alpha subunit | CHEMBL4005 | 12526 | Inhibitor |
| 1221 | PI3-kinase p110-beta subunit | CHEMBL3145 | 12527 | Inhibitor |
| 1221 | PI3-kinase p110-delta subunit | CHEMBL3130 | 12528 | Inhibitor |
| 1228 | Serine/threonine-protein kinase Aurora | CHEMBL3430911 | 1654, 1657, 1658 | Inhibitor |
| 1228 | Vascular endothelial growth factor receptor 2 | CHEMBL279 | 9005 | Inhibitor |
| 1234 | Histamine H1 receptor | CHEMBL231 | 7620 | Antagonist |
| 1235 | Serotonin 2a (5-HT2a) receptor | CHEMBL224 | 66 | Antagonist |
| 1235 | Serotonin 2c (5-HT2c) receptor | CHEMBL225 | 68 | Antagonist |
| 1248 | Muscarinic acetylcholine receptor M3 | CHEMBL245 | 2937 | Antagonist |
| 1249 | DNA | CHEMBL2311221 | | Inhibitor |
| 1252 | Cyclophilin A | CHEMBL1949 | 12360 | Modulator |
| 1255 | Thiazide-sensitive sodium-chloride cotransporter | CHEMBL1876 | 16025 | Inhibitor |
| 1257 | Muscarinic acetylcholine receptor M1 | CHEMBL216 | 2935 | Antagonist |
| 1258 | Histamine H1 receptor | CHEMBL231 | 7620 | Antagonist |
| 1260 | Cystine | CHEMBL2364039 | | Hydrolytic enzyme |
| 1267 | DNA | CHEMBL2311221 | | Inhibitor |
| 1267 | DNA polymerase (alpha/delta/epsilon) | CHEMBL2363042 | 12927, 12930, 12934 | Inhibitor |
| 1267 | RNA | CHEMBL2311222 | | Inhibitor |
| 1286 | Thrombin | CHEMBL204 | 3583 | Inhibitor |
| 1287 | Serine/threonine-protein kinase B-raf | CHEMBL5145 | 1924 | Inhibitor |
| 1288 | Alpha-1a adrenergic receptor | CHEMBL229 | 766 | Partial agonist |
| 1289 | DNA | CHEMBL2311221 | | Inhibitor |
| 1291 | Interleukin-2 receptor | CHEMBL2364167 | 8444-8446 | Inhibitor |
| 1292 | Epidermal growth factor receptor | CHEMBL2363049 | 5466, 5520-5522 | Inhibitor |
| 1292 | Epidermal growth factor receptor erbB1 | CHEMBL203 | 5466 | Inhibitor |
| 1292 | Receptor protein-tyrosine kinase erbB-2 | CHEMBL1824 | 5520 | Inhibitor |

TABLE 3-continued

Ligand sets

| Ligand No. | Target Name | Target ChEMBL ID | Payload ID | Action type |
|---|---|---|---|---|
| 1292 | Receptor protein-tyrosine kinase erbB-4 | CHEMBL3009 | 5522 | Inhibitor |
| 1293 | DNA | CHEMBL2311221 | | Inhibitor |
| 1294 | PI3-kinase class I | CHEMBL3559703 | 12526-12529, 12596-12598, 12601 | Inhibitor |
| 1294 | Serine/threonine-protein kinase mTOR | CHEMBL2842 | 9934 | Inhibitor |
| 1295 | Glucocorticoid receptor | CHEMBL2034 | 11442 | Modulator |
| 1299 | Voltage-gated potassium channel | CHEMBL2362996 | 13088-13123 | Blocker |
| 1303 | Antithrombin-III | CHEMBL1950 | 15564 | Activator |
| 1304 | Antithrombin-III | CHEMBL1950 | 15564 | Activator |
| 1305 | Androgen Receptor | CHEMBL1871 | 1034 | Agonist |
| 1305 | Progesterone receptor | CHEMBL208 | 13299 | Agonist |
| 1306 | Interleukin-8 receptor B | CHEMBL2434 | 2887 | Antagonist |
| 1309 | Ryanodine receptor 1 | CHEMBL1846 | 15210 | Antagonist |
| 1309 | Ryanodine receptor 3 | CHEMBL2062 | 15212 | Antagonist |
| 1310 | Serine/threonine-protein kinase Aurora | CHEMBL3430911 | 1654, 1657, 1658 | Inhibitor |
| 1311 | Sodium/glucose cotransporter 2 | CHEMBL3884 | 16309 | Inhibitor |
| 1312 | Alpha-1a adrenergic receptor | CHEMBL229 | 766 | Antagonist |
| 1316 | Lymphocyte differentiation antigen CD38 | CHEMBL4660 | 2556 | Inhibitor |
| 1317 | Erythropoietin receptor | CHEMBL1817 | 5541 | Agonist |
| 1319 | Muscarinic acetylcholine receptor M2 | CHEMBL211 | 2936 | Antagonist |
| 1319 | Muscarinic acetylcholine receptor M3 | CHEMBL245 | 2937 | Antagonist |
| 1320 | Muscarinic acetylcholine receptor | CHEMBL2094109 | 2935-2939 | Antagonist |
| 1322 | Endothelin receptor ET-A | CHEMBL252 | 5399 | Antagonist |
| 1322 | Endothelin receptor ET-B | CHEMBL1785 | 5400 | Antagonist |
| 1325 | Ephrin type-A receptor 2 | CHEMBL2068 | 5445 | Inhibitor |
| 1325 | Platelet-derived growth factor receptor beta | CHEMBL1913 | 12774 | Inhibitor |
| 1325 | SRC | CHEMBL2363074 | 1864, 6212, 6514, 6515, 7387, 9206, 9637, 16684, 16687, 19589 | Inhibitor |
| 1325 | Stem cell growth factor receptor | CHEMBL1936 | 19299 | Inhibitor |
| 1325 | Tyrosine-protein kinase ABL | CHEMBL1862 | 149 | Inhibitor |
| 1327 | DNA | CHEMBL2311221 | | Inhibitor |
| 1327 | DNA topoisomerase II alpha | CHEMBL1806 | 17865 | Inhibitor |
| 1328 | Amylin receptor AMY1, CALCR/RAMP1 | CHEMBL2111189 | 2101, 14266 | Agonist |
| 1328 | Calcitonin gene-related peptide type 1 receptor | CHEMBL3798 | 2102 | Agonist |
| 1330 | Peroxisome proliferator-activated receptor delta | CHEMBL3979 | 12427 | Agonist |
| 1330 | Peroxisome proliferator-activated receptor gamma | CHEMBL235 | 12428 | Agonist |
| 1335 | Rho-associated protein kinase | CHEMBL2111459 | 14557, 14558 | Inhibitor |
| 1341 | Muscle-type nicotinic acetylcholine receptor | CHEMBL2362997 | 2941, 2950, 2954, 2955, 2956 | Partial agonist |
| 1344 | Tyrosine-protein kinase JAK3 | CHEMBL2148 | 8597 | Inhibitor |
| 1345 | DNA | CHEMBL2311221 | | Inhibitor |
| 1345 | DNA (cytosine-5)-methyltransferase 1 | CHEMBL1993 | 4953 | Inhibitor |
| 1345 | DNA (cytosine-5)-methyltransferase 3A | CHEMBL1992 | 4954 | Inhibitor |
| 1346 | Metabotropic glutamate receptor 2 | CHEMBL5137 | 6926 | Modulator |
| 1346 | Metabotropic glutamate receptor 3 | CHEMBL2888 | 6927 | Modulator |
| 1351 | Focal adhesion kinase 1 | CHEMBL2695 | 13729 | Inhibitor |
| 1351 | Protein tyrosine kinase 2 beta | CHEMBL5469 | 13730 | Inhibitor |
| 1356 | Gonadotropin-releasing hormone receptor | CHEMBL1855 | 7145 | Antagonist |
| 1361 | Protein kinase C delta | CHEMBL2996 | 13590 | Inhibitor |
| 1369 | Acetylcholinesterase | CHEMBL220 | 380 | Inhibitor |
| 1371 | Elongation factor 2 | CHEMBL1795108 | 5577 | Inhibitor |
| 1371 | Interleukin-2 receptor | CHEMBL2364167 | 8444-8446 | Binding agent |
| 1372 | Tumor necrosis factor ligand superfamily member 11 | CHEMBL2364162 | 18713 | Inhibitor |
| 1376 | Cell membrane | CHEMBL3390826 | | Disrupting agent |
| 1384 | Adenosine A1 receptor | CHEMBL226 | 624 | Antagonist |
| 1388 | Synaptic vesicular amine transporter | CHEMBL1893 | 16067 | Inhibitor |

TABLE 3-continued

Ligand sets

| Ligand No. | Target Name | Target ChEMBL ID | Payload ID | Action type |
|---|---|---|---|---|
| 1389 | GABA-A receptor; anion channel | CHEMBL2093872 | 6682-6696, 6700 | Positive allosteric modulator |
| 1389 | Glycine receptor (alpha-1/beta) | CHEMBL2363052 | 7027, 7031 | Positive modulator |
| 1389 | Potassium channel subfamily K member 10 | CHEMBL2331041 | 13074 | Opener |
| 1389 | Potassium channel subfamily K member 18 | CHEMBL2331042 | 13080 | Opener |
| 1389 | Potassium channel subfamily K member 2 | CHEMBL2321615 | 13081 | Opener |
| 1389 | Potassium channel subfamily K member 3 | CHEMBL2321613 | 13082 | Opener |
| 1389 | Potassium channel subfamily K member 9 | CHEMBL2321614 | 13087 | Opener |
| 1390 | Norepinephrine transporter | CHEMBL222 | 16329 | Inhibitor |
| 1391 | Thrombin | CHEMBL204 | 3583 | Inhibitor |
| 1392 | Sodium/potassium-transporting ATPase | CHEMBL2095186 | 1590-1596, 6506 | Inhibitor |
| 1393 | Histamine H1 receptor | CHEMBL231 | 7620 | Antagonist |
| 1394 | Vasopressin receptor | CHEMBL2363078 | 1343-1345 | Agonist |
| 1396 | Progesterone receptor | CHEMBL208 | 13299 | Agonist |
| 1397 | Glucocorticoid receptor | CHEMBL2034 | 11442 | Agonist |
| 1398 | Glucocorticoid receptor | CHEMBL2034 | 11442 | Agonist |
| 1399 | Mineralocorticoid receptor | CHEMBL1994 | 11443 | Agonist |
| 1400 | Mineralocorticoid receptor | CHEMBL1994 | 11443 | Agonist |
| 1401 | DNA | CHEMBL2311221 | | Hydrolytic enzyme |
| 1404 | Norepinephrine transporter | CHEMBL222 | 16329 | Inhibitor |
| 1404 | Serotonin transporter | CHEMBL228 | 16331 | Inhibitor |
| 1405 | Glucocorticoid receptor | CHEMBL2034 | 11442 | Agonist |
| 1406 | Glucocorticoid receptor | CHEMBL2034 | 11442 | Agonist |
| 1407 | Glucocorticoid receptor | CHEMBL2034 | 11442 | Agonist |
| 1408 | Histamine H1 receptor | CHEMBL231 | 7620 | Antagonist |
| 1409 | Histamine H1 receptor | CHEMBL231 | 7620 | Antagonist |
| 1411 | Potassium-transporting ATPase | CHEMBL2095173 | 1587, 1588 | Inhibitor |
| 1413 | Neuronal acetylcholine receptor; alpha4/beta2 | CHEMBL1907589 | 2945, 2951 | Agonist |
| 1414 | Adrenergic receptor alpha-2 | CHEMBL2095158 | 769-771 | Agonist |
| 1415 | Dopamine transporter | CHEMBL238 | 16330 | Inhibitor |
| 1415 | Norepinephrine transporter | CHEMBL222 | 16329 | Inhibitor |
| 1417 | Dopamine transporter | CHEMBL238 | 16330 | Releasing agent |
| 1417 | Norepinephrine transporter | CHEMBL222 | 16329 | Releasing agent |
| 1417 | Synaptic vesicular amine transporter | CHEMBL1893 | 16067 | Inhibitor |
| 1419 | Glutamate [NMDA] receptor subunit epsilon 1 | CHEMBL1972 | 6918 | Antagonist |
| 1419 | Sigma opioid receptor | CHEMBL287 | 15742 | Agonist |
| 1421 | Thyroid hormone receptor | CHEMBL2111462 | 17778, 17779 | Agonist |
| 1422 | Kappa opioid receptor | CHEMBL237 | 12036 | Antagonist |
| 1422 | Mu opioid receptor | CHEMBL233 | 12037 | Partial agonist |
| 1436 | GABA-A receptor; anion channel | CHEMBL2093872 | 6682-6696, 6700 | Positive allosteric modulator |
| 1437 | Potassium channel, inwardly rectifying, subfamily J, member 11 | CHEMBL1886 | 13056 | Opener |
| 1437 | Potassium channel, inwardly rectifying, subfamily J, member 8 | CHEMBL4770 | 13068 | Opener |
| 1439 | Sodium channel protein type V alpha subunit | CHEMBL1980 | 15998 | Blocker |
| 1439 | Sodium channel protein type X alpha subunit | CHEMBL5451 | 16001 | Blocker |
| 1441 | Carbonic anhydrase I | CHEMBL261 | 2310 | Inhibitor |
| 1441 | Carbonic anhydrase II | CHEMBL205 | 2311 | Inhibitor |
| 1441 | Carbonic anhydrase IV | CHEMBL3729 | 2313 | Inhibitor |
| 1441 | Carbonic anhydrase XII | CHEMBL3242 | 2322 | Inhibitor |
| 1442 | Cyclooxygenase | CHEMBL2094253 | 13461, 13462 | Inhibitor |
| 1447 | Vitamin k epoxide reductase complex subunit 1 isoform 1 | CHEMBL1930 | 19294 | Inhibitor |
| 1448 | Muscarinic acetylcholine receptor M1 | CHEMBL216 | 2935 | Antagonist |
| 1448 | Muscarinic acetylcholine receptor M3 | CHEMBL245 | 2937 | Antagonist |
| 1451 | Estrogen receptor alpha | CHEMBL206 | 5551 | Agonist |
| 1460 | Dopamine transporter | CHEMBL238 | 16330 | Inhibitor |
| 1460 | Norepinephrine transporter | CHEMBL222 | 16329 | Inhibitor |
| 1461 | Estrogen receptor alpha | CHEMBL206 | 5551 | Agonist |
| 1462 | Estrogen receptor | CHEMBL2093866 | 5551, 5552 | Agonist |
| 1463 | Mu opioid receptor | CHEMBL233 | 12037 | Agonist |

TABLE 3-continued

Ligand sets

| Ligand No. | Target Name | Target ChEMBL ID | Payload ID | Action type |
|---|---|---|---|---|
| 1465 | Glucocorticoid receptor | CHEMBL2034 | 11442 | Agonist |
| 1466 | Cyclooxygenase | CHEMBL2094253 | 13461, 13462 | Inhibitor |
| 1469 | Glucocorticoid receptor | CHEMBL2034 | 11442 | Agonist |
| 1470 | Sodium/potassium-transporting ATPase | CHEMBL2095186 | 1590-1596, 6506 | Inhibitor |
| 1471 | Sodium/potassium-transporting ATPase | CHEMBL2095186 | 1590-1596, 6506 | Inhibitor |
| 1474 | Mu opioid receptor | CHEMBL233 | 12037 | Agonist |
| 1475 | Serotonin 1d (5-HT1d) receptor | CHEMBL1983 | 63 | Agonist |
| 1488 | MAP kinase p38 alpha | CHEMBL260 | 10445 | Inhibitor |
| 1489 | Voltage-gated L-type calcium channel | CHEMBL2095229 | 2138-2141 | Blocker |
| 1490 | Histamine H1 receptor | CHEMBL231 | 7620 | Antagonist |
| 1494 | Kelch-like ECH-associated protein 1 | CHEMBL2069156 | 8699 | Inhibitor |
| 1507 | Cyclin-dependent kinase 1 | CHEMBL308 | 4269 | Inhibitor |
| 1507 | Cyclin-dependent kinase 2 | CHEMBL301 | 4281 | Inhibitor |
| 1507 | Cyclin-dependent kinase 5 | CHEMBL4036 | 4288 | Inhibitor |
| 1507 | Cyclin-dependent kinase 9 | CHEMBL3116 | 4294 | Inhibitor |
| 1509 | Prostanoid FP receptor | CHEMBL1987 | 13455 | Agonist |
| 1511 | Prostaglandin E2 receptor | CHEMBL2363068 | 13447-13450 | Agonist |
| 1513 | Disialoganglioside GD2 | CHEMBL3390823 | | Binding agent |
| 1516 | Muscarinic acetylcholine receptor M1 | CHEMBL216 | 2935 | Antagonist |
| 1516 | Muscarinic acetylcholine receptor M3 | CHEMBL245 | 2937 | Antagonist |
| 1518 | Histamine H1 receptor | CHEMBL231 | 7620 | Antagonist |
| 1519 | Muscarinic acetylcholine receptor M1 | CHEMBL216 | 2935 | Antagonist |
| 1520 | Mu opioid receptor | CHEMBL233 | 12037 | Agonist |
| 1522 | Histamine H1 receptor | CHEMBL231 | 7620 | Antagonist |
| 1526 | Adrenergic receptor | CHEMBL2331074 | 766-774 | Agonist |
| 1527 | Metabotropic glutamate receptor 5 | CHEMBL3227 | 6929 | Modulator |
| 1529 | 3',5'-cyclic phosphodiesterase | CHEMBL2363066 | 12546, 12549-12557, 12559-12571 | Inhibitor |
| 1529 | Equilibrative nucleoside transporter 1 | CHEMBL1997 | 16187 | Inhibitor |
| 1532 | Sodium channel alpha subunit | CHEMBL2331043 | 15989, 15991, 15993, 15995, 15997-16001, 16002 | Blocker |
| 1535 | Aldehyde dehydrogenase | CHEMBL1935 | 882 | Inhibitor |
| 1554 | Neurokinin 1 receptor | CHEMBL249 | 17315 | Antagonist |
| 1556 | Beta-1 adrenergic receptor | CHEMBL213 | 772 | Agonist |
| 1556 | Beta-2 adrenergic receptor | CHEMBL210 | 773 | Agonist |
| 1557 | Tubulin | CHEMBL2095182 | 18669-18675, 18679-18687 | Inhibitor |
| 1564 | HERG | CHEMBL240 | 13089 | Blocker |
| 1565 | Serotonin 3a (5-HT3a) receptor | CHEMBL1899 | 69 | Antagonist |
| 1569 | Acetylcholinesterase | CHEMBL220 | 380 | Inhibitor |
| 1570 | G protein-coupled receptor 44 | CHEMBL5071 | 13445 | Antagonist |
| 1570 | Serotonin 1b (5-HT1b) receptor | CHEMBL1898 | 62 | Agonist |
| 1570 | Serotonin 1d (5-HT1d) receptor | CHEMBL1983 | 63 | Agonist |
| 1571 | Beta-1 adrenergic receptor | CHEMBL213 | 772 | Agonist |
| 1572 | MAP kinase p38 alpha | CHEMBL260 | 10445 | Inhibitor |
| 1574 | Carbonic anhydrase II | CHEMBL205 | 2311 | Inhibitor |
| 1576 | Fibroblast growth factor receptor 3 | CHEMBL2742 | 6255 | Inhibitor |
| 1576 | Platelet-derived growth factor receptor | CHEMBL2095189 | 12773, 12774 | Inhibitor |
| 1576 | Stem cell growth factor receptor | CHEMBL1936 | 19299 | Inhibitor |
| 1576 | Tyrosine-protein kinase receptor FLT3 | CHEMBL1974 | 6337 | Inhibitor |
| 1576 | Vascular endothelial growth factor receptor | CHEMBL2095227 | 6336, 6339, 9005 | Inhibitor |
| 1577 | Muscle-type nicotinic acetylcholine receptor | CHEMBL2362997 | 2941, 2950, 2954, 2955 2956 | Antagonist |
| 1579 | Potassium channel subfamily K member 3 | CHEMBL2321613 | 13082 | Blocker |
| 1579 | Potassium channel subfamily K member 9 | CHEMBL2321614 | 13087 | Blocker |
| 1580 | Adrenergic receptor alpha-1 | CHEMBL2094251 | 766-768 | Antagonist |
| 1581 | Norepinephrine transporter | CHEMBL222 | 16329 | Inhibitor |
| 1582 | Vitamin D receptor | CHEMBL1977 | 19293 | Agonist |
| 1583 | DNA | CHEMBL2311221 | | Inhibitor |
| 1583 | DNA topoisomerase II alpha | CHEMBL1806 | 17865 | Inhibitor |
| 1584 | Matrix metalloproteinase 13 | CHEMBL280 | 9894 | Inhibitor |
| 1584 | Matrix metalloproteinase 7 | CHEMBL4073 | 9910 | Inhibitor |
| 1584 | Matrix metalloproteinase 8 | CHEMBL4588 | 9911 | Inhibitor |

TABLE 3-continued

Ligand sets

| Ligand No. | Target Name | Target ChEMBL ID | Payload ID | Action type |
|---|---|---|---|---|
| 1584 | Matrix metalloproteinase-1 | CHEMBL332 | 9890 | Inhibitor |
| 1585 | Histamine H1 receptor | CHEMBL231 | 7620 | Antagonist |
| 1586 | Vitamin D receptor | CHEMBL1977 | 19293 | Agonist |
| 1599 | Peroxisome proliferator-activated receptor alpha | CHEMBL239 | 12426 | Agonist |
| 1600 | Cannabinoid CB1 receptor | CHEMBL218 | 2270 | Antagonist |
| 1601 | Estrogen receptor | CHEMBL2093866 | 5551, 5552 | Modulator |
| 1602 | Androgen Receptor | CHEMBL1871 | 1034 | Agonist |
| 1603 | Cannabinoid CB1 receptor | CHEMBL218 | 2270 | Agonist |
| 1604 | Inward rectifier potassium channel 2 | CHEMBL1914276 | 13063 | Blocker |
| 1604 | Potassium/sodium hyperpolarization-activated cyclic nucleotide-gated channel 4 | CHEMBL1250417 | 7886 | Blocker |
| 1604 | Sodium channel alpha subunit | CHEMBL2331043 | 15989, 15991, 15993, 15995, 15997-16001, 16002 | Blocker |
| 1604 | Voltage-gated L-type calcium channel | CHEMBL2095229 | 2138-2141 | Blocker |
| 1605 | D2-like dopamine receptor | CHEMBL2331075 | 5041-5043 | Antagonist |
| 1605 | Serotonin 2a (5-HT2a) receptor | CHEMBL224 | 66 | Antagonist |
| 1606 | Mineralocorticoid receptor | CHEMBL1994 | 11443 | Antagonist |
| 1606 | Progesterone receptor | CHEMBL208 | 13299 | Agonist |
| 1610 | Coagulation factor V | CHEMBL3618 | 3590 | Inhibitor |
| 1610 | Coagulation factor VIII | CHEMBL3143 | 3592 | Inhibitor |
| 1611 | Adrenergic receptor | CHEMBL2331074 | 766-774 | Agonist |
| 1612 | Serine/threonine-protein kinase mTOR | CHEMBL2842 | 9934 | Inhibitor |
| 1613 | PI3-kinase class I | CHEMBL3559703 | 12526-12529, 12596-12598, 12601 | Inhibitor |
| 1613 | Serine/threonine-protein kinase mTOR | CHEMBL2842 | 9934 | Inhibitor |
| 1616 | Sodium channel protein type IX alpha subunit | CHEMBL4296 | 15997 | Blocker |
| 1616 | Sodium channel protein type X alpha subunit | CHEMBL5451 | 16001 | Blocker |
| 1621 | Glucagon-like peptide 1 receptor | CHEMBL1784 | 6862 | Agonist |
| 1622 | Norepinephrine transporter | CHEMBL222 | 16329 | Inhibitor |
| 1622 | Serotonin transporter | CHEMBL228 | 16331 | Inhibitor |
| 1624 | Steroid 5-alpha-reductase | CHEMBL2363075 | 16796, 16799, 16800 | Inhibitor |
| 1625 | PI3-kinase p110-delta subunit | CHEMBL3130 | 12528 | Inhibitor |
| 1625 | PI3-kinase p110-gamma subunit | CHEMBL3267 | 12529 | Inhibitor |
| 1626 | Vanilloid receptor | CHEMBL4794 | 18061 | Antagonist |
| 1629 | Sodium channel alpha subunit | CHEMBL2331043 | 15989, 15991, 15993, 15995, 15997-16001, 16002 | Blocker |
| 1630 | Progesterone receptor | CHEMBL208 | 13299 | Agonist |
| 1631 | Phosphodiesterase 3A | CHEMBL241 | 12553 | Inhibitor |
| 1631 | Phosphodiesterase 4 | CHEMBL2093863 | 12555-12557, 12559 | Inhibitor |
| 1633 | Dual specificity mitogen-activated protein kinase kinase 1 | CHEMBL3587 | 10458 | Inhibitor |
| 1633 | Mitogen-activated protein kinase kinase kinase 1 | CHEMBL3956 | 10465 | Inhibitor |
| 1637 | Plasma kallikrein | CHEMBL2000 | 8638 | Inhibitor |
| 1639 | Acetylcholinesterase | CHEMBL220 | 380 | Inhibitor |
| 1641 | Complement C5 | CHEMBL2364163 | 3893 | Inhibitor |
| 1646 | Coagulation factor X | CHEMBL244 | 3596 | Inhibitor |
| 1647 | Acetylcholinesterase | CHEMBL220 | 380 | Inhibitor |
| 1648 | Integrin alpha-L/beta-2 (LFA-1) | CHEMBL2364172 | 8306, 8311 | Inhibitor |
| 1649 | Peroxisome proliferator-activated receptor gamma | CHEMBL235 | 12428 | Agonist |
| 1652 | Ornithine decarboxylase | CHEMBL1869 | 12073 | Inhibitor |
| 1653 | Epidermal growth factor receptor erbB1 | CHEMBL203 | 5466 | Inhibitor |
| 1656 | Gonadotropin-releasing hormone receptor | CHEMBL1855 | 7145 | Antagonist |
| 1658 | Serotonin 1b (5-HT1b) receptor | CHEMBL1898 | 62 | Agonist |
| 1658 | Serotonin 1d (5-HT1d) receptor | CHEMBL1983 | 63 | Agonist |
| 1658 | Serotonin 1f (5-HT1f) receptor | CHEMBL1805 | 65 | Agonist |
| 1659 | Ceramide glucosyltransferase | CHEMBL2063 | 19066 | Inhibitor |
| 1660 | Purinergic receptor P2Y12 | CHEMBL2001 | 13908 | Antagonist |
| 1662 | Vitamin D receptor | CHEMBL1977 | 19293 | Agonist |
| 1663 | Chondroitin-6-sulfate | CHEMBL3140342 | | Hydrolytic enzyme |
| 1663 | Keratan sulfate | CHEMBL3140341 | | Hydrolytic enzyme |
| 1664 | SLAM family member 7 | CHEMBL3559386 | 15836 | Inhibitor |
| 1666 | Glucagon-like peptide 2 receptor | CHEMBL5844 | 6863 | Agonist |

TABLE 3-continued

Ligand sets

| Ligand No. | Target Name | Target ChEMBL ID | Payload ID | Action type |
|---|---|---|---|---|
| 1667 | Thrombopoietin receptor | CHEMBL1864 | 10559 | Agonist |
| 1668 | Interleukin-8 receptor B | CHEMBL2434 | 2887 | Antagonist |
| 1669 | Mu opioid receptor | CHEMBL233 | 12037 | Agonist |
| 1671 | Serotonin 1b (5-HT1b) receptor | CHEMBL1898 | 62 | Antagonist |
| 1671 | Serotonin 1d (5-HT1d) receptor | CHEMBL1983 | 63 | Antagonist |
| 1673 | Hepatocyte growth factor receptor | CHEMBL3717 | 10107 | Inhibitor |
| 1674 | Histamine H1 receptor | CHEMBL231 | 7620 | Antagonist |
| 1675 | Corticotropin releasing factor receptor 1 | CHEMBL1800 | 3994 | Antagonist |
| 1676 | Sodium/glucose cotransporter 2 | CHEMBL3884 | 16309 | Inhibitor |
| 1678 | Angiotensin-converting enzyme | CHEMBL1808 | 1056 | Inhibitor |
| 1679 | Angiotensin-converting enzyme | CHEMBL1808 | 1056 | Inhibitor |
| 1682 | Neuronal acetylcholine receptor protein alpha-7 subunit | CHEMBL2492 | 2940 | Partial agonist |
| 1683 | Estrogen receptor alpha | CHEMBL206 | 5551 | Modulator |
| 1684 | Serine/threonine-protein kinase B-raf | CHEMBL5145 | 1924 | Inhibitor |
| 1685 | GABA-A receptor; anion channel | CHEMBL2093872 | 6682-6696, 6700 | Positive modulator |
| 1685 | Glycine receptor (alpha-1/beta) | CHEMBL2363052 | 7027, 7031 | Positive modulator |
| 1685 | Potassium channel subfamily K member 10 | CHEMBL2331041 | 13074 | Opener |
| 1685 | Potassium channel subfamily K member 18 | CHEMBL2331042 | 13080 | Opener |
| 1685 | Potassium channel subfamily K member 2 | CHEMBL2321615 | 13081 | Opener |
| 1685 | Potassium channel subfamily K member 3 | CHEMBL2321613 | 13082 | Opener |
| 1685 | Potassium channel subfamily K member 9 | CHEMBL2321614 | 13087 | Opener |
| 1688 | Fibroblast growth factor receptor 3 | CHEMBL2742 | 6255 | Inhibitor |
| 1688 | Macrophage colony stimulating factor receptor | CHEMBL1844 | 3854 | Inhibitor |
| 1688 | Serine/threonine-protein kinase Aurora-A | CHEMBL4722 | 1654 | Inhibitor |
| 1688 | Serine/threonine-protein kinase Aurora-B | CHEMBL2185 | 1657 | Inhibitor |
| 1688 | Stem cell growth factor receptor | CHEMBL1936 | 19299 | Inhibitor |
| 1688 | Tyrosine-protein kinase receptor FLT3 | CHEMBL1974 | 6337 | Inhibitor |
| 1688 | Vascular endothelial growth factor receptor 2 | CHEMBL279 | 9005 | Inhibitor |
| 1689 | Fibroblast growth factor receptor | CHEMBL2095217 | 6253-6256 | Inhibitor |
| 1689 | Platelet-derived growth factor receptor | CHEMBL2095189 | 12773, 12774 | Inhibitor |
| 1689 | Serine/threonine-protein kinase Aurora-A | CHEMBL4722 | 1654 | Inhibitor |
| 1689 | SRC | CHEMBL2363074 | 1864, 6212, 6514, 6515, 7387, 9206, 9637, 16684, 16687, 19589 | Inhibitor |
| 1689 | Tyrosine-protein kinase receptor FLT3 | CHEMBL1974 | 6337 | Inhibitor |
| 1689 | Vascular endothelial growth factor receptor 2 | CHEMBL279 | 9005 | Inhibitor |
| 1690 | Androgen Receptor | CHEMBL1871 | 1034 | Modulator |
| 1693 | Antithrombin-III | CHEMBL1950 | 15564 | Activator |
| 1696 | Endothelin receptor ET-A | CHEMBL252 | 5399 | Antagonist |
| 1696 | Endothelin receptor ET-B | CHEMBL1785 | 5400 | Antagonist |
| 1697 | Catechol O-methyltransferase | CHEMBL2023 | 2437 | Inhibitor |
| 1699 | Tyrosine-protein kinase SYK | CHEMBL2599 | 16634 | Inhibitor |
| 1700 | Androgen Receptor | CHEMBL1871 | 1034 | Antagonist |
| 1701 | Protein kinase C beta | CHEMBL3045 | 13589 | Inhibitor |
| 1703 | Oxytocin receptor | CHEMBL2049 | 12157 | Antagonist |
| 1708 | Histamine H1 receptor | CHEMBL231 | 7620 | Antagonist |
| 1709 | Adrenergic receptor | CHEMBL2331074 | 766-774 | Agonist |
| 1710 | DNA | CHEMBL2311221 | | Inhibitor |
| 1711 | Epidermal growth factor receptor erbB1 | CHEMBL203 | 5466 | Inhibitor |
| 1712 | Mineralocorticoid receptor | CHEMBL1994 | 11443 | Antagonist |
| 1713 | Erythropoietin receptor | CHEMBL1817 | 5541 | Agonist |
| 1715 | Prostanoid IP receptor | CHEMBL1995 | 13457 | Agonist |
| 1719 | Type-1 angiotensin II receptor | CHEMBL227 | 1058 | Antagonist |
| 1720 | Thyroid hormone receptor beta-1 | CHEMBL1947 | 17779 | Agonist |
| 1722 | Integrin alpha-IIb/beta-3 | CHEMBL2093869 | 8296, 8312 | Inhibitor |
| 1725 | Estrogen receptor beta | CHEMBL242 | 5552 | Agonist |
| 1727 | Vitamin D receptor | CHEMBL1977 | 19293 | Agonist |

TABLE 3-continued

Ligand sets

| Ligand No. | Target Name | Target ChEMBL ID | Payload ID | Action type |
|---|---|---|---|---|
| 1728 | Adrenergic receptor alpha | CHEMBL2095203 | 766-771 | Antagonist |
| 1728 | Dopamine receptor | CHEMBL2096905 | 5040-5044 | Agonist |
| 1728 | Serotonin 1a (5-HT1a) receptor | CHEMBL214 | 61 | Agonist |
| 1728 | Serotonin 1b (5-HT1b) receptor | CHEMBL1898 | 62 | Agonist |
| 1731 | Adrenergic receptor alpha | CHEMBL2095203 | 766-771 | Agonist |
| 1731 | Serotonin 1d (5-HT1d) receptor | CHEMBL1983 | 63 | Agonist |
| 1732 | Tubulin | CHEMBL2095182 | 18669-18675, 18679-18687 | Inhibitor |
| 1733 | Smoothened homolog | CHEMBL5971 | 15967 | Inhibitor |
| 1735 | Epidermal growth factor receptor erbB1 | CHEMBL203 | 5466 | Inhibitor |
| 1737 | Estrogen receptor beta | CHEMBL242 | 5552 | Agonist |
| 1743 | Serotonin transporter | CHEMBL228 | 16331 | Inhibitor |
| 1744 | Sodium channel alpha subunit | CHEMBL2331043 | 15989, 15991, 15993, 15995, 15997-16001, 16002 | Blocker |
| 1745 | Adrenergic receptor alpha-2 | CHEMBL2095158 | 769-771 | Antagonist |
| 1745 | Histamine H1 receptor | CHEMBL231 | 7620 | Antagonist |
| 1745 | Serotonin 2a (5-HT2a) receptor | CHEMBL224 | 66 | Antagonist |
| 1745 | Serotonin 2c (5-HT2c) receptor | CHEMBL225 | 68 | Antagonist |
| 1746 | Beta-1 adrenergic receptor | CHEMBL213 | 772 | Antagonist |
| 1746 | Beta-2 adrenergic receptor | CHEMBL210 | 773 | Antagonist |
| 1747 | Potassium-transporting ATPase | CHEMBL2095173 | 1587, 1588 | Inhibitor |
| 1748 | GABA-A receptor; anion channel | CHEMBL2093872 | 6682-6696, 6700 | Positive allosteric modulator |
| 1749 | Estrogen receptor alpha | CHEMBL206 | 5551 | Agonist |
| 1750 | Estrogen receptor alpha | CHEMBL206 | 5551 | Agonist |
| 1751 | Estrogen receptor alpha | CHEMBL206 | 5551 | Agonist |
| 1752 | Estrogen receptor alpha | CHEMBL206 | 5551 | Agonist |
| 1754 | DNA | CHEMBL2311221 | | Inhibitor |
| 1754 | Estrogen receptor beta | CHEMBL242 | 5552 | Modulator |
| 1756 | Estrogen receptor | CHEMBL2093866 | 5551, 5552 | Agonist |
| 1757 | Estrogen receptor | CHEMBL2093866 | 5551, 5552 | Agonist |
| 1758 | Estrogen receptor | CHEMBL2093866 | 5551, 5552 | Agonist |
| 1759 | Estrogen receptor alpha | CHEMBL206 | 5551 | Agonist |
| 1760 | Estrogen receptor alpha | CHEMBL206 | 5551 | Agonist |
| 1762 | Prostanoid IP receptor | CHEMBL1995 | 13457 | Agonist |
| 1763 | GABA-A receptor; anion channel | CHEMBL2093872 | 6682-6696, 6700 | Positive allosteric modulator |
| 1764 | Leukotriene B4 receptor 1 | CHEMBL3911 | 9429 | Antagonist |
| 1764 | Peroxisome proliferator-activated receptor gamma | CHEMBL235 | 12428 | Agonist |
| 1765 | TNF-alpha | CHEMBL1825 | 18711 | Inhibitor |
| 1766 | Sodium-(potassium)-chloride cotransporter 2 | CHEMBL1874 | 16026 | Inhibitor |
| 1772 | GABA-A receptor; anion channel | CHEMBL2093872 | 6682-6696, 6700 | Positive modulator |
| 1776 | Estrogen receptor alpha | CHEMBL206 | 5551 | Agonist |
| 1778 | Muscarinic acetylcholine receptor M1 | CHEMBL216 | 2935 | Antagonist |
| 1779 | Voltage-gated T-type calcium channel | CHEMBL2362995 | 2145-2147 | Blocker |
| 1780 | Sodium channel alpha subunit | CHEMBL2331043 | 15989, 15991, 15993, 15995, 15997-16001, 16002 | Blocker |
| 1781 | Carbonic anhydrase | CHEMBL2095180 | 2310-2318, 2322-2324 | Inhibitor |
| 1794 | Androgen Receptor | CHEMBL1871 | 1034 | Agonist |
| 1799 | Progesterone receptor | CHEMBL208 | 13299 | Agonist |
| 1800 | Sodium channel alpha subunit | CHEMBL2331043 | 15989, 15991, 15993, 15995, 15997-16001, 16002 | Blocker |
| 1801 | ATP | CHEMBL2366048 | | Inhibitor |
| 1802 | Dopamine D3 receptor | CHEMBL234 | 5042 | Agonist |
| 1803 | Cyclooxygenase-2 | CHEMBL230 | 13462 | Inhibitor |
| 1804 | GABA-A receptor; anion channel | CHEMBL2093872 | 6682-6696, 6700 | Positive modulator |
| 1805 | Progesterone receptor | CHEMBL208 | 13299 | Agonist |
| 1806 | DNA topoisomerase II | CHEMBL2094255 | 17865, 12866 | Inhibitor |
| 1807 | DNA topoisomerase II alpha | CHEMBL1806 | 17865 | Inhibitor |
| 1811 | Retinoid receptor | CHEMBL2363071 | 14451-14456 | Agonist |
| 1812 | FK506-binding protein 1A | CHEMBL1902 | 6309 | Inhibitor |
| 1813 | Adenosine A2a receptor | CHEMBL251 | 625 | Agonist |
| 1814 | Subtilisin/kexin type 9 | CHEMBL2929 | 13439 | Inhibitor |
| 1815 | Glutamate NMDA receptor; GRIN1/GRIN2B | CHEMBL1907603 | 6917, 6919 | Antagonist |
| 1816 | Cytochrome P450 19A1 | CHEMBL1978 | 4424 | Inhibitor |
| 1817 | Glucagon-like peptide 1 receptor | CHEMBL1784 | 6862 | Agonist |
| 1818 | Niemann-Pick C1-like protein 1 | CHEMBL2027 | 11326 | Inhibitor |
| 1819 | Neurokinin 1 receptor | CHEMBL249 | 17315 | Antagonist |

TABLE 3-continued

Ligand sets

| Ligand No. | Target Name | Target ChEMBL ID | Payload ID | Action type |
|---|---|---|---|---|
| 1820 | KCNQ (Kv7) potassium channel | CHEMBL2363063 | 13096-13100 | Blocker |
| 1822 | Adrenergic receptor alpha-2 | CHEMBL2095158 | 769-771 | Agonist |
| 1823 | Epidermal growth factor receptor erbB1 | CHEMBL203 | 5466 | Inhibitor |
| 1825 | Platelet-derived growth factor receptor | CHEMBL2095189 | 12773, 12774 | Inhibitor |
| 1825 | Stem cell growth factor receptor | CHEMBL1936 | 19299 | Inhibitor |
| 1825 | Tyrosine-protein kinase receptor FLT3 | CHEMBL1974 | 6337 | Inhibitor |
| 1825 | Vascular endothelial growth factor receptor 1 | CHEMBL1868 | 6336 | Inhibitor |
| 1825 | Vascular endothelial growth factor receptor 2 | CHEMBL279 | 9005 | Inhibitor |
| 1825 | Vascular endothelial growth factor receptor 3 | CHEMBL1955 | 6339 | Inhibitor |
| 1826 | Histamine H2 receptor | CHEMBL1941 | 7621 | Antagonist |
| 1828 | Peroxisome proliferator-activated receptor gamma | CHEMBL235 | 12428 | Agonist |
| 1834 | Bradykinin B2 receptor | CHEMBL3157 | 1923 | Antagonist |
| 1836 | Mu opioid receptor | CHEMBL233 | 12037 | Agonist |
| 1836 | Norepinephrine transporter | CHEMBL222 | 16329 | Inhibitor |
| 1836 | Serotonin transporter | CHEMBL228 | 16331 | Inhibitor |
| 1837 | Oxytocin receptor | CHEMBL2049 | 12157 | Agonist |
| 1838 | Xanthine dehydrogenase | CHEMBL1929 | 19536 | Inhibitor |
| 1839 | Tyrosine-protein kinase JAK2 | CHEMBL2971 | 8596 | Inhibitor |
| 1839 | Tyrosine-protein kinase receptor FLT3 | CHEMBL1974 | 6337 | Inhibitor |
| 1840 | Glutamate [NMDA] receptor | CHEMBL2094124 | 6917-6921, 6923, 6924 | Antagonist |
| 1841 | Mineralocorticoid receptor | CHEMBL1994 | 11443 | Antagonist |
| 1841 | Voltage-gated L-type calcium channel | CHEMBL2095229 | 2138-2141 | Blocker |
| 1845 | Peroxisome proliferator-activated receptor alpha | CHEMBL239 | 12426 | Agonist |
| 1846 | Peroxisome proliferator-activated receptor alpha | CHEMBL239 | 12426 | Agonist |
| 1847 | Dopamine D1 receptor | CHEMBL2056 | 5040 | Agonist |
| 1848 | Cyclooxygenase | CHEMBL2094253 | 13461, 13462 | Inhibitor |
| 1850 | Mu opioid receptor | CHEMBL233 | 12037 | Agonist |
| 1851 | Phosphate | CHEMBL2364184 | | Sequestering agent |
| 1855 | Muscarinic acetylcholine receptor M2 | CHEMBL211 | 2936 | Antagonist |
| 1855 | Muscarinic acetylcholine receptor M3 | CHEMBL245 | 2937 | Antagonist |
| 1856 | G protein-coupled receptor 44 | CHEMBL5071 | 13445 | Antagonist |
| 1858 | Histamine H1 receptor | CHEMBL231 | 7620 | Antagonist |
| 1860 | Fibroblast growth factor receptor 4 | CHEMBL3973 | 6256 | Inhibitor |
| 1861 | Fibrinogen | CHEMBL2364709 | 6219, 6220, 6222 | Inhibitor |
| 1866 | Neurokinin 1 receptor | CHEMBL249 | 17315 | Antagonist |
| 1868 | Tyrosine-protein kinase JAK1 | CHEMBL2835 | 8595 | Inhibitor |
| 1869 | Granulocyte colony stimulating factor receptor | CHEMBL1996 | 3859 | Agonist |
| 1871 | Steroid 5-alpha-reductase 2 | CHEMBL1856 | 16800 | Inhibitor |
| 1872 | Mineralocorticoid receptor | CHEMBL1994 | 11443 | Antagonist |
| 1873 | Sphingosine 1-phosphate receptor | CHEMBL2363041 | 16606-16610 | Agonist |
| 1875 | Estrogen receptor | CHEMBL2093866 | 5551, 5552 | Modulator |
| 1876 | Adenosine A1 receptor | CHEMBL226 | 624 | Antagonist |
| 1882 | Phosphodiesterase 4 | CHEMBL2093863 | 12555-12557, 12559 | Inhibitor |
| 1882 | Phosphodiesterase 7 | CHEMBL2111411 | 12567, 12568 | Inhibitor |
| 1882 | Phosphodiesterase 8 | CHEMBL2363067 | 12569, 12570 | Inhibitor |
| 1883 | Sodium channel protein type V alpha subunit | CHEMBL1980 | 15998 | Blocker |
| 1886 | Calcium-activated potassium channel subunit alpha-1 | CHEMBL4304 | 13053 | Activator |
| 1886 | Voltage-gated potassium channel subunit Kv7.2 | CHEMBL2476 | 13097 | Activator |
| 1886 | Voltage-gated potassium channel subunit Kv7.4 | CHEMBL3576 | 13099 | Activator |
| 1886 | Voltage-gated potassium channel subunit Kv7.5 | CHEMBL2925 | 13100 | Activator |
| 1888 | Thymidylate synthase | CHEMBL1952 | 17755 | Inhibitor |
| 1893 | DNA polymerase (alpha/delta/epsilon) | CHEMBL2363042 | 12927, 12930, 12934 | Inhibitor |
| 1893 | Ribonucleoside-diphosphate reductase RR1 | CHEMBL2095215 | 14615-14617 | Inhibitor |
| 1896 | Mineralocorticoid receptor | CHEMBL1994 | 11443 | Agonist |

TABLE 3-continued

Ligand sets

| Ligand No. | Target Name | Target ChEMBL ID | Payload ID | Action type |
|---|---|---|---|---|
| 1898 | Tyrosine-protein kinase ABL | CHEMBL1862 | 149 | Inhibitor |
| 1899 | GABA-A receptor; anion channel | CHEMBL2093872 | 6682-6696, 6700 | Allosteric antagonist |
| 1900 | Glucocorticoid receptor | CHEMBL2034 | 11442 | Agonist |
| 1902 | Glucocorticoid receptor | CHEMBL2034 | 11442 | Agonist |
| 1904 | Glucocorticoid receptor | CHEMBL2034 | 11442 | Agonist |
| 1905 | Glucocorticoid receptor | CHEMBL2034 | 11442 | Agonist |
| 1908 | Glucocorticoid receptor | CHEMBL2034 | 11442 | Agonist |
| 1909 | Glucocorticoid receptor | CHEMBL2034 | 11442 | Agonist |
| 1912 | DNA | CHEMBL2311221 | | Inhibitor |
| 1912 | RNA | CHEMBL2311222 | | Inhibitor |
| 1912 | Thymidylate synthase | CHEMBL1952 | 17755 | Inhibitor |
| 1914 | Serotonin transporter | CHEMBL228 | 16331 | Inhibitor |
| 1915 | Androgen Receptor | CHEMBL1871 | 1034 | Agonist |
| 1917 | Dopamine D2 receptor | CHEMBL217 | 5041 | Antagonist |
| 1918 | Dopamine D2 receptor | CHEMBL217 | 5041 | Antagonist |
| 1919 | Dopamine D2 receptor | CHEMBL217 | 5041 | Antagonist |
| 1921 | Glucocorticoid receptor | CHEMBL2034 | 11442 | Agonist |
| 1922 | Glucocorticoid receptor | CHEMBL2034 | 11442 | Agonist |
| 1923 | GABA-A receptor; anion channel | CHEMBL2093872 | 6682-6696, 6700 | Positive allosteric modulator |
| 1924 | Cyclooxygenase | CHEMBL2094253 | 13461, 13462 | Inhibitor |
| 1927 | Androgen Receptor | CHEMBL1871 | 1034 | Antagonist |
| 1928 | Glucocorticoid receptor | CHEMBL2034 | 11442 | Agonist |
| 1929 | Glucocorticoid receptor | CHEMBL2034 | 11442 | Agonist |
| 1930 | HMG-CoA reductase | CHEMBL402 | 26 | Inhibitor |
| 1931 | Serotonin transporter | CHEMBL228 | 16331 | Inhibitor |
| 1935 | Alcohol dehydrogenase class I | CHEMBL2363044 | 866-868 | Inhibitor |
| 1937 | Antithrombin-III | CHEMBL1950 | 15564 | Activator |
| 1941 | Hepatocyte growth factor receptor | CHEMBL3717 | 10107 | Inhibitor |
| 1941 | Platelet-derived growth factor receptor | CHEMBL2095189 | 12773, 12774 | Inhibitor |
| 1941 | Stem cell growth factor receptor | CHEMBL1936 | 19299 | Inhibitor |
| 1941 | Tyrosine-protein kinase receptor FLT3 | CHEMBL1974 | 6337 | Inhibitor |
| 1941 | Tyrosine-protein kinase TIE-2 | CHEMBL4128 | 17514 | Inhibitor |
| 1941 | Vascular endothelial growth factor receptor | CHEMBL2095227 | 6336, 6339, 9005 | Inhibitor |
| 1945 | Beta-2 adrenergic receptor | CHEMBL210 | 773 | Agonist |
| 1951 | Neurokinin 1 receptor | CHEMBL249 | 17315 | Antagonist |
| 1953 | Glucocorticoid receptor | CHEMBL2034 | 11442 | Modulator |
| 1955 | Angiotensin-converting enzyme | CHEMBL1808 | 1056 | Inhibitor |
| 1957 | Sodium channel alpha subunit | CHEMBL2331043 | 15989, 15991, 15993, 15995, 15997-16001, 16002 | Blocker |
| 1959 | Tyrosine-protein kinase SYK | CHEMBL2599 | 16634 | Inhibitor |
| 1967 | Mu opioid receptor | CHEMBL233 | 12037 | Agonist |
| 1969 | Serotonin 1b (5-HT1b) receptor | CHEMBL1898 | 62 | Agonist |
| 1969 | Serotonin 1d (5-HT1d) receptor | CHEMBL1983 | 63 | Agonist |
| 1974 | Vascular endothelial growth factor receptor | CHEMBL2095227 | 6336, 6339, 9005 | Inhibitor |
| 1977 | Estrogen receptor | CHEMBL2093866 | 5551, 5552 | Antagonist |
| 1982 | Sodium-(potassium)-chloride cotransporter 2 | CHEMBL1874 | 16026 | Inhibitor |
| 1986 | MAP kinase p38 alpha | CHEMBL260 | 10445 | Inhibitor |
| 1988 | Cyclin-dependent kinase 4 | CHEMBL331 | 4287 | Inhibitor |
| 1988 | Cyclin-dependent kinase 6 | CHEMBL2508 | 4291 | Inhibitor |
| 1991 | Voltage-gated calcium channel | CHEMBL2363032 | 2121-2128, 2130-2147 | Modulator |
| 1992 | Voltage-gated calcium channel | CHEMBL2363032 | 2121-2128, 2130-2147 | Modulator |
| 1996 | Acetylcholinesterase | CHEMBL220 | 380 | Inhibitor |
| 1997 | Androgen Receptor | CHEMBL1871 | 1034 | Degrader |
| 1997 | Cytochrome P450 17A1 | CHEMBL3522 | 4423 | Inhibitor |
| 1999 | Muscle-type nicotinic acetylcholine receptor | CHEMBL2362997 | 2941, 2950, 2954, 2955 2956 | Antagonist |
| 2003 | Hydroxyapatite | CHEMBL2363055 | | Sequestering agent |
| 2003 | Ribonucleoside-diphosphate reductase RR1 | CHEMBL2095215 | 14615-14617 | Inhibitor |
| 2004 | Dermatan sulfate | CHEMBL2364179 | | Hydrolytic enzyme |
| 2005 | TGF-beta receptor type I | CHEMBL4439 | 18022 | Inhibitor |
| 2015 | Tyrosine-protein kinase JAK2 | CHEMBL2971 | 8596 | Inhibitor |
| 2017 | Gonadotropin-releasing hormone receptor | CHEMBL1855 | 7145 | Antagonist |
| 2021 | Estrogen receptor alpha | CHEMBL206 | 5551 | Degrader |
| 2022 | MAP kinase ERK1 | CHEMBL3385 | 10447 | Inhibitor |
| 2022 | MAP kinase ERK2 | CHEMBL4040 | 10439 | Inhibitor |

TABLE 3-continued

Ligand sets

| Ligand No. | Target Name | Target ChEMBL ID | Payload ID | Action type |
|---|---|---|---|---|
| 2024 | PI3-kinase class I | CHEMBL3559703 | 12526-12529, 12596-12598, 12601 | Inhibitor |
| 2024 | Serine/threonine-protein kinase mTOR | CHEMBL2842 | 9934 | Inhibitor |
| 2025 | Epidermal growth factor receptor erbB1 | CHEMBL203 | 5466 | Inhibitor |
| 2028 | DNA polymerase (alpha/delta/epsilon) | CHEMBL2363042 | 12927, 12930, 12934 | Inhibitor |
| 2028 | Ribonucleoside-diphosphate reductase RR1 | CHEMBL2095215 | 14615-14617 | Inhibitor |
| 2029 | Peroxisome proliferator-activated receptor alpha | CHEMBL239 | 12426 | Agonist |
| 2031 | DNA | CHEMBL2311221 | | Inhibitor |
| 2031 | Myeloid cell surface antigen CD33 | CHEMBL1842 | 2552 | Binding agent |
| 2039 | Peroxisome proliferator-activated receptor alpha | CHEMBL239 | 12426 | Agonist |
| 2039 | Peroxisome proliferator-activated receptor delta | CHEMBL3979 | 12427 | Agonist |
| 2043 | Tyrosine-protein kinase receptor FLT3 | CHEMBL1974 | 6337 | Inhibitor |
| 2043 | Tyrosine-protein kinase receptor UFO | CHEMBL4895 | 1685 | Inhibitor |
| 2046 | Smoothened homolog | CHEMBL5971 | 15967 | Antagonist |
| 2049 | Sulfonylurea receptor 1, Kir6.2 | CHEMBL2096972 | 1628, 13056 | Blocker |
| 2050 | Sulfonylurea receptor 1, Kir6.2 | CHEMBL2096972 | 1628, 13056 | Blocker |
| 2053 | MAP kinase-activated protein kinase 5 | CHEMBL3094 | 10490 | Inhibitor |
| 2054 | Androgen Receptor | CHEMBL1871 | 1034 | Modulator |
| 2055 | Tyrosine-protein kinase JAK1 | CHEMBL2835 | 8595 | Inhibitor |
| 2056 | Tyrosine-protein kinase JAK1 | CHEMBL2835 | 8595 | |
| 2057 | Glucagon receptor | CHEMBL1985 | 6861 | Agonist |
| 2058 | Glucagon receptor | CHEMBL1985 | 6861 | Agonist |
| 2059 | Glucagon receptor | CHEMBL1985 | 6861 | Agonist |
| 2080 | GABA-A receptor; anion channel | CHEMBL2093872 | 6682-6696, 6700 | Positive modulator |
| 2081 | Sulfonylurea receptor 1, Kir6.2 | CHEMBL2096972 | 1628, 13056 | Blocker |
| 2084 | Glutamine | CHEMBL2366039 | | Sequestering agent |
| 2093 | Muscarinic acetylcholine receptor M1 | CHEMBL216 | 2935 | Antagonist |
| 2093 | Muscarinic acetylcholine receptor M3 | CHEMBL245 | 2937 | Antagonist |
| 2102 | TNF-alpha | CHEMBL1825 | 18711 | Inhibitor |
| 2103 | Hepatocyte growth factor receptor | CHEMBL3717 | 10107 | Inhibitor |
| 2103 | Vascular endothelial growth factor receptor 2 | CHEMBL279 | 9005 | Inhibitor |
| 2104 | Gonadotropin-releasing hormone receptor | CHEMBL1855 | 7145 | Agonist |
| 2105 | Luteinizing hormone/Choriogonadotropin receptor | CHEMBL1854 | 9598 | Agonist |
| 2106 | Gonadotropin-releasing hormone receptor | CHEMBL1855 | 7145 | Agonist |
| 2110 | Serotonin 3a (5-HT3a) receptor | CHEMBL1899 | 69 | Antagonist |
| 2111 | Vanilloid receptor | CHEMBL4794 | 18061 | Antagonist |
| 2115 | Adenosine A2b receptor | CHEMBL255 | 626 | Antagonist |
| 2116 | Mitogen-activated protein kinase kinase kinase 5 | CHEMBL5285 | 10476 | Inhibitor |
| 2117 | Adenosine A1 receptor | CHEMBL226 | 624 | Partial agonist |
| 2119 | PI3-kinase class I | CHEMBL3559703 | 12526-12529, 12596-12598, 12601 | Inhibitor |
| 2120 | Serine/threonine-protein kinase Aurora-B | CHEMBL2185 | 1657 | Inhibitor |
| 2120 | Serine/threonine-protein kinase Aurora-C | CHEMBL3935 | 1658 | Inhibitor |
| 2121 | P2X purinoceptor 7 | CHEMBL4805 | 13904 | Negative allosteric modulator |
| 2122 | Beta-2 adrenergic receptor | CHEMBL210 | 773 | Agonist |
| 2123 | Serotonin 1a (5-HT1a) receptor | CHEMBL214 | 61 | Antagonist |
| 2123 | Serotonin 1b (5-HT1b) receptor | CHEMBL1898 | 62 | Antagonist |
| 2123 | Serotonin 1d (5-HT1d) receptor | CHEMBL1983 | 63 | Antagonist |
| 2124 | Histamine H3 receptor | CHEMBL264 | 7622 | Antagonist |
| 2125 | Focal adhesion kinase 1 | CHEMBL2695 | 13729 | Inhibitor |
| 2126 | PI3-kinase p110-delta subunit | CHEMBL3130 | 12528 | Inhibitor |
| 2127 | Histamine H3 receptor | CHEMBL264 | 7622 | Antagonist |
| 2128 | PI3-kinase p110-beta subunit | CHEMBL3145 | 12527 | Inhibitor |

TABLE 3-continued

Ligand sets

| Ligand No. | Target Name | Target ChEMBL ID | Payload ID | Action type |
|---|---|---|---|---|
| 2129 | Androgen Receptor | CHEMBL1871 | 1034 | Modulator |
| 2130 | Androgen Receptor | CHEMBL1871 | 1034 | Modulator |
| 2131 | Serine/threonine-protein kinase PLK1 | CHEMBL3024 | 12860 | Inhibitor |
| 2132 | MAP kinase p38 alpha | CHEMBL260 | 10445 | Inhibitor |
| 2133 | cAMP-dependent protein kinase (PKA) | CHEMBL2094138 | 13612-13614 | Inhibitor |
| 2133 | Protein kinase C (PKC) | CHEMBL2093867 | 13588-13590, 13592-13598, 13600 | Inhibitor |
| 2133 | Serine/threonine-protein kinase AKT | CHEMBL2111353 | 19217-19219 | Inhibitor |
| 2138 | Estrogen receptor alpha | CHEMBL206 | 5551 | Agonist |
| 2140 | Adrenergic receptor alpha-2 | CHEMBL2095158 | 769-771 | Agonist |
| 2141 | Norepinephrine transporter | CHEMBL222 | 16329 | Substrate |
| 2142 | Norepinephrine transporter | CHEMBL222 | 16329 | Substrate |
| 2143 | Adrenergic receptor alpha-2 | CHEMBL2095158 | 769-771 | Agonist |
| 2144 | Voltage-gated potassium channel | CHEMBL2362996 | 13088-13123 | Blocker |
| 2166 | Glutamate [NMDA] receptor | CHEMBL2094124 | 6917-6921, 6923, 6924 | Antagonist |
| 2166 | Glutamate [NMDA] receptor subunit epsilon 1 | CHEMBL1972 | 6918 | Antagonist |
| 2166 | Glutamate [NMDA] receptor subunit epsilon 3 | CHEMBL4109 | 6920 | Antagonist |
| 2166 | Glutamate [NMDA] receptor subunit epsilon 4 | CHEMBL2591 | 6921 | Antagonist |
| 2166 | Glutamate NMDA receptor; GRIN1/GRIN2B | CHEMBL1907603 | 6917, 6919 | Antagonist |
| 2167 | Adenosine A1 receptor | CHEMBL226 | 624 | Agonist |
| 2168 | Peroxisome proliferator-activated receptor alpha | CHEMBL239 | 12426 | Agonist |
| 2169 | Cannabinoid CB2 receptor | CHEMBL253 | 2271 | Agonist |
| 2173 | GABA-A receptor; anion channel | CHEMBL2093872 | 6682-6696, 6700 | Positive allosteric modulator |
| 2174 | Glucocorticoid receptor | CHEMBL2034 | 11442 | Agonist |
| 2175 | Glucocorticoid receptor | CHEMBL2034 | 11442 | Agonist |
| 2178 | D2-like dopamine receptor | CHEMBL2331075 | 5041-5043 | Inverse agonist |
| 2178 | Serotonin 2a (5-HT2a) receptor | CHEMBL224 | 66 | Antagonist |
| 2179 | D2-like dopamine receptor | CHEMBL2331075 | 5041-5043 | Inverse agonist |
| 2179 | Serotonin 2a (5-HT2a) receptor | CHEMBL224 | 66 | Antagonist |
| 2181 | GABA-A receptor; anion channel | CHEMBL2093872 | 6682-6696, 6700 | Positive allosteric modulator |
| 2181 | Glycine receptor (alpha-1/beta) | CHEMBL2363052 | 7027, 7031 | Positive modulator |
| 2181 | Potassium channel subfamily K member 10 | CHEMBL2331041 | 13074 | Opener |
| 2181 | Potassium channel subfamily K member 18 | CHEMBL2331042 | 13080 | Opener |
| 2181 | Potassium channel subfamily K member 2 | CHEMBL2321615 | 13081 | Opener |
| 2181 | Potassium channel subfamily K member 3 | CHEMBL2321613 | 13082 | Opener |
| 2181 | Potassium channel subfamily K member 9 | CHEMBL2321614 | 13087 | Opener |
| 2183 | Androgen Receptor | CHEMBL1871 | 1034 | Modulator |
| 2185 | Receptor protein-tyrosine kinase erbB-2 | CHEMBL1824 | 5520 | Inhibitor |
| 2190 | Vascular endothelial growth factor receptor 2 | CHEMBL279 | 9005 | Inhibitor |
| 2192 | Antithrombin-III | CHEMBL1950 | 15564 | Activator |
| 2195 | Antithrombin-III | CHEMBL1950 | 15564 | Activator |
| 2212 | Acetylcholinesterase | CHEMBL220 | 380 | Inhibitor |
| 2218 | Muscarinic acetylcholine receptor M1 | CHEMBL216 | 2935 | Antagonist |
| 2218 | Muscarinic acetylcholine receptor M3 | CHEMBL245 | 2937 | Antagonist |
| 2219 | Sodium channel alpha subunit | CHEMBL2331043 | 15989, 15991, 15993, 15995, 15997-16001, 16002 | Blocker |
| 2225 | Histamine H1 receptor | CHEMBL231 | 7620 | Agonist |
| 2230 | Gonadotropin-releasing hormone receptor | CHEMBL1855 | 7145 | Agonist |
| 2231 | Epidermal growth factor receptor erbB1 | CHEMBL203 | 5466 | Inhibitor |
| 2232 | Tyrosine-protein kinase BTK | CHEMBL5251 | 1989 | Inhibitor |
| 2233 | Serine/threonine-protein kinase PLK1 | CHEMBL3024 | 12860 | Inhibitor |
| 2235 | Tyrosine-protein kinase SYK | CHEMBL2599 | 16634 | Inhibitor |

TABLE 3-continued

Ligand sets

| Ligand No. | Target Name | Target ChEMBL ID | Payload ID | Action type |
|---|---|---|---|---|
| 2242 | DNA | CHEMBL2311221 | | Hydrolytic enzyme |
| 2243 | Follicle stimulating hormone receptor | CHEMBL2024 | 6347 | Agonist |
| 2244 | Interleukin-2 receptor | CHEMBL2364167 | 8444-8446 | Agonist |
| 2245 | Luteinizing hormone/Choriogonadotropin receptor | CHEMBL1854 | 9598 | Agonist |
| 2260 | Thiazide-sensitive sodium-chloride cotransporter | CHEMBL1876 | 16025 | Inhibitor |
| 2261 | Opioid receptors; mu/kappa/delta | CHEMBL2095181 | 12035-12037 | Agonist |
| 2262 | Glucocorticoid receptor | CHEMBL2034 | 11442 | Agonist |
| 2263 | Glucocorticoid receptor | CHEMBL2034 | 11442 | Agonist |
| 2264 | Glucocorticoid receptor | CHEMBL2034 | 11442 | Agonist |
| 2265 | Glucocorticoid receptor | CHEMBL2034 | 11442 | Agonist |
| 2266 | Glucocorticoid receptor | CHEMBL2034 | 11442 | Agonist |
| 2267 | Glucocorticoid receptor | CHEMBL2034 | 11442 | Agonist |
| 2268 | Glucocorticoid receptor | CHEMBL2034 | 11442 | Agonist |
| 2269 | Glucocorticoid receptor | CHEMBL2034 | 11442 | Agonist |
| 2270 | Glucocorticoid receptor | CHEMBL2034 | 11442 | Agonist |
| 2271 | Thiazide-sensitive sodium-chloride cotransporter | CHEMBL1876 | 16025 | Inhibitor |
| 2274 | Mu opioid receptor | CHEMBL233 | 12037 | Agonist |
| 2280 | Adrenergic receptor | CHEMBL2331074 | 766-774 | Agonist |
| 2281 | Toll-like receptor 7 | CHEMBL5936 | 17854 | Antagonist |
| 2281 | Toll-like receptor 9 | CHEMBL5804 | 17856 | Antagonist |
| 2287 | Progesterone receptor | CHEMBL208 | 13299 | Agonist |
| 2288 | DNA | CHEMBL2311221 | | Inhibitor |
| 2288 | RNA | CHEMBL2311222 | | Inhibitor |
| 2289 | Ribonucleoside-diphosphate reductase RR1 | CHEMBL2095215 | 14615-14617 | Inhibitor |
| 2290 | Histamine H1 receptor | CHEMBL231 | 7620 | Antagonist |
| 2292 | LXR-alpha | CHEMBL2808 | 11431 | Agonist |
| 2292 | LXR-beta | CHEMBL4093 | 11430 | Agonist |
| 2300 | Farnesyl diphosphate synthase | CHEMBL1782 | 6021 | Inhibitor |
| 2301 | Cannabinoid CB1 receptor | CHEMBL218 | 2270 | Antagonist |
| 2302 | Adenosine A3 receptor | CHEMBL256 | 627 | Agonist |
| 2303 | Neurokinin 2 receptor | CHEMBL2327 | 17316 | Antagonist |
| 2305 | Tyrosine-protein kinase BTK | CHEMBL5251 | 1989 | Inhibitor |
| 2307 | Cyclooxygenase | CHEMBL2094253 | 13461, 13462 | Inhibitor |
| 2308 | HERG | CHEMBL240 | 13089 | Blocker |
| 2311 | Bradykinin B2 receptor | CHEMBL3157 | 1923 | Antagonist |
| 2315 | Serotonin 6 (5-HT6) receptor | CHEMBL3371 | 76 | Antagonist |
| 2316 | DNA | CHEMBL2311221 | | Inhibitor |
| 2316 | DNA topoisomerase II alpha | CHEMBL1806 | 17865 | Inhibitor |
| 2320 | PI3-kinase p110-delta subunit | CHEMBL3130 | 12528 | Inhibitor |
| 2322 | Estrogen receptor | CHEMBL2093866 | 5551, 5552 | Modulator |
| 2324 | Heparan sulfate | CHEMBL2364677 | | Hydrolytic enzyme |
| 2326 | Serotonin 2a (5-HT2a) receptor | CHEMBL224 | 66 | Antagonist |
| 2327 | DNA | CHEMBL2311221 | | Inhibitor |
| 2329 | Dopamine D2 receptor | CHEMBL217 | 5041 | Antagonist |
| 2329 | Serotonin 2a (5-HT2a) receptor | CHEMBL224 | 66 | Antagonist |
| 2330 | Prostanoid IP receptor | CHEMBL1995 | 13457 | Agonist |
| 2331 | Platelet-derived growth factor receptor | CHEMBL2095189 | 12773, 12774 | Inhibitor |
| 2331 | Serine/threonine-protein kinase Aurora | CHEMBL3430911 | 1654, 1657, 1658 | Inhibitor |
| 2331 | SRC | CHEMBL2363074 | 1864, 6212, 6514, 6515, 7387, 9206, 9637, 16684, 16687, 19589 | Inhibitor |
| 2331 | Vascular endothelial growth factor receptor | CHEMBL2095227 | 6336, 6339, 9005 | Inhibitor |
| 2332 | Vitamin D receptor | CHEMBL1977 | 19293 | Agonist |
| 2333 | Platelet-derived growth factor receptor beta | CHEMBL1913 | 12774 | Inhibitor |
| 2333 | Stem cell growth factor receptor | CHEMBL1936 | 19299 | Inhibitor |
| 2333 | Tyrosine-protein kinase ABL | CHEMBL1862 | 149 | Inhibitor |
| 2337 | Inhibitor of nuclear factor kappa B kinase beta subunit | CHEMBL1991 | 8194 | Inhibitor |
| 2338 | Inhibitor of nuclear factor kappa B kinase beta subunit | CHEMBL1991 | 8194 | Inhibitor |
| 2339 | Inhibitor of nuclear factor kappa B kinase beta subunit | CHEMBL1991 | 8194 | Inhibitor |
| 2344 | Peroxisome proliferator-activated receptor alpha | CHEMBL239 | 12426 | Agonist |

TABLE 3-continued

Ligand sets

| Ligand No. | Target Name | Target ChEMBL ID | Payload ID | Action type |
|---|---|---|---|---|
| 2344 | Peroxisome proliferator-activated receptor gamma | CHEMBL235 | 12428 | Agonist |
| 2345 | Glucocerebroside | CHEMBL2364176 | | Hydrolytic enzyme |
| 2348 | Norepinephrine transporter | CHEMBL222 | 16329 | Inhibitor |
| 2348 | Serotonin transporter | CHEMBL228 | 16331 | Inhibitor |
| 2349 | Toll-like receptor 7 | CHEMBL5936 | 17854 | Agonist |
| 2352 | Phosphodiesterase 3A | CHEMBL241 | 12553 | Inhibitor |
| 2353 | Tyrosine-protein kinase JAK1 | CHEMBL2835 | 8595 | Inhibitor |
| 2354 | PI3-kinase p110-delta subunit | CHEMBL3130 | 12528 | Inhibitor |
| 2355 | Tyrosine-protein kinase JAK1 | CHEMBL2835 | 8595 | Inhibitor |
| 2358 | Tyrosine-protein kinase JAK1 | CHEMBL2835 | 8595 | |
| 2358 | Tyrosine-protein kinase JAK2 | CHEMBL2971 | 8596 | |
| 2359 | PI3-kinase p110-delta subunit | CHEMBL3130 | 12528 | Inhibitor |
| 2360 | Tyrosine-protein kinase JAK1 | CHEMBL2835 | 8595 | |
| 2363 | C-C chemokine receptor type 5 | CHEMBL274 | 2864 | Antagonist |
| 2364 | Synaptosomal-associated protein 25 | CHEMBL2364159 | 17018 | Inhibitor |
| 2365 | Beta-2 adrenergic receptor | CHEMBL210 | 773 | Agonist |
| 2367 | Thiazide-sensitive sodium-chloride cotransporter | CHEMBL1876 | 16025 | Inhibitor |
| 2368 | Sodium channel alpha subunit | CHEMBL2331043 | 15989, 15991, 15993, 15995, 15997-16001, 16002 | Blocker |
| 2369 | Peroxisome proliferator-activated receptor | CHEMBL3559683 | 12426-12428 | Agonist |
| 2371 | Cyclin-dependent kinase 2 | CHEMBL301 | 4281 | Inhibitor |
| 2379 | Cyclooxygenase | CHEMBL2094253 | 13461, 13462 | Inhibitor |
| 2380 | Vitamin D receptor | CHEMBL1977 | 19293 | Agonist |
| 2381 | Fibroblast growth factor receptor | CHEMBL2095217 | 6253-6256 | Inhibitor |
| 2382 | TNF-alpha | CHEMBL1825 | 18711 | Inhibitor |
| 2397 | PI3-kinase p110-alpha subunit | CHEMBL4005 | 12526 | |
| 2398 | Serine/threonine-protein kinase mTOR | CHEMBL2842 | 9934 | Inhibitor |
| 2405 | Insulin-like growth factor I receptor | CHEMBL1957 | 8256 | Inhibitor |
| 2405 | Receptor protein-tyrosine kinase erbB-2 | CHEMBL1824 | 5520 | Inhibitor |
| 2406 | Insulin receptor | CHEMBL1981 | 8245 | Agonist |
| 2407 | Insulin receptor | CHEMBL1981 | 8245 | Agonist |
| 2408 | Insulin receptor | CHEMBL1981 | 8245 | Agonist |
| 2409 | Insulin receptor | CHEMBL1981 | 8245 | Agonist |
| 2410 | Insulin receptor | CHEMBL1981 | 8245 | Agonist |
| 2411 | Insulin receptor | CHEMBL1981 | 8245 | Agonist |
| 2412 | Insulin receptor | CHEMBL1981 | 8245 | Agonist |
| 2413 | Insulin receptor | CHEMBL1981 | 8245 | Agonist |
| 2414 | Insulin receptor | CHEMBL1981 | 8245 | Agonist |
| 2415 | Insulin receptor | CHEMBL1981 | 8245 | Agonist |
| 2416 | Insulin receptor | CHEMBL1981 | 8245 | Agonist |
| 2417 | Insulin receptor | CHEMBL1981 | 8245 | Agonist |
| 2419 | Insulin receptor | CHEMBL1981 | 8245 | Agonist |
| 2420 | Insulin receptor | CHEMBL1981 | 8245 | Agonist |
| 2421 | Insulin receptor | CHEMBL1981 | 8245 | Agonist |
| 2422 | Insulin receptor | CHEMBL1981 | 8245 | Agonist |
| 2423 | Insulin receptor | CHEMBL1981 | 8245 | Agonist |
| 2424 | Insulin receptor | CHEMBL1981 | 8245 | Agonist |
| 2425 | Insulin receptor | CHEMBL1981 | 8245 | Agonist |
| 2426 | Insulin receptor | CHEMBL1981 | 8245 | Agonist |
| 2427 | Insulin receptor | CHEMBL1981 | 8245 | Agonist |
| 2428 | Insulin receptor | CHEMBL1981 | 8245 | Agonist |
| 2429 | Insulin receptor | CHEMBL1981 | 8245 | Agonist |
| 2430 | Insulin receptor | CHEMBL1981 | 8245 | Agonist |
| 2431 | Insulin receptor | CHEMBL1981 | 8245 | Agonist |
| 2432 | Insulin receptor | CHEMBL1981 | 8245 | Agonist |
| 2433 | Insulin receptor | CHEMBL1981 | 8245 | Agonist |
| 2434 | Insulin receptor | CHEMBL1981 | 8245 | Agonist |
| 2435 | Insulin receptor | CHEMBL1981 | 8245 | Agonist |
| 2436 | Insulin receptor | CHEMBL1981 | 8245 | Agonist |
| 2437 | Insulin receptor | CHEMBL1981 | 8245 | Agonist |
| 2438 | Insulin receptor | CHEMBL1981 | 8245 | Agonist |
| 2441 | Peroxisome proliferator-activated receptor gamma | CHEMBL235 | 12428 | Modulator |
| 2442 | Interferon alpha/beta receptor | CHEMBL2364170 | 8338, 8339 | Agonist |
| 2444 | Interferon alpha/beta receptor | CHEMBL2364170 | 8338, 8339 | Agonist |
| 2446 | Interferon alpha/beta receptor | CHEMBL2364170 | 8338, 8339 | Agonist |
| 2448 | Interferon alpha/beta receptor | CHEMBL2364170 | 8338, 8339 | Agonist |
| 2449 | Interferon alpha/beta receptor | CHEMBL2364170 | 8338, 8339 | Agonist |

TABLE 3-continued

Ligand sets

| Ligand No. | Target Name | Target ChEMBL ID | Payload ID | Action type |
|---|---|---|---|---|
| 2450 | Interferon alpha/beta receptor | CHEMBL2364170 | 8338, 8339 | Agonist |
| 2451 | Interferon gamma receptor | CHEMBL2364171 | 8340, 8341 | Agonist |
| 2459 | Frizzled-8 | CHEMBL3559689 | 6461 | Antagonist |
| 2460 | Serine/threonine-protein kinase AKT | CHEMBL2111353 | 19217-19219 | Inhibitor |
| 2461 | Cytotoxic T-lymphocyte protein 4 | CHEMBL2364164 | 4502 | Inhibitor |
| 2462 | Muscarinic acetylcholine receptor M3 | CHEMBL245 | 2937 | Antagonist |
| 2464 | Type-1 angiotensin II receptor | CHEMBL227 | 1058 | Antagonist |
| 2465 | Receptor protein-tyrosine kinase erbB-2 | CHEMBL1824 | 5520 | Inhibitor |
| 2466 | Histamine H3 receptor | CHEMBL264 | 7622 | Inverse agonist |
| 2467 | DNA topoisomerase I | CHEMBL1781 | 17863 | Inhibitor |
| 2469 | Retinoid X receptor | CHEMBL2363070 | 14454-14456 | Agonist |
| 2470 | Retinoic acid receptor | CHEMBL2363069 | 14451-14453 | Antagonist |
| 2479 | Monoamine oxidase | CHEMBL2095205 | 10527, 10528 | Inhibitor |
| 2484 | Beta-2 adrenergic receptor | CHEMBL210 | 773 | Agonist |
| 2485 | GABA-A receptor; anion channel | CHEMBL2093872 | 6682-6696, 6700 | Positive allosteric modulator |
| 2485 | Glycine receptor (alpha-1/beta) | CHEMBL2363052 | 7027, 7031 | Positive modulator |
| 2485 | Potassium channel subfamily K member 10 | CHEMBL2331041 | 13074 | Opener |
| 2485 | Potassium channel subfamily K member 18 | CHEMBL2331042 | 13080 | Opener |
| 2485 | Potassium channel subfamily K member 2 | CHEMBL2321615 | 13081 | Opener |
| 2485 | Potassium channel subfamily K member 3 | CHEMBL2321613 | 13082 | Opener |
| 2485 | Potassium channel subfamily K member 9 | CHEMBL2321614 | 13087 | Opener |
| 2486 | Acetylcholinesterase | CHEMBL220 | 380 | Inhibitor |
| 2492 | Muscarinic acetylcholine receptor M1 | CHEMBL216 | 2935 | Antagonist |
| 2492 | Muscarinic acetylcholine receptor M3 | CHEMBL245 | 2937 | Antagonist |
| 2495 | Adrenergic receptor beta | CHEMBL2094118 | 772-774 | Agonist |
| 2498 | Soluble guanylate cyclase | CHEMBL2111348 | 7329-7331 | Activator |
| 2499 | Soluble guanylate cyclase | CHEMBL2111348 | 7329-7331 | Activator |
| 2502 | Retinoic acid receptor | CHEMBL2363069 | 14451-14453 | Agonist |
| 2504 | Neuronal acetylcholine receptor; alpha4/beta2 | CHEMBL1907589 | 2945, 2951 | Partial agonist |
| 2505 | Voltage-gated L-type calcium channel | CHEMBL2095229 | 2138-2141 | Blocker |
| 2507 | Dopamine D2 receptor | CHEMBL217 | 5041 | Modulator |
| 2507 | Serotonin 2a (5-HT2a) receptor | CHEMBL224 | 66 | Antagonist |
| 2507 | Serotonin transporter | CHEMBL228 | 16331 | Inhibitor |
| 2511 | Cholecystokinin B receptor | CHEMBL298 | 2926 | Antagonist |
| 2512 | Potassium/sodium hyperpolarization-activated cyclic nucleotide-gated channel 4 | CHEMBL1250417 | 7886 | Blocker |
| 2513 | Cystic fibrosis transmembrane conductance regulator | CHEMBL4051 | 4367 | Positive modulator |
| 2515 | Tubulin | CHEMBL2095182 | 18669-18675, 18679-18687 | Inhibitor |
| 2516 | 26S proteosome | CHEMBL2364701 | 13506-13509 | Inhibitor |
| 2519 | Ephrin type-B receptor 4 | CHEMBL5147 | 5455 | Inhibitor |
| 2519 | Platelet-derived growth factor receptor beta | CHEMBL1913 | 12774 | Inhibitor |
| 2519 | Vascular endothelial growth factor receptor 2 | CHEMBL279 | 9005 | Inhibitor |
| 2520 | Histamine H3 receptor | CHEMBL264 | 7622 | Antagonist |
| 2521 | Epidermal growth factor receptor erbB1 | CHEMBL203 | 5466 | Inhibitor |
| 2521 | Receptor protein-tyrosine kinase erbB-2 | CHEMBL1824 | 5520 | Inhibitor |
| 2521 | Receptor protein-tyrosine kinase erbB-4 | CHEMBL3009 | 5522 | Inhibitor |
| 2521 | Tyrosine-protein kinase FYN | CHEMBL1841 | 6514 | Inhibitor |
| 2521 | Tyrosine-protein kinase LCK | CHEMBL258 | 9206 | Inhibitor |
| 2521 | Tyrosine-protein kinase Lyn | CHEMBL3905 | 9637 | Inhibitor |
| 2521 | Tyrosine-protein kinase SRC | CHEMBL267 | 16684 | Inhibitor |
| 2521 | Tyrosine-protein kinase YES | CHEMBL2073 | 19589 | Inhibitor |
| 2521 | Vascular endothelial growth factor receptor 3 | CHEMBL1955 | 6339 | Inhibitor |
| 2522 | Hepatocyte growth factor receptor | CHEMBL3717 | 10107 | Inhibitor |

TABLE 3-continued

Ligand sets

| Ligand No. | Target Name | Target ChEMBL ID | Payload ID | Action type |
|---|---|---|---|---|
| 2523 | Neuronal acetylcholine receptor protein alpha-7 subunit | CHEMBL2492 | 2940 | Positive allosteric modulator |
| 2524 | Macrophage colony stimulating factor receptor | CHEMBL1844 | 3854 | Inhibitor |
| 2525 | Fibroblast growth factor receptor | CHEMBL2095217 | 6253-6256 | Inhibitor |
| 2527 | Nuclear receptor ROR-gamma | CHEMBL1741186 | 14170 | Antagonist |
| 2528 | Vanilloid receptor | CHEMBL4794 | 18061 | Antagonist |
| 2531 | Peroxisome proliferator-activated receptor alpha | CHEMBL239 | 12426 | Agonist |
| 2540 | MAP kinase p38 alpha | CHEMBL260 | 10445 | Inhibitor |
| 2541 | Peroxisome proliferator-activated receptor delta | CHEMBL3979 | 12427 | Agonist |
| 2543 | Glutamate [NMDA] receptor | CHEMBL2094124 | 6917-6921, 6923, 6924 | Negative allosteric modulator |
| 2547 | Cyclooxygenase | CHEMBL2094253 | 13461, 13462 | Inhibitor |
| 2549 | Cyclooxygenase | CHEMBL2094253 | 13461, 13462 | Inhibitor |
| 2550 | Histamine H1 receptor | CHEMBL231 | 7620 | Antagonist |
| 2553 | Gonadotropin-releasing hormone receptor | CHEMBL1855 | 7145 | Antagonist |
| 2554 | Vascular endothelial growth factor receptor | CHEMBL2095227 | 6336, 6339, 9005 | Inhibitor |
| 2556 | Sphingosine 1-phosphate receptor Edg-1 | CHEMBL4333 | 16606 | Agonist |
| 2557 | Serine/threonine-protein kinase Aurora-A | CHEMBL4722 | 1654 | Inhibitor |
| 2557 | Serine/threonine-protein kinase Aurora-B | CHEMBL2185 | 1657 | Inhibitor |
| 2557 | Tyrosine-protein kinase ABL | CHEMBL1862 | 149 | Inhibitor |
| 2557 | Tyrosine-protein kinase receptor FLT3 | CHEMBL1974 | 6337 | Inhibitor |
| 2558 | Insulin receptor | CHEMBL1981 | 8245 | Inhibitor |
| 2558 | Insulin-like growth factor I receptor | CHEMBL1957 | 8256 | Inhibitor |
| 2560 | Tyrosine-protein kinase SRC | CHEMBL267 | 16684 | Inhibitor |
| 2564 | Vascular endothelial growth factor receptor | CHEMBL2095227 | 6336, 6339, 9005 | Inhibitor |
| 2571 | Adrenergic receptor | CHEMBL2331074 | 766-774 | Antagonist |
| 2573 | Bradykinin B2 receptor | CHEMBL3157 | 1923 | Agonist |
| 2574 | Sodium channel alpha subunit | CHEMBL2331043 | 15989, 15991, 15993, 15995, 15997-16001, 16002 | Blocker |
| 2580 | Interleukin-8 receptor A | CHEMBL4029 | 2886 | Modulator |
| 2580 | Interleukin-8 receptor B | CHEMBL2434 | 2887 | Modulator |
| 2591 | Sodium channel alpha subunit | CHEMBL2331043 | 15989, 15991, 15993, 15995, 15997-16001, 16002 | Blocker |
| 2592 | Glutamate (NMDA) receptor subunit zeta 1 | CHEMBL2015 | 6917 | Blocker |
| 2594 | Somatostatin receptor 2 | CHEMBL1804 | 16391 | Agonist |
| 2594 | Somatostatin receptor 5 | CHEMBL1792 | 16394 | Agonist |
| 2595 | Potassium-transporting ATPase | CHEMBL2095173 | 1587, 1588 | Inhibitor |
| 2596 | Phosphate | CHEMBL2364184 |  | Sequestering agent |
| 2597 | Epidermal growth factor receptor erbB1 | CHEMBL203 | 5466 | Inhibitor |
| 2597 | Receptor protein-tyrosine kinase erbB-2 | CHEMBL1824 | 5520 | Inhibitor |
| 2600 | Dermatan sulfate | CHEMBL2364179 |  | Hydrolytic enzyme |
| 2600 | Heparan sulfate | CHEMBL2364677 |  | Hydrolytic enzyme |
| 2601 | Prostanoid DP receptor | CHEMBL4427 | 13444 | Antagonist |
| 2602 | Adenosine A2b receptor | CHEMBL255 | 626 | Antagonist |
| 2603 | Beta-2 adrenergic receptor | CHEMBL210 | 773 | Agonist |
| 2603 | Muscarinic acetylcholine receptor M3 | CHEMBL245 | 2937 | Antagonist |
| 2604 | Serotonin if (5-HT1f) receptor | CHEMBL1805 | 65 | Agonist |
| 2608 | Prostanoid FP receptor | CHEMBL1987 | 13455 | Agonist |
| 2609 | Prostanoid FP receptor | CHEMBL1987 | 13455 | Agonist |
| 2620 | Serotonin 1a (5-HT1a) receptor | CHEMBL214 | 61 | Antagonist |
| 2622 | Dihydroorotate dehydrogenase | CHEMBL1966 | 4867 | Inhibitor |
| 2624 | Orexin receptor 1 | CHEMBL5113 | 7888 | Antagonist |
| 2624 | Orexin receptor 2 | CHEMBL4792 | 7889 | Antagonist |
| 2626 | Vascular endothelial growth factor receptor | CHEMBL2095227 | 6336, 6339, 9005 | Inhibitor |
| 2627 | MAP kinase p38 alpha | CHEMBL260 | 10445 | Inhibitor |
| 2628 | Thrombin | CHEMBL204 | 3583 | Inhibitor |
| 2630 | Smoothened homolog | CHEMBL5971 | 15967 | Antagonist |

TABLE 3-continued

Ligand sets

| Ligand No. | Target Name | Target ChEMBL ID | Payload ID | Action type |
|---|---|---|---|---|
| 2633 | Solute carrier family 22 member 12 | CHEMBL6120 | 16093 | Inhibitor |
| 2635 | GABA-B receptor 1 | CHEMBL2064 | 6688 | Agonist |
| 2635 | GABA-B receptor 2 | CHEMBL5034 | 6689 | Agonist |
| 2637 | Nerve growth factor receptor Trk-A | CHEMBL2815 | 11145 | Inhibitor |
| 2637 | Neurotrophic tyrosine kinase receptor type 2 | CHEMBL4898 | 11146 | Inhibitor |
| 2637 | NT-3 growth factor receptor | CHEMBL5608 | 11147 | Inhibitor |
| 2637 | Tyrosine-protein kinase JAK2 | CHEMBL2971 | 8596 | Inhibitor |
| 2637 | Tyrosine-protein kinase receptor FLT3 | CHEMBL1974 | 6337 | Inhibitor |
| 2637 | Tyrosine-protein kinase receptor RET | CHEMBL2041 | 14404 | Inhibitor |
| 2638 | Cytochrome P450 19A1 | CHEMBL1978 | 4424 | Inhibitor |
| 2642 | Gonadotropin-releasing hormone receptor | CHEMBL1855 | 7145 | Agonist |
| 2643 | Kappa opioid receptor | CHEMBL237 | 12036 | Partial agonist |
| 2643 | Mu opioid receptor | CHEMBL233 | 12037 | Antagonist |
| 2645 | Synaptic vesicle glycoprotein 2A | CHEMBL1998 | 16992 | Modulator |
| 2645 | Voltage-gated N-type calcium channel alpha-1B subunit | CHEMBL4478 | 2142 | Blocker |
| 2646 | Beta-1 adrenergic receptor | CHEMBL213 | 772 | Antagonist |
| 2647 | Beta-1 adrenergic receptor | CHEMBL213 | 772 | Antagonist |
| 2647 | Beta-2 adrenergic receptor | CHEMBL210 | 773 | Antagonist |
| 2648 | Sodium channel protein type IV alpha subunit | CHEMBL2072 | 15995 | Blocker |
| 2649 | Histamine H1 receptor | CHEMBL231 | 7620 | Antagonist |
| 2650 | Histamine H1 receptor | CHEMBL231 | 7620 | Antagonist |
| 2651 | Dopamine D3 receptor | CHEMBL234 | 5042 | Agonist |
| 2655 | D2-like dopamine receptor | CHEMBL2331075 | 5041-5043 | Antagonist |
| 2656 | Mu opioid receptor | CHEMBL233 | 12037 | Agonist |
| 2657 | Norepinephrine transporter | CHEMBL222 | 16329 | Inhibitor |
| 2657 | Serotonin transporter | CHEMBL228 | 16331 | Inhibitor |
| 2658 | Adrenergic receptor alpha-2 | CHEMBL2095158 | 769-771 | Agonist |
| 2659 | Progesterone receptor | CHEMBL208 | 13299 | Agonist |
| 2661 | Mu opioid receptor | CHEMBL233 | 12037 | Agonist |
| 2662 | Beta-2 adrenergic receptor | CHEMBL210 | 773 | Agonist |
| 2664 | Thyroid hormone receptor | CHEMBL2111462 | 17778, 17779 | Agonist |
| 2668 | Androgen Receptor | CHEMBL1871 | 1034 | Modulator |
| 2669 | Serine/threonine-protein kinase PIM | CHEMBL3559682 | 12722-12724 | Inhibitor |
| 2675 | Serine/threonine-protein kinase B-raf | CHEMBL5145 | 1924 | Inhibitor |
| 2675 | Serine/threonine-protein kinase RAF | CHEMBL1906 | 14116 | Inhibitor |
| 2681 | Sodium channel alpha subunit | CHEMBL2331043 | 15989, 15991, 15993, 15995, 15997-16001, 16002 | Blocker |
| 2684 | Heat-stable enterotoxin receptor | CHEMBL1795197 | 7332 | Agonist |
| 2685 | Dipeptidyl peptidase IV | CHEMBL284 | 4887 | Inhibitor |
| 2689 | Macrophage colony stimulating factor receptor | CHEMBL1844 | 3854 | Inhibitor |
| 2689 | Platelet-derived growth factor receptor | CHEMBL2095189 | 12773, 12774 | Inhibitor |
| 2689 | Tyrosine-protein kinase receptor FLT3 | CHEMBL1974 | 6337 | Inhibitor |
| 2689 | Vascular endothelial growth factor receptor | CHEMBL2095227 | 6336, 6339, 9005 | Inhibitor |
| 2690 | Insulin receptor | CHEMBL1981 | 8245 | Inhibitor |
| 2690 | Insulin-like growth factor I receptor | CHEMBL1957 | 8256 | Inhibitor |
| 2692 | Thyroid hormone receptor | CHEMBL2111462 | 17778, 17779 | Agonist |
| 2694 | Fatty acids | CHEMBL2364711 | | Hydrolytic enzyme |
| 2697 | Glucagon-like peptide 1 receptor | CHEMBL1784 | 6862 | Agonist |
| 2698 | Dopamine transporter | CHEMBL238 | 16330 | Releasing agent |
| 2698 | Norepinephrine transporter | CHEMBL222 | 16329 | Releasing agent |
| 2698 | Synaptic vesicular amine transporter | CHEMBL1893 | 16067 | Inhibitor |
| 2699 | Angiotensin-converting enzyme | CHEMBL1808 | 1056 | Inhibitor |
| 2704 | Glycogen synthase kinase-3 | CHEMBL2095188 | 7039, 7040 | Inhibitor |
| 2704 | Inositol-1(or 4)-monophosphatase 1 | CHEMBL1786 | 8233 | Inhibitor |
| 2705 | Glycogen synthase kinase-3 | CHEMBL2095188 | 7039, 7040 | Inhibitor |
| 2705 | Inositol-1(or 4)-monophosphatase 1 | CHEMBL1786 | 8233 | Inhibitor |

TABLE 3-continued

Ligand sets

| Ligand No. | Target Name | Target ChEMBL ID | Payload ID | Action type |
|---|---|---|---|---|
| 2706 | Vasopressin V2 receptor | CHEMBL1790 | 1345 | Antagonist |
| 2722 | Microsomal triglyceride transfer protein | CHEMBL2364681 | 10240, 13417 | Inhibitor |
| 2723 | DNA | CHEMBL2311221 | | Inhibitor |
| 2724 | Progesterone receptor | CHEMBL208 | 13299 | Antagonist |
| 2725 | Mu opioid receptor | CHEMBL233 | 12037 | Agonist |
| 2728 | Histamine H1 receptor | CHEMBL231 | 7620 | Antagonist |
| 2729 | GABA-A receptor; anion channel | CHEMBL2093872 | 6682-6696, 6700 | Positive allosteric modulator |
| 2730 | Serotonin 2c (5-HT2c) receptor | CHEMBL225 | 68 | Agonist |
| 2733 | Type-1 angiotensin II receptor | CHEMBL227 | 1058 | Antagonist |
| 2734 | MAP kinase p38 alpha | CHEMBL260 | 10445 | Inhibitor |
| 2734 | MAP kinase p38 beta | CHEMBL3961 | 10442 | Inhibitor |
| 2736 | Glucocorticoid receptor | CHEMBL2034 | 11442 | Agonist |
| 2737 | HMG-CoA reductase | CHEMBL402 | 26 | Inhibitor |
| 2738 | D2-like dopamine receptor | CHEMBL2331075 | 5041-5043 | Antagonist |
| 2738 | Serotonin 2a (5-HT2a) receptor | CHEMBL224 | 66 | Antagonist |
| 2738 | Serotonin 2c (5-HT2c) receptor | CHEMBL225 | 68 | Antagonist |
| 2739 | Nerve growth factor receptor Trk-A | CHEMBL2815 | 11145 | Inhibitor |
| 2739 | Neurotrophic tyrosine kinase receptor type 2 | CHEMBL4898 | 11146 | Inhibitor |
| 2739 | NT-3 growth factor receptor | CHEMBL5608 | 11147 | Inhibitor |
| 2748 | Tyrosine-protein kinase JAK2 | CHEMBL2971 | 8596 | Inhibitor |
| 2757 | Chloride channel protein 2 | CHEMBL1628478 | 2910 | Opener |
| 2760 | Fibroblast growth factor receptor 1 | CHEMBL3650 | 6253 | Inhibitor |
| 2760 | Fibroblast growth factor receptor 2 | CHEMBL4142 | 6254 | Inhibitor |
| 2760 | Vascular endothelial growth factor receptor | CHEMBL2095227 | 6336, 6339, 9005 | Inhibitor |
| 2762 | Cystic fibrosis transmembrane conductance regulator | CHEMBL4051 | 4367 | Stabiliser |
| 2765 | Vitamin D receptor | CHEMBL1977 | 19293 | Agonist |
| 2766 | Dopamine D2 receptor | CHEMBL217 | 5041 | Antagonist |
| 2766 | Serotonin 2a (5-HT2a) receptor | CHEMBL224 | 66 | Antagonist |
| 2767 | Luteinizing hormone/Choriogonadotropin receptor | CHEMBL1854 | 9598 | Agonist |
| 2770 | LXR-alpha | CHEMBL2808 | 11431 | Agonist |
| 2770 | LXR-beta | CHEMBL4093 | 11430 | Agonist |
| 2774 | Glycogen synthase kinase-3 alpha | CHEMBL2850 | 7039 | Inhibitor |
| 2774 | Glycogen synthase kinase-3 beta | CHEMBL262 | 7040 | Inhibitor |
| 2777 | Estrogen receptor | CHEMBL2093866 | 5551, 5552 | Modulator |
| 2780 | Glucagon receptor | CHEMBL1985 | 6861 | Antagonist |
| 2781 | Androgen Receptor | CHEMBL1871 | 1034 | Modulator |
| 2783 | Ribosomal protein S6 kinase 1 | CHEMBL4501 | 14707 | Inhibitor |
| 2784 | Serotonin 7 (5-HT7) receptor | CHEMBL3155 | 77 | Antagonist |
| 2785 | Serine/threonine-protein kinase Chk1 | CHEMBL4630 | 2825 | Inhibitor |
| 2786 | Mineralocorticoid receptor | CHEMBL1994 | 11443 | Antagonist |
| 2787 | Histamine H1 receptor | CHEMBL231 | 7620 | Antagonist |
| 2788 | Ribosomal protein S6 kinase (P70S6K) | CHEMBL2111330 | 14707, 14708 | Inhibitor |
| 2788 | Serine/threonine-protein kinase AKT | CHEMBL2111353 | 19217-19219 | Inhibitor |
| 2789 | Cannabinoid CB2 receptor | CHEMBL253 | 2271 | Agonist |
| 2790 | Fibroblast growth factor receptor | CHEMBL2095217 | 6253-6256 | Inhibitor |
| 2791 | Free fatty acid receptor 1 | CHEMBL4422 | 6447 | Agonist |
| 2792 | Nociceptin receptor | CHEMBL2014 | 12031 | Antagonist |
| 2793 | Metabotropic glutamate receptor 2 | CHEMBL5137 | 6926 | Agonist |
| 2793 | Metabotropic glutamate receptor 3 | CHEMBL2888 | 6927 | Agonist |
| 2794 | Metabotropic glutamate receptor 2 | CHEMBL5137 | 6926 | Agonist |
| 2795 | MAP kinase p38 alpha | CHEMBL260 | 10445 | Inhibitor |
| 2796 | Serine/threonine-protein kinase A-Raf | CHEMBL1169596 | 1313 | Inhibitor |
| 2796 | Serine/threonine-protein kinase B-raf | CHEMBL5145 | 1924 | Inhibitor |
| 2796 | Serine/threonine-protein kinase RAF | CHEMBL1906 | 14116 | Inhibitor |
| 2797 | PI3-kinase class I | CHEMBL3559703 | 12526-12529, 12596-12598, 12601 | Inhibitor |
| 2797 | Serine/threonine-protein kinase mTOR | CHEMBL2842 | 9934 | Inhibitor |
| 2800 | Beta-1 adrenergic receptor | CHEMBL213 | 772 | Antagonist |
| 2800 | Beta-2 adrenergic receptor | CHEMBL210 | 773 | Antagonist |

TABLE 3-continued

Ligand sets

| Ligand No. | Target Name | Target ChEMBL ID | Payload ID | Action type |
|---|---|---|---|---|
| 2800 | Beta-3 adrenergic receptor | CHEMBL246 | 774 | Agonist |
| 2801 | Metabotropic glutamate receptor 2 | CHEMBL5137 | 6926 | Agonist |
| 2801 | Metabotropic glutamate receptor 3 | CHEMBL2888 | 6927 | Agonist |
| 2803 | Peroxisome proliferator-activated receptor alpha | CHEMBL239 | 12426 | Agonist |
| 2804 | Metabotropic glutamate receptor 5 | CHEMBL3227 | 6929 | Antagonist |
| 2806 | Vasopressin receptor | CHEMBL2363078 | 1343-1345 | Agonist |
| 2812 | Ghrelin receptor | CHEMBL4616 | 7232 | Agonist |
| 2813 | Endothelin receptor, ET-A/ET-B | CHEMBL2096678 | 5399, 5400 | Antagonist |
| 2834 | Glucocorticoid receptor | CHEMBL2034 | 11442 | Agonist |
| 2835 | Norepinephrine transporter | CHEMBL222 | 16329 | Inhibitor |
| 2836 | C-C chemokine receptor type 5 | CHEMBL274 | 2864 | Antagonist |
| 2838 | Fibroblast growth factor receptor 3 | CHEMBL2742 | 6255 | Inhibitor |
| 2838 | Platelet-derived growth factor receptor | CHEMBL2095189 | 12773, 12774 | Inhibitor |
| 2838 | Stem cell growth factor receptor | CHEMBL1936 | 19299 | Inhibitor |
| 2842 | Metabotropic glutamate receptor 5 | CHEMBL3227 | 6929 | Antagonist |
| 2843 | Monoamine transporter | CHEMBL2363064 | 16329-16331 | Inhibitor |
| 2845 | Thyroid hormone receptor beta-1 | CHEMBL1947 | 17779 | Agonist |
| 2846 | Peroxisome proliferator-activated receptor gamma | CHEMBL235 | 12428 | Modulator |
| 2847 | Peroxisome proliferator-activated receptor delta | CHEMBL3979 | 12427 | Agonist |
| 2854 | Mitochondrial complex I (NADH dehydrogenase) | CHEMBL2363065 | 10429-10435, 10860-10885, 10888-10891, 10895-10905 | Inhibitor |
| 2855 | PI3-kinase p110-delta subunit | CHEMBL3130 | 12528 | Inhibitor |
| 2858 | Neuronal acetylcholine receptor; alpha3/beta4 | CHEMBL1907594 | 2944, 2953 | Negative allosteric modulator |
| 2859 | Insulin-like growth factor I receptor | CHEMBL1957 | 8256 | Agonist |
| 2860 | Insulin-like growth factor I receptor | CHEMBL1957 | 8256 | Agonist |
| 2861 | DNA | CHEMBL2311221 | | Inhibitor |
| 2862 | Histamine H1 receptor | CHEMBL231 | 7620 | Antagonist |
| 2864 | Arachidonate 5-lipoxygenase | CHEMBL215 | 1310 | Inhibitor |
| 2864 | Cyclooxygenase | CHEMBL2094253 | 13461, 13462 | Inhibitor |
| 2865 | Progesterone receptor | CHEMBL208 | 13299 | Agonist |
| 2866 | Glucocorticoid receptor | CHEMBL2034 | 11442 | Agonist |
| 2867 | Cyclooxygenase | CHEMBL2094253 | 13461, 13462 | Inhibitor |
| 2869 | Progesterone receptor | CHEMBL208 | 13299 | Agonist |
| 2871 | Cyclooxygenase-2 | CHEMBL230 | 13462 | Inhibitor |
| 2872 | DNA | CHEMBL2311221 | | Inhibitor |
| 2874 | Glutamate [NMDA] receptor | CHEMBL2094124 | 6917-6921, 6923, 6924 | Negative allosteric modulator |
| 2876 | Follicle stimulating hormone receptor | CHEMBL2024 | 6347 | Agonist |
| 2876 | Luteinizing hormone/Choriogonadotropin receptor | CHEMBL1854 | 9598 | Agonist |
| 2877 | Transient receptor potential cation channel subfamily A member 1 | CHEMBL6007 | 18045 | Opener |
| 2877 | Transient receptor potential cation channel subfamily M member 8 | CHEMBL1075319 | 18060 | Opener |
| 2878 | Muscarinic acetylcholine receptor M1 | CHEMBL216 | 2935 | Antagonist |
| 2878 | Muscarinic acetylcholine receptor M3 | CHEMBL245 | 2937 | Antagonist |
| 2879 | Mu opioid receptor | CHEMBL233 | 12037 | Agonist |
| 2880 | Adrenergic receptor | CHEMBL2331074 | 766-774 | Agonist |
| 2881 | Sodium channel alpha subunit | CHEMBL2331043 | 15989, 15991, 15993, 15995, 15997-16001, 16002 | Blocker |
| 2882 | Sodium channel alpha subunit | CHEMBL2331043 | 15989, 15991, 15993, 15995, 15997-16001, 16002 | Blocker |
| 2883 | Interleukin-5 | CHEMBL1169600 | 8477 | Inhibitor |
| 2884 | Glucocorticoid receptor | CHEMBL2034 | 11442 | Agonist |
| 2885 | GABA-A receptor; anion channel | CHEMBL2093872 | 6682-6696, 6700 | Agonist |
| 2887 | Tyrosinase | CHEMBL1973 | 18793 | Inhibitor |
| 2891 | Amidophosphoribosyltransferase | CHEMBL2362992 | 12679 | Inhibitor |
| 2891 | DNA | CHEMBL2311221 | | Inhibitor |
| 2894 | Hepatocyte growth factor receptor | CHEMBL3717 | 10107 | Inhibitor |

TABLE 3-continued

Ligand sets

| Ligand No. | Target Name | Target ChEMBL ID | Payload ID | Action type |
|---|---|---|---|---|
| 2895 | Sodium channel alpha subunit | CHEMBL2331043 | 15989, 15991, 15993, 15995, 15997-16001, 16002 | Blocker |
| 2899 | Arachidonate 5-lipoxygenase | CHEMBL215 | 1310 | Inhibitor |
| 2899 | Cyclooxygenase | CHEMBL2094253 | 13461, 13462 | Inhibitor |
| 2899 | Peroxisome proliferator-activated receptor gamma | CHEMBL235 | 12428 | Agonist |
| 2903 | Dopamine D2 receptor | CHEMBL217 | 5041 | Antagonist |
| 2903 | Serotonin 2a (5-HT2a) receptor | CHEMBL224 | 66 | Antagonist |
| 2904 | Estrogen receptor alpha | CHEMBL206 | 5551 | Agonist |
| 2909 | Beta-2 adrenergic receptor | CHEMBL210 | 773 | Agonist |
| 2910 | Adrenergic receptor alpha-1 | CHEMBL2094251 | 766-768 | Agonist |
| 2913 | Mitochondrial complex I (NADH dehydrogenase) | CHEMBL2363065 | 10429-10435, 10860-10885, 10888-10891, 10895-10905 | Inhibitor |
| 2913 | Mitochondrial glycerol-3-phosphate dehydrogenase | CHEMBL3391681 | 7013 | Inhibitor |
| 2914 | Muscarinic acetylcholine receptor M3 | CHEMBL245 | 2937 | Agonist |
| 2917 | Mu opioid receptor | CHEMBL233 | 12037 | Agonist |
| 2919 | Monoamine transporter | CHEMBL2363064 | 16329-16331 | Inhibitor |
| 2920 | Histamine H2 receptor | CHEMBL1941 | 7621 | Antagonist |
| 2921 | GABA-A receptor; anion channel | CHEMBL2093872 | 6682-6696, 6700 | Positive allosteric modulator |
| 2922 | Carbonic anhydrase I | CHEMBL261 | 2310 | Inhibitor |
| 2922 | Carbonic anhydrase II | CHEMBL205 | 2311 | Inhibitor |
| 2922 | Carbonic anhydrase IV | CHEMBL3729 | 2313 | Inhibitor |
| 2922 | Carbonic anhydrase VII | CHEMBL2326 | 2318 | Inhibitor |
| 2923 | Histamine H1 receptor | CHEMBL231 | 7620 | Antagonist |
| 2927 | Thyroid peroxidase | CHEMBL1839 | 17781 | Inhibitor |
| 2931 | Muscarinic acetylcholine receptor M1 | CHEMBL216 | 2935 | Antagonist |
| 2931 | Serotonin 2c (5-HT2c) receptor | CHEMBL225 | 68 | Antagonist |
| 2932 | Carbonic anhydrase I | CHEMBL261 | 2310 | Inhibitor |
| 2933 | GABA-A receptor; anion channel | CHEMBL2093872 | 6682-6696, 6700 | Positive allosteric modulator |
| 2934 | Dihydrofolate reductase | CHEMBL202 | 4861 | Inhibitor |
| 2936 | Adrenergic receptor alpha-1 | CHEMBL2094251 | 766-768 | Agonist |
| 2937 | DNA | CHEMBL2311221 | | Inhibitor |
| 2939 | GABA-A receptor; anion channel | CHEMBL2093872 | 6682-6696, 6700 | Positive modulator |
| 2939 | Glycine receptor (alpha-1/beta) | CHEMBL2363052 | 7027, 7031 | Agonist |
| 2941 | Muscarinic acetylcholine receptor M1 | CHEMBL216 | 2935 | Antagonist |
| 2941 | Muscarinic acetylcholine receptor M3 | CHEMBL245 | 2937 | Antagonist |
| 2942 | Voltage-gated T-type calcium channel | CHEMBL2362995 | 2145-2147 | Blocker |
| 2943 | Thiazide-sensitive sodium-chloride cotransporter | CHEMBL1876 | 16025 | Inhibitor |
| 2958 | DNA | CHEMBL2311221 | | Inhibitor |
| 2974 | Adrenergic receptor alpha-2 | CHEMBL2095158 | 769-771 | Agonist |
| 2975 | Adrenergic receptor alpha-2 | CHEMBL2095158 | 769-771 | Agonist |
| 2977 | Dopamine D1 receptor | CHEMBL2056 | 5040 | Antagonist |
| 2977 | Serotonin 2b (5-HT2b) receptor | CHEMBL1833 | 67 | Partial agonist |
| 2983 | Mu opioid receptor | CHEMBL233 | 12037 | Antagonist |
| 2984 | Dopamine transporter | CHEMBL238 | 16330 | Inhibitor |
| 2984 | Norepinephrine transporter | CHEMBL222 | 16329 | Inhibitor |
| 2992 | Glucocorticoid receptor | CHEMBL2034 | 11442 | Agonist |
| 2993 | Glucocorticoid receptor | CHEMBL2034 | 11442 | Agonist |
| 2994 | Histamine H1 receptor | CHEMBL231 | 7620 | Antagonist |
| 2995 | Mu opioid receptor | CHEMBL233 | 12037 | Antagonist |
| 2997 | Androgen Receptor | CHEMBL1871 | 1034 | Agonist |
| 3002 | GABA-A receptor; anion channel | CHEMBL2093872 | 6682-6696, 6700 | Positive allosteric modulator |
| 3003 | Serotonin 1a (5-HT1a) receptor | CHEMBL214 | 61 | Partial agonist |
| 3003 | Serotonin 2b (5-HT2b) receptor | CHEMBL1833 | 67 | Antagonist |
| 3003 | Serotonin 2c (5-HT2c) receptor | CHEMBL225 | 68 | Antagonist |
| 3006 | Beta-1 adrenergic receptor | CHEMBL213 | 772 | Antagonist |
| 3006 | Beta-2 adrenergic receptor | CHEMBL210 | 773 | Antagonist |
| 3008 | Dopamine D2 receptor | CHEMBL217 | 5041 | Antagonist |
| 3008 | Serotonin 3a (5-HT3a) receptor | CHEMBL1899 | 69 | Antagonist |
| 3008 | Serotonin 4 (5-HT4) receptor | CHEMBL1875 | 74 | Agonist |
| 3009 | Muscle-type nicotinic acetylcholine receptor | CHEMBL2362997 | 2941, 2950, 2954, 2955 2956 | Antagonist |
| 3011 | Thiazide-sensitive sodium-chloride cotransporter | CHEMBL1876 | 16025 | Inhibitor |

TABLE 3-continued

Ligand sets

| Ligand No. | Target Name | Target ChEMBL ID | Payload ID | Action type |
|---|---|---|---|---|
| 3013 | Beta-1 adrenergic receptor | CHEMBL213 | 772 | Antagonist |
| 3014 | Leptin receptor | CHEMBL5913 | 9248 | Agonist |
| 3017 | Tyrosine 3-hydroxylase | CHEMBL1969 | 18802 | Inhibitor |
| 3019 | Sodium channel alpha subunit | CHEMBL2331043 | 15989, 15991, 15993, 15995, 15997-16001, 16002 | Blocker |
| 3021 | Estrogen receptor beta | CHEMBL242 | 5552 | Agonist |
| 3024 | Hepatocyte growth factor receptor | CHEMBL3717 | 10107 | Inhibitor |
| 3024 | Macrophage-stimulating protein receptor | CHEMBL2689 | 9723 | Inhibitor |
| 3024 | Tyrosine-protein kinase TIE-2 | CHEMBL4128 | 17514 | Inhibitor |
| 3024 | Vascular endothelial growth factor receptor | CHEMBL2095227 | 6336, 6339, 9005 | Inhibitor |
| 3026 | Thyroid hormone receptor beta-1 | CHEMBL1947 | 17779 | Agonist |
| 3028 | Voltage-gated T-type calcium channel | CHEMBL2362995 | 2145-2147 | Blocker |
| 3031 | GABA-A receptor; anion channel | CHEMBL2093872 | 6682-6696, 6700 | Positive allosteric modulator |
| 3032 | Adrenergic receptor alpha-1 | CHEMBL2094251 | 766-768 | Agonist |
| 3033 | Platelet-derived growth factor receptor | CHEMBL2095189 | 12773, 12774 | Inhibitor |
| 3033 | Protein kinase C (PKC) | CHEMBL2093867 | 13588-13590, 13592-13598, 13600 | Inhibitor |
| 3033 | Stem cell growth factor receptor | CHEMBL1936 | 19299 | Inhibitor |
| 3033 | Tyrosine-protein kinase receptor FLT3 | CHEMBL1974 | 6337 | Inhibitor |
| 3033 | Vascular endothelial growth factor receptor 2 | CHEMBL279 | 9005 | Inhibitor |
| 3034 | Glucocorticoid receptor | CHEMBL2034 | 11442 | Antagonist |
| 3034 | Progesterone receptor | CHEMBL208 | 13299 | Antagonist |
| 3036 | Lysosomal alpha-glucosidase | CHEMBL2608 | 6888 | Inhibitor |
| 3036 | Maltase-glucoamylase | CHEMBL2074 | 9808 | Inhibitor |
| 3037 | Ceramide glucosyltransferase | CHEMBL2063 | 19066 | Inhibitor |
| 3038 | Cyclin-dependent kinase 1 | CHEMBL308 | 4269 | Inhibitor |
| 3038 | Cyclin-dependent kinase 2 | CHEMBL301 | 4281 | Inhibitor |
| 3038 | Cyclin-dependent kinase 4 | CHEMBL331 | 4287 | Inhibitor |
| 3038 | Nerve growth factor receptor Trk-A | CHEMBL2815 | 11145 | Inhibitor |
| 3039 | Norepinephrine transporter | CHEMBL222 | 16329 | Inhibitor |
| 3039 | Serotonin transporter | CHEMBL228 | 16331 | Inhibitor |
| 3040 | Phosphodiesterase 3A | CHEMBL241 | 12553 | Inhibitor |
| 3042 | Beta-2 adrenergic receptor | CHEMBL210 | 773 | Agonist |
| 3046 | Platelet activating factor receptor | CHEMBL250 | 12770 | Antagonist |
| 3047 | Sulfonylurea receptor 2, Kir6.2 | CHEMBL2095198 | 1629, 13056 | Opener |
| 3048 | Apo-B 100 mRNA | CHEMBL2364185 | | Antisense inhibitor |
| 3049 | Beta-3 adrenergic receptor | CHEMBL246 | 774 | Agonist |
| 3050 | Adrenergic receptor alpha-2 | CHEMBL2095158 | 769-771 | Antagonist |
| 3050 | Serotonin 2a (5-HT2a) receptor | CHEMBL224 | 66 | Antagonist |
| 3050 | Serotonin 2c (5-HT2c) receptor | CHEMBL225 | 68 | Antagonist |
| 3051 | Prostanoid EP3 receptor | CHEMBL3710 | 13449 | Agonist |
| 3054 | DNA | CHEMBL2311221 | | Inhibitor |
| 3055 | Cytochrome P450 11A1 | CHEMBL2033 | 4420 | Inhibitor |
| 3055 | Cytochrome P450 11B1 | CHEMBL1908 | 4421 | Inhibitor |
| 3056 | DNA | CHEMBL2311221 | | Inhibitor |
| 3056 | DNA topoisomerase II alpha | CHEMBL1806 | 17865 | Inhibitor |
| 3058 | Muscle-type nicotinic acetylcholine receptor | CHEMBL2362997 | 2941, 2950, 2954, 2955 2956 | Antagonist |
| 3060 | Histamine H3 receptor | CHEMBL264 | 7622 | Inverse agonist |
| 3061 | Peroxisome proliferator-activated receptor gamma | CHEMBL235 | 12428 | Modulator |
| 3062 | Bradykinin B1 receptor | CHEMBL4308 | 1922 | Antagonist |
| 3063 | Androgen Receptor | CHEMBL1871 | 1034 | Modulator |
| 3064 | Glucagon receptor | CHEMBL1985 | 6861 | Antagonist |
| 3066 | G protein-coupled receptor 44 | CHEMBL5071 | 13445 | Antagonist |
| 3067 | Serine/threonine-protein kinase PLK1 | CHEMBL3024 | 12860 | Inhibitor |
| 3068 | Serine/threonine-protein kinase AKT | CHEMBL2111353 | 19217-19219 | Inhibitor |
| 3069 | Serine/threonine-protein kinase AKT | CHEMBL2111353 | 19217-19219 | Inhibitor |
| 3070 | Hepatocyte growth factor receptor | CHEMBL3717 | 10107 | Inhibitor |
| 3071 | Calcitonin gene-related peptide type 1 receptor | CHEMBL3798 | 2102 | Antagonist |

TABLE 3-continued

Ligand sets

| Ligand No. | Target Name | Target ChEMBL ID | Payload ID | Action type |
|---|---|---|---|---|
| 3072 | Serine/threonine-protein kinase Aurora-A | CHEMBL4722 | 1654 | Inhibitor |
| 3073 | Serine/threonine-protein kinase Aurora | CHEMBL3430911 | 1654, 1657, 1658 | Inhibitor |
| 3074 | Estrogen receptor | CHEMBL2093866 | 5551, 5552 | Agonist |
| 3075 | G protein-coupled receptor 44 | CHEMBL5071 | 13445 | Antagonist |
| 3076 | Hepatocyte growth factor receptor | CHEMBL3717 | 10107 | Inhibitor |
| 3076 | Macrophage-stimulating protein receptor | CHEMBL2689 | 9723 | Inhibitor |
| 3077 | MAP kinase ERK1 | CHEMBL3385 | 10447 | Inhibitor |
| 3077 | MAP kinase ERK2 | CHEMBL4040 | 10439 | Inhibitor |
| 3079 | Serine/threonine-protein kinase mTOR | CHEMBL2842 | 9934 | Inhibitor |
| 3082 | Inhibitor of nuclear factor kappa B kinase beta subunit | CHEMBL1991 | 8194 | Inhibitor |
| 3083 | PI3-kinase p110-alpha subunit | CHEMBL4005 | 12526 | Inhibitor |
| 3085 | RAF serine/threonine protein kinase | CHEMBL3559685 | 1313, 1924, 14116 | Inhibitor |
| 3086 | C-C chemokine receptor type 9 | CHEMBL5815 | 2868 | Antagonist |
| 3088 | Serine/threonine-protein kinase Aurora-A | CHEMBL4722 | 1654 | Inhibitor |
| 3096 | Dopamine transporter | CHEMBL238 | 16330 | Inhibitor |
| 3099 | Melanocortin receptor 1 | CHEMBL3795 | 9987 | Agonist |
| 3099 | Melanocortin receptor 3 | CHEMBL4644 | 9991 | Agonist |
| 3100 | Angiotensin-converting enzyme | CHEMBL1808 | 1056 | Inhibitor |
| 3101 | Retinoid receptor | CHEMBL2363071 | 14451-14456 | Modulator |
| 3103 | Dopamine D2 receptor | CHEMBL217 | 5041 | Antagonist |
| 3103 | Serotonin 2a (5-HT2a) receptor | CHEMBL224 | 66 | Antagonist |
| 3105 | Tyrosine-protein kinase JAK1 | CHEMBL2835 | 8595 | Inhibitor |
| 3105 | Tyrosine-protein kinase JAK2 | CHEMBL2971 | 8596 | Inhibitor |
| 3107 | Glucocorticoid receptor | CHEMBL2034 | 11442 | Agonist |
| 3110 | Tyrosinase | CHEMBL1973 | 18793 | Inhibitor |
| 3116 | Cysteinyl leukotriene receptor 1 | CHEMBL1798 | 4363 | Antagonist |
| 3117 | Sodium channel alpha subunit | CHEMBL2331043 | 15989, 15991, 15993, 15995, 15997-16001, 16002 | Blocker |
| 3118 | Mu opioid receptor | CHEMBL233 | 12037 | Agonist |
| 3122 | Platelet-derived growth factor receptor | CHEMBL2095189 | 12773, 12774 | Inhibitor |
| 3122 | Stem cell growth factor receptor | CHEMBL1936 | 19299 | Inhibitor |
| 3122 | Tyrosine-protein kinase receptor RET | CHEMBL2041 | 14404 | Inhibitor |
| 3122 | Vascular endothelial growth factor receptor | CHEMBL2095227 | 6336, 6339, 9005 | Inhibitor |
| 3130 | Epidermal growth factor receptor erbB1 | CHEMBL203 | 5466 | Inhibitor |
| 3130 | Receptor protein-tyrosine kinase erbB-2 | CHEMBL1824 | 5520 | Inhibitor |
| 3134 | Ribosomal protein S6 kinase (P70S6K) | CHEMBL2111330 | 14707, 14708 | Inhibitor |
| 3134 | Serine/threonine-protein kinase AKT | CHEMBL4282 | 19217 | Inhibitor |
| 3134 | Serine/threonine-protein kinase AKT3 | CHEMBL4816 | 19219 | Inhibitor |
| 3135 | Tyrosine-protein kinase BTK | CHEMBL5251 | 1989 | Inhibitor |
| 3136 | C—X—C chemokine receptor type 4 | CHEMBL2107 | 2889 | Antagonist |
| 3137 | Mineralocorticoid receptor | CHEMBL1994 | 11443 | Antagonist |
| 3139 | Epidermal growth factor receptor erbB1 | CHEMBL203 | 5466 | |
| 3139 | Receptor protein-tyrosine kinase erbB-2 | CHEMBL1824 | 5520 | |
| 3141 | Peroxisome proliferator-activated receptor alpha | CHEMBL239 | 12426 | Agonist |
| 3141 | Peroxisome proliferator-activated receptor gamma | CHEMBL235 | 12428 | Agonist |
| 3143 | T cell surface glycoprotein CD3 | CHEMBL2364168 | 2557, 2558, 2560 | Inhibitor |
| 3144 | Inosine-5'-monophosphate dehydrogenase (IMPDH) | CHEMBL2111369 | 8156, 8157 | Inhibitor |
| 3145 | Inosine-5'-monophosphate dehydrogenase (IMPDH) | CHEMBL2111369 | 8156, 8157 | Inhibitor |
| 3463 | Cannabinoid CB1 receptor | CHEMBL218 | 2270 | Agonist |
| 3464 | Cyclooxygenase-2 | CHEMBL230 | 13462 | Inhibitor |
| 3482 | Beta-1 adrenergic receptor | CHEMBL213 | 772 | Antagonist |
| 3482 | Beta-2 adrenergic receptor | CHEMBL210 | 773 | Antagonist |

TABLE 3-continued

Ligand sets

| Ligand No. | Target Name | Target ChEMBL ID | Payload ID | Action type |
|---|---|---|---|---|
| 3485 | Gonadotropin-releasing hormone receptor | CHEMBL1855 | 7145 | Agonist |
| 3488 | Opioid receptors; mu/kappa/delta | CHEMBL2095181 | 12035-12037 | Agonist |
| 3489 | Mu opioid receptor | CHEMBL233 | 12037 | Antagonist |
| 3493 | Opioid receptors; mu/kappa/delta | CHEMBL2095181 | 12035-12037 | Antagonist |
| 3494 | Mu opioid receptor | CHEMBL233 | 12037 | Antagonist |
| 3495 | Opioid receptors; mu/kappa/delta | CHEMBL2095181 | 12035-12037 | Antagonist |
| 3503 | Mu opioid receptor | CHEMBL233 | 12037 | Partial agonist |
| 3504 | Opioid receptors; mu/kappa/delta | CHEMBL2095181 | 12035-12037 | Antagonist |
| 3505 | Serotonin 1a (5-HT1a) receptor | CHEMBL214 | 61 | Agonist |
| 3511 | Androgen Receptor | CHEMBL1871 | 1034 | Agonist |
| 3512 | Androgen Receptor | CHEMBL1871 | 1034 | Agonist |
| 3514 | Adrenergic receptor alpha | CHEMBL2095203 | 766-771 | Agonist |
| 3522 | Cyclooxygenase | CHEMBL2094253 | 13461, 13462 | Inhibitor |
| 3523 | Serotonin 1b (5-HT1b) receptor | CHEMBL1898 | 62 | Agonist |
| 3523 | Serotonin 1d (5-HT1d) receptor | CHEMBL1983 | 63 | Agonist |
| 3525 | Serotonin 4 (5-HT4) receptor | CHEMBL1875 | 74 | Agonist |
| 3526 | Integrin alpha-4/beta-1 | CHEMBL1907599 | 8298, 8310 | Inhibitor |
| 3526 | Integrin alpha-4/beta-7 | CHEMBL2095184 | 8298, 8316 | Inhibitor |
| 3528 | Sulfonylurea receptor 1, Kir6.2 | CHEMBL2096972 | 1628, 13056 | Blocker |
| 3530 | Interleukin-8 receptor A | CHEMBL4029 | 2886 | Antagonist |
| 3530 | Interleukin-8 receptor B | CHEMBL2434 | 2887 | Antagonist |
| 3531 | Peroxisome proliferator-activated receptor alpha | CHEMBL239 | 12426 | Agonist |
| 3531 | Peroxisome proliferator-activated receptor gamma | CHEMBL235 | 12428 | Agonist |
| 3532 | Adenosine A1 receptor | CHEMBL226 | 624 | Antagonist |
| 3579 | Endothelin receptor ET-A | CHEMBL252 | 5399 | Antagonist |
| 3580 | Beta-1 adrenergic receptor | CHEMBL213 | 772 | Antagonist |
| 3580 | Beta-2 adrenergic receptor | CHEMBL210 | 773 | Antagonist |
| 3581 | Glutamate (NMDA) receptor subunit zeta 1 | CHEMBL2015 | 6917 | Positive allosteric modulator |
| 3581 | Glutamate [NMDA] receptor subunit epsilon 1 | CHEMBL1972 | 6918 | Positive allosteric modulator |
| 3581 | Glutamate [NMDA] receptor subunit epsilon 3 | CHEMBL4109 | 6920 | Positive allosteric modulator |
| 3581 | Glutamate [NMDA] receptor subunit epsilon 4 | CHEMBL2591 | 6921 | Positive allosteric modulator |
| 3581 | Glutamate NMDA receptor; GRIN1/GRIN2B | CHEMBL1907603 | 6917, 6919 | Positive allosteric modulator |
| 3582 | Epidermal growth factor receptor erbB1 | CHEMBL203 | 5466 | Inhibitor |
| 3584 | Norepinephrine transporter | CHEMBL222 | 16329 | Inhibitor |
| 3584 | Serotonin 2a (5-HT2a) receptor | CHEMBL224 | 66 | Antagonist |
| 3584 | Serotonin 2c (5-HT2c) receptor | CHEMBL225 | 68 | Antagonist |
| 3584 | Serotonin transporter | CHEMBL228 | 16331 | Inhibitor |
| 3585 | DNA | CHEMBL2311221 | | Inhibitor |
| 3587 | Vasopressin V1b receptor | CHEMBL1921 | 1344 | Antagonist |
| 3588 | Serotonin 2a (5-HT2a) receptor | CHEMBL224 | 66 | Inverse agonist |
| 3590 | Acetylcholinesterase | CHEMBL220 | 380 | Inhibitor |
| 3591 | Cyclooxygenase | CHEMBL2094253 | 13461, 13462 | Inhibitor |
| 3593 | Epidermal growth factor receptor erbB1 | CHEMBL203 | 5466 | Inhibitor |
| 3593 | Receptor protein-tyrosine kinase erbB-2 | CHEMBL1824 | 5520 | Inhibitor |
| 3594 | Atrial natriuretic peptide receptor A | CHEMBL1988 | 10932 | Agonist |
| 3595 | Cholecystokinin B receptor | CHEMBL298 | 2926 | Antagonist |
| 3602 | Peroxisome proliferator-activated receptor gamma | CHEMBL235 | 12428 | Modulator |
| 3603 | Neurokinin 1 receptor | CHEMBL249 | 17315 | Antagonist |
| 3607 | Vanilloid receptor | CHEMBL4794 | 18061 | Antagonist |
| 3623 | Voltage-gated L-type calcium channel | CHEMBL2095229 | 2138-2141 | Blocker |
| 3629 | Neuronal acetylcholine receptor; alpha4/beta2 | CHEMBL1907589 | 2945, 2951 | Agonist |
| 3630 | Voltage-gated L-type calcium channel | CHEMBL2095229 | 2138-2141 | Blocker |
| 3632 | Tyrosine-protein kinase ABL | CHEMBL1862 | 149 | Inhibitor |
| 3633 | Androgen Receptor | CHEMBL1871 | 1034 | Antagonist |
| 3636 | Mineralocorticoid receptor | CHEMBL1994 | 11443 | Antagonist |
| 3636 | Voltage-gated L-type calcium channel | CHEMBL2095229 | 2138-2141 | Blocker |

TABLE 3-continued

Ligand sets

| Ligand No. | Target Name | Target ChEMBL ID | Payload ID | Action type |
|---|---|---|---|---|
| 3637 | Fibroblast growth factor receptor | CHEMBL2095217 | 6253-6256 | |
| 3637 | Fibroblast growth factor receptor | CHEMBL2095217 | 6253-6256 | Inhibitor |
| 3637 | Platelet-derived growth factor receptor | CHEMBL2095189 | 12773, 12774 | |
| 3637 | Platelet-derived growth factor receptor | CHEMBL2095189 | 12773, 12774 | Inhibitor |
| 3637 | Vascular endothelial growth factor receptor | CHEMBL2095227 | 6336, 6339, 9005 | |
| 3637 | Vascular endothelial growth factor receptor | CHEMBL2095227 | 6336, 6339, 9005 | Inhibitor |
| 3639 | Voltage-gated L-type calcium channel | CHEMBL2095229 | 2138-2141 | Blocker |
| 3642 | 4-hydroxyphenylpyruvate dioxygenase | CHEMBL1861 | 49 | Inhibitor |
| 3645 | Soluble guanylate cyclase | CHEMBL2111348 | 7329-7331 | Activator |
| 3653 | Soluble guanylate cyclase | CHEMBL2111348 | 7329-7331 | Activator |
| 3655 | Soluble guanylate cyclase | CHEMBL2111348 | 7329-7331 | Activator |
| 3658 | Programmed cell death protein 1 | CHEMBL3307223 | 13309 | Inhibitor |
| 3659 | Histamine H2 receptor | CHEMBL1941 | 7621 | Antagonist |
| 3660 | Sodium channel protein type I alpha subunit | CHEMBL1845 | 15989 | Blocker |
| 3660 | Sodium channel protein type II alpha subunit | CHEMBL4187 | 15991 | Blocker |
| 3660 | Sodium channel protein type III alpha subunit | CHEMBL5163 | 15993 | Blocker |
| 3660 | Sodium channel protein type IV alpha subunit | CHEMBL2072 | 15995 | Blocker |
| 3660 | Sodium channel protein type IX alpha subunit | CHEMBL4296 | 15997 | Blocker |
| 3660 | Sodium channel protein type V alpha subunit | CHEMBL1980 | 15998 | Blocker |
| 3660 | Sodium channel protein type VII alpha subunit | CHEMBL3585 | 15999 | Blocker |
| 3660 | Sodium channel protein type VIII alpha subunit | CHEMBL5202 | 16000 | Blocker |
| 3660 | Sodium channel protein type X alpha subunit | CHEMBL5451 | 16001 | Blocker |
| 3660 | Sodium channel protein type XI alpha subunit | CHEMBL5167 | 16002 | Blocker |
| 3682 | Cell division cycle 7-related protein kinase | CHEMBL5443 | 2667 | Inhibitor |
| 3683 | Serine/threonine-protein kinase PLK1 | CHEMBL3024 | 12860 | Inhibitor |
| 3694 | Cannabinoid CB1 receptor | CHEMBL218 | 2270 | Agonist |
| 3694 | Cannabinoid CB2 receptor | CHEMBL253 | 2271 | Agonist |
| 3698 | Progesterone receptor | CHEMBL208 | 13299 | Agonist |
| 3699 | Adrenergic receptor | CHEMBL2331074 | 766-774 | Agonist |
| 3700 | Progesterone receptor | CHEMBL208 | 13299 | Agonist |
| 3701 | Progesterone receptor | CHEMBL208 | 13299 | Agonist |
| 3702 | Progesterone receptor | CHEMBL208 | 13299 | Agonist |
| 3704 | Progesterone receptor | CHEMBL208 | 13299 | Agonist |
| 3705 | Progesterone receptor | CHEMBL208 | 13299 | Agonist |
| 3709 | Norepinephrine transporter | CHEMBL222 | 16329 | Inhibitor |
| 3709 | Serotonin transporter | CHEMBL228 | 16331 | Inhibitor |
| 3732 | Glutamate (NMDA) receptor subunit zeta 1 | CHEMBL2015 | 6917 | Partial agonist |
| 3732 | Glutamate [NMDA] receptor subunit epsilon 1 | CHEMBL1972 | 6918 | Partial agonist |
| 3732 | Glutamate [NMDA] receptor subunit epsilon 3 | CHEMBL4109 | 6920 | Partial agonist |
| 3732 | Glutamate [NMDA] receptor subunit epsilon 4 | CHEMBL2591 | 6921 | Partial agonist |
| 3732 | Glutamate NMDA receptor; GRIN1/GRIN2B | CHEMBL1907603 | 6917, 6919 | Partial agonist |
| 3733 | Retinoic acid receptor alpha | CHEMBL2055 | 14451 | Agonist |
| 3734 | Tyrosine-protein kinase JAK2 | CHEMBL2971 | 8596 | Inhibitor |
| 3741 | Mitochondrial complex I (NADH dehydrogenase) | CHEMBL2363065 | 10429-10435, 10860-10885, 10888-10891, 10895-10905 | Inhibitor |
| 3743 | Sodium channel protein type I alpha subunit | CHEMBL1845 | 15989 | Blocker |
| 3743 | Sodium channel protein type II alpha subunit | CHEMBL4187 | 15991 | Blocker |
| 3743 | Sodium channel protein type III alpha subunit | CHEMBL5163 | 15993 | Blocker |

TABLE 3-continued

Ligand sets

| Ligand No. | Target Name | Target ChEMBL ID | Payload ID | Action type |
|---|---|---|---|---|
| 3743 | Sodium channel protein type IV alpha subunit | CHEMBL2072 | 15995 | Blocker |
| 3743 | Sodium channel protein type IX alpha subunit | CHEMBL4296 | 15997 | Blocker |
| 3743 | Sodium channel protein type V alpha subunit | CHEMBL1980 | 15998 | Blocker |
| 3743 | Sodium channel protein type VII alpha subunit | CHEMBL3585 | 15999 | Blocker |
| 3743 | Sodium channel protein type VIII alpha subunit | CHEMBL5202 | 16000 | Blocker |
| 3743 | Sodium channel protein type X alpha subunit | CHEMBL5451 | 16001 | Blocker |
| 3743 | Sodium channel protein type XI alpha subunit | CHEMBL5167 | 16002 | Blocker |
| 3766 | Bile acid receptor FXR | CHEMBL2047 | 11432 | Agonist |
| 3767 | B-lymphocyte antigen CD20 | CHEMBL2058 | 10070 | Inhibitor |
| 3768 | G protein-coupled receptor 44 | CHEMBL5071 | 13445 | Antagonist |
| 3769 | Collagen | CHEMBL2364188 | 3083-3809, 3811-3813, 3817-3819, 3820-3824, 3829, 3830, 3835, 3838, 3843, 3846, 3847 | Hydrolytic enzyme |
| 3769 | Fibronectin | CHEMBL3810 | 6261 | Proteolytic enzyme |
| 3769 | Laminin | CHEMBL2364187 | 9154-9165 | Hydrolytic enzyme |
| 3772 | Somatostatin receptor | CHEMBL2111436 | 16390-16394 | Agonist |
| 3779 | Delta opioid receptor | CHEMBL236 | 12035 | Antagonist |
| 3779 | Kappa opioid receptor | CHEMBL237 | 12036 | Antagonist |
| 3779 | Mu opioid receptor | CHEMBL233 | 12037 | Antagonist |
| 3780 | Androgen Receptor | CHEMBL1871 | 1034 | Antagonist |
| 3781 | B-lymphocyte antigen CD20 | CHEMBL2058 | 10070 | Inhibitor |
| 3784 | D2-like dopamine receptor | CHEMBL2331075 | 5041-5043 | Antagonist |
| 3784 | Serotonin 2a (5-HT2a) receptor | CHEMBL224 | 66 | Antagonist |
| 3784 | Serotonin 2c (5-HT2c) receptor | CHEMBL225 | 68 | Antagonist |
| 3785 | PARP 1, 2 and 3 | CHEMBL3390820 | 12866, 12867, 12874 | Inhibitor |
| 3786 | Calcitonin gene-related peptide type 1 receptor | CHEMBL3798 | 2102 | Antagonist |
| 3789 | Type-1 angiotensin II receptor | CHEMBL227 | 1058 | Antagonist |
| 3790 | FK506-binding protein 1A | CHEMBL1902 | 6309 | Inhibitor |
| 3791 | Beta-2 adrenergic receptor | CHEMBL210 | 773 | Agonist |
| 3794 | Histamine H1 receptor | CHEMBL231 | 7620 | Antagonist |
| 3795 | Arachidonate 5-lipoxygenase | CHEMBL215 | 1310 | Inhibitor |
| 3795 | Cyclooxygenase | CHEMBL2094253 | 13461, 13462 | Inhibitor |
| 3795 | Peroxisome proliferator-activated receptor gamma | CHEMBL235 | 12428 | Agonist |
| 3797 | Ig epsilon chain C region | CHEMBL1834 | 7931 | Inhibitor |
| 3803 | Potassium-transporting ATPase | CHEMBL2095173 | 1587, 1588 | Inhibitor |
| 3804 | PI3-kinase class I | CHEMBL3559703 | 12526-12529, 12596-12598, 12601 | Inhibitor |
| 3804 | Serine/threonine-protein kinase mTOR | CHEMBL2842 | 9934 | Inhibitor |
| 3806 | Peroxisome proliferator-activated receptor gamma | CHEMBL235 | 12428 | Agonist |
| 3807 | Progesterone receptor | CHEMBL208 | 13299 | Antagonist |
| 3808 | Serotonin 3a (5-HT3a) receptor | CHEMBL1899 | 69 | Antagonist |
| 3809 | Corticotropin releasing factor receptor 1 | CHEMBL1800 | 3994 | Antagonist |
| 3811 | Tyrosine-protein kinase BTK | CHEMBL5251 | 1989 | Inhibitor |
| 3820 | Interleukin 11 receptor alpha | CHEMBL2050 | 8416 | Agonist |
| 3821 | Fibroblast growth factor receptor | CHEMBL2095217 | 6253-6256 | Inhibitor |
| 3821 | Platelet-derived growth factor receptor | CHEMBL2095189 | 12773, 12774 | Inhibitor |
| 3821 | Vascular endothelial growth factor receptor 2 | CHEMBL279 | 9005 | Inhibitor |
| 3823 | Dopamine D2 receptor | CHEMBL217 | 5041 | Modulator |
| 3825 | Glucocorticoid receptor | CHEMBL2034 | 11442 | Antagonist |
| 3827 | Fatty acid synthase | CHEMBL4158 | 6068 | Inhibitor |
| 3827 | Gastric lipase | CHEMBL1796 | 9501 | Inhibitor |
| 3827 | Pancreatic lipase | CHEMBL1812 | 12206 | Inhibitor |
| 3829 | Glutamate [NMDA] receptor | CHEMBL2094124 | 6917-6921, 6923, 6924 | Antagonist |
| 3829 | Histamine H1 receptor | CHEMBL231 | 7620 | Antagonist |
| 3829 | Norepinephrine transporter | CHEMBL222 | 16329 | Inhibitor |
| 3829 | Sodium channel alpha subunit | CHEMBL2331043 | 15989, 15991, 15993, 15995, 15997-16001, 16002 | Blocker |

TABLE 3-continued

Ligand sets

| Ligand No. | Target Name | Target ChEMBL ID | Payload ID | Action type |
|---|---|---|---|---|
| 3831 | Neurokinin 1 receptor | CHEMBL249 | 17315 | Antagonist |
| 3834 | Serotonin 1a (5-HT1a) receptor | CHEMBL214 | 61 | Modulator |
| 3835 | Serine/threonine-protein kinase mTOR | CHEMBL2842 | 9934 | Inhibitor |
| 3837 | Vascular endothelial growth factor receptor 2 | CHEMBL279 | 9005 | Inhibitor |
| 3839 | Stem cell growth factor receptor | CHEMBL1936 | 19299 | Inhibitor |
| 3839 | Vascular endothelial growth factor receptor | CHEMBL2095227 | 6336, 6339, 9005 | Inhibitor |
| 3842 | Epidermal growth factor receptor | CHEMBL2363049 | 5466, 5520-5522 | Inhibitor |
| 3842 | Epidermal growth factor receptor erbB1 | CHEMBL203 | 5466 | Inhibitor |
| 3844 | Estrogen receptor | CHEMBL2093866 | 5551, 5552 | Modulator |
| 3846 | Cannabinoid CB1 receptor | CHEMBL218 | 2270 | Antagonist |
| 3851 | DNA | CHEMBL2311221 | | Inhibitor |
| 3855 | Androgen Receptor | CHEMBL1871 | 1034 | Agonist |
| 3856 | Cyclooxygenase | CHEMBL2094253 | 13461, 13462 | Inhibitor |
| 3857 | GABA-A receptor; anion channel | CHEMBL2093872 | 6682-6696, 6700 | Positive allosteric modulator |
| 3858 | Sodium channel alpha subunit | CHEMBL2331043 | 15989, 15991, 15993, 15995, 15997-16001, 16002 | Blocker |
| 3864 | Glutathione reductase | CHEMBL2755 | 6980 | |
| 3867 | Beta-1 adrenergic receptor | CHEMBL213 | 772 | Antagonist |
| 3867 | Beta-2 adrenergic receptor | CHEMBL210 | 773 | Antagonist |
| 3869 | GABA-B receptor | CHEMBL2111463 | 6688, 6689 | Agonist |
| 3871 | Muscarinic acetylcholine receptor M2 | CHEMBL211 | 2936 | Antagonist |
| 3871 | Muscarinic acetylcholine receptor M3 | CHEMBL245 | 2937 | Antagonist |
| 3872 | Mu opioid receptor | CHEMBL233 | 12037 | Agonist |
| 3873 | Adrenergic receptor alpha | CHEMBL2095203 | 766-771 | Agonist |
| 3874 | Androgen Receptor | CHEMBL1871 | 1034 | Agonist |
| 3875 | Opioid receptors; mu/kappa/delta | CHEMBL2095181 | 12035-12037 | Agonist |
| 3876 | Cyclooxygenase | CHEMBL2094253 | 13461, 13462 | Inhibitor |
| 3877 | Muscarinic acetylcholine receptor M1 | CHEMBL216 | 2935 | Antagonist |
| 3877 | Muscarinic acetylcholine receptor M3 | CHEMBL245 | 2937 | Antagonist |
| 3878 | Muscarinic acetylcholine receptor M1 | CHEMBL216 | 2935 | Antagonist |
| 3878 | Muscarinic acetylcholine receptor M3 | CHEMBL245 | 2937 | Antagonist |
| 3881 | Oxytocin receptor | CHEMBL2049 | 12157 | Agonist |
| 3882 | Gonadotropin-releasing hormone receptor | CHEMBL1855 | 7145 | Antagonist |
| 3887 | Amiloride-sensitive sodium channel alpha-subunit | CHEMBL1791 | 15985 | Blocker |
| 3887 | Amiloride-sensitive sodium channel subunit beta | CHEMBL1628483 | 15986 | Blocker |
| 3887 | Amiloride-sensitive sodium channel subunit gamma | CHEMBL1628484 | 15988 | Blocker |
| 3890 | PI3-kinase class I | CHEMBL3559703 | 12526-12529, 12596-12598, 12601 | Inhibitor |
| 3891 | Tubulin | CHEMBL2095182 | 18669-18675, 18679-18687 | Inhibitor |
| 3892 | Tyrosine-protein kinase JAK2 | CHEMBL2971 | 8596 | Inhibitor |
| 3892 | Tyrosine-protein kinase receptor FLT3 | CHEMBL1974 | 6337 | Inhibitor |
| 3894 | CDK6/cyclin D1 | CHEMBL2111455 | 4243, 4291 | Inhibitor |
| 3894 | Cyclin-dependent kinase 4/cyclin D1 | CHEMBL1907601 | 4287, 4243 | Inhibitor |
| 3895 | Fibroblast growth factor receptor 2 | CHEMBL4142 | 6254 | Agonist |
| 3896 | Dopamine D2 receptor | CHEMBL217 | 5041 | Antagonist |
| 3896 | Serotonin 2a (5-HT2a) receptor | CHEMBL224 | 66 | Antagonist |
| 3901 | Serine/threonine-protein kinase mTOR | CHEMBL2842 | 9934 | Inhibitor |
| 3902 | Serotonin 3a (5-HT3a) receptor | CHEMBL1899 | 69 | Antagonist |
| 3903 | Urotensin II receptor | CHEMBL3764 | 19164 | Antagonist |
| 3904 | Retinoic acid receptor gamma | CHEMBL2003 | 14453 | Agonist |
| 3905 | MAP kinase p38 alpha | CHEMBL260 | 10445 | Inhibitor |
| 3907 | Farnesyl diphosphate synthase | CHEMBL1782 | 6021 | Inhibitor |
| 3909 | Fatty acids | CHEMBL2364711 | | Hydrolytic enzyme |
| 3909 | Polypeptides | CHEMBL2364181 | | Hydrolytic enzyme |

TABLE 3-continued

Ligand sets

| Ligand No. | Target Name | Target ChEMBL ID | Payload ID | Action type |
|---|---|---|---|---|
| 3909 | Starch | CHEMBL2364180 | | Hydrolytic enzyme |
| 3910 | Muscle-type nicotinic acetylcholine receptor | CHEMBL2362997 | 2941, 2950, 2954, 2955 2956 | Antagonist |
| 3912 | Epidermal growth factor receptor erbB1 | CHEMBL203 | 5466 | Inhibitor |
| 3913 | Histone deacetylase | CHEMBL2093865 | 7713-7723 | Inhibitor |
| 3914 | Potassium-transporting ATPase | CHEMBL2095173 | 1587, 1588 | Inhibitor |
| 3920 | PI3-kinase class I | CHEMBL3559703 | 12526-12529, 12596-12598, 12601 | Inhibitor |
| 3920 | Serine/threonine-protein kinase mTOR | CHEMBL2842 | 9934 | Inhibitor |
| 3920 | Serine/threonine-protein kinase receptor R3 | CHEMBL5311 | 473 | Inhibitor |
| 3928 | Voltage-gated T-type calcium channel | CHEMBL2362995 | 2145-2147 | Blocker |
| 3930 | Glucocorticoid receptor | CHEMBL2034 | 11442 | Agonist |
| 3936 | Parathyroid hormone receptor | CHEMBL1793 | 12246 | Agonist |
| 3939 | Monoamine oxidase | CHEMBL2095205 | 10527, 10528 | Inhibitor |
| 3940 | Vitamin D receptor | CHEMBL1977 | 19293 | Agonist |
| 3943 | Serotonin transporter | CHEMBL228 | 16331 | Inhibitor |
| 3946 | Somatostatin receptor 1 | CHEMBL1917 | 16390 | Agonist |
| 3946 | Somatostatin receptor 1 | CHEMBL1917 | 16390 | Agonist |
| 3946 | Somatostatin receptor 2 | CHEMBL1804 | 16391 | Agonist |
| 3946 | Somatostatin receptor 2 | CHEMBL1804 | 16391 | Agonist |
| 3946 | Somatostatin receptor 3 | CHEMBL2028 | 16392 | Agonist |
| 3946 | Somatostatin receptor 3 | CHEMBL2028 | 16392 | Agonist |
| 3946 | Somatostatin receptor 5 | CHEMBL1792 | 16394 | Agonist |
| 3946 | Somatostatin receptor 5 | CHEMBL1792 | 16394 | Agonist |
| 3947 | Smoothened homolog | CHEMBL5971 | 15967 | Antagonist |
| 3949 | Fibroblast growth factor receptor 1 | CHEMBL3650 | 6253 | Inhibitor |
| 3949 | Fibroblast growth factor receptor 3 | CHEMBL2742 | 6255 | Inhibitor |
| 3949 | Macrophage colony stimulating factor receptor | CHEMBL1844 | 3854 | Inhibitor |
| 3949 | Platelet-derived growth factor receptor | CHEMBL2095189 | 12773, 12774 | Inhibitor |
| 3949 | Stem cell growth factor receptor | CHEMBL1936 | 19299 | Inhibitor |
| 3949 | Tyrosine-protein kinase ITK/TSK | CHEMBL2959 | 7915 | Inhibitor |
| 3949 | Tyrosine-protein kinase LCK | CHEMBL258 | 9206 | Inhibitor |
| 3949 | Vascular endothelial growth factor receptor | CHEMBL2095227 | 6336, 6339, 9005 | Inhibitor |
| 3950 | Adenosine A2a receptor | CHEMBL251 | 625 | Antagonist |
| 3951 | Adenosine A1 receptor | CHEMBL226 | 624 | Antagonist |
| 3952 | Adenosine A2a receptor | CHEMBL251 | 625 | Antagonist |
| 3952 | Phosphodiesterase 10A | CHEMBL4409 | 12546 | Inhibitor |
| 3957 | Epidermal growth factor receptor erbB1 | CHEMBL203 | 5466 | Inhibitor |
| 3957 | Fibroblast growth factor receptor 1 | CHEMBL3650 | 6253 | Inhibitor |
| 3957 | Platelet-derived growth factor receptor beta | CHEMBL1913 | 12774 | Inhibitor |
| 3957 | Tyrosine-protein kinase SRC | CHEMBL267 | 16684 | Inhibitor |
| 3958 | Dual specificity mitogen-activated protein kinase kinase 1 | CHEMBL3587 | 10458 | Inhibitor |
| 3958 | Dual specificity mitogen-activated protein kinase kinase 2 | CHEMBL2964 | 10459 | Inhibitor |
| 3962 | Vitamin D receptor | CHEMBL1977 | 19293 | Agonist |
| 3963 | Janus Kinase (JAK) | CHEMBL2363062 | 8595-8597, 18803 | Inhibitor |
| 3965 | 2'-deoxyadenosine | CHEMBL2364177 | | Hydrolytic enzyme |
| 3965 | Adenosine | CHEMBL2364178 | 624 | Hydrolytic enzyme |
| 3967 | Vascular endothelial growth factor A | CHEMBL1783 | 19239 | Antagonist |
| 3968 | Asparagine | CHEMBL2364706 | | Hydrolytic enzyme |
| 3969 | Granulocyte colony stimulating factor receptor | CHEMBL1996 | 3859 | Agonist |
| 3971 | Erythropoietin receptor | CHEMBL1817 | 5541 | Agonist |
| 3972 | Interferon alpha/beta receptor | CHEMBL2364170 | 8338, 8339 | Agonist |
| 3973 | Interferon alpha/beta receptor | CHEMBL2364170 | 8338, 8339 | Agonist |
| 3974 | Interferon alpha/beta receptor | CHEMBL2364170 | 8338, 8339 | Agonist |
| 3975 | Uric acid | CHEMBL2364183 | | Oxidative enzyme |
| 3977 | Growth hormone receptor | CHEMBL1976 | 7228 | Antagonist |
| 3979 | Epidermal growth factor receptor erbB1 | CHEMBL203 | 5466 | Inhibitor |
| 3980 | Programmed cell death protein 1 | CHEMBL3307223 | 13309 | Inhibitor |
| 3981 | Dihydrofolate reductase | CHEMBL202 | 4861 | Inhibitor |
| 3981 | GAR transformylase | CHEMBL3972 | 12688 | Inhibitor |
| 3981 | Thymidylate synthase | CHEMBL1952 | 17755 | Inhibitor |
| 3984 | Beta-1 adrenergic receptor | CHEMBL213 | 772 | Antagonist |

TABLE 3-continued

Ligand sets

| Ligand No. | Target Name | Target ChEMBL ID | Payload ID | Action type |
|---|---|---|---|---|
| 3984 | Beta-2 adrenergic receptor | CHEMBL210 | 773 | Antagonist |
| 3994 | Sigma opioid receptor | CHEMBL287 | 15742 | Modulator |
| 3996 | GABA-A receptor; anion channel | CHEMBL2093872 | 6682-6696, 6700 | Positive allosteric modulator |
| 3997 | Neuronal acetylcholine receptor; alpha3/beta4 | CHEMBL1907594 | 2944, 2953 | Antagonist |
| 4000 | Adenosine deaminase | CHEMBL1910 | 628 | Inhibitor |
| 4001 | 3',5'-cyclic phosphodiesterase | CHEMBL2363066 | 12546, 12549-12557, 12559-12571 | Inhibitor |
| 4001 | Adenosine A2b receptor | CHEMBL2094257 | 626 | Antagonist |
| 4003 | Glutamate receptor ionotropic AMPA | CHEMBL2096670 | 6905-6908 | Antagonist |
| 4005 | Dopamine receptor | CHEMBL2096905 | 5040-5044 | Agonist |
| 4007 | Angiotensin-converting enzyme | CHEMBL1808 | 1056 | Inhibitor |
| 4009 | Dopamine D2 receptor | CHEMBL217 | 5041 | Antagonist |
| 4010 | Receptor protein-tyrosine kinase erbB-2 | CHEMBL1824 | 5520 | Inhibitor |
| 4012 | Corticotropin releasing factor receptor 1 | CHEMBL1800 | 3994 | Antagonist |
| 4013 | MAP kinase p38 alpha | CHEMBL260 | 10445 | Inhibitor |
| 4013 | Tyrosine-protein kinase TIE-2 | CHEMBL4128 | 17514 | Inhibitor |
| 4014 | Vascular endothelial growth factor receptor 2 | CHEMBL279 | 9005 | Inhibitor |
| 4016 | Melanocortin receptor 4 | CHEMBL259 | 9992 | Agonist |
| 4017 | Serine/threonine-protein kinase Chk1 | CHEMBL4630 | 2825 | Inhibitor |
| 4018 | Serine/threonine-protein kinase receptor R3 | CHEMBL5311 | 473 | Inhibitor |
| 4019 | Histamine H3 receptor | CHEMBL264 | 7622 | Antagonist |
| 4020 | Histamine H3 receptor | CHEMBL264 | 7622 | Antagonist |
| 4021 | MAP kinase p38 alpha | CHEMBL260 | 10445 | Inhibitor |
| 4022 | Serine/threonine-protein kinase PAK 4 | CHEMBL4482 | 9934 | Inhibitor |
| 4023 | Serine/threonine-protein kinase Aurora-A | CHEMBL4722 | 1654 | Inhibitor |
| 4023 | Serine/threonine-protein kinase Aurora-B | CHEMBL2185 | 1657 | Inhibitor |
| 4024 | Mineralocorticoid receptor | CHEMBL1994 | 11443 | Antagonist |
| 4025 | Histamine H4 receptor | CHEMBL3759 | 7623 | Antagonist |
| 4026 | Hepatocyte growth factor receptor | CHEMBL3717 | 10107 | Inhibitor |
| 4027 | Sodium channel protein type X alpha subunit | CHEMBL5451 | 16001 | Blocker |
| 4028 | C-C chemokine receptor type 2 | CHEMBL4015 | 2861 | Antagonist |
| 4028 | C-C chemokine receptor types | CHEMBL274 | 2864 | Antagonist |
| 4029 | PI3-kinase class I | CHEMBL3559703 | 12526-12529, 12596-12598, 12601 | Inhibitor |
| 4029 | Serine/threonine-protein kinase mTOR | CHEMBL2842 | 9934 | Inhibitor |
| 4030 | Tyrosine-protein kinase JAK1 | CHEMBL2835 | 8595 | Inhibitor |
| 4031 | Progesterone receptor | CHEMBL208 | 13299 | Antagonist |
| 4032 | Sodium channel protein type IX alpha subunit | CHEMBL4296 | 15997 | Blocker |
| 4032 | Sodium channel protein type X alpha subunit | CHEMBL5451 | 16001 | Blocker |
| 4033 | Serotonin 6 (5-HT6) receptor | CHEMBL3371 | 76 | Antagonist |
| 4034 | Glucagon receptor | CHEMBL1985 | 6861 | Antagonist |
| 4035 | Focal adhesion kinase 1 | CHEMBL2695 | 13729 | Inhibitor |
| 4037 | MAP kinase p38 alpha | CHEMBL260 | 10445 | Inhibitor |
| 4039 | MAP kinase p38 alpha | CHEMBL260 | 10445 | Inhibitor |
| 4040 | Neuronal acetylcholine receptor protein alpha-7 subunit | CHEMBL2492 | 2940 | Agonist |
| 4041 | Cyclin-dependent kinase | CHEMBL3559691 | 4269, 4270, 4272-4281, 4285-4288, 4291-4294 | Inhibitor |
| 4042 | Vanilloid receptor | CHEMBL4794 | 18061 | Antagonist |
| 4043 | Sodium channel alpha subunit | CHEMBL2331043 | 15989, 15991, 15993, 15995, 15997-16001, 16002 | Blocker |
| 4045 | Sodium channel alpha subunit | CHEMBL2331043 | 15989, 15991, 15993, 15995, 15997-16001, 16002 | Blocker |
| 4047 | Dopamine transporter | CHEMBL238 | 16330 | Inhibitor |
| 4047 | Norepinephrine transporter | CHEMBL222 | 16329 | Inhibitor |
| 4048 | Monoamine oxidase | CHEMBL2095205 | 10527, 10528 | Inhibitor |
| 4051 | Vitamin k epoxide reductase complex subunit 1 isoform 1 | CHEMBL1930 | 19294 | Inhibitor |

TABLE 3-continued

Ligand sets

| Ligand No. | Target Name | Target ChEMBL ID | Payload ID | Action type |
|---|---|---|---|---|
| 4052 | Histamine H1 receptor | CHEMBL231 | 7620 | Antagonist |
| 4053 | Dopamine transporter | CHEMBL238 | 16330 | Inhibitor |
| 4053 | Norepinephrine transporter | CHEMBL222 | 16329 | Inhibitor |
| 4058 | Adrenergic receptor alpha | CHEMBL2095203 | 766-771 | Antagonist |
| 4060 | Vitamin k epoxide reductase complex subunit 1 isoform 1 | CHEMBL1930 | 19294 | Inhibitor |
| 4062 | Voltage-gated T-type calcium channel | CHEMBL2362995 | 2145-2147 | Blocker |
| 4063 | Norepinephrine transporter | CHEMBL222 | 16329 | Releasing agent |
| 4064 | Adrenergic receptor alpha | CHEMBL2095203 | 766-771 | Antagonist |
| 4079 | Glutamine | CHEMBL2366039 | | Sequestering agent |
| 4080 | Cyclooxygenase | CHEMBL2094253 | 13461, 13462 | Inhibitor |
| 4081 | Adrenergic receptor alpha-1 | CHEMBL2094251 | 766-768 | Agonist |
| 4085 | Alpha-1a adrenergic receptor | CHEMBL229 | 766 | Agonist |
| 4085 | Norepinephrine transporter | CHEMBL222 | 16329 | Releasing agent |
| 4087 | Sodium channel alpha subunit | CHEMBL2331043 | 15989, 15991, 15993, 15995, 15997-16001, 16002 | Blocker |
| 4128 | Serotonin 1a (5-HT1a) receptor | CHEMBL214 | 61 | Agonist |
| 4129 | Insulin-like growth factor I receptor | CHEMBL1957 | 8256 | Inhibitor |
| 4131 | PI3-kinase class I | CHEMBL3559703 | 12526-12529, 12596-12598, 12601 | Inhibitor |
| 4132 | PI3-kinase class I | CHEMBL3559703 | 12526-12529, 12596-12598, 12601 | Inhibitor |
| 4133 | Muscarinic acetylcholine receptor M1 | CHEMBL216 | 2935 | Agonist |
| 4133 | Muscarinic acetylcholine receptor M3 | CHEMBL245 | 2937 | Agonist |
| 4135 | Dual specificity mitogen-activated protein kinase kinase 1 | CHEMBL3587 | 10458 | Inhibitor |
| 4135 | Dual specificity mitogen-activated protein kinase kinase 2 | CHEMBL2964 | 10459 | Inhibitor |
| 4136 | Serotonin 2a (5-HT2a) receptor | CHEMBL224 | 66 | Inverse agonist |
| 4137 | FK506-binding protein 1A | CHEMBL1902 | 6309 | Inhibitor |
| 4139 | Dopamine receptor | CHEMBL2096905 | 5040-5044 | Antagonist |
| 4139 | Serotonin 2a (5-HT2a) receptor | CHEMBL224 | 66 | Antagonist |
| 4140 | Sulfonylurea receptor 2, Kir6.2 | CHEMBL2095198 | 1629, 13056 | Opener |
| 4142 | Beta-1 adrenergic receptor | CHEMBL213 | 772 | Partial agonist |
| 4142 | Beta-2 adrenergic receptor | CHEMBL210 | 773 | Partial agonist |
| 4143 | Peroxisome proliferator-activated receptor gamma | CHEMBL235 | 12428 | Agonist |
| 4144 | Muscle-type nicotinic acetylcholine receptor | CHEMBL2362997 | 2941, 2950, 2954, 2955 2956 | Antagonist |
| 4152 | DNA | CHEMBL2311221 | | Inhibitor |
| 4154 | Beta-2 adrenergic receptor | CHEMBL210 | 773 | Agonist |
| 4158 | Cyclooxygenase | CHEMBL2094253 | 13461, 13462 | Inhibitor |
| 4159 | HMG-CoA reductase | CHEMBL402 | 26 | Inhibitor |
| 4162 | Epidermal growth factor receptor erbB1 | CHEMBL203 | 5466 | Inhibitor |
| 4163 | PI3-kinase p110-alpha subunit | CHEMBL4005 | 12526 | Inhibitor |
| 4163 | Serine/threonine-protein kinase mTOR | CHEMBL2842 | 9934 | Inhibitor |
| 4164 | Insulin-like growth factor I receptor | CHEMBL1957 | 8256 | Inhibitor |
| 4169 | C—X—C chemokine receptor type 4 | CHEMBL2107 | 2889 | Partial agonist |
| 4170 | DNA | CHEMBL2311221 | | Inhibitor |
| 4171 | Macrophage colony stimulating factor receptor | CHEMBL1844 | 3854 | Inhibitor |
| 4171 | Stem cell growth factor receptor | CHEMBL1936 | 19299 | Inhibitor |
| 4171 | Tyrosine-protein kinase receptor FLT3 | CHEMBL1974 | 6337 | Inhibitor |
| 4173 | Macrophage colony stimulating factor receptor | CHEMBL1844 | 3854 | Inhibitor |
| 4174 | Macrophage colony stimulating factor receptor | CHEMBL1844 | 3854 | Inhibitor |
| 4174 | Nerve growth factor receptor Trk-A | CHEMBL2815 | 11145 | Inhibitor |
| 4174 | Neurotrophic tyrosine kinase receptor type 2 | CHEMBL4898 | 11146 | Inhibitor |
| 4174 | NT-3 growth factor receptor | CHEMBL5608 | 11147 | Inhibitor |
| 4175 | Serine/threonine-protein kinase B-raf | CHEMBL5145 | 1924 | Inhibitor |
| 4181 | C—X—C chemokine receptor type 4 | CHEMBL2107 | 2889 | Antagonist |
| 4183 | Estrogen receptor alpha | CHEMBL206 | 5551 | Agonist |

TABLE 3-continued

Ligand sets

| Ligand No. | Target Name | Target ChEMBL ID | Payload ID | Action type |
|---|---|---|---|---|
| 4185 | Thiazide-sensitive sodium-chloride cotransporter | CHEMBL1876 | 16025 | Inhibitor |
| 4186 | Metabotropic glutamate receptor 2 | CHEMBL5137 | 6926 | Agonist |
| 4186 | Metabotropic glutamate receptor 3 | CHEMBL2888 | 6927 | Agonist |
| 4188 | Bcr/Abl fusion protein | CHEMBL2096618 | 149, 1949 | Inhibitor |
| 4188 | Breakpoint cluster region protein | CHEMBL5146 | 1949 | Inhibitor |
| 4188 | Tyrosine-protein kinase ABL | CHEMBL1862 | 149 | Inhibitor |
| 4191 | DNA | CHEMBL2311221 | | Inhibitor |
| 4199 | Neuronal acetylcholine receptor; alpha4/beta2 | CHEMBL1907589 | 2945, 2951 | Partial agonist |
| 4199 | Neuronal acetylcholine receptor; alpha6/beta2 | CHEMBL2109237 | 2947, 2951 | Partial agonist |
| 4200 | Epidermal growth factor receptor | CHEMBL2363049 | 5466, 5520-5522 | Inhibitor |
| 4204 | Dihydrofolate reductase | CHEMBL202 | 4861 | Inhibitor |
| 4205 | Acetylcholinesterase | CHEMBL220 | 380 | Activator |
| 4207 | D2-like dopamine receptor | CHEMBL2331075 | 5041-5043 | Agonist |
| 4209 | Amylin receptor AMY1, CALCR/RAMP1 | CHEMBL2111189 | 2101, 14266 | Agonist |
| 4209 | Amylin receptor AMY2; CALCR/RAMP2 | CHEMBL2364173 | 2101, 14267 | Agonist |
| 4209 | Amylin receptor AMY3; CALCR/RAMP3 | CHEMBL2111190 | 2101, 14268 | Agonist |
| 4212 | Purinergic receptor P2Y12 | CHEMBL2001 | 13908 | Antagonist |
| 4213 | Solute carrier family 22 member 12 | CHEMBL6120 | 16093 | Inhibitor |
| 4213 | Solute carrier family 22 member 6 | CHEMBL1641347 | 16088 | Inhibitor |
| 4213 | Solute carrier family 22 member 8 | CHEMBL1641348 | 16090 | Inhibitor |
| 4213 | Type-1 angiotensin II receptor | CHEMBL227 | 1058 | Antagonist |
| 4214 | HMG-CoA reductase | CHEMBL402 | 26 | Inhibitor |
| 4215 | GABA-A receptor; anion channel | CHEMBL2093872 | 6682-6696, 6700 | Positive allosteric modulator |
| 4217 | Adrenergic receptor alpha-1 | CHEMBL2094251 | 766-768 | Antagonist |
| 4218 | Glucocorticoid receptor | CHEMBL2034 | 11442 | Agonist |
| 4219 | Glucocorticoid receptor | CHEMBL2034 | 11442 | Agonist |
| 4220 | Glucocorticoid receptor | CHEMBL2034 | 11442 | Agonist |
| 4221 | Glucocorticoid receptor | CHEMBL2034 | 11442 | Agonist |
| 4222 | Glucocorticoid receptor | CHEMBL2034 | 11442 | Agonist |
| 4223 | Glucocorticoid receptor | CHEMBL2034 | 11442 | Agonist |
| 4224 | Voltage-gated calcium channel | CHEMBL2363032 | 2121-2128, 2130-2147 | Modulator |
| 4226 | Adenosine A2a receptor | CHEMBL251 | 625 | Antagonist |
| 4230 | Dopamine D2 receptor | CHEMBL217 | 5041 | Modulator |
| 4231 | Sodium channel alpha subunit | CHEMBL2331043 | 15989, 15991, 15993, 15995, 15997-16001, 16002 | Blocker |
| 4233 | GABA-A receptor; anion channel | CHEMBL2093872 | 6682-6696, 6700 | Positive allosteric modulator |
| 4233 | Sodium channel alpha subunit | CHEMBL2331043 | 15989, 15991, 15993, 15995, 15997-16001, 16002 | Blocker |
| 4234 | Estrogen receptor beta | CHEMBL242 | 5552 | Agonist |
| 4237 | Solute carrier family 22 member 11 | CHEMBL2073677 | 16092 | Inhibitor |
| 4237 | Solute carrier family 22 member 6 | CHEMBL1641347 | 16088 | Inhibitor |
| 4237 | Solute carrier family 22 member 8 | CHEMBL1641348 | 16090 | Inhibitor |
| 4238 | ATP-binding cassette sub-family A member 1 | CHEMBL2362986 | 1598 | Inhibitor |
| 4239 | Sodium channel alpha subunit | CHEMBL2331043 | 15989, 15991, 15993, 15995, 15997-16001, 16002 | Blocker |
| 4240 | Sodium channel alpha subunit | CHEMBL2331043 | 15989, 15991, 15993, 15995, 15997-16001, 16002 | Blocker |
| 4242 | DNA | CHEMBL2311221 | | Inhibitor |
| 4244 | Dopamine D2 receptor | CHEMBL217 | 5041 | Antagonist |
| 4245 | Muscarinic acetylcholine receptor M1 | CHEMBL216 | 2935 | Antagonist |
| 4249 | Progesterone receptor | CHEMBL208 | 13299 | Agonist |
| 4253 | D2-like dopamine receptor | CHEMBL2331075 | 5041-5043 | Antagonist |
| 4253 | Serotonin 2a (5-HT2a) receptor | CHEMBL224 | 66 | Antagonist |
| 4254 | Histamine H1 receptor | CHEMBL231 | 7620 | Antagonist |
| 4255 | Beta-1 adrenergic receptor | CHEMBL213 | 772 | Antagonist |
| 4255 | Beta-2 adrenergic receptor | CHEMBL210 | 773 | Antagonist |
| 4255 | Sodium channel alpha subunit | CHEMBL2331043 | 15989, 15991, 15993, 15995, 15997-16001, 16002 | Blocker |

TABLE 3-continued

Ligand sets

| Ligand No. | Target Name | Target ChEMBL ID | Payload ID | Action type |
|---|---|---|---|---|
| 4257 | Muscarinic acetylcholine receptor M1 | CHEMBL216 | 2935 | Antagonist |
| 4257 | Muscarinic acetylcholine receptor M2 | CHEMBL211 | 2936 | Antagonist |
| 4257 | Muscarinic acetylcholine receptor M3 | CHEMBL245 | 2937 | Antagonist |
| 4258 | Sodium channel alpha subunit | CHEMBL2331043 | 15989, 15991, 15993, 15995, 15997-16001, 16002 | Blocker |
| 4261 | Histamine H1 receptor | CHEMBL231 | 7620 | Antagonist |
| 4263 | GABA-A receptor; anion channel | CHEMBL2093872 | 6682-6696, 6700 | Positive allosteric modulator |
| 4264 | Sodium channel alpha subunit | CHEMBL2331043 | 15989, 15991, 15993, 15995, 15997-16001, 16002 | Blocker |
| 4265 | Mu opioid receptor | CHEMBL233 | 12037 | Agonist |
| 4266 | Beta-1 adrenergic receptor | CHEMBL213 | 772 | Antagonist |
| 4266 | Beta-2 adrenergic receptor | CHEMBL210 | 773 | Antagonist |
| 4269 | Thyroid peroxidase | CHEMBL1839 | 17781 | Inhibitor |
| 4269 | Type I iodothyronine deiodinase (Type-I 5'-deiodinase) (DIOI) (Type 1 DI) (5DI) | CHEMBL2019 | 4720 | Inhibitor |
| 4271 | Heparin | CHEMBL2364712 | | Inhibitor |
| 4272 | Polypeptides | CHEMBL2364181 | | Hydrolytic enzyme |
| 4273 | Thyrotropin-releasing hormone receptor | CHEMBL1810 | 17787 | Agonist |
| 4274 | Beta-2 adrenergic receptor | CHEMBL210 | 773 | Agonist |
| 4278 | Norepinephrine transporter | CHEMBL222 | 16329 | Inhibitor |
| 4278 | Serotonin transporter | CHEMBL228 | 16331 | Inhibitor |
| 4279 | Cannabinoid CB2 receptor | CHEMBL253 | 2271 | Agonist |
| 4280 | Tyrosine-protein kinase SYK | CHEMBL2599 | 16634 | Inhibitor |
| 4283 | Serotonin 2a (5-HT2a) receptor | CHEMBL224 | 66 | Antagonist |
| 4285 | MAP kinase p38 alpha | CHEMBL260 | 10445 | Inhibitor |
| 4286 | MAP kinase p38 alpha | CHEMBL260 | 10445 | |
| 4287 | Norepinephrine transporter | CHEMBL222 | 16329 | Releasing agent |
| 4294 | Epidermal growth factor receptor erbB1 | CHEMBL203 | 5466 | Inhibitor |
| 4294 | PI3-kinase class I | CHEMBL3559703 | 12526-12529, 12596-12598, 12601 | Inhibitor |
| 4294 | Platelet-derived growth factor receptor beta | CHEMBL1913 | 12774 | Inhibitor |
| 4294 | Vascular endothelial growth factor receptor 2 | CHEMBL279 | 9005 | Inhibitor |
| 4302 | PI3-kinase p110-alpha subunit | CHEMBL4005 | 12526 | Inhibitor |
| 4302 | Serine/threonine-protein kinase mTOR | CHEMBL2842 | 9934 | Inhibitor |
| 4303 | PI3-kinase class I | CHEMBL3559703 | 12526-12529, 12596-12598, 12601 | Inhibitor |
| 4303 | Serine/threonine-protein kinase mTOR | CHEMBL2842 | 9934 | Inhibitor |
| 4304 | Bile acid receptor FXR | CHEMBL2047 | 11432 | Agonist |
| 4310 | Acetylcholinesterase | CHEMBL220 | 380 | Inhibitor |
| 4320 | Histamine H1 receptor | CHEMBL231 | 7620 | Antagonist |
| 4330 | Epidermal growth factor receptor erbB1 | CHEMBL203 | 5466 | Inhibitor |
| 4330 | Receptor protein-tyrosine kinase erbB-2 | CHEMBL1824 | 5520 | Inhibitor |
| 4336 | Adenosine A2b receptor | CHEMBL255 | 626 | Antagonist |
| 4336 | Adenosine A3 receptor | CHEMBL256 | 627 | Antagonist |
| 4337 | G protein-coupled receptor 44 | CHEMBL5071 | 13445 | Antagonist |
| 4338 | Cystic fibrosis transmembrane conductance regulator | CHEMBL4051 | 4367 | Activator |
| 4340 | GABA-A receptor; anion channel | CHEMBL2093872 | 6682-6696, 6700 | Positive allosteric modulator |
| 4342 | Dopamine D2 receptor | CHEMBL217 | 5041 | Antagonist |
| 4342 | Serotonin 2a (5-HT2a) receptor | CHEMBL224 | 66 | Antagonist |
| 4342 | Serotonin 2c (5-HT2c) receptor | CHEMBL225 | 68 | Antagonist |
| 4345 | Angiotensin-converting enzyme | CHEMBL1808 | 1056 | Inhibitor |
| 4346 | Estrogen receptor | CHEMBL2093866 | 5551, 5552 | Agonist |
| 4347 | Thiazide-sensitive sodium-chloride cotransporter | CHEMBL1876 | 16025 | Inhibitor |
| 4348 | Sodium channel alpha subunit | CHEMBL2331043 | 15989, 15991, 15993, 15995, 15997-16001, 16002 | Blocker |

TABLE 3-continued

Ligand sets

| Ligand No. | Target Name | Target ChEMBL ID | Payload ID | Action type |
|---|---|---|---|---|
| 4350 | Sodium channel alpha subunit | CHEMBL2331043 | 15989, 15991, 15993, 15995, 15997-16001, 16002 | Blocker |
| 4356 | Macrophage colony stimulating factor receptor | CHEMBL1844 | 3854 | Inhibitor |
| 4356 | Platelet-derived growth factor receptor | CHEMBL2095189 | 12773, 12774 | Inhibitor |
| 4356 | Stem cell growth factor receptor | CHEMBL1936 | 19299 | Inhibitor |
| 4356 | Tyrosine-protein kinase receptor FLT3 | CHEMBL1974 | 6337 | Inhibitor |
| 4356 | Tyrosine-protein kinase receptor RET | CHEMBL2041 | 14404 | Inhibitor |
| 4359 | Tyrosine-protein kinase SYK | CHEMBL2599 | 16634 | Inhibitor |
| 4362 | MAP kinase p38 alpha | CHEMBL260 | 10445 | Inhibitor |
| 4363 | Fibroblast growth factor receptor 1 | CHEMBL3650 | 6253 | |
| 4363 | Fibroblast growth factor receptor 2 | CHEMBL4142 | 6254 | |
| 4363 | Platelet-derived growth factor receptor beta | CHEMBL1913 | 12774 | Inhibitor |
| 4363 | Tyrosine-protein kinase receptor FLT3 | CHEMBL1974 | 6337 | |
| 4363 | Vascular endothelial growth factor receptor | CHEMBL2095227 | 6336, 6339, 9005 | |
| 4366 | Tyrosine-protein kinase JAK3 | CHEMBL2148 | 8597 | Inhibitor |
| 4366 | Tyrosine-protein kinase SYK | CHEMBL2599 | 16634 | Inhibitor |
| 4367 | Tyrosine-protein kinase SYK | CHEMBL2599 | 16634 | Inhibitor |
| 4368 | Tyrosine-protein kinase JAK3 | CHEMBL2148 | 8597 | Inhibitor |
| 4368 | Tyrosine-protein kinase SYK | CHEMBL2599 | 16634 | Inhibitor |
| 4371 | Tyrosine-protein kinase receptor UFO | CHEMBL4895 | 1685 | Inhibitor |
| 4373 | Cyclin-dependent kinase 1 | CHEMBL308 | 4269 | |
| 4373 | Cyclin-dependent kinase 2 | CHEMBL301 | 4281 | |
| 4373 | Cyclin-dependent kinase 4 | CHEMBL331 | 4287 | |
| 4376 | Potassium-transporting ATPase | CHEMBL2095173 | 1587, 1588 | Inhibitor |
| 4377 | Serine/threonine-protein kinase Chk1 | CHEMBL4630 | 2825 | Inhibitor |
| 4378 | Estrogen receptor alpha | CHEMBL206 | 5551 | Degrader |
| 4380 | Glutamate NMDA receptor; GRIN1/GRIN2B | CHEMBL1907603 | 6917, 6919 | Antagonist |
| 4382 | Beta-3 adrenergic receptor | CHEMBL246 | 774 | Agonist |
| 4383 | Monoamine oxidase B | CHEMBL2039 | 10528 | Inhibitor |
| 4383 | Sodium channel protein type I alpha subunit | CHEMBL1845 | 15989 | Blocker |
| 4383 | Sodium channel protein type II alpha subunit | CHEMBL4187 | 15991 | Blocker |
| 4383 | Sodium channel protein type III alpha subunit | CHEMBL5163 | 15993 | Blocker |
| 4383 | Sodium channel protein type IV alpha subunit | CHEMBL2072 | 15995 | Blocker |
| 4383 | Sodium channel protein type IX alpha subunit | CHEMBL4296 | 15997 | Blocker |
| 4383 | Sodium channel protein type V alpha subunit | CHEMBL1980 | 15998 | Blocker |
| 4383 | Sodium channel protein type VII alpha subunit | CHEMBL3585 | 15999 | Blocker |
| 4383 | Sodium channel protein type VIII alpha subunit | CHEMBL5202 | 16000 | Blocker |
| 4383 | Sodium channel protein type X alpha subunit | CHEMBL5451 | 16001 | Blocker |
| 4383 | Sodium channel protein type XI alpha subunit | CHEMBL5167 | 16002 | Blocker |
| 4383 | Voltage-gated N-type calcium channel alpha-1B subunit | CHEMBL4478 | 2142 | Blocker |
| 4384 | MAP kinase p38 alpha | CHEMBL260 | 10445 | Inhibitor |
| 4385 | Prostanoid IP receptor | CHEMBL1995 | 13457 | Agonist |
| 4386 | Estrogen receptor beta | CHEMBL242 | 5552 | Modulator |
| 4390 | Melatonin receptor | CHEMBL2094268 | 10037, 10038 | Agonist |
| 4391 | Angiotensin-converting enzyme | CHEMBL1808 | 1056 | Inhibitor |
| 4392 | Vascular endothelial growth factor receptor 2 | CHEMBL279 | 9005 | Inhibitor |
| 4393 | Vascular endothelial growth factor A | CHEMBL1783 | 19239 | Inhibitor |
| 4394 | Histamine H2 receptor | CHEMBL1941 | 7621 | Antagonist |
| 4395 | Sodium channel protein type IV alpha subunit | CHEMBL2072 | 15995 | Blocker |
| 4395 | Sodium channel protein type V alpha subunit | CHEMBL1980 | 15998 | Blocker |

TABLE 3-continued

Ligand sets

| Ligand No. | Target Name | Target ChEMBL ID | Payload ID | Action type |
|---|---|---|---|---|
| 4396 | Muscle-type nicotinic acetylcholine receptor | CHEMBL2362997 | 2941, 2950, 2954, 2955 2956 | Antagonist |
| 4397 | Glutamate (NMDA) receptor subunit zeta 1 | CHEMBL2015 | 6917 | Partial agonist |
| 4397 | Glutamate [NMDA] receptor subunit epsilon 1 | CHEMBL1972 | 6918 | Partial agonist |
| 4397 | Glutamate [NMDA] receptor subunit epsilon 3 | CHEMBL4109 | 6920 | Partial agonist |
| 4397 | Glutamate [NMDA] receptor subunit epsilon 4 | CHEMBL2591 | 6921 | Partial agonist |
| 4397 | Glutamate NMDA receptor; GRIN1/GRIN2B | CHEMBL1907603 | 6917, 6919 | Partial agonist |
| 4398 | Monoamine oxidase B | CHEMBL2039 | 10528 | Inhibitor |
| 4399 | Uric acid | CHEMBL2364183 |  | Oxidative enzyme |
| 4400 | Metabotropic glutamate receptor 5 | CHEMBL3227 | 6929 | Modulator |
| 4401 | Adrenergic receptor alpha | CHEMBL2095203 | 766-771 | Antagonist |
| 4402 | Sodium channel protein type IX alpha subunit | CHEMBL4296 | 15997 | Blocker |
| 4407 | Tyrosine-protein kinase ABL | CHEMBL1862 | 149 | Inhibitor |
| 4409 | PI3-kinase class I | CHEMBL3559703 | 12526-12529, 12596-12598, 12601 | Inhibitor |
| 4412 | Dual specificity mitogen-activated protein kinase kinase 1 | CHEMBL3587 | 10458 | Inhibitor |
| 4412 | Dual specificity mitogen-activated protein kinase kinase 2 | CHEMBL2964 | 10459 | Inhibitor |
| 4413 | Adenosine A2a receptor | CHEMBL251 | 625 | Agonist |
| 4415 | Discoidin domain-containing receptor 2 | CHEMBL5122 | 4906 | Inhibitor |
| 4415 | Fibroblast growth factor receptor 1 | CHEMBL3650 | 6253 | Inhibitor |
| 4415 | Fibroblast growth factor receptor 2 | CHEMBL4142 | 6254 | Inhibitor |
| 4415 | MAP kinase p38 beta | CHEMBL3961 | 10442 | Inhibitor |
| 4415 | Platelet-derived growth factor receptor | CHEMBL2095189 | 12773, 12774 | Inhibitor |
| 4415 | Serine/threonine-protein kinase B-raf | CHEMBL5145 | 1924 | Inhibitor |
| 4415 | Serine/threonine-protein kinase RAF | CHEMBL1906 | 14116 | Inhibitor |
| 4415 | Stem cell growth factor receptor | CHEMBL1936 | 19299 | Inhibitor |
| 4415 | Tyrosine-protein kinase ABL | CHEMBL1862 | 149 | Inhibitor |
| 4415 | Tyrosine-protein kinase FRK | CHEMBL4223 | 6515 | Inhibitor |
| 4415 | Tyrosine-protein kinase receptor RET | CHEMBL2041 | 14404 | Inhibitor |
| 4415 | Tyrosine-protein kinase TIE-2 | CHEMBL4128 | 17514 | Inhibitor |
| 4415 | Vascular endothelial growth factor receptor | CHEMBL2095227 | 6336, 6339, 9005 | Inhibitor |
| 4416 | Purinergic receptor P2Y12 | CHEMBL2001 | 13908 | Antagonist |
| 4420 | Oxytocin receptor | CHEMBL2049 | 12157 | Antagonist |
| 4420 | Vasopressin V1a receptor | CHEMBL1889 | 1343 | Antagonist |
| 4421 | Gonadotropin-releasing hormone receptor | CHEMBL1855 | 7145 | Antagonist |
| 4422 | Mu opioid receptor | CHEMBL233 | 12037 | Agonist |
| 4424 | Neurotensin receptor 1 | CHEMBL4123 | 11142 | Antagonist |
| 4428 | Sulfonylurea receptor 1, Kir6.2 | CHEMBL2096972 | 1628, 13056 | Blocker |
| 4429 | Interleukin-8 receptor A | CHEMBL4029 | 2886 | Modulator |
| 4429 | Interleukin-8 receptor B | CHEMBL2434 | 2887 | Modulator |
| 4430 | Synaptic vesicular amine transporter | CHEMBL1893 | 16067 | Inhibitor |
| 4431 | Synaptic vesicular amine transporter | CHEMBL1893 | 16067 | Inhibitor |
| 4434 | Plasminogen | CHEMBL1801 | 12750 | Activator |
| 4435 | Oxytocin receptor | CHEMBL2049 | 12157 | Antagonist |
| 4437 | Serotonin 4 (5-HT4) receptor | CHEMBL1875 | 74 | Agonist |
| 4438 | Insulin-like growth factor I receptor | CHEMBL1957 | 8256 |  |
| 4439 | Fibroblast growth factor receptor 1 | CHEMBL3650 | 6253 | Inhibitor |
| 4439 | Fibroblast growth factor receptor 2 | CHEMBL4142 | 6254 | Inhibitor |
| 4439 | Platelet-derived growth factor receptor beta | CHEMBL1913 | 12774 | Inhibitor |
| 4439 | Serine/threonine-protein kinase Aurora-A | CHEMBL4722 | 1654 | Inhibitor |
| 4439 | Serine/threonine-protein kinase PLK4 | CHEMBL3788 | 12863 | Inhibitor |
| 4439 | Tyrosine-protein kinase receptor FLT3 | CHEMBL1974 | 6337 | Inhibitor |
| 4439 | Vascular endothelial growth factor receptor | CHEMBL2095227 | 6336, 6339, 9005 | Inhibitor |

TABLE 3-continued

Ligand sets

| Ligand No. | Target Name | Target ChEMBL ID | Payload ID | Action type |
|---|---|---|---|---|
| 4440 | GABA receptor alpha-5 subunit | CHEMBL5112 | 6686 | Negative allosteric modulator |
| 4441 | Neuronal acetylcholine receptor protein alpha-7 subunit | CHEMBL2492 | 2940 | Partial agonist |
| 4442 | Cyclin-dependent kinase 1 | CHEMBL308 | 4269 | Inhibitor |
| 4442 | Cyclin-dependent kinase 2 | CHEMBL301 | 4281 | Inhibitor |
| 4442 | Cyclin-dependent kinase 4 | CHEMBL331 | 4287 | Inhibitor |
| 4443 | Dual specificity mitogen-activated protein kinase kinase; MEK1/2 | CHEMBL2111289 | 10458, 10459 | Inhibitor |
| 4444 | G protein-coupled receptor 44 | CHEMBL5071 | 13445 | Antagonist |
| 4445 | Serine/threonine-protein kinase B-raf | CHEMBL5145 | 1924 | Inhibitor |
| 4446 | Dual specificity mitogen-activated protein kinase kinase 1 | CHEMBL3587 | 10458 | Inhibitor |
| 4446 | Dual specificity mitogen-activated protein kinase kinase 2 | CHEMBL2964 | 10459 | Inhibitor |
| 4447 | Vasopressin V1a receptor | CHEMBL1889 | 1343 | Antagonist |
| 4448 | Metabotropic glutamate receptor 5 | CHEMBL3227 | 6929 | Modulator |
| 4449 | Serine/threonine-protein kinase RAF | CHEMBL1906 | 14116 | Inhibitor |
| 4450 | Dual specificity mitogen-activated protein kinase kinase 1 | CHEMBL3587 | 10458 | Inhibitor |
| 4451 | Serine/threonine-protein kinase Chk1 | CHEMBL4630 | 2825 | Inhibitor |
| 4452 | Serine/threonine-protein kinase mTOR | CHEMBL2842 | 9934 | Inhibitor |
| 4453 | PI3-kinase class I | CHEMBL3559703 | 12526-12529, 12596-12598, 12601 | Inhibitor |
| 4454 | Serine/threonine-protein kinase Chk1 | CHEMBL4630 | 2825 | Inhibitor |
| 4455 | Cyclin-dependent kinase 1 | CHEMBL308 | 4269 | Inhibitor |
| 4455 | Cyclin-dependent kinase 2 | CHEMBL301 | 4281 | Inhibitor |
| 4455 | Cyclin-dependent kinase 4 | CHEMBL331 | 4287 | Inhibitor |
| 4455 | Cyclin-dependent kinase 5 | CHEMBL4036 | 4288 | Inhibitor |
| 4455 | Cyclin-dependent kinase 7 | CHEMBL3055 | 4292 | Inhibitor |
| 4455 | Cyclin-dependent kinase 9 | CHEMBL3116 | 4294 | Inhibitor |
| 4460 | Inosine-5'-monophosphate dehydrogenase 1 | CHEMBL1822 | 8156 | Inhibitor |
| 4462 | Cyclin-dependent kinase 4 | CHEMBL331 | 4287 | Inhibitor |
| 4462 | Cyclin-dependent kinase 6 | CHEMBL2508 | 4291 | Inhibitor |
| 4477 | Proteinase-activated receptor 1 | CHEMBL3974 | 3584 | Inhibitor |
| 4478 | Interleukin-1 beta | CHEMBL1909490 | 8411 | Inhibitor |
| 4480 | Sodium channel alpha subunit | CHEMBL2331043 | 15989, 15991, 15993, 15995, 15997-16001, 16002 | Blocker |
| 4482 | Calcitonin gene-related peptide type 1 receptor | CHEMBL3798 | 2102 | Antagonist |
| 4483 | Glucocorticoid receptor | CHEMBL2034 | 11442 | Agonist |
| 4485 | Soluble guanylate cyclase | CHEMBL2111348 | 7329-7331 | Positive allosteric modulator |
| 4487 | Farnesyl diphosphate synthase | CHEMBL1782 | 6021 | Inhibitor |
| 4488 | Dopamine D2 receptor | CHEMBL217 | 5041 | Antagonist |
| 4488 | Serotonin 2a (5-HT2a) receptor | CHEMBL224 | 66 | Antagonist |
| 4488 | Serotonin 2c (5-HT2c) receptor | CHEMBL225 | 68 | Antagonist |
| 4489 | Beta-3 adrenergic receptor | CHEMBL246 | 774 | Agonist |
| 4490 | Beta-2 adrenergic receptor | CHEMBL210 | 773 | Agonist |
| 4492 | B-lymphocyte antigen CD20 | CHEMBL2058 | 10070 | Inhibitor |
| 4494 | Coagulation factor X | CHEMBL244 | 3596 | Inhibitor |
| 4495 | Cholinesterases; ACHE & BCHE | CHEMBL2095233 | 380, 2027 | Inhibitor |
| 4496 | Prostanoid EP4 receptor | CHEMBL1836 | 13450 | Agonist |
| 4497 | Cyclin-dependent kinase 1 | CHEMBL308 | 4269 | Inhibitor |
| 4497 | Cyclin-dependent kinase 4 | CHEMBL331 | 4287 | Inhibitor |
| 4497 | Cyclin-dependent kinase 9 | CHEMBL3116 | 4294 | Inhibitor |
| 4498 | Peroxisome proliferator-activated receptor gamma | CHEMBL235 | 12428 | Agonist |
| 4499 | Serotonin 1b (5-HT1b) receptor | CHEMBL1898 | 62 | Agonist |
| 4499 | Serotonin 1d (5-HT1d) receptor | CHEMBL1983 | 63 | Agonist |
| 4500 | MAP kinase p38 alpha | CHEMBL260 | 10445 | Inhibitor |
| 4501 | Dual specificity mitogen-activated protein kinase kinase 1 | CHEMBL3587 | 10458 | Inhibitor |
| 4501 | Dual specificity mitogen-activated protein kinase kinase 2 | CHEMBL2964 | 10459 | Inhibitor |
| 4502 | Serotonin 1a (5-HT1a) receptor | CHEMBL214 | 61 | Antagonist |
| 4503 | Epidermal growth factor receptor erbB1 | CHEMBL203 | 5466 | Inhibitor |

TABLE 3-continued

Ligand sets

| Ligand No. | Target Name | Target ChEMBL ID | Payload ID | Action type |
|---|---|---|---|---|
| 4504 | Muscle-type nicotinic acetylcholine receptor | CHEMBL2362997 | 2941, 2950, 2954, 2955 2956 | Antagonist |
| 4505 | Cyclooxygenase-2 | CHEMBL230 | 13462 | Inhibitor |
| 4506 | Phosphodiesterase 4 | CHEMBL2093863 | 12555-12557, 12559 | Inhibitor |
| 4507 | Neurokinin 1 receptor | CHEMBL249 | 17315 | Antagonist |
| 4510 | Adenosine A1 receptor | CHEMBL226 | 624 | Antagonist |
| 4511 | Histone deacetylase | CHEMBL2093865 | 7713-7723 | Inhibitor |
| 4512 | Thrombopoietin receptor | CHEMBL1864 | 10559 | Agonist |
| 4513 | Calcium sensing receptor | CHEMBL1878 | 2171 | Antagonist |
| 4514 | Cyclin-dependent kinase | CHEMBL3559691 | 4269, 4270, 4272-4281, 4285-4288, 4291-4294 | Inhibitor |
| 4515 | D2-like dopamine receptor | CHEMBL2331075 | 5041-5043 | Agonist |
| 4516 | Sodium channel alpha subunit | CHEMBL2331043 | 15989, 15991, 15993, 15995, 15997-16001, 16002 | Blocker |
| 4517 | Peroxisome proliferator-activated receptor gamma | CHEMBL235 | 12428 | Agonist |
| 4519 | HMG-CoA reductase | CHEMBL402 | 26 | Inhibitor |
| 4520 | D2-like dopamine receptor | CHEMBL2331075 | 5041-5043 | Agonist |
| 4525 | PI3-kinase p110-delta subunit | CHEMBL3130 | 12528 | Inhibitor |
| 4525 | PI3-kinase p110-gamma subunit | CHEMBL3267 | 12529 | Inhibitor |
| 4529 | Adenosine A1 receptor | CHEMBL226 | 624 | Agonist |
| 4549 | Protein kinase C beta | CHEMBL3045 | 13589 | Inhibitor |
| 4550 | Sodium channel alpha subunit | CHEMBL2331043 | 15989, 15991, 15993, 15995, 15997-16001, 16002 | Blocker |
| 4552 | Tyrosine-protein kinase JAK1 | CHEMBL2835 | 8595 | Inhibitor |
| 4552 | Tyrosine-protein kinase JAK2 | CHEMBL2971 | 8596 | Inhibitor |
| 4554 | MAP kinase p38 alpha | CHEMBL260 | 10445 | Inhibitor |
| 4554 | MAP kinase p38 beta | CHEMBL3961 | 10442 | Inhibitor |
| 4555 | ALK tyrosine kinase receptor | CHEMBL4247 | 1032 | Inhibitor |
| 4555 | Neurotrophic tyrosine kinase receptor | CHEMBL3559684 | 11145-11147 | Inhibitor |
| 4555 | Proto-oncogene tyrosine-protein kinase ROS | CHEMBL5568 | 14926 | Inhibitor |
| 4556 | Cell division cycle 7-related protein kinase | CHEMBL5443 | 2667 | Inhibitor |
| 4581 | Epidermal growth factor receptor erbB1 | CHEMBL203 | 5466 | Inhibitor |
| 4581 | Receptor protein-tyrosine kinase erbB-2 | CHEMBL1824 | 5520 | Inhibitor |
| 4582 | Neuropeptide Y receptor type 5 | CHEMBL4561 | 11133 | Antagonist |
| 4587 | Sucrose | CHEMBL2364182 |  | Hydrolytic enzyme |
| 4588 | Neprilysin | CHEMBL1944 | 10048 | Inhibitor |
| 4589 | Cannabinoid CB1 receptor | CHEMBL218 | 2270 | Agonist |
| 4589 | Cannabinoid CB2 receptor | CHEMBL253 | 2271 | Agonist |
| 4595 | Bradykinin B1 receptor | CHEMBL4308 | 1922 | Antagonist |
| 4599 | Beta-2 adrenergic receptor | CHEMBL210 | 773 | Agonist |
| 4606 | Mu opioid receptor | CHEMBL233 | 12037 | Antagonist |
| 4607 | Epidermal growth factor receptor erbB1 | CHEMBL203 | 5466 | Inhibitor |
| 4607 | Receptor protein-tyrosine kinase erbB-2 | CHEMBL1824 | 5520 | Inhibitor |
| 4607 | Receptor tyrosine-protein kinase erbB-3 | CHEMBL5838 | 5521 | Inhibitor |
| 4609 | Phenylalanine-4-hydroxylase | CHEMBL3076 | 12464 | Activator |
| 4612 | Inhibitor of nuclear factor kappa B kinase beta subunit | CHEMBL1991 | 8194 | Inhibitor |
| 4613 | Hepatocyte growth factor receptor | CHEMBL3717 | 10107 | Inhibitor |
| 4614 | PI3-kinase p110-beta subunit | CHEMBL3145 | 12527 | Inhibitor |
| 4615 | Rho-associated protein kinase | CHEMBL2111459 | 14557, 14558 | Inhibitor |
| 4616 | Glucagon receptor | CHEMBL1985 | 6861 | Agonist |
| 4617 | Tyrosine-protein kinase ABL | CHEMBL1862 | 149 | Inhibitor |
| 4617 | Tyrosine-protein kinase SRC | CHEMBL267 | 16684 | Inhibitor |
| 4618 | Type-1 angiotensin II receptor | CHEMBL227 | 1058 | Antagonist |
| 4619 | Granulocyte-macrophage colony-stimulating factor receptor | CHEMBL2364169 | 3856, 3857 | Agonist |
| 4620 | Dopamine D2 receptor | CHEMBL217 | 5041 | Partial agonist |
| 4620 | Dopamine D3 receptor | CHEMBL234 | 5042 | Agonist |
| 4620 | Dopamine D4 receptor | CHEMBL219 | 5043 | Agonist |
| 4620 | Serotonin 1a (5-HT1a) receptor | CHEMBL214 | 61 | Agonist |
| 4622 | Vasopressin V2 receptor | CHEMBL1790 | 1345 | Antagonist |
| 4624 | Hepatocyte growth factor receptor | CHEMBL3717 | 10107 | Inhibitor |

TABLE 3-continued

Ligand sets

| Ligand No. | Target Name | Target ChEMBL ID | Payload ID | Action type |
|---|---|---|---|---|
| 4625 | Dipeptidyl peptidase IV | CHEMBL284 | 4887 | Inhibitor |
| 4628 | Orexin receptor 1 | CHEMBL5113 | 7888 | Antagonist |
| 4628 | Orexin receptor 2 | CHEMBL4792 | 7889 | Antagonist |
| 4629 | Vanilloid receptor | CHEMBL4794 | 18061 | Antagonist |
| 4630 | Serotonin 6 (5-HT6) receptor | CHEMBL3371 | 76 | Antagonist |
| 4631 | Dopamine D2 receptor | CHEMBL217 | 5041 | Antagonist |
| 4631 | Serotonin 2a (5-HT2a) receptor | CHEMBL224 | 66 | Antagonist |
| 4632 | MAP kinase p38 alpha | CHEMBL260 | 10445 | Inhibitor |
| 4638 | MAP kinase p38 alpha | CHEMBL260 | 10445 | Inhibitor |
| 4640 | Serine/threonine-protein kinase Chk1 | CHEMBL4630 | 2825 | Inhibitor |
| 4641 | MAP kinase p38 alpha | CHEMBL260 | 10445 | Inhibitor |
| 4643 | Muscarinic acetylcholine receptor M1 | CHEMBL216 | 2935 | Antagonist |
| 4645 | MAP kinase p38 alpha | CHEMBL260 | 10445 | Inhibitor |
| 4649 | Retinoid X receptor alpha | CHEMBL2061 | 14454 | Modulator |
| 4652 | GABA-A receptor; anion channel | CHEMBL2093872 | 6682-6696, 6700 | Positive allosteric modulator |
| 4653 | Secretin receptor | CHEMBL1925 | 15367 | Agonist |
| 4654 | Secretin receptor | CHEMBL1925 | 15367 | Agonist |
| 4655 | Secretin receptor | CHEMBL1925 | 15367 | Agonist |
| 4656 | Interleukin 17A | CHEMBL3390822 | 8433 | Inhibitor |
| 4658 | Monoamine oxidase B | CHEMBL2039 | 10528 | Inhibitor |
| 4663 | Vasopressin V1a receptor | CHEMBL1889 | 1343 | Agonist |
| 4664 | Prostanoid IP receptor | CHEMBL1995 | 13457 | Agonist |
| 4665 | Cyclin-dependent kinase 1 | CHEMBL308 | 4269 | Inhibitor |
| 4665 | Cyclin-dependent kinase 2 | CHEMBL301 | 4281 | Inhibitor |
| 4665 | Cyclin-dependent kinase 5 | CHEMBL4036 | 4288 | Inhibitor |
| 4665 | Cyclin-dependent kinase 7 | CHEMBL3055 | 4292 | Inhibitor |
| 4665 | Cyclin-dependent kinase 9 | CHEMBL3116 | 4294 | Inhibitor |
| 4666 | Adenosine A1 receptor | CHEMBL226 | 624 | Agonist |
| 4667 | Dual specificity mitogen-activated protein kinase kinase 1 | CHEMBL3587 | 10458 | Inhibitor |
| 4667 | Dual specificity mitogen-activated protein kinase kinase 2 | CHEMBL2964 | 10459 | Inhibitor |
| 4668 | Glutamate receptor ionotropic AMPA | CHEMBL2096670 | 6905-6908 | Antagonist |
| 4668 | Glutamate receptor ionotropic kainate | CHEMBL2109241 | 6912-6916 | Antagonist |
| 4668 | Glutamate receptor ionotropic, AMPA 1 | CHEMBL2009 | 6905 | Antagonist |
| 4668 | Glutamate receptor ionotropic, AMPA 2 | CHEMBL4016 | 6906 | Antagonist |
| 4668 | Glutamate receptor ionotropic, AMPA 3 | CHEMBL3595 | 6907 | Antagonist |
| 4668 | Glutamate receptor ionotropic, AMPA 4 | CHEMBL3190 | 6908 | Antagonist |
| 4669 | Glucagon-like peptide 1 receptor | CHEMBL1784 | 6862 | Agonist |
| 4670 | MAP kinase p38 alpha | CHEMBL260 | 10445 | Inhibitor |
| 4671 | Stem cell growth factor receptor | CHEMBL1936 | 19299 | Inhibitor |
| 4671 | Vascular endothelial growth factor receptor | CHEMBL2095227 | 6336, 6339, 9005 | Inhibitor |
| 4672 | Intermediate conductance calcium-activated potassium channel protein 4 | CHEMBL4305 | 13052 | Blocker |
| 4673 | Vitamin D receptor | CHEMBL1977 | 19293 | Agonist |
| 4674 | Melanocortin receptor 2 | CHEMBL1965 | 9988 | Agonist |
| 4675 | Relaxin receptor 1 | CHEMBL1293316 | 14360 | Activator |
| 4675 | Relaxin receptor 2 | CHEMBL1628482 | 14361 | Activator |
| 4676 | Dopamine D2 receptor | CHEMBL217 | 5041 | Modulator |
| 4678 | Neurokinin 1 receptor | CHEMBL249 | 17315 | Antagonist |
| 4680 | Growth hormone-releasing hormone receptor | CHEMBL2032 | 7231 | Agonist |
| 4683 | Serotonin transporter | CHEMBL228 | 16331 | Inhibitor |
| 4688 | G protein-coupled receptor 44 | CHEMBL5071 | 13445 | Antagonist |
| 4689 | Melanocortin receptor 4 | CHEMBL259 | 9992 | Agonist |
| 4691 | Phosphate | CHEMBL2364184 | | Sequestering agent |
| 4692 | GABA-A receptor; anion channel | CHEMBL2093872 | 6682-6696, 6700 | Positive allosteric modulator |
| 4692 | Glycine receptor (alpha-1/beta) | CHEMBL2363052 | 7027, 7031 | Positive modulator |
| 4692 | Potassium channel subfamily K member 10 | CHEMBL2331041 | 13074 | Opener |
| 4692 | Potassium channel subfamily K member 18 | CHEMBL2331042 | 13080 | Opener |
| 4692 | Potassium channel subfamily K member 2 | CHEMBL2321615 | 13081 | Opener |

TABLE 3-continued

Ligand sets

| Ligand No. | Target Name | Target ChEMBL ID | Payload ID | Action type |
|---|---|---|---|---|
| 4692 | Potassium channel subfamily K member 3 | CHEMBL2321613 | 13082 | Opener |
| 4692 | Potassium channel subfamily K member 9 | CHEMBL2321614 | 13087 | Opener |
| 4694 | PI3-kinase class I | CHEMBL3559703 | 12526-12529, 12596-12598, 12601 | Inhibitor |
| 4694 | Serine/threonine-protein kinase mTOR | CHEMBL2842 | 9934 | Inhibitor |
| 4695 | Serine/threonine-protein kinase PIM | CHEMBL3559682 | 12722-12724 | Inhibitor |
| 4699 | Hepatocyte growth factor receptor | CHEMBL3717 | 10107 | Inhibitor |
| 4704 | Monoamine transporter | CHEMBL2363064 | 16329-16331 | Inhibitor |
| 4705 | Phosphodiesterase 5A | CHEMBL1827 | 12560 | Inhibitor |
| 4706 | Casein kinase II alpha | CHEMBL3629 | 2397 | Inhibitor |
| 4707 | Alpha-1a adrenergic receptor | CHEMBL229 | 766 | Antagonist |
| 4708 | Interleukin-6 | CHEMBL1795129 | 8479 | Inhibitor |
| 4711 | Epidermal growth factor receptor erbB1 | CHEMBL203 | 5466 | Inhibitor |
| 4712 | HMG-CoA reductase | CHEMBL402 | 26 | Inhibitor |
| 4716 | Sphingosine 1-phosphate receptor Edg-1 | CHEMBL4333 | 16606 | Agonist |
| 4716 | Sphingosine 1-phosphate receptor Edg-8 | CHEMBL2274 | 16610 | Agonist |
| 4719 | FK506-binding protein 1A | CHEMBL1902 | 6309 | Inhibitor |
| 4721 | Dipeptidyl peptidase IV | CHEMBL284 | 4887 | Inhibitor |
| 4727 | Calcitonin receptor | CHEMBL1832 | 2101 | Agonist |
| 4735 | Serine/threonine-protein kinase Aurora | CHEMBL3430911 | 1654, 1657, 1658 | Inhibitor |
| 4739 | Peroxisome proliferator-activated receptor | CHEMBL3559683 | 12426-12428 | Agonist |
| 4741 | Glutamine | CHEMBL2366039 |  | Sequestering agent |
| 4745 | Neuronal acetylcholine receptor; alpha4/beta2 | CHEMBL1907589 | 2945, 2951 | Agonist |
| 4747 | Beta-3 adrenergic receptor | CHEMBL246 | 774 | Agonist |
| 4748 | Tyrosine-protein kinase JAK1 | CHEMBL2835 | 8595 | Inhibitor |
| 4749 | Muscarinic acetylcholine receptor M2 | CHEMBL211 | 2936 | Antagonist |
| 4749 | Muscarinic acetylcholine receptor M3 | CHEMBL245 | 2937 | Antagonist |
| 4750 | Growth hormone receptor | CHEMBL1976 | 7228 | Agonist |
| 4751 | Growth hormone receptor | CHEMBL1976 | 7228 | Agonist |
| 4753 | Adenosine A2a receptor | CHEMBL251 | 625 | Agonist |
| 4755 | PI3-kinase class I | CHEMBL3559703 | 12526-12529, 12596-12598, 12601 | Inhibitor |
| 4756 | Platelet-derived growth factor receptor beta | CHEMBL1913 | 12774 | Inhibitor |
| 4756 | Serine/threonine-protein kinase B-raf | CHEMBL5145 | 1924 | Inhibitor |
| 4756 | Serine/threonine-protein kinase RAF | CHEMBL1906 | 14116 | Inhibitor |
| 4756 | Stem cell growth factor receptor | CHEMBL1936 | 19299 | Inhibitor |
| 4756 | Tyrosine-protein kinase receptor FLT3 | CHEMBL1974 | 6337 | Inhibitor |
| 4756 | Tyrosine-protein kinase receptor RET | CHEMBL2041 | 14404 | Inhibitor |
| 4756 | Vascular endothelial growth factor receptor | CHEMBL2095227 | 6336, 6339, 9005 | Inhibitor |
| 4761 | Beta-1 adrenergic receptor | CHEMBL213 | 772 | Antagonist |
| 4761 | Beta-2 adrenergic receptor | CHEMBL210 | 773 | Antagonist |
| 4761 | HERG | CHEMBL240 | 13089 | Blocker |
| 4762 | Protein kinase C (PKC) | CHEMBL2093867 | 13588-13590, 13592-13598, 13600 | Inhibitor |
| 4775 | Endothelin receptor ET-A | CHEMBL252 | 5399 | Antagonist |
| 4775 | Type-1 angiotensin II receptor | CHEMBL227 | 1058 | Antagonist |
| 4776 | Tyrosine-protein kinase BTK | CHEMBL5251 | 1989 | Inhibitor |
| 4784 | Angiotensin-converting enzyme | CHEMBL1808 | 1056 | Inhibitor |
| 4786 | Mineralocorticoid receptor | CHEMBL1994 | 11443 | Antagonist |
| 4799 | Serine/threonine-protein kinase AKT | CHEMBL4282 | 19217 | Inhibitor |
| 4800 | Estrogen receptor alpha | CHEMBL206 | 5551 | Antagonist |
| 4804 | Vasopressin V1a receptor | CHEMBL1889 | 1343 | Antagonist |
| 4805 | Vasopressin V1a receptor | CHEMBL1889 | 1343 | Antagonist |
| 4807 | Corticotropin releasing factor receptor 1 | CHEMBL1800 | 3994 | Antagonist |

TABLE 3-continued

Ligand sets

| Ligand No. | Target Name | Target ChEMBL ID | Payload ID | Action type |
|---|---|---|---|---|
| 4809 | Neuronal acetylcholine receptor protein alpha-7 subunit | CHEMBL2492 | 2940 | Partial agonist |
| 4810 | Adenosine A2a receptor | CHEMBL251 | 625 | Antagonist |
| 4812 | Androgen Receptor | CHEMBL1871 | 1034 | Agonist |
| 4816 | Plasminogen | CHEMBL1801 | 12750 | Activator |
| 4819 | DNA | CHEMBL2311221 | | Inhibitor |
| 4821 | Metabotropic glutamate receptor 5 | CHEMBL3227 | 6929 | Negative allosteric modulator |
| 4822 | Platelet-derived growth factor receptor | CHEMBL2095189 | 12773, 12774 | Inhibitor |
| 4822 | Stem cell growth factor receptor | CHEMBL1936 | 19299 | Inhibitor |
| 4822 | Tyrosine-protein kinase receptor FLT3 | CHEMBL1974 | 6337 | Inhibitor |
| 4822 | Vascular endothelial growth factor receptor | CHEMBL2095227 | 6336, 6339, 9005 | Inhibitor |
| 4823 | Platelet-derived growth factor receptor | CHEMBL2095189 | 12773, 12774 | Inhibitor |
| 4823 | Stem cell growth factor receptor | CHEMBL1936 | 19299 | Inhibitor |
| 4823 | Tyrosine-protein kinase receptor FLT3 | CHEMBL1974 | 6337 | Inhibitor |
| 4823 | Vascular endothelial growth factor receptor | CHEMBL2095227 | 6336, 6339, 9005 | Inhibitor |
| 4832 | Glycoproteins | CHEMBL2363054 | | Cross-linking agent |
| 4832 | Pepsin A | CHEMBL3295 | 12331 | Inhibitor |
| 4833 | Phosphate | CHEMBL2364184 | | Sequestering agent |
| 4836 | Mu opioid receptor | CHEMBL233 | 12037 | Agonist |
| 4837 | Gonadotropin-releasing hormone receptor | CHEMBL1855 | 7145 | Antagonist |
| 4858 | Arachidonate 5-lipoxygenase | CHEMBL215 | 1310 | Inhibitor |
| 4858 | Cyclooxygenase | CHEMBL2094253 | 13461, 13462 | Inhibitor |
| 4860 | Fibroblast growth factor receptor 1 | CHEMBL3650 | 6253 | Inhibitor |
| 4860 | Vascular endothelial growth factor receptor | CHEMBL2095227 | 6336, 6339, 9005 | Inhibitor |
| 4861 | Solute carrier family 22 member 12 | CHEMBL6120 | 16093 | Inhibitor |
| 4865 | Cyclooxygenase | CHEMBL2094253 | 13461, 13462 | Inhibitor |
| 4869 | Serotonin 1b (5-HT1b) receptor | CHEMBL1898 | 62 | Agonist |
| 4869 | Serotonin 1d (5-HT1d) receptor | CHEMBL1983 | 63 | Agonist |
| 4870 | Macrophage colony stimulating factor receptor | CHEMBL1844 | 3854 | Inhibitor |
| 4870 | Platelet-derived growth factor receptor | CHEMBL2095189 | 12773, 12774 | Inhibitor |
| 4870 | Stem cell growth factor receptor | CHEMBL1936 | 19299 | Inhibitor |
| 4870 | Tyrosine-protein kinase receptor FLT3 | CHEMBL1974 | 6337 | Inhibitor |
| 4870 | Tyrosine-protein kinase receptor RET | CHEMBL2041 | 14404 | Inhibitor |
| 4870 | Vascular endothelial growth factor receptor | CHEMBL2095227 | 6336, 6339, 9005 | Inhibitor |
| 4871 | Cyclooxygenase | CHEMBL2094253 | 13461, 13462 | Inhibitor |
| 4873 | Cannabinoid CB1 receptor | CHEMBL218 | 2270 | Antagonist |
| 4874 | Orexin receptor | CHEMBL3307226 | 7888, 7889 | Antagonist |
| 4875 | Muscle-type nicotinic acetylcholine receptor | CHEMBL2362997 | 2941, 2950, 2954, 2955 2956 | Agonist |
| 4878 | Estrogen receptor | CHEMBL2093866 | 5551, 5552 | Agonist |
| 4882 | MAP kinase p38 alpha | CHEMBL260 | 10445 | Inhibitor |
| 4883 | Cytochrome P450 3A4 | CHEMBL340 | 4451 | Inhibitor |
| 4883 | Ghrelin receptor | CHEMBL4616 | 7232 | Agonist |
| 4884 | Cholinesterases; ACHE & BCHE | CHEMBL2095233 | 380, 2027 | Inhibitor |
| 4886 | FK506-binding protein 1A | CHEMBL1902 | 6309 | Inhibitor |
| 4887 | Phosphodiesterase 5A | CHEMBL1827 | 12560 | Inhibitor |
| 4888 | Prostanoid FP receptor | CHEMBL1987 | 13455 | Agonist |
| 4890 | Epidermal growth factor receptor erbB1 | CHEMBL203 | 5466 | Inhibitor |
| 4890 | Receptor protein-tyrosine kinase erbB-2 | CHEMBL1824 | 5520 | Inhibitor |
| 4892 | Smoothened homolog | CHEMBL5971 | 15967 | Antagonist |
| 4895 | Platelet-derived growth factor receptor | CHEMBL2095189 | 12773, 12774 | Inhibitor |
| 4895 | Vascular endothelial growth factor receptor | CHEMBL2095227 | 6336, 6339, 9005 | Inhibitor |
| 4896 | Tyrosine-protein kinase SYK | CHEMBL2599 | 16634 | Inhibitor |
| 4897 | MAP kinase p38 alpha | CHEMBL260 | 10445 | Inhibitor |
| 4898 | Dual specificity mitogen-activated protein kinase kinase 1 | CHEMBL3587 | 10458 | Inhibitor |

TABLE 3-continued

Ligand sets

| Ligand No. | Target Name | Target ChEMBL ID | Payload ID | Action type |
|---|---|---|---|---|
| 4898 | Dual specificity mitogen-activated protein kinase kinase 2 | CHEMBL2964 | 10459 | Inhibitor |
| 4899 | Serine/threonine-protein kinase Aurora-B | CHEMBL2185 | 1657 | Inhibitor |
| 4900 | Serine/threonine-protein kinase PLK1 | CHEMBL3024 | 12860 | Inhibitor |
| 4901 | Smoothened homolog | CHEMBL5971 | 15967 | Antagonist |
| 4903 | GABA-A receptor; anion channel | CHEMBL2093872 | 6682-6696, 6700 | Positive allosteric modulator |
| 4904 | Glucocerebroside | CHEMBL2364176 | | Hydrolytic enzyme |
| 4905 | MAP kinase p38 alpha | CHEMBL260 | 10445 | Inhibitor |
| 4906 | Neurokinin 3 receptor | CHEMBL4429 | 17317 | Antagonist |
| 4907 | Tyrosine-protein kinase SYK | CHEMBL2599 | 16634 | Inhibitor |
| 4909 | Estrogen receptor alpha | CHEMBL206 | 5551 | Modulator |
| 4910 | Adrenergic receptor alpha-1 | CHEMBL2094251 | 766-768 | Antagonist |
| 4912 | Platelet-derived growth factor receptor beta | CHEMBL1913 | 12774 | Inhibitor |
| 4912 | Stem cell growth factor receptor | CHEMBL1936 | 19299 | Inhibitor |
| 4912 | Tyrosine-protein kinase receptor FLT3 | CHEMBL1974 | 6337 | Inhibitor |
| 4913 | c-Jun N-terminal kinase 1 | CHEMBL2276 | 10451 | Inhibitor |
| 4913 | c-Jun N-terminal kinase 2 | CHEMBL4179 | 10455 | Inhibitor |
| 4913 | c-Jun N-terminal kinase 3 | CHEMBL2637 | 10441 | Inhibitor |
| 4914 | Mu opioid receptor | CHEMBL233 | 12037 | Agonist |
| 4914 | Norepinephrine transporter | CHEMBL222 | 16329 | Inhibitor |
| 4915 | Muscarinic acetylcholine receptor M3 | CHEMBL245 | 2937 | Antagonist |
| 4916 | Cannabinoid CB1 receptor | CHEMBL218 | 2270 | Inverse agonist |
| 4918 | Hepatocyte growth factor receptor | CHEMBL3717 | 10107 | Inhibitor |
| 4918 | Vascular endothelial growth factor receptor 2 | CHEMBL279 | 9005 | Inhibitor |
| 4919 | Serine/threonine-protein kinase Aurora-A | CHEMBL4722 | 1654 | Inhibitor |
| 4920 | PI3-kinase class I | CHEMBL3559703 | 12526-12529, 12596-12598, 12601 | Inhibitor |
| 4921 | Melatonin receptor | CHEMBL2094268 | 10037, 10038 | Agonist |
| 4923 | Glucagon-like peptide 1 receptor | CHEMBL1784 | 6862 | Agonist |
| 4927 | Retinoic acid receptor | CHEMBL2363069 | 14451-14453 | Agonist |
| 4932 | Neuronal acetylcholine receptor; alpha4/beta2 | CHEMBL1907589 | 2945, 2951 | Antagonist |
| 4934 | Neuronal acetylcholine receptor; alpha3/beta4 | CHEMBL1907594 | 2944, 2953 | Agonist |
| 4934 | Neuronal acetylcholine receptor; alpha4/beta2 | CHEMBL1907589 | 2945, 2951 | Agonist |
| 4935 | Neuronal acetylcholine receptor protein alpha-7 subunit | CHEMBL2492 | 2940 | Agonist |
| 4936 | Choline kinase alpha | CHEMBL3117 | 2930 | Inhibitor |
| 4939 | Neuronal acetylcholine receptor protein alpha-4 subunit | CHEMBL1882 | 2945 | Agonist |
| 4940 | Adenosine A1 receptor | CHEMBL226 | 624 | Agonist |
| 4941 | Calcium sensing receptor | CHEMBL1878 | 2171 | Modulator |
| 4942 | Cannabinoid CB2 receptor | CHEMBL253 | 2271 | Agonist |
| 4943 | Alpha-1a adrenergic receptor | CHEMBL229 | 766 | Antagonist |
| 4943 | Dopamine transporter | CHEMBL238 | 16330 | Inhibitor |
| 4943 | Norepinephrine transporter | CHEMBL222 | 16329 | Inhibitor |
| 4943 | Serotonin 2a (5-HT2a) receptor | CHEMBL224 | 66 | Antagonist |
| 4943 | Serotonin 2c (5-HT2c) receptor | CHEMBL225 | 68 | Antagonist |
| 4943 | Serotonin 3 (5-HT3) receptor | CHEMBL2094132 | 69-73 | Antagonist |
| 4943 | Serotonin transporter | CHEMBL228 | 16331 | Inhibitor |
| 4945 | Glucagon-like peptide 2 receptor | CHEMBL5844 | 6863 | Agonist |
| 4946 | Serotonin 4 (5-HT4) receptor | CHEMBL1875 | 74 | Partial agonist |
| 4948 | Progesterone receptor | CHEMBL208 | 13299 | Modulator |
| 4949 | Platelet-derived growth factor receptor beta | CHEMBL1913 | 12774 | Inhibitor |
| 4949 | Stem cell growth factor receptor | CHEMBL1936 | 19299 | Inhibitor |
| 4949 | Vascular endothelial growth factor receptor 2 | CHEMBL279 | 9005 | Inhibitor |
| 4949 | Vascular endothelial growth factor receptor 3 | CHEMBL1955 | 6339 | Inhibitor |
| 4952 | Calcitonin gene-related peptide type 1 receptor | CHEMBL3798 | 2102 | Antagonist |
| 4954 | Type-1 angiotensin II receptor | CHEMBL227 | 1058 | Antagonist |
| 4956 | Serotonin 2a (5-HT2a) receptor | CHEMBL224 | 66 | Inverse agonist |
| 4957 | GABA-A receptor; anion channel | CHEMBL2093872 | 6682-6696, 6700 | Positive allosteric modulator |

TABLE 3-continued

Ligand sets

| Ligand No. | Target Name | Target ChEMBL ID | Payload ID | Action type |
|---|---|---|---|---|
| 4959 | DNA | CHEMBL2311221 | | Inhibitor |
| 4960 | FK506-binding protein 1A | CHEMBL1902 | 6309 | Inhibitor |
| 4961 | Plasminogen | CHEMBL1801 | 12750 | Activator |
| 4962 | DNA topoisomerase II | CHEMBL2094255 | 17865, 12866 | Inhibitor |
| 4968 | Hepatocyte growth factor receptor | CHEMBL3717 | 10107 | Inhibitor |
| 4969 | Adrenergic receptor alpha-1 | CHEMBL2094251 | 766-768 | Antagonist |
| 4971 | Beta-2 adrenergic receptor | CHEMBL210 | 773 | Agonist |
| 4974 | Dihydroorotate dehydrogenase | CHEMBL1966 | 4867 | Inhibitor |
| 4975 | Parathyroid hormone receptor | CHEMBL1793 | 12246 | Agonist |
| 4976 | Parathyroid hormone receptor | CHEMBL1793 | 12246 | Agonist |
| 4987 | Thromboxane A2 receptor | CHEMBL2069 | 17746 | Antagonist |
| 4988 | Peroxisome proliferator-activated receptor alpha | CHEMBL239 | 12426 | Agonist |
| 4988 | Peroxisome proliferator-activated receptor gamma | CHEMBL235 | 12428 | Agonist |
| 4989 | Growth hormone-releasing hormone receptor | CHEMBL2032 | 7231 | Agonist |
| 4990 | Ephrin type-B receptor 4 | CHEMBL5147 | 5455 | Inhibitor |
| 4990 | Epidermal growth factor receptor erbB1 | CHEMBL203 | 5466 | Inhibitor |
| 4990 | Receptor protein-tyrosine kinase erbB-2 | CHEMBL1824 | 5520 | Inhibitor |
| 4992 | Cytochrome P450 19A1 | CHEMBL1978 | 4424 | Inhibitor |
| 4993 | Androgen Receptor | CHEMBL1871 | 1034 | Agonist |
| 4994 | Androgen Receptor | CHEMBL1871 | 1034 | Agonist |
| 4995 | Androgen Receptor | CHEMBL1871 | 1034 | Agonist |
| 4997 | Androgen Receptor | CHEMBL1871 | 1034 | Agonist |
| 4998 | Androgen Receptor | CHEMBL1871 | 1034 | Agonist |
| 5001 | Synaptic vesicular amine transporter | CHEMBL1893 | 16067 | Inhibitor |
| 5004 | Sodium channel alpha subunit | CHEMBL2331043 | 15989, 15991, 15993, 15995, 15997-16001, 16002 | Blocker |
| 5015 | Adrenergic receptor alpha | CHEMBL2095203 | 766-771 | Agonist |
| 5022 | Endothelin receptor ET-A | CHEMBL252 | 5399 | Antagonist |
| 5022 | Endothelin receptor ET-B | CHEMBL1785 | 5400 | Antagonist |
| 5023 | Cyclin-dependent kinase 1 | CHEMBL308 | 4269 | Inhibitor |
| 5023 | Cyclin-dependent kinase 2 | CHEMBL301 | 4281 | Inhibitor |
| 5023 | Cyclin-dependent kinase 7 | CHEMBL3055 | 4292 | Inhibitor |
| 5023 | Cyclin-dependent kinase 9 | CHEMBL3116 | 4294 | Inhibitor |
| 5023 | Tyrosine-protein kinase JAK2 | CHEMBL2971 | 8596 | Inhibitor |
| 5023 | Tyrosine-protein kinase receptor FLT3 | CHEMBL1974 | 6337 | Inhibitor |
| 5024 | PI3-kinase p110-delta subunit | CHEMBL3130 | 12528 | Inhibitor |
| 5024 | PI3-kinase p110-gamma subunit | CHEMBL3267 | 12529 | Inhibitor |
| 5026 | Ephrin type-B receptor 4 | CHEMBL5147 | 5455 | Inhibitor |
| 5026 | Fibroblast growth factor receptor 1 | CHEMBL3650 | 6253 | Inhibitor |
| 5026 | Fibroblast growth factor receptor 2 | CHEMBL4142 | 6254 | Inhibitor |
| 5026 | Platelet-derived growth factor receptor beta | CHEMBL1913 | 12774 | Inhibitor |
| 5026 | SRC | CHEMBL2363074 | 1864, 6212, 6514, 6515, 7387, 9206, 9637, 16684, 16687, 19589 | Inhibitor |
| 5026 | Vascular endothelial growth factor receptor 1 | CHEMBL1868 | 6336 | Inhibitor |
| 5026 | Vascular endothelial growth factor receptor 2 | CHEMBL279 | 9005 | Inhibitor |
| 5027 | PI3-kinase p110-delta subunit | CHEMBL3130 | 12528 | Inhibitor |
| 5029 | Epidermal growth factor receptor erbB1 | CHEMBL203 | 5466 | Inhibitor |
| 5032 | Adenosine receptor | CHEMBL2111329 | 624-627 | Antagonist |
| 5032 | Phosphodiesterase 3 | CHEMBL2094125 | 12553, 12554 | Inhibitor |
| 5032 | Phosphodiesterase 4 | CHEMBL2093863 | 12555-12557, 12559 | Inhibitor |
| 5033 | Adenosine receptor | CHEMBL2111329 | 624-627 | Antagonist |
| 5033 | Phosphodiesterase 3 | CHEMBL2094125 | 12553, 12554 | Inhibitor |
| 5033 | Phosphodiesterase 4 | CHEMBL2093863 | 12555-12557, 12559 | Inhibitor |
| 5039 | GABA-A receptor; anion channel | CHEMBL2093872 | 6682-6696, 6700 | Positive allosteric modulator |
| 5045 | Dopamine D2 receptor | CHEMBL217 | 5041 | Antagonist |
| 5051 | DNA | CHEMBL2311221 | | Inhibitor |
| 5051 | Inosine-5'-monophosphate dehydrogenase (IMPDH) | CHEMBL2111369 | 8156, 8157 | Inhibitor |
| 5055 | GABA-A receptor; anion channel | CHEMBL2093872 | 6682-6696, 6700 | Positive allosteric modulator |

TABLE 3-continued

Ligand sets

| Ligand No. | Target Name | Target ChEMBL ID | Payload ID | Action type |
|---|---|---|---|---|
| 5059 | D2-like dopamine receptor | CHEMBL2331075 | 5041-5043 | Antagonist |
| 5059 | Serotonin 2a (5-HT2a) receptor | CHEMBL224 | 66 | Antagonist |
| 5059 | Serotonin 2c (5-HT2c) receptor | CHEMBL225 | 68 | Antagonist |
| 5061 | DNA | CHEMBL2311221 | | Inhibitor |
| 5062 | Dopamine D2 receptor | CHEMBL217 | 5041 | Antagonist |
| 5062 | Serotonin 2a (5-HT2a) receptor | CHEMBL224 | 66 | Antagonist |
| 5074 | Thyroid stimulating hormone receptor | CHEMBL1963 | 17782 | Agonist |
| 5075 | Thyroid stimulating hormone receptor | CHEMBL1963 | 17782 | Agonist |
| 5076 | GABA transporter 1 | CHEMBL1903 | 16325 | Inhibitor |
| 5078 | Purinergic receptor P2Y12 | CHEMBL2001 | 13908 | Negative allosteric modulator |
| 5080 | Purinergic receptor P2Y12 | CHEMBL2001 | 13908 | Antagonist |
| 5081 | Glycogen synthase kinase-3 beta | CHEMBL262 | 7040 | Inhibitor |
| 5084 | ATP | CHEMBL2366048 | | Inhibitor |
| 5085 | Beta-1 adrenergic receptor | CHEMBL213 | 772 | Antagonist |
| 5085 | Beta-2 adrenergic receptor | CHEMBL210 | 773 | Antagonist |
| 5088 | Antithrombin-III | CHEMBL1950 | 15564 | Activator |
| 5091 | Muscarinic acetylcholine receptor M3 | CHEMBL245 | 2937 | Antagonist |
| 5092 | Thymidine phosphorylase | CHEMBL3106 | 17754 | Inhibitor |
| 5094 | Histamine H3 receptor | CHEMBL264 | 7622 | Inverse agonist |
| 5095 | Integrin alpha-IIb/beta-3 | CHEMBL2093869 | 8296, 8312 | Inhibitor |
| 5096 | Hepatocyte growth factor receptor | CHEMBL3717 | 10107 | Inhibitor |
| 5097 | Vascular endothelial growth factor receptor | CHEMBL2095227 | 6336, 6339, 9005 | Inhibitor |
| 5098 | Adrenergic receptor alpha-2 | CHEMBL2095158 | 769-771 | Agonist |
| 5102 | Neuropeptide Y receptor type 4 | CHEMBL4877 | 11132 | Agonist |
| 5107 | Sodium channel alpha subunit | CHEMBL2331043 | 15989, 15991, 15993, 15995, 15997-16001, 16002 | Blocker |
| 5108 | Interleukin-6 receptor alpha subunit | CHEMBL2364155 | 8480 | Inhibitor |
| 5109 | Janus Kinase (JAK) | CHEMBL2363062 | 8595-8597, 18803 | Inhibitor |
| 5111 | Sulfonylurea receptor 1, Kir6.2 | CHEMBL2096972 | 1628, 13056 | Blocker |
| 5112 | Adrenergic receptor alpha | CHEMBL2095203 | 766-771 | Antagonist |
| 5112 | Histamine H1 receptor | CHEMBL231 | 7620 | Agonist |
| 5112 | Histamine H2 receptor | CHEMBL1941 | 7621 | Agonist |
| 5113 | Sulfonylurea receptor 1, Kir6.2 | CHEMBL2096972 | 1628, 13056 | Blocker |
| 5114 | Catechol O-methyltransferase | CHEMBL2023 | 2437 | Inhibitor |
| 5115 | Cyclooxygenase | CHEMBL2094253 | 13461, 13462 | Inhibitor |
| 5118 | Muscarinic acetylcholine receptor M2 | CHEMBL211 | 2936 | Antagonist |
| 5118 | Muscarinic acetylcholine receptor M3 | CHEMBL245 | 2937 | Antagonist |
| 5119 | Vasopressin V2 receptor | CHEMBL1790 | 1345 | Antagonist |
| 5120 | Adenosine A1 receptor | CHEMBL226 | 624 | Antagonist |
| 5121 | Carbonic anhydrase II | CHEMBL205 | 2311 | Inhibitor |
| 5121 | Carbonic anhydrase IV | CHEMBL3729 | 2313 | Inhibitor |
| 5121 | GABA-A receptor; anion channel | CHEMBL2093872 | 6682-6696, 6700 | Positive modulator |
| 5121 | Glutamate receptor ionotropic AMPA | CHEMBL2096670 | 6905-6908 | Antagonist |
| 5121 | Glutamate receptor ionotropic kainate | CHEMBL2109241 | 6912-6916 | Antagonist |
| 5121 | Sodium channel alpha subunit | CHEMBL2331043 | 15989, 15991, 15993, 15995, 15997-16001, 16002 | Blocker |
| 5122 | DNA topoisomerase I, mitochondrial | CHEMBL2362989 | | Inhibitor |
| 5124 | Histamine H4 receptor | CHEMBL3759 | 7623 | Antagonist |
| 5125 | Estrogen receptor | CHEMBL2093866 | 5551, 5552 | Modulator |
| 5126 | Sodium-(potassium)-chloride cotransporter 2 | CHEMBL1874 | 16026 | Inhibitor |
| 5127 | B-lymphocyte antigen CD20 | CHEMBL2058 | 10070 | Inhibitor |
| 5129 | Adenosine A2a receptor | CHEMBL251 | 625 | Antagonist |
| 5130 | Serine/threonine-protein kinase Aurora | CHEMBL3430911 | 1654, 1657, 1658 | Inhibitor |
| 5132 | DNA | CHEMBL2311221 | | Inhibitor |
| 5133 | Adenosine A1 receptor | CHEMBL226 | 624 | Agonist |
| 5134 | Neurokinin 1 receptor | CHEMBL249 | 17315 | Antagonist |
| 5135 | Mu opioid receptor | CHEMBL233 | 12037 | Agonist |
| 5136 | Dual specificity mitogen-activated protein kinase kinase 1 | CHEMBL3587 | 10458 | Inhibitor |

TABLE 3-continued

Ligand sets

| Ligand No. | Target Name | Target ChEMBL ID | Payload ID | Action type |
|---|---|---|---|---|
| 5136 | Dual specificity mitogen-activated protein kinase kinase 2 | CHEMBL2964 | 10459 | Inhibitor |
| 5137 | Angiotensin-converting enzyme | CHEMBL1808 | 1056 | Inhibitor |
| 5138 | Plasminogen | CHEMBL1801 | 12750 | Inhibitor |
| 5149 | Monoamine oxidase | CHEMBL2095205 | 10527, 10528 | Inhibitor |
| 5150 | Receptor protein-tyrosine kinase erbB-2 | CHEMBL1824 | 5520 | Inhibitor |
| 5151 | Receptor protein-tyrosine kinase erbB-2 | CHEMBL1824 | 5520 | Inhibitor |
| 5151 | Tubulin | CHEMBL2095182 | 18669-18675, 18679-18687 | Inhibitor |
| 5152 | Prostanoid FP receptor | CHEMBL1987 | 13455 | Agonist |
| 5153 | Glutamate NMDA receptor; GRIN1/GRIN2B | CHEMBL1907603 | 6917, 6919 | Antagonist |
| 5155 | Serotonin 2a (5-HT2a) receptor | CHEMBL224 | 66 | Antagonist |
| 5155 | Serotonin 2c (5-HT2c) receptor | CHEMBL225 | 68 | Antagonist |
| 5155 | Serotonin transporter | CHEMBL228 | 16331 | Inhibitor |
| 5157 | Serotonin 1b (5-HT1b) receptor | CHEMBL1898 | 62 | Antagonist |
| 5157 | Serotonin 2a (5-HT2a) receptor | CHEMBL224 | 66 | Antagonist |
| 5159 | Prostanoid IP receptor | CHEMBL1995 | 13457 | Agonist |
| 5160 | Retinoic acid receptor | CHEMBL2363069 | 14451-14453 | Agonist |
| 5161 | Glucocorticoid receptor | CHEMBL2034 | 11442 | Agonist |
| 5162 | Glucocorticoid receptor | CHEMBL2034 | 11442 | Agonist |
| 5163 | Glucocorticoid receptor | CHEMBL2034 | 11442 | Agonist |
| 5164 | Glucocorticoid receptor | CHEMBL2034 | 11442 | Agonist |
| 5165 | Amiloride-sensitive sodium channel, ENaC | CHEMBL2107836 | 15985, 15986, 15988 | Blocker |
| 5166 | GABA-A receptor; anion channel | CHEMBL2093872 | 6682-6696, 6700 | Positive allosteric modulator |
| 5171 | Tyrosine-protein kinase JAK1 | CHEMBL2835 | 8595 | Inhibitor |
| 5171 | Tyrosine-protein kinase JAK3 | CHEMBL2148 | 8597 | Inhibitor |
| 5172 | Thiazide-sensitive sodium-chloride cotransporter | CHEMBL1876 | 16025 | Inhibitor |
| 5173 | Serine/threonine-protein kinase AKT | CHEMBL2111353 | 19217-19219 | Inhibitor |
| 5174 | GABA-A receptor; anion channel | CHEMBL2093872 | 6682-6696, 6700 | Positive modulator |
| 5177 | Muscarinic acetylcholine receptor M1 | CHEMBL216 | 2935 | Antagonist |
| 5177 | Muscarinic acetylcholine receptor M3 | CHEMBL245 | 2937 | Antagonist |
| 5180 | D2-like dopamine receptor | CHEMBL2331075 | 5041-5043 | Antagonist |
| 5180 | Serotonin 2a (5-HT2a) receptor | CHEMBL224 | 66 | Antagonist |
| 5180 | Serotonin 2c (5-HT2c) receptor | CHEMBL225 | 68 | Antagonist |
| 5185 | Dopamine D2 receptor | CHEMBL217 | 5041 | Antagonist |
| 5189 | Muscarinic acetylcholine receptor M1 | CHEMBL216 | 2935 | Antagonist |
| 5192 | 3-beta-hydroxysteroid dehydrogenase/delta 5-->4-isomerase type II | CHEMBL3670 | 7858 | Inhibitor |
| 5194 | Voltage-gated T-type calcium channel | CHEMBL2362995 | 2145-2147 | Blocker |
| 5195 | Neuronal acetylcholine receptor; alpha3/beta4 | CHEMBL1907594 | 2944, 2953 | Antagonist |
| 5200 | Adrenergic receptor alpha-1 | CHEMBL2094251 | 766-768 | Antagonist |
| 5200 | Dopamine D2 receptor | CHEMBL217 | 5041 | Antagonist |
| 5200 | Histamine H1 receptor | CHEMBL231 | 7620 | Antagonist |
| 5200 | Norepinephrine transporter | CHEMBL222 | 16329 | Inhibitor |
| 5200 | Serotonin 2a (5-HT2a) receptor | CHEMBL224 | 66 | Antagonist |
| 5200 | Serotonin 2c (5-HT2c) receptor | CHEMBL225 | 68 | Antagonist |
| 5202 | DNA | CHEMBL2311221 | | Inhibitor |
| 5203 | Histamine H1 receptor | CHEMBL231 | 7620 | Antagonist |
| 5206 | Histamine H1 receptor | CHEMBL231 | 7620 | Antagonist |
| 5207 | Gonadotropin-releasing hormone receptor | CHEMBL1855 | 7145 | Agonist |
| 5212 | Peroxisome proliferator-activated receptor gamma | CHEMBL235 | 12428 | Agonist |
| 5215 | Muscarinic acetylcholine receptor M3 | CHEMBL245 | 2937 | Antagonist |
| 5216 | Muscarinic acetylcholine receptor M2 | CHEMBL211 | 2936 | Antagonist |
| 5216 | Muscarinic acetylcholine receptor M3 | CHEMBL245 | 2937 | Antagonist |
| 5222 | Serine/threonine-protein kinase Aurora | CHEMBL3430911 | 1654, 1657, 1658 | Inhibitor |
| 5226 | Muscle-type nicotinic acetylcholine receptor | CHEMBL2362997 | 2941, 2950, 2954, 2955, 2956 | Antagonist |

TABLE 3-continued

Ligand sets

| Ligand No. | Target Name | Target ChEMBL ID | Payload ID | Action type |
|---|---|---|---|---|
| 5227 | Bile acid receptor FXR | CHEMBL2047 | 11432 | Agonist |
| 5228 | Sodium channel protein type I alpha subunit | CHEMBL1845 | 15989 | Blocker |
| 5228 | Sodium channel protein type II alpha subunit | CHEMBL4187 | 15991 | Blocker |
| 5228 | Sodium channel protein type III alpha subunit | CHEMBL5163 | 15993 | Blocker |
| 5228 | Sodium channel protein type IV alpha subunit | CHEMBL2072 | 15995 | Blocker |
| 5228 | Sodium channel protein type IX alpha subunit | CHEMBL4296 | 15997 | Blocker |
| 5228 | Sodium channel protein type V alpha subunit | CHEMBL1980 | 15998 | Blocker |
| 5228 | Sodium channel protein type VII alpha subunit | CHEMBL3585 | 15999 | Blocker |
| 5228 | Sodium channel protein type VIII alpha subunit | CHEMBL5202 | 16000 | Blocker |
| 5228 | Sodium channel protein type X alpha subunit | CHEMBL5451 | 16001 | Blocker |
| 5228 | Sodium channel protein type XI alpha subunit | CHEMBL5167 | 16002 | Blocker |
| 5229 | Proto-oncogene Mas | CHEMBL3559701 | 9866 | Agonist |
| 5237 | Calcitonin gene-related peptide type 1 receptor | CHEMBL3798 | 2102 | Antagonist |
| 5242 | Adenosine A2a receptor | CHEMBL251 | 625 | Agonist |
| 5245 | Ghrelin receptor | CHEMBL4616 | 7232 | Agonist |
| 5247 | Progesterone receptor | CHEMBL208 | 13299 | Modulator |
| 5248 | MAP kinase ERK1 | CHEMBL3385 | 10447 | Inhibitor |
| 5248 | MAP kinase ERK2 | CHEMBL4040 | 10439 | Inhibitor |
| 5249 | Muscarinic acetylcholine receptor M3 | CHEMBL245 | 2937 | Antagonist |
| 5257 | Serine/threonine-protein kinase AKT | CHEMBL2111353 | 19217-19219 | Inhibitor |
| 5258 | Histamine H4 receptor | CHEMBL3759 | 7623 | Antagonist |
| 5260 | DNA | CHEMBL2311221 |  | Inhibitor |
| 5280 | Follicle stimulating hormone receptor | CHEMBL2024 | 6347 | Agonist |
| 5281 | Plasminogen | CHEMBL1801 | 12750 | Activator |
| 5283 | Bile acid receptor FXR | CHEMBL2047 | 11432 | Agonist |
| 5284 | Interleukin-12 | CHEMBL2364153 | 8419, 8420 | Inhibitor |
| 5284 | Interleukin-23 | CHEMBL2364154 | 8420, 8456 | Inhibitor |
| 5287 | Adenosine A2a receptor | CHEMBL251 | 625 | Antagonist |
| 5288 | Serotonin 2a (5-HT2a) receptor | CHEMBL224 | 66 | Antagonist |
| 5288 | Serotonin 2b (5-HT2b) receptor | CHEMBL1833 | 67 | Antagonist |
| 5288 | Serotonin 2c (5-HT2c) receptor | CHEMBL225 | 68 | Agonist |
| 5291 | Cyclooxygenase-2 | CHEMBL230 | 13462 | Inhibitor |
| 5293 | Succinate semialdehyde dehydrogenase | CHEMBL1911 | 888 | Inhibitor |
| 5295 | DNA | CHEMBL2311221 |  | Inhibitor |
| 5295 | DNA topoisomerase II alpha | CHEMBL1806 | 17865 | Inhibitor |
| 5296 | Type-1 angiotensin II receptor | CHEMBL227 | 1058 | Antagonist |
| 5298 | Ephrin receptor | CHEMBL2363043 | 5443, 5445-5456 | Inhibitor |
| 5298 | Epidermal growth factor receptor | CHEMBL2363049 | 5466, 5520-5522 | Inhibitor |
| 5298 | Tyrosine-protein kinase BRK | CHEMBL4601 | 13731 | Inhibitor |
| 5298 | Tyrosine-protein kinase receptor RET | CHEMBL2041 | 14404 | Inhibitor |
| 5298 | Tyrosine-protein kinase SRC | CHEMBL267 | 16684 | Inhibitor |
| 5298 | Tyrosine-protein kinase TIE-2 | CHEMBL4128 | 17514 | Inhibitor |
| 5298 | Vascular endothelial growth factor receptor | CHEMBL2095227 | 6336, 6339, 9005 | Inhibitor |
| 5300 | Frizzled-1 | CHEMBL2346493 | 6453 | Antagonist |
| 5300 | Frizzled-2 | CHEMBL3559686 | 6455 | Antagonist |
| 5300 | Frizzled-5 | CHEMBL3559687 | 6458 | Antagonist |
| 5300 | Frizzled-7 | CHEMBL3559688 | 6460 | Antagonist |
| 5300 | Frizzled-8 | CHEMBL3559689 | 6461 | Antagonist |
| 5301 | Histamine H1 receptor | CHEMBL231 | 7620 | Antagonist |
| 5302 | Somatostatin receptor 2 | CHEMBL1804 | 16391 | Agonist |
| 5302 | Somatostatin receptor 3 | CHEMBL2028 | 16392 | Agonist |
| 5302 | Somatostatin receptor 5 | CHEMBL1792 | 16394 | Agonist |
| 5303 | Phosphodiesterase 5A | CHEMBL1827 | 12560 | Inhibitor |
| 5304 | Neuronal acetylcholine receptor; alpha4/beta2 | CHEMBL1907589 | 2945, 2951 | Agonist |
| 5305 | Epidermal growth factor receptor erbB1 | CHEMBL203 | 5466 | Inhibitor |
| 5305 | Receptor protein-tyrosine kinase erbB-2 | CHEMBL1824 | 5520 | Inhibitor |

TABLE 3-continued

Ligand sets

| Ligand No. | Target Name | Target ChEMBL ID | Payload ID | Action type |
|---|---|---|---|---|
| 5306 | Vasopressin receptor | CHEMBL2363078 | 1343-1345 | Agonist |
| 5307 | Vasopressin V1a receptor | CHEMBL1889 | 1343 | Agonist |
| 5307 | Vasopressin V1b receptor | CHEMBL1921 | 1344 | Agonist |
| 5307 | Vasopressin V2 receptor | CHEMBL1790 | 1345 | Agonist |
| 5308 | Macrophage colony stimulating factor receptor | CHEMBL1844 | 3854 | Inhibitor |
| 5308 | Platelet-derived growth factor receptor | CHEMBL2095189 | 12773, 12774 | Inhibitor |
| 5308 | Stem cell growth factor receptor | CHEMBL1936 | 19299 | Inhibitor |
| 5308 | Vascular endothelial growth factor receptor | CHEMBL2095227 | 6336, 6339, 9005 | Inhibitor |
| 5310 | Muscle-type nicotinic acetylcholine receptor | CHEMBL2362997 | 2941, 2950, 2954, 2955 2956 | Antagonist |
| 5311 | Integrin alpha-4/beta-7 | CHEMBL2095184 | 8298, 8316 | Inhibitor |
| 5313 | Glucocerebroside | CHEMBL2364176 |  | Hydrolytic enzyme |
| 5314 | Calcium sensing receptor | CHEMBL1878 | 2171 | Agonist |
| 5315 | Neuropeptide Y receptor type 5 | CHEMBL4561 | 11133 | Antagonist |
| 5316 | Serotonin 4 (5-HT4) receptor | CHEMBL1875 | 74 | Agonist |
| 5317 | Serine/threonine-protein kinase B-raf | CHEMBL5145 | 1924 | Inhibitor |
| 5318 | Norepinephrine transporter | CHEMBL222 | 16329 | Inhibitor |
| 5318 | Serotonin transporter | CHEMBL228 | 16331 | Inhibitor |
| 5319 | Voltage-gated L-type calcium channel | CHEMBL2095229 | 2138-2141 | Blocker |
| 5322 | C-C chemokine receptor type 9 | CHEMBL5815 | 2868 | Antagonist |
| 5323 | Rho-associated protein kinase | CHEMBL2111459 | 14557, 14558 | Inhibitor |
| 5324 | DNA | CHEMBL2311221 |  | Inhibitor |
| 5325 | Corticotropin releasing factor receptor 1 | CHEMBL1800 | 3994 | Antagonist |
| 5326 | Neurokinin 1 receptor | CHEMBL249 | 17315 | Antagonist |
| 5329 | Beta-3 adrenergic receptor | CHEMBL246 | 774 | Agonist |
| 5330 | C-C chemokine receptor type 5 | CHEMBL274 | 2864 | Antagonist |
| 5332 | G protein-coupled receptor 44 | CHEMBL5071 | 13445 | Antagonist |
| 5332 | Prostanoid DP receptor | CHEMBL4427 | 13444 | Antagonist |
| 5333 | Gamma-amino-N-butyrate transaminase | CHEMBL2044 | 47 | Inhibitor |
| 5334 | Beta-2 adrenergic receptor | CHEMBL210 | 773 | Agonist |
| 5335 | Serotonin 1a (5-HT1a) receptor | CHEMBL214 | 61 | Partial agonist |
| 5335 | Serotonin transporter | CHEMBL228 | 16331 | Inhibitor |
| 5337 | Tubulin | CHEMBL2095182 | 18669-18675, 18679-18687 | Inhibitor |
| 5338 | Tubulin | CHEMBL2095182 | 18669-18675, 18679-18687 | Inhibitor |
| 5341 | Tubulin | CHEMBL2095182 | 18669-18675, 18679-18687 | Inhibitor |
| 5345 | Adenosine A2a receptor | CHEMBL251 | 625 | Antagonist |
| 5349 | Smoothened homolog | CHEMBL5971 | 15967 | Inhibitor |
| 5355 | Androgen Receptor | CHEMBL1871 | 1034 | Modulator |
| 5357 | Neurokinin 1 receptor | CHEMBL249 | 17315 | Antagonist |
| 5359 | Serine/threonine-protein kinase PLK1 | CHEMBL3024 | 12860 | Inhibitor |
| 5360 | Serotonin 2a (5-HT2a) receptor | CHEMBL224 | 66 | Antagonist |
| 5361 | Proteinase-activated receptor 1 | CHEMBL3974 | 3584 | Antagonist |
| 5363 | Histone deacetylase 1 | CHEMBL325 | 7713 | Inhibitor |
| 5363 | Histone deacetylase 2 | CHEMBL1937 | 7716 | Inhibitor |
| 5363 | Histone deacetylase 3 | CHEMBL1829 | 7717 | Inhibitor |
| 5363 | Histone deacetylase 6 | CHEMBL1865 | 7720 | Inhibitor |
| 5364 | Serotonin 1a (5-HT1a) receptor | CHEMBL214 | 61 | Agonist |
| 5364 | Serotonin 3a (5-HT3a) receptor | CHEMBL1899 | 69 | Antagonist |
| 5364 | Serotonin transporter | CHEMBL228 | 16331 | Inhibitor |
| 5365 | Cyclin-dependent kinase 4 | CHEMBL331 | 4287 | Inhibitor |
| 5366 | PI3-kinase class I | CHEMBL3559703 | 12526-12529, 12596-12598, 12601 | Inhibitor |
| 5366 | Serine/threonine-protein kinase mTOR | CHEMBL2842 | 9934 | Inhibitor |
| 5368 | Focal adhesion kinase 1 | CHEMBL2695 | 13729 | Inhibitor |
| 5369 | PI3-kinase class I | CHEMBL3559703 | 12526-12529, 12596-12598, 12601 | Inhibitor |
| 5369 | Serine/threonine-protein kinase mTOR | CHEMBL2842 | 9934 | Inhibitor |
| 5371 | MAP kinase p38 alpha | CHEMBL260 | 10445 | Inhibitor |
| 5372 | MAP kinase p38 alpha | CHEMBL260 | 10445 | Inhibitor |
| 5374 | Serine-protein kinase ATR | CHEMBL5024 | 1645 | Inhibitor |
| 5375 | Vitamin k epoxide reductase complex subunit 1 isoform 1 | CHEMBL1930 | 19294 | Inhibitor |
| 5378 | Tyrosine-protein kinase JAK3 | CHEMBL2148 | 8597 | Inhibitor |
| 5383 | PI3-kinase class I | CHEMBL3559703 | 12526-12529, 12596-12598, 12601 | Inhibitor |

TABLE 3-continued

Ligand sets

| Ligand No. | Target Name | Target ChEMBL ID | Payload ID | Action type |
|---|---|---|---|---|
| 5384 | Dual specificity mitogen-activated protein kinase kinase 1 | CHEMBL3587 | 10458 | Inhibitor |
| 5384 | Dual specificity mitogen-activated protein kinase kinase 2 | CHEMBL2964 | 10459 | Inhibitor |
| 5387 | ALK tyrosine kinase receptor | CHEMBL4247 | 1032 | Inhibitor |
| 5388 | Platelet-derived growth factor receptor | CHEMBL2095189 | 12773, 12774 | Inhibitor |
| 5388 | Vascular endothelial growth factor receptor | CHEMBL2095227 | 6336, 6339, 9005 | Inhibitor |
| 5391 | Sodium channel protein type IX alpha subunit | CHEMBL4296 | 15997 | Blocker |
| 5394 | Tyrosine-protein kinase JAK2 | CHEMBL2971 | 8596 | Inhibitor |
| 5398 | Insulin-like growth factor I receptor | CHEMBL1957 | 8256 | Inhibitor |
| 5398 | SRC | CHEMBL2363074 | 1864, 6212, 6514, 6515, 7387, 9206, 9637, 16684, 16687, 19589 | Inhibitor |
| 5398 | Tyrosine-protein kinase ABL | CHEMBL1862 | 149 | Inhibitor |
| 5400 | Serine/threonine-protein kinase B-raf | CHEMBL5145 | 1924 | Inhibitor |
| 5400 | Serine/threonine-protein kinase RAF | CHEMBL1906 | 14116 | Inhibitor |
| 5402 | Ribosomal protein S6 kinase (P70S6K) | CHEMBL2111330 | 14707, 14708 | Inhibitor |
| 5402 | Serine/threonine-protein kinase AKT | CHEMBL2111353 | 19217-19219 | Inhibitor |
| 5403 | Mineralocorticoid receptor | CHEMBL1994 | 11443 | Antagonist |
| 5408 | Platelet-derived growth factor receptor | CHEMBL2095189 | 12773, 12774 | Inhibitor |
| 5408 | Stem cell growth factor receptor | CHEMBL1936 | 19299 | Inhibitor |
| 5408 | Vascular endothelial growth factor receptor | CHEMBL2095227 | 6336, 6339, 9005 | Inhibitor |
| 5410 | Serine/threonine-protein kinase Chk1 | CHEMBL4630 | 2825 | Inhibitor |
| 5410 | Serine/threonine-protein kinase Chk2 | CHEMBL2527 | 2826 | Inhibitor |
| 5413 | Fibroblast growth factor receptor | CHEMBL2095217 | 6253-6256 | Inhibitor |
| 5413 | Platelet-derived growth factor receptor | CHEMBL2095189 | 12773, 12774 | Inhibitor |
| 5413 | Stem cell growth factor receptor | CHEMBL1936 | 19299 | Inhibitor |
| 5413 | Tyrosine-protein kinase receptor FLT3 | CHEMBL1974 | 6337 | Inhibitor |
| 5413 | Vascular endothelial growth factor receptor | CHEMBL2095227 | 6336, 6339, 9005 | Inhibitor |
| 5423 | Rho-associated protein kinase | CHEMBL2111459 | 14557, 14558 | Inhibitor |
| 5428 | B-lymphocyte antigen CD20 | CHEMBL2058 | 10070 | Binding agent |
| 5429 | Voltage-gated N-type calcium channel alpha-1B subunit | CHEMBL4478 | 2142 | Blocker |
| 5430 | Cysteinyl leukotriene receptor 1 | CHEMBL1798 | 4363 | Antagonist |
| 5433 | GABA A receptor alpha-1/beta-1/gamma-2 | CHEMBL2111392 | 6682, 6688, 6694 | Positive allosteric modulator |
| 5436 | Vascular endothelial growth factor receptor 2 | CHEMBL279 | 9005 | Inhibitor |
| 5439 | Endothelin receptor ET-A | CHEMBL252 | 5399 | Antagonist |
| 5440 | Voltage-gated N-type calcium channel alpha-1B subunit | CHEMBL4478 | 2142 | Blocker |
| 5442 | Arachidonate 5-lipoxygenase | CHEMBL215 | 1310 | Inhibitor |
| 5446 | Dopamine D2 receptor | CHEMBL217 | 5041 | Antagonist |
| 5446 | Serotonin 2a (5-HT2a) receptor | CHEMBL224 | 66 | Antagonist |
| 5446 | Serotonin 2c (5-HT2c) receptor | CHEMBL225 | 68 | Antagonist |
| 5452 | Farnesyl diphosphate synthase | CHEMBL1782 | 6021 | Inhibitor |
| 5453 | Serotonin 1b (5-HT1b) receptor | CHEMBL1898 | 62 | Agonist |
| 5453 | Serotonin 1d (5-HT1d) receptor | CHEMBL1983 | 63 | Agonist |
| 5454 | GABA A receptor alpha-1/beta-1/gamma-2 | CHEMBL2111392 | 6682, 6688, 6694 | Positive allosteric modulator |
| 5456 | Sodium channel alpha subunit | CHEMBL2331043 | 15989, 15991, 15993, 15995, 15997-16001, 16002 | Blocker |
| 5458 | Gonadotropin-releasing hormone receptor | CHEMBL1855 | 7145 | Agonist |
| 5460 | PI3-kinase class I | CHEMBL3559703 | 12526-12529, 12596-12598, 12601 | Inhibitor |
| 5462 | Peroxisome proliferator-activated receptor alpha | CHEMBL239 | 12426 | Agonist |
| 5911 | 3-phosphoinositide dependent protein kinase-1 | CHEMBL2534 | 46 | Inhibitor |

TABLE 3-continued

Ligand sets

| Ligand No. | Target Name | Target ChEMBL ID | Payload ID | Action type |
|---|---|---|---|---|
| 5911 | Cyclin-dependent kinase 2 | CHEMBL301 | 4281 | Inhibitor |
| 5911 | Cyclin-dependent kinase 4 | CHEMBL331 | 4287 | Inhibitor |
| 5911 | Cyclin-dependent kinase 6 | CHEMBL2508 | 4291 | Inhibitor |
| 5911 | Protein kinase C (PKC) | CHEMBL2093867 | 13588-13590, 13592-13598, 13600 | Inhibitor |
| 5911 | Serine/threonine-protein kinase Chk1 | CHEMBL4630 | 2825 | Inhibitor |
| 6672 | Vitamin D receptor | CHEMBL1977 | 19293 | Agonist |
| 7535 | Tyrosine-protein kinase receptor FLT3 | CHEMBL1974 | 6337 | Inhibitor |
| 7535 | Vascular endothelial growth factor receptor | CHEMBL2095227 | 6336, 6339, 9005 | Inhibitor |

Destabilizing Domains as Stimulus Response Elements (SREs)

Destabilizing domains described herein or known in the art may be used as SREs in the biocircuits of the present invention in association with any of the payloads taught herein. The presence, absence or an amount of a small molecule ligand that binds to or interacts with the DD, can, upon such binding or interaction modulate the stability of the payload(s) and consequently the function of the payload. Depending on the degree of binding and/or interaction the altered function of the payload may vary, hence providing a "tuning" of the payload function. Table 4 lists a number of DDs which may be used.

TABLE 4

Destabilizing Domains (SREs)

| SRE No. | SRE Name |
|---|---|
| 1 | Human DHFR (hDHFR) |
| 2 | Human DHFR methotrexate stabilized |
| 3 | Human DHFR trimethoprim stabilized |
| 4 | E. coli DHFR |
| 5 | FKBP |
| 6 | PDE5 Catalytic domain |
| 7 | PPAR gamma ligand binding domain |
| 8 | Carbonic Anhydrase 2 (CA2) |
| 9 | Carbonic Anhydrase 2 acetazolamide stabilized |
| 10 | Carbonic Anhydrase 2 celecoxib stabilized |
| 11 | NAD(P)H Dehydrogenase, Quinone 2 (NQO2) |
| 12 | HMG-CoAR |

Antibodies as Payloads

In some embodiments, antibodies or fragments thereof may be utilized as payloads. Table 5 provides a list of antibodies which may form all or a portion of the payload region of an effector module of the invention or a reference sequence for the design or an SRE or other payload.

TABLE 5

Antibodies

| Antibody No. | Antibody Name | Chembl No. | Species | SEQ ID NO |
|---|---|---|---|---|
| 1 | (3E)-hex-3-enoylsomatoliberin | CHEMBL1237026 | Homo sapiens | 204901 |
| 2 | [23-methionine]-23-163-fibroblast growth factor 7 | CHEMBL1201821 | Homo sapiens | 204902 |
| 3 | Abaloparatide | CHEMBL3301581 | | 204903 |
| 4 | Abatacept fusion protein | CHEMBL1201823 | Homo sapiens | 204904 |
| 5 | Abciximab heavy chain | CHEMBL1201584 | | 204905 |
| 5 | Abciximab light chain | CHEMBL1201584 | | 204906 |
| 6 | Abrilumab heavy chain | CHEMBL3137351 | Homo sapiens | 204907 |
| 6 | Abrilumab light chain | CHEMBL3137351 | Homo sapiens | 204908 |
| 7 | Aducanumab heavy chain | CHEMBL3039540 | Homo sapiens | 204909 |
| 7 | Aducanumab light chain | CHEMBL3039540 | Homo sapiens | 204910 |
| 8 | Aflibercept fusion protein | CHEMBL1742982 | | 204911 |
| 9 | Alacizumab pegol f(ab')2 fragment | CHEMBL1742983 | | 204912 |
| 9 | Alacizumab pegol light chain | CHEMBL1742983 | | 204913 |
| 10 | Alefacept heavy chain | CHEMBL1201571 | | 204914 |
| 10 | Alefacept light chain | CHEMBL1201571 | Homo sapiens | 204915 |
| 11 | Alemtuzumab heavy chain | CHEMBL1201587 | | 204916 |
| 11 | Alemtuzumab light chain | CHEMBL1201587 | | 204917 |
| 12 | Alirocumab heavy chain | CHEMBL2109540 | Homo sapiens | 204918 |
| 12 | Alirocumab light chain | CHEMBL2109540 | Homo sapiens | 204919 |
| 13 | Alpha-amylase 2B precursor | CHEMBL1201648 | Homo sapiens | 204920 |
| 14 | Alpha-L-iduronidase precursor | CHEMBL1201595 | Homo sapiens | 204921 |
| 15 | Amatuximab heavy chain | CHEMBL1742984 | | 204922 |
| 15 | Amatuximab light chain | CHEMBL1742984 | | 204923 |
| 16 | Andexanet alfa | CHEMBL3301583 | | 204924 |
| 17 | Anrukinzumab heavy chain | CHEMBL1742985 | | 204925 |
| 17 | Anrukinzumab light chain | CHEMBL1742985 | | 204926 |
| 18 | Antithrombin-III precursor | CHEMBL1201554 | Homo sapiens | 204927 |
| 19 | Asfotase alfa fusion protein | CHEMBL2108311 | | 204928 |

TABLE 5-continued

Antibodies

| Antibody No. | Antibody Name | Chembl No. | Species | SEQ ID NO |
|---|---|---|---|---|
| 20 | Atacicept fusion protein | CHEMBL1742986 | | 204929 |
| 21 | Atinumab heavy chain | CHEMBL1742987 | Homo sapiens | 204930 |
| 21 | Atinumab light chain | CHEMBL1742987 | Homo sapiens | 204931 |
| 22 | Baminercept fusion protein | CHEMBL1742988 | | 204932 |
| 23 | Basiliximab heavy chain | CHEMBL1201439 | | 204933 |
| 23 | Basiliximab light chain | CHEMBL1201439 | | 204934 |
| 24 | Bavituximab heavy chain | CHEMBL1742989 | | 204935 |
| 24 | Bavituximab light chain | CHEMBL1742989 | | 204936 |
| 25 | Belatacept fusion protein | CHEMBL1742990 | | 204937 |
| 26 | Benralizumab heavy chain | CHEMBL1742991 | Homo sapiens | 204938 |
| 26 | Benralizumab light chain | CHEMBL1742991 | Homo sapiens | 204939 |
| 27 | Bevacizumab heavy chain | CHEMBL1201583 | | 204940 |
| 27 | Bevacizumab light chain | CHEMBL1201583 | | 204941 |
| 28 | Bezlotoxumab heavy chain | CHEMBL2108670 | Homo sapiens | 204942 |
| 28 | Bezlotoxumab light chain | CHEMBL2108670 | Homo sapiens | 204943 |
| 29 | Bimagrumab heavy chain | CHEMBL3137353 | Homo sapiens | 204944 |
| 29 | Bimagrumab light chain | CHEMBL3137353 | Homo sapiens | 204945 |
| 30 | Blinatumumab single chain variable fragment fusion protein (bite) | CHEMBL1742992 | Homo sapiens | 204946 |
| 31 | Blisibimod fusion protein | CHEMBL2107877 | | 204947 |
| 32 | BLONTUVETMAB HEAVY chain | CHEMBL3544990 | | 204948 |
| 32 | BLONTUVETMAB LIGHT chain | CHEMBL3544990 | | 204949 |
| 33 | Blosozumab heavy chain | CHEMBL1742993 | | 204950 |
| 33 | Blosozumab light chain | CHEMBL1742993 | | 204951 |
| 34 | Bococizumab heavy chain | CHEMBL3137349 | | 204952 |
| 34 | Bococizumab light chain | CHEMBL3137349 | | 204953 |
| 35 | Brentuximab vedotin heavy chain | CHEMBL1742994 | | 204954 |
| 35 | Brentuximab vedotin light chain | CHEMBL1742994 | | 204955 |
| 36 | Briakinumab heavy chain | CHEMBL1742995 | Homo sapiens | 204956 |
| 36 | Briakinumab light chain | CHEMBL1742995 | Homo sapiens | 204957 |
| 37 | Brodalumab heavy chain | CHEMBL1742996 | Homo sapiens | 204958 |
| 37 | Brodalumab light chain | CHEMBL1742996 | Homo sapiens | 204959 |
| 38 | BRONTICTUZUMAB HEAVY chain | CHEMBL3545261 | | 204960 |
| 38 | BRONTICTUZUMAB LIGHT chain | CHEMBL3545261 | | 204961 |
| 39 | Calcitonin precursor | CHEMBL1201614 | Homo sapiens | 204962 |
| 40 | Canakinumab heavy chain | CHEMBL1201834 | Homo sapiens | 204963 |
| 40 | Canakinumab light chain | CHEMBL1201834 | Homo sapiens | 204964 |
| 41 | Cantuzumab ravtansine heavy chain | CHEMBL1742998 | | 204965 |
| 41 | Cantuzumab ravtansine heavy chain | CHEMBL1742997 | | 204966 |
| 41 | Cantuzumab ravtansine light chain | CHEMBL1742998 | | 204967 |
| 41 | Cantuzumab ravtansine light chain | CHEMBL1742997 | | 204968 |
| 42 | Caplacizumab | CHEMBL2109624 | | 204969 |
| 43 | Carlumab heavy chain | CHEMBL1742999 | Homo sapiens | 204970 |
| 43 | Carlumab light chain | CHEMBL1742999 | Homo sapiens | 204971 |
| 44 | Cerliponase alfa | CHEMBL3544921 | | 204972 |
| 45 | Cetuximab heavy chain | CHEMBL1201577 | | 204973 |
| 45 | Cetuximab light chain | CHEMBL1201577 | | 204974 |
| 46 | Choriogonadotropin beta chain | CHEMBL1201509 | Homo sapiens | 204975 |
| 46 | Choriogonadotropin beta chain | CHEMBL1201464 | Homo sapiens | 204976 |
| 47 | Cimaglermin alfa (glial growth factor 2) | CHEMBL3039542 | Homo sapiens | 204977 |
| 48 | Citatuzumab bogatox heavy chain | CHEMBL1743000 | | 204978 |
| 48 | Citatuzumab bogatox light chain-toxin | CHEMBL1743000 | | 204979 |
| 49 | Cixutumumab heavy chain | CHEMBL1743001 | Homo sapiens | 204980 |
| 49 | Cixutumumab light chain | CHEMBL1743001 | Homo sapiens | 204981 |
| 50 | Clazakizumab heavy chain | CHEMBL2108589 | | 204982 |
| 50 | Clazakizumab light chain | CHEMBL2108589 | | 204983 |
| 51 | Clivatuzumab tetraxetan heavy chain | CHEMBL3301586 | | 204984 |
| 51 | Clivatuzumab tetraxetan light chain | CHEMBL3301586 | | 204985 |
| 52 | Conatumumab heavy chain | CHEMBL1743003 | Homo sapiens | 204986 |
| 52 | Conatumumab light chain | CHEMBL1743003 | Homo sapiens | 204987 |
| 53 | Conbercept fusion protein | CHEMBL2108313 | | 204988 |
| 54 | Corticoliberin precursor | CHEMBL1201591 | Homo sapiens | 204989 |
| 55 | Corticotropin-lipotropin precursor | CHEMBL1201489 | Homo sapiens | 204990 |
| 55 | Corticotropin-lipotropin precursor | CHEMBL1201610 | Homo sapiens | 204991 |
| 55 | Corticotropin-lipotropin precursor | CHEMBL1201609 | Homo sapiens | 204992 |
| 56 | Crenezumab heavy chain | CHEMBL1743004 | | 204993 |
| 56 | Crenezumab light chain | CHEMBL1743004 | | 204994 |
| 57 | Dacetuzumab heavy chain | CHEMBL1743005 | | 204995 |
| 57 | Dacetuzumab light chain | CHEMBL1743005 | | 204996 |
| 58 | Daclizumab heavy chain | CHEMBL1201605 | | 204997 |
| 58 | Daclizumab light chain | CHEMBL1201605 | | 204998 |
| 59 | Dalotuzumab heavy chain | CHEMBL1743006 | | 204999 |
| 59 | Dalotuzumab light chain | CHEMBL1743006 | | 205000 |
| 60 | Daratumumab heavy chain | CHEMBL1743007 | Homo sapiens | 205001 |
| 60 | Daratumumab light chain | CHEMBL1743007 | Homo sapiens | 205002 |
| 61 | Delantercept fusion protein | CHEMBL2109662 | | 205003 |

TABLE 5-continued

Antibodies

| Antibody No. | Antibody Name | Chembl No. | Species | SEQ ID NO |
|---|---|---|---|---|
| 62 | Demcizumab heavy chain | CHEMBL2109384 | | 205004 |
| 62 | Demcizumab light chain | CHEMBL2109384 | | 205005 |
| 63 | DENINTUZUMAB HEAVY chain | CHEMBL3544992 | | 205006 |
| 63 | DENINTUZUMAB LIGHT chain | CHEMBL3544992 | | 205007 |
| 64 | Deoxyribonuclease I precursor | CHEMBL1201431 | Homo sapiens | 205008 |
| 65 | Dinutuximab heavy chain | CHEMBL3137342 | | 205009 |
| 65 | Dinutuximab light chain | CHEMBL3137342 | | 205010 |
| 66 | Diridavumab heavy chain | CHEMBL3137350 | Homo sapiens | 205011 |
| 66 | Diridavumab light chain | CHEMBL3137350 | Homo sapiens | 205012 |
| 67 | DOMAGROZUMAB HEAVY chain | CHEMBL3544991 | | 205013 |
| 67 | DOMAGROZUMAB LIGHT chain | CHEMBL3544991 | | 205014 |
| 68 | Drozitumab heavy chain | CHEMBL1743008 | Homo sapiens | 205015 |
| 68 | Drozitumab light chain | CHEMBL1743008 | Homo sapiens | 205016 |
| 69 | Duligotumab heavy chain | CHEMBL2109405 | Homo sapiens | 205017 |
| 69 | Duligotumab light chain | CHEMBL2109405 | Homo sapiens | 205018 |
| 70 | Duligotuzumab heavy chain | CHEMBL3137345 | | 205019 |
| 70 | Duligotuzumab light chain | CHEMBL3137345 | | 205020 |
| 71 | Durvalumab heavy chain | CHEMBL3301587 | Homo sapiens | 205021 |
| 71 | Durvalumab light chain | CHEMBL3301587 | Homo sapiens | 205022 |
| 72 | Ecallantide peptide | CHEMBL1201837 | Homo sapiens | 205023 |
| 73 | Efungumab single chain variable fragment | CHEMBL1743009 | Homo sapiens | 205024 |
| 74 | Elotuzumab heavy chain | CHEMBL1743010 | | 205025 |
| 74 | Elotuzumab light chain | CHEMBL1743010 | | 205026 |
| 75 | EMACTUZUMAB HEAVY chain | CHEMBL3545370 | | 205027 |
| 75 | EMACTUZUMAB LIGHT chain | CHEMBL3545370 | | 205028 |
| 76 | Emibetuzumab heavy chain | CHEMBL3301578 | | 205029 |
| 76 | Emibetuzumab light chain | CHEMBL3301578 | | 205030 |
| 77 | Enavatuzumab heavy chain | CHEMBL1743011 | | 205031 |
| 77 | Enavatuzumab light chain | CHEMBL1743011 | | 205032 |
| 78 | Enfortumab heavy chain | CHEMBL3301579 | Homo sapiens | 205033 |
| 78 | Enfortumab light chain | CHEMBL3301579 | Homo sapiens | 205034 |
| 79 | Enfortumab vedotin heavy chain | CHEMBL3301589 | Homo sapiens | 205035 |
| 79 | Enfortumab vedotin light chain | CHEMBL3301589 | Homo sapiens | 205036 |
| 80 | Enfuvirtide peptide | CHEMBL525076 | | 205037 |
| 81 | ENOBLITUZUMAB HEAVY chain | CHEMBL3545373 | | 205038 |
| 81 | ENOBLITUZUMAB LIGHT chain | CHEMBL3545373 | | 205039 |
| 82 | Enokizumab heavy chain | CHEMBL1743012 | | 205040 |
| 82 | Enokizumab light chain | CHEMBL1743012 | | 205041 |
| 83 | Enoticumab heavy chain | CHEMBL2109385 | Homo sapiens | 205042 |
| 83 | Enoticumab light chain | CHEMBL2109385 | Homo sapiens | 205043 |
| 84 | Ensituximab heavy chain | CHEMBL1743013 | | 205044 |
| 84 | Ensituximab light chain | CHEMBL1743013 | | 205045 |
| 85 | Erythropoietin precursor | CHEMBL1201566 | Homo sapiens | 205046 |
| 85 | Erythropoietin precursor | CHEMBL1201565 | Homo sapiens | 205047 |
| 86 | Etaracizumab heavy chain | CHEMBL1743014 | | 205048 |
| 86 | Etaracizumab light chain | CHEMBL1743014 | | 205049 |
| 87 | Etrolizumab heavy chain | CHEMBL1743015 | | 205050 |
| 87 | Etrolizumab light chain | CHEMBL1743015 | | 205051 |
| 88 | EVINACUMAB HEAVY chain | CHEMBL3545191 | | 205052 |
| 88 | EVINACUMAB LIGHT chain | CHEMBL3545191 | | 205053 |
| 89 | Farletuzumab heavy chain | CHEMBL1743016 | | 205054 |
| 89 | Farletuzumab light chain | CHEMBL1743016 | | 205055 |
| 90 | Fasinumab heavy chain | CHEMBL2109528 | Homo sapiens | 205056 |
| 90 | Fasinumab light chain | CHEMBL2109528 | Homo sapiens | 205057 |
| 91 | Fezakinumab heavy chain | CHEMBL1743017 | Homo sapiens | 205058 |
| 91 | Fezakinumab light chain | CHEMBL1743017 | Homo sapiens | 205059 |
| 92 | Fibrinogen alpha/alpha-E chain precursor | CHEMBL1201504 | Homo sapiens | 205060 |
| 93 | Ficlatuzumab heavy chain | CHEMBL1743018 | | 205061 |
| 93 | Ficlatuzumab light chain | CHEMBL1743018 | | 205062 |
| 94 | Figitumumab heavy chain | CHEMBL1743019 | Homo sapiens | 205063 |
| 94 | Figitumumab light chain | CHEMBL1743019 | Homo sapiens | 205064 |
| 95 | Flanvotumab heavy chain | CHEMBL2108734 | Homo sapiens | 205065 |
| 95 | Flanvotumab light chain | CHEMBL2108734 | Homo sapiens | 205066 |
| 96 | Fletikumab heavy chain | CHEMBL3301580 | Homo sapiens | 205067 |
| 96 | Fletikumab light chain | CHEMBL3301580 | Homo sapiens | 205068 |
| 97 | Follitropin beta chain precursor | CHEMBL1201692 | Homo sapiens | 205069 |
| 97 | Follitropin beta chain precursor | CHEMBL1201622 | Homo sapiens | 205070 |
| 97 | Follitropin beta chain precursor | CHEMBL1201520 | Homo sapiens | 205071 |
| 98 | Foralumab heavy chain | CHEMBL1743020 | Homo sapiens | 205072 |
| 98 | Foralumab light chain | CHEMBL1743020 | Homo sapiens | 205073 |
| 99 | Foravirumab heavy chain | CHEMBL1743021 | Homo sapiens | 205074 |
| 99 | Foravirumab light chain | CHEMBL1743021 | Homo sapiens | 205075 |
| 100 | Fresolimumab heavy chain | CHEMBL1743022 | Homo sapiens | 205076 |
| 100 | Fresolimumab light chain | CHEMBL1743022 | Homo sapiens | 205077 |
| 101 | Fulranumab heavy chain | CHEMBL1743023 | Homo sapiens | 205078 |
| 101 | Fulranumab light chain | CHEMBL1743023 | Homo sapiens | 205079 |

TABLE 5-continued

Antibodies

| Antibody No. | Antibody Name | Chembl No. | Species | SEQ ID NO |
|---|---|---|---|---|
| 102 | Fusion protein (human activin receptor type iib extracellular domain/igg1 Fc domain | CHEMBL3039545 | Homo sapiens | 205080 |
| 103 | Futuximab heavy chain | CHEMBL2109388 | | 205081 |
| 103 | Futuximab light chain | CHEMBL2109388 | | 205082 |
| 104 | Gantenerumab heavy chain | CHEMBL1743025 | Homo sapiens | 205083 |
| 104 | Gantenerumab light chain | CHEMBL1743025 | Homo sapiens | 205084 |
| 105 | Gevokizumab heavy chain | CHEMBL1743026 | | 205085 |
| 105 | Gevokizumab light chain | CHEMBL1743026 | | 205086 |
| 106 | Girentuximab heavy chain | CHEMBL1743027 | | 205087 |
| 106 | Girentuximab light chain | CHEMBL1743027 | | 205088 |
| 107 | Glembatumumab vedotin heavy chain | CHEMBL1743028 | Homo sapiens | 205089 |
| 107 | Glembatumumab vedotin light chain | CHEMBL1743028 | Homo sapiens | 205090 |
| 108 | Glucagon precursor | CHEMBL1201618 | Homo sapiens | 205091 |
| 108 | Glucagon precursor | CHEMBL1201508 | Homo sapiens | 205092 |
| 109 | Glucosylceramidase precursor | CHEMBL1201632 | Homo sapiens | 205093 |
| 109 | Glucosylceramidase precursor | CHEMBL1201633 | Homo sapiens | 205094 |
| 110 | Glycoprotein hormones alpha chain | CHEMBL1201509 | Homo sapiens | 205095 |
| 110 | Glycoprotein hormones alpha chain | CHEMBL1201464 | Homo sapiens | 205096 |
| 111 | Granulocyte colony-stimulating factor precursor | CHEMBL1201567 | Homo sapiens | 205097 |
| 111 | Granulocyte colony-stimulating factor precursor | CHEMBL1201568 | Homo sapiens | 205098 |
| 112 | Granulocyte-macrophage colony-stimulating factor | CHEMBL1201670 | Homo sapiens | 205099 |
| 113 | Human glucosylceramidase | CHEMBL1201865 | Homo sapiens | 205100 |
| 114 | Human lysosomal prepro-alpha-glucosidase-(57-952)-peptide 199-arginine-223-histidine variant | CHEMBL1201824 | Homo sapiens | 205101 |
| 115 | Ibalizumab heavy chain | CHEMBL1743029 | | 205102 |
| 115 | Ibalizumab light chain | CHEMBL1743029 | | 205103 |
| 116 | Icrucumab heavy chain | CHEMBL1743030 | Homo sapiens | 205104 |
| 116 | Icrucumab light chain | CHEMBL1743030 | Homo sapiens | 205105 |
| 117 | IDARUCIZUMAB HEAVY chain FAB FRAGMENT | CHEMBL3544996 | | 205106 |
| 117 | IDARUCIZUMAB LIGHT chain | CHEMBL3544996 | | 205107 |
| 118 | Imgatuzumab heavy chain | CHEMBL2109389 | | 205108 |
| 118 | Imgatuzumab light chain | CHEMBL2109389 | | 205109 |
| 119 | Inclacumab heavy chain | CHEMBL2109488 | Homo sapiens | 205110 |
| 119 | Inclacumab light chain | CHEMBL2109488 | Homo sapiens | 205111 |
| 120 | Indatuximab ravtansine heavy chain | CHEMBL1743031 | | 205112 |
| 120 | Indatuximab ravtansine light chain | CHEMBL1743031 | | 205113 |
| 121 | Insulin-like growth factor IA | CHEMBL1201716 | Homo sapiens | 205114 |
| 121 | Insulin-like growth factor IA | CHEMBL1201717 | Homo sapiens | 205115 |
| 122 | Insulin-like growth factor-binding protein 3 [Precursor] | CHEMBL1201717 | | 205116 |
| 123 | Interferon alpha-2 precursor | CHEMBL1201561 | Homo sapiens | 205117 |
| 123 | Interferon alpha-2 precursor | CHEMBL1201557 | Homo sapiens | 205118 |
| 123 | Interferon alpha-2 precursor | CHEMBL1201560 | Homo sapiens | 205119 |
| 123 | Interferon alpha-2 precursor | CHEMBL1201558 | Homo sapiens | 205120 |
| 124 | Interferon beta precursor | CHEMBL1201563 | Homo sapiens | 205121 |
| 124 | Interferon beta precursor | CHEMBL1201562 | Homo sapiens | 205122 |
| 125 | Interferon gamma precursor | CHEMBL1201564 | Homo sapiens | 205123 |
| 126 | Interleukin-1 receptor antagonist protein precursor | CHEMBL1201570 | Homo sapiens | 205124 |
| 127 | Interleukin-11 precursor | CHEMBL1201573 | Homo sapiens | 205125 |
| 128 | Interleukin-2 precursor | CHEMBL1201438 | Homo sapiens | 205126 |
| 129 | Intetumumab heavy chain | CHEMBL1743032 | Homo sapiens | 205127 |
| 129 | Intetumumab light chain | CHEMBL1743032 | Homo sapiens | 205128 |
| 130 | IODINE I 131 DERLOTUXIMAB BIOTIN HEAVY chain | CHEMBL3544924 | | 205129 |
| 130 | IODINE I 131 DERLOTUXIMAB BIOTIN LIGHT chain | CHEMBL3544924 | | 205130 |
| 131 | Ipafricept | CHEMBL3301577 | Homo sapiens | 205131 |
| 132 | ISATUXIMAB HEAVY chain | CHEMBL3545131 | | 205132 |
| 132 | ISATUXIMAB LIGHT chain | CHEMBL3545131 | | 205133 |
| 133 | Isunakinra | CHEMBL3545190 | | 205134 |
| 134 | Itolizumab heavy chain | CHEMBL1743033 | | 205135 |
| 134 | Itolizumab light chain | CHEMBL1743033 | | 205136 |
| 135 | Ixekizumab heavy chain | CHEMBL1743034 | | 205137 |
| 135 | Ixekizumab light chain | CHEMBL1743034 | | 205138 |
| 136 | LABETUZUMAB GOVITECAN HEAVY chain | CHEMBL3544923 | | 205139 |
| 136 | LABETUZUMAB GOVITECAN LIGHT chain | CHEMBL3544923 | | 205140 |
| 137 | Lampalizumab heavy chain | CHEMBL2109408 | | 205141 |
| 137 | Lampalizumab light chain | CHEMBL2109408 | | 205142 |
| 138 | LANADELUMAB HEAVY chain | CHEMBL3545189 | | 205143 |
| 138 | LANADELUMAB LIGHT chain | CHEMBL3545189 | | 205144 |
| 139 | LANDOGROZUMAB HEAVY chain | CHEMBL3545072 | | 205145 |
| 139 | LANDOGROZUMAB LIGHT chain | CHEMBL3545072 | | 205146 |
| 140 | Lebrikizumab heavy chain | CHEMBL1743035 | | 205147 |
| 140 | Lebrikizumab light chain | CHEMBL1743035 | | 205148 |
| 141 | Lexatumumab heavy chain | CHEMBL1743036 | Homo sapiens | 205149 |
| 141 | Lexatumumab light chain | CHEMBL1743036 | Homo sapiens | 205150 |

TABLE 5-continued

Antibodies

| Antibody No. | Antibody Name | Chembl No. | Species | SEQ ID NO |
|---|---|---|---|---|
| 142 | LIFASTUZUMAB HEAVY chain | CHEMBL3545260 | | 205151 |
| 142 | LIFASTUZUMAB LIGHT chain | CHEMBL3545260 | | 205152 |
| 143 | Ligelizumab heavy chain | CHEMBL2109457 | | 205153 |
| 143 | Ligelizumab light chain | CHEMBL2109457 | | 205154 |
| 144 | Lirilumab heavy chain | CHEMBL2109500 | Homo sapiens | 205155 |
| 144 | Lirilumab light chain | CHEMBL2109500 | Homo sapiens | 205156 |
| 145 | Lorvotuzumab mertansine heavy chain | CHEMBL1743037 | | 205157 |
| 145 | Lorvotuzumab mertansine light chain | CHEMBL1743037 | | 205158 |
| 146 | Lucatumumab heavy chain | CHEMBL1743038 | Homo sapiens | 205159 |
| 146 | Lucatumumab light chain | CHEMBL1743038 | Homo sapiens | 205160 |
| 147 | Lulizumab pegol light chain | CHEMBL3137354 | | 205161 |
| 148 | Lutropin beta chain precursor | CHEMBL1201697 | Homo sapiens | 205162 |
| 148 | Lutropin beta chain precursor | CHEMBL1201419 | Homo sapiens | 205163 |
| 149 | Mavrilimumab heavy chain | CHEMBL1743039 | Homo sapiens | 205164 |
| 149 | Mavrilimumab light chain | CHEMBL1743039 | Homo sapiens | 205165 |
| 150 | Milatuzumab heavy chain | CHEMBL1743040 | | 205166 |
| 150 | Milatuzumab light chain | CHEMBL1743040 | | 205167 |
| 151 | MIRVETUXIMAB SORAVTANSINE HEAVY chain | CHEMBL3545132 | | 205168 |
| 151 | MIRVETUXIMAB SORAVTANSINE LIGHT chain | CHEMBL3545132 | | 205169 |
| 152 | Mogamulizumab heavy chain | CHEMBL1743041 | | 205170 |
| 152 | Mogamulizumab light chain | CHEMBL1743041 | | 205171 |
| 153 | Motavizumab heavy chain | CHEMBL1743042 | | 205172 |
| 153 | Motavizumab light chain | CHEMBL1743042 | | 205173 |
| 154 | N-acetylgalactosamine 4-sulfatase | CHEMBL1201822 | Homo sapiens | 205174 |
| 155 | Namilumab heavy chain | CHEMBL1743044 | Homo sapiens | 205175 |
| 155 | Namilumab light chain | CHEMBL1743044 | Homo sapiens | 205176 |
| 156 | Narnatumab heavy chain | CHEMBL1743046 | Homo sapiens | 205177 |
| 156 | Narnatumab light chain | CHEMBL1743046 | Homo sapiens | 205178 |
| 157 | Natriuretic peptides B | CHEMBL1201668 | Homo sapiens | 205179 |
| 158 | Necitumumab heavy chain | CHEMBL1743047 | Homo sapiens | 205180 |
| 158 | Necitumumab light chain | CHEMBL1743047 | Homo sapiens | 205181 |
| 159 | Nivolumab heavy chain | CHEMBL2108738 | Homo sapiens | 205182 |
| 159 | Nivolumab light chain | CHEMBL2108738 | Homo sapiens | 205183 |
| 160 | OBILTOXAXIMAB HEAVY chain | CHEMBL3544926 | | 205184 |
| 160 | OBILTOXAXIMAB LIGHT chain | CHEMBL3544926 | | 205185 |
| 161 | Obinutuzumab heavy chain | CHEMBL1743048 | | 205186 |
| 161 | Obinutuzumab light chain | CHEMBL1743048 | | 205187 |
| 162 | Ocaratuzumab heavy chain | CHEMBL2109665 | | 205188 |
| 162 | Ocaratuzumab light chain | CHEMBL2109665 | | 205189 |
| 163 | Olaratumab heavy chain | CHEMBL1743049 | Homo sapiens | 205190 |
| 163 | Olaratumab light chain | CHEMBL1743049 | Homo sapiens | 205191 |
| 164 | Olokizumab heavy chain | CHEMBL1743050 | | 205192 |
| 164 | Olokizumab light chain | CHEMBL1743050 | | 205193 |
| 165 | Omalizumab heavy chain | CHEMBL1201589 | | 205194 |
| 165 | Omalizumab light chain | CHEMBL1201589 | | 205195 |
| 166 | Onartuzumab heavy chain | CHEMBL1743051 | | 205196 |
| 167 | Onartuzumab hinge-CH2—CH3 | CHEMBL1743051 | | 205197 |
| 166 | Onartuzumab light chain | CHEMBL1743051 | | 205198 |
| 168 | OPICINUMAB HEAVY chain | CHEMBL3544922 | | 205199 |
| 168 | OPICINUMAB LIGHT chain | CHEMBL3544922 | | 205200 |
| 169 | Oportuzumab monatox single chain variable fragment | CHEMBL1743052 | | 205201 |
| 170 | Orticumab heavy chain | CHEMBL2109533 | Homo sapiens | 205202 |
| 170 | Orticumab light chain | CHEMBL2109533 | Homo sapiens | 205203 |
| 171 | Otelixizumab heavy chain | CHEMBL1743053 | | 205204 |
| 171 | Otelixizumab light chain | CHEMBL1743053 | | 205205 |
| 172 | Otlertuzumab | CHEMBL3039539 | | 205206 |
| 173 | Ozoralizumab scvh-VH'-VH chain | CHEMBL1743054 | | 205207 |
| 174 | Panobacumab heavy chain | CHEMBL1743055 | Homo sapiens | 205208 |
| 175 | Panobacumab j chain | CHEMBL1743055 | Homo sapiens | 205209 |
| 174 | Panobacumab light chain | CHEMBL1743055 | Homo sapiens | 205210 |
| 176 | Parathyroid hormone precursor | CHEMBL1201549 | Homo sapiens | 205211 |
| 177 | Parsatuzumab heavy chain | CHEMBL2109387 | | 205212 |
| 177 | Parsatuzumab light chain | CHEMBL2109387 | | 205213 |
| 178 | Pateclizumab heavy chain | CHEMBL1743056 | | 205214 |
| 178 | Pateclizumab light chain | CHEMBL1743056 | | 205215 |
| 179 | Patritumab heavy chain | CHEMBL2109406 | Homo sapiens | 205216 |
| 179 | Patritumab light chain | CHEMBL2109406 | Homo sapiens | 205217 |
| 180 | Pegargiminase fusion protein | CHEMBL3137346 | | 205218 |
| 181 | Pegloticase | CHEMBL1237025 | | 205219 |
| 182 | Pegsunercept fusion protein | CHEMBL1743057 | | 205220 |
| 183 | Pembrolizumab heavy chain | CHEMBL3137343 | | 205221 |
| 183 | Pembrolizumab light chain | CHEMBL3137343 | | 205222 |
| 184 | Perakizumab heavy chain | CHEMBL2109470 | | 205223 |
| 184 | Perakizumab light chain | CHEMBL2109470 | | 205224 |
| 185 | Pinatuzumab vedotin heavy chain | CHEMBL3301585 | | 205225 |

TABLE 5-continued

Antibodies

| Antibody No. | Antibody Name | Chembl No. | Species | SEQ ID NO |
|---|---|---|---|---|
| 185 | Pinatuzumab vedotin light chain | CHEMBL3301585 | | 205226 |
| 186 | Placulumab heavy chain | CHEMBL2108739 | Homo sapiens | 205227 |
| 187 | Platelet-derived growth factor, B chain precursor | CHEMBL1201556 | Homo sapiens | 205228 |
| 188 | Polatuzumab vedotin heavy chain | CHEMBL3301582 | | 205229 |
| 188 | Polatuzumab vedotin light chain | CHEMBL3301582 | | 205230 |
| 189 | Ponezumab heavy chain | CHEMBL1743058 | | 205231 |
| 189 | Ponezumab light chain | CHEMBL1743058 | | 205232 |
| 190 | Pramlintide acetate | CHEMBL1201669 | | 205233 |
| 191 | Progonadoliberin I precursor | CHEMBL1200516 | Homo sapiens | 205234 |
| 191 | Progonadoliberin I precursor | CHEMBL1200511 | Homo sapiens | 205235 |
| 191 | Progonadoliberin I precursor | CHEMBL1007 | Homo sapiens | 205236 |
| 192 | Quilizumab heavy chain | CHEMBL2109456 | | 205237 |
| 192 | Quilizumab light chain | CHEMBL2109456 | | 205238 |
| 193 | Radretumab scfv-CH chain | CHEMBL1743060 | Homo sapiens | 205239 |
| 194 | Rafivirumab heavy chain | CHEMBL1743061 | Homo sapiens | 205240 |
| 194 | Rafivirumab light chain | CHEMBL1743061 | Homo sapiens | 205241 |
| 195 | Ralpancizumab heavy chain | CHEMBL3137352 | | 205242 |
| 195 | Ralpancizumab light chain | CHEMBL3137352 | | 205243 |
| 196 | Ramucirumab heavy chain | CHEMBL1743062 | Homo sapiens | 205244 |
| 196 | Ramucirumab light chain | CHEMBL1743062 | Homo sapiens | 205245 |
| 197 | Ranibizumab fab fragment | CHEMBL1201825 | | 205246 |
| 198 | Ranibizumab light chain | CHEMBL1201825 | | 205247 |
| 199 | REFANEZUMAB HEAVY chain | CHEMBL3545317 | | 205248 |
| 199 | REFANEZUMAB LIGHT chain | CHEMBL3545317 | | 205249 |
| 200 | Riloacept fusion protein | CHEMBL1201830 | | 205250 |
| 201 | Rilotumumab heavy chain | CHEMBL1743063 | Homo sapiens | 205251 |
| 201 | Rilotumumab light chain | CHEMBL1743063 | Homo sapiens | 205252 |
| 202 | RINUCUMAB HEAVY chain | CHEMBL3545316 | | 205253 |
| 202 | RINUCUMAB LIGHT chain | CHEMBL3545316 | | 205254 |
| 203 | Rituximab heavy chain | CHEMBL1201576 | | 205255 |
| 203 | Rituximab light chain | CHEMBL1201576 | | 205256 |
| 204 | Robatumumab heavy chain | CHEMBL1743064 | Homo sapiens | 205257 |
| 204 | Robatumumab light chain | CHEMBL1743064 | Homo sapiens | 205258 |
| 205 | Roledumab heavy chain | CHEMBL1743065 | Homo sapiens | 205259 |
| 205 | Roledumab light chain | CHEMBL1743065 | Homo sapiens | 205260 |
| 206 | Romiplostim | CHEMBL1201832 | Homo sapiens | 205261 |
| 207 | Romosozumab heavy chain | CHEMBL2107874 | | 205262 |
| 207 | Romosozumab light chain | CHEMBL2107874 | | 205263 |
| 208 | Rontalizumab heavy chain | CHEMBL1743066 | | 205264 |
| 208 | Rontalizumab light chain | CHEMBL1743066 | | 205265 |
| 209 | SACITUZUMAB GOVITECAN HEAVY chain | CHEMBL3545262 | | 205266 |
| 209 | SACITUZUMAB GOVITECAN LIGHT chain | CHEMBL3545262 | | 205267 |
| 210 | Samalizumab heavy chain | CHEMBL1743067 | | 205268 |
| 210 | Samalizumab light chain | CHEMBL1743067 | | 205269 |
| 211 | Sarilumab heavy chain | CHEMBL2108730 | Homo sapiens | 205270 |
| 211 | Sarilumab light chain | CHEMBL2108730 | Homo sapiens | 205271 |
| 212 | Sebelipase alfa (human lysosomal acid lipase) | CHEMBL3039537 | Homo sapiens | 205272 |
| 213 | Secretin precursor | CHEMBL1201488 | Homo sapiens | 205273 |
| 214 | Secukinumab heavy chain | CHEMBL1743068 | Homo sapiens | 205274 |
| 214 | Secukinumab light chain | CHEMBL1743068 | Homo sapiens | 205275 |
| 215 | Senrebotase heavy chain | CHEMBL3137348 | | 205276 |
| 215 | Senrebotase light chain | CHEMBL3137348 | | 205277 |
| 216 | SERIBANTUMAB HEAVY chain | CHEMBL3545071 | | 205278 |
| 216 | SERIBANTUMAB LIGHT chain | CHEMBL3545071 | | 205279 |
| 217 | Serum albumin precursor | CHEMBL1201409 | Homo sapiens | 205280 |
| 217 | Serum albumin precursor | CHEMBL1201412 | Homo sapiens | 205281 |
| 217 | Serum albumin precursor | CHEMBL1201410 | Homo sapiens | 205282 |
| 217 | Serum albumin precursor | CHEMBL1201522 | Homo sapiens | 205283 |
| 217 | Serum albumin precursor | CHEMBL1201450 | Homo sapiens | 205284 |
| 217 | Serum albumin precursor | CHEMBL1201453 | Homo sapiens | 205285 |
| 217 | Serum albumin precursor | CHEMBL1201452 | Homo sapiens | 205286 |
| 217 | Serum albumin precursor | CHEMBL1201451 | Homo sapiens | 205287 |
| 218 | Sifalimumab heavy chain | CHEMBL1743069 | Homo sapiens | 205288 |
| 218 | Sifalimumab light chain | CHEMBL1743069 | Homo sapiens | 205289 |
| 219 | Siltuximab heavy chain | CHEMBL1743070 | | 205290 |
| 219 | Siltuximab light chain | CHEMBL1743070 | | 205291 |
| 220 | Simtuzumab heavy chain | CHEMBL2109667 | | 205292 |
| 220 | Simtuzumab light chain | CHEMBL2109667 | | 205293 |
| 221 | Sirukumab heavy chain | CHEMBL1743071 | Homo sapiens | 205294 |
| 221 | Sirukumab light chain | CHEMBL1743071 | Homo sapiens | 205295 |
| 222 | SOFITUZUMAB VEDOTIN HEAVY chain | CHEMBL3545372 | | 205296 |
| 222 | SOFITUZUMAB VEDOTIN LIGHT chain | CHEMBL3545372 | | 205297 |
| 223 | Solanezumab heavy chain | CHEMBL1743072 | | 205298 |
| 223 | Solanezumab light chain | CHEMBL1743072 | | 205299 |
| 224 | Somatoliberin | CHEMBL1201490 | Homo sapiens | 205300 |
| 225 | Somatotropin precursor | CHEMBL1201621 | Homo sapiens | 205301 |

TABLE 5-continued

Antibodies

| Antibody No. | Antibody Name | Chembl No. | Species | SEQ ID NO |
|---|---|---|---|---|
| 225 | Somatotropin precursor | CHEMBL1201515 | *Homo sapiens* | 205302 |
| 225 | Somatotropin precursor | CHEMBL1201620 | *Homo sapiens* | 205303 |
| 226 | Sotatercept fusion protein | CHEMBL1743073 | | 205304 |
| 227 | Suvizumab heavy chain | CHEMBL1743074 | | 205305 |
| 227 | Suvizumab light chain | CHEMBL1743074 | | 205306 |
| 228 | Tabalumab heavy chain | CHEMBL1743075 | *Homo sapiens* | 205307 |
| 228 | Tabalumab light chain | CHEMBL1743075 | *Homo sapiens* | 205308 |
| 229 | Tadocizumab fab fragment | CHEMBL1743076 | | 205309 |
| 229 | Tadocizumab fab fragment | CHEMBL1743076 | | 205310 |
| 230 | Tarextumab heavy chain | CHEMBL3301588 | *Homo sapiens* | 205311 |
| 230 | Tarextumab light chain | CHEMBL3301588 | *Homo sapiens* | 205312 |
| 231 | Tecemotide | CHEMBL3039544 | | 205313 |
| 232 | Teplizumab heavy chain | CHEMBL1743078 | | 205314 |
| 232 | Teplizumab light chain | CHEMBL1743078 | | 205315 |
| 233 | Teprotumumab heavy chain | CHEMBL1743079 | *Homo sapiens* | 205316 |
| 233 | Teprotumumab light chain | CHEMBL1743079 | *Homo sapiens* | 205317 |
| 234 | Thrombomodulin alfa | CHEMBL2108653 | *Homo sapiens* | 205318 |
| 235 | Thyrotropin beta chain precursor | CHEMBL1201533 | *Homo sapiens* | 205319 |
| 235 | Thyrotropin beta chain precursor | CHEMBL1201532 | *Homo sapiens* | 205320 |
| 236 | Tigatuzumab heavy chain | CHEMBL1743080 | | 205321 |
| 236 | Tigatuzumab light chain | CHEMBL1743080 | | 205322 |
| 237 | Tissue-type plasminogen activator precursor | CHEMBL1201593 | *Homo sapiens* | 205323 |
| 238 | Tralokinumab heavy chain | CHEMBL1743081 | *Homo sapiens* | 205324 |
| 238 | Tralokinumab light chain | CHEMBL1743081 | *Homo sapiens* | 205325 |
| 239 | Trastuzumab emtansine heavy chain | CHEMBL1743082 | | 205326 |
| 239 | Trastuzumab emtansine light chain | CHEMBL1743082 | | 205327 |
| 239 | Trastuzumab emtansine light chain | CHEMBL1201585 | | 205328 |
| 240 | Trastuzumab heavy chain | CHEMBL1201585 | | 205329 |
| 241 | Tregalizumab heavy chain | CHEMBL1743083 | | 205330 |
| 241 | Tregalizumab light chain | CHEMBL1743083 | | 205331 |
| 242 | Trenonacog alfa (coagulation factor IX isoform) | CHEMBL3039538 | | 205332 |
| 243 | TREVOGRUMAB HEAVY chain | CHEMBL3545374 | | 205333 |
| 243 | TREVOGRUMAB LIGHT chain | CHEMBL3545374 | | 205334 |
| 244 | Triacylglycerol lipase, pancreatic precursor | CHEMBL1201637 | *Homo sapiens* | 205335 |
| 245 | Tumor necrosis factor receptor superfamily member 1B precursor | CHEMBL1201572 | *Homo sapiens* | 205336 |
| 245 | Tumor necrosis factor receptor superfamily member 1B precursor | CHEMBL1201572 | | 205337 |
| 246 | Ublituxumab heavy chain | CHEMBL1743084 | *Homo sapiens* | 205338 |
| 246 | Ublituxumab light chain | CHEMBL1743084 | *Homo sapiens* | 205339 |
| 247 | Ulocuplumab heavy chain | CHEMBL3039543 | *Homo sapiens* | 205340 |
| 247 | Ulocuplumab light chain | CHEMBL3039543 | *Homo sapiens* | 205341 |
| 248 | Urelumab heavy chain | CHEMBL1743085 | *Homo sapiens* | 205342 |
| 248 | Urelumab light chain | CHEMBL1743085 | *Homo sapiens* | 205343 |
| 249 | Urokinase-type plasminogen activator precursor | CHEMBL1201420 | *Homo sapiens* | 205344 |
| 250 | VANUCIZUMAB HEAVY chain 1 | CHEMBL3545259 | | 205345 |
| 250 | VANUCIZUMAB HEAVY chain 2 | CHEMBL3545259 | | 205346 |
| 250 | VANUCIZUMAB LIGHT chain 1 | CHEMBL3545259 | | 205347 |
| 250 | VANUCIZUMAB LIGHT chain 2 | CHEMBL3545259 | | 205348 |
| 251 | Varlilumab heavy chain | CHEMBL3137347 | *Homo sapiens* | 205349 |
| 251 | Varlilumab light chain | CHEMBL3137347 | *Homo sapiens* | 205350 |
| 252 | Vasopressin-neurophysin 2-copeptin | CHEMBL1201528 | *Homo sapiens* | 205351 |
| 253 | Vatelizumab heavy chain | CHEMBL1743086 | | 205352 |
| 253 | Vatelizumab light chain | CHEMBL1743086 | | 205353 |
| 254 | Vedolizumab heavy chain | CHEMBL1743087 | | 205354 |
| 254 | Vedolizumab light chain | CHEMBL1743087 | | 205355 |
| 255 | Veltuzumab heavy chain | CHEMBL1743088 | | 205356 |
| 255 | Veltuzumab light chain | CHEMBL1743088 | | 205357 |
| 256 | Vesencumab heavy chain | CHEMBL1743089 | *Homo sapiens* | 205358 |
| 256 | Vesencumab light chain | CHEMBL1743089 | *Homo sapiens* | 205359 |
| 257 | Vonapanitase | CHEMBL3545070 | | 205360 |
| 258 | Vorsetuzumab heavy chain | CHEMBL2108673 | | 205361 |
| 258 | Vorsetuzumab heavy chain | CHEMBL2108672 | | 205362 |
| 258 | Vorsetuzumab light chain | CHEMBL2108673 | | 205363 |
| 258 | Vorsetuzumab light chain | CHEMBL2108672 | | 205364 |
| 259 | Zatuximab heavy chain | CHEMBL2109395 | | 205365 |
| 259 | Zatuximab light chain | CHEMBL2109395 | | 205366 |
| 260 | Ziconotide acetate (*Conus magus*) | CHEMBL1795072 | | 205367 |

Antibody Fragments and Variants

In some embodiments, antibody fragments encoded by payloads of the invention comprise antigen binding regions from intact antibodies. Examples of antibody fragments may include, but are not limited to Fab, Fab', F(ab)2, and Fv fragments; diabodies; linear antibodies; single-chain antibody molecules; and multispecific antibodies formed from antibody fragments. Papain digestion of antibodies produces two identical antigen-binding fragments, called "Fab" fragments, each with a single antigen-binding site. Also produced is a residual "Fc" fragment, whose name reflects its ability to crystallize readily. Pepsin treatment yields an F(ab')2 fragment that has two antigen-binding sites and is still capable of cross-linking antigen. Pharmaceutical compositions, biocircuits, biocircuit components, effector modules including their SREs or payloads of the present invention may comprise one or more of these fragments. For the purposes herein, an "antibody" may comprise a heavy and light variable domain as well as an Fc region.

As used herein, the term "native antibody" refers to a usually heterotetrameric glycoprotein of about 150,000 daltons, composed of two identical light (L) chains and two identical heavy (H) chains. Genes encoding antibody heavy and light chains are known and segments making up each have been well characterized and described (Matsuda, F. et al., 1998. The Journal of Experimental Medicine. 188(11); 2151-62 and Li, A. et al., 2004. Blood. 103(12: 4602-9, the content of each of which are herein incorporated by reference in their entirety). Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end; the constant domain of the light chain is aligned with the first constant domain of the heavy chain, and the light chain variable domain is aligned with the variable domain of the heavy chain.

As used herein, the term "variable domain" refers to specific antibody domains found on both the antibody heavy and light chains that differ extensively in sequence among antibodies and are used in the binding and specificity of each particular antibody for its particular antigen. Variable domains comprise hypervariable regions. As used herein, the term "hypervariable region" refers to a region within a variable domain comprising amino acid residues responsible for antigen binding. The amino acids present within the hypervariable regions determine the structure of the complementarity determining regions (CDRs) that become part of the antigen-binding site of the antibody. As used herein, the term "CDR" refers to a region of an antibody comprising a structure that is complimentary to its target antigen or epitope. Other portions of the variable domain, not interacting with the antigen, are referred to as framework (FW) regions. The antigen-binding site (also known as the antigen combining site or paratope) comprises the amino acid residues necessary to interact with a particular antigen. The exact residues making up the antigen-binding site are typically elucidated by co-crystallography with bound antigen, however computational assessments can also be used based on comparisons with other antibodies (Strohl, W. R. Therapeutic Antibody Engineering. Woodhead Publishing, Philadelphia Pa. 2012. Ch. 3, p 47-54, the contents of which are herein incorporated by reference in their entirety). Determining residues making up CDRs may include the use of numbering schemes including, but not limited to, those taught by Kabat (Wu, T. T. et al., 1970, JEM, 132(2):211-50 and Johnson, G. et al., 2000, Nucleic Acids Res. 28(1): 214-8, the contents of each of which are herein incorporated by reference in their entirety), Chothia (Chothia and Lesk, J. Mol. Biol. 196, 901 (1987), Chothia et al., Nature 342, 877 (1989) and Al-Lazikani, B. et al., 1997, J. Mol. Biol. 273(4):927-48, the contents of each of which are herein incorporated by reference in their entirety), Lefranc (Lefranc, M. P. et al., 2005, Immunome Res. 1:3) and Honegger (Honegger, A. and Pluckthun, A. 2001. J. Mol. Biol. 309(3):657-70, the contents of which are herein incorporated by reference in their entirety).

VH and VL domains have three CDRs each. VL CDRs are referred to herein as CDR-L1, CDR-L2 and CDR-L3, in order of occurrence when moving from N- to C-terminus along the variable domain polypeptide. VH CDRs are referred to herein as CDR-H1, CDR-H2 and CDR-H3, in order of occurrence when moving from N- to C-terminus along the variable domain polypeptide. Each of CDRs have favored canonical structures with the exception of the CDR-H3, which comprises amino acid sequences that may be highly variable in sequence and length between antibodies resulting in a variety of three-dimensional structures in antigen-binding domains (Nikoloudis, D. et al., 2014. PeerJ. 2: e456). In some cases, CDR-H3s may be analyzed among a panel of related antibodies to assess antibody diversity. Various methods of determining CDR sequences are known in the art and may be applied to known antibody sequences (Strohl, W. R. Therapeutic Antibody Engineering. Woodhead Publishing, Philadelphia Pa. 2012. Ch. 3, p 47-54, the contents of which are herein incorporated by reference in their entirety).

As used herein, the term "Fv" refers to an antibody fragment comprising the minimum fragment on an antibody needed to form a complete antigen-binding site. These regions consist of a dimer of one heavy chain and one light chain variable domain in tight, non-covalent association. Fv fragments can be generated by proteolytic cleavage, but are largely unstable. Recombinant methods are known in the art for generating stable Fv fragments, typically through insertion of a flexible linker between the light chain variable domain and the heavy chain variable domain (to form a single chain Fv (scFv)) or through the introduction of a disulfide bridge between heavy and light chain variable domains (Strohl, W. R. Therapeutic Antibody Engineering. Woodhead Publishing, Philadelphia Pa. 2012. Ch. 3, p 46-47, the contents of which are herein incorporated by reference in their entirety).

As used herein, the term "light chain" refers to a component of an antibody from any vertebrate species assigned to one of two clearly distinct types, called kappa and lambda based on amino acid sequences of constant domains. Depending on the amino acid sequence of the constant domain of their heavy chains, antibodies can be assigned to different classes. There are five major classes of intact antibodies: IgA, IgD, IgE, IgG, and IgM, and several of these may be further divided into subclasses (isotypes), e.g., IgG1, IgG2, IgG3, IgG4, IgA, and IgA2.

As used herein, the term "single chain Fv" or "scFv" refers to a fusion protein of VH and VL antibody domains, wherein these domains are linked together into a single polypeptide chain by a flexible peptide linker. In some embodiments, the Fv polypeptide linker enables the scFv to form the desired structure for antigen binding. In some embodiments, scFvs are utilized in conjunction with phage display, yeast display or other display methods where they may be expressed in association with a surface member (e.g. phage coat protein) and used in the identification of high affinity peptides for a given antigen.

As used herein, the term "bispecific antibody" refers to an antibody capable of binding two different antigens. Such antibodies typically comprise regions from at least two different antibodies. Bispecific antibodies may include any of those described in Riethmuller, G. 2012. Cancer Immunity. 12:12-18, Marvin, J. S. et al., 2005. Acta Pharmacologica Sinica. 26(6):649-58 and Schaefer, W. et al., 2011.

PNAS. 108(27):11187-92, the contents of each of which are herein incorporated by reference in their entirety.

As used herein, the term "diabody" refers to a small antibody fragment with two antigen-binding sites. Diabodies comprise a heavy chain variable domain VH connected to a light chain variable domain VL in the same polypeptide chain. By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (Hollinger, P. et al., "Diabodies": Small bivalent and bispecific antibody fragments. PNAS. 1993. 90:6444-8) the contents of each of which are incorporated herein by reference in their entirety.

The term "intrabody" refers to a form of antibody that is not secreted from a cell in which it is produced, but instead targets one or more intracellular proteins. Intrabodies may be used to affect a multitude of cellular processes including, but not limited to intracellular trafficking, transcription, translation, protein phosphorylation and dephosphorylation, metabolic processes, proliferative signaling and cell division. In some embodiments, methods of the present invention may include intrabody-based therapies. In some such embodiments, variable domain sequences and/or CDR sequences disclosed herein may be incorporated into one or more constructs for intrabody-based therapy.

As used herein, the term "monoclonal antibody" refers to an antibody obtained from a population of substantially homogeneous cells (or clones), i.e., the individual antibodies comprising the population are identical and/or bind the same epitope, except for possible variants that may arise during production of the monoclonal antibodies, such variants generally being present in minor amounts. In contrast to polyclonal antibody preparations that typically include different antibodies directed against different determinants (epitopes), each monoclonal antibody is directed against a single determinant on the antigen The modifier "monoclonal" indicates the character of the antibody as being obtained from a substantially homogeneous population of antibodies, and is not to be construed as requiring production of the antibody by any particular method. The monoclonal antibodies herein include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies.

As used herein, the term "humanized antibody" refers to a chimeric antibody comprising a minimal portion from one or more non-human (e.g., murine) antibody source(s) with the remainder derived from one or more human immunoglobulin sources. For the most part, humanized antibodies are human immunoglobulins (recipient antibody) in which residues from the hypervariable region from an antibody of the recipient are replaced by residues from the hypervariable region from an antibody of a non-human species (donor antibody) such as mouse, rat, rabbit or nonhuman primate having the desired specificity, affinity, and/or capacity.

In some embodiments, pharmaceutical compositions, biocircuits, biocircuit components, effector modules including their SREs or payloads of the present invention may be antibody mimetics. As used herein, the term "antibody mimetic" refers to any molecule which mimics the function or effect of an antibody and which binds specifically and with high affinity to their molecular targets. In some embodiments, antibody mimetics may be monobodies, designed to incorporate the fibronectin type III domain (Fn3) as a protein scaffold (U.S. Pat. Nos. 6,673,901; 6,348,584). In some embodiments, antibody mimetics may be those known in the art including, but are not limited to affibody molecules, affilins, affitins, anticalins, avimers, Centyrins, DARPINS™, Fynomers and Kunitz and domain peptides. In other embodiments, antibody mimetics may include one or more non-peptide regions.

As used herein, the term "antibody variant" refers to a modified antibody (in relation to a native or starting antibody) or a biomolecule resembling a native or starting antibody in structure and/or function (e.g., an antibody mimetic). Antibody variants may be altered in their amino acid sequence, composition or structure as compared to a native antibody. Antibody variants may include, but are not limited to, antibodies with altered isotypes (e.g., IgA, IgD, IgE, IgG1, IgG2, IgG3, IgG4, or IgM), humanized variants, optimized variants, multispecific antibody variants (e.g., bispecific variants), and antibody fragments.

The preparation of antibodies, whether monoclonal or polyclonal, is known in the art. Techniques for the production of antibodies are well known in the art and described, e.g. in Harlow and Lane "Antibodies, A Laboratory Manual", Cold Spring Harbor Laboratory Press, 1988; Harlow and Lane "Using Antibodies: A Laboratory Manual" Cold Spring Harbor Laboratory Press, 1999 and "Therapeutic Antibody Engineering: Current and Future Advances Driving the Strongest Growth Area in the Pharmaceutical Industry" Woodhead Publishing, 2012.

In one embodiment, the antibody is an anti-CD22 antibody. As a non-limiting example, the anti-CD22 antibody is any of the antibodies, fragments or variants thereof described in US Patent Publication No. US20150086562, the contents of which are herein incorporated by reference in their entirety, such as a heavy chain variable region having the amino acid sequences of SEQ ID NO: 49-64 in US20150086562, or a light chain variable region having the amino acid sequence of SEQ ID NO: 17-32 in US20150086562.

In one embodiment, the antibody is a recombinant monoclonal antibody derived from B cells of a non-human host which has been immunochallenged with one or more target antigens as described in US Patent Publication No. US20130281303, the contents of which are herein incorporated by reference in their entirety. As a non-limiting example, the method comprises screening B cells to generate a B cell library enriched in B cells capable of binding to the at least one target antigen, amplifying cDNA obtained from mRNA expressed in the B cell library to prepare an immunoglobulin library comprising VH and VL domains, generating antibodies from the VH and VL domains whereby the antibodies comprise light chain/heavy chain combinations and whereby the number of combinations generated is more than the number of B cells in the enriched B cell library, and screening the antibodies with the at least one target antigen to identify a subset of antibodies capable of binding to the at least one target antigen.

In one embodiment, the antibody may be a conditionally active biologic protein. An antibody, such as those described in Table 5 may be used to generate a conditionally active biologic protein which are reversibly or irreversibly inactivated at the wild type normal physiological conditions as well as to such conditionally active biologic proteins and uses of such conditional active biologic proteins are provided. Such methods and conditionally active proteins are taught in, for example, International Publication No. WO2015175375 and WO2016036916 and US Patent Publication No. US20140378660, the contents of each of which are incorporated herein by reference in their entirety.

In one embodiment, the antibody may be a humanized full-length antibody. As a non-limiting example, the antibody may have been humanized using the methods taught in US Patent Publication No. US20130303399, the contents of which are herein incorporated by reference in their entirety.

In one embodiment, the antibody may be a humanized or CDR-grafted anti-IL6 antibody. As a non-limiting example, the anti-IL6 antibody may have been humanized using the methods taught in US Patent Publication No. US20100138945, the contents of which are herein incorporated by reference in their entirety.

In one embodiment, the antibody may comprise a modified Fc region. As a non-limiting example, the modified Fc region may be made by the methods or may be any of the regions described in US Patent Publication No. US20150065690, the contents of which are herein incorporated by reference in their entireties.

Multispecific Antibodies

In some embodiments, payloads of the invention may encode antibodies that bind more than one epitope. As used herein, the terms "multibody" or "multispecific antibody" refer to an antibody wherein two or more variable regions bind to different epitopes. The epitopes may be on the same or different targets. In certain embodiments, a multi-specific antibody is a "bispecific antibody," which recognizes two different epitopes on the same or different antigens.

In one embodiment, the multispecific antibody may be generated and optimized by the methods described in International Patent Publication No. WO2011109726 and US Patent Publication No. US20150252119, the contents of which each of which are herein incorporated by reference in its entirety. These antibodies are able to bind to multiple antigens with high specificity and high affinity.

Bispecific Antibodies

In some embodiments, payloads of the invention may encode bispecific antibodies. Bispecific antibodies are capable of binding two different antigens. Such antibodies typically comprise antigen-binding regions from at least two different antibodies. For example, a bispecific monoclonal antibody (BsMAb, BsAb) is an artificial protein composed of fragments of two different monoclonal antibodies, thus allowing the BsAb to bind to two different types of antigen.

Bispecific antibody frameworks may include any of those described in Riethmuller, G., 2012. Cancer Immunity. 12:12-18; Marvin, J. S. et al., 2005. Acta Pharmacologica Sinica. 26(6):649-58; and Schaefer, W. et al., 2011. PNAS. 108(27):11187-92, the contents of each of which are herein incorporated by reference in their entirety.

New generations of BsMAb, called "trifunctional bispecific" antibodies, have been developed. These consist of two heavy and two light chains, one each from two different antibodies, where the two Fab regions (the arms) are directed against two antigens, and the Fc region (the foot) comprises the two heavy chains and forms the third binding site.

Of the two paratopes that form the tops of the variable domains of a bispecific antibody, one can be directed against a target antigen and the other against a T-lymphocyte antigen like CD3. In the case of trifunctional antibodies, the Fc region may additionally bind to a cell that expresses Fc receptors, like a macrophage, a natural killer (NK) cell or a dendritic cell. In sum, the targeted cell is connected to one or two cells of the immune system, which subsequently destroy it.

Other types of bispecific antibodies have been designed to overcome certain problems, such as short half-life, immunogenicity and side-effects caused by cytokine liberation. They include chemically linked Fabs, consisting only of the Fab regions, and various types of bivalent and trivalent single-chain variable fragments (scFvs), fusion proteins mimicking the variable domains of two antibodies. The furthest developed of these newer formats are the bi-specific T-cell engagers (BITES) and mAb2's, antibodies engineered to contain an Fcab antigen-binding fragment instead of the Fc constant region.

In some embodiments, antibodies of the present invention may be diabodies. Diabodies are functional bispecific single-chain antibodies (bscAb). These bivalent antigen-binding molecules are composed of non-covalent dimers of scFvs, and can be produced in mammalian cells using recombinant methods. (See, e.g., Mack et al, Proc. Natl. Acad. Sci., 92: 7021-7025, 1995). Few diabodies have entered clinical development. An iodine-123-labeled diabody version of the anti-CEA chimeric antibody cT84.66 has been evaluated for pre-surgical immunoscintigraphic detection of colorectal cancer in a study sponsored by the Beckman Research Institute of the City of Hope (Clinicaltrials.gov NCT00647153) (Nelson, A. L., MAbs. 2010. January-February; 2(1):77-83).

Using molecular genetics, two scFvs can be engineered in tandem into a single polypeptide, separated by a linker domain, called a "tandem scFV" (tascFv). TascFvs have been found to be poorly soluble and require refolding when produced in bacteria, or they may be manufactured in mammalian cell culture systems, which avoids refolding requirements but may result in poor yields. Construction of a tascFv with genes for two different scFvs yields a "bispecific single-chain variable fragments" (bis-scFvs). Only two tascFvs have been developed clinically by commercial firms; both are bispecific agents in active early phase development by Micromet for oncologic indications, and are described as "Bispecific T-cell Engagers (BITE)." Blinatumomab is an anti-CD19/anti-CD3 bispecific tascFv that potentiates T-cell responses to B-cell non-Hodgkin lymphoma in Phase 2. MT110 is an anti-EP-CAM/anti-CD3 bispecific tascFv that potentiates T-cell responses to solid tumors in Phase 1. Bispecific, tetravalent "TandAbs" are also being researched by Affimed (Nelson, A. L., MAbs. 2010. January-February; 2(1):77-83).

Also included are maxibodies (bivalent scFV fused to the amino terminus of the Fc (CH2-CH3 domains) of IgG.

Third generation molecules include "miniaturized" antibodies. Among the best examples of mAb miniaturization are the small modular immunopharmaceuticals (SMIPs) from Trubion Pharmaceuticals. These molecules, which can be monovalent or bivalent, are recombinant single-chain molecules containing one VL, one VH antigen-binding domain, and one or two constant "effector" domains, all connected by linker domains. Presumably, such a molecule might offer the advantages of increased tissue or tumor penetration claimed by fragments while retaining the immune effector functions conferred by constant domains. At least three "miniaturized" SMIPs have entered clinical development. TRU-015, an anti-CD20 SMIP developed in collaboration with Wyeth, is the most advanced project, having progressed to Phase 2 for rheumatoid arthritis (RA). Earlier attempts in systemic lupus erythrematosus (SLE) and B cell lymphomas were ultimately discontinued. Trubion and Facet Biotechnology are collaborating in the development of TRU-016, an anti-CD37 SMIP, for the treatment of CLL and other lymphoid neoplasias, a project that has reached Phase 2. Wyeth has licensed the anti-CD20 SMIP SBI-087 for the treatment of autoimmune diseases, including RA, SLE and possibly multiple sclerosis, although these projects remain in the earliest stages of clinical testing. (Nelson, A. L., MAbs. 2010. January-February; 2(1):77-83).

In some cases, payloads may encode a "unibody," in which the hinge region has been removed from IgG4 molecules. While IgG4 molecules are unstable and can exchange light-heavy chain heterodimers with one another, deletion of the hinge region prevents heavy chain-heavy chain pairing entirely, leaving highly specific monovalent light/heavy heterodimers, while retaining the Fc region to ensure stability and half-life in vivo. This configuration may minimize the risk of immune activation or oncogenic growth, as IgG4 interacts poorly with FcRs and monovalent unibodies fail to promote intracellular signaling complex formation. These contentions are, however, largely supported by laboratory, rather than clinical, evidence. Other antibodies may be "miniaturized" antibodies, which are compacted 100 kDa antibodies (see, e.g., Nelson, A. L., MAbs. 2010. January-February; 2(1):77-83).

In some embodiments, payloads may encode antibodies comprising a single antigen-binding domain. These molecules are extremely small, with molecular weights approximately one-tenth of those observed for full-sized mAbs. Further antibodies may include "nanobodies" derived from the antigen-binding variable heavy chain regions (VHHs) of heavy chain antibodies found in camels and llamas, which lack light chains (Nelson, A. L., MAbs. 2010. January-February; 2(1):77-83).

Disclosed and claimed in PCT Publication WO2014144573 to Memorial Sloan-Kettering Cancer Center are multimerization technologies for making dimeric multispecific binding agents (e.g., fusion proteins comprising antibody components) with improved properties over multispecific binding agents without the capability of dimerization.

In some cases, payloads of the invention may encode tetravalent bispecific antibodies (TetBiAbs as disclosed and claimed in PCT Publication WO2014144357). TetBiAbs feature a second pair of Fab fragments with a second antigen specificity attached to the C-terminus of an antibody, thus providing a molecule that is bivalent for each of the two antigen specificities. The tetravalent antibody is produced by genetic engineering methods, by linking an antibody heavy chain covalently to a Fab light chain, which associates with its cognate, co-expressed Fab heavy chain.

In some aspects, payloads of the invention may encode biosynthetic antibodies as described in U.S. Pat. No. 5,091,513, the contents of which are herein incorporated by reference in their entirety. Such antibody may include one or more sequences of amino acids constituting a region which behaves as a biosynthetic antibody binding site (BABS). The sites comprise 1) non-covalently associated or disulfide bonded synthetic VH and VL dimers, 2) VH-VL or VL-VH single chains wherein the VH and VL are attached by a polypeptide linker, or 3) individuals VH or VL domains. The binding domains comprise linked CDR and FR regions, which may be derived from separate immunoglobulins. The biosynthetic antibodies may also include other polypeptide sequences which function, e.g., as an enzyme, toxin, binding site, or site of attachment to an immobilization media or radioactive atom. Methods are disclosed for producing the biosynthetic antibodies, for designing BABS having any specificity that can be elicited by in vivo generation of antibody, and for producing analogs thereof.

In some embodiments, payloads may encode antibodies with antibody acceptor frameworks taught in U.S. Pat. No. 8,399,625. Such antibody acceptor frameworks may be particularly well suited accepting CDRs from an antibody of interest.

Intrabodies

In some embodiments, payloads of the invention may encode intrabodies. Intrabodies are a form of antibody that is not secreted from a cell in which it is produced, but instead targets one or more intracellular proteins. Intrabodies are expressed and function intracellularly, and may be used to affect a multitude of cellular processes including, but not limited to intracellular trafficking, transcription, translation, metabolic processes, proliferative signaling and cell division. In some embodiments, methods described herein include intrabody-based therapies. In some such embodiments, variable domain sequences and/or CDR sequences disclosed herein are incorporated into one or more constructs for intrabody-based therapy. For example, intrabodies may target one or more glycated intracellular proteins or may modulate the interaction between one or more glycated intracellular proteins and an alternative protein.

More than two decades ago, intracellular antibodies against intracellular targets were first described (Biocca, Neuberger and Cattaneo EMBO J. 9: 101-108, 1990). The intracellular expression of intrabodies in different compartments of mammalian cells allows blocking or modulation of the function of endogenous molecules (Biocca, et al., EMBO J. 9: 101-108, 1990; Colby et al., Proc. Natl. Acad. Sci. U.S.A. 101: 17616-21, 2004). Intrabodies can alter protein folding, protein-protein, protein-DNA, protein-RNA interactions and protein modification. They can induce a phenotypic knockout and work as neutralizing agents by direct binding to the target antigen, by diverting its intracellular trafficking or by inhibiting its association with binding partners. They have been largely employed as research tools and are emerging as therapeutic molecules for the treatment of human diseases such as viral pathologies, cancer and misfolding diseases. The fast growing biomarket of recombinant antibodies provides intrabodies with enhanced binding specificity, stability and solubility, together with lower immunogenicity, for their use in therapy (Biocca, abstract in Antibody Expression and Production Cell Engineering Volume 7, 2011, pp. 179-195).

In some embodiments, intrabodies have advantages over interfering RNA (iRNA); for example, iRNA has been shown to exert multiple non-specific effects, whereas intrabodies have been shown to have high specificity and affinity to target antigens. Furthermore, as proteins, intrabodies possess a much longer active half-life than iRNA. Thus, when the active half-life of the intracellular target molecule is long, gene silencing through iRNA may be slow to yield an effect, whereas the effects of intrabody expression can be almost instantaneous. Lastly, it is possible to design intrabodies to block certain binding interactions of a particular target molecule, while sparing others.

Intrabodies are often single chain variable fragments (scFvs) expressed from a recombinant nucleic acid molecule and engineered to be retained intracellularly (e.g., retained in the cytoplasm, endoplasmic reticulum, or periplasm). Intrabodies may be used, for example, to ablate the function of a protein to which the intrabody binds. The expression of intrabodies may also be regulated through the use of inducible promoters in the nucleic acid expression vector comprising the intrabody. Intrabodies may be produced using methods known in the art, such as those disclosed and reviewed in: (Marasco et al., 1993 Proc. Natl. Acad. Sci. USA, 90: 7889-7893; Chen et al., 1994, Hum. Gene Ther. 5:595-601; Chen et al., 1994, Proc. Natl. Acad. Sci. USA, 91: 5932-5936; Maciejewski et al., 1995, Nature Med., 1: 667-673; Marasco, 1995, Immunotech, 1: 1-19; Mhashilkar, et al., 1995, EMBO J. 14: 1542-51; Chen et al., 1996, Hum. Gene Therap., 7: 1515-1525; Marasco, Gene Ther. 4:11-15, 1997; Rondon and Marasco, 1997, Annu. Rev. Microbiol. 51:257-283; Cohen, et al., 1998, Oncogene 17:2445-56; Proba et al., 1998, J. Mol. Biol. 275:245-253; Cohen et al., 1998, Oncogene 17:2445-2456; Hassanzadeh, et al., 1998, FEBS Lett. 437:81-6; Richardson et al., 1998, Gene Ther. 5:635-44; Ohage and Steipe, 1999, J. Mol. Biol. 291:1119-1128; Ohage et al., 1999, J. Mol. Biol. 291:1129-1134; Wirtz and Steipe, 1999, Protein Sci. 8:2245-2250; Zhu et al., 1999, J. Immunol. Methods 231:207-222; Arafat et al., 2000, Cancer Gene Ther. 7:1250-6; der Maur et al., 2002, J. Biol. Chem. 277:45075-85; Mhashilkar et al., 2002, Gene Ther. 9:307-19; and Wheeler et al., 2003, FASEB J. 17: 1733-5; and references cited therein). In particular, a CCR5 intrabody has been produced by Steinberger et al., 2000, Proc. Natl. Acad. Sci. USA 97:805-810). See generally Marasco, W A, 1998, "Intrabodies: Basic Research and Clinical Gene Therapy Applications" Springer: New York; and for a review of scFvs, see Pluckthun in "The Pharmacology of Monoclonal Antibodies," 1994, vol. 113, Rosenburg and Moore eds. Springer-Verlag, New York, pp. 269-315.

Sequences from donor antibodies may be used to develop intrabodies. Intrabodies are often recombinantly expressed as single domain fragments such as isolated VH and VL domains or as a single chain variable fragment (scFv) antibody within the cell. For example, intrabodies are often expressed as a single polypeptide to form a single chain antibody comprising the variable domains of the heavy and light chains joined by a flexible linker polypeptide. Intrabodies typically lack disulfide bonds and are capable of modulating the expression or activity of target genes through their specific binding activity. Single chain antibodies can also be expressed as a single chain variable region fragment joined to the light chain constant region.

As is known in the art, an intrabody can be engineered into recombinant polynucleotide vectors to encode sub-cellular trafficking signals at its N or C terminus to allow expression at high concentrations in the sub-cellular compartments where a target protein is located. For example, intrabodies targeted to the endoplasmic reticulum (ER) are engineered to incorporate a leader peptide and, optionally, a C-terminal ER retention signal, such as the KDEL amino acid motif. Intrabodies intended to exert activity in the nucleus are engineered to include a nuclear localization signal. Lipid moieties are joined to intrabodies in order to tether the intrabody to the cytosolic side of the plasma membrane. Intrabodies can also be targeted to exert function in the cytosol. For example, cytosolic intrabodies are used to sequester factors within the cytosol, thereby preventing them from being transported to their natural cellular destination.

In some embodiments, the polynucleotides are designed to produce one or more antibodies, or combinations of antibodies selected from the group consisting of IgA, IgG, IgM, IgE, and IgD.

The resulting antibodies expressed in a cell, tissue or organism from the polynucleotides of the present invention may have any of the following properties and may mimic the natural isotype. They may also exhibit improved properties over the native or natural isotype.

For IgG isotype-like antibodies, they may appear as the major Ig in serum, and even at greater than 75%. They may bind to macrophages, monocytes; may act as opsonin; Cross placental transport. They may exhibit complement fixation. They may exist as a monomer of two heavy and two light chains.

For IgA isotype-like antibodies, they may appear commonly in serum. They may bind PMNs and some lymphocytes with major class in secretions such as tears, saliva, colostrum, and/or mucous. They may exhibit complement fixation but only upon aggregation. They may exist in serum as a monomer and when secreted as a dimer with J chain with the secretory piece made in epithelial cells.

For IgM isotype-like antibodies, they may appear commonly in serum. They may be made by fetus and virgin B cells. They may exhibit fixation of complement; destruction of microorganisms by agglutination and/or clumping. They may exist as a pentamer or monomer where all heavy chains are identical and all light chains identical.

For IgE isotype-like antibodies, they may appear less commonly in serum. They may be involved in allergic reactions; release of mediators of allergic symptoms or play a role in parasitic helminth disease. They may exhibit no fixation of complement. They may exist as monomer with extra domain in constant region; binds to Fc receptors on basophils and mast cells before antigen interaction.

For IgD isotype-like antibodies, they may appear less commonly in serum. They may be found on the surface of B cells as a receptor for antigens. They may exhibit no fixation of complement. They may exist as a monomer with additional amino acids at C-terminus for membrane anchoring. They may associate with Ig-alpha and Ig-beta.

The polynucleotides of the present invention may be engineered to produce any standard class of immunoglobulins using an antibody described herein or any of its component parts as a starting molecule.

In one embodiment, the polynucleotides have a modular design to encode at least one of the antibodies, fragments or variants thereof. As a non-limiting example, the polynucleotide construct may encode any of the following designs: (1) the heavy chain of an antibody, (2) the light chain of an antibody, (3) the heavy and light chain of the antibody, (4) the heavy chain and light chain separated by a linker, (5) the VH1, CH1, CH2, CH3 domains, a linker and the light chain or (6) the VH1, CH1, CH2, CH3 domains, VL region, and the light chain. Any of these designs may also comprise optional linkers between any domain and/or region.

In one embodiment, the polynucleotides have a modular design and encode a polypeptide of interest such as, but not limited to, an antibody, fragment or variant thereof described herein.

Bicistronic and/or Pseudo-Bicistronic Antibody Payloads

According to the present invention, a bicistronic payload is a polynucleotide encoding a two-protein chain antibody on a single polynucleotide strand. A pseudo-bicistronic payload is a polynucleotide encoding a single chain antibody discontinuously on a single polynucleotide strand. For bicistronic payloads, the encoded two strands or two portions/regions and/or domains (as is the case with pseudo-bicistronic) are separated by at least one nucleotide not encoding the strands or domains. More often the separation comprises a cleavage signal or site or a non-coding region of nucleotides. Such cleavage sites include, for example, furin cleavage sites encoded as an "RKR" site, or a modified furin cleavage site in the resultant polypeptide or any of those taught herein.

Single Domain Antibody Payloads

According to the present invention, a single domain payload comprises one or two polynucleotides encoding a single monomeric variable antibody domain. Typically, single domain antibodies comprise one variable domain (VH) of a heavy-chain antibody.

Single Chain Fv Antibody Payloads

According to the present invention, a single chain Fv payloads is a polynucleotide encoding at least two coding regions and a linker region. The scFv payload may encode a fusion protein of the variable regions of the heavy (VH) and light chains (VL) of immunoglobulins, connected with a short linker peptide of ten to about 25 amino acids. The linker is usually rich in glycine for flexibility, as well as serine or threonine for solubility, and can either connect the N-terminus of the VH with the C-terminus of the VL, or vice versa. Other linkers include those known in the art and disclosed herein.

Bispecific Antibody Payloads

According to the present invention, a bispecific payload is a polynucleotide encoding portions or regions of two different antibodies. Bispecific payloads encode polypeptides which may bind two different antigens. Polynucleotides of the present invention may also encode trispecific antibodies having an affinity for three antigens.

Additional Effector Module Features

Signal Sequences

In addition to the SRE and payload region, effector modules of the invention may further comprise one or more additional features such as one or more signal sequences. Representative signal sequences are given in Table 6.

Signal sequences (sometimes referred to as signal peptides, targeting signals, target peptides, localization sequences, transit peptides, leader sequences or leader peptides) direct proteins (e.g., the effector module of the present invention) to their designated cellular and/or extracellular locations. Protein signal sequences play a central role in the targeting and translocation of nearly all secreted proteins and many integral membrane proteins.

A signal sequence is a short (5-30 amino acids long) peptide present at the N-terminus of the majority of newly synthesized proteins that are destined towards a particular location. Signal sequences can be recognized by signal recognition particles (SRPs) and cleaved using type I and type II signal peptide peptidases. Signal sequences derived from human proteins can be incorporated as a regulatory module of the effector module to direct the effector module to a particular cellular and/or extracellular location (See Table 6). These signal sequences are experimentally verified and can be cleaved (Zhang Z. and Henzel W. J.; "Signal peptide prediction based on analysis of experimentally verified cleavage sites."; Protein Sci. 2004, 13:2819-2824.)

In some embodiments, a signal sequence may be, although not necessarily, located at the N-terminus or C-terminus of the effector module, and may be, although not necessarily, cleaved off the desired effector module to yield a "mature" payload.

In addition to signal sequences naturally occurring such as from a secreted protein, a signal sequence may be a variant modified from a known signal sequence of a protein. For example, U.S. Pat. Nos. 8,258,102 and 9,133,265 to Sleep disclose a modified albumin signal sequence having a secretion signal and an additional X1-X2-X3-X4-X5- motif which can increase protein secretion; U.S. Pat. No. 9,279,007 to Do discloses signal sequences of modified fragments of human immunoglobulin heavy chain binding protein (Bip) that can enhance protein expression and secretion; U.S. Pat. No. 8,148,494 to Leonhartsberger et al., discloses a signal peptide with a cleavage site that can be fused with a recombinant protein; the contents of each of which are incorporated by reference in their entirety.

In some instances, the secreted signal sequences may be cytokine signal sequences such as, but not limited to, IL2 signal sequence or a p40 signal sequence.

In some instances, signal sequences directing the payload of interest to the surface membrane of the target cell may be used. Expression of the payload on the surface of the target cell may be useful to limit the diffusion of the payload to non-target in vivo environments, thereby potentially improving the safety profile of the payloads. Additionally, the membrane presentation of the payload may allow for physiologically and qualitative signaling as well as stabilization and recycling of the payload for a longer half-life. Membrane sequences may be the endogenous signal sequence of the N terminal component of the payload of interest. Optionally, it may be desirable to exchange this sequence for a different signal sequence. Signal sequences may be selected based on their compatibility with the secretory pathway of the cell type of interest so that the payload is presented on the surface of the T cell. In some embodiments, the signal sequence may be IgE signal sequence, or CD8a signal sequence.

Other signal sequence variants may be used in the present effector module may include those discussed in U.S. patent application publication NOs.: 2007/0141666; PCT patent application publication NOs.: 1993/018181; the contents of each of which are incorporated herein by reference in their entirety.

In other embodiments, a signal sequence may be a heterogeneous signal sequence from other organisms such as virus, yeast and bacteria, which can direct an effector module to a particular cellular site, such as a nucleus (e.g., EP 1209450). Other examples may include Aspartic Protease (NSP24) signal sequences from *Trichoderma* that can increase secretion of fused protein such as enzymes (e.g., U.S. Pat. No. 8,093,016 to Cervin and Kim), bacterial lipoprotein signal sequences (e.g., PCT application publication NO.: 1991/09952 to Lau and Rioux), *E. coli* enterotoxin II signal peptides (e.g., U.S. Pat. No. 6,605,697 to Kwon et al.), *E. coli* secretion signal sequence (e.g., U.S. patent publication NO.: 2016/090404 to Malley et al.), a lipase signal sequence from a methylotrophic yeast (e.g., U.S. Pat. No. 8,975,041), and signal peptides for DNases derived from *Coryneform* bacteria (e.g., U.S. Pat. No. 4,965,197); the contents of each of which are incorporated herein by reference in their entirety.

Signal sequences may also include nuclear localization signals (NLSs), nuclear export signals (NESs), polarized cell tubulo-vesicular structure localization signals (See, e.g., U.S. Pat. No. 8,993,742; Cour et al., Nucleic Acids Res. 2003, 31(1): 393-396; the contents of each of which are incorporated herein by reference in their entirety), extracellular localization signals, signals to subcellular locations (e.g. lysosome, endoplasmic reticulum, golgi, mitochondria, plasma membrane and peroxisomes, etc.) (See, e.g., U.S. Pat. No. 7,396,811; Negi et al., Database, 2015, 1-7; the contents of each of which are incorporated herein by reference in their entirety.)

TABLE 6

Signal Sequences

| SS No. | Symbol | Signal Sequence Name | Cellular and extracellular location | SEQ ID NO |
|---|---|---|---|---|
| 1 | LYPA3 | 1-O-acylceramide synthase | Lysosome; Secreted | 205368 |
| 2 | TYRP1 | 5,6-dihydroxyindole-2-carboxylic acid oxidase (DHICA oxidase) (Tyrosinase-related protein 1) (TRP-1) | Melanosome membrane; Single-pass type I membrane protein | 205369 |
| 3 | 5NTD | 5'-nucleotidase | Membrane (Single-pass type I membrane protein) | 205370 |
| 4 | GRP78 | 78 kDa glucose-regulated protein | Endoplasmic reticulum lumen; Melanosome; Cytoplasm | 205371 |
| 5 | ACHA | Acetylcholine receptor subunit alpha | transmembrane (Antigen Lipoprotein Membrane Outer membrane Palmitate Signal) | 205372 |
| 6 | ACHB | Acetylcholine receptor subunit beta | | 205373 |
| 7 | ACHE | Acetylcholine receptor subunit epsilon | | 205374 |
| 8 | ACRO | Acrosin | | 205375 |
| 9 | ADA32 | ADAM 32 | | 205376 |
| 10 | ATL1 | ADAMTS-like protein 1 | | 205377 |
| 11 | ADIPO | Adipokine | Secreted (extracellular space) | 205378 |
| 12 | ADML | ADM | Secreted | 205379 |
| 13 | PGCA | Aggrecan core protein | | 205380 |
| 14 | PPBT | Alkaline phosphatase, tissue-nonspecific isozyme | | 205381 |
| 15 | A1AG1 | Alpha-1-acid glycoprotein 1 | Secreted (blood serum; extracellular) | 205382 |
| 16 | A1AG2 | Alpha-1-acid glycoprotein 2 | Secreted (blood serum; extracellular) | 205383 |
| 17 | AACT | Alpha-1-antichymotrypsin | | 205384 |
| 18 | A1AT | Alpha-1-antitrypsin (Alpha-1 protease inhibitor) | Secreted (Endoplasmic reticulum) | 205385 |
| 19 | A1BG | Alpha-1B-glycoprotein | Secreted (blood serum; extracellular) | 205386 |
| 20 | A2AP | Alpha-2-antiplasmin | Secreted | 205387 |
| 21 | FETUA | Alpha-2-HS-glycoprotein (Fetuin-A) (Alpha-2-Z-globulin) | Secreted | 205388 |
| 22 | A2MG | Alpha-2-macroglobulin | | 205389 |
| 23 | AMY2B | Alpha-amylase 2B | | 205390 |
| 24 | FETA | Alpha-fetoprotein | | 205391 |
| 25 | AGAL | Alpha-galactosidase A | Lysosome | 205392 |
| 26 | LALBA | Alpha-lactalbumin (Lactose synthase B protein) | Secreted | 205393 |
| 27 | NAGAB | Alpha-N-acetylgalactosaminidase | Lysosome | 205394 |
| 28 | ANAG | Alpha-N-acetylglucosaminidase | | 205395 |
| 29 | CASA1 | Alpha-S1-casein | Secreted | 205396 |
| 30 | PGFRA | Alpha-type platelet-derived growth factor receptor | | 205397 |
| 31 | AMELX | Amelogenin, X isoform | | 205398 |
| 32 | AMTN | Amelotin | Secreted | 205399 |
| 33 | ABP1 | Amiloride-sensitive amine oxidase [copper-containing] | Secreted, extracellular space | 205400 |
| 34 | A4 | Amyloid beta A4 protein | | 205401 |
| 35 | ANGI | Angiogenin | Secreted (cytoplasmic); Nucleus | 205402 |
| 36 | TIE2 | Angiopoietin-1 receptor | | 205403 |
| 37 | ANGL3 | Angiopoietin-related protein 3 (Angiopoietin-like 3) | Secreted | 205404 |
| 38 | ANGL7 | Angiopoietin-related protein 7 (Angiopoietin-like 7) | Secreted | 205405 |
| 39 | ACET | Angiotensin-converting enzyme, testis-specific isoform | Cell membrane; Single-pass type I membrane | 205406 |
| 40 | ANGT | Angiotensinogen (Serpin A8) | Secreted | 205407 |
| 41 | AGR2 | Anterior gradient protein 2 homolog | Secreted cement gland | 205408 |
| 42 | AGR3 | Anterior gradient protein 3 homolog | Secreted | 205409 |
| 43 | SLPI | Antileukoproteinase (ALP) (Secretory leukocyte protease, inhibitor) | Secreted | 205410 |
| 44 | ANT3 | Antithrombin-III | | 205411 |
| 45 | APOA1 | Apolipoprotein A-I (Apo-AI) | | 205412 |
| 46 | APOA2 | Apolipoprotein A-II (Apo-AII) | Secreted; Transport | 205413 |
| 47 | APOA4 | Apolipoprotein A-IV | | 205414 |
| 48 | APOB | Apolipoprotein B-100 | Membrane (Single-pass type I membrane protein) | 205415 |
| 49 | APOC2 | Apolipoprotein C-2 | | 205416 |
| 50 | APOC3 | Apolipoprotein C-3 | | 205417 |
| 51 | APOC1 | Apolipoprotein C-I | | 205418 |
| 52 | APOD | Apolipoprotein D | | 205419 |
| 53 | APOE | Apolipoprotein E (Apo-E) | Secreted; Transport/VLDL | 205420 |
| 54 | APOM | Apolipoprotein M | | 205421 |
| 55 | APOA | Apolipoprotein(a) | Transport | 205422 |
| 56 | APRIII | Apoptosis-related protein 3 | | 205423 |
| 57 | GHRL | Appetite-regulating hormone | | 205424 |
| 58 | ARSA | Arylsulfatase A | | 205425 |
| 59 | ANF | Atrial natriuretic factor | | 205426 |
| 60 | ANPRA | Atrial natriuretic peptide receptor A | | 205427 |
| 61 | CAP7 | Azurocidin | | 205428 |
| 62 | BPI | Bactericidal permeability-increasing protein (BPI) | membrane | 205429 |
| 63 | BPIL1 | Bactericidal/permeability-increasing protein-like 1 | | 205430 |
| 64 | PRP1 | Basic salivary proline-rich protein 1 | | 205431 |
| 65 | PRB4 | Basic salivary proline-rich protein 4 | | 205432 |
| 66 | BASI | Basigin | | 205433 |
| 67 | CD79A | B-cell antigen receptor complex-associated protein alpha-chain | | 205434 |
| 68 | CD79B | B-cell antigen receptor complex-associated protein beta-chain | | 205435 |

TABLE 6-continued

Signal Sequences

| SS No. | Symbol | Signal Sequence Name | Cellular and extracellular location | SEQ ID NO |
|---|---|---|---|---|
| 69 | NTRK2 | BDNF/NT-3 growth factors receptor | Membrane (Single-pass type I membrane protein) | 205436 |
| 70 | APOH | Beta-2-glycoprotein 1 (Beta-2-glycoprotein I), (Apolipoprotein H) | Secreted | 205437 |
| 71 | B2MG | Beta-2-microglobulin | | 205438 |
| 72 | CASB | Beta-casein | | 205439 |
| 73 | D103A | Beta-defensin 103 (Defensin, beta 103) | Secreted | 205440 |
| 74 | DB127 | Beta-defensin 127 (Defensin, beta 127) | Secreted | 205441 |
| 75 | BGAL | Beta-galactosidase | Lysosome | 205442 |
| 76 | BGLR | Beta-glucuronidase | Lysosome | 205443 |
| 77 | HEXA | Beta-hexosaminidase subunit alpha | | 205444 |
| 78 | MSMB | Beta-microseminoprotein | Secreted (Sperm surface) | 205445 |
| 79 | PDYN | Beta-neoendorphin-dynorphin (Proenkephalin B) | Secreted | 205446 |
| 80 | PGFRB | Beta-type platelet-derived growth factor receptor | Membrane (Single-pass type I membrane protein) | 205447 |
| 81 | BAMBI | BMP and activin membrane-bound inhibitor homolog | Membrane (Single-pass type I membrane protein) | 205448 |
| 82 | PRG2 | Bone marrow proteoglycan | | 205449 |
| 83 | SIAL | Bone sialoprotein 2 (Bone sialoprotein II) (BSP II) | Secreted | 205450 |
| 84 | BOC | Brother of CDO | Cell membrane; transmembrane | 205451 |
| 85 | BT3A3 | Butyrophilin subfamily 3 member A3 | Membrane (Single-pass type I membrane protein) | 205452 |
| 86 | BTNL8 | Butyrophilin-like protein 8 | | 205453 |
| 87 | CA187 | C1orf187 | Secreted | 205454 |
| 88 | C4BPA | C4b-binding protein alpha chain | Secreted | 205455 |
| 89 | C4BPB | C4b-binding protein beta chain | | 205456 |
| 90 | CALRL | Calcitonin gene-related peptide type 1 receptor | Membrane (Single-pass type I membrane protein) | 205457 |
| 91 | CALCR | Calcitonin receptor | Membrane (Single-pass type I membrane protein) | 205458 |
| 92 | CALR | Calreticulin | Endoplasmic reticulum lumen; Cytoplasm | 205459 |
| 93 | CSTN1 | Calsyntenin-1 | | 205460 |
| 94 | CALU | Calumenin | Endoplasmic reticulum lumen; Golgi apparatus; Melanosome | 205461 |
| 95 | CAH4 | Carbonic anhydrase 4 | | 205462 |
| 96 | CAH9 | Carbonic anhydrase 9 | | 205463 |
| 97 | EST2 | Carboxylesterase 2 | | 205464 |
| 98 | CBPA1 | Carboxypeptidase A1 | Secreted (extracellular space) | 205465 |
| 99 | CBPB1 | Carboxypeptidase B | Secreted (extracellular space) | 205466 |
| 100 | CBPM | Carboxypeptidase M | | 205467 |
| 101 | CBPN | Carboxypeptidase N catalytic chain | | 205468 |
| 102 | CEAM1 | Carcinoembryonic antigen-related cell adhesion molecule 1, (Biliary glycoprotein 1) (BGP-1) (CD66 antigen) | Cell membrane (lipid anchor) | 205469 |
| 103 | CEAM6 | Carcinoembryonic antigen-related cell adhesion molecule 6 | Cell membrane (lipid anchor) | 205470 |
| 104 | CEAM7 | Carcinoembryonic antigen-related cell adhesion molecule 7 | Cell membrane (lipid anchor) | 205471 |
| 105 | CEAM8 | Carcinoembryonic antigen-related cell adhesion molecule 8 | Cell membrane (lipid anchor) | 205472 |
| 106 | MATN1 | Cartilage matrix protein | | 205473 |
| 107 | CATD | Cathepsin D | | 205474 |
| 108 | CATE | Cathepsin E | | 205475 |
| 109 | CATG | Cathepsin G | | 205476 |
| 110 | CATH | Cathepsin H | | 205477 |
| 111 | CATW | Cathepsin W | | 205478 |
| 112 | MPRD | Cation-dependent mannose-6-phosphate receptor | Lysosome membrane (Single-pass type I membrane protein) | 205479 |
| 113 | MPRI | Cation-independent mannose-6-phosphate receptor | Lysosome membrane (Single-pass type I membrane protein) | 205480 |
| 114 | CCL1 | C-C motif chemokine 1 (Small-inducible cytokine A1) | Secreted | 205481 |
| 115 | CCL13 | C-C motif chemokine 13 | Secreted | 205482 |
| 116 | CCL14 | C-C motif chemokine 14 | Secreted | 205483 |
| 117 | CCL15 | C-C motif chemokine 15 (Small-inducible cytokine A15) | Secreted | 205484 |
| 118 | CCL16 | C-C motif chemokine 16 | Secreted | 205485 |
| 119 | CCL17 | C-C motif chemokine 17 | Secreted | 205486 |
| 120 | CCL18 | C-C motif chemokine 18 | Secreted | 205487 |
| 121 | CCL19 | C-C motif chemokine 19 | Secreted | 205488 |
| 122 | CCL2 | C-C motif chemokine 2 | Secreted | 205489 |
| 123 | CCL20 | C-C motif chemokine 20 | Secreted | 205490 |
| 124 | CCL21 | C-C motif chemokine 21 | Secreted | 205491 |
| 125 | CCL22 | C-C motif chemokine 22 | Secreted | 205492 |
| 126 | CCL23 | C-C motif chemokine 23 | Secreted | 205493 |
| 127 | CCL24 | C-C motif chemokine 24 (Small-inducible cytokine A24) | Secreted | 205494 |
| 128 | CCL26 | C-C motif chemokine 26 | Secreted | 205495 |
| 129 | CCL27 | C-C motif chemokine 27 | Secreted | 205496 |
| 130 | CCL3 | C-C motif chemokine 3 | Secreted | 205497 |
| 131 | CL3L1 | C-C motif chemokine 3-like 1 (Small-inducible cytokine A3-, like 1) | Secreted | 205498 |

TABLE 6-continued

Signal Sequences

| SS No. | Symbol | Signal Sequence Name | Cellular and extracellular location | SEQ ID NO |
|---|---|---|---|---|
| 132 | CCL4 | C-C motif chemokine 4 (Small-inducible cytokine A4) | Secreted | 205499 |
| 133 | CCL5 | C-C motif chemokine 5 | Secreted | 205500 |
| 134 | CCL7 | C-C motif chemokine 7 | Secreted | 205501 |
| 135 | CD109 | CD109 antigen | | 205502 |
| 136 | C16L2 | CD164 sialomucin-like 2 protein | | 205503 |
| 137 | C16L2 | CD164 sialomucin-like 2 protein | Membrane (Single-pass type I membrane protein) | 205504 |
| 138 | CD177 | CD177 antigen | | 205505 |
| 139 | CD180 | CD180 antigen (Lymphocyte antigen 64) | Cell membrane (Single-pass type I membrane protein) | 205506 |
| 140 | CD226 | CD226 antigen | | 205507 |
| 141 | CD27 | CD27 antigen (CD27L receptor) | Membrane (Single-pass type I membrane protein) | 205508 |
| 142 | CD276 | CD276 antigen (Costimulatory molecule) | Membrane (Single-pass type I membrane protein) | 205509 |
| 143 | CD320 | CD320 antigen (8D6 antigen) | Membrane (Single-pass type I membrane protein) | 205510 |
| 144 | CD5L | CD5 antigen-like (SP-alpha) (CT-2) | Secreted | 205511 |
| 145 | CD59 | CD59 glycoprotein | | 205512 |
| 146 | CD83 | CD83 antigen (Cell surface protein HB15) | Transmembrane | 205513 |
| 147 | CD99 | CD99 antigen | | 205514 |
| 148 | CADM3 | Cell adhesion molecule 3 (Immunoglobulin superfamily member,4B) | Membrane (Single-pass type I membrane protein) | 205515 |
| 149 | GPA33 | Cell surface A33 antigen | | 205516 |
| 150 | MUC18 | Cell surface glycoprotein MUC18 | | 205517 |
| 151 | MOX2R | Cell surface glycoprotein OX2 receptor (CD200 cell surface, glycoprotein receptor) | Secreted | 205518 |
| 152 | CER1 | Cerberus | | 205519 |
| 153 | CBLN3 | Cerebellin-3 | | 205520 |
| 154 | CBLN4 | Cerebellin-4 | | 205521 |
| 155 | CERU | Ceruloplasmin (Ferroxidase) | Secreted | 205522 |
| 156 | CH3L1 | Chitinase-3-like protein 1 (Cartilage glycoprotein 39) | Secreted, extracellular space | 205523 |
| 157 | CH3L2 | Chitinase-3-like protein 2 (YKL-39) (Chondrocyte protein,39) | | 205524 |
| 158 | CHIT1 | Chitotriosidase-1 (Chitinase-1) | Secreted; Lysosome (a small portion) | 205525 |
| 159 | CCKN | Cholecystokinin | Secreted | 205526 |
| 160 | CETP | Cholesteryl ester transfer protein | Secreted | 205527 |
| 161 | CHLE | Cholinesterase | | 205528 |
| 162 | CRDL2 | Chordin-like protein 2 (Chordin-related protein 2) | Secreted | 205529 |
| 163 | CGHB | Choriogonadotropin subunit beta | | 205530 |
| 164 | CSH | Chorionic somatomammotropin hormone | | 205531 |
| 165 | CMGA | Chromogranin-A (CgA) (Pituitary secretory protein I) (SP-I) | Secreted (Neuroendocrine and endocrine secretory granules) | 205532 |
| 166 | CMA1 | Chymase | | 205533 |
| 167 | CTRB1 | Chymotrypsinogen B | Secreted (extracellular space) | 205534 |
| 168 | CLUS | Clusterin (Complement-associated protein SP-40,40) | Secreted | 205535 |
| 169 | CLM1 | CMRF35-like molecule 1 | | 205536 |
| 170 | CLM9 | CMRF35-like molecule 9 | | 205537 |
| 171 | FA5 | Coagulation factor V (Activated protein C cofactor) | Secreted | 205538 |
| 172 | FA8 | Coagulation factor VIII | | 205539 |
| 173 | FA11 | Coagulation factor XI (Plasma thromboplastin, antecedent) (PTA) (FXI) | Secreted | 205540 |
| 174 | FA12 | Coagulation factor XII | | 205541 |
| 175 | F13B | Coagulation factor XIII B chain (Protein-glutamine gamma-, glutamyltransferase B chain) | | 205542 |
| 176 | CART | Cocaine- and amphetamine-regulated transcript protein | | 205543 |
| 177 | COL | Colipase | | 205544 |
| 178 | CF126 | Colipase-like protein C6orf126 | | 205545 |
| 179 | CO1A1 | Collagen alpha-1(I) chain | | 205546 |
| 180 | CO3A1 | Collagen alpha-1(III) chain | | 205547 |
| 181 | CO4A1 | Collagen alpha-1(IV) chain | | 205548 |
| 182 | CO9A1 | Collagen alpha-1(IX) chain | Secreted (extracellular space, extracellular matrix) | 205549 |
| 183 | CO6A1 | Collagen alpha-1(VI) chain | | 205550 |
| 184 | COGA1 | Collagen alpha-1(XVI) chain | Secreted (extracellular space, extracellular matrix) | 205551 |
| 185 | CO4A2 | Collagen alpha-2(IV) chain | Secreted (extracellular space, extracellular matrix, basement membrane) | 205552 |
| 186 | CO5A2 | Collagen alpha-2(V) chain | Secreted (extracellular space, extracellular matrix) | 205553 |
| 187 | CTHR1 | Collagen triple helix repeat-containing protein 1 (NMTC1, protein) | Secreted (extracellular space) | 205554 |
| 188 | C1QA | Complement C1q subcomponent subunit A | | 205555 |
| 189 | C1QB | Complement C1q subcomponent subunit B | | 205556 |
| 190 | C1QC | Complement C1q subcomponent subunit C | | 205557 |
| 191 | C1QT5 | Complement C1q tumor necrosis factor-related protein 5 | | 205558 |
| 192 | C1QT5 | Complement C1q tumor necrosis factor-related protein 5 | | 205559 |
| 193 | C1QT6 | Complement C1q tumor necrosis factor-related protein 6 | Secreted | 205560 |

TABLE 6-continued

Signal Sequences

| SS No. | Symbol | Signal Sequence Name | Cellular and extracellular location | SEQ ID NO |
|---|---|---|---|---|
| 194 | C1R | Complement C1r subcomponent | Secreted | 205561 |
| 195 | C1S | Complement C1s subcomponent | Secreted | 205562 |
| 196 | CO2 | Complement C2 (C3/C5 convertase) | Secreted | 205563 |
| 197 | CO3 | Complement C3 | | 205564 |
| 198 | CO4A | Complement C4-A | | 205565 |
| 199 | C1QR1 | Complement component C1q receptor | Secreted | 205566 |
| 200 | CO6 | Complement component C6 | Secreted | 205567 |
| 201 | CO7 | Complement component C7 | Secreted | 205568 |
| 202 | CO8G | Complement component C8 gamma chain | | 205569 |
| 203 | CO9 | Complement component C9 | Transmembrane | 205570 |
| 204 | DAF | Complement decay-accelerating factor | | 205571 |
| 205 | CFAB | Complement factor B (C3/C5 convertase) | Secreted | 205572 |
| 206 | CFAH | Complement factor H | | 205573 |
| 207 | FHR2 | Complement factor H-related protein 2 | | 205574 |
| 208 | CFAI | Complement factor I | | 205575 |
| 209 | CR1 | Complement receptor type 1 | | 205576 |
| 210 | CR2 | Complement receptor type 2 | | 205577 |
| 211 | CNTN1 | Contactin-1 | | 205578 |
| 212 | CNTN2 | Contactin-2 | | 205579 |
| 213 | CBG | Corticosteroid-binding globulin | Secreted | 205580 |
| 214 | COLI | Corticotropin-lipotropin (Pro-opiomelanocortin) (POMC) | | 205581 |
| 215 | CRFR1 | Corticotropin-releasing factor receptor 1 | | 205582 |
| 216 | CRHBP | Corticotropin-releasing factor-binding protein (CRF-binding, protein) | | 205583 |
| 217 | CRP | C-reactive protein | Secreted | 205584 |
| 218 | SG1D1 | cretoglobin family 1D member 1 | | 205585 |
| 219 | SG3A1 | cretoglobin family 3A member 1 | | 205586 |
| 220 | CLC11 | C-type lectin domain family 11 member A (Stem cell growth factor) | Cytoplasm; Secreted. | 205587 |
| 221 | CLC14 | C-type lectin domain family 14 member A (Epidermal growth, factor receptor 5) (EGFR-5) | Membrane (Single-pass type I membrane protein) | 205588 |
| 222 | CDCP1 | CUB domain-containing protein 1 | | 205589 |
| 223 | CXL10 | C-X-C motif chemokine 10 (Small-inducible cytokine B10) | Secreted | 205590 |
| 224 | CXL11 | C-X-C motif chemokine 11 | | 205591 |
| 225 | CXCL2 | C-X-C motif chemokine 2 | | 205592 |
| 226 | CXCL3 | C-X-C motif chemokine 3 | | 205593 |
| 227 | CXCL5 | C-X-C motif chemokine 5 | | 205594 |
| 228 | CXCL6 | C-X-C motif chemokine 6 | | 205595 |
| 229 | CXCL9 | C-X-C motif chemokine 9 | | 205596 |
| 230 | CST9 | Cystatin-9 (Cystatin-like molecule) | Secreted (through the Golgi via the secretory pathway) | 205597 |
| 231 | CST9L | Cystatin-9-like | | 205598 |
| 232 | CYTC | Cystatin-C | Secreted (extracellular space) | 205599 |
| 233 | CYTD | Cystatin-D | Secreted (extracellular space) | 205600 |
| 234 | CYTS | Cystatin-S | | 205601 |
| 235 | CYTT | Cystatin-SA | | 205602 |
| 236 | CYTN | Cystatin-SN | | 205603 |
| 237 | CRIM1 | Cysteine-rich motor neuron 1 protein (CRIM-1) | Cell membrane | 205604 |
| 238 | CRIS1 | Cysteine-rich secretory protein 1 (CRISP-1) | Located in the lumen and epithelium of distal ductus efferentes and epididy | 205605 |
| 239 | CREL2 | Cysteine-rich with EGF-like domain protein 2 | | 205606 |
| 240 | IL2RG | Cytokine receptor common subunit gamma | Membrane (Single-pass type I membrane protein) | 205607 |
| 241 | CRLF1 | Cytokine receptor-like factor 1 | | 205608 |
| 242 | XCL2 | Cytokine SCM-1 beta | | 205609 |
| 243 | CYTL1 | Cytokine-like protein 1 | | 205610 |
| 244 | DLK | Delta-like protein (DLK) (pG2) | Membrane (Single-pass type I membrane protein) | 205611 |
| 245 | DLL4 | Delta-like protein 4 | | 205612 |
| 246 | DNAS1 | Deoxyribonuclease-1 | | 205613 |
| 247 | DCD | Dermcidin | | 205614 |
| 248 | DMKN | Dermokine | | 205615 |
| 249 | DKK1 | Dickkopf-related protein 1 (Dkk-1) (Dickkopf-1) | Secreted | 205616 |
| 250 | DKK3 | Dickkopf-related protein 3 | | 205617 |
| 251 | DKK4 | Dickkopf-related protein 4 (Dkk-4) (Dickkopf-4) | Secreted | 205618 |
| 252 | DPEP1 | Dipeptidase 1 | | 205619 |
| 253 | CATC | Dipeptidyl-peptidase 1 | Lysosome | 205620 |
| 254 | RIB2 | Dolichyl-diphosphooligosaccharide--protein glycosyltransferase 63 kDa, subunit | Endoplasmic reticulum membrane (Single-pass type I membrane protein) | 205621 |
| 255 | RPN1 | Dolichyl-diphosphooligosaccharide--protein glycosyltransferase subunit 1 | | 205622 |
| 256 | RPN2 | Dolichyl-diphosphooligosaccharide--protein glycosyltransferase subunit 2 | | 205623 |
| 257 | INSL4 | Early placenta insulin-like peptide (EPIL) (Placentin), (Insulin-like peptide 4) | Secreted | 205624 |

TABLE 6-continued

Signal Sequences

| SS No. | Symbol | Signal Sequence Name | Cellular and extracellular location | SEQ ID NO |
|---|---|---|---|---|
| 258 | ENPP7 | Ectonucleotide pyrophosphatase/phosphodiesterase family member 7 | | 205625 |
| 259 | EGFL8 | EGF-like domain-containing protein 8 (Epidermal growth, factor-like protein 8) | Secreted | 205626 |
| 260 | ELAF | Elafin (Elastase-specific inhibitor) (ESI) | Secreted | 205627 |
| 261 | ELA2A | Elastase-2A | Secreted | 205628 |
| 262 | ELA2B | Elastase-2B | Secreted | 205629 |
| 263 | EGLN | Endoglin | | 205630 |
| 264 | ERP29 | Endoplasmic reticulum protein ERp29 | | 205631 |
| 265 | ENPL | Endoplasmin (Heat shock protein 90 kDa beta member 1) | Endoplasmic reticulum lumen; Melanosome | 205632 |
| 266 | ESAM | Endothelial cell-selective adhesion molecule | | 205633 |
| 267 | EDN1 | Endothelin-1 | | 205634 |
| 268 | ECP | Eosinophil cationic protein (ECP), (Ribonuclease 3) | Cytoplasmic granule (Matrix of eosinophil's large specific granule) | 205635 |
| 269 | CCL11 | Eotaxin | Secreted | 205636 |
| 270 | EPHA3 | Ephrin type-A receptor 3 | | 205637 |
| 271 | EPHB1 | Ephrin type-B receptor 1 | | 205638 |
| 272 | EPHB6 | Ephrin type-B receptor 6 | | 205639 |
| 273 | EFNA1 | Ephrin-A1 | | 205640 |
| 274 | EFNA4 | Ephrin-A4 | | 205641 |
| 275 | EFNB1 | Ephrin-B1 (EPH-related receptor tyrosine kinase ligand 2) | Membrane | 205642 |
| 276 | EFNB3 | Ephrin-B3 | | 205643 |
| 277 | EGFR | Epidermal growth factor receptor (Receptor, tyrosine-protein kinase ErbB-1) | Membrane (Single-pass type I membrane protein) | 205644 |
| 278 | EPGN | Epigen (Epithelial mitogen) (EPG) | Membrane | 205645 |
| 279 | ERO1A | ERO1-like protein alpha | | 205646 |
| 280 | EPO | Erythropoietin | | 205647 |
| 281 | EPOR | Erythropoietin receptor (EPO-R), Isoform EPOR-S | Secreted and located to the cell surface | 205648 |
| 282 | LYAM2 | E-selectin (Endothelial leukocyte adhesion molecule 1) | Membrane (Single-pass type I membrane protein) | 205649 |
| 283 | SODE | Extracellular superoxide dismutase [Cu—Zn] | Secreted (extracellular) | 205650 |
| 284 | FCRLA | Fc receptor-like and mucin-like 1 (Fc receptor-like A) | Secreted; Cytoplasm | 205651 |
| 285 | FCRL1 | Fc receptor-like protein 1 | | 205652 |
| 286 | FCRL2 | Fc receptor-like protein 2 precursor (FcR-like protein 2) (FcRL2) | Membrane (Single-pass type I membrane protein) | 205653 |
| 287 | FIBA | Fibrinogen alpha chain | Secreted | 205654 |
| 288 | FIBB | Fibrinogen beta chain | Secreted | 205655 |
| 289 | FIBG | Fibrinogen gamma chain | Secreted | 205656 |
| 290 | FGF19 | Fibroblast growth factor 19 (FGF-19) | Secreted | 205657 |
| 291 | FGF21 | Fibroblast growth factor 21 (FGF-21) | Secreted | 205658 |
| 292 | FGF23 | Fibroblast growth factor 23 (FGF-23) (Tumor-derived, hypophosphatemia-inducing factor) | Secreted | 205659 |
| 293 | FGFR3 | Fibroblast growth factor receptor 3 | | 205660 |
| 294 | FGFR4 | Fibroblast growth factor receptor 4 | | 205661 |
| 295 | FGRL1 | Fibroblast growth factor receptor-like 1 | | 205662 |
| 296 | FINC | Fibronectin | | 205663 |
| 297 | FBLN1 | Fibulin-1 | | 205664 |
| 298 | FCN1 | Ficolin-1 (Ficolin-A) (Ficolin-alpha) (M-Ficolin), (Collagen/fibrinogen domain-containing protein 1) | Secreted (on the monocyte surface) | 205665 |
| 299 | FCN3 | Ficolin-3 | | 205666 |
| 300 | FKB14 | FK506-binding protein 14 (Peptidyl-prolyl cis-, trans isomerase) | Endoplasmic reticulum lumen | 205667 |
| 301 | FKBP2 | FK506-binding protein 2 (Peptidyl-prolyl cis-, trans isomerase) (Pease) (Aromatase) (13 kDa FKBP) (FKBP-13). | Endoplasmic reticulum membrane; Peripheral membrane protein | 205668 |
| 302 | FOLR2 | Folate receptor beta | | 205669 |
| 303 | FST | Follistatin (FS) (Activin-binding protein) | Secreted | 205670 |
| 304 | FSTL1 | Follistatin-related protein 1 | | 205671 |
| 305 | FSTL3 | Follistatin-related protein 3 | | 205672 |
| 306 | FSHB | Follitropin subunit beta (Follicle-stimulating hormone beta, subunit) | Secreted | 205673 |
| 307 | X3CL1 | Fractalkine precursor (C-X3-C motif chemokine 1) (Neurotactin) | Membrane; Secreted | 205674 |
| 308 | FZD3 | Frizzled-3 (Fz-3) (hFz3) | Membrane (Multi-pass membrane protein) | 205675 |
| 309 | KV313 | g kappa chain V-III region HIC | | 205676 |
| 310 | GALC | Galactocerebrosidase | Lysosome | 205677 |
| 311 | LG3BP | Galectin-3-binding protein (Lectin galactoside-binding, soluble 3-binding protein) | Secreted (extracellular space, extracellular matrix) | 205678 |
| 312 | LIPG | Gastric triacylglycerol lipase | Secreted | 205679 |
| 313 | PEPC | Gastricsin | | 205680 |
| 314 | GAST | Gastrin | | 205681 |
| 315 | GRP | Gastrin-releasing peptide | Secreted | 205682 |
| 316 | GFRA3 | GDNF family receptor alpha-3 | | 205683 |
| 317 | GELS | Gelsolin | | 205684 |
| 318 | GDN | Glia-derived nexin | Secreted (extracellular space) | 205685 |

TABLE 6-continued

Signal Sequences

| SS No. | Symbol | Signal Sequence Name | Cellular and extracellular location | SEQ ID NO |
|---|---|---|---|---|
| 319 | GPRL1 | GLIPR1-like protein 1 | | 205686 |
| 320 | GLUC | Glucagon | Secreted | 205687 |
| 321 | GLU2B | Glucosidase 2 subunit beta | | 205688 |
| 322 | GLCM | Glucosylceramidase | | 205689 |
| 323 | PAEP | Glycodelin | | 205690 |
| 324 | GLPA | Glycophorin-A (PAS-2) | Membrane (Single-pass type I membrane protein) | 205691 |
| 325 | GLPB | Glycophorin-B (PAS-3) | Membrane (Single-pass type I membrane protein) | 205692 |
| 326 | GLPE | Glycophorin-E | Membrane (Single-pass type I membrane protein) | 205693 |
| 327 | GLHA | Glycoprotein hormones alpha chain | Secreted | 205694 |
| 328 | GPC1 | Glypican-1 | | 205695 |
| 329 | PIGT | GPI transamidase component PIG-T | | 205696 |
| 330 | GPI8 | GPI-anchor transamidase, (GPI transamidase) | Endoplasmic reticulum membrane (Single-pass type I membrane protein) | 205697 |
| 331 | GPR56 | G-protein coupled receptor 56 | | 205698 |
| 332 | CSF3R | Granulocyte colony-stimulating factor receptor (G-CSF-R), (CD114 antigen) | Cell membrane | 205699 |
| 333 | CSF2 | Granulocyte-macrophage colony-stimulating factor (GM-CSF) | Secreted | 205700 |
| 334 | CSF2R | Granulocyte-macrophage colony-stimulating factor receptor subunit alpha | | 205701 |
| 335 | GRAA | Granzyme A | | 205702 |
| 336 | GRAB | Granzyme B | membrane (postsynaptic membrane) | 205703 |
| 337 | GRAH | Granzyme H | | 205704 |
| 338 | GREM1 | Gremlin-1 | | 205705 |
| 339 | PG12B | Group XIIB secretory phospholipase A2-like protein | Secreted | 205706 |
| 340 | SOM2 | Growth hormone variant | | 205707 |
| 341 | GROA | Growth-regulated alpha protein (C-X-C motif chemokine 1) | Secreted | 205708 |
| 342 | GUC2A | Guanylin | | 205709 |
| 343 | HPT | Haptoglobin | Secreted | 205710 |
| 344 | CD34 | Hematopoietic progenitor cell antigen CD34 | Membrane (Single-pass type I membrane protein) | 205711 |
| 345 | HEMO | Hemopexin | | 205712 |
| 346 | HPSE | Heparanase | | 205713 |
| 347 | HEP2 | Heparin cofactor 2 (Heparin cofactor II) | | 205714 |
| 348 | LIPC | Hepatic triacylglycerol lipase | | 205715 |
| 349 | HGF | Hepatocyte growth factor | | 205716 |
| 350 | HGFA | Hepatocyte growth factor activator | Secreted | 205717 |
| 351 | HFE | Hereditary hemochromatosis protein | | 205718 |
| 352 | FCGR1 | High affinity immunoglobulin gamma Fc receptor I (Fc-gamma, RI) | Cell membrane (Single-pass type I membrane protein) | 205719 |
| 353 | HIS1 | Histatin-1 (Histidine-rich protein 1) | | 205720 |
| 354 | HIS3 | Histatin-3 (Histidine-rich protein 3) | Secreted (by serous acinar and demilune cells) | 205721 |
| 355 | HRG | Histidine-rich glycoprotein | | 205722 |
| 356 | 1A01 | HLA class I histocompatibility antigen, A-1 alpha chain | Membrane (Single-pass type I membrane protein) | 205723 |
| 357 | 1A11 | HLA class I histocompatibility antigen, A-11 alpha chain | Membrane (Single-pass type I membrane protein) | 205724 |
| 358 | 1A02 | HLA class I histocompatibility antigen, A-2 alpha chain | Membrane (Single-pass type I membrane protein) | 205725 |
| 359 | 1A23 | HLA class I histocompatibility antigen, A-23 alpha chain | Membrane (Single-pass type I membrane protein) | 205726 |
| 360 | 1A25 | HLA class I histocompatibility antigen, A-25 alpha chain | Membrane (Single-pass type I membrane protein) | 205727 |
| 361 | 1A26 | HLA class I histocompatibility antigen, A-26 alpha chain | Membrane (Single-pass type I membrane protein) | 205728 |
| 362 | 1A30 | HLA class I histocompatibility antigen, A-30 alpha chain | Membrane (Single-pass type I membrane protein) | 205729 |
| 363 | 1A31 | HLA class I histocompatibility antigen, A-31 alpha chain | Membrane (Single-pass type I membrane protein) | 205730 |
| 364 | 1A33 | HLA class I histocompatibility antigen, A-33 alpha chain | Membrane (Single-pass type I membrane protein) | 205731 |
| 365 | 1A34 | HLA class I histocompatibility antigen, A-34 alpha chain | Membrane (Single-pass type I membrane protein) | 205732 |
| 366 | 1A68 | HLA class I histocompatibility antigen, A-68 alpha chain | Membrane (Single-pass type I membrane protein) | 205733 |
| 367 | 1A80 | HLA class I histocompatibility antigen, A-80 alpha chain | Membrane (Single-pass type I membrane protein) | 205734 |
| 368 | HLAE | HLA class I histocompatibility antigen, alpha chain E | | 205735 |
| 369 | HLAF | HLA class I histocompatibility antigen, alpha chain F | | 205736 |
| 370 | 1B15 | HLA class I histocompatibility antigen, B-15 alpha chain | Membrane (Single-pass type I membrane protein) | 205737 |
| 371 | 1B37 | HLA class I histocompatibility antigen, B-37 alpha chain | Membrane (Single-pass type I membrane protein) | 205738 |
| 372 | 1B40 | HLA class I histocompatibility antigen, B-40 alpha chain | Membrane (Single-pass type I membrane protein) | 205739 |
| 373 | 1A45 | HLA class I histocompatibility antigen, B-45 alpha chain | Membrane (Single-pass type I membrane protein) | 205740 |

TABLE 6-continued

Signal Sequences

| SS No. | Symbol | Signal Sequence Name | Cellular and extracellular location | SEQ ID NO |
|---|---|---|---|---|
| 374 | 1B47 | HLA class I histocompatibility antigen, B-47 alpha chain | Membrane (Single-pass type I membrane protein) | 205741 |
| 375 | 1B48 | HLA class I histocompatibility antigen, B-48 alpha chain | Membrane (Single-pass type I membrane protein) | 205742 |
| 376 | 1B52 | HLA class I histocompatibility antigen, B-52 alpha chain | Membrane (Single-pass type I membrane protein) | 205743 |
| 377 | 1B57 | HLA class I histocompatibility antigen, B-57 alpha chain | Membrane (Single-pass type I membrane protein) | 205744 |
| 378 | 1B59 | HLA class I histocompatibility antigen, B-59 alpha chain | Membrane (Single-pass type I membrane protein) | 205745 |
| 379 | 1B07 | HLA class I histocompatibility antigen, B-7 alpha chain | Membrane (Single-pass type I membrane protein) | 205746 |
| 380 | 1B78 | HLA class I histocompatibility antigen, B-78 alpha chain | Membrane (Single-pass type I membrane protein) | 205747 |
| 381 | 1B82 | HLA class I histocompatibility antigen, B-82 alpha chain | Membrane (Single-pass type I membrane protein) | 205748 |
| 382 | 1C01 | HLA class I histocompatibility antigen, Cw-1 alpha chain | Membrane (Single-pass type I membrane protein) | 205749 |
| 383 | 1C14 | HLA class I histocompatibility antigen, Cw-14 alpha chain | Membrane (Single-pass type I membrane protein) | 205750 |
| 384 | 1C15 | HLA class I histocompatibility antigen, Cw-15 alpha chain | Membrane (Single-pass type I membrane protein) | 205751 |
| 385 | 1C16 | HLA class I histocompatibility antigen, Cw-16 alpha chain | Membrane (Single-pass type I membrane protein) | 205752 |
| 386 | 1C17 | HLA class I histocompatibility antigen, Cw-17 alpha chain | Membrane (Single-pass type I membrane protein) | 205753 |
| 387 | 1C18 | HLA class I histocompatibility antigen, Cw-18 alpha chain | Membrane (Single-pass type I membrane protein) | 205754 |
| 388 | 1C03 | HLA class I histocompatibility antigen, Cw-3 alpha chain | Membrane (Single-pass type I membrane protein) | 205755 |
| 389 | 1C04 | HLA class I histocompatibility antigen, Cw-4 alpha chain | Membrane (Single-pass type I membrane protein) | 205756 |
| 390 | 1C05 | HLA class I histocompatibility antigen, Cw-5 alpha chain | Membrane (Single-pass type I membrane protein) | 205757 |
| 391 | 1C07 | HLA class I histocompatibility antigen, Cw-7 alpha chain | Membrane (Single-pass type I membrane protein) | 205758 |
| 392 | 2DOB | HLA class II histocompatibility antigen, DO beta chain | Membrane (Single-pass type I membrane protein) | 205759 |
| 393 | HB2O | HLA class II histocompatibility antigen, DP alpha chain | | 205760 |
| 394 | HB2P | HLA class II histocompatibility antigen, DP(W4) beta chain | | 205761 |
| 395 | HA21 | HLA class II histocompatibility antigen, DQ(1) alpha chain | | 205762 |
| 396 | HB21 | HLA class II histocompatibility antigen, DQ (1) beta chain | Membrane (Single-pass type I membrane protein) | 205763 |
| 397 | HA23 | HLA class II histocompatibility antigen, DQ (3) alpha chain | Membrane (Single-pass type I membrane protein) | 205764 |
| 398 | HB24 | HLA class II histocompatibility antigen, DQ (3) beta chain | Membrane (Single-pass type I membrane protein) | 205765 |
| 399 | HA25 | HLA class II histocompatibility antigen, DQ (5) alpha chain | Membrane (Single-pass type I membrane protein) | 205766 |
| 400 | HA26 | HLA class II histocompatibility antigen, DQ (6) alpha chain | | 205767 |
| 401 | HB22 | HLA class II histocompatibility antigen, DQ(W1.1) beta chain | Membrane (Single-pass type I membrane protein) | 205768 |
| 402 | HA27 | HLA class II histocompatibility antigen, DQ(W3) alpha chain | Membrane (Single-pass type I membrane protein) | 205769 |
| 403 | HB23 | HLA class II histocompatibility antigen, DQ(W3) beta chain | Membrane (Single-pass type I membrane protein) | 205770 |
| 404 | HB25 | HLA class II histocompatibility antigen, DQB1*0602 beta chain | Membrane (Single-pass type I membrane protein) | 205771 |
| 405 | 2DRA | HLA class II histocompatibility antigen, DR alpha chain | Membrane (Single-pass type I membrane protein) | 205772 |
| 406 | HB2B | HLA class II histocompatibility antigen, DR-1 beta chain | Membrane (Single-pass type I membrane protein) | 205773 |
| 407 | HB2C | HLA class II histocompatibility antigen, DR-1 beta chain | Membrane (Single-pass type I membrane protein) | 205774 |
| 408 | 2B11 | HLA class II histocompatibility antigen, DRB1-1 beta chain | Membrane (Single-pass type I membrane protein) | 205775 |
| 409 | 2B1A | HLA class II histocompatibility antigen, DRB1-10 beta chain | Membrane (Single-pass type I membrane protein) | 205776 |
| 410 | 2B1B | HLA class II histocompatibility antigen, DRB1-11 beta chain | Membrane (Single-pass type I membrane protein) | 205777 |
| 411 | 2B14 | HLA class II histocompatibility antigen, DRB1-4 beta chain | Membrane (Single-pass type I membrane protein) | 205778 |
| 412 | 2B17 | HLA class II histocompatibility antigen, DRB1-7 beta chain | Membrane (Single-pass type I membrane protein) | 205779 |
| 413 | 2B19 | HLA class II histocompatibility antigen, DRB1-9 beta chain | Membrane (Single-pass type I membrane protein) | 205780 |

TABLE 6-continued

Signal Sequences

| SS No. | Symbol | Signal Sequence Name | Cellular and extracellular location | SEQ ID NO |
|---|---|---|---|---|
| 414 | 2B32 | HLA class II histocompatibility antigen, DRB3-2 beta chain | Membrane (Single-pass type I membrane protein) | 205781 |
| 415 | HB2K | HLA class II histocompatibility antigen, DR-W53 beta chain | Membrane (Single-pass type I membrane protein) | 205782 |
| 416 | HB2X | HLA class II histocompatibility antigen, DX beta chain | | 205783 |
| 417 | HA22 | HLA class II histocompatibility antigen, DQ (2) alpha chain | Membrane (Single-pass type I membrane protein) | 205784 |
| 418 | HABP2 | Hyaluronan-binding protein 2 | Secreted | 205785 |
| 419 | HV102 | Ig heavy chain V-I region HG3 | Plasm membrane; extracellular space | 205786 |
| 420 | HV104 | Ig heavy chain V-I region ND | Plasm membrane; extracellular space | 205787 |
| 421 | HV103 | Ig heavy chain V-I region V35 | Plasm membrane; extracellular space | 205788 |
| 422 | HV209 | Ig heavy chain V-II region ARH-77 | | 205789 |
| 423 | HV208 | Ig heavy chain V-II region SESS precursor | | 205790 |
| 424 | HV303 | Ig heavy chain V-III region VH26 precursor | | 205791 |
| 425 | KV501 | Ig kappa chain V region EV15 | | 205792 |
| 426 | KV124 | Ig kappa chain V-I region Daudi | | 205793 |
| 427 | KV110 | Ig kappa chain V-I region HK102 | | 205794 |
| 428 | KV123 | Ig kappa chain V-I region Walker | | 205795 |
| 429 | KV205 | Ig kappa chain V-II region GM607 | | 205796 |
| 430 | KV206 | Ig kappa chain V-II region RPMI 6410 | | 205797 |
| 431 | KV308 | Ig kappa chain V-III region CLL | | 205798 |
| 432 | KV312 | Ig kappa chain V-III region HAH | | 205799 |
| 433 | KV311 | Ig kappa chain V-III region IARC/BL41 | | 205800 |
| 434 | KV303 | Ig kappa chain V-III region NG9 | | 205801 |
| 435 | KV309 | Ig kappa chain V-III region VG | | 205802 |
| 436 | KV310 | Ig kappa chain V-III region VH | | 205803 |
| 437 | KV401 | Ig kappa chain V-IV region | | 205804 |
| 438 | KV404 | Ig kappa chain V-IV region B17 | | 205805 |
| 439 | KV403 | Ig kappa chain V-IV region JI | | 205806 |
| 440 | LV001 | Ig lambda chain V region 4A | | 205807 |
| 441 | LV107 | Ig lambda chain V-I region BL2 | | 205808 |
| 442 | LV605 | Ig lambda chain V-VI region EB4 | | 205809 |
| 443 | FCGRN | IgG receptor FcRn large subunit p51 (FcRn) (Neonatal Fc, receptor) | Cell membrane (Single-pass type I membrane protein) | 205810 |
| 444 | INHA | Inhibin alpha chain | | 205811 |
| 445 | INS | Insulin | | 205812 |
| 446 | IGFL1 | Insulin growth factor-like family member 1 | Secreted | 205813 |
| 447 | IGFL3 | Insulin growth factor-like family member 3 | Secreted | 205814 |
| 448 | INSR | Insulin receptor | Cell membrane (Single-pass type I membrane protein) | 205815 |
| 449 | INSL3 | Insulin-like 3 (Leydig insulin-like peptide) | Secreted | 205816 |
| 450 | IGF1R | Insulin-like growth factor 1 receptor | | 205817 |
| 451 | IGF2 | Insulin-like growth factor II | Secreted | 205818 |
| 452 | IBP1 | Insulin-like growth factor-binding protein 1 | Secreted | 205819 |
| 453 | IBP2 | Insulin-like growth factor-binding protein 2 | Secreted | 205820 |
| 454 | IBP3 | Insulin-like growth factor-binding protein 3 | Secreted | 205821 |
| 455 | IBP4 | Insulin-like growth factor-binding protein 4 | Secreted | 205822 |
| 456 | IBP7 | Insulin-like growth factor-binding protein 7 | | 205823 |
| 457 | ALS | Insulin-like growth factor-binding protein complex acid labile chain | | 205824 |
| 458 | INSL5 | Insulin-like peptide INSL5 (Insulin-like peptide 5) | Secreted | 205825 |
| 459 | ITA2 | Integrin alpha-2 (Platelet membrane glycoprotein Ia) | Membrane (Single-pass type I membrane protein) | 205826 |
| 460 | ITA3 | Integrin alpha-3 | Membrane (Single-pass type I membrane protein) | 205827 |
| 461 | ITA4 | Integrin alpha-4 | Membrane (Single-pass type I membrane protein) | 205828 |
| 462 | ITA5 | Integrin alpha-5 | Membrane (Single-pass type I membrane protein) | 205829 |
| 463 | ITA6 | Integrin alpha-6 | Membrane (Single-pass type I membrane protein) | 205830 |
| 464 | ITA7 | Integrin alpha-7 | Membrane (Single-pass type I membrane protein) | 205831 |
| 465 | ITAE | Integrin Alpha-E | | 205832 |
| 466 | ITA2B | Integrin alpha-Iib | Membrane (Single-pass type I membrane protein) | 205833 |
| 467 | ITA2B | Integrin alpha-IIb | | 205834 |
| 468 | ITAL | Integrin alpha-L (Leukocyte adhesion glycoprotein LFA-1, alpha chain) (LFA-1A) | Membrane (Single-pass type I membrane protein) | 205835 |
| 469 | ITAM | Integrin alpha-M | | 205836 |
| 470 | ITAV | Integrin alpha-V | | 205837 |
| 471 | ITAX | Integrin alpha-X | | 205838 |
| 472 | ITB1 | Integrin beta-1 | | 205839 |
| 473 | ITB2 | Integrin beta-2 | | 205840 |
| 474 | ITB2 | Integrin beta-2 | Membrane (Single-pass type I membrane protein) | 205841 |
| 475 | ITB4 | Integrin beta-4 (GP150) (CD104 antigen) | Membrane (Single-pass type I membrane protein) | 205842 |
| 476 | ITB7 | Integrin beta-7 | Membrane (Single-pass type I membrane protein) | 205843 |
| 477 | ITLN1 | Intelectin-1 | | 205844 |
| 478 | ITIH4 | Inter-alpha-trypsin inhibitor heavy chain H4 | Secreted | 205845 |
| 479 | ICAM1 | Intercellular adhesion molecule 1 | | 205846 |
| 480 | IFNA1 | Interferon alpha-1/13 | | 205847 |
| 481 | IFN10 | Interferon alpha-10 | | 205848 |
| 482 | IFN14 | Interferon alpha-14 | | 205849 |

TABLE 6-continued

Signal Sequences

| SS No. | Symbol | Signal Sequence Name | Cellular and extracellular location | SEQ ID NO |
|---|---|---|---|---|
| 483 | IFN16 | Interferon alpha-16 | Secreted | 205850 |
| 484 | IFN17 | Interferon alpha-17 | | 205851 |
| 485 | IFNA2 | Interferon alpha-2 | Secreted | 205852 |
| 486 | IFN21 | Interferon alpha-21 | | 205853 |
| 487 | IFNA4 | Interferon alpha-4 | Secreted | 205854 |
| 488 | IFNA5 | Interferon alpha-5 | Secreted | 205855 |
| 489 | IFNA6 | Interferon alpha-6 | Secreted | 205856 |
| 490 | IFNA7 | Interferon alpha-7 | Secreted | 205857 |
| 491 | IFNA8 | Interferon alpha-8 | Secreted | 205858 |
| 492 | IFNB | Interferon beta | Secreted | 205859 |
| 493 | IFNK | Interferon kappa (IFN-kappa) | Secreted | 205860 |
| 494 | IFNW1 | Interferon omega-1 (Interferon alpha-II-1) | Secreted | 205861 |
| 495 | INAR2 | Interferon-alpha/beta receptor beta chain | Membrane (Single-pass type I membrane protein) | 205862 |
| 496 | INGR1 | Interferon-gamma receptor alpha chain | | 205863 |
| 497 | IL20 | Interleukin 20 | | 205864 |
| 498 | IL1RA | Interleukin-1 receptor antagonist protein | Cytoplasm | 205865 |
| 499 | IL1R1 | Interleukin-1 receptor type I | Membrane (Single-pass type I membrane protein) | 205866 |
| 500 | ILRL1 | Interleukin-1 receptor-like 1 (ST2 protein) | Cell membrane (Single-pass type I membrane protein) | 205867 |
| 501 | ILRL2 | Interleukin-1 receptor-like 2 | | 205868 |
| 502 | IL10 | Interleukin-10 | Secreted | 205869 |
| 503 | I10R1 | Interleukin-10 receptor alpha chain | | 205870 |
| 504 | I10R2 | Interleukin-10 receptor beta chain | | 205871 |
| 505 | IL12A | Interleukin-12 subunit alpha | Secreted | 205872 |
| 506 | IL12B | Interleukin-12 subunit beta | Secreted | 205873 |
| 507 | I17RA | Interleukin-17 receptor A | | 205874 |
| 508 | I17RB | Interleukin-17 receptor B | Secreted | 205875 |
| 509 | I17RC | Interleukin-17 receptor C | Cell membrane (Single-pass type I membrane protein) | 205876 |
| 510 | IL17 | Interleukin-17A | | 205877 |
| 511 | IL17F | Interleukin-17F | | 205878 |
| 512 | IL18R | Interleukin-18 receptor 1 | | 205879 |
| 513 | I18BP | Interleukin-18-binding protein (IL-18BP) | Secreted | 205880 |
| 514 | IL19 | Interleukin-19 | Secreted | 205881 |
| 515 | IL2 | Interleukin-2 | Secreted | 205882 |
| 516 | IL2RA | Interleukin-2 receptor alpha chain | Membrane (Single-pass type I membrane protein) | 205883 |
| 517 | IL2RB | Interleukin-2 receptor subunit beta | Membrane (Single-pass type I membrane protein) | 205884 |
| 518 | I20RB | Interleukin-20 receptor beta chain (IL-20R-beta) | Membrane (Single-pass type I membrane protein) | 205885 |
| 519 | IL21R | Interleukin-21 receptor | Membrane (Single-pass type I membrane protein) | 205886 |
| 520 | IL22 | Interleukin-22 | | 205887 |
| 521 | I22RA | Interleukin-22 receptor alpha-2 chain (IL-22R-alpha-2) | Secreted | 205888 |
| 522 | IL24 | Interleukin-24 | Secreted | 205889 |
| 523 | IL25 | Interleukin-25 | Secreted | 205890 |
| 524 | IL3 | Interleukin-3 | Secreted | 205891 |
| 525 | IL31R | Interleukin-31 receptor A | | 205892 |
| 526 | IL4 | Interleukin-4 p | Secreted | 205893 |
| 527 | IL5 | Interleukin-5 | Secreted | 205894 |
| 528 | IL5RA | Interleukin-5 receptor alpha chain (IL-5R-alpha) (CD125,antigen) | Membrane (Single-pass type I membrane protein) | 205895 |
| 529 | IL6 | Interleukin-6 | | 205896 |
| 530 | IL6RA | Interleukin-6 receptor alpha chain | | 205897 |
| 531 | IL6RB | Interleukin-6 receptor beta chain | | 205898 |
| 532 | IL7 | Interleukin-7 | Secreted | 205899 |
| 533 | IL7RA | Interleukin-7 receptor alpha chain (IL-7R-alpha) (CD127,antigen) | Secreted; transmembrane | 205900 |
| 534 | IL8 | Interleukin-8 | | 205901 |
| 535 | IL9 | Interleukin-9 | | 205902 |
| 536 | IRBP | Interphotoreceptor retinoid-binding protein | Secreted (extracellular space, extracellular matrix, interphotoreceptor matrix) | 205903 |
| 537 | MMP1 | Interstitial collagenase | Secreted | 205904 |
| 538 | PPBI | Intestinal alkaline phosphatase | | 205905 |
| 539 | JAM1 | Junctional adhesion molecule A | Cell junction, tight junction (Single-pass type I membrane protein) | 205906 |
| 540 | JAM2 | Junctional adhesion molecule B | Cell junction, tight junction (Single-pass type I membrane protein) | 205907 |
| 541 | JAM3 | Junctional adhesion molecule C | Cell junction, tight junction (Single-pass type I membrane protein) | 205908 |
| 542 | JAML1 | Junctional adhesion molecule-like | | 205909 |
| 543 | KLK7 | Kallikrein-7 | | 205910 |
| 544 | CASK | Kappa-casein | Secreted | 205911 |
| 545 | KAZD1 | Kazal-type serine protease inhibitor domain-containing protein 1 | | 205912 |
| 546 | FGF7 | Keratinocyte growth factor | | 205913 |
| 547 | KI2L1 | Killer cell immunoglobulin-like receptor 2DL1 | Cell membrane (Single-pass type I membrane protein) | 205914 |

TABLE 6-continued

Signal Sequences

| SS No. | Symbol | Signal Sequence Name | Cellular and extracellular location | SEQ ID NO |
|---|---|---|---|---|
| 548 | KIRR2 | Kin of IRRE-like protein 2 | Cell membrane (Single-pass type I membrane protein) | 205915 |
| 549 | KNG1 | Kininogen-1 | | 205916 |
| 550 | SCF | Kit ligand | | 205917 |
| 551 | KTEL1 | KTEL motif-containing protein 1 (CAP10-like 46 kDa protein) | Endoplasmic reticulum lumen | 205918 |
| 552 | SPIT1 | Kunitz-type protease inhibitor 1 (Hepatocyte growth factor, activator inhibitor type 1) | Secreted | 205919 |
| 553 | SPIT2 | Kunitz-type protease inhibitor 2 | | 205920 |
| 554 | MFGM | Lactadherin | | 205921 |
| 555 | LCTL | Lactase-like protein | Endoplasmic reticulum membrane (Single-pass membrane protein) | 205922 |
| 556 | LPH | Lactase-phlorizin hydrolase (Lactase-glycosylceramidase) | Apical cell membrane (Single-pass type I membrane protein) (Brush border) | 205923 |
| 557 | TRFL | Lactotransferrin | | 205924 |
| 558 | LAMB1 | Laminin subunit beta-1 | | 205925 |
| 559 | LAMC1 | Laminin subunit gamma-1 | | 205926 |
| 560 | OXLA | L-amino-acid oxidase | | 205927 |
| 561 | LEPR | Leptin receptor | | 205928 |
| 562 | A2GL | Leucine-rich alpha-2-glycoprotein precursor (LRG) | Secreted | 205929 |
| 563 | LRRN1 | Leucine-rich repeat neuronal protein 1 | Membrane (Single-pass type I membrane protein) | 205930 |
| 564 | FLRT2 | Leucine-rich repeat transmembrane protein FLRT2 | Membrane (Single-pass type I membrane protein) | 205931 |
| 565 | LRC55 | Leucine-rich repeat-containing protein 55 | Membrane (Single-pass type I membrane protein) | 205932 |
| 566 | LIF | Leukemia inhibitory factor | | 205933 |
| 567 | CD45 | Leukocyte common antigen | Cell membrane (Single-pass type I membrane protein) | 205934 |
| 568 | LIRA3 | Leukocyte immunoglobulin-like receptor subfamily A member 3 | Secreted | 205935 |
| 569 | LEUK | Leukosialin | | 205936 |
| 570 | LCN1 | Lipocalin-1 | Secreted | 205937 |
| 571 | LBP | Lipopolysaccharide-binding protein | Secreted; Cytoplasmic granule membrane | 205938 |
| 572 | LIPL | Lipoprotein lipase | | 205939 |
| 573 | REG1A | Lithostathine 1 alpha (Pancreatic stone protein) (PSP) | Islet cells | 205940 |
| 574 | EST1 | Liver carboxylesterase 1 (Acyl coenzyme, A: cholesterol acyltransferase) (ACAT) | Endoplasmic reticulum lumen | 205941 |
| 575 | FCG2A | Low affinity immunoglobulin gamma Fc region receptor II-a | | 205942 |
| 576 | LDLR | Low-density lipoprotein receptor | | 205943 |
| 577 | LYAM1 | L-selectin | | 205944 |
| 578 | LUM | Lumican precursor (Keratan sulfate proteoglycan lumican) | Secreted (extracellular space, extracellular matrix) | 205945 |
| 579 | LU | Lutheran blood group glycoprotein | | 205946 |
| 580 | LSHB | Lutropin subunit beta (Luteinizing hormone subunit beta) | Secreted | 205947 |
| 581 | LYPD5 | Ly6/PLAUR domain-containing protein 5 | Secreted (extracellular space) | 205948 |
| 582 | LYPD6 | Ly6/PLAUR domain-containing protein 6 | Secreted (extracellular space) | 205949 |
| 583 | SLUR1 | Ly-6/uPAR-related protein 1 | Secreted | 205950 |
| 584 | LAG3 | Lymphocyte activation gene 3 protein | | 205951 |
| 585 | LY6D | Lymphocyte antigen 6D | | 205952 |
| 586 | LY75 | Lymphocyte antigen 75 | | 205953 |
| 587 | LY86 | Lymphocyte antigen 86 | Secreted (extracellular space) | 205954 |
| 588 | LFA3 | Lymphocyte function-associated antigen 3 | | 205955 |
| 589 | TNFB | Lymphotoxin-alpha (LT-alpha) (TNF-beta) (Tumor necrosis, factor ligand superfamily member 1) | Secreted; Membrane (The homotrimer is secreted. The heterotrimer is membrane) | 205956 |
| 590 | PPA6 | Lysophosphatidic acid phosphatase type 6 | Secreted | 205957 |
| 591 | PPAL | Lysosomal acid phosphatase | | 205958 |
| 592 | MA2B1 | Lysosomal alpha-mannosidase | Lysosome | 205959 |
| 593 | PPGB | Lysosomal protective protein | Lysosome | 205960 |
| 594 | LAMP1 | Lysosome-associated membrane glycoprotein 1 | | 205961 |
| 595 | LAMP2 | Lysosome-associated membrane glycoprotein 2 | | 205962 |
| 596 | LYSC | Lysozyme C | Lysosome | 205963 |
| 597 | CSF1 | Macrophage colony-stimulating factor 1 | | 205964 |
| 598 | MIP2A | Macrophage inflammatory protein 2-alpha (MIP2-alpha) | Secreted | 205965 |
| 599 | MIP2B | Macrophage inflammatory protein 2-beta (MIP2-beta) | Secreted | 205966 |
| 600 | HMR1 | Major histocompatibility complex class I-related gene protein | | 205967 |
| 601 | SG2A1 | Mammaglobin-B | | 205968 |
| 602 | MBL2 | Mannose-binding protein C | | 205969 |
| 603 | CBPA3 | Mast cell carboxypeptidase A | Secretory granules; Cytoplasmic vesicle | 205970 |
| 604 | MMP7 | Matrilysin | | 205971 |
| 605 | MGP | Matrix Gla protein | | 205972 |
| 606 | MMP9 | Matrix metalloproteinase-9 | | 205973 |
| 607 | PME17 | Melanocyte protein Pmel 17 | | 205974 |
| 608 | MIA | Melanoma-derived growth regulatory protein | Secreted | 205975 |
| 609 | TRFM | Melanotransferrin | | 205976 |

TABLE 6-continued

Signal Sequences

| SS No. | Symbol | Signal Sequence Name | Cellular and extracellular location | SEQ ID NO |
|---|---|---|---|---|
| 610 | MCP | Membrane cofactor protein (Trophoblast leukocyte common, antigen) (TLX) (CD46 antigen) | Acrosome inner membrane (Single-pass type I membrane protein) | 205977 |
| 611 | MBTP1 | Membrane-bound transcription factor site-1 protease | | 205978 |
| 612 | MSLN | Mesothelin | | 205979 |
| 613 | TIMP1 | Metalloproteinase inhibitor 1 | | 205980 |
| 614 | TIMP2 | Metalloproteinase inhibitor 2 | | 205981 |
| 615 | TIMP3 | Metalloproteinase inhibitor 3 (TIMP-3) | Secreted, extracellular space, extracellular matrix | 205982 |
| 616 | MICA | MHC class I polypeptide-related sequence A | | 205983 |
| 617 | MFAP4 | Microfibril-associated glycoprotein 4 | | 205984 |
| 618 | MK | Midkine | | 205985 |
| 619 | MIME | Mimecan (Osteoglycin) | Secreted (extracellular space, extracellular matrix) | 205986 |
| 620 | CD14 | Monocyte differentiation antigen CD14 | | 205987 |
| 621 | MUC1 | Mucin-1 | | 205988 |
| 622 | MUCL1 | Mucin-like protein 1 | | 205989 |
| 623 | MYP0 | Myelin P0 protein | | 205990 |
| 624 | MPZL3 | Myelin protein zero-like protein 3 | Membrane (Single-pass type I membrane protein) | 205991 |
| 625 | MAG | Myelin-associated glycoprotein | | 205992 |
| 626 | MOG | Myelin-oligodendrocyte glycoprotein | | 205993 |
| 627 | PRTN3 | Myeloblastin | | 205994 |
| 628 | PERM | Myeloperoxidase | | 205995 |
| 629 | ASPG | N(4)-(Beta-N-acetylglucosaminyl)-L-asparaginase (Glycosylasparaginase) | Lysosome | 205996 |
| 630 | GALNS | N-acetylgalactosamine-6-sulfatase | | 205997 |
| 631 | GNS | N-acetylglucosamine-6-sulfatase | | 205998 |
| 632 | PGRP2 | N-acetylmuramoyl-L-alanine amidase | | 205999 |
| 633 | ANFB | Natriuretic peptides B | | 206000 |
| 634 | CD244 | Natural killer cell receptor 2B4 (NKR2B4) | Membrane (Single-pass type I membrane protein) | 206001 |
| 635 | NEU1 | NEU 1 protein | | 206002 |
| 636 | L1CAM | Neural cell adhesion molecule L1 (N-CAM L1) (CD171 antigen) | Cell membrane (Single-pass type I membrane protein) | 206003 |
| 637 | NXPH3 | Neurexophilin-3 | Secreted | 206004 |
| 638 | NBL1 | Neuroblastoma suppressor of tumorigenicity 1 | | 206005 |
| 639 | 7B2 | Neuroendocrine protein 7B2 (Secretogranin-5) | Secreted, transport | 206006 |
| 640 | NLGNX | Neuroligin-4, X-linked (Neuroligin X) | Membrane (Single-pass type I membrane protein) | 206007 |
| 641 | NMB | Neuromedin-B | Secreted | 206008 |
| 642 | NETO2 | Neuropilin and tolloid-like protein 2 | | 206009 |
| 643 | NRP1 | Neuropilin-1 | | 206010 |
| 644 | NPTN | Neuroplastin | | 206011 |
| 645 | NTRI | Neurotrimin | | 206012 |
| 646 | MMP8 | Neutrophil collagenase | | 206013 |
| 647 | DEF1 | Neutrophil defensin 1 | | 206014 |
| 648 | DEF3 | Neutrophil defensin 3 | | 206015 |
| 649 | NGAL | Neutrophil gelatinase-associated lipocalin | | 206016 |
| 650 | NID1 | Nidogen-1 | Secreted (extracellular space, extracellular matrix, basement membrane) | 206017 |
| 651 | NID2 | Nidogen-2 | | 206018 |
| 652 | N2DL1 | NKG2D ligand 2 | | 206019 |
| 653 | CEAM5 | noembryonic antigen-related cell adhesion molecule 5 | Cell membrane (lipid anchor) | 206020 |
| 654 | RNAS2 | Non-secretory ribonuclease | | 206021 |
| 655 | SPHM | N-sulphoglucosamine sulphohydrolase | | 206022 |
| 656 | NTRK3 | NT-3 growth factor receptor | | 206023 |
| 657 | I20RA | nterleukin-20 receptor alpha chain | | 206024 |
| 658 | OLFL1 | Olfactomedin-like protein 1 | Secreted | 206025 |
| 659 | OMGP | Oligodendrocyte-myelin glycoprotein | | 206026 |
| 660 | ONCM | Oncostatin-M | | 206027 |
| 661 | OTOR | Otoraplin (Fibrocyte-derived protein) | Secreted | 206028 |
| 662 | AMYP | Pancreatic alpha-amylase | | 206029 |
| 663 | PAHO | Pancreatic prohormone | | 206030 |
| 664 | ISK1 | Pancreatic secretory trypsin inhibitor | | 206031 |
| 665 | LIPP | Pancreatic triacylglycerol lipase | Secreted | 206032 |
| 666 | PTHY | Parathyroid hormone precursor (Parathyrin) (PTH) | Secreted | 206033 |
| 667 | PEPA | Pepsin A | | 206034 |
| 668 | PI16 | Peptidase inhibitor 16 | | 206035 |
| 669 | YQ001 | Peptide | | 206036 |
| 670 | PYY | Peptide YY (PYY) (PYY-I) | Secreted | 206037 |
| 671 | PPIB | Peptidyl-prolyl cis-trans isomerase B | Endoplasmic reticulum lumen; Melanosome | 206038 |
| 672 | PERF | Perforin-1 | | 206039 |
| 673 | LCAT | Phosphatidylcholine-sterol acyltransferase | | 206040 |
| 674 | PEBP4 | Phosphatidylethanolamine-binding protein 4 | Lysosome | 206041 |
| 675 | PHLD | Phosphatidylinositol-glycan-specific phospholipase D | | 206042 |
| 676 | P3IP1 | Phosphoinositide-3-kinase-interacting protein 1 | Membrane (Single-pass type I membrane protein) | 206043 |
| 677 | PA21B | Phospholipase A2 | | 206044 |
| 678 | PA2GA | Phospholipase A2, membrane associated | Membrane | 206045 |
| 679 | PLTP | Phospholipid transfer protein | | 206046 |
| 680 | PLGF | Placenta growth factor | | 206047 |
| 681 | PP11 | Placental protein 11 | | 206048 |

TABLE 6-continued

Signal Sequences

| SS No. | Symbol | Signal Sequence Name | Cellular and extracellular location | SEQ ID NO |
|---|---|---|---|---|
| 682 | KLKB1 | Plasma kallikrein (Plasma prekallikrein) | Secreted | 206049 |
| 683 | IC1 | Plasma protease C1 inhibitor | Membrane (postsynaptic membrane) | 206050 |
| 684 | IPSP | Plasma serine protease inhibitor | | 206051 |
| 685 | PLMN | Plasminogen | | 206052 |
| 686 | PAH | Plasminogen activator inhibitor 1 | | 206053 |
| 687 | CXCL7 | Platelet basic protein (PBP) (C-X-C motif chemokine 7) | Secreted | 206054 |
| 688 | PECA1 | Platelet endothelial cell adhesion molecule (PECAM-1) | Membrane (Single-pass type I membrane protein) | 206055 |
| 689 | PLF4 | Platelet factor 4 | | 206056 |
| 690 | PF4V | Platelet factor 4 variant | | 206057 |
| 691 | GP1BA | Platelet glycoprotein Ib alpha chain | Membrane (Single-pass type I membrane protein) | 206058 |
| 692 | GP1BB | Platelet glycoprotein Ib beta chain | Membrane (Single-pass type I membrane protein) | 206059 |
| 693 | GPIX | Platelet glycoprotein IX(GPIX) (CD42a antigen) | Membrane (Single-pass type I membrane protein) | 206060 |
| 694 | GI24 | Platelet receptor Gi24 | Membrane (Single-pass type I membrane protein) | 206061 |
| 695 | PAFA | Platelet-activating factor acetylhydrolase | | 206062 |
| 696 | PDGFA | Platelet-derived growth factor subunit A | | 206063 |
| 697 | PDGFB | Platelet-derived growth factor subunit B | | 206064 |
| 698 | PTN | Pleiotrophin | | 206065 |
| 699 | PIGR | Polymeric immunoglobulin receptor | | 206066 |
| 700 | PORIM | Porimin | | 206067 |
| 701 | PZP | Pregnancy zone protein | | 206068 |
| 702 | PSG1 | Pregnancy-specific beta-1-glycoprotein 1 | | 206069 |
| 703 | PSG2 | Pregnancy-specific beta-1-glycoprotein 2 | | 206070 |
| 704 | PCYXL | Prenylcysteine oxidase-like | | 206071 |
| 705 | SAP | Proactivator polypeptide | | 206072 |
| 706 | GPR97 | Probable G-protein coupled receptor 97 | Cell membrane (Multi-pass membrane protein) | 206073 |
| 707 | PCOC2 | Procollagen C-endopeptidase enhancer 2 | | 206074 |
| 708 | GON1 | Progonadoliberin-1 | | 206075 |
| 709 | PD1L2 | Programmed cell death 1 ligand 2 | | 206076 |
| 710 | PROK1 | Prokineticin-1 (Endocrine-gland-derived vascular endothelial, growth factor) | Secreted | 206077 |
| 711 | PROK2 | Prokineticin-2 (PK2) (Protein Bv8 homolog) | Secreted | 206078 |
| 712 | PRL | Prolactin | Secreted | 206079 |
| 713 | PRLR | Prolactin receptor | | 206080 |
| 714 | PIP | Prolactin-inducible protein (Prolactin-induced protein) | Secreted | 206081 |
| 715 | PRRT3 | Proline-rich transmembrane protein 3 | Membrane (Multi-pass membrane protein) | 206082 |
| 716 | P4HA1 | Prolyl 4-hydroxylase subunit alpha-1 | | 206083 |
| 717 | MOTI | Promotilin | | 206084 |
| 718 | NPY | Pro-neuropeptide Y | Secreted | 206085 |
| 719 | PROP | Properdin r (Complement factor P) | Secreted | 206086 |
| 720 | PCSK9 | Proprotein convertase subtilisin/kexin type 9 | | 206087 |
| 721 | REL2 | Prorelaxin H2 | | 206088 |
| 722 | PGH1 | Prostaglandin G/H synthase 1 | | 206089 |
| 723 | PTGDS | Prostaglandin-H2 D-isomerase | Rough endoplasmic reticulum. Nucleus membrane. Golgi apparatus. Cytoplasm, perin | 206090 |
| 724 | PSCA | Prostate stem cell antigen | | 206091 |
| 725 | KLK3 | Prostate-specific antigen (PSA) (Kallikrein-,3) | Secreted | 206092 |
| 726 | PPAP | Prostatic acid phosphatase | | 206093 |
| 727 | AMBP | Protein AMBP | | 206094 |
| 728 | ARMET | Protein ARMET | | 206095 |
| 729 | CREG1 | Protein CREG1 | | 206096 |
| 730 | PDIA1 | Protein disulfide-isomerase | | 206097 |
| 731 | PDIA3 | Protein disulfide-isomerase A3 | Endoplasmic reticulum lumen | 206098 |
| 732 | LMAN1 | Protein ERGIC-53 (ER-Golgi intermediate compartment 53 kDa, protein) | Endoplasmic reticulum-Golgi intermediate compartment membrane (Single-pass type) | 206099 |
| 733 | G6B | Protein G6b | Endoplasmic reticulum and Golgi apparatus (Isoforms A E and D); Cell membrane (Single-pass type I membrane protein) (Isoforms A and B) | 206100 |
| 734 | NELL2 | Protein kinase C-binding protein NELL2 | Secreted | 206101 |
| 735 | NOV | Protein NOV homolog (NovH) | Secreted | 206102 |
| 736 | PARM1 | Protein PARM-1 | Membrane (Single-pass type I membrane protein) | 206103 |
| 737 | ZPI | Protein Z-dependent protease inhibitor | | 206104 |
| 738 | PCDA2 | Protocadherin alpha-2 | | 206105 |
| 739 | PCDBA | Protocadherin beta 10 (PCDH-beta10) | Cell membrane (Single-pass type I membrane protein) | 206106 |
| 740 | LYAM3 | P-selectin | | 206107 |
| 741 | SFTA1 | Pulmonary surfactant-associated protein A1 | | 206108 |
| 742 | SFTA2 | Pulmonary surfactant-associated protein A2 | | 206109 |
| 743 | PLBL2 | Putative phospholipase B-like 2 | Lysosome lumen | 206110 |
| 744 | PTPRG | Receptor-type tyrosine-protein phosphatase gamma | Membrane (Single-pass type I membrane protein) | 206111 |
| 745 | REG3G | Regenerating islet-derived protein 3 gamma | Secreted | 206112 |
| 746 | REG4 | Regenerating islet-derived protein 4 | | 206113 |
| 747 | REL3 | Relaxin-3 | | 206114 |
| 748 | RENI | Renin | | 206115 |
| 749 | RISC | Retinoid-inducible serine carboxypeptidase | | 206116 |
| 750 | RET3 | Retinol-binding protein 3 | | 206117 |
| 751 | RET4 | Retinol-binding protein 4 | | 206118 |

TABLE 6-continued

Signal Sequences

| SS No. | Symbol | Signal Sequence Name | Cellular and extracellular location | SEQ ID NO |
|---|---|---|---|---|
| 752 | RNAS4 | Ribonuclease 4 | Secreted | 206119 |
| 753 | RNAS1 | Ribonuclease pancreatic | Secreted | 206120 |
| 754 | RIB1 | Ribonuclease, RNase A Family, 1 (Pancreatic) | | 206121 |
| 755 | PLOD1 | rocollagen-lysine,2-oxoglutarate 5-dioxygenase 1 | | 206122 |
| 756 | PRPC | Salivary acidic proline-rich phosphoprotein 1/2 | | 206123 |
| 757 | SRCH | Sarcoplasmic reticulum histidine-rich calcium-binding protein | Sarcoplasmic reticulum lumen | 206124 |
| 758 | C163B | Scavenger receptor cysteine-rich type 1 protein M160 | | 206125 |
| 759 | SOST | Sclerostin | | 206126 |
| 760 | SOSD1 | Sclerostin domain-containing protein 1 (Ectodermal BMP, inhibitor) | Secreted | 206127 |
| 761 | SCRG1 | Scrapie-responsive protein 1 | Secreted | 206128 |
| 762 | SFRP1 | Secreted frizzled-related protein 1 | | 206129 |
| 763 | SFRP2 | Secreted frizzled-related protein 2 (sFRP-2) | Secreted (Wnt signaling pathway) | 206130 |
| 764 | SFRP3 | Secreted frizzled-related protein 3 (sFRP-3) | Secreted (Wnt signaling pathway) | 206131 |
| 765 | SG1D4 | Secretoglobin family 1D member 4 (IFN-gamma-inducible, secretoglobin) | Secreted | 206132 |
| 766 | SCG1 | Secretogranin-1 | | 206133 |
| 767 | SEPP1 | Selenoprotein P | | 206134 |
| 768 | SEM4B | Semaphoring | Membrane (Single-pass type I membrane protein) | 206135 |
| 769 | SEM6B | Semaphorin-6B (Semaphorin-Z) (Sema Z) | Membrane (Single-pass type I membrane protein) | 206136 |
| 770 | SEMG1 | Semenogelin-1 (Semenogelin I) (SGI) | Secreted | 206137 |
| 771 | SEMG2 | Semenogelin-2 | | 206138 |
| 772 | SRGN | Serglycin (Secretory granule proteoglycan core protein), (Platelet proteoglycan core protein) | Cytoplasmic granule | 206139 |
| 773 | ISK2 | serine protease inhibitor Kazal-type 2 | | 206140 |
| 774 | ISK6 | Serine protease inhibitor Kazal-type 6 | | 206141 |
| 775 | TRFE | Serotransferrin | | 206142 |
| 776 | ALBU | Serum albumin | Secreted | 206143 |
| 777 | SAA | Serum amyloid A protein (SAA) | Secreted | 206144 |
| 778 | SAA4 | Serum amyloid A-4 protein | Secreted | 206145 |
| 779 | SAMP | Serum amyloid P-component (SAP) | Secreted | 206146 |
| 780 | SHBG | Sex hormone-binding globulin (SHBG) (Sex steroid-binding, protein) (SBP) (Testis-specific androgen-binding protein) (ABP) | Secreted (In testis by Sertoli cells) | 206147 |
| 781 | NEUR1 | Sialidase-1 | Lysosome (membrane and lumen); cell membrane; cytoplasmic vesicle | 206148 |
| 782 | SIDT2 | SID1 transmembrane family member 2 | Membrane (Multi-pass membrane protein) | 206149 |
| 783 | SLAF5 | SLAM family member 5 | | 206150 |
| 784 | SLAF6 | SLAM family member 6 (NK-T-B-antigen) (NTB-A) | Membrane (Single-pass type I membrane protein) | 206151 |
| 785 | SLAF7 | SLAM family member 7 (CD2-like receptor-activating cytotoxic, cells) (CRACC) | Membrane (Single-pass type I membrane protein) | 206152 |
| 786 | SLAF8 | SLAM family member 8 | | 206153 |
| 787 | SMS | Somatostatin (Growth hormone release-inhibiting factor) | Secreted | 206154 |
| 788 | SOMA | Somatotropin | | 206155 |
| 789 | SPRC | SPARC | | 206156 |
| 790 | ASM | Sphingomyelin phosphodiesterase | Lysosome | 206157 |
| 791 | STC1 | Stanniocalcin-1 (STC-1) | Secreted | 206158 |
| 792 | STAT | Statherin | Secreted | 206159 |
| 793 | STS | Steryl-sulfatase | | 206160 |
| 794 | STIM2 | Stromal interaction molecule 2 | | 206161 |
| 795 | SMR3B | Submaxillary gland androgen-regulated protein 3 homolog B | Secreted | 206162 |
| 796 | SUMF1 | Sulfatase-modifying factor 1 | | 206163 |
| 797 | SFTPG | Surfactant-associated protein G | | 206164 |
| 798 | TPSN | Tapasin | | 206165 |
| 799 | TPSNR | Tapasin-related protein (TAPASIN-R) | Cell membrane (Single-pass type I membrane protein); Endoplasmic reticulum | 206166 |
| 800 | PPA5 | Tartrate-resistant acid phosphatase type 5 | | 206167 |
| 801 | CD7 | T-cell antigen CD7 | | 206168 |
| 802 | TVA2 | T-cell receptor alpha chain V region CTL-L17 | membrane | 206169 |
| 803 | TVA1 | T-cell receptor alpha chain V region HPB-MLT | | 206170 |
| 804 | TVA3 | T-cell receptor alpha chain V region PY14 | | 206171 |
| 805 | TVB2 | T-cell receptor beta chain V region CTL-L17 | membrane | 206172 |
| 806 | TVC | T-cell receptor gamma chain V region PT-gamma-1/2 | | 206173 |
| 807 | CD2 | T-cell surface antigen CD2 precursor (T-cell surface antigen T11/Leu-,5) | Membrane (Single-pass type I membrane protein) | 206174 |
| 808 | CD1A | T-cell surface glycoprotein CD1a | | 206175 |
| 809 | CD1E | T-cell surface glycoprotein CD1e | | 206176 |
| 810 | CD3D | T-cell surface glycoprotein CD3 delta chain | | 206177 |
| 811 | CD3E | T-cell surface glycoprotein CD3 epsilon chain (T-cell, surface antigen T3/Leu-4 epsilon chain) | Membrane (Single-pass type I membrane protein) | 206178 |
| 812 | CD3G | T-cell surface glycoprotein CD3 gamma chain | | 206179 |
| 813 | CD3Z | T-cell surface glycoprotein CD3 zeta chain (T-cell receptor, T3 zeta chain) (CD247 antigen) | Membrane (Single-pass type I membrane protein) | 206180 |

TABLE 6-continued

Signal Sequences

| SS No. | Symbol | Signal Sequence Name | Cellular and extracellular location | SEQ ID NO |
|---|---|---|---|---|
| 814 | CD4 | T-cell surface glycoprotein CD4 | | 206181 |
| 815 | CD5 | T-cell surface glycoprotein CD5 (Lymphocyte antigen T1/Leu-,1) (CD5 antigen) | Cell membrane (Single-pass type I membrane protein) | 206182 |
| 816 | CD8A | T-cell surface glycoprotein CD8 alpha chain | | 206183 |
| 817 | CD8B | T-cell surface glycoprotein CD8 beta chain | | 206184 |
| 818 | CD28 | T-cell-specific surface glycoprotein CD28 | Membrane (Single-pass type I membrane protein) | 206185 |
| 819 | TENA | Tenascin | | 206186 |
| 820 | TDGF1 | Teratocarcinoma-derived growth factor 1 | | 206187 |
| 821 | TICN2 | Testican-2 (SPARC/osteonectin, CWCV, and Kazal-like domains, proteoglycan 2) | Secreted, extracellular space, extracellular matrix | 206188 |
| 822 | TETN | Tetranectin (TN) (C-type lectin domain family 3-member B) | Secreted | 206189 |
| 823 | TGFR2 | TGF-beta receptor type-2 | Membrane (Single-pass type I membrane protein) | 206190 |
| 824 | TXD12 | Thioredoxin domain-containing protein 12 (Thioredoxin-like protein p19) | Endoplasmic reticulum lumen | 206191 |
| 825 | TXND4 | Thioredoxin domain-containing protein 4 (Endoplasmic, reticulum resident protein ERp44) | Endoplasmic reticulum lumen | 206192 |
| 826 | TRBM | Thrombomodulin | | 206193 |
| 827 | TPO | Thrombopoietin | | 206194 |
| 828 | TSP1 | Thrombospondin-1 | | 206195 |
| 829 | THY1 | Thy-1 membrane glycoprotein | | 206196 |
| 830 | THYG | Thyroglobulin (Tg) | Secreted | 206197 |
| 831 | TSHR | Thyrotropin receptor | | 206198 |
| 832 | TSHB | Thyrotropin subunit beta precursor (Thyroid-stimulating hormone, subunit beta) (TSH-beta) (TSH-B) | Secreted | 206199 |
| 833 | THBG | Thyroxine-binding globulin | Secreted | 206200 |
| 834 | TF | Tissue factor | | 206201 |
| 835 | TFPI1 | Tissue factor pathway inhibitor (TFPI) (Lipoprotein-, associated coagulation inhibitor) (LACI) | Secreted | 206202 |
| 836 | TFPI2 | Tissue factor pathway inhibitor 2 | | 206203 |
| 837 | TPA | Tissue-type plasminogen activator | | 206204 |
| 838 | CD80 | T-lymphocyte activation antigen CD80 | | 206205 |
| 839 | TM2D1 | TM2 domain-containing protein 1 (Beta-amyloid-binding, protein) | Membrane (Multi-pass membrane protein) | 206206 |
| 840 | TLR1 | Toll-like receptor 1 (Toll/interleukin-1 receptor-like, protein) (TIL) (CD281 antigen) | Cell membrane (Single-pass type I membrane protein); Cytoplasmic | 206207 |
| 841 | TLR3 | Toll-like receptor 3 (CD283 antigen) | Membrane (Single-pass type I membrane protein) | 206208 |
| 842 | TLR4 | Toll-like receptor 4 (hToll) (CD284 antigen) | Membrane (Single-pass type I membrane protein) | 206209 |
| 843 | TLR5 | Toll-like receptor 5 | Membrane (Single-pass type I membrane protein) | 206210 |
| 844 | TEFF | Tomoregulin-2 | | 206211 |
| 845 | TCO1 | Transcobalamin-1 (Transcobalamin I) (TCI) | Secreted | 206212 |
| 846 | TCO2 | Transcobalamin-2 | | 206213 |
| 847 | TGFB1 | Transforming growth factor beta-1 | Secreted | 206214 |
| 848 | SSRA | Translocon-associated protein subunit alpha | | 206215 |
| 849 | TMIG2 | Transmembrane and immunoglobulin domain-containing protein 2 | Membrane (Single-pass type I membrane protein) | 206216 |
| 850 | TMM25 | Transmembrane protein 25, Isoform 3 | Secreted; Signal; Transmembrane | 206217 |
| 851 | TMM46 | Transmembrane protein 46 | | 206218 |
| 852 | TMM66 | Transmembrane protein 66 | | 206219 |
| 853 | TMM9B | Transmembrane protein 9B | | 206220 |
| 854 | TTHY | Transthyretin | | 206221 |
| 855 | TFF1 | Trefoil factor 1 (pS2 protein) | Secreted | 206222 |
| 856 | TFF3 | Trefoil factor 3 | | 206223 |
| 857 | TPP1 | Tripeptidyl-peptidase 1 | | 206224 |
| 858 | TRY1 | Trypsin-1 (Trypsin I) (Cationic trypsinogen) | Secreted, extracellular space | 206225 |
| 859 | TRY2 | Trypsin-2 (Trypsin II) (Anionic trypsinogen) | Secreted, extracellular space | 206226 |
| 860 | TINAL | Tubulointerstitial nephritis antigen-like | | 206227 |
| 861 | TR10B | Tumor necrosis factor receptor superfamily member 10B | | 206228 |
| 862 | TNR10C | Tumor necrosis factor receptor superfamily member 10C | | 206229 |
| 863 | TR10D | Tumor necrosis factor receptor superfamily member 10D (Decoy, receptor 2) (DcR2) | Membrane; Single-pass type I membrane protein | 206230 |
| 864 | TR11B | Tumor necrosis factor receptor superfamily member 11B | Secreted | 206231 |
| 865 | TNR14 | Tumor necrosis factor receptor superfamily member 14 (Herpesvirus entry mediator A) | Membrane (Single-pass type I membrane protein) | 206232 |
| 866 | TNR16 | Tumor necrosis factor receptor superfamily member 16 (Low-, affinity nerve growth factor receptor) | Membrane (Single-pass type I membrane protein) | 206233 |
| 867 | TNR18 | Tumor necrosis factor receptor superfamily member 18(Glucocorticoid-induced TNFR-related protein) | Secreted | 206234 |
| 868 | TNR19 | Tumor necrosis factor receptor superfamily member 19 | Membrane (Single-pass type I membrane protein) | 206235 |
| 869 | TR19L | Tumor necrosis factor receptor superfamily member 19L | Cell membrane (Single-pass type I membrane protein); Cytoplasm | 206236 |
| 870 | TNR1A | Tumor necrosis factor receptor superfamily member 1A | | 206237 |

TABLE 6-continued

Signal Sequences

| SS No. | Symbol | Signal Sequence Name | Cellular and extracellular location | SEQ ID NO |
|---|---|---|---|---|
| 871 | TNR1B | Tumor necrosis factor receptor superfamily member 1B (Tumor, necrosis factor receptor 2) (TNF-R2) | Secreted | 206238 |
| 872 | TNR5 | Tumor necrosis factor receptor superfamily member 5 (CD40L, receptor) | Secreted | 206239 |
| 873 | TNR6B | Tumor necrosis factor receptor superfamily member 6B | Secreted | 206240 |
| 874 | TNR8 | Tumor necrosis factor receptor superfamily member 8 | Cell membrane (Single-pass type I membrane protein) (isoform 1); cytoplasm (isoform 2) | 206241 |
| 875 | TNR9 | Tumor necrosis factor receptor superfamily member 9 (4-1BB, ligand receptor) | Membrane (Single-pass type I membrane protein) | 206242 |
| 876 | EDAR | Tumor necrosis factor receptor superfamily member EDAR, (Anhidrotic ectodysplasin receptor 1) | Membrane (Single-pass type I membrane protein) | 206243 |
| 877 | TSG6 | Tumor necrosis factor-inducible gene 6 protein | | 206244 |
| 878 | TIE1 | Tyrosine-protein kinase receptor Tie-1 | Membrane (Single-pass type I membrane protein) | 206245 |
| 879 | CK083 | Uncharacterized protein C11orf83 | | 206246 |
| 880 | CQ099 | Uncharacterized protein C17orf99 | | 206247 |
| 881 | YK001 | Uncharacterized protein UNQ655/PRO1286 | Secreted; Signal | 206248 |
| 882 | UPAR | Urokinase plasminogen activator surface receptor | | 206249 |
| 883 | UROK | Urokinase-type plasminogen activator | | 206250 |
| 884 | UROM | Uromodulin | | 206251 |
| 885 | UTS2 | Urotensin-2 (Urotensin-II) | Secreted; Signal | 206252 |
| 886 | UTER | Uteroglobin | | 206253 |
| 887 | BPHL | Valacyclovir hydrolase | | 206254 |
| 888 | VCAM1 | Vascular cell adhesion protein 1 (V-CAM 1) (CD106 antigen) | Membrane; Single-pass type I membrane protein | 206255 |
| 889 | VEGFA | Vascular endothelial growth factor A (VEGF-A) | Secreted; Signal | 206256 |
| 890 | VEGFC | Vascular endothelial growth factor C (VEGF-C) (Vascular, endothelial growth factor-related protein) (VRP) (Flt4 ligand) | Secreted; Signal | 206257 |
| 891 | VGFR1 | Vascular endothelial growth factor receptor 1 | | 206258 |
| 892 | VGFR3 | Vascular endothelial growth factor receptor 3 | | 206259 |
| 893 | NEU2 | Vasopressin-neurophysin 2-copeptin | Secreted | 206260 |
| 894 | VCC1 | VEGF co-regulated chemokine 1 | | 206261 |
| 895 | CSPG2 | Versican core protein (Large fibroblast proteoglycan) | Secreted (extracellular space, extracellular matrix) | 206262 |
| 896 | VTDB | Vitamin D-binding protein | | 206263 |
| 897 | PROC | Vitamin K-dependent protein C | | 206264 |
| 898 | PROS | Vitamin K-dependent protein S | | 206265 |
| 899 | PROZ | Vitamin K-dependent protein Z | | 206266 |
| 900 | VMO1 | Vitelline membrane outer layer protein 1 homolog | Secreted; Signal | 206267 |
| 901 | VTNC | Vitronectin | | 206268 |
| 902 | VWF | von Willebrand factor (vWF) | Secreted; Localized to storage granules | 206269 |
| 903 | VSIG2 | V-set and immunoglobulin domain-containing protein 2 | | 206270 |
| 904 | VSIG4 | V-set and immunoglobulin domain-containing protein 4 | | 206271 |
| 905 | VSTM1 | V-set and transmembrane domain-containing protein 1 | | 206272 |
| 906 | WISP2 | WNT1-inducible-signaling pathway protein 2 precursor (WISP-2), (Connective tissue growth factor-like protein) (CTGF-L) | Secreted | 206273 |
| 907 | S39A6 | Zinc transporter ZIP6 (Zrt- and Irt-like protein 6) (ZIP-6) | Cell membrane (Multi-pass membrane protein) | 206274 |
| 908 | ZA2G | Zinc-alpha-2-glycoprotein | | 206275 |
| 909 | ZP2 | Zona pellucida sperm-binding protein 2 (Zona pellucida, glycoprotein ZP2) | Cell membrane (Single-pass type I membrane protein) | 206276 |
| 910 | ZG16 | Zymogen granule membrane protein 16 | | 206277 |

Cleavage Sites

In some embodiments, the effector module comprises a cleavage and/or processing feature. Representative examples are given in Table 7.

The effector module of the present invention may include at least one protein cleavage signal/site. The protein cleavage signal/site may be located at the N-terminus, the C-terminus, at any space between the N- and the C-termini such as, but not limited to, half-way between the N- and C-termini, between the N-terminus and the half-way point, between the half-way point and the C-terminus, and combinations thereof.

The effector module may include one or more cleavage signal(s)/site(s) of any proteinases. The proteinases may be a serine proteinase, a cysteine proteinase, an endopeptidease, a dipeptidease, a metalloproteinase, a glutamic proteinase, a threonine proteinase and an aspartic proteinase.

As a non-limiting example, U.S. Pat. No. 7,374,930 and U.S. application publication NO.: 2009/227660, herein incorporated by reference in their entireties, use a furin cleavage site to cleave the N-terminal methionine of GLP-1 in the expression product from the Golgi apparatus of the cells. In one aspect, the effector module may include a furin cleavage site or a modified furin cleavage site. In one embodiment, the effector module may include at least one protein cleavage signal and/or site with the proviso that the payload is not GLP-1.

TABLE 7

Proteinase and Cleavage Sites

| Proteinase No. | Proteinase | Type | Sequence or type of cleavage | SEQ ID NO |
|---|---|---|---|---|
| 1 | Actinidain | | X-X-X-R/K*R/K (not V)-X-X-X | 206278 |
| 2 | Calpain-1 | Cysteine proteinase | | — |
| 3 | Carboxypeptidase A | | P1*X-X(P1 = K, R) | 206279 |
| 4 | Carboxypeptidase P | | X-X-X-X-X-X*(X is not S); or X-X-X-X-X-X-X*(X is not G); or X-X-X-X-X-X*(X is not P) | 206280-206282 |
| 5 | Carboxypeptidase Y | | X-X-X-X-Xa*Xa-X-X-X(Xa = F, W, H, Y; X = any amino acid) | 206283 |
| 6 | Caspase-1 | Cysteine proteinase | F/W/Y/L-X-H/A/T-D* X(not P/E/D/Q/K)-X-X-X | 206284 |
| 7 | Caspase-2 | Cysteine proteinase | D-V-A-D*X(not P/E/D/Q/K)-X-X-X | 206285 |
| 8 | Caspase-3 | Cysteine proteinase | D-M-Q-D*X(not P/E/D/Q/K)-X-X-X | 206286 |
| 9 | Caspase-4 | Cysteine proteinase | L-E-V-D*X(not P/E/D/Q/K)-X-X-X | 206287 |
| 10 | Caspase-5 | Cysteine proteinase | L/W-E-H-D*X-X-X-X | 206288 |
| 11 | Caspase-6 | Cysteine proteinase | V-E-H/I-D*X(not P/E/D/Q/K)-X-X-X | 206289 |
| 12 | Caspase-7 | Cysteine proteinase | D-E-V-D*X(not P/E/D/Q/K)-X-X-X | 206290 |
| 13 | Caspase-8 | Cysteine proteinase | X-X-I-Q-A-D*S-X-X-X; or X-X-Xa-E-X-D*Xs-X-X-X (Xs = S, G, A; Xa = V, L, I, A) | 206291, 206292 |
| 14 | Caspase-9 | Cysteine proteinase | L-E-H-D*X-X-X-X | 206293 |
| 15 | Caspase-10 | Cysteine proteinase | I-E-A-D*X-X-X-X | 206294 |
| 16 | Cathepsin B | Cysteine proteinase | X-X-X-R-R *X-X-X-X | 206295 |
| 17 | Cathepsin C (dipeptidyl-peptidase I) | Cysteine proteinase | X-X(N-terminal dipeptide)*X(not P) | — |
| 18 | Cathepsin G | Cysteine proteinase | X-X-X-X-(E or K or W or F)*X-X-X-X | 206296 |
| 19 | Cathepsin H | | X-X-X-R*X-X-X-X | 206297 |
| 20 | Cathepsin K | Cysteine proteinase | X-X-L/M/F(not R)-X*X-X-X-X | 206298 |
| 21 | Cathepsin L | Cysteine proteinase | X-X-R-R *X-X-X-X | 206299 |
| 22 | Cathepsin S | | X-V-V-R*X-X-X-X | 206300 |

TABLE 7-continued

Proteinase and Cleavage Sites

| Proteinase No. | Proteinase | Type | Sequence or type of cleavage | SEQ ID NO |
|---|---|---|---|---|
| 23 | Cathepsin V | | X-F/L/V-R*X | 206301 |
| 24 | Clostripain (Clostridiopeptidase B) | Cysteine proteinase | X-X-X-X-R* P1' (P1' not E, D)-X-X | 206302 |
| 25 | Chymase | | X-X-F/Y/W/L*X-X-X-X | 206303 |
| 26 | Chymotrypsin | | P1*P1'-(P1 = aromatic(W, Y and F), P1' = nonspecific) | — |
| 27 | Elastase (neutrophil) | | X-X-X-V/A *X-X-X-X | 206304 |
| 28 | Elastase (pancreatic) | | X-X-X-X-A*X-X-X-X | 206305 |
| 29 | Elastase (leukocyte) | | V/A*X-X | — |
| 30 | Endoproteinase Arg-C | | K*K and R*K | — |
| 31 | Endoproteinase Glu-C (V8 protease) | | X-X-X-E* X-X-X(X = any amino acid); X-X-X-D* X-X-X (X = any amino acid) | 206306, 206307 |
| 32 | Endoproteinase Lys-C | | X-X-X-X-X-X-K*X-X-X-X-X-X(X = any amino acid | 206308 |
| 33 | Endoproteinase Asp-N | Metallo proteinase | X-X-X-P1*D- X-X-X(P1 = cysteic acid) | 206309 |
| 34 | Enterokinase | Serine proteinase | D-D-D-D-K*X-X-X | 206310 |
| 35 | Factor Xa | | I/A-E/D-G-R*X-X-X | 206311 |
| 36 | Formic acid | | X-X-X-D*X-X-X | 206312 |
| 37 | Furin | | X-X-R/K-R*X (small, hydrophilic)-X(not P) | 206313 |
| 38 | Glutamyl-endopeptidase | | D-AN-P/v-D*X(not P/D)-X(not P) | 206314 |
| 39 | Granzyme B | | I-E-P-D*X-X | 206315 |
| 40 | HRV 3C Protease | | L-E-V-L-F-Q*G-P | 206316 |
| 41 | Hydroxylamine (NH2OH) | | X-X-X-N*G-X-X-X | 206317 |
| 42 | Intein Site | | dithioTeritol cleavage | — |
| 43 | Iodosobenzoic acid | | X-X-X-W*X-X-X-X | 206318 |
| 44 | Leucyl aminopeptidase (peptidase S; cytosol aminopeptidase; cathepsin III) | | X-X-X-L/P(not RN)*P-X-X-X | 206319 |

TABLE 7-continued

Proteinase and Cleavage Sites

| Proteinase No. | Proteinase | Type | Sequence or type of cleavage | SEQ ID NO |
|---|---|---|---|---|
| 45 | LysC Lysyl endopeptidase (Achromobacter proteinase I) | | X-X-X-K*X-X-X-X | 206320 |
| 46 | LysN Peptidyl-Lys metalloendopeptidase | | X-X-X*K-X-X-X-X | 206321 |
| 47 | Matrix metallopeptidase-2 | Metallo proteinase | X -D(L/F/N/I)- I (or V)-P (or V/I-V (or A-S(or G/A/E)*L (or M/I/Y/F)- R (or Y/K/M/I/V)- S (or A/G)- X | 206322 |
| 48 | Matrix metallopeptidase-3 | Metallo proteinase | X -N (or I)- K (or V/I/R)-P (or V/I)- F(or Y/L/M/A)- S (or E) * M(or I/K/Y/F)- M(or K/I/R) -M (or A)- X | 206323 |
| 49 | oligopeptidase A | | X-G-P-G/A*G/A-P-A-X | 206324 |
| 50 | Papain | Cysteine proteinase | X-X-X-R/K*R/K (not V)-X-X-X | 206325 |
| 51 | Pepsin | Aspartic proteinase | X-X-X-X-hydrophobic*hydrophobic-X-X-X (hydrophobic AA = F, Y, W, L) | 206326 |
| 52 | peptidyl-dipeptidase A (peptidase P) | | (X)n (oligopeptide)*X(not P)-X(not D/E) | 206327 |
| 53 | Phytepsin | | X-X-X-F/V/I/L/A*F/V/I/L/A-X-X-X | 206328 |

TABLE 7-continued

Proteinase and Cleavage Sites

| Proteinase No. | Proteinase | Type | Sequence or type of cleavage | SEQ ID NO |
|---|---|---|---|---|
| 54 | Plasmin | Serine proteinase | X-X-X-K/R*X-X-X | 206329 |
| 55 | PreScission | | L-E-V-L-F-Q*G-P | 206330 |
| 56 | Proline-endopeptidase | | X-X-K/H/R-P*X(not P)-X-X-X | 206331 |
| 57 | Proteinase K | | P1*P1'-(P1 = aromatic, hydrophobic preferred) | — |
| 58 | Pyroglutamate aminopeptidase (bovine) | Cysteine proteinase | P1*P1 (P1 = 5-oxoPline or pyroEtamate) | — |
| 59 | Subtilisin | | P1*P1'-(P1 = neutral/acidic preferred) | — |
| 60 | signal peptidase I | | Cleavage of hydrophobic, N-terminal signal or leader sequences | — |
| 61 | SUMO Protease | | Recognize the tertiary structure of the ubiquitin-like (UBL) Ptein, SUMO | — |
| 62 | TEV protease | | E-N-L-Y-F-Q*G | 206332 |
| 63 | Thermolysin | Metallo proteinase | X-X-X-X-X*L/ F/I/L/V/M/A-X-X-X | 206333 |
| 64 | Thrombin | | L-V-P-R*G-S | 206334 |
| 65 | Trypsin | Serine proteinase | X-X-X-K/R*X-X | 206335 |
| 66 | TAGZyme | | H-tag remoV by ExoPteolytic Digestion | — |

Tags

In some embodiments, the effector module comprises a protein tag. Representative examples are given in Table 8.

The protein tag may be used for detecting and monitoring the process of the effector module. The effector module may include one or more tags such as an epitope tag (e.g., a FLAG or hemagglutinin (HA) tag). A large number of protein tags may be used for the present effector modules. They include, but are not limited to, self-labeling polypeptide tags (e.g., haloalkane dehalogenase (halotag2 or halotag7), ACP tag, clip tag, MCP tag, snap tag), epitope tags (e.g., FLAG, HA, His, and Myc), fluorescent tags (e.g., green fluorescent protein (GFP), red fluorescent protein (RFP), yellow fluorescent protein (YFP), and its variants), bioluminescent tags (e.g. luciferase and its variants), affinity tags (e.g., maltose-binding protein (MBP) tag, glutathione-S-transferase (GST) tag), immunogenic affinity tags (e.g., protein NG, IRS, AU1, AU5, glu-glu, KT3, S-tag, HSV, VSV-G, Xpress and V5), and other tags (e.g., biotin (small molecule), StrepTag (Strep/1), SBP, biotin carboxyl carrier protein (BCCP), eXact, CBP, CYD, HPC, CBD intein-chitin binding domain, Trx, NorpA, and NusA).

In other embodiments, a tag may also be selected from those disclosed in U.S. Pat. Nos. 8,999,897; 8,357,511; 7,094, 568; 5,011,912; 4,851,341; and 4,703,004; U.S. patent application publication NOs.: 2013/115635 and 2013/012687; and PCT application publication NO.: WO2013/091661; the contents of each of which are incorporated herein by reference in their entirety.

In some aspects, a multiplicity of protein tags, either the same or different tags, may be used; each of the tags may be located at the same N- or C-terminus, whereas in other cases these tags may be located at each terminus.

TABLE 8

Protein Tags

| Tag No. | Protein Tag Name | SEQ ID NO |
|---|---|---|
| 1 | AviTag | 206336 |
| 2 | BCCP (Biotin Carboxyl Carrier Protein) | 206337 |
| 3 | Calmodulin tag | 206338 |
| 4 | chitin binding protein (CBP) | 206339 |
| 5 | E-tag | 206340 |
| 6 | Fc-tag | 206341 |
| 7 | FLAG-tag | 206342 |
| 8 | GFP (from vector pHT3AG) | 206343 |
| 9 | GFP variant (CFP from Cloning vector pSEVA247C) | 206344 |
| 10 | GFP variant (RFP from Cloning vector pSAT6-DEST-RFP-N1) | 206345 |
| 11 | GFP variant (YFP from Cloning vector pSEVA227Y) | 206346 |
| 12 | Glutathione-S-transferase (GST) | 206347 |
| 13 | Halo-tag | 206348 |
| 14 | HAT tag | 206349 |
| 15 | HA-tag | 206350 |
| 16 | Isopep-tag | 206351 |
| 17 | maltose binding protein (MBP) | 206352 |
| 18 | Myc-tag | 206353 |
| 19 | poly (Histidine) (His-tag) | 206354 |
| 20 | polyarginine -tag (Arg-tag) | 206355 |
| 21 | polyglutamate tag | 206356 |
| 22 | SBP tag | 206357 |
| 23 | Snoop-tag | 206358 |
| 24 | Softag I | 206359 |
| 25 | Spy tag | 206360 |
| 26 | S-tag | 206361 |
| 27 | Strep tag II | 206362 |
| 28 | TC tag | 206363 |
| 29 | Thioredoxin (TRX) | 206364 |
| 30 | V5-tag | 206365 |

TABLE 8-continued

Protein Tags

| Tag No. | Protein Tag Name | SEQ ID NO |
|---|---|---|
| 31 | VSV-tag | 206366 |
| 32 | Xpress tag | 206367 |

Targeting or Penetrating Peptides

In some embodiments, the effector module comprises a targeting and/or penetrating peptide. Representative examples are given in Tables 9 and 10.

Small targeting and/or penetrating peptides that selectively recognize cell surface markers (e.g. receptors, trans-membrane proteins, and extra-cellular matrix molecules) can be employed to target the effector module to the desired organs, tissues or cells. Short peptides (5-50 amino acid residues) synthesized in vitro and naturally occurring peptides, or analogs, variants, derivatives thereof, may be incorporated into the effector module for homing the effector module to the desired organs, tissues and cells, and/or subcellular locations inside the cells.

In some embodiments, a targeting sequence and/or penetrating peptide may be included in the effector module to drive the effector module to a target organ, or a tissue, or a cell (e.g., a cancer cell; See Tables 9 and 10). As non-limiting examples, such targeting sequences and/or penetrating peptides may include those for targeting the effector module to desired region of the central nervous system (e.g., U.S. Pat. No. 9,259,432; U.S. application publication NO.: 2015/259392); or adipose tissue (e.g., U.S. Pat. Nos. 8,067, 377 and 8,710,017); or prostate (e.g., U.S. patent publication NO.: 2016/0046668); the contents of each of which are incorporated herein by reference in their entirety.

In other embodiments, a targeting and/or penetrating peptide may direct the effector module to a specific subcellular location inside a cell. As a non-limiting example, a mitochondria targeting peptide and/or a mitochondria membrane penetrating peptide may be included in the effector module to drive the effector module to the mitochondria of a cell. See e.g., U.S. Pat. Nos. 9,260,495; 9,173,952 and 9,132,198; and U.S. application publication NO.: 2015/361140; the contents of each of which are incorporated herein by reference in their entirety.

Naturally occurring small targeting and/or penetrating peptides that recognize specific tissues or cells bind cell surface molecules (e.g. receptors, trans-membrane proteins) with high affinity, which make them attractive trafficking moieties. Such peptides may include peptide toxins from microbes, insects (e.g. scorpion, honey bee, spider), animals (e.g. snake) and plants, and analogs, variants and derivatives thereof; and secreted peptide hormones, ligands and signal peptides.

In some aspects, analogs, variants and derivatives from natural toxins that abolish their cytotoxic activities may be used as targeting peptides. Exotoxin is a toxin secreted by bacteria. Many exotoxins have been shown to bind specific cell molecules. For example, enterotoxins, a group of protein toxins produced and secreted from bacterial organisms bind the mucosal (epithelial) cells of the intestinal wall. Enterotoxins may include, but are not limited to, *E. coli* heat stable enterotoxin (ST), Cholera toxin (CT), *E. coli* heat-labile enterotoxin (LT), *Bordetella pertussis*-derived pertussis toxin (PT), *Pseudomonas aeruginosa* exotoxin A (ETA), *Staphylococcus* enterotoxins, *Corynebacterium diphtheria*-derived diphtheria toxin, enterotoxin NSP4 from rotavirus.

Other exotoxins include neurotoxins which affect the nervous system, cardiotoxins which affect the heart, *pseudomonas* exotoxins, Botulinum neurotoxins, shiga toxin, shiga-like toxin 1 and 2, *Clostridium difficile* toxins, *Clostridium perfringens* epsiolon toxin and anthrax toxin.

In addition to exotoxins, other toxins may include those isolated from plants such as maize RIP, gelonin, pokeweed antiviral protein, saporin, trichsanthin, ricin, abrin; scorpions such as Charybdotoxin; spider such as PcTx1; cone snail such as PcTx1; sea anemone such as gigantoxin 1; honey bees such as mellitins, a group of water-soluble, cationic, amphipathic 26 amino acid alpha-helical peptides isolated from the venoms of honey bee *Apis mellifera* (western or European or big honey bee), *Apis florea* (little or dwarf honey bee), *Apis dorsata* (giant honey bee) and *Apis cerana* (oriental honey bee); snake venom toxins, bombesin which is originally isolated from the skin of toad, which binds g-protein couple gastrin releasing peptide receptors (e.g. BBR-1/2/3) in the gastric tract and brain. See e.g. Suchanek, G., et al., PNAS (1978) 75:701-704; the contents of which are incorporated by reference in its entirety.

Peptides hormones and other signal peptides transfer important messages for cell to cell communications, which selectively bind cells that express their receptors with high affinity. In some aspects, peptide hormones may be included in the effector module. Such small peptide hormones and signal peptides may include, but are not limited to, adiponectin, adipose-derived hormone, agouti signaling peptide, allatostatin, amylin, angiotensin, atrial natriuretic peptide, bomben-like peptide, big gastrin, betatrophin, bradykinin, calcitonin, corticotrophin releasing hormone, cosyntrophin, endothelin, enteroglucagon, FGF, FNDC5, follicle-stimulating hormone, gastrin, ghrelin, glucagon and glucagon-like peptide, gonadotrophin, granulocyte colony stimulating factor, growth hormone, growth hormone releasing hormone, hepcidin, human chorionic gonadotrophin, human placental lactogen, incretin, insulin and insulin analogs, insulin-like growth factor, leptin, little gastrin, liraglutide, luteinizing hormone, melanocortin, minigastrin, alpha-melanocyte-stimulating hormone, neuropeptide Y, nerve growth factor (NGF), neurotrophin-3/4, NPH insulin, orexin, obestatin, osteocalcin, pancreatic hormone, parathyroid hormone, peptide hormone, peptide YY, prolactin, preprohormone, relaxi, renin, salcatonin, somatostatin (SST), secretin, substance P, sincalide, teleost leptins, temporin, tesamorelin, thyroid stimulating hormone, urocortin, vasoactive intestinal peptide (VIP), VGF and Vitellogenin.

Targeting and penetrating peptides may also be engineered biomimetic peptides and/or chemically modified small peptides. Numerous peptides with specific motifs and sequences that target specific cells and tissues with high affinity and selectivity in normal or diseased conditions are identified. A synthetic targeting peptide may be up to 30 amino acids in length, or may be longer. A targeting peptide generally has at least about 5 amino acids but may have fewer, for example, 4 amino acids, or 3 amino acids. Generally, a targeting peptide has any number of amino acids from about 6 to about 30 inclusive. The peptide may have 6, 7, 8, 9, 10, 11, 12, 13, 14, 15, 16, 17, 18, 19, 20, 21, 22, 23, 24, 25, 26, 27, 28, 29 or 30 amino acids. Generally, a targeting peptide may have 25 or fewer amino acids, for example, 20 or fewer, for example 15 or fewer.

A chimeric peptide may also be synthesized with fused amino acids from naturally occurring proteins and artificial amino acid sequences.

In addition to penetrating peptides listed in Table 9 and Table 10, newly developed cell penetrating peptides discussed in U.S. Pat. Nos. 9,206,231; 9,110,059; 8,706,219; and 8,772,449; and U.S. application publication NOs.: 2016/089447; 2016/060296; 2016/060314; 2016/060312; 2016/060311; 2016/009772; 2016/002613; 2015/314011 and 2015/166621; and PCT application publication NOs.: WO2015/179691 and 2015/183044 (the contents of each of which are incorporated herein by reference in their entirety) may also be included in the effector module.

TABLE 9

Targeting and/or Penetrating Peptides

| Targeting Peptide No. | Gene | Targeted receptor | SEQ ID | Targeted tissues/cells | Category |
|---|---|---|---|---|---|
| 1 | CD4 binding peptide | CD4 | 206368 | anti-HIV; CD4 positive cells | Non-tumor |
| 2 | — | CD4 | 206369 | Non-tumor | Non-tumor |
| 3 | — | CD4 | 206370 | Non-tumor | Non-tumor |
| 4 | CTxB | Cholera enterotoxin subunit B; binds to ganglioside receptor (GM1) | 206371 | vaccine delivery to enhance immuno response; mucosa; Peyer's patch M cells | Non-tumor |
| 5 | mNSP4 131K; NSP4 114-135 | Derived from rotaviral enterotoxin NSP4 | 206372 | vaccine | Non-tumor |
| 6 | NSP4 120-147 | Derived from rotaviral enterotoxin NSP4 | 206373 | vaccine | Non-tumor |
| 7 | NSP4 2-22 | Derived from rotaviral enterotoxin NSP4 | 206374 | vaccine | Non-tumor |
| 8 | NSP4 90-123 | Derived from rotaviral enterotoxin NSP4 | 206375 | vaccine | Non-tumor |
| 9 | Tet-1 peptide | — | 206376 | neuron; Alzheimer's disease | Non-tumor |
| 10 | bFGF | binds to fibroblast growth factor (FGF) receptor (FGFR) | 206377 | FGFR positive cancer cells | Tumor |
| 11 | DEVDG | caspase 3 | 206378 | Tumor | Tumor |
| 12 | CD44BP | CD44 | 206379 | cancer stem cells | Tumor |
| 13 | collagen peptide | collagen derived peptide | 206380 | metastatic melanoma cells | Tumor |
| 14 | DV3 | CXC chemokine receptor 4 (CXCR4) | 206381 | Tumor | Tumor |
| 15 | Bn (2-7) | Derived from bombesin, binds to bombesin receptor such as BBR-1/2/3) | 206382 | Tumor cells; DU145 tumor xenograft | Tumor |

TABLE 9-continued

Targeting and/or Penetrating Peptides

| Targeting Peptide No. | Gene | Targeted receptor | SEQ ID | Targeted tissues/cells | Category |
|---|---|---|---|---|---|
| 16 | Bn(6-14) | Derived from bombesin, binds to bombesin receptor such as BBR-1/2/3) | 206383 | Tumor cells; DU145 tumor xenograft | Tumor |
| 17 | EAST1 | derived from *E. coli* enterotoxin; binds to GC-C | 206384 | colon cancer, irritable bowel movement and chronic constipation | Tumor |
| 18 | STh (6-19) | derived from *E. coli* enterotoxin; binds to GC-C | 206385 | colon cancer | Tumor |
| 19 | STh (2-19) | derived from *E. coli* enterotoxin; binds to GC-C | 206386 | colon cancer; bind to epithelial cells | Tumor |
| 20 | STp | derived from *E. coli* enterotoxin; binds to GC-C | 206387 | colon cancer, irritable bowel movement and chronic constipation | Tumor |
| 21 | | derived from *E. coli* enterotoxin; binds to GC-C | 206388 | nonsmall cell lung cancer | Tumor |
| 22 | LHRH peptide | derived from Luteinizing Hormone-Releasing Hormone (LHRH); modified | 206389 | various cancer cells | Tumor |
| 23 | STh | Derived from *V. cholerae* enterotoxin; Derived from *V. mimicus* enterotoxin; binds to GC-C | 206390 | colon cancer, irritable bowel movement and chronic constipation | Tumor |
| 24 | ST | Derived from *Y. enterocolitica* enterotoxin; binds to GC-C | 206391 | colon cancer, irritable bowel movement and chronic constipation | Tumor |
| 25 | FHBP | Fibronectin | 206392 | cancer stem cells | Tumor |
| 26 | PC34 | from phage display biopanning | 206393 | breast cancer cells | Tumor |
| 27 | PC65 | from phage display biopanning | 206394 | breast cancer cells | Tumor |
| 28 | PC73 | from phage display biopanning | 206395 | breast cancer cells | Tumor |
| 29 | PC82 | from phage display biopanning | 206396 | breast cancer cells | Tumor |
| 30 | SP90 | from phage display biopanning | 206397 | breast cancer cells | Tumor |
| 31 | SP94 | from phage display biopanning | 206398 | hepatocellular carcinoma cells | Tumor |
| 32 | FROP-1 | FROP-1 | 206399 | follicular thyroid carcinoma and other carcinoma | Tumor |
| 33 | cancer recognition peptide | Her-2 | 206400 | target to tumor HER-2 antigen; breast cancer, prostate cancer | Tumor |
| 34 | integrin (IBP) | Integrin | 206401 | cancer stem cells | Tumor |
| 35 | — | neuropilin-1 | 206402 | glioblastoma and endothelial cells | Tumor |
| 36 | VIP | Vasoactive intestinal peptide | 206403 | breast cancer | Tumor |
| 37 | ACPP-MMP-2 | — | 206404 | Proteases in breast cancer cells | Tumor |
| 38 | ACPP-MMP-2/9 | — | 206405 | Proteases in human fibrosarcoma | Tumor |
| 39 | alpha-melanocyte stimulating hormone peptide | — | | melanomas | Tumor |
| 40 | Antagonist G peptide | — | 206406 | small cell lung cancer | Tumor |
| 41 | CP15 | — | 206407 | colon cancer | Tumor |
| 42 | IRQ | — | 206408 | parenchymal cells | Tumor |
| 43 | L-peptide | — | 206409 | nasopharyngeal carcinoma cells | Tumor |
| 44 | p160 | — | 206410 | breast cancer | Tumor |
| 45 | RPMrel | — | 206411 | colon cancer tissue | Tumor |
| 46 | RPMrel | — | 206412 | colon cancer tissue | Tumor |
| 47 | VTW | — | 206413 | glioblastoma cells; brain tumor | Tumor |
| 48 | — | — | 206414 | fibrosarcomas | Tumor |
| 49 | — | Aminopeptidase A | 206415 | vasculature; breast tumor | Vasculature |
| 50 | IF7 | Anxa1 | 206416 | Tumor blood vessels; Melanoma and colorectal cancer | Vasculature |
| 51 | F3 peptide | bind to nucleolin | 206417 | Angiogenic blood vessels (endothelial cells) and tumor cells; leukemia tumor | Vasculature |
| 52 | CLT1 | CLC1 and fibronectin | 206418 | tumor blood vessels | Vasculature |
| 53 | CREKA | from phage display | 206419 | the blood vessels and stroma of tumor | Vasculature |
| 54 | — | MMP-2; MMP-9 | 206420 | Tumor blood vessels; Breast carcinoma | Vasculature |
| 55 | — | NG2 | 206421 | NG2-positive pericytes | Vasculature |
| 56 | — | NG2 | 206422 | NG2-positive pericytes | Vasculature |
| 57 | LyP-1 | P32/gC1qR | 206423 | Tumor cells, lymphatic endothelium | Vasculature |

TABLE 9-continued

Targeting and/or Penetrating Peptides

| Targeting Peptide No. | Gene | Targeted receptor | SEQ ID | Targeted tissues/cells | Category |
|---|---|---|---|---|---|
| 58 | RGR | PDGFR-beta | 206424 | "Pericytes and endothelial cells; Pancreatic tumors and angiogenic islets" | Vasculature |
| 59 | AGR | — | 206425 | Lymphatic vessels | Vasculature |
| 60 | CLT2 | — | 206426 | tumor blood vessels | Vasculature |
| 61 | GX1 | — | 206427 | vasculature; gastric cancer | Vasculature |
| 62 | K237 | — | 206428 | K237 ligand, a peptide that can bind to the KDR receptors predominantly expressed on the surface of tumor neovasculature endothelial cells with high affinity and specificity and inhibit the VEGF-KDR angiogenic signal pathway, was conjugated to the aldehyde group of PEG chain using the N-terminal PEGylation technique | Vasculature |
| 63 | KAA | — | 206429 | vasculature; pancreatic tumors; Pericytes and endothelial cells | Vasculature |
| 64 | KAR | — | 206430 | vasculature; pancreatic tumors | Vasculature |
| 65 | KRK | — | 206431 | Angiogenic blood: vessels and tumor cells; Tumor blood vessels; skin carcinoma | Vasculature |
| 66 | LSD | — | 206432 | Lymphatic vessels | Vasculature |
| 67 | LyP-2 | — | 206433 | Lymphatic vessels | Vasculature |
| 68 | PEGA | — | 206434 | tumor blood vessels | Vasculature |
| 69 | REA | — | 206435 | Lymphatic vessels | Vasculature |
| 70 | RMS-II | — | 206436 | tumor blood vessels | Vasculature |
| 71 | RSR | — | 206437 | Pericytes and endothelial cells | Vasculature |
| 72 | SP5-52 | — | 206438 | vasculature; various cancer | Vasculature |
| 73 | TCP-1 | — | 206439 | tumor blood vessels; Orthotopic colorectal cancer and gastric cancer | Vasculature |
| 74 | — | — | 206440 | Blood vessels; tumor blood vessels; dysplastic skin | Vasculature |

TABLE 10

Penetrating Peptides

| Peptide No. | Name | SEQ ID | Peptide features | Source |
|---|---|---|---|---|
| 1 | TAT | 206444 | Trans-Activator of Transcription protein from HIV-1; cell penetrating peptide | Torchilin, Eur. J. Pharm. Biopharm., 2009, 71, 431-444 |
| 2 | Pep-1 | 206445 | designed; synthetic peptide; for penetrating cell membrane | Delehanty J et al., Therapeutic delivery, 2010, 1, 411-433 |
| 3 | RDP | 206446 | derived from rabies virus glycoprotein; neuron; brain-blood barrier; Parkinson's disease | Fu A et al., Pharm Res 2012, 29, 1562-1569 |
| 4 | RVG29 | 206447 | rabies viral glycoprotein; brain blood barrier; binds to acetylcholine receptor (AchR) | Delehanty J et al., Therapeutic delivery, 2010, 1, 411-433 |
| 5 | Ast 1 | 206448 | Insect neuropeptide allatostatin 1; cell penetrating | Delehanty J et al., Therapeutic delivery, 2010, 1, 411-433 |
| 6 | Penetratin | 206449 | protein derived; from the antennapedia transcription factor of *Drosophila melanogaster*; cell penetrating peptide | Regberg J et al, pharmaceuticals, 2012, 5, 991-1007 |
| 7 | pVEC | 206450 | protein derived; cell penetrating peptide | |
| 8 | MPG8 | 206451 | Chimeric peptide; cell penetrating peptide | |
| 9 | Transportan | 206452 | Chimeric peptide; cell penetrating peptide | |
| 10 | Transportan10 | 206453 | Chimeric, modified; cell penetrating peptide | |
| 11 | PepFect3 | 206454 | Chimeric, modified; cell penetrating peptide | |
| 12 | PepFect 6 | 206455 | Chimeric, modified; cell penetrating peptide | |
| 13 | PepFect 14 | 206456 | Chimeric, modified; cell penetrating peptide | |
| 14 | Polyarginine | 206457 | designed, synthetic peptide; cell penetrating | |
| 15 | Stearylpolyarginine | 206458 | designed, synthetic peptide; cell penetrating | |
| 16 | Pep-3 | 206459 | designed, synthetic peptide; cell penetrating | |
| 17 | CADY | 206460 | designed, synthetic peptide; cell penetrating | |
| 18 | YTA2 | 206461 | designed, synthetic peptide; cell penetrating | |
| 19 | YTA4 | 206462 | designed, synthetic peptide; cell penetrating | |
| 20 | SynB1 | 206463 | protein derived, cell penetrating peptide | |
| 21 | SynB3 | 206464 | protein derived, cell penetrating peptide | |

TABLE 10-continued

Penetrating Peptides

| Peptide No. | Name | SEQ ID | Peptide features | Source |
|---|---|---|---|---|
| 22 | Maurocalcine | 206465 | protein derived, cell penetrating peptide | |
| 23 | PTD4 | 206466 | protein derived, cell penetrating peptide | |
| 24 | Angiopep-2 | 206467 | brain, penetrating the blood-brain barrier (BBB) | Zou L et al. Current Neuropharmacology, 2013, 11, 197-208 |
| 25 | Angiopep-5 | 206468 | brain, penetrating the blood-brain barrier (BBB) | |
| 26 | TAT (47-57) | 206469 | brain, penetrating the blood-brain barrier (BBB) | |
| 27 | (RXRRBR)2XB | 206470 | brain, penetrating the blood-brain barrier (BBB) | |
| 28 | SynB 5 | 206471 | brain, BBB | |
| 29 | FGF4 | 206472 | FGF4-SOCS3 protected mice from lethal effects of staphylococcal enterotoxin B and lipopolysaccharide by reducing production of inflammatory cytokines and hemorrhagic necrosis brain | |
| 30 | TAT-10H | 206473 | brain, penetrating the blood-brain barrier (BBB) | |
| 31 | RVG-9R | 206474 | brain, BBB | |
| 32 | TAT-HA | 206475 | brain, BBB | |
| 33 | HC-[poly(K)] | 206476 | derived from tetanus toxin; Induce increased brain cell penetration | |
| 34 | CM18-TAT | 206477 | residues 1-7 of Cecropin-A, 2-12 of Melittin, and 47-57 of HIV-1 Tat protein | |
| 35 | TH-Lip | 206478 | an engineered α-helical cell penetrating peptide originated from peptide TK (AGYLLGKINLKKLAKL(Aib)LLIL-NH; tumor cell penetrating | |
| 36 | BR2 | 206479 | synthesized peptide; tumor cell penetrating | Lim et al., Plos One, 2013, 8, e66084 |
| 37 | Xentry | 206480 | derived from an N-terminal region of the X-protein of the hepatitis B virus | Montrose K et al., Sci Rep 2013, 3, 1661 |
| 38 | | 206481 | derived from the heparin-binding motif of human eosinophil cationic protein (ECP). | Fang et al., Plos One, 2013, 8, e57318 |
| 39 | | 206482 | ECP, cell penetrating peptide | |
| 40 | | 206483 | ECP, cell penetrating peptide | |
| 41 | | 206484 | ECP, cell penetrating peptide | |
| 42 | | 206485 | ECP, cell penetrating peptide | |
| 43 | | 206486 | ECP, cell penetrating peptide | |
| 44 | | 206487 | ECP, cell penetrating peptide | |
| 45 | | 206488 | ECP, cell penetrating peptide | |
| 46 | | 206489 | ECP, cell penetrating peptide | |
| 47 | KLA | 206490 | cell penetrating peptide | |
| 48 | | 206491 | integrin; targeting dendritic cells | U.S. Pat. No. 7,820,624 |
| 49 | | 206492 | integrin; targeting dendritic cells | U.S. Pat. No. 7,820,624 |
| 50 | | 206493 | integrin; targeting dendritic cells | U.S. Pat. No. 7,820,624 |
| 51 | | 206494 | integrin; targeting dendritic cells | U.S. Pat. No. 7,820,624 |
| 52 | | 206495 | | U.S. Pat. No. 7,820,624; SEQ ID NO 5 |
| 53 | | 206496 | Dendritic cells | U.S. Pat. No. 7,820,624; SEQ ID NO 6 |
| 54 | | 206497 | | U.S. Pat. No. 7,820,624; SEQ ID NO 7 |
| 55 | | 206498 | Dendritic cells | U.S. Pat. No. 7,820,624; SEQ ID NO 8 |
| 56 | | 206499 | Dendritic cells | U.S. Pat. No. 7,820,624; SEQ ID NO 9 |
| 57 | | 206500 | Dendritic cells | U.S. Pat. No. 7,820,624; SEQ ID NO 10 |
| 58 | | 206501 | Dendritic cells | U.S. Pat. No. 7,820,624; SEQ ID NO 11 |
| 59 | | 206502 | Dendritic cells | U.S. Pat. No. 7,820,624; SEQ ID NO 12 |
| 60 | | 206503 | Dendritic cells | U.S. Pat. No. 7,820,624; SEQ ID NO 13 |
| 61 | | 206504 | Dendritic cells | U.S. Pat. No. 7,820,624; SEQ ID NO 14 |
| 62 | | 206505 | Dendritic cells | U.S. Pat. No. 7,820,624; SEQ ID NO 15 |
| 63 | | 206506 | Dendritic cells | U.S. Pat. No. 7,820,624; SEQ ID NO 16 |
| 64 | | 206507 | Dendritic cells | U.S. Pat. No. 7,820,624; SEQ ID NO 17 |
| 65 | | 206508 | Dendritic cells | U.S. Pat. No. 7,820,624; SEQ ID NO 18 |
| 66 | | 206509 | Dendritic cells | U.S. Pat. No. 7,820,624; SEQ ID NO 19 |
| 67 | | 206510 | Dendritic cells | U.S. Pat. No. 7,820,624; SEQ ID NO20 |
| 68 | | 206511 | Dendritic cells | U.S. Pat. No. 7,820,624; SEQ ID NO21 |
| 69 | | 206512 | Dendritic cells | U.S. Pat. No. 7,820,624; SEQ ID NO 22 |
| 70 | | 206513 | Dendritic cells | U.S. Pat. No. 7,820,624; SEQ ID NO23 |
| 71 | | 206514 | Dendritic cells | U.S. Pat. No. 7,820,624; SEQ ID NO 24 |
| 72 | | 206515 | Dendritic cells | U.S. Pat. No. 7,820,624; SEQ ID NO 25 |
| 73 | | 206516 | Dendritic cells | U.S. Pat. No. 7,820,624; SEQ ID NO 26 |
| 74 | | 206517 | Dendritic cells | U.S. Pat. No. 7,820,624; SEQ ID NO27 |
| 75 | | 206518 | Dendritic cells | U.S. Pat. No. 7,820,624; SEQ ID NO28 |
| 76 | | 206519 | Dendritic cells | U.S. Pat. No. 7,820,624; SEQ ID NO 29 |
| 77 | | 206520 | Dendritic cells | U.S. Pat. No. 7,820,624; SEQ ID NO 30 |
| 78 | | 206521 | Dendritic cells | U.S. Pat. No. 7,820,624; SEQ ID NO 31 |
| 79 | | 206522 | Dendritic cells | U.S. Pat. No. 7,820,624; SEQ ID NO 32 |
| 80 | | 206523 | Dendritic cells | U.S. Pat. No. 7,820,624; SEQ ID NO 33 |
| 81 | | 206524 | Dendritic cells | U.S. Pat. No. 7,820,624; SEQ ID NO 34 |
| 82 | | 206525 | Dendritic cells | U.S. Pat. No. 7,820,624; SEQ ID NO 35 |
| 83 | | 206526 | Dendritic cells | U.S. Pat. No. 7,820,624; SEQ ID NO 36 |
| 84 | | 206527 | Dendritic cells | U.S. Pat. No. 7,820,624; SEQ ID NO 37 |
| 85 | | 206528 | Dendritic cells | U.S. Pat. No. 7,820,624; SEQ ID NO 38 |

TABLE 10-continued

Penetrating Peptides

| Peptide No. | Name | SEQ ID | Peptide features | Source |
|---|---|---|---|---|
| 86 | | 206529 | Dendritic cells | U.S. Pat. No. 7,820,624; SEQ ID NO 39 |
| 87 | | 206530 | Dendritic cells | U.S. Pat. No. 7,820,624; SEQ ID NO 40 |
| 88 | | 206531 | Dendritic cells | U.S. Pat. No. 7,820,624; SEQ ID NO 41 |
| 89 | | 206532 | Dendritic cells | U.S. Pat. No. 7,820,624; SEQ ID NO 42 |
| 90 | | 206533 | Dendritic cells | U.S. Pat. No. 7,820,624; SEQ ID NO 43 |
| 91 | | 206534 | Dendritic cells | U.S. Pat. No. 7,820,624; SEQ ID NO 44 |
| 92 | | 206535 | Dendritic cells | U.S. Pat. No. 7,820,624; SEQ ID NO 45 |
| 93 | | 206536 | Dendritic cells | U.S. Pat. No. 7,820,624; SEQ ID NO 47 |
| 94 | | 206537 | Dendritic cells | U.S. Pat. No. 7,820,624; SEQ ID NO 48 |
| 95 | | 206538 | Dendritic cells | U.S. Pat. No. 7,820,624; SEQ ID NO 51 |
| 96 | | 206539 | Dendritic cells | U.S. Pat. No. 7,820,624; SEQ ID NO 52 |
| 97 | | 206540 | Honey bee toxin (mellitin, 26AAs); target to integrin, enhance nuclear transport; membrane lytic peptides | Ogris, M., et al., J. Biol. Chem. (2001) 276: 47550-47555 and Boeckle, S., et al., J. Control Release (2006) 112: 240-248). |
| 98 | | 206541 | from *apis florea*; mellitin peptides 26AAs | U.S. Pat. No. 7,943,168; U.S. Pat. No. 8,496,945; US20130281658; SEQ ID NO 1 |
| 99 | | 206542 | mellitin derivative | US20130281658;SEQ ID NO 2 |
| 100 | | 206543 | mellitin derivative | US20130281658; SEQ ID NO 3 |
| 101 | | 206544 | mellitin derivative | US20130281658; SEQ ID NO 4 |
| 102 | | 206545 | mellitin derivative | US20130281658; SEQ ID NO 5 |
| 103 | | 206546 | mellitin derivative | US20130281658; SEQ ID NO 6 |
| 104 | | 206547 | leu-mellitin; *apis florea* | US20130281658; SEQ ID NO 7 |
| 105 | | 206548 | mellitin derivative | US20130281658; SEQ ID NO 8 |
| 106 | | 206549 | mellitin derivative | US20130281658; SEQ ID NO 9 |
| 107 | | 206550 | mellitin derivative | US20130281658; SEQ ID NO 10 |
| 108 | | 206551 | mellitin derivative | US20130281658; SEQ ID NO 11 |
| 109 | | 206552 | mellitin derivative | US20130281658; SEQ ID NO 12 |
| 110 | | 206553 | mellitin derivative | US20130281658; SEQ ID NO 13 |
| 111 | | 206554 | mellitin derivative | US20130281658; SEQ ID NO 14 |
| 112 | | 206555 | mellitin derivative | US20130281658; SEQ ID NO 15 |
| 113 | | 206556 | mellitin derivative | US20130281658; SEQ ID NO 16 |
| 114 | | 206557 | mellitin derivative | US20130281658; SEQ ID NO 17 |
| 115 | | 206558 | mellitin derivative | US20130281658; SEQ ID NO 18 |
| 116 | | 206559 | mellitin derivative | US20130281658; SEQ ID NO 19 |
| 117 | | 206560 | mellitin derivative | US20130281658; SEQ ID NO 20 |
| 118 | | 206561 | mellitin derivative | US20130281658; SEQ ID NO 21 |
| 119 | | 206562 | mellitin derivative | US20130281658; SEQ ID NO 76 |
| 120 | | 206563 | mellitin derivative | US20130281658; SEQ ID NO 77 |
| 121 | | 206564 | mellitin derivative | US20130281658; SEQ ID NO 78 |
| 122 | | 206565 | mellitin derivative | US20130281658; SEQ ID NO 79 |
| 123 | | 206566 | mellitin derivative | US20130281658; SEQ ID NO 80 |
| 124 | | 206567 | mellitin derivative | US20130281658; SEQ ID NO 81 |
| 125 | | 206568 | mellitin derivative | US20130281658; SEQ ID NO 82 |
| 126 | | 206569 | mellitin derivative | US20130281658; SEQ ID NO 83 |
| 127 | | 206570 | mellitin derivative | US20130281658; SEQ ID NO 84 |
| 128 | | 206571 | mellitin derivative | US20130281658; SEQ ID NO 85 |
| 129 | | 206572 | mellitin derivative | US20130281658; SEQ ID NO 86 |
| 130 | | 206573 | mellitin derivative | US20130281658; SEQ ID NO 87 |
| 131 | | 206574 | mellitin derivative | US20130281658; SEQ ID NO 88 |
| 132 | | 206575 | mellitin derivative | US20130281658; SEQ ID NO 89 |
| 133 | | 206576 | | US20130281658; SEQ ID NO 90 |
| 134 | | 206577 | reversed mellitin | US20130281658; SEQ ID NO 92 |
| 135 | | 206578 | reversed mellitin | US20130281658; SEQ ID NO 93 |
| 136 | | 206579 | mellitin derivative | US20130281658; SEQ ID NO 94 |
| 137 | | 206580 | normal mellitin amino acid sequence is reversed and all amino acids are D-form amino acids (Glycine (G) is achiral) | US20130281658; SEQ ID NO 95 |
| 138 | | 206581 | mellitin derivative | US20130281658; SEQ ID NO 96 |
| 139 | | 206582 | cell penetrating peptides | SEQ ID NO 1 (U.S. Pat. No. 8,242,081; U.S. Pat. No. 7,943,581; U.S. Pat. No. 7,579,318) |
| 140 | | 206583 | cell penetrating peptides | SEQ ID NO 2 (U.S. Pat. No. 8,242,081; U.S. Pat. No. 7,943,581; U.S. Pat. No. 7,579,318) |
| 141 | | 206584 | cell penetrating peptides | SEQ ID NO 3 (U.S. Pat. No. 8,242,081; U.S. Pat. No. 7,943,581; U.S. Pat. No. 7,579,318) |
| 142 | | 206585 | cell penetrating peptides | SEQ ID NO 4 (U.S. Pat. No. 8,242,081; U.S. Pat. No. 7,943,581; U.S. Pat. No. 7,579,318) |
| 143 | | 206586 | cell penetrating peptides | SEQ ID NO 5 (U.S. Pat. No. 8,242,081; U.S. Pat. No. 7,943,581; U.S. Pat. No. 7,579,318) |
| 144 | | 206587 | cell penetrating peptides | SEQ ID NO 6 (U.S. Pat. No. 8,242,081; U.S. Pat. No. 7,943,581; U.S. Pat. No. 7,579,318) |
| 145 | | 206588 | cell penetrating peptides | SEQ ID NO 7 (U.S. Pat. No. 8,242,081; U.S. Pat. No. 7,943,581; U.S. Pat. No. 7,579,318) |
| 146 | | 206589 | cell penetrating peptides | SEQ ID NO 8 (U.S. Pat. No. 8,242,081; U.S. Pat. No. 7,943,581; U.S. Pat. No. 7,579,318) |

TABLE 10-continued

Penetrating Peptides

| Peptide No. | Name | SEQ ID | Peptide features | Source |
|---|---|---|---|---|
| 147 | | 206590 | cell penetrating peptides | SEQ ID NO 9 (U.S. Pat. No. 8,242,081; U.S. Pat. No. 7,943,581; U.S. Pat. No. 7,579,318) |
| 148 | | 206591 | cell penetrating peptides | SEQ ID NO 10 (U.S. Pat. No. 8,242,081; U.S. Pat. No. 7,943,581; U.S. Pat. No. 7,579,318) |
| 149 | | 206592 | cell penetrating peptides | SEQ ID NO 11 (U.S. Pat. No. 8,242,081; U.S. Pat. No. 7,943,581; U.S. Pat. No. 7,579,318) |
| 150 | | 206593 | cell penetrating peptides | SEQ ID NO 12 (U.S. Pat. No. 8,242,081; U.S. Pat. No. 7,943,581; U.S. Pat. No. 7,579,318) |
| 151 | | 206594 | cell penetrating peptides | SEQ ID NO 13 (U.S. Pat. No. 8,242,081; U.S. Pat. No. 7,943,581; U.S. Pat. No. 7,579,318) |
| 152 | | 206595 | penetrating peptide for coating nanoparticle, but not lipid based nanoparticle | U.S. Pat. No. 7,943,396; U.S. Pat. No. 8,383,423; SEQ ID NO 1 |
| 153 | | 206596 | penetrating peptide for coating nanoparticle, but not lipid based nanoparticle | U.S. Pat. No. 7,943,396; U.S. Pat. No. 8,383,423; SEQ ID NO 2 |
| 154 | | 206597 | penetrating peptide for coating nanoparticle, but not lipid based nanoparticle | U.S. Pat. No. 7,943,396; U.S. Pat. No. 8,383,423; SEQ ID NO 3 |
| 155 | | 206598 | penetrating peptide for coating nanoparticle, but not lipid based nanoparticle | U.S. Pat. No. 7,943,396; U.S. Pat. No. 8,383,423; SEQ ID NO 4 |
| 156 | | 206599 | penetrating peptide for coating nanoparticle, but not lipid based nanoparticle | U.S. Pat. No. 7,943,396; U.S. Pat. No. 8,383,423; SEQ ID NO 5 |
| 157 | | 206600 | CAP peptide; clustering; cancer | U.S. Pat. No. 8,263,133; SEQ ID NO 1 |
| 158 | | 206601 | CAP peptide; clustering; cancer | U.S. Pat. No. 8,263,133; SEQ ID NO 2 |
| 159 | | 206602 | CAP-RGD-ASA peptide; | U.S. Pat. No. 8,263,133; SEQ ID NO 3 |
| 160 | | 206603 | CAP-ASA peptide; | U.S. Pat. No. 8,263,133; SEQ ID NO 4 |
| 161 | | 206604 | CAP-RGD peptide; | U.S. Pat. No. 8,263,133; SEQ ID NO 5 |
| 162 | | 206605 | brain and heart | U.S. Pat. No. 8,506,928; SEQ ID NO 1 |
| 163 | | 206606 | brain and heart | U.S. Pat. No. 8,506,928; SEQ ID NO 2 |
| 164 | | 206607 | brain and heart | U.S. Pat. No. 8,506,928; SEQ ID NO 3 |
| 165 | | 206608 | brain and heart | U.S. Pat. No. 8,506,928; SEQ ID No 4 |
| 166 | | 206609 | brain and heart | U.S. Pat. No. 8,506,928; SEQ ID NO 5 |
| 167 | | 206610 | brain and heart | U.S. Pat. No. 8,506,928; SEQ ID NO 6 |
| 168 | | 206611 | brain and heart | U.S. Pat. No. 8,506,928; SEQ ID NO 7 |
| 169 | | 206612 | heart vasculature; cardiovascular diseases | U.S. Pat. No. 7,501,486; US20060160743; SEQ ID NO 1 |
| 170 | | 206613 | heart vasculature; cardiovascular diseases | U.S. Pat. No. 7,501,486; US20060160743; SEQ ID NO 2 |
| 171 | | 206614 | heart vasculature; cardiovascular diseases | U.S. Pat. No. 7,501,486; US20060160743; SEQ ID NO 3 |
| 172 | | 206615 | heart vasculature; cardiovascular diseases | U.S. Pat. No. 7,501,486; US20060160743; SEQ ID NO 4 |
| 173 | | 206616 | heart vasculature; cardiovascular diseases | U.S. Pat. No. 7,501,486; US20060160743; SEQ ID NO 5 |
| 174 | | 206617 | heart vasculature; cardiovascular diseases | U.S. Pat. No. 7,501,486; US20060160743; SEQ ID NO 6 |
| 175 | | 206618 | heart vasculature; cardiovascular diseases | U.S. Pat. No. 7,501,486; US20060160743; SEQ ID NO 7 |
| 176 | | 206619 | heart vasculature; cardiovascular diseases | U.S. Pat. No. 7,501,486; US20060160743; SEQ ID NO 8 |
| 177 | | 206620 | heart vasculature; cardiovascular diseases | U.S. Pat. No. 7,501,486; US20060160743; SEQ ID NO 9 |
| 178 | | 206621 | heart vasculature; cardiovascular diseases | U.S. Pat. No. 7,501,486; US20060160743; SEQ ID NO 10 |
| 179 | | 206622 | heart vasculature; cardiovascular diseases | U.S. Pat. No. 7,501,486; US20060160743; SEQ ID NO 11 |
| 180 | | 206623 | heart vasculature; cardiovascular diseases | U.S. Pat. No. 7,501,486; US20060160743; SEQ ID NO 12 |
| 181 | | 206624 | heart vasculature; cardiovascular diseases | U.S. Pat. No. 7,501,486; US20060160743; SEQ ID NO 13 |
| 182 | | 206625 | heart vasculature; cardiovascular diseases | U.S. Pat. No. 7,501,486; US20060160743; SEQ ID NO 14 |
| 183 | | 206626 | heart vasculature; cardiovascular diseases | U.S. Pat. No. 7,501,486; US20060160743; SEQ ID NO 15 |
| 184 | | 206627 | heart vasculature; cardiovascular diseases | U.S. Pat. No. 7,501,486; US20060160743; SEQ ID NO 16 |
| 185 | | 206628 | heart vasculature; cardiovascular diseases | U.S. Pat. No. 7,501,486; US20060160743; SEQ ID NO 17 |
| 186 | | 206629 | heart vasculature; cardiovascular diseases | U.S. Pat. No. 7,501,486; US20060160743; SEQ ID NO 18 |
| 187 | | 206630 | heart vasculature; cardiovascular diseases | U.S. Pat. No. 7,501,486; US20060160743; SEQ ID NO 19 |
| 188 | | 206631 | heart vasculature; cardiovascular diseases | U.S. Pat. No. 7,501,486; US20060160743; SEQ ID NO 20 |
| 189 | | 206632 | heart vasculature; cardiovascular diseases | U.S. Pat. No. 7,501,486; US20060160743; SEQ ID NO 21 |

TABLE 10-continued

Penetrating Peptides

| Peptide No. | Name | SEQ ID | Peptide features | Source |
|---|---|---|---|---|
| 190 | | 206633 | heart vasculature; cardiovascular diseases | U.S. Pat. No. 7,501,486; US20060160743; SEQ ID NO 22 |
| 191 | | 206634 | heart vasculature; cardiovascular diseases | U.S. Pat. No. 7,501,486; US20060160743; SEQ ID NO 23 |
| 192 | | 206635 | U87R cell binding peptide; | U.S. Pat. No. 6,303,573; SEQ ID NO 2 |
| 193 | | 206636 | U87R cell binding peptide; | U.S. Pat. No. 6,303,573; SEQ ID NO 3 |
| 194 | | 206637 | U87R cell binding peptide; | U.S. Pat. No. 6,303,573; SEQ ID NO 4 |
| 195 | | 206638 | U87R cell binding peptide; | U.S. Pat. No. 6,303,573; SEQ ID NO 9 |
| 196 | | 206639 | U87R cell binding peptide; | U.S. Pat. No. 6,303,573; SEQ ID NO 10 |
| 197 | | 206640 | U87R cell binding peptide; | U.S. Pat. No. 8,530,429; SEQ ID NO 1 |
| 198 | | 206641 | U87R cells binding peptide; | U.S. Pat. No. 8,530,429; SEQ ID NO 2 |
| 199 | | 206642 | U87R cells binding peptide; | U.S. Pat. No. 8,530,429; SEQ ID NO 3 |
| 200 | | 206643 | U87R cells binding peptide; | U.S. Pat. No. 8,530,429; SEQ ID NO 4 |
| 201 | | 206644 | U87R cells binding peptide; | U.S. Pat. No. 8,530,429; SEQ ID NO 5 |
| 202 | | 206645 | U87R cells binding peptide; | U.S. Pat. No. 8,530,429; SEQ ID NO 6 |
| 203 | | 206646 | U87R cells binding peptide; | U.S. Pat. No. 8,530,429; SEQ ID NO 7 |
| 204 | | 206647 | U87R cells binding peptide; | U.S. Pat. No. 8,530,429; SEQ ID NO 8 |
| 205 | | 206648 | U87R cells binding peptide; | U.S. Pat. No. 8,530,429; SEQ ID NO 9 |
| 206 | | 206649 | U87R cells binding peptide; | U.S. Pat. No. 8,530,429; SEQ ID NO 10 |
| 207 | | 206650 | BTIC-binding peptide; | U.S. Pat. No. 8,530,429; SEQ ID NO 11 |
| 208 | | 206651 | BTIC-binding peptide; | U.S. Pat. No. 8,530,429; SEQ ID NO 12 |
| 209 | | 206652 | BTIC-binding peptide; | U.S. Pat. No. 8,530,429; SEQ ID NO 13 |
| 210 | | 206653 | BTIC-binding peptide; | U.S. Pat. No. 8,530,429; SEQ ID NO 14 |
| 211 | | 206654 | BTIC-binding peptide; | U.S. Pat. No. 8,530,429; SEQ ID NO 15 |
| 212 | | 206655 | BTIC-binding peptide; | U.S. Pat. No. 8,530,429; SEQ ID NO 16 |
| 213 | | 206656 | skin penetrating and cell entering peptides; in particular penetrating stratum corneum layer and cell membrane. | U.S. Pat. No. 8,518,871; SEQ ID NO 1 |
| 214 | | 206657 | skin penetrating and cell entering peptides; in particular penetrating stratum corneum layer and cell membrane. | U.S. Pat. No. 8,518,871; SEQ ID NO 2 |
| 215 | | 206658 | skin penetrating and cell entering peptides; in particular penetrating stratum corneum layer and cell membrane. | U.S. Pat. No. 8,518,871; SEQ ID NO 3 |
| 216 | | 206659 | skin penetrating and cell entering peptides; in particular penetrating stratum corneum layer and cell membrane. | U.S. Pat. No. 8,518,871; SEQ ID NO 4 |
| 217 | | 206660 | skin penetrating and cell entering peptides; in particular penetrating stratum corneum layer and cell membrane. | U.S. Pat. No. 8,518,871; SEQ ID NO 5 |
| 218 | | 206661 | skin penetrating and cell entering peptides; in particular penetrating stratum corneum layer and cell membrane. | U.S. Pat. No. 8,518,871; SEQ ID NO 6 |
| 219 | | 206662 | skin penetrating and cell entering peptides; in particular penetrating stratum corneum layer and cell membrane. | U.S. Pat. No. 8,518,871; SEQ ID NO 7 |
| 220 | | 206663 | skin penetrating and cell entering peptides; in particular penetrating stratum corneum layer and cell membrane. | U.S. Pat. No. 8,518,871; SEQ ID NO 8 |
| 221 | | 206664 | skin penetrating and cell entering peptides; in particular penetrating stratum corneum layer and cell membrane. | U.S. Pat. No. 8,518,871; SEQ ID NO 9 |
| 222 | | 206665 | skin penetrating and cell entering peptides; in particular penetrating stratum corneum layer and cell membrane. | U.S. Pat. No. 8,518,871; SEQ ID NO 10 |
| 223 | | 206666 | skin penetrating and cell entering peptides; in particular penetrating stratum corneum layer and cell membrane. | U.S. Pat. No. 8,518,871; SEQ ID NO 11 |
| 224 | | 206667 | skin penetrating and cell entering peptides; in particular penetrating stratum corneum layer and cell membrane. | U.S. Pat. No. 8,518,871; SEQ ID NO 12 |
| 225 | | 206668 | skin penetrating and cell entering peptides; in particular penetrating stratum corneum layer and cell membrane. | U.S. Pat. No. 8,518,871; SEQ ID NO 13 |
| 226 | | 206669 | skin penetrating and cell entering peptides; in particular penetrating stratum corneum layer and cell membrane. | U.S. Pat. No. 8,518,871; SEQ ID NO 14 |
| 227 | | 206670 | skin penetrating and cell entering peptides; in particular penetrating stratum corneum layer and cell membrane. | U.S. Pat. No. 8,518,871; SEQ ID NO 15 |
| 228 | | 206671 | skin penetrating and cell entering peptides; in particular penetrating stratum corneum layer and cell membrane. | U.S. Pat. No. 8,518,871; SEQ ID NO 16 |
| 229 | | 206672 | skin penetrating and cell entering peptides; in particular penetrating stratum corneum layer and cell membrane. | U.S. Pat. No. 8,518,871; SEQ ID NO 17 |
| 230 | | 206673 | skin penetrating and cell entering peptides; in particular penetrating stratum corneum layer and cell membrane. | U.S. Pat. No. 8,518,871; SEQ ID NO 18 |
| 231 | | 206674 | F3 peptide; penetrating tumor blood and tumor cells | WO2003087124; SEQ ID NO. 9 |
| 232 | | 206675 | APA-binding peptide | SEQ ID NO 125 (WO2002020769) |
| 233 | | 206676 | APA-binding peptide | SEQ ID NO 126 (WO2002020769) |
| 234 | | 206677 | APA-binding peptide | SEQ ID NO 127(WO2002020769) |
| 235 | | 206678 | APA-binding peptide | SEQ ID NO 128(WO2002020769) |
| 236 | | 206679 | APA-binding peptide | SEQ ID NO 129(WO2002020769) |
| 237 | | 206680 | APA-binding peptide | SEQ ID NO 130(WO2002020769) |
| 238 | | 206681 | APA-binding peptide | SEQ ID NO 131(WO2002020769) |
| 239 | | 206682 | APA-binding peptide | SEQ ID NO 138(WO2002020769) |
| 240 | | 206683 | pancreatic targeting peptide | SEQ ID NO 139 (WO2002020769) |
| 241 | | 206684 | pancreatic targeting peptide | SEQ ID NO 140(WO2002020769) |
| 242 | | 206685 | APA-binding peptide | SEQ ID NO 141(WO2002020769) |
| 243 | | 206686 | APA-binding peptide | SEQ ID NO 142 (WO2002020769) |
| 244 | Buforin II | 206687 | cell penetrating peptide | SEQ ID NO 1(US20090186802) |

TABLE 10-continued

Penetrating Peptides

| Peptide No. | Name | SEQ ID | Peptide features | Source |
|---|---|---|---|---|
| 245 | DPV3 | 206688 | cell penetrating peptide | SEQ ID NO 2(US20090186802) |
| 246 | DPV6 | 206689 | cell penetrating peptide | SEQ ID NO 3(US20090186802) |
| 247 | DPV7 | 206690 | cell penetrating peptide | SEQ ID NO 4(US20090186802) |
| 248 | DPV7b | 206691 | cell penetrating peptide | SEQ ID NO 5(US20090186802) |
| 249 | DPV3/10 | 206692 | cell penetrating peptide | SEQ ID NO 6(US20090186802) |
| 250 | DPV10/6 | 206693 | cell penetrating peptide | SEQ ID NO 7(US20090186802) |
| 251 | DPV1047 | 206694 | cell penetrating peptide | SEQ ID NO 8(US20090186802) |
| 252 | DPV1048 | 206695 | cell penetrating peptide | SEQ ID NO 9 (US20090186802) |
| 253 | DPV10 | 206696 | cell penetrating peptide | SEQ ID NO 10 (US20090186802) |
| 254 | DPV15 | 206697 | cell penetrating peptide | SEQ ID NO 11(US20090186802) |
| 255 | DPV15b | 206698 | cell penetrating peptide | SEQ ID NO 12 (US20090186802) |
| 256 | GALA | 206699 | cell penetrating peptide | SEQ ID NO 13 (US20090186802) |
| 257 | Cβ | 206700 | Haptotactic peptide | SEQ ID NO 14 (US20090186802) |
| 258 | preCγ | 206701 | Haptotactic peptide | SEQ ID NO 15 (US20090186802) |
| 259 | CαE | 206702 | Haptotactic peptide | SEQ ID NO 16 (US20090186802) |
| 260 | hCT(9-32) | 206703 | Haptotactic peptide | SEQ ID NO 17 (US20090186802) |
| 261 | HN-1 | 206704 | Haptotactic peptide | SEQ ID NO 18 (US20090186802) |
| 262 | Influenza virus nucleoprotein (NLS) | 206705 | Haptotactic peptide | SEQ ID NO 19 (US20090186802) |
| 263 | KALA | 206706 | Haptotactic peptide | SEQ ID NO 20 (US20090186802) |
| 264 | K-FGF | 206707 | Haptotactic peptide | SEQ ID NO 21 (US20090186802) |
| 265 | Ku70 | 206708 | Haptotactic peptide | SEQ ID NO 22 (US20090186802) |
| 266 | MAP | 206709 | Haptotactic peptide | SEQ ID NO 23 (US20090186802) |
| 267 | MPG | 206710 | Haptotactic peptide | SEQ ID NO 24 (US20090186802) |
| 268 | MPM (IP/K-FGF) | 206711 | Haptotactic peptide | SEQ ID NO 25 (US20090186802) |
| 269 | N50 (NLS of NF-κB P50) | 206712 | Haptotactic peptide | SEQ ID NO 26 (US20090186802) |
| 270 | Pep-7 | 206713 | Haptotactic peptide | SEQ ID NO 28 (US20090186802) |
| 271 | Short Penetratin | 206714 | Haptotactic peptide | SEQ ID NO 30 (US20090186802) |
| 272 | pISL | 206715 | Haptotactic peptide | SEQ ID NO 33 (US20090186802) |
| 273 | Prion mouse PrPc1-28 | 206716 | Haptotactic peptide | SEQ ID NO 34 (US20090186802) |
| 274 | SAP | 206717 | Haptotactic peptide | SEQ ID NO 36 (US20090186802) |
| 275 | SV-40 (NLS) | 206718 | Haptotactic peptide | SEQ ID NO 37 (US20090186802) |
| 276 | SynB4 | 206719 | Haptotactic peptide | SEQ ID NO 40 (US20090186802) |
| 277 | Transportan derivative | 206720 | Haptotactic peptide | SEQ ID NO 46 (US20090186802) |
| 278 | Transportan derivative | 206721 | Haptotactic peptide | SEQ ID NO 47 (US20090186802) |
| 279 | VP22 | 206722 | Haptotactic peptide | SEQ ID NO 48 (US20090186802) |
| 280 | VT5 | 206723 | Haptotactic peptide | SEQ ID NO 49 (US20090186802) |

Linkers

In some embodiments, the effector module comprises a linker. Representative examples are given in Table 11 and Table 12.

The effector module of the present invention may optionally further comprise a linker region. The linker region serves primarily as a spacer between two or more polypeptides within the effector module. The "linker" or "spacer", as used herein, refers to a molecule or group of molecules that connects two molecules, or two parts of a molecule such as two domains of a recombinant protein.

In some embodiments, "Linker" (L) or "linker domain" or "linker region" or "linker module" or "peptide linker" as used herein refers to an oligo- or polypeptide region of from about 1 to 100 amino acids in length, which links together any of the domains/regions of the effector module (also called peptide linker). The peptide linker may be 1-40 amino acids in length, or 2-30 amino acids in length, or 20-80 amino acids in length, or 50-100 amino acids in length. Linker length may also be optimized depending on the type of payload utilized and based on the crystal structure of the payload. In some instances, a shorter linker length may be preferably selected. In some aspects, the peptide linker is made up of amino acids linked together by peptide bonds, preferably from 1 to 20 amino acids linked by peptide bonds, wherein the amino acids are selected from the 20 naturally occurring amino acids: Glycine (G), Alanine (A), Valine (V), Leucine (L), Isoleucine (I), Serine (S), Cysteine (C), Threonine (T), Methionine (M), Proline (P), Phenylalanine (F), Tyrosine (Y), Tryptophan (W), Histidine (H), Lysine (K), Arginine (R), Aspartate (D), Glutamic acid (E), Asparagine (N), and Glutamine (Q). One or more of these amino acids may be glycosylated, as is understood by those in the art. In some aspects, amino acids of a peptide linker may be selected from Alanine (A), Glycine (G), Proline (P), Asparagine (R), Serine (S), Glutamine (Q) and Lysine (K).

In one example, an artificially designed peptide linker may preferably be composed of a polymer of flexible residues like Glycine (G) and Serine (S) so that the adjacent protein domains are free to move relative to one another. Longer linkers may be used when it is desirable to ensure that two adjacent domains do not interfere with one another. The choice of a particular linker sequence may concern if it affects biological activity, stability, folding, targeting and/or pharmacokinetic features of the fusion construct.

In other examples, a peptide linker may be made up of a majority of amino acids that are sterically unhindered, such as Glycine (G) and Alanine (A). Exemplary linkers are polyglycines (such as $(G)_4$, $(G)_5$, $(G)_8$), poly(GA), and polyalanines. The linkers described herein are exemplary, and linkers that are much longer and which include other residues are contemplated by the present invention.

A linker sequence may be a natural linker derived from a multi-domain protein. A natural linker is a short peptide sequence that separates two different domains or motifs within a protein. Examples of proteins which may contain natural linkers or regions that can be used in the effector module may include, but are not limited to, those listed in Table 12.

In some aspects, linkers may be flexible or rigid. In other aspects, linkers may be cleavable or non-cleavable. As used herein, the terms "cleavable linker domain or region" or "cleavable peptide linker" are used interchangeably. In some embodiments, the linker sequence may be cleaved enzymatically and/or chemically. Examples of enzymes (e.g., proteinase/peptidase) useful for cleaving the peptide linker include, but are not limited to, Arg-C proteinase, Asp-N endopeptidase, chymotrypsin, clostripain, enterokinase, Factor Xa, glutamyl endopeptidase, Granzyme B, *Achromobacter* proteinase I, pepsin, proline endopeptidase, proteinase K, Staphylococcal peptidase I, thermolysin, thrombin, trypsin, and members of the Caspase family of proteolytic enzymes (e.g. Caspases 1-10). Chemical sensitive cleavage sites may also be included in a linker sequence. Examples of chemical cleavage reagents include, but are not limited to, cyanogen bromide, which cleaves methionine residues; N-chloro succinimide, iodobenzoic acid or BNPS-skatole [2-(2-nitrophenylsulfenyl)-3-methylindole], which cleaves tryptophan residues; dilute acids, which cleave at aspartyl-prolyl bonds; and e aspartic acid-proline acid cleavable recognition sites (i.e., a cleavable peptide linker comprising one or more D-P dipeptide moieties). The fusion module may include multiple regions encoding peptides of interest separated by one or more cleavable peptide linkers.

In other embodiments, a cleavable linker may be a "self-cleaving" linker peptide, such as 2 A linker (for example T2A), 2A-like linkers or functional equivalents thereof and combinations thereof. In some embodiments, the linkers include the picornaviral 2A-like linker, CHYSEL sequences of porcine teschovirus (P2A), Thosea asigna virus (T2A) or combinations, variants and functional equivalents thereof. Other linkers will be apparent to those skilled in the art and may be used in connection with alternate embodiments of the invention.

The linkers of the present invention may also be non-peptide linkers. For example, alkyl linkers such as —NH—(CH$_2$)a-C(O)—, wherein a=2-20 can be used. These alkyl linkers may further be substituted by any non-sterically hindering group such as lower alkyl (e.g., $C_1$-$C_6$) lower acyl, halogen (e.g., Cl, Br), CN, NH$_2$, phenyl, etc.

TABLE 11

Artificial Linkers

| Linker No. | Linker | Protease(s) | Source | SEQ ID NO |
|---|---|---|---|---|
| 1 | Artificial linker | — | U.S. Pat. No. 4,946,778 | — |
| 2 | Artificial linker | — | WO2012083424 | — |
| 3 | Artificial linker | — | WO2012083424 | — |
| 4 | Artificial linker | — | WO2012083424 | 206724 |
| 5 | Artificial linker | — | U.S. Pat. No. 4,946,778 | 206725 |
| 6 | Artificial linker | — | U.S. Pat. No. 4,946,778 | 206726 |
| 7 | Artificial linker | — | — | 206727 |
| 8 | Artificial linker | — | U.S. Pat. No. 5,856,456 | 206728 |
| 9 | Artificial linker | — | U.S. Pat. No. 4,946,778 | 206729 |
| 10 | Cleavable Disulfide | chymotrypsin | — | 206730 |
| 11 | Cleavable Disulfide | chymotrypsin | — | 206731 |
| 12 | Cleavable Disulfide | trypsin | — | 206732 |
| 13 | Cleavable Disulfide | factor Xa, thrombin, trypsin | — | 206733 |
| 14 | Cleavable Disulfide | trypsin | — | 206734 |
| 15 | Cleavable Disulfide | CSV | — | 206735 |
| 16 | Cleavable Disulfide | chymotrypsin, trypsin | — | 206736 |
| 17 | Cleavable Disulfide | trypsin | — | 206737 |
| 18 | Cleavable Disulfide | trypsin | — | 206738 |
| 19 | Cleavable Disulfide | trypsin | — | 206739 |
| 20 | Cleavable Disulfide | chymotrypsin, thrombin, trypsin | — | 206740 |
| 21 | Flexible G/S rich linker | — | — | — |
| 22 | Flexible G/S rich linker | — | — | — |
| 23 | Flexible G/S rich linker | — | — | — |
| 24 | Flexible G/S rich linker | — | — | — |
| 25 | Flexible G/S rich linker | — | — | — |
| 26 | Flexible G/S rich linker | — | — | — |
| 27 | Flexible G/S rich linker | — | — | 206741 |
| 28 | Flexible G/S rich linker | — | — | 206742 |
| 29 | Flexible G/S rich linker | — | — | 206743 |
| 30 | Flexible G/S rich linker | — | — | 206744 |
| 31 | Flexible G/S rich linker | — | — | 206745 |
| 32 | Flexible G/S rich linker | — | — | 206746 |
| 33 | Flexible G/S rich linker | — | — | 206747 |
| 34 | Flexible G/S rich linker | trypsin | — | 206748 |
| 35 | Flexible G/S rich linker | — | — | 206749 |
| 36 | Flexible G/S rich linker | chymotrypsin, trypsin | — | 206750 |
| 37 | Flexible G/S rich linker | trypsin | — | 206751 |
| 38 | Flexible G/S rich linker | — | — | 206752 |
| 39 | Flexible G/S rich linker | — | — | 206753 |
| 40 | Flexible G/S rich linker | — | — | 206754 |
| 41 | Rigid extended P-rich | — | — | 206755 |
| 42 | Rigid extended P-rich | — | — | 206756 |
| 43 | Rigid extended P-rich | — | — | 206757 |
| 44 | Rigid extended P-rich | — | — | 206758 |

TABLE 11-continued

Artificial Linkers

| Linker No. | Linker | Protease(s) | Source | SEQ ID NO |
|---|---|---|---|---|
| 45 | Rigid extended P-rich | — | — | 206759 |
| 46 | Rigid extended P-rich | — | — | 206760 |
| 47 | Rigid extended P-rich | — | — | 206761 |
| 48 | Rigid extended P-rich | — | — | 206762 |
| 49 | Rigid extended P-rich | — | — | 206763 |
| 50 | Rigid extended P-rich | — | — | 206764 |
| 51 | Rigid extended P-rich | — | — | 206765 |
| 52 | Rigid extended P-rich | — | — | 206766 |
| 53 | Rigid extended P-rich | — | — | 206767 |
| 54 | Rigid extended P-rich | — | — | 206768 |
| 55 | Rigid extended P-rich | — | — | 206769 |
| 56 | Rigid helical | — | — | 206770 |
| 57 | Rigid helical | trypsin | — | 206771 |
| 58 | Rigid helical | trypsin | — | 206772 |
| 59 | Rigid helical | trypsin | — | 206773 |
| 60 | Rigid helical | trypsin | — | 206774 |
| 61 | Rigid helical | trypsin | — | 206775 |
| 62 | Rigid helical | trypsin | — | 206776 |
| 63 | Rigid helical | trypsin | — | 206777 |
| 64 | Serine rich linker | — | U.S. Pat. No. 5,525,491 | 206778 |
| 65 | Serine rich linker | — | U.S. Pat. No. 5,525,491 | 206779 |
| 66 | Serine rich linker | — | U.S. Pat. No. 5,525,491 | 206780 |
| 67 | Serine rich linker | — | U.S. Pat. No. 5,525,491 | 206781 |
| 68 | Serine rich linker | — | U.S. Pat. No. 5,525,491 | 206782 |
| 69 | Serine rich linker | — | U.S. Pat. No. 5,525,491 | 206783 |
| 70 | Serine rich linker | — | U.S. Pat. No. 5,525,491 | 206784 |

TABLE 12

Proteins containing natural linker regions

| Linker No. | Name | SEQ ID NO | Protease cleavage site; linker core |
|---|---|---|---|
| 71 | 1,4-alpha-glucan-branching enzyme | — | |
| 72 | 1,4-alpha-glucan-branching enzyme | 206785 | chymotrypsin |
| 73 | 1,4-beta-n-acetylmuramidase | — | chymotrypsin, trypsin |
| 74 | 1,4-beta-n-acetylmuramidase | 206786 | |
| 75 | 1,4-beta-n-acetylmuramidase | 206787 | |
| 76 | 1,4-beta-n-acetylmuramidase | 206788 | trypsin |
| 77 | 1,4-beta-n-acetylmuramidase | 206789 | |
| 78 | 1,4-beta-n-acetylmuramidase | 206790 | |
| 79 | 1,4-beta-n-acetylmuramidase | 206791 | |
| 80 | 1,4-beta-n-acetylmuramidase | 206792 | chymotrypsin |
| 81 | 1,4-beta-n-acetylmuramidase | 206793 | chymotrypsin, trypsin |
| 82 | 1,4-beta-n-acetylmuramidase | 206794 | chymotrypsin, trypsin |
| 83 | 1,4-beta-n-acetylmuramidase | 206795 | |
| 84 | 150aa long hypothetical transcriptional regulator | 206796 | |
| 85 | 150aa long hypothetical transcriptional regulator | 206797 | chymotrypsin, trypsin |
| 86 | 1-deoxy-d-xylulose 5-phosphate reductoisomerase | 206798 | trypsin |
| 87 | 1-deoxy-d-xylulose 5-phosphate reductoisomerase | 206799 | chymotrypsin |
| 88 | 1-deoxy-d-xylulose 5-phosphate reductoisomerase | 206800 | chymotrypsin |
| 89 | 1-deoxy-d-xylulose 5-phosphate reductoisomerase | 206801 | |
| 90 | 235aa long hypothetical biotin-[acetyl-coa-carboxylase] ligase | 206802 | trypsin |
| 91 | 235aa long hypothetical biotin-[acetyl-coa-carboxylase] ligase | 206803 | |
| 92 | 235aa long hypothetical biotin-[acetyl-coa-carboxylase] ligase | 206804 | trypsin |
| 93 | 2-dehydropantoate 2-reductase | 206805 | |
| 94 | 2-dehydropantoate 2-reductase | 206806 | trypsin |
| 95 | 2-dehydropantoate 2-reductase | 206807 | |
| 96 | 2-dehydropantoate 2-reductase | 206808 | chymotrypsin |
| 97 | 2-dehydropantoate 2-reductase | 206809 | chymotrypsin, trypsin |
| 98 | 2-dehydropantoate 2-reductase | 206810 | |
| 99 | 2-dehydropantoate 2-reductase, putative | 206811 | chymotrypsin |
| 100 | 2-dehydropantoate 2-reductase, putative | 206812 | trypsin |
| 101 | 4-alpha-glucanotransferase | 206813 | trypsin |
| 102 | 4-alpha-glucanotransferase | 206814 | trypsin |
| 103 | 4-alpha-glucanotransferase | 206815 | chymotrypsin, trypsin |
| 104 | 4-diphosphocytidyl-2c-methyl-d-erythritol kinase | — | |
| 105 | 4-diphosphocytidyl-2c-methyl-d-erythritol kinase | 206816 | |
| 106 | 4-diphosphocytidyl-2c-methyl-d-erythritol kinase | 206817 | trypsin |
| 107 | 4-diphosphocytidyl-2c-methyl-d-erythritol kinase | 206818 | |
| 108 | 4-diphosphocytidyl-2c-methyl-d-erythritol kinase | 206819 | chymotrypsin, trypsin |

TABLE 12-continued

Proteins containing natural linker regions

| Linker No. | Name | SEQ ID NO | Protease cleavage site; linker core |
|---|---|---|---|
| 109 | 4-hydroxyphenylpyruvate dioxygenase | 206820 | chymotrypsin, trypsin |
| 110 | 5-13 amino acids from the N termini of human Ck and CH1 domains Linker | 206821 | |
| 111 | 5-13 amino acids from the N termini of human Ck and CH1 domains Linker | — | |
| 112 | 5-13 amino acids from the N termini of human Ck and CH1 domains Linker | 206822 | |
| 113 | 5-13 amino acids from the N termini of human Ck and CH1 domains Linker | 206823 | |
| 114 | 5-13 amino acids from the N termini of human Ck and CH1 domains Linker | 206824 | |
| 115 | 5-13 amino acids from the N termini of human Ck and CH1 domains Linker | 206825 | |
| 116 | 5'-exonuclease | 206826 | |
| 117 | 5-methyltetrahydropteroyltriglutamate--homocysteinemethyltransferase | — | trypsin |
| 118 | 5-methyltetrahydropteroyltriglutamate--homocysteinemethyltransferase | 206827 | trypsin |
| 119 | 5-methyltetrahydropteroyltriglutamate--homocysteinemethyltransferase | 206828 | trypsin |
| 120 | 5-methyltetrahydropteroyltriglutamate--homocysteinemethyltransferase | 206829 | trypsin |
| 121 | 5-methyltetrahydropteroyltriglutamate--homocysteinemethyltransferase | 206830 | trypsin |
| 122 | 5'-nucleotidase | 206831 | trypsin |
| 123 | 5'-nucleotidase | 206832 | |
| 124 | 5'-nucleotidase | 206833 | trypsin |
| 125 | 5'-nucleotidase | 206834 | chymotrypsin |
| 126 | 704aa long hypothetical glycosyltransferase | 206835 | |
| 127 | 704aa long hypothetical glycosyltransferase | 206836 | trypsin |
| 128 | 80 kda nuclear cap binding protein | 206837 | chymotrypsin, trypsin |
| 129 | 80 kda nuclear cap binding protein | 206838 | |
| 130 | 80 kda nuclear cap binding protein | 206839 | chymotrypsin, trypsin |
| 131 | 80 kda nuclear cap binding protein | 206840 | chymotrypsin, trypsin |
| 132 | Acetaldehyde dehydrogenase (acylating) | 206841 | |
| 133 | Acetaldehyde dehydrogenase (acylating) | 206842 | trypsin |
| 134 | Acetolactate synthase isozyme iii small subunit | 206843 | |
| 135 | Acetylcholine receptor protein, alpha chain | 206844 | trypsin |
| 136 | Acetylcholine receptor protein, beta chain | 206845 | chymotrypsin, trypsin |
| 137 | Aconitate hydratase 2 | 206846 | |
| 138 | Aconitate hydratase 2 | 206847 | chymotrypsin, trypsin |
| 139 | Aconitate hydratase 2 | 206848 | |
| 140 | Aconitate hydratase 2 | 206849 | chymotrypsin, trypsin |
| 141 | Aconitate hydratase 2 | 206850 | chymotrypsin, trypsin |
| 142 | Acriflavine resistance protein b | — | chymotrypsin |
| 143 | Acriflavine resistance protein b | — | |
| 144 | Acriflavine resistance protein b | — | |
| 145 | Acriflavine resistance protein b | — | trypsin |
| 146 | Acriflavine resistance protein b | — | |
| 147 | Acriflavine resistance protein b | 206851 | trypsin |
| 148 | Acriflavine resistance protein b | 206852 | chymotrypsin |
| 149 | Acriflavine resistance protein b | 206853 | chymotrypsin |
| 150 | Acriflavine resistance protein b | 206854 | |
| 151 | Acriflavine resistance protein b | 206855 | |
| 152 | Acriflavine resistance protein b | 206856 | trypsin |
| 153 | Acriflavine resistance protein b | 206857 | chymotrypsin, trypsin |
| 154 | Acriflavine resistance protein b | 206858 | chymotrypsin |
| 155 | Acriflavine resistance protein b | 206859 | chymotrypsin |
| 156 | Acriflavine resistance protein b | 206860 | trypsin |
| 157 | Acriflavine resistance protein b | 206861 | trypsin |
| 158 | Acriflavine resistance protein b | 206862 | trypsin |
| 159 | Acriflavine resistance protein b | 206863 | |
| 160 | Acriflavine resistance protein b | 206864 | chymotrypsin, trypsin |
| 161 | Acriflavine resistance protein b | 206865 | trypsin |
| 162 | Acriflavine resistance protein b | 206866 | |
| 163 | Acriflavine resistance protein b | 206867 | trypsin |
| 164 | Acriflavine resistance protein b | 206868 | trypsin |
| 165 | Acriflavine resistance protein b | 206869 | |
| 166 | Acriflavine resistance protein b | 206870 | trypsin |
| 167 | Acriflavine resistance protein b | 206871 | chymotrypsin, thrombin, trypsin |
| 168 | Acriflavine resistance protein b | 206872 | chymotrypsin, trypsin |
| 169 | Acriflavine resistance protein b | 206873 | chymotrypsin |
| 170 | Acriflavine resistance protein b | 206874 | trypsin |
| 171 | Acyl-coa thioesterase ii | 206875 | |
| 172 | Acyl-coa thioesterase ii | 206876 | chymotrypsin |
| 173 | Acyl-coa thioesterase ii | 206877 | chymotrypsin, trypsin |
| 174 | Acyl-coa thioesterase ii | 206878 | chymotrypsin, trypsin |
| 175 | Acyl-coa thioesterase ii | 206879 | trypsin |
| 176 | Acyl-coenzyme a thioesterase 4 | 206880 | trypsin |
| 177 | Acyl-coenzyme a thioesterase 4 | 206881 | chymotrypsin |
| 178 | Acyl-coenzyme a thioesterase 4 | 206882 | |
| 179 | Acyl-coenzyme a thioesterase 4 | 206883 | chymotrypsin |
| 180 | Acyl-coenzyme a thioesterase 4 | 206884 | chymotrypsin |
| 181 | Adenine glycosylase | 206885 | trypsin |
| 182 | Adenylate cyclase | 206886 | |
| 183 | Aerolysin | 206887 | |

TABLE 12-continued

Proteins containing natural linker regions

| Linker No. | Name | SEQ ID NO | Protease cleavage site; linker core |
|---|---|---|---|
| 184 | Aerolysin | 206888 | |
| 185 | Agglutinin | — | chymotrypsin |
| 186 | Agglutinin isolectin 1 | 206889 | trypsin |
| 187 | Agglutinin isolectin 1 | 206890 | |
| 188 | Aldehyde ferredoxin oxidoreductase | 206891 | trypsin |
| 189 | Aldehyde oxidoreductase | 206892 | trypsin |
| 190 | Aldehyde oxidoreductase | 206893 | chymotrypsin |
| 191 | Aldehyde oxidoreductase | 206894 | chymotrypsin |
| 192 | Aldehyde oxidoreductase | 206895 | |
| 193 | Aldehyde oxidoreductase | 206896 | chymotrypsin, factor xa, trypsin |
| 194 | Alkyl hydroperoxide reductase subunit f | 206897 | chymotrypsin |
| 195 | Alkyl hydroperoxide reductase subunit f | 206898 | |
| 196 | Alkyl hydroperoxide reductase subunit f | 206899 | |
| 197 | Alkyl hydroperoxide reductase subunit f | 206900 | trypsin |
| 198 | Alkyl hydroperoxide reductase subunit f | 206901 | trypsin |
| 199 | Alkyl hydroperoxide reductase subunit f | 206902 | chymotrypsin, trypsin |
| 200 | Alkyl hydroperoxide reductase subunit f | 206903 | trypsin |
| 201 | Alkyl hydroperoxide reductase subunit f | 206904 | trypsin |
| 202 | Alkyl hydroperoxide reductase subunit f | 206905 | |
| 203 | Alkyl hydroperoxide reductase subunit f | 206906 | chymotrypsin, trypsin |
| 204 | Allantoicase | 206907 | chymotrypsin |
| 205 | Allantoicase | 206908 | trypsin |
| 206 | Alliin lyase 1 | — | |
| 207 | Alliin lyase 1 | 206909 | chymotrypsin, trypsin |
| 208 | Alliin lyase 1 | 206910 | trypsin |
| 209 | Alliin lyase 1 | 206911 | |
| 210 | Alliin lyase 1 | 206912 | chymotrypsin, trypsin |
| 211 | Alpha amylase | 206913 | chymotrypsin |
| 212 | Alpha amylase | 206914 | trypsin |
| 213 | Alpha-actinin 1 | 206915 | |
| 214 | Alpha-actinin 1 | 206916 | |
| 215 | Alpha-adaptin c | 206917 | trypsin |
| 216 | Alpha-amylase | 206918 | chymotrypsin |
| 217 | Alpha-glucuronidase | — | |
| 218 | Alpha-glucuronidase | 206919 | chymotrypsin |
| 219 | Alpha-glucuronidase | 206920 | chymotrypsin |
| 220 | Alpha-glucuronidase | 206921 | chymotrypsin |
| 221 | Alpha-glucuronidase | 206922 | chymotrypsin, trypsin |
| 222 | Alpha-glucuronidase | 206923 | trypsin |
| 223 | Alpha-glucuronidase | 206924 | |
| 224 | Alpha-glucuronidase | 206925 | trypsin |
| 225 | Alpha-glucuronidase | 206926 | chymotrypsin |
| 226 | Alpha-glucuronidase | 206927 | chymotrypsin |
| 227 | Alpha-glucuronidase | 206928 | chymotrypsin, trypsin |
| 228 | Alpha-glucuronidase | 206929 | |
| 229 | Alpha-glucuronidase | 206930 | trypsin |
| 230 | Alpha-glucuronidase | 206931 | chymotrypsin, trypsin |
| 231 | Alpha-glucuronidase | 206932 | trypsin |
| 232 | Alpha-glucuronidase | 206933 | chymotrypsin, trypsin |
| 233 | Alpha-glucuronidase | 206934 | chymotrypsin |
| 234 | Alpha-glucuronidase | 206935 | trypsin |
| 235 | Alpha-glucuronidase | 206936 | chymotrypsin, trypsin |
| 236 | Alpha-glucuronidase | 206937 | chymotrypsin, trypsin |
| 237 | Alpha-glucuronidase | 206938 | chymotrypsin |
| 238 | Alpha-glucuronidase | 206939 | chymotrypsin, trypsin |
| 239 | Alpha-l-arabinofuranosidase b | 206940 | chymotrypsin |
| 240 | Alpha-mannosidase | 206941 | chymotrypsin |
| 241 | Alr2269 protein | 206942 | |
| 242 | Amp nucleosidase | 206943 | chymotrypsin |
| 243 | Amp nucleosidase | 206944 | |
| 244 | Amp nucleosidase | 206945 | chymotrypsin |
| 245 | Angiopoietin-1 receptor | — | |
| 246 | Angiopoietin-1 receptor | — | |
| 247 | Angiopoietin-1 receptor | — | |
| 248 | Angiopoietin-1 receptor | — | |
| 249 | Angiopoietin-1 receptor | 206946 | chymotrypsin |
| 250 | Angiopoietin-1 receptor | 206947 | trypsin |
| 251 | Angiopoietin-1 receptor | 206948 | chymotrypsin, trypsin |
| 252 | Angiopoietin-1 receptor | 206949 | |
| 253 | Angiopoietin-1 receptor | 206950 | |
| 254 | Angiopoietin-1 receptor | 206951 | |
| 255 | Angiopoietin-1 receptor | 206952 | chymotrypsin |
| 256 | Angiopoietin-1 receptor | 206953 | |
| 257 | Angiopoietin-1 receptor | 206954 | trypsin |
| 258 | Angiopoietin-1 receptor | 206955 | chymotrypsin |

TABLE 12-continued

Proteins containing natural linker regions

| Linker No. | Name | SEQ ID NO | Protease cleavage site; linker core |
|---|---|---|---|
| 259 | Angiopoietin-1 receptor | 206956 | chymotrypsin, trypsin |
| 260 | Angiopoietin-1 receptor | 206957 | trypsin |
| 261 | Angiopoietin-1 receptor | 206958 | chymotrypsin |
| 262 | Angiopoietin-1 receptor | 206959 | trypsin |
| 263 | Angiopoietin-1 receptor | 206960 | trypsin |
| 264 | Angiopoietin-1 receptor | 206961 | chymotrypsin, trypsin |
| 265 | Angiopoietin-1 receptor | 206962 | |
| 266 | Angiopoietin-1 receptor | 206963 | |
| 267 | Angiopoietin-1 receptor | 206964 | chymotrypsin, trypsin |
| 268 | Angiopoietin-1 receptor | 206965 | chymotrypsin, thrombin, trypsin |
| 269 | Angiopoietin-1 receptor | 206966 | chymotrypsin, trypsin |
| 270 | Annexin a2 | — | |
| 271 | Annexin a2 | 206967 | trypsin |
| 272 | Annexin a2 | 206968 | trypsin |
| 273 | Anthranilate phosphoribosyltransferase | 206969 | trypsin |
| 274 | Ap-2 complex subunit beta-2 | 206970 | |
| 275 | Archaeosine trna-guanine transglycosylase | — | |
| 276 | Archaeosine trna-guanine transglycosylase | 206971 | chymotrypsin |
| 277 | Archaeosine trna-guanine transglycosylase | 206972 | chymotrypsin |
| 278 | Archaeosine trna-guanine transglycosylase | 206973 | trypsin |
| 279 | Archaeosine trna-guanine transglycosylase | 206974 | trypsin |
| 280 | Archaeosine trna-guanine transglycosylase | 206975 | trypsin |
| 281 | Archaeosine trna-guanine transglycosylase | 206976 | trypsin |
| 282 | Archaeosine trna-guanine transglycosylase | 206977 | chymotrypsin, trypsin |
| 283 | Archeal exosome rna binding protein rrp4 | 206978 | chymotrypsin, trypsin |
| 284 | Archeal exosome rna binding protein rrp4 | 206979 | |
| 285 | Archeal exosome rna binding protein rrp4 | 206980 | chymotrypsin, trypsin |
| 286 | Arginyl-trna synthetase | — | |
| 287 | Arginyl-trna synthetase | 206981 | trypsin |
| 288 | Arginyl-trna synthetase | 206982 | chymotrypsin, trypsin |
| 289 | Arginyl-trna synthetase | 206983 | chymotrypsin, trypsin |
| 290 | Arrestin | 206984 | chymotrypsin |
| 291 | Arrestin | 206985 | trypsin |
| 292 | Arsenite oxidase | 206986 | chymotrypsin |
| 293 | Atp phosphoribosyltransferase | — | |
| 294 | Atp-dependent dna helicase | — | chymotrypsin |
| 295 | Atp-dependent dna helicase | 206987 | trypsin |
| 296 | Atp-dependent dna helicase | 206988 | |
| 297 | Atp-dependent dna helicase | 206989 | |
| 298 | Atp-dependent dna helicase | 206990 | |
| 299 | Atp-dependent dna helicase | 206991 | |
| 300 | Atp-dependent dna helicase | 206992 | trypsin |
| 301 | Atp-dependent dna helicase | 206993 | chymotrypsin |
| 302 | Atp-dependent dna helicase | 206994 | chymotrypsin, factor xa, trypsin |
| 303 | At-rich dna-binding protein | 206995 | trypsin |
| 304 | At-rich dna-binding protein | 206996 | chymotrypsin, trypsin |
| 305 | Axonin-1 | — | |
| 306 | Axonin-1 | — | |
| 307 | Axonin-1 | 206997 | trypsin |
| 308 | Axonin-1 | 206998 | |
| 309 | Axonin-1 | 206999 | trypsin |
| 310 | Axonin-1 | 207000 | |
| 311 | Axonin-1 | 207001 | |
| 312 | Axonin-1 | 207002 | trypsin |
| 313 | Axonin-1 | 207003 | chymotrypsin, trypsin |
| 314 | Bacilysin biosynthesis protein bacb | 207004 | chymotrypsin |
| 315 | Bacilysin biosynthesis protein bacb | 207005 | |
| 316 | Bacilysin biosynthesis protein bacb | 207006 | |
| 317 | Bacilysin biosynthesis protein bacb | 207007 | chymotrypsin |
| 318 | Bacilysin biosynthesis protein bacb | 207008 | chymotrypsin, trypsin |
| 319 | Bacteriophage mu transposase | 207009 | trypsin |
| 320 | Bacteriophage mu transposase | 207010 | chymotrypsin, trypsin |
| 321 | Benzoyl-coa-dihydrodiol lyase | 207011 | trypsin |
| 322 | Benzoyl-coa-dihydrodiol lyase | 207012 | chymotrypsin, trypsin |
| 323 | Benzoyl-coa-dihydrodiol lyase | 207013 | trypsin |
| 324 | Benzoyl-coa-dihydrodiol lyase | 207014 | trypsin |
| 325 | Benzoyl-coa-dihydrodiol lyase | 207015 | trypsin |
| 326 | Benzoylformate decarboxylase | 207016 | chymotrypsin |
| 327 | Benzoylformate decarboxylase | 207017 | chymotrypsin, trypsin |
| 328 | Benzoylformate decarboxylase | 207018 | trypsin |
| 329 | Beta-amylase | 207019 | |
| 330 | Beta-galactosidase | — | |
| 331 | Beta-galactosidase | 207020 | |
| 332 | Beta-galactosidase | 207021 | |
| 333 | Beta-galactosidase | 207022 | chymotrypsin, trypsin |

TABLE 12-continued

Proteins containing natural linker regions

| Linker No. | Name | SEQ ID NO | Protease cleavage site; linker core |
|---|---|---|---|
| 334 | Beta-galactosidase | 207023 | trypsin |
| 335 | Beta-galactosidase | 207024 | |
| 336 | Beta-galactosidase | 207025 | |
| 337 | Beta-galactosidase | 207026 | |
| 338 | Beta-galactosidase | 207027 | |
| 339 | Beta-galactosidase | 207028 | trypsin |
| 340 | Beta-galactosidase | 207029 | |
| 341 | Beta-galactosidase | 207030 | chymotrypsin, trypsin |
| 342 | Beta-galactosidase | 207031 | |
| 343 | Beta-galactosidase | 207032 | |
| 344 | Beta-galactosidase | 207033 | |
| 345 | Beta-galactosidase | 207034 | chymotrypsin, trypsin |
| 346 | Beta-galactosidase | 207035 | |
| 347 | Beta-galactosidase | 207036 | chymotrypsin |
| 348 | Beta-galactosidase | 207037 | chymotrypsin, trypsin |
| 349 | Beta-galactosidase | 207038 | chymotrypsin, trypsin |
| 350 | Beta-galactosidase | 207039 | |
| 351 | Beta-galactosidase | 207040 | chymotrypsin |
| 352 | Beta-galactosidase | 207041 | chymotrypsin, trypsin |
| 353 | Beta-n-acetylhexosaminidase | — | trypsin |
| 354 | Beta-n-acetylhexosaminidase | 207042 | |
| 355 | Beta-n-acetylhexosaminidase | 207043 | trypsin |
| 356 | Beta-n-acetylhexosaminidase | 207044 | chymotrypsin, trypsin |
| 357 | Bifunctional nmn adenylyltransferase/nudix hydrolase | 207045 | chymotrypsin |
| 358 | Bifunctional purine biosynthesis protein purh | 207046 | chymotrypsin, trypsin |
| 359 | Biliverdin reductase a | — | |
| 360 | Biliverdin reductase a | — | |
| 361 | Biliverdin reductase a | 207047 | trypsin |
| 362 | Biliverdin reductase a | 207048 | trypsin |
| 363 | Biodegradative arginine decarboxylase | — | |
| 364 | Biodegradative arginine decarboxylase | 207049 | |
| 365 | Biodegradative arginine decarboxylase | 207050 | |
| 366 | Biodegradative arginine decarboxylase | 207051 | |
| 367 | Biodegradative arginine decarboxylase | 207052 | chymotrypsin |
| 368 | Biodegradative arginine decarboxylase | 207053 | chymotrypsin, trypsin |
| 369 | Biodegradative arginine decarboxylase | 207054 | |
| 370 | Biodegradative arginine decarboxylase | 207055 | trypsin |
| 371 | Biodegradative arginine decarboxylase | 207056 | trypsin |
| 372 | Biodegradative arginine decarboxylase | 207057 | chymotrypsin |
| 373 | Biodegradative arginine decarboxylase | 207058 | chymotrypsin, trypsin |
| 374 | Biodegradative arginine decarboxylase | 207059 | |
| 375 | Biodegradative arginine decarboxylase | 207060 | chymotrypsin, trypsin |
| 376 | Biotin carboxylase | 207061 | trypsin |
| 377 | Bowman-birk trypsin inhibitor | 207062 | chymotrypsin, trypsin |
| 378 | Bpt4 gene 59 helicase assembly protein | — | trypsin |
| 379 | Brca1-associated ring domain protein 1 | 207063 | chymotrypsin, trypsin |
| 380 | Brca1-associated ring domain protein 1 | 207064 | trypsin |
| 381 | Brca1-associated ring domain protein 1 | 207065 | chymotrypsin, trypsin |
| 382 | Breast cancer 2 | 207066 | chymotrypsin |
| 383 | Breast cancer 2 | 207067 | |
| 384 | Breast cancer 2 | 207068 | trypsin |
| 385 | Breast cancer 2 | 207069 | chymotrypsin |
| 386 | Breast cancer 2 | 207070 | |
| 387 | Breast cancer 2 | 207071 | chymotrypsin, trypsin |
| 388 | Butyrate response factor 2 | 207072 | chymotrypsin, trypsin |
| 389 | C4b-binding protein | — | chymotrypsin, trypsin |
| 390 | C4b-binding protein | 207073 | chymotrypsin |
| 391 | C5a peptidase | 207074 | |
| 392 | C5a peptidase | 207075 | chymotrypsin |
| 393 | C5a peptidase | 207076 | trypsin |
| 394 | C5a peptidase | 207077 | |
| 395 | C5a peptidase | 207078 | |
| 396 | C5a peptidase | 207079 | trypsin |
| 397 | C5a peptidase | 207080 | |
| 398 | C5a peptidase | 207081 | trypsin |
| 399 | C5a peptidase | 207082 | trypsin |
| 400 | C5a peptidase | 207083 | |
| 401 | C5a peptidase | 207084 | chymotrypsin, trypsin |
| 402 | C5a peptidase | 207085 | |
| 403 | C5a peptidase | 207086 | chymotrypsin, trypsin |
| 404 | Calcium-binding protein | 207087 | |
| 405 | Cara | 207088 | chymotrypsin, trypsin |
| 406 | Cara | 207089 | |
| 407 | Carbamoyl phosphate synthetase (small chain) | 207090 | |
| 408 | Carbamoyl phosphate synthetase (small chain) | 207091 | |

TABLE 12-continued

Proteins containing natural linker regions

| Linker No. | Name | SEQ ID NO | Protease cleavage site; linker core |
|---|---|---|---|
| 409 | Carbamoyl phosphate synthetase (small chain) | 207092 | |
| 410 | Carbamoyl phosphate synthetase (small chain) | 207093 | |
| 411 | Carbamoyl phosphate synthetase (small chain) | 207094 | chymotrypsin, trypsin |
| 412 | Carbon monoxide dehydrogenase/acetyl-coa synthase subunitalpha | 207095 | trypsin |
| 413 | Carboxypeptidase gp180 residues 503-882 | — | trypsin |
| 414 | Catabolite activation-like protein | 207096 | chymotrypsin |
| 415 | Catabolite activation-like protein | 207097 | |
| 416 | Catechol 2,3-dioxygenase | 207098 | chymotrypsin, trypsin |
| 417 | Cation-independent mannose 6-phosphate receptor | 207099 | chymotrypsin, trypsin |
| 418 | Cd3 epsilon and gamma ectodomain fragmentcomplex | 207100 | trypsin |
| 419 | Cd3 epsilon and gamma ectodomain fragmentcomplex | 207101 | trypsin |
| 420 | Cell filamentation protein | — | |
| 421 | Cell filamentation protein | 207102 | trypsin |
| 422 | Cell filamentation protein | 207103 | trypsin |
| 423 | Cellular coagulation factor xiii zymogen | — | |
| 424 | Cellular coagulation factor xiii zymogen | — | |
| 425 | Cellular coagulation factor xiii zymogen | — | |
| 426 | Cellular coagulation factor xiii zymogen | 207104 | |
| 427 | Cellular coagulation factor xiii zymogen | 207105 | |
| 428 | Cellular coagulation factor xiii zymogen | 207106 | chymotrypsin |
| 429 | Cellular coagulation factor xiii zymogen | 207107 | thrombin, trypsin |
| 430 | Cellular coagulation factor xiii zymogen | 207108 | |
| 431 | Cellular coagulation factor xiii zymogen | 207109 | trypsin |
| 432 | Cellular coagulation factor xiii zymogen | 207110 | trypsin |
| 433 | Cellular coagulation factor xiii zymogen | 207111 | chymotrypsin |
| 434 | Cellular coagulation factor xiii zymogen | 207112 | trypsin |
| 435 | Cellular coagulation factor xiii zymogen | 207113 | trypsin |
| 436 | Cellular coagulation factor xiii zymogen | 207114 | trypsin |
| 437 | Cellular coagulation factor xiii zymogen | 207115 | |
| 438 | Cellular coagulation factor xiii zymogen | 207116 | chymotrypsin, trypsin |
| 439 | Cellular coagulation factor xiii zymogen | 207117 | trypsin |
| 440 | Cellular coagulation factor xiii zymogen | 207118 | chymotrypsin |
| 441 | Cellular coagulation factor xiii zymogen | 207119 | chymotrypsin |
| 442 | Cellular coagulation factor xiii zymogen | 207120 | chymotrypsin |
| 443 | Cellular coagulation factor xiii zymogen | 207121 | chymotrypsin |
| 444 | Cellular coagulation factor xiii zymogen | 207122 | chymotrypsin, trypsin |
| 445 | Cellulase | 207123 | |
| 446 | Cellulase | 207124 | |
| 447 | Cellulase | 207125 | |
| 448 | Cellulase | 207126 | |
| 449 | Cellulase | 207127 | |
| 450 | Cellulase | 207128 | |
| 451 | Cellulase | 207129 | |
| 452 | Cellulase | 207130 | |
| 453 | Cellulase | 207131 | |
| 454 | Cellulase linker | 207132 | |
| 455 | Cellulase linker | 207133 | |
| 456 | Cellulase linker | 207134 | |
| 457 | Cellulase linker | 207135 | |
| 458 | Chaperone protein fimc | — | trypsin |
| 459 | Chaperone protein fimc | — | |
| 460 | Chaperone protein fimc | 207136 | trypsin |
| 461 | Chaperone protein fimc | 207137 | trypsin |
| 462 | Chaperone protein hscb | — | trypsin |
| 463 | Chaperone protein hscb | 207138 | chymotrypsin, trypsin |
| 464 | Cheb methylesterase | 207139 | trypsin |
| 465 | Cheb methylesterase | 207140 | trypsin |
| 466 | Cheb methylesterase | 207141 | trypsin |
| 467 | Chelatase, putative | 207142 | trypsin |
| 468 | Chemotaxis receptor methyltransferase cher | 207143 | trypsin |
| 469 | Chemotaxis receptor methyltransferase cher | 207144 | |
| 470 | Chemotaxis receptor methyltransferase cher | 207145 | chymotrypsin, trypsin |
| 471 | Cholesterol oxidase | 207146 | |
| 472 | Cholesterol oxidase | 207147 | trypsin |
| 473 | Cholesterol oxidase | 207148 | chymotrypsin |
| 474 | Cholesterol oxidase | 207149 | |
| 475 | Cholesterol oxidase | 207150 | trypsin |
| 476 | Cholesterol oxidase | 207151 | |
| 477 | Cholesterol oxidase | 207152 | chymotrypsin |
| 478 | Cholesterol oxidase | 207153 | trypsin |
| 479 | Cholesterol oxidase | 207154 | trypsin |
| 480 | Cholesterol oxidase | 207155 | chymotrypsin |
| 481 | Cholesterol oxidase | 207156 | |
| 482 | Cholesterol oxidase | 207157 | chymotrypsin |
| 483 | Chromatin structure-remodeling complex proteinrsc4 | — | trypsin |

TABLE 12-continued

Proteins containing natural linker regions

| Linker No. | Name | SEQ ID NO | Protease cleavage site; linker core |
|---|---|---|---|
| 484 | Chromatin structure-remodeling complex proteinrsc4 | 207158 | |
| 485 | Chromatin structure-remodeling complex proteinrsc4 | 207159 | chymotrypsin, trypsin |
| 486 | Chromatin structure-remodeling complex proteinrsc4 | 207160 | trypsin |
| 487 | Chromodomain-helicase-dna-binding protein 1 | 207161 | chymotrypsin |
| 488 | Chromodomain-helicase-dna-binding protein 1 | 207162 | chymotrypsin, trypsin |
| 489 | Colicin ia | 207163 | trypsin |
| 490 | Collagen adhesin | 207164 | chymotrypsin |
| 491 | Complement c3 beta chain | 207165 | chymotrypsin |
| 492 | Complement c3 beta chain | 207166 | |
| 493 | Complement c3 beta chain | 207167 | |
| 494 | Complement c3 beta chain | 207168 | trypsin |
| 495 | Complement decay-accelerating factor | — | |
| 496 | Complement factor h | — | trypsin |
| 497 | Complement receptor type 2 | 207169 | chymotrypsin, trypsin |
| 498 | Conserved hypothetical protein | 207170 | chymotrypsin, trypsin |
| 499 | Conserved hypothetical protein mth1747 | — | |
| 500 | Conserved hypothetical protein mth1747 | 207171 | chymotrypsin |
| 501 | Conserved hypothetical protein mth1747 | 207172 | |
| 502 | Conserved hypothetical protein mth1747 | 207173 | trypsin |
| 503 | Conserved hypothetical protein mth1747 | 207174 | trypsin |
| 504 | Conserved hypothetical protein mth1747 | 207175 | |
| 505 | Conserved hypothetical protein mth1747 | 207176 | trypsin |
| 506 | Conserved hypothetical protein mth1747 | 207177 | trypsin |
| 507 | Conserved protein (mth177) | 207178 | |
| 508 | Creatine amidinohydrolase | 207179 | |
| 509 | Cruciferin | 207180 | chymotrypsin |
| 510 | Cruciferin | 207181 | chymotrypsin, trypsin |
| 511 | Cruciferin | 207182 | |
| 512 | Cruciferin | 207183 | trypsin |
| 513 | Cruciferin | 207184 | chymotrypsin, factor xa, trypsin |
| 514 | Cruciferin | 207185 | chymotrypsin, trypsin |
| 515 | Cruciferin | 207186 | chymotrypsin, trypsin |
| 516 | Csl3 | 207187 | |
| 517 | Csl3 | 207188 | |
| 518 | Ctp synthase | 207189 | trypsin |
| 519 | Ctp synthase | 207190 | trypsin |
| 520 | Cullin homolog | — | trypsin |
| 521 | Cullin homolog | 207191 | trypsin |
| 522 | Cullin homolog | 207192 | chymotrypsin |
| 523 | Cullin homolog | 207193 | chymotrypsin, trypsin |
| 524 | Cullin homolog | 207194 | chymotrypsin, trypsin |
| 525 | Cullin homolog | 207195 | trypsin |
| 526 | Cyclin a2 | 207196 | chymotrypsin |
| 527 | Cysteine-rich secretory protein | 207197 | chymotrypsin, trypsin |
| 528 | Cytidine deaminase | 207198 | trypsin |
| 529 | Cytidine deaminase | 207199 | chymotrypsin |
| 530 | Cytidine deaminase | 207200 | chymotrypsin, trypsin |
| 531 | Cytochrome b-c1 complex subunit rieske, mitochondrial | 207201 | trypsin |
| 532 | Cytochrome c oxidase subunit 2 | — | |
| 533 | Cytochrome c oxidase subunit 2 | 207202 | chymotrypsin |
| 534 | Cytochrome c oxidase subunit 2 | 207203 | |
| 535 | Cytochrome c oxidase subunit 2 | 207204 | |
| 536 | Cytochrome c oxidase subunit 2 | 207205 | chymotrypsin, trypsin |
| 537 | Cytochrome c4 | — | |
| 538 | Cytochrome c4 | — | |
| 539 | D-aminopeptidase | 207206 | trypsin |
| 540 | Ddmc | 207207 | chymotrypsin |
| 541 | Ddmc | 207208 | chymotrypsin |
| 542 | Deltex protein | 207209 | chymotrypsin |
| 543 | Deoxyuridine 5'-triphosphate nucleotidohydrolase | 207210 | trypsin |
| 544 | Diaminopimelate epimerase | 207211 | chymotrypsin |
| 545 | Diaminopimelate epimerase | 207212 | chymotrypsin |
| 546 | Diaminopimelate epimerase | 207213 | chymotrypsin, trypsin |
| 547 | Di-heme peroxidase | — | |
| 548 | Di-heme peroxidase | 207214 | trypsin |
| 549 | Dihydropyrimidine dehydrogenase | 207215 | |
| 550 | Dihydropyrimidine dehydrogenase | 207216 | trypsin |
| 551 | Dihydropyrimidine dehydrogenase | 207217 | trypsin |
| 552 | Dihydropyrimidine dehydrogenase | 207218 | |
| 553 | Dihydropyrimidine dehydrogenase | 207219 | chymotrypsin |
| 554 | Dihydropyrimidine dehydrogenase | 207220 | trypsin |
| 555 | Dihydropyrimidine dehydrogenase | 207221 | trypsin |
| 556 | Dihydropyrimidine dehydrogenase | 207222 | |
| 557 | Dihydropyrimidine dehydrogenase | 207223 | trypsin |
| 558 | Dihydropyrimidine dehydrogenase | 207224 | trypsin |

TABLE 12-continued

Proteins containing natural linker regions

| Linker No. | Name | SEQ ID NO | Protease cleavage site; linker core |
|---|---|---|---|
| 559 | Dihydropyrimidine dehydrogenase | 207225 | chymotrypsin |
| 560 | Dihydropyrimidine dehydrogenase | 207226 | trypsin |
| 561 | Dihydropyrimidine dehydrogenase | 207227 | chymotrypsin, trypsin |
| 562 | Dihydropyrimidine dehydrogenase | 207228 | trypsin |
| 563 | Dihydropyrimidine dehydrogenase | 207229 | |
| 564 | Dihydropyrimidine dehydrogenase | 207230 | trypsin |
| 565 | Dihydropyrimidine dehydrogenase | 207231 | trypsin |
| 566 | Dihydropyrimidine dehydrogenase | 207232 | chymotrypsin, trypsin |
| 567 | Dihydropyrimidine dehydrogenase | 207233 | trypsin |
| 568 | Dihydropyrimidine dehydrogenase | 207234 | |
| 569 | Dihydropyrimidine dehydrogenase | 207235 | trypsin |
| 570 | Dihydropyrimidine dehydrogenase | 207236 | |
| 571 | Dihydropyrimidine dehydrogenase | 207237 | |
| 572 | Dihydropyrimidine dehydrogenase | 207238 | chymotrypsin |
| 573 | Dihydropyrimidine dehydrogenase | 207239 | trypsin |
| 574 | Dihydropyrimidine dehydrogenase | 207240 | chymotrypsin |
| 575 | Dihydropyrimidine dehydrogenase | 207241 | chymotrypsin, trypsin |
| 576 | Dihydropyrimidine dehydrogenase | 207242 | chymotrypsin |
| 577 | Dihydropyrimidine dehydrogenase | 207243 | trypsin |
| 578 | Dihydropyrimidine dehydrogenase | 207244 | chymotrypsin, trypsin |
| 579 | Dihydropyrimidine dehydrogenase | 207245 | chymotrypsin, trypsin |
| 580 | Discoidin-1 subunit a | 207246 | trypsin |
| 581 | Discoidin-1 subunit a | 207247 | |
| 582 | Discoidin-1 subunit a | 207248 | chymotrypsin |
| 583 | Dissimilatory copper-containing nitritereductase | 207249 | chymotrypsin, trypsin |
| 584 | D-lactate dehydrogenase | — | |
| 585 | D-lactate dehydrogenase | 207250 | trypsin |
| 586 | D-lactate dehydrogenase | 207251 | trypsin |
| 587 | D-lactate dehydrogenase | 207252 | |
| 588 | D-lactate dehydrogenase | 207253 | chymotrypsin, trypsin |
| 589 | D-lactate dehydrogenase | 207254 | chymotrypsin, trypsin |
| 590 | D-lactate dehydrogenase | 207255 | chymotrypsin, trypsin |
| 591 | Dna damage-binding protein 1 | — | |
| 592 | Dna damage-binding protein 1 | 207256 | |
| 593 | Dna damage-binding protein 1 | 207257 | |
| 594 | Dna damage-binding protein 1 | 207258 | |
| 595 | Dna damage-binding protein 1 | 207259 | |
| 596 | Dna damage-binding protein 1 | 207260 | |
| 597 | Dna damage-binding protein 1 | 207261 | |
| 598 | Dna damage-binding protein 1 | 207262 | chymotrypsin, trypsin |
| 599 | Dna damage-binding protein 1 | 207263 | |
| 600 | Dna damage-binding protein 1 | 207264 | trypsin |
| 601 | Dna damage-binding protein 1 | 207265 | trypsin |
| 602 | Dna damage-binding protein 1 | 207266 | chymotrypsin |
| 603 | Dna damage-binding protein 1 | 207267 | |
| 604 | Dna damage-binding protein 1 | 207268 | chymotrypsin, trypsin |
| 605 | Dna damage-binding protein 1 | 207269 | |
| 606 | Dna damage-binding protein 1 | 207270 | chymotrypsin, trypsin |
| 607 | Dna damage-binding protein 1 | 207271 | trypsin |
| 608 | Dna damage-binding protein 1 | 207272 | trypsin |
| 609 | Dna damage-binding protein 1 | 207273 | chymotrypsin, trypsin |
| 610 | Dna damage-binding protein 1 | 207274 | chymotrypsin |
| 611 | Dna damage-binding protein 1 | 207275 | |
| 612 | Dna damage-binding protein 1 | 207276 | chymotrypsin, trypsin |
| 613 | Dna damage-binding protein 1 | 207277 | chymotrypsin, trypsin |
| 614 | Dna gyrase b | — | |
| 615 | Dna gyrase b | 207278 | |
| 616 | Dna gyrase b | 207279 | trypsin |
| 617 | Dna gyrase b | 207280 | |
| 618 | Dna gyrase b | 207281 | trypsin |
| 619 | Dna gyrase b | 207282 | chymotrypsin |
| 620 | Dna gyrase b | 207283 | |
| 621 | Dna gyrase b | 207284 | |
| 622 | Dna gyrase b | 207285 | trypsin |
| 623 | Dna gyrase b | 207286 | |
| 624 | Dna gyrase b | 207287 | chymotrypsin |
| 625 | Dna gyrase b | 207288 | chymotrypsin, trypsin |
| 626 | Dna ligase | 207289 | |
| 627 | Dna ligase | 207290 | trypsin |
| 628 | Dna ligase | 207291 | trypsin |
| 629 | Dna ligase | 207292 | chymotrypsin, trypsin |
| 630 | Dna ligase | 207293 | chymotrypsin |
| 631 | Dna mismatch repair protein muts | — | |
| 632 | Dna mismatch repair protein muts | — | |
| 633 | Dna mismatch repair protein muts | 207294 | trypsin |

TABLE 12-continued

Proteins containing natural linker regions

| Linker No. | Name | SEQ ID NO | Protease cleavage site; linker core |
|---|---|---|---|
| 634 | Dna mismatch repair protein muts | 207295 | chymotrypsin |
| 635 | Dna mismatch repair protein muts | 207296 | chymotrypsin |
| 636 | Dna mismatch repair protein muts | 207297 | trypsin |
| 637 | Dna mismatch repair protein muts | 207298 | trypsin |
| 638 | Dna polymerase | — | chymotrypsin |
| 639 | Dna polymerase | — | trypsin |
| 640 | Dna polymerase | 207299 | |
| 641 | Dna polymerase | 207300 | trypsin |
| 642 | Dna polymerase | 207301 | trypsin |
| 643 | Dna polymerase | 207302 | trypsin |
| 644 | Dna polymerase | 207303 | chymotrypsin |
| 645 | Dna polymerase | 207304 | chymotrypsin, trypsin |
| 646 | Dna polymerase | 207305 | trypsin |
| 647 | Dna polymerase | 207306 | chymotrypsin, trypsin |
| 648 | Dna polymerase alpha subunit b | 207307 | |
| 649 | Dna polymerase alpha subunit b | 207308 | trypsin |
| 650 | Dna polymerase alpha subunit b | 207309 | chymotrypsin |
| 651 | Dna polymerase alpha subunit b | 207310 | |
| 652 | Dna polymerase alpha subunit b | 207311 | |
| 653 | Dna polymerase alpha subunit b | 207312 | chymotrypsin, trypsin |
| 654 | Dna polymerase alpha subunit b | 207313 | |
| 655 | Dna polymerase alpha subunit b | 207314 | chymotrypsin |
| 656 | Dna polymerase alpha subunit b | 207315 | chymotrypsin |
| 657 | Dna polymerase alpha subunit b | 207316 | chymotrypsin, trypsin |
| 658 | Dna polymerase eta | — | |
| 659 | Dna polymerase eta | 207317 | |
| 660 | Dna polymerase eta | 207318 | chymotrypsin |
| 661 | Dna polymerase eta | 207319 | chymotrypsin, trypsin |
| 662 | Dna polymerase eta | 207320 | chymotrypsin, trypsin |
| 663 | Dna polymerase eta | 207321 | chymotrypsin |
| 664 | Dna polymerase i | — | |
| 665 | Dna polymerase i | — | |
| 666 | Dna polymerase i | 207322 | trypsin |
| 667 | Dna primase | — | |
| 668 | Dna primase | 207323 | trypsin |
| 669 | Dna primase | 207324 | |
| 670 | Dna primase | 207325 | trypsin |
| 671 | Dna primase | 207326 | |
| 672 | Dna primase | 207327 | trypsin |
| 673 | Dna primase | 207328 | trypsin |
| 674 | Dna primase | 207329 | chymotrypsin, trypsin |
| 675 | Dna primase/helicase | — | |
| 676 | Dna primase/helicase | 207330 | |
| 677 | Dna primase/helicase | 207331 | chymotrypsin |
| 678 | Dna primase/helicase | 207332 | trypsin |
| 679 | Dna primase/helicase | 207333 | chymotrypsin, trypsin |
| 680 | Dna primase/helicase | 207334 | trypsin |
| 681 | Dna primase/helicase | 207335 | chymotrypsin, trypsin |
| 682 | Dna primase/helicase | 207336 | |
| 683 | Dna primase/helicase | 207337 | chymotrypsin, trypsin |
| 684 | Dna primase/helicase | 207338 | chymotrypsin, trypsin |
| 685 | Dna primase/helicase | 207339 | chymotrypsin, trypsin |
| 686 | Dna topoisomerase 2 | — | |
| 687 | Dna topoisomerase 2 | — | |
| 688 | Dna topoisomerase 2 | — | trypsin |
| 689 | Dna topoisomerase 2 | 207340 | chymotrypsin |
| 690 | Dna topoisomerase 2 | 207341 | chymotrypsin, trypsin |
| 691 | Dna topoisomerase 2 | 207342 | chymotrypsin |
| 692 | Dna topoisomerase 2 | 207343 | chymotrypsin, trypsin |
| 693 | Dna topoisomerase 2 | 207344 | trypsin |
| 694 | Dna topoisomerase 2 | 207345 | chymotrypsin |
| 695 | Dna topoisomerase 2 | 207346 | trypsin |
| 696 | Dna topoisomerase 2 | 207347 | chymotrypsin, trypsin |
| 697 | Dna topoisomerase 2 | 207348 | chymotrypsin, trypsin |
| 698 | Dna topoisomerase i | 207349 | |
| 699 | Dna topoisomerase i | 207350 | trypsin |
| 700 | Dna topoisomerase i | 207351 | trypsin |
| 701 | Dna topoisomerase ii, alpha isozyme | — | |
| 702 | Dna topoisomerase ii, alpha isozyme | 207352 | |
| 703 | Dna topoisomerase ii, alpha isozyme | 207353 | |
| 704 | Dna topoisomerase ii, alpha isozyme | 207354 | |
| 705 | Dna topoisomerase ii, alpha isozyme | 207355 | chymotrypsin, trypsin |
| 706 | Dna topoisomerase ii, alpha isozyme | 207356 | trypsin |
| 707 | Dna topoisomerase ii, alpha isozyme | 207357 | trypsin |
| 708 | Dna topoisomerase ii, alpha isozyme | 207358 | chymotrypsin |

TABLE 12-continued

Proteins containing natural linker regions

| Linker No. | Name | SEQ ID NO | Protease cleavage site; linker core |
|---|---|---|---|
| 709 | Dna topoisomerase ii, alpha isozyme | 207359 | chymotrypsin, trypsin |
| 710 | Dna topoisomerase vi a subunit | 207360 | |
| 711 | Dna topoisomerase vi a subunit | 207361 | |
| 712 | Dna topoisomerase vi a subunit | 207362 | |
| 713 | Dna topoisomerase vi a subunit | 207363 | |
| 714 | Dna topoisomerase vi a subunit | 207364 | trypsin |
| 715 | Dna topoisomerase vi a subunit | 207365 | trypsin |
| 716 | Dna-3-methyladenine glycosylase 2 | 207366 | trypsin |
| 717 | Dna-binding response regulator mtra | 207367 | trypsin |
| 718 | Dna-directed rna polymerase beta chain | 207368 | |
| 719 | Dna-directed rna polymerase beta chain | 207369 | |
| 720 | Dna-directed rna polymerase beta chain | 207370 | chymotrypsin, trypsin |
| 721 | Dna-directed rna polymerase beta chain | 207371 | chymotrypsin |
| 722 | Dna-directed rna polymerase beta chain | 207372 | chymotrypsin, trypsin |
| 723 | Dna-directed rna polymerase beta chain | 207373 | trypsin |
| 724 | Dna-directed rna polymerase beta chain | 207374 | chymotrypsin |
| 725 | Dna-directed rna polymerase beta chain | 207375 | trypsin |
| 726 | Dna-directed rna polymerase ii 14.2 kda polypeptide | 207376 | |
| 727 | Dna-directed rna polymerase ii 14.2 kda polypeptide | 207377 | trypsin |
| 728 | Dna-directed rna polymerase, subunit e' (rpoe1) | 207378 | |
| 729 | Dna-directed rna polymerase, subunit e' (rpoe1) | 207379 | chymotrypsin |
| 730 | Dna-directed rna polymerases i, ii, and iii 27 kdapolypeptide | — | |
| 731 | Dna-directed rna polymerases i, ii, and iii 27 kdapolypeptide | 207380 | chymotrypsin |
| 732 | Dna-directed rna polymerases i, ii, and iii 27 kdapolypeptide | 207381 | |
| 733 | Dna-directed rna polymerases i, ii, and iii 27 kdapolypeptide | 207382 | chymotrypsin, trypsin |
| 734 | Dna-directed rna polymerases i, ii, and iii 27 kdapolypeptide | 207383 | trypsin |
| 735 | *Drosophila* neuroglian | 207384 | chymotrypsin, trypsin |
| 736 | Dystroglycan | 207385 | trypsin |
| 737 | Dystrophin | 207386 | |
| 738 | Dystrophin | 207387 | |
| 739 | Dystrophin | 207388 | chymotrypsin, trypsin |
| 740 | Dystrophin | 207389 | trypsin |
| 741 | Dystrophin | 207390 | |
| 742 | Dystrophin | 207391 | chymotrypsin, trypsin |
| 743 | Dystrophin | 207392 | |
| 744 | E2a dna-binding protein | 207393 | |
| 745 | E2a dna-binding protein | 207394 | chymotrypsin, trypsin |
| 746 | E3 sumo-protein ligase siz1 | 207395 | |
| 747 | E3 sumo-protein ligase siz1 | 207396 | trypsin |
| 748 | E3 sumo-protein ligase siz1 | 207397 | trypsin |
| 749 | Early switch protein xol-1 2.2k splice form | 207398 | trypsin |
| 750 | Egf-like module containing mucin-like hormonereceptor-like 2 precursor | 207399 | |
| 751 | Egf-like module containing mucin-like hormonereceptor-like 2 precursor | 207400 | chymotrypsin, trypsin |
| 752 | Elongation factor 1-gamma 1 | 207401 | |
| 753 | Elongation factor 1-gamma 1 | 207402 | |
| 754 | Elongation factor g | 207403 | |
| 755 | Elongation factor g | 207404 | trypsin |
| 756 | Elongation factor g | 207405 | |
| 757 | Elongation factor g | 207406 | chymotrypsin |
| 758 | Elongation factor g | 207407 | |
| 759 | Elongation factor g | 207408 | chymotrypsin |
| 760 | Elongation factor g | 207409 | trypsin |
| 761 | Elongation factor g | 207410 | chymotrypsin, trypsin |
| 762 | Elongation factor g | 207411 | chymotrypsin |
| 763 | Elongation factor g | 207412 | chymotrypsin, trypsin |
| 764 | Elongation factor p | 207413 | chymotrypsin |
| 765 | Elongation factor ts | 207414 | |
| 766 | Elongation factor ts | 207415 | trypsin |
| 767 | Elongation factor ts | 207416 | trypsin |
| 768 | Elongation factor tu (ef-tu) | 207417 | chymotrypsin, trypsin |
| 769 | Endoglucanase | 207418 | |
| 770 | Endonuclease pi-scei | 207419 | |
| 771 | Endonuclease pi-scei | 207420 | chymotrypsin |
| 772 | Endonuclease pi-scei | 207421 | trypsin |
| 773 | Endonuclease pi-scei | 207422 | trypsin |
| 774 | Endonuclease pi-scei | 207423 | |
| 775 | Endonuclease pi-scei | 207424 | trypsin |
| 776 | Endonuclease pi-scei | 207425 | trypsin |
| 777 | Endonuclease pi-scei | 207426 | trypsin |
| 778 | Endonuclease pi-scei | 207427 | chymotrypsin |
| 779 | Enterobactin synthetase component f | 207428 | chymotrypsin |
| 780 | Enterobactin synthetase component f | 207429 | chymotrypsin |
| 781 | Enterobactin synthetase component f | 207430 | trypsin |
| 782 | Enterobactin synthetase component f | 207431 | trypsin |
| 783 | Enterobactin synthetase component f | 207432 | chymotrypsin |

TABLE 12-continued

Proteins containing natural linker regions

| Linker No. | Name | SEQ ID NO | Protease cleavage site; linker core |
|---|---|---|---|
| 784 | Enterobactin synthetase component f | 207433 | |
| 785 | Enterobactin synthetase component f | 207434 | chymotrypsin |
| 786 | Enterobactin synthetase component f | 207435 | |
| 787 | Enterobactin synthetase component f | 207436 | chymotrypsin, trypsin |
| 788 | Enterochelin esterase | 207437 | chymotrypsin |
| 789 | Epo receptor | — | |
| 790 | Epo receptor | 207438 | |
| 791 | Erythrocyte binding antigen region ii | 207439 | |
| 792 | Erythrocyte binding antigen region ii | 207440 | chymotrypsin |
| 793 | Erythrocyte binding antigen region ii | 207441 | |
| 794 | Erythrocyte binding antigen region ii | 207442 | |
| 795 | Erythrocyte binding antigen region ii | 207443 | trypsin |
| 796 | E-selectin | 207444 | |
| 797 | Esterase esta | — | |
| 798 | Esterase esta | 207445 | |
| 799 | Esterase esta | 207446 | chymotrypsin |
| 800 | Eukaryotic peptide chain release factor gtp-bindingsubunit | 207447 | trypsin |
| 801 | Exonuclease i | — | trypsin |
| 802 | Exonuclease i | 207448 | trypsin |
| 803 | Fasciclin i | — | |
| 804 | Fasciclin i | 207449 | chymotrypsin |
| 805 | Fibrillin-1 | 207450 | |
| 806 | Fibrillin-1 | 207451 | trypsin |
| 807 | Fibrillin-1 | 207452 | trypsin |
| 808 | Fibrillin-1 | 207453 | |
| 809 | Fibrillin-1 | 207454 | trypsin |
| 810 | Fibronectin | 207455 | |
| 811 | Fibronectin | 207456 | chymotrypsin |
| 812 | Fibronectin | 207457 | chymotrypsin |
| 813 | Flagellar hook protein flge | 207458 | |
| 814 | Flagellar hook protein flge | 207459 | chymotrypsin |
| 815 | Flagellar hook protein flge | 207460 | chymotrypsin |
| 816 | Flagellar hook protein flge | 207461 | |
| 817 | Flagellar hook protein flge | 207462 | chymotrypsin |
| 818 | Flagellar hook protein flge | 207463 | |
| 819 | Flagellar hook protein flge | 207464 | |
| 820 | Flavohemoprotein | 207465 | chymotrypsin, trypsin |
| 821 | Focal adhesion kinase 1 | 207466 | chymotrypsin, trypsin |
| 822 | Folc bifunctional protein | 207467 | |
| 823 | Folc bifunctional protein | 207468 | trypsin |
| 824 | Folc bifunctional protein | 207469 | trypsin |
| 825 | Folc bifunctional protein | 207470 | |
| 826 | Folc bifunctional protein | 207471 | |
| 827 | Folc bifunctional protein | 207472 | |
| 828 | Folc bifunctional protein | 207473 | |
| 829 | Folc bifunctional protein | 207474 | chymotrypsin, trypsin |
| 830 | Follistatin | 207475 | chymotrypsin, trypsin |
| 831 | Formate dehydrogenase (large subunit) | — | chymotrypsin |
| 832 | Formate dehydrogenase (large subunit) | 207476 | |
| 833 | Formate dehydrogenase (large subunit) | 207477 | chymotrypsin |
| 834 | Formate dehydrogenase (large subunit) | 207478 | trypsin |
| 835 | Formate dehydrogenase (large subunit) | 207479 | chymotrypsin, trypsin |
| 836 | Formate dehydrogenase (large subunit) | 207480 | chymotrypsin, trypsin |
| 837 | Formate dehydrogenase (large subunit) | 207481 | |
| 838 | Formate dehydrogenase (large subunit) | 207482 | chymotrypsin |
| 839 | Formate dehydrogenase (large subunit) | 207483 | trypsin |
| 840 | Formate dehydrogenase (large subunit) | 207484 | chymotrypsin, trypsin |
| 841 | Formate dehydrogenase (large subunit) | 207485 | chymotrypsin, trypsin |
| 842 | Formate dehydrogenase (large subunit) | 207486 | chymotrypsin, trypsin |
| 843 | Formate dehydrogenase (large subunit) | 207487 | chymotrypsin, trypsin |
| 844 | Formate dehydrogenase, nitrate-inducible major subunit | 207488 | chymotrypsin, trypsin |
| 845 | Formate dehydrogenase, nitrate-inducible, major subunit | 207489 | |
| 846 | Formate dehydrogenase, nitrate-inducible, major subunit | 207490 | |
| 847 | Formate dehydrogenase, nitrate-inducible, major subunit | 207491 | chymotrypsin |
| 848 | Formate dehydrogenase, nitrate-inducible, major subunit | 207492 | |
| 849 | Formate dehydrogenase, nitrate-inducible, major subunit | 207493 | trypsin |
| 850 | Formate dehydrogenase, nitrate-inducible, major subunit | 207494 | trypsin |
| 851 | Formate dehydrogenase, nitrate-inducible, major subunit | 207495 | trypsin |
| 852 | Formate dehydrogenase, nitrate-inducible, major subunit | 207496 | chymotrypsin, trypsin |
| 853 | Formate dehydrogenase, nitrate-inducible, major subunit | 207497 | trypsin |
| 854 | Formate dehydrogenase, nitrate-inducible, major subunit | 207498 | chymotrypsin, trypsin |
| 855 | Formate dehydrogenase, nitrate-inducible, major subunit | 207499 | trypsin |
| 856 | Formate dehydrogenase, nitrate-inducible, major subunit | 207500 | trypsin |
| 857 | Formate dehydrogenase, nitrate-inducible, major subunit | 207501 | chymotrypsin, trypsin |
| 858 | Fumarylacetoacetate hydrolase | 207502 | |

TABLE 12-continued

Proteins containing natural linker regions

| Linker No. | Name | SEQ ID NO | Protease cleavage site; linker core |
|---|---|---|---|
| 859 | Galactose oxidase | — | |
| 860 | Galactose oxidase | — | chymotrypsin |
| 861 | Galactose oxidase | — | |
| 862 | Galactose oxidase | — | trypsin |
| 863 | Galactose oxidase | — | |
| 864 | Galactose oxidase | — | |
| 865 | Galactose oxidase | 207503 | trypsin |
| 866 | Galactose oxidase | 207504 | trypsin |
| 867 | Galactose oxidase | 207505 | trypsin |
| 868 | Galactose oxidase | 207506 | |
| 869 | Galactose oxidase | 207507 | |
| 870 | Galactose oxidase | 207508 | chymotrypsin |
| 871 | Galactose oxidase | 207509 | |
| 872 | Galactose oxidase | 207510 | chymotrypsin |
| 873 | Galactose oxidase | 207511 | chymotrypsin |
| 874 | Galactose oxidase | 207512 | |
| 875 | Galactose oxidase | 207513 | trypsin |
| 876 | Galactose oxidase | 207514 | chymotrypsin |
| 877 | Galactose oxidase | 207515 | chymotrypsin |
| 878 | Galactose oxidase | 207516 | trypsin |
| 879 | Galactose oxidase | 207517 | |
| 880 | Galactose oxidase | 207518 | |
| 881 | Galactose oxidase | 207519 | chymotrypsin, trypsin |
| 882 | Galactose oxidase | 207520 | chymotrypsin, trypsin |
| 883 | Galactose oxidase | 207521 | chymotrypsin, trypsin |
| 884 | Galactose oxidase | 207522 | chymotrypsin |
| 885 | Galactose oxidase | 207523 | chymotrypsin |
| 886 | Galactose oxidase | 207524 | chymotrypsin |
| 887 | Galactose oxidase | 207525 | chymotrypsin, trypsin |
| 888 | Galactose oxidase | 207526 | chymotrypsin, trypsin |
| 889 | Gamma b-crystallin | 207527 | chymotrypsin |
| 890 | Gamma-delta t-cell receptor | 207528 | trypsin |
| 891 | Gelation factor | — | |
| 892 | Gelation factor | 207529 | |
| 893 | Gelation factor | 207530 | |
| 894 | Gelation factor | 207531 | trypsin |
| 895 | Gene activator apha | 207532 | trypsin |
| 896 | Gingipain r | 207533 | trypsin |
| 897 | Glucodextranase | 207534 | |
| 898 | Glucodextranase | 207535 | |
| 899 | Glucodextranase | 207536 | chymotrypsin |
| 900 | Glucosamine-fructose-6-phosphate aminotransferase | — | chymotrypsin |
| 901 | Glucosamine-fructose-6-phosphate aminotransferase | 207537 | trypsin |
| 902 | Glucosamine-fructose-6-phosphate aminotransferase | 207538 | |
| 903 | Glucosamine-fructose-6-phosphate aminotransferase | 207539 | |
| 904 | Glucosamine-fructose-6-phosphate aminotransferase | 207540 | trypsin |
| 905 | Glucosamine-fructose-6-phosphate aminotransferase | 207541 | |
| 906 | Glucosamine-fructose-6-phosphate aminotransferase | 207542 | trypsin |
| 907 | Glucosamine-fructose-6-phosphate aminotransferase | 207543 | trypsin |
| 908 | Glucosamine-fructose-6-phosphate aminotransferase | 207544 | trypsin |
| 909 | Glucosamine-fructose-6-phosphate aminotransferase | 207545 | chymotrypsin, trypsin |
| 910 | Glucosamine-fructose-6-phosphate aminotransferase | 207546 | chymotrypsin, trypsin |
| 911 | Glucose-1-phosphate adenylyltransferase smallsubunit | 207547 | |
| 912 | Glucose-1-phosphate adenylyltransferase smallsubunit | 207548 | chymotrypsin, trypsin |
| 913 | Glucose-6-phosphate isomerase | — | trypsin |
| 914 | Glucose-6-phosphate isomerase | — | |
| 915 | Glucose-6-phosphate isomerase | 207549 | trypsin |
| 916 | Glucose-6-phosphate isomerase | 207550 | chymotrypsin |
| 917 | Glucose-6-phosphate isomerase, conjectural | 207551 | chymotrypsin, trypsin |
| 918 | Glutamate dehydrogenase | 207552 | chymotrypsin |
| 919 | Glutamate dehydrogenase | 207553 | trypsin |
| 920 | Glutamate receptor interacting protein | 207554 | chymotrypsin |
| 921 | Glutamate synthase [nadph] large chain | 207555 | |
| 922 | Glutamate synthase [nadph] large chain | 207556 | |
| 923 | Glutamate synthase [nadph] large chain | 207557 | trypsin |
| 924 | Glutamate synthase [nadph] large chain | 207558 | trypsin |
| 925 | Glutamate synthase [nadph] large chain | 207559 | trypsin |
| 926 | Glutamate synthase [nadph] large chain | 207560 | chymotrypsin, trypsin |
| 927 | Glutamate synthase [nadph] large chain | 207561 | chymotrypsin, trypsin |
| 928 | Glutamine synthetase | 207562 | chymotrypsin, trypsin |
| 929 | Glutamine synthetase | 207563 | chymotrypsin, trypsin |
| 930 | Glutamyl-trna synthetase | 207564 | |
| 931 | Glutamyl-trna synthetase | 207565 | chymotrypsin, trypsin |
| 932 | Glutamyl-trna synthetase | 207566 | chymotrypsin |
| 933 | Glutamyl-trna synthetase | 207567 | trypsin |

TABLE 12-continued

Proteins containing natural linker regions

| Linker No. | Name | SEQ ID NO | Protease cleavage site; linker core |
|---|---|---|---|
| 934 | Glutamyl-trna synthetase | 207568 | |
| 935 | Glutamyl-trna synthetase | 207569 | chymotrypsin, trypsin |
| 936 | Glutamyl-trna synthetase | 207570 | trypsin |
| 937 | Glutamyl-trna synthetase | 207571 | trypsin |
| 938 | Glutaredoxin 2 | 207572 | trypsin |
| 939 | Glutathione s-transferase | 207573 | |
| 940 | Glutathione s-transferase | 207574 | chymotrypsin |
| 941 | Glutathione s-transferase | 207575 | |
| 942 | Glutathione s-transferase 1-6 | 207576 | chymotrypsin, trypsin |
| 943 | Glutathione s-transferase a1 | 207577 | chymotrypsin, trypsin |
| 944 | Glutathione s-transferase i | — | |
| 945 | Glutathione s-transferase i | 207578 | trypsin |
| 946 | Glutathione synthetase | 207579 | trypsin |
| 947 | Glutathione transferase gst1-4 | 207580 | |
| 948 | Glutathione transferase gst1-4 | 207581 | chymotrypsin |
| 949 | Glutathione transferase sigma class | 207582 | chymotrypsin, trypsin |
| 950 | Glycerol-3-phosphate dehydrogenase [nad(p)+] | 207583 | chymotrypsin |
| 951 | Glycine cleavage system transcriptional repressor, putative | 207584 | |
| 952 | Glycolipid-anchored surface protein 2 | 207585 | trypsin |
| 953 | Glycolipid-anchored surface protein 2 | 207586 | chymotrypsin, trypsin |
| 954 | Glycyl-trna synthetase | — | chymotrypsin, trypsin |
| 955 | Glycyl-trna synthetase | 207587 | |
| 956 | Glycyl-trna synthetase | 207588 | |
| 957 | Glycyl-trna synthetase | 207589 | trypsin |
| 958 | Glycyl-trna synthetase | 207590 | trypsin |
| 959 | Glycyl-trna synthetase | 207591 | trypsin |
| 960 | Glycyl-trna synthetase | 207592 | trypsin |
| 961 | Glycyl-trna synthetase | 207593 | chymotrypsin |
| 962 | Glycyl-trna synthetase | 207594 | chymotrypsin, trypsin |
| 963 | "Glycyl-trna synthetase" | 207595 | chymotrypsin, trypsin |
| 964 | Growth hormone receptor | 207596 | |
| 965 | Growth hormone receptor | 207597 | chymotrypsin |
| 966 | Harmonin | 207598 | thrombin, trypsin |
| 967 | Hasr protein | 207599 | trypsin |
| 968 | Hasr protein | 207600 | |
| 969 | Hemin transport protein hems | 207601 | trypsin |
| 970 | Hemin transport protein hems | 207602 | trypsin |
| 971 | Hemin transport protein hems | 207603 | |
| 972 | Hemoglobin | 207604 | |
| 973 | Hemolytic lectin cel-iii | 207605 | trypsin |
| 974 | Hepatocyte nuclear factor 6 | 207606 | chymotrypsin, trypsin |
| 975 | Histidyl-trna synthetase | 207607 | chymotrypsin, trypsin |
| 976 | Hnh homing endonuclease | 207608 | trypsin |
| 977 | Hnh homing endonuclease | 207609 | trypsin |
| 978 | Hnh homing endonuclease | 207610 | trypsin |
| 979 | Homoserine dehydrogenase | 207611 | |
| 980 | Homoserine kinase | 207612 | |
| 981 | Homoserine kinase | 207613 | |
| 982 | Homoserine kinase | 207614 | |
| 983 | Homoserine kinase | 207615 | trypsin |
| 984 | Hth-type transcriptional regulator mqsa (ygit/b3021) | 207616 | |
| 985 | Hth-type transcriptional repressor yvoa | 207617 | |
| 986 | Hth-type transcriptional repressor yvoa | 207618 | trypsin |
| 987 | Human igg1 Middle Hinge Linker | 207619 | |
| 988 | Human igg1 Upper Hinge Linker | 207620 | |
| 989 | Human igg3 Middle Hinge Linker | 207621 | |
| 990 | Human igg3m15 Middle Hinge Linker | 207622 | |
| 991 | Human igg4 Lower Hinge Linker | 207623 | |
| 992 | Human igg4 Middle Hinge Linker | 207624 | |
| 993 | Human igg4 Upper Hinge Linker | 207625 | |
| 994 | Hybrid cluster protein | 207626 | |
| 995 | Hybrid cluster protein | 207627 | trypsin |
| 996 | Hybrid cluster protein | 207628 | chymotrypsin |
| 997 | Hybrid cluster protein | 207629 | chymotrypsin |
| 998 | Hybrid cluster protein | 207630 | chymotrypsin, trypsin |
| 999 | Hypothetical conserved protein, gk1056 | 207631 | trypsin |
| 1000 | Hypothetical membrane spanning protein | 207632 | chymotrypsin |
| 1001 | Hypothetical methylmalonyl-coa decarboxylase alpha subunit | 207633 | |
| 1002 | Hypothetical methylmalonyl-coa decarboxylase alpha subunit | 207634 | chymotrypsin |
| 1003 | Hypothetical methylmalonyl-coa decarboxylase alpha subunit | 207635 | chymotrypsin, trypsin |
| 1004 | Hypothetical methylmalonyl-coa decarboxylase alpha subunit | 207636 | trypsin |
| 1005 | Hypothetical methylmalonyl-coa decarboxylase alpha subunit | 207637 | |
| 1006 | Hypothetical methylmalonyl-coa decarboxylase alpha subunit | 207638 | chymotrypsin |
| 1007 | Hypothetical methylmalonyl-coa decarboxylase alpha subunit | 207639 | chymotrypsin, trypsin |
| 1008 | Hypothetical protein | — | |

TABLE 12-continued

Proteins containing natural linker regions

| Linker No. | Name | SEQ ID NO | Protease cleavage site; linker core |
|---|---|---|---|
| 1009 | Hypothetical protein | 207640 | |
| 1010 | Hypothetical protein ape0525 | — | |
| 1011 | Hypothetical protein ape0525 | 207641 | chymotrypsin, trypsin |
| 1012 | Hypothetical protein loc449832 | 207642 | |
| 1013 | Hypothetical protein loc449832 | 207643 | |
| 1014 | Hypothetical protein pa4388 | 207644 | chymotrypsin, trypsin |
| 1015 | Hypothetical protein pa5201 | — | |
| 1016 | Hypothetical protein pa5201 | — | |
| 1017 | Hypothetical protein pa5201 | — | trypsin |
| 1018 | Hypothetical protein pa5201 | 207645 | |
| 1019 | Hypothetical protein pa5201 | 207646 | trypsin |
| 1020 | Hypothetical protein pa5201 | 207647 | trypsin |
| 1021 | Hypothetical protein pa5201 | 207648 | |
| 1022 | Hypothetical protein pa5201 | 207649 | |
| 1023 | Hypothetical protein pa5201 | 207650 | chymotrypsin |
| 1024 | Hypothetical protein pa5201 | 207651 | trypsin |
| 1025 | Hypothetical protein pa5201 | 207652 | chymotrypsin, trypsin |
| 1026 | Hypothetical protein pa5201 | 207653 | trypsin |
| 1027 | Hypothetical protein pa5201 | 207654 | trypsin |
| 1028 | Hypothetical protein pa5201 | 207655 | trypsin |
| 1029 | Hypothetical protein pa5201 | 207656 | chymotrypsin, trypsin |
| 1030 | Hypothetical protein pa5201 | 207657 | thrombin, trypsin |
| 1031 | Hypothetical protein pa5201 | 207658 | trypsin |
| 1032 | Hypothetical protein pa5201 | 207659 | |
| 1033 | Hypothetical protein pa5201 | 207660 | chymotrypsin, trypsin |
| 1034 | Hypothetical protein pa5201 | 207661 | trypsin |
| 1035 | Hypothetical protein pa5201 | 207662 | chymotrypsin |
| 1036 | Hypothetical protein pa5201 | 207663 | chymotrypsin, trypsin |
| 1037 | Hypothetical protein pa5201 | 207664 | chymotrypsin, trypsin |
| 1038 | Hypothetical protein ph0495 | — | |
| 1039 | Hypothetical protein ph0495 | 207665 | |
| 1040 | Hypothetical protein ph0495 | 207666 | chymotrypsin, trypsin |
| 1041 | Hypothetical protein ph0495 | 207667 | chymotrypsin, trypsin |
| 1042 | Hypothetical protein ph0495 | 207668 | trypsin |
| 1043 | Hypothetical protein ph0510 | 207669 | chymotrypsin |
| 1044 | Hypothetical protein ph0510 | 207670 | chymotrypsin |
| 1045 | Hypothetical protein ph1313 | 207671 | |
| 1046 | Hypothetical protein ph1313 | 207672 | chymotrypsin, trypsin |
| 1047 | Hypothetical protein slr0953 | 207673 | |
| 1048 | Hypothetical protein slr0953 | 207674 | chymotrypsin |
| 1049 | Hypothetical protein slr0953 | 207675 | chymotrypsin |
| 1050 | Hypothetical protein slr0953 | 207676 | chymotrypsin |
| 1051 | Hypothetical protein slr0953 | 207677 | |
| 1052 | Hypothetical protein yigz | 207678 | trypsin |
| 1053 | Hypothetical protein yigz | 207679 | trypsin |
| 1054 | Hypothetical protein yjia | 207680 | |
| 1055 | Hypothetical protein yjia | 207681 | trypsin |
| 1056 | Hypothetical protein yjia | 207682 | |
| 1057 | Hypothetical protein yjia | 207683 | trypsin |
| 1058 | Hypothetical protein yjia | 207684 | chymotrypsin, trypsin |
| 1059 | Hypothetical trna/rrna methyltransferase yjfh | 207685 | |
| 1060 | Hypothetical trna/rrna methyltransferase yjfh | 207686 | chymotrypsin, trypsin |
| 1061 | Iclr transcriptional regulator | 207687 | chymotrypsin |
| 1062 | Iclr transcriptional regulator | 207688 | chymotrypsin, trypsin |
| 1063 | Iclr transcriptional regulator | 207689 | trypsin |
| 1064 | Iclr transcriptional regulator | 207690 | trypsin |
| 1065 | Integrase | 207691 | trypsin |
| 1066 | Interferon, alpha-inducible protein (clone ifi-15k) | 207692 | trypsin |
| 1067 | Interleukin-1 receptor, type i | — | |
| 1068 | Interleukin-1 receptor, type i | 207693 | |
| 1069 | Interleukin-1 receptor, type i | 207694 | chymotrypsin |
| 1070 | Interleukin-1 receptor, type i | 207695 | chymotrypsin |
| 1071 | Interleukin-12 subunit p40 | — | chymotrypsin |
| 1072 | Interleukin-12 subunit p40 | 207696 | |
| 1073 | Interleukin-12 subunit p40 | 207697 | trypsin |
| 1074 | Interleukin-12 subunit p40 | 207698 | trypsin |
| 1075 | Interleukin-12 subunit p40 | 207699 | |
| 1076 | Interleukin-12 subunit p40 | 207700 | chymotrypsin |
| 1077 | Interleukin-12 subunit p40 | 207701 | |
| 1078 | Interleukin-12 subunit p40 | 207702 | chymotrypsin, trypsin |
| 1079 | Interleukin-2 receptor alpha chain | 207703 | chymotrypsin |
| 1080 | Interleukin-2 receptor alpha chain | 207704 | trypsin |
| 1081 | Internalin b | — | |
| 1082 | Internalin b | 207705 | |
| 1083 | Internalin b | 207706 | |

TABLE 12-continued

Proteins containing natural linker regions

| Linker No. | Name | SEQ ID NO | Protease cleavage site; linker core |
|---|---|---|---|
| 1084 | Internalin b | 207707 | |
| 1085 | Internalin b | 207708 | chymotrypsin |
| 1086 | Internalin b | 207709 | trypsin |
| 1087 | Internalin b | 207710 | trypsin |
| 1088 | Internalin b | 207711 | chymotrypsin, trypsin |
| 1089 | Internalin b | 207712 | trypsin |
| 1090 | Internalin b | 207713 | chymotrypsin, trypsin |
| 1091 | Internalin b | 207714 | trypsin |
| 1092 | Internalin b | 207715 | |
| 1093 | Internalin b | 207716 | trypsin |
| 1094 | Intimin | — | |
| 1095 | Intimin | 207717 | chymotrypsin |
| 1096 | Intimin | 207718 | trypsin |
| 1097 | Intimin | 207719 | |
| 1098 | Intron-encoded dna endonuclease i-anii | 207720 | chymotrypsin |
| 1099 | Intron-encoded dna endonuclease i-anii | 207721 | chymotrypsin, trypsin |
| 1100 | Invasin | — | trypsin |
| 1101 | Invasin | 207722 | |
| 1102 | Invasin | 207723 | chymotrypsin, trypsin |
| 1103 | Invasin | 207724 | chymotrypsin |
| 1104 | Invasin | 207725 | |
| 1105 | Invasin | 207726 | |
| 1106 | Invasin | 207727 | |
| 1107 | Invasin | 207728 | chymotrypsin |
| 1108 | Invasin | 207729 | trypsin |
| 1109 | Invasin | 207730 | chymotrypsin, trypsin |
| 1110 | Invasin | 207731 | chymotrypsin |
| 1111 | Invasin | 207732 | chymotrypsin, trypsin |
| 1112 | Invasin | 207733 | trypsin |
| 1113 | Iron hydrogenase 1 | — | |
| 1114 | Iron hydrogenase 1 | 207734 | trypsin |
| 1115 | Iron hydrogenase 1 | 207735 | trypsin |
| 1116 | Iron hydrogenase 1 | 207736 | trypsin |
| 1117 | Iron hydrogenase 1 | 207737 | |
| 1118 | Iron hydrogenase 1 | 207738 | trypsin |
| 1119 | Iron hydrogenase 1 | 207739 | |
| 1120 | Iron hydrogenase 1 | 207740 | trypsin |
| 1121 | Iron hydrogenase 1 | 207741 | trypsin |
| 1122 | Iron hydrogenase 1 | 207742 | chymotrypsin |
| 1123 | Iron hydrogenase 1 | 207743 | |
| 1124 | Iron hydrogenase 1 | 207744 | |
| 1125 | Iron hydrogenase 1 | 207745 | chymotrypsin, trypsin |
| 1126 | Iron hydrogenase 1 | 207746 | chymotrypsin, trypsin |
| 1127 | Iron transport protein | 207747 | |
| 1128 | Isoflavanone 4'-o-methyltransferase | 207748 | chymotrypsin |
| 1129 | Isoflavanone 4'-o-methyltransferase | 207749 | trypsin |
| 1130 | Junctional adhesion molecule 1 | 207750 | trypsin |
| 1131 | Junctional adhesion molecule 1 | 207751 | trypsin |
| 1132 | Junctional adhesion molecule 1 | 207752 | |
| 1133 | Kanamycin nucleotidyltransferase | 207753 | chymotrypsin |
| 1134 | Kanamycin nucleotidyltransferase | 207754 | chymotrypsin |
| 1135 | Kanamycin nucleotidyltransferase | 207755 | |
| 1136 | Kanamycin nucleotidyltransferase | 207756 | |
| 1137 | Kelch-like protein 11 | 207757 | trypsin |
| 1138 | Kexin | — | |
| 1139 | Kexin | 207758 | |
| 1140 | Kexin | 207759 | trypsin |
| 1141 | Kexin | 207760 | |
| 1142 | Kexin | 207761 | chymotrypsin, trypsin |
| 1143 | Kexin | 207762 | chymotrypsin |
| 1144 | Kexin | 207763 | chymotrypsin, trypsin |
| 1145 | Kexin | 207764 | chymotrypsin, trypsin |
| 1146 | Ku70 | 207765 | trypsin |
| 1147 | Ku70 | 207766 | trypsin |
| 1148 | Ku70 | 207767 | trypsin |
| 1149 | Ku70 | 207768 | chymotrypsin, trypsin |
| 1150 | Ku80 | 207769 | trypsin |
| 1151 | Laccase-1 | 207770 | chymotrypsin |
| 1152 | Laccase-1 | 207771 | chymotrypsin |
| 1153 | Laccase-1 | 207772 | chymotrypsin |
| 1154 | Laccase-1 | 207773 | chymotrypsin, thrombin, trypsin |
| 1155 | Laminin | — | trypsin |
| 1156 | L-aspartate dehydrogenase | — | |
| 1157 | L-aspartate dehydrogenase | 207774 | chymotrypsin, trypsin |
| 1158 | L-aspartate dehydrogenase | 207775 | |

TABLE 12-continued

Proteins containing natural linker regions

| Linker No. | Name | SEQ ID NO | Protease cleavage site; linker core |
|---|---|---|---|
| 1159 | Leucine dehydrogenase | 207776 | |
| 1160 | Leucine dehydrogenase | 207777 | |
| 1161 | Light chain of hyhel10 antibody fragment (fab) | 207778 | trypsin |
| 1162 | Lin2111 protein | 207779 | trypsin |
| 1163 | Lin2111 protein | 207780 | trypsin |
| 1164 | Lipopolysaccharide-responsive and beige-like anchor protein | 207781 | chymotrypsin, thrombin, trypsin |
| 1165 | Lipopolysaccharide-responsive and beige-like anchor protein | 207782 | |
| 1166 | Lipovitellin (lv-1n, lv-1c) | 207783 | |
| 1167 | Lipovitellin (lv-1n, lv-1c) | 207784 | trypsin |
| 1168 | Lipovitellin (lv-1n, lv-1c) | 207785 | trypsin |
| 1169 | Lipovitellin (lv-1n, lv-1c) | 207786 | trypsin |
| 1170 | Lipovitellin (lv-1n, lv-1c) | 207787 | chymotrypsin, trypsin |
| 1171 | Lipoxygenase-1 | 207788 | |
| 1172 | Lipoxygenase-1 | 207789 | chymotrypsin |
| 1173 | Low affinity immunoglobulin gamma fc region receptor ii-a | 207790 | chymotrypsin |
| 1174 | Luciferase | 207791 | chymotrypsin, trypsin |
| 1175 | Lysr-type regulatory protein | 207792 | trypsin |
| 1176 | Macrolide-specific efflux protein maca | — | |
| 1177 | Macrolide-specific efflux protein maca | 207793 | chymotrypsin |
| 1178 | Macrolide-specific efflux protein maca | 207794 | |
| 1179 | Magnesium transporter, putative | 207795 | chymotrypsin |
| 1180 | Main hemagglutinin component | 207796 | |
| 1181 | Major centromere autoantigen b | 207797 | chymotrypsin, trypsin |
| 1182 | Major surface antigen p30 | 207798 | |
| 1183 | Major surface antigen p30 | 207799 | trypsin |
| 1184 | Major vault protein | 207800 | chymotrypsin, trypsin |
| 1185 | Major vault protein | 207801 | trypsin |
| 1186 | Maltose phosphorylase | 207802 | trypsin |
| 1187 | Maltose phosphorylase | 207803 | |
| 1188 | Maltose phosphorylase | 207804 | |
| 1189 | Maltose phosphorylase | 207805 | chymotrypsin, trypsin |
| 1190 | Maltose phosphorylase | 207806 | chymotrypsin, trypsin |
| 1191 | Manganese-dependent inorganic pyrophosphatase | 207807 | |
| 1192 | Manganese-dependent inorganic pyrophosphatase | 207808 | trypsin |
| 1193 | Mannan-binding lectin | 207809 | |
| 1194 | Mannan-binding lectin | 207810 | chymotrypsin |
| 1195 | Mannan-binding lectin | 207811 | |
| 1196 | Mannitol dehydrogenase | — | |
| 1197 | Mannitol dehydrogenase | 207812 | |
| 1198 | Membrane cofactor protein | — | trypsin |
| 1199 | Membrane cofactor protein | 207813 | chymotrypsin, trypsin |
| 1200 | Membrane-associated prostaglandin e synthase-2 | 207814 | chymotrypsin |
| 1201 | Membrane-associated prostaglandin e synthase-2 | 207815 | |
| 1202 | Membrane-associated prostaglandin e synthase-2 | 207816 | chymotrypsin |
| 1203 | Membrane-associated prostaglandin e synthase-2 | 207817 | trypsin |
| 1204 | Membrane-associated prostaglandin e synthase-2 | 207818 | chymotrypsin, trypsin |
| 1205 | Membrane-bound lytic murein transglycosylase a | 207819 | chymotrypsin, trypsin |
| 1206 | Methionyl-trna synthetase | 207820 | |
| 1207 | Methyl-accepting chemotaxis protein | — | |
| 1208 | Methyl-accepting chemotaxis protein | 207821 | trypsin |
| 1209 | Methyl-accepting chemotaxis protein | 207822 | trypsin |
| 1210 | Methyl-accepting chemotaxis protein | 207823 | chymotrypsin |
| 1211 | Methyl-coenzyme m reductase | 207824 | |
| 1212 | Methyl-coenzyme m reductase | 207825 | |
| 1213 | Methyl-coenzyme m reductase | 207826 | chymotrypsin |
| 1214 | Methyl-coenzyme m reductase | 207827 | trypsin |
| 1215 | Methylene tetrahydromethanopterin dehydrogenase | 207828 | |
| 1216 | Methylene tetrahydromethanopterin dehydrogenase | 207829 | trypsin |
| 1217 | Mg2+ transporter mgte | 207830 | chymotrypsin |
| 1218 | Mg2+ transporter mgte | 207831 | chymotrypsin |
| 1219 | Mg2+ transporter mgte | 207832 | chymotrypsin, trypsin |
| 1220 | Mitochondrial aconitase | 207833 | chymotrypsin, trypsin |
| 1221 | Mitochondrial aconitase | 207834 | chymotrypsin, trypsin |
| 1222 | Modification methylase taqi | — | |
| 1223 | Modification methylase taqi | — | |
| 1224 | Modification methylase taqi | 207835 | |
| 1225 | Modification methylase taqi | 207836 | |
| 1226 | Modification methylase taqi | 207837 | |
| 1227 | Modification methylase taqi | 207838 | chymotrypsin, trypsin |
| 1228 | Modification methylase taqi | 207839 | trypsin |
| 1229 | Modification methylase taqi | 207840 | trypsin |
| 1230 | Modification methylase taqi | 207841 | trypsin |
| 1231 | Modification methylase taqi | 207842 | chymotrypsin, trypsin |
| 1232 | Multidrug-efflux transporter 1 regulator | 207843 | |
| 1233 | Muramoyl-pentapeptide carboxypeptidase | 207844 | |

TABLE 12-continued

Proteins containing natural linker regions

| Linker No. | Name | SEQ ID NO | Protease cleavage site; linker core |
|---|---|---|---|
| 1234 | MutI | 207845 | |
| 1235 | MutI | 207846 | |
| 1236 | MutI | 207847 | |
| 1237 | MutI | 207848 | chymotrypsin, trypsin |
| 1238 | MutI | 207849 | trypsin |
| 1239 | MutI | 207850 | chymotrypsin, trypsin |
| 1240 | MutI | 207851 | chymotrypsin |
| 1241 | MutI | 207852 | trypsin |
| 1242 | MutI | 207853 | chymotrypsin, trypsin |
| 1243 | Mutm (fpg) protein | 207854 | chymotrypsin, trypsin |
| 1244 | Mutm (fpg) protein | 207855 | chymotrypsin, trypsin |
| 1245 | Mutm (fpg) protein | 207856 | chymotrypsin, trypsin |
| 1246 | Mutm (fpg) protein | 207857 | chymotrypsin, trypsin |
| 1247 | Myotubularin-related protein 2 | — | |
| 1248 | Myotubularin-related protein 2 | 207858 | trypsin |
| 1249 | Myotubularin-related protein 2 | 207859 | chymotrypsin |
| 1250 | Myotubularin-related protein 2 | 207860 | |
| 1251 | Myotubularin-related protein 2 | 207861 | trypsin |
| 1252 | Myotubularin-related protein 2 | 207862 | chymotrypsin, trypsin |
| 1253 | N utilization substance protein a | — | |
| 1254 | N utilization substance protein a | 207863 | |
| 1255 | N utilization substance protein a | 207864 | trypsin |
| 1256 | N utilization substance protein a | 207865 | chymotrypsin, trypsin |
| 1257 | N-acetylglucosamine kinase | — | |
| 1258 | N-acetylglucosamine kinase | — | |
| 1259 | N-acetylglucosamine kinase | 207866 | trypsin |
| 1260 | N-acyl-d-glutamate deacylase | 207867 | |
| 1261 | N-acyl-d-glutamate deacylase | 207868 | |
| 1262 | N-acyl-d-glutamate deacylase | 207869 | |
| 1263 | N-acyl-d-glutamate deacylase | 207870 | |
| 1264 | N-acyl-d-glutamate deacylase | 207871 | chymotrypsin |
| 1265 | N-acyl-d-glutamate deacylase | 207872 | chymotrypsin |
| 1266 | N-acyl-d-glutamate deacylase | 207873 | trypsin |
| 1267 | Nad-dependent malic enzyme | 207874 | |
| 1268 | Nad-dependent malic enzyme | 207875 | chymotrypsin, trypsin |
| 1269 | Nadh peroxidase | — | |
| 1270 | Nadh peroxidase | — | |
| 1271 | Nadh peroxidase | — | |
| 1272 | Nadh peroxidase | 207876 | |
| 1273 | Nadh peroxidase | 207877 | |
| 1274 | Nadh peroxidase | 207878 | |
| 1275 | Nadh peroxidase | 207879 | |
| 1276 | Nadh peroxidase | 207880 | trypsin |
| 1277 | Nadh peroxidase | 207881 | chymotrypsin, trypsin |
| 1278 | Nadh pyrophosphatase | 207882 | chymotrypsin |
| 1279 | Naphthalene 1,2-dioxygenase alpha subunit | 207883 | |
| 1280 | Naphthalene 1,2-dioxygenase alpha subunit | 207884 | chymotrypsin, trypsin |
| 1281 | Nedd8-activating enzyme e1 catalytic subunit | 207885 | chymotrypsin, trypsin |
| 1282 | Nedd8-activating enzyme e1 regulatory subunit | 207886 | chymotrypsin |
| 1283 | Nedd8-activating enzyme e1 regulatory subunit | 207887 | |
| 1284 | Nedd8-activating enzyme e1 regulatory subunit | 207888 | trypsin |
| 1285 | Nei endonuclease viii-like 1 | 207889 | trypsin |
| 1286 | Nei endonuclease viii-like 1 | 207890 | chymotrypsin, thrombin, trypsin |
| 1287 | Nei endonuclease viii-like 1 | 207891 | |
| 1288 | Nei endonuclease viii-like 1 | 207892 | chymotrypsin, thrombin, trypsin |
| 1289 | Neural cell adhesion molecule 2 | 207893 | chymotrypsin, trypsin |
| 1290 | Neural cell adhesion molecule 2 | 207894 | chymotrypsin |
| 1291 | Neural cell adhesion molecule 2 | 207895 | chymotrypsin |
| 1292 | Neural cell adhesion molecule 2 | 207896 | chymotrypsin, trypsin |
| 1293 | Neural cell adhesion molecule 2 | 207897 | |
| 1294 | Neuroplastin | 207898 | chymotrypsin |
| 1295 | Neuroplastin | 207899 | |
| 1296 | Neuroplastin | 207900 | trypsin |
| 1297 | Neutrophil cytosol factor 1 | 207901 | chymotrypsin |
| 1298 | Nickel responsive regulator | 207902 | |
| 1299 | Nifu-like protein 2, chloroplast | 207903 | |
| 1300 | Nitric oxide reductase | — | |
| 1301 | Nitric oxide reductase | 207904 | |
| 1302 | Nitric oxide reductase | 207905 | chymotrypsin, trypsin |
| 1303 | Nitric oxide reductase | 207906 | |
| 1304 | Nitric oxide reductase | 207907 | trypsin |
| 1305 | Nitric oxide reductase | 207908 | trypsin |
| 1306 | Nk receptor | 207909 | chymotrypsin |
| 1307 | Nuclear factor of activated t-cells, cytoplasmic2 | 207910 | |
| 1308 | Nucleolin rbd12 | 207911 | trypsin |

TABLE 12-continued

Proteins containing natural linker regions

| Linker No. | Name | SEQ ID NO | Protease cleavage site; linker core |
|---|---|---|---|
| 1309 | O-glcnacase nagj | 207912 | |
| 1310 | Orange carotenoid protein | — | |
| 1311 | Orange carotenoid protein | 207913 | trypsin |
| 1312 | Orange carotenoid protein | 207914 | chymotrypsin, trypsin |
| 1313 | Orn/lys/arg decarboxylase family protein | — | |
| 1314 | Orn/lys/arg decarboxylase family protein | 207915 | |
| 1315 | Orn/lys/arg decarboxylase family protein | 207916 | chymotrypsin |
| 1316 | Orn/lys/arg decarboxylase family protein | 207917 | chymotrypsin |
| 1317 | Orn/lys/arg decarboxylase family protein | 207918 | |
| 1318 | Orn/lys/arg decarboxylase family protein | 207919 | chymotrypsin, trypsin |
| 1319 | Orn/lys/arg decarboxylase family protein | 207920 | chymotrypsin |
| 1320 | Orn/lys/arg decarboxylase family protein | 207921 | trypsin |
| 1321 | Osteoclast-stimulating factor 1 | 207922 | |
| 1322 | Oxygen-independent coproporphyrinogen iii oxidase | 207923 | |
| 1323 | Oxygen-independent coproporphyrinogen iii oxidase | 207924 | |
| 1324 | Oxygen-independent coproporphyrinogen iii oxidase | 207925 | |
| 1325 | Oxygen-independent coproporphyrinogen iii oxidase | 207926 | trypsin |
| 1326 | Oxygen-independent coproporphyrinogen iii oxidase | 207927 | |
| 1327 | Oxygen-independent coproporphyrinogen iii oxidase | 207928 | chymotrypsin |
| 1328 | Oxygen-independent coproporphyrinogen iii oxidase | 207929 | |
| 1329 | Oxygen-independent coproporphyrinogen iii oxidase | 207930 | |
| 1330 | Oxygen-independent coproporphyrinogen iii oxidase | 207931 | chymotrypsin, trypsin |
| 1331 | Oxygen-independent coproporphyrinogen iii oxidase | 207932 | |
| 1332 | Paraneoplastic encephalomyelitis antigen hud | 207933 | trypsin |
| 1333 | Paraneoplastic encephalomyelitis antigen hud | 207934 | chymotrypsin |
| 1334 | Penicillin binding protein 4 | 207935 | trypsin |
| 1335 | Penicillin binding protein 4 | 207936 | |
| 1336 | Penicillin binding protein 4 | 207937 | trypsin |
| 1337 | Penicillin binding protein 4 | 207938 | |
| 1338 | Penicillin binding protein 4 | 207939 | trypsin |
| 1339 | Penicillin binding protein 4 | 207940 | chymotrypsin, trypsin |
| 1340 | Penicillin binding protein 4 | 207941 | chymotrypsin, trypsin |
| 1341 | Peptide-n(4)-(n-acetyl-beta-d-glucosaminyl)asparagineamidase f | — | |
| 1342 | Peptide-n(4)-(n-acetyl-beta-d-glucosaminyl)asparagineamidase f | 207942 | chymotrypsin, trypsin |
| 1343 | Peptide-n(4)-(n-acetyl-beta-d-glucosaminyl)asparagineamidase f | 207943 | chymotrypsin, trypsin |
| 1344 | Peptide-n(4)-(n-acetyl-beta-d-glucosaminyl)asparagineamidase f | 207944 | chymotrypsin, trypsin |
| 1345 | Peroxisomal primary amine oxidase | 207945 | trypsin |
| 1346 | Peroxisomal primary amine oxidase | 207946 | chymotrypsin, trypsin |
| 1347 | Peroxisome biogenesis factor 1 | 207947 | |
| 1348 | Pesticidial crystal protein cry2aa | 207948 | |
| 1349 | Pesticidial crystal protein cry2aa | 207949 | trypsin |
| 1350 | Pesticidial crystal protein cry2aa | 207950 | chymotrypsin |
| 1351 | Phase 1 flagellin | — | |
| 1352 | Phase 1 flagellin | 207951 | |
| 1353 | Phase 1 flagellin | 207952 | |
| 1354 | Phase 1 flagellin | 207953 | trypsin |
| 1355 | Phase 1 flagellin | 207954 | |
| 1356 | Phase 1 flagellin | 207955 | trypsin |
| 1357 | Phase 1 flagellin | 207956 | trypsin |
| 1358 | Phase 1 flagellin | 207957 | trypsin |
| 1359 | Phase 1 flagellin | 207958 | |
| 1360 | Phase 1 flagellin | 207959 | |
| 1361 | Phase 1 flagellin | 207960 | trypsin |
| 1362 | Phase 1 flagellin | 207961 | chymotrypsin, trypsin |
| 1363 | Phase 1 flagellin | 207962 | chymotrypsin, trypsin |
| 1364 | Phenylalanyl-trna synthetase beta chain | — | |
| 1365 | Phenylalanyl-trna synthetase beta chain | 207963 | |
| 1366 | Phenylalanyl-trna synthetase beta chain | 207964 | |
| 1367 | Phenylalanyl-trna synthetase beta chain | 207965 | |
| 1368 | Phenylalanyl-trna synthetase beta chain | 207966 | trypsin |
| 1369 | Phenylalanyl-trna synthetase beta chain | 207967 | chymotrypsin |
| 1370 | Phenylalanyl-trna synthetase beta chain | 207968 | trypsin |
| 1371 | Phenylalanyl-trna synthetase beta chain | 207969 | |
| 1372 | Phenylalanyl-trna synthetase beta chain | 207970 | |
| 1373 | Phenylalanyl-trna synthetase beta chain | 207971 | |
| 1374 | Phenylalanyl-trna synthetase beta chain | 207972 | chymotrypsin, trypsin |
| 1375 | Phenylalanyl-trna synthetase beta chain | 207973 | chymotrypsin |
| 1376 | Phenylalanyl-trna synthetase beta chain | 207974 | chymotrypsin, trypsin |
| 1377 | Phenylalanyl-trna synthetase beta chain | 207975 | chymotrypsin, trypsin |
| 1378 | Phosphatase | 207976 | |
| 1379 | Phosphatase | 207977 | |
| 1380 | Phosphatase | 207978 | trypsin |
| 1381 | Phosphatidylinositol transfer protein sec14p | — | chymotrypsin |
| 1382 | Phosphatidylinositol transfer protein sec14p | 207979 | chymotrypsin |
| 1383 | Phosphatidylinositol transfer protein sec14p | 207980 | chymotrypsin |

TABLE 12-continued

Proteins containing natural linker regions

| Linker No. | Name | SEQ ID NO | Protease cleavage site; linker core |
|---|---|---|---|
| 1384 | Phosphatidylserine synthase | 207981 | chymotrypsin |
| 1385 | Phosphatidylserine synthase | 207982 | trypsin |
| 1386 | Phosphatidylserine synthase | 207983 | chymotrypsin, trypsin |
| 1387 | Phosphoglycolate phosphatase | 207984 | trypsin |
| 1388 | Phosphoglycolate phosphatase | 207985 | chymotrypsin |
| 1389 | Phosphoglycolate phosphatase | 207986 | trypsin |
| 1390 | Phosphoglycolate phosphatase | 207987 | chymotrypsin, trypsin |
| 1391 | Phospholipase d | 207988 | trypsin |
| 1392 | Phospholipase d | 207989 | |
| 1393 | Phospholipase d | 207990 | |
| 1394 | Phosphoribosylamine--glycine ligase | 207991 | trypsin |
| 1395 | Phosphoribosylamine--glycine ligase | 207992 | chymotrypsin, trypsin |
| 1396 | Phosphotransferase system, enzyme i | 207993 | trypsin |
| 1397 | Photosystem ii d1 protease | 207994 | |
| 1398 | Photosystem ii d1 protease | 207995 | |
| 1399 | Photosystem ii d1 protease | 207996 | trypsin |
| 1400 | Photosystem ii d1 protease | 207997 | trypsin |
| 1401 | Photosystem ii d1 protease | 207998 | trypsin |
| 1402 | Phthalate dioxygenase reductase | 207999 | chymotrypsin, trypsin |
| 1403 | P-hydroxybenzoate hydroxylase | — | |
| 1404 | P-hydroxybenzoate hydroxylase | — | |
| 1405 | P-hydroxybenzoate hydroxylase | — | trypsin |
| 1406 | P-hydroxybenzoate hydroxylase | 208000 | |
| 1407 | P-hydroxybenzoate hydroxylase | 208001 | chymotrypsin |
| 1408 | P-hydroxybenzoate hydroxylase | 208002 | chymotrypsin |
| 1409 | P-hydroxybenzoate hydroxylase | 208003 | |
| 1410 | P-hydroxybenzoate hydroxylase | 208004 | trypsin |
| 1411 | P-hydroxybenzoate hydroxylase | 208005 | |
| 1412 | P-hydroxybenzoate hydroxylase | 208006 | |
| 1413 | P-hydroxybenzoate hydroxylase | 208007 | chymotrypsin |
| 1414 | P-hydroxybenzoate hydroxylase | 208008 | |
| 1415 | P-hydroxybenzoate hydroxylase | 208009 | chymotrypsin |
| 1416 | P-hydroxybenzoate hydroxylase | 208010 | |
| 1417 | P-hydroxybenzoate hydroxylase | 208011 | trypsin |
| 1418 | P-hydroxybenzoate hydroxylase | 208012 | trypsin |
| 1419 | P-hydroxybenzoate hydroxylase | 208013 | chymotrypsin, trypsin |
| 1420 | P-hydroxybenzoate hydroxylase | 208014 | |
| 1421 | P-hydroxybenzoate hydroxylase | 208015 | chymotrypsin |
| 1422 | P-hydroxybenzoate hydroxylase | 208016 | |
| 1423 | Phytase | — | |
| 1424 | Phytase | — | |
| 1425 | Phytase | 208017 | trypsin |
| 1426 | Phytase | 208018 | |
| 1427 | Phytase | 208019 | |
| 1428 | Phytase | 208020 | trypsin |
| 1429 | Phytase | 208021 | |
| 1430 | Phytase | 208022 | |
| 1431 | Phytase | 208023 | trypsin |
| 1432 | Phytase | 208024 | chymotrypsin, trypsin |
| 1433 | Pirin | — | trypsin |
| 1434 | Pirin | — | |
| 1435 | Pirin | 208025 | |
| 1436 | Pirin | 208026 | trypsin |
| 1437 | Pirin | 208027 | trypsin |
| 1438 | Pirin | 208028 | |
| 1439 | Pirin | 208029 | trypsin |
| 1440 | Pirin | 208030 | chymotrypsin, trypsin |
| 1441 | Poly(a) polymerase | 208031 | |
| 1442 | Poly(a) polymerase | 208032 | chymotrypsin |
| 1443 | Poly(a) polymerase | 208033 | trypsin |
| 1444 | Poly(a) polymerase | 208034 | chymotrypsin, trypsin |
| 1445 | Poly(a) polymerase | 208035 | chymotrypsin, trypsin |
| 1446 | Poly(a) polymerase | 208036 | |
| 1447 | Poly(a) polymerase | 208037 | chymotrypsin, trypsin |
| 1448 | Poly(a) polymerase | 208038 | trypsin |
| 1449 | Poly(a) polymerase | 208039 | chymotrypsin |
| 1450 | Poly(a) polymerase | 208040 | |
| 1451 | Poly(a) polymerase | 208041 | trypsin |
| 1452 | Poly(a) polymerase | 208042 | chymotrypsin, trypsin |
| 1453 | Poly(rc)-binding protein 2 | 208043 | |
| 1454 | Polymerase x | 208044 | |
| 1455 | Polymerase x | 208045 | chymotrypsin |
| 1456 | Polypeptide n-acetylgalactosaminyltransferase 2 | 208046 | |
| 1457 | Polypeptide n-acetylgalactosaminyltransferase 2 | 208047 | trypsin |
| 1458 | Polyphosphate kinase | 208048 | |

TABLE 12-continued

Proteins containing natural linker regions

| Linker No. | Name | SEQ ID NO | Protease cleavage site; linker core |
|---|---|---|---|
| 1459 | Polyphosphate kinase | 208049 | chymotrypsin, trypsin |
| 1460 | Polyphosphate kinase | 208050 | chymotrypsin |
| 1461 | Polypyrimidine tract-binding protein | 208051 | chymotrypsin, trypsin |
| 1462 | Porcine pancreatic spasmolytic polypeptide | 208052 | chymotrypsin |
| 1463 | Possible 3-mercaptopyruvate sulfurtransferase | — | chymotrypsin |
| 1464 | Possible 3-mercaptopyruvate sulfurtransferase | — | chymotrypsin |
| 1465 | Possible 3-mercaptopyruvate sulfurtransferase | 208053 | trypsin |
| 1466 | Possible 3-mercaptopyruvate sulfurtransferase | 208054 | |
| 1467 | Possible 3-mercaptopyruvate sulfurtransferase | 208055 | chymotrypsin, trypsin |
| 1468 | Postsynaptic density protein 95 | 208056 | chymotrypsin |
| 1469 | Postsynaptic density protein 95 | 208057 | chymotrypsin, trypsin |
| 1470 | Predicted sugar phosphatases of the hadsuperfamily | — | |
| 1471 | Predicted sugar phosphatases of the hadsuperfamily | 208058 | |
| 1472 | Predicted sugar phosphatases of the hadsuperfamily | 208059 | trypsin |
| 1473 | Predicted sugar phosphatases of the hadsuperfamily | 208060 | |
| 1474 | Predicted sugar phosphatases of the hadsuperfamily | 208061 | trypsin |
| 1475 | Predicted sugar phosphatases of the hadsuperfamily | 208062 | |
| 1476 | Predicted sugar phosphatases of the hadsuperfamily | 208063 | trypsin |
| 1477 | Predicted sugar phosphatases of the hadsuperfamily | 208064 | chymotrypsin |
| 1478 | Predicted sugar phosphatases of the hadsuperfamily | 208065 | chymotrypsin |
| 1479 | Preprotein translocase seca | — | |
| 1480 | Preprotein translocase seca | — | |
| 1481 | Preprotein translocase seca | 208066 | trypsin |
| 1482 | Preprotein translocase seca | 208067 | |
| 1483 | Preprotein translocase seca | 208068 | chymotrypsin, trypsin |
| 1484 | Preprotein translocase seca | 208069 | trypsin |
| 1485 | Preprotein translocase seca | 208070 | |
| 1486 | Preprotein translocase seca | 208071 | |
| 1487 | Preprotein translocase seca | 208072 | |
| 1488 | Preprotein translocase seca | 208073 | chymotrypsin |
| 1489 | Preprotein translocase seca | 208074 | chymotrypsin, trypsin |
| 1490 | Preprotein translocase seca | 208075 | trypsin |
| 1491 | Preprotein translocase seca | 208076 | chymotrypsin |
| 1492 | Preprotein translocase seca | 208077 | |
| 1493 | Preprotein translocase seca | 208078 | trypsin |
| 1494 | Preprotein translocase seca | 208079 | chymotrypsin |
| 1495 | Preprotein translocase seca | 208080 | trypsin |
| 1496 | Preprotein translocase seca | 208081 | chymotrypsin, trypsin |
| 1497 | Preprotein translocase seca | 208082 | chymotrypsin, trypsin |
| 1498 | Prfa | — | |
| 1499 | Probable 16s rrna-processing protein rimm | 208083 | chymotrypsin, trypsin |
| 1500 | Probable biphenyl-2,3-diol 1,2-dioxygenase bphc | 208084 | chymotrypsin, trypsin |
| 1501 | Probable chorismate mutase | — | |
| 1502 | Probable chorismate mutase | 208085 | |
| 1503 | Probable chorismate mutase | 208086 | |
| 1504 | Probable ferredoxin-dependent nitrite reductase nira | — | |
| 1505 | Probable ferredoxin-dependent nitrite reductase nira | — | chymotrypsin |
| 1506 | Probable ferredoxin-dependent nitrite reductase nira | 208087 | |
| 1507 | Probable ferredoxin-dependent nitrite reductase nira | 208088 | trypsin |
| 1508 | Probable ferredoxin-dependent nitrite reductase nira | 208089 | |
| 1509 | Probable ferredoxin-dependent nitrite reductase nira | 208090 | chymotrypsin |
| 1510 | Probable ferredoxin-dependent nitrite reductase nira | 208091 | chymotrypsin, trypsin |
| 1511 | Probable ferredoxin-dependent nitrite reductase nira | 208092 | chymotrypsin, trypsin |
| 1512 | Probable ferredoxin-dependent nitrite reductase nira | 208093 | chymotrypsin, trypsin |
| 1513 | Probable ferredoxin-dependent nitrite reductase nira | 208094 | |
| 1514 | Probable ferredoxin-dependent nitrite reductase nira | 208095 | |
| 1515 | Probable ferredoxin-dependent nitrite reductase nira | 208096 | |
| 1516 | Probable ferredoxin-dependent nitrite reductase nira | 208097 | trypsin |
| 1517 | Probable ferredoxin-dependent nitrite reductase nira | 208098 | |
| 1518 | Probable galactokinase | 208099 | trypsin |
| 1519 | Probable galactokinase | 208100 | |
| 1520 | Probable galactokinase | 208101 | trypsin |
| 1521 | Probable galactokinase | 208102 | chymotrypsin, trypsin |
| 1522 | Probable galactokinase | 208103 | trypsin |
| 1523 | Probable galactokinase | 208104 | trypsin |
| 1524 | Probable galactokinase | 208105 | chymotrypsin |
| 1525 | Probable galactokinase | 208106 | chymotrypsin, trypsin |
| 1526 | Probable galactokinase | 208107 | |
| 1527 | Probable galactokinase | 208108 | chymotrypsin |
| 1528 | Probable galactokinase | 208109 | |
| 1529 | Probable galactokinase | 208110 | chymotrypsin, trypsin |
| 1530 | Probable glutathione s-transferase | 208111 | |
| 1531 | Probable gst-related protein | 208112 | trypsin |
| 1532 | Probable hpr(ser) kinase/phosphatase | 208113 | chymotrypsin |
| 1533 | Probable thiosulfate sulfurtransferase | 208114 | |

TABLE 12-continued

Proteins containing natural linker regions

| Linker No. | Name | SEQ ID NO | Protease cleavage site; linker core |
|---|---|---|---|
| 1534 | Probable thiosulfate sulfurtransferase | 208115 | trypsin |
| 1535 | Probable thiosulfate sulfurtransferase | 208116 | |
| 1536 | Probable thiosulfate sulfurtransferase | 208117 | chymotrypsin |
| 1537 | Probable thiosulfate sulfurtransferase | 208118 | chymotrypsin |
| 1538 | Probable thiosulfate sulfurtransferase | 208119 | trypsin |
| 1539 | Probable thiosulfate sulfurtransferase | 208120 | trypsin |
| 1540 | Probable thiosulfate sulfurtransferase | 208121 | chymotrypsin, trypsin |
| 1541 | Probable trna pseudouridine synthase d | 208122 | |
| 1542 | Probable trna pseudouridine synthase d | 208123 | trypsin |
| 1543 | Probable trna pseudouridine synthase d | 208124 | trypsin |
| 1544 | Probable trna pseudouridine synthase d | 208125 | chymotrypsin, trypsin |
| 1545 | Probable trna pseudouridine synthase d | 208126 | chymotrypsin |
| 1546 | Probable trna pseudouridine synthase d | 208127 | chymotrypsin, trypsin |
| 1547 | Programed cell death protein 8 | — | trypsin |
| 1548 | Programed cell death protein 8 | — | |
| 1549 | Programed cell death protein 8 | 208128 | trypsin |
| 1550 | Programed cell death protein 8 | 208129 | trypsin |
| 1551 | Programed cell death protein 8 | 208130 | chymotrypsin |
| 1552 | Programed cell death protein 8 | 208131 | |
| 1553 | Programed cell death protein 8 | 208132 | |
| 1554 | Programed cell death protein 8 | 208133 | chymotrypsin, trypsin |
| 1555 | Programed cell death protein 8 | 208134 | trypsin |
| 1556 | Programed cell death protein 8 | 208135 | trypsin |
| 1557 | Programed cell death protein 8 | 208136 | trypsin |
| 1558 | Programed cell death protein 8 | 208137 | |
| 1559 | Programed cell death protein 8 | 208138 | |
| 1560 | Programed cell death protein 8 | 208139 | trypsin |
| 1561 | Programed cell death protein 8 | 208140 | trypsin |
| 1562 | Programed cell death protein 8 | 208141 | chymotrypsin, trypsin |
| 1563 | Programed cell death protein 8 | 208142 | chymotrypsin |
| 1564 | Programed cell death protein 8 | 208143 | trypsin |
| 1565 | Programed cell death protein 8 | 208144 | chymotrypsin |
| 1566 | Programed cell death protein 8 | 208145 | chymotrypsin, trypsin |
| 1567 | Proline oxidase | 208146 | chymotrypsin |
| 1568 | Prolyl-trna synthetase | 208147 | trypsin |
| 1569 | Prostaglandin g/h synthase 1 | — | |
| 1570 | Prostaglandin g/h synthase 1 | 208148 | |
| 1571 | Protease | 208149 | |
| 1572 | Protease | 208150 | |
| 1573 | Protease | 208151 | chymotrypsin, trypsin |
| 1574 | Protease degs | 208152 | chymotrypsin |
| 1575 | Protease degs | 208153 | trypsin |
| 1576 | Protease degs | 208154 | chymotrypsin, trypsin |
| 1577 | Protease degs | 208155 | |
| 1578 | Protease iii | — | |
| 1579 | Protease iii | — | trypsin |
| 1580 | Protease iii | 208156 | |
| 1581 | Protease iii | 208157 | |
| 1582 | Protease iii | 208158 | trypsin |
| 1583 | Protease iii | 208159 | |
| 1584 | Protease iii | 208160 | |
| 1585 | Protease iii | 208161 | |
| 1586 | Protease iii | 208162 | chymotrypsin, trypsin |
| 1587 | Protease iii | 208163 | trypsin |
| 1588 | Protease iii | 208164 | trypsin |
| 1589 | Protease iii | 208165 | chymotrypsin |
| 1590 | Protease iii | 208166 | |
| 1591 | Protease iii | 208167 | chymotrypsin, trypsin |
| 1592 | Protease iii | 208168 | chymotrypsin |
| 1593 | Protease iii | 208169 | trypsin |
| 1594 | Protease iii | 208170 | |
| 1595 | Protease iii | 208171 | trypsin |
| 1596 | Protease iii | 208172 | chymotrypsin |
| 1597 | Protease iii | 208173 | chymotrypsin, trypsin |
| 1598 | Protease iii | 208174 | chymotrypsin, trypsin |
| 1599 | Protease iii | 208175 | chymotrypsin, trypsin |
| 1600 | Protection of telomeres 1 | 208176 | |
| 1601 | Protection of telomeres 1 | 208177 | chymotrypsin, trypsin |
| 1602 | Protein (cd58) | 208178 | |
| 1603 | Protein (crp1) | 208179 | chymotrypsin, trypsin |
| 1604 | Protein (dna polymerase) | 208180 | |
| 1605 | Protein (dna polymerase) | 208181 | trypsin |
| 1606 | Protein (dna polymerase) | 208182 | trypsin |
| 1607 | Protein (electron transfer flavoprotein) | 208183 | |
| 1608 | Protein (electron transfer flavoprotein) | 208184 | trypsin |

TABLE 12-continued

Proteins containing natural linker regions

| Linker No. | Name | SEQ ID NO | Protease cleavage site; linker core |
|---|---|---|---|
| 1609 | Protein (ffh) | 208185 | chymotrypsin |
| 1610 | Protein (ffh) | 208186 | |
| 1611 | Protein (ffh) | 208187 | |
| 1612 | Protein (ffh) | 208188 | trypsin |
| 1613 | Protein (ffh) | 208189 | trypsin |
| 1614 | Protein (foki restriction endonuclease) | 208190 | trypsin |
| 1615 | Protein (foki restriction endonuclease) | 208191 | trypsin |
| 1616 | Protein (foki restriction endonuclease) | 208192 | chymotrypsin |
| 1617 | Protein (foki restriction endonuclease) | 208193 | trypsin |
| 1618 | Protein (foki restriction endonuclease) | 208194 | chymotrypsin, trypsin |
| 1619 | Protein (foki restriction endonuclease) | 208195 | chymotrypsin |
| 1620 | Protein (foki restriction endonuclease) | 208196 | |
| 1621 | Protein (foki restriction endonuclease) | 208197 | chymotrypsin, trypsin |
| 1622 | Protein (foki restriction endonuclease) | 208198 | chymotrypsin, trypsin |
| 1623 | Protein (neural cell adhesion molecule) | 208199 | chymotrypsin, trypsin |
| 1624 | Protein (neural cell adhesion molecule) | 208200 | |
| 1625 | Protein (neural cell adhesion molecule) | 208201 | chymotrypsin, trypsin |
| 1626 | Protein (nine-haem cytochrome c) | — | chymotrypsin |
| 1627 | Protein (nine-haem cytochrome c) | 208202 | |
| 1628 | Protein (nine-haem cytochrome c) | 208203 | chymotrypsin, trypsin |
| 1629 | Protein (nine-haem cytochrome c) | 208204 | trypsin |
| 1630 | Protein (nine-haem cytochrome c) | 208205 | chymotrypsin |
| 1631 | Protein (nine-haem cytochrome c) | 208206 | trypsin |
| 1632 | Protein (nine-haem cytochrome c) | 208207 | |
| 1633 | Protein (nine-haem cytochrome c) | 208208 | |
| 1634 | Protein (nine-haem cytochrome c) | 208209 | chymotrypsin, trypsin |
| 1635 | Protein (protease/helicase ns3) | 208210 | chymotrypsin |
| 1636 | Protein (protease/helicase ns3) | 208211 | |
| 1637 | Protein (protease/helicase ns3) | 208212 | |
| 1638 | Protein (protease/helicase ns3) | 208213 | chymotrypsin, trypsin |
| 1639 | Protein disulfide oxidoreductase | 208214 | trypsin |
| 1640 | Protein disulfide oxidoreductase | 208215 | trypsin |
| 1641 | Protein disulfide-isomerase a4 | 208216 | |
| 1642 | Protein kinase pkr | 208217 | trypsin |
| 1643 | Protein kinase pkr | 208218 | chymotrypsin, trypsin |
| 1644 | Protein tolb | — | |
| 1645 | Protein tolb | 208219 | |
| 1646 | Protein tolb | 208220 | |
| 1647 | Protein tolb | 208221 | chymotrypsin |
| 1648 | Protein tolb | 208222 | |
| 1649 | Protein tolb | 208223 | |
| 1650 | Protein tolb | 208224 | chymotrypsin, trypsin |
| 1651 | Protein translation elongation factor 1a | 208225 | |
| 1652 | Protein transport protein sec24 | — | trypsin |
| 1653 | Protein transport protein sec24 | 208226 | |
| 1654 | Protein transport protein sec24 | 208227 | trypsin |
| 1655 | Protein transport protein sec24 | 208228 | |
| 1656 | Protein transport protein sec24 | 208229 | |
| 1657 | Protein transport protein sec24 | 208230 | |
| 1658 | Protein transport protein sec24 | 208231 | chymotrypsin, trypsin |
| 1659 | Protein transport protein sec24 | 208232 | trypsin |
| 1660 | Protein transport protein sec24 | 208233 | |
| 1661 | Pseudouridine synthase cbf5 | — | |
| 1662 | Pseudouridine synthase cbf5 | 208234 | |
| 1663 | Pseudouridine synthase cbf5 | 208235 | |
| 1664 | Putative acetylglutamate synthase | 208236 | |
| 1665 | Putative acetylglutamate synthase | 208237 | chymotrypsin, trypsin |
| 1666 | Putative acetylglutamate synthase | 208238 | trypsin |
| 1667 | Putative family 31 glucosidase yici | 208239 | |
| 1668 | Putative family 31 glucosidase yici | 208240 | |
| 1669 | Putative family 31 glucosidase yici | 208241 | trypsin |
| 1670 | Putative glutathione transferase | 208242 | |
| 1671 | Putative glutathione transferase | 208243 | |
| 1672 | Putative glutathione transferase | 208244 | |
| 1673 | Putative gntr-family transcriptional regulator | 208245 | trypsin |
| 1674 | Putative gntr-family transcriptional regulator | 208246 | trypsin |
| 1675 | Putative gntr-family transcriptional regulator | 208247 | chymotrypsin, trypsin |
| 1676 | Putative hth-type transcriptional regulator ph0061 | 208248 | trypsin |
| 1677 | Putative hth-type transcriptional regulator ph1519 | 208249 | chymotrypsin |
| 1678 | Putative hth-type transcriptional regulator ph1519 | 208250 | chymotrypsin, trypsin |
| 1679 | Putative metallopeptidase | 208251 | trypsin |
| 1680 | Putative n-acetylmannosamine kinase | 208252 | |
| 1681 | Putative n-acetylmannosamine kinase | 208253 | |
| 1682 | Putative n-acetylmannosamine kinase | 208254 | |
| 1683 | Putative nadp oxidoreductase bf3122 | 208255 | |

TABLE 12-continued

Proteins containing natural linker regions

| Linker No. | Name | SEQ ID NO | Protease cleavage site; linker core |
|---|---|---|---|
| 1684 | Putative nadp oxidoreductase bf3122 | 208256 | chymotrypsin |
| 1685 | Putative nadp oxidoreductase bf3122 | 208257 | trypsin |
| 1686 | Putative nadp oxidoreductase bf3122 | 208258 | chymotrypsin, trypsin |
| 1687 | Putative oxidoreductase | 208259 | chymotrypsin, trypsin |
| 1688 | Putative secreted alpha-galactosidase | — | |
| 1689 | Putative secreted alpha-galactosidase | — | |
| 1690 | Putative secreted alpha-galactosidase | 208260 | |
| 1691 | Putative secreted alpha-galactosidase | 208261 | chymotrypsin |
| 1692 | Putative secreted alpha-galactosidase | 208262 | |
| 1693 | Putative tagatose-6-phosphate ketose/aldose isomerase | — | trypsin |
| 1694 | Putative tagatose-6-phosphate ketose/aldose isomerase | 208263 | chymotrypsin |
| 1695 | Putative tagatose-6-phosphate ketose/aldose isomerase | 208264 | chymotrypsin |
| 1696 | Putative tagatose-6-phosphate ketose/aldose isomerase | 208265 | chymotrypsin |
| 1697 | Putative transcriptional regulator gntr | 208266 | chymotrypsin |
| 1698 | Putative transcriptional repressor (tetr/acrr family) | — | chymotrypsin, trypsin |
| 1699 | Putative transcriptional repressor (tetr/acrr family) | 208267 | chymotrypsin |
| 1700 | Putative uncharacterized protein | 208268 | |
| 1701 | Putative uncharacterized protein | 208269 | trypsin |
| 1702 | Putative uncharacterized protein | 208270 | chymotrypsin |
| 1703 | Putative uncharacterized protein | 208271 | |
| 1704 | Putative uncharacterized protein | 208272 | |
| 1705 | Putative uncharacterized protein | 208273 | trypsin |
| 1706 | Putative uncharacterized protein | 208274 | trypsin |
| 1707 | Putative uncharacterized protein | 208275 | chymotrypsin, trypsin |
| 1708 | Putative uncharacterized protein | 208276 | chymotrypsin |
| 1709 | Pyruvate decarboxylase | — | |
| 1710 | Pyruvate decarboxylase | 208277 | |
| 1711 | Pyruvate decarboxylase | 208278 | trypsin |
| 1712 | Pyruvate decarboxylase | 208279 | |
| 1713 | Pyruvate decarboxylase | 208280 | chymotrypsin |
| 1714 | Pyruvate decarboxylase | 208281 | trypsin |
| 1715 | Pyruvate dehydrogenase [lipoamide] kinase isozyme 2, mitochondrial | — | chymotrypsin |
| 1716 | Pyruvate dehydrogenase [lipoamide] kinase isozyme 2, mitochondrial | 208282 | chymotrypsin, trypsin |
| 1717 | Pyruvate dehydrogenase [lipoamide] kinase isozyme 2, mitochondrial | 208283 | |
| 1718 | Pyruvate dehydrogenase e1 component subunit beta, mitochondrial | 208284 | |
| 1719 | Pyruvate dehydrogenase e1 component subunit beta, mitochondrial | 208285 | chymotrypsin |
| 1720 | Pyruvate dehydrogenase e1 component subunit beta, mitochondrial | 208286 | chymotrypsin, trypsin |
| 1721 | Pyruvate phosphate dikinase | — | chymotrypsin |
| 1722 | Pyruvate phosphate dikinase | — | |
| 1723 | Pyruvate phosphate dikinase | 208287 | |
| 1724 | Pyruvate phosphate dikinase | 208288 | |
| 1725 | Pyruvate phosphate dikinase | 208289 | trypsin |
| 1726 | Pyruvate phosphate dikinase | 208290 | |
| 1727 | Pyruvate phosphate dikinase | 208291 | chymotrypsin |
| 1728 | Pyruvate phosphate dikinase | 208292 | |
| 1729 | Pyruvate phosphate dikinase | 208293 | trypsin |
| 1730 | Pyruvate phosphate dikinase | 208294 | trypsin |
| 1731 | Pyruvate phosphate dikinase | 208295 | |
| 1732 | Pyruvate phosphate dikinase | 208296 | |
| 1733 | Pyruvate-ferredoxin oxidoreductase | — | trypsin |
| 1734 | Pyruvate-ferredoxin oxidoreductase | 208297 | |
| 1735 | Pyruvate-ferredoxin oxidoreductase | 208298 | chymotrypsin, trypsin |
| 1736 | Pyruvate-ferredoxin oxidoreductase | 208299 | |
| 1737 | Pyruvate-ferredoxin oxidoreductase | 208300 | chymotrypsin |
| 1738 | Pyruvate-ferredoxin oxidoreductase | 208301 | |
| 1739 | Pyruvate-ferredoxin oxidoreductase | 208302 | |
| 1740 | Pyruvate-ferredoxin oxidoreductase | 208303 | chymotrypsin, trypsin |
| 1741 | Pyruvate-ferredoxin oxidoreductase | 208304 | trypsin |
| 1742 | Pyruvate-ferredoxin oxidoreductase | 208305 | |
| 1743 | Pyruvate-ferredoxin oxidoreductase | 208306 | trypsin |
| 1744 | Pyruvate-ferredoxin oxidoreductase | 208307 | trypsin |
| 1745 | Pyruvate-ferredoxin oxidoreductase | 208308 | chymotrypsin, trypsin |
| 1746 | Pyruvate-ferredoxin oxidoreductase | 208309 | trypsin |
| 1747 | Pyruvate-ferredoxin oxidoreductase | 208310 | chymotrypsin, trypsin |
| 1748 | Pyruvate-ferredoxin oxidoreductase | 208311 | trypsin |
| 1749 | Pyruvate-ferredoxin oxidoreductase | 208312 | trypsin |
| 1750 | Pyruvate-ferredoxin oxidoreductase | 208313 | chymotrypsin |
| 1751 | Pyruvate-ferredoxin oxidoreductase | 208314 | trypsin |
| 1752 | Pyruvate-ferredoxin oxidoreductase | 208315 | chymotrypsin, trypsin |
| 1753 | Quinohemoprotein amine dehydrogenase 60 kdasubunit | 208316 | |
| 1754 | Quinohemoprotein amine dehydrogenase 60 kdasubunit | 208317 | |
| 1755 | Quinohemoprotein amine dehydrogenase 60 kdasubunit | 208318 | |
| 1756 | Quinohemoprotein amine dehydrogenase 60 kdasubunit | 208319 | |
| 1757 | Quinohemoprotein amine dehydrogenase 60 kdasubunit | 208320 | |
| 1758 | Quinohemoprotein amine dehydrogenase 60 kdasubunit | 208321 | thrombin, trypsin |

TABLE 12-continued

Proteins containing natural linker regions

| Linker No. | Name | SEQ ID NO | Protease cleavage site; linker core |
|---|---|---|---|
| 1759 | Quinohemoprotein amine dehydrogenase 60 kdasubunit | 208322 | chymotrypsin |
| 1760 | Quinohemoprotein amine dehydrogenase 60 kdasubunit | 208323 | chymotrypsin |
| 1761 | Quinohemoprotein amine dehydrogenase 60 kdasubunit | 208324 | trypsin |
| 1762 | Quinohemoprotein amine dehydrogenase 60 kdasubunit | 208325 | chymotrypsin |
| 1763 | Rag1 | 208326 | |
| 1764 | Rag1 | 208327 | |
| 1765 | Receptor-type tyrosine-protein phosphatase mu | 208328 | chymotrypsin, trypsin |
| 1766 | Receptor-type tyrosine-protein phosphatase mu | 208329 | trypsin |
| 1767 | Recg | 208330 | trypsin |
| 1768 | Recg | 208331 | trypsin |
| 1769 | Recg | 208332 | |
| 1770 | Recg | 208333 | chymotrypsin |
| 1771 | Recg | 208334 | chymotrypsin, trypsin |
| 1772 | Recg | 208335 | trypsin |
| 1773 | Recg | 208336 | trypsin |
| 1774 | Recg | 208337 | trypsin |
| 1775 | Recg | 208338 | chymotrypsin, trypsin |
| 1776 | Recg | 208339 | trypsin |
| 1777 | Recg | 208340 | trypsin |
| 1778 | Recg | 208341 | chymotrypsin, trypsin |
| 1779 | Recombination endonuclease vii | 208342 | chymotrypsin, trypsin |
| 1780 | Recombining binding protein suppressor of hairless | 208343 | |
| 1781 | Restriction endonuclease | — | trypsin |
| 1782 | Restriction endonuclease | 208344 | chymotrypsin |
| 1783 | Restriction endonuclease | 208345 | |
| 1784 | Restriction endonuclease | 208346 | chymotrypsin, trypsin |
| 1785 | Retinaldehyde-binding protein 1 | — | |
| 1786 | Retinaldehyde-binding protein 1 | 208347 | |
| 1787 | Retinaldehyde-binding protein 1 | 208348 | chymotrypsin |
| 1788 | Retinoblastoma pocket | 208349 | trypsin |
| 1789 | Rfcs | — | |
| 1790 | Rfcs | — | |
| 1791 | Rfcs | 208350 | |
| 1792 | Rfcs | 208351 | trypsin |
| 1793 | Rfcs | 208352 | |
| 1794 | Rfcs | 208353 | chymotrypsin, trypsin |
| 1795 | Rfcs | 208354 | trypsin |
| 1796 | Rhamnogalacturonase b | 208355 | trypsin |
| 1797 | Rhamnogalacturonase b | 208356 | |
| 1798 | Rhamnogalacturonase b | 208357 | trypsin |
| 1799 | Rhamnogalacturonase b | 208358 | chymotrypsin, trypsin |
| 1800 | Rhamnogalacturonase b | 208359 | trypsin |
| 1801 | Rhodniin | 208360 | chymotrypsin |
| 1802 | Rhodniin | 208361 | |
| 1803 | Riboflavin synthase | 208362 | chymotrypsin, trypsin |
| 1804 | Ribonuclease d | 208363 | trypsin |
| 1805 | Ribonuclease d | 208364 | |
| 1806 | Ribonuclease d | 208365 | |
| 1807 | Ribonuclease ttha0252 | 208366 | |
| 1808 | Ribonuclease ttha0252 | 208367 | |
| 1809 | Ribonuclease ttha0252 | 208368 | |
| 1810 | Ribonuclease ttha0252 | 208369 | chymotrypsin |
| 1811 | Ribonuclease ttha0252 | 208370 | chymotrypsin |
| 1812 | Ribonuclease ttha0252 | 208371 | chymotrypsin, trypsin |
| 1813 | Ribonucleotide reductase r1 protein | 208372 | chymotrypsin |
| 1814 | Ribonucleotide reductase r1 protein | 208373 | chymotrypsin |
| 1815 | Ribonucleotide reductase r1 protein | 208374 | chymotrypsin |
| 1816 | Ribonucleotide reductase r1 protein | 208375 | chymotrypsin, trypsin |
| 1817 | Ribonucleotide reductase r1 protein | 208376 | chymotrypsin |
| 1818 | Ribonucleotide reductase r1 protein | 208377 | chymotrypsin, trypsin |
| 1819 | Ribosome maturation factor rimm | 208378 | |
| 1820 | Ribulose-1,5 bisphosphate carboxylase/oxygenase large subunit n-methyltransferase | — | trypsin |
| 1821 | Ribulose-1,5 bisphosphate carboxylase/oxygenase large subunit n-methyltransferase | 208379 | chymotrypsin |
| 1822 | Rna binding domain of rho transcription termination factor | 208380 | trypsin |
| 1823 | Rna binding protein zfa | 208381 | chymotrypsin, trypsin |
| 1824 | Rob transcription factor | 208382 | trypsin |
| 1825 | Rob transcription factor | 208383 | chymotrypsin, trypsin |
| 1826 | Rp2 lipase | 208384 | chymotrypsin, trypsin |
| 1827 | Rubrerythrin | 208385 | trypsin |
| 1828 | S-adenosylmethionine synthetase | 208386 | trypsin |
| 1829 | Sarcoplasmic/endoplasmic reticulum calcium atpase 1 | — | chymotrypsin |
| 1830 | Sarcoplasmic/endoplasmic reticulum calcium atpase 1 | 208387 | |
| 1831 | Sarcoplasmic/endoplasmic reticulum calcium atpase 1 | 208388 | trypsin |

TABLE 12-continued

Proteins containing natural linker regions

| Linker No. | Name | SEQ ID NO | Protease cleavage site; linker core |
|---|---|---|---|
| 1832 | Sarcoplasmic/endoplasmic reticulum calcium atpase 1 | 208389 | trypsin |
| 1833 | Sarcoplasmic/endoplasmic reticulum calcium atpase 1 | 208390 | |
| 1834 | Sarcoplasmic/endoplasmic reticulum calcium atpase 1 | 208391 | trypsin |
| 1835 | Sarcoplasmic/endoplasmic reticulum calcium atpase 1 | 208392 | |
| 1836 | Sarcoplasmic/endoplasmic reticulum calcium atpase 1 | 208393 | |
| 1837 | Sarcoplasmic/endoplasmic reticulum calcium atpase 1 | 208394 | |
| 1838 | Sarcoplasmic/endoplasmic reticulum calcium atpase 1 | 208395 | |
| 1839 | Sarcoplasmic/endoplasmic reticulum calcium atpase 1 | 208396 | chymotrypsin |
| 1840 | Sarcoplasmic/endoplasmic reticulum calcium atpase 1 | 208397 | |
| 1841 | Sarcoplasmic/endoplasmic reticulum calcium atpase 1 | 208398 | |
| 1842 | Sarcoplasmic/endoplasmic reticulum calcium atpase 1 | 208399 | chymotrypsin |
| 1843 | Sarcoplasmic/endoplasmic reticulum calcium atpase 1 | 208400 | |
| 1844 | Sarcoplasmic/endoplasmic reticulum calcium atpase 1 | 208401 | |
| 1845 | Sarcoplasmic/endoplasmic reticulum calcium atpase 1 | 208402 | trypsin |
| 1846 | Sarcoplasmic/endoplasmic reticulum calcium atpase 1 | 208403 | |
| 1847 | Sarcoplasmic/endoplasmic reticulum calcium atpase 1 | 208404 | trypsin |
| 1848 | Sarcoplasmic/endoplasmic reticulum calcium atpase 1 | 208405 | trypsin |
| 1849 | Sarcoplasmic/endoplasmic reticulum calcium atpase 1 | 208406 | trypsin |
| 1850 | Sarcoplasmic/endoplasmic reticulum calcium atpase 1 | 208407 | chymotrypsin |
| 1851 | Sarcoplasmic/endoplasmic reticulum calcium atpase 1 | 208408 | |
| 1852 | Sarcoplasmic/endoplasmic reticulum calcium atpase 1 | 208409 | trypsin |
| 1853 | Sarcoplasmic/endoplasmic reticulum calcium atpase 1 | 208410 | chymotrypsin |
| 1854 | Sarcoplasmic/endoplasmic reticulum calcium atpase 1 | 208411 | chymotrypsin, trypsin |
| 1855 | Scavenger mrna-decapping enzyme dcps | — | |
| 1856 | Scavenger mrna-decapping enzyme dcps | — | |
| 1857 | Scavenger mrna-decapping enzyme dcps | 208412 | chymotrypsin, trypsin |
| 1858 | Scavenger mrna-decapping enzyme dcps | 208413 | |
| 1859 | Sec18p (residues 22 - 210) | 208414 | trypsin |
| 1860 | Sec18p (residues 22 - 210) | 208415 | chymotrypsin, trypsin |
| 1861 | Sensor protein | 208416 | |
| 1862 | Sensor protein | 208417 | trypsin |
| 1863 | Septum site-determining protein minc | 208418 | trypsin |
| 1864 | Serine acetyltransferase | 208419 | trypsin |
| 1865 | Serine protease/ntpase/helicase ns3 | 208420 | chymotrypsin |
| 1866 | Serine protease/ntpase/helicase ns3 | 208421 | |
| 1867 | Serine protease/ntpase/helicase ns3 | 208422 | |
| 1868 | Seryl-trna synthetase | 208423 | |
| 1869 | Sialidase | 208424 | chymotrypsin, trypsin |
| 1870 | Sialidase b | — | |
| 1871 | Sialidase b | — | trypsin |
| 1872 | Sialidase b | 208425 | |
| 1873 | Sialidase b | 208426 | chymotrypsin, trypsin |
| 1874 | Sialidase b | 208427 | |
| 1875 | Sialidase b | 208428 | chymotrypsin |
| 1876 | Sialidase b | 208429 | chymotrypsin, trypsin |
| 1877 | Sialidase b | 208430 | chymotrypsin, trypsin |
| 1878 | Signal peptidase i | — | trypsin |
| 1879 | Signal peptidase i | 208431 | |
| 1880 | Signal peptidase i | 208432 | |
| 1881 | Signal peptidase i | 208433 | chymotrypsin |
| 1882 | Signal peptidase i | 208434 | trypsin |
| 1883 | Signal peptidase i | 208435 | |
| 1884 | Signal peptidase i | 208436 | |
| 1885 | Signal peptidase i | 208437 | |
| 1886 | Signal peptidase i | 208438 | trypsin |
| 1887 | Signal peptidase i | 208439 | chymotrypsin |
| 1888 | Signal peptidase i | 208440 | |
| 1889 | Signal recognition particle protein | 208441 | trypsin |
| 1890 | Signal transducer and activator of transcription 1-alpha/beta | — | |
| 1891 | Signal transducer and activator of transcription 1-alpha/beta | — | |
| 1892 | Signal transducer and activator of transcription 1-alpha/beta | 208442 | chymotrypsin, trypsin |
| 1893 | Signal transducer and activator of transcription 1-alpha/beta | 208443 | |
| 1894 | Signal transducer and activator of transcription 1-alpha/beta | 208444 | chymotrypsin, trypsin |
| 1895 | Signal transducer and activator of transcription 1-alpha/beta | 208445 | trypsin |
| 1896 | Signal transduction protein cbl | 208446 | chymotrypsin |
| 1897 | Signal transduction protein cbl | 208447 | trypsin |
| 1898 | Similar to rad54-like | — | |
| 1899 | Similar to rad54-like | — | chymotrypsin |
| 1900 | Similar to rad54-like | — | chymotrypsin, trypsin |
| 1901 | Similar to rad54-like | 208448 | |
| 1902 | Similar to rad54-like | 208449 | |
| 1903 | Similar to rad54-like | 208450 | |
| 1904 | Similar to rad54-like | 208451 | trypsin |
| 1905 | Similar to rad54-like | 208452 | chymotrypsin, trypsin |
| 1906 | Similar to rad54-like | 208453 | |

TABLE 12-continued

Proteins containing natural linker regions

| Linker No. | Name | SEQ ID NO | Protease cleavage site; linker core |
|---|---|---|---|
| 1907 | Similar to rad54-like | 208454 | trypsin |
| 1908 | Similar to rad54-like | 208455 | chymotrypsin |
| 1909 | Similar to rad54-like | 208456 | trypsin |
| 1910 | Similar to rad54-like | 208457 | chymotrypsin, trypsin |
| 1911 | Skd1 protein | — | |
| 1912 | Skd1 protein | 208458 | |
| 1913 | Skd1 protein | 208459 | chymotrypsin |
| 1914 | Skd1 protein | 208460 | chymotrypsin, trypsin |
| 1915 | Skd1 protein | 208461 | trypsin |
| 1916 | Skd1 protein | 208462 | |
| 1917 | Sll1358 protein | 208463 | |
| 1918 | Sll1358 protein | 208464 | chymotrypsin |
| 1919 | Sll1358 protein | 208465 | chymotrypsin, trypsin |
| 1920 | Sll1358 protein | 208466 | trypsin |
| 1921 | Soluble ifn alpha/beta receptor | 208467 | chymotrypsin |
| 1922 | Soluble ifn alpha/beta receptor | 208468 | chymotrypsin |
| 1923 | Sporozoite-specific sag protein | 208469 | trypsin |
| 1924 | Staphylococcal accessory regulator a homologue | 208470 | trypsin |
| 1925 | Staphylococcal nuclease domain-containing protein 1 | 208471 | chymotrypsin |
| 1926 | Staphylococcal nuclease domain-containing protein 1 | 208472 | |
| 1927 | Staphylococcal nuclease domain-containing protein 1 | 208473 | |
| 1928 | Staphylococcal nuclease domain-containing protein 1 | 208474 | |
| 1929 | Staphylococcal nuclease domain-containing protein 1 | 208475 | |
| 1930 | Staphylococcal nuclease domain-containing protein 1 | 208476 | chymotrypsin, trypsin |
| 1931 | Stat protein | 208477 | |
| 1932 | Stat protein | 208478 | |
| 1933 | Stat protein | 208479 | |
| 1934 | Stat protein | 208480 | chymotrypsin |
| 1935 | Stat protein | 208481 | |
| 1936 | Stat protein | 208482 | |
| 1937 | Stat protein | 208483 | trypsin |
| 1938 | Stat protein | 208484 | |
| 1939 | Stat protein | 208485 | chymotrypsin, trypsin |
| 1940 | Stat protein | 208486 | |
| 1941 | Stat protein | 208487 | chymotrypsin, trypsin |
| 1942 | Stat protein | 208488 | |
| 1943 | Stat protein | 208489 | trypsin |
| 1944 | Stat protein | 208490 | trypsin |
| 1945 | Stat protein | 208491 | trypsin |
| 1946 | Subtilisin-like protease | 208492 | chymotrypsin |
| 1947 | Succinyl-coa ligase [gdp-forming] alpha-chain, mitochondrial | 208493 | trypsin |
| 1948 | Succinyl-coa ligase [gdp-forming] alpha-chain, mitochondrial | 208494 | |
| 1949 | Succinyl-coa ligase [gdp-forming] alpha-chain, mitochondrial | 208495 | |
| 1950 | Succinyl-coa ligase [gdp-forming] alpha-chain, mitochondrial | 208496 | |
| 1951 | Succinyl-coa ligase [gdp-forming] alpha-chain, mitochondrial | 208497 | |
| 1952 | Succinyl-coa ligase [gdp-forming] alpha-chain, mitochondrial | 208498 | trypsin |
| 1953 | Succinyl-coa synthetase beta chain | — | |
| 1954 | Succinyl-coa synthetase beta chain | — | trypsin |
| 1955 | Succinyl-coa synthetase beta chain | 208499 | trypsin |
| 1956 | Succinyl-coa synthetase beta chain | 208500 | |
| 1957 | Succinyl-coa synthetase beta chain | 208501 | |
| 1958 | Succinyl-coa synthetase beta chain | 208502 | chymotrypsin |
| 1959 | Succinyl-coa synthetase beta chain | 208503 | |
| 1960 | Succinyl-coa synthetase beta chain | 208504 | trypsin |
| 1961 | Succinyl-coa: 3-ketoacid-coenzyme a transferase | 208505 | chymotrypsin, trypsin |
| 1962 | Sulfurtransferase | 208506 | trypsin |
| 1963 | Super antigen smez-2 | 208507 | chymotrypsin, trypsin |
| 1964 | Superoxide dismutase 1 copper chaperone | 208508 | trypsin |
| 1965 | Surface layer protein | 208509 | trypsin |
| 1966 | Surface layer protein | 208510 | |
| 1967 | Surface layer protein | 208511 | chymotrypsin |
| 1968 | Surface layer protein | 208512 | chymotrypsin |
| 1969 | Surface layer protein | 208513 | |
| 1970 | Surface layer protein | 208514 | trypsin |
| 1971 | Surface layer protein | 208515 | chymotrypsin |
| 1972 | Surface layer protein | 208516 | |
| 1973 | T lymphocyte activation antigen | 208517 | |
| 1974 | T lymphocyte activation antigen | 208518 | trypsin |
| 1975 | T-cell receptor alpha chain c region | 208519 | chymotrypsin |
| 1976 | Terminal oxygenase component of carbazide | 208520 | chymotrypsin |
| 1977 | Tetanus neurotoxin | 208521 | chymotrypsin, trypsin |
| 1978 | Tetracycline repressor protein class d | 208522 | chymotrypsin |
| 1979 | The gdp-binding protein obg | 208523 | |
| 1980 | The gtp-binding protein obg | 208524 | |
| 1981 | The gtp-binding protein obg | 208525 | |

TABLE 12-continued

Proteins containing natural linker regions

| Linker No. | Name | SEQ ID NO | Protease cleavage site; linker core |
|---|---|---|---|
| 1982 | The gtp-binding protein obg | 208526 | trypsin |
| 1983 | Thioredoxin domain-containing protein 4 | 208527 | |
| 1984 | Thioredoxin domain-containing protein 4 | 208528 | trypsin |
| 1985 | Thiosulfate sulfurtransferase | — | |
| 1986 | Thiosulfate sulfurtransferase | 208529 | |
| 1987 | Thiosulfate sulfurtransferase | 208530 | chymotrypsin, trypsin |
| 1988 | Thiosulfate sulfurtransferase | 208531 | chymotrypsin, trypsin |
| 1989 | Thiosulfate sulfurtransferase | 208532 | chymotrypsin, trypsin |
| 1990 | Threonyl-trna synthetase | 208533 | |
| 1991 | Threonyl-trna synthetase | 208534 | trypsin |
| 1992 | Threonyl-trna synthetase | 208535 | trypsin |
| 1993 | Threonyl-trna synthetase | 208536 | trypsin |
| 1994 | Threonyl-trna synthetase | 208537 | |
| 1995 | Threonyl-trna synthetase | 208538 | |
| 1996 | Threonyl-trna synthetase | 208539 | chymotrypsin, trypsin |
| 1997 | Threonyl-trna synthetase | 208540 | trypsin |
| 1998 | Threonyl-trna synthetase | 208541 | |
| 1999 | Threonyl-trna synthetase 1 | 208542 | chymotrypsin |
| 2000 | Threonyl-trna synthetase 1 | 208543 | chymotrypsin |
| 2001 | Threonyl-trna synthetase 1 | 208544 | |
| 2002 | Threonyl-trna synthetase 1 | 208545 | trypsin |
| 2003 | Threonyl-trna synthetase 1 | 208546 | chymotrypsin |
| 2004 | Threonyl-trna synthetase 1 | 208547 | chymotrypsin |
| 2005 | Threonyl-trna synthetase 1 | 208548 | trypsin |
| 2006 | Threonyl-trna synthetase 1 | 208549 | chymotrypsin, trypsin |
| 2007 | Thrombospondin 1 | 208550 | chymotrypsin |
| 2008 | Tick-borne encephalitis virus glycoprotein | 208551 | chymotrypsin, trypsin |
| 2009 | Titin | 208552 | trypsin |
| 2010 | Titin | 208553 | trypsin |
| 2011 | Tlr1789 protein | 208554 | |
| 2012 | Tlr1789 protein | 208555 | trypsin |
| 2013 | Topoisomerase i | 208556 | chymotrypsin, trypsin |
| 2014 | Topoisomerase i | 208557 | trypsin |
| 2015 | Toxic shock syndrome toxin-1 | 208558 | |
| 2016 | Toxic shock syndrome toxin-1 | 208559 | |
| 2017 | Toxic shock syndrome toxin-1 | 208560 | |
| 2018 | Toxic shock syndrome toxin-1 | 208561 | chymotrypsin, trypsin |
| 2019 | T-plasminogen activator f1-g | — | |
| 2020 | T-plasminogen activator f1-g | 208562 | chymotrypsin, trypsin |
| 2021 | Tpsb transporter fhac | 208563 | |
| 2022 | Tpsb transporter fhac | 208564 | |
| 2023 | Tpsb transporter fhac | 208565 | chymotrypsin, trypsin |
| 2024 | Transcarbamylase | 208566 | chymotrypsin, trypsin |
| 2025 | Transcarbamylase | 208567 | chymotrypsin |
| 2026 | Transcription antiterminator lict | 208568 | |
| 2027 | Transcription elongation factor greb | 208569 | chymotrypsin, trypsin |
| 2028 | Transcription initiation factor iia gamma chain | 208570 | trypsin |
| 2029 | Transcription initiation factor iib | 208571 | chymotrypsin |
| 2030 | Transcription initiation factor iib | 208572 | |
| 2031 | Transcriptional regulator (ntrc family) | 208573 | chymotrypsin, trypsin |
| 2032 | Transcriptional regulator aefr | 208574 | |
| 2033 | Transcriptional regulator aefr | 208575 | |
| 2034 | Transcriptional regulator aefr | 208576 | trypsin |
| 2035 | Transcriptional regulator aefr | 208577 | trypsin |
| 2036 | Transcriptional regulator aefr | 208578 | chymotrypsin |
| 2037 | Transcriptional regulator, asnc family | 208579 | |
| 2038 | Transcriptional regulator, asnc family | 208580 | trypsin |
| 2039 | Transcriptional regulator, asnc family | 208581 | trypsin |
| 2040 | Transcriptional regulator, biotin repressor family | 208582 | trypsin |
| 2041 | Transcriptional regulator, crp/fnr family | 208583 | trypsin |
| 2042 | Transcriptional regulator, gntr family | 208584 | |
| 2043 | Transcriptional regulator, hth_3 family | 208585 | |
| 2044 | Transcriptional regulator, hth_3 family | 208586 | chymotrypsin |
| 2045 | Transcriptional regulator, hth_3 family | 208587 | |
| 2046 | Transcriptional regulator, hth_3 family | 208588 | |
| 2047 | Transcriptional regulator, hth_3 family | 208589 | trypsin |
| 2048 | Transcriptional regulator, laci family | 208590 | chymotrypsin, trypsin |
| 2049 | Transcriptional regulatory protein zrar | 208591 | |
| 2050 | Transcriptional regulatory protein zrar | 208592 | |
| 2051 | Transcriptional regulatory protein zrar | 208593 | trypsin |
| 2052 | Transcriptional regulatory protein zrar | 208594 | chymotrypsin |
| 2053 | Transcriptional regulatory protein zrar | 208595 | chymotrypsin |
| 2054 | Transcriptional regulatory protein zrar | 208596 | chymotrypsin, trypsin |
| 2055 | Transcriptional regulatory protein zrar | 208597 | chymotrypsin, trypsin |
| 2056 | Transferrin receptor protein | — | |

TABLE 12-continued

Proteins containing natural linker regions

| Linker No. | Name | SEQ ID NO | Protease cleavage site; linker core |
|---|---|---|---|
| 2057 | Transferrin receptor protein | 208598 | chymotrypsin |
| 2058 | Transferrin receptor protein | 208599 | |
| 2059 | Transferrin receptor protein | 208600 | trypsin |
| 2060 | Transferrin receptor protein | 208601 | chymotrypsin |
| 2061 | Translation initiation factor 5a | 208602 | |
| 2062 | Translation initiation factor 5a | 208603 | |
| 2063 | Translation initiation factor 5a | 208604 | chymotrypsin |
| 2064 | Translation initiation factor if2/eif5b | 208605 | chymotrypsin, trypsin |
| 2065 | Translation initiation factor if2/eif5b | 208606 | |
| 2066 | Transposable element mariner, complete cds | 208607 | chymotrypsin, trypsin |
| 2067 | Tricorn protease | 208608 | |
| 2068 | Tricorn protease | 208609 | trypsin |
| 2069 | Tricorn protease | 208610 | chymotrypsin, trypsin |
| 2070 | Trigger factor | 208611 | |
| 2071 | Trigger factor | 208612 | |
| 2072 | Trigger factor | 208613 | chymotrypsin, trypsin |
| 2073 | Trna cca-adding enzyme | — | trypsin |
| 2074 | Trna cca-adding enzyme | 208614 | chymotrypsin, trypsin |
| 2075 | Trna cca-adding enzyme | 208615 | |
| 2076 | Trna cca-adding enzyme | 208616 | trypsin |
| 2077 | Trna cca-adding enzyme | 208617 | chymotrypsin, trypsin |
| 2078 | Trna nucleotidyltransferase | 208618 | factor xa, trypsin |
| 2079 | Trna-splicing endonuclease | 208619 | trypsin |
| 2080 | Tt1467 protein | — | |
| 2081 | Tt1467 protein | 208620 | trypsin |
| 2082 | Tumor suppressor p53-binding protein 1 | 208621 | |
| 2083 | Tumor suppressor p53-binding protein 1 | 208622 | |
| 2084 | Tumor suppressor p53-binding protein 1 | 208623 | chymotrypsin |
| 2085 | Tumor suppressor p53-binding protein 1 | 208624 | chymotrypsin, trypsin |
| 2086 | Type a flavoprotein fpra | 208625 | trypsin |
| 2087 | Type a flavoprotein fpra | 208626 | chymotrypsin |
| 2088 | Type a flavoprotein fpra | 208627 | |
| 2089 | Type a flavoprotein fpra | 208628 | |
| 2090 | Type a flavoprotein fpra | 208629 | |
| 2091 | Type i restriction enzyme specificity protein mg438 | — | |
| 2092 | Type i restriction enzyme specificity protein mg438 | 208630 | chymotrypsin |
| 2093 | Type i restriction enzyme specificity protein mg438 | 208631 | chymotrypsin, trypsin |
| 2094 | Type i restriction-modification enzyme, s subunit | 208632 | |
| 2095 | Type i restriction-modification enzyme, s subunit | 208633 | trypsin |
| 2096 | Type i site-specific restriction-modificationsystem, r (restriction) subunit | 208634 | trypsin |
| 2097 | Type i site-specific restriction-modificationsystem, r (restriction) subunit | 208635 | trypsin |
| 2098 | Type i site-specific restriction-modificationsystem, r (restriction) subunit | 208636 | chymotrypsin, trypsin |
| 2099 | Type ii dna topoisomerase vi subunit b | 208637 | |
| 2100 | Type ii dna topoisomerase vi subunit b | 208638 | trypsin |
| 2101 | Type ii dna topoisomerase vi subunit b | 208639 | chymotrypsin |
| 2102 | Type ii dna topoisomerase vi subunit b | 208640 | chymotrypsin |
| 2103 | Type ii dna topoisomerase vi subunit b | 208641 | trypsin |
| 2104 | Type ii dna topoisomerase vi subunit b | 208642 | |
| 2105 | Type ii dna topoisomerase vi subunit b | 208643 | trypsin |
| 2106 | Type ii dna topoisomerase vi subunit b | 208644 | chymotrypsin, trypsin |
| 2107 | Type ii dna topoisomerase vi subunit b | 208645 | chymotrypsin, trypsin |
| 2108 | Type ii dna topoisomerase vi subunit b | 208646 | chymotrypsin, trypsin |
| 2109 | Type ii dna topoisomerase vi subunit b | 208647 | chymotrypsin, trypsin |
| 2110 | Type vi secretion system component | 208648 | chymotrypsin, trypsin |
| 2111 | Type vi secretion system component | 208649 | chymotrypsin, trypsin |
| 2112 | Type vi secretion system component | 208650 | chymotrypsin, thrombin, trypsin |
| 2113 | Tyrosine-protein kinase receptor ufo | 208651 | |
| 2114 | Tyrosine-protein kinase receptor ufo | 208652 | |
| 2115 | Tyrosine-protein kinase zap-70 | 208653 | |
| 2116 | Tyrosine-protein kinase zap-70 | 208654 | chymotrypsin, trypsin |
| 2117 | Tyrosyl-dna phosphodiesterase | 208655 | chymotrypsin |
| 2118 | Tyrosyl-dna phosphodiesterase | 208656 | trypsin |
| 2119 | Ubiquitin carboxyl-terminal hydrolase 7 | 208657 | |
| 2120 | Udp-galactopyranose mutase | 208658 | chymotrypsin, trypsin |
| 2121 | Udp-galactopyranose mutase | 208659 | chymotrypsin |
| 2122 | Udp-galactopyranose mutase | 208660 | chymotrypsin, trypsin |
| 2123 | Udp-galactopyranose mutase | 208661 | chymotrypsin, trypsin |
| 2124 | Udp-galactopyranose mutase | 208662 | chymotrypsin, trypsin |
| 2125 | Udp-glucose dehydrogenase | 208663 | trypsin |
| 2126 | Udp-n-acetylmuramate-l-alanine ligase | 208664 | |
| 2127 | Udp-n-acetylmuramate-l-alanine ligase | 208665 | chymotrypsin, trypsin |
| 2128 | Udp-n-acetylmuramoylalanine--d-glutamate ligase | 208666 | |
| 2129 | Udp-n-acetylmuramoylalanine--d-glutamate ligase | 208667 | chymotrypsin, trypsin |
| 2130 | Udp-n-acetylmuramoylalanine-d-glutamyl-lysine-d-alanyl-d-alanine ligase, murf protein | 208668 | |

TABLE 12-continued

Proteins containing natural linker regions

| Linker No. | Name | SEQ ID NO | Protease cleavage site; linker core |
|---|---|---|---|
| 2131 | Udp-n-acetylmuramoylalanyl-d-glutamate--2,6-diaminopimelate ligase | 208669 | |
| 2132 | Udp-n-acetylmuramoylalanyl-d-glutamate--2,6-diaminopimelate ligase | 208670 | chymotrypsin |
| 2133 | Udp-n-acetylmuramoylalanyl-d-glutamate--2,6-diaminopimelate ligase | 208671 | |
| 2134 | Udp-n-acetylmuramoylalanyl-d-glutamate--2,6-diaminopimelate ligase | 208672 | |
| 2135 | Udp-n-acetylmuramoylalanyl-d-glutamate--2,6-diaminopimelate ligase | 208673 | |
| 2136 | Udp-n-acetylmuramoylalanyl-d-glutamate--2,6-diaminopimelate ligase | 208674 | |
| 2137 | Udp-n-acetylmuramoylalanyl-d-glutamate--2,6-diaminopimelate ligase | 208675 | trypsin |
| 2138 | Uncharacterized conserved protein | 208676 | trypsin |
| 2139 | Uncharacterized conserved protein | 208677 | chymotrypsin, trypsin |
| 2140 | Uncharacterized gst-like protein yfcf | 208678 | chymotrypsin, trypsin |
| 2141 | Uncharacterized gst-like proteinprotein | 208679 | chymotrypsin |
| 2142 | Uncharacterized gst-like proteinprotein | 208680 | chymotrypsin, trypsin |
| 2143 | Uncharacterized gst-like proteinprotein | 208681 | chymotrypsin, trypsin |
| 2144 | Uncharacterized protein | 208682 | trypsin |
| 2145 | Uncharacterized protein | 208683 | trypsin |
| 2146 | Uncharacterized protein bt_1490 | 208684 | chymotrypsin, trypsin |
| 2147 | Uncharacterized protein ypfi | — | |
| 2148 | Uncharacterized protein ypfi | — | |
| 2149 | Uncharacterized protein ypfi | 208685 | chymotrypsin |
| 2150 | Uncharacterized protein ypfi | 208686 | |
| 2151 | Uncharacterized protein ypfi | 208687 | |
| 2152 | Uncharacterized protein ypfi | 208688 | |
| 2153 | Uncharacterized protein ypfi | 208689 | chymotrypsin |
| 2154 | Uncharacterized protein ypfi | 208690 | |
| 2155 | Uncharacterized protein ypfi | 208691 | |
| 2156 | Uncharacterized protein ypfi | 208692 | chymotrypsin, trypsin |
| 2157 | Uncharacterized protein ypfi | 208693 | trypsin |
| 2158 | Uncharacterized protein ypfi | 208694 | |
| 2159 | Uncharacterized protein ypfi | 208695 | chymotrypsin, trypsin |
| 2160 | Uncharacterized protein ypfi | 208696 | chymotrypsin |
| 2161 | Uncharacterized protein ypfi | 208697 | chymotrypsin, trypsin |
| 2162 | Uncharacterized protein ypfi | 208698 | chymotrypsin, trypsin |
| 2163 | Uncharacterized protein ypfi | 208699 | chymotrypsin |
| 2164 | Unknown protein | 208700 | chymotrypsin |
| 2165 | Unknown protein | 208701 | trypsin |
| 2166 | Upf0131 protein ykqa | 208702 | trypsin |
| 2167 | Upf0131 protein ykqa | 208703 | trypsin |
| 2168 | Upf0131 protein ykqa | 208704 | chymotrypsin, trypsin |
| 2169 | Upf0348 protein mj0951 | 208705 | |
| 2170 | Upf0348 protein mj0951 | 208706 | chymotrypsin |
| 2171 | Upf0348 protein mj0951 | 208707 | |
| 2172 | Upf0348 protein mj0951 | 208708 | |
| 2173 | Upf0348 protein mj0951 | 208709 | chymotrypsin |
| 2174 | Upf0348 protein mj0951 | 208710 | trypsin |
| 2175 | Upf0348 protein mj0951 | 208711 | chymotrypsin, trypsin |
| 2176 | Upf0348 protein mj0951 | 208712 | |
| 2177 | Ure2 protein | 208713 | chymotrypsin |
| 2178 | Uridine diphospho-n-acetylenolpyruvylglucosaminereductase | — | |
| 2179 | Uridine diphospho-n-acetylenolpyruvylglucosaminereductase | 208714 | chymotrypsin, trypsin |
| 2180 | Uridine diphospho-n-acetylenolpyruvylglucosaminereductase | 208715 | chymotrypsin, trypsin |
| 2181 | Uridine diphospho-n-acetylenolpyruvylglucosaminereductase | 208716 | trypsin |
| 2182 | Uridine diphospho-n-acetylenolpyruvylglucosaminereductase | 208717 | chymotrypsin, trypsin |
| 2183 | Urokinase plasminogen activator surface receptor | 208718 | trypsin |
| 2184 | Urokinase plasminogen activator surface receptor | 208719 | chymotrypsin, trypsin |
| 2185 | Vascular cell adhesion molecule-1 | 208720 | trypsin |
| 2186 | Vcp-like atpase | 208721 | trypsin |
| 2187 | Vcp-like atpase | 208722 | chymotrypsin, trypsin |
| 2188 | Viral casp8 and fadd-like apoptosis regulator | 208723 | chymotrypsin |
| 2189 | Vitamin k-dependent protein z | 208724 | chymotrypsin, trypsin |
| 2190 | Vp1 protein | 208725 | trypsin |
| 2191 | V-type atp synthase alpha chain | 208726 | |
| 2192 | Xaa-pro aminopeptidase | 208727 | chymotrypsin |
| 2193 | Xaa-pro aminopeptidase | 208728 | trypsin |
| 2194 | Xaa-pro aminopeptidase | 208729 | chymotrypsin, trypsin |
| 2195 | Xaa-pro aminopeptidase | 208730 | |
| 2196 | Xanthine dehydrogenase | 208731 | chymotrypsin |
| 2197 | Xanthine dehydrogenase | 208732 | chymotrypsin |
| 2198 | Xanthine dehydrogenase | 208733 | trypsin |
| 2199 | Xanthine dehydrogenase | 208734 | chymotrypsin |
| 2200 | X-prolyl dipeptidyl aminopetidase | — | trypsin |
| 2201 | X-prolyl dipeptidyl aminopetidase | — | |
| 2202 | X-prolyl dipeptidyl aminopetidase | — | |
| 2203 | X-prolyl dipeptidyl aminopetidase | — | chymotrypsin |
| 2204 | X-prolyl dipeptidyl aminopetidase | 208735 | chymotrypsin |
| 2205 | X-prolyl dipeptidyl aminopetidase | 208736 | trypsin |

TABLE 12-continued

Proteins containing natural linker regions

| Linker No. | Name | SEQ ID NO | Protease cleavage site; linker core |
|---|---|---|---|
| 2206 | X-prolyl dipeptidyl aminopetidase | 208737 | trypsin |
| 2207 | X-prolyl dipeptidyl aminopetidase | 208738 | |
| 2208 | X-prolyl dipeptidyl aminopetidase | 208739 | chymotrypsin, trypsin |
| 2209 | X-prolyl dipeptidyl aminopetidase | 208740 | chymotrypsin, trypsin |
| 2210 | X-prolyl dipeptidyl aminopetidase | 208741 | trypsin |
| 2211 | X-prolyl dipeptidyl aminopetidase | 208742 | chymotrypsin |
| 2212 | X-prolyl dipeptidyl aminopetidase | 208743 | |
| 2213 | X-prolyl dipeptidyl aminopetidase | 208744 | |
| 2214 | X-prolyl dipeptidyl aminopetidase | 208745 | trypsin |
| 2215 | X-prolyl dipeptidyl aminopetidase | 208746 | chymotrypsin, trypsin |
| 2216 | X-prolyl dipeptidyl aminopetidase | 208747 | chymotrypsin |
| 2217 | X-prolyl dipeptidyl aminopetidase | 208748 | chymotrypsin |
| 2218 | X-prolyl dipeptidyl aminopetidase | 208749 | chymotrypsin, trypsin |
| 2219 | X-prolyl dipeptidyl aminopetidase | 208750 | trypsin |
| 2220 | X-prolyl dipeptidyl aminopetidase | 208751 | chymotrypsin |
| 2221 | X-prolyl dipeptidyl aminopetidase | 208752 | trypsin |
| 2222 | X-prolyl dipeptidyl aminopetidase | 208753 | trypsin |
| 2223 | X-prolyl dipeptidyl aminopetidase | 208754 | chymotrypsin, trypsin |
| 2224 | X-prolyl dipeptidyl aminopetidase | 208755 | chymotrypsin, trypsin |
| 2225 | X-prolyl dipeptidyl aminopetidase | 208756 | trypsin |
| 2226 | X-prolyl dipeptidyl aminopetidase | 208757 | chymotrypsin, trypsin |
| 2227 | X-prolyl dipeptidyl aminopetidase | 208758 | trypsin |
| 2228 | Xylosidase/arabinosidase | 208759 | chymotrypsin, trypsin |
| 2229 | Xylosidase/arabinosidase | 208760 | chymotrypsin |
| 2230 | Xylosidase/arabinosidase | 208761 | chymotrypsin, trypsin |
| 2231 | Xylosidase/arabinosidase | 208762 | |
| 2232 | Xylosidase/arabinosidase | 208763 | chymotrypsin |
| 2233 | Xylosidase/arabinosidase | 208764 | chymotrypsin, trypsin |
| 2234 | Xylosidase/arabinosidase | 208765 | chymotrypsin |
| 2235 | Ykof | 208766 | chymotrypsin, trypsin |

Embedded Stimulus, Signals or Other Regulatory Moieties
microRNA microRNAs (or miRNA) are 19-25 nucleotide long non-coding RNAs that bind to the 3'UTR of nucleic acid molecules and down-regulate gene expression either by reducing nucleic acid molecule stability or by inhibiting translation. The polynucleotides of the invention may comprise one or more microRNA target sequences, microRNA sequences, or microRNA seeds. Such sequences may correspond to any known microRNA such as those taught in US Publication US2005/0261218 and US Publication US2005/0059005, the contents of which are incorporated herein by reference in their entirety. As a non-limiting embodiment, known microRNAs, their sequences and their binding site sequences in the human genome are listed below in Table 13.

A microRNA sequence comprises a "seed" region, i.e., a sequence in the region of positions 2-8 of the mature microRNA, which sequence has perfect Watson-Crick complementarity to the miRNA target sequence. A microRNA seed may comprise positions 2-8 or 2-7 of the mature microRNA. In some embodiments, a microRNA seed may comprise 7 nucleotides (e.g., nucleotides 2-8 of the mature microRNA), wherein the seed-complementary site in the corresponding miRNA target is flanked by an adenine (A) opposed to microRNA position 1. In some embodiments, a microRNA seed may comprise 6 nucleotides (e.g., nucleotides 2-7 of the mature microRNA), wherein the seed-complementary site in the corresponding miRNA target is flanked by an adenine (A) opposed to microRNA position 1. See for example, Grimson A, Farh K K, Johnston W K, Garrett-Engele P, Lim L P, Bartel D P; Mol Cell. 2007 Jul. 6; 27(1):91-105. The bases of the microRNA seed have complete complementarity with the target sequence. By engineering microRNA target sequences into the polynucle-otides encoding the biocircuit components, effector modules, SREs or payloads of the invention one can target the molecule for degradation or reduced translation, provided the microRNA in question is available. This process will reduce the hazard of off target effects upon nucleic acid molecule delivery.

Identification of microRNA, microRNA target regions, and their expression patterns and role in biology have been reported (Bonauer et al., Curr Drug Targets 2010 11:943-949; Anand and Cheresh Curr Opin Hematol 2011 18:171-176; Contreras and Rao Leukemia 2012 26:404-413 (2011 Dec. 20. doi: 10.1038/leu.2011.356); Bartel Cell 2009 136: 215-233; Landgraf et al, Cell, 2007 129:1401-1414; Gentner and Naldini, Tissue Antigens. 2012 80:393-403 and all references therein; each of which is herein incorporated by reference in its entirety).

For example, if the polynucleotide is not intended to be delivered to the liver but ends up there, then miR-122, a microRNA abundant in liver, can inhibit the expression of the polynucleotide if one or multiple target sites of miR-122 are engineered into the polynucleotide. Introduction of one or multiple binding sites for different microRNA can be engineered to further decrease the longevity, stability, and protein translation of a polynucleotide hence providing an additional layer of tenability beyond the stimulus selection, SRE design and payload variation.

As used herein, the term "microRNA site" refers to a microRNA target site or a microRNA recognition site, or any nucleotide sequence to which a microRNA binds or associates. It should be understood that "binding" may follow traditional Watson-Crick hybridization rules or may reflect any stable association of the microRNA with the target sequence at or adjacent to the microRNA site.

Conversely, for the purposes of the polynucleotides of the present invention, microRNA binding sites can be engineered out of (i.e. removed from) sequences in which they naturally occur in order to increase protein expression in specific tissues. For example, miR-122 binding sites may be removed to improve protein expression in the liver.

Regulation of expression in multiple tissues can be accomplished through introduction or removal or one or several microRNA binding sites.

Specifically, microRNAs are known to be differentially expressed in immune cells (also called hematopoietic cells), such as antigen presenting cells (APCs) (e.g. dendritic cells and macrophages), macrophages, monocytes, B lymphocytes, T lymphocytes, granulocytes, natural killer cells, etc. Immune cell specific microRNAs are involved in immunogenicity, autoimmunity, the immune-response to infection, inflammation, as well as unwanted immune response after gene therapy and tissue/organ transplantation. Immune cells specific microRNAs also regulate many aspects of development, proliferation, differentiation and apoptosis of hematopoietic cells (immune cells). For example, miR-142 and miR-146 are exclusively expressed in the immune cells, particularly abundant in myeloid dendritic cells. Introducing the miR-142 binding site into the 3'-UTR of a polypeptide of the present invention can selectively suppress the gene expression in the antigen presenting cells through miR-142 mediated mRNA degradation, limiting antigen presentation in professional APCs (e.g. dendritic cells) and thereby preventing antigen-mediated immune response after gene delivery (see, Annoni A et al., blood, 2009, 114, 5152-5161, the content of which is herein incorporated by reference in its entirety.)

In one embodiment, microRNAs binding sites that are known to be expressed in immune cells, in particular, the antigen presenting cells, can be engineered into the polynucleotides to suppress the expression of the polynucleotide in APCs through microRNA mediated RNA degradation, subduing the antigen-mediated immune response, while the expression of the polynucleotide is maintained in non-immune cells where the immune cell specific microRNAs are not expressed.

Many microRNA expression studies have been conducted, and are described in the art, to profile the differential expression of microRNAs in various cancer cells/tissues and other diseases. Some microRNAs are abnormally over-expressed in certain cancer cells and others are under-expressed. For example, microRNAs are differentially expressed in cancer cells (WO2008/154098, US2013/0059015, US2013/0042333, WO2011/157294); cancer stem cells (US2012/0053224); pancreatic cancers and diseases (US2009/0131348, US2011/0171646, US2010/0286232, U.S. Pat. No. 8,389,210); asthma and inflammation (U.S. Pat. No. 8,415,096); prostate cancer (US2013/0053264); hepatocellular carcinoma (WO2012/151212, US2012/0329672, WO2008/054828, U.S. Pat. No. 8,252,538); lung cancer cells (WO2011/076143, WO2013/033640, WO2009/070653, US2010/0323357); cutaneous T cell lymphoma (WO2013/011378); colorectal cancer cells (WO2011/0281756, WO2011/076142); cancer positive lymph nodes (WO2009/100430, US2009/0263803); nasopharyngeal carcinoma (EP2112235); chronic obstructive pulmonary disease (US2012/0264626, US2013/0053263); thyroid cancer (WO2013/066678); ovarian cancer cells (US2012/0309645, WO2011/095623); breast cancer cells (WO2008/154098, WO2007/081740, US2012/0214699), leukemia and lymphoma (WO2008/073915, US2009/0092974, US2012/0316081, US2012/0283310, WO2010/018563, the content of each of which is incorporated herein by reference in their entirety).

In one embodiment, microRNA may be used as described herein in support of the creation of tunable biocircuits.

In some embodiments, effector modules may be designed to encode (as a DNA or RNA or mRNA) one or more payloads, SREs and/or regulatory sequence such as a microRNA or microRNA binding site. In some embodiments, any of the encoded payloads or SREs may be stabilized or de-stabilized by mutation and then combined with one or more regulatory sequences to generate a dual or multi-tuned effector module or biocircuit system.

Each aspect or tuned modality may bring to the effector module or biocircuit a differentially tuned feature. For example, an SRE may represent a destabilizing domain, while mutations in the protein payload may alter its cleavage sites or dimerization properties or half-life and the inclusion of one or more microRNA or microRNA binding site may impart cellular detargeting or trafficking features. Consequently, the present invention embraces biocircuits which are multifactorial in their tenability.

Such biocircuits may be engineered to contain one, two, three, four or more tuned features.

Figure 19A:
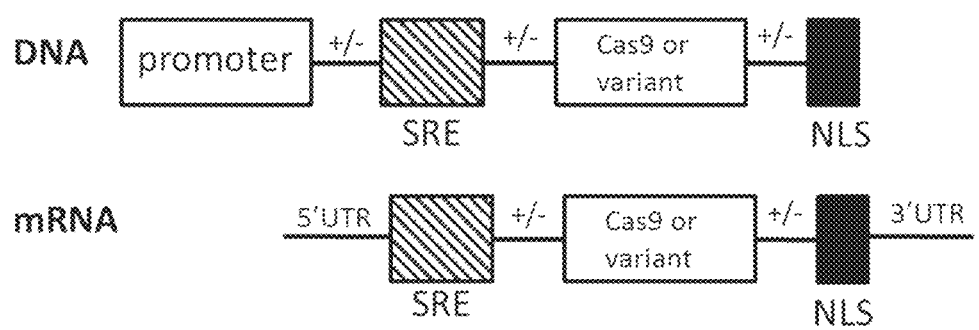
FIG. 19 shows representative effector modules having Cas9 or variant Cas9 as the payload and a nuclear localization signal (NLS) without a miR binding site (miR BS) (FIG. 19A) or with a miR binding site (FIG. 19B).
Figure 19B:
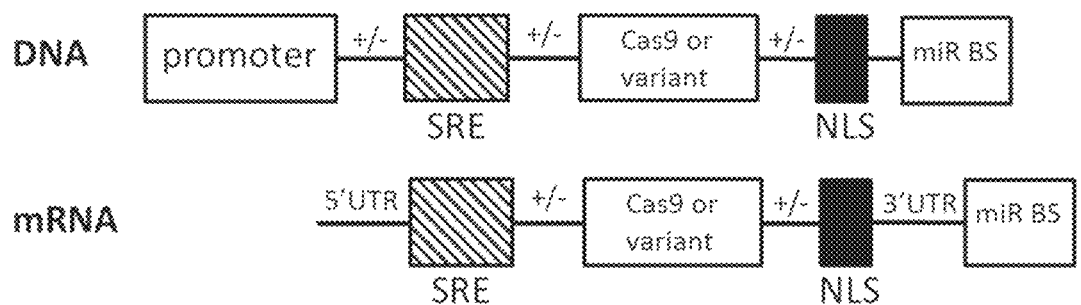

Shown in FIG. 19B, for example is a multi-tuned effector module having such a microRNA feature.

TABLE 13 microRNA Sequences

| microRNA name | miR SEQ ID | miR BS SEQ ID | Types of Tissues and/or Cells |
|---|---|---|---|
| hsa-miR-1 | 208768 | 210810 | Heart and muscle |
| hsa-miR-10a-3p | 208769 | 210811 | Hematopoietic cells |
| hsa-miR-10a-5p | 208770 | 210812 | Hematopoietic cells |
| hsa-miR-10b-3p | 208771 | 210813 | Variety of tissues and cells |
| hsa-miR-10b-5p | 208772 | 210814 | Variety of tissues and cells |
| hsa-miR-15a-3p | 208773 | 210815 | Lymphocyte, blood, hematopoietic tissues (spleen) |
| hsa-miR-15a-5p | 208774 | 210816 | Lymphocyte, blood, hematopoietic tissues (spleen) |
| hsa-miR-15b-3p | 208775 | 210817 | Lymphocyte, blood, hematopoietic tissues (spleen) |
| hsa-miR-15b-5p | 208776 | 210818 | Lymphocyte, blood, hematopoietic tissues (spleen) |
| hsa-miR-16-1-3p | 208777 | 210819 | Blood, embryonic stem cells, hematopoietic tissues (spleen) |
| hsa-miR-16-2-3p | 208778 | 210820 | Lymphocyte, blood, hematopoietic tissues (spleen) |
| hsa-miR-16-5p | 208779 | 210821 | Variety of tissues, blood |
| hsa-miR-17-3p | 208780 | 210822 | Endothelial cells, embryonic stem cells |
| hsa-miR-17-5p | 208781 | 210823 | Kidney, breast and endothelial cells |
| hsa-miR-18a-3p | 208782 | 210824 | Lung and endothelial cells |
| hsa-miR-18a-5p | 208783 | 210825 | Lung and endothelial cells |
| hsa-miR-18b-3p | 208784 | 210826 | Lung |
| hsa-miR-18b-5p | 208785 | 210827 | Lung |
| hsa-miR-19a-3p | 208786 | 210828 | Endothelial cells |

TABLE 13-continued microRNA Sequences

| microRNA name | miR SEQ ID | miR BS SEQ ID | Types of Tissues and/or Cells |
|---|---|---|---|
| hsa-miR-19a-5p | 208787 | 210829 | Endothelial cells |
| hsa-miR-19b-1-5p | 208788 | 210830 | Endothelial cells |
| hsa-miR-19b-2-5p | 208789 | 210831 | Endothelial cells |
| hsa-miR-19b-3p | 208790 | 210832 | Endothelial cells |
| hsa-miR-20a-3p | 208791 | 210833 | Kidney, endothelial cells, osteogenic cells |
| hsa-miR-20a-5p | 208792 | 210834 | Kidney, endothelial cells, osteogenic cells |
| hsa-miR-20b-3p | 208793 | 210835 | Osteogenic cells |
| hsa-miR-20b-5p | 208794 | 210836 | Osteogenic cells |
| hsa-miR-21-3p | 208795 | 210837 | Blood (myeloid cells), glioblast, liver, vascular endothelial cells |
| hsa-miR-21-5p | 208796 | 210838 | Blood (myeloid cells), liver, endothelial cells |
| hsa-miR-22-3p | 208797 | 210839 | Variety of cells and tissues |
| hsa-miR-22-5p | 208798 | 210840 | Variety of cells and tissues |
| hsa-miR-23a-3p | 208799 | 210841 | Endothelial cells, brain(astrocyte), blood(erythroid) |
| hsa-miR-23a-5p | 208800 | 210842 | Endothelial cells, brain(astrocyte), blood(erythroid) |
| hsa-miR-23b-3p | 208801 | 210843 | Myeloid cells and blood |
| hsa-miR-23b-5p | 208802 | 210844 | Myeloid cells and blood |
| hsa-miR-23c | 208803 | 210845 | |
| hsa-miR-24-1-5p | 208804 | 210846 | Myeloid cells and lung |
| hsa-miR-24-2-5p | 208805 | 210847 | Myeloid cells and lung |
| hsa-miR-24-3p | 208806 | 210848 | Myeloid cells and lung |
| hsa-miR-25-3p | 208807 | 210849 | Embryonic stem cells, airway smooth muscle |
| hsa-miR-25-5p | 208808 | 210850 | Embryonic stem cells, airway smooth muscle |
| hsa-miR-26a-1-3p | 208809 | 210851 | Embryonic stem cells, Blood and other tissues |
| hsa-miR-26a-2-3p | 208810 | 210852 | Blood and other tissues |
| hsa-miR-26a-5p | 208811 | 210853 | Blood and other tissues |
| hsa-miR-26b-3p | 208812 | 210854 | Hematopoietic cells |
| hsa-miR-26b-5p | 208813 | 210855 | Hematopoietic cells |
| hsa-miR-27a-3p | 208814 | 210856 | Myeloid cells |
| hsa-miR-27a-5p | 208815 | 210857 | Myeloid cells |
| hsa-miR-27b-3p | 208816 | 210858 | Myeloid cells and vascular endothelial cells |
| hsa-miR-27b-5p | 208817 | 210859 | Myeloid cells and vascular endothelial cells |
| hsa-miR-28-3p | 208818 | 210860 | Blood (immune cells) |
| hsa-miR-28-5p | 208819 | 210861 | Blood (immune cells) |
| hsa-miR-29a-3p | 208820 | 210862 | Immune system |
| hsa-miR-29a-5p | 208821 | 210863 | Immune system |
| hsa-miR-29b-1-5p | 208822 | 210864 | Immune system |
| hsa-miR-29b-2-5p | 208823 | 210865 | Immune system |
| hsa-miR-29b-3p | 208824 | 210866 | Immune system |
| hsa-miR-29c-3p | 208825 | 210867 | Immune system |
| hsa-miR-29c-5p | 208826 | 210868 | Immune system |
| hsa-miR-30a-3p | 208827 | 210869 | Kidney and pancreatic cells |
| hsa-miR-30a-5p | 208828 | 210870 | CNS (prefrontal cortex), other tissues |
| hsa-miR-30b-3p | 208829 | 210871 | Kidney, adipose, CNS (prefrontal cortex) |
| hsa-miR-30b-5p | 208830 | 210872 | Kidney, adipose, CNS (prefrontal cortex) |
| hsa-miR-30c-1-3p | 208831 | 210873 | Kidney, adipose, CNS (prefrontal cortex) |
| hsa-miR-30c-2-3p | 208832 | 210874 | Kidney, adipose, CNS (prefrontal cortex) |
| hsa-miR-30c-5p | 208833 | 210875 | Kidney, adipose, CNS (prefrontal cortex) |
| hsa-miR-30d-3p | 208834 | 210876 | CNS (prefrontal cortex) |
| hsa-miR-30d-5p | 208835 | 210877 | CNS (prefrontal cortex, embryoid body cells |
| hsa-miR-30e-3p | 208836 | 210878 | Myeloid cells and glia cells |
| hsa-miR-30e-5p | 208837 | 210879 | Myeloid cell and glia cells |
| hsa-miR-31-3p | 208838 | 210880 | |
| hsa-miR-31-5p | 208839 | 210881 | |
| hsa-miR-32-3p | 208840 | 210882 | Blood and glia |
| hsa-miR-32-5p | 208841 | 210883 | Blood and glia |
| hsa-miR-34a-3p | 208842 | 210884 | Breast, myeloid cells, ciliated epithelial cells |
| hsa-miR-34a-5p | 208843 | 210885 | Breast, myeloid cells, ciliated epithelial cells |
| hsa-miR-34b-3p | 208844 | 210886 | Ciliated epithelial cells |
| hsa-miR-34b-5p | 208845 | 210887 | Ciliated epithelial cells |
| hsa-miR-34c-3p | 208846 | 210888 | Ciliated epithelial cells, placenta |
| hsa-miR-34c-5p | 208847 | 210889 | Ciliated epithelial cells, placenta |
| hsa-miR-7-1-3p | 208848 | 210890 | Glioblast, brain, pancreas |
| hsa-miR-7-2-3p | 208849 | 210891 | Brain and pancreas |
| hsa-miR-7-5p | 208850 | 210892 | Brain |
| hsa-miR-92a-1-5p | 208851 | 210893 | Endothelial cells |
| hsa-miR-92a-2-5p | 208852 | 210894 | Endothelial cells |
| hsa-miR-92a-3p | 208853 | 210895 | Endothelial cells and CNS |
| hsa-miR-92b-3p | 208854 | 210896 | Endothelial cells and heart |
| hsa-miR-92b-5p | 208855 | 210897 | Endothelial cells and heart |
| hsa-miR-93-3p | 208856 | 210898 | Embryonic stem cells |
| hsa-miR-93-5p | 208857 | 210899 | Embryonic stem cells |
| hsa-miR-9-3p | 208858 | 210900 | Brain |
| hsa-miR-95 | 208859 | 210901 | |
| hsa-miR-9-5p | 208860 | 210902 | Brain |
| hsa-miR-96-3p | 208861 | 210903 | Stem cells |
| hsa-miR-96-5p | 208862 | 210904 | Stem cells |

TABLE 13-continued microRNA Sequences

| microRNA name | miR SEQ ID | miR BS SEQ ID | Types of Tissues and/or Cells |
|---|---|---|---|
| hsa-miR-98-3p | 208863 | 210905 | |
| hsa-miR-98-5p | 208864 | 210906 | |
| hsa-miR-99a-3p | 208865 | 210907 | Hematopoietic cells |
| hsa-miR-99a-5p | 208866 | 210908 | Hematopoietic cells |
| hsa-miR-99b-3p | 208867 | 210909 | Hematopoietic cells and embryonic stem cells |
| hsa-miR-99b-5p | 208868 | 210910 | Hematopoietic cells and embryonic stem cells |
| hsa-miR-100-3p | 208869 | 210911 | Hematopoietic cells, endothelial cells |
| hsa-miR-100-5p | 208870 | 210912 | Hematopoietic cells and endothelial cells |
| hsa-miR-101-3p | 208871 | 210913 | Endothelial cells |
| hsa-miR-101-5p | 208872 | 210914 | Endothelial cells |
| hsa-miR-103a-2-5p | 208873 | 210915 | Embryonic stem cells and a variety of cells and tissues |
| hsa-miR-103a-3p | 208874 | 210916 | Embryonic stem cells and a variety of cells and tissues |
| hsa-miR-103b | 208875 | 210917 | Variety of cells and tissues |
| hsa-miR-105-3p | 208876 | 210918 | Pancreatic cells |
| hsa-miR-105-5p | 208877 | 210919 | Pancreatic cells |
| hsa-miR-106a-3p | 208878 | 210920 | Osteogenic cells |
| hsa-miR-106a-5p | 208879 | 210921 | Osteogenic cells |
| hsa-miR-106b-3p | 208880 | 210922 | Embryonic stem cells |
| hsa-miR-106b-5p | 208881 | 210923 | Embryonic stem cells |
| hsa-miR-107 | 208882 | 210924 | Many tissues and brain hepatocytes/liver |
| hsa-miR-122-3p | 208883 | 210925 | Kidney and liver/hepatocytes |
| hsa-miR-122-5p | 208884 | 210926 | Liver/hepatocytes |
| hsa-miR-124-3p | 208885 | 210927 | Brain and plasma (exosomal) |
| hsa-miR-124-5p | 208886 | 210928 | Brain and plasma (circulating) |
| hsa-miR-125a-3p | 208887 | 210929 | Brain and hematopoietic cells |
| hsa-miR-125a-5p | 208888 | 210930 | Brain and hematopoietic cells |
| hsa-miR-125b-1-3p | 208889 | 210931 | Hematopoietic cells (monocytes), brain(neuron) |
| hsa-miR-125b-2-3p | 208890 | 210932 | Hematopoietic cells (monocytes), brain(neuron) |
| hsa-miR-125b-5p | 208891 | 210933 | Hematopoietic cells, brain (neuron) |
| hsa-miR-126-3p | 208892 | 210934 | Endothelial cells, lung |
| hsa-miR-126-5p | 208893 | 210935 | Endothelial cells, lung |
| hsa-miR-127-3p | 208894 | 210936 | Lung, placenta |
| hsa-miR-127-5p | 208895 | 210937 | Lung, placenta(islet) |
| hsa-miR-128 | 208896 | 210938 | Glioblast, brain |
| hsa-miR-129-1-3p | 208897 | 210939 | Multiple cell types |
| hsa-miR-129-2-3p | 208898 | 210940 | Multiple cell types |
| hsa-miR-129-5p | 208899 | 210941 | Liver(hepatocytes) |
| hsa-miR-130a-3p | 208900 | 210942 | Lung, monocytes, vascular endothelial cells |
| hsa-miR-130a-5p | 208901 | 210943 | Lung, monocytes, vascular endothelial cells |
| hsa-miR-130b-3p | 208902 | 210944 | Lung, epidermal cells(keratinocytes) |
| hsa-miR-130b-5p | 208903 | 210945 | Lung, epidermal cells(keratinocytes) |
| hsa-miR-132-3p | 208904 | 210946 | Brain(neuron), immune cells |
| hsa-miR-132-5p | 208905 | 210947 | Brain(neuron), immune cells |
| hsa-miR-133a | 208906 | 210948 | Muscle, heart, epithelial cells (lung) |
| hsa-miR-133b | 208907 | 210949 | Muscle, heart, epithelial cells (lung) |
| hsa-miR-134 | 208908 | 210950 | Lung (epithelial) |
| hsa-miR-135a-3p | 208909 | 210951 | Brain, other tissues |
| hsa-miR-135a-5p | 208910 | 210952 | Brain, other tissues |
| hsa-miR-135b-3p | 208911 | 210953 | Brain, placenta, other tissues |
| hsa-miR-135b-5p | 208912 | 210954 | Brain, placenta, other tissues |
| hsa-miR-136-3p | 208913 | 210955 | Stem cells, placenta |
| hsa-miR-136-5p | 208914 | 210956 | Stem cells, placenta |
| hsa-miR-137 | 208915 | 210957 | Brain |
| hsa-miR-138-1-3p | 208916 | 210958 | Stem cells, epidermal cells (keratinocytes) |
| hsa-miR-138-2-3p | 208917 | 210959 | Stem cells |
| hsa-miR-138-5p | 208918 | 210960 | Stem cells |
| hsa-miR-139-3p | 208919 | 210961 | Hematocytes, brain |
| hsa-miR-139-5p | 208920 | 210962 | Hematocytes, brain |
| hsa-miR-140-3p | 208921 | 210963 | Airway smooth muscle |
| hsa-miR-140-5p | 208922 | 210964 | Cartilage (chondrocytes) |
| hsa-miR-141-3p | 208923 | 210965 | Variety of cells and tissues |
| hsa-miR-141-5p | 208924 | 210966 | Variety of cells and tissues |
| hsa-miR-142-3p | 208925 | 210967 | Myeloid cells, hematopoiesis, APC cells |
| hsa-miR-142-5p | 208926 | 210968 | Myeloid cells, hematopoiesis, APC cells |
| hsa-miR-143-3p | 208927 | 210969 | Vascular smooth muscle |
| hsa-miR-143-5p | 208928 | 210970 | Vascular smooth muscle, T-cells |
| hsa-miR-144-3p | 208929 | 210971 | Erythroid |
| hsa-miR-144-5p | 208930 | 210972 | Erythroid |
| hsa-miR-145-3p | 208931 | 210973 | Kidney, cartilage, vascular smooth muscle |
| hsa-miR-145-5p | 208932 | 210974 | Kidney, cartilage, vascular smooth muscle |
| hsa-miR-146a-3p | 208933 | 210975 | Immune cells, hematopoiesis |
| hsa-miR-146a-5p | 208934 | 210976 | Immune cells, hematopoiesis |
| hsa-miR-146b-3p | 208935 | 210977 | Immune cells |
| hsa-miR-146b-5p | 208936 | 210978 | Embryonic stem cells |
| hsa-miR-147a | 208937 | 210979 | Macrophage |
| hsa-miR-147b | 208938 | 210980 | Macrophage |

TABLE 13-continued microRNA Sequences

| microRNA name | miR SEQ ID | miR BS SEQ ID | Types of Tissues and/or Cells |
|---|---|---|---|
| hsa-miR-148a-3p | 208939 | 210981 | Hematopoietic cells |
| hsa-miR-148a-5p | 208940 | 210982 | Hematopoietic cells |
| hsa-miR-148b-3p | 208941 | 210983 | Neuron |
| hsa-miR-148b-5p | 208942 | 210984 | Neuron |
| hsa-miR-149-3p | 208943 | 210985 | Heart and brain |
| hsa-miR-149-5p | 208944 | 210986 | Heart and brain |
| hsa-miR-150-3p | 208945 | 210987 | Hematopoietic cells (lymphoid) |
| hsa-miR-150-5p | 208946 | 210988 | Hematopoietic cells (lymphoid) |
| hsa-miR-151a-3p | 208947 | 210989 | Neuron, fetal liver |
| hsa-miR-151a-5p | 208948 | 210990 | Neuron, fetal liver |
| hsa-miR-151b | 208949 | 210991 | Immune cells (B-cells) |
| hsa-miR-152 | 208950 | 210992 | Liver |
| hsa-miR-153 | 208951 | 210993 | Brain |
| hsa-miR-154-3p | 208952 | 210994 | Embryonic stem cells |
| hsa-miR-154-5p | 208953 | 210995 | Embryonic stem cells |
| hsa-miR-155-3p | 208954 | 210996 | T/B cells, monocytes, breast |
| hsa-miR-155-5p | 208955 | 210997 | T/B cells, monocytes, breast |
| hsa-miR-181a-2-3p | 208956 | 210998 | Glioblast, stem cells |
| hsa-miR-181a-3p | 208957 | 210999 | Glioblast, myeloid cells, embryonic stem cells |
| hsa-miR-181a-5p | 208958 | 211000 | Glioblast, myeloid cells, embryonic stem cells |
| hsa-miR-181b-3p | 208959 | 211001 | Glioblast, Embryonic stem cells, epidermal (keratinocytes) |
| hsa-miR-181b-5p | 208960 | 211002 | Glioblast, Embryonic stem cells, epidermal (keratinocytes) |
| hsa-miR-181c-3p | 208961 | 211003 | Brain, stem cells/progenitor |
| hsa-miR-181c-5p | 208962 | 211004 | Brain, stem cells/progenitor |
| hsa-miR-181d | 208963 | 211005 | Glia cells |
| hsa-miR-182-3p | 208964 | 211006 | Immune cells |
| hsa-miR-182-5p | 208965 | 211007 | Lung, immune cells |
| hsa-miR-183-3p | 208966 | 211008 | Brain |
| hsa-miR-183-5p | 208967 | 211009 | Brain |
| hsa-miR-184 | 208968 | 211010 | Blood, tongue, pancreas (islet) |
| hsa-miR-185-3p | 208969 | 211011 | |
| hsa-miR-185-5p | 208970 | 211012 | |
| hsa-miR-186-3p | 208971 | 211013 | Osteoblasts, heart |
| hsa-miR-186-5p | 208972 | 211014 | Osteoblasts, heart |
| hsa-miR-187-3p | 208973 | 211015 | |
| hsa-miR-187-5p | 208974 | 211016 | |
| hsa-miR-188-3p | 208975 | 211017 | Smooth muscle, central nervous system |
| hsa-miR-188-5p | 208976 | 211018 | Smooth muscle, central nervous system |
| hsa-miR-190a | 208977 | 211019 | Brain |
| hsa-miR-190b | 208978 | 211020 | Brain |
| hsa-miR-191-3p | 208979 | 211021 | |
| hsa-miR-191-5p | 208980 | 211022 | |
| hsa-miR-192-3p | 208981 | 211023 | Kidney |
| hsa-miR-192-5p | 208982 | 211024 | Kidney |
| hsa-miR-193a-3p | 208983 | 211025 | Variety of cells and tissues |
| hsa-miR-193a-5p | 208984 | 211026 | Variety of cells and tissues |
| hsa-miR-193b-3p | 208985 | 211027 | Many tissues/cells, semen |
| hsa-miR-193b-5p | 208986 | 211028 | Many tissues/cells, semen |
| hsa-miR-194-3p | 208987 | 211029 | Kidney, liver |
| hsa-miR-194-5p | 208988 | 211030 | Kidney, liver |
| hsa-miR-195-3p | 208989 | 211031 | Breast, pancreas (islet) |
| hsa-miR-195-5p | 208990 | 211032 | Breast, pancreas (islet) |
| hsa-miR-196a-3p | 208991 | 211033 | Pancreatic cells, endometrial tissues, mesenchymal stem cells |
| hsa-miR-196a-5p | 208992 | 211034 | Pancreatic cells, endometrial tissues, mesenchymal stem cells |
| hsa-miR-196b-3p | 208993 | 211035 | Endometrial tissues |
| hsa-miR-196b-5p | 208994 | 211036 | Endometrial tissues |
| hsa-miR-197-3p | 208995 | 211037 | Blood (myeloid), other tissues/cells |
| hsa-miR-197-5p | 208996 | 211038 | Blood (myeloid), other tissues/cells |
| hsa-miR-198 | 208997 | 211039 | Central nervous system(CNS) |
| hsa-miR-199a-3p | 208998 | 211040 | Liver, embryonic body cells, cardiomyocytes |
| hsa-miR-199a-5p | 208999 | 211041 | Liver, cardiomyocytes |
| hsa-miR-199b-3p | 209000 | 211042 | Liver, osteoblast |
| hsa-miR-199b-5p | 209001 | 211043 | Liver, osteoblast |
| hsa-miR-200a-3p | 209002 | 211044 | Epithelial cells, many other tissues |
| hsa-miR-200a-5p | 209003 | 211045 | Epithelial cells, many other tissues |
| hsa-miR-200b-3p | 209004 | 211046 | Epithelial cells, many other tissues |
| hsa-miR-200b-5p | 209005 | 211047 | Epithelial cells, many other tissues |
| hsa-miR-200c-3p | 209006 | 211048 | Epithelial cells, many other tissues, embryonic stem cells |
| hsa-miR-200c-5p | 209007 | 211049 | Epithelial cells, many other tissues, embryonic stem cells |
| hsa-miR-202-3p | 209008 | 211050 | Blood |
| hsa-miR-202-5p | 209009 | 211051 | Blood |
| hsa-miR-203a | 209010 | 211052 | Skin (epithelium) |
| hsa-miR-203b-3p | 209011 | 211053 | Skin specific (epithelium) |
| hsa-miR-203b-5p | 209012 | 211054 | Skin specific (epithelium) |
| hsa-miR-204-3p | 209013 | 211055 | Adipose, other tissues/cells. Kidney |
| hsa-miR-204-5p | 209014 | 211056 | Adipose, other tissues/cells, kidney |

TABLE 13-continued microRNA Sequences

| microRNA name | miR SEQ ID | miR BS SEQ ID | Types of Tissues and/or Cells |
|---|---|---|---|
| hsa-miR-205-3p | 209015 | 211057 | Blood(plasma) |
| hsa-miR-205-5p | 209016 | 211058 | Blood(plasma) |
| hsa-miR-206 | 209017 | 211059 | Muscle (cardiac and skeletal) |
| hsa-miR-208a | 209018 | 211060 | Heart (cardiomyocyte), muscle |
| hsa-miR-208b | 209019 | 211061 | Heart (cardiomyocyte), muscle |
| hsa-miR-210 | 209020 | 211062 | Kidney, heart, vascular endothelial cells |
| hsa-miR-211-3p | 209021 | 211063 | Melanocytes |
| hsa-miR-211-5p | 209022 | 211064 | Melanocytes |
| hsa-miR-212-3p | 209023 | 211065 | Brain(neuron), spleen |
| hsa-miR-212-5p | 209024 | 211066 | Brain(neuron), spleen |
| hsa-miR-214-3p | 209025 | 211067 | Immune cells, pancreas |
| hsa-miR-214-5p | 209026 | 211068 | Immune cells, pancreas |
| hsa-miR-215 | 209027 | 211069 | Variety of cells and tissues |
| hsa-miR-216a-3p | 209028 | 211070 | Kidney, pancreas |
| hsa-miR-216a-5p | 209029 | 211071 | Kidney, pancreas |
| hsa-miR-216b | 209030 | 211072 | |
| hsa-miR-217 | 209031 | 211073 | Endothelial cells |
| hsa-miR-218-1-3p | 209032 | 211074 | Endothelial cells |
| hsa-miR-218-2-3p | 209033 | 211075 | |
| hsa-miR-218-5p | 209034 | 211076 | |
| hsa-miR-219-1-3p | 209035 | 211077 | Brain, oligodendrocytes |
| hsa-miR-219-2-3p | 209036 | 211078 | Brain, oligodendrocytes |
| hsa-miR-219-5p | 209037 | 211079 | Brain, oligodendrocytes |
| hsa-miR-221-3p | 209038 | 211080 | Endothelial cells, immune cells |
| hsa-miR-221-5p | 209039 | 211081 | Endothelial cells, immune cells |
| hsa-miR-222-3p | 209040 | 211082 | Endothelial cells |
| hsa-miR-222-5p | 209041 | 211083 | Endothelial cells |
| hsa-miR-223-3p | 209042 | 211084 | Myeloid cells |
| hsa-miR-223-5p | 209043 | 211085 | Myeloid cells |
| hsa-miR-224-3p | 209044 | 211086 | Blood(plasma), ovary |
| hsa-miR-224-5p | 209045 | 211087 | Blood(plasma), ovary |
| hsa-miR-296-3p | 209046 | 211088 | Kidney, heart, lung, endothelial cells |
| hsa-miR-296-5p | 209047 | 211089 | Lung, liver, endothelial cells |
| hsa-miR-297 | 209048 | 211090 | Oocyte and prostate |
| hsa-miR-298 | 209049 | 211091 | |
| hsa-miR-299-3p | 209050 | 211092 | |
| hsa-miR-299-5p | 209051 | 211093 | |
| hsa-miR-300 | 209052 | 211094 | Osteoblast |
| hsa-miR-301a-3p | 209053 | 211095 | Embryonic stem cells |
| hsa-miR-301a-5p | 209054 | 211096 | Embryonic stem cells |
| hsa-miR-301b | 209055 | 211097 | |
| hsa-miR-302a-3p | 209056 | 211098 | Embryonic stem cells, lipid metabolism |
| hsa-miR-302a-5p | 209057 | 211099 | Embrypnic stem cells, lipid metabolism |
| hsa-miR-302b-3p | 209058 | 211100 | Embryonic stem cells |
| hsa-miR-302b-5p | 209059 | 211101 | Embryonic stem cells |
| hsa-miR-302c-3p | 209060 | 211102 | Embryonic stem cells |
| hsa-miR-302c-5p | 209061 | 211103 | Embryonic stem cells |
| hsa-miR-302d-3p | 209062 | 211104 | Embryonic stem cells |
| hsa-miR-302d-5p | 209063 | 211105 | Embryonic stem cells |
| hsa-miR-302e | 209064 | 211106 | Embryonic body cells |
| hsa-miR-302f | 209065 | 211107 | |
| hsa-miR-320a | 209066 | 211108 | Blood, heart (myocardial) |
| hsa-miR-320b | 209067 | 211109 | Central nervous system |
| hsa-miR-320c | 209068 | 211110 | Chondrocyte |
| hsa-miR-320d | 209069 | 211111 | |
| hsa-miR-320e | 209070 | 211112 | Neural cells |
| hsa-miR-323a-3p | 209071 | 211113 | Neurons |
| hsa-miR-323a-5p | 209072 | 211114 | Neurons |
| hsa-miR-323b-3p | 209073 | 211115 | |
| hsa-miR-323b-5p | 209074 | 211116 | |
| hsa-miR-324-3p | 209075 | 211117 | Kidney |
| hsa-miR-324-5p | 209076 | 211118 | Neurons |
| hsa-miR-325 | 209077 | 211119 | Neurons, placenta |
| hsa-miR-326 | 209078 | 211120 | Neurons |
| hsa-miR-328 | 209079 | 211121 | Neuron, blood |
| hsa-miR-329 | 209080 | 211122 | Brain and platelet |
| hsa-miR-330-3p | 209081 | 211123 | |
| hsa-miR-330-5p | 209082 | 211124 | |
| hsa-miR-331-3p | 209083 | 211125 | |
| hsa-miR-331-5p | 209084 | 211126 | Lymphocytes |
| hsa-miR-335-3p | 209085 | 211127 | Kidney, breast |
| hsa-miR-335-5p | 209086 | 211128 | Kidney, breast |
| hsa-miR-337-3p | 209087 | 211129 | Lung |
| hsa-miR-337-5p | 209088 | 211130 | Lung |
| hsa-miR-338-3p | 209089 | 211131 | Epithelial cells, oligodendrocytes |
| hsa-miR-338-5p | 209090 | 211132 | Oligodendrocytes |

TABLE 13-continued microRNA Sequences

| microRNA name | miR SEQ ID | miR BS SEQ ID | Types of Tissues and/or Cells |
|---|---|---|---|
| hsa-miR-339-3p | 209091 | 211133 | Immune cell |
| hsa-miR-339-5p | 209092 | 211134 | Immune cell |
| hsa-miR-33a-3p | 209093 | 211135 | Pancreatic islet, lipid metabolism |
| hsa-miR-33a-5p | 209094 | 211136 | Pancreatic islet, lipid metabolism |
| hsa-miR-33b-3p | 209095 | 211137 | Lipid metabolism |
| hsa-miR-33b-5p | 209096 | 211138 | Lipid metabolism |
| hsa-miR-340-3p | 209097 | 211139 | |
| hsa-miR-340-5p | 209098 | 211140 | Embryoid body cells |
| hsa-miR-342-3p | 209099 | 211141 | Brain, circulating plasma |
| hsa-miR-342-5p | 209100 | 211142 | Circulating plasma |
| hsa-miR-345-3p | 209101 | 211143 | Hematopoietic cells |
| hsa-miR-345-5p | 209102 | 211144 | Hematopoietic cells |
| hsa-miR-346 | 209103 | 211145 | Immune cells |
| hsa-miR-361-3p | 209104 | 211146 | Blood, endothelial cells |
| hsa-miR-361-5p | 209105 | 211147 | Endothelial cells |
| hsa-miR-362-3p | 209106 | 211148 | |
| hsa-miR-362-5p | 209107 | 211149 | |
| hsa-miR-363-3p | 209108 | 211150 | Kidney stem cell, blood cells |
| hsa-miR-363-5p | 209109 | 211151 | Kidney stem cell, blood cells |
| hsa-miR-365a-3p | 209110 | 211152 | |
| hsa-miR-365a-5p | 209111 | 211153 | |
| hsa-miR-365b-3p | 209112 | 211154 | |
| hsa-miR-365b-5p | 209113 | 211155 | |
| hsa-miR-367-3p | 209114 | 211156 | Embryonic stem cells |
| hsa-miR-367-5p | 209115 | 211157 | Embryonic stem cells |
| hsa-miR-369-3p | 209116 | 211158 | Stem cells |
| hsa-miR-369-5p | 209117 | 211159 | Stem cells |
| hsa-miR-370 | 209118 | 211160 | |
| hsa-miR-371a-3p | 209119 | 211161 | Serum |
| hsa-miR-371a-5p | 209120 | 211162 | Serum |
| hsa-miR-371b-3p | 209121 | 211163 | Serum |
| hsa-miR-371b-5p | 209122 | 211164 | Serum |
| hsa-miR-372 | 209123 | 211165 | Hematopoietic cells, lung, placental (blood) |
| hsa-miR-373-3p | 209124 | 211166 | |
| hsa-miR-373-5p | 209125 | 211167 | |
| hsa-miR-374a-3p | 209126 | 211168 | Muscle (myoblasts) |
| hsa-miR-374a-5p | 209127 | 211169 | Muscle (myoblasts) |
| hsa-miR-374b-3p | 209128 | 211170 | Muscle (myoblasts) |
| hsa-miR-374b-5p | 209129 | 211171 | Muscle (myoblasts) |
| hsa-miR-374c-3p | 209130 | 211172 | Muscle (myoblasts) |
| hsa-miR-374c-5p | 209131 | 211173 | Muscle (myoblasts) |
| hsa-miR-375 | 209132 | 211174 | Pancreas (islet) |
| hsa-miR-376a-2-5p | 209133 | 211175 | Hematopoietic cells (erythroid, platelet, and lymphoma) |
| hsa-miR-376a-3p | 209134 | 211176 | Hematopoietic cells (erythroid, platelet, and lymphoma) |
| hsa-miR-376a-5p | 209135 | 211177 | Hematopoietic cells (erythroid, platelet, and lymphoma) |
| hsa-miR-376b-3p | 209136 | 211178 | Blood |
| hsa-miR-376b-5p | 209137 | 211179 | Blood |
| hsa-miR-376c-3p | 209138 | 211180 | Trophoblast |
| hsa-miR-376c-5p | 209139 | 211181 | Trophoblast |
| hsa-miR-377-3p | 209140 | 211182 | Hematopoietic cells |
| hsa-miR-377-5p | 209141 | 211183 | Hematopoietic cells |
| hsa-miR-378a-3p | 209142 | 211184 | Ovary, lipid metabolism |
| hsa-miR-378a-5p | 209143 | 211185 | Ovary, placenta/trophoblast, lipid metabolism |
| hsa-miR-378b | 209144 | 211186 | Lipid metabolism |
| hsa-miR-378c | 209145 | 211187 | Lipid metabolism |
| hsa-miR-378d | 209146 | 211188 | Lipid metabolism |
| hsa-miR-378e | 209147 | 211189 | Lipid metabolism |
| hsa-miR-378f | 209148 | 211190 | Lipid metabolism |
| hsa-miR-378g | 209149 | 211191 | Lipid metabolism |
| hsa-miR-378h | 209150 | 211192 | Lipid metabolism |
| hsa-miR-378i | 209151 | 211193 | Lipid metabolism |
| hsa-miR-378j | 209152 | 211194 | Lipid metabolism |
| hsa-miR-379-3p | 209153 | 211195 | |
| hsa-miR-379-5p | 209154 | 211196 | |
| hsa-miR-380-3p | 209155 | 211197 | Brain |
| hsa-miR-380-5p | 209156 | 211198 | Brain, embryonic stem cells |
| hsa-miR-381-3p | 209157 | 211199 | Chondrogenesis, lung, brain |
| hsa-miR-381-5p | 209158 | 211200 | Chondrogenesis, lung, brain |
| hsa-miR-382-3p | 209159 | 211201 | Renal epithelial cells |
| hsa-miR-382-5p | 209160 | 211202 | Renal epithelial cells |
| hsa-miR-383 | 209161 | 211203 | Testes, brain (medulla) |
| hsa-miR-384 | 209162 | 211204 | Epithelial cells |
| hsa-miR-409-3p | 209163 | 211205 | |
| hsa-miR-409-5p | 209164 | 211206 | |
| hsa-miR-410 | 209165 | 211207 | Brain |
| hsa-miR-411-3p | 209166 | 211208 | |

TABLE 13-continued microRNA Sequences

| microRNA name | miR SEQ ID | miR BS SEQ ID | Types of Tissues and/or Cells |
|---|---|---|---|
| hsa-miR-411-5p | 209167 | 211209 | |
| hsa-miR-412 | 209168 | 211210 | |
| hsa-miR-421 | 209169 | 211211 | Endothelial cells |
| hsa-miR-422a | 209170 | 211212 | Plasma |
| hsa-miR-423-3p | 209171 | 211213 | Embryonic stem cells |
| hsa-miR-423-5p | 209172 | 211214 | Heart, embryonic stem cells |
| hsa-miR-424-3p | 209173 | 211215 | Endothelial cells |
| hsa-miR-424-5p | 209174 | 211216 | Endothelial cells |
| hsa-miR-425-3p | 209175 | 211217 | Brain |
| hsa-miR-425-5p | 209176 | 211218 | Brain |
| hsa-miR-429 | 209177 | 211219 | Epithelial cells |
| hsa-miR-431-3p | 209178 | 211220 | |
| hsa-miR-431-5p | 209179 | 211221 | |
| hsa-miR-432-3p | 209180 | 211222 | Myoblast |
| hsa-miR-432-5p | 209181 | 211223 | Myoblast |
| hsa-miR-433 | 209182 | 211224 | |
| hsa-miR-448 | 209183 | 211225 | Liver (hepatocytes) |
| hsa-miR-449a | 209184 | 211226 | Chondrocytes, ciliated epithelial cells |
| hsa-miR-449b-3p | 209185 | 211227 | Ciliated epithelial cells, other tissues |
| hsa-miR-449b-5p | 209186 | 211228 | Ciliated epithelial cells, other tissues |
| hsa-miR-449c-3p | 209187 | 211229 | |
| hsa-miR-449c-5p | 209188 | 211230 | |
| hsa-miR-450a-3p | 209189 | 211231 | |
| hsa-miR-450a-5p | 209190 | 211232 | |
| hsa-miR-450b-3p | 209191 | 211233 | |
| hsa-miR-450b-5p | 209192 | 211234 | |
| hsa-miR-451a | 209193 | 211235 | Heart, central nervous system, epithelial cells |
| hsa-miR-451b | 209194 | 211236 | Heart, central nervous system, epithelial cells |
| hsa-miR-452-3p | 209195 | 211237 | Myoblast |
| hsa-miR-452-5p | 209196 | 211238 | Myoblast |
| hsa-miR-454-3p | 209197 | 211239 | Embryoid body cells, central nervous system, monocytes |
| hsa-miR-454-5p | 209198 | 211240 | Embryoid body cells, central nervous system, monocytes |
| hsa-miR-455-3p | 209199 | 211241 | |
| hsa-miR-455-5p | 209200 | 211242 | |
| hsa-miR-466 | 209201 | 211243 | |
| hsa-miR-483-3p | 209202 | 211244 | |
| hsa-miR-483-5p | 209203 | 211245 | Cartilage (chondrocyte), fetal brain |
| hsa-miR-484 | 209204 | 211246 | |
| hsa-miR-485-3p | 209205 | 211247 | |
| hsa-miR-485-5p | 209206 | 211248 | |
| hsa-miR-486-3p | 209207 | 211249 | Erythroid cells |
| hsa-miR-486-5p | 209208 | 211250 | Stem cells (adipose) |
| hsa-miR-487a | 209209 | 211251 | |
| hsa-miR-487b | 209210 | 211252 | |
| hsa-miR-488-3p | 209211 | 211253 | |
| hsa-miR-488-5p | 209212 | 211254 | |
| hsa-miR-489 | 209213 | 211255 | Mesenchymal stem cells |
| hsa-miR-490-3p | 209214 | 211256 | |
| hsa-miR-490-5p | 209215 | 211257 | |
| hsa-miR-491-3p | 209216 | 211258 | |
| hsa-miR-491-5p | 209217 | 211259 | |
| hsa-miR-492 | 209218 | 211260 | |
| hsa-miR-493-3p | 209219 | 211261 | Myeloid cells, pancreas (islet) |
| hsa-miR-493-5p | 209220 | 211262 | Myeloid cells, pancreas (islet) |
| hsa-miR-494 | 209221 | 211263 | Epithelial cells |
| hsa-miR-495-3p | 209222 | 211264 | Platelet |
| hsa-miR-495-5p | 209223 | 211265 | Platelet |
| hsa-miR-496 | 209224 | 211266 | Blood |
| hsa-miR-497-3p | 209225 | 211267 | |
| hsa-miR-497-5p | 209226 | 211268 | |
| hsa-miR-498 | 209227 | 211269 | |
| hsa-miR-500a-3p | 209228 | 211270 | |
| hsa-miR-500a-5p | 209229 | 211271 | |
| hsa-miR-500b | 209230 | 211272 | Blood (plasma) |
| hsa-miR-501-3p | 209231 | 211273 | |
| hsa-miR-501-5p | 209232 | 211274 | |
| hsa-miR-502-3p | 209233 | 211275 | |
| hsa-miR-502-5p | 209234 | 211276 | |
| hsa-miR-503-3p | 209235 | 211277 | Ovary |
| hsa-miR-503-5p | 209236 | 211278 | Ovary |
| hsa-miR-504 | 209237 | 211279 | |
| hsa-miR-505-3p | 209238 | 211280 | |
| hsa-miR-505-5p | 209239 | 211281 | |
| hsa-miR-506-3p | 209240 | 211282 | |
| hsa-miR-506-5p | 209241 | 211283 | |
| hsa-miR-507 | 209242 | 211284 | |

TABLE 13-continued microRNA Sequences

| microRNA name | miR SEQ ID | miR BS SEQ ID | Types of Tissues and/or Cells |
|---|---|---|---|
| hsa-miR-508-3p | 209243 | 211285 | |
| hsa-miR-508-5p | 209244 | 211286 | Endothelial progenitor cells (epcs) |
| hsa-miR-509-3-5p | 209245 | 211287 | Testis |
| hsa-miR-509-3p | 209246 | 211288 | |
| hsa-miR-509-5p | 209247 | 211289 | |
| hsa-miR-510 | 209248 | 211290 | Brain |
| hsa-miR-511 | 209249 | 211291 | Dendritic cells and macrophages |
| hsa-miR-512-3p | 209250 | 211292 | Embryonic stem cells, placenta |
| hsa-miR-512-5p | 209251 | 211293 | Embryonic stem cells, placenta, |
| hsa-miR-513a-3p | 209252 | 211294 | |
| hsa-miR-513a-5p | 209253 | 211295 | Endothelial cells |
| hsa-miR-513b | 209254 | 211296 | |
| hsa-miR-513c-3p | 209255 | 211297 | |
| hsa-miR-513c-5p | 209256 | 211298 | |
| hsa-miR-514a-3p | 209257 | 211299 | |
| hsa-miR-514a-5p | 209258 | 211300 | |
| hsa-miR-514b-3p | 209259 | 211301 | |
| hsa-miR-514b-5p | 209260 | 211302 | |
| hsa-miR-515-3p | 209261 | 211303 | |
| hsa-miR-515-5p | 209262 | 211304 | Placenta |
| hsa-miR-516a-3p | 209263 | 211305 | Frontal cortex |
| hsa-miR-516a-5p | 209264 | 211306 | Placenta |
| hsa-miR-516b-3p | 209265 | 211307 | |
| hsa-miR-516b-5p | 209266 | 211308 | |
| hsa-miR-517-5p | 209267 | 211309 | Placenta |
| hsa-miR-517a-3p | 209268 | 211310 | Placenta |
| hsa-miR-517b-3p | 209269 | 211311 | Placenta |
| hsa-miR-517c-3p | 209270 | 211312 | Placenta |
| hsa-miR-518a-3p | 209271 | 211313 | |
| hsa-miR-518a-5p | 209272 | 211314 | |
| hsa-miR-518b | 209273 | 211315 | Placenta |
| hsa-miR-518c-3p | 209274 | 211316 | Placenta |
| hsa-miR-518c-5p | 209275 | 211317 | Placenta |
| hsa-miR-518d-3p | 209276 | 211318 | |
| hsa-miR-518d-5p | 209277 | 211319 | |
| hsa-miR-518e-3p | 209278 | 211320 | |
| hsa-miR-518e-5p | 209279 | 211321 | |
| hsa-miR-518f-3p | 209280 | 211322 | Placenta |
| hsa-miR-518f-5p | 209281 | 211323 | Placenta |
| hsa-miR-519a-3p | 209282 | 211324 | Placenta |
| hsa-miR-519a-5p | 209283 | 211325 | Placenta |
| hsa-miR-519b-3p | 209284 | 211326 | |
| hsa-miR-519b-5p | 209285 | 211327 | |
| hsa-miR-519c-3p | 209286 | 211328 | |
| hsa-miR-519c-5p | 209287 | 211329 | |
| hsa-miR-519d | 209288 | 211330 | Placenta |
| hsa-miR-519e-3p | 209289 | 211331 | Placenta |
| hsa-miR-519e-5p | 209290 | 211332 | Placenta |
| hsa-miR-520a-3p | 209291 | 211333 | Placenta |
| hsa-miR-520a-5p | 209292 | 211334 | Placenta |
| hsa-miR-520b | 209293 | 211335 | |
| hsa-miR-520c-3p | 209294 | 211336 | |
| hsa-miR-520c-5p | 209295 | 211337 | |
| hsa-miR-520d-3p | 209296 | 211338 | |
| hsa-miR-520d-5p | 209297 | 211339 | |
| hsa-miR-520e | 209298 | 211340 | |
| hsa-miR-520f | 209299 | 211341 | |
| hsa-miR-520g | 209300 | 211342 | |
| hsa-miR-520h | 209301 | 211343 | Placental specific |
| hsa-miR-521 | 209302 | 211344 | |
| hsa-miR-522-3p | 209303 | 211345 | |
| hsa-miR-522-5p | 209304 | 211346 | |
| hsa-miR-523-3p | 209305 | 211347 | |
| hsa-miR-523-5p | 209306 | 211348 | |
| hsa-miR-524-3p | 209307 | 211349 | |
| hsa-miR-524-5p | 209308 | 211350 | Placental specific |
| hsa-miR-525-3p | 209309 | 211351 | Placental specific |
| hsa-miR-525-5p | 209310 | 211352 | Placental specific |
| hsa-miR-526a | 209311 | 211353 | Placental specific |
| hsa-miR-526b-3p | 209312 | 211354 | Placental specific |
| hsa-miR-526b-5p | 209313 | 211355 | Placental specific |
| hsa-miR-527 | 209314 | 211356 | |
| hsa-miR-532-3p | 209315 | 211357 | |
| hsa-miR-532-5p | 209316 | 211358 | |
| hsa-miR-539-3p | 209317 | 211359 | |
| hsa-miR-539-5p | 209318 | 211360 | |

TABLE 13-continued microRNA Sequences

| microRNA name | miR SEQ ID | miR BS SEQ ID | Types of Tissues and/or Cells |
|---|---|---|---|
| hsa-miR-541-3p | 209319 | 211361 | |
| hsa-miR-541-5p | 209320 | 211362 | |
| hsa-miR-542-3p | 209321 | 211363 | Monocytes |
| hsa-miR-542-5p | 209322 | 211364 | |
| hsa-miR-543 | 209323 | 211365 | |
| hsa-miR-544a | 209324 | 211366 | |
| hsa-miR-544b | 209325 | 211367 | |
| hsa-miR-545-3p | 209326 | 211368 | |
| hsa-miR-545-5p | 209327 | 211369 | |
| hsa-miR-548 | 209328 | 211370 | |
| hsa-miR-548-3p | 209329 | 211371 | |
| hsa-miR-548-5p | 209330 | 211372 | |
| hsa-miR-548a | 209331 | 211373 | Colorectal micrornaome |
| hsa-miR-548a-3p | 209332 | 211374 | Colorectal micrornaome |
| hsa-miR-548a-5p | 209333 | 211375 | Colorectal micrornaome |
| hsa-miR-548aa | 209334 | 211376 | Cervical tumor |
| hsa-miR-548ab | 209335 | 211377 | B-cells |
| hsa-miR-548ac | 209336 | 211378 | B-cells |
| hsa-miR-548ad | 209337 | 211379 | B-cells |
| hsa-miR-548ae | 209338 | 211380 | B-cells |
| hsa-miR-548ag | 209339 | 211381 | B-cells |
| hsa-miR-548ah-3p | 209340 | 211382 | B-cells |
| hsa-miR-548ah-5p | 209341 | 211383 | B-cells |
| hsa-miR-548ai | 209342 | 211384 | B-cells |
| hsa-miR-548aj-3p | 209343 | 211385 | B-cells |
| hsa-miR-548aj-5p | 209344 | 211386 | B-cells |
| hsa-miR-548ak | 209345 | 211387 | B-cells |
| hsa-miR-548al | 209346 | 211388 | B-cells |
| hsa-miR-548am-3p | 209347 | 211389 | B-cells |
| hsa-miR-548am-5p | 209348 | 211390 | B-cells |
| hsa-miR-548an | 209349 | 211391 | B-cells |
| hsa-miR-548ao-3p | 209350 | 211392 | |
| hsa-miR-548ao-5p | 209351 | 211393 | |
| hsa-miR-548ap-3p | 209352 | 211394 | |
| hsa-miR-548ap-5p | 209353 | 211395 | |
| hsa-miR-548aq-3p | 209354 | 211396 | |
| hsa-miR-548aq-5p | 209355 | 211397 | |
| hsa-miR-548ar-3p | 209356 | 211398 | |
| hsa-miR-548ar-5p | 209357 | 211399 | |
| hsa-miR-548as-3p | 209358 | 211400 | |
| hsa-miR-548as-5p | 209359 | 211401 | |
| hsa-miR-548at-3p | 209360 | 211402 | |
| hsa-miR-548at-5p | 209361 | 211403 | |
| hsa-miR-548au-3p | 209362 | 211404 | |
| hsa-miR-548au-5p | 209363 | 211405 | |
| hsa-miR-548av-3p | 209364 | 211406 | |
| hsa-miR-548av-5p | 209365 | 211407 | |
| hsa-miR-548aw | 209366 | 211408 | |
| hsa-miR-548ay-3p | 209367 | 211409 | Abnormal skin (psoriasis) |
| hsa-miR-548ay-5p | 209368 | 211410 | Abnormal skin (psoriasis) |
| hsa-miR-548az-3p | 209369 | 211411 | Abnormal skin (psoriasis) |
| hsa-miR-548az-5p | 209370 | 211412 | Abnormal skin (psoriasis) |
| hsa-miR-548b-3p | 209371 | 211413 | Colorectal micrornaome |
| hsa-miR-548b-5p | 209372 | 211414 | Immune cells, frontal cortex |
| hsa-miR-548c-3p | 209373 | 211415 | Colorectal micrornaome |
| hsa-miR-548c-5p | 209374 | 211416 | Immune cells, frontal cortex |
| hsa-miR-548d-3p | 209375 | 211417 | Colorectal micrornaome |
| hsa-miR-548d-5p | 209376 | 211418 | Colorectal micrornaome |
| hsa-miR-548e | 209377 | 211419 | Embryonic stem cells |
| hsa-miR-548f | 209378 | 211420 | Embryonic stem cells |
| hsa-miR-548g-3p | 209379 | 211421 | Embryonic stem cells |
| hsa-miR-548g-5p | 209380 | 211422 | Embryonic stem cells |
| hsa-miR-548h-3p | 209381 | 211423 | Embryonic stem cells |
| hsa-miR-548h-5p | 209382 | 211424 | Embryonic stem cells |
| hsa-miR-548i | 209383 | 211425 | Embryonic stem cells, immune cells |
| hsa-miR-548j | 209384 | 211426 | Immune cells |
| hsa-miR-548k | 209385 | 211427 | Embryonic stem cells |
| hsa-miR-548l | 209386 | 211428 | Embryonic stem cells |
| hsa-miR-548m | 209387 | 211429 | Embryonic stem cells |
| hsa-miR-548n | 209388 | 211430 | Embryonic stem cells, immune cells |
| hsa-miR-548o-3p | 209389 | 211431 | Embryonic stem cells |
| hsa-miR-548o-5p | 209390 | 211432 | Embryonic stem cells |
| hsa-miR-548p | 209391 | 211433 | Embryonic stem cells |
| hsa-miR-548q | 209392 | 211434 | |
| hsa-miR-548s | 209393 | 211435 | Melanoma micrornaome |
| hsa-miR-548t-3p | 209394 | 211436 | Melanoma micrornaome |

TABLE 13-continued microRNA Sequences

| microRNA name | miR SEQ ID | miR BS SEQ ID | Types of Tissues and/or Cells |
|---|---|---|---|
| hsa-miR-548t-5p | 209395 | 211437 | Melanoma micrornaome |
| hsa-miR-548u | 209396 | 211438 | Melanoma micrornaome |
| hsa-miR-548w | 209397 | 211439 | Melanoma micrornaome |
| hsa-miR-548y | 209398 | 211440 | |
| hsa-miR-548z | 209399 | 211441 | Cervical tumor |
| hsa-miR-549a | 209400 | 211442 | Colorectal micrornaome |
| hsa-miR-550a-3-5p | 209401 | 211443 | |
| hsa-miR-550a-3p | 209402 | 211444 | |
| hsa-miR-550a-5p | 209403 | 211445 | |
| hsa-miR-550b-2-5p | 209404 | 211446 | Cervical tumor |
| hsa-miR-550b-3p | 209405 | 211447 | Cervical tumor |
| hsa-miR-551a | 209406 | 211448 | |
| hsa-miR-551b-3p | 209407 | 211449 | Hepatocytes |
| hsa-miR-551b-5p | 209408 | 211450 | Hepatocytes |
| hsa-miR-552 | 209409 | 211451 | Colorectal micrornaome |
| hsa-miR-553 | 209410 | 211452 | Colorectal micrornaome |
| hsa-miR-554 | 209411 | 211453 | Colorectal micrornaome |
| hsa-miR-555 | 209412 | 211454 | Colorectal micrornaome |
| hsa-miR-556-3p | 209413 | 211455 | Colorectal micrornaome |
| hsa-miR-556-5p | 209414 | 211456 | Colorectal micrornaome |
| hsa-miR-557 | 209415 | 211457 | Liver (hepatocytes) |
| hsa-miR-558 | 209416 | 211458 | |
| hsa-miR-559 | 209417 | 211459 | |
| hsa-miR-561-3p | 209418 | 211460 | |
| hsa-miR-561-5p | 209419 | 211461 | |
| hsa-miR-562 | 209420 | 211462 | |
| hsa-miR-563 | 209421 | 211463 | Colorectal micrornaome |
| hsa-miR-564 | 209422 | 211464 | |
| hsa-miR-566 | 209423 | 211465 | |
| hsa-miR-567 | 209424 | 211466 | |
| hsa-miR-568 | 209425 | 211467 | Colorectal micrornaome |
| hsa-miR-569 | 209426 | 211468 | |
| hsa-miR-570-3p | 209427 | 211469 | |
| hsa-miR-570-5p | 209428 | 211470 | |
| hsa-miR-571 | 209429 | 211471 | Frontal cortex |
| hsa-miR-572 | 209430 | 211472 | Circulating microrna (in plasma) |
| hsa-miR-573 | 209431 | 211473 | Colorectal micrornaome |
| hsa-miR-574-3p | 209432 | 211474 | Blood (myeloid cells) |
| hsa-miR-574-5p | 209433 | 211475 | Semen |
| hsa-miR-575 | 209434 | 211476 | |
| hsa-miR-576-3p | 209435 | 211477 | Colorectal micrornaome |
| hsa-miR-576-5p | 209436 | 211478 | Cartilage/chondrocyte |
| hsa-miR-577 | 209437 | 211479 | Colorectal micrornaome |
| hsa-miR-578 | 209438 | 211480 | Colorectal micrornaome |
| hsa-miR-579 | 209439 | 211481 | |
| hsa-miR-580 | 209440 | 211482 | |
| hsa-miR-581 | 209441 | 211483 | Liver(hepatocytes) |
| hsa-miR-582-3p | 209442 | 211484 | Cartilage/chondrocyte |
| hsa-miR-582-5p | 209443 | 211485 | |
| hsa-miR-583 | 209444 | 211486 | |
| hsa-miR-584-3p | 209445 | 211487 | |
| hsa-miR-584-5p | 209446 | 211488 | |
| hsa-miR-585 | 209447 | 211489 | |
| hsa-miR-586 | 209448 | 211490 | Colorectal micrornaome |
| hsa-miR-587 | 209449 | 211491 | Colorectal micrornaome |
| hsa-miR-588 | 209450 | 211492 | Colorectal micrornaome |
| hsa-miR-589-3p | 209451 | 211493 | Mesothelial cells |
| hsa-miR-589-5p | 209452 | 211494 | Mesothelial cells |
| hsa-miR-590-3p | 209453 | 211495 | Cardiomyocytes |
| hsa-miR-590-5p | 209454 | 211496 | Cardiomyocytes |
| hsa-miR-591 | 209455 | 211497 | |
| hsa-miR-592 | 209456 | 211498 | |
| hsa-miR-593-3p | 209457 | 211499 | |
| hsa-miR-593-5p | 209458 | 211500 | |
| hsa-miR-595 | 209459 | 211501 | |
| hsa-miR-596 | 209460 | 211502 | |
| hsa-miR-597 | 209461 | 211503 | Colorectal micrornaome |
| hsa-miR-598 | 209462 | 211504 | Blood (lymphocytes) |
| hsa-miR-599 | 209463 | 211505 | |
| hsa-miR-600 | 209464 | 211506 | Colorectal micrornaome |
| hsa-miR-601 | 209465 | 211507 | |
| hsa-miR-602 | 209466 | 211508 | Oocyte |
| hsa-miR-603 | 209467 | 211509 | |
| hsa-miR-604 | 209468 | 211510 | Colorectal micrornaome |
| hsa-miR-605 | 209469 | 211511 | Colorectal micrornaome |
| hsa-miR-606 | 209470 | 211512 | Colorectal micrornaome |

TABLE 13-continued microRNA Sequences

| microRNA name | miR SEQ ID | miR BS SEQ ID | Types of Tissues and/or Cells |
|---|---|---|---|
| hsa-miR-607 | 209471 | 211513 | Colorectal micrornaome |
| hsa-miR-608 | 209472 | 211514 | |
| hsa-miR-609 | 209473 | 211515 | Colorectal micrornaome |
| hsa-miR-610 | 209474 | 211516 | |
| hsa-miR-611 | 209475 | 211517 | |
| hsa-miR-612 | 209476 | 211518 | |
| hsa-miR-613 | 209477 | 211519 | Lipid metabolism |
| hsa-miR-614 | 209478 | 211520 | Circulating micrornas (in Plasma) |
| hsa-miR-615-3p | 209479 | 211521 | |
| hsa-miR-615-5p | 209480 | 211522 | |
| hsa-miR-616-3p | 209481 | 211523 | |
| hsa-miR-616-5p | 209482 | 211524 | |
| hsa-miR-617 | 209483 | 211525 | |
| hsa-miR-618 | 209484 | 211526 | |
| hsa-miR-619 | 209485 | 211527 | Colorectal micrornaome |
| hsa-miR-620 | 209486 | 211528 | Colorectal micrornaome |
| hsa-miR-621 | 209487 | 211529 | |
| hsa-miR-622 | 209488 | 211530 | |
| hsa-miR-623 | 209489 | 211531 | |
| hsa-miR-624-3p | 209490 | 211532 | Chondrocyte |
| hsa-miR-624-5p | 209491 | 211533 | Chondrocyte |
| hsa-miR-625-3p | 209492 | 211534 | Liver (hepatocytes), circulating (blood) |
| hsa-miR-625-5p | 209493 | 211535 | Liver (hepatocytes), circulating (blood) |
| hsa-miR-626 | 209494 | 211536 | Colorectal micrornaome |
| hsa-miR-627 | 209495 | 211537 | |
| hsa-miR-628-3p | 209496 | 211538 | |
| hsa-miR-628-5p | 209497 | 211539 | |
| hsa-miR-629-3p | 209498 | 211540 | |
| hsa-miR-629-5p | 209499 | 211541 | |
| hsa-miR-630 | 209500 | 211542 | Chondrocytes |
| hsa-miR-631 | 209501 | 211543 | Colorectal micrornaome |
| hsa-miR-632 | 209502 | 211544 | |
| hsa-miR-633 | 209503 | 211545 | |
| hsa-miR-634 | 209504 | 211546 | Cartilage/chondrocyte |
| hsa-miR-635 | 209505 | 211547 | Colorectal micrornaome |
| hsa-miR-636 | 209506 | 211548 | |
| hsa-miR-637 | 209507 | 211549 | Colorectal micrornaome |
| hsa-miR-638 | 209508 | 211550 | |
| hsa-miR-639 | 209509 | 211551 | Colorectal micrornaome |
| hsa-miR-640 | 209510 | 211552 | |
| hsa-miR-641 | 209511 | 211553 | Cartilage/chondrocyte |
| hsa-miR-642a-3p | 209512 | 211554 | Adipocyte |
| hsa-miR-642a-5p | 209513 | 211555 | Colorectal micrornaome |
| hsa-miR-642b-3p | 209514 | 211556 | Cervical tumor |
| hsa-miR-642b-5p | 209515 | 211557 | Cervical tumor |
| hsa-miR-643 | 209516 | 211558 | Colorectal micrornaome |
| hsa-miR-644a | 209517 | 211559 | |
| hsa-miR-645 | 209518 | 211560 | |
| hsa-miR-646 | 209519 | 211561 | |
| hsa-miR-647 | 209520 | 211562 | |
| hsa-miR-648 | 209521 | 211563 | Circulating micrornas (in Plasma) |
| hsa-miR-649 | 209522 | 211564 | Serum |
| hsa-miR-650 | 209523 | 211565 | |
| hsa-miR-651 | 209524 | 211566 | Colorectal micrornaome |
| hsa-miR-652-3p | 209525 | 211567 | |
| hsa-miR-652-5p | 209526 | 211568 | |
| hsa-miR-653 | 209527 | 211569 | Colorectal micrornaome |
| hsa-miR-654-3p | 209528 | 211570 | Colorectal micrornaome |
| hsa-miR-654-5p | 209529 | 211571 | Bone marrow |
| hsa-miR-655 | 209530 | 211572 | |
| hsa-miR-656 | 209531 | 211573 | |
| hsa-miR-657 | 209532 | 211574 | Oligodendrocytes |
| hsa-miR-658 | 209533 | 211575 | |
| hsa-miR-659-3p | 209534 | 211576 | Myoblast |
| hsa-miR-659-5p | 209535 | 211577 | Myoblast |
| hsa-miR-660-3p | 209536 | 211578 | Myoblast |
| hsa-miR-660-5p | 209537 | 211579 | Myoblast |
| hsa-miR-661 | 209538 | 211580 | |
| hsa-miR-662 | 209539 | 211581 | Endothelial progenitor cells, oocytes |
| hsa-miR-663a | 209540 | 211582 | |
| hsa-miR-663b | 209541 | 211583 | |
| hsa-miR-664a-3p | 209542 | 211584 | Embryonic stem cells |
| hsa-miR-664a-5p | 209543 | 211585 | Embryonic stem cells |
| hsa-miR-664b-3p | 209544 | 211586 | Embryonic stem cells |
| hsa-miR-664b-5p | 209545 | 211587 | Embryonic stem cells |
| hsa-miR-665 | 209546 | 211588 | |

TABLE 13-continued microRNA Sequences

| microRNA name | miR SEQ ID | miR BS SEQ ID | Types of Tissues and/or Cells |
|---|---|---|---|
| hsa-miR-668 | 209547 | 211589 | Keratinocytes |
| hsa-miR-670 | 209548 | 211590 | |
| hsa-miR-671-3p | 209549 | 211591 | |
| hsa-miR-671-5p | 209550 | 211592 | |
| hsa-miR-675-3p | 209551 | 211593 | |
| hsa-miR-675-5p | 209552 | 211594 | |
| hsa-miR-676-3p | 209553 | 211595 | Female reproductive tract |
| hsa-miR-676-5p | 209554 | 211596 | Female reproductive tract |
| hsa-miR-708-3p | 209555 | 211597 | |
| hsa-miR-708-5p | 209556 | 211598 | |
| hsa-miR-711 | 209557 | 211599 | |
| hsa-miR-718 | 209558 | 211600 | Blood |
| hsa-miR-744-3p | 209559 | 211601 | Heart |
| hsa-miR-744-5p | 209560 | 211602 | Embryonic stem cells, heart |
| hsa-miR-758-3p | 209561 | 211603 | Cholesterol regulation and brain |
| hsa-miR-758-5p | 209562 | 211604 | Cholesterol regulation and brain |
| hsa-miR-759 | 209563 | 211605 | |
| hsa-miR-760 | 209564 | 211606 | |
| hsa-miR-761 | 209565 | 211607 | |
| hsa-miR-762 | 209566 | 211608 | Corneal epithelial cells |
| hsa-miR-764 | 209567 | 211609 | Osteoblast |
| hsa-miR-765 | 209568 | 211610 | |
| hsa-miR-766-3p | 209569 | 211611 | Embryonic stem cells |
| hsa-miR-766-5p | 209570 | 211612 | Embryonic stem cells |
| hsa-miR-767-3p | 209571 | 211613 | |
| hsa-miR-767-5p | 209572 | 211614 | |
| hsa-miR-769-3p | 209573 | 211615 | |
| hsa-miR-769-5p | 209574 | 211616 | |
| hsa-miR-770-5p | 209575 | 211617 | |
| hsa-miR-802 | 209576 | 211618 | Brain, epithelial cells, hepatocytes |
| hsa-miR-873-3p | 209577 | 211619 | |
| hsa-miR-873-5p | 209578 | 211620 | |
| hsa-miR-874 | 209579 | 211621 | |
| hsa-miR-875-3p | 209580 | 211622 | |
| hsa-miR-875-5p | 209581 | 211623 | |
| hsa-miR-876-3p | 209582 | 211624 | |
| hsa-miR-876-5p | 209583 | 211625 | |
| hsa-miR-877-3p | 209584 | 211626 | |
| hsa-miR-877-5p | 209585 | 211627 | |
| hsa-miR-885-3p | 209586 | 211628 | Embryonic stem cells |
| hsa-miR-885-5p | 209587 | 211629 | Embryonic stem cells |
| hsa-miR-887 | 209588 | 211630 | |
| hsa-miR-888-3p | 209589 | 211631 | |
| hsa-miR-888-5p | 209590 | 211632 | |
| hsa-miR-889 | 209591 | 211633 | |
| hsa-miR-890 | 209592 | 211634 | Epididymis |
| hsa-miR-891a | 209593 | 211635 | Epididymis |
| hsa-miR-891b | 209594 | 211636 | Epididymis |
| hsa-miR-892a | 209595 | 211637 | Epididymis |
| hsa-miR-892b | 209596 | 211638 | Epididymis |
| hsa-miR-892c-3p | 209597 | 211639 | Epididymis |
| hsa-miR-892c-5p | 209598 | 211640 | Epididymis |
| hsa-miR-920 | 209599 | 211641 | Human testis |
| hsa-miR-921 | 209600 | 211642 | Human testis |
| hsa-miR-922 | 209601 | 211643 | Human testis, neuronal tissues |
| hsa-miR-924 | 209602 | 211644 | Human testis |
| hsa-miR-933 | 209603 | 211645 | Cervical cancer |
| hsa-miR-934 | 209604 | 211646 | Cervical cancer |
| hsa-miR-935 | 209605 | 211647 | Blood mononuclear cells |
| hsa-miR-936 | 209606 | 211648 | Skin |
| hsa-miR-937-3p | 209607 | 211649 | |
| hsa-miR-937-5p | 209608 | 211650 | |
| hsa-miR-938 | 209609 | 211651 | |
| hsa-miR-939-3p | 209610 | 211652 | Hepatocytes |
| hsa-miR-939-5p | 209611 | 211653 | Hepatocytes |
| hsa-miR-940 | 209612 | 211654 | Cervical cancer |
| hsa-miR-941 | 209613 | 211655 | Embryonic stem cells |
| hsa-miR-942 | 209614 | 211656 | |
| hsa-miR-943 | 209615 | 211657 | Cervical cancer |
| hsa-miR-944 | 209616 | 211658 | |
| hsa-miR-1178-3p | 209617 | 211659 | |
| hsa-miR-1178-5p | 209618 | 211660 | |
| hsa-miR-1179 | 209619 | 211661 | |
| hsa-miR-1180 | 209620 | 211662 | Sarcoma |
| hsa-miR-1181 | 209621 | 211663 | |
| hsa-miR-1182 | 209622 | 211664 | Placenta |

TABLE 13-continued microRNA Sequences

| microRNA name | miR SEQ ID | miR BS SEQ ID | Types of Tissues and/or Cells |
|---|---|---|---|
| hsa-miR-1183 | 209623 | 211665 | |
| hsa-miR-1184 | 209624 | 211666 | Hematopoietic cells |
| hsa-miR-1185-1-3p | 209625 | 211667 | Placenta |
| hsa-miR-1185-2-3p | 209626 | 211668 | Placenta |
| hsa-miR-1185-5p | 209627 | 211669 | Placenta |
| hsa-miR-1193 | 209628 | 211670 | |
| hsa-miR-1197 | 209629 | 211671 | |
| hsa-miR-1200 | 209630 | 211672 | |
| hsa-miR-1202 | 209631 | 211673 | |
| hsa-miR-1203 | 209632 | 211674 | |
| hsa-miR-1204 | 209633 | 211675 | |
| hsa-miR-1205 | 209634 | 211676 | |
| hsa-miR-1206 | 209635 | 211677 | |
| hsa-miR-1207-3p | 209636 | 211678 | |
| hsa-miR-1207-5p | 209637 | 211679 | |
| hsa-miR-1208 | 209638 | 211680 | |
| hsa-miR-1224-3p | 209639 | 211681 | |
| hsa-miR-1224-5p | 209640 | 211682 | |
| hsa-miR-1225-3p | 209641 | 211683 | |
| hsa-miR-1225-5p | 209642 | 211684 | |
| hsa-miR-1226-3p | 209643 | 211685 | |
| hsa-miR-1226-5p | 209644 | 211686 | |
| hsa-miR-1227-3p | 209645 | 211687 | Cartilage/chondrocytes |
| hsa-miR-1227-5p | 209646 | 211688 | Cartilage/chondrocytes |
| hsa-miR-1228-3p | 209647 | 211689 | Liver (hepatocytes) |
| hsa-miR-1228-5p | 209648 | 211690 | Liver (hepatocytes) |
| hsa-miR-1229-3p | 209649 | 211691 | |
| hsa-miR-1229-5p | 209650 | 211692 | |
| hsa-miR-1231 | 209651 | 211693 | |
| hsa-miR-1233-1-5p | 209652 | 211694 | Serum |
| hsa-miR-1233-3p | 209653 | 211695 | Serum |
| hsa-miR-1234-3p | 209654 | 211696 | Embryonic stem cell |
| hsa-miR-1234-5p | 209655 | 211697 | Embryonic stem cell |
| hsa-miR-1236-3p | 209656 | 211698 | Lymphatic endothelial cells |
| hsa-miR-1236-5p | 209657 | 211699 | Lymphatic endothelial cells |
| hsa-miR-1237-3p | 209658 | 211700 | Esophageal cell line KYSE-150R |
| hsa-miR-1237-5p | 209659 | 211701 | Esophageal cell line KYSE-150R |
| hsa-miR-1238-3p | 209660 | 211702 | |
| hsa-miR-1238-5p | 209661 | 211703 | |
| hsa-miR-1243 | 209662 | 211704 | Embryonic stem cells |
| hsa-miR-1244 | 209663 | 211705 | Embryonic stem cells |
| hsa-miR-1245a | 209664 | 211706 | Embryonic stem cells |
| hsa-miR-1245b-3p | 209665 | 211707 | Embryonic stem cells |
| hsa-miR-1245b-5p | 209666 | 211708 | Embryonic stem cells |
| hsa-miR-1246 | 209667 | 211709 | Embryonic stem cells, epithelial cells |
| hsa-miR-1247-3p | 209668 | 211710 | Embryoid body cells |
| hsa-miR-1247-5p | 209669 | 211711 | Embryoid body cells |
| hsa-miR-1248 | 209670 | 211712 | |
| hsa-miR-1249 | 209671 | 211713 | Liver (hepatocytes) |
| hsa-miR-1250 | 209672 | 211714 | Oligodendrocytes |
| hsa-miR-1251 | 209673 | 211715 | Embryonic stem cells |
| hsa-miR-1252 | 209674 | 211716 | Embryonic stem cells |
| hsa-miR-1253 | 209675 | 211717 | Embryonic stem cells |
| hsa-miR-1254 | 209676 | 211718 | Embryonic stem cells |
| hsa-miR-1255a | 209677 | 211719 | Embryonic stem cells |
| hsa-miR-1255b-2-3p | 209678 | 211720 | Embryonic stem cells |
| hsa-miR-1255b-5p | 209679 | 211721 | Embryonic stem cells |
| hsa-miR-1256 | 209680 | 211722 | Embryonic stem cells |
| hsa-miR-1257 | 209681 | 211723 | Embryonic stem cells |
| hsa-miR-1258 | 209682 | 211724 | Embryonic stem cells |
| hsa-miR-1260a | 209683 | 211725 | Periodontal tissue |
| hsa-miR-1260b | 209684 | 211726 | Periodontal tissue |
| hsa-miR-1261 | 209685 | 211727 | Embryonic stem cells |
| hsa-miR-1262 | 209686 | 211728 | Embryoid body cells |
| hsa-miR-1263 | 209687 | 211729 | Embryonic stem cells |
| hsa-miR-1264 | 209688 | 211730 | Embryonic stem cells |
| hsa-miR-1265 | 209689 | 211731 | Embryonic stem cells |
| hsa-miR-1266 | 209690 | 211732 | Embryonic stem cells |
| hsa-miR-1267 | 209691 | 211733 | Embryonic stem cells |
| hsa-miR-1268a | 209692 | 211734 | Embryonic stem cells |
| hsa-miR-1268b | 209693 | 211735 | Embryonic stem cells |
| hsa-miR-1269a | 209694 | 211736 | Embryoid body cells |
| hsa-miR-1269b | 209695 | 211737 | Embryoid body cells |
| hsa-miR-1270 | 209696 | 211738 | Embryonic stem cells |
| hsa-miR-1271-3p | 209697 | 211739 | Brain |
| hsa-miR-1271-5p | 209698 | 211740 | Brain |

TABLE 13-continued microRNA Sequences

| microRNA name | miR SEQ ID | miR BS SEQ ID | Types of Tissues and/or Cells |
|---|---|---|---|
| hsa-miR-1272 | 209699 | 211741 | Embryonic stem cells |
| hsa-miR-1273a | 209700 | 211742 | Embryonic stem cells |
| hsa-miR-1273c | 209701 | 211743 | |
| hsa-miR-1273d | 209702 | 211744 | Embryonic stem cells |
| hsa-miR-1273e | 209703 | 211745 | |
| hsa-miR-1273f | 209704 | 211746 | |
| hsa-miR-1273g-3p | 209705 | 211747 | |
| hsa-miR-1273g-5p | 209706 | 211748 | |
| hsa-miR-1275 | 209707 | 211749 | Embryonic stem cells |
| hsa-miR-1276 | 209708 | 211750 | Embryonic stem cells |
| hsa-miR-1277-3p | 209709 | 211751 | Embryoid body cells |
| hsa-miR-1277-5p | 209710 | 211752 | Embryoid body cells |
| hsa-miR-1278 | 209711 | 211753 | Embryonic stem cells |
| hsa-miR-1279 | 209712 | 211754 | Monocytes |
| hsa-miR-1281 | 209713 | 211755 | |
| hsa-miR-1282 | 209714 | 211756 | Embryonic stem cells |
| hsa-miR-1283 | 209715 | 211757 | Placenta |
| hsa-miR-1284 | 209716 | 211758 | |
| hsa-miR-1285-3p | 209717 | 211759 | |
| hsa-miR-1285-5p | 209718 | 211760 | |
| hsa-miR-1286 | 209719 | 211761 | Smooth muscle |
| hsa-miR-1287 | 209720 | 211762 | Embryoid body cells |
| hsa-miR-1288 | 209721 | 211763 | Embryonic stem cells |
| hsa-miR-1289 | 209722 | 211764 | Multiple cell types |
| hsa-miR-1290 | 209723 | 211765 | Embryoid body cells |
| hsa-miR-1291 | 209724 | 211766 | Hepatocytes |
| hsa-miR-1292-3p | 209725 | 211767 | |
| hsa-miR-1292-5p | 209726 | 211768 | |
| hsa-miR-1293 | 209727 | 211769 | Embryonic stem cells |
| hsa-miR-1294 | 209728 | 211770 | Embryonic stem cells |
| hsa-miR-1295a | 209729 | 211771 | |
| hsa-miR-1295b-3p | 209730 | 211772 | |
| hsa-miR-1295b-5p | 209731 | 211773 | |
| hsa-miR-1296 | 209732 | 211774 | |
| hsa-miR-1297 | 209733 | 211775 | Embryonic stem cells |
| hsa-miR-1298 | 209734 | 211776 | |
| hsa-miR-1299 | 209735 | 211777 | Embryonic stem cells |
| hsa-miR-1301 | 209736 | 211778 | |
| hsa-miR-1302 | 209737 | 211779 | |
| hsa-miR-1303 | 209738 | 211780 | Hepatocyte |
| hsa-miR-1304-3p | 209739 | 211781 | |
| hsa-miR-1304-5p | 209740 | 211782 | |
| hsa-miR-1305 | 209741 | 211783 | Embryonic stem cells |
| hsa-miR-1306-3p | 209742 | 211784 | Embryonic stem cells |
| hsa-miR-1306-5p | 209743 | 211785 | Embryonic stem cells |
| hsa-miR-1307-3p | 209744 | 211786 | Embryonic stem cells |
| hsa-miR-1307-5p | 209745 | 211787 | Embryonic stem cells |
| hsa-miR-1321 | 209746 | 211788 | |
| hsa-miR-1322 | 209747 | 211789 | |
| hsa-miR-1323 | 209748 | 211790 | Placenta |
| hsa-miR-1324 | 209749 | 211791 | |
| hsa-miR-1343 | 209750 | 211792 | |
| hsa-miR-1468 | 209751 | 211793 | |
| hsa-miR-1469 | 209752 | 211794 | |
| hsa-miR-1470 | 209753 | 211795 | |
| hsa-miR-1471 | 209754 | 211796 | |
| hsa-miR-1537 | 209755 | 211797 | |
| hsa-miR-1538 | 209756 | 211798 | Blood |
| hsa-miR-1539 | 209757 | 211799 | Esophageal cell line KYSE-150R |
| hsa-miR-1587 | 209758 | 211800 | B-cells |
| hsa-miR-1825 | 209759 | 211801 | |
| hsa-miR-1827 | 209760 | 211802 | |
| hsa-miR-1908 | 209761 | 211803 | |
| hsa-miR-1909-3p | 209762 | 211804 | |
| hsa-miR-1909-5p | 209763 | 211805 | |
| hsa-miR-1910 | 209764 | 211806 | Embryonic stem cells |
| hsa-miR-1911-3p | 209765 | 211807 | Embryonic stem cells, neural precursor |
| hsa-miR-1911-5p | 209766 | 211808 | Embryonic stem cells, neural precursor |
| hsa-miR-1912 | 209767 | 211809 | Embryonic stem cells, neural precursor |
| hsa-miR-1913 | 209768 | 211810 | Embryonic stem cells |
| hsa-miR-1914-3p | 209769 | 211811 | Embryonic stem cells |
| hsa-miR-1914-5p | 209770 | 211812 | Embryonic stem cells |
| hsa-miR-1915-3p | 209771 | 211813 | Embryonic stem cells |
| hsa-miR-1915-5p | 209772 | 211814 | Embryonic stem cells |
| hsa-miR-1972 | 209773 | 211815 | |
| hsa-miR-1973 | 209774 | 211816 | |

TABLE 13-continued microRNA Sequences

| microRNA name | miR SEQ ID | miR BS SEQ ID | Types of Tissues and/or Cells |
|---|---|---|---|
| hsa-miR-1976 | 209775 | 211817 | |
| hsa-miR-2052 | 209776 | 211818 | |
| hsa-miR-2053 | 209777 | 211819 | |
| hsa-miR-2054 | 209778 | 211820 | |
| hsa-miR-2110 | 209779 | 211821 | |
| hsa-miR-2113 | 209780 | 211822 | Embryonic stem cells |
| hsa-miR-2114-3p | 209781 | 211823 | Ovary, female reproductive tract |
| hsa-miR-2114-5p | 209782 | 211824 | Ovary, female reproductive tract |
| hsa-miR-2115-3p | 209783 | 211825 | Female reproductive tract |
| hsa-miR-2115-5p | 209784 | 211826 | Female reproductive tract |
| hsa-miR-2116-3p | 209785 | 211827 | |
| hsa-miR-2116-5p | 209786 | 211828 | |
| hsa-miR-2117 | 209787 | 211829 | |
| hsa-miR-2276 | 209788 | 211830 | |
| hsa-miR-2277-3p | 209789 | 211831 | Female reproductive tract |
| hsa-miR-2277-5p | 209790 | 211832 | Female reproductive tract |
| hsa-miR-2278 | 209791 | 211833 | |
| hsa-miR-2355-3p | 209792 | 211834 | Embryonic stem cells |
| hsa-miR-2355-5p | 209793 | 211835 | Embryonic stem cells |
| hsa-miR-2392 | 209794 | 211836 | B-cells |
| hsa-miR-2467-3p | 209795 | 211837 | |
| hsa-miR-2467-5p | 209796 | 211838 | |
| hsa-miR-2681-3p | 209797 | 211839 | |
| hsa-miR-2681-5p | 209798 | 211840 | |
| hsa-miR-2682-3p | 209799 | 211841 | |
| hsa-miR-2682-5p | 209800 | 211842 | |
| hsa-miR-2861 | 209801 | 211843 | Osteoblasts |
| hsa-miR-2909 | 209802 | 211844 | T-Lymphocytes |
| hsa-miR-2964a-3p | 209803 | 211845 | |
| hsa-miR-2964a-5p | 209804 | 211846 | |
| hsa-miR-3064-3p | 209805 | 211847 | |
| hsa-miR-3064-5p | 209806 | 211848 | |
| hsa-miR-3065-3p | 209807 | 211849 | Oligodendrocytes |
| hsa-miR-3065-5p | 209808 | 211850 | Oligodendrocytes |
| hsa-miR-3074-3p | 209809 | 211851 | |
| hsa-miR-3074-5p | 209810 | 211852 | |
| hsa-miR-3115 | 209811 | 211853 | |
| hsa-miR-3116 | 209812 | 211854 | Melanoma miRNAome |
| hsa-miR-3117-3p | 209813 | 211855 | Melanoma miRNAome |
| hsa-miR-3117-5p | 209814 | 211856 | Melanoma miRNAome |
| hsa-miR-3118 | 209815 | 211857 | Melanoma miRNAome |
| hsa-miR-3119 | 209816 | 211858 | Melanoma miRNAome |
| hsa-miR-3120-3p | 209817 | 211859 | Melanoma miRNAome |
| hsa-miR-3120-5p | 209818 | 211860 | Melanoma miRNAome |
| hsa-miR-3121-3p | 209819 | 211861 | Melanoma miRNAome |
| hsa-miR-3121-5p | 209820 | 211862 | Melanoma miRNAome |
| hsa-miR-3122 | 209821 | 211863 | Melanoma miRNAome |
| hsa-miR-3123 | 209822 | 211864 | Melanoma miRNAome |
| hsa-miR-3124-3p | 209823 | 211865 | Melanoma miRNAome, ovary |
| hsa-miR-3124-5p | 209824 | 211866 | Melanoma miRNAome, ovary |
| hsa-miR-3125 | 209825 | 211867 | Melanoma miRNAome |
| hsa-miR-3126-3p | 209826 | 211868 | Melanoma miRNAome, ovary |
| hsa-miR-3126-5p | 209827 | 211869 | Melanoma miRNAome, ovary |
| hsa-miR-3127-3p | 209828 | 211870 | Melanoma miRNAome |
| hsa-miR-3127-5p | 209829 | 211871 | Melanoma miRNAome |
| hsa-miR-3128 | 209830 | 211872 | Melanoma miRNAome |
| hsa-miR-3129-3p | 209831 | 211873 | Melanoma miRNAome, ovary |
| hsa-miR-3129-5p | 209832 | 211874 | Melanoma miRNAome, ovary |
| hsa-miR-3130-3p | 209833 | 211875 | Melanoma miRNAome, ovary |
| hsa-miR-3130-5p | 209834 | 211876 | Melanoma miRNAome, ovary |
| hsa-miR-3131 | 209835 | 211877 | Melanoma miRNAome |
| hsa-miR-3132 | 209836 | 211878 | Melanoma miRNAome |
| hsa-miR-3133 | 209837 | 211879 | Melanoma miRNAome |
| hsa-miR-3134 | 209838 | 211880 | Melanoma miRNAome |
| hsa-miR-3135a | 209839 | 211881 | Melanoma miRNAome |
| hsa-miR-3135b | 209840 | 211882 | B cells |
| hsa-miR-3136-3p | 209841 | 211883 | Melanoma miRNAome |
| hsa-miR-3136-5p | 209842 | 211884 | Melanoma miRNAome |
| hsa-miR-3137 | 209843 | 211885 | Melanoma miRNAome |
| hsa-miR-3138 | 209844 | 211886 | Melanoma miRNAome, ovary |
| hsa-miR-3139 | 209845 | 211887 | Melanoma miRNAome |
| hsa-miR-3140-3p | 209846 | 211888 | Melanoma miRNAome, ovary |
| hsa-miR-3140-5p | 209847 | 211889 | Melanoma miRNAome, ovary |
| hsa-miR-3141 | 209848 | 211890 | Melanoma miRNAome |
| hsa-miR-3142 | 209849 | 211891 | Melanoma miRNAome; immune cells |
| hsa-miR-3143 | 209850 | 211892 | Melanoma miRNAome |

TABLE 13-continued microRNA Sequences

| microRNA name | miR SEQ ID | miR BS SEQ ID | Types of Tissues and/or Cells |
|---|---|---|---|
| hsa-miR-3144-3p | 209851 | 211893 | Melanoma miRNAome, ovary |
| hsa-miR-3144-5p | 209852 | 211894 | Melanoma miRNAome, ovary |
| hsa-miR-3145-3p | 209853 | 211895 | Melanoma miRNAome |
| hsa-miR-3145-5p | 209854 | 211896 | Melanoma miRNAome |
| hsa-miR-3146 | 209855 | 211897 | Melanoma miRNAome |
| hsa-miR-3147 | 209856 | 211898 | Melanoma miRNAome |
| hsa-miR-3148 | 209857 | 211899 | Melanoma miRNAome |
| hsa-miR-3149 | 209858 | 211900 | Melanoma miRNAome, ovary |
| hsa-miR-3150a-3p | 209859 | 211901 | Melanoma miRNAome |
| hsa-miR-3150a-5p | 209860 | 211902 | Melanoma miRNAome |
| hsa-miR-3150b-3p | 209861 | 211903 | Melanoma miRNAome |
| hsa-miR-3150b-5p | 209862 | 211904 | Melanoma miRNAome |
| hsa-miR-3151 | 209863 | 211905 | Melanoma miRNAome |
| hsa-miR-3152-3p | 209864 | 211906 | Melanoma miRNAome, ovary |
| hsa-miR-3152-5p | 209865 | 211907 | Melanoma miRNAome, ovary |
| hsa-miR-3153 | 209866 | 211908 | Melanoma miRNAome |
| hsa-miR-3154 | 209867 | 211909 | Melanoma miRNAome |
| hsa-miR-3155a | 209868 | 211910 | Melanoma miRNAome |
| hsa-miR-3155b | 209869 | 211911 | B cells |
| hsa-miR-3156-3p | 209870 | 211912 | Melanoma miRNAome |
| hsa-miR-3156-5p | 209871 | 211913 | Melanoma miRNAome |
| hsa-miR-3157-3p | 209872 | 211914 | Melanoma miRNAome |
| hsa-miR-3157-5p | 209873 | 211915 | Melanoma miRNAome |
| hsa-miR-3158-3p | 209874 | 211916 | Melanoma miRNAome, ovary |
| hsa-miR-3158-5p | 209875 | 211917 | Melanoma miRNAome, ovary |
| hsa-miR-3159 | 209876 | 211918 | Melanoma miRNAome |
| hsa-miR-3160-3p | 209877 | 211919 | Melanoma miRNAome |
| hsa-miR-3160-5p | 209878 | 211920 | Melanoma miRNAome |
| hsa-miR-3161 | 209879 | 211921 | Melanoma miRNAome |
| hsa-miR-3162-3p | 209880 | 211922 | Melanoma miRNAome |
| hsa-miR-3162-5p | 209881 | 211923 | Melanoma miRNAome |
| hsa-miR-3163 | 209882 | 211924 | Melanoma miRNAome |
| hsa-miR-3164 | 209883 | 211925 | Melanoma miRNAome |
| hsa-miR-3165 | 209884 | 211926 | Melanoma miRNAome |
| hsa-miR-3166 | 209885 | 211927 | Melanoma miRNAome |
| hsa-miR-3167 | 209886 | 211928 | Melanoma miRNAome, ovary |
| hsa-miR-3168 | 209887 | 211929 | Melanoma miRNAome |
| hsa-miR-3169 | 209888 | 211930 | Melanoma miRNAome |
| hsa-miR-3170 | 209889 | 211931 | Melanoma miRNAome |
| hsa-miR-3171 | 209890 | 211932 | Melanoma miRNAome, ovary |
| hsa-miR-3173-3p | 209891 | 211933 | Melanoma miRNAome |
| hsa-miR-3173-5p | 209892 | 211934 | Melanoma miRNAome |
| hsa-miR-3174 | 209893 | 211935 | Melanoma miRNAome |
| hsa-miR-3175 | 209894 | 211936 | Melanoma miRNAome, ovary |
| hsa-miR-3176 | 209895 | 211937 | Melanoma miRNAome |
| hsa-miR-3177-3p | 209896 | 211938 | Melanoma miRNAome |
| hsa-miR-3177-5p | 209897 | 211939 | Melanoma miRNAome |
| hsa-miR-3178 | 209898 | 211940 | Melanoma miRNAome |
| hsa-miR-3179 | 209899 | 211941 | Melanoma miRNAome |
| hsa-miR-3180 | 209900 | 211942 | Melanoma miRNAome, ovary |
| hsa-miR-3180-3p | 209901 | 211943 | Breast tumor |
| hsa-miR-3180-5p | 209902 | 211944 | Breast tumor |
| hsa-miR-3181 | 209903 | 211945 | Melanoma miRNAome |
| hsa-miR-3182 | 209904 | 211946 | Melanoma miRNAome |
| hsa-miR-3183 | 209905 | 211947 | Melanoma miRNAome |
| hsa-miR-3184-3p | 209906 | 211948 | Melanoma miRNAome |
| hsa-miR-3184-5p | 209907 | 211949 | Melanoma miRNAome |
| hsa-miR-3185 | 209908 | 211950 | Melanoma miRNAome |
| hsa-miR-3186-3p | 209909 | 211951 | Melanoma miRNAome, ovary |
| hsa-miR-3186-5p | 209910 | 211952 | Melanoma miRNAome, ovary |
| hsa-miR-3187-3p | 209911 | 211953 | Melanoma miRNAome |
| hsa-miR-3187-5p | 209912 | 211954 | Melanoma miRNAome |
| hsa-miR-3188 | 209913 | 211955 | Melanoma miRNAome |
| hsa-miR-3189-3p | 209914 | 211956 | Melanoma miRNAome |
| hsa-miR-3189-5p | 209915 | 211957 | Melanoma miRNAome |
| hsa-miR-3190-3p | 209916 | 211958 | Melanoma miRNAome |
| hsa-miR-3190-5p | 209917 | 211959 | Melanoma miRNAome |
| hsa-miR-3191-3p | 209918 | 211960 | Melanoma miRNAome |
| hsa-miR-3191-5p | 209919 | 211961 | Melanoma miRNAome |
| hsa-miR-3192 | 209920 | 211962 | Melanoma miRNAome |
| hsa-miR-3193 | 209921 | 211963 | Melanoma miRNAome |
| hsa-miR-3194-3p | 209922 | 211964 | Melanoma miRNAome |
| hsa-miR-3194-5p | 209923 | 211965 | Melanoma miRNAome |
| hsa-miR-3195 | 209924 | 211966 | Melanoma miRNAome |
| hsa-miR-3196 | 209925 | 211967 | |
| hsa-miR-3197 | 209926 | 211968 | Melanoma miRNAome |

TABLE 13-continued microRNA Sequences

| microRNA name | miR SEQ ID | miR BS SEQ ID | Types of Tissues and/or Cells |
|---|---|---|---|
| hsa-miR-3198 | 209927 | 211969 | Melanoma miRNAome |
| hsa-miR-3199 | 209928 | 211970 | Melanoma miRNAome |
| hsa-miR-3200-3p | 209929 | 211971 | Melanoma miRNAome, ovary |
| hsa-miR-3200-5p | 209930 | 211972 | Melanoma miRNAome, ovary |
| hsa-miR-3201 | 209931 | 211973 | Melanoma miRNAome, |
| hsa-miR-3202 | 209932 | 211974 | Melanoma miRNAome, epithelial cell BEAS2B |
| hsa-miR-3529-3p | 209933 | 211975 | Breast tumor |
| hsa-miR-3529-5p | 209934 | 211976 | Breast tumor |
| hsa-miR-3591-3p | 209935 | 211977 | Breast tumor |
| hsa-miR-3591-5p | 209936 | 211978 | Breast tumor |
| hsa-miR-3605-3p | 209937 | 211979 | Reproductive tracts |
| hsa-miR-3605-5p | 209938 | 211980 | Reproductive tracts |
| hsa-miR-3606-3p | 209939 | 211981 | Cervical tumors |
| hsa-miR-3606-5p | 209940 | 211982 | Cervical tumors |
| hsa-miR-3607-3p | 209941 | 211983 | Cervical tumors |
| hsa-miR-3607-5p | 209942 | 211984 | Cervical tumors |
| hsa-miR-3609 | 209943 | 211985 | Cervical tumors |
| hsa-miR-3610 | 209944 | 211986 | Cervical tumors |
| hsa-miR-3611 | 209945 | 211987 | Cervical tumors |
| hsa-miR-3612 | 209946 | 211988 | Cervical tumors |
| hsa-miR-3613-3p | 209947 | 211989 | Cervical tumors |
| hsa-miR-3613-5p | 209948 | 211990 | Cervical tumors |
| hsa-miR-3614-3p | 209949 | 211991 | Cervical and breast tumors |
| hsa-miR-3614-5p | 209950 | 211992 | Cervical and breast tumors |
| hsa-miR-3615 | 209951 | 211993 | Cervical tumors |
| hsa-miR-3616-3p | 209952 | 211994 | Cervical tumors |
| hsa-miR-3616-5p | 209953 | 211995 | Cervical tumors |
| hsa-miR-3617-3p | 209954 | 211996 | Cervical tumors and psoriasis |
| hsa-miR-3617-5p | 209955 | 211997 | Cervical tumors and psoriasis |
| hsa-miR-3618 | 209956 | 211998 | Cervical tumors |
| hsa-miR-3619-3p | 209957 | 211999 | Breast tumors |
| hsa-miR-3619-5p | 209958 | 212000 | Breast tumors |
| hsa-miR-3620-3p | 209959 | 212001 | Cervical tumors |
| hsa-miR-3620-5p | 209960 | 212002 | Cervical tumors |
| hsa-miR-3621 | 209961 | 212003 | Cervical tumors |
| hsa-miR-3622a-3p | 209962 | 212004 | Breast tumors |
| hsa-miR-3622a-5p | 209963 | 212005 | Breast tumors |
| hsa-miR-3622b-3p | 209964 | 212006 | Cervical tumors |
| hsa-miR-3622b-5p | 209965 | 212007 | Cervical tumors |
| hsa-miR-3646 | 209966 | 212008 | Solid tumor |
| hsa-miR-3648 | 209967 | 212009 | Solid tumor |
| hsa-miR-3649 | 209968 | 212010 | Solid tumor |
| hsa-miR-3650 | 209969 | 212011 | Solid tumor |
| hsa-miR-3651 | 209970 | 212012 | Solid tumor |
| hsa-miR-3652 | 209971 | 212013 | Solid tumor |
| hsa-miR-3653 | 209972 | 212014 | Solid tumor |
| hsa-miR-3654 | 209973 | 212015 | Solid tumor |
| hsa-miR-3655 | 209974 | 212016 | Solid tumor |
| hsa-miR-3656 | 209975 | 212017 | Solid tumor |
| hsa-miR-3657 | 209976 | 212018 | Solid tumor |
| hsa-miR-3658 | 209977 | 212019 | Solid tumor |
| hsa-miR-3659 | 209978 | 212020 | Breast tumors |
| hsa-miR-3660 | 209979 | 212021 | Breast tumors |
| hsa-miR-3661 | 209980 | 212022 | Breast tumors |
| hsa-miR-3662 | 209981 | 212023 | |
| hsa-miR-3663-3p | 209982 | 212024 | |
| hsa-miR-3663-5p | 209983 | 212025 | |
| hsa-miR-3664-3p | 209984 | 212026 | Breast tumors |
| hsa-miR-3664-5p | 209985 | 212027 | Breast tumors |
| hsa-miR-3665 | 209986 | 212028 | Brain |
| hsa-miR-3666 | 209987 | 212029 | Brain |
| hsa-miR-3667-3p | 209988 | 212030 | Peripheral blood |
| hsa-miR-3667-5p | 209989 | 212031 | Peripheral blood |
| hsa-miR-3668 | 209990 | 212032 | Peripheral blood |
| hsa-miR-3669 | 209991 | 212033 | Peripheral blood |
| hsa-miR-3670 | 209992 | 212034 | Peripheral blood |
| hsa-miR-3671 | 209993 | 212035 | Peripheral blood |
| hsa-miR-3672 | 209994 | 212036 | Peripheral blood |
| hsa-miR-3673 | 209995 | 212037 | Peripheral blood |
| hsa-miR-3674 | 209996 | 212038 | Peripheral blood |
| hsa-miR-3675-3p | 209997 | 212039 | Peripheral blood |
| hsa-miR-3675-5p | 209998 | 212040 | Peripheral blood |
| hsa-miR-3676-3p | 209999 | 212041 | Peripheral blood |
| hsa-miR-3676-5p | 210000 | 212042 | Peripheral blood |
| hsa-miR-3677-3p | 210001 | 212043 | Peripheral blood |
| hsa-miR-3677-5p | 210002 | 212044 | Peripheral blood |

TABLE 13-continued microRNA Sequences

| microRNA name | miR SEQ ID | miR BS SEQ ID | Types of Tissues and/or Cells |
|---|---|---|---|
| hsa-miR-3678-3p | 210003 | 212045 | Peripheral blood |
| hsa-miR-3678-5p | 210004 | 212046 | Peripheral blood |
| hsa-miR-3679-3p | 210005 | 212047 | Peripheral blood |
| hsa-miR-3679-5p | 210006 | 212048 | Peripheral blood |
| hsa-miR-3680-3p | 210007 | 212049 | Peripheral blood |
| hsa-miR-3680-5p | 210008 | 212050 | Peripheral blood |
| hsa-miR-3681-3p | 210009 | 212051 | Peripheral blood |
| hsa-miR-3681-5p | 210010 | 212052 | Peripheral blood |
| hsa-miR-3682-3p | 210011 | 212053 | Peripheral blood |
| hsa-miR-3682-5p | 210012 | 212054 | Peripheral blood |
| hsa-miR-3683 | 210013 | 212055 | Peripheral blood |
| hsa-miR-3684 | 210014 | 212056 | Peripheral blood |
| hsa-miR-3685 | 210015 | 212057 | Peripheral blood |
| hsa-miR-3686 | 210016 | 212058 | Peripheral blood |
| hsa-miR-3687 | 210017 | 212059 | Peripheral blood |
| hsa-miR-3688-3p | 210018 | 212060 | Breast tumor |
| hsa-miR-3688-5p | 210019 | 212061 | Breast tumor |
| hsa-miR-3689a-3p | 210020 | 212062 | Female reproductive tract |
| hsa-miR-3689a-5p | 210021 | 212063 | Female reproductive tract and peripheral blood |
| hsa-miR-3689b-3p | 210022 | 212064 | Female reproductive tract and peripheral blood |
| hsa-miR-3689b-5p | 210023 | 212065 | Female reproductive tract |
| hsa-miR-3689c | 210024 | 212066 | B cells |
| hsa-miR-3689d | 210025 | 212067 | B cells |
| hsa-miR-3689e | 210026 | 212068 | B cells |
| hsa-miR-3689f | 210027 | 212069 | B cells |
| hsa-miR-3690 | 210028 | 212070 | Peripheral blood |
| hsa-miR-3691-3p | 210029 | 212071 | Peripheral blood |
| hsa-miR-3691-5p | 210030 | 212072 | Peripheral blood |
| hsa-miR-3692-3p | 210031 | 212073 | Peripheral blood |
| hsa-miR-3692-5p | 210032 | 212074 | Peripheral blood |
| hsa-miR-3713 | 210033 | 212075 | Neuroblastoma |
| hsa-miR-3714 | 210034 | 212076 | Neuroblastoma |
| hsa-miR-3907 | 210035 | 212077 | Female reproductive tract |
| hsa-miR-3908 | 210036 | 212078 | Female reproductive tract |
| hsa-miR-3909 | 210037 | 212079 | Female reproductive tract |
| hsa-miR-3910 | 210038 | 212080 | Female reproductive tract |
| hsa-miR-3911 | 210039 | 212081 | Breast tumor and female reproductive tract |
| hsa-miR-3912 | 210040 | 212082 | Female reproductive tract |
| hsa-miR-3913-3p | 210041 | 212083 | Breast tumor and female reproductive tract |
| hsa-miR-3913-5p | 210042 | 212084 | Breast tumor and female reproductive tract |
| hsa-miR-3914 | 210043 | 212085 | Breast tumor and female reproductive tract |
| hsa-miR-3915 | 210044 | 212086 | Female reproductive tract |
| hsa-miR-3916 | 210045 | 212087 | Female reproductive tract |
| hsa-miR-3917 | 210046 | 212088 | Female reproductive tract |
| hsa-miR-3918 | 210047 | 212089 | Female reproductive tract |
| hsa-miR-3919 | 210048 | 212090 | Female reproductive tract |
| hsa-miR-3920 | 210049 | 212091 | Female reproductive tract |
| hsa-miR-3921 | 210050 | 212092 | Female reproductive tract |
| hsa-miR-3922-3p | 210051 | 212093 | Breast tumor and female reproductive tract |
| hsa-miR-3922-5p | 210052 | 212094 | Breast tumor and female reproductive tract |
| hsa-miR-3923 | 210053 | 212095 | Female reproductive tract |
| hsa-miR-3924 | 210054 | 212096 | Female reproductive tract |
| hsa-miR-3925-3p | 210055 | 212097 | Breast tumor and female reproductive tract |
| hsa-miR-3925-5p | 210056 | 212098 | Breast tumor and female reproductive tract |
| hsa-miR-3926 | 210057 | 212099 | Female reproductive tract |
| hsa-miR-3927-3p | 210058 | 212100 | Female reproductive tract and psoriasis |
| hsa-miR-3927-5p | 210059 | 212101 | Female reproductive tract and psoriasis |
| hsa-miR-3928 | 210060 | 212102 | Female reproductive tract |
| hsa-miR-3929 | 210061 | 212103 | Female reproductive tract |
| hsa-miR-3934-3p | 210062 | 212104 | Abnormal skin (psoriasis) |
| hsa-miR-3934-5p | 210063 | 212105 | Abnormal skin (psoriasis) |
| hsa-miR-3935 | 210064 | 212106 | |
| hsa-miR-3936 | 210065 | 212107 | Breast tumor and lymphoblastic leukemia |
| hsa-miR-3937 | 210066 | 212108 | |
| hsa-miR-3938 | 210067 | 212109 | |
| hsa-miR-3939 | 210068 | 212110 | |
| hsa-miR-3940-3p | 210069 | 212111 | Breast tumor |
| hsa-miR-3940-5p | 210070 | 212112 | Breast tumor |
| hsa-miR-3941 | 210071 | 212113 | |
| hsa-miR-3942-3p | 210072 | 212114 | Breast tumor and lymphoblastic leukemia |
| hsa-miR-3942-5p | 210073 | 212115 | Breast tumor and lymphoblastic leukemia |
| hsa-miR-3943 | 210074 | 212116 | |
| hsa-miR-3944-3p | 210075 | 212117 | Breast tumor |
| hsa-miR-3944-5p | 210076 | 212118 | Breast tumor |
| hsa-miR-3945 | 210077 | 212119 | |
| hsa-miR-3960 | 210078 | 212120 | Osteoblast |

TABLE 13-continued microRNA Sequences

| microRNA name | miR SEQ ID | miR BS SEQ ID | Types of Tissues and/or Cells |
|---|---|---|---|
| hsa-miR-3972 | 210079 | 212121 | Acute Myeloid Leukemia |
| hsa-miR-3973 | 210080 | 212122 | Acute Myeloid Leukemia |
| hsa-miR-3974 | 210081 | 212123 | Acute Myeloid Leukemia |
| hsa-miR-3975 | 210082 | 212124 | Acute Myeloid Leukemia |
| hsa-miR-3976 | 210083 | 212125 | Acute Myeloid Leukemia |
| hsa-miR-3977 | 210084 | 212126 | Acute Myeloid Leukemia |
| hsa-miR-3978 | 210085 | 212127 | Acute Myeloid Leukemia |
| hsa-miR-4251 | 210086 | 212128 | Embryonic stem cells and neural precursors |
| hsa-miR-4252 | 210087 | 212129 | Embryonic stem cells and neural precursors |
| hsa-miR-4253 | 210088 | 212130 | Embryonic stem cells and neural precursors |
| hsa-miR-4254 | 210089 | 212131 | Embryonic stem cells and neural precursors |
| hsa-miR-4255 | 210090 | 212132 | Embryonic stem cells and neural precursors |
| hsa-miR-4256 | 210091 | 212133 | Embryonic stem cells and neural precursors |
| hsa-miR-4257 | 210092 | 212134 | Embryonic stem cells and neural precursors |
| hsa-miR-4258 | 210093 | 212135 | Embryonic stem cells and neural precursors |
| hsa-miR-4259 | 210094 | 212136 | Embryonic stem cells and neural precursors |
| hsa-miR-4260 | 210095 | 212137 | Embryonic stem cells and neural precursors |
| hsa-miR-4261 | 210096 | 212138 | Embryonic stem cells and neural precursors |
| hsa-miR-4262 | 210097 | 212139 | Embryonic stem cells and neural precursors |
| hsa-miR-4263 | 210098 | 212140 | Embryonic stem cells and neural precursors |
| hsa-miR-4264 | 210099 | 212141 | Embryonic stem cells and neural precursors |
| hsa-miR-4265 | 210100 | 212142 | Embryonic stem cells and neural precursors |
| hsa-miR-4266 | 210101 | 212143 | Embryonic stem cells and neural precursors |
| hsa-miR-4267 | 210102 | 212144 | Embryonic stem cells and neural precursors |
| hsa-miR-4268 | 210103 | 212145 | Embryonic stem cells and neural precursors |
| hsa-miR-4269 | 210104 | 212146 | Embryonic stem cells and neural precursors |
| hsa-miR-4270 | 210105 | 212147 | Embryonic stem cells and neural precursors |
| hsa-miR-4271 | 210106 | 212148 | Embryonic stem cells and neural precursors |
| hsa-miR-4272 | 210107 | 212149 | Embryonic stem cells and neural precursors |
| hsa-miR-4273 | 210108 | 212150 | |
| hsa-miR-4274 | 210109 | 212151 | Embryonic stem cells and neural precursors |
| hsa-miR-4275 | 210110 | 212152 | Embryonic stem cells and neural precursors |
| hsa-miR-4276 | 210111 | 212153 | Embryonic stem cells and neural precursors |
| hsa-miR-4277 | 210112 | 212154 | Embryonic stem cells and neural precursors |
| hsa-miR-4278 | 210113 | 212155 | Embryonic stem cells and neural precursors |
| hsa-miR-4279 | 210114 | 212156 | Embryonic stem cells and neural precursors |
| hsa-miR-4280 | 210115 | 212157 | Embryonic stem cells and neural precursors |
| hsa-miR-4281 | 210116 | 212158 | Embryonic stem cells and neural precursors |
| hsa-miR-4282 | 210117 | 212159 | Embryonic stem cells and neural precursors |
| hsa-miR-4283 | 210118 | 212160 | Embryonic stem cells and neural precursors |
| hsa-miR-4284 | 210119 | 212161 | Embryonic stem cells and neural precursors |
| hsa-miR-4285 | 210120 | 212162 | Embryonic stem cells and neural precursors |
| hsa-miR-4286 | 210121 | 212163 | Embryonic stem cells and neural precursors |
| hsa-miR-4287 | 210122 | 212164 | Embryonic stem cells and neural precursors |
| hsa-miR-4288 | 210123 | 212165 | Embryonic stem cells and neural precursors |
| hsa-miR-4289 | 210124 | 212166 | Embryonic stem cells and neural precursors |
| hsa-miR-4290 | 210125 | 212167 | Embryonic stem cells and neural precursors |
| hsa-miR-4291 | 210126 | 212168 | Embryonic stem cells and neural precursors |
| hsa-miR-4292 | 210127 | 212169 | Embryonic stem cells and neural precursors |
| hsa-miR-4293 | 210128 | 212170 | Embryonic stem cells and neural precursors |
| hsa-miR-4294 | 210129 | 212171 | Embryonic stem cells and neural precursors |
| hsa-miR-4295 | 210130 | 212172 | Embryonic stem cells and neural precursors |
| hsa-miR-4296 | 210131 | 212173 | Embryonic stem cells and neural precursors |
| hsa-miR-4297 | 210132 | 212174 | Embryonic stem cells and neural precursors |
| hsa-miR-4298 | 210133 | 212175 | Embryonic stem cells and neural precursors |
| hsa-miR-4299 | 210134 | 212176 | Embryonic stem cells and neural precursors |
| hsa-miR-4300 | 210135 | 212177 | Embryonic stem cells and neural precursors |
| hsa-miR-4301 | 210136 | 212178 | Embryonic stem cells and neural precursors |
| hsa-miR-4302 | 210137 | 212179 | Embryonic stem cells and neural precursors |
| hsa-miR-4303 | 210138 | 212180 | Embryonic stem cells and neural precursors |
| hsa-miR-4304 | 210139 | 212181 | Embryonic stem cells and neural precursors |
| hsa-miR-4305 | 210140 | 212182 | Embryonic stem cells and neural precursors |
| hsa-miR-4306 | 210141 | 212183 | Embryonic stem cells and neural precursors |
| hsa-miR-4307 | 210142 | 212184 | Embryonic stem cells and neural precursors |
| hsa-miR-4308 | 210143 | 212185 | Embryonic stem cells and neural precursors |
| hsa-miR-4309 | 210144 | 212186 | Embryonic stem cells and neural precursors |
| hsa-miR-4310 | 210145 | 212187 | Embryonic stem cells and neural precursors |
| hsa-miR-4311 | 210146 | 212188 | Embryonic stem cells and neural precursors |
| hsa-miR-4312 | 210147 | 212189 | Embryonic stem cells and neural precursors |
| hsa-miR-4313 | 210148 | 212190 | Embryonic stem cells and neural precursors |
| hsa-miR-4314 | 210149 | 212191 | Embryonic stem cells and neural precursors |
| hsa-miR-4315 | 210150 | 212192 | Embryonic stem cells and neural precursors |
| hsa-miR-4316 | 210151 | 212193 | Embryonic stem cells and neural precursors |
| hsa-miR-4317 | 210152 | 212194 | Embryonic stem cells and neural precursors |
| hsa-miR-4318 | 210153 | 212195 | Embryonic stem cells and neural precursors |
| hsa-miR-4319 | 210154 | 212196 | Embryonic stem cells and neural precursors |

TABLE 13-continued microRNA Sequences

| microRNA name | miR SEQ ID | miR BS SEQ ID | Types of Tissues and/or Cells |
|---|---|---|---|
| hsa-miR-4320 | 210155 | 212197 | Embryonic stem cells and neural precursors |
| hsa-miR-4321 | 210156 | 212198 | Embryonic stem cells and neural precursors |
| hsa-miR-4322 | 210157 | 212199 | Embryonic stem cells and neural precursors |
| hsa-miR-4323 | 210158 | 212200 | Embryonic stem cells and neural precursors |
| hsa-miR-4324 | 210159 | 212201 | Embryonic stem cells and neural precursors |
| hsa-miR-4325 | 210160 | 212202 | Embryonic stem cells and neural precursors |
| hsa-miR-4326 | 210161 | 212203 | Embryonic stem cells and neural precursors |
| hsa-miR-4327 | 210162 | 212204 | Embryonic stem cells and neural precursors |
| hsa-miR-4328 | 210163 | 212205 | Embryonic stem cells and neural precursors |
| hsa-miR-4329 | 210164 | 212206 | Embryonic stem cells and neural precursors |
| hsa-miR-4330 | 210165 | 212207 | Embryonic stem cells and neural precursors |
| hsa-miR-4417 | 210166 | 212208 | B cells |
| hsa-miR-4418 | 210167 | 212209 | B cells |
| hsa-miR-4419a | 210168 | 212210 | B cells |
| hsa-miR-4419b | 210169 | 212211 | B cells |
| hsa-miR-4420 | 210170 | 212212 | B cells |
| hsa-miR-4421 | 210171 | 212213 | B cells |
| hsa-miR-4422 | 210172 | 212214 | Breast tumor and B cells |
| hsa-miR-4423-3p | 210173 | 212215 | Breast tumor, B cells and skin (psoriasis) |
| hsa-miR-4423-5p | 210174 | 212216 | Breast tumor B cells and skin (psoriasis) |
| hsa-miR-4424 | 210175 | 212217 | B cells |
| hsa-miR-4425 | 210176 | 212218 | B cells |
| hsa-miR-4426 | 210177 | 212219 | B cells |
| hsa-miR-4427 | 210178 | 212220 | B cells |
| hsa-miR-4428 | 210179 | 212221 | B cells |
| hsa-miR-4429 | 210180 | 212222 | B cells |
| hsa-miR-4430 | 210181 | 212223 | B cells |
| hsa-miR-4431 | 210182 | 212224 | B cells |
| hsa-miR-4432 | 210183 | 212225 | B cells |
| hsa-miR-4433-3p | 210184 | 212226 | B cells |
| hsa-miR-4433-5p | 210185 | 212227 | B cells |
| hsa-miR-4434 | 210186 | 212228 | B cells |
| hsa-miR-4435 | 210187 | 212229 | B cells |
| hsa-miR-4436a | 210188 | 212230 | Breast tumor and B cells |
| hsa-miR-4436b-3p | 210189 | 212231 | Breast tumor |
| hsa-miR-4436b-5p | 210190 | 212232 | Breast tumor |
| hsa-miR-4437 | 210191 | 212233 | B cells |
| hsa-miR-4438 | 210192 | 212234 | B cells |
| hsa-miR-4439 | 210193 | 212235 | B cells |
| hsa-miR-4440 | 210194 | 212236 | B cells |
| hsa-miR-4441 | 210195 | 212237 | B cells |
| hsa-miR-4442 | 210196 | 212238 | B cells |
| hsa-miR-4443 | 210197 | 212239 | B cells |
| hsa-miR-4444 | 210198 | 212240 | B cells |
| hsa-miR-4445-3p | 210199 | 212241 | B cells |
| hsa-miR-4445-5p | 210200 | 212242 | B cells |
| hsa-miR-4446-3p | 210201 | 212243 | Breast tumor and B cells |
| hsa-miR-4446-5p | 210202 | 212244 | Breast tumor and B cells |
| hsa-miR-4447 | 210203 | 212245 | B cells |
| hsa-miR-4448 | 210204 | 212246 | B cells |
| hsa-miR-4449 | 210205 | 212247 | B cells |
| hsa-miR-4450 | 210206 | 212248 | B cells |
| hsa-miR-4451 | 210207 | 212249 | B cells |
| hsa-miR-4452 | 210208 | 212250 | B cells |
| hsa-miR-4453 | 210209 | 212251 | B cells |
| hsa-miR-4454 | 210210 | 212252 | B cells |
| hsa-miR-4455 | 210211 | 212253 | B cells |
| hsa-miR-4456 | 210212 | 212254 | B cells |
| hsa-miR-4457 | 210213 | 212255 | B cells |
| hsa-miR-4458 | 210214 | 212256 | B cells |
| hsa-miR-4459 | 210215 | 212257 | B cells |
| hsa-miR-4460 | 210216 | 212258 | B cells |
| hsa-miR-4461 | 210217 | 212259 | B cells |
| hsa-miR-4462 | 210218 | 212260 | B cells |
| hsa-miR-4463 | 210219 | 212261 | B cells |
| hsa-miR-4464 | 210220 | 212262 | B cells |
| hsa-miR-4465 | 210221 | 212263 | B cells |
| hsa-miR-4466 | 210222 | 212264 | B cells |
| hsa-miR-4467 | 210223 | 212265 | Breast tumor and B cells |
| hsa-miR-4468 | 210224 | 212266 | B cells |
| hsa-miR-4469 | 210225 | 212267 | Breast tumor and B cells |
| hsa-miR-4470 | 210226 | 212268 | B cells |
| hsa-miR-4471 | 210227 | 212269 | Breast tumor and B cells |
| hsa-miR-4472 | 210228 | 212270 | B cells |
| hsa-miR-4473 | 210229 | 212271 | B cells |
| hsa-miR-4474-3p | 210230 | 212272 | Breast tumor, lymphoblastic leukemia and B cells |

TABLE 13-continued microRNA Sequences

| microRNA name | miR SEQ ID | miR BS SEQ ID | Types of Tissues and/or Cells |
|---|---|---|---|
| hsa-miR-4474-5p | 210231 | 212273 | Breast tumor, lymphoblastic leukemia and B cells |
| hsa-miR-4475 | 210232 | 212274 | B cells |
| hsa-miR-4476 | 210233 | 212275 | B cells |
| hsa-miR-4477a | 210234 | 212276 | B cells |
| hsa-miR-4477b | 210235 | 212277 | B cells |
| hsa-miR-4478 | 210236 | 212278 | B cells |
| hsa-miR-4479 | 210237 | 212279 | B cells |
| hsa-miR-4480 | 210238 | 212280 | B cells |
| hsa-miR-4481 | 210239 | 212281 | B cells |
| hsa-miR-4482-3p | 210240 | 212282 | B cells |
| hsa-miR-4482-5p | 210241 | 212283 | B cells |
| hsa-miR-4483 | 210242 | 212284 | B cells |
| hsa-miR-4484 | 210243 | 212285 | B cells |
| hsa-miR-4485 | 210244 | 212286 | B cells |
| hsa-miR-4486 | 210245 | 212287 | B cells |
| hsa-miR-4487 | 210246 | 212288 | B cells |
| hsa-miR-4488 | 210247 | 212289 | B cells |
| hsa-miR-4489 | 210248 | 212290 | Breast tumor and B cells |
| hsa-miR-4490 | 210249 | 212291 | B cells |
| hsa-miR-4491 | 210250 | 212292 | B cells |
| hsa-miR-4492 | 210251 | 212293 | B cells |
| hsa-miR-4493 | 210252 | 212294 | B cells |
| hsa-miR-4494 | 210253 | 212295 | B cells |
| hsa-miR-4495 | 210254 | 212296 | B cells |
| hsa-miR-4496 | 210255 | 212297 | B cells |
| hsa-miR-4497 | 210256 | 212298 | B cells |
| hsa-miR-4498 | 210257 | 212299 | B cells |
| hsa-miR-4499 | 210258 | 212300 | B cells |
| hsa-miR-4500 | 210259 | 212301 | B cells |
| hsa-miR-4501 | 210260 | 212302 | B cells |
| hsa-miR-4502 | 210261 | 212303 | B cells |
| hsa-miR-4503 | 210262 | 212304 | B cells |
| hsa-miR-4504 | 210263 | 212305 | B cells |
| hsa-miR-4505 | 210264 | 212306 | B cells |
| hsa-miR-4506 | 210265 | 212307 | B cells |
| hsa-miR-4507 | 210266 | 212308 | B cells |
| hsa-miR-4508 | 210267 | 212309 | B cells |
| hsa-miR-4509 | 210268 | 212310 | B cells |
| hsa-miR-4510 | 210269 | 212311 | B cells |
| hsa-miR-4511 | 210270 | 212312 | B cells |
| hsa-miR-4512 | 210271 | 212313 | B cells |
| hsa-miR-4513 | 210272 | 212314 | B cells |
| hsa-miR-4514 | 210273 | 212315 | B cells |
| hsa-miR-4515 | 210274 | 212316 | B cells |
| hsa-miR-4516 | 210275 | 212317 | B cells |
| hsa-miR-4517 | 210276 | 212318 | B cells |
| hsa-miR-4518 | 210277 | 212319 | B cells |
| hsa-miR-4519 | 210278 | 212320 | B cells |
| hsa-miR-4520a-3p | 210279 | 212321 | Breast tumor and B cells, skin (psoriasis) |
| hsa-miR-4520a-5p | 210280 | 212322 | Breast tumor and B cells, skin (psoriasis) |
| hsa-miR-4520b-3p | 210281 | 212323 | Breast tumor |
| hsa-miR-4520b-5p | 210282 | 212324 | Breast tumor |
| hsa-miR-4521 | 210283 | 212325 | B cells |
| hsa-miR-4522 | 210284 | 212326 | B cells |
| hsa-miR-4523 | 210285 | 212327 | B cells |
| hsa-miR-4524a-3p | 210286 | 212328 | Breast tumor and B cells, skin (psoriasis) |
| hsa-miR-4524a-5p | 210287 | 212329 | Breast tumor and B cells, skin (psoriasis) |
| hsa-miR-4524b-3p | 210288 | 212330 | Breast tumor and B cells, skin (psoriasis) |
| hsa-miR-4524b-5p | 210289 | 212331 | Breast tumor and B cells, skin (psoriasis) |
| hsa-miR-4525 | 210290 | 212332 | B cells |
| hsa-miR-4526 | 210291 | 212333 | Breast tumor and B cells |
| hsa-miR-4527 | 210292 | 212334 | B cells |
| hsa-miR-4528 | 210293 | 212335 | B cells |
| hsa-miR-4529-3p | 210294 | 212336 | Breast tumor and B cells |
| hsa-miR-4529-5p | 210295 | 212337 | Breast tumor and B cells |
| hsa-miR-4530 | 210296 | 212338 | B cells |
| hsa-miR-4531 | 210297 | 212339 | B cells |
| hsa-miR-4532 | 210298 | 212340 | B cells |
| hsa-miR-4533 | 210299 | 212341 | B cells |
| hsa-miR-4534 | 210300 | 212342 | B cells |
| hsa-miR-4535 | 210301 | 212343 | B cells |
| hsa-miR-4536-3p | 210302 | 212344 | B cells |
| hsa-miR-4536-5p | 210303 | 212345 | B cells |
| hsa-miR-4537 | 210304 | 212346 | B cells |
| hsa-miR-4538 | 210305 | 212347 | B cells |
| hsa-miR-4539 | 210306 | 212348 | B cells |

TABLE 13-continued microRNA Sequences

| microRNA name | miR SEQ ID | miR BS SEQ ID | Types of Tissues and/or Cells |
|---|---|---|---|
| hsa-miR-4540 | 210307 | 212349 | B cells |
| hsa-miR-4632-3p | 210308 | 212350 | Breast tumor |
| hsa-miR-4632-5p | 210309 | 212351 | Breast tumor |
| hsa-miR-4633-3p | 210310 | 212352 | Breast tumor |
| hsa-miR-4633-5p | 210311 | 212353 | Breast tumor |
| hsa-miR-4634 | 210312 | 212354 | Breast tumor |
| hsa-miR-4635 | 210313 | 212355 | Breast tumor |
| hsa-miR-4636 | 210314 | 212356 | Breast tumor |
| hsa-miR-4637 | 210315 | 212357 | Breast tumor and lymphoblastic leukemia |
| hsa-miR-4638-3p | 210316 | 212358 | Breast tumor |
| hsa-miR-4638-5p | 210317 | 212359 | Breast tumor |
| hsa-miR-4639-3p | 210318 | 212360 | Breast tumor |
| hsa-miR-4639-5p | 210319 | 212361 | Breast tumor |
| hsa-miR-4640-3p | 210320 | 212362 | Breast tumor |
| hsa-miR-4640-5p | 210321 | 212363 | Breast tumor |
| hsa-miR-4641 | 210322 | 212364 | Breast tumor |
| hsa-miR-4642 | 210323 | 212365 | Breast tumor |
| hsa-miR-4643 | 210324 | 212366 | Breast tumor |
| hsa-miR-4644 | 210325 | 212367 | Breast tumor |
| hsa-miR-4645-3p | 210326 | 212368 | Breast tumor |
| hsa-miR-4645-5p | 210327 | 212369 | Breast tumor |
| hsa-miR-4646-3p | 210328 | 212370 | Breast tumor |
| hsa-miR-4646-5p | 210329 | 212371 | Breast tumor |
| hsa-miR-4647 | 210330 | 212372 | Breast tumor |
| hsa-miR-4648 | 210331 | 212373 | Breast tumor |
| hsa-miR-4649-3p | 210332 | 212374 | Breast tumor |
| hsa-miR-4649-5p | 210333 | 212375 | Breast tumor |
| hsa-miR-4650-3p | 210334 | 212376 | Breast tumor |
| hsa-miR-4650-5p | 210335 | 212377 | Breast tumor |
| hsa-miR-4651 | 210336 | 212378 | Breast tumor |
| hsa-miR-4652-3p | 210337 | 212379 | Breast tumor |
| hsa-miR-4652-5p | 210338 | 212380 | Breast tumor |
| hsa-miR-4653-3p | 210339 | 212381 | Breast tumor |
| hsa-miR-4653-5p | 210340 | 212382 | Breast tumor |
| hsa-miR-4654 | 210341 | 212383 | Breast tumor |
| hsa-miR-4655-3p | 210342 | 212384 | Breast tumor |
| hsa-miR-4655-5p | 210343 | 212385 | Breast tumor |
| hsa-miR-4656 | 210344 | 212386 | Breast tumor |
| hsa-miR-4657 | 210345 | 212387 | Breast tumor |
| hsa-miR-4658 | 210346 | 212388 | Breast tumor |
| hsa-miR-4659a-3p | 210347 | 212389 | Breast tumor |
| hsa-miR-4659a-5p | 210348 | 212390 | Breast tumor |
| hsa-miR-4659b-3p | 210349 | 212391 | Breast tumor |
| hsa-miR-4659b-5p | 210350 | 212392 | Breast tumor |
| hsa-miR-4660 | 210351 | 212393 | Breast tumor |
| hsa-miR-4661-3p | 210352 | 212394 | Breast tumor |
| hsa-miR-4661-5p | 210353 | 212395 | Breast tumor |
| hsa-miR-4662a-3p | 210354 | 212396 | Breast tumor, psoriasis |
| hsa-miR-4662a-5p | 210355 | 212397 | Breast tumor, psoriasis |
| hsa-miR-4662b | 210356 | 212398 | Breast tumor |
| hsa-miR-4663 | 210357 | 212399 | Breast tumor |
| hsa-miR-4664-3p | 210358 | 212400 | Breast tumor |
| hsa-miR-4664-5p | 210359 | 212401 | Breast tumor |
| hsa-miR-4665-3p | 210360 | 212402 | Breast tumor |
| hsa-miR-4665-5p | 210361 | 212403 | Breast tumor |
| hsa-miR-4666a-3p | 210362 | 212404 | Breast tumor |
| hsa-miR-4666a-5p | 210363 | 212405 | Breast tumor |
| hsa-miR-4666b | 210364 | 212406 | |
| hsa-miR-4667-3p | 210365 | 212407 | Breast tumor |
| hsa-miR-4667-5p | 210366 | 212408 | Breast tumor |
| hsa-miR-4668-3p | 210367 | 212409 | Breast tumor |
| hsa-miR-4668-5p | 210368 | 212410 | Breast tumor |
| hsa-miR-4669 | 210369 | 212411 | Breast tumor |
| hsa-miR-4670-3p | 210370 | 212412 | Breast tumor |
| hsa-miR-4670-5p | 210371 | 212413 | Breast tumor |
| hsa-miR-4671-3p | 210372 | 212414 | Breast tumor |
| hsa-miR-4671-5p | 210373 | 212415 | Breast tumor |
| hsa-miR-4672 | 210374 | 212416 | Breast tumor |
| hsa-miR-4673 | 210375 | 212417 | Breast tumor |
| hsa-miR-4674 | 210376 | 212418 | Breast tumor |
| hsa-miR-4675 | 210377 | 212419 | Breast tumor |
| hsa-miR-4676-3p | 210378 | 212420 | Breast tumor |
| hsa-miR-4676-5p | 210379 | 212421 | Breast tumor |
| hsa-miR-4677-3p | 210380 | 212422 | Breast tumor, psoriasis |
| hsa-miR-4677-5p | 210381 | 212423 | Breast tumor, psoriasis |
| hsa-miR-4678 | 210382 | 212424 | Breast tumor |

TABLE 13-continued microRNA Sequences

| microRNA name | miR SEQ ID | miR BS SEQ ID | Types of Tissues and/or Cells |
|---|---|---|---|
| hsa-miR-4679 | 210383 | 212425 | Breast tumor |
| hsa-miR-4680-3p | 210384 | 212426 | Breast tumor |
| hsa-miR-4680-5p | 210385 | 212427 | Breast tumor |
| hsa-miR-4681 | 210386 | 212428 | Breast tumor |
| hsa-miR-4682 | 210387 | 212429 | Breast tumor |
| hsa-miR-4683 | 210388 | 212430 | Breast tumor |
| hsa-miR-4684-3p | 210389 | 212431 | Breast tumor |
| hsa-miR-4684-5p | 210390 | 212432 | Breast tumor |
| hsa-miR-4685-3p | 210391 | 212433 | Breast tumor |
| hsa-miR-4685-5p | 210392 | 212434 | Breast tumor |
| hsa-miR-4686 | 210393 | 212435 | Breast tumor |
| hsa-miR-4687-3p | 210394 | 212436 | Breast tumor |
| hsa-miR-4687-5p | 210395 | 212437 | Breast tumor |
| hsa-miR-4688 | 210396 | 212438 | Breast tumor |
| hsa-miR-4689 | 210397 | 212439 | Breast tumor |
| hsa-miR-4690-3p | 210398 | 212440 | Breast tumor |
| hsa-miR-4690-5p | 210399 | 212441 | Breast tumor |
| hsa-miR-4691-3p | 210400 | 212442 | Breast tumor |
| hsa-miR-4691-5p | 210401 | 212443 | Breast tumor |
| hsa-miR-4692 | 210402 | 212444 | Breast tumor |
| hsa-miR-4693-3p | 210403 | 212445 | Breast tumor |
| hsa-miR-4693-5p | 210404 | 212446 | Breast tumor |
| hsa-miR-4694-3p | 210405 | 212447 | Breast tumor |
| hsa-miR-4694-5p | 210406 | 212448 | Breast tumor |
| hsa-miR-4695-3p | 210407 | 212449 | Breast tumor |
| hsa-miR-4695-5p | 210408 | 212450 | Breast tumor |
| hsa-miR-4696 | 210409 | 212451 | Breast tumor |
| hsa-miR-4697-3p | 210410 | 212452 | Breast tumor |
| hsa-miR-4697-5p | 210411 | 212453 | Breast tumor |
| hsa-miR-4698 | 210412 | 212454 | Breast tumor |
| hsa-miR-4699-3p | 210413 | 212455 | Breast tumor |
| hsa-miR-4699-5p | 210414 | 212456 | Breast tumor |
| hsa-miR-4700-3p | 210415 | 212457 | Breast tumor |
| hsa-miR-4700-5p | 210416 | 212458 | Breast tumor |
| hsa-miR-4701-3p | 210417 | 212459 | Breast tumor |
| hsa-miR-4701-5p | 210418 | 212460 | Breast tumor |
| hsa-miR-4703-3p | 210419 | 212461 | Breast tumor |
| hsa-miR-4703-5p | 210420 | 212462 | Breast tumor |
| hsa-miR-4704-3p | 210421 | 212463 | Breast tumor |
| hsa-miR-4704-5p | 210422 | 212464 | Breast tumor |
| hsa-miR-4705 | 210423 | 212465 | Breast tumor |
| hsa-miR-4706 | 210424 | 212466 | Breast tumor |
| hsa-miR-4707-3p | 210425 | 212467 | Breast tumor |
| hsa-miR-4707-5p | 210426 | 212468 | Breast tumor |
| hsa-miR-4708-3p | 210427 | 212469 | Breast tumor |
| hsa-miR-4708-5p | 210428 | 212470 | Breast tumor |
| hsa-miR-4709-3p | 210429 | 212471 | Breast tumor |
| hsa-miR-4709-5p | 210430 | 212472 | Breast tumor |
| hsa-miR-4710 | 210431 | 212473 | Breast tumor |
| hsa-miR-4711-3p | 210432 | 212474 | Breast tumor |
| hsa-miR-4711-5p | 210433 | 212475 | Breast tumor |
| hsa-miR-4712-3p | 210434 | 212476 | Breast tumor |
| hsa-miR-4712-5p | 210435 | 212477 | Breast tumor |
| hsa-miR-4713-3p | 210436 | 212478 | Breast tumor |
| hsa-miR-4713-5p | 210437 | 212479 | Breast tumor |
| hsa-miR-4714-3p | 210438 | 212480 | Breast tumor |
| hsa-miR-4714-5p | 210439 | 212481 | Breast tumor |
| hsa-miR-4715-3p | 210440 | 212482 | Breast tumor |
| hsa-miR-4715-5p | 210441 | 212483 | Breast tumor |
| hsa-miR-4716-3p | 210442 | 212484 | Breast tumor |
| hsa-miR-4716-5p | 210443 | 212485 | Breast tumor |
| hsa-miR-4717-3p | 210444 | 212486 | Breast tumor |
| hsa-miR-4717-5p | 210445 | 212487 | Breast tumor |
| hsa-miR-4718 | 210446 | 212488 | Breast tumor |
| hsa-miR-4719 | 210447 | 212489 | Breast tumor |
| hsa-miR-4720-3p | 210448 | 212490 | Breast tumor |
| hsa-miR-4720-5p | 210449 | 212491 | Breast tumor |
| hsa-miR-4721 | 210450 | 212492 | Breast tumor |
| hsa-miR-4722-3p | 210451 | 212493 | Breast tumor |
| hsa-miR-4722-5p | 210452 | 212494 | Breast tumor |
| hsa-miR-4723-3p | 210453 | 212495 | Breast tumor |
| hsa-miR-4723-5p | 210454 | 212496 | Breast tumor |
| hsa-miR-4724-3p | 210455 | 212497 | Breast tumor |
| hsa-miR-4724-5p | 210456 | 212498 | Breast tumor |
| hsa-miR-4725-3p | 210457 | 212499 | Breast tumor |
| hsa-miR-4725-5p | 210458 | 212500 | Breast tumor |

TABLE 13-continued microRNA Sequences

| microRNA name | miR SEQ ID | miR BS SEQ ID | Types of Tissues and/or Cells |
|---|---|---|---|
| hsa-miR-4726-3p | 210459 | 212501 | Breast tumor |
| hsa-miR-4726-5p | 210460 | 212502 | Breast tumor |
| hsa-miR-4727-3p | 210461 | 212503 | Breast tumor |
| hsa-miR-4727-5p | 210462 | 212504 | Breast tumor |
| hsa-miR-4728-3p | 210463 | 212505 | Breast tumor |
| hsa-miR-4728-5p | 210464 | 212506 | Breast tumor |
| hsa-miR-4729 | 210465 | 212507 | Breast tumor |
| hsa-miR-4730 | 210466 | 212508 | Breast tumor |
| hsa-miR-4731-3p | 210467 | 212509 | Breast tumor |
| hsa-miR-4731-5p | 210468 | 212510 | Breast tumor |
| hsa-miR-4732-3p | 210469 | 212511 | Breast tumor |
| hsa-miR-4732-5p | 210470 | 212512 | Breast tumor |
| hsa-miR-4733-3p | 210471 | 212513 | Breast tumor |
| hsa-miR-4733-5p | 210472 | 212514 | Breast tumor |
| hsa-miR-4734 | 210473 | 212515 | Breast tumor |
| hsa-miR-4735-3p | 210474 | 212516 | Breast tumor |
| hsa-miR-4735-5p | 210475 | 212517 | Breast tumor |
| hsa-miR-4736 | 210476 | 212518 | Breast tumor |
| hsa-miR-4737 | 210477 | 212519 | Breast tumor |
| hsa-miR-4738-3p | 210478 | 212520 | Breast tumor |
| hsa-miR-4738-5p | 210479 | 212521 | Breast tumor |
| hsa-miR-4739 | 210480 | 212522 | Breast tumor |
| hsa-miR-4740-3p | 210481 | 212523 | Breast tumor |
| hsa-miR-4740-5p | 210482 | 212524 | Breast tumor |
| hsa-miR-4741 | 210483 | 212525 | Breast tumor, psoriasis |
| hsa-miR-4742-3p | 210484 | 212526 | Breast tumor, psoriasis |
| hsa-miR-4742-5p | 210485 | 212527 | Breast tumor |
| hsa-miR-4743-3p | 210486 | 212528 | Breast tumor |
| hsa-miR-4743-5p | 210487 | 212529 | Breast tumor |
| hsa-miR-4744 | 210488 | 212530 | Breast tumor |
| hsa-miR-4745-3p | 210489 | 212531 | Breast tumor |
| hsa-miR-4745-5p | 210490 | 212532 | Breast tumor |
| hsa-miR-4746-3p | 210491 | 212533 | Breast tumor |
| hsa-miR-4746-5p | 210492 | 212534 | Breast tumor |
| hsa-miR-4747-3p | 210493 | 212535 | Breast tumor |
| hsa-miR-4747-5p | 210494 | 212536 | Breast tumor |
| hsa-miR-4748 | 210495 | 212537 | Breast tumor |
| hsa-miR-4749-3p | 210496 | 212538 | Breast tumor |
| hsa-miR-4749-5p | 210497 | 212539 | Breast tumor |
| hsa-miR-4750-3p | 210498 | 212540 | Breast tumor |
| hsa-miR-4750-5p | 210499 | 212541 | Breast tumor |
| hsa-miR-4751 | 210500 | 212542 | Breast tumor |
| hsa-miR-4752 | 210501 | 212543 | Breast tumor |
| hsa-miR-4753-3p | 210502 | 212544 | Breast tumor |
| hsa-miR-4753-5p | 210503 | 212545 | Breast tumor |
| hsa-miR-4754 | 210504 | 212546 | Breast tumor |
| hsa-miR-4755-3p | 210505 | 212547 | Breast tumor |
| hsa-miR-4755-5p | 210506 | 212548 | Breast tumor |
| hsa-miR-4756-3p | 210507 | 212549 | Breast tumor |
| hsa-miR-4756-5p | 210508 | 212550 | Breast tumor |
| hsa-miR-4757-3p | 210509 | 212551 | Breast tumor |
| hsa-miR-4757-5p | 210510 | 212552 | Breast tumor |
| hsa-miR-4758-3p | 210511 | 212553 | Breast tumor |
| hsa-miR-4758-5p | 210512 | 212554 | Breast tumor |
| hsa-miR-4759 | 210513 | 212555 | Breast tumor |
| hsa-miR-4760-3p | 210514 | 212556 | Breast tumor |
| hsa-miR-4760-5p | 210515 | 212557 | Breast tumor |
| hsa-miR-4761-3p | 210516 | 212558 | Breast tumor |
| hsa-miR-4761-5p | 210517 | 212559 | Breast tumor |
| hsa-miR-4762-3p | 210518 | 212560 | Breast tumor |
| hsa-miR-4762-5p | 210519 | 212561 | Breast tumor |
| hsa-miR-4763-3p | 210520 | 212562 | Breast tumor |
| hsa-miR-4763-5p | 210521 | 212563 | Breast tumor |
| hsa-miR-4764-3p | 210522 | 212564 | Breast tumor |
| hsa-miR-4764-5p | 210523 | 212565 | Breast tumor |
| hsa-miR-4765 | 210524 | 212566 | Breast tumor |
| hsa-miR-4766-3p | 210525 | 212567 | Breast tumor |
| hsa-miR-4766-5p | 210526 | 212568 | Breast tumor |
| hsa-miR-4767 | 210527 | 212569 | Breast tumor |
| hsa-miR-4768-3p | 210528 | 212570 | Breast tumor |
| hsa-miR-4768-5p | 210529 | 212571 | Breast tumor |
| hsa-miR-4769-3p | 210530 | 212572 | Breast tumor |
| hsa-miR-4769-5p | 210531 | 212573 | Breast tumor |
| hsa-miR-4770 | 210532 | 212574 | Breast tumor |
| hsa-miR-4771 | 210533 | 212575 | Breast tumor |
| hsa-miR-4772-3p | 210534 | 212576 | Breast tumor, blood mononuclear cells |

TABLE 13-continued microRNA Sequences

| microRNA name | miR SEQ ID | miR BS SEQ ID | Types of Tissues and/or Cells |
|---|---|---|---|
| hsa-miR-4772-5p | 210535 | 212577 | Breast tumor, blood mononuclear cells |
| hsa-miR-4773 | 210536 | 212578 | Breast tumor |
| hsa-miR-4774-3p | 210537 | 212579 | Breast tumor and Lymphoblastic leukemia |
| hsa-miR-4774-5p | 210538 | 212580 | Breast tumor and Lymphoblastic leukemia |
| hsa-miR-4775 | 210539 | 212581 | Breast tumor |
| hsa-miR-4776-3p | 210540 | 212582 | Breast tumor |
| hsa-miR-4776-5p | 210541 | 212583 | Breast tumor |
| hsa-miR-4777-3p | 210542 | 212584 | Breast tumor |
| hsa-miR-4777-5p | 210543 | 212585 | Breast tumor |
| hsa-miR-4778-3p | 210544 | 212586 | Breast tumor |
| hsa-miR-4778-5p | 210545 | 212587 | Breast tumor |
| hsa-miR-4779 | 210546 | 212588 | Breast tumor |
| hsa-miR-4780 | 210547 | 212589 | Breast tumor |
| hsa-miR-4781-3p | 210548 | 212590 | Breast tumor |
| hsa-miR-4781-5p | 210549 | 212591 | Breast tumor |
| hsa-miR-4782-3p | 210550 | 212592 | Breast tumor |
| hsa-miR-4782-5p | 210551 | 212593 | Breast tumor |
| hsa-miR-4783-3p | 210552 | 212594 | Breast tumor |
| hsa-miR-4783-5p | 210553 | 212595 | Breast tumor |
| hsa-miR-4784 | 210554 | 212596 | Breast tumor |
| hsa-miR-4785 | 210555 | 212597 | Breast tumor |
| hsa-miR-4786-3p | 210556 | 212598 | Breast tumor |
| hsa-miR-4786-5p | 210557 | 212599 | Breast tumor |
| hsa-miR-4787-3p | 210558 | 212600 | Breast tumor |
| hsa-miR-4787-5p | 210559 | 212601 | Breast tumor |
| hsa-miR-4788 | 210560 | 212602 | Breast tumor |
| hsa-miR-4789-3p | 210561 | 212603 | Breast tumor |
| hsa-miR-4789-5p | 210562 | 212604 | Breast tumor |
| hsa-miR-4790-3p | 210563 | 212605 | Breast tumor |
| hsa-miR-4790-5p | 210564 | 212606 | Breast tumor |
| hsa-miR-4791 | 210565 | 212607 | Breast tumor |
| hsa-miR-4792 | 210566 | 212608 | Breast tumor |
| hsa-miR-4793-3p | 210567 | 212609 | Breast tumor |
| hsa-miR-4793-5p | 210568 | 212610 | Breast tumor |
| hsa-miR-4794 | 210569 | 212611 | Breast tumor |
| hsa-miR-4795-3p | 210570 | 212612 | Breast tumor |
| hsa-miR-4795-5p | 210571 | 212613 | Breast tumor |
| hsa-miR-4796-3p | 210572 | 212614 | Breast tumor |
| hsa-miR-4796-5p | 210573 | 212615 | Breast tumor |
| hsa-miR-4797-3p | 210574 | 212616 | Breast tumor |
| hsa-miR-4797-5p | 210575 | 212617 | Breast tumor |
| hsa-miR-4798-3p | 210576 | 212618 | Breast tumor |
| hsa-miR-4798-5p | 210577 | 212619 | Breast tumor |
| hsa-miR-4799-3p | 210578 | 212620 | Breast tumor |
| hsa-miR-4799-5p | 210579 | 212621 | Breast tumor |
| hsa-miR-4800-3p | 210580 | 212622 | Breast tumor |
| hsa-miR-4800-5p | 210581 | 212623 | Breast tumor |
| hsa-miR-4801 | 210582 | 212624 | Breast tumor |
| hsa-miR-4802-3p | 210583 | 212625 | Breast tumor, psoriasis |
| hsa-miR-4802-5p | 210584 | 212626 | Breast tumor, psoriasis |
| hsa-miR-4803 | 210585 | 212627 | Breast tumor |
| hsa-miR-4804-3p | 210586 | 212628 | Breast tumor |
| hsa-miR-4804-5p | 210587 | 212629 | Breast tumor |
| hsa-miR-4999-3p | 210588 | 212630 | |
| hsa-miR-4999-5p | 210589 | 212631 | |
| hsa-miR-499a-3p | 210590 | 212632 | Heart, cardiac stem cells |
| hsa-miR-499a-5p | 210591 | 212633 | Heart, cardiac stem cells |
| hsa-miR-499b-3p | 210592 | 212634 | Heart, cardiac stem cells |
| hsa-miR-499b-5p | 210593 | 212635 | Heart, cardiac stem cells |
| hsa-miR-5000-3p | 210594 | 212636 | Lymphoblastic leukemia |
| hsa-miR-5000-5p | 210595 | 212637 | Lymphoblastic leukemia |
| hsa-miR-5001-3p | 210596 | 212638 | |
| hsa-miR-5001-5p | 210597 | 212639 | |
| hsa-miR-5002-3p | 210598 | 212640 | |
| hsa-miR-5002-5p | 210599 | 212641 | |
| hsa-miR-5003-3p | 210600 | 212642 | |
| hsa-miR-5003-5p | 210601 | 212643 | |
| hsa-miR-5004-3p | 210602 | 212644 | |
| hsa-miR-5004-5p | 210603 | 212645 | |
| hsa-miR-5006-3p | 210604 | 212646 | Lymphoblastic leukemia |
| hsa-miR-5006-5p | 210605 | 212647 | Lymphoblastic leukemia |
| hsa-miR-5007-3p | 210606 | 212648 | |
| hsa-miR-5007-5p | 210607 | 212649 | |
| hsa-miR-5008-3p | 210608 | 212650 | |
| hsa-miR-5008-5p | 210609 | 212651 | |
| hsa-miR-5009-3p | 210610 | 212652 | |

TABLE 13-continued microRNA Sequences

| microRNA name | miR SEQ ID | miR BS SEQ ID | Types of Tissues and/or Cells |
|---|---|---|---|
| hsa-miR-5009-5p | 210611 | 212653 | |
| hsa-miR-5010-3p | 210612 | 212654 | |
| hsa-miR-5010-5p | 210613 | 212655 | |
| hsa-miR-5011-3p | 210614 | 212656 | |
| hsa-miR-5011-5p | 210615 | 212657 | |
| hsa-miR-5047 | 210616 | 212658 | |
| hsa-miR-5087 | 210617 | 212659 | |
| hsa-miR-5088 | 210618 | 212660 | |
| hsa-miR-5089-3p | 210619 | 212661 | |
| hsa-miR-5089-5p | 210620 | 212662 | |
| hsa-miR-5090 | 210621 | 212663 | |
| hsa-miR-5091 | 210622 | 212664 | |
| hsa-miR-5092 | 210623 | 212665 | |
| hsa-miR-5093 | 210624 | 212666 | |
| hsa-miR-5094 | 210625 | 212667 | |
| hsa-miR-5095 | 210626 | 212668 | |
| hsa-miR-5096 | 210627 | 212669 | |
| hsa-miR-5100 | 210628 | 212670 | Salivary gland |
| hsa-miR-5186 | 210629 | 212671 | Lymphoblastic leukemia |
| hsa-miR-5187-3p | 210630 | 212672 | Lymphoblastic leukemia, skin (psoriasis) |
| hsa-miR-5187-5p | 210631 | 212673 | Lymphoblastic leukemia, skin (psoriasis) |
| hsa-miR-5188 | 210632 | 212674 | Lymphoblastic leukemia |
| hsa-miR-5189 | 210633 | 212675 | Lymphoblastic leukemia |
| hsa-miR-5190 | 210634 | 212676 | Lymphoblastic leukemia |
| hsa-miR-5191 | 210635 | 212677 | Lymphoblastic leukemia |
| hsa-miR-5192 | 210636 | 212678 | Lymphoblastic leukemia |
| hsa-miR-5193 | 210637 | 212679 | Lymphoblastic leukemia |
| hsa-miR-5194 | 210638 | 212680 | Lymphoblastic leukemia |
| hsa-miR-5195-3p | 210639 | 212681 | Lymphoblastic leukemia |
| hsa-miR-5195-5p | 210640 | 212682 | Lymphoblastic leukemia |
| hsa-miR-5196-3p | 210641 | 212683 | Lymphoblastic leukemia |
| hsa-miR-5196-5p | 210642 | 212684 | Lymphoblastic leukemia |
| hsa-miR-5197-3p | 210643 | 212685 | Lymphoblastic leukemia |
| hsa-miR-5197-5p | 210644 | 212686 | Lymphoblastic leukemia |
| hsa-miR-5571-3p | 210645 | 212687 | Salivary gland |
| hsa-miR-5571-5p | 210646 | 212688 | Salivary gland |
| hsa-miR-5572 | 210647 | 212689 | Salivary gland |
| hsa-miR-5579-3p | 210648 | 212690 | |
| hsa-miR-5579-5p | 210649 | 212691 | |
| hsa-miR-5580-3p | 210650 | 212692 | |
| hsa-miR-5580-5p | 210651 | 212693 | |
| hsa-miR-5581-3p | 210652 | 212694 | |
| hsa-miR-5581-5p | 210653 | 212695 | |
| hsa-miR-5582-3p | 210654 | 212696 | |
| hsa-miR-5582-5p | 210655 | 212697 | |
| hsa-miR-5583-3p | 210656 | 212698 | |
| hsa-miR-5583-5p | 210657 | 212699 | |
| hsa-miR-5584-3p | 210658 | 212700 | |
| hsa-miR-5584-5p | 210659 | 212701 | |
| hsa-miR-5585-3p | 210660 | 212702 | |
| hsa-miR-5585-5p | 210661 | 212703 | |
| hsa-miR-5586-3p | 210662 | 212704 | |
| hsa-miR-5586-5p | 210663 | 212705 | |
| hsa-miR-5587-3p | 210664 | 212706 | |
| hsa-miR-5587-5p | 210665 | 212707 | |
| hsa-miR-5588-3p | 210666 | 212708 | |
| hsa-miR-5588-5p | 210667 | 212709 | |
| hsa-miR-5589-3p | 210668 | 212710 | |
| hsa-miR-5589-5p | 210669 | 212711 | |
| hsa-miR-5590-3p | 210670 | 212712 | |
| hsa-miR-5590-5p | 210671 | 212713 | |
| hsa-miR-5591-3p | 210672 | 212714 | |
| hsa-miR-5591-5p | 210673 | 212715 | |
| hsa-miR-5680 | 210674 | 212716 | |
| hsa-miR-5681a | 210675 | 212717 | |
| hsa-miR-5681b | 210676 | 212718 | |
| hsa-miR-5682 | 210677 | 212719 | |
| hsa-miR-5683 | 210678 | 212720 | |
| hsa-miR-5684 | 210679 | 212721 | |
| hsa-miR-5685 | 210680 | 212722 | |
| hsa-miR-5686 | 210681 | 212723 | |
| hsa-miR-5687 | 210682 | 212724 | |
| hsa-miR-5688 | 210683 | 212725 | |
| hsa-miR-5689 | 210684 | 212726 | |
| hsa-miR-5690 | 210685 | 212727 | |
| hsa-miR-5691 | 210686 | 212728 | |

TABLE 13-continued microRNA Sequences

| microRNA name | miR SEQ ID | miR BS SEQ ID | Types of Tissues and/or Cells |
|---|---|---|---|
| hsa-miR-5692a | 210687 | 212729 | |
| hsa-miR-5692b | 210688 | 212730 | |
| hsa-miR-5692c | 210689 | 212731 | |
| hsa-miR-5693 | 210690 | 212732 | |
| hsa-miR-5694 | 210691 | 212733 | |
| hsa-miR-5695 | 210692 | 212734 | |
| hsa-miR-5696 | 210693 | 212735 | |
| hsa-miR-5697 | 210694 | 212736 | |
| hsa-miR-5698 | 210695 | 212737 | |
| hsa-miR-5699 | 210696 | 212738 | |
| hsa-miR-5700 | 210697 | 212739 | |
| hsa-miR-5701 | 210698 | 212740 | |
| hsa-miR-5702 | 210699 | 212741 | |
| hsa-miR-5703 | 210700 | 212742 | |
| hsa-miR-5704 | 210701 | 212743 | |
| hsa-miR-5705 | 210702 | 212744 | |
| hsa-miR-5706 | 210703 | 212745 | |
| hsa-miR-5707 | 210704 | 212746 | |
| hsa-miR-5708 | 210705 | 212747 | |
| hsa-miR-5739 | 210706 | 212748 | Endothelial cells |
| hsa-miR-5787 | 210707 | 212749 | Fibroblast |
| hsa-miR-6068 | 210708 | 212750 | Endothelial cells |
| hsa-miR-6069 | 210709 | 212751 | Endothelial cells |
| hsa-miR-6070 | 210710 | 212752 | A colorectal microRNAome |
| hsa-miR-6071 | 210711 | 212753 | Endothelial cells |
| hsa-miR-6072 | 210712 | 212754 | Endothelial cells |
| hsa-miR-6073 | 210713 | 212755 | Endothelial cells |
| hsa-miR-6074 | 210714 | 212756 | Endothelial cells |
| hsa-miR-6075 | 210715 | 212757 | Endothelial cells |
| hsa-miR-6076 | 210716 | 212758 | Endothelial cells |
| hsa-miR-6077 | 210717 | 212759 | Endothelial cells |
| hsa-miR-6078 | 210718 | 212760 | Endothelial cells |
| hsa-miR-6079 | 210719 | 212761 | Endothelial cells |
| hsa-miR-6080 | 210720 | 212762 | Endothelial cells |
| hsa-miR-6081 | 210721 | 212763 | Endothelial cells |
| hsa-miR-6082 | 210722 | 212764 | Endothelial cells |
| hsa-miR-6083 | 210723 | 212765 | Endothelial cells |
| hsa-miR-6084 | 210724 | 212766 | Endothelial cells |
| hsa-miR-6085 | 210725 | 212767 | Endothelial cells |
| hsa-miR-6086 | 210726 | 212768 | Embryonic stem cells |
| hsa-miR-6087 | 210727 | 212769 | Embryonic stem cells |
| hsa-miR-6088 | 210728 | 212770 | Embryonic stem cells |
| hsa-miR-6089 | 210729 | 212771 | Embryonic stem cells |
| hsa-miR-6090 | 210730 | 212772 | Embryonic stem cells |
| hsa-miR-6124 | 210731 | 212773 | |
| hsa-miR-6125 | 210732 | 212774 | |
| hsa-miR-6126 | 210733 | 212775 | |
| hsa-miR-6127 | 210734 | 212776 | |
| hsa-miR-6128 | 210735 | 212777 | |
| hsa-miR-6129 | 210736 | 212778 | |
| hsa-miR-6130 | 210737 | 212779 | |
| hsa-miR-6131 | 210738 | 212780 | |
| hsa-miR-6132 | 210739 | 212781 | |
| hsa-miR-6133 | 210740 | 212782 | |
| hsa-miR-6134 | 210741 | 212783 | |
| hsa-miR-6165 | 210742 | 212784 | |
| hsa-miR-6499-3p | 210743 | 212785 | Abnormal skin (psoriasis) |
| hsa-miR-6499-5p | 210744 | 212786 | Abnormal skin (psoriasis) |
| hsa-miR-6500-3p | 210745 | 212787 | Abnormal skin (psoriasis) |
| hsa-miR-6500-5p | 210746 | 212788 | Abnormal skin (psoriasis) |
| hsa-miR-6501-3p | 210747 | 212789 | Abnormal skin (psoriasis) |
| hsa-miR-6501-5p | 210748 | 212790 | Abnormal skin (psoriasis) |
| hsa-miR-6502-3p | 210749 | 212791 | Abnormal skin (psoriasis) |
| hsa-miR-6502-5p | 210750 | 212792 | Abnormal skin (psoriasis) |
| hsa-miR-6503-3p | 210751 | 212793 | Abnormal skin (psoriasis) |
| hsa-miR-6503-5p | 210752 | 212794 | Abnormal skin (psoriasis) |
| hsa-miR-6504-3p | 210753 | 212795 | Abnormal skin (psoriasis) |
| hsa-miR-6504-5p | 210754 | 212796 | Abnormal skin (psoriasis) |
| hsa-miR-6505-3p | 210755 | 212797 | Abnormal skin (psoriasis) |
| hsa-miR-6505-5p | 210756 | 212798 | Abnormal skin (psoriasis) |
| hsa-miR-6506-3p | 210757 | 212799 | Abnormal skin (psoriasis) |
| hsa-miR-6506-5p | 210758 | 212800 | Abnormal skin (psoriasis) |
| hsa-miR-6507-3p | 210759 | 212801 | Abnormal skin (psoriasis) |
| hsa-miR-6507-5p | 210760 | 212802 | Abnormal skin (psoriasis) |
| hsa-miR-6508-3p | 210761 | 212803 | Abnormal skin (psoriasis) |
| hsa-miR-6508-5p | 210762 | 212804 | Abnormal skin (psoriasis) |

TABLE 13-continued microRNA Sequences

| microRNA name | miR SEQ ID | miR BS SEQ ID | Types of Tissues and/or Cells |
|---|---|---|---|
| hsa-miR-6509-3p | 210763 | 212805 | Abnormal skin (psoriasis) |
| hsa-miR-6509-5p | 210764 | 212806 | Abnormal skin (psoriasis) |
| hsa-miR-6510-3p | 210765 | 212807 | Abnormal skin (psoriasis) |
| hsa-miR-6510-5p | 210766 | 212808 | Abnormal skin (psoriasis) |
| hsa-miR-6511a-3p | 210767 | 212809 | Abnormal skin (psoriasis) and epididymis |
| hsa-miR-6511a-5p | 210768 | 212810 | Abnormal skin (psoriasis) and epididymis |
| hsa-miR-6511b-3p | 210769 | 212811 | Epididymis |
| hsa-miR-6511b-5p | 210770 | 212812 | Epididymis |
| hsa-miR-6512-3p | 210771 | 212813 | Abnormal skin (psoriasis) |
| hsa-miR-6512-5p | 210772 | 212814 | Abnormal skin (psoriasis) |
| hsa-miR-6513-3p | 210773 | 212815 | Abnormal skin (psoriasis) |
| hsa-miR-6513-5p | 210774 | 212816 | Abnormal skin (psoriasis) |
| hsa-miR-6514-3p | 210775 | 212817 | Abnormal skin (psoriasis) |
| hsa-miR-6514-5p | 210776 | 212818 | Abnormal skin (psoriasis) |
| hsa-miR-6515-3p | 210777 | 212819 | Abnormal skin (psoriasis) and epididymis |
| hsa-miR-6515-5p | 210778 | 212820 | Abnormal skin (psoriasis) and epididymis |
| hsa-miR-6715a-3p | 210779 | 212821 | Epididymis |
| hsa-miR-6715b-3p | 210780 | 212822 | Epididymis |
| hsa-miR-6715b-5p | 210781 | 212823 | Epididymis |
| hsa-miR-6716-3p | 210782 | 212824 | Epididymis |
| hsa-miR-6716-5p | 210783 | 212825 | Epididymis |
| hsa-miR-6717-5p | 210784 | 212826 | Epididymis |
| hsa-miR-6718-5p | 210785 | 212827 | Epididymis |
| hsa-miR-6719-3p | 210786 | 212828 | Epididymis |
| hsa-miR-6720-3p | 210787 | 212829 | Epididymis |
| hsa-miR-6721-5p | 210788 | 212830 | Epididymis |
| hsa-miR-6722-3p | 210789 | 212831 | Epididymis |
| hsa-miR-6722-5p | 210790 | 212832 | Epididymis |
| hsa-miR-6723-5p | 210791 | 212833 | Epididymis |
| hsa-miR-6724-5p | 210792 | 212834 | Epididymis |
| hsa-let-7a-2-3p | 210793 | 212835 | Embryonic stem cells, lung, myeloid cells |
| hsa-let-7a-3p | 210794 | 212836 | Embryonic stem cells, lung |
| hsa-let-7a-5p | 210795 | 212837 | Embryonic stem cells, lung |
| hsa-let-7b-3p | 210796 | 212838 | Epithelial cells, endothelial cells (vascular) |
| hsa-let-7b-5p | 210797 | 212839 | Epithelial cells, endothelial cells (vascular) |
| hsa-let-7c | 210798 | 212840 | Dendritic cells |
| hsa-let-7d-3p | 210799 | 212841 | Embryonic stem cells |
| hsa-let-7d-5p | 210800 | 212842 | Embryonic stem cells |
| hsa-let-7e-3p | 210801 | 212843 | Immune cells |
| hsa-let-7e-5p | 210802 | 212844 | Immune cells |
| hsa-let-7f-1-3p | 210803 | 212845 | Immune cells (T cells) |
| hsa-let-7f-2-3p | 210804 | 212846 | Immune cells (T cells) |
| hsa-let-7f-5p | 210805 | 212847 | Immune cells (T cells) |
| hsa-let-7g-3p | 210806 | 212848 | Hematopoietic cells, adipose, smooth muscle cells |
| hsa-let-7g-5p | 210807 | 212849 | Hematopoietic cells, adipose, smooth muscle cells |
| hsa-let-7i-3p | 210808 | 212850 | Immune cells |
| hsa-let-7i-5p | 210809 | 212851 | Immune cells |

Construct Optimization to Reduce Basal Expression

Biocircuit constructs are to be further optimized to reduce or eliminate the basal expression in the absence of ligands. In some embodiments, an interfering RNA may be used to reduce the basal expression. Other RNA regulatory elements may also be introduced to the construct, for example, by incorporating AU-rich mRNA destabilizing elements (ARE) into the 3' untranslated region (3'UTR) of the construct (Malta et al., RNA, 2008, 14(5): 950-959).

In some embodiments, a construct may be test with different promoters or mutated promoters. The promoter that gives the least "leaky" expression may be used. In some embodiments, one or more suppressor binding sites may be inserted to the constructs. The suppressor proteins bind to the construct and suppress the expression of the construct in the absence of the stimulus.

Additionally, constructs encoding proteins which can attenuate the transgene activity may also be co-expressed with the biocircuits of the present invention.

In some embodiments, effector modules of the present invention may include one or more degrons to tune expression. As used herein, a "degron" refers to a minimal sequence within a protein that is sufficient for the recognition and the degradation by the proteolytic system. An important property of degrons is that they are transferrable, that is, appending a degron to a sequence confers degradation upon the sequence. In some embodiments, the degron may be appended to the destabilizing domains, the payload or both. Incorporation of the degron within the effector module of the invention, confers additional protein instability the effector module and may be used to minimize basal expression. In some embodiments, the degron may be an N-degron, a phospho degron, a heat inducible degron, a photosensitive degron, an oxygen dependent degron. As a non-limiting example, the degron may be an Ornithine decarboxylase degron as described by Takeuchi et al. (Takeuchi J et al. (2008). Biochem J. 2008 Mar. 1; 410(2): 401-7; the contents of which are incorporated by reference in their entirety). Other examples of degrons useful in the present invention include degrons described in International patent publication Nos. WO2017004022, WO2016210343, and WO2011062962; the contents of each of which are incorporated by reference in their entirety.

Biocircuit Classification by Payload

Biocircuit systems may be classified, according to the nature of their payload by biological process, their cellular location or molecular function. The category and category number for the classification of the payload by biological process, cellular location, molecular function are described in the following paragraph in a semi-colon delimited list (Category Number—Category). For example, a nBAF complex category has the category number 7544 and will be shown in the list as Category No. 7544—nBAF complex.

In one embodiment, the payload may be classified using at least one of the following category numbers and categories: Category No. 1—(1->3)-beta-D-glucan binding; Category No. 2—(alpha-N-acetylneuraminyl-2,3-beta-galactosyl-1,3)-N-acetyl-galactosaminide 6-alpha-sialyltransferase activity; Category No. 3—(N-acetylneuraminyl)-galactosylglucosylceramide N-acetylgalactosaminyltransferase activity; Category No. 4—(R)-2-hydroxyglutarate dehydrogenase activity; Category No. 5—(R)-3-amino-2-methylpropionate-pyruvate transaminase activity; Category No. 6—(R)-limonene 6-monooxygenase activity; Category No. 7—(S)-2-(5-amino-1-(5-phospho-D-ribosyl)imidazole-4-carboxamido)succinate AMP-lyase (fumarate-forming) activity; Category No. 8—(S)-2-hydroxy-acid oxidase activity; Category No. 9—(S)-3-amino-2-methylpropionate transaminase activity; Category No. 10—(S)-limonene 6-monooxygenase activity; Category No. 11—(S)-limonene 7-monooxygenase activity; Category No. 12—[2Fe-2S] cluster assembly; Category No. 13—[3-methyl-2-oxobutanoate dehydrogenase (acetyl-transferring)] kinase activity; Category No. 14—[acetyl-CoA carboxylase] kinase activity; Category No. 15—[acyl-carrier-protein] S-acetyltransferase activity; Category No. 16—[acyl-carrier-protein] S-malonyltransferase activity; Category No. 17—[heparan sulfate]-glucosamine 3-sulfotransferase 1 activity; Category No. 18—[heparan sulfate]-glucosamine 3-sulfotransferase 2 activity; Category No. 19—[heparan sulfate]-glucosamine 3-sulfotransferase 3 activity; Category No. 20—[heparan sulfate]-glucosamine N-sulfotransferase activity; Category No. 21—[hydroxymethylglutaryl-CoA reductase (NADPH)] kinase activity; Category No. 22—[methionine synthase] reductase activity; Category No. 23—[myelin basic protein]-arginine N-methyltransferase activity; Category No. 24—[pyruvate dehydrogenase (lipoamide)] phosphatase activity; Category No. 25—1-(4-iodo-2,5-dimethoxyphenyl)propan-2-amine binding; Category No. 26—1,4-alpha-glucan branching enzyme activity; Category No. 27—1,5-anhydro-D-fructose reductase activity; Category No. 28—10-formyltetrahydrofolate biosynthetic process; Category No. 29—10-formyltetrahydrofolate catabolic process; Category No. 30—10-formyltetrahydrofolate metabolic process; Category No. 31—10-hydroxy-9-(phosphonooxy)octadecanoate phosphatase activity; Category No. 32—11-beta-hydroxysteroid dehydrogenase (NADP+) activity; Category No. 33—11-beta-hydroxysteroid dehydrogenase [NAD(P)] activity; Category No. 34—11-cis retinal binding; Category No. 35—11-cis retinol forming activity; Category No. 36—13-prostaglandin reductase activity; Category No. 37—14-3-3 protein binding; Category No. 38—15-hydroxyprostaglandin dehydrogenase (NAD+) activity; Category No. 39—15-hydroxyprostaglandin dehydrogenase (NADP+) activity; Category No. 40—15-hydroxyprostaglandin-D dehydrogenase (NADP+) activity; Category No. 41—15-oxoprostaglandin 13-oxidase activity; Category No. 42—17-alpha,20-alpha-dihydroxypregn-4-en-3-one dehydrogenase activity; Category No. 43—17-alpha-hydroxyprogesterone aldolase activity; Category No. 44—17-beta-hydroxysteroid dehydrogenase (NAD+) activity; Category No. 45—18S rRNA (adenine(1779)-N(6) adenine(1780)-N(6))-dimethyltransferase activity; Category No. 46—1-acyl-2-lysophosphatidylserine acylhydrolase activity; Category No. 47—1-acylglycerol-3-phosphate O-acyltransferase activity; Category No. 48—1-acylglycerophosphocholine O-acyltransferase activity; Category No. 49—1-alkenylglycerophosphocholine O-acyltransferase activity; Category No. 50—1-alkenylglycerophosphoethanolamine O-acyltransferase activity; Category No. 51—1-alkyl-2-acetylglycerophosphocholine esterase activity; Category No. 52—1-alkylglycerophosphocholine O-acetyltransferase activity; Category No. 53—1-alkylglycerophosphocholine O-acyltransferase activity; Category No. 54—1-alpha,25-dihydroxyvitamin D3 24-hydroxylase activity; Category No. 55—1-phosphatidylinositol 4-kinase activity; Category No. 56—1-phosphatidylinositol binding; Category No. 57—1-phosphatidylinositol-3-kinase activity; Category No. 58—1-phosphatidylinositol-3-kinase regulator activity; Category No. 59—1-phosphatidylinositol-3-phosphate 5-kinase activity; Category No. 60—1-phosphatidylinositol-4-phosphate 3-kinase activity; Category No. 61—1-phosphatidylinositol-4-phosphate 5-kinase activity; Category No. 62—1-phosphatidylinositol-5-phosphate 4-kinase activity; Category No. 63—1-pyrroline dehydrogenase activity; Category No. 64—1-pyrroline-5-carboxylate dehydrogenase activity; Category No. 65—2 iron 2 sulfur cluster binding; Category No. 66—2-(3-amino-3-carboxypropyl)histidine synthase activity; Category No. 67—2,3-bisphosphoglycerate-dependent phosphoglycerate mutase activity; Category No. 68—2',3'-cyclic-nucleotide 3-phosphodiesterase activity; Category No. 69—2,3-dihydro-2,3-dihydroxybenzoate dehydrogenase activity; Category No. 70—2,4-dienoyl-CoA reductase (NADPH) activity; Category No. 71—23S rRNA (adenine(1618)-N(6))-methyltransferase activity; Category No. 72—24-hydroxycholesterol 7alpha-hydroxylase activity; Category No. 73—25-hydroxycholecalciferol-24-hydroxylase activity; Category No. 74—25-hydroxycholesterol 7alpha-hydroxylase activity; Category No. 75—2'-5'-oligoadenylate synthetase activity; Category No. 76—2-acylglycerol O-acyltransferase activity; Category No. 77—2-alkenal reductase [NAD(P)] activity; Category No. 78—2-aminoadipate transaminase activity; Category No. 79—2-C-methyl-D-erythritol 4-phosphate cytidylyltransferase activity; Category No. 80—2-hydroxyacylsphingosine 1-beta-galactosyltransferase activity; Category No. 81—2-hydroxyglutarate dehydrogenase activity; Category No. 82—2-oxobutyrate biosynthetic process; Category No. 83—2-oxoglutarate as one donor; Category No. 84—2-oxoglutarate metabolic process; Category No. 85—2'-phosphotransferase activity; Category No. 86—2-polyprenyl-6-methoxy-1,4-benzoquinone methyltransferase activity; Category No. 87—3 iron 4 sulfur cluster binding; Category No. 88—3'(2'),5'-bisphosphate nucleotidase activity; Category No. 89—3,4-dihydrocoumarin hydrolase activity; Category No. 90—3,5'-cyclic-AMP phosphodiesterase activity; Category No. 91—3,5'-cyclic-GMP phosphodiesterase activity; Category No. 92—3,5'-cyclic-nucleotide phosphodiesterase activity; Category No. 93—3'-5' DNA helicase activity; Category No. 94—3-5' exonuclease activity; Category No. 95—3'-5' RNA helicase activity; Category No. 96—3-5'-exodeoxyribonuclease activity; Category No. 97—3'-5'-exoribonuclease activity; Category No. 98—3alpha,7alpha,12alpha-trihydroxy-5beta-cholest-24-enoyl-CoA hydratase activity; Category No. 99—3alpha,7alpha,12alpha-trihydroxy-5beta-cholestanoyl-CoA 24-hydroxylase activity; Category No. 100—3-beta-hydroxy-delta5-steroid dehydrogenase activity; Category No. 101—3-chloroallyl aldehyde dehydrogenase activity; Category No. 102—3-dehydrosphinganine reductase activity; Category No. 103—3-demethylubiquinone-9 3-O-methyltransferase activity; Category No. 104—3'-flap endonuclease activity; Category No. 105—3-galactosyl-N-acetylglucosaminide 4-alpha-L-fucosyltransferase activity; Category No. 106—3-hydroxy-2-methylbutyryl-CoA dehydrogenase activity; Category No. 107—3-hydroxyacyl-CoA dehydratase activity; Category No. 108—3-hydroxyacyl-CoA dehydrogenase activity; Category No. 109—3-hydroxyanthranilate 3,4-dioxygenase activity; Category No. 110—3-hydroxybutyrate dehydrogenase activity; Category No. 111—3-hydroxyisobutyrate dehydrogenase activity; Category No. 112—3-hydroxyisobutyryl-CoA hydrolase activity; Category No. 113—3-hydroxyoctanoyl-[acyl-carrier-protein] dehydratase activity; Category No. 114—3-hydroxypalmitoyl-[acyl-carrier-protein] dehydratase activity; Category No. 115—3-keto sterol reductase activity; Category No. 116—3-keto-sphinganine metabolic process; Category No. 117—3M complex; Category No. 118—3-mercaptopyruvate sulfurtransferase activity; Category No. 119—3-methyl-2-oxobutanoate dehydrogenase (2-methylpropanoyl-transferring) activity; Category No. 120—3'-nucleotidase activity; Category No. 121—3-oxo-5-alpha-steroid 4-dehydrogenase activity; Category No. 122—3-oxoacid CoA-transferase activity; Category No. 123—3-oxoacyl-[acyl-carrier-protein] reductase (NADPH) activity; Category No. 124—3-oxoacyl-[acyl-carrier-protein] synthase activity; Category No. 125—3'-phospho-5'-adenylyl sulfate transmembrane transport; Category No. 126—3-phosphoadenosine 5'-phosphosulfate binding; Category No. 127—3'-phosphoadenosine 5'-phosphosulfate biosynthetic process; Category No. 128—3'-phosphoadenosine 5'-phosphosulfate metabolic process; Category No. 129—3'-phosphoadenosine 5'-phosphosulfate transmembrane transporter activity; Category No. 130—3'-phosphoadenosine 5'-phosphosulfate transport; Category No. 131—3-phosphoinositide-dependent protein kinase activity; Category No. 132—3-phosphoinositide-dependent protein kinase binding; Category No. 133—3'-to lesion; Category No. 134—3'-tRNA processing endoribonuclease activity; Category No. 135—3'-tyrosyl-DNA phosphodiesterase activity; Category No. 136—3'-UTR-mediated mRNA destabilization; Category No. 137—3-UTR-mediated mRNA stabilization; Category No. 138—4 iron 4 sulfur cluster binding; Category No. 139—4-alpha-glucanotransferase activity; Category No. 140—4-alpha-hydroxytetrahydrobiopterin dehydratase activity; Category No. 141—4-aminobutyrate transaminase activity; Category No. 142—4-aminobutyrate transaminase complex; Category No. 143—4-hydroxy-2-oxoglutarate aldolase activity; Category No. 144—4-hydroxybenzoate decaprenyltransferase activity; Category No. 145—4-hydroxybenzoate nonaprenyltransferase activity; Category No. 146—4-hydroxyphenylpyruvate dioxygenase activity; Category No. 147—4-hydroxyproline catabolic process; Category No. 148—4-hydroxyproline metabolic process; Category No. 149—4-trimethylammoniobutyraldehyde dehydrogenase activity; Category No. 150—5(S)-hydroxyperoxy-6E,8Z,11Z,14Z-icosatetraenoic acid binding; Category No. 151—5.8S rRNA; Category No. 152—5'-3' DNA helicase activity; Category No. 153—5'-3' exodeoxyribonuclease activity; Category No. 154—exonuclease activity; Category No. 155—exoribonuclease activity; Category No. 156—5-aminolevulinate synthase activity; Category No. 157—5'-deoxyribose-5-phosphate lyase activity; Category No. 158—endonuclease activity; Category No. 159—5-formyltetrahydrofolate cyclo-ligase activity; Category No. 160—5-hydroxy-6E,8Z,11Z,14Z-icosatetraenoic acid binding; Category No. 161—5-methylcytosine catabolic process; Category No. 162—5-methylcytosine metabolic process; Category No. 163—5'-nucleotidase activity; Category No. 164—5-oxo-6E,8Z,11Z,14Z-icosatetraenoic acid binding; Category No. 165—5-oxoprolinase (ATP-hydrolyzing) activity; Category No. 166—5-phosphoribose 1-diphosphate biosynthetic process; Category No. 167—5S class rRNA transcription from RNA polymerase III type 1 promoter; Category No. 168—5S rRNA binding; Category No. 169—5'-to lesion; Category No. 170—5'-tyrosyl-DNA phosphodiesterase activity; Category No. 171—6,7-dihydropteridine reductase activity; Category No. 172—6-phosphofructo-2-kinase activity; Category No. 173—6-phosphofructo-2-kinase fructose-2,6-biphosphatase complex; Category No. 174—6-phosphofructokinase activity; Category No. 175—6-phosphofructokinase complex; Category No. 176—6-phosphogluconolactonase activity; Category No. 177—6-pyruvoyltetrahydropterin synthase activity; Category No. 178—7,8-dihydroneopterin 3'-triphosphate biosynthetic process; Category No. 179—7alpha-hydroxycholest-4-en-3-one 12alpha-hydroxylase activity; Category No. 180—7-dehydrocholesterol reductase activity; Category No. 181—7-methylguanosine cap hypermethylation; Category No. 182—7-methylguanosine mRNA capping; Category No. 183—7-methylguanosine RNA capping; Category No. 184—7S RNA binding; Category No. 185—7SK snRNA binding; Category No. 186—8-hydroxy-dADP phosphatase activity; Category No. 187—8-oxo-7,8-dihydrodeoxyguanosine triphosphate pyrophosphatase activity; Category No. 188—8-oxo-7,8-dihydroguanine DNA N-glycosylase activity; Category No. 189—8-oxo-7,8-dihydroguanosine triphosphate pyrophosphatase activity; Category No. 190—8-oxo-dGDP phosphatase activity; Category No. 191—8-oxo-GDP phosphatase activity; Category No. 192—90S preribosome; Category No. 193—90S preribosome assembly; Category No. 194—9-cis retinoic acid receptor activity; Category No. 195—9-cis-retinoic acid biosynthetic process; Category No. 196—A band; Category No. 197—A1 adenosine receptor binding; Category No. 198—abducens nerve formation; Category No. 199—abortive mitotic cell cycle; Category No. 200—abscission; Category No. 201—absorption of visible light; Category No. 202—Ac-Asp-Glu binding; Category No. 203—acetaldehyde metabolic process; Category No. 204—acetate biosynthetic process; Category No. 205—acetate ester transport; Category No. 206—acetate metabolic process; Category No. 207—acetate-CoA ligase activity; Category No. 208—acetoacetate-CoA ligase activity; Category No. 209—acetoacetic acid metabolic process; Category No. 210—acetoacetyl-CoA reductase activity; Category No. 211—acetylcholine binding; Category No. 212—acetylcholine biosynthetic process; Category No. 213—acetylcholine catabolic process; Category No. 214—acetylcholine catabolic process in synaptic cleft; Category No. 215—acetylcholine receptor activator activity; Category No. 216—acetylcholine receptor activity; Category No. 217—acetylcholine receptor binding; Category No. 218—acetylcholine receptor regulator activity; Category No. 219—acetylcholine secretion; Category No. 220—acetylcholine transmembrane transporter activity; Category No. 221—acetylcholine transport; Category No. 222—acetylcholine-activated cation-selective channel activity; Category No. 223—acetylcholine-gated cation channel activity; Category No. 224—acetylcholine-gated channel complex; Category No. 225—acetylcholinesterase activity; Category No. 226—acetyl-CoA biosynthetic process; Category No. 227—acetyl-CoA biosynthetic process from acetate; Category No. 228—acetyl-CoA biosynthetic process from pyruvate; Category No. 229—acetyl-CoA C-acetyltransferase activity; Category No. 230—acetyl-CoA C-acyltransferase activity; Category No. 231—acetyl-CoA carboxylase activity; Category No. 232—acetyl-CoA carboxylase complex; Category No. 233—acetyl-CoA catabolic process; Category No. 234—acetyl-CoA hydrolase activity; Category No. 235—acetyl-CoA metabolic process; Category No. 236—acetyl-CoA transport; Category No. 237—acetyl-CoA transporter activity; Category No. 238—acetyl-CoA:L-glutamate N-acetyltransferase activity; Category No. 239—acetylgalactosaminyl-O-glycosyl-glycoprotein beta-1,3-N-acetylglucosaminyltransferase activity; Category No. 240—acetylgalactosaminyl-O-glycosyl-glycoprotein beta-1,6-N-acetylglucosaminyltransferase activity; Category No. 241—acetylgalactosaminyltransferase activity; Category No. 242—acetylglucosaminyltransferase activity; Category No. 243—acetylpyruvate hydrolase activity; Category No. 244—acetylserotonin O-methyltransferase activity; Category No. 245—acetyltransferase activator activity; Category No. 246—acetyltransferase activity; Category No. 247—ACF complex; Category No. 248—acid phosphatase activity; Category No. 249—acid secretion; Category No. 250—acid-amino acid ligase activity; Category No. 251—acid-sensing ion channel activity; Category No. 252—acid-thiol ligase activity; Category No. 253—acinar cell differentiation; Category No. 254—acireductone dioxygenase [Iron(II)-requiring] activity; Category No. 255—acireductone synthase activity; Category No. 256—aconitate decarboxylase activity; Category No. 257—aconitate hydratase activity; Category No. 258—ACP phosphopantetheine attachment site binding involved in fatty acid biosynthetic process; Category No. 259—acrosin binding; Category No. 260—acrosomal matrix; Category No. 261—acrosomal membrane; Category No. 262—acrosomal vesicle; Category No. 263—acrosomal vesicle exocytosis; Category No. 264—acrosome assembly; Category No. 265—acrosome matrix dispersal; Category No. 266—acrosome reaction; Category No. 267—actin binding; Category No. 268—actin cap; Category No. 269—actin cortical patch; Category No. 270—actin cortical patch assembly; Category No. 271—actin cortical patch localization; Category No. 272—actin crosslink formation; Category No. 273—actin cytoskeleton; Category No. 274—actin cytoskeleton organization; Category No. 275—actin cytoskeleton reorganization; Category No. 276—actin filament; Category No. 277—actin filament binding; Category No. 278—actin filament branching; Category No. 279—actin filament bundle; Category No. 280—actin filament bundle assembly; Category No. 281—actin filament bundle organization; Category No. 282—actin filament bundle retrograde transport; Category No. 283—actin filament capping; Category No. 284—actin filament depolymerization; Category No. 285—actin filament network formation; Category No. 286—actin filament organization; Category No. 287—actin filament polymerization; Category No. 288—actin filament reorganization; Category No. 289—actin filament reorganization involved in cell cycle; Category No. 290—actin filament severing; Category No. 291—actin filament uncapping; Category No. 292—actin filament-based movement; Category No. 293—actin filament-based process; Category No. 294—actin modification; Category No. 295—actin monomer binding; Category No. 296—actin nucleation; Category No. 297—actin polymerization or depolymerization; Category No. 298—actin polymerization-dependent cell motility; Category No. 299—actin portion; Category No. 300—actin rod assembly; Category No. 301—actin ubiquitination; Category No. 302—actin-dependent ATPase activity; Category No. 303—acting on a sulfur group of donors; Category No. 304—acting on acetyl phosphate as donor; Category No. 305—acting on acid anhydrides; Category No. 306—acting on carbohydrates and derivatives; Category No. 307—acting on carbon-nitrogen (but not peptide) bonds; Category No. 308—acting on CH—OH group of donors; Category No. 309—acting on CpG substrates; Category No. 310—acting on diphenols and related substances as donors; Category No. 311—acting on ester bonds; Category No. 312—acting on free nucleotides; Category No. 313—acting on glycosyl bonds; Category No. 314—acting on NAD(P)H; Category No. 315—acting on paired donors; Category No. 316—acting on peroxide as acceptor; Category No. 317—acting on single donors with incorporation of molecular oxygen; Category No. 318—acting on the aldehyde or oxo group of donors; Category No. 319—acting on the CH—CH group of donors; Category No. 320—acting on the CH—NH2 group of donors; Category No. 321—acting on the CH—OH group of donors; Category No. 322—actinin binding; Category No. 323—actin-mediated cell contraction; Category No. 324—actin-myosin filament sliding; Category No. 325—action potential; Category No. 326—activated T cell proliferation; Category No. 327—activating transcription factor binding; Category No. 328—activation of adenylate cyclase activity; Category No. 329—activation of anaphase-promoting complex activity; Category No. 330—activation of anaphase-promoting complex activity involved in meiotic cell cycle; Category No. 331—activation of APC-Cdc20 complex activity; Category No. 332—activation of blood coagulation via clotting cascade; Category No. 333—activation of cysteine-type endopeptidase activity; Category No. 334—activation of cysteine-type endopeptidase activity involved in apoptotic process; Category No. 335—activation of cysteine-type endopeptidase activity involved in apoptotic process by cytochrome c; Category No. 336—activation of cysteine-type endopeptidase activity involved in apoptotic signaling pathway; Category No. 337—activation of GTPase activity; Category No. 338—activation of immune response; Category No. 339—activation of innate immune response; Category No. 340—activation of JAK1 kinase activity; Category No. 341—activation of JAK2 kinase activity; Category No. 342—activation of Janus kinase activity; Category No. 343—activation of JNKK activity; Category No. 344—activation of JUN kinase activity; Category No. 345—activation of MAPK activity; Category No. 346—activation of MAPK activity by adrenergic receptor signaling pathway; Category No. 347—activation of MAPK activity involved in innate immune response; Category No. 348—activation of MAPKK activity; Category No. 349—activation of MAPKKK activity; Category No. 350—activation of meiosis; Category No. 351—activation of meiosis involved in egg activation; Category No. 352—activation of NF-kappaB-inducing kinase activity; Category No. 353—activation of phospholipase A2 activity; Category No. 354—activation of phospholipase A2 activity by calcium-mediated signaling; Category No. 355—activation of phospholipase C activity; Category No. 356—activation of phospholipase D activity; Category No. 357—activation of plasma proteins involved in acute inflammatory response; Category No. 358—activation of prostate induction by androgen receptor signaling pathway; Category No. 359—activation of protein kinase A activity; Category No. 360—activation of protein kinase activity; Category No. 361—activation of protein kinase B activity; Category No.

362—activation of signaling protein activity involved in unfolded protein response; Category No. 363—activation of store-operated calcium channel activity; Category No. 364—activation of transmembrane receptor protein tyrosine kinase activity; Category No. 365—activation-induced cell death of T cells; Category No. 366—active induction of host immune response by virus; Category No. 367—activin A complex; Category No. 368—activin binding; Category No. 369—activin receptor activity type I; Category No. 370—activin receptor activity type II; Category No. 371—activin receptor complex; Category No. 372—activin receptor signaling pathway; Category No. 373—activin responsive factor complex; Category No. 374—activin-activated receptor activity; Category No. 375—actomyosin; Category No. 376—actomyosin contractile ring; Category No. 377—actomyosin contractile ring assembly; Category No. 378—actomyosin structure organization; Category No. 379—acute inflammatory response; Category No. 380—acute inflammatory response to antigenic stimulus; Category No. 381—acute-phase response; Category No. 382—acyl binding; Category No. 383—acyl carnitine transmembrane transport; Category No. 384—acyl carnitine transmembrane transporter activity; Category No. 385—acyl carnitine transport; Category No. 386—acyl groups converted into alkyl on transfer; Category No. 387—acyl-CoA dehydrogenase activity; Category No. 388—acyl-CoA hydrolase activity; Category No. 389—acyl-CoA ligase activity; Category No. 390—acyl-CoA metabolic process; Category No. 391—acyl-CoA oxidase activity; Category No. 392—acylglycerol acyl-chain remodeling; Category No. 393—acylglycerol catabolic process; Category No. 394—acylglycerol homeostasis; Category No. 395—acylglycerol kinase activity; Category No. 396—acylglycerol lipase activity; Category No. 397—acylglycerol metabolic process; Category No. 398—acyloxyacyl hydrolase activity; Category No. 399—acylphosphatase activity; Category No. 400—acylpyruvate hydrolase activity; Category No. 401—Ada2 Gcn5 Ada3 transcription activator complex; Category No. 402—adaptation of rhodopsin mediated signaling; Category No. 403—adaptive immune response; Category No. 404—adaptive immune response based on somatic recombination of immune receptors built from immunoglobulin superfamily domains; Category No. 405—adaptive thermogenesis; Category No. 406—adenine binding; Category No. 407—adenine biosynthetic process; Category No. 408—adenine metabolic process; Category No. 409—adenine nucleotide transport; Category No. 410—adenine phosphoribosyltransferase activity; Category No. 411—adenine salvage; Category No. 412—adenine transmembrane transporter activity; Category No. 413—adenine transport; Category No. 414—adenohypophysis development; Category No. 415—adenohypophysis morphogenesis; Category No. 416—adenosine biosynthetic process; Category No. 417—adenosine catabolic process; Category No. 418—adenosine deaminase activity; Category No. 419—adenosine kinase activity; Category No. 420—adenosine metabolic process; Category No. 421—adenosine receptor binding; Category No. 422—adenosine receptor signaling pathway; Category No. 423—adenosine to inosine editing; Category No. 424—adenosine-diphosphatase activity; Category No. 425—adenosylhomocysteinase activity; Category No. 426—adenosylmethionine decarboxylase activity; Category No. 427—adenyl nucleotide binding; Category No. 428—adenylate cyclase activity; Category No. 429—adenylate cyclase binding; Category No. 430—adenylate cyclase inhibiting G-protein coupled glutamate receptor activity; Category No. 431—adenylate cyclase inhibitor activity; Category No. 432—adenylate cyclase-activating adrenergic receptor signaling pathway; Category No. 433—adenylate cyclase-activating dopamine receptor signaling pathway; Category No. 434—adenylate cyclase-activating G-protein coupled receptor signaling pathway; Category No. 435—adenylate cyclase-inhibiting adrenergic receptor signaling pathway; Category No. 436—adenylate cyclase-inhibiting dopamine receptor signaling pathway; Category No. 437—adenylate cyclase-inhibiting G-protein coupled acetylcholine receptor signaling pathway; Category No. 438—adenylate cyclase-inhibiting G-protein coupled glutamate receptor signaling pathway; Category No. 439—adenylate cyclase-inhibiting G-protein coupled receptor signaling pathway; Category No. 440—adenylate cyclase-inhibiting opioid receptor signaling pathway; Category No. 441—adenylate cyclase-inhibiting serotonin receptor signaling pathway; Category No. 442—adenylate cyclase-modulating G-protein coupled receptor signaling pathway; Category No. 443—adenylate kinase activity; Category No. 444—adenylnucleotide exchange factor activity; Category No. 445—adenylosuccinate synthase activity; Category No. 446—adenylylsulfate kinase activity; Category No. 447—adherens junction; Category No. 448—adherens junction assembly; Category No. 449—adherens junction maintenance; Category No. 450—adherens junction organization; Category No. 451—adhesion of symbiont to host; Category No. 452—adipokinetic hormone receptor activity; Category No. 453—adiponectin binding; Category No. 454—adiponectin-activated signaling pathway; Category No. 455—adipose tissue development; Category No. 456—ADP binding; Category No. 457—ADP biosynthetic process; Category No. 458—ADP catabolic process; Category No. 459—ADP metabolic process; Category No. 460—ADP receptor activity; Category No. 461—ADP transmembrane transporter activity; Category No. 462—ADP transport; Category No. 463—ADP-activated adenosine receptor activity; Category No. 464—ADP-dependent NAD(P)H-hydrate dehydratase activity; Category No. 465—ADP-ribose diphosphatase activity; Category No. 466—ADP-ribosylarginine hydrolase activity; Category No. 467—ADP-ribosylation factor binding; Category No. 468—ADP-specific glucokinase activity; Category No. 469—ADP-sugar diphosphatase activity; Category No. 470—adrenal chromaffin cell differentiation; Category No. 471—adrenal cortex formation; Category No. 472—adrenal gland development; Category No. 473—adrenergic receptor activity; Category No. 474—adrenergic receptor binding; Category No. 475—adrenergic receptor signaling pathway; Category No. 476—adrenergic receptor signaling pathway involved in heart process; Category No. 477—adrenergic receptor signaling pathway involved in positive regulation of heart rate; Category No. 478—adrenomedullin receptor activity; Category No. 479—adrenomedullin receptor binding; Category No. 480—adult behavior; Category No. 481—adult feeding behavior; Category No. 482—adult heart development; Category No. 483—adult locomotory behavior; Category No. 484—adult walking behavior; Category No. 485—aerobic electron transport chain; Category No. 486—aerobic respiration; Category No. 487—AF-1 domain binding; Category No. 488—AF-2 domain binding; Category No. 489—aflatoxin B1 metabolic process; Category No. 490—age-dependent response to oxidative stress; Category No. 491—age-dependent response to reactive oxygen species; Category No. 492—aggrephagy; Category No. 493—aggresome; Category No. 494—aggresome assembly; Category No. 495—aggressive behavior; Category No. 496—aging; Category No. 497—agmatinase activity; Category No. 498—agmatine biosynthetic process; Category No. 499—AIM2 inflammasome complex; Category No. 500—AIP1-IRE1 complex; Category No. 501—alanine transport; Category No. 502—alanine-glyoxylate transaminase activity; Category No. 503—alanine-tRNA ligase activity; Category No. 504—alanyl-tRNA aminoacylation; Category No. 505—albendazole monooxygenase activity; Category No. 506—alcohol binding; Category No. 507—alcohol catabolic process; Category No. 508—alcohol dehydrogenase (NAD) activity; Category No. 509—alcohol dehydrogenase (NADP+) activity; Category No. 510—alcohol dehydrogenase [NAD(P)+] activity; Category No. 511—alcohol dehydrogenase activity; Category No. 512—alcohol group as acceptor; Category No. 513—alcohol metabolic process; Category No. 514—alcohol sulfotransferase activity; Category No. 515—aldehyde catabolic process; Category No. 516—aldehyde dehydrogenase (NAD) activity; Category No. 517—aldehyde dehydrogenase [NAD(P)+] activity; Category No. 518—aldehyde oxidase activity; Category No. 519—alditol:NADP+1-oxidoreductase activity; Category No. 520—aldo-keto reductase (NADP) activity; Category No. 521—aldose 1-epimerase activity; Category No. 522—aldosterone biosynthetic process; Category No. 523—aldosterone secretion; Category No. 524—aliphatic-amine oxidase activity; Category No. 525—alkaline phosphatase activity; Category No. 526—alkaloid catabolic process; Category No. 527—alkaloid metabolic process; Category No. 528—alkane 1-monooxygenase activity; Category No. 529—alkanesulfonate metabolic process; Category No. 530—alkenylglycerophosphocholine hydrolase activity; Category No. 531—alkenylglycerophosphoethanolamine hydrolase activity; Category No. 532—alkyl hydroperoxide reductase activity; Category No. 533—alkylbase DNA N-glycosylase activity; Category No. 534—alkylglycerone-phosphate synthase activity; Category No. 535—alkylglycerophosphoethanolamine phosphodiesterase activity; Category No. 536—allantoicase activity; Category No. 537—allantoin biosynthetic process; Category No. 538—allantoin catabolic process; Category No. 539—allantoin metabolic process; Category No. 540—all-trans retinal binding; Category No. 541—all-trans-retinol 13,14-reductase activity; Category No. 542—all-trans-retinyl-ester hydrolase; Category No. 543—all-trans-retinyl-palmitate hydrolase; Category No. 544—alpha DNA polymerase:primase complex; Category No. 545—alpha-(1->3)-fucosyltransferase activity; Category No. 546—alpha-(1->6)-fucosyltransferase activity; Category No. 547—alpha,alpha-trehalase activity; Category No. 548—alpha-1,2-mannosyltransferase activity; Category No. 549—alpha-1,3-mannosylglycoprotein 2-beta-N-acetylglucosaminyltransferase activity; Category No. 550—alpha-1,3-mannosylglycoprotein 4-beta-N-acetylglucosaminyltransferase activity; Category No. 551—alpha-1,3-mannosyltransferase activity; Category No. 552—alpha-1,4-glucosidase activity; Category No. 553—alpha-1,4-N-acetylgalactosaminyltransferase activity; Category No. 554—alpha-1,6-mannosylglycoprotein 2-beta-N-acetylglucosaminyltransferase activity; Category No. 555—alpha-1,6-mannosylglycoprotein 6-beta-N-acetylglucosaminyltransferase activity; Category No. 556—alpha-1,6-mannosyltransferase activity; Category No. 557—alpha-1A adrenergic receptor binding; Category No. 558—alpha1-adrenergic receptor activity; Category No. 559—alpha-1B adrenergic receptor binding; Category No. 560—alpha-2A adrenergic receptor binding; Category No. 561—alpha2-adrenergic receptor activity; Category No. 562—alpha-2B adrenergic receptor binding; Category No. 563—alpha-2C adrenergic receptor binding; Category No. 564—alpha9-beta1 integrin-ADAM8 complex; Category No. 565—alpha9-beta1 integrin-vascular cell adhesion molecule-1 complex; Category No. 566—alpha-actinin binding; Category No. 567—alpha-amylase activity; Category No. 568—alpha-beta cytotoxic T cell extravasation; Category No. 569—alpha-beta regulatory T cell differentiation; Category No. 570—alpha-beta regulatory T cell differentiation involved in immune response; Category No. 571—alpha-beta regulatory T cell lineage commitment; Category No. 572—alpha-beta T cell activation; Category No. 573—alpha-beta T cell costimulation; Category No. 574—alpha-beta T cell cytokine production; Category No. 575—alpha-beta T cell differentiation; Category No. 576—alpha-beta T cell differentiation involved in immune response; Category No. 577—alpha-beta T cell extravasation; Category No. 578—alpha-beta T cell lineage commitment; Category No. 579—alpha-beta T cell proliferation; Category No. 580—alpha-beta T cell receptor complex; Category No. 581—alpha-catenin binding; Category No. 582—alpha-galactosidase activity; Category No. 583—alpha-ketoacid dehydrogenase activity; Category No. 584—alpha-ketoglutarate transport; Category No. 585—alpha-L-arabinofuranosidase activity; Category No. 586—alpha-L-fucosidase activity; Category No. 587—alpha-linolenic acid metabolic process; Category No. 588—alpha-mannosidase activity; Category No. 589—alpha-methylacyl-CoA racemase activity; Category No. 590—alpha-N-acetylgalactosaminidase activity; Category No. 591—alpha-N-acetylgalactosaminide alpha-2,6-sialyltransferase activity; Category No. 592—alpha-N-acetylglucosaminidase activity; Category No. 593—alpha-N-acetylneuraminate alpha-2,8-sialyltransferase activity; Category No. 594—alpha-sialidase activity; Category No. 595—alpha-subunit complex; Category No. 596—alpha-tocopherol omega-hydroxylase activity; Category No. 597—alpha-tubulin acetylation; Category No. 598—alpha-tubulin binding; Category No. 599—alphav-beta3integrin-IGF-1-IGF1R complex; Category No. 600—alphav-beta3 integrin-vitronectin complex; Category No. 601—alternative mRNA splicing; Category No. 602—alternative pathway; Category No. 603—alveolar lamellar body; Category No. 604—alveolar lamellar body membrane; Category No. 605—alveolar primary septum development; Category No. 606—alveolar secondary septum development; Category No. 607—amacrine cell differentiation; Category No. 608—ameboidal-type cell migration; Category No. 609—amelogenesis; Category No. 610—amidase activity; Category No. 611—amide binding; Category No. 612—amide transport; Category No. 613—amidophosphoribosyltransferase activity; Category No. 614—amine binding; Category No. 615—amine biosynthetic process; Category No. 616—amine metabolic process; Category No. 617—amine N-methyltransferase activity; Category No. 618—amine transmembrane transporter activity; Category No. 619—amine transport; Category No. 620—amino acid binding; Category No. 621—amino acid homeostasis; Category No. 622—amino acid transmembrane transport; Category No. 623—amino acid transmembrane transporter activity; Category No. 624—amino acid transport; Category No. 625—amino sugar metabolic process; Category No. 626—aminoacetone:oxygen oxidoreductase (deaminating) activity; Category No. 627—amino-acid betaine catabolic process; Category No. 628—amino-acid betaine metabolic process; Category No. 629—aminoacylase activity; Category No. 630—aminoacyl-tRNA editing activity; Category No. 631—aminoacyl-tRNA hydrolase activity; Category No. 632—aminoacyl-tRNA ligase activity; Category No. 633—aminoacyl-tRNA synthetase multienzyme complex;

Category No. 634—aminobutyraldehyde dehydrogenase activity; Category No. 635—aminocarboxymuconate-semialdehyde decarboxylase activity; Category No. 636—aminomethyltransferase activity; Category No. 637—aminopeptidase activity; Category No. 638—aminophospholipid transport; Category No. 639—ammon gyrus development; Category No. 640—ammonia assimilation cycle; Category No. 641—ammonia homeostasis; Category No. 642—ammonia-lyase activity; Category No. 643—ammonium transmembrane transport; Category No. 644—ammonium transmembrane transporter activity; Category No. 645—ammonium transport; Category No. 646—AMP binding; Category No. 647—AMP biosynthetic process; Category No. 648—AMP catabolic process; Category No. 649—AMP deaminase activity; Category No. 650—AMP metabolic process; Category No. 651—AMP phosphorylation; Category No. 652—AMP salvage; Category No. 653—AMP transmembrane transporter activity; Category No. 654—AMP transport; Category No. 655—AMPA glutamate receptor activity; Category No. 656—AMPA glutamate receptor clustering; Category No. 657—AMPA glutamate receptor complex; Category No. 658—AMP-activated protein kinase activity; Category No. 659—amygdala development; Category No. 660—amylase activity; Category No. 661—amylase secretion; Category No. 662—amylo-alpha-1,6-glucosidase activity; Category No. 663—amyloid fibril formation; Category No. 664—amyloid precursor protein catabolic process; Category No. 665—amyloid precursor protein metabolic process; Category No. 666—amylopectin biosynthetic process; Category No. 667—anagen; Category No. 668—anaphase-promoting complex; Category No. 669—anaphase-promoting complex binding; Category No. 670—anaphase-promoting complex-dependent proteasomal ubiquitin-dependent protein catabolic process; Category No. 671—anatomical structure arrangement; Category No. 672—anatomical structure development; Category No. 673—anatomical structure formation involved in morphogenesis; Category No. 674—anatomical structure morphogenesis; Category No. 675—anatomical structure regression; Category No. 676—anchored component of external side of plasma membrane; Category No. 677—anchored component of membrane; Category No. 678—anchored component of plasma membrane; Category No. 679—and incorporation of one atom each of oxygen into both donors; Category No. 680—and incorporation of one atom of oxygen; Category No. 681—androgen binding; Category No. 682—androgen biosynthetic process; Category No. 683—androgen catabolic process; Category No. 684—androgen metabolic process; Category No. 685—androgen receptor activity; Category No. 686—androgen receptor binding; Category No. 687—androgen receptor signaling pathway; Category No. 688—androsterone dehydrogenase (B-specific) activity; Category No. 689—androsterone dehydrogenase activity; Category No. 690—angiogenesis; Category No. 691—angiogenesis involved in coronary vascular morphogenesis; Category No. 692—angiogenesis involved in wound healing; Category No. 693—angiogenin-PRI complex; Category No. 694—angiostatin binding; Category No. 695—angiotensin catabolic process in blood; Category No. 696—angiotensin maturation; Category No. 697—angiotensin mediated vasoconstriction involved in regulation of systemic arterial blood pressure; Category No. 698—angiotensin receptor activity; Category No. 699—angiotensin receptor binding; Category No. 700—angiotensin type I receptor activity; Category No. 701—angiotensin type II receptor activity; Category No. 702—angiotensin-activated signaling pathway; Category No. 703—angiotensin-activated signaling pathway involved in heart process; Category No. 704—angiotensin-mediated drinking behavior; Category No. 705—anion binding; Category No. 706—anion channel activity; Category No. 707—anion homeostasis; Category No. 708—anion transmembrane transport; Category No. 709—anion transmembrane transporter activity; Category No. 710—anion transport; Category No. 711—anion:anion antiporter activity; Category No. 712—ankyrin binding; Category No. 713—ankyrin repeat binding; Category No. 714—annealing helicase activity; Category No. 715—annulate lamellae; Category No. 716—anoikis; Category No. 717—another compound as one donor; Category No. 718—anterior commissure morphogenesis; Category No. 719—anterior compartment pattern formation; Category No. 720—anterior neural tube closure; Category No. 721—anterior neuropore closure; Category No. 722—anterior posterior axis specification; Category No. 723—anterior posterior axon guidance; Category No. 724—anterior posterior pattern specification; Category No. 725—anterior semicircular canal development; Category No. 726—anterograde axon cargo transport; Category No. 727—anterograde synaptic vesicle transport; Category No. 728—anthranilate metabolic process; Category No. 729—antibacterial humoral response; Category No. 730—antibacterial peptide biosynthetic process; Category No. 731—antibacterial peptide production; Category No. 732—antibacterial peptide secretion; Category No. 733—antibiotic metabolic process; Category No. 734—antifungal humoral response; Category No. 735—antigen binding; Category No. 736—antigen processing and presentation; Category No. 737—antigen processing and presentation of endogenous antigen; Category No. 738—antigen processing and presentation of endogenous peptide antigen via MHC class I; Category No. 739—antigen processing and presentation of endogenous peptide antigen via MHC class I via ER pathway; Category No. 740—antigen processing and presentation of endogenous peptide antigen via MHC class Ib via ER pathway; Category No. 741—antigen processing and presentation of exogenous antigen; Category No. 742—antigen processing and presentation of exogenous peptide antigen via MHC class I; Category No. 743—antigen processing and presentation of exogenous peptide antigen via MHC class II; Category No. 744—antigen processing and presentation of exogenous protein antigen via MHC class Ib; Category No. 745—antigen processing and presentation of peptide antigen; Category No. 746—antigen processing and presentation of peptide antigen via MHC class I; Category No. 747—antigen processing and presentation of peptide antigen via MHC class II; Category No. 748—antigen processing and presentation of peptide or polysaccharide antigen via MHC class II; Category No. 749—antigen receptor-mediated signaling pathway; Category No. 750—antimicrobial humoral response; Category No. 751—anti-Mullerian hormone receptor activity; Category No. 752—anti-Mullerian hormone signaling pathway; Category No. 753—antioxidant activity; Category No. 754—antiporter activity; Category No. 755—antral ovarian follicle growth; Category No. 756—aorta development; Category No. 757—aorta morphogenesis; Category No. 758—aorta smooth muscle tissue morphogenesis; Category No. 759—aortic smooth muscle cell differentiation; Category No. 760—aortic valve development; Category No. 761—aortic valve morphogenesis; Category No. 762—AP site formation; Category No. 763—AP-1 adaptor complex; Category No. 764—AP-1 adaptor complex binding; Category No. 765—AP1 complex; Category No. 766—AP-2 adaptor complex; Category No. 767—AP-2 adaptor complex binding; Category No. 768—

AP-3 adaptor complex; Category No. 769—AP-3 adaptor complex binding; Category No. 770—AP-5 adaptor complex; Category No. 771—apelin receptor binding; Category No. 772—apelin receptor signaling pathway; Category No. 773—apical constriction; Category No. 774—apical cortex; Category No. 775—apical dendrite; Category No. 776—apical junction assembly; Category No. 777—apical junction complex; Category No. 778—apical part of cell; Category No. 779—apical plasma membrane; Category No. 780—apical protein localization; Category No. 781—apicolateral plasma membrane; Category No. 782—apolipoprotein A-I binding; Category No. 783—apolipoprotein A-I receptor activity; Category No. 784—apolipoprotein A-I receptor binding; Category No. 785—apolipoprotein A-I-mediated signaling pathway; Category No. 786—apolipoprotein B mRNA editing enzyme complex; Category No. 787—apolipoprotein binding; Category No. 788—apolipoprotein receptor binding; Category No. 789—apoptosome; Category No. 790—apoptotic cell clearance; Category No. 791—apoptotic chromosome condensation; Category No. 792—apoptotic DNA fragmentation; Category No. 793—apoptotic mitochondrial changes; Category No. 794—apoptotic nuclear changes; Category No. 795—apoptotic process; Category No. 796—apoptotic process in bone marrow; Category No. 797—apoptotic process involved in development; Category No. 798—apoptotic process involved in embryonic digit morphogenesis; Category No. 799—apoptotic process involved in heart morphogenesis; Category No. 800—apoptotic process involved in luteolysis; Category No. 801—apoptotic process involved in morphogenesis; Category No. 802—apoptotic process involved in patterning of blood vessels; Category No. 803—apoptotic signaling pathway; Category No. 804—AP-type membrane coat adaptor complex; Category No. 805—aquacobalamin reductase (NADPH) activity; Category No. 806—arachidonate 12-lipoxygenase activity; Category No. 807—arachidonate 15-lipoxygenase activity; Category No. 808—arachidonate 5-lipoxygenase activity; Category No. 809—arachidonate 8(S)-lipoxygenase activity; Category No. 810—arachidonate-CoA ligase activity; Category No. 811—arachidonic acid 11,12-epoxygenase activity; Category No. 812—arachidonic acid 14,15-epoxygenase activity; Category No. 813—arachidonic acid binding; Category No. 814—arachidonic acid epoxygenase activity; Category No. 815—arachidonic acid metabolic process; Category No. 816—arachidonic acid omega-hydroxylase activity; Category No. 817—arachidonic acid secretion; Category No. 818—aralkylamine N-acetyltransferase activity; Category No. 819—ARC complex; Category No. 820—ARF guanyl-nucleotide exchange factor activity; Category No. 821—arginase activity; Category No. 822—arginine binding; Category No. 823—arginine biosynthetic process; Category No. 824—arginine biosynthetic process via ornithine; Category No. 825—arginine catabolic process; Category No. 826—arginine catabolic process to glutamate; Category No. 827—arginine catabolic process to ornithine; Category No. 828—arginine catabolic process to proline via ornithine; Category No. 829—arginine deiminase activity; Category No. 830—arginine metabolic process; Category No. 831—arginine transmembrane transport; Category No. 832—arginine transmembrane transporter activity; Category No. 833—arginine transport; Category No. 834—arginine-tRNA ligase activity; Category No. 835—argininosuccinate lyase activity; Category No. 836—argininosuccinate metabolic process; Category No. 837—argininosuccinate synthase activity; Category No. 838—arginyltransferase activity; Category No. 839—arginyl-tRNA aminoacylation; Category No. 840—armadillo repeat domain binding; Category No. 841—aromatase activity; Category No. 842—aromatic amino acid family catabolic process; Category No. 843—aromatic amino acid family metabolic process; Category No. 844—aromatic amino acid transmembrane transporter activity; Category No. 845—aromatic amino acid transport; Category No. 846—aromatic compound catabolic process; Category No. 847—aromatic-L-amino-acid decarboxylase activity; Category No. 848—Arp2 3 complex binding; Category No. 849—Arp2 3 complex-mediated actin nucleation; Category No. 850—Arp2 3 protein complex; Category No. 851—arrestin family protein binding; Category No. 852—arsenate ion transmembrane transport; Category No. 853—arsenate reductase (glutaredoxin) activity; Category No. 854—arsenite methyltransferase activity; Category No. 855—arsenite transmembrane transporter activity; Category No. 856—arsonoacetate metabolic process; Category No. 857—arterial endothelial cell differentiation; Category No. 858—arterial endothelial cell fate commitment; Category No. 859—artery development; Category No. 860—artery morphogenesis; Category No. 861—artery smooth muscle contraction; Category No. 862—aryl hydrocarbon receptor activity; Category No. 863—aryl hydrocarbon receptor binding; Category No. 864—aryl hydrocarbon receptor complex; Category No. 865—aryl sulfotransferase activity; Category No. 866—arylamine N-acetyltransferase activity; Category No. 867—aryldialkylphosphatase activity; Category No. 868—arylesterase activity; Category No. 869—arylformamidase activity; Category No. 870—arylsulfatase activity; Category No. 871—ASAP complex; Category No. 872—ascending aorta morphogenesis; Category No. 873—asialoglycoprotein receptor activity; Category No. 874—asparaginase activity; Category No. 875—asparagine biosynthetic process; Category No. 876—asparagine catabolic process via L-aspartate; Category No. 877—asparagine metabolic process; Category No. 878—asparagine synthase (glutamine-hydrolyzing) activity; Category No. 879—asparagine transport; Category No. 880—asparagine-tRNA ligase activity; Category No. 881—asparaginyl-tRNA aminoacylation; Category No. 882—aspartate 1-decarboxylase activity; Category No. 883—aspartate binding; Category No. 884—aspartate biosynthetic process; Category No. 885—aspartate carbamoyltransferase activity; Category No. 886—aspartate catabolic process; Category No. 887—aspartate dehydrogenase activity; Category No. 888—aspartate metabolic process; Category No. 889—aspartate N-acetyltransferase activity; Category No. 890—aspartate transport; Category No. 891—aspartate-tRNA ligase activity; Category No. 892—aspartate-tRNA(Asn) ligase activity; Category No. 893—aspartic endopeptidase activity; Category No. 894—aspartic-type endopeptidase activity; Category No. 895—aspartic-type endopeptidase inhibitor activity; Category No. 896—aspartic-type peptidase activity; Category No. 897—aspartoacylase activity; Category No. 898—aspartyl-tRNA aminoacylation; Category No. 899—A-specific) activity; Category No. 900—assembly of large subunit precursor of preribosome; Category No. 901—associative learning; Category No. 902—aster; Category No. 903—astral microtubule; Category No. 904—astral microtubule organization; Category No. 905—astrocyte activation; Category No. 906—astrocyte cell migration; Category No. 907—astrocyte development; Category No. 908—astrocyte differentiation; Category No. 909—astrocyte end-foot; Category No. 910—astrocyte fate commitment; Category No. 911—astrocyte projection; Category No. 912—asymmetric cell division; Category No. 913—asymmetric Golgi ribbon formation;

Category No. 914—asymmetric protein localization; Category No. 915—asymmetric synapse; Category No. 916—AT DNA binding; Category No. 917—ATF1-ATF4 transcription factor complex; Category No. 918—ATF4-CREB1 transcription factor complex; Category No. 919—ATF6-mediated unfolded protein response; Category No. 920—ATG1 ULK1 kinase complex; Category No. 921—Atg12 activating enzyme activity; Category No. 922—Atg12 transferase activity; Category No. 923—Atg12-Atg5-Atg16 complex; Category No. 924—Atg8 activating enzyme activity; Category No. 925—Atg8 ligase activity; Category No. 926—ATP binding; Category No. 927—ATP biosynthetic process; Category No. 928—ATP citrate synthase activity; Category No. 929—ATP diphosphatase activity; Category No. 930—ATP generation from ADP; Category No. 931—ATP hydrolysis coupled proton transport; Category No. 932—ATP metabolic process; Category No. 933—ATP synthesis coupled electron transport; Category No. 934—ATP synthesis coupled proton transport; Category No. 935—ATP transmembrane transporter activity; Category No. 936—ATP transport; Category No. 937—ATP:3'-cytidine-cytidine-tRNA adenylyltransferase activity; Category No. 938—ATP:ADP antiporter activity; Category No. 939—ATP-activated adenosine receptor activity; Category No. 940—ATP-activated inward rectifier potassium channel activity; Category No. 941—ATPase activator activity; Category No. 942—ATPase activity; Category No. 943—ATPase binding; Category No. 944—ATPase inhibitor activity; Category No. 945—ATPase regulator activity; Category No. 946—ATP-binding and phosphorylation-dependent chloride channel activity; Category No. 947—ATP-binding cassette (ABC) transporter complex; Category No. 948—ATP-dependent 3-5' DNA helicase activity; Category No. 949—ATP-dependent 5'-3' DNA helicase activity; Category No. 950—ATP-dependent 5'-3' DNA RNA helicase activity; Category No. 951—ATP-dependent 5'-3' RNA helicase activity; Category No. 952—ATP-dependent chromatin remodeling; Category No. 953—ATP-dependent DNA helicase activity; Category No. 954—ATP-dependent helicase activity; Category No. 955—ATP-dependent microtubule motor activity; Category No. 956—ATP-dependent NAD(P)H-hydrate dehydratase activity; Category No. 957—ATP-dependent peptidase activity; Category No. 958—ATP-dependent polydeoxyribonucleotide 5'-hydroxyl-kinase activity; Category No. 959—ATP-dependent polyribonucleotide 5'-hydroxyl-kinase activity; Category No. 960—ATP-dependent protein binding; Category No. 961—ATP-dependent RNA helicase activity; Category No. 962—ATP-sensitive potassium channel complex; Category No. 963—atrial cardiac muscle cell action potential; Category No. 964—atrial cardiac muscle cell development; Category No. 965—atrial cardiac muscle cell to AV node cell communication; Category No. 966—atrial cardiac muscle tissue morphogenesis; Category No. 967—atrial septum development; Category No. 968—atrial septum morphogenesis; Category No. 969—atrial septum primum morphogenesis; Category No. 970—atrial septum secundum morphogenesis; Category No. 971—atrial ventricular junction remodeling; Category No. 972—atrioventricular bundle cell differentiation; Category No. 973—atrioventricular canal development; Category No. 974—atrioventricular node cell development; Category No. 975—atrioventricular node cell fate commitment; Category No. 976—atrioventricular node development; Category No. 977—atrioventricular valve development; Category No. 978—atrioventricular valve formation; Category No. 979—atrioventricular valve morphogenesis; Category No. 980—attachment of GPI anchor to protein; Category No. 981—attachment of mitotic spindle microtubules to kinetochore; Category No. 982—attachment of spindle microtubules to kinetochore; Category No. 983—A-type (transient outward) potassium channel activity; Category No. 984—auditory behavior; Category No. 985—auditory receptor cell development; Category No. 986—auditory receptor cell differentiation; Category No. 987—auditory receptor cell fate commitment; Category No. 988—auditory receptor cell fate determination; Category No. 989—auditory receptor cell fate specification; Category No. 990—auditory receptor cell morphogenesis; Category No. 991—auditory receptor cell stereocilium organization; Category No. 992—AU-rich element binding; Category No. 993—autocrine signaling; Category No. 994—autolysis; Category No. 995—autonomic nervous system development; Category No. 996—autophagic cell death; Category No. 997—autophagosome; Category No. 998—autophagosome assembly; Category No. 999—autophagosome lumen; Category No. 1000—autophagosome maturation; Category No. 1001—autophagosome membrane; Category No. 1002—autophagy; Category No. 1003—autophagy in response to ER overload; Category No. 1004—autosome; Category No. 1005—AV node cell action potential; Category No. 1006—AV node cell to bundle of His cell communication; Category No. 1007—AV node cell to bundle of His cell communication by electrical coupling; Category No. 1008—AV node cell-bundle of His cell adhesion involved in cell communication; Category No. 1009—axial mesoderm development; Category No. 1010—axial mesoderm formation; Category No. 1011—axial mesoderm morphogenesis; Category No. 1012—axial mesodermal cell fate specification; Category No. 1013—axis elongation; Category No. 1014—axis elongation involved in somitogenesis; Category No. 1015—axis specification; Category No. 1016—axolemma; Category No. 1017—axon; Category No. 1018—axon cargo transport; Category No. 1019—axon choice point recognition; Category No. 1020—axon cytoplasm; Category No. 1021—axon development; Category No. 1022—axon ensheathment; Category No. 1023—axon extension; Category No. 1024—axon extension involved in axon guidance; Category No. 1025—axon extension involved in regeneration; Category No. 1026—axon guidance; Category No. 1027—axon guidance receptor activity; Category No. 1028—axon hillock; Category No. 1029—axon initial segment; Category No. 1030—axon midline choice point recognition; Category No. 1031—axon regeneration; Category No. 1032—axon target recognition; Category No. 1033—axon terminus; Category No. 1034—axon transport of mitochondrion; Category No. 1035—axonal fasciculation; Category No. 1036—axonal growth cone; Category No. 1037—axonal spine; Category No. 1038—axonemal basal plate; Category No. 1039—axonemal central apparatus; Category No. 1040—axonemal central apparatus assembly; Category No. 1041—axonemal central pair projection; Category No. 1042—axonemal dynein complex; Category No. 1043—axonemal dynein complex assembly; Category No. 1044—axonemal microtubule; Category No. 1045—axonemal microtubule depolymerization; Category No. 1046—axoneme; Category No. 1047—axoneme assembly; Category No. 1048—axonogenesis; Category No. 1049—axonogenesis involved in innervation; Category No. 1050—azurophil granule; Category No. 1051—azurophil granule lumen; Category No. 1052—azurophil granule membrane; Category No. 1053—B cell activation; Category No. 1054—B cell activation involved in immune response; Category No. 1055—B cell apoptotic process; Category No. 1056—B cell chemotaxis; Category No. 1057—B cell chemotaxis across high endothelial venule; Category No. 1058—B cell costimulation; Category No. 1059—B cell cytokine production; Category No. 1060—B cell differentiation; Category No. 1061—B cell homeostasis; Category No. 1062—B cell homeostatic proliferation; Category No. 1063—B cell lineage commitment; Category No. 1064—B cell mediated immunity; Category No. 1065—B cell negative selection; Category No. 1066—B cell proliferation; Category No. 1067—B cell proliferation involved in immune response; Category No. 1068—B cell receptor apoptotic signaling pathway; Category No. 1069—B cell receptor complex; Category No. 1070—B cell receptor signaling pathway; Category No. 1071—B-1 B cell differentiation; Category No. 1072—B-1 B cell homeostasis; Category No. 1073—B-1a B cell differentiation; Category No. 1074—B2 bradykinin receptor binding; Category No. 1075—bacterial-type flagellum-dependent cell motility; Category No. 1076—baculum development; Category No. 1077—BAF-type complex; Category No. 1078—barbed-end actin filament capping; Category No. 1079—barbed-end actin filament uncapping; Category No. 1080—Barr body; Category No. 1081—barrier septum assembly; Category No. 1082—basal cortex; Category No. 1083—basal lamina; Category No. 1084—basal part of cell; Category No. 1085—basal plasma membrane; Category No. 1086—basal protein localization; Category No. 1087—base conversion or substitution editing; Category No. 1088—base subcomplex; Category No. 1089—base-excision repair; Category No. 1090—basement membrane; Category No. 1091—basement membrane assembly; Category No. 1092—basement membrane disassembly; Category No. 1093—basement membrane organization; Category No. 1094—basic amino acid transmembrane transport; Category No. 1095—basic amino acid transmembrane transporter activity; Category No. 1096—basic amino acid transport; Category No. 1097—basilar dendrite; Category No. 1098—basolateral part of cell; Category No. 1099—basolateral plasma membrane; Category No. 1100—basolateral protein localization; Category No. 1101—basophil activation; Category No. 1102—basophil chemotaxis; Category No. 1103—basophil differentiation; Category No. 1104—BAT3 complex; Category No. 1105—BAT3 complex binding; Category No. 1106—BAX complex; Category No. 1107—BBSome; Category No. 1108—Bcl-2 family protein complex; Category No. 1109—Bcl3 NF-kappaB2 complex; Category No. 1110—Bcl3-Bcl10 complex; Category No. 1111—behavior; Category No. 1112—behavioral fear response; Category No. 1113—behavioral process; Category No. 1114—behavioral response to cocaine; Category No. 1115—behavioral response to ethanol; Category No. 1116—behavioral response to formalin induced pain; Category No. 1117—behavioral response to nicotine; Category No. 1118—behavioral response to nutrient; Category No. 1119—behavioral response to pain; Category No. 1120—behavioral response to starvation; Category No. 1121—bending; Category No. 1122—bent DNA binding; Category No. 1123—benzaldehyde dehydrogenase (NAD+) activity; Category No. 1124—benzaldehyde dehydrogenase activity; Category No. 1125—benzoate metabolic process; Category No. 1126—benzodiazepine receptor activity; Category No. 1127—benzodiazepine receptor binding; Category No. 1128—Bergmann glial cell differentiation; Category No. 1129—beta selection; Category No. 1130—beta-1 adrenergic receptor binding; Category No. 1131—beta-1,3-galactosyl-O-glycosyl-glycoprotein beta-1,3-N-acetylglucosaminyltransferase activity; Category No. 1132—beta-1,3-galactosyl-O-glycosyl-glycoprotein beta-1,6-N-acetylglucosaminyltransferase activity; Category No. 1133—beta-1,4-mannosylglycoprotein 4-beta-N-acetylglucosaminyltransferase activity; Category No. 1134—beta1-adrenergic receptor activity; Category No. 1135—beta-2 adrenergic receptor binding; Category No. 1136—beta2-adrenergic receptor activity; Category No. 1137—beta-2-microglobulin binding; Category No. 1138—beta-3 adrenergic receptor binding; Category No. 1139—beta3-adrenergic receptor activity; Category No. 1140—beta-adrenergic receptor activity; Category No. 1141—beta-adrenergic receptor kinase activity; Category No. 1142—beta-alanine biosynthetic process; Category No. 1143—beta-alanine catabolic process; Category No. 1144—beta-alanine metabolic process; Category No. 1145—beta-alanine-pyruvate transaminase activity; Category No. 1146—beta-amyloid binding; Category No. 1147—beta-amyloid clearance; Category No. 1148—beta-amyloid formation; Category No. 1149—beta-amyloid metabolic process; Category No. 1150—beta-aspartyl-peptidase activity; Category No. 1151—beta-carotene 15,15'-monooxygenase activity; Category No. 1152—beta-carotene metabolic process; Category No. 1153—beta-catenin binding; Category No. 1154—beta-catenin destruction complex; Category No. 1155—beta-catenin destruction complex binding; Category No. 1156—beta-catenin-TCF7L2 complex; Category No. 1157—beta-endorphin binding; Category No. 1158—beta-endorphin receptor activity; Category No. 1159—beta-galactosidase activity; Category No. 1160—beta-galactoside (CMP) alpha-2,3-sialyltransferase activity; Category No. 1161—beta-galactoside alpha-2,3-sialyltransferase activity; Category No. 1162—beta-galactoside alpha-2,6-sialyltransferase activity; Category No. 1163—beta-galactosyl-N-acetylglucosaminylgalactosylglucosyl-ceramide beta-1,3-acetylglucosaminyltransferase activity; Category No. 1164—beta-glucosidase activity; Category No. 1165—beta-glucuronidase activity; Category No. 1166—betaine-aldehyde dehydrogenase activity; Category No. 1167—betaine-homocysteine S-methyltransferase activity; Category No. 1168—beta-mannosidase activity; Category No. 1169—beta-N-acetylgalactosaminidase activity; Category No. 1170—beta-N-acetylglucosaminidase activity; Category No. 1171—beta-N-acetylglucosaminylglycopeptide beta-1,4-galactosyltransferase activity; Category No. 1172—beta-N-acetylhexosaminidase activity; Category No. 1173—beta-tubulin binding; Category No. 1174—beta-ureidopropionase activity; Category No. 1175—BH domain binding; Category No. 1176—BH3 domain binding; Category No. 1177—BH4 domain binding; Category No. 1178—bHLH transcription factor binding; Category No. 1179—bicarbonate binding; Category No. 1180—bicarbonate transmembrane transporter activity; Category No. 1181—bicarbonate transport; Category No. 1182—bicellular tight junction; Category No. 1183—bicellular tight junction assembly; Category No. 1184—bile acid and bile salt transport; Category No. 1185—bile acid binding; Category No. 1186—bile acid biosynthetic process; Category No. 1187—bile acid catabolic process; Category No. 1188—bile acid conjugation; Category No. 1189—bile acid metabolic process; Category No. 1190—bile acid receptor activity; Category No. 1191—bile acid secretion; Category No. 1192—bile acid signaling pathway; Category No. 1193—bile acid transmembrane transporter activity; Category No. 1194—bile acid:sodium symporter activity; Category No. 1195—bile acid-exporting ATPase activity; Category No. 1196—bile-salt sulfotransferase activity; Category No. 1197—bilirubin conjugation; Category No. 1198—biliverdin reductase activity; Category No. 1199—BIM-BCL-2 complex; Category No. 1200—BIM-BCL-xl complex; Category No. 1201—binding; Category No. 1202—binding of sperm to zona pellucida; Category No. 1203—bioactive lipid receptor activity; Category No. 1204—biological process; Category No. 1205—bioluminescence; Category No. 1206—biomineral tissue development; Category No. 1207—biosynthetic process; Category No. 1208—biotin binding; Category No. 1209—biotin carboxylase activity; Category No. 1210—biotin metabolic process; Category No. 1211—biotin transport; Category No. 1212—biotin-[acetyl-CoA-carboxylase] ligase activity; Category No. 1213—biotin-[methylcrotonoyl-CoA-carboxylase] ligase activity; Category No. 1214—biotin-[methylmalonyl-CoA-carboxytransferase] ligase activity; Category No. 1215—biotin-[propionyl-CoA-carboxylase (ATP-hydrolyzing)] ligase activity; Category No. 1216—biotinidase activity; Category No. 1217—biotin-protein ligase activity; Category No. 1218—biphenyl catabolic process; Category No. 1219—biphenyl metabolic process; Category No. 1220—bis(5'-adenosyl)-triphosphatase activity; Category No. 1221—bis(5'-nucleosyl)-tetraphosphatase (asymmetrical) activity; Category No. 1222—bis(5'-nucleosyl)-tetraphosphatase (symmetrical) activity; Category No. 1223—bisphosphoglycerate 2-phosphatase activity; Category No. 1224—bisphosphoglycerate 3-phosphatase activity; Category No. 1225—bisphosphoglycerate mutase activity; Category No. 1226—bitter taste receptor activity; Category No. 1227—blastocyst development; Category No. 1228—blastocyst formation; Category No. 1229—blastocyst growth; Category No. 1230—blastocyst hatching; Category No. 1231—bleb; Category No. 1232—bleb assembly; Category No. 1233—BLOC-1 complex; Category No. 1234—BLOC-2 complex; Category No. 1235—BLOC-2 complex binding; Category No. 1236—BLOC-3 complex; Category No. 1237—blood circulation; Category No. 1238—blood coagulation; Category No. 1239—blood microparticle; Category No. 1240—blood vessel development; Category No. 1241—blood vessel endothelial cell delamination; Category No. 1242—blood vessel endothelial cell differentiation; Category No. 1243—blood vessel endothelial cell fate specification; Category No. 1244—blood vessel endothelial cell migration; Category No. 1245—blood vessel endothelial cell migration involved in intussusceptive angiogenesis; Category No. 1246—blood vessel endothelial cell proliferation involved in sprouting angiogenesis; Category No. 1247—blood vessel lumenization; Category No. 1248—blood vessel maturation; Category No. 1249—blood vessel morphogenesis; Category No. 1250—blood vessel remodeling; Category No. 1251—blue light photoreceptor activity; Category No. 1252—blue light signaling pathway; Category No. 1253—BMP binding; Category No. 1254—BMP receptor activity; Category No. 1255—BMP receptor binding; Category No. 1256—BMP receptor complex; Category No. 1257—BMP signaling pathway; Category No. 1258—BMP signaling pathway involved in heart development; Category No. 1259—BMP signaling pathway involved in heart induction; Category No. 1260—BMP signaling pathway involved in mesodermal cell fate specification; Category No. 1261—BMP signaling pathway involved in nephric duct formation; Category No. 1262—BMP signaling pathway involved in renal system segmentation; Category No. 1263—BMP signaling pathway involved in spinal cord dorsal ventral patterning; Category No. 1264—BMP signaling pathway involved in ureter morphogenesis; Category No. 1265—body fluid secretion; Category No. 1266—body morphogenesis; Category No. 1267—bombesin receptor activity; Category No. 1268—bombesin receptor signaling pathway; Category No. 1269—bone development; Category No. 1270—bone marrow development; Category No. 1271—bone maturation; Category No. 1272—bone mineralization; Category No. 1273—bone mineralization involved in bone maturation; Category No. 1274—bone morphogenesis; Category No. 1275—bone regeneration; Category No. 1276—bone remodeling; Category No. 1277—bone resorption; Category No. 1278—bone trabecula formation; Category No. 1279—borate transmembrane transport; Category No. 1280—borate transmembrane transporter activity; Category No. 1281—borate transport; Category No. 1282—bounding membrane of organelle; Category No. 1283—box C D snoRNA 3'-end processing; Category No. 1284—box C D snoRNA binding; Category No. 1285—box C D snoRNP assembly; Category No. 1286—box C D snoRNP complex; Category No. 1287—box H ACA RNP complex; Category No. 1288—box H ACA scaRNP complex; Category No. 1289—box H ACA snoRNA 3-end processing; Category No. 1290—box H ACA snoRNA metabolic process; Category No. 1291—box H ACA snoRNP complex; Category No. 1292—bradykinin catabolic process; Category No. 1293—bradykinin receptor activity; Category No. 1294—bradykinin receptor binding; Category No. 1295—brain development; Category No. 1296—brain morphogenesis; Category No. 1297—brain renin-angiotensin system; Category No. 1298—brain segmentation; Category No. 1299—brain-derived neurotrophic factor binding; Category No. 1300—brain-derived neurotrophic factor receptor signaling pathway; Category No. 1301—brain-derived neurotrophic factor-activated receptor activity; Category No. 1302—brainstem development; Category No. 1303—branch elongation involved in mammary gland duct branching; Category No. 1304—branch elongation involved in salivary gland morphogenesis; Category No. 1305—branch elongation involved in ureteric bud branching; Category No. 1306—branch elongation of an epithelium; Category No. 1307—branched-chain amino acid biosynthetic process; Category No. 1308—branched-chain amino acid catabolic process; Category No. 1309—branched-chain amino acid metabolic process; Category No. 1310—branched-chain amino acid transport; Category No. 1311—branched-chain-amino-acid transaminase activity; Category No. 1312—branching involved in labyrinthine layer morphogenesis; Category No. 1313—branching involved in mammary gland duct morphogenesis; Category No. 1314—branching involved in open tracheal system development; Category No. 1315—branching involved in pancreas morphogenesis; Category No. 1316—branching involved in prostate gland morphogenesis; Category No. 1317—branching involved in salivary gland morphogenesis; Category No. 1318—branching involved in ureteric bud morphogenesis; Category No. 1319—branching morphogenesis of a nerve; Category No. 1320—branching morphogenesis of an epithelial tube; Category No. 1321—branchiomeric skeletal muscle development; Category No. 1322—branchiomotor neuron axon guidance; Category No. 1323—BRCA1-A complex; Category No. 1324—BRCA1-BARD1 complex; Category No. 1325—BRCA2-MAGE-D1 complex; Category No. 1326—BRE binding; Category No. 1327—bridging; Category No. 1328—BRISC complex; Category No. 1329—bronchiole development; Category No. 1330—bronchiole morphogenesis; Category No. 1331—bronchus cartilage development; Category No. 1332—bronchus development; Category No. 1333—bronchus morphogenesis; Category No. 1334—brown fat cell differentiation; Category No. 1335—brush border; Category No. 1336—brush border membrane; Category No. 1337—B-specific) activity; Category No. 1338— bubble DNA binding; Category No. 1339—bud dilation involved in lung branching; Category No. 1340—bud elongation involved in lung branching; Category No. 1341—bud outgrowth involved in lung branching; Category No. 1342—bundle of His cell action potential; Category No. 1343—bundle of His cell to Purkinje myocyte communication; Category No. 1344—bundle of His cell to Purkinje myocyte communication by electrical coupling; Category No. 1345—bundle of His cell-Purkinje myocyte adhesion involved in cell communication; Category No. 1346—bundle of His development; Category No. 1347—butyrate catabolic process; Category No. 1348—butyrate metabolic process; Category No. 1349—butyrate-CoA ligase activity; Category No. 1350—butyryl-CoA dehydrogenase activity; Category No. 1351—by transamination; Category No. 1352—by transamination of glyoxylate; Category No. 1353—C zone; Category No. 1354—C21-steroid hormone biosynthetic process; Category No. 1355—C21-steroid hormone metabolic process; Category No. 1356—C2H2 zinc finger domain binding; Category No. 1357—C3a anaphylatoxin receptor activity; Category No. 1358—C3HC4-type RING finger domain binding; Category No. 1359—C-4 methylsterol oxidase activity; Category No. 1360—C-5 methylation of cytosine; Category No. 1361—C-5 sterol desaturase activity; Category No. 1362—C5a anaphylatoxin receptor activity; Category No. 1363—C5L2 anaphylatoxin chemotactic receptor binding; Category No. 1364—C-8 sterol isomerase activity; Category No. 1365—CA3 pyramidal cell dendrite; Category No. 1366—CAAX-box protein processing; Category No. 1367—CAAX-protein geranylgeranyltransferase activity; Category No. 1368—CAAX-protein geranylgeranyltransferase complex; Category No. 1369—cadherin binding; Category No. 1370—cadherin binding involved in cell-cell adhesion; Category No. 1371—cadmium ion binding; Category No. 1372—cadmium ion homeostasis; Category No. 1373—cadmium ion transmembrane transport; Category No. 1374—cadmium ion transmembrane transporter activity; Category No. 1375—CAF-1 complex; Category No. 1376—caffeine oxidase activity; Category No. 1377—Cajal body; Category No. 1378—Cajal body organization; Category No. 1379—Cajal-Retzius cell differentiation; Category No. 1380—calcidiol 1-monooxygenase activity; Category No. 1381—calcidiol binding; Category No. 1382—calcineurin complex; Category No. 1383—calcineurin-NFAT signaling cascade; Category No. 1384—calcitonin binding; Category No. 1385—calcitonin catabolic process; Category No. 1386—calcitonin gene-related peptide receptor activity; Category No. 1387—calcitonin receptor activity; Category No. 1388—calcitonin receptor binding; Category No. 1389—calcitriol binding; Category No. 1390—calcitriol biosynthetic process from calciol; Category No. 1391—calcitriol receptor activity; Category No. 1392—calcium; Category No. 1393—calcium activated cation channel activity; Category No. 1394—calcium activated galactosylceramide scrambling; Category No. 1395—calcium activated phosphatidylcholine scrambling; Category No. 1396—calcium activated phosphatidylserine scrambling; Category No. 1397—calcium activated phospholipid scrambling; Category No. 1398—calcium- and calmodulin-dependent protein kinase complex; Category No. 1399—calcium- and calmodulin-regulated 3',5'-cyclic-GMP phosphodiesterase activity; Category No. 1400—calcium- and calmodulin-responsive adenylate cyclase activity; Category No. 1401—calcium channel activity; Category No. 1402—calcium channel complex; Category No. 1403—calcium channel inhibitor activity; Category No. 1404—calcium channel regulator activity; Category No. 1405—calcium ion binding; Category No. 1406—calcium ion export; Category No. 1407—calcium ion export from cell; Category No. 1408—calcium ion homeostasis; Category No. 1409—calcium ion import; Category No. 1410—calcium ion import across plasma membrane; Category No. 1411—calcium ion import into cell; Category No. 1412—calcium ion import into sarcoplasmic reticulum; Category No. 1413—calcium ion transmembrane import into cytosol; Category No. 1414—calcium ion transmembrane import into mitochondrion; Category No. 1415—calcium ion transmembrane transport; Category No. 1416—calcium ion transmembrane transporter activity; Category No. 1417—calcium ion transport; Category No. 1418—calcium ion transport from cytosol to endoplasmic reticulum; Category No. 1419—calcium ion transport into cytosol; Category No. 1420—calcium ion-dependent exocytosis; Category No. 1421—calcium ion-dependent exocytosis of neurotransmitter; Category No. 1422—calcium ion-independent exocytosis of neurotransmitter; Category No. 1423—calcium ion-transporting ATPase complex; Category No. 1424—calcium modulating pathway; Category No. 1425—calcium oxalate binding; Category No. 1426—calcium sensitive guanylate cyclase activator activity; Category No. 1427—calcium:cation antiporter activity; Category No. 1428—calcium:sodium antiporter activity; Category No. 1429—calcium:sodium antiporter activity involved in regulation of cardiac muscle cell membrane potential; Category No. 1430—calcium-activated potassium channel activity; Category No. 1431—calcium-dependent ATPase activity; Category No. 1432—calcium-dependent cell-cell adhesion via plasma membrane cell adhesion molecules; Category No. 1433—calcium-dependent cell-matrix adhesion; Category No. 1434—calcium-dependent cysteine-type endopeptidase activity; Category No. 1435—calcium-dependent cysteine-type endopeptidase inhibitor activity; Category No. 1436—calcium-dependent phospholipase A2 activity; Category No. 1437—calcium-dependent phospholipase C activity; Category No. 1438—calcium-dependent phospholipid binding; Category No. 1439—calcium-dependent protein binding; Category No. 1440—calcium-dependent protein kinase activity; Category No. 1441—calcium-dependent protein kinase C activity; Category No. 1442—calcium-dependent protein kinase inhibitor activity; Category No. 1443—calcium-dependent protein serine threonine kinase activity; Category No. 1444—calcium-dependent protein serine threonine phosphatase activity; Category No. 1445—calcium-dependent protein serine threonine phosphatase regulator activity; Category No. 1446—calcium-independent cell-cell adhesion via plasma membrane cell-adhesion molecules; Category No. 1447—calcium-independent cell-matrix adhesion; Category No. 1448—calcium-independent phospholipase A2 activity; Category No. 1449—calcium-independent protein kinase C activity; Category No. 1450—calcium-induced calcium release activity; Category No. 1451—calcium-mediated signaling; Category No. 1452—calcium-mediated signaling using extracellular calcium source; Category No. 1453—calcium-mediated signaling using intracellular calcium source; Category No. 1454—calcium-release channel activity; Category No. 1455—calcium-transporting ATPase activity; Category No. 1456—calcium-transporting ATPase activity involved in regulation of cardiac muscle cell membrane potential; Category No. 1457—calmodulin binding; Category No. 1458—calmodulin-dependent cyclic-nucleotide phosphodiesterase activity; Category No. 1459—calmodulin-dependent protein kinase activity; Category No. 1460—calmodulin-dependent protein phosphatase activity; Category No. 1461—calmodulin-lysine N-methyltransferase activity; Category No. 1462—calyx of Held; Category No. 1463—camera-type eye development; Category No. 1464—camera-type eye morphogenesis; Category No. 1465—camera-type eye photoreceptor cell differentiation; Category No. 1466—camera-type eye photoreceptor cell fate commitment; Category No. 1467—cAMP binding; Category No. 1468—cAMP biosynthetic process; Category No. 1469—cAMP catabolic process; Category No. 1470—cAMP metabolic process; Category No. 1471—cAMP response element binding; Category No. 1472—cAMP response element binding protein binding; Category No. 1473—cAMP-dependent protein kinase activity; Category No. 1474—cAMP-dependent protein kinase complex; Category No. 1475—cAMP-dependent protein kinase inhibitor activity; Category No. 1476—cAMP-dependent protein kinase regulator activity; Category No. 1477—cAMP-mediated signaling; Category No. 1478—canalicular bile acid transmembrane transporter activity; Category No. 1479—canalicular bile acid transport; Category No. 1480—cannabinoid receptor activity; Category No. 1481—cannabinoid signaling pathway; Category No. 1482—canonical glycolysis; Category No. 1483—canonical Wnt signaling pathway; Category No. 1484—canonical Wnt signaling pathway involved in cardiac muscle cell fate commitment; Category No. 1485—canonical Wnt signaling pathway involved in mesenchymal stem cell differentiation; Category No. 1486—canonical Wnt signaling pathway involved in metanephric kidney development; Category No. 1487—canonical Wnt signaling pathway involved in negative regulation of apoptotic process; Category No. 1488—canonical Wnt signaling pathway involved in neural crest cell differentiation; Category No. 1489—canonical Wnt signaling pathway involved in neural plate anterior posterior pattern formation; Category No. 1490—canonical Wnt signaling pathway involved in osteoblast differentiation; Category No. 1491—canonical Wnt signaling pathway involved in positive regulation of apoptotic process; Category No. 1492—canonical Wnt signaling pathway involved in positive regulation of cardiac outflow tract cell proliferation; Category No. 1493—canonical Wnt signaling pathway involved in positive regulation of cell-cell adhesion; Category No. 1494—canonical Wnt signaling pathway involved in positive regulation of endothelial cell migration; Category No. 1495—canonical Wnt signaling pathway involved in positive regulation of epithelial to mesenchymal transition; Category No. 1496—canonical Wnt signaling pathway involved in positive regulation of wound healing; Category No. 1497—canonical Wnt signaling pathway involved in regulation of cell proliferation; Category No. 1498—cap1 mRNA methylation; Category No. 1499—cap2 mRNA methylation; Category No. 1500—cap-independent translational initiation; Category No. 1501—carbamoyl phosphate biosynthetic process; Category No. 1502—carbamoyl-phosphate synthase (ammonia) activity; Category No. 1503—carbamoyl-phosphate synthase (glutamine-hydrolyzing) activity; Category No. 1504—carbohydrate binding; Category No. 1505—carbohydrate biosynthetic process; Category No. 1506—carbohydrate catabolic process; Category No. 1507—carbohydrate derivative biosynthetic process; Category No. 1508—carbohydrate derivative transport; Category No. 1509—carbohydrate homeostasis; Category No. 1510—carbohydrate kinase activity; Category No. 1511—carbohydrate mediated signaling; Category No. 1512—carbohydrate metabolic process; Category No. 1513—carbohydrate phosphatase activity; Category No. 1514—carbohydrate phosphorylation; Category No. 1515—carbohydrate response element binding; Category No. 1516—carbohydrate transmembrane transport; Category No. 1517—carbohydrate transport; Category No. 1518—carbohydrate utilization; Category No. 1519—carbon catabolite regulation of transcription; Category No. 1520—carbon dioxide transmembrane transport; Category No. 1521—carbon dioxide transmembrane transporter activity; Category No. 1522—carbon dioxide transport; Category No. 1523—carbon monoxide binding; Category No. 1524—carbon tetrachloride metabolic process; Category No. 1525—carbonate dehydratase activity; Category No. 1526—carbon-carbon lyase activity; Category No. 1527—carbon-nitrogen ligase activity; Category No. 1528—carbon-sulfur lyase activity; Category No. 1529—carbonyl reductase (NADPH) activity; Category No. 1530—carboxyl- or carbamoyltransferase activity; Category No. 1531—carboxylic acid binding; Category No. 1532—carboxylic acid catabolic process; Category No. 1533—carboxylic acid metabolic process; Category No. 1534—carboxylic acid transmembrane transporter activity; Category No. 1535—carboxylic acid transport; Category No. 1536—carboxylic ester hydrolase activity; Category No. 1537—carboxy-lyase activity; Category No. 1538—carboxypeptidase activity; Category No. 1539—CARD domain binding; Category No. 1540—cardiac atrium formation; Category No. 1541—cardiac atrium morphogenesis; Category No. 1542—cardiac cell development; Category No. 1543—cardiac cell fate determination; Category No. 1544—cardiac cell fate specification; Category No. 1545—cardiac chamber development; Category No. 1546—cardiac chamber formation; Category No. 1547—cardiac conduction; Category No. 1548—cardiac conduction system development; Category No. 1549—cardiac epithelial to mesenchymal transition; Category No. 1550—cardiac left ventricle formation; Category No. 1551—cardiac left ventricle morphogenesis; Category No. 1552—cardiac muscle cell action potential; Category No. 1553—cardiac muscle cell action potential involved in contraction; Category No. 1554—cardiac muscle cell apoptotic process; Category No. 1555—cardiac muscle cell contraction; Category No. 1556—cardiac muscle cell development; Category No. 1557—cardiac muscle cell differentiation; Category No. 1558—cardiac muscle cell fate commitment; Category No. 1559—cardiac muscle cell myoblast differentiation; Category No. 1560—cardiac muscle cell proliferation; Category No. 1561—cardiac muscle cell-cardiac muscle cell adhesion; Category No. 1562—cardiac muscle contraction; Category No. 1563—cardiac muscle fiber development; Category No. 1564—cardiac muscle hypertrophy; Category No. 1565—cardiac muscle hypertrophy in response to stress; Category No. 1566—cardiac muscle thin filament assembly; Category No. 1567—cardiac muscle tissue development; Category No. 1568—cardiac muscle tissue growth; Category No. 1569—cardiac muscle tissue growth involved in heart morphogenesis; Category No. 1570—cardiac muscle tissue morphogenesis; Category No. 1571—cardiac muscle tissue regeneration; Category No. 1572—cardiac myofibril assembly; Category No. 1573—cardiac neural crest cell development involved in heart development; Category No. 1574—cardiac neural crest cell development involved in outflow tract morphogenesis; Category No. 1575—cardiac neural crest cell migration involved in outflow tract morphogenesis; Category No. 1576—cardiac right atrium morphogenesis; Category No. 1577—cardiac right ventricle formation; Category No. 1578—cardiac right ventricle morphogenesis; Category No. 1579—cardiac septum development; Category No. 1580—cardiac septum morphogenesis; Category No. 1581—cardiac vascular smooth muscle cell development; Category No. 1582—cardiac vascular smooth muscle cell differentiation; Category No. 1583—cardiac ventricle development; Category No. 1584—cardiac ventricle formation; Category No. 1585—cardiac ventricle morphogenesis; Category No. 1586—cardioblast anterior-lateral migration; Category No. 1587—cardioblast differentiation; Category No. 1588—cardioblast migration; Category No. 1589—cardioblast migration to the midline involved in heart field formation; Category No. 1590—cardiocyte differentiation; Category No. 1591—cardiogenic plate morphogenesis; Category No. 1592—cardiolipin acyl-chain remodeling; Category No. 1593—cardiolipin binding; Category No. 1594—cardiolipin biosynthetic process; Category No. 1595—cardiolipin hydrolase activity; Category No. 1596—cardiolipin metabolic process; Category No. 1597—cardiolipin synthase activity; Category No. 1598—cardiovascular system development; Category No. 1599—cargo loading into COPII-coated vesicle; Category No. 1600—cargo loading into vesicle; Category No. 1601—cargo receptor activity; Category No. 1602—cargo-selective complex; Category No. 1603—carnitine biosynthetic process; Category No. 1604—carnitine catabolic process; Category No. 1605—carnitine metabolic process; Category No. 1606—carnitine O-acetyltransferase activity; Category No. 1607—carnitine O-octanoyltransferase activity; Category No. 1608—carnitine O-palmitoyltransferase activity; Category No. 1609—carnitine shuttle; Category No. 1610—carnitine transmembrane transport; Category No. 1611—carnitine transmembrane transporter activity; Category No. 1612—carnitine transport; Category No. 1613—carnosine biosynthetic process; Category No. 1614—carnosine metabolic process; Category No. 1615—carnosine N-methyltransferase activity; Category No. 1616—carnosine synthase activity; Category No. 1617—carotene catabolic process; Category No. 1618—carotene metabolic process; Category No. 1619—carotenoid metabolic process; Category No. 1620—carotid body glomus cell differentiation; Category No. 1621—cartilage condensation; Category No. 1622—cartilage development; Category No. 1623—cartilage development involved in endochondral bone morphogenesis; Category No. 1624—cartilage homeostasis; Category No. 1625—cartilage morphogenesis; Category No. 1626—caspase binding; Category No. 1627—catabolic process; Category No. 1628—catagen; Category No. 1629—catalase activity; Category No. 1630—catalytic activity; Category No. 1631—catalytic core; Category No. 1632—catalytic core F(1); Category No. 1633—catalytic domain; Category No. 1634—catalytic step 1 spliceosome; Category No. 1635—catalytic step 2 spliceosome; Category No. 1636—catalyzing transmembrane movement of substances; Category No. 1637—catechol O-methyltransferase activity; Category No. 1638—catecholamine biosynthetic process; Category No. 1639—catecholamine catabolic process; Category No. 1640—catecholamine metabolic process; Category No. 1641—catecholamine secretion; Category No. 1642—catechol-containing compound metabolic process; Category No. 1643—catenin complex; Category No. 1644—catenin import into nucleus; Category No. 1645—catenin-TCF7L2 complex; Category No. 1646—cation binding; Category No. 1647—cation channel activity; Category No. 1648—cation channel complex; Category No. 1649—cation transmembrane transport; Category No. 1650—cation transmembrane transporter activity; Category No. 1651—cation transport; Category No. 1652—cation:cation antiporter activity; Category No. 1653—cation:chloride symporter activity; Category No. 1654—cation-selective; Category No. 1655—cation-transporting ATPase activity; Category No. 1656—cation-transporting ATPase complex; Category No. 1657—CatSper complex; Category No. 1658—caudate nucleus development; Category No. 1659—caveola; Category No. 1660—caveola assembly; Category No. 1661—caveolar macromolecular signaling complex; Category No. 1662—caveolin-mediated endocytosis; Category No. 1663—CBM complex; Category No. 1664—C—C chemokine binding; Category No. 1665—C—C chemokine receptor activity; Category No. 1666—C—C motif chemokine 19 receptor activity; Category No. 1667—C—C motif chemokine 21 receptor activity; Category No. 1668—CCAAT-binding factor complex; Category No. 1669—CCR chemokine receptor binding; Category No. 1670—CCR1 chemokine receptor binding; Category No. 1671—CCR10 chemokine receptor binding; Category No. 1672—CCR2 chemokine receptor binding; Category No. 1673—CCR4 chemokine receptor binding; Category No. 1674—CCR4-NOT complex; Category No. 1675—CCR4-NOT core complex; Category No. 1676—CCR5 chemokine receptor binding; Category No. 1677—CCR7 chemokine receptor binding; Category No. 1678—CD25-positive; Category No. 1679—CD27 receptor binding; Category No. 1680—CD4 receptor binding; Category No. 1681—CD40 receptor binding; Category No. 1682—CD40 receptor complex; Category No. 1683—CD40 signaling pathway; Category No. 1684—CD4-positive; Category No. 1685—CD4-positive or CD8-positive; Category No. 1686—CD8 receptor binding; Category No. 1687—CD8-positive; Category No. 1688—CD95 death-inducing signaling complex; Category No. 1689—Cdc42 protein signal transduction; Category No. 1690—Cdc48p-Npl4p-Vms1p AAA ATPase complex; Category No. 1691—Cdc73 Paf1 complex; Category No. 1692—CDP phosphorylation; Category No. 1693—CDP-choline pathway; Category No. 1694—CDP-diacylglycerol biosynthetic process; Category No. 1695—CDP-diacylglycerol metabolic process; Category No. 1696—CDP-diacylglycerol-glycerol-3-phosphate 3-phosphatidyltransferase activity; Category No. 1697—CDP-diacylglycerol-inositol 3-phosphatidyltransferase activity; Category No. 1698—CDP-diacylglycerol-serine O-phosphatidyltransferase activity; Category No. 1699—CDP-glycerol diphosphatase activity; Category No. 1700—cell; Category No. 1701—cell activation; Category No. 1702—cell activation involved in immune response; Category No. 1703—cell adhesion; Category No. 1704—cell adhesion involved in heart morphogenesis; Category No. 1705—cell adhesion mediated by integrin; Category No. 1706—cell adhesion molecule binding; Category No. 1707—cell adhesion molecule production; Category No. 1708—cell adhesive protein binding involved in bundle of His cell-Purkinje myocyte communication; Category No. 1709—cell aging; Category No. 1710—cell attachment to substrate; Category No. 1711—cell body; Category No. 1712—cell body fiber; Category No. 1713—cell chemotaxis; Category No. 1714—cell communication; Category No. 1715—cell communication by chemical coupling; Category No. 1716—cell communication by electrical coupling; Category No. 1717—cell communication by electrical coupling involved in cardiac conduction; Category No. 1718—cell communication involved in cardiac conduction; Category No. 1719—cell competition in a multicellular organism; Category No. 1720—cell cortex; Category No. 1721—cell cycle; Category No. 1722—cell cycle arrest; Category No. 1723—cell cycle checkpoint; Category No. 1724—cell cycle comprising mitosis without cytokinesis; Category No. 1725—cell cycle phase transition; Category No. 1726—cell cycle process; Category No. 1727—cell death; Category No. 1728—cell dedifferentiation; Category No. 1729—cell development; Category No. 1730—cell differentiation; Category No. 1731—cell differentiation in hindbrain; Category No. 1732—cell differentiation in spinal cord; Category No. 1733—cell differentiation involved in embryonic placenta development; Category No. 1734—cell differentiation involved in kidney development; Category No. 1735—cell differentiation involved in metanephros development; Category No. 1736—cell differentiation involved in salivary gland development; Category No. 1737—cell division; Category No. 1738—cell envelope; Category No. 1739—cell envelope organization; Category No. 1740—cell extension; Category No. 1741—cell fate commitment; Category No. 1742—cell fate commitment involved in formation of primary germ layer; Category No. 1743—cell fate determination; Category No. 1744—cell fate specification; Category No. 1745—cell gliding; Category No. 1746—cell growth; Category No. 1747—cell growth involved in cardiac muscle cell development; Category No. 1748—cell junction; Category No. 1749—cell junction assembly; Category No. 1750—cell leading edge; Category No. 1751—cell maturation; Category No. 1752—cell migration; Category No. 1753—cell migration in diencephalon; Category No. 1754—cell migration in hindbrain; Category No. 1755—cell migration involved in coronary angiogenesis; Category No. 1756—cell migration involved in coronary vasculogenesis; Category No. 1757—cell migration involved in endocardial cushion formation; Category No. 1758—cell migration involved in gastrulation; Category No. 1759—cell migration involved in heart development; Category No. 1760—cell migration involved in kidney development; Category No. 1761—cell migration involved in mesendoderm migration; Category No. 1762—cell migration involved in sprouting angiogenesis; Category No. 1763—cell migration involved in vasculogenesis; Category No. 1764—cell morphogenesis; Category No. 1765—cell morphogenesis involved in differentiation; Category No. 1766—cell morphogenesis involved in neuron differentiation; Category No. 1767—cell motility; Category No. 1768—cell motility in response to calcium ion; Category No. 1769—cell motility involved in cerebral cortex radial glia guided migration; Category No. 1770—cell outer membrane; Category No. 1771—cell part morphogenesis; Category No. 1772—cell periphery; Category No. 1773—cell pole; Category No. 1774—cell projection; Category No. 1775—cell projection assembly; Category No. 1776—cell projection cytoplasm; Category No. 1777—cell projection membrane; Category No. 1778—cell projection morphogenesis; Category No. 1779—cell projection organization; Category No. 1780—cell proliferation; Category No. 1781—cell proliferation in bone marrow; Category No. 1782—cell proliferation in forebrain; Category No. 1783—cell proliferation in hindbrain; Category No. 1784—cell proliferation in midbrain; Category No. 1785—cell proliferation involved in heart valve development; Category No. 1786—cell proliferation involved in kidney development; Category No. 1787—cell proliferation involved in metanephros development; Category No. 1788—cell proliferation involved in outflow tract morphogenesis; Category No. 1789—cell recognition; Category No. 1790—cell redox homeostasis; Category No. 1791—cell separation after cytokinesis; Category No. 1792—cell surface; Category No. 1793—cell surface bile acid receptor signaling pathway; Category No. 1794—cell surface pattern recognition receptor signaling pathway; Category No. 1795—cell surface receptor signaling pathway; Category No. 1796—cell tip; Category No. 1797—cell volume homeostasis; Category No. 1798—cell wall; Category No. 1799—cell wall chitin metabolic process; Category No. 1800—cell wall macromolecule catabolic process; Category No. 1801—cell wall mannoprotein biosynthetic process; Category No. 1802—cell-abiotic substrate adhesion; Category No. 1803—cell-cell adherens junction; Category No. 1804—cell-cell adhesion; Category No. 1805—cell-cell adhesion involved in gastrulation; Category No. 1806—cell-cell adhesion involved in neuronal-glial interactions involved in cerebral cortex radial glia guided migration; Category No. 1807—cell-cell adhesion mediated by cadherin; Category No. 1808—cell-cell adhesion mediated by integrin; Category No. 1809—cell-cell adhesion via plasma-membrane adhesion molecules; Category No. 1810—cell-cell contact zone; Category No. 1811—cell-cell junction; Category No. 1812—cell-cell junction assembly; Category No. 1813—cell-cell junction maintenance; Category No. 1814—cell-cell junction organization; Category No. 1815—cell-cell recognition; Category No. 1816—cell-cell signaling; Category No. 1817—cell-cell signaling involved in cardiac conduction; Category No. 1818—cell-cell signaling involved in cell-cell junction organization; Category No. 1819—cell-cell signaling involved in mammary gland development; Category No. 1820—cell-matrix adhesion; Category No. 1821—cell-matrix adhesion involved in ameboidal cell migration; Category No. 1822—cell-substrate adherens junction; Category No. 1823—cell-substrate adhesion; Category No. 1824—cell-substrate junction; Category No. 1825—cell-substrate junction assembly; Category No. 1826—cellular aldehyde metabolic process; Category No. 1827—cellular amide metabolic process; Category No. 1828—cellular amino acid biosynthetic process; Category No. 1829—cellular amino acid catabolic process; Category No. 1830—cellular amino acid metabolic process; Category No. 1831—cellular ammonia homeostasis; Category No. 1832—cellular aromatic compound metabolic process; Category No. 1833—cellular biogenic amine metabolic process; Category No. 1834—cellular biosynthetic process; Category No. 1835—cellular cadmium ion homeostasis; Category No. 1836—cellular calcium ion homeostasis; Category No. 1837—cellular carbohydrate catabolic process; Category No. 1838—cellular carbohydrate metabolic process; Category No. 1839—cellular cation homeostasis; Category No. 1840—cellular chemical homeostasis; Category No. 1841—cellular chloride ion homeostasis; Category No. 1842—cellular component; Category No. 1843—cellular component assembly; Category No. 1844—cellular component disassembly involved in execution phase of apoptosis; Category No. 1845—cellular component maintenance; Category No. 1846—cellular component organization; Category No. 1847—cellular copper ion homeostasis; Category No. 1848—cellular creatinine homeostasis; Category No. 1849—cellular defense response; Category No. 1850—cellular detoxification of nitrogen compound; Category No. 1851—cellular developmental process; Category No. 1852—cellular extravasation; Category No. 1853—cellular glucose homeostasis; Category No. 1854—cellular glucuronidation; Category No. 1855—cellular heat acclimation; Category No. 1856—cellular homeostasis; Category No. 1857—cellular hyperosmotic response; Category No. 1858—cellular hyperosmotic salinity response; Category No. 1859—cellular hypotonic response; Category No. 1860—cellular hypotonic salinity response; Category No. 1861—cellular ion homeostasis; Category No. 1862—cellular iron ion homeostasis; Category No. 1863—cellular ketone body metabolic process; Category No. 1864—cellular ketone metabolic process; Category No. 1865—cellular lactam catabolic process; Category No. 1866—cellular lipid catabolic process; Category No. 1867—cellular lipid metabolic process; Category No. 1868—cellular localization; Category No. 1869—cellular macromolecular complex assembly; Category No. 1870—cellular macromolecule biosynthetic process; Category No. 1871—cellular macromolecule catabolic process; Category No. 1872—cellular magnesium ion homeostasis; Category No. 1873—cellular manganese ion homeostasis; Category No. 1874—cellular metabolic process; Category No. 1875—cellular metal ion homeostasis; Category No. 1876—cellular modified amino acid catabolic process; Category No. 1877—cellular modified amino acid metabolic process; Category No. 1878—cellular nitrogen compound metabolic process; Category No. 1879—cellular organofluorine metabolic process; Category No. 1880—cellular phosphate ion homeostasis; Category No. 1881—cellular pigment accumulation; Category No. 1882—cellular pigmentation; Category No. 1883—cellular polysaccharide biosynthetic process; Category No. 1884—cellular potassium ion homeostasis; Category No. 1885—cellular potassium ion transport; Category No. 1886—cellular process; Category No. 1887—cellular process regulating host cell cycle in response to virus; Category No. 1888—cellular protein catabolic process; Category No. 1889—cellular protein complex assembly; Category No. 1890—cellular protein complex disassembly; Category No. 1891—cellular protein complex localization; Category No. 1892—cellular protein localization; Category No. 1893—cellular protein metabolic process; Category No. 1894—cellular protein modification process; Category No. 1895—cellular respiration; Category No. 1896—cellular response to 1-oleoyl-sn-glycerol 3-phosphate; Category No. 1897—cellular response to 2-O-acetyl-1-O-hexadecyl-sn-glycero-3-phosphocholine; Category No. 1898—cellular response to acidic pH; Category No. 1899—cellular response to aldosterone; Category No. 1900—cellular response to alkaline pH; Category No. 1901—cellular response to alkaloid; Category No. 1902—cellular response to alkyl hydroperoxide; Category No. 1903—cellular response to aluminum ion; Category No. 1904—cellular response to amine stimulus; Category No. 1905—cellular response to amino acid starvation; Category No. 1906—cellular response to amino acid stimulus; Category No. 1907—cellular response to ammonium ion; Category No. 1908—cellular response to angiotensin; Category No. 1909—cellular response to anoxia; Category No. 1910—cellular response to antibiotic; Category No. 1911—cellular response to arsenic-containing substance; Category No. 1912—cellular response to ATP; Category No. 1913—cellular response to azide; Category No. 1914—cellular response to bacterial lipopeptide; Category No. 1915—cellular response to benomyl; Category No. 1916—cellular response to bile acid; Category No. 1917—cellular response to bisphenol A; Category No. 1918—cellular response to BMP stimulus; Category No. 1919—cellular response to brain-derived neurotrophic factor stimulus; Category No. 1920—cellular response to cadmium ion; Category No. 1921—cellular response to caffeine; Category No. 1922—cellular response to calcium ion; Category No. 1923—cellular response to calcium ion starvation; Category No. 1924—cellular response to caloric restriction; Category No. 1925—cellular response to cAMP; Category No. 1926—cellular response to camptothecin; Category No. 1927—cellular response to carbohydrate stimulus; Category No. 1928—cellular response to carbon monoxide; Category No. 1929—cellular response to carcinoembryonic antigen; Category No. 1930—cellular response to catecholamine stimulus; Category No. 1931—cellular response to cell-matrix adhesion; Category No. 1932—cellular response to cGMP; Category No. 1933—cellular response to cholesterol; Category No. 1934—cellular response to chromate; Category No. 1935—cellular response to cisplatin; Category No. 1936—cellular response to cobalt ion; Category No. 1937—cellular response to cocaine; Category No. 1938—cellular response to cold; Category No. 1939—cellular response to copper ion; Category No. 1940—cellular response to copper ion starvation; Category No. 1941—cellular response to cordycepin; Category No. 1942—cellular response to corticosteroid stimulus; Category No. 1943—cellular response to corticosterone stimulus; Category No. 1944—cellular response to corticotropin-releasing hormone stimulus; Category No. 1945—cellular response to cortisol stimulus; Category No. 1946—cellular response to cyanide; Category No. 1947—cellular response to cycloheximide; Category No. 1948—cellular response to cytokine stimulus; Category No. 1949—cellular response to decreased oxygen levels; Category No. 1950—cellular response to desipramine; Category No. 1951—cellular response to dexamethasone stimulus; Category No. 1952—cellular response to diacyl bacterial lipopeptide; Category No. 1953—cellular response to diterpene; Category No. 1954—cellular response to dithiothreitol; Category No. 1955—cellular response to DNA damage stimulus; Category No. 1956—cellular response to dopamine; Category No. 1957—cellular response to drug; Category No. 1958—cellular response to dsRNA; Category No. 1959—cellular response to electrical stimulus; Category No. 1960—cellular response to epidermal growth factor stimulus; Category No. 1961—cellular response to epinephrine stimulus; Category No. 1962—cellular response to ergosterol; Category No. 1963—cellular response to erythropoietin; Category No. 1964—cellular response to estradiol stimulus; Category No. 1965—cellular response to estrogen stimulus; Category No. 1966—cellular response to ethanol; Category No. 1967—cellular response to exogenous dsRNA; Category No. 1968—cellular response to extracellular stimulus; Category No. 1969—cellular response to fatty acid; Category No. 1970—cellular response to fibroblast growth factor stimulus; Category No. 1971—cellular response to fluid shear stress; Category No. 1972—cellular response to fluoride; Category No. 1973—cellular response to folic acid; Category No. 1974—cellular response to follicle-stimulating hormone stimulus; Category No. 1975—cellular response to forskolin; Category No. 1976—cellular response to freezing; Category No. 1977—cellular response to fructose stimulus; Category No. 1978—cellular response to gamma radiation; Category No. 1979—cellular response to genistein; Category No. 1980—cellular response to glial cell derived neurotrophic factor; Category No. 1981—cellular response to glucagon stimulus; Category No. 1982—cellular response to glucocorticoid stimulus; Category No. 1983—cellular response to glucose starvation; Category No. 1984—cellular response to glucose stimulus; Category No. 1985—cellular response to glucoside; Category No. 1986—cellular response to glyoxal; Category No. 1987—cellular response to gold(3+); Category No. 1988—cellular response to gonadotropin stimulus; Category No. 1989—cellular response to gonadotropin-releasing hormone; Category No. 1990—cellular response to granulocyte colony-stimulating factor; Category No. 1991—cellular response to granulocyte macrophage colony-stimulating factor stimulus; Category No. 1992—cellular response to gravity; Category No. 1993—cellular response to growth factor stimulus; Category No. 1994—cellular response to growth hormone stimulus; Category No. 1995—cellular response to heat; Category No.

1996—cellular response to heparin; Category No. 1997—cellular response to hepatocyte growth factor stimulus; Category No. 1998—cellular response to high density lipoprotein particle stimulus; Category No. 1999—cellular response to histamine; Category No. 2000—cellular response to hormone stimulus; Category No. 2001—cellular response to hydrogen peroxide; Category No. 2002—cellular response to hydroperoxide; Category No. 2003—cellular response to hydrostatic pressure; Category No. 2004—cellular response to hydroxyurea; Category No. 2005—cellular response to hyperoxia; Category No. 2006—cellular response to hypoxia; Category No. 2007—cellular response to indole-3-methanol; Category No. 2008—cellular response to inorganic substance; Category No. 2009—cellular response to insulin stimulus; Category No. 2010—cellular response to insulin-like growth factor stimulus; Category No. 2011—cellular response to interferon-alpha; Category No. 2012—cellular response to interferon-beta; Category No. 2013—cellular response to interferon-gamma; Category No. 2014—cellular response to interleukin-1; Category No. 2015—cellular response to interleukin-11; Category No. 2016—cellular response to interleukin-13; Category No. 2017—cellular response to interleukin-18; Category No. 2018—cellular response to interleukin-2; Category No. 2019—cellular response to interleukin-3; Category No. 2020—cellular response to interleukin-4; Category No. 2021—cellular response to interleukin-6; Category No. 2022—cellular response to ionizing radiation; Category No. 2023—cellular response to ionomycin; Category No. 2024—cellular response to iron ion; Category No. 2025—cellular response to iron ion starvation; Category No. 2026—cellular response to iron(II) ion; Category No. 2027—cellular response to iron(III) ion; Category No. 2028—cellular response to jasmonic acid stimulus; Category No. 2029—cellular response to laminar fluid shear stress; Category No. 2030—cellular response to L-ascorbic acid; Category No. 2031—cellular response to L-dopa; Category No. 2032—cellular response to lead ion; Category No. 2033—cellular response to leptin stimulus; Category No. 2034—cellular response to leptomycin B; Category No. 2035—cellular response to leucine; Category No. 2036—cellular response to leucine starvation; Category No. 2037—cellular response to leukemia inhibitory factor; Category No. 2038—cellular response to light stimulus; Category No. 2039—cellular response to lipid; Category No. 2040—cellular response to lipid hydroperoxide; Category No. 2041—cellular response to lipopolysaccharide; Category No. 2042—cellular response to lipoprotein particle stimulus; Category No. 2043—cellular response to lipoteichoic acid; Category No. 2044—cellular response to lithium ion; Category No. 2045—cellular response to low-density lipoprotein particle stimulus; Category No. 2046—cellular response to luteinizing hormone stimulus; Category No. 2047—cellular response to macrophage colony-stimulating factor stimulus; Category No. 2048—cellular response to magnesium ion; Category No. 2049—cellular response to magnetism; Category No. 2050—cellular response to manganese ion; Category No. 2051—cellular response to mechanical stimulus; Category No. 2052—cellular response to menadione; Category No. 2053—cellular response to mercury ion; Category No. 2054—cellular response to metal ion; Category No. 2055—cellular response to methamphetamine hydrochloride; Category No. 2056—cellular response to methotrexate; Category No. 2057—cellular response to methyl methanesulfonate; Category No. 2058—cellular response to methylglyoxal; Category No. 2059—cellular response to mineralocorticoid stimulus; Category No. 2060—cellular response to misfolded protein; Category No. 2061—cellular response to molecule of bacterial origin; Category No. 2062—cellular response to molecule of fungal origin; Category No. 2063—cellular response to monosodium glutamate; Category No. 2064—cellular response to morphine; Category No. 2065—cellular response to muramyl dipeptide; Category No. 2066—cellular response to mycophenolic acid; Category No. 2067—cellular response to mycotoxin; Category No. 2068—cellular response to nerve growth factor stimulus; Category No. 2069—cellular response to nicotine; Category No. 2070—cellular response to nitric oxide; Category No. 2071—cellular response to nitrite; Category No. 2072—cellular response to nitrogen dioxide; Category No. 2073—cellular response to nitrogen starvation; Category No. 2074—cellular response to nitrosative stress; Category No. 2075—cellular response to norepinephrine stimulus; Category No. 2076—cellular response to nutrient; Category No. 2077—cellular response to nutrient levels; Category No. 2078—cellular response to oleic acid; Category No. 2079—cellular response to organic cyclic compound; Category No. 2080—cellular response to organic substance; Category No. 2081—cellular response to organonitrogen compound; Category No. 2082—cellular response to osmotic stress; Category No. 2083—cellular response to oxidative stress; Category No. 2084—cellular response to oxygen levels; Category No. 2085—cellular response to oxygen-glucose deprivation; Category No. 2086—cellular response to parathyroid hormone stimulus; Category No. 2087—cellular response to peptide; Category No. 2088—cellular response to peptide hormone stimulus; Category No. 2089—cellular response to peptidoglycan; Category No. 2090—cellular response to pH; Category No. 2091—cellular response to phenylalanine; Category No. 2092—cellular response to pheromone; Category No. 2093—cellular response to phosphate starvation; Category No. 2094—cellular response to platelet-derived growth factor stimulus; Category No. 2095—cellular response to potassium ion; Category No. 2096—cellular response to potassium ion starvation; Category No. 2097—cellular response to progesterone stimulus; Category No. 2098—cellular response to prolactin; Category No. 2099—cellular response to prostaglandin D stimulus; Category No. 2100—cellular response to prostaglandin E stimulus; Category No. 2101—cellular response to prostaglandin stimulus; Category No. 2102—cellular response to purine-containing compound; Category No. 2103—cellular response to putrescine; Category No. 2104—cellular response to radiation; Category No. 2105—cellular response to rapamycin; Category No. 2106—cellular response to reactive nitrogen species; Category No. 2107—cellular response to reactive oxygen species; Category No. 2108—cellular response to redox state; Category No. 2109—cellular response to resveratrol; Category No. 2110—cellular response to retinoic acid; Category No. 2111—cellular response to salt stress; Category No. 2112—cellular response to selenite ion; Category No. 2113—cellular response to serotonin; Category No. 2114—cellular response to sodium dodecyl sulfate; Category No. 2115—cellular response to sorbitol; Category No. 2116—cellular response to starvation; Category No. 2117—cellular response to staurosporine; Category No. 2118—cellular response to steroid hormone stimulus; Category No. 2119—cellular response to sterol; Category No. 2120—cellular response to stimulus; Category No. 2121—cellular response to stress; Category No. 2122—cellular response to sucrose stimulus; Category No. 2123—cellular response to superoxide; Category No. 2124—cellular response to temperature stimulus; Category No. 2125—cellular response to testosterone stimulus; Category No.

2126—cellular response to tetrahydrofolate; Category No. 2127—cellular response to Thyroglobulin triiodothyronine; Category No. 2128—cellular response to thyroid hormone stimulus; Category No. 2129—cellular response to topologically incorrect protein; Category No. 2130—cellular response to toxic substance; Category No. 2131—cellular response to transforming growth factor beta stimulus; Category No. 2132—cellular response to triacyl bacterial lipopeptide; Category No. 2133—cellular response to trichostatin A; Category No. 2134—cellular response to triglyceride; Category No. 2135—cellular response to tumor cell; Category No. 2136—cellular response to tumor necrosis factor; Category No. 2137—cellular response to type I interferon; Category No. 2138—cellular response to unfolded protein; Category No. 2139—cellular response to UV; Category No. 2140—cellular response to UV-A; Category No. 2141—cellular response to UV-B; Category No. 2142—cellular response to UV-C; Category No. 2143—cellular response to vascular endothelial growth factor stimulus; Category No. 2144—cellular response to vasopressin; Category No. 2145—cellular response to virus; Category No. 2146—cellular response to vitamin; Category No. 2147—cellular response to vitamin A; Category No. 2148—cellular response to vitamin B1; Category No. 2149—cellular response to vitamin D; Category No. 2150—cellular response to vitamin E; Category No. 2151—cellular response to vitamin K; Category No. 2152—cellular response to water deprivation; Category No. 2153—cellular response to wortmannin; Category No. 2154—cellular response to xenobiotic stimulus; Category No. 2155—cellular response to X-ray; Category No. 2156—cellular response to zinc ion; Category No. 2157—cellular response to zinc ion starvation; Category No. 2158—cellular senescence; Category No. 2159—cellular sodium ion homeostasis; Category No. 2160—cellular sphingolipid homeostasis; Category No. 2161—cellular stress response to acidic pH; Category No. 2162—cellular triglyceride homeostasis; Category No. 2163—cellular urea homeostasis; Category No. 2164—cellular water homeostasis; Category No. 2165—cellular zinc ion homeostasis; Category No. 2166—cementum mineralization; Category No. 2167—CENP-A containing nucleosome assembly; Category No. 2168—central element; Category No. 2169—central nervous system development; Category No. 2170—central nervous system interneuron axonogenesis; Category No. 2171—central nervous system morphogenesis; Category No. 2172—central nervous system myelin formation; Category No. 2173—central nervous system myelin maintenance; Category No. 2174—central nervous system myelination; Category No. 2175—central nervous system neuron axonogenesis; Category No. 2176—central nervous system neuron development; Category No. 2177—central nervous system neuron differentiation; Category No. 2178—central nervous system projection neuron axonogenesis; Category No. 2179—central nervous system vasculogenesis; Category No. 2180—central tolerance induction; Category No. 2181—centralspindlin complex; Category No. 2182—centriolar satellite; Category No. 2183—centriole; Category No. 2184—centriole assembly; Category No. 2185—centriole elongation; Category No. 2186—centriole replication; Category No. 2187—centriole-centriole cohesion; Category No. 2188—centromere complex assembly; Category No. 2189—centromeric; Category No. 2190—centromeric core domain; Category No. 2191—centromeric DNA binding; Category No. 2192—centromeric region; Category No. 2193—centrosomal corona; Category No. 2194—centrosome; Category No. 2195—centrosome cycle; Category No. 2196—centrosome duplication; Category No. 2197—centrosome localization; Category No. 2198—centrosome organization; Category No. 2199—centrosome separation; Category No. 2200—centrosome-templated microtubule nucleation; Category No. 2201—ceramidase activity; Category No. 2202—ceramide 1-phosphate binding; Category No. 2203—ceramide 1-phosphate transport; Category No. 2204—ceramide 1-phosphate transporter activity; Category No. 2205—ceramide binding; Category No. 2206—ceramide biosynthetic process; Category No. 2207—ceramide catabolic process; Category No. 2208—ceramide cholinephosphotransferase activity; Category No. 2209—ceramide glucosyltransferase activity; Category No. 2210—ceramide kinase activity; Category No. 2211—ceramide metabolic process; Category No. 2212—ceramide transport; Category No. 2213—ceramide transporter activity; Category No. 2214—cerebellar cortex development; Category No. 2215—cerebellar cortex formation; Category No. 2216—cerebellar cortex morphogenesis; Category No. 2217—cerebellar cortex structural organization; Category No. 2218—cerebellar granular layer development; Category No. 2219—cerebellar granular layer maturation; Category No. 2220—cerebellar granular layer morphogenesis; Category No. 2221—cerebellar granular layer structural organization; Category No. 2222—cerebellar granule cell differentiation; Category No. 2223—cerebellar granule cell precursor proliferation; Category No. 2224—cerebellar granule cell precursor tangential migration; Category No. 2225—cerebellar molecular layer development; Category No. 2226—cerebellar molecular layer formation; Category No. 2227—cerebellar mossy fiber; Category No. 2228—cerebellar Purkinje cell differentiation; Category No. 2229—cerebellar Purkinje cell layer development; Category No. 2230—cerebellar Purkinje cell layer formation; Category No. 2231—cerebellar Purkinje cell layer maturation; Category No. 2232—cerebellar Purkinje cell layer morphogenesis; Category No. 2233—cerebellar Purkinje cell layer structural organization; Category No. 2234—cerebellar Purkinje cell-granule cell precursor cell signaling involved in regulation of granule cell precursor cell proliferation; Category No. 2235—cerebellum development; Category No. 2236—cerebellum formation; Category No. 2237—cerebellum maturation; Category No. 2238—cerebellum morphogenesis; Category No. 2239—cerebellum structural organization; Category No. 2240—cerebellum vasculature development; Category No. 2241—cerebellum vasculature morphogenesis; Category No. 2242—cerebral cortex cell migration; Category No. 2243—cerebral cortex development; Category No. 2244—cerebral cortex GABAergic interneuron development; Category No. 2245—cerebral cortex GABAergic interneuron differentiation; Category No. 2246—cerebral cortex GABAergic interneuron fate commitment; Category No. 2247—cerebral cortex GABAergic interneuron migration; Category No. 2248—cerebral cortex neuron differentiation; Category No. 2249—cerebral cortex radial glia guided migration; Category No. 2250—cerebral cortex radially oriented cell migration; Category No. 2251—cerebral cortex regionalization; Category No. 2252—cerebral cortex tangential migration; Category No. 2253—cerebroside-sulfatase activity; Category No. 2254—cerebrospinal fluid secretion; Category No. 2255—CERF complex; Category No. 2256—cervix development; Category No. 2257—C-fiber; Category No. 2258—cGMP binding; Category No. 2259—cGMP biosynthetic process; Category No. 2260—cGMP catabolic process; Category No. 2261—cGMP metabolic process; Category No. 2262—cGMP-dependent protein kinase activity; Category No. 2263—cGMP-inhibited cyclic-nucleotide phosphodiesterase activity; Category No. 2264—cGMP-mediated signaling; Category No. 2265—cGMP-stimulated cyclic-nucleotide phosphodiesterase activity; Category No. 2266—chain elongation of O-linked mannose residue; Category No. 2267—channel activity; Category No. 2268—channel inhibitor activity; Category No. 2269—channel regulator activity; Category No. 2270—channel-conductance-controlling ATPase activity; Category No. 2271—chaperone binding; Category No. 2272—chaperone cofactor-dependent protein refolding; Category No. 2273—chaperone mediated protein folding requiring cofactor; Category No. 2274—chaperone-mediated autophagy; Category No. 2275—chaperone-mediated protein complex assembly; Category No. 2276—chaperone-mediated protein folding; Category No. 2277—chaperone-mediated protein transport; Category No. 2278—chaperonin-containing T-complex; Category No. 2279—checkpoint clamp complex; Category No. 2280—chemical homeostasis; Category No. 2281—chemical homeostasis within a tissue; Category No. 2282—chemoattractant activity; Category No. 2283—chemoattraction of axon; Category No. 2284—chemokine (C—C motif) ligand 11 production; Category No. 2285—chemokine (C—C motif) ligand 19 binding; Category No. 2286—chemokine (C—C motif) ligand 19 signaling pathway; Category No. 2287—chemokine (C—C motif) ligand 2 secretion; Category No. 2288—chemokine (C—C motif) ligand 21 binding; Category No. 2289—chemokine (C—C motif) ligand 21 signaling pathway; Category No. 2290—chemokine (C—C motif) ligand 5 binding; Category No. 2291—chemokine (C—C motif) ligand 5 production; Category No. 2292—chemokine (C—C motif) ligand 7 binding; Category No. 2293—chemokine activity; Category No. 2294—chemokine binding; Category No. 2295—chemokine biosynthetic process; Category No. 2296—chemokine metabolic process; Category No. 2297—chemokine production; Category No. 2298—chemokine receptor activity; Category No. 2299—chemokine receptor antagonist activity; Category No. 2300—chemokine receptor binding; Category No. 2301—chemokine receptor transport out of membrane raft; Category No. 2302—chemokine secretion; Category No. 2303—chemokine-mediated signaling pathway; Category No. 2304—chemokinesis; Category No. 2305—chemorepellent activity; Category No. 2306—chemorepulsion involved in interneuron migration from the subpallium to the cortex; Category No. 2307—chemorepulsion involved in postnatal olfactory bulb interneuron migration; Category No. 2308—chemorepulsion of axon; Category No. 2309—chemorepulsion of branchiomotor axon; Category No. 2310—chemosensory behavior; Category No. 2311—chemotaxis; Category No. 2312—chemotaxis to arachidonic acid; Category No. 2313—chenodeoxycholic acid binding; Category No. 2314—chiasma; Category No. 2315—chiasma assembly; Category No. 2316—chitin binding; Category No. 2317—chitin catabolic process; Category No. 2318—chitin metabolic process; Category No. 2319—chitinase activity; Category No. 2320—chitobiosyldiphosphodolichol beta-mannosyltransferase activity; Category No. 2321—chloramphenicol transport; Category No. 2322—chlordecone reductase activity; Category No. 2323—chloride channel activity; Category No. 2324—chloride channel complex; Category No. 2325—chloride channel inhibitor activity; Category No. 2326—chloride channel regulator activity; Category No. 2327—chloride ion binding; Category No. 2328—chloride ion homeostasis; Category No. 2329—chloride transmembrane transport; Category No. 2330—chloride transmembrane transporter activity; Category No. 2331—chloride transport; Category No. 2332—chloride-transporting ATPase activity; Category No. 2333—chlorophyll biosynthetic process; Category No. 2334—cholangiocyte proliferation; Category No. 2335—cholate 7-alpha-dehydrogenase activity; Category No. 2336—cholate-CoA ligase activity; Category No. 2337—cholecystokinin receptor activity; Category No. 2338—cholecystokinin signaling pathway; Category No. 2339—cholest-5-ene-3-beta,7-alpha-diol 3-beta-dehydrogenase activity; Category No. 2340—cholestanetriol 26-monooxygenase activity; Category No. 2341—cholestenol delta-isomerase activity; Category No. 2342—cholestenone 5-alpha-reductase activity; Category No. 2343—cholesterol 24-hydroxylase activity; Category No. 2344—cholesterol 25-hydroxylase activity; Category No. 2345—cholesterol 7-alpha-monooxygenase activity; Category No. 2346—cholesterol binding; Category No. 2347—cholesterol biosynthetic process; Category No. 2348—cholesterol biosynthetic process via 24,25-dihydrolanosterol; Category No. 2349—cholesterol biosynthetic process via lathosterol; Category No. 2350—cholesterol catabolic process; Category No. 2351—cholesterol efflux; Category No. 2352—cholesterol esterification; Category No. 2353—cholesterol homeostasis; Category No. 2354—cholesterol import; Category No. 2355—cholesterol metabolic process; Category No. 2356—cholesterol monooxygenase (side-chain-cleaving) activity; Category No. 2357—cholesterol O-acyltransferase activity; Category No. 2358—cholesterol storage; Category No. 2359—cholesterol transport; Category No. 2360—cholesterol transporter activity; Category No. 2361—choline binding; Category No. 2362—choline dehydrogenase activity; Category No. 2363—choline kinase activity; Category No. 2364—choline metabolic process; Category No. 2365—choline 0-acetyltransferase activity; Category No. 2366—choline transmembrane transporter activity; Category No. 2367—choline transport; Category No. 2368—choline:sodium symporter activity; Category No. 2369—cholinephosphate cytidylyltransferase activity; Category No. 2370—cholinergic; Category No. 2371—cholinesterase activity; Category No. 2372—choloyl-CoA hydrolase activity; Category No. 2373—chondroblast differentiation; Category No. 2374—chondrocyte development; Category No. 2375—chondrocyte development involved in endochondral bone morphogenesis; Category No. 2376—chondrocyte differentiation; Category No. 2377—chondrocyte differentiation involved in endochondral bone morphogenesis; Category No. 2378—chondrocyte hypertrophy; Category No. 2379—chondrocyte proliferation; Category No. 2380—chondroitin 4-sulfotransferase activity; Category No. 2381—chondroitin 6-sulfotransferase activity; Category No. 2382—chondroitin sulfate binding; Category No. 2383—chondroitin sulfate biosynthetic process; Category No. 2384—chondroitin sulfate catabolic process; Category No. 2385—chondroitin sulfate metabolic process; Category No. 2386—chondroitin sulfate proteoglycan binding; Category No. 2387—chondroitin sulfate proteoglycan biosynthetic process; Category No. 2388—chondroitin-glucuronate 5-epimerase activity; Category No. 2389—CHOP-ATF3 complex; Category No. 2390—CHOP-ATF4 complex; Category No. 2391—CHOP-C EBP complex; Category No. 2392—chordate embryonic development; Category No. 2393—chorioallantoic fusion; Category No. 2394—choriogonadotropin hormone binding; Category No. 2395—choriogonadotropin hormone receptor activity; Category No. 2396—chorion development; Category No. 2397—chorionic trophoblast cell differentiation; Category No. 2398—CHRAC; Category No. 2399—chromaffin granule; Category No. 2400—chromaffin granule lumen; Category No. 2401—chromaffin granule membrane; Category No. 2402—chromatin; Category No. 2403—chromatin assembly; Category No. 2404—chromatin assembly or disassembly; Category No. 2405—chromatin binding; Category No. 2406—chromatin DNA binding; Category No. 2407—chromatin insulator sequence binding; Category No. 2408—chromatin maintenance; Category No. 2409—chromatin modification; Category No. 2410—chromatin organization; Category No. 2411—chromatin remodeling; Category No. 2412—chromatin silencing; Category No. 2413—chromatin silencing at rDNA; Category No. 2414—chromatin silencing at telomere; Category No. 2415—chromatin silencing complex; Category No. 2416—chromatin-mediated maintenance of transcription; Category No. 2417—chromatoid body; Category No. 2418—chromo shadow domain binding; Category No. 2419—chromocenter; Category No. 2420—chromosome; Category No. 2421—chromosome breakage; Category No. 2422—chromosome condensation; Category No. 2423—chromosome localization to nuclear envelope involved in homologous chromosome segregation; Category No. 2424—chromosome organization; Category No. 2425—chromosome organization involved in meiosis; Category No. 2426—chromosome passenger complex; Category No. 2427—chromosome passenger complex localization to kinetochore; Category No. 2428—chromosome passenger complex localization to spindle midzone; Category No. 2429—chromosome segregation; Category No. 2430—chromosome separation; Category No. 2431—chronic inflammatory response; Category No. 2432—chronic inflammatory response to antigenic stimulus; Category No. 2433—chronological cell aging; Category No. 2434—chylomicron; Category No. 2435—chylomicron assembly; Category No. 2436—chylomicron binding; Category No. 2437—chylomicron remnant; Category No. 2438—chylomicron remnant clearance; Category No. 2439—chylomicron remodeling; Category No. 2440—CIA complex; Category No. 2441—ciliary basal body; Category No. 2442—ciliary basal body organization; Category No. 2443—ciliary base; Category No. 2444—ciliary body morphogenesis; Category No. 2445—ciliary inversin compartment; Category No. 2446—ciliary membrane; Category No. 2447—ciliary neurotrophic factor binding; Category No. 2448—ciliary neurotrophic factor receptor activity; Category No. 2449—ciliary neurotrophic factor receptor binding; Category No. 2450—ciliary neurotrophic factor receptor complex; Category No. 2451—ciliary neurotrophic factor-mediated signaling pathway; Category No. 2452—ciliary pocket membrane; Category No. 2453—ciliary receptor clustering involved in smoothened signaling pathway; Category No. 2454—ciliary rootlet; Category No. 2455—ciliary tip; Category No. 2456—ciliary transition fiber; Category No. 2457—ciliary transition zone; Category No. 2458—cilium; Category No. 2459—cilium assembly; Category No. 2460—cilium morphogenesis; Category No. 2461—cilium movement; Category No. 2462—cilium movement involved in cell motility; Category No. 2463—cilium or flagellum-dependent cell motility; Category No. 2464—cilium organization; Category No. 2465—cilium-dependent cell motility; Category No. 2466—circadian behavior; Category No. 2467—circadian regulation of gene expression; Category No. 2468—circadian regulation of translation; Category No. 2469—circadian rhythm; Category No. 2470—circadian sleep wake cycle; Category No. 2471—circadian sleep wake cycle process; Category No. 2472—circadian temperature homeostasis; Category No. 2473—circulating; Category No. 2474—circulatory system development; Category No. 2475—circulatory system process; Category No. 2476—cis assembly of pre-catalytic spliceosome; Category No. 2477—cis-Golgi network; Category No. 2478—cis-stilbene-oxide hydrolase activity; Category No. 2479—citrate (Si)-synthase activity; Category No. 2480—citrate lyase complex; Category No. 2481—citrate metabolic process; Category No. 2482—citrate transmembrane transporter activity; Category No. 2483—citrate transport; Category No. 2484—citrate-L-glutamate ligase activity; Category No. 2485—citrulline biosynthetic process; Category No. 2486—citrulline metabolic process; Category No. 2487—Clara cell differentiation; Category No. 2488—classical pathway; Category No. 2489—clathrin adaptor activity; Category No. 2490—clathrin adaptor complex; Category No. 2491—clathrin binding; Category No. 2492—clathrin coat; Category No. 2493—clathrin coat assembly; Category No. 2494—clathrin coat disassembly; Category No. 2495—clathrin coat of coated pit; Category No. 2496—clathrin coat of endocytic vesicle; Category No. 2497—clathrin coat of trans-Golgi network vesicle; Category No. 2498—clathrin complex; Category No. 2499—clathrin heavy chain binding; Category No. 2500—clathrin light chain binding; Category No. 2501—clathrin vesicle coat; Category No. 2502—clathrin-coated endocytic vesicle; Category No. 2503—clathrin-coated endocytic vesicle membrane; Category No. 2504—clathrin-coated vesicle; Category No. 2505—clathrin-coated vesicle membrane; Category No. 2506—clathrin-mediated endocytosis; Category No. 2507—clathrin-mediated extracellular exosome endocytosis; Category No. 2508—clathrin-sculpted acetylcholine transport vesicle membrane; Category No. 2509—clathrin-sculpted gamma-aminobutyric acid transport vesicle membrane; Category No. 2510—clathrin-sculpted glutamate transport vesicle membrane; Category No. 2511—clathrin-sculpted monoamine transport vesicle membrane; Category No. 2512—clearance of foreign intracellular DNA by conversion of DNA cytidine to uridine; Category No. 2513—cleavage body; Category No. 2514—cleavage furrow; Category No. 2515—cleavage furrow formation; Category No. 2516—cleavage furrow ingression; Category No. 2517—cleavage in ITS2 between 5.8S rRNA and LSU-rRNA of tricistronic rRNA transcript (SSU-rRNA; Category No. 2518—cleavage involved in rRNA processing; Category No. 2519—cleaving miRNA-paired mRNA; Category No. 2520—cleaving siRNA-paired mRNA; Category No. 2521—climbing fiber; Category No. 2522—cloaca development; Category No. 2523—cloacal septation; Category No. 2524—closure of optic fissure; Category No. 2525—clustering of voltage-gated potassium channels; Category No. 2526—clustering of voltage-gated sodium channels; Category No. 2527—CMP phosphorylation; Category No. 2528—CMP salvage; Category No. 2529—CMP-N-acetylneuraminate transmembrane transporter activity; Category No. 2530—CMP-N-acetylneuraminate transport; Category No. 2531—CNTFR-CLCF1 complex; Category No. 2532—coagulation; Category No. 2533—CoA-linked; Category No. 2534—coated pit; Category No. 2535—coated vesicle; Category No. 2536—CoA-transferase activity; Category No. 2537—cob(l)yrinic acid a,c-diamide adenosyltransferase activity; Category No. 2538—cobalamin binding; Category No. 2539—cobalamin biosynthetic process; Category No. 2540—cobalamin metabolic process; Category No. 2541—cobalamin transport; Category No. 2542—cobalt ion binding; Category No. 2543—cobalt ion transmembrane transporter activity; Category No. 2544—cobalt ion transport; Category No. 2545—cocaine binding; Category No. 2546—cocaine metabolic process; Category No. 2547—cochlea development; Category No. 2548— cochlea morphogenesis; Category No. 2549—cochlear nucleus development; Category No. 2550—codon nonspecific; Category No. 2551—codon specific; Category No. 2552—coenzyme A biosynthetic process; Category No. 2553—coenzyme A catabolic process; Category No. 2554—coenzyme A metabolic process; Category No. 2555—coenzyme A transmembrane transport; Category No. 2556—coenzyme A transmembrane transporter activity; Category No. 2557—coenzyme binding; Category No. 2558—coenzyme biosynthetic process; Category No. 2559—cofactor binding; Category No. 2560—cofactor metabolic process; Category No. 2561—cofactor transport; Category No. 2562—cognition; Category No. 2563—cohesin complex; Category No. 2564—cohesin core heterodimer; Category No. 2565—cold acclimation; Category No. 2566—collagen binding; Category No. 2567—collagen binding involved in cell-matrix adhesion; Category No. 2568—collagen biosynthetic process; Category No. 2569—collagen catabolic process; Category No. 2570—collagen fibril binding; Category No. 2571—collagen fibril organization; Category No. 2572—collagen metabolic process; Category No. 2573—collagen receptor activity; Category No. 2574—collagen trimer; Category No. 2575—collagen type I trimer; Category No. 2576—collagen type II trimer; Category No. 2577—collagen type III trimer; Category No. 2578—collagen type IV trimer; Category No. 2579—collagen type IX trimer; Category No. 2580—collagen type V trimer; Category No. 2581—collagen type VI trimer; Category No. 2582—collagen type VII trimer; Category No. 2583—collagen type VIII trimer; Category No. 2584—collagen type XI trimer; Category No. 2585—collagen type XII trimer; Category No. 2586—collagen type XIII trimer; Category No. 2587—collagen type XIV trimer; Category No. 2588—collagen type XV trimer; Category No. 2589—collagen type XVI trimer; Category No. 2590—collagen V binding; Category No. 2591—collagen-activated signaling pathway; Category No. 2592—collagen-activated tyrosine kinase receptor signaling pathway; Category No. 2593—collateral sprouting; Category No. 2594—collateral sprouting in absence of injury; Category No. 2595—collecting duct development; Category No. 2596—colon epithelial cell migration; Category No. 2597—columnar cuboidal epithelial cell development; Category No. 2598—comma-shaped body morphogenesis; Category No. 2599—commissural neuron axon guidance; Category No. 2600—commissural neuron differentiation in spinal cord; Category No. 2601—commitment complex; Category No. 2602—commitment of neuronal cell to specific neuron type in forebrain; Category No. 2603—common bile duct development; Category No. 2604—common myeloid progenitor cell proliferation; Category No. 2605—common pathway; Category No. 2606—common-partner cytoplasmic mediator activity; Category No. 2607—common-partner SMAD protein phosphorylation; Category No. 2608—compact myelin; Category No. 2609—compartment pattern specification; Category No. 2610—complement activation; Category No. 2611—complement binding; Category No. 2612—complement component C1 complex; Category No. 2613—complement component C1 q binding; Category No. 2614—complement component C3a binding; Category No. 2615—complement component C3a receptor activity; Category No. 2616—complement component C3b binding; Category No. 2617—complement component C3b receptor activity; Category No. 2618—complement component C4b binding; Category No. 2619—complement component C4b receptor activity; Category No. 2620—complement component C5a binding; Category No. 2621—complement component C5a receptor activity; Category No. 2622—complement component C5a signaling pathway; Category No. 2623—complement receptor activity; Category No. 2624—complement receptor mediated signaling pathway; Category No. 2625—complement-dependent cytotoxicity; Category No. 2626—compound eye corneal lens development; Category No. 2627—compound eye development; Category No. 2628—condensed chromosome; Category No. 2629—condensed chromosome inner kinetochore; Category No. 2630—condensed chromosome kinetochore; Category No. 2631—condensed chromosome outer kinetochore; Category No. 2632—condensed nuclear chromosome; Category No. 2633—condensed nuclear chromosome kinetochore; Category No. 2634—condensed nuclear chromosome outer kinetochore; Category No. 2635—condensin complex; Category No. 2636—condensin core heterodimer; Category No. 2637—conditioned place preference; Category No. 2638—conditioned taste aversion; Category No. 2639—cone cell pedicle; Category No. 2640—connective tissue development; Category No. 2641—connective tissue growth factor biosynthetic process; Category No. 2642—connective tissue replacement involved in inflammatory response wound healing; Category No. 2643—connexin binding; Category No. 2644—connexon complex; Category No. 2645—constitutive protein ectodomain proteolysis; Category No. 2646—constitutive secretory pathway; Category No. 2647—contact inhibition; Category No. 2648—contractile actin filament bundle assembly; Category No. 2649—contractile fiber; Category No. 2650—contractile ring; Category No. 2651—convergent extension; Category No. 2652—convergent extension involved in axis elongation; Category No. 2653—convergent extension involved in gastrulation; Category No. 2654—convergent extension involved in neural plate elongation; Category No. 2655—convergent extension involved in organogenesis; Category No. 2656—convergent extension involved in somitogenesis; Category No. 2657—conversion of ds siRNA to ss siRNA; Category No. 2658—conversion of ds siRNA to ss siRNA involved in RNA interference; Category No. 2659—conversion of methionyl-tRNA to N-formyl-methionyl-tRNA; Category No. 2660—COP9 signalosome; Category No. 2661—COP9 signalosome assembly; Category No. 2662—COPI coating of Golgi vesicle; Category No. 2663—COPI vesicle coat; Category No. 2664—COPI-coated vesicle; Category No. 2665—COPI-coated vesicle budding; Category No. 2666—COPI-coated vesicle membrane; Category No. 2667—COPII adaptor activity; Category No. 2668—COPII vesicle coat; Category No. 2669—COPII vesicle coating; Category No. 2670—COPII-coated vesicle budding; Category No. 2671—copper chaperone activity; Category No. 2672—copper ion binding; Category No. 2673—copper ion export; Category No. 2674—copper ion homeostasis; Category No. 2675—copper ion import; Category No. 2676—copper ion import into cell; Category No. 2677—copper ion transmembrane transport; Category No. 2678—copper ion transmembrane transporter activity; Category No. 2679—copper ion transport; Category No. 2680—copper uptake transmembrane transporter activity; Category No. 2681—copper-dependent protein binding; Category No. 2682—copper-exporting ATPase activity; Category No. 2683—copper-transporting ATPase activity; Category No. 2684—coproporphyrinogen oxidase activity; Category No. 2685—copulation; Category No. 2686—core complex; Category No. 2687—core mediator complex; Category No. 2688—core promoter binding; Category No. 2689—core promoter proximal region DNA binding; Category No. 2690—core promoter proximal region sequence-specific DNA binding;

Category No. 2691—core promoter sequence-specific DNA binding; Category No. 2692—core RNA polymerase II binding; Category No. 2693—core TFIIH complex; Category No. 2694—coreceptor activity; Category No. 2695—coreceptor activity involved in Wnt signaling pathway; Category No. 2696—co-receptor binding; Category No. 2697—coreceptor-mediated virion attachment to host cell; Category No. 2698—cornea development in camera-type eye; Category No. 2699—corneocyte development; Category No. 2700—cornification; Category No. 2701—cornified envelope; Category No. 2702—cornified envelope assembly; Category No. 2703—coronal suture morphogenesis; Category No. 2704—coronary artery morphogenesis; Category No. 2705—coronary vasculature development; Category No. 2706—coronary vasculature morphogenesis; Category No. 2707—coronary vein morphogenesis; Category No. 2708—corpus callosum development; Category No. 2709—corpus callosum morphogenesis; Category No. 2710—cortical actin cytoskeleton; Category No. 2711—cortical actin cytoskeleton organization; Category No. 2712—cortical cytoskeleton; Category No. 2713—cortical cytoskeleton organization; Category No. 2714—cortical endoplasmic reticulum; Category No. 2715—cortical granule; Category No. 2716—cortical microtubule cytoskeleton; Category No. 2717—cortical microtubule organization; Category No. 2718—cortical microtubule plus-end; Category No. 2719—corticospinal neuron axon guidance; Category No. 2720—corticospinal neuron axon guidance through spinal cord; Category No. 2721—corticospinal tract morphogenesis; Category No. 2722—corticosterone 18-monooxygenase activity; Category No. 2723—corticosterone secretion; Category No. 2724—corticotrophin-releasing factor receptor activity; Category No. 2725—corticotropin hormone receptor binding; Category No. 2726—corticotropin hormone secreting cell differentiation; Category No. 2727—corticotropin receptor activity; Category No. 2728—corticotropin secretion; Category No. 2729—corticotropin-releasing hormone binding; Category No. 2730—corticotropin-releasing hormone receptor 1 binding; Category No. 2731—corticotropin-releasing hormone receptor 2 binding; Category No. 2732—corticotropin-releasing hormone receptor activity; Category No. 2733—cortisol biosynthetic process; Category No. 2734—cortisol metabolic process; Category No. 2735—cortisol secretion; Category No. 2736—CORVET complex; Category No. 2737—co-SMAD binding; Category No. 2738—costamere; Category No. 2739—co-translational protein modification; Category No. 2740—cotranslational protein targeting to membrane; Category No. 2741—coumarin 7-hydroxylase activity; Category No. 2742—coumarin catabolic process; Category No. 2743—coumarin metabolic process; Category No. 2744—coupled; Category No. 2745—coupled to cyclic nucleotide second messenger; Category No. 2746—coupled to movement of substances; Category No. 2747—coupled to transmembrane movement of ions; Category No. 2748—coupled to transmembrane movement of substances; Category No. 2749—coupled via Gi Go; Category No. 2750—coupled via Gs; Category No. 2751—coupling factor F(o); Category No. 2752—CP2 mannose-ethanolamine phosphotransferase activity; Category No. 2753—cranial nerve development; Category No. 2754—cranial nerve morphogenesis; Category No. 2755—cranial suture morphogenesis; Category No. 2756—craniofacial suture morphogenesis; Category No. 2757—CRD-mediated mRNA stability complex; Category No. 2758—CRD-mediated mRNA stabilization; Category No. 2759—creatine biosynthetic process; Category No. 2760—creatine kinase activity; Category No. 2761—creatine metabolic process; Category No. 2762—creatine transmembrane transport; Category No. 2763—creatine transmembrane transporter activity; Category No. 2764—creatine transport; Category No. 2765—creatine:sodium symporter activity; Category No. 2766—creatinine metabolic process; Category No. 2767—C-rich single-stranded DNA binding; Category No. 2768—cristae formation; Category No. 2769—CRLF-CLCF1 complex; Category No. 2770—crossover junction endodeoxyribonuclease activity; Category No. 2771—CryPer complex; Category No. 2772—CSF1-CSF1R complex; Category No. 2773—CTD phosphatase activity; Category No. 2774—C-terminal protein deglutamylation; Category No. 2775—C-terminal protein lipidation; Category No. 2776—C-terminal protein methylation; Category No. 2777—Ctf18 RFC-like complex; Category No. 2778—CTP binding; Category No. 2779—CTP biosynthetic process; Category No. 2780—CTP salvage; Category No. 2781—CTP synthase activity; Category No. 2782—CTP:3'-cytidine-tRNA cytidylyltransferase activity; Category No. 2783—CTP:tRNA cytidylyltransferase activity; Category No. 2784—CTPase activity; Category No. 2785—Cul2-RING ubiquitin ligase complex; Category No. 2786—Cul3-RING ubiquitin ligase complex; Category No. 2787—Cul4A-RING E3 ubiquitin ligase complex; Category No. 2788—Cul4B-RING E3 ubiquitin ligase complex; Category No. 2789—Cul4-RING E3 ubiquitin ligase complex; Category No. 2790—Cul5-RING ubiquitin ligase complex; Category No. 2791—Cul7-RING ubiquitin ligase complex; Category No. 2792—cullin deneddylation; Category No. 2793—cullin family protein binding; Category No. 2794—cullin-RING ubiquitin ligase complex; Category No. 2795—cupric ion binding; Category No. 2796—cupric reductase activity; Category No. 2797—cuprous ion binding; Category No. 2798—CURI complex; Category No. 2799—CUT catabolic process; Category No. 2800—cuticle development; Category No. 2801—cuticular plate; Category No. 2802—CVT pathway; Category No. 2803—C-X3-C chemokine receptor activity; Category No. 2804—C—X—C chemokine binding; Category No. 2805—C—X—C chemokine receptor activity; Category No. 2806—CXCR chemokine receptor binding; Category No. 2807—CXCR3 chemokine receptor binding; Category No. 2808—CXCR4 chemokine receptor binding; Category No. 2809—CXCR5 chemokine receptor binding; Category No. 2810—cyanate catabolic process; Category No. 2811—cyclic nucleotide binding; Category No. 2812—cyclic nucleotide biosynthetic process; Category No. 2813—cyclic nucleotide catabolic process; Category No. 2814—cyclic nucleotide metabolic process; Category No. 2815—cyclic nucleotide-gated ion channel activity; Category No. 2816—cyclic purine nucleotide metabolic process; Category No. 2817—cyclic pyranopterin monophosphate synthase activity; Category No. 2818—cyclic-di-GMP binding; Category No. 2819—cyclic-GMP-AMP binding; Category No. 2820—cyclic-GMP-AMP synthase activity; Category No. 2821—cyclic-nucleotide phosphodiesterase activity; Category No. 2822—cyclic-nucleotide-mediated signaling; Category No. 2823—cyclin binding; Category No. 2824—cyclin K-CDK12 complex; Category No. 2825—cyclin K-CDK13 complex; Category No. 2826—cyclin-dependent protein kinase 5 activator activity; Category No. 2827—cyclin-dependent protein kinase 5 holoenzyme complex; Category No. 2828—cyclin-dependent protein kinase activating kinase activity; Category No. 2829—cyclin-dependent protein kinase activating kinase holoenzyme complex; Category No. 2830—cyclin-dependent protein kinase activity; Category No. 2831— cyclin-dependent protein kinase holoenzyme complex; Category No. 2832—cyclin-dependent protein serine threonine kinase activity; Category No. 2833—cyclin-dependent protein serine threonine kinase inhibitor activity; Category No. 2834—cyclin-dependent protein serine threonine kinase regulator activity; Category No. 2835—cyclooxygenase pathway; Category No. 2836—cyclosporin A binding; Category No. 2837—cystathionine beta-synthase activity; Category No. 2838—cystathionine gamma-lyase activity; Category No. 2839—cysteamine dioxygenase activity; Category No. 2840—cysteine biosynthetic process; Category No. 2841—cysteine biosynthetic process from serine; Category No. 2842—cysteine biosynthetic process via cystathionine; Category No. 2843—cysteine desulfurase activity; Category No. 2844—cysteine dioxygenase activity; Category No. 2845—cysteine metabolic process; Category No. 2846—cysteine transmembrane transport; Category No. 2847—cysteine transmembrane transporter activity; Category No. 2848—cysteine transport; Category No. 2849—cysteine-S-conjugate beta-lyase activity; Category No. 2850—cysteine-S-conjugate N-acetyltransferase activity; Category No. 2851—cysteine-tRNA ligase activity; Category No. 2852—cysteine-type carboxypeptidase activity; Category No. 2853—cysteine-type endopeptidase activator activity involved in apoptotic process; Category No. 2854—cysteine-type endopeptidase activity; Category No. 2855—cysteine-type endopeptidase activity involved in apoptotic process; Category No. 2856—cysteine-type endopeptidase activity involved in apoptotic signaling pathway; Category No. 2857—cysteine-type endopeptidase activity involved in execution phase of apoptosis; Category No. 2858—cysteine-type endopeptidase inhibitor activity; Category No. 2859—cysteine-type endopeptidase inhibitor activity involved in apoptotic process; Category No. 2860—cysteine-type endopeptidase regulator activity involved in apoptotic process; Category No. 2861—cysteine-type peptidase activity; Category No. 2862—cysteinyl leukotriene receptor activity; Category No. 2863—cysteinyl-tRNA aminoacylation; Category No. 2864—cystine:glutamate antiporter activity; Category No. 2865—cytidine deaminase activity; Category No. 2866—cytidine deamination; Category No. 2867—cytidine to uridine editing; Category No. 2868—cytidylate kinase activity; Category No. 2869—cytochrome c to oxygen; Category No. 2870—cytochrome complex; Category No. 2871—cytochrome complex assembly; Category No. 2872—cytochrome-b5 reductase activity; Category No. 2873—cytochrome-c oxidase activity; Category No. 2874—cytokine activity; Category No. 2875—cytokine binding; Category No. 2876—cytokine biosynthetic process; Category No. 2877—cytokine metabolic process; Category No. 2878—cytokine production; Category No. 2879—cytokine production involved in immune response; Category No. 2880—cytokine production involved in inflammatory response; Category No. 2881—cytokine receptor activity; Category No. 2882—cytokine receptor binding; Category No. 2883—cytokine secretion; Category No. 2884—cytokine secretion involved in immune response; Category No. 2885—cytokine-mediated signaling pathway; Category No. 2886—cytokinesis; Category No. 2887—cytokinetic process; Category No. 2888—cytolysis; Category No. 2889—cytolytic granule; Category No. 2890—cytoplasm; Category No. 2891—cytoplasm organization; Category No. 2892—cytoplasm-associated proteasomal ubiquitin-dependent protein catabolic process; Category No. 2893—cytoplasmic actin-based contraction involved in cell motility; Category No. 2894—cytoplasmic chromatin; Category No. 2895—cytoplasmic cyclin-dependent protein kinase holoenzyme complex; Category No. 2896—cytoplasmic dynein complex; Category No. 2897—cytoplasmic exosome (RNase complex); Category No. 2898—cytoplasmic mediator activity; Category No. 2899—cytoplasmic membrane-bounded vesicle; Category No. 2900—cytoplasmic membrane-bounded vesicle lumen; Category No. 2901—cytoplasmic microtubule; Category No. 2902—cytoplasmic microtubule organization; Category No. 2903—cytoplasmic mRNA processing body; Category No. 2904—cytoplasmic mRNA processing body assembly; Category No. 2905—cytoplasmic pattern recognition receptor signaling pathway in response to virus; Category No. 2906—cytoplasmic periphery of the nuclear pore complex; Category No. 2907—cytoplasmic ribonucleoprotein granule; Category No. 2908—cytoplasmic sequestering of CFTR protein; Category No. 2909—cytoplasmic sequestering of NF-kappaB; Category No. 2910—cytoplasmic sequestering of protein; Category No. 2911—cytoplasmic sequestering of transcription factor; Category No. 2912—cytoplasmic side of apical plasma membrane; Category No. 2913—cytoplasmic side of dendritic spine plasma membrane; Category No. 2914—cytoplasmic side of early endosome membrane; Category No. 2915—cytoplasmic side of endoplasmic reticulum membrane; Category No. 2916—cytoplasmic side of endosome membrane; Category No. 2917—cytoplasmic side of mitochondrial outer membrane; Category No. 2918—cytoplasmic side of plasma membrane; Category No. 2919—cytoplasmic side of rough endoplasmic reticulum membrane; Category No. 2920—cytoplasmic stress granule; Category No. 2921—cytoplasmic translation; Category No. 2922—cytoplasmic translational initiation; Category No. 2923—cytoplasmic translational termination; Category No. 2924—cytoplasmic transport; Category No. 2925—cytoplasmic ubiquitin ligase complex; Category No. 2926—cytoplasmic vesicle; Category No. 2927—cytoplasmic vesicle membrane; Category No. 2928—cytosine C-5 DNA demethylase activity; Category No. 2929—cytosine deaminase activity; Category No. 2930—cytosine metabolic process; Category No. 2931—cytoskeletal adaptor activity; Category No. 2932—cytoskeletal anchoring at nuclear membrane; Category No. 2933—cytoskeletal anchoring at plasma membrane; Category No. 2934—cytoskeletal calyx; Category No. 2935—cytoskeletal matrix organization at active zone; Category No. 2936—cytoskeletal protein binding; Category No. 2937—cytoskeletal regulatory protein binding; Category No. 2938—cytoskeleton; Category No. 2939—cytoskeleton of presynaptic active zone; Category No. 2940—cytoskeleton organization; Category No. 2941—cytoskeleton-dependent intracellular transport; Category No. 2942—cytosol; Category No. 2943—cytosol to ER transport; Category No. 2944—cytosolic aryl hydrocarbon receptor complex; Category No. 2945—cytosolic calcium ion homeostasis; Category No. 2946—cytosolic calcium ion transport; Category No. 2947—cytosolic large ribosomal subunit; Category No. 2948—cytosolic proteasome complex; Category No. 2949—cytosolic ribosome; Category No. 2950—cytosolic small ribosomal subunit; Category No. 2951—cytotoxic T cell degranulation; Category No. 2952—cytotoxic T cell differentiation; Category No. 2953—D1 dopamine receptor binding; Category No. 2954—D2 dopamine receptor binding; Category No. 2955—D3 dopamine receptor binding; Category No. 2956—D4 dopamine receptor binding; Category No. 2957—D5 dopamine receptor binding; Category No. 2958—dADP biosynthetic process; Category No. 2959—dADP catabolic process; Category No. 2960—dADP phosphorylation; Category No. 2961—D-alanine catabolic process; Category No. 2962—D-alanine transport; Category No. 2963—damaged DNA binding; Category No. 2964—D-amino acid catabolic process; Category No. 2965—D-amino acid metabolic process; Category No. 2966—D-amino-acid oxidase activity; Category No. 2967—dAMP phosphorylation; Category No. 2968—D-aspartate import; Category No. 2969—D-aspartate oxidase activity; Category No. 2970—dATP binding; Category No. 2971—dATP biosynthetic process; Category No. 2972—dATP catabolic process; Category No. 2973—dATP metabolic process; Category No. 2974—daunorubicin metabolic process; Category No. 2975—DBD domain binding; Category No. 2976—DBIRD complex; Category No. 2977—dCDP phosphorylation; Category No. 2978—dCMP deaminase activity; Category No. 2979—dCMP phosphorylation; Category No. 2980—dCTP diphosphatase activity; Category No. 2981—D-dopachrome decarboxylase activity; Category No. 2982—'de novo' actin filament nucleation; Category No. 2983—'de novo' AMP biosynthetic process; Category No. 2984—'de novo' AMP biosynthetic process; Category No. 2985—de novo centriole assembly; Category No. 2986—'de novo' cotranslational protein folding; Category No. 2987—'de novo' cotranslational protein folding; Category No. 2988—'de novo' CTP biosynthetic process; Category No. 2989—'de novo' GDP-L-fucose biosynthetic process; Category No. 2990—'de novo' IMP biosynthetic process; Category No. 2991—'de novo' IMP biosynthetic process; Category No. 2992—'de novo' NAD biosynthetic process from aspartate; Category No. 2993—'de novo' NAD biosynthetic process from tryptophan; Category No. 2994—'de novo' posttranslational protein folding; Category No. 2995—'de novo' protein folding; Category No. 2996—'de novo' pyrimidine nucleobase biosynthetic process; Category No. 2997—'de novo' UMP biosynthetic process; Category No. 2998—deacetylase activity; Category No. 2999—DEAD H-box RNA helicase binding; Category No. 3000—deadenylation-dependent decapping of nuclear-transcribed mRNA; Category No. 3001—deadenylation-dependent decay; Category No. 3002—deadenylation-independent decapping of nuclear-transcribed mRNA; Category No. 3003—deaminase activity; Category No. 3004—death domain binding; Category No. 3005—death effector domain binding; Category No. 3006—death receptor activity; Category No. 3007—death receptor binding; Category No. 3008—death-inducing signaling complex; Category No. 3009—death-inducing signaling complex assembly; Category No. 3010—decidualization; Category No. 3011—defecation; Category No. 3012—defense response; Category No. 3013—defense response to bacterium; Category No. 3014—defense response to fungus; Category No. 3015—defense response to Gram-negative bacterium; Category No. 3016—defense response to Gram-positive bacterium; Category No. 3017—defense response to nematode; Category No. 3018—defense response to other organism; Category No. 3019—defense response to protozoan; Category No. 3020—defense response to tumor cell; Category No. 3021—defense response to virus; Category No. 3022—definitive erythrocyte differentiation; Category No. 3023—definitive hemopoiesis; Category No. 3024—dehydroascorbic acid transport; Category No. 3025—dehydroascorbic acid transporter activity; Category No. 3026—delayed rectifier potassium channel activity; Category No. 3027—delta DNA polymerase complex; Category No. 3028—delta14-sterol reductase activity; Category No. 3029—delta24(24-1) sterol reductase activity; Category No. 3030—delta24-sterol reductase activity; Category No. 3031—delta4-3-oxosteroid 5beta-reductase activity; Category No. 3032—delta-catenin binding; Category No. 3033—deltoid tuberosity development; Category No. 3034—demethylase activity; Category No. 3035—demethylation; Category No. 3036—dendrite; Category No. 3037—dendrite cytoplasm; Category No. 3038—dendrite development; Category No. 3039—dendrite extension; Category No. 3040—dendrite membrane; Category No. 3041—dendrite morphogenesis; Category No. 3042—dendrite regeneration; Category No. 3043—dendrite self-avoidance; Category No. 3044—dendrite terminus; Category No. 3045—dendritic branch; Category No. 3046—dendritic cell chemotaxis; Category No. 3047—dendritic cell cytokine production; Category No. 3048—dendritic cell dendrite assembly; Category No. 3049—dendritic cell differentiation; Category No. 3050—dendritic cell migration; Category No. 3051—dendritic cell proliferation; Category No. 3052—dendritic growth cone; Category No. 3053—dendritic microtubule; Category No. 3054—dendritic shaft; Category No. 3055—dendritic spine; Category No. 3056—dendritic spine development; Category No. 3057—dendritic spine head; Category No. 3058—dendritic spine maintenance; Category No. 3059—dendritic spine membrane; Category No. 3060—dendritic spine morphogenesis; Category No. 3061—dendritic spine neck; Category No. 3062—dendritic spine organization; Category No. 3063—dendritic tree; Category No. 3064—dense body; Category No. 3065—dense core granule; Category No. 3066—dense core granule biogenesis; Category No. 3067—dense core granule maturation; Category No. 3068—dense core granule membrane; Category No. 3069—dense fibrillar component; Category No. 3070—dentate gyrus development; Category No. 3071—dentate gyrus mossy fiber; Category No. 3072—dentinogenesis; Category No. 3073—deoxyadenosine catabolic process; Category No. 3074—deoxycytidine deaminase activity; Category No. 3075—deoxycytidine kinase activity; Category No. 3076—deoxycytidine metabolic process; Category No. 3077—deoxycytidyl transferase activity; Category No. 3078—deoxyguanosine kinase activity; Category No. 3079—deoxyhypusine biosynthetic process from spermidine; Category No. 3080—deoxyhypusine monooxygenase activity; Category No. 3081—deoxyhypusine synthase activity; Category No. 3082—deoxynucleotide transmembrane transporter activity; Category No. 3083—deoxynucleotide transport; Category No. 3084—deoxyribonuclease activity; Category No. 3085—deoxyribonuclease I activity; Category No. 3086—deoxyribonuclease II activity; Category No. 3087—deoxyribonucleoside 5'-monophosphate N-glycosidase activity; Category No. 3088—deoxyribonucleoside catabolic process; Category No. 3089—deoxyribonucleoside diphosphate metabolic process; Category No. 3090—deoxyribonucleoside monophosphate biosynthetic process; Category No. 3091—deoxyribonucleoside monophosphate catabolic process; Category No. 3092—deoxyribonucleoside triphosphate catabolic process; Category No. 3093—deoxyribonucleoside triphosphate metabolic process; Category No. 3094—deoxyribonucleotide biosynthetic process; Category No. 3095—deoxyribonucleotide catabolic process; Category No. 3096—deoxyribonucleotide metabolic process; Category No. 3097—deoxyribose phosphate catabolic process; Category No. 3098—deoxyribose-phosphate aldolase activity; Category No. 3099—dephospho-CoA kinase activity; Category No. 3100—dephosphorylation; Category No. 3101—dephosphorylation of RNA polymerase II C-terminal domain; Category No. 3102—depurination; Category No. 3103—depyrimidination; Category No. 3104—Derlin-1 retrotranslocation complex; Category No. 3105—Derlin-1-VIMP complex; Category No. 3106—dermatan sulfate biosynthetic process; Category No. 3107— dermatan sulfate catabolic process; Category No. 3108—dermatan sulfate proteoglycan biosynthetic process; Category No. 3109—dermatan sulfate proteoglycan metabolic process; Category No. 3110—D-erythro-sphingosine kinase activity; Category No. 3111—desensitization of G-protein coupled receptor protein signaling pathway; Category No. 3112—desensitization of G-protein coupled receptor protein signaling pathway by arrestin; Category No. 3113—desmosome; Category No. 3114—desmosome assembly; Category No. 3115—desmosome disassembly; Category No. 3116—desmosome organization; Category No. 3117—detection of abiotic stimulus; Category No. 3118—detection of bacterial lipoprotein; Category No. 3119—detection of bacterium; Category No. 3120—detection of biotic stimulus; Category No. 3121—detection of calcium ion; Category No. 3122—detection of cell density by contact stimulus involved in contact inhibition; Category No. 3123—detection of chemical stimulus; Category No. 3124—detection of chemical stimulus involved in sensory perception; Category No. 3125—detection of chemical stimulus involved in sensory perception of bitter taste; Category No. 3126—detection of chemical stimulus involved in sensory perception of pain; Category No. 3127—detection of chemical stimulus involved in sensory perception of smell; Category No. 3128—detection of chemical stimulus involved in sensory perception of sour taste; Category No. 3129—detection of chemical stimulus involved in sensory perception of sweet taste; Category No. 3130—detection of chemical stimulus involved in sensory perception of taste; Category No. 3131—detection of diacyl bacterial lipopeptide; Category No. 3132—detection of DNA damage; Category No. 3133—detection of fungus; Category No. 3134—detection of glucose; Category No. 3135—detection of gravity; Category No. 3136—detection of hormone stimulus; Category No. 3137—detection of hypoxia; Category No. 3138—detection of hypoxic conditions in blood by carotid body chemoreceptor signaling; Category No. 3139—detection of light stimulus; Category No. 3140—detection of light stimulus involved in visual perception; Category No. 3141—detection of lipopolysaccharide; Category No. 3142—detection of lipoteichoic acid; Category No. 3143—detection of mechanical stimulus; Category No. 3144—detection of mechanical stimulus involved in equilibrioception; Category No. 3145—detection of mechanical stimulus involved in sensory perception; Category No. 3146—detection of mechanical stimulus involved in sensory perception of pain; Category No. 3147—detection of mechanical stimulus involved in sensory perception of sound; Category No. 3148—detection of mechanical stimulus involved in sensory perception of touch; Category No. 3149—detection of misfolded protein; Category No. 3150—detection of molecule of bacterial origin; Category No. 3151—detection of muramyl dipeptide; Category No. 3152—detection of muscle stretch; Category No. 3153—detection of nodal flow; Category No. 3154—detection of oxidative stress; Category No. 3155—detection of oxygen; Category No. 3156—detection of peptidoglycan; Category No. 3157—detection of stimulus; Category No. 3158—detection of stimulus involved in sensory perception; Category No. 3159—detection of temperature stimulus; Category No. 3160—detection of temperature stimulus involved in sensory perception; Category No. 3161—detection of temperature stimulus involved in sensory perception of pain; Category No. 3162—detection of triacyl bacterial lipopeptide; Category No. 3163—detection of tumor cell; Category No. 3164—detection of UV; Category No. 3165—detection of virus; Category No. 3166—detection of visible light; Category No. 3167—determination of adult lifespan; Category No. 3168—determination of affect; Category No. 3169—determination of bilateral symmetry; Category No. 3170—determination of digestive tract left right asymmetry; Category No. 3171—determination of dorsal identity; Category No. 3172—determination of heart left right asymmetry; Category No. 3173—determination of intestine left right asymmetry; Category No. 3174—determination of left right asymmetry in lateral mesoderm; Category No. 3175—determination of left right asymmetry in nervous system; Category No. 3176—determination of left right symmetry; Category No. 3177—determination of liver left right asymmetry; Category No. 3178—determination of pancreatic left right asymmetry; Category No. 3179—determination of stomach left right asymmetry; Category No. 3180—detoxification of cadmium ion; Category No. 3181—detoxification of copper ion; Category No. 3182—detoxification of mercury ion; Category No. 3183—detoxification of nitrogen compound; Category No. 3184—deubiquitinase activator activity; Category No. 3185—deuterosome; Category No. 3186—development involved in symbiotic interaction; Category No. 3187—development of primary female sexual characteristics; Category No. 3188—development of primary male sexual characteristics; Category No. 3189—development of primary sexual characteristics; Category No. 3190—development of secondary female sexual characteristics; Category No. 3191—development of secondary male sexual characteristics; Category No. 3192—development of secondary sexual characteristics; Category No. 3193—developmental cell growth; Category No. 3194—developmental growth; Category No. 3195—developmental growth involved in morphogenesis; Category No. 3196—developmental induction; Category No. 3197—developmental pigmentation; Category No. 3198—developmental process; Category No. 3199—developmental process involved in reproduction; Category No. 3200—developmental programmed cell death; Category No. 3201—dGDP biosynthetic process; Category No. 3202—dGDP catabolic process; Category No. 3203—dGDP phosphorylation; Category No. 3204—D-gluconate catabolic process; Category No. 3205—D-gluconate metabolic process; Category No. 3206—D-glucose transmembrane transporter activity; Category No. 3207—D-glucuronate catabolic process; Category No. 3208—dGMP metabolic process; Category No. 3209—dGTP binding; Category No. 3210—dGTP catabolic process; Category No. 3211—dGTP metabolic process; Category No. 3212—dGTPase activity; Category No. 3213—DH domain binding; Category No. 3214—diacyl lipopeptide binding; Category No. 3215—diacylglycerol binding; Category No. 3216—diacylglycerol biosynthetic process; Category No. 3217—diacylglycerol catabolic process; Category No. 3218—diacylglycerol cholinephosphotransferase activity; Category No. 3219—diacylglycerol kinase activity; Category No. 3220—diacylglycerol metabolic process; Category No. 3221—diacylglycerol O-acyltransferase activity; Category No. 3222—diadenosine polyphosphate catabolic process; Category No. 3223—diadenosine tetraphosphate biosynthetic process; Category No. 3224—diamine N-acetyltransferase activity; Category No. 3225—diamine oxidase activity; Category No. 3226—diapedesis; Category No. 3227—diaphragm contraction; Category No. 3228—diaphragm development; Category No. 3229—diazepam binding; Category No. 3230—dibenzo-p-dioxin catabolic process; Category No. 3231—dibenzo-p-dioxin metabolic process; Category No. 3232—dicarboxylic acid catabolic process; Category No. 3233—dicarboxylic acid metabolic process; Category No. 3234—dicarboxylic acid transmembrane transporter activity; Category No. 3235—dicarboxylic acid transport; Category No. 3236—dichotomous subdivision of terminal units involved in lung branching; Category No. 3237—dichotomous subdivision of terminal units involved in mammary gland duct morphogenesis; Category No. 3238—dichotomous subdivision of terminal units involved in salivary gland branching; Category No. 3239—dichotomous subdivision of terminal units involved in ureteric bud branching; Category No. 3240—dIDP diphosphatase activity; Category No. 3241—diencephalon development; Category No. 3242—diencephalon morphogenesis; Category No. 3243—diet induced thermogenesis; Category No. 3244—digestion; Category No. 3245—digestive system development; Category No. 3246—digestive tract development; Category No. 3247—digestive tract morphogenesis; Category No. 3248—dihydrobiopterin metabolic process; Category No. 3249—dihydroceramidase activity; Category No. 3250—dihydrocoumarin hydrolase activity; Category No. 3251—dihydrofolate metabolic process; Category No. 3252—dihydrofolate reductase activity; Category No. 3253—dihydrolipoamide metabolic process; Category No. 3254—dihydrolipoyl dehydrogenase activity; Category No. 3255—dihydrolipoyllysine-residue (2-methylpropanoyl)transferase activity; Category No. 3256—dihydrolipoyllysine-residue acetyltransferase activity; Category No. 3257—dihydrolipoyllysine-residue succinyltransferase activity; Category No. 3258—dihydroorotase activity; Category No. 3259—dihydroorotate dehydrogenase activity; Category No. 3260—dihydropyrimidinase activity; Category No. 3261—dihydropyrimidine dehydrogenase (NADP+) activity; Category No. 3262—dihydrotestosterone 17-beta-dehydrogenase activity; Category No. 3263—diiodophenylpyruvate reductase activity; Category No. 3264—dimeric G-protein coupled receptor signaling pathway; Category No. 3265—dimeric IgA immunoglobulin complex; Category No. 3266—dimethylallyl diphosphate biosynthetic process; Category No. 3267—dimethylallyltranstransferase activity; Category No. 3268—dimethylargininase activity; Category No. 3269—dimethylglycine dehydrogenase activity; Category No. 3270—dinitrosyl-iron complex binding; Category No. 3271—dinucleotide insertion or deletion binding; Category No. 3272—dinucleotide repeat insertion binding; Category No. 3273—diolein transacylation activity; Category No. 3274—dioxygenase activity; Category No. 3275—dipeptidase activity; Category No. 3276—dipeptidyl-peptidase activity; Category No. 3277—diphosphate metabolic process; Category No. 3278—diphosphoinositol polyphosphate catabolic process; Category No. 3279—diphosphoinositol-pentakisphosphate kinase activity; Category No. 3280—diphosphoinositol-polyphosphate diphosphatase activity; Category No. 3281—diphosphomevalonate decarboxylase activity; Category No. 3282—diphthine methylesterase activity; Category No. 3283—diphthine synthase activity; Category No. 3284—diphthine-ammonia ligase activity; Category No. 3285—direct ligand regulated sequence-specific DNA binding; Category No. 3286—directional locomotion; Category No. 3287—disaccharide binding; Category No. 3288—disaccharide metabolic process; Category No. 3289—discoidal high-density lipoprotein particle; Category No. 3290—distal tubule development; Category No. 3291—distal tubule morphogenesis; Category No. 3292—disulfide as acceptor; Category No. 3293—disulfide oxidoreductase activity; Category No. 3294—diterpenoid metabolic process; Category No. 3295—dITP catabolic process; Category No. 3296—dITP diphosphatase activity; Category No. 3297—diuretic hormone activity; Category No. 3298—divalent metal ion export; Category No. 3299—D-lactate dehydrogenase (cytochrome) activity; Category No. 3300—DNA (cytosine-5-)-methyltransferase activity; Category No. 3301—DNA 3' dephosphorylation involved in DNA repair; Category No. 3302—DNA 5'-adenosine monophosphate hydrolase activity; Category No. 3303—DNA binding; Category No. 3304—DNA biosynthetic process; Category No. 3305—DNA catabolic process; Category No. 3306—DNA clamp loader activity; Category No. 3307—DNA conformation change; Category No. 3308—DNA cytosine deamination; Category No. 3309—DNA damage checkpoint; Category No. 3310—DNA damage induced protein phosphorylation; Category No. 3311—DNA damage recognition; Category No. 3312—DNA damage removal; Category No. 3313—DNA damage response; Category No. 3314—DNA dealkylation involved in DNA repair; Category No. 3315—DNA deamination; Category No. 3316—DNA demethylation; Category No. 3317—DNA demethylation of male pronucleus; Category No. 3318—DNA double-strand break processing; Category No. 3319—DNA double-strand break processing involved in repair via single-strand annealing; Category No. 3320—DNA duplex unwinding; Category No. 3321—DNA endoreduplication; Category No. 3322—DNA gap filling; Category No. 3323—DNA geometric change; Category No. 3324—DNA hairpin binding; Category No. 3325—DNA helicase activity; Category No. 3326—DNA hypermethylation; Category No. 3327—DNA incision; Category No. 3328—DNA integration; Category No. 3329—DNA ligase (ATP) activity; Category No. 3330—DNA ligase activity; Category No. 3331—DNA ligase III-XRCC1 complex; Category No. 3332—DNA ligase IV complex; Category No. 3333—DNA ligation; Category No. 3334—DNA ligation involved in DNA recombination; Category No. 3335—DNA ligation involved in DNA repair; Category No. 3336—DNA metabolic process; Category No. 3337—DNA methylation; Category No. 3338—DNA methylation involved in embryo development; Category No. 3339—DNA methylation involved in gamete generation; Category No. 3340—DNA methylation on cytosine; Category No. 3341—DNA methylation on cytosine within a CG sequence; Category No. 3342—DNA modification; Category No. 3343—DNA N-glycosylase activity; Category No. 3344—DNA nucleotidylexotransferase activity; Category No. 3345—DNA packaging; Category No. 3346—DNA polymerase activity; Category No. 3347—DNA polymerase binding; Category No. 3348—DNA polymerase III complex; Category No. 3349—DNA polymerase processivity factor activity; Category No. 3350—DNA primase activity; Category No. 3351—DNA protection; Category No. 3352—DNA recombinase assembly; Category No. 3353—DNA recombination; Category No. 3354—DNA repair; Category No. 3355—DNA repair complex; Category No. 3356—DNA replication; Category No. 3357—DNA replication checkpoint; Category No. 3358—DNA replication factor A complex; Category No. 3359—DNA replication factor C complex; Category No. 3360—DNA replication initiation; Category No. 3361—DNA replication origin binding; Category No. 3362—DNA replication preinitiation complex; Category No. 3363—DNA replication proofreading; Category No. 3364—DNA replication-dependent nucleosome assembly; Category No. 3365—DNA replication-independent nucleosome assembly; Category No. 3366—DNA rewinding; Category No. 3367—DNA RNA helicase activity; Category No. 3368—DNA strand elongation; Category No. 3369—DNA strand elongation involved in DNA replication; Category No. 3370—DNA strand renaturation; Category No. 3371—DNA synthesis involved in DNA repair;

Category No. 3372—DNA topoisomerase activity; Category No. 3373—DNA topoisomerase binding; Category No. 3374—DNA topoisomerase complex (ATP-hydrolyzing); Category No. 3375—DNA topoisomerase type I activity; Category No. 3376—DNA topoisomerase type II (ATP-hydrolyzing) activity; Category No. 3377—DNA topological change; Category No. 3378—DNA translocase activity; Category No. 3379—DNA unwinding involved in DNA replication; Category No. 3380—DNA-(apurinic or apyrimidinic site) lyase activity; Category No. 3381—DNA-3-methyladenine glycosylase activity; Category No. 3382—DNA-3-methylguanine glycosylase activity; Category No. 3383—DNA-7-methyladenine glycosylase activity; Category No. 3384—DNA-7-methylguanine glycosylase activity; Category No. 3385—DNA-dependent ATPase activity; Category No. 3386—DNA-dependent DNA replication; Category No. 3387—DNA-dependent protein kinase activity; Category No. 3388—DNA-dependent protein kinase complex; Category No. 3389—DNA-dependent protein kinase-DNA ligase 4 complex; Category No. 3390—DNA-directed DNA polymerase activity; Category No. 3391—DNA-directed RNA polymerase activity; Category No. 3392—DNA-directed RNA polymerase I complex; Category No. 3393—DNA-directed RNA polymerase II; Category No. 3394—DNA-directed RNA polymerase III complex; Category No. 3395—DNA-mediated; Category No. 3396—DNA-methyltransferase activity; Category No. 3397—DNA-N1-methyladenine dioxygenase activity; Category No. 3398—DNA-templated; Category No. 3399—DNA-templated transcription; Category No. 3400—docking; Category No. 3401—dodecenoyl-CoA delta-isomerase activity; Category No. 3402—dolichol biosynthetic process; Category No. 3403—dolichol kinase activity; Category No. 3404—dolichol metabolic process; Category No. 3405—dolichol-linked oligosaccharide biosynthetic process; Category No. 3406—dolichol-phosphate-mannose synthase complex; Category No. 3407—dolichyl diphosphate biosynthetic process; Category No. 3408—dolichyl monophosphate biosynthetic process; Category No. 3409—dolichyl pyrophosphate Man9GlcNAc2 alpha-1,3-glucosyltransferase activity; Category No. 3410—dolichyldiphosphatase activity; Category No. 3411—dolichyl-diphosphooligosaccharide-protein glycotransferase activity; Category No. 3412—dolichyl-phosphate beta-D-mannosyltransferase activity; Category No. 3413—dolichyl-phosphate beta-glucosyltransferase activity; Category No. 3414—dolichyl-phosphate-glucose-glycolipid alpha-glucosyltransferase activity; Category No. 3415—dolichyl-phosphate-mannose-glycolipid alpha-mannosyltransferase activity; Category No. 3416—dolichyl-phosphate-mannose-protein mannosyltransferase activity; Category No. 3417—dolichyl-phosphate-mannose-protein mannosyltransferase complex; Category No. 3418—dol-P-Man:Man(5)GlcNAc(2)-PP-Dol alpha-1,3-mannosyltransferase activity; Category No. 3419—dol-P-Man:Man(6)GlcNAc(2)-PP-Dol alpha-1,2-mannosyltransferase activity; Category No. 3420—dol-P-Man: Man(7)GlcNAc(2)-PP-Dol alpha-1,6-mannosyltransferase activity; Category No. 3421—dol-P-Man:Man(8) GlcNAc(2)-PP-Dol alpha-1,2-mannosyltransferase activity; Category No. 3422—dopachrome isomerase activity; Category No. 3423—dopamine beta-monooxygenase activity; Category No. 3424—dopamine binding; Category No. 3425—dopamine biosynthetic process; Category No. 3426—dopamine biosynthetic process from tyrosine; Category No. 3427—dopamine catabolic process; Category No. 3428—dopamine metabolic process; Category No. 3429—dopamine neurotransmitter receptor activity; Category No. 3430—dopamine receptor binding; Category No. 3431—dopamine receptor signaling pathway; Category No. 3432—dopamine transmembrane transporter activity; Category No. 3433—dopamine transport; Category No. 3434—dopamine uptake involved in synaptic transmission; Category No. 3435—dopamine:sodium symporter activity; Category No. 3436—dopaminergic; Category No. 3437—dopaminergic neuron differentiation; Category No. 3438—dorsal aorta development; Category No. 3439—dorsal aorta morphogenesis; Category No. 3440—dorsal root ganglion development; Category No. 3441—dorsal spinal cord development; Category No. 3442—dorsal ventral axis specification; Category No. 3443—dorsal ventral axon guidance; Category No. 3444—dorsal ventral neural tube patterning; Category No. 3445—dorsal ventral pattern formation; Category No. 3446—dosage compensation; Category No. 3447—dosage compensation by inactivation of X chromosome; Category No. 3448—double-strand break repair; Category No. 3449—double-strand break repair via alternative nonhomologous end joining; Category No. 3450—double-strand break repair via break-induced replication; Category No. 3451—double-strand break repair via classical nonhomologous end joining; Category No. 3452—double-strand break repair via homologous recombination; Category No. 3453—double-strand break repair via nonhomologous end joining; Category No. 3454—double-strand break repair via single-strand annealing; Category No. 3455—double-strand break repair via synthesis-dependent strand annealing; Category No. 3456—double-strand single-strand DNA junction binding; Category No. 3457—double-stranded DNA 3'-5' exodeoxyribonuclease activity; Category No. 3458—double-stranded DNA 5'-3' exodeoxyribonuclease activity; Category No. 3459—double-stranded DNA binding; Category No. 3460—double-stranded DNA exodeoxyribonuclease activity; Category No. 3461—double-stranded DNA-dependent ATPase activity; Category No. 3462—double-stranded methylated DNA binding; Category No. 3463—double-stranded RNA adenosine deaminase activity; Category No. 3464—double-stranded RNA binding; Category No. 3465—double-stranded telomeric DNA binding; Category No. 3466—doxorubicin metabolic process; Category No. 3467—D-ribose catabolic process; Category No. 3468—D-ribose metabolic process; Category No. 3469—drinking behavior; Category No. 3470—DRM complex; Category No. 3471—drug binding; Category No. 3472—drug catabolic process; Category No. 3473—drug export; Category No. 3474—drug metabolic process; Category No. 3475—drug transmembrane transport; Category No. 3476—drug transmembrane transporter activity; Category No. 3477—drug transport; Category No. 3478—D-serine ammonia-lyase activity; Category No. 3479—D-serine biosynthetic process; Category No. 3480—D-serine catabolic process; Category No. 3481—D-serine metabolic process; Category No. 3482—D-serine transmembrane transporter activity; Category No. 3483—D-serine transport; Category No. 3484—DSIF complex; Category No. 3485—Dsl1p complex; Category No. 3486—dsRNA transport; Category No. 3487—dTDP biosynthetic process; Category No. 3488—dTDP-glucose 4,6-dehydratase activity; Category No. 3489—dTMP biosynthetic process; Category No. 3490—dTTP biosynthetic process; Category No. 3491—D-tyrosyl-tRNA(Tyr) deacylase activity; Category No. 3492—DUBm complex; Category No. 3493—ductus arteriosus closure; Category No. 3494—dUDP biosynthetic process; Category No. 3495—dUMP biosynthetic process; Category No. 3496—dUMP catabolic process; Category No. 3497—dUMP metabolic process; Category No. 3498—dUTP catabolic process; Category No. 3499—dUTP diphosphatase activity; Category No. 3500—dUTP metabolic process; Category No. 3501—D-xylose 1-dehydrogenase (NADP+) activity; Category No. 3502—D-xylose catabolic process; Category No. 3503—D-xylose metabolic process; Category No. 3504—D-xylulose reductase activity; Category No. 3505—dynactin binding; Category No. 3506—dynactin complex; Category No. 3507—dynamin polymerization involved in mitochondrial fission; Category No. 3508—dynein binding; Category No. 3509—dynein complex; Category No. 3510—dynein complex binding; Category No. 3511—dynein heavy chain binding; Category No. 3512—dynein intermediate chain binding; Category No. 3513—dynein light chain binding; Category No. 3514—dynein light intermediate chain binding; Category No. 3515—dynorphin receptor activity; Category No. 3516—dystroglycan binding; Category No. 3517—dystroglycan complex; Category No. 3518—dystrophin-associated glycoprotein complex; Category No. 3519—ear development; Category No. 3520—ear morphogenesis; Category No. 3521—early endosome; Category No. 3522—early endosome lumen; Category No. 3523—early endosome membrane; Category No. 3524—early endosome to Golgi transport; Category No. 3525—early endosome to late endosome transport; Category No. 3526—early endosome to recycling endosome transport; Category No. 3527—early phagosome; Category No. 3528—EARP complex; Category No. 3529—eating behavior; Category No. 3530—E-box binding; Category No. 3531—ectoderm and mesoderm interaction; Category No. 3532—ectoderm development; Category No. 3533—ectoderm formation; Category No. 3534—ectodermal cell differentiation; Category No. 3535—ectodermal cell fate commitment; Category No. 3536—ectopic germ cell programmed cell death; Category No. 3537—ectoplasm; Category No. 3538—Edg-2 lysophosphatidic acid receptor binding; Category No. 3539—efferent axon development in a lateral line nerve; Category No. 3540—efflux transmembrane transporter activity; Category No. 3541—egg activation; Category No. 3542—egg coat; Category No. 3543—egg coat formation; Category No. 3544—EGO complex; Category No. 3545—EH domain binding; Category No. 3546—eiF2alpha phosphorylation in response to endoplasmic reticulum stress; Category No. 3547—elF3m; Category No. 3548—EKC KEOPS complex; Category No. 3549—elastic fiber; Category No. 3550—elastic fiber assembly; Category No. 3551—elastin biosynthetic process; Category No. 3552—elastin catabolic process; Category No. 3553—elastin metabolic process; Category No. 3554—electron carrier activity; Category No. 3555—electron transport chain; Category No. 3556—electron transporter; Category No. 3557—electron-transferring-flavoprotein dehydrogenase activity; Category No. 3558—ELL-EAF complex; Category No. 3559—elongation; Category No. 3560—elongation factor-2 kinase activity; Category No. 3561—Elongator holoenzyme complex; Category No. 3562—elongin complex; Category No. 3563—embryo; Category No. 3564—embryo development; Category No. 3565—embryo development ending in birth or egg hatching; Category No. 3566—embryo implantation; Category No. 3567—embryonic; Category No. 3568—embryonic axis specification; Category No. 3569—embryonic body morphogenesis; Category No. 3570—embryonic brain development; Category No. 3571—embryonic camera-type eye development; Category No. 3572—embryonic camera-type eye formation; Category No. 3573—embryonic camera-type eye morphogenesis; Category No. 3574—embryonic cleavage; Category No. 3575—embryonic cranial skeleton morphogenesis; Category No. 3576—embryonic digestive tract development; Category No. 3577—embryonic digestive tract morphogenesis; Category No. 3578—embryonic digit morphogenesis; Category No. 3579—embryonic ectodermal digestive tract development; Category No. 3580—embryonic ectodermal digestive tract morphogenesis; Category No. 3581—embryonic epithelial tube formation; Category No. 3582—embryonic eye morphogenesis; Category No. 3583—embryonic foregut morphogenesis; Category No. 3584—embryonic forelimb morphogenesis; Category No. 3585—embryonic genitalia morphogenesis; Category No. 3586—embryonic heart tube anterior posterior pattern specification; Category No. 3587—embryonic heart tube development; Category No. 3588—embryonic heart tube elongation; Category No. 3589—embryonic heart tube formation; Category No. 3590—embryonic heart tube left right pattern formation; Category No. 3591—embryonic heart tube morphogenesis; Category No. 3592—embryonic hemopoiesis; Category No. 3593—embryonic hindgut morphogenesis; Category No. 3594—embryonic hindlimb morphogenesis; Category No. 3595—embryonic limb morphogenesis; Category No. 3596—embryonic liver development; Category No. 3597—embryonic lung development; Category No. 3598—embryonic morphogenesis; Category No. 3599—embryonic nail plate morphogenesis; Category No. 3600—embryonic neurocranium morphogenesis; Category No. 3601—embryonic olfactory bulb interneuron precursor migration; Category No. 3602—embryonic organ development; Category No. 3603—embryonic organ morphogenesis; Category No. 3604—embryonic pattern specification; Category No. 3605—embryonic placenta development; Category No. 3606—embryonic placenta morphogenesis; Category No. 3607—embryonic process involved in female pregnancy; Category No. 3608—embryonic retina morphogenesis in camera-type eye; Category No. 3609—embryonic skeletal joint development; Category No. 3610—embryonic skeletal joint morphogenesis; Category No. 3611—embryonic skeletal limb joint morphogenesis; Category No. 3612—embryonic skeletal system development; Category No. 3613—embryonic skeletal system morphogenesis; Category No. 3614—embryonic viscerocranium morphogenesis; Category No. 3615—enamel mineralization; Category No. 3616—endocannabinoid signaling pathway; Category No. 3617—endocardial cell differentiation; Category No. 3618—endocardial cushion cell development; Category No. 3619—endocardial cushion cell fate commitment; Category No. 3620—endocardial cushion development; Category No. 3621—endocardial cushion formation; Category No. 3622—endocardial cushion morphogenesis; Category No. 3623—endocardial cushion to mesenchymal transition; Category No. 3624—endocardial cushion to mesenchymal transition involved in heart valve formation; Category No. 3625—endocardium development; Category No. 3626—endocardium formation; Category No. 3627—endocardium morphogenesis; Category No. 3628—endochitinase activity; Category No. 3629—endochondral bone growth; Category No. 3630—endochondral bone morphogenesis; Category No. 3631—endochondral ossification; Category No. 3632—endocrine pancreas development; Category No. 3633—endocrine signaling; Category No. 3634—endocrine system development; Category No. 3635—endocytic recycling; Category No. 3636—endocytic vesicle; Category No. 3637—endocytic vesicle lumen; Category No. 3638—endocytic vesicle membrane; Category No. 3639—endocytosis; Category No. 3640—endodeoxyribonuclease activity; Category No. 3641—endoderm development; Category No. 3642—endoderm formation; Category No. 3643—endodermal cell differentiation; Category No. 3644—endodermal cell fate commitment; Category No. 3645—endodermal cell fate determination; Category No. 3646—endodermal cell fate specification; Category No. 3647—endodermal digestive tract morphogenesis; Category No. 3648—endogenous lipid antigen binding; Category No. 3649—endogenous lipid antigen via MHC class Ib; Category No. 3650—endolysosome lumen; Category No. 3651—endolysosome membrane; Category No. 3652—endomembrane system; Category No. 3653—endomembrane system organization; Category No. 3654—endomitotic cell cycle; Category No. 3655—endonuclease activity; Category No. 3656—endonucleolytic; Category No. 3657—endonucleolytic cleavage in 5'-ETS of tricistronic rRNA transcript (SSU-rRNA; Category No. 3658—endonucleolytic cleavage in ITS1 to separate SSU-rRNA from 5.8S rRNA and LSU-rRNA from tricistronic rRNA transcript (SSU-rRNA; Category No. 3659—endonucleolytic cleavage of tricistronic rRNA transcript (SSU-rRNA; Category No. 3660—endonucleolytic cleavage to generate mature 3'-end of SSU-rRNA from (SSU-rRNA; Category No. 3661—endonucleolytic cleavage to generate mature 5'-end of SSU-rRNA from (SSU-rRNA; Category No. 3662—endopeptidase activator activity; Category No. 3663—endopeptidase activity; Category No. 3664—endopeptidase Clp complex; Category No. 3665—endopeptidase inhibitor activity; Category No. 3666—endoplasmic reticulum; Category No. 3667—endoplasmic reticulum calcium ion homeostasis; Category No. 3668—endoplasmic reticulum chaperone complex; Category No. 3669—endoplasmic reticulum exit site; Category No. 3670—endoplasmic reticulum localization; Category No. 3671—endoplasmic reticulum lumen; Category No. 3672—endoplasmic reticulum mannose trimming; Category No. 3673—endoplasmic reticulum membrane; Category No. 3674—endoplasmic reticulum membrane fusion; Category No. 3675—endoplasmic reticulum membrane organization; Category No. 3676—endoplasmic reticulum organization; Category No. 3677—endoplasmic reticulum polarization; Category No. 3678—endoplasmic reticulum quality control compartment; Category No. 3679—endoplasmic reticulum Sec complex; Category No. 3680—endoplasmic reticulum signal peptide binding; Category No. 3681—endoplasmic reticulum targeting; Category No. 3682—endoplasmic reticulum tubular network; Category No. 3683—endoplasmic reticulum tubular network organization; Category No. 3684—endoplasmic reticulum unfolded protein response; Category No. 3685—endoplasmic reticulum-Golgi intermediate compartment; Category No. 3686—endoplasmic reticulum-Golgi intermediate compartment membrane; Category No. 3687—endoplasmic reticulum-Golgi intermediate compartment organization; Category No. 3688—endoribonuclease activity; Category No. 3689—endoribonuclease inhibitor activity; Category No. 3690—endosomal lumen acidification; Category No. 3691—endosomal transport; Category No. 3692—endosomal vesicle fusion; Category No. 3693—endosome; Category No. 3694—endosome localization; Category No. 3695—endosome lumen; Category No. 3696—endosome membrane; Category No. 3697—endosome organization; Category No. 3698—endosome to Golgi; Category No. 3699—endosome to lysosome transport; Category No. 3700—endosome to lysosome transport via multivesicular body sorting pathway; Category No. 3701—endosome to melanosome transport; Category No. 3702—endosome to plasma membrane; Category No. 3703—endosome to plasma membrane transport vesicle; Category No. 3704—endosome transport via multivesicular body sorting pathway; Category No. 3705—endothelial cell activation; Category No. 3706—endothelial cell activation involved in immune response; Category No. 3707—endothelial cell apoptotic process; Category No. 3708—endothelial cell chemotaxis; Category No. 3709—endothelial cell chemotaxis to fibroblast growth factor; Category No. 3710—endothelial cell development; Category No. 3711—endothelial cell differentiation; Category No. 3712—endothelial cell fate specification; Category No. 3713—endothelial cell migration; Category No. 3714—endothelial cell morphogenesis; Category No. 3715—endothelial cell proliferation; Category No. 3716—endothelial cell-cell adhesion; Category No. 3717—endothelial microparticle; Category No. 3718—endothelial tip cell fate specification; Category No. 3719—endothelial tube morphogenesis; Category No. 3720—endothelin A receptor binding; Category No. 3721—endothelin B receptor binding; Category No. 3722—endothelin maturation; Category No. 3723—endothelin receptor activity; Category No. 3724—endothelin receptor signaling pathway; Category No. 3725—endothelium development; Category No. 3726—energy derivation by oxidation of organic compounds; Category No. 3727—energy homeostasis; Category No. 3728—energy reserve metabolic process; Category No. 3729—engulfment; Category No. 3730—engulfment of apoptotic cell; Category No. 3731—enhancer binding; Category No. 3732—enhancer sequence-specific DNA binding; Category No. 3733—enkephalin processing; Category No. 3734—enkephalin receptor activity; Category No. 3735—enoyl-[acyl-carrier-protein] reductase (NADPH; Category No. 3736—enoyl-CoA hydratase activity; Category No. 3737—enteric nervous system development; Category No. 3738—enteric smooth muscle cell differentiation; Category No. 3739—enterobactin transport; Category No. 3740—enterobactin transporter activity; Category No. 3741—enteroendocrine cell differentiation; Category No. 3742—entrainment of circadian clock; Category No. 3743—entrainment of circadian clock by photoperiod; Category No. 3744—entry into host cell; Category No. 3745—entry of symbiont into host cell by promotion of host phagocytosis; Category No. 3746—enucleate erythrocyte development; Category No. 3747—enucleate erythrocyte differentiation; Category No. 3748—enzymatic modification; Category No. 3749—enzyme activator activity; Category No. 3750—enzyme active site formation via cysteine modification to L-cysteine persulfide; Category No. 3751—enzyme active site formation via L-cysteine sulfinic acid; Category No. 3752—enzyme binding; Category No. 3753—enzyme inhibitor activity; Category No. 3754—enzyme linked receptor protein signaling pathway; Category No. 3755—enzyme regulator activity; Category No. 3756—enzyme-directed rRNA 2'-O-methylation; Category No. 3757—eosinophil chemotaxis; Category No. 3758—eosinophil degranulation; Category No. 3759—eosinophil differentiation; Category No. 3760—eosinophil fate commitment; Category No. 3761—eosinophil migration; Category No. 3762—eoxin A4 synthase activity; Category No. 3763—EP4 subtype prostaglandin E2 receptor binding; Category No. 3764—ephrin receptor activity; Category No. 3765—ephrin receptor binding; Category No. 3766—ephrin receptor signaling pathway; Category No. 3767—epiblast cell-extraembryonic ectoderm cell signaling involved in anterior posterior axis specification; Category No. 3768—epiboly involved in gastrulation with mouth forming second; Category No. 3769—epidermal cell differentiation; Category No. 3770—epidermal cell division; Category No. 3771—epidermal cell fate specification; Category No. 3772—epidermal growth factor binding; Category No. 3773—epidermal growth factor catabolic process; Category No. 3774—epidermal growth factor receptor binding; Category No. 3775—epidermal growth factor receptor signaling pathway; Category No. 3776—epidermal growth factor receptor signaling pathway via 1-kappaB kinase NF-kappaB cascade; Category No. 3777—epidermal growth factor-activated receptor activity; Category No. 3778—epidermal growth factor-activated receptor transactivation by G-protein coupled receptor signaling pathway; Category No. 3779—epidermal lamellar body; Category No. 3780—epidermal stem cell homeostasis; Category No. 3781—epidermis development; Category No. 3782—epidermis morphogenesis; Category No. 3783—epigenetic; Category No. 3784—epinephrine binding; Category No. 3785—epinephrine biosynthetic process; Category No. 3786—epinephrine metabolic process; Category No. 3787—epinephrine secretion; Category No. 3788—epinephrine transport; Category No. 3789—epithelial cell apoptotic process involved in palatal shelf morphogenesis; Category No. 3790—epithelial cell development; Category No. 3791—epithelial cell differentiation; Category No. 3792—epithelial cell differentiation involved in mammary gland alveolus development; Category No. 3793—epithelial cell differentiation involved in prostate gland development; Category No. 3794—epithelial cell fate commitment; Category No. 3795—epithelial cell maturation; Category No. 3796—epithelial cell maturation involved in prostate gland development; Category No. 3797—epithelial cell maturation involved in salivary gland development; Category No. 3798—epithelial cell migration; Category No. 3799—epithelial cell morphogenesis; Category No. 3800—epithelial cell morphogenesis involved in placental branching; Category No. 3801—epithelial cell proliferation; Category No. 3802—epithelial cell proliferation involved in lung morphogenesis; Category No. 3803—epithelial cell proliferation involved in mammary gland duct elongation; Category No. 3804—epithelial cell proliferation involved in prostatic bud elongation; Category No. 3805—epithelial cell proliferation involved in renal tubule morphogenesis; Category No. 3806—epithelial cell proliferation involved in salivary gland morphogenesis; Category No. 3807—epithelial cell-cell adhesion; Category No. 3808—epithelial cilium movement; Category No. 3809—epithelial cilium movement involved in determination of left right asymmetry; Category No. 3810—epithelial fluid transport; Category No. 3811—epithelial structure maintenance; Category No. 3812—epithelial to mesenchymal transition; Category No. 3813—epithelial to mesenchymal transition involved in endocardial cushion formation; Category No. 3814—epithelial tube branching involved in lung morphogenesis; Category No. 3815—epithelial tube formation; Category No. 3816—epithelial tube morphogenesis; Category No. 3817—epithelial-mesenchymal cell signaling; Category No. 3818—epithelial-mesenchymal signaling involved in prostate gland development; Category No. 3819—epithelium development; Category No. 3820—epithelium migration; Category No. 3821—epoxide hydrolase activity; Category No. 3822—epoxygenase P450 pathway; Category No. 3823—epsilon DNA polymerase complex; Category No. 3824—equatorial microtubule organizing center; Category No. 3825—equilibrioception; Category No. 3826—ER membrane protein complex; Category No. 3827—ER overload response; Category No. 3828—ER retention sequence binding; Category No. 3829—ER to cytosol; Category No. 3830—ER to Golgi ceramide transport; Category No. 3831—ER to Golgi transport vesicle; Category No. 3832—ER to Golgi transport vesicle membrane; Category No. 3833—ER to Golgi vesicle-mediated transport; Category No. 3834—ER ubiquitin ligase complex; Category No. 3835—ERAD pathway; Category No. 3836—ER-associated misfolded protein catabolic process; Category No. 3837—ER-associated ubiquitin-dependent protein catabolic process; Category No. 3838—ERBB signaling pathway; Category No. 3839—ErbB-2 class receptor binding; Category No. 3840—ERBB2 signaling pathway; Category No. 3841—ERBB2-ERBB3 signaling pathway; Category No. 3842—ErbB-3 class receptor binding; Category No. 3843—ErbB-4 class receptor binding; Category No. 3844—ERCC4-ERCC1 complex; Category No. 3845—ER-dependent peroxisome organization; Category No. 3846—ERK1 and ERK2 cascade; Category No. 3847—ERK5 cascade; Category No. 3848—ER-mitochondrion membrane contact site; Category No. 3849—ER-nucleus signaling pathway; Category No. 3850—error-free postreplication DNA repair; Category No. 3851—error-free translesion synthesis; Category No. 3852—error-prone translesion synthesis; Category No. 3853—erythrocyte development; Category No. 3854—erythrocyte differentiation; Category No. 3855—erythrocyte homeostasis; Category No. 3856—erythrocyte maturation; Category No. 3857—erythrophore differentiation; Category No. 3858—erythropoietin receptor activity; Category No. 3859—erythropoietin receptor binding; Category No. 3860—erythropoietin-mediated signaling pathway; Category No. 3861—ESC E(Z) complex; Category No. 3862—ESCRT I complex; Category No. 3863—ESCRT II complex; Category No. 3864—ESCRT III complex; Category No. 3865—esophagus smooth muscle contraction; Category No. 3866—establishment of anatomical structure orientation; Category No. 3867—establishment of apical basal cell polarity; Category No. 3868—establishment of blood-brain barrier; Category No. 3869—establishment of blood-nerve barrier; Category No. 3870—establishment of body hair planar orientation; Category No. 3871—establishment of cell polarity; Category No. 3872—establishment of cell polarity involved in ameboidal cell migration; Category No. 3873—establishment of centrosome localization; Category No. 3874—establishment of chromatin silencing; Category No. 3875—establishment of chromosome localization; Category No. 3876—establishment of endothelial barrier; Category No. 3877—establishment of endothelial intestinal barrier; Category No. 3878—establishment of epithelial cell apical basal polarity; Category No. 3879—establishment of epithelial cell polarity; Category No. 3880—establishment of glial blood-brain barrier; Category No. 3881—establishment of Golgi localization; Category No. 3882—establishment of integrated proviral latency; Category No. 3883—establishment of localization in cell; Category No. 3884—establishment of meiotic spindle localization; Category No. 3885—establishment of meiotic spindle orientation; Category No. 3886—establishment of melanosome localization; Category No. 3887—establishment of mitochondrion localization; Category No. 3888—establishment of mitotic spindle localization; Category No. 3889—establishment of mitotic spindle orientation; Category No. 3890—establishment of monopolar cell polarity; Category No. 3891—establishment of natural killer cell polarity; Category No. 3892—establishment of neuroblast polarity; Category No. 3893—establishment of nucleus localization; Category No. 3894—establishment of organ orientation; Category No. 3895—establishment of organelle localization; Category No. 3896—establishment of planar polarity; Category No. 3897—establishment of planar polarity involved in nephron morphogenesis; Category No. 3898—establishment of planar polarity involved in neural tube closure; Category No. 3899—establishment of planar polarity of embryonic epithelium; Category No. 3900—establishment of protein localization; Category No. 3901—establishment of protein localization to chromatin; Category No. 3902—establishment of protein localization to endoplasmic reticulum; Category No. 3903—establishment of protein localization to endoplasmic reticulum membrane; Category No. 3904—establishment of protein localization to Golgi; Category No. 3905—establishment of protein localization to juxtaparanode region of axon; Category No. 3906—establishment of protein localization to membrane; Category No. 3907—establishment of protein localization to mitochondrion; Category No. 3908—establishment of protein localization to organelle; Category No. 3909—establishment of protein localization to peroxisome; Category No. 3910—establishment of protein localization to plasma membrane; Category No. 3911—establishment of protein localization to vacuole; Category No. 3912—establishment of Sertoli cell barrier; Category No. 3913—establishment of skin barrier; Category No. 3914—establishment of spindle localization; Category No. 3915—establishment of spindle orientation; Category No. 3916—establishment of spindle pole body localization to nuclear envelope; Category No. 3917—establishment of synaptic specificity at neuromuscular junction; Category No. 3918—establishment of T cell polarity; Category No. 3919—establishment of tissue polarity; Category No. 3920—establishment of vesicle localization; Category No. 3921—establishment of viral latency; Category No. 3922—establishment or maintenance of actin cytoskeleton polarity; Category No. 3923—establishment or maintenance of apical basal cell polarity; Category No. 3924—establishment or maintenance of cell polarity; Category No. 3925—establishment or maintenance of cell polarity regulating cell shape; Category No. 3926—establishment or maintenance of epithelial cell apical basal polarity; Category No. 3927—establishment or maintenance of microtubule cytoskeleton polarity; Category No. 3928—establishment or maintenance of polarity of embryonic epithelium; Category No. 3929—establishment or maintenance of transmembrane electrochemical gradient; Category No. 3930—estradiol 17-beta-dehydrogenase activity; Category No. 3931—estradiol binding; Category No. 3932—estrogen biosynthetic process; Category No. 3933—estrogen catabolic process; Category No. 3934—estrogen metabolic process; Category No. 3935—estrogen receptor activity; Category No. 3936—estrogen receptor binding; Category No. 3937—estrogen response element binding; Category No. 3938—estrogen-activated sequence-specific DNA binding; Category No. 3939—estrone sulfotransferase activity; Category No. 3940—estrous cycle; Category No. 3941—ethanol binding; Category No. 3942—ethanol catabolic process; Category No. 3943—ethanol metabolic process; Category No. 3944—ethanol oxidation; Category No. 3945—ethanolamine kinase activity; Category No. 3946—ethanolamine metabolic process; Category No. 3947—ethanolamine-phosphate cytidylyltransferase activity; Category No. 3948—ethanolamine-phosphate phospho-lyase activity; Category No. 3949—ethanolaminephosphotransferase activity; Category No. 3950—ether lipid biosynthetic process; Category No. 3951—ether lipid metabolic process; Category No. 3952—euchromatin; Category No. 3953—euchromatin binding; Category No. 3954—eukaryotic 43S preinitiation complex; Category No. 3955—eukaryotic 48S preinitiation complex; Category No. 3956—eukaryotic 80S initiation complex; Category No. 3957—eukaryotic initiation factor 4E binding; Category No. 3958—eukaryotic initiation factor 4G binding; Category No. 3959—eukaryotic initiation factor elF2 binding; Category No. 3960—eukaryotic translation elongation factor 1 complex; Category No. 3961—eukaryotic translation initiation factor 2 complex; Category No. 3962—eukaryotic translation initiation factor 2alpha kinase activity; Category No. 3963—eukaryotic translation initiation factor 2B complex; Category No. 3964—eukaryotic translation initiation factor 3 complex; Category No. 3965—eukaryotic translation initiation factor 4F complex; Category No. 3966—evasion or tolerance by virus of host immune response; Category No. 3967—evasion or tolerance of host defenses by virus; Category No. 3968—evoked neurotransmitter secretion; Category No. 3969—exchange of chromosomal proteins; Category No. 3970—excitatory extracellular ligand-gated ion channel activity; Category No. 3971—excitatory postsynaptic potential; Category No. 3972—excitatory synapse; Category No. 3973—excretion; Category No. 3974—execution phase of apoptosis; Category No. 3975—exit from mitosis; Category No. 3976—exo-alpha-(2->3)-sialidase activity; Category No. 3977—exo-alpha-(2->6)-sialidase activity; Category No. 3978—exo-alpha-(2->8)-sialidase activity; Category No. 3979—exo-alpha-sialidase activity; Category No. 3980—exocrine pancreas development; Category No. 3981—exocrine system development; Category No. 3982—exocyst; Category No. 3983—exocyst assembly; Category No. 3984—exocyst localization; Category No. 3985—exocytic vesicle; Category No. 3986—exocytosis; Category No. 3987—exodeoxyribonuclease III activity; Category No. 3988—exogenous drug catabolic process; Category No. 3989—exogenous lipid antigen binding; Category No. 3990—exogenous lipid antigen via MHC class Ib; Category No. 3991—exon-exon junction complex; Category No. 3992—exon-exon junction complex disassembly; Category No. 3993—exonuclease activity; Category No. 3994—exonucleolytic; Category No. 3995—exonucleolytic 3-5'; Category No. 3996—exonucleolytic nuclear-transcribed mRNA catabolic process involved in deadenylation-dependent decay; Category No. 3997—exonucleolytic trimming to generate mature 3-end of 5.8S rRNA from tricistronic rRNA transcript (SSU-rRNA; Category No. 3998—exopeptidase activity; Category No. 3999—exopolyphosphatase activity; Category No. 4000—exoribonuclease activity; Category No. 4001—exoribonuclease II activity; Category No. 4002—exosomal secretion; Category No. 4003—exosome (RNase complex); Category No. 4004—exploration behavior; Category No. 4005—extension of a leading process involved in cell motility in cerebral cortex radial glia guided migration; Category No. 4006—external genitalia morphogenesis; Category No. 4007—external side of cell outer membrane; Category No. 4008—external side of plasma membrane; Category No. 4009—extracellular ATP-gated cation channel activity; Category No. 4010—extracellular exosome; Category No. 4011—extracellular exosome assembly; Category No. 4012—extracellular fibril organization; Category No. 4013—extracellular ligand-gated ion channel activity; Category No. 4014—extracellular matrix; Category No. 4015—extracellular matrix assembly; Category No. 4016—extracellular matrix binding; Category No. 4017—extracellular matrix constituent; Category No. 4018—extracellular matrix constituent conferring elasticity; Category No. 4019—extracellular matrix constituent secretion; Category No. 4020—extracellular matrix disassembly; Category No. 4021—extracellular matrix organization; Category No. 4022—extracellular matrix protein binding; Category No. 4023—extracellular matrix structural constituent; Category No. 4024—extracellular matrix structural constituent conferring tensile strength; Category No. 4025—extracellular matrix-cell signaling; Category No. 4026—extracellular membrane-bounded organelle; Category No. 4027—extracellular negative regulation of signal transduction; Category No. 4028—extracellular polysaccharide biosynthetic process; Category No. 4029—extracellular region; Category No. 4030—extracellular space; Category No. 4031—extracellular structure organization; Category No. 4032—extracellular vesicle; Category No. 4033—extracellular-glutamate-gated chloride channel activity; Category No. 4034—extracellular-glutamate-gated ion channel activity; Category No. 4035—extracellular-glycine-gated chloride channel activity; Category No. 4036—extracellular-glycine-gated ion channel activity; Category No. 4037—extraocular skeletal muscle development; Category No. 4038—extrathymic T cell selection; Category No. 4039—extrinsic apoptotic signaling pathway; Category No. 4040—extrinsic apoptotic signaling pathway in absence of ligand; Category No. 4041—extrinsic apoptotic signaling pathway via death domain receptors; Category No. 4042—extrinsic component of autophagosome membrane; Category No. 4043—extrinsic component of cytoplasmic side of plasma membrane; Category No. 4044—extrinsic component of endoplasmic reticulum membrane; Category No. 4045—extrinsic component of endosome membrane; Category No. 4046—extrinsic component of external side of plasma membrane; Category No. 4047—extrinsic component of Golgi membrane; Category No. 4048—extrinsic component of lysosome membrane; Category No. 4049—extrinsic component of membrane; Category No. 4050—extrinsic component of mitochondrial inner membrane; Category No. 4051—extrinsic component of mitochondrial outer membrane; Category No. 4052—extrinsic component of omegasome membrane; Category No. 4053—extrinsic component of plasma membrane; Category No. 4054—extrinsic component of pre-autophagosomal structure membrane; Category No. 4055—extrinsic pathway; Category No. 4056—eye blink reflex; Category No. 4057—eye development; Category No. 4058—eye morphogenesis; Category No. 4059—eye photoreceptor cell development; Category No. 4060—eye photoreceptor cell differentiation; Category No. 4061—eye photoreceptor cell fate commitment; Category No. 4062—eye pigment biosynthetic process; Category No. 4063—eye pigment granule organization; Category No. 4064—eye pigmentation; Category No. 4065—eyelid development in camera-type eye; Category No. 4066—face development; Category No. 4067—face morphogenesis; Category No. 4068—facial nerve morphogenesis; Category No. 4069—facial nerve structural organization; Category No. 4070—facial nucleus development; Category No. 4071—facioacoustic ganglion development; Category No. 4072—FACT complex; Category No. 4073—F-actin capping protein complex; Category No. 4074—Factor XII activation; Category No. 4075—FAD binding; Category No. 4076—FAD biosynthetic process; Category No. 4077—FAD transmembrane transport; Category No. 4078—FAD transmembrane transporter activity; Category No. 4079—FAD-AMP lyase (cyclizing) activity; Category No. 4080—FANCM-MHF complex; Category No. 4081—Fanconi anaemia nuclear complex; Category No. 4082—farnesol catabolic process; Category No. 4083—farnesyl diphosphate biosynthetic process; Category No. 4084—farnesyl diphosphate metabolic process; Category No. 4085—farnesylated protein binding; Category No. 4086—farnesyl-diphosphate farnesyltransferase activity; Category No. 4087—farnesyltranstransferase activity; Category No. 4088—Fas-activated serine threonine kinase activity; Category No. 4089—fascia adherens; Category No. 4090—fasciculation of motor neuron axon; Category No. 4091—fasciculation of sensory neuron axon; Category No. 4092—FasL biosynthetic process; Category No. 4093—fast calcium ion-dependent exocytosis of neurotransmitter; Category No. 4094—fat cell differentiation; Category No. 4095—fat pad development; Category No. 4096—FAT10 activating enzyme activity; Category No. 4097—fatty acid alpha-hydroxylase activity; Category No. 4098—fatty acid alpha-oxidation; Category No. 4099—fatty acid amide hydrolase activity; Category No. 4100—fatty acid beta-oxidation; Category No. 4101—fatty acid beta-oxidation using acyl-CoA dehydrogenase; Category No. 4102—fatty acid beta-oxidation using acyl-CoA oxidase; Category No. 4103—fatty acid binding; Category No. 4104—fatty acid biosynthetic process; Category No. 4105—fatty acid catabolic process; Category No. 4106—fatty acid elongase activity; Category No. 4107—fatty acid elongation; Category No. 4108—fatty acid homeostasis; Category No. 4109—fatty acid ligase activity; Category No. 4110—fatty acid metabolic process; Category No. 4111—fatty acid omega-oxidation; Category No. 4112—fatty acid oxidation; Category No. 4113—fatty acid peroxidase activity; Category No. 4114—fatty acid synthase activity; Category No. 4115—fatty acid transport; Category No. 4116—fatty acid transporter activity; Category No. 4117—fatty-acyl-CoA binding; Category No. 4118—fatty-acyl-CoA biosynthetic process; Category No. 4119—fatty-acyl-CoA reductase (alcohol-forming) activity; Category No. 4120—fatty-acyl-CoA synthase activity; Category No. 4121—FATZ binding; Category No. 4122—F-box domain binding; Category No. 4123—Fc receptor mediated inhibitory signaling pathway; Category No. 4124—Fc receptor mediated stimulatory signaling pathway; Category No. 4125—Fc receptor signaling pathway; Category No. 4126—Fc-epsilon receptor I complex; Category No. 4127—Fc-epsilon receptor signaling pathway; Category No. 4128—Fc-gamma receptor I complex binding; Category No. 4129—Fc-gamma receptor signaling pathway; Category No. 4130—Fc-gamma receptor signaling pathway involved in phagocytosis; Category No. 4131—fear response; Category No. 4132—feeding behavior; Category No. 4133—female courtship behavior; Category No. 4134—female gamete generation; Category No. 4135—female genitalia development; Category No. 4136—female genitalia morphogenesis; Category No. 4137—female germ cell nucleus; Category No. 4138—female gonad development; Category No. 4139—female mating behavior; Category No. 4140—female meiosis chromosome segregation; Category No. 4141—female meiosis I; Category No. 4142—female meiosis II; Category No. 4143—female meiosis sister chromatid cohesion; Category No. 4144—female meiotic division; Category No. 4145—female pregnancy; Category No. 4146—female pronucleus; Category No. 4147—female pronucleus assembly; Category No. 4148—female sex determination; Category No. 4149—female somatic sex determination; Category No. 4150—ferredoxin-NADP+ reductase activity; Category No. 4151—ferric iron binding; Category No. 4152—ferric iron import into cell; Category No. 4153—ferric iron transmembrane transporter activity; Category No. 4154—ferric-chelate reductase (NADPH) activity; Category No. 4155—ferric-chelate reductase activity; Category No. 4156—ferritin receptor activity; Category No. 4157—ferrochelatase activity; Category No. 4158—ferrous iron binding; Category No. 4159—ferrous iron export; Category No. 4160—ferrous iron import; Category No. 4161—ferrous iron import into cell; Category No. 4162—ferrous iron transmembrane transport; Category No. 4163—ferrous iron transmembrane transporter activity; Category No. 4164—ferrous iron transport; Category No. 4165—ferrous iron uptake transmembrane transporter activity; Category No. 4166—ferroxidase activity; Category No. 4167—fertilization; Category No. 4168—fetal process involved in parturition; Category No. 4169—fever generation; Category No. 4170—FFAT motif binding; Category No. 4171—FHA domain binding; Category No. 4172—FHF complex; Category No. 4173—fibril; Category No. 4174—fibril organization; Category No. 4175—fibrillar center; Category No. 4176—fibrillar collagen trimer; Category No. 4177—fibrin clot formation; Category No. 4178—fibrinogen binding; Category No. 4179—fibrinogen complex; Category No. 4180—fibrinolysis; Category No. 4181—fibroblast activation; Category No. 4182—fibroblast apoptotic process; Category No. 4183—fibroblast growth factor binding; Category No. 4184—fibroblast growth factor receptor apoptotic signaling pathway; Category No. 4185—fibroblast growth factor receptor binding; Category No. 4186—fibroblast growth factor receptor signaling pathway; Category No. 4187—fibroblast growth factor receptor signaling pathway involved in hemopoiesis; Category No. 4188—fibroblast growth factor receptor signaling pathway involved in mammary gland specification; Category No. 4189—fibroblast growth factor receptor signaling pathway involved in negative regulation of apoptotic process in bone marrow; Category No. 4190—fibroblast growth factor receptor signaling pathway involved in neural plate anterior posterior pattern formation; Category No. 4191—fibroblast growth factor receptor signaling pathway involved in orbitofrontal cortex development; Category No. 4192—fibroblast growth factor receptor signaling pathway involved in positive regulation of cell proliferation in bone marrow; Category No. 4193—fibroblast growth factor-activated receptor activity; Category No. 4194—fibroblast migration; Category No. 4195—fibroblast proliferation; Category No. 4196—fibronectin binding; Category No. 4197—filamentous actin; Category No. 4198—filamin binding; Category No. 4199—filopodium; Category No. 4200—filopodium assembly; Category No. 4201—filopodium membrane; Category No. 4202—filopodium tip; Category No. 4203—first spliceosomal transesterification activity; Category No. 4204—FK506 binding; Category No. 4205—flap endonuclease activity; Category No. 4206—flap-structured DNA binding; Category No. 4207—flavin adenine dinucleotide binding; Category No. 4208—flavin adenine dinucleotide catabolic process; Category No. 4209—flavin-linked sulfhydryl oxidase activity; Category No. 4210—flavone metabolic process; Category No. 4211—flavonoid 3'-monooxygenase activity; Category No. 4212—flavonoid biosynthetic process; Category No. 4213—flavonoid glucuronidation; Category No. 4214—flavonoid metabolic process; Category No. 4215—flavonol 3-sulfotransferase activity; Category No. 4216—Flemming body; Category No. 4217—floor plate development; Category No. 4218—floor plate formation; Category No. 4219—floor plate morphogenesis; Category No. 4220—flotillin complex; Category No. 4221—fluid transport; Category No. 4222—fluorene metabolic process; Category No. 4223—fluorene oxygenase activity; Category No. 4224—FMN adenylyltransferase activity; Category No. 4225—FMN binding; Category No. 4226—FMN biosynthetic process; Category No. 4227—FMN transmembrane transporter activity; Category No. 4228—focal adhesion; Category No. 4229—focal adhesion assembly; Category No. 4230—folic acid binding; Category No. 4231—folic acid catabolic process; Category No. 4232—folic acid import into cell; Category No. 4233—folic acid metabolic process; Category No. 4234—folic acid receptor activity; Category No. 4235—folic acid transport; Category No. 4236—folic acid transporter activity; Category No. 4237—folic acid-containing compound biosynthetic process; Category No. 4238—folic acid-containing compound metabolic process; Category No. 4239—follicle-stimulating hormone activity; Category No. 4240—follicle-stimulating hormone receptor activity; Category No. 4241—follicle-stimulating hormone receptor binding; Category No. 4242—follicle-stimulating hormone secretion; Category No. 4243—follicle-stimulating hormone signaling pathway; Category No. 4244—follicular B cell differentiation; Category No. 4245—follicular dendritic cell differentiation; Category No. 4246—for other substituted phosphate groups; Category No. 4247—foramen ovale closure; Category No. 4248—forebrain anterior posterior pattern specification; Category No. 4249—forebrain astrocyte development; Category No. 4250—forebrain cell migration; Category No. 4251—forebrain development; Category No. 4252—forebrain dorsal ventral pattern formation; Category No. 4253—forebrain generation of neurons; Category No. 4254—forebrain morphogenesis; Category No. 4255—forebrain neuroblast division; Category No. 4256—forebrain neuron development; Category No. 4257—forebrain neuron differentiation; Category No. 4258—forebrain neuron fate commitment; Category No. 4259—forebrain radial glial cell differentiation; Category No. 4260—forebrain regionalization; Category No. 4261—forebrain ventricular zone progenitor cell division; Category No. 4262—forebrain-midbrain boundary formation; Category No. 4263—foregut morphogenesis; Category No. 4264—forelimb morphogenesis; Category No. 4265—formaldehyde biosynthetic process; Category No. 4266—formaldehyde catabolic process; Category No. 4267—formaldehyde dehydrogenase activity; Category No. 4268—formaldehyde metabolic process; Category No. 4269—formate efflux transmembrane transporter activity; Category No. 4270—formate metabolic process; Category No. 4271—formate transmembrane transporter activity; Category No. 4272—formate transport; Category No. 4273—formate uptake transmembrane transporter activity; Category No. 4274—formate-tetrahydrofolate ligase activity; Category No. 4275—formation of anatomical boundary; Category No. 4276—formation of cytoplasmic translation initiation complex; Category No. 4277—formation of primary germ layer; Category No. 4278—formation of radial glial scaffolds; Category No. 4279—formation of translation preinitiation complex; Category No. 4280—formimidoyltetrahydrofolate cyclodeaminase activity; Category No. 4281—formimidoyltransferase activity; Category No. 4282—forming aminoacyl-tRNA and related compounds; Category No. 4283—formin-nucleated actin cable assembly; Category No. 4284—formyl- and related transferase activity; Category No. 4285—formyltetrahydrofolate dehydrogenase activity; Category No. 4286—forward locomotion; Category No. 4287—fourth ventricle development; Category No. 4288—four-way junction DNA binding; Category No. 4289—four-way junction helicase activity; Category No. 4290—free ubiquitin chain polymerization; Category No. 4291—frizzled binding; Category No. 4292—frizzled-2 binding; Category No. 4293—Frizzled-LRP5 6 complex; Category No. 4294—frontal suture morphogenesis; Category No. 4295—fructokinase activity; Category No. 4296—fructosamine metabolic process; Category No. 4297—fructosamine-3-kinase activity; Category No. 4298—fructose 1,6-bisphosphate 1-phosphatase activity; Category No. 4299—fructose 1,6-bisphosphate metabolic process; Category No. 4300—fructose 2,6-bisphosphate metabolic process; Category No. 4301—fructose 6-phosphate metabolic process; Category No. 4302—fructose binding; Category No. 4303—fructose biosynthetic process; Category No. 4304—fructose catabolic process to hydroxyacetone phosphate and glyceraldehyde-3-phosphate; Category No. 4305—fructose metabolic process; Category No. 4306—fructose transmembrane transporter activity; Category No. 4307—fructose transport; Category No. 4308—fructose-1-phosphate aldolase activity; Category No. 4309—fructose-2,6-bisphosphate 2-phosphatase activity; Category No. 4310—fructose-6-phosphate binding; Category No. 4311—fructose-bisphosphate aldolase activity; Category No. 4312—fructoselysine metabolic process; Category No. 4313—fucokinase activity; Category No. 4314—fucose binding; Category No. 4315—fucose metabolic process; Category No. 4316—fucose-1-phosphate guanylyltransferase activity; Category No. 4317—fucosidase activity; Category No. 4318—fucosylation; Category No. 4319—fucosylgalactoside 3-alpha-galactosyltransferase activity; Category No. 4320—fucosyltransferase activity; Category No. 4321—fumarate hydratase activity; Category No. 4322—fumarate metabolic process; Category No. 4323—fumarylacetoacetase activity; Category No. 4324—fumarylpyruvate hydrolase activity; Category No. 4325—fungiform papilla development; Category No. 4326—fungiform papilla formation; Category No. 4327—fungiform papilla morphogenesis; Category No. 4328—fusion of sperm to egg plasma membrane; Category No. 4329—fusion of virus membrane with host plasma membrane; Category No. 4330—G0 to G1 transition; Category No. 4331—G1 DNA damage checkpoint; Category No. 4332—G1 S transition of mitotic cell cycle; Category No. 4333—G1 to G0 transition; Category No. 4334—G1 to G0 transition involved in cell differentiation; Category No. 4335—G2 DNA damage checkpoint; Category No. 4336—G2 M transition of mitotic cell cycle; Category No. 4337—GABA receptor activity; Category No. 4338—GABA receptor binding; Category No. 4339—GABA receptor complex; Category No. 4340—GABA-A receptor activity; Category No. 4341—GABA-A receptor complex; Category No. 4342—GABAergic; Category No. 4343—GABAergic neuron differentiation; Category No. 4344—GABAergic neuron differentiation in basal ganglia; Category No. 4345—GABA-gated chloride ion channel activity; Category No. 4346—GAF domain binding; Category No. 4347—GAIT complex; Category No. 4348—galactitol metabolic process; Category No. 4349—galactokinase activity; Category No. 4350—galactose 3-O-sulfotransferase activity; Category No. 4351—galactose binding; Category No. 4352—galactose catabolic process; Category No. 4353—galactose metabolic process; Category No. 4354—galactoside 2-alpha-L-fucosyltransferase activity; Category No. 4355—galactoside binding; Category No. 4356—galactosylceramidase activity; Category No. 4357—galactosylceramide biosynthetic process; Category No. 4358—galactosylceramide catabolic process; Category No. 4359—galactosylceramide metabolic process; Category No. 4360—galactosylceramide sulfotransferase activity; Category No. 4361—galactosylgalactosylglucosylceramide beta-D-acetylgalactosaminyltransferase activity; Category No. 4362—galactosylgalactosylxylosylprotein 3-beta-glucuronosyltransferase activity; Category No. 4363—galactosyltransferase activity; Category No. 4364—galactosylxylosylprotein 3-beta-galactosyltransferase activity; Category No. 4365—galanin receptor activity; Category No. 4366—gall bladder development; Category No. 4367—gamete generation; Category No. 4368—gamma DNA polymerase complex; Category No. 4369—gamma-aminobutyric acid biosynthetic process; Category No. 4370—gamma-aminobutyric acid catabolic process; Category No. 4371—gamma-aminobutyric acid import; Category No. 4372—gamma-aminobutyric acid metabolic process; Category No. 4373—gamma-aminobutyric acid receptor clustering; Category No. 4374—gamma-aminobutyric acid secretion; Category No. 4375—gamma-aminobutyric acid signaling pathway; Category No. 4376—gamma-aminobutyric acid transport; Category No. 4377—gamma-aminobutyric acid:proton symporter activity; Category No. 4378—gamma-aminobutyric acid:sodium symporter activity; Category No. 4379—gamma-butyrobetaine dioxygenase activity; Category No. 4380—gamma-catenin binding; Category No. 4381—gamma-catenin-TCF7L2 complex; Category No. 4382—gamma-delta T cell activation; Category No. 4383—gamma-delta T cell differentiation; Category No. 4384—gamma-glutamyl carboxylase activity; Category No. 4385—gamma-glutamylcyclotransferase activity; Category No. 4386—gamma-glutamyl-peptidase activity; Category No. 4387—gamma-glutamyltransferase activity; Category No. 4388—gamma-secretase complex; Category No. 4389—gamma-tubulin binding; Category No. 4390—gamma-tubulin complex; Category No. 4391—gamma-tubulin complex localization; Category No. 4392—gamma-tubulin ring complex; Category No. 4393—gamma-tubulin small complex; Category No. 4394—ganglion development; Category No. 4395—ganglion morphogenesis; Category No. 4396—ganglion mother cell fate determination; Category No. 4397—ganglioside binding; Category No. 4398—ganglioside biosynthetic process; Category No. 4399—ganglioside catabolic process; Category No. 4400—ganglioside galactosyltransferase activity; Category No. 4401—ganglioside metabolic process; Category No. 4402—gap junction; Category No. 4403—gap junction assembly; Category No. 4404—gap junction channel activity; Category No. 4405—gap junction channel activity involved in AV node cell-bundle of His cell electrical coupling; Category No. 4406—gap junction channel activity involved in cardiac conduction electrical coupling; Category No. 4407—gap junction channel activity involved in cell communication by electrical coupling; Category No. 4408—gap junction hemi-channel activity; Category No. 4409—gap-filling; Category No. 4410—GARP complex; Category No. 4411—gastric acid secretion; Category No. 4412—gastric emptying; Category No. 4413—gastric inhibitory peptide receptor activity; Category No. 4414—gastric inhibitory peptide signaling pathway; Category No. 4415—gastric motility; Category No. 4416—gastrin receptor activity; Category No. 4417—gastrin-induced gastric acid secretion; Category No. 4418—gastrulation; Category No. 4419—gastrulation with mouth forming second; Category No. 4420—GATOR2 complex; Category No. 4421—GBD domain binding; Category No. 4422—GDP binding; Category No. 4423—GDP biosynthetic process; Category No. 4424—GDP catabolic process; Category No. 4425—GDP metabolic process; Category No. 4426—GDP phosphorylation; Category No. 4427—GDP-4-dehydro-D-rhamnose reductase activity; Category No. 4428—GDP-D-glucose phosphorylase activity; Category No. 4429—GDP-dissociation inhibitor activity; Category No. 4430—GDP-L-fucose metabolic process; Category No. 4431—GDP-L-fucose synthase activity; Category No. 4432—GDP-Man:Man1 GlcNAc2-PP-Dol alpha-1,3-mannosyltransferase activity; Category No. 4433—GDP-Man:Man3GlcNAc2-PP-Dol alpha-1,2-mannosyltransferase activity; Category No. 4434—GDP-mannose 4,6-dehydratase activity; Category No. 4435—GDP-mannose biosynthetic process; Category No. 4436—GDP-mannose metabolic process; Category No. 4437—GDP-mannose transmembrane transport; Category No. 4438—Gemini of coiled bodies; Category No. 4439—gene expression; Category No. 4440—gene silencing; Category No. 4441—gene silencing by miRNA; Category No. 4442—gene silencing by RNA; Category No. 4443—general adaptation syndrome; Category No. 4444—generation of catalytic spliceosome for first transesterification step; Category No. 4445—generation of catalytic spliceosome for second transesterification step; Category No. 4446—generation of neurons; Category No. 4447—generation of ovulation cycle rhythm; Category No. 4448—generation of precursor metabolites and energy; Category No. 4449—genetic imprinting; Category No. 4450—genitalia development; Category No. 4451—genitalia morphogenesis; Category No. 4452—gentamycin metabolic process; Category No. 4453—gephyrin clustering involved in postsynaptic density assembly; Category No. 4454—geranyl diphosphate biosynthetic process; Category No. 4455—geranylgeranyl diphosphate biosynthetic process; Category No. 4456—geranylgeranyl reductase activity; Category No. 4457—geranyltranstransferase activity; Category No. 4458—germ cell development; Category No. 4459—germ cell migration; Category No. 4460—germinal center B cell differentiation; Category No. 4461—germinal center formation; Category No. 4462—germinal vesicle; Category No. 4463—germline cell cycle switching; Category No. 4464—germ-line stem cell population maintenance; Category No. 4465—ghrelin receptor binding; Category No. 4466—GINS complex; Category No. 4467—GKAP Homer scaffold activity; Category No. 4468—gland development; Category No. 4469—gland morphogenesis; Category No. 4470—glandular epithelial cell development; Category No. 4471—glandular epithelial cell differentiation; Category No. 4472—glandular epithelial cell maturation; Category No. 4473—glial cell apoptotic process; Category No. 4474—glial cell development; Category No. 4475—glial cell differentiation; Category No. 4476—glial cell fate commitment; Category No. 4477—glial cell fate determination; Category No. 4478—glial cell migration; Category No. 4479—glial cell projection; Category No. 4480—glial cell proliferation; Category No. 4481—glial cell-derived neurotrophic factor receptor activity; Category No. 4482—glial cell-derived neurotrophic factor receptor signaling pathway; Category No. 4483—glial limiting end-foot; Category No. 4484—gliogenesis; Category No. 4485—global genome nucleotide-excision repair; Category No. 4486—globoside alpha-N-acetylgalactosaminyltransferase activity; Category No. 4487—globoside biosynthetic process; Category No. 4488—globoside metabolic process; Category No. 4489—globus pallidus development; Category No. 4490—glomerular basement membrane development; Category No. 4491—glomerular capillary formation; Category No. 4492—glomerular endothelium development; Category No. 4493—glomerular endothelium fenestra; Category No. 4494—glomerular filtration; Category No. 4495—glomerular mesangial cell development; Category No. 4496—glomerular mesangial cell proliferation; Category No. 4497—glomerular parietal epithelial cell development; Category No. 4498—glomerular parietal epithelial cell differentiation; Category No. 4499—glomerular visceral epithelial cell development; Category No. 4500—glomerular visceral epithelial cell differentiation; Category No. 4501—glomerular visceral epithelial cell migration; Category No. 4502—glomerulus development; Category No. 4503—glomerulus morphogenesis; Category No. 4504—glomerulus vasculature development; Category No. 4505—glossopharyngeal nerve development; Category No. 4506—glossopharyngeal nerve morphogenesis; Category No. 4507—glucagon receptor activity; Category No. 4508—glucagon receptor binding; Category No. 4509—glucagon secretion; Category No. 4510—glucan 1,3-alpha-glucosidase activity; Category No. 4511—glucan 1,4-alpha-glucosidase activity; Category No. 4512—glucocorticoid biosynthetic process; Category No. 4513—glucocorticoid catabolic process; Category No. 4514—glucocorticoid mediated signaling pathway; Category No. 4515—glucocorticoid metabolic process; Category No. 4516—glucocorticoid receptor activity; Category No. 4517—glucocorticoid receptor binding; Category No. 4518—glucocorticoid receptor signaling pathway; Category No. 4519—glucocorticoid-activated RNA polymerase II transcription factor binding transcription factor activity; Category No. 4520—glucokinase activity; Category No. 4521—gluconeogenesis; Category No. 4522—gluconokinase activity; Category No. 4523—gluconolactonase activity; Category No. 4524—glucosamine 6-phosphate N-acetyltransferase activity; Category No. 4525—glucosamine biosynthetic process; Category No. 4526—glucosamine catabolic process; Category No. 4527—glucosamine metabolic process; Category No. 4528—glucosamine-6-phosphate deaminase activity; Category No. 4529—glucose 1-dehydrogenase [NAD(P)] activity; Category No. 4530—glucose 1-phosphate metabolic process; Category No. 4531—glucose 6-phosphate metabolic process; Category No. 4532—glucose binding; Category No. 4533—glucose catabolic process; Category No. 4534—glucose catabolic process to lactate via pyruvate; Category No. 4535—glucose homeostasis; Category No. 4536—glucose import; Category No. 4537—glucose mediated signaling pathway; Category No. 4538—glucose metabolic process; Category No. 4539—glucose transmembrane transport; Category No. 4540—glucose transmembrane transporter activity; Category No. 4541—glucose transport; Category No. 4542—glucose:sodium symporter activity; Category No. 4543—glucose-1,6-bisphosphate synthase activity; Category No. 4544—glucose-6-phosphatase activity; Category No. 4545—glucose-6-phosphate dehydrogenase activity; Category No. 4546—glucose-6-phosphate isomerase activity; Category No. 4547—glucose-6-phosphate transmembrane transporter activity; Category No. 4548—glucose-6-phosphate transport; Category No. 4549—glucosidase activity; Category No. 4550—glucosidase II complex; Category No. 4551—glucoside transmembrane transporter activity; Category No. 4552—glucoside transport; Category No. 4553—glucosylceramidase activity; Category No. 4554—glucosylceramide biosynthetic process; Category No. 4555—glucosylceramide catabolic process; Category No. 4556—glucosylceramide metabolic process; Category No. 4557—glucosyltransferase activity; Category No. 4558—glucuronate catabolic process to xylulose 5-phosphate; Category No. 4559—glucuronoside catabolic process; Category No. 4560—glucuronosyl-N-acetylgalactosaminyl-proteoglycan 4-beta-N-acetylgalactosaminyltransferase activity; Category No. 4561—glucuronosyl-N-acetylglucosaminyl-proteoglycan 4-alpha-N-acetylglucosaminyltransferase activity; Category No. 4562—glucuronosyltransferase activity; Category No. 4563—glucuronyl-galactosyl-proteoglycan 4-alpha-N-acetylglucosaminyltransferase activity; Category No. 4564—glucuronylgalactosylproteoglycan 4-beta-N-acetylgalactosaminyltransferase activity; Category No. 4565—glutamate 5-kinase activity; Category No. 4566—glutamate binding; Category No. 4567—glutamate biosynthetic process; Category No. 4568—glutamate catabolic process; Category No. 4569—glutamate catabolic process to 2-oxoglutarate; Category No. 4570—glutamate catabolic process to aspartate; Category No. 4571—glutamate decarboxylase activity; Category No. 4572—glutamate decarboxylation to succinate; Category No. 4573—glutamate dehydrogenase (NAD+) activity; Category No. 4574—glutamate dehydrogenase [NAD(P)+] activity; Category No. 4575—glutamate formimidoyltransferase activity; Category No. 4576—glutamate metabolic process; Category No. 4577—glutamate receptor activity; Category No. 4578—glutamate receptor binding; Category No. 4579—glutamate receptor signaling pathway; Category No. 4580—glutamate reuptake; Category No. 4581—glutamate secretion; Category No. 4582—glutamate:sodium symporter activity; Category No. 4583—glutamate-5-semialdehyde dehydrogenase activity; Category No. 4584—glutamate-ammonia ligase activity; Category No. 4585—glutamate-cysteine ligase activity; Category No. 4586—glutamate-cysteine ligase catalytic subunit binding; Category No. 4587—glutamate-cysteine ligase complex; Category No. 4588—glutamatergic; Category No. 4589—glutamate-tRNA ligase activity; Category No. 4590—glutamate-tRNA(Gln) ligase activity; Category No. 4591—glutamic-type peptidase activity; Category No. 4592—glutaminase activity; Category No. 4593—glutamine biosynthetic process; Category No. 4594—glutamine catabolic process; Category No. 4595—glutamine metabolic process; Category No. 4596—glutamine N-acyltransferase activity; Category No. 4597—glutamine transport; Category No. 4598—glutamine-fructose-6-phosphate transaminase (isomerizing) activity; Category No. 4599—glutamine-phenylpyruvate transaminase activity; Category No. 4600—glutamine-tRNA ligase activity; Category No. 4601—glutaminyl-peptide cyclotransferase activity; Category No. 4602—glutaminyl-tRNA aminoacylation; Category No. 4603—glutaminyl-tRNA synthase (glutamine-hydrolyzing) activity; Category No. 4604—glutaminyl-tRNAGln biosynthesis via transamidation; Category No. 4605—glutamyl-tRNA aminoacylation; Category No. 4606—glutamyl-tRNA (Gln) amidotransferase complex; Category No. 4607—glutaryl-CoA dehydrogenase activity; Category No. 4608—glutathione binding; Category No. 4609—glutathione biosynthetic process; Category No. 4610—glutathione catabolic process; Category No. 4611—glutathione dehydrogenase (ascorbate) activity; Category No. 4612—glutathione derivative biosynthetic process; Category No. 4613—glutathione disulfide oxidoreductase activity; Category No. 4614—glutathione hydrolase activity; Category No. 4615—glutathione metabolic process; Category No. 4616—glutathione oxidoreductase activity; Category No. 4617—glutathione peroxidase activity; Category No. 4618—glutathione synthase activity; Category No. 4619—glutathione transferase activity; Category No. 4620—glutathione transport; Category No. 4621—glutathione-disulfide reductase activity; Category No. 4622—glyceraldehyde oxidoreductase activity; Category No. 4623—glyceraldehyde-3-phosphate biosynthetic process; Category No. 4624—glyceraldehyde-3-phosphate dehydrogenase (NAD+) (phosphorylating) activity; Category No. 4625—glyceraldehyde-3-phosphate metabolic process; Category No. 4626—glycerate dehydrogenase activity; Category No. 4627—glycerate kinase activity; Category No. 4628—glycerol biosynthetic process; Category No. 4629—glycerol biosynthetic process from pyruvate; Category No. 4630—glycerol catabolic process; Category No. 4631—glycerol channel activity; Category No. 4632—glycerol ether metabolic process; Category No. 4633—glycerol kinase activity; Category No. 4634—glycerol metabolic process; Category No. 4635—glycerol transmembrane transporter activity; Category No. 4636—glycerol transport; Category No. 4637—glycerol-3-phosphate biosynthetic process; Category No. 4638—glycerol-3-phosphate catabolic process; Category No. 4639—glycerol-3-phosphate dehydrogenase [NAD+] activity; Category No. 4640—glycerol-3-phosphate dehydrogenase activity; Category No. 4641—glycerol-3-phosphate dehydrogenase complex; Category No. 4642—glycerol-3-phosphate metabolic process; Category No. 4643—glycerol-3-phosphate O-acyltransferase activity; Category No. 4644—glycerolipid metabolic process; Category No. 4645—glycerone kinase activity; Category No. 4646—glycerone-phosphate O-acyltransferase activity; Category No. 4647—glycerophosphate shuttle; Category No. 4648—glycerophosphocholine cholinephosphodiesterase activity; Category No. 4649—glycerophosphocholine phosphodiesterase activity; Category No. 4650—glycerophosphodiester phosphodiesterase activity; Category No. 4651—glycerophosphoinositol glycerophosphodiesterase activity; Category No. 4652—glycerophosphoinositol inositolphosphodiesterase activity; Category No. 4653—glycerophospholipid biosynthetic process; Category No. 4654—glycerophospholipid catabolic process; Category No. 4655—glycerophospholipid metabolic process; Category No. 4656—glyceryl-ether monooxygenase activity; Category No. 4657—glycine amidinotransferase activity; Category No. 4658—glycine betaine biosynthetic process from choline; Category No. 4659—glycine betaine transport; Category No. 4660—glycine binding; Category No. 4661—glycine biosynthetic process; Category No. 4662—glycine biosynthetic process from serine; Category No. 4663—glycine C-acetyltransferase activity; Category No. 4664—glycine catabolic process; Category No. 4665—glycine cleavage complex; Category No. 4666—glycine decarboxylation via glycine cleavage system; Category No. 4667—glycine dehydrogenase (decarboxylating) activity; Category No. 4668—glycine hydroxymethyltransferase activity; Category No. 4669—glycine import; Category No. 4670—glycine metabolic process; Category No. 4671—glycine N-acyltransferase activity; Category No. 4672—glycine N-benzoyltransferase activity; Category No. 4673—glycine N-choloyltransferase activity; Category No. 4674—glycine N-methyltransferase activity; Category No. 4675—glycine receptor clustering; Category No. 4676—glycine secretion; Category No. 4677—glycine transmembrane transporter activity; Category No. 4678—glycine transport; Category No. 4679—glycine:sodium symporter activity; Category No. 4680—glycinergic; Category No. 4681—glycine-tRNA ligase activity; Category No. 4682—glycocalyx; Category No. 4683—glycogen (starch) synthase activity; Category No. 4684—glycogen binding; Category No. 4685—glycogen biosynthetic process; Category No. 4686—glycogen catabolic process; Category No. 4687—glycogen cell differentiation involved in embryonic placenta development; Category No. 4688—glycogen debranching enzyme activity; Category No. 4689—glycogen granule; Category No. 4690—glycogen metabolic process; Category No. 4691—glycogen phosphorylase activity; Category No. 4692—glycogen synthase activity; Category No. 4693—glycogenin glucosyltransferase activity; Category No. 4694—glycolate biosynthetic process; Category No. 4695—glycolate catabolic process; Category No. 4696—glycolate metabolic process; Category No. 4697—glycolate oxidase activity; Category No. 4698—glycolipid binding; Category No. 4699—glycolipid biosynthetic process; Category No. 4700—glycolipid catabolic process; Category No. 4701—glycolipid metabolic process; Category No. 4702—glycolipid translocation; Category No. 4703—glycolipid transport; Category No. 4704—glycolipid transporter activity; Category No. 4705—glycolysis from storage polysaccharide through glucose-1-phosphate; Category No. 4706—glycolytic process; Category No. 4707—glycolytic process through fructose-6-phosphate; Category No. 4708—glycophagy; Category No. 4709—glycoprotein 6-alpha-L-fucosyltransferase activity; Category No. 4710—glycoprotein binding; Category No. 4711—glycoprotein biosynthetic process; Category No. 4712—glycoprotein catabolic process; Category No. 4713—glycoprotein endo-alpha-1,2-mannosidase activity; Category No. 4714—glycoprotein ERAD pathway; Category No. 4715—glycoprotein metabolic process; Category No. 4716—glycoprotein transport; Category No. 4717—glycoprotein transporter activity; Category No. 4718—glycoprotein-fucosylgalactoside alpha-N-acetylgalactosaminyltransferase activity; Category No. 4719—glycoprotein-N-acetylgalactosamine 3-beta-galactosyltransferase activity; Category No. 4720—glycosaminoglycan binding; Category No. 4721—glycosaminoglycan biosynthetic process; Category No. 4722—glycosaminoglycan catabolic process; Category No. 4723—glycosaminoglycan metabolic process; Category No. 4724—glycoside catabolic process; Category No. 4725—glycoside metabolic process; Category No. 4726—glycosphingolipid binding; Category No. 4727—glycosphingolipid biosynthetic process; Category No. 4728—glycosphingolipid catabolic process; Category No. 4729—glycosphingolipid metabolic process; Category No. 4730—glycosylation; Category No. 4731—glycosylceramidase activity; Category No. 4732—glycosylceramide catabolic process; Category No. 4733—glycosylceramide metabolic process; Category No. 4734—glycosylphosphatidylinositol phospholipase D activity; Category No. 4735—glycosylphosphatidylinositol-N-acetylglucosaminyltransferase (GPI-GnT) complex; Category No. 4736—glycylpeptide N-tetradecanoyltransferase activity; Category No. 4737—glycyl-tRNA aminoacylation; Category No. 4738—glyoxal catabolic process; Category No. 4739—glyoxalase (glycolic acid-forming) activity; Category No. 4740—glyoxalase III activity; Category No. 4741—glyoxylate catabolic process; Category No. 4742—glyoxylate cycle; Category No. 4743—glyoxylate metabolic process; Category No. 4744—glyoxylate oxidase activity; Category No. 4745—glyoxylate reductase (NADP) activity; Category No. 4746—GMP binding; Category No. 4747—GMP biosynthetic process; Category No. 4748—GMP catabolic process; Category No. 4749—GMP metabolic process; Category No. 4750—GMP reductase activity; Category No. 4751—GMP reductase complex; Category No. 4752—GMP salvage; Category No. 4753—GMP synthase (glutamine-hydrolyzing) activity; Category No. 4754—GMP synthase activity; Category No. 4755—Golgi apparatus; Category No. 4756—Golgi calcium ion homeostasis; Category No. 4757—Golgi calcium ion transport; Category No. 4758—Golgi cis cisterna; Category No. 4759—Golgi cisterna; Category No. 4760—Golgi cisterna membrane; Category No. 4761—Golgi disassembly; Category No. 4762—Golgi localization; Category No. 4763—Golgi lumen; Category No. 4764—Golgi medial cisterna; Category No. 4765—Golgi membrane; Category No. 4766—Golgi organization; Category No. 4767—Golgi reassembly; Category No. 4768—Golgi ribbon formation; Category No. 4769—Golgi stack; Category No. 4770—Golgi to endosome transport; Category No. 4771—Golgi to ER; Category No. 4772—Golgi to lysosome transport; Category No. 4773—Golgi to plasma membrane CFTR protein transport; Category No. 4774—Golgi to plasma membrane protein transport; Category No. 4775—Golgi to plasma membrane transport; Category No. 4776—Golgi to secretory granule transport; Category No. 4777—Golgi to transport vesicle transport; Category No. 4778—Golgi to vacuole transport; Category No. 4779—Golgi trans cisterna; Category No. 4780—Golgi transport complex; Category No. 4781—Golgi vesicle budding; Category No. 4782—Golgi vesicle docking; Category No. 4783—Golgi vesicle fusion to target membrane; Category No. 4784—Golgi vesicle prefusion complex stabilization; Category No. 4785—Golgi vesicle transport; Category No. 4786—Golgi-associated vesicle; Category No. 4787—Golgi-associated vesicle lumen; Category No. 4788—Golgi-associated vesicle membrane; Category No. 4789—gonad development; Category No. 4790—gonad morphogenesis; Category No. 4791—gonadal mesoderm development; Category No. 4792—gonadotrophin-releasing hormone neuronal migration to the hypothalamus; Category No. 4793—gonadotropin hormone-releasing hormone activity; Category No. 4794—gonadotropin-releasing hormone receptor activity; Category No. 4795—gonadotropin-releasing hormone receptor binding; Category No. 4796—GPI anchor binding; Category No. 4797—GPI anchor biosynthetic process; Category No. 4798—GPI anchor metabolic process; Category No. 4799—GPI anchor release; Category No. 4800—GPI-anchor transamidase activity; Category No. 4801—GPI-anchor transamidase complex; Category No. 4802—GPI-linked ephrin receptor activity; Category No. 4803—G-protein activated inward rectifier potassium channel activity; Category No. 4804—G-protein alpha-subunit binding; Category No. 4805—G-protein beta gamma-subunit complex binding; Category No. 4806—G-protein beta-subunit binding; Category No. 4807—G-protein coupled acetylcholine receptor activity; Category No. 4808—G-protein coupled acetylcholine receptor signaling pathway; Category No. 4809—G-protein coupled adenosine receptor activity; Category No. 4810—G-protein coupled amine receptor activity; Category No. 4811—G-protein coupled bile acid receptor activity; Category No. 4812—G-protein coupled GABA receptor activity; Category No. 4813—G-protein coupled glutamate receptor binding; Category No. 4814—G-protein coupled glutamate receptor signaling pathway; Category No. 4815—G-protein coupled neurotensin receptor activity; Category No. 4816—G-protein coupled peptide receptor activity; Category No. 4817—G-protein coupled photoreceptor activity; Category No. 4818—G-protein coupled purinergic nucleotide receptor activity; Category No. 4819—G-protein coupled purinergic nucleotide receptor signaling pathway; Category No. 4820—G-protein coupled receptor activity; Category No. 4821—G-protein coupled receptor binding; Category No. 4822—G-protein coupled receptor catabolic process; Category No. 4823—G-protein coupled receptor dimeric complex; Category No. 4824—G-protein coupled receptor heterodimeric complex; Category No. 4825—G-protein coupled receptor homodimeric complex; Category No. 4826—G-protein coupled receptor internalization; Category No. 4827—G-protein coupled receptor kinase activity; Category No. 4828—G-protein coupled receptor signaling pathway; Category No. 4829—G-protein coupled receptor signaling pathway coupled to cGMP nucleotide second messenger; Category No. 4830—G-protein coupled receptor signaling pathway involved in heart process; Category No. 4831—G-protein coupled serotonin receptor binding; Category No. 4832—G-protein gamma-subunit binding; Category No. 4833—Gq 11-coupled serotonin receptor activity; Category No. 4834—G-quadruplex DNA binding; Category No. 4835—G-quadruplex DNA unwinding; Category No. 4836—G- quadruplex RNA binding; Category No. 4837—granular component; Category No. 4838—granular vesicle; Category No. 4839—granulocyte chemotaxis; Category No. 4840—granulocyte colony-stimulating factor binding; Category No. 4841—granulocyte colony-stimulating factor receptor activity; Category No. 4842—granulocyte colony-stimulating factor receptor binding; Category No. 4843—granulocyte colony-stimulating factor signaling pathway; Category No. 4844—granulocyte differentiation; Category No. 4845—granulocyte macrophage colony-stimulating factor biosynthetic process; Category No. 4846—granulocyte macrophage colony-stimulating factor receptor binding; Category No. 4847—granulocyte macrophage colony-stimulating factor receptor complex; Category No. 4848—granuloma formation; Category No. 4849—granulosa cell development; Category No. 4850—granulosa cell differentiation; Category No. 4851—granzyme-mediated apoptotic signaling pathway; Category No. 4852—Grb2-EGFR complex; Category No. 4853—Grb2-Sos complex; Category No. 4854—G-rich strand telomeric DNA binding; Category No. 4855—grooming behavior; Category No. 4856—group II metabotropic glutamate receptor activity; Category No. 4857—group III metabotropic glutamate receptor activity; Category No. 4858—growing cell tip; Category No. 4859—growth; Category No. 4860—growth cone; Category No. 4861—growth cone filopodium; Category No. 4862—growth cone lamellipodium; Category No. 4863—growth cone membrane; Category No. 4864—growth factor activity; Category No. 4865—growth factor binding; Category No. 4866—growth factor dependent regulation of skeletal muscle satellite cell proliferation; Category No. 4867—growth factor receptor binding; Category No. 4868—growth hormone receptor activity; Category No. 4869—growth hormone receptor binding; Category No. 4870—growth hormone receptor complex; Category No. 4871—growth hormone receptor signaling pathway; Category No. 4872—growth hormone secretagogue receptor activity; Category No. 4873—growth hormone secretion; Category No. 4874—growth hormone-releasing hormone activity; Category No. 4875—growth hormone-releasing hormone receptor activity; Category No. 4876—growth hormone-releasing hormone receptor binding; Category No. 4877—growth involved in heart morphogenesis; Category No. 4878—growth of symbiont in host; Category No. 4879—growth plate cartilage axis specification; Category No. 4880—growth plate cartilage chondrocyte development; Category No. 4881—growth plate cartilage chondrocyte differentiation; Category No. 4882—growth plate cartilage chondrocyte growth; Category No. 4883—growth plate cartilage chondrocyte morphogenesis; Category No. 4884—growth plate cartilage chondrocyte proliferation; Category No. 4885—growth plate cartilage development; Category No. 4886—GTP binding; Category No. 4887—GTP biosynthetic process; Category No. 4888—GTP cyclohydrolase binding; Category No. 4889—GTP cyclohydrolase I activity; Category No. 4890—GTP diphosphatase activity; Category No. 4891—GTP diphosphokinase activity; Category No. 4892—GTP metabolic process; Category No. 4893—GTPase activating protein binding; Category No. 4894—GTPase activator activity; Category No. 4895—GTPase activity; Category No. 4896—GTPase binding; Category No. 4897—GTPase inhibitor activity; Category No. 4898—GTPase regulator activity; Category No. 4899—GTP-dependent protein binding; Category No. 4900—GTP-dependent protein kinase activity; Category No. 4901—GTP-Rho binding; Category No. 4902—Gtr1-Gtr2 GTPase complex; Category No. 4903—guanidinoacetate N-methyltransferase activity; Category No. 4904—guanine catabolic process; Category No. 4905—guanine deaminase activity; Category No. 4906—guanine metabolic process; Category No. 4907—guanine phosphoribosyltransferase activity; Category No. 4908—guanine salvage; Category No. 4909—guanine thymine mispair binding; Category No. 4910—guanosine metabolic process; Category No. 4911—guanosine tetraphosphate metabolic process; Category No. 4912—guanosine-3',5'-bis(diphosphate) 3'-diphosphatase activity; Category No. 4913—guanosine-5'-triphosphate,3'-diphosphate diphosphatase activity; Category No. 4914—guanosine-diphosphatase activity; Category No. 4915—guanyl nucleotide binding; Category No. 4916—guanyl ribonucleotide binding; Category No. 4917—guanylate cyclase activator activity; Category No. 4918—guanylate cyclase activity; Category No. 4919—guanylate cyclase complex; Category No. 4920—guanylate cyclase inhibitor activity; Category No. 4921—guanylate cyclase regulator activity; Category No. 4922—guanylate kinase activity; Category No. 4923—guanylate kinase-associated protein clustering; Category No. 4924—guanyl-nucleotide exchange factor activity; Category No. 4925—guanyl-nucleotide exchange factor complex; Category No. 4926—H zone; Category No. 4927—H3 histone acetyltransferase activity; Category No. 4928—H3K27me3 modified histone binding; Category No. 4929—H4 H2A histone acetyltransferase complex; Category No. 4930—H4 histone acetyltransferase activity; Category No. 4931—habenula development; Category No. 4932—habituation; Category No. 4933—hair cell differentiation; Category No. 4934—hair cycle; Category No. 4935—hair cycle process; Category No. 4936—hair follicle cell proliferation; Category No. 4937—hair follicle development; Category No. 4938—hair follicle maturation; Category No. 4939—hair follicle morphogenesis; Category No. 4940—hair follicle placode formation; Category No. 4941—haptoglobin binding; Category No. 4942—haptoglobin-hemoglobin complex; Category No. 4943—hard palate development; Category No. 4944—Harderian gland development; Category No. 4945—HAUS complex; Category No. 4946—head development; Category No. 4947—head morphogenesis; Category No. 4948—heart contraction; Category No. 4949—heart development; Category No. 4950—heart formation; Category No. 4951—heart growth; Category No. 4952—heart looping; Category No. 4953—heart morphogenesis; Category No. 4954—heart trabecula formation; Category No. 4955—heart trabecula morphogenesis; Category No. 4956—heart valve development; Category No. 4957—heart valve formation; Category No. 4958—heart valve morphogenesis; Category No. 4959—heat acclimation; Category No. 4960—heat generation; Category No. 4961—heat shock protein binding; Category No. 4962—HECT domain binding; Category No. 4963—hedgehog family protein binding; Category No. 4964—hedgehog receptor activity; Category No. 4965—helicase activity; Category No. 4966—helper T cell enhancement of adaptive immune response; Category No. 4967—helper T cell extravasation; Category No. 4968—hemangioblast cell differentiation; Category No. 4969—hematopoietic progenitor cell differentiation; Category No. 4970—hematopoietic stem cell differentiation; Category No. 4971—hematopoietic stem cell homeostasis; Category No. 4972—hematopoietic stem cell migration; Category No. 4973—hematopoietic stem cell migration to bone marrow; Category No. 4974—hematopoietic stem cell proliferation; Category No. 4975—heme a biosynthetic process; Category No. 4976—heme binding; Category No. 4977—heme biosynthetic process; Category No. 4978— heme catabolic process; Category No. 4979—heme export; Category No. 4980—heme metabolic process; Category No. 4981—heme 0 biosynthetic process; Category No. 4982—heme oxidation; Category No. 4983—heme oxygenase (decyclizing) activity; Category No. 4984—heme protein as acceptor; Category No. 4985—heme transport; Category No. 4986—heme transporter activity; Category No. 4987—heme-copper terminal oxidase activity; Category No. 4988—heme-transporting ATPase activity; Category No. 4989—hemidesmosome; Category No. 4990—hemidesmosome assembly; Category No. 4991—hemi-methylated DNA-binding; Category No. 4992—hemoglobin alpha binding; Category No. 4993—hemoglobin binding; Category No. 4994—hemoglobin biosynthetic process; Category No. 4995—hemoglobin complex; Category No. 4996—hemoglobin metabolic process; Category No. 4997—hemolysis by symbiont of host erythrocytes; Category No. 4998—hemopoiesis; Category No. 4999—hemostasis; Category No. 5000—heparan sulfate 6-O-sulfotransferase activity; Category No. 5001—heparan sulfate binding; Category No. 5002—heparan sulfate N-acetylglucosaminyltransferase activity; Category No. 5003—heparan sulfate proteoglycan binding; Category No. 5004—heparan sulfate proteoglycan biosynthetic process; Category No. 5005—heparan sulfate proteoglycan catabolic process; Category No. 5006—heparan sulfate proteoglycan metabolic process; Category No. 5007—heparan-alpha-glucosaminide N-acetyltransferase activity; Category No. 5008—heparanase activity; Category No. 5009—heparin binding; Category No. 5010—heparin biosynthetic process; Category No. 5011—heparosan-N-sulfate-glucuronate 5-epimerase activity; Category No. 5012—hepatic duct development; Category No. 5013—hepatic immune response; Category No. 5014—hepatic stellate cell activation; Category No. 5015—hepatoblast differentiation; Category No. 5016—hepatocyte apoptotic process; Category No. 5017—hepatocyte cell migration; Category No. 5018—hepatocyte dedifferentiation; Category No. 5019—hepatocyte differentiation; Category No. 5020—hepatocyte growth factor binding; Category No. 5021—hepatocyte growth factor receptor binding; Category No. 5022—hepatocyte growth factor receptor signaling pathway; Category No. 5023—hepatocyte growth factor-activated receptor activity; Category No. 5024—hepatocyte proliferation; Category No. 5025—hepoxilin A3 synthase activity; Category No. 5026—hepoxilin biosynthetic process; Category No. 5027—hepoxilin metabolic process; Category No. 5028—hepoxilin-epoxide hydrolase activity; Category No. 5029—heterochromatin; Category No. 5030—heterochromatin assembly; Category No. 5031—heterochromatin assembly involved in chromatin silencing; Category No. 5032—heterochromatin maintenance; Category No. 5033—heterochromatin organization; Category No. 5034—heterochronic; Category No. 5035—heterocycle metabolic process; Category No. 5036—heteroduplex DNA loop binding; Category No. 5037—heterophilic cell-cell adhesion via plasma membrane cell adhesion molecules; Category No. 5038—heterotrimeric G-protein binding; Category No. 5039—heterotrimeric G-protein complex; Category No. 5040—heterotrimeric G-protein complex assembly; Category No. 5041—heterotypic cell-cell adhesion; Category No. 5042—hexaprenyldihydroxybenzoate methyltransferase activity; Category No. 5043—hexokinase activity; Category No. 5044—hexose biosynthetic process; Category No. 5045—hexose metabolic process; Category No. 5046—hexose transmembrane transport; Category No. 5047—hexose transmembrane transporter activity; Category No. 5048—hexose transport; Category No. 5049—HFE-transferrin receptor complex; Category No. 5050—high molecular weight B cell growth factor receptor binding; Category No. 5051—high voltage-gated calcium channel activity; Category No. 5052—high-affinity arginine transmembrane transporter activity; Category No. 5053—high-affinity glutamate transmembrane transporter activity; Category No. 5054—high-affinity inorganic phosphate:sodium symporter activity; Category No. 5055—high-affinity L-ornithine transmembrane transporter activity; Category No. 5056—high-affinity lysine transmembrane transporter activity; Category No. 5057—high-affinity oligopeptide transporter activity; Category No. 5058—high-affinity sodium:dicarboxylate symporter activity; Category No. 5059—high-density lipoprotein particle; Category No. 5060—high-density lipoprotein particle assembly; Category No. 5061—high-density lipoprotein particle binding; Category No. 5062—high-density lipoprotein particle clearance; Category No. 5063—high-density lipoprotein particle receptor activity; Category No. 5064—high-density lipoprotein particle receptor binding; Category No. 5065—high-density lipoprotein particle remodeling; Category No. 5066—hindbrain development; Category No. 5067—hindbrain morphogenesis; Category No. 5068—hindbrain tangential cell migration; Category No. 5069—hindgut development; Category No. 5070—hindgut morphogenesis; Category No. 5071—hindlimb morphogenesis; Category No. 5072—hippo signaling; Category No. 5073—hippocampus development; Category No. 5074—histamine binding; Category No. 5075—histamine biosynthetic process; Category No. 5076—histamine metabolic process; Category No. 5077—histamine N-methyltransferase activity; Category No. 5078—histamine oxidase activity; Category No. 5079—histamine receptor activity; Category No. 5080—histamine secretion; Category No. 5081—histamine secretion by mast cell; Category No. 5082—histamine transport; Category No. 5083—histamine uptake; Category No. 5084—histamine-induced gastric acid secretion; Category No. 5085—histidine ammonia-lyase activity; Category No. 5086—histidine biosynthetic process; Category No. 5087—histidine catabolic process; Category No. 5088—histidine catabolic process to glutamate and formamide; Category No. 5089—histidine catabolic process to glutamate and formate; Category No. 5090—histidine decarboxylase activity; Category No. 5091—histidine metabolic process; Category No. 5092—histidine transport; Category No. 5093—histidine-tRNA ligase activity; Category No. 5094—histidyl-tRNA aminoacylation; Category No. 5095—histone acetylation; Category No. 5096—histone acetyltransferase activity; Category No. 5097—histone acetyltransferase activity (H4-K12 specific); Category No. 5098—histone acetyltransferase activity (H4-K16 specific); Category No. 5099—histone acetyltransferase activity (H4-K5 specific); Category No. 5100—histone acetyltransferase activity (H4-K8 specific); Category No. 5101—histone acetyltransferase binding; Category No. 5102—histone acetyltransferase complex; Category No. 5103—histone acetyltransferase regulator activity; Category No. 5104—histone arginine methylation; Category No. 5105—histone binding; Category No. 5106—histone biotinylation; Category No. 5107—histone citrullination; Category No. 5108—histone deacetylase activity; Category No. 5109—histone deacetylase binding; Category No. 5110—histone deacetylase complex; Category No. 5111—histone deacetylase inhibitor activity; Category No. 5112—histone deacetylase regulator activity; Category No. 5113—histone deacetylation; Category No. 5114—histone demethylase activity; Category No. 5115—histone demethylase activity (H3-dimethyl-K4 specific); Category No. 5116—histone demethylase activity (H3-K27 specific); Category No. 5117—histone demethylase activity (H3-K36 specific); Category No. 5118—histone demethylase activity (H3-K4 specific); Category No. 5119—histone demethylase activity (H3-K9 specific); Category No. 5120—histone demethylase activity (H3-monomethyl-K4 specific); Category No. 5121—histone demethylase activity (H3-R2 specific); Category No. 5122—histone demethylase activity (H3-trimethyl-K4 specific); Category No. 5123—histone demethylase activity (H4-K20 specific); Category No. 5124—histone demethylase activity (H4-R3 specific); Category No. 5125—histone demethylation; Category No. 5126—histone dephosphorylation; Category No. 5127—histone deubiquitination; Category No. 5128—histone displacement; Category No. 5129—histone exchange; Category No. 5130—histone glutamine methylation; Category No. 5131—histone H2A acetylation; Category No. 5132—histone H2A K63-linked deubiquitination; Category No. 5133—histone H2A K63-linked ubiquitination; Category No. 5134—histone H2A monoubiquitination; Category No. 5135—histone H2A ubiquitination; Category No. 5136—histone H2A-K119 monoubiquitination; Category No. 5137—histone H2A-K13 ubiquitination; Category No. 5138—histone H2A-K15 ubiquitination; Category No. 5139—histone H2A-S1 phosphorylation; Category No. 5140—histone H2A-S139 phosphorylation; Category No. 5141—histone H2A-T120 phosphorylation; Category No. 5142—histone H2B acetylation; Category No. 5143—histone H2B conserved C-terminal lysine deubiquitination; Category No. 5144—histone H2B conserved C-terminal lysine ubiquitination; Category No. 5145—histone H2B ubiquitination; Category No. 5146—histone H3 acetylation; Category No. 5147—histone H3 deacetylation; Category No. 5148—histone H3-K14 acetylation; Category No. 5149—histone H3-K27 demethylation; Category No. 5150—histone H3-K27 methylation; Category No. 5151—histone H3-K27 trimethylation; Category No. 5152—histone H3-K36 demethylation; Category No. 5153—histone H3-K36 dimethylation; Category No. 5154—histone H3-K36 methylation; Category No. 5155—histone H3-K36 trimethylation; Category No. 5156—histone H3-K4 acetylation; Category No. 5157—histone H3-K4 demethylation; Category No. 5158—histone H3-K4 dimethylation; Category No. 5159—histone H3-K4 methylation; Category No. 5160—histone H3-K4 trimethylation; Category No. 5161—histone H3-K79 methylation; Category No. 5162—histone H3-K9 acetylation; Category No. 5163—histone H3-K9 deacetylation; Category No. 5164—histone H3-K9 demethylation; Category No. 5165—histone H3-K9 dimethylation; Category No. 5166—histone H3-K9 methylation; Category No. 5167—histone H3-K9 modification; Category No. 5168—histone H3-K9 trimethylation; Category No. 5169—histone H3-R17 methylation; Category No. 5170—histone H3-R2 demethylation; Category No. 5171—histone H3-R2 methylation; Category No. 5172—histone H3-R26 citrullination; Category No. 5173—histone H3-R26 methylation; Category No. 5174—histone H3-S10 phosphorylation; Category No. 5175—histone H3-S10 phosphorylation involved in chromosome condensation; Category No. 5176—histone H3-S28 phosphorylation; Category No. 5177—histone H3-T11 phosphorylation; Category No. 5178—histone H3-T3 phosphorylation; Category No. 5179—histone H3-T3 phosphorylation involved in chromosome passenger complex localization to kinetochore; Category No. 5180—histone H3-T6 phosphorylation; Category No. 5181—histone H3-Y41 phosphorylation; Category No. 5182—histone H4 acetylation; Category No. 5183—histone H4 deacetylation; Category No. 5184—histone H4-K12 acetylation; Category No. 5185—histone H4-K16 acetylation; Category No. 5186—histone H4-K20 demethylation; Category No. 5187—histone H4-K20 methylation; Category No. 5188—histone H4-K20 trimethylation; Category No. 5189—histone H4-K5 acetylation; Category No. 5190—histone H4-K8 acetylation; Category No. 5191—histone H4-R3 demethylation; Category No. 5192—histone H4-R3 methylation; Category No. 5193—histone kinase activity; Category No. 5194—histone kinase activity (H2A-T120 specific); Category No. 5195—histone kinase activity (H3-S10 specific); Category No. 5196—histone kinase activity (H3-T11 specific); Category No. 5197—histone kinase activity (H3-T3 specific); Category No. 5198—histone kinase activity (H3-T6 specific); Category No. 5199—histone kinase activity (H3-Y41 specific); Category No. 5200—histone locus body; Category No. 5201—histone lysine demethylation; Category No. 5202—histone lysine methylation; Category No. 5203—histone methylation; Category No. 5204—histone methyltransferase activity; Category No. 5205—histone methyltransferase activity (H2A-R3 specific); Category No. 5206—histone methyltransferase activity (H3-K27 specific); Category No. 5207—histone methyltransferase activity (H3-K36 specific); Category No. 5208—histone methyltransferase activity (H3-K4 specific); Category No. 5209—histone methyltransferase activity (H3-K79 specific); Category No. 5210—histone methyltransferase activity (H3-K9 specific); Category No. 5211—histone methyltransferase activity (H3-R17 specific); Category No. 5212—histone methyltransferase activity (H3-R2 specific); Category No. 5213—histone methyltransferase activity (H4-K20 specific); Category No. 5214—histone methyltransferase activity (H4-R3 specific); Category No. 5215—histone methyltransferase binding; Category No. 5216—histone methyltransferase complex; Category No. 5217—histone modification; Category No. 5218—histone monoubiquitination; Category No. 5219—histone mRNA catabolic process; Category No. 5220—histone mRNA metabolic process; Category No. 5221—histone phosphorylation; Category No. 5222—histone pre-mRNA 3'end processing complex; Category No. 5223—histone pre-mRNA DCP binding; Category No. 5224—histone pre-mRNA stem-loop binding; Category No. 5225—histone serine kinase activity; Category No. 5226—histone ubiquitination; Category No. 5227—histone-arginine N-methyltransferase activity; Category No. 5228—histone-glutamine methyltransferase activity; Category No. 5229—histone-lysine N-methyltransferase activity; Category No. 5230—histone-serine phosphorylation; Category No. 5231—HLA-A specific activating MHC class I receptor activity; Category No. 5232—HLA-A specific inhibitory MHC class I receptor activity; Category No. 5233—HLA-B specific inhibitory MHC class I receptor activity; Category No. 5234—HLH domain binding; Category No. 5235—HMG box domain binding; Category No. 5236—HNK-1 sulfotransferase activity; Category No. 5237—Holliday junction resolvase complex; Category No. 5238—holo TFIIH complex; Category No. 5239—holo-[acyl-carrier-protein] synthase activity; Category No. 5240—holocytochrome-c synthase activity; Category No. 5241—holoenzyme; Category No. 5242—homeostasis of number of cells; Category No. 5243—homeostasis of number of cells within a tissue; Category No. 5244—homeostatic process; Category No. 5245—homocysteine biosynthetic process; Category No. 5246—homocysteine catabolic process; Category No. 5247—homocysteine desulfhydrase activity; Category No. 5248—homocysteine metabolic process; Category No. 5249—homogentisate 1,2-dioxygenase activity; Category No. 5250—homoiothermy; Category No. 5251—homologous chromosome movement towards spindle pole involved in homologous chromosome segregation; Category No. 5252—homologous chromosome orientation involved in meiotic metaphase I plate congression; Category No. 5253—homologous chromosome segregation; Category No. 5254—homologous recombination-dependent replication fork processing; Category No. 5255—homophilic cell adhesion via plasma membrane adhesion molecules; Category No. 5256—homotypic cell-cell adhesion; Category No. 5257—HOPS complex; Category No. 5258—hormonal regulation of the force of heart contraction; Category No. 5259—hormone activity; Category No. 5260—hormone binding; Category No. 5261—hormone biosynthetic process; Category No. 5262—hormone catabolic process; Category No. 5263—hormone metabolic process; Category No. 5264—hormone receptor binding; Category No. 5265—hormone secretion; Category No. 5266—hormone transport; Category No. 5267—hormone-mediated apoptotic signaling pathway; Category No. 5268—hormone-mediated signaling pathway; Category No. 5269—hormone-sensitive lipase activity; Category No. 5270—host cell; Category No. 5271—host cell nucleus; Category No. 5272—host cell perinuclear region of cytoplasm; Category No. 5273—host cell presynaptic membrane; Category No. 5274—host cell surface; Category No. 5275—host cell surface receptor binding; Category No. 5276—host cell viral assembly compartment; Category No. 5277—host programmed cell death induced by symbiont; Category No. 5278—Hrd1p ubiquitin ligase complex; Category No. 5279—Hrd1p ubiquitin ligase ERAD-L complex; Category No. 5280—Hsp70 protein binding; Category No. 5281—Hsp90 deacetylation; Category No. 5282—Hsp90 protein binding; Category No. 5283—HSP90-CDC37 chaperone complex; Category No. 5284—HULC complex; Category No. 5285—humoral immune response; Category No. 5286—humoral immune response mediated by circulating immunoglobulin; Category No. 5287—hyaloid vascular plexus regression; Category No. 5288—hyaluranon cable; Category No. 5289—hyaluronan biosynthetic process; Category No. 5290—hyaluronan catabolic process; Category No. 5291—hyaluronan metabolic process; Category No. 5292—hyaluronan synthase activity; Category No. 5293—hyaluronic acid binding; Category No. 5294—hyaluronoglucuronidase activity; Category No. 5295—hyaluronoglucosaminidase activity; Category No. 5296—hydrogen ion channel activity; Category No. 5297—hydrogen ion transmembrane transport; Category No. 5298—hydrogen ion transmembrane transporter activity; Category No. 5299—hydrogen peroxide biosynthetic process; Category No. 5300—hydrogen peroxide catabolic process; Category No. 5301—hydrogen peroxide metabolic process; Category No. 5302—hydrogen sulfide biosynthetic process; Category No. 5303—hydrogen sulfide metabolic process; Category No. 5304—hydrogen:amino acid symporter activity; Category No. 5305—hydrogen:potassium-exchanging ATPase activity; Category No. 5306—hydrogen:potassium-exchanging ATPase complex; Category No. 5307—hydrogen-exporting ATPase activity; Category No. 5308—hydrolase activity; Category No. 5309—hydro-lyase activity; Category No. 5310—hydrolyzing N-glycosyl compounds; Category No. 5311—hydrolyzing 0-glycosyl compounds; Category No. 5312—hydroxyacid-oxoacid transhydrogenase activity; Category No. 5313—hydroxyacylglutathione hydrolase activity; Category No. 5314—hydroxyapatite binding; Category No. 5315—hydroxylysine biosynthetic process; Category No. 5316—hydroxylysine kinase activity; Category No. 5317—hydroxymethyl-; Category No. 5318—hydroxymethylbilane synthase activity; Category No. 5319—hydroxymethylglutaryl-CoA lyase activity; Category No. 5320—hydroxymethylglutaryl-CoA reductase (NADPH) activity; Category No. 5321—hydroxymethylglutaryl-CoA reductase activity; Category No. 5322—hydroxymethylglutaryl-CoA synthase activity; Category No. 5323—hydroxyproline transport; Category No. 5324—hydroxypyruvate isomerase activity; Category No. 5325—hydroxypyruvate reductase activity; Category No. 5326—hypermethylation of CpG island; Category No. 5327—hyperosmotic response; Category No. 5328—hyperosmotic salinity response; Category No. 5329—hypochlorous acid biosynthetic process; Category No. 5330—hypomethylation of CpG island; Category No. 5331—hypophysis morphogenesis; Category No. 5332—hypothalamus cell differentiation; Category No. 5333—hypothalamus cell migration; Category No. 5334—hypothalamus development; Category No. 5335—hypothalamus gonadotrophin-releasing hormone neuron development; Category No. 5336—hypotonic response; Category No. 5337—hypoxanthine biosynthetic process; Category No. 5338—hypoxanthine metabolic process; Category No. 5339—hypoxanthine phosphoribosyltransferase activity; Category No. 5340—hypoxanthine salvage; Category No. 5341—hypoxia-inducible factor-1alpha signaling pathway; Category No. 5342—I band; Category No. 5343—ICAM-3 receptor activity; Category No. 5344—icosanoid biosynthetic process; Category No. 5345—icosanoid metabolic process; Category No. 5346—icosatetraenoic acid binding; Category No. 5347—identical protein binding; Category No. 5348—IDP catabolic process; Category No. 5349—iduronate-2-sulfatase activity; Category No. 5350—IgA binding; Category No. 5351—IgE binding; Category No. 5352—IgE receptor activity; Category No. 5353—IgG binding; Category No. 5354—IgG immunoglobulin transcytosis in epithelial cells mediated by FcRn immunoglobulin receptor; Category No. 5355—IgG receptor activity; Category No. 5356—IgM binding; Category No. 5357—IkappaB kinase activity; Category No. 5358—IkappaB kinase complex; Category No. 5359—I-kappaB kinase NF-kappaB signaling; Category No. 5360—I-kappaB NF-kappaB complex; Category No. 5361—I-kappaB phosphorylation; Category No. 5362—imidazolonepropionase activity; Category No. 5363—Iml1 complex; Category No. 5364—immature B cell differentiation; Category No. 5365—immature T cell proliferation in thymus; Category No. 5366—immortalization of host cell by virus; Category No. 5367—immune response; Category No. 5368—immune response to tumor cell; Category No. 5369—immune response-activating cell surface receptor signaling pathway; Category No. 5370—immune response-activating signal transduction; Category No. 5371—immune response-inhibiting cell surface receptor signaling pathway; Category No. 5372—immune response-inhibiting signal transduction; Category No. 5373—immune response-regulating cell surface receptor signaling pathway; Category No. 5374—immune response-regulating signaling pathway; Category No. 5375—immune system development; Category No. 5376—immune system process; Category No. 5377—immunoglobulin binding; Category No. 5378—immunoglobulin biosynthetic process; Category No. 5379—immunoglobulin complex; Category No. 5380—immunoglobulin heavy chain V-D-J recombination; Category No. 5381—immunoglobulin mediated immune response; Category No. 5382—immunoglobulin production; Category No. 5383—immunoglobulin production in mucosal tissue; Category No. 5384—immunoglobulin production involved in immunoglobulin mediated immune response; Category No. 5385—immunoglobulin receptor activity; Category No. 5386—immunoglobulin receptor binding; Category No. 5387—immunoglobulin secretion; Category No. 5388—immunoglobulin secretion involved in immune response; Category No. 5389—immunoglobulin transcytosis in epithelial cells; Category No. 5390—immunoglobulin transcytosis in epithelial cells mediated by polymeric immunoglobulin receptor; Category No. 5391—immunoglobulin V(D)J recombination; Category No. 5392—immunological synapse; Category No. 5393—immunological synapse formation; Category No. 5394—IMP biosynthetic process; Category No. 5395—IMP cyclohydrolase activity; Category No. 5396—IMP dehydrogenase activity; Category No. 5397—IMP metabolic process; Category No. 5398—IMP salvage; Category No. 5399—import into cell; Category No. 5400—importin-alpha family protein binding; Category No. 5401—in cyclic amides; Category No. 5402—in cyclic amidines; Category No. 5403—in linear amides; Category No. 5404—in linear amidines; Category No. 5405—in phosphorus-containing anhydrides; Category No. 5406—in utero embryonic development; Category No. 5407—inactivation of MAPK activity; Category No. 5408—inactivation of MAPK activity involved in osmosensory signaling pathway; Category No. 5409—inactivation of MAPKK activity; Category No. 5410—inactivation of paternal X chromosome; Category No. 5411—inactivation of X chromosome by DNA methylation; Category No. 5412—inclusion body; Category No. 5413—incompatible interaction; Category No. 5414—incorporation of two atoms of oxygen; Category No. 5415—indanol dehydrogenase activity; Category No. 5416—indolalkylamine biosynthetic process; Category No. 5417—indole metabolic process; Category No. 5418—indoleamine 2,3-dioxygenase activity; Category No. 5419—induced systemic resistance; Category No. 5420—induction by symbiont of defense-related host nitric oxide production; Category No. 5421—induction by virus of host cell-cell fusion; Category No. 5422—induction of bacterial agglutination; Category No. 5423—induction of negative chemotaxis; Category No. 5424—induction of positive chemotaxis; Category No. 5425—inductive cell-cell signaling; Category No. 5426—inferior colliculus development; Category No. 5427—inflammatory cell apoptotic process; Category No. 5428—inflammatory response; Category No. 5429—inflammatory response to antigenic stimulus; Category No. 5430—inhibin A complex; Category No. 5431—inhibin B complex; Category No. 5432—inhibin binding; Category No. 5433—inhibin-betaglycan-ActRII complex; Category No. 5434—inhibition of cysteine-type endopeptidase activity involved in apoptotic process; Category No. 5435—inhibition of neuroepithelial cell differentiation; Category No. 5436—inhibitory cytoplasmic mediator activity; Category No. 5437—inhibitory extracellular ligand-gated ion channel activity; Category No. 5438—inhibitory G-protein coupled receptor phosphorylation; Category No. 5439—inhibitory MHC class I receptor activity; Category No. 5440—inhibitory postsynaptic potential; Category No. 5441—inhibitory synapse; Category No. 5442—initiating; Category No. 5443—initiation; Category No. 5444—initiation of neural tube closure; Category No. 5445—initiation of primordial ovarian follicle growth; Category No. 5446—innate immune response; Category No. 5447—innate immune response in mucosa; Category No. 5448—innate immune response-activating signal transduction; Category No. 5449—innate vocalization behavior; Category No. 5450—inner acrosomal membrane; Category No. 5451—inner cell mass cell differentiation; Category No. 5452—inner cell mass cell fate commitment; Category No. 5453—inner cell mass cell proliferation; Category No. 5454—inner cell mass cellular morphogenesis; Category No. 5455—inner dense plaque of desmosome; Category No. 5456—inner dynein arm; Category No. 5457—inner dynein arm assembly; Category No. 5458—inner ear development; Category No. 5459—inner ear morphogenesis; Category No. 5460—inner ear receptor cell development; Category No. 5461—inner ear receptor cell differentiation; Category No. 5462—inner ear receptor stereocilium organization; Category No. 5463—inner medullary collecting duct development; Category No. 5464—inner mitochondrial membrane organization; Category No. 5465—innervation; Category No. 5466—Ino80 complex; Category No. 5467—inorganic anion exchanger activity; Category No. 5468—inorganic anion transport; Category No. 5469—inorganic cation transmembrane transporter activity; Category No. 5470—inorganic diphosphatase activity; Category No. 5471—inorganic diphosphate transmembrane transporter activity; Category No. 5472—inorganic diphosphate transport; Category No. 5473—inorganic phosphate transmembrane transporter activity; Category No. 5474—inosine biosynthetic process; Category No. 5475—inosine catabolic process; Category No. 5476—inosine-diphosphatase activity; Category No. 5477—inositol 1,3,4,5 tetrakisphosphate binding; Category No. 5478—inositol 1,4,5 trisphosphate binding; Category No. 5479—inositol 1,4,5-trisphosphate-sensitive calcium-release channel activity; Category No. 5480—inositol biosynthetic process; Category No. 5481—inositol bisphosphate phosphatase activity; Category No. 5482—inositol catabolic process; Category No. 5483—inositol diphosphate tetrakisphosphate diphosphatase activity; Category No. 5484—inositol hexakisphosphate 1-kinase activity; Category No. 5485—inositol hexakisphosphate 2-phosphatase activity; Category No. 5486—inositol hexakisphosphate 3-kinase activity; Category No. 5487—inositol hexakisphosphate 5-kinase activity; Category No. 5488—inositol hexakisphosphate 6-kinase activity; Category No. 5489—inositol hexakisphosphate binding; Category No. 5490—inositol lipid-mediated signaling; Category No. 5491—inositol metabolic process; Category No. 5492—inositol monophosphate 1-phosphatase activity; Category No. 5493—inositol monophosphate 3-phosphatase activity; Category No. 5494—inositol monophosphate 4-phosphatase activity; Category No. 5495—inositol monophosphate phosphatase activity; Category No. 5496—inositol oxygenase activity; Category No. 5497—inositol pentakisphosphate 2-kinase activity; Category No. 5498—inositol phosphate biosynthetic process; Category No. 5499—inositol phosphate catabolic process; Category No. 5500—inositol phosphate dephosphorylation; Category No. 5501—inositol phosphate metabolic process; Category No. 5502—inositol phosphate phosphatase activity; Category No. 5503—inositol phosphate-mediated signaling; Category No. 5504—inositol phosphorylation; Category No. 5505—inositol tetrakisphosphate 1-kinase activity; Category No. 5506—inositol tetrakisphosphate 3-kinase activity; Category No. 5507—inositol trisphosphate biosynthetic process; Category No. 5508—inositol trisphosphate metabolic process; Category No. 5509—inositol trisphosphate phosphatase activity; Category No. 5510—inositol-1,3,4,5,6-pentakisphosphate 1-phosphatase activity; Category No. 5511—inositol-1,3,4,5,6-pentakisphosphate kinase activity; Category No. 5512—inositol-1,3,4,5-tetrakisphosphate 3-phosphatase activity; Category No. 5513—inositol-1,3,4,5-tetrakisphosphate 5-phosphatase activity; Category No. 5514—inositol- 1,3,4,6-tetrakisphosphate 1-phosphatase activity; Category No. 5515—inositol-1,3,4,6-tetrakisphosphate 6-phosphatase activity; Category No. 5516—inositol-1,3,4-trisphosphate 1-phosphatase activity; Category No. 5517—inositol-1,3,4-trisphosphate 5-kinase activity; Category No. 5518—inositol-1,3,4-trisphosphate 6-kinase activity; Category No. 5519—inositol-1,4,5-trisphosphate 3-kinase activity; Category No. 5520—inositol-1,4,5-trisphosphate 5-phosphatase activity; Category No. 5521—inositol-1,4,5-trisphosphate 6-kinase activity; Category No. 5522—inositol-1,4-bisphosphate 1-phosphatase activity; Category No. 5523—inositol-1,5-bisdiphosphate-2,3,4,6-tetrakisphosphate 1-diphosphatase activity; Category No. 5524—inositol-1,5-bisdiphosphate-2,3,4,6-tetrakisphosphate 5-diphosphatase activity; Category No. 5525—inositol-1-diphosphate-2,3,4,5,6-pentakisphosphate diphosphatase activity; Category No. 5526—inositol-3,4,6-trisphosphate 1-kinase activity; Category No. 5527—inositol-3,5-bisdiphosphate-2,3,4,6-tetrakisphosphate 5-diphosphatase activity; Category No. 5528—inositol-3-diphosphate-1,2,4,5,6-pentakisphosphate diphosphatase activity; Category No. 5529—inositol-3-phosphate synthase activity; Category No. 5530—inositol-5-diphosphate-1,2,3,4,6-pentakisphosphate diphosphatase activity; Category No. 5531—inositol-polyphosphate 5-phosphatase activity; Category No. 5532—insecticide metabolic process; Category No. 5533—insemination; Category No. 5534—insulin binding; Category No. 5535—insulin catabolic process; Category No. 5536—insulin metabolic process; Category No. 5537—insulin processing; Category No. 5538—insulin receptor binding; Category No. 5539—insulin receptor complex; Category No. 5540—insulin receptor internalization; Category No. 5541—insulin receptor signaling pathway; Category No. 5542—insulin receptor signaling pathway via phosphatidylinositol 3-kinase; Category No. 5543—insulin receptor substrate binding; Category No. 5544—insulin secretion; Category No. 5545—insulin secretion involved in cellular response to glucose stimulus; Category No. 5546—insulin-activated receptor activity; Category No. 5547—insulin-like growth factor binding; Category No. 5548—insulin-like growth factor binding protein complex; Category No. 5549—insulin-like growth factor I binding; Category No. 5550—insulin-like growth factor II binding; Category No. 5551—insulin-like growth factor receptor binding; Category No. 5552—insulin-like growth factor receptor signaling pathway; Category No. 5553—insulin-like growth factor ternary complex; Category No. 5554—insulin-like growth factor-activated receptor activity; Category No. 5555—insulin-responsive compartment; Category No. 5556—integral component of cytoplasmic side of endoplasmic reticulum membrane; Category No. 5557—integral component of endoplasmic reticulum membrane; Category No. 5558—integral component of external side of plasma membrane; Category No. 5559—integral component of Golgi membrane; Category No. 5560—integral component of lumenal side of endoplasmic reticulum membrane; Category No. 5561—integral component of membrane; Category No. 5562—integral component of mitochondrial inner membrane; Category No. 5563—integral component of mitochondrial membrane; Category No. 5564—integral component of mitochondrial outer membrane; Category No. 5565—integral component of nuclear inner membrane; Category No. 5566—integral component of nuclear outer membrane; Category No. 5567—integral component of omegasome membrane; Category No. 5568—integral component of organelle membrane; Category No. 5569—integral component of peroxisomal membrane; Category No. 5570—integral component of plasma membrane; Category No. 5571—integral component of synaptic vesicle membrane; Category No. 5572—integrator complex; Category No. 5573—integrin activation; Category No. 5574—integrin alpha10-beta1 complex; Category No. 5575—integrin alpha11-beta1 complex; Category No. 5576—integrin alpha1-beta1 complex; Category No. 5577—integrin alpha2-beta1 complex; Category No. 5578—integrin alpha3-beta1 complex; Category No. 5579—integrin alpha4-beta7 complex; Category No. 5580—integrin alpha7-beta1 complex; Category No. 5581—integrin alpha8-beta1 complex; Category No. 5582—integrin alpha9-beta1 complex; Category No. 5583—integrin alpha11b-beta3 complex; Category No. 5584—integrin alphaL-beta2 complex; Category No. 5585—integrin alphav-beta3 complex; Category No. 5586—integrin alphav-beta5 complex; Category No. 5587—integrin alphav-beta8 complex; Category No. 5588—integrin binding; Category No. 5589—integrin binding involved in cell-matrix adhesion; Category No. 5590—integrin biosynthetic process; Category No. 5591—integrin complex; Category No. 5592—integrin-mediated signaling pathway; Category No. 5593—intein-mediated protein splicing; Category No. 5594—interaction with host; Category No. 5595—interaction with symbiont; Category No. 5596—intercalated disc; Category No. 5597—intercellular bridge; Category No. 5598—intercellular bridge organization; Category No. 5599—intercellular canaliculus; Category No. 5600—interchromatin granule; Category No. 5601—interferon receptor activity; Category No. 5602—interferon-alpha production; Category No. 5603—interferon-beta production; Category No. 5604—interferon-gamma binding; Category No. 5605—interferon-gamma biosynthetic process; Category No. 5606—interferon-gamma production; Category No. 5607—interferon-gamma receptor activity; Category No. 5608—interferon-gamma receptor binding; Category No. 5609—interferon-gamma secretion; Category No. 5610—interferon-gamma-mediated signaling pathway; Category No. 5611—interfibrillar mitochondrion; Category No. 5612—interkinetic nuclear migration; Category No. 5613—interleukin-1; Category No. 5614—interleukin-1 alpha secretion; Category No. 5615—interleukin-1 beta biosynthetic process; Category No. 5616—interleukin-1 beta production; Category No. 5617—interleukin-1 beta secretion; Category No. 5618—interleukin-1 binding; Category No. 5619—interleukin-1 receptor activity; Category No. 5620—interleukin-1 receptor antagonist activity; Category No. 5621—interleukin-1 receptor binding; Category No. 5622—interleukin-1 receptor complex; Category No. 5623—interleukin-1 secretion; Category No. 5624—interleukin-1 Type I receptor antagonist activity; Category No. 5625—interleukin-1 Type II receptor antagonist activity; Category No. 5626—interleukin-10 binding; Category No. 5627—interleukin-10 production; Category No. 5628—interleukin-10 receptor activity; Category No. 5629—interleukin-10 receptor binding; Category No. 5630—interleukin-10 secretion; Category No. 5631—interleukin-11 binding; Category No. 5632—interleukin-11 receptor activity; Category No. 5633—interleukin-11 receptor binding; Category No. 5634—interleukin-11-mediated signaling pathway; Category No. 5635—interleukin-12 alpha subunit binding; Category No. 5636—interleukin-12 beta subunit binding; Category No. 5637—interleukin-12 complex; Category No. 5638—interleukin-12 production; Category No. 5639—interleukin-12 receptor activity; Category No. 5640—interleukin-12 receptor binding; Category No. 5641—interleukin-12 receptor complex; Category No. 5642—interleukin-12 secretion;

Category No. 5643—interleukin-12-mediated signaling pathway; Category No. 5644—interleukin-13 biosynthetic process; Category No. 5645—interleukin-13 production; Category No. 5646—interleukin-13 receptor binding; Category No. 5647—interleukin-13 receptor complex; Category No. 5648—interleukin-15 production; Category No. 5649—interleukin-15-mediated signaling pathway; Category No. 5650—interleukin-17 production; Category No. 5651—interleukin-17 receptor activity; Category No. 5652—interleukin-17E receptor binding; Category No. 5653—interleukin-18 binding; Category No. 5654—interleukin-18 production; Category No. 5655—interleukin-18 receptor activity; Category No. 5656—interleukin-18 receptor complex; Category No. 5657—interleukin-18 secretion; Category No. 5658—interleukin-18-mediated signaling pathway; Category No. 5659—interleukin-1-mediated signaling pathway; Category No. 5660—interleukin-2 binding; Category No. 5661—interleukin-2 biosynthetic process; Category No. 5662—interleukin-2 production; Category No. 5663—interleukin-2 receptor activity; Category No. 5664—interleukin-2 receptor binding; Category No. 5665—interleukin-2 secretion; Category No. 5666—interleukin-20 binding; Category No. 5667—interleukin-20 receptor binding; Category No. 5668—interleukin-21 receptor activity; Category No. 5669—interleukin-21 secretion; Category No. 5670—interleukin-21-mediated signaling pathway; Category No. 5671—interleukin-22 binding; Category No. 5672—interleukin-22 receptor activity; Category No. 5673—interleukin-22 receptor binding; Category No. 5674—interleukin-23 binding; Category No. 5675—interleukin-23 complex; Category No. 5676—interleukin-23 receptor activity; Category No. 5677—interleukin-23 receptor binding; Category No. 5678—interleukin-23 receptor complex; Category No. 5679—interleukin-23-mediated signaling pathway; Category No. 5680—interleukin-27 binding; Category No. 5681—interleukin-27 receptor activity; Category No. 5682—interleukin-27 receptor binding; Category No. 5683—interleukin-27-mediated signaling pathway; Category No. 5684—interleukin-28 receptor binding; Category No. 5685—interleukin-28 receptor complex; Category No. 5686—interleukin-2-mediated signaling pathway; Category No. 5687—interleukin-3 production; Category No. 5688—interleukin-3 receptor activity; Category No. 5689—interleukin-3 receptor binding; Category No. 5690—interleukin-33 binding; Category No. 5691—interleukin-33 receptor activity; Category No. 5692—interleukin-33-mediated signaling pathway; Category No. 5693—interleukin-3-mediated signaling pathway; Category No. 5694—interleukin-4 production; Category No. 5695—interleukin-4 receptor activity; Category No. 5696—interleukin-4 receptor binding; Category No. 5697—interleukin-4 secretion; Category No. 5698—interleukin-4-mediated signaling pathway; Category No. 5699—interleukin-5 production; Category No. 5700—interleukin-5 receptor activity; Category No. 5701—interleukin-5 receptor binding; Category No. 5702—interleukin-5 receptor complex; Category No. 5703—interleukin-5-mediated signaling pathway; Category No. 5704—interleukin-6 binding; Category No. 5705—interleukin-6 biosynthetic process; Category No. 5706—interleukin-6 production; Category No. 5707—interleukin-6 receptor activity; Category No. 5708—interleukin-6 receptor binding; Category No. 5709—interleukin-6 receptor complex; Category No. 5710—interleukin-6-mediated signaling pathway; Category No. 5711—interleukin-7 binding; Category No. 5712—interleukin-7 receptor activity; Category No. 5713—interleukin-7 receptor binding; Category No. 5714—interleukin-7-mediated signaling pathway; Category No. 5715—interleukin-8 binding; Category No. 5716—interleukin-8 biosynthetic process; Category No. 5717—interleukin-8 production; Category No. 5718—interleukin-8 receptor activity; Category No. 5719—interleukin-8 receptor binding; Category No. 5720—interleukin-8 secretion; Category No. 5721—interleukin-8-mediated signaling pathway; Category No. 5722—interleukin-9 receptor activity; Category No. 5723—interleukin-9 receptor binding; Category No. 5724—interleukin-9-mediated signaling pathway; Category No. 5725—intermale aggressive behavior; Category No. 5726—Intermediate conductance calcium-activated potassium channel activity; Category No. 5727—intermediate filament; Category No. 5728—intermediate filament binding; Category No. 5729—intermediate filament bundle assembly; Category No. 5730—intermediate filament cytoskeleton; Category No. 5731—intermediate filament cytoskeleton organization; Category No. 5732—intermediate filament organization; Category No. 5733—intermediate filament polymerization or depolymerization; Category No. 5734—intermediate filament-based process; Category No. 5735—intermediate mesoderm development; Category No. 5736—intermediate mesodermal cell differentiation; Category No. 5737—intermediate-density lipoprotein particle; Category No. 5738—intermediate-density lipoprotein particle remodeling; Category No. 5739—intermembrane transport; Category No. 5740—internal peptidyl-lysine acetylation; Category No. 5741—internal protein amino acid acetylation; Category No. 5742—internal vesicle; Category No. 5743—internal vesicle lumen; Category No. 5744—interneuron migration from the subpallium to the cortex; Category No. 5745—internode region of axon; Category No. 5746—interphase microtubule nucleation by interphase microtubule organizing center; Category No. 5747—interphase microtubule organizing center; Category No. 5748—interphotoreceptor matrix; Category No. 5749—interstitial matrix; Category No. 5750—interstrand cross-link repair; Category No. 5751—intestinal absorption; Category No. 5752—intestinal cholesterol absorption; Category No. 5753—intestinal D-glucose absorption; Category No. 5754—intestinal epithelial cell development; Category No. 5755—intestinal epithelial cell differentiation; Category No. 5756—intestinal epithelial cell maturation; Category No. 5757—intestinal epithelial cell migration; Category No. 5758—intestinal epithelial structure maintenance; Category No. 5759—intestinal folate absorption; Category No. 5760—intestinal stem cell homeostasis; Category No. 5761—intestine smooth muscle contraction; Category No. 5762—intracellular; Category No. 5763—intracellular bile acid receptor signaling pathway; Category No. 5764—intracellular calcium activated chloride channel activity; Category No. 5765—intracellular cAMP activated cation channel activity; Category No. 5766—intracellular canaliculus; Category No. 5767—intracellular cGMP activated cation channel activity; Category No. 5768—intracellular cholesterol transport; Category No. 5769—intracellular copper ion transport; Category No. 5770—intracellular cyclic nucleotide activated cation channel activity; Category No. 5771—intracellular cyclic nucleotide activated cation channel complex; Category No. 5772—intracellular distribution of mitochondria; Category No. 5773—intracellular estrogen receptor signaling pathway; Category No. 5774—intracellular ferritin complex; Category No. 5775—intracellular ligand-gated calcium channel activity; Category No. 5776—intracellular membrane-bounded organelle; Category No. 5777—intracellular mRNA localization; Category No. 5778—intracellular organelle; Category No. 5779—intracellular pH elevation; Category No. 5780—intracellular pH reduction; Category No. 5781—intracellular protein transmembrane transport; Category No. 5782—intracellular protein transport; Category No. 5783—intracellular receptor signaling pathway; Category No. 5784—intracellular sequestering of iron ion; Category No. 5785—intracellular signal transduction; Category No. 5786—intracellular steroid hormone receptor signaling pathway; Category No. 5787—intracellular sterol transport; Category No. 5788—intracellular transport; Category No. 5789—intracellular transport of viral protein in host cell; Category No. 5790—intracellular transport of virus; Category No. 5791—intraciliary anterograde transport; Category No. 5792—intraciliary retrograde transport; Category No. 5793—intraciliary transport; Category No. 5794—intraciliary transport involved in cilium morphogenesis; Category No. 5795—intraciliary transport particle; Category No. 5796—intraciliary transport particle A; Category No. 5797—intraciliary transport particle B; Category No. 5798—intra-Golgi vesicle-mediated transport; Category No. 5799—intrahepatic bile duct development; Category No. 5800—intralumenal vesicle formation; Category No. 5801—intramembrane cleaving; Category No. 5802—intramembranous ossification; Category No. 5803—intramolecular oxidoreductase activity; Category No. 5804—intramolecular transferase activity; Category No. 5805—intra-S DNA damage checkpoint; Category No. 5806—intrinsic apoptotic signaling pathway; Category No. 5807—intrinsic apoptotic signaling pathway by p53 class mediator; Category No. 5808—intrinsic apoptotic signaling pathway in response to DNA damage; Category No. 5809—intrinsic apoptotic signaling pathway in response to DNA damage by p53 class mediator; Category No. 5810—intrinsic apoptotic signaling pathway in response to endoplasmic reticulum stress; Category No. 5811—intrinsic apoptotic signaling pathway in response to hydrogen peroxide; Category No. 5812—intrinsic apoptotic signaling pathway in response to hypoxia; Category No. 5813—intrinsic apoptotic signaling pathway in response to osmotic stress; Category No. 5814—intrinsic apoptotic signaling pathway in response to oxidative stress; Category No. 5815—intrinsic component of endoplasmic reticulum membrane; Category No. 5816—intrinsic component of endosome membrane; Category No. 5817—intrinsic component of external side of plasma membrane; Category No. 5818—intrinsic component of Golgi membrane; Category No. 5819—intrinsic component of membrane; Category No. 5820—intrinsic component of mitochondrial inner membrane; Category No. 5821—intrinsic component of mitochondrial outer membrane; Category No. 5822—intrinsic component of peroxisomal membrane; Category No. 5823—intrinsic component of plasma membrane; Category No. 5824—intrinsic component of the cytoplasmic side of the plasma membrane; Category No. 5825—intrinsic pathway; Category No. 5826—intronic transcription regulatory region DNA binding; Category No. 5827—intronic transcription regulatory region sequence-specific DNA binding; Category No. 5828—intussusceptive angiogenesis; Category No. 5829—invadopodium; Category No. 5830—invadopodium membrane; Category No. 5831—involuntary skeletal muscle contraction; Category No. 5832—involved in preinitiation complex assembly; Category No. 5833—inward rectifier potassium channel activity; Category No. 5834—inward rectifier potassium channel complex; Category No. 5835—inward rectifier potassium channel inhibitor activity; Category No. 5836—iodide peroxidase activity; Category No. 5837—iodide transmembrane transporter activity; Category No. 5838—iodide transport; Category No. 5839—ion binding; Category No. 5840—ion channel activity; Category No. 5841—ion channel binding; Category No. 5842—Ion channel complex; Category No. 5843—ion channel inhibitor activity; Category No. 5844—ion gated channel activity; Category No. 5845—Ion homeostasis; Category No. 5846—ion transmembrane transport; Category No. 5847—ion transmembrane transporter activity; Category No. 5848—ion transport; Category No. 5849—ionotropic glutamate receptor activity; Category No. 5850—ionotropic glutamate receptor binding; Category No. 5851—ionotropic glutamate receptor complex; Category No. 5852—ionotropic glutamate receptor signaling pathway; Category No. 5853—IPAF inflammasome complex; Category No. 5854—Ire1 complex; Category No. 5855—IRE1-mediated unfolded protein response; Category No. 5856—IRE1-RACK1-PP2A complex; Category No. 5857—IRE1-TRAF2-ASK1 complex; Category No. 5858—IRES-dependent translational initiation; Category No. 5859—iris morphogenesis; Category No. 5860—iron assimilation by chelation and transport; Category No. 5861—iron channel activity; Category No. 5862—iron channel inhibitor activity; Category No. 5863—iron chaperone activity; Category No. 5864—iron incorporation into metallo-sulfur cluster; Category No. 5865—iron ion binding; Category No. 5866—iron ion homeostasis; Category No. 5867—iron ion import; Category No. 5868—iron ion import into cell; Category No. 5869—iron ion transmembrane transport; Category No. 5870—iron ion transmembrane transporter activity; Category No. 5871—iron ion transport; Category No. 5872—iron-cytochrome-c reductase activity; Category No. 5873—iron-responsive element binding; Category No. 5874—iron-sulfur cluster assembly; Category No. 5875—iron-sulfur cluster binding; Category No. 5876—iron-sulfur transferase activity; Category No. 5877—ISG15 activating enzyme activity; Category No. 5878—ISG15 transferase activity; Category No. 5879—ISG15-protein conjugation; Category No. 5880—ISG15-specific protease activity; Category No. 5881—islet amyloid polypeptide processing; Category No. 5882—I-SMAD binding; Category No. 5883—isoamylase complex; Category No. 5884—isocitrate dehydrogenase (NAD+) activity; Category No. 5885—isocitrate dehydrogenase (NADP+) activity; Category No. 5886—isocitrate dehydrogenase activity; Category No. 5887—isocitrate metabolic process; Category No. 5888—isoleucine catabolic process; Category No. 5889—isoleucine metabolic process; Category No. 5890—isoleucine-tRNA ligase activity; Category No. 5891—isoleucyl-tRNA aminoacylation; Category No. 5892—isomerase activity; Category No. 5893—isopentenyl diphosphate biosynthetic process; Category No. 5894—isopentenyl diphosphate metabolic process; Category No. 5895—isopentenyl-diphosphate delta-isomerase activity; Category No. 5896—isopeptide cross-linking via N6-(L-isoglutamyl)-L-lysine; Category No. 5897—isoprenoid binding; Category No. 5898—isoprenoid biosynthetic process; Category No. 5899—isoprenoid metabolic process; Category No. 5900—isoquinoline alkaloid metabolic process; Category No. 5901—isotype switching; Category No. 5902—isotype switching to IgG isotypes; Category No. 5903—isovaleryl-CoA dehydrogenase activity; Category No. 5904—ISWI-type complex; Category No. 5905—ITP binding; Category No. 5906—ITP catabolic process; Category No. 5907—ITP diphosphatase activity; Category No. 5908—ITP metabolic process; Category No. 5909—JAK pathway signal transduction adaptor activity; Category No. 5910—JAK-STAT cascade; Category No. 5911—JAK-STAT cascade involved in growth hormone signaling pathway; Category No. 5912—JNK cascade; Category No. 5913—JUN kinase activity; Category No. 5914—JUN kinase binding; Category No. 5915—JUN kinase kinase activity; Category No. 5916—JUN kinase kinase kinase activity; Category No. 5917—JUN kinase phosphatase activity; Category No. 5918—JUN phosphorylation; Category No. 5919—junctional membrane complex; Category No. 5920—junctional sarcoplasmic reticulum membrane; Category No. 5921—juxtaparanode region of axon; Category No. 5922—K48-linked polyubiquitin binding; Category No. 5923—K63-linked polyubiquitin binding; Category No. 5924—K6-linked polyubiquitin binding; Category No. 5925—kainate selective glutamate receptor activity; Category No. 5926—kainate selective glutamate receptor complex; Category No. 5927—kappa-type opioid receptor binding; Category No. 5928—katanin complex; Category No. 5929—KDEL sequence binding; Category No. 5930—keratan sulfate biosynthetic process; Category No. 5931—keratan sulfate catabolic process; Category No. 5932—keratan sulfate metabolic process; Category No. 5933—keratan sulfotransferase activity; Category No. 5934—keratin filament; Category No. 5935—keratin filament binding; Category No. 5936—keratinization; Category No. 5937—keratinocyte activation; Category No. 5938—keratinocyte development; Category No. 5939—keratinocyte differentiation; Category No. 5940—keratinocyte migration; Category No. 5941—keratinocyte proliferation; Category No. 5942—keratohyalin granule; Category No. 5943—ketohexokinase activity; Category No. 5944—ketone body biosynthetic process; Category No. 5945—ketone body catabolic process; Category No. 5946—ketone catabolic process; Category No. 5947—ketoreductase activity; Category No. 5948—ketosteroid monooxygenase activity; Category No. 5949—kidney development; Category No. 5950—kidney epithelium development; Category No. 5951—kidney morphogenesis; Category No. 5952—kidney rudiment formation; Category No. 5953—killing by host of symbiont cells; Category No. 5954—killing of cells of other organism; Category No. 5955—kinase activator activity; Category No. 5956—kinase activity; Category No. 5957—kinase binding; Category No. 5958—kinase inhibitor activity; Category No. 5959—kinase regulator activity; Category No. 5960—kinesin binding; Category No. 5961—kinesin complex; Category No. 5962—kinesin I complex; Category No. 5963—kinesin II complex; Category No. 5964—kinetochore; Category No. 5965—kinetochore assembly; Category No. 5966—kinetochore binding; Category No. 5967—kinetochore microtubule; Category No. 5968—kinetochore organization; Category No. 5969—kininogen binding; Category No. 5970—kinocillary basal body; Category No. 5971—kinocilium; Category No. 5972—kisspeptin receptor binding; Category No. 5973—Kit signaling pathway; Category No. 5974—kringle domain binding; Category No. 5975—Krueppel-associated box domain binding; Category No. 5976—Ku70:Ku80 complex; Category No. 5977—Kupffer's vesicle development; Category No. 5978—kynurenic acid biosynthetic process; Category No. 5979—kynureninase activity; Category No. 5980—kynurenine 3-monooxygenase activity; Category No. 5981—kynurenine metabolic process; Category No. 5982—kynurenine-glyoxylate transaminase activity; Category No. 5983—kynurenine-oxoglutarate transaminase activity; Category No. 5984—L27 domain binding; Category No. 5985—labyrinthine layer blood vessel development; Category No. 5986—labyrinthine layer development; Category No. 5987—labyrinthine layer morphogenesis; Category No. 5988—lacrimal gland development; Category No. 5989—lactase activity; Category No. 5990—lactate biosynthetic process; Category No. 5991—lactate biosynthetic process from pyruvate; Category No. 5992—lactate dehydrogenase activity; Category No. 5993—lactate metabolic process; Category No. 5994—lactate oxidation; Category No. 5995—lactate transmembrane transport; Category No. 5996—lactate transmembrane transporter activity; Category No. 5997—lactate transport; Category No. 5998—lactation; Category No. 5999—lactose binding; Category No. 6000—lactose biosynthetic process; Category No. 6001—lactose synthase activity; Category No. 6002—lactosylceramide 1,3-N-acetyl-beta-D-glucosaminyltransferase activity; Category No. 6003—lactosylceramide 4-alpha-galactosyltransferase activity; Category No. 6004—lactosylceramide alpha-2,3-sialyltransferase activity; Category No. 6005—lactoylglutathione lyase activity; Category No. 6006—lagging strand elongation; Category No. 6007—L-alanine catabolic process; Category No. 6008—L-alanine metabolic process; Category No. 6009—L-alanine transmembrane transporter activity; Category No. 6010—L-alanine transport; Category No. 6011—L-alanine:2-oxoglutarate aminotransferase activity; Category No. 6012—L-allo-threonine aldolase activity; Category No. 6013—L-alpha-amino acid transmembrane transport; Category No. 6014—lambdoid suture morphogenesis; Category No. 6015—lamellar body; Category No. 6016—lamellar body membrane; Category No. 6017—lamellipodium; Category No. 6018—lamellipodium assembly; Category No. 6019—lamellipodium membrane; Category No. 6020—lamellipodium morphogenesis; Category No. 6021—lamellipodium organization; Category No. 6022—lamin binding; Category No. 6023—lamin filament; Category No. 6024—laminin binding; Category No. 6025—laminin complex; Category No. 6026—laminin receptor activity; Category No. 6027—laminin-1 binding; Category No. 6028—laminin-1 complex; Category No. 6029—laminin-10 complex; Category No. 6030—laminin-11 complex; Category No. 6031—laminin-2 complex; Category No. 6032—laminin-3 complex; Category No. 6033—laminin-5 complex; Category No. 6034—laminin-8 complex; Category No. 6035—L-amino acid transmembrane transporter activity; Category No. 6036—L-amino acid transport; Category No. 6037—L-amino-acid oxidase activity; Category No. 6038—L-aminoadipate-semialdehyde dehydrogenase activity; Category No. 6039—L-arabinose metabolic process; Category No. 6040—large conductance calcium-activated potassium channel activity; Category No. 6041—large ribosomal subunit; Category No. 6042—large ribosomal subunit rRNA binding; Category No. 6043—large subunit precursor; Category No. 6044—L-arginine import; Category No. 6045—L-arginine import across plasma membrane; Category No. 6046—L-arginine transmembrane transporter activity; Category No. 6047—L-arginine transport; Category No. 6048—L-ascorbate:sodium symporter activity; Category No. 6049—L-ascorbic acid binding; Category No. 6050—L-ascorbic acid biosynthetic process; Category No. 6051—L-ascorbic acid metabolic process; Category No. 6052—L-ascorbic acid transport; Category No. 6053—L-ascorbic acid transporter activity; Category No. 6054—L-asparagine biosynthetic process; Category No. 6055—L-asparagine transmembrane transporter activity; Category No. 6056—L-aspartate transmembrane transport; Category No. 6057—L-aspartate transmembrane transporter activity; Category No. 6058—L-aspartate:2-oxoglutarate aminotransferase activity; Category No. 6059—late endosome; Category No. 6060—late endosome membrane; Category No. 6061—late endosome to Golgi transport; Category No. 6062—late endosome to lysosome transport; Category No. 6063—late endosome to vacuole transport; Category No. 6064—late nucleophagy; Category No. 6065—late viral transcription; Category No. 6066—lateral element; Category No. 6067—lateral element assembly; Category No. 6068—lateral ganglionic eminence cell proliferation; Category No. 6069—lateral geniculate nucleus development; Category No. 6070—lateral inhibition; Category No. 6071—lateral loop; Category No. 6072—lateral mesoderm development; Category No. 6073—lateral mesoderm formation; Category No. 6074—lateral motor column neuron migration; Category No. 6075—lateral plasma membrane; Category No. 6076—lateral semicircular canal development; Category No. 6077—lateral sprouting from an epithelium; Category No. 6078—lateral sprouting involved in lung morphogenesis; Category No. 6079—lateral sprouting involved in mammary gland duct morphogenesis; Category No. 6080—lateral ventricle development; Category No. 6081—latrotoxin receptor activity; Category No. 6082—layer formation in cerebral cortex; Category No. 6083—LBD domain binding; Category No. 6084—L-cysteine catabolic process; Category No. 6085—L-cysteine desulfhydrase activity; Category No. 6086—L-cysteine metabolic process; Category No. 6087—L-cysteine:2-oxoglutarate aminotransferase activity; Category No. 6088—L-cystine L-cysteine-lyase (deaminating); Category No. 6089—L-cystine transmembrane transporter activity; Category No. 6090—L-cystine transport; Category No. 6091—L-DOPA binding; Category No. 6092—L-dopa decarboxylase activator activity; Category No. 6093—L-dopa decarboxylase activity; Category No. 6094—L-DOPA receptor activity; Category No. 6095—lead ion binding; Category No. 6096—lead ion transmembrane transporter activity; Category No. 6097—lead ion transport; Category No. 6098—leading edge cell differentiation; Category No. 6099—leading edge membrane; Category No. 6100—leading strand elongation; Category No. 6101—leak channel activity; Category No. 6102—learning; Category No. 6103—learning or memory; Category No. 6104—lectin pathway; Category No. 6105—left lung development; Category No. 6106—left lung morphogenesis; Category No. 6107—left right axis specification; Category No. 6108—left right pattern formation; Category No. 6109—left ventricular cardiac muscle tissue morphogenesis; Category No. 6110—left-handed Z-DNA binding; Category No. 6111—lens development in camera-type eye; Category No. 6112—lens fiber cell apoptotic process; Category No. 6113—lens fiber cell development; Category No. 6114—lens fiber cell differentiation; Category No. 6115—lens fiber cell morphogenesis; Category No. 6116—lens induction in camera-type eye; Category No. 6117—lens morphogenesis in camera-type eye; Category No. 6118—leptin receptor binding; Category No. 6119—leptin-mediated signaling pathway; Category No. 6120—leptomycin B sensitive; Category No. 6121—leucine binding; Category No. 6122—leucine catabolic process; Category No. 6123—leucine import; Category No. 6124—leucine metabolic process; Category No. 6125—leucine rich repeat containing receptor signaling pathway; Category No. 6126—leucine transport; Category No. 6127—leucine zipper domain binding; Category No. 6128—leucine-tRNA ligase activity; Category No. 6129—leucyl-tRNA aminoacylation; Category No. 6130—leukemia inhibitory factor receptor activity; Category No. 6131—leukemia inhibitory factor receptor binding; Category No. 6132—leukemia inhibitory factor signaling pathway; Category No. 6133—leukocyte activation; Category No. 6134—leukocyte activation involved in immune response; Category No. 6135—leukocyte adhesive activation; Category No. 6136—leukocyte aggregation; Category No. 6137—leukocyte cell-cell adhesion; Category No. 6138—leukocyte chemotaxis; Category No. 6139—leukocyte chemotaxis involved in inflammatory response; Category No. 6140—leukocyte degranulation; Category No. 6141—leukocyte differentiation; Category No. 6142—leukocyte homeostasis; Category No. 6143—leukocyte mediated cytotoxicity; Category No. 6144—leukocyte mediated immunity; Category No. 6145—leukocyte migration; Category No. 6146—leukocyte migration involved in immune response; Category No. 6147—leukocyte migration involved in inflammatory response; Category No. 6148—leukocyte proliferation; Category No. 6149—leukocyte tethering or rolling; Category No. 6150—leukotriene A4 metabolic process; Category No. 6151—leukotriene B4 catabolic process; Category No. 6152—leukotriene B4 receptor activity; Category No. 6153—leukotriene biosynthetic process; Category No. 6154—leukotriene metabolic process; Category No. 6155—leukotriene production involved in inflammatory response; Category No. 6156—leukotriene receptor activity; Category No. 6157—leukotriene signaling pathway; Category No. 6158—leukotriene-A4 hydrolase activity; Category No. 6159—leukotriene-B4 20-monooxygenase activity; Category No. 6160—leukotriene-C4 synthase activity; Category No. 6161—Lewy body; Category No. 6162—Lewy body core; Category No. 6163—Leydig cell differentiation; Category No. 6164—L-fuconate dehydratase activity; Category No. 6165—L-fucose catabolic process; Category No. 6166—L-glucuronate reductase activity; Category No. 6167—L-glutamate import; Category No. 6168—L-glutamate import into cell; Category No. 6169—L-glutamate transmembrane transport; Category No. 6170—L-glutamate transmembrane transporter activity; Category No. 6171—L-glutamate transport; Category No. 6172—L-glutamate-forming) activity; Category No. 6173—L-glutamine transmembrane transporter activity; Category No. 6174—L-glutamine:pyruvate aminotransferase activity; Category No. 6175—L-gulonate 3-dehydrogenase activity; Category No. 6176—L-histidine transmembrane transport; Category No. 6177—L-histidine transmembrane transporter activity; Category No. 6178—L-hydroxyproline transmembrane transporter activity; Category No. 6179—lid subcomplex; Category No. 6180—L-iditol 2-dehydrogenase activity; Category No. 6181—L-iduronidase activity; Category No. 6182—ligand-activated RNA polymerase II transcription factor binding; Category No. 6183—ligand-activated sequence-specific DNA binding; Category No. 6184—ligand-dependent nuclear receptor binding; Category No. 6185—ligand-dependent nuclear receptor transcription coactivator activity; Category No. 6186—ligand-gated ion channel activity; Category No. 6187—ligand-gated sodium channel activity; Category No. 6188—ligase activity; Category No. 6189—ligase regulator activity; Category No. 6190—LIM domain binding; Category No. 6191—limb bud formation; Category No. 6192—limb development; Category No. 6193—limb epidermis development; Category No. 6194—limb morphogenesis; Category No. 6195—limbic system development; Category No. 6196—LINC complex; Category No. 6197—linear polyubiquitin binding; Category No. 6198—linear vestibuloocular reflex; Category No. 6199—linoleate 13S-lipoxygenase activity; Category No. 6200—linoleate 9S-lipoxygenase activity; Category No. 6201—linoleic acid binding; Category No. 6202—linoleic acid epoxygenase activity; Category No. 6203—linoleic acid metabolic process; Category No. 6204—linoleoyl-CoA desaturase activity; Category No. 6205—lipase activator activity; Category No. 6206—lipase activity; Category No. 6207—lipase binding;

Category No. 6208—lipase inhibitor activity; Category No. 6209—lipid antigen binding; Category No. 6210—lipid binding; Category No. 6211—lipid biosynthetic process; Category No. 6212—lipid catabolic process; Category No. 6213—lipid digestion; Category No. 6214—lipid glycosylation; Category No. 6215—lipid homeostasis; Category No. 6216—lipid hydroperoxide transport; Category No. 6217—lipid kinase activity; Category No. 6218—lipid localization; Category No. 6219—lipid metabolic process; Category No. 6220—lipid modification; Category No. 6221—lipid oxidation; Category No. 6222—lipid particle; Category No. 6223—lipid particle organization; Category No. 6224—lipid phosphatase activity; Category No. 6225—lipid phosphorylation; Category No. 6226—lipid storage; Category No. 6227—lipid transport; Category No. 6228—lipid transport across blood brain barrier; Category No. 6229—lipid transporter activity; Category No. 6230—lipid tube; Category No. 6231—lipid tube assembly; Category No. 6232—lipid tube assembly involved in organelle fusion; Category No. 6233—lipid-transporting ATPase activity; Category No. 6234—lipoamidase activity; Category No. 6235—lipoamide binding; Category No. 6236—lipoate biosynthetic process; Category No. 6237—lipoate metabolic process; Category No. 6238—lipoate synthase activity; Category No. 6239—lipoic acid binding; Category No. 6240—lipopeptide binding; Category No. 6241—lipophagy; Category No. 6242—lipopolysaccharide binding; Category No. 6243—lipopolysaccharide biosynthetic process; Category No. 6244—lipopolysaccharide metabolic process; Category No. 6245—lipopolysaccharide receptor activity; Category No. 6246—lipopolysaccharide receptor complex; Category No. 6247—lipopolysaccharide transport; Category No. 6248—lipopolysaccharide-mediated signaling pathway; Category No. 6249—lipoprotein biosynthetic process; Category No. 6250—lipoprotein catabolic process; Category No. 6251—lipoprotein lipase activator activity; Category No. 6252—lipoprotein lipase activity; Category No. 6253—lipoprotein metabolic process; Category No. 6254—lipoprotein particle binding; Category No. 6255—lipoprotein particle receptor binding; Category No. 6256—lipoprotein transport; Category No. 6257—lipoprotein transporter activity; Category No. 6258—lipoteichoic acid binding; Category No. 6259—lipoteichoic acid receptor activity; Category No. 6260—lipoxin A4 biosynthetic process; Category No. 6261—lipoxin B4 biosynthetic process; Category No. 6262—lipoxin metabolic process; Category No. 6263—lipoxygenase pathway; Category No. 6264—lipoyl(octanoyl) transferase activity; Category No. 6265—L-isoleucine transaminase activity; Category No. 6266—lithium ion binding; Category No. 6267—lithocholic acid binding; Category No. 6268—lithocholic acid receptor activity; Category No. 6269—liver development; Category No. 6270—liver morphogenesis; Category No. 6271—liver regeneration; Category No. 6272—L-kynurenine catabolic process; Category No. 6273—L-kynurenine metabolic process; Category No. 6274—L-lactate dehydrogenase activity; Category No. 6275—L-leucine transaminase activity; Category No. 6276—L-leucine transmembrane transporter activity; Category No. 6277—L-lysine catabolic process; Category No. 6278—L-lysine catabolic process to acetyl-CoA via L-pipecolate; Category No. 6279—L-lysine catabolic process to acetyl-CoA via saccharopine; Category No. 6280—L-lysine import across plasma membrane; Category No. 6281—L-lysine transmembrane transport; Category No. 6282—L-lysine transmembrane transporter activity; Category No. 6283—L-lysine-forming) activity; Category No. 6284—L-malate dehydrogenase activity; Category No. 6285—L-methionine biosynthetic process from methylthioadenosine; Category No. 6286—L-methionine biosynthetic process from S-adenosylmethionine; Category No. 6287—L-methionine salvage; Category No. 6288—L-methionine transmembrane transporter activity; Category No. 6289—L-methylmalonyl-CoA metabolic process; Category No. 6290—lobar bronchus development; Category No. 6291—lobar bronchus epithelium development; Category No. 6292—localization within membrane; Category No. 6293—locomotion; Category No. 6294—locomotion involved in locomotory behavior; Category No. 6295—locomotor rhythm; Category No. 6296—locomotory behavior; Category No. 6297—locomotory exploration behavior; Category No. 6298—locus ceruleus development; Category No. 6299—long term synaptic depression; Category No. 6300—long-chain acyl-CoA hydrolase activity; Category No. 6301—long-chain fatty acid binding; Category No. 6302—long-chain fatty acid biosynthetic process; Category No. 6303—long-chain fatty acid catabolic process; Category No. 6304—long-chain fatty acid import; Category No. 6305—long-chain fatty acid metabolic process; Category No. 6306—long-chain fatty acid transport; Category No. 6307—long-chain fatty acid transporter activity; Category No. 6308—long-chain fatty acid-CoA ligase activity; Category No. 6309—long-chain fatty acyl-CoA binding; Category No. 6310—long-chain fatty-acyl-CoA biosynthetic process; Category No. 6311—long-chain fatty-acyl-CoA catabolic process; Category No. 6312—long-chain fatty-acyl-CoA metabolic process; Category No. 6313—long-chain-(S)-2-hydroxy-long-chain-acid oxidase activity; Category No. 6314—long-chain-3-hydroxyacyl-CoA dehydrogenase activity; Category No. 6315—long-chain-acyl-CoA dehydrogenase activity; Category No. 6316—long-chain-alcohol 0-fatty-acyltransferase activity; Category No. 6317—long-chain-alcohol oxidase activity; Category No. 6318—long-chain-aldehyde dehydrogenase activity; Category No. 6319—long-chain-enoyl-CoA hydratase activity; Category No. 6320—long-chain-fatty-acyl-CoA reductase activity; Category No. 6321—longitudinal sarcoplasmic reticulum; Category No. 6322—long-term memory; Category No. 6323—long-term synaptic potentiation; Category No. 6324—loop of Henle development; Category No. 6325—L-ornithine import across plasma membrane; Category No. 6326—L-ornithine transmembrane transport; Category No. 6327—L-ornithine transmembrane transporter activity; Category No. 6328—low voltage-gated calcium channel activity; Category No. 6329—low-affinity glucose:sodium symporter activity; Category No. 6330—low-affinity L-arginine transmembrane transporter activity; Category No. 6331—low-affinity phosphate transmembrane transporter activity; Category No. 6332—low-affinity sodium:dicarboxylate symporter activity; Category No. 6333—low-density lipoprotein particle; Category No. 6334—low-density lipoprotein particle binding; Category No. 6335—low-density lipoprotein particle clearance; Category No. 6336—low-density lipoprotein particle mediated signaling; Category No. 6337—low-density lipoprotein particle receptor binding; Category No. 6338—low-density lipoprotein particle receptor biosynthetic process; Category No. 6339—low-density lipoprotein particle receptor catabolic process; Category No. 6340—low-density lipoprotein particle remodeling; Category No. 6341—low-density lipoprotein receptor activity; Category No. 6342—low-density lipoprotein receptor particle metabolic process; Category No. 6343—L-phenylalanine catabolic process; Category No. 6344—L-phenylalanine metabolic process; Category No. 6345—L-phenylalanine transmembrane transporter activity; Category No. 6346—L-phenylalanine:2-oxoglutarate aminotransferase activity; Category No. 6347—L-phenylalanine:pyruvate aminotransferase activity; Category No. 6348—L-pipecolate oxidase activity; Category No. 6349—L-proline biosynthetic process; Category No. 6350—L-proline transmembrane transporter activity; Category No. 6351—LRR domain binding; Category No. 6352—Lsd1 2 complex; Category No. 6353—L-serine ammonia-lyase activity; Category No. 6354—L-serine biosynthetic process; Category No. 6355—L-serine catabolic process; Category No. 6356—L-serine metabolic process; Category No. 6357—L-serine transmembrane transporter activity; Category No. 6358—L-serine transport; Category No. 6359—Lsm1-7-Pat1 complex; Category No. 6360—LSU-rRNA); Category No. 6361—L-threonine ammonia-lyase activity; Category No. 6362—L-threonine catabolic process to glycine; Category No. 6363—L-threonine transmembrane transporter activity; Category No. 6364—L-tryptophan transmembrane transporter activity; Category No. 6365—L-type voltage-gated calcium channel complex; Category No. 6366—L-tyrosine transmembrane transporter activity; Category No. 6367—L-tyrosine:2-oxoglutarate aminotransferase activity; Category No. 6368—LUBAC complex; Category No. 6369—lubricant activity; Category No. 6370—lumenal side of Golgi membrane; Category No. 6371—lung alveolus development; Category No. 6372—lung cell differentiation; Category No. 6373—lung ciliated cell differentiation; Category No. 6374—lung connective tissue development; Category No. 6375—lung development; Category No. 6376—lung epithelial cell differentiation; Category No. 6377—lung epithelium development; Category No. 6378—lung goblet cell differentiation; Category No. 6379—lung growth; Category No. 6380—lung induction; Category No. 6381—lung lobe development; Category No. 6382—lung lobe formation; Category No. 6383—lung lobe morphogenesis; Category No. 6384—lung morphogenesis; Category No. 6385—lung neuroendocrine cell differentiation; Category No. 6386—lung proximal distal axis specification; Category No. 6387—lung saccule development; Category No. 6388—lung smooth muscle development; Category No. 6389—lung vasculature development; Category No. 6390—lung-associated mesenchyme development; Category No. 6391—luteinization; Category No. 6392—luteinizing hormone receptor activity; Category No. 6393—luteinizing hormone secretion; Category No. 6394—luteinizing hormone signaling pathway; Category No. 6395—luteolysis; Category No. 6396—lutropin-choriogonadotropic hormone receptor binding; Category No. 6397—L-valine transaminase activity; Category No. 6398—L-xylitol catabolic process; Category No. 6399—L-xylitol metabolic process; Category No. 6400—L-xylulose reductase (NADP+) activity; Category No. 6401—lyase activity; Category No. 6402—lymph circulation; Category No. 6403—lymph node development; Category No. 6404—lymph vessel development; Category No. 6405—lymph vessel morphogenesis; Category No. 6406—lymphanglogenesis; Category No. 6407—lymphatic endothelial cell differentiation; Category No. 6408—lymphocyte activation; Category No. 6409—lymphocyte aggregation; Category No. 6410—lymphocyte chemotaxis; Category No. 6411—lymphocyte chemotaxis across high endothelial venule; Category No. 6412—lymphocyte differentiation; Category No. 6413—lymphocyte homeostasis; Category No. 6414—lymphocyte migration; Category No. 6415—lymphocyte migration into lymph node; Category No. 6416—lymphocyte migration into lymphoid organs; Category No. 6417—lymphocyte proliferation; Category No. 6418—lymphoid lineage cell migration into thymus; Category No. 6419—lymphoid progenitor cell differentiation; Category No. 6420—lymphotoxin A biosynthetic process; Category No. 6421—Lys48-specific deubiquitinase activity; Category No. 6422—Lys63-specific deubiquitinase activity; Category No. 6423—lysine biosynthetic process via aminoadipic acid; Category No. 6424—lysine catabolic process; Category No. 6425—lysine N-acetyltransferase activity; Category No. 6426—lysine transport; Category No. 6427—lysine-acetylated histone binding; Category No. 6428—lysine-tRNA ligase activity; Category No. 6429—lysobisphosphatidic acid metabolic process; Category No. 6430—lysophosphatidic acid acyltransferase activity; Category No. 6431—lysophosphatidic acid binding; Category No. 6432—lysophosphatidic acid phosphatase activity; Category No. 6433—lysophosphatidic acid receptor activity; Category No. 6434—lysophospholipase activity; Category No. 6435—lysophospholipid acyltransferase activity; Category No. 6436—lysophospholipid transport; Category No. 6437—lysosomal lumen; Category No. 6438—lysosomal lumen acidification; Category No. 6439—lysosomal lumen pH elevation; Category No. 6440—lysosomal membrane; Category No. 6441—lysosomal membrane organization; Category No. 6442—lysosomal transport; Category No. 6443—lysosome; Category No. 6444—lysosome localization; Category No. 6445—lysosome organization; Category No. 6446—lysozyme activity; Category No. 6447—lysyl-tRNA aminoacylation; Category No. 6448—lytic vacuole; Category No. 6449—M band; Category No. 6450—m7G (5')pppN diphosphatase activity; Category No. 6451—macroautophagy; Category No. 6452—macrolide binding; Category No. 6453—macromitophagy; Category No. 6454—macromolecular complex; Category No. 6455—macromolecule biosynthetic process; Category No. 6456—macromolecule depalmitoylation; Category No. 6457—macromolecule glycosylation; Category No. 6458—macromolecule modification; Category No. 6459—macrophage activation; Category No. 6460—macrophage activation involved in immune response; Category No. 6461—macrophage apoptotic process; Category No. 6462—macrophage chemotaxis; Category No. 6463—macrophage colony-stimulating factor receptor activity; Category No. 6464—macrophage colony-stimulating factor receptor binding; Category No. 6465—macrophage colony-stimulating factor signaling pathway; Category No. 6466—macrophage cytokine production; Category No. 6467—macrophage derived foam cell differentiation; Category No. 6468—macrophage differentiation; Category No. 6469—macrophage inflammatory protein-1 alpha production; Category No. 6470—macrophage migration inhibitory factor binding; Category No. 6471—macrophage migration inhibitory factor receptor complex; Category No. 6472—macrophage migration inhibitory factor signaling pathway; Category No. 6473—macropinocytic cup; Category No. 6474—macropinocytosis; Category No. 6475—macropinosome; Category No. 6476—MADS box domain binding; Category No. 6477—magnesium chelatase activity; Category No. 6478—magnesium ion binding; Category No. 6479—magnesium ion homeostasis; Category No. 6480—magnesium ion transmembrane transport; Category No. 6481—magnesium ion transmembrane transporter activity; Category No. 6482—magnesium ion transport; Category No. 6483—magnesium-dependent protein serine threonine phosphatase activity; Category No. 6484—main axon; Category No. 6485—maintenance of blood-brain barrier; Category No. 6486—maintenance of cell number; Category No. 6487—maintenance of cell polarity; Category No. 6488—maintenance of centrosome location; Category No. 6489— maintenance of chromatin silencing; Category No. 6490—maintenance of DNA methylation; Category No. 6491—maintenance of DNA repeat elements; Category No. 6492—maintenance of epithelial cell apical basal polarity; Category No. 6493—maintenance of ER location; Category No. 6494—maintenance of gastrointestinal epithelium; Category No. 6495—maintenance of Golgi location; Category No. 6496—maintenance of granzyme B location in T cell secretory granule; Category No. 6497—maintenance of lens transparency; Category No. 6498—maintenance of location in cell; Category No. 6499—maintenance of mitochondrion location; Category No. 6500—maintenance of mitotic sister chromatid cohesion; Category No. 6501—maintenance of organ identity; Category No. 6502—maintenance of presynaptic active zone structure; Category No. 6503—maintenance of protease location in mast cell secretory granule; Category No. 6504—maintenance of protein localization in endoplasmic reticulum; Category No. 6505—maintenance of protein location; Category No. 6506—maintenance of protein location in cell; Category No. 6507—maintenance of protein location in mitochondrion; Category No. 6508—maintenance of protein location in nucleus; Category No. 6509—maintenance of protein location in plasma membrane; Category No. 6510—maintenance of symbiont-containing vacuole by host; Category No. 6511—maintenance of transcriptional fidelity during DNA-templated transcription elongation from RNA polymerase II promoter; Category No. 6512—maintenance of translational fidelity; Category No. 6513—maintenance of unfolded protein involved in ERAD pathway; Category No. 6514—malate dehydrogenase (decarboxylating) (NAD+) activity; Category No. 6515—malate dehydrogenase (decarboxylating) (NADP+) activity; Category No. 6516—malate dehydrogenase (NADP+) activity; Category No. 6517—malate dehydrogenase activity; Category No. 6518—malate metabolic process; Category No. 6519—malate synthase activity; Category No. 6520—malate-aspartate shuttle; Category No. 6521—male courtship behavior; Category No. 6522—male gamete generation; Category No. 6523—male genitalia development; Category No. 6524—male genitalia morphogenesis; Category No. 6525—male germ cell nucleus; Category No. 6526—male germ cell proliferation; Category No. 6527—male germ-line sex determination; Category No. 6528—male germ-line stem cell asymmetric division; Category No. 6529—male germ-line stem cell population maintenance; Category No. 6530—male gonad development; Category No. 6531—male mating behavior; Category No. 6532—male meiosis; Category No. 6533—male meiosis chromosome segregation; Category No. 6534—male meiosis chromosome separation; Category No. 6535—male meiosis I; Category No. 6536—male pronucleus; Category No. 6537—male pronucleus assembly; Category No. 6538—male sex determination; Category No. 6539—male sex differentiation; Category No. 6540—male somatic sex determination; Category No. 6541—maleylacetoacetate isomerase activity; Category No. 6542—malic enzyme activity; Category No. 6543—malonate catabolic process; Category No. 6544—malonate-semialdehyde dehydrogenase (acetylating) activity; Category No. 6545—malonyl-CoA biosynthetic process; Category No. 6546—malonyl-CoA catabolic process; Category No. 6547—malonyl-CoA decarboxylase activity; Category No. 6548—malonyl-CoA synthetase activity; Category No. 6549—maltose alpha-glucosidase activity; Category No. 6550—maltose metabolic process; Category No. 6551—MAML1-RBP-Jkappa-ICN1 complex; Category No. 6552—mammary duct terminal end bud growth; Category No. 6553—mammary gland alveolus development; Category No. 6554—mammary gland branching involved in pregnancy; Category No. 6555—mammary gland branching involved in thelarche; Category No. 6556—mammary gland bud elongation; Category No. 6557—mammary gland bud formation; Category No. 6558—mammary gland bud morphogenesis; Category No. 6559—mammary gland development; Category No. 6560—mammary gland duct morphogenesis; Category No. 6561—mammary gland epithelial cell differentiation; Category No. 6562—mammary gland epithelial cell proliferation; Category No. 6563—mammary gland epithelium development; Category No. 6564—mammary gland fat development; Category No. 6565—mammary gland formation; Category No. 6566—mammary gland involution; Category No. 6567—mammary gland lobule development; Category No. 6568—mammary gland morphogenesis; Category No. 6569—mammary gland specification; Category No. 6570—mammary placode formation; Category No. 6571—mammillary body development; Category No. 6572—mammillothalamic axonal tract development; Category No. 6573—manchette; Category No. 6574—manganese ion binding; Category No. 6575—manganese ion transmembrane transport; Category No. 6576—manganese ion transmembrane transporter activity; Category No. 6577—manganese ion transport; Category No. 6578—manganese-transporting ATPase activity; Category No. 6579—mannan binding; Category No. 6580—mannan catabolic process; Category No. 6581—mannitol transport; Category No. 6582—mannokinase activity; Category No. 6583—mannose binding; Category No. 6584—mannose metabolic process; Category No. 6585—mannose to fructose-6-phosphate metabolic process; Category No. 6586—mannose transmembrane transporter activity; Category No. 6587—mannose transport; Category No. 6588—mannose trimming involved in glycoprotein ERAD pathway; Category No. 6589—mannose-1-phosphate guanylyltransferase activity; Category No. 6590—mannose-6-phosphate isomerase activity; Category No. 6591—mannose-ethanolamine phosphotransferase activity; Category No. 6592—mannosidase activity; Category No. 6593—mannosylation; Category No. 6594—mannosyl-glycoprotein endo-beta-N-acetylglucosaminidase activity; Category No. 6595—mannosyl-oligosaccharide 1,2-alpha-mannosidase activity; Category No. 6596—mannosyl-oligosaccharide 1,3-1,6-alpha-mannosidase activity; Category No. 6597—mannosyl-oligosaccharide glucosidase activity; Category No. 6598—mannosyltransferase activity; Category No. 6599—mannosyltransferase complex; Category No. 6600—MAP kinase activity; Category No. 6601—MAP kinase kinase activity; Category No. 6602—MAP kinase kinase kinase activity; Category No. 6603—MAP kinase kinase kinase kinase activity; Category No. 6604—MAP kinase phosphatase activity; Category No. 6605—MAP kinase tyrosine serine threonine phosphatase activity; Category No. 6606—MAPK cascade; Category No. 6607—MAPK export from nucleus; Category No. 6608—MAPK import into nucleus; Category No. 6609—MAPK phosphatase export from nucleus; Category No. 6610—MAP-kinase scaffold activity; Category No. 6611—marginal zone B cell differentiation; Category No. 6612—mast cell activation; Category No. 6613—mast cell chemotaxis; Category No. 6614—mast cell cytokine production; Category No. 6615—mast cell degranulation; Category No. 6616—mast cell differentiation; Category No. 6617—mast cell granule; Category No. 6618—mast cell mediated immunity; Category No. 6619—mast cell migration; Category No. 6620—mast cell proliferation; Category No. 6621—mast cell secretagogue receptor activity; Category No. 6622—mast cell secretory granule organization; Category No. 6623—maternal aggressive behavior; Category No. 6624—maternal behavior; Category No. 6625—maternal placenta development; Category No. 6626—maternal process involved in female pregnancy; Category No. 6627—maternal process involved in parturition; Category No. 6628—mating; Category No. 6629—mating behavior; Category No. 6630—mating plug formation; Category No. 6631—maturation of 5.8S rRNA; Category No. 6632—maturation of 5.8S rRNA from tricistronic rRNA transcript (SSU-rRNA; Category No. 6633—maturation of 5S rRNA; Category No. 6634—maturation of LSU-rRNA; Category No. 6635—maturation of LSU-rRNA from tricistronic rRNA transcript (SSU-rRNA; Category No. 6636—maturation of SSU-rRNA; Category No. 6637—maturation of SSU-rRNA from tricistronic rRNA transcript (SSU-rRNA; Category No. 6638—mature B cell differentiation; Category No. 6639—mature B cell differentiation involved in immune response; Category No. 6640—mature chylomicron; Category No. 6641—mature conventional dendritic cell differentiation; Category No. 6642—mature natural killer cell chemotaxis; Category No. 6643—mature ribosome assembly; Category No. 6644—MCM complex; Category No. 6645—MCM8-MCM9 complex; Category No. 6646—MDA-5 signaling pathway; Category No. 6647—MDM2 MDM4 family protein binding; Category No. 6648—mechanically-gated ion channel activity; Category No. 6649—mechanically-gated potassium channel activity; Category No. 6650—mechanoreceptor differentiation; Category No. 6651—mechanosensory behavior; Category No. 6652—medial motor column neuron differentiation; Category No. 6653—mediator complex; Category No. 6654—mediator complex binding; Category No. 6655—medium-chain acyl-CoA hydrolase activity; Category No. 6656—medium-chain fatty acid biosynthetic process; Category No. 6657—medium-chain fatty acid catabolic process; Category No. 6658—medium-chain fatty acid metabolic process; Category No. 6659—medium-chain fatty acid transport; Category No. 6660—medium-chain fatty-acyl-CoA catabolic process; Category No. 6661—medium-chain fatty-acyl-CoA metabolic process; Category No. 6662—medium-chain-(S)-2-hydroxy-acid oxidase activity; Category No. 6663—medium-chain-acyl-CoA dehydrogenase activity; Category No. 6664—medium-chain-aldehyde dehydrogenase activity; Category No. 6665—medullary reticular formation development; Category No. 6666—megakaryocyte development; Category No. 6667—megakaryocyte differentiation; Category No. 6668—meiosis I; Category No. 6669—meiotic attachment of telomere to nuclear envelope; Category No. 6670—meiotic cell cycle; Category No. 6671—meiotic cell cycle checkpoint; Category No. 6672—meiotic chromosome condensation; Category No. 6673—meiotic chromosome movement towards spindle pole; Category No. 6674—meiotic chromosome segregation; Category No. 6675—meiotic chromosome separation; Category No. 6676—meiotic cohesin complex; Category No. 6677—meiotic cytokinesis; Category No. 6678—meiotic DNA double-strand break formation; Category No. 6679—meiotic DNA integrity checkpoint; Category No. 6680—meiotic DNA recombinase assembly; Category No. 6681—meiotic DNA repair synthesis; Category No. 6682—meiotic DNA replication checkpoint; Category No. 6683—meiotic gene conversion; Category No. 6684—meiotic metaphase I plate congression; Category No. 6685—meiotic metaphase plate congression; Category No. 6686—meiotic mismatch repair; Category No. 6687—meiotic nuclear division; Category No. 6688—meiotic prophase I; Category No. 6689—meiotic recombination checkpoint; Category No. 6690—meiotic sister chromatid cohesion; Category No. 6691—meiotic sister chromatid cohesion involved in meiosis I; Category No. 6692—meiotic spindle; Category No. 6693—meiotic spindle elongation; Category No. 6694—meiotic spindle midzone assembly; Category No. 6695—meiotic spindle organization; Category No. 6696—meiotic telomere clustering; Category No. 6697—melanin biosynthetic process; Category No. 6698—melanin biosynthetic process from tyrosine; Category No. 6699—melanin metabolic process; Category No. 6700—melanin-concentrating hormone activity; Category No. 6701—melanin-concentrating hormone receptor activity; Category No. 6702—melanocortin receptor activity; Category No. 6703—melanocyte adhesion; Category No. 6704—melanocyte apoptotic process; Category No. 6705—melanocyte differentiation; Category No. 6706—melanocyte migration; Category No. 6707—melanocyte proliferation; Category No. 6708—melanocyte-stimulating hormone receptor activity; Category No. 6709—melanosome; Category No. 6710—melanosome assembly; Category No. 6711—melanosome localization; Category No. 6712—melanosome membrane; Category No. 6713—melanosome organization; Category No. 6714—melanosome transport; Category No. 6715—melatonin biosynthetic process; Category No. 6716—melatonin receptor activity; Category No. 6717—membrane; Category No. 6718—membrane assembly; Category No. 6719—membrane attack complex; Category No. 6720—membrane biogenesis; Category No. 6721—membrane budding; Category No. 6722—membrane coat; Category No. 6723—membrane depolarization; Category No. 6724—membrane depolarization during action potential; Category No. 6725—membrane depolarization during AV node cell action potential; Category No. 6726—membrane depolarization during bundle of His cell action potential; Category No. 6727—membrane depolarization during cardiac muscle cell action potential; Category No. 6728—membrane depolarization during Purkinje myocyte cell action potential; Category No. 6729—membrane depolarization during SA node cell action potential; Category No. 6730—membrane disruption in other organism; Category No. 6731—membrane docking; Category No. 6732—membrane fission; Category No. 6733—membrane fusion; Category No. 6734—membrane hyperpolarization; Category No. 6735—membrane invagination; Category No. 6736—membrane lipid catabolic process; Category No. 6737—membrane lipid metabolic process; Category No. 6738—membrane organization; Category No. 6739—membrane protein ectodomain proteolysis; Category No. 6740—membrane protein intracellular domain proteolysis; Category No. 6741—membrane protein proteolysis; Category No. 6742—membrane protein proteolysis involved in retrograde protein transport; Category No. 6743—membrane raft; Category No. 6744—membrane raft assembly; Category No. 6745—membrane raft localization; Category No. 6746—membrane raft organization; Category No. 6747—membrane raft polarization; Category No. 6748—membrane repolarization; Category No. 6749—membrane repolarization during action potential; Category No. 6750—membrane repolarization during bundle of His cell action potential; Category No. 6751—membrane repolarization during cardiac muscle cell action potential; Category No. 6752—membrane repolarization during SA node cell action potential; Category No. 6753—membrane to membrane docking; Category No. 6754—membrane tubulation; Category No. 6755—membrane-bounded organelle; Category No. 6756—membrane-bounded vesicle; Category No. 6757—membranous septum morphogenesis; Category No. 6758—memory; Category No. 6759—memory T cell activation; Category No. 6760—memory T cell differentiation; Category No. 6761—memory T cell proliferation; Category No. 6762—menaquinone biosynthetic process; Category No. 6763—menaquinone catabolic process; Category No. 6764—menstrual cycle phase; Category No. 6765—menstruation; Category No. 6766—meprin A complex; Category No. 6767—mercury ion binding; Category No. 6768—mesangial cell development; Category No. 6769—mesangial cell-matrix adhesion; Category No. 6770—mesaxon; Category No. 6771—mesenchymal cell apoptotic process; Category No. 6772—mesenchymal cell development; Category No. 6773—mesenchymal cell differentiation; Category No. 6774—mesenchymal cell differentiation involved in kidney development; Category No. 6775—mesenchymal cell differentiation involved in lung development; Category No. 6776—mesenchymal cell differentiation involved in renal system development; Category No. 6777—mesenchymal cell proliferation; Category No. 6778—mesenchymal cell proliferation involved in lung development; Category No. 6779—mesenchymal cell proliferation involved in ureter development; Category No. 6780—mesenchymal cell proliferation involved in ureteric bud development; Category No. 6781—mesenchymal smoothened signaling pathway involved in prostate gland development; Category No. 6782—mesenchymal stem cell maintenance involved in metanephric nephron morphogenesis; Category No. 6783—mesenchymal stem cell maintenance involved in nephron morphogenesis; Category No. 6784—mesenchymal stem cell proliferation; Category No. 6785—mesenchymal to epithelial transition; Category No. 6786—mesenchymal to epithelial transition involved in metanephric renal vesicle formation; Category No. 6787—mesenchymal to epithelial transition involved in metanephros morphogenesis; Category No. 6788—mesenchymal-epithelial cell signaling; Category No. 6789—mesenchymal-epithelial cell signaling involved in lung development; Category No. 6790—mesenchymal-epithelial cell signaling involved in prostate gland development; Category No. 6791—mesenchyme development; Category No. 6792—mesenchyme migration; Category No. 6793—mesendoderm development; Category No. 6794—mesendoderm migration; Category No. 6795—mesoderm development; Category No. 6796—mesoderm formation; Category No. 6797—mesoderm migration involved in gastrulation; Category No. 6798—mesoderm morphogenesis; Category No. 6799—mesodermal cell differentiation; Category No. 6800—mesodermal cell fate commitment; Category No. 6801—mesodermal cell fate determination; Category No. 6802—mesodermal cell fate specification; Category No. 6803—mesodermal cell migration; Category No. 6804—mesodermal to mesenchymal transition involved in gastrulation; Category No. 6805—mesodermal-endodermal cell signaling; Category No. 6806—mesonephric duct development; Category No. 6807—mesonephric duct formation; Category No. 6808—mesonephric duct morphogenesis; Category No. 6809—mesonephric epithelium development; Category No. 6810—mesonephric tubule development; Category No. 6811—mesonephric tubule formation; Category No. 6812—mesonephros development; Category No. 6813—messenger ribonucleoprotein complex; Category No. 6814—metabolic process; Category No. 6815—metal chelating activity; Category No. 6816—metal ion binding; Category No. 6817—metal ion homeostasis; Category No. 6818—metal ion transmembrane transporter activity; Category No. 6819—metal ion transport; Category No. 6820—metal ion:proton antiporter activity; Category No. 6821—metalloaminopeptidase activity; Category No. 6822—metallocarboxypeptidase activity; Category No. 6823—metallochaperone activity; Category No. 6824—metallodipeptidase activity; Category No. 6825—metalloendopeptidase activity; Category No. 6826—metalloendopeptidase inhibitor activity; Category No. 6827—metalloenzyme activator activity; Category No. 6828—metalloexopeptidase activity; Category No. 6829—metallopeptidase activity; Category No. 6830—metanephric ascending thin limb development; Category No. 6831—metanephric cap mesenchymal cell proliferation involved in metanephros development; Category No. 6832—metanephric capsule development; Category No. 6833—metanephric capsule specification; Category No. 6834—metanephric collecting duct development; Category No. 6835—metanephric comma-shaped body morphogenesis; Category No. 6836—metanephric connecting tubule development; Category No. 6837—metanephric cortex development; Category No. 6838—metanephric cortical collecting duct development; Category No. 6839—metanephric DCT cell differentiation; Category No. 6840—metanephric descending thin limb development; Category No. 6841—metanephric distal convoluted tubule development; Category No. 6842—metanephric distal tubule development; Category No. 6843—metanephric distal tubule morphogenesis; Category No. 6844—metanephric epithelium development; Category No. 6845—metanephric glomerular basement membrane development; Category No. 6846—metanephric glomerular capillary formation; Category No. 6847—metanephric glomerular mesangial cell development; Category No. 6848—metanephric glomerular mesangial cell differentiation; Category No. 6849—metanephric glomerular mesangial cell proliferation involved in metanephros development; Category No. 6850—metanephric glomerular visceral epithelial cell development; Category No. 6851—metanephric glomerulus development; Category No. 6852—metanephric glomerulus morphogenesis; Category No. 6853—metanephric glomerulus vasculature development; Category No. 6854—metanephric interstitial fibroblast development; Category No. 6855—metanephric loop of Henle development; Category No. 6856—metanephric macula densa development; Category No. 6857—metanephric mesenchymal cell differentiation; Category No. 6858—metanephric mesenchymal cell migration; Category No. 6859—metanephric mesenchymal cell proliferation involved in metanephros development; Category No. 6860—metanephric mesenchyme development; Category No. 6861—metanephric mesenchyme morphogenesis; Category No. 6862—metanephric nephron development; Category No. 6863—metanephric nephron morphogenesis; Category No. 6864—metanephric nephron tubule development; Category No. 6865—metanephric nephron tubule formation; Category No. 6866—metanephric nephron tubule morphogenesis; Category No. 6867—metanephric part of ureteric bud development; Category No. 6868—metanephric proximal convoluted tubule development; Category No. 6869—metanephric proximal convoluted tubule segment 2 development; Category No. 6870—metanephric proximal straight tubule development; Category No. 6871—metanephric proximal tubule development; Category No. 6872—metanephric smooth muscle tissue development; Category No. 6873—metanephric S-shaped body morphogenesis; Category No. 6874—metanephric thick ascending limb development; Category No. 6875—metanephric tubule development; Category No. 6876—metanephric tubule formation; Category No. 6877—metanephric tubule morphogenesis; Category No. 6878—metanephros development; Category No.

6879—metanephros morphogenesis; Category No. 6880—metaphase anaphase transition of mitotic cell cycle; Category No. 6881—metaphase plate congression; Category No. 6882—metencephalon development; Category No. 6883—methenyltetrahydrofolate cyclohydrolase activity; Category No. 6884—methionine adenosyltransferase activity; Category No. 6885—methionine adenosyltransferase complex; Category No. 6886—methionine adenosyltransferase regulator activity; Category No. 6887—methionine biosynthetic process; Category No. 6888—methionine metabolic process; Category No. 6889—methionine synthase activity; Category No. 6890—methionine transport; Category No. 6891—methionine-R-sulfoxide reductase activity; Category No. 6892—methionine-tRNA ligase activity; Category No. 6893—methionyl-tRNA aminoacylation; Category No. 6894—methionyl-tRNA formyltransferase activity; Category No. 6895—methotrexate binding; Category No. 6896—methotrexate transport; Category No. 6897—methotrexate transporter activity; Category No. 6898—methylarsonate reductase activity; Category No. 6899—methylarsonite methyltransferase activity; Category No. 6900—methylated histone binding; Category No. 6901—methylated-DNA-[protein]-cysteine S-methyltransferase activity; Category No. 6902—methylation; Category No. 6903—methylation-dependent chromatin silencing; Category No. 6904—methyl-branched fatty acid metabolic process; Category No. 6905—methyl-CpG binding; Category No. 6906—methyl-CpNpG binding; Category No. 6907—methylcrotonoyl-CoA carboxylase activity; Category No. 6908—methylcytosine dioxygenase activity; Category No. 6909—methylenetetrahydrofolate dehydrogenase (NAD+) activity; Category No. 6910—methylenetetrahydrofolate dehydrogenase (NADP+) activity; Category No. 6911—methylenetetrahydrofolate dehydrogenase [NAD(P)+] activity; Category No. 6912—methylenetetrahydrofolate reductase (NAD(P)H) activity; Category No. 6913—methylglutaconyl-CoA hydratase activity; Category No. 6914—methylglyoxal biosynthetic process; Category No. 6915—methylglyoxal catabolic process to D-lactate via 5-lactoyl-glutathione; Category No. 6916—methylglyoxal metabolic process; Category No. 6917—methylmalonate-semialdehyde dehydrogenase (acylating) activity; Category No. 6918—methylmalonyl-CoA decarboxylase activity; Category No. 6919—methylmalonyl-CoA epimerase activity; Category No. 6920—methylmalonyl-CoA mutase activity; Category No. 6921—methylosome; Category No. 6922—methylputrescine oxidase activity; Category No. 6923—methylthioribulose 1-phosphate dehydratase activity; Category No. 6924—methyltransferase activity; Category No. 6925—methylumbelliferyl-acetate deacetylase activity; Category No. 6926—mevalonate kinase activity; Category No. 6927—mevalonate pathway; Category No. 6928—mevalonate transmembrane transporter activity; Category No. 6929—mevalonate transport; Category No. 6930—MH1 domain binding; Category No. 6931—MH2 domain binding; Category No. 6932—MHC class I peptide loading complex; Category No. 6933—MHC class I protein binding; Category No. 6934—MHC class I protein complex; Category No. 6935—MHC class I protein complex binding; Category No. 6936—MHC class I receptor activity; Category No. 6937—MHC class Ib protein binding; Category No. 6938—MHC class Ib protein complex; Category No. 6939—MHC class Ib receptor activity; Category No. 6940—MHC class II biosynthetic process; Category No. 6941—MHC class II protein binding; Category No. 6942—MHC class II protein complex; Category No. 6943—MHC class II protein complex assembly; Category No. 6944—MHC class II protein complex binding; Category No. 6945—MHC class II receptor activity; Category No. 6946—MHC protein binding; Category No. 6947—MICOS complex; Category No. 6948—microfibril; Category No. 6949—microfibril binding; Category No. 6950—microfilament motor activity; Category No. 6951—microglia development; Category No. 6952—microglial cell activation; Category No. 6953—microglial cell activation involved in immune response; Category No. 6954—microglial cell proliferation; Category No. 6955—microprocessor complex; Category No. 6956—micro-ribonucleoprotein complex; Category No. 6957—microsatellite binding; Category No. 6958—microspike; Category No. 6959—microspike assembly; Category No. 6960—microtubule; Category No. 6961—microtubule anchoring; Category No. 6962—microtubule anchoring at centrosome; Category No. 6963—microtubule anchoring at microtubule organizing center; Category No. 6964—microtubule associated complex; Category No. 6965—microtubule binding; Category No. 6966—microtubule bundle; Category No. 6967—microtubule bundle formation; Category No. 6968—microtubule cytoskeleton; Category No. 6969—microtubule cytoskeleton organization; Category No. 6970—microtubule cytoskeleton organization involved in establishment of planar polarity; Category No. 6971—microtubule depolymerization; Category No. 6972—microtubule minus-end; Category No. 6973—microtubule minus-end binding; Category No. 6974—microtubule motor activity; Category No. 6975—microtubule nucleation; Category No. 6976—microtubule organizing center; Category No. 6977—microtubule organizing center organization; Category No. 6978—microtubule plus-end; Category No. 6979—microtubule plus-end binding; Category No. 6980—microtubule polymerization; Category No. 6981—microtubule polymerization or depolymerization; Category No. 6982—microtubule severing; Category No. 6983—microtubule sliding; Category No. 6984—microtubule-based movement; Category No. 6985—microtubule-based peroxisome localization; Category No. 6986—microtubule-based process; Category No. 6987—microtubule-dependent intracellular transport of viral material towards nucleus; Category No. 6988—microtubule-severing ATPase activity; Category No. 6989—microvillus; Category No. 6990—microvillus assembly; Category No. 6991—microvillus membrane; Category No. 6992—microvillus organization; Category No. 6993—micturition; Category No. 6994—midbody; Category No. 6995—midbrain development; Category No. 6996—midbrain morphogenesis; Category No. 6997—midbrain-hindbrain boundary development; Category No. 6998—midbrain-hindbrain boundary initiation; Category No. 6999—midbrain-hindbrain boundary maturation during brain development; Category No. 7000—midbrain-hindbrain boundary morphogenesis; Category No. 7001—middle ear morphogenesis; Category No. 7002—midgut development; Category No. 7003—milk ejection; Category No. 7004—mineralocorticoid biosynthetic process; Category No. 7005—mineralocorticoid receptor activity; Category No. 7006—mineralocorticoid receptor signaling pathway; Category No. 7007—minus-end directed microfilament motor activity; Category No. 7008—minus-end-directed; Category No. 7009—minus-end-directed organelle transport along microtubule; Category No. 7010—miRNA binding; Category No. 7011—miRNA catabolic process; Category No. 7012—miRNA loading onto RISC involved in gene silencing by miRNA; Category No. 7013—miRNA metabolic process; Category No. 7014—MIS complex; Category No. 7015—MIS12 MIND type complex; Category No. 7016—misfolded or incompletely synthesized protein catabolic process; Category No. 7017—misfolded protein binding; Category No. 7018—mismatch repair; Category No. 7019—mismatch repair complex; Category No. 7020—mismatched DNA binding; Category No. 7021—MIT domain binding; Category No. 7022—mitochondria-associated ubiquitin-dependent protein catabolic process; Category No. 7023—mitochondrial acetyl-CoA biosynthetic process from pyruvate; Category No. 7024—mitochondrial alanyl-tRNA aminoacylation; Category No. 7025—mitochondrial alpha-ketoglutarate dehydrogenase complex; Category No. 7026—mitochondrial asparaginyl-tRNA aminoacylation; Category No. 7027—mitochondrial ATP synthesis coupled electron transport; Category No. 7028—mitochondrial ATP synthesis coupled proton transport; Category No. 7029—mitochondrial calcium ion homeostasis; Category No. 7030—mitochondrial calcium ion transport; Category No. 7031—mitochondrial chromosome; Category No. 7032—mitochondrial crista; Category No. 7033—mitochondrial crista junction; Category No. 7034—mitochondrial degradosome; Category No. 7035—mitochondrial depolarization; Category No. 7036—mitochondrial DNA metabolic process; Category No. 7037—mitochondrial DNA repair; Category No. 7038—mitochondrial DNA replication; Category No. 7039—mitochondrial electron transport; Category No. 7040—mitochondrial endopeptidase Clp complex; Category No. 7041—mitochondrial envelope; Category No. 7042—mitochondrial fatty acid beta-oxidation multienzyme complex; Category No. 7043—mitochondrial fission; Category No. 7044—mitochondrial fragmentation involved in apoptotic process; Category No. 7045—mitochondrial fusion; Category No. 7046—mitochondrial genome maintenance; Category No. 7047—mitochondrial heavy strand promoter anti-sense binding; Category No. 7048—mitochondrial inner membrane; Category No. 7049—mitochondrial inner membrane peptidase complex; Category No. 7050—mitochondrial inner membrane presequence translocase complex; Category No. 7051—mitochondrial inner membrane protein insertion complex; Category No. 7052—mitochondrial intermembrane space; Category No. 7053—mitochondrial intermembrane space protein transporter complex; Category No. 7054—mitochondrial iron ion transport; Category No. 7055—mitochondrial large ribosomal subunit; Category No. 7056—mitochondrial large ribosomal subunit assembly; Category No. 7057—mitochondrial light strand promoter anti-sense binding; Category No. 7058—mitochondrial light strand promoter sense binding; Category No. 7059—mitochondrial magnesium ion transport; Category No. 7060—mitochondrial matrix; Category No. 7061—mitochondrial membrane; Category No. 7062—mitochondrial membrane fission; Category No. 7063—mitochondrial membrane organization; Category No. 7064—mitochondrial mRNA catabolic process; Category No. 7065—mitochondrial mRNA polyadenylation; Category No. 7066—mitochondrial mRNA surveillance; Category No. 7067—mitochondrial ncRNA surveillance; Category No. 7068—mitochondrial nucleoid; Category No. 7069—mitochondrial ornithine transport; Category No. 7070—mitochondrial outer membrane; Category No. 7071—mitochondrial outer membrane permeabilization; Category No. 7072—mitochondrial outer membrane translocase complex; Category No. 7073—mitochondrial outer membrane translocase complex assembly; Category No. 7074—mitochondrial oxoglutarate dehydrogenase complex; Category No. 7075—mitochondrial permeability transition pore complex; Category No. 7076—mitochondrial protein catabolic process; Category No. 7077—mitochondrial protein processing; Category No. 7078—mitochondrial proton-transporting ATP synthase; Category No. 7079—mitochondrial proton-transporting ATP synthase complex; Category No. 7080—mitochondrial proton-transporting ATP synthase complex assembly; Category No. 7081—mitochondrial pyrimidine nucleotide import; Category No. 7082—mitochondrial pyruvate dehydrogenase complex; Category No. 7083—mitochondrial pyruvate transmembrane transport; Category No. 7084—mitochondrial pyruvate transport; Category No. 7085—mitochondrial respiratory chain; Category No. 7086—mitochondrial respiratory chain complex assembly; Category No. 7087—mitochondrial respiratory chain complex I; Category No. 7088—mitochondrial respiratory chain complex I assembly; Category No. 7089—mitochondrial respiratory chain complex I biogenesis; Category No. 7090—mitochondrial respiratory chain complex II; Category No. 7091—mitochondrial respiratory chain complex II assembly; Category No. 7092—mitochondrial respiratory chain complex III; Category No. 7093—mitochondrial respiratory chain complex III assembly; Category No. 7094—mitochondrial respiratory chain complex III biogenesis; Category No. 7095—mitochondrial respiratory chain complex IV; Category No. 7096—mitochondrial respiratory chain complex IV assembly; Category No. 7097—mitochondrial ribosome; Category No. 7098—mitochondrial ribosome assembly; Category No. 7099—mitochondrial ribosome binding; Category No. 7100—mitochondrial RNA 3-end processing; Category No. 7101—mitochondrial RNA 5'-end processing; Category No. 7102—mitochondrial RNA catabolic process; Category No. 7103—mitochondrial RNA processing; Category No. 7104—mitochondrial RNA surveillance; Category No. 7105—mitochondrial small ribosomal subunit; Category No. 7106—mitochondrial sorting and assembly machinery complex; Category No. 7107—mitochondrial threonyl-tRNA aminoacylation; Category No. 7108—mitochondrial translation; Category No. 7109—mitochondrial translational elongation; Category No. 7110—mitochondrial translational initiation; Category No. 7111—mitochondrial translational termination; Category No. 7112—mitochondrial transport; Category No. 7113—mitochondrial tRNA 3'-trailer cleavage; Category No. 7114—mitochondrial tRNA methylation; Category No. 7115—mitochondrial tRNA wobble uridine modification; Category No. 7116—mitochondrial tyrosyl-tRNA aminoacylation; Category No. 7117—mitochondria-nucleus signaling pathway; Category No. 7118—mitochondrion; Category No. 7119—mitochondrion distribution; Category No. 7120—mitochondrion localization; Category No. 7121—mitochondrion morphogenesis; Category No. 7122—mitochondrion organization; Category No. 7123—mitochondrion targeting sequence binding; Category No. 7124—mitochondrion transport along microtubule; Category No. 7125—mitogen-activated protein kinase binding; Category No. 7126—mitogen-activated protein kinase kinase binding; Category No. 7127—mitogen-activated protein kinase kinase kinase binding; Category No. 7128—mitogen-activated protein kinase p38 binding; Category No. 7129—mitophagy; Category No. 7130—mitophagy by induced vacuole formation; Category No. 7131—mitophagy in response to mitochondrial depolarization; Category No. 7132—mitotic cell cycle; Category No. 7133—mitotic cell cycle arrest; Category No. 7134—mitotic cell cycle checkpoint; Category No. 7135—mitotic cell cycle phase transition; Category No. 7136—mitotic cell cycle process; Category No. 7137—mitotic centrosome separation; Category No. 7138—mitotic chromosome condensation; Category No. 7139—mitotic chromosome movement towards spindle pole; Category No.

7140—mitotic cohesin complex; Category No. 7141—mitotic cytokinesis; Category No. 7142—mitotic cytokinetic process; Category No. 7143—mitotic DNA damage checkpoint; Category No. 7144—mitotic DNA integrity checkpoint; Category No. 7145—mitotic DNA replication checkpoint; Category No. 7146—mitotic DNA replication initiation; Category No. 7147—mitotic DNA replication preinitiation complex assembly; Category No. 7148—mitotic G1 DNA damage checkpoint; Category No. 7149—mitotic G1 S transition checkpoint; Category No. 7150—mitotic G2 DNA damage checkpoint; Category No. 7151—mitotic G2 M transition checkpoint; Category No. 7152—mitotic M phase; Category No. 7153—mitotic metaphase plate congression; Category No. 7154—mitotic nuclear division; Category No. 7155—mitotic nuclear envelope disassembly; Category No. 7156—mitotic nuclear envelope reassembly; Category No. 7157—mitotic recombination; Category No. 7158—mitotic sister chromatid cohesion; Category No. 7159—mitotic sister chromatid segregation; Category No. 7160—mitotic sister chromatid separation; Category No. 7161—mitotic spindle; Category No. 7162—mitotic spindle assembly; Category No. 7163—mitotic spindle assembly checkpoint; Category No. 7164—mitotic spindle checkpoint; Category No. 7165—mitotic spindle elongation; Category No. 7166—mitotic spindle midzone; Category No. 7167—mitotic spindle midzone assembly; Category No. 7168—mitotic spindle organization; Category No. 7169—mitotic spindle organization in nucleus; Category No. 7170—mitotic spindle pole; Category No. 7171—mitotic spindle pole body; Category No. 7172—mitotic spindle pole body duplication; Category No. 7173—mitotic spindle pole body localization to nuclear envelope; Category No. 7174—mitotic spindle stabilization; Category No. 7175—mitotic to meiotic cell cycle; Category No. 7176—mitral valve development; Category No. 7177—mitral valve formation; Category No. 7178—mitral valve morphogenesis; Category No. 7179—MLL1 complex; Category No. 7180—MLL5-L complex; Category No. 7181—MMXD complex; Category No. 7182—modification by virus of host mRNA processing; Category No. 7183—modification-dependent protein catabolic process; Category No. 7184—modified amino acid binding; Category No. 7185—modified amino acid transport; Category No. 7186—modulation by symbiont of host 1-kappaB kinase NF-kappaB cascade; Category No. 7187—modulation by virus of host morphology or physiology; Category No. 7188—modulation by virus of host process; Category No. 7189—modulation by virus of host transcription; Category No. 7190—modulation of excitatory postsynaptic potential; Category No. 7191—modulation of synaptic transmission; Category No. 7192—molecular function; Category No. 7193—molecular hydrogen transport; Category No. 7194—molybdate ion transmembrane transporter activity; Category No. 7195—molybdate ion transport; Category No. 7196—molybdenum incorporation into molybdenum-molybdopterin complex; Category No. 7197—molybdenum ion binding; Category No. 7198—molybdopterin adenylyltransferase activity; Category No. 7199—molybdopterin cofactor binding; Category No. 7200—molybdopterin cofactor biosynthetic process; Category No. 7201—molybdopterin cofactor metabolic process; Category No. 7202—molybdopterin molybdotransferase activity; Category No. 7203—molybdopterin synthase activity; Category No. 7204—molybdopterin synthase complex; Category No. 7205—molybdopterin-synthase adenylyltransferase activity; Category No. 7206—molybdopterin-synthase sulfurtransferase activity; Category No. 7207—Mo-molybdopterin cofactor biosynthetic process; Category No. 7208—Mo-molybdopterin cofactor sulfurase activity; Category No. 7209—monoamine transmembrane transporter activity; Category No. 7210—monoamine transport; Category No. 7211—monocarboxylic acid metabolic process; Category No. 7212—monocarboxylic acid transmembrane transporter activity; Category No. 7213—monocarboxylic acid transport; Category No. 7214—monocyte activation; Category No. 7215—monocyte aggregation; Category No. 7216—monocyte chemotaxis; Category No. 7217—monocyte differentiation; Category No. 7218—monocyte extravasation; Category No. 7219—monomeric IgA immunoglobulin complex; Category No. 7220—mononuclear cell migration; Category No. 7221—mononuclear cell proliferation; Category No. 7222—mono-olein transacylation activity; Category No. 7223—monooxygenase activity; Category No. 7224—monophenol monooxygenase activity; Category No. 7225—monosaccharide binding; Category No. 7226—monosaccharide metabolic process; Category No. 7227—monosialoganglioside sialyltransferase activity; Category No. 7228—monoterpenoid metabolic process; Category No. 7229—monoubiquitinated histone H2A deubiquitination; Category No. 7230—monoubiquitinated protein deubiquitination; Category No. 7231—monounsaturated fatty acid; Category No. 7232—monovalent cation:proton antiporter activity; Category No. 7233—monovalent inorganic cation transmembrane transporter activity; Category No. 7234—monovalent inorganic cation transport; Category No. 7235—morphine receptor activity; Category No. 7236—morphogen activity; Category No. 7237—morphogenesis of a branching epithelium; Category No. 7238—morphogenesis of a branching structure; Category No. 7239—morphogenesis of a polarized epithelium; Category No. 7240—morphogenesis of an epithelial fold; Category No. 7241—morphogenesis of an epithelial sheet; Category No. 7242—morphogenesis of an epithelium; Category No. 7243—morphogenesis of embryonic epithelium; Category No. 7244—motile cilium; Category No. 7245—motile cilium assembly; Category No. 7246—motile primary cilium; Category No. 7247—motile primary cilium assembly; Category No. 7248—motogenic signaling involved in postnatal olfactory bulb interneuron migration; Category No. 7249—motor activity; Category No. 7250—motor neuron apoptotic process; Category No. 7251—motor neuron axon guidance; Category No. 7252—movement of cell or subcellular component; Category No. 7253—MOZ MORF histone acetyltransferase complex; Category No. 7254—Mpp10 complex; Category No. 7255—MPP7-DLG1-LIN7 complex; Category No. 7256—Mre11 complex; Category No. 7257—MRF binding; Category No. 7258—mRNA (2'-O-methyladenosine-N6-)-methyltransferase activity; Category No. 7259—mRNA (guanine-N7-)-methyltransferase activity; Category No. 7260—mRNA (nucleoside-2'-O-)-methyltransferase activity; Category No. 7261—mRNA 3'-end processing; Category No. 7262—mRNA 3'-end processing by stem-loop binding and cleavage; Category No. 7263—mRNA 3'-splice site recognition; Category No. 7264—mRNA 3'-UTR AU-rich region binding; Category No. 7265—mRNA 3-UTR binding; Category No. 7266—mRNA 5'-splice site recognition; Category No. 7267—mRNA 5'-UTR binding; Category No. 7268—mRNA binding; Category No. 7269—mRNA cap binding complex; Category No. 7270—mRNA catabolic process; Category No. 7271—mRNA CDS binding; Category No. 7272—mRNA cis splicing; Category No. 7273—mRNA cleavage; Category No. 7274—mRNA cleavage and polyadenylation specificity factor complex; Category No. 7275—mRNA cleavage factor complex; Category No. 7276—mRNA cleavage involved in gene silencing by miRNA; Category No. 7277—mRNA cleavage involved in gene silencing by siRNA; Category No. 7278—mRNA destabilization; Category No. 7279—mRNA endonucleolytic cleavage involved in unfolded protein response; Category No. 7280—mRNA export from nucleus; Category No. 7281—mRNA export from nucleus in response to heat stress; Category No. 7282—mRNA guanylyltransferase activity; Category No. 7283—mRNA localization resulting in posttranscriptional regulation of gene expression; Category No. 7284—mRNA metabolic process; Category No. 7285—mRNA methylation; Category No. 7286—mRNA modification; Category No. 7287—mRNA polyadenylation; Category No. 7288—mRNA processing; Category No. 7289—mRNA pseudouridine synthesis; Category No. 7290—mRNA splice site selection; Category No. 7291—mRNA splicing; Category No. 7292—mRNA stabilization; Category No. 7293—mRNA transcription; Category No. 7294—mRNA transcription from RNA polymerase II promoter; Category No. 7295—mRNA transport; Category No. 7296—MSL complex; Category No. 7297—mucin granule; Category No. 7298—mucosal immune response; Category No. 7299—mucosal-associated lymphoid tissue development; Category No. 7300—mucus layer; Category No. 7301—mucus secretion; Category No. 7302—Mullerian duct regression; Category No. 7303—multicellular organism growth; Category No. 7304—multicellular organism reproduction; Category No. 7305—multicellular organismal aging; Category No. 7306—multicellular organismal development; Category No. 7307—multicellular organismal homeostasis; Category No. 7308—multicellular organismal iron ion homeostasis; Category No. 7309—multicellular organismal lipid catabolic process; Category No. 7310—multicellular organismal macromolecule metabolic process; Category No. 7311—multicellular organismal metabolic process; Category No. 7312—multicellular organismal protein catabolic process; Category No. 7313—multicellular organismal protein metabolic process; Category No. 7314—multicellular organismal reproductive process; Category No. 7315—multicellular organismal response to stress; Category No. 7316—multicellular organismal water homeostasis; Category No. 7317—multicellular structure septum development; Category No. 7318—multi-ciliated epithelial cell differentiation; Category No. 7319—multi-eIF complex; Category No. 7320—multinuclear osteoclast differentiation; Category No. 7321—multivesicular body; Category No. 7322—multivesicular body assembly; Category No. 7323—multivesicular body lumen; Category No. 7324—multivesicular body membrane; Category No. 7325—multivesicular body organization; Category No. 7326—multivesicular body sorting pathway; Category No. 7327—muramyl dipeptide binding; Category No. 7328—muscle alpha-actinin binding; Category No. 7329—muscle atrophy; Category No. 7330—muscle attachment; Category No. 7331—muscle cell apoptotic process; Category No. 7332—muscle cell cellular homeostasis; Category No. 7333—muscle cell development; Category No. 7334—muscle cell differentiation; Category No. 7335—muscle cell fate commitment; Category No. 7336—muscle cell fate determination; Category No. 7337—muscle cell fate specification; Category No. 7338—muscle cell migration; Category No. 7339—muscle cell projection membrane; Category No. 7340—muscle contraction; Category No. 7341—muscle fiber development; Category No. 7342—muscle filament sliding; Category No. 7343—muscle hypertrophy; Category No. 7344—muscle myosin complex; Category No. 7345—muscle organ development; Category No. 7346—muscle organ morphogenesis; Category No. 7347—muscle structure development; Category No. 7348—muscle system process; Category No. 7349—muscle tendon junction; Category No. 7350—muscle thin filament tropomyosin; Category No. 7351—muscle tissue development; Category No. 7352—muscle tissue morphogenesis; Category No. 7353—muscular septum morphogenesis; Category No. 7354—musculoskeletal movement; Category No. 7355—MutLalpha complex; Category No. 7356—MutLalpha complex binding; Category No. 7357—MutSalpha complex; Category No. 7358—MutSalpha complex binding; Category No. 7359—MutSbeta complex; Category No. 7360—mu-type opioid receptor binding; Category No. 7361—Myb complex; Category No. 7362—MyD88-dependent toll-like receptor signaling pathway; Category No. 7363—MyD88-independent toll-like receptor signaling pathway; Category No. 7364—myelin assembly; Category No. 7365—myelin maintenance; Category No. 7366—myelin sheath; Category No. 7367—myelin sheath abaxonal region; Category No. 7368—myelin sheath adaxonal region; Category No. 7369—myelination; Category No. 7370—myelination in peripheral nervous system; Category No. 7371—myeloid cell apoptotic process; Category No. 7372—myeloid cell differentiation; Category No. 7373—myeloid cell homeostasis; Category No. 7374—myeloid dendritic cell activation; Category No. 7375—myeloid dendritic cell activation involved in immune response; Category No. 7376—myeloid dendritic cell chemotaxis; Category No. 7377—myeloid dendritic cell differentiation; Category No. 7378—myeloid leukocyte differentiation; Category No. 7379—myeloid progenitor cell differentiation; Category No. 7380—myoblast development; Category No. 7381—myoblast differentiation; Category No. 7382—myoblast differentiation involved in skeletal muscle regeneration; Category No. 7383—myoblast fate commitment; Category No. 7384—myoblast fate determination; Category No. 7385—myoblast fusion; Category No. 7386—myoblast migration; Category No. 7387—myoblast migration involved in skeletal muscle regeneration; Category No. 7388—myoblast proliferation; Category No. 7389—myofibril; Category No. 7390—myofibril assembly; Category No. 7391—myo-inositol transport; Category No. 7392—myo-inositol:sodium symporter activity; Category No. 7393—myosin binding; Category No. 7394—myosin complex; Category No. 7395—myosin filament; Category No. 7396—myosin filament assembly; Category No. 7397—myosin head neck binding; Category No. 7398—myosin heavy chain binding; Category No. 7399—myosin I binding; Category No. 7400—myosin I complex; Category No. 7401—myosin II binding; Category No. 7402—myosin II complex; Category No. 7403—myosin II filament; Category No. 7404—myosin II heavy chain binding; Category No. 7405—myosin light chain binding; Category No. 7406—myosin light chain kinase activity; Category No. 7407—myosin phosphatase activity; Category No. 7408—myosin phosphatase regulator activity; Category No. 7409—myosin tail binding; Category No. 7410—myosin V binding; Category No. 7411—myosin VI binding; Category No. 7412—myosin VI light chain binding; Category No. 7413—myosin VII complex; Category No. 7414—myosin-light-chain-phosphatase activity; Category No. 7415—myotome development; Category No. 7416—myotube cell development; Category No. 7417—myotube differentiation; Category No. 7418—myotube differentiation involved in skeletal muscle regeneration; Category No. 7419—myristoyl-[acyl-carrier-protein] hydrolase activity; Category No. 7420—myristoyltransferase activity; Category No. 7421—N(1),N(12)-diacetylspermine:oxygen oxidoreductase (3-acetamidopropanal-forming) activity; Category No. 7422—N(6)-L-threonylcarbamoyladenine synthase; Category No. 7423—N,N-dimethylaniline monooxygenase activity; Category No. 7424—N1-acetylspermidine:oxygen oxidoreductase (3-acetamidopropanal-forming) activity; Category No. 7425—N1-acetylspermine:oxygen oxidoreductase (3-acetamidopropanal-forming) activity; Category No. 7426—N1-acetylspermine:oxygen oxidoreductase (N1-acetylspermidine-forming) activity; Category No. 7427—N4-(beta-N-acetylglucosaminyl)-L-asparaginase activity; Category No. 7428—N6-(1,2-dicarboxyethyl)AMP AMP-lyase (fumarate-forming) activity; Category No. 7429—N6-methyladenosine-containing RNA binding; Category No. 7430—N6-threonylcarbomyladenosine methylthiotransferase activity; Category No. 7431—NAADP-sensitive calcium-release channel activity; Category No. 7432—N-acetyl-beta-glucosaminyl-glycoprotein 4-beta-N-acetylgalactosaminyltransferase activity; Category No. 7433—N-acetylgalactosamine 4-O-sulfotransferase activity; Category No. 7434—N-acetylgalactosamine 4-sulfate 6-O-sulfotransferase activity; Category No. 7435—N-acetylgalactosamine kinase activity; Category No. 7436—N-acetylgalactosamine-4-sulfatase activity; Category No. 7437—N-acetylgalactosamine-6-sulfatase activity; Category No. 7438—N-acetylgalactosaminyl-proteoglycan 3-beta-glucuronosyltransferase activity; Category No. 7439—N-acetylglucosamine 6-O-sulfotransferase activity; Category No. 7440—N-acetylglucosamine biosynthetic process; Category No. 7441—N-acetylglucosamine catabolic process; Category No. 7442—N-acetylglucosamine kinase activity; Category No. 7443—N-acetylglucosamine metabolic process; Category No. 7444—N-acetylglucosamine-1-phosphodiester alpha-N-acetylglucosaminidase activity; Category No. 7445—N-acetylglucosamine-6-phosphate deacetylase activity; Category No. 7446—N-acetylglucosamine-6-sulfatase activity; Category No. 7447—N-acetylglucosaminyldiphosphodolichol N-acetylglucosaminyltransferase activity; Category No. 7448—N-acetylglucosaminylphosphatidylinositol deacetylase activity; Category No. 7449—N-acetylglucosaminyl-proteoglycan 4-beta-glucuronosyltransferase activity; Category No. 7450—N-acetyllactosamine synthase activity; Category No. 7451—N-acetyllactosaminide alpha-2,3-sialyltransferase activity; Category No. 7452—N-acetyllactosaminide beta-1,3-N-acetylglucosaminyltransferase activity; Category No. 7453—N-acetyllactosaminide beta-1,6-N-acetylglucosaminyltransferase activity; Category No. 7454—N-acetyl-L-aspartate-L-glutamate ligase activity; Category No. 7455—N-acetylmannosamine metabolic process; Category No. 7456—N-acetylmuramoyl-L-alanine amidase activity; Category No. 7457—N-acetylneuraminate biosynthetic process; Category No. 7458—N-acetylneuraminate catabolic process; Category No. 7459—N-acetylneuraminate lyase activity; Category No. 7460—N-acetylneuraminate metabolic process; Category No. 7461—N-acetylneuraminate synthase activity; Category No. 7462—N-acetyltransferase activity; Category No. 7463—NACHT domain binding; Category No. 7464—N-acylglucosamine 2-epimerase activity; Category No. 7465—N-acylmannosamine kinase activity; Category No. 7466—N-acylneuraminate cytidylyltransferase activity; Category No. 7467—N-acylneuraminate-9-phosphatase activity; Category No. 7468—N-acylneuraminate-9-phosphate synthase activity; Category No. 7469—N-acylphosphatidylethanolamine metabolic process; Category No. 7470—N-acylphosphatidylethanolamine-specific phospholipase D activity; Category No. 7471—N-acyltransferase activity; Category No. 7472—NAD binding; Category No. 7473—NAD biosynthesis via nicotinamide riboside salvage pathway; Category No. 7474—NAD biosynthetic process; Category No. 7475—NAD catabolic process; Category No. 7476—NAD metabolic process; Category No. 7477—NAD or NADP as acceptor; Category No. 7478—NAD transport; Category No. 7479—NAD transporter activity; Category No. 7480—NAD(P) as acceptor; Category No. 7481—NAD(P)+ nucleosidase activity; Category No. 7482—NAD(P)+ transhydrogenase (AB-specific) activity; Category No. 7483—NAD(P)+ transhydrogenase (B-specific) activity; Category No. 7484—NAD(P)+ transhydrogenase activity; Category No. 7485—NAD(P)+-protein-arginine ADP-ribosyltransferase activity; Category No. 7486—NAD(P)H as one donor; Category No. 7487—NAD(P)H dehydrogenase (quinone) activity; Category No. 7488—NAD(P)H oxidase activity; Category No. 7489—NAD+ ADP-ribosyltransferase activity; Category No. 7490—NAD+ binding; Category No. 7491—NAD+ diphosphatase activity; Category No. 7492—NAD+ kinase activity; Category No. 7493—NAD+ nucleosidase activity; Category No. 7494—NAD+ synthase (glutamine-hydrolyzing) activity; Category No. 7495—NAD-dependent histone deacetylase activity; Category No. 7496—NAD-dependent histone deacetylase activity (H3-K14 specific); Category No. 7497—NAD-dependent histone deacetylase activity (H3-K18 specific); Category No. 7498—NAD-dependent histone deacetylase activity (H3-K9 specific); Category No. 7499—NAD-dependent histone deacetylase activity (H4-K16 specific); Category No. 7500—NAD-dependent protein deacetylase activity; Category No. 7501—NADH binding; Category No. 7502—NADH dehydrogenase (ubiquinone) activity; Category No. 7503—NADH dehydrogenase activity; Category No. 7504—NADH dehydrogenase complex assembly; Category No. 7505—NADH metabolic process; Category No. 7506—NADH oxidation; Category No. 7507—NADH pyrophosphatase activity; Category No. 7508—NADH to ubiquinone; Category No. 7509—NADHX epimerase activity; Category No. 7510—NADP binding; Category No. 7511—NADP biosynthetic process; Category No. 7512—NADP catabolic process; Category No. 7513—NADP metabolic process; Category No. 7514—NADP+ binding; Category No. 7515—NADPH binding; Category No. 7516—NADPH dehydrogenase (quinone) activity; Category No. 7517—NADPH oxidase complex; Category No. 7518—NADPH oxidation; Category No. 7519—NADPH regeneration; Category No. 7520—NADPH:quinone reductase activity; Category No. 7521—NADPH:sulfur oxidoreductase activity; Category No. 7522—NADPH-adrenodoxin reductase activity; Category No. 7523—NADPH-hemoprotein reductase activity; Category No. 7524—NADPHX epimerase activity; Category No. 7525—NADP-retinol dehydrogenase activity; Category No. 7526—nail development; Category No. 7527—naphthalene metabolic process; Category No. 7528—nascent polypeptide-associated complex; Category No. 7529—NatA complex; Category No. 7530—NatB complex; Category No. 7531—NatC complex; Category No. 7532—natriuretic peptide receptor activity; Category No. 7533—natural killer cell activation; Category No. 7534—natural killer cell activation involved in immune response; Category No. 7535—natural killer cell chemotaxis; Category No. 7536—natural killer cell degranulation; Category No. 7537—natural killer cell differentiation; Category No. 7538—natural killer cell inhibitory signaling pathway; Category No. 7539—natural killer cell lectin-like receptor binding; Category No. 7540—natural killer cell mediated cytotoxicity; Category No. 7541—natural killer cell mediated immunity; Category No. 7542—natural killer cell proliferation; Category No. 7543—natural killer cell tolerance induction; Category No. 7544—nBAF complex; Category No. 7545—N-box binding; Category No. 7546—ncRNA metabolic process; Category No. 7547—Ndc80 complex; Category No. 7548—necroptotic process; Category No. 7549—necroptotic signaling pathway; Category No. 7550—NEDD8 activating enzyme activity; Category No. 7551—NEDD8 transferase activity; Category No. 7552—NEDD8-specific protease activity; Category No. 7553—negative chemotaxis; Category No. 7554—negative regulation by host of symbiont molecular function; Category No. 7555—negative regulation by host of viral exo-alpha-sialidase activity; Category No. 7556—negative regulation by host of viral genome replication; Category No. 7557—negative regulation by host of viral glycoprotein metabolic process; Category No. 7558—negative regulation by host of viral process; Category No. 7559—negative regulation by host of viral release from host cell; Category No. 7560—negative regulation by host of viral transcription; Category No. 7561—negative regulation by symbiont of host apoptotic process; Category No. 7562—negative regulation by virus of viral protein levels in host cell; Category No. 7563—negative regulation of acid-sensing ion channel activity; Category No. 7564—negative regulation of acrosome reaction; Category No. 7565—negative regulation of actin filament bundle assembly; Category No. 7566—negative regulation of actin filament depolymerization; Category No. 7567—negative regulation of actin filament polymerization; Category No. 7568—negative regulation of actin filament severing; Category No. 7569—negative regulation of actin nucleation; Category No. 7570—negative regulation of action potential; Category No. 7571—negative regulation of activated T cell proliferation; Category No. 7572—negative regulation of activation of JAK2 kinase activity; Category No. 7573—negative regulation of activation of membrane attack complex; Category No. 7574—negative regulation of activation-induced cell death of T cells; Category No. 7575—negative regulation of activin receptor signaling pathway; Category No. 7576—negative regulation of acute inflammatory response; Category No. 7577—negative regulation of acute inflammatory response to antigenic stimulus; Category No. 7578—negative regulation of acute inflammatory response to non-antigenic stimulus; Category No. 7579—negative regulation of adaptive immune response; Category No. 7580—negative regulation of adenosine receptor signaling pathway; Category No. 7581—negative regulation of adenylate cyclase activity; Category No. 7582—negative regulation of adherens junction organization; Category No. 7583—negative regulation of adiponectin secretion; Category No. 7584—negative regulation of adipose tissue development; Category No. 7585—negative regulation of adrenergic receptor signaling pathway; Category No. 7586—negative regulation of adrenergic receptor signaling pathway involved in heart process; Category No. 7587—negative regulation of aldosterone biosynthetic process; Category No. 7588—negative regulation of alkaline phosphatase activity; Category No. 7589—negative regulation of alpha-beta T cell activation; Category No. 7590—negative regulation of alpha-beta T cell differentiation; Category No. 7591—negative regulation of alpha-beta T cell proliferation; Category No. 7592—negative regulation of amacrine cell differentiation; Category No. 7593—negative regulation of amniotic stem cell differentiation; Category No. 7594—negative regulation of amyloid precursor protein biosynthetic process; Category No. 7595—negative regulation of amyloid precursor protein catabolic process; Category No. 7596—negative regulation of androgen receptor activity; Category No. 7597—negative regulation of androgen receptor signaling pathway; Category No. 7598—negative regulation of angiogenesis; Category No. 7599—negative regulation of anion channel activity; Category No. 7600—negative regulation of anoikis; Category No. 7601—negative regulation of anterograde synaptic vesicle transport; Category No. 7602—negative regulation of antibacterial peptide production; Category No. 7603—negative regulation of antigen processing and presentation; Category No. 7604—negative regulation of antigen processing and presentation of endogenous peptide antigen via MHC class I; Category No. 7605—negative regulation of antigen processing and presentation of peptide antigen via MHC class I; Category No. 7606—negative regulation of antigen processing and presentation of peptide antigen via MHC class II; Category No. 7607—negative regulation of antigen processing and presentation of peptide or polysaccharide antigen via MHC class II; Category No. 7608—negative regulation of anti-Mullerian hormone signaling pathway; Category No. 7609—negative regulation of APC-Cdc20 complex activity; Category No. 7610—negative regulation of apolipoprotein binding; Category No. 7611—negative regulation of apoptotic cell clearance; Category No. 7612—negative regulation of apoptotic DNA fragmentation; Category No. 7613—negative regulation of apoptotic process; Category No. 7614—negative regulation of apoptotic process in bone marrow; Category No. 7615—negative regulation of apoptotic process involved in metanephric collecting duct development; Category No. 7616—negative regulation of apoptotic process involved in metanephric nephron tubule development; Category No. 7617—negative regulation of apoptotic process involved in outflow tract morphogenesis; Category No. 7618—negative regulation of apoptotic signaling pathway; Category No. 7619—negative regulation of appetite; Category No. 7620—negative regulation of appetite by leptin-mediated signaling pathway; Category No. 7621—negative regulation of arachidonic acid secretion; Category No. 7622—negative regulation of arginine catabolic process; Category No. 7623—negative regulation of Arp2 3 complex-mediated actin nucleation; Category No. 7624—negative regulation of aspartic-type endopeptidase activity involved in amyloid precursor protein catabolic process; Category No. 7625—negative regulation of astrocyte differentiation; Category No. 7626—negative regulation of asymmetric cell division; Category No. 7627—negative regulation of ATF6-mediated unfolded protein response; Category No. 7628—negative regulation of ATP biosynthetic process; Category No. 7629—negative regulation of ATP citrate synthase activity; Category No. 7630—negative regulation of ATP metabolic process; Category No. 7631—negative regulation of ATPase activity; Category No. 7632—negative regulation of auditory receptor cell differentiation; Category No. 7633—negative regulation of autophagosome assembly; Category No. 7634—negative regulation of autophagosome maturation; Category No. 7635—negative regulation of autophagy; Category No. 7636—negative regulation of axon extension; Category No. 7637—negative regulation of axon extension involved in axon guidance; Category No. 7638—negative regulation of axon extension involved in regeneration; Category No. 7639—negative regulation of axon regeneration; Category No. 7640—negative regulation of axonogenesis; Category No. 7641—negative regulation of B cell activation; Category No. 7642—negative regulation of B cell apoptotic process; Category No. 7643—negative regulation of B cell differentiation; Category No. 7644—negative regulation of B cell proliferation; Category No. 7645—negative regulation of B cell receptor signaling pathway; Category No. 7646—negative regulation of barbed-end actin filament capping; Category No. 7647—negative regulation of behavior; Category No. 7648—negative regulation of beta-amyloid clearance; Category No. 7649—negative regulation of beta-amyloid formation; Category No. 7650—negative regulation of beta-galactosidase activity; Category No. 7651—negative regulation of bicellular tight junction assembly; Category No. 7652—negative regulation of bile acid biosynthetic process; Category No. 7653—negative regulation of binding; Category No. 7654—negative regulation of binding of sperm to zona pellucida; Category No. 7655—negative regulation of biomineral tissue development; Category No. 7656—negative regulation of biosynthetic process; Category No. 7657—negative regulation of blood coagulation; Category No. 7658—negative regulation of blood pressure; Category No. 7659—negative regulation of blood vessel endothelial cell migration; Category No. 7660—negative regulation of blood vessel endothelial cell proliferation involved in sprouting angiogenesis; Category No. 7661—negative regulation of blood vessel remodeling; Category No. 7662—negative regulation of BMP signaling pathway; Category No. 7663—negative regulation of bone development; Category No. 7664—negative regulation of bone mineralization; Category No. 7665—negative regulation of bone mineralization involved in bone maturation; Category No. 7666—negative regulation of bone remodeling; Category No. 7667—negative regulation of bone resorption; Category No. 7668—negative regulation of bone trabecula formation; Category No. 7669—negative regulation of branch elongation involved in ureteric bud branching by BMP signaling pathway; Category No. 7670—negative regulation of branching involved in ureteric bud morphogenesis; Category No. 7671—negative regulation of branching morphogenesis of a nerve; Category No. 7672—negative regulation of calcidiol 1-monooxygenase activity; Category No. 7673—negative regulation of calcineurin-NFAT signaling cascade; Category No. 7674—negative regulation of calcium ion binding; Category No. 7675—negative regulation of calcium ion import; Category No. 7676—negative regulation of calcium ion import into sarcoplasmic reticulum; Category No. 7677—negative regulation of calcium ion transmembrane transport; Category No. 7678—negative regulation of calcium ion transmembrane transporter activity; Category No. 7679—negative regulation of calcium ion transport; Category No. 7680—negative regulation of calcium ion transport into cytosol; Category No. 7681—negative regulation of calcium ion-dependent exocytosis; Category No. 7682—negative regulation of calcium:sodium antiporter activity; Category No. 7683—negative regulation of calcium-dependent ATPase activity; Category No. 7684—negative regulation of calcium-dependent cell-cell adhesion; Category No. 7685—negative regulation of calcium-independent cell-cell adhesion; Category No. 7686—negative regulation of calcium-mediated signaling; Category No. 7687—negative regulation of calcium-transporting ATPase activity; Category No. 7688—negative regulation of cAMP biosynthetic process; Category No. 7689—negative regulation of cAMP catabolic process; Category No. 7690—negative regulation of cAMP metabolic process; Category No. 7691—negative regulation of cAMP-dependent protein kinase activity; Category No. 7692—negative regulation of cAMP-mediated signaling; Category No. 7693—negative regulation of canonical Wnt signaling pathway; Category No. 7694—negative regulation of canonical Wnt signaling pathway involved in cardiac muscle cell fate commitment; Category No. 7695—negative regulation of canonical Wnt signaling pathway involved in controlling type B pancreatic cell proliferation; Category No. 7696—negative regulation of canonical Wnt signaling pathway involved in neural plate anterior posterior pattern formation; Category No. 7697—negative regulation of cardiac chamber formation; Category No. 7698—negative regulation of cardiac muscle cell apoptotic process; Category No. 7699—negative regulation of cardiac muscle cell differentiation; Category No. 7700—negative regulation of cardiac muscle cell myoblast differentiation; Category No. 7701—negative regulation of cardiac muscle cell proliferation; Category No. 7702—negative regulation of cardiac muscle contraction; Category No. 7703—negative regulation of cardiac muscle hypertrophy; Category No. 7704—negative regulation of cardiac muscle hypertrophy in response to stress; Category No. 7705—negative regulation of cardiac muscle tissue development; Category No. 7706—negative regulation of cardiac vascular smooth muscle cell differentiation; Category No. 7707—negative regulation of cargo loading into COPII-coated vesicle; Category No. 7708—negative regulation of cartilage development; Category No. 7709—negative regulation of catagen; Category No. 7710—negative regulation of catalytic activity; Category No. 7711—negative regulation of catecholamine secretion; Category No. 7712—negative regulation of catenin import into nucleus; Category No. 7713—negative regulation of cation channel activity; Category No. 7714—negative regulation of caveolin-mediated endocytosis; Category No. 7715—negative regulation of C—C chemokine binding; Category No. 7716—negative regulation of CD40 signaling pathway; Category No. 7717—negative regulation of CD4-positive; Category No. 7718—negative regulation of CD8-positive; Category No. 7719—negative regulation of cell adhesion; Category No. 7720—negative regulation of cell adhesion involved in substrate-bound cell migration; Category No. 7721—negative regulation of cell adhesion mediated by integrin; Category No. 7722—negative regulation of cell adhesion molecule production; Category No. 7723—negative regulation of cell aging; Category No. 7724—negative regulation of cell cycle; Category No. 7725—negative regulation of cell cycle arrest; Category No. 7726—negative regulation of cell cycle G1 S phase transition; Category No. 7727—negative regulation of cell cycle G2 M phase transition; Category No. 7728—negative regulation of cell death; Category No. 7729—negative regulation of cell development; Category No. 7730—negative regulation of cell differentiation; Category No. 7731—negative regulation of cell differentiation involved in embryonic placenta development; Category No. 7732—negative regulation of cell division; Category No. 7733—negative regulation of cell fate commitment; Category No. 7734—negative regulation of cell fate specification; Category No. 7735—negative regulation of cell growth; Category No. 7736—negative regulation of cell growth involved in cardiac muscle cell development; Category No. 7737—negative regulation of cell migration; Category No. 7738—negative regulation of cell migration involved in sprouting angiogenesis; Category No. 7739—negative regulation of cell morphogenesis involved in differentiation; Category No. 7740—negative regulation of cell motility; Category No. 7741—negative regulation of cell motility involved in cerebral cortex radial glia guided migration; Category No. 7742—negative regulation of cell projection organization; Category No. 7743—negative regulation of cell proliferation; Category No. 7744—negative regulation of cell proliferation involved in contact inhibition; Category No. 7745—negative regulation of cell proliferation involved in heart morphogenesis; Category No. 7746—negative regulation of cell proliferation involved in kidney development; Category No. 7747—negative regulation of cell proliferation involved in mesonephros development; Category No. 7748—negative regulation of cell size; Category No. 7749—negative regulation of cell volume; Category No. 7750—negative regulation of cell-cell adhesion; Category No. 7751—negative regulation of cell-cell adhesion by negative regulation of transcription from RNA polymerase II promoter; Category No. 7752—negative regulation of cell-cell adhesion mediated by cadherin; Category No. 7753—negative regulation of cell-cell adhesion mediated by integrin; Category No. 7754—negative regulation of cell-matrix adhesion; Category No. 7755—negative regulation of cell-substrate adhesion; Category No. 7756—negative regulation of cellular component movement; Category No. 7757—negative regulation of cellular extravasation; Category No. 7758—negative regulation of cellular glucuronidation; Category No. 7759—negative regulation of cellular metabolic process; Category No. 7760—negative regulation of cellular organofluorine metabolic process; Category No. 7761—negative regulation of cellular pH reduction; Category No. 7762—negative regulation of cellular process; Category No. 7763—negative regulation of cellular protein catabolic process; Category No. 7764—negative regulation of cellular protein localization; Category No. 7765—negative regulation of cellular protein metabolic process; Category No. 7766—negative regulation of cellular respiration; Category No. 7767—negative regulation of cellular response to growth factor stimulus; Category No. 7768—negative regulation of cellular response to heat; Category No. 7769—negative regulation of cellular response to hepatocyte growth factor stimulus; Category No. 7770—negative regulation of cellular response to hypoxia; Category No. 7771—negative regulation of cellular response to testosterone stimulus; Category No. 7772—negative regulation of cellular response to vascular endothelial growth factor stimulus; Category No. 7773—negative regulation of cellular senescence; Category No. 7774—negative regulation of centriole elongation; Category No. 7775—negative regulation of centriole replication; Category No. 7776—negative regulation of centriole-centriole cohesion; Category No. 7777—negative regulation of centrosome duplication; Category No. 7778—negative regulation of cerebellar granule cell precursor proliferation; Category No. 7779—negative regulation of cGMP biosynthetic process; Category No. 7780—negative regulation of cGMP metabolic process; Category No. 7781—negative regulation of cGMP-mediated signaling; Category No. 7782—negative regulation of chaperone-mediated autophagy; Category No. 7783—negative regulation of chaperone-mediated protein folding; Category No. 7784—negative regulation of chemokine (C—C motif) ligand 5 production; Category No. 7785—negative regulation of chemokine (C—X—C motif) ligand 2 production; Category No. 7786—negative regulation of chemokine biosynthetic process; Category No. 7787—negative regulation of chemokine production; Category No. 7788—negative regulation of chemokine secretion; Category No. 7789—negative regulation of chemokine-mediated signaling pathway; Category No. 7790—negative regulation of chemotaxis; Category No. 7791—negative regulation of cholangiocyte apoptotic process; Category No. 7792—negative regulation of cholesterol biosynthetic process; Category No. 7793—negative regulation of cholesterol efflux; Category No. 7794—negative regulation of cholesterol import; Category No. 7795—negative regulation of cholesterol storage; Category No. 7796—negative regulation of cholesterol transport; Category No. 7797—negative regulation of cholesterol transporter activity; Category No. 7798—negative regulation of chondrocyte development; Category No. 7799—negative regulation of chondrocyte differentiation; Category No. 7800—negative regulation of chondrocyte proliferation; Category No. 7801—negative regulation of chorionic trophoblast cell proliferation; Category No. 7802—negative regulation of chromatin binding; Category No. 7803—negative regulation of chromatin silencing; Category No. 7804—negative regulation of chromatin silencing at rDNA; Category No. 7805—negative regulation of chromosome organization; Category No. 7806—negative regulation of chronic inflammatory response; Category No. 7807—negative regulation of chronic inflammatory response to antigenic stimulus; Category No. 7808—negative regulation of chronic inflammatory response to non-antigenic stimulus; Category No. 7809—negative regulation of cilium assembly; Category No. 7810—negative regulation of circadian rhythm; Category No. 7811—negative regulation of circadian sleep wake cycle; Category No. 7812—negative regulation of citrulline biosynthetic process; Category No. 7813—negative regulation of clathrin-mediated endocytosis; Category No. 7814—negative regulation of coagulation; Category No. 7815—negative regulation of collagen binding; Category No. 7816—negative regulation of collagen biosynthetic process; Category No. 7817—negative regulation of collagen catabolic process; Category No. 7818—negative regulation of collagen fibril organization; Category No. 7819—negative regulation of collateral sprouting; Category No. 7820—negative regulation of collateral sprouting in absence of injury; Category No. 7821—negative regulation of collateral sprouting of intact axon in response to injury; Category No. 7822—negative regulation of collecting lymphatic vessel constriction; Category No. 7823—negative regulation of complement activation; Category No. 7824—negative regulation of complement-dependent cytotoxicity; Category No. 7825—negative regulation of constitutive secretory pathway; Category No. 7826—negative regulation of convergent extension involved in axis elongation; Category No. 7827—negative regulation of corticotropin secretion; Category No. 7828—negative regulation of corticotropin-releasing hormone receptor activity; Category No. 7829—negative regulation of cortisol biosynthetic process; Category No. 7830—negative regulation of cortisol secretion; Category No. 7831—negative regulation of CREB transcription factor activity; Category No. 7832—negative regulation of cyclic-nucleotide phosphodiesterase activity; Category No. 7833—negative regulation of cyclin catabolic process; Category No. 7834—negative regulation of cyclin-dependent protein kinase activity; Category No. 7835—negative regulation of cyclin-dependent protein serine threonine kinase activity; Category No. 7836—negative regulation of cyclin-dependent protein serine threonine kinase activity involved in G1 S transition of mitotic cell cycle; Category No. 7837—negative regulation of cyclin-dependent protein serine threonine kinase by cyclin degradation; Category No. 7838—negative regulation of cystathionine beta-synthase activity; Category No. 7839—negative regulation of cysteine-type endopeptidase activity; Category No. 7840—negative regulation of cysteine-type endopeptidase activity involved in apoptotic process; Category No. 7841—negative regulation of cysteine-type endopeptidase activity involved in apoptotic signaling pathway; Category No. 7842—negative regulation of cysteine-type endopeptidase activity involved in execution phase of apoptosis; Category No. 7843—negative regulation of cytokine activity; Category No. 7844—negative regulation of cytokine biosynthetic process; Category No. 7845—negative regulation of cytokine production; Category No. 7846—negative regulation of cytokine production involved in inflammatory response; Category No. 7847—negative regulation of cytokine secretion; Category No. 7848—negative regulation of cytokine secretion involved in immune response; Category No. 7849—negative regulation of cytokine-mediated signaling pathway; Category No. 7850—negative regulation of cytokinesis; Category No. 7851—negative regulation of cytolysis; Category No. 7852—negative regulation of cytoplasmic translation; Category No. 7853—negative regulation of cytoplasmic translational elongation; Category No. 7854—negative regulation of cytoskeleton organization; Category No. 7855—negative regulation of cytosolic calcium ion concentration; Category No. 7856—negative regulation of D-amino-acid oxidase activity; Category No. 7857—negative regulation of death-inducing signaling complex assembly; Category No. 7858—negative regulation of defecation; Category No. 7859—negative regulation of defense response to bacterium; Category No. 7860—negative regulation of defense response to virus; Category No. 7861—negative regulation of defense response to virus by host; Category No. 7862—negative regulation of delayed rectifier potassium channel activity; Category No. 7863—negative regulation of dendrite development; Category No. 7864—negative regulation of dendrite morphogenesis; Category No. 7865—negative regulation of dendritic cell antigen processing and presentation; Category No. 7866—negative regulation of dendritic cell apoptotic process; Category No. 7867—negative regulation of dendritic cell cytokine production; Category No. 7868—negative regulation of dendritic cell dendrite assembly; Category No. 7869—negative regulation of dendritic cell differentiation; Category No. 7870—negative regulation of dendritic spine development; Category No. 7871—negative regulation of dendritic spine maintenance; Category No. 7872—negative regulation of dendritic spine morphogenesis; Category No. 7873—negative regulation of dense core granule biogenesis; Category No. 7874—negative regulation of dephosphorylation; Category No. 7875—negative regulation of dermatome development; Category No. 7876—negative regulation of detection of glucose; Category No. 7877—negative regulation of determination of dorsal identity; Category No. 7878—negative regulation of developmental growth; Category No. 7879—negative regulation of DNA binding; Category No. 7880—negative regulation of DNA biosynthetic process; Category No. 7881—negative regulation of DNA catabolic process; Category No. 7882—negative regulation of DNA damage checkpoint; Category No. 7883—negative regulation of DNA damage response; Category No. 7884—negative regulation of DNA demethylation; Category No. 7885—negative regulation of DNA endoreduplication; Category No. 7886—negative regulation of DNA metabolic process; Category No. 7887—negative regulation of DNA recombination; Category No. 7888—negative regulation of DNA recombination at telomere; Category No. 7889—negative regulation of DNA repair; Category No. 7890—negative regulation of DNA replication; Category No. 7891—negative regulation of DNA-templated transcription; Category No. 7892—negative regulation of dopamine metabolic process; Category No. 7893—negative regulation of dopamine receptor signaling pathway; Category No. 7894—negative regulation of dopamine secretion; Category No. 7895—negative regulation of dopamine uptake involved in synaptic transmission; Category No. 7896—negative regulation of dopaminergic neuron differentiation; Category No. 7897—negative regulation of double-strand break repair; Category No. 7898—negative regulation of double-strand break repair via homologous recombination; Category No. 7899—negative regulation of double-strand break repair via nonhomologous end joining; Category No. 7900—negative regulation of double-strand break repair via single-strand annealing; Category No. 7901—negative regulation of ductus arteriosus closure; Category No. 7902—negative regulation of early endosome to late endosome transport; Category No. 7903—negative regulation of ectoderm development; Category No. 7904—negative regulation of ectodermal cell fate specification; Category No. 7905—negative regulation of elastin biosynthetic process; Category No. 7906—negative regulation of elastin catabolic process; Category No. 7907—negative regulation of embryonic development; Category No. 7908—negative regulation of endocytosis; Category No. 7909—negative regulation of endodeoxyribonuclease activity; Category No. 7910—negative regulation of endodermal cell differentiation; Category No. 7911—negative regulation of endodermal cell fate specification; Category No. 7912—negative regulation of endopeptidase activity; Category No. 7913—negative regulation of endoplasmic reticulum calcium ion concentration; Category No. 7914—negative regulation of endoplasmic reticulum stress-induced eIF2 alpha phosphorylation; Category No. 7915—negative regulation of endoplasmic reticulum stress-induced intrinsic apoptotic signaling pathway; Category No. 7916—negative regulation of endoplasmic reticulum stress-induced neuron intrinsic apoptotic signaling pathway; Category No. 7917—negative regulation of endoplasmic reticulum unfolded protein response; Category No. 7918—negative regulation of endoribonuclease activity; Category No. 7919—negative regulation of endothelial cell apoptotic process; Category No. 7920—negative regulation of endothelial cell chemotaxis; Category No. 7921—negative regulation of endothelial cell chemotaxis to fibroblast growth factor; Category No. 7922—negative regulation of endothelial cell differentiation; Category No. 7923—negative regulation of endothelial cell migration; Category No. 7924—negative regulation of endothelial cell proliferation; Category No. 7925—negative regulation of endothelin secretion; Category No. 7926—negative regulation of energy homeostasis; Category No. 7927—negative regulation of entry of bacterium into host cell; Category No. 7928—negative regulation of eosinophil activation; Category No. 7929—negative regulation of eosinophil degranulation; Category No. 7930—negative regulation of eosinophil extravasation; Category No. 7931—negative regulation of eosinophil migration; Category No. 7932—negative regulation of epidermal cell differentiation; Category No. 7933—negative regulation of epidermal growth factor receptor signaling pathway; Category No. 7934—negative regulation of epidermal growth factor-activated receptor activity; Category No. 7935—negative regulation of epinephrine secretion; Category No. 7936—negative regulation of epithelial cell apoptotic process; Category No. 7937—negative regulation of epithelial cell differentiation; Category No. 7938—negative regulation of epithelial cell migration; Category No. 7939—negative regulation of epithelial cell proliferation; Category No. 7940—negative regulation of epithelial cell proliferation involved in lung morphogenesis; Category No. 7941—negative regulation of epithelial cell proliferation involved in prostate gland development; Category No. 7942—negative regulation of epithelial to mesenchymal transition; Category No. 7943—negative regulation of ERAD pathway; Category No. 7944— negative regulation of ER-associated ubiquitin-dependent protein catabolic process; Category No. 7945—negative regulation of ERBB signaling pathway; Category No. 7946—negative regulation of ERK1 and ERK2 cascade; Category No. 7947—negative regulation of ERK5 cascade; Category No. 7948—negative regulation of erythrocyte aggregation; Category No. 7949—negative regulation of erythrocyte apoptotic process; Category No. 7950—negative regulation of erythrocyte clearance; Category No. 7951—negative regulation of erythrocyte differentiation; Category No. 7952—negative regulation of establishment of blood-brain barrier; Category No. 7953—negative regulation of establishment of endothelial barrier; Category No. 7954—negative regulation of establishment of protein localization to mitochondrion; Category No. 7955—negative regulation of establishment of protein localization to plasma membrane; Category No. 7956—negative regulation of estrogen receptor binding; Category No. 7957—negative regulation of excitatory postsynaptic potential; Category No. 7958—negative regulation of execution phase of apoptosis; Category No. 7959—negative regulation of exit from mitosis; Category No. 7960—negative regulation of exo-alpha-sialidase activity; Category No. 7961—negative regulation of exocytosis; Category No. 7962—negative regulation of exosomal secretion; Category No. 7963—negative regulation of extracellular matrix disassembly; Category No. 7964—negative regulation of extracellular matrix organization; Category No. 7965—negative regulation of extrinsic apoptotic signaling pathway; Category No. 7966—negative regulation of extrinsic apoptotic signaling pathway in absence of ligand; Category No. 7967—negative regulation of extrinsic apoptotic signaling pathway via death domain receptors; Category No. 7968—negative regulation of eye pigmentation; Category No. 7969—negative regulation of Fas signaling pathway; Category No. 7970—negative regulation of FasL biosynthetic process; Category No. 7971—negative regulation of fat cell differentiation; Category No. 7972—negative regulation of fat cell proliferation; Category No. 7973—negative regulation of fatty acid beta-oxidation; Category No. 7974—negative regulation of fatty acid biosynthetic process; Category No. 7975—negative regulation of fatty acid metabolic process; Category No. 7976—negative regulation of fatty acid oxidation; Category No. 7977—negative regulation of feeding behavior; Category No. 7978—negative regulation of female gonad development; Category No. 7979—negative regulation of female receptivity; Category No. 7980—negative regulation of fermentation; Category No. 7981—negative regulation of ferrous iron export; Category No. 7982—negative regulation of fibril organization; Category No. 7983—negative regulation of fibrinolysis; Category No. 7984—negative regulation of fibroblast apoptotic process; Category No. 7985—negative regulation of fibroblast growth factor production; Category No. 7986—negative regulation of fibroblast growth factor receptor signaling pathway; Category No. 7987—negative regulation of fibroblast growth factor receptor signaling pathway involved in neural plate anterior posterior pattern formation; Category No. 7988—negative regulation of fibroblast growth factor receptor signaling pathway involved in ureteric bud formation; Category No. 7989—negative regulation of fibroblast migration; Category No. 7990—negative regulation of fibroblast proliferation; Category No. 7991—negative regulation of filopodium assembly; Category No. 7992—negative regulation of focal adhesion assembly; Category No. 7993—negative regulation of follicle-stimulating hormone secretion; Category No. 7994—negative regulation of forebrain neuron differentiation; Category No. 7995—negative regulation of formation of translation preinitiation complex; Category No. 7996—negative regulation of G0 to G1 transition; Category No. 7997—negative regulation of G1 S transition of mitotic cell cycle; Category No. 7998—negative regulation of G1 S transition of mitotic cell cycle by negative regulation of transcription from RNA polymerase II promoter; Category No. 7999—negative regulation of G2 M transition of mitotic cell cycle; Category No. 8000—negative regulation of gamma-aminobutyric acid secretion; Category No. 8001—negative regulation of gap junction assembly; Category No. 8002—negative regulation of gastric acid secretion; Category No. 8003—negative regulation of gastrin-induced gastric acid secretion; Category No. 8004—negative regulation of gene expression; Category No. 8005—negative regulation of gene silencing by miRNA; Category No. 8006—negative regulation of germinal center formation; Category No. 8007—negative regulation of glial cell apoptotic process; Category No. 8008—negative regulation of glial cell differentiation; Category No. 8009—negative regulation of glial cell proliferation; Category No. 8010—negative regulation of glial cell-derived neurotrophic factor receptor signaling pathway involved in ureteric bud formation; Category No. 8011—negative regulation of glomerular filtration; Category No. 8012—negative regulation of glomerular filtration by angiotensin; Category No. 8013—negative regulation of glomerular mesangial cell proliferation; Category No. 8014—negative regulation of glomerulus development; Category No. 8015—negative regulation of glucagon secretion; Category No. 8016—negative regulation of glucocorticoid biosynthetic process; Category No. 8017—negative regulation of glucocorticoid mediated signaling pathway; Category No. 8018—negative regulation of glucocorticoid receptor signaling pathway; Category No. 8019—negative regulation of glucocorticoid secretion; Category No. 8020—negative regulation of glucokinase activity; Category No. 8021—negative regulation of gluconeogenesis; Category No. 8022—negative regulation of glucose catabolic process to lactate via pyruvate; Category No. 8023—negative regulation of glucose import; Category No. 8024—negative regulation of glucose import in response to insulin stimulus; Category No. 8025—negative regulation of glucose transport; Category No. 8026—negative regulation of glucosylceramide biosynthetic process; Category No. 8027—negative regulation of glucuronosyltransferase activity; Category No. 8028—negative regulation of glutamate metabolic process; Category No. 8029—negative regulation of glutamate secretion; Category No. 8030—negative regulation of glutamine transport; Category No. 8031—negative regulation of glycogen (starch) synthase activity; Category No. 8032—negative regulation of glycogen biosynthetic process; Category No. 8033—negative regulation of glycogen catabolic process; Category No. 8034—negative regulation of glycogen synthase activity; Category No. 8035—negative regulation of glycolytic process; Category No. 8036—negative regulation of glycoprotein metabolic process; Category No. 8037—negative regulation of Golgi to plasma membrane protein transport; Category No. 8038—negative regulation of gonadotropin secretion; Category No. 8039—negative regulation of G-protein coupled receptor internalization; Category No. 8040—negative regulation of G-protein coupled receptor protein signaling pathway; Category No. 8041—negative regulation of granulocyte differentiation; Category No. 8042—negative regulation of growth; Category No. 8043—negative regulation of growth hormone receptor signaling pathway; Category No. 8044—negative regulation of growth hormone secretion; Category No. 8045—negative regulation of growth of symbiont in host; Category No. 8046—negative regulation of growth of symbiont involved in interaction with host; Category No. 8047—negative regulation of GTP binding; Category No. 8048—negative regulation of GTP cyclohydrolase I activity; Category No. 8049—negative regulation of GTPase activity; Category No. 8050—negative regulation of guanylate cyclase activity; Category No. 8051—negative regulation of hair cycle; Category No. 8052—negative regulation of hair follicle development; Category No. 8053—negative regulation of hair follicle placode formation; Category No. 8054—negative regulation of heart contraction; Category No. 8055—negative regulation of heart induction by canonical Wnt signaling pathway; Category No. 8056—negative regulation of heart looping; Category No. 8057—negative regulation of heart rate; Category No. 8058—negative regulation of heart rate involved in baroreceptor response to increased systemic arterial blood pressure; Category No. 8059—negative regulation of heat generation; Category No. 8060—negative regulation of helicase activity; Category No. 8061—negative regulation of hematopoietic progenitor cell differentiation; Category No. 8062—negative regulation of hematopoietic stem cell differentiation; Category No. 8063—negative regulation of hemoglobin biosynthetic process; Category No. 8064—negative regulation of hepatic stellate cell activation; Category No. 8065—negative regulation of hepatocyte differentiation; Category No. 8066—negative regulation of hepatocyte growth factor biosynthetic process; Category No. 8067—negative regulation of hepatocyte growth factor receptor signaling pathway; Category No. 8068—negative regulation of hepatocyte proliferation; Category No. 8069—negative regulation of heterotypic cell-cell adhesion; Category No. 8070—negative regulation of high-density lipoprotein particle clearance; Category No. 8071—negative regulation of hippo signaling; Category No. 8072—negative regulation of histone acetylation; Category No. 8073—negative regulation of histone deacetylase activity; Category No. 8074—negative regulation of histone deacetylation; Category No. 8075—negative regulation of histone H2A K63-linked ubiquitination; Category No. 8076—negative regulation of histone H3-K14 acetylation; Category No. 8077—negative regulation of histone H3-K27 acetylation; Category No. 8078—negative regulation of histone H3-K27 methylation; Category No. 8079—negative regulation of histone H3-K36 methylation; Category No. 8080—negative regulation of histone H3-K4 methylation; Category No. 8081—negative regulation of histone H3-K9 methylation; Category No. 8082—negative regulation of histone H3-K9 trimethylation; Category No. 8083—negative regulation of histone H4 acetylation; Category No. 8084—negative regulation of histone H4-K16 acetylation; Category No. 8085—negative regulation of histone methylation; Category No. 8086—negative regulation of histone phosphorylation; Category No. 8087—negative regulation of homotypic cell-cell adhesion; Category No. 8088—negative regulation of hormone biosynthetic process; Category No. 8089—negative regulation of hormone secretion; Category No. 8090—negative regulation of humoral immune response mediated by circulating immunoglobulin; Category No. 8091—negative regulation of hyaluronan biosynthetic process; Category No. 8092—negative regulation of hydrogen peroxide biosynthetic process; Category No. 8093—negative regulation of hydrogen peroxide catabolic process; Category No. 8094—negative regulation of hydrogen peroxide metabolic process; Category No. 8095—negative regulation of hydrogen peroxide-induced cell death; Category No. 8096—negative regulation of hydrogen peroxide-induced neuron death; Category No. 8097—negative regulation of hydrogen peroxide-induced neuron intrinsic apoptotic signaling pathway; Category No. 8098—negative regulation of hydrogen peroxide-mediated programmed cell death; Category No. 8099—negative regulation of hydrolase activity; Category No. 8100—negative regulation of hypoxia-induced intrinsic apoptotic signaling pathway; Category No. 8101—negative regulation of hypoxia-inducible factor-1alpha signaling pathway; Category No. 8102—negative regulation of icosanoid secretion; Category No. 8103—negative regulation of 1-kappaB kinase NF-kappaB signaling; Category No. 8104—negative regulation of immature T cell proliferation; Category No. 8105—negative regulation of immature T cell proliferation in thymus; Category No. 8106—negative regulation of immune response; Category No. 8107—negative regulation of immune system process; Category No. 8108—negative regulation of immunoglobulin production; Category No. 8109—negative regulation of immunoglobulin secretion; Category No. 8110—negative regulation of immunological synapse formation; Category No. 8111—negative regulation of inclusion body assembly; Category No. 8112—negative regulation of inflammatory response; Category No. 8113—negative regulation of inflammatory response to antigenic stimulus; Category No. 8114—negative regulation of innate immune response; Category No. 8115—negative regulation of inner ear receptor cell differentiation; Category No. 8116—negative regulation of inositol phosphate biosynthetic process; Category No. 8117—negative regulation of insulin receptor signaling pathway; Category No. 8118—negative regulation of insulin secretion; Category No. 8119—negative regulation of insulin secretion involved in cellular response to glucose stimulus; Category No. 8120—negative regulation of insulin-like growth factor receptor signaling pathway; Category No. 8121—negative regulation of integrin activation; Category No. 8122—negative regulation of integrin biosynthetic process; Category No. 8123—negative regulation of integrin-mediated signaling pathway; Category No. 8124—negative regulation of interferon-alpha biosynthetic process; Category No. 8125—negative regulation of interferon-beta biosynthetic process; Category No. 8126—negative regulation of interferon-beta production; Category No. 8127—negative regulation of interferon-beta secretion; Category No. 8128—negative regulation of interferon-gamma biosynthetic process; Category No. 8129—negative regulation of interferon-gamma production; Category No. 8130—negative regulation of interferon-gamma secretion; Category No. 8131—negative regulation of interferon-gamma-mediated signaling pathway; Category No. 8132—negative regulation of interleukin-1 alpha secretion; Category No. 8133—negative regulation of interleukin-1 beta production; Category No. 8134—negative regulation of interleukin-1 beta secretion; Category No. 8135—negative regulation of interleukin-1 production; Category No. 8136—negative regulation of interleukin-1 secretion; Category No. 8137—negative regulation of interleukin-10 biosynthetic process; Category No. 8138—negative regulation of interleukin-10 production; Category No. 8139—negative regulation of interleukin-10 secretion; Category No. 8140—negative regulation of interleukin-12 biosynthetic process; Category No. 8141—negative regulation of interleukin-12 production; Category No. 8142—negative regulation of interleukin-12 secretion; Category No. 8143—negative regulation of interleukin-13 production; Category No. 8144—negative regulation of interleukin-13 secretion; Category No. 8145—negative regulation of interleukin-17 production; Category No. 8146—negative regulation of interleukin-18 production; Category No. 8147—negative regulation of interleukin-1-mediated signaling pathway; Category No. 8148—negative regulation of interleukin-2 biosynthetic process; Category No. 8149—negative regulation of interleukin-2 production; Category No. 8150—negative regulation of interleukin-2 secretion; Category No. 8151—negative regulation of interleukin-23 production; Category No. 8152—negative regulation of interleukin-2-mediated signaling pathway; Category No. 8153—negative regulation of interleukin-4 biosynthetic process; Category No. 8154—negative regulation of interleukin-4 production; Category No. 8155—negative regulation of interleukin-4-mediated signaling pathway; Category No. 8156—negative regulation of interleukin-5 production; Category No. 8157—negative regulation of interleukin-5 secretion; Category No. 8158—negative regulation of interleukin-6 biosynthetic process; Category No. 8159—negative regulation of interleukin-6 production; Category No. 8160—negative regulation of interleukin-6 secretion; Category No. 8161—negative regulation of interleukin-6-mediated signaling pathway; Category No. 8162—negative regulation of interleukin-8 biosynthetic process; Category No. 8163—negative regulation of interleukin-8 production; Category No. 8164—negative regulation of interleukin-8 secretion; Category No. 8165—negative regulation of intestinal absorption; Category No. 8166—negative regulation of intestinal cholesterol absorption; Category No. 8167—negative regulation of intestinal phytosterol absorption; Category No. 8168—negative regulation of intracellular calcium activated chloride channel activity; Category No. 8169—negative regulation of intracellular estrogen receptor signaling pathway; Category No. 8170—negative regulation of intracellular protein transport; Category No. 8171—negative regulation of intracellular signal transduction; Category No. 8172—negative regulation of intracellular steroid hormone receptor signaling pathway; Category No. 8173—negative regulation of intracellular transport; Category No. 8174—negative regulation of intracellular transport of viral material; Category No. 8175—negative regulation of intrinsic apoptotic signaling pathway; Category No. 8176—negative regulation of intrinsic apoptotic signaling pathway by p53 class mediator; Category No. 8177—negative regulation of intrinsic apoptotic signaling pathway in response to DNA damage; Category No. 8178—negative regulation of intrinsic apoptotic signaling pathway in response to DNA damage by p53 class mediator; Category No. 8179—negative regulation of intrinsic apoptotic signaling pathway in response to hydrogen peroxide; Category No. 8180—negative regulation of intrinsic apoptotic signaling pathway in response to osmotic stress; Category No. 8181—negative regulation of intrinsic apoptotic signaling pathway in response to osmotic stress by p53 class mediator; Category No. 8182—negative regulation of iodide transmembrane transport; Category No. 8183—negative regulation of ion transmembrane transport; Category No. 8184—negative regulation of ion transmembrane transporter activity; Category No. 8185—negative regulation of ion transport; Category No. 8186—negative regulation of IRE1-mediated unfolded protein response; Category No. 8187—negative regulation of iron channel activity; Category No. 8188—negative regulation of iron ion transmembrane transport; Category No. 8189—negative regulation of isotype switching to IgA isotypes; Category No. 8190—negative regulation of isotype switching to IgE isotypes; Category No. 8191—negative regulation of JAK-STAT cascade; Category No. 8192—negative regulation of JNK cascade; Category No. 8193—negative regulation of JUN kinase activity; Category No. 8194—negative regulation of keratinocyte apoptotic process; Category No. 8195—negative regulation of keratinocyte differentiation; Category No. 8196—negative regulation of keratinocyte proliferation; Category No. 8197—negative regulation of kidney smooth muscle cell differentiation; Category No. 8198—negative regulation of kinase activity; Category No. 8199—negative regulation of Kit signaling pathway; Category No. 8200—negative regulation of lamellipodium assembly; Category No. 8201—negative regulation of lamellipodium morphogenesis; Category No. 8202—negative regulation of late endosome to lysosome transport; Category No. 8203—negative regulation of lens fiber cell differentiation; Category No. 8204—negative regulation of leucine-tRNA ligase activity; Category No. 8205—negative regulation of leukocyte activation; Category No. 8206—negative regulation of leukocyte apoptotic process; Category No. 8207—negative regulation of leukocyte cell-cell adhesion; Category No. 8208—negative regulation of leukocyte chemotaxis; Category No. 8209—negative regulation of leukocyte migration; Category No. 8210—negative regulation of leukocyte proliferation; Category No. 8211—negative regulation of leukocyte tethering or rolling; Category No. 8212—negative regulation of ligand-dependent nuclear receptor transcription coactivator activity; Category No. 8213—negative regulation of lipase activity; Category No. 8214—negative regulation of lipid binding; Category No. 8215—negative regulation of lipid biosynthetic process; Category No. 8216—negative regulation of lipid catabolic process; Category No. 8217—negative regulation of lipid kinase activity; Category No. 8218—negative regulation of lipid metabolic process; Category No. 8219—negative regulation of lipid storage; Category No. 8220—negative regulation of lipid transport; Category No. 8221—negative regulation of lipid transport across blood brain barrier; Category No. 8222—negative regulation of lipopolysaccharide-mediated signaling pathway; Category No. 8223—negative regulation of lipoprotein lipase activity; Category No. 8224—negative regulation of lipoprotein lipid oxidation; Category No. 8225—negative regulation of lipoprotein metabolic process; Category No. 8226—negative regulation of locomotion involved in locomotory behavior; Category No. 8227—negative regulation of long term synaptic depression; Category No. 8228—negative regulation of long-term synaptic potentiation; Category No. 8229—negative regulation of low-density lipoprotein particle clearance; Category No. 8230—negative regulation of low-density lipoprotein particle receptor biosynthetic process; Category No. 8231—negative regulation of low-density lipoprotein particle receptor catabolic process; Category No. 8232—negative regulation of lung ciliated cell differentiation; Category No. 8233—negative regulation of luteinizing hormone secretion; Category No. 8234—negative regulation of lyase activity; Category No. 8235—negative regulation of lymphangiogenesis; Category No. 8236—negative regulation of lymphocyte activation; Category No. 8237—negative regulation of lymphocyte chemotaxis; Category No. 8238—negative regulation of lymphocyte differentiation; Category No. 8239—negative regulation of lymphocyte migration; Category No. 8240—negative regulation of lymphocyte proliferation; Category No. 8241—negative regulation of macroautophagy; Category No. 8242—negative regulation of macromitophagy; Category No. 8243—negative regulation of macrophage activation; Category No. 8244—negative regulation of macrophage apoptotic process; Category No. 8245—negative regulation of macrophage chemotaxis; Category No. 8246—negative regulation of macrophage colony-stimulating factor signaling pathway; Category No.

8247—negative regulation of macrophage cytokine production; Category No. 8248—negative regulation of macrophage derived foam cell differentiation; Category No. 8249—negative regulation of macrophage differentiation; Category No. 8250—negative regulation of macrophage fusion; Category No. 8251—negative regulation of macrophage inflammatory protein 1 alpha production; Category No. 8252—negative regulation of male germ cell proliferation; Category No. 8253—negative regulation of male gonad development; Category No. 8254—negative regulation of mammary gland epithelial cell proliferation; Category No. 8255—negative regulation of MAP kinase activity; Category No. 8256—negative regulation of MAPK cascade; Category No. 8257—negative regulation of mast cell activation; Category No. 8258—negative regulation of mast cell activation involved in immune response; Category No. 8259—negative regulation of mast cell apoptotic process; Category No. 8260—negative regulation of mast cell cytokine production; Category No. 8261—negative regulation of mast cell degranulation; Category No. 8262—negative regulation of mast cell differentiation; Category No. 8263—negative regulation of mast cell proliferation; Category No. 8264—negative regulation of mature B cell apoptotic process; Category No. 8265—negative regulation of MDA-5 signaling pathway; Category No. 8266—negative regulation of megakaryocyte differentiation; Category No. 8267—negative regulation of meiotic cell cycle; Category No. 8268—negative regulation of meiotic cell cycle phase transition; Category No. 8269—negative regulation of meiotic nuclear division; Category No. 8270—negative regulation of melanin biosynthetic process; Category No. 8271—negative regulation of membrane depolarization during cardiac muscle cell action potential; Category No. 8272—negative regulation of membrane potential; Category No. 8273—negative regulation of membrane protein ectodomain proteolysis; Category No. 8274—negative regulation of membrane tubulation; Category No. 8275—negative regulation of memory T cell differentiation; Category No. 8276—negative regulation of mesenchymal cell apoptotic process; Category No. 8277—negative regulation of mesenchymal cell apoptotic process involved in mesonephric nephron morphogenesis; Category No. 8278—negative regulation of mesenchymal cell apoptotic process involved in metanephric nephron morphogenesis; Category No. 8279—negative regulation of mesenchymal cell apoptotic process involved in metanephros development; Category No. 8280—negative regulation of mesenchymal cell apoptotic process involved in nephron morphogenesis; Category No. 8281—negative regulation of mesenchymal cell proliferation; Category No. 8282—negative regulation of mesenchymal cell proliferation involved in lung development; Category No. 8283—negative regulation of mesenchymal cell proliferation involved in ureter development; Category No. 8284—negative regulation of mesenchymal stem cell differentiation; Category No. 8285—negative regulation of mesenchymal to epithelial transition involved in metanephros morphogenesis; Category No. 8286—negative regulation of mesoderm development; Category No. 8287—negative regulation of mesodermal cell fate specification; Category No. 8288—negative regulation of metabolic process; Category No. 8289—negative regulation of metalloendopeptidase activity involved in amyloid precursor protein catabolic process; Category No. 8290—negative regulation of metalloenzyme activity; Category No. 8291—negative regulation of metanephric comma-shaped body morphogenesis; Category No. 8292—negative regulation of metanephric glomerular mesangial cell proliferation; Category No. 8293—negative regulation of metanephric mesenchymal cell migration; Category No. 8294—negative regulation of metanephric nephron tubule epithelial cell differentiation; Category No. 8295—negative regulation of metanephric S-shaped body morphogenesis; Category No. 8296—negative regulation of metaphase anaphase transition of meiotic cell cycle; Category No. 8297—negative regulation of methylation-dependent chromatin silencing; Category No. 8298—negative regulation of MHC class II biosynthetic process; Category No. 8299—negative regulation of microglial cell migration; Category No. 8300—negative regulation of microtubule depolymerization; Category No. 8301—negative regulation of microtubule polymerization; Category No. 8302—negative regulation of microtubule polymerization or depolymerization; Category No. 8303—negative regulation of microvillus assembly; Category No. 8304—negative regulation of mitochondrial calcium ion concentration; Category No. 8305—negative regulation of mitochondrial depolarization; Category No. 8306—negative regulation of mitochondrial DNA replication; Category No. 8307—negative regulation of mitochondrial electron transport; Category No. 8308—negative regulation of mitochondrial fission; Category No. 8309—negative regulation of mitochondrial fusion; Category No. 8310—negative regulation of mitochondrial membrane permeability; Category No. 8311—negative regulation of mitochondrial membrane permeability involved in apoptotic process; Category No. 8312—negative regulation of mitochondrial membrane potential; Category No. 8313—negative regulation of mitochondrial outer membrane permeabilization involved in apoptotic signaling pathway; Category No. 8314—negative regulation of mitochondrial RNA catabolic process; Category No. 8315—negative regulation of mitochondrial translation; Category No. 8316—negative regulation of mitochondrion organization; Category No. 8317—negative regulation of mitophagy; Category No. 8318—negative regulation of mitotic cell cycle; Category No. 8319—negative regulation of mitotic cell cycle phase transition; Category No. 8320—negative regulation of mitotic nuclear division; Category No. 8321—negative regulation of mitotic recombination; Category No. 8322—negative regulation of mitotic sister chromatid separation; Category No. 8323—negative regulation of molecular function; Category No. 8324—negative regulation of monocyte chemotactic protein-1 production; Category No. 8325—negative regulation of monocyte chemotaxis; Category No. 8326—negative regulation of monocyte differentiation; Category No. 8327—negative regulation of monocyte extravasation; Category No. 8328—negative regulation of mononuclear cell migration; Category No. 8329—negative regulation of mononuclear cell proliferation; Category No. 8330—negative regulation of monooxygenase activity; Category No. 8331—negative regulation of motor neuron apoptotic process; Category No. 8332—negative regulation of mRNA 3'-end processing; Category No. 8333—negative regulation of mRNA modification; Category No. 8334—negative regulation of mRNA polyadenylation; Category No. 8335—negative regulation of mRNA splicing; Category No. 8336—negative regulation of mucus secretion; Category No. 8337—negative regulation of multicellular organism growth; Category No. 8338—negative regulation of multicellular organismal metabolic process; Category No. 8339—negative regulation of muscle atrophy; Category No. 8340—negative regulation of muscle cell apoptotic process; Category No. 8341—negative regulation of muscle cell differentiation; Category No. 8342—negative regulation of muscle contraction; Category No. 8343—negative regulation of muscle hyperplasia; Category No. 8344—negative regulation of muscle hypertrophy; Category No. 8345—negative regulation of muscle organ development; Category No. 8346—negative regulation of muscle tissue development; Category No. 8347—negative regulation of myelination; Category No. 8348—negative regulation of myeloid cell apoptotic process; Category No. 8349—negative regulation of myeloid cell differentiation; Category No. 8350—negative regulation of myeloid dendritic cell activation; Category No. 8351—negative regulation of myeloid leukocyte differentiation; Category No. 8352—negative regulation of myoblast differentiation; Category No. 8353—negative regulation of myoblast fusion; Category No. 8354—negative regulation of myoblast proliferation; Category No. 8355—negative regulation of myosin-light-chain-phosphatase activity; Category No. 8356—negative regulation of myotube differentiation; Category No. 8357—negative regulation of NAD(P)H oxidase activity; Category No. 8358—negative regulation of natural killer cell activation; Category No. 8359—negative regulation of natural killer cell chemotaxis; Category No. 8360—negative regulation of natural killer cell differentiation involved in immune response; Category No. 8361—negative regulation of natural killer cell mediated cytotoxicity; Category No. 8362—negative regulation of necroptotic process; Category No. 8363—negative regulation of necrotic cell death; Category No. 8364—negative regulation of negative chemotaxis; Category No. 8365—negative regulation of nephron tubule epithelial cell differentiation; Category No. 8366—negative regulation of neural crest formation; Category No. 8367—negative regulation of neural precursor cell proliferation; Category No. 8368—negative regulation of neuroblast proliferation; Category No. 8369—negative regulation of neurofibrillary tangle assembly; Category No. 8370—negative regulation of neurogenesis; Category No. 8371—negative regulation of neurological system process; Category No. 8372—negative regulation of neuromuscular junction development; Category No. 8373—negative regulation of neuron apoptotic process; Category No. 8374—negative regulation of neuron death; Category No. 8375—negative regulation of neuron differentiation; Category No. 8376—negative regulation of neuron maturation; Category No. 8377—negative regulation of neuron migration; Category No. 8378—negative regulation of neuron projection development; Category No. 8379—negative regulation of neurotransmitter secretion; Category No. 8380—negative regulation of neurotransmitter transport; Category No. 8381—negative regulation of neurotrophin production; Category No. 8382—negative regulation of neurotrophin TRK receptor signaling pathway; Category No. 8383—negative regulation of neutrophil activation; Category No. 8384—negative regulation of neutrophil apoptotic process; Category No. 8385—negative regulation of neutrophil chemotaxis; Category No. 8386—negative regulation of neutrophil degranulation; Category No. 8387—negative regulation of neutrophil differentiation; Category No. 8388—negative regulation of NFAT protein import into nucleus; Category No. 8389—negative regulation of NF-kappaB import into nucleus; Category No. 8390—negative regulation of NF-kappaB transcription factor activity; Category No. 8391—negative regulation of NIK NF-kappaB signaling; Category No. 8392—negative regulation of nitric oxide biosynthetic process; Category No. 8393—negative regulation of nitric oxide mediated signal transduction; Category No. 8394—negative regulation of nitric-oxide synthase activity; Category No. 8395—negative regulation of nitric-oxide synthase biosynthetic process; Category No. 8396—negative regulation of NK T cell activation; Category No. 8397—negative regulation of NLRP3 inflammasome complex assembly; Category No. 8398—negative regulation of nodal signaling pathway; Category No. 8399—negative regulation of non-canonical Wnt signaling pathway; Category No. 8400—negative regulation of norepinephrine secretion; Category No. 8401—negative regulation of norepinephrine uptake; Category No. 8402—negative regulation of Notch signaling pathway; Category No. 8403—negative regulation of Notch signaling pathway involved in somitogenesis; Category No. 8404—negative regulation of N-terminal protein palmitoylation; Category No. 8405—negative regulation of nuclear-transcribed mRNA catabolic process; Category No. 8406—negative regulation of nuclear-transcribed mRNA poly(A) tail shortening; Category No. 8407—negative regulation of nuclease activity; Category No. 8408—negative regulation of nucleic acid-templated transcription; Category No. 8409—negative regulation of nucleotide metabolic process; Category No. 8410—negative regulation of nucleotide-binding oligomerization domain containing 1 signaling pathway; Category No. 8411—negative regulation of nucleotide-binding oligomerization domain containing 2 signaling pathway; Category No. 8412—negative regulation of odontogenesis; Category No. 8413—negative regulation of odontogenesis of dentin-containing tooth; Category No. 8414—negative regulation of oligodendrocyte apoptotic process; Category No. 8415—negative regulation of oligodendrocyte differentiation; Category No. 8416—negative regulation of oligodendrocyte progenitor proliferation; Category No. 8417—negative regulation of oocyte development; Category No. 8418—negative regulation of oocyte maturation; Category No. 8419—negative regulation of organ growth; Category No. 8420—negative regulation of ossification; Category No. 8421—negative regulation of osteoblast differentiation; Category No. 8422—negative regulation of osteoblast proliferation; Category No. 8423—negative regulation of osteoclast development; Category No. 8424—negative regulation of osteoclast differentiation; Category No. 8425—negative regulation of osteoclast proliferation; Category No. 8426—negative regulation of ovarian follicle development; Category No. 8427—negative regulation of ovulation; Category No. 8428—negative regulation of oxidative phosphorylation; Category No. 8429—negative regulation of oxidative phosphorylation uncoupler activity; Category No. 8430—negative regulation of oxidative stress-induced cell death; Category No. 8431—negative regulation of oxidative stress-induced intrinsic apoptotic signaling pathway; Category No. 8432—negative regulation of oxidative stress-induced neuron death; Category No. 8433—negative regulation of oxidative stress-induced neuron intrinsic apoptotic signaling pathway; Category No. 8434—negative regulation of oxidoreductase activity; Category No. 8435—negative regulation of p38MAPK cascade; Category No. 8436—negative regulation of pancreatic A cell differentiation; Category No. 8437—negative regulation of pancreatic juice secretion; Category No. 8438—negative regulation of pancreatic stellate cell proliferation; Category No. 8439—negative regulation of pathway-restricted SMAD protein phosphorylation; Category No. 8440—negative regulation of penile erection; Category No. 8441—negative regulation of peptidase activity; Category No. 8442—negative regulation of peptide secretion; Category No. 8443—negative regulation of peptidyl-cysteine S-nitrosylation; Category No. 8444—negative regulation of peptidyl-lysine acetylation; Category No. 8445—negative regulation of peptidyl-serine dephosphorylation; Category No. 8446—negative regulation of peptidyl-serine phosphorylation; Category No. 8447—negative regulation of peptidyl-threonine phosphorylation; Category No. 8448—negative regulation of peptidyl-tyrosine autophosphorylation; Category No. 8449—negative regulation of peptidyl-tyrosine phosphorylation; Category No. 8450—negative regulation of PERK-mediated unfolded protein response; Category No. 8451—negative regulation of peroxidase activity; Category No. 8452—negative regulation of peroxisome proliferator activated receptor signaling pathway; Category No. 8453—negative regulation of phagocytosis; Category No. 8454—negative regulation of phosphatase activity; Category No. 8455—negative regulation of phosphatidylcholine biosynthetic process; Category No. 8456—negative regulation of phosphatidylcholine catabolic process; Category No. 8457—negative regulation of phosphatidylinositol 3-kinase activity; Category No. 8458—negative regulation of phosphatidylinositol 3-kinase signaling; Category No. 8459—negative regulation of phosphatidylinositol biosynthetic process; Category No. 8460—negative regulation of phosphatidylinositol-3,4,5-trisphosphate 5-phosphatase activity; Category No. 8461—negative regulation of phospholipase A2 activity; Category No. 8462—negative regulation of phospholipase activity; Category No. 8463—negative regulation of phospholipase C activity; Category No. 8464—negative regulation of phospholipase C-activating G-protein coupled receptor signaling pathway; Category No. 8465—negative regulation of phospholipid biosynthetic process; Category No. 8466—negative regulation of phospholipid efflux; Category No. 8467—negative regulation of phosphoprotein phosphatase activity; Category No. 8468—negative regulation of phosphorylation; Category No. 8469—negative regulation of photoreceptor cell differentiation; Category No. 8470—negative regulation of pinocytosis; Category No. 8471—negative regulation of planar cell polarity pathway involved in axis elongation; Category No. 8472—negative regulation of plasma lipoprotein particle oxidation; Category No. 8473—negative regulation of plasma membrane long-chain fatty acid transport; Category No. 8474—negative regulation of plasmacytoid dendritic cell cytokine production; Category No. 8475—negative regulation of plasminogen activation; Category No. 8476—negative regulation of platelet activation; Category No. 8477—negative regulation of platelet aggregation; Category No. 8478—negative regulation of platelet-derived growth factor receptor signaling pathway; Category No. 8479—negative regulation of platelet-derived growth factor receptor-alpha signaling pathway; Category No. 8480—negative regulation of platelet-derived growth factor receptor-beta signaling pathway; Category No. 8481—negative regulation of polyamine transmembrane transport; Category No. 8482—negative regulation of positive chemotaxis; Category No. 8483—negative regulation of positive thymic T cell selection; Category No. 8484—negative regulation of postsynaptic membrane organization; Category No. 8485—negative regulation of post-translational protein modification; Category No. 8486—negative regulation of potassium ion export; Category No. 8487—negative regulation of potassium ion transmembrane transport; Category No. 8488—negative regulation of potassium ion transmembrane transporter activity; Category No. 8489—negative regulation of potassium ion transport; Category No. 8490—negative regulation of pre-miRNA processing; Category No. 8491—negative regulation of presynaptic membrane organization; Category No. 8492—negative regulation of primary amine oxidase activity; Category No. 8493—negative regulation of pri-miRNA transcription from RNA polymerase II promoter; Category No. 8494—negative regulation of pro-B cell differentiation; Category No. 8495—negative regulation of production of siRNA involved in RNA interference; Category No. 8496—negative regulation of programmed cell death; Category No. 8497—negative regulation of prolactin secretion; Category No. 8498—negative regulation of prolactin signaling pathway; Category No. 8499—negative regulation of prostaglandin biosynthetic process; Category No. 8500—negative regulation of prostaglandin secretion; Category No. 8501—negative regulation of prostatic bud formation; Category No. 8502—negative regulation of proteasomal protein catabolic process; Category No. 8503—negative regulation of proteasomal ubiquitin-dependent protein catabolic process; Category No. 8504—negative regulation of protein acetylation; Category No. 8505—negative regulation of protein ADP-ribosylation; Category No. 8506—negative regulation of protein autophosphorylation; Category No. 8507—negative regulation of protein binding; Category No. 8508—negative regulation of protein catabolic process; Category No. 8509—negative regulation of protein complex assembly; Category No. 8510—negative regulation of protein complex disassembly; Category No. 8511—negative regulation of protein dephosphorylation; Category No. 8512—negative regulation of protein deubiquitination; Category No. 8513—negative regulation of protein export from nucleus; Category No. 8514—negative regulation of protein glutathionylation; Category No. 8515—negative regulation of protein glycosylation in Golgi; Category No. 8516—negative regulation of protein homodimerization activity; Category No. 8517—negative regulation of protein homooligomerization; Category No. 8518—negative regulation of protein homotetramerization; Category No. 8519—negative regulation of protein import into nucleus; Category No. 8520—negative regulation of protein K48-linked deubiquitination; Category No. 8521—negative regulation of protein K63-linked ubiquitination; Category No. 8522—negative regulation of protein kinase activity; Category No. 8523—negative regulation of protein kinase activity by regulation of protein phosphorylation; Category No. 8524—negative regulation of protein kinase B signaling; Category No. 8525—negative regulation of protein kinase C signaling; Category No. 8526—negative regulation of protein localization to cell surface; Category No. 8527—negative regulation of protein localization to ciliary membrane; Category No. 8528—negative regulation of protein localization to cilium; Category No. 8529—negative regulation of protein localization to nucleus; Category No. 8530—negative regulation of protein localization to plasma membrane; Category No. 8531—negative regulation of protein metabolic process; Category No. 8532—negative regulation of protein oligomerization; Category No. 8533—negative regulation of protein phosphatase type 2A activity; Category No. 8534—negative regulation of protein phosphatase type 2B activity; Category No. 8535—negative regulation of protein phosphorylation; Category No. 8536—negative regulation of protein polymerization; Category No. 8537—negative regulation of protein processing; Category No. 8538—negative regulation of protein processing involved in protein targeting to mitochondrion; Category No. 8539—negative regulation of protein refolding; Category No. 8540—negative regulation of protein secretion; Category No. 8541—negative regulation of protein serine threonine kinase activity; Category No. 8542—negative regulation of protein sumoylation; Category No. 8543—negative regulation of protein targeting to membrane; Category No. 8544—negative regulation of protein targeting to mitochondrion; Category No. 8545—negative regulation of protein transport; Category No. 8546—negative regulation of protein tyrosine kinase activity; Category No. 8547—negative regulation of protein ubiquitination; Category No. 8548—negative regulation of protein ubiquitination involved in ubiquitin-dependent protein catabolic process; Category No. 8549—negative regulation of proteolysis; Category No. 8550—negative regulation of proteolysis involved in cellular protein catabolic process; Category No. 8551—negative regulation of Rac protein signal transduction; Category No. 8552—negative regulation of Ras protein signal transduction; Category No. 8553—negative regulation of reactive oxygen species biosynthetic process; Category No. 8554—negative regulation of reactive oxygen species metabolic process; Category No. 8555—negative regulation of receptor activity; Category No. 8556—negative regulation of receptor binding; Category No. 8557—negative regulation of receptor biosynthetic process; Category No. 8558—negative regulation of receptor catabolic process; Category No. 8559—negative regulation of receptor internalization; Category No. 8560—negative regulation of receptor localization to synapse; Category No. 8561—negative regulation of receptor recycling; Category No. 8562—negative regulation of receptor-mediated endocytosis; Category No. 8563—negative regulation of reciprocal meiotic recombination; Category No. 8564—negative regulation of regulatory T cell differentiation; Category No. 8565—negative regulation of relaxation of cardiac muscle; Category No. 8566—negative regulation of relaxation of muscle; Category No. 8567—negative regulation of release of cytochrome c from mitochondria; Category No. 8568—negative regulation of release of sequestered calcium ion into cytosol; Category No. 8569—negative regulation of renal albumin absorption; Category No. 8570—negative regulation of renal phosphate excretion; Category No. 8571—negative regulation of renal sodium excretion; Category No. 8572—negative regulation of renin secretion into blood stream; Category No. 8573—negative regulation of respiratory burst; Category No. 8574—negative regulation of respiratory burst involved in inflammatory response; Category No. 8575—negative regulation of response to cytokine stimulus; Category No. 8576—negative regulation of response to endoplasmic reticulum stress; Category No. 8577—negative regulation of response to gamma radiation; Category No. 8578—negative regulation of retinal cell programmed cell death; Category No. 8579—negative regulation of retinal cone cell fate commitment; Category No. 8580—negative regulation of retinal ganglion cell axon guidance; Category No. 8581—negative regulation of retinoic acid biosynthetic process; Category No. 8582—negative regulation of retinoic acid receptor signaling pathway; Category No. 8583—negative regulation of retrograde protein transport; Category No. 8584—negative regulation of Rho protein signal transduction; Category No. 8585—negative regulation of Rho-dependent protein serine threonine kinase activity; Category No. 8586—negative regulation of ribosome biogenesis; Category No. 8587—negative regulation of RIG-I signaling pathway; Category No. 8588—negative regulation of ripoptosome assembly involved in necroptotic process; Category No. 8589—negative regulation of RNA biosynthetic process; Category No. 8590—negative regulation of RNA export from nucleus; Category No. 8591—negative regulation of RNA interference; Category No. 8592—negative regulation of RNA polymerase II regulatory region sequence-specific DNA binding; Category No. 8593—negative regulation of RNA polymerase II transcriptional preinitiation complex assembly; Category No. 8594—negative regulation of RNA splicing; Category No. 8595—negative regulation of RNA-directed RNA polymerase activity; Category No. 8596—negative regulation of root hair elongation; Category No. 8597—negative regulation of rRNA processing; Category No. 8598—negative regulation of rubidium ion transmembrane transporter activity; Category No. 8599—negative regulation of rubidium ion transport; Category No. 8600—negative regulation of ruffle assembly; Category No. 8601—negative regulation of ryanodine-sensitive calcium-release channel activity; Category No. 8602—negative regulation of sarcomere organization; Category No. 8603—negative regulation of satellite cell differentiation; Category No. 8604—negative regulation of Schwann cell proliferation; Category No. 8605—negative regulation of secretion; Category No. 8606—negative regulation of secretion by cell; Category No. 8607—negative regulation of secretion of lysosomal enzymes; Category No. 8608—negative regulation of selenocysteine incorporation; Category No. 8609—negative regulation of selenocysteine insertion sequence binding; Category No. 8610—negative regulation of sensory perception of pain; Category No. 8611—negative regulation of sequence-specific DNA binding transcription factor activity; Category No. 8612—negative regulation of sequestering of triglyceride; Category No. 8613—negative regulation of serine-type endopeptidase activity; Category No. 8614—negative regulation of serine-type peptidase activity; Category No. 8615—negative regulation of serotonin secretion; Category No. 8616—negative regulation of serotonin uptake; Category No. 8617—negative regulation of signal transduction; Category No. 8618—negative regulation of signal transduction by p53 class mediator; Category No. 8619—negative regulation of signaling; Category No. 8620—negative regulation of single stranded viral RNA replication via double stranded DNA intermediate; Category No. 8621—negative regulation of single-species biofilm formation in or on host organism; Category No. 8622—negative regulation of sister chromatid cohesion; Category No. 8623—negative regulation of skeletal muscle cell differentiation; Category No. 8624—negative regulation of skeletal muscle hypertrophy; Category No. 8625—negative regulation of skeletal muscle satellite cell proliferation; Category No. 8626—negative regulation of skeletal muscle tissue development; Category No. 8627—negative regulation of skeletal muscle tissue growth; Category No. 8628—negative regulation of SMAD protein complex assembly; Category No. 8629—negative regulation of SMAD protein import into nucleus; Category No. 8630—negative regulation of small GTPase mediated signal transduction; Category No. 8631—negative regulation of small intestine smooth muscle contraction; Category No. 8632—negative regulation of smooth muscle cell apoptotic process; Category No. 8633—negative regulation of smooth muscle cell chemotaxis; Category No. 8634—negative regulation of smooth muscle cell differentiation; Category No. 8635—negative regulation of smooth muscle cell migration; Category No. 8636—negative regulation of smooth muscle cell proliferation; Category No. 8637—negative regulation of smooth muscle cell-matrix adhesion; Category No. 8638—negative regulation of smooth muscle contraction; Category No. 8639—negative regulation of smoothened signaling pathway; Category No. 8640—negative regulation of smoothened signaling pathway involved in dorsal ventral neural tube patterning; Category No. 8641—negative regulation of smoothened signaling pathway involved in ventral spinal cord patterning; Category No. 8642—negative regulation of SNARE complex assembly; Category No. 8643—negative regulation of sodium ion transmembrane transport; Category No. 8644—negative regulation of sodium ion transmembrane transporter activity; Category No. 8645— negative regulation of sodium ion transport; Category No. 8646—negative regulation of sodium:proton antiporter activity; Category No. 8647—negative regulation of sodium-dependent phosphate transport; Category No. 8648—negative regulation of sperm motility; Category No. 8649—negative regulation of sphingolipid biosynthetic process; Category No. 8650—negative regulation of spontaneous neurotransmitter secretion; Category No. 8651—negative regulation of sprouting angiogenesis; Category No. 8652—negative regulation of SREBP signaling pathway; Category No. 8653—negative regulation of stem cell differentiation; Category No. 8654—negative regulation of stem cell population maintenance; Category No. 8655—negative regulation of stem cell proliferation; Category No. 8656—negative regulation of steroid biosynthetic process; Category No. 8657—negative regulation of steroid hormone biosynthetic process; Category No. 8658—negative regulation of steroid metabolic process; Category No. 8659—negative regulation of stomach neuroendocrine cell differentiation; Category No. 8660—negative regulation of store-operated calcium channel activity; Category No. 8661—negative regulation of stress fiber assembly; Category No. 8662—negative regulation of stress-activated MAPK cascade; Category No. 8663—negative regulation of striated muscle cell apoptotic process; Category No. 8664—negative regulation of striated muscle cell differentiation; Category No. 8665—negative regulation of striated muscle contraction; Category No. 8666—negative regulation of striated muscle tissue development; Category No. 8667—negative regulation of substrate adhesion-dependent cell spreading; Category No. 8668—negative regulation of superoxide anion generation; Category No. 8669—negative regulation of synapse assembly; Category No. 8670—negative regulation of synapse maturation; Category No. 8671—negative regulation of synaptic plasticity; Category No. 8672—negative regulation of synaptic transmission; Category No. 8673—negative regulation of synaptic vesicle clustering; Category No. 8674—negative regulation of synaptic vesicle exocytosis; Category No. 8675—negative regulation of syncytium formation by plasma membrane fusion; Category No. 8676—negative regulation of systemic arterial blood pressure; Category No. 8677—negative regulation of T cell activation; Category No. 8678—negative regulation of T cell activation via T cell receptor contact with antigen bound to MHC molecule on antigen presenting cell; Category No. 8679—negative regulation of T cell anergy; Category No. 8680—negative regulation of T cell apoptotic process; Category No. 8681—negative regulation of T cell cytokine production; Category No. 8682—negative regulation of T cell differentiation; Category No. 8683—negative regulation of T cell differentiation in thymus; Category No. 8684—negative regulation of T cell homeostatic proliferation; Category No. 8685—negative regulation of T cell mediated cytotoxicity; Category No. 8686—negative regulation of T cell mediated immunity; Category No. 8687—negative regulation of T cell migration; Category No. 8688—negative regulation of T cell proliferation; Category No. 8689—negative regulation of T cell receptor signaling pathway; Category No. 8690—negative regulation of tau-protein kinase activity; Category No. 8691—negative regulation of t-circle formation; Category No. 8692—negative regulation of telomerase activity; Category No. 8693—negative regulation of telomere maintenance; Category No. 8694—negative regulation of telomere maintenance in response to DNA damage; Category No. 8695—negative regulation of telomere maintenance via semi-conservative replication; Category No. 8696—negative regulation of telomere maintenance via telomerase; Category No. 8697—negative regulation of telomere single strand break repair; Category No. 8698—negative regulation of telomeric RNA transcription from RNA pol II promoter; Category No. 8699—negative regulation of testicular blood vessel morphogenesis; Category No. 8700—negative regulation of testosterone biosynthetic process; Category No. 8701—negative regulation of the force of heart contraction; Category No. 8702—negative regulation of the force of heart contraction by chemical signal; Category No. 8703—negative regulation of the force of heart contraction involved in baroreceptor response to increased systemic arterial blood pressure; Category No. 8704—negative regulation of T-helper 1 cell activation; Category No. 8705—negative regulation of T-helper 1 cell differentiation; Category No. 8706—negative regulation of T-helper 1 type immune response; Category No. 8707—negative regulation of T-helper 17 cell differentiation; Category No. 8708—negative regulation of T-helper 17 cell lineage commitment; Category No. 8709—negative regulation of T-helper 2 cell cytokine production; Category No. 8710—negative regulation of T-helper 2 cell differentiation; Category No. 8711—negative regulation of T-helper cell differentiation; Category No. 8712—negative regulation of thioredoxin peroxidase activity by peptidyl-threonine phosphorylation; Category No. 8713—negative regulation of thrombin receptor signaling pathway; Category No. 8714—negative regulation of thymidylate synthase biosynthetic process; Category No. 8715—negative regulation of thymocyte apoptotic process; Category No. 8716—negative regulation of thyroid gland epithelial cell proliferation; Category No. 8717—negative regulation of thyroid hormone receptor activity; Category No. 8718—negative regulation of tissue remodeling; Category No. 8719—negative regulation of tolerance induction; Category No. 8720—negative regulation of Toll signaling pathway; Category No. 8721—negative regulation of toll-like receptor 2 signaling pathway; Category No. 8722—negative regulation of toll-like receptor 3 signaling pathway; Category No. 8723—negative regulation of toll-like receptor 4 signaling pathway; Category No. 8724—negative regulation of toll-like receptor 5 signaling pathway; Category No. 8725—negative regulation of toll-like receptor 9 signaling pathway; Category No. 8726—negative regulation of toll-like receptor signaling pathway; Category No. 8727—negative regulation of tooth mineralization; Category No. 8728—negative regulation of TOR signaling; Category No. 8729—negative regulation of TORC1 signaling; Category No. 8730—negative regulation of TRAIL-activated apoptotic signaling pathway; Category No. 8731—negative regulation of transcription; Category No. 8732—negative regulation of transcription by competitive promoter binding; Category No. 8733—negative regulation of transcription by glucose; Category No. 8734—negative regulation of transcription by transcription factor localization; Category No. 8735—negative regulation of transcription elongation from RNA polymerase I promoter; Category No. 8736—negative regulation of transcription elongation from RNA polymerase II promoter; Category No. 8737—negative regulation of transcription factor import into nucleus; Category No. 8738—negative regulation of transcription from RNA polymerase I promoter; Category No. 8739—negative regulation of transcription from RNA polymerase II promoter; Category No. 8740—negative regulation of transcription from RNA polymerase II promoter by glucose; Category No. 8741—negative regulation of transcription from RNA polymerase II promoter by histone modification; Category No. 8742—negative regulation of transcription from RNA polymerase II promoter during mitosis; Category No. 8743—negative regulation of transcription from RNA polymerase II promoter in response to endoplasmic reticulum stress; Category No. 8744—negative regulation of transcription from RNA polymerase II promoter in response to hypoxia; Category No. 8745—negative regulation of transcription from RNA polymerase II promoter in response to stress; Category No. 8746—negative regulation of transcription from RNA polymerase II promoter in response to UV-induced DNA damage; Category No. 8747—negative regulation of transcription from RNA polymerase II promoter involved in heart development; Category No. 8748—negative regulation of transcription from RNA polymerase II promoter involved in smooth muscle cell differentiation; Category No. 8749—negative regulation of transcription from RNA polymerase III promoter; Category No. 8750—negative regulation of transcription initiation from RNA polymerase II promoter; Category No. 8751—negative regulation of transcription involved in G1 S transition of mitotic cell cycle; Category No. 8752—negative regulation of transcription of nuclear large rRNA transcript from RNA polymerase I promoter; Category No. 8753—negative regulation of transcription regulatory region DNA binding; Category No. 8754—negative regulation of transformation of host cell by virus; Category No. 8755—negative regulation of transforming growth factor beta production; Category No. 8756—negative regulation of transforming growth factor beta receptor signaling pathway; Category No. 8757—negative regulation of transforming growth factor beta1 production; Category No. 8758—negative regulation of transforming growth factor beta2 production; Category No. 8759—negative regulation of transforming growth factor-beta secretion; Category No. 8760—negative regulation of translation; Category No. 8761—negative regulation of translation in response to oxidative stress; Category No. 8762—negative regulation of translation in response to stress; Category No. 8763—negative regulation of translation involved in gene silencing by miRNA; Category No. 8764—negative regulation of translational elongation; Category No. 8765—negative regulation of translational initiation; Category No. 8766—negative regulation of translational initiation by iron; Category No. 8767—negative regulation of translational initiation in response to stress; Category No. 8768—negative regulation of transmembrane receptor protein serine threonine kinase signaling pathway; Category No. 8769—negative regulation of transmembrane transport; Category No. 8770—negative regulation of transmission of nerve impulse; Category No. 8771—negative regulation of transport; Category No. 8772—negative regulation of transporter activity; Category No. 8773—negative regulation of transposition; Category No. 8774—negative regulation of transposon integration; Category No. 8775—negative regulation of triglyceride biosynthetic process; Category No. 8776—negative regulation of triglyceride catabolic process; Category No. 8777—negative regulation of triglyceride metabolic process; Category No. 8778—negative regulation of trophoblast cell migration; Category No. 8779—negative regulation of tubulin deacetylation; Category No. 8780—negative regulation of tumor necrosis factor (ligand) superfamily member 11 production; Category No. 8781—negative regulation of tumor necrosis factor biosynthetic process; Category No. 8782—negative regulation of tumor necrosis factor production; Category No. 8783—negative regulation of tumor necrosis factor secretion; Category No. 8784—negative regulation of tumor necrosis factor superfamily cytokine production; Category No. 8785—negative regulation of tumor necrosis factor-mediated signaling pathway; Category No. 8786—negative regulation of type 2 immune response; Category No. 8787—negative regulation of type B pancreatic cell apoptotic process; Category No. 8788—negative regulation of type B pancreatic cell development; Category No. 8789—negative regulation of type I interferon production; Category No. 8790—negative regulation of type I interferon-mediated signaling pathway; Category No. 8791—negative regulation of type IV hypersensitivity; Category No. 8792—negative regulation of tyrosine phosphorylation of Stat1 protein; Category No. 8793—negative regulation of tyrosine phosphorylation of Stat3 protein; Category No. 8794—negative regulation of tyrosine phosphorylation of Stat4 protein; Category No. 8795—negative regulation of tyrosine phosphorylation of Stat5 protein; Category No. 8796—negative regulation of tyrosine phosphorylation of Stat6 protein; Category No. 8797—negative regulation of ubiquitin-protein ligase activity involved in mitotic cell cycle; Category No. 8798—negative regulation of ubiquitin-protein transferase activity; Category No. 8799—negative regulation of ubiquitin-specific protease activity; Category No. 8800—negative regulation of UDP-glucose catabolic process; Category No. 8801—negative regulation of ureter smooth muscle cell differentiation; Category No. 8802—negative regulation of urine volume; Category No. 8803—negative regulation of uterine smooth muscle contraction; Category No. 8804—negative regulation of vascular endothelial growth factor production; Category No. 8805—negative regulation of vascular endothelial growth factor receptor signaling pathway; Category No. 8806—negative regulation of vascular endothelial growth factor signaling pathway; Category No. 8807—negative regulation of vascular permeability; Category No. 8808—negative regulation of vascular smooth muscle contraction; Category No. 8809—negative regulation of vascular wound healing; Category No. 8810—negative regulation of vasculogenesis; Category No. 8811—negative regulation of vasoconstriction; Category No. 8812—negative regulation of vasodilation; Category No. 8813—negative regulation of VCP-NPL4-UFD1 AAA ATPase complex assembly; Category No. 8814—negative regulation of very-low-density lipoprotein particle clearance; Category No. 8815—negative regulation of very-low-density lipoprotein particle remodeling; Category No. 8816—negative regulation of vesicle fusion; Category No. 8817—negative regulation of viral entry into host cell; Category No. 8818—negative regulation of viral genome replication; Category No. 8819—negative regulation of viral process; Category No. 8820—negative regulation of viral release from host cell; Category No. 8821—negative regulation of viral transcription; Category No. 8822—negative regulation of viral-induced cytoplasmic pattern recognition receptor signaling pathway; Category No. 8823—negative regulation of vitamin D biosynthetic process; Category No. 8824—negative regulation of vitamin D receptor signaling pathway; Category No. 8825—negative regulation of voltage-gated calcium channel activity; Category No. 8826—negative regulation of voltage-gated potassium channel activity; Category No. 8827—negative regulation of voltage-gated potassium channel activity involved in atrial cardiac muscle cell action potential repolarization; Category No. 8828—negative regulation of voltage-gated potassium channel activity involved in ventricular cardiac muscle cell action potential repolarization; Category No. 8829—negative regulation of white fat cell proliferation; Category No. 8830—negative regulation of Wnt protein secretion; Category No. 8831—negative regulation of Wnt signaling pathway; Category No. 8832—negative regulation of Wnt signaling pathway involved in digestive tract morphogenesis; Category No. 8833—negative regulation of Wnt signaling pathway involved in dorsal ventral axis specification; Category No. 8834—negative regulation of Wnt signaling pathway involved in heart development; Category No. 8835—negative regulation of wound healing; Category No. 8836—negative regulation of zinc ion transmembrane import; Category No. 8837—negative regulation of zinc ion transmembrane transport; Category No. 8838—negative stranded viral RNA replication; Category No. 8839—negative T cell selection; Category No. 8840—negative thymic T cell selection; Category No. 8841—NELF complex; Category No. 8842—Nem1-Spo7 phosphatase complex; Category No. 8843—neolactotetraosylceramide alpha-2,3-sialyltransferase activity; Category No. 8844—nephric duct development; Category No. 8845—nephric duct formation; Category No. 8846—nephric duct morphogenesis; Category No. 8847—nephrogenic mesenchyme morphogenesis; Category No. 8848—nephron development; Category No. 8849—nephron morphogenesis; Category No. 8850—nephron tubule development; Category No. 8851—nephron tubule epithelial cell differentiation; Category No. 8852—nephron tubule formation; Category No. 8853—nephron tubule morphogenesis; Category No. 8854—nerve development; Category No. 8855—nerve growth factor binding; Category No. 8856—nerve growth factor processing; Category No. 8857—nerve growth factor production; Category No. 8858—nerve growth factor receptor activity; Category No. 8859—nerve growth factor receptor binding; Category No. 8860—nerve growth factor signaling pathway; Category No. 8861—nerve maturation; Category No. 8862—nervous system development; Category No. 8863—netrin receptor activity; Category No. 8864—netrin-activated signaling pathway; Category No. 8865—neural crest cell development; Category No. 8866—neural crest cell differentiation; Category No. 8867—neural crest cell fate commitment; Category No. 8868—neural crest cell fate specification; Category No. 8869—neural crest cell migration; Category No. 8870—neural crest cell migration involved in autonomic nervous system development; Category No. 8871—neural crest cell migration involved in heart formation; Category No. 8872—neural crest cell migration involved in sympathetic nervous system development; Category No. 8873—neural crest formation; Category No. 8874—neural fold bending; Category No. 8875—neural fold elevation formation; Category No. 8876—neural fold formation; Category No. 8877—neural nucleus development; Category No. 8878—neural plate anterior posterior regionalization; Category No. 8879—neural plate axis specification; Category No. 8880—neural plate development; Category No. 8881—neural plate formation; Category No. 8882—neural plate mediolateral regionalization; Category No. 8883—neural plate morphogenesis; Category No. 8884—neural plate pattern specification; Category No. 8885—neural precursor cell proliferation; Category No. 8886—neural retina development; Category No. 8887—neural tube closure; Category No. 8888—neural tube development; Category No. 8889—neural tube formation; Category No. 8890—neural tube patterning; Category No. 8891—neuregulin receptor activity; Category No. 8892—neurexin clustering involved in presynaptic membrane assembly; Category No. 8893—neurexin family protein binding; Category No. 8894—neuroblast differentiation; Category No. 8895—neuroblast division in subventricular zone; Category No. 8896—neuroblast fate determination; Category No. 8897—neuroblast migration; Category No. 8898—neuroblast proliferation; Category No. 8899—neuroendocrine cell differentiation; Category No. 8900—neuroepithelial cell differentiation; Category No. 8901—neurofibrillary tangle; Category No. 8902—neurofilament; Category No. 8903—neurofilament bundle assembly; Category No. 8904—neurofilament cytoskeleton; Category No. 8905—neurofilament cytoskeleton organization; Category No. 8906—neurogenesis; Category No. 8907—neurohypophyseal hormone activity; Category No. 8908—neurohypophysis development; Category No. 8909—neuroligin clustering involved in postsynaptic membrane assembly; Category No. 8910—neuroligin family protein binding; Category No. 8911—neurological system process; Category No. 8912—neurological system process involved in regulation of systemic arterial blood pressure; Category No. 8913—neuromedin B receptor binding; Category No. 8914—neuromedin U binding; Category No. 8915—neuromedin U receptor activity; Category No. 8916—neuromedin U receptor binding; Category No. 8917—neuromuscular junction; Category No. 8918—neuromuscular junction development; Category No. 8919—neuromuscular process; Category No. 8920—neuromuscular process controlling balance; Category No. 8921—neuromuscular process controlling posture; Category No. 8922—neuromuscular synaptic transmission; Category No. 8923—neuron apoptotic process; Category No. 8924—neuron cell-cell adhesion; Category No. 8925—neuron cellular homeostasis; Category No. 8926—neuron death; Category No. 8927—neuron death in response to oxidative stress; Category No. 8928—neuron development; Category No. 8929—neuron differentiation; Category No. 8930—neuron fate commitment; Category No. 8931—neuron fate determination; Category No. 8932—neuron fate specification; Category No. 8933—neuron maturation; Category No. 8934—neuron migration; Category No. 8935—neuron projection; Category No. 8936—neuron projection development; Category No. 8937—neuron projection extension; Category No. 8938—neuron projection guidance; Category No. 8939—neuron projection membrane; Category No. 8940—neuron projection morphogenesis; Category No. 8941—neuron projection regeneration; Category No. 8942—neuron projection terminus; Category No. 8943—neuron recognition; Category No. 8944—neuron remodeling; Category No. 8945—neuron spine; Category No. 8946—neuronal action potential; Category No. 8947—neuronal action potential propagation; Category No. 8948—neuronal cell body; Category No. 8949—neuronal cell body membrane; Category No. 8950—neuronal ion channel clustering; Category No. 8951—neuronal postsynaptic density; Category No. 8952—neuronal ribonucleoprotein granule; Category No. 8953—neuronal signal transduction; Category No. 8954—neuronal stem cell population maintenance; Category No. 8955—neuronal-glial interaction involved in cerebral cortex radial glia guided migration; Category No. 8956—neuron-neuron synaptic transmission; Category No. 8957—neuropeptide binding; Category No. 8958—neuropeptide catabolic process; Category No. 8959—neuropeptide hormone activity; Category No. 8960—neuropeptide receptor activity; Category No. 8961—neuropeptide receptor binding; Category No. 8962—neuropeptide signaling pathway; Category No. 8963—neuropeptide Y receptor activity; Category No. 8964—neuropeptide Y receptor binding; Category No. 8965—neuropilin binding; Category No. 8966—neurosecretory vesicle; Category No. 8967—neurotensin receptor activity; Category No. 8968—neurotransmission; Category No. 8969—neurotransmitter binding; Category No. 8970—neurotransmitter biosynthetic process; Category No. 8971—neurotransmitter catabolic process; Category No. 8972—neurotransmitter loading into synaptic vesicle; Category No. 8973—neurotransmitter metabolic process; Category No. 8974—neurotransmitter receptor activity; Category No. 8975—neurotransmitter receptor biosynthetic process; Category No. 8976—neurotransmitter receptor metabolic process; Category No. 8977—neurotransmitter secretion; Category No. 8978—neurotransmitter secretory pathway; Category No. 8979—neurotransmitter transport; Category No. 8980—neurotransmitter transporter activity; Category No. 8981—neurotransmitter uptake; Category No. 8982—neurotransmitter:sodium symporter activity; Category No. 8983—neurotransmitter-gated ion channel clustering; Category No. 8984—neurotrophin binding; Category No. 8985—neurotrophin p75 receptor binding; Category No. 8986—neurotrophin receptor activity; Category No. 8987—neurotrophin signaling pathway; Category No. 8988—neurotrophin TRK receptor signaling pathway; Category No. 8989—neurotrophin TRKA receptor binding; Category No. 8990—neurotrophin TRKB receptor binding; Category No. 8991—neurotrophin TRKC receptor binding; Category No. 8992—neutral amino acid transmembrane transporter activity; Category No. 8993—neutral amino acid transport; Category No. 8994—neutral lipid catabolic process; Category No. 8995—neutral lipid metabolic process; Category No. 8996—neutrophil activation; Category No. 8997—neutrophil activation involved in immune response; Category No. 8998—neutrophil aggregation; Category No. 8999—neutrophil apoptotic process; Category No. 9000—neutrophil chemotaxis; Category No. 9001—neutrophil clearance; Category No. 9002—neutrophil degranulation; Category No. 9003—neutrophil differentiation; Category No. 9004—neutrophil extravasation; Category No. 9005—neutrophil homeostasis; Category No. 9006—neutrophil mediated immunity; Category No. 9007—neutrophil mediated killing of fungus; Category No. 9008—neutrophil mediated killing of gram-negative bacterium; Category No. 9009—neutrophil mediated killing of gram-positive bacterium; Category No. 9010—neutrophil migration; Category No. 9011—new growing cell tip; Category No. 9012—NFAT protein binding; Category No. 9013—NFAT protein import into nucleus; Category No. 9014—NF-kappaB binding; Category No. 9015—NF-kappaB complex; Category No. 9016—NF-kappaB-inducing kinase activity; Category No. 9017—N-formyl peptide receptor activity; Category No. 9018—N-formylglutamate deformylase activity; Category No. 9019—N-glycan fucosylation; Category No. 9020—N-glycan processing; Category No. 9021—N-glycan processing to lysosome; Category No. 9022—nickel cation binding; Category No. 9023—nickel cation transmembrane transport; Category No. 9024—nickel cation transmembrane transporter activity; Category No. 9025—nickel cation transport; Category No. 9026—nicotinamide metabolic process; Category No. 9027—nicotinamide N-methyltransferase activity; Category No. 9028—nicotinamide phosphoribosyltransferase activity; Category No. 9029—nicotinamide riboside catabolic process; Category No. 9030—nicotinamide-nucleotide adenylyltransferase activity; Category No. 9031—nicotinate nucleotide salvage; Category No. 9032—nicotinate phosphoribosyltransferase activity; Category No. 9033—nicotinate transport; Category No. 9034—nicotinate transporter activity; Category No. 9035—nicotinate-nucleotide adenylyltransferase activity; Category No. 9036—nicotinate-nucleotide diphosphorylase (carboxylating) activity; Category No. 9037—nicotinic acid receptor activity; Category No. 9038—NIK NF-kappaB signaling; Category No. 9039—nipple morphogenesis; Category No. 9040—nipple sheath formation; Category No. 9041—nitrate assimilation; Category No. 9042—nitrate catabolic process; Category No. 9043—nitrate metabolic process; Category No. 9044—nitrate reductase activity; Category No. 9045—nitrate transmembrane transporter activity; Category No. 9046—nitrate transport; Category No. 9047—nitric oxide binding; Category No. 9048—nitric oxide biosynthetic process; Category No. 9049—nitric oxide catabolic process; Category No. 9050—nitric oxide dioxygenase activity; Category No. 9051—nitric oxide homeostasis; Category No. 9052—nitric oxide mediated signal transduction; Category No. 9053—nitric oxide metabolic process; Category No. 9054—nitric oxide production involved in inflammatory response; Category No. 9055—nitric oxide storage; Category No. 9056—nitric oxide transmembrane transporter activity; Category No. 9057—nitric oxide transport; Category No. 9058—nitric oxide-cGMP-mediated signaling pathway; Category No. 9059—nitric-oxide synthase activity; Category No. 9060—nitric-oxide synthase binding; Category No. 9061—nitric-oxide synthase inhibitor activity; Category No. 9062—nitric-oxide synthase regulator activity; Category No. 9063—nitrilase activity; Category No. 9064—nitrite reductase (NO-forming) activity; Category No. 9065—nitrite transport; Category No. 9066—nitrobenzene metabolic process; Category No. 9067—nitrogen catabolite activation of transcription from RNA polymerase II promoter; Category No. 9068—nitrogen compound metabolic process; Category No. 9069—nitrogen fixation; Category No. 9070—NK T cell differentiation; Category No. 9071—NK T cell proliferation; Category No. 9072—NLRP1 inflammasome complex; Category No. 9073—NLRP3 inflammasome complex; Category No. 9074—NLRP3 inflammasome complex assembly; Category No. 9075—NLS-bearing protein import into nucleus; Category No. 9076—NLS-dependent protein nuclear import complex; Category No. 9077—NMDA glutamate receptor activity; Category No. 9078—NMDA glutamate receptor clustering; Category No. 9079—NMDA selective glutamate receptor complex; Category No. 9080—N-methyltransferase activity; Category No. 9081—Noc1p-Noc2p complex; Category No. 9082—Noc4p-Nop14p complex; Category No. 9083—nociceptin receptor activity; Category No. 9084—nodal binding; Category No. 9085—nodal signaling pathway; Category No. 9086—nodal signaling pathway involved in determination of lateral mesoderm left right asymmetry; Category No. 9087—node of Ranvier; Category No. 9088—no-go decay; Category No. 9089—nonassociative learning; Category No. 9090—nonautophagic; Category No. 9091—non-canonical Wnt signaling pathway; Category No. 9092—non-canonical Wnt signaling pathway via JNK cascade; Category No. 9093—non-canonical Wnt signaling pathway via MAPK cascade; Category No. 9094—non-G-protein coupled; Category No. 9095—nonhomologous end joining complex; Category No. 9096—non-membrane spanning protein tyrosine kinase activity; Category No. 9097—non-membrane spanning protein tyrosine phosphatase activity; Category No. 9098—nonmotile primary cilium; Category No. 9099—nonmotile primary cilium assembly; Category No. 9100—non-nucleic acid binding; Category No. 9101—non-oxidative branch; Category No. 9102—non-REM sleep; Category No. 9103—nonsense-mediated decay; Category No. 9104—non-sequence-specific DNA binding; Category No. 9105—non-stop decay; Category No. 9106—noradrenergic neuron development; Category No. 9107—noradrenergic neuron differentiation; Category No. 9108—noradrenergic neuron fate commitment; Category No. 9109—norepinephrine binding; Category No. 9110—norepinephrine biosynthetic process; Category No. 9111—norepinephrine metabolic process; Category No. 9112—norepinephrine secretion; Category No. 9113—norepinephrine transmembrane transporter activity; Category No. 9114—norepinephrine transport; Category No. 9115—norepinephrine:sodium symporter activity; Category No. 9116—norepinephrine-epinephrine vasoconstriction involved in regulation of systemic arterial blood pressure; Category No. 9117—norspermidine metabolic process; Category No. 9118—norspermine:oxygen oxidoreductase activity; Category No. 9119—NOS2-CD74 complex; Category No. 9120—nose development; Category No. 9121—nose morphogenesis; Category No. 9122—Notch binding; Category No. 9123—Notch receptor processing; Category No. 9124—Notch signaling involved in heart development; Category No. 9125—Notch signaling pathway; Category No. 9126—Notch signaling pathway involved in arterial endothelial cell fate commitment; Category No. 9127—Notch signaling pathway involved in regulation of secondary heart field cardioblast proliferation; Category No. 9128—notochord cell development; Category No. 9129—notochord development; Category No. 9130—notochord formation; Category No. 9131—notochord morphogenesis; Category No. 9132—notochord regression; Category No. 9133—npBAF complex; Category No. 9134—NSL complex; Category No. 9135—N-sulfoglucosamine sulfohydrolase activity; Category No. 9136—N-terminal myristoylation domain binding; Category No. 9137—N-terminal peptidyl-alanine methylation; Category No. 9138—N-terminal peptidyl-alanine trimethylation; Category No. 9139—N-terminal peptidyl-glutamic acid acetylation; Category No. 9140—N-terminal peptidyl-glycine N-myristoylation; Category No. 9141—N-terminal peptidyl-L-cysteine N-palmitoylation; Category No. 9142—N-terminal peptidyl-lysine acetylation; Category No. 9143—N-terminal peptidyl-methionine acetylation; Category No. 9144—N-terminal peptidyl-proline dimethylation; Category No. 9145—N-terminal peptidyl-serine acetylation; Category No. 9146—N-terminal peptidyl-serine dimethylation; Category No. 9147—N-terminal peptidyl-serine trimethylation; Category No. 9148—N-terminal protein amino acid acetylation; Category No. 9149—N-terminal protein amino acid methylation; Category No. 9150—N-terminal protein amino acid modification; Category No. 9151—N-terminal protein myristoylation; Category No. 9152—N-terminal protein N-methyltransferase activity; Category No. 9153—NuA4 histone acetyltransferase complex; Category No. 9154—nuclear aryl hydrocarbon receptor complex; Category No. 9155—nuclear body; Category No. 9156—nuclear cap binding complex; Category No. 9157—nuclear chromatin; Category No. 9158—nuclear chromosome; Category No. 9159—nuclear condensin complex; Category No. 9160—nuclear cyclin-dependent protein kinase holoenzyme complex; Category No. 9161—nuclear DNA replication; Category No. 9162—nuclear envelope; Category No. 9163—nuclear envelope disassembly; Category No. 9164—nuclear envelope lumen; Category No. 9165—nuclear envelope organization; Category No. 9166—nuclear envelope reassembly; Category No. 9167—nuclear euchromatin; Category No. 9168—nuclear exosome (RNase complex); Category No. 9169—nuclear export; Category No. 9170—nuclear export signal receptor activity; Category No. 9171—nuclear fragmentation involved in apoptotic nuclear change; Category No. 9172—nuclear heterochromatin; Category No. 9173—nuclear hormone receptor binding; Category No. 9174—nuclear import; Category No. 9175—nuclear inclusion body; Category No. 9176—nuclear inner membrane; Category No. 9177—nuclear inner membrane organization; Category No. 9178—nuclear lamina; Category No. 9179—nuclear localization sequence binding; Category No. 9180—nuclear lumen; Category No. 9181—nuclear matrix; Category No. 9182—nuclear matrix anchoring at nuclear membrane; Category No. 9183—nuclear meiotic cohesin complex; Category No. 9184—nuclear membrane; Category No. 9185—nuclear membrane organization; Category No. 9186—nuclear microtubule; Category No. 9187—nuclear migration; Category No. 9188—nuclear migration along microfilament; Category No. 9189—nuclear mRNA surveillance; Category No. 9190—nuclear nucleosome; Category No. 9191—nuclear origin of replication recognition complex; Category No. 9192—nuclear outer membrane; Category No. 9193—nuclear outer membrane-endoplasmic reticulum membrane network; Category No. 9194—nuclear pericentric heterochromatin; Category No. 9195—nuclear periphery; Category No. 9196—nuclear polyadenylation-dependent mRNA catabolic process; Category No. 9197—nuclear polyadenylation-dependent rRNA catabolic process; Category No. 9198—nuclear polyadenylation-dependent tRNA catabolic process; Category No. 9199—nuclear pore; Category No. 9200—nuclear pore central transport channel; Category No. 9201—nuclear pore complex assembly; Category No. 9202—nuclear pore cytoplasmic filaments; Category No. 9203—nuclear pore distribution; Category No. 9204—nuclear pore nuclear basket; Category No. 9205—nuclear pore organization; Category No. 9206—nuclear pore outer ring; Category No. 9207—nuclear pre-replicative complex; Category No. 9208—nuclear proteasome complex; Category No. 9209—nuclear replication fork; Category No. 9210—nuclear retention of pre-mRNA with aberrant 3'-ends at the site of transcription; Category No. 9211—nuclear retention of unspliced pre-mRNA at the site of transcription; Category No. 9212—nuclear RNA export factor complex; Category No. 9213—nuclear RNA-directed RNA polymerase complex; Category No. 9214—nuclear SCF ubiquitin ligase complex; Category No. 9215—nuclear speck; Category No. 9216—nuclear speck organization; Category No. 9217—nuclear stress granule; Category No. 9218—nuclear telomere cap complex; Category No. 9219—nuclear telomeric heterochromatin; Category No. 9220—nuclear transcription factor complex; Category No. 9221—nuclear transport; Category No. 9222—nuclear ubiquitin ligase complex; Category No. 9223—nuclear-transcribed mRNA catabolic process; Category No. 9224—nuclear-transcribed mRNA poly(A) tail shortening; Category No. 9225—nuclease activity; Category No. 9226—nucleic acid binding; Category No. 9227—nucleic acid binding transcription factor activity; Category No. 9228—nucleic acid phosphodiester bond hydrolysis; Category No. 9229—nucleobase transmembrane transporter activity; Category No. 9230—nucleobase transport; Category No. 9231—nucleobase-containing compound kinase activity; Category No. 9232—nucleobase-containing compound metabolic process; Category No. 9233—nucleobase-containing compound transmembrane transporter activity; Category No. 9234—nucleobase-containing small molecule catabolic process; Category No. 9235—nucleobase-containing small molecule interconversion; Category No. 9236—nucleobase-containing small molecule metabolic process; Category No. 9237—nucleocytoplasmic shuttling complex; Category No. 9238—nucleocytoplasmic transport; Category No. 9239—nucleocytoplasmic transporter activity; Category No. 9240—nucleolar ribonuclease P complex; Category No. 9241—nucleologenesis; Category No. 9242—nucleolus; Category No. 9243—nucleolus organization; Category No. 9244—nucleolus organizer region; Category No. 9245—nucleolus to nucleoplasm transport; Category No. 9246—nucleophagy; Category No. 9247—nucleoplasm; Category No. 9248—nucleoside binding; Category No. 9249—nucleoside deoxyribosyltransferase activity; Category No. 9250—nucleoside diphosphate biosynthetic process; Category No. 9251—nucleoside diphosphate catabolic process; Category No. 9252—nucleoside diphosphate kinase activity; Category No. 9253—nucleoside diphosphate metabolic process; Category No. 9254—nucleoside diphosphate phosphorylation; Category No. 9255—nucleoside kinase activity; Category No. 9256—nucleoside metabolic process; Category No. 9257—nucleoside monophosphate biosynthetic process; Category No. 9258—nucleoside monophosphate phosphorylation; Category No. 9259—nucleoside phosphate kinase activity; Category No. 9260—nucleoside phosphotransferase activity; Category No. 9261—nucleoside transmembrane transport; Category No. 9262—nucleoside transmembrane transporter activity; Category No. 9263—nucleoside transport; Category No. 9264—nucleoside triphosphate adenylate kinase activity; Category No. 9265—nucleoside triphosphate biosynthetic process; Category No. 9266—nucleoside triphosphate catabolic process; Category No. 9267—nucleoside:sodium symporter activity; Category No. 9268—nucleoside-diphosphatase activity; Category No. 9269—nucleoside-triphosphatase activity; Category No. 9270—nucleoside-triphosphate diphosphatase activity; Category No. 9271—nucleosomal DNA binding; Category No. 9272—nucleosomal histone binding; Category No. 9273—nucleosome; Category No. 9274—nucleosome assembly; Category No. 9275—nucleosome binding; Category No. 9276—nucleosome disassembly; Category No. 9277—nucleosome mobilization; Category No. 9278—nucleosome organization; Category No. 9279—nucleosome positioning; Category No. 9280—nucleosome-dependent ATPase activity; Category No. 9281—nucleotidase activity; Category No. 9282—nucleotide binding; Category No. 9283—nucleotide biosynthetic process; Category No. 9284—nucleotide catabolic process; Category No. 9285—nucleotide diphosphatase activity; Category No. 9286—nucleotide kinase activity; Category No. 9287—nucleotide metabolic process; Category No. 9288—nucleotide phosphatase activity; Category No. 9289—nucleotide phosphorylation; Category No. 9290—nucleotide transmembrane transport; Category No. 9291—nucleotide-activated protein kinase complex; Category No. 9292—nucleotide-binding domain; Category No. 9293—nucleotide-binding oligomerization domain containing 1 signaling pathway; Category No. 9294—nucleotide-binding oligomerization domain containing 2 signaling pathway; Category No. 9295—nucleotide-binding oligomerization domain containing signaling pathway; Category No. 9296—nucleotide-excision repair; Category No. 9297—nucleotide-excision repair complex; Category No. 9298—nucleotide-excision repair factor 1 complex; Category No. 9299—nucleotide-excision repair factor 2 complex; Category No. 9300—nucleotide-excision repair involved in interstrand cross-link repair; Category No. 9301—nucleotide-sugar metabolic process; Category No. 9302—nucleotide-sugar transmembrane transporter activity; Category No. 9303—nucleotide-sugar transport; Category No. 9304—nucleotidyltransferase activity; Category No. 9305—nucleus; Category No. 9306—nucleus accumbens development; Category No. 9307—nucleus localization; Category No. 9308—nucleus organization; Category No. 9309—nucleus-associated proteasomal ubiquitin-dependent protein catabolic process; Category No. 9310—nucleus-vacuole junction; Category No. 9311—NuRD complex; Category No. 9312—NURF complex; Category No. 9313—nutrient reservoir activity; Category No. 9314—O-acyltransferase activity; Category No. 9315—observational learning; Category No. 9316—octanoyltransferase activity; Category No. 9317—oculomotor nerve development; Category No. 9318—oculomotor nerve formation; Category No. 9319—odontoblast differentiation; Category No. 9320—odontogenesis; Category No. 9321—odontogenesis of dentin-containing tooth; Category No. 9322—odorant binding; Category No. 9323—O-fucosylpeptide 3-beta-N-acetylglucosaminyltransferase activity; Category No. 9324—O-glycan processing; Category No. 9325—O-glycan processing core 1; Category No. 9326—0-glycan processing core 3; Category No. 9327—Okazaki fragment processing; Category No. 9328—Okazaki fragment processing involved in mitotic DNA replication; Category No. 9329—oleic acid binding; Category No. 9330—oleoyl-[acyl-carrier-protein] hydrolase activity; Category No. 9331—olfactory behavior; Category No. 9332—olfactory bulb axon guidance; Category No. 9333—olfactory bulb development; Category No. 9334—olfactory bulb interneuron development; Category No. 9335—olfactory bulb interneuron differentiation; Category No. 9336—olfactory bulb mitral cell layer development; Category No. 9337—olfactory learning; Category No. 9338—olfactory lobe development; Category No. 9339—olfactory nerve development; Category No. 9340—olfactory nerve structural organization; Category No. 9341—olfactory pit development; Category No. 9342—olfactory placode formation; Category No. 9343—olfactory receptor activity; Category No. 9344—olfactory receptor binding; Category No. 9345—oligo-1,6-glucosidase activity; Category No. 9346—oligodendrocyte apoptotic process; Category No. 9347—oligodendrocyte cell fate commitment; Category No. 9348—oligodendrocyte cell fate specification; Category No. 9349—oligodendrocyte development; Category No. 9350—oligodendrocyte differentiation; Category No. 9351—oligopeptidase activity; Category No. 9352—oligopeptide transmembrane transport; Category No. 9353—oligopeptide transport; Category No. 9354—oligopeptide transporter activity; Category No. 9355—oligopeptide-transporting ATPase activity; Category No. 9356—oligosaccharide binding; Category No. 9357—oligosaccharide biosynthetic process; Category No. 9358—oligosaccharide catabolic process; Category No. 9359—oligosaccharide metabolic process; Category No. 9360—oligosaccharide-lipid intermediate biosynthetic process; Category No. 9361—oligosaccharyl transferase activity; Category No. 9362—oligosaccharyltransferase complex; Category No. 9363—omega peptidase activity; Category No. 9364—omega-amidase activity; Category No. 9365—omega-hydroxylase P450 pathway; Category No. 9366—omegasome; Category No. 9367—O-methyltransferase activity; Category No. 9368—oncogene-induced cell senescence; Category No. 9369—oncosis; Category No. 9370—oncostatin-M receptor activity; Category No. 9371—oncostatin-M receptor binding; Category No. 9372—oncostatin-M receptor complex; Category No. 9373—oncostatin-M-mediated signaling pathway; Category No. 9374—one-carbon metabolic process; Category No. 9375—oocyte development; Category No. 9376—oocyte differentiation; Category No. 9377—oocyte growth; Category No. 9378—oocyte maturation; Category No. 9379—oogenesis; Category No. 9380—open rectifier potassium channel activity; Category No. 9381—operant conditioning; Category No. 9382—O-phosphotserine:2-oxoglutarate aminotransferase activity; Category No. 9383—opioid peptide activity; Category No. 9384—opioid receptor activity; Category No. 9385—opioid receptor binding; Category No. 9386—opioid receptor signaling pathway; Category No. 9387—opsin binding; Category No. 9388—opsin transport; Category No. 9389—opsonin binding; Category No. 9390—opsonin receptor activity; Category No. 9391—opsonization; Category No. 9392—optic chiasma development; Category No. 9393—optic cup formation involved in camera-type eye development; Category No. 9394—optic cup morphogenesis involved in camera-type eye development; Category No. 9395—optic cup structural organization; Category No. 9396—optic nerve development; Category No. 9397—optic nerve morphogenesis; Category No. 9398—optic nerve structural organization; Category No. 9399—optic placode formation; Category No. 9400—optic placode formation involved in camera-type eye formation; Category No. 9401—optic vesicle morphogenesis; Category No. 9402—optokinetic behavior; Category No. 9403—orbitofrontal cortex development; Category No. 9404—orexigenic neuropeptide QRFP receptor binding; Category No. 9405—orexin receptor activity; Category No. 9406—organ development; Category No. 9407—organ formation; Category No. 9408—organ growth; Category No. 9409—organ induction; Category No. 9410—organ morphogenesis; Category No. 9411—organ regeneration; Category No. 9412—organ senescence; Category No. 9413—organelle assembly; Category No. 9414—organelle disassembly; Category No. 9415—organelle fusion; Category No. 9416—organelle inner membrane; Category No. 9417—organelle localization; Category No. 9418—organelle membrane; Category No. 9419—organelle membrane contact site; Category No. 9420—organelle organization; Category No. 9421—organelle transport along microtubule; Category No. 9422—organic acid binding; Category No. 9423—organic acid metabolic process; Category No. 9424—organic acid transmembrane transport; Category No. 9425—organic acid:sodium symporter activity; Category No. 9426—organic anion transmembrane transporter activity; Category No. 9427—organic anion transport; Category No. 9428—organic cation transmembrane transporter activity; Category No. 9429—organic cation transport; Category No. 9430—organic cyclic compound binding; Category No. 9431—organic cyclic compound metabolic process; Category No. 9432—organic substance metabolic process; Category No. 9433—organophosphate catabolic process; Category No. 9434—organophosphate metabolic process; Category No. 9435—organophosphate:inorganic phosphate antiporter activity; Category No. 9436—origin recognition complex; Category No. 9437—ornithine biosynthetic process; Category No. 9438—ornithine carbamoyltransferase activity; Category No. 9439—ornithine catabolic process; Category No. 9440—ornithine decarboxylase activator activity; Category No. 9441—ornithine decarboxylase activity; Category No. 9442—ornithine decarboxylase inhibitor activity; Category No. 9443—ornithine metabolic process; Category No. 9444—ornithine transport; Category No. 9445—ornithine-oxo-acid transaminase activity; Category No. 9446—orotate phosphoribosyltransferase activity; Category No. 9447—orotidine-5'-phosphate decarboxylase activity; Category No. 9448—orthogonal dichotomous subdivision of terminal units involved in lung branching morphogenesis; Category No. 9449—osmosensor activity; Category No. 9450—osmosensory signaling pathway; Category No. 9451—ossification; Category No. 9452—ossification involved in bone maturation; Category No. 9453—ossification involved in bone remodeling; Category No. 9454—osteoblast development; Category No. 9455—osteoblast differentiation; Category No. 9456—osteoblast fate commitment; Category No. 9457—osteoblast proliferation; Category No. 9458—osteoclast development; Category No. 9459—osteoclast differentiation; Category No. 9460—osteoclast fusion; Category No. 9461—osteoclast maturation; Category No. 9462—osteoclast proliferation; Category No. 9463—other organism cell; Category No. 9464—otic placode formation; Category No. 9465—otic vesicle development; Category No. 9466—otic vesicle formation; Category No. 9467—otic vesicle morphogenesis; Category No. 9468—otolith development; Category No. 9469—otolith mineralization; Category No. 9470—otolith morphogenesis; Category No. 9471—outer acrosomal membrane; Category No. 9472—outer dense fiber; Category No. 9473—outer dense plaque of desmosome; Category No. 9474—outer dynein arm; Category No. 9475—outer dynein arm assembly; Category No. 9476—outer ear morphogenesis; Category No. 9477—outer medullary collecting duct development; Category No. 9478—outer membrane; Category No. 9479—outer mitochondrial membrane organization; Category No. 9480—outflow tract morphogenesis; Category No. 9481—outflow tract septum morphogenesis; Category No. 9482—outward rectifier potassium channel activity; Category No. 9483—ovarian cumulus expansion; Category No. 9484—ovarian follicle atresia; Category No. 9485—ovarian follicle development; Category No. 9486—ovarian follicle rupture; Category No. 9487—oviduct development; Category No. 9488—oviduct epithelium development; Category No. 9489—ovulation; Category No. 9490—ovulation cycle; Category No. 9491—ovulation cycle process; Category No. 9492—ovulation from ovarian follicle; Category No. 9493—oxalate metabolic process; Category No. 9494—oxalate transmembrane transporter activity; Category No. 9495—oxalate transport; Category No. 9496—oxalic acid secretion; Category No. 9497—oxaloacetate decarboxylase activity; Category No. 9498—oxaloacetate metabolic process; Category No. 9499—oxidation-dependent protein catabolic process; Category No. 9500—oxidation-reduction process; Category No. 9501—oxidative branch; Category No. 9502—oxidative deethylation; Category No. 9503—oxidative demethylation; Category No. 9504—oxidative DNA demethylase activity; Category No. 9505—oxidative DNA demethylation; Category No. 9506—oxidative phosphorylation; Category No. 9507—oxidative phosphorylation uncoupler activity; Category No. 9508—oxidative RNA demethylase activity; Category No. 9509—oxidative single-stranded DNA demethylation; Category No. 9510—oxidative single-stranded RNA demethylation; Category No. 9511—oxidative stress-induced premature senescence; Category No. 9512—oxidized purine DNA binding; Category No. 9513—oxidized purine nucleobase lesion DNA N-glycosylase activity; Category No. 9514—oxidized pyrimidine DNA binding; Category No. 9515—oxidized pyrimidine nucleobase lesion DNA N-glycosylase activity; Category No. 9516—oxidizing metal ions; Category No. 9517—oxidizing metal ions with flavin as acceptor; Category No. 9518—oxidoreductase activity; Category No. 9519—oxoglutarate dehydrogenase (NAD+) activity; Category No. 9520—oxoglutarate dehydrogenase (succinyl-transferring) activity; Category No. 9521—oxoglutarate dehydrogenase complex; Category No. 9522—oxoglutarate:malate antiporter activity; Category No. 9523—oxygen as acceptor; Category No. 9524—oxygen binding; Category No. 9525—oxygen homeostasis; Category No. 9526—oxygen metabolic process; Category No. 9527—oxygen sensor activity; Category No. 9528—oxygen transport; Category No. 9529—oxygen transporter activity; Category No. 9530—oxygen-dependent protoporphyrinogen oxidase activity; Category No. 9531—oxysterol 7-alpha-hydroxylase activity; Category No. 9532—oxysterol binding; Category No. 9533—oxytocin receptor activity; Category No. 9534—oxytocin receptor binding; Category No. 9535—P granule; Category No. 9536—P granule organization; Category No. 9537—P2Y1 nucleotide receptor binding; Category No. 9538—p38MAPK cascade; Category No. 9539—p53 binding; Category No. 9540—palate development; Category No. 9541—pallium cell proliferation in forebrain; Category No. 9542—pallium development; Category No. 9543—palmitic acid biosynthetic process; Category No. 9544—palmitoleoyltransferase activity; Category No. 9545—palmitoleyl hydrolase activity; Category No. 9546—palmitoyl hydrolase activity; Category No. 9547—palmitoyl-(protein) hydrolase activity; Category No. 9548—palmitoyl-[acyl-carrier-protein] hydrolase activity; Category No. 9549—palmitoyl-CoA hydrolase activity; Category No. 9550—palmitoyl-CoA oxidase activity; Category No. 9551—palmitoyltransferase activity; Category No. 9552—palmitoyltransferase complex; Category No. 9553—PAN complex; Category No. 9554—pancreas development; Category No. 9555—pancreas morphogenesis; Category No. 9556—pancreatic A cell development; Category No. 9557—pancreatic A cell differentiation; Category No. 9558—pancreatic A cell fate commitment; Category No. 9559—pancreatic D cell differentiation; Category No. 9560—pancreatic epsilon cell differentiation; Category No. 9561—pancreatic juice secretion; Category No. 9562—pancreatic polypeptide receptor activity; Category No. 9563—pancreatic PP cell fate commitment; Category No. 9564—pantetheine hydrolase activity; Category No. 9565—pantetheine-phosphate adenylyltransferase activity; Category No. 9566—pantothenate kinase activity; Category No. 9567—pantothenate metabolic process; Category No. 9568—pantothenate transmembrane transport; Category No. 9569—paracrine signaling; Category No. 9570—paraferritin complex; Category No. 9571—parallel actin filament bundle assembly; Category No. 9572—parallel fiber; Category No. 9573—paramesonephric duct development; Category No. 9574—paranodal junction; Category No. 9575—paranodal junction assembly; Category No. 9576—paranodal junction maintenance; Category No. 9577—paranode region of axon; Category No. 9578—paraspeckles; Category No. 9579—parasympathetic nervous system development; Category No. 9580—parathyroid gland development; Category No. 9581—parathyroid hormone receptor activity; Category No. 9582—parathyroid hormone receptor binding; Category No. 9583—parathyroid hormone secretion; Category No. 9584—paraxial mesoderm development; Category No. 9585—paraxial mesoderm formation; Category No. 9586—paraxial mesoderm morphogenesis; Category No. 9587—paraxial mesoderm structural organization; Category No. 9588—paraxial mesodermal cell fate commitment; Category No. 9589—Parkin-FBXW7-Cul1 ubiquitin ligase complex; Category No. 9590—parturition; Category No. 9591—PAS complex; Category No. 9592—patched binding; Category No. 9593—patched ligand maturation; Category No. 9594—pathogenesis; Category No. 9595—pathway-restricted SMAD protein phosphorylation; Category No. 9596—pathway-specific cytoplasmic mediator activity; Category No. 9597—pattern recognition receptor signaling pathway; Category No. 9598—pattern specification involved in metanephros development; Category No. 9599—pattern specification process; Category No. 9600—patterning of blood vessels; Category No. 9601—PCAF complex; Category No. 9602—PCAF complex mitotic spindle; Category No. 9603—PcG protein complex; Category No. 9604—PCNA complex; Category No. 9605—PCNA-p21 complex; Category No. 9606—PCSK9-AnxA2 complex; Category No. 9607—PCSK9-LDLR complex; Category No. 9608—PDZ domain binding; Category No. 9609—PeBoW complex; Category No. 9610—penetration of zona pellucida; Category No. 9611—penile erection; Category No. 9612—pentacyclic triterpenoid metabolic process; Category No. 9613—pentameric IgM immunoglobulin complex; Category No. 9614—pentose biosynthetic process; Category No. 9615—pentose catabolic process; Category No. 9616—pentose-phosphate shunt; Category No. 9617—peptidase activator activity; Category No. 9618—peptidase activator activity involved in apoptotic process; Category No. 9619—peptidase activity; Category No. 9620—peptidase inhibitor activity; Category No. 9621—peptide alpha-N-acetyltransferase activity; Category No. 9622—peptide amidation; Category No. 9623—peptide antigen assembly with MHC class I protein complex; Category No. 9624—peptide antigen assembly with MHC class II protein complex; Category No. 9625—peptide antigen binding; Category No. 9626—peptide antigen stabilization; Category No. 9627—peptide antigen transport; Category No. 9628—peptide antigen-transporting ATPase activity; Category No. 9629—peptide binding; Category No. 9630—peptide biosynthetic process; Category No. 9631—peptide catabolic process; Category No. 9632—peptide cross-linking; Category No. 9633—peptide cross-linking via chondroitin 4-sulfate glycosaminoglycan; Category No. 9634—peptide deformylase activity; Category No. 9635—peptide disulfide oxidoreductase activity; Category No. 9636—peptide hormone binding; Category No. 9637—peptide hormone processing; Category No. 9638—peptide hormone receptor binding; Category No. 9639—peptide hormone secretion; Category No. 9640—peptide metabolic process; Category No. 9641—peptide secretion; Category No. 9642—peptide transport; Category No. 9643—peptide transporter activity; Category No. 9644—peptide YY receptor activity; Category No. 9645—peptide:proton symporter activity; Category No. 9646—peptide-aspartate beta-dioxygenase activity; Category No. 9647—peptide-glutamate-N-acetyltransferase activity; Category No. 9648—peptide-methionine (R)-S-oxide reductase activity; Category No. 9649—peptide-methionine (S)-S-oxide reductase activity; Category No. 9650—peptide-N4-(N-acetyl-beta-glucosaminyl)asparagine amidase activity; Category No. 9651—peptide-O-fucosyltransferase activity; Category No. 9652—peptide-serine-N-acetyltransferase activity; Category No. 9653—peptide-transporting ATPase activity; Category No. 9654—peptidoglycan binding; Category No. 9655—peptidoglycan catabolic process; Category No. 9656—peptidoglycan glycosyltransferase activity; Category No. 9657—peptidoglycan receptor activity; Category No. 9658—peptidylamidoglycolate lyase activity; Category No. 9659—peptidyl-amino acid modification; Category No. 9660—peptidyl-arginine methylation; Category No. 9661—peptidyl-arginine N-methylation; Category No. 9662—peptidyl-arginine omega-N-methylation; Category No. 9663—peptidyl-asparagine 3-dioxygenase activity; Category No. 9664—peptidyl-asparagine hydroxylation; Category No. 9665—peptidyl-aspartic acid hydroxylation; Category No. 9666—peptidyl-cysteine methylation; Category No. 9667—peptidyl-cysteine oxidation; Category No. 9668—peptidyl-cysteine S-nitrosylase activity; Category No. 9669—peptidyl-cysteine S-nitrosylation; Category No. 9670—peptidyl-cysteine S-trans-nitrosylation; Category No. 9671—peptidyl-dipeptidase activity; Category No. 9672—peptidyl-dipeptidase inhibitor activity; Category No. 9673—peptidyl-diphthamide biosynthetic process from peptidyl-histidine; Category No. 9674—peptidyl-glutamic acid carboxylation; Category No. 9675—peptidyl-glutamine methylation; Category No. 9676—peptidylglycine monooxygenase activity; Category No. 9677—peptidyl-histidine dephosphorylation; Category No. 9678—peptidyl-histidine dioxygenase activity; Category No. 9679—peptidyl-histidine hydroxylation; Category No. 9680—peptidyl-histidine phosphorylation; Category No. 9681—peptidyl-L-cysteine S-palmitoylation; Category No. 9682—peptidyl-lysine 5-dioxygenase activity; Category No. 9683—peptidyl-lysine acetylation; Category No. 9684—peptidyl-lysine deacetylation; Category No. 9685—peptidyl-lysine deglutarylation; Category No. 9686—peptidyl-lysine demalonylation; Category No. 9687—peptidyl-lysine desuccinylation; Category No. 9688—peptidyl-lysine dimethylation; Category No. 9689—peptidyl-lysine hydroxylation; Category No. 9690—peptidyl-lysine hydroxylation to 5-hydroxy-L-lysine; Category No. 9691—peptidyl-lysine methylation; Category No. 9692—peptidyl-lysine modification; Category No. 9693—peptidyl-lysine modification to peptidyl-hypusine; Category No. 9694—peptidyl-lysine monomethylation; Category No. 9695—peptidyl-lysine N6-acetylation; Category No. 9696—peptidyl-lysine N-acetyltransferase activity; Category No. 9697—peptidyl-lysine trimethylation; Category No. 9698—peptidyl-methionine modification; Category No. 9699—peptidyl-proline 3-dioxygenase activity; Category No. 9700—peptidyl-proline 4-dioxygenase activity; Category No. 9701—peptidyl-proline dioxygenase activity; Category No. 9702—peptidyl-proline hydroxylation; Category No. 9703—peptidyl-proline hydroxylation to 3-hydroxy-L-proline; Category No. 9704—peptidyl-proline hydroxylation to 4-hydroxy-L-proline; Category No. 9705—peptidyl-proline modification; Category No. 9706—peptidyl-prolyl cis-trans isomerase activity; Category No. 9707—peptidyl-pyroglutamic acid biosynthetic process; Category No. 9708—peptidyl-pyrromethane cofactor linkage; Category No. 9709—peptidyl-serine autophosphorylation; Category No. 9710—peptidyl-serine dephosphorylation; Category No. 9711—peptidyl-serine octanoylation; Category No. 9712—peptidyl-serine phosphopantetheinylation; Category No. 9713—peptidyl-serine phosphorylation; Category No. 9714—peptidyl-serine trans-autophosphorylation; Category No. 9715—peptidyl-threonine dephosphorylation; Category No. 9716—peptidyl-threonine phosphorylation; Category No. 9717—peptidyl-tyrosine autophosphorylation; Category No. 9718—peptidyl-tyrosine dephosphorylation; Category No. 9719—peptidyl-tyrosine dephosphorylation involved in inactivation of protein kinase activity; Category No. 9720—peptidyl-tyrosine phosphorylation; Category No. 9721—peptidyl-tyrosine sulfation; Category No. 9722—pericardium development; Category No. 9723—pericardium morphogenesis; Category No. 9724—pericellular basket; Category No. 9725—pericentric heterochromatin; Category No. 9726—pericentric heterochromatin assembly; Category No. 9727—pericentriolar material; Category No. 9728—perichromatin fibrils; Category No. 9729—periciliary membrane compartment; Category No. 9730—perikaryon; Category No. 9731—perineuronal net; Category No. 9732—perinuclear endoplasmic reticulum; Category No. 9733—perinuclear endoplasmic reticulum membrane; Category No. 9734—perinuclear region of cytoplasm; Category No. 9735—perinuclear theca; Category No. 9736—perinucleolar chromocenter; Category No. 9737—peripheral nervous system axon regeneration; Category No. 9738—peripheral nervous system development; Category No. 9739—peripheral nervous system myelin formation; Category No. 9740—peripheral nervous system myelin maintenance; Category No. 9741—peripheral nervous system neuron axonogenesis; Category No. 9742—peripheral nervous system neuron development; Category No. 9743—peripheral nervous system neuron differentiation; Category No. 9744—peristalsis; Category No. 9745—perivitelline space; Category No. 9746—PERK-mediated unfolded protein response; Category No. 9747—peroxidase activity; Category No. 9748—peroxidase inhibitor activity; Category No. 9749—peroxiredoxin activity; Category No. 9750—peroxisomal fatty-acyl-CoA transporter activity; Category No. 9751—peroxisomal importomer complex; Category No. 9752—peroxisomal long-chain fatty acid import; Category No. 9753—peroxisomal matrix; Category No. 9754—peroxisomal membrane; Category No. 9755—peroxisomal membrane transport; Category No. 9756—peroxisome; Category No. 9757—peroxisome fission; Category No. 9758—peroxisome matrix targeting signal-1 binding; Category No. 9759—peroxisome matrix targeting signal-2 binding; Category No. 9760—peroxisome membrane biogenesis; Category No. 9761—peroxisome membrane class-1 targeting sequence binding; Category No. 9762—peroxisome organization; Category No. 9763—peroxisome proliferator activated receptor binding; Category No. 9764—peroxisome proliferator activated receptor signaling pathway; Category No. 9765—peroxisome targeting sequence binding; Category No. 9766—peroxisome transport along microtubule; Category No. 9767—peroxynitrite reductase activity; Category No. 9768—pexophagy; Category No. 9769—Peyer's patch development; Category No. 9770—Peyer's patch morphogenesis; Category No. 9771—PH domain binding; Category No. 9772—pH reduction; Category No. 9773—phagocytic cup; Category No. 9774—phagocytic vesicle; Category No. 9775—phagocytic vesicle lumen; Category No. 9776—phagocytic vesicle membrane; Category No. 9777—phagocytosis; Category No. 9778—phagolysosome; Category No. 9779—phagolysosome assembly; Category No. 9780—phagolysosome assembly involved in apoptotic cell clearance; Category No. 9781—phagolysosome membrane; Category No. 9782—phagosome acidification; Category No. 9783—phagosome maturation; Category No. 9784—phagosome-lysosome fusion; Category No. 9785—pharyngeal arch artery morphogenesis; Category No. 9786—pharyngeal system development; Category No. 9787—pharynx development; Category No. 9788—phenanthrene 9,10-monooxygenase activity; Category No. 9789—phenanthrene-9,10-epoxide hydrolase activity; Category No. 9790—phenethylamine:oxygen oxidoreductase (deaminating) activity; Category No. 9791—phenol-containing compound metabolic process; Category No. 9792—phenylacetate catabolic process; Category No. 9793—phenylalanine 4-monooxygenase activity; Category No. 9794—phenylalanine transport; Category No. 9795—phenylalanine-tRNA ligase activity; Category No. 9796—phenylalanine-tRNA ligase complex; Category No. 9797—phenylalanyl-tRNA aminoacylation; Category No. 9798—phenylethanolamine N-methyltransferase activity; Category No. 9799—phenylethylamine metabolic process; Category No. 9800—phenylpyruvate tautomerase activity; Category No. 9801—pheromone binding; Category No. 9802—pheromone receptor activity; Category No. 9803—phosphatase activator activity; Category No. 9804—phosphatase activity; Category No. 9805—phosphatase binding; Category No. 9806—phosphatase inhibitor activity; Category No. 9807—phosphatase regulator activity; Category No. 9808—phosphate group as acceptor; Category No. 9809—phosphate ion binding; Category No. 9810—phosphate ion carrier activity;

Category No. 9811—phosphate ion homeostasis; Category No. 9812—phosphate ion transmembrane transport; Category No. 9813—phosphate ion transmembrane transporter activity; Category No. 9814—phosphate ion transport; Category No. 9815—phosphate-containing compound metabolic process; Category No. 9816—phosphatidate cytidylyltransferase activity; Category No. 9817—phosphatidate phosphatase activity; Category No. 9818—phosphatidic acid binding; Category No. 9819—phosphatidic acid biosynthetic process; Category No. 9820—phosphatidic acid metabolic process; Category No. 9821—phosphatidic acid transporter activity; Category No. 9822—phosphatidylcholine 1-acylhydrolase activity; Category No. 9823—phosphatidylcholine acyl-chain remodeling; Category No. 9824—phosphatidylcholine binding; Category No. 9825—phosphatidylcholine biosynthetic process; Category No. 9826—phosphatidylcholine catabolic process; Category No. 9827—phosphatidylcholine metabolic process; Category No. 9828—phosphatidylcholine transporter activity; Category No. 9829—phosphatidylcholine-retinol O-acyltransferase activity; Category No. 9830—phosphatidylcholine-sterol O-acyltransferase activator activity; Category No. 9831—phosphatidylcholine-sterol O-acyltransferase activity; Category No. 9832—phosphatidylcholine-translocating ATPase activity; Category No. 9833—phosphatidylethanolamine acyl-chain remodeling; Category No. 9834—phosphatidylethanolamine binding; Category No. 9835—phosphatidylethanolamine biosynthetic process; Category No. 9836—phosphatidylethanolamine catabolic process; Category No. 9837—phosphatidylethanolamine metabolic process; Category No. 9838—phosphatidylethanolamine N-methyltransferase activity; Category No. 9839—phosphatidylglycerol acyl-chain remodeling; Category No. 9840—phosphatidylglycerol binding; Category No. 9841—phosphatidylglycerol biosynthetic process; Category No. 9842—phosphatidylglycerophosphatase activity; Category No. 9843—phosphatidylinositol 3-kinase activity; Category No. 9844—phosphatidylinositol 3-kinase binding; Category No. 9845—phosphatidylinositol 3-kinase catalytic subunit binding; Category No. 9846—phosphatidylinositol 3-kinase complex; Category No. 9847—phosphatidylinositol 3-kinase complex class IA; Category No. 9848—phosphatidylinositol 3-kinase complex class IB; Category No. 9849—phosphatidylinositol 3-kinase complex class III; Category No. 9850—phosphatidylinositol 3-kinase complex class III type I; Category No. 9851—phosphatidylinositol 3-kinase complex class III type II; Category No. 9852—phosphatidylinositol 3-kinase regulator activity; Category No. 9853—phosphatidylinositol 3-kinase regulatory subunit binding; Category No. 9854—phosphatidylinositol 3-kinase signaling; Category No. 9855—phosphatidylinositol 5-phosphate metabolic process; Category No. 9856—phosphatidylinositol acyl-chain remodeling; Category No. 9857—phosphatidylinositol binding; Category No. 9858—phosphatidylinositol biosynthetic process; Category No. 9859—phosphatidylinositol bisphosphate phosphatase activity; Category No. 9860—phosphatidylinositol catabolic process; Category No. 9861—phosphatidylinositol dephosphorylation; Category No. 9862—phosphatidylinositol metabolic process; Category No. 9863—phosphatidylinositol N-acetylglucosaminyltransferase activity; Category No. 9864—phosphatidylinositol phosphate 5-phosphatase activity; Category No. 9865—phosphatidylinositol phosphate binding; Category No. 9866—phosphatidylinositol phosphate kinase activity; Category No. 9867—phosphatidylinositol phosphate phosphatase activity; Category No. 9868—phosphatidylinositol phospholipase C activity; Category No. 9869—phosphatidylinositol phosphorylation; Category No. 9870—phosphatidylinositol transporter activity; Category No. 9871—phosphatidylinositol trisphosphate phosphatase activity; Category No. 9872—phosphatidylinositol-3,4,5-trisphosphate 3-phosphatase activity; Category No. 9873—phosphatidylinositol-3,4,5-trisphosphate 5-phosphatase activity; Category No. 9874—phosphatidylinositol-3,4,5-trisphosphate binding; Category No. 9875—phosphatidylinositol-3,4-bisphosphate 3-phosphatase activity; Category No. 9876—phosphatidylinositol-3,4-bisphosphate 4-phosphatase activity; Category No. 9877—phosphatidylinositol-3,4-bisphosphate binding; Category No. 9878—phosphatidylinositol-3,5-bisphosphate 3-phosphatase activity; Category No. 9879—phosphatidylinositol-3,5-bisphosphate 5-phosphatase activity; Category No. 9880—phosphatidylinositol-3,5-bisphosphate binding; Category No. 9881—phosphatidylinositol-3-phosphatase activity; Category No. 9882—phosphatidylinositol-3-phosphate binding; Category No. 9883—phosphatidylinositol-3-phosphate biosynthetic process; Category No. 9884—phosphatidylinositol-4,5-bisphosphate 3-kinase activity; Category No. 9885—phosphatidylinositol-4,5-bisphosphate 4-phosphatase activity; Category No. 9886—phosphatidylinositol-4,5-bisphosphate 5-phosphatase activity; Category No. 9887—phosphatidylinositol-4,5-bisphosphate binding; Category No. 9888—phosphatidylinositol-4-phosphate binding; Category No. 9889—phosphatidylinositol-4-phosphate phosphatase activity; Category No. 9890—phosphatidylinositol-5-phosphate binding; Category No. 9891—phosphatidylinositol-mediated signaling; Category No. 9892—phosphatidyl-N-dimethylethanolamine N-methyltransferase activity; Category No. 9893—phosphatidyl-N-methylethanolamine N-methyltransferase activity; Category No. 9894—phosphatidylserine 1-acylhydrolase activity; Category No. 9895—phosphatidylserine acyl-chain remodeling; Category No. 9896—phosphatidylserine binding; Category No. 9897—phosphatidylserine biosynthetic process; Category No. 9898—phosphatidylserine catabolic process; Category No. 9899—phosphatidylserine decarboxylase activity; Category No. 9900—phosphatidylserine exposure on apoptotic cell surface; Category No. 9901—phosphatidylserine exposure on blood platelet; Category No. 9902—phosphatidylserine metabolic process; Category No. 9903—phosphoacetylglucosamine mutase activity; Category No. 9904—phosphoanandamide dephosphorylation; Category No. 9905—phosphocholine phosphatase activity; Category No. 9906—phosphocreatine biosynthetic process; Category No. 9907—phosphodiesterase decapping endonuclease activity; Category No. 9908—phosphodiesterase I activity; Category No. 9909—phosphoenolpyruvate carboxykinase (GTP) activity; Category No. 9910—phosphoenolpyruvate carboxykinase activity; Category No. 9911—phosphoethanolamine phosphatase activity; Category No. 9912—phosphofructokinase activity; Category No. 9913—phosphoglucomutase activity; Category No. 9914—phosphogluconate dehydrogenase (decarboxylating) activity; Category No. 9915—phosphoglycerate dehydrogenase activity; Category No. 9916—phosphoglycerate kinase activity; Category No. 9917—phosphoglycerate mutase activity; Category No. 9918—phosphoglycolate phosphatase activity; Category No. 9919—phosphohistidine phosphatase activity; Category No. 9920—phospholipase A2 activator activity; Category No. 9921—phospholipase A2 activity; Category No. 9922—phospholipase A2 inhibitor activity; Category No. 9923—phospholipase activator activity; Category No. 9924—phospholipase activity; Category No. 9925—phospholipase binding; Category No. 9926—phospholipase C activity; Category No. 9927—phospholipase C-activating adrenergic receptor signaling pathway; Category No. 9928—phospholipase C-activating angiotensin-activated signaling pathway; Category No. 9929—phospholipase C-activating dopamine receptor signaling pathway; Category No. 9930—phospholipase C-activating G-protein coupled acetylcholine receptor signaling pathway; Category No. 9931—phospholipase C-activating G-protein coupled glutamate receptor signaling pathway; Category No. 9932—phospholipase C-activating G-protein coupled receptor signaling pathway; Category No. 9933—phospholipase C-activating serotonin receptor signaling pathway; Category No. 9934—phospholipase C-inhibiting G-protein coupled receptor signaling pathway; Category No. 9935—phospholipase D activator activity; Category No. 9936—phospholipase D activity; Category No. 9937—phospholipase D-activating G-protein coupled receptor signaling pathway; Category No. 9938—phospholipase inhibitor activity; Category No. 9939—phospholipid binding; Category No. 9940—phospholipid biosynthetic process; Category No. 9941—phospholipid catabolic process; Category No. 9942—phospholipid dephosphorylation; Category No. 9943—phospholipid efflux; Category No. 9944—phospholipid homeostasis; Category No. 9945—phospholipid metabolic process; Category No. 9946—phospholipid scramblase activity; Category No. 9947—phospholipid scrambling; Category No. 9948—phospholipid transfer to membrane; Category No. 9949—phospholipid translocation; Category No. 9950—phospholipid transport; Category No. 9951—phospholipid transporter activity; Category No. 9952—phospholipid-hydroperoxide glutathione peroxidase activity; Category No. 9953—phospholipid-translocating ATPase activity; Category No. 9954—phosphomannomutase activity; Category No. 9955—phosphomevalonate kinase activity; Category No. 9956—phospho-N-acetylmuramoyl-pentapeptide-transferase activity; Category No. 9957—phosphopantetheine binding; Category No. 9958—phosphopantothenate-cysteine ligase activity; Category No. 9959—phosphopantothenoylcysteine decarboxylase activity; Category No. 9960—phosphopentomutase activity; Category No. 9961—phosphoprotein binding; Category No. 9962—phosphoprotein phosphatase activity; Category No. 9963—phosphopyruvate hydratase activity; Category No. 9964—phosphopyruvate hydratase complex; Category No. 9965—phosphorelay sensor kinase activity; Category No. 9966—phosphorelay signal transduction system; Category No. 9967—phosphoribosylamine-glycine ligase activity; Category No. 9968—phosphoribosylaminoimidazole carboxylase activity; Category No. 9969—phosphoribosylaminoimidazolecarboxamide formyltransferase activity; Category No. 9970—phosphoribosylaminoimidazolesuccinocarboxamide synthase activity; Category No. 9971—phosphoribosylformylglycinamidine cyclo-ligase activity; Category No. 9972—phosphoribosylformylglycinamidine synthase activity; Category No. 9973—phosphoribosylglycinamide formyltransferase activity; Category No. 9974—phosphoric diester hydrolase activity; Category No. 9975—phosphoric ester hydrolase activity; Category No. 9976—phosphorus-oxygen lyase activity; Category No. 9977—phosphorylase activity; Category No. 9978—phosphorylase kinase activity; Category No. 9979—phosphorylase kinase complex; Category No. 9980—phosphorylase kinase regulator activity; Category No. 9981—phosphorylated carbohydrate dephosphorylation; Category No. 9982—phosphorylation; Category No. 9983—phosphorylation of RNA polymerase II C-terminal domain; Category No. 9984—phosphorylative mechanism; Category No. 9985—phosphoserine binding; Category No. 9986—phosphoserine phosphatase activity; Category No. 9987—phosphothreonine binding; Category No. 9988—phosphotransferase activity; Category No. 9989—phosphotransferases; Category No. 9990—phosphotyrosine binding; Category No. 9991—photoperiodism; Category No. 9992—photoreceptor activity; Category No. 9993—photoreceptor cell development; Category No. 9994—photoreceptor cell maintenance; Category No. 9995—photoreceptor cell morphogenesis; Category No. 9996—photoreceptor cell outer segment organization; Category No. 9997—photoreceptor cell terminal bouton; Category No. 9998—photoreceptor connecting cilium; Category No. 9999—photoreceptor disc membrane; Category No. 10000—photoreceptor inner segment; Category No. 10001—photoreceptor inner segment membrane; Category No. 10002—photoreceptor outer segment; Category No. 10003—photoreceptor outer segment membrane; Category No. 10004—photosynthesis; Category No. 10005—phototransduction; Category No. 10006—phthalate metabolic process; Category No. 10007—phylloquinone catabolic process; Category No. 10008—phytanate-CoA ligase activity; Category No. 10009—phytanoyl-CoA dioxygenase activity; Category No. 10010—phytoalexin metabolic process; Category No. 10011—phytoceramidase activity; Category No. 10012—phytol metabolic process; Category No. 10013—phytosphingosine biosynthetic process; Category No. 10014—pi-body; Category No. 10015—Piccolo NuA4 histone acetyltransferase complex; Category No. 10016—pICln-Sm protein complex; Category No. 10017—piecemeal microautophagy of nucleus; Category No. 10018—pigment biosynthetic process; Category No. 10019—pigment cell differentiation; Category No. 10020—pigment granule aggregation in cell center; Category No. 10021—pigment granule localization; Category No. 10022—pigment granule maturation; Category No. 10023—pigment granule organization; Category No. 10024—pigment granule transport; Category No. 10025—pigmentation; Category No. 10026—pilomotor reflex; Category No. 10027—pinceau fiber; Category No. 10028—pinocytosis; Category No. 10029—piP-body; Category No. 10030—pi RNA binding; Category No. 10031—piRNA metabolic process; Category No. 10032—pituitary adenylate cyclase activating polypeptide activity; Category No. 10033—pituitary adenylate cyclase-activating polypeptide receptor binding; Category No. 10034—pituitary gland development; Category No. 10035—placenta blood vessel development; Category No. 10036—placenta development; Category No. 10037—placental growth factor-activated receptor activity; Category No. 10038—planar cell polarity pathway; Category No. 10039—planar cell polarity pathway involved in axis elongation; Category No. 10040—planar cell polarity pathway involved in cardiac muscle tissue morphogenesis; Category No. 10041—planar cell polarity pathway involved in cardiac right atrium morphogenesis; Category No. 10042—planar cell polarity pathway involved in gastrula mediolateral intercalation; Category No. 10043—planar cell polarity pathway involved in heart morphogenesis; Category No. 10044—planar cell polarity pathway involved in neural tube closure; Category No. 10045—planar cell polarity pathway involved in outflow tract morphogenesis; Category No. 10046—planar cell polarity pathway involved in pericardium morphogenesis; Category No. 10047—planar cell polarity pathway involved in ventricular septum morphogenesis; Category No. 10048—planar dichotomous subdivision of terminal units involved in lung branching morphogenesis; Category No.

10049—plasma cell differentiation; Category No. 10050—plasma kallikrein-kinin cascade; Category No. 10051—plasma lipoprotein particle; Category No. 10052—plasma lipoprotein particle assembly; Category No. 10053—plasma lipoprotein particle clearance; Category No. 10054—plasma lipoprotein particle oxidation; Category No. 10055—plasma lipoprotein particle remodeling; Category No. 10056—plasma membrane; Category No. 10057—plasma membrane copper ion transport; Category No. 10058—plasma membrane fusion; Category No. 10059—plasma membrane lactate transport; Category No. 10060—plasma membrane long-chain fatty acid transport; Category No. 10061—plasma membrane organization; Category No. 10062—plasma membrane protein complex; Category No. 10063—plasma membrane raft; Category No. 10064—plasma membrane raft assembly; Category No. 10065—plasma membrane repair; Category No. 10066—plasma membrane to endosome transport; Category No. 10067—plasma membrane to Golgi; Category No. 10068—plasmacytoid dendritic cell activation; Category No. 10069—plasminogen activation; Category No. 10070—platelet activating factor biosynthetic process; Category No. 10071—platelet activating factor metabolic process; Category No. 10072—platelet activating factor receptor activity; Category No. 10073—platelet activating factor receptor binding; Category No. 10074—platelet activation; Category No. 10075—platelet aggregation; Category No. 10076—platelet alpha granule; Category No. 10077—platelet alpha granule lumen; Category No. 10078—platelet alpha granule membrane; Category No. 10079—platelet alpha granule organization; Category No. 10080—platelet degranulation; Category No. 10081—platelet dense granule; Category No. 10082—platelet dense granule membrane; Category No. 10083—platelet dense granule organization; Category No. 10084—platelet dense tubular network; Category No. 10085—platelet dense tubular network membrane; Category No. 10086—platelet formation; Category No. 10087—platelet morphogenesis; Category No. 10088—platelet-activating factor acetyltransferase activity; Category No. 10089—platelet-derived growth factor alpha-receptor activity; Category No. 10090—platelet-derived growth factor beta-receptor activity; Category No. 10091—platelet-derived growth factor binding; Category No. 10092—platelet-derived growth factor receptor binding; Category No. 10093—platelet-derived growth factor receptor signaling pathway; Category No. 10094—platelet-derived growth factor receptor-alpha signaling pathway; Category No. 10095—platelet-derived growth factor receptor-beta signaling pathway; Category No. 10096—platelet-derived growth factor-activated receptor activity; Category No. 10097—platinum binding; Category No. 10098—plus-end directed microfilament motor activity; Category No. 10099—plus-end kinesin complex; Category No. 10100—plus-end specific microtubule depolymerization; Category No. 10101—plus-end-directed; Category No. 10102—plus-end-directed vesicle transport along microtubule; Category No. 10103—PMA-inducible membrane protein ectodomain proteolysis; Category No. 10104—PML body; Category No. 10105—PML body organization; Category No. 10106—podosome; Category No. 10107—podosome assembly; Category No. 10108—pointed-end actin filament capping; Category No. 10109—polar body extrusion after meiotic divisions; Category No. 10110—polar microtubule; Category No. 10111—polarity specification of anterior posterior axis; Category No. 10112—polarity specification of proximal distal axis; Category No. 10113—polarized epithelial cell differentiation; Category No. 10114—polo kinase kinase activity; Category No. 10115—poly(A) binding; Category No. 10116—poly(A) RNA binding; Category No. 10117—poly(A)+ mRNA export from nucleus; Category No. 10118—poly(A)-coupled; Category No. 10119—poly(A)-specific ribonuclease activity; Category No. 10120—poly(ADP-ribose) glycohydrolase activity; Category No. 10121—poly(G) binding; Category No. 10122—poly(U) RNA binding; Category No. 10123—polyadenylation-dependent snoRNA 3'-end processing; Category No. 10124—poly-ADP-D-ribose binding; Category No. 10125—polyamine binding; Category No. 10126—polyamine biosynthetic process; Category No. 10127—polyamine catabolic process; Category No. 10128—polyamine homeostasis; Category No. 10129—polyamine metabolic process; Category No. 10130—polyamine oxidase activity; Category No. 10131—polychlorinated biphenyl binding; Category No. 10132—polycystin complex; Category No. 10133—polydeoxyribonucleotide kinase activity; Category No. 10134—poly-glutamine tract binding; Category No. 10135—polyketide metabolic process; Category No. 10136—polymeric immunoglobulin receptor activity; Category No. 10137—poly-N-acetyllactosamine biosynthetic process; Category No. 10138—poly-N-acetyllactosamine metabolic process; Category No. 10139—polynucleotide 3' dephosphorylation; Category No. 10140—polynucleotide 3'-phosphatase activity; Category No. 10141—polynucleotide 5' dephosphorylation; Category No. 10142—polynucleotide 5'-hydroxyl-kinase activity; Category No. 10143—polynucleotide 5'-phosphatase activity; Category No. 10144—polynucleotide adenylyltransferase activity; Category No. 10145—polyol transmembrane transporter activity; Category No. 10146—polyol transport; Category No. 10147—polypeptide N-acetylgalactosaminyltransferase activity; Category No. 10148—polyphosphate catabolic process; Category No. 10149—polyphosphate metabolic process; Category No. 10150—polyprenol catabolic process; Category No. 10151—polyprenyltransferase activity; Category No. 10152—poly-pyrimidine tract binding; Category No. 10153—polyribonucleotide nucleotidyltransferase activity; Category No. 10154—polysaccharide binding; Category No. 10155—polysaccharide biosynthetic process; Category No. 10156—polysaccharide catabolic process; Category No. 10157—polysaccharide chain biosynthetic process; Category No. 10158—polysaccharide digestion; Category No. 10159—polysaccharide localization; Category No. 10160—polysaccharide metabolic process; Category No. 10161—polysomal ribosome; Category No. 10162—polysome; Category No. 10163—polyubiquitin binding; Category No. 10164—polyubiquitinated misfolded protein transport; Category No. 10165—polyunsaturated fatty acid; Category No. 10166—polyuridylation-dependent mRNA catabolic process; Category No. 10167—pons development; Category No. 10168—pons maturation; Category No. 10169—pore complex; Category No. 10170—pore complex assembly; Category No. 10171—porin activity; Category No. 10172—porphobilinogen synthase activity; Category No. 10173—porphyrin-containing compound biosynthetic process; Category No. 10174—porphyrin-containing compound metabolic process; Category No. 10175—positive chemotaxis; Category No. 10176—positive regulation by host of symbiont catalytic activity; Category No. 10177—positive regulation by host of viral genome replication; Category No. 10178—positive regulation by host of viral process; Category No. 10179—positive regulation by host of viral release from host cell; Category No. 10180—positive regulation by host of viral transcription; Category No. 10181—positive regulation by virus of viral protein levels in host cell; Category No. 10182—positive regulation of 1-phosphatidylinositol 4-kinase activity; Category No. 10183—positive regulation of abscisic acid-activated signaling pathway; Category No. 10184—positive regulation of acetylcholine secretion; Category No. 10185—positive regulation of aconitate hydratase activity; Category No. 10186—positive regulation of acrosomal vesicle exocytosis; Category No. 10187—positive regulation of acrosome reaction; Category No. 10188—positive regulation of actin cytoskeleton reorganization; Category No. 10189—positive regulation of actin filament binding; Category No. 10190—positive regulation of actin filament bundle assembly; Category No. 10191—positive regulation of actin filament depolymerization; Category No. 10192—positive regulation of actin filament polymerization; Category No. 10193—positive regulation of actin filament severing; Category No. 10194—positive regulation of actin nucleation; Category No. 10195—positive regulation of action potential; Category No. 10196—positive regulation of activated T cell autonomous cell death; Category No. 10197—positive regulation of activated T cell proliferation; Category No. 10198—positive regulation of activation of JAK2 kinase activity; Category No. 10199—positive regulation of activation of Janus kinase activity; Category No. 10200—positive regulation of activation of membrane attack complex; Category No. 10201—positive regulation of activation-induced cell death of T cells; Category No. 10202—positive regulation of activin receptor signaling pathway; Category No. 10203—positive regulation of acute inflammatory response; Category No. 10204—positive regulation of acute inflammatory response to antigenic stimulus; Category No. 10205—positive regulation of acute inflammatory response to non-antigenic stimulus; Category No. 10206—positive regulation of adaptive immune response; Category No. 10207—positive regulation of adenosine receptor signaling pathway; Category No. 10208—positive regulation of adenylate cyclase activity; Category No. 10209—positive regulation of adenylate cyclase activity involved in G-protein coupled receptor signaling pathway; Category No. 10210—positive regulation of adherens junction organization; Category No. 10211—positive regulation of adiponectin secretion; Category No. 10212—positive regulation of adrenergic receptor signaling pathway; Category No. 10213—positive regulation of adrenergic receptor signaling pathway involved in heart process; Category No. 10214—positive regulation of aldosterone biosynthetic process; Category No. 10215—positive regulation of aldosterone secretion; Category No. 10216—positive regulation of alkaline phosphatase activity; Category No. 10217—positive regulation of alpha-amino-3-hydroxy-5-methyl-4-isoxazole propionate selective glutamate receptor activity; Category No. 10218—positive regulation of alpha-beta T cell differentiation; Category No. 10219—positive regulation of alpha-beta T cell proliferation; Category No. 10220—positive regulation of amino acid transport; Category No. 10221—positive regulation of ammonia assimilation cycle; Category No. 10222—positive regulation of amyloid precursor protein biosynthetic process; Category No. 10223—positive regulation of anagen; Category No. 10224—positive regulation of androgen receptor activity; Category No. 10225—positive regulation of androgen secretion; Category No. 10226—positive regulation of angiogenesis; Category No. 10227—positive regulation of anion channel activity; Category No. 10228—positive regulation of anoikis; Category No. 10229—positive regulation of anterior head development; Category No. 10230—positive regulation of antibacterial peptide biosynthetic process; Category No. 10231—positive regulation of antibacterial peptide production; Category No. 10232—positive regulation of antigen processing and presentation of peptide antigen via MHC class I; Category No. 10233—positive regulation of antigen processing and presentation of peptide antigen via MHC class II; Category No. 10234—positive regulation of antimicrobial humoral response; Category No. 10235—positive regulation of antral ovarian follicle growth; Category No. 10236—positive regulation of apoptotic cell clearance; Category No. 10237—positive regulation of apoptotic DNA fragmentation; Category No. 10238—positive regulation of apoptotic process; Category No. 10239—positive regulation of apoptotic process by virus; Category No. 10240—positive regulation of apoptotic process involved in mammary gland involution; Category No. 10241—positive regulation of apoptotic signaling pathway; Category No. 10242—positive regulation of appetite; Category No. 10243—positive regulation of arachidonic acid secretion; Category No. 10244—positive regulation of Arp2 3 complex-mediated actin nucleation; Category No. 10245—positive regulation of aspartate secretion; Category No. 10246—positive regulation of aspartic-type endopeptidase activity involved in amyloid precursor protein catabolic process; Category No. 10247—positive regulation of astrocyte chemotaxis; Category No. 10248—positive regulation of astrocyte differentiation; Category No. 10249—positive regulation of ATP biosynthetic process; Category No. 10250—positive regulation of ATPase activity; Category No. 10251—positive regulation of attachment of mitotic spindle microtubules to kinetochore; Category No. 10252—positive regulation of attachment of spindle microtubules to kinetochore; Category No. 10253—positive regulation of auditory receptor cell differentiation; Category No. 10254—positive regulation of autophagosome assembly; Category No. 10255—positive regulation of autophagosome maturation; Category No. 10256—positive regulation of autophagy; Category No. 10257—positive regulation of axon extension; Category No. 10258—positive regulation of axon extension involved in axon guidance; Category No. 10259—positive regulation of axon extension involved in regeneration; Category No. 10260—positive regulation of axon regeneration; Category No. 10261—positive regulation of axonogenesis; Category No. 10262—positive regulation of B cell activation; Category No. 10263—positive regulation of B cell apoptotic process; Category No. 10264—positive regulation of B cell chemotaxis; Category No. 10265—positive regulation of B cell differentiation; Category No. 10266—positive regulation of B cell proliferation; Category No. 10267—positive regulation of B cell receptor signaling pathway; Category No. 10268—positive regulation of B cell tolerance induction; Category No. 10269—positive regulation of basement membrane assembly involved in embryonic body morphogenesis; Category No. 10270—positive regulation of behavior; Category No. 10271—positive regulation of behavioral fear response; Category No. 10272—positive regulation of beta-amyloid clearance; Category No. 10273—positive regulation of beta-amyloid formation; Category No. 10274—positive regulation of bile acid biosynthetic process; Category No. 10275—positive regulation of binding; Category No. 10276—positive regulation of biomineral tissue development; Category No. 10277—positive regulation of biosynthetic process of antibacterial peptides active against Gram-positive bacteria; Category No. 10278—positive regulation of bleb assembly; Category No. 10279—positive regulation of blood circulation; Category No. 10280—positive regulation of blood coagulation; Category No. 10281—positive regulation of blood microparticle formation; Category No. 10282—positive regulation of blood pressure; Category No. 10283—positive regulation of blood vessel endothelial cell migration; Category No. 10284—positive regulation of blood vessel endothelial cell proliferation involved in sprouting angiogenesis; Category No. 10285—positive regulation of blood vessel remodeling; Category No. 10286—positive regulation of BMP signaling pathway; Category No. 10287—positive regulation of bone mineralization; Category No. 10288—positive regulation of bone mineralization involved in bone maturation; Category No. 10289—positive regulation of bone resorption; Category No. 10290—positive regulation of brain-derived neurotrophic factor receptor signaling pathway; Category No. 10291—positive regulation of branching involved in lung morphogenesis; Category No. 10292—positive regulation of branching involved in ureteric bud morphogenesis; Category No. 10293—positive regulation of brown fat cell differentiation; Category No. 10294—positive regulation of brown fat cell proliferation; Category No. 10295—positive regulation of calcidiol 1-monooxygenase activity; Category No. 10296—positive regulation of calcineurin-NFAT signaling cascade; Category No. 10297—positive regulation of calcitonin secretion; Category No. 10298—positive regulation of calcium ion import; Category No. 10299—positive regulation of calcium ion transmembrane transport; Category No. 10300—positive regulation of calcium ion transmembrane transporter activity; Category No. 10301—positive regulation of calcium ion transport; Category No. 10302—positive regulation of calcium ion transport into cytosol; Category No. 10303—positive regulation of calcium ion-dependent exocytosis; Category No. 10304—positive regulation of calcium:sodium antiporter activity; Category No. 10305—positive regulation of calcium-dependent cell-cell adhesion; Category No. 10306—positive regulation of calcium-independent cell-cell adhesion; Category No. 10307—positive regulation of calcium-mediated signaling; Category No. 10308—positive regulation of calcium-transporting ATPase activity; Category No. 10309—positive regulation of cAMP biosynthetic process; Category No. 10310—positive regulation of cAMP catabolic process; Category No. 10311—positive regulation of cAMP metabolic process; Category No. 10312—positive regulation of cAMP-dependent protein kinase activity; Category No. 10313—positive regulation of cAMP-mediated signaling; Category No. 10314—positive regulation of canonical Wnt signaling pathway; Category No. 10315—positive regulation of canonical Wnt signaling pathway involved in cardiac muscle cell fate commitment; Category No. 10316—positive regulation of canonical Wnt signaling pathway involved in controlling type B pancreatic cell proliferation; Category No. 10317—positive regulation of cap-dependent translational initiation; Category No. 10318—positive regulation of cap-independent translational initiation; Category No. 10319—positive regulation of cardiac muscle cell apoptotic process; Category No. 10320—positive regulation of cardiac muscle cell differentiation; Category No. 10321—positive regulation of cardiac muscle cell proliferation; Category No. 10322—positive regulation of cardiac muscle contraction; Category No. 10323—positive regulation of cardiac muscle fiber development; Category No. 10324—positive regulation of cardiac muscle hypertrophy; Category No. 10325—positive regulation of cardiac muscle hypertrophy in response to stress; Category No. 10326—positive regulation of cardiac vascular smooth muscle cell differentiation; Category No. 10327—positive regulation of cardioblast differentiation; Category No. 10328—positive regulation of cardiolipin metabolic process; Category No. 10329—positive regulation of cartilage development; Category No. 10330—positive regulation of catagen; Category No. 10331—positive regulation of catalytic activity; Category No. 10332—positive regulation of catecholamine secretion; Category No. 10333—positive regulation of catenin import into nucleus; Category No. 10334—positive regulation of cation channel activity; Category No. 10335—positive regulation of caveolin-mediated endocytosis; Category No. 10336—positive regulation of C—C chemokine receptor CCR7 signaling pathway; Category No. 10337—positive regulation of CD24 biosynthetic process; Category No. 10338—positive regulation of CD40 signaling pathway; Category No. 10339—positive regulation of CD4-positive; Category No. 10340—positive regulation of CD8-positive; Category No. 10341—positive regulation of CDP-diacylglycerol-serine O-phosphatidyltransferase activity; Category No. 10342—positive regulation of cell activation; Category No. 10343—positive regulation of cell adhesion; Category No. 10344—positive regulation of cell adhesion mediated by integrin; Category No. 10345—positive regulation of cell adhesion molecule production; Category No. 10346—positive regulation of cell aging; Category No. 10347—positive regulation of cell communication by chemical coupling; Category No. 10348—positive regulation of cell communication by electrical coupling involved in cardiac conduction; Category No. 10349—positive regulation of cell cycle; Category No. 10350—positive regulation of cell cycle arrest; Category No. 10351—positive regulation of cell cycle checkpoint; Category No. 10352—positive regulation of cell cycle G1 S phase transition; Category No. 10353—positive regulation of cell cycle G2 M phase transition; Category No. 10354—positive regulation of cell cycle phase transition; Category No. 10355—positive regulation of cell cycle process; Category No. 10356—positive regulation of cell death; Category No. 10357—positive regulation of cell development; Category No. 10358—positive regulation of cell differentiation; Category No. 10359—positive regulation of cell division; Category No. 10360—positive regulation of cell fate commitment; Category No. 10361—positive regulation of cell fate specification; Category No. 10362—positive regulation of cell growth; Category No. 10363—positive regulation of cell growth involved in cardiac muscle cell development; Category No. 10364—positive regulation of cell junction assembly; Category No. 10365—positive regulation of cell maturation; Category No. 10366—positive regulation of cell migration; Category No. 10367—positive regulation of cell migration by vascular endothelial growth factor signaling pathway; Category No. 10368—positive regulation of cell migration involved in sprouting angiogenesis; Category No. 10369—positive regulation of cell morphogenesis involved in differentiation; Category No. 10370—positive regulation of cell motility; Category No. 10371—positive regulation of cell projection organization; Category No. 10372—positive regulation of cell proliferation; Category No. 10373—positive regulation of cell proliferation by VEGF-activated platelet derived growth factor receptor signaling pathway; Category No. 10374—positive regulation of cell proliferation in bone marrow; Category No. 10375—positive regulation of cell proliferation involved in heart morphogenesis; Category No. 10376—positive regulation of cell proliferation involved in heart valve morphogenesis; Category No. 10377—positive regulation of cell proliferation involved in kidney development; Category No. 10378—positive regulation of cell size; Category No. 10379—positive regulation of cell-cell adhesion; Category No. 10380—positive regulation of cell-cell adhesion mediated by cadherin; Category No. 10381—positive regulation of cell-cell adhesion mediated by integrin; Category No. 10382—positive regulation of cell-matrix adhesion; Category No. 10383—positive regulation of cell-substrate adhesion; Category No. 10384—positive regulation of cellular biosynthetic process; Category No. 10385—positive regulation of cellular component biogenesis; Category No. 10386—positive regulation of cellular component movement; Category No. 10387—positive regulation of cellular component organization; Category No. 10388—positive regulation of cellular extravasation; Category No. 10389—positive regulation of cellular glucuronidation; Category No. 10390—positive regulation of cellular metabolic process; Category No. 10391—positive regulation of cellular pH reduction; Category No. 10392—positive regulation of cellular protein catabolic process; Category No. 10393—positive regulation of cellular protein localization; Category No. 10394—positive regulation of cellular protein metabolic process; Category No. 10395—positive regulation of cellular respiration; Category No. 10396—positive regulation of cellular response to drug; Category No. 10397—positive regulation of cellular response to hypoxia; Category No. 10398—positive regulation of cellular response to insulin stimulus; Category No. 10399—positive regulation of cellular response to X-ray; Category No. 10400—positive regulation of cellular senescence; Category No. 10401—positive regulation of central B cell tolerance induction; Category No. 10402—positive regulation of centriole elongation; Category No. 10403—positive regulation of centriole replication; Category No. 10404—positive regulation of ceramide biosynthetic process; Category No. 10405—positive regulation of cerebellar granule cell precursor proliferation; Category No. 10406—positive regulation of cGMP biosynthetic process; Category No. 10407—positive regulation of cGMP metabolic process; Category No. 10408—positive regulation of chaperone-mediated protein complex assembly; Category No. 10409—positive regulation of chemokine (C—C motif) ligand 2 secretion; Category No. 10410—positive regulation of chemokine (C—C motif) ligand 20 production; Category No. 10411—positive regulation of chemokine (C—C motif) ligand 5 production; Category No. 10412—positive regulation of chemokine (C—X—C motif) ligand 1 production; Category No. 10413—positive regulation of chemokine (C—X—C motif) ligand 2 production; Category No. 10414—positive regulation of chemokine biosynthetic process; Category No. 10415—positive regulation of chemokine production; Category No. 10416—positive regulation of chemokine secretion; Category No. 10417—positive regulation of chemokine-mediated signaling pathway; Category No. 10418—positive regulation of chemokinesis; Category No. 10419—positive regulation of chemotaxis; Category No. 10420—positive regulation of cholangiocyte proliferation; Category No. 10421—positive regulation of cholesterol biosynthetic process; Category No. 10422—positive regulation of cholesterol efflux; Category No. 10423—positive regulation of cholesterol esterification; Category No. 10424—positive regulation of cholesterol homeostasis; Category No. 10425—positive regulation of cholesterol metabolic process; Category No. 10426—positive regulation of cholesterol storage; Category No. 10427—positive regulation of cholesterol transport; Category No. 10428—positive regulation of choline 0-acetyltransferase activity; Category No. 10429—positive regulation of chondrocyte differentiation; Category No. 10430—positive regulation of chondrocyte proliferation; Category No. 10431—positive regulation of chromatin assembly or disassembly; Category No. 10432—positive regulation of chromatin binding; Category No. 10433—positive regulation of chromatin silencing; Category No. 10434—positive regulation of chromatin-mediated maintenance of transcription; Category No. 10435—positive regulation of chromosome segregation; Category No. 10436—positive regulation of chronic inflammatory response; Category No. 10437—positive regulation of chronic inflammatory response to non-antigenic stimulus; Category No. 10438—positive regulation of chylomicron remnant clearance; Category No. 10439—positive regulation of cilium assembly; Category No. 10440—positive regulation of cilium movement; Category No. 10441—positive regulation of circadian rhythm; Category No. 10442—positive regulation of circadian sleep wake cycle; Category No. 10443—positive regulation of clathrin-mediated endocytosis; Category No. 10444—positive regulation of coagulation; Category No. 10445—positive regulation of collagen binding; Category No. 10446—positive regulation of collagen biosynthetic process; Category No. 10447—positive regulation of collagen metabolic process; Category No. 10448—positive regulation of collateral sprouting; Category No. 10449—positive regulation of collateral sprouting in absence of injury; Category No. 10450—positive regulation of colon smooth muscle contraction; Category No. 10451—positive regulation of complement activation; Category No. 10452—positive regulation of connective tissue growth factor production; Category No. 10453—positive regulation of constitutive secretory pathway; Category No. 10454—positive regulation of corticosterone secretion; Category No. 10455—positive regulation of corticotropin secretion; Category No. 10456—positive regulation of corticotropin-releasing hormone secretion; Category No. 10457—positive regulation of cortisol biosynthetic process; Category No. 10458—positive regulation of cortisol secretion; Category No. 10459—positive regulation of CREB transcription factor activity; Category No. 10460—positive regulation of cristae formation; Category No. 10461—positive regulation of cyclase activity; Category No. 10462—positive regulation of cyclic nucleotide metabolic process; Category No. 10463—positive regulation of cyclic nucleotide-gated ion channel activity; Category No. 10464—positive regulation of cyclic-nucleotide phosphodiesterase activity; Category No. 10465—positive regulation of cyclin-dependent protein kinase activity; Category No. 10466—positive regulation of cyclin-dependent protein serine threonine kinase activity; Category No. 10467—positive regulation of cyclin-dependent protein serine threonine kinase activity involved in G1 S transition of mitotic cell cycle; Category No. 10468—positive regulation of cyclin-dependent protein serine threonine kinase activity involved in G2 M transition of mitotic cell cycle; Category No. 10469—positive regulation of cysteine-type endopeptidase activity; Category No. 10470—positive regulation of cysteine-type endopeptidase activity involved in apoptotic process; Category No. 10471—positive regulation of cysteine-type endopeptidase activity involved in apoptotic signaling pathway; Category No. 10472—positive regulation of cysteine-type endopeptidase activity involved in execution phase of apoptosis; Category No. 10473—positive regulation of cytokine activity; Category No. 10474—positive regulation of cytokine biosynthetic process; Category No. 10475—positive regulation of cytokine production; Category No. 10476—positive regulation of cytokine production involved in immune response; Category No. 10477—positive regulation of cytokine production involved in inflammatory response; Category No. 10478—positive regulation of cytokine secretion; Category No. 10479—positive regulation of cytokine secretion involved in immune response; Category No. 10480—positive regulation of cytokine-mediated signaling pathway; Category No. 10481—positive regulation of cytokinesis; Category No. 10482—positive regulation of cytolysis; Category No. 10483—positive regulation of cytoplasmic mRNA processing body assembly; Category No. 10484—positive regulation of cytoplasmic translation; Category No. 10485—positive regulation of cytoskeleton organization; Category No. 10486—positive regulation of cytosolic calcium ion concentration; Category No. 10487—positive regulation of cytosolic calcium ion concentration involved in phospholipase C-activating G-protein coupled signaling pathway; Category No. 10488—positive regulation of cytotoxic T cell differentiation; Category No. 10489—positive regulation of deacetylase activity; Category No. 10490—positive regulation of defense response to bacterium; Category No. 10491—positive regulation of defense response to virus by host; Category No. 10492—positive regulation of delayed rectifier potassium channel activity; Category No. 10493—positive regulation of dendrite development; Category No. 10494—positive regulation of dendrite extension; Category No. 10495—positive regulation of dendrite morphogenesis; Category No. 10496—positive regulation of dendritic cell antigen processing and presentation; Category No. 10497—positive regulation of dendritic cell apoptotic process; Category No. 10498—positive regulation of dendritic cell chemotaxis; Category No. 10499—positive regulation of dendritic cell dendrite assembly; Category No. 10500—positive regulation of dendritic cell differentiation; Category No. 10501—positive regulation of dendritic spine development; Category No. 10502—positive regulation of dendritic spine maintenance; Category No. 10503—positive regulation of dendritic spine morphogenesis; Category No. 10504—positive regulation of dense core granule biogenesis; Category No. 10505—positive regulation of deoxyribonuclease activity; Category No. 10506—positive regulation of dephosphorylation; Category No. 10507—positive regulation of dermatome development; Category No. 10508—positive regulation of determination of dorsal identity; Category No. 10509—positive regulation of developmental growth; Category No. 10510—positive regulation of developmental pigmentation; Category No. 10511—positive regulation of digestive system process; Category No. 10512—positive regulation of dipeptide transmembrane transport; Category No. 10513—positive regulation of DNA binding; Category No. 10514—positive regulation of DNA biosynthetic process; Category No. 10515—positive regulation of DNA damage checkpoint; Category No. 10516—positive regulation of DNA damage response; Category No. 10517—positive regulation of DNA endoreduplication; Category No. 10518—positive regulation of DNA ligation; Category No. 10519—positive regulation of DNA metabolic process; Category No. 10520—positive regulation of DNA N-glycosylase activity; Category No. 10521—positive regulation of DNA repair; Category No. 10522—positive regulation of DNA replication; Category No. 10523—positive regulation of DNA strand elongation; Category No. 10524—positive regulation of DNA topoisomerase (ATP-hydrolyzing) activity; Category No. 10525—positive regulation of DNA-dependent DNA replication; Category No. 10526—positive regulation of DNA-dependent DNA replication initiation; Category No. 10527—positive regulation of DNA-templated transcription; Category No. 10528—positive regulation of dopamine biosynthetic process; Category No. 10529—positive regulation of dopamine metabolic process; Category No. 10530—positive regulation of dopamine receptor signaling pathway; Category No. 10531—positive regulation of dopamine secretion; Category No. 10532—positive regulation of dopamine uptake involved in synaptic transmission; Category No. 10533—positive regulation of double-strand break repair; Category No. 10534—positive regulation of double-strand break repair via nonhomologous end joining; Category No. 10535—positive regulation of dUTP diphosphatase activity; Category No. 10536—positive regulation of early endosome to late endosome transport; Category No. 10537—positive regulation of early endosome to recycling endosome transport; Category No. 10538—positive regulation of eating behavior; Category No. 10539—positive regulation of embryonic development; Category No. 10540—positive regulation of enamel mineralization; Category No. 10541—positive regulation of endocardial cushion to mesenchymal transition involved in heart valve formation; Category No. 10542—positive regulation of endocytic recycling; Category No. 10543—positive regulation of endocytosis; Category No. 10544—positive regulation of endodeoxyribonuclease activity; Category No. 10545—positive regulation of endopeptidase activity; Category No. 10546—positive regulation of endoplasmic reticulum calcium ion concentration; Category No. 10547—positive regulation of endoplasmic reticulum stress-induced eIF2 alpha dephosphorylation; Category No. 10548—positive regulation of endoplasmic reticulum stress-induced intrinsic apoptotic signaling pathway; Category No. 10549—positive regulation of endoplasmic reticulum tubular network organization; Category No. 10550—positive regulation of endoplasmic reticulum unfolded protein response; Category No. 10551—positive regulation of endoribonuclease activity; Category No. 10552—positive regulation of endothelial cell apoptotic process; Category No. 10553—positive regulation of endothelial cell chemotaxis; Category No. 10554—positive regulation of endothelial cell chemotaxis by VEGF-activated vascular endothelial growth factor receptor signaling pathway; Category No. 10555—positive regulation of endothelial cell chemotaxis to fibroblast growth factor; Category No. 10556—positive regulation of endothelial cell differentiation; Category No. 10557—positive regulation of endothelial cell migration; Category No. 10558—positive regulation of endothelial cell proliferation; Category No. 10559—positive regulation of energy homeostasis; Category No. 10560—positive regulation of engulfment of apoptotic cell; Category No. 10561—positive regulation of eosinophil chemotaxis; Category No. 10562—positive regulation of eosinophil degranulation; Category No. 10563—positive regulation of eosinophil differentiation; Category No. 10564—positive regulation of eosinophil migration; Category No. 10565—positive regulation of ephrin receptor signaling pathway; Category No. 10566—positive regulation of epidermal cell differentiation; Category No. 10567—positive regulation of epidermal growth factor receptor signaling pathway; Category No. 10568—positive regulation of epidermal growth factor-activated receptor activity; Category No. 10569—positive regulation of epidermis development; Category No. 10570—positive regulation of epinephrine secretion; Category No. 10571—positive regulation of epithelial cell apoptotic process; Category No. 10572—positive regulation of epithelial cell differentiation; Category No. 10573—positive regulation of epithelial cell migration; Category No. 10574—positive regulation of epithelial cell proliferation; Category No. 10575—positive regulation of epithelial cell proliferation involved in lung morphogenesis; Category No. 10576—positive regulation of epithelial cell proliferation involved in prostate gland development; Category No.

10577—positive regulation of epithelial cell proliferation involved in wound healing; Category No. 10578—positive regulation of epithelial to mesenchymal transition; Category No. 10579—positive regulation of ER to Golgi vesicle-mediated transport; Category No. 10580—positive regulation of ERAD pathway; Category No. 10581—positive regulation of ER-associated ubiquitin-dependent protein catabolic process; Category No. 10582—positive regulation of ERBB signaling pathway; Category No. 10583—positive regulation of ERK1 and ERK2 cascade; Category No. 10584—positive regulation of ERK1 and ERK2 cascade via TNFSF11-mediated signaling; Category No. 10585—positive regulation of erythrocyte aggregation; Category No. 10586—positive regulation of erythrocyte differentiation; Category No. 10587—positive regulation of establishment of endothelial barrier; Category No. 10588—positive regulation of establishment of protein localization to plasma membrane; Category No. 10589—positive regulation of establishment of T cell polarity; Category No. 10590—positive regulation of excitatory postsynaptic potential; Category No. 10591—positive regulation of execution phase of apoptosis; Category No. 10592—positive regulation of exit from mitosis; Category No. 10593—positive regulation of exocytosis; Category No. 10594—positive regulation of exoribonuclease activity; Category No. 10595—positive regulation of exosomal secretion; Category No. 10596—positive regulation of extracellular exosome assembly; Category No. 10597—positive regulation of extracellular matrix assembly; Category No. 10598—positive regulation of extracellular matrix constituent secretion; Category No. 10599—positive regulation of extracellular matrix disassembly; Category No. 10600—positive regulation of extrinsic apoptotic signaling pathway; Category No. 10601—positive regulation of extrinsic apoptotic signaling pathway in absence of ligand; Category No. 10602—positive regulation of extrinsic apoptotic signaling pathway via death domain receptors; Category No. 10603—positive regulation of eye pigmentation; Category No. 10604—positive regulation of fast-twitch skeletal muscle fiber contraction; Category No. 10605—positive regulation of fat cell apoptotic process; Category No. 10606—positive regulation of fat cell differentiation; Category No. 10607—positive regulation of fat cell proliferation; Category No. 10608—positive regulation of fatty acid beta-oxidation; Category No. 10609—positive regulation of fatty acid biosynthetic process; Category No. 10610—positive regulation of fatty acid metabolic process; Category No. 10611—positive regulation of fatty acid oxidation; Category No. 10612—positive regulation of fatty acid transport; Category No. 10613—positive regulation of Fc receptor mediated stimulatory signaling pathway; Category No. 10614—positive regulation of feeding behavior; Category No. 10615—positive regulation of female receptivity; Category No. 10616—positive regulation of ferrous iron binding; Category No. 10617—positive regulation of ferrous iron import into cell; Category No. 10618—positive regulation of fever generation; Category No. 10619—positive regulation of fever generation by positive regulation of prostaglandin secretion; Category No. 10620—positive regulation of fibril organization; Category No. 10621—positive regulation of fibrinolysis; Category No. 10622—positive regulation of fibroblast apoptotic process; Category No. 10623—positive regulation of fibroblast growth factor production; Category No. 10624—positive regulation of fibroblast growth factor receptor signaling pathway; Category No. 10625—positive regulation of fibroblast migration; Category No. 10626—positive regulation of fibroblast proliferation; Category No. 10627—positive regulation of fibronectin-dependent thymocyte migration; Category No. 10628—positive regulation of filopodium assembly; Category No. 10629—positive regulation of focal adhesion assembly; Category No. 10630—positive regulation of follicle-stimulating hormone secretion; Category No. 10631—positive regulation of forebrain neuron differentiation; Category No. 10632—positive regulation of fractalkine biosynthetic process; Category No. 10633—positive regulation of free ubiquitin chain polymerization; Category No. 10634—positive regulation of fructose 1,6-bisphosphate 1-phosphatase activity; Category No. 10635—positive regulation of fructose 1,6-bisphosphate metabolic process; Category No. 10636—positive regulation of G0 to G1 transition; Category No. 10637—positive regulation of G1 S transition of mitotic cell cycle; Category No. 10638—positive regulation of G2 M transition of mitotic cell cycle; Category No. 10639—positive regulation of gamma-aminobutyric acid secretion; Category No. 10640—positive regulation of gamma-delta T cell activation; Category No. 10641—positive regulation of gamma-delta T cell activation involved in immune response; Category No. 10642—positive regulation of gamma-delta T cell differentiation; Category No. 10643—positive regulation of gap junction assembly; Category No. 10644—positive regulation of gastric acid secretion; Category No. 10645—positive regulation of gastric mucosal blood circulation; Category No. 10646—positive regulation of gastro-intestinal system smooth muscle contraction; Category No. 10647—positive regulation of gastrulation; Category No. 10648—positive regulation of gene expression; Category No. 10649—positive regulation of gene silencing by miRNA; Category No. 10650—positive regulation of germinal center formation; Category No. 10651—positive regulation of glial cell differentiation; Category No. 10652—positive regulation of glial cell proliferation; Category No. 10653—positive regulation of glial cell-derived neurotrophic factor secretion; Category No. 10654—positive regulation of gliogenesis; Category No. 10655—positive regulation of glomerular filtration; Category No. 10656—positive regulation of glomerular mesangial cell proliferation; Category No. 10657—positive regulation of glomerular metanephric mesangial cell proliferation; Category No. 10658—positive regulation of glomerular visceral epithelial cell apoptotic process; Category No. 10659—positive regulation of glomerulus development; Category No. 10660—positive regulation of glucagon secretion; Category No. 10661—positive regulation of glucocorticoid receptor signaling pathway; Category No. 10662—positive regulation of glucokinase activity; Category No. 10663—positive regulation of gluconeogenesis; Category No. 10664—positive regulation of gluconeogenesis by positive regulation of transcription from RNA polymerase II promoter; Category No. 10665—positive regulation of glucose catabolic process to lactate via pyruvate; Category No. 10666—positive regulation of glucose import; Category No. 10667—positive regulation of glucose import in response to insulin stimulus; Category No. 10668—positive regulation of glucose metabolic process; Category No. 10669—positive regulation of glucose transport; Category No. 10670—positive regulation of glucosylceramide catabolic process; Category No. 10671—positive regulation of glutamate metabolic process; Category No. 10672—positive regulation of glutamate neurotransmitter secretion in response to membrane depolarization; Category No. 10673—positive regulation of glutamate receptor signaling pathway; Category No. 10674—positive regulation of glutamate secretion; Category No. 10675—positive regulation of glutamate-cysteine ligase activity; Category No. 10676—positive regulation of glutamine transport; Category No. 10677—positive regulation of glutathione biosynthetic process; Category No. 10678—positive regulation of glutathione peroxidase activity; Category No. 10679—positive regulation of glycogen (starch) synthase activity; Category No. 10680—positive regulation of glycogen biosynthetic process; Category No. 10681—positive regulation of glycogen catabolic process; Category No. 10682—positive regulation of glycolytic process; Category No. 10683—positive regulation of glycoprotein biosynthetic process; Category No. 10684—positive regulation of glycoprotein biosynthetic process involved in immunological synapse formation; Category No. 10685—positive regulation of glycoprotein metabolic process; Category No. 10686—positive regulation of Golgi to plasma membrane protein transport; Category No. 10687—positive regulation of G-protein coupled receptor protein signaling pathway; Category No. 10688—positive regulation of granulocyte chemotaxis; Category No. 10689—positive regulation of granulocyte colony-stimulating factor production; Category No. 10690—positive regulation of granulocyte differentiation; Category No. 10691—positive regulation of granulocyte macrophage colony-stimulating factor biosynthetic process; Category No. 10692—positive regulation of granulocyte macrophage colony-stimulating factor production; Category No. 10693—positive regulation of granulosa cell proliferation; Category No. 10694—positive regulation of granzyme A production; Category No. 10695—positive regulation of granzyme B production; Category No. 10696—positive regulation of growth; Category No. 10697—positive regulation of growth factor dependent skeletal muscle satellite cell proliferation; Category No. 10698—positive regulation of growth hormone receptor signaling pathway; Category No. 10699—positive regulation of growth hormone secretion; Category No. 10700—positive regulation of growth of symbiont in host; Category No. 10701—positive regulation of GTP binding; Category No. 10702—positive regulation of GTPase activity; Category No. 10703—positive regulation of guanylate cyclase activity; Category No. 10704—positive regulation of hair cycle; Category No. 10705—positive regulation of hair follicle cell proliferation; Category No. 10706—positive regulation of hair follicle development; Category No. 10707—positive regulation of heart contraction; Category No. 10708—positive regulation of heart growth; Category No. 10709—positive regulation of heart induction by negative regulation of canonical Wnt signaling pathway; Category No. 10710—positive regulation of heart rate; Category No. 10711—positive regulation of heart rate by epinephrine; Category No. 10712—positive regulation of heart rate by epinephrine-norepinephrine; Category No. 10713—positive regulation of heat generation; Category No. 10714—positive regulation of helicase activity; Category No. 10715—positive regulation of hematopoietic progenitor cell differentiation; Category No. 10716—positive regulation of hematopoietic stem cell differentiation; Category No. 10717—positive regulation of hematopoietic stem cell migration; Category No. 10718—positive regulation of hematopoietic stem cell proliferation; Category No. 10719—positive regulation of hemoglobin biosynthetic process; Category No. 10720—positive regulation of heparan sulfate proteoglycan biosynthetic process; Category No. 10721—positive regulation of hepatic stellate cell activation; Category No. 10722—positive regulation of hepatocyte differentiation; Category No. 10723—positive regulation of hepatocyte growth factor receptor signaling pathway; Category No. 10724—positive regulation of hepatocyte proliferation; Category No. 10725—positive regulation of heterochromatin assembly; Category No. 10726—positive regulation of heterotypic cell-cell adhesion; Category No. 10727—positive regulation of hexokinase activity; Category No. 10728—positive regulation of hh target transcription factor activity; Category No. 10729—positive regulation of high voltage-gated calcium channel activity; Category No. 10730—positive regulation of high-density lipoprotein particle assembly; Category No. 10731—positive regulation of high-density lipoprotein particle clearance; Category No. 10732—positive regulation of hindgut contraction; Category No. 10733—positive regulation of hippo signaling; Category No. 10734—positive regulation of histamine secretion by mast cell; Category No. 10735—positive regulation of histone acetylation; Category No. 10736—positive regulation of histone deacetylase activity; Category No. 10737—positive regulation of histone deacetylation; Category No. 10738—positive regulation of histone deubiquitination; Category No. 10739—positive regulation of histone H2B ubiquitination; Category No. 10740—positive regulation of histone H3-K14 acetylation; Category No. 10741—positive regulation of histone H3-K27 acetylation; Category No. 10742—positive regulation of histone H3-K27 methylation; Category No. 10743—positive regulation of histone H3-K27 trimethylation; Category No. 10744—positive regulation of histone H3-K36 methylation; Category No. 10745—positive regulation of histone H3-K4 methylation; Category No. 10746—positive regulation of histone H3-K79 methylation; Category No. 10747—positive regulation of histone H3-K9 acetylation; Category No. 10748—positive regulation of histone H3-K9 dimethylation; Category No. 10749—positive regulation of histone H3-K9 methylation; Category No. 10750—positive regulation of histone H3-K9 trimethylation; Category No. 10751—positive regulation of histone H4 acetylation; Category No. 10752—positive regulation of histone H4-K16 acetylation; Category No. 10753—positive regulation of histone H4-K20 methylation; Category No. 10754—positive regulation of histone methylation; Category No. 10755—positive regulation of histone modification; Category No. 10756—positive regulation of histone phosphorylation; Category No. 10757—positive regulation of histone ubiquitination; Category No. 10758—positive regulation of homocysteine metabolic process; Category No. 10759—positive regulation of homophilic cell adhesion; Category No. 10760—positive regulation of homotypic cell-cell adhesion; Category No. 10761—positive regulation of hormone biosynthetic process; Category No. 10762—positive regulation of hormone secretion; Category No. 10763—positive regulation of humoral immune response; Category No. 10764—positive regulation of humoral immune response mediated by circulating immunoglobulin; Category No. 10765—positive regulation of hyaluranon cable assembly; Category No. 10766—positive regulation of hyaluronan biosynthetic process; Category No. 10767—positive regulation of hydrogen peroxide biosynthetic process; Category No. 10768—positive regulation of hydrogen peroxide catabolic process; Category No. 10769—positive regulation of hydrogen peroxide-mediated programmed cell death; Category No. 10770—positive regulation of hydrogen:potassium-exchanging ATPase activity; Category No. 10771—positive regulation of hydrolase activity; Category No. 10772—positive regulation of hypersensitivity; Category No. 10773—positive regulation of hypoxia-inducible factor-1alpha signaling pathway; Category No. 10774—positive regulation of icosanoid secretion; Category No. 10775—positive regulation of 1-kappaB kinase NF-kappaB signaling; Category No. 10776—positive regulation of I-kappaB phosphorylation; Category No. 10777—positive regulation of immature T cell proliferation; Category No. 10778—positive regulation of immature T cell proliferation in thymus; Category No. 10779—positive regulation of immune complex clearance by monocytes and macrophages; Category No. 10780—positive regulation of immune response; Category No. 10781—positive regulation of immune response to tumor cell; Category No. 10782—positive regulation of immune system process; Category No. 10783—positive regulation of immunoglobulin biosynthetic process; Category No. 10784—positive regulation of immunoglobulin mediated immune response; Category No. 10785—positive regulation of immunoglobulin production; Category No. 10786—positive regulation of immunoglobulin production in mucosal tissue; Category No. 10787—positive regulation of immunoglobulin secretion; Category No. 10788—positive regulation of immunological synapse formation; Category No. 10789—positive regulation of inclusion body assembly; Category No. 10790—positive regulation of inflammatory response; Category No. 10791—positive regulation of inflammatory response to antigenic stimulus; Category No. 10792—positive regulation of inhibitory G-protein coupled receptor phosphorylation; Category No. 10793—positive regulation of inhibitory postsynaptic potential; Category No. 10794—positive regulation of innate immune response; Category No. 10795—positive regulation of inner ear receptor cell differentiation; Category No. 10796—positive regulation of inositol 1,4,5-trisphosphate-sensitive calcium-release channel activity; Category No. 10797—positive regulation of inositol phosphate biosynthetic process; Category No. 10798—positive regulation of inositol trisphosphate biosynthetic process; Category No. 10799—positive regulation of inositol-polyphosphate 5-phosphatase activity; Category No. 10800—positive regulation of insulin receptor signaling pathway; Category No. 10801—positive regulation of insulin secretion; Category No. 10802—positive regulation of insulin secretion involved in cellular response to glucose stimulus; Category No. 10803—positive regulation of insulin-like growth factor receptor signaling pathway; Category No. 10804—positive regulation of integrin activation; Category No. 10805—positive regulation of integrin biosynthetic process; Category No. 10806—positive regulation of integrin-mediated signaling pathway; Category No. 10807—positive regulation of interferon-alpha biosynthetic process; Category No. 10808—positive regulation of interferon-alpha production; Category No. 10809—positive regulation of interferon-alpha secretion; Category No. 10810—positive regulation of interferon-beta biosynthetic process; Category No. 10811—positive regulation of interferon-beta production; Category No. 10812—positive regulation of interferon-beta secretion; Category No. 10813—positive regulation of interferon-gamma biosynthetic process; Category No. 10814—positive regulation of interferon-gamma production; Category No. 10815—positive regulation of interferon-gamma secretion; Category No. 10816—positive regulation of interferon-gamma-mediated signaling pathway; Category No. 10817—positive regulation of interleukin-1 alpha biosynthetic process; Category No. 10818—positive regulation of interleukin-1 alpha production; Category No. 10819—positive regulation of interleukin-1 alpha secretion; Category No. 10820—positive regulation of interleukin-1 beta biosynthetic process; Category No. 10821—positive regulation of interleukin-1 beta production; Category No. 10822—positive regulation of interleukin-1 beta secretion; Category No. 10823—positive regulation of interleukin-1 production; Category No. 10824—positive regulation of interleukin-1 secretion; Category No. 10825—positive regulation of interleukin-10 biosynthetic process; Category No. 10826—positive regulation of interleukin-10 production; Category No. 10827—positive regulation of interleukin-10 secretion; Category No. 10828—positive regulation of interleukin-12 biosynthetic process; Category No. 10829—positive regulation of interleukin-12 production; Category No. 10830—positive regulation of interleukin-12 secretion; Category No. 10831—positive regulation of interleukin-13 biosynthetic process; Category No. 10832—positive regulation of interleukin-13 production; Category No. 10833—positive regulation of interleukin-13 secretion; Category No. 10834—positive regulation of interleukin-15 production; Category No. 10835—positive regulation of interleukin-17 production; Category No. 10836—positive regulation of interleukin-17-mediated signaling pathway; Category No. 10837—positive regulation of interleukin-18 production; Category No. 10838—positive regulation of interleukin-18-mediated signaling pathway; Category No. 10839—positive regulation of interleukin-2 biosynthetic process; Category No. 10840—positive regulation of interleukin-2 production; Category No. 10841—positive regulation of interleukin-2 secretion; Category No. 10842—positive regulation of interleukin-23 production; Category No. 10843—positive regulation of interleukin-3 biosynthetic process; Category No. 10844—positive regulation of interleukin-4 biosynthetic process; Category No. 10845—positive regulation of interleukin-4 production; Category No. 10846—positive regulation of interleukin-4-dependent isotype switching to IgE isotypes; Category No. 10847—positive regulation of interleukin-5 biosynthetic process; Category No. 10848—positive regulation of interleukin-5 production; Category No. 10849—positive regulation of interleukin-5 secretion; Category No. 10850—positive regulation of interleukin-6 biosynthetic process; Category No. 10851—positive regulation of interleukin-6 production; Category No. 10852—positive regulation of interleukin-6 secretion; Category No. 10853—positive regulation of interleukin-6-mediated signaling pathway; Category No. 10854—positive regulation of interleukin-8 biosynthetic process; Category No. 10855—positive regulation of interleukin-8 production; Category No. 10856—positive regulation of interleukin-8 secretion; Category No. 10857—positive regulation of intermediate filament depolymerization; Category No. 10858—positive regulation of intestinal epithelial structure maintenance; Category No. 10859—positive regulation of intracellular cholesterol transport; Category No. 10860—positive regulation of intracellular estrogen receptor signaling pathway; Category No. 10861—positive regulation of intracellular protein transport; Category No. 10862—positive regulation of intracellular signal transduction; Category No. 10863—positive regulation of intracellular transport; Category No. 10864—positive regulation of intrinsic apoptotic signaling pathway; Category No. 10865—positive regulation of intrinsic apoptotic signaling pathway by p53 class mediator; Category No. 10866—positive regulation of intrinsic apoptotic signaling pathway in response to DNA damage; Category No. 10867—positive regulation of intrinsic apoptotic signaling pathway in response to DNA damage by p53 class mediator; Category No. 10868—positive regulation of ion transmembrane transport; Category No. 10869—positive regulation of ion transmembrane transporter activity; Category No. 10870—positive regulation of ion transport; Category No. 10871—positive regulation of IP-10 production; Category No. 10872—positive regulation of IRE1-mediated unfolded protein response; Category No. 10873— positive regulation of isotype switching; Category No. 10874—positive regulation of isotype switching to IgA isotypes; Category No. 10875—positive regulation of isotype switching to IgE isotypes; Category No. 10876—positive regulation of isotype switching to IgG isotypes; Category No. 10877—positive regulation of JAK-STAT cascade; Category No. 10878—positive regulation of JNK cascade; Category No. 10879—positive regulation of JUN kinase activity; Category No. 10880—positive regulation of keratinocyte apoptotic process; Category No. 10881—positive regulation of keratinocyte differentiation; Category No. 10882—positive regulation of keratinocyte migration; Category No. 10883—positive regulation of keratinocyte proliferation; Category No. 10884—positive regulation of kidney development; Category No. 10885—positive regulation of kidney smooth muscle cell differentiation; Category No. 10886—positive regulation of killing of cells of other organism; Category No. 10887—positive regulation of kinase activity; Category No. 10888—positive regulation of lactation; Category No. 10889—positive regulation of lamellipodium assembly; Category No. 10890—positive regulation of lamellipodium morphogenesis; Category No. 10891—positive regulation of lamellipodium organization; Category No. 10892—positive regulation of large conductance calcium-activated potassium channel activity; Category No. 10893—positive regulation of late endosome to lysosome transport; Category No. 10894—positive regulation of lateral motor column neuron migration; Category No. 10895—positive regulation of L-dopa biosynthetic process; Category No. 10896—positive regulation of L-dopa decarboxylase activity; Category No. 10897—positive regulation of lens epithelial cell proliferation; Category No. 10898—positive regulation of lens fiber cell differentiation; Category No. 10899—positive regulation of leukocyte activation; Category No. 10900—positive regulation of leukocyte apoptotic process; Category No. 10901—positive regulation of leukocyte cell-cell adhesion; Category No. 10902—positive regulation of leukocyte chemotaxis; Category No. 10903—positive regulation of leukocyte mediated cytotoxicity; Category No. 10904—positive regulation of leukocyte migration; Category No. 10905—positive regulation of leukocyte tethering or rolling; Category No. 10906—positive regulation of leukotriene production involved in inflammatory response; Category No. 10907—positive regulation of ligand-dependent nuclear receptor transcription coactivator activity; Category No. 10908—positive regulation of ligase activity; Category No. 10909—positive regulation of lipase activity; Category No. 10910—positive regulation of lipid biosynthetic process; Category No. 10911—positive regulation of lipid catabolic process; Category No. 10912—positive regulation of lipid kinase activity; Category No. 10913—positive regulation of lipid storage; Category No. 10914—positive regulation of lipid transport; Category No. 10915—positive regulation of lipid transport across blood brain barrier; Category No. 10916—positive regulation of lipophagy; Category No. 10917—positive regulation of lipopolysaccharide-mediated signaling pathway; Category No. 10918—positive regulation of lipoprotein lipase activity; Category No. 10919—positive regulation of lipoprotein metabolic process; Category No. 10920—positive regulation of locomotion; Category No. 10921—positive regulation of long term synaptic depression; Category No. 10922—positive regulation of long-term neuronal synaptic plasticity; Category No. 10923—positive regulation of long-term synaptic potentiation; Category No. 10924—positive regulation of low-density lipoprotein particle receptor biosynthetic process; Category No. 10925—positive regulation of low-density lipoprotein particle receptor catabolic process; Category No. 10926—positive regulation of lung ciliated cell differentiation; Category No. 10927—positive regulation of lung goblet cell differentiation; Category No. 10928—positive regulation of luteinizing hormone secretion; Category No. 10929—positive regulation of lyase activity; Category No. 10930—positive regulation of lymphangiogenesis; Category No. 10931—positive regulation of lymphocyte activation; Category No. 10932—positive regulation of lymphocyte apoptotic process; Category No. 10933—positive regulation of lymphocyte differentiation; Category No. 10934—positive regulation of lymphocyte proliferation; Category No. 10935—positive regulation of lymphotoxin A biosynthetic process; Category No. 10936—positive regulation of Lys63-specific deubiquitinase activity; Category No. 10937—positive regulation of lysosomal membrane permeability; Category No. 10938—positive regulation of macroautophagy; Category No. 10939—positive regulation of macromolecule biosynthetic process; Category No. 10940—positive regulation of macrophage activation; Category No. 10941—positive regulation of macrophage apoptotic process; Category No. 10942—positive regulation of macrophage chemotaxis; Category No. 10943—positive regulation of macrophage colony-stimulating factor production; Category No. 10944—positive regulation of macrophage colony-stimulating factor signaling pathway; Category No. 10945—positive regulation of macrophage cytokine production; Category No. 10946—positive regulation of macrophage derived foam cell differentiation; Category No. 10947—positive regulation of macrophage differentiation; Category No. 10948—positive regulation of macrophage fusion; Category No. 10949—positive regulation of macrophage tolerance induction; Category No. 10950—positive regulation of maintenance of mitotic sister chromatid cohesion; Category No. 10951—positive regulation of male germ cell proliferation; Category No. 10952—positive regulation of male gonad development; Category No. 10953—positive regulation of mammary gland epithelial cell proliferation; Category No. 10954—positive regulation of MAP kinase activity; Category No. 10955—positive regulation of MAPK cascade; Category No. 10956—positive regulation of MAPKKK cascade by fibroblast growth factor receptor signaling pathway; Category No. 10957—positive regulation of mast cell activation; Category No. 10958—positive regulation of mast cell activation by Fc-epsilon receptor signaling pathway; Category No. 10959—positive regulation of mast cell chemotaxis; Category No. 10960—positive regulation of mast cell cytokine production; Category No. 10961—positive regulation of mast cell degranulation; Category No. 10962—positive regulation of mast cell differentiation; Category No. 10963—positive regulation of mast cell proliferation; Category No. 10964—positive regulation of maternal process involved in parturition; Category No. 10965—positive regulation of matrix metallopeptidase secretion; Category No. 10966—positive regulation of MDA-5 signaling pathway; Category No. 10967—positive regulation of mediator complex assembly; Category No. 10968—positive regulation of megakaryocyte differentiation; Category No. 10969—positive regulation of meiosis I; Category No. 10970—positive regulation of meiotic cell cycle; Category No. 10971—positive regulation of meiotic nuclear division; Category No. 10972—positive regulation of melanin biosynthetic process; Category No. 10973—positive regulation of melanocyte differentiation; Category No. 10974—positive regulation of melanosome transport; Category No. 10975—positive regulation of membrane depolarization during cardiac muscle cell action potential; Category No. 10976—positive regulation of membrane hyperpolarization; Category No. 10977—positive regulation of membrane potential; Category No. 10978—positive regulation of membrane protein ectodomain proteolysis; Category No. 10979—positive regulation of membrane tubulation; Category No. 10980—positive regulation of memory T cell activation; Category No. 10981—positive regulation of memory T cell differentiation; Category No. 10982—positive regulation of mesenchymal cell apoptotic process; Category No. 10983—positive regulation of mesenchymal cell proliferation; Category No. 10984—positive regulation of mesenchymal cell proliferation involved in ureter development; Category No. 10985—positive regulation of mesenchymal stem cell differentiation; Category No. 10986—positive regulation of mesenchymal stem cell proliferation; Category No. 10987—positive regulation of mesenchymal to epithelial transition involved in metanephros morphogenesis; Category No. 10988—positive regulation of mesoderm development; Category No. 10989—positive regulation of mesodermal cell fate specification; Category No. 10990—positive regulation of metabolic process; Category No. 10991—positive regulation of metalloenzyme activity; Category No. 10992—positive regulation of metanephric cap mesenchymal cell proliferation; Category No. 10993—positive regulation of metanephric DCT cell differentiation; Category No. 10994—positive regulation of metanephric glomerular visceral epithelial cell development; Category No. 10995—positive regulation of metanephric glomerulus development; Category No. 10996—positive regulation of metanephric mesenchymal cell migration; Category No. 10997—positive regulation of metanephric mesenchymal cell migration by platelet-derived growth factor receptor-beta signaling pathway; Category No. 10998—positive regulation of metanephric ureteric bud development; Category No. 10999—positive regulation of MHC class I biosynthetic process; Category No. 11000—positive regulation of MHC class II biosynthetic process; Category No. 11001—positive regulation of microglial cell activation; Category No. 11002—positive regulation of microglial cell mediated cytotoxicity; Category No. 11003—positive regulation of microglial cell migration; Category No. 11004—positive regulation of microtubule binding; Category No. 11005—positive regulation of microtubule depolymerization; Category No. 11006—positive regulation of microtubule motor activity; Category No. 11007—positive regulation of microtubule plus-end binding; Category No. 11008—positive regulation of microtubule polymerization; Category No. 11009—positive regulation of miRNA catabolic process; Category No. 11010—positive regulation of miRNA metabolic process; Category No. 11011—positive regulation of mismatch repair; Category No. 11012—positive regulation of mitochondrial calcium ion concentration; Category No. 11013—positive regulation of mitochondrial depolarization; Category No. 11014—positive regulation of mitochondrial DNA metabolic process; Category No. 11015—positive regulation of mitochondrial DNA replication; Category No. 11016—positive regulation of mitochondrial electron transport; Category No. 11017—positive regulation of mitochondrial fission; Category No. 11018—positive regulation of mitochondrial fusion; Category No. 11019—positive regulation of mitochondrial membrane permeability; Category No. 11020—positive regulation of mitochondrial membrane permeability involved in apoptotic process; Category No. 11021—positive regulation of mitochondrial membrane potential; Category No. 11022—positive regulation of mitochondrial outer membrane permeabilization involved in apoptotic signaling pathway; Category No. 11023—positive regulation of mitochondrial RNA catabolic process; Category No. 11024—positive regulation of mitochondrial translation; Category No. 11025—positive regulation of mitochondrion organization; Category No. 11026—positive regulation of mitophagy; Category No. 11027—positive regulation of mitotic cell cycle; Category No. 11028—positive regulation of mitotic cell cycle phase transition; Category No. 11029—positive regulation of mitotic cell cycle spindle assembly checkpoint; Category No. 11030—positive regulation of mitotic centrosome separation; Category No. 11031—positive regulation of mitotic cytokinetic process; Category No. 11032—positive regulation of mitotic metaphase anaphase transition; Category No. 11033—positive regulation of mitotic nuclear division; Category No. 11034—positive regulation of mitotic sister chromatid separation; Category No. 11035—positive regulation of monocyte aggregation; Category No. 11036—positive regulation of monocyte chemotactic protein-1 production; Category No. 11037—positive regulation of monocyte chemotaxis; Category No. 11038—positive regulation of monocyte differentiation; Category No. 11039—positive regulation of monocyte extravasation; Category No. 11040—positive regulation of mononuclear cell migration; Category No. 11041—positive regulation of mononuclear cell proliferation; Category No. 11042—positive regulation of monooxygenase activity; Category No. 11043—positive regulation of monophenol monooxygenase activity; Category No. 11044—positive regulation of mRNA 3'-end processing; Category No. 11045—positive regulation of mRNA 3'-UTR binding; Category No. 11046—positive regulation of mRNA catabolic process; Category No. 11047—positive regulation of mRNA modification; Category No. 11048—positive regulation of mRNA polyadenylation; Category No. 11049—positive regulation of mRNA splicing; Category No. 11050—positive regulation of mucus secretion; Category No. 11051—positive regulation of multicellular organism growth; Category No. 11052—positive regulation of muscle atrophy; Category No. 11053—positive regulation of muscle cell differentiation; Category No. 11054—positive regulation of muscle tissue development; Category No. 11055—positive regulation of myelination; Category No. 11056—positive regulation of myeloid cell apoptotic process; Category No. 11057—positive regulation of myeloid cell differentiation; Category No. 11058—positive regulation of myeloid dendritic cell activation; Category No. 11059—positive regulation of myeloid dendritic cell chemotaxis; Category No. 11060—positive regulation of myeloid leukocyte cytokine production involved in immune response; Category No. 11061—positive regulation of myeloid leukocyte differentiation; Category No. 11062—positive regulation of myoblast differentiation; Category No. 11063—positive regulation of myoblast fusion; Category No. 11064—positive regulation of myoblast proliferation; Category No. 11065—positive regulation of myofibroblast contraction; Category No. 11066—positive regulation of myosin light chain kinase activity; Category No. 11067—positive regulation of myosin-light-chain-phosphatase activity; Category No. 11068—positive regulation of myotome development; Category No. 11069—positive regulation of myotube differentiation; Category No. 11070—positive regulation of NAD(P)H oxidase activity; Category No. 11071—positive regulation of NAD+ ADP-ribosyltransferase activity; Category No. 11072—positive regulation of natural killer cell activation; Category No. 11073—positive regulation of natural killer cell chemotaxis; Category No. 11074—positive regulation of natural killer cell cytokine production; Category No. 11075—positive regulation of natural killer cell degranulation; Category No. 11076—positive regulation of natural killer cell differentiation; Category No. 11077—positive regulation of natural killer cell mediated cytotoxicity; Category No. 11078—positive regulation of natural killer cell mediated cytotoxicity directed against tumor cell target; Category No. 11079—positive regulation of natural killer cell mediated immunity; Category No. 11080—positive regulation of natural killer cell proliferation; Category No. 11081—positive regulation of necroptotic process; Category No. 11082—positive regulation of necrotic cell death; Category No. 11083—positive regulation of nephron tubule epithelial cell differentiation; Category No. 11084—positive regulation of neural precursor cell proliferation; Category No. 11085—positive regulation of neuroblast proliferation; Category No. 11086—positive regulation of neurofibrillary tangle assembly; Category No. 11087—positive regulation of neurogenesis; Category No. 11088—positive regulation of neuromuscular synaptic transmission; Category No. 11089—positive regulation of neuron apoptotic process; Category No. 11090—positive regulation of neuron death; Category No. 11091—positive regulation of neuron differentiation; Category No. 11092—positive regulation of neuron maturation; Category No. 11093—positive regulation of neuron migration; Category No. 11094—positive regulation of neuron projection development; Category No. 11095—positive regulation of neuron projection regeneration; Category No. 11096—positive regulation of neuronal action potential; Category No. 11097—positive regulation of neurotransmitter secretion; Category No. 11098—positive regulation of neurotransmitter uptake; Category No. 11099—positive regulation of neurotrophin production; Category No. 11100—positive regulation of neurotrophin TRK receptor signaling pathway; Category No. 11101—positive regulation of neutrophil apoptotic process; Category No. 11102—positive regulation of neutrophil chemotaxis; Category No. 11103—positive regulation of neutrophil degranulation; Category No. 11104—positive regulation of neutrophil differentiation; Category No. 11105—positive regulation of neutrophil extravasation; Category No. 11106—positive regulation of neutrophil mediated killing of gram-negative bacterium; Category No. 11107—positive regulation of NFAT protein import into nucleus; Category No. 11108—positive regulation of NF-kappaB import into nucleus; Category No. 11109—positive regulation of NF-kappaB transcription factor activity; Category No. 11110—positive regulation of NIK NF-kappaB signaling; Category No. 11111—positive regulation of nitric oxide biosynthetic process; Category No. 11112—positive regulation of nitric oxide mediated signal transduction; Category No. 11113—positive regulation of nitric-oxide synthase activity; Category No. 11114—positive regulation of nitric-oxide synthase biosynthetic process; Category No. 11115—positive regulation of NK T cell activation; Category No. 11116—positive regulation of NK T cell differentiation; Category No. 11117—positive regulation of NK T cell proliferation; Category No. 11118—positive regulation of NLRP3 inflammasome complex assembly; Category No. 11119—positive regulation of nodal signaling pathway involved in determination of lateral mesoderm left right asymmetry; Category No. 11120—positive regulation of non-canonical Wnt signaling pathway; Category No. 11121—positive regulation of non-canonical Wnt signaling pathway via JNK cascade; Category No. 11122—positive regulation of non-membrane spanning protein tyrosine kinase activity; Category No. 11123—positive regulation of nonmotile primary cilium assembly; Category No. 11124—positive regulation of norepinephrine secretion; Category No. 11125—positive regulation of Notch signaling pathway; Category No. 11126—positive regulation of Notch signaling pathway involved in heart induction; Category No. 11127—positive regulation of N-terminal peptidyl-lysine acetylation; Category No. 11128—positive regulation of nuclear cell cycle DNA replication; Category No. 11129—positive regulation of nuclear-transcribed mRNA catabolic process; Category No. 11130—positive regulation of nuclear-transcribed mRNA poly(A) tail shortening; Category No. 11131—positive regulation of nuclease activity; Category No. 11132—positive regulation of nucleocytoplasmic transport; Category No. 11133—positive regulation of nucleoside transport; Category No. 11134—positive regulation of nucleotide-binding oligomerization domain containing 1 signaling pathway; Category No. 11135—positive regulation of nucleotide-binding oligomerization domain containing 2 signaling pathway; Category No. 11136—positive regulation of odontogenesis; Category No. 11137—positive regulation of odontogenesis of dentin-containing tooth; Category No. 11138—positive regulation of oligodendrocyte differentiation; Category No. 11139—positive regulation of oligodendrocyte progenitor proliferation; Category No. 11140—positive regulation of oocyte development; Category No. 11141—positive regulation of oocyte maturation; Category No. 11142—positive regulation of optic nerve formation; Category No. 11143—positive regulation of organ growth; Category No. 11144—positive regulation of organelle assembly; Category No. 11145—positive regulation of organelle organization; Category No. 11146—positive regulation of ossification; Category No. 11147—positive regulation of osteoblast differentiation; Category No. 11148—positive regulation of osteoblast proliferation; Category No. 11149—positive regulation of osteoclast development; Category No. 11150—positive regulation of osteoclast differentiation; Category No. 11151—positive regulation of osteoclast proliferation; Category No. 11152—positive regulation of otic vesicle morphogenesis; Category No. 11153—positive regulation of ovarian follicle development; Category No. 11154—positive regulation of ovulation; Category No. 11155—positive regulation of oxidative phosphorylation; Category No. 11156—positive regulation of oxidative phosphorylation uncoupler activity; Category No. 11157—positive regulation of oxidative stress-induced cell death; Category No. 11158—positive regulation of oxidative stress-induced intrinsic apoptotic signaling pathway; Category No. 11159—positive regulation of oxidative stress-induced neuron death; Category No. 11160—positive regulation of oxidative stress-induced neuron intrinsic apoptotic signaling pathway; Category No. 11161—positive regulation of oxidoreductase activity; Category No. 11162—positive regulation of oxygen metabolic process; Category No. 11163—positive regulation of p38MAPK cascade; Category No. 11164—positive regulation of pancreatic juice secretion; Category No. 11165—positive regulation of pancreatic stellate cell proliferation; Category No. 11166—positive regulation of pancreatic trypsinogen secretion; Category No. 11167—positive regulation of pathway-restricted SMAD protein phosphorylation; Category No. 11168—positive regulation of penile erection; Category No. 11169—positive regulation of peptidase activity; Category No. 11170—positive regulation of peptide hormone secretion; Category No. 11171—positive regulation of peptide secretion; Category No. 11172—positive regulation of peptidyl-cysteine S-nitrosylation; Category No. 11173—positive regulation of peptidyl-serine dephosphorylation; Category No. 11174— positive regulation of peptidyl-serine phosphorylation; Category No. 11175—positive regulation of peptidyl-serine phosphorylation of STAT protein; Category No. 11176—positive regulation of peptidyl-threonine phosphorylation; Category No. 11177—positive regulation of peptidyl-tyrosine autophosphorylation; Category No. 11178—positive regulation of peptidyl-tyrosine phosphorylation; Category No. 11179—positive regulation of peripheral T cell tolerance induction; Category No. 11180—positive regulation of PERK-mediated unfolded protein response; Category No. 11181—positive regulation of peroxisome proliferator activated receptor signaling pathway; Category No. 11182—positive regulation of phagocytosis; Category No. 11183—positive regulation of phosphatase activity; Category No. 11184—positive regulation of phosphate transmembrane transport; Category No. 11185—positive regulation of phosphatidylcholine biosynthetic process; Category No. 11186—positive regulation of phosphatidylinositol 3-kinase activity; Category No. 11187—positive regulation of phosphatidylinositol 3-kinase signaling; Category No. 11188—positive regulation of phosphatidylinositol biosynthetic process; Category No. 11189—positive regulation of phospholipase A2 activity; Category No. 11190—positive regulation of phospholipase activity; Category No. 11191—positive regulation of phospholipase C activity; Category No. 11192—positive regulation of phospholipase C-activating G-protein coupled receptor signaling pathway; Category No. 11193—positive regulation of phospholipid biosynthetic process; Category No. 11194—positive regulation of phospholipid biosynthetic process by positive regulation of transcription from RNA polymerase II promoter; Category No. 11195—positive regulation of phospholipid catabolic process; Category No. 11196—positive regulation of phospholipid efflux; Category No. 11197—positive regulation of phospholipid scramblase activity; Category No. 11198—positive regulation of phospholipid translocation; Category No. 11199—positive regulation of phospholipid transport; Category No. 11200—positive regulation of phosphoprotein phosphatase activity; Category No. 11201—positive regulation of phosphorylation; Category No. 11202—positive regulation of phosphorylation of RNA polymerase II C-terminal domain; Category No. 11203—positive regulation of phosphorylation of RNA polymerase II C-terminal domain serine 2 residues; Category No. 11204—positive regulation of photoreceptor cell differentiation; Category No. 11205—positive regulation of pigment cell differentiation; Category No. 11206—positive regulation of pinocytosis; Category No. 11207—positive regulation of plasma cell differentiation; Category No. 11208—positive regulation of plasminogen activation; Category No. 11209—positive regulation of platelet activation; Category No. 11210—positive regulation of platelet aggregation; Category No. 11211—positive regulation of platelet-derived growth factor production; Category No. 11212—positive regulation of platelet-derived growth factor receptor signaling pathway; Category No. 11213—positive regulation of podosome assembly; Category No. 11214—positive regulation of polarized epithelial cell differentiation; Category No. 11215—positive regulation of polyamine transmembrane transport; Category No. 11216—positive regulation of positive chemotaxis; Category No. 11217—positive regulation of postsynaptic membrane organization; Category No. 11218—positive regulation of potassium ion export across plasma membrane; Category No. 11219—positive regulation of potassium ion import; Category No. 11220—positive regulation of potassium ion transmembrane transport; Category No. 11221—positive regulation of potassium ion transmembrane transporter activity; Category No. 11222—positive regulation of potassium ion transport; Category No. 11223—positive regulation of presynaptic membrane organization; Category No. 11224—positive regulation of pri-miRNA transcription from RNA polymerase II promoter; Category No. 11225—positive regulation of progesterone biosynthetic process; Category No. 11226—positive regulation of progesterone secretion; Category No. 11227—positive regulation of programmed cell death; Category No. 11228—positive regulation of prolactin secretion; Category No. 11229—positive regulation of prolactin signaling pathway; Category No. 11230—positive regulation of prostaglandin biosynthetic process; Category No. 11231—positive regulation of prostaglandin secretion; Category No. 11232—positive regulation of prostaglandin secretion involved in immune response; Category No. 11233—positive regulation of prostaglandin-E synthase activity; Category No. 11234—positive regulation of prostaglandin-endoperoxide synthase activity; Category No. 11235—positive regulation of pro-T cell differentiation; Category No. 11236—positive regulation of proteasomal protein catabolic process; Category No. 11237—positive regulation of proteasomal ubiquitin-dependent protein catabolic process; Category No. 11238—positive regulation of proteasomal ubiquitin-dependent protein catabolic process involved in cellular response to hypoxia; Category No. 11239—positive regulation of protein acetylation; Category No. 11240—positive regulation of protein autophosphorylation; Category No. 11241—positive regulation of protein autoubiquitination; Category No. 11242—positive regulation of protein binding; Category No. 11243—positive regulation of protein catabolic process; Category No. 11244—positive regulation of protein catabolic process in the vacuole; Category No. 11245—positive regulation of protein complex assembly; Category No. 11246—positive regulation of protein complex disassembly; Category No. 11247—positive regulation of protein deacetylation; Category No. 11248—positive regulation of protein dephosphorylation; Category No. 11249—positive regulation of protein depolymerization; Category No. 11250—positive regulation of protein exit from endoplasmic reticulum; Category No. 11251—positive regulation of protein export from nucleus; Category No. 11252—positive regulation of protein geranylgeranylation; Category No. 11253—positive regulation of protein glycosylation; Category No. 11254—positive regulation of protein glycosylation in Golgi; Category No. 11255—positive regulation of protein homodimerization activity; Category No. 11256—positive regulation of protein homooligomerization; Category No. 11257—positive regulation of protein import; Category No. 11258—positive regulation of protein import into mitochondrial outer membrane; Category No. 11259—positive regulation of protein import into nucleus; Category No. 11260—positive regulation of protein insertion into mitochondrial membrane involved in apoptotic signaling pathway; Category No. 11261—positive regulation of protein K48-linked ubiquitination; Category No. 11262—positive regulation of protein K63-linked deubiquitination; Category No. 11263—positive regulation of protein K63-linked ubiquitination; Category No. 11264—positive regulation of protein kinase A signaling; Category No. 11265—positive regulation of protein kinase activity; Category No. 11266—positive regulation of protein kinase B signaling; Category No. 11267—positive regulation of protein kinase C activity; Category No. 11268—positive regulation of protein kinase C signaling; Category No. 11269—positive regulation of protein kinase D signaling; Category No. 11270—positive regulation of protein linear polyubiquitination; Category No.

11271—positive regulation of protein lipidation; Category No. 11272—positive regulation of protein localization to actin cortical patch; Category No. 11273—positive regulation of protein localization to cell surface; Category No. 11274—positive regulation of protein localization to early endosome; Category No. 11275—positive regulation of protein localization to nucleus; Category No. 11276—positive regulation of protein localization to plasma membrane; Category No. 11277—positive regulation of protein localization to synapse; Category No. 11278—positive regulation of protein maturation; Category No. 11279—positive regulation of protein metabolic process; Category No. 11280—positive regulation of protein modification process; Category No. 11281—positive regulation of protein monoubiquitination; Category No. 11282—positive regulation of protein oligomerization; Category No. 11283—positive regulation of protein O-linked glycosylation; Category No. 11284—positive regulation of protein phosphatase type 2B activity; Category No. 11285—positive regulation of protein phosphorylation; Category No. 11286—positive regulation of protein polymerization; Category No. 11287—positive regulation of protein polyubiquitination; Category No. 11288—positive regulation of protein processing; Category No. 11289—positive regulation of protein processing in phagocytic vesicle; Category No. 11290—positive regulation of protein secretion; Category No. 11291—positive regulation of protein serine threonine kinase activity; Category No. 11292—positive regulation of protein sumoylation; Category No. 11293—positive regulation of protein targeting to membrane; Category No. 11294—positive regulation of protein targeting to mitochondrion; Category No. 11295—positive regulation of protein transport; Category No. 11296—positive regulation of protein tyrosine kinase activity; Category No. 11297—positive regulation of protein tyrosine phosphatase activity; Category No. 11298—positive regulation of protein ubiquitination; Category No. 11299—positive regulation of protein ubiquitination involved in ubiquitin-dependent protein catabolic process; Category No. 11300—positive regulation of proteolysis; Category No. 11301—positive regulation of proteolysis involved in cellular protein catabolic process; Category No. 11302—positive regulation of pseudopodium assembly; Category No. 11303—positive regulation of pyrroline-5-carboxylate reductase activity; Category No. 11304—positive regulation of Rac protein signal transduction; Category No. 11305—positive regulation of Ras protein signal transduction; Category No. 11306—positive regulation of reactive oxygen species biosynthetic process; Category No. 11307—positive regulation of reactive oxygen species metabolic process; Category No. 11308—positive regulation of receptor activity; Category No. 11309—positive regulation of receptor binding; Category No. 11310—positive regulation of receptor biosynthetic process; Category No. 11311—positive regulation of receptor catabolic process; Category No. 11312—positive regulation of receptor clustering; Category No. 11313—positive regulation of receptor internalization; Category No. 11314—positive regulation of receptor localization to synapse; Category No. 11315—positive regulation of receptor recycling; Category No. 11316—positive regulation of receptor-mediated endocytosis; Category No. 11317—positive regulation of reciprocal meiotic recombination; Category No. 11318—positive regulation of regulated secretory pathway; Category No. 11319—positive regulation of regulatory T cell differentiation; Category No. 11320—positive regulation of relaxation of cardiac muscle; Category No. 11321—positive regulation of relaxation of smooth muscle; Category No. 11322—positive regulation of release of cytochrome c from mitochondria; Category No. 11323—positive regulation of release of sequestered calcium ion into cytosol; Category No. 11324—positive regulation of renal albumin absorption; Category No. 11325—positive regulation of renal sodium excretion; Category No. 11326—positive regulation of renal water transport; Category No. 11327—positive regulation of renin secretion into blood stream; Category No. 11328—positive regulation of respiratory burst; Category No. 11329—positive regulation of respiratory burst involved in inflammatory response; Category No. 11330—positive regulation of response to cytokine stimulus; Category No. 11331—positive regulation of response to DNA damage stimulus; Category No. 11332—positive regulation of response to drug; Category No. 11333—positive regulation of response to food; Category No. 11334—positive regulation of response to interferon-gamma; Category No. 11335—positive regulation of retinal ganglion cell axon guidance; Category No. 11336—positive regulation of retinoic acid receptor signaling pathway; Category No. 11337—positive regulation of retrograde protein transport; Category No. 11338—positive regulation of Rho guanyl-nucleotide exchange factor activity; Category No. 11339—positive regulation of Rho protein signal transduction; Category No. 11340—positive regulation of rhodopsin gene expression; Category No. 11341—positive regulation of RIG-I signaling pathway; Category No. 11342—positive regulation of RNA export from nucleus; Category No. 11343—positive regulation of RNA interference; Category No. 11344—positive regulation of RNA polymerase II transcriptional preinitiation complex assembly; Category No. 11345—positive regulation of RNA splicing; Category No. 11346—positive regulation of rubidium ion transmembrane transporter activity; Category No. 11347—positive regulation of rubidium ion transport; Category No. 11348—positive regulation of ruffle assembly; Category No. 11349—positive regulation of ryanodine-sensitive calcium-release channel activity; Category No. 11350—positive regulation of saliva secretion; Category No. 11351—positive regulation of sarcomere organization; Category No. 11352—positive regulation of satellite cell activation involved in skeletal muscle regeneration; Category No. 11353—positive regulation of Schwann cell chemotaxis; Category No. 11354—positive regulation of Schwann cell differentiation; Category No. 11355—positive regulation of Schwann cell migration; Category No. 11356—positive regulation of Schwann cell proliferation; Category No. 11357—positive regulation of sclerotome development; Category No. 11358—positive regulation of secondary heart field cardioblast proliferation; Category No. 11359—positive regulation of secretion; Category No. 11360—positive regulation of secretion of lysosomal enzymes; Category No. 11361—positive regulation of semaphorin-plexin signaling pathway involved in outflow tract morphogenesis; Category No. 11362—positive regulation of sensory perception of pain; Category No. 11363—positive regulation of sequence-specific DNA binding transcription factor activity; Category No. 11364—positive regulation of sequestering of calcium ion; Category No. 11365—positive regulation of sequestering of triglyceride; Category No. 11366—positive regulation of sequestering of zinc ion; Category No. 11367—positive regulation of serine C-palmitoyltransferase activity; Category No. 11368—positive regulation of serine phosphorylation of STAT3 protein; Category No. 11369—positive regulation of serine-type endopeptidase activity; Category No. 11370—positive regulation of serotonin secretion; Category No. 11371—positive regulation of signal transduction; Category No. 11372— positive regulation of signal transduction by p53 class mediator; Category No. 11373—positive regulation of single stranded viral RNA replication via double stranded DNA intermediate; Category No. 11374—positive regulation of single-stranded telomeric DNA binding; Category No. 11375—positive regulation of sister chromatid cohesion; Category No. 11376—positive regulation of skeletal muscle acetylcholine-gated channel clustering; Category No. 11377—positive regulation of skeletal muscle cell differentiation; Category No. 11378—positive regulation of skeletal muscle cell proliferation; Category No. 11379—positive regulation of skeletal muscle contraction by regulation of release of sequestered calcium ion; Category No. 11380—positive regulation of skeletal muscle fiber development; Category No. 11381—positive regulation of skeletal muscle hypertrophy; Category No. 11382—positive regulation of skeletal muscle tissue development; Category No. 11383—positive regulation of skeletal muscle tissue growth; Category No. 11384—positive regulation of skeletal muscle tissue regeneration; Category No. 11385—positive regulation of SMAD protein import into nucleus; Category No. 11386—positive regulation of small GTPase mediated signal transduction; Category No. 11387—positive regulation of smooth muscle cell apoptotic process; Category No. 11388—positive regulation of smooth muscle cell chemotaxis; Category No. 11389—positive regulation of smooth muscle cell differentiation; Category No. 11390—positive regulation of smooth muscle cell migration; Category No. 11391—positive regulation of smooth muscle cell proliferation; Category No. 11392—positive regulation of smooth muscle contraction; Category No. 11393—positive regulation of smooth muscle contraction involved in micturition; Category No. 11394—positive regulation of smoothened signaling pathway; Category No. 11395—positive regulation of SNARE complex assembly; Category No. 11396—positive regulation of sodium ion export from cell; Category No. 11397—positive regulation of sodium ion transmembrane transport; Category No. 11398—positive regulation of sodium ion transmembrane transporter activity; Category No. 11399—positive regulation of sodium ion transport; Category No. 11400—positive regulation of sodium:potassium-exchanging ATPase activity; Category No. 11401—positive regulation of sodium:proton antiporter activity; Category No. 11402—positive regulation of sodium-dependent phosphate transport; Category No. 11403—positive regulation of somatostatin secretion; Category No. 11404—positive regulation of sperm motility; Category No. 11405—positive regulation of sperm motility involved in capacitation; Category No. 11406—positive regulation of spermidine biosynthetic process; Category No. 11407—positive regulation of sphingolipid mediated signaling pathway; Category No. 11408—positive regulation of sphingomyelin catabolic process; Category No. 11409—positive regulation of spindle checkpoint; Category No. 11410—positive regulation of sprouting angiogenesis; Category No. 11411—positive regulation of STAT protein import into nucleus; Category No. 11412—positive regulation of stem cell differentiation; Category No. 11413—positive regulation of stem cell population maintenance; Category No. 11414—positive regulation of stem cell proliferation; Category No. 11415—positive regulation of steroid hormone biosynthetic process; Category No. 11416—positive regulation of steroid metabolic process; Category No. 11417—positive regulation of store-operated calcium channel activity; Category No. 11418—positive regulation of stress fiber assembly; Category No. 11419—positive regulation of stress-activated MAPK cascade; Category No. 11420—positive regulation of stress-activated protein kinase signaling cascade; Category No. 11421—positive regulation of striated muscle cell differentiation; Category No. 11422—positive regulation of striated muscle contraction; Category No. 11423—positive regulation of striated muscle tissue development; Category No. 11424—positive regulation of substance P secretion; Category No. 11425—positive regulation of substrate adhesion-dependent cell spreading; Category No. 11426—positive regulation of substrate-dependent cell migration; Category No. 11427—positive regulation of succinate dehydrogenase activity; Category No. 11428—positive regulation of SUMO transferase activity; Category No. 11429—positive regulation of superoxide anion generation; Category No. 11430—positive regulation of superoxide dismutase activity; Category No. 11431—positive regulation of synapse assembly; Category No. 11432—positive regulation of synapse maturation; Category No. 11433—positive regulation of synapse structural plasticity; Category No. 11434—positive regulation of synaptic growth at neuromuscular junction; Category No. 11435—positive regulation of synaptic plasticity; Category No. 11436—positive regulation of synaptic transmission; Category No. 11437—positive regulation of synaptic vesicle clustering; Category No. 11438—positive regulation of synaptic vesicle endocytosis; Category No. 11439—positive regulation of synaptic vesicle exocytosis; Category No. 11440—positive regulation of synaptic vesicle priming; Category No. 11441—positive regulation of synaptic vesicle recycling; Category No. 11442—positive regulation of synaptic vesicle uncoating; Category No. 11443—positive regulation of syncytium formation by plasma membrane fusion; Category No. 11444—positive regulation of systemic arterial blood pressure; Category No. 11445—positive regulation of T cell activation; Category No. 11446—positive regulation of T cell activation via T cell receptor contact with antigen bound to MHC molecule on antigen presenting cell; Category No. 11447—positive regulation of T cell anergy; Category No. 11448—positive regulation of T cell apoptotic process; Category No. 11449—positive regulation of T cell chemotaxis; Category No. 11450—positive regulation of T cell costimulation; Category No. 11451—positive regulation of T cell cytokine production; Category No. 11452—positive regulation of T cell differentiation; Category No. 11453—positive regulation of T cell differentiation in thymus; Category No. 11454—positive regulation of T cell extravasation; Category No. 11455—positive regulation of T cell homeostatic proliferation; Category No. 11456—positive regulation of T cell mediated cytotoxicity; Category No. 11457—positive regulation of T cell mediated immune response to tumor cell; Category No. 11458—positive regulation of T cell mediated immunity; Category No. 11459—positive regulation of T cell migration; Category No. 11460—positive regulation of T cell proliferation; Category No. 11461—positive regulation of T cell receptor signaling pathway; Category No. 11462—positive regulation of T cell tolerance induction; Category No. 11463—positive regulation of tau-protein kinase activity; Category No. 11464—positive regulation of t-circle formation; Category No. 11465—positive regulation of telomerase activity; Category No. 11466—positive regulation of telomere capping; Category No. 11467—positive regulation of telomere maintenance; Category No. 11468—positive regulation of telomere maintenance via telomerase; Category No. 11469—positive regulation of telomere maintenance via telomere lengthening; Category No. 11470—positive regulation of telomeric loop disassembly; Category No. 11471—positive regulation of tendon cell differentiation; Category No. 11472—positive regulation of termination of RNA polymerase II transcription; Category No. 11473—positive regulation of testosterone secretion; Category No. 11474—positive regulation of the force of heart contraction; Category No. 11475—positive regulation of the force of heart contraction by chemical signal; Category No. 11476—positive regulation of the force of heart contraction by epinephrine; Category No. 11477—positive regulation of the force of heart contraction by epinephrine-norepinephrine; Category No. 11478—positive regulation of T-helper 1 cell cytokine production; Category No. 11479—positive regulation of T-helper 1 cell differentiation; Category No. 11480—positive regulation of T-helper 1 type immune response; Category No. 11481—positive regulation of T-helper 17 cell differentiation; Category No. 11482—positive regulation of T-helper 17 cell lineage commitment; Category No. 11483—positive regulation of T-helper 17 type immune response; Category No. 11484—positive regulation of T-helper 2 cell activation; Category No. 11485—positive regulation of T-helper 2 cell cytokine production; Category No. 11486—positive regulation of T-helper 2 cell differentiation; Category No. 11487—positive regulation of T-helper cell differentiation; Category No. 11488—positive regulation of thymocyte apoptotic process; Category No. 11489—positive regulation of thymocyte migration; Category No. 11490—positive regulation of thyroid hormone generation; Category No. 11491—positive regulation of tissue remodeling; Category No. 11492—positive regulation of tolerance induction; Category No. 11493—positive regulation of tolerance induction to self antigen; Category No. 11494—positive regulation of toll-like receptor 2 signaling pathway; Category No. 11495—positive regulation of toll-like receptor 3 signaling pathway; Category No. 11496—positive regulation of toll-like receptor 4 signaling pathway; Category No. 11497—positive regulation of toll-like receptor 7 signaling pathway; Category No. 11498—positive regulation of toll-like receptor 9 signaling pathway; Category No. 11499—positive regulation of toll-like receptor signaling pathway; Category No. 11500—positive regulation of tongue muscle cell differentiation; Category No. 11501—positive regulation of tooth mineralization; Category No. 11502—positive regulation of TOR signaling; Category No. 11503—positive regulation of TORC1 signaling; Category No. 11504—positive regulation of TRAIL biosynthetic process; Category No. 11505—positive regulation of TRAIL-activated apoptotic signaling pathway; Category No. 11506—positive regulation of transcription; Category No. 11507—positive regulation of transcription by glucose; Category No. 11508—positive regulation of transcription during meiosis; Category No. 11509—positive regulation of transcription elongation from RNA polymerase II promoter; Category No. 11510—positive regulation of transcription factor import into nucleus; Category No. 11511—positive regulation of transcription from RNA polymerase I promoter; Category No. 11512—positive regulation of transcription from RNA polymerase II promoter; Category No. 11513—positive regulation of transcription from RNA polymerase II promoter by galactose; Category No. 11514—positive regulation of transcription from RNA polymerase II promoter by glucose; Category No. 11515—positive regulation of transcription from RNA polymerase II promoter by pheromones; Category No. 11516—positive regulation of transcription from RNA polymerase II promoter during mitosis; Category No. 11517—positive regulation of transcription from RNA polymerase II promoter in response to acidic pH; Category No. 11518—positive regulation of transcription from RNA polymerase II promoter in response to arsenic-containing substance; Category No. 11519—positive regulation of transcription from RNA polymerase II promoter in response to calcium ion; Category No. 11520—positive regulation of transcription from RNA polymerase II promoter in response to endoplasmic reticulum stress; Category No. 11521—positive regulation of transcription from RNA polymerase II promoter in response to hypoxia; Category No. 11522—positive regulation of transcription from RNA polymerase II promoter in response to oxidative stress; Category No. 11523—positive regulation of transcription from RNA polymerase II promoter in response to stress; Category No. 11524—positive regulation of transcription from RNA polymerase II promoter involved in cellular response to chemical stimulus; Category No. 11525—positive regulation of transcription from RNA polymerase II promoter involved in heart development; Category No. 11526—positive regulation of transcription from RNA polymerase II promoter involved in myocardial precursor cell differentiation; Category No. 11527—positive regulation of transcription from RNA polymerase II promoter involved in norepinephrine biosynthetic process; Category No. 11528—positive regulation of transcription from RNA polymerase II promoter involved in smooth muscle cell differentiation; Category No. 11529—positive regulation of transcription from RNA polymerase II promoter involved in unfolded protein response; Category No. 11530—positive regulation of transcription from RNA polymerase III promoter; Category No. 11531—positive regulation of transcription initiation from RNA polymerase II promoter; Category No. 11532—positive regulation of transcription involved in exit from mitosis; Category No. 11533—positive regulation of transcription involved in G1 S transition of mitotic cell cycle; Category No. 11534—positive regulation of transcription of Notch receptor target; Category No. 11535—positive regulation of transcription of nuclear large rRNA transcript from RNA polymerase I promoter; Category No. 11536—positive regulation of transcription regulatory region DNA binding; Category No. 11537—positive regulation of transcription via serum response element binding; Category No. 11538—positive regulation of transcytosis; Category No. 11539—positive regulation of transferase activity; Category No. 11540—positive regulation of transferrin receptor binding; Category No. 11541—positive regulation of transforming growth factor beta production; Category No. 11542—positive regulation of transforming growth factor beta receptor signaling pathway; Category No. 11543—positive regulation of transforming growth factor beta1 production; Category No. 11544—positive regulation of transforming growth factor beta2 production; Category No. 11545—positive regulation of transforming growth factor beta3 production; Category No. 11546—positive regulation of translation; Category No. 11547—positive regulation of translation in response to endoplasmic reticulum stress; Category No. 11548—positive regulation of translational elongation; Category No. 11549—positive regulation of translational fidelity; Category No. 11550—positive regulation of translational initiation; Category No. 11551—positive regulation of translational initiation by iron; Category No. 11552—positive regulation of translational initiation in response to starvation; Category No. 11553—positive regulation of translational initiation in response to stress; Category No. 11554—positive regulation of translational termination; Category No. 11555—positive regulation of transmission of nerve impulse; Category No. 11556—positive regulation of transport; Category No. 11557—positive regulation of transporter activity; Category No. 11558—positive regulation of triglyceride biosynthetic process; Category No. 11559—positive regulation of triglyceride catabolic process; Category No. 11560—positive regulation of triglyceride lipase activity; Category No. 11561—positive regulation of trophectodermal cell proliferation; Category No. 11562—positive regulation of trophoblast cell migration; Category No. 11563—positive regulation of tubulin deacetylation; Category No. 11564—positive regulation of tumor necrosis factor (ligand) superfamily member 11 production; Category No. 11565—positive regulation of tumor necrosis factor biosynthetic process; Category No. 11566—positive regulation of tumor necrosis factor production; Category No. 11567—positive regulation of tumor necrosis factor secretion; Category No. 11568—positive regulation of tumor necrosis factor-mediated signaling pathway; Category No. 11569—positive regulation of type 2 immune response; Category No. 11570—positive regulation of type B pancreatic cell apoptotic process; Category No. 11571—positive regulation of type B pancreatic cell development; Category No. 11572—positive regulation of type I hypersensitivity; Category No. 11573—positive regulation of type I interferon production; Category No. 11574—positive regulation of type I interferon-mediated signaling pathway; Category No. 11575—positive regulation of type IIa hypersensitivity; Category No. 11576—positive regulation of type III hypersensitivity; Category No. 11577—positive regulation of type III interferon production; Category No. 11578—positive regulation of type IV hypersensitivity; Category No. 11579—positive regulation of tyrosine 3-monooxygenase activity; Category No. 11580—positive regulation of tyrosine phosphorylation of STAT protein; Category No. 11581—positive regulation of tyrosine phosphorylation of Stat1 protein; Category No. 11582—positive regulation of tyrosine phosphorylation of Stat3 protein; Category No. 11583—positive regulation of tyrosine phosphorylation of Stat4 protein; Category No. 11584—positive regulation of tyrosine phosphorylation of Stat5 protein; Category No. 11585—positive regulation of tyrosine phosphorylation of Stat6 protein; Category No. 11586—positive regulation of ubiquitin-dependent endocytosis; Category No. 11587—positive regulation of ubiquitin-protein ligase activity involved in regulation of mitotic cell cycle transition; Category No. 11588—positive regulation of ubiquitin-protein transferase activity; Category No. 11589—positive regulation of ureter smooth muscle cell differentiation; Category No. 11590—positive regulation of ureteric bud formation; Category No. 11591—positive regulation of urine volume; Category No. 11592—positive regulation of urothelial cell proliferation; Category No. 11593—positive regulation of uterine smooth muscle contraction; Category No. 11594—positive regulation of vacuole organization; Category No. 11595—positive regulation of vascular endothelial growth factor production; Category No. 11596—positive regulation of vascular endothelial growth factor receptor signaling pathway; Category No. 11597—positive regulation of vascular endothelial growth factor signaling pathway; Category No. 11598—positive regulation of vascular permeability; Category No. 11599—positive regulation of vascular wound healing; Category No. 11600—positive regulation of vasculogenesis; Category No. 11601—positive regulation of vasoconstriction; Category No. 11602—positive regulation of vasodilation; Category No. 11603—positive regulation of very-low-density lipoprotein particle remodeling; Category No. 11604—positive regulation of vesicle fusion; Category No. 11605—positive regulation of viral budding via host ESCRT complex; Category No. 11606—positive regulation of viral entry into host cell; Category No. 11607—positive regulation of viral genome replication; Category No. 11608—positive regulation of viral life cycle; Category No. 11609—positive regulation of viral process; Category No. 11610—positive regulation of viral release from host cell; Category No. 11611—positive regulation of viral transcription; Category No. 11612—positive regulation of vitamin D 24-hydroxylase activity; Category No. 11613—positive regulation of vitamin D biosynthetic process; Category No. 11614—positive regulation of vitamin D receptor signaling pathway; Category No. 11615—positive regulation of voltage-gated calcium channel activity; Category No. 11616—positive regulation of voltage-gated chloride channel activity; Category No. 11617—positive regulation of voltage-gated potassium channel activity involved in ventricular cardiac muscle cell action potential repolarization; Category No. 11618—positive regulation of white fat cell proliferation; Category No. 11619—positive regulation of Wnt protein secretion; Category No. 11620—positive regulation of Wnt signaling pathway; Category No. 11621—positive regulation of Wnt signaling pathway by BMP signaling pathway; Category No. 11622—positive regulation of Wnt signaling pathway involved in dorsal ventral axis specification; Category No. 11623—positive regulation of wound healing; Category No. 11624—positive regulation of xenophagy; Category No. 11625—positive T cell selection; Category No. 11626—positive thymic T cell selection; Category No. 11627—positive transcription elongation factor complex b; Category No. 11628—post-anal tail morphogenesis; Category No. 11629—post-chaperonin tubulin folding pathway; Category No. 11630—post-embryonic body morphogenesis; Category No. 11631—post-embryonic camera-type eye development; Category No. 11632—post-embryonic camera-type eye morphogenesis; Category No. 11633—post-embryonic cardiac muscle cell growth involved in heart morphogenesis; Category No. 11634—post-embryonic development; Category No. 11635—post-embryonic digestive tract morphogenesis; Category No. 11636—post-embryonic eye morphogenesis; Category No. 11637—post-embryonic forelimb morphogenesis; Category No. 11638—post-embryonic hemopoiesis; Category No. 11639—post-embryonic organ development; Category No. 11640—post-embryonic organ morphogenesis; Category No. 11641—post-embryonic retina morphogenesis in camera-type eye; Category No. 11642—posterior compartment specification; Category No. 11643—posterior mesonephric tubule development; Category No. 11644—posterior midgut development; Category No. 11645—postganglionic parasympathetic fiber development; Category No. 11646—post-Golgi vesicle-mediated transport; Category No. 11647—post-mRNA release spliceosomal complex; Category No. 11648—postreplication repair; Category No. 11649—post-spliceosomal complex; Category No. 11650—postsynaptic density; Category No. 11651—postsynaptic density assembly; Category No. 11652—postsynaptic density protein 95 clustering; Category No. 11653—postsynaptic membrane; Category No. 11654—postsynaptic membrane assembly; Category No. 11655—postsynaptic membrane organization; Category No. 11656—posttranscriptional gene silencing; Category No. 11657—posttranscriptional gene silencing by RNA; Category No. 11658—posttranscriptional regulation of gene expression; Category No. 11659—post-translational protein acetylation; Category No. 11660—post-translational protein modification; Category No. 11661—posttranslational protein targeting to membrane; Category No. 11662—potassium channel activity; Category No. 11663—potassium channel complex; Category No. 11664—potassium channel inhibitor activity; Category No. 11665—potassium channel regulator activity; Category No. 11666—potassium ion binding; Category No. 11667—potassium ion export; Category No. 11668—potassium ion export across plasma membrane; Category No. 11669—potassium ion homeostasis; Category No. 11670—potassium ion import; Category No. 11671—potassium ion import across plasma membrane; Category No. 11672—potassium ion leak channel activity; Category No. 11673—potassium ion symporter activity; Category No. 11674—potassium ion transmembrane transport; Category No. 11675—potassium ion transmembrane transporter activity; Category No. 11676—potassium ion transport; Category No. 11677—potassium:chloride symporter activity; Category No. 11678—potassium:proton antiporter activity; Category No. 11679—potassium:sodium antiporter activity; Category No. 11680—POU domain binding; Category No. 11681—POZ domain binding; Category No. 11682—P—P-bond-hydrolysis-driven protein transmembrane transporter activity; Category No. 11683—PRC1 complex; Category No. 11684—PR-DUB complex; Category No. 11685—preantral ovarian follicle growth; Category No. 11686—preassembly of GPI anchor in ER membrane; Category No. 11687—pre-autophagosomal structure; Category No. 11688—pre-autophagosomal structure membrane; Category No. 11689—pre-B cell allelic exclusion; Category No. 11690—pre-B cell differentiation; Category No. 11691—precatalytic spliceosome; Category No. 11692—prechordal plate formation; Category No. 11693—prefoldin complex; Category No. 11694—preincision complex assembly; Category No. 11695—pre-miRNA binding; Category No. 11696—pre-miRNA export from nucleus; Category No. 11697—pre-miRNA processing; Category No. 11698—pre-mRNA 3'-splice site binding; Category No. 11699—pre-mRNA 5'-splice site binding; Category No. 11700—pre-mRNA binding; Category No. 11701—pre-mRNA branch point binding; Category No. 11702—pre-mRNA catabolic process; Category No. 11703—pre-mRNA cleavage required for polyadenylation; Category No. 11704—pre-mRNA intronic binding; Category No. 11705—pre-mRNA intronic pyrimidine-rich binding; Category No. 11706—prenylated protein catabolic process; Category No. 11707—prenylated protein tyrosine phosphatase activity; Category No. 11708—prenylcysteine catabolic process; Category No. 11709—prenylcysteine metabolic process; Category No. 11710—prenylcysteine oxidase activity; Category No. 11711—prenyltransferase activity; Category No. 11712—preprotein binding; Category No. 11713—prepulse inhibition; Category No. 11714—pre-replicative complex assembly involved in nuclear cell cycle DNA replication; Category No. 11715—preribosome; Category No. 11716—preribosome binding; Category No. 11717—presequence translocase-associated import motor; Category No. 11718—pre-snoRNP complex; Category No. 11719—prespliceosome; Category No. 11720—pressure natriuresis; Category No. 11721—presynaptic active zone; Category No. 11722—presynaptic active zone assembly; Category No. 11723—presynaptic membrane; Category No. 11724—presynaptic membrane assembly; Category No. 11725—presynaptic membrane organization; Category No. 11726—prevention of polyspermy; Category No. 11727—primary amine oxidase activity; Category No. 11728—primary cilium; Category No. 11729—primary follicle stage; Category No. 11730—primary heart field specification; Category No. 11731—primary lung bud formation; Category No. 11732—primary miRNA binding; Category No. 11733—primary miRNA methylation; Category No. 11734—primary miRNA processing; Category No. 11735—primary ovarian follicle growth; Category No. 11736—primary prostatic bud elongation; Category No. 11737—primary sex determination; Category No. 11738—primitive erythrocyte differentiation; Category No. 11739—primitive hemopoiesis; Category No. 11740—primitive streak formation; Category No. 11741—primosome complex; Category No. 11742—principal sensory nucleus of trigeminal nerve development; Category No. 11743—pristanate-CoA ligase activity; Category No. 11744—pristanoyl-CoA oxidase activity; Category No. 11745—pro-B cell differentiation; Category No. 11746—procollagen galactosyltransferase activity; Category No. 11747—procollagen glucosyltransferase activity; Category No. 11748—procollagen-lysine 5-dioxygenase activity; Category No. 11749—procollagen-proline 3-dioxygenase activity; Category No. 11750—procollagen-proline 4-dioxygenase activity; Category No. 11751—procollagen-proline 4-dioxygenase complex; Category No. 11752—producing 3'-phosphomonoesters; Category No. 11753—producing 5'-phosphomonoesters; Category No. 11754—production of miRNAs involved in gene silencing by miRNA; Category No. 11755—production of molecular mediator involved in inflammatory response; Category No. 11756—production of siRNA involved in RNA interference; Category No. 11757—proepicardium cell migration involved in pericardium morphogenesis; Category No. 11758—proepicardium development; Category No. 11759—profilin binding; Category No. 11760—progesterone biosynthetic process; Category No. 11761—progesterone metabolic process; Category No. 11762—progesterone receptor binding; Category No. 11763—progesterone receptor signaling pathway; Category No. 11764—progesterone secretion; Category No. 11765—programmed cell death; Category No. 11766—programmed necrotic cell death; Category No. 11767—prolactin receptor activity; Category No. 11768—prolactin receptor binding; Category No. 11769—prolactin secreting cell differentiation; Category No. 11770—prolactin secretion; Category No. 11771—prolactin signaling pathway; Category No. 11772—prolactin-releasing peptide receptor binding; Category No. 11773—proline biosynthetic process; Category No. 11774—proline catabolic process; Category No. 11775—proline catabolic process to glutamate; Category No. 11776—proline dehydrogenase activity; Category No. 11777—proline metabolic process; Category No. 11778—proline racemase activity; Category No. 11779—proline transmembrane transport; Category No. 11780—proline transport; Category No. 11781—proline:sodium symporter activity; Category No. 11782—proline-rich region binding; Category No. 11783—proline-tRNA ligase activity; Category No. 11784—prolyl-tRNA aminoacylation; Category No. 11785—prominosome; Category No. 11786—promoter-specific chromatin binding; Category No. 11787—pronephric duct morphogenesis; Category No. 11788—pronephric field specification; Category No. 11789—pronephric nephron tubule development; Category No. 11790—pronephric nephron tubule morphogenesis; Category No. 11791—pronephros development; Category No. 11792—pronuclear fusion; Category No. 11793—pronucleus; Category No. 11794—propane-1,3-diamine oxidase activity; Category No. 11795—propanoyl-CoA C-acyltransferase activity; Category No. 11796—propionate biosynthetic process; Category No. 11797—propionyl-CoA carboxylase activity; Category No. 11798—proprioception; Category No. 11799—proprioception involved in equilibrioception; Category No. 11800—propylene metabolic process; Category No. 11801—prosaposin receptor activity; Category No. 11802—prostaglandin biosynthetic process; Category No. 11803—prostaglandin D receptor activity; Category No. 11804—prostaglandin D2

11-ketoreductase activity; Category No. 11805—prostaglandin E receptor activity; Category No. 11806—prostaglandin F receptor activity; Category No. 11807—prostaglandin J receptor activity; Category No. 11808—prostaglandin metabolic process; Category No. 11809—prostaglandin receptor activity; Category No. 11810—prostaglandin receptor internalization; Category No. 11811—prostaglandin transmembrane transporter activity; Category No. 11812—prostaglandin transport; Category No. 11813—prostaglandin-D synthase activity; Category No. 11814—prostaglandin-E synthase activity; Category No. 11815—prostaglandin-E2 9-reductase activity; Category No. 11816—prostaglandin-endoperoxide synthase activity; Category No. 11817—prostaglandin-F synthase activity; Category No. 11818—prostaglandin-I synthase activity; Category No. 11819—prostate epithelial cord arborization involved in prostate glandular acinus morphogenesis; Category No. 11820—prostate epithelial cord elongation; Category No. 11821—prostate gland development; Category No. 11822—prostate gland epithelium morphogenesis; Category No. 11823—prostate gland growth; Category No. 11824—prostate gland morphogenesis; Category No. 11825—prostate gland stromal morphogenesis; Category No. 11826—prostatic bud formation; Category No. 11827—pro-T cell differentiation; Category No. 11828—protease binding; Category No. 11829—protease localization to mast cell secretory granule; Category No. 11830—proteasomal protein catabolic process; Category No. 11831—proteasomal ubiquitin-independent protein catabolic process; Category No. 11832—proteasome accessory complex; Category No. 11833—proteasome activator complex; Category No. 11834—proteasome assembly; Category No. 11835—proteasome binding; Category No. 11836—proteasome complex; Category No. 11837—proteasome core complex; Category No. 11838—proteasome core complex assembly; Category No. 11839—proteasome regulatory particle; Category No. 11840—proteasome regulatory particle assembly; Category No. 11841—proteasome storage granule; Category No. 11842—proteasome-activating ATPase activity; Category No. 11843—proteasome-mediated ubiquitin-dependent protein catabolic process; Category No. 11844—protection from natural killer cell mediated cytotoxicity; Category No. 11845—protection from non-homologous end joining at telomere; Category No. 11846—protection of DNA demethylation of female pronucleus; Category No. 11847—protein acetylation; Category No. 11848—protein adenylylation; Category No. 11849—protein adenylyltransferase activity; Category No. 11850—protein ADP-ribosylase activity; Category No. 11851—protein ADP-ribosylation; Category No. 11852—protein alpha-1,2-demannosylation; Category No. 11853—protein amidation; Category No. 11854—protein anchor; Category No. 11855—protein antigen binding; Category No. 11856—protein arginylation; Category No. 11857—protein auto-ADP-ribosylation; Category No. 11858—protein autophosphorylation; Category No. 11859—protein autoprocessing; Category No. 11860—protein autoubiquitination; Category No. 11861—protein binding; Category No. 11862—protein binding involved in cell-cell adhesion; Category No. 11863—protein binding involved in heterotypic cell-cell adhesion; Category No. 11864—protein binding involved in protein folding; Category No. 11865—protein biotinylation; Category No. 11866—protein branching point deglutamylation; Category No. 11867—protein C inhibitor-coagulation factor V complex; Category No. 11868—protein C inhibitor-coagulation factor Xa complex; Category No. 11869—protein C inhibitor-coagulation factor XI complex; Category No. 11870—protein C inhibitor-KLK3 complex; Category No. 11871—protein C inhibitor-plasma kallikrein complex; Category No. 11872—protein C inhibitor-PLAT complex; Category No. 11873—protein C inhibitor-PLAU complex; Category No. 11874—protein C inhibitor-thrombin complex; Category No. 11875—protein C inhibitor-TMPRSS11E complex; Category No. 11876—protein C inhibitor-TMPRSS7 complex; Category No. 11877—protein carboxyl O-methyltransferase activity; Category No. 11878—protein catabolic process; Category No. 11879—protein catabolic process in the vacuole; Category No. 11880—protein channel activity; Category No. 11881—protein citrullination; Category No. 11882—protein C-linked glycosylation via 2'-alpha-mannosyl-L-tryptophan; Category No. 11883—protein complex; Category No. 11884—protein complex assembly; Category No. 11885—protein complex assembly involved in synapse maturation; Category No. 11886—protein complex binding; Category No. 11887—protein complex disassembly; Category No. 11888—protein complex localization; Category No. 11889—protein complex oligomerization; Category No. 11890—protein complex scaffold; Category No. 11891—protein C-terminal carboxyl O-methyltransferase activity; Category No. 11892—protein C-terminal leucine carboxyl O-methyltransferase activity; Category No. 11893—protein C-terminal methylesterase activity; Category No. 11894—protein C-terminal S-isoprenylcysteine carboxyl O-methyltransferase activity; Category No. 11895—protein C-terminus binding; Category No. 11896—protein deacetylase activity; Category No. 11897—protein deacetylation; Category No. 11898—protein de-ADP-ribosylation; Category No. 11899—protein deamination; Category No. 11900—protein deglutamylation; Category No. 11901—protein deglutarylation; Category No. 11902—protein deglutathionylation; Category No. 11903—protein deglycosylation; Category No. 11904—protein delipidation; Category No. 11905—protein demalonylation; Category No. 11906—protein demethylation; Category No. 11907—protein deneddylation; Category No. 11908—protein depalmitoleylation; Category No. 11909—protein depalmitoylation; Category No. 11910—protein dephosphorylation; Category No. 11911—protein depolymerization; Category No. 11912—protein destabilization; Category No. 11913—protein desuccinylation; Category No. 11914—protein desumoylation; Category No. 11915—protein deubiquitination; Category No. 11916—protein deubiquitination involved in ubiquitin-dependent protein catabolic process; Category No. 11917—protein dimerization activity; Category No. 11918—protein disulfide isomerase activity; Category No. 11919—protein disulfide oxidoreductase activity; Category No. 11920—protein domain specific binding; Category No. 11921—protein exit from endoplasmic reticulum; Category No. 11922—protein export from nucleus; Category No. 11923—protein farnesylation; Category No. 11924—protein farnesyltransferase activity; Category No. 11925—protein farnesyltransferase complex; Category No. 11926—protein folding; Category No. 11927—protein folding in endoplasmic reticulum; Category No. 11928—protein geranylgeranylation; Category No. 11929—protein geranylgeranyltransferase activity; Category No. 11930—protein glycosylation; Category No. 11931—protein glycosylation in endoplasmic reticulum; Category No. 11932—protein glycosylation in Golgi; Category No. 11933—protein heterodimerization activity; Category No. 11934—protein heterooligomerization; Category No. 11935—protein heterotetramerization; Category No. 11936—protein heterotrimerization; Category No. 11937—protein hexamerization; Category No. 11938—protein histidine kinase activity; Category No. 11939—protein homodimerization activity; Category No. 11940—protein homooligomerization; Category No. 11941—protein homotetramerization; Category No. 11942—protein homotrimerization; Category No. 11943—protein hydroxylation; Category No. 11944—protein import; Category No. 11945—protein import into mitochondrial inner membrane; Category No. 11946—protein import into mitochondrial intermembrane space; Category No. 11947—protein import into mitochondrial matrix; Category No. 11948—protein import into mitochondrial outer membrane; Category No. 11949—protein import into nucleus; Category No. 11950—protein import into peroxisome matrix; Category No. 11951—protein import into peroxisome membrane; Category No. 11952—protein initiator methionine removal; Category No. 11953—protein insertion into ER membrane; Category No. 11954—protein insertion into membrane; Category No. 11955—protein insertion into membrane from inner side; Category No. 11956—protein insertion into mitochondrial membrane; Category No. 11957—protein insertion into mitochondrial membrane involved in apoptotic signaling pathway; Category No. 11958—protein K11-linked deubiquitination; Category No. 11959—protein K11-linked ubiquitination; Category No. 11960—protein K27-linked deubiquitination; Category No. 11961—protein K27-linked ubiquitination; Category No. 11962—protein K29-linked deubiquitination; Category No. 11963—protein K29-linked ubiquitination; Category No. 11964—protein K33-linked deubiquitination; Category No. 11965—protein K33-linked ubiquitination; Category No. 11966—protein K48-linked deubiquitination; Category No. 11967—protein K48-linked ubiquitination; Category No. 11968—protein K63-linked deubiquitination; Category No. 11969—protein K63-linked ubiquitination; Category No. 11970—protein K69-linked ufmylation; Category No. 11971—protein K6-linked deubiquitination; Category No. 11972—protein K6-linked ubiquitination; Category No. 11973—protein kinase A binding; Category No. 11974—protein kinase A catalytic subunit binding; Category No. 11975—protein kinase A regulatory subunit binding; Category No. 11976—protein kinase A signaling; Category No. 11977—protein kinase activator activity; Category No. 11978—protein kinase activity; Category No. 11979—protein kinase B binding; Category No. 11980—protein kinase B signaling; Category No. 11981—protein kinase binding; Category No. 11982—protein kinase C activity; Category No. 11983—protein kinase C binding; Category No. 11984—protein kinase C deactivation; Category No. 11985—protein kinase C inhibitor activity; Category No. 11986—protein kinase C signaling; Category No. 11987—protein kinase C-activating G-protein coupled receptor signaling pathway; Category No. 11988—protein kinase CK2 complex; Category No. 11989—protein kinase complex; Category No. 11990—protein kinase D signaling; Category No. 11991—protein kinase inhibitor activity; Category No. 11992—protein kinase regulator activity; Category No. 11993—protein linear deubiquitination; Category No. 11994—protein linear polyubiquitination; Category No. 11995—protein lipidation; Category No. 11996—protein lipoylation; Category No. 11997—protein localization; Category No. 11998—protein localization involved in establishment of planar polarity; Category No. 11999—protein localization to actin cytoskeleton; Category No. 12000—protein localization to adherens junction; Category No. 12001—protein localization to basolateral plasma membrane; Category No. 12002—protein localization to bicellular tight junction; Category No. 12003—protein localization to cell cortex; Category No. 12004—protein localization to cell junction; Category No. 12005—protein localization to cell leading edge; Category No. 12006—protein localization to cell periphery; Category No. 12007—protein localization to cell surface; Category No. 12008—protein localization to centrosome; Category No. 12009—protein localization to chromatin; Category No. 12010—protein localization to chromosome; Category No. 12011—protein localization to ciliary membrane; Category No. 12012—protein localization to ciliary transition zone; Category No. 12013—protein localization to cilium; Category No. 12014—protein localization to cytoskeleton; Category No. 12015—protein localization to cytosolic proteasome complex involved in ERAD pathway; Category No. 12016—protein localization to early endosome; Category No. 12017—protein localization to endoplasmic reticulum; Category No. 12018—protein localization to endoplasmic reticulum exit site; Category No. 12019—protein localization to endoplasmic reticulum tubular network; Category No. 12020—protein localization to endosome; Category No. 12021—protein localization to Golgi apparatus; Category No. 12022—protein localization to juxtaparanode region of axon; Category No. 12023—protein localization to kinetochore; Category No. 12024—protein localization to lysosome; Category No. 12025—protein localization to M-band; Category No. 12026—protein localization to membrane; Category No. 12027—protein localization to membrane raft; Category No. 12028—protein localization to microtubule; Category No. 12029—protein localization to mitochondrion; Category No. 12030—protein localization to mitotic spindle; Category No. 12031—protein localization to myelin sheath abaxonal region; Category No. 12032—protein localization to nonmotile primary cilium; Category No. 12033—protein localization to nuclear envelope; Category No. 12034—protein localization to nuclear pore; Category No. 12035—protein localization to nucleolus; Category No. 12036—protein localization to nucleus; Category No. 12037—protein localization to organelle; Category No. 12038—protein localization to paranode region of axon; Category No. 12039—protein localization to photoreceptor connecting cilium; Category No. 12040—protein localization to photoreceptor outer segment; Category No. 12041—protein localization to plasma membrane; Category No. 12042—protein localization to plasma membrane raft; Category No. 12043—protein localization to pre-autophagosomal structure; Category No. 12044—protein localization to site of double-strand break; Category No. 12045—protein localization to synapse; Category No. 12046—protein localization to T-tubule; Category No. 12047—protein localization to vacuolar membrane; Category No. 12048—protein mannosylation; Category No. 12049—protein maturation; Category No. 12050—protein maturation by iron-sulfur cluster transfer; Category No. 12051—protein maturation by protein folding; Category No. 12052—protein metabolic process; Category No. 12053—protein methylation; Category No. 12054—protein methyltransferase activity; Category No. 12055—protein modification by small protein conjugation; Category No. 12056—protein modification by small protein removal; Category No. 12057—protein modification process; Category No. 12058—protein monoubiquitination; Category No. 12059—protein myristoylation; Category No. 12060—protein N-acetylglucosaminyltransferase activity; Category No. 12061—protein neddylation; Category No. 12062—protein N-linked glycosylation; Category No. 12063—protein N-linked glycosylation via asparagine; Category No. 12064—protein N-terminus binding; Category No. 12065—protein O-GlcNAc transferase activity; Category No.

12066—protein oligomerization; Category No. 12067—protein O-linked fucosylation; Category No. 12068—protein O-linked glycosylation; Category No. 12069—protein O-linked glycosylation via serine; Category No. 12070—protein O-linked glycosylation via threonine; Category No. 12071—protein O-linked mannosylation; Category No. 12072—protein oxidation; Category No. 12073—protein palmitoleylation; Category No. 12074—protein palmitoylation; Category No. 12075—protein peptidyl-prolyl isomerization; Category No. 12076—protein phosphatase 1 binding; Category No. 12077—protein phosphatase 2A binding; Category No. 12078—protein phosphatase 2B binding; Category No. 12079—protein phosphatase 4 complex; Category No. 12080—protein phosphatase activator activity; Category No. 12081—protein phosphatase binding; Category No. 12082—protein phosphatase inhibitor activity; Category No. 12083—protein phosphatase regulator activity; Category No. 12084—protein phosphatase type 1 activator activity; Category No. 12085—protein phosphatase type 1 complex; Category No. 12086—protein phosphatase type 1 regulator activity; Category No. 12087—protein phosphatase type 2A complex; Category No. 12088—protein phosphatase type 2A regulator activity; Category No. 12089—protein phosphatase type 4 regulator activity; Category No. 12090—protein phosphorylated amino acid binding; Category No. 12091—protein phosphorylation; Category No. 12092—protein poly-ADP-ribosylation; Category No. 12093—protein polyglutamylation; Category No. 12094—protein polyglycylation; Category No. 12095—protein polymerization; Category No. 12096—protein polyubiquitination; Category No. 12097—protein prenylation; Category No. 12098—protein prenyltransferase activity; Category No. 12099—protein processing; Category No. 12100—protein processing involved in protein targeting to mitochondrion; Category No. 12101—protein refolding; Category No. 12102—protein repair; Category No. 12103—protein retention in ER lumen; Category No. 12104—protein retention in Golgi apparatus; Category No. 12105—protein secretion; Category No. 12106—protein secretion by platelet; Category No. 12107—protein self-association; Category No. 12108—protein serine threonine kinase activator activity; Category No. 12109—protein serine threonine kinase activity; Category No. 12110—protein serine threonine kinase inhibitor activity; Category No. 12111—protein serine threonine phosphatase activity; Category No. 12112—protein serine threonine phosphatase complex; Category No. 12113—protein serine threonine phosphatase inhibitor activity; Category No. 12114—protein serine threonine tyrosine kinase activity; Category No. 12115—protein sialylation; Category No. 12116—protein side chain deglutamylation; Category No. 12117—protein stabilization; Category No. 12118—protein sulfation; Category No. 12119—protein sulfhydration; Category No. 12120—protein sumoylation; Category No. 12121—protein tag; Category No. 12122—protein targeting; Category No. 12123—protein targeting to ER; Category No. 12124—protein targeting to Golgi; Category No. 12125—protein targeting to lysosome; Category No. 12126—protein targeting to membrane; Category No. 12127—protein targeting to mitochondrion; Category No. 12128—protein targeting to peroxisome; Category No. 12129—protein targeting to plasma membrane; Category No. 12130—protein targeting to vacuole; Category No. 12131—protein targeting to vacuole involved in autophagy; Category No. 12132—protein targeting to vacuole involved in ubiquitin-dependent protein catabolic process via the multivesicular body sorting pathway; Category No. 12133—protein tetramerization; Category No. 12134—protein to membrane docking; Category No. 12135—protein transmembrane transport; Category No. 12136—protein transmembrane transporter activity; Category No. 12137—protein transport; Category No. 12138—protein transport from ciliary membrane to plasma membrane; Category No. 12139—protein transport into membrane raft; Category No. 12140—protein transport into plasma membrane raft; Category No. 12141—protein transport within lipid bilayer; Category No. 12142—protein transporter activity; Category No. 12143—protein trimerization; Category No. 12144—protein tyrosine kinase activator activity; Category No. 12145—protein tyrosine kinase activity; Category No. 12146—protein tyrosine kinase binding; Category No. 12147—protein tyrosine kinase collagen receptor activity; Category No. 12148—protein tyrosine kinase inhibitor activity; Category No. 12149—protein tyrosine phosphatase activator activity; Category No. 12150—protein tyrosine phosphatase activity; Category No. 12151—protein tyrosine serine threonine phosphatase activity; Category No. 12152—protein tyrosine threonine phosphatase activity; Category No. 12153—protein ubiquitination; Category No. 12154—protein ubiquitination involved in ubiquitin-dependent protein catabolic process; Category No. 12155—protein ufmylation; Category No. 12156—protein unfolding; Category No. 12157—protein urmylation; Category No. 12158—protein xylosyltransferase activity; Category No. 12159—proteinaceous extracellular matrix; Category No. 12160—protein-arginine deiminase activity; Category No. 12161—protein-arginine N-methyltransferase activity; Category No. 12162—protein-arginine omega-N asymmetric methyltransferase activity; Category No. 12163—protein-arginine omega-N monomethyltransferase activity; Category No. 12164—protein-arginine omega-N symmetric methyltransferase activity; Category No. 12165—proteinase activated receptor binding; Category No. 12166—protein-chromophore linkage; Category No. 12167—protein-cysteine S-palmitoyltransferase activity; Category No. 12168—protein-disulfide reductase (glutathione) activity; Category No. 12169—protein-disulfide reductase activity; Category No. 12170—protein-DNA complex; Category No. 12171—protein-DNA complex assembly; Category No. 12172—protein-FAD linkage; Category No. 12173—protein-glutamine gamma-glutamyltransferase activity; Category No. 12174—protein-glutaryllysine deglutarylase activity; Category No. 12175—protein-glycine ligase activity; Category No. 12176—protein-hormone receptor activity; Category No. 12177—protein-lipid complex; Category No. 12178—protein-lipid complex assembly; Category No. 12179—protein-L-isoaspartate (D-aspartate) O-methyltransferase activity; Category No. 12180—protein-lysine 6-oxidase activity; Category No. 12181—protein-lysine N-methyltransferase activity; Category No. 12182—protein-malonyllysine demalonylase activity; Category No. 12183—protein-N-terminal asparagine amidohydrolase activity; Category No. 12184—protein-N-terminal glutamine amidohydrolase activity; Category No. 12185—protein-pyridoxal-5-phosphate linkage; Category No. 12186—protein-pyridoxal-5-phosphate linkage via peptidyl-N6-pyridoxal phosphate-L-lysine; Category No. 12187—protein-succinyllysine desuccinylase activity; Category No. 12188—protein-tyrosine sulfotransferase activity; Category No. 12189—proteoglycan binding; Category No. 12190—proteoglycan biosynthetic process; Category No. 12191—proteoglycan catabolic process; Category No. 12192—proteoglycan metabolic process; Category No. 12193—proteoglycan sulfotransferase activity; Category No. 12194—proteolysis; Category No.

12195—proteolysis involved in cellular protein catabolic process; Category No. 12196—protoheme IX farnesyltransferase activity; Category No. 12197—proton transport; Category No. 12198—proton-dependent oligopeptide secondary active transmembrane transporter activity; Category No. 12199—proton-transporting ATP synthase activity; Category No. 12200—proton-transporting ATP synthase complex; Category No. 12201—proton-transporting ATP synthase complex assembly; Category No. 12202—proton-transporting ATPase activity; Category No. 12203—proton-transporting domain; Category No. 12204—proton-transporting two-sector ATPase complex; Category No. 12205—proton-transporting two-sector ATPase complex proton-transporting domain; Category No. 12206—proton-transporting V-type ATPase complex; Category No. 12207—proton-transporting V-type ATPase V0 domain; Category No. 12208—proton-transporting V-type ATPase V1 domain; Category No. 12209—protoporphyrinogen IX biosynthetic process; Category No. 12210—protoporphyrinogen IX metabolic process; Category No. 12211—proximal dendrite; Category No. 12212—proximal distal axis specification; Category No. 12213—proximal distal pattern formation; Category No. 12214—proximal distal pattern formation involved in metanephric nephron development; Category No. 12215—proximal distal pattern formation involved in nephron development; Category No. 12216—proximal neuron projection; Category No. 12217—proximal tubule development; Category No. 12218—Prp19 complex; Category No. 12219—pseudopodium; Category No. 12220—pseudopodium membrane; Category No. 12221—pseudopodium organization; Category No. 12222—pseudouridine 5'-phosphatase activity; Category No. 12223—pseudouridine synthase activity; Category No. 12224—pseudouridine synthesis; Category No. 12225—pseudouridylate synthase activity; Category No. 12226—psychomotor behavior; Category No. 12227—PTB domain binding; Category No. 12228—pteridine metabolic process; Category No. 12229—pteridine-containing compound biosynthetic process; Category No. 12230—pteridine-containing compound metabolic process; Category No. 12231—PTW PP1 phosphatase complex; Category No. 12232—pulmonary artery endothelial tube morphogenesis; Category No. 12233—pulmonary artery morphogenesis; Category No. 12234—pulmonary myocardium development; Category No. 12235—pulmonary valve formation; Category No. 12236—pulmonary valve morphogenesis; Category No. 12237—pulmonary vein morphogenesis; Category No. 12238—purine deoxyribonucleoside metabolic process; Category No. 12239—purine nucleobase binding; Category No. 12240—purine nucleobase biosynthetic process; Category No. 12241—purine nucleobase catabolic process; Category No. 12242—purine nucleobase metabolic process; Category No. 12243—purine nucleobase transmembrane transporter activity; Category No. 12244—purine nucleobase transport; Category No. 12245—purine nucleoside binding; Category No. 12246—purine nucleoside metabolic process; Category No. 12247—purine nucleoside monophosphate catabolic process; Category No. 12248—purine nucleoside transmembrane transport; Category No. 12249—purine nucleoside transmembrane transporter activity; Category No. 12250—purine nucleotide binding; Category No. 12251—purine nucleotide biosynthetic process; Category No. 12252—purine nucleotide catabolic process; Category No. 12253—purine nucleotide metabolic process; Category No. 12254—purine nucleotide salvage; Category No. 12255—purine nucleotide transmembrane transporter activity; Category No. 12256—purine nucleotide transport; Category No. 12257—purine ribonucleoside catabolic process; Category No. 12258—purine ribonucleoside diphosphate catabolic process; Category No. 12259—purine ribonucleoside monophosphate biosynthetic process; Category No. 12260—purine ribonucleoside salvage; Category No. 12261—purine ribonucleoside triphosphate binding; Category No. 12262—purine ribonucleotide biosynthetic process; Category No. 12263—purine ribonucleotide catabolic process; Category No. 12264—purine ribonucleotide transport; Category No. 12265—purine-containing compound salvage; Category No. 12266—purine-nucleoside phosphorylase activity; Category No. 12267—purinergic nucleotide receptor activity; Category No. 12268—purinergic nucleotide receptor signaling pathway; Category No. 12269—purine-rich negative regulatory element binding; Category No. 12270—purine-specific mismatch base pair DNA N-glycosylase activity; Category No. 12271—purine-specific nucleoside:sodium symporter activity; Category No. 12272—Purkinje myocyte development; Category No. 12273—Purkinje myocyte differentiation; Category No. 12274—Purkinje myocyte to ventricular cardiac muscle cell signaling; Category No. 12275—putamen development; Category No. 12276—putrescine acetylation; Category No. 12277—putrescine binding; Category No. 12278—putrescine biosynthetic process; Category No. 12279—putrescine biosynthetic process from arginine; Category No. 12280—putrescine biosynthetic process from ornithine; Category No. 12281—putrescine catabolic process; Category No. 12282—putrescine transmembrane transporter activity; Category No. 12283—putrescine transport; Category No. 12284—Pwp2p-containing subcomplex of 90S preribosome; Category No. 12285—pyramidal neuron development; Category No. 12286—pyramidal neuron differentiation; Category No. 12287—pyramidal neuron migration; Category No. 12288—pyridine nucleotide biosynthetic process; Category No. 12289—pyridoxal 5'-phosphate salvage; Category No. 12290—pyridoxal kinase activity; Category No. 12291—pyridoxal phosphatase activity; Category No. 12292—pyridoxal phosphate binding; Category No. 12293—pyridoxal phosphate biosynthetic process; Category No. 12294—pyridoxal phosphate catabolic process; Category No. 12295—pyridoxamine-phosphate oxidase activity; Category No. 12296—pyridoxine biosynthetic process; Category No. 12297—pyrimidine- and adenine-specific:sodium symporter activity; Category No. 12298—pyrimidine deoxyribonucleotide binding; Category No. 12299—pyrimidine deoxyribonucleotide catabolic process; Category No. 12300—pyrimidine dimer repair; Category No. 12301—pyrimidine dimer repair by nucleotide-excision repair; Category No. 12302—pyrimidine nucleobase catabolic process; Category No. 12303—pyrimidine nucleobase metabolic process; Category No. 12304—pyrimidine nucleobase transmembrane transporter activity; Category No. 12305—pyrimidine nucleobase transport; Category No. 12306—pyrimidine nucleoside biosynthetic process; Category No. 12307—pyrimidine nucleoside catabolic process; Category No. 12308—pyrimidine nucleoside metabolic process; Category No. 12309—pyrimidine nucleoside salvage; Category No. 12310—pyrimidine nucleoside transport; Category No. 12311—pyrimidine nucleotide binding; Category No. 12312—pyrimidine nucleotide biosynthetic process; Category No. 12313—pyrimidine nucleotide metabolic process; Category No. 12314—pyrimidine nucleotide transmembrane transporter activity; Category No. 12315—pyrimidine nucleotide transport; Category No. 12316—pyrimidine nucleotide-sugar transmembrane transport; Category No. 12317—pyrimidine nucleotide-sugar transmembrane transporter activity; Category No. 12318—pyrimidine nucleotide-sugar transport; Category No. 12319—pyrimidine ribonucleotide binding; Category No. 12320—pyrimidine ribonucleotide biosynthetic process; Category No. 12321—pyrimidine-containing compound salvage; Category No. 12322—pyrimidine-containing compound transmembrane transport; Category No. 12323—pyrimidine-nucleoside phosphorylase activity; Category No. 12324—pyrimidine-specific mismatch base pair DNA N-glycosylase activity; Category No. 12325—Pyrin domain binding; Category No. 12326—pyroglutamyl-peptidase activity; Category No. 12327—pyrophosphatase activity; Category No. 12328—pyroptosis; Category No. 12329—pyrroline-5-carboxylate reductase activity; Category No. 12330—pyruvate biosynthetic process; Category No. 12331—pyruvate carboxylase activity; Category No. 12332—pyruvate dehydrogenase (acetyl-transferring) activity; Category No. 12333—pyruvate dehydrogenase (acetyl-transferring) kinase activity; Category No. 12334—pyruvate dehydrogenase (NAD+) activity; Category No. 12335—pyruvate dehydrogenase activity; Category No. 12336—pyruvate dehydrogenase complex; Category No. 12337—pyruvate kinase activity; Category No. 12338—pyruvate metabolic process; Category No. 12339—pyruvate oxidation; Category No. 12340—pyruvate secondary active transmembrane transporter activity; Category No. 12341—pyruvate transmembrane transport; Category No. 12342—pyruvate transmembrane transporter activity; Category No. 12343—quaternary ammonium group transmembrane transporter activity; Category No. 12344—quaternary ammonium group transport; Category No. 12345—quercetin 2,3-dioxygenase activity; Category No. 12346—queuine tRNA-ribosyltransferase activity; Category No. 12347—queuosine biosynthetic process; Category No. 12348—quinine 3-monooxygenase activity; Category No. 12349—quinolinate biosynthetic process; Category No. 12350—quinolinate catabolic process; Category No. 12351—quinolinate metabolic process; Category No. 12352—quinone binding; Category No. 12353—quinone metabolic process; Category No. 12354—quinone or similar compound as acceptor; Category No. 12355—quorum sensing involved in interaction with host; Category No. 12356—R2TP complex; Category No. 12357—Rab GDP-dissociation inhibitor activity; Category No. 12358—Rab geranylgeranyltransferase activity; Category No. 12359—Rab GTPase binding; Category No. 12360—Rab guanyl-nucleotide exchange factor activity; Category No. 12361—Rab protein signal transduction; Category No. 12362—Rab-protein geranylgeranyltransferase complex; Category No. 12363—Rac GTPase binding; Category No. 12364—Rac guanyl-nucleotide exchange factor activity; Category No. 12365—Rac protein signal transduction; Category No. 12366—racemase and epimerase activity; Category No. 12367—Rad17 RFC-like complex; Category No. 12368—Rad51B-Rad51C-Rad51D-XRCC2 complex; Category No. 12369—Rad51C-XRCC3 complex; Category No. 12370—Rad6-Rad18 complex; Category No. 12371—radial glia guided migration of cerebellar granule cell; Category No. 12372—radial glia guided migration of Purkinje cell; Category No. 12373—radial glial cell differentiation; Category No. 12374—radial pattern formation; Category No. 12375—radial spoke; Category No. 12376—raffinose alpha-galactosidase activity; Category No. 12377—RAGE receptor binding; Category No. 12378—Ragulator complex; Category No. 12379—Ral GTPase binding; Category No. 12380—Ral guanyl-nucleotide exchange factor activity; Category No. 12381—Ral protein signal transduction; Category No. 12382—Ran GTPase binding; Category No. 12383—Ran guanyl-nucleotide exchange factor activity; Category No. 12384—Ran protein signal transduction; Category No. 12385—random inactivation of X chromosome; Category No. 12386—Rap guanyl-nucleotide exchange factor activity; Category No. 12387—Rap protein signal transduction; Category No. 12388—Ras GTPase binding; Category No. 12389—Ras guanyl-nucleotide exchange factor activity; Category No. 12390—Ras palmitoyltransferase activity; Category No. 12391—Ras protein signal transduction; Category No. 12392—Rb-E2F complex; Category No. 12393—rDNA binding; Category No. 12394—rDNA heterochromatin; Category No. 12395—reactive nitrogen species metabolic process; Category No. 12396—reactive oxygen species biosynthetic process; Category No. 12397—reactive oxygen species metabolic process; Category No. 12398—receptor activator activity; Category No. 12399—receptor activity; Category No. 12400—receptor agonist activity; Category No. 12401—receptor antagonist activity; Category No. 12402—receptor binding; Category No. 12403—receptor biosynthetic process; Category No. 12404—receptor catabolic process; Category No. 12405—receptor clustering; Category No. 12406—receptor complex; Category No. 12407—receptor guanylyl cyclase signaling pathway; Category No. 12408—receptor inhibitor activity; Category No. 12409—receptor internalization; Category No. 12410—receptor internalization involved in canonical Wnt signaling pathway; Category No. 12411—receptor localization to nonmotile primary cilium; Category No. 12412—receptor localization to synapse; Category No. 12413—receptor metabolic process; Category No. 12414—receptor recycling; Category No. 12415—receptor serine threonine kinase binding; Category No. 12416—receptor signaling complex scaffold activity; Category No. 12417—receptor signaling protein activity; Category No. 12418—receptor signaling protein serine threonine kinase activity; Category No. 12419—receptor signaling protein serine threonine phosphatase activity; Category No. 12420—receptor signaling protein tyrosine kinase activator activity; Category No. 12421—receptor signaling protein tyrosine kinase activity; Category No. 12422—receptor signaling protein tyrosine kinase inhibitor activity; Category No. 12423—receptor signaling protein tyrosine phosphatase activity; Category No. 12424—receptor transactivation; Category No. 12425—receptor tyrosine kinase binding; Category No. 12426—receptor tyrosine kinase-like orphan receptor binding; Category No. 12427—receptor-mediated endocytosis; Category No. 12428—receptor-mediated endocytosis of low-density lipoprotein particle involved in cholesterol transport; Category No. 12429—receptor-mediated endocytosis of virus by host cell; Category No. 12430—receptor-mediated virion attachment to host cell; Category No. 12431—reciprocal meiotic recombination; Category No. 12432—recognition; Category No. 12433—recognition of apoptotic cell; Category No. 12434—recombinase activity; Category No. 12435—recombination hotspot binding; Category No. 12436—recombinational repair; Category No. 12437—recruitment of 3-end processing factors to RNA polymerase II holoenzyme complex; Category No. 12438—recruitment of mRNA capping enzyme to RNA polymerase II holoenzyme complex; Category No. 12439—recycling endosome; Category No. 12440—recycling endosome membrane; Category No. 12441—recycling endosome to Golgi transport; Category No. 12442—red far-red light phototransduction; Category No. 12443—reduced ascorbate as one donor; Category No. 12444—reduced flavin or flavoprotein as one donor; Category No. 12445—reduced folate carrier activity; Category No. 12446—reduced pteridine as one donor; Category No. 12447—reduction of food intake in response to dietary excess; Category No. 12448—reelin receptor activity; Category No. 12449—reelin-mediated signaling pathway; Category No. 12450—re-entry into mitotic cell cycle; Category No. 12451—reflex; Category No. 12452—regionalization; Category No. 12453—regulated secretory pathway; Category No. 12454—regulation of acetylcholine metabolic process; Category No. 12455—regulation of acetylcholine secretion; Category No. 12456—regulation of acetyl-CoA biosynthetic process from pyruvate; Category No. 12457—regulation of acid-sensing ion channel activity; Category No. 12458—regulation of acrosome reaction; Category No. 12459—regulation of actin cytoskeleton organization; Category No. 12460—regulation of actin cytoskeleton organization by cell-cell adhesion; Category No. 12461—regulation of actin cytoskeleton reorganization; Category No. 12462—regulation of actin filament bundle assembly; Category No. 12463—regulation of actin filament depolymerization; Category No. 12464—regulation of actin filament length; Category No. 12465—regulation of actin filament polymerization; Category No. 12466—regulation of actin filament-based process; Category No. 12467—regulation of actin nucleation; Category No. 12468—regulation of actin phosphorylation; Category No. 12469—regulation of actin polymerization or depolymerization; Category No. 12470—regulation of action potential; Category No. 12471—regulation of activated T cell proliferation; Category No. 12472—regulation of activation of JAK2 kinase activity; Category No. 12473—regulation of activation-induced cell death of T cells; Category No. 12474—regulation of activin receptor signaling pathway; Category No. 12475—regulation of acute inflammatory response; Category No. 12476—regulation of acyl-CoA biosynthetic process; Category No. 12477—regulation of adaptive immune response; Category No. 12478—regulation of adenylate cyclase activity; Category No. 12479—regulation of adenylate cyclase activity involved in G-protein coupled receptor signaling pathway; Category No. 12480—regulation of adrenergic receptor signaling pathway; Category No. 12481—regulation of aerobic respiration; Category No. 12482—regulation of aldosterone metabolic process; Category No. 12483—regulation of alpha-amino-3-hydroxy-5-methyl-4-isoxazole propionate selective glutamate receptor activity; Category No. 12484—regulation of alternative mRNA splicing; Category No. 12485—regulation of amyloid precursor protein biosynthetic process; Category No. 12486—regulation of amyloid precursor protein catabolic process; Category No. 12487—regulation of androgen receptor signaling pathway; Category No. 12488—regulation of angiogenesis; Category No. 12489—regulation of angiotensin levels in blood; Category No. 12490—regulation of angiotensin metabolic process; Category No. 12491—regulation of anion transmembrane transport; Category No. 12492—regulation of anion transport; Category No. 12493—regulation of anoikis; Category No. 12494—regulation of antimicrobial humoral response; Category No. 12495—regulation of apoptosis involved in tissue homeostasis; Category No. 12496—regulation of apoptotic cell clearance; Category No. 12497—regulation of apoptotic DNA fragmentation; Category No. 12498—regulation of apoptotic process; Category No. 12499—regulation of apoptotic signaling pathway; Category No. 12500—regulation of appetite; Category No. 12501—regulation of arachidonic acid secretion; Category No. 12502—regulation of ARF protein signal transduction; Category No. 12503—regulation of arginine metabolic process; Category No. 12504—regulation of Arp2 3 complex-mediated actin nucleation; Category No. 12505—regulation of aspartic-type endopeptidase activity involved in amyloid precursor protein catabolic process; Category No. 12506—regulation of astrocyte differentiation; Category No. 12507—regulation of asymmetric cell division; Category No. 12508—regulation of ATF6-mediated unfolded protein response; Category No. 12509—regulation of ATP metabolic process; Category No. 12510—regulation of ATP:ADP antiporter activity; Category No. 12511—regulation of ATPase activity; Category No. 12512—regulation of atrial cardiac muscle cell action potential; Category No. 12513—regulation of atrial cardiac muscle cell membrane depolarization; Category No. 12514—regulation of atrial cardiac muscle cell membrane repolarization; Category No. 12515—regulation of attachment of spindle microtubules to kinetochore; Category No. 12516—regulation of auditory receptor cell differentiation; Category No. 12517—regulation of autophagosome assembly; Category No. 12518—regulation of autophagosome maturation; Category No. 12519—regulation of autophagy; Category No. 12520—regulation of AV node cell action potential; Category No. 12521—regulation of axon diameter; Category No. 12522—regulation of axon extension; Category No. 12523—regulation of axon extension involved in axon guidance; Category No. 12524—regulation of axon guidance; Category No. 12525—regulation of axon regeneration; Category No. 12526—regulation of axonogenesis; Category No. 12527—regulation of B cell activation; Category No. 12528—regulation of B cell apoptotic process; Category No. 12529—regulation of B cell cytokine production; Category No. 12530—regulation of B cell differentiation; Category No. 12531—regulation of B cell proliferation; Category No. 12532—regulation of B cell receptor signaling pathway; Category No. 12533—regulation of barbed-end actin filament capping; Category No. 12534—regulation of behavior; Category No. 12535—regulation of behavioral fear response; Category No. 12536—regulation of beta-amyloid clearance; Category No. 12537—regulation of beta-amyloid formation; Category No. 12538—regulation of bicellular tight junction assembly; Category No. 12539—regulation of bile acid biosynthetic process; Category No. 12540—regulation of bile acid metabolic process; Category No. 12541—regulation of binding; Category No. 12542—regulation of binding of sperm to zona pellucida; Category No. 12543—regulation of blood coagulation; Category No. 12544—regulation of blood pressure; Category No. 12545—regulation of blood vessel endothelial cell migration; Category No. 12546—regulation of blood vessel remodeling; Category No. 12547—regulation of blood vessel size; Category No. 12548—regulation of blood vessel size by renin-angiotensin; Category No. 12549—regulation of blood volume by renal aldosterone; Category No. 12550—regulation of blood volume by renin-angiotensin; Category No. 12551—regulation of BMP signaling pathway; Category No. 12552—regulation of body fluid levels; Category No. 12553—regulation of bone mineralization; Category No. 12554—regulation of bone remodeling; Category No. 12555—regulation of bone resorption; Category No. 12556—regulation of branch elongation involved in ureteric bud branching; Category No. 12557—regulation of branching involved in lung morphogenesis; Category No. 12558—regulation of branching involved in mammary gland duct morphogenesis; Category No. 12559—regulation of branching involved in prostate gland morphogenesis; Category No. 12560—regulation of branching involved in salivary gland morphogenesis; Category No. 12561—regulation of branching involved in salivary gland morphogenesis by epithelial-mesenchymal signaling; Category No.

12562—regulation of branching involved in salivary gland morphogenesis by extracellular matrix-epithelial cell signaling; Category No. 12563—regulation of branching involved in salivary gland morphogenesis by mesenchymal-epithelial signaling; Category No. 12564—regulation of branching involved in ureteric bud morphogenesis; Category No. 12565—regulation of branching morphogenesis of a nerve; Category No. 12566—regulation of brown fat cell differentiation; Category No. 12567—regulation of bundle of His cell action potential; Category No. 12568—regulation of calcidiol 1-monooxygenase activity; Category No. 12569—regulation of calcineurin-NFAT signaling cascade; Category No. 12570—regulation of calcium ion import; Category No. 12571—regulation of calcium ion transmembrane transport; Category No. 12572—regulation of calcium ion transmembrane transporter activity; Category No. 12573—regulation of calcium ion transport; Category No. 12574—regulation of calcium ion transport into cytosol; Category No. 12575—regulation of calcium ion-dependent exocytosis; Category No. 12576—regulation of calcium ion-dependent exocytosis of neurotransmitter; Category No. 12577—regulation of calcium-mediated signaling; Category No. 12578—regulation of calcium-transporting ATPase activity; Category No. 12579—regulation of cAMP biosynthetic process; Category No. 12580—regulation of cAMP metabolic process; Category No. 12581—regulation of cAMP-dependent protein kinase activity; Category No. 12582—regulation of cAMP-mediated signaling; Category No. 12583—regulation of canonical Wnt signaling pathway; Category No. 12584—regulation of carbohydrate metabolic process; Category No. 12585—regulation of carbohydrate metabolic process by regulation of transcription from RNA polymerase II promoter; Category No. 12586—regulation of carbohydrate utilization; Category No. 12587—regulation of cardiac cell fate specification; Category No. 12588—regulation of cardiac conduction; Category No. 12589—regulation of cardiac muscle cell action potential; Category No. 12590—regulation of cardiac muscle cell action potential involved in regulation of contraction; Category No. 12591—regulation of cardiac muscle cell contraction; Category No. 12592—regulation of cardiac muscle cell membrane potential; Category No. 12593—regulation of cardiac muscle cell proliferation; Category No. 12594—regulation of cardiac muscle contraction; Category No. 12595—regulation of cardiac muscle contraction by calcium ion signaling; Category No. 12596—regulation of cardiac muscle contraction by regulation of the release of sequestered calcium ion; Category No. 12597—regulation of cardiac muscle hypertrophy; Category No. 12598—regulation of cardiac muscle hypertrophy in response to stress; Category No. 12599—regulation of cardiac muscle tissue development; Category No. 12600—regulation of cardioblast proliferation; Category No. 12601—regulation of cargo loading into COPII-coated vesicle; Category No. 12602—regulation of cartilage development; Category No. 12603—regulation of catalytic activity; Category No. 12604—regulation of catecholamine metabolic process; Category No. 12605—regulation of catecholamine secretion; Category No. 12606—regulation of catenin import into nucleus; Category No. 12607—regulation of cation channel activity; Category No. 12608—regulation of caveolin-mediated endocytosis; Category No. 12609—regulation of CD40 signaling pathway; Category No. 12610—regulation of CD4-positive; Category No. 12611—regulation of CD8-positive; Category No. 12612—regulation of Cdc42 protein signal transduction; Category No. 12613—regulation of cell activation; Category No. 12614—regulation of cell adhesion; Category No. 12615—regulation of cell adhesion mediated by integrin; Category No. 12616—regulation of cell communication; Category No. 12617—regulation of cell communication by electrical coupling; Category No. 12618—regulation of cell communication by electrical coupling involved in cardiac conduction; Category No. 12619—regulation of cell cycle; Category No. 12620—regulation of cell cycle arrest; Category No. 12621—regulation of cell cycle checkpoint; Category No. 12622—regulation of cell cycle G1 S phase transition; Category No. 12623—regulation of cell cycle G2 M phase transition; Category No. 12624—regulation of cell cycle phase transition; Category No. 12625—regulation of cell cycle process; Category No. 12626—regulation of cell death; Category No. 12627—regulation of cell diameter; Category No. 12628—regulation of cell differentiation; Category No. 12629—regulation of cell differentiation involved in embryonic placenta development; Category No. 12630—regulation of cell division; Category No. 12631—regulation of cell fate commitment; Category No. 12632—regulation of cell fate specification; Category No. 12633—regulation of cell growth; Category No. 12634—regulation of cell growth by extracellular stimulus; Category No. 12635—regulation of cell growth involved in cardiac muscle cell development; Category No. 12636—regulation of cell junction assembly; Category No. 12637—regulation of cell maturation; Category No. 12638—regulation of cell migration; Category No. 12639—regulation of cell migration involved in sprouting angiogenesis; Category No. 12640—regulation of cell morphogenesis; Category No. 12641—regulation of cell morphogenesis involved in differentiation; Category No. 12642—regulation of cell motility; Category No. 12643—regulation of cell motility involved in somitogenic axis elongation; Category No. 12644—regulation of cell projection assembly; Category No. 12645—regulation of cell projection organization; Category No. 12646—regulation of cell proliferation; Category No. 12647—regulation of cell proliferation involved in tissue homeostasis; Category No. 12648—regulation of cell shape; Category No. 12649—regulation of cell size; Category No. 12650—regulation of cell-cell adhesion; Category No. 12651—regulation of cell-cell adhesion mediated by integrin; Category No. 12652—regulation of cell-matrix adhesion; Category No. 12653—regulation of cell-substrate adhesion; Category No. 12654—regulation of cellular amino acid metabolic process; Category No. 12655—regulation of cellular component movement; Category No. 12656—regulation of cellular component organization; Category No. 12657—regulation of cellular component size; Category No. 12658—regulation of cellular extravasation; Category No. 12659—regulation of cellular ketone metabolic process; Category No. 12660—regulation of cellular ketone metabolic process by negative regulation of transcription from RNA polymerase II promoter; Category No. 12661—regulation of cellular ketone metabolic process by positive regulation of transcription from RNA polymerase II promoter; Category No. 12662—regulation of cellular localization; Category No. 12663—regulation of cellular metabolic process; Category No. 12664—regulation of cellular pH; Category No. 12665—regulation of cellular process; Category No. 12666—regulation of cellular protein localization; Category No. 12667—regulation of cellular protein metabolic process; Category No. 12668—regulation of cellular respiration; Category No. 12669—regulation of cellular response to drug; Category No. 12670—regulation of cellular response to growth factor stimulus; Category No. 12671—regulation of cellular response to heat; Category No. 12672—regulation of cellular response to hypoxia; Category No. 12673—regulation of cellular response to insulin stimulus; Category No. 12674—regulation of cellular response to oxidative stress; Category No. 12675—regulation of cellular response to X-ray; Category No. 12676—regulation of cellular senescence; Category No. 12677—regulation of centriole replication; Category No. 12678—regulation of centriole-centriole cohesion; Category No. 12679—regulation of centromere complex assembly; Category No. 12680—regulation of centromeric sister chromatid cohesion; Category No. 12681—regulation of centrosome cycle; Category No. 12682—regulation of centrosome duplication; Category No. 12683—regulation of ceramide biosynthetic process; Category No. 12684—regulation of cerebellar granule cell precursor proliferation; Category No. 12685—regulation of cGMP biosynthetic process; Category No. 12686—regulation of cGMP metabolic process; Category No. 12687—regulation of cGMP-mediated signaling; Category No. 12688—regulation of chaperone-mediated autophagy; Category No. 12689—regulation of chemokine (C—X—C motif) ligand 1 production; Category No. 12690—regulation of chemokine (C—X—C motif) ligand 2 production; Category No. 12691—regulation of chemokine production; Category No. 12692—regulation of chemotaxis; Category No. 12693—regulation of chloride transport; Category No. 12694—regulation of cholesterol biosynthetic process; Category No. 12695—regulation of cholesterol efflux; Category No. 12696—regulation of cholesterol esterification; Category No. 12697—regulation of cholesterol homeostasis; Category No. 12698—regulation of cholesterol import; Category No. 12699—regulation of cholesterol metabolic process; Category No. 12700—regulation of cholesterol transport; Category No. 12701—regulation of cholesterol transporter activity; Category No. 12702—regulation of chondrocyte development; Category No. 12703—regulation of chondrocyte differentiation; Category No. 12704—regulation of chorionic trophoblast cell proliferation; Category No. 12705—regulation of chromatin assembly; Category No. 12706—regulation of chromatin assembly or disassembly; Category No. 12707—regulation of chromatin disassembly; Category No. 12708—regulation of chromatin silencing; Category No. 12709—regulation of chromatin silencing at telomere; Category No. 12710—regulation of chromosome condensation; Category No. 12711—regulation of chromosome organization; Category No. 12712—regulation of chromosome segregation; Category No. 12713—regulation of chronic inflammatory response; Category No. 12714—regulation of cilium assembly; Category No. 12715—regulation of cilium beat frequency; Category No. 12716—regulation of cilium beat frequency involved in ciliary motility; Category No. 12717—regulation of circadian rhythm; Category No. 12718—regulation of circadian sleep wake cycle; Category No. 12719—regulation of clathrin-mediated endocytosis; Category No. 12720—regulation of cohesin localization to chromatin; Category No. 12721—regulation of collagen catabolic process; Category No. 12722—regulation of collagen metabolic process; Category No. 12723—regulation of collateral sprouting of intact axon in response to injury; Category No. 12724—regulation of complement activation; Category No. 12725—regulation of copper ion transmembrane transport; Category No. 12726—regulation of corticosterone secretion; Category No. 12727—regulation of corticotropin secretion; Category No. 12728—regulation of corticotropin-releasing hormone secretion; Category No. 12729—regulation of cyclase activity; Category No. 12730—regulation of cyclic nucleotide biosynthetic process; Category No. 12731—regulation of cyclic nucleotide-gated ion channel activity; Category No. 12732—regulation of cyclin-dependent protein serine threonine kinase activity; Category No. 12733—regulation of cysteine-type endopeptidase activity; Category No. 12734—regulation of cysteine-type endopeptidase activity involved in apoptotic process; Category No. 12735—regulation of cytokine activity; Category No. 12736—regulation of cytokine biosynthetic process; Category No. 12737—regulation of cytokine production; Category No. 12738—regulation of cytokine production involved in immune response; Category No. 12739—regulation of cytokine production involved in inflammatory response; Category No. 12740—regulation of cytokine secretion; Category No. 12741—regulation of cytokine secretion involved in immune response; Category No. 12742—regulation of cytokine-mediated signaling pathway; Category No. 12743—regulation of cytokinesis; Category No. 12744—regulation of cytoplasmic mRNA processing body assembly; Category No. 12745—regulation of cytoplasmic translation; Category No. 12746—regulation of cytoskeleton organization; Category No. 12747—regulation of defense response to bacterium; Category No. 12748—regulation of defense response to virus; Category No. 12749—regulation of defense response to virus by host; Category No. 12750—regulation of defense response to virus by virus; Category No. 12751—regulation of definitive erythrocyte differentiation; Category No. 12752—regulation of delayed rectifier potassium channel activity; Category No. 12753—regulation of dendrite development; Category No. 12754—regulation of dendrite morphogenesis; Category No. 12755—regulation of dendritic cell chemotaxis; Category No. 12756—regulation of dendritic cell cytokine production; Category No. 12757—regulation of dendritic cell dendrite assembly; Category No. 12758—regulation of dendritic cell differentiation; Category No. 12759—regulation of dendritic spine development; Category No. 12760—regulation of dendritic spine morphogenesis; Category No. 12761—regulation of dephosphorylation; Category No. 12762—regulation of development; Category No. 12763—regulation of developmental growth; Category No. 12764—regulation of developmental pigmentation; Category No. 12765—regulation of developmental process; Category No. 12766—regulation of digestive system process; Category No. 12767—regulation of DNA binding; Category No. 12768—regulation of DNA biosynthetic process; Category No. 12769—regulation of DNA damage checkpoint; Category No. 12770—regulation of DNA damage response; Category No. 12771—regulation of DNA endoreduplication; Category No. 12772—regulation of DNA methylation; Category No. 12773—regulation of DNA recombination; Category No. 12774—regulation of DNA repair; Category No. 12775—regulation of DNA replication; Category No. 12776—regulation of DNA-dependent DNA replication initiation; Category No. 12777—regulation of DNA-templated transcription; Category No. 12778—regulation of DNA-templated transcription in response to stress; Category No. 12779—regulation of dopamine metabolic process; Category No. 12780—regulation of dopamine receptor signaling pathway; Category No. 12781—regulation of dopamine secretion; Category No. 12782—regulation of dopamine uptake involved in synaptic transmission; Category No. 12783—regulation of dopaminergic neuron differentiation; Category No. 12784—regulation of dosage compensation by inactivation of X chromosome; Category No. 12785—regulation of double-strand break repair; Category No. 12786—regulation of double-strand break repair via homologous recombination; Category No. 12787—regulation of double-strand break repair via nonhomologous end joining; Category No. 12788—regulation of early endosome to late endosome transport; Category No. 12789—regulation of early endosome to recycling endosome transport; Category No. 12790—regulation of eIF2 alpha phosphorylation by amino acid starvation; Category No. 12791—regulation of eIF2 alpha phosphorylation by dsRNA; Category No. 12792—regulation of eIF2 alpha phosphorylation by heme; Category No. 12793—regulation of embryonic cell shape; Category No. 12794—regulation of embryonic development; Category No. 12795—regulation of enamel mineralization; Category No. 12796—regulation of endocannabinoid signaling pathway; Category No. 12797—regulation of endocytic recycling; Category No. 12798—regulation of endocytosis; Category No. 12799—regulation of endodeoxyribonuclease activity; Category No. 12800—regulation of endodermal cell fate specification; Category No. 12801—regulation of endopeptidase activity; Category No. 12802—regulation of endoplasmic reticulum stress-induced eIF2 alpha phosphorylation; Category No. 12803—regulation of endoplasmic reticulum stress-induced intrinsic apoptotic signaling pathway; Category No. 12804—regulation of endoplasmic reticulum unfolded protein response; Category No. 12805—regulation of endoribonuclease activity; Category No. 12806—regulation of endosome size; Category No. 12807—regulation of endothelial cell apoptotic process; Category No. 12808—regulation of endothelial cell chemotaxis to fibroblast growth factor; Category No. 12809—regulation of endothelial cell differentiation; Category No. 12810—regulation of endothelial cell migration; Category No. 12811—regulation of endothelial cell proliferation; Category No. 12812—regulation of endothelial tube morphogenesis; Category No. 12813—regulation of energy homeostasis; Category No. 12814—regulation of engulfment of apoptotic cell; Category No. 12815—regulation of entry of bacterium into host cell; Category No. 12816—regulation of epidermal cell differentiation; Category No. 12817—regulation of epidermal cell division; Category No. 12818—regulation of epidermal growth factor receptor signaling pathway; Category No. 12819—regulation of epidermal growth factor-activated receptor activity; Category No. 12820—regulation of epidermis development; Category No. 12821—regulation of epithelial cell differentiation; Category No. 12822—regulation of epithelial cell differentiation involved in kidney development; Category No. 12823—regulation of epithelial cell migration; Category No. 12824—regulation of epithelial cell proliferation; Category No. 12825—regulation of epithelial cell proliferation involved in lung morphogenesis; Category No. 12826—regulation of epithelial cell proliferation involved in prostate gland development; Category No. 12827—regulation of epithelial to mesenchymal transition; Category No. 12828—regulation of ER to Golgi vesicle-mediated transport; Category No. 12829—regulation of ERAD pathway; Category No. 12830—regulation of ER-associated ubiquitin-dependent protein catabolic process; Category No. 12831—regulation of ERBB signaling pathway; Category No. 12832—regulation of ERK1 and ERK2 cascade; Category No. 12833—regulation of erythrocyte differentiation; Category No. 12834—regulation of establishment of blood-brain barrier; Category No. 12835—regulation of establishment of cell polarity; Category No. 12836—regulation of establishment of endothelial barrier; Category No. 12837—regulation of establishment of planar polarity; Category No. 12838—regulation of establishment of planar polarity involved in neural tube closure; Category No. 12839—regulation of establishment of protein localization; Category No. 12840—regulation of establishment of protein localization to chromosome; Category No. 12841—regulation of establishment of protein localization to plasma membrane; Category No. 12842—regulation of establishment of T cell polarity; Category No. 12843—regulation of establishment or maintenance of cell polarity; Category No. 12844—regulation of estradiol secretion; Category No. 12845—regulation of excitatory postsynaptic membrane potential involved in skeletal muscle contraction; Category No. 12846—regulation of excretion; Category No. 12847—regulation of execution phase of apoptosis; Category No. 12848—regulation of exit from mitosis; Category No. 12849—regulation of exocyst assembly; Category No. 12850—regulation of exocyst localization; Category No. 12851—regulation of exocytosis; Category No. 12852—regulation of extracellular exosome assembly; Category No. 12853—regulation of extracellular matrix assembly; Category No. 12854—regulation of extracellular matrix disassembly; Category No. 12855—regulation of extracellular matrix organization; Category No. 12856—regulation of extrinsic apoptotic signaling pathway; Category No. 12857—regulation of extrinsic apoptotic signaling pathway in absence of ligand; Category No. 12858—regulation of extrinsic apoptotic signaling pathway via death domain receptors; Category No. 12859—regulation of eye pigmentation; Category No. 12860—regulation of Fas signaling pathway; Category No. 12861—regulation of fat cell differentiation; Category No. 12862—regulation of fatty acid beta-oxidation; Category No. 12863—regulation of fatty acid biosynthetic process; Category No. 12864—regulation of fatty acid metabolic process; Category No. 12865—regulation of fatty acid oxidation; Category No. 12866—regulation of fatty acid transport; Category No. 12867—regulation of Fc receptor mediated stimulatory signaling pathway; Category No. 12868—regulation of feeding behavior; Category No. 12869—regulation of female gonad development; Category No. 12870—regulation of female receptivity; Category No. 12871—regulation of ferrochelatase activity; Category No. 12872—regulation of fertilization; Category No. 12873—regulation of fever generation; Category No. 12874—regulation of fibril organization; Category No. 12875—regulation of fibrinolysis; Category No. 12876—regulation of fibroblast apoptotic process; Category No. 12877—regulation of fibroblast growth factor receptor signaling pathway; Category No. 12878—regulation of fibroblast growth factor receptor signaling pathway involved in neural plate anterior posterior pattern formation; Category No. 12879—regulation of fibroblast migration; Category No. 12880—regulation of fibroblast proliferation; Category No. 12881—regulation of filopodium assembly; Category No. 12882—regulation of focal adhesion assembly; Category No. 12883—regulation of follicle-stimulating hormone secretion; Category No. 12884—regulation of forebrain neuron differentiation; Category No. 12885—regulation of fusion of sperm to egg plasma membrane; Category No. 12886—regulation of G1 S transition of mitotic cell cycle; Category No. 12887—regulation of G2 M transition of mitotic cell cycle; Category No. 12888—regulation of gamma-delta T cell differentiation; Category No. 12889—regulation of gastric acid secretion; Category No. 12890—regulation of gastrulation; Category No. 12891—regulation of gene expression; Category No. 12892—regulation of gene expression by genetic imprinting; Category No. 12893—regulation of gene silencing; Category No. 12894—regulation of gene silencing by miRNA; Category No. 12895—regulation of generation of L-type calcium current; Category No. 12896—regulation of generation of precursor metabolites and energy; Category No. 12897—regulation of genetic imprinting; Category No. 12898—regulation of germinal center formation; Category No. 12899—regulation of glial cell differentiation; Category No. 12900—regulation of glial cell migration; Category No. 12901—regulation of glial cell proliferation; Category No. 12902—regulation of gliogenesis; Category No. 12903—regulation of glomerular filtration; Category No. 12904—regulation of glucagon secretion; Category No. 12905—regulation of glucocorticoid biosynthetic process; Category No. 12906—regulation of glucocorticoid mediated signaling pathway; Category No. 12907—regulation of glucocorticoid metabolic process; Category No. 12908—regulation of gluconeogenesis; Category No. 12909—regulation of gluconeogenesis by regulation of transcription from RNA polymerase II promoter; Category No. 12910—regulation of gluconeogenesis involved in cellular glucose homeostasis; Category No. 12911—regulation of glucose import; Category No. 12912—regulation of glucose import in response to insulin stimulus; Category No. 12913—regulation of glucose metabolic process; Category No. 12914—regulation of glucose transport; Category No. 12915—regulation of glutamate metabolic process; Category No. 12916—regulation of glutamate secretion; Category No. 12917—regulation of glutamate uptake involved in transmission of nerve impulse; Category No. 12918—regulation of glutamine family amino acid metabolic process; Category No. 12919—regulation of glycogen (starch) synthase activity; Category No. 12920—regulation of glycogen biosynthetic process; Category No. 12921—regulation of glycogen catabolic process; Category No. 12922—regulation of glycogen metabolic process; Category No. 12923—regulation of glycolytic process; Category No. 12924—regulation of glycolytic process by negative regulation of transcription from RNA polymerase II promoter; Category No. 12925—regulation of glycolytic process by positive regulation of transcription from RNA polymerase II promoter; Category No. 12926—regulation of glycoprotein biosynthetic process; Category No. 12927—regulation of Golgi inheritance; Category No. 12928—regulation of Golgi organization; Category No. 12929—regulation of Golgi to plasma membrane protein transport; Category No. 12930—regulation of G-protein activated inward rectifier potassium channel activity; Category No. 12931—regulation of G-protein coupled receptor protein signaling pathway; Category No. 12932—regulation of granulocyte chemotaxis; Category No. 12933—regulation of granulocyte differentiation; Category No. 12934—regulation of granulocyte macrophage colony-stimulating factor biosynthetic process; Category No. 12935—regulation of grooming behavior; Category No. 12936—regulation of growth; Category No. 12937—regulation of growth hormone receptor signaling pathway; Category No. 12938—regulation of growth hormone secretion; Category No. 12939—regulation of growth plate cartilage chondrocyte proliferation; Category No. 12940—regulation of growth rate; Category No. 12941—regulation of GTP binding; Category No. 12942—regulation of GTPase activity; Category No. 12943—regulation of guanylate cyclase activity; Category No. 12944—regulation of hair cycle; Category No. 12945—regulation of hair cycle by canonical Wnt signaling pathway; Category No. 12946—regulation of hair follicle cell proliferation; Category No. 12947—regulation of hair follicle development; Category No. 12948—regulation of heart contraction; Category No. 12949—regulation of heart growth; Category No. 12950—regulation of heart induction by regulation of canonical Wnt signaling pathway; Category No. 12951—regulation of heart looping; Category No. 12952—regulation of heart morphogenesis; Category No. 12953—regulation of heart rate; Category No. 12954—regulation of heart rate by cardiac conduction; Category No. 12955—regulation of heart rate by chemical signal; Category No. 12956—regulation of heart rate by hormone; Category No. 12957—regulation of hematopoietic progenitor cell differentiation; Category No. 12958—regulation of hematopoietic stem cell differentiation; Category No. 12959—regulation of hematopoietic stem cell proliferation; Category No. 12960—regulation of hemoglobin biosynthetic process; Category No. 12961—regulation of hemopoiesis; Category No. 12962—regulation of hepatocyte growth factor receptor signaling pathway; Category No. 12963—regulation of hepatocyte proliferation; Category No. 12964—regulation of high voltage-gated calcium channel activity; Category No. 12965—regulation of high-density lipoprotein particle assembly; Category No. 12966—regulation of hindgut contraction; Category No. 12967—regulation of hippo signaling; Category No. 12968—regulation of histone acetylation; Category No. 12969—regulation of histone deacetylase activity; Category No. 12970—regulation of histone deacetylation; Category No. 12971—regulation of histone H3-K14 acetylation; Category No. 12972—regulation of histone H3-K27 acetylation; Category No. 12973—regulation of histone H3-K27 methylation; Category No. 12974—regulation of histone H3-K36 methylation; Category No. 12975—regulation of histone H3-K36 trimethylation; Category No. 12976—regulation of histone H3-K4 methylation; Category No. 12977—regulation of histone H3-K9 acetylation; Category No. 12978—regulation of histone H3-K9 methylation; Category No. 12979—regulation of histone H4 acetylation; Category No. 12980—regulation of histone methylation; Category No. 12981—regulation of histone modification; Category No. 12982—regulation of histone ubiquitination; Category No. 12983—regulation of homocysteine metabolic process; Category No. 12984—regulation of homologous chromosome segregation; Category No. 12985—regulation of hormone biosynthetic process; Category No. 12986—regulation of hormone levels; Category No. 12987—regulation of hormone metabolic process; Category No. 12988—regulation of hormone secretion; Category No. 12989—regulation of humoral immune response; Category No. 12990—regulation of humoral immune response mediated by circulating immunoglobulin; Category No. 12991—regulation of hydrogen peroxide metabolic process; Category No. 12992—regulation of hydrogen peroxide-induced cell death; Category No. 12993—regulation of 1-kappaB kinase NF-kappaB signaling; Category No. 12994—regulation of immune response; Category No. 12995—regulation of immune system process; Category No. 12996—regulation of immunoglobulin production; Category No. 12997—regulation of immunoglobulin secretion; Category No. 12998—regulation of inclusion body assembly; Category No. 12999—regulation of inflammatory response; Category No. 13000—regulation of innate immune response; Category No. 13001—regulation of inositol 1,4,5-trisphosphate-sensitive calcium-release channel activity; Category No. 13002—regulation of inositol trisphosphate biosynthetic process; Category No. 13003—regulation of insulin receptor signaling pathway; Category No. 13004—regulation of insulin secretion; Category No. 13005—regulation of insulin secretion involved in cellular response to glucose stimulus; Category No. 13006—regulation of insulin-like growth factor receptor signaling pathway; Category No. 13007—regulation of integrin activation; Category No. 13008—regulation of integrin biosynthetic process; Category No. 13009—regulation of integrin-mediated signaling pathway;

Category No. 13010—regulation of interferon-beta production; Category No. 13011—regulation of interferon-gamma production; Category No. 13012—regulation of interferon-gamma-mediated signaling pathway; Category No. 13013—regulation of interleukin-1 beta production; Category No. 13014—regulation of interleukin-1 beta secretion; Category No. 13015—regulation of interleukin-1 production; Category No. 13016—regulation of interleukin-12 biosynthetic process; Category No. 13017—regulation of interleukin-12 secretion; Category No. 13018—regulation of interleukin-18 biosynthetic process; Category No. 13019—regulation of interleukin-1-mediated signaling pathway; Category No. 13020—regulation of interleukin-2 biosynthetic process; Category No. 13021—regulation of interleukin-23 production; Category No. 13022—regulation of interleukin-5 production; Category No. 13023—regulation of interleukin-6 biosynthetic process; Category No. 13024—regulation of interleukin-6 production; Category No. 13025—regulation of interleukin-8 biosynthetic process; Category No. 13026—regulation of interleukin-8 secretion; Category No. 13027—regulation of intestinal cholesterol absorption; Category No. 13028—regulation of intestinal epithelial structure maintenance; Category No. 13029—regulation of intracellular cholesterol transport; Category No. 13030—regulation of intracellular estrogen receptor signaling pathway; Category No. 13031—regulation of intracellular pH; Category No. 13032—regulation of intracellular protein transport; Category No. 13033—regulation of intracellular signal transduction; Category No. 13034—regulation of intracellular steroid hormone receptor signaling pathway; Category No. 13035—regulation of intracellular transport; Category No. 13036—regulation of intrinsic apoptotic signaling pathway; Category No. 13037—regulation of intrinsic apoptotic signaling pathway by p53 class mediator; Category No. 13038—regulation of intrinsic apoptotic signaling pathway in response to DNA damage by p53 class mediator; Category No. 13039—regulation of inward rectifier potassium channel activity; Category No. 13040—regulation of ion homeostasis; Category No. 13041—regulation of ion transmembrane transport; Category No. 13042—regulation of ion transmembrane transporter activity; Category No. 13043—regulation of ion transport; Category No. 13044—regulation of IRE1-mediated unfolded protein response; Category No. 13045—regulation of isoprenoid metabolic process; Category No. 13046—regulation of isotype switching; Category No. 13047—regulation of isotype switching to IgG isotypes; Category No. 13048—regulation of JAK-STAT cascade; Category No. 13049—regulation of JNK cascade; Category No. 13050—regulation of JUN kinase activity; Category No. 13051—regulation of kainate selective glutamate receptor activity; Category No. 13052—regulation of keratinocyte differentiation; Category No. 13053—regulation of keratinocyte proliferation; Category No. 13054—regulation of ketone biosynthetic process; Category No. 13055—regulation of kidney size; Category No. 13056—regulation of killing of cells of other organism; Category No. 13057—regulation of kinase activity; Category No. 13058—regulation of kinetochore assembly; Category No. 13059—regulation of lamellipodium assembly; Category No. 13060—regulation of lamellipodium morphogenesis; Category No. 13061—regulation of L-arginine import; Category No. 13062—regulation of lateral mesodermal cell fate specification; Category No. 13063—regulation of lateral pseudopodium assembly; Category No. 13064—regulation of leukocyte chemotaxis; Category No. 13065—regulation of leukocyte mediated cytotoxicity; Category No. 13066—regulation of leukocyte migration; Category No. 13067—regulation of L-glutamate transport; Category No. 13068—regulation of lipid biosynthetic process; Category No. 13069—regulation of lipid catabolic process; Category No. 13070—regulation of lipid kinase activity; Category No. 13071—regulation of lipid metabolic process; Category No. 13072—regulation of lipid storage; Category No. 13073—regulation of lipid transport; Category No. 13074—regulation of lipid transport by negative regulation of transcription from RNA polymerase II promoter; Category No. 13075—regulation of lipid transport by positive regulation of transcription from RNA polymerase II promoter; Category No. 13076—regulation of lipopolysaccharide-mediated signaling pathway; Category No. 13077—regulation of lipoprotein lipid oxidation; Category No. 13078—regulation of lipoprotein metabolic process; Category No. 13079—regulation of liquid surface tension; Category No. 13080—regulation of locomotion; Category No. 13081—regulation of locomotion involved in locomotory behavior; Category No. 13082—regulation of locomotor rhythm; Category No. 13083—regulation of long term synaptic depression; Category No. 13084—regulation of long-term neuronal synaptic plasticity; Category No. 13085—regulation of long-term synaptic potentiation; Category No. 13086—regulation of low-density lipoprotein particle clearance; Category No. 13087—regulation of low-density lipoprotein particle receptor biosynthetic process; Category No. 13088—regulation of low-density lipoprotein particle receptor catabolic process; Category No. 13089—regulation of lung blood pressure; Category No. 13090—regulation of lymphocyte activation; Category No. 13091—regulation of lymphocyte apoptotic process; Category No. 13092—regulation of lymphocyte differentiation; Category No. 13093—regulation of lymphocyte migration; Category No. 13094—regulation of lysosomal lumen pH; Category No. 13095—regulation of macroautophagy; Category No. 13096—regulation of macrophage activation; Category No. 13097—regulation of macrophage apoptotic process; Category No. 13098—regulation of macrophage chemotaxis; Category No. 13099—regulation of macrophage colony-stimulating factor production; Category No. 13100—regulation of macrophage derived foam cell differentiation; Category No. 13101—regulation of macrophage migration inhibitory factor signaling pathway; Category No. 13102—regulation of male germ cell proliferation; Category No. 13103—regulation of mammary gland epithelial cell proliferation; Category No. 13104—regulation of MAP kinase activity; Category No. 13105—regulation of MAPK cascade; Category No. 13106—regulation of MAPK export from nucleus; Category No. 13107—regulation of mast cell activation; Category No. 13108—regulation of mast cell apoptotic process; Category No. 13109—regulation of mast cell chemotaxis; Category No. 13110—regulation of mast cell degranulation; Category No. 13111—regulation of mast cell differentiation; Category No. 13112—regulation of megakaryocyte differentiation; Category No. 13113—regulation of meiosis I; Category No. 13114—regulation of meiotic cell cycle; Category No. 13115—regulation of meiotic cell cycle process involved in oocyte maturation; Category No. 13116—regulation of meiotic nuclear division; Category No. 13117—regulation of melanin biosynthetic process; Category No. 13118—regulation of melanocyte differentiation; Category No. 13119—regulation of melanosome organization; Category No. 13120—regulation of melanosome transport; Category No. 13121—regulation of membrane depolarization; Category No. 13122—regulation of membrane depolarization during action potential; Category No. 13123—regulation of membrane depolarization during cardiac muscle cell action potential; Category No. 13124—regulation of membrane lipid distribution; Category No. 13125—regulation of membrane permeability; Category No. 13126—regulation of membrane potential; Category No. 13127—regulation of membrane repolarization; Category No. 13128—regulation of membrane repolarization during action potential; Category No. 13129—regulation of memory T cell differentiation; Category No. 13130—regulation of mesenchymal cell proliferation; Category No. 13131—regulation of mesenchymal cell proliferation involved in prostate gland development; Category No. 13132—regulation of mesenchymal stem cell differentiation; Category No. 13133—regulation of mesenchymal to epithelial transition involved in metanephros morphogenesis; Category No. 13134—regulation of mesodermal cell fate specification; Category No. 13135—regulation of metabolic process; Category No. 13136—regulation of metalloenzyme activity; Category No. 13137—regulation of metanephric nephron tubule epithelial cell differentiation; Category No. 13138—regulation of metanephros size; Category No. 13139—regulation of metaphase plate congression; Category No. 13140—regulation of methylation-dependent chromatin silencing; Category No. 13141—regulation of MHC class I biosynthetic process; Category No. 13142—regulation of microglial cell migration; Category No. 13143—regulation of microtubule cytoskeleton organization; Category No. 13144—regulation of microtubule motor activity; Category No. 13145—regulation of microtubule nucleation; Category No. 13146—regulation of microtubule polymerization; Category No. 13147—regulation of microtubule polymerization or depolymerization; Category No. 13148—regulation of microtubule-based movement; Category No. 13149—regulation of microtubule-based process; Category No. 13150—regulation of microvillus assembly; Category No. 13151—regulation of microvillus length; Category No. 13152—regulation of miRNA metabolic process; Category No. 13153—regulation of mismatch repair; Category No. 13154—regulation of mitochondrial depolarization; Category No. 13155—regulation of mitochondrial DNA metabolic process; Category No. 13156—regulation of mitochondrial fission; Category No. 13157—regulation of mitochondrial fusion; Category No. 13158—regulation of mitochondrial membrane permeability; Category No. 13159—regulation of mitochondrial membrane permeability involved in apoptotic process; Category No. 13160—regulation of mitochondrial membrane permeability involved in programmed necrotic cell death; Category No. 13161—regulation of mitochondrial membrane potential; Category No. 13162—regulation of mitochondrial outer membrane permeabilization involved in apoptotic signaling pathway; Category No. 13163—regulation of mitochondrial translation; Category No. 13164—regulation of mitochondrion organization; Category No. 13165—regulation of mitophagy; Category No. 13166—regulation of mitotic cell cycle; Category No. 13167—regulation of mitotic cell cycle phase transition; Category No. 13168—regulation of mitotic cell cycle spindle assembly checkpoint; Category No. 13169—regulation of mitotic centrosome separation; Category No. 13170—regulation of mitotic metaphase anaphase transition; Category No. 13171—regulation of mitotic nuclear division; Category No. 13172—regulation of mitotic recombination; Category No. 13173—regulation of mitotic sister chromatid separation; Category No. 13174—regulation of mitotic spindle assembly; Category No. 13175—regulation of mitotic spindle organization; Category No. 13176—regulation of molecular function; Category No. 13177—regulation of monocyte chemotaxis; Category No. 13178—regulation of monocyte differentiation; Category No. 13179—regulation of morphogenesis of a branching structure; Category No. 13180—regulation of motor neuron apoptotic process; Category No. 13181—regulation of mRNA 3-end processing; Category No. 13182—regulation of mRNA binding; Category No. 13183—regulation of mRNA export from nucleus; Category No. 13184—regulation of mRNA processing; Category No. 13185—regulation of mRNA splicing; Category No. 13186—regulation of mRNA stability; Category No. 13187—regulation of mRNA stability involved in response to stress; Category No. 13188—regulation of mucus secretion; Category No. 13189—regulation of multicellular organism growth; Category No. 13190—regulation of multivesicular body size; Category No. 13191—regulation of multivesicular body size involved in endosome transport; Category No. 13192—regulation of muscle cell apoptotic process; Category No. 13193—regulation of muscle cell differentiation; Category No. 13194—regulation of muscle contraction; Category No. 13195—regulation of muscle filament sliding; Category No. 13196—regulation of muscle filament sliding speed; Category No. 13197—regulation of muscle system process; Category No. 13198—regulation of MyD88-dependent toll-like receptor signaling pathway; Category No. 13199—regulation of MyD88-independent toll-like receptor signaling pathway; Category No. 13200—regulation of myelination; Category No. 13201—regulation of myeloid cell apoptotic process; Category No. 13202—regulation of myeloid cell differentiation; Category No. 13203—regulation of myeloid dendritic cell activation; Category No. 13204—regulation of myeloid leukocyte differentiation; Category No. 13205—regulation of myoblast differentiation; Category No. 13206—regulation of myoblast fusion; Category No. 13207—regulation of myoblast proliferation; Category No. 13208—regulation of myosin II filament organization; Category No. 13209—regulation of myosin-light-chain-phosphatase activity; Category No. 13210—regulation of myotube differentiation; Category No. 13211—regulation of NAD(P)H oxidase activity; Category No. 13212—regulation of NADP metabolic process; Category No. 13213—regulation of natural killer cell apoptotic process; Category No. 13214—regulation of natural killer cell mediated cytotoxicity; Category No. 13215—regulation of natural killer cell proliferation; Category No. 13216—regulation of necroptotic process; Category No. 13217—regulation of necrotic cell death; Category No. 13218—regulation of negative chemotaxis; Category No. 13219—regulation of nephron tubule epithelial cell differentiation; Category No. 13220—regulation of nerve growth factor receptor activity; Category No. 13221—regulation of nervous system development; Category No. 13222—regulation of neural precursor cell proliferation; Category No. 13223—regulation of neural retina development; Category No. 13224—regulation of neuroblast proliferation; Category No. 13225—regulation of neurogenesis; Category No. 13226—regulation of neurological system process; Category No. 13227—regulation of neuron apoptotic process; Category No. 13228—regulation of neuron death; Category No. 13229—regulation of neuron differentiation; Category No. 13230—regulation of neuron maturation; Category No. 13231—regulation of neuron migration; Category No. 13232—regulation of neuron projection development; Category No. 13233—regulation of neuron projection regeneration; Category No. 13234—regulation of neuronal action potential; Category No. 13235—regulation of neuronal signal transduction; Category No. 13236—regulation of neuronal synaptic plasticity; Category No. 13237—regulation of neurotransmitter levels; Category No. 13238—regulation of neurotransmitter secretion; Category No. 13239—regulation of neurotransmitter uptake; Category No. 13240—regulation of neurotrophin TRK receptor signaling pathway; Category No. 13241—regulation of neutrophil chemotaxis; Category No. 13242—regulation of neutrophil degranulation; Category No. 13243—regulation of neutrophil migration; Category No. 13244—regulation of NF-kappaB import into nucleus; Category No. 13245—regulation of NIK NF-kappaB signaling; Category No. 13246—regulation of nitric oxide biosynthetic process; Category No. 13247—regulation of nitric oxide metabolic process; Category No. 13248—regulation of nitric-oxide synthase activity; Category No. 13249—regulation of nitrogen compound metabolic process; Category No. 13250—regulation of nitrogen utilization; Category No. 13251—regulation of NLRP3 inflammasome complex assembly; Category No. 13252—regulation of N-methyl-D-aspartate selective glutamate receptor activity; Category No. 13253—regulation of nodal signaling pathway; Category No. 13254—regulation of nodal signaling pathway involved in determination of lateral mesoderm left right asymmetry; Category No. 13255—regulation of nonmotile primary cilium assembly; Category No. 13256—regulation of norepinephrine secretion; Category No. 13257—regulation of Notch signaling pathway; Category No. 13258—regulation of nuclear cell cycle DNA replication; Category No. 13259—regulation of nucleic acid-templated transcription; Category No. 13260—regulation of nucleocytoplasmic transport; Category No. 13261—regulation of nucleotide-binding oligomerization domain containing signaling pathway; Category No. 13262—regulation of nucleotide-excision repair; Category No. 13263—regulation of nucleus size; Category No. 13264—regulation of odontogenesis; Category No. 13265—regulation of odontogenesis of dentin-containing tooth; Category No. 13266—regulation of oligodendrocyte differentiation; Category No. 13267—regulation of oligodendrocyte progenitor proliferation; Category No. 13268—regulation of opioid receptor signaling pathway; Category No. 13269—regulation of opsonization; Category No. 13270—regulation of organ formation; Category No. 13271—regulation of organ growth; Category No. 13272—regulation of organ morphogenesis; Category No. 13273—regulation of organelle assembly; Category No. 13274—regulation of organelle organization; Category No. 13275—regulation of organelle transport along microtubule; Category No. 13276—regulation of ossification; Category No. 13277—regulation of osteoblast differentiation; Category No. 13278—regulation of osteoblast proliferation; Category No. 13279—regulation of osteoclast development; Category No. 13280—regulation of osteoclast differentiation; Category No. 13281—regulation of ovarian follicle development; Category No. 13282—regulation of oxidative phosphorylation; Category No. 13283—regulation of oxidative stress-induced intrinsic apoptotic signaling pathway; Category No. 13284—regulation of oxidoreductase activity; Category No. 13285—regulation of oxygen metabolic process; Category No. 13286—regulation of p38MAPK cascade; Category No. 13287—regulation of pathway-restricted SMAD protein phosphorylation; Category No. 13288—regulation of penile erection; Category No. 13289—regulation of pentose-phosphate shunt; Category No. 13290—regulation of peptidase activity; Category No. 13291—regulation of peptide hormone secretion; Category No. 13292—regulation of peptidyl-serine phosphorylation; Category No. 13293—regulation of peptidyl-tyrosine phosphorylation; Category No. 13294—regulation of PERK-mediated unfolded protein response; Category No. 13295—regulation of peroxisome organization; Category No. 13296—regulation of peroxisome proliferator activated receptor signaling pathway; Category No. 13297—regulation of peroxisome size; Category No. 13298—regulation of pH; Category No. 13299—regulation of phagocytosis; Category No. 13300—regulation of phosphatase activity; Category No. 13301—regulation of phosphate transport; Category No. 13302—regulation of phosphatidylcholine catabolic process; Category No. 13303—regulation of phosphatidylinositol 3-kinase activity; Category No. 13304—regulation of phosphatidylinositol 3-kinase signaling; Category No. 13305—regulation of phosphatidylinositol dephosphorylation; Category No. 13306—regulation of phospholipase A2 activity; Category No. 13307—regulation of phospholipase activity; Category No. 13308—regulation of phospholipid biosynthetic process; Category No. 13309—regulation of phospholipid catabolic process; Category No. 13310—regulation of phospholipid metabolic process; Category No. 13311—regulation of phosphoprotein phosphatase activity; Category No. 13312—regulation of phosphorus metabolic process; Category No. 13313—regulation of phosphorylation; Category No. 13314—regulation of phosphorylation of RNA polymerase II C-terminal domain; Category No. 13315—regulation of planar cell polarity pathway involved in neural tube closure; Category No. 13316—regulation of plasma lipoprotein particle levels; Category No. 13317—regulation of plasma membrane raft polarization; Category No. 13318—regulation of plasma membrane sterol distribution; Category No. 13319—regulation of platelet activation; Category No. 13320—regulation of platelet aggregation; Category No. 13321—regulation of platelet-derived growth factor production; Category No. 13322—regulation of platelet-derived growth factor receptor signaling pathway; Category No. 13323—regulation of podosome assembly; Category No. 13324—regulation of positive thymic T cell selection; Category No. 13325—regulation of postsynaptic density protein 95 clustering; Category No. 13326—regulation of postsynaptic membrane organization; Category No. 13327—regulation of postsynaptic membrane potential; Category No. 13328—regulation of potassium ion transmembrane transport; Category No. 13329—regulation of potassium ion transmembrane transporter activity; Category No. 13330—regulation of potassium ion transport; Category No. 13331—regulation of primitive erythrocyte differentiation; Category No. 13332—regulation of pro-B cell differentiation; Category No. 13333—regulation of progesterone secretion; Category No. 13334—regulation of programmed cell death; Category No. 13335—regulation of pronephros size; Category No. 13336—regulation of prostatic bud formation; Category No. 13337—regulation of proteasomal protein catabolic process; Category No. 13338—regulation of proteasomal ubiquitin-dependent protein catabolic process; Category No. 13339—regulation of protein ADP-ribosylation; Category No. 13340—regulation of protein autophosphorylation; Category No. 13341—regulation of protein autoubiquitination; Category No. 13342—regulation of protein binding; Category No. 13343—regulation of protein catabolic process; Category No. 13344—regulation of protein complex assembly; Category No. 13345—regulation of protein complex disassembly; Category No. 13346—regulation of protein complex stability; Category No. 13347—regulation of protein deacetylation; Category No. 13348—regulation of protein dephosphorylation; Category No. 13349—regulation of protein depolymerization; Category No. 13350—regulation of protein deubiquitination; Category No. 13351—regulation of protein exit from endoplasmic reticulum; Category No. 13352—regulation of protein export from nucleus; Category No. 13353—regulation of protein folding in endoplasmic reticulum; Category No. 13354—regulation of protein glycosylation; Category No. 13355—regulation of protein heterodimerization activity; Category No. 13356—regulation of protein homodimerization activity; Category No. 13357—regulation of protein import into nucleus; Category No. 13358—regulation of protein K63-linked ubiquitination; Category No. 13359—regulation of protein kinase A signaling; Category No. 13360—regulation of protein kinase activity; Category No. 13361—regulation of protein kinase B signaling; Category No. 13362—regulation of protein kinase C signaling; Category No. 13363—regulation of protein localization; Category No. 13364—regulation of protein localization to cell surface; Category No. 13365—regulation of protein localization to nucleus; Category No. 13366—regulation of protein localization to plasma membrane; Category No. 13367—regulation of protein metabolic process; Category No. 13368—regulation of protein monoubiquitination; Category No. 13369—regulation of protein oligomerization; Category No. 13370—regulation of protein phosphatase type 2A activity; Category No. 13371—regulation of protein phosphorylation; Category No. 13372—regulation of protein processing; Category No. 13373—regulation of protein secretion; Category No. 13374—regulation of protein serine threonine kinase activity; Category No. 13375—regulation of protein serine threonine phosphatase activity; Category No. 13376—regulation of protein stability; Category No. 13377—regulation of protein sumoylation; Category No. 13378—regulation of protein targeting; Category No. 13379—regulation of protein targeting to mitochondrion; Category No. 13380—regulation of protein targeting to vacuolar membrane; Category No. 13381—regulation of protein transport; Category No. 13382—regulation of protein tyrosine kinase activity; Category No. 13383—regulation of protein ubiquitination; Category No. 13384—regulation of protein ubiquitination involved in ubiquitin-dependent protein catabolic process; Category No. 13385—regulation of proteinase activated receptor activity; Category No. 13386—regulation of proteolysis; Category No. 13387—regulation of proton transport; Category No. 13388—regulation of proton-transporting ATPase activity; Category No. 13389—regulation of Purkinje myocyte action potential; Category No. 13390—regulation of pyruvate dehydrogenase activity; Category No. 13391—regulation of Rab protein signal transduction; Category No. 13392—regulation of Rac protein signal transduction; Category No. 13393—regulation of Ral protein signal transduction; Category No. 13394—regulation of Rap protein signal transduction; Category No. 13395—regulation of Ras protein signal transduction; Category No. 13396—regulation of reactive oxygen species biosynthetic process; Category No. 13397—regulation of reactive oxygen species metabolic process; Category No. 13398—regulation of receptor activity; Category No. 13399—regulation of receptor biosynthetic process; Category No. 13400—regulation of receptor clustering; Category No. 13401—regulation of receptor internalization; Category No. 13402—regulation of receptor recycling; Category No. 13403—regulation of receptor-mediated endocytosis; Category No. 13404—regulation of regulated secretory pathway; Category No. 13405—regulation of regulatory T cell differentiation; Category No. 13406—regulation of relaxation of cardiac muscle; Category No. 13407—regulation of relaxation of muscle; Category No. 13408—regulation of release of sequestered calcium ion into cytosol; Category No. 13409—regulation of release of sequestered calcium ion into cytosol by sarcoplasmic reticulum; Category No. 13410—regulation of removal of superoxide radicals; Category No. 13411—regulation of renal output by angiotensin; Category No. 13412—regulation of renal sodium excretion; Category No. 13413—regulation of renin secretion into blood stream; Category No. 13414—regulation of replicative cell aging; Category No. 13415—regulation of respiratory burst; Category No. 13416—regulation of respiratory gaseous exchange; Category No. 13417—regulation of respiratory gaseous exchange by neurological system process; Category No. 13418—regulation of respiratory system process; Category No. 13419—regulation of response to DNA damage checkpoint signaling; Category No. 13420—regulation of response to DNA damage stimulus; Category No. 13421—regulation of response to drug; Category No. 13422—regulation of response to food; Category No. 13423—regulation of response to interferon-gamma; Category No. 13424—regulation of response to osmotic stress; Category No. 13425—regulation of response to oxidative stress; Category No. 13426—regulation of response to reactive oxygen species; Category No. 13427—regulation of resting membrane potential; Category No. 13428—regulation of restriction endodeoxyribonuclease activity; Category No. 13429—regulation of retinal cell programmed cell death; Category No. 13430—regulation of retinal ganglion cell axon guidance; Category No. 13431—regulation of retinoic acid receptor signaling pathway; Category No. 13432—regulation of retrograde protein transport; Category No. 13433—regulation of retrograde vesicle-mediated transport; Category No. 13434—regulation of Rho guanyl-nucleotide exchange factor activity; Category No. 13435—regulation of Rho protein signal transduction; Category No. 13436—regulation of rhodopsin gene expression; Category No. 13437—regulation of rhodopsin mediated signaling pathway; Category No. 13438—regulation of ribonuclease activity; Category No. 13439—regulation of RIG-I signaling pathway; Category No. 13440—regulation of RNA biosynthetic process; Category No. 13441—regulation of RNA export from nucleus; Category No. 13442—regulation of RNA metabolic process; Category No. 13443—regulation of RNA polymerase II regulatory region sequence-specific DNA binding; Category No. 13444—regulation of RNA polymerase II transcriptional preinitiation complex assembly; Category No. 13445—regulation of RNA splicing; Category No. 13446—regulation of RNA stability; Category No. 13447—regulation of rRNA processing; Category No. 13448—regulation of rubidium ion transport; Category No. 13449—regulation of ruffle assembly; Category No. 13450—regulation of ryanodine-sensitive calcium-release channel activity; Category No. 13451—regulation of SA node cell action potential; Category No. 13452—regulation of saliva secretion; Category No. 13453—regulation of sarcomere organization; Category No. 13454—regulation of satellite cell activation involved in skeletal muscle regeneration; Category No. 13455—regulation of satellite cell proliferation; Category No. 13456—regulation of Schwann cell differentiation; Category No. 13457—regulation of secondary heart field cardioblast proliferation; Category No. 13458—regulation of secretion; Category No. 13459—regulation of sensory perception of pain; Category No. 13460—regulation of sequence-specific DNA binding transcription factor activity; Category No. 13461—regulation of sequestering of calcium ion; Category No. 13462—regulation of sequestering of zinc ion; Category No. 13463—regulation of serotonin secretion; Category No. 13464—regulation of short-term neuronal synaptic plasticity;

Category No. 13465—regulation of signal transduction; Category No. 13466—regulation of signal transduction by p53 class mediator; Category No. 13467—regulation of signal transduction by receptor internalization; Category No. 13468—regulation of signal transduction involved in mitotic G2 DNA damage checkpoint; Category No. 13469—regulation of signaling; Category No. 13470—regulation of single strand break repair; Category No. 13471—regulation of single stranded viral RNA replication via double stranded DNA intermediate; Category No. 13472—regulation of sister chromatid cohesion; Category No. 13473—regulation of skeletal muscle adaptation; Category No. 13474—regulation of skeletal muscle cell differentiation; Category No. 13475—regulation of skeletal muscle contraction; Category No. 13476—regulation of skeletal muscle contraction by calcium ion signaling; Category No. 13477—regulation of skeletal muscle contraction by regulation of release of sequestered calcium ion; Category No. 13478—regulation of skeletal muscle contraction via regulation of action potential; Category No. 13479—regulation of skeletal muscle fiber development; Category No. 13480—regulation of skeletal muscle fiber differentiation; Category No. 13481—regulation of skeletal muscle tissue development; Category No. 13482—regulation of skeletal muscle tissue growth; Category No. 13483—regulation of slow-twitch skeletal muscle fiber contraction; Category No. 13484—regulation of SMAD protein import into nucleus; Category No. 13485—regulation of small GTPase mediated signal transduction; Category No. 13486—regulation of smooth muscle cell apoptotic process; Category No. 13487—regulation of smooth muscle cell differentiation; Category No. 13488—regulation of smooth muscle cell migration; Category No. 13489—regulation of smooth muscle cell proliferation; Category No. 13490—regulation of smooth muscle cell-matrix adhesion; Category No. 13491—regulation of smooth muscle contraction; Category No. 13492—regulation of smoothened signaling pathway; Category No. 13493—regulation of smoothened signaling pathway involved in dorsal ventral neural tube patterning; Category No. 13494—regulation of SNARE complex assembly; Category No. 13495—regulation of sodium ion transmembrane transport; Category No. 13496—regulation of sodium ion transmembrane transporter activity; Category No. 13497—regulation of sodium ion transport; Category No. 13498—regulation of sodium:proton antiporter activity; Category No. 13499—regulation of sodium-dependent phosphate transport; Category No. 13500—regulation of somatostatin secretion; Category No. 13501—regulation of somitogenesis; Category No. 13502—regulation of sperm motility; Category No. 13503—regulation of sphingolipid mediated signaling pathway; Category No. 13504—regulation of spindle assembly; Category No. 13505—regulation of spindle checkpoint; Category No. 13506—regulation of spongiotrophoblast cell proliferation; Category No. 13507—regulation of stem cell differentiation; Category No. 13508—regulation of stem cell division; Category No. 13509—regulation of stem cell population maintenance; Category No. 13510—regulation of stem cell proliferation; Category No. 13511—regulation of steroid biosynthetic process; Category No. 13512—regulation of steroid metabolic process; Category No. 13513—regulation of store-operated calcium channel activity; Category No. 13514—regulation of store-operated calcium entry; Category No. 13515—regulation of stress fiber assembly; Category No. 13516—regulation of stress-activated MAPK cascade; Category No. 13517—regulation of striated muscle cell differentiation; Category No. 13518—regulation of striated muscle contraction; Category No. 13519—regulation of striated muscle tissue development; Category No. 13520—regulation of substrate adhesion-dependent cell spreading; Category No. 13521—regulation of superoxide anion generation; Category No. 13522—regulation of superoxide dismutase activity; Category No. 13523—regulation of synapse assembly; Category No. 13524—regulation of synapse maturation; Category No. 13525—regulation of synapse organization; Category No. 13526—regulation of synapse structural plasticity; Category No. 13527—regulation of synapse structure or activity; Category No. 13528—regulation of synaptic activity; Category No. 13529—regulation of synaptic growth at neuromuscular junction; Category No. 13530—regulation of synaptic plasticity; Category No. 13531—regulation of synaptic plasticity by receptor localization to synapse; Category No. 13532—regulation of synaptic transmission; Category No. 13533—regulation of synaptic vesicle clustering; Category No. 13534—regulation of synaptic vesicle endocytosis; Category No. 13535—regulation of synaptic vesicle exocytosis; Category No. 13536—regulation of synaptic vesicle fusion to presynaptic membrane; Category No. 13537—regulation of synaptic vesicle membrane organization; Category No. 13538—regulation of synaptic vesicle priming; Category No. 13539—regulation of synaptic vesicle recycling; Category No. 13540—regulation of synaptic vesicle transport; Category No. 13541—regulation of systemic arterial blood pressure; Category No. 13542—regulation of systemic arterial blood pressure by aortic arch baroreceptor feedback; Category No. 13543—regulation of systemic arterial blood pressure by atrial natriuretic peptide; Category No. 13544—regulation of systemic arterial blood pressure by baroreceptor feedback; Category No. 13545—regulation of systemic arterial blood pressure by circulatory renin-angiotensin; Category No. 13546—regulation of systemic arterial blood pressure by endothelin; Category No. 13547—regulation of systemic arterial blood pressure by ischemic conditions; Category No. 13548—regulation of systemic arterial blood pressure by norepinephrine-epinephrine; Category No. 13549—regulation of systemic arterial blood pressure by renin-angiotensin; Category No. 13550—regulation of systemic arterial blood pressure by vasopressin; Category No. 13551—regulation of T cell activation; Category No. 13552—regulation of T cell anergy; Category No. 13553—regulation of T cell antigen processing and presentation; Category No. 13554—regulation of T cell apoptotic process; Category No. 13555—regulation of T cell chemotaxis; Category No. 13556—regulation of T cell cytokine production; Category No. 13557—regulation of T cell differentiation; Category No. 13558—regulation of T cell differentiation in thymus; Category No. 13559—regulation of T cell homeostatic proliferation; Category No. 13560—regulation of T cell mediated cytotoxicity; Category No. 13561—regulation of T cell migration; Category No. 13562—regulation of T cell proliferation; Category No. 13563—regulation of T cell receptor signaling pathway; Category No. 13564—regulation of tau-protein kinase activity; Category No. 13565—regulation of telomerase activity; Category No. 13566—regulation of telomere maintenance; Category No. 13567—regulation of telomere maintenance via telomerase; Category No. 13568—regulation of telomere maintenance via telomere lengthening; Category No. 13569—regulation of terminal button organization; Category No. 13570—regulation of testosterone biosynthetic process; Category No. 13571—regulation of the force of heart contraction; Category No. 13572—regulation of the force of heart contraction by cardiac conduction; Category No. 13573—regulation of the force of heart contraction by chemical signal; Category No.

13574—regulation of the force of skeletal muscle contraction; Category No. 13575—regulation of T-helper 1 cell differentiation; Category No. 13576—regulation of T-helper cell differentiation; Category No. 13577—regulation of thymidylate synthase biosynthetic process; Category No. 13578—regulation of thymocyte apoptotic process; Category No. 13579—regulation of thyroid hormone generation; Category No. 13580—regulation of thyroid hormone mediated signaling pathway; Category No. 13581—regulation of thyroid-stimulating hormone secretion; Category No. 13582—regulation of timing of cell differentiation; Category No. 13583—regulation of timing of neuron differentiation; Category No. 13584—regulation of timing of subpallium neuron differentiation; Category No. 13585—regulation of tissue remodeling; Category No. 13586—regulation of tolerance induction; Category No. 13587—regulation of toll-like receptor signaling pathway; Category No. 13588—regulation of TOR signaling; Category No. 13589—regulation of transcription; Category No. 13590—regulation of transcription by glucose; Category No. 13591—regulation of transcription elongation from RNA polymerase II promoter; Category No. 13592—regulation of transcription factor import into nucleus; Category No. 13593—regulation of transcription from RNA polymerase I promoter; Category No. 13594—regulation of transcription from RNA polymerase II promoter; Category No. 13595—regulation of transcription from RNA polymerase II promoter by glucose; Category No. 13596—regulation of transcription from RNA polymerase II promoter in response to arsenic-containing substance; Category No. 13597—regulation of transcription from RNA polymerase II promoter in response to hypoxia; Category No. 13598—regulation of transcription from RNA polymerase II promoter in response to iron; Category No. 13599—regulation of transcription from RNA polymerase II promoter in response to oxidative stress; Category No. 13600—regulation of transcription from RNA polymerase II promoter in response to stress; Category No. 13601—regulation of transcription from RNA polymerase II promoter in response to UV-induced DNA damage; Category No. 13602—regulation of transcription from RNA polymerase II promoter involved in definitive endodermal cell fate specification; Category No. 13603—regulation of transcription from RNA polymerase II promoter involved in forebrain neuron fate commitment; Category No. 13604—regulation of transcription from RNA polymerase II promoter involved in myocardial precursor cell differentiation; Category No. 13605—regulation of transcription from RNA polymerase II promoter involved in somatic motor neuron fate commitment; Category No. 13606—regulation of transcription from RNA polymerase II promoter involved in spinal cord association neuron specification; Category No. 13607—regulation of transcription from RNA polymerase II promoter involved in spinal cord motor neuron fate specification; Category No. 13608—regulation of transcription from RNA polymerase II promoter involved in ventral spinal cord interneuron specification; Category No. 13609—regulation of transcription from RNA polymerase III promoter; Category No. 13610—regulation of transcription involved in anterior posterior axis specification; Category No. 13611—regulation of transcription involved in cell fate commitment; Category No. 13612—regulation of transcription involved in G1 S transition of mitotic cell cycle; Category No. 13613—regulation of transcription involved in G2 M transition of mitotic cell cycle; Category No. 13614—regulation of transcription involved in lymphatic endothelial cell fate commitment; Category No. 13615—regulation of transcription regulatory region DNA binding; Category No. 13616—regulation of transforming growth factor beta receptor signaling pathway; Category No. 13617—regulation of transforming growth factor beta2 production; Category No. 13618—regulation of translation; Category No. 13619—regulation of translation by machinery localization; Category No. 13620—regulation of translation in response to stress; Category No. 13621—regulation of translational fidelity; Category No. 13622—regulation of translational initiation; Category No. 13623—regulation of translational initiation by eIF2 alpha dephosphorylation; Category No. 13624—regulation of translational initiation by eIF2 alpha phosphorylation; Category No. 13625—regulation of translational initiation in response to stress; Category No. 13626—regulation of translational termination; Category No. 13627—regulation of transmembrane transporter activity; Category No. 13628—regulation of transmission of nerve impulse; Category No. 13629—regulation of triglyceride biosynthetic process; Category No. 13630—regulation of triglyceride metabolic process; Category No. 13631—regulation of tube size; Category No. 13632—regulation of tubulin deacetylation; Category No. 13633—regulation of tumor necrosis factor biosynthetic process; Category No. 13634—regulation of tumor necrosis factor production; Category No. 13635—regulation of tumor necrosis factor-mediated signaling pathway; Category No. 13636—regulation of type 2 immune response; Category No. 13637—regulation of type B pancreatic cell development; Category No. 13638—regulation of type B pancreatic cell proliferation; Category No. 13639—regulation of type I interferon production; Category No. 13640—regulation of type I interferon-mediated signaling pathway; Category No. 13641—regulation of type III interferon production; Category No. 13642—regulation of tyrosine phosphorylation of Stat1 protein; Category No. 13643—regulation of tyrosine phosphorylation of Stat3 protein; Category No. 13644—regulation of ubiquitin-protein ligase activity involved in mitotic cell cycle; Category No. 13645—regulation of ubiquitin-protein transferase activity; Category No. 13646—regulation of urea metabolic process; Category No. 13647—regulation of uterine smooth muscle contraction; Category No. 13648—regulation of vacuole fusion; Category No. 13649—regulation of vacuole organization; Category No. 13650—regulation of vascular endothelial growth factor production; Category No. 13651—regulation of vascular endothelial growth factor receptor signaling pathway; Category No. 13652—regulation of vascular endothelial growth factor signaling pathway; Category No. 13653—regulation of vascular permeability; Category No. 13654—regulation of vascular permeability involved in acute inflammatory response; Category No. 13655—regulation of vascular smooth muscle contraction; Category No. 13656—regulation of vascular wound healing; Category No. 13657—regulation of vasculature development; Category No. 13658—regulation of vasculogenesis; Category No. 13659—regulation of vasoconstriction; Category No. 13660—regulation of vasoconstriction by circulating norepinephrine; Category No. 13661—regulation of vasodilation; Category No. 13662—regulation of ventricular cardiac muscle cell action potential; Category No. 13663—regulation of ventricular cardiac muscle cell membrane depolarization; Category No. 13664—regulation of ventricular cardiac muscle cell membrane repolarization; Category No. 13665—regulation of vesicle fusion; Category No. 13666—regulation of vesicle size; Category No. 13667—regulation of vesicle targeting to from or within Golgi; Category No. 13668—regulation of vesicle-mediated transport; Category No. 13669—regulation of viral budding via host ESCRT complex; Category No. 13670—regulation of viral entry into host cell; Category No. 13671—regulation of viral genome replication; Category No. 13672—regulation of viral process; Category No. 13673—regulation of viral release from host cell; Category No. 13674—regulation of viral transcription; Category No. 13675—regulation of vitamin A metabolic process; Category No. 13676—regulation of vitamin D receptor signaling pathway; Category No. 13677—regulation of vitamin metabolic process; Category No. 13678—regulation of voltage-gated calcium channel activity; Category No. 13679—regulation of water loss via skin; Category No. 13680—regulation of white fat cell proliferation; Category No. 13681—regulation of Wnt signaling pathway; Category No. 13682—regulation of wound healing; Category No. 13683—regulatory region DNA binding; Category No. 13684—regulatory region RNA binding; Category No. 13685—regulatory T cell differentiation; Category No. 13686—relaxation of cardiac muscle; Category No. 13687—relaxation of muscle; Category No. 13688—relaxation of skeletal muscle; Category No. 13689—relaxation of smooth muscle; Category No. 13690—relaxation of vascular smooth muscle; Category No. 13691—release from viral latency; Category No. 13692—release of cytochrome c from mitochondria; Category No. 13693—release of cytoplasmic sequestered N F-kappaB; Category No. 13694—release of matrix enzymes from mitochondria; Category No. 13695—release of sequestered calcium ion into cytosol; Category No. 13696—release of sequestered calcium ion into cytosol by sarcoplasmic reticulum; Category No. 13697—REM sleep; Category No. 13698—removal of RNA primer; Category No. 13699—removal of RNA primer involved in mitotic DNA replication; Category No. 13700—removal of superoxide radicals; Category No. 13701—renal absorption; Category No. 13702—renal artery morphogenesis; Category No. 13703—renal filtration; Category No. 13704—renal glucose absorption; Category No. 13705—renal inner medulla development; Category No. 13706—renal interstitial fibroblast development; Category No. 13707—renal outer medulla development; Category No. 13708—renal phosphate ion absorption; Category No. 13709—renal protein absorption; Category No. 13710—renal response to blood flow involved in circulatory renin-angiotensin regulation of systemic arterial blood pressure; Category No. 13711—renal sodium ion absorption; Category No. 13712—renal sodium ion transport; Category No. 13713—renal system development; Category No. 13714—renal system process; Category No. 13715—renal system process involved in regulation of systemic arterial blood pressure; Category No. 13716—renal tubular secretion; Category No. 13717—renal tubule development; Category No. 13718—renal tubule morphogenesis; Category No. 13719—renal vesicle formation; Category No. 13720—renal vesicle induction; Category No. 13721—renal vesicle morphogenesis; Category No. 13722—renal vesicle progenitor cell differentiation; Category No. 13723—renal water absorption; Category No. 13724—renal water homeostasis; Category No. 13725—renal water transport; Category No. 13726—renin secretion into blood stream; Category No. 13727—renin-angiotensin regulation of aldosterone production; Category No. 13728—replication fork; Category No. 13729—replication fork processing; Category No. 13730—replication fork protection; Category No. 13731—replication fork protection complex; Category No. 13732—replication-born double-strand break repair via sister chromatid exchange; Category No. 13733—replicative cell aging; Category No. 13734—replicative senescence; Category No. 13735—repressing transcription factor binding; Category No. 13736—reproduction; Category No. 13737—reproductive process; Category No. 13738—reproductive senescence; Category No. 13739—reproductive structure development; Category No. 13740—reproductive system development; Category No. 13741—RES complex; Category No. 13742—rescue of stalled ribosome; Category No. 13743—resolution of meiotic recombination intermediates; Category No. 13744—resolution of mitotic recombination intermediates; Category No. 13745—resolution of recombination intermediates; Category No. 13746—respiratory burst; Category No. 13747—respiratory burst after phagocytosis; Category No. 13748—respiratory burst involved in defense response; Category No. 13749—respiratory chain; Category No. 13750—respiratory chain complex I; Category No. 13751—respiratory chain complex II; Category No. 13752—respiratory chain complex III; Category No. 13753—respiratory chain complex IV; Category No. 13754—respiratory chain complex IV assembly; Category No. 13755—respiratory electron transport chain; Category No. 13756—respiratory gaseous exchange; Category No. 13757—respiratory system development; Category No. 13758—respiratory system process; Category No. 13759—respiratory tube development; Category No. 13760—response to 2-O-acetyl-1-O-hexadecyl-sn-glycero-3-phosphocholine; Category No. 13761—response to 3-methylcholanthrene; Category No. 13762—response to abiotic stimulus; Category No. 13763—response to acetate; Category No. 13764—response to acetylsalicylate; Category No. 13765—response to acidic pH; Category No. 13766—response to acrylamide; Category No. 13767—response to activity; Category No. 13768—response to alcohol; Category No. 13769—response to alkaline pH; Category No. 13770—response to alkaloid; Category No. 13771—response to aluminum ion; Category No. 13772—response to amine; Category No. 13773—response to amino acid; Category No. 13774—response to ammonium ion; Category No. 13775—response to amphetamine; Category No. 13776—response to anesthetic; Category No. 13777—response to angiotensin; Category No. 13778—response to anoxia; Category No. 13779—response to antibiotic; Category No. 13780—response to antidepressant; Category No. 13781—response to antineoplastic agent; Category No. 13782—response to antipsychotic drug; Category No. 13783—response to Aroclor 1254; Category No. 13784—response to arsenic-containing substance; Category No. 13785—response to ATP; Category No. 13786—response to auditory stimulus; Category No. 13787—response to axon injury; Category No. 13788—response to bacterium; Category No. 13789—response to benzene; Category No. 13790—response to biotic stimulus; Category No. 13791—response to biotin; Category No. 13792—response to bisphenol A; Category No. 13793—response to brefeldin A; Category No. 13794—response to cadmium ion; Category No. 13795—response to caffeine; Category No. 13796—response to calcium ion; Category No. 13797—response to cAMP; Category No. 13798—response to camptothecin; Category No. 13799—response to carbohydrate; Category No. 13800—response to carbon monoxide; Category No. 13801—response to catecholamine; Category No. 13802—response to cesium ion; Category No. 13803—response to cGMP; Category No. 13804—response to chlorate; Category No. 13805—response to cholesterol; Category No. 13806—response to ciliary neurotrophic factor; Category No. 13807—response to cisplatin; Category No. 13808—response to clozapine; Category No. 13809—response to cobalamin; Category No. 13810—response to cobalt ion;

Category No. 13811—response to cocaine; Category No. 13812—response to cold; Category No. 13813—response to copper ion; Category No. 13814—response to corticosteroid; Category No. 13815—response to corticosterone; Category No. 13816—response to cortisol; Category No. 13817—response to cycloheximide; Category No. 13818—response to cytokine; Category No. 13819—response to DDT; Category No. 13820—response to defense-related host nitric oxide production; Category No. 13821—response to defense-related host reactive oxygen species production; Category No. 13822—response to denervation involved in regulation of muscle adaptation; Category No. 13823—response to dexamethasone; Category No. 13824—response to dietary excess; Category No. 13825—response to diuretic; Category No. 13826—response to doxorubicin; Category No. 13827—response to drug; Category No. 13828—response to dsRNA; Category No. 13829—response to electrical stimulus; Category No. 13830—response to electrical stimulus involved in regulation of muscle adaptation; Category No. 13831—response to endoplasmic reticulum stress; Category No. 13832—response to environmental enrichment; Category No. 13833—response to epidermal growth factor; Category No. 13834—response to epinephrine; Category No. 13835—response to estradiol; Category No. 13836—response to estrogen; Category No. 13837—response to ethanol; Category No. 13838—response to ether; Category No. 13839—response to etoposide; Category No. 13840—response to exogenous dsRNA; Category No. 13841—response to external stimulus; Category No. 13842—response to extracellular stimulus; Category No. 13843—response to fatty acid; Category No. 13844—response to fenofibrate; Category No. 13845—response to fibroblast growth factor; Category No. 13846—response to fluid shear stress; Category No. 13847—response to fluoride; Category No. 13848—response to fluoxetine; Category No. 13849—response to folic acid; Category No. 13850—response to follicle-stimulating hormone; Category No. 13851—response to food; Category No. 13852—response to fructose; Category No. 13853—response to fungicide; Category No. 13854—response to fungus; Category No. 13855—response to G1 DNA damage checkpoint signaling; Category No. 13856—response to gamma radiation; Category No. 13857—response to genistein; Category No. 13858—response to glucagon; Category No. 13859—response to glucocorticoid; Category No. 13860—response to glucose; Category No. 13861—response to glycoside; Category No. 13862—response to gold nanoparticle; Category No. 13863—response to gonadotropin; Category No. 13864—response to gravity; Category No. 13865—response to growth factor; Category No. 13866—response to growth hormone; Category No. 13867—response to heat; Category No. 13868—response to heparin; Category No. 13869—response to hepatocyte growth factor; Category No. 13870—response to herbicide; Category No. 13871—response to high density lipoprotein particle; Category No. 13872—response to high light intensity; Category No. 13873—response to histamine; Category No. 13874—response to hormone; Category No. 13875—response to host immune response; Category No. 13876—response to human chorionic gonadotropin; Category No. 13877—response to hydrogen peroxide; Category No. 13878—response to hydroperoxide; Category No. 13879—response to hydrostatic pressure; Category No. 13880—response to hydroxyisoflavone; Category No. 13881—response to hyperoxia; Category No. 13882—response to hypoxia; Category No. 13883—response to immobilization stress; Category No. 13884—response to inactivity; Category No. 13885—response to injury involved in regulation of muscle adaptation; Category No. 13886—response to inorganic substance; Category No. 13887—response to insecticide; Category No. 13888—response to insulin; Category No. 13889—response to insulin-like growth factor stimulus; Category No. 13890—response to interferon-alpha; Category No. 13891—response to interferon-beta; Category No. 13892—response to interferon-gamma; Category No. 13893—response to interleukin-1; Category No. 13894—response to interleukin-11; Category No. 13895—response to interleukin-12; Category No. 13896—response to interleukin-13; Category No. 13897—response to interleukin-15; Category No. 13898—response to interleukin-18; Category No. 13899—response to interleukin-2; Category No. 13900—response to interleukin-4; Category No. 13901—response to interleukin-6; Category No. 13902—response to interleukin-9; Category No. 13903—response to intra-S DNA damage checkpoint signaling; Category No. 13904—response to ionizing radiation; Category No. 13905—response to iron ion; Category No. 13906—response to iron ion starvation; Category No. 13907—response to iron(II) ion; Category No. 13908—response to iron(III) ion; Category No. 13909—response to ischemia; Category No. 13910—response to isolation stress; Category No. 13911—response to kainic acid; Category No. 13912—response to ketamine; Category No. 13913—response to laminar fluid shear stress; Category No. 13914—response to L-arginine; Category No. 13915—response to L-ascorbic acid; Category No. 13916—response to lead ion; Category No. 13917—response to leptin; Category No. 13918—response to leucine; Category No. 13919—response to L-glutamate; Category No. 13920—response to light intensity; Category No. 13921—response to light stimulus; Category No. 13922—response to linoleic acid; Category No. 13923—response to lipid; Category No. 13924—response to lipid hydroperoxide; Category No. 13925—response to lipopolysaccharide; Category No. 13926—response to lipoprotein particle; Category No. 13927—response to lithium ion; Category No. 13928—response to low light intensity stimulus; Category No. 13929—response to low-density lipoprotein particle; Category No. 13930—response to L-phenylalanine derivative; Category No. 13931—response to luteinizing hormone; Category No. 13932—response to magnesium ion; Category No. 13933—response to magnetism; Category No. 13934—response to manganese ion; Category No. 13935—response to manganese-induced endoplasmic reticulum stress; Category No. 13936—response to mechanical stimulus; Category No. 13937—response to melanocyte-stimulating hormone; Category No. 13938—response to mercury ion; Category No. 13939—response to metal ion; Category No. 13940—response to metformin; Category No. 13941—response to methionine; Category No. 13942—response to methotrexate; Category No. 13943—response to methylglyoxal; Category No. 13944—response to methylmercury; Category No. 13945—response to mineralocorticoid; Category No. 13946—response to misfolded protein; Category No. 13947—response to molecule of bacterial origin; Category No. 13948—response to molecule of fungal origin; Category No. 13949—response to monoamine; Category No. 13950—response to monosaccharide; Category No. 13951—response to morphine; Category No. 13952—response to muramyl dipeptide; Category No. 13953—response to muscle activity; Category No. 13954—response to muscle activity involved in regulation of muscle adaptation; Category No. 13955—response to muscle inactivity; Category No. 13956—response to muscle stretch; Category No.

13957—response to mycotoxin; Category No. 13958—response to nematode; Category No. 13959—response to nerve growth factor; Category No. 13960—response to nickel cation; Category No. 13961—response to nicotine; Category No. 13962—response to nitric oxide; Category No. 13963—response to nitrogen dioxide; Category No. 13964—response to nitrosative stress; Category No. 13965—response to norepinephrine; Category No. 13966—response to nutrient; Category No. 13967—response to nutrient levels; Category No. 13968—response to oleic acid; Category No. 13969—response to organic cyclic compound; Category No. 13970—response to organic substance; Category No. 13971—response to organonitrogen compound; Category No. 13972—response to organophosphorus; Category No. 13973—response to osmotic stress; Category No. 13974—response to other organism; Category No. 13975—response to oxidative stress; Category No. 13976—response to oxygen radical; Category No. 13977—response to ozone; Category No. 13978—response to pain; Category No. 13979—response to parathyroid hormone; Category No. 13980—response to peptide; Category No. 13981—response to peptide hormone; Category No. 13982—response to peptidoglycan; Category No. 13983—response to pH; Category No. 13984—response to phenylpropanoid; Category No. 13985—response to pheromone; Category No. 13986—response to platelet-derived growth factor; Category No. 13987—response to platinum ion; Category No. 13988—response to potassium ion; Category No. 13989—response to progesterone; Category No. 13990—response to prolactin; Category No. 13991—response to prostaglandin E; Category No. 13992—response to prostaglandin F; Category No. 13993—response to protozoan; Category No. 13994—response to purine-containing compound; Category No. 13995—response to pyrethroid; Category No. 13996—response to radiation; Category No. 13997—response to rapamycin; Category No. 13998—response to reactive oxygen species; Category No. 13999—response to redox state; Category No. 14000—response to retinoic acid; Category No. 14001—response to salicylic acid; Category No. 14002—response to salt; Category No. 14003—response to salt stress; Category No. 14004—response to selenium ion; Category No. 14005—response to silicon dioxide; Category No. 14006—response to simvastatin; Category No. 14007—response to sodium arsenite; Category No. 14008—response to sodium phosphate; Category No. 14009—response to starvation; Category No. 14010—response to statin; Category No. 14011—response to steroid hormone; Category No. 14012—response to sterol depletion; Category No. 14013—response to stilbenoid; Category No. 14014—response to stimulus; Category No. 14015—response to stress; Category No. 14016—response to sucrose; Category No. 14017—response to sulfur dioxide; Category No. 14018—response to superoxide; Category No. 14019—response to symbiotic bacterium; Category No. 14020—response to tellurium ion; Category No. 14021—response to temperature stimulus; Category No. 14022—response to testosterone; Category No. 14023—response to thyroid hormone; Category No. 14024—response to TNF agonist; Category No. 14025—response to toxic substance; Category No. 14026—response to transforming growth factor beta; Category No. 14027—response to triglyceride; Category No. 14028—response to tumor cell; Category No. 14029—response to tumor necrosis factor; Category No. 14030—response to type I interferon; Category No. 14031—response to type III interferon; Category No. 14032—response to ultrasound; Category No. 14033—response to unfolded protein; Category No. 14034—response to UV; Category No. 14035—response to UV-A; Category No. 14036—response to UV-B; Category No. 14037—response to UV-C; Category No. 14038—response to virus; Category No. 14039—response to vitamin; Category No. 14040—response to vitamin A; Category No. 14041—response to vitamin B1; Category No. 14042—response to vitamin B2; Category No. 14043—response to vitamin B3; Category No. 14044—response to vitamin B6; Category No. 14045—response to vitamin D; Category No. 14046—response to vitamin E; Category No. 14047—response to vitamin K; Category No. 14048—response to water deprivation; Category No. 14049—response to water-immersion restraint stress; Category No. 14050—response to wounding; Category No. 14051—response to xenobiotic stimulus; Category No. 14052—response to X-ray; Category No. 14053—response to yeast; Category No. 14054—response to zinc ion; Category No. 14055—reticulophagy; Category No. 14056—retina development in camera-type eye; Category No. 14057—retina homeostasis; Category No. 14058—retina layer formation; Category No. 14059—retina morphogenesis in camera-type eye; Category No. 14060—retina vasculature development in camera-type eye; Category No. 14061—retina vasculature morphogenesis in camera-type eye; Category No. 14062—retinal binding; Category No. 14063—retinal bipolar neuron differentiation; Category No. 14064—retinal blood vessel morphogenesis; Category No. 14065—retinal cell apoptotic process; Category No. 14066—retinal cell programmed cell death; Category No. 14067—retinal cone cell development; Category No. 14068—retinal dehydrogenase activity; Category No. 14069—retinal ganglion cell axon guidance; Category No. 14070—retinal isomerase activity; Category No. 14071—retinal metabolic process; Category No. 14072—retinal pigment epithelium development; Category No. 14073—retinal rod cell development; Category No. 14074—retinal rod cell differentiation; Category No. 14075—retinal rod cell fate commitment; Category No. 14076—retinoic acid 4-hydroxylase activity; Category No. 14077—retinoic acid binding; Category No. 14078—retinoic acid biosynthetic process; Category No. 14079—retinoic acid catabolic process; Category No. 14080—retinoic acid metabolic process; Category No. 14081—retinoic acid receptor activity; Category No. 14082—retinoic acid receptor binding; Category No. 14083—retinoic acid receptor signaling pathway; Category No. 14084—retinoic acid-responsive element binding; Category No. 14085—retinoid binding; Category No. 14086—retinoid metabolic process; Category No. 14087—retinoid X receptor binding; Category No. 14088—retinol binding; Category No. 14089—retinol dehydrogenase activity; Category No. 14090—retinol metabolic process; Category No. 14091—retinol O-fatty-acyltransferase activity; Category No. 14092—retinol transport; Category No. 14093—retinol transporter activity; Category No. 14094—retinyl-palmitate esterase activity; Category No. 14095—retrograde axon cargo transport; Category No. 14096—retrograde protein transport; Category No. 14097—retrograde transport; Category No. 14098—retrograde vesicle-mediated transport; Category No. 14099—retromer; Category No. 14100—retromer complex; Category No. 14101—retrotrapezoid nucleus neuron differentiation; Category No. 14102—reverse cholesterol transport; Category No. 14103—rhabdomere; Category No. 14104—Rho GDP-dissociation inhibitor activity; Category No. 14105—Rho GDP-dissociation inhibitor binding; Category No. 14106—Rho GTPase binding; Category No. 14107—Rho guanyl-nucleotide exchange factor activity; Category No. 14108—Rho protein signal transduction; Category No. 14109—Rho-dependent protein serine threonine kinase activity; Category No. 14110—rhodopsin kinase activity; Category No. 14111—rhodopsin mediated signaling pathway; Category No. 14112—rhombomere 2 development; Category No. 14113—rhombomere 3 development; Category No. 14114—rhombomere 3 formation; Category No. 14115—rhombomere 3 morphogenesis; Category No. 14116—rhombomere 4 development; Category No. 14117—rhombomere 5 development; Category No. 14118—rhombomere 5 formation; Category No. 14119—rhombomere 6 development; Category No. 14120—rhombomere development; Category No. 14121—rhythmic behavior; Category No. 14122—rhythmic excitation; Category No. 14123—rhythmic process; Category No. 14124—rhythmic synaptic transmission; Category No. 14125—ribbon synapse; Category No. 14126—riboflavin biosynthetic process; Category No. 14127—riboflavin kinase activity; Category No. 14128—riboflavin metabolic process; Category No. 14129—riboflavin reductase (NADPH) activity; Category No. 14130—riboflavin transport; Category No. 14131—riboflavin transporter activity; Category No. 14132—ribokinase activity; Category No. 14133—ribonuclease A activity; Category No. 14134—ribonuclease activity; Category No. 14135—ribonuclease E activity; Category No. 14136—ribonuclease H2 complex; Category No. 14137—ribonuclease III activity; Category No. 14138—ribonuclease inhibitor activity; Category No. 14139—ribonuclease MRP activity; Category No. 14140—ribonuclease MRP complex; Category No. 14141—ribonuclease P activity; Category No. 14142—ribonuclease P complex; Category No. 14143—ribonuclease P RNA binding; Category No. 14144—ribonuclease T2 activity; Category No. 14145—ribonucleoprotein complex; Category No. 14146—ribonucleoprotein complex assembly; Category No. 14147—ribonucleoprotein complex binding; Category No. 14148—ribonucleoprotein complex biogenesis; Category No. 14149—ribonucleoprotein complex import into nucleus; Category No. 14150—ribonucleoprotein granule; Category No. 14151—ribonucleoside binding; Category No. 14152—ribonucleoside diphosphate catabolic process; Category No. 14153—ribonucleoside monophosphate biosynthetic process; Category No. 14154—ribonucleoside-diphosphate reductase activity; Category No. 14155—ribonucleoside-diphosphate reductase complex; Category No. 14156—ribonucleotide metabolic process; Category No. 14157—ribose phosphate biosynthetic process; Category No. 14158—ribose phosphate diphosphokinase activity; Category No. 14159—ribose phosphate diphosphokinase complex; Category No. 14160—ribose phosphate metabolic process; Category No. 14161—ribose-5-phosphate isomerase activity; Category No. 14162—ribosomal large subunit assembly; Category No. 14163—ribosomal large subunit binding; Category No. 14164—ribosomal large subunit biogenesis; Category No. 14165—ribosomal large subunit export from nucleus; Category No. 14166—ribosomal protein import into nucleus; Category No. 14167—ribosomal protein S6 kinase activity; Category No. 14168—ribosomal S6-glutamic acid ligase activity; Category No. 14169—ribosomal small subunit assembly; Category No. 14170—ribosomal small subunit binding; Category No. 14171—ribosomal small subunit biogenesis; Category No. 14172—ribosomal small subunit export from nucleus; Category No. 14173—ribosomal subunit export from nucleus; Category No. 14174—ribosome; Category No. 14175—ribosome assembly; Category No. 14176—ribosome binding; Category No. 14177—ribosome biogenesis; Category No. 14178—ribosome disassembly; Category No. 14179—ribosylnicotinamide kinase activity; Category No. 14180—ribulose-phosphate 3-epimerase activity; Category No. 14181—RIC1-RGP1 guanyl-nucleotide exchange factor complex; Category No. 14182—right lung development; Category No. 14183—right ventricular cardiac muscle tissue morphogenesis; Category No. 14184—righting reflex; Category No. 14185—RIG-I signaling pathway; Category No. 14186—RING-like zinc finger domain binding; Category No. 14187—ripoptosome; Category No. 14188—ripoptosome assembly; Category No. 14189—ripoptosome assembly involved in necroptotic process; Category No. 14190—RISC complex; Category No. 14191—RISC-loading complex; Category No. 14192—RNA (guanine-N7)-methylation; Category No. 14193—RNA 3'-end processing; Category No. 14194—RNA 5'-end processing; Category No. 14195—RNA 7-methylguanosine cap binding; Category No. 14196—RNA binding; Category No. 14197—RNA biosynthetic process; Category No. 14198—RNA cap binding; Category No. 14199—RNA catabolic process; Category No. 14200—RNA destabilization; Category No. 14201—RNA export from nucleus; Category No. 14202—RNA guanylyltransferase activity; Category No. 14203—RNA helicase activity; Category No. 14204—RNA import into mitochondrion; Category No. 14205—RNA import into nucleus; Category No. 14206—RNA interference; Category No. 14207—RNA lariat debranching enzyme activity; Category No. 14208—RNA ligase (ATP) activity; Category No. 14209—RNA ligase activity; Category No. 14210—RNA localization; Category No. 14211—RNA metabolic process; Category No. 14212—RNA methylation; Category No. 14213—RNA methyltransferase activity; Category No. 14214—RNA modification; Category No. 14215—RNA nuclear export complex; Category No. 14216—RNA phosphodiester bond hydrolysis; Category No. 14217—RNA polyadenylation; Category No. 14218—RNA polymerase binding; Category No. 14219—RNA polymerase core enzyme binding; Category No. 14220—RNA polymerase I activity; Category No. 14221—RNA polymerase I core binding; Category No. 14222—RNA polymerase I CORE element binding transcription factor recruiting; Category No. 14223—RNA polymerase I CORE element sequence-specific DNA binding; Category No. 14224—RNA polymerase I core factor complex; Category No. 14225—RNA polymerase I regulatory region DNA binding; Category No. 14226—RNA polymerase I transcription factor binding; Category No. 14227—RNA polymerase I transcription factor complex; Category No. 14228—RNA polymerase I transcriptional preinitiation complex assembly at the promoter for the nuclear large rRNA transcript; Category No. 14229—RNA polymerase II activating transcription factor binding; Category No. 14230—RNA polymerase II activity; Category No. 14231—RNA polymerase II carboxy-terminal domain kinase activity; Category No. 14232—RNA polymerase II core binding; Category No. 14233—RNA polymerase II core promoter proximal region sequence-specific binding; Category No. 14234—RNA polymerase II core promoter proximal region sequence-specific DNA binding; Category No. 14235—RNA polymerase II core promoter sequence-specific; Category No. 14236—RNA polymerase II core promoter sequence-specific binding involved in preinitiation complex assembly; Category No. 14237—RNA polymerase II core promoter sequence-specific DNA binding; Category No. 14238—RNA polymerase II C-terminal domain phosphoserine binding; Category No. 14239—RNA polymerase II distal enhancer sequence-specific binding; Category No. 14240—RNA polymerase II distal enhancer sequence-specific DNA binding; Category No. 14241—RNA polymerase II intronic transcription regulatory region sequence-specific DNA binding; Category No. 14242—RNA polymerase II regulatory region DNA binding; Category No. 14243—RNA polymerase II regulatory region sequence-specific DNA binding; Category No. 14244—RNA polymerase II repressing transcription factor binding; Category No. 14245—RNA polymerase II sequence-specific DNA binding transcription factor binding; Category No. 14246—RNA polymerase II transcription coactivator activity; Category No. 14247—RNA polymerase II transcription coactivator activity involved in preinitiation complex assembly; Category No. 14248—RNA polymerase II transcription cofactor activity; Category No. 14249—RNA polymerase II transcription corepressor activity; Category No. 14250—RNA polymerase II transcription corepressor binding; Category No. 14251—RNA polymerase II transcription factor activity; Category No. 14252—RNA polymerase II transcription factor binding; Category No. 14253—RNA polymerase II transcription factor complex; Category No. 14254—RNA polymerase II transcription factor recruiting; Category No. 14255—RNA polymerase II transcription regulatory region sequence-specific binding; Category No. 14256—RNA polymerase II transcription repressor complex; Category No. 14257—RNA polymerase II transcriptional preinitiation complex assembly; Category No. 14258—RNA polymerase III activity; Category No. 14259—RNA polymerase III core binding; Category No. 14260—RNA polymerase III regulatory region DNA binding; Category No. 14261—RNA polymerase III transcription factor binding; Category No. 14262—RNA polymerase III type 1 promoter DNA binding; Category No. 14263—RNA polymerase III type 2 promoter DNA binding; Category No. 14264—RNA polymerase III type 3 promoter DNA binding; Category No. 14265—RNA polymerase recruiting; Category No. 14266—RNA polymerase transcription factor SL1 complex; Category No. 14267—RNA processing; Category No. 14268—RNA pyrophosphohydrolase activity; Category No. 14269—RNA repair; Category No. 14270—RNA secondary structure unwinding; Category No. 14271—RNA splicing; Category No. 14272—RNA stem-loop binding; Category No. 14273—RNA surveillance; Category No. 14274—RNA transmembrane transporter activity; Category No. 14275—RNA transport; Category No. 14276—RNA trimethylguanosine synthase activity; Category No. 14277—RNA uridylyltransferase activity; Category No. 14278—RNA-3'-phosphate cyclase activity; Category No. 14279—RNA-dependent ATPase activity; Category No. 14280—RNA-dependent DNA replication; Category No. 14281—RNA-directed DNA polymerase activity; Category No. 14282—RNA-directed RNA polymerase activity; Category No. 14283—RNA-directed RNA polymerase complex; Category No. 14284—RNA-DNA hybrid ribonuclease activity; Category No. 14285—RNA-mediated; Category No. 14286—RNA-templated; Category No. 14287—rod bipolar cell differentiation; Category No. 14288—rod bipolar cell terminal bouton; Category No. 14289—rod spherule; Category No. 14290—roof plate formation; Category No. 14291—rostrocaudal neural tube patterning; Category No. 14292—rotational mechanism; Category No. 14293—rough endoplasmic reticulum; Category No. 14294—rough endoplasmic reticulum lumen; Category No. 14295—rough endoplasmic reticulum membrane; Category No. 14296—Roundabout binding; Category No. 14297—Roundabout signaling pathway; Category No. 14298—rRNA (adenine) methyltransferase activity; Category No. 14299—rRNA (adenine-N6,N6-)-dimethyltransferase activity; Category No. 14300—rRNA (cytosine-N4-)-methyltransferase activity; Category No. 14301—rRNA (guanine) methyltransferase activity; Category No. 14302—rRNA (guanine-N7)-methylation; Category No. 14303—rRNA (guanosine-2'-O-)-methyltransferase activity; Category No. 14304—rRNA (pseudouridine) methyltransferase activity; Category No. 14305—rRNA (uridine-2'-O-)-methyltransferase activity; Category No. 14306—rRNA (uridine-N3-)-methyltransferase activity; Category No. 14307—rRNA 3'-end processing; Category No. 14308—rRNA base methylation; Category No. 14309—rRNA binding; Category No. 14310—rRNA catabolic process; Category No. 14311—rRNA export from nucleus; Category No. 14312—rRNA import into mitochondrion; Category No. 14313—rRNA metabolic process; Category No. 14314—rRNA methylation; Category No. 14315—rRNA methyltransferase activity; Category No. 14316—rRNA modification; Category No. 14317—rRNA primary transcript binding; Category No. 14318—rRNA processing; Category No. 14319—rRNA pseudouridine synthesis; Category No. 14320—rRNA transcription; Category No. 14321—rRNA transport; Category No. 14322—RS domain binding; Category No. 14323—RSF complex; Category No. 14324—R-SMAD binding; Category No. 14325—rubidium ion transmembrane transporter activity; Category No. 14326—rubidium ion transport; Category No. 14327—ruffle; Category No. 14328—ruffle assembly; Category No. 14329—ruffle membrane; Category No. 14330—ruffle organization; Category No. 14331—ryanodine receptor complex; Category No. 14332—ryanodine-sensitive calcium-release channel activity; Category No. 14333—RZZ complex; Category No. 14334—S-(hydroxymethyl) glutathione dehydrogenase activity; Category No. 14335—S100 protein binding; Category No. 14336—SA node cell action potential; Category No. 14337—SA node cell to atrial cardiac muscle cell communication; Category No. 14338—saccharopine dehydrogenase (NAD+; Category No. 14339—saccharopine dehydrogenase (NADP+; Category No. 14340—S-adenosylhomocysteine catabolic process; Category No. 14341—S-adenosylhomocysteine metabolic process; Category No. 14342—S-adenosyl-L-methionine binding; Category No. 14343—S-adenosyl-L-methionine transmembrane transport; Category No. 14344—S-adenosyltmethionine transmembrane transporter activity; Category No. 14345—S-adenosyl-L-methionine transport; Category No. 14346—S-adenosylmethioninamine biosynthetic process; Category No. 14347—S-adenosylmethioninamine metabolic process; Category No. 14348—S-adenosylmethionine biosynthetic process; Category No. 14349—S-adenosylmethionine cycle; Category No. 14350—S-adenosylmethionine metabolic process; Category No. 14351—S-adenosylmethionine-dependent methyltransferase activity; Category No. 14352—S-adenosylmethionine-dependent tRNA (m5U54) methyltransferase activity; Category No. 14353—S-adenosylmethionine-homocysteine S-methyltransferase activity; Category No. 14354—SAGA complex; Category No. 14355—SAGA-type complex; Category No. 14356—sagittal suture morphogenesis; Category No. 14357—saliva secretion; Category No. 14358—salivary gland cavitation; Category No. 14359—salivary gland development; Category No. 14360—salivary gland morphogenesis; Category No. 14361—SAM domain binding; Category No. 14362—sarcoglycan complex; Category No. 14363—sarcolemma; Category No. 14364—sarcomere; Category No. 14365—sarcomere organization; Category No. 14366—sarcomerogenesis; Category No. 14367—sarcoplasm; Category No. 14368—sarcoplasmic reticulum; Category No. 14369—sarcoplasmic reticulum calcium ion transport; Category No. 14370—sarcoplasmic reticulum lumen; Category No. 14371—sarcoplasmic reticulum membrane; Category No. 14372—sarcosine dehydrogenase activity; Category No. 14373—sarcosine oxidase activity; Category No. 14374—satellite DNA binding; Category No. 14375—saturated fatty acid; Category No. 14376—saturated monocarboxylic acid metabolic process; Category No. 14377—scaffold protein binding; Category No. 14378—SCAR complex; Category No. 14379—scavenger receptor activity; Category No. 14380—scavenger receptor binding; Category No. 14381—SCF complex assembly; Category No. 14382—SCF ubiquitin ligase complex; Category No. 14383—SCF-dependent proteasomal ubiquitin-dependent protein catabolic process; Category No. 14384—Schmidt-Lanterman incisure; Category No. 14385—Schwann cell development; Category No. 14386—Schwann cell differentiation; Category No. 14387—Schwann cell microvillus; Category No. 14388—Schwann cell proliferation; Category No. 14389—sclerotome development; Category No. 14390—Scrib-APC-beta-catenin complex; Category No. 14391—sebaceous gland cell differentiation; Category No. 14392—sebaceous gland development; Category No. 14393—sebum secreting cell proliferation; Category No. 14394—Sec61 translocon complex; Category No. 14395—second spliceosomal transesterification activity; Category No. 14396—secondary active organic cation transmembrane transporter activity; Category No. 14397—secondary active sulfate transmembrane transporter activity; Category No. 14398—secondary heart field specification; Category No. 14399—secondary lysosome; Category No. 14400—secondary metabolite biosynthetic process; Category No. 14401—second-messenger-mediated signaling; Category No. 14402—secretin receptor activity; Category No. 14403—secretion; Category No. 14404—secretion by cell; Category No. 14405—secretion by lung epithelial cell involved in lung growth; Category No. 14406—secretion of lysosomal enzymes; Category No. 14407—secretory columnal luminar epithelial cell differentiation involved in prostate glandular acinus development; Category No. 14408—secretory dimeric IgA immunoglobulin complex; Category No. 14409—secretory granule; Category No. 14410—secretory granule localization; Category No. 14411—secretory granule lumen; Category No. 14412—secretory granule membrane; Category No. 14413—secretory granule organization; Category No. 14414—secretory IgA immunoglobulin complex; Category No. 14415—sedoheptulokinase activity; Category No. 14416—sedoheptulose-7-phosphate:D-glyceraldehyde-3-phosphate glyceronetransferase activity; Category No. 14417—segment specification; Category No. 14418—segmentation; Category No. 14419—selenide; Category No. 14420—selenium binding; Category No. 14421—selenium compound metabolic process; Category No. 14422—selenocysteine biosynthetic process; Category No. 14423—selenocysteine incorporation; Category No. 14424—selenocysteine insertion sequence binding; Category No. 14425—selenocysteine lyase activity; Category No. 14426—selenocysteine metabolic process; Category No. 14427—selenocysteinyl-tRNA(Sec) biosynthetic process; Category No. 14428—self proteolysis; Category No. 14429—semaphorin receptor activity; Category No. 14430—semaphorin receptor binding; Category No. 14431—semaphorin receptor complex; Category No. 14432—semaphorin-plexin signaling pathway; Category No. 14433—semaphorin-plexin signaling pathway involved in axon guidance; Category No. 14434—semaphorin-plexin signaling pathway involved in bone trabecula morphogenesis; Category No. 14435—semaphorin-plexin signaling pathway involved in neuron projection guidance; Category No. 14436—semicircular canal development; Category No. 14437—semicircular canal formation; Category No. 14438—semicircular canal fusion; Category No. 14439—semicircular canal morphogenesis; Category No. 14440—seminal clot liquefaction; Category No. 14441—seminal vesicle epithelium development; Category No. 14442—seminiferous tubule development; Category No. 14443—senescence-associated heterochromatin focus; Category No. 14444—senescence-associated heterochromatin focus assembly; Category No. 14445—sensitization; Category No. 14446—sensory neuron axon guidance; Category No. 14447—sensory organ boundary specification; Category No. 14448—sensory organ development; Category No. 14449—sensory perception; Category No. 14450—sensory perception of bitter taste; Category No. 14451—sensory perception of chemical stimulus; Category No. 14452—sensory perception of light stimulus; Category No. 14453—sensory perception of mechanical stimulus; Category No. 14454—sensory perception of pain; Category No. 14455—sensory perception of smell; Category No. 14456—sensory perception of sound; Category No. 14457—sensory perception of sour taste; Category No. 14458—sensory perception of sweet taste; Category No. 14459—sensory perception of taste; Category No. 14460—sensory perception of temperature stimulus; Category No. 14461—sensory perception of touch; Category No. 14462—sensory perception of umami taste; Category No. 14463—sensory processing; Category No. 14464—sensory system development; Category No. 14465—sepiapterin reductase activity; Category No. 14466—septin complex; Category No. 14467—septin cytoskeleton organization; Category No. 14468—septin ring assembly; Category No. 14469—septum primum development; Category No. 14470—septum secundum development; Category No. 14471—sequence-specific DNA binding; Category No. 14472—sequence-specific DNA binding transcription factor recruiting; Category No. 14473—sequence-specific mRNA binding; Category No. 14474—sequence-specific transcription regulatory region DNA binding; Category No. 14475—sequestering of actin monomers; Category No. 14476—sequestering of BMP from receptor via BMP binding; Category No. 14477—sequestering of BMP in extracellular matrix; Category No. 14478—sequestering of calcium ion; Category No. 14479—sequestering of extracellular ligand from receptor; Category No. 14480—sequestering of metal ion; Category No. 14481—sequestering of neurotransmitter; Category No. 14482—sequestering of nodal from receptor via nodal binding; Category No. 14483—sequestering of TGFbeta in extracellular matrix; Category No. 14484—sequestering of triglyceride; Category No. 14485—sequestering of zinc ion; Category No. 14486—serine binding; Category No. 14487—serine C-palmitoyltransferase activity; Category No. 14488—serine C-palmitoyltransferase complex; Category No. 14489—serine family amino acid biosynthetic process; Category No. 14490—serine family amino acid catabolic process; Category No. 14491—serine family amino acid metabolic process; Category No. 14492—serine hydrolase activity; Category No. 14493—serine O-acyltransferase activity; Category No. 14494—serine phosphorylation of STAT protein; Category No. 14495—serine phosphorylation of STAT3 protein; Category No. 14496—serine racemase activity; Category No. 14497—serine threonine protein kinase complex; Category No. 14498—serine-pyruvate aminotransferase complex; Category No. 14499—serine-pyruvate transaminase activity; Category No. 14500—serine-tRNA ligase activity; Category No. 14501—serine-type aminopeptidase activity; Category No. 14502—serine-type carboxypeptidase activity; Category No. 14503—serine-type endopeptidase activity; Category No. 14504—serine-type endopeptidase inhibitor activity; Category No. 14505—serine-type exopeptidase activity; Category No. 14506—serine-type peptidase activity; Category No. 14507—serotonin binding; Category No. 14508—serotonin biosynthetic process; Category No. 14509—serotonin metabolic process; Category No. 14510—serotonin receptor activity; Category No. 14511—serotonin receptor signaling pathway; Category No. 14512—serotonin secretion; Category No. 14513—serotonin secretion by platelet; Category No. 14514—serotonin transmembrane transporter activity; Category No. 14515—serotonin transport; Category No. 14516—serotonin uptake; Category No. 14517—serotonin: sodium symporter activity; Category No. 14518—serotonin-activated cation-selective channel activity; Category No. 14519—serpin family protein binding; Category No. 14520—Sertoli cell development; Category No. 14521—Sertoli cell differentiation; Category No. 14522—Sertoli cell fate commitment; Category No. 14523—Sertoli cell proliferation; Category No. 14524—Ser-tRNA(Ala) hydrolase activity; Category No. 14525—serum response element binding; Category No. 14526—seryl-tRNA aminoacylation; Category No. 14527—sesquiterpenoid metabolic process; Category No. 14528—SET domain binding; Category No. 14529—Set1C COMPASS complex; Category No. 14530—sex chromatin; Category No. 14531—sex chromosome; Category No. 14532—sex determination; Category No. 14533—sex differentiation; Category No. 14534—sexual reproduction; Category No. 14535—5-formylglutathione hydrolase activity; Category No. 14536—SH2 domain binding; Category No. 14537—SH3 domain binding; Category No. 14538—SH3 SH2 adaptor activity; Category No. 14539—Shc-EGFR complex; Category No. 14540—short-chain fatty acid biosynthetic process; Category No. 14541—short-chain fatty acid catabolic process; Category No. 14542—short-chain fatty acid import; Category No. 14543—short-chain fatty acid metabolic process; Category No. 14544—short-chain fatty acid uptake transporter activity; Category No. 14545—short-term memory; Category No. 14546—Shu complex; Category No. 14547—sialate O-acetylesterase activity; Category No. 14548—sialic acid binding; Category No. 14549—sialic acid transmembrane transporter activity; Category No. 14550—sialic acid transport; Category No. 14551—sialylation; Category No. 14552—sialyltransferase activity; Category No. 14553—siderophore biosynthetic process; Category No. 14554—siderophore transport; Category No. 14555—signal clustering; Category No. 14556—signal complex assembly; Category No. 14557—signal peptidase complex; Category No. 14558—signal peptide processing; Category No. 14559—signal recognition particle; Category No. 14560—signal recognition particle binding; Category No. 14561—signal recognition particle receptor complex; Category No. 14562—signal sequence binding; Category No. 14563—signal sequence recognition; Category No. 14564—signal transducer activity; Category No. 14565—signal transduction; Category No. 14566—signal transduction by p53 class mediator; Category No. 14567—signal transduction by p53 class mediator resulting in cell cycle arrest; Category No. 14568—signal transduction by p53 class mediator resulting in transcription of p21 class mediator; Category No. 14569—signal transduction by protein phosphorylation; Category No. 14570—signal transduction downstream of smoothened; Category No. 14571—signal transduction in response to DNA damage; Category No. 14572—signal transduction involved in cell cycle checkpoint; Category No. 14573—signal transduction involved in DNA damage checkpoint; Category No. 14574—signal transduction involved in intra-S DNA damage checkpoint; Category No. 14575—signal transduction involved in mitotic G1 DNA damage checkpoint; Category No. 14576—signal transduction involved in mitotic G2 DNA damage checkpoint; Category No. 14577—signal transduction involved in regulation of gene expression; Category No. 14578—signal transduction resulting in transcription; Category No. 14579—signaling; Category No. 14580—signaling adaptor activity; Category No. 14581—signaling pattern recognition receptor activity; Category No. 14582—signaling receptor activity; Category No. 14583—Sin3 complex; Category No. 14584—Sin3-type complex; Category No. 14585—single base insertion or deletion binding; Category No. 14586—single fertilization; Category No. 14587—single guanine insertion binding; Category No. 14588—single organism reproductive process; Category No. 14589—single organismal cell-cell adhesion; Category No. 14590—single strand break repair; Category No. 14591—single stranded viral RNA replication via double stranded DNA intermediate; Category No. 14592—single thymine insertion binding; Category No. 14593—single-organism behavior; Category No. 14594—single-strand selective uracil DNA N-glycosylase activity; Category No. 14595—single-stranded DNA 3'-5' exodeoxyribonuclease activity; Category No. 14596—single-stranded DNA 5'-3' exodeoxyribonuclease activity; Category No. 14597—single-stranded DNA binding; Category No. 14598—single-stranded DNA endodeoxyribonuclease activity; Category No. 14599—single-stranded DNA exodeoxyribonuclease activity; Category No. 14600—single-stranded DNA-dependent ATPase activity; Category No. 14601—single-stranded DNA-dependent ATP-dependent DNA helicase activity; Category No. 14602—single-stranded RNA binding; Category No. 14603—single-stranded telomeric DNA binding; Category No. 14604—sinoatrial node cell development; Category No. 14605—sinoatrial node cell differentiation; Category No. 14606—sinoatrial node development; Category No. 14607—sinoatrial valve morphogenesis; Category No. 14608—sinus venosus morphogenesis; Category No. 14609—siRNA binding; Category No. 14610—siRNA loading onto RISC involved in RNA interference; Category No. 14611—sister chromatid biorientation; Category No. 14612—sister chromatid cohesion; Category No. 14613—sister chromatid segregation; Category No. 14614—site of double-strand break; Category No. 14615—site of polarized growth; Category No. 14616—site-specific endodeoxyribonuclease activity; Category No. 14617—skeletal muscle acetylcholine-gated channel clustering; Category No. 14618—skeletal muscle adaptation; Category No. 14619—skeletal muscle atrophy; Category No. 14620—skeletal muscle cell differentiation; Category No. 14621—skeletal muscle cell proliferation; Category No. 14622—skeletal muscle contraction; Category No. 14623—skeletal muscle fiber adaptation; Category No. 14624—skeletal muscle fiber development; Category No. 14625—skeletal muscle fiber differentiation; Category No. 14626—skeletal muscle hypertrophy; Category No. 14627—skeletal muscle myosin thick filament assembly; Category No. 14628—skeletal muscle organ development; Category No. 14629—skeletal muscle satellite cell activation; Category No. 14630—skeletal muscle satellite cell commitment; Category No. 14631—skeletal muscle satellite cell differentiation; Category No. 14632—skeletal muscle satellite cell maintenance involved in skeletal muscle regeneration; Category No. 14633—skeletal muscle satellite cell migration; Category No. 14634—skeletal muscle satellite cell proliferation; Category No. 14635—skeletal muscle thin filament assembly; Category No. 14636—skeletal muscle tissue development; Category No. 14637—skeletal muscle tissue growth; Category No. 14638—skeletal muscle tissue regeneration; Category No. 14639—skeletal myofibril assembly; Category No. 14640—skeletal system development; Category No. 14641—skeletal system morphogenesis; Category No. 14642—Ski complex; Category No. 14643—skin development; Category No. 14644—skin epidermis development; Category No. 14645—skin morphogenesis; Category No. 14646—sleep; Category No. 14647—slit diaphragm; Category No. 14648—slit diaphragm assembly; Category No. 14649—slow endocytic recycling; Category No. 14650—slow-twitch skeletal muscle fiber contraction; Category No. 14651—Slx1-Slx4 complex; Category No. 14652—SMAD binding; Category No. 14653—SMAD protein complex; Category No. 14654—SMAD protein complex assembly; Category No. 14655—SMAD protein import into nucleus; Category No. 14656—SMAD protein signal transduction; Category No. 14657—SMAD2-SMAD3 protein complex; Category No. 14658—SMAD3-SMAD4 protein complex; Category No. 14659—small conductance calcium-activated potassium channel activity; Category No. 14660—small GTPase binding; Category No. 14661—small GTPase mediated signal transduction; Category No. 14662—small molecule binding; Category No. 14663—small molecule metabolic process; Category No. 14664—small nuclear ribonucleoprotein complex; Category No. 14665—small nucleolar ribonucleoprotein complex; Category No. 14666—small protein activating enzyme activity; Category No. 14667—small protein activating enzyme binding; Category No. 14668—small ribosomal subunit; Category No. 14669—small ribosomal subunit rRNA binding; Category No. 14670—small subunit precursor; Category No. 14671—small-subunit processome; Category No. 14672—small-subunit processome assembly; Category No. 14673—SMC family protein binding; Category No. 14674—SMC loading complex; Category No. 14675—Smc5-Smc6 complex; Category No. 14676—S-methyl-5-thioadenosine phosphorylase activity; Category No. 14677—S-methyl-5-thioribose-1-phosphate isomerase activity; Category No. 14678—5-methylmethionine cycle; Category No. 14679—5-methylmethionine metabolic process; Category No. 14680—5-methylmethionine-homocysteine S-methyltransferase activity; Category No. 14681—SMN complex; Category No. 14682—SMN-Sm protein complex; Category No. 14683—smooth endoplasmic reticulum; Category No. 14684—smooth endoplasmic reticulum calcium ion homeostasis; Category No. 14685—smooth endoplasmic reticulum membrane; Category No. 14686—smooth muscle adaptation; Category No. 14687—smooth muscle cell chemotaxis; Category No. 14688—smooth muscle cell differentiation; Category No. 14689—smooth muscle cell migration; Category No. 14690—smooth muscle cell proliferation; Category No. 14691—smooth muscle cell-matrix adhesion; Category No. 14692—smooth muscle contractile fiber; Category No. 14693—smooth muscle contraction; Category No. 14694—smooth muscle contraction involved in micturition; Category No. 14695—smooth muscle hyperplasia; Category No. 14696—smooth muscle hypertrophy; Category No. 14697—smooth muscle tissue development; Category No. 14698—smoothened binding; Category No. 14699—smoothened signaling pathway; Category No. 14700—smoothened signaling pathway involved in dorsal ventral neural tube patterning; Category No. 14701—smoothened signaling pathway involved in regulation of cerebellar granule cell precursor cell proliferation; Category No. 14702—smoothened signaling pathway involved in spinal cord motor neuron cell fate specification; Category No. 14703—smoothened signaling pathway involved in ventral spinal cord interneuron specification; Category No. 14704—smoothened signaling pathway involved in ventral spinal cord patterning; Category No. 14705—SNAP receptor activity; Category No. 14706—SNARE binding; Category No. 14707—SNARE complex; Category No. 14708—SNARE complex assembly; Category No. 14709—SNARE complex disassembly; Category No. 14710—sn-glycerol-3-phosphate:ubiquinone-8 oxidoreductase activity; Category No. 14711—5-nitrosoglutathione binding; Category No. 14712—snoRNA binding; Category No. 14713—snoRNA catabolic process; Category No. 14714—snoRNA metabolic process; Category No. 14715—snRNA binding; Category No. 14716—snRNA export from nucleus; Category No. 14717—snRNA import into nucleus; Category No. 14718—snRNA metabolic process; Category No. 14719—snRNA modification; Category No. 14720—snRNA processing; Category No. 14721—snRNA pseudouridine synthesis; Category No. 14722—snRNA stem-loop binding; Category No. 14723—snRNA transcription; Category No. 14724—snRNA transcription from RNA polymerase II promoter; Category No. 14725—snRNA transcription from RNA polymerase III promoter; Category No. 14726—snRNA-activating protein complex; Category No. 14727—snRNP binding; Category No. 14728—snRNP protein import into nucleus; Category No. 14729—social behavior; Category No. 14730—sodium channel activity; Category No. 14731—sodium channel complex; Category No. 14732—sodium channel inhibitor activity; Category No. 14733—sodium channel regulator activity; Category No. 14734—sodium ion binding; Category No. 14735—sodium ion export; Category No. 14736—sodium ion export from cell; Category No. 14737—sodium ion homeostasis; Category No. 14738—sodium ion import; Category No. 14739—sodium ion import across plasma membrane; Category No. 14740—sodium ion transmembrane transport; Category No. 14741—sodium ion transmembrane transporter activity; Category No. 14742—sodium ion transport; Category No. 14743—sodium:amino acid symporter activity; Category No. 14744—sodium:bicarbonate symporter activity; Category No. 14745—sodium:chloride symporter activity; Category No. 14746—sodium:dicarboxylate symporter activity; Category No. 14747—sodium:inorganic phosphate symporter activity; Category No. 14748—sodium:iodide symporter activity; Category No. 14749—sodium:phosphate symporter activity; Category No. 14750—sodium:potassium:chloride symporter activity; Category No. 14751—sodium:potassium-exchanging ATPase activity; Category No. 14752—sodium:potassium-exchanging ATPase activity involved in regulation of cardiac muscle cell membrane potential; Category No. 14753—sodium:potassium-exchanging ATPase complex; Category No. 14754—sodium:proton antiporter activity; Category No. 14755—sodium:proton antiporter activity involved in regulation of cardiac muscle cell membrane potential; Category No. 14756—sodium:sulfate symporter activity; Category No. 14757—sodium-dependent L-ascorbate transmembrane transporter activity; Category No. 14758—sodium-dependent multivitamin transmembrane transporter activity; Category No. 14759—sodium-dependent organic anion transmembrane transporter activity; Category No. 14760—sodium-dependent organic anion transport; Category No. 14761—sodium-dependent organic cation transport; Category No. 14762—sodium-dependent phosphate transmembrane transporter activity; Category No.

14763—sodium-dependent phosphate transport; Category No. 14764—sodium-exporting ATPase activity; Category No. 14765—sodium-independent icosanoid transport; Category No. 14766—sodium-independent organic anion transmembrane transporter activity; Category No. 14767—sodium-independent organic anion transport; Category No. 14768—soft palate development; Category No. 14769—soluble; Category No. 14770—soluble NSF attachment protein activity; Category No. 14771—solute:proton antiporter activity; Category No. 14772—solute:proton symporter activity; Category No. 14773—somatic cell DNA recombination; Category No. 14774—somatic diversification of immune receptors via somatic mutation; Category No. 14775—somatic diversification of immunoglobulins; Category No. 14776—somatic hypermutation of immunoglobulin genes; Category No. 14777—somatic motor neuron differentiation; Category No. 14778—somatic muscle development; Category No. 14779—somatic recombination of immunoglobulin gene segments; Category No. 14780—somatic recombination of immunoglobulin genes involved in immune response; Category No. 14781—somatic stem cell division; Category No. 14782—somatic stem cell population maintenance; Category No. 14783—somatodendritic compartment; Category No. 14784—somatostatin receptor activity; Category No. 14785—somatostatin receptor binding; Category No. 14786—somatostatin secretion; Category No. 14787—somatostatin signaling pathway; Category No. 14788—somatotropin secreting cell development; Category No. 14789—somatotropin secreting cell differentiation; Category No. 14790—somite development; Category No. 14791—somite rostral caudal axis specification; Category No. 14792—somite specification; Category No. 14793—somitogenesis; Category No. 14794—sorbitol biosynthetic process; Category No. 14795—sorbitol catabolic process; Category No. 14796—sorbitol metabolic process; Category No. 14797—sorting endosome; Category No. 14798—SOSS complex; Category No. 14799—sour taste receptor activity; Category No. 14800—spanning component of plasma membrane; Category No. 14801—specific for altered base; Category No. 14802—specific granule; Category No. 14803—specific granule membrane; Category No. 14804—specification of anterior mesonephric tubule identity; Category No. 14805—specification of axis polarity; Category No. 14806—specification of loop of Henle identity; Category No. 14807—specification of organ identity; Category No. 14808—specification of organ position; Category No. 14809—specification of posterior mesonephric tubule identity; Category No. 14810—specification of ureteric bud anterior posterior symmetry by BMP signaling pathway; Category No. 14811—spectrin; Category No. 14812—spectrin binding; Category No. 14813—spectrin-associated cytoskeleton; Category No. 14814—Spemann organizer formation; Category No. 14815—sperm annulus; Category No. 14816—sperm axoneme assembly; Category No. 14817—sperm capacitation; Category No. 14818—sperm chromatin condensation; Category No. 14819—sperm connecting piece; Category No. 14820—sperm cytoplasmic droplet; Category No. 14821—sperm displacement; Category No. 14822—sperm ejaculation; Category No. 14823—sperm end piece; Category No. 14824—sperm entry; Category No. 14825—sperm fibrous sheath; Category No. 14826—sperm flagellum; Category No. 14827—sperm individualization; Category No. 14828—sperm midpiece; Category No. 14829—sperm mitochondrial sheath; Category No. 14830—sperm mitochondrion organization; Category No. 14831—sperm motility; Category No. 14832—sperm plasma membrane; Category No. 14833—sperm principal piece; Category No. 14834—spermatid development; Category No. 14835—spermatid differentiation; Category No. 14836—spermatid nucleus differentiation; Category No. 14837—spermatid nucleus elongation; Category No. 14838—spermatogenesis; Category No. 14839—spermatoproteasome complex; Category No. 14840—sperm-egg recognition; Category No. 14841—spermidine acetylation; Category No. 14842—spermidine biosynthetic process; Category No. 14843—spermidine catabolic process; Category No. 14844—spermidine synthase activity; Category No. 14845—spermidine:oxygen oxidoreductase (3-aminopropanal-forming) activity; Category No. 14846—spermine acetylation; Category No. 14847—spermine biosynthetic process; Category No. 14848—spermine catabolic process; Category No. 14849—spermine synthase activity; Category No. 14850—spermine transport; Category No. 14851—spermine:oxygen oxidoreductase (spermidine-forming) activity; Category No. 14852—spherical high-density lipoprotein particle; Category No. 14853—sphinganine biosynthetic process; Category No. 14854—sphinganine kinase activity; Category No. 14855—sphinganine metabolic process; Category No. 14856—sphinganine-1-phosphate aldolase activity; Category No. 14857—sphinganine-1-phosphate biosynthetic process; Category No. 14858—sphinganine-1-phosphate metabolic process; Category No. 14859—sphingoid biosynthetic process; Category No. 14860—sphingoid catabolic process; Category No. 14861—sphingolipid binding; Category No. 14862—sphingolipid biosynthetic process; Category No. 14863—sphingolipid catabolic process; Category No. 14864—sphingolipid delta-4 desaturase activity; Category No. 14865—sphingolipid metabolic process; Category No. 14866—sphingolipid transporter activity; Category No. 14867—sphingomyelin biosynthetic process; Category No. 14868—sphingomyelin catabolic process; Category No. 14869—sphingomyelin metabolic process; Category No. 14870—sphingomyelin phosphodiesterase activator activity; Category No. 14871—sphingomyelin phosphodiesterase activity; Category No. 14872—sphingomyelin phosphodiesterase D activity; Category No. 14873—sphingomyelin synthase activity; Category No. 14874—sphingosine biosynthetic process; Category No. 14875—sphingosine hydroxylase activity; Category No. 14876—sphingosine metabolic process; Category No. 14877—sphingosine N-acyltransferase activity; Category No. 14878—sphingosine-1-phosphate phosphatase activity; Category No. 14879—sphingosine-1-phosphate receptor activity; Category No. 14880—sphingosine-1-phosphate signaling pathway; Category No. 14881—spinal cord anterior posterior patterning; Category No. 14882—spinal cord association neuron differentiation; Category No. 14883—spinal cord development; Category No. 14884—spinal cord dorsal ventral patterning; Category No. 14885—spinal cord motor neuron cell fate specification; Category No. 14886—spinal cord motor neuron differentiation; Category No. 14887—spinal cord motor neuron migration; Category No. 14888—spinal cord oligodendrocyte cell differentiation; Category No. 14889—spinal cord oligodendrocyte cell fate specification; Category No. 14890—spinal cord patterning; Category No. 14891—spinal cord ventral commissure morphogenesis; Category No. 14892—spinal reflex action; Category No. 14893—spindle; Category No. 14894—spindle assembly; Category No. 14895—spindle assembly checkpoint; Category No. 14896—spindle assembly involved in female meiosis; Category No. 14897—spindle assembly involved in female meiosis I; Category No. 14898—spindle assembly involved in meiosis; Category No. 14899—spindle checkpoint; Category No.

14900—spindle localization; Category No. 14901—spindle matrix; Category No. 14902—spindle microtubule; Category No. 14903—spindle midzone; Category No. 14904—spindle midzone assembly; Category No. 14905—spindle organization; Category No. 14906—spindle pole; Category No. 14907—spindle pole body; Category No. 14908—spindle pole centrosome; Category No. 14909—spindle stabilization; Category No. 14910—spleen development; Category No. 14911—spleen trabecula formation; Category No. 14912—spliceosomal complex; Category No. 14913—spliceosomal complex assembly; Category No. 14914—spliceosomal complex disassembly; Category No. 14915—spliceosomal snRNP assembly; Category No. 14916—spliceosomal snRNP complex; Category No. 14917—spliceosomal tri-snRNP complex; Category No. 14918—spliceosomal tri-snRNP complex assembly; Category No. 14919—splicing factor protein import into nucleus; Category No. 14920—spongiotrophoblast differentiation; Category No. 14921—spongiotrophoblast layer development; Category No. 14922—spongiotrophoblast layer developmental growth; Category No. 14923—spontaneous neurotransmitter secretion; Category No. 14924—spot adherens junction; Category No. 14925—SPOTS complex; Category No. 14926—spreading of cells; Category No. 14927—spreading of epidermal cells; Category No. 14928—sprouting angiogenesis; Category No. 14929—squalene monooxygenase activity; Category No. 14930—squalene synthase activity; Category No. 14931—squamous basal epithelial stem cell differentiation involved in prostate gland acinus development; Category No. 14932—SREBP signaling pathway; Category No. 14933—SREBP-SCAP-Insig complex; Category No. 14934—SRP-dependent cotranslational protein targeting to membrane; Category No. 14935—S-shaped body morphogenesis; Category No. 14936—stabilization of membrane potential; Category No. 14937—STAGA complex; Category No. 14938—starch binding; Category No. 14939—starch catabolic process; Category No. 14940—startle response; Category No. 14941—STAT protein import into nucleus; Category No. 14942—stearoyl-CoA 9-desaturase activity; Category No. 14943—stem cell development; Category No. 14944—stem cell differentiation; Category No. 14945—stem cell division; Category No. 14946—stem cell factor receptor activity; Category No. 14947—stem cell factor receptor binding; Category No. 14948—stem cell fate specification; Category No. 14949—stem cell population maintenance; Category No. 14950—stem cell proliferation; Category No. 14951—stereocilia ankle link; Category No. 14952—stereocilia ankle link complex; Category No. 14953—stereocilium; Category No. 14954—stereocilium bundle; Category No. 14955—stereocilium bundle tip; Category No. 14956—stereocilium membrane; Category No. 14957—steroid 11-beta-monooxygenase activity; Category No. 14958—steroid 17-alpha-monooxygenase activity; Category No. 14959—steroid 21-monooxygenase activity; Category No. 14960—steroid 7-alpha-hydroxylase activity; Category No. 14961—steroid binding; Category No. 14962—steroid biosynthetic process; Category No. 14963—steroid catabolic process; Category No. 14964—steroid dehydrogenase activity; Category No. 14965—steroid delta-isomerase activity; Category No. 14966—steroid hormone binding; Category No. 14967—steroid hormone mediated signaling pathway; Category No. 14968—steroid hormone receptor activity; Category No. 14969—steroid hormone receptor binding; Category No. 14970—steroid hormone receptor complex assembly; Category No. 14971—steroid hydroxylase activity; Category No. 14972—steroid metabolic process; Category No. 14973—steroid receptor RNA activator RNA binding; Category No. 14974—steroid sulfotransferase activity; Category No. 14975—sterol 12-alpha-hydroxylase activity; Category No. 14976—sterol 14-demethylase activity; Category No. 14977—sterol 5-alpha reductase activity; Category No. 14978—sterol binding; Category No. 14979—sterol biosynthetic process; Category No. 14980—sterol esterase activity; Category No. 14981—sterol homeostasis; Category No. 14982—sterol metabolic process; Category No. 14983—sterol O-acyltransferase activity; Category No. 14984—sterol regulatory element binding protein import into nucleus; Category No. 14985—sterol response element binding; Category No. 14986—sterol transport; Category No. 14987—sterol transporter activity; Category No. 14988—sterol-4-alpha-carboxylate 3-dehydrogenase (decarboxylating) activity; Category No. 14989—sterol-transporting ATPase activity; Category No. 14990—steryl-sulfatase activity; Category No. 14991—stilbene catabolic process; Category No. 14992—stimulatory C-type lectin receptor signaling pathway; Category No. 14993—Stn1-Ten1 complex; Category No. 14994—stomach neuroendocrine cell differentiation; Category No. 14995—storage vacuole; Category No. 14996—store-operated calcium channel activity; Category No. 14997—store-operated calcium entry; Category No. 14998—strand invasion; Category No. 14999—stress fiber; Category No. 15000—stress fiber assembly; Category No. 15001—stress granule assembly; Category No. 15002—stress granule disassembly; Category No. 15003—stress-activated MAPK cascade; Category No. 15004—stress-activated protein kinase signaling cascade; Category No. 15005—stress-induced mitochondrial fusion; Category No. 15006—stress-induced premature senescence; Category No. 15007—stretch-activated; Category No. 15008—striatal medium spiny neuron differentiation; Category No. 15009—striated muscle atrophy; Category No. 15010—striated muscle cell development; Category No. 15011—striated muscle cell differentiation; Category No. 15012—striated muscle contraction; Category No. 15013—striated muscle myosin thick filament; Category No. 15014—striated muscle thin filament; Category No. 15015—striated muscle tissue development; Category No. 15016—striatum development; Category No. 15017—strictosidine synthase activity; Category No. 15018—stromal-epithelial cell signaling involved in prostate gland development; Category No. 15019—structural constituent of bone; Category No. 15020—structural constituent of cell wall; Category No. 15021—structural constituent of cytoskeleton; Category No. 15022—structural constituent of epidermis; Category No. 15023—structural constituent of eye lens; Category No. 15024—structural constituent of muscle; Category No. 15025—structural constituent of myelin sheath; Category No. 15026—structural constituent of nuclear pore; Category No. 15027—structural constituent of ribosome; Category No. 15028—structural constituent of tooth enamel; Category No. 15029—structural molecule activity; Category No. 15030—structural molecule activity conferring elasticity; Category No. 15031—structure-specific DNA binding; Category No. 15032—subapical complex; Category No. 15033—sublamina densa; Category No. 15034—submandibular salivary gland formation; Category No. 15035—subpallium development; Category No. 15036—subpallium neuron fate commitment; Category No. 15037—subsarcolemmal mitochondrion; Category No. 15038—substance K receptor activity; Category No. 15039—substance P catabolic process; Category No. 15040—substance P receptor activity; Category No. 15041—substance P receptor binding; Category No.

15042—substantia nigra development; Category No. 15043—substrate adhesion-dependent cell spreading; Category No. 15044—substrate release; Category No. 15045—substrate-dependent cell migration; Category No. 15046—substrate-specific transmembrane transporter activity; Category No. 15047—subthalamic nucleus development; Category No. 15048—subthalamus development; Category No. 15049—succinate dehydrogenase (ubiquinone) activity; Category No. 15050—succinate dehydrogenase activity; Category No. 15051—succinate dehydrogenase complex; Category No. 15052—succinate dehydrogenase complex (ubiquinone); Category No. 15053—succinate metabolic process; Category No. 15054—succinate to ubiquinone; Category No. 15055—succinate transmembrane transport; Category No. 15056—succinate transmembrane transporter activity; Category No. 15057—succinate transport; Category No. 15058—succinate-CoA ligase (ADP-forming) activity; Category No. 15059—succinate-CoA ligase (GDP-forming) activity; Category No. 15060—succinate-hydroxymethylglutarate CoA-transferase activity; Category No. 15061—succinate-semialdehyde dehydrogenase (NAD+) activity; Category No. 15062—succinate-semialdehyde dehydrogenase [NAD(P)+] activity; Category No. 15063—succinate-semialdehyde dehydrogenase binding; Category No. 15064—succinyl-CoA hydrolase activity; Category No. 15065—succinyl-CoA metabolic process; Category No. 15066—succinyl-CoA pathway; Category No. 15067—suckling behavior; Category No. 15068—sucrose alpha-glucosidase activity; Category No. 15069—sucrose metabolic process; Category No. 15070—sugar transmembrane transporter activity; Category No. 15071—sugar:proton symporter activity; Category No. 15072—sulfate adenylyltransferase (ATP) activity; Category No. 15073—sulfate assimilation; Category No. 15074—sulfate binding; Category No. 15075—sulfate transmembrane transport; Category No. 15076—sulfate transmembrane transporter activity; Category No. 15077—sulfate transport; Category No. 15078—sulfation; Category No. 15079—sulfide oxidation; Category No. 15080—sulfide:quinone oxidoreductase activity; Category No. 15081—sulfinoalanine decarboxylase activity; Category No. 15082—sulfiredoxin activity; Category No. 15083—sulfite oxidase activity; Category No. 15084—sulfonylurea receptor activity; Category No. 15085—sulfonylurea receptor binding; Category No. 15086—sulfotransferase activity; Category No. 15087—sulfur amino acid biosynthetic process; Category No. 15088—sulfur amino acid catabolic process; Category No. 15089—sulfur amino acid metabolic process; Category No. 15090—sulfur compound metabolic process; Category No. 15091—sulfur dioxygenase activity; Category No. 15092—sulfur oxidation; Category No. 15093—sulfuric ester hydrolase activity; Category No. 15094—sulfurtransferase activity; Category No. 15095—SUMO activating enzyme activity; Category No. 15096—SUMO activating enzyme complex; Category No. 15097—SUMO binding; Category No. 15098—SUMO conjugating enzyme activity; Category No. 15099—SUMO ligase activity; Category No. 15100—SUMO polymer binding; Category No. 15101—SUMO transferase activity; Category No. 15102—SUMO-specific isopeptidase activity; Category No. 15103—SUMO-specific protease activity; Category No. 15104—SUMO-targeted ubiquitin ligase complex; Category No. 15105—sumoylated E2 ligase complex; Category No. 15106—supercoiled DNA binding; Category No. 15107—superior olivary nucleus maturation; Category No. 15108—superior temporal gyrus development; Category No. 15109—superior vena cava morphogenesis; Category No. 15110—superoxide anion generation; Category No. 15111—superoxide dismutase activity; Category No. 15112—superoxide dismutase copper chaperone activity; Category No. 15113—superoxide metabolic process; Category No. 15114—superoxide-generating NADPH oxidase activator activity; Category No. 15115—superoxide-generating NADPH oxidase activity; Category No. 15116—suppression by virus of host apoptotic process; Category No. 15117—suppression by virus of host autophagy; Category No. 15118—suppression by virus of host molecular function; Category No. 15119—supraspliceosomal complex; Category No. 15120—suramin binding; Category No. 15121—surfactant homeostasis; Category No. 15122—susceptibility to natural killer cell mediated cytotoxicity; Category No. 15123—susceptibility to T cell mediated cytotoxicity; Category No. 15124—sweet taste receptor activity; Category No. 15125—sweet taste receptor complex; Category No. 15126—SWI SNF complex; Category No. 15127—SWI SNF superfamily-type complex; Category No. 15128—Swi5-Sfr1 complex; Category No. 15129—swimming behavior; Category No. 15130—Swr1 complex; Category No. 15131—symbiont-containing vacuole; Category No. 15132—symbiont-containing vacuole membrane; Category No. 15133—symmetric synapse; Category No. 15134—sympathetic ganglion development; Category No. 15135—sympathetic nervous system development; Category No. 15136—sympathetic neuron projection extension; Category No. 15137—sympathetic neuron projection guidance; Category No. 15138—symporter activity; Category No. 15139—synapse; Category No. 15140—synapse assembly; Category No. 15141—synapse assembly involved in innervation; Category No. 15142—synapse maturation; Category No. 15143—synapse organization; Category No. 15144—synapsis; Category No. 15145—synaptic cleft; Category No. 15146—synaptic growth at neuromuscular junction; Category No. 15147—synaptic membrane; Category No. 15148—synaptic target recognition; Category No. 15149—synaptic transmission; Category No. 15150—synaptic transmission involved in micturition; Category No. 15151—synaptic vesicle; Category No. 15152—synaptic vesicle amine transport; Category No. 15153—synaptic vesicle budding; Category No. 15154—synaptic vesicle clustering; Category No. 15155—synaptic vesicle docking; Category No. 15156—synaptic vesicle endocytosis; Category No. 15157—synaptic vesicle exocytosis; Category No. 15158—synaptic vesicle fusion to presynaptic membrane; Category No. 15159—synaptic vesicle lumen acidification; Category No. 15160—synaptic vesicle maturation; Category No. 15161—synaptic vesicle membrane; Category No. 15162—synaptic vesicle membrane organization; Category No. 15163—synaptic vesicle priming; Category No. 15164—synaptic vesicle recycling; Category No. 15165—synaptic vesicle targeting; Category No. 15166—synaptic vesicle to endosome fusion; Category No. 15167—synaptic vesicle transport; Category No. 15168—synaptic vesicle uncoating; Category No. 15169—synaptobrevin 2-SNAP-25-syntaxin-1a complex; Category No. 15170—synaptobrevin 2-SNAP-25-syntaxin-1a-complexin I complex; Category No. 15171—synaptobrevin 2-SNAP-25-syntaxin-1a-complexin II complex; Category No. 15172—synaptobrevin 2-SNAP-25-syntaxin-3-complexin complex; Category No. 15173—synaptonemal complex; Category No. 15174—synaptonemal complex assembly; Category No. 15175—synaptonemal complex disassembly; Category No. 15176—synaptonemal complex organization; Category No. 15177—syncytiotrophoblast cell differentiation involved in labyrinthine layer development; Category No. 15178—syncytium formation; Category No. 15179—syndecan binding; Category No. 15180—syntaxin binding; Category No. 15181—syntaxin-1 binding; Category No. 15182—syntaxin-3 binding; Category No. 15183—synthesis of RNA primer; Category No. 15184—syntrophin complex; Category No. 15185—T cell activation; Category No. 15186—T cell activation involved in immune response; Category No. 15187—T cell activation via T cell receptor contact with antigen bound to MHC molecule on antigen presenting cell; Category No. 15188—T cell aggregation; Category No. 15189—T cell antigen processing and presentation; Category No. 15190—T cell apoptotic process; Category No. 15191—T cell chemotaxis; Category No. 15192—T cell costimulation; Category No. 15193—T cell cytokine production; Category No. 15194—T cell differentiation; Category No. 15195—T cell differentiation in thymus; Category No. 15196—T cell differentiation involved in immune response; Category No. 15197—T cell homeostasis; Category No. 15198—T cell homeostatic proliferation; Category No. 15199—T cell lineage commitment; Category No. 15200—T cell mediated cytotoxicity; Category No. 15201—T cell mediated immunity; Category No. 15202—T cell migration; Category No. 15203—T cell proliferation; Category No. 15204—T cell proliferation involved in immune response; Category No. 15205—T cell receptor binding; Category No. 15206—T cell receptor complex; Category No. 15207—T cell receptor signaling pathway; Category No. 15208—T cell receptor V(D)J recombination; Category No. 15209—T cell secretory granule organization; Category No. 15210—T cell selection; Category No. 15211—T cell tolerance induction; Category No. 15212—T follicular helper cell differentiation; Category No. 15213—tachykinin receptor activity; Category No. 15214—tachykinin receptor signaling pathway; Category No. 15215—tail-anchored membrane protein insertion into ER membrane; Category No. 15216—talin binding; Category No. 15217—tangential migration from the subventricular zone to the olfactory bulb; Category No. 15218—TAP binding; Category No. 15219—TAP complex; Category No. 15220—TAP1 binding; Category No. 15221—TAP2 binding; Category No. 15222—tapasin binding; Category No. 15223—TAP-dependent; Category No. 15224—TAP-independent; Category No. 15225—targeting of mRNA for destruction involved in RNA interference; Category No. 15226—taste bud development; Category No. 15227—taste receptor activity; Category No. 15228—taste receptor binding; Category No. 15229—Tat protein binding; Category No. 15230—tau protein binding; Category No. 15231—tau-protein kinase activity; Category No. 15232—taurine binding; Category No. 15233—taurine biosynthetic process; Category No. 15234—taurine metabolic process; Category No. 15235—taurine transmembrane transporter activity; Category No. 15236—taurine transport; Category No. 15237—taurine:sodium symporter activity; Category No. 15238—taurochenodeoxycholate 6alpha-hydroxylase activity; Category No. 15239—TBP-class protein binding; Category No. 15240—t-circle formation; Category No. 15241—TCR signalosome; Category No. 15242—TCR signalosome assembly; Category No. 15243—TCTN-B9D complex; Category No. 15244—TDP phosphorylation; Category No. 15245—tear secretion; Category No. 15246—telencephalon cell migration; Category No. 15247—telencephalon development; Category No. 15248—telencephalon regionalization; Category No. 15249—telethonin binding; Category No. 15250—telomerase activity; Category No. 15251—telomerase catalytic core complex; Category No. 15252—telomerase holoenzyme complex; Category No. 15253—telomerase inhibitor activity; Category No. 15254—telomere assembly; Category No. 15255—telomere capping; Category No. 15256—telomere formation via telomerase; Category No. 15257—telomere maintenance; Category No. 15258—telomere maintenance in response to DNA damage; Category No. 15259—telomere maintenance via recombination; Category No. 15260—telomere maintenance via semi-conservative replication; Category No. 15261—telomere maintenance via telomerase; Category No. 15262—telomere maintenance via telomere lengthening; Category No. 15263—telomere organization; Category No. 15264—telomeric 3' overhang formation; Category No. 15265—telomeric DNA binding; Category No. 15266—telomeric heterochromatin; Category No. 15267—telomeric loop disassembly; Category No. 15268—telomeric loop formation; Category No. 15269—telomeric region; Category No. 15270—telomeric RNA binding; Category No. 15271—telomeric template RNA reverse transcriptase activity; Category No. 15272—telosome; Category No. 15273—temperature homeostasis; Category No. 15274—temperature-gated cation channel activity; Category No. 15275—temperature-gated ion channel activity; Category No. 15276—tendon cell differentiation; Category No. 15277—tendon development; Category No. 15278—tendon formation; Category No. 15279—tendon sheath development; Category No. 15280—terminal bouton; Category No. 15281—terminal button organization; Category No. 15282—terminal cisterna; Category No. 15283—terminal cisterna lumen; Category No. 15284—terminal loop; Category No. 15285—terminal web; Category No. 15286—terminal web assembly; Category No. 15287—termination; Category No. 15288—termination of G-protein coupled receptor signaling pathway; Category No. 15289—termination of mitochondrial transcription; Category No. 15290—termination of RNA polymerase I transcription; Category No. 15291—termination of RNA polymerase II transcription; Category No. 15292—termination of RNA polymerase III transcription; Category No. 15293—termination of signal transduction; Category No. 15294—terpene metabolic process; Category No. 15295—tertiary branching involved in mammary gland duct morphogenesis; Category No. 15296—tertiary granule; Category No. 15297—tertiary granule membrane; Category No. 15298—TERT-RMRP complex; Category No. 15299—testosterone 17-beta-dehydrogenase (NADP+) activity; Category No. 15300—testosterone 6-beta-hydroxylase activity; Category No. 15301—testosterone biosynthetic process; Category No. 15302—testosterone dehydrogenase (NAD+) activity; Category No. 15303—testosterone dehydrogenase [NAD (P)] activity; Category No. 15304—tetracycline transport; Category No. 15305—tetracycline transporter activity; Category No. 15306—tetrahydrobiopterin binding; Category No. 15307—tetrahydrobiopterin biosynthetic process; Category No. 15308—tetrahydrobiopterin metabolic process; Category No. 15309—tetrahydrofolate biosynthetic process; Category No. 15310—tetrahydrofolate interconversion; Category No. 15311—tetrahydrofolate metabolic process; Category No. 15312—tetrahydrofolyl-poly(glutamate) polymer binding; Category No. 15313—tetrahydrofolylpolyglutamate biosynthetic process; Category No. 15314—tetrahydrofolylpolyglutamate metabolic process; Category No. 15315—tetrahydrofolylpolyglutamate synthase activity; Category No. 15316—tetrapyrrole binding; Category No. 15317—tetrapyrrole biosynthetic process; Category No. 15318—tetraspanin-enriched microdomain; Category No. 15319—TFIIB-class binding; Category No. 15320—TFIIB-class transcription factor binding; Category No. 15321—TFIID-class transcription factor binding; Category No.

15322—TFIIH-class transcription factor binding; Category No. 15323—TFIIIC-class transcription factor binding; Category No. 15324—TFIIK complex; Category No. 15325—thalamus development; Category No. 15326—T-helper 1 cell activation; Category No. 15327—T-helper 1 cell differentiation; Category No. 15328—T-helper 1 cell lineage commitment; Category No. 15329—T-helper 1 type immune response; Category No. 15330—T-helper 17 cell chemotaxis; Category No. 15331—T-helper 17 cell differentiation; Category No. 15332—T-helper 17 cell lineage commitment; Category No. 15333—T-helper 2 cell activation; Category No. 15334—T-helper 2 cell cytokine production; Category No. 15335—T-helper 2 cell differentiation; Category No. 15336—T-helper cell differentiation; Category No. 15337—T-helper cell lineage commitment; Category No. 15338—thermoception; Category No. 15339—thermosensory behavior; Category No. 15340—thiamine binding; Category No. 15341—thiamine diphosphate biosynthetic process; Category No. 15342—thiamine diphosphate metabolic process; Category No. 15343—thiamine diphosphokinase activity; Category No. 15344—thiamine metabolic process; Category No. 15345—thiamine phosphate phosphatase activity; Category No. 15346—thiamine pyrophosphate binding; Category No. 15347—thiamine transmembrane transport; Category No. 15348—thiamine transmembrane transporter activity; Category No. 15349—thiamine transport; Category No. 15350—thiamine uptake transmembrane transporter activity; Category No. 15351—thiamine-containing compound metabolic process; Category No. 15352—thiamin-triphosphatase activity; Category No. 15353—thiocyanate metabolic process; Category No. 15354—thiocyanate peroxidase activity; Category No. 15355—thioesterase binding; Category No. 15356—thioether S-methyltransferase activity; Category No. 15357—thiol oxidase activity; Category No. 15358—thiolester hydrolase activity; Category No. 15359—thiomorpholine-carboxylate dehydrogenase activity; Category No. 15360—thiopurine S-methyltransferase activity; Category No. 15361—thioredoxin disulfide as acceptor; Category No. 15362—thioredoxin peroxidase activity; Category No. 15363—thioredoxin-disulfide reductase activity; Category No. 15364—thiosulfate sulfurtransferase activity; Category No. 15365—third ventricle development; Category No. 15366—THO complex; Category No. 15367—THO complex part of transcription export complex; Category No. 15368—thorax and anterior abdomen determination; Category No. 15369—threonine biosynthetic process; Category No. 15370—threonine catabolic process; Category No. 15371—threonine metabolic process; Category No. 15372—threonine racemase activity; Category No. 15373—threonine synthase activity; Category No. 15374—threonine transport; Category No. 15375—threonine-tRNA ligase activity; Category No. 15376—threonine-type endopeptidase activity; Category No. 15377—threonyl-tRNA aminoacylation; Category No. 15378—thrombin receptor activity; Category No. 15379—thrombin receptor signaling pathway; Category No. 15380—thrombopoietin receptor activity; Category No. 15381—thrombopoietin-mediated signaling pathway; Category No. 15382—thrombospondin receptor activity; Category No. 15383—thromboxane A2 receptor activity; Category No. 15384—thromboxane A2 receptor binding; Category No. 15385—thromboxane A2 signaling pathway; Category No. 15386—thromboxane receptor activity; Category No. 15387—thromboxane-A synthase activity; Category No. 15388—thymic T cell selection; Category No. 15389—thymidine biosynthetic process; Category No. 15390—thymidine catabolic process; Category No. 15391—thymidine kinase activity; Category No. 15392—thymidine metabolic process; Category No. 15393—thymidine phosphorylase activity; Category No. 15394—thymidylate kinase activity; Category No. 15395—thymidylate synthase activity; Category No. 15396—thymine binding; Category No. 15397—thymine catabolic process; Category No. 15398—thymine metabolic process; Category No. 15399—thymocyte apoptotic process; Category No. 15400—thymus development; Category No. 15401—thymus epithelium morphogenesis; Category No. 15402—thyroid gland development; Category No. 15403—thyroid hormone binding; Category No. 15404—thyroid hormone catabolic process; Category No. 15405—thyroid hormone generation; Category No. 15406—thyroid hormone mediated signaling pathway; Category No. 15407—thyroid hormone metabolic process; Category No. 15408—thyroid hormone receptor activity; Category No. 15409—thyroid hormone receptor binding; Category No. 15410—thyroid hormone receptor coactivator activity; Category No. 15411—thyroid hormone transmembrane transporter activity; Category No. 15412—thyroid hormone transport; Category No. 15413—thyroid-stimulating hormone receptor activity; Category No. 15414—thyroid-stimulating hormone signaling pathway; Category No. 15415—thyroid-stimulating hormone-secreting cell differentiation; Category No. 15416—thyrotropin-releasing hormone activity; Category No. 15417—thyrotropin-releasing hormone receptor activity; Category No. 15418—thyrotropin-releasing hormone receptor binding; Category No. 15419—thyroxine 5'-deiodinase activity; Category No. 15420—thyroxine 5-deiodinase activity; Category No. 15421—Tie signaling pathway; Category No. 15422—TIR domain binding; Category No. 15423—TIRAP-dependent toll-like receptor 4 signaling pathway; Category No. 15424—tissue development; Category No. 15425—tissue homeostasis; Category No. 15426—tissue morphogenesis; Category No. 15427—tissue regeneration; Category No. 15428—tissue remodeling; Category No. 15429—titin binding; Category No. 15430—titin Z domain binding; Category No. 15431—Tle3-Aes complex; Category No. 15432—TNFSF11-mediated signaling pathway; Category No. 15433—to asymmetrical-dimethyl arginine; Category No. 15434—to symmetrical-dimethyl arginine; Category No. 15435—tocotrienol omega-hydroxylase activity; Category No. 15436—tolerance induction; Category No. 15437—tolerance induction to lipopolysaccharide; Category No. 15438—tolerance induction to non-self antigen; Category No. 15439—tolerance induction to self antigen; Category No. 15440—Toll binding; Category No. 15441—Toll signaling pathway; Category No. 15442—toll-like receptor 1 signaling pathway; Category No. 15443—toll-like receptor 10 signaling pathway; Category No. 15444—Toll-like receptor 1-Toll-like receptor 2 protein complex; Category No. 15445—Toll-like receptor 2 binding; Category No. 15446—toll-like receptor 2 signaling pathway; Category No. 15447—Toll-like receptor 2-Toll-like receptor 6 protein complex; Category No. 15448—toll-like receptor 3 signaling pathway; Category No. 15449—Toll-like receptor 4 binding; Category No. 15450—toll-like receptor 4 signaling pathway; Category No. 15451—toll-like receptor 5 signaling pathway; Category No. 15452—toll-like receptor 6 signaling pathway; Category No. 15453—toll-like receptor 7 signaling pathway; Category No. 15454—toll-like receptor 9 signaling pathway; Category No. 15455—Toll-like receptor binding; Category No. 15456—toll-like receptor signaling pathway; Category No. 15457—toll-like receptor TLR1:TLR2 signaling pathway; Category No. 15458—toll-like receptor TLR6:TLR2 signaling pathway; Category No. 15459—tongue development; Category No. 15460—tongue morphogenesis; Category No. 15461—tonic smooth muscle contraction; Category No. 15462—tooth eruption; Category No. 15463—tooth mineralization; Category No. 15464—TOR signaling; Category No. 15465—TORC1 complex; Category No. 15466—TORC2 complex; Category No. 15467—TORC2 signaling; Category No. 15468—toxic substance binding; Category No. 15469—toxin biosynthetic process; Category No. 15470—toxin metabolic process; Category No. 15471—toxin transport; Category No. 15472—toxin transporter activity; Category No. 15473—TPR domain binding; Category No. 15474—trabecula morphogenesis; Category No. 15475—trabecular meshwork development; Category No. 15476—trace-amine receptor activity; Category No. 15477—trachea cartilage development; Category No. 15478—trachea cartilage morphogenesis; Category No. 15479—trachea development; Category No. 15480—trachea formation; Category No. 15481—trachea gland development; Category No. 15482—trachea morphogenesis; Category No. 15483—TRAF2-GSTP1 complex; Category No. 15484—TRAIL binding; Category No. 15485—TRAIL-activated apoptotic signaling pathway; Category No. 15486—TRAM-dependent toll-like receptor 4 signaling pathway; Category No. 15487—trans-1,2-dihydrobenzene-1,2-diol dehydrogenase activity; Category No. 15488—trans-2-enoyl-CoA reductase (NADPH) activity; Category No. 15489—transaminase activity; Category No. 15490—transcription; Category No. 15491—transcription coactivator activity; Category No. 15492—transcription coactivator binding; Category No. 15493—transcription cofactor activity; Category No. 15494—transcription cofactor binding; Category No. 15495—transcription corepressor activity; Category No. 15496—transcription corepressor binding; Category No. 15497—transcription elongation factor complex; Category No. 15498—transcription elongation from RNA polymerase I promoter; Category No. 15499—transcription elongation from RNA polymerase II promoter; Category No. 15500—transcription elongation from RNA polymerase III promoter; Category No. 15501—transcription export complex; Category No. 15502—transcription export complex 2; Category No. 15503—transcription factor activity; Category No. 15504—transcription factor binding; Category No. 15505—transcription factor complex; Category No. 15506—transcription factor import into nucleus; Category No. 15507—transcription factor TFIIA complex; Category No. 15508—transcription factor TFIID complex; Category No. 15509—transcription factor TFIIE complex; Category No. 15510—transcription factor TFIIF complex; Category No. 15511—transcription factor TFIIIB complex; Category No. 15512—transcription factor TFIIIB complex assembly; Category No. 15513—transcription factor TFIIIC complex; Category No. 15514—transcription factor TFTC complex; Category No. 15515—transcription from mitochondrial promoter; Category No. 15516—transcription from RNA polymerase I promoter; Category No. 15517—transcription from RNA polymerase II promoter; Category No. 15518—transcription from RNA polymerase III promoter; Category No. 15519—transcription initiation from mitochondrial promoter; Category No. 15520—transcription initiation from RNA polymerase I promoter; Category No. 15521—transcription initiation from RNA polymerase II promoter; Category No. 15522—transcription initiation from RNA polymerase III promoter; Category No. 15523—transcription of nuclear large rRNA transcript from RNA polymerase I promoter; Category No. 15524—transcription regulatory region DNA binding; Category No. 15525—transcription regulatory region sequence-specific DNA binding; Category No. 15526—transcription termination site sequence-specific DNA binding; Category No. 15527—transcriptional activation by promoter-enhancer looping; Category No. 15528—transcriptional activator activity; Category No. 15529—transcriptional open complex formation at RNA polymerase II promoter; Category No. 15530—transcriptional repressor activity; Category No. 15531—transcriptional repressor complex; Category No. 15532—transcriptionally active chromatin; Category No. 15533—transcription-coupled nucleotide-excision repair; Category No. 15534—transcription-dependent tethering of RNA polymerase II gene DNA at nuclear periphery; Category No. 15535—transcytosis; Category No. 15536—transdifferentiation; Category No. 15537—transepithelial ammonium transport; Category No. 15538—transepithelial chloride transport; Category No. 15539—transepithelial L-ascorbic acid transport; Category No. 15540—transepithelial transport; Category No. 15541—transepithelial water transport; Category No. 15542—transferase activity; Category No. 15543—transferase complex; Category No. 15544—transferrin receptor activity; Category No. 15545—transferrin receptor binding; Category No. 15546—transferrin transmembrane transporter activity; Category No. 15547—transferrin transport; Category No. 15548—transferring acyl groups; Category No. 15549—transferring acyl groups other than amino-acyl groups; Category No. 15550—transferring alkyl or aryl (other than methyl) groups; Category No. 15551—transferring electrons from CoQH2-cytochrome c reductase complex and cytochrome c oxidase complex activity; Category No. 15552—transferring glucose-1-phosphate; Category No. 15553—transferring glycosyl groups; Category No. 15554—transferring hexosyl groups; Category No. 15555—transferring pentosyl groups; Category No. 15556—transferring phosphorus-containing groups; Category No. 15557—transferring selenium-containing groups; Category No. 15558—transformation of host cell by virus; Category No. 15559—transformed cell apoptotic process; Category No. 15560—transforming growth factor beta activation; Category No. 15561—transforming growth factor beta binding; Category No. 15562—transforming growth factor beta receptor; Category No. 15563—transforming growth factor beta receptor activity; Category No. 15564—transforming growth factor beta receptor activity type I; Category No. 15565—transforming growth factor beta receptor activity type II; Category No. 15566—transforming growth factor beta receptor activity type III; Category No. 15567—transforming growth factor beta receptor binding; Category No. 15568—transforming growth factor beta receptor complex assembly; Category No. 15569—transforming growth factor beta receptor homodimeric complex; Category No. 15570—transforming growth factor beta receptor signaling pathway; Category No. 15571—transforming growth factor beta receptor signaling pathway involved in primitive streak formation; Category No. 15572—transforming growth factor beta-activated receptor activity; Category No. 15573—trans-Golgi network; Category No. 15574—trans-Golgi network membrane; Category No. 15575—trans-Golgi network membrane organization; Category No. 15576—trans-Golgi network to recycling endosome transport; Category No. 15577—trans-Golgi network transport vesicle; Category No. 15578—trans-Golgi network transport vesicle membrane; Category No. 15579—trans-Golgi to endosome; Category No. 15580—trans-hexaprenyltranstransferase activity; Category No. 15581—transition between fast and slow fiber; Category No. 15582—transition between slow and fast fiber;

Category No. 15583—transition metal ion binding; Category No. 15584—transition metal ion transmembrane transporter activity; Category No. 15585—transitional one stage B cell differentiation; Category No. 15586—transketolase activity; Category No. 15587—trans-L-3-hydroxyproline dehydratase activity; Category No. 15588—translation; Category No. 15589—translation activator activity; Category No. 15590—translation elongation factor activity; Category No. 15591—translation factor activity; Category No. 15592—translation initiation factor activity; Category No. 15593—translation initiation factor binding; Category No. 15594—translation initiation ternary complex; Category No. 15595—translation regulator activity; Category No. 15596—translation release factor activity; Category No. 15597—translation release factor complex; Category No. 15598—translation repressor activity; Category No. 15599—translation termination factor activity; Category No. 15600—translational attenuation; Category No. 15601—translational elongation; Category No. 15602—translational frameshifting; Category No. 15603—translational initiation; Category No. 15604—translational termination; Category No. 15605—translesion synthesis; Category No. 15606—translocation; Category No. 15607—translocation of peptides or proteins into host cell cytoplasm; Category No. 15608—transmembrane electron transfer carrier; Category No. 15609—transmembrane receptor protein serine threonine kinase activity; Category No. 15610—transmembrane receptor protein serine threonine kinase signaling pathway; Category No. 15611—transmembrane receptor protein tyrosine kinase activator activity; Category No. 15612—transmembrane receptor protein tyrosine kinase activity; Category No. 15613—transmembrane receptor protein tyrosine kinase adaptor activity; Category No. 15614—transmembrane receptor protein tyrosine kinase signaling pathway; Category No. 15615—transmembrane receptor protein tyrosine phosphatase activity; Category No. 15616—transmembrane receptor protein tyrosine phosphatase signaling pathway; Category No. 15617—transmembrane signaling receptor activity; Category No. 15618—transmembrane transport; Category No. 15619—transmembrane transporter activity; Category No. 15620—transmembrane transporter complex; Category No. 15621—transmembrane-ephrin receptor activity; Category No. 15622—transmission of nerve impulse; Category No. 15623—transmission of virus; Category No. 15624—transmitter-gated ion channel activity; Category No. 15625—trans-octaprenyltranstransferase activity; Category No. 15626—transport; Category No. 15627—transport vesicle; Category No. 15628—transport vesicle membrane; Category No. 15629—transporter activity; Category No. 15630—transposase activity; Category No. 15631—transposing C=C bonds; Category No. 15632—transposition; Category No. 15633—transsulfuration; Category No. 15634—transverse filament; Category No. 15635—TRAPP complex; Category No. 15636—TRAPPII protein complex; Category No. 15637—TRAPPIII protein complex; Category No. 15638—traversing start control point of mitotic cell cycle; Category No. 15639—trehalose catabolic process; Category No. 15640—trehalose metabolic process; Category No. 15641—triacyl lipopeptide binding; Category No. 15642—tricarboxylic acid cycle; Category No. 15643—tricarboxylic acid cycle enzyme complex; Category No. 15644—tricarboxylic acid metabolic process; Category No. 15645—tricarboxylic acid transmembrane transport; Category No. 15646—tricarboxylic acid transmembrane transporter activity; Category No. 15647—tricarboxylic acid transport; Category No. 15648—tricellular tight junction; Category No. 15649—trichloroethylene metabolic process; Category No. 15650—tricuspid valve development; Category No. 15651—tricuspid valve formation; Category No. 15652—tricuspid valve morphogenesis; Category No. 15653—TRIF-dependent toll-like receptor signaling pathway; Category No. 15654—trigeminal ganglion development; Category No. 15655—trigeminal nerve development; Category No. 15656—trigeminal nerve morphogenesis; Category No. 15657—trigeminal nerve structural organization; Category No. 15658—triglyceride acyl-chain remodeling; Category No. 15659—triglyceride binding; Category No. 15660—triglyceride biosynthetic process; Category No. 15661—triglyceride catabolic process; Category No. 15662—triglyceride homeostasis; Category No. 15663—triglyceride lipase activity; Category No. 15664—triglyceride metabolic process; Category No. 15665—triglyceride mobilization; Category No. 15666—triglyceride transport; Category No. 15667—triglyceride-rich lipoprotein particle remodeling; Category No. 15668—trimethylamine monooxygenase activity; Category No. 15669—trimethylamine receptor activity; Category No. 15670—trimethyl-H3-K4-specific; Category No. 15671—trimethyllysine dioxygenase activity; Category No. 15672—trimming of terminal mannose on B branch; Category No. 15673—trimming of terminal mannose on C branch; Category No. 15674—triokinase activity; Category No. 15675—triose-phosphate isomerase activity; Category No. 15676—tripeptidase activity; Category No. 15677—tripeptidyl-peptidase activity; Category No. 15678—triphosphatase activity; Category No. 15679—tRNA (5-methylaminomethyl-2-thiouridylate)-methyltransferase activity; Category No. 15680—tRNA (adenine-N1-)-methyltransferase activity; Category No. 15681—tRNA (cytosine) methyltransferase activity; Category No. 15682—tRNA (cytosine-5-)-methyltransferase activity; Category No. 15683—tRNA (guanine(37)-N(1))-methyltransferase activity; Category No. 15684—tRNA (guanine) methyltransferase activity; Category No. 15685—tRNA (guanine-N2-)-methyltransferase activity; Category No. 15686—tRNA (guanine-N7-)-methyltransferase activity; Category No. 15687—tRNA (m1A) methyltransferase complex; Category No. 15688—tRNA (N(6)-L-threonylcarbamoyladenosine(37)-C(2))-methylthiotransferase; Category No. 15689—tRNA (uracil) methyltransferase activity; Category No. 15690—tRNA 2'-phosphotransferase activity; Category No. 15691—tRNA 3-end processing; Category No. 15692—tRNA 3'-terminal CCA addition; Category No. 15693—tRNA 3'-trailer cleavage; Category No. 15694—tRNA 5'-leader removal; Category No. 15695—tRNA adenylyltransferase activity; Category No. 15696—tRNA aminoacylation; Category No. 15697—tRNA aminoacylation for mitochondrial protein translation; Category No. 15698—tRNA aminoacylation for protein translation; Category No. 15699—tRNA binding; Category No. 15700—tRNA catabolic process; Category No. 15701—tRNA dihydrouridine synthase activity; Category No. 15702—tRNA dihydrouridine synthesis; Category No. 15703—tRNA dimethylallyltransferase activity; Category No. 15704—tRNA export from nucleus; Category No. 15705—tRNA guanylyltransferase activity; Category No. 15706—tRNA import into mitochondrion; Category No. 15707—tRNA metabolic process; Category No. 15708—tRNA methylation; Category No. 15709—tRNA methylthiolation; Category No. 15710—tRNA methyltransferase activity; Category No. 15711—tRNA methyltransferase complex; Category No. 15712—tRNA modification; Category No. 15713—tRNA N2-guanine methylation; Category No. 15714—tRNA nucleoside ribose methylation;

Category No. 15715—tRNA processing; Category No. 15716—tRNA pseudouridine synthesis; Category No. 15717—tRNA re-export from nucleus; Category No. 15718—tRNA splicing; Category No. 15719—tRNA thio-modification; Category No. 15720—tRNA threonylcarbamoyladenosine metabolic process; Category No. 15721—tRNA threonylcarbamoyladenosine modification; Category No. 15722—tRNA transcription; Category No. 15723—tRNA transcription from RNA polymerase III promoter; Category No. 15724—tRNA wobble adenosine to inosine editing; Category No. 15725—tRNA wobble position uridine thiolation; Category No. 15726—tRNA wobble uridine modification; Category No. 15727—tRNA-intron endonuclease activity; Category No. 15728—tRNA-intron endonuclease complex; Category No. 15729—tRNA-specific adenosine deaminase activity; Category No. 15730—tRNA-specific adenosine-34 deaminase activity; Category No. 15731—tRNA-specific adenosine-34 deaminase complex; Category No. 15732—tRNA-splicing ligase complex; Category No. 15733—tRNA-type intron splice site recognition and cleavage; Category No. 15734—trochlear nerve development; Category No. 15735—trochlear nerve formation; Category No. 15736—trophectodermal cell differentiation; Category No. 15737—trophectodermal cell proliferation; Category No. 15738—trophectodermal cellular morphogenesis; Category No. 15739—trophoblast cell migration; Category No. 15740—trophoblast giant cell differentiation; Category No. 15741—tropomyosin binding; Category No. 15742—troponin C binding; Category No. 15743—troponin complex; Category No. 15744—troponin I binding; Category No. 15745—troponin T binding; Category No. 15746—trypsinogen activation; Category No. 15747—tryptamine:oxygen oxidoreductase (deaminating) activity; Category No. 15748—tryptophan 2,3-dioxygenase activity; Category No. 15749—tryptophan 5-monooxygenase activity; Category No. 15750—tryptophan catabolic process; Category No. 15751—tryptophan catabolic process to acetyl-CoA; Category No. 15752—tryptophan catabolic process to kynurenine; Category No. 15753—tryptophan metabolic process; Category No. 15754—tryptophan transport; Category No. 15755—tryptophan-tRNA ligase activity; Category No. 15756—tryptophanyl-tRNA aminoacylation; Category No. 15757—TSC1-TSC2 complex; Category No. 15758—T-tubule; Category No. 15759—T-tubule organization; Category No. 15760—tube closure; Category No. 15761—tube development; Category No. 15762—tube formation; Category No. 15763—tube morphogenesis; Category No. 15764—tubular endosome; Category No. 15765—tubulation complex; Category No. 15766—tubulin binding; Category No. 15767—tubulin complex; Category No. 15768—tubulin complex assembly; Category No. 15769—tubulin deacetylase activity; Category No. 15770—tubulin deacetylation; Category No. 15771—tubulin N-acetyltransferase activity; Category No. 15772—tubulin-dependent ATPase activity; Category No. 15773—tubulin-glutamic acid ligase activity; Category No. 15774—tubulin-tyrosine ligase activity; Category No. 15775—tumor necrosis factor binding; Category No. 15776—tumor necrosis factor production; Category No. 15777—tumor necrosis factor receptor binding; Category No. 15778—tumor necrosis factor receptor superfamily binding; Category No. 15779—tumor necrosis factor receptor superfamily complex; Category No. 15780—tumor necrosis factor secretion; Category No. 15781—tumor necrosis factor-activated receptor activity; Category No. 15782—tumor necrosis factor-mediated signaling pathway; Category No. 15783—t-UTP complex; Category No. 15784—type 1 angiotensin receptor binding; Category No. 15785—type 1 fibroblast growth factor receptor binding; Category No. 15786—type 1 galanin receptor binding; Category No. 15787—type 1 hypocretin receptor binding; Category No. 15788—type 1 melanocortin receptor binding; Category No. 15789—type 1 metabotropic glutamate receptor binding; Category No. 15790—type 1 parathyroid hormone receptor binding; Category No. 15791—type 2 angiotensin receptor binding; Category No. 15792—type 2 fibroblast growth factor receptor binding; Category No. 15793—type 2 galanin receptor binding; Category No. 15794—type 2 hypocretin receptor binding; Category No. 15795—type 2 immune response; Category No. 15796—type 2A serotonin receptor binding; Category No. 15797—type 3 galanin receptor binding; Category No. 15798—type 3 melanocortin receptor binding; Category No. 15799—type 3 metabotropic glutamate receptor binding; Category No. 15800—type 4 melanocortin receptor binding; Category No. 15801—type 5 melanocortin receptor binding; Category No. 15802—type 5 metabotropic glutamate receptor binding; Category No. 15803—type B gastrin cholecystokinin receptor binding; Category No. 15804—type B pancreatic cell apoptotic process; Category No. 15805—type B pancreatic cell development; Category No. 15806—type B pancreatic cell differentiation; Category No. 15807—type B pancreatic cell fate commitment; Category No. 15808—type B pancreatic cell maturation; Category No. 15809—type B pancreatic cell proliferation; Category No. 15810—Type I activating receptor activity; Category No. 15811—type I activin receptor binding; Category No. 15812—type I interferon binding; Category No. 15813—type I interferon biosynthetic process; Category No. 15814—type I interferon production; Category No. 15815—type I interferon receptor activity; Category No. 15816—type I interferon receptor binding; Category No. 15817—type I interferon signaling pathway; Category No. 15818—Type I pneumocyte differentiation; Category No. 15819—Type I receptor binding; Category No. 15820—type I transforming growth factor beta receptor binding; Category No. 15821—type II; Category No. 15822—type II activin receptor binding; Category No. 15823—Type II blocking receptor activity; Category No. 15824—Type II pneumocyte differentiation; Category No. 15825—Type II receptor binding; Category No. 15826—type II transforming growth factor beta receptor binding; Category No. 15827—type III intermediate filament; Category No. 15828—type III transforming growth factor beta receptor binding; Category No. 15829—type IV hypersensitivity; Category No. 15830—tyrosine 3-monooxygenase activator activity; Category No. 15831—tyrosine 3-monooxygenase activity; Category No. 15832—tyrosine binding; Category No. 15833—tyrosine biosynthetic process; Category No. 15834—tyrosine catabolic process; Category No. 15835—tyrosine metabolic process; Category No. 15836—tyrosine phosphorylation of STAT protein; Category No. 15837—tyrosine phosphorylation of Stat1 protein; Category No. 15838—tyrosine phosphorylation of Stat3 protein; Category No. 15839—tyrosine phosphorylation of Stat5 protein; Category No. 15840—tyrosine-tRNA ligase activity; Category No. 15841—tyrosyl-RNA phosphodiesterase activity; Category No. 15842—tyrosyl-tRNA aminoacylation; Category No. 15843—U1 snRNA 3'-end processing; Category No. 15844—U1 snRNA binding; Category No. 15845—U1 snRNP; Category No. 15846—U11 U12 snRNP; Category No. 15847—U12 snRNA binding; Category No. 15848—U12-type spliceosomal complex; Category No. 15849—U2 snRNA 3'-end processing; Category No. 15850—U2 snRNA binding; Category No. 15851—U2 snRNP; Category No. 15852—U2AF; Category No. 15853—U2-type catalytic step 1 spliceosome; Category No. 15854—U2-type catalytic step 2 spliceosome; Category No. 15855—U2-type post-mRNA release spliceosomal complex; Category No. 15856—U2-type post-spliceosomal complex; Category No. 15857—U2-type prespliceosome; Category No. 15858—U2-type spliceosomal complex; Category No. 15859—U3 snoRNA binding; Category No. 15860—U4 snRNA 3-end processing; Category No. 15861—U4 snRNA binding; Category No. 15862—U4 snRNP; Category No. 15863—U4 U6 snRNP; Category No. 15864—U4 U6×U5 tri-snRNP complex; Category No. 15865—U4atac snRNA binding; Category No. 15866—U4atac snRNP; Category No. 15867—U4atac U6atac snRNP; Category No. 15868—U5 snRNA 3'-end processing; Category No. 15869—U5 snRNA binding; Category No. 15870—U5 snRNP; Category No. 15871—U6 snRNA 3'-end processing; Category No. 15872—U6 snRNA binding; Category No. 15873—U6 snRNP; Category No. 15874—U6atac snRNA binding; Category No. 15875—U6atac snRNP; Category No. 15876—U7 snRNA binding; Category No. 15877—U7 snRNP; Category No. 15878—UBC13-MMS2 complex; Category No. 15879—UBC13-UEV1A complex; Category No. 15880—ubiquinol to cytochrome c; Category No. 15881—ubiquinol-cytochrome-c reductase activity; Category No. 15882—ubiquinone binding; Category No. 15883—ubiquinone biosynthetic process; Category No. 15884—ubiquinone metabolic process; Category No. 15885—ubiquinone-6 biosynthetic process; Category No. 15886—ubiquitin activating enzyme activity; Category No. 15887—ubiquitin binding; Category No. 15888—ubiquitin conjugating enzyme activity; Category No. 15889—ubiquitin conjugating enzyme binding; Category No. 15890—ubiquitin conjugating enzyme complex; Category No. 15891—ubiquitin homeostasis; Category No. 15892—ubiquitin ligase complex; Category No. 15893—ubiquitin protein ligase activity; Category No. 15894—ubiquitin protein ligase activity involved in ERAD pathway; Category No. 15895—ubiquitin protein ligase binding; Category No. 15896—ubiquitinated histone binding; Category No. 15897—ubiquitin-dependent endocytosis; Category No. 15898—ubiquitin-dependent protein catabolic process; Category No. 15899—ubiquitin-dependent protein catabolic process via the multivesicular body sorting pathway; Category No. 15900—ubiquitin-dependent protein catabolic process via the N-end rule pathway; Category No. 15901—ubiquitin-dependent SMAD protein catabolic process; Category No. 15902—ubiquitin-independent protein catabolic process via the multivesicular body sorting pathway; Category No. 15903—ubiquitin-like protein binding; Category No. 15904—ubiquitin-like protein conjugating enzyme binding; Category No. 15905—ubiquitin-like protein ligase binding; Category No. 15906—ubiquitin-like protein transferase activity; Category No. 15907—ubiquitin-protein transferase activator activity; Category No. 15908—ubiquitin-protein transferase activity; Category No. 15909—ubiquitin-protein transferase inhibitor activity; Category No. 15910—ubiquitin-protein transferase regulator activity; Category No. 15911—ubiquitin-specific protease activity; Category No. 15912—ubiquitin-specific protease activity involved in negative regulation of ERAD pathway; Category No. 15913—ubiquitin-specific protease activity involved in negative regulation of retrograde protein transport; Category No. 15914—ubiquitin-specific protease activity involved in positive regulation of ERAD pathway; Category No. 15915—ubiquitin-specific protease binding; Category No. 15916—ubiquitin-ubiquitin ligase activity; Category No. 15917—ubiquitinyl hydrolase activity; Category No. 15918—UDP catabolic process; Category No. 15919—UDP phosphorylation; Category No. 15920—UDP-activated nucleotide receptor activity; Category No. 15921—UDP-D-xylose biosynthetic process; Category No. 15922—UDP-galactose transmembrane transport; Category No. 15923—UDP-galactose transmembrane transporter activity; Category No. 15924—UDP-galactose transport; Category No. 15925—UDP-galactose:beta-N-acetylglucosamine beta-1,3-galactosyltransferase activity; Category No. 15926—UDP-galactose:glucosylceramide beta-1,4-galactosyltransferase activity; Category No. 15927—UDP-galactosyltransferase activity; Category No. 15928—UDP-glucose 4-epimerase activity; Category No. 15929—UDP-glucose 6-dehydrogenase activity; Category No. 15930—UDP-glucose catabolic process; Category No. 15931—UDP-glucose metabolic process; Category No. 15932—UDP-glucose transport; Category No. 15933—UDP-glucose:glycoprotein glucosyltransferase activity; Category No. 15934—UDP-glucose:hexose-1-phosphate uridylyltransferase activity; Category No. 15935—UDP-glucosylation; Category No. 15936—UDP-glucosyltransferase activity; Category No. 15937—UDP-glucuronate 5'-epimerase activity; Category No. 15938—UDP-glucuronate biosynthetic process; Category No. 15939—UDP-glucuronate decarboxylase activity; Category No. 15940—UDP-glucuronate metabolic process; Category No. 15941—UDP-glucuronic acid transmembrane transporter activity; Category No. 15942—UDP-glucuronic acid transport; Category No. 15943—UDP-glycosyltransferase activity; Category No. 15944—UDP-N-acetylgalactosamine metabolic process; Category No. 15945—UDP-N-acetylglucosamine 2-epimerase activity; Category No. 15946—UDP-N-acetylglucosamine 4-epimerase activity; Category No. 15947—UDP-N-acetylglucosamine biosynthetic process; Category No. 15948—UDP-N-acetylglucosamine catabolic process; Category No. 15949—UDP-N-acetylglucosamine diphosphorylase activity; Category No. 15950—UDP-N-acetylglucosamine metabolic process; Category No. 15951—UDP-N-acetylglucosamine transferase complex; Category No. 15952—UDP-N-acetylglucosamine transmembrane transport; Category No. 15953—UDP-N-acetylglucosamine transmembrane transporter activity; Category No. 15954—UDP-N-acetylglucosamine transport; Category No. 15955—UDP-N-acetylglucosamine-dolichyl-phosphate N-acetylglucosaminephosphotransferase activity; Category No. 15956—UDP-N-acetylglucosamine-lysosomal-enzyme N-acetylglucosaminephosphotransferase activity; Category No. 15957—UDP-sugar diphosphatase activity; Category No. 15958—UDP-xylose transmembrane transporter activity; Category No. 15959—UDP-xylose transport; Category No. 15960—UDP-xylosyltransferase activity; Category No. 15961—UFD1-NPL4 complex; Category No. 15962—UFM1 activating enzyme activity; Category No. 15963—UFM1 hydrolase activity; Category No. 15964—UFM1 transferase activity; Category No. 15965—ultradian rhythm; Category No. 15966—umbilical cord morphogenesis; Category No. 15967—UMP biosynthetic process; Category No. 15968—UMP kinase activity; Category No. 15969—UMP salvage; Category No. 15970—uncoating of virus; Category No. 15971—unconventional myosin complex; Category No. 15972—uncoupled; Category No. 15973—unfolded protein binding; Category No. 15974—unidimensional cell growth; Category No. 15975—uniplex complex; Category No. 15976—uniporter activity; Category No. 15977—unmethylated CpG binding; Category No. 15978—unsaturated fatty acid biosynthetic process; Category No. 15979—unsaturated fatty acid metabolic process; Category No. 15980—unsaturated monocarboxylic acid metabolic process; Category No. 15981—upper tip-link density; Category No. 15982—uracil binding; Category No. 15983—uracil catabolic process; Category No. 15984—uracil DNA N-glycosylase activity; Category No. 15985—uracil metabolic process; Category No. 15986—urate biosynthetic process; Category No. 15987—urate catabolic process; Category No. 15988—urate homeostasis; Category No. 15989—urate metabolic process; Category No. 15990—urate transmembrane transporter activity; Category No. 15991—urate transport; Category No. 15992—urea channel activity; Category No. 15993—urea cycle; Category No. 15994—urea homeostasis; Category No. 15995—urea metabolic process; Category No. 15996—urea transmembrane transport; Category No. 15997—urea transmembrane transporter activity; Category No. 15998—urea transport; Category No. 15999—ureter development; Category No. 16000—ureter epithelial cell differentiation; Category No. 16001—ureter maturation; Category No. 16002—ureter morphogenesis; Category No. 16003—ureter smooth muscle cell differentiation; Category No. 16004—ureter urothelium development; Category No. 16005—ureteric bud development; Category No. 16006—ureteric bud elongation; Category No. 16007—ureteric bud formation; Category No. 16008—ureteric bud invasion; Category No. 16009—ureteric bud morphogenesis; Category No. 16010—uridine catabolic process; Category No. 16011—uridine kinase activity; Category No. 16012—uridine metabolic process; Category No. 16013—uridine nucleotide receptor activity; Category No. 16014—uridine phosphorylase activity; Category No. 16015—uridine transport; Category No. 16016—uridine-diphosphatase activity; Category No. 16017—uridylate kinase activity; Category No. 16018—uridylyltransferase activity; Category No. 16019—urinary bladder development; Category No. 16020—urinary bladder smooth muscle contraction; Category No. 16021—URM1 activating enzyme activity; Category No. 16022—urocanate hydratase activity; Category No. 16023—urogenital system development; Category No. 16024—urokinase plasminogen activator receptor activity; Category No. 16025—urokinase plasminogen activator signaling pathway; Category No. 16026—uropod; Category No. 16027—uropod membrane; Category No. 16028—uropod organization; Category No. 16029—uroporphyrinogen decarboxylase activity; Category No. 16030—uroporphyrinogen Ill biosynthetic process; Category No. 16031—uroporphyrinogen Ill metabolic process; Category No. 16032—uroporphyrinogen-III synthase activity; Category No. 16033—urotensin II receptor activity; Category No. 16034—urothelial cell proliferation; Category No. 16035—USH2 complex; Category No. 16036—using glutaminyl-peptide cyclotransferase; Category No. 16037—using sulfide:quinone oxidoreductase; Category No. 16038—uterine epithelium development; Category No. 16039—uterine smooth muscle contraction; Category No. 16040—uterine wall breakdown; Category No. 16041—uterus development; Category No. 16042—uterus morphogenesis; Category No. 16043—UTP binding; Category No. 16044—UTP biosynthetic process; Category No. 16045—UTP metabolic process; Category No. 16046—UTP:glucose-1-phosphate uridylyltransferase activity; Category No. 16047—UTP-activated nucleotide receptor activity; Category No. 16048—UTP-C complex; Category No. 16049—UV protection; Category No. 16050—UV-damage excision repair; Category No. 16051—V(D)J recombination; Category No. 16052—V1A vasopressin receptor binding; Category No. 16053—V1B vasopressin receptor binding; Category No. 16054—V2 vasopressin receptor binding; Category No. 16055—vacuolar acidification; Category No. 16056—vacuolar lumen; Category No. 16057—vacuolar membrane; Category No. 16058—vacuolar protein processing; Category No. 16059—vacuolar proton-transporting V-type ATPase complex; Category No. 16060—vacuolar proton-transporting V-type ATPase complex assembly; Category No. 16061—vacuolar proton-transporting V-type ATPase V0 domain; Category No. 16062—vacuolar proton-transporting V-type ATPase V1 domain; Category No. 16063—vacuolar sequestering; Category No. 16064—vacuolar transport; Category No. 16065—vacuole; Category No. 16066—vacuole fusion; Category No. 16067—vacuole inheritance; Category No. 16068—vacuole organization; Category No. 16069—vagina development; Category No. 16070—vagus nerve development; Category No. 16071—vagus nerve morphogenesis; Category No. 16072—valine catabolic process; Category No. 16073—valine metabolic process; Category No. 16074—valine-tRNA ligase activity; Category No. 16075—valyl-tRNA aminoacylation; Category No. 16076—vanadium ion transmembrane transporter activity; Category No. 16077—vanadium ion transport; Category No. 16078—varicosity; Category No. 16079—vascular endothelial growth factor binding; Category No. 16080—vascular endothelial growth factor production; Category No. 16081—vascular endothelial growth factor receptor 1 binding; Category No. 16082—vascular endothelial growth factor receptor 2 binding; Category No. 16083—vascular endothelial growth factor receptor 3 binding; Category No. 16084—vascular endothelial growth factor receptor binding; Category No. 16085—vascular endothelial growth factor receptor signaling pathway; Category No. 16086—vascular endothelial growth factor receptor-1 signaling pathway; Category No. 16087—vascular endothelial growth factor receptor-2 signaling pathway; Category No. 16088—vascular endothelial growth factor signaling pathway; Category No. 16089—vascular endothelial growth factor-activated receptor activity; Category No. 16090—vascular smooth muscle cell development; Category No. 16091—vascular smooth muscle cell differentiation; Category No. 16092—vascular smooth muscle contraction; Category No. 16093—vascular transport; Category No. 16094—vascular wound healing; Category No. 16095—vasculature development; Category No. 16096—vasculogenesis; Category No. 16097—vasculogenesis involved in coronary vascular morphogenesis; Category No. 16098—vasoactive intestinal polypeptide receptor activity; Category No. 16099—vasoconstriction; Category No. 16100—vasoconstriction of artery involved in baroreceptor response to lowering of systemic arterial blood pressure; Category No. 16101—vasoconstriction of artery involved in ischemic response to lowering of systemic arterial blood pressure; Category No. 16102—vasodilation; Category No. 16103—vasodilation by acetylcholine involved in regulation of systemic arterial blood pressure; Category No. 16104—vasodilation by angiotensin involved in regulation of systemic arterial blood pressure; Category No. 16105—vasodilation by norepinephrine-epinephrine involved in regulation of systemic arterial blood pressure; Category No. 16106—vasodilation of artery involved in baroreceptor response to increased systemic arterial blood pressure; Category No. 16107—vasomotion; Category No. 16108—vasopressin receptor activity; Category No. 16109—vasopressin secretion; Category No. 16110—VCB complex; Category No. 16111—VCP-NPL4-UFD1 AAA ATPase complex; Category No. 16112—VCP-NSFL1C complex; Category No. 16113—VEGF-A-activated receptor activity; Category No. 16114—VEGF-activated neuropilin signaling pathway; Category No. 16115—VEGF-activated neuropilin signaling pathway involved in axon guidance; Category No. 16116—VEGF-B-activated receptor activity; Category No. 16117—vein smooth muscle contraction; Category No. 16118—venous blood vessel development; Category No. 16119—venous blood vessel morphogenesis; Category No. 16120—venous endothelial cell differentiation; Category No. 16121—ventral midline determination; Category No. 16122—ventral midline development; Category No. 16123—ventral spinal cord development; Category No. 16124—ventral spinal cord interneuron differentiation; Category No. 16125—ventral spinal cord interneuron fate commitment; Category No. 16126—ventral spinal cord interneuron fate determination; Category No. 16127—ventral spinal cord interneuron specification; Category No. 16128—ventral trunk neural crest cell migration; Category No. 16129—ventricular cardiac muscle cell action potential; Category No. 16130—ventricular cardiac muscle cell development; Category No. 16131—ventricular cardiac muscle cell differentiation; Category No. 16132—ventricular cardiac muscle tissue development; Category No. 16133—ventricular cardiac muscle tissue morphogenesis; Category No. 16134—ventricular cardiac myofibril assembly; Category No. 16135—ventricular compact myocardium morphogenesis; Category No. 16136—ventricular septum development; Category No. 16137—ventricular septum morphogenesis; Category No. 16138—ventricular system development; Category No. 16139—ventricular trabecula myocardium morphogenesis; Category No. 16140—ventricular zone neuroblast division; Category No. 16141—very long chain acyl-CoA hydrolase activity; Category No. 16142—very long-chain fatty acid biosynthetic process; Category No. 16143—very long-chain fatty acid catabolic process; Category No. 16144—very long-chain fatty acid metabolic process; Category No. 16145—very long-chain fatty acid-CoA ligase activity; Category No. 16146—very long-chain fatty-acyl-CoA metabolic process; Category No. 16147—very-long-chain-(S)-2-hydroxy-acid oxidase activity; Category No. 16148—very-long-chain-acyl-CoA dehydrogenase activity; Category No. 16149—very-low-density lipoprotein particle; Category No. 16150—very-low-density lipoprotein particle assembly; Category No. 16151—very-low-density lipoprotein particle binding; Category No. 16152—very-low-density lipoprotein particle clearance; Category No. 16153—very-low-density lipoprotein particle receptor activity; Category No. 16154—very-low-density lipoprotein particle receptor binding; Category No. 16155—very-low-density lipoprotein particle remodeling; Category No. 16156—vesicle; Category No. 16157—vesicle coat; Category No. 16158—vesicle docking; Category No. 16159—vesicle docking involved in exocytosis; Category No. 16160—vesicle fusion; Category No. 16161—vesicle fusion with Golgi apparatus; Category No. 16162—vesicle localization; Category No. 16163—vesicle lumen; Category No. 16164—vesicle membrane; Category No. 16165—vesicle organization; Category No. 16166—vesicle recycling within Golgi; Category No. 16167—vesicle targeting; Category No. 16168—vesicle targeting to from or within Golgi; Category No. 16169—vesicle transport along actin filament; Category No. 16170—vesicle transport along microtubule; Category No. 16171—vesicle uncoating; Category No. 16172—vesicle-mediated transport; Category No. 16173—vestibular nucleus development; Category No. 16174—vestibular receptor cell development; Category No. 16175—vestibular receptor cell morphogenesis; Category No. 16176—vestibular reflex; Category No. 16177—vestibulocochlear nerve development; Category No. 16178—vestibulocochlear nerve formation; Category No. 16179—vestibulocochlear nerve structural organization; Category No. 16180—via antigen binding groove; Category No. 16181—via endonucleolytic cleavage and ligation; Category No. 16182—via spliceosome; Category No. 16183—via transesterification reactions; Category No. 16184—vinculin binding; Category No. 16185—viral budding; Category No. 16186—viral budding via host ESCRT complex; Category No. 16187—viral capsid; Category No. 16188—viral capsid secondary envelopment; Category No. 16189—viral entry into host cell; Category No. 16190—viral envelope; Category No. 16191—viral genome replication; Category No. 16192—viral integration complex; Category No. 16193—viral life cycle; Category No. 16194—viral mRNA export from host cell nucleus; Category No. 16195—viral nucleocapsid; Category No. 16196—viral penetration into host nucleus; Category No. 16197—viral process; Category No. 16198—viral protein processing; Category No. 16199—viral release from host cell; Category No. 16200—viral RNA genome packaging; Category No. 16201—viral transcription; Category No. 16202—virion assembly; Category No. 16203—virion attachment to host cell; Category No. 16204—virion binding; Category No. 16205—virus maturation; Category No. 16206—virus receptor activity; Category No. 16207—visceral mesoderm-endoderm interaction involved in midgut development; Category No. 16208—visceral motor neuron differentiation; Category No. 16209—visceral muscle development; Category No. 16210—visceral serous pericardium development; Category No. 16211—visible light; Category No. 16212—visual behavior; Category No. 16213—visual learning; Category No. 16214—visual perception; Category No. 16215—vitamin A biosynthetic process; Category No. 16216—vitamin A metabolic process; Category No. 16217—vitamin B6 metabolic process; Category No. 16218—vitamin binding; Category No. 16219—vitamin D 24-hydroxylase activity; Category No. 16220—vitamin D binding; Category No. 16221—vitamin D catabolic process; Category No. 16222—vitamin D metabolic process; Category No. 16223—vitamin D receptor activator activity; Category No. 16224—vitamin D receptor binding; Category No. 16225—vitamin D receptor signaling pathway; Category No. 16226—vitamin D response element binding; Category No. 16227—vitamin D3 25-hydroxylase activity; Category No. 16228—vitamin E binding; Category No. 16229—vitamin E biosynthetic process; Category No. 16230—vitamin E metabolic process; Category No. 16231—vitamin K biosynthetic process; Category No. 16232—vitamin K catabolic process; Category No. 16233—vitamin K metabolic process; Category No. 16234—vitamin metabolic process; Category No. 16235—vitamin transmembrane transport; Category No. 16236—vitamin transport; Category No. 16237—vitamin transporter activity; Category No. 16238—vitamin-K-epoxide reductase (warfarin-sensitive) activity; Category No. 16239—vitelline membrane formation; Category No. 16240—vitellogenesis; Category No. 16241—vocal learning; Category No. 16242—vocalization behavior; Category No. 16243—voltage-gated anion channel activity; Category No. 16244—voltage-gated calcium channel activity; Category No. 16245—voltage-gated calcium channel activity involved in cardiac muscle cell action potential; Category No. 16246—voltage-gated calcium channel activity involved SA node cell action potential; Category No. 16247—voltage-gated calcium channel complex; Category No. 16248—voltage-gated cation channel activity; Category No. 16249—voltage-gated chloride channel activity; Category No. 16250—voltage-gated ion channel activity; Category No. 16251—voltage-gated potassium channel activity; Category No. 16252—voltage-gated potassium channel activity involved in atrial cardiac muscle cell action potential repolarization; Category No. 16253—voltage-gated potassium channel activity involved in bundle of His cell action potential repolarization; Category No. 16254—voltage-gated potassium channel activity involved in cardiac muscle cell action potential repolarization; Category No. 16255—voltage-gated potassium channel activity involved in SA node cell action potential repolarization; Category No. 16256—voltage-gated potassium channel activity involved in ventricular cardiac muscle cell action potential repolarization; Category No. 16257—voltage-gated potassium channel complex; Category No. 16258—voltage-gated proton channel activity; Category No. 16259—voltage-gated sodium channel activity; Category No. 16260—voltage-gated sodium channel activity involved in AV node cell action potential; Category No. 16261—voltage-gated sodium channel activity involved in bundle of His cell action potential; Category No. 16262—voltage-gated sodium channel activity involved in cardiac muscle cell action potential; Category No. 16263—voltage-gated sodium channel activity involved in Purkinje myocyte action potential; Category No. 16264—voltage-gated sodium channel activity involved in SA node cell action potential; Category No. 16265—voltage-gated sodium channel complex; Category No. 16266—volume-sensitive chloride channel activity; Category No. 16267—voluntary musculoskeletal movement; Category No. 16268—wakefulness; Category No. 16269—WASH complex; Category No. 16270—water channel activity; Category No. 16271—water dikinase activity; Category No. 16272—water homeostasis; Category No. 16273—water transmembrane transporter activity; Category No. 16274—water transport; Category No. 16275—water-soluble vitamin metabolic process; Category No. 16276—wax biosynthetic process; Category No. 16277—WD40-repeat domain binding; Category No. 16278—Weibel-Palade body; Category No. 16279—white fat cell differentiation; Category No. 16280—wide pore channel activity; Category No. 16281—with a flavin as acceptor; Category No. 16282—with glutamine as amido-N-donor; Category No. 16283—with incorporation or reduction of molecular oxygen; Category No. 16284—with oxidation of a pair of donors resulting in the reduction of molecular oxygen to two molecules of water; Category No. 16285—Wnt receptor catabolic process; Category No. 16286—Wnt signaling pathway; Category No. 16287—Wnt signaling pathway involved in dorsal ventral axis specification; Category No. 16288—Wnt signaling pathway involved in forebrain neuroblast division; Category No. 16289—Wnt signaling pathway involved in somitogenesis; Category No. 16290—Wnt signaling pathway involved in wound healing; Category No. 16291—Wnt-activated receptor activity; Category No. 16292—Wnt-activated signaling pathway involved in forebrain neuron fate commitment; Category No. 16293—Wnt-protein binding; Category No. 16294—wound healing; Category No. 16295—wound healing involved in inflammatory response; Category No. 16296—WW domain binding; Category No. 16297—wybutosine biosynthetic process; Category No. 16298—X chromosome; Category No. 16299—X11-like protein binding; Category No. 16300—xanthine biosynthetic process; Category No. 16301—xanthine catabolic process; Category No. 16302—xanthine dehydrogenase activity; Category No. 16303—xanthine oxidase activity; Category No. 16304—xanthophyll metabolic process; Category No. 16305—XDP catabolic process; Category No. 16306—xenobiotic catabolic process; Category No. 16307—xenobiotic glucuronidation; Category No. 16308—xenobiotic metabolic process; Category No. 16309—xenobiotic transport; Category No. 16310—xenobiotic transporter activity; Category No. 16311—xenobiotic-transporting ATPase activity; Category No. 16312—xenon atom binding; Category No. 16313—xenophagy; Category No. 16314—XPC complex; Category No. 16315—XTP binding; Category No. 16316—XTP diphosphatase activity; Category No. 16317—XY body; Category No. 16318—xylosylprotein 4-beta-galactosyltransferase activity; Category No. 16319—xylosyltransferase activity; Category No. 16320—xylulokinase activity; Category No. 16321—xylulose biosynthetic process; Category No. 16322—xylulose catabolic process; Category No. 16323—xylulose metabolic process; Category No. 16324—Y chromosome; Category No. 16325—Y-form DNA binding; Category No. 16326—Z disc; Category No. 16327—zeta DNA polymerase complex; Category No. 16328—zinc II ion transmembrane import; Category No. 16329—zinc II ion transmembrane transport; Category No. 16330—zinc II ion transport; Category No. 16331—zinc ion binding; Category No. 16332—zinc ion homeostasis; Category No. 16333—zinc ion transmembrane transporter activity; Category No. 16334—zinc transporting ATPase activity; Category No. 16335—zinc-dependent; Category No. 16336—zona pellucida receptor complex; Category No. 16337—zonula adherens; Category No. 16338—zonula adherens maintenance; Category No. 16339—zygote asymmetric cell division; Category No. 16340—zygotic determination of anterior posterior axis; Category No. 16341—zygotic specification of dorsal ventral axis; Category No. 16342—zymogen activation; Category No. 16343—zymogen binding; Category No. 16344—zymogen granule; Category No. 16345—zymogen granule exocytosis; Category No. 16346—zymogen granule membrane.

According to the present invention, biocircuits may be combined which exploit or utilize payloads which share one or more biological processes, cellular locations or molecular functions.

Such shared special technical features allow the regulation of pathways of targets, targets in a particular location or cellular environment or those having a similar molecular function.

Biological Process

In one embodiment, the biocircuit may be classified by the biological process nature of the payload. Shown in the following paragraph are the payloads and classification (category number) for the payloads for the biocircuit systems described herein. Separated by a semi-colon, each payload-classification information describes the payload identifier (Payload ID) and the classifications (category number). For example, for the gene symbol ACCS the payload-classification information is shown as "Payload ID: 7 relates to Category No.: 1207."

In one embodiment, the biocircuit of the invention may be classified by one of the following biological process categories for the payloads described herein such as, but not limited to, Payload ID: 2 relates to Category No.: 6814, 9940, 15660, 9945, 1867, 14663, 3728, 10390, 4653, 9819, 10475, 10480, 1694; Payload ID: 3 relates to Category No.: 6814, 15660, 9945, 1867, 14663, 4653, 9819, 10475, 10480, 1694, 9940, 3781, 13780; Payload ID: 4 relates to Category No.: 6814, 9940, 15660, 9945, 1867, 14663, 4653, 9819, 1694; Payload ID: 5 relates to Category No.: 6814, 9940, 15660, 9945, 1867, 14663, 4653, 9819, 1694; Payload ID: 6 relates to Category No.: 6814, 9940, 15660, 9945, 1867, 14663, 4653, 9819, 1694, 4969, 397; Payload ID: 7 relates to Category No.: 1207; Payload ID: 8 relates to Category No.: 1207; Payload ID: 9 relates to Category No.: 6814, 1512, 3100, 4706, 4521, 13756, 13289; Payload ID: 10 relates to Category No.: 15149, 2813, 15042, 14025, 483, 1048, 9350, 13925, 496, 6969, 4251, 13158; Payload ID: 11 relates to Category No.: 4100, 1867, 14663, 11941, 6814, 9500; Payload ID: 12 relates to Category No.: 9500, 15978, 6814; Payload ID: 13 relates to Category No.: 9500, 1722, 13975, 795, 7613, 7840, 14663, 2347, 15424, 13228, 14643, 2355, 6523, 11997, 6738, 664, 10069, 14982, 13874, 7743, 14972, 12391; Payload ID: 14 relates to Category No.: 5367, 14038, 2885, 3021, 2011, 8818, 4538, 12251, 12066, 5610, 15817, 4535, 13438, 6814; Payload ID: 15 relates to Category No.: 5367, 14038, 9232, 2885, 11930, 3021, 12251, 5610, 15817, 12059, 14199, 6814; Payload ID: 16 relates to Category No.: 5367, 14038, 9232, 2885, 3021, 8818, 5610, 15817, 13438, 6814; Payload ID: 17 relates to Category No.: 6814, 5367, 14038, 2885, 3021, 8818, 5610, 15817; Payload ID: 18 relates to Category No.: 9500; Payload ID: 19 relates to Category No.: 9287, 1780, 9256, 10362, 3091, 3791; Payload ID: 20 relates to Category No.: 1867, 14663, 12066, 4098, 6219, 6814; Payload ID: 21 relates to Category No.: 9500, 1780, 9702, 15001, 13626, 11943; Payload ID: 22 relates to Category No.: 9500; Payload ID: 23 relates to Category No.: 9500; Payload ID: 24 relates to Category No.: 3100, 4721, 2387, 10720; Payload ID: 25 relates to Category No.: 8862, 16308, 9232, 9869, 3100, 14663, 128; Payload ID: 26 relates to Category No.: 9500, 5898, 12133, 1867, 14663, 2347, 2554, 16213, 8255, 7613, 10372, 496, 13966, 13837, 11391, 10583, 7381, 8119, 11419, 8835, 8812, 10319, 15884, 8663, 11382; Payload ID: 27 relates to Category No.: 6219, 6814, 5898, 1867, 14663, 2347, 6530, 14046, 2079, 1295, 13969, 13874, 13827, 6269, 13971, 13970, 13863, 13805, 13994, 1933, 1974, 13928, 14020, 13926; Payload ID: 28 relates to Category No.: 6814, 5898, 1867, 14663, 5944, 2347, 1863, 2079, 1295, 13969, 13859, 2041, 13888, 13827, 6269, 13966, 14009, 13837, 13866, 455, 5949, 13939, 13981, 13797, 2000, 7002, 13858, 1982, 2009, 14027, 6375, 1969, 14022, 13843, 7315, 1906, 13788, 13950, 13992, 14021, 13922; Payload ID: 29 relates to Category No.: 7306, 4104, 15660, 6310, 16142, 1867, 14663, 10383, 14862, 4107, 1869, 2166, 7417, 12887, 12886; Payload ID: 30 relates to Category No.: 15660, 6310, 16142, 1867, 14663, 14862, 4107; Payload ID: 31 relates to Category No.: 14661, 10702, 344, 16142, 4107, 11607, 12365, 10181, 14108, 5359, 5912; Payload ID: 32 relates to Category No.: 16142, 4107; Payload ID: 33 relates to Category No.: 9500, 15750, 14663, 1878, 14054, 12349, 2993, 728, 8925, 13794, 12351; Payload ID: 34 relates to Category No.: 6814, 9500, 1867, 14663, 5944, 1863, 5945, 13835, 1295, 14025, 13874, 13888, 13827, 6269, 13966, 14009, 13837, 13794, 13815, 13866, 455; Payload ID: 35 relates to Category No.: 4100, 1867, 14663, 5944, 14553, 3791, 5866, 1863, 4980, 9500, 6814; Payload ID: 36 relates to Category No.: 9500, 14663, 1878, 1308, 16072; Payload ID: 37 relates to Category No.: 6814, 14663, 1878, 1308, 16072; Payload ID: 38 relates to Category No.: 12133, 1867, 14663, 5944, 1863, 6122, 7122, 6269, 13966, 14009, 390, 13843; Payload ID: 39 relates to Category No.: 5944; Payload ID: 40 relates to Category No.: 6814, 9500, 14865, 14663, 14862, 116; Payload ID: 41 relates to Category No.: 6814, 1867, 14663, 1863, 5945, 5946, 1295, 13874, 13827, 13966, 14009, 13837, 455, 13767, 4949, 10802; Payload ID: 42 relates to Category No.: 6814, 5945; Payload ID: 43 relates to Category No.: 6814, 390, 4104, 6656, 14540; Payload ID: 44 relates to Category No.: 16308, 9982, 1512, 14640, 14663, 15073, 4723, 128, 127; Payload ID: 45 relates to Category No.: 16308, 9982, 1512, 14640, 14663, 15073, 4723, 128, 127, 1238, 1269; Payload ID: 46 relates to Category No.: 12091, 13589, 3398, 15490, 3398, 14661, 5785, 15207, 10074, 15149, 1752, 5446, 274, 4186, 12993, 8756, 1451, 9891, 4127, 3775, 14992, 5541, 16085, 8988, 1238, 2009, 11858, 8522, 4039, 15192, 11323, 361, 9716, 11190, 1960, 10588, 15805, 13110, 8726, 5327, 7698, 12810, 4229; Payload ID: 47 relates to Category No.: 8977, 15149, 4370, 8971, 1114, 4372, 1207, 13882, 496, 13827, 13837, 13811, 8477, 7658, 13961, 13905, 6296, 2235, 4004, 10801, 4369, 10793, 7894, 11593, 2685, 10529, 8000, 10713, 11228, 10245; Payload ID: 48 relates to Category No.: 6814, 147, 4743, 12330, 4741, 9493; Payload ID: 49 relates to Category No.: 9500, 843, 14663, 1878, 6343, 15834; Payload ID: 50 relates to Category No.: 9500, 843; Payload ID: 51 relates to Category No.: 3100, 3095, 14663, 12242, 12303, 9236, 12307, 12252, 12299; Payload ID: 52 relates to Category No.: 4237, 15310, 15311, 4576, 4270, 4231; Payload ID: 53 relates to Category No.: 3356, 3100, 14663, 12303, 3095, 9236, 12307, 12299, 3496; Payload ID: 54 relates to Category No.: 13186, 9228, 9223, 4439, 3996, 9223, 3001, 14310, 9189, 5219; Payload ID: 55 relates to Category No.: 7288, 13589, 3398, 9232, 1746, 14267, 14838, 14216, 3994, 3305, 3994, 14211, 14199, 3399, 15287; Payload ID: 56 relates to Category No.: 9232, 2991, 14663, 12242, 12251, 12259, 9236, 13886, 9411, 2235, 2243, 9256, 3251, 15309, 1302, 14156; Payload ID: 57 relates to Category No.: 6814, 1207, 15317, 9420, 1867, 14663, 7122, 4977, 10174, 12209; Payload ID: 58 relates to Category No.: 6814, 1207, 15317, 1862, 3854, 14663, 13882, 4977, 10174, 9525, 4994, 12209; Payload ID: 59 relates to Category No.: 7132, 15185, 2878, 5606, 5359, 3049, 5602, 5706, 15776, 3051; Payload ID: 60 relates to Category No.: 12194; Payload ID: 61 relates to Category No.: 4828, 10372, 14511, 12988, 12534, 1780, 16099, 12779, 1112, 441, 13463, 4004, 14509; Payload ID: 62 relates to Category No.: 4828, 8615, 12534, 16099, 4828, 2745, 7688, 1957, 441, 1901, 13827, 11987, 4826, 1276, 2124, 15149, 3469, 13837, 13811, 4132, 13945, 12781, 8672, 4588, 8672, 4342; Payload ID: 63 relates to Category No.: 4828, 15149, 14511, 12534, 16099, 439, 4828, 2745, 13080, 5761, 14025; Payload ID: 64 relates to Category No.: 4828, 15149, 14511, 439, 4828, 2745, 7690; Payload ID: 65 relates to Category No.: 4828, 15149, 14511, 439, 4828, 2745; Payload ID: 66 relates to Category No.: 4828, 15149, 9854, 14511, 12988, 12534, 1836, 13827, 10583, 16189, 13695, 355, 11188, 14693, 11178, 10887, 10606, 10682, 12014, 10372, 496, 10486, 16020, 11601, 14454, 6758, 1727, 3146, 8489, 10954, 1114, 15273, 3161, 861, 14646, 9933, 12781, 8672, 4588; Payload ID: 67 relates to Category No.: 4828, 9982, 7613, 10372, 11987, 9854, 7728, 14511, 12534, 1836, 10775, 1451, 10359, 16099, 7635, 10558, 2259, 3598, 10954, 8869, 13827, 10583, 3846, 13695, 11113, 10475, 4953, 1564, 355, 8866, 11986, 10478, 1111, 11188, 5761, 2124, 10702, 4949, 4826, 5846, 5014, 5501, 1904, 2113; Payload ID: 68 relates to Category No.: 4828, 15149, 6296, 14511, 1836, 4132, 2259, 12500, 9932, 13827, 10583, 13695, 10487, 1112, 11188, 9933, 13226, 12728, 10606; Payload ID: 69 relates to Category No.: 15618, 15626, 1649, 5846, 15149, 3244, 14511, 13126, 5848, 8911, 11674, 13837, 13811, 1993; Payload ID: 70 relates to Category No.: 15618, 15626, 1649, 5846, 15149, 14511, 13126, 5848, 8911; Payload ID: 71 relates to Category No.: 15618, 15626, 1649, 5846, 14511, 13126, 5848, 8911; Payload ID: 72 relates to Category No.: 5848, 15618, 1649, 5846, 14511, 13126, 8911, 15626; Payload ID: 73 relates to Category No.: 15618, 15626, 1649, 5846, 14511, 13126, 5848, 8911; Payload ID: 74 relates to Category No.: 4828, 15149, 14451, 14511, 10209, 4375, 4828, 2745, 12500; Payload ID: 75 relates to Category No.: 4828, 14511, 1477, 13835, 1295, 5073, 4828, 2745; Payload ID: 76 relates to Category No.: 4828, 15149, 14511, 4828, 2745, 11502, 2242; Payload ID: 77 relates to Category No.: 4828, 15149, 14693, 14511, 16099, 4828, 2745, 2469, 1237; Payload ID: 78 relates to Category No.: 8862, 16308, 6902, 1874, 14663, 1878, 6887, 12230, 13787, 2540, 16234, 16275, 15089, 1031, 2070; Payload ID: 79 relates to Category No.: 9500, 16308, 6902, 3337, 14663, 1878, 6887, 14349, 2540, 16234, 16275, 15089, 4233, 6888, 5246, 7838; Payload ID: 80 relates to Category No.: 3100; Payload ID: 81 relates to Category No.: 3100; Payload ID: 82 relates to Category No.: 3100; Payload ID: 83 relates to Category No.: 3100; Payload ID: 84 relates to Category No.: 3100, 9287, 14663, 12242, 9256, 12303, 9236, 12307, 12252, 12247, 420; Payload ID: 85 relates to Category No.: 3100, 9287, 14663, 12242, 9236, 12252; Payload ID: 86 relates to Category No.: 9982, 14663, 12242, 3474, 5397, 420, 9236, 12252, 3100; Payload ID: 87 relates to Category No.: 3100, 9287, 14663, 12303, 12308, 9236, 12307, 420; Payload ID: 88 relates to Category No.: 3100, 9287, 4439, 3996, 9223, 3001; Payload ID: 89 relates to Category No.: 9284, 3336, 14663, 12242, 12303, 9236, 12307, 12252, 6137, 8112, 648, 416, 1295, 3100, 420, 12251, 10910, 13771; Payload ID: 90 relates to Category No.: 16308, 4609, 14663, 4612; Payload ID: 91 relates to Category No.: 14663, 4020, 1878, 4021, 2569, 6424, 6814; Payload ID: 92 relates to Category No.: 15588, 15601, 15603, 14934, 15604, 14177, 1893, 4439, 16197, 16193, 9223, 9103, 16201; Payload ID: 93 relates to Category No.: 6814, 5785, 1512, 3100, 4706, 4300, 4521, 14663, 4538, 4305, 3728, 1482, 13859, 13888, 14009, 13797, 1514, 9411, 13858, 10662; Payload ID: 94 relates to Category No.: 4300, 1514, 4305, 6814, 1512, 3100, 4706, 14663, 4538, 1482, 13860, 12338, 10662, 10801, 5993, 4533; Payload ID: 95 relates to Category No.: 6814, 1512, 3100, 14663, 4538, 1514, 4305, 1482, 4300, 1295; Payload ID: 96 relates to Category No.: 6814, 1512, 3100, 4300, 14663, 4538, 1514, 4305, 1482; Payload ID: 97 relates to Category No.: 1512, 14663, 9616, 9616, 9501; Payload ID: 98 relates to Category No.: 13248, 1830, 2169, 14663, 15307, 9053; Payload ID: 99 relates to Category No.: 9500, 14663, 2347, 1730, 12646, 7303, 11634, 1240, 6375, 14979, 12694; Payload ID: 100 relates to Category No.: 13589, 3398, 13975, 9296, 1955, 13996, 3354, 1089, 1089, 762, 13357, 15606, 9296, 3327, 3102, 3103, 7900, 13835, 7613, 496, 13827, 13837, 13921, 13849, 379, 1920; Payload ID: 101 relates to Category No.: 1238, 2088, 1925, 7703, 8511, 8388; Payload ID: 102 relates to Category No.: 14565, 1238; Payload ID: 103 relates to Category No.: 13359, 5785; Payload ID: 104 relates to Category No.: 4828, 14565, 12122, 10309, 11264, 13362; Payload ID: 105 relates to Category No.: 12091, 14661, 10702, 13435, 10238, 803, 13485, 8988, 5785, 12906, 13360, 12597, 9169; Payload ID: 106 relates to Category No.: 14838; Payload ID: 107 relates to Category No.: 7288, 13589, 3398, 14565, 14271, 13445, 1053; Payload ID: 109 relates to Category No.: 13359, 14586, 266, 7252, 11997, 15610; Payload ID: 110 relates to Category No.: 13359, 14565, 14831, 14586, 7252, 3900, 11997, 7245, 15610; Payload ID: 111 relates to Category No.: 14565, 15149, 14663, 13004, 12122, 3728, 10309, 11264, 661, 13953, 14883, 11285, 6626, 5073, 10495, 13829, 8489, 7581, 10302, 8185, 1890, 10208, 11107, 2081; Payload ID: 112 relates to Category No.: 13359, 325, 1948, 1925, 1477, 13127, 10362, 12122, 7688, 11323, 13409, 11220, 10492, 10296, 11107, 11349, 11284, 10363; Payload ID: 113 relates to Category No.: 1204, 5785, 325, 5848, 1925, 11997, 13127, 11220, 10492; Payload ID: 114 relates to Category No.: 14565, 7154; Payload ID: 115 relates to Category No.: 1204, 9982; Payload ID: 116 relates to Category No.: 1026, 14661, 15626, 14565, 6975, 15149, 5446, 6606, 348, 4186, 12391, 1925, 4127, 9420, 3775, 7132, 5541, 16085, 8988, 4336, 13127, 12954, 11174, 13664, 11221, 14838, 14520, 9982; Payload ID: 117 relates to Category No.: 15043; Payload ID: 118 relates to Category No.: 14918; Payload ID: 119 relates to Category No.: 12091; Payload ID: 120 relates to Category No.: 12091; Payload ID: 121 relates to Category No.: 9982, 15883; Payload ID: 122 relates to Category No.: 12091; Payload ID: 123 relates to Category No.: 12091; Payload ID: 124 relates to Category No.: 11512, 7613, 16172, 15614, 12534, 2460, 2169, 2459, 14058, 1892, 11313, 4952, 5066, 9996, 9465, 14805, 7239, 11214, 2522, 11790, 11787, 5977, 6107, 14056, 10648, 16167, 12037; Payload ID: 125 relates to Category No.: 12194, 6814, 1830; Payload ID: 126 relates to Category No.: 6814, 1204; Payload ID: 127 relates to Category No.: 16308, 14663, 1854, 4559; Payload ID: 128 relates to Category No.: 6814, 1204; Payload ID: 129 relates to Category No.: 10074, 1238, 393, 484, 9898, 13786; Payload ID: 130 relates to Category No.: 6814; Payload ID: 131 relates to Category No.: 6814; Payload ID: 132 relates to Category No.: 6814; Payload ID: 133 relates to Category No.: 11512, 16308, 14663, 128, 6814; Payload ID: 134 relates to Category No.: 6814; Payload ID: 135 relates to Category No.: 6814; Payload ID: 136 relates to Category No.: 6814; Payload ID: 137 relates to Category No.: 6814, 1204; Payload ID: 138 relates to Category No.: 6814; Payload ID: 139 relates to Category No.: 6814; Payload ID: 141 relates to Category No.: 6814, 1204, 7737, 14050; Payload ID: 142 relates to Category No.: 9945, 14663, 9827, 4653, 9825; Payload ID: 143 relates to Category No.: 6219, 6212, 6226, 9945, 14663, 4653, 6215; Payload ID: 144 relates to Category No.: 12194, 1730, 4110, 14663, 15661, 11559, 9819, 6215, 8612, 10918, 10911, 6219; Payload ID: 145 relates to Category No.: 10074, 1238, 393, 7737, 9941, 10910, 6299, 12796; Payload ID: 146 relates to Category No.: 6814; Payload ID: 147 relates to Category No.: 12638, 7252; Payload ID: 148 relates to Category No.: 4021, 10383; Payload ID: 149 relates to Category No.: 12091, 1026, 13589, 3398, 7018, 14661, 1002, 1722, 9720, 13975, 5808, 1703, 1730, 1894, 3452, 1752, 9717, 5446, 1955, 10238, 3354, 274, 12614, 12459, 12798, 7154, 3448, 12646, 8541, 4130, 3775, 11285, 12519, 1238, 2083, 12461, 12522, 10095, 10486, 11178, 10093, 7334, 11053, 3310, 8798, 12642, 3900, 1956, 13146, 14571, 11161, 7035, 8463, 11004, 10189, 13420, 1070, 15043, 9777, 12619, 11323, 10583, 7750, 14910, 15400, 1066, 8920, 2238, 10775, 575, 1128, 10841, 10815, 12855, 11620, 10038, 7919, 8103, 2041, 1072, 1067, 15585, 6959, 7662, 11148, 8318, 11027, 2593, 326, 7946, 278, 11090, 12676, 7773; Payload ID: 150 relates to Category No.: 12091, 1026, 14565, 9720, 1730, 1894, 1752, 9717, 5446, 12498, 12614, 12798, 12646, 3775, 12519, 12461, 10486, 10093, 2110, 12642, 11094, 11161, 11191, 1892, 6102, 16213, 9777, 10583, 7750, 11242, 286, 8584, 8920, 15045, 1740, 8944, 2238, 4004, 10775, 575, 3041, 280, 1128, 3058, 10841, 10815, 12855, 11620, 10038, 7919; Payload ID: 151 relates to Category No.: 14661, 9720, 15614, 5446, 7743, 297, 4130, 16197, 16085, 7252, 14793, 6666, 1886, 6020, 11296; Payload ID: 152 relates to Category No.: 297, 6103, 3038, 1752, 1463, 9720, 2940, 16197, 7252, 12365, 10244; Payload ID: 153 relates to Category No.: 14905, 7154, 14900, 2243, 8934, 8375, 6530, 14838, 9379, 1295, 10314, 3194, 11085, 4255, 7626, 6488, 14898, 8954, 13114; Payload ID: 154 relates to Category No.: 1512; Payload ID: 156 relates to Category No.: 1204; Payload ID: 158 relates to Category No.: 5367, 5428, 795, 5446, 11109, 15782, 8390, 339, 10822, 1957, 10491, 11282, 10821, 9292, 6125, 5617, 12328, 10469, 2012; Payload ID: 159 relates to Category No.: 13589, 3398; Payload ID: 160 relates to Category No.: 13589, 3398; Payload ID: 162 relates to Category No.: 4814, 13514; Payload ID: 163 relates to Category No.: 13589, 3398; Payload ID: 164 relates to Category No.: 13589, 3398; Payload ID: 165 relates to Category No.: 13589, 3398; Payload ID: 166 relates to Category No.: 13589, 3398; Payload ID: 168 relates to Category No.: 13589, 3398; Payload ID: 171 relates to Category No.: 15588; Payload ID: 176 relates to Category No.: 4828; Payload ID: 180 relates to Category No.: 15588; Payload ID: 185 relates to Category No.: 15588; Payload ID: 189 relates to Category No.: 12091; Payload ID: 190 relates to Category No.: 15618, 6819, 16329; Payload ID: 213 relates to Category No.: 7474; Payload ID: 214 relates to Category No.: 13790; Payload ID: 216 relates to Category No.: 13589, 3398; Payload ID: 225 relates to Category No.: 13589, 3398; Payload ID: 234 relates to Category No.: 12091, 5785, 9713, 13171, 8533, 13116; Payload ID: 236 relates to Category No.: 15588; Payload ID: 238 relates to Category No.: 15588, 11549; Payload ID: 239 relates to Category No.: 15588, 11549; Payload ID: 240 relates to Category No.: 15588, 11549; Payload ID: 241 relates to Category No.: 15588, 11549; Payload ID: 242 relates to Category No.: 15588, 11549; Payload ID: 243 relates to Category No.: 15588, 11549; Payload ID: 245 relates to Category No.: 12194; Payload ID: 268 relates to Category No.: 13755; Payload ID: 281 relates to Category No.: 15490, 3398, 12133, 1874, 15993, 823, 11634, 1830, 6296, 640; Payload ID: 294 relates to Category No.: 13589, 3398; Payload ID: 301 relates to Category No.: 15588; Payload ID: 304 relates to Category No.: 15588; Payload ID: 308 relates to Category No.: 13589, 3398; Payload ID: 316 relates to Category No.: 6814; Payload ID: 344 relates to Category No.: 8979; Payload ID: 353 relates to Category No.: 4828; Payload ID: 355 relates to Category No.: 9500; Payload ID: 362 relates to Category No.: 9500; Payload ID: 367 relates to Category No.: 14565; Payload ID: 368 relates to Category No.: 12075, 11926; Payload ID: 374 relates to Category No.: 9500; Payload ID: 375 relates to Category No.: 9500; Payload ID: 376 relates to Category No.: 9500; Payload ID: 377 relates to Category No.: 14565; Payload ID: 378 relates to Category No.: 9500; Payload ID: 379 relates to Category No.: 6219, 6814, 4110, 1867, 14663, 5944, 1863, 2125, 1984, 13969, 13827, 6269, 13971, 13966, 14009, 13837, 455, 10801, 13994, 1933, 13968, 16279; Payload ID: 380 relates to Category No.: 8862, 1703, 15149, 3356, 7345, 15140, 9945, 1780, 14663, 9454, 14050, 11290, 4653, 8970, 9825, 213, 214, 8672, 2370, 665, 6814, 14056, 12409, 13402, 8975, 12133; Payload ID: 381 relates to Category No.: 6814, 1867, 14663, 1878, 5944, 1308, 1863, 5945, 1295, 13969, 11940, 13874, 6269, 14009, 455, 6868; Payload ID: 382 relates to Category No.: 6219, 6814; Payload ID: 383 relates to Category No.: 6814, 4100, 1867, 14663, 1189, 4102, 15979, 587, 16144; Payload ID: 384 relates to Category No.: 6814, 4110, 2347, 2006, 8313, 8311; Payload ID: 385 relates to Category No.: 4104, 15660, 6310, 1867, 14663, 11941, 3728, 235, 16234, 16275, 1210, 1609, 10390, 6545, 6215, 6219, 15425, 2100, 7313, 6814; Payload ID: 386 relates to Category No.: 4104, 1867, 14663, 11941, 3728, 235, 16234, 16275, 1210, 1609, 10390, 6545, 7710, 8004, 12913, 3727, 8216, 7973, 10913, 13967, 7976, 10708, 6814; Payload ID: 387 relates to Category No.: 15588, 6902, 14663, 1878, 5416, 6715; Payload ID: 388 relates to Category No.: 6902, 1204; Payload ID: 389 relates to Category No.: 8906, 15490, 3398, 11091, 11512, 7613, 8739, 8731, 3398, 12891, 9125, 8375, 15134, 14000, 15135, 9106, 9108, 2245, 6376, 16125, 13594, 2243, 1730, 12646, 9599, 8934, 13225, 8930, 11125, 8932, 8929, 8928, 1751, 13166, 4475, 11084, 11089, 2176, 9350, 14882, 10349, 9349, 11087, 4446, 2602, 12821, 13257, 8898, 15036, 16173, 7354, 14892, 9341, 14888, 14889, 8896, 9347, 13584, 6385, 14994, 1620, 470, 8862, 13927, 13833, 13849, 4257, 2049; Payload ID: 390 relates to Category No.: 13589, 3398, 15490, 3398, 8739, 10036, 13882, 14921, 13594, 1730, 14782, 5406, 14920, 8604; Payload ID: 391 relates to Category No.: 13594, 15490, 3398, 8739; Payload ID: 392 relates to Category No.: 13594, 15490, 3398, 14643; Payload ID: 393 relates to Category No.: 13589, 3398, 15490, 3398, 1204; Payload ID: 394 relates to Category No.: 15618, 12137, 1512, 2885, 15715, 9238, 1893, 14663, 4439, 16197, 16193, 7132, 7295, 12120, 7187, 7188, 11660, 1995, 4442, 7155, 5048, 12914, 4541, 16201, 12671, 13260, 6102, 4167; Payload ID: 395 relates to Category No.: 9718; Payload ID: 396 relates to Category No.: 3100, 14640, 6445, 13970, 11910, 996; Payload ID: 397 relates to Category No.: 14663, 16234, 16275, 14128, 13925, 13818, 3100, 8112, 3016, 1274, 8782, 8392, 8141, 1277, 8133, 8668, 10366, 13969, 9451, 14054, 7719, 13915, 9459, 7315, 13805, 6814; Payload ID: 398 relates to Category No.: 3100, 4969, 9945, 6429; Payload ID: 399 relates to Category No.: 3100, 15344, 420, 13459, 10207, 12242, 9287; Payload ID: 400 relates to Category No.: 3100; Payload ID: 401 relates to Category No.: 15618, 15626, 14565, 5846, 14740, 14742, 11942, 13983, 14457, 2090, 13126, 1415, 1651, 6758, 901, 13765, 8379; Payload ID: 402 relates to Category No.: 15618, 5846, 14740, 15149, 12891, 2169, 14742, 7234, 9738, 12543, 14457, 7613, 13126, 1649, 13659, 13041, 11431, 14456, 3145, 12045, 1651, 10005, 13936, 13765, 13542; Payload ID: 403 relates to Category No.: 15618, 15626, 14565, 1649, 5846, 14740, 14449, 14742, 14457, 3124, 3145, 1651, 3146, 13867, 13936, 3739, 3160, 3161, 3126, 13765; Payload ID: 404 relates to Category No.: 15626, 5846, 14740, 14742; Payload ID: 405 relates to Category No.: 15618, 5846, 14742, 14740, 12197; Payload ID: 406 relates to Category No.: 14740, 14742; Payload ID: 407 relates to Category No.: 13589, 3398, 15490, 3398, 5785, 13186, 9238, 4439; Payload ID: 408 relates to Category No.: 334, 7730, 9274, 11251, 9540, 16138, 5458, 16095; Payload ID: 410 relates to Category No.: 5129, 7710; Payload ID: 412 relates to Category No.: 6902, 1955, 12053, 13420; Payload ID: 413 relates to Category No.: 9500, 10129, 6285, 14663, 1878, 15089; Payload ID: 414 relates to Category No.: 6814, 15642, 2481, 13907, 11634, 12891, 1862, 13618, 5751; Payload ID: 415 relates to Category No.: 6814, 15642, 1874, 14663, 4448, 2481, 5887; Payload ID: 416 relates to Category No.: 12194, 328, 14586, 7304, 266, 265, 1202, 9610, 14011; Payload ID: 417 relates to Category No.: 1204; Payload ID: 418 relates to Category No.: 7306; Payload ID: 419 relates to Category No.: 1026, 2940, 16214, 2459, 6018, 9410, 11512; Payload ID: 420 relates to Category No.: 1026, 15490, 3398, 2940, 274, 11512; Payload ID: 421 relates to Category No.: 1026, 15490, 3398, 2940, 274, 2459, 6018, 11294, 11512; Payload ID: 422 relates to Category No.: 15490, 3398, 11363, 11339, 11512, 11506, 3398, 11949, 15606; Payload ID: 423 relates to Category No.: 13465, 12746; Payload ID: 425 relates to Category No.: 5428, 13166, 11506, 3398, 11296, 10855, 10567, 13024, 11371; Payload ID: 426 relates to Category No.: 1026, 14661, 3766, 5446, 1814, 4130, 14057, 6738, 16085, 10075, 450, 7252, 1749, 14365; Payload ID: 427 relates to Category No.: 849, 1026, 14661, 3766, 5446, 274, 4130, 12465; Payload ID: 428 relates to Category No.: 849, 1026, 14661, 3766, 5446, 4130, 12465, 7252; Payload ID: 429 relates to Category No.: 1026, 14661, 3766, 5446, 849, 4130, 12465, 7252, 10889, 10192, 11425; Payload ID: 430 relates to Category No.: 1026, 14661, 3766, 5446, 849, 4130, 12465, 7252; Payload ID: 431 relates to Category No.: 1026, 14661, 3766, 5446, 849, 296, 287, 4130; Payload ID: 432 relates to Category No.: 1026, 14661, 3766, 1752, 5446, 274, 849, 4130, 12465, 7252; Payload ID: 433 relates to Category No.: 849, 1204, 12465; Payload ID: 434 relates to Category No.: 10648, 7340, 7342, 14635, 14624, 6792, 13936, 13927, 14011, 1746, 13842, 14623; Payload ID: 435 relates to Category No.: 14038, 10648, 7340, 4495, 6792, 12544, 16092; Payload ID: 436 relates to Category No.: 795, 4948, 378, 10648, 292, 7342, 14635, 1572, 1570, 6792, 324, 7613, 323, 1562, 13827, 13837; Payload ID: 437 relates to Category No.: 1026, 14661, 11926, 952, 3766, 5446, 2410, 1814, 4130, 1893, 14057, 6738, 16085, 1238, 15042, 10075, 450, 7252, 2994, 1749; Payload ID: 438 relates to Category No.: 1204; Payload ID: 439 relates to Category No.: 10648, 7340, 6792; Payload ID: 440 relates to Category No.: 10074, 12498, 13259, 286, 4021, 1238, 272, 10080, 4229, 1749, 285, 7756, 10086, 10087, 280; Payload ID: 441 relates to Category No.: 1026, 14661, 1703, 10074, 15149, 5446, 6606, 348, 12498, 4186, 13126, 12391, 4127, 3775, 5541, 16085, 8988, 1238, 10080, 11941, 4229, 3910, 8526, 8489, 8488, 7342, 14365, 6959, 11221, 11222, 10334, 9928, 291, 10542, 7340, 1556, 13259, 11308; Payload ID: 442 relates to Category No.: 7340, 1274, 11380, 7673, 8035, 13574, 15581, 12481, 10288, 8428, 10604, 14619, 13822, 11383, 13197, 8566, 10665, 12498, 4229, 7342; Payload ID: 443 relates to Category No.: 12137, 10074, 12498, 13259, 10366, 1238, 14083, 10080, 16169, 8667, 11401, 9764, 10386, 11110, 280, 7756, 11206, 13882, 1183, 12002; Payload ID: 445 relates to Category No.: 13594, 15490, 3398, 14565, 952, 2411, 3354, 3353, 2410, 12936, 13165, 5182, 11294, 5131, 8886, 8862, 14883; Payload ID: 446 relates to Category No.: 13594, 15490, 3398, 2411, 2410, 8862, 14883; Payload ID: 449 relates to Category No.: 3791; Payload ID: 451 relates to Category No.: 6984; Payload ID: 452 relates to Category No.: 7737, 7569, 8201, 3286; Payload ID: 453 relates to Category No.: 7131, 10491; Payload ID: 456 relates to Category No.: 1026, 14565, 1703, 7251; Payload ID: 457 relates to Category No.: 13589, 3398, 15490, 3398, 3354, 3314; Payload ID: 458 relates to Category No.: 13589, 3398, 15490, 3398, 3354, 3314; Payload ID: 459 relates to Category No.: 13589, 3398, 15490, 3398, 3354, 3320, 1780, 11661, 15606, 3314; Payload ID: 460 relates to Category No.: 13589, 3398, 11512, 5446, 7362, 8988, 15003, 15456, 15450, 7363, 15448, 15443, 15454, 15446, 15653, 15457, 15458, 15451, 13969, 11094, 10522, 13810, 1889; Payload ID: 461 relates to Category No.: 13594, 5095, 13589, 3398, 11512, 5446, 1955, 5805, 7362, 2410, 15003, 15456, 15450, 7363, 15448, 15443, 11363, 15454, 13460, 15446, 15653, 15457, 15458, 13973, 15451, 11020, 15517, 9480, 4094, 455, 11544, 8739, 11089, 14048, 7939, 609; Payload ID: 462 relates to Category No.: 13594, 13589, 3398, 11512, 8739, 3684, 15517, 1893, 11520, 9746, 13596, 11505, 8731, 3398, 10648, 14620, 1905, 7946, 4521, 10372; Payload ID: 463 relates to Category No.: 13589, 3398, 11512, 11089, 1830, 3684, 2467, 10238, 15517, 11506, 3398, 1983, 4521, 10648, 1893, 13831, 11511, 5810, 11520, 11595, 9746, 11522, 11518, 8432, 13594, 2469, 1905, 4375, 8489, 13935; Payload ID: 464 relates to Category No.: 13594, 13589, 3398, 11512, 7613, 8731, 3398, 15517, 7743, 11506, 3398, 4094, 12681, 7727, 2223, 7303, 11634, 12891, 2469, 9335, 9338, 9334, 7625, 8370; Payload ID: 465 relates to Category No.: 13594, 13589, 3398, 15490, 3398, 11926, 14565, 3684, 1893, 14015, 919, 11520, 11529, 11512; Payload ID: 466 relates to Category No.: 13589, 3398, 15490, 3398, 14565, 919, 11520; Payload ID: 467 relates to Category No.: 13589, 3398, 15490, 3398, 8739, 16197; Payload ID: 468 relates to Category No.: 15490, 3398, 8731, 3398, 11506, 3398, 3337, 2410, 16197, 13444, 8739; Payload ID: 469 relates to Category No.: 13589, 3398, 15490, 3398; Payload ID: 470 relates to Category No.: 7288, 14776, 1060, 3316, 8297, 14775, 2041, 5901, 2866, 6814; Payload ID: 471 relates to Category No.: 3658, 151, 6360, 3661, 151, 6360, 3657, 151, 6360, 14672, 13594, 15517, 14886; Payload ID: 472 relates to Category No.: 5785, 14565, 10702, 13435, 14661, 10238, 803, 13485, 8988; Payload ID: 473 relates to Category No.: 14569, 15610, 12091, 690, 13589, 3398, 11512, 14565, 11167, 7743, 11506, 3398, 7737, 12544, 1257, 12775, 7735, 1248, 15570, 372, 1250, 1918, 2131, 7923, 7719, 10286, 1246, 7992, 7659, 1237, 16294, 14927, 14060, 12545, 10429, 3719, 6406, 6407, 12811, 859, 16118, 7880, 5406, 1249, 10226, 7924, 10558, 10556, 7922, 11934; Payload ID: 474 relates to Category No.: 12091, 11512, 14569, 11167, 11506, 3398, 7965, 1257, 15570, 372, 4332, 8617, 10287, 11147, 1918, 9716, 9595, 7575, 1558, 7178, 969, 3591, 13276, 3619, 10508, 5406, 4419, 3176, 379, 9786, 6795, 4949, 6796, 4458, 8869, 4418, 14688, 9600, 1982, 15610; Payload ID: 475 relates to Category No.: 12091, 13589, 3398, 14565, 14569, 7735, 372, 15610, 4332, 11858, 4039, 9716, 10586, 9085, 10202, 11562, 4937, 5406, 10648, 8004, 13465, 11512, 11167, 2169, 3187; Payload ID: 476 relates to Category No.: 12091, 1730, 14569, 10470, 8778, 9085, 794, 7801, 13888, 13824, 8118, 13860, 6226; Payload ID: 477 relates to Category No.: 12091, 11512, 14569, 11167, 1257, 11285, 372, 15610, 10287, 11147, 1918, 10586, 10202, 4419, 724, 3176, 6530, 14838, 6795, 13465, 14523, 3612, 12551, 14822, 9611, 13248; Payload ID: 478 relates to Category No.: 12091, 13589, 3398, 14565, 8739, 14569, 1257, 372, 15610, 1250, 10287, 11147, 724, 14060, 10202, 6406, 6407, 859, 16118, 4419, 360, 5949, 9599, 11634, 3176, 9408, 6795, 3583, 4949, 14640, 13465, 5544, 6375, 9540, 14641, 13860, 9554, 9321; Payload ID: 479 relates to Category No.: 13589, 3398, 15490, 3398, 8373, 13886, 11094, 11178, 360, 13799, 8004, 3940, 10257, 11431, 10406, 14545, 1968, 8507, 8672, 13339, 9051; Payload ID: 480 relates to Category No.: 3639, 1752, 2940, 12640, 724, 3641, 13236, 6102, 10217; Payload ID: 481 relates to Category No.: 12194, 15588, 15604, 1893, 4439, 1149; Payload ID: 482 relates to Category No.: 15626, 14962; Payload ID: 484 relates to Category No.: 15626, 9768; Payload ID: 487 relates to Category No.: 6814, 9500, 4100, 1867, 14663, 4101, 6215; Payload ID: 488 relates to Category No.: 6814, 9500, 4100, 1867, 14663, 4101, 6215; Payload ID: 489 relates to Category No.: 6219, 6814, 13589, 3398, 15490, 3398, 9500, 14663, 1878, 1308, 4101, 6215, 16072; Payload ID: 490 relates to Category No.: 6814, 9500, 7088, 4101, 6215; Payload ID: 491 relates to Category No.: 6814, 9500, 4100, 1867, 14663, 4101, 6215, 1347, 13859, 14009, 11941; Payload ID: 492 relates to Category No.: 6814, 9500, 4100, 1867, 14663, 4101, 6215, 1603, 1605, 2533, 6658, 6657, 11634, 4949, 6269, 13812, 1557, 14009, 9423, 4685, 1605, 12908, 13859, 13874, 13827, 13966, 13813, 11941; Payload ID: 493 relates to Category No.: 6814, 9500, 4100, 1867, 14663, 4101, 6215, 15273, 7974, 1605, 2533, 1866, 1604, 6303, 7976, 12699, 11941; Payload ID: 494 relates to Category No.: 6814, 9500, 4110, 14663, 1878, 1308, 4101, 6215; Payload ID: 495 relates to Category No.: 6814, 9500, 3684, 4100, 1893, 1867, 14663, 3791, 5855, 4101, 6215, 15273, 7974, 16143, 7976, 12699, 3726; Payload ID: 496 relates to Category No.: 6219, 6814, 9500, 4110, 4100, 1867, 14663, 9757, 11808, 4448, 4102, 15979, 587, 10424, 4101, 6215, 16144, 4112, 14838; Payload ID: 497 relates to Category No.: 6814, 9500, 4110, 4100, 1867, 14663, 1186, 1189, 4102, 4101, 6215; Payload ID: 498 relates to Category No.: 6814, 9500, 4110, 4100, 1867, 14663, 4102, 4101, 6215; Payload ID: 499 relates to Category No.: 6814, 9500, 4100, 1204, 4101, 6215, 4110; Payload ID: 500 relates to Category No.: 6814, 15660, 7369, 6310, 1867, 14663, 6305, 16144, 13859, 9484; Payload ID: 501 relates to Category No.: 6814, 1730, 4110, 7306, 15660, 14838, 6310, 1867, 14663, 6305; Payload ID: 502 relates to Category No.: 6814, 4110, 15660, 6310, 1867, 14663; Payload ID: 503 relates to Category No.: 6814, 4110, 4104, 15660, 6310, 1867, 14663, 6543; Payload ID: 504 relates to Category No.: 6814, 15660, 6211, 6310, 1867, 14663, 6305, 15979, 587, 6304, 6203, 454, 11291, 13969, 13827, 13966, 13970, 4110, 15664, 16306, 4115, 13968; Payload ID: 505 relates to Category No.: 6814, 15660, 6310, 1867, 14663, 6305, 6304, 16150, 10686, 11359, 11185, 1295, 13969, 13966, 4104; Payload ID: 506 relates to Category No.: 6219, 6814, 15660, 6211, 6310, 1867, 14663, 6305, 10362, 8500, 8929, 3607, 13966, 15664, 4115, 3056, 13897; Payload ID: 507 relates to Category No.: 6814, 15660, 6310, 1867, 14663, 6305, 12856; Payload ID: 508 relates to Category No.: 6814, 390, 15660, 6310, 1867, 14663, 6305; Payload ID: 509 relates to Category No.: 6814, 16308, 14663, 2353, 4112, 3726, 1125, 1348, 4104; Payload ID: 510 relates to Category No.: 6814, 4110, 15662, 4535, 6661; Payload ID: 511 relates to Category No.: 6814, 16308, 4110, 14663; Payload ID: 512 relates to Category No.: 6814, 12544, 2353, 4104; Payload ID: 513 relates to Category No.: 6814, 4110, 390; Payload ID: 514 relates to Category No.: 6814, 4110; Payload ID: 515 relates to Category No.: 6814, 4110, 13376, 11294; Payload ID: 516 relates to Category No.: 6814, 16308, 3944, 14663, 226, 227, 204, 11796; Payload ID: 517 relates to Category No.: 6814, 16308, 6211, 3944, 14663, 227, 226, 204, 11796; Payload ID: 518 relates to Category No.: 6814; Payload ID: 519 relates to Category No.: 390, 15660, 6310, 1867, 14663, 6305, 16144; Payload ID: 520 relates to Category No.: 5785, 4110, 14021, 15660, 6310, 1867, 14663, 13812; Payload ID: 521 relates to Category No.: 390, 4110, 15660, 6310, 1867, 14663, 12338, 235; Payload ID: 522 relates to Category No.: 15660, 6310, 1867, 14663, 11941; Payload ID: 523 relates to Category No.: 390, 15660, 6310, 1867, 14663, 6305, 16144; Payload ID: 524 relates to Category No.: 390, 15660, 6310, 1867, 14663, 6305, 3232, 16144, 14543, 15065, 14376, 15980, 3233; Payload ID: 525 relates to Category No.: 15660, 6310, 1867, 14663; Payload ID: 526 relates to Category No.: 15660, 6310, 1867, 14663, 2552, 6660, 6311, 6656, 9543, 4105; Payload ID: 527 relates to Category No.: 390, 15660, 6310, 1867, 14663, 16197, 9757, 1186, 1189, 4102, 15979, 587, 3232; Payload ID: 528 relates to Category No.: 390, 15660, 6310, 1867, 14663; Payload ID: 529 relates to Category No.: 9945, 14663, 815, 4653, 392; Payload ID: 530 relates to Category No.: 14090, 16276, 6814; Payload ID: 531 relates to Category No.: 15660, 6310, 1867, 14663; Payload ID: 532 relates to Category No.: 6219, 5428, 8112, 6244; Payload ID: 533 relates to Category No.: 9815, 6814; Payload ID: 534 relates to Category No.: 6814, 9815; Payload ID: 536 relates to Category No.: 12194, 12091, 1026, 3766, 10372, 1816, 5592, 10366, 9125, 3775, 4020, 4021, 2569, 10362, 14029, 9123, 7719, 5406, 6739, 11449, 7214, 10103, 2645, 12099; Payload ID: 537 relates to Category No.: 12194, 5592; Payload ID: 538 relates to Category No.: 12194, 1703, 7385, 3775; Payload ID: 539 relates to Category No.: 12194, 690, 5446, 1820, 5592, 7737, 4020, 7735, 4021, 2569, 7754, 11986, 8556, 1549, 6530, 15427; Payload ID: 540 relates to Category No.: 12194, 1703, 10372, 1060, 1795, 1767, 8756, 4461, 10366, 9125, 3775, 11285, 4020, 15782, 8988, 13925, 13882, 4021, 2569, 3016, 10415, 10902, 13827, 10362, 11542, 9123, 5911, 6739, 11449, 10103, 10568, 10467, 6740, 14910, 10386, 1705, 9006, 16294, 14927, 3778, 15195, 13108, 13871; Payload ID: 541 relates to Category No.: 12194, 1730, 7306, 14838; Payload ID: 542 relates to Category No.: 12194, 4949, 6739; Payload ID: 543 relates to Category No.: 12194, 14586, 4328, 7304, 1202, 5592; Payload ID: 544 relates to Category No.: 12194, 14586, 7304, 1202; Payload ID: 545 relates to Category No.: 12194, 14586, 7304, 1202; Payload ID: 546 relates to Category No.: 12194, 1703, 2169, 7719, 483, 14386, 7370, 4484; Payload ID: 547 relates to Category No.: 12194, 1703, 2169; Payload ID: 548 relates to Category No.: 12194, 14838; Payload ID: 549 relates to Category No.: 12194, 14838; Payload ID: 550 relates to Category No.: 12194, 14586, 7304, 1202; Payload ID: 551 relates to Category No.: 12194; Payload ID: 552 relates to Category No.: 12194; Payload ID: 553 relates to Category No.: 12194; Payload ID: 554 relates to Category No.: 12194, 690, 1764, 5428, 11109, 8373, 4020, 11453, 4021, 12650, 6410, 11266, 10343, 11290, 2006, 10289, 10978, 11564, 11488, 6147, 10203, 11288, 347, 11105, 10627, 10564, 14589, 10790, 11459, 10388; Payload ID: 555 relates to Category No.: 12194, 1703, 5939, 348, 1820, 5592, 4020, 2041, 4021, 2569, 15570, 14029, 11290, 13877, 10344, 6739, 7214, 10103, 10882, 10978, 13796, 13859, 1705, 1808, 13934, 10948; Payload ID: 556 relates to Category No.: 12194; Payload ID: 557 relates to Category No.: 12194, 5592, 7743, 5949, 9492, 4954, 2100, 11094, 2149, 9489, 2086, 15462; Payload ID: 558 relates to Category No.: 12194, 1204; Payload ID: 559 relates to Category No.: 12194, 12195, 1752, 1820, 12999, 2014, 2136, 1918, 7799, 12812, 12191, 8067, 7772, 7769; Payload ID: 560 relates to Category No.: 12194, 10074, 1820, 5592, 12099, 1893, 11660, 12068, 9631, 4715, 12067, 14025, 14029, 13892, 13900; Payload ID: 561 relates to Category No.: 12194, 4021, 2569, 2571; Payload ID: 562 relates to Category No.: 12194; Payload ID: 563 relates to Category No.: 12194, 1318, 13541, 12714; Payload ID: 564 relates to Category No.: 12194; Payload ID: 565 relates to Category No.: 12194, 4057, 8477, 5592; Payload ID: 566 relates to Category No.: 12194; Payload ID: 567 relates to Category No.: 12194, 4021, 2569, 14643, 12099, 14838, 2571, 6375; Payload ID: 568 relates to Category No.: 12194, 4021, 7613, 11371, 12764, 10973; Payload ID: 569 relates to Category No.: 12194, 12099, 4021, 2569, 2571, 11597, 16080, 2568, 4012; Payload ID: 570 relates to Category No.: 12194, 14640, 4020, 4021, 3013; Payload ID: 571 relates to Category No.: 12194, 1893, 4020, 4021, 11660, 12068, 12067, 3013; Payload ID: 572 relates to Category No.: 12194, 4949, 1579, 756, 2705; Payload ID: 573 relates to Category No.: 12194, 12195, 1893, 2014, 2136, 11660, 12068, 1918, 7131, 7799, 12067; Payload ID: 574 relates to Category No.: 12194, 7743, 9812; Payload ID: 575 relates to Category No.: 12194, 12137, 16172, 7306, 4712; Payload ID: 576 relates to Category No.: 12194, 5367, 7719; Payload ID: 577 relates to Category No.: 12194, 1893, 11660, 12068, 12067; Payload ID: 578 relates to Category No.: 12194, 8756, 4021, 6291; Payload ID: 579 relates to Category No.: 12194; Payload ID: 580 relates to Category No.: 12194, 795, 10238, 1893, 11660, 12068, 12067, 4021; Payload ID: 581 relates to Category No.: 12194; Payload ID: 582 relates to Category No.: 14565, 795, 1721, 4040, 1780, 11765, 5541, 4039, 12841, 12911; Payload ID: 583 relates to Category No.: 14565, 1721, 1780; Payload ID: 584 relates to Category No.: 12137, 8667, 16167, 15579, 8561, 1892, 12504, 7740; Payload ID: 585 relates to Category No.: 12137, 5782, 16172, 16197, 6738, 743, 11646, 12750, 3176, 4949; Payload ID: 586 relates to Category No.: 12137, 5782, 16172, 16197, 6738, 6713, 743, 11646, 3701, 11077, 11075, 12750, 4772; Payload ID: 587 relates to Category No.: 12137, 5782, 16172, 16197, 6738, 11646; Payload ID: 588 relates to Category No.: 15626, 5782, 16172, 16197, 6738, 6713, 743, 11646, 3701, 12750, 12137; Payload ID: 589 relates to Category No.: 15626, 5782, 16172, 16197, 6738, 12122, 743, 11646, 16167, 12750; Payload ID: 590 relates to Category No.: 12137, 15626, 5782, 14038, 12427, 16172, 16197, 6738, 743, 11646, 12750, 14097, 3698; Payload ID: 591 relates to Category No.: 12137, 15626, 5782, 16172, 16197, 6738, 743, 11646, 12750, 16213, 8920, 4094, 455, 15164; Payload ID: 592 relates to Category No.: 12137, 15626, 5782, 16172, 16197, 6738, 12122, 743, 11646, 12750; Payload ID: 593 relates to Category No.: 1026, 12137, 5782, 3766, 16172, 15149, 3639, 2506, 3775, 16197, 8988, 4770, 743, 7933, 12750, 8091; Payload ID: 594 relates to Category No.: 5782, 16172, 12137; Payload ID: 595 relates to Category No.: 5782, 16172, 12137, 1026, 3766, 15149, 2506, 3775, 16197, 8988, 743, 7933, 12750, 16136, 4949, 1579, 756, 2705, 2493; Payload ID: 596 relates to Category No.: 1026, 15626, 5782, 3766, 16172, 15149, 2506, 3775, 16197, 6738, 8988, 743, 7933, 12750, 8530; Payload ID: 597 relates to Category No.: 12137, 15626, 5782, 16172, 1026, 3766, 15149, 12798, 2493, 2506, 3775, 16197, 8988, 743, 7933, 12750; Payload ID: 598 relates to Category No.: 5782, 16172, 6713, 726, 727, 736, 1238, 12125, 736, 3990, 11116; Payload ID: 599 relates to Category No.: 5782, 16172, 11646, 726, 727; Payload ID: 600 relates to Category No.: 12137, 5782, 16172, 12026, 6713, 726, 727, 4062, 3701, 13462, 736, 12037, 736, 3990, 11116, 15162; Payload ID: 601 relates to Category No.: 15626, 5782, 16172, 12125, 726, 727; Payload ID: 602 relates to Category No.: 15626, 5782, 16172, 726, 727; Payload ID: 603 relates to Category No.: 12137, 15626, 5782, 16172, 5541, 726, 727; Payload ID: 604 relates to Category No.: 12137, 15626, 5782, 16172, 726, 727; Payload ID: 605 relates to Category No.: 12137, 5782, 16172, 6738, 11646; Payload ID: 606 relates to Category No.: 5782, 16172, 6738, 11646; Payload ID: 607 relates to Category No.: 15626, 5782, 16172, 6738, 4770, 11646, 12137; Payload ID: 608 relates to Category No.: 12137, 15626, 6738, 11646; Payload ID: 609 relates to Category No.: 12137, 3691; Payload ID: 610 relates to Category No.: 12137, 3691; Payload ID: 611 relates to Category No.: 3691, 3452, 12137; Payload ID: 612 relates to Category No.: 12137, 3691, 3452; Payload ID: 613 relates to Category No.: 13589, 3398, 15490, 3398, 11512, 8739, 8582, 7971, 14000, 11336, 8452, 7229, 6387, 4953, 1269; Payload ID: 614 relates to Category No.: 13589, 3398, 15490, 3398, 11512, 10606, 11181, 8739, 3613, 4949, 11150, 4953, 482, 10288, 10743; Payload ID: 615 relates to Category No.: 13589, 3398, 15490, 3398; Payload ID: 616 relates to Category No.: 15618, 795, 3684, 274, 1078, 280, 11765, 1893, 11242, 1844, 5855, 5406, 5243, 1797, 7303, 3854, 1764, 4996; Payload ID: 617 relates to Category No.: 15618, 274, 1078, 280, 11884, 11242, 5848; Payload ID: 618 relates to Category No.: 15618, 13827; Payload ID: 619 relates to Category No.: 14663, 12242, 9256, 12265, 9236, 411, 652, 4855, 12260, 5998, 2009; Payload ID: 620 relates to Category No.: 8831, 7693, 16286, 1752, 8300, 12628, 1780, 1744, 9599, 11243, 7712; Payload ID: 621 relates to Category No.: 16286, 8831, 4937, 906; Payload ID: 623 relates to Category No.: 1722, 1752, 1955, 10238, 7743, 7141, 8300, 8831, 16286, 795, 1703, 1483, 12628, 7693, 10366, 11884, 1183, 11765, 10314, 11302, 7163, 1744, 9599, 11243, 7835, 1844, 13149, 12515, 4937, 14949, 14782, 14643, 12638, 5949, 724, 3445, 14056, 7613, 12619, 15400, 7939, 1048, 10359, 7332, 2424, 1015, 1487, 1491, 11008, 8256, 10358, 13280, 10343, 15195, 10572, 12821, 6880, 13277, 12213, 2902, 8412, 13249, 7941, 13827, 3924, 2068, 9554, 8936, 13768, 12915; Payload ID: 624 relates to Category No.: 8862, 4828, 14565, 5428, 9777, 1816, 803, 422, 3971, 8209, 12903, 8112, 8336, 8227, 13459, 6212, 7613, 13882, 11222, 7743, 348, 7658, 8571, 13530, 439, 12594, 2562, 12126, 10282, 11248, 8029, 10568, 8054, 13417, 8089, 15273, 3161, 11171, 7811, 14646, 7576, 13690, 8812, 8672, 4588, 8672, 4342, 11133, 8381, 7811, 9102, 8216, 7702; Payload ID: 625 relates to Category No.: 4828, 422, 5428, 795, 442, 15614, 9777, 1816, 14449, 2169, 10209, 1468, 328, 1893, 8988, 1238, 1849, 1237; Payload ID: 626 relates to Category No.: 4828, 345, 422, 328, 1893, 5912, 3973, 1849, 11595, 434, 10309, 13690, 10851, 10961, 10406, 10415, 10703, 1968, 10437; Payload ID: 627 relates to Category No.: 4828, 422; Payload ID: 628 relates to Category No.: 5340, 5474, 14663, 12242, 13882, 12265, 15185, 12259, 417, 9236, 12254, 12651, 7580, 15736, 5406, 10266, 7613, 10710, 3576, 6269, 6375, 11452, 10218, 10307, 8209, 8112, 8336, 10036, 2972, 6371, 9769, 11392, 11445, 11453, 8264, 8715, 11461, 4460, 10650, 3073, 13557, 5337, 16300, 8440, 14046, 496, 13827, 5080, 13951, 13877, 12718, 14646, 7811, 9102; Payload ID: 629 relates to Category No.: 14267, 7306, 14834; Payload ID: 630 relates to Category No.: 14267; Payload ID: 631 relates to Category No.: 7288, 14038, 2885, 5446, 14267, 11949, 4439, 11697, 7012, 11607, 15817, 11922, 8523, 13890, 7286, 423, 1087, 5406, 7613, 3021, 3023, 9455, 3854, 4969, 8818, 4971, 11754, 2145, 8790, 14774, 8591; Payload ID: 632 relates to Category No.: 7288, 12619, 5446, 14267, 3021, 7743, 7737, 4439, 11607, 8523, 7286, 423, 1087; Payload ID: 633 relates to Category No.: 7288, 14267; Payload ID: 634 relates to Category No.: 14267, 15715, 15712, 4439; Payload ID: 635 relates to Category No.: 15715, 15712, 4439, 15724; Payload ID: 636 relates to Category No.: 6814; Payload ID: 637 relates to Category No.: 9287, 5474, 14663, 12242, 12265, 3474, 417, 9236; Payload ID: 638 relates to Category No.: 9982, 14153, 14663, 12242, 12265, 9236, 652, 12260, 2971, 2467, 10324, 11460, 15809, 420; Payload ID: 639 relates to Category No.: 14663, 12242, 12265, 5398, 12259, 9236, 13970; Payload ID: 640 relates to Category No.: 5398, 14663, 12242, 12265, 12259, 9236, 5394, 2816, 3727, 932, 9287, 650, 4892; Payload ID: 641 relates to Category No.: 5398, 14663, 12242, 12265, 12259, 9236, 648, 932, 5394, 3727, 650, 4892, 3855, 459; Payload ID: 642 relates to Category No.: 16308, 6902, 9374, 14663, 1878, 14349, 15089, 13882, 13966, 2432, 2470, 14340, 5245; Payload ID: 643 relates to Category No.: 9374, 702, 7287, 1204, 14349, 11399, 13181, 13042, 13796, 11922, 12492, 3810; Payload ID: 644 relates to Category No.: 9374, 14349; Payload ID: 645 relates to Category No.: 10129, 14663, 1878, 14847, 14842, 14346, 14350; Payload ID: 646 relates to Category No.: 5785, 2812, 15618, 14565, 15149, 5446, 4186, 1468, 434, 3775, 14663, 8988, 439, 1477, 16274, 1981, 3728, 12717, 355, 13724, 359, 1975, 1922, 1048, 6322, 13827, 13927, 2469; Payload ID: 647 relates to Category No.: 5785, 1468, 14838, 2812, 3808, 2008, 10238; Payload ID: 648 relates to Category No.:

15618, 5785, 14565, 442, 15149, 5446, 4186, 1468, 434, 3775, 14663, 8988, 439, 1477, 2812, 16274, 1981, 3728, 355, 13724, 359, 1975; Payload ID: 649 relates to Category No.: 15618, 5785, 14565, 15149, 5446, 14455, 4186, 1468, 434, 14831, 3775, 14663, 8988, 14586, 439, 1477, 2812, 266, 16274, 1981, 3728, 355, 13724, 359, 1975, 9337, 4144; Payload ID: 650 relates to Category No.: 15618, 5785, 14565, 442, 15149, 5446, 4186, 1468, 434, 3775, 14663, 8988, 439, 1477, 2812, 16274, 1981, 3728, 355, 13724, 359; Payload ID: 651 relates to Category No.: 15618, 5785, 14565, 15149, 5446, 4186, 1468, 434, 3775, 14663, 8988, 439, 1477, 2812, 10486, 13005, 16274, 1981, 3728, 355, 13724, 359, 1975, 8920, 6296, 422, 433, 436; Payload ID: 652 relates to Category No.: 15618, 5785, 14565, 3431, 15149, 5446, 4186, 1468, 434, 3775, 14663, 8988, 439, 1477, 2812, 16274, 1981, 3728, 8378, 355, 13724, 359, 8802, 13661, 2100, 1930, 2144, 1975; Payload ID: 653 relates to Category No.: 15618, 5785, 14565, 15149, 5446, 4186, 1468, 434, 3775, 14663, 8988, 439, 1477, 2812, 16274, 1981, 3728, 355, 13724, 359, 10309, 1966, 6626; Payload ID: 654 relates to Category No.: 15618, 5785, 14565, 15149, 5446, 4186, 1468, 434, 3775, 14663, 8988, 439, 1477, 2812, 16274, 1981, 3728, 355, 13724, 359, 6103, 6322; Payload ID: 655 relates to Category No.: 15618, 5785, 14565, 15149, 5446, 4186, 1468, 434, 3775, 14663, 8988, 439, 1477, 2812, 432, 16274, 1981, 3728, 355, 13724, 359; Payload ID: 656 relates to Category No.: 11512, 10702, 8962, 15614, 12931, 1816, 10209, 328, 8936, 8988, 1477, 10583, 4145, 10411, 11265, 13363, 10648, 7724, 10372, 932, 14009, 13837, 10486, 10309, 11094, 5080, 14454, 1982, 11436, 4588, 8489, 11602, 9485, 8049, 10851, 1112, 8340, 11403, 10034, 10699, 8009, 7577, 7578, 13327, 13267; Payload ID: 657 relates to Category No.: 4828, 1730, 15614, 1795, 328, 14838, 8988, 13835, 7728, 13827, 13837, 10309, 1477, 7315, 10302, 3187, 355, 10797; Payload ID: 658 relates to Category No.: 9232, 9254, 9265, 14663, 932, 457, 650, 9236, 9235, 1722, 9982; Payload ID: 659 relates to Category No.: 9232, 14663, 932, 9289, 457, 650, 9236, 9235, 9982, 1295, 6269, 9506, 2973, 14023; Payload ID: 660 relates to Category No.: 9982, 9232, 1238, 457, 650, 4892, 5908, 16045; Payload ID: 661 relates to Category No.: 9232, 9289, 9254, 9265, 932, 457, 650, 4892, 1295, 13827, 6269; Payload ID: 662 relates to Category No.: 9232, 9254, 9265, 14663, 932, 457, 9236, 9235, 12320, 2958, 9982; Payload ID: 663 relates to Category No.: 9289; Payload ID: 664 relates to Category No.: 9254, 9265, 14663, 9236, 9235, 14838, 1295, 3808, 5429, 1047, 9982, 9232; Payload ID: 665 relates to Category No.: 9254, 9265, 14663, 9236, 9235, 16138; Payload ID: 666 relates to Category No.: 9982, 9232, 14663, 9236, 9235, 2960, 3203, 651, 930, 1692, 2967, 2527, 2979, 4426, 15919, 2977, 15244; Payload ID: 667 relates to Category No.: 6814, 12133, 2991, 2984, 14663, 12242, 12251, 12259, 9236, 647, 12262, 13882, 13953, 13966, 14009, 14153, 486, 12253; Payload ID: 668 relates to Category No.: 2983, 14663, 12242, 12251, 12259, 5397, 9236, 5376, 647, 1959, 13994, 888, 13774; Payload ID: 669 relates to Category No.: 2983, 14663, 12242, 12251, 12259, 5397, 9236, 5376, 647, 12253, 13953, 14009, 1957, 4595, 1959, 888; Payload ID: 670 relates to Category No.: 1703; Payload ID: 671 relates to Category No.: 4828, 14565, 1795; Payload ID: 672 relates to Category No.: 4828, 1795, 2169, 14928, 12488, 3713, 12692, 690, 10557, 8806, 12834; Payload ID: 673 relates to Category No.: 4828, 1795; Payload ID: 674 relates to Category No.: 4828, 14565, 1703, 7743, 1795, 1048, 7598, 9738, 11431; Payload ID: 675 relates to Category No.: 4828, 1795, 7598, 11431, 9738; Payload ID: 676 relates to Category No.: 4828, 1795, 7385, 7598, 12754, 10702, 11431; Payload ID: 677 relates to Category No.: 4828, 1795, 10209; Payload ID: 678 relates to Category No.: 4828, 1795; Payload ID: 679 relates to Category No.: 4828, 1795, 403, 1795; Payload ID: 680 relates to Category No.: 4828, 5428, 1703, 1752, 1795, 4839; Payload ID: 681 relates to Category No.: 4828, 1795; Payload ID: 682 relates to Category No.: 4828, 5367, 5428, 1703, 1816, 1795, 7252; Payload ID: 683 relates to Category No.: 4828, 1795; Payload ID: 684 relates to Category No.: 4828, 1795; Payload ID: 685 relates to Category No.: 4828, 1795; Payload ID: 686 relates to Category No.: 4828, 1795; Payload ID: 687 relates to Category No.: 4828, 1795, 4535, 15121, 13071, 4094, 3728, 8243, 11193; Payload ID: 688 relates to Category No.: 4828, 690, 1295, 1703, 1816, 7743, 1795, 14108, 10343, 16080, 8377, 11986, 11339, 6082, 2249, 2251, 11084; Payload ID: 689 relates to Category No.: 4828, 1795, 14838; Payload ID: 690 relates to Category No.: 4828, 12638, 1060, 1795, 8391, 7831; Payload ID: 691 relates to Category No.: 4828, 1795; Payload ID: 692 relates to Category No.: 4828, 1795; Payload ID: 693 relates to Category No.: 4828, 1795; Payload ID: 694 relates to Category No.: 4828, 1795; Payload ID: 695 relates to Category No.: 4828, 1795, 15157, 11432, 5037, 1453, 11431; Payload ID: 696 relates to Category No.: 4828, 1795, 11431; Payload ID: 697 relates to Category No.: 4828, 1795, 15140, 1804, 8934, 11431, 13811, 6294; Payload ID: 698 relates to Category No.: 4828, 1795; Payload ID: 699 relates to Category No.: 4828, 1714, 8862, 14456, 9994, 16214, 14589, 1795, 8911, 6501, 14452; Payload ID: 700 relates to Category No.: 5255, 1295, 7369, 1035, 1804, 5037, 10261, 11220, 11431, 1048; Payload ID: 701 relates to Category No.: 5255, 1295, 7613, 1804, 5037, 8496, 11431; Payload ID: 702 relates to Category No.: 1295, 1804, 5037, 11431; Payload ID: 703 relates to Category No.: 12994, 10577, 1238, 9000, 4382, 6145, 5037, 9004, 7218; Payload ID: 704 relates to Category No.: 15499, 11834, 10545; Payload ID: 705 relates to Category No.: 1207, 1204; Payload ID: 706 relates to Category No.: 11512, 7613, 10606; Payload ID: 707 relates to Category No.: 15490, 3398, 11512, 1730, 10606, 2104, 1935, 13421; Payload ID: 708 relates to Category No.: 4094, 10606, 16279, 1334, 14838; Payload ID: 709 relates to Category No.: 4828, 5268, 454, 13071, 4535, 12913, 4112, 7735, 10877, 6119, 10800; Payload ID: 710 relates to Category No.: 4828, 5268, 454, 4535, 4112, 16094, 7735, 10666, 13966, 4145, 4949; Payload ID: 711 relates to Category No.: 11940, 8731, 3398, 7737, 10775, 7658, 7946, 11371, 4100, 11285, 8112, 4538, 12041, 2009, 7971, 14029, 8782, 11036, 10855, 1957, 4448, 8478, 10394, 8103, 4535, 8069, 8255, 12913, 8453, 10666, 8635, 8021, 8636, 8248, 6335, 10679, 8785, 10422, 13860, 8041, 8249, 8230, 8556, 11264, 8506, 4112, 10312, 1334, 7880, 11056, 10610, 8672, 3154, 8170, 10994, 11324, 8479, 8293, 11936, 13967, 13859, 13882, 13827, 13966, 13837, 13767, 11178, 2469, 14016, 1925, 10282, 8089, 11265, 6723, 454, 1961, 6734, 13922; Payload ID: 712 relates to Category No.: 13589, 3398, 15490, 3398, 8929, 7728, 2083, 10362, 2110; Payload ID: 713 relates to Category No.: 1512, 4706, 14663, 4538, 9982; Payload ID: 714 relates to Category No.: 14663, 9236, 9234, 6814; Payload ID: 715 relates to Category No.: 1894, 11898; Payload ID: 716 relates to Category No.: 14661, 12137, 5782, 14098, 4771, 12504, 9858, 9945, 14663, 16197, 6738, 743, 11646, 2662, 12750, 1847, 13401, 6299, 3062, 16172, 10543, 11290, 286, 10331, 16150, 10501, 10303, 11397, 4777, 15153, 6441, 10893, 10579, 13310; Payload ID: 717 relates to Category No.: 14661, 12137, 5782, 16172, 9858, 9945, 14663; Payload ID: 718 relates to Category No.: 11851, 14661, 12137, 11512, 5782, 7613, 16172, 1752, 9420, 13397, 3056, 356, 6102, 780, 3926, 12013, 1295, 13787, 3775; Payload ID: 719 relates to Category No.: 14661, 12137, 5782, 16172; Payload ID: 720 relates to Category No.: 1737, 14661, 12137, 5782, 1721, 1703, 16172, 2711, 10192, 12881, 7252, 14330, 12007, 13392, 10588, 8562, 12020, 12759, 6269, 5016, 3879, 7371, 7863; Payload ID: 721 relates to Category No.: 12137, 10702, 3684, 14098, 4771, 1893, 6738, 2662, 5855, 12798; Payload ID: 722 relates to Category No.: 12137, 10702, 16172; Payload ID: 723 relates to Category No.: 5782, 10702, 16172, 12105; Payload ID: 724 relates to Category No.: 10702, 12502, 12137, 3986, 12835, 4766, 7567, 8049, 11623, 3653, 11254, 8936, 11266; Payload ID: 725 relates to Category No.: 12137, 5785, 10702, 12502, 3697, 4775, 11566, 12414, 3653, 3986; Payload ID: 726 relates to Category No.: 5782, 12504, 13373; Payload ID: 727 relates to Category No.: 14661, 274, 12504, 6018, 7252, 14330; Payload ID: 728 relates to Category No.: 14661, 14565, 14097, 3698, 4774, 12021, 12137, 5782, 4418; Payload ID: 729 relates to Category No.: 14661, 12137, 5782, 14097, 3698, 4766, 12021, 356, 15470, 4785; Payload ID: 730 relates to Category No.: 14661, 5782; Payload ID: 731 relates to Category No.: 14661, 5782, 4969; Payload ID: 732 relates to Category No.: 14661, 5782; Payload ID: 733 relates to Category No.: 14661, 14699, 2459, 9099, 9420, 4278, 8890, 5744, 5782, 3445, 3176, 4952, 6107; Payload ID: 734 relates to Category No.: 14661, 12137, 5782; Payload ID: 737 relates to Category No.: 14661, 5782, 1204; Payload ID: 738 relates to Category No.: 14661, 5782; Payload ID: 739 relates to Category No.: 14661, 12137, 16172; Payload ID: 740 relates to Category No.: 14661, 12137, 16172; Payload ID: 741 relates to Category No.: 14661, 12137, 5782, 1721, 1183, 14663, 2198, 10383, 13004, 15768, 8049, 3728, 13146, 6508, 11008; Payload ID: 742 relates to Category No.: 14565, 12603, 13259, 14663, 13004, 3728, 11582, 6508; Payload ID: 743 relates to Category No.: 14661, 12137, 5782, 2460, 2886, 9420, 9993, 5949, 11646, 5793, 14699; Payload ID: 744 relates to Category No.: 14661, 12137, 5782, 14565, 1334; Payload ID: 745 relates to Category No.: 3635, 14661, 12137, 5782; Payload ID: 746 relates to Category No.: 14661, 12137, 5782, 14565, 12105; Payload ID: 747 relates to Category No.: 14661, 5782; Payload ID: 748 relates to Category No.: 14661, 5782; Payload ID: 749 relates to Category No.: 14661, 5782; Payload ID: 750 relates to Category No.: 14661, 12095, 5782, 16286, 16214, 2459, 12126, 12013, 6714, 9420, 3176, 1295, 4094, 13492, 14058, 5739, 12032; Payload ID: 751 relates to Category No.: 2740; Payload ID: 752 relates to Category No.: 7288, 14271; Payload ID: 753 relates to Category No.: 10238, 6171, 11419, 10470, 5814, 8312; Payload ID: 755 relates to Category No.: 1737, 14661, 12137, 5782, 7154, 2429; Payload ID: 756 relates to Category No.: 1737, 14661, 12137, 5782, 14565, 1721, 2429; Payload ID: 757 relates to Category No.: 14661; Payload ID: 758 relates to Category No.: 11898; Payload ID: 759 relates to Category No.: 6814, 2123; Payload ID: 760 relates to Category No.: 11851, 5446; Payload ID: 761 relates to Category No.: 11851; Payload ID: 762 relates to Category No.: 11851, 830; Payload ID: 763 relates to Category No.: 11851; Payload ID: 764 relates to Category No.: 12091, 14565, 5446, 9713, 4186, 15214, 4808, 16191, 3775, 8988, 16189, 1562, 8665, 355, 12409, 3111, 8702, 10332, 9716, 4828, 4949, 13571; Payload ID: 765 relates to Category No.: 12091, 14565, 12409; Payload ID: 766 relates to Category No.: 4828, 5785, 14565, 795, 1816, 7743, 14693, 11601, 11392, 13874, 9932, 9116, 10486, 432, 10955, 13827, 10583, 355, 11268, 10322, 496, 1419, 11436, 4342, 8584, 10195, 9408, 1746, 482, 10712, 11477, 10026, 8058, 10710, 6993, 11444, 12594; Payload ID: 767 relates to Category No.: 4828, 5785, 442, 1816, 7306, 1780, 11601, 11392, 9932, 9116, 10486, 12594, 432, 10955, 4535, 16213, 9408, 1746, 6296, 482, 1114, 1250, 13775, 13951, 16100, 10712, 11477, 8033, 10681; Payload ID: 768 relates to Category No.: 4828, 442, 10372, 1816, 7306, 1780, 3336, 11601, 11392, 9932, 9116, 10486, 432, 8703; Payload ID: 769 relates to Category No.: 4828, 14565, 2000, 10074, 10372, 1816, 274, 7581, 14108, 13659, 12391, 10366, 360, 14663, 1238, 13004, 10954, 8119, 435, 7681, 7688, 8118, 7252, 3728, 7678, 361, 10475, 10568, 4535, 10978, 8216, 11623, 8400, 7935, 3778, 11222, 5751, 7679, 7585, 9927, 346, 4131, 3356, 4145, 11602, 379, 15338, 8803; Payload ID: 770 relates to Category No.: 4828, 10074, 475, 6606, 690, 4145, 345, 10282, 11593, 13655; Payload ID: 771 relates to Category No.: 4828, 10074, 7581, 13659, 13491, 8119, 435, 11091, 1816, 14663, 1238, 13004, 3728, 361, 8400, 7935, 3778, 346, 13459, 4145, 11601, 8803; Payload ID: 772 relates to Category No.: 4828, 5785, 10702, 1816, 328, 432, 10313, 15273, 10309, 16105, 10712, 434, 1334, 13812, 4131, 8337, 3243, 11477, 4960; Payload ID: 773 relates to Category No.: 4828, 442, 12427, 1816, 1795, 328, 3699, 11298, 432, 10955, 7131, 364, 16105, 3112, 8638, 10255, 10916, 11512, 434, 1334, 13812, 8337, 10287, 3243, 13497, 1277, 4960, 13548, 6271, 13882, 16294, 13989, 10372, 13459, 496, 11222, 2006, 13836, 6269, 10238, 15149, 4588, 7598, 4145, 8477, 10707, 10250, 12573, 3940, 13823, 14022, 3971, 11602, 8420, 901, 8112, 11399, 8802, 3227, 11476, 11383, 13949; Payload ID: 774 relates to Category No.: 4828, 1512, 442, 1816, 328, 4828, 2745, 432, 10955, 3728, 4448, 15273, 16105, 434, 1334, 13812, 8337, 3243, 4960, 496, 3529, 13779; Payload ID: 775 relates to Category No.: 15254, 5782, 15257, 11845, 11465, 12010, 15269, 8696, 15255, 11374, 16023, 14640, 3595, 14418; Payload ID: 776 relates to Category No.: 14565, 1816, 1468, 729, 3016, 3015, 10309, 12409, 16096, 1237, 11760, 4826, 8811, 8807, 8887, 10226, 10372, 4949, 3194, 1312, 14921, 11600, 16090, 13925, 14050, 13859, 13882, 13812, 496, 13888, 14009, 10238, 13970, 7743, 10486, 4145, 9411, 9321, 1477, 1408, 11602, 8941, 10710, 684, 13571, 5265; Payload ID: 777 relates to Category No.: 12091, 690, 10648, 10226, 3244, 434, 7658, 4132; Payload ID: 779 relates to Category No.: 5446, 11109, 1795, 8936, 14050; Payload ID: 780 relates to Category No.: 8862, 2940, 2460, 283, 11094, 13232; Payload ID: 781 relates to Category No.: 12194, 15490, 3398, 8739, 7345, 14640, 13589, 3398; Payload ID: 782 relates to Category No.: 15490, 3398, 2409, 2410, 4439, 12891, 3783, 8004, 3783, 8739, 13589, 3398; Payload ID: 783 relates to Category No.: 6814; Payload ID: 787 relates to Category No.: 11506, 3398; Payload ID: 788 relates to Category No.: 7288, 1295, 14271, 13445, 6103; Payload ID: 789 relates to Category No.: 13589, 3398, 15490, 3398, 14029, 3594; Payload ID: 790 relates to Category No.: 13589, 3398, 15517, 14834; Payload ID: 791 relates to Category No.: 16236; Payload ID: 792 relates to Category No.: 12194, 14184, 1048, 7045, 8918, 7369, 7341, 7122, 13189, 8854, 2768, 7077; Payload ID: 793 relates to Category No.: 12137, 5788; Payload ID: 794 relates to Category No.: 14057; Payload ID: 795 relates to Category No.: 1703, 14640, 2169, 4949, 2571, 2374, 1621, 12190; Payload ID: 796 relates to Category No.: 10129, 14663, 1878, 14842, 498, 12279; Payload ID: 797 relates to Category No.: 8962, 5268, 4132, 12868, 481, 13888, 6626, 2469, 3529, 10614, 9991; Payload ID: 798 relates to Category No.: 14565, 1816, 5268, 10972; Payload ID: 799 relates to Category No.: 1026, 11512, 14565, 10702, 1512, 15143, 4808, 12405, 2526, 4721, 14663, 4021, 10628, 4723, 14086, 4722, 10005, 16211, 2385, 11434, 15149, 10061, 8918, 11089, 8976, 13529, 13398; Payload ID: 800 relates to Category No.: 14015, 10250; Payload ID: 801 relates to Category No.: 10250; Payload ID: 802 relates to Category No.: 13678, 13445, 12066; Payload ID: 806 relates to Category No.: 15490, 3398, 7132, 4441, 13882, 8071, 10649, 4336, 11245, 12672, 8739, 12638, 1892, 10887, 10775, 6018, 12942, 1432, 8198, 10954, 4229, 4653, 16294, 14927, 10384; Payload ID: 808 relates to Category No.: 15490, 3398, 5446, 11512, 13925, 10851, 3564, 8739, 8731, 3398, 10372, 8004, 10545; Payload ID: 810 relates to Category No.: 12137, 795, 12153, 11285, 3699, 6445, 3697, 3525, 11242; Payload ID: 811 relates to Category No.: 5446, 8728, 4186, 9891, 4127, 3775, 5541, 8988, 13227, 8522, 1995, 12671, 7748; Payload ID: 813 relates to Category No.: 5297, 13621; Payload ID: 838 relates to Category No.: 4279, 13622; Payload ID: 839 relates to Category No.: 4279, 13622; Payload ID: 858 relates to Category No.: 6375; Payload ID: 859 relates to Category No.: 14663, 1878, 11830, 4743, 4741, 4661, 1352, 6084, 6007, 9125, 9496, 13859, 13797, 12330; Payload ID: 860 relates to Category No.: 14663, 1878, 12303, 9236, 11111, 12307, 4743, 4741, 4661, 1352, 6007, 1351; Payload ID: 861 relates to Category No.: 12194, 690, 1730, 1893, 16189, 9631, 696, 1832, 8571; Payload ID: 862 relates to Category No.: 15715, 15712, 4439, 504, 15698, 15696, 4937, 14643, 11926, 8920, 8373, 3684, 2229, 8919, 13773, 13621, 2138; Payload ID: 863 relates to Category No.: 15712, 4439, 504, 15698, 15696, 7086, 7024; Payload ID: 864 relates to Category No.: 13621, 1204, 504, 15696; Payload ID: 865 relates to Category No.: 15626, 15618, 7613, 12427, 10074, 1184, 6253, 14663, 14057, 14767, 1238, 10080, 1189, 6499, 2116, 8496, 4997, 13966, 13970, 10442, 9102, 13938, 13987; Payload ID: 866 relates to Category No.: 16308, 9500, 3944, 14663, 3474, 513; Payload ID: 867 relates to Category No.: 16308, 9500, 3944, 14663; Payload ID: 868 relates to Category No.: 16308, 9500, 3944, 14663; Payload ID: 869 relates to Category No.: 16308, 9500, 14090, 3944, 14663, 14086, 1826, 12353, 513, 507, 3943; Payload ID: 870 relates to Category No.: 16308, 9500, 3944, 14663, 13999, 13925, 14086, 13758, 9669, 10282, 4266, 13964; Payload ID: 871 relates to Category No.: 9500, 16308, 3944, 14663, 13837; Payload ID: 872 relates to Category No.: 9500, 16308, 3944, 14663, 14086, 13788, 4027, 13837, 4111, 14080, 14090, 3942; Payload ID: 873 relates to Category No.: 9500, 1874, 14663, 84, 7193; Payload ID: 874 relates to Category No.: 6814, 16308, 9500, 10702, 14090, 3944, 14663, 1826; Payload ID: 875 relates to Category No.: 6814, 9500, 8888, 14090, 13818, 7743, 16216, 14080, 724, 10238, 10648, 1463, 8929, 10372, 3576, 1240, 6375, 2110, 4251, 3571, 4953, 14083, 5066, 1567, 3595, 9554, 3584, 14071, 7243, 4066, 12213, 8865, 195, 16001, 12811, 3169, 13835, 14040, 6269, 5949, 7002, 10034, 14078; Payload ID: 876 relates to Category No.: 6814, 9500, 14090, 3582, 14080, 14071, 10238, 5459, 14184, 8920, 3571, 6296, 4066, 9394, 14078, 9306, 9341; Payload ID: 877 relates to Category No.: 6814, 16308, 9500, 1512, 3944, 14663, 3942; Payload ID: 878 relates to Category No.: 6814, 1207, 9500, 6902, 9374, 29; Payload ID: 879 relates to Category No.: 6814, 1207, 9500, 6902, 9374, 29; Payload ID: 880 relates to Category No.: 6814, 9500; Payload ID: 881 relates to Category No.: 6814, 9500, 9982, 11773, 6349, 14663, 1878, 1828, 2485, 4576, 9437; Payload ID: 882 relates to Category No.: 6814, 16308, 9500, 1512, 15149, 3944, 14663, 8970, 513, 3942; Payload ID: 883 relates to Category No.: 6814, 9500, 16308, 14663, 1826, 13969, 13859, 13882, 10372, 496, 13827, 13966, 13797; Payload ID: 884 relates to Category No.: 6814, 9500, 3781, 2169, 14865, 14663, 14862, 9738, 1826, 14527, 10012, 13998, 4268; Payload ID: 885 relates to Category No.: 6219, 6814, 9500, 14865, 14663, 2083, 14862, 1826, 513, 3942, 515; Payload ID: 886 relates to Category No.: 6219, 6814, 9500, 513, 3942; Payload ID: 887 relates to Category No.: 6814, 9500, 11773, 11774, 14663, 1878, 11777, 11775, 147, 4567; Payload ID: 888 relates to Category No.: 6814, 9500, 8977, 15149, 4615, 4595, 13755, 2169, 4538, 4370, 8971, 11941, 4576, 15053, 206, 4655, 4359, 14543, 11634, 4556, 4372; Payload ID: 889 relates to Category No.: 6814, 9500, 14663, 1878, 1308, 16073, 16072, 15397, 15398, 1334, 1143; Payload ID: 890 relates to Category No.: 6814, 9500, 14456, 14663, 1878, 1826, 6424, 4658; Payload ID: 891 relates to Category No.: 6814, 9500, 14080, 14071, 195; Payload ID: 892 relates to Category No.: 6814, 9500, 14663, 1878, 1308, 8970, 1826, 1603, 5263, 1605, 6269, 5949; Payload ID: 893 relates to Category No.: 9500, 5428, 14663, 16234, 16275, 16217, 12397; Payload ID: 894 relates to Category No.: 16308, 9500, 1512, 14663, 4538, 4612, 1826, 4558, 6050, 3207, 515; Payload ID: 895 relates to Category No.: 9500, 1512, 14663, 14015, 4305, 14972, 2974, 3466, 1354, 4303, 2001, 14023, 11391, 13970, 15425, 6626, 15004, 14048, 10877, 2087, 7226, 7527, 14794, 9111, 5463, 2058; Payload ID: 896 relates to Category No.: 9500, 3244, 14972, 14086, 10005, 16211, 1826, 2974, 3466, 4082; Payload ID: 897 relates to Category No.: 9500, 3932, 14663, 14972; Payload ID: 898 relates to Category No.: 11940, 16308, 9500, 3244, 1184, 2353, 3791, 14086, 10005, 16211, 1189, 2974, 3466, 5752, 13972, 11761, 2028, 14071; Payload ID: 899 relates to Category No.: 4828, 9500, 10372, 3244, 14972, 11808, 11266, 3791, 2974, 3466, 11761, 2028, 2099; Payload ID: 900 relates to Category No.: 9500, 4828, 5939, 10372, 2835, 14663, 6530, 11307, 14972, 815, 11808, 11266, 11949, 15606, 14086, 10005, 16211, 13701, 13966, 1922, 10356, 2974, 3466, 4082, 2116, 2107, 1920, 11761, 10552, 2028, 13431, 15301, 14071, 7310, 2101, 1942, 2099, 8581, 13570; Payload ID: 901 relates to Category No.: 9500; Payload ID: 902 relates to Category No.: 9500, 1184, 14663, 14972, 1186, 14086, 10005, 16211, 1189, 2974, 3466, 684, 2028; Payload ID: 903 relates to Category No.: 9500, 3244, 14663, 2350, 1186, 1189, 684, 1355, 1187; Payload ID: 904 relates to Category No.: 9500, 7131; Payload ID: 905 relates to Category No.: 16308, 9500, 1512, 14663, 1826, 2974, 3466; Payload ID: 906 relates to Category No.: 16308, 9500, 14663, 1826; Payload ID: 907 relates to Category No.: 16308, 9500, 14663; Payload ID: 908 relates to Category No.: 1512, 12648, 10074, 4706, 286, 4521, 14663, 4538, 1238, 4305, 10080, 11941, 1482, 7332, 15012, 927, 4299; Payload ID: 909 relates to Category No.: 1512, 4706, 4521, 14663, 4538, 16060, 4305, 10250, 1482, 4299, 7506, 4304, 13969, 13859, 13827, 6269, 14009, 13773, 14054, 13981, 13797, 13799, 13813, 2009, 13852, 1968, 13901; Payload ID: 910 relates to Category No.: 4706, 1512, 4521, 14663, 4538, 4305, 3791, 1482, 4299; Payload ID: 911 relates to Category No.: 6593, 11930, 12063, 1893, 3405, 11660, 6243, 6814; Payload ID: 912 relates to Category No.: 6593, 11930; Payload ID: 913 relates to Category No.: 6814; Payload ID: 914 relates to Category No.: 12063, 1893, 3405, 11660; Payload ID: 915 relates to Category No.: 12063, 1893, 3405, 11660; Payload ID: 916 relates to Category No.: 6593, 12063, 1893, 3405, 11660; Payload ID: 917 relates to Category No.: 11926, 6593, 12062, 12063, 1893, 3405, 11660; Payload ID: 918 relates to Category No.: 6814, 12194, 12063, 1893, 3405, 11660; Payload ID: 919 relates to Category No.: 12063, 1893, 3405, 11660; Payload ID: 920 relates to Category No.: 6593, 12063, 1893, 3405, 11660, 13796, 11931; Payload ID: 921 relates to Category No.: 6814, 6593, 11930, 12063, 1893, 3405, 11660; Payload ID: 922 relates to Category No.: 11930, 4797, 12062, 12063, 1893, 12071, 3405, 11660, 3404, 3176; Payload ID: 923 relates to Category No.: 12062, 12063, 1893, 9360, 3405, 11660; Payload ID: 924 relates to Category No.: 9360, 6593, 12062, 12063, 1893, 3405, 11660; Payload ID: 925 relates to Category No.: 6593, 12063, 1893, 3405, 11660; Payload ID: 926 relates to Category No.: 1730, 5939, 3781, 14865, 14663, 14862, 2211, 1922, 14874, 2207, 13769, 13071; Payload ID: 927 relates to Category No.: 334, 10372, 14865, 14663, 14862, 2211, 1957, 14000, 7754, 10356, 7721, 14874, 8515; Payload ID: 928 relates to Category No.: 2211, 10372, 14865, 14663, 14862, 14874, 10013; Payload ID: 929 relates to Category No.: 6814, 3100; Payload ID: 930 relates to Category No.: 6814, 14640, 14045, 9455, 3631, 2079, 13779, 3199, 13925, 3100, 13859, 2166; Payload ID: 931 relates to Category No.: 6814, 3100; Payload ID: 932 relates to Category No.: 6814, 3100; Payload ID: 933 relates to Category No.: 9500, 3354, 3316, 9503, 3314, 14269; Payload ID: 934 relates to Category No.: 9500, 3354, 9505, 3316, 9503, 3314; Payload ID: 935 relates to Category No.: 9500, 3354, 1780, 3314, 9509; Payload ID: 936 relates to Category No.: 13589, 3398, 15490, 3398, 9500, 378, 11906, 2516; Payload ID: 937 relates to Category No.: 7288, 1730, 14838, 13882, 7280, 10491, 9510; Payload ID: 938 relates to Category No.: 9500; Payload ID: 939 relates to Category No.: 9500, 1955, 4110, 13160, 13072; Payload ID: 940 relates to Category No.: 6814, 9500, 1955, 15715, 15712, 4439, 15726, 15708, 6902; Payload ID: 941 relates to Category No.: 9500, 4104, 15660, 1867, 14663, 6737, 3951; Payload ID: 942 relates to Category No.: 9500, 6211, 1867, 14663, 3950; Payload ID: 943 relates to Category No.: 538; Payload ID: 944 relates to Category No.: 5428, 280, 287, 9777, 3729, 2013, 14328, 10637, 11460, 11037, 11459, 11391, 8633, 12365, 8636, 6952, 11388; Payload ID: 946 relates to Category No.: 1730, 12891, 10287, 11147, 8422, 7833; Payload ID: 947 relates to Category No.: 1512, 4727, 6214; Payload ID: 948 relates to Category No.: 11930, 10061, 4727, 4487; Payload ID: 949 relates to Category No.: 12137; Payload ID: 950 relates to Category No.: 11926, 4998, 12117, 4996; Payload ID: 951 relates to Category No.: 13589, 3398, 15490, 3398, 11512, 2411, 3354, 3320, 3353, 9274, 3337, 13729, 3313, 14566, 11128, 3365, 11467, 2004, 8698, 7303, 14838, 4251, 14442, 11637, 14520; Payload ID: 952 relates to Category No.: 8928, 9420, 13143, 597; Payload ID: 953 relates to Category No.: 1512, 9324, 1893, 11660, 12068, 4711, 7939; Payload ID: 954 relates to Category No.: 1204; Payload ID: 955 relates to Category No.: 7912, 1703, 12427, 16197, 12166, 4145, 8192, 8106, 4978, 11878; Payload ID: 956 relates to Category No.: 15618, 5367, 1703, 746, 7743, 3125, 14216, 14057, 12135; Payload ID: 957 relates to Category No.: 7912, 10028, 12999, 381, 14640, 12553, 8117, 11182, 7664, 8468, 9451; Payload ID: 958 relates to Category No.: 14661, 7912, 10074, 13485, 4020, 4021, 1238, 10080, 1238, 5825, 7823, 6104, 14944; Payload ID: 959 relates to Category No.: 7912, 12801; Payload ID: 961 relates to Category No.: 15626, 14534, 14656, 9492, 11761, 6269, 13970, 9411, 9554; Payload ID: 962 relates to Category No.: 12091, 7131, 10491, 9982; Payload ID: 963 relates to Category No.: 12091; Payload ID: 964 relates to Category No.: 12091, 4949, 1556; Payload ID: 965 relates to Category No.: 1867, 14663, 1186, 1189, 4102, 6814; Payload ID: 966 relates to Category No.: 1204; Payload ID: 967 relates to Category No.: 10702, 13435, 3697; Payload ID: 969 relates to Category No.: 1204, 6738, 5782, 4535, 12911; Payload ID: 970 relates to Category No.: 13589, 3398, 11512, 8739, 15517, 7306, 11506, 3398, 1621, 10578, 724, 8887, 3613, 9540, 3595, 6772, 8731, 3398; Payload ID: 971 relates to Category No.: 13589, 3398, 15490, 3398, 9599, 3613, 12498, 3584, 3594; Payload ID: 972 relates to Category No.: 13589, 3398, 14640, 4937, 13594, 15517, 11512, 9599, 11634, 724, 3613, 3246, 12498, 3578, 9540, 7345, 14641, 6194, 3584, 3594; Payload ID: 974 relates to Category No.: 1703, 9321, 1780, 1206; Payload ID: 975 relates to Category No.: 14565, 1703, 9321, 7306, 1780, 2376, 1206, 5845, 3812, 3615, 9455, 10446, 15463, 11501; Payload ID: 976 relates to Category No.: 7306, 1206; Payload ID: 977 relates to Category No.: 1703, 9321, 1206, 10276, 10540; Payload ID: 978 relates to Category No.: 14663, 1878, 5087, 5088, 5089, 6814; Payload ID: 979 relates to Category No.: 6814, 1512, 7443, 7441, 7458; Payload ID: 980 relates to Category No.: 16308, 9500, 14740, 616, 14663, 13827, 13779, 1999, 1996, 1939, 1940, 1913; Payload ID: 981 relates to Category No.: 16308, 9500, 16214, 616, 14663, 1640; Payload ID: 982 relates to Category No.: 16308, 9500, 5428, 1649, 1703, 616, 14663, 13779; Payload ID: 983 relates to Category No.: 690, 14565, 5428, 795, 1703, 1816, 2311, 4439, 4538, 15698, 6145, 14050, 7924, 3021, 1249; Payload ID: 984 relates to Category No.: 795, 4439, 15698, 7743, 11298, 15824, 11090; Payload ID: 985 relates to Category No.: 12194, 6814, 1830, 16308, 14663; Payload ID: 986 relates to Category No.: 6814, 16308, 1204, 14663, 16197; Payload ID: 987 relates to Category No.: 1207, 15750, 14663, 1878, 5981, 84, 4576, 6273, 6424, 6279, 15752; Payload ID: 988 relates to Category No.: 6814, 4110; Payload ID: 989 relates to Category No.: 4104, 14663, 16234, 16275, 9567, 9712, 6423; Payload ID: 990 relates to Category No.: 9500, 12133, 14663, 1878, 6424, 6279, 6277; Payload ID: 991 relates to Category No.: 15750, 14663, 1878, 12351; Payload ID: 992 relates to Category No.: 11940, 15317, 14663, 4977, 10174, 12209, 2020, 13967, 14046, 13969, 13925, 13859, 13882, 14025, 13874, 13886, 13827, 13966, 13837, 13794, 13767, 13970, 13938, 13987, 13773, 13975, 13870, 13939, 14054, 13904, 13944, 13905, 13916, 14039, 13843, 13810, 14004, 13784, 2032, 13771, 14041; Payload ID: 993 relates to Category No.: 6902, 4664, 14663, 1878, 4743; Payload ID: 994 relates to Category No.: 12194, 746, 12096, 2006, 9631, 11294; Payload ID: 995 relates to Category No.: 12194; Payload ID: 996 relates to Category No.: 15490, 3398, 8739, 16286, 8731, 3398, 7306, 7693, 8004, 13893, 9410, 8507, 8575, 10228, 13594, 12936, 14640, 1968; Payload ID: 998 relates to Category No.: 12427, 7306, 6253, 14663, 2541, 4774, 2540, 16234, 16275, 11997, 3973; Payload ID: 999 relates to Category No.: 15149, 3639, 6102, 15156; Payload ID: 1000 relates to Category No.: 4828, 10372, 1816, 3833, 1780, 12063, 2669, 3775, 1893, 6738, 11660, 10522, 3237, 3803, 6553, 6555, 13835, 13969, 13859, 13981, 13797, 8936, 13877, 8421, 4480, 11201; Payload ID: 1001 relates to Category No.: 1512, 3244; Payload ID: 1002 relates to Category No.: 1512, 3244; Payload ID: 1003 relates to Category No.: 1512, 3244; Payload ID: 1004 relates to Category No.: 1512, 14663, 1506, 10158; Payload ID: 1005 relates to Category No.: 1512, 3244; Payload ID: 1006 relates to Category No.: 1512, 14663, 4538, 4685, 4686, 4690, 13859, 13874, 13966; Payload ID: 1007 relates to Category No.: 12091, 7912, 1703, 10074, 3639, 5446, 6296, 5852, 1048, 7287, 9125, 1893, 8936, 6738, 13618, 4021, 1238, 729, 3016, 483, 10080, 734, 3038, 11646, 3015, 9292, 6125, 11027, 16213, 12819, 1847, 2594, 8923, 8944, 13189, 14053, 6629, 1018, 1030, 13527, 11512, 12891, 8375, 13975, 2355, 4251, 8920, 13342, 15067, 10638, 15146, 14684, 2068, 13916, 2075, 1925, 11169, 8862; Payload ID:

1008 relates to Category No.: 15149, 11884; Payload ID: 1009 relates to Category No.: 8862, 12137; Payload ID: 1010 relates to Category No.: 12137, 7710, 5406, 15149, 12891; Payload ID: 1011 relates to Category No.: 13589, 3398, 15490, 3398, 14565, 1722, 795, 1955, 10238, 3354, 11506, 3398, 3448, 1048, 7735, 5182, 8714, 11512, 11094, 11290, 13905, 10521; Payload ID: 1012 relates to Category No.: 14565, 10074, 1238, 10343, 15187; Payload ID: 1013 relates to Category No.: 13589, 3398, 5785, 1722, 7735, 8934, 1026, 4021, 10238, 7613; Payload ID: 1014 relates to Category No.: 13589, 3398; Payload ID: 1015 relates to Category No.: 8862, 795, 1703, 3639, 439, 7688, 9410, 2075; Payload ID: 1016 relates to Category No.: 4828, 7912, 4021, 2355, 4251, 8920, 13342, 6296, 15067, 1847, 6629, 6995, 12819; Payload ID: 1017 relates to Category No.: 5782, 5788; Payload ID: 1018 relates to Category No.: 11926, 5446, 381, 1893, 2275, 8817, 8835, 8326, 7576, 7555, 7557, 8819, 7960, 8036; Payload ID: 1019 relates to Category No.: 10702, 13435, 8940, 3697, 11291, 11265, 12806, 11304, 13975, 6296, 15149, 4588, 1112, 11997, 12414, 8918, 16165, 3691, 12942, 1727, 1048, 5406, 12365; Payload ID: 1021 relates to Category No.: 12942; Payload ID: 1022 relates to Category No.: 1737, 7154, 7132, 670, 11587, 13644, 7163, 8797, 11959; Payload ID: 1023 relates to Category No.: 1737, 13170, 7154, 7132, 670, 11587, 13644, 7163, 8797, 11959; Payload ID: 1024 relates to Category No.: 1737, 12154, 12153, 7154, 11032, 7132, 670, 11587, 13644, 7163, 8797, 11959; Payload ID: 1025 relates to Category No.: 1737, 7154, 11959; Payload ID: 1026 relates to Category No.: 13168, 1737, 7154; Payload ID: 1027 relates to Category No.: 1737, 12153, 7154, 1721; Payload ID: 1028 relates to Category No.: 1737, 15898, 7154, 11432, 7132, 670, 11587, 13644, 7163, 8797, 11959, 11435, 10495, 10257; Payload ID: 1029 relates to Category No.: 1737, 13170, 7154, 7132, 670, 11587, 13644, 7163, 8797, 11959; Payload ID: 1030 relates to Category No.: 1737, 7154, 7132, 670, 11587, 13644, 7163, 8797, 11959; Payload ID: 1031 relates to Category No.: 1737, 7154, 7132, 670, 11587, 13644, 7163, 8797, 11959; Payload ID: 1032 relates to Category No.: 12091, 9982, 14565, 9720, 15614, 9038, 11109, 12498, 345, 8928, 1780, 11858, 8862; Payload ID: 1033 relates to Category No.: 3837, 12603, 14096, 3829; Payload ID: 1034 relates to Category No.: 13589, 3398, 15490, 3398, 14967, 687, 13594, 5406, 10955, 7303, 12891, 6530, 14838, 3799, 7939, 10860, 12603, 4167, 14442, 6553, 13739, 14586, 11822, 3793, 1886, 6524, 10803, 11823, 15295, 13541, 13740, 6163, 9407, 6540, 12763, 358, 7240, 6079, 13336, 14661, 11512, 15626, 14565, 10372, 1816, 11109, 1746, 7743, 11506, 3398, 5783, 7965, 15521, 14533, 1780, 10648, 4439, 10358, 12066, 11201, 11821, 11530, 8122, 10805, 12841; Payload ID: 1037 relates to Category No.: 12194; Payload ID: 1039 relates to Category No.: 8318, 137; Payload ID: 1040 relates to Category No.: 690, 1730, 10557, 14689; Payload ID: 1041 relates to Category No.: 690, 1703, 14267, 10558, 10226, 16096; Payload ID: 1042 relates to Category No.: 690, 9228, 1752, 5446, 8760, 1714, 287, 14320, 14216, 1814, 10036, 13882, 729, 3016, 13874, 10558, 734, 450, 11290, 5244, 11201, 361, 9378, 355, 1749, 8636, 9485, 14053, 3216, 353; Payload ID: 1043 relates to Category No.: 12638, 274, 7598, 5072, 1892, 1812, 8807, 11418, 10283, 10378, 16096, 5406, 4419, 3872, 2311, 8049, 10539, 1758, 1244, 1249, 13485; Payload ID: 1044 relates to Category No.: 16286, 5072, 3872, 10283; Payload ID: 1045 relates to Category No.: 16286, 5072; Payload ID: 1046 relates to Category No.: 1026, 14661, 7613, 5446, 6606, 348, 4186, 10175, 12391, 4127, 14928, 3775, 5541, 16085, 8988, 11298, 1238, 15421, 11313, 6145, 11178, 11266, 10583, 8807, 7919, 7719, 12007, 10557, 4504, 13455, 5010, 10283, 364, 5406, 8535, 11174, 690, 4998, 15614, 13342, 8373, 13634, 1823, 8519, 11187, 10343, 12993, 7848, 13101; Payload ID: 1047 relates to Category No.: 14565, 1238, 15421, 6145, 7659, 8482, 4504, 7598, 1249, 690, 7755, 13969, 13882, 13936, 13767, 13860, 6626, 9411, 13996, 1993, 10226, 4458; Payload ID: 1048 relates to Category No.: 690, 7613, 7598, 1238, 6145, 11178, 10557, 2006, 7659, 10226, 10283, 364, 9125; Payload ID: 1049 relates to Category No.: 15614; Payload ID: 1050 relates to Category No.: 7306; Payload ID: 1051 relates to Category No.: 14565, 4634, 4110, 1820, 5592, 9941, 6226, 9945, 2355, 10366, 2353, 15662, 860, 6215, 10226, 9944, 10911, 8223, 8462, 394, 13874; Payload ID: 1052 relates to Category No.: 690, 1730, 7613, 1867, 14663, 13882, 15662, 10226, 8223, 7919, 11940; Payload ID: 1054 relates to Category No.: 690, 1730; Payload ID: 1055 relates to Category No.: 13975; Payload ID: 1056 relates to Category No.: 12194, 746, 4948, 12544, 11296, 13659, 14838, 1893, 1149, 1250, 5949, 9631, 13661, 11177, 11172, 696, 13488, 13411, 9006, 817, 695, 13549, 7221, 5262, 12490, 4970, 1781, 12959, 8001; Payload ID: 1057 relates to Category No.: 12194, 12999, 13659, 12646, 1893, 11307, 12737, 16189, 13661, 696, 10643, 12588, 12403, 12430, 695, 13549, 704, 10322, 15754; Payload ID: 1058 relates to Category No.: 4828, 1713, 12633, 12999, 14108, 1451, 13659, 702, 12646, 11307, 10423, 10790, 9932, 10486, 5949, 10946, 10394, 13661, 13727, 12548, 11070, 6340, 13412, 10487, 13549, 11189, 9928; Payload ID: 1059 relates to Category No.: 4828, 5785, 1295, 1795, 12544, 702, 9052, 11602, 7735, 1250, 11113, 7659, 11111, 10600, 11200, 4027, 4829, 8382, 8057, 13545, 11506, 3398, 5428, 4004, 10292, 16104, 13138, 1297, 10995, 10372, 13971, 5949, 8400, 11325, 2159, 1951, 1747, 13727, 2214, 8102, 523, 3425, 13592, 7990, 10478, 5951; Payload ID: 1060 relates to Category No.: 12544, 702, 13882; Payload ID: 1061 relates to Category No.: 4828, 7912, 12633, 1816, 11109, 11506, 3398, 12544, 11296, 13659, 9052, 12646, 1893, 1867, 14663, 11307, 13714, 10423, 10790, 9932, 1250, 5949, 11187, 11178, 10557, 10475, 10626, 10946, 10394, 10600, 696, 10324, 10567, 12550, 13727, 13411, 12548, 4829, 10198, 13954, 11070, 6340, 13412, 8382, 10292, 12853, 10976, 10643, 12588, 8644, 10955, 12891, 4021, 7743, 10648, 1318, 11051, 11174, 1240, 1820, 352, 12498, 13812, 8373, 3973, 12999, 14688, 3869, 10609, 5263, 9744, 697, 11143, 13545, 3469, 14003, 11267, 1297, 905, 9486, 13710, 14690, 1795, 7735, 10372, 496, 2051, 16102, 7598, 4145, 13256, 11325, 16099, 4195, 10331, 2883, 2159, 12573, 11111, 1747, 13084, 12953, 10282, 11602, 15003, 3846, 355, 861, 704, 10598, 11429, 8718, 1644, 13628, 16039; Payload ID: 1062 relates to Category No.: 7141, 7154, 12848, 14468, 4501, 4969; Payload ID: 1063 relates to Category No.: 15618, 6296, 14640, 9812, 12553, 5472; Payload ID: 1065 relates to Category No.: 1026, 14565, 2940, 3986, 3833, 6492, 12129, 11145; Payload ID: 1066 relates to Category No.: 1026, 14565, 1836, 10648, 12041, 12117, 12573, 1892, 12594, 12596, 13376, 12954, 12007, 14369, 10301, 12953, 13408, 13664, 12017, 12595, 11221, 11222, 16129, 963, 10334, 12591, 967, 12512, 12037, 15759, 12572, 12025, 12046, 14336, 6729, 965, 14337, 13451, 10300, 12129, 1562, 11997, 12592, 12607, 12520, 8862, 13944, 9575; Payload ID: 1067 relates to Category No.: 14565, 10061, 7141, 2933, 8946, 1048, 10648, 12041, 4774, 13330, 11399, 3900, 2048, 11398, 7862, 12129, 10977, 6718, 6479, 6509, 10975, 1026, 15143; Payload ID: 1068 relates to Category No.: 11512, 12632; Payload ID: 1069 relates to Category No.: 15601; Payload ID: 1070 relates to Category No.: 2130; Payload ID: 1071 relates to Category No.: 14565; Payload ID: 1072 relates to Category No.: 14565; Payload ID: 1074 relates to Category No.: 3639, 14097, 3698, 3692, 3694, 4772, 11206; Payload ID: 1075 relates to Category No.: 12154, 11237, 12096, 12153; Payload ID: 1076 relates to Category No.: 5446; Payload ID: 1077 relates to Category No.: 12091; Payload ID: 1079 relates to Category No.: 1737, 12603, 7154, 13370, 7132, 11248, 7156, 8468; Payload ID: 1082 relates to Category No.: 5785, 12153, 7844, 6523; Payload ID: 1083 relates to Category No.: 5785, 12153; Payload ID: 1084 relates to Category No.: 5785, 12153; Payload ID: 1085 relates to Category No.: 5785, 12153; Payload ID: 1086 relates to Category No.: 5785, 12153; Payload ID: 1087 relates to Category No.: 5785, 12153; Payload ID: 1088 relates to Category No.: 5785, 12153; Payload ID: 1089 relates to Category No.: 5785, 12153; Payload ID: 1090 relates to Category No.: 5785, 12153; Payload ID: 1091 relates to Category No.: 5785, 12153; Payload ID: 1092 relates to Category No.: 5785, 14565, 12153, 7131, 10491, 12154, 14620, 12096, 7381; Payload ID: 1093 relates to Category No.: 5785, 12153; Payload ID: 1094 relates to Category No.: 5785, 11600, 11860; Payload ID: 1095 relates to Category No.: 5785, 12153; Payload ID: 1096 relates to Category No.: 5785, 12153; Payload ID: 1097 relates to Category No.: 5785, 12153; Payload ID: 1098 relates to Category No.: 5785, 12153; Payload ID: 1099 relates to Category No.: 5785, 12153, 11243; Payload ID: 1100 relates to Category No.: 3766, 8944, 15045; Payload ID: 1101 relates to Category No.: 13531; Payload ID: 1103 relates to Category No.: 13831; Payload ID: 1104 relates to Category No.: 3176, 4949; Payload ID: 1106 relates to Category No.: 3837, 9309, 7022; Payload ID: 1107 relates to Category No.: 11512, 10238, 1867, 14663, 2041, 2014, 2136, 2051, 2131, 11290, 13956, 14365, 1570, 10516, 14566, 7880, 13594, 14620, 1957, 2079, 8739, 2006, 11094; Payload ID: 1108 relates to Category No.: 12583; Payload ID: 1109 relates to Category No.: 9321, 4067, 14641, 5406, 7303, 4947, 15425, 1269; Payload ID: 1114 relates to Category No.: 12103, 13399, 12493; Payload ID: 1116 relates to Category No.: 5446, 3013, 10775, 12775, 16197, 10637, 10349, 10966, 11341, 1248, 8634; Payload ID: 1119 relates to Category No.: 8739, 7345, 7340, 8352, 13599, 14620, 8356, 12737, 13207, 13037; Payload ID: 1125 relates to Category No.: 13936; Payload ID: 1128 relates to Category No.: 12137, 10702, 8940, 14097, 3702, 3525, 8642, 10495, 3701; Payload ID: 1129 relates to Category No.: 3833, 12063, 2669, 1893, 6738, 11660; Payload ID: 1131 relates to Category No.: 13589, 3398; Payload ID: 1132 relates to Category No.: 1204; Payload ID: 1135 relates to Category No.: 8739, 8753, 14620; Payload ID: 1145 relates to Category No.: 1204; Payload ID: 1146 relates to Category No.: 1204; Payload ID: 1147 relates to Category No.: 15588; Payload ID: 1149 relates to Category No.: 1204; Payload ID: 1151 relates to Category No.: 1730, 11506, 3398, 14838; Payload ID: 1152 relates to Category No.: 12137, 14097, 3702; Payload ID: 1155 relates to Category No.: 10586, 13033, 13360, 9238; Payload ID: 1157 relates to Category No.: 7693, 10878, 11620, 10038; Payload ID: 1164 relates to Category No.: 6530; Payload ID: 1165 relates to Category No.: 7613; Payload ID: 1166 relates to Category No.: 13594, 1204; Payload ID: 1167 relates to Category No.: 14565, 1730, 7306, 14838, 4439, 4442, 10031, 3339, 6532; Payload ID: 1169 relates to Category No.: 14565, 5428, 12648, 7613, 5939, 9777, 9632, 275, 12988, 12999, 8164, 4828, 2745, 575, 11460, 7216, 10840, 11479, 8710, 11623, 9005, 13066, 11604, 13015, 7961, 1982, 4839, 9001, 7710, 12646, 817, 10637, 7387, 11101, 13835, 13969, 1795, 13859, 13874, 13827, 2001, 10238, 5544, 13893, 13981, 3320, 11821, 11230, 3940, 3632, 5019, 3370, 14052, 4484, 8540, 11770, 13814, 3366, 8461; Payload ID: 1171 relates to Category No.: 1737, 1721, 9777, 13796; Payload ID: 1172 relates to Category No.: 1730, 10686, 8037; Payload ID: 1173 relates to Category No.: 690, 7710, 6721, 11308, 11935, 6744, 11604, 8559, 8231, 9458, 8556, 2571, 4180, 10275, 14023, 11285, 10626, 1265, 12129; Payload ID: 1175 relates to Category No.: 9777, 7710, 3013, 9002, 11363, 10557, 10226, 13859, 5073, 9411, 13865, 10519; Payload ID: 1176 relates to Category No.: 7814, 13594, 14565, 7613, 7710, 8164, 8390, 3791, 9125; Payload ID: 1177 relates to Category No.: 14565, 7613, 7710, 1238, 7131, 10491, 13970, 11940, 1415, 13796, 14023, 10238, 7657, 2032, 1989, 13502, 8497, 7814; Payload ID: 1178 relates to Category No.: 11940, 5846, 1417, 13194, 803, 7029; Payload ID: 1179 relates to Category No.: 1002, 14729, 8004, 3791, 12648, 1836, 1780, 4999, 2164, 14003, 13969, 13796, 6733; Payload ID: 1180 relates to Category No.: 3691, 1238, 3697, 8613, 8461; Payload ID: 1182 relates to Category No.: 15149, 14589; Payload ID: 1183 relates to Category No.: 15618, 1649, 2331, 5846, 12491, 7306, 1651, 2329, 9932, 1995, 10802, 3161, 5838, 13126; Payload ID: 1184 relates to Category No.: 15618, 1649, 2331, 5846, 1651, 2329; Payload ID: 1185 relates to Category No.: 15618, 5846, 2329, 2331; Payload ID: 1186 relates to Category No.: 1397, 6227, 15618, 5846, 1395, 1394, 3143, 3159; Payload ID: 1187 relates to Category No.: 1397, 6227, 15618, 2331, 5846, 2329, 1396, 1395, 1394; Payload ID: 1188 relates to Category No.: 15618, 2331, 5846, 2329; Payload ID: 1189 relates to Category No.: 6227, 15618, 2331, 5846, 12491, 14740, 1415, 10238, 1651, 2329, 12268, 9947, 1238, 11037, 10287, 10552, 332, 7749, 1232, 11182, 3729, 10868, 10170, 9901, 1396, 1395, 1394, 1397, 1273, 3046; Payload ID: 1190 relates to Category No.: 6227, 15618, 2331, 5846, 2329, 1396, 1395, 1394, 1397; Payload ID: 1191 relates to Category No.: 15618, 2331, 5846, 2329; Payload ID: 1192 relates to Category No.: 6227, 15618, 2331, 5846, 2329, 8168, 1396, 1395, 1394; Payload ID: 1193 relates to Category No.: 13589, 3398; Payload ID: 1194 relates to Category No.: 1026, 7912, 1703, 2311, 7252, 8441; Payload ID: 1196 relates to Category No.: 7728, 10648, 10383, 10588, 10872, 10567, 3247, 10509, 7301, 11180, 6378; Payload ID: 1197 relates to Category No.: 1204; Payload ID: 1198 relates to Category No.: 14565, 15043, 275, 13737; Payload ID: 1199 relates to Category No.: 15471, 13737; Payload ID: 1201 relates to Category No.: 8667, 10599, 11208, 5867, 5866; Payload ID: 1202 relates to Category No.: 1816, 14533, 10648, 4791, 14532, 16023, 7302, 4789, 13969, 496, 13827, 11109, 11685, 8426; Payload ID: 1203 relates to Category No.: 12091, 14565, 14569, 14533, 7302, 7608, 752, 6530, 15570, 4138, 15610; Payload ID: 1204 relates to Category No.: 6819, 13975, 2679, 13998, 5769, 1847, 2677; Payload ID: 1205 relates to Category No.: 15490, 3398, 3354, 2409, 9274, 7803, 2404, 3364, 3365, 9455, 7334; Payload ID: 1206 relates to Category No.: 13589, 3398, 15490, 3398, 1730, 7306, 2409, 14838, 2404, 3364, 3365, 9274; Payload ID: 1207 relates to Category No.: 10331, 10129, 14663, 12654, 1878, 12280, 8508, 11215; Payload ID: 1208 relates to Category No.: 10331, 10129, 14838, 14663, 1878, 12280, 8508, 11215, 12283, 498, 15575, 9443; Payload ID: 1209 relates to Category No.: 1778; Payload ID: 1210 relates to Category No.: 2885; Payload ID: 1211 relates to Category No.: 934; Payload ID: 1215 relates to Category No.: 15618, 12197, 5046, 4536, 4539; Payload ID: 1218 relates to Category No.: 5297, 7039, 2869; Payload ID: 1221 relates to Category No.: 15642, 2006, 12605; Payload ID: 1223 relates to Category No.: 3356; Payload ID: 1227 relates to Category No.: 12091, 3639, 12117, 11858, 11125, 13363, 12719; Payload ID: 1228 relates to Category No.: 6285, 795, 7613, 10129, 14663, 1878, 12832, 15089, 6286; Payload ID: 1229 relates to Category No.: 16286, 7693, 10314, 12583, 5949, 455, 1269, 6774; Payload ID: 1230 relates to Category No.: 16286, 7693, 3532; Payload ID: 1231 relates to Category No.: 16286; Payload ID: 1232 relates to Category No.: 5367, 14565, 5998, 10372, 3469, 7658, 4132, 10455, 12552, 11602, 8811, 13571, 11201, 13416, 10713, 10456; Payload ID: 1233 relates to Category No.: 4828, 4949, 4418, 12552; Payload ID: 1234 relates to Category No.: 4949, 3641, 772, 6794, 1761; Payload ID: 1235 relates to Category No.: 1721, 9228, 3354, 3353, 1089; Payload ID: 1236 relates to Category No.: 14216, 3656, 13589, 3398, 15490, 3398, 9500, 13186, 9228, 3354, 15257, 1089, 8408, 7132, 10521, 3316, 3369, 15259, 15260, 1790, 496, 13827, 2001, 13971, 2088, 1925, 10637, 2081, 8635; Payload ID: 1237 relates to Category No.: 10331, 1026, 3766, 10238, 803, 12099, 9125, 8988, 9123, 6739, 6740, 664, 6878; Payload ID: 1238 relates to Category No.: 10331, 12099, 1026, 3766, 10238, 803, 9125, 8988, 9123, 6740; Payload ID: 1240 relates to Category No.: 7288, 4439, 12117, 2867, 7286, 7283; Payload ID: 1241 relates to Category No.: 6219, 6227, 10331; Payload ID: 1242 relates to Category No.: 6227, 4828, 15618, 12427, 10074, 2359, 5592, 2351, 9943, 2355, 6253, 1893, 1867, 14663, 12072, 15661, 8112, 1238, 12117, 14102, 2347, 10423, 13027, 8941, 16155, 5060, 16236, 10080, 2353, 11559, 10609, 10918, 15662, 14086, 10005, 16211, 11418, 7553, 8069, 8575, 5065, 5062, 12612, 9944, 2354, 7848, 11339, 9825, 8785, 8815, 9698, 8134, 10771, 7722, 11425, 1244, 472, 13371, 9945, 3715, 6226, 8099, 4515, 6249, 13827, 13836, 13966, 9411, 9950, 9737, 8213; Payload ID: 1243 relates to Category No.: 7513, 7505, 1204, 11941; Payload ID: 1244 relates to Category No.: 10331, 11926, 9941, 2351, 9943, 2355, 6253, 1867, 14663, 16197, 12072, 14102, 10423, 5060, 2353, 15664, 13376, 10854, 14086, 10005, 16211, 8216, 5065, 5062, 6340, 7848, 10911, 9825, 8815, 9698, 13860, 7796, 15667, 3217, 8213, 7794, 7797, 6227, 13027, 13859, 13827, 13836, 9411, 2359, 379; Payload ID: 1245 relates to Category No.: 6227, 2351, 9943, 13700, 2355, 6253, 1893, 5300, 14663, 15661, 14102, 5447, 2347, 10423, 13027, 8941, 16155, 5060, 9827, 2353, 11559, 10609, 10918, 15662, 14086, 10005, 16211, 6215, 5065, 8472, 12700, 2439, 7309, 6137, 13924, 2435, 12178, 14013; Payload ID: 1246 relates to Category No.: 6227, 2351, 9943, 6253, 1867, 14663, 15661, 14102, 15427, 2347, 10423, 13027, 8941, 16155, 5060, 9827, 2353, 11559, 10609, 10918, 15664, 15662, 11316, 10911, 11603, 394, 10331, 15667; Payload ID: 1247 relates to Category No.: 6227, 14038, 12427, 2359, 2355, 6253, 14663, 1238, 6145, 2353, 14086, 10005, 16211, 10946, 10913, 16150, 6340, 6335, 10426, 5406, 11634, 2351, 10648, 14838, 6212, 14831, 4167, 8862, 6219, 12694, 6256, 860, 15665, 15661, 6250, 6249, 13925, 2136, 13970, 13799, 14004, 2101; Payload ID: 1248 relates to Category No.: 6219, 7288, 14267, 4439, 3316, 2866, 2867, 7286, 8297, 12646, 7292, 13856, 6256, 6253, 6249, 3021, 13827, 13796, 13837, 14054, 10331, 2009, 13973, 3308, 11047; Payload ID: 1249 relates to Category No.: 7288, 3316, 2866, 7286; Payload ID: 1250 relates to Category No.: 5446, 3021, 8818, 3316, 2866, 8773, 2512, 3308, 2154; Payload ID: 1251 relates to Category No.: 6814, 5446, 3021, 8773; Payload ID: 1252 relates to Category No.: 5446, 3021, 16197, 8818, 3316, 2866, 8773; Payload ID: 1253 relates to Category No.: 5446, 3021, 8773, 3308, 8620, 6814; Payload ID: 1254 relates to Category No.: 5446, 3021, 8818, 10491, 3316, 8819, 2866, 8773, 3308, 8620, 1087; Payload ID: 1255 relates to Category No.: 5446, 3021, 16197, 8818, 10491, 8819, 2866, 8773, 3308, 8620, 1087; Payload ID: 1256 relates to Category No.: 5446, 3021, 8819, 2866, 8773, 3308, 8620, 6814; Payload ID: 1257 relates to Category No.: 7288; Payload ID: 1258 relates to Category No.: 6227, 12427, 2355, 15664; Payload ID: 1259 relates to Category No.: 6219, 10331, 2351, 9943, 6253, 10423, 8216, 7974, 16150, 5065, 8218, 2438, 16152, 7796, 8456, 8814, 12700, 10055, 8562, 8223, 2355, 15664; Payload ID: 1260 relates to Category No.: 6219, 6227, 10331, 6212, 7710, 2351, 9943, 6253, 14663, 14102, 16155, 2353, 11559, 10609, 10918, 15662, 14086, 10005, 16211, 11190, 5062, 8218, 2438, 7796, 15667, 8814, 8562, 11603, 2439, 11195; Payload ID: 1261 relates to Category No.: 6227, 6253, 4828, 2351, 9943, 14663, 15661, 14102, 2353, 15664, 15662, 14086, 10005, 16211, 8216, 7974, 16150, 5065, 12612, 8218, 8815, 2438, 7794, 8814, 8562, 8223, 8776, 8070, 8229, 2355, 15665, 5428, 1984, 13827, 14040, 13966, 13981, 14027, 11558, 13843, 6256, 8428, 14006; Payload ID: 1262 relates to Category No.: 6219, 6227, 11365, 15662; Payload ID: 1263 relates to Category No.: 6219, 6227, 690, 1295, 4538, 15427, 13787, 13827, 13998, 7992, 8478, 8636, 496, 9737, 8519, 8224, 8324, 7846, 8637, 8687, 15626; Payload ID: 1264 relates to Category No.: 6227, 4828, 12427, 2940, 2351, 9943, 9052, 8373, 2355, 6253, 14663, 10273, 16202, 15661, 8112, 10501, 5788, 14102, 15149, 2370, 2347, 10423, 8941, 16155, 5060, 12522, 2350, 6250, 13236, 2353, 15664, 13998, 2264, 14086, 10005, 16211, 7924, 11113, 7659, 7793, 8374, 8255, 10978, 10910, 11223, 7792, 5065, 5062, 12612, 13228, 8476, 7657, 4108, 10422, 6306, 11944, 10406, 10925, 2438, 16152, 10178, 8215, 7870, 656, 9078, 12536, 11090, 8484, 11217, 8491, 7649, 13564, 7871, 10502, 11196, 11086, 8466, 8221, 10915, 12891, 13975, 1598, 1836, 16102, 13824, 6215, 6340, 6219, 860, 6249, 6498, 2359; Payload ID: 1265 relates to Category No.: 6219, 6227, 2355; Payload ID: 1266 relates to Category No.: 7598, 10069, 10918, 15664, 7924, 7923, 8632, 1238, 5825, 10280, 7983, 7657, 8348, 15666, 12875, 12543, 496, 9411, 1238, 14027, 11559, 8573; Payload ID: 1267 relates to Category No.: 6227, 1730, 6253, 13882, 690, 3705, 12809; Payload ID: 1268 relates to Category No.: 6227, 12427, 5446, 2329, 2888, 2355, 6253, 5954; Payload ID: 1269 relates to Category No.: 6219, 6227, 7306, 381, 2355, 6253, 6626; Payload ID: 1270 relates to Category No.: 6227, 14565, 5428, 10775, 6253; Payload ID: 1271 relates to Category No.: 6219, 6227, 6253; Payload ID: 1272 relates to Category No.: 6227, 6253; Payload ID: 1273 relates to Category No.: 6227, 6253; Payload ID: 1274 relates to Category No.: 2351, 14102, 5060, 2353, 14086, 10005, 16211, 5065, 5062, 8472; Payload ID: 1275 relates to Category No.: 6227, 2768; Payload ID: 1277 relates to Category No.: 11322, 10470, 5806, 11387; Payload ID: 1278 relates to Category No.: 11512, 7613, 1955, 10238, 803, 8988, 8554, 8668; Payload ID: 1279 relates to Category No.: 9228, 5809, 13904; Payload ID: 1280 relates to Category No.: 795, 7613, 7984; Payload ID: 1281 relates to Category No.: 12153, 12154, 795, 7613; Payload ID: 1282 relates to Category No.: 795, 7613; Payload ID: 1283 relates to Category No.: 12091, 11858, 795, 9717, 1295, 8923, 7636, 12361, 9720; Payload ID: 1284 relates to Category No.: 9500, 1790, 334, 795, 8929, 10238, 792, 3305, 7088, 5810, 2422, 8923, 10356, 12497, 13909, 14025, 2001, 11089, 13919, 2085, 1964, 2070, 1899; Payload ID: 1285 relates to Category No.: 9500, 10238, 793; Payload ID: 1286 relates to Category No.: 9500, 1790, 3974; Payload ID: 1287 relates to Category No.: 1737, 14661, 2167, 1955, 3354, 7154, 9274, 7132, 13743, 13729, 11298, 5750; Payload ID: 1288 relates to Category No.: 7288, 795, 10238, 3854, 14271, 11765, 1844, 8335, 16182, 7131, 10491, 791, 11038; Payload ID: 1289 relates to Category No.: 8862, 334, 795, 10238, 12498, 803, 11765, 5806, 335, 13855, 8887, 10241, 4251, 7306, 1295, 8923, 5810, 12497, 11940, 2131, 13882, 496, 13966, 1730, 4473, 1554; Payload ID: 1290 relates to Category No.: 9228, 1955, 3100, 3448, 14590, 13376, 13877, 10139, 3354, 3333; Payload ID: 1291 relates to Category No.: 9228, 1955, 3448, 14590, 10518, 13046, 4828; Payload ID: 1292 relates to Category No.: 15618, 11674, 15626, 1649, 2139, 7613, 643, 11676, 2164, 1181, 1925, 4636, 7840, 1797, 14663, 2259, 2121, 13827, 16274, 1520, 2051, 2110, 2006, 10626, 13724, 10226, 1857, 1939, 2001, 9057, 9320, 2070, 9561, 1856, 2111, 13725, 1522, 645, 6080, 3922, 2254, 15541, 11350, 7316, 2008, 2053, 1951, 6510, 16294, 10366, 14404, 14413, 14454, 1464, 4494, 16272, 6213, 13723, 2728, 6840, 6870, 6869, 6853, 13874, 13836, 10573, 5328, 5327, 10889; Payload ID: 1293 relates to Category No.: 15618, 15626, 5846, 2164, 15996, 4636, 14025, 16274; Payload ID: 1294 relates to Category No.: 15618, 15626, 16274, 11940; Payload ID: 1295 relates to Category No.: 15626; Payload ID: 1296 relates to Category No.: 15626; Payload ID: 1297 relates to Category No.: 15626, 5846, 2164, 4636, 15618, 16274, 3973, 13724, 1939, 2053, 6834, 13725, 2152; Payload ID: 1298 relates to Category No.: 15618, 15626, 5846, 2164, 15996, 16274, 3973, 14000, 14045, 13724, 13796, 13052, 9320, 10782, 4636, 13723, 15998; Payload ID: 1299 relates to Category No.: 15618, 15626, 5846, 2164, 4636, 2013, 16274, 13724, 7316; Payload ID: 1300 relates to Category No.: 15618, 15626, 5846, 2164, 4636, 16274, 3973, 9320, 9561, 1522, 14357, 1464; Payload ID: 1301 relates to Category No.: 15626, 2164, 4636, 15618, 708, 16274, 3973, 9320, 9046; Payload ID: 1302 relates to Category No.: 15626, 5846, 2164, 15996, 15618, 4636, 16274, 4448, 3973; Payload ID: 1303 relates to Category No.: 15626, 5846, 2164, 4636, 15618, 1925, 16274, 13998; Payload ID: 1304 relates to Category No.: 15626, 5846, 2164, 15996, 4636, 6814, 15618, 5367, 1925, 16274, 13970, 12244, 12305, 12322, 3973, 13973, 10146, 619, 16272, 13938, 1535, 1479; Payload ID: 1305 relates to Category No.: 9296, 3354, 7291, 16182, 15533; Payload ID: 1306 relates to Category No.: 9500, 7613, 10372, 10366, 14663, 815, 10362, 10343, 7252, 3913, 6263, 5026, 12397, 10226, 6203, 15110, 8477, 6262, 6260, 8340, 4112, 5027, 6150, 6261, 496, 10238, 11391, 10648, 10470, 10356, 2039, 11602, 10557, 10556, 11013; Payload ID: 1307 relates to Category No.: 9500, 14865, 10648, 14663, 11995, 2206, 815, 10955, 3913, 6263, 5026, 6203, 11050; Payload ID: 1308 relates to Category No.: 9500, 5428, 14663, 1272, 10192, 10383, 13831, 9451, 815, 16294, 10583, 6263, 5026, 1922, 6154, 790, 7579, 9835, 13296, 2016, 12814, 6260, 10726; Payload ID: 1309 relates to Category No.: 6219, 9500, 795, 7743, 7737, 14663, 7724, 815, 10946, 6263, 11821, 12821, 8042, 5026, 10416, 10881, 11181, 6203; Payload ID: 1310 relates to Category No.: 9500, 6153, 14663, 815, 6263, 6154, 6262, 5428, 6155, 13966, 11601, 14454, 13881, 379; Payload ID: 1311 relates to Category No.: 10331, 6153, 14663, 815, 6263, 1922, 6154, 6262, 11942, 6155, 9500, 10203; Payload ID: 1312 relates to Category No.: 9500, 14454, 14865, 4094, 2206, 815, 3913, 6263, 5026, 9764, 6203; Payload ID: 1313 relates to Category No.: 12091, 1026, 14661, 5785, 14565, 7613, 1894, 5446, 6606, 348, 4186, 12391, 4127, 3775, 5541, 16085, 8988, 11174, 13588, 13338; Payload ID: 1314 relates to Category No.: 1925, 14663, 1878, 2469, 5416, 9148, 6715, 13969, 13888, 13796, 13815, 14054, 13991, 13818, 13797, 13921, 13813, 9991; Payload ID: 1315 relates to Category No.: 12194; Payload ID: 1316 relates to Category No.: 12194; Payload ID: 1317 relates to Category No.: 15626, 5782, 14098, 4771, 6738, 2662, 12137, 483, 10025, 4785, 2231; Payload ID: 1318 relates to Category No.: 12137, 10702; Payload ID: 1319 relates to Category No.: 10702, 2068, 12020; Payload ID: 1320 relates to Category No.: 10702; Payload ID: 1321 relates to Category No.: 10702, 1795, 12942; Payload ID: 1322 relates to Category No.: 10702, 4949; Payload ID: 1323 relates to Category No.: 10702, 7306, 7280, 264, 14836, 5732; Payload ID: 1324 relates to Category No.: 10702, 1204; Payload ID: 1325 relates to Category No.: 14661, 12137, 14565, 10702; Payload ID: 1326 relates to Category No.: 1026, 14661, 12137, 14565, 10702, 8373, 8508, 11512, 7613, 10877, 6553, 10953, 360, 11187, 7966; Payload ID: 1327 relates to Category No.: 14661, 14565, 10702, 12137, 11949, 15606, 11843; Payload ID: 1328 relates to Category No.: 10702; Payload ID: 1329 relates to Category No.: 10702; Payload ID: 1330 relates to Category No.: 10702; Payload ID: 1331 relates to Category No.: 10702; Payload ID: 1332 relates to Category No.: 14661, 14565, 10702, 12648, 13485, 10628, 8661, 289, 12655, 11315; Payload ID: 1333 relates to Category No.: 14661, 14565, 10702, 13485; Payload ID: 1334 relates to Category No.: 14565, 10702, 14661, 12648, 16172, 2940, 13485, 7737, 8584, 8551; Payload ID: 1335 relates to Category No.: 10702, 2460, 9420, 7870; Payload ID: 1336 relates to Category No.: 10331, 10702; Payload ID: 1337 relates to Category No.: 10702, 1752, 13515; Payload ID: 1338 relates to Category No.: 10702, 16172, 12502, 8454; Payload ID: 1339 relates to Category No.: 10129, 14663, 1878, 15993, 825, 830, 14046, 13925, 14050, 2041, 2131, 496, 13827, 2001, 14040, 6269, 13794, 13773, 13870, 14054, 4145, 6626, 13981, 14011, 13944, 13934, 13772, 1951, 6375, 11942, 13787, 14004, 10558, 1981, 13061, 827, 2020, 6566, 2568; Payload ID: 1340 relates to Category No.: 10129, 9048, 14663, 1878, 15993, 830, 16005, 15012; Payload ID: 1341 relates to Category No.: 13589, 3398, 15490, 3398; Payload ID: 1342 relates to Category No.: 15618, 14565, 7613, 1816, 7840, 16099, 10648, 14767, 16274, 2469, 11174, 3846, 4448, 13724, 8567, 11986, 10309, 13969, 10372, 13837, 10486, 11601, 9611, 13961, 10362, 6296, 11230, 5328, 14022, 7316, 8770, 14729, 10674, 10391, 11444, 13412, 6623, 4855, 6624, 7979; Payload ID: 1343 relates to Category No.: 4828, 2000, 13980, 11601, 13550, 6624, 4448, 355, 1237, 10372, 13886, 13815, 13970, 1451, 10486, 11325, 9611, 10362, 11230, 10282, 8770, 14729, 10710, 2152, 15247, 10674, 10391, 11444, 7417, 6623, 4855, 14822, 7979; Payload ID: 1344 relates to Category No.: 4828, 2000, 13980, 11601, 13550, 10486, 355; Payload ID: 1345 relates to Category No.: 2000, 13980, 11601, 13550, 4828, 15618, 442, 328, 10648, 11298, 16274, 3973, 13724, 4999, 13818, 5606, 5359, 10372, 8571, 10282, 15247, 11444, 8802; Payload ID: 1346 relates to Category No.: 1721, 345; Payload ID: 1347 relates to Category No.: 7291, 16182, 9238, 14271, 12091, 601, 16182, 13779; Payload ID: 1350 relates to Category No.: 13589, 3398, 15490, 3398; Payload ID: 1351 relates to Category No.: 13589, 3398, 15490, 3398, 9075, 8739, 11512, 2235, 2411, 3041, 12372, 2231, 2223, 1319; Payload ID: 1352 relates to Category No.: 10129, 12133, 14663, 1878, 15993, 823, 824, 5741, 825; Payload ID: 1353 relates to Category No.: 10129, 14663, 1878, 15993, 823, 11111, 2029, 2486, 888, 836, 8207, 13835, 13925, 13859, 2041, 2136, 14025, 496, 13827, 6269, 13966, 13866, 13773, 5949, 14054, 1907, 381, 13981, 14011, 7002, 2013, 13772, 1951, 13843, 1925, 1906, 1981, 13957, 1904, 2078, 3228; Payload ID: 1354 relates to Category No.: 12194, 6153, 7658, 9631; Payload ID: 1355 relates to Category No.: 12194, 6153, 9631; Payload ID: 1356 relates to Category No.: 11856; Payload ID: 1357 relates to Category No.: 4439, 15698, 839; Payload ID: 1358 relates to Category No.: 4439, 7108, 15698, 839; Payload ID: 1359 relates to Category No.: 15490, 3398, 11512, 5446, 14270, 4186, 9891, 4127, 9125, 3775, 9223, 4439, 8988, 11697, 7012, 4442, 11754, 8763, 11657, 10648, 7013; Payload ID: 1360 relates to Category No.: 15588, 14216, 3656, 15490, 3398, 11512, 8765, 5446, 14270, 15603, 4186, 9891, 4127, 9125, 3775, 4439, 8988, 11130, 11129, 3001, 11697, 14610, 7012, 4442, 11754, 8763, 11657, 7276, 7277, 11634, 10648, 7013; Payload ID: 1361 relates to Category No.: 15603, 5446, 14270, 4186, 9891, 4127, 9125, 3775, 4439, 8988, 11697, 7270, 7012, 4442, 11754, 13510, 8763, 11657; Payload ID: 1362 relates to Category No.: 5446, 14270, 4186, 9891, 4127, 9125, 3775, 4439, 8988, 11697, 7270, 7012, 4442, 11754, 8763, 11657; Payload ID: 1363 relates to Category No.: 14565; Payload ID: 1365 relates to Category No.: 15898, 12154, 12153, 2885, 11237, 12096; Payload ID: 1366 relates to Category No.: 12153, 12154, 11237, 7306, 12096, 11969, 4974, 11967, 11294, 3193, 15898; Payload ID: 1367 relates to Category No.: 13589, 3398, 15490, 3398, 8739, 12646, 8934, 1026, 10648, 2247, 4251, 1782, 9333, 3794, 11143, 2252, 3601, 4489, 6213; Payload ID: 1368 relates to Category No.: 14661; Payload ID: 1369 relates to Category No.: 6819; Payload ID: 1370 relates to Category No.: 12936; Payload ID: 1374 relates to Category No.: 2461, 3176, 9475, 12715, 4949, 16138; Payload ID: 1376 relates to Category No.: 4969; Payload ID: 1382 relates to Category No.: 11512, 1892; Payload ID: 1386 relates to Category No.: 1703, 7306, 14589, 1432; Payload ID: 1387 relates to Category No.: 16172, 9420, 7132, 4336, 743; Payload ID: 1388 relates to Category No.: 743; Payload ID: 1389 relates to Category No.: 1026, 14661, 3766, 5446, 849, 2459, 4130, 7252, 274, 3924, 912, 6673, 6677, 6670, 14900, 2924; Payload ID: 1390 relates to Category No.: 1026, 14661, 3766, 5446, 2460, 849, 4130, 7252, 3924, 912, 6673, 6677, 6670, 14900; Payload ID: 1391 relates to Category No.: 849, 1204; Payload ID: 1392 relates to Category No.: 849, 1204; Payload ID: 1393 relates to Category No.: 13589, 3398, 15490, 3398, 3353, 3448, 16050; Payload ID: 1394 relates to Category No.: 13589, 3398, 2411, 3354; Payload ID: 1395 relates to Category No.: 1737, 13589, 3398, 15490, 3398, 2411, 3354, 7154, 3353; Payload ID: 1396 relates to Category No.: 849, 287, 1894; Payload ID: 1397 relates to Category No.: 14565, 3639, 13371, 16214; Payload ID: 1399 relates to Category No.: 14565; Payload ID: 1400 relates to Category No.: 11588, 14643, 15273, 8059, 8338, 4095, 10212, 8226; Payload ID: 1401 relates to Category No.: 11588; Payload ID: 1403 relates to Category No.: 12137, 11843, 11512, 10702, 12153, 10074, 15517, 9125, 11285, 6738, 8390, 1238, 11313, 11646, 10583, 8159, 8547, 10735, 11339, 4826, 8163, 15000, 10751, 11174, 11242, 12931, 7840, 10802, 10005, 4828, 3639, 10470, 8535, 345, 11298, 13780, 4243, 7946, 8049, 11387, 14565; Payload ID: 1404 relates to Category No.: 12137, 11843, 1713, 12153, 10074, 15517, 9125, 8390, 11298, 1238, 15570, 11313, 10583, 8361, 8547, 12409, 4826, 3112, 12487, 14565, 12931, 484, 13371, 11266, 8159, 8782, 8141, 11436, 3436, 8726, 8133, 4828, 1295, 3639, 8632, 10514, 11285, 11178, 10301, 7840, 4243, 11174, 8049, 3161, 8567; Payload ID: 1405 relates to Category No.: 15626, 3684, 11953, 1893, 5855, 5468, 6814; Payload ID: 1406 relates to Category No.: 16308, 6902, 14663, 15470, 856; Payload ID: 1407 relates to Category No.: 1026, 14565, 8898, 9738, 5424, 9770, 6416; Payload ID: 1408 relates to Category No.: 14865, 14982, 5787, 13318, 14663, 2347, 1189, 12699; Payload ID: 1409 relates to Category No.: 13594, 13589, 3398, 11512, 16308, 795, 1721, 8731, 3398, 2467, 15517, 11506, 3398, 5783, 12891, 14051, 14025, 1240, 12531, 8739, 11344, 11821, 13739, 4468, 13835, 13969, 1982, 9485; Payload ID: 1410 relates to Category No.: 11926, 14565, 12127, 12051, 13259, 16308, 13359, 7832; Payload ID: 1411 relates to Category No.: 11926, 16214, 11923, 7613, 10005, 16211, 12686, 14057; Payload ID: 1412 relates to Category No.: 13589, 3398, 15490, 3398, 11506, 3398, 13882, 10558, 10682, 2006, 13597, 10586, 11595, 11596, 13599, 7294, 10761, 1730, 11512, 11292, 5783, 3605; Payload ID: 1413 relates to Category No.: 13589, 3398, 15490, 3398, 11843, 11512, 12619, 8731, 3398, 2467, 11506, 3398, 8728, 14838, 10314, 13225, 13004, 7971, 2469, 12944, 10441, 13999, 9511, 13637, 8018, 12676, 11377, 11949, 15606, 13343, 6627; Payload ID: 1414 relates to Category No.: 13594, 13589, 3398, 15490, 3398, 11512, 11506, 3398, 2469, 10441, 3742; Payload ID: 1415 relates to Category No.: 6814, 16308, 14663, 11559; Payload ID: 1416 relates to Category No.: 6814; Payload ID: 1417 relates to Category No.: 6814; Payload ID: 1418 relates to Category No.: 6814; Payload ID: 1419 relates to Category No.: 6814, 15750, 14663, 1878, 15752, 2993; Payload ID: 1420 relates to Category No.: 13589, 3398, 1295, 11506, 3398, 2169, 13882, 5406, 15517, 11512, 13835, 7613, 10372, 15490, 3398; Payload ID: 1421 relates to Category No.: 13589, 3398, 15490, 3398, 8739, 14051; Payload ID: 1422 relates to Category No.: 6814, 1202, 13836, 13966, 13837, 13944, 1002, 2169, 13983, 14865, 1893, 14663, 11660, 4729; Payload ID: 1423 relates to Category No.: 6814, 1512, 14865, 1893, 14663, 6445, 11660, 4723, 2385, 2384, 6442, 11094, 4729, 12823, 2596, 13836, 13966, 13944, 1002, 2169, 13983; Payload ID: 1424 relates to Category No.: 6814, 14865, 1893, 14663, 11660, 4729; Payload ID: 1425 relates to Category No.: 6814, 14640, 14865, 1893, 14663, 11660, 4729; Payload ID: 1426 relates to Category No.: 6814, 14865, 1893, 14663, 11660, 4729; Payload ID: 1427 relates to Category No.: 6814, 14865, 1893, 14663, 11660, 4729; Payload ID: 1428 relates to Category No.: 6814, 14865, 1893, 14663, 11660, 4729; Payload ID: 1429 relates to Category No.: 6814, 14865, 1893, 14663, 11660, 4729; Payload ID: 1430 relates to Category No.: 6814, 14865, 1893, 14663, 11660, 4729; Payload ID: 1431 relates to Category No.: 6814, 14865, 1893, 14663, 11660, 15090, 4729; Payload ID: 1432 relates to Category No.: 1816, 15517, 3345, 5153, 11512, 5159, 8103, 8112, 8256, 7576, 5706; Payload ID: 1433 relates to Category No.: 13589, 3398, 15490, 3398, 4998, 10372, 1955, 15517, 5159, 2410, 13836, 11512; Payload ID: 1434 relates to Category No.: 1968, 12427; Payload ID: 1435 relates to Category No.: 12427, 1795, 6215, 13376, 4715, 1272; Payload ID: 1436 relates to Category No.: 6212, 1830; Payload ID: 1437 relates to Category No.: 12194, 14663, 1878, 6343, 876, 6814; Payload ID: 1438 relates to Category No.: 7613, 3684, 1983, 4595, 1893, 14663, 1878, 875, 11027, 1828, 9746, 6054, 13967, 13936, 14025, 6269, 13773, 1830, 13921, 2000, 13850, 13942; Payload ID: 1439 relates to Category No.: 875, 4595, 1204; Payload ID: 1440 relates to Category No.: 4439, 15698, 881; Payload ID: 1441 relates to Category No.: 4439, 15698, 881; Payload ID: 1442 relates to Category No.: 15618, 9500, 5846, 1415, 11506, 3398, 13785, 7340, 363, 12596, 9659, 3121, 12617, 13409, 10861, 11300, 1922, 10302, 13450, 11349, 13001, 333, 9599, 7743, 9540, 13376, 6194, 9665, 4067, 13349; Payload ID: 1443 relates to Category No.: 9659, 9500; Payload ID: 1444 relates to Category No.: 9500, 9659; Payload ID: 1445 relates to Category No.: 9500, 7474, 7512, 12288; Payload ID: 1447 relates to Category No.: 12194, 12099, 14643; Payload ID: 1448 relates to Category No.: 6814, 14663, 1878, 1828, 886; Payload ID: 1449 relates to Category No.: 12194, 9640; Payload ID: 1450 relates to Category No.: 12194, 11903, 12049, 6814; Payload ID: 1451 relates to Category No.: 15588, 11884, 4439, 15698, 898; Payload ID: 1452 relates to Category No.: 4439, 15698, 15696, 7026; Payload ID: 1453 relates to Category No.: 8756, 1272, 8727; Payload ID: 1454 relates to Category No.: 12194, 1703, 4167, 7654, 11288, 11726; Payload ID: 1455 relates to Category No.: 9228, 3354; Payload ID: 1456 relates to Category No.: 8934, 14589, 1752, 6296, 8924; Payload ID: 1457 relates to Category No.: 8526; Payload ID: 1458 relates to Category No.: 1737, 13166, 7154, 7168, 14831, 2197, 12872, 12033; Payload ID: 1459 relates to Category No.: 14661, 12137, 2886, 7132, 7295, 9201, 13589, 3398; Payload ID: 1461 relates to Category No.: 13594, 15490, 3398, 2411, 687, 11506, 3398, 4518, 5773, 9276, 9277, 2416, 8739, 8887, 2410, 4251, 1557, 952, 15471, 1545, 9393, 6489, 10035; Payload ID: 1462 relates to Category No.: 8862, 15490, 3398, 2411, 2416; Payload ID: 1463 relates to Category No.: 13589, 3398, 15490, 3398, 2409, 9276; Payload ID: 1464 relates to Category No.: 13589, 3398, 15517, 11512; Payload ID: 1465 relates to Category No.: 1204, 15517, 11512; Payload ID: 1466 relates to Category No.: 15490, 3398, 11512; Payload ID: 1467 relates to Category No.: 13594, 8731, 3398, 15517, 2410, 11512, 12892, 14838, 5160, 5188, 5168, 3912, 3853; Payload ID: 1468 relates to Category No.: 13594, 15490, 3398, 2410, 1204, 4439, 12891, 3783, 8004, 3783, 11512, 12892, 14838, 5188, 5168, 3912; Payload ID: 1469 relates to Category No.: 13594, 15490, 3398, 8731, 3398, 11512, 10735, 2376; Payload ID: 1470 relates to Category No.: 15490, 3398, 8739, 8731, 3398, 2410, 455, 11363, 6269, 7303, 5949, 11634, 472, 6530, 4194, 10093, 1729, 9540, 14641, 4094, 4138, 4067, 7346, 9068, 4095; Payload ID: 1471 relates to Category No.: 795, 15626, 8936, 13363, 7119, 8028; Payload ID: 1472 relates to Category No.: 15490, 3398, 8731, 3398, 14267, 9169, 8739, 11512, 16213, 483, 3971, 6371, 10652, 8468, 8120; Payload ID: 1473 relates to Category No.: 8862, 8936, 2459, 11942; Payload ID: 1474 relates to Category No.: 15490, 3398, 8739, 4021, 6371, 10718; Payload ID: 1475 relates to Category No.: 12744, 13618, 2904, 15001, 14211, 8559, 14275, 2228, 8940, 5242, 8337, 8919; Payload ID: 1476 relates to Category No.: 15001, 12744; Payload ID: 1477 relates to Category No.: 8862, 15898, 13589, 3398, 15490, 3398, 11843, 11915, 9296, 15149, 6969, 274, 7016, 1995, 11968, 5731, 7230, 12653, 11966, 10580, 12015, 2060, 12194; Payload ID: 1478 relates to Category No.: 13589, 3398, 15490, 3398, 11915, 11843, 15898, 7230, 1995, 4004, 7016, 2060, 5147, 12194; Payload ID: 1479 relates to Category No.: 15490, 3398, 6969, 16214, 5127, 2410, 9308, 13594, 11512, 8468, 8120; Payload ID: 1482 relates to Category No.: 15490, 3398, 11506, 3398, 5127, 2410; Payload ID: 1484 relates to Category No.: 1512, 15639, 6814; Payload ID: 1485 relates to Category No.: 11512, 15517; Payload ID: 1486 relates to Category No.: 6814, 11940, 3676, 1048; Payload ID: 1487 relates to Category No.: 6814, 11940, 3676, 4766; Payload ID: 1488 relates to Category No.: 6814, 11940, 3676, 4766; Payload ID: 1489 relates to Category No.: 15490, 3398, 1955, 11506, 3398, 2460; Payload ID: 1490 relates to Category No.: 12091, 3452, 14565, 1722, 9883, 1955, 10238, 9713, 3354, 12431, 3448, 3313, 14567, 3453, 7163, 11858, 7644, 1995, 13904, 13734, 3310, 5219, 3455, 12671, 10516, 14566, 1978, 9709, 11689, 14576, 5808, 14793, 4949, 4134, 1295, 6696, 8923, 3309, 11089, 3167, 9375, 16051, 6250, 13882, 12619, 795, 11090, 10756; Payload ID: 1491 relates to Category No.: 11091, 2169, 15517, 2243, 1730, 11512, 8934, 1026, 7613, 5459, 13229, 8929, 986, 1295, 9125, 5458, 988, 989, 10253, 10795; Payload ID: 1492 relates to Category No.: 13589, 3398, 15490, 3398, 1730, 8886, 9396, 2469, 3742; Payload ID: 1493 relates to Category No.: 8862, 15490, 3398, 1730, 8731, 3398, 14656, 11506, 3398, 7924, 10557, 15762, 7388, 10556, 4277; Payload ID: 1494 relates to Category No.: 6814, 15660, 6211, 6310, 1867, 14663, 2554, 3728, 10390, 226, 2481, 6219, 235, 4104; Payload ID: 1495 relates to Category No.: 11884, 7080; Payload ID: 1496 relates to Category No.: 12201; Payload ID: 1497 relates to Category No.: 6219, 12197, 934, 13755, 931, 3564, 1874, 14663, 932, 7924, 927, 7028; Payload ID: 1498 relates to Category No.: 12197, 931, 932, 934, 690, 13755, 13031, 1874, 9420, 14663, 7122, 4448, 9455, 927, 7028, 6219, 7720; Payload ID: 1499 relates to Category No.: 934, 13755, 1874, 14663, 9506, 927, 7028, 13813; Payload ID: 1500 relates to Category No.: 934, 13755, 1874, 14663, 7028; Payload ID: 1501 relates to Category No.: 934; Payload ID: 1502 relates to Category No.: 934, 13755, 1874, 14663, 9506, 927, 7028; Payload ID: 1503 relates to Category No.: 934, 12197, 13755, 1874, 14663, 927, 7028; Payload ID: 1504 relates to Category No.: 934, 13755, 1874, 14663, 15042, 7028; Payload ID: 1505 relates to Category No.: 13755, 931, 1874, 14663, 7028, 934; Payload ID: 1506 relates to Category No.: 13755, 931, 1874, 14663, 7028; Payload ID: 1507 relates to Category No.: 13755, 931, 1874, 14663, 7028, 496, 13837; Payload ID: 1508 relates to Category No.: 934, 13755, 1874, 14663, 7028; Payload ID: 1509 relates to Category No.: 934, 13755, 1874, 14663, 7028, 932; Payload ID: 1510 relates to Category No.: 12197, 13755, 1874, 14663, 7028, 932; Payload ID: 1511 relates to Category No.: 934, 13755, 1874, 14663, 15042, 7028, 932; Payload ID: 1512 relates to Category No.: 934, 13755, 1874, 14663, 7028; Payload ID: 1513 relates to Category No.: 934; Payload ID: 1514 relates to Category No.: 12197, 13755, 1874, 14663, 7028; Payload ID: 1515 relates to Category No.: 12194, 7122, 8919, 9333, 4060, 2228, 2774, 12116, 2235, 14056, 484, 2229, 8973; Payload ID: 1516 relates to Category No.: 12194, 2774, 12116; Payload ID: 1517 relates to Category No.: 12194, 12116; Payload ID: 1518 relates to Category No.: 12194, 12116; Payload ID: 1519 relates to Category No.: 12194, 2774, 12116; Payload ID: 1520 relates to Category No.: 12194, 11900, 11866; Payload ID: 1523 relates to Category No.: 15618, 12197; Payload ID: 1524 relates to Category No.: 6814, 2902, 11313, 8672, 4588, 6102, 6758; Payload ID: 1525 relates to Category No.: 11512, 7803, 15490, 3398, 11506, 3398; Payload ID: 1526 relates to Category No.: 11512, 7803; Payload ID: 1527 relates to Category No.: 7613, 1746; Payload ID: 1530 relates to Category No.: 1955; Payload ID: 1531 relates to Category No.: 690, 11940, 3854, 8409, 4977, 11941, 13379, 7131, 7924, 4448, 7035, 7631, 11301, 8099, 12509, 12397, 11022, 7710; Payload ID: 1532 relates to Category No.: 6814, 15618, 1649, 5846, 1651, 1836, 1204; Payload ID: 1533 relates to Category No.: 6814, 15618, 1649, 5846, 1651, 1836, 2050; Payload ID: 1534 relates to Category No.: 6814, 1649, 1651, 1836; Payload ID: 1535 relates to Category No.: 6814, 15618, 1649, 5846, 1836, 1651; Payload ID: 1536 relates to Category No.: 6814, 15618, 1649, 5846, 1651, 1836; Payload ID: 1537 relates to Category No.: 6814, 9949, 15618, 1649, 5846, 9950, 6102, 10366, 11198; Payload ID: 1538 relates to Category No.:

6814, 9949, 9950, 7743, 8928, 14643, 5459, 11051, 1048, 11094, 3140, 496, 8921, 11198, 14058, 3529, 8905, 5831, 13786, 8936; Payload ID: 1539 relates to Category No.: 15618, 9949, 5846, 9950, 8731, 3398, 1184, 4766, 3475, 13150, 5460, 14456, 1189, 16178; Payload ID: 1540 relates to Category No.: 6814, 15618, 9949, 5846, 4766, 9950; Payload ID: 1541 relates to Category No.: 6814, 9949, 9950, 4766, 1202; Payload ID: 1542 relates to Category No.: 6814, 15618, 5846, 1415, 1409, 1417, 1238, 13831, 13518, 793, 5810, 10604, 10546, 7913, 8665, 11012, 6499, 13688; Payload ID: 1543 relates to Category No.: 6814, 15618, 1703, 5846, 1415, 1417, 3781, 1836, 1238, 13831, 12592, 14369, 10546, 3667, 10710, 13686, 12595, 12590, 1418, 1412, 15759, 2083, 9420, 13571, 15581, 8054, 3849, 12576, 13981; Payload ID: 1544 relates to Category No.: 6814, 15618, 15626, 1649, 5846, 1415, 1836, 1238, 1295, 13812, 496, 2149, 8886, 1406, 1943; Payload ID: 1545 relates to Category No.: 15618, 15626, 14456, 5846, 8929, 1415, 1417, 2945, 1238, 6814, 2235, 2228, 15143, 5459, 1836, 8920, 13530, 6296, 5998, 12649, 5458, 3147, 1764, 9420, 991, 10301, 2261, 2222, 14509, 2547, 6293, 5461, 2232, 9469; Payload ID: 1546 relates to Category No.: 6814, 15618, 15626, 1649, 5846, 1415, 1836, 1238; Payload ID: 1547 relates to Category No.: 13594, 6814, 15618, 5846, 1415, 1836, 1238, 11174, 7673, 8392, 8394, 8393, 8443, 1961, 13879, 1413, 1410, 8701, 7622, 7586, 13495, 12622, 7704, 7812, 10312, 14838, 5073, 1417, 8886, 1406; Payload ID: 1548 relates to Category No.: 6814, 1415, 1417, 15618, 14565, 5846, 3781, 275, 1836, 10775, 1432, 6577, 6575, 1873, 4756, 4757; Payload ID: 1549 relates to Category No.: 6814, 15618, 5846, 1415, 1417, 1836, 6575, 10298, 12129, 6563; Payload ID: 1550 relates to Category No.: 6814, 15618, 15626, 5846, 1415, 1417, 1836, 1238; Payload ID: 1551 relates to Category No.: 9949, 4766, 6814, 9950; Payload ID: 1552 relates to Category No.: 6814, 9949, 3639, 9950, 14098, 4771; Payload ID: 1553 relates to Category No.: 9949, 3639, 14098, 4771, 6814, 9950, 3904; Payload ID: 1554 relates to Category No.: 6814, 15618, 9949, 5782, 12648, 5846, 9950; Payload ID: 1555 relates to Category No.: 6814, 9949, 5782, 9950; Payload ID: 1556 relates to Category No.: 6814, 15618, 9949, 5782, 5846, 9950, 1651; Payload ID: 1557 relates to Category No.: 6814, 9949, 9950; Payload ID: 1558 relates to Category No.: 6814, 15618, 9949, 5846, 9950, 5848, 638; Payload ID: 1559 relates to Category No.: 6814, 9949, 9950, 15618, 5846, 10265, 11690; Payload ID: 1560 relates to Category No.: 10331, 15618, 6819, 5846, 6296, 1651, 13700, 8940, 4021, 2176, 8290, 2675, 7122, 2679, 1640, 1250, 2571, 13998, 4939, 1240, 10025, 6371, 1847, 1622, 3428, 11161, 14643, 14509, 12285, 3550, 10991, 15336, 2673, 2228, 9692, 13282, 15753, 3181, 3786, 9111, 3551, 12891, 932, 3041, 8373, 13692, 15835, 9110, 14054, 5998, 13813, 10057, 5406, 13908; Payload ID: 1561 relates to Category No.: 6814, 15618, 6819, 5846, 1651, 2675, 2679, 14478, 1847, 13813, 2673, 2165, 5998, 2677, 5769, 14054, 13797, 2469, 1649; Payload ID: 1562 relates to Category No.: 15618, 12197, 931, 6814, 5846, 1746, 1862, 5541, 16055, 15547, 9783; Payload ID: 1563 relates to Category No.: 15618, 12197, 5846, 1862, 5541, 15547, 9783, 5297; Payload ID: 1564 relates to Category No.: 15618, 12197, 5846, 1862, 5541, 15547, 9783; Payload ID: 1565 relates to Category No.: 15618, 12197, 5846, 1862, 5541, 15547, 9783; Payload ID: 1566 relates to Category No.: 15618, 12197, 5846, 1862, 931, 5541, 15547, 9783; Payload ID: 1567 relates to Category No.: 15618, 12197, 5846, 1862, 931, 16197, 5541, 15547, 11620, 9783, 6438; Payload ID: 1568 relates to Category No.: 931, 15618, 12197, 5846, 1862, 5541, 16055, 15547, 9783; Payload ID: 1569 relates to Category No.: 6814, 15618, 12197, 5846, 1862, 931, 5541, 15547, 9783; Payload ID: 1570 relates to Category No.: 6814, 15618, 5846, 1862, 931, 5541, 15547, 9783; Payload ID: 1571 relates to Category No.: 15618, 12197, 5846, 1862, 2459, 12013, 5541, 15547, 9783; Payload ID: 1572 relates to Category No.: 15618, 12197, 5846, 3684, 1862, 2459, 931, 1893, 5541, 15547, 5855, 9783, 1295; Payload ID: 1573 relates to Category No.: 931, 15618, 5846, 1862, 5541, 15547, 9783; Payload ID: 1574 relates to Category No.: 931, 15618, 12197, 5846, 1862, 5541, 15547, 9783; Payload ID: 1575 relates to Category No.: 15618, 5846, 1862, 931, 5541, 15547, 11620, 9783; Payload ID: 1576 relates to Category No.: 15618, 5846, 3639, 12603, 1862, 931, 16197, 5541, 16055, 15547, 9783, 12750; Payload ID: 1577 relates to Category No.: 15618, 12197, 14456, 5846, 1862, 13298, 931, 5541, 932, 9451, 1408, 15547, 3973, 9783, 5459, 9772; Payload ID: 1578 relates to Category No.: 15618, 12197, 5846, 1862, 931, 5541, 932, 15547, 9783; Payload ID: 1579 relates to Category No.: 15618, 15626, 12197, 5846, 1862, 931, 5541, 932, 15547, 9783; Payload ID: 1580 relates to Category No.: 6814, 15618, 12197, 5846, 1746, 1862, 931, 5541, 16055, 15547, 9783; Payload ID: 1581 relates to Category No.: 15618, 12197, 5846, 1862, 931, 5541, 15547, 10583, 10593, 11147, 10289, 9772, 3895, 11149; Payload ID: 1582 relates to Category No.: 931; Payload ID: 1583 relates to Category No.: 13105, 1893, 4064, 11620, 696, 14291, 11543, 4947, 6814; Payload ID: 1584 relates to Category No.: 15618, 934, 5846, 1862, 931, 5541, 16055, 16060, 15547, 9783, 15471; Payload ID: 1585 relates to Category No.: 15618, 5367, 934, 5846, 1862, 931, 5541, 16055, 16060, 15547, 9783; Payload ID: 1586 relates to Category No.: 15618, 12197, 934, 14456, 5846, 1862, 13298, 931, 5541, 16055, 16060, 9451, 15547, 3973, 9783; Payload ID: 1587 relates to Category No.: 6814, 15618, 15626, 5846, 11676, 14742, 11670, 931, 2159, 1884, 14736, 13827, 13387, 9772; Payload ID: 1588 relates to Category No.: 15618, 1703, 5846, 5297, 11676, 14742, 13925, 13971; Payload ID: 1589 relates to Category No.: 6814, 15618, 5846, 11676, 14742, 11670, 931, 2159, 1884, 14736, 11669, 13298, 6819, 13969, 13939; Payload ID: 1590 relates to Category No.: 15618, 5846, 11676, 14742, 11670, 931, 2159, 1562, 13497, 2118, 1884, 14736, 13686, 6748, 6751, 1717, 13861, 11671, 13827, 12544, 3100, 10707, 13571, 8054, 8016, 11422, 2051, 12591, 6734; Payload ID: 1591 relates to Category No.: 15618, 5846, 11676, 14742, 13532, 4588, 11670, 931, 932, 13518, 12596, 2159, 1562, 12917, 6727, 2118, 1884, 14736, 13686, 6748, 1717, 13861, 11671, 7677, 7682, 16213, 483, 12544, 13659, 13194, 13571, 7855, 13417, 13491, 6293, 8981, 8054, 8665, 2051, 13961, 12591, 6814, 14740; Payload ID: 1592 relates to Category No.: 6814, 14740, 11676, 14742, 15618, 5846, 11670, 931, 2159, 2118, 1884, 14736, 1717, 13861, 13827, 16213, 1562, 483, 6758, 5852, 12592; Payload ID: 1593 relates to Category No.: 6814, 15618, 5846, 11676, 14742, 11670, 14831, 931, 2159, 1884, 14736, 12664, 13126, 14838, 4167; Payload ID: 1594 relates to Category No.: 15618, 1703, 5846, 1836, 12891, 11676, 14742, 11670, 12041, 1238, 12117, 932, 6145, 10250, 2159, 11396, 7131, 10491, 1562, 1884, 14736, 13686, 6748, 6751, 1717, 11671, 12595, 12140, 11221, 10304, 11219, 12571, 6819, 13882; Payload ID: 1595 relates to Category No.: 11676, 14742, 15618, 15626, 1703, 5846, 11670, 1238, 12117, 6145, 10250, 2159, 11396, 1884, 14736, 6748, 1717, 11221, 11219; Payload ID: 1596 relates to Category No.: 11676, 14742, 15618, 15626, 5846, 11670, 12041, 1238, 12117, 6145, 10250, 2159, 11396, 1884, 14736, 6748, 11221, 11219, 6819; Payload ID: 1597 relates to Category No.: 13589, 3398, 15490, 3398, 11512, 15626, 11676, 14742, 7234, 15521, 4439, 15570; Payload ID: 1598 relates to Category No.: 4828, 15618, 3691, 2351, 9943, 2355, 6253, 1867, 14663, 14102, 6445, 5060, 2353, 5617, 13913, 10309, 8248, 7795, 5768, 12612, 785, 9944, 13929, 10083, 9777, 3729, 708, 2110, 2041, 11995, 10422, 9949, 6249, 9641, 13827, 13966, 2359, 1933; Payload ID: 1599 relates to Category No.: 6227, 15618, 6814; Payload ID: 1600 relates to Category No.: 6227, 6814, 15618, 2351, 9943, 12041, 12453, 10422, 14404, 1856, 15121, 6215, 5939, 3913, 6371, 11273, 5936, 2212, 9950; Payload ID: 1601 relates to Category No.: 6814, 15618, 2351, 9943; Payload ID: 1602 relates to Category No.: 6219, 6227, 13594, 15618, 15626, 14011, 2353, 13827, 13029, 6814; Payload ID: 1603 relates to Category No.: 6227, 15618, 15626, 1893, 13827, 13859, 6814; Payload ID: 1604 relates to Category No.: 15618, 15626, 16214, 2351, 9943, 14086, 10005, 16211, 9994, 9949, 9948, 6814; Payload ID: 1605 relates to Category No.: 6227, 6814, 15618, 2351, 14102, 5065, 8248; Payload ID: 1606 relates to Category No.: 6227, 6814, 15618; Payload ID: 1607 relates to Category No.: 15618, 9777, 9950, 2359, 9632, 2351, 9943, 9947, 5060, 10250, 10583, 11182, 12036, 6758, 785, 10422, 7649, 11196, 7631, 7594, 10272, 10560, 6814; Payload ID: 1608 relates to Category No.: 6227, 6814, 15618, 15626; Payload ID: 1609 relates to Category No.: 6227, 6814, 15618; Payload ID: 1610 relates to Category No.: 15618, 15626, 14663, 4336, 3475, 13827, 16309, 14950; Payload ID: 1611 relates to Category No.: 6814, 15618, 15626; Payload ID: 1612 relates to Category No.: 15618, 15626, 14740, 1184, 14663, 1479, 1186, 1189; Payload ID: 1613 relates to Category No.: 15618, 6219, 9949, 15626, 1867, 14663, 3475, 13827, 1191, 6215, 11199, 16309, 10427, 11198, 13844, 1916; Payload ID: 1614 relates to Category No.: 6814, 15618, 15626, 1730, 744, 15223, 739, 15223, 10232, 13126, 740, 15223, 2626; Payload ID: 1615 relates to Category No.: 15618, 15626, 1295, 1862, 10173, 4985, 14643, 6814; Payload ID: 1616 relates to Category No.: 15618, 15626, 1862, 14663, 4985, 6814; Payload ID: 1617 relates to Category No.: 15618, 6814, 15626; Payload ID: 1618 relates to Category No.: 6814, 15618, 12137, 15626, 9642, 9352; Payload ID: 1619 relates to Category No.: 15618, 15626, 14663, 815, 13827, 2540, 16234, 16275, 6154, 6814; Payload ID: 1620 relates to Category No.: 6814, 15618, 15626; Payload ID: 1621 relates to Category No.: 6814, 15618, 15626, 9427, 12256; Payload ID: 1622 relates to Category No.: 6814, 15618, 15626; Payload ID: 1623 relates to Category No.: 6814, 15618, 15626, 13867, 13827, 13836, 13975, 3475, 14011, 11812, 13784, 15412, 1841, 13942, 9427; Payload ID: 1624 relates to Category No.: 15618, 15626, 1184, 14663, 1189; Payload ID: 1625 relates to Category No.: 15618, 15626, 9500, 10074, 1204, 1238, 10080; Payload ID: 1626 relates to Category No.: 15618, 15626, 1512, 5291, 9427, 14663, 4723, 5289; Payload ID: 1627 relates to Category No.: 6814, 15618, 15626, 16214, 13827; Payload ID: 1628 relates to Category No.: 15618, 11674, 15626, 14565, 1512, 15149, 11676, 14663, 13004, 3728, 6814, 13925, 13888, 13827, 11222, 14054, 8118, 2080, 13983; Payload ID: 1629 relates to Category No.: 6814, 15618, 15626, 14565, 15149, 3021, 11676, 11670, 11674; Payload ID: 1630 relates to Category No.: 15618, 15626, 4100, 1867, 14663, 9762, 4102, 15979, 587, 6203, 9752, 16143, 6303, 9755; Payload ID: 1631 relates to Category No.: 15618, 15626, 4100, 16144, 16143, 10608; Payload ID: 1632 relates to Category No.: 15618, 15626, 4104, 4100, 9762, 9752, 16143, 13969, 13827; Payload ID: 1633 relates to Category No.: 15618, 15626, 14663, 2540, 16234, 16275, 6814; Payload ID: 1634 relates to Category No.: 15618, 14038, 7710, 16197, 14199, 6814; Payload ID: 1635 relates to Category No.: 15588, 15618, 5428, 15603, 11546, 6814; Payload ID: 1636 relates to Category No.: 6814, 15626; Payload ID: 1637 relates to Category No.: 6814, 3021; Payload ID: 1638 relates to Category No.: 13589, 3398, 15618, 15626, 2351, 9943, 2355, 6253, 14663, 14102, 2353, 13970, 15471, 13923, 5065, 8248, 7795, 5768, 9944, 6340, 10421, 3136, 12696, 4716, 664, 6814, 10422, 2359, 8219, 13871; Payload ID: 1639 relates to Category No.: 15618, 15626, 1862, 14663, 3475, 13827, 4985, 15989, 16309; Payload ID: 1640 relates to Category No.: 6814, 15618, 2351; Payload ID: 1641 relates to Category No.: 15618, 2351, 14663, 2353, 3973, 5752, 14986, 8167, 8166, 13827, 13966, 13904, 6814; Payload ID: 1642 relates to Category No.: 15618, 2351, 14663, 2353, 3973, 5752, 14986, 8167, 8166, 9950, 14981, 13827, 13966; Payload ID: 1643 relates to Category No.: 3452, 3356, 3354, 3448, 3309, 5750; Payload ID: 1644 relates to Category No.: 9228, 7018, 5446, 3356, 3354, 3353, 3336, 3305, 3994, 11573, 13639, 3452, 3448, 3309, 5750; Payload ID: 1645 relates to Category No.: 3452, 1721, 2139, 1955, 3356, 9713, 3354, 7306, 3448, 3309, 5750, 11858, 7890, 1995, 13734, 12671, 10516, 14566, 1978, 12091, 13342, 13827, 9982; Payload ID: 1646 relates to Category No.: 15490, 3398, 8739, 2169, 8923; Payload ID: 1647 relates to Category No.: 5428, 2235, 10025, 7369, 13189, 13975; Payload ID: 1648 relates to Category No.: 4828; Payload ID: 1649 relates to Category No.: 4828, 5428, 2303, 3012, 12691; Payload ID: 1650 relates to Category No.: 4828, 5367, 5428, 2303, 12427, 7306, 2311, 8996, 14565; Payload ID: 1651 relates to Category No.: 4828, 690, 2303, 1703, 2311, 16197, 10583, 10491, 8177, 12409, 16096; Payload ID: 1652 relates to Category No.: 4828, 5367, 2303, 12427, 2311; Payload ID: 1653 relates to Category No.: 6814, 14663, 1878, 1308, 6122; Payload ID: 1654 relates to Category No.: 12091, 1737, 7154, 7168, 12743, 7132, 670, 4336, 11858, 13376, 8507, 11033, 14909, 12681, 11237, 722, 7613, 6969, 6687, 2198, 12008, 8937, 2197, 7137, 6695, 14897, 5230, 11141, 13835; Payload ID: 1655 relates to Category No.: 14905; Payload ID: 1656 relates to Category No.: 9420, 7108, 7109, 8320, 7110, 7111, 11300; Payload ID: 1657 relates to Category No.: 12091, 14661, 2139, 8739, 7168, 10481, 7850, 7132, 670, 5217, 11858, 14899, 5176, 8507, 982, 14909, 12023, 12712, 7167, 7642, 200, 2515, 496, 1780, 7154, 5230; Payload ID: 1658 relates to Category No.: 12091, 5230, 2886, 7168, 14838, 9375, 6670, 10481, 5217, 982, 7167, 14904; Payload ID: 1659 relates to Category No.: 11512, 1204, 10745, 10752, 14184, 5449; Payload ID: 1660 relates to Category No.: 15898, 14565, 3684, 3837, 12096, 11860, 11242, 12066, 7252, 11967, 3835, 496, 6103; Payload ID: 1661 relates to Category No.: 13589, 3398, 5367, 11512, 15517, 11506, 3398, 13618, 5285; Payload ID: 1662 relates to Category No.: 12137, 1002, 11995, 6451, 12055, 11280, 1003; Payload ID: 1663 relates to Category No.: 998, 6451; Payload ID: 1664 relates to Category No.: 5446, 998, 2073, 9246, 7129, 2775, 8789, 6451, 6453, 1002; Payload ID: 1665 relates to Category No.: 998, 6451, 7131, 11294, 1002; Payload ID: 1666 relates to Category No.: 998, 1983, 11285, 3699, 6451, 10256, 8535, 7131, 11186, 13371, 11658, 13346, 1002, 13630; Payload ID: 1667 relates to Category No.: 998, 8838, 11940, 12137, 6451; Payload ID: 1668 relates to Category No.: 12137, 998, 8838; Payload ID: 1669 relates to Category No.: 998, 2073, 9246, 7129; Payload ID: 1670 relates to Category No.: 998, 2073, 9246, 7129; Payload ID: 1671 relates to Category No.: 12153, 1894, 998, 9246, 7129, 12126, 12714, 6451, 7044, 1002;

Payload ID: 1672 relates to Category No.: 12194, 998, 2073, 9246, 12099, 7129, 2775, 12126, 11904; Payload ID: 1673 relates to Category No.: 12194, 1002, 998, 2073, 9246, 12099, 7129, 2775, 12126, 11904, 6451, 10256, 11243; Payload ID: 1674 relates to Category No.: 2073, 9246, 12099, 7129, 2775, 12126, 11904, 12194, 1002, 998; Payload ID: 1675 relates to Category No.: 998, 2073, 9246, 12099, 7129, 2775, 12126, 11904, 795; Payload ID: 1676 relates to Category No.: 1002, 795, 5446, 998, 2073, 9246, 7129, 2775, 12714, 8789, 6451, 11660, 6453, 13827, 7613, 8554, 16102, 13397, 8838, 11050, 8084, 4948, 8547, 1250, 13408, 11026, 13854, 16130, 9468, 12741; Payload ID: 1677 relates to Category No.: 12137, 12153, 1894, 10238, 998, 2073, 3021, 6733, 2775, 10017, 6064, 11995, 6451, 10256, 11243, 13165, 10938, 2116, 11280, 15117, 2005, 1002, 2243, 11634, 7613, 8911, 484, 8936, 6269, 1830, 13383, 1556, 9420, 7122, 2229, 12285, 2175, 11878, 12055, 8838, 14009, 6738, 11050, 8084; Payload ID: 1678 relates to Category No.: 7129, 12043, 10017, 6064, 12137, 998, 5446, 1002, 8126, 12021; Payload ID: 1679 relates to Category No.: 998, 1002; Payload ID: 1680 relates to Category No.: 1002, 1730, 6451, 7131, 11186, 11026, 12517, 7743, 8373, 8888; Payload ID: 1681 relates to Category No.: 1752; Payload ID: 1682 relates to Category No.: 10702, 795, 1730, 1483, 1727, 3442, 2079, 16289, 11506, 3398, 344, 8831, 11588, 7693, 360, 11285, 2902, 3176, 10314, 10878, 11298, 8736, 7333, 9399, 4248, 16292, 9342, 12606, 7971, 3582, 1010, 3610, 1489, 11243, 11174, 11176, 1889, 11299, 5406, 11237, 11940, 12096, 16286, 1009, 14456, 11628, 13371, 9238, 11878, 11542, 4449, 8531; Payload ID: 1683 relates to Category No.: 13589, 3398, 10702, 1730, 7743, 5802, 1727, 3442, 8421, 2079, 16289, 7693, 11285, 10314, 1892, 7292, 7712, 10578, 10356, 9320, 6491, 12680, 13153, 14793, 13681, 1272, 1780, 14398, 2377, 12702; Payload ID: 1684 relates to Category No.: 8193, 3445, 8192, 13356; Payload ID: 1685 relates to Category No.: 12091, 14565, 9720, 5446, 9777, 2011, 16085, 2041, 3049, 8129, 16189, 1751, 10480, 11076, 11206, 7866, 8934, 15043, 5428, 7613, 14838, 10074, 14404, 8373, 4250, 790, 11980, 11266, 7537, 8782, 1250, 16069, 1968, 3754, 3855, 9490, 8236; Payload ID: 1687 relates to Category No.: 12194, 5367, 12099, 5428, 1713, 7613, 11987, 3021, 10648, 11565, 3015, 10343, 11182, 11265, 7214, 11176, 5424, 11986, 1453, 11000, 13653, 6462, 6952, 750, 4478, 1852, 10820, 10632; Payload ID: 1688 relates to Category No.: 403, 15192, 1795, 7644, 8688, 5373, 7591; Payload ID: 1689 relates to Category No.: 13589, 3398, 15518, 4439; Payload ID: 1691 relates to Category No.: 14699, 2460, 2459, 9420, 5406, 1463, 8900, 3578, 13363, 16095; Payload ID: 1692 relates to Category No.: 14661, 2459, 9420, 7132; Payload ID: 1693 relates to Category No.: 8782, 8159, 8163, 8243, 5367, 3013; Payload ID: 1694 relates to Category No.: 8362, 5434, 13589, 3398, 15490, 3398, 11843, 795, 12619, 7613, 5446, 5359, 9038, 12498, 1795, 12999, 12096, 10775, 12646, 12628, 11765, 15782, 15456, 15450, 7363, 15448, 7548, 15653, 13217, 11766, 1844, 13635, 13216, 13000, 11281, 13261, 13587, 13439, 12733, 11263, 11261, 13397, 10036, 8588, 13969, 11934, 13882, 13971, 13837, 13797; Payload ID: 1695 relates to Category No.: 12153, 7613, 5446, 5359, 9038, 12498, 1795, 12999, 8362, 5434, 10775, 11765, 15782, 11298, 15456, 15450, 7363, 15448, 7548, 15653, 13217, 11766, 13635, 13216, 13000, 13261, 13587, 13439, 12733, 14838, 11934; Payload ID: 1696 relates to Category No.: 12153, 13465, 5434, 7162, 6969, 8373, 13166, 13005, 13638, 12091, 1737, 15490, 3398, 14661, 7613, 10372, 8731, 3398, 7154, 2886, 7840, 7132, 3875, 4336, 2429, 14899, 10592, 11888, 11027; Payload ID: 1697 relates to Category No.: 12091, 1737, 795, 12153, 7912, 7613, 7154, 12646, 7965, 12743, 10372, 14921, 5986, 10036; Payload ID: 1698 relates to Category No.: 12153, 7613, 13465, 344, 5434, 12646, 13213; Payload ID: 1699 relates to Category No.: 12153, 5434, 10314, 8923; Payload ID: 1701 relates to Category No.: 14661, 12648, 5446, 12459, 10061, 280, 1048, 4130, 5541, 16085, 10192, 272, 10188, 13788, 3038, 13530, 10503; Payload ID: 1702 relates to Category No.: 10061, 280, 5541, 10192, 272, 10188, 13003, 13788; Payload ID: 1703 relates to Category No.: 10061, 280, 6738, 5541, 10192, 272, 10188; Payload ID: 1704 relates to Category No.: 4828, 8977; Payload ID: 1705 relates to Category No.: 9099, 9994, 16214, 2459, 12013, 9420, 14057, 14014, 4774; Payload ID: 1706 relates to Category No.: 9994, 16214, 9099, 14057, 14014, 2275, 13344; Payload ID: 1707 relates to Category No.: 7971, 2275, 5793, 9994, 3529; Payload ID: 1708 relates to Category No.: 2459, 9099, 12011, 9994, 16214, 2460, 1296, 2243, 6714, 9420, 4094, 11997, 4774, 8337, 5073, 12037, 480, 12716, 15016, 7620, 14816, 8004, 11051, 16102, 1622, 861, 6119, 13917; Payload ID: 1709 relates to Category No.: 12137, 6969, 14455, 9994, 16214, 7141, 2460, 1296, 2459, 12013, 6962, 9099, 2243, 6714, 9420, 4094, 12743, 14057, 2198, 5788, 14834, 8887, 3038, 4952, 13071, 6508, 10439, 5073, 12008, 12037, 14073, 480, 12716, 14463, 15016, 7620, 8049, 8934, 8004, 11051, 13515, 7567, 11997, 16138, 14729, 4066, 12040, 4095, 9996, 8676, 6119, 13917, 13255; Payload ID: 1710 relates to Category No.: 12137, 16214, 2459, 6714, 9420, 14014, 5788, 7245, 4952; Payload ID: 1711 relates to Category No.: 13594, 12137, 11237, 16214, 2460, 2459, 9099, 6714, 9420, 4094, 3176, 5788, 11997, 4952, 3247, 10020, 4949, 1295, 9540, 14699, 4057, 6192; Payload ID: 1712 relates to Category No.: 2459, 12137, 16214, 12013, 9420, 4094, 14014; Payload ID: 1713 relates to Category No.: 13594, 8862, 13589, 3398, 9406, 15424, 15517, 11512, 8934, 14456, 8373, 6995; Payload ID: 1714 relates to Category No.: 13594, 8862, 13589, 3398, 9406, 15424, 15517, 11512, 8934, 1741, 8929, 11546, 1743, 12522; Payload ID: 1715 relates to Category No.: 14038, 16197, 7132, 7155, 3882, 7156, 3328; Payload ID: 1717 relates to Category No.: 15618, 2331, 5846, 2329; Payload ID: 1718 relates to Category No.: 13594, 13589, 3398, 11512, 15517, 9406, 15424, 3245, 1816, 724, 672, 14910, 3791, 8831; Payload ID: 1719 relates to Category No.: 13589, 3398, 11512, 15517, 1621, 8739, 7417; Payload ID: 1720 relates to Category No.: 7245; Payload ID: 1721 relates to Category No.: 14565, 1703, 1820; Payload ID: 1722 relates to Category No.: 14838, 14586; Payload ID: 1723 relates to Category No.: 14838, 14586; Payload ID: 1724 relates to Category No.: 14838, 14586; Payload ID: 1725 relates to Category No.: 13589, 3398, 15490, 3398, 2411; Payload ID: 1726 relates to Category No.: 11431, 8373, 10503, 11087, 6103; Payload ID: 1727 relates to Category No.: 3684, 1983, 8356, 15517, 11512, 1816, 4766, 4828, 4535, 1751, 1451, 7030, 5772; Payload ID: 1728 relates to Category No.: 13589, 3398, 15490, 3398, 7306; Payload ID: 1729 relates to Category No.: 13589, 3398, 15490, 3398; Payload ID: 1730 relates to Category No.: 11512, 14073, 8578, 11636, 13589, 3398, 15490, 3398; Payload ID: 1731 relates to Category No.: 13589, 3398, 15490, 3398, 8739, 8731, 3398, 2467, 2469, 8611, 3743, 13921; Payload ID: 1732 relates to Category No.: 13589, 3398, 15490, 3398, 1730, 8739, 8731, 3398, 1780, 2469, 9410, 8732, 8356, 2467; Payload ID: 1733 relates to Category No.: 13589, 3398, 15490, 3398; Payload ID: 1734 relates to Category No.: 8862, 1730; Payload ID: 1735 relates to Category No.: 13594, 12633, 1780, 7132, 4766, 4774; Payload ID: 1736 relates to Category No.: 13594, 13589, 3398, 1955, 5901, 3313, 14566, 2878, 7377, 15332, 6419, 4970, 15331, 3019, 15335, 15517, 11512; Payload ID: 1737 relates to Category No.: 13594, 13589, 3398, 15490, 3398, 7377, 3019; Payload ID: 1738 relates to Category No.: 13589, 3398, 14038, 8739, 15517, 3049, 7377; Payload ID: 1739 relates to Category No.: 13589, 3398, 12137, 15517, 5406; Payload ID: 1742 relates to Category No.: 1795, 1874, 14663, 4020, 4021, 1238, 12338, 6145, 12129, 13938, 13981, 13797, 9321, 3566, 3010; Payload ID: 1743 relates to Category No.: 15490, 3398, 10372, 3781, 13594, 16294, 10574, 2424, 13593; Payload ID: 1744 relates to Category No.: 13589, 3398, 15490, 3398, 15459, 9540, 3629, 6791; Payload ID: 1745 relates to Category No.: 15149, 15140; Payload ID: 1746 relates to Category No.: 1417; Payload ID: 1747 relates to Category No.: 12137, 2459, 9420; Payload ID: 1748 relates to Category No.: 7093, 7122, 7096, 7088; Payload ID: 1749 relates to Category No.: 14212, 7013, 8490; Payload ID: 1751 relates to Category No.: 11940, 15207, 5446, 403, 11109, 12498, 1727, 11506, 3398, 10775, 4127, 14992, 11298, 15456, 8887, 13947, 10854, 2051, 12066, 11201, 10600, 8264, 13851, 10960, 6420, 5705, 5381, 10470, 1055, 13854, 11445, 1849, 13563, 15190, 11934, 10238; Payload ID: 1752 relates to Category No.: 15490, 3398, 11512, 14565, 8739, 12120, 8378, 11094, 12753, 8517, 10448, 7636, 7819, 7863, 1060, 8004, 15194; Payload ID: 1753 relates to Category No.: 8906, 11512, 14565, 5938, 15517, 14643, 11634, 12891, 7743, 7613, 13229, 3799, 15400, 1048, 575, 13071, 13053, 15195, 9321, 2602, 2177, 11631, 15208, 11625, 15008, 9332; Payload ID: 1754 relates to Category No.: 15618, 795, 1070, 5808, 8175, 7613, 5446, 1955, 12498, 13996, 10266, 3021, 13818, 5285, 1066, 4040, 12096, 8373, 7635, 11765, 12573, 13161, 14025, 13827, 10362, 4145, 4041, 13692, 10864, 5806, 7966, 5810, 9292, 6125, 11260, 7600, 8923, 3667, 13627, 13961, 13158, 8305, 13905, 7761, 13356, 13355, 7618, 9713, 9716, 1060, 5243, 16005, 5949, 11634, 12891, 7737, 13975, 7743, 14589, 9408, 6530, 1746, 6878, 1318, 11910, 9410, 12619, 8554, 11051, 4939, 793, 12397, 10372, 11174, 7997, 14910, 15400, 4998, 1836, 1048, 286, 1780, 7735, 9485, 10331, 12519, 4859, 13877, 1112, 12603, 3194, 9451, 13856, 10025, 1061, 6413, 13363, 6705, 1764, 13376, 13859, 5814, 8318, 1983, 2080, 2006, 8420, 15195, 11092, 12764, 4229, 4502, 15197, 6699, 15194, 3519, 11390, 5375, 12652, 11380, 9375, 12926, 3247, 13909, 7680, 8348, 3197, 1709, 2549, 8422, 13714, 6142, 14011, 1063, 4469, 14036, 10973, 6419, 13671, 13334, 10023, 15199, 1031, 13250, 6772, 1687, 578, 8578, 10510; Payload ID: 1755 relates to Category No.: 15490, 3398, 14038, 7613, 8731, 3398, 1955, 5359, 12498, 11506, 3398, 5809, 3313, 14566, 11949, 15606, 11546, 8162, 6508, 12767, 14037, 13244, 11512, 3013, 5286, 4021, 10814, 3019, 14910, 4461, 4245, 6611, 750, 15329, 8781, 15335, 10825; Payload ID: 1756 relates to Category No.: 15490, 3398, 5428, 8739, 8731, 3398, 1955, 10238, 12999, 12646, 12628, 15795, 12994, 7735, 11949, 15606, 12898, 7642, 13594, 274, 7754, 1060, 10266, 7743, 11091, 7613, 14838, 8584, 11997, 12942, 8402, 1764, 7730, 10737, 7773, 14108, 4461, 3853, 8786, 10386, 8710, 8260, 13129, 8190; Payload ID: 1757 relates to Category No.: 8739; Payload ID: 1758 relates to Category No.: 8731, 3398; Payload ID: 1759 relates to Category No.: 1204; Payload ID: 1760 relates to Category No.: 795; Payload ID: 1761 relates to Category No.: 14782, 11512, 14620, 1483, 7418; Payload ID: 1762 relates to Category No.: 15490, 3398, 11512, 8756, 12640, 10578, 14782, 14620, 1483; Payload ID: 1763 relates to Category No.: 5785, 5428, 15614, 5285, 1060, 11371; Payload ID: 1764 relates to Category No.: 5782, 795, 9455, 3833, 12018; Payload ID: 1765 relates to Category No.: 5782, 795, 746, 11765, 10486, 1844, 10864, 10470, 7913, 11012, 10581, 1453, 11337, 3829, 14838, 3833, 12018; Payload ID: 1766 relates to Category No.: 1053, 10955, 8524, 8765, 7641, 8160; Payload ID: 1767 relates to Category No.: 13589, 3398, 1752, 7743, 7735, 10226, 10622, 11062, 10556, 12053, 14838, 13975, 13981; Payload ID: 1768 relates to Category No.: 1722, 8929, 7743, 8318; Payload ID: 1769 relates to Category No.: 795, 334, 11089, 1955, 803, 3974, 11765, 13831, 11256, 11322, 13692, 10864, 5806, 13695, 2006, 5810, 10469, 7913, 8042, 11260, 10548, 10872, 3167, 11488; Payload ID: 1770 relates to Category No.: 795, 11765, 11256, 11322, 10864, 5806, 11260, 716, 10241, 7618; Payload ID: 1771 relates to Category No.: 795, 7743, 12940; Payload ID: 1772 relates to Category No.: 1002, 795, 7613, 16172, 3676, 3974, 3674; Payload ID: 1773 relates to Category No.: 10955, 11091, 1227, 2198, 11386, 15011, 10702, 795, 7613, 7334, 11053; Payload ID: 1774 relates to Category No.: 795, 7613, 10238, 7071, 3021, 1727, 7129, 16197, 13882, 4851, 10256, 11322, 2051, 7044, 11017, 2006, 12397, 7076, 8309, 8923, 11227, 11246, 13158, 8272, 1936, 5812, 8554, 1334, 13164, 15471, 5806, 12481, 2001, 13881, 996, 10319; Payload ID: 1775 relates to Category No.: 7613, 10238, 7071, 3021, 16197, 7076, 13165, 13379; Payload ID: 1776 relates to Category No.: 795, 2139, 5808, 10238, 12498, 803, 4040, 2888, 11765, 13161, 2051, 13692, 5806, 5810, 11300, 11022, 10872, 362, 10550, 3667, 13158, 13356, 13355, 3929, 333, 8446, 334, 12619, 5242, 1780, 7045, 1055, 13856, 1061, 6194, 1250, 10302, 7913, 335, 7373, 16069, 13854, 6142, 11632, 802, 4182, 1065, 13957, 15399, 1295, 13969, 496, 13827, 13837, 7743, 9411, 8004, 13877, 3632, 11322, 14037; Payload ID: 1777 relates to Category No.: 334, 795, 5446, 10238, 803, 4186, 9891, 4127, 3775, 11765, 8988, 932, 10256, 11322, 2051, 4039, 10801, 10864, 10470, 5806, 2006, 11300, 10574, 4535, 11260, 2069, 7851, 13158, 11571, 15809, 11021, 333, 10170, 10662, 459, 5808, 2885, 11452, 12498, 1780, 4041, 4040, 10802, 12734, 10265, 13692, 15116, 1887, 4533, 10239, 2039, 14838, 13835, 13969, 13859, 13882, 13989, 13874, 13827, 13796, 13837, 13970, 13773, 13860, 2243, 13877, 11090, 14022, 13968, 1934; Payload ID: 1778 relates to Category No.: 5785, 795, 7613, 1795, 1995, 12671, 2272, 11512, 8535, 8929, 11089, 12029, 8331; Payload ID: 1779 relates to Category No.: 11926, 1995, 12671, 12052; Payload ID: 1780 relates to Category No.: 11926, 7613, 1995, 4041, 12671, 12117, 4040, 2051, 8663, 1295, 14883; Payload ID: 1781 relates to Category No.: 11926, 5785, 7613, 1795, 15782, 2136, 1995, 12671, 8544, 12041, 11174, 14328, 10192, 11266, 11418, 10343, 1960, 10625, 8460; Payload ID: 1782 relates to Category No.: 11926, 13645, 4766, 1995, 8503, 8926, 8378, 8547, 8798, 12671, 8431, 8539, 12998; Payload ID: 1783 relates to Category No.: 15898, 15626, 1295, 1730, 2409, 15174, 5809, 15215, 14838, 3564, 12117, 5949, 8503, 5810, 5376, 6375, 8549, 5740, 10580, 6513, 12015; Payload ID: 1784 relates to Category No.: 15490, 3398, 795, 8731, 3398, 10238, 11331, 10864, 12778, 10527, 5443; Payload ID: 1785 relates to Category No.: 334, 11940, 795, 11089, 5808, 10238, 12498, 803, 4040, 7045, 11765, 16197, 13161, 14025, 793, 11322, 4039, 4041, 12066, 13692, 7044, 10864, 5806, 8507, 335, 5810, 11282, 11022, 10872, 362, 10550, 1055, 3667, 15559, 13356, 13355, 3929, 13694, 10237, 14065, 1068, 2243, 5243, 8446, 5949, 11634, 8934, 1955, 7743, 14056, 6530, 7990, 13904, 12619, 11323, 14838, 5242, 2139, 1780, 14050, 9485, 8373, 8923, 5807, 10263, 13856, 4167, 1061, 4458, 8862, 13787, 13103, 13227, 6194, 4729, 2080, 1250, 10601, 14523, 10302, 9321, 12734, 7913, 7373, 16069, 14533, 7618, 13159, 7121, 798, 14835, 11020, 3192, 10240, 5334, 3536, 6142, 11632, 802, 1065, 15399, 14066, 14003, 13250, 10510, 1062, 15198, 11957, 336, 13160, 1295, 496, 13827, 13815, 13811, 13813, 4473, 5464, 9479, 1895; Payload ID: 1786 relates to Category No.: 795, 12498, 6530, 793, 11256, 11322, 14838; Payload ID: 1787 relates to Category No.: 5808, 8175, 7613, 12498, 4040, 14838, 14523, 795; Payload ID: 1788 relates to Category No.: 795, 5808, 8175, 7613, 3639, 5446, 12498, 13818, 4040, 2886, 7134, 7635, 11765, 13161, 793, 7958, 13692, 10864, 5806, 7966, 9292, 6125, 8177, 7600, 8567, 13158, 7955, 15116, 5406, 10238, 6530, 14838, 10372, 13996, 1906, 1780, 9485, 8373, 4859, 5016, 8923, 4167, 4458, 14038, 13817, 1887, 7121, 1901, 1978, 796; Payload ID: 1789 relates to Category No.: 334, 5808, 8175, 7613, 12498, 4040, 14838, 4134, 10238, 7966; Payload ID: 1790 relates to Category No.: 334, 795, 5808, 10238, 803, 11765, 8988, 13831, 11256, 11322, 10864, 5806, 11260, 10548, 10872, 10622, 5406, 5949, 11634, 6530, 14838, 14910, 15400, 1820, 13271, 10470, 12498, 4040, 6559, 1055, 1061, 6413, 11089, 10349, 12764, 9321, 7373, 15197, 1887, 15762, 798, 3519, 11020, 3197, 11640, 6142, 10239, 15399, 1295, 10356; Payload ID: 1791 relates to Category No.: 11512, 5434, 7773, 8178; Payload ID: 1792 relates to Category No.: 334, 795, 12498; Payload ID: 1793 relates to Category No.: 795, 12498, 10600; Payload ID: 1794 relates to Category No.: 795; Payload ID: 1795 relates to Category No.: 5808, 8175, 7613, 12498, 4040, 14838, 14523, 795; Payload ID: 1796 relates to Category No.: 334, 795, 5808, 12498, 4040, 1780, 5807, 10591, 8923, 6530, 1295, 10238, 9350; Payload ID: 1797 relates to Category No.: 5808, 8175, 7613, 12498, 4040; Payload ID: 1798 relates to Category No.: 15490, 3398, 8739, 8731, 3398, 4949, 9540, 7664, 8080, 5134, 9320, 8079, 14805, 8727; Payload ID: 1799 relates to Category No.: 13589, 3398, 15490, 3398, 2409; Payload ID: 1800 relates to Category No.: 1204, 1751, 6113; Payload ID: 1801 relates to Category No.: 16214, 14014, 2940, 1751, 6113, 5731; Payload ID: 1802 relates to Category No.: 1002, 998, 2073, 2802, 9246, 6063, 3021, 1983, 2886, 12743, 16197, 6451, 10256, 7131, 7153, 1849, 12404, 11026, 10251, 7743, 7613, 8554, 8928, 13974, 12603, 10938, 1149, 6445, 3730, 7728, 14046, 13882, 13827, 1960, 1903; Payload ID: 1803 relates to Category No.: 1002, 3699, 4822, 4535; Payload ID: 1805 relates to Category No.: 15490, 3398, 8739, 3337, 5188, 5182, 5160, 2413, 5168, 5151; Payload ID: 1807 relates to Category No.: 8731, 3398; Payload ID: 1808 relates to Category No.: 8739, 11091, 8402; Payload ID: 1810 relates to Category No.: 8977, 15149, 1204, 4581; Payload ID: 1811 relates to Category No.: 6212, 6226, 4094, 6223, 8216; Payload ID: 1812 relates to Category No.: 15618, 2331, 5846, 16214, 2329, 15538, 3140, 12573; Payload ID: 1813 relates to Category No.: 14455, 2329, 1204, 6723; Payload ID: 1814 relates to Category No.: 2329, 1204, 5468, 8185; Payload ID: 1815 relates to Category No.: 2329, 1204; Payload ID: 1816 relates to Category No.: 12137, 3833, 12063, 2669, 1893, 6738, 11660, 16161; Payload ID: 1817 relates to Category No.: 12137, 6733, 14097, 3698, 13433, 4771; Payload ID: 1818 relates to Category No.: 1893, 4315, 11660, 12068, 12067; Payload ID: 1819 relates to Category No.: 1512, 11930, 14663, 4723, 2385, 2387; Payload ID: 1820 relates to Category No.: 1512, 11930, 14663, 4723, 2385, 2387, 6814; Payload ID: 1821 relates to Category No.: 10331, 1512, 11930, 4721, 14663, 5004, 4723, 10861, 2387, 3108, 6814; Payload ID: 1822 relates to Category No.: 11930, 9357; Payload ID: 1823 relates to Category No.: 11930, 12068; Payload ID: 1824 relates to Category No.: 1512, 14663, 12071, 4723, 5930, 5932, 10137, 11930, 1026; Payload ID: 1825 relates to Category No.: 1512, 11930, 4729, 6214, 14838, 4398, 6226, 6814; Payload ID: 1826 relates to Category No.: 11930, 7750, 6214, 15944, 15950; Payload ID: 1827 relates to Category No.: 6814; Payload ID: 1828 relates to Category No.: 6814; Payload ID: 1829 relates to Category No.: 2885, 5446, 746, 738, 12994, 1893, 14057, 16197, 742, 15223, 742, 2041, 729, 3016, 3015, 11242, 11316, 5610, 11451, 12750, 742, 15224, 5866, 2024, 8556, 11309, 13121, 10617, 10616, 11540, 12101, 11456, 15195, 13947, 744, 15223, 13827, 13794, 5367; Payload ID: 1830 relates to Category No.: 9500, 14090, 14086, 10005, 16211, 14071, 16215, 1152; Payload ID: 1831 relates to Category No.: 9500, 13161, 14086, 10005, 16211, 13397, 14080, 14071, 1619, 1618, 1617, 16304; Payload ID: 1832 relates to Category No.: 1026, 14661, 5446, 10372, 6606, 348, 4186, 9891, 12391, 4127, 3775, 5541, 16085, 8988, 7613, 11591, 10358, 10626, 11033; Payload ID: 1834 relates to Category No.: 12053, 14663, 1878, 6887, 14678, 15089, 628, 627, 12983, 6287, 6902; Payload ID: 1835 relates to Category No.: 6902, 14663, 1878, 6887, 14678, 15089, 14350, 6287, 14679; Payload ID: 1836 relates to Category No.: 12194, 11878, 1893, 1149, 6739; Payload ID: 1837 relates to Category No.: 12194, 11878, 1149, 9637, 6739, 7594; Payload ID: 1838 relates to Category No.: 15898, 11843, 15207, 14565, 12153, 16286, 5446, 8731, 3398, 9038, 11910, 11506, 3398, 14383, 7362, 4127, 16197, 7132, 14992, 670, 15782, 11587, 13644, 4336, 15003, 15456, 15450, 7363, 15448, 15443, 15454, 2469, 15446, 15653, 15457, 15458, 8611, 10441, 15451, 12717, 11300, 8639, 11912, 12619, 12096, 13337, 2079, 11878, 1313, 12993, 6562; Payload ID: 1839 relates to Category No.: 795, 10238, 12498, 11765, 793, 11256, 11322, 4041, 13692, 10864, 5806, 11282, 3906, 11022, 10600, 11260, 8923, 14571, 12646, 11940, 334, 4039, 5016, 12127, 12886, 13159, 7071, 13369, 13835, 1295, 4473; Payload ID: 1840 relates to Category No.: 795; Payload ID: 1841 relates to Category No.: 674, 14267, 16197, 15001, 11316, 8463, 7009, 12037, 6963, 5777, 13385, 8464, 13589, 3398, 15626; Payload ID: 1842 relates to Category No.: 15626, 7009, 6963, 6984; Payload ID: 1843 relates to Category No.: 7306, 7693, 3176, 4949; Payload ID: 1844 relates to Category No.: 12154, 11843, 795, 7613, 12096, 11860, 11969, 11967, 8186; Payload ID: 1845 relates to Category No.: 1512, 1204, 14663, 4021, 4723, 2385, 2383, 2384, 3106, 9633, 1250; Payload ID: 1846 relates to Category No.: 390, 4110, 1184, 14663, 4670, 1186, 1189, 15234, 1188, 6269, 9411; Payload ID: 1847 relates to Category No.: 9500, 14663, 10174, 4978; Payload ID: 1848 relates to Category No.: 9500, 14663, 10174, 4978; Payload ID: 1849 relates to Category No.: 14586; Payload ID: 1850 relates to Category No.: 3691, 8936, 6738, 486, 6713, 11646, 726, 727, 7131, 10083, 9683; Payload ID: 1851 relates to Category No.: 6975, 10372, 7071, 11506, 3398, 8936, 6713, 726, 727, 4041, 10083, 11512; Payload ID: 1852 relates to Category No.: 10074, 6714, 4057, 8936, 6738, 6713, 11646, 726, 727, 3701, 10025, 10083, 13827, 1238, 3197, 11072, 14406, 12135; Payload ID: 1853 relates to Category No.: 8936, 6738, 5788, 6713, 11646, 726, 727, 8920, 10075; Payload ID: 1854 relates to Category No.: 6714, 8936, 6713, 726, 727, 3701, 11205; Payload ID: 1855 relates to Category No.: 15155, 6714, 8936, 6738, 6713, 11646, 726, 727, 3701, 11205, 1238, 10025, 6705, 6733, 11072, 14406; Payload ID: 1856 relates to Category No.: 1737, 7154; Payload ID: 1857 relates to Category No.: 1955, 3354, 13729; Payload ID: 1858 relates to Category No.:

1737, 7154; Payload ID: 1859 relates to Category No.: 6814, 2169, 14663, 9068, 16234, 16275, 1210; Payload ID: 1860 relates to Category No.: 1830, 14025, 6814; Payload ID: 1861 relates to Category No.: 9228, 9296, 3354; Payload ID: 1862 relates to Category No.: 1721, 794; Payload ID: 1863 relates to Category No.: 12194, 746, 12096, 13827, 14025; Payload ID: 1864 relates to Category No.: 12091, 5785, 1070, 15614, 9717, 5446, 12646, 15194, 2088, 10801; Payload ID: 1868 relates to Category No.: 4949; Payload ID: 1869 relates to Category No.: 3691; Payload ID: 1870 relates to Category No.: 14318, 12619, 14177, 1780, 6635, 151, 6360, 14164, 2517, 151, 6360; Payload ID: 1871 relates to Category No.: 15043, 12648, 16172, 7345, 3807, 12942, 11315, 10920, 13126, 12953, 4969, 16158, 12797, 14604, 1759; Payload ID: 1872 relates to Category No.: 14052, 3452, 1955, 3356, 3354, 3320, 11506, 3398, 3353, 3448, 12732, 1874, 1893, 13729, 12120, 2022, 11660, 13730, 12066, 7150, 3455, 3370, 7732, 7887, 2004, 3318, 1926; Payload ID: 1873 relates to Category No.: 15490, 3398, 4998, 8739, 2409, 12891, 11588, 1893, 12120, 11660, 14417, 10626; Payload ID: 1874 relates to Category No.: 12648, 1752, 10372, 11506, 3398, 8756, 10314, 15570, 11242, 10578, 10333; Payload ID: 1875 relates to Category No.: 3705, 7662, 10583, 1246, 13287, 12810, 16005, 5458; Payload ID: 1876 relates to Category No.: 12091, 12603, 12553; Payload ID: 1877 relates to Category No.: 14177, 14175; Payload ID: 1878 relates to Category No.: 12091, 5785, 14565, 795, 1703, 1730, 15614, 9717, 5446, 403, 12646, 11765, 11858, 1844, 6795; Payload ID: 1879 relates to Category No.: 1512; Payload ID: 1880 relates to Category No.: 13589, 3398, 15490, 3398, 1269; Payload ID: 1881 relates to Category No.: 1703, 7131, 7334, 11053, 11062; Payload ID: 1883 relates to Category No.: 9982, 3452; Payload ID: 1885 relates to Category No.: 1204; Payload ID: 1886 relates to Category No.: 4828, 12544, 4538, 481, 1268; Payload ID: 1887 relates to Category No.: 1703, 14640, 13280, 1272, 12553, 14045, 9455, 12555, 13967, 13969, 9451, 13859, 13936, 496, 13886, 13827, 13836, 13837, 13767, 14054, 2149, 1993, 9320, 14022, 13864, 1709, 1269, 9454, 14047, 13880; Payload ID: 1888 relates to Category No.: 6814, 10266, 7306, 5285; Payload ID: 1889 relates to Category No.: 14038, 2885, 7912, 5446, 1816, 3021, 7306, 5285, 12459, 7737, 10775, 1780, 7735, 8818, 13892, 1053, 15817, 13891, 13890, 8474, 8174; Payload ID: 1890 relates to Category No.: 12194, 1730, 7306, 14640, 6253, 14663, 4020, 4021, 9451, 1621, 10329; Payload ID: 1891 relates to Category No.: 1703, 12498, 11167, 13105, 1729, 14656, 11506, 3398, 7737, 4859, 1257, 7735, 16130, 4021, 372, 12594, 7923, 16133, 9595, 482, 14365, 7703, 10324, 966, 1560, 10321, 11351, 4954, 12598, 10375, 10648, 4949, 10329; Payload ID: 1892 relates to Category No.: 12498, 11167, 13105, 1729, 14656, 1257, 4134, 9485, 4849; Payload ID: 1893 relates to Category No.: 12091, 13589, 3398, 11091, 11512, 5428, 5458, 8739, 1741, 8731, 3398, 9321, 10238, 1816, 11167, 1729, 14656, 4949, 345, 7743, 11506, 3398, 4859, 14640, 1257, 7693, 2376, 10366, 9125, 3564, 11285, 10648, 9722, 13882, 4021, 1272, 10558, 6773, 1549, 7724, 3812, 1273, 10606, 10955, 10583, 10287, 11147, 10329, 1918, 11242, 10248, 11148, 9410, 11620, 5406, 1557, 9595, 11524, 1570, 10578, 9455, 1318, 11183, 11163, 8120, 7699, 15247, 15248, 1259, 979, 3622, 8834, 8656, 7587, 1590, 3586, 11136, 11146, 7685, 2726, 15415, 6791, 11621, 6780, 7829, 9500, 8004, 13265, 11912, 1993, 2079, 10358, 12192; Payload ID: 1894 relates to Category No.: 1816, 12498, 11167, 13105, 1729, 14656, 4859, 14640, 9455, 1622, 11512; Payload ID: 1895 relates to Category No.: 11512, 7613, 8739, 14967, 8731, 3398, 10238, 7728, 348, 11167, 14656, 7743, 11506, 3398, 14699, 10175, 4859, 1257, 2376, 11285, 8105, 4021, 10558, 7724, 5949, 10287, 11147, 10329, 1918, 11242, 7217, 15805, 8352, 10286, 12036, 1246, 10557, 8320, 11391, 3631, 6812, 1320, 10574, 10356, 8255, 9455, 16005, 1318, 6371, 6384, 8666, 15247, 4969, 10446, 2607, 13357, 11385, 8468, 6468, 9320, 7670, 1259, 11146, 6419, 14398, 3620, 1579, 6787, 11634, 12631, 8683, 15276, 3033, 10566, 5736, 14697, 10323, 13287, 1332, 15479, 3814, 3802, 1339, 10291, 1264, 1262, 12232, 8715, 1261, 13713, 7669, 14810, 4491, 8013, 16000, 16003, 8283, 6834, 10884, 8014, 8295, 8291, 10525, 7745, 722, 12891, 673, 8887, 11091, 10648, 1463, 8930, 6878, 1741, 3613, 8004, 10583, 13265, 10372, 690, 1240, 4949, 10366, 14640, 7939, 6375, 1993, 4251, 3854, 3578, 11824, 2755, 10034, 3575, 6796, 4458, 6116, 3819, 15248, 3444, 3595, 3598, 3610, 12628, 10358, 14688, 1269, 9321, 3594, 3612, 15424, 1464, 12559, 1316, 9409, 7799, 1340, 5461, 16095, 10556, 13489, 15480, 14808, 13714, 13487, 13179, 2523, 4499, 12602, 6799, 6780, 6801, 6565, 3817, 8501, 6774, 6779, 6776, 13835, 1295, 13969, 13859, 13936, 16294, 14056, 2051, 11094, 14000, 8415, 10552, 14022, 13962, 2083, 9485, 2128, 12832, 15460, 10302, 10722, 675, 6381, 11417, 10986; Payload ID: 1896 relates to Category No.: 11512, 12498, 11167, 13105, 14656, 7743, 4859, 14640, 1257, 9451, 15805, 7942, 7967, 10574, 1622, 10493, 8120, 8328, 8656, 7587, 7829, 10525, 9599, 6523; Payload ID: 1897 relates to Category No.: 5367, 11512, 8739, 12498, 11167, 13105, 14656, 1862, 4859, 14640, 1257, 10287, 11147, 1918, 11290, 15805, 10574, 1622, 10917, 11385, 2024, 10525, 10214, 7308, 1730, 5949, 11091, 5428, 9455, 3631, 6523, 10558, 4057, 10556, 9451, 13859, 13767, 2051, 14000, 13905, 13932, 10429, 10215; Payload ID: 1898 relates to Category No.: 14967, 8731, 3398, 7728, 12498, 11167, 1729, 14656, 11506, 3398, 4859, 14640, 1257, 8940, 8390, 4021, 6773, 7724, 9451, 3812, 3038, 8375, 10765, 10287, 11147, 1918, 12036, 2006, 8320, 11176, 6878, 6812, 8255, 16005, 1622, 10493, 8389, 10726, 13410, 7215, 8468, 6791, 13287, 8013, 8663, 11512, 5949, 9599, 3604, 673, 1026, 10238, 7743, 11091, 9410, 8402, 6796, 1320, 3595, 1317, 3610, 3791, 10358, 4057, 9321, 14360, 3573, 1464, 10356, 12559, 15763, 8370, 8501, 8280, 6861, 8847, 6859, 13835, 13981, 13313, 14045; Payload ID: 1899 relates to Category No.: 12498, 11167, 13105, 1729, 14656, 4859, 1257, 9451, 8118, 12813, 1622, 3243; Payload ID: 1900 relates to Category No.: 12498, 11167, 13105, 1729, 14656, 4859, 14640, 1257, 9451, 1622; Payload ID: 1901 relates to Category No.: 12091, 5367, 11512, 14569, 11167, 1257, 15570, 10287, 11147, 1918, 11385, 3621, 14949, 1730, 5406, 9599, 724, 3445, 11506, 3398, 10574, 14793, 3532, 3641, 9584, 4949, 6375, 1622, 3578, 9540, 10034, 4953, 3194, 6796, 8862, 5071, 3602, 12676, 10983, 2376, 3598, 9321, 3442, 8865, 13062, 6072, 4950, 7302, 8882, 9587, 6793, 8370, 8884; Payload ID: 1902 relates to Category No.: 12091, 11512, 14569, 14640, 1257, 4057, 1621, 9483, 2374, 12190, 10287, 6194, 9490, 10358, 11147, 3630, 10329, 1918, 7800, 15610, 1730, 3445, 14056, 5428, 1463, 14069, 10602, 2376; Payload ID: 1903 relates to Category No.: 12091, 11512, 15517, 14569, 11167, 12646, 1257, 7735, 16085, 10558, 372, 15610, 1250, 2374, 12190, 10287, 11147, 3630, 10329, 1918, 7800, 10286, 10557, 10573, 724, 6371, 2116, 3715, 6796, 14060, 8811, 6406, 6407, 859, 16118, 7880, 3707, 8676, 13089, 6192, 6625, 10258, 1295, 14056; Payload ID: 1904 relates to Category No.: 1722, 1727, 7724, 11091, 2110, 8318; Payload ID: 1905 relates to Category No.: 1722, 11091, 2110, 8318; Payload ID: 1906 relates to Category No.: 11091, 1722, 2110, 8318, 8862, 7724; Payload ID: 1907 relates to Category No.: 1737, 7154, 13171, 7132, 4336, 13363, 13175; Payload ID: 1909 relates to Category No.: 13589, 3398, 15490, 3398; Payload ID: 1910 relates to Category No.: 1730, 7306, 14838, 11550, 6687; Payload ID: 1911 relates to Category No.: 5446, 729, 8621, 13495, 7316, 13079; Payload ID: 1912 relates to Category No.: 3013; Payload ID: 1914 relates to Category No.: 8723, 5447; Payload ID: 1916 relates to Category No.: 5446; Payload ID: 1920 relates to Category No.: 12091, 5785, 8977, 8929, 1955, 14034, 2196, 1048, 3871, 4335, 8940; Payload ID: 1921 relates to Category No.: 12091, 1737, 8929, 3986, 7154, 275, 1048, 3871, 4336, 13005, 5810, 3835, 12511, 13432, 3829, 9713, 8940; Payload ID: 1922 relates to Category No.: 4828, 10486, 13936, 13925, 5428, 11987, 7735, 7658, 14454, 11323, 1752, 8535, 10904; Payload ID: 1923 relates to Category No.: 4828, 5428, 15614, 1795, 14693, 13659, 16099, 1237, 817, 13653, 8446, 16102, 8180, 14003, 8181, 13827, 2006, 7743, 10486, 7658, 380, 6485; Payload ID: 1924 relates to Category No.: 12091, 1026, 14661, 5785, 14565, 7613, 15149, 5446, 6606, 348, 4186, 12391, 4127, 3775, 10648, 5541, 16085, 8988, 11174, 10583, 9410, 3906, 4541, 1922, 1730, 14782, 12646, 16213, 1957, 15400, 7379, 6323, 575, 7919, 8373, 10261, 11425, 11418, 4947, 7989, 15402, 8674, 12525, 4066, 1684, 575, 11625, 10260, 11934, 13981, 13797; Payload ID: 1925 relates to Category No.: 8731, 3398, 4500, 15042, 3228, 6785, 15368, 4789, 10708, 6860, 10998; Payload ID: 1927 relates to Category No.: 14565, 795, 3452, 1955, 3354, 2409, 3448, 3453, 13904, 10521, 4335; Payload ID: 1928 relates to Category No.: 795, 1721, 12619, 12498; Payload ID: 1930 relates to Category No.: 8862, 11512, 1730, 11363; Payload ID: 1934 relates to Category No.: 8862, 1026, 15614, 1816, 15140, 11431, 8373, 8940, 13229, 1300, 10290, 2593, 10448, 13827, 16005, 11091, 6103, 3038, 7613, 13530, 7728, 1112, 4131, 5458, 1023, 13227, 4375, 6650, 13135, 5440, 4132, 3039, 8368, 1032, 8943, 4581, 8854, 8672, 4342, 13429, 15226; Payload ID: 1935 relates to Category No.: 9982; Payload ID: 1936 relates to Category No.: 13589, 3398, 15517, 11512, 6296, 3529, 6566; Payload ID: 1937 relates to Category No.: 6814, 1780, 14663, 1878, 1307, 4332, 1308, 1309; Payload ID: 1938 relates to Category No.: 6814, 14663, 1878, 1307, 1308, 1309, 6124, 5889, 5888, 16073, 12986; Payload ID: 1939 relates to Category No.: 6814, 9500, 14663, 1878, 1308; Payload ID: 1940 relates to Category No.: 9500, 14663, 1878, 1308, 6814; Payload ID: 1941 relates to Category No.: 12091, 9982, 14663, 1878, 1829, 1308; Payload ID: 1942 relates to Category No.: 1026, 14661, 12153, 5446, 6606, 348, 4186, 12391, 4127, 3775, 5541, 16085, 8988, 8617; Payload ID: 1943 relates to Category No.: 15898, 11915, 12619, 1894, 12633, 7743, 11294, 7230, 11966, 7229; Payload ID: 1944 relates to Category No.: 1722, 12153, 7613, 3452, 1955, 10238, 3354, 3448, 13313, 3453, 11243, 3455, 11972, 15425, 8513, 8332; Payload ID: 1945 relates to Category No.: 13594, 9232, 3452, 3354, 3320, 3448, 3309, 14663, 3455, 7743, 2146; Payload ID: 1946 relates to Category No.: 14052, 3452, 12603, 3354, 3448, 3453, 13904, 10521, 11968, 4335, 5132; Payload ID: 1947 relates to Category No.: 795, 1752, 1955, 1746, 1780, 11285, 4538, 13904, 7120; Payload ID: 1948 relates to Category No.: 1721, 3354, 12732, 8899, 1955; Payload ID: 1949 relates to Category No.: 12091, 14661, 5785, 14565, 10702, 9720, 13435, 13485, 274, 11182, 7737, 13925, 5459, 12619, 8920, 1295, 8112, 13653, 8386, 7757, 7661, 11858, 10093; Payload ID: 1950 relates to Category No.: 13594, 15490, 3398, 11512, 795, 5808, 12153, 13609, 3452, 8731, 3398, 687, 1955, 12498, 3354, 11506, 3398, 3448, 4104, 11648, 3447, 8072, 2392, 12646, 3313, 14568, 10648, 1893, 8169, 2136, 11298, 12120, 3453, 11860, 2429, 11660, 13904, 10521, 13836, 4335, 10745, 3455, 10350, 7967, 10226, 11972, 8554, 7974, 10735, 7775, 11595, 2007, 8081, 10753, 10747, 10752, 12892, 3356, 2195, 2421, 10749, 12772, 8080, 13835, 1295, 13966, 13970, 13923, 11259, 15606, 1721, 3353; Payload ID: 1951 relates to Category No.: 3452, 9296, 3354, 11506, 3398, 3448, 2196, 2886, 5146, 2424, 5182, 3455, 8254, 1955, 5809, 14838, 5808, 2421, 2392, 12743, 4998, 1780, 1295, 6535, 13856, 11027, 4138, 5453, 14052, 9378, 3313, 14568, 1709, 14037, 13730, 13835, 3353, 13966, 6559, 7303, 5252; Payload ID: 1952 relates to Category No.: 1737, 4828, 15207, 1713, 1070, 1703, 10074, 1752, 12633, 12498, 5592, 286, 1780, 10366, 3775, 5541, 16085, 8988, 1238, 10093, 10557, 1997, 5022, 749; Payload ID: 1953 relates to Category No.: 14661, 14565, 10702, 13827, 11174, 6117; Payload ID: 1954 relates to Category No.: 8739, 5113, 1886, 15490, 3398, 795, 8731, 3398, 2410, 8390, 10228, 11247; Payload ID: 1955 relates to Category No.: 15490, 3398, 8739, 5113, 12936; Payload ID: 1957 relates to Category No.: 7288, 7291, 16182, 14271, 4439, 14271, 16183; Payload ID: 1958 relates to Category No.: 14009, 10331, 690, 15490, 3398, 11512, 10702, 337, 12835, 10188, 4766, 1965, 10628, 6977, 8049, 10557, 15762, 7992, 10861; Payload ID: 1959 relates to Category No.: 5788; Payload ID: 1960 relates to Category No.: 1703, 14640, 2169, 1512, 14663, 4020, 4021, 4723, 2385, 2383, 2384, 3106, 5073, 13236; Payload ID: 1961 relates to Category No.: 15522, 15518, 14320, 4439, 15722, 13589, 3398, 13186, 11530; Payload ID: 1962 relates to Category No.: 13589, 3398, 15518, 3399, 5443, 4439; Payload ID: 1965 relates to Category No.: 14661, 5446, 4130, 16085, 10889, 12365, 11942, 10244, 5406, 274, 10372, 1767; Payload ID: 1966 relates to Category No.: 3639, 10238, 12798, 1780, 16197, 13229, 10248, 6231, 12620, 7334; Payload ID: 1968 relates to Category No.: 286, 2886, 1081, 11997, 15974, 14624, 13059, 14638, 7387; Payload ID: 1969 relates to Category No.: 3452, 3354, 2409, 3448, 3453, 13904, 10521, 11968, 4335; Payload ID: 1971 relates to Category No.: 15490, 3398, 8731, 3398, 2412, 5030; Payload ID: 1972 relates to Category No.: 13589, 3398, 15490, 3398, 3386, 2411; Payload ID: 1973 relates to Category No.: 13589, 3398, 15490, 3398, 9720, 1955, 3354, 3448, 2416, 4953, 5221, 2411, 2404, 11308; Payload ID: 1974 relates to Category No.: 13589, 3398, 15490, 3398, 2411, 3337, 5113, 4439, 12891, 3783, 8004, 3783, 2413, 5183, 5166, 5187, 5031; Payload ID: 1975 relates to Category No.: 13589, 3398, 15490, 3398; Payload ID: 1976 relates to Category No.: 15490, 3398, 11506, 3398, 2410, 5146; Payload ID: 1977 relates to Category No.: 10074, 5146, 1238, 10080; Payload ID: 1978 relates to Category No.: 13594, 15490, 3398, 12648, 2940; Payload ID: 1979 relates to Category No.: 13594, 12648, 2940; Payload ID: 1980 relates to Category No.: 5146, 13883, 13829; Payload ID: 1981 relates to Category No.: 13594, 15490, 3398, 2409, 9274, 14838; Payload ID: 1982 relates to Category No.: 13594, 15490, 3398, 2409; Payload ID: 1983 relates to Category No.: 15490, 3398, 11512, 2411, 1955, 12999, 10775, 16197, 11509, 10638, 13612, 13314, 7882, 12091, 2429, 10513, 5184, 5453, 5148; Payload ID: 1984 relates to Category No.: 13594, 15490, 3398, 1721, 16286, 8731, 3398, 7743, 11506, 3398, 7997, 10735; Payload ID: 1985 relates to Category No.: 13594, 13589, 3398, 15490, 3398, 14565, 5783, 1795, 2410, 12936, 5182, 5131; Payload ID: 1986 relates to Category No.: 13589, 3398, 15490, 3398, 2409, 1204; Payload ID: 1987 relates to Category No.: 13589, 3398, 15490, 3398, 1295, 8739, 2411, 11506, 3398, 724, 3641, 3605, 14050, 2068; Payload ID: 1988 relates to Category No.: 7288, 15490, 3398, 1730, 2411, 14271, 13445, 14838, 6532, 6535, 5128, 11508; Payload ID: 1989 relates to Category No.: 12091, 15490, 3398, 5785, 9720, 1070, 1730, 15614, 9717, 5446, 403, 11109, 803, 7362, 1451, 12646, 10265, 4127, 15456, 15450, 12528, 15446, 15457, 15458, 1053, 6795, 12529, 7845, 1751, 5359; Payload ID: 1990 relates to Category No.: 14162; Payload ID: 1992 relates to Category No.: 6814, 8731, 3398, 7802; Payload ID: 1993 relates to Category No.: 12153, 13342; Payload ID: 1994 relates to Category No.: 11201, 8374, 15809; Payload ID: 1995 relates to Category No.: 14656; Payload ID: 1997 relates to Category No.: 14038, 8818; Payload ID: 1998 relates to Category No.: 12153; Payload ID: 2001 relates to Category No.: 2243, 3041; Payload ID: 2003 relates to Category No.: 7306; Payload ID: 2004 relates to Category No.: 13594, 11506, 3398; Payload ID: 2005 relates to Category No.: 7308, 483, 6322, 14509, 14460, 2466, 2470, 9102, 13534; Payload ID: 2006 relates to Category No.: 13589, 3398, 12153, 8739, 3354, 13612, 13613, 13597, 15517, 11512, 2083; Payload ID: 2007 relates to Category No.: 13589, 3398, 12153, 15517, 8739; Payload ID: 2008 relates to Category No.: 15490, 3398, 1955, 3354, 8760, 7743, 8936, 11130, 724, 14620, 3070, 901, 2176, 12053, 8367, 8739, 13969, 7613, 13936, 13971, 13970, 8373, 13981, 13829, 8929; Payload ID: 2009 relates to Category No.: 7743, 8318; Payload ID: 2010 relates to Category No.: 15490, 3398, 1721, 7306, 2409, 11506, 3398, 8508, 12036; Payload ID: 2011 relates to Category No.: 12091, 1737, 14661, 795, 7154, 7134, 16197, 7132, 7163, 12712, 13472, 14895, 2429, 10864, 1780; Payload ID: 2012 relates to Category No.: 12091, 1737, 14661, 795, 7154, 7134, 1780, 7132, 670, 13644, 7163, 8797, 12023, 12010, 2192, 6880; Payload ID: 2013 relates to Category No.: 1737, 14661, 6670, 7132, 670, 13644, 7163, 8797, 982, 14895, 2429, 7159, 12712; Payload ID: 2014 relates to Category No.: 7291, 16182, 7280; Payload ID: 2015 relates to Category No.: 13594, 7291, 16182, 10224; Payload ID: 2016 relates to Category No.: 9500, 14663, 1878, 1308, 1603; Payload ID: 2018 relates to Category No.: 6219; Payload ID: 2019 relates to Category No.: 7571, 7847, 7759; Payload ID: 2020 relates to Category No.: 15207, 403, 2883, 326, 5609; Payload ID: 2021 relates to Category No.: 15201, 5609; Payload ID: 2022 relates to Category No.: 15201; Payload ID: 2023 relates to Category No.: 10841, 11460, 8689; Payload ID: 2024 relates to Category No.: 1204; Payload ID: 2025 relates to Category No.: 403; Payload ID: 2027 relates to Category No.: 15149, 1893, 213, 2546, 13859, 13827, 13966, 7743, 6102, 13849, 2364, 13770, 8672, 8894, 6814; Payload ID: 2030 relates to Category No.: 1703, 4145, 15736, 5406, 1228, 1780, 6637, 151, 6360, 2079, 1295, 2041, 2014, 1993, 8929; Payload ID: 2031 relates to Category No.: 15626, 5782, 16172, 12137; Payload ID: 2032 relates to Category No.: 15490, 3398, 795, 6631, 8731, 3398; Payload ID: 2033 relates to Category No.: 9324, 1893, 11660, 12068, 9325, 10074, 10087; Payload ID: 2035 relates to Category No.: 10648, 10486, 8476, 8477, 10215, 10955, 11940, 11266, 12913, 11936; Payload ID: 2036 relates to Category No.: 345, 11940, 10666, 10611, 11936, 10680, 12143; Payload ID: 2037 relates to Category No.: 4094, 8112, 8004, 8389, 8021, 10478, 8324, 12143, 2162, 8160, 10211; Payload ID: 2039 relates to Category No.: 3564; Payload ID: 2040 relates to Category No.: 12066, 11936; Payload ID: 2041 relates to Category No.: 11940; Payload ID: 2048 relates to Category No.: 9099, 9420, 12008, 2185, 2459, 5406, 9599, 12099, 4952, 3578, 1295, 13492, 3595, 13386, 8888, 8879; Payload ID: 2053 relates to Category No.: 6738, 11293, 2009, 10669, 5542, 11604, 5781; Payload ID: 2055 relates to Category No.: 1204, 10802; Payload ID: 2056 relates to Category No.: 7912; Payload ID: 2057 relates to Category No.: 7290; Payload ID: 2058 relates to Category No.: 12091; Payload ID: 2059 relates to Category No.: 12137, 3986, 16165, 15163, 1641; Payload ID: 2060 relates to Category No.: 12137, 3986, 10593, 2116, 15163; Payload ID: 2062 relates to Category No.: 5446, 7306, 7291, 16182, 8390, 2041, 2014, 2136, 8782, 8535, 8126, 8222, 8163, 8726, 8790; Payload ID: 2063 relates to Category No.: 14661, 5255, 795, 1703, 11506, 3398, 14589, 1814, 12994, 11765, 4020, 4021, 12041, 450, 1844, 11510, 7750, 3910, 1749, 2044, 2007, 14025, 13827, 13970, 15140, 8936, 10034; Payload ID: 2064 relates to Category No.: 5255, 1703, 14589, 1814, 450, 1749; Payload ID: 2065 relates to Category No.: 5255, 1703, 14640, 1814, 9451, 450, 1749, 2721; Payload ID: 2066 relates to Category No.: 5255, 1703, 1814, 450, 1749; Payload ID: 2067 relates to Category No.: 11512, 5255, 1703, 7743, 12798, 14108, 1432, 10366, 12818, 1814, 14928, 10558, 450, 6018, 10382, 7719, 3713, 5941, 11391, 1749, 12365, 11216, 10307, 6292, 6336, 13970, 7132; Payload ID: 2068 relates to Category No.: 5255, 1703, 1814, 450, 7334, 11053, 1749; Payload ID: 2069 relates to Category No.: 5255, 1703, 1432; Payload ID: 2070 relates to Category No.: 15626, 5255, 1703, 9353, 1432, 1814, 450, 1749, 9352; Payload ID: 2071 relates to Category No.: 5255, 1703, 1814, 450, 1749; Payload ID: 2072 relates to Category No.: 5255, 1703; Payload ID: 2073 relates to Category No.: 5255, 1703, 1814, 450, 8954, 7334, 11053, 4475, 1749, 1807, 2243, 1249, 10955, 1752, 5037, 8900, 5242, 15247, 7693, 1432, 1296, 15011, 13267, 12373, 3910, 13325, 8909, 11437, 14589, 11934, 13435, 12526, 15140, 13200, 13363, 13465; Payload ID: 2074 relates to Category No.: 5255, 1703; Payload ID: 2075 relates to Category No.: 5255, 1703, 1432; Payload ID: 2076 relates to Category No.: 5255, 1703, 14589, 1814, 450, 1749; Payload ID: 2077 relates to Category No.: 5255, 1703; Payload ID: 2078 relates to Category No.: 5255, 1703, 1483, 16214, 1814, 5936, 10648, 14057, 450, 10883, 10972, 1749, 10803, 4935, 11043, 8758, 7709, 12945, 10974, 14589, 16294, 13827; Payload ID: 2079 relates to Category No.: 5255, 1703, 1814, 450, 1749, 1026, 5037, 10257; Payload ID: 2080 relates to Category No.: 5255, 1703, 1814, 12835, 16085, 15570, 450, 1812, 10587, 1749, 7743, 1248; Payload ID: 2081 relates to Category No.: 5255, 1703, 1814, 450, 1749, 9125; Payload ID: 2082 relates to Category No.: 5255, 1703, 14589, 1814, 450, 1749; Payload ID: 2083 relates to Category No.: 5255, 1703, 1814, 450, 1749, 15149, 13812, 15149, 4588; Payload ID: 2084 relates to Category No.: 5255, 1703, 14589, 1814, 450, 1749; Payload ID: 2085 relates to Category No.: 4828, 5255, 1703, 3896, 1795, 2169, 8887, 4937, 724, 8934, 16294, 5459, 12459, 6296, 14108, 780, 3870, 9448, 10048, 6078, 10044, 3899, 11998; Payload ID: 2086 relates to Category No.: 4828, 13589, 3398, 5255, 1703, 16286, 1795, 3041, 12650, 8878, 2459, 8934, 2461, 16138, 13363, 2254, 14838; Payload ID: 2087 relates to Category No.: 4828, 5255, 1703, 1795, 2459, 8934, 1035, 13371, 13363; Payload ID: 2089 relates to Category No.: 5255, 1703, 14456, 1417, 9994, 16214, 1432, 2945, 14014, 14452, 3825, 5459, 5462, 986, 6296, 5458, 991, 11640; Payload ID: 2090 relates to Category No.: 5255, 1703, 9994, 1886; Payload ID: 2091 relates to Category No.: 5255, 1703, 7735; Payload ID: 2092 relates to Category No.: 5255, 16189; Payload ID: 2093 relates to Category No.: 5255, 1703; Payload ID: 2094 relates to Category No.: 5255, 1703; Payload ID: 2095 relates to Category No.: 2945, 6322, 14545, 14056, 6296, 2080, 14058, 6834, 6867, 6841, 6836, 13530, 6103, 1408; Payload ID: 2096 relates to Category No.: 2945; Payload ID:

2097 relates to Category No.: 2409, 7710, 1795, 3365, 7728, 13767; Payload ID: 2098 relates to Category No.: 14661, 1512, 5291, 6733, 11676, 13031, 14663, 2902, 6738, 11293, 8390, 8454, 6967, 12117, 5290, 8522, 7834, 4723, 8535, 11922, 8547, 11401, 11253, 13228, 11295, 7673, 8519, 8506, 1898, 6731, 1420, 12066; Payload ID: 2099 relates to Category No.: 12137, 11512, 10372, 11259, 1922, 11183, 10296; Payload ID: 2100 relates to Category No.: 11910; Payload ID: 2101 relates to Category No.: 4828, 1795, 12137, 434, 12041, 10486, 10309, 12409, 10208, 13859, 8420, 13186, 9459; Payload ID: 2102 relates to Category No.: 4828, 690, 12137, 1417, 1795, 1468, 4828, 2745, 10309, 12409, 2122, 434, 10372, 4949, 11391, 8638, 8112; Payload ID: 2103 relates to Category No.: 12091, 5446, 1816, 12544, 328, 7658, 11602, 2945, 729, 3016, 734, 10855, 8424, 3015, 3713, 16095, 10309, 12409, 3715, 7667, 10487, 14053, 7680, 10947, 6137, 8912, 4826, 10818, 8731, 3398, 360, 1893, 3566, 10486, 7216, 10208, 5428, 434, 1836, 12953, 13978, 2068, 8962, 13867, 8420, 3161, 4132, 8638, 11146, 16106, 8371, 2136, 496, 16102, 12948; Payload ID: 2104 relates to Category No.: 14565, 1836, 7131; Payload ID: 2105 relates to Category No.: 14565, 10775, 12190, 6814; Payload ID: 2106 relates to Category No.: 1737, 690, 795, 1703, 7613, 10372, 1955, 11109, 7743, 3448, 8300, 12646, 10366, 8541, 11285, 2902, 11293, 2136, 8524, 7834, 14834, 10362, 11291, 10583, 4039, 8535, 12630, 10382, 10344, 8378, 13909, 10588, 1993, 10296, 10368, 11425, 8266, 2068, 10086, 10991, 15381, 3654, 10951; Payload ID: 2107 relates to Category No.: 9994, 1408, 10486, 1912; Payload ID: 2110 relates to Category No.: 15490, 3398, 14565, 16286, 11506, 3398, 5786, 11512; Payload ID: 2111 relates to Category No.: 16197, 13892, 16313, 10255; Payload ID: 2112 relates to Category No.: 7710, 8519; Payload ID: 2113 relates to Category No.: 14565; Payload ID: 2114 relates to Category No.: 5785, 1722, 14569, 5541, 11291, 11174, 8488, 11176, 8487, 1859, 8599, 8598, 360, 12091, 11934; Payload ID: 2115 relates to Category No.: 1722, 5541; Payload ID: 2116 relates to Category No.: 14565, 16214, 10005, 14067, 14063, 9995; Payload ID: 2117 relates to Category No.: 14565; Payload ID: 2119 relates to Category No.: 14817, 3808; Payload ID: 2120 relates to Category No.: 15149, 1415, 1204, 15156, 6723; Payload ID: 2121 relates to Category No.: 13041, 1415, 1417, 12573; Payload ID: 2122 relates to Category No.: 1415, 12573, 13041, 14663, 13004, 3728, 8918, 7341, 13189, 11143, 14124; Payload ID: 2123 relates to Category No.: 13041, 1415, 12573; Payload ID: 2124 relates to Category No.: 13041, 1415, 12573, 3140; Payload ID: 2125 relates to Category No.: 1026, 15626, 15149, 1415, 13678, 8918, 12126, 1417; Payload ID: 2126 relates to Category No.: 1026, 15626, 15149, 1415, 13678, 1409, 8918, 10301, 16214; Payload ID: 2127 relates to Category No.: 15149, 1415, 13678, 8918, 1026, 15626, 1417, 6723, 15207; Payload ID: 2128 relates to Category No.: 1026, 15626, 15149, 1415, 13678, 8918, 6723, 13126, 8911, 1417, 14910, 15400, 484, 1836, 15207, 3140, 15149, 4588, 7341, 4375, 4374, 9769, 8947, 1470; Payload ID: 2129 relates to Category No.: 8825; Payload ID: 2130 relates to Category No.: 13041, 15626, 7340, 1415, 14369; Payload ID: 2131 relates to Category No.: 15626, 15149, 1415, 6723, 15622, 12483, 13126, 8911, 8918, 6734; Payload ID: 2132 relates to Category No.: 15149, 1415, 1417, 15622, 12483; Payload ID: 2133 relates to Category No.: 15626, 15149, 1415, 6723, 15622, 12483; Payload ID: 2134 relates to Category No.: 15626, 1415, 15622, 12483; Payload ID: 2135 relates to Category No.: 13041, 1415, 1417; Payload ID: 2136 relates to Category No.: 1415, 1417, 15622, 12483; Payload ID:

2137 relates to Category No.: 15149, 1415, 1417, 15622, 12483; Payload ID: 2138 relates to Category No.: 5846, 1415, 1409, 6724, 15618, 13041, 5848, 1026, 14663, 13004, 10486, 12596, 3728, 1717, 1419, 1452, 15149, 16213, 1417, 484, 1836, 14693, 12544, 1420, 13659, 5544, 4873, 4535, 13271, 14694; Payload ID: 2139 relates to Category No.: 1026, 15618, 442, 14456, 5846, 1415, 1409, 1417, 5848, 14663, 13004, 13328, 12954, 13329, 3728, 10301, 6727, 12514, 6729, 13041; Payload ID: 2140 relates to Category No.: 15618, 13041, 5846, 1415, 1409, 6724, 1417, 16214, 5848, 13563, 15197, 3140, 14056, 1836, 1048, 3041; Payload ID: 2141 relates to Category No.: 15618, 13041, 5846, 1415, 1409, 6724, 5848, 1026, 1417, 7340, 14640, 14636, 14624, 15012, 8918, 3676, 7333, 7385, 4037, 14618; Payload ID: 2142 relates to Category No.: 15618, 13041, 15626, 5846, 15149, 1409, 6724, 1417, 5848, 6723, 1415, 12544, 8977, 12573, 6296, 12948, 13978; Payload ID: 2143 relates to Category No.: 15618, 13041, 5846, 15149, 1415, 1409, 6724, 1417, 1727, 5848, 14663, 13004, 10486, 6723, 3728, 2228, 1746, 15622, 8922, 13126, 8911, 484, 1119, 1420, 15140, 4538, 8920, 3041, 15149, 4588, 8373, 13978, 1421, 12526, 2229, 12405, 14886, 4375, 4374, 8919, 12575, 5263, 2177, 8973, 1841, 15089, 8956, 12455, 8968, 2237, 2225, 16173, 8088, 7354, 14892, 14124; Payload ID: 2144 relates to Category No.: 15618, 13041, 5846, 1415, 1409, 6724, 1417, 5848, 15626, 15149, 14663, 13004, 6723, 3728, 16213, 15622, 8911, 1119, 4535, 12953, 6296, 1112, 4131, 14454, 14831, 13978, 13005, 13500; Payload ID: 2145 relates to Category No.: 1026, 15618, 13041, 15626, 5846, 1415, 1409, 6724, 13126, 5848, 10303, 15149, 12953, 325, 12513, 13960; Payload ID: 2146 relates to Category No.: 1026, 15618, 13041, 15626, 2000, 5846, 1415, 1409, 6724, 7345, 13126, 7385, 5848, 7340, 12948, 522, 2733, 2095, 10187; Payload ID: 2147 relates to Category No.: 1026, 15618, 13041, 15626, 14565, 5846, 1415, 1409, 6724, 5848, 8946, 14646; Payload ID: 2148 relates to Category No.: 8862, 14267, 7743, 1836, 13695, 11107; Payload ID: 2149 relates to Category No.: 13041, 11940, 5846, 1415, 1651, 14458, 14462, 936, 14450, 14459; Payload ID: 2150 relates to Category No.: 1649, 5846; Payload ID: 2151 relates to Category No.: 1649, 5846; Payload ID: 2152 relates to Category No.: 14565, 3012, 16197, 3775, 12414; Payload ID: 2153 relates to Category No.: 13589, 3398, 5785, 13186; Payload ID: 2154 relates to Category No.: 14661, 12137, 5782, 14565, 403, 9238, 14997, 363, 10301; Payload ID: 2155 relates to Category No.: 14997, 13514; Payload ID: 2156 relates to Category No.: 1922, 2095, 11519, 13589, 3398, 15517, 11512; Payload ID: 2157 relates to Category No.: 12091, 11512, 1721, 10501, 11291, 11174, 11053, 8507, 11094, 13363, 13342, 11251, 11443, 11239, 13193, 11433, 14565, 9238; Payload ID: 2158 relates to Category No.: 12091, 5428, 10459, 11182, 11102, 11094, 12753, 11328, 12932, 10238, 7613; Payload ID: 2159 relates to Category No.: 12091; Payload ID: 2160 relates to Category No.: 12091, 1026, 14661, 2885, 15149, 5446, 6606, 348, 11109, 9713, 1417, 4186, 702, 12391, 4127, 3775, 5541, 16085, 8988, 4332, 11858, 1995, 13236, 5610, 10301, 13909, 12671, 13238, 10319, 13159; Payload ID: 2161 relates to Category No.: 12091, 1026, 14661, 14565, 2885, 15149, 5446, 6606, 348, 4186, 11432, 12391, 4127, 3775, 5541, 16085, 8988, 12573, 11858, 1995, 5610, 10503, 12671, 11094, 13084, 13526, 12759, 13473, 9713, 10241, 4332, 1417, 8920, 13794, 5438, 13532, 2370, 351, 11189, 1778; Payload ID: 2162 relates to Category No.: 12091, 13594, 1026, 14661, 2885, 15149, 5446, 12633, 6606, 348, 9713, 4186, 12391, 4127, 3775, 5541, 16085, 8988, 11858, 1995, 12596, 12954, 12948, 12066, 5610, 9716, 12617, 13409, 12671, 1922, 12589, 12895, 13571, 3667, 10324, 8644, 13686, 13450, 12590, 12618, 13406, 10319, 13121, 12662, 1555, 12969, 8643, 1562, 4332, 1417, 13497, 13882, 11390, 11391, 10583, 12887, 1884, 1747, 11304; Payload ID: 2163 relates to Category No.: 12091, 1026, 14661, 2885, 15149, 5446, 6606, 348, 11910, 4186, 12391, 4127, 3775, 5541, 16085, 8988, 12573, 5544, 1995, 12066, 5610, 12671, 13473, 11858, 4332, 1417, 13406; Payload ID: 2164 relates to Category No.: 7834; Payload ID: 2165 relates to Category No.: 7834; Payload ID: 2166 relates to Category No.: 12091, 5785, 9713, 11858, 14565, 5428, 15149, 5446, 403, 11506, 3398, 4186, 13280, 3775, 8988, 6322, 7377, 355, 13558, 9238, 11251, 8956; Payload ID: 2167 relates to Category No.: 12091, 15149, 360, 11265; Payload ID: 2168 relates to Category No.: 12091, 9720, 6606, 11506, 3398, 1451, 13360, 11858; Payload ID: 2169 relates to Category No.: 12091, 1703, 8977, 15149, 4021, 4749, 4425, 7754, 8196, 8835, 7767, 11512, 1409, 10298; Payload ID: 2170 relates to Category No.: 14838; Payload ID: 2171 relates to Category No.: 4828, 1409, 674, 1836, 9451, 3121, 2310, 10648, 12573, 10250, 1984, 13969, 13909, 10372, 2006, 13796, 16102, 13939, 11601, 2149, 9932, 1417, 795, 5912, 13845, 439, 11216, 10801, 2087, 10298, 1320, 2045, 1997, 4095; Payload ID: 2173 relates to Category No.: 3431, 3639, 2493, 10543; Payload ID: 2174 relates to Category No.: 5785, 7131; Payload ID: 2177 relates to Category No.: 7340, 7252; Payload ID: 2178 relates to Category No.: 12153, 1730, 7306, 14838; Payload ID: 2179 relates to Category No.: 11926, 14586, 11884, 1202; Payload ID: 2180 relates to Category No.: 7743, 8936; Payload ID: 2181 relates to Category No.: 4828, 1026, 13248, 14661, 14565, 1512, 10074, 15149, 5446, 6606, 348, 4186, 12391, 4127, 3775, 14663, 12743, 6738, 14992, 5541, 16085, 8988, 8601, 4538, 1238, 7340, 15042, 10080, 12594, 4686, 12596, 11248, 11291, 9053, 10005, 16211, 5501, 14111, 13437, 8447, 12953, 3121, 13409, 11176, 355, 13796, 11240, 11200, 12618, 11349, 10462, 10464, 13815, 13775, 1451, 13450, 11113, 12964, 328, 9982; Payload ID: 2182 relates to Category No.: 4828, 1026, 13248, 14661, 14565, 1512, 10074, 15149, 5446, 6606, 348, 4186, 12391, 4127, 3775, 14663, 12743, 6738, 14992, 5541, 16085, 8988, 8601, 4538, 1238, 7340, 15042, 10080, 12594, 4686, 12596, 11248, 11291, 9053, 10005, 16211, 5501, 14111, 13437, 8447, 12953, 3121, 13409, 11176, 355, 13796, 11240, 11200, 12618, 11349, 10462, 10464, 13815, 13775, 1451, 13450, 11113, 12964, 328, 9982; Payload ID: 2183 relates to Category No.: 4828, 1026, 13248, 14661, 14565, 1512, 10074, 15149, 5446, 6606, 348, 4186, 12391, 4127, 3775, 14663, 12743, 6738, 14992, 5541, 16085, 8988, 8601, 4538, 1238, 7340, 15042, 10080, 12594, 4686, 12596, 11248, 11291, 9053, 10005, 16211, 5501, 14111, 13437, 8447, 12953, 3121, 13409, 11176, 355, 13796, 11240, 11200, 12618, 11349, 10462, 10464, 13815, 13775, 1451, 13450, 11113, 12964, 328, 9982; Payload ID: 2184 relates to Category No.: 11512, 15517, 8920; Payload ID: 2185 relates to Category No.: 13594, 11512, 15517, 1565; Payload ID: 2186 relates to Category No.: 2940, 8936, 12640; Payload ID: 2187 relates to Category No.: 6969, 13274; Payload ID: 2188 relates to Category No.: 6961, 6969, 3807, 8454, 13274, 13143, 16338; Payload ID: 2191 relates to Category No.: 14565, 3781; Payload ID: 2193 relates to Category No.: 9691; Payload ID: 2195 relates to Category No.: 11926, 746, 12105, 2506, 12063, 1893, 15156, 11927, 11660, 743, 496, 2276; Payload ID: 2196 relates to Category No.: 12194, 10372, 4020, 4021, 12404, 6566; Payload ID: 2197 relates to Category No.: 12194, 275, 2009, 10801, 1844, 10666, 10863, 15804, 11570; Payload ID: 2198 relates to Category No.: 12194; Payload ID: 2199 relates to Category No.: 12194; Payload ID: 2200 relates to Category No.: 12194; Payload ID: 2201 relates to Category No.: 12194; Payload ID: 2202 relates to Category No.: 12194, 13589, 3398; Payload ID: 2203 relates to Category No.: 12194, 12746, 12195, 1906, 1227, 7385, 13882; Payload ID: 2204 relates to Category No.: 12194, 14565, 795, 7613, 8731, 3398, 12603, 11109, 11506, 3398, 12993, 7345, 14428, 11884, 12026, 8542, 7390, 11323, 7332, 14365, 11300, 1922, 13796, 11352, 13953, 7347, 2111, 13205, 994, 4334; Payload ID: 2205 relates to Category No.: 12194, 14565, 6391, 9485, 4850; Payload ID: 2206 relates to Category No.: 12194, 12746, 6967; Payload ID: 2207 relates to Category No.: 12194, 14428, 10573; Payload ID: 2208 relates to Category No.: 12194, 3244; Payload ID: 2209 relates to Category No.: 12194, 3244; Payload ID: 2210 relates to Category No.: 12194, 10372, 4020, 4021; Payload ID: 2211 relates to Category No.: 12194; Payload ID: 2212 relates to Category No.: 8787, 8441, 7912, 1295, 7710, 496, 6269, 3541, 7385, 9411, 7381, 7725; Payload ID: 2213 relates to Category No.: 378, 13491; Payload ID: 2214 relates to Category No.: 2940, 378, 2051, 12466, 12646, 7737, 10648, 16294, 4998, 8453; Payload ID: 2215 relates to Category No.: 378, 3791, 7631; Payload ID: 2216 relates to Category No.: 13589, 3398, 11926, 1722, 12427, 8739, 3684, 10372, 8731, 3398, 8582, 12498, 746, 8760, 1836, 12063, 1893, 742, 15223, 742, 12117, 11927, 4518, 11660, 8375, 12051, 10498, 11182, 12036, 10522, 14478, 11922, 10349, 2158, 919, 11425, 9623, 8172, 10648, 2711, 13116, 14838, 13835, 13827, 2044, 13970, 2080, 14022, 2276, 1557; Payload ID: 2217 relates to Category No.: 11926, 1730, 14838; Payload ID: 2218 relates to Category No.: 15618, 12095, 5846, 14365, 13477, 13867, 3676, 13409, 14636, 13970, 13955, 13822, 13461; Payload ID: 2219 relates to Category No.: 15618, 12095, 5846, 8601, 13127, 12596, 12953, 3121, 15012, 12617, 13409, 8489, 14478, 1562, 1921, 12274, 8488, 14365; Payload ID: 2220 relates to Category No.: 5255, 1703, 12633, 11431, 11436; Payload ID: 2221 relates to Category No.: 5255, 11431, 11436; Payload ID: 2222 relates to Category No.: 5255, 12633, 15140, 11431, 15149, 4588, 11436, 15149, 4342, 11277; Payload ID: 2223 relates to Category No.: 10074, 1204, 1238, 10080, 13969, 7710, 9737; Payload ID: 2224 relates to Category No.: 12091; Payload ID: 2225 relates to Category No.: 12091, 1026, 13589, 3398, 11512, 14565, 15149, 5446, 11506, 3398, 4186, 7362, 9891, 4127, 9125, 3775, 16197, 8988, 15003, 12117, 15456, 15450, 7363, 15448, 15443, 10606, 15454, 2469, 15446, 15653, 15457, 15458, 13970, 15451, 8732, 355, 10910, 13858, 13827, 11051, 1048, 1993, 14413, 6758, 5998, 12649, 10034, 6559, 11150, 10762, 6377, 6387, 15818, 2156, 12498, 2094, 2131, 13882, 496, 13767, 10238, 13919, 15570, 15517, 2068, 2010, 13961, 16213, 8004, 8374, 12717, 1969, 10923, 13780, 11344, 11545, 2312, 12880, 12901; Payload ID: 2226 relates to Category No.: 13589, 3398, 15490, 3398, 11512, 12633, 15517, 11506, 3398, 12646, 2311, 10366, 16197, 13831, 7724, 11037, 2911, 10491, 10301, 11529, 3921, 13691, 5424, 10489, 7915, 8212, 3684; Payload ID: 2227 relates to Category No.: 13589, 3398, 3684, 15517, 7306, 11520, 9455, 7915, 4019, 11512; Payload ID: 2228 relates to Category No.: 13589, 3398, 3684, 11506, 3398, 2376, 13831, 1622, 15517, 11512, 3833; Payload ID: 2229 relates to Category No.: 13589, 3398, 11512, 3684, 15517, 11520, 10203; Payload ID: 2230 relates to Category No.: 13589, 3398, 11512, 3684, 15517, 14838; Payload ID: 2231 relates to Category No.: 13589, 3398, 15517, 11506, 3398; Payload ID: 2232 relates to Category No.: 13589, 3398, 15490, 3398, 14565, 1721, 1730, 11506, 3398, 12117, 10606, 11174, 10666, 10910; Payload ID: 2233 relates to Category No.: 13589, 3398, 15490, 3398, 14565, 1730, 7306, 14838, 11512, 8731, 3398, 2469, 4729, 2467, 13797, 14083, 4538, 4110, 12717; Payload ID: 2234 relates to Category No.: 1737, 7710, 7154, 13370, 7132, 4336, 10666, 10663, 3431, 11305; Payload ID: 2235 relates to Category No.: 1204, 1995; Payload ID: 2239 relates to Category No.: 7288, 14271, 1204, 4439, 7295, 13618, 14211, 9223, 9103, 5777; Payload ID: 2241 relates to Category No.: 1737, 14661, 2167, 7154, 9274, 7132, 8454, 982, 12023, 14895, 264; Payload ID: 2244 relates to Category No.: 1204; Payload ID: 2270 relates to Category No.: 4828, 442, 4828, 2745, 1481, 1035, 4535, 14838, 13925, 496, 13966, 13837, 10238, 8394, 13811, 11094, 6626, 7658, 14454, 13951, 6758, 13961, 6103, 13532, 4588, 10282, 13071, 13004, 12868, 8185, 7894, 7973, 10618, 13532, 4342, 10204, 8257, 7570, 13288; Payload ID: 2271 relates to Category No.: 4828, 5367, 5428, 4828, 2745, 1481, 13925, 8394, 13775, 14454, 8112, 8257, 7570, 8672, 4342; Payload ID: 2274 relates to Category No.: 8004, 13086, 10924; Payload ID: 2275 relates to Category No.: 5446, 15456; Payload ID: 2277 relates to Category No.: 6902, 7285, 182, 1498; Payload ID: 2278 relates to Category No.: 6902, 182, 1499; Payload ID: 2279 relates to Category No.: 1026, 14565, 10074, 2940, 328, 1238, 10080, 3924, 274, 12427, 1764, 608; Payload ID: 2280 relates to Category No.: 1026, 14565, 2940, 328, 3924, 1764; Payload ID: 2281 relates to Category No.: 14661, 7154, 7132, 6967, 11008, 12140; Payload ID: 2283 relates to Category No.: 10238, 1795, 4094, 11285, 15782, 10543, 2277, 13635, 10588, 8301, 10669, 9681, 6720; Payload ID: 2285 relates to Category No.: 8739, 15490, 3398, 6371; Payload ID: 2286 relates to Category No.: 5446, 1078, 11884, 1238, 7252; Payload ID: 2287 relates to Category No.: 5446, 1078, 11884, 1238, 7252; Payload ID: 2288 relates to Category No.: 1078, 14834; Payload ID: 2289 relates to Category No.: 1764, 13059, 274, 1078, 7991, 2940, 12640, 1238, 7252, 8936, 6018, 1779, 8301, 7341, 13362; Payload ID: 2290 relates to Category No.: 1078, 11884, 1775; Payload ID: 2291 relates to Category No.: 11512, 8760, 7735, 10314, 11174, 11242, 10495, 10503; Payload ID: 2292 relates to Category No.: 15993, 823, 10129, 4595, 11602, 14663, 1878, 13925, 15661, 9068, 2996, 4686, 9053, 2485, 5248, 1501, 12194, 13859, 1970, 14025, 13827, 6269, 14009, 13866, 13773, 14054, 14011, 13797, 7002, 13858, 13772, 13851, 13823, 5019, 1925, 1981, 13968, 707, 2078; Payload ID: 2293 relates to Category No.: 1830, 4595, 14663, 9068, 3474, 11858, 12303, 15993, 823, 2996, 2997, 9236, 9716, 12306, 6269, 1957, 4145, 9411, 13772, 5998, 4949, 13795, 14022, 1960, 16044, 13816; Payload ID: 2294 relates to Category No.: 1505, 1512, 14663, 4723, 2385, 2383, 12646, 11634, 7613, 3613, 1622, 11628, 3578, 3194, 3595, 2374, 8756, 3614, 13756, 10159; Payload ID: 2295 relates to Category No.: 1512, 1505, 14663, 4723, 2385, 2383, 3106; Payload ID: 2296 relates to Category No.: 1512, 1505, 14663, 4723, 2385, 2383; Payload ID: 2297 relates to Category No.: 1512, 14663, 4723, 2385, 7131, 2383, 10491, 15090, 15197, 10386, 9737; Payload ID: 2298 relates to Category No.: 5428, 1512, 14663, 4353, 4723, 5930, 5932, 10160, 15090; Payload ID: 2299 relates to Category No.: 1512, 1505, 14663, 4723, 2385, 3106, 3109; Payload ID: 2300 relates to Category No.: 1505, 5261, 2169, 12190, 15090; Payload ID: 2301 relates to Category No.: 1512, 1505, 5261, 14663, 4723, 12190, 2385, 2383, 15090; Payload ID: 2302 relates to Category No.: 1512, 14663, 4723, 2385, 2383, 5044; Payload ID: 2303 relates to Category No.: 5367, 5428, 1512, 1703, 1816, 7443, 7252, 15090, 12118; Payload ID: 2304 relates to Category No.: 1512, 14663, 7443, 4723, 5930, 5932, 15090, 12118; Payload ID: 2305 relates to Category No.: 1512, 14663, 7443, 4723, 5930, 5932, 15090; Payload ID: 2306 relates to Category No.: 1512, 14663, 7443, 4723, 2385, 2383, 10160, 15090; Payload ID: 2307 relates to Category No.: 5428, 1512, 7306, 14663, 7443, 4723, 5930, 5932, 15090; Payload ID: 2308 relates to Category No.: 6814, 1204; Payload ID: 2309 relates to Category No.: 1703, 1505, 6102, 6322; Payload ID: 2310 relates to Category No.: 9374, 1181, 14663; Payload ID: 2311 relates to Category No.: 9374, 13031, 702, 1181, 14663, 12492, 10512, 7242, 14403, 11436, 4342, 10391, 12693, 13836, 13970, 5949, 14054, 10289, 14011, 9321, 13983, 11150, 1971; Payload ID: 2312 relates to Category No.: 9374, 1181, 14663, 3100, 13837, 13975; Payload ID: 2313 relates to Category No.: 9374, 1181, 14663, 6814; Payload ID: 2314 relates to Category No.: 9374, 1181, 14663, 2006, 13597, 7242, 14403, 13882, 13827, 14022; Payload ID: 2315 relates to Category No.: 9374, 1181, 14663; Payload ID: 2316 relates to Category No.: 6814, 9374, 1181, 14663; Payload ID: 2317 relates to Category No.: 9374, 3125, 1181, 14663; Payload ID: 2318 relates to Category No.: 9374, 1181, 14663, 7131, 10491, 11436, 4342, 10391, 12693; Payload ID: 2319 relates to Category No.: 9374, 9891; Payload ID: 2320 relates to Category No.: 1295; Payload ID: 2322 relates to Category No.: 9374, 1181, 2328, 14663; Payload ID: 2323 relates to Category No.: 9374, 1181, 14663; Payload ID: 2324 relates to Category No.: 1181, 14663; Payload ID: 2325 relates to Category No.: 6814, 9500, 2835, 14663, 3474, 815, 3791, 16233; Payload ID: 2326 relates to Category No.: 6814, 9500, 2562, 10007; Payload ID: 2327 relates to Category No.: 6814, 9500, 4104, 11941, 2974, 3466; Payload ID: 2328 relates to Category No.: 2207, 14090, 1204; Payload ID: 2329 relates to Category No.: 6814, 6212, 16308, 14663, 14025, 3791; Payload ID: 2330 relates to Category No.: 16308, 1627, 14663, 6814; Payload ID: 2331 relates to Category No.: 6212, 6814; Payload ID: 2332 relates to Category No.: 6814; Payload ID: 2333 relates to Category No.: 6212, 6814; Payload ID: 2334 relates to Category No.: 6814; Payload ID: 2335 relates to Category No.: 12194; Payload ID: 2336 relates to Category No.: 12194, 11879; Payload ID: 2337 relates to Category No.: 12194, 1893, 10491, 696, 12489; Payload ID: 2338 relates to Category No.: 12194, 5095; Payload ID: 2339 relates to Category No.: 12194; Payload ID: 2340 relates to Category No.: 12194; Payload ID: 2341 relates to Category No.: 12194; Payload ID: 2342 relates to Category No.: 12194, 1238, 4180, 1984, 6271, 13867, 13827, 7983, 10598, 8475, 8068; Payload ID: 2343 relates to Category No.: 12194; Payload ID: 2344 relates to Category No.: 12194, 6814, 1894, 8962, 16286, 1893, 12026, 1551, 5537; Payload ID: 2345 relates to Category No.: 12194, 674; Payload ID: 2346 relates to Category No.: 12194, 13859, 1292; Payload ID: 2347 relates to Category No.: 12603, 12117; Payload ID: 2348 relates to Category No.: 12194; Payload ID: 2349 relates to Category No.: 12194, 15405, 15427, 9631; Payload ID: 2350 relates to Category No.: 12194; Payload ID: 2351 relates to Category No.: 12194; Payload ID: 2352 relates to Category No.: 12194, 16286; Payload ID: 2353 relates to Category No.: 12194; Payload ID: 2354 relates to Category No.: 690, 5255, 1752, 5592, 1238, 6145; Payload ID: 2355 relates to Category No.: 14456; Payload ID: 2361 relates to Category No.: 9777; Payload ID: 2362 relates to Category No.: 7613, 5256, 7600, 8356; Payload ID: 2363 relates to Category No.: 14565, 1816, 1238, 6145; Payload ID: 2365 relates to Category No.: 5367, 1238, 6145; Payload ID: 2366 relates to Category No.: 9940, 9945, 14663, 4653, 9839, 1594; Payload ID: 2367 relates to Category No.: 8534, 7673, 13473; Payload ID: 2368 relates to Category No.: 8862, 10372, 1816, 7345, 1795, 1780, 11582, 8928, 6132; Payload ID: 2369 relates to Category No.: 2885, 10372, 10785, 10266, 1060, 5910, 1795, 8373, 10248, 11582, 10875; Payload ID: 2370 relates to Category No.: 15626, 1867, 14663, 4102, 1605, 2533, 6814; Payload ID: 2371 relates to Category No.: 4110, 4100, 1867, 14663, 2554, 4448, 4102, 1605, 6658, 4115, 13827, 13971, 6814; Payload ID: 2372 relates to Category No.: 4100, 1867, 14663, 6305, 2469, 3791, 1609, 1605, 13969, 11940, 13827, 4538, 1969, 15664, 3529, 13004, 10608, 12865, 6814; Payload ID: 2373 relates to Category No.: 4100, 1867, 14663, 1609, 6306, 6814; Payload ID: 2374 relates to Category No.: 6814, 4100, 1605; Payload ID: 2375 relates to Category No.: 4100, 1867, 14663, 1609; Payload ID: 2376 relates to Category No.: 12194, 6814; Payload ID: 2377 relates to Category No.: 6902, 1614; Payload ID: 2378 relates to Category No.: 1613; Payload ID: 2379 relates to Category No.: 4828, 14565, 8962, 15149, 2467, 1816, 348, 1853, 8424, 2116, 7667, 481, 7619, 10282, 10570, 11555, 12554, 13004, 8015, 14786; Payload ID: 2380 relates to Category No.: 1035, 9333, 8556; Payload ID: 2381 relates to Category No.: 2276, 4021, 12117, 8485, 14838, 9703; Payload ID: 2383 relates to Category No.: 8120; Payload ID: 2384 relates to Category No.: 1703, 795, 7613, 14640, 4021, 9410, 6192, 4885; Payload ID: 2385 relates to Category No.: 1703, 14569, 9966; Payload ID: 2387 relates to Category No.: 15618, 15626; Payload ID: 2388 relates to Category No.: 15626; Payload ID: 2389 relates to Category No.: 15618, 12117, 5998; Payload ID: 2390 relates to Category No.: 12091, 1737, 14565, 12648, 16286, 9777, 9713, 7154, 1795, 10314, 4766, 5731, 12941, 1764; Payload ID: 2391 relates to Category No.: 12091, 12648, 16286, 9777, 9713; Payload ID: 2392 relates to Category No.: 12648, 3639, 16286, 9713, 12091, 14565, 11237, 6975, 2467, 3354, 3833, 14894, 12013, 9099, 12063, 2669, 9420, 11285, 1893, 6738, 7132, 10314, 4336, 4766, 11660, 12717, 12021, 12008, 2068; Payload ID: 2393 relates to Category No.: 12091, 14565, 12648, 11237, 3639, 16286, 2467, 9713, 3354, 9420, 7132, 4336, 2469, 12717, 1892, 10314, 8831; Payload ID: 2394 relates to Category No.: 12091, 12648, 3639, 16286, 9713, 11858; Payload ID: 2395 relates to Category No.: 12091, 14565, 12648, 3639, 16286, 9713, 14865, 14663, 10314, 14862, 11858; Payload ID: 2396 relates to Category No.: 12091, 14565, 12648, 1894, 3639, 16286, 9713; Payload ID: 2397 relates to Category No.: 12091, 1026, 13589, 3398, 15490, 3398, 14565, 2276, 16286, 10372, 7840, 7132, 10362, 11243, 11620, 14123, 7164; Payload ID: 2398 relates to Category No.: 12091, 10372, 10362, 11243; Payload ID: 2399 relates to Category No.: 12091, 1026, 13589, 3398, 15490, 3398, 795, 16286, 7132, 13165, 11294, 7164, 12619; Payload ID: 2400 relates to Category No.: 9982, 13360, 12091, 1026, 14565, 16286, 11167, 7743, 7132, 454, 7659, 1889, 12767, 10202, 3719; Payload ID: 2401 relates to Category No.: 11926, 12195, 11169; Payload ID: 2402 relates to Category No.: 12194, 12195, 11940; Payload ID: 2403 relates to Category No.: 14565; Payload ID: 2404 relates to Category No.: 1204; Payload ID: 2405 relates to Category No.: 12498, 14565, 3313, 14567, 2051, 4041, 334, 10241; Payload ID: 2406 relates to Category No.: 12194, 334, 795, 7613, 11109, 12498, 10775, 7965, 7840, 11765, 16197, 7548, 4039, 336, 13217, 11766, 12858, 14636, 14619, 13455, 14639, 14638, 13216, 8353, 7967, 803; Payload ID: 2407 relates to Category No.: 12194, 795, 12999, 334, 14565, 5446, 10775, 2051, 9292, 6125, 2080, 12498, 13788, 13925, 12099, 10478, 13882, 12519, 13785, 5616, 15471, 12328, 6734, 11766, 10819, 10822, 7035; Payload ID: 2408 relates to Category No.: 12194, 334, 795, 5446, 12498, 803, 1795, 10775; Payload ID: 2409 relates to Category No.: 795, 12498, 12194, 3684, 14428; Payload ID: 2410 relates to Category No.: 12194, 334, 795, 5808, 3781, 4040, 5936, 2700; Payload ID: 2411 relates to Category No.: 12194, 334, 795, 5808, 10238, 12498, 803, 12099, 4040, 3974, 3313, 14567, 8988, 2051, 12734, 10241, 3536, 1295, 496, 11089, 6395, 8886; Payload ID: 2412 relates to Category No.: 12194, 795, 8929, 5939, 7613, 3854, 803, 4040, 3974, 792, 11765, 4020, 8988, 4021, 5072, 14029, 4039, 1844, 5806, 335, 12734, 10086, 1955, 12099, 7724, 1741, 4949, 14456, 14050, 8923, 1061, 14034, 2080, 7644, 15197, 7835, 7571, 4473, 13835, 5785, 2079, 13969, 13925, 13859, 13882, 16294, 13827, 10238, 11089, 13970, 13773, 13860, 13939, 5073, 10331, 13961, 13877, 6103, 13810, 13779, 14052; Payload ID: 2413 relates to Category No.: 12194, 795, 12498, 12999, 5806, 5810; Payload ID: 2414 relates to Category No.: 12194, 795, 12999, 12498, 15042, 2051, 12328, 10822, 3536; Payload ID: 2415 relates to Category No.: 12194, 795, 3974, 11765, 1844, 3791; Payload ID: 2416 relates to Category No.: 12194, 795, 3974, 11765, 1844, 5806, 335, 12099, 4949, 8923, 14034, 496; Payload ID: 2418 relates to Category No.: 12194, 334, 795, 12195, 5446, 12498, 803, 1795, 3974, 10775, 7840, 11765, 16197, 14992, 15782, 15456, 15450, 7363, 15448, 15185, 7548, 14029, 15653, 2051, 4039, 336, 13217, 15485, 11766, 12858, 1844, 7533, 1053, 5806, 9292, 6125, 13635, 9295, 11300, 8103, 11260, 3009, 10947, 6468, 333, 15177, 10600, 690, 4949, 4041, 8889, 8362, 13578, 5016, 12499, 13835, 2079, 13925, 11934, 13812, 13837, 13810, 13779; Payload ID: 2419 relates to Category No.: 12194, 795, 12498, 803, 2139, 5808, 5446, 1955, 4186, 4040, 9891, 4127, 3775, 11765, 8988, 4039, 5806, 335, 14571, 13420, 10086, 334, 1951, 14034, 11089, 13835, 2079, 13969, 13925, 496, 10238, 13810, 4473, 13779; Payload ID: 2420 relates to Category No.: 795; Payload ID: 2421 relates to Category No.: 12498, 11884, 352; Payload ID: 2422 relates to Category No.: 15207, 5446, 11109, 12498, 4127, 14992, 4749, 4425, 15192, 10475, 10266, 14565, 15388, 10775, 11460, 12994, 12530, 10839, 11445, 13557; Payload ID: 2423 relates to Category No.: 795, 7613, 11109, 12498, 11285, 15782, 352; Payload ID: 2424 relates to Category No.: 7912, 12498; Payload ID: 2425 relates to Category No.: 7912, 12498; Payload ID: 2426 relates to Category No.: 5428, 7912, 12498; Payload ID: 2427 relates to Category No.: 8103; Payload ID: 2428 relates to Category No.: 795, 12498; Payload ID: 2429 relates to Category No.: 334, 10822, 10470, 8103, 12498; Payload ID: 2430 relates to Category No.: 5446, 12498, 10775, 14992, 10878, 11419, 9292, 6125, 9295, 13827, 13840, 3021, 13020, 13023, 11566, 3016, 10851, 10794, 13854, 13982, 13952, 13633, 5359; Payload ID: 2431 relates to Category No.: 13589, 3398, 15490, 3398, 8375, 14063, 14075, 8579, 7592; Payload ID: 2432 relates to Category No.: 7306, 5340, 5474, 1893, 417; Payload ID: 2433 relates to Category No.: 952, 8887, 5462, 14586, 8888, 2547, 8876, 16172, 2940, 3974, 2886, 792; Payload ID: 2434 relates to Category No.: 4653; Payload ID: 2436 relates to Category No.: 9500, 13975, 7613, 12133, 10359, 5300, 14663, 12242, 11941, 9236, 13998, 13877, 9455, 12252, 16049, 2355, 15664, 8390, 486, 11109, 11187, 4996, 13835, 14046, 13977, 13882, 14025, 496, 13888, 13827, 14040, 13837, 13794, 13767, 5949, 13996, 13916, 1993, 13881, 13915, 13920, 13843, 14034, 16005, 13884, 13984; Payload ID: 2437 relates to Category No.: 16308, 15149, 6902, 14663, 1640, 8971, 8970, 3428, 1642, 2093, 3427,

US 11,446,398 B2

1925

13969, 13925, 13459, 13827, 4145, 8571, 6102, 3198, 8636, 14545, 13978, 7892, 3934, 7314, 10758; Payload ID: 2438 relates to Category No.: 6902; Payload ID: 2439 relates to Category No.: 1703, 286, 3807, 14661, 1814, 16085, 450, 7334, 11053, 1749, 776, 2007, 12646, 1892, 7613, 7966, 3924, 11394, 10601, 7740, 8368, 8123, 6530, 13969, 11934, 496, 13836, 9321, 9485, 1031, 4403; Payload ID: 2440 relates to Category No.: 1703, 14589, 1296, 1048, 3041, 7334, 11053, 11713, 12372, 13526; Payload ID: 2441 relates to Category No.: 1703, 14589, 12954, 1345, 13662; Payload ID: 2442 relates to Category No.: 1703, 14108; Payload ID: 2443 relates to Category No.: 12632, 15490, 3398, 14661, 11512, 795, 1703, 16286, 5446, 8731, 3398, 687, 1483, 10238, 7743, 11506, 3398, 14589, 11765, 10314, 8542, 448, 12488, 9600, 3812, 13827, 11573, 1844, 12007, 7334, 11053, 13835, 13364, 15134, 10745, 10578, 1993, 14949, 10527, 5443, 4933, 12570, 1487, 2007, 13489, 11085, 13219, 10720, 12678, 3611, 1495, 8318, 3567, 12880, 3719, 1492, 12680, 14565, 8739, 13589, 3398, 13594, 1730, 12646, 14643, 16096, 5406, 4419, 1892, 10955, 15149, 3642, 5949, 722, 3445, 12891, 13713, 8934, 10648, 15143, 1318, 8004, 3437, 8929, 10624, 4939, 10372, 1765, 3532, 3583, 15400, 1820, 4949, 14640, 4998, 6375, 4251, 12498, 1780, 1751, 10775, 3587, 3578, 6523, 8374, 8424, 2079, 13562, 6117, 1744, 7730, 1743, 9554, 3814, 10983, 3584, 12628, 11382, 11147, 13280, 14688, 6082, 1277, 15195, 9321, 3594, 3442, 10572, 12821, 3793, 4940, 6192, 9459, 7243, 7618, 1886, 3568, 13705, 15194, 9406, 11468, 11465, 13277, 3644, 12213, 7799, 10508, 8415, 9375, 8880, 16095, 13457, 6787, 6879, 4477, 2179, 4935, 13200, 450, 4451, 10556, 15167, 9487, 15482, 15480, 6372, 6390, 6380, 10576, 6778, 10291, 4326, 13719, 13707, 8852, 2416, 10434, 13969, 11934, 1970, 13874, 13836, 6269, 13794, 13767, 2051, 2044, 13818, 7381, 7002, 14388, 2010; Payload ID: 2444 relates to Category No.: 13589, 3398, 15490, 3398, 1703, 16286, 14589, 7693, 1814, 16085, 450, 1749, 1295; Payload ID: 2445 relates to Category No.: 13589, 3398, 15490, 3398, 14565, 1703, 16286, 15143, 14589, 12583, 3060, 6102, 13530, 7238; Payload ID: 2446 relates to Category No.: 8831, 11147, 8611, 8507, 724, 1318, 11038, 8281, 13654, 8739, 16286, 8509, 7879, 8636, 8750; Payload ID: 2447 relates to Category No.: 795, 10238, 7291, 16182, 14271, 4439, 14775; Payload ID: 2448 relates to Category No.: 3013, 3012, 2041, 2014, 2136, 10372, 11285, 2021, 10226, 3015, 3016, 2089; Payload ID: 2449 relates to Category No.: 12194, 10331, 5782, 14865, 12063, 1893, 14663, 3405, 11660, 4729, 12688; Payload ID: 2450 relates to Category No.: 12194, 12195, 5446, 12603, 12498, 4020, 4021, 2569, 15456, 3791, 2128, 3010, 16189, 14838, 7728, 14636, 13969, 14050, 13936, 13837, 2051, 13860, 13981, 13818, 1002, 13772, 13900; Payload ID: 2451 relates to Category No.: 12194, 334, 5367, 12195, 3833, 10241, 12063, 2669, 1893, 6738, 11169, 11660, 11301, 795, 15200, 496, 13970; Payload ID: 2452 relates to Category No.: 12194, 1002, 11878, 4020, 4021, 2569, 743; Payload ID: 2453 relates to Category No.: 12194, 3244, 11878, 743, 11859; Payload ID: 2454 relates to Category No.: 12194, 12195, 743; Payload ID: 2455 relates to Category No.: 12194, 12091, 5367, 12099, 1893, 4020, 4021, 696, 10780, 13925, 3016, 8045, 3014, 9009; Payload ID: 2456 relates to Category No.: 12194, 334, 7613, 12195, 10372, 403, 10241, 10366, 736, 10648, 1893, 11169, 3846, 14000, 6878, 10573, 10226, 6741, 15121, 16342, 11912, 2128, 15200, 5374, 8958, 1292, 3236; Payload ID: 2457 relates to Category No.: 12194, 12195, 5446, 4020, 4021, 2569, 15456, 13165, 11294, 1277, 5802; Payload ID: 2458 relates to Category No.: 12194, 12195, 5446, 403, 736, 4020, 4021, 2569,

1926

15456, 743, 6461, 2128; Payload ID: 2459 relates to Category No.: 12194, 12195; Payload ID: 2460 relates to Category No.: 12194, 5367, 12195, 5446, 403, 746, 12099, 736, 4020, 742, 4021, 2569, 15456, 743, 742, 15224, 1092, 2128, 13765, 745, 10334, 10790; Payload ID: 2461 relates to Category No.: 12194, 12195, 4020, 4021, 743, 8196, 12099, 4939, 12461, 11859, 14838, 6530, 13969, 1714, 13859, 13860, 13863, 2116, 3010, 7305, 14521, 8854, 996; Payload ID: 2462 relates to Category No.: 12194, 5367, 12195; Payload ID: 2463 relates to Category No.: 12194, 12195, 3833, 12063, 2669, 1893, 6738, 11660, 696, 3814; Payload ID: 2464 relates to Category No.: 15618, 13041, 1730, 5846, 1415, 1409, 6724, 7306, 5848, 14831, 14586, 14840, 7304, 14838, 1417, 12573, 4328, 12716; Payload ID: 2465 relates to Category No.: 15618, 13041, 1730, 5846, 1415, 1409, 6724, 7306, 14838, 5848, 14831, 14586, 14840, 7304, 4167, 14817; Payload ID: 2466 relates to Category No.: 15618, 13041, 5846, 1415, 1409, 6724, 7306, 5848, 14831, 14586, 14840, 7304, 14817, 14742; Payload ID: 2467 relates to Category No.: 15618, 5846, 1415, 1409, 6724, 5848, 14831, 13041, 7306, 14586, 14840, 7304, 14817, 14742; Payload ID: 2468 relates to Category No.: 7306, 14586, 14840, 7304, 14817; Payload ID: 2469 relates to Category No.: 7306, 14838, 14831, 14586, 14840, 7304, 14817; Payload ID: 2470 relates to Category No.: 1730, 7306, 14838, 14586, 14840, 7304; Payload ID: 2471 relates to Category No.: 13589, 3398, 11512, 1730, 15517, 7306, 13501, 9410, 722, 9599, 724, 1274; Payload ID: 2472 relates to Category No.: 13589, 3398, 1730, 8739, 15517, 7306, 13501, 9410, 722, 5755, 15736, 13594, 14782, 9599, 724, 1227, 1240, 3699, 5986, 10036, 10358, 3926, 11506, 3398, 10372; Payload ID: 2473 relates to Category No.: 13589, 3398, 11512, 1730, 15517, 7306, 9410, 722, 8739, 724, 1240, 5986, 10036; Payload ID: 2474 relates to Category No.: 13248, 11940, 8739, 16165, 2359, 1417, 803, 1836, 6226, 13491, 7693, 2945, 14663, 16085, 10314, 13882, 11298, 1238, 11601, 8546, 1660, 11997, 6559, 2088, 1408, 6145, 5407, 2353, 8191, 15664, 12001, 7662, 12954, 11174, 11242, 6723, 9053, 10864, 7924, 7937, 15192, 8507, 13836, 8256, 8547, 8446, 14636, 10600, 7600, 10581, 13796, 2116, 13788, 16096, 11495, 10345, 1967, 2005, 12543, 10643, 13989, 6506, 10302, 8392, 703, 13662, 12590, 12410, 10991, 12618, 1662, 13449, 12429, 8470, 8487, 6566, 12864, 9051, 12042, 13290, 13128, 8448, 13039, 12815, 6606, 11658, 7743, 10648, 2131, 690, 11169, 8362, 5998, 7849, 8255, 12066, 13571, 8617, 16099, 13909, 8394, 13573, 8795, 13859, 13936, 16294, 11371, 13827, 13966, 2051, 8375, 10543, 9411, 2351, 6980, 8636, 7946, 10558, 2158, 13856, 8340, 11008, 7713; Payload ID: 2475 relates to Category No.: 10702, 16165, 16158, 3676, 13171, 16160, 5541, 7122, 1660, 10955, 7924, 14624, 10530, 12429, 7743, 10558, 8756, 12066; Payload ID: 2476 relates to Category No.: 1730, 3639, 1746, 10061, 7345, 13496, 13126, 12041, 1660, 11997, 10486, 12594, 8522, 2353, 15664, 12948, 7332, 8256, 8526, 12953, 8488, 13663, 6746, 11299, 4535, 8255, 13664, 7703, 12570, 8394, 11008, 7679, 13475, 16129, 7748, 15759, 13467, 13220, 8602, 13123, 12572, 8487, 286, 13616, 12573, 3152, 1556, 7417, 12558, 9307, 13361, 11069, 2902, 3910, 7385, 10065, 4954, 13286, 8271, 10372, 7736, 10335; Payload ID: 2477 relates to Category No.: 12153, 13469, 14565, 1795, 9075, 5785, 5367, 15185, 11243, 8689, 11447, 7591, 13874, 13864; Payload ID: 2478 relates to Category No.: 12154, 12153, 1795, 7933, 8255, 7934; Payload ID: 2479 relates to Category No.: 13589, 3398, 12154, 12153, 7613, 4186, 1795, 3775, 15570, 11187, 11316, 7933; Payload ID: 2480 relates to Category No.: 12153, 12614, 14589, 10366, 10543, 7719; Payload ID:

2481 relates to Category No.: 13594, 13589, 3398, 15490, 3398, 795, 8731, 3398, 14656, 13818, 8421, 11506, 3398, 6705, 9238, 8831, 8373, 1780, 10036, 10648, 13979, 13925, 15570, 13888, 6697, 13892, 13893, 11542, 13836, 13797, 6878, 10025, 1318, 6785, 13901, 13899, 13900, 13902, 14026, 13894, 16096, 1295, 14921, 5986, 3568, 8285; Payload ID: 2482 relates to Category No.: 13589, 3398, 15490, 3398, 11512, 1730, 7613, 8739, 8731, 3398, 4949, 13259, 11506, 3398, 7737, 1780, 10648, 3176, 13882, 8004, 11542, 9480, 13836, 10379, 16137, 10349, 6269, 14532, 14910, 9086, 13270, 471, 10952, 13846, 8744, 11181, 3590, 6107, 15736, 13594, 16096, 5406, 16136, 8887, 472, 6530, 14620, 4952, 15400, 1240, 15570, 2169, 3010, 8889, 1274, 4969, 6117, 9738, 3573, 3605, 3620, 3853, 1580, 4844, 12233, 16095, 3172, 1573, 3607, 6141, 2754, 13936, 1993, 1709; Payload ID: 2483 relates to Category No.: 13589, 3398, 15490, 3398, 13836, 11506, 3398; Payload ID: 2484 relates to Category No.: 13622, 9223, 9103; Payload ID: 2485 relates to Category No.: 13589, 3398, 15490, 3398, 11512, 2885, 11237, 15516, 8731, 3398, 15517, 7743, 4094, 16197, 7835, 4448, 6215, 6269, 4535, 6375, 4844, 11530, 7372, 8739, 13594, 12646, 11506, 3398, 2355, 7724, 1334, 1751, 6468, 2079, 9125, 5458, 7122, 10606, 11147, 16279, 3605, 15993, 2044; Payload ID: 2486 relates to Category No.: 13589, 3398, 5367, 11512, 5428, 381, 3013, 13280, 13831, 10606, 10845, 11520, 8688, 9485, 4848, 15326, 13611, 5024, 6271, 15517, 8731, 3398, 11506, 3398, 13925, 8929, 1906, 1334, 13023, 8373, 4094, 6561, 11147, 3605, 6562, 5810, 2079, 2041, 2014, 6269, 6758; Payload ID: 2487 relates to Category No.: 13589, 3398, 15517, 11512; Payload ID: 2488 relates to Category No.: 13589, 3398, 11512, 15517, 3012, 3013, 9777, 10648, 2876, 6468, 2041, 7372; Payload ID: 2489 relates to Category No.: 13594, 13589, 3398, 5367, 11512, 15517, 1060, 11363, 10521, 8611, 10813, 6269, 10513, 7540, 3747, 7284; Payload ID: 2490 relates to Category No.: 11512, 15517; Payload ID: 2491 relates to Category No.: 8739, 8731, 3398, 2409, 11506, 3398, 10648, 2429, 12891, 3783, 9279, 12680, 13176, 3783, 13589, 3398, 15517, 11512, 3337, 8004, 12892, 12980, 6490, 12968; Payload ID: 2492 relates to Category No.: 11512, 1721, 15517, 11506, 3398, 10648, 3339, 12892, 5203, 12976; Payload ID: 2494 relates to Category No.: 13589, 3398, 15490, 3398, 11512, 10372, 11506, 3398, 2347; Payload ID: 2495 relates to Category No.: 5367; Payload ID: 2496 relates to Category No.: 15490, 3398, 8739, 8582, 7306, 8760, 9224, 10483, 4439, 9223, 3001, 8169, 4441, 11130, 11046, 14216, 3994, 11129, 3001, 13509; Payload ID: 2497 relates to Category No.: 13589, 3398, 15490, 3398, 9224, 4439, 9223, 3001, 13618, 4442; Payload ID: 2498 relates to Category No.: 13589, 3398, 15490, 3398, 9224, 1780, 4439, 9223, 3001, 13618, 4442; Payload ID: 2499 relates to Category No.: 13594, 13589, 3398, 15490, 3398, 8739, 8760, 9224, 10483, 4439, 9223, 3001, 8169, 14216, 3994, 13509, 4442, 15736; Payload ID: 2500 relates to Category No.: 13589, 3398; Payload ID: 2501 relates to Category No.: 9224, 4439, 9223, 3001, 11860; Payload ID: 2502 relates to Category No.: 13589, 3398, 15490, 3398, 10372, 9224, 10483, 4439, 3996, 9223, 3001, 4441, 14216, 3994, 13618, 9223, 9088, 10907; Payload ID: 2503 relates to Category No.: 7288, 13589, 3398, 15490, 3398, 10372, 9224, 10483, 4439, 9223, 3001, 14216, 3994, 4442, 7278; Payload ID: 2504 relates to Category No.: 15490, 3398, 14565, 1512, 10372, 8760, 7743, 9224, 4439, 3996, 9223, 3001, 4441, 11130, 11046, 14216, 3994, 11129, 3001, 8004, 4442, 11512, 3000, 2904; Payload ID: 2505 relates to Category No.: 13589, 3398, 15490, 3398, 10372, 8760, 7743, 9224, 4439, 3996, 9223, 3001, 4441, 11046, 14216, 3994; Payload ID: 2506 relates to Category No.: 16172; Payload ID: 2507 relates to Category No.: 16172; Payload ID: 2508 relates to Category No.: 6814, 1795, 11061; Payload ID: 2509 relates to Category No.: 7912, 8756, 8835, 4937, 8196, 8535, 13052, 9460; Payload ID: 2510 relates to Category No.: 795, 5446, 9777, 5359, 1795, 7362, 11765, 2041, 15456, 15450, 7363, 15448, 10814, 11566, 15446, 15653, 15457, 15458, 4039, 336, 2043, 12427, 10543, 13788, 6248, 13947, 11573, 5428, 13925, 13867, 13837, 13932, 13829, 14029, 10478; Payload ID: 2511 relates to Category No.: 1703, 1795, 4021, 1749, 4990, 1752, 15203; Payload ID: 2512 relates to Category No.: 1795, 1780, 12994, 1849, 3015; Payload ID: 2513 relates to Category No.: 12427, 381; Payload ID: 2514 relates to Category No.: 12427, 7131, 10491; Payload ID: 2515 relates to Category No.: 5367, 14565, 4998, 1703, 7306, 7743, 7345, 5037, 7719; Payload ID: 2517 relates to Category No.: 1238, 6145; Payload ID: 2518 relates to Category No.: 5428, 5446, 10917, 2041, 1067; Payload ID: 2519 relates to Category No.: 1070, 5446, 4186, 1795, 9891, 4127, 12994, 3775, 8988, 1849; Payload ID: 2520 relates to Category No.: 5367, 403, 736, 3990; Payload ID: 2521 relates to Category No.: 5367, 403, 736, 3990; Payload ID: 2522 relates to Category No.: 403, 15186, 736, 3990, 5367; Payload ID: 2523 relates to Category No.: 5446, 16197, 11460, 10794, 3119, 15210, 5041, 736, 3990, 736, 3649; Payload ID: 2524 relates to Category No.: 5367, 403, 736, 3990; Payload ID: 2525 relates to Category No.: 7291, 16182, 14271, 14918, 4439, 8454; Payload ID: 2526 relates to Category No.: 795, 1703, 14589, 1795, 1238, 15185, 6145, 10815, 10856, 11566, 7533, 5041, 6747, 11058, 13557; Payload ID: 2527 relates to Category No.: 5255, 12994, 5037, 1789; Payload ID: 2528 relates to Category No.: 12994, 16197; Payload ID: 2530 relates to Category No.: 3021, 746, 742, 15223, 742; Payload ID: 2531 relates to Category No.: 5785, 3639, 5446, 403, 16191, 736, 5790, 14992, 7187, 5037, 16189, 6137, 16203, 13562, 1815, 9627; Payload ID: 2532 relates to Category No.: 1703; Payload ID: 2533 relates to Category No.: 14565, 5255, 1703, 12994, 5037, 11078, 1789, 11077, 10784, 10957, 10613, 2878; Payload ID: 2534 relates to Category No.: 1703, 11178, 8375, 1752, 8922, 5037, 793, 8936, 1795, 11094, 10219, 10307, 803, 10263, 6137, 12530, 2353, 5256, 10344, 7644, 15156, 794, 10379, 8368, 13947, 12742, 12650, 11690, 11457, 6147, 10804, 10381, 8370, 12651, 10791, 2301, 7950, 7948, 11455, 8684, 5367; Payload ID: 2535 relates to Category No.: 14565, 1238, 6145; Payload ID: 2536 relates to Category No.: 15207, 5446, 1795, 4130, 12994, 16197, 15192, 12750; Payload ID: 2537 relates to Category No.: 1204, 1752, 10372, 6403, 10552, 675; Payload ID: 2538 relates to Category No.: 5367, 5428, 1295, 7613, 1795, 12646, 10265, 7840, 15782, 13925, 10878, 10955, 4039, 4041, 13693, 5381, 8680, 13837; Payload ID: 2539 relates to Category No.: 5367, 14565, 13818, 1795, 11460, 8129, 7571, 10827, 8138, 15192, 8784, 15471, 8688, 10366; Payload ID: 2540 relates to Category No.: 5367, 1780, 12994, 15185, 11460, 10813, 10841, 8112, 10287, 11147, 8688, 8128, 8148; Payload ID: 2541 relates to Category No.: 5446, 5285, 4186, 1795, 9891, 4127, 3775, 10648, 16197, 8988, 11460, 8004, 11607, 11546, 15192, 11033, 12750, 10839, 2876, 13685, 11512, 8840, 10219, 15207, 803, 11266, 10876, 11187, 13405, 10791; Payload ID: 2542 relates to Category No.: 1737, 14565, 7154, 11884, 15045, 1740, 11275, 12461, 8757, 11843, 14589, 1752, 16165, 13403; Payload ID: 2543 relates to Category No.: 5446, 12994, 2041, 10957, 9006; Payload ID: 2544 relates to Category No.: 12994, 5376; Payload ID: 2545 relates to Category No.: 12994, 5376; Payload ID: 2546 relates to Category No.: 12994, 5376, 5389; Payload ID: 2547 relates to Category No.: 14565, 1703, 13563, 12994, 7644, 8261, 5376, 8255, 7645, 11200, 7990, 8258, 8396, 8453, 3729, 8383, 7928, 7572, 7931; Payload ID: 2548 relates to Category No.: 14565, 12994, 5376, 1849; Payload ID: 2549 relates to Category No.: 5446, 12994; Payload ID: 2550 relates to Category No.: 9777; Payload ID: 2551 relates to Category No.: 12633, 14663, 2540, 16234, 16275, 13677; Payload ID: 2552 relates to Category No.: 14565, 1703, 1816, 7743, 12994; Payload ID: 2553 relates to Category No.: 14565, 4998, 1820, 14589, 1767, 12544, 1780, 12994, 10648, 6145, 8004, 8782, 11541, 10826, 6769, 4974, 8374, 10226, 15425, 3715, 7657, 9569, 4494, 8392, 14950, 11136, 8150, 10653, 4492, 3725, 15536, 16094, 10689, 4011, 6848, 7768, 7770, 11600, 1703; Payload ID: 2554 relates to Category No.: 6219, 1703, 12427, 14459, 10074, 5446, 2359, 746, 7362, 6226, 9052, 1867, 14663, 742, 15223, 742, 6256, 1238, 15456, 15450, 10080, 10486, 10583, 15446, 15457, 15458, 2264, 12813, 10382, 13843, 6304, 10946, 13923, 5752, 6335, 2354, 15666, 5751, 10053, 13922, 8739, 9777, 12432, 10955, 11178, 8004, 1795, 10775, 11566, 2041, 3016, 790, 8045, 10851, 9597, 10829, 11182, 3729, 10945, 1914, 2043, 11307, 10426, 10280, 2002, 8737, 14013, 13410, 10281; Payload ID: 2555 relates to Category No.: 1795, 7743, 3019, 12748, 10785, 12989, 8350; Payload ID: 2556 relates to Category No.: 6814, 14565, 1070, 7613, 8731, 3398, 10266, 803, 11506, 3398, 13827, 13835, 13882, 13989, 6299, 13874, 10486, 4145, 11601, 13893, 14000, 13818, 10362, 7667, 10801, 13878; Payload ID: 2557 relates to Category No.: 11512, 15207, 1795, 12994, 15194, 15192, 11626; Payload ID: 2558 relates to Category No.: 4828, 5785, 15207, 15614, 12498, 1795, 11884, 12994, 10648, 14556, 15185, 11460, 8004, 15192, 11178, 10814, 8840, 10219, 10307, 6408, 8639, 803, 10839, 11445, 11447, 10845, 13966, 15195; Payload ID: 2559 relates to Category No.: 15516, 15614, 4439, 12891, 3783, 8004, 3783, 15520, 15498, 15290, 14320; Payload ID: 2560 relates to Category No.: 12137, 15207, 5446, 1795, 11884, 4130, 12994, 15185, 15192, 3924, 13091; Payload ID: 2561 relates to Category No.: 5367, 15207, 14565, 1703, 15614, 5446, 403, 1795, 13551, 16197, 15194, 16189, 15192, 11265, 12750, 3754, 10839, 5421, 3744, 6506, 15210, 12073, 11178, 3015, 10307, 2878, 11445, 4966, 13835, 11460, 14045, 10302, 15185; Payload ID: 2562 relates to Category No.: 5367, 5428, 7613, 10074, 5901, 1066, 12994, 15782, 10829, 6137, 10552, 1060, 5387, 12997; Payload ID: 2563 relates to Category No.: 11512, 10702, 10074, 11109, 7306, 1066, 803, 1836, 10775, 12646, 11884, 12994, 11285, 15782, 13925, 10954, 2051, 11268, 11581, 10552, 10266, 3019, 3021, 1053, 11980, 10876, 10829, 5373, 12997, 5428, 2041; Payload ID: 2564 relates to Category No.: 1512, 2885, 5291, 1703, 7613, 1820, 14589, 7840, 14663, 4020, 4021, 1238, 5290, 6145, 4723, 11174, 11178, 10583, 5610, 1970, 7883, 14566, 8178, 1622, 10726, 7215, 11035, 10648, 1318, 16286, 16295, 1316, 10887; Payload ID: 2565 relates to Category No.: 5446, 403, 2610, 2488, 10648, 14586, 15201, 11460, 12724, 8004, 11541, 10826, 16189, 5627, 13257, 14479, 10981, 11319, 7823, 12194, 7710; Payload ID: 2566 relates to Category No.: 1703, 10372, 5592, 4021, 1238, 6145, 11445, 10379, 11182, 13788, 10790, 9391; Payload ID: 2567 relates to Category No.: 3012, 1238, 6145, 14565, 15185, 6612; Payload ID: 2568 relates to Category No.: 12427, 1780, 1789, 803, 15192; Payload ID: 2569 relates to Category No.: 795, 12427, 1849; Payload ID: 2570 relates to Category No.: 10486, 13746; Payload ID: 2571 relates to Category No.: 14565, 1795, 11063; Payload ID: 2572 relates to Category No.: 5446, 2610, 2488, 10486, 12724, 10339, 579, 16189, 13746, 13076, 1684, 574, 7823, 10339, 572, 14838, 7710, 6627, 13981; Payload ID: 2573 relates to Category No.: 1703, 14589, 2013, 2136, 1238, 6145, 10856, 5041; Payload ID: 2574 relates to Category No.: 12724, 5446, 3833, 1795, 12063, 2669, 1893, 6738, 1238, 11660, 7613, 11460, 7573; Payload ID: 2575 relates to Category No.: 1703, 12427; Payload ID: 2576 relates to Category No.: 12137, 10074, 1752, 1820, 1238, 1892, 10080, 11313, 13652, 3701, 10022, 13448, 10806, 10025, 10019, 10343, 10543, 7938, 3791; Payload ID: 2577 relates to Category No.: 2080; Payload ID: 2578 relates to Category No.: 14565, 1957; Payload ID: 2579 relates to Category No.: 5367, 15614, 403, 15185, 5243; Payload ID: 2580 relates to Category No.: 5367, 14565, 1816, 1780, 15782, 4039; Payload ID: 2581 relates to Category No.: 1026, 14565, 1703; Payload ID: 2582 relates to Category No.: 5367, 5782, 14565, 7613, 10266, 1780, 11884, 736, 743, 11178, 10583, 11102, 11802, 10626, 10480, 13096, 7883, 14566, 8178, 10945, 10413, 15210, 8442, 5381, 737, 10496, 11626, 8840, 11452, 3012, 8264, 2273, 11569, 8682, 6472, 345; Payload ID: 2583 relates to Category No.: 1070, 403, 1060, 1066, 1795, 1053; Payload ID: 2584 relates to Category No.: 5367, 14565, 403, 1795, 1070; Payload ID: 2585 relates to Category No.: 5785, 5446, 1816, 11506, 3398, 4186, 9891, 11371, 4127, 3775, 8988, 15185, 11178, 16189, 15192, 11479, 10839, 10691, 10219, 11460, 2041; Payload ID: 2586 relates to Category No.: 11512, 10372, 10266, 345, 1795, 1780, 12994, 11997, 13376, 11178, 16189, 12024, 12430, 10182, 11244, 12642, 14050, 12646, 12936; Payload ID: 2587 relates to Category No.: 1795; Payload ID: 2588 relates to Category No.: 14565, 5285, 3012, 12737, 10840, 10826, 13969, 8154, 10339, 575; Payload ID: 2589 relates to Category No.: 5255, 3012, 1238, 6145; Payload ID: 2590 relates to Category No.: 5367, 5446, 10372, 403, 1816, 11506, 3398, 4186, 9891, 4127, 3775, 8988, 15185, 16189, 15192, 10839, 11486, 10935, 10844, 3021, 1053, 11460, 2041, 15456, 15448, 1948, 13925, 496, 13827, 13892, 15204, 7377, 10197, 14053, 8679, 2054; Payload ID: 2591 relates to Category No.: 5367, 15614, 1795, 736, 12994, 15201, 15185, 2952, 3021, 10307; Payload ID: 2592 relates to Category No.: 5367, 15614, 403, 12994, 16197, 15185, 12750; Payload ID: 2593 relates to Category No.: 1703, 10074, 1795, 14586, 4328, 1238, 7304, 10080, 7252, 9575, 7743, 1295, 14048, 9349; Payload ID: 2594 relates to Category No.: 9777, 14589, 16197, 6459, 7131, 10491, 7657; Payload ID: 2595 relates to Category No.: 5367, 1703, 12994; Payload ID: 2596 relates to Category No.: 1703; Payload ID: 2597 relates to Category No.: 1703; Payload ID: 2598 relates to Category No.: 1737, 9982, 1721, 13360, 12732, 1780, 7132, 4332; Payload ID: 2599 relates to Category No.: 1737, 1721, 12732, 1780, 6668; Payload ID: 2600 relates to Category No.: 12091, 5785, 1752, 275, 378, 6969, 9187; Payload ID: 2601 relates to Category No.: 12091, 5785, 14565, 1752, 2940, 275, 378, 3924, 274; Payload ID: 2602 relates to Category No.: 12091, 5785, 275; Payload ID: 2603 relates to Category No.: 10702, 12648, 14108, 11302, 10192; Payload ID: 2604 relates to Category No.: 10702, 12648, 274, 286, 14108, 11302, 10192, 11245; Payload ID: 2605 relates to Category No.: 14565, 10702, 12648, 14108, 11302, 10192; Payload ID: 2606 relates to Category No.: 10702, 12648, 14108, 11302, 10192; Payload ID: 2607 relates to Category No.: 10702, 12648, 14108, 11302, 10192, 5912; Payload ID: 2608 relates to Category No.: 15618, 14661, 10702, 13435, 5846, 15149, 10238, 803, 13485, 8988; Payload ID: 2609 relates to Category No.: 14565, 12648, 9777, 8049; Payload ID: 2610 relates to Category No.: 14565, 12648, 9777, 13465; Payload ID:

2611 relates to Category No.: 12091, 13445, 1780, 9713, 9716, 11858, 9720; Payload ID: 2612 relates to Category No.: 12091, 13445, 11858, 13904, 8021, 9720, 13970, 14000; Payload ID: 2613 relates to Category No.: 12091, 13445, 11858, 9720; Payload ID: 2614 relates to Category No.: 12091, 13445, 11858, 9720; Payload ID: 2615 relates to Category No.: 12668; Payload ID: 2616 relates to Category No.: 12519, 7305, 7129; Payload ID: 2618 relates to Category No.: 15898, 12154, 10372, 4332, 11265; Payload ID: 2619 relates to Category No.: 1737, 1721, 12619, 1238; Payload ID: 2620 relates to Category No.: 1737, 1721, 12619; Payload ID: 2621 relates to Category No.: 14214, 1295, 13229, 7835, 6458, 12732; Payload ID: 2622 relates to Category No.: 15715, 1204, 15712, 4439, 14214, 15709, 6458, 6512; Payload ID: 2623 relates to Category No.: 8906, 1295, 6969, 11506, 3398, 9420, 7132, 3889, 4336, 2198, 6967, 2429, 13229, 7775, 13505, 8375; Payload ID: 2624 relates to Category No.: 12732, 1295, 3684, 1780, 8541, 8390, 11298, 13229, 8535, 7150, 8255, 12155, 11372, 11275, 13300, 8523, 794, 7763, 7151, 11512; Payload ID: 2625 relates to Category No.: 10526, 6508; Payload ID: 2626 relates to Category No.: 1955, 11371, 7735, 10362, 13376; Payload ID: 2628 relates to Category No.: 14565, 9858, 9945, 14663, 10005, 9841, 4653, 1694, 1693; Payload ID: 2629 relates to Category No.: 9945, 14663, 9841, 4653, 1694; Payload ID: 2630 relates to Category No.: 9940, 9858, 9945, 14663, 4653, 1695, 6814; Payload ID: 2631 relates to Category No.: 1780; Payload ID: 2633 relates to Category No.: 1703, 7334, 11053, 2243, 11512, 10955, 724, 11091, 13229, 6111, 1744, 11285, 3598, 11382, 11084, 11386, 3569, 13355, 15011, 7385, 14631, 3608; Payload ID: 2634 relates to Category No.: 5255, 795, 1730, 7306, 14838, 1814, 450, 5037, 1789, 15122, 11077, 1749, 10478, 3157, 1703, 15974, 15140, 1269, 1446; Payload ID: 2635 relates to Category No.: 5255, 1814, 450, 5037, 1789, 1749; Payload ID: 2636 relates to Category No.: 5255, 1814, 450, 5037, 1789, 1749, 11997; Payload ID: 2637 relates to Category No.: 5255, 5037, 1789; Payload ID: 2638 relates to Category No.: 1026, 14565, 1703, 8934, 483, 8936, 4004, 8373, 2562; Payload ID: 2639 relates to Category No.: 7288, 15490, 3398, 1721, 16286, 8731, 3398, 1955, 10238, 14034, 7710, 14271, 12777, 3559, 7735, 10314, 1995, 13376, 8503, 7044, 12717, 12671, 14123, 8177, 13347, 10515, 13589, 3398; Payload ID: 2640 relates to Category No.: 8760, 10495, 10503; Payload ID: 2641 relates to Category No.: 2228, 484, 12371, 2219, 7778; Payload ID: 2642 relates to Category No.: 1721, 10372, 10349, 11512, 13434; Payload ID: 2643 relates to Category No.: 6219, 13589, 3398, 15490, 3398, 795, 12498, 1727, 8756, 6226, 11365, 8782, 7958, 15273, 7847, 8216, 12497, 14013; Payload ID: 2644 relates to Category No.: 795, 5808, 3974, 11322, 10356, 333; Payload ID: 2645 relates to Category No.: 13589, 3398, 15490, 3398, 795, 12498, 3974, 6223; Payload ID: 2646 relates to Category No.: 795, 5809, 15782; Payload ID: 2647 relates to Category No.: 1721, 1737, 1722, 10372, 13166, 13618, 4276; Payload ID: 2648 relates to Category No.: 3100, 11910, 1737, 9718, 2459, 1780, 12848, 7167, 7133; Payload ID: 2649 relates to Category No.: 9718, 3100, 3354, 11910, 329, 4335; Payload ID: 2650 relates to Category No.: 1737, 7154, 13171, 1780, 7132, 670, 11587, 13644, 7163, 8797, 11959; Payload ID: 2651 relates to Category No.: 1737, 14661, 1721, 12153, 7154, 11432, 329, 7132, 670, 11587, 13644, 7163, 8797, 11435, 13116, 10372, 12753; Payload ID: 2653 relates to Category No.: 1737, 15898, 13170, 7154, 7132, 670, 11587, 13644, 7163, 8797, 11959, 7153, 12848, 6880; Payload ID: 2654 relates to Category No.: 1737, 9718, 2139, 12619, 13996, 3356, 11910, 7154, 12732, 1780, 7132, 4336, 4332, 7152; Payload ID: 2655 relates to Category No.: 12091, 1737, 9718, 10372, 11910, 7154, 10481, 7132, 4336, 11027, 7152, 11265, 9378, 4141; Payload ID: 2656 relates to Category No.: 1737, 9718, 14661, 12619, 3356, 11910, 7154, 12732, 13171, 1780, 16197, 7132, 4336, 7152, 14838; Payload ID: 2657 relates to Category No.: 1737, 13170, 7154, 7132, 670, 11587, 13644, 7163, 8797, 11959; Payload ID: 2658 relates to Category No.: 1780, 7132, 670, 11587, 13644, 7163, 8797, 11959, 6880, 1737; Payload ID: 2659 relates to Category No.: 11843, 12153, 1894, 12096, 3360, 2012, 4332, 11967, 7692, 11089, 13865, 10789; Payload ID: 2660 relates to Category No.: 11926, 12732, 12117, 12122, 13012, 13640, 11658, 7131, 13360; Payload ID: 2661 relates to Category No.: 11926, 12117; Payload ID: 2662 relates to Category No.: 15517, 7291, 16182, 14271, 15291, 4439, 4445, 7280, 7261; Payload ID: 2663 relates to Category No.: 1026, 14661, 12137, 14565, 12153, 3766, 5446, 274, 13485, 10481, 4130, 3775, 16085, 11302, 1238, 4766, 9421, 12881, 15042, 10362, 3881, 8509, 15192, 7334, 11053, 7933, 3924, 11425, 6468, 12515, 5938, 1892, 10955, 7303, 4200, 10648, 3923, 8004, 11186, 4939, 3782, 11174, 3639, 280, 13360, 1483, 13376, 13171, 4948, 11285, 9187, 10575, 13343, 4940, 9307, 13355, 450, 8931, 13367, 5936, 3807, 3050, 10705, 3817, 1548, 11089, 14928, 286, 10522, 10878, 10991, 11433, 15034, 278, 10861; Payload ID: 2664 relates to Category No.: 3356, 3320, 7132, 3360, 3450, 3357, 4332, 11714, 12709, 10637, 7147, 13612, 3369; Payload ID: 2665 relates to Category No.: 13589, 3398, 15490, 3398, 3354, 7291, 16182, 14271, 4439, 14573, 1970, 2068, 7132, 2018, 2153, 2098; Payload ID: 2666 relates to Category No.: 1737, 13170, 3356, 7743, 7154, 12732, 10481, 7132, 3360, 3357, 4332, 7890, 13612, 15638, 10435, 10626, 10466, 2144, 1908; Payload ID: 2667 relates to Category No.: 12091, 1737, 12648, 9777, 10372, 3356, 9713, 7132, 3360, 3450, 4332, 11128, 10638, 1725; Payload ID: 2668 relates to Category No.: 15499, 11512, 1721, 8739, 16286, 7743, 7287, 7997, 2041, 11509, 8349, 11620, 7939, 14949, 5218, 5145, 7990, 11912, 11044, 3644; Payload ID: 2669 relates to Category No.: 13589, 3398, 15490, 3398, 795, 1721, 10372, 7291, 16182, 14271, 10366, 8408, 4439; Payload ID: 2670 relates to Category No.: 1737, 7154, 11248, 2429; Payload ID: 2671 relates to Category No.: 1737, 12153, 7154, 1204; Payload ID: 2673 relates to Category No.: 1737, 7154, 3448, 7138, 7132, 4332, 7158, 10592, 7153, 12720, 10354; Payload ID: 2674 relates to Category No.: 13589, 3398, 15490, 3398, 795, 12646; Payload ID: 2675 relates to Category No.: 13589, 3398, 15490, 3398, 10372; Payload ID: 2676 relates to Category No.: 1737, 14661, 7132, 2424, 7153; Payload ID: 2677 relates to Category No.: 1722, 1703, 7743, 14015, 7735; Payload ID: 2678 relates to Category No.: 1722, 7743, 14015; Payload ID: 2679 relates to Category No.: 1512, 5291, 14456, 10366, 14663, 11293, 5290, 4723, 5289, 11323, 11176, 11267; Payload ID: 2680 relates to Category No.: 4797; Payload ID: 2681 relates to Category No.: 13594, 9500, 7306, 1780, 8408, 12936, 13589, 3398; Payload ID: 2682 relates to Category No.: 9500; Payload ID: 2683 relates to Category No.: 15626, 14565, 7306, 14079; Payload ID: 2684 relates to Category No.: 13589, 3398, 15626, 14565, 3781, 13431, 3584, 10448, 14080; Payload ID: 2687 relates to Category No.: 10702; Payload ID: 2688 relates to Category No.: 14569, 9966, 12037, 2187; Payload ID: 2689 relates to Category No.: 1737, 7154, 1995; Payload ID: 2690 relates to Category No.: 1737, 2186, 9296, 3354, 7154, 9420, 1893, 12743, 7132, 4336, 12120, 11660, 4485, 9296, 3311, 14838; Payload ID: 2691 relates to Category No.: 1737, 7154, 2195; Payload ID: 2692 relates to Category No.: 2186, 2196, 1779, 9420, 12743, 7132, 4336; Payload ID: 2693 relates to Category No.: 7306, 12794, 12716; Payload ID: 2694 relates to Category No.: 1737, 9420, 7132, 4336, 16136, 1579, 756, 2705; Payload ID: 2695 relates to Category No.: 2186, 2199, 7142; Payload ID: 2696 relates to Category No.: 14661, 2167, 9274, 5965, 16197, 7132, 3889, 12010, 2192; Payload ID: 2697 relates to Category No.: 13589, 3398; Payload ID: 2698 relates to Category No.: 1737, 14661, 2167, 7154, 9274, 5965, 7132, 2429; Payload ID: 2699 relates to Category No.: 1737, 6814, 6984, 14661, 13170, 7306, 5965, 7132, 1238, 2429, 981, 743, 11265, 7153, 7139; Payload ID: 2700 relates to Category No.: 1737, 14661, 12137, 12619, 1730, 3304, 8731, 3398, 7345, 7154, 5965, 1780, 7132, 4336, 7163, 2429, 13519, 13827, 12887, 6881; Payload ID: 2701 relates to Category No.: 14661, 2167, 9274, 5965, 7132, 5968; Payload ID: 2702 relates to Category No.: 2188, 14661, 2167, 9274, 14533, 7132, 4243; Payload ID: 2703 relates to Category No.: 1737, 2186, 6975, 9420, 7132, 4336, 6980, 12677; Payload ID: 2704 relates to Category No.: 14661, 2167, 9274, 7132; Payload ID: 2705 relates to Category No.: 14661, 2167, 9274, 7132; Payload ID: 2706 relates to Category No.: 14661, 2167, 9274, 7132; Payload ID: 2707 relates to Category No.: 14661, 2167, 9274, 7132, 2429, 2188; Payload ID: 2708 relates to Category No.: 14661, 2167, 9274, 7132, 2188; Payload ID: 2709 relates to Category No.: 14661, 2167, 9274, 7132; Payload ID: 2710 relates to Category No.: 14661, 2167, 9274, 7132; Payload ID: 2711 relates to Category No.: 1737, 14661, 2167, 7154, 9274, 5965, 7132, 2424, 2429; Payload ID: 2712 relates to Category No.: 13589, 3398, 15490, 3398, 14661, 2167, 9274, 16197, 7132, 2392; Payload ID: 2713 relates to Category No.: 1737, 6814, 7154, 10481, 2188, 608, 9726, 12711; Payload ID: 2714 relates to Category No.: 6814; Payload ID: 2715 relates to Category No.: 6814; Payload ID: 2716 relates to Category No.: 7154, 5965, 1737, 2167, 9274, 7132, 2424, 2429; Payload ID: 2718 relates to Category No.: 12412; Payload ID: 2719 relates to Category No.: 2243, 6969, 904, 1780, 13363, 8906, 13149, 5612; Payload ID: 2720 relates to Category No.: 2459, 7168, 9099, 2902; Payload ID: 2722 relates to Category No.: 1730, 10372, 7306, 14838, 9420, 7132, 4336, 5794, 10861, 12682; Payload ID: 2723 relates to Category No.: 2186, 9420, 7132, 4336, 2187; Payload ID: 2724 relates to Category No.: 2186, 2985, 2196, 1779, 9420, 7132, 4336; Payload ID: 2725 relates to Category No.: 2459, 9420; Payload ID: 2726 relates to Category No.: 1737, 3354, 7154, 2459, 9420, 7132, 4336; Payload ID: 2729 relates to Category No.: 14894, 2196, 9420, 7132, 4336, 8454; Payload ID: 2731 relates to Category No.: 9099, 9420, 7132, 4336, 11997, 12678, 12037, 2187; Payload ID: 2732 relates to Category No.: 12137, 11506, 3398, 2460, 2459, 9420, 7132, 4336, 4059, 10861, 5066, 9466, 11791, 12839, 3176, 14056, 9994, 3924, 4949, 12580, 9099; Payload ID: 2733 relates to Category No.: 11144; Payload ID: 2734 relates to Category No.: 6961; Payload ID: 2735 relates to Category No.: 12137, 2459, 9420, 7132, 4336, 12093; Payload ID: 2737 relates to Category No.: 7141, 1791, 3900; Payload ID: 2738 relates to Category No.: 6961, 4186, 7159, 9420, 7132, 4336, 14834, 11949, 15606, 11940; Payload ID: 2739 relates to Category No.: 6961, 7159, 1204; Payload ID: 2740 relates to Category No.: 1737, 2186, 2985, 7154, 14894, 3309, 9420, 7132, 4336, 14571; Payload ID: 2741 relates to Category No.: 2198, 12037, 2187; Payload ID: 2742 relates to Category No.: 9420, 7132, 4336; Payload ID: 2743 relates to Category No.: 14905, 9420, 7132, 4336, 4391; Payload ID: 2744 relates to Category No.: 9420, 7132, 4336, 12677; Payload ID: 2745 relates to Category No.: 9420, 7132, 4336; Payload ID: 2746 relates to Category No.: 16158, 2459, 3873, 9420, 12008; Payload ID: 2749 relates to Category No.: 2459, 9099, 9420; Payload ID: 2751 relates to Category No.: 1779, 9420; Payload ID: 2752 relates to Category No.: 10481, 10359; Payload ID: 2753 relates to Category No.: 7912; Payload ID: 2754 relates to Category No.: 14865, 14663, 2211, 4729, 6225, 9982; Payload ID: 2755 relates to Category No.: 9982, 7613; Payload ID: 2756 relates to Category No.: 14865, 14663, 14862, 2206, 8692, 1957, 2140, 2067, 1954, 4859; Payload ID: 2757 relates to Category No.: 2206, 14865, 14663, 14862; Payload ID: 2758 relates to Category No.: 5939, 14865, 14663, 14862, 2206; Payload ID: 2759 relates to Category No.: 2206, 14865, 14663, 14862; Payload ID: 2760 relates to Category No.: 14865, 14663, 14862, 2206; Payload ID: 2761 relates to Category No.: 14865, 14663, 14862, 2206; Payload ID: 2762 relates to Category No.: 4703, 14865, 14663, 4729, 2203; Payload ID: 2763 relates to Category No.: 8862, 7743, 1257, 1272, 7662, 1918, 722, 724, 16005, 3171, 7575, 4884, 4418, 14577, 14477, 1758, 8286; Payload ID: 2767 relates to Category No.: 8862, 15149, 5037, 2222, 11431, 12105; Payload ID: 2768 relates to Category No.: 11431; Payload ID: 2770 relates to Category No.: 12105; Payload ID: 2771 relates to Category No.: 12194, 11843, 12153, 8517, 11255, 8183; Payload ID: 2772 relates to Category No.: 5592, 15003, 16096, 3719, 5406, 7303, 1240, 5458, 3710, 1814, 9722, 16095, 16119, 1242; Payload ID: 2773 relates to Category No.: 1204, 16294, 8507, 1541, 16139, 8087, 1568, 10623; Payload ID: 2775 relates to Category No.: 1703, 7252, 6137; Payload ID: 2776 relates to Category No.: 16064, 6445, 7613, 12427, 1830, 325, 12099, 5852, 7710, 11878, 8373, 2945, 6738, 16170, 2211, 6451, 1000, 8241, 8920, 14869, 6438, 8549, 901, 8973, 664, 4359, 4488, 4556, 833, 6439; Payload ID: 2777 relates to Category No.: 8906, 16214, 6445, 1295, 14558, 11878, 6438, 8933, 4730; Payload ID: 2778 relates to Category No.: 11878, 2355, 4723, 11300, 6438, 4401, 16214, 6445, 1871, 6294; Payload ID: 2779 relates to Category No.: 6227, 8862, 6211, 11878, 9945, 2355, 2211, 2206, 8549, 16214, 14056, 7613, 9994, 7354, 483, 484, 8920, 1888, 12649, 8921, 14729, 14886, 901, 6445, 7063, 1871, 8905, 1893, 490, 14777, 4580; Payload ID: 2780 relates to Category No.: 9500, 15618, 1862, 2679, 496, 6269, 13966, 13813, 6375; Payload ID: 2781 relates to Category No.: 690, 1730, 10074, 10175, 10359, 16085, 1238, 10080, 5424, 10959, 10372, 1780, 13882, 13893, 10851, 13651; Payload ID: 2782 relates to Category No.: 15490, 3398, 8739; Payload ID: 2783 relates to Category No.: 15522, 15490, 3398, 15518, 5446, 3021, 1874, 4439, 11573, 15500, 15292, 8962; Payload ID: 2791 relates to Category No.: 13609; Payload ID: 2795 relates to Category No.: 12091, 5785; Payload ID: 2802 relates to Category No.: 8906, 6814, 14033, 9125, 5810, 8402, 8537; Payload ID: 2803 relates to Category No.: 6814, 1204; Payload ID: 2804 relates to Category No.: 11926, 1893, 2275, 2994, 15471, 1202; Payload ID: 2805 relates to Category No.: 11926, 1893, 2994, 15471, 1202, 10170; Payload ID: 2806 relates to Category No.: 11926, 1893, 2994, 15471, 1202; Payload ID: 2807 relates to Category No.: 11926, 14038, 1893, 2994, 15471, 1202; Payload ID: 2808 relates to Category No.: 11926, 1893, 2994; Payload ID: 2809 relates to Category No.: 12137, 11926, 14838, 2275, 15471; Payload ID: 2810 relates to Category No.: 11926, 1893, 2994, 15471, 1202; Payload ID: 2811 relates to Category No.: 11926, 1893, 2994, 15471, 1202, 10170; Payload ID: 2812 relates to Category No.: 11674, 15626, 708; Payload ID: 2813 relates to Category No.: 7306, 13552, 13556, 12471, 15190; Payload ID: 2814 relates to Category No.: 12194, 1737, 15490, 3398, 12137, 16172, 8731, 3398, 16064, 7138, 9308, 7153, 12682, 1791, 13174, 4440, 8733; Payload ID: 2815 relates to Category No.: 1737, 12137, 16064, 9308, 7153, 12682, 1791, 16186, 3900, 13174; Payload ID: 2816 relates to Category No.: 16064, 11940, 12137, 12095, 3691, 7728, 11934, 16197, 16193, 6738, 11646, 10595, 6735, 9308, 7153, 12682, 1791, 16186, 3900, 13672, 13174, 11610, 7774; Payload ID: 2817 relates to Category No.: 12137, 3691, 16064, 2562, 16197, 16193, 6738, 3697, 9308, 7153, 12682, 1791, 16186, 13174, 11610, 8925; Payload ID: 2818 relates to Category No.: 12137, 12095, 3691, 795, 16064, 11934, 16197, 16193, 6738, 12682, 1791, 16186, 13672, 11610, 8820; Payload ID: 2819 relates to Category No.: 11940, 12095, 3691, 16064, 16197, 16193, 6738, 6721, 6735, 9308, 7153, 8374, 1791, 16186, 11661, 6754, 7633; Payload ID: 2820 relates to Category No.: 11940, 3691, 7728, 16064, 16197, 16193, 6738, 9308, 7153, 8374, 12682, 1791, 16186, 13672, 13174, 11610, 15902, 11661, 6497, 16185, 7633; Payload ID: 2821 relates to Category No.: 12137, 3691, 16064, 7850, 16197, 16193, 6738, 9308, 7153, 12682, 1791, 13672, 13174, 11610, 15902, 200; Payload ID: 2822 relates to Category No.: 12137, 3691, 16064, 16197, 16193, 6738, 7326, 9308, 7153, 12682, 1791, 13174, 16185, 3699, 13402, 6445; Payload ID: 2823 relates to Category No.: 16064, 12137, 3691, 16197, 16193, 6738, 9308, 7153, 1791, 16186; Payload ID: 2824 relates to Category No.: 12137, 3691, 6063, 16064, 16197, 16193, 6738, 9308, 7153, 1791; Payload ID: 2825 relates to Category No.: 12091, 3452, 1955, 3356, 3354, 3448, 3309, 12786, 2051, 2416, 13734, 3310, 13601, 9716, 4335, 5177, 8320, 13169, 12977, 12646, 12891, 4336; Payload ID: 2826 relates to Category No.: 12091, 1737, 13589, 3398, 15490, 3398, 5808, 1955, 3354, 13343, 11506, 3398, 3448, 7162, 3309, 1888, 4336, 12117, 11858, 13734, 3310, 13733, 14571, 14574, 795, 13856, 1957, 11285, 7725, 9713, 10228, 7882, 13826, 1917; Payload ID: 2827 relates to Category No.: 1737, 7154, 12096, 7134, 7183, 11237, 11298, 15898, 7132, 11912; Payload ID: 2828 relates to Category No.: 4828, 5367, 2303, 14640, 2311, 8390, 10606, 8141, 10942, 12577; Payload ID: 2829 relates to Category No.: 4828, 5367, 14565, 14038, 2303, 10702, 8731, 3398, 1816, 12999, 2013, 2014, 2136, 9000, 10902, 7216, 10583, 8129, 11541, 7717, 579, 10339, 579, 10826, 8611, 2131, 13695, 11102, 11323, 11449, 11456, 11451, 10340, 579, 8149, 11073, 2020, 8681, 8706, 6642, 10695, 11489, 10694, 8704, 10264, 11485, 11478, 10786; Payload ID: 2830 relates to Category No.: 4828, 5367, 14565, 5428, 2303, 10702, 2013, 2014, 2136, 9000, 7216, 10583, 11449, 1237; Payload ID: 2831 relates to Category No.: 4828, 5428, 2303, 4828, 2745, 10486, 2311, 13695, 13818; Payload ID: 2832 relates to Category No.: 4828, 5367, 14565, 5428, 2303, 10702, 1836, 2311, 16197, 2013, 2014, 2136, 9000, 6410, 7216, 3757, 10583, 13859; Payload ID: 2833 relates to Category No.: 12091, 4828, 5367, 14565, 5428, 14038, 2303, 10702, 1703, 12648, 2940, 13996, 1836, 2311, 10366, 2013, 2014, 2136, 10192, 10558, 9000, 6410, 7216, 3757, 10583, 10226, 6552, 1313, 286, 2431, 13900, 3846, 6613, 13896; Payload ID: 2834 relates to Category No.: 4828, 5367, 14565, 5428, 2303, 10702, 12648, 2940, 1816, 1836, 2311, 2013, 2014, 2136, 9000, 6410, 7216, 3757, 10583, 1713; Payload ID: 2835 relates to Category No.: 5367, 1713, 4828, 2303, 10702, 10372, 1836, 2013, 2014, 2136, 9000, 10790, 6410, 7216, 3757, 10583; Payload ID: 2836 relates to Category No.: 5367, 4828, 14565, 2303, 10702, 1816, 1836, 10175, 2311, 2013, 2014, 2136, 9000, 10790, 6410, 7216, 3757, 10583; Payload ID: 2837 relates to Category No.: 5367, 4828, 5428, 2303, 10702, 1816, 10175, 1714, 2311, 2013, 2014, 2136, 9000, 10790, 6410, 7216, 3757, 10583; Payload ID: 2838 relates to Category No.: 4828, 5367, 5428, 2303, 10702, 1816, 7306, 2311, 2013, 2014, 2136, 9000, 6410, 7216, 10583, 8352; Payload ID: 2839 relates to Category No.: 4828, 5367, 14565, 5428, 2303, 10702, 13790, 1816, 1714, 2311, 2013, 2014, 2136, 9000, 10790, 6410, 7216, 3757, 10583; Payload ID: 2840 relates to Category No.: 4828, 5367, 5428, 14038, 2303, 10702, 344, 1836, 1714, 10775, 2013, 2014, 2136, 10878, 11460, 6410, 11266, 7216, 10583, 11108, 10822, 2145, 10829, 11566, 11316, 10543, 3918, 5393, 3046, 10496, 10683, 15192, 13991, 11186, 11265, 1751, 10419, 13695, 11102, 8206, 10370, 11479, 6641, 7376, 13962, 5642, 12644, 10499, 1713; Payload ID: 2841 relates to Category No.: 5367, 1713, 12091, 4828, 690, 14565, 5428, 2303, 10702, 2885, 1703, 12648, 3684, 2940, 6606, 5285, 2079, 5910, 1795, 8373, 16191, 2311, 1893, 2041, 2013, 2014, 2136, 4828, 2745, 9000, 7216, 3757, 10583, 6248, 11114, 8007, 9410, 1970, 11445, 10298, 13788, 10236, 11980, 9746, 6462, 906, 1856, 4967, 8359, 7598, 14050, 13650, 10942, 11037, 10779, 2110, 13925, 10343, 4478, 2094, 13859, 13882, 13936, 13989, 1836, 496, 13867, 13827, 13837, 13767, 13773, 1957, 6627, 6626, 11436, 15570, 9411, 16085, 2009, 1951, 10904, 10446, 2021, 13779, 6147, 10558, 6410, 11293, 10379, 13856, 11566, 1912, 14043, 10903, 10388, 2047, 2042, 1998; Payload ID: 2842 relates to Category No.: 4828, 5367, 14565, 5428, 2303, 10702, 1816, 3013, 2311, 2013, 2014, 2136, 9000, 6410, 7216, 10583, 11459, 2041, 16294, 2080, 11114, 10817, 2043; Payload ID: 2843 relates to Category No.: 4828, 5367, 5428, 1713, 2303, 1816, 337, 10775, 2013, 2014, 2136, 10878, 11302, 10192, 10628, 6410, 11266, 7216, 10583, 11316, 3918, 5393, 10382, 3046, 10496, 10683, 15192, 14330, 10344, 13991, 6769, 11186, 11265, 1751, 10419, 13695, 11102, 3048, 8211, 8206, 10370, 11459, 11059, 7868; Payload ID: 2844 relates to Category No.: 4828, 5367, 14565, 5428, 14038, 2303, 10702, 1816, 2311, 2013, 2014, 2136, 9000, 6410, 7216, 10583; Payload ID: 2845 relates to Category No.: 4828, 5367, 14565, 5428, 2303, 10702, 1816, 7743, 1836, 2311, 2013, 2014, 2136, 9000, 10790, 6410, 7216, 3757, 10583, 7715; Payload ID: 2846 relates to Category No.: 4828, 5367, 14565, 5428, 2303, 10702, 12648, 2940, 1816, 2311, 10366, 2013, 2014, 2136, 10192, 10558, 9000, 10790, 6410, 7216, 3757, 10583, 10226, 10564; Payload ID: 2847 relates to Category No.: 4828, 5367, 5428, 1713, 2303, 10702, 1795, 2311, 2013, 2014, 2136, 9000, 6410, 7216, 10583, 10382, 8211, 6145; Payload ID: 2848 relates to Category No.: 4828, 5367, 14565, 5428, 2303, 10702, 1816, 2311, 10366, 2013, 2014, 2136, 10192, 10558, 9000, 6410, 7216, 3757, 10583; Payload ID: 2849 relates to Category No.: 5367, 1713, 1816, 2311; Payload ID: 2850 relates to Category No.: 5367, 1713, 2311, 10382, 8211, 10486; Payload ID: 2851 relates to Category No.: 4828, 5367, 5428, 2303, 10702, 11089, 12648, 2940, 1816, 6606, 3986, 1417, 2079, 1836, 10175, 14579, 1451, 2311, 10366, 10648, 2013, 2014, 2136, 9000, 10790, 14025, 6410, 11266, 7216, 3757, 10583, 8004, 10822, 6248, 11566, 8424, 15191, 10301, 10298, 9455, 7664, 13696, 11980, 13805, 1111, 4839, 1701, 7560, 6462, 3758, 906, 10307, 13459, 11073; Payload ID: 2852 relates to Category No.: 4828, 5367, 5428, 2303, 10702, 7743, 2013, 2014, 2136, 9000, 10790, 6410, 7216, 3757, 10583; Payload ID: 2853 relates to Category No.: 4828, 5367, 5428, 2303, 10702, 7743, 2013, 2014, 2136, 9000, 10790, 6410, 7216, 3757, 10583; Payload ID: 2854 relates to Category No.: 5367; Payload ID: 2855 relates to Category No.: 4828, 5367, 5428, 2303, 10702, 2013, 2014, 2136, 9000, 10790, 6410, 7216, 3757, 10583; Payload ID: 2856 relates to Category No.: 4828, 5367, 5428, 14038, 2303, 10702, 1816, 6606, 3986, 1417, 2079, 12133, 1836, 10175, 11296, 13551, 2311, 10366, 8818, 2013, 2014, 2136, 11448, 13004, 9000, 10790, 11460, 10877, 11550, 11037, 14025, 11187, 7216, 3757, 10583, 6248, 10343, 11607, 11201, 3046, 11459, 8996, 10381, 11449, 1970, 11390, 10760, 10794, 10301, 11391, 1889, 8040, 7789, 13228, 10198, 11980, 6137, 7560, 11580, 10942, 6462, 11073, 8680, 12713, 10384, 356, 10574, 13818, 14029, 8244, 7728, 1948, 13967, 13969, 13925, 13859, 2041, 2131, 496, 13888, 13827, 13836, 13767, 10648, 11091, 3231, 2064, 8374, 2431, 13805, 10226, 11150, 2039, 1906, 6410, 13788, 14003, 1966, 10618, 1998, 10959, 2151, 1902, 1713; Payload ID: 2857 relates to Category No.: 4828, 5367, 14565, 5428, 2303, 10702, 12648, 2940, 1816, 1836, 2311, 10366, 2013, 2014, 2136, 9000, 7216, 3757, 10583, 11073, 13856, 1966; Payload ID: 2858 relates to Category No.: 12091, 4828, 5367, 14565, 5428, 14038, 2303, 10702, 1816, 3986, 1417, 1836, 2311, 2013, 2014, 2136, 9000, 6410, 7216, 3757, 10583, 690, 10904, 8210; Payload ID: 2859 relates to Category No.: 4828, 5367, 5428, 2303, 2885, 1703, 1816, 3986, 1417, 1795, 1836, 2311, 10366, 4828, 2745, 10486, 11037, 10583, 8004, 14050, 3046, 11150, 10301, 7664; Payload ID: 2860 relates to Category No.: 4828, 5367, 2303, 2311, 10486; Payload ID: 2861 relates to Category No.: 4828, 5367, 5428, 2303, 2885, 5446, 5910, 7581, 1836, 2311, 7598, 16197, 10790, 10486, 1250, 11037, 10814, 11565, 14050, 3046, 11449, 11445, 10840, 1849, 13650, 10717, 1856, 10219, 11480, 8786, 15330, 7929, 10779, 11039, 10340, 577, 10247, 13925, 496, 10648, 11091, 13904, 3013, 7636, 7737, 4251, 10368, 4094, 5429, 10379, 10851, 11566, 8926, 8367, 10618, 10822, 10239; Payload ID: 2862 relates to Category No.: 4828, 5428, 2303, 442, 1703, 16197, 10486, 10226, 1849, 2311, 10558; Payload ID: 2863 relates to Category No.: 4828, 5367, 2303, 10486, 2311, 8934, 5428, 5242, 15436; Payload ID: 2864 relates to Category No.: 4828, 5367, 5428, 2303, 1816, 6606, 1417, 1795, 14579, 1451, 2311, 16197, 2041, 10486, 16189, 3046, 1849, 13696, 13805, 3744; Payload ID: 2865 relates to Category No.: 4828, 5367, 14565, 2303, 5446, 5285, 2311, 7252, 3046, 1849, 10486, 10573, 10498; Payload ID: 2866 relates to Category No.: 4828, 5428, 2303, 1948, 337, 10775, 10878, 11302, 10192, 10628, 10486, 11266, 10583, 10498, 10829, 10343, 3918, 10382, 3046, 10496, 14330, 13991, 11186, 11265, 13695, 11102, 8206, 10370, 13011, 10763, 6641, 7376, 10772, 2286, 2289, 13014, 13962, 5642, 6415, 10788, 11450, 10684, 12757, 2311, 13925, 5242, 5367, 8840, 11461; Payload ID: 2867 relates to Category No.: 4828, 5367, 2303, 1703, 10486; Payload ID: 2868 relates to Category No.: 4828, 5367, 2303, 10486, 1849, 2311; Payload ID: 2869 relates to Category No.: 4828, 5428, 2303, 2311; Payload ID: 2870 relates to Category No.: 4828, 5367, 2303, 10702, 2885, 1703, 2311, 3012, 2013, 2014, 2136, 9000, 10790, 6138, 6410, 7216, 3757, 10583, 6135, 10306, 16294, 7966, 10226, 692, 6462, 11543, 10366, 10343, 13882, 496, 11391, 10074, 6952, 8811, 11085, 10942, 7847, 5440, 1713; Payload ID: 2871 relates to Category No.: 4828, 2303, 1703, 2311, 16197, 14050, 1849, 7598, 7966, 2885, 2242, 6462, 6953, 2041, 2131, 6758, 7737, 10226, 6952, 11085, 8228, 7808; Payload ID: 2872 relates to Category No.: 10331, 8862, 4828, 5367, 5785, 14565, 5428, 1713, 2303, 274, 7743, 1780, 2311, 13925, 10902; Payload ID: 2873 relates to Category No.: 4828, 5367, 11512, 14565, 5428, 2303, 1816, 7345, 1795, 12646, 2311, 13360, 2041, 3705, 11037, 15191, 11459, 10311, 10313, 11323, 1237, 13555, 12812, 3021, 8352, 8353, 10366, 13925, 10372, 13812, 7598, 1995, 13786, 14045, 14038, 13856, 10902; Payload ID: 2874 relates to Category No.: 4828, 5367, 14565, 5428, 2303, 1816, 12646, 2311, 13925, 10902, 15191, 10311, 10313, 11323; Payload ID: 2875 relates to Category No.: 4828, 1026, 5367, 14565, 14038, 1713, 2303, 1703, 12469, 1836, 10175, 2311, 11037, 10343, 8211, 8206, 11459, 10298, 8177, 5424, 1237, 12638, 10366, 1295, 4458, 4459, 15203, 7251, 1804, 9600, 11063, 608, 13882, 13936, 10372, 13867, 11091, 13981, 9411, 13996, 12573, 8934, 483, 10558, 10258, 10531, 15246; Payload ID: 2876 relates to Category No.: 4828, 5367, 5428, 2303, 1816, 337, 1795, 3013, 12646, 4461, 13925, 12488, 10486, 1056, 10381, 11449, 6411, 2431, 12989, 10804, 3709, 7921, 6403, 1057; Payload ID: 2877 relates to Category No.: 5367, 1713, 14565, 1816, 2311, 8352, 5458, 11073; Payload ID: 2878 relates to Category No.: 12427, 13818, 2311, 10366, 10362, 13892, 14029, 15191, 2041, 6410; Payload ID: 2879 relates to Category No.: 690, 1730, 2311; Payload ID: 2880 relates to Category No.: 4828, 5367, 5428, 1713, 2303, 12646, 2311, 13925, 10902, 13947; Payload ID: 2881 relates to Category No.: 4828, 5367, 5428, 2303, 12646, 13925, 9000, 10902; Payload ID: 2882 relates to Category No.: 4828, 5367, 14565, 5428, 1713, 2303, 10372, 1816, 2311, 13925, 10902; Payload ID: 2883 relates to Category No.: 4828, 5367, 14565, 5428, 1713, 2303, 1816, 3013, 12646, 2311, 13925, 10902; Payload ID: 2884 relates to Category No.: 4828, 690, 5367, 5785, 14565, 1722, 5428, 2303, 3684, 12614, 7743, 1451, 2311, 1893, 2041, 2014, 2136, 13831, 9000, 9002, 13947, 7252, 11102, 8996, 1970, 10226, 5424, 8040, 12409, 3576, 9746, 13471; Payload ID: 2885 relates to Category No.: 4828, 5367, 14565, 5428, 2303, 1816, 12646, 2311, 3012, 13925, 10902, 15191, 10311, 10313, 11323, 1849, 3021, 11062, 11063; Payload ID: 2886 relates to Category No.: 4828, 5428, 2303, 1795, 2311, 3046, 12409, 5721; Payload ID: 2887 relates to Category No.: 4828, 2303, 2311, 14565, 5428, 10372, 1795, 9000, 9932, 3046, 8996, 1849, 12409, 5721, 7613, 10486, 11102, 6995, 11598, 10226, 8384, 380, 10902, 10319, 6877; Payload ID: 2888 relates to Category No.: 4828, 690, 11512, 5428, 2303, 795, 1703, 10372, 1795, 2311, 7598, 7958, 7252, 7924, 10419, 10311, 10313, 11323, 10226, 13066, 10591, 2284, 1451, 10486, 15191; Payload ID: 2889 relates to Category No.: 4828, 5428, 14038, 2303, 795, 1948, 345, 1451, 16197, 13882, 10486, 16189, 3046, 8996, 3744, 12692, 7365, 11138, 1562, 1752, 12573, 8934, 3790, 8943, 15246, 13334; Payload ID: 2890 relates to Category No.: 4828, 5367, 2303, 2311, 10481, 1053, 7252, 6403; Payload ID: 2891 relates to Category No.: 4828, 5428, 2303, 16191, 2311; Payload ID: 2892 relates to Category No.: 1780, 9000, 6410, 14404, 6462, 6138; Payload ID: 2893 relates to Category No.: 8731, 3398, 8831, 4094, 11997, 1557, 2459, 7693; Payload ID: 2895 relates to Category No.: 14661, 5785, 14565, 10702, 3766, 12526, 13485, 11371, 7251, 12942; Payload ID: 2896 relates to Category No.: 14661, 5785, 14565, 10702, 13485, 11371; Payload ID: 2897 relates to Category No.: 5367, 1512, 2317, 13788, 10156, 2318; Payload ID: 2898 relates to Category No.: 5428, 795, 1512, 2136, 352, 2317, 13936, 14029, 11266, 10583, 13893, 11176, 10226, 1622, 6375, 13901, 5720, 2014; Payload ID: 2899 relates to Category No.: 1512, 2317; Payload ID: 2900 relates to Category No.: 2317, 1512, 5446, 7846; Payload ID: 2901 relates to Category No.: 1512, 2317, 2318, 5367, 795, 3244, 11755, 10416, 10156, 1799, 13854; Payload ID: 2902 relates to Category No.: 1512, 2317, 9358; Payload ID: 2904 relates to Category No.: 12194, 15618, 15626, 2331, 5846, 1417, 2329, 2006; Payload ID: 2905 relates to Category No.: 12194, 15618, 15626, 1703, 5846, 2329, 2331; Payload ID: 2906 relates to Category No.: 12194, 15618, 15626, 2331, 5846, 2329; Payload ID: 2907 relates to Category No.: 2329; Payload ID: 2908 relates to Category No.: 14915, 4439, 7546, 2331, 1797; Payload ID: 2909 relates to Category No.: 15618, 15626, 2331, 5846, 12491, 2329, 7340, 8947; Payload ID: 2910 relates to Category No.: 15618, 15626, 2331, 5846, 12491, 2329, 14056, 1736; Payload ID: 2911 relates to Category No.: 15618, 2331, 5846, 12491, 15626, 13298, 2329, 12492, 7749, 3690, 9777, 3729, 9994, 483, 15149, 4588, 11306, 15149, 4342, 8925, 15159, 5848, 13041; Payload ID: 2912 relates to Category No.: 15618, 15626, 2331, 5846, 12491, 2329; Payload ID: 2913 relates to Category No.: 15618, 15626, 2331, 5846, 12491, 2329, 3973, 3639; Payload ID: 2914 relates to Category No.: 15618, 14565, 2331, 5846, 12491, 1797, 13936; Payload ID: 2915 relates to Category No.: 15618, 15626, 2331, 5846, 12491, 2329, 13983; Payload ID: 2916 relates to Category No.: 15618, 15626, 2331, 5846, 12491, 2329, 3973; Payload ID: 2917 relates to Category No.: 15618, 15626, 2331, 5846, 12491, 2329, 3973; Payload ID: 2918 relates to Category No.: 13041, 14565, 2331, 2329, 10075, 13161, 11147; Payload ID: 2919 relates to Category No.: 15626, 9500, 14565, 2329, 8601, 12596, 13409, 10275; Payload ID: 2920 relates to Category No.: 13041, 14565, 2331, 2329; Payload ID: 2921 relates to Category No.: 690, 13041, 795, 1730, 2331, 5939, 7737, 12746, 2329, 1922, 3923, 7303, 16055, 4167, 1320, 3714, 14061; Payload ID: 2922 relates to Category No.: 13041, 15626, 14456, 2331, 2329, 4145, 991, 8920, 13824, 11997, 3243; Payload ID: 2923 relates to Category No.: 13041, 2329; Payload ID: 2924 relates to Category No.: 14565, 1048, 8934, 3529, 11987, 10372, 13459, 10238, 11178, 795, 13692, 334, 1112, 11013, 7619, 10674, 11282; Payload ID: 2925 relates to Category No.: 4828, 2000, 3244, 12988, 4132, 13980, 9932, 2338, 8934, 1048, 4251, 13925, 13859, 13867, 13966, 14009, 5544, 10486, 14011, 9411, 9554, 13996, 275, 12573, 4411, 3529, 15273, 12447, 9561, 13330, 11403; Payload ID: 2926 relates to Category No.: 4828, 10372, 3244, 14449, 1795, 1780, 4132, 13303, 9932, 10486, 2338, 3246, 4468, 4411; Payload ID: 2927 relates to Category No.: 6219, 9500, 4104, 14663, 1186, 1189, 14979, 2355; Payload ID: 2928 relates to Category No.: 6227, 12427, 9950, 2359, 2355, 6253, 14663, 14102, 16155, 9827, 2353, 15664, 15662, 6215, 5065, 8248, 9944, 6340, 15666, 12695; Payload ID: 2929 relates to Category No.: 9500, 4658; Payload ID: 2930 relates to Category No.: 6219, 6227, 9982, 14565, 9945, 14663, 4653, 9825, 9835, 1693, 14025, 2364, 3946, 13761; Payload ID: 2931 relates to Category No.: 9982, 9945, 14663, 4653, 9825, 9835, 1693; Payload ID: 2932 relates to Category No.: 8977, 15149, 9945, 14663, 4653, 8970, 9825, 13882, 13827, 13966, 13837, 6758, 755, 212; Payload ID: 2933 relates to Category No.: 6219, 12633, 9940, 9945, 14663, 4653, 9825, 1693, 10070; Payload ID: 2934 relates to Category No.: 6219, 9940, 9945, 14663, 4653, 9825, 9835, 1693; Payload ID: 2935 relates to Category No.: 8862, 4828, 14565, 1894, 10372, 11987, 14451, 2562, 4808, 1780, 437, 9930, 15149, 2370, 14357, 10005, 16211, 3742, 10870, 13080, 10861, 8922; Payload ID: 2936 relates to Category No.: 8862, 4828, 14038, 442, 14451, 4808, 13491, 437, 9930, 15149, 2370, 4828, 2745, 12948; Payload ID: 2937 relates to Category No.: 8862, 4828, 14565, 1894, 14451, 4808, 1780, 14663, 13655, 437, 9930, 15149, 2370, 14357, 13004, 3728, 14693, 3244, 11392, 13659; Payload ID: 2938 relates to Category No.: 4828, 14565, 1795, 14451, 4808, 1780, 437, 9930, 15149, 2370, 13080, 10702, 13970; Payload ID: 2939 relates to Category No.: 14451, 9930, 15149, 2370, 4828, 4411, 4808, 1780, 437, 15622, 3433, 13305; Payload ID: 2940 relates to Category No.: 15626, 5848; Payload ID: 2941 relates to Category No.: 15626, 14565, 1649, 5846, 15149, 13126, 8946, 5848, 14622, 15149, 2370, 8918, 14637, 7332, 8925, 8922, 13961, 7354, 8919, 1651; Payload ID: 2942 relates to Category No.: 15626, 14565, 1649, 1415, 13126, 5848, 12646, 8911, 15149, 2370, 10486, 8922, 13961, 5459, 3147, 5846; Payload ID: 2943 relates to Category No.: 15626, 14565, 1649, 15149, 13126, 5848, 8911, 15149, 2370, 8922, 13961, 11934, 5846; Payload ID: 2944 relates to Category No.: 8862, 15626, 14565, 1649, 5846, 15149, 6296, 13126, 5848, 13491, 8911, 15149, 2370, 12754, 3971, 364, 1117, 15150, 12455, 8968, 11934, 13886, 13827, 13961, 4949; Payload ID: 2945 relates to Category No.: 15626, 14565, 13975, 1649, 5846, 14454, 15149, 325, 3354, 1417, 2562, 13126, 5848, 8911, 13882, 15149, 2370, 12781, 6723, 1053, 8922, 13961, 1117, 5440, 4004, 6296, 13756; Payload ID: 2946 relates to Category No.: 15626, 14565, 1649, 5846, 15149, 13126, 5848, 8911, 15149, 2370, 8922, 1117, 13961; Payload ID: 2947 relates to Category No.: 15626, 14565, 1649, 15149, 13126, 5848, 8911, 15149, 2370, 8922, 13961, 6723, 12781; Payload ID: 2948 relates to Category No.: 15626, 14565, 1649, 5846, 15149, 10372, 1417, 345, 2562, 13126, 1836, 5848, 13882, 15149, 2370, 8782, 6758, 10226, 13961; Payload ID: 2949 relates to Category No.: 15626, 14565, 1649, 15149, 1415, 13126, 5848, 8911, 15149, 2370, 10486, 8922, 13961, 5459, 1651, 3147, 14456; Payload ID: 2950 relates to Category No.: 15626, 14565, 1649, 1651, 13126, 5848, 8911, 15149, 2370, 7340, 7341, 8922, 11655, 1117, 14622, 5846; Payload ID: 2951 relates to Category No.: 15626, 14565, 1649, 14456, 5846, 14454, 15149, 6296, 10266, 1417, 16214, 2562, 14693, 13126, 5848, 8911, 13882, 15149, 2370, 14729, 12781, 12754, 6723, 1053, 6102, 6758, 16213, 12779, 8922, 13837, 13961, 1117, 901, 13811, 16177, 9397, 6069, 2178, 13532, 3436, 10531, 12718, 13697, 7570, 13523, 15150, 2175, 325, 2638, 11436, 3436, 12718, 9102, 11934; Payload ID: 2952 relates to Category No.: 15618, 15626, 14565, 1649, 15149, 13126, 5848, 8911, 15149, 2370, 8922, 13961, 11934; Payload ID: 2953 relates to Category No.: 15626, 14565, 1649, 5846, 15149, 13126, 5848, 8911, 15149, 2370, 13961, 13238, 15150, 14693, 6296, 11555, 325, 1117, 13491, 11934; Payload ID: 2954 relates to Category No.: 15626, 1649, 5846, 14565, 15149, 13126, 5848, 8911, 15149, 2370, 7340, 14637, 8922, 13961, 7354, 8919, 14622, 1651; Payload ID: 2955 relates to Category No.: 15626, 14565, 1649, 15149, 13126, 5848, 8911, 15149, 2370, 7340, 8922, 13961, 14622, 1651; Payload ID: 2956 relates to Category No.: 15626, 14565, 1649, 15149, 13126, 5848, 8911, 15149, 2370, 7340, 8922, 13961; Payload ID: 2957 relates to Category No.: 1269, 7668; Payload ID: 2958 relates to Category No.: 7799, 7818; Payload ID: 2959 relates to Category No.: 1512, 14663, 4723, 2385, 2383, 6814; Payload ID: 2960 relates to Category No.: 6814, 1512, 14663, 4723, 2385, 2383; Payload ID: 2961 relates to Category No.: 8862, 1512, 674, 1780, 14663, 4021, 4723, 12190, 2385, 2383, 1789, 2387, 3108, 5010, 5004, 10157, 2387, 10157, 15944, 15940, 3631, 1622; Payload ID: 2962 relates to Category No.: 1512, 14663, 4723, 12190, 2385, 2383, 2387, 3108, 3108, 10157, 2387, 10157; Payload ID: 2963 relates to Category No.: 690, 5785, 1512, 1752, 14663, 4723, 11178, 2385, 2383, 2384, 3106, 15428, 345, 15614, 1780, 4478; Payload ID: 2964 relates to Category No.: 8862, 1512, 1730, 14663, 12936, 5788, 4723, 2385, 7131, 2383, 2384, 3106, 10491, 7191; Payload ID: 2965 relates to Category No.: 1512, 14663, 4723, 2385, 2383, 8420, 1622, 1274, 2374, 11394, 12213, 15078, 13967; Payload ID: 2966 relates to Category No.: 1512, 14663, 4723, 2385, 2383; Payload ID: 2967 relates to Category No.: 7345, 13232;

Payload ID: 2969 relates to Category No.: 8421, 7737, 14640, 7662, 10343, 10983, 4217, 1263, 4419, 9599, 3445, 2169, 9455, 4251, 6796, 7306; Payload ID: 2970 relates to Category No.: 8862, 1730, 1257, 4057, 9451, 2627, 7662; Payload ID: 2971 relates to Category No.: 9451, 1622, 1730, 7662; Payload ID: 2972 relates to Category No.: 14565, 795, 1816, 1893, 4134, 9637; Payload ID: 2975 relates to Category No.: 14565, 795, 1816, 1893, 4134, 9637; Payload ID: 2976 relates to Category No.: 14565, 795, 1816, 1893, 4134, 9637; Payload ID: 2977 relates to Category No.: 14565, 795, 1816, 1893, 4134, 9637; Payload ID: 2978 relates to Category No.: 5911; Payload ID: 2980 relates to Category No.: 1204; Payload ID: 2981 relates to Category No.: 5782, 10702, 16214, 12126, 14014, 11928, 1240; Payload ID: 2982 relates to Category No.: 5782, 10702, 11928; Payload ID: 2983 relates to Category No.: 15626, 5846, 5848; Payload ID: 2984 relates to Category No.: 3304, 2411; Payload ID: 2985 relates to Category No.: 1721, 3356, 3354, 11884, 3364, 2403; Payload ID: 2986 relates to Category No.: 13589, 3398, 15490, 3398, 1721, 3356, 3354, 11884, 7131, 10491, 3364, 2403; Payload ID: 2987 relates to Category No.: 3356, 7132, 3357, 4332, 13612, 12776, 13258; Payload ID: 2988 relates to Category No.: 13589, 3398, 15490, 3398, 7280, 10250, 10714; Payload ID: 2989 relates to Category No.: 8731, 3398; Payload ID: 2990 relates to Category No.: 15490, 3398, 1730, 8739, 2409, 1893, 12120, 11660, 3189; Payload ID: 2991 relates to Category No.: 15490, 3398, 2411, 8731, 3398, 14123, 1951; Payload ID: 2992 relates to Category No.: 15490, 3398, 7613, 8739, 8731, 3398, 2409, 1893, 12120, 11660; Payload ID: 2993 relates to Category No.: 8731, 3398, 16197, 1238; Payload ID: 2994 relates to Category No.: 15490, 3398, 8739, 2409; Payload ID: 2995 relates to Category No.: 15490, 3398, 8739, 2409, 14392, 13827; Payload ID: 2996 relates to Category No.: 15490, 3398, 8739, 1893, 12120, 11660, 5226, 12603, 10372, 2001, 10446, 10521; Payload ID: 2997 relates to Category No.: 13594, 15490, 3398, 3320, 10180; Payload ID: 2998 relates to Category No.: 2411, 3354, 3320, 9296, 1955, 9296, 3327, 4485, 6814; Payload ID: 2999 relates to Category No.: 13594, 15490, 3398, 3320, 2409, 7345, 1955, 4970, 13589, 3398, 6814; Payload ID: 3000 relates to Category No.: 13594, 13589, 3398, 15490, 3398, 14905, 3320, 2409, 2410, 2198, 2404, 6814; Payload ID: 3001 relates to Category No.: 6814, 13589, 3398, 14894, 2410, 13594, 15490, 3398, 952, 3320, 8739, 15281; Payload ID: 3002 relates to Category No.: 13589, 3398, 7743, 5182, 11372, 13611, 14838, 3969, 5151, 2248, 6814; Payload ID: 3003 relates to Category No.: 15490, 3398, 2409, 11522; Payload ID: 3004 relates to Category No.: 13589, 3398, 15490, 3398, 14318, 2409, 2562, 14640, 2169, 14056, 15194, 9540, 5406, 4953, 5459, 6192, 2753, 4450, 4066, 9120, 12938, 13225, 1463, 14439, 11051, 484, 1240, 14456, 6296, 482, 3819, 9333, 3594, 1237, 9339, 4135, 9331, 3520, 860; Payload ID: 3005 relates to Category No.: 15490, 3398, 11512, 952, 1295, 8739, 8731, 3398, 1483, 3320, 11506, 3398, 8831, 7693, 3246, 11530, 5406, 7613, 7984; Payload ID: 3006 relates to Category No.: 13589, 3398, 15490, 3398, 2409, 1867, 14663, 6814; Payload ID: 3007 relates to Category No.: 5095, 6814, 13589, 3398, 15490, 3398, 14838, 8408; Payload ID: 3008 relates to Category No.: 6814; Payload ID: 3009 relates to Category No.: 5095, 6814, 14838; Payload ID: 3010 relates to Category No.: 5095, 6814, 14838; Payload ID: 3011 relates to Category No.: 5095, 6814, 14838; Payload ID: 3012 relates to Category No.: 5095, 6814, 14838; Payload ID: 3013 relates to Category No.: 5446, 12544, 3016, 6612, 3015, 6613, 6615, 5954, 3014, 6614, 7711, 10504; Payload ID: 3023 relates to Category No.: 1204; Payload ID: 3025 relates to Category No.: 1204; Payload ID: 3026 relates to Category No.: 3176, 4949; Payload ID: 3044 relates to Category No.: 10491; Payload ID: 3052 relates to Category No.: 9500; Payload ID: 3060 relates to Category No.: 5939, 9632, 3781; Payload ID: 3068 relates to Category No.: 6705; Payload ID: 3075 relates to Category No.: 11940, 3356, 9420, 7122, 7038, 15515, 11937, 3379, 1984; Payload ID: 3078 relates to Category No.: 10286, 14944, 1257, 8681, 7717, 579, 11412; Payload ID: 3087 relates to Category No.: 3016, 7732, 3014, 7726; Payload ID: 3088 relates to Category No.: 1204; Payload ID: 3092 relates to Category No.: 13589, 3398, 15490, 3398, 3354, 2409; Payload ID: 3100 relates to Category No.: 6814; Payload ID: 3102 relates to Category No.: 1204; Payload ID: 3103 relates to Category No.: 1295, 1047, 2254, 2442; Payload ID: 3108 relates to Category No.: 12137, 11949, 1995, 12671, 4766, 6375; Payload ID: 3121 relates to Category No.: 10025, 6297; Payload ID: 3122 relates to Category No.: 4969; Payload ID: 3123 relates to Category No.: 13110; Payload ID: 3134 relates to Category No.: 15604, 7111, 13742; Payload ID: 3140 relates to Category No.: 1649, 13785, 12268; Payload ID: 3141 relates to Category No.: 1204, 14979; Payload ID: 3145 relates to Category No.: 1204; Payload ID: 3146 relates to Category No.: 15490, 3398, 11512, 15715, 4439, 16197, 15718, 16181, 14275; Payload ID: 3147 relates to Category No.: 15490, 3398, 9500, 8731, 3398, 8421, 5157, 5152; Payload ID: 3151 relates to Category No.: 1204; Payload ID: 3154 relates to Category No.: 7306, 13460; Payload ID: 3155 relates to Category No.: 5788; Payload ID: 3168 relates to Category No.: 10702, 12648, 14108, 11302, 10192; Payload ID: 3171 relates to Category No.: 8300, 7741; Payload ID: 3177 relates to Category No.: 12137, 4775; Payload ID: 3196 relates to Category No.: 2409; Payload ID: 3207 relates to Category No.: 1204; Payload ID: 3209 relates to Category No.: 8930; Payload ID: 3210 relates to Category No.: 11856; Payload ID: 3214 relates to Category No.: 6814; Payload ID: 3215 relates to Category No.: 14565, 10775; Payload ID: 3216 relates to Category No.: 11997; Payload ID: 3221 relates to Category No.: 1204; Payload ID: 3224 relates to Category No.: 1204; Payload ID: 3225 relates to Category No.: 12091; Payload ID: 3235 relates to Category No.: 7306; Payload ID: 3239 relates to Category No.: 12154, 11843, 795, 7306, 15898; Payload ID: 3240 relates to Category No.: 2768; Payload ID: 3243 relates to Category No.: 1867, 15662, 13071, 15809, 11288, 13078, 1751, 4094; Payload ID: 3248 relates to Category No.: 7837, 2158, 4333; Payload ID: 3250 relates to Category No.: 12066; Payload ID: 3252 relates to Category No.: 15715, 1204, 4439, 3598; Payload ID: 3261 relates to Category No.: 16214, 14014; Payload ID: 3268 relates to Category No.: 13589, 3398; Payload ID: 3270 relates to Category No.: 15626, 3475, 15351, 15347; Payload ID: 3275 relates to Category No.: 14551, 12063, 9324, 11660, 4398, 9359, 5930; Payload ID: 3280 relates to Category No.: 1204; Payload ID: 3281 relates to Category No.: 1204; Payload ID: 3285 relates to Category No.: 12648, 2940, 2460, 14699; Payload ID: 3288 relates to Category No.: 1778; Payload ID: 3289 relates to Category No.: 1204; Payload ID: 3292 relates to Category No.: 1204; Payload ID: 3293 relates to Category No.: 7071, 13161; Payload ID: 3299 relates to Category No.: 8375, 11125; Payload ID: 3304 relates to Category No.: 7946, 13460; Payload ID: 3306 relates to Category No.: 795; Payload ID: 3307 relates to Category No.: 16172; Payload ID: 3309 relates to Category No.: 13304, 1560; Payload ID: 3334 relates to Category No.: 12137, 2460; Payload ID: 3337 relates to Category No.: 2459, 5949, 2235, 16136, 4949, 3578, 9540, 1579, 2705, 3896, 12012; Payload ID: 3338 relates to Category No.: 1204; Payload ID: 3339 relates to Category No.: 1204; Payload ID: 3345 relates to Category No.: 9500; Payload ID: 3349 relates to Category No.: 1204, 6451; Payload ID: 3351 relates to Category No.: 795; Payload ID: 3355 relates to Category No.: 1204, 4021; Payload ID: 3356 relates to Category No.: 1204; Payload ID: 3364 relates to Category No.: 5592, 10086, 6666, 1238; Payload ID: 3368 relates to Category No.: 7306; Payload ID: 3369 relates to Category No.: 1204; Payload ID: 3370 relates to Category No.: 16294, 10349, 3801; Payload ID: 3381 relates to Category No.: 14314; Payload ID: 3384 relates to Category No.: 1204; Payload ID: 3387 relates to Category No.: 1730, 7306, 1744, 3980; Payload ID: 3391 relates to Category No.: 795, 1995, 11108, 12778, 8402, 12622, 3706, 12961; Payload ID: 3396 relates to Category No.: 7131, 10491; Payload ID: 3403 relates to Category No.: 1737, 1721, 6902, 1204; Payload ID: 3408 relates to Category No.: 1955, 3335, 3453; Payload ID: 3411 relates to Category No.: 1204; Payload ID: 3414 relates to Category No.: 1730, 14838, 1889; Payload ID: 3415 relates to Category No.: 12194, 6153, 1867, 9631; Payload ID: 3421 relates to Category No.: 1204; Payload ID: 3423 relates to Category No.: 1721, 10372, 16197, 11609; Payload ID: 3424 relates to Category No.: 1002, 3639; Payload ID: 3429 relates to Category No.: 1204; Payload ID: 3431 relates to Category No.: 981, 12028, 12023, 14611; Payload ID: 3432 relates to Category No.: 1721, 3356; Payload ID: 3433 relates to Category No.: 1721, 3356; Payload ID: 3450 relates to Category No.: 7306, 11506, 3398, 11923, 12646; Payload ID: 3451 relates to Category No.: 15490, 3398, 7306, 11506, 3398; Payload ID: 3452 relates to Category No.: 12194, 12099, 12999, 1893, 4020, 4021, 696, 5615, 1984, 6995, 10226, 9640; Payload ID: 3453 relates to Category No.: 12194, 14663, 2540, 16234, 16275; Payload ID: 3454 relates to Category No.: 12194, 3244; Payload ID: 3455 relates to Category No.: 12194, 8739, 12646, 11512, 7303, 11634, 5428, 10226, 16286, 9555, 12628, 3245, 3980, 15428, 3552; Payload ID: 3456 relates to Category No.: 12194; Payload ID: 3457 relates to Category No.: 12194; Payload ID: 3458 relates to Category No.: 12194, 3244, 2355; Payload ID: 3459 relates to Category No.: 12194, 2355; Payload ID: 3460 relates to Category No.: 12194, 3244, 14663, 4020, 4021, 2540, 16234, 16275; Payload ID: 3461 relates to Category No.: 12194, 3244, 14663, 4020, 4021, 2540, 16234, 16275; Payload ID: 3464 relates to Category No.: 2464; Payload ID: 3467 relates to Category No.: 7306, 2460, 12093, 10370, 12716, 10614; Payload ID: 3469 relates to Category No.: 2460, 2461; Payload ID: 3474 relates to Category No.: 12194, 1047, 2462; Payload ID: 3477 relates to Category No.: 1204; Payload ID: 3482 relates to Category No.: 1204; Payload ID: 3484 relates to Category No.: 1047; Payload ID: 3489 relates to Category No.: 14565, 4859, 8373, 10648, 11582, 2451, 10372, 8928, 13429, 8469, 7346; Payload ID: 3490 relates to Category No.: 8862, 14565, 2451, 10372, 8373, 15067, 14533, 1302, 14628, 2885; Payload ID: 3491 relates to Category No.: 1721, 1779, 2198, 11997, 12037, 2187, 9994, 3811, 2442, 3895; Payload ID: 3493 relates to Category No.: 287, 2464; Payload ID: 3494 relates to Category No.: 6814, 1204, 15570, 6969, 3799, 1183; Payload ID: 3495 relates to Category No.: 6814; Payload ID: 3496 relates to Category No.: 15490, 3398, 8731, 3398, 2467, 6295; Payload ID: 3497 relates to Category No.: 13589, 3398, 15490, 3398, 6636; Payload ID: 3498 relates to Category No.: 6814; Payload ID: 3499 relates to Category No.: 15642, 2481, 1512, 1874, 14663, 6814; Payload ID: 3500 relates to Category No.: 12091, 14661, 5785, 7154, 2886, 4446, 10481, 3038, 14838, 7159, 7864, 6880; Payload ID: 3502 relates to Category No.: 2311; Payload ID: 3503 relates to Category No.: 2311; Payload ID: 3504 relates to Category No.: 2311, 10267; Payload ID: 3505 relates to Category No.: 2311; Payload ID: 3506 relates to Category No.: 2311, 8352; Payload ID: 3507 relates to Category No.: 2311; Payload ID: 3508 relates to Category No.: 2311, 1073; Payload ID: 3509 relates to Category No.: 2311; Payload ID: 3510 relates to Category No.: 14456, 9994, 16214, 286, 1767, 14014, 10889, 14452, 3825, 8920, 991, 985; Payload ID: 3513 relates to Category No.: 795, 3452, 3356, 9713, 3354, 3448, 360, 3309, 11765, 7145, 1844, 4335; Payload ID: 3514 relates to Category No.: 13589, 3398, 5367, 15490, 3398, 11512, 9982, 2885, 8739, 8731, 3398, 11506, 3398, 13892, 5610, 13779, 11000, 7816, 10999, 5428, 496, 1959, 2013, 1967; Payload ID: 3516 relates to Category No.: 3639, 6738, 11646; Payload ID: 3517 relates to Category No.: 5782, 12427, 16172, 7154, 14097, 3698, 6738, 15547, 743, 11646, 9455, 12409, 8091, 8530; Payload ID: 3518 relates to Category No.: 5782, 14565, 12427, 16172, 674, 7154, 14097, 3698, 10666; Payload ID: 3519 relates to Category No.: 1026, 5782, 16172, 2506, 3775, 6738, 8988, 743, 11646, 7933, 3639; Payload ID: 3520 relates to Category No.: 5782, 16172, 2506; Payload ID: 3521 relates to Category No.: 11940, 1183, 1814, 11934, 16189, 1446, 3913; Payload ID: 3522 relates to Category No.: 1703, 5848, 1446; Payload ID: 3523 relates to Category No.: 1446, 1703, 14838, 1022; Payload ID: 3524 relates to Category No.: 1183, 1814, 1446, 1749; Payload ID: 3525 relates to Category No.: 11884, 1183, 1814, 1446, 1749; Payload ID: 3526 relates to Category No.: 5848, 1183, 1814, 1446, 1749; Payload ID: 3527 relates to Category No.: 5848, 6480, 1446, 3973, 1875, 10301, 15540; Payload ID: 3528 relates to Category No.: 1183, 1814, 1446, 1749; Payload ID: 3529 relates to Category No.: 1183, 1814, 1446, 1749; Payload ID: 3530 relates to Category No.: 16214, 14014, 1446, 776, 8947; Payload ID: 3531 relates to Category No.: 1446; Payload ID: 3532 relates to Category No.: 1183, 1814, 1446, 1749; Payload ID: 3533 relates to Category No.: 1183, 1814, 1446, 1749; Payload ID: 3534 relates to Category No.: 1183, 1814, 1446, 1749; Payload ID: 3537 relates to Category No.: 11940, 14565, 1183, 11934, 13882, 3799, 1446; Payload ID: 3539 relates to Category No.: 14565, 1446, 3913, 13989, 4145, 2469; Payload ID: 3540 relates to Category No.: 7369, 15570, 4067, 9540, 1812, 9480, 6102, 1446, 10587; Payload ID: 3541 relates to Category No.: 16197, 1446, 1814; Payload ID: 3542 relates to Category No.: 1446, 10491, 7613, 10372, 7719, 8517, 10370; Payload ID: 3543 relates to Category No.: 1446; Payload ID: 3544 relates to Category No.: 1183, 1814, 16197, 1446, 1749; Payload ID: 3547 relates to Category No.: 6445, 6738, 11646, 7131; Payload ID: 3548 relates to Category No.: 6738, 6445, 11646; Payload ID: 3549 relates to Category No.: 7273, 7287, 9982, 7261, 7207, 15718, 16181, 14610, 15517, 15715, 7291, 16182, 14271, 15291, 4439, 2214, 15225; Payload ID: 3550 relates to Category No.: 15517, 15715, 7291, 16182, 14271, 7287, 15291, 4439, 7280, 7261, 11703; Payload ID: 3551 relates to Category No.: 15517, 7291, 16182, 14271, 7273, 7287, 15291, 4439, 7280, 7261, 7262; Payload ID: 3552 relates to Category No.: 15517, 7291, 16182, 14271, 7273, 7287, 15291, 4439, 7280, 7261, 7262, 9228, 14216, 3656; Payload ID: 3553 relates to Category No.: 14720; Payload ID: 3554 relates to Category No.: 7288, 15715, 4439, 16193, 7187, 7188, 7182; Payload ID: 3556 relates to Category No.: 7288, 12133, 7287; Payload ID: 3557 relates to Category No.: 15517, 12133, 7291, 16182, 14271, 15291, 4439, 7261;

Payload ID: 3558 relates to Category No.: 15517, 14267, 7291, 16182, 14271, 7273, 7287, 15291, 4439, 7261; Payload ID: 3559 relates to Category No.: 15517, 15715, 7291, 16182, 14271, 7273, 7287, 15291, 4439, 7261; Payload ID: 3560 relates to Category No.: 7261; Payload ID: 3561 relates to Category No.: 7288, 15517, 14267, 7291, 16182, 14271, 7273, 7287, 15291, 4439, 7261; Payload ID: 3562 relates to Category No.: 1730, 7306, 13558; Payload ID: 3563 relates to Category No.: 7288, 14271; Payload ID: 3564 relates to Category No.: 13594, 5095, 13589, 3398, 11843, 11512, 14565, 8731, 3398, 2467, 15517, 11109, 11506, 3398, 14838, 2410, 3309, 2022, 13004, 2469, 12944, 13999, 13637, 8018, 9991, 10790, 13921, 3742, 15490, 3398; Payload ID: 3565 relates to Category No.: 15490, 3398, 8731, 3398, 7810, 14123; Payload ID: 3566 relates to Category No.: 6814, 1995; Payload ID: 3567 relates to Category No.: 795; Payload ID: 3568 relates to Category No.: 7122, 5772; Payload ID: 3569 relates to Category No.: 6219, 1764, 14038, 2276, 11237, 10074, 5446, 10238, 11109, 1727, 2610, 2610, 2488, 10273, 1238, 12117, 14102, 10080, 2275, 11566, 13692, 10864, 5806, 11299, 11111, 8177, 13228, 13946, 11944, 12536, 11090, 7649, 11086, 6952, 2173, 8517, 6954, 13235, 11463, 14050, 7613, 10372, 496, 13921, 10358, 1993, 8940, 13988, 3940, 3632; Payload ID: 3570 relates to Category No.: 2459, 9420; Payload ID: 3571 relates to Category No.: 1727; Payload ID: 3574 relates to Category No.: 1204; Payload ID: 3578 relates to Category No.: 6814, 12194, 16308, 4609, 14663, 1878, 4612, 15089; Payload ID: 3579 relates to Category No.: 13465, 7946, 11399, 8446, 11398; Payload ID: 3580 relates to Category No.: 1207, 9982, 14663, 2552, 16234, 16275, 9567, 2558; Payload ID: 3581 relates to Category No.: 13589, 3398, 15490, 3398, 9660, 15433, 12053, 2410, 1867, 14663, 16197, 10606, 13030, 5203, 5171, 5169, 10372, 8507, 5786, 5773, 3630, 12939, 5104, 496, 7863, 13797, 13182; Payload ID: 3582 relates to Category No.: 1204, 3014; Payload ID: 3583 relates to Category No.: 12194, 10074, 7306, 1795, 381, 2945, 11285, 1893, 11307, 1238, 11660, 4180, 6145, 9674, 14050, 11323, 1238, 5825, 8476, 12543, 10280, 10446, 8549, 7625, 7983, 11192, 12891, 10372, 12648, 10362, 11187, 2051, 13884; Payload ID: 3584 relates to Category No.: 4828, 334, 5428, 10074, 10372, 11987, 348, 674, 7743, 11506, 3398, 10775, 8373, 10366, 13925, 1238, 11601, 11392, 9932, 10877, 10486, 10955, 11187, 10583, 10856, 10852, 14050, 10470, 13695, 11323, 10301, 15836, 14941, 10083, 12543, 10280, 10446, 2642, 10487, 11339, 13459, 8011, 3917, 13013, 5243, 8572, 15379; Payload ID: 3585 relates to Category No.: 4828, 15379, 11512, 5428, 5446, 3021, 15186, 12993, 10775, 11602, 10366, 10878, 11302, 1238, 13049, 10902, 10486, 6145, 10191, 11187, 10583, 10856, 10852, 8192, 3876, 5609, 10419, 8996, 5617, 11495, 11429, 12543, 10655, 11339, 8785, 11496, 11216, 11494, 8722, 6641, 10479, 2287, 10562, 11182, 3729, 6148, 11106, 5630, 2302, 7788, 11327; Payload ID: 3586 relates to Category No.: 4828, 10074, 1238, 15379, 14050; Payload ID: 3587 relates to Category No.: 4828, 14565, 10074, 1238, 15379, 9932, 14050, 11323, 10083; Payload ID: 3588 relates to Category No.: 334, 2885, 10366, 1238, 10558, 11266, 10226, 1238, 4055, 11212, 11216, 357, 332, 13835, 13925, 14050, 13936, 11390, 496, 2001, 13846, 14021, 13929; Payload ID: 3589 relates to Category No.: 12194, 1893, 1238, 11660, 9674, 1238, 5825, 1238, 4055, 16342; Payload ID: 3590 relates to Category No.: 10074, 3833, 12063, 2669, 1893, 6738, 1238, 11660, 10080, 1237; Payload ID: 3591 relates to Category No.: 12194, 10366, 1893, 1238, 10902, 11660, 9674, 2469, 11266, 1238, 4055, 11212, 11216, 13967, 13969, 13874, 13836, 13866, 9411, 14047, 10280; Payload ID: 3592 relates to Category No.: 9500, 10074, 3833, 381, 12063, 2669, 1893, 6738, 1238, 11660, 10080, 1238, 5825; Payload ID: 3593 relates to Category No.: 1204; Payload ID: 3594 relates to Category No.: 1204; Payload ID: 3595 relates to Category No.: 1204; Payload ID: 3596 relates to Category No.: 12194, 10366, 1893, 1238, 11660, 9674, 11266, 1238, 5825, 1238, 4055; Payload ID: 3597 relates to Category No.: 12194, 1238, 10069, 1238, 5825, 10621, 12543; Payload ID: 3598 relates to Category No.: 12194, 5446, 12099, 1238, 4180, 11859, 1238, 5825, 10280, 16342, 10621, 10050, 4074, 11208, 13946, 12543; Payload ID: 3599 relates to Category No.: 10074, 9632, 1238, 10080, 16294; Payload ID: 3600 relates to Category No.: 1238; Payload ID: 3601 relates to Category No.: 5782, 16172, 3833, 14098, 4771, 5798, 6738, 2662, 9561; Payload ID: 3602 relates to Category No.: 5782, 16172, 14098, 4771, 5798, 16197, 6738, 2662; Payload ID: 3603 relates to Category No.: 5782, 16172, 3833, 14098, 4771, 5798, 6738, 2662, 15471; Payload ID: 3604 relates to Category No.: 12137, 3833, 14098, 4771, 5798, 6738, 2662; Payload ID: 3605 relates to Category No.: 5782, 16172, 14098, 4771, 6738, 9421, 3881, 2662; Payload ID: 3606 relates to Category No.: 5782, 16172, 14098, 4771, 5798; Payload ID: 3607 relates to Category No.: 15626, 5782, 16172, 14098, 4771, 5798, 6738, 2662, 15471, 12137; Payload ID: 3608 relates to Category No.: 12137, 15626, 5782, 16172; Payload ID: 3614 relates to Category No.: 12648, 3013, 14456, 10794; Payload ID: 3615 relates to Category No.: 2410, 11997, 7890, 2403; Payload ID: 3618 relates to Category No.: 6814, 4634, 5898, 15883, 14663; Payload ID: 3619 relates to Category No.: 4634, 6902, 15883, 14663; Payload ID: 3620 relates to Category No.: 15883; Payload ID: 3621 relates to Category No.: 6902, 15883, 14663; Payload ID: 3622 relates to Category No.: 9500, 15883, 14400, 14663; Payload ID: 3623 relates to Category No.: 11512, 9500, 8739, 15883, 14663, 7027, 13397, 5406, 13975, 8889, 2083, 8906, 13755, 3167, 7121, 490, 13827; Payload ID: 3624 relates to Category No.: 15883, 7039, 7508; Payload ID: 3625 relates to Category No.: 1026, 14038, 3766, 12760, 7613, 10074, 5446, 2940, 274, 14108, 4130, 12640, 1238, 10080, 284, 12091, 7141, 286, 8869, 13773, 3871, 8876, 10191; Payload ID: 3626 relates to Category No.: 10191, 286, 7332, 14365, 284; Payload ID: 3627 relates to Category No.: 1730, 7306; Payload ID: 3628 relates to Category No.: 15490, 3398, 14565, 8739, 10775; Payload ID: 3629 relates to Category No.: 15490, 3398, 8739; Payload ID: 3630 relates to Category No.: 14699, 2460, 2459, 9420, 3176, 4949; Payload ID: 3632 relates to Category No.: 6814; Payload ID: 3634 relates to Category No.: 2461, 9475, 4952, 3170, 3809, 5457, 1043; Payload ID: 3639 relates to Category No.: 7030, 7029, 1414; Payload ID: 3642 relates to Category No.: 2459; Payload ID: 3643 relates to Category No.: 2461, 9475; Payload ID: 3648 relates to Category No.: 7306; Payload ID: 3651 relates to Category No.: 1737, 1721; Payload ID: 3653 relates to Category No.: 12062; Payload ID: 3656 relates to Category No.: 1955, 9099, 2902; Payload ID: 3657 relates to Category No.: 14038; Payload ID: 3662 relates to Category No.: 15042; Payload ID: 3664 relates to Category No.: 2250, 2197; Payload ID: 3673 relates to Category No.: 2461, 3176, 9475, 12714; Payload ID: 3677 relates to Category No.: 15144, 14838, 9379, 3452, 2423; Payload ID: 3697 relates to Category No.: 2186, 2985; Payload ID: 3700 relates to Category No.: 4138; Payload ID: 3705 relates to Category No.: 6961; Payload ID: 3710 relates to Category No.: 12137, 10775, 4775, 11299, 8103, 1847, 2909; Payload ID: 3715 relates to Category No.: 2459; Payload ID: 3720 relates to Category No.: 10491; Payload ID: 3722 relates to Category No.: 14831, 2461, 7245, 4952, 6375, 3178, 3170, 3177, 3809, 5457, 2465, 1043, 12715, 3176, 4949; Payload ID: 3723 relates to Category No.: 14831, 2461, 7245, 4952, 6375, 3178, 3170, 3177, 3809, 5457, 3808, 1043, 12715; Payload ID: 3726 relates to Category No.: 9455, 11634, 3837, 3827, 3676, 1408; Payload ID: 3729 relates to Category No.: 12137, 1204; Payload ID: 3733 relates to Category No.: 13589, 3398, 15490, 3398, 1893; Payload ID: 3734 relates to Category No.: 1204; Payload ID: 3737 relates to Category No.: 11512, 1964; Payload ID: 3739 relates to Category No.: 8936, 4776; Payload ID: 3742 relates to Category No.: 3140, 14073, 11641; Payload ID: 3743 relates to Category No.: 2985, 2186, 1779, 7318; Payload ID: 3754 relates to Category No.: 2985, 1779, 14622; Payload ID: 3755 relates to Category No.: 15144, 6696; Payload ID: 3756 relates to Category No.: 6969, 13171, 8454; Payload ID: 3757 relates to Category No.: 4021, 10383; Payload ID: 3763 relates to Category No.: 15490, 3398, 1730, 8731, 3398, 7735, 7971; Payload ID: 3764 relates to Category No.: 2243; Payload ID: 3765 relates to Category No.: 16197; Payload ID: 3766 relates to Category No.: 6969, 2886; Payload ID: 3767 relates to Category No.: 1752, 3356, 12459, 12646, 12775, 6738, 13232, 15464, 6018, 361, 13371; Payload ID: 3769 relates to Category No.: 16286, 11940, 15004, 13371, 11912; Payload ID: 3773 relates to Category No.: 12137; Payload ID: 3775 relates to Category No.: 12137, 4775; Payload ID: 3783 relates to Category No.: 6967; Payload ID: 3784 relates to Category No.: 9420, 7108, 7109, 7110, 7111; Payload ID: 3785 relates to Category No.: 7122, 9506, 927, 7629; Payload ID: 3786 relates to Category No.: 15490, 3398, 11512, 12672; Payload ID: 3787 relates to Category No.: 15490, 3398, 8739, 7045, 5464, 2768; Payload ID: 3788 relates to Category No.: 9500, 12127, 1893, 12051, 2994, 11946, 2083, 7037, 13352, 3907, 10395; Payload ID: 3789 relates to Category No.: 486; Payload ID: 3790 relates to Category No.: 1955, 2768; Payload ID: 3792 relates to Category No.: 9500; Payload ID: 3793 relates to Category No.: 14034, 8760, 15001, 7292, 11546, 13812; Payload ID: 3794 relates to Category No.: 7288, 13589, 3398; Payload ID: 3795 relates to Category No.: 13589, 3398, 6530, 9223, 9088; Payload ID: 3796 relates to Category No.: 6219, 6212, 3244, 14663, 14086, 10005, 16211, 6213, 10331, 13851, 11634; Payload ID: 3797 relates to Category No.: 10331, 6212, 3244; Payload ID: 3798 relates to Category No.: 10331, 6212, 3244; Payload ID: 3799 relates to Category No.: 14928, 11597, 11595, 16119, 6406, 11288, 10226, 10557, 10930; Payload ID: 3800 relates to Category No.: 6814, 4021; Payload ID: 3801 relates to Category No.: 6814, 4021; Payload ID: 3802 relates to Category No.: 2548, 5462, 11242, 11148, 7693, 11147, 16286, 10038, 3898, 9453, 1752; Payload ID: 3803 relates to Category No.: 14456, 12427, 10074, 11506, 3398, 16214, 14640, 10366, 12994, 4020, 10314, 4021, 2569, 1238, 2571, 6145, 14645, 12036, 2568, 10578, 1240, 3612, 15463, 14643, 12137, 1906, 9455, 7755, 3631, 14641, 1623, 11936, 5802, 4067, 1278, 2051, 13835, 13967, 2110, 9451, 2131, 13936, 16294, 1970, 2136, 13827, 13966, 13981, 14011, 13797, 13877, 13881, 1960, 13847, 2150, 13814, 15462, 1972; Payload ID: 3804 relates to Category No.: 12427, 10074, 14640, 14108, 12544, 12994, 4020, 4021, 2569, 1238, 15570, 2571, 6145, 14645, 1240, 9320, 1906, 11936; Payload ID: 3805 relates to Category No.: 1026, 14456, 16214, 14640, 12994, 4020, 4021, 2569, 2571, 3610, 1622, 12891, 5459, 9465, 7966, 2169, 3631, 9540, 4953, 9451, 5458, 14641, 6194, 2376, 1623, 15425, 1621, 1269, 6191, 9129, 1918, 12192; Payload ID: 3806 relates to Category No.: 1026, 12427, 10074, 9632, 13996, 13818, 4949, 1820, 5592, 2243, 12994, 4020, 4021, 2569, 15570, 16294, 2571, 4012, 8377, 11339, 14643, 8106, 1240, 3246, 1906, 758, 13936, 496, 14640; Payload ID: 3807 relates to Category No.: 1026, 1295, 12427, 4020, 4021, 2569, 9600, 1093, 13718, 1249, 14064, 1906, 8918, 3791; Payload ID: 3808 relates to Category No.: 690, 1026, 12427, 4020, 7598, 4021, 2569, 3643, 2131, 15490, 3398; Payload ID: 3809 relates to Category No.: 1026, 334, 7912, 1703, 14456, 7743, 1795, 1780, 4020, 7598, 4021, 2569, 4490, 1237, 3707; Payload ID: 3810 relates to Category No.: 12091, 5367, 14865, 14663, 14862, 3830, 5406, 9982, 14565, 1780, 13831, 7340, 4953, 6215, 2211, 1764, 3676, 7121; Payload ID: 3811 relates to Category No.: 1026, 4020, 4021, 2569, 4490; Payload ID: 3812 relates to Category No.: 1026, 4020, 4021, 2569, 8918; Payload ID: 3813 relates to Category No.: 1703, 4020, 4021, 2569, 1906; Payload ID: 3814 relates to Category No.: 1026, 4020, 4021, 2569, 9410, 1622, 15425, 4885, 2376; Payload ID: 3815 relates to Category No.: 1026, 14640, 4020, 4021, 2569; Payload ID: 3816 relates to Category No.: 1026, 4020, 4021, 2569, 6530, 4138; Payload ID: 3817 relates to Category No.: 1026, 1703, 1752, 4020, 4021, 2569, 2571, 2568, 4012, 14643, 4058, 7910, 16294, 14927, 5590, 1240, 4953, 15277, 12656; Payload ID: 3818 relates to Category No.: 1026, 4020, 4021, 2569, 2571, 14643, 4058, 7910, 1906, 14640, 9451; Payload ID: 3819 relates to Category No.: 1026, 4020, 4021, 2569, 2571, 14643, 1820; Payload ID: 3820 relates to Category No.: 1026, 1703, 4020, 4021, 2569, 9455, 11936, 3643, 1906; Payload ID: 3821 relates to Category No.: 1026, 1703, 4020, 4021, 2569, 11936, 13860; Payload ID: 3822 relates to Category No.: 1026, 7912, 1703, 7345, 4020, 4021, 2569; Payload ID: 3823 relates to Category No.: 1703, 4020, 4021, 2569; Payload ID: 3824 relates to Category No.: 1703, 4020, 4021, 2569; Payload ID: 3825 relates to Category No.: 7912, 1703, 3781, 3833, 12063, 2669, 1893, 4020, 6738, 4021, 2569, 11660, 3643; Payload ID: 3826 relates to Category No.: 690, 1703, 4020, 4021, 2569, 3643, 3801, 10383, 1464; Payload ID: 3827 relates to Category No.: 690, 14589, 4020, 4021, 2569, 3801, 1464; Payload ID: 3828 relates to Category No.: 14640, 4020, 4021, 2569, 3631, 1622; Payload ID: 3829 relates to Category No.: 14456, 16214, 4020, 4021, 2569, 2571, 3643, 3147, 16133, 5459, 3613, 1622, 4953, 14641, 2374, 1621, 15277, 12192, 9451; Payload ID: 3830 relates to Category No.: 14456, 14640, 4020, 4021, 2569, 2571, 9540, 14768, 1622; Payload ID: 3831 relates to Category No.: 1703, 14640, 4020, 4021, 2569, 2571, 3643; Payload ID: 3832 relates to Category No.: 1730, 1820, 14589, 4020, 4021, 2569, 3631, 7238; Payload ID: 3833 relates to Category No.: 14589, 4020, 4021, 2569, 2571, 5243, 16132, 12635; Payload ID: 3834 relates to Category No.: 1703, 1730, 14589, 14640, 4020, 4021, 2569, 14636; Payload ID: 3835 relates to Category No.: 690, 14565, 1703, 1730, 4020, 4021, 2569; Payload ID: 3836 relates to Category No.: 1703, 5592, 4020, 4021, 2569, 4145, 5573, 1705, 10629, 1906; Payload ID: 3837 relates to Category No.: 3781, 1820, 12994, 4020, 4021, 2569, 1749, 4990; Payload ID: 3838 relates to Category No.: 1703, 7743, 16214, 4020, 4021, 2569, 9410, 10372, 690, 10366, 10552, 3714, 13827, 13879; Payload ID: 3839 relates to Category No.: 4021; Payload ID: 3840 relates to Category No.: 4021; Payload ID: 3841 relates to Category No.: 4021; Payload ID: 3842 relates to Category No.: 4020, 4021, 2569; Payload ID: 3843 relates to Category No.: 4021, 4969; Payload ID: 3844 relates to Category No.: 4020, 4021, 2569, 1049; Payload ID: 3845 relates to Category No.: 4020, 4021, 2569, 10383; Payload ID: 3846 relates to Category No.: 4021, 4880;

Payload ID: 3847 relates to Category No.: 7912, 1703, 4021; Payload ID: 3848 relates to Category No.: 914, 214, 13529, 14617, 3906; Payload ID: 3849 relates to Category No.: 8862, 1026, 9232, 6969, 8928, 6814; Payload ID: 3851 relates to Category No.: 12427, 7306, 3198; Payload ID: 3852 relates to Category No.: 11940, 12427, 5446, 3012, 9777, 12432, 15448, 10345, 1967, 1511, 5367; Payload ID: 3853 relates to Category No.: 5428, 4998, 1730, 15614, 5446, 10372, 1780, 10366, 10648, 11041, 10382, 11265, 7214, 9459, 11150, 10946, 10394, 10947, 6468, 10942, 3199, 13100, 11038, 10944, 11003, 5243, 11051, 6552, 1313, 13276, 11305, 9462, 11137, 6564, 6465, 9451, 9320; Payload ID: 3854 relates to Category No.: 12091, 9720, 2885, 15614, 14565, 5428, 4998, 12648, 5446, 10372, 1948, 7306, 11296, 9891, 1780, 10366, 11285, 11858, 9862, 12461, 11291, 10583, 7217, 2047, 14330, 10370, 9459, 10416, 11582, 12555, 6468, 6465, 1813, 6560, 1026, 7743, 7613, 9333, 4257, 14636, 11150; Payload ID: 3855 relates to Category No.: 1026, 5367, 14661, 5446, 6606, 348, 4186, 12391, 4127, 3775, 10648, 5541, 16085, 8988, 3049, 7966, 10522, 7377, 10946, 11584, 11213, 10842, 7851, 12646, 12891, 10372, 3605, 2041, 6459, 3810; Payload ID: 3856 relates to Category No.: 1026, 14661, 5446, 6606, 348, 4186, 12391, 4127, 3775, 5541, 16085, 8988, 2885, 1991, 4843; Payload ID: 3857 relates to Category No.: 1026, 14661, 14565, 2885, 5446, 6606, 348, 4186, 13756, 12391, 4127, 3775, 1893, 5541, 16085, 8988, 2019, 5693, 5703; Payload ID: 3858 relates to Category No.: 5367, 11512, 2885, 1948, 7306, 10192, 10188, 11187, 11174, 11178, 11266, 11242, 11510, 4844, 11057, 2041, 10372, 8374; Payload ID: 3859 relates to Category No.: 14565, 2885, 1703, 3012, 9000, 13202, 609; Payload ID: 3861 relates to Category No.: 13589, 3398, 15490, 3398; Payload ID: 3862 relates to Category No.: 13589, 3398, 15490, 3398; Payload ID: 3863 relates to Category No.: 13589, 3398, 15490, 3398, 14742; Payload ID: 3864 relates to Category No.: 13589, 3398, 15490, 3398; Payload ID: 3865 relates to Category No.: 13589, 3398, 15490, 3398; Payload ID: 3866 relates to Category No.: 15490, 3398, 8390; Payload ID: 3867 relates to Category No.: 15490, 3398, 8731, 3398, 15782, 8390; Payload ID: 3868 relates to Category No.: 13589, 3398, 15490, 3398; Payload ID: 3869 relates to Category No.: 13589, 3398, 15490, 3398, 14742; Payload ID: 3871 relates to Category No.: 5446, 2610, 2488, 12724, 16189, 7823, 2488, 11369, 8613, 2624, 7823, 602; Payload ID: 3873 relates to Category No.: 5367, 5446, 1060, 1066, 2610, 2488, 16189, 1053, 2624; Payload ID: 3874 relates to Category No.: 7288, 5367, 15490, 3398, 795, 8739, 5446, 9854, 10238, 14271, 6643, 2610, 2488, 16197, 1238, 12724, 11266, 8129, 10498, 10343, 8335, 16182, 11102, 8141, 7860, 1238, 5825, 11425, 11562, 8265, 8587, 11024; Payload ID: 3875 relates to Category No.: 5446, 1816, 2610, 2610, 2488, 13905; Payload ID: 3876 relates to Category No.: 5446, 2610, 2610, 2488, 5458; Payload ID: 3877 relates to Category No.: 5367, 5446, 2610, 2610, 2488, 8041, 8249; Payload ID: 3878 relates to Category No.: 6296; Payload ID: 3879 relates to Category No.: 12066; Payload ID: 3880 relates to Category No.: 13525; Payload ID: 3881 relates to Category No.: 7990, 7946, 7971; Payload ID: 3882 relates to Category No.: 12194, 5367, 5446, 2610, 2610, 2488; Payload ID: 3883 relates to Category No.: 12194, 5446, 2610, 2488; Payload ID: 3884 relates to Category No.: 12194, 5446, 2610, 2610, 2488; Payload ID: 3885 relates to Category No.: 12194, 5446, 2610, 2610, 2488, 12724, 10236, 13966; Payload ID: 3886 relates to Category No.: 4828, 5367, 14565, 5428, 7912, 5446, 4110, 2610, 2610, 2488, 12994, 11285, 12724, 10913, 2610, 602, 11595, 10669, 13629, 10687, 10236, 11575, 11182, 10226, 10200, 13835, 13859, 13989, 13836, 10583, 13932, 1238, 10509, 15436; Payload ID: 3887 relates to Category No.: 4828, 5428, 2311, 10486, 1237, 11595, 10226, 11102, 10942, 10366, 11391, 10514, 12544, 10656, 2624, 15438; Payload ID: 3888 relates to Category No.: 5446, 2610, 2488, 12724, 11243, 7823, 2488, 13269; Payload ID: 3889 relates to Category No.: 5446, 2610, 2488, 1238, 12724, 11243, 7823, 2488, 13269; Payload ID: 3890 relates to Category No.: 5428, 7912, 5446, 2610, 2610, 2488, 12724, 10236; Payload ID: 3891 relates to Category No.: 5428, 7912, 5446, 2610, 2610, 2488, 12724, 10236, 9391, 3150; Payload ID: 3892 relates to Category No.: 5428, 7912, 5446, 2610, 2610, 2488, 12724, 10236, 9391, 3150; Payload ID: 3893 relates to Category No.: 4828, 5428, 1713, 7912, 5446, 345, 1795, 2610, 2888, 2311, 2610, 2488, 14015, 12724, 7131, 10416, 2610, 602, 11595, 8245, 5406, 10226; Payload ID: 3894 relates to Category No.: 4828, 5367, 14565, 345, 14451, 2311, 10583, 10574, 355, 1849, 7294, 2622, 11595, 10226, 9000, 3016, 11102, 13982, 10942, 5428, 13925, 8373, 10486, 9411, 795, 2624, 1783; Payload ID: 3895 relates to Category No.: 4828, 5428, 2311, 10583, 8782, 10574, 8385, 13026, 8160; Payload ID: 3896 relates to Category No.: 5446, 2610, 2888, 2610, 2488, 12724, 5406, 10226, 10200, 10451; Payload ID: 3897 relates to Category No.: 5446, 2610, 2888, 2610, 2488, 12724, 2610, 602; Payload ID: 3898 relates to Category No.: 5367, 5446, 2610, 2610, 2488, 12724, 2610, 602, 2888; Payload ID: 3899 relates to Category No.: 5367, 5446, 2610, 2610, 2488, 12724, 2610, 602, 2888; Payload ID: 3900 relates to Category No.: 5446, 2610, 2488, 12724, 2610, 602, 2888; Payload ID: 3901 relates to Category No.: 5446, 2610, 2488, 12724, 2610, 602, 4997; Payload ID: 3902 relates to Category No.: 12194, 5446, 2610, 12724, 2610, 602; Payload ID: 3903 relates to Category No.: 12194, 10074, 5446, 2610, 1238, 10080, 2610, 602; Payload ID: 3904 relates to Category No.: 5446, 2610, 12724, 2610, 602; Payload ID: 3905 relates to Category No.: 2610; Payload ID: 3908 relates to Category No.: 6227; Payload ID: 3909 relates to Category No.: 2610, 602; Payload ID: 3911 relates to Category No.: 12194, 12427, 5446, 2610, 2488, 12724; Payload ID: 3912 relates to Category No.: 5367, 5446, 2610, 3013, 1893, 11660, 12724, 12068, 2610, 602, 12067; Payload ID: 3913 relates to Category No.: 8977, 15149, 3986, 8979, 12851, 4581, 5544, 15157; Payload ID: 3914 relates to Category No.: 8862, 1730, 16159, 8979, 12851, 6615, 11435, 15157; Payload ID: 3915 relates to Category No.: 8979, 5544, 13238, 15157; Payload ID: 3916 relates to Category No.: 8979, 3986, 13238; Payload ID: 3917 relates to Category No.: 12137, 5798, 4766, 14097, 16166; Payload ID: 3918 relates to Category No.: 12137, 5798, 4766; Payload ID: 3919 relates to Category No.: 5782, 11930, 3833, 14098, 4771, 5798, 12117, 4766, 12037; Payload ID: 3920 relates to Category No.: 4785, 12137, 14098, 4771, 4766, 14097, 16166, 4784; Payload ID: 3921 relates to Category No.: 12137, 5798; Payload ID: 3922 relates to Category No.: 12137, 5798, 4730; Payload ID: 3923 relates to Category No.: 5782, 11930, 14098, 4771, 12117, 4766, 12021, 12037; Payload ID: 3924 relates to Category No.: 12137, 5798; Payload ID: 3925 relates to Category No.: 13589, 3398, 11512, 15517, 7306, 16214, 14014, 9410, 14056, 2469, 11204; Payload ID: 3926 relates to Category No.: 14565, 1703, 3304, 12633, 1816, 7728, 3781, 15521, 1867, 14663, 4439, 10878, 10583, 10358, 14050, 11418, 1730, 1752, 8004, 12397, 690, 1820, 5592, 6375, 9451, 4186, 12703, 15425, 1621, 2379, 2640, 13835, 5785, 13969, 10372, 13773, 13860, 11285, 10648, 13981, 10470, 10446, 13843, 10356, 13945, 10636, 10322, 9412, 13778, 10342, 4019, 2946; Payload ID: 3927 relates to Category No.: 15614, 14108, 12391, 9982; Payload ID: 3928 relates to Category No.: 13465; Payload ID: 3929 relates to Category No.: 12091, 5367, 11512, 15207, 5428, 14038, 5446, 5359, 9038, 11109, 674, 4186, 1795, 7362, 10775, 9891, 4127, 3775, 14992, 15782, 8988, 2136, 15003, 15456, 15450, 7363, 15448, 15443, 15454, 11573, 5361, 15446, 15653, 15457, 15458, 15451, 9292, 6125, 13635, 9295, 5998, 7241, 6553, 9321, 13956, 9459, 6562, 14622, 13925, 14025, 13827, 13970, 13773, 13763, 14108, 13878, 15011; Payload ID: 3930 relates to Category No.: 8454, 10686; Payload ID: 3931 relates to Category No.: 1026, 1703, 9125, 2235, 10648, 8936, 11094, 11399, 11178; Payload ID: 3932 relates to Category No.: 1026, 1703, 12022, 2525, 11725, 6102, 8934, 8375, 6969, 12409, 1035, 484, 12641, 11288, 2247, 2174, 12521, 8936, 13236, 12506, 10207, 3905, 1820, 1048; Payload ID: 3933 relates to Category No.: 1703, 8862; Payload ID: 3934 relates to Category No.: 8862, 1026, 1295, 1048, 8936, 1035, 13530, 8375, 8924; Payload ID: 3935 relates to Category No.: 1703, 14456; Payload ID: 3936 relates to Category No.: 1026, 1703, 2169, 9125; Payload ID: 3937 relates to Category No.: 1026, 14565, 1703, 2940, 11371, 8940, 12022, 9575, 12038, 8947, 8936, 8920, 8921; Payload ID: 3938 relates to Category No.: 1295, 1703, 2243, 8936, 14729, 15325, 12022, 6102, 15622, 15108, 480, 16242, 2525, 8943, 15016, 16241, 6195; Payload ID: 3939 relates to Category No.: 1703, 1789; Payload ID: 3940 relates to Category No.: 1703; Payload ID: 3941 relates to Category No.: 1703, 13532, 4342, 13532, 3436, 12935; Payload ID: 3942 relates to Category No.: 1703; Payload ID: 3943 relates to Category No.: 13589, 3398, 15490, 3398, 7345, 2410, 5192; Payload ID: 3944 relates to Category No.: 14565, 9296, 15517, 3354, 8408, 15533, 4485, 9296, 3311, 2792, 8731, 3398, 14620, 1780, 8739, 8929; Payload ID: 3945 relates to Category No.: 15898, 14565, 9296, 3354, 15533, 4485, 9296, 3311, 13921, 2792, 5406; Payload ID: 3946 relates to Category No.: 9296, 3354, 11907, 15533, 4485, 9296, 3311, 2792; Payload ID: 3947 relates to Category No.: 15588, 11512, 11915, 9296, 15517, 15603, 3354, 11907, 13049, 15533, 4485, 9296, 3311, 13044, 4002, 2792, 12619; Payload ID: 3948 relates to Category No.: 9296, 3354, 16197, 15533, 4485, 9296, 3311, 2792; Payload ID: 3949 relates to Category No.: 9296, 3354, 15533, 4485, 9296, 3311, 2792; Payload ID: 3950 relates to Category No.: 9296, 3354, 15533, 4485, 9296, 3311, 2792; Payload ID: 3951 relates to Category No.: 9296, 3354, 7743, 352, 15533, 4485, 9296, 3311, 2792; Payload ID: 3952 relates to Category No.: 10494; Payload ID: 3953 relates to Category No.: 12194, 6219, 13589, 3398, 15490, 3398, 11091, 16172, 12993, 9945, 14663, 11266, 8004, 7879, 4653, 1922, 8391, 11568, 8937; Payload ID: 3954 relates to Category No.: 1922; Payload ID: 3955 relates to Category No.: 12091, 6219, 16172, 9945, 10366, 14663, 4653, 1922, 1993, 3840; Payload ID: 3957 relates to Category No.: 10494; Payload ID: 3958 relates to Category No.: 6219, 8862, 16172, 15149, 9945, 14663, 4653, 10494, 1922; Payload ID: 3959 relates to Category No.: 6219, 15626, 9945, 14663, 4653, 1922; Payload ID: 3960 relates to Category No.: 1204; Payload ID: 3961 relates to Category No.: 9500, 6819, 13700, 15113, 13998, 5769, 2677, 11161, 10331; Payload ID: 3962 relates to Category No.: 15490, 3398, 12137, 2674, 8390, 11298, 4775, 8526, 13338, 10066, 8643; Payload ID: 3963 relates to Category No.: 9500, 10173, 14663, 4977, 10174, 12209, 13886, 13887, 13944, 13905, 13916, 13784; Payload ID: 3964 relates to Category No.: 287, 3246, 8887, 3568, 6269, 14792, 9129, 4217, 2594, 285, 10493, 11348; Payload ID: 3965 relates to Category No.: 287, 285; Payload ID: 3966 relates to Category No.: 9324, 690, 1893, 11660, 12068, 5949, 9325, 5754; Payload ID: 3967 relates to Category No.: 13259, 15517, 12096, 11512, 7372, 3023, 9455, 1751, 9451, 6412; Payload ID: 3968 relates to Category No.: 13589, 3398, 15490, 3398, 8731, 3398, 8378, 11094, 11512, 3791; Payload ID: 3969 relates to Category No.: 13589, 3398, 15490, 3398, 11237, 8731, 3398, 7743, 1780, 13882, 4844, 8035, 12481, 8739; Payload ID: 3970 relates to Category No.: 13594, 7288, 15490, 3398, 8731, 3398, 14271; Payload ID: 3971 relates to Category No.: 12194, 12544, 9637, 4145, 13412, 13543; Payload ID: 3972 relates to Category No.: 14645; Payload ID: 3973 relates to Category No.: 5367, 5785, 14565, 3833, 12063, 2669, 1893, 6738, 11660; Payload ID: 3974 relates to Category No.: 5785, 3833, 12063, 2669, 1893, 6738, 11660, 12483, 13126, 15149, 4588, 13252, 6292, 8560, 7601; Payload ID: 3975 relates to Category No.: 5785, 3833, 12063, 2669, 1893, 6738, 11660, 12483, 13126, 15149, 4588; Payload ID: 3976 relates to Category No.: 12137, 5785, 3833; Payload ID: 3977 relates to Category No.: 5936; Payload ID: 3978 relates to Category No.: 14589, 13867; Payload ID: 3980 relates to Category No.: 274; Payload ID: 3981 relates to Category No.: 12137, 287, 4770; Payload ID: 3982 relates to Category No.: 9779, 6138, 5446, 9777, 274, 12459, 10175, 7536, 7252, 1823, 7569, 5243, 2020, 1752, 12648, 1417, 13818, 10366, 286, 11460, 8373, 12469, 12465, 8860, 13408, 15197, 11445, 8816, 16028, 3526; Payload ID: 3983 relates to Category No.: 1752, 274, 12504, 280, 16294, 7623, 14330, 3708, 8633, 10890, 2094, 278, 12005; Payload ID: 3984 relates to Category No.: 14565, 9777, 274, 337, 8869, 8535, 7992, 8667, 13371, 12882, 3900, 7938, 8523, 10890, 12823, 12879, 13520, 13449; Payload ID: 3985 relates to Category No.: 5785, 274; Payload ID: 3986 relates to Category No.: 274; Payload ID: 3987 relates to Category No.: 14661, 5782, 12427, 275, 1767, 287, 8940, 10192, 11392, 12522, 4229, 6021, 7965, 13165, 15045, 1740, 3058; Payload ID: 3988 relates to Category No.: 1295; Payload ID: 3992 relates to Category No.: 14565, 5428, 15149, 15149, 3436, 4145, 6103, 9590, 10442, 16268, 7811, 13697, 10458, 13252, 6297, 472, 6375, 4512, 7728, 6323, 10372, 13827, 13836, 13837, 13815, 13811, 11285, 10648, 8400, 10309, 13883, 7658, 8004, 13838, 1937, 14972, 1951, 5334, 10802, 3294, 10356, 8233, 10455, 901, 7935, 10298, 5845, 8015, 5267, 13463, 13978, 10511, 10454, 10271; Payload ID: 3993 relates to Category No.: 14565, 5428, 5268, 1925, 2136, 1965, 2121, 12453, 15149, 3436, 1115, 4145, 1957, 1922, 6103, 1964, 2095, 13252, 12727, 7827, 1937, 1989, 7828, 5263, 6623; Payload ID: 3994 relates to Category No.: 4828, 5367, 1795, 10209, 328, 4145, 8825, 9590, 1944, 12479, 2728, 12726; Payload ID: 3995 relates to Category No.: 4828, 1795, 472, 4131, 1115, 12726, 2728, 4443, 1113, 13882, 6323, 8962, 10486, 10309, 9932, 434, 13883, 6758, 16213, 13530, 13829, 8374, 4132, 5334, 3791, 5268, 7977, 1114, 442, 7935, 6297, 1119, 10961; Payload ID: 3996 relates to Category No.: 4828, 442, 1795, 7598, 7692, 10313, 1944, 11987, 6323, 10648, 8400, 7688, 10309, 286, 14454, 8004, 1982, 2235, 5334, 11109, 3791, 8233, 7993, 10282, 5268, 7977, 1638, 8119, 12832, 10710, 11370, 10311, 10851, 7935, 11419, 4415, 14637, 7675, 7858; Payload ID: 3997 relates to Category No.: 15149, 439; Payload ID: 3998 relates to Category No.: 5297, 14663, 7039, 2869, 4977, 10174, 1895, 13754, 4975, 4981, 7043, 7122, 486, 2871; Payload ID: 3999 relates to Category No.: 5297, 13756, 13754, 8020; Payload ID: 4000 relates to Category No.: 7096; Payload ID: 4001 relates to Category No.: 1204; Payload ID: 4002 relates to Category No.: 2679, 4448, 1295, 4949; Payload ID: 4003 relates to Category No.:

12137, 11954, 13754, 11956; Payload ID: 4004 relates to Category No.: 486, 7096; Payload ID: 4005 relates to Category No.: 486, 7096; Payload ID: 4006 relates to Category No.: 3021, 4949, 275, 1814, 12994, 5256, 1238, 7122, 9000, 1563, 4382, 6145, 5037, 16189, 4459, 3811, 15540, 1006, 14589, 7701, 12520, 1008; Payload ID: 4017 relates to Category No.: 7306, 1204, 12646, 1703, 12648, 7984; Payload ID: 4018 relates to Category No.: 5428, 381, 10648, 8812, 3016, 8248, 11429, 8219, 9391, 13026; Payload ID: 4019 relates to Category No.: 9982, 10129, 14663, 1878, 15042, 2761, 1295, 1841; Payload ID: 4020 relates to Category No.: 9982, 10129, 14663, 1878, 2761, 6814; Payload ID: 4021 relates to Category No.: 9982, 10129, 14663, 1878, 2761, 6814; Payload ID: 4022 relates to Category No.: 9982, 10129, 14663, 1878, 7340, 2761; Payload ID: 4023 relates to Category No.: 9982, 10129, 14663, 1878, 2761, 9906; Payload ID: 4024 relates to Category No.: 5095, 13589, 3398, 14565, 2139, 8739, 5446, 11506, 3398, 13492, 15521, 2410, 9125, 11884, 1867, 14663, 4439, 16197, 14992, 13882, 1995, 11573, 5244, 3578, 2006, 13597, 12671, 14123, 11847, 9142, 15517, 4464, 11512, 13893, 1780, 1804, 10637, 10345, 11110; Payload ID: 4025 relates to Category No.: 15490, 3398, 11512, 16197, 10459, 11941, 3743, 14123, 6758, 6734, 10923, 10493; Payload ID: 4026 relates to Category No.: 11512, 10459, 11941, 15490, 3398, 4521, 16197, 4535, 15471, 5162; Payload ID: 4027 relates to Category No.: 15490, 3398, 11512, 16197, 6459, 10459, 11941, 7692, 3727, 8216; Payload ID: 4028 relates to Category No.: 13589, 3398, 15490, 3398, 14038, 8731, 3398, 13460, 8004, 3783; Payload ID: 4029 relates to Category No.: 13589, 3398, 15490, 3398, 15626, 8739, 14033, 13831, 11243, 11295, 7917, 10863, 6624, 8017, 11229; Payload ID: 4030 relates to Category No.: 3176, 4418, 9085; Payload ID: 4031 relates to Category No.: 4418; Payload ID: 4032 relates to Category No.: 7288, 14267, 7291, 16182, 14913, 7131, 10491; Payload ID: 4033 relates to Category No.: 1816, 3924, 4059, 10061, 6738; Payload ID: 4034 relates to Category No.: 7912, 14793, 6492, 10286, 10578, 6796, 9130, 1598; Payload ID: 4035 relates to Category No.: 1183, 1814, 12041, 1749; Payload ID: 4036 relates to Category No.: 15490, 3398, 8739, 8731, 3398, 2467, 4521, 12166, 2469, 8018, 3743, 3310, 8547, 12717, 7810, 4535, 8040, 12769, 13858, 1252, 13888, 6226, 8019; Payload ID: 4037 relates to Category No.: 15490, 3398, 8739, 8731, 3398, 2467, 12166, 2469, 8018, 3743, 12717, 7810, 4535, 8467, 1252, 13499, 11949, 13888, 6226, 8019; Payload ID: 4038 relates to Category No.: 11940, 7613, 16214, 14014, 8173; Payload ID: 4039 relates to Category No.: 11940, 7613, 12626, 7340, 1978, 8173, 1463, 8004, 13882, 7840, 6111, 13877, 7345, 801, 15768, 13835, 11926, 7735, 496, 8554, 15003, 6981; Payload ID: 4040 relates to Category No.: 16214, 1463, 8728, 7946, 6111, 8524, 7845, 8458, 10228; Payload ID: 4041 relates to Category No.: 1204, 6111; Payload ID: 4042 relates to Category No.: 16214, 1463; Payload ID: 4043 relates to Category No.: 16214; Payload ID: 4044 relates to Category No.: 14014, 16214, 1463; Payload ID: 4045 relates to Category No.: 16214; Payload ID: 4046 relates to Category No.: 16214, 6111, 4057; Payload ID: 4047 relates to Category No.: 16214, 6111, 6113, 4057, 6115; Payload ID: 4048 relates to Category No.: 16214, 1463, 4057; Payload ID: 4049 relates to Category No.: 16214, 6111, 6114, 2107; Payload ID: 4051 relates to Category No.: 7242, 6111; Payload ID: 4052 relates to Category No.: 9500, 1512, 4110, 14663, 4558; Payload ID: 4053 relates to Category No.: 9500, 15412, 14456, 8739, 14663, 1878, 6424, 15407; Payload ID: 4054 relates to Category No.: 9500, 16214, 11941, 16306; Payload ID: 4055 relates to Category No.: 9500, 12353; Payload ID: 4056 relates to Category No.: 5782, 795, 11949, 1780, 11922; Payload ID: 4057 relates to Category No.: 12091, 15207, 1730, 10074, 7242, 15614, 1752, 9717, 5446, 403, 12646, 3775, 1238, 12737, 450, 12867, 15192, 8037, 7743, 8198, 11858, 1295, 2088, 8159, 7667, 8229, 9350, 10954, 7946, 8453; Payload ID: 4058 relates to Category No.: 2410, 5146, 5095, 4336, 6814; Payload ID: 4060 relates to Category No.: 1204; Payload ID: 4061 relates to Category No.: 10331, 3833, 12063, 1893, 6738, 11660; Payload ID: 4062 relates to Category No.: 1204; Payload ID: 4065 relates to Category No.: 7912; Payload ID: 4068 relates to Category No.: 9500, 15702; Payload ID: 4072 relates to Category No.: 10702, 12502, 12614; Payload ID: 4075 relates to Category No.: 14526, 15698; Payload ID: 4078 relates to Category No.: 14661, 14565, 10702; Payload ID: 4079 relates to Category No.: 6814, 9500; Payload ID: 4080 relates to Category No.: 13589, 3398; Payload ID: 4081 relates to Category No.: 11843, 12195, 11831; Payload ID: 4083 relates to Category No.: 14934; Payload ID: 4085 relates to Category No.: 13589, 3398; Payload ID: 4087 relates to Category No.: 1722, 1752, 1955, 10238, 7743, 7141, 8300, 12628, 1780, 7693, 1744, 9599, 11243; Payload ID: 4088 relates to Category No.: 1737, 15499, 15517, 11910, 4439, 16197, 11611, 3975, 7736; Payload ID: 4089 relates to Category No.: 13594, 11910, 8535, 8375, 7997, 8370, 3100; Payload ID: 4090 relates to Category No.: 3684, 11910, 1893, 5855, 8535, 7997, 3100; Payload ID: 4091 relates to Category No.: 11910, 7662, 11251; Payload ID: 4092 relates to Category No.: 11910, 1204, 8535, 7997, 3100; Payload ID: 4093 relates to Category No.: 3100, 11910, 7132, 12036, 9165, 7155, 11558, 4367, 6795, 10314; Payload ID: 4094 relates to Category No.: 6219, 7132, 11248, 12036, 7155, 11558; Payload ID: 4095 relates to Category No.: 13589, 3398; Payload ID: 4096 relates to Category No.: 13589, 3398; Payload ID: 4100 relates to Category No.: 5782, 12361, 12798, 12881, 14661, 12137, 14565, 5095, 13589, 3398, 9238; Payload ID: 4102 relates to Category No.: 13589, 3398; Payload ID: 4103 relates to Category No.: 13589, 3398; Payload ID: 4104 relates to Category No.: 13589, 3398; Payload ID: 4105 relates to Category No.: 1512, 6584, 11903; Payload ID: 4106 relates to Category No.: 1512, 6584, 11903; Payload ID: 4109 relates to Category No.: 10702, 13435; Payload ID: 4110 relates to Category No.: 10521; Payload ID: 4112 relates to Category No.: 3013; Payload ID: 4113 relates to Category No.: 13589, 3398; Payload ID: 4116 relates to Category No.: 7291, 16182; Payload ID: 4118 relates to Category No.: 15898; Payload ID: 4119 relates to Category No.: 12194; Payload ID: 4120 relates to Category No.: 9223, 9103; Payload ID: 4122 relates to Category No.: 13589, 3398; Payload ID: 4125 relates to Category No.: 13594, 13589, 3398, 1730; Payload ID: 4126 relates to Category No.: 13589, 3398; Payload ID: 4128 relates to Category No.: 13589, 3398; Payload ID: 4133 relates to Category No.: 6227; Payload ID: 4134 relates to Category No.: 13589, 3398; Payload ID: 4135 relates to Category No.: 13589, 3398; Payload ID: 4136 relates to Category No.: 13589, 3398; Payload ID: 4137 relates to Category No.: 9500; Payload ID: 4139 relates to Category No.: 7096; Payload ID: 4140 relates to Category No.: 13594, 15490, 3398, 15521; Payload ID: 4141 relates to Category No.: 12091, 6814, 15490, 3398, 9500, 10737, 12619, 8739, 8731, 3398, 7743, 8072, 16191, 16279, 8083, 8741; Payload ID: 4142 relates to Category No.: 6814, 15490, 3398, 11512, 9500, 8739, 8731, 3398, 7743, 16191, 16279, 11336, 10432; Payload ID: 4143 relates to Category No.: 9232, 2779, 1066, 4595, 14663, 12312, 13827, 9236, 9235, 15203, 2988; Payload ID: 4144 relates to Category No.: 12313, 4595, 14663, 12312, 9236, 9235, 2988; Payload ID: 4145 relates to Category No.: 15490, 3398, 11512, 8334, 8739, 16286, 5910, 2041, 11509, 8349, 10745, 5160, 14949, 5218, 5145, 10739, 5710, 3644, 10746, 15736, 5451, 1229, 12897, 13589, 3398, 5217; Payload ID: 4146 relates to Category No.: 15257, 8692, 10522, 13568, 7303, 1955, 10626, 14910, 15400, 2424, 496, 13734, 4974, 1270, 12887, 15262; Payload ID: 4147 relates to Category No.: 11910, 8772, 8769; Payload ID: 4148 relates to Category No.: 1795, 3012; Payload ID: 4149 relates to Category No.: 1795, 3012, 10086; Payload ID: 4150 relates to Category No.: 3639, 5446, 403; Payload ID: 4151 relates to Category No.: 10372; Payload ID: 4155 relates to Category No.: 1002; Payload ID: 4161 relates to Category No.: 7540; Payload ID: 4162 relates to Category No.: 12994; Payload ID: 4163 relates to Category No.: 1795, 12994; Payload ID: 4166 relates to Category No.: 1272, 9451, 2131, 11208, 2080, 14640; Payload ID: 4167 relates to Category No.: 1703, 5446, 403, 1795, 14992; Payload ID: 4168 relates to Category No.: 5446, 403, 14992; Payload ID: 4169 relates to Category No.: 5446, 14992, 3013, 403, 15196, 4129; Payload ID: 4170 relates to Category No.: 5446, 14992, 3013, 10478, 5367, 15196, 4129; Payload ID: 4171 relates to Category No.: 3639; Payload ID: 4172 relates to Category No.: 16189, 8688, 8686; Payload ID: 4173 relates to Category No.: 5785, 3639, 5446, 403, 12891, 16191, 736, 5790, 7187, 16189, 12543, 6137, 16203, 1815, 9627; Payload ID: 4174 relates to Category No.: 14565, 7613, 5446, 9454, 16189, 1849, 7372, 10478, 8348; Payload ID: 4175 relates to Category No.: 5446, 403, 10775, 14992, 10478, 3014; Payload ID: 4176 relates to Category No.: 5428, 5446, 9777, 12432, 14992, 15185, 1789, 3019, 1511, 6134, 2062; Payload ID: 4177 relates to Category No.: 12427, 10478; Payload ID: 4180 relates to Category No.: 4535, 14940; Payload ID: 4183 relates to Category No.: 1737, 1721, 1780, 15045, 1710, 15746; Payload ID: 4186 relates to Category No.: 12427, 2355, 6253, 14663, 2541, 14972, 2540, 16234, 16275, 16222, 15425, 6256; Payload ID: 4188 relates to Category No.: 8247, 7846; Payload ID: 4189 relates to Category No.: 7288, 8760, 13445, 7290, 3564, 4458, 14206, 11051, 14834; Payload ID: 4190 relates to Category No.: 7288, 14267, 12948, 7290; Payload ID: 4191 relates to Category No.: 7291, 16182, 14271, 12484, 16182, 11049, 16182, 14838, 14831; Payload ID: 4192 relates to Category No.: 8760, 3564, 12484, 16182, 601, 16182, 4458, 11049, 16182, 8335, 16182, 7290, 7957; Payload ID: 4193 relates to Category No.: 7288; Payload ID: 4194 relates to Category No.: 7288, 12484, 16182; Payload ID: 4195 relates to Category No.: 15898, 15207, 1722, 12153, 5446, 9038, 7743, 14383, 7362, 4127, 9125, 16197, 7132, 14992, 670, 15782, 11587, 13644, 4336, 15003, 4332, 15456, 15450, 7363, 15448, 15443, 15454, 2469, 15446, 15653, 15457, 15458, 5806, 15451, 9410, 795, 12058, 1780; Payload ID: 4196 relates to Category No.: 15898, 12154, 1722, 7743, 16197, 4332, 5806, 2006, 13597, 11878; Payload ID: 4197 relates to Category No.: 1026, 15898, 12154, 14661, 11843, 1722, 12153, 1752, 5446, 10372, 6606, 348, 5592, 4186, 3833, 11032, 12096, 12391, 7693, 2669, 4127, 10481, 3775, 5541, 16085, 8988, 12058, 4332, 5806, 7837, 7153, 15000, 8584, 14945, 3574, 8739, 13594, 5406, 16286, 7132, 1764, 4418, 6270, 15738, 4182; Payload ID: 4198 relates to Category No.: 15898, 12154, 1722, 9296, 3354, 7743, 16197, 4332, 15533, 5806, 15605, 9296, 3327, 3313, 3132, 4485, 9296, 3311, 14782, 5406, 11843, 10372, 4998, 8041, 10637, 13367, 13262, 12769; Payload ID: 4199 relates to Category No.: 15898, 12154, 1721, 9296, 3354, 15533, 15605, 9296, 3327, 3313, 3132, 5134, 4485, 9296, 3311, 16050, 11243, 10637, 8936; Payload ID: 4200 relates to Category No.: 15898, 12154, 1722, 1415, 7743, 1780, 16197, 4332, 5806, 12153, 2250, 12372; Payload ID: 4201 relates to Category No.: 12194, 15898, 12153, 3684, 6969, 7141, 13171, 10036, 1893, 16197, 4766, 3812, 10495, 5855, 16096; Payload ID: 4202 relates to Category No.: 15898, 12153, 6969, 13171; Payload ID: 4203 relates to Category No.: 12153, 1730, 7710, 14381, 11506, 3398, 11344; Payload ID: 4204 relates to Category No.: 15490, 3398, 12153, 11506, 3398, 14381; Payload ID: 4205 relates to Category No.: 13939, 11997; Payload ID: 4206 relates to Category No.: 1204; Payload ID: 4207 relates to Category No.: 15618, 5846, 12133, 2674, 2679; Payload ID: 4208 relates to Category No.: 5798, 13594, 13589, 3398, 7306, 10495, 8739, 15517, 11512, 5949, 6375, 986, 14097, 16166; Payload ID: 4209 relates to Category No.: 13589, 3398, 15490, 3398, 8739, 2562, 11431, 10648, 14545, 10495, 10503, 10590, 8731, 3398, 2080; Payload ID: 4210 relates to Category No.: 7291, 16182, 14271, 4439; Payload ID: 4211 relates to Category No.: 7291, 16182, 13185, 16182; Payload ID: 4213 relates to Category No.: 12075, 11926, 7291, 16182; Payload ID: 4214 relates to Category No.: 6814, 1204; Payload ID: 4215 relates to Category No.: 6814; Payload ID: 4218 relates to Category No.: 1780; Payload ID: 4219 relates to Category No.: 3246; Payload ID: 4220 relates to Category No.: 13589, 3398, 15490, 3398, 3684, 11506, 3398, 5159, 1893, 5855; Payload ID: 4221 relates to Category No.: 16286; Payload ID: 4222 relates to Category No.: 15490, 3398, 14565, 8739, 10775; Payload ID: 4224 relates to Category No.: 14838; Payload ID: 4225 relates to Category No.: 15618, 11674, 15626, 16214, 13126, 5848, 10005, 16211, 14111, 13437; Payload ID: 4226 relates to Category No.: 15618, 11674, 13126, 5848, 9420, 14014, 14455; Payload ID: 4227 relates to Category No.: 15618, 11674, 15626, 14565, 16214, 1651, 13126, 5848, 14067, 5846, 13797, 13932, 13814; Payload ID: 4228 relates to Category No.: 11674, 13126, 15618, 5848, 9420, 14014, 14455, 11935; Payload ID: 4229 relates to Category No.: 11674, 15626, 16214, 1651, 13126, 9420, 14057, 3140, 10005, 16211, 14111, 13437, 9994, 14455, 10005, 12037, 9996; Payload ID: 4230 relates to Category No.: 11674, 13126, 15626, 14565, 16214, 1651; Payload ID: 4231 relates to Category No.: 1737, 7154, 14838, 7132, 4336, 4332, 13612, 6535; Payload ID: 4232 relates to Category No.: 1737, 7154, 12732, 12391, 16197, 7132, 4336, 7150, 11506, 3398, 13835, 2079, 2094, 2006, 9411, 2010, 13858, 2033, 10626, 1937, 2046, 1964, 2070, 2547; Payload ID: 4233 relates to Category No.: 5848; Payload ID: 4234 relates to Category No.: 6479, 6482; Payload ID: 4235 relates to Category No.: 5848; Payload ID: 4236 relates to Category No.: 16214, 14014, 14740, 6482, 6480, 3615, 6479; Payload ID: 4237 relates to Category No.: 1737, 12619, 7132, 670, 11587, 13644, 4336, 4332, 13168, 11027, 7155, 7153, 7174, 10252, 5406, 12091, 10626, 10349, 5175, 14838, 2079, 13936, 14025, 13827, 2006, 8004, 8535, 1969, 10756, 3246, 15427, 11884, 2027, 10321, 9378, 11044, 13819, 16130, 12710; Payload ID: 4238 relates to Category No.: 12153, 12431, 2315, 1228, 14834; Payload ID: 4239 relates to Category No.: 1737, 12619, 7154, 7132, 4336, 7155, 5406, 15400, 4859, 15197; Payload ID: 4240 relates to Category No.: 1737, 6670; Payload ID: 4241 relates to Category No.: 15490, 3398, 11512, 15521, 9125, 4439, 15570, 10466, 11202, 12153, 8777, 13589, 3398, 12732; Payload ID: 4242 relates to Category No.: 13589, 3398, 15490, 3398, 1721; Payload ID: 4243 relates to Category No.: 1737, 15490, 3398, 7725, 8739, 1955, 7148, 2410, 9125, 11285, 7132, 4332, 13827, 10638, 10466, 14035, 12091, 12619, 16286, 3684, 5998, 1483, 4094, 6553, 10953, 2080, 12886, 8831, 6562, 7937, 12450, 13835, 14046, 13969, 13859, 10372, 13836, 13796, 6269, 13971, 13837, 13815, 13970, 6163, 14011, 9411, 13905, 13932, 14052, 1721; Payload ID: 4244 relates to Category No.: 1737, 1721, 11285, 10466, 12619; Payload ID: 4245 relates to Category No.: 1737, 1721, 11285, 10466, 14565, 12619, 15203; Payload ID: 4246 relates to Category No.: 1721, 12619; Payload ID: 4247 relates to Category No.: 12091, 1737, 687, 11506, 3398, 7132, 4332, 13612, 12619, 16286, 13360, 3360, 13835, 14046, 13969, 13989, 13827, 6269, 13971, 13837, 13815, 13818, 14011, 13944, 9411, 10358, 755, 13994, 2076; Payload ID: 4248 relates to Category No.: 1737, 12732, 7132, 4332, 1723, 12619, 13360, 3360; Payload ID: 4249 relates to Category No.: 1737, 12153, 7154, 14383, 7777, 10036, 12450; Payload ID: 4250 relates to Category No.: 12091, 1721, 4766, 8378, 9982; Payload ID: 4251 relates to Category No.: 1737, 7154, 12732, 12619; Payload ID: 4252 relates to Category No.: 1737, 7154, 1723, 12619; Payload ID: 4253 relates to Category No.: 13589, 3398, 15490, 3398, 12732, 12091, 15499, 11512, 15516, 9296, 15517, 3354, 15521, 4439, 16197, 7132, 4336, 4332, 182, 12891, 3783, 15533, 11611, 8004, 3783, 15520, 15498, 15290, 10466, 11202, 4485; Payload ID: 4254 relates to Category No.: 12619, 14838; Payload ID: 4258 relates to Category No.: 12091, 1737, 11512, 7725, 1955, 15517, 7154, 12732, 7556, 10466, 11203, 5406, 13589, 3398; Payload ID: 4259 relates to Category No.: 13589, 3398, 14267, 12732, 15490, 3398, 11512, 10466, 11202; Payload ID: 4260 relates to Category No.: 13589, 3398, 15490, 3398, 11512, 12732, 10466, 11202; Payload ID: 4261 relates to Category No.: 14838, 12431; Payload ID: 4263 relates to Category No.: 1737, 1721, 2459, 1089, 7318, 13827; Payload ID: 4264 relates to Category No.: 12732; Payload ID: 4265 relates to Category No.: 12091, 1737, 15499, 15490, 3398, 11512, 1721, 8334, 15517, 12732, 15521, 4439, 16197, 15570, 11611, 10466, 11202; Payload ID: 4266 relates to Category No.: 13589, 3398, 15490, 3398, 12732, 1737, 15499, 11512, 1721, 15517, 15521, 4439, 16197, 15570, 10466, 11202; Payload ID: 4267 relates to Category No.: 1737, 16286, 12732, 4336, 10466, 12583; Payload ID: 4268 relates to Category No.: 12732; Payload ID: 4269 relates to Category No.: 12091, 1737, 795, 7613, 1752, 6969, 3356, 9713, 3354, 345, 12794, 7154, 9420, 7132, 670, 11587, 13644, 4336, 4332, 3791, 9716, 13612, 2195, 7155, 12023, 5221, 11275, 11792, 13456, 4761, 7150, 13969, 14025, 13827, 2001, 13971, 13837, 13794, 13767, 10648, 10522, 9411, 13772, 13813, 13877, 2422, 11259, 15606, 1709, 13787, 11884, 11027, 10321, 16130; Payload ID: 4270 relates to Category No.: 12091, 7743, 15638, 10955, 9982; Payload ID: 4271 relates to Category No.: 12091, 13589, 3398, 795, 12619, 12633, 7154, 13184; Payload ID: 4272 relates to Category No.: 12091, 1737; Payload ID: 4273 relates to Category No.: 12091, 7288, 12619, 9983, 14271, 13104, 11858, 13445; Payload ID: 4274 relates to Category No.: 12091, 4998, 10372, 7306, 9983, 13171, 16197, 601, 16182; Payload ID: 4275 relates to Category No.: 12091, 1737, 12619, 16286, 4336, 12583; Payload ID: 4276 relates to Category No.: 12091, 12619; Payload ID: 4277 relates to Category No.: 12091, 12619, 3986, 14838, 8936, 13005, 4873; Payload ID: 4278 relates to Category No.: 12091, 12619; Payload ID: 4279 relates to Category No.: 12091, 12619; Payload ID: 4280 relates to Category No.: 12091, 12619, 2041, 10238, 10790; Payload ID: 4281 relates to Category No.: 12091, 1737, 3452, 10372, 3356, 9713, 3354, 7154, 3448, 2196, 12391, 7148, 7132, 3313, 14567, 670, 13644, 4336, 1238, 4332, 6687, 5221, 2070, 12893, 11506, 3398, 11676, 10526, 13835, 14025, 13827, 13837, 13794, 13797, 9411, 12619, 13829, 2009, 6111; Payload ID: 4282 relates to Category No.: 1721, 3386, 11285; Payload ID: 4284 relates to Category No.: 1737, 1721, 3356, 3354; Payload ID: 4285 relates to Category No.: 12091, 1737, 1721, 12619, 7306; Payload ID: 4286 relates to Category No.: 12091, 1737, 12619, 1955, 7154, 1780, 4332, 4330; Payload ID: 4287 relates to Category No.: 12091, 1737, 7725, 10372, 12891, 2410, 13360, 7132, 4332, 13827, 10638, 10626, 12646, 14565, 12619, 14025, 10238, 13970, 9411, 13916, 2469, 10378, 13881, 11546, 14022, 6111; Payload ID: 4288 relates to Category No.: 12091, 1737, 1026, 9982, 1721, 11089, 12760, 8929, 15149, 8731, 3398, 12498, 9713, 15157, 15140, 1780, 8936, 15156, 1238, 10188, 13530, 1023, 12620, 8934, 14123, 8374, 8923, 8549, 9350, 13539, 2243, 12638, 9716, 1409, 2235, 16213, 1752, 7724, 12404, 795, 11242, 5782, 1820, 1048, 14636, 4251, 3041, 15149, 3436, 15149, 4588, 12045, 13327, 3971, 14454, 11265, 15247, 12405, 1114, 8547, 5073, 901, 7636, 14385, 7251, 2214, 2215, 6082, 2176, 2708, 8671, 14495, 13811, 10303, 8513, 11293, 11308, 11858, 3986, 9238, 14050, 2711, 8940, 12453, 11090; Payload ID: 4289 relates to Category No.: 1026, 11089, 1295, 3766, 12760, 8929, 8731, 3398, 9713, 5852, 12732, 4808, 1780, 8936, 1035, 13229, 11291, 9716, 8934, 8924, 14123, 2235, 13143, 10350, 12459, 11265, 2250, 5073, 7636, 6082, 14495, 11293, 15107, 12091, 3564; Payload ID: 4290 relates to Category No.: 12732, 11291, 2235, 8934, 11265, 5073, 6082, 10303, 15107; Payload ID: 4291 relates to Category No.: 12091, 1737, 1722, 14038, 7730, 7743, 8421, 12891, 4446, 7132, 4332, 7724, 3070, 8349, 15805, 907, 10382, 7773, 10626, 7939, 12642, 12833, 6080, 4484, 1728, 10648, 4998, 9125, 4969, 4970, 15195; Payload ID: 4292 relates to Category No.: 12091, 1737, 15499, 11512, 1722, 15516, 9296, 687, 15517, 3354, 11506, 3398, 12732, 15521, 1780, 4439, 16197, 7132, 4336, 4332, 182, 12891, 3783, 15533, 11611, 8004, 3783, 15520, 15498, 15290, 4485; Payload ID: 4293 relates to Category No.: 12091, 15490, 3398, 11512, 12619, 15521, 9125, 4439, 15570; Payload ID: 4294 relates to Category No.: 12091, 15499, 15490, 3398, 11512, 8334, 7725, 15517, 1948, 3354, 15521, 1780, 4439, 16197, 13729, 15570, 11611, 10739, 10756, 12774, 12981, 11045, 13827, 10324; Payload ID: 4295 relates to Category No.: 1722, 5446, 1955, 7743, 4186, 12732, 9891, 12391, 4127, 3775, 7735, 7997, 7132, 3313, 14567, 8988, 11307, 4336, 2022, 4332, 5806, 10626, 2158, 2141, 8468, 1968, 15006, 10465, 10266, 5809, 8004, 12619, 13166, 13734, 14034, 7133, 7835, 11227, 13357, 15606, 12768, 13969, 7613, 13859, 14025, 13827, 13971, 13815, 13970, 9411, 1995, 13881, 10356, 14052, 13784, 5756; Payload ID: 4296 relates to Category No.: 334, 14661, 1722, 5446, 8731, 3398, 7743, 4186, 12732, 9891, 4127, 3775, 7735, 7132, 3313, 14567, 8988, 4332, 11243, 8318, 10356, 8468, 2044, 7133, 8198, 996, 7613, 10372, 1910, 7939, 11676, 14456, 2079, 9125, 5458, 11008, 7756, 7835, 7941, 13835, 13969, 13882, 13827, 13794, 13773, 13860, 13981, 1727, 10466, 12646, 8541; Payload ID: 4297 relates to Category No.: 1722, 13166, 8541, 8731, 3398, 11506, 3398, 7834, 11542, 7939, 8468, 8198, 8739, 7303, 5949, 472, 1463, 7372, 14640, 496, 10036, 3606, 4449, 8933, 3245, 16041; Payload ID: 4298 relates to Category No.: 1722, 8731, 3398, 7743, 12391, 7735, 7132, 8390, 4332, 7835, 13734, 7754, 2158, 11387, 8468, 14444, 10400, 10941, 334, 15490, 3398, 11512, 14318, 795, 10238, 11506, 3398, 12096, 7129, 1893, 8105, 12120, 12117, 11660, 11969, 7644, 8522, 793, 13376, 13379, 8798, 10350, 10516, 14566, 12497, 11292, 11372, 11275, 7035, 11912, 8548, 13352, 14781, 12887, 8550, 9982; Payload ID: 4299 relates to Category No.: 15490, 3398, 11512, 1722, 6667, 7743, 12732, 15521, 7134, 8541, 4439, 7132, 4336, 15570, 11542, 7939, 8468, 2076, 1968, 7997, 14910; Payload ID: 4300 relates to Category No.: 1722, 7743, 12732, 8541, 7735, 7132, 4332, 8468, 9350; Payload ID: 4301 relates to Category No.: 1722, 14034, 7743, 12732, 7840, 8541, 7735, 7132, 4332, 14000, 14045, 8177, 8468, 3371, 996, 14456; Payload ID: 4302 relates to Category No.: 9718, 1722, 3100, 11910, 7743, 12732, 4332, 1721; Payload ID: 4303 relates to Category No.: 12091, 12619, 4949; Payload ID: 4304 relates to Category No.: 12091, 14565, 12619, 14533, 11294; Payload ID: 4305 relates to Category No.: 12091, 12619, 1894, 9982; Payload ID: 4306 relates to Category No.: 12091, 12619; Payload ID: 4307 relates to Category No.: 12091, 10702, 12619, 10257, 11858, 10495, 8934, 12753; Payload ID: 4308 relates to Category No.: 1730, 7306, 14838; Payload ID: 4309 relates to Category No.: 1730, 7306, 14838; Payload ID: 4310 relates to Category No.: 7548, 15898, 11915, 1721, 16286, 5446, 13166, 1795, 7693, 12714, 15782, 8390, 8789, 11968, 9292, 6125, 13635, 9295, 10600, 8389, 13143, 13036, 8682, 14189; Payload ID: 4311 relates to Category No.: 16308, 9500, 14663; Payload ID: 4312 relates to Category No.: 3684, 14663, 1878, 2842, 11941, 15089, 15088, 2840, 5302, 2845, 12186, 15633, 12119, 7613, 10775, 11109, 7618; Payload ID: 4313 relates to Category No.: 9500, 14663, 1878, 2841, 2842, 6355, 6356, 15089, 5248, 2840, 6084, 5302, 15633, 3351, 5246; Payload ID: 4314 relates to Category No.: 9500, 14663, 1878, 2841, 2842, 6355, 6356, 15089, 5248, 2840, 6084, 5302, 15633, 3351, 5246; Payload ID: 4315 relates to Category No.: 7912, 3013; Payload ID: 4316 relates to Category No.: 7912; Payload ID: 4317 relates to Category No.: 7912; Payload ID: 4318 relates to Category No.: 7912; Payload ID: 4319 relates to Category No.: 7912, 5939, 8441, 9632, 14589, 8549; Payload ID: 4320 relates to Category No.: 7912, 8441, 8549, 483; Payload ID: 4321 relates to Category No.: 7912, 8441, 3012, 1893, 4012, 8549, 7817, 7963, 13585, 7906, 7661, 6530, 13835, 7728, 13967, 1295, 13969, 1701, 13882, 14025, 10372, 13886, 13827, 2001, 13975, 10522, 13799, 795, 2083, 13787, 3566, 14520, 4057, 2470, 13697, 13334, 14359; Payload ID: 4322 relates to Category No.: 7912; Payload ID: 4323 relates to Category No.: 7912, 674, 3781; Payload ID: 4324 relates to Category No.: 5367, 7912; Payload ID: 4325 relates to Category No.: 7912, 3125, 14057, 8549; Payload ID: 4326 relates to Category No.: 7912, 3125; Payload ID: 4327 relates to Category No.: 7912, 3125; Payload ID: 4328 relates to Category No.: 7912; Payload ID: 4329 relates to Category No.: 10075; Payload ID: 4330 relates to Category No.: 1730, 7306, 7381; Payload ID: 4331 relates to Category No.: 11512, 1567, 1836, 8352, 1562, 1564, 3152, 1572, 14636, 13571, 11062, 7568, 12037, 10193, 1250; Payload ID: 4332 relates to Category No.: 2276, 12671, 12682, 8585; Payload ID: 4333 relates to Category No.: 1207, 1830, 15750, 14663, 1878, 5981, 6273, 84; Payload ID: 4334 relates to Category No.: 1207, 15750, 14663, 1878, 6343, 5981, 1828, 6272, 1877, 12338, 6273; Payload ID: 4335 relates to Category No.: 9500, 5428, 14663, 1878, 15089, 15088, 2845, 15087, 15233, 6086, 13859, 13971, 13837, 13773, 13797, 13858, 5998, 6084; Payload ID: 4336 relates to Category No.: 8862, 7912, 12633, 5552; Payload ID: 4337 relates to Category No.: 1533, 14663, 1878, 15089, 15088, 15233; Payload ID: 4339 relates to Category No.: 1204; Payload ID: 4340 relates to Category No.: 5939, 9632; Payload ID: 4341 relates to Category No.: 15626; Payload ID: 4342 relates to Category No.: 1204, 4775; Payload ID: 4343 relates to Category No.: 12746, 8169, 8522, 13836; Payload ID: 4344 relates to Category No.: 2902, 12028, 3900, 13325; Payload ID: 4346 relates to Category No.: 5367, 5808, 4949, 12891, 1780, 13970, 14054, 2141, 11825, 1910; Payload ID: 4347 relates to Category No.: 10372, 4998; Payload ID: 4349 relates to Category No.: 4328, 1202, 12458; Payload ID: 4350 relates to Category No.: 14589; Payload ID: 4351 relates to Category No.: 5446, 3012; Payload ID: 4352 relates to Category No.: 4067; Payload ID: 4353 relates to Category No.: 4067, 4021, 6375; Payload ID: 4355 relates to Category No.: 1204; Payload ID: 4356 relates to Category No.: 3620, 1579; Payload ID: 4358 relates to Category No.: 11512, 14565, 1703, 12633, 1816, 7728, 674, 1780, 2311, 10366, 11285, 11147, 11265, 10286, 11148, 16294, 14926, 12832, 4021, 10238, 16136, 14589, 7613, 12397, 9455, 10470, 979, 10358, 10383, 2393, 5985, 11190, 968, 10329, 2373, 5828, 799, 10404; Payload ID: 4360 relates to Category No.: 11512, 795, 13589, 3398, 15517, 11634, 10093, 9540, 14641, 4067; Payload ID: 4361 relates to Category No.: 11512, 795, 8454, 15517; Payload ID: 4362 relates to Category No.: 11512, 795, 10238, 8454, 15517; Payload ID: 4363 relates to Category No.: 4828, 8962, 13756, 3012, 9932, 10486, 6157, 2475, 2311, 1417, 1795; Payload ID: 4364 relates to Category No.: 4828, 5367, 8962, 9932, 6157, 10583, 10226, 10356; Payload ID: 4365 relates to Category No.: 2863, 4439, 15698; Payload ID: 4366 relates to Category No.: 2863, 4439, 15698; Payload ID: 4367 relates to Category No.: 2329, 15618, 14661, 15626, 13756, 5848, 1925, 14817, 10802, 10593, 5779, 6734, 10463, 11616, 2331, 2347, 1181, 16159, 2359, 6814; Payload ID: 4368 relates to Category No.: 9420; Payload ID: 4369 relates to Category No.: 15618, 1295, 1830, 4615, 2562, 5848, 932, 6697, 6090, 16213, 484, 6111, 6322, 4855; Payload ID: 4370 relates to Category No.: 6814; Payload ID: 4371 relates to Category No.: 1795, 8409, 14663, 7735, 12303, 11941, 12309, 9236, 2866, 12321, 2930; Payload ID: 4372 relates to Category No.: 9232, 9254, 9265, 14663, 2996, 12312, 9236, 9235, 15967, 12320, 9982; Payload ID: 4373 relates to Category No.: 9254, 9265, 3494, 3487, 3490, 2041; Payload ID: 4374 relates to Category No.: 12063, 1893, 3405, 11660, 7460; Payload ID: 4375 relates to Category No.: 15618, 9500, 1862, 13905; Payload ID: 4376 relates to Category No.: 14661, 9500, 5428, 5446, 746, 15113, 742, 15223, 742, 16085, 10851, 11566, 11182, 9783, 5299, 15110, 13746, 14696, 2871, 11494, 10490, 11306, 12397, 11050, 13408, 1978, 13967, 1984, 2079, 2136, 13827, 11391, 2051, 13893, 12544, 2080, 10362, 1906, 10558, 11429, 8012; Payload ID: 4377 relates to Category No.: 13041, 14661, 9500, 5428, 5446, 746, 5848, 15113, 742, 15223, 742, 16085, 9783, 15110, 13746, 5299; Payload ID: 4379 relates to Category No.: 11091; Payload ID: 4380 relates to Category No.: 9500, 1204, 11294, 14979; Payload ID: 4381 relates to Category No.: 9500, 14979; Payload ID: 4382 relates to Category No.: 9500, 14663, 2347, 16234, 16275, 1237, 6051; Payload ID: 4383 relates to Category No.: 9500, 1729, 15113, 5544, 4448, 4535, 13779, 3155, 7513; Payload ID: 4384 relates to Category No.: 9500; Payload ID: 4385 relates to Category No.: 9500, 5297, 14663, 16234, 16275, 6051, 13794; Payload ID: 4386 relates to Category No.: 9500, 10331; Payload ID: 4387 relates to Category No.: 15618, 9500, 3555; Payload ID: 4388 relates to Category No.: 9500; Payload ID: 4389 relates to Category No.: 9500; Payload ID: 4390 relates to Category No.: 9500; Payload ID: 4391 relates to Category No.: 15588, 7096, 7088; Payload ID: 4392 relates to Category No.: 7096, 11024; Payload ID: 4393 relates to Category No.: 7096; Payload ID: 4395 relates to Category No.: 5297, 1204; Payload ID: 4397 relates to Category No.: 9500, 5297, 13756, 14663, 7039, 2869, 4977, 10174, 1895, 13754, 4975; Payload ID: 4398 relates to Category No.: 5297, 13755, 15521, 1874, 14663, 4439, 486, 7039, 2869, 4448, 13966; Payload ID: 4399 relates to Category No.: 9500, 5297, 486, 7039, 2869, 4448, 1895; Payload ID: 4400 relates to Category No.: 5297, 13755, 15521, 1874, 14663, 4439, 7039, 2869; Payload ID: 4401 relates to Category No.: 5297, 13755, 13756, 15521, 1874, 14663, 4439; Payload ID: 4402 relates to Category No.: 5297, 13755, 15521, 1874, 14663, 4439, 4448; Payload ID: 4403 relates to Category No.: 5297, 4448; Payload ID: 4404 relates to Category No.: 5297, 13755, 15521, 1874, 14663, 4439, 15042; Payload ID: 4405 relates to Category No.: 5297; Payload ID: 4406 relates to Category No.: 5297, 13755, 15521, 1874, 14663, 4439, 4448; Payload ID: 4407 relates to Category No.: 5297, 4448; Payload ID: 4408 relates to Category No.: 5297; Payload ID: 4409 relates to Category No.: 5297, 13755, 15521, 1874, 14663, 4439; Payload ID: 4410 relates to Category No.: 5297, 13755, 2169, 15521, 1874, 14663, 4439; Payload ID: 4411 relates to Category No.: 5297; Payload ID: 4412 relates to Category No.: 5297, 13755, 15521, 1874, 14663, 4439, 4448; Payload ID: 4413 relates to Category No.: 5297, 13755, 15521, 1874, 14663, 4439, 7039, 2869, 7131, 4448, 10491; Payload ID: 4414 relates to Category No.: 5297, 7039, 2869; Payload ID: 4415 relates to Category No.: 795, 11910, 13755, 7039, 15880, 792, 15521, 1874, 9420, 11765, 14663, 4439, 933, 7122, 7039, 2869, 13998, 5806, 335, 1895; Payload ID: 4416 relates to Category No.: 13755, 1874, 14663, 13858; Payload ID: 4417 relates to Category No.: 16308, 3822, 9500, 2079, 1867, 14663, 3474, 815, 16222, 9365, 14025, 15470, 616, 5299, 5035, 13969, 13925, 14050, 13882, 496, 13827, 14040, 6269, 13970, 13870, 6627, 3231, 13883, 1780, 13851, 13881, 5019, 3246, 10637, 13779, 3198, 1463, 13784, 14038, 4214, 5532, 10174, 13958, 3565, 2743, 13908, 3230, 195, 3035; Payload ID: 4418 relates to Category No.: 16308, 3822, 3988, 9500, 6902, 14663, 3474, 815, 9365, 14963, 15469, 527, 7228, 7211, 3472, 5035, 9503, 9502, 11634, 12891, 1895, 6375, 15470, 10174, 1832, 5299, 1920, 3231, 13835, 13969, 13925, 13827, 13970, 13883; Payload ID: 4419 relates to Category No.: 16308, 3822, 9500, 14090, 1703, 10238, 7743, 2079, 16214, 7737, 14982, 9048, 14663, 8390, 14972, 815, 10877, 2571, 3713, 5814, 1249, 10226, 7721, 13397, 14064, 3934, 11595, 9365, 2001, 14071, 15475, 6736, 14025, 690, 15470, 3716, 1832, 14060; Payload ID: 4420 relates to Category No.: 16308, 9500, 14982, 2355, 14400, 14663, 14972, 2088, 16222, 4512, 1354, 2734; Payload ID: 4421 relates to Category No.: 9500, 5367, 16308, 2000, 12544, 14982, 2355, 14400, 14663, 14972, 2088, 4535, 522, 2733, 2095, 4512, 1354; Payload ID: 4422 relates to Category No.: 16308, 9500, 2000, 14982, 2355, 14400, 11669, 14663, 14972, 2088, 13724, 522, 2733, 2095, 1354, 7004, 12549, 14737; Payload ID: 4423 relates to Category No.: 16308, 9500, 5261, 14982, 14533, 14663, 14962, 14972, 682, 4512, 11761, 6530, 13967, 13969, 2041, 14025, 13827, 13970, 10006, 13870, 13863, 9423, 13763, 13904, 13887, 1219, 3231, 9791, 5073, 472, 9489, 14000, 6163, 13818, 14011, 13797, 13944, 13853, 1910, 1988, 11415; Payload ID: 4424 relates to Category No.: 16308, 9500, 3932, 14982, 14663, 14962, 14972, 11823, 684, 8245, 7806; Payload ID: 4425 relates to Category No.: 16308, 3822, 3988, 9500, 14663, 2743; Payload ID: 4426 relates to Category No.: 16308, 3822, 3988, 9500, 14663, 3474, 14972, 2743, 2742; Payload ID: 4427 relates to Category No.: 16308, 3822, 3988, 9500, 2743; Payload ID: 4428 relates to Category No.: 16308, 3822, 3988, 9500, 14663, 3474, 14972, 1864; Payload ID: 4429 relates to Category No.: 16308, 3822, 3988, 9500, 14663; Payload ID: 4430 relates to Category No.: 16308, 3822, 3988, 9500, 14663, 3474, 14972, 815, 9365, 7228, 5035; Payload ID: 4431 relates to Category No.: 16308, 3822, 9500, 3988, 14663, 9423, 3474, 815, 9365, 9503; Payload ID: 4432 relates to Category No.: 16308, 3822, 3988, 9500, 14663, 3474, 14972, 815, 9365, 7228, 7211, 3472, 9503, 15995, 1827; Payload ID: 4433 relates to Category No.: 3988, 9500, 815, 16308, 14663, 3474, 14972, 2743, 527, 7228, 3472, 5035, 9503, 526, 5900, 7653, 7760; Payload ID: 4434 relates to Category No.: 9500; Payload ID: 4435 relates to Category No.: 16308, 3822, 3988, 9500, 14663, 3474, 14972, 7228, 5035, 13977, 13827, 13971, 13837, 15664; Payload ID: 4436 relates to Category No.: 16308, 3822, 3988, 9500, 14663, 7527, 14025, 15649; Payload ID: 4437 relates to Category No.: 16308, 3822, 3988, 9500, 14663, 815, 12948, 6203, 5345; Payload ID: 4438 relates to Category No.: 16308, 3988, 9500, 14663, 9423, 14972, 16234, 16222, 1390, 13939, 13904, 13802; Payload ID: 4439 relates to Category No.: 16308, 3822, 3988, 9500, 14663; Payload ID: 4440 relates to Category No.: 16308, 3988, 9500, 14663, 9423, 815, 9365; Payload ID: 4441 relates to Category No.: 16308, 3988, 9500, 14663, 9423, 489; Payload ID: 4442 relates to Category No.: 9500; Payload ID: 4443 relates to Category No.: 9500, 2088, 13779, 1354, 7004, 11761, 16308, 14982, 14663, 14972, 4512; Payload ID: 4444 relates to Category No.: 16308, 9500, 14663, 14972, 16225, 16234, 14045, 16222, 9455, 16221; Payload ID: 4445 relates to Category No.: 6814, 16308, 9500, 8582, 14663, 14079, 16234; Payload ID: 4446 relates to Category No.: 16308, 9500, 8582, 14838, 14663, 1274, 14079, 3595, 1743, 12213, 16234, 6532, 14080; Payload ID: 4447 relates to Category No.: 9500, 16308, 8582, 2169, 14663, 14079, 16234, 724, 8865, 9415; Payload ID: 4448 relates to Category No.: 16308, 9500, 14982, 14663, 1186, 1189; Payload ID: 4449 relates to Category No.: 16308, 9500, 1417, 7743, 14663, 7735, 13925, 1272, 12553, 14972, 1408, 13892, 16234, 13836, 7672, 11612, 14045, 1390, 16222, 10881, 3010, 4333, 11614, 16221; Payload ID: 4450 relates to Category No.: 9500; Payload ID: 4451 relates to Category No.: 6219, 16308, 3988, 9500, 14663, 3474, 14972, 1390, 16222, 14963, 7228, 3472, 5035, 9503, 684, 526; Payload ID: 4452 relates to Category No.: 16308, 9500, 14663; Payload ID: 4453 relates to Category No.: 16308, 9500, 14663, 14972, 3472, 9503, 526; Payload ID: 4454 relates to Category No.: 16308, 9500, 14663; Payload ID: 4455 relates to Category No.: 16308, 9500, 3244, 14982, 14663, 1186, 1189, 1187, 2350; Payload ID: 4456 relates to Category No.: 16308, 3822, 9500, 4110, 1867, 14663, 6305, 815, 13724, 9365, 6154, 14737, 11720, 10774, 6151; Payload ID: 4457 relates to Category No.: 9500; Payload ID: 4458 relates to Category No.: 16308, 9500, 14663, 1219, 3988, 1832, 4222; Payload ID: 4459 relates to Category No.: 16308, 9500, 5428, 14663, 1238, 6763, 10007, 16232; Payload ID: 4460 relates to Category No.: 9500, 16308, 3822, 14663, 3474, 6305, 815, 13724, 16144, 14737, 11720, 6151, 16230; Payload ID: 4461 relates to Category No.: 16308, 3822, 9500, 12544, 14663, 1238, 3474, 6305, 815, 13724, 9365, 16144, 6154, 14737, 5345, 11720, 8102, 10774, 6151, 16230, 6763, 10007, 16232; Payload ID: 4462 relates to Category No.: 16308, 9500, 14663, 5345; Payload ID: 4463 relates to Category No.: 16308, 9500, 14663, 815, 6154, 5345, 6151; Payload ID: 4464 relates to Category No.: 9500, 16308, 14663, 11808, 5345; Payload ID: 4465 relates to Category No.: 9500, 16214, 14014, 4111; Payload ID: 4466 relates to Category No.: 9500; Payload ID: 4467 relates to Category No.: 9500; Payload ID: 4468 relates to Category No.: 9500, 8862, 16308, 14982, 14663, 2350, 1186, 1189; Payload ID: 4469 relates to Category No.: 9500, 2348, 16308, 14982, 14663, 14962, 2347, 3035; Payload ID: 4470 relates to Category No.: 16308, 9500, 14982, 1867, 14663, 2350, 2353, 1186, 1189, 1984, 1933, 12539; Payload ID: 4471 relates to Category No.: 16308, 9500, 14982, 2355, 14663, 1186, 1189, 10574, 8169, 11822; Payload ID: 4472 relates to Category No.: 6219, 9500, 16308, 14982, 14663, 1186, 1189; Payload ID: 4473 relates to Category No.: 13248, 13975, 14663, 9528, 9053, 13882, 7989, 7816, 4112, 8064; Payload ID: 4474 relates to Category No.: 10702, 16172, 12502, 12614, 3879; Payload ID: 4475 relates to Category No.: 12614; Payload ID: 4476 relates to Category No.: 10702, 3639, 274, 12502, 12614; Payload ID: 4477 relates to Category No.: 10702, 12502, 12614, 4785, 10343, 3879; Payload ID: 4478 relates to Category No.: 10702, 12502, 12614; Payload ID: 4479 relates to Category No.: 795, 4998, 7613, 6902, 14663, 5874, 6814; Payload ID: 4480 relates to Category No.: 5785, 12153, 2885, 12633, 8117, 8522, 7834, 8191, 5911, 11987; Payload ID: 4481 relates to Category No.: 10372, 8373, 11582, 16005, 8331; Payload ID: 4483 relates to Category No.: 11512, 11506, 3398, 7735, 4332, 10877, 10350; Payload ID: 4484 relates to Category No.: 5367, 5785, 15614, 11371; Payload ID: 4485 relates to Category No.: 14565, 11512, 11363, 5458, 2376, 2387, 1624; Payload ID: 4486 relates to Category No.: 14661, 12648, 5446, 2562, 4130, 16085, 1023, 6018, 14330, 12365, 10244; Payload ID: 4487 relates to Category No.: 14661, 795, 5446, 14589, 4130, 16085, 11300, 333; Payload ID: 4488 relates to Category No.: 1737, 1026, 14661, 6961, 6975, 6969, 8300, 7168, 7162, 9420, 7132, 4336, 6967, 12827, 4766, 3888, 6977, 16167, 10593, 3975, 10573, 8661, 12882, 3924, 12890, 10599, 8835, 14927, 10269, 11008, 904, 3915, 13143, 8302, 3879; Payload ID: 4489 relates to Category No.: 1752, 8300, 3924, 1737, 1026, 14661, 6961, 6975, 6969, 12459, 7168, 13147, 7132, 12827, 4766, 12522, 10095, 6977, 16167, 10593, 3975, 7992, 3910, 10573, 8661, 13149, 12890, 13146, 10599, 8835, 14927, 10269; Payload ID: 4490 relates to Category No.: 7288, 15588, 2009, 1906, 7852, 2006; Payload ID: 4491 relates to Category No.: 15588, 2083, 2009, 7852, 8049, 1911, 2006, 7853, 8764; Payload ID: 4492 relates to Category No.: 15588, 8739, 8760, 11130, 11129, 3001, 10501, 13530, 1906, 7852, 6322, 11546, 12759, 136, 7853, 11048; Payload ID: 4493 relates to Category No.: 15588, 1983, 5852, 8373, 1906, 7852, 13909, 1949; Payload ID: 4494 relates to Category No.: 11512, 795, 7141, 8300; Payload ID: 4496 relates to Category No.: 1737, 14661, 14905, 7154, 9420, 7132, 4336, 2198, 3927, 14275; Payload ID: 4497 relates to Category No.: 1893; Payload ID: 4498 relates to Category No.: 13594, 10372, 14663, 5874, 2429; Payload ID: 4499 relates to Category No.: 15715, 15712, 4439, 15726, 12157, 15719; Payload ID: 4500 relates to Category No.: 15715, 15712, 4439, 15726, 12157, 15719; Payload ID: 4501 relates to Category No.: 5255, 12994, 5037, 11078, 1789, 11077, 3163, 10478, 3157; Payload ID: 4502 relates to Category No.: 5367, 1070, 403, 1955, 10238, 7644, 15192, 8564; Payload ID: 4503 relates to Category No.: 13594, 13589, 3398, 11512, 15517, 2469, 6269; Payload ID: 4504 relates to Category No.: 9500, 1874, 1893, 14663, 14054, 84, 13934, 13810, 6814; Payload ID: 4505 relates to Category No.: 8862, 13589, 3398, 15490, 3398, 795; Payload ID: 4506 relates to Category No.: 13589, 3398, 15490, 3398, 795, 803; Payload ID: 4507 relates to Category No.: 8862, 13589, 3398, 15490, 3398, 2409, 1204, 7131, 10491; Payload ID: 4508 relates to Category No.: 12137, 795, 7613, 12427, 11237, 16286, 8731, 3398, 11167, 7306, 11506, 3398, 1780, 7693, 10366, 11285, 6738, 11542, 10443, 10543, 8507, 10578, 7597, 11385, 8530, 10536, 11620, 10038, 6098; Payload ID: 4509 relates to Category No.: 8934, 11091, 3038, 484, 7719, 14661, 4762, 11265, 2239, 2242, 2250, 1806, 12372, 8191, 7625, 7640, 16123, 6074, 1295, 13827, 7002, 2243; Payload ID: 4510 relates to Category No.: 10702, 8552, 10238, 7743, 7598, 8805, 12449, 690, 1026, 14661, 11512, 14565, 5428, 1721, 8739, 5446, 8731, 3398, 6606, 348, 4186, 12993, 344, 12942, 10241, 11236, 349, 11432, 7946, 12391, 7693, 4127, 8940, 8541, 11093, 3775, 1888, 5541, 16085, 8988, 12936, 8390, 8723, 2041, 2014, 2136, 10878, 10955, 11243, 11291, 5361, 4041, 8535, 8049, 7923, 10879, 15762, 2143, 8458, 7712, 5810, 7939, 7933, 7942, 10350, 1960, 8103, 13286, 11094, 10872, 8255, 10493, 16087, 362, 13344, 7990, 15559, 8806, 7938, 13355, 6082, 7996, 3707, 1769, 8457, 7833; Payload ID: 4511 relates to Category No.: 8731, 3398, 7737, 8732, 7880, 8739, 13589, 3398, 7990, 1780, 15067, 13756, 7744, 3187, 14257, 13258; Payload ID: 4512 relates to Category No.: 13589, 3398, 15490, 3398, 3187; Payload ID: 4513 relates to Category No.: 8906, 5255, 1703, 1432, 5072, 5037, 5949, 1318, 3246, 11628, 4953, 8888, 2547, 9452; Payload ID: 4514 relates to Category No.: 5255, 1703, 1204; Payload ID: 4516 relates to Category No.: 13360; Payload ID: 4517 relates to Category No.: 15698, 839; Payload ID: 4519 relates to Category No.: 13360; Payload ID: 4520 relates to Category No.: 12154, 11843, 9296, 3354, 16197, 15533, 11607, 15605, 9296, 3327, 11610, 3313, 3132, 5134, 10181, 4485, 9296, 3311, 13167, 16050, 5595, 7613, 16286; Payload ID: 4521 relates to Category No.: 9296, 3354, 14034, 12096, 11860, 9296, 3327, 5134, 4485, 9296, 3311, 16050, 12300; Payload ID: 4522 relates to Category No.: 10331, 7856; Payload ID: 4523 relates to Category No.: 9500, 2965, 11774, 14663, 1878, 3425, 4743, 3480, 2961, 3481; Payload ID: 4524 relates to Category No.: 8756, 7662, 16136, 967, 3174, 8398, 3172, 14482, 3176, 13616; Payload ID: 4525 relates to Category No.: 6456; Payload ID: 4527 relates to Category No.: 9500, 2964, 2965, 886, 4855, 5263, 5533, 888; Payload ID: 4528 relates to Category No.: 15618, 12197; Payload ID: 4530 relates to Category No.: 1730, 14838, 1780, 11049, 16182, 6625; Payload ID: 4532 relates to Category No.: 7306, 2459, 14838, 4458; Payload ID: 4533 relates to Category No.: 2459; Payload ID: 4534 relates to Category No.: 12096; Payload ID: 4535 relates to Category No.: 10331, 3356, 7132, 4332; Payload ID: 4536 relates to Category No.: 1721, 10372, 360, 11128, 10638; Payload ID: 4537 relates to Category No.: 1026, 795, 4040, 1048, 11765, 4039, 8378, 13228, 7819, 7863, 8934, 14891, 723, 3443; Payload ID: 4538 relates to Category No.: 12313, 9283, 14663, 12303, 9236, 12306, 6814; Payload ID: 4539 relates to Category No.: 12061, 11588, 1204; Payload ID: 4540 relates to Category No.: 12061, 11588; Payload ID: 4541 relates to Category No.: 10238, 12061, 11588, 13856, 7735, 14037; Payload ID: 4542 relates to Category No.: 12061, 11588, 1204; Payload ID: 4543 relates to Category No.: 12061, 11588, 1204; Payload ID: 4546 relates to Category No.: 9266, 11941; Payload ID: 4547 relates to Category No.: 12153; Payload ID: 4548 relates to Category No.: 12153; Payload ID: 4549 relates to Category No.: 12153; Payload ID: 4550 relates to Category No.: 1204; Payload ID: 4552 relates to Category No.: 6637, 151, 6360, 12153; Payload ID: 4553 relates to Category No.: 12153; Payload ID: 4554 relates to Category No.: 12153; Payload ID: 4555 relates to Category No.: 12153; Payload ID: 4556 relates to Category No.: 12153; Payload ID: 4559 relates to Category No.: 12153; Payload ID: 4560 relates to Category No.: 11512, 12153; Payload ID: 4561 relates to Category No.: 12153, 7306; Payload ID: 4562 relates to Category No.: 12153; Payload ID: 4565 relates to Category No.: 6212, 11017, 14830; Payload ID: 4566 relates to Category No.: 6212, 11017; Payload ID: 4567 relates to Category No.: 6697; Payload ID: 4568 relates to Category No.: 6814; Payload ID: 4569 relates to Category No.: 11109, 11236, 13831, 13030, 11970, 10776; Payload ID: 4570 relates to Category No.: 13589, 3398, 15490, 3398, 9228, 13622, 14270, 7306, 3320, 15715, 3448, 4439, 14913, 15718, 16181, 13840, 14038; Payload ID: 4571 relates to Category No.: 14270, 11634, 1598, 15490, 3398, 11512, 14267, 10860, 13474; Payload ID: 4572 relates to Category No.: 14318, 14270, 15517, 9455, 13840, 14038; Payload ID: 4573 relates to Category No.: 14270, 14211; Payload ID: 4574 relates to Category No.: 14270, 7306, 13618, 7280, 14834; Payload ID: 4575 relates to Category No.: 15490, 3398, 11512, 5785, 14038, 8175, 7613, 5446, 14270, 10238, 15603, 8760, 3320, 6643, 7840, 10648, 7735, 16197, 2429, 10637, 15001, 11550, 10362, 10811, 4041, 11607, 8509, 10470, 11546, 1911, 2082, 10411, 5806; Payload ID: 4576 relates to Category No.: 14270, 15603, 12891, 2429; Payload ID: 4577 relates to Category No.: 14270, 11997; Payload ID: 4578 relates to Category No.: 14270, 11512, 8739, 1746, 7291, 16182, 12484, 16182, 10860, 7293, 5807, 10516, 14566, 13277, 13474, 12487, 5406, 11506, 3398, 2469, 13671, 13259; Payload ID: 4579 relates to Category No.: 14318, 14270; Payload ID: 4580 relates to Category No.: 14270, 4439, 3996, 9223, 3001, 13618, 2904, 16200, 14949, 8375; Payload ID: 4581 relates to Category No.: 14270; Payload ID: 4582 relates to Category No.: 14270; Payload ID: 4583 relates to Category No.: 12137, 14270, 1204, 7280; Payload ID: 4584 relates to Category No.: 14270, 12137, 7280; Payload ID: 4585 relates to Category No.: 8739, 14270, 10238, 14267, 14915, 14918, 4439, 7546, 9379, 13511, 8731, 3398, 7743; Payload ID: 4586 relates to Category No.: 14270, 7291, 16182, 14271, 4439, 14271, 16183, 2476; Payload ID: 4587 relates to Category No.: 14270; Payload ID: 4588 relates to Category No.: 14270, 7056; Payload ID: 4589 relates to Category No.: 14270, 14177; Payload ID: 4590 relates to Category No.: 14270, 1955, 7291, 16182, 12891, 7280; Payload ID: 4591 relates to Category No.: 1955, 6814; Payload ID: 4592 relates to Category No.: 14270, 7306, 14831, 4439, 4442, 10031, 14838, 6535, 13363; Payload ID: 4593 relates to Category No.: 14270, 795, 5446, 14267, 7306, 7291, 16182, 11573, 13639, 11512, 3021, 2012; Payload ID: 4594 relates to Category No.: 14270; Payload ID: 4595 relates to Category No.: 14270, 7291, 16182, 12891; Payload ID: 4596 relates to Category No.: 7288, 14318, 14270, 14271, 4041; Payload ID: 4597 relates to Category No.: 14270; Payload ID: 4598 relates to Category No.: 14270; Payload ID: 4599 relates to Category No.: 14318, 14270; Payload ID: 4600 relates to Category No.: 6814; Payload ID: 4601 relates to Category No.: 14270; Payload ID: 4602 relates to Category No.: 13589, 3398, 15490, 3398, 14270, 14267, 8408, 14211, 5773; Payload ID: 4603 relates to Category No.: 14270; Payload ID: 4604 relates to Category No.: 6814, 11512, 14038, 12638, 5446, 10648, 16197, 8789, 11363, 10808, 10811, 10851, 10855, 11510, 10491, 3165, 10692, 13641, 2905, 14185, 13840; Payload ID: 4605 relates to Category No.: 14270; Payload ID: 4606 relates to Category No.: 12638, 14038, 5446, 10966, 11341, 3021; Payload ID: 4607 relates to Category No.: 6814; Payload ID: 4608 relates to Category No.: 9232, 3684, 3320, 14612, 1893, 16197, 5855, 6814; Payload ID: 4610 relates to Category No.: 13594, 8731, 3398, 674, 11506, 3398, 8887, 4458, 13103, 3612, 15517, 16213, 1112; Payload ID: 4611 relates to Category No.: 795, 14456, 7743, 10864, 5461; Payload ID: 4612 relates to Category No.: 10648, 3900, 5462, 2230, 9576, 14456, 14057, 14452; Payload ID: 4613 relates to Category No.: 14456; Payload ID: 4614 relates to Category No.: 14267; Payload ID: 4615 relates to Category No.: 7288, 14271, 14025, 13770; Payload ID: 4616 relates to Category No.: 14267, 7056; Payload ID: 4617 relates to Category No.: 5446, 14267, 3320, 7291, 16182, 14271, 4439, 11573, 9455, 2758, 2469, 1995; Payload ID: 4618 relates to Category No.: 7288, 14271, 6814; Payload ID: 4619 relates to Category No.: 15603, 14267; Payload ID: 4620 relates to Category No.: 14267; Payload ID: 4621 relates to Category No.: 14267, 11511; Payload ID: 4622 relates to Category No.: 14267, 9223, 8405, 9103, 9223, 9103; Payload ID: 4623 relates to Category No.: 14267, 7291, 16182; Payload ID: 4624 relates to Category No.: 15490, 3398, 11512, 5446, 14270, 14267, 9451, 11573, 11467, 13840, 14038; Payload ID: 4625 relates to Category No.: 14267; Payload ID: 4626 relates to Category No.: 15517, 7291, 16182, 14271, 15291, 4439, 7280, 7261; Payload ID: 4627 relates to Category No.: 14267, 15626; Payload ID: 4628 relates to Category No.: 6814, 14267, 7291, 16182, 14271; Payload ID: 4629 relates to Category No.: 14267; Payload ID: 4630 relates to Category No.: 803, 9420, 7108, 7109, 7110, 7111, 795, 793; Payload ID: 4631 relates to Category No.: 1730, 803, 7635, 1905, 4828; Payload ID: 4632 relates to Category No.: 14565, 11237, 11840; Payload ID: 4633 relates to Category No.: 15490, 3398, 12498, 3010, 8508, 4041, 8752, 14838; Payload ID: 4634 relates to Category No.: 15490, 3398, 5785, 8731, 3398, 12498, 14267, 14310, 4041, 10600, 1856, 794; Payload ID: 4635 relates to Category No.: 15490, 3398, 803; Payload ID: 4636 relates to Category No.: 334, 1002, 795, 8731, 3398, 803, 7635, 1905, 8390; Payload ID: 4637 relates to Category No.: 12091, 5785, 14565, 795, 12498, 8760, 803, 4040, 11765, 12519, 2013, 11858, 4039, 10470, 13252, 7613, 7967, 4041; Payload ID: 4638 relates to Category No.: 12091, 5785, 795, 12498, 12519, 11858, 11102, 716, 13036, 10561; Payload ID: 4639 relates to Category No.: 12091, 13589, 3398, 15490, 3398, 5785, 795, 10238, 13166, 12498, 8760, 2409, 2886, 13491, 13171, 10314, 12519, 2013, 11858, 12461, 12882, 12642, 12648, 10366, 803, 13208, 8929, 10601; Payload ID: 4640 relates to Category No.: 13589, 3398, 15490, 3398, 795, 2411, 8731, 3398, 687, 344, 9274, 11285, 16197, 13383, 4041, 11265, 11090; Payload ID: 4641 relates to Category No.: 7288, 14216, 3656, 7291, 16182, 14271, 16183; Payload ID: 4642 relates to Category No.: 4439, 3996, 9223, 3001, 7272, 16182, 3000, 8496, 2052; Payload ID: 4643 relates to Category No.: 6814, 9228, 7270, 9189, 14200; Payload ID: 4644 relates to Category No.: 13186, 4439, 3996, 9223, 3001, 9223, 9103; Payload ID: 4645 relates to Category No.: 12603, 4439, 3996, 9223, 3001, 3000, 3002, 9223, 9103; Payload ID: 4646 relates to Category No.: 13186, 4439, 3996, 9223, 3001, 14216, 3994, 3000, 7270, 9223, 9103, 5219, 6814; Payload ID: 4647 relates to Category No.: 1512, 14663, 4020, 4021, 10256, 4723, 2385, 2383, 2384, 3106, 9410, 9633, 14636, 13925, 13936, 16294, 496, 5949, 10036; Payload ID: 4648 relates to Category No.: 1026, 14661, 14565, 10702, 795, 1752, 5446, 2940, 5592, 9777, 3729, 4130, 16085, 1238, 4969; Payload ID: 4649 relates to Category No.: 14661, 10702, 12638; Payload ID: 4650 relates to Category No.: 14661, 10702, 1238; Payload ID: 4651 relates to Category No.: 14661, 10702, 274, 16197, 11182, 12750, 6474, 7375, 2311, 2940, 11626, 8840, 15185, 5393, 15203, 572, 6747, 3918, 579; Payload ID: 4652 relates to Category No.: 14661, 10702; Payload ID: 4653 relates to Category No.: 14661, 10702, 1713, 11390, 8808; Payload ID: 4654 relates to Category No.: 14661, 10702, 11390, 8808; Payload ID: 4655 relates to Category No.: 14661, 10702, 1238; Payload ID: 4656 relates to Category No.: 14661, 6969, 337, 1048, 8936, 13225, 11174, 11390, 3892, 5612, 10702, 10025, 4969; Payload ID: 4657 relates to Category No.: 14661, 10702, 1238, 6761, 5393, 8680, 3050; Payload ID: 4658 relates to Category No.: 14661, 10702, 1204, 1238; Payload ID: 4661 relates to Category No.: 795, 11930, 12063, 1893, 11660, 7613, 1227, 13827, 13966; Payload ID: 4662 relates to Category No.: 5367, 5446, 3021, 2311, 3012, 5447, 729, 3016, 5773, 5954, 3014; Payload ID: 4663 relates to Category No.: 5367, 5446, 3021, 2311, 3012, 5447, 729, 3016, 5773, 5954, 3014; Payload ID: 4664 relates to Category No.: 5446, 3021, 3012, 5447, 729, 3016, 5773, 5954, 3014; Payload ID: 4665 relates to Category No.: 5446, 3012, 729, 3016, 3015, 5954, 3014, 750; Payload ID: 4666 relates to Category No.: 5446, 3012, 729, 5954, 3014; Payload ID: 4667 relates to Category No.: 5446, 3012, 729, 5954, 3014; Payload ID: 4668 relates to Category No.: 4828, 5367, 5446, 2311, 3012, 5447, 729, 3016, 13788, 14022, 379; Payload ID: 4669 relates to Category No.: 5446, 3013, 3012, 10277; Payload ID: 4670 relates to Category No.: 5446, 3013, 3012, 10277; Payload ID: 4671 relates to Category No.: 5446, 3013; Payload ID: 4672 relates to Category No.: 5446, 3013; Payload ID: 4673 relates to Category No.: 3013; Payload ID: 4674 relates to Category No.: 3013; Payload ID: 4675 relates to Category No.: 5446, 3013; Payload ID: 4676 relates to Category No.: 5446, 3013; Payload ID: 4677 relates to Category No.: 3013; Payload ID: 4678 relates to Category No.: 3013; Payload ID: 4679 relates to Category No.: 5446, 3013; Payload ID: 4680 relates to Category No.: 3013; Payload ID: 4681 relates to Category No.: 3013; Payload ID: 4682 relates to Category No.: 3013; Payload ID: 4683 relates to Category No.: 3013, 8222; Payload ID: 4684 relates to Category No.: 5446, 3013; Payload ID: 4685 relates to Category No.: 5446, 3013; Payload ID: 4686 relates to Category No.: 5446, 1820, 3013, 14838; Payload ID: 4687 relates to Category No.: 5446, 3013; Payload ID: 4688 relates to Category No.: 5446, 3013; Payload ID: 4689 relates to Category No.: 5446, 3013; Payload ID: 4690 relates to Category No.: 5446, 3013; Payload ID: 4691 relates to Category No.: 5446, 3013; Payload ID: 4692 relates to Category No.: 5446, 3013; Payload ID: 4693 relates to Category No.: 5446, 3013; Payload ID: 4694 relates to Category No.: 5446, 3013; Payload ID: 4695 relates to Category No.: 5446, 3013; Payload ID: 4696 relates to Category No.: 3013, 3012; Payload ID: 4697 relates to Category No.: 5446, 3013; Payload ID: 4698 relates to Category No.: 5446, 3013; Payload ID: 4699 relates to Category No.: 3013; Payload ID: 4700 relates to Category No.: 5446, 3013; Payload ID: 4701 relates to Category No.: 5446, 3013; Payload ID: 4702 relates to Category No.: 3013; Payload ID: 4703 relates to Category No.: 4828, 5367, 5446, 3013, 2311, 3012; Payload ID: 4704 relates to Category No.: 4828, 5367, 5446, 3013, 2311, 3012; Payload ID: 4705 relates to Category No.: 6814, 12063, 1893, 3405, 11660, 3407; Payload ID: 4706 relates to Category No.: 6814, 9500, 15642, 4706, 4448, 4969; Payload ID: 4707 relates to Category No.: 6814, 9500; Payload ID: 4708 relates to Category No.: 6814, 9500; Payload ID: 4709 relates to Category No.: 6814, 9500; Payload ID: 4710 relates to Category No.: 6814, 9500; Payload ID: 4711 relates to Category No.: 9500, 7613, 7743, 2083, 14025, 7377, 1355, 6814; Payload ID: 4712 relates to Category No.: 6814, 9500, 14090, 16214, 14086, 10005, 16211, 8582, 9480, 9540, 1274, 13276, 1580; Payload ID: 4713 relates to Category No.: 9500, 12133, 14972, 513, 1864, 6814; Payload ID: 4714 relates to Category No.: 6814, 9500; Payload ID: 4715 relates to Category No.: 6814, 9500; Payload ID: 4716 relates to Category No.: 6814, 9500, 1204; Payload ID: 4717 relates to Category No.: 9500, 6814, 13409; Payload ID: 4718 relates to Category No.: 6814, 9500, 14090, 3791, 11761, 684, 195, 14078; Payload ID: 4719 relates to Category No.: 6814, 9500; Payload ID: 4720 relates to Category No.: 9500, 5261, 15405, 14663, 1878; Payload ID: 4721 relates to Category No.: 9500, 5261, 15405, 14663, 1878, 15407, 14423, 15404; Payload ID: 4722 relates to Category No.: 9500, 5261, 15405, 1204, 14663, 1878, 11051, 15404; Payload ID: 4723 relates to Category No.: 13594, 14565, 15517, 2409, 16191, 12785, 12787; Payload ID: 4724 relates to Category No.: 1730, 7306, 14838, 11550; Payload ID: 4725 relates to Category No.: 1730, 7306, 14838, 14586; Payload ID: 4726 relates to Category No.: 1730, 7306, 14838; Payload ID: 4727 relates to Category No.: 1730, 7306, 14838; Payload ID: 4728 relates to Category No.: 7306, 14838, 11550, 4458, 9378, 10971, 4142; Payload ID: 4729 relates to Category No.: 7743; Payload ID: 4730 relates to Category No.: 7743; Payload ID: 4733 relates to Category No.: 12137, 12427, 5446, 3021, 1893, 16197, 3791, 9597, 5422, 1227, 5453, 10572; Payload ID: 4734 relates to Category No.: 3176, 14838, 16138, 3808, 14831, 6080, 6108, 15365; Payload ID: 4735 relates to Category No.: 6219, 9500, 2206, 14865, 14663, 15978, 14862; Payload ID: 4736 relates to Category No.: 6219, 9500, 14865, 14663, 14862, 2206, 14855; Payload ID: 4737 relates to Category No.: 3639, 2169, 15140, 9125, 8934, 9123, 4475, 14624; Payload ID: 4738 relates to Category No.: 11512, 4998, 1730, 10372, 7730, 7306, 12614, 7743, 12544, 13501, 1714, 2506, 9125, 3176, 12936, 13225, 14056, 14793, 11125, 8375, 1743, 4952, 6611, 15805, 9123, 12213, 907, 14883, 2226, 2233, 7937, 8138, 8007, 9408, 7932, 8352, 10543, 6070, 14637, 13482, 11383, 8932, 12630, 14059, 9126, 8848, 3718, 8954, 14644, 13652, 11410, 12813; Payload ID: 4739 relates to Category No.: 9125, 8402, 11634, 12891, 3612, 1730; Payload ID: 4740 relates to Category No.: 8402, 12861; Payload ID: 4741 relates to Category No.: 1730, 7306, 14640, 9125, 14793, 9584, 15424, 2609, 8370; Payload ID: 4742 relates to Category No.: 690, 14565, 8739, 7306, 7743, 16214, 1714, 9125, 10648, 15194, 9600, 1250, 9723, 11125, 8004, 7923, 9123, 2143, 1970, 7738, 8402, 13223, 1237, 9124, 1585, 1541, 16139, 11084, 16125, 3439, 7660, 13225, 7659, 1247; Payload ID: 4743 relates to Category No.: 15490, 3398, 12153, 15517, 13259, 1795, 9125, 8375, 13257, 4475, 8682; Payload ID: 4744 relates to Category No.: 12153; Payload ID: 4745 relates to Category No.: 1955, 3448, 5218; Payload ID: 4746 relates to Category No.: 12153; Payload ID: 4747 relates to Category No.: 12153, 5446, 9125, 11573, 13639; Payload ID: 4748 relates to Category No.: 15618, 12648, 2940, 13059, 274, 12459, 280, 1925, 11884, 283, 12881, 3853, 7992, 8543, 8667, 8447, 8446, 1922, 7755, 1453, 288, 10280, 11623, 10625, 11425, 12106, 10806, 8449, 1452, 11210; Payload ID: 4749 relates to Category No.: 11512; Payload ID: 4750 relates to Category No.: 13589, 3398, 15490, 3398; Payload ID: 4751 relates to Category No.: 6733, 7735, 2136, 2047, 9459, 10289, 7377, 11038, 2020, 10948, 9460; Payload ID: 4752 relates to Category No.: 12137, 10702, 3639, 13391, 15156; Payload ID: 4753 relates to Category No.: 12137, 10702; Payload ID: 4754 relates to Category No.: 10702; Payload ID: 4755 relates to Category No.: 12137, 10702, 14097, 3698; Payload ID:

4756 relates to Category No.: 10702; Payload ID: 4757 relates to Category No.: 10702; Payload ID: 4758 relates to Category No.: 10702, 3699, 1888; Payload ID: 4759 relates to Category No.: 13589, 3398, 15490, 3398, 10702; Payload ID: 4760 relates to Category No.: 10702, 13391; Payload ID: 4761 relates to Category No.: 12041, 2009; Payload ID: 4762 relates to Category No.: 10702, 1415, 3143, 14097, 3698; Payload ID: 4763 relates to Category No.: 10702, 1415, 3143; Payload ID: 4764 relates to Category No.: 10702, 10380; Payload ID: 4765 relates to Category No.: 10702; Payload ID: 4766 relates to Category No.: 4279, 15603, 5858, 14178; Payload ID: 4767 relates to Category No.: 15898, 12619, 1955, 3356, 3354, 14034, 12096, 12058, 4335, 15605, 3313, 3132; Payload ID: 4768 relates to Category No.: 1206, 4021, 9451, 10383; Payload ID: 4769 relates to Category No.: 7306, 14640, 1206, 4021, 9451, 1931; Payload ID: 4770 relates to Category No.: 9982, 9232, 12313, 9283, 14663, 12242, 12265, 12303, 3090, 12309, 9236; Payload ID: 4771 relates to Category No.: 9283, 14663, 12242, 12265, 3090, 9236, 4910, 12238, 12091, 3211, 8378; Payload ID: 4772 relates to Category No.: 9500, 9693, 1893, 11660; Payload ID: 4773 relates to Category No.: 9693, 15588, 10372, 1893, 11660, 3079, 4535, 11460, 11941; Payload ID: 4774 relates to Category No.: 13589, 3398, 15490, 3398; Payload ID: 4775 relates to Category No.: 13589, 3398, 15490, 3398; Payload ID: 4776 relates to Category No.: 3305, 3305, 3656, 795; Payload ID: 4777 relates to Category No.: 792, 3336; Payload ID: 4778 relates to Category No.: 792, 3336, 3854, 3305, 3656, 3305; Payload ID: 4779 relates to Category No.: 3336, 3305, 3305, 3656; Payload ID: 4780 relates to Category No.: 3336, 3305, 3305, 3656, 4937, 2699; Payload ID: 4781 relates to Category No.: 792, 3336, 3305, 3200; Payload ID: 4782 relates to Category No.: 3095, 1506, 3097, 3088; Payload ID: 4783 relates to Category No.: 1721, 1780, 14663, 9289, 3494, 3487, 3490, 9236, 9235, 9258, 1993, 9283, 13836, 13794, 7381; Payload ID: 4784 relates to Category No.: 3495, 3498, 3500, 9232, 3356, 14663, 12303, 9236, 12306; Payload ID: 4785 relates to Category No.: 15490, 3398, 5785, 14565, 10702, 8731, 3398; Payload ID: 4786 relates to Category No.: 14661, 5785, 14565, 10702, 1752, 13485, 11620; Payload ID: 4787 relates to Category No.: 5785; Payload ID: 4788 relates to Category No.: 5785, 10702, 8728, 1905; Payload ID: 4789 relates to Category No.: 14661, 5785, 13485, 1204; Payload ID: 4790 relates to Category No.: 5785, 8728, 8522, 7748, 12856; Payload ID: 4791 relates to Category No.: 9982, 2552; Payload ID: 4792 relates to Category No.: 11940, 3684, 3837, 14033, 14096, 3829, 11298, 11242, 3836, 3900, 3835, 11912, 5789, 2138; Payload ID: 4793 relates to Category No.: 11926, 3684, 10372, 3837, 12063, 14096, 3829, 1893, 11660, 10362, 8583, 3829, 15067; Payload ID: 4794 relates to Category No.: 3684, 3837, 12063, 8583, 3829; Payload ID: 4795 relates to Category No.: 1512, 14663, 5004, 4723, 2385, 2383, 3106; Payload ID: 4796 relates to Category No.: 1512, 14663, 4723, 2385, 3106; Payload ID: 4797 relates to Category No.: 1703, 7743, 2571; Payload ID: 4798 relates to Category No.: 12194, 3013, 5954, 3014; Payload ID: 4799 relates to Category No.: 2702; Payload ID: 4800 relates to Category No.: 12194, 1816, 7306, 1714, 14834, 13511, 6163, 6538, 13835, 13836; Payload ID: 4801 relates to Category No.: 2940, 7340, 12948, 7342; Payload ID: 4802 relates to Category No.: 5255, 1703; Payload ID: 4803 relates to Category No.: 5255, 1703, 12954, 1345, 13662, 1561, 2116; Payload ID: 4804 relates to Category No.: 5255, 1703, 12117, 5406; Payload ID: 4805 relates to Category No.: 5255, 795, 1703, 14589, 1432, 11765, 12117, 1812, 1844, 13989, 6626; Payload ID: 4806 relates to Category No.: 5255, 795, 1703, 11765, 12954, 1844, 1345, 13662, 3116, 12272, 13989, 6626; Payload ID: 4807 relates to Category No.: 5255, 795, 1703, 11765, 1844; Payload ID: 4808 relates to Category No.: 5255, 1703, 4937, 14589, 5939, 1257; Payload ID: 4809 relates to Category No.: 795, 5939, 9632, 3781, 11765, 12954, 1844, 5732, 1345, 13662, 3116, 16135, 12000, 14643, 14589, 450, 5731, 16294; Payload ID: 4810 relates to Category No.: 290, 297, 284, 10191; Payload ID: 4811 relates to Category No.: 12194; Payload ID: 4812 relates to Category No.: 12194; Payload ID: 4814 relates to Category No.: 13589, 3398, 16127; Payload ID: 4815 relates to Category No.: 13589, 3398; Payload ID: 4816 relates to Category No.: 13589, 3398, 15490, 3398, 14949, 11414, 12980, 6390; Payload ID: 4817 relates to Category No.: 2409, 11846, 7884, 12897, 3574; Payload ID: 4818 relates to Category No.: 13589, 3398, 15490, 3398, 6390; Payload ID: 4819 relates to Category No.: 7306; Payload ID: 4820 relates to Category No.: 15490, 3398, 7306; Payload ID: 4821 relates to Category No.: 14565; Payload ID: 4822 relates to Category No.: 6814, 14038, 5446, 3021, 16197, 8789, 8114, 11573, 10966, 11341, 13000, 8265, 8587; Payload ID: 4824 relates to Category No.: 14216, 3656, 14216, 4439, 4442, 11734, 13510; Payload ID: 4825 relates to Category No.: 334, 795, 10238, 11765, 4041, 5806, 8923, 5814, 335; Payload ID: 4826 relates to Category No.: 5785, 9982, 10074, 11987, 1238; Payload ID: 4827 relates to Category No.: 5785, 9982, 10074, 11987, 1238; Payload ID: 4828 relates to Category No.: 11940, 12137, 5785, 9982, 14565, 10074, 3639, 11987, 1746, 7306, 3775, 1238, 13970, 3220, 14401; Payload ID: 4829 relates to Category No.: 5785, 9982, 10074, 11987, 9940, 1238; Payload ID: 4830 relates to Category No.: 5785, 9982, 10074, 11987, 1238, 12066; Payload ID: 4831 relates to Category No.: 5785, 9982, 14565, 10074, 11987, 1238, 8928; Payload ID: 4832 relates to Category No.: 9982, 11987, 5785, 10074, 1238, 8049, 8977, 13532, 4588, 3971, 12942, 11305, 4932, 13083; Payload ID: 4833 relates to Category No.: 5785, 9982, 13975, 10074, 11987, 1238, 3220; Payload ID: 4834 relates to Category No.: 13594, 4828, 5785, 9982, 14565, 10074, 11987, 13785, 1238, 1477, 15379, 11986; Payload ID: 4835 relates to Category No.: 5785, 9982, 10074, 1752, 11987, 7148, 1238, 8318, 6225, 7710, 8552; Payload ID: 4836 relates to Category No.: 6219, 10074, 1238, 815, 8970, 3217, 8906, 8898, 3616; Payload ID: 4837 relates to Category No.: 6219, 6212, 10074, 1238, 815, 8906, 8898, 8970; Payload ID: 4838 relates to Category No.: 14090, 15660, 6226, 9945, 1867, 14663, 15664, 4653, 16150, 6312, 392, 3220, 4108, 6814; Payload ID: 4839 relates to Category No.: 6814, 14090, 4634, 15660, 6226, 9945, 1867, 14663, 2353, 4653, 6312, 392, 3220, 6335, 4108, 2162, 4095, 2078, 13316, 10663, 11558, 12699, 7976, 13078; Payload ID: 4840 relates to Category No.: 6219; Payload ID: 4841 relates to Category No.: 14661, 12648, 14456, 2940, 274, 12028, 13149, 13408, 1999, 1846, 287, 10366; Payload ID: 4842 relates to Category No.: 14661, 274, 7306, 2886, 4134, 9379, 1846, 287, 286; Payload ID: 4843 relates to Category No.: 14661, 274, 1846, 14838; Payload ID: 4844 relates to Category No.: 15626, 9823, 4937, 14643, 6103, 6323, 15664, 1112, 6080; Payload ID: 4845 relates to Category No.: 6814, 9500, 1512, 14663, 4538, 11941, 16323, 4558, 3503, 7513; Payload ID: 4846 relates to Category No.: 14216, 3656, 8739, 14267, 792, 8940, 4439, 11756, 11697, 14610, 7012, 8854, 4442, 11754, 8604, 15225, 11055, 9739, 11354, 2658, 2657, 4937, 14949, 2243, 7303, 11634, 12891, 13225, 10648, 7292, 13229, 672, 12619, 5460, 4939, 13265, 3782, 14910, 690, 3021, 3246, 6375, 1780, 1622, 1556, 1320, 14886, 3595, 12628, 13739, 3594, 11010, 14894, 5754, 7382, 13200, 13442, 13266, 9335, 13152, 16339, 13192, 13671, 8009, 1574, 4394, 12795, 4936; Payload ID: 4847 relates to Category No.: 8739, 7306, 8831, 7693, 12800, 8509, 8446, 8439, 13401, 8287, 10709, 4027, 7694, 7699, 4937, 3642, 1765, 3641, 13681, 4251, 14000, 6796, 3595, 7662, 4947, 8626, 16289, 4067, 12783, 6996; Payload ID: 4848 relates to Category No.: 16286, 7306, 8831, 7693, 10314; Payload ID: 4849 relates to Category No.: 16286, 8731, 3398, 674, 7306, 8831, 7693, 472, 7587, 7829; Payload ID: 4850 relates to Category No.: 16286, 7306, 8831, 8053; Payload ID: 4851 relates to Category No.: 14565, 674, 7131, 10491, 10606; Payload ID: 4852 relates to Category No.: 13589, 3398, 15490, 3398, 1295, 8731, 3398, 2169, 3194, 8739, 483, 481; Payload ID: 4853 relates to Category No.: 5785; Payload ID: 4854 relates to Category No.: 11294; Payload ID: 4855 relates to Category No.: 8862, 7291, 16182; Payload ID: 4856 relates to Category No.: 1703, 2562, 9410; Payload ID: 4857 relates to Category No.: 1703, 9410; Payload ID: 4859 relates to Category No.: 6637, 151, 6360, 7306; Payload ID: 4860 relates to Category No.: 9500, 1512, 3502; Payload ID: 4861 relates to Category No.: 13248, 9500, 9374, 9283, 14663, 7132, 4661, 4332, 15307, 9053, 16234, 16275, 11113, 13612, 1031, 13942, 3251, 15311, 15309, 4233, 13410; Payload ID: 4862 relates to Category No.: 9500, 9374, 9283, 4661, 15311, 15309, 15389; Payload ID: 4863 relates to Category No.: 6814, 14663, 1878, 1308; Payload ID: 4864 relates to Category No.: 9500, 1790, 15642, 1874, 14663, 1878, 12338, 12456, 7023, 1308, 6424, 4743, 12194, 13126, 7039, 7508, 14817, 4418, 496, 228, 84, 6237, 3253; Payload ID: 4865 relates to Category No.: 6814, 15642, 1874, 14663, 4538, 12338, 12456, 228, 14646; Payload ID: 4866 relates to Category No.: 6814, 15642, 1874, 14663, 1878, 4448, 6424, 6279, 7505, 84; Payload ID: 4867 relates to Category No.: 9500, 2996, 2997, 15967, 14663, 12303, 9236, 12306, 13969, 13827, 14009, 10238, 4145, 5998, 13795, 13156; Payload ID: 4868 relates to Category No.: 14663, 12303, 11941, 9236, 12307, 15397, 12302, 15983, 11940, 15985, 1144, 6814; Payload ID: 4869 relates to Category No.: 8862, 1026, 14565, 9232, 3639, 2940, 12522, 6814, 1295, 13232, 13827, 14883, 13775, 13811, 13229, 9333, 10674, 15167; Payload ID: 4870 relates to Category No.: 1026, 6814, 11940, 1948, 7737, 280, 272, 13787, 10628, 8378, 11094, 8862, 8928, 12638, 13232; Payload ID: 4871 relates to Category No.: 8862, 1026, 6814, 8926, 8928, 8938; Payload ID: 4872 relates to Category No.: 1026, 6814, 8862, 14565; Payload ID: 4873 relates to Category No.: 9500, 14663, 12303, 9236, 12307, 15397, 12241, 12302, 15983, 15390, 1142; Payload ID: 4874 relates to Category No.: 9500, 15715, 15702; Payload ID: 4875 relates to Category No.: 9500, 15702, 15715, 6814, 7728, 15712, 4439, 7834; Payload ID: 4876 relates to Category No.: 9500, 15702, 15715; Payload ID: 4877 relates to Category No.: 9500, 15715, 15702; Payload ID: 4878 relates to Category No.: 14318, 14314, 14316; Payload ID: 4879 relates to Category No.: 13248, 9052, 14663, 9053, 11111, 2486, 13541, 825, 10226, 830, 6814; Payload ID: 4880 relates to Category No.: 13248, 7613, 9048, 9052, 14663, 9053, 11111, 2486, 825, 830; Payload ID: 4881 relates to Category No.: 9500, 4670, 2364, 627; Payload ID: 4882 relates to Category No.: 12194, 16308, 7613, 4615, 7737, 7840, 14663, 815, 1957, 1922, 2070, 6154, 733, 5248, 1865; Payload ID: 4883 relates to Category No.: 12194; Payload ID: 4884 relates to Category No.: 12194, 6532; Payload ID: 4885 relates to Category No.: 12194, 12041, 13328, 10588; Payload ID: 4886 relates to Category No.: 12194; Payload ID: 4887 relates to Category No.: 12194, 10372, 13882, 15185, 16189, 15192, 3713, 12651, 7963, 6297, 1112, 12226; Payload ID: 4888 relates to Category No.: 12194, 12041, 13328, 13126, 11220, 8946, 13330, 11222; Payload ID: 4889 relates to Category No.: 12194; Payload ID: 4890 relates to Category No.: 12194, 5367; Payload ID: 4891 relates to Category No.: 12194; Payload ID: 4892 relates to Category No.: 9982, 3100, 5491, 14663, 5501; Payload ID: 4893 relates to Category No.: 9982, 3100, 14663, 5491, 5501; Payload ID: 4894 relates to Category No.: 9673, 1893, 11660, 1780; Payload ID: 4895 relates to Category No.: 9673, 1893, 11660, 10275, 8540; Payload ID: 4896 relates to Category No.: 6814, 6902, 9673, 1893, 11660; Payload ID: 4897 relates to Category No.: 9673, 1893, 11660; Payload ID: 4898 relates to Category No.: 9673, 1893, 11660, 13376, 11294; Payload ID: 4899 relates to Category No.: 14661, 12137, 14565; Payload ID: 4900 relates to Category No.: 14661, 12137, 14565; Payload ID: 4901 relates to Category No.: 14661, 12137, 14565, 12732, 12892; Payload ID: 4902 relates to Category No.: 14318, 10702, 13186, 9228, 4439, 3996, 2799, 9223, 3001, 14216, 3994, 14310, 7270; Payload ID: 4903 relates to Category No.: 1737, 14318, 7743, 7154, 14216, 9223, 3995, 14216, 3994, 14310, 9223, 3994, 14949, 7011, 7160, 10166; Payload ID: 4904 relates to Category No.: 14318, 14216, 3994, 14310, 7270; Payload ID: 4905 relates to Category No.: 12091, 1703, 15614, 9717, 2592, 4021, 11858, 4145, 16294, 14926, 5998, 14691, 14689, 12854, 9720, 7743, 12633, 3566, 6553, 1313, 3519, 12652, 14643, 9411; Payload ID: 4906 relates to Category No.: 12091, 14565, 9720, 1703, 15614, 2592, 1206, 4021, 12553, 11858, 9451, 11363, 2571, 11147, 11265, 10626, 10599, 10625, 12854, 3629, 2379, 10372; Payload ID: 4908 relates to Category No.: 5783, 7735, 16294; Payload ID: 4909 relates to Category No.: 6814, 12498, 7306, 8004; Payload ID: 4910 relates to Category No.: 6814, 1204; Payload ID: 4911 relates to Category No.: 6814, 1204; Payload ID: 4912 relates to Category No.: 15149, 14579; Payload ID: 4913 relates to Category No.: 14579, 8956; Payload ID: 4914 relates to Category No.: 14579; Payload ID: 4915 relates to Category No.: 14579; Payload ID: 4916 relates to Category No.: 11910, 11032, 14579, 1780, 7139; Payload ID: 4917 relates to Category No.: 8862, 1026, 12648, 8739, 15149, 2711, 11910, 14589, 286, 13126, 12405, 7946, 3926, 12412, 7134, 1183, 16197, 12041, 4749, 4425, 8318, 1891, 10588, 3924, 3715, 11222, 904, 2717, 3873, 8435, 13495, 360, 16005, 15193, 1318, 3613, 10372, 7939, 8524, 10192, 15185, 6111, 5393, 11997, 13739, 8688, 14697, 9744, 6746, 13200, 665, 15426, 4943; Payload ID: 4918 relates to Category No.: 8862, 15149, 12405, 12412, 8454, 4749, 4425, 14454; Payload ID: 4919 relates to Category No.: 8862, 15149, 12405, 3926, 12412, 4749, 4425, 1026, 7743, 8454, 3896; Payload ID: 4920 relates to Category No.: 8862, 1026, 14661, 14565, 15149, 5446, 6606, 348, 4186, 12391, 12412, 4127, 11884, 3775, 5541, 16085, 8988, 4749, 4425, 10486, 6102, 10590, 3900, 13084, 12045, 3060, 11436, 656, 13252, 8559, 15160, 6297, 8920, 14729, 16242, 12935; Payload ID: 4921 relates to Category No.: 5785, 14565, 12498, 7743, 14589; Payload ID: 4922 relates to Category No.: 14661, 274, 1846; Payload ID: 4923 relates to Category No.: 274, 1846, 3176; Payload ID: 4924 relates to Category No.: 5785, 8888, 8977, 11237, 1483, 15517, 15143, 10044, 11506, 3398, 13237, 12405, 7693, 10314, 12117, 8918, 3041, 8522, 11620, 8507, 12036, 16286, 10038, 12666, 8535, 1026, 2548, 1048, 11094, 13371, 1023, 14729, 11285, 2593, 11713, 12028, 2902, 2654, 2655, 14617; Payload ID: 4925 relates to Category No.: 14661, 5785, 16286, 1483, 15517, 10044, 4949, 11506, 3398, 7693, 11285, 10314, 5072, 9091, 11363, 8887, 9480, 16286, 10038, 14417, 10879, 1497, 1892, 2548, 4953, 11296, 2654, 2655, 14418; Payload ID: 4926 relates to Category No.: 5785, 16286, 1483, 10044, 11506, 3398, 7693, 11285, 10314, 9091, 16286, 10038, 12666, 10879, 9092, 2548, 4953, 9481, 13827; Payload ID: 4927 relates to Category No.: 8739, 16286, 8831, 7693, 7997, 12606, 11243, 13376, 8192, 11620, 10333, 13681, 10038, 3593, 4419, 15143, 3041, 3598, 10606; Payload ID: 4928 relates to Category No.: 13681, 7719, 3799, 14643, 5463, 8398, 4969; Payload ID: 4929 relates to Category No.: 16286, 8831, 7735, 7712, 7693, 7942; Payload ID: 4930 relates to Category No.: 9642, 14699, 3228, 9599, 3604, 3445, 3176, 9593; Payload ID: 4931 relates to Category No.: 14699; Payload ID: 4933 relates to Category No.: 15626; Payload ID: 4935 relates to Category No.: 6969, 9099, 11620, 8934, 11085, 1892, 1782, 11997, 1483, 2250, 13232, 11299, 15464, 7029, 13524, 8862, 11094, 2459, 13829, 10257, 12008, 10382, 12759, 12287; Payload ID: 4936 relates to Category No.: 13589, 3398, 8739, 13594, 1730, 8373, 8402, 5073, 9321, 3612, 12213, 4257, 8415, 15035, 13603, 2245, 2246; Payload ID: 4937 relates to Category No.: 13589, 3398, 1295, 8739, 13594, 15517, 1730, 11512, 1622, 8402, 3575, 9333, 5073, 9321, 3612, 1319, 12213, 4257, 8415, 15035, 13603, 2245, 2246; Payload ID: 4938 relates to Category No.: 13589, 3398, 15517, 11512, 1240, 10036, 9321, 9319; Payload ID: 4939 relates to Category No.: 13589, 3398, 8739, 7306; Payload ID: 4940 relates to Category No.: 8862, 13589, 3398, 11506, 3398, 14640, 1257, 1780, 1918, 11524, 3631, 9455, 15517, 11512, 673, 4946, 1026, 5459, 10574, 1048, 9540, 10314, 1274, 3595, 3791, 4067, 3519, 9341, 11147; Payload ID: 4941 relates to Category No.: 8862, 13589, 3398, 14640, 673, 4946, 5459, 10574, 9540, 3595, 3791; Payload ID: 4942 relates to Category No.: 13589, 3398, 15490, 3398; Payload ID: 4943 relates to Category No.: 1483, 10314, 8375, 13143, 11620, 12459, 1782, 1721, 2242, 2250, 4261; Payload ID: 4944 relates to Category No.: 334, 14661, 14565, 10702, 795, 12648, 274, 12459, 7743, 13485, 7737, 8887, 11248, 4229, 7992, 4953, 8661, 10591, 4251, 8584, 5067; Payload ID: 4945 relates to Category No.: 13589, 3398, 15490, 3398, 14533, 9485, 6531; Payload ID: 4946 relates to Category No.: 13589, 3398, 14533, 14620, 8932, 3437, 2251, 11085; Payload ID: 4947 relates to Category No.: 13589, 3398, 15490, 3398; Payload ID: 4948 relates to Category No.: 13589, 3398, 14533, 15490, 3398; Payload ID: 4949 relates to Category No.: 13589, 3398, 14533, 15490, 3398; Payload ID: 4950 relates to Category No.: 13589, 3398, 15490, 3398, 1730, 14533, 6535, 14837, 10748, 10750; Payload ID: 4953 relates to Category No.: 15490, 3398, 2409, 6490, 3337, 10648, 4439, 12891, 3783, 8004, 3783, 1360, 10745, 3340, 8081, 6902, 8739, 12646, 12891, 8731, 3398, 4440, 1906, 13835, 13967, 1295, 13925, 2094, 2131, 14025, 496, 13867, 13827, 14040, 13837, 13767, 13970, 13904, 2068, 13916, 13795, 8929, 14022, 13780, 14350, 3341, 3326, 14341, 14347, 2032; Payload ID: 4954 relates to Category No.: 3337, 2410, 4439, 12891, 3783, 8004, 3783, 1360, 12892, 3340, 8739, 14838, 1906, 3339, 6903, 5326, 3338, 13835, 13967, 14025, 496, 13827, 2006, 14040, 13837, 13811, 13904, 13916, 7132, 8929, 10356, 13780, 5016, 3341, 14341, 14347, 1966; Payload ID: 4955 relates to Category No.: 8739, 3337, 10648, 4439, 12891, 3783, 8004, 3783, 1360, 10745, 3340, 8081, 12892, 1906, 11888, 6903, 5411, 13835, 8731, 3398, 13882, 14025, 13827, 14040, 13767, 13811, 11091, 13904, 13795, 1951, 3341, 14341, 14347, 2005; Payload ID: 4956 relates to Category No.: 10331, 8731, 3398, 14838, 3337, 4439, 12891, 3783, 12892, 3340; Payload ID: 4957 relates to Category No.: 1737, 9228, 3354, 7154, 5750, 3453, 11845, 9296, 3311, 9296; Payload ID: 4958 relates to Category No.: 9228, 15257, 5750, 3453, 15268, 11845, 1723, 9296, 3311, 15264; Payload ID: 4959 relates to Category No.: 9228, 403, 3354, 3448, 5750, 3453, 11845, 9296, 3311, 1060, 13904, 3353, 2424, 15257, 16051; Payload ID: 4960 relates to Category No.: 795, 1955, 14834, 4998, 2139, 1948, 7133, 1978, 7984, 2002; Payload ID: 4961 relates to Category No.: 795, 792, 11765, 1844, 791; Payload ID: 4962 relates to Category No.: 795, 792, 11765, 1844, 7958, 7612, 10238, 15399, 14565; Payload ID: 4963 relates to Category No.: 3354, 12431, 14838, 3336, 4134, 3352, 13904, 7157, 14998, 6687, 2425, 4367, 15144, 14834, 9485, 6535, 9378; Payload ID: 4964 relates to Category No.: 15490, 3398, 8739, 2411, 8731, 3398, 3354, 3337, 2410, 12936, 5182, 11510, 5131, 13837; Payload ID: 4965 relates to Category No.: 3304, 3336, 3342; Payload ID: 4966 relates to Category No.: 3356, 12775, 11659, 6500; Payload ID: 4967 relates to Category No.: 3356, 9327, 9228, 3452, 3356, 3354, 3320, 3448, 15257, 1089, 7132, 3357, 3356, 13698, 7038, 10522, 3455, 3369, 7037, 15259, 15260, 3318; Payload ID: 4968 relates to Category No.: 12194; Payload ID: 4969 relates to Category No.: 12194; Payload ID: 4970 relates to Category No.: 1002, 795, 12519; Payload ID: 4971 relates to Category No.: 795, 12519; Payload ID: 4972 relates to Category No.: 13589, 3398, 11843, 11512, 1722, 1790, 11089, 8739, 16286, 3684, 8731, 3398, 1955, 11506, 3398, 7693, 14033, 1893, 13831, 8524, 10855, 8611, 5810, 919, 11520, 10548, 12778, 8592, 9746, 7294, 7831, 13610, 7877, 13695, 795, 8352, 7879, 14009, 11090, 3827, 1248, 7971, 496, 13827, 13966, 10238, 13975, 13775, 13877, 3602, 15490, 3398; Payload ID: 4973 relates to Category No.: 1295, 8929, 3021, 8728, 5809, 15521, 1780, 4439, 8988, 13882, 8617, 8934, 8447, 8446, 11090, 8171, 12397, 11887, 8035; Payload ID: 4974 relates to Category No.: 8617; Payload ID: 4975 relates to Category No.: 15490, 3398, 15517; Payload ID: 4976 relates to Category No.: 11926, 7613, 10238, 8193, 14033, 13381, 13867, 12101, 8547, 12029, 14838, 14831, 687, 15471, 3313, 3132; Payload ID: 4977 relates to Category No.: 11926, 10372, 13867, 12101, 1524; Payload ID: 4978 relates to Category No.: 334, 11926, 7613, 8739, 10238, 7743, 7840, 8390, 11298, 12117, 8918, 7122, 8522, 13867, 12101, 13892, 14617, 8103, 8131; Payload ID: 4979 relates to Category No.: 11926, 13867, 12101, 8111; Payload ID: 4980 relates to Category No.: 11926, 14033, 1995, 10250, 12671, 8111, 2272, 2273; Payload ID: 4981 relates to Category No.: 11926, 3684, 1893, 10250, 5855, 7096; Payload ID: 4983 relates to Category No.: 11926; Payload ID: 4985 relates to Category No.: 11926, 11237, 3837, 14033, 11298, 12101, 8111, 8512; Payload ID: 4986 relates to Category No.: 11926, 14033, 13867; Payload ID: 4987 relates to Category No.: 11926, 14033, 8739; Payload ID: 4988 relates to Category No.: 11926, 7840, 1995, 10250, 12671, 5732, 8111, 274, 8731, 3398, 4021, 12036, 2393, 15177, 2396; Payload ID: 4990 relates to Category No.: 2276, 8111; Payload ID: 4991 relates to Category No.: 3684, 3837, 1893, 5855; Payload ID: 4993 relates to Category No.: 10250, 13373, 8549, 11926, 13618; Payload ID: 4994 relates to Category No.: 9500, 1790, 3837, 13831, 11927, 10250, 8535, 5810; Payload ID: 4997 relates to Category No.: 12137, 3697, 9455, 12789, 12788; Payload ID: 4998 relates to Category No.: 12137; Payload ID: 4999 relates to Category No.: 11947, 10250, 8509, 2116, 13071, 8307, 7508; Payload ID: 5000 relates to Category No.: 1790; Payload ID: 5001 relates to Category No.: 8739, 15471; Payload ID: 5003 relates to Category No.: 11926, 16214, 11947, 12127, 1893, 10250, 4450; Payload ID: 5004 relates to Category No.: 15490, 3398, 2409, 11506, 3398, 1995, 12671, 2987, 3356, 7880, 7735; Payload ID: 5005 relates to Category No.: 11926; Payload ID: 5006 relates to Category No.: 12101; Payload ID: 5008 relates to Category No.: 14661, 12137, 5782, 14565, 12361, 9238, 10955, 10583, 13106; Payload ID: 5009 relates to Category No.: 14098, 4771, 4766, 14097, 16166, 4784; Payload ID: 5010 relates to Category No.: 7613, 3684, 3021, 1893, 7834, 5855, 7914, 12195; Payload ID: 5012 relates to Category No.: 11926, 14033; Payload ID: 5013 relates to Category No.: 8977, 15149, 3986, 15157, 12453, 8373; Payload ID: 5016 relates to Category No.: 9718, 6738, 11646, 12719, 2494; Payload ID: 5017 relates to Category No.: 11926, 1995, 12671, 2272; Payload ID: 5018 relates to Category No.: 7291, 16182, 14271, 4439; Payload ID: 5019 relates to Category No.: 14729, 10250; Payload ID: 5020 relates to Category No.: 4828; Payload ID: 5021 relates to Category No.: 7306, 8005, 4458; Payload ID: 5022 relates to Category No.: 11926, 11947, 12117; Payload ID: 5023 relates to Category No.: 14565, 1795, 5785, 15614, 12391; Payload ID: 5024 relates to Category No.: 14565, 1795, 1238, 6145, 15614, 12391; Payload ID: 5025 relates to Category No.: 12391; Payload ID: 5026 relates to Category No.: 6606, 15614, 8862; Payload ID: 5027 relates to Category No.: 13240, 6606, 15614, 8862; Payload ID: 5029 relates to Category No.: 11296; Payload ID: 5030 relates to Category No.: 9982, 12063, 1893, 3405, 11660, 3407, 3408; Payload ID: 5031 relates to Category No.: 12062, 6211, 12063, 1893, 3405, 11660, 3407; Payload ID: 5032 relates to Category No.: 12063, 15588, 5446, 11930, 13818, 14934, 12062, 1893, 4439, 11660, 15185; Payload ID: 5033 relates to Category No.: 12062, 12063, 1893, 3405, 11660, 15950, 12066, 3402, 3404; Payload ID: 5034 relates to Category No.: 4797, 2775, 12062, 12063, 1893, 12071, 3405, 11660, 3404, 12048, 4436; Payload ID: 5035 relates to Category No.: 12603, 4797, 2775, 12063, 1893, 12071, 3405, 11660, 13376, 3404, 11686, 6455; Payload ID: 5036 relates to Category No.: 1512, 4797, 2775, 12063, 1893, 12071, 3405, 11660, 11882, 13376, 12048; Payload ID: 5037 relates to Category No.: 1830, 1533, 14663, 1878, 1638, 3425, 5416, 14025, 15152, 1957, 1901, 1993, 2469, 13995, 7305, 5900, 14508, 10010; Payload ID: 5038 relates to Category No.: 6814, 9500, 3781, 14663, 1878, 6697, 6698, 1729, 10025, 11085, 3197, 16140; Payload ID: 5039 relates to Category No.: 9500, 15149, 14663, 1878, 1638, 9110, 12646, 16213, 4535, 6296, 6758, 4131, 11601, 6145, 13978, 2878, 901, 12856, 1250, 1115, 13775, 6624, 3427, 6144, 5250; Payload ID: 5040 relates to Category No.: 4828, 9929, 14451, 10209, 433, 15140, 434, 328, 10366, 4828, 2745, 15149, 3436, 13827, 6102, 11323, 12782, 1930, 11713, 16213, 3428, 15622, 10309, 16102, 10487, 6629, 11222, 484, 2247, 11436, 4588, 11949, 8946, 6323, 6296, 12779, 3070, 7340, 1112, 6758, 15273, 1114, 5073, 907, 901, 4536, 13811, 2638, 4132, 4855, 13775, 9744, 6624, 6299, 3431, 14445, 4932, 9381, 15016, 3433, 13835, 5782, 13969, 2006, 13971, 13837, 13767, 13773, 1451, 14000, 14011, 13951, 13961, 2009, 7737, 13851, 13659, 13084, 10923, 8522, 13780, 10614, 14729, 10977, 9403, 7811, 14646, 13043; Payload ID: 5041 relates to Category No.: 4828, 5785, 2467, 6296, 9929, 14455, 7743, 7581, 7737, 1836, 15140, 7658, 1048, 10481, 8956, 436, 9862, 11997, 8524, 12781, 15149, 3436, 14025, 13827, 13330, 1114, 1115, 7855, 8672, 4588, 13695, 12782, 8825, 12953, 13532, 4342, 13497, 11713, 16213, 13084, 3428, 15273, 7893, 10487, 414, 10699, 8540, 817, 13951, 8912, 13921, 13775, 11085, 484, 901, 2247, 9744, 12580, 13873, 13811, 1319, 10532, 10653, 11051, 480, 14940, 7191, 10025, 4132, 4855, 3431, 8114, 11591, 11325, 11512, 13882, 13837, 13105, 8118, 10583, 6322, 13961, 13905, 16286, 360, 4251, 11313, 10923, 13311, 13787, 13884, 442, 7894, 15016, 9403, 7811, 14646, 10687, 13526, 4826, 249, 13081, 984; Payload ID: 5042 relates to Category No.: 4828, 15149, 2467, 6296, 7581, 14451, 1836, 433, 7658, 10481, 436, 14729, 8524, 12781, 13827, 1114, 6102, 12782, 11033, 11713, 16213, 6103, 3428, 8540, 817, 13951, 4826, 12580, 13873, 13811, 8415, 249, 7354, 14892, 10530, 13837, 13071, 13189, 13775, 12550, 7893, 11512, 8739, 10372, 11325, 15149, 3436, 13080, 8646, 4412, 12718, 14646, 13081; Payload ID: 5043 relates to Category No.: 4828, 3431, 15149, 345, 7581, 14451, 1836, 436, 483, 14729, 1114, 1115, 10887, 7688, 8825, 12717, 11401, 12779, 3428, 8540, 817, 1112, 13775, 13873, 10532, 4131, 5440, 7191, 14056, 10590, 14011, 2469, 13238, 901, 15149, 3436, 14545, 9337, 9991, 12577, 11168; Payload ID: 5044 relates to Category No.: 4828, 15149, 9929, 14451, 1836, 10209, 433, 434, 328, 15149, 3436, 6102, 12397, 1930, 10208, 8357, 16294, 15622, 13550, 901, 13811, 7658, 13775, 9116, 6299, 6629, 12870, 14445; Payload ID: 5045 relates to Category No.: 12137, 3676, 4770; Payload ID: 5046 relates to Category No.: 12137, 7306, 3676, 2562, 4770; Payload ID: 5047 relates to Category No.: 1026, 16286, 7693, 4251, 3441, 2600, 8373, 7636; Payload ID: 5048 relates to Category No.: 13589, 3398, 15490, 3398, 8934, 1026, 8929, 1048, 8862, 3441, 3159, 15655, 14453, 3123; Payload ID: 5049 relates to Category No.: 12619, 5161, 2410, 2412, 13048, 13615; Payload ID: 5050 relates to Category No.: 8862, 15149, 12575, 15157, 1421; Payload ID: 5051 relates to Category No.: 15149, 12575; Payload ID: 5052 relates to Category No.: 15490, 3398, 11512, 795, 7743, 7996; Payload ID: 5053 relates to Category No.: 13589, 3398, 15490, 3398; Payload ID: 5054 relates to Category No.: 7131; Payload ID: 5055 relates to Category No.: 5785, 9713, 11858, 8862, 1026, 2169, 8934, 3041, 1295, 1023, 12285, 5073, 6082, 2178, 13829; Payload ID: 5056 relates to Category No.: 5785; Payload ID: 5057 relates to Category No.: 5785, 13681, 8934, 1849, 11394, 16213, 3041; Payload ID: 5058 relates to Category No.: 5785; Payload ID: 5059 relates to Category No.: 5785; Payload ID: 5060 relates to Category No.: 12091, 8862, 5785, 14038, 3691, 2169, 8934, 1048, 4251, 3041, 1295, 1023, 2178; Payload ID: 5061 relates to Category No.: 12091, 5785, 12285, 5073; Payload ID: 5062 relates to Category No.: 12091; Payload ID: 5063 relates to Category No.: 13589, 3398, 11512, 8739, 9375, 14533, 6526, 8269, 10969, 11033, 14521, 6538, 6539, 15517, 6530, 14838, 1764, 4459, 14520, 3199, 10952, 13253, 5785; Payload ID: 5064 relates to Category No.: 13589, 3398, 15490, 3398, 13501, 1204, 11512, 3612, 11068; Payload ID: 5065 relates to Category No.: 13589, 3398, 15490, 3398, 14533, 484, 16127, 13265, 15622, 6539; Payload ID: 5066 relates to Category No.: 8862, 5255, 1703, 15140, 14058, 11201, 7719, 10258, 1465, 3043, 3041, 6296, 11641; Payload ID: 5067 relates to Category No.: 5255, 1295, 2169, 1048, 3445, 1743, 3613; Payload ID: 5068 relates to Category No.: 5782, 1204; Payload ID: 5069 relates to Category No.: 1204; Payload ID: 5070 relates to Category No.: 1204; Payload ID: 5071 relates to Category No.: 15490, 3398, 8739, 2410, 5146; Payload ID: 5072 relates to Category No.: 7306, 1204; Payload ID: 5073 relates to Category No.: 9673, 1893, 11660; Payload ID: 5074 relates to Category No.: 12194; Payload ID: 5075 relates to Category No.: 11882; Payload ID: 5076 relates to Category No.: 7306, 11882, 14834; Payload ID: 5077 relates to Category No.: 11882; Payload ID: 5078 relates to Category No.: 11882; Payload ID: 5079 relates to Category No.: 2414, 5159; Payload ID: 5080 relates to Category No.: 2414, 5159; Payload ID: 5081 relates to Category No.: 15490, 3398, 3691, 2414, 5159, 2410; Payload ID: 5082 relates to Category No.: 15490, 3398, 8739; Payload ID: 5083 relates to Category No.: 286, 13236, 12753, 4446, 8885, 6506, 1715, 1716; Payload ID: 5084 relates to Category No.: 795, 12427, 403, 344, 15140, 8940, 11765, 10107, 14328, 1844, 12365; Payload ID: 5085 relates to Category No.: 14216, 3656, 14267, 14177, 14216, 4439, 3016, 14310, 11756, 11697, 3015, 4442, 11734, 12891, 10648, 7013, 13152; Payload ID: 5086 relates to Category No.: 1737, 2429, 14661, 7154, 7132; Payload ID: 5088 relates to Category No.: 11294; Payload ID: 5089 relates to Category No.: 15707, 13621, 2964, 3356; Payload ID: 5090 relates to Category No.: 15707, 13621, 2964, 1204; Payload ID: 5091 relates to Category No.: 14565, 11910; Payload ID: 5092 relates to Category No.: 9500, 13975, 2885, 5261, 15405, 5300, 14663, 1878, 13797, 5299, 15110, 2800, 12397; Payload ID: 5093 relates to Category No.: 9500, 13975, 14038, 2885, 5261, 15405, 5300, 14663, 1878, 13797, 2800, 7303, 1272, 5458, 4167, 15402, 15407, 5263, 415; Payload ID: 5094 relates to Category No.: 12137, 11091, 12999, 5301, 11307, 13579; Payload ID: 5095 relates to Category No.: 12137, 12999, 5301, 13579; Payload ID: 5096 relates to Category No.: 12091, 9720, 10887, 10583, 1970, 10624; Payload ID: 5097 relates to Category No.: 9718, 13975, 12498, 3100, 11910, 5407, 13168, 8256, 9715, 8255, 3642, 8267, 7133, 13835, 5785, 7613, 13859, 13796, 10238, 13970, 14000, 13797, 13921, 2000, 13877, 14022, 7946, 7880; Payload ID: 5098 relates to Category No.: 9718, 3100, 11910, 8193, 14015, 5912, 5407, 13925, 8192, 9350, 8523, 13000, 8574, 8662, 12477, 12566, 13970, 8415; Payload ID: 5099 relates to Category No.: 9718, 14267, 3100, 11910, 14211, 10141; Payload ID: 5100 relates to Category No.: 11910, 10662, 9718, 1894, 3100; Payload ID: 5101 relates to Category No.: 9718, 3100, 11910, 14838, 6687; Payload ID: 5102 relates to Category No.: 9718, 3100, 11910, 5407; Payload ID: 5103 relates to Category No.: 11910, 12646, 10878, 15570, 9718, 3100; Payload ID: 5104 relates to Category No.: 9718, 3100, 11910, 5407, 6607, 6609, 6120, 8256; Payload ID: 5105 relates to Category No.: 11910, 9718, 3100, 5407; Payload ID: 5106 relates to Category No.: 9718, 3100, 11910, 8193, 360, 10878, 5912, 8522, 7834, 10955, 8192, 11265, 10879, 5407; Payload ID: 5107 relates to Category No.: 9718, 3100, 11910, 5407, 3642; Payload ID: 5108 relates to Category No.: 9718, 3100, 11910, 5407; Payload ID: 5109 relates to Category No.: 3100, 11910, 12646, 10878, 15570, 9718, 795, 8739, 7306, 1780, 5407, 8677, 8689, 8686; Payload ID: 5110 relates to Category No.: 9718, 3100, 11910; Payload ID: 5111 relates to Category No.: 9718, 8739, 3100, 11910, 7946, 10343, 11173, 8523; Payload ID: 5112 relates to Category No.: 3100, 11910; Payload ID: 5113 relates to Category No.: 9718, 3100, 11910, 5912; Payload ID: 5114 relates to Category No.: 9718, 5446, 3100, 11910, 7362, 7946, 8988, 15003, 15456, 15450, 7363, 15448, 15443, 5407, 15454, 15446, 15653, 15457, 15458, 8192, 15451, 8256, 11027, 8689, 8677; Payload ID: 5115 relates to Category No.: 9718, 5446, 6606, 3100, 11910, 7362, 8988, 15003, 15456, 15450, 7363, 15448, 15443, 5407, 15454, 15446, 15653, 15457, 15458, 15451, 3642; Payload ID: 5116 relates to Category No.: 1026, 9718, 14661, 5446, 6606, 348, 3100, 11910, 345, 4186, 12391, 4127, 3775, 5541, 16085, 8988, 5407, 3642; Payload ID: 5117 relates to Category No.: 1026, 9718, 14661, 5446, 10238, 6606, 348, 3100, 11910, 345, 4186, 7362, 7946, 12391, 4127, 3775, 5541, 16085, 8988, 15003, 15456, 15450, 7363, 15448, 15443, 5407, 3445, 12877, 12800, 12949, 15454, 15446, 15653, 15457, 15458, 15451, 13964, 8535, 13969, 13827, 13970, 13865, 1730, 10356; Payload ID: 5118 relates to Category No.: 1026, 9718, 14661, 5446, 6606, 348, 3100, 11910, 345, 4186, 7362, 12391, 4127, 3775, 5541, 16085, 8988, 15003, 15456, 15450, 7363, 15448, 15443, 5407, 15454, 15446, 15653, 15457, 15458, 15451, 8255; Payload ID: 5119 relates to Category No.: 9718, 3100, 11910, 5407; Payload ID: 5120 relates to Category No.: 1026, 9718, 14661, 5446, 6606, 348, 3100, 11910, 345, 4186, 12391, 4127, 3775, 5541, 16085, 8988, 5912, 5407; Payload ID: 5121 relates to Category No.: 9718, 3100, 11910; Payload ID: 5122 relates to Category No.: 12091, 8862, 9720, 7132, 11858, 2469, 9716, 7883, 14566, 11247, 9982, 9713, 8335, 16182, 12484, 16182; Payload ID: 5123 relates to Category No.: 12091, 9720, 11506, 3398, 455, 7385; Payload ID: 5124 relates to Category No.: 12091, 9720, 1955, 14699, 5809, 10680, 8388; Payload ID: 5125 relates to Category No.: 12091, 9720, 3854; Payload ID: 5126 relates to Category No.: 12091, 9720; Payload ID: 5127 relates to Category No.: 1269, 4766; Payload ID: 5128 relates to Category No.: 8862, 3684, 7154, 14097, 3698, 9420, 1893, 7132, 4336, 743, 5855, 6714; Payload ID: 5129 relates to Category No.: 6814, 7154, 7168, 1780, 9420, 7132, 4336, 743, 12008, 6714; Payload ID: 5130 relates to Category No.: 7154, 2886, 9420, 7132, 4336, 743, 6986; Payload ID: 5131 relates to Category No.: 9187, 743; Payload ID: 5132 relates to Category No.: 743, 16136, 756, 2705; Payload ID: 5133 relates to Category No.: 743, 7168; Payload ID: 5134 relates to Category No.: 10372, 12498, 361, 1962; Payload ID: 5135 relates to Category No.: 1026, 6814, 3766, 12427, 3639, 2506, 3697, 483, 14456, 15471, 12133, 15149, 4342, 12409, 4826, 11441; Payload ID: 5136 relates to Category No.: 6814, 795, 3639, 10238, 6733, 11765, 7043, 9757, 11941, 7548, 13165, 11322, 1844, 13692, 3507, 13164, 13369, 7044, 11290, 7121, 11017, 7062, 13295, 10864, 4948, 12029, 12509; Payload ID: 5137 relates to Category No.: 13589, 3398, 13248, 14565, 12427, 3639, 10238, 11506, 3398, 8940, 14663, 6738, 4336, 12522, 15547, 743, 11646, 9053, 8274, 15167, 12409, 16136, 756, 2705, 14838, 1956, 13811, 10543, 13921, 2070, 11111, 4775, 2460, 11182, 8756, 1928, 2155, 11425, 4826, 13392, 10889, 6474, 12928, 11400, 6814; Payload ID: 5138 relates to Category No.: 6814, 3639, 15140, 4200, 10628, 12760, 7872; Payload ID: 5139 relates to Category No.: 5785, 10702, 13435; Payload ID: 5140 relates to Category No.: 3176, 4949; Payload ID: 5141 relates to Category No.: 6814, 6984; Payload ID: 5142 relates to Category No.: 2465, 1043, 1075, 3176, 4949; Payload ID: 5145 relates to Category No.: 2460, 2461, 9475, 7245, 4952, 6375, 3178, 3170, 3177, 3809, 5457, 1043, 12715, 6108; Payload ID: 5146 relates to Category No.: 7131, 10491, 2465, 1043, 1075, 13970, 14000; Payload ID: 5147 relates to Category No.: 7245, 1043; Payload ID: 5148 relates to Category No.: 2461, 9475, 5457; Payload ID: 5149 relates to Category No.: 6814, 6984, 2463, 14831, 13936, 5457, 3808, 2462, 2461; Payload ID: 5150 relates to Category No.: 6814, 6984; Payload ID: 5152 relates to Category No.: 6814, 6984, 14831, 3176, 12715, 4949, 2461; Payload ID: 5153 relates to Category No.: 6814, 6984; Payload ID: 5154 relates to Category No.: 6814, 6984; Payload ID: 5155 relates to Category No.: 6814, 6984, 2463; Payload ID: 5156 relates to Category No.: 6814, 6984, 2463; Payload ID: 5157 relates to Category No.: 6814, 6984, 2463; Payload ID: 5158 relates to Category No.: 6814, 6984, 2459, 14831, 1204, 2461, 3176, 9475, 4949, 6080; Payload ID: 5159 relates to Category No.: 6814, 6984, 2463; Payload ID: 5160 relates to Category No.: 6814, 6984, 2463, 2461, 5457; Payload ID: 5161 relates to Category No.: 6814, 6984, 2463; Payload ID: 5162 relates to Category No.: 6814, 6984, 1779, 14838, 7252; Payload ID: 5163 relates to Category No.: 6814, 14831, 2461, 3176, 9475, 4949, 3808; Payload ID: 5164 relates to Category No.: 6814, 2459, 2461, 3176, 9475; Payload ID: 5166 relates to Category No.: 6814, 6986, 8988; Payload ID: 5167 relates to Category No.: 6814, 14586, 7252; Payload ID: 5168 relates to Category No.: 6814, 6984, 15626, 7168, 9420, 7132, 4336, 2904, 15001, 743, 3914; Payload ID: 5169 relates to Category No.: 6814, 6984, 16170, 743; Payload ID: 5170 relates to Category No.: 6984, 6814, 15626, 9420, 16197, 7132, 4336, 743; Payload ID: 5171 relates to Category No.: 1737, 6814, 6984, 15626, 7154, 16197, 11029; Payload ID: 5172 relates to Category No.: 6814, 6984, 15626, 743, 6969, 2197; Payload ID: 5173 relates to Category No.: 6984, 9420, 4766, 743, 2459, 3445, 3176, 12099, 8929, 2460, 4949, 4251, 14886, 3595, 11394, 2705, 914, 5792, 6814; Payload ID: 5174 relates to Category No.: 6814, 2459, 9420, 743, 3176; Payload ID: 5175 relates to Category No.: 13589, 3398, 15490, 3398, 6986, 795, 674, 274, 9420, 11765, 16197, 7132, 4134, 4336, 6451, 15042, 743, 5806, 11260, 8468, 2460, 5792, 12603; Payload ID: 5176 relates to Category No.: 6986, 15626, 795, 9420, 11765, 6451, 743, 5806, 11260, 15148; Payload ID: 5177 relates to Category No.: 6814, 6984, 15626, 9420, 16212; Payload ID: 5178 relates to Category No.: 6814, 6984, 15626, 9420; Payload ID: 5179 relates to Category No.: 1737, 6814, 12931, 7154, 3889, 16189, 8370, 5789, 6987, 12746, 8940, 12942; Payload ID: 5180 relates to Category No.: 1737, 6814, 15626, 13166, 7154; Payload ID: 5182 relates to Category No.: 8522; Payload ID: 5183 relates to Category No.: 16160, 10065; Payload ID: 5184 relates to Category No.: 14318, 14267, 12224, 15257, 1780, 1289, 14319, 14721, 7289, 14214, 15261, 11468, 1290, 11465; Payload ID: 5185 relates to Category No.: 13337, 2461, 3176, 9475, 8934, 5457, 13030; Payload ID: 5186 relates to Category No.: 1722, 1703, 2940, 6969, 5592, 1767, 4021, 14050, 5731, 4990, 6487, 6814, 16286, 1048, 14095; Payload ID: 5187 relates to Category No.: 275, 8940, 10648, 8936, 6738, 11097, 12781, 6713, 11646, 726, 727, 12780, 1238, 9420, 13050, 10083; Payload ID: 5188 relates to Category No.: 14565, 15149, 15012, 8922; Payload ID: 5190 relates to Category No.: 6961, 7737, 2933, 4021, 9075, 7187, 12827, 8524, 16189, 6739, 8256, 12890, 10269, 12793, 7241, 3814, 1317, 2599, 1093, 14385, 7370, 8861, 13981, 1433; Payload ID: 5192 relates to Category No.: 12091, 12603, 9713, 1836, 12948, 9165, 13210, 7331, 13476, 13497, 12845, 13526; Payload ID: 5193 relates to Category No.: 7330, 11091, 13678, 12670, 7345, 4021, 1892, 7341, 7245, 12596, 7332, 12953, 13409, 1562, 8446, 1889, 7342, 13956, 11094, 9630, 13477, 13475, 13450, 1552, 8443, 11398, 13589, 3398, 12891, 13126, 10382, 14636, 7946, 7416, 3869, 9340, 8976, 9307, 3880; Payload ID: 5194 relates to Category No.: 2169, 15143; Payload ID: 5196 relates to Category No.: 5095, 8862, 13589, 3398, 11512, 795, 2139, 12619, 8739, 9296, 5446, 3354, 5809, 2410, 9125, 4094, 16197, 7132, 14992, 13882, 4336, 12117, 11363, 1995, 5741, 2469, 11573, 15533, 5182, 10180, 13836, 2006, 13597, 12671, 11529, 12487, 5740, 11847, 9142, 5142, 13632, 15517, 1060, 11506, 3398, 9410, 14793, 11242, 4949, 14636, 10086, 6375, 6666; Payload ID: 5197 relates to Category No.: 2410, 5182, 5131; Payload ID: 5198 relates to Category No.: 13589, 3398, 15490, 3398, 11512, 795, 5808, 8739, 8731, 3398, 11506, 3398, 9125, 3309, 11765, 10648, 7132, 4332, 7292, 7971, 5806, 7879, 7972, 10626, 11260, 12886, 8751, 12619, 4251, 5807, 716, 2154, 6112, 14838, 2006, 2068, 1969; Payload ID: 5199 relates to Category No.: 13589, 3398, 15521, 7132, 12619, 5807, 6112; Payload ID: 5200 relates to Category No.: 13589, 3398, 15521, 9125, 7132, 7972, 11506, 3398, 10372, 15490, 3398; Payload ID: 5201 relates to Category No.: 13589, 3398, 15490, 3398, 11512, 15521, 4439, 7132, 15570, 7245, 2184, 7318, 15517, 12646, 2459, 1797, 9410, 3790, 12649, 1237, 13612; Payload ID: 5202 relates to Category No.: 13589, 3398, 15490, 3398, 11512, 12619, 1779, 15521, 4439, 7132, 15570, 9410; Payload ID: 5203 relates to Category No.: 13589, 3398, 15490, 3398, 8739, 13612; Payload ID: 5204 relates to Category No.: 13589, 3398, 15490, 3398, 11512, 8739, 7743, 10036, 14928, 7850, 10517, 15740, 2397, 5019, 7997, 3313, 14566, 8751; Payload ID: 5205 relates to Category No.: 13589, 3398, 15490, 3398, 11512, 8739, 10036, 14928, 7850, 10517, 1724, 15740, 2397, 5019, 1780; Payload ID: 5206 relates to Category No.: 10372, 8736, 11509; Payload ID: 5207 relates to Category No.: 1737, 15490, 3398, 12153, 8739, 7154, 1780, 16197, 12936, 7133, 12625, 3356, 13166, 3567; Payload ID: 5208 relates to Category No.: 1730, 13589, 3398, 11512, 15517, 11506, 3398, 12737, 8689; Payload ID: 5209 relates to Category No.: 13594, 13589, 3398, 15490, 3398, 1730, 8731, 3398, 11506, 3398; Payload ID: 5210 relates to Category No.: 13594, 13589, 3398, 5428, 8731, 3398, 7306, 3781, 11506, 3398, 3791, 6566, 15517, 11512, 674, 4021, 1227; Payload ID: 5211 relates to Category No.: 13589, 3398, 11512, 1730, 15517, 11506, 3398, 7542, 9071; Payload ID: 5212 relates to Category No.: 13594, 13589, 3398, 1730, 1780, 15517, 14782, 11512, 3532, 7730, 6561, 3535; Payload ID: 5213 relates to Category No.: 11512, 15517, 7306, 13589, 3398, 11506, 3398, 15490, 3398; Payload ID: 5214 relates to Category No.: 11512, 15517, 11506, 3398, 1334, 1743, 455, 10432, 13589, 3398, 15490, 3398, 7306; Payload ID: 5215 relates to Category No.: 11512, 7306, 15517, 11506, 3398, 13589, 3398; Payload ID: 5216 relates to Category No.: 13589, 3398, 15490, 3398, 7306, 11512, 15517; Payload ID: 5217 relates to Category No.: 3639, 16160, 3525, 15166; Payload ID: 5218 relates to Category No.: 11512, 2885, 7613, 15517, 11506, 3398, 1925, 1988, 5659, 15817, 1996, 2066, 13377, 4496, 10657, 8739, 13589, 3398, 14620, 13888, 12498, 13860, 7693, 2080, 1257, 1978, 15194, 13597; Payload ID: 5219 relates to Category No.: 11512, 1295, 7613, 15517, 11506, 3398, 7369, 1925, 1988, 4094, 12120, 13236, 9738, 11922, 14620, 13589, 3398, 14386, 7251, 2080, 13276, 14113, 4069, 14121, 14114, 14118, 1298, 13888, 6103; Payload ID: 5220 relates to Category No.: 13589, 3398, 15490, 3398, 7613, 7345, 1925, 1988, 10558, 2469, 2143, 1970, 1762, 3708, 8922, 9738, 12888, 11453; Payload ID: 5221 relates to Category No.: 13589, 3398, 7613, 1925, 1988, 15490, 3398, 10372; Payload ID: 5222 relates to Category No.: 14177; Payload ID: 5223 relates to Category No.: 13589, 3398, 15517, 12923, 1780, 12886; Payload ID: 5224 relates to Category No.: 1295, 6969, 7168, 8898, 4969; Payload ID: 5225 relates to Category No.: 14456, 16214, 13145, 8301; Payload ID: 5227 relates to Category No.: 6986, 7154; Payload ID: 5228 relates to Category No.: 6814, 1204; Payload ID: 5230 relates to Category No.: 14565; Payload ID: 5232 relates to Category No.: 1737, 10702, 1721, 7306, 14097, 3698, 1780; Payload ID: 5233 relates to Category No.: 10702, 7809; Payload ID: 5234 relates to Category No.: 9500, 5446, 13284; Payload ID: 5235 relates to Category No.: 8862, 12153, 11831, 7306, 8760, 11094; Payload ID: 5236 relates to Category No.: 5367, 14565, 1730, 11109, 15782, 3532, 4937, 14643, 10648, 1820, 10775, 10314, 10025, 11108, 9321, 4940, 14358, 4439, 15481; Payload ID: 5237 relates to Category No.: 14565, 795, 1730, 3781, 15782, 4937, 10648, 10025, 11108, 9321, 14358; Payload ID: 5238 relates to Category No.: 11109, 7306, 3781, 15782, 10878, 3534, 5807; Payload ID: 5239 relates to Category No.: 9500, 14123; Payload ID: 5240 relates to Category No.: 9500, 1746, 12936, 15965; Payload ID: 5241 relates to Category No.: 1703, 1238; Payload ID: 5242 relates to Category No.: 1703, 1238; Payload ID: 5243 relates to Category No.: 4828, 10074, 12258, 11940, 2041, 2136, 2021, 13786, 2011; Payload ID: 5244 relates to Category No.: 9266, 9251, 6814; Payload ID: 5245 relates to Category No.: 6814, 15918; Payload ID: 5246 relates to Category No.: 6814, 1746, 12062, 1780, 932, 10682, 2994, 13304; Payload ID: 5247 relates to Category No.: 6814, 13796, 13932; Payload ID: 5248 relates to Category No.: 6814; Payload ID: 5249 relates to Category No.: 6814, 9257, 9250; Payload ID: 5250 relates to Category No.: 6814, 5367, 12427, 9228, 9815, 1206, 14663, 7735, 12553, 2009, 8117, 7971, 128, 16234, 16275, 4448, 9266, 1880, 14484, 14128, 8506, 5472, 8032, 8023; Payload ID: 5251 relates to Category No.: 4828, 6814, 5367, 12638, 12427, 9228, 9941, 9815, 2311, 12488, 11178, 7252, 10573, 10890, 9826; Payload ID: 5252 relates to Category No.: 6814, 5367, 12427, 9228, 9815, 9266; Payload ID: 5253 relates to Category No.: 6814, 1238, 10280, 12257; Payload ID: 5254 relates to Category No.: 6814, 1714; Payload ID: 5255 relates to Category No.: 6219, 6814, 6212, 2364; Payload ID: 5256 relates to Category No.: 6814, 7743, 14865, 14663, 7890, 14868, 14869, 4729; Payload ID: 5257 relates to Category No.: 1002, 1000, 3635; Payload ID: 5258 relates to Category No.: 14565, 1730, 15782, 4937, 9321, 15481; Payload ID: 5259 relates to Category No.: 15601, 4615; Payload ID: 5270 relates to Category No.: 13589, 3398, 15490, 3398; Payload ID: 5274 relates to Category No.: 2242; Payload ID: 5277 relates to Category No.: 8936; Payload ID: 5281 relates to Category No.: 13589, 3398, 9720, 16214, 3775, 4021, 3582, 7799, 1463, 11636, 10372, 10371, 8378, 12900; Payload ID: 5282 relates to Category No.: 4021; Payload ID: 5283 relates to Category No.: 12068, 6814; Payload ID: 5284 relates to Category No.: 1703, 7306, 10383; Payload ID: 5285 relates to Category No.: 4021, 10383, 9633; Payload ID: 5286 relates to Category No.: 1721, 1730, 7306, 4021, 10383, 1808; Payload ID: 5287 relates to Category No.: 690, 1703, 10558, 1240, 16096, 8402, 7737; Payload ID: 5289 relates to Category No.: 9500, 13882, 12488, 8611, 2006, 13597, 9525, 9704, 7832, 13962, 7689, 1570, 5986, 16137, 4954; Payload ID: 5290 relates to Category No.: 9500, 1790, 12633, 13882, 13227, 5773, 11243, 2006, 13597, 9704; Payload ID: 5291 relates to Category No.: 334, 9500, 795, 1955, 12646, 13882, 13227, 2006, 13597, 9704, 11943; Payload ID: 5293 relates to Category No.: 1204; Payload ID: 5294 relates to Category No.: 3635, 11940, 5782, 3639, 2459, 12013, 8936, 1238, 2353, 11063, 6335, 10426, 2068, 10542, 3691; Payload ID: 5295 relates to Category No.: 3635, 6814, 12041, 1238, 11063, 10542, 6754, 3639, 2711; Payload ID: 5296 relates to Category No.: 3635, 11940, 2459, 1238, 12592, 12129; Payload ID: 5297 relates to Category No.: 3635, 11940, 11178, 1993, 12798, 10028; Payload ID: 5298 relates to Category No.: 15693, 3656, 15693; Payload ID: 5299 relates to Category No.: 15715, 4439, 7113, 3656, 15693, 3656; Payload ID: 5300 relates to Category No.: 12194, 8739, 9777, 14034, 1836, 3013, 11878, 4020, 8112, 4021, 2569, 10954, 10854, 11391, 8162, 7786, 380, 7790, 10780, 13925, 6145, 14053, 8045, 3014, 9007; Payload ID: 5301 relates to Category No.: 13756, 1780, 4020, 4021, 9410, 1237, 14636, 15000, 12465, 2110, 2079, 2131, 1970, 496, 2006, 1250, 1951, 13881, 756, 13825, 1939, 2030; Payload ID: 5302 relates to Category No.: 4021, 10383; Payload ID: 5303 relates to Category No.: 1703, 1204; Payload ID: 5305 relates to Category No.: 13589, 3398; Payload ID: 5306 relates to Category No.: 8862, 1730; Payload ID: 5307 relates to Category No.: 7288, 14267, 6102, 3041, 6296; Payload ID: 5308 relates to Category No.: 13186, 7306, 4439, 13509, 7292, 11546, 137; Payload ID: 5309 relates to Category No.: 13755, 1874, 14663, 4101, 6215; Payload ID: 5310 relates to Category No.: 13755, 1874, 14663; Payload ID: 5311 relates to Category No.: 9500, 13975, 13755, 1874, 14663, 3555, 4101; Payload ID: 5312 relates to Category No.: 15601, 13589, 3398, 15490, 3398; Payload ID: 5313 relates to Category No.: 13589, 3398, 11512, 1730, 5446, 15517, 11506, 3398, 7362, 8988, 15003, 15456, 15450, 7363, 15448, 15443, 15454, 15446, 15653, 15457, 15458, 15451, 13845, 2125, 1978, 13921, 11090, 2039; Payload ID: 5314 relates to Category No.: 13589, 3398, 11512, 14565, 1730, 8731, 3398, 15517, 16294, 690; Payload ID: 5315 relates to Category No.: 13589, 3398, 15490, 3398, 1730, 8739, 5147, 13594; Payload ID: 5316 relates to Category No.: 13589, 3398, 12137, 11109, 7306, 14097, 3698, 5361; Payload ID: 5318 relates to Category No.: 13589, 3398, 15490, 3398; Payload ID: 5319 relates to Category No.: 13589, 3398, 11512, 795, 15517, 11506, 3398, 7735, 7941; Payload ID: 5320 relates to Category No.: 7345, 14699, 14640, 11394, 3629, 1622; Payload ID: 5321 relates to Category No.: 14699; Payload ID: 5322 relates to Category No.: 13589, 3398, 15490, 3398; Payload ID: 5323 relates to Category No.: 10702, 13376, 11294; Payload ID: 5324 relates to Category No.: 10702, 3021, 12748; Payload ID: 5325 relates to Category No.: 10702; Payload ID: 5326 relates to Category No.: 15499, 15517, 4439, 16197, 8454, 10527, 3559, 11509, 11611, 14724, 11530, 14725, 5406; Payload ID: 5327 relates to Category No.: 15499, 11512, 15517, 14838, 12827, 10527, 3559, 14944, 3399, 3559, 14724, 11084, 11087, 8618, 8178; Payload ID: 5328 relates to Category No.: 6643, 6814; Payload ID: 5329 relates to Category No.: 7288, 7291, 16182, 14271, 4439, 1957, 13811; Payload ID: 5330 relates to Category No.: 13589, 3398, 15499, 14724; Payload ID: 5331 relates to Category No.: 13594, 15499, 8739, 2410, 13048; Payload ID: 5332 relates to Category No.: 15726, 13594, 15499, 2169, 2410, 10366, 13360, 5146, 5182, 8934; Payload ID: 5333 relates to Category No.: 13594, 15499, 2410, 13360, 5146, 5182; Payload ID: 5334 relates to Category No.: 13589, 3398, 15490, 3398, 2410, 10366; Payload ID: 5335 relates to Category No.: 13589, 3398, 15490, 3398, 2410, 10366, 1204; Payload ID: 5336 relates to Category No.: 15660, 4107, 14375, 6310, 16142, 1867, 14663, 14862, 15979, 587, 6203, 4107, 7231; Payload ID: 5337 relates to Category No.: 15660, 4107, 10165, 6310, 16142, 1867, 14663, 15978, 15979, 587, 6203, 16144; Payload ID: 5338 relates to Category No.: 15660, 4107, 14375, 4107, 10165, 6310, 16142, 1867, 14663, 15978, 15979, 587, 6203, 4107, 7231; Payload ID: 5339 relates to Category No.: 4104, 15660, 4107, 14375, 6310, 16142, 1867, 14663, 3166; Payload ID: 5340 relates to Category No.: 15660, 4107, 10165, 6310, 16142, 1867, 14663, 15978, 15979, 587, 6203, 4107, 7231, 4104; Payload ID: 5341 relates to Category No.: 15660, 4107, 14375, 6310, 1867, 14663, 6302, 4107, 4104; Payload ID: 5342 relates to Category No.: 15660, 4107, 14375, 4107, 10165, 6310, 16142, 1867, 14663, 4104; Payload ID: 5343 relates to Category No.: 10059; Payload ID: 5344 relates to Category No.: 5785, 1703; Payload ID: 5345 relates to Category No.: 15490, 3398, 8731, 3398, 2410, 4439, 12891, 3783, 8004, 3783, 12892, 5203, 10742, 8739, 14883; Payload ID: 5346 relates to Category No.: 7345, 7132, 7340, 7712, 7155, 1993, 12583, 7156, 11251, 7990, 14620; Payload ID: 5347 relates to Category No.: 14318, 14314, 14171, 6902; Payload ID: 5349 relates to Category No.: 14565, 14640, 14982, 2355, 14663, 3475, 2347, 4998; Payload ID: 5350 relates to Category No.: 14982; Payload ID: 5351 relates to Category No.: 13589, 3398, 2243, 5406, 13827, 11634, 8929, 8900, 5242, 1295, 2251, 15247, 2248, 1296, 8937, 13267, 12373; Payload ID: 5352 relates to Category No.: 13589, 3398, 2243, 13827, 724, 12891, 13713, 8929, 4251, 1295, 3070, 2251, 1782, 4250; Payload ID: 5353 relates to Category No.: 1026, 15207, 5788, 274, 8887, 297; Payload ID: 5354 relates to Category No.: 8862, 1026, 14661, 1795, 286, 297, 11941, 9410, 11418, 7938, 8600, 10192; Payload ID: 5355 relates to Category No.: 1206, 9321, 609; Payload ID: 5356 relates to Category No.: 3305, 3656, 1204; Payload ID: 5357 relates to Category No.: 6814; Payload ID: 5360 relates to Category No.: 1204; Payload ID: 5361 relates to Category No.: 15178; Payload ID: 5366 relates to Category No.: 674, 15178; Payload ID: 5367 relates to Category No.: 13589, 3398, 11512, 5785, 1713, 1703, 8739, 1752, 11167, 12614, 7737, 1767, 8756, 12646, 1257, 13313, 11285, 4020, 13882, 15570, 9600, 16294, 7924, 4952, 10286, 860, 13616, 8439, 16096, 2433, 8394, 3137, 14697, 11444, 2179, 8506, 16119, 690, 4949, 1757; Payload ID: 5369 relates to Category No.: 9228; Payload ID: 5370 relates to Category No.: 3353, 792, 5406, 10238, 14029, 13779, 13835, 1984, 13936, 496, 2006, 2083, 10769, 1922, 8927, 10237; Payload ID: 5371 relates to Category No.: 9228, 3354, 14216, 3656; Payload ID: 5372 relates to Category No.: 12194, 14216, 3656, 5367, 12427, 4145; Payload ID: 5373 relates to Category No.: 3354; Payload ID: 5374 relates to Category No.: 690, 403, 746, 12544, 738, 4094, 6739, 9631, 13788, 13000, 12194, 10226; Payload ID: 5375 relates to Category No.: 12194, 403, 746, 12544, 738, 9631; Payload ID: 5376 relates to Category No.: 3837, 3835, 8583, 3829; Payload ID: 5377 relates to Category No.: 12194; Payload ID: 5378 relates to Category No.: 11926, 9500, 1894, 14021, 1893, 13831, 13998, 13695, 2273, 5810, 4021, 1334, 3684, 1790, 148, 12051, 2006, 9412; Payload ID: 5379 relates to Category No.: 11926, 9500, 4021, 4535, 1790, 148, 12051, 5537; Payload ID: 5381 relates to Category No.: 11926, 5782, 345, 12105, 11285, 10648, 8004, 8540, 12156, 12803; Payload ID: 5382 relates to Category No.: 11926, 1790, 14033, 13831, 4715; Payload ID: 5383 relates to Category No.: 12091, 7288, 14216, 3656, 13589, 3398, 15490, 3398, 1722, 3684, 344, 7273, 1893, 13831, 11858, 7270, 5855, 2143, 11345, 3715, 362, 13095, 9709, 7291, 16181, 7279, 1984, 10550, 5536, 9714, 5810; Payload ID: 5384 relates to Category No.: 12091, 7288, 14216, 15490, 3398, 9228, 8731, 3398, 13831, 14310, 791, 13589, 3398, 344, 1722, 5810; Payload ID: 5385 relates to Category No.: 3833; Payload ID: 5386 relates to Category No.: 1737, 15626, 7710, 7154, 13370, 7132, 4336, 13004, 13966, 13860; Payload ID: 5387 relates to Category No.: 1238, 6145, 14589, 5255; Payload ID: 5388 relates to Category No.: 690, 795, 1730, 11236, 2311, 7598, 10552; Payload ID: 5389 relates to Category No.: 690, 795, 1730, 11236, 2311, 7598, 10552; Payload ID: 5390 relates to Category No.: 690, 10372, 12633, 14928, 10723; Payload ID: 5391 relates to Category No.: 13589, 3398, 15490, 3398, 7306, 11506, 3398, 13071, 3711, 10513; Payload ID: 5392 relates to Category No.: 13594, 13589, 3398, 15490, 3398, 11512, 14565, 13882, 2006, 13597, 14782, 7383, 15517, 1730, 16214, 13975, 5866, 9111, 690, 4998, 6375, 12953, 1751, 3854, 15121, 7122, 1250, 3605, 13599; Payload ID: 5393 relates to Category No.: 4828, 8739, 10372, 9854, 1816, 1795, 1451, 13659, 10366, 16099, 5503, 9054, 10486, 10879, 11802, 10557, 11033, 11391, 11111, 10324, 11351, 7657, 10710, 13546, 11310, 861, 16117, 9639, 9057, 7765, 11984, 6133, 10378, 10762, 8395, 11234, 10417, 5406, 1249, 3445, 7001, 11987, 4949, 14640, 12544, 13882, 1622, 13298, 4541, 13756, 9600, 1265, 10487, 8865, 7688, 11591, 9937, 11325, 14122, 11512, 5785, 13925, 13977, 2014, 2131, 2136, 13459, 13827, 2006, 13767, 8632, 13773, 1957, 6627, 14002, 14026, 5080, 14454, 11136, 11102, 13961, 2088, 2013, 1982, 11231, 1746, 1969, 13823, 11392, 14022, 2059, 7305, 8089, 1922, 6723, 13917, 13992, 3810, 13956, 15110; Payload ID: 5394 relates to Category No.: 2885, 10372, 1795, 1451, 13659, 16099, 5503, 9000, 6459, 10902, 10486, 11802, 10710, 13546, 861, 16117, 11234, 6462, 5258, 11475, 15273, 6371, 3727, 11392; Payload ID: 5395 relates to Category No.: 14565, 10372, 1816, 7306, 1795, 12891, 13659, 16099, 5503, 9000, 10954, 10902, 10358, 11033, 1237, 10710, 13546, 16117, 9639, 10762, 12638, 11220, 8929, 1836, 6705, 1872, 8869, 12764; Payload ID: 5396 relates to Category No.: 12194, 4949, 12099, 13659, 9637, 3578, 11315, 13546, 1292, 5262, 3519, 15039, 1385, 3722, 9786, 13882, 13827, 13794, 10309, 10324, 12544, 795, 12832, 13661, 10687, 13956; Payload ID: 5397 relates to Category No.: 6814, 1295, 6902, 1816, 4949, 9637, 1587, 12194; Payload ID: 5398 relates to Category No.: 12194, 8962, 13758, 5785; Payload ID: 5399 relates to Category No.: 4828, 14565, 14693, 12544, 328, 13756, 1780, 16099, 3737, 3724, 10486, 4541, 355, 861, 5406, 4946, 4949, 13882, 9600, 8865, 7688, 13969, 13925, 7613, 11987, 10372, 496, 2051, 11285, 6627, 5080, 4494, 14108, 14454, 11136, 9611, 13951, 4195, 14690, 12824, 10790, 11323, 10487, 10301, 10583, 11102, 10884; Payload ID: 5400 relates to Category No.: 8862, 4828, 8739, 1795, 7581, 12544, 16099, 3737, 3724, 9932, 16117, 7765, 6462, 8376, 3738, 10025, 13298, 6705, 8869, 9738, 3197, 11644, 13969, 13925, 7613, 2041, 10372, 13459, 496, 16102, 11285, 10486, 11591, 11325, 14454, 12824, 11168, 13978, 2264, 12873, 3810; Payload ID: 5402 relates to Category No.: 13589, 3398, 8739, 674, 14640, 11512, 7303, 3445, 12891, 8929, 8928, 10025, 5066, 3595, 3584, 6192, 12213, 6995, 6997; Payload ID: 5403 relates to Category No.: 13589, 3398, 7306, 11512, 8929, 8928, 5066, 6995; Payload ID: 5404 relates to Category No.: 795, 1752, 5446, 274, 9777, 3729, 4130, 16197, 16085, 7252, 12750, 12365, 9777, 293; Payload ID: 5405 relates to Category No.: 1713, 795, 5446, 2940, 4130, 16085, 1804, 1752; Payload ID: 5406 relates to Category No.: 1752, 795, 9777; Payload ID: 5407 relates to Category No.: 14216, 3656, 4439, 3996, 9223, 3001; Payload ID: 5408 relates to Category No.: 1204, 4439, 3996, 9223, 3001; Payload ID: 5409 relates to Category No.: 15490, 3398, 11512, 8739, 8731, 3398, 11506, 3398, 2410, 12936, 5182, 8004, 3783, 5131, 16091; Payload ID: 5410 relates to Category No.: 13594, 15490, 3398, 3354, 2409; Payload ID: 5411 relates to Category No.: 9232, 1721, 12308, 12312, 11125, 9455; Payload ID: 5412 relates to Category No.: 13594, 15499, 12137, 11506, 3398, 5127, 2410, 10117, 8119, 7280; Payload ID: 5413 relates to Category No.: 15490, 3398, 674, 5202, 11512, 5073; Payload ID: 5414 relates to Category No.: 5202, 13589, 3398, 15490, 3398, 10702, 8739, 8731, 3398, 8582, 2410, 4439, 10954, 11291, 12891, 3783, 8004, 3783, 12717, 10578, 14123, 5150, 13594, 12646, 12891, 3337, 13225, 8611, 7997, 13371, 2001, 5203, 2214, 8664, 12009, 12902, 14632, 8736, 7932, 4333, 13835, 5073, 8004, 10493; Payload ID: 5417 relates to Category No.: 15490, 3398, 14038, 1512, 8739, 8731, 3398, 4706, 4521, 14663, 7735, 4538, 1482; Payload ID: 5418 relates to Category No.: 4706, 1512, 4521, 14663, 4538, 1482; Payload ID: 5419 relates to Category No.: 4706, 15042, 1512, 4521, 14663, 4538, 1482, 496, 13827, 14638; Payload ID: 5420 relates to Category No.:

4706, 1204; Payload ID: 5421 relates to Category No.: 1829, 1837, 6814; Payload ID: 5422 relates to Category No.: 6814, 3100, 10129, 6285, 14663, 1878, 15089; Payload ID: 5423 relates to Category No.: 6814, 4100; Payload ID: 5424 relates to Category No.: 6814, 4110; Payload ID: 5425 relates to Category No.: 6814; Payload ID: 5426 relates to Category No.: 6814, 4100, 1867, 14663; Payload ID: 5427 relates to Category No.: 6814, 4100, 1867, 14663; Payload ID: 5428 relates to Category No.: 6814, 4105, 4100; Payload ID: 5429 relates to Category No.: 6814; Payload ID: 5430 relates to Category No.: 6814, 9500, 4110, 4100, 5741; Payload ID: 5433 relates to Category No.: 3781, 5939, 9632, 5936; Payload ID: 5434 relates to Category No.: 3781; Payload ID: 5435 relates to Category No.: 13589, 3398, 15490, 3398, 11512, 1295, 8739, 403, 11506, 3398, 6796, 3642, 1687, 576, 1733, 6804, 15736, 13594, 14949, 1730, 12891, 13225, 14620, 13229, 1227, 2251, 3646, 9333, 10358, 1587, 5606, 2248; Payload ID: 5436 relates to Category No.: 9500, 13975, 5300, 8138, 10845, 8156, 3017, 3761; Payload ID: 5437 relates to Category No.: 15490, 3398, 1721, 1730, 8739, 8731, 3398, 12968; Payload ID: 5438 relates to Category No.: 15490, 3398, 1730, 8731, 3398, 7345, 8756, 12646, 13616, 14654, 15568; Payload ID: 5439 relates to Category No.: 13589, 3398, 15490, 3398, 1730, 7345; Payload ID: 5440 relates to Category No.: 13589, 3398, 15490, 3398, 3354, 3353, 1893, 12120, 11660; Payload ID: 5442 relates to Category No.: 1820; Payload ID: 5443 relates to Category No.: 12091, 690, 1026, 9720, 3766, 15043, 15614, 10372, 337, 1795, 7737, 12942, 10366, 11858, 8522, 10382, 11418, 14782, 10226; Payload ID: 5444 relates to Category No.: 12091, 1026, 9720, 3766, 15614, 1204; Payload ID: 5445 relates to Category No.: 12091, 690, 1026, 1713, 9720, 5808, 3766, 1703, 5939, 15614, 1752, 13059, 7306, 337, 16197, 1276, 12488, 8524, 12832, 12615, 9459, 10588, 9455, 13865, 11980, 12545, 6562, 1313, 6115, 16096, 8929, 1240, 14640, 11628, 8888, 9131, 9130, 1010, 9128; Payload ID: 5446 relates to Category No.: 12091, 1026, 9720, 3766, 1703, 15614, 1752, 12459, 12942, 12827, 2110, 12882, 11094, 13143, 4091, 4090; Payload ID: 5447 relates to Category No.: 12091, 9720, 3766, 15614, 1026, 1703, 12760, 12526, 12942, 11858, 7639, 7251, 4091, 4090, 2721, 12506, 11338, 484, 8846, 10879, 4478, 10495; Payload ID: 5448 relates to Category No.: 12091, 1026, 9720, 3766, 15614, 12459, 8928, 12942, 1477, 13005, 10459, 5073; Payload ID: 5449 relates to Category No.: 12091, 3766, 15614, 9720, 1026, 1204; Payload ID: 5450 relates to Category No.: 12091, 1026, 9982, 9720, 11089, 1295, 3766, 15614, 12650, 12832, 7553, 13293, 12734, 1319, 13340, 14069, 8846, 11285, 7819, 8669, 10238; Payload ID: 5451 relates to Category No.: 12091, 1026, 9720, 3766, 1703, 15614, 12614, 8936, 11858, 10955, 11186, 12615, 8944, 15045; Payload ID: 5452 relates to Category No.: 3766, 12091, 15614, 690, 1026, 8906, 1713, 9720, 11431, 3871, 13049, 11858, 12832, 14069, 1823, 3056, 3060, 13228, 2178, 3161, 8885, 5393; Payload ID: 5453 relates to Category No.: 12091, 8862, 690, 1026, 9982, 9720, 3766, 15614, 11431, 1035, 9540, 2599, 5459, 3056, 3060, 16023, 2708, 12552; Payload ID: 5454 relates to Category No.: 12091, 690, 1026, 9720, 3766, 15043, 15614, 1752, 12526, 12942, 11431, 11858, 1035, 9540, 12650, 15400, 3056, 3060, 3247, 16023, 2708, 14069, 2178; Payload ID: 5455 relates to Category No.: 12091, 9720, 3766, 15614, 690, 1026, 1703, 11858, 1762, 4953, 11450; Payload ID: 5456 relates to Category No.: 12091, 3766, 15614; Payload ID: 5457 relates to Category No.: 690, 1026, 3766, 15043, 8739, 1752, 1816, 11178, 12615, 7942, 13293, 761, 7178, 3624, 7872, 345, 8929, 12526, 12488, 9130, 12545; Payload ID: 5458 relates to Category No.: 1026, 3766, 1816, 1276, 9459, 9333; Payload ID: 5459 relates to Category No.: 1026, 3766, 1816; Payload ID: 5460 relates to Category No.: 1026, 3766, 1816, 1276, 9459; Payload ID: 5461 relates to Category No.: 8862, 1026, 3766, 12459, 12942, 11285, 13005, 12650, 11178, 12882, 364, 13143, 14069, 11431, 2593, 7553, 10448; Payload ID: 5462 relates to Category No.: 1026, 3766, 1703, 1816, 3604, 11460, 8869, 15192, 8862; Payload ID: 5463 relates to Category No.: 1026, 3766, 1703, 1816, 674, 10320, 16189, 1762, 1249, 12692, 8196, 9410, 8846, 15192, 6404; Payload ID: 5464 relates to Category No.: 8862, 1026, 3766, 1816, 16189, 484, 15192, 1019; Payload ID: 5465 relates to Category No.: 690, 1026, 14661, 14565, 10074, 5446, 10372, 6606, 348, 3356, 11506, 3398, 4186, 9891, 12391, 4127, 3775, 5541, 16085, 8988, 1238, 10954, 10080, 3846, 11201, 13364, 10568, 11033, 7933, 11176, 10513, 14941, 10333, 10766, 364, 8605, 12570, 11178, 9720, 1320, 13293, 6553, 10405, 11299, 7793; Payload ID: 5466 relates to Category No.: 12091, 9720, 12427, 15614, 1026, 13248, 14661, 11512, 14565, 7613, 5446, 10372, 6606, 348, 4186, 14589, 1795, 9891, 12391, 1780, 10366, 4127, 3775, 11285, 14015, 5541, 16085, 8988, 11954, 11858, 10954, 9451, 10521, 11266, 10583, 11201, 10522, 7933, 8508, 10467, 10574, 1960, 355, 11111, 6103, 1964, 10333, 354, 13293, 14035, 4937, 12646, 10626, 1906, 2242, 1764, 3781, 14360, 3605, 3247, 7240; Payload ID: 5467 relates to Category No.: 3635, 12137, 16165, 2493, 1780, 3775, 4770, 16189, 7933, 12429; Payload ID: 5468 relates to Category No.: 3639, 3775, 7933; Payload ID: 5469 relates to Category No.: 1078, 280, 11371, 14565, 12648, 1780, 3775, 272, 3975, 12365, 12464, 298, 3050, 483, 275, 1115; Payload ID: 5470 relates to Category No.: 7912, 8441, 3013, 12066, 7675, 8648; Payload ID: 5471 relates to Category No.: 14821; Payload ID: 5473 relates to Category No.: 14586; Payload ID: 5474 relates to Category No.: 11910, 5500, 9718, 1002, 1512, 3100, 14663, 4690, 4538, 4685, 8862, 4932; Payload ID: 5475 relates to Category No.: 4145; Payload ID: 5477 relates to Category No.: 690, 1026, 14661, 2885, 5939, 5446, 10372, 8731, 3398, 1816, 6606, 348, 674, 345, 7743, 4186, 9891, 12391, 4127, 3775, 5541, 16085, 8988, 10850, 6394, 16294, 9483, 11201, 11265, 9410, 10794, 9378, 10475, 4144, 7293, 9489, 10474, 5941, 10522, 10568, 11033, 10626, 11729, 11391, 7939, 8634, 13981; Payload ID: 5478 relates to Category No.: 11512, 10372, 14944, 14577, 7752, 11414, 16005, 7613, 10370, 1804; Payload ID: 5479 relates to Category No.: 11940, 14661, 12137, 11091, 5785, 10702, 13435, 10238, 803, 13485, 337, 10775, 2886, 360, 10481, 13360, 1183, 8988, 2022, 11259, 1922, 2001, 12515, 1764; Payload ID: 5480 relates to Category No.: 10702, 13435; Payload ID: 5481 relates to Category No.: 1746, 7306, 3781, 1727, 1780, 1232; Payload ID: 5482 relates to Category No.: 1703, 1752, 10372, 1820, 1727, 286, 360, 3566, 12041, 3525, 12488, 10382, 12007, 6744, 10806, 15200, 1244, 1232, 12903, 12810, 13057, 323, 13658, 12652; Payload ID: 5483 relates to Category No.: 1746, 7743, 1727, 1232; Payload ID: 5484 relates to Category No.: 690, 10372, 345, 3775, 10954, 10568, 11033, 10574, 6606; Payload ID: 5485 relates to Category No.: 7288, 14271, 13445; Payload ID: 5486 relates to Category No.: 7288, 14271, 13445; Payload ID: 5488 relates to Category No.: 13888, 10680, 10679; Payload ID: 5489 relates to Category No.: 16308, 14663, 14025, 846, 13969, 1832; Payload ID: 5490 relates to Category No.: 6814, 16308, 3822, 5428, 3100, 1836, 12544, 9942, 11602, 10648, 14663, 3474, 815, 2353, 14025, 12397, 12699, 14991; Payload ID: 5491 relates to Category No.: 1204, 1867;

Payload ID: 5492 relates to Category No.: 1867; Payload ID: 5493 relates to Category No.: 7912, 8441, 3013, 12066, 7675, 8648; Payload ID: 5494 relates to Category No.: 10702, 13435, 14108, 11348, 9982; Payload ID: 5495 relates to Category No.: 10702, 13435, 14108, 11348; Payload ID: 5497 relates to Category No.: 3775, 7933, 5406, 9125, 3602, 4145; Payload ID: 5498 relates to Category No.: 3639, 5406, 9125, 3602, 12798; Payload ID: 5500 relates to Category No.: 2885, 5285, 15329, 10813, 10219, 15203; Payload ID: 5501 relates to Category No.: 3639, 4328, 263; Payload ID: 5502 relates to Category No.: 6814, 11926, 3684, 3837, 9020, 12063, 1893, 11660, 5855, 11337, 3829, 4714, 6588, 15673; Payload ID: 5503 relates to Category No.: 11926, 3684, 3837, 9020, 12063, 1893, 11660, 11337, 3829, 4714, 6588, 15672; Payload ID: 5504 relates to Category No.: 11926, 3684, 3837, 9020, 12063, 1893, 11660, 4714, 6588, 11843, 4712, 6814; Payload ID: 5505 relates to Category No.: 3837, 2355, 14932, 7792, 7974; Payload ID: 5506 relates to Category No.: 3837, 2355, 14932, 7792, 7974; Payload ID: 5507 relates to Category No.: 11927; Payload ID: 5510 relates to Category No.: 1204, 11927; Payload ID: 5511 relates to Category No.: 795; Payload ID: 5512 relates to Category No.: 998, 11927; Payload ID: 5513 relates to Category No.: 1204; Payload ID: 5516 relates to Category No.: 7306; Payload ID: 5517 relates to Category No.: 14169; Payload ID: 5518 relates to Category No.: 10702, 14015, 14645, 6377, 6371, 6389, 13052, 7934, 8506, 7933, 2094, 1857, 7816, 2009, 1951, 8133, 1960, 7946, 8781, 13638, 7704; Payload ID: 5519 relates to Category No.: 14565, 1721, 1703, 1746, 5592, 3926, 3775, 10648, 13925, 8390, 2136, 5731, 13952, 1086, 8411, 12122, 8324; Payload ID: 5520 relates to Category No.: 12091, 1026, 15490, 3398, 14661, 14565, 10702, 9720, 15614, 5446, 9854, 6606, 348, 4186, 1795, 9891, 12391, 1780, 4127, 3775, 11285, 5541, 16085, 8988, 11293, 11858, 12488, 10954, 11511, 16294, 10362, 10343, 11546, 12832, 10574, 1993, 13149, 3754, 11530, 14569, 4949, 8918, 7369, 8862, 7251, 8105, 9350, 9738; Payload ID: 5521 relates to Category No.: 12091, 1026, 14661, 14565, 15614, 5446, 9854, 6606, 348, 4949, 4186, 4040, 11296, 9891, 12646, 12391, 8373, 4127, 3775, 5541, 16085, 8988, 8617, 16294, 11187, 7719, 9738, 8923, 8605, 14386, 2753, 3620, 10296, 9720; Payload ID: 5522 relates to Category No.: 12091, 8862, 1026, 15490, 3398, 14661, 14565, 9720, 12638, 7613, 15614, 1752, 5446, 10372, 6606, 348, 4949, 7743, 11506, 3398, 4186, 9891, 12391, 1780, 4127, 3775, 11285, 5541, 16085, 8988, 11858, 8869, 3604, 10583, 7044, 11186, 6561, 11584, 10321, 5998, 2171, 11411, 6553, 9335, 1571, 8377, 1741, 11187, 11273, 14569; Payload ID: 5525 relates to Category No.: 16172; Payload ID: 5526 relates to Category No.: 16172; Payload ID: 5527 relates to Category No.: 3997, 151, 6360, 3305, 3994; Payload ID: 5528 relates to Category No.: 3997, 151, 6360, 3305, 3994; Payload ID: 5529 relates to Category No.: 12648, 286, 12645, 7238; Payload ID: 5531 relates to Category No.: 2711, 274, 11242, 1237; Payload ID: 5532 relates to Category No.: 1204; Payload ID: 5533 relates to Category No.: 378, 10648, 16294, 10343, 10882; Payload ID: 5534 relates to Category No.: 5406, 274, 14791, 11658, 10573, 1765, 14793, 3812, 8883, 10382, 3799, 773, 15045, 1710, 3532, 3641, 6795, 6797, 15974, 10578, 7750, 378, 8507, 11242, 1009, 1011, 9584, 3583, 10629, 12839, 6107, 2131; Payload ID: 5535 relates to Category No.: 15149, 2711, 12633, 2933; Payload ID: 5536 relates to Category No.: 2711; Payload ID: 5537 relates to Category No.: 795, 12648, 12633, 2711, 2933, 2713, 8940, 1204, 12041, 12022, 9575, 7365, 12038; Payload ID: 5538 relates to Category No.: 12648, 9632, 3856, 5866, 14910, 1764, 4996, 5845;

Payload ID: 5539 relates to Category No.: 13589, 3398, 15490, 3398; Payload ID: 5540 relates to Category No.: 14565, 8739, 10372, 3854, 11506, 3398, 2006, 13597, 10522, 11305, 11584, 3856, 1237, 7680, 1857, 8180, 7949, 7713, 13594, 9713, 360, 7613, 795, 13882, 3566, 11265, 8348, 4994, 13925, 496, 14040, 13836, 13966, 11094, 11091, 13893, 381, 10583, 13829, 8374, 13881, 14022, 13787, 14003, 10197; Payload ID: 5541 relates to Category No.: 14565, 3860, 4949, 3010, 1295, 10372, 8373, 10486, 11094, 10583, 8095; Payload ID: 5542 relates to Category No.: 14661, 12137, 14565; Payload ID: 5543 relates to Category No.: 13589, 3398, 15490, 3398; Payload ID: 5544 relates to Category No.: 14456, 280, 6296, 10628, 9571, 7854; Payload ID: 5546 relates to Category No.: 9228, 3452, 3354, 3448, 5750, 13903; Payload ID: 5547 relates to Category No.: 9228, 3354, 3353; Payload ID: 5548 relates to Category No.: 12775, 14612, 11659, 7132; Payload ID: 5549 relates to Category No.: 12775, 11659, 7132, 3448, 2429, 4969, 12009; Payload ID: 5550 relates to Category No.: 16308, 1204, 14663, 4266, 4612; Payload ID: 5551 relates to Category No.: 13589, 3398, 14967, 15490, 3398, 11512, 14565, 2411, 15517, 11506, 3398, 15521, 4439, 9932, 11363, 10486, 5773, 8004, 8611, 5786, 13835, 13836, 11113, 8103, 11111, 1964, 11191, 3803, 10626, 6530, 3790, 12498, 6553, 5783, 16069, 1965, 12559, 6554, 16041, 684, 11820, 11819, 755, 10583, 8374, 10574, 9454, 13227, 10567, 8023, 3010, 8636, 14520, 14523, 8777, 1076; Payload ID: 5552 relates to Category No.: 13589, 3398, 15490, 3398, 14967, 5773, 14565, 8739, 1816, 11506, 3398, 15521, 7735, 4439, 11363, 4027, 6530, 13835, 13876, 11512, 7728, 13967, 2079, 13969, 13874, 13827, 13836, 13837, 13767, 10238, 1957, 14002, 13887, 10583, 1964, 11821, 8374, 2235, 5334, 3940, 13857, 13823, 6103, 14022, 14048, 11602, 7977, 9485, 5786, 13227, 10567, 8636, 14520, 14523, 4138, 7939, 8554, 1112, 2049, 659, 7647, 13792; Payload ID: 5553 relates to Category No.: 795, 12633; Payload ID: 5554 relates to Category No.: 13589, 3398, 11512, 14967, 5783, 15521, 9420, 4439, 7122, 15490, 3398, 8739, 15517, 13835, 11506, 3398, 12646, 13280, 1622, 13276, 13277, 10398; Payload ID: 5555 relates to Category No.: 13589, 3398, 15490, 3398, 14967, 11512, 5783, 15521, 4439, 14949, 5406, 3605, 15737, 15738; Payload ID: 5556 relates to Category No.: 13589, 3398, 14967, 11506, 3398, 15521, 4439, 14083, 15517, 11512, 15490, 3398; Payload ID: 5557 relates to Category No.: 13589, 3398, 15490, 3398, 12619, 8739, 8731, 3398, 13594, 1240, 5987, 5985; Payload ID: 5558 relates to Category No.: 9982, 9945, 14663, 4653, 9835; Payload ID: 5559 relates to Category No.: 9982, 9945, 1204, 14663, 4653, 9835, 5406, 7303, 11634, 10036; Payload ID: 5560 relates to Category No.: 9945, 14663, 4653, 9835, 6814; Payload ID: 5561 relates to Category No.: 9940, 9945, 14663, 4653, 11294, 9835; Payload ID: 5562 relates to Category No.: 4615, 14663, 1878, 15089, 15088, 15079, 16037, 5303; Payload ID: 5563 relates to Category No.: 6814; Payload ID: 5564 relates to Category No.: 1002, 795, 7735; Payload ID: 5565 relates to Category No.: 13589, 3398, 11512, 15517, 7306, 11506, 3398, 1780, 3791; Payload ID: 5566 relates to Category No.: 13589, 3398, 11512, 1730, 15517, 9742, 1026, 11506, 3398, 7345, 6651; Payload ID: 5567 relates to Category No.: 13594, 13589, 3398, 1730, 15517, 11512, 5406, 1249, 10648, 16286, 1227, 4998, 3854, 9125, 6796, 10036, 10556, 1260, 10988; Payload ID: 5568 relates to Category No.: 13594, 13589, 3398, 15490, 3398, 1730, 1204, 8739, 7743, 1991; Payload ID: 5569 relates to Category No.: 13594, 13589, 3398, 15490, 3398, 1730; Payload ID: 5570 relates to Category No.: 13589, 3398, 11512, 1730, 15517, 11506, 3398, 10648, 14944, 7251, 8254, 1313, 12558, 13594; Payload ID: 5571 relates to Category No.: 13589, 3398, 11512, 1730, 15517, 2083, 11506, 3398, 8922, 6296, 13525, 12558, 14617, 11091, 6528, 10652; Payload ID: 5572 relates to Category No.: 13589, 3398, 1730, 8739, 4974, 15517, 11512, 13594; Payload ID: 5573 relates to Category No.: 13589, 3398, 1730, 8739, 15517, 9410; Payload ID: 5574 relates to Category No.: 13589, 3398, 15490, 3398, 1721, 1730, 8739, 13594; Payload ID: 5575 relates to Category No.: 8731, 3398, 2409, 5202, 3337, 2410, 3564, 5203, 9694, 9688, 8739, 5166, 5150, 13853; Payload ID: 5576 relates to Category No.: 5202, 8739, 3337, 2410, 12775, 5203, 5150, 9688, 5166; Payload ID: 5577 relates to Category No.: 12091, 15601, 5541, 11858, 13340, 13909, 7613, 10543, 2009, 1919, 1925, 11431, 10503, 1922, 13990, 1909; Payload ID: 5578 relates to Category No.: 9697; Payload ID: 5579 relates to Category No.: 14423, 6814; Payload ID: 5580 relates to Category No.: 15588, 15601, 13589, 3398, 15490, 3398, 1893, 4439, 1960, 6814; Payload ID: 5581 relates to Category No.: 15601, 10912, 10238, 13886, 13829; Payload ID: 5582 relates to Category No.: 15588, 15601, 1893, 4439; Payload ID: 5583 relates to Category No.: 15588, 15601, 13589, 3398, 15490, 3398, 14565, 12626, 10775, 1893, 4439, 2022, 7293; Payload ID: 5584 relates to Category No.: 15601, 10238, 4615, 7743, 4439, 15698, 10516, 14566; Payload ID: 5585 relates to Category No.: 15588, 15601, 14038, 4615, 1893, 4439; Payload ID: 5586 relates to Category No.: 15588, 15601, 9673, 1893, 4439, 11660, 11546, 4969, 13835, 14622, 13909, 496, 13837, 13831, 13877, 1919, 13848, 13849, 14620, 4480, 10484; Payload ID: 5587 relates to Category No.: 15603, 13622, 14015, 3447; Payload ID: 5588 relates to Category No.: 15603; Payload ID: 5589 relates to Category No.: 15588, 15603, 1893, 4439; Payload ID: 5590 relates to Category No.: 15603; Payload ID: 5591 relates to Category No.: 13622, 15603; Payload ID: 5592 relates to Category No.: 12091, 13622, 1905, 8375, 13624, 8937, 2036, 3684, 2116, 8760, 13625; Payload ID: 5593 relates to Category No.: 15588, 15618, 3684, 15603, 1893, 4439, 7131, 10491, 9746, 11858, 13625, 496, 1995, 11570, 13935; Payload ID: 5594 relates to Category No.: 15588, 15618, 15603, 1893, 4439, 5406, 6530, 6526; Payload ID: 5595 relates to Category No.: 15588, 15618, 4279, 15603, 1893, 4439, 6814; Payload ID: 5596 relates to Category No.: 15603, 13618, 14175, 12091, 15588, 14932, 11371; Payload ID: 5597 relates to Category No.: 12091, 14015, 11858, 13841, 13624, 8766, 8063, 7743, 9777, 5866, 379, 6468, 13618, 12792, 12210, 12960; Payload ID: 5598 relates to Category No.: 12091, 15490, 3398, 14038, 9720, 5446, 348, 11109, 3021, 8760, 7743, 13370, 16193, 8818, 7187, 7188, 11858, 10415, 11419, 10475, 8422, 11110, 12959, 13890, 13624, 3966, 13251, 12957, 12958, 15588, 7613, 3684, 14046, 13925, 13936, 14025, 10238, 13970, 13840; Payload ID: 5599 relates to Category No.: 12091, 690, 334, 11940, 3684, 9713, 8760, 1983, 3676, 14640, 1451, 10648, 1893, 1272, 13831, 5544, 11858, 9451, 3632, 11511, 2374, 8347, 3827, 11275, 11595, 9746, 5552, 13624, 8767, 3546, 12803, 15588, 7613, 8004, 11242, 10548, 14932, 11371, 12864, 5998, 4094, 9554, 5810, 13935, 8762; Payload ID: 5600 relates to Category No.: 15588, 10702, 13622, 15603, 1874, 1893, 4439, 13867, 13860, 13981, 9349, 2120; Payload ID: 5601 relates to Category No.: 15588, 10702, 13622, 15603, 2169, 7369, 1874, 1893, 4439, 13867, 9485, 13860, 13981, 9349, 2120; Payload ID: 5602 relates to Category No.: 15588, 1207, 10702, 15603, 1893, 4439, 13867, 13860, 13981, 9349, 2120, 8767, 13618; Payload ID: 5603 relates to Category No.: 15588, 10702, 8765, 15603, 7369, 1874, 1893, 4439, 13618, 13867, 9485, 13860, 13981, 9349, 2120, 8767; Payload ID: 5604 relates to Category No.: 15588, 10702, 15603, 7369, 1893, 4439, 13831, 11550, 13867, 1957, 907, 9485, 13860, 13981, 908, 9349, 8767, 13618, 496; Payload ID: 5605 relates to Category No.: 5782, 4279, 15603, 5858, 14178; Payload ID: 5607 relates to Category No.: 15588, 4279, 13622, 15603, 1893, 4439, 4276; Payload ID: 5608 relates to Category No.: 15603, 15588, 4279, 13622, 1893, 4439; Payload ID: 5609 relates to Category No.: 15588, 4279, 13622, 15603, 1893, 4439; Payload ID: 5610 relates to Category No.: 4279, 13622, 15603; Payload ID: 5611 relates to Category No.: 15588, 4279, 13622, 15603, 1893, 4439, 4276; Payload ID: 5612 relates to Category No.: 15603, 15588, 8765, 4279, 13622, 1893, 4439, 9223, 9103; Payload ID: 5613 relates to Category No.: 15588, 11915, 4279, 13622, 15603, 1893, 4439; Payload ID: 5614 relates to Category No.: 15588, 4279, 13622, 15603, 1893, 4439; Payload ID: 5615 relates to Category No.: 15588, 4279, 13622, 15603, 1893, 4439; Payload ID: 5616 relates to Category No.: 15588, 4279, 13622, 15603, 1893, 4439; Payload ID: 5617 relates to Category No.: 15588, 4279, 13622, 15603, 2921, 1893, 4439; Payload ID: 5618 relates to Category No.: 13622, 15603, 15588, 4279, 1893, 4439; Payload ID: 5619 relates to Category No.: 4279, 13622, 15603; Payload ID: 5620 relates to Category No.: 2922, 4279, 13622, 15603, 15588; Payload ID: 5621 relates to Category No.: 15588, 2885, 13186, 13622, 15603, 9224, 1893, 4439, 16197, 5541, 9223, 3001, 9223, 9103, 11091, 1112; Payload ID: 5622 relates to Category No.: 15603, 1722, 2885, 13622, 1727; Payload ID: 5623 relates to Category No.: 2885, 13622, 15603, 16197; Payload ID: 5624 relates to Category No.: 14270, 15603, 12891, 13622, 15588, 2885, 9224, 1893, 4439, 16197, 9223, 3001, 9411; Payload ID: 5625 relates to Category No.: 13622, 14270, 15603, 15588, 2885, 9224, 1893, 4439, 16197, 9223, 3001, 8595; Payload ID: 5626 relates to Category No.: 14318, 2885, 14270, 8760, 3575, 7291, 16182, 14271, 9224, 4439, 9223, 3001, 7295, 9223, 9103, 11546, 13969, 8004, 1919, 4004, 7957, 901, 14426, 2112, 13182, 8608, 8609; Payload ID: 5627 relates to Category No.: 15588, 13622, 15603, 9224, 1893, 4439, 5541, 9223, 3001; Payload ID: 5628 relates to Category No.: 15588, 2885, 15603, 9224, 1893, 4439, 16197, 5541, 9223, 3001, 13618, 7280, 4332, 11027, 14949, 8375, 1112, 8760, 6375; Payload ID: 5629 relates to Category No.: 15588, 8765, 15603, 1893, 4439, 5541, 4332, 15464, 11027, 5858, 13909, 2006, 13837, 6375, 8509; Payload ID: 5630 relates to Category No.: 15588, 8765, 7191, 14729, 15464, 13530, 6758, 5541, 1477; Payload ID: 5631 relates to Category No.: 8765; Payload ID: 5632 relates to Category No.: 15603, 13618; Payload ID: 5633 relates to Category No.: 2885, 15603, 8760, 5406; Payload ID: 5634 relates to Category No.: 2885, 15603, 13618; Payload ID: 5635 relates to Category No.: 12137, 14949, 8375, 8760; Payload ID: 5636 relates to Category No.: 15588, 13622, 15603, 1893, 4439, 16197, 14534, 3194; Payload ID: 5637 relates to Category No.: 15588, 13622, 15603, 1893, 4439; Payload ID: 5638 relates to Category No.: 795, 10372, 9693, 9238, 1893, 7280, 15602, 11548, 11554, 11660, 11922; Payload ID: 5639 relates to Category No.: 12137, 10372, 9693, 14838, 1893, 7295, 15602, 11548, 11554, 11660, 10128; Payload ID: 5640 relates to Category No.: 12137, 7295, 15602, 11548, 11554; Payload ID: 5641 relates to Category No.: 15588, 13622, 15603, 1893, 4439, 6814; Payload ID: 5642 relates to Category No.: 6643, 14164, 15603, 14173; Payload ID: 5643 relates to Category No.: 15588, 15604, 12053, 1893, 4439, 9223, 9103, 13626; Payload ID: 5644 relates to Category No.: 1002, 795;

Payload ID: 5645 relates to Category No.: 7131; Payload ID: 5647 relates to Category No.: 13589, 3398, 11512, 3565, 13608; Payload ID: 5648 relates to Category No.: 13589, 3398, 1204, 6194; Payload ID: 5650 relates to Category No.: 13589, 3398, 15490, 3398; Payload ID: 5651 relates to Category No.: 13975, 3452, 9296, 3354, 3353, 3448, 5750, 15533, 7157, 9296, 3327, 9296, 3327, 133, 9296, 3327, 169, 8693, 4485, 15240, 11464, 9228, 7303, 1955, 6530, 14838, 9379, 1780, 1729, 2424, 4458, 16049, 5901, 7305, 13733, 14052, 11638, 12301, 15178, 13966, 14016, 3602; Payload ID: 5652 relates to Category No.: 12091, 15499, 11512, 9232, 13975, 795, 15516, 9296, 15517, 3354, 3320, 11506, 3398, 15521, 14663, 4439, 16197, 2429, 182, 12891, 3783, 15533, 11611, 8004, 3783, 15520, 15498, 15290, 9296, 3327, 4933, 16049, 4485, 13167, 14643, 5406, 7303, 11634, 4021, 1272, 1780, 10513, 496, 14034, 4970, 3856, 14883, 4935, 3574, 2172, 4938, 13882, 6814; Payload ID: 5653 relates to Category No.: 15499, 11512, 13975, 795, 15516, 9296, 10238, 15517, 3354, 14034, 15521, 4439, 16197, 3377, 11997, 182, 12891, 3783, 15533, 11611, 8004, 3783, 15520, 15498, 15290, 9296, 3327, 4933, 4485, 13167, 9296, 3320, 16049, 12091, 13882, 3602; Payload ID: 5654 relates to Category No.: 2139, 3452, 9296, 3354, 14034, 3448, 15257, 13743, 5750, 9300, 15533, 9296, 3327, 9296, 3327, 133, 9296, 3327, 169, 8693, 4485, 16049; Payload ID: 5655 relates to Category No.: 7613, 9296, 3354, 14034, 15533, 9296, 3327, 16049, 9296, 3327, 133, 4485, 14037, 9228; Payload ID: 5656 relates to Category No.: 13975, 9296, 15517, 3354, 14034, 11296, 12777, 3559, 1089, 10527, 3559, 15533, 7303, 1955, 14025, 9994, 5808, 344, 13856, 343, 14052, 12300, 15498, 14018, 14036; Payload ID: 5657 relates to Category No.: 1737, 6814, 14661, 7154, 7132; Payload ID: 5658 relates to Category No.: 3354; Payload ID: 5659 relates to Category No.: 11843, 13975, 9296, 1955, 3354, 14034, 12096, 11860, 10521, 15533, 14052; Payload ID: 5660 relates to Category No.: 12137, 3986, 9891, 9420, 1893, 6738, 3984, 4775, 11290; Payload ID: 5661 relates to Category No.: 12137, 9420, 1893, 6738, 4775, 12815, 3983; Payload ID: 5662 relates to Category No.: 12137, 3986, 9420, 1893, 6738, 3984; Payload ID: 5663 relates to Category No.: 3986, 3984, 9639; Payload ID: 5664 relates to Category No.: 3986, 1204, 3984; Payload ID: 5665 relates to Category No.: 3986, 3984; Payload ID: 5666 relates to Category No.: 12137, 16159, 9420, 1893, 6738, 9585; Payload ID: 5667 relates to Category No.: 12137, 3986, 16158, 9420, 1893, 6738, 11646; Payload ID: 5668 relates to Category No.: 16159, 12137, 9420, 1893, 6738, 3854; Payload ID: 5669 relates to Category No.: 12137, 16159; Payload ID: 5670 relates to Category No.: 12137, 3986, 9420, 1893, 6738, 12815; Payload ID: 5671 relates to Category No.: 12137, 9420, 1893, 4020, 6738, 3697, 3984, 3983, 1892; Payload ID: 5672 relates to Category No.: 14216, 3656, 7018, 9228, 3452, 3354, 3353, 3448, 6670, 3455, 5286, 14776, 5901; Payload ID: 5673 relates to Category No.: 9232, 9228; Payload ID: 5674 relates to Category No.: 9232, 9228; Payload ID: 5675 relates to Category No.: 9228, 9232; Payload ID: 5676 relates to Category No.: 9228, 5750, 3336; Payload ID: 5677 relates to Category No.: 5782, 10593, 7326, 11290, 5938; Payload ID: 5678 relates to Category No.: 3997, 151, 6360, 3305, 3994, 14307, 4442; Payload ID: 5679 relates to Category No.: 14318, 13186, 4439, 3996, 9223, 3001; Payload ID: 5680 relates to Category No.: 9232, 14267, 1874, 9223, 2799, 9197, 14216, 3994, 9223, 9103, 9189, 9211, 5219, 6631, 3447; Payload ID: 5681 relates to Category No.: 14318, 13186, 4439, 3997, 151, 6360, 9223, 3995, 15860, 3996, 2799, 9197, 9198, 9210, 10123, 9223, 3001, 10362;

Payload ID: 5682 relates to Category No.: 14318, 13186, 5901, 4439, 3997, 151, 6360, 9223, 3995, 15860, 3996, 2799, 9197, 9198, 9210, 10123, 9223, 3001, 3315, 10873; Payload ID: 5683 relates to Category No.: 14318, 13186, 3021, 9223, 4439, 9223, 3995, 15860, 3996, 10123, 9223, 3001, 14216, 3994, 14310, 14307, 10362, 9189, 5219, 6631, 3315; Payload ID: 5684 relates to Category No.: 14318, 13186, 3021, 4439, 9223, 3995, 15860, 3996, 10123, 9223, 3001, 14216, 3994, 14310, 14307, 9189, 3315; Payload ID: 5685 relates to Category No.: 13186, 5901, 4439, 9223, 3995, 15860, 3996, 10123, 9223, 3001, 14310, 14307, 9189, 3315; Payload ID: 5686 relates to Category No.: 14318, 13186, 4439, 3997, 151, 6360, 9223, 3995, 15860, 3996, 9197, 9198, 9223, 3001, 14199, 9189, 15843, 15868, 9196; Payload ID: 5687 relates to Category No.: 13186, 1204, 4439, 3997, 151, 6360, 9223, 3995, 15860, 3996, 9197, 9198, 9223, 3001, 9189, 15843, 15868, 9196; Payload ID: 5688 relates to Category No.: 5367, 14318, 13186, 9223, 4439, 3997, 151, 6360, 9223, 3995, 15860, 3996, 9197, 9198, 9223, 3001, 10362, 9189, 15843, 15868, 9196; Payload ID: 5689 relates to Category No.: 14565, 1512, 11930, 14640, 4721, 14663, 5004, 9451, 4723, 5004, 10157, 1883, 1026, 3641, 6795, 1295, 9333, 4418, 3609; Payload ID: 5690 relates to Category No.: 14565, 1512, 11930, 4721, 14663, 5004, 9451, 4723, 5004, 10157, 1883, 1730, 6796; Payload ID: 5691 relates to Category No.: 11930, 14640, 4721, 5004; Payload ID: 5692 relates to Category No.: 4721, 7443, 5004, 15944; Payload ID: 5693 relates to Category No.: 4721, 5004, 3684, 1893, 5855, 10362; Payload ID: 5694 relates to Category No.: 14661, 5782, 13186, 8756, 4439, 16197, 16193, 5790, 7132, 7295, 15570, 14165, 14172, 11922, 12036, 12682, 13343, 13352, 8739, 13827; Payload ID: 5695 relates to Category No.: 11922, 11251; Payload ID: 5696 relates to Category No.: 5782, 4439, 11922, 4442, 11696, 11343; Payload ID: 5697 relates to Category No.: 5782, 11922; Payload ID: 5698 relates to Category No.: 5782, 7295, 11922; Payload ID: 5699 relates to Category No.: 5782, 15715, 15704, 4439, 15717; Payload ID: 5700 relates to Category No.: 6227; Payload ID: 5701 relates to Category No.: 6227, 3639; Payload ID: 5702 relates to Category No.: 6227; Payload ID: 5703 relates to Category No.: 12194, 6675, 11034, 795, 11032, 7159, 2886, 7132, 3888, 8622, 7154, 2429, 5253, 6668, 6695; Payload ID: 5704 relates to Category No.: 15143, 8454; Payload ID: 5705 relates to Category No.: 8454; Payload ID: 5706 relates to Category No.: 690, 14565, 8441, 10775, 1206, 10558, 9451, 10226, 7664, 13594, 5428, 7849, 13636, 13561; Payload ID: 5707 relates to Category No.: 1820, 1048, 4021, 10383; Payload ID: 5708 relates to Category No.: 15490, 3398, 9718, 14456, 674, 3354, 7306, 3448, 12120, 13904, 10521, 5126, 13589, 3398, 3520, 11512, 1892, 16005, 9599, 11506, 3398, 3889, 6878, 1318, 9480, 11910, 9410, 15015, 3923, 757, 5459, 9476, 7001, 1741, 13229, 11125, 8932, 3613, 14439, 672, 10574, 9786, 6376, 9465, 9467, 11358, 2548, 7966, 6802; Payload ID: 5709 relates to Category No.: 13589, 3398, 15490, 3398, 9718, 3354, 7306, 3448, 6802, 5126, 11910, 15015, 4040, 7071; Payload ID: 5710 relates to Category No.: 13589, 3398, 15490, 3398, 9718, 674, 3354, 7306, 16214, 3448, 13904, 10521, 5126, 11910; Payload ID: 5711 relates to Category No.: 13589, 3398, 15490, 3398, 9718, 14456, 674, 3354, 7306, 2409, 16214, 7001, 5458; Payload ID: 5712 relates to Category No.: 3140, 14638; Payload ID: 5713 relates to Category No.: 1026, 12648, 8739, 14880, 275, 2933, 9891, 280, 7946, 1925, 10648, 3876, 11290, 6990, 3910, 1891, 4200, 11976, 8689, 6137, 6753, 8150, 904, 2717, 3873, 12003, 13273, 11274, 10392, 8435, 10536, 3923, 11051, 12409, 10588, 15286, 5753, 13151, 3791; Payload ID: 5714 relates to Category No.: 5428, 10702, 378, 1183, 1814, 4021, 1238, 15570, 12461, 6145, 16189, 8049, 3910, 1749, 5751, 3877, 13125, 1703, 3791, 12737, 13996, 1730, 10282; Payload ID: 5715 relates to Category No.: 7288; Payload ID: 5716 relates to Category No.: 9500, 1204, 7088; Payload ID: 5717 relates to Category No.: 9500, 3837; Payload ID: 5720 relates to Category No.: 14641, 7665, 7798, 281; Payload ID: 5721 relates to Category No.: 274, 3812, 14641, 7665, 7798, 281; Payload ID: 5724 relates to Category No.: 6902, 182, 12438; Payload ID: 5729 relates to Category No.: 12633; Payload ID: 5730 relates to Category No.: 14456; Payload ID: 5731 relates to Category No.: 14097, 3698, 3697, 12414; Payload ID: 5732 relates to Category No.: 14097, 3698, 3697, 12414; Payload ID: 5735 relates to Category No.: 10366, 11266, 12644; Payload ID: 5737 relates to Category No.: 3356, 3021, 16197, 8818; Payload ID: 5740 relates to Category No.: 1204; Payload ID: 5747 relates to Category No.: 13589, 3398, 15490, 3398, 1730; Payload ID: 5754 relates to Category No.: 14565, 1204; Payload ID: 5759 relates to Category No.: 11285, 13831, 8535, 11546; Payload ID: 5760 relates to Category No.: 7613; Payload ID: 5762 relates to Category No.: 14661, 10702, 13485, 14565; Payload ID: 5763 relates to Category No.: 14661, 14565, 10702, 13485, 7131, 10491; Payload ID: 5766 relates to Category No.: 7131, 10491; Payload ID: 5768 relates to Category No.: 12911, 8112, 10800, 10666, 10802, 11266, 12913, 8021; Payload ID: 5769 relates to Category No.: 1862, 12864, 10612; Payload ID: 5773 relates to Category No.: 14454, 8373, 14055; Payload ID: 5774 relates to Category No.: 11094; Payload ID: 5775 relates to Category No.: 1867; Payload ID: 5776 relates to Category No.: 1867; Payload ID: 5782 relates to Category No.: 1204; Payload ID: 5794 relates to Category No.: 12137, 3699, 6445, 3697, 3525; Payload ID: 5797 relates to Category No.: 16214, 2459, 14014, 2464; Payload ID: 5799 relates to Category No.: 334, 10238, 11322, 2006, 15559, 8923; Payload ID: 5811 relates to Category No.: 15517, 11506, 3398; Payload ID: 5821 relates to Category No.: 3452, 3354, 2409, 3448, 3453, 13904, 10521, 4335; Payload ID: 5822 relates to Category No.: 1976; Payload ID: 5834 relates to Category No.: 1204; Payload ID: 5841 relates to Category No.: 795; Payload ID: 5844 relates to Category No.: 1204; Payload ID: 5845 relates to Category No.: 1204; Payload ID: 5849 relates to Category No.: 13126, 13459; Payload ID: 5855 relates to Category No.: 12827; Payload ID: 5861 relates to Category No.: 11285, 1206, 1408, 11291, 3615, 15462; Payload ID: 5862 relates to Category No.: 9982, 11294; Payload ID: 5863 relates to Category No.: 12091, 1206, 14640, 12877, 10287, 11147, 3615, 9319, 9461, 13312, 3072; Payload ID: 5871 relates to Category No.: 13589, 3398, 15490, 3398; Payload ID: 5873 relates to Category No.: 1204; Payload ID: 5875 relates to Category No.: 12137, 14097, 3698; Payload ID: 5876 relates to Category No.: 12137, 14097, 3698, 14097, 3702, 13520, 7646; Payload ID: 5879 relates to Category No.: 8888; Payload ID: 5881 relates to Category No.: 9500, 13280; Payload ID: 5882 relates to Category No.: 9500, 2835, 14663, 815, 11802; Payload ID: 5908 relates to Category No.: 1204; Payload ID: 5915 relates to Category No.: 1649, 5846; Payload ID: 5916 relates to Category No.: 1649, 5846; Payload ID: 5917 relates to Category No.: 1649, 5846; Payload ID: 5918 relates to Category No.: 1204; Payload ID: 5919 relates to Category No.: 795, 5544; Payload ID: 5920 relates to Category No.: 7306, 1204; Payload ID: 5921 relates to Category No.: 8118; Payload ID: 5922 relates to Category No.: 795, 1721, 1204; Payload ID: 5927 relates to Category No.: 12891, 12543; Payload ID: 5937 relates to Category No.: 14838; Payload ID: 5940 relates to Category No.: 1204; Payload ID: 5943 relates to Category No.: 2206, 7971; Payload ID: 5944 relates to Category No.: 11512, 10466, 11202, 13589, 3398, 12732, 360, 10955; Payload ID: 5945 relates to Category No.: 7737; Payload ID: 5946 relates to Category No.: 1204; Payload ID: 5947 relates to Category No.: 1204; Payload ID: 5948 relates to Category No.: 1737, 7154; Payload ID: 5949 relates to Category No.: 1204; Payload ID: 5950 relates to Category No.: 1730, 14456, 7345; Payload ID: 5968 relates to Category No.: 1269; Payload ID: 5969 relates to Category No.: 11907; Payload ID: 5970 relates to Category No.: 11907; Payload ID: 5976 relates to Category No.: 1780, 3775; Payload ID: 5977 relates to Category No.: 1780, 3775; Payload ID: 5979 relates to Category No.: 1737, 1752, 13343, 7154, 1780, 3812, 12832, 13588, 6881, 10352, 12030; Payload ID: 5982 relates to Category No.: 1257; Payload ID: 5983 relates to Category No.: 10366, 1206, 5731, 12014; Payload ID: 5986 relates to Category No.: 6902; Payload ID: 5987 relates to Category No.: 6902; Payload ID: 5988 relates to Category No.: 6902; Payload ID: 5990 relates to Category No.: 8756, 8629; Payload ID: 5991 relates to Category No.: 14834; Payload ID: 5992 relates to Category No.: 14834; Payload ID: 5993 relates to Category No.: 14834; Payload ID: 5999 relates to Category No.: 1204, 5874, 2429; Payload ID: 6000 relates to Category No.: 14663, 5874, 2429; Payload ID: 6002 relates to Category No.: 15715, 4439; Payload ID: 6005 relates to Category No.: 3452, 9296, 3354, 5750, 9296, 3327; Payload ID: 6006 relates to Category No.: 3354, 5750; Payload ID: 6007 relates to Category No.: 1955, 3354, 5750, 15605; Payload ID: 6008 relates to Category No.: 3354, 5750; Payload ID: 6009 relates to Category No.: 3354, 11884, 5750, 12646, 6530, 6532, 4138; Payload ID: 6010 relates to Category No.: 3354, 5750; Payload ID: 6011 relates to Category No.: 3354, 11884, 5750, 7131, 4367, 4458, 13700, 9296, 7373; Payload ID: 6012 relates to Category No.: 3354, 13856, 5750, 4367, 1955, 15144; Payload ID: 6013 relates to Category No.: 3354, 5750; Payload ID: 6014 relates to Category No.: 3354, 1204, 5750, 7131, 12153, 1955, 14838, 9485; Payload ID: 6015 relates to Category No.: 3354, 5750, 7122, 1723, 1955, 13996, 14834, 9485; Payload ID: 6016 relates to Category No.: 3354, 11298, 5750, 7150; Payload ID: 6017 relates to Category No.: 12153, 3354, 1955, 5750, 12058, 10491, 12646, 4367; Payload ID: 6018 relates to Category No.: 9228, 3354, 13743, 13729, 5750, 3336; Payload ID: 6019 relates to Category No.: 10648, 15517, 11512; Payload ID: 6020 relates to Category No.: 15490, 3398, 11512, 15517, 11506, 3398, 10648; Payload ID: 6021 relates to Category No.: 5898, 14663, 16197, 2347, 4454, 4083; Payload ID: 6022 relates to Category No.: 1207, 9500, 5898, 6211, 1867, 14663, 14962, 2347, 4084; Payload ID: 6023 relates to Category No.: 795, 11765, 12097, 11923, 15570, 11928, 1844, 10005, 16211, 14111, 13437, 10489, 11563, 8918, 8976, 13398, 14617; Payload ID: 6024 relates to Category No.: 11923, 10005, 16211, 14111, 13437, 7743, 10626, 16294, 10372, 13969, 13886, 13818, 11114, 10349; Payload ID: 6025 relates to Category No.: 11843, 795, 10238, 13343, 1727, 13360, 11245, 10356, 2909, 10602, 12614; Payload ID: 6026 relates to Category No.: 2459, 9420, 776, 3879; Payload ID: 6027 relates to Category No.: 334, 11512, 14565, 795, 5446, 10238, 12498, 3021, 803, 1795, 10775, 15197, 7840, 11765, 16197, 15782, 15456, 15450, 7363, 15448, 7548, 10814, 10855, 11566, 15653, 2051, 4039, 336, 4041, 13217, 15485, 11766, 12858, 15400, 11300, 11456, 7549, 10600, 14910, 10197, 6403, 3009, 10947, 15195, 10206, 11574, 333, 7574, 10340, 568, 10602, 8362, 4040, 7250, 11934; Payload ID: 6028 relates to Category No.: 795, 7613, 7967; Payload ID: 6029 relates to Category No.: 795, 7613, 13227, 2235, 2228, 2229, 2218, 8373, 7618, 13909; Payload ID: 6030 relates to Category No.: 3837, 7710, 14033, 14096, 3829, 6223; Payload ID: 6031 relates to Category No.: 334, 5367, 14565, 5428, 795, 1295, 7613, 10238, 12498, 803, 1795, 12646, 7840, 11884, 11765, 15782, 13925, 10955, 7548, 2051, 4039, 336, 13217, 11766, 12858, 7549, 2005, 11940, 14025, 14910, 2469, 8840, 4041, 5016, 8923, 4040, 13859, 10601, 5382, 7641, 15197, 13202, 4439, 11256, 13714, 365, 2044, 1064, 15559, 13092, 5427, 7250, 14838, 1948, 1984, 2079, 6271, 12891, 2014, 13882, 2136, 9490, 496, 13886, 13827, 2001, 2006, 13836, 6626, 1965, 13981, 13818, 13865, 10470, 2003, 9484, 10356, 1936, 13817, 15247, 3042, 2392, 2091, 13847; Payload ID: 6032 relates to Category No.: 334, 5367, 15490, 3398, 14565, 795, 8739, 10238, 1816, 803, 1795, 15190, 10775, 7840, 11765, 7598, 7548, 4039, 336, 4041, 13217, 11766, 12858, 7549, 10552, 14066, 13925, 10372, 11089, 13865, 10567, 1841, 5427, 3690; Payload ID: 6033 relates to Category No.: 12091, 803, 13445; Payload ID: 6034 relates to Category No.: 8862, 1026, 15626, 1703, 7633, 11094, 11091, 1993, 3887; Payload ID: 6035 relates to Category No.: 8862, 1026, 14565, 7633; Payload ID: 6036 relates to Category No.: 1752, 274, 12459, 1767, 280, 1780, 10628, 1812, 13150, 10889, 6959, 10599, 11213, 3867, 286; Payload ID: 6037 relates to Category No.: 674, 274, 16214, 280, 4059; Payload ID: 6038 relates to Category No.: 286, 14834; Payload ID: 6039 relates to Category No.: 12091, 1895; Payload ID: 6040 relates to Category No.: 12091, 1895, 7056; Payload ID: 6041 relates to Category No.: 12091, 1895; Payload ID: 6042 relates to Category No.: 12091, 7288, 1895, 7103; Payload ID: 6043 relates to Category No.: 5255, 1703, 1752, 1816, 674, 14589, 286, 3924; Payload ID: 6044 relates to Category No.: 5255, 1703, 3798; Payload ID: 6045 relates to Category No.: 5255, 1703, 8934, 1765, 14058, 7863, 7306; Payload ID: 6046 relates to Category No.: 8906, 5255, 1703, 2243, 5072, 5037, 5949, 10061, 1318, 5462, 3246, 4953, 9452, 13137; Payload ID: 6047 relates to Category No.: 3316, 9503, 3314, 14269, 9510, 9509, 15273, 455, 13189, 13418, 13072, 13680; Payload ID: 6048 relates to Category No.: 9940, 6226, 11365, 6223; Payload ID: 6049 relates to Category No.: 2940, 9940, 6226, 11365, 6223, 12640, 13629, 2162, 14484; Payload ID: 6050 relates to Category No.: 5255, 1703; Payload ID: 6051 relates to Category No.: 9500, 4110, 4104, 14865, 14663, 14862, 12646, 12944, 9740, 2173, 14391, 6220; Payload ID: 6052 relates to Category No.: 4105, 14663, 815, 6814; Payload ID: 6053 relates to Category No.: 14663, 815; Payload ID: 6054 relates to Category No.: 15626, 7613, 7840, 1867, 14663, 15661, 7131, 2006, 10491, 2001, 10372, 10608, 5751, 6306, 10771; Payload ID: 6055 relates to Category No.: 15626, 14663, 15661; Payload ID: 6056 relates to Category No.: 15626, 3244, 14663, 15661; Payload ID: 6057 relates to Category No.: 15626, 4949, 7743, 14663, 15661, 2353, 6304, 9944, 12865, 11193, 13888, 13827, 4110, 13843, 6306; Payload ID: 6058 relates to Category No.: 15626, 14663, 15661, 8731, 3398, 1334, 2878, 8522, 2353, 10790, 16279, 2044; Payload ID: 6059 relates to Category No.: 6219, 15626, 3781, 14663, 15661, 4538, 4541, 9825; Payload ID: 6060 relates to Category No.: 6219, 15626, 7743, 1184, 14663, 15661, 1189; Payload ID: 6061 relates to Category No.: 8862, 15626, 7743, 14663, 15661, 14940, 1782, 8906, 11713, 3801; Payload ID: 6062 relates to Category No.: 15626, 14663, 15661, 264; Payload ID: 6063 relates to Category No.: 6219, 9500, 13969, 496, 13888, 14040, 13966, 13970, 815, 14016, 13910, 13589, 3398, 1816, 9940, 12628, 1867, 14663, 15978, 15979, 587, 2116, 6203, 5344; Payload ID: 6064 relates to Category No.: 6219, 9500, 14663, 15978, 15979, 587, 6203; Payload ID: 6065 relates to Category No.: 6219, 9500, 15978; Payload ID: 6066 relates to Category No.: 6219; Payload ID: 6067 relates to Category No.: 9500, 4104; Payload ID: 6068 relates to Category No.: 6814, 1207, 9500, 4110, 15660, 6310, 1867, 14663, 3728, 16234, 16275, 10390, 9455, 9567, 2020, 6559, 235, 4104; Payload ID: 6069 relates to Category No.: 9500, 1867, 14663, 16276, 3950, 4653, 6312; Payload ID: 6070 relates to Category No.: 9500, 16276, 1867, 14663, 3950, 6312; Payload ID: 6071 relates to Category No.: 13594, 13589, 3398, 11512, 5428, 5446, 14656, 11506, 3398, 7362, 3337, 4127, 15003, 15570, 15456, 15450, 7363, 15448, 15443, 15454, 13460, 15446, 15653, 15457, 15458, 15451, 11224, 2107, 13827, 14620, 1922, 11150, 8862, 13956, 1968, 13969, 13925, 13936, 14025, 13989, 13812, 496, 13815, 4145, 15517, 13818, 13797, 13883, 13921, 2000, 13864, 14646, 2638; Payload ID: 6072 relates to Category No.: 8739, 13589, 3398, 11512, 1922, 13936, 13989, 13827, 13815, 4145, 15517, 13797, 13951, 2000, 13594; Payload ID: 6073 relates to Category No.: 12153, 14383, 15898; Payload ID: 6074 relates to Category No.: 12153, 14383; Payload ID: 6075 relates to Category No.: 12154, 14383; Payload ID: 6076 relates to Category No.: 12153, 14383, 1272, 4336, 3445, 10286; Payload ID: 6077 relates to Category No.: 12153, 14383; Payload ID: 6078 relates to Category No.: 12153, 14383; Payload ID: 6079 relates to Category No.: 12153, 14383; Payload ID: 6080 relates to Category No.: 11843, 12153, 14383; Payload ID: 6081 relates to Category No.: 12194, 12153, 1894, 14383, 16197, 12519, 13304, 15898, 12058; Payload ID: 6082 relates to Category No.: 12153, 14383, 1112; Payload ID: 6083 relates to Category No.: 11843, 12153, 14383; Payload ID: 6084 relates to Category No.: 12153, 14383, 2469, 3743, 12717, 11912, 11843; Payload ID: 6085 relates to Category No.: 15898, 12153, 14383; Payload ID: 6086 relates to Category No.: 12153, 14383, 5866, 10392; Payload ID: 6087 relates to Category No.: 12194, 12153, 14383; Payload ID: 6088 relates to Category No.: 1737, 15898, 12153, 7154, 14383, 1780, 4336; Payload ID: 6091 relates to Category No.: 11843, 15207, 12153, 16286, 5446, 8731, 3398, 9038, 11910, 11506, 3398, 12096, 14383, 7362, 4127, 7132, 14992, 15782, 4336, 15003, 15456, 15450, 7363, 15448, 15443, 15454, 15446, 15653, 15457, 15458, 10441, 15451, 11300, 14123, 11912, 8389; Payload ID: 6093 relates to Category No.: 12194, 12153, 1894; Payload ID: 6094 relates to Category No.: 15898, 16286, 3595, 1622, 3578, 10983, 6192; Payload ID: 6095 relates to Category No.: 11843, 12153, 2196, 14383, 7154; Payload ID: 6096 relates to Category No.: 2139, 12153, 1955, 11236, 14383, 11588, 14612, 9125, 16197, 11298, 12117, 13165, 10583, 11294, 10568, 11299, 6215, 13363, 16095, 8402, 12622, 7885, 8775, 11160, 13072, 8068, 8652, 13589, 3398, 16096, 6375; Payload ID: 6097 relates to Category No.: 12153, 1780, 4766, 10495, 14921, 5985; Payload ID: 6098 relates to Category No.: 14383; Payload ID: 6099 relates to Category No.: 12154, 795, 12153, 12498; Payload ID: 6100 relates to Category No.: 15898, 12153, 1894, 9661, 14456; Payload ID: 6104 relates to Category No.: 12194, 12153, 1894, 14383, 4712, 3837, 15898, 13383, 7743; Payload ID: 6105 relates to Category No.: 15898, 12153; Payload ID: 6106 relates to Category No.: 15898, 1894, 11237, 12096, 13479, 2116, 9238, 11299, 13210; Payload ID: 6107 relates to Category No.: 12153; Payload ID: 6108 relates to Category No.: 12153; Payload ID: 6111 relates to Category No.:

12194, 12153; Payload ID: 6112 relates to Category No.: 12153; Payload ID: 6113 relates to Category No.: 12153, 1955, 14383, 7148, 7837; Payload ID: 6114 relates to Category No.: 12153, 13822, 1951; Payload ID: 6115 relates to Category No.: 12153; Payload ID: 6119 relates to Category No.: 14383; Payload ID: 6120 relates to Category No.: 15898, 12153, 12096, 14383, 15257, 11298; Payload ID: 6121 relates to Category No.: 12153, 7334; Payload ID: 6124 relates to Category No.: 12153, 6670, 13171, 8269, 8797, 8508, 13116; Payload ID: 6126 relates to Category No.: 12154, 11843, 12153, 1955, 8934, 5465, 2250, 2721, 718, 2252, 15141; Payload ID: 6130 relates to Category No.: 1737, 13166, 13171, 7132, 670, 11587, 13644, 4332, 8269, 8797, 13612, 6880, 16165, 9378, 6980, 14894, 13116, 14897; Payload ID: 6131 relates to Category No.: 12194, 12153, 3837, 3354, 14383, 14033, 3309, 4712; Payload ID: 6132 relates to Category No.: 15898, 12153, 12127, 7129, 13376, 7997, 7835, 8238; Payload ID: 6133 relates to Category No.: 15898, 10702, 16172, 12502; Payload ID: 6134 relates to Category No.: 12153, 14383, 13588, 5446, 4094; Payload ID: 6135 relates to Category No.: 12153, 3452, 1955, 3320, 1727, 11285, 3305, 3656, 13729, 13730, 7898, 10866, 13903, 7802, 6814; Payload ID: 6137 relates to Category No.: 5367; Payload ID: 6138 relates to Category No.: 5446, 4127, 11572, 345, 11178, 14565, 6153, 344, 1795, 10307, 10961, 14512, 10843, 10691; Payload ID: 6139 relates to Category No.: 10074, 5446, 1795, 3013, 4127, 14992, 742, 1238, 9000, 4124, 6145, 743, 11182, 13319, 5381, 8997, 15196, 4129, 9777, 3729, 11575, 11572, 10780, 14565, 12041, 5592, 11566, 11576, 10826, 10851, 10960, 8259, 10961, 6612, 12994, 14513; Payload ID: 6140 relates to Category No.: 9125, 11114, 11113, 10886, 10764; Payload ID: 6142 relates to Category No.: 5367, 5785, 14565, 2885, 5446, 746, 9777, 3729, 4130, 12994, 742, 15223, 742, 5610; Payload ID: 6143 relates to Category No.: 5367, 2885, 403, 746, 742, 15223, 742, 5610, 4125; Payload ID: 6144 relates to Category No.: 5446, 4130; Payload ID: 6145 relates to Category No.: 5367, 14565, 12994, 16197; Payload ID: 6147 relates to Category No.: 5367, 5446, 4130, 12994; Payload ID: 6148 relates to Category No.: 5367, 7131, 10491; Payload ID: 6149 relates to Category No.: 5367, 4129, 5354; Payload ID: 6150 relates to Category No.: 7613, 5376, 1849; Payload ID: 6151 relates to Category No.: 14565, 403; Payload ID: 6153 relates to Category No.: 1816, 11371; Payload ID: 6155 relates to Category No.: 403; Payload ID: 6156 relates to Category No.: 8568, 7645; Payload ID: 6158 relates to Category No.: 1730; Payload ID: 6159 relates to Category No.: 8106; Payload ID: 6160 relates to Category No.: 14318; Payload ID: 6163 relates to Category No.: 2506, 2493; Payload ID: 6164 relates to Category No.: 2493, 2506, 12041, 6735; Payload ID: 6165 relates to Category No.: 15618, 15626, 1862, 7306, 3854, 7112, 4985, 3856, 4979, 5406, 7303, 3613, 14910, 1240, 13271, 3578, 6194, 4947; Payload ID: 6166 relates to Category No.: 15618, 4985; Payload ID: 6167 relates to Category No.: 12153, 8112, 13645; Payload ID: 6168 relates to Category No.: 795, 12153, 13645, 12858, 12769, 1316, 3795, 3796; Payload ID: 6169 relates to Category No.: 12153; Payload ID: 6170 relates to Category No.: 12091, 5785, 9720, 2885, 1703, 15043, 1730, 1752, 9717, 5446, 10372, 6969, 11109, 13059, 275, 1780, 2311, 10366, 4127, 12818, 13110, 7132, 13925, 10192, 2009, 11858, 2047, 10093, 13371, 2107, 5542, 5710, 5973, 3226, 8258, 4025, 13986, 15838, 1807, 14565, 12879; Payload ID: 6171 relates to Category No.: 7385; Payload ID: 6173 relates to Category No.: 15490, 3398, 8731, 3398, 8739, 13225, 1729, 4217; Payload ID: 6175 relates to Category No.: 1183; Payload ID: 6177 relates to Category No.: 11433; Payload ID: 6180 relates to Category No.: 3879; Payload ID: 6181 relates to Category No.: 3879; Payload ID: 6182 relates to Category No.: 1204; Payload ID: 6183 relates to Category No.: 1892, 773, 12466; Payload ID: 6184 relates to Category No.: 13232, 8661, 8507, 10889, 11386; Payload ID: 6186 relates to Category No.: 10702, 13435, 15140, 8454, 3041; Payload ID: 6187 relates to Category No.: 1026, 14432, 10702, 13435, 1703, 275, 10107, 9459, 8944, 12365, 13007; Payload ID: 6188 relates to Category No.: 1703, 5941, 5940, 3879; Payload ID: 6189 relates to Category No.: 15043, 12648, 16286, 1820, 5592, 12026, 15570, 4229, 5573, 1749; Payload ID: 6190 relates to Category No.: 15043, 5592, 10366, 10075, 5573, 12651, 6137; Payload ID: 6191 relates to Category No.: 16308, 9500, 5261, 14982, 2355, 14663, 14972, 1354; Payload ID: 6192 relates to Category No.: 16308, 9500, 14982, 14663, 14972, 1354; Payload ID: 6193 relates to Category No.: 9500, 15883, 16308, 14982, 2355, 14663, 14962, 14972, 4448, 1354, 7518; Payload ID: 6194 relates to Category No.: 14308, 15715, 9797; Payload ID: 6195 relates to Category No.: 9500; Payload ID: 6196 relates to Category No.: 1204; Payload ID: 6197 relates to Category No.: 9500, 10372, 1862, 5871, 10929, 11427, 10185; Payload ID: 6198 relates to Category No.: 1862, 5871, 15618, 5367, 9500, 12427, 7743, 6738, 11646, 7990, 5784, 8363; Payload ID: 6199 relates to Category No.: 1862, 5871; Payload ID: 6200 relates to Category No.: 15618, 12427, 1862, 5871, 6738, 11646, 5866; Payload ID: 6201 relates to Category No.: 14663, 4977, 10174, 4448, 13921, 12210, 12891, 2355, 16150, 5866, 3854, 10173, 3164, 12792, 12960, 13827, 13837, 13987, 13939, 13887, 13944, 13916, 1951, 13784; Payload ID: 6202 relates to Category No.: 1703, 1730, 15614, 1752, 9717, 5446, 2311, 12091, 1026, 9720, 12648, 7306, 12614, 12646, 12628, 1780, 13110, 10188, 11858, 13668, 12642, 11094, 11008, 11057, 6967, 2198; Payload ID: 6204 relates to Category No.: 7912, 1204, 14586, 1202; Payload ID: 6205 relates to Category No.: 13594, 13589, 3398, 1730, 15517, 8408, 10648, 8932, 8933; Payload ID: 6206 relates to Category No.: 13594, 1026, 15490, 3398, 8731, 3398, 8739, 8934, 11506, 3398, 7743, 11091, 4251, 15247, 9333, 4248; Payload ID: 6207 relates to Category No.: 13594, 1026, 8731, 3398, 8739, 15517, 11512, 8375, 11506, 3398, 7743, 11091, 3038, 1035, 2247, 4251, 6296, 3070, 15247, 4248, 2602, 2248, 12524, 8931; Payload ID: 6208 relates to Category No.: 6961, 9720, 10372, 10366, 9420, 7132, 4336, 8546, 8522, 10362; Payload ID: 6209 relates to Category No.: 16294, 14050; Payload ID: 6210 relates to Category No.: 6961, 2459; Payload ID: 6211 relates to Category No.: 1514, 1512, 8925; Payload ID: 6212 relates to Category No.: 12091, 14038, 9720, 1730, 12648, 15614, 9717, 5446, 10961, 5592, 12646, 10366, 13360, 4130, 1238, 3016, 11858, 2088, 11187, 11186, 13299, 10478, 5373, 13000; Payload ID: 6214 relates to Category No.: 14318, 15715, 14314, 1283, 9455, 5130, 14714, 14267; Payload ID: 6215 relates to Category No.: 14318, 6902, 15715; Payload ID: 6216 relates to Category No.: 12670, 674, 4949, 14640, 4020, 4021, 3582, 14477, 1463, 14483, 11636, 2131, 5949, 2010, 6878; Payload ID: 6217 relates to Category No.: 12670, 4020, 4021, 3582, 10287, 11147, 1463, 14483, 1278, 3595, 6194; Payload ID: 6218 relates to Category No.: 12670, 674; Payload ID: 6219 relates to Category No.: 12095, 14565, 10074, 5446, 403, 1820, 11884, 1893, 4021, 1238, 11601, 10069, 10080, 4180, 10075, 10583, 10593, 11290, 7919, 1889, 7967, 13796, 10726, 11170, 11425, 5422, 1238, 2605, 1238, 4177, 7657, 2605, 13835, 1948, 2079, 6271, 381, 13951, 13857, 2021, 13817, 1990; Payload ID: 6220 relates to Category No.:

1999

12095, 14565, 10074, 5446, 403, 1820, 4021, 1238, 11601, 10069, 10080, 4180, 10075, 10583, 10593, 11290, 7919, 1889, 7967, 13796, 10726, 11170, 11425, 5422, 1238, 4177, 2014, 2033; Payload ID: 6222 relates to Category No.: 12095, 14565, 10074, 1820, 12105, 4021, 1238, 11601, 10069, 10080, 4180, 10075, 10583, 10593, 11290, 7919, 1889, 7967, 13796, 10726, 11170, 11425, 1238, 4177; Payload ID: 6223 relates to Category No.: 13589, 3398, 15490, 3398; Payload ID: 6226 relates to Category No.: 12194, 690, 1703, 12195, 3713, 10350, 7963, 12875, 10591, 12721, 7133, 7744, 6707, 6704, 7964; Payload ID: 6227 relates to Category No.: 4186, 10075; Payload ID: 6228 relates to Category No.: 690, 1026, 14661, 11512, 14565, 5446, 10372, 6606, 348, 674, 7306, 4186, 10359, 9891, 12391, 10366, 4127, 3775, 5541, 16085, 8988, 10954, 1995, 10583, 10862, 10226, 10421, 1305, 6809, 12808, 10574, 6375, 11285, 9409, 1780; Payload ID: 6229 relates to Category No.: 1026, 14661, 7725, 5446, 6606, 348, 345, 11506, 3398, 4186, 275, 10175, 9891, 12391, 4127, 3775, 10577, 5541, 16085, 8988, 16294, 10955, 10250, 10521, 11178, 10583, 3846, 15400, 12007, 10522, 6878, 6812, 14359, 10573, 10883, 10467, 5988, 11305, 13452, 1320, 10934, 3801, 16034, 11592, 10574, 10882, 12373, 6377, 6387, 1341, 4188, 14405, 15245, 10705, 14782, 11512, 2311, 1249, 1816, 3604, 12891, 3176, 7743, 10626, 9408, 3889, 9410, 5459, 11125, 14439, 7966, 4939, 3782, 10372, 14910, 3576, 3246, 11620, 6375, 3571, 12824, 10034, 10314, 13757, 3577, 7730, 3781, 13492, 6194, 5941, 11027, 9554, 3814, 1317, 3791, 15824, 1250, 15402, 14688, 16279, 9321, 3806, 6371, 14360, 6192, 6191, 6384, 6524, 3798, 11826, 11596, 1340, 6569, 7335, 5424, 6879, 9407, 12563, 9466, 3585, 4944, 6557, 1304, 6775, 4136, 12474, 1330, 6789, 15034, 14438, 6386, 11618, 13835, 13969, 13925, 1730, 690, 15427, 9409; Payload ID: 6230 relates to Category No.: 8862, 14565, 1816; Payload ID: 6231 relates to Category No.: 8862, 14565, 1816, 4949, 4186, 13496, 5912, 1553, 13495, 15149, 483, 11399, 8919, 13121, 7713; Payload ID: 6232 relates to Category No.: 8862, 14565, 1816, 6606, 8300, 360, 12041, 6102, 8934, 6758, 6980, 5073, 7819, 2242, 3892; Payload ID: 6233 relates to Category No.: 8862, 14565, 1816, 5912, 10491, 15149, 483, 11399, 8919, 13530, 13327, 10729, 13539; Payload ID: 6234 relates to Category No.: 1026, 6814, 14661, 14565, 5446, 1816, 6606, 348, 4186, 14021, 9891, 12391, 4127, 3775, 5541, 16085, 8988, 9410, 10555, 10294; Payload ID: 6235 relates to Category No.: 8862, 1026, 14661, 14565, 5446, 1816, 6606, 348, 4186, 9891, 12391, 4127, 3775, 5541, 16085, 8988, 10372; Payload ID: 6236 relates to Category No.: 1026, 14661, 14565, 5446, 1816, 6606, 348, 674, 4186, 9891, 12391, 4127, 3775, 5541, 16085, 8988, 10954, 10583, 10555, 10372, 690, 6375, 3631, 9451, 2374, 5802, 10429, 11596; Payload ID: 6237 relates to Category No.: 8862, 1026, 14661, 5446, 10372, 6606, 348, 4186, 9891, 12391, 4127, 3775, 11285, 5541, 16085, 8988, 10878, 10583, 8004, 10666, 7652, 4949, 8869; Payload ID: 6238 relates to Category No.: 4866, 7743, 10648, 10574, 12619, 690, 6375, 348, 4475, 10314, 13787, 11266, 6561, 11285, 14943, 10358, 11147, 10557, 10405, 13429, 9409, 2726, 15415, 15042, 16294, 10372, 496, 11391, 10583, 4186, 691, 3565, 10321, 8862, 1026, 14661, 11512, 14565, 5446, 7728, 6606, 345, 11506, 3398, 10175, 10359, 9858, 9891, 12391, 2311, 4127, 3775, 5541, 16085, 8988, 4021, 10558, 3598, 5290, 12488, 10954, 11410, 11186, 13695, 9410, 7989, 1762, 8835, 7659, 14782, 10555, 10226, 1318, 10283, 11191, 12808, 2373, 5498, 10361; Payload ID: 6239 relates to Category No.: 1026, 14661, 14565, 5446, 1816, 6606, 348, 4186, 9891, 12391, 4127, 3775, 5541, 16085, 8988, 1730,

2000

12593, 5461, 10372, 10583; Payload ID: 6240 relates to Category No.: 14565, 1816, 10583, 10666, 13086, 10924, 10372, 10956, 13967, 1984, 13767, 1957, 3684, 7919, 2045, 3707; Payload ID: 6241 relates to Category No.: 4186, 1026, 14661, 1730, 5446, 6606, 348, 9891, 12391, 4127, 3775, 5541, 16085, 8988; Payload ID: 6242 relates to Category No.: 1026, 14661, 5446, 6606, 348, 8421, 4186, 9891, 12391, 9811, 4127, 3775, 5541, 16085, 8988, 11612, 7664, 8089, 16221, 13301, 11506, 3398, 10583, 12553, 1880, 10956, 2149, 9815, 13932, 2033, 2021, 2086, 16222, 14008; Payload ID: 6243 relates to Category No.: 1026, 14661, 14565, 5446, 10372, 1816, 6606, 348, 674, 4186, 10359, 9891, 12391, 4127, 3775, 5541, 16085, 8988, 7705, 14439, 15400, 11628, 9409, 9466; Payload ID: 6244 relates to Category No.: 1026, 14661, 14565, 5446, 10372, 1816, 6606, 348, 4186, 10359, 9891, 12391, 4127, 3775, 5541, 16085, 8988, 10583, 12808, 6777, 2373, 14949, 11512, 12891, 10648, 7613, 2755, 3595, 11285, 1621, 9321, 3594, 801; Payload ID: 6245 relates to Category No.: 8862, 1026, 14661, 5446, 10372, 1816, 6606, 348, 4186, 10359, 9891, 12391, 1780, 4127, 3775, 5541, 16085, 8988, 4475, 14577; Payload ID: 6246 relates to Category No.: 4186, 690, 1026, 14661, 14565, 5446, 10372, 1816, 6606, 348, 10359, 9891, 12391, 1780, 4127, 3775, 5541, 16085, 8988, 1621, 7381; Payload ID: 6247 relates to Category No.: 1026, 14661, 14565, 5446, 10372, 6606, 348, 3781, 4186, 275, 10175, 10359, 9891, 12391, 4127, 3775, 5541, 16085, 8988, 11178, 14050, 12007, 10491, 10883, 10574, 10882, 14405, 6777, 10575, 11506, 3398, 4939, 1317, 12563, 9825, 16294, 9940, 6375, 9485, 15121; Payload ID: 6248 relates to Category No.: 1026, 14661, 5446, 10372, 6606, 348, 674, 4186, 9891, 12391, 4127, 3775, 1269, 5541, 16085, 8988, 3437, 6878, 6812, 9481, 3813, 4418, 9320, 7705, 4789, 8900, 5949, 3176, 10648, 7613, 1318, 9480, 757, 5459, 1741, 9786, 4952, 10583, 13265, 795, 8883, 4949, 6375, 3587, 6523, 8373, 1782, 4953, 1483, 15247, 6194, 1317, 11033, 14577, 3565, 1250, 15402, 1257, 4254, 3594, 4446, 9542, 4252, 9600, 6384, 6803, 9409, 15035, 9466, 6997, 11143, 2726, 15415, 1761, 13969, 2176, 13827, 13975, 10175, 7251, 4256, 3443; Payload ID: 6249 relates to Category No.: 1026, 14661, 14565, 5446, 10372, 6606, 348, 4186, 10359, 9891, 12391, 4127, 3775, 5541, 16085, 8988, 6530, 15042, 8739, 1816, 10648, 5459, 10574, 11949, 3576, 690, 9455, 6375, 13582, 10314, 3595, 10983, 2376, 11394, 4057, 3612, 8831, 10202, 11596, 6390, 6538, 10955; Payload ID: 6250 relates to Category No.: 14565, 7743, 4186, 7131, 10491, 10624, 10372, 1816; Payload ID: 6252 relates to Category No.: 11598, 10624; Payload ID: 6253 relates to Category No.: 12091, 1026, 15490, 3398, 14661, 11091, 9720, 1752, 5446, 10372, 6606, 348, 4186, 14640, 9891, 2392, 12628, 12391, 4127, 3775, 5541, 16085, 8988, 11858, 10954, 10955, 11187, 8934, 11190, 11191, 14641, 8739, 12646, 5406, 1249, 16005, 12891, 5459, 9476, 7001, 8004, 9584, 690, 6375, 11094, 14456, 1751, 1295, 3595, 1317, 10983, 2376, 10349, 4446, 985, 14360, 9409, 6773, 10321, 6390, 6995, 12563, 13062, 10956, 12857, 9403, 16140, 4191, 2176, 13459, 8936, 8421, 13510, 14949, 7248; Payload ID: 6254 relates to Category No.: 12091, 690, 1026, 14661, 11512, 9720, 795, 8739, 1741, 5446, 10372, 1816, 6606, 348, 4186, 3575, 13492, 10359, 9891, 12391, 1048, 4127, 3775, 1269, 5541, 16085, 8988, 10314, 3246, 1272, 1274, 6773, 11858, 10955, 3604, 6995, 12877, 10583, 3791, 4939, 3603, 9408, 12832, 9410, 11620, 5406, 4469, 9466, 16133, 10349, 5988, 10574, 4188, 11190, 10983, 9481, 5459, 13277, 16005, 6371, 3577, 13739, 6375, 10321, 6390, 13189, 9320, 14641, 13487, 11634, 12631, 1319, 13278, 10575, 6757, 7243, 9403, 16140, 12285, 7303, 4189, 4187, 4192, 4191, 3602, 3782, 6191, 1316, 1317, 1340, 6383, 11824, 11820, 11819, 14931, 6077, 6557, 3806, 1304, 1312, 12559, 13179, 6775, 6778, 12646, 7743, 12824, 8918, 3801, 3814, 6113, 8320, 15167, 2703, 3647, 11391, 3812, 7939, 6799; Payload ID: 6255 relates to Category No.: 12091, 9720, 10372, 4186, 1026, 14661, 5446, 6606, 348, 5910, 14640, 9891, 12391, 2376, 4127, 3775, 5541, 16085, 8988, 1272, 1274, 11858, 10955, 10583, 11186, 3631, 11190, 11582, 1271, 11581, 3629, 2379, 7878, 4184, 8739, 1730, 14782, 11178, 7743, 11298, 2174, 4251, 8639, 1622, 7242, 10314, 5458, 6117, 7625, 13787, 10558, 6113, 10358, 11089, 8320, 9349, 1049, 3794, 2547, 3247, 5461, 10956, 15042, 606, 1816; Payload ID: 6256 relates to Category No.: 12091, 1026, 14661, 9720, 1752, 5446, 10372, 6606, 348, 4186, 9891, 12391, 9811, 4127, 3775, 10648, 5541, 16085, 8988, 11858, 10583, 13071, 11300, 4535, 10514, 12697, 12854, 10991, 12539; Payload ID: 6257 relates to Category No.: 4828, 1026, 14661, 5446, 6606, 348, 4186, 9891, 12391, 4127, 3775, 5541, 16085, 8988, 15616, 4419, 345, 16136, 4251, 15614, 12498, 12832, 12824, 6111, 6113, 722, 3563, 9409, 8898, 11819, 9400; Payload ID: 6258 relates to Category No.: 1026, 14661, 14565, 5446, 6606, 348, 4186, 12391, 4127, 3775, 5541, 16085, 8988; Payload ID: 6259 relates to Category No.: 11940, 4186, 1809, 7743, 14640, 3228, 4958, 16137; Payload ID: 6260 relates to Category No.: 1512, 14663, 4021, 4723, 5930, 5932, 5931, 15568, 2571; Payload ID: 6261 relates to Category No.: 690, 1703, 15043, 12648, 10074, 10372, 9632, 381, 10648, 4020, 4021, 1238, 10080, 6145, 14050, 12832, 5573, 10626, 13371, 3643, 11426, 1710, 8759, 16294, 1825, 1820, 10257, 1447, 11169, 1984, 10366, 1701, 13909, 4478, 13977, 2143, 2094, 7613, 10419, 13859, 2041, 2053, 2014, 2100, 2131, 1918; Payload ID: 6262 relates to Category No.: 5785, 1703, 4186, 3038, 8937, 11431; Payload ID: 6263 relates to Category No.: 5785, 4186, 1204, 4953, 1704, 1093, 1026, 11431, 7553, 13231; Payload ID: 6264 relates to Category No.: 5785, 4949, 4186, 15140, 8936, 3598, 13787, 1804, 8937, 4946, 11757, 11431, 7553; Payload ID: 6266 relates to Category No.: 1737, 7154; Payload ID: 6267 relates to Category No.: 1204; Payload ID: 6270 relates to Category No.: 14589, 14834, 4167, 14520; Payload ID: 6273 relates to Category No.: 13953, 10293, 1204; Payload ID: 6282 relates to Category No.: 4021, 11169, 7946, 10648, 16197, 8535, 7719, 8667, 10626, 7740, 1238, 4177, 11426, 1710, 8759, 8754, 8655, 3566; Payload ID: 6283 relates to Category No.: 4021, 10383; Payload ID: 6284 relates to Category No.: 1820, 4021, 12007, 13410, 3550, 14403, 12633; Payload ID: 6285 relates to Category No.: 1703; Payload ID: 6286 relates to Category No.: 8049, 11848; Payload ID: 6287 relates to Category No.: 5446, 2610, 3016, 2610, 6104, 3015, 12433, 9391; Payload ID: 6288 relates to Category No.: 4828, 5446, 2610, 10856, 2610, 6104, 1794, 12007, 12433, 8817; Payload ID: 6289 relates to Category No.: 5446, 3021, 2610, 2610, 6104, 12433, 8817, 8589; Payload ID: 6290 relates to Category No.: 2902, 12786, 1737, 7154; Payload ID: 6291 relates to Category No.: 12619, 7613, 2902, 2022, 12786, 932, 9455, 9457, 8175; Payload ID: 6292 relates to Category No.: 9883, 9858, 9945, 14663, 8928, 7364, 6296, 10025, 9862, 8347, 16068, 3100, 11094, 6814; Payload ID: 6293 relates to Category No.: 5939, 7306, 3913; Payload ID: 6294 relates to Category No.: 3913; Payload ID: 6296 relates to Category No.: 1204; Payload ID: 6297 relates to Category No.: 14661, 7613, 10074, 275, 12405, 10775, 2459, 7162, 436, 1238, 272, 12117, 10080, 10075, 8611, 11510, 12007, 8508, 3900, 1749, 2910, 11425, 10806, 8738, 274, 3525, 3812, 7294; Payload ID: 6298 relates to Category No.: 14565, 2885, 2933, 5938, 274, 3799, 14636, 1730; Payload ID: 6299 relates to Category No.: 12648, 14589, 1749, 13007; Payload ID: 6300 relates to Category No.: 1749, 7341; Payload ID: 6302 relates to Category No.: 15588, 15601, 15603, 14934, 15604, 1204, 1893, 4439, 16197, 16193, 5447, 729, 3016, 9223, 9103, 16201; Payload ID: 6303 relates to Category No.: 11940, 12127, 7129, 7045, 11293, 7043, 9757, 10486, 13692, 13164, 7044, 7121, 11017, 10864, 10470, 7913, 11012, 1453; Payload ID: 6304 relates to Category No.: 1737, 3354, 7154, 329, 7132, 670, 11587, 13644, 11243, 8797, 11959, 4335, 10372, 6114, 7723, 13116; Payload ID: 6305 relates to Category No.: 12075, 11926, 2276; Payload ID: 6306 relates to Category No.: 12075, 11926, 2276; Payload ID: 6307 relates to Category No.: 12075, 11926, 2276, 3684, 1893, 5855; Payload ID: 6308 relates to Category No.: 12075, 11926, 3639, 8454; Payload ID: 6309 relates to Category No.: 12075, 11926, 2276, 1415, 10775, 12994, 11298, 15570, 15185, 12101, 12051, 11242, 4012, 12474, 16133, 4953, 13363, 4954, 14654, 663, 2995, 13450, 8534, 12486, 8535, 13695, 2885, 7340, 15203, 13795, 13905; Payload ID: 6310 relates to Category No.: 15618, 12075, 11926, 2276, 5846, 1415, 2945, 8601, 12596, 12101, 12051, 13999, 13409, 1453, 1717, 2995, 13450, 8057, 8534, 8568, 11364, 13695, 14693, 10486, 5544, 12953, 13860, 15203, 8947, 13696, 8119, 14046, 10260, 13970, 13877; Payload ID: 6311 relates to Category No.: 12075, 11926, 2276, 8568; Payload ID: 6312 relates to Category No.: 12075, 11926, 2276; Payload ID: 6313 relates to Category No.: 12075, 11926, 2276; Payload ID: 6314 relates to Category No.: 12075, 11926, 2276, 1995, 8378, 12671, 8302, 3566, 687, 11821, 13739, 11888, 14970, 6539, 8301, 2679; Payload ID: 6315 relates to Category No.: 12075, 11926, 2276; Payload ID: 6316 relates to Category No.: 12075, 11926, 1730, 2276, 14838, 4442, 10031, 6687, 3339, 9705; Payload ID: 6317 relates to Category No.: 12075, 11926, 2276; Payload ID: 6318 relates to Category No.: 12075, 11926, 5785, 795, 2276, 16197, 7303, 3445, 12891, 1463, 7613, 10286, 1744, 14699, 3444, 8888, 12551; Payload ID: 6319 relates to Category No.: 12075, 11926, 2276; Payload ID: 6320 relates to Category No.: 12075, 2276, 13996; Payload ID: 6321 relates to Category No.: 14216, 3656, 9228, 3452, 3356, 3354, 3448, 15257, 1089, 7132, 3356, 13698, 3369, 16049, 15259, 15260, 6758; Payload ID: 6322 relates to Category No.: 4076, 6814, 14663, 16234, 16275, 14128; Payload ID: 6323 relates to Category No.: 9500, 3474, 16308, 14663, 9423, 7518, 15470, 13925, 13973; Payload ID: 6324 relates to Category No.: 16308, 9500, 14663, 9423, 3474, 7513, 7518, 15470, 9526; Payload ID: 6325 relates to Category No.: 16308, 9500, 14663, 3474; Payload ID: 6326 relates to Category No.: 9500, 3474, 3472; Payload ID: 6327 relates to Category No.: 9500, 3474, 1204; Payload ID: 6328 relates to Category No.: 13594, 1730, 13589, 3398, 4999, 15517, 11512, 9410, 6666, 1237; Payload ID: 6329 relates to Category No.: 13589, 3398, 15490, 3398, 7306; Payload ID: 6330 relates to Category No.: 11940, 11285, 4020, 13831, 3486, 10811, 11242, 10543, 3910, 10475, 6744, 13401, 11436, 3436, 10726, 11495, 10064, 11382, 10345, 11986, 1967, 11063, 10364, 12027, 10380, 12041, 1048, 13435; Payload ID: 6331 relates to Category No.: 1703, 3781, 12117, 8004, 3910, 13205, 6744, 12042, 7595, 10589; Payload ID: 6332 relates to Category No.: 13589, 3398, 15490, 3398, 11285; Payload ID: 6333 relates to Category No.: 1204; Payload ID: 6336 relates to Category No.: 12091, 690, 16088, 9720, 1730, 15614, 1752, 10372, 10366, 6085, 3598, 11858, 10954, 10955, 11187, 7216, 11186, 2143, 1249, 10226, 11596, 11191, 16086, 13882, 11391, 348, 5783, 13491; Payload ID: 6337 relates to Category No.: 12091, 16088, 9720, 4998, 2885, 15614, 10372, 12498, 1948, 1060, 11858, 10954, 3049, 10955, 11187, 11186, 11580, 2604, 6142, 7379, 11745, 6417, 5243, 11634, 7743, 14910, 11285, 7643, 6412, 6419, 11827, 13971, 9411, 1982; Payload ID: 6338 relates to Category No.: 14565, 10372, 3592, 11062, 11285, 11076, 11063, 6412, 13203; Payload ID: 6339 relates to Category No.: 12091, 16088, 9720, 7613, 15614, 10372, 14928, 11285, 16085, 10878, 10558, 11858, 10955, 10583, 10557, 2143, 6404, 1249, 16095, 11268, 11595, 12546, 6406; Payload ID: 6340 relates to Category No.: 849; Payload ID: 6343 relates to Category No.: 12194, 14663, 1878, 1828, 2774, 4238; Payload ID: 6344 relates to Category No.: 12427, 3833, 12063, 2669, 1893, 6738, 4235, 11660, 4952, 13616, 12583, 1031, 1973, 8871, 1575, 9785, 720, 13787, 4233; Payload ID: 6345 relates to Category No.: 5428, 12427, 10372, 4235, 13577, 1973; Payload ID: 6346 relates to Category No.: 4235; Payload ID: 6347 relates to Category No.: 4828, 11735, 434, 328, 5268, 13280, 16041, 14838, 8936, 14834, 10860, 9485, 13371, 6296, 13105, 1093, 439, 442, 4243, 14523, 9932, 14520, 13322, 14818, 14838, 3969, 13541, 13030, 12987, 2164, 9491, 12711, 7667, 12454, 15535, 13359, 6530, 4138, 4134, 11187, 10583, 4789; Payload ID: 6348 relates to Category No.: 11512, 14565, 10372, 10366, 1893, 4134, 15570, 9637, 4145, 11760, 9485, 4243, 13280, 10289, 14523; Payload ID: 6350 relates to Category No.: 11512, 4998, 8739, 10238, 8728, 7737, 7946, 11285, 7735, 12743, 8524, 15464, 10256, 11502, 1812, 8004, 10343, 11542, 5406, 13371, 13588, 8584, 8529, 7628, 12968, 8316, 7746, 7926, 13332; Payload ID: 6351 relates to Category No.: 10702, 8739, 8728, 7840, 11285, 15464, 11174, 11245, 13371, 2116, 5364, 10263, 13332; Payload ID: 6352 relates to Category No.: 12091, 5808, 8739, 11174, 11245, 13371; Payload ID: 6353 relates to Category No.: 7306, 9375, 15517, 11512; Payload ID: 6354 relates to Category No.: 14565, 8739, 4969, 7575, 10706; Payload ID: 6355 relates to Category No.: 1257, 14009; Payload ID: 6356 relates to Category No.: 13594, 15490, 3398, 11512, 9451, 7662, 8424, 10379, 4969, 7575, 8768, 14838, 6530, 5949, 472, 6375, 2054; Payload ID: 6359 relates to Category No.: 1207, 9232, 9374, 4237, 1780, 14663, 16234, 16275, 4238, 4233, 4576, 15313, 1295, 6269, 9411; Payload ID: 6360 relates to Category No.: 13589, 3398, 11512, 1730, 2411, 674, 11363, 13835, 10860, 7942, 11027, 10380, 15517, 12891, 673, 11091, 8932, 6376, 12619, 4535, 6375, 9125, 3444, 3814, 11394, 11822, 14407, 5263, 15763, 2640, 11825, 3796, 3818, 13594; Payload ID: 6361 relates to Category No.: 13594, 13589, 3398, 15490, 3398, 11512, 1730, 674, 2409, 11506, 3398, 483, 3632, 13005, 11740, 1744, 8611, 3437, 7942, 8020, 10380, 12543, 11514, 10539, 10647, 13901, 8740, 7876, 15517, 5406, 3533, 9599, 724, 3445, 12891, 14791, 673, 8375, 11091, 8932, 6376, 6375, 1729, 9125, 13071, 3444, 3814, 11394, 14577, 13512, 1731, 2640; Payload ID: 6362 relates to Category No.: 13594, 13589, 3398, 1730, 674, 15490, 3398, 11512, 2409, 1853, 3632, 14838, 2116; Payload ID: 6363 relates to Category No.: 13594, 13589, 3398, 15490, 3398, 1730, 674, 8373, 14793, 6995, 16213, 4217, 5998, 1032, 3792, 6571, 5333, 15246, 6572, 6567, 5426, 1753, 16023, 14883, 15325; Payload ID: 6364 relates to Category No.: 13594, 13589, 3398, 15490, 3398, 1730, 674; Payload ID: 6365 relates to Category No.: 16088, 13589, 3398, 11512, 1730, 1752, 9321, 15517, 4949, 11506, 3398, 1780, 4057, 7598, 8318, 6772, 6497, 8235, 10715, 10716, 5406, 16005, 5949, 10648, 16133, 1463, 2571, 1240, 2571, 14640, 13271, 9485, 3587, 1295, 16085, 4953, 9451, 9125, 4459, 5988, 1250, 1560, 12547, 860, 6773, 8865, 6404, 9585, 7617, 4723; Payload ID: 6366 relates to Category No.:

13594, 13589, 3398, 11512, 1730, 8739, 15517, 4949, 11506, 3398, 5541, 13874, 10344, 10557, 6795, 10368, 6406, 11599, 16005, 5949, 16133, 1463, 6878, 3613, 14793, 1240, 2571, 14640, 13271, 1780, 3587, 16085, 4953, 9451, 9125, 3575, 1250, 1560, 4500, 12547, 3614, 9600, 860, 8865, 6404, 9585, 9588, 4492, 4495, 7617; Payload ID: 6367 relates to Category No.: 13594, 13589, 3398, 15490, 3398, 1730, 8731, 3398, 674, 10648, 10286, 10884, 3239, 6832, 6833; Payload ID: 6368 relates to Category No.: 13594, 13589, 3398, 15490, 3398, 1730, 674; Payload ID: 6369 relates to Category No.: 13589, 3398, 15490, 3398, 11512, 1730, 8739, 674, 5406, 14782, 15736, 3605; Payload ID: 6370 relates to Category No.: 13594, 13589, 3398, 15490, 3398, 1730, 674; Payload ID: 6371 relates to Category No.: 13594, 13589, 3398, 15490, 3398, 1730, 674; Payload ID: 6372 relates to Category No.: 13594, 13589, 3398, 1730, 674; Payload ID: 6373 relates to Category No.: 13594, 13589, 3398, 15490, 3398, 1730, 674; Payload ID: 6374 relates to Category No.: 13594, 13589, 3398, 15490, 3398, 1730, 674; Payload ID: 6375 relates to Category No.: 13589, 3398, 15490, 3398; Payload ID: 6376 relates to Category No.: 13594, 13589, 3398, 1730, 8739, 1752, 8731, 3398, 674, 11506, 3398, 15405, 15402, 4939, 15400, 3603, 4943, 14768, 9787; Payload ID: 6377 relates to Category No.: 13594, 13589, 3398, 1730, 7613, 7725, 15517, 674, 5859, 2698, 6111, 10897, 15475, 2444, 8203, 1463, 10574, 1729, 4057; Payload ID: 6378 relates to Category No.: 13589, 3398, 11512, 1730, 15517, 4949, 11506, 3398, 3246, 5406, 1240, 7238, 3577, 6389, 6375, 3620, 13713, 3493, 1551, 16118, 9554, 15999, 7002, 13759, 3580, 1314; Payload ID: 6379 relates to Category No.: 13589, 3398, 11512, 15517, 11506, 3398, 3812, 9540, 4450, 8731, 3398, 4021, 3576, 3573, 3899; Payload ID: 6380 relates to Category No.: 13589, 3398, 15490, 3398, 8731, 3398, 1295, 496; Payload ID: 6381 relates to Category No.: 13589, 3398, 11512, 1730, 674, 11506, 3398, 8169, 15570, 7597, 9086, 7596, 8739, 13594, 15517, 724, 3176, 9480, 757, 4952, 1009, 14398, 16139, 3586, 1578; Payload ID: 6382 relates to Category No.: 13589, 3398, 11512, 15517, 3564, 11506, 3398, 5459; Payload ID: 6383 relates to Category No.: 13594, 13589, 3398, 15490, 3398, 1730, 674; Payload ID: 6384 relates to Category No.: 13589, 3398, 15490, 3398; Payload ID: 6385 relates to Category No.: 13589, 3398, 11512, 1295, 1730, 8739, 674, 274, 5285, 337, 2460, 2459, 14838, 8390, 6145, 9599, 6377, 3819, 8683, 7641, 8158, 6867, 3867, 8006, 2180, 10401, 8090, 4497, 10926, 15517, 3176, 4949, 6108, 8688, 12821; Payload ID: 6386 relates to Category No.: 13589, 3398, 11512, 1730, 15517, 674, 11506, 3398; Payload ID: 6387 relates to Category No.: 13594, 1730, 674, 13589, 3398, 15490, 3398; Payload ID: 6388 relates to Category No.: 13594, 13589, 3398, 15490, 3398, 1730, 674, 7345, 8731, 3398, 11506, 3398, 7735; Payload ID: 6389 relates to Category No.: 13594, 13589, 3398, 11512, 1730, 15517, 674, 15490, 3398; Payload ID: 6390 relates to Category No.: 13594, 13589, 3398, 1730, 674, 15490, 3398, 7306, 4949, 13681, 12190, 9410, 16207, 9770; Payload ID: 6391 relates to Category No.: 13594, 13589, 3398, 1730, 8731, 3398, 10238, 674, 11506, 3398, 792, 10470, 9485, 4037, 6765, 8739, 15517, 11512, 3582, 4149, 4850, 9377; Payload ID: 6392 relates to Category No.: 13589, 3398, 15490, 3398, 11512, 1721, 12619, 1730, 8739, 10372, 8731, 3398, 12633, 15517, 674, 3354, 11506, 3398, 12646, 3313, 14568, 7132, 4336, 12620, 13397, 8662, 7723, 13395, 10533, 16096, 6269, 13863, 13797, 13594; Payload ID: 6393 relates to Category No.: 13594, 1730, 13589, 3398, 15517, 3781, 3012, 9410, 4937, 1249, 12891, 15400, 4998, 1780, 6413, 13558, 3801, 5939, 15197, 7526, 15199, 10706, 6418, 15401, 13324; Payload ID: 6394 relates to Category No.: 13589, 3398, 15490, 3398, 14620; Payload ID: 6395 relates to Category No.: 13589, 3398, 15490, 3398, 8731, 3398, 7150; Payload ID: 6396 relates to Category No.: 13589, 3398, 15490, 3398, 11506, 3398, 14058, 12948, 4952, 16125, 973, 607, 1730, 8930; Payload ID: 6397 relates to Category No.: 13589, 3398, 15490, 3398, 1002, 11512, 795, 1730, 7613, 5446, 8731, 3398, 1955, 10238, 674, 11506, 3398, 4186, 9891, 4127, 4094, 3775, 5541, 8988, 2083, 1853, 2009, 3632, 10256, 7971, 11243, 12813, 2116, 15273, 2005, 8662, 2070, 1938, 11847, 8739, 12646, 1240, 4535, 13397, 7693, 13222, 8954, 12909, 10663, 13594, 13888, 2001, 1951, 3615, 13847; Payload ID: 6398 relates to Category No.: 13594, 13589, 3398, 11512, 11089, 1730, 8739, 5446, 10238, 674, 11506, 3398, 4186, 9891, 4127, 3775, 15782, 8988, 13618, 2083, 10586, 15517, 4535, 13397, 4040, 7693, 13222, 8954, 9378, 9492, 755, 3313, 14566, 5445; Payload ID: 6399 relates to Category No.: 13594, 13589, 3398, 1722, 5446, 15517, 674, 7743, 4186, 7345, 9891, 4127, 3775, 7598, 5541, 8988, 14944, 8634, 7996, 11506, 3398, 7150; Payload ID: 6400 relates to Category No.: 13594, 13589, 3398, 15490, 3398, 1730, 674, 6758, 10501; Payload ID: 6401 relates to Category No.: 13594, 13589, 3398, 15490, 3398, 8731, 3398, 674, 12999, 13925, 3705, 6459, 7214, 10557, 9459, 11391, 7597, 12812, 13634, 9458, 13014, 7642, 2287, 13178, 15212, 5669, 12747, 13099, 13017; Payload ID: 6402 relates to Category No.: 15490, 3398, 8731, 3398, 2243, 1658, 12275, 13589, 3398, 8739, 11634, 2235, 1463, 10574, 14184, 14636, 6375, 4859, 16241, 10983, 10575, 6371, 14697; Payload ID: 6403 relates to Category No.: 13589, 3398, 15490, 3398, 11512, 14038, 1730, 2411, 8731, 3398, 674, 7743, 11506, 3398, 13552, 15197, 8390, 15185, 8129, 7571, 8145, 8611, 8138, 7847, 10735, 8688, 8106, 8149, 8148, 7831, 8681, 8074, 1684, 1678, 571, 8154, 10339, 1678, 569, 7844, 8707, 8739, 13594, 10648, 15207, 8112, 1061, 2878, 8159, 8782, 7373, 1684, 1678, 569, 11319, 11447, 10845, 8072, 11462, 8156, 11543, 12996, 15439, 13685, 15201, 8240, 13047, 10778, 7806, 8190, 15436, 11179, 8128; Payload ID: 6404 relates to Category No.: 13589, 3398, 15490, 3398; Payload ID: 6405 relates to Category No.: 13594, 13589, 3398, 15490, 3398, 1730, 674, 4939; Payload ID: 6406 relates to Category No.: 13589, 3398; Payload ID: 6407 relates to Category No.: 13594, 13589, 3398, 15490, 3398, 1730, 674; Payload ID: 6408 relates to Category No.: 13594, 13589, 3398, 15490, 3398, 1730, 8731, 3398, 674, 8611, 1240, 11051, 8920; Payload ID: 6410 relates to Category No.: 6814, 1874, 14663, 1878, 15310, 5087, 4238, 5088, 5089, 2940; Payload ID: 6411 relates to Category No.: 6814; Payload ID: 6412 relates to Category No.: 296, 5949, 10629, 3041, 10192, 14641, 5071, 6192, 4439, 10194, 16008, 4264; Payload ID: 6413 relates to Category No.: 12137, 5785, 7613, 16172, 1955, 7306, 9379, 5788, 2006, 8508, 10109, 3884, 4283, 5251, 6673, 280, 296; Payload ID: 6414 relates to Category No.: 3639; Payload ID: 6415 relates to Category No.: 1002, 16165, 2459, 2506, 10628, 6721, 16169, 6735, 6754; Payload ID: 6417 relates to Category No.: 11512, 11418; Payload ID: 6418 relates to Category No.: 7567, 1572, 285, 286; Payload ID: 6419 relates to Category No.: 14661, 12648, 2711, 274, 290, 1846, 15045, 1886, 2940; Payload ID: 6420 relates to Category No.: 14661, 2940, 2711, 274, 12640, 1846; Payload ID: 6421 relates to Category No.: 690, 14661, 12648, 1752, 2940, 274, 1846; Payload ID: 6422 relates to Category No.: 4828, 14565, 442, 345, 9052, 2311, 9932, 7252; Payload ID: 6423 relates to Category No.: 4828, 5428, 1703, 2311, 7252; Payload ID: 6424 relates to Category No.: 4828, 14565, 2311, 7252; Payload ID: 6425 relates to Category No.: 7280; Payload ID: 6426 relates to Category No.: 13594, 14038, 10372, 15517, 2311, 1849, 10527, 5443, 13589, 3398, 5406, 1968, 10035, 16240, 11512, 13969, 13936, 13989, 13827, 13815, 10238, 7743, 4145, 13818, 13797, 11363, 13877, 6102, 13864, 10349; Payload ID: 6427 relates to Category No.: 13594, 13589, 3398, 15490, 3398, 1727, 5938, 11512, 11506, 3398, 10626; Payload ID: 6428 relates to Category No.: 1730, 7345, 7735, 7997, 13329, 9410, 11222, 13121, 7999; Payload ID: 6429 relates to Category No.: 15490, 3398, 7613, 8739, 687, 11506, 3398, 1867, 14663, 13874, 13594, 8731, 3398, 9455, 16130, 4954, 964; Payload ID: 6430 relates to Category No.: 7345, 274; Payload ID: 6431 relates to Category No.: 11512; Payload ID: 6432 relates to Category No.: 1816, 14058; Payload ID: 6434 relates to Category No.: 15626; Payload ID: 6435 relates to Category No.: 12091; Payload ID: 6436 relates to Category No.: 13589, 3398, 15490, 3398, 12253, 9287, 8503, 5807, 3356, 6814; Payload ID: 6438 relates to Category No.: 8765, 8760, 7295, 3056, 2169; Payload ID: 6440 relates to Category No.: 8760, 795, 1730, 7345; Payload ID: 6441 relates to Category No.: 8760, 10491; Payload ID: 6442 relates to Category No.: 1714, 2756, 1820; Payload ID: 6443 relates to Category No.: 1703, 1714; Payload ID: 6444 relates to Category No.: 5255, 1714, 4949, 7242, 5458; Payload ID: 6445 relates to Category No.: 1714, 14643, 12137, 7242, 9540, 3595, 6879; Payload ID: 6446 relates to Category No.: 9500, 7613, 10372, 1862, 5848, 14663, 5874, 10362, 4977, 11859, 8567, 2001, 13905, 10991, 12871, 5864, 10929, 11427, 10185, 484, 7122, 9506, 8337, 486, 3565, 8419, 11798; Payload ID: 6447 relates to Category No.: 4828, 10702, 14663, 13004, 3728, 10301, 13843, 5544, 4535, 10801; Payload ID: 6448 relates to Category No.: 4828, 6226, 4094, 10415, 10856, 1794, 7298, 10476, 10205, 1969, 13291, 6139, 12475, 4535; Payload ID: 6449 relates to Category No.: 4828, 5428, 13256, 7658, 439, 10415, 10667, 7298, 10476, 10205, 12985, 1969, 13291; Payload ID: 6450 relates to Category No.: 4828, 7613, 8112, 10583, 12914, 7847, 5265, 3130, 4094; Payload ID: 6451 relates to Category No.: 16286, 10314, 3568; Payload ID: 6452 relates to Category No.: 7306, 1780, 10314, 16286; Payload ID: 6453 relates to Category No.: 4828, 8929, 1483, 1816, 11506, 3398, 1795, 10314, 9091, 11363, 13827, 993, 1485, 1490, 8731, 3398, 9480, 16286, 11285, 7662, 7693, 3791, 16137, 7712, 6757, 7353, 10044, 4943, 2149, 1993, 2088, 6371, 13277; Payload ID: 6454 relates to Category No.: 4828, 1483, 10702, 8929, 12459, 1795, 8049, 2110, 10879, 9092, 16286; Payload ID: 6455 relates to Category No.: 4828, 8929, 1483, 11506, 3398, 1795, 10314, 9091, 11363, 10407, 1816, 9480, 2548, 14455, 5460, 3791, 16137, 6757, 7353, 10044, 4943; Payload ID: 6456 relates to Category No.: 4828, 9091, 8929, 1483, 1795, 7958, 15134, 11085, 8318, 3567, 4937, 8934, 8887, 5459, 11628, 2599, 3896, 6995, 1784; Payload ID: 6457 relates to Category No.: 4828, 8929, 16286, 1483, 11506, 3398, 1795, 11363, 2110, 14061, 7755, 16286, 1424, 16096, 15043, 1240, 14456, 6391, 10879, 6294, 13651, 14064, 4025, 11764, 2241; Payload ID: 6458 relates to Category No.: 4828, 11512, 8929, 1483, 1795, 10314, 2061, 9091, 16287, 13165, 10814, 3568, 11294, 722, 3563, 11451, 14814, 7743, 16286, 690, 1751, 3571, 1312, 15177, 15195, 3573, 5985, 10879, 2397, 12583, 11631, 801, 16095, 12538, 12704; Payload ID: 6459 relates to Category No.: 4828, 1483, 1795, 7693, 9091, 8611, 7306, 4937, 8887, 5459, 10074, 16286, 10038, 3896, 6995, 1784, 3599; Payload ID: 6460 relates to Category No.: 4828, 13589, 3398, 8929, 1483, 11506, 3398, 1795, 10577, 10878, 12606, 11201, 2110, 14949, 7755, 9092, 7904, 6785, 15043, 15195, 14781, 9091, 14632; Payload ID: 6461 relates to Category No.: 4828, 8929, 1483, 1795, 9091, 8739, 11512, 16286, 690, 11285, 15195, 10879; Payload ID: 6462 relates to Category No.: 8862, 4828, 1483, 1795, 9091, 1060, 6103, 8898, 16286; Payload ID: 6463 relates to Category No.: 1483, 10238, 7743, 14640, 8831, 7693, 7735, 9091, 10606, 5459, 2548, 8866, 14790, 7708, 2655, 7729, 8065; Payload ID: 6464 relates to Category No.: 9982, 3791, 4296, 4312; Payload ID: 6465 relates to Category No.: 9982; Payload ID: 6466 relates to Category No.: 1512, 8552, 3100, 4521, 14663, 7735, 4538, 4301, 4305, 11941, 1957, 8035, 12908, 2048; Payload ID: 6467 relates to Category No.: 1512, 3100, 4521, 14663, 4538, 4305; Payload ID: 6468 relates to Category No.: 13589, 3398, 1764, 15490, 3398, 8936, 288; Payload ID: 6469 relates to Category No.: 14318, 7345, 7291, 16182; Payload ID: 6473 relates to Category No.: 14318, 6902, 14314, 6635, 151, 6360, 6632, 151, 6360, 3756; Payload ID: 6474 relates to Category No.: 6902, 2921, 15708, 15714, 14212; Payload ID: 6475 relates to Category No.: 14318, 6902, 14212, 14314, 1780, 3756; Payload ID: 6476 relates to Category No.: 9982, 6814; Payload ID: 6477 relates to Category No.: 4315, 7226, 8375, 4318, 4139; Payload ID: 6478 relates to Category No.: 6814, 4315; Payload ID: 6479 relates to Category No.: 1512, 12063, 1893, 4315, 11660, 4722, 4724; Payload ID: 6480 relates to Category No.: 1512, 4315, 13788, 4724, 12815; Payload ID: 6481 relates to Category No.: 1512, 11930, 4318, 6165; Payload ID: 6482 relates to Category No.: 8862, 11926, 4998, 11930, 3564, 4318, 4167, 16294, 12122, 6165, 2250, 8954; Payload ID: 6483 relates to Category No.: 11930, 4318; Payload ID: 6484 relates to Category No.: 1512, 4318, 11930, 6165; Payload ID: 6485 relates to Category No.: 11930, 12063, 1893, 11660, 4318, 9357, 1815, 6457; Payload ID: 6486 relates to Category No.: 1512, 11930, 4318, 6165; Payload ID: 6487 relates to Category No.: 11930, 4318, 1512, 6165; Payload ID: 6488 relates to Category No.: 11930, 4318, 6165; Payload ID: 6489 relates to Category No.: 11930, 4318, 6165, 1684, 1678, 569, 6146; Payload ID: 6490 relates to Category No.: 12062, 9020, 12063, 1893, 11660, 5406, 9357, 6165, 11932, 9019, 4430, 12891, 1752, 15570, 5592, 12674, 13756, 12413, 6814; Payload ID: 6491 relates to Category No.: 1512, 11930, 4318, 6165, 8862; Payload ID: 6492 relates to Category No.: 8862, 7743, 7345, 12071, 8192, 13354; Payload ID: 6493 relates to Category No.: 12071, 12099, 4711; Payload ID: 6494 relates to Category No.: 15642, 12133, 1874, 14663, 6518, 4322, 5243; Payload ID: 6495 relates to Category No.: 6814, 843, 14663, 1878, 6343, 15834, 825; Payload ID: 6496 relates to Category No.: 6814; Payload ID: 6497 relates to Category No.: 6814; Payload ID: 6498 relates to Category No.: 6814; Payload ID: 6499 relates to Category No.: 7129, 13882; Payload ID: 6500 relates to Category No.: 7129; Payload ID: 6501 relates to Category No.: 12194, 7912, 14558, 13343, 12099, 1780, 9125, 1893, 4020, 16197, 16193, 16202, 16198, 8988, 4021, 2569, 12801, 15570, 11660, 9637, 9674, 10978, 8856, 8231, 8857, 8757, 14404, 9630, 13465, 13087, 10366, 496, 11542; Payload ID: 6502 relates to Category No.: 1764, 8936, 288, 7710, 8779; Payload ID: 6503 relates to Category No.: 13259, 7291, 16182, 14271, 4439, 1922; Payload ID: 6504 relates to Category No.: 12137, 3896, 7743, 7737, 13492, 2459, 9099, 7693, 8887, 4937, 3613, 10439, 3569, 8366, 7987, 724, 11288, 3578, 1579, 756, 2705, 14883, 14884; Payload ID: 6505 relates to Category No.: 15618, 2331, 5846, 13496, 2329, 5848, 7340, 12948, 12592, 11396; Payload ID: 6506 relates to Category No.: 15618, 15626, 5846, 13496, 5848, 14736, 11671, 11676, 14742, 14740, 12633, 12646; Payload ID: 6507 relates to Category No.: 15618, 2331, 5846, 13496, 2329, 5848, 12603; Payload ID: 6508 relates to Category No.: 15618, 5846, 13496, 5848, 11674; Payload ID: 6509 relates to Category No.: 13496, 5846, 5848, 6990, 7684; Payload ID: 6510 relates to Category No.: 15618, 5846, 13496, 5848, 1204; Payload ID: 6511 relates to Category No.: 5846, 13496, 5848, 15618, 13043; Payload ID: 6512 relates to Category No.: 5846, 13496, 5848; Payload ID: 6513 relates to Category No.: 12091, 5367, 5785, 15207, 14565, 1204, 9075, 12041; Payload ID: 6514 relates to Category No.: 12091, 1026, 14661, 5785, 15207, 9720, 3766, 1730, 10074, 15614, 1752, 9717, 5446, 403, 6606, 348, 12498, 1417, 4186, 9891, 12646, 12391, 4127, 4130, 3775, 16197, 14992, 5541, 16085, 8988, 4132, 1238, 15185, 2088, 6145, 6102, 15192, 12750, 11858, 8934, 8004, 12648, 2131, 1795, 11094, 4251, 8508, 10775, 3041, 13837, 3146, 326, 8547, 11275, 2094, 11584, 13827, 8373, 1993, 11187, 7966; Payload ID: 6515 relates to Category No.: 12091, 1730, 15614, 1752, 9717, 5446, 274, 7743; Payload ID: 6516 relates to Category No.: 15626, 10102; Payload ID: 6517 relates to Category No.: 14661, 14565, 10702, 13435, 12648, 2940, 10238, 274, 7306, 803, 13485, 12942, 8988, 9410, 4200; Payload ID: 6518 relates to Category No.: 14661, 10702, 13435, 12648, 2940, 10238, 274, 803, 13485, 12942, 8988, 4200; Payload ID: 6519 relates to Category No.: 14661, 10702, 13435, 12648, 2940, 10238, 274, 803, 13485, 12942, 8988, 4200; Payload ID: 6520 relates to Category No.: 10702, 13435, 14661, 12648, 2940, 10238, 274, 803, 13485, 12942, 8988, 4200, 6018, 6959; Payload ID: 6521 relates to Category No.: 10702, 13435, 12648, 2940, 274, 12942, 4200; Payload ID: 6522 relates to Category No.: 10702, 13435, 12648, 2940, 274, 12942, 4200; Payload ID: 6523 relates to Category No.: 1849; Payload ID: 6529 relates to Category No.: 1204; Payload ID: 6530 relates to Category No.: 1204; Payload ID: 6536 relates to Category No.: 15601, 9420, 7108, 7109, 6814; Payload ID: 6537 relates to Category No.: 9420, 7108, 7111, 14178, 6814; Payload ID: 6538 relates to Category No.: 14565, 9982; Payload ID: 6540 relates to Category No.: 1204; Payload ID: 6541 relates to Category No.: 7291, 16182; Payload ID: 6543 relates to Category No.: 8454; Payload ID: 6545 relates to Category No.: 1204; Payload ID: 6546 relates to Category No.: 4969; Payload ID: 6547 relates to Category No.: 1204; Payload ID: 6548 relates to Category No.: 1721, 9296, 3354, 5912, 5407, 15533, 8049, 4485, 9296, 3311, 2792; Payload ID: 6549 relates to Category No.: 1721, 8739, 2410, 5912, 5407, 8192, 8049; Payload ID: 6550 relates to Category No.: 8936; Payload ID: 6552 relates to Category No.: 4828, 1793, 12538; Payload ID: 6553 relates to Category No.: 4828, 11512, 5428, 1721, 7725, 14967, 5446, 10372, 10238, 7743, 10209, 8946, 11602, 10366, 2945, 11285, 10648, 11097, 8112, 2136, 2088, 10486, 10955, 7971, 11187, 10583, 8004, 11322, 10801, 10470, 5786, 11323, 10588, 10600, 11087, 10309, 1964, 1984, 791, 10567, 10687, 8215, 10552, 10798, 9171, 8205, 7006, 7886, 11593, 2059; Payload ID: 6554 relates to Category No.: 4828, 8962, 15149, 4828, 2745; Payload ID: 6555 relates to Category No.: 4828, 1816, 432; Payload ID: 6556 relates to Category No.: 2506; Payload ID: 6558 relates to Category No.: 4828, 5544; Payload ID: 6559 relates to Category No.: 4828, 1836; Payload ID: 6560 relates to Category No.: 4828, 434, 4332, 7999; Payload ID: 6561 relates to Category No.: 4828; Payload ID: 6565 relates to Category No.: 4828, 8962, 9932; Payload ID: 6566 relates to Category No.: 4828, 434; Payload ID: 6567 relates to Category No.: 4828; Payload ID: 6568 relates to Category No.: 4828, 14565, 8962, 16214, 9891, 6714, 6713, 4062, 1453, 12577, 6711, 13120, 13119; Payload ID: 6569 relates to Category No.: 4828, 434; Payload ID: 6570 relates to Category No.: 4828; Payload ID: 6571 relates to Category No.: 4828, 8962, 15149, 4828, 2745, 755, 11685, 8427; Payload ID: 6572 relates to Category No.: 4828, 15202; Payload ID: 6573 relates to Category No.: 4828; Payload ID: 6574 relates to Category No.: 4828, 434; Payload ID: 6575 relates to Category No.: 4828; Payload ID: 6576 relates to Category No.: 4828; Payload ID: 6577 relates to Category No.: 15618, 5785, 2562; Payload ID: 6578 relates to Category No.: 4828; Payload ID: 6579 relates to Category No.: 4828, 1795; Payload ID: 6580 relates to Category No.: 4828, 12041, 12931; Payload ID: 6581 relates to Category No.: 4828; Payload ID: 6582 relates to Category No.: 4828, 7306, 14451, 13492, 10209, 10309, 8640; Payload ID: 6583 relates to Category No.: 4828; Payload ID: 6584 relates to Category No.: 4828, 2303; Payload ID: 6585 relates to Category No.: 4828, 4819, 8349; Payload ID: 6586 relates to Category No.: 4828, 14565, 8377, 1989; Payload ID: 6587 relates to Category No.: 4828, 434, 15197; Payload ID: 6588 relates to Category No.: 4828, 15149; Payload ID: 6589 relates to Category No.: 4828, 12041; Payload ID: 6590 relates to Category No.: 4828; Payload ID: 6591 relates to Category No.: 4828, 13985; Payload ID: 6592 relates to Category No.: 4828, 5785, 1795, 13882; Payload ID: 6593 relates to Category No.: 4828, 5367, 403, 10266, 5285, 434, 10583, 1054, 6639; Payload ID: 6594 relates to Category No.: 4828, 1795; Payload ID: 6595 relates to Category No.: 4828; Payload ID: 6596 relates to Category No.: 4828, 14451, 10209, 11051, 4535, 8117; Payload ID: 6597 relates to Category No.: 4828, 2000, 13980; Payload ID: 6598 relates to Category No.: 4828; Payload ID: 6599 relates to Category No.: 4828, 434, 13376, 11294; Payload ID: 6600 relates to Category No.: 4828, 14565, 10802, 11192; Payload ID: 6601 relates to Category No.: 4828, 434, 13116; Payload ID: 6602 relates to Category No.: 4828; Payload ID: 6603 relates to Category No.: 4828; Payload ID: 6604 relates to Category No.: 4828; Payload ID: 6605 relates to Category No.: 4828, 4819; Payload ID: 6606 relates to Category No.: 4828; Payload ID: 6607 relates to Category No.: 4828, 439, 10955, 8095, 3425, 6294, 10529; Payload ID: 6608 relates to Category No.: 4828, 439, 10955, 8095, 8375, 8639, 7625, 10405; Payload ID: 6609 relates to Category No.: 4828, 13126, 11323, 4535, 2156, 10801, 10802, 13071, 2353, 481, 3243, 4412, 8002; Payload ID: 6610 relates to Category No.: 4828; Payload ID: 6611 relates to Category No.: 4828; Payload ID: 6612 relates to Category No.: 4828; Payload ID: 6613 relates to Category No.: 4828, 1816, 1795; Payload ID: 6614 relates to Category No.: 4828, 14451, 10209; Payload ID: 6615 relates to Category No.: 4828, 1277, 1481, 10583, 8424, 355, 11339; Payload ID: 6616 relates to Category No.: 4828, 10486, 14880; Payload ID: 6617 relates to Category No.: 4828, 1204; Payload ID: 6618 relates to Category No.: 4828, 1204; Payload ID: 6619 relates to Category No.: 4828, 1204; Payload ID: 6620 relates to Category No.: 4828, 5367, 795, 7306, 337, 275, 11418, 10309, 13765; Payload ID: 6621 relates to Category No.: 4828, 5428, 8326, 10801, 10802, 2090, 11149; Payload ID: 6622 relates to Category No.: 4828, 2303, 1795, 13228; Payload ID: 6623 relates to Category No.: 4828, 434; Payload ID: 6624 relates to Category No.: 4828; Payload ID: 6625 relates to Category No.: 4828, 8962, 1795, 13859; Payload ID: 6626 relates to Category No.: 4828, 8962, 1204, 9932; Payload ID: 6627 relates to Category No.: 4828, 14565; Payload ID: 6628 relates to Category No.: 4828, 7581, 1204, 4819; Payload ID: 6629 relates to Category No.: 4828, 1795, 8946, 8920, 6296; Payload ID: 6630 relates to Category No.: 12137, 14565, 12491, 10775, 5848, 5780; Payload ID: 6631 relates to Category No.: 13041, 12137, 5848; Payload ID: 6632 relates to Category No.: 3699, 4822; Payload ID: 6634 relates to Category No.: 12091, 12931, 16214, 11858, 10005, 16211, 14111, 13437, 7613, 11201, 13921, 9995, 11641; Payload ID: 6635 relates to Category No.: 12091, 12931, 10005, 16211, 14111, 13437, 12409, 3111, 4826; Payload ID: 6636 relates to Category No.: 12091, 795, 12619, 442, 7613, 16286, 10372, 12931, 15214, 11858, 4094, 13827, 3111; Payload ID: 6637 relates to Category No.: 12091, 14565, 16286, 12931, 3111, 7599; Payload ID: 6638 relates to Category No.: 12091, 16214, 11858, 10005, 16211, 14111, 13437; Payload ID: 6639 relates to Category No.: 1026, 10702, 3766, 12931, 12743; Payload ID: 6640 relates to Category No.: 10702, 12931, 1119; Payload ID: 6641 relates to Category No.: 4828, 14565, 7934; Payload ID: 6642 relates to Category No.: 4828, 11091, 11296, 10775, 360, 10314, 10790, 10945, 4535, 11094, 6296, 11265, 11285; Payload ID: 6643 relates to Category No.: 4828; Payload ID: 6644 relates to Category No.: 4828; Payload ID: 6645 relates to Category No.: 4828, 13773, 1451; Payload ID: 6646 relates to Category No.: 1867, 14663, 4039, 10600; Payload ID: 6647 relates to Category No.: 12053, 4332, 9223, 9103, 2923, 6814; Payload ID: 6648 relates to Category No.: 15588, 1721, 15604, 1893, 4439, 9223, 9103, 2923; Payload ID: 6649 relates to Category No.: 6986, 3313, 14567; Payload ID: 6650 relates to Category No.: 795, 12096, 1227, 8175, 12153; Payload ID: 6651 relates to Category No.: 13589, 3398, 11512, 1730, 15517, 9420, 7122, 8739, 13594, 5406, 8266; Payload ID: 6652 relates to Category No.: 13594, 15490, 3398, 11512, 9420, 7122; Payload ID: 6653 relates to Category No.: 15490, 3398, 11512; Payload ID: 6654 relates to Category No.: 15149, 998, 9246, 6733, 7129, 6451, 12122, 4041, 6969, 12137; Payload ID: 6655 relates to Category No.: 998, 9246, 6733, 7129, 6451; Payload ID: 6656 relates to Category No.: 12137, 1002, 998, 2073, 9246, 6733, 5798, 7129, 6451, 10250, 8502; Payload ID: 6657 relates to Category No.: 1512, 14663, 1514, 4353, 4352, 4348; Payload ID: 6658 relates to Category No.: 1512, 1514, 4353; Payload ID: 6659 relates to Category No.: 6814, 1512, 14663, 4723, 5932, 5931; Payload ID: 6660 relates to Category No.: 1512, 4538, 4353, 5045; Payload ID: 6661 relates to Category No.: 4353, 1512, 14663, 4352, 15930; Payload ID: 6662 relates to Category No.: 12062, 14838, 7369, 4357, 1207; Payload ID: 6664 relates to Category No.: 12190, 9359, 15090, 7226, 10138; Payload ID: 6665 relates to Category No.: 1816, 12190, 4715, 9359, 15090; Payload ID: 6666 relates to Category No.: 1512, 4724, 4732, 14865, 14663, 9359, 4729, 8392, 4728, 8394; Payload ID: 6667 relates to Category No.: 1512, 14865, 12063, 1893, 14663, 3405, 1838, 11660, 4723, 4722, 5932, 4729, 5931, 4352; Payload ID: 6668 relates to Category No.: 1512; Payload ID: 6669 relates to Category No.: 1512; Payload ID: 6670 relates to Category No.: 1512; Payload ID: 6671 relates to Category No.: 1512, 4358, 14865, 14663, 4729; Payload ID: 6672 relates to Category No.: 4828, 11512, 442, 8962, 3244, 7581, 10486, 10458, 434; Payload ID: 6673 relates to Category No.: 4828, 11512, 442, 8962, 15149, 3244, 7306, 1795, 7581, 4132, 7340, 9932, 10486, 6103, 10892, 8936, 434, 9862, 5501; Payload ID: 6674 relates to Category No.: 4828, 11512, 442, 8962, 15149, 7581, 4132, 9932, 6103; Payload ID: 6675 relates to Category No.: 11512, 8962, 1477, 5544, 10892, 11976, 10458, 10330, 8596, 8862, 5428, 13888, 13827, 13836, 10238, 7743, 13883, 4132, 8240, 12907; Payload ID: 6676 relates to Category No.: 8962, 3013, 1204, 1120, 12500, 13874, 13888; Payload ID: 6680 relates to Category No.: 1730, 4367, 14838, 3448, 3566, 11997; Payload ID: 6681 relates to Category No.: 1730, 7306, 14838; Payload ID: 6682 relates to Category No.: 15618, 15626, 5846, 15149, 13126, 2329, 4375, 5848, 8911, 13827, 15149, 4342, 1999, 14565; Payload ID: 6683 relates to Category No.: 15618, 15626, 5846, 15149, 8979, 13237, 13126, 2329, 4375, 5848, 8911, 13827, 14565, 2331; Payload ID: 6684 relates to Category No.: 15618, 15626, 5846, 15149, 13126, 2329, 4375, 5848, 8911, 13827; Payload ID: 6685 relates to Category No.: 15618, 15626, 5846, 15149, 13126, 2329, 4375, 5848, 8911, 13827, 2169, 13421; Payload ID: 6686 relates to Category No.: 15618, 15626, 14565, 5846, 15149, 13126, 2329, 4375, 5848, 8911, 13827, 7131, 10491, 5460, 8928, 14456, 5465, 8373, 1112, 13227, 901, 2547, 1295, 2331; Payload ID: 6687 relates to Category No.: 15618, 15626, 14565, 5846, 15149, 13126, 2329, 4375, 5848, 8911, 13827, 2331; Payload ID: 6688 relates to Category No.: 15626, 5846, 15618, 14565, 15149, 13126, 2329, 5848, 8911, 1999, 14025, 2176, 13989, 9490; Payload ID: 6689 relates to Category No.: 15618, 15626, 5846, 15149, 13126, 2329, 4375, 5848, 8911, 1999, 15149, 4342, 14565, 5460, 8928, 14456, 5465, 8373, 8374, 13227, 2547; Payload ID: 6690 relates to Category No.: 15618, 15626, 14565, 5846, 15149, 13126, 2329, 5848, 8911, 9540, 1999, 5460, 8928, 14456, 5465, 8373, 8374, 13227, 5440, 2547; Payload ID: 6691 relates to Category No.: 15626, 14565, 15149, 13126, 2329, 5848, 8911; Payload ID: 6692 relates to Category No.: 15626, 15149, 13126, 2329, 4375, 5848, 8911, 13827; Payload ID: 6693 relates to Category No.: 15626, 15149, 13126, 2329, 4375, 5848, 8911, 13827; Payload ID: 6694 relates to Category No.: 15618, 15626, 5846, 15149, 13126, 2329, 5848, 8911, 13827, 1999, 15149, 4342, 11634, 480, 4375, 2331; Payload ID: 6695 relates to Category No.: 15618, 15626, 5846, 15149, 13126, 2329, 4375, 5848, 8911, 13827, 2331; Payload ID: 6696 relates to Category No.: 15626, 14565, 5846, 5848, 15149, 13126, 2329, 8911; Payload ID: 6697 relates to Category No.: 15618, 15626, 5846, 15149, 13126, 2329, 4375, 5848, 8911; Payload ID: 6698 relates to Category No.: 15618, 15626, 14565, 5846, 15149, 13126, 2329, 5848, 8911, 16214, 4375; Payload ID: 6699 relates to Category No.: 15618, 15626, 5846, 15149, 2329, 4375, 5848; Payload ID: 6700 relates to Category No.: 15618, 15626, 14565, 5846, 15149, 8979, 13126, 2329, 5848, 8911; Payload ID: 6701 relates to Category No.: 4828, 15149, 7581, 4375, 439, 13837, 7743, 13961, 9455, 7935, 7894, 10674, 10699, 8672, 12916, 12579, 8000; Payload ID: 6702 relates to Category No.: 4828, 15149, 7581, 4375; Payload ID: 6703 relates to Category No.: 1894, 1893, 1238, 11660, 9674; Payload ID: 6704 relates to Category No.: 12194, 4595, 15314, 13888, 13827, 13837, 14054; Payload ID: 6705 relates to Category No.: 1876; Payload ID: 6706 relates to Category No.: 4609, 16308, 14663, 13692, 4612; Payload ID: 6707 relates to Category No.: 16308, 1830, 4615, 12999, 6153, 14838, 4609, 14663, 815, 4612, 4576, 16342, 12995, 6154, 4610, 2840; Payload ID: 6708 relates to Category No.: 4615, 16308, 6153, 4609, 14663, 4612; Payload ID: 6709 relates to Category No.: 12194, 1830, 4615, 6153, 4609, 14663, 815, 6154, 5428; Payload ID: 6710 relates to Category No.: 12194, 4615, 6153, 4609; Payload ID: 6711 relates to Category No.: 12194, 4615, 6153, 4609; Payload ID: 6712 relates to Category No.: 4615, 6153; Payload ID: 6713 relates to Category No.: 4615, 6153; Payload ID: 6714 relates to Category No.: 4615, 6153; Payload ID: 6715 relates to Category No.: 13386, 10273; Payload ID: 6716 relates to Category No.: 4615, 12127, 7045, 7043, 14000; Payload ID: 6717 relates to Category No.: 4615; Payload ID: 6718 relates to Category No.: 14000; Payload ID: 6719 relates to Category No.: 15626, 14565, 5846, 1816, 1714, 10775, 7735, 6738, 7340, 1717, 4403, 1716, 963, 5406, 1249, 8934, 10648, 8004, 13664, 4952, 4949, 9455, 3587, 3578, 12948, 6111, 482, 14638, 1814, 12553, 11147, 3795, 1547, 12513, 13663, 12554, 1715, 11423, 971, 7003, 15618, 11243, 2051, 7743, 13860, 7924, 10486, 11601, 13981, 8940, 12573, 13983, 795, 2431, 12066, 12953, 11602, 10801, 3725, 10271, 10655, 16093, 10347, 936, 13846, 7701, 8835, 7880, 12538; Payload ID: 6720 relates to Category No.: 15149, 1714, 4367, 15618, 15140, 3140, 13921; Payload ID: 6721 relates to Category No.: 15618, 15626, 1816, 16214, 1714, 13983, 13877; Payload ID: 6722 relates to Category No.: 15626, 1714, 1812, 1240, 1417, 1816, 3725, 13978; Payload ID: 6723 relates to Category No.: 690, 1714, 12594, 9480, 860, 12513, 1717, 4403, 16136, 7176, 12235, 967, 1007, 1344, 12520, 12567, 13389, 12512, 13664, 16129, 12954, 1240, 14640, 3587, 3595, 16137, 968, 13541, 1547, 13663, 14336, 1006, 13661, 971, 1548, 13123, 13715, 14469, 4247, 1718, 13413, 11676, 15618, 11601, 7658, 4949, 12066, 11602, 3725, 10347, 1716, 8011, 1715, 16107; Payload ID: 6724 relates to Category No.: 15626, 16214, 1714, 1463, 6111, 15618, 11940, 1816; Payload ID: 6725 relates to Category No.: 1714; Payload ID: 6726 relates to Category No.: 8862, 15626, 1816, 1714, 6738, 4403, 15618, 12066, 12264; Payload ID: 6727 relates to Category No.: 15626, 14456, 1714, 6738, 4403, 1816, 15618, 13835, 13876, 13989, 4145, 2083, 3010, 6523; Payload ID: 6728 relates to Category No.: 15618, 1714, 10036, 14643, 14456, 5406; Payload ID: 6729 relates to Category No.: 1714, 14455, 9331; Payload ID: 6730 relates to Category No.: 3781, 1714, 5987, 15740, 14920; Payload ID: 6731 relates to Category No.: 1714, 14456, 3520, 1984, 13925, 496, 7743, 13829, 795, 5458; Payload ID: 6732 relates to Category No.: 1714; Payload ID: 6733 relates to Category No.: 15618, 15149, 1714, 16214, 1816, 325; Payload ID: 6734 relates to Category No.: 1714, 4403, 5846, 13860; Payload ID: 6735 relates to Category No.: 1714, 13454; Payload ID: 6736 relates to Category No.: 1714, 9408, 6111, 1764; Payload ID: 6737 relates to Category No.: 1714, 15626, 15149, 6738, 7340, 1812, 4403, 963, 16214, 16096, 1816, 4949, 5846, 1729, 1567; Payload ID: 6738 relates to Category No.: 1714, 1816, 14025, 15618; Payload ID: 6739 relates to Category No.: 1714, 14456, 7369; Payload ID: 6740 relates to Category No.: 14318, 1649, 12224, 14177, 15261; Payload ID: 6741 relates to Category No.: 795; Payload ID: 6743 relates to Category No.: 1204; Payload ID: 6744 relates to Category No.: 1968; Payload ID: 6745 relates to Category No.: 14565, 1893, 13004, 483, 4004, 6758, 14454, 3632, 13967, 13969, 6323, 13827, 14009, 13773, 13860, 4145, 11436, 13981, 13799, 13923, 15662, 13787, 10801, 14004, 3245, 10669, 10313, 13765, 10660; Payload ID: 6746 relates to Category No.: 4828, 1795, 328, 4414, 4448, 13966, 3632, 13796, 13860, 3111, 10486, 10309, 13843, 13787, 10801; Payload ID: 6747 relates to Category No.: 14663, 2541, 2540, 16234, 16275, 2544; Payload ID: 6748 relates to Category No.: 4828, 14565, 13851; Payload ID: 6749 relates to Category No.: 14565, 8962; Payload ID: 6750 relates to Category No.: 4828, 1780, 1268, 12646; Payload ID: 6751 relates to Category No.: 3244, 10359; Payload ID: 6753 relates to Category No.: 13589, 3398, 15490, 3398, 8930, 484, 14886, 11798, 14446; Payload ID: 6754 relates to Category No.: 8862, 13589, 3398, 15517, 11512, 2235, 1026, 5459, 1780, 5066, 8869, 9600, 2223, 15763, 6997, 15325, 4256, 995, 14112, 7000; Payload ID: 6755 relates to Category No.: 13589, 3398, 11512, 7613, 8739, 15517, 4949, 3854, 6667, 11506, 3398, 3246, 6530, 1238, 8753, 3853, 10075, 11178, 15424, 9410, 7966, 10586, 2128, 10086, 12926, 12751, 1103, 3759, 3760, 15527, 5406, 1816, 7743, 7372, 3592, 1729, 11148, 7664, 3049; Payload ID: 6756 relates to Category No.: 13589, 3398, 15490, 3398, 11512, 9777, 4949, 3246, 1238, 7971, 11182, 15424, 7972, 9410, 10226, 8402, 3760, 8367, 8739, 15517, 1730, 14782, 5243, 16023, 8930, 5459, 8929, 3023, 8349, 1751, 10034, 1743, 2176, 16124, 2602, 3605, 10586, 1731, 10968, 8249, 12968, 14436, 4343, 12884, 11182, 3729, 10486, 11091, 13923, 8934, 6615, 4998; Payload ID: 6757 relates to Category No.: 13589, 3398, 11512, 15207, 14565, 14038, 1741, 5446, 8731, 3398, 9854, 674, 4949, 7743, 11506, 3398, 2011, 16041, 11452, 11371, 3012, 3246, 9786, 6530, 8112, 2136, 1238, 7724, 15464, 7971, 12736, 5949, 11266, 10845, 10833, 7919, 1743, 9410, 13836, 10557, 6812, 7740, 6785, 11536, 15135, 11490, 9110, 2020, 761, 1578, 16136, 8254, 3519, 673, 16007, 1486, 11590, 8846, 8845, 13219, 6414, 7747, 10849, 12675, 7988, 8010, 8739, 13594, 15517, 5406, 11634, 13713, 8934, 1026, 10475, 10648, 5459, 9465, 8004, 8929, 15400, 5242, 5285, 3592, 15388, 1751, 3854, 6111, 1948, 3194, 1764, 8862, 13227, 3602, 13232, 10358, 12835, 15195, 8129, 12976, 5609, 1918, 5697, 15194, 9580, 12610, 575, 8149, 15335, 1701, 11827, 10832, 10848, 16001, 9583, 6616, 12973, 13827, 13837, 13856, 15829; Payload ID: 6758 relates to Category No.: 13589, 3398, 11506, 3398, 11512, 1741, 1816, 15517, 1729, 6530, 1238, 13827, 4952, 3641, 10226, 11595, 3586, 3620, 1578, 16136, 673, 1585, 969, 970, 3583, 10327, 968, 5755, 13594, 5406, 4419, 3642, 12891, 14838, 13836, 4949, 979, 3587, 14656, 1483, 14442, 3577, 1567, 1557, 3598, 14577, 1257, 1565, 1988, 1974, 15763, 16132, 14521, 12593, 10321, 6382, 3794, 15536, 1984, 13936, 14040, 1747, 10286, 7635, 12591; Payload ID: 6759 relates to Category No.: 13589, 3398, 11512, 1741, 15517, 1729, 4949, 11506, 3398, 1238, 9410, 673, 5755, 1918; Payload ID: 6760 relates to Category No.: 13589, 3398, 11512, 7613, 8739, 1741, 8731, 3398, 15517, 1729, 11506, 3398, 1893, 6530, 1238, 13827, 10286, 2006, 10350, 9481, 10226, 13865, 8757, 8758, 5755, 14688, 1582, 5406, 12891, 13836, 6269, 3643, 9945, 6387, 1567, 1557, 9554, 3791, 3645, 15824, 10327, 1565, 1988, 15806, 1918, 15763, 10321, 9407, 2487, 9557; Payload ID: 6761 relates to Category No.: 13589, 3398; Payload ID: 6762 relates to Category No.: 13589, 3398, 15490, 3398, 8739, 8731, 3398, 3337, 5406, 1240, 3569, 11765, 8876, 721; Payload ID: 6763 relates to Category No.: 13589, 3398, 15490, 3398, 952, 8739, 3337; Payload ID: 6767 relates to Category No.: 15588, 1905, 13618, 11523, 2036; Payload ID: 6768 relates to Category No.: 15490, 3398, 11506, 3398, 13589, 3398; Payload ID: 6769 relates to Category No.: 13589, 3398, 15490, 3398, 11506, 3398; Payload ID: 6770 relates to Category No.: 13589, 3398, 15490, 3398, 8739, 8731, 3398, 14913; Payload ID: 6771 relates to Category No.: 1026, 1795, 4482, 8862; Payload ID: 6772 relates to Category No.: 15614, 8862, 11368, 8506, 4482; Payload ID: 6773 relates to Category No.: 8862, 14565, 9738, 8934, 1026, 8928, 15135; Payload ID: 6774 relates to Category No.: 8420, 4482; Payload ID: 6775 relates to Category No.: 7966, 8373, 15004; Payload ID: 6776 relates to Category No.: 15490, 3398, 8739, 8731, 3398, 1318; Payload ID: 6777 relates to Category No.: 14661, 12137, 14565, 10702, 12361, 13485, 8543, 7640, 13796, 12603; Payload ID: 6778 relates to Category No.: 14661, 12137, 14565, 10702, 13485, 16172, 12603; Payload ID: 6779 relates to Category No.: 10702, 4538, 6814; Payload ID: 6780 relates to Category No.: 9125, 4436, 2989; Payload ID: 6781 relates to Category No.: 1207, 12063, 1893, 4435, 3405, 11660; Payload ID: 6782 relates to Category No.: 1207, 12063, 1893, 4435, 3405, 11660; Payload ID: 6783 relates to Category No.: 795, 2460, 14475, 296, 290, 1078, 287, 9777, 3729, 11765, 10648, 1893, 10194, 283, 10471, 1844, 8817, 288, 15009, 11912, 13323, 13709, 5016, 10880, 13682, 14927, 12842, 13317, 13400, 11289, 663, 16172, 9891, 16294, 496, 13837, 12614, 297, 13849, 15427, 9349, 1920; Payload ID: 6784 relates to Category No.: 7288, 14271, 14915, 4439, 14913, 14271, 16183, 7546; Payload ID: 6785 relates to Category No.: 14318, 14915, 4439, 7546; Payload ID: 6786 relates to Category No.: 7291, 16182, 14915, 11884, 4439, 7546; Payload ID: 6787 relates to Category No.: 14913, 7291, 16182, 14915, 4439, 7546; Payload ID: 6788 relates to Category No.: 7291, 16182, 14915, 4439, 7546; Payload ID: 6789 relates to Category No.: 14915; Payload ID: 6790 relates to Category No.: 14661, 5785, 14565, 10702, 13485, 8049, 7131, 10491; Payload ID: 6791 relates to Category No.: 1721, 1780, 3360, 3356; Payload ID: 6792 relates to Category No.: 8731, 3398, 12775, 7132, 7890, 7724, 11884, 9410; Payload ID: 6793 relates to Category No.: 9228, 3452, 3354, 3448, 12682, 13744, 11029, 13745; Payload ID: 6794 relates to Category No.: 13589, 3398, 15499, 15517, 15521, 4439, 16197; Payload ID: 6795 relates to Category No.: 15521, 13589, 3398, 15517, 2562; Payload ID: 6796 relates to Category No.: 15499, 11512, 15517, 14257, 15521, 4439, 16197, 11363; Payload ID: 6797 relates to Category No.: 13589, 3398, 15499, 15517, 15521, 4439, 16197, 3399, 5443; Payload ID: 6798 relates to Category No.: 13594, 15499, 15517, 15521, 4439, 16197, 15529; Payload ID: 6799 relates to Category No.: 13589, 3398, 15499, 15517, 15521, 4439, 16197; Payload ID: 6800 relates to Category No.: 10331, 15499, 14038, 15517, 7291, 16182, 14271, 15521, 4439, 16197, 11509, 182, 11611, 11512; Payload ID: 6801 relates to Category No.: 15499, 15517, 7291, 16182, 14271, 15521, 4439, 16197, 11509, 182, 11611, 11531, 11512, 11344; Payload ID: 6802 relates to Category No.: 12091, 15499, 11512, 15516, 9296, 15517, 3354, 12732, 15521, 4439, 16197, 182, 12891, 3783, 15533, 11611, 8004, 3783, 15520, 15498, 15290, 9296, 3327, 4485, 15490, 3398; Payload ID: 6803 relates to Category No.: 12091, 15588, 13589, 3398, 15499, 15490, 3398, 15516, 9296, 15517, 3354, 14034, 15521, 4439, 16197, 182, 12891, 3783, 15533, 11611, 8004, 3783, 15520, 15498, 15290, 9296, 3327, 4826, 4485; Payload ID: 6804 relates to Category No.: 13589, 3398, 9296, 9983, 15588, 15499, 15516, 15517, 3354, 15521, 4439, 16197, 182, 12891, 3783, 15533, 11611, 8004, 3783, 15520, 15498, 15290, 9296, 3327, 4485; Payload ID: 6805 relates to Category No.: 15499, 15516, 9296, 15517, 3354, 3320, 9983, 15521, 4439, 16197, 182, 12891, 3783, 15533, 11611, 8004, 3783, 15520, 15498, 15290, 9296, 3327, 4485; Payload ID: 6806 relates to Category No.: 13589, 3398, 15499, 15516, 9296, 15517, 3354, 15521, 4439, 16197, 182, 12891, 3783, 15533, 11611, 8004, 3783, 15520, 15498, 15290, 9296, 3327, 4485, 14318, 1978, 9296, 11694; Payload ID: 6807 relates to Category No.: 13589, 3398, 14565, 15517, 15521, 7598, 15582, 7855; Payload ID: 6808 relates to Category No.: 13589, 3398, 15518, 14320, 4439; Payload ID: 6809 relates to Category No.: 15490, 3398, 15518, 14320, 4439, 15722, 167, 15723; Payload ID: 6810 relates to Category No.: 15490, 3398, 15518, 4439, 167, 15723; Payload ID: 6811 relates to Category No.: 15490, 3398, 15518, 4439, 167, 15723; Payload ID: 6812 relates to Category No.: 10331, 5095, 15490, 3398, 15522, 15518, 4439, 167, 15723; Payload ID: 6813 relates to Category No.: 15490, 3398, 15518, 4439, 167, 15723, 14620; Payload ID: 6814 relates to Category No.: 15490, 3398, 15518, 167, 15723; Payload ID: 6815 relates to Category No.: 14663, 7207, 7196, 4675, 16234, 16275, 7200, 3917; Payload ID: 6816 relates to Category No.: 5898, 14663, 2347, 5899, 4454, 4455, 4083; Payload ID: 6818 relates to Category No.: 12091, 5785, 7158, 12010, 2192, 13505, 5179; Payload ID: 6819 relates to Category No.: 1730, 7306, 14838, 13589, 3398; Payload ID: 6820 relates to Category No.: 12532, 8239; Payload ID: 6822 relates to Category No.: 1204; Payload ID: 6823 relates to Category No.: 4828, 7613, 345, 4411, 11431, 11296, 5268, 12646, 297, 1893, 7598, 8112, 4538, 13422, 13874, 10486, 3038, 10801, 7924, 13836, 3010, 8133, 1622, 10698, 11051, 4873, 10699, 481, 10242, 7811, 13697, 10458, 8158, 8781, 2735, 10442, 9102, 10455, 8118, 11333; Payload ID: 6826 relates to Category No.: 12154, 12153; Payload ID: 6828 relates to Category No.: 7132, 3369, 3356, 5453; Payload ID: 6829 relates to Category No.: 3356, 3320, 7132, 3450, 7146, 3369; Payload ID: 6830 relates to Category No.: 7132, 3369; Payload ID: 6831 relates to Category No.: 3320, 3360, 3450, 7132, 3369, 5453; Payload ID: 6832 relates to Category No.: 4828, 15149, 10481, 13530, 12122, 13376, 8503, 11542, 4581, 3713; Payload ID: 6833 relates to Category No.: 1204; Payload ID: 6835 relates to Category No.: 12137, 7280, 10117; Payload ID: 6836 relates to Category No.: 15490, 3398, 11512, 10372, 11506, 3398, 14699, 13492, 7693, 10366, 10522, 9455, 3247, 3769, 11394, 3445, 14838, 6375, 10034, 13277, 12213, 16122, 2216, 14701, 9132; Payload ID: 6837 relates to Category No.: 1026, 11512, 8739, 9321, 4949, 11506, 3398, 14699, 8928, 14640, 1780, 11453, 6559, 9454, 9599, 5949, 2145, 12213, 10522, 5066, 1320, 9455, 6375, 10034, 3576, 15761, 3769, 16122, 5070, 4218, 14884, 16123, 2216, 14703, 14891, 3194, 15517, 1730, 5406, 3445, 673, 4946, 11091, 7613, 672, 2548, 10372, 3578, 7242, 2079, 13492, 14886, 3444, 6560, 14700, 2376, 8888, 11826, 14702, 14701, 7799, 9132, 13936; Payload ID: 6838 relates to Category No.: 11512, 8739, 8731, 3398, 15517, 11506, 3398, 14699, 7693, 6194, 3578, 8639, 10218, 3576, 15195, 9121, 8840, 7590, 15399, 13589, 3398, 12646, 5406, 5949, 9599, 724, 3445, 12891, 673, 1026, 8375, 7743, 12099, 1463, 8930, 7613, 6878, 1318, 3613, 672, 15459, 4949, 2169, 6375, 4251, 12498, 1295, 9540, 6559, 3194, 5458, 3577, 1320, 6705, 7730, 15247, 14886, 3595, 14700, 1734, 5073, 4259, 3598, 12628, 11147, 6082, 9350, 9321, 11085, 9397, 9542, 4252, 6192, 1464, 8888, 12213, 10429, 5070, 14884, 14703, 14702, 15761, 11259, 15035, 2249, 6068, 4294, 6014, 14356, 6569, 859, 725, 6076, 16294, 13836; Payload ID: 6839 relates to Category No.: 13589, 3398, 1204; Payload ID: 6840 relates to Category No.: 1867, 14663; Payload ID: 6841 relates to Category No.: 1202; Payload ID: 6843 relates to Category No.: 10583, 10573, 10578; Payload ID: 6844 relates to Category No.: 7623, 12091, 10331, 8862, 14565, 7834, 6102, 6296; Payload ID: 6845 relates to Category No.: 12461, 7623, 12091, 10331, 7834; Payload ID: 6846 relates to Category No.: 8862, 1026, 11512, 14565, 7613, 10372, 12891, 8373, 3737, 8936, 483, 8869, 7292, 10358, 12782, 7966, 6878, 1318, 10292, 15135, 9744, 11042, 10531, 13179, 11590, 11645, 13507, 16005, 9738, 9409, 6787, 16007, 10987, 11655; Payload ID: 6847 relates to Category No.: 13589, 3398, 11512, 15517, 674, 1312, 1733, 910, 11443; Payload ID: 6848 relates to Category No.: 13589, 3398, 15490, 3398, 7306, 1836, 9580, 1880; Payload ID: 6849 relates to Category No.: 8378, 4021, 5732, 6323, 1128, 907, 5734, 8941, 11356, 13239, 14050, 10652; Payload ID: 6850 relates to Category No.: 9506, 927, 7629; Payload ID: 6852 relates to Category No.: 1204; Payload ID: 6853 relates to Category No.: 5041, 2526, 6992; Payload ID: 6854 relates to Category No.: 11512, 8739, 15517, 13594, 11506, 3398; Payload ID: 6855 relates to Category No.: 8862, 11512, 1730, 8739, 8731, 3398, 11506, 3398, 8611, 8639; Payload ID: 6856 relates to Category No.: 11512, 8739, 15517; Payload ID: 6857 relates to Category No.: 1512, 11930, 4699; Payload ID: 6858 relates to Category No.: 12891, 3783, 11201, 7334, 8547, 16096, 8688, 13338, 10478, 10839, 8887, 2474; Payload ID: 6860 relates to Category No.: 4828, 14565, 442, 7613, 14009, 1780, 1893, 14663, 4132, 13004, 10802, 1981, 3728, 11976, 10298, 10745, 10583, 11176, 11174, 11242, 10309, 8175, 11265, 10664, 7958, 7619; Payload ID: 6861 relates to Category No.: 4828, 10702, 442, 1795, 14009, 12544, 14663, 1981, 3728, 4448, 13966, 4535, 12922, 3986, 5268; Payload ID: 6862 relates to Category No.: 4828, 1795, 328, 14663, 1477, 13004, 10486, 1981, 3728, 6103, 12948, 10282, 14015; Payload ID: 6863 relates to Category No.: 4828, 1795, 10372, 442, 1981; Payload ID: 6864 relates to Category No.: 1512, 14663, 4690, 4538, 4685, 4448; Payload ID: 6866 relates to Category No.: 13594, 15517, 11512; Payload ID: 6867 relates to Category No.: 13259, 13594, 15517; Payload ID: 6868 relates to Category No.: 1512, 4706, 1853, 1514, 15618, 14663, 4538, 4531, 2009, 13004, 3632, 10801, 1482, 12923, 5048, 12914, 4541, 4535, 8021, 10680, 2033, 3134, 1409, 7513, 13330, 10682, 13860, 10486, 4685, 4300, 6215, 1983, 7935, 11201, 14401; Payload ID: 6869 relates to Category No.: 9982, 1512, 11949, 15606, 12036, 1853, 10662, 7710, 13852, 8020, 15618, 14663, 15662, 15989, 5048, 12914, 4541; Payload ID: 6870 relates to Category No.: 6814, 4723, 1512, 14663, 4722, 5932, 5931; Payload ID: 6871 relates to Category No.: 1703, 12063, 1893, 1514, 3405, 11660, 15950, 7460, 7440; Payload ID: 6872 relates to Category No.: 1512, 7443, 14586, 4448, 4526; Payload ID: 6873 relates to Category No.: 7443, 1512; Payload ID: 6874 relates to Category No.: 12063, 1893, 3405, 11660, 15947, 6269, 4527, 7443, 6814; Payload ID: 6875 relates to Category No.: 9324, 1893, 11660, 12068, 4711, 6149, 1707, 5951, 15426, 13888; Payload ID: 6876 relates to Category No.: 10372, 11930, 10366, 15570, 11266, 10583, 11658, 10578, 7755, 10726, 6497, 7306, 4721; Payload ID: 6877 relates to Category No.: 1512, 9324, 1893, 11660, 12068, 5951, 5751, 15426, 5383; Payload ID: 6878 relates to Category No.: 1512, 9324, 1893, 11660, 12068, 5725, 5242, 5951, 15407, 15426; Payload ID: 6879 relates to Category No.: 11930, 6814; Payload ID: 6880 relates to Category No.: 15618, 1512, 3100, 4521, 14663, 4531, 5048, 4541, 4548, 9815; Payload ID: 6881 relates to Category No.: 15618, 1512, 4521, 14663, 4690, 4531, 5048, 4541, 4535, 7303, 12891, 15664, 2353, 4686, 15989, 14972, 4548, 9815, 13851, 6215, 9981; Payload ID: 6882 relates to Category No.: 15618, 1512, 3100, 4521, 14663, 4531, 13004, 5048, 4541, 4535; Payload ID: 6883 relates to Category No.: 6219, 9500, 1512, 4615, 15521, 14663, 4439, 4538, 2083, 4531, 2347, 15042, 9616, 7519, 3856, 7513, 9616, 9501, 8514, 9614, 14157, 13969, 13837, 13851, 13227; Payload ID: 6884 relates to Category No.: 4706, 4521, 690, 1512, 5285, 15521, 14663, 4439, 4538, 1482, 4999, 8373, 4531, 7840, 6103, 6914, 515; Payload ID: 6885 relates to Category No.: 15618, 15626, 1512, 14663, 4538, 7131, 4548, 10491, 5048, 4541, 4535; Payload ID: 6886 relates to Category No.: 6814, 9500; Payload ID: 6887 relates to Category No.: 9500, 4021; Payload ID: 6888 relates to Category No.: 1512, 14663, 4538, 6445, 4686, 1562, 6550, 3227, 15069, 16063, 8920, 6296, 7332, 4953, 15012, 8921, 13571, 4690, 15424; Payload ID: 6889 relates to Category No.: 11926, 12063, 1893, 11660, 1512; Payload ID: 6890 relates to Category No.: 1512, 6550; Payload ID: 6891 relates to Category No.: 14865, 14663, 2176, 1189, 4729, 4555, 4724; Payload ID: 6892 relates to Category No.: 1512, 14865; Payload ID: 6893 relates to Category No.: 1512; Payload ID: 6894 relates to Category No.: 1512, 9324, 14663, 4723, 2385; Payload ID: 6895 relates to Category No.: 9324; Payload ID: 6896 relates to Category No.: 4721, 1512, 14663, 5004, 4723, 5010; Payload ID: 6897 relates to Category No.: 1512, 5291, 14663, 5290, 4723, 4722, 4559; Payload ID: 6898 relates to Category No.: 8977, 15149, 1533, 8970, 4568, 4572, 12185, 13827, 4369; Payload ID: 6899 relates to Category No.: 8977, 15149, 1533, 8970, 13827, 4572; Payload ID: 6900 relates to Category No.: 1533; Payload ID: 6901 relates to Category No.: 9500, 1830, 4595, 14663, 1878, 15042, 10801, 1828, 4567, 4568, 15644; Payload ID: 6902 relates to Category No.: 9500, 1830, 4567, 4568, 4576; Payload ID: 6903 relates to Category No.: 5785, 15149, 687, 11506, 3398, 3038, 11997; Payload ID: 6904 relates to Category No.: 9125, 10282, 861, 12137; Payload ID: 6905 relates to Category No.: 14565, 5846, 15149, 5852, 15149, 4588, 3833, 12063, 2669, 1893, 6738, 11660, 12409, 6322, 6299; Payload ID: 6906 relates to Category No.: 5846, 15149, 4588, 14565, 15149, 5852; Payload ID: 6907 relates to Category No.: 5846, 15149, 4588, 15626, 15149, 5852, 4579, 13853; Payload ID: 6908 relates to Category No.: 5846, 15149, 4588, 15626, 15149, 5852, 4579, 13853; Payload ID: 6909 relates to Category No.: 5846, 5852, 15149, 4588, 14729; Payload ID: 6910 relates to Category No.: 15626, 5846, 5852, 15149, 4588, 4579, 13227, 1892, 5037, 3971, 2222, 11713, 13232; Payload ID: 6911 relates to Category No.: 6299; Payload ID: 6912 relates to Category No.: 5846, 5852, 15149, 4588, 8862, 15626, 15149, 2169, 13532, 4588, 4579, 13126, 1119, 480, 3971, 11436, 4342, 6723, 5440, 8672, 4588, 10639; Payload ID: 6913 relates to Category No.: 15626, 5846, 15149, 7191, 5852, 15149, 4588, 13464, 4579, 11436, 13126, 5782, 1836, 8946, 8373, 1112, 3971, 13084, 5440, 8672, 4588, 14565, 12405, 11089, 13049, 8923; Payload ID: 6914 relates to Category No.: 5846, 15149, 5852, 15149, 4588, 13126, 438, 4814, 4579, 8672, 4588; Payload ID: 6915 relates to Category No.: 15626, 5846, 15149, 5852, 15149, 4588, 4579; Payload ID: 6916 relates to Category No.: 5846, 15149, 5852, 15149, 4588, 13126, 3971, 13536, 14565, 1984, 12405, 11089, 12103, 3883; Payload ID: 6917 relates to Category No.: 1026, 14661, 11512, 3766, 5846, 15149, 1415, 5446, 6606, 348, 4186, 5852, 15149, 4588, 1651, 13126, 12391, 4127, 3775, 5541, 16085, 8988, 1408, 10590, 3971, 16213, 13837, 11800, 2243, 6102, 10238, 6103, 483, 1417, 13236, 1836, 13530, 14940, 8373, 15067, 6758, 14454, 13084, 14729, 12526, 13227, 6322, 901, 8919, 13756, 2638, 12754, 13523, 13775, 9337, 12616, 10168, 13951, 13416, 11713, 6531, 13969, 13796, 13041, 13853, 13772, 12133, 10356, 2050, 14123; Payload ID: 6918 relates to Category No.: 1026, 14661, 15626, 5846, 15149, 5446, 6606, 348, 4186, 5852, 15149, 4588, 12391, 4127, 3775, 5541, 16085, 8988, 4579, 6103, 13837, 6102, 13827, 16213, 10238, 13126, 1649, 1415, 1417, 8508, 14050, 6323, 13530, 14940, 3428, 7191, 6758, 13327, 3971, 11997, 14454, 8906, 3286, 14509, 13775, 6293, 13459, 14646; Payload ID: 6919 relates to Category No.: 1026, 14661, 15626, 3766, 15149, 5446, 6606, 348, 4186, 5852, 12391, 4127, 3775, 5541, 16085, 8988, 4579, 6103, 13837, 5406, 6102, 1649, 1415, 1417, 1119, 6323, 13530, 14940, 1112, 15067, 1651, 14448, 6758, 13359, 4131, 3146, 13327, 3971; Payload ID: 6920 relates to Category No.: 1026, 14661, 15626, 5846, 15149, 5446, 6606, 348, 4186, 5852, 15149, 4588, 12391, 4127, 3775, 5541, 16085, 8988, 4579, 13126, 1649, 8508, 8920, 14050, 3971, 11997, 3286; Payload ID: 6921 relates to Category No.: 1026, 14661, 14565, 5846, 15149, 5446, 6606, 348, 4186, 5852, 15149, 4588, 12391, 4127, 3775, 5541, 16085, 8988, 483, 14940, 13459; Payload ID: 6922 relates to Category No.: 7915, 3667; Payload ID: 6923 relates to Category No.: 5846, 1417, 5852, 15149, 4588, 13837, 3038, 1415, 11713; Payload ID: 6924 relates to Category No.: 5846, 5852, 15149, 4588, 12573, 11954, 1415; Payload ID: 6925 relates to Category No.: 4828, 15149, 11987, 13532, 4588, 4814, 10487, 3264, 345, 6296, 13105, 348, 14454, 1959, 13459; Payload ID: 6926 relates to Category No.: 4828, 15149, 7581, 13532, 4588, 4814, 438, 4581; Payload ID: 6927 relates to Category No.: 4828, 15149, 7581, 13532, 4588, 438; Payload ID: 6928 relates to Category No.: 4828, 8977, 15149, 345, 13532, 4588, 438, 13227, 10955, 6102; Payload ID: 6929 relates to Category No.: 4828, 11987, 2562, 13532, 4588, 4814, 9931, 6102, 6296, 13084; Payload ID: 6930 relates to Category No.: 4828, 13532, 4588, 438, 4814, 3140, 3166, 10298, 14565, 14056, 6296, 14452, 15149; Payload ID: 6931 relates to Category No.: 13532, 4588, 4828, 14456, 15149, 14455, 7581, 8029, 438, 7688, 12729, 15622, 8911, 1415, 480, 1112, 6758, 901, 2638, 7315, 14545; Payload ID: 6932 relates to Category No.: 4828, 14455, 16214, 13532, 4588, 438, 7688; Payload ID: 6933 relates to Category No.: 15149, 4593, 1780, 14663, 1878, 9068, 1828, 4568, 8981, 2116, 13860, 11940, 11436, 4588, 10574, 10801, 4576; Payload ID: 6934 relates to Category No.: 16308, 1790, 13975, 7613, 8731, 3398, 12547, 4609, 14663, 1878, 13874, 13867, 4612, 15089, 4576, 2845, 11237, 4615, 793, 7965, 14051, 8547, 13154, 6051, 13784, 8373, 13964; Payload ID: 6935 relates to Category No.: 16308, 13975, 12547, 4609, 14663, 1878, 13827, 4612, 15089, 4576, 10675, 4615, 793, 7965, 2845, 13154, 8373, 13964; Payload ID: 6944 relates to Category No.: 1207, 14663, 1878, 1828, 84, 6007, 6008; Payload ID: 6945 relates to Category No.: 1207, 1512, 10129, 4521, 6285, 14663, 1878, 4538, 2009, 1828, 84, 15089, 888, 886, 4576, 13859, 4628, 884, 9125, 4108, 9498, 4570, 4569, 3233; Payload ID: 6946 relates to Category No.: 1207, 884, 1830; Payload ID: 6947 relates to Category No.: 1207, 1512, 4521, 14663, 1878, 4538, 4115, 1828, 147, 84, 13837, 888, 886, 4576, 6273, 9498, 884, 4570, 4569, 3233; Payload ID: 6948 relates to Category No.: 1207, 14663, 1878, 1828, 6007; Payload ID: 6949 relates to Category No.: 8977, 15149, 4595, 15521, 14663, 4439, 1878, 11941, 4581, 1828, 4567, 4594, 15067, 13417; Payload ID: 6950 relates to Category No.: 4595, 8977, 1830, 15149, 12498, 15521, 14663, 4439, 1878, 4581, 11294, 1828, 12397, 4567, 4594; Payload ID: 6953 relates to Category No.: 1512, 3684, 2467, 4595, 12062, 12063, 1893, 4301, 3405, 11660, 15950, 3728, 5855, 15947, 1507, 13888, 2009, 11941, 4525, 14016, 8032; Payload ID: 6954 relates to Category No.: 1512, 4595, 12062, 12063, 1893, 4301, 3405, 11660, 15950, 3728, 15947, 1507; Payload ID: 6955 relates to Category No.: 1204, 12498; Payload ID: 6956 relates to Category No.: 1894, 9707, 16036; Payload ID: 6957 relates to Category No.: 9707, 16036; Payload ID: 6958 relates to Category No.: 15588, 7108, 4604, 13376, 6814; Payload ID: 6959 relates to Category No.: 15588, 15698, 15696, 1295, 4439, 4602; Payload ID: 6960 relates to Category No.: 12194, 690, 1752, 1816, 1780, 1893, 9631, 4502, 696, 695, 13549; Payload ID: 6961 relates to Category No.: 15588, 8760, 15715, 11884, 15712, 4439, 2013, 15698, 15696, 4605, 11784; Payload ID: 6962 relates to Category No.: 4439, 15698, 15696, 4605, 15697; Payload ID: 6963 relates to Category No.: 15588, 7108, 4604, 6814; Payload ID: 6964 relates to Category No.: 13621, 7108, 4604; Payload ID: 6965 relates to Category No.: 9500, 1790, 14663, 9236, 9235, 11398, 10977, 11902; Payload ID: 6966 relates to Category No.: 13589, 3398, 11926, 9500, 1790, 795, 1730, 13465, 4615, 14021, 13970, 13999, 13877, 3351, 496, 2123; Payload ID: 6967 relates to Category No.: 9500, 1790, 13571, 7703; Payload ID: 6968 relates to Category No.: 9500, 1790, 4998; Payload ID: 6969 relates to Category No.: 9500, 1790, 14456, 8454, 16174, 5460, 5462, 986, 5458, 11640; Payload ID: 6970 relates to Category No.: 14456; Payload ID: 6971 relates to Category No.: 6814, 9500, 14663, 1878, 4101, 6215, 6424, 15753, 390, 4112, 4118; Payload ID: 6972 relates to Category No.: 13337, 9500, 1790, 13975, 4615, 4948, 7840, 5300, 14663, 12242, 2083, 815, 12891, 3783, 9236, 13998, 13877, 6263, 7967, 8567, 13103, 12252, 16049, 14004, 10620, 1244, 7613, 14025, 795, 1780, 14456, 16102, 14050, 15664, 14624, 13856, 4094, 6219, 15273, 3710, 8113, 5814, 14051, 14019, 7417, 12072, 13878, 14638, 13227, 7388, 5595, 11266, 692, 8431; Payload ID: 6973 relates to Category No.: 9500, 13975, 15521, 4439, 13998; Payload ID: 6974 relates to Category No.: 9500, 13975, 5300, 11941, 13998, 13924; Payload ID: 6975 relates to Category No.: 9500, 13975, 7306, 9945, 14663, 815, 6263, 2410, 14838; Payload ID: 6976 relates to Category No.: 6219, 9500, 13975, 2083; Payload ID: 6977 relates to Category No.: 9500, 13975; Payload ID: 6978 relates to Category No.: 9500, 13975, 13998; Payload ID: 6979 relates to Category No.: 9500, 13975, 13998; Payload ID: 6980 relates to Category No.: 9500, 1790, 4615, 15521, 14663, 4439, 9236, 13998, 9235; Payload ID: 6981 relates to Category No.: 6814, 16308, 4615, 14663, 3791, 4612; Payload ID: 6982 relates to Category No.: 16308, 4615, 14663, 3791, 4612; Payload ID: 6983 relates to Category No.: 6814, 16308, 4615, 14663, 4612; Payload ID: 6984 relates to Category No.: 16308, 4615, 14663, 4612; Payload ID: 6985 relates to Category No.: 4615, 6814; Payload ID: 6986 relates to Category No.: 9500, 16308, 14663, 3791, 4612, 4615; Payload ID: 6987 relates to Category No.: 16308, 4615, 14663, 4612, 9066, 16306, 1850, 6814; Payload ID: 6988 relates to Category No.: 6814, 16308, 4615, 14663, 8601, 12596, 4612, 13409, 1921, 13686, 9066, 16306, 1850, 13477, 11349; Payload ID: 6989 relates to Category No.: 16308, 4615, 14663, 13836, 4612, 9066, 16306, 1850, 3869, 6814; Payload ID: 6990 relates to Category No.: 16308, 4615, 14663, 4612, 16306, 9066, 6814; Payload ID: 6991 relates to Category No.: 16308, 4615, 14663, 4612, 6814; Payload ID: 6992 relates to Category No.: 16308, 9500, 6902, 4615, 14663, 8601, 12596, 1911, 4612, 13409, 6051, 16306, 11349, 11379, 6050, 6814; Payload ID: 6993 relates to Category No.: 16308, 9500, 4615, 14663, 1911, 16234, 16275, 4612, 6051; Payload ID: 6994 relates to Category No.: 16308, 7613, 4615, 2169, 7946, 7965, 8193, 14663, 2041, 8522, 7656, 8782, 13998, 12832, 8256, 4612, 8103, 8133, 8255, 11429, 8662, 7990, 7576, 8785, 8324, 8395, 13516, 2604, 9055, 8210, 13835, 13967, 14025, 13837, 13938, 13773, 9411, 1982, 2009, 13915, 9349, 1931, 1960, 6814; Payload ID: 6995 relates to Category No.: 6814, 16308, 9500, 4615, 14663, 4612; Payload ID: 6996 relates to Category No.: 4615; Payload ID: 6997 relates to Category No.: 16308, 4615, 14663, 4612, 6814; Payload ID: 6998 relates to Category No.: 843, 16308, 9500, 4615, 14663, 1878, 6343, 4612, 15834; Payload ID: 6999 relates to Category No.: 1204; Payload ID: 7000 relates to Category No.: 8862, 16308, 13975, 1830, 4609, 14663, 4612, 13794, 13967, 496, 13773, 14029, 14051; Payload ID: 7001 relates to Category No.: 9500, 1512, 6969, 8760, 4521, 14663, 2013, 4538, 12117, 1482, 8923, 9670; Payload ID: 7002 relates to Category No.: 9500, 1512, 4521, 14831, 14663, 4538, 10682, 1482, 14834; Payload ID: 7003 relates to Category No.: 12091; Payload ID: 7004 relates to Category No.: 9982, 1512, 4634, 15660, 1867, 14663, 4642, 15664, 4637, 4630, 4535, 12864, 13812, 13827, 13837, 13970; Payload ID: 7005 relates to Category No.: 9982, 1512, 4634, 4642, 15664, 4637, 4630; Payload ID: 7006 relates to Category No.: 9982, 1512, 4634, 15664, 4637, 4630; Payload ID: 7007 relates to Category No.: 6814, 15660, 9945, 14663, 4642, 4653, 9819, 1694, 1867; Payload ID: 7008 relates to Category No.: 6814, 15660, 9945, 1867, 14663, 4653, 9819, 1694, 13588; Payload ID: 7009 relates to Category No.: 6814, 390, 15660, 6211, 9945, 1867, 14663, 4653, 9819, 1694, 5998, 9825, 3220, 15664, 6559, 13189, 4110, 4472; Payload ID: 7010 relates to Category No.: 6814, 9940, 15660, 9945, 1867, 14663, 4653, 9819, 1694, 11051, 3021, 15664, 13860, 10197, 4110, 390, 12740, 7574, 4655, 4108, 9944, 5665, 13967, 13794, 13767, 2009, 13852, 11558; Payload ID: 7011 relates to Category No.: 9500, 1512, 15660, 9945, 1867, 14663, 4638, 4642, 4653, 9819, 1925, 2136, 4521, 10682, 7506, 4647, 7505, 4644; Payload ID: 7012 relates to Category No.: 9500, 4638, 1512, 13496, 7476, 15660, 9945, 1867, 14663, 4642, 11399, 4653, 9819, 12953, 8446, 13663, 11273, 16129, 8525, 7505; Payload ID: 7013 relates to Category No.: 9500, 4642, 1867, 14663, 4630, 7303, 1463, 4521; Payload ID: 7014 relates to Category No.: 6814, 1867, 9945, 14663, 3950, 4653, 9819, 9575, 15140, 2238, 7369, 6738, 13827, 13966, 14009, 13843; Payload ID: 7015 relates to Category No.: 6219, 9945, 14663, 4653, 1880, 4654, 14636; Payload ID: 7016 relates to Category No.: 6219; Payload ID: 7017 relates to Category No.: 6219; Payload ID: 7018 relates to Category No.: 6219; Payload ID: 7019 relates to Category No.: 6219, 6814; Payload ID: 7020 relates to Category No.: 6219; Payload ID: 7021 relates to Category No.: 6219, 6814, 11091, 8936, 13582, 14886, 10349, 2248; Payload ID: 7022 relates to Category No.: 10129, 14663, 1878, 2761, 2759; Payload ID: 7023 relates to Category No.: 6814, 1207, 1830, 15370, 6362; Payload ID: 7024 relates to Category No.: 6902, 14663, 1878, 4664, 4666, 4743; Payload ID: 7025 relates to Category No.: 9500, 1830, 14663, 1878, 4670, 4664, 4666, 4743; Payload ID: 7026 relates to Category No.: 1894, 6902, 11941, 14350, 4690, 6888, 9374, 12908; Payload ID: 7027 relates to Category No.: 15618, 15626, 2331, 5846, 8962, 13126, 2329, 5848, 7340, 13773, 15149, 4680, 10187, 14940, 8770, 16214, 15149, 14184, 484, 8921, 325, 8919, 5440, 266, 13417, 13416, 710, 11940, 11934; Payload ID: 7028 relates to Category No.: 15618, 15626, 5846, 8962, 13126, 2329, 5848, 8911, 13773, 15149, 4680, 15140, 14883; Payload ID: 7029 relates to Category No.: 15618, 15626, 5846, 8962, 13126, 2329, 5848, 8911, 13773, 15149, 4680, 12405, 8983, 4373; Payload ID: 7030 relates to Category No.: 15626, 8962, 13126, 2329, 5848, 8911, 13773, 15149, 4680; Payload ID: 7031 relates to Category No.: 8862, 15618, 15626, 5846, 8962, 15149, 13126, 2329, 5848, 13773, 15149, 4680, 14940, 16214, 14184, 484, 8919, 266, 8983, 4373, 11934; Payload ID: 7032 relates to Category No.: 6814, 16308, 390, 14663, 14025, 4670, 7211; Payload ID: 7033 relates to Category No.: 6814; Payload ID: 7035 relates to Category No.: 6814; Payload ID: 7036 relates to Category No.: 6814; Payload ID: 7037 relates to Category No.: 1512, 14663, 4538, 4685, 4949, 4690; Payload ID: 7038 relates to Category No.: 1512, 14663, 4538, 4685, 4448, 13860, 4690; Payload ID: 7039 relates to Category No.: 12091, 8862, 11843, 16286, 3684, 5446, 8728, 4186, 4040, 9891, 7693, 4127, 3775, 1893, 5541, 8988, 4690, 2009, 8117, 11243, 13165, 5855, 11294, 11022, 10309, 13541, 10679, 2019, 1551, 8032, 8023, 10707, 8800, 7736, 10212, 8034, 15552, 8788, 8031, 496, 11089, 7863; Payload ID: 7040 relates to Category No.: 12091, 1026, 5785, 10702, 7613, 5446, 1483, 9713, 4186, 4040, 9891, 7693, 4127, 3775, 8988, 10314, 4690, 11858, 3812, 1995, 2469, 11243, 11242, 8509, 10382, 11245, 8507, 11022, 12671, 13149, 3827, 11251, 2019, 8032, 5073, 8788, 8031, 8388, 15108, 8529, 11512, 11237, 8378, 9982, 1752, 9410, 12892, 16286, 11176, 11174, 1048, 10257, 1491, 11922, 4094, 7417, 13232, 7703, 5810, 12028, 7385, 11412, 5326, 12450, 8376, 13835, 13834, 496, 13888, 13827, 2001, 3924, 13927, 11021, 13767, 3871, 12522, 8632, 1963, 10238, 8255, 11089, 13236, 11391, 12754, 12526, 7864, 8394, 2051, 2026, 2044, 13919, 1956, 7896, 13889, 14032, 13777, 7863, 10590, 10514, 8377; Payload ID: 7041 relates to Category No.: 1512, 14663, 4538, 4685, 4686, 6814; Payload ID: 7042 relates to Category No.: 1512, 14663, 4538, 4685, 4686, 6814; Payload ID: 7043 relates to Category No.: 4703, 14865, 14663, 4729; Payload ID: 7044 relates to Category No.: 4703; Payload ID: 7045 relates to Category No.: 2933, 13424, 16189, 1204; Payload ID: 7049 relates to Category No.: 7743, 1703, 8782, 9455, 1272; Payload ID: 7052 relates to Category No.: 11294; Payload ID: 7053 relates to Category No.: 13580; Payload ID: 7054 relates to Category No.: 11512, 14565, 10372, 1816, 10366, 1893, 9637, 2000, 3194, 15405, 4789, 15402, 6393, 8419, 4242; Payload ID: 7055 relates to Category No.: 1703, 10074, 1795, 1238, 15379, 4180, 1238, 5825, 12543, 1764, 4999; Payload ID: 7056 relates to Category No.: 1703, 10074, 1795, 1238, 1238, 5825; Payload ID: 7058 relates to Category No.: 1703, 10074, 1238, 1238, 5825; Payload ID: 7059 relates to Category No.: 15140, 8940, 10628, 14944, 8934, 8886, 1415; Payload ID: 7060 relates to Category No.: 8862, 12137, 1730, 12459, 9451, 4015, 10287, 8526, 12882, 8616; Payload ID: 7061 relates to Category No.: 1703, 10074, 1048, 1238, 1238, 5825, 1820, 8476; Payload ID: 7062 relates to Category No.: 10074, 1238, 6145, 3754; Payload ID: 7063 relates to Category No.: 11512, 5783; Payload ID: 7064 relates to Category No.: 2775, 11884, 1893, 980, 11660, 12103; Payload ID: 7065 relates to Category No.: 5782, 12117, 2353, 10918, 15662, 12007, 15535, 11944, 13868, 10438, 6227, 12135; Payload ID: 7066 relates to Category No.: 795, 7743, 3313, 14567; Payload ID: 7067 relates to Category No.: 10238, 7743, 2376, 5541, 2009, 9827, 9451, 10802, 1957, 10557, 1762, 1922, 10978, 1933, 11558, 11359, 13860, 8776, 2624, 10668, 15540, 2090, 4799, 10216, 10731, 4972, 10482, 2134, 4973, 12673; Payload ID: 7068 relates to Category No.: 6814; Payload ID: 7069 relates to Category No.: 1512; Payload ID: 7070 relates to Category No.: 10155, 6814; Payload ID: 7071 relates to Category No.: 10155; Payload ID: 7072 relates to Category No.: 6814, 12071, 7332; Payload ID: 7073 relates to Category No.: 6814; Payload ID: 7074 relates to Category No.: 4439, 15698, 4737, 3223; Payload ID: 7077 relates to Category No.: 7613, 1874, 14663, 12338, 9459, 13594, 1512, 4615, 6916; Payload ID: 7078 relates to Category No.: 9500; Payload ID: 7079 relates to Category No.: 6814, 9500, 14663, 1878, 12066, 3973, 4743, 3233; Payload ID: 7080 relates to Category No.: 1026, 1512, 4721, 14663, 4723, 11377, 14086, 4722, 10005, 16211, 2385, 7986, 14386, 5005, 7364; Payload ID: 7081 relates to Category No.: 1512, 4721, 14663, 4723, 14086, 4722, 10005, 16211, 2385, 14699, 8929; Payload ID: 7082 relates to Category No.: 1512, 8441, 674, 4721, 14663, 4723, 14086, 4722, 10005, 16211, 2385, 6780, 10543, 5949, 722, 7743, 1318, 9410, 12936, 7939, 6375, 1272, 8639, 10286, 8042, 10666, 11243, 1787, 11394, 2705, 3594, 9459, 1266, 1786, 6808; Payload ID: 7083 relates to Category No.: 1512, 674, 4721, 1780, 14663, 4723, 14086, 4722, 10005, 16211, 2385; Payload ID: 7084 relates to Category No.: 1512, 4721, 14663, 4723, 14086, 4722, 10005, 16211, 2385; Payload ID: 7085 relates to Category No.: 1512, 1752, 4721, 14663, 4723, 14086, 4722, 10005, 16211, 2385; Payload ID: 7086 relates to Category No.: 10331, 4399, 14865, 14663, 4729, 6103, 8911, 8920, 6226, 9358, 6227, 10771, 4401; Payload ID: 7087 relates to Category No.: 12105, 14451, 433, 13979, 4145, 8337, 4828, 14565, 2562, 434, 1269, 10075, 3194, 4940, 14643, 7303, 13827, 11634, 3337, 14640, 3631, 1622, 11150, 3575, 15425, 11147, 3594, 3728, 11630, 4449, 13465, 6814, 15618, 10702, 14455, 1468, 328, 14663, 1238, 5788, 13004, 432, 16274, 1981, 10313, 13724, 2100, 1930, 10309; Payload ID: 7088 relates to Category No.: 4828; Payload ID: 7089 relates to Category No.: 12137, 10702, 13166, 12502, 12614, 14098, 4771, 14097, 3698, 9420, 16197, 6738, 4766, 9000, 4770, 11646, 2662, 13364, 12021, 4761, 3687, 1702, 3890, 12018, 12396, 12019; Payload ID: 7090 relates to Category No.: 1238, 6145, 1274, 12703, 8756, 8537; Payload ID: 7091 relates to Category No.: 15626; Payload ID: 7092 relates to Category No.: 13071, 9308; Payload ID: 7093 relates to Category No.: 7613, 1752, 12105, 12104, 1780, 4439, 4766, 4774, 11502, 6018, 13164, 11290, 4768, 4711, 6149, 1707, 4781, 913; Payload ID: 7094 relates to Category No.: 4766, 11290; Payload ID: 7095 relates to Category No.: 12137, 3833, 12063, 2669, 1893, 6738, 7132, 4766, 11660, 7864, 12062; Payload ID: 7096 relates to Category No.: 9420, 7132; Payload ID: 7097 relates to Category No.: 12137, 3833, 5798, 14097, 3698, 16160, 13667; Payload ID: 7098 relates to Category No.: 15626, 5798, 4778, 14097, 3698, 12130, 16161, 16172, 3684, 3833, 6733, 12063, 2669, 1893, 6738, 11660, 5855; Payload ID: 7099 relates to Category No.: 15626, 15215, 2910, 6513; Payload ID: 7100 relates to Category No.: 6219, 12137, 16172; Payload ID: 7101 relates to Category No.: 6219, 16172, 12137, 14565, 10775; Payload ID: 7102 relates to Category No.: 11940, 14661, 12137, 3833, 780, 4775, 2908; Payload ID: 7103 relates to Category No.: 5782, 16172, 1893, 11243, 15471; Payload ID: 7104 relates to Category No.: 5782, 16172, 1893; Payload ID: 7105 relates to Category No.: 5782, 16172, 1893, 11243; Payload ID: 7106 relates to Category No.: 14455, 14014, 2460, 12032; Payload ID: 7107 relates to Category No.: 12124; Payload ID: 7108 relates to Category No.: 6975, 11930, 3833, 14894, 7162, 12063, 2669, 7635, 1893, 6738, 7132, 2198, 11660, 11941, 8507, 4768, 11253, 4761, 912, 14898; Payload ID: 7109 relates to Category No.: 5798; Payload ID: 7110 relates to Category No.: 16172, 10257, 12124, 4774; Payload ID: 7111 relates to Category No.: 4785, 4766, 14097, 16166; Payload ID: 7123 relates to Category No.: 12117, 4774, 9681; Payload ID: 7140 relates to Category No.: 13589, 3398, 4766; Payload ID: 7142 relates to Category No.: 13589, 3398; Payload ID: 7143 relates to Category No.: 14565, 1816, 7306, 7743, 12988, 13736, 12891, 8377, 13837, 14011, 13281, 13969, 13925, 7613, 9490, 496, 4145, 13991, 13981, 13988, 3940, 14022, 13814, 6538, 8104, 13990; Payload ID: 7144 relates to Category No.: 14565, 7306, 12988, 13736; Payload ID: 7145 relates to Category No.: 4828, 7306, 1989; Payload ID: 7146 relates to Category No.: 13589, 3398, 7001, 4418, 8868, 8739, 674, 3613, 4251, 3444, 14577, 8831, 3519, 7346; Payload ID: 7147 relates to Category No.: 13594, 13589, 3398, 674; Payload ID: 7149 relates to Category No.: 6814; Payload ID: 7150 relates to Category No.: 6814, 1204; Payload ID: 7151 relates to Category No.: 6814; Payload ID: 7152 relates to Category No.: 5785, 12153; Payload ID: 7154 relates to Category No.: 12931, 12603, 8862, 1730; Payload ID: 7155 relates to Category No.: 4828, 12603, 3889, 6376; Payload ID: 7156 relates to Category No.: 12603, 1204, 5367; Payload ID: 7157 relates to Category No.: 11512, 15517, 7306, 3781, 1867, 14663; Payload ID: 7158 relates to Category No.: 13594, 11512, 8888, 1295, 1703, 15517, 3781, 1780, 1183, 8887, 11465, 3799, 1749, 8195, 6376, 12772, 3820, 5406, 7303, 12891, 11506, 3398, 1463, 3578, 3575, 3602, 4066, 6383, 3800, 1585, 13759; Payload ID: 7159 relates to Category No.: 13594, 11512, 15517, 3781, 12459, 8887, 9599, 10702, 11506, 3398, 10648, 16294, 2548, 3532, 2169, 3913, 3896, 4065, 10044; Payload ID: 7165 relates to Category No.: 795; Payload ID: 7166 relates to Category No.: 12194, 6733; Payload ID: 7167 relates to Category No.: 14565, 10574, 3566, 1230, 13835, 11094, 6531, 10501, 15156, 2379, 8885; Payload ID: 7168 relates to Category No.: 3013, 5954, 1849, 3014; Payload ID: 7169 relates to Category No.: 12194, 5367, 795, 12195, 10238, 2888, 7879, 8434, 7909; Payload ID: 7170 relates to Category No.: 12194, 12099, 4851, 795, 2888, 9125, 11765, 5806, 11260, 7540, 15200; Payload ID: 7171 relates to Category No.: 12194, 5367, 795, 12099, 2888; Payload ID: 7172 relates to Category No.: 12194; Payload ID: 7173 relates to Category No.: 12194, 795, 5446, 1727, 2888; Payload ID: 7174 relates to Category No.: 5552; Payload ID: 7175 relates to Category No.: 8760, 5243, 7303, 11634, 7354, 483, 8920, 5552, 14886, 4132, 7148, 1893; Payload ID: 7176 relates to Category No.: 10372, 10359, 3775, 10583, 1960; Payload ID: 7178 relates to Category No.: 5446, 4186, 9891, 1780, 4127, 3775, 5541, 8988, 12638, 345, 10955, 14565, 13975, 344, 4949, 10093, 5986, 3781, 5710; Payload ID: 7179 relates to Category No.: 15614, 5446, 10372, 10961, 9891, 4127, 9459, 1752, 5592; Payload ID: 7180 relates to Category No.: 6468; Payload ID: 7182 relates to Category No.: 1061, 1067, 5384; Payload ID: 7183 relates to Category No.: 1816, 11371, 12391; Payload ID: 7184 relates to Category No.: 15207, 5446, 1816, 11371, 12391, 4127, 15192; Payload ID: 7186 relates to Category No.: 1764, 11512, 14565, 7613, 10372, 7693, 12827, 11313, 2571, 7662, 10320, 1762, 7799, 8439, 11526, 11465, 8422, 7664, 7666, 3171, 6192, 8325, 8425, 11177, 7668, 7665, 11308; Payload ID: 7187 relates to Category No.: 2885, 1257, 3569, 12735, 7662, 14476; Payload ID: 7188 relates to Category No.: 15715, 7287, 724, 7243; Payload ID: 7189 relates to Category No.: 5785; Payload ID: 7190 relates to Category No.: 12124; Payload ID: 7191 relates to Category No.: 6961, 14097, 3698, 12124, 12125, 6977, 4768, 6061, 12021, 13351, 12441; Payload ID: 7192 relates to Category No.: 1204; Payload ID: 7193 relates to Category No.: 14663, 14972, 16236, 16222, 13835, 13967, 4145, 14011, 5998; Payload ID: 7194 relates to Category No.: 1722, 795, 10238, 3354, 12732, 349, 11307, 10878, 2022, 2051, 11163, 14571, 7133, 12619, 2195, 8522, 4336, 14015; Payload ID: 7195 relates to Category No.: 795, 1730, 10238, 7306, 349, 14015, 10878, 11163, 12619, 348, 8522; Payload ID: 7196 relates to Category No.: 795, 1730, 10238, 7306, 349, 14015, 10878, 11163, 12619, 348, 8522; Payload ID: 7197 relates to Category No.: 1721, 9420, 16197, 7108, 7109, 7110, 7111, 7133, 10372, 11155; Payload ID: 7198 relates to Category No.: 1722, 1741, 12498, 13492, 2143, 8318, 8537, 3194, 12828; Payload ID: 7199 relates to Category No.: 1722, 795, 12648, 11765, 1844; Payload ID: 7200 relates to Category No.: 1722, 12619, 8300, 7735, 6967, 8004, 2116, 2128, 7951; Payload ID: 7201 relates to Category No.: 1722, 8300, 6967; Payload ID: 7202 relates to Category No.: 1722, 6969, 274; Payload ID: 7203 relates to Category No.: 12194, 12091, 14565, 1722, 1703, 7613, 10074, 1415, 1752, 9777, 8731, 3398, 9713, 2011, 11296, 1780, 16191, 7840, 11285, 10648, 1893, 12936, 1238, 11660, 10080, 3049, 6145, 11502, 9674, 4015, 10075, 11174, 11266, 10583, 8129, 8782, 10498, 8159, 8611, 11182, 16189, 1056, 8519, 15606, 1957, 7919, 11265, 361, 10626, 10480, 1984, 11251, 10655, 11980, 8785, 12430, 790, 12129, 11076, 7866, 7655, 8136, 4973, 4329, 2151, 8414, 8160, 7984, 8569, 8934, 1993, 2116, 1823, 3754, 6466, 9411; Payload ID: 7204 relates to Category No.: 13589, 3398, 1722, 8940, 8929, 12648, 280, 287; Payload ID: 7205 relates to Category No.: 7743, 1767, 14831, 1892; Payload ID: 7206 relates to Category No.: 11987, 12936, 12881, 14050, 1026, 1741, 4475, 1019, 8862, 15427; Payload ID: 7207 relates to Category No.: 12498, 11167, 13105, 1729, 14656, 4859, 1257; Payload ID: 7208 relates to Category No.: 12498, 11167, 13105, 1729, 14656, 8421, 4859, 14640, 15570, 9455, 4094; Payload ID: 7209 relates to Category No.: 8862, 12498, 11167, 13105, 1729, 14656, 4859, 14640, 6795, 16005, 724, 7743, 6878, 9410, 1751, 9540, 7730, 9554, 1464, 14881, 8375; Payload ID: 7210 relates to Category No.: 12498, 11167, 13105, 1729, 14656, 14565, 1816, 15570, 11063; Payload ID: 7211 relates to Category No.: 690, 11512, 12498, 11167, 13105, 1729, 14656, 1862, 11506, 3398, 4859, 1257, 7735, 7598, 10558, 372, 7890, 9451, 9600, 10855, 1918, 7924, 7923, 9595, 7659, 1249, 10226, 1622, 7880, 16096, 10648, 9455, 10286, 11147, 10329, 10556; Payload ID: 7212 relates to Category No.: 12498, 11167, 13105, 1729, 14656, 4859, 14640, 1257, 4057, 7662, 7932, 12631, 5406, 14791, 11740, 14565, 3641, 6795, 8352, 13824, 9129, 4275; Payload ID: 7213 relates to Category No.: 1816, 12498, 11167, 13105, 1729, 14656, 4859, 1257, 4021, 15570, 7131, 10286, 7799, 7939, 14655, 2373, 10429, 3595, 5071, 2376, 13189, 15610, 4264, 8276, 8373, 11091; Payload ID: 7215 relates to Category No.: 795, 12498, 11167, 13105, 1729, 14656, 11506, 3398, 4859, 1257, 372, 9595, 14065, 11091; Payload ID: 7216 relates to Category No.: 12498, 11167, 13105, 1729, 14656, 11506, 3398, 4859, 1257, 372, 9595, 1026, 11091, 10648, 1741, 1320, 3791, 13739, 14882, 4254, 8888, 6995, 4469, 7240, 14290, 11471; Payload ID: 7217 relates to Category No.: 10372, 12498, 11167, 13105, 1729, 14656, 1257, 4134, 15570, 13333, 7735, 9377; Payload ID: 7218 relates to Category No.: 15490, 3398, 8739, 8731, 3398, 16197, 8390, 2041, 13612, 8378, 7672, 8823, 7372, 13587, 10853, 5459, 1741, 986, 6651, 7734, 10361; Payload ID: 7219 relates to Category No.: 8739, 15517, 2409, 1780, 13225, 7372; Payload ID: 7220 relates to Category No.: 14565, 8831, 5541, 13888, 8117, 11201, 11596, 8032, 8023, 5552, 8468; Payload ID: 7221 relates to Category No.: 14565, 1238, 6145, 11371; Payload ID: 7222 relates to Category No.: 1026, 14661, 10074, 5446, 1816, 6606, 348, 4186, 9891, 12391, 4127, 4130, 3775, 16197, 5541, 16085, 8988, 11307, 1238, 2022, 6145, 15192, 7933, 12409, 14571, 1730, 673, 10192, 13105, 11371, 1312; Payload ID: 7223 relates to Category No.: 14565, 8760, 11371, 10366, 3775, 1238, 15001, 6145; Payload ID: 7224 relates to Category No.: 9500, 12127, 1893; Payload ID: 7225 relates to Category No.: 5910, 10954, 10877, 11187, 11178, 13835, 4871, 5911, 4541, 11582, 11584, 10198, 11051, 10803, 1271; Payload ID: 7226 relates to Category No.: 5911; Payload ID: 7227 relates to Category No.: 795, 1204; Payload ID: 7228 relates to Category No.: 2885, 2000, 3639, 4110, 345, 5910, 11178, 13835, 4871, 5911, 11582, 11584, 341, 12409, 84, 13189, 11051, 2761, 5552, 2766, 539, 2481, 15053, 9498, 5889, 16073, 15234, 7311, 13817, 13859, 13874, 13893, 13981, 13818, 13951, 2009, 8374, 13851, 5268, 10877, 1623, 342; Payload ID: 7229 relates to Category No.: 10702; Payload ID: 7230 relates to Category No.: 10372, 1816, 434, 1477, 10309, 13851, 11051, 10803, 414, 4873, 10442, 13697, 10699, 10762; Payload ID: 7231 relates to Category No.: 4828, 10372, 1795, 434, 1477, 13888, 13836, 10309, 11051, 10803, 10699, 13859, 7314, 4873, 1751, 5998, 6559, 10762, 2009, 3167, 5263, 414, 13006, 16272, 13367, 14788, 13034, 14565, 1984, 10442, 9102, 442, 10311, 328, 1204; Payload ID: 7232 relates to Category No.: 4828, 5268, 297, 8112, 13874, 3010, 8133, 11051, 4873, 481, 10242, 8158, 8781, 2009, 13851, 13523, 10803, 8118, 12966, 10610; Payload ID: 7235 relates to Category No.: 14565, 11997; Payload ID: 7236 relates to Category No.: 11926, 12603, 12127, 1893; Payload ID: 7237 relates to Category No.: 11926, 12603, 12127, 1893; Payload ID: 7238 relates to Category No.: 13589, 3398, 11512, 15517, 8930, 14882, 5334, 414; Payload ID: 7239 relates to Category No.: 13589, 3398, 15490, 3398, 12638, 9599, 8930, 11125, 8932, 2169, 1295, 15248, 14882, 4254, 4252, 13417, 15035, 5067, 9335, 11138, 15036; Payload ID: 7247 relates to Category No.: 15490, 3398, 9296, 13589, 3398, 3354; Payload ID: 7248 relates to Category No.: 15490, 3398, 9296, 13589, 3398, 3354; Payload ID: 7249 relates to Category No.: 13594, 13589, 3398, 15490, 3398, 7306, 15582; Payload ID: 7250 relates to Category No.: 13589, 3398, 15490, 3398; Payload ID: 7251 relates to Category No.: 13589, 3398, 15490, 3398; Payload ID: 7252 relates to Category No.: 5367, 14565, 15603, 11046; Payload ID: 7253 relates to Category No.: 15603, 1204, 6814; Payload ID: 7254 relates to Category No.: 15712; Payload ID: 7255 relates to Category No.: 7743, 7737, 14177, 12732, 12117, 7890, 7750, 8547, 9455, 7815; Payload ID: 7257 relates to Category No.: 5367, 14661, 12137, 14565, 7154, 1795, 2424, 6881; Payload ID: 7258 relates to Category No.: 13248, 11940, 12544, 9048, 14663, 13925, 15307, 13892, 14029, 9053, 11113, 15309, 13410, 13978, 3425, 178, 12229, 8921, 13089, 11934, 16102, 7658, 11884, 3248; Payload ID: 7259 relates to Category No.: 13248, 9048, 14663, 7656, 9053, 8973, 8048, 11934, 11884, 6814; Payload ID: 7260 relates to Category No.: 15626, 9228, 3320, 12391, 7693; Payload ID: 7261 relates to Category No.: 15626, 12391, 7295, 2909; Payload ID: 7262 relates to Category No.: 14565, 12942, 10702, 3639, 13381; Payload ID: 7263 relates to Category No.: 10702, 13485; Payload ID: 7264 relates to Category No.: 1060, 15194; Payload ID: 7271 relates to Category No.: 6814, 14177; Payload ID: 7272 relates to Category No.: 1081; Payload ID: 7279 relates to Category No.: 6902, 10129, 14663, 1878, 7340, 2761, 2759, 9410, 14838, 13189, 14350, 14341, 3596; Payload ID: 7280 relates to Category No.: 4904, 8862, 9232, 14663, 12242, 9236, 12252, 4906; Payload ID: 7281 relates to Category No.: 4595, 14663, 12242, 4747, 12240, 12251, 12259, 9236; Payload ID: 7282 relates to Category No.: 4828, 6814, 14565, 442, 10074, 14108, 1238, 13588, 13338, 12879, 1730, 5406, 5785, 12648, 3578, 13827; Payload ID: 7283 relates to Category No.: 4828, 6814, 14565, 442, 10074, 325, 9929, 4808, 1238, 10005, 16211, 3742, 4949, 14640, 2090, 3197, 13118; Payload ID: 7284 relates to Category No.: 4828, 6814, 14565, 10074, 14108, 434, 1238, 7252, 356, 1730, 5406, 12638, 5785, 12648, 690, 9600, 10486; Payload ID: 7285 relates to Category No.: 4828, 6814, 14565, 442, 10074, 9929, 1238; Payload ID: 7286 relates to Category No.: 4828, 6814, 14565, 442, 10074, 9929, 1238, 9930, 10486, 355, 9932; Payload ID: 7287 relates to Category No.: 4828, 6814, 14565, 442, 3431, 7340, 6296, 12948, 1886, 10702, 13969, 496, 13827, 13971, 13818, 13951, 8936, 13877, 4251, 7679; Payload ID: 7288 relates to Category No.: 4828, 6814, 14565, 15149, 14455, 433, 434, 439, 328, 13775, 13795; Payload ID: 7289 relates to Category No.: 442, 1737, 4828, 6814, 14565, 1721, 10074, 15149, 439, 1238, 13981, 8672; Payload ID: 7290 relates to Category No.: 1737, 4828, 6814, 14565, 1721, 10074, 15149, 7581, 422, 4375, 439, 1238, 13966, 1780, 4808, 5785, 10372, 348, 12573, 8672; Payload ID: 7291 relates to Category No.: 1737, 4828, 6814, 15626, 14565, 1721, 442, 10074, 15149, 7581, 439, 1238, 16160; Payload ID: 7292 relates to Category No.: 4828, 6814, 14565, 442, 16214, 14462, 3140, 10005, 16211, 14111, 13437, 13921, 7832, 4059, 14056, 1780, 10005, 1959, 3125, 13920, 10464; Payload ID: 7293 relates to Category No.: 4828, 6814, 14565, 442, 16214, 3125, 10005, 3140, 14067, 10486, 13920; Payload ID: 7294 relates to Category No.: 4828, 6814, 5785, 14565, 442, 439; Payload ID: 7295 relates to Category No.: 14565, 10005, 16211, 14111, 13437, 8825, 4828; Payload ID: 7296 relates to Category No.: 14565, 10074, 15149, 4808, 433, 12391, 14663, 1238, 1981, 3728, 10005, 16211, 14111, 13437, 2100, 1930, 14056, 4828, 1780, 9932, 14459, 2006, 10486, 1554; Payload ID: 7297 relates to Category No.: 4828, 5785, 14729; Payload ID: 7298 relates to Category No.: 4828, 15149, 14663, 1981, 3728, 14565; Payload ID: 7299 relates to Category No.: 334, 10702, 1721, 12619, 11237, 10238, 8760, 1795, 8831, 10366, 12835, 11285, 7735, 16197, 15782, 8546, 8524, 8004, 11256, 10864, 12630, 13635, 8446, 14123, 1993, 13363, 8453, 10404, 1984, 10310, 10686, 4418, 7917, 10647, 10464, 11013, 8096, 9455, 12841; Payload ID: 7300 relates to Category No.: 4828, 15149, 12544, 14663, 1981, 3728, 14565; Payload ID: 7301 relates to Category No.: 14565, 14663, 15042, 1981, 3728; Payload ID: 7302 relates to Category No.: 4828, 14565, 15149, 14663, 1981, 3728; Payload ID: 7303 relates to Category No.: 4828, 14565, 14663, 1981, 3728; Payload ID: 7304 relates to Category No.: 4828, 14565, 15149, 14663, 1981, 3728, 13925, 2243; Payload ID: 7305 relates to Category No.: 4828, 14663, 1981, 3728, 9932, 14459; Payload ID: 7306 relates to Category No.: 4828, 10074, 15149, 433, 14663, 1238, 1981, 3728, 2100, 1930, 1780; Payload ID: 7307 relates to Category No.: 4828, 15149, 345, 14663, 1981, 3728, 10486; Payload ID: 7308 relates to Category No.: 4828, 15149, 12931, 14663, 7735, 1981, 3728; Payload ID: 7309 relates to Category No.: 4828, 14565, 15149, 14663, 1981, 3728; Payload ID: 7310 relates to Category No.: 4828, 15149, 12931, 14663, 1981, 3728, 6296, 1112, 12407; Payload ID: 7311 relates to Category No.: 4828, 15149, 14663, 1981, 3728, 14729, 9120, 2092, 8862; Payload ID: 7312 relates to Category No.: 4828, 14565, 15149, 10005, 16211, 14111, 13437, 4059, 11997, 10005, 2006, 1554; Payload ID: 7313 relates to Category No.: 4828, 15149, 10005; Payload ID: 7314 relates to Category No.: 4828, 6814, 14565, 10702, 10074, 325, 9929, 4808, 434, 1238, 12117, 4579, 8522, 12606, 10005, 16211, 3742, 355, 11634, 4949, 14640, 8944, 3578, 6624, 3197, 4256, 13118; Payload ID: 7315 relates to Category No.: 4828, 6814, 14565, 442, 10074, 15149, 3125, 439, 1238, 14458, 14462, 14459, 14450, 13961; Payload ID: 7316 relates to Category No.: 14565, 1955, 14177, 15201; Payload ID: 7317 relates to Category No.: 14177, 1204; Payload ID: 7318 relates to Category No.: 14177, 12646, 11224, 1780; Payload ID: 7319 relates to Category No.: 14177; Payload ID: 7320 relates to Category No.: 9500, 9287, 14663, 12242, 12265, 9236, 13812; Payload ID: 7321 relates to Category No.: 9500, 9287, 14663, 12242, 4749, 12265, 9236, 6814; Payload ID: 7322 relates to Category No.: 6814, 2885, 3021, 7946, 5610, 8667, 13366, 8530, 8689, 8150, 12577; Payload ID: 7323 relates to Category No.: 6814, 5367, 2885, 5610, 15817; Payload ID: 7324 relates to Category No.: 6814, 3021; Payload ID: 7325 relates to Category No.: 6814; Payload ID: 7326 relates to Category No.: 6814, 5428, 11941, 10794, 5617, 5657, 10477, 11118, 2013; Payload ID: 7327 relates to Category No.: 6814; Payload ID: 7328 relates to Category No.: 6814, 5367, 3013, 2013; Payload ID: 7329 relates to Category No.: 5785, 14565, 1238, 2259, 2812, 10406; Payload ID: 7330 relates to Category No.: 5785, 1238, 2259, 2812, 1237, 12544, 13690, 10406, 13820, 13969, 13870, 9052; Payload ID: 7331 relates to Category No.: 5785, 2259, 2812, 9052, 1238, 1237, 2070, 9058; Payload ID: 7332 relates to Category No.: 12091, 5785, 2259, 2812, 12407, 12646, 14025; Payload ID: 7333 relates to Category No.: 12091, 5785, 16214, 2259, 2812, 12407, 10005, 16211, 14111, 13437; Payload ID: 7334 relates to Category No.: 12091, 5785, 16214, 2259, 2812, 12407, 10005, 16211, 14111, 13437, 3140; Payload ID: 7335 relates to Category No.: 14565, 10005, 16211, 14111, 13437, 16214, 10005, 12943, 10703, 10406; Payload ID: 7336 relates to Category No.: 1816, 12407, 10005, 16211, 14111, 13437, 1265, 16214, 10005, 10703, 12943; Payload ID: 7337 relates to Category No.: 14565, 16214, 10703, 10005, 16211, 14111, 13437; Payload ID: 7338 relates to Category No.: 10703; Payload ID: 7339 relates to Category No.: 10703, 3973, 2259, 1265, 7658, 12730; Payload ID: 7340 relates to Category No.: 12253, 14663, 3474, 9236, 9235, 4749, 932, 2973, 9289, 4436, 3201, 4716, 3208, 4423, 4425; Payload ID: 7342 relates to Category No.: 15588, 11546; Payload ID: 7343 relates to Category No.: 6227, 14565, 795, 9777, 3729; Payload ID: 7346 relates to Category No.: 3328, 15632, 14285; Payload ID: 7347 relates to Category No.: 795, 9274, 792, 11765, 1844; Payload ID: 7348 relates to Category No.: 7306, 2422, 14837, 14818; Payload ID: 7349 relates to Category No.: 9274, 6670, 9279, 8653, 12772; Payload ID: 7350 relates to Category No.: 9274; Payload ID: 7351 relates to Category No.: 13589, 3398, 15490, 3398, 1730, 7306, 10372, 6269, 14636, 3577, 9406, 11143, 3737, 11479, 8710; Payload ID: 7352 relates to Category No.: 7288, 9274, 2412; Payload ID: 7353 relates to Category No.: 7288, 9274, 2412; Payload ID: 7354 relates to Category No.: 7288, 9274, 2412; Payload ID: 7355 relates to Category No.: 2410, 1204, 2412; Payload ID: 7356 relates to Category No.: 2410, 1204, 2412; Payload ID: 7357 relates to Category No.: 3452, 1955, 3354, 9274, 3448, 6670, 2410, 3309, 16197, 2412, 3453, 13904, 10521, 14838, 1978, 2243, 2158; Payload ID: 7358 relates to Category No.: 8739, 2409, 9274, 8541, 12891, 3783, 8004, 3783, 13071, 10881, 8078, 3446, 8086, 10648, 3783, 8080, 3901, 8752, 7727; Payload ID: 7359 relates to Category No.: 1295, 8739, 2409, 9274, 2410, 2412, 8004, 3783, 10881, 3446, 3901, 8752; Payload ID: 7360 relates to Category No.: 11512, 2410, 2412, 1964; Payload ID: 7361 relates to Category No.: 9274; Payload ID: 7362 relates to Category No.: 5447, 729, 3016, 15042; Payload ID: 7363 relates to Category No.: 9274; Payload ID: 7364 relates to Category No.: 14661, 9274, 1893, 4439, 1238, 10362, 12891, 3783, 8004, 3783, 3365, 4442, 2413, 3340, 1295, 13874; Payload ID: 7365 relates to Category No.: 14661, 9274, 1893, 4439, 1238, 10362, 12891, 3783, 8004, 3783, 3365, 4442, 2413, 3340; Payload ID: 7366 relates to Category No.: 10362; Payload ID: 7367 relates to Category No.: 13589, 3398, 15490, 3398, 8731, 3398, 7306; Payload ID: 7368 relates to Category No.: 13589, 3398, 15490, 3398, 1730, 5459, 10372, 1295, 11049, 16182; Payload ID: 7369 relates to Category No.: 13589, 3398, 15490, 3398, 1730, 5459, 3566, 8920, 1295, 6626, 3519; Payload ID: 7370 relates to Category No.: 13589, 3398, 15490, 3398, 9500, 8731, 3398, 11934, 8611; Payload ID: 7371 relates to Category No.: 1204; Payload ID: 7372 relates to Category No.: 6814; Payload ID: 7373 relates to Category No.: 12194, 12427, 381, 3013, 3012, 13877, 5376, 10356, 8434, 8093; Payload ID: 7374 relates to Category No.: 12194, 12427, 7131, 10491; Payload ID: 7375 relates to Category No.: 795, 10238, 12498, 11256, 11322; Payload ID: 7376 relates to Category No.: 9228; Payload ID: 7377 relates to Category No.: 1026, 14661, 12137, 11512, 14565, 1722, 10702, 3766, 15149, 5446, 10372, 6606, 348, 7743, 4186, 1795, 12391, 7134, 2311, 10366, 4127, 3775, 11285, 14992, 5541, 16085, 8988, 10878, 1238, 10188, 10954, 6145, 10955, 10583, 8004, 8049, 9410, 10522, 2158, 10574, 11623, 11348, 11010, 10648, 3639, 1780, 8373, 13084, 5806, 1709, 11934, 795, 14729, 11305; Payload ID: 7378 relates to Category No.: 1737, 7154, 14894, 2198; Payload ID: 7379 relates to Category No.: 1737, 7154, 14894, 9420, 7132, 4336, 2198, 6977; Payload ID: 7380 relates to Category No.: 1737, 7154, 14894, 2198; Payload ID: 7381 relates to Category No.: 1737, 7154, 14894, 2198; Payload ID: 7382 relates to Category No.: 1737, 7154, 14894, 2198; Payload ID: 7383 relates to Category No.: 1737, 7154, 14894, 2198; Payload ID: 7384 relates to Category No.: 1737, 7154, 14894, 2198; Payload ID: 7385 relates to Category No.: 1737, 7154, 14894, 2198; Payload ID: 7386 relates to Category No.: 15588, 15601, 14565, 14178, 6814; Payload ID: 7387 relates to Category No.: 12091, 1730, 15614, 9717, 5446, 2088, 5428, 9720, 2885, 1703, 12648, 7613, 10372, 5592, 12999, 4130, 16197, 10192, 10188, 11858, 13460, 6248, 5610, 13299, 6795, 12750, 13323, 6146, 5448, 6140, 13747, 9777, 3016; Payload ID: 7388 relates to Category No.: 11512, 7613, 12498, 1948, 10188, 11187, 12465, 10690, 11174, 11178, 11266, 13165, 13379; Payload ID: 7389 relates to Category No.: 12498; Payload ID: 7391 relates to Category No.: 14009, 4911; Payload ID: 7392 relates to Category No.: 8318, 13759; Payload ID: 7393 relates to Category No.: 690, 11512, 8739, 8731, 3398, 15517, 4949, 3587, 8611, 4952, 16133, 1227, 15736, 1550, 1577, 1580, 8592, 1730, 5406, 11506, 3398, 6796, 1625, 9321, 15740, 3172, 6791, 3589; Payload ID: 7394 relates to Category No.: 690, 13589, 3398, 11512, 795, 15517, 4949, 11506, 3398, 15400, 4952, 5406, 9107, 4953, 482, 8865, 11536, 7698, 13457, 1574, 11527, 11361, 7613, 15459, 8611, 8421, 3578, 9540, 15067, 7879, 1625, 9321, 1577, 16210, 2704, 3172, 15135, 1788, 6791, 9742, 6777, 799, 1575; Payload ID: 7395 relates to Category No.: 1812, 16096, 5406, 7303, 11634, 16136, 4949, 6375, 3710, 1541, 1814, 9722, 12552, 3714, 16139, 1568, 10623, 6404, 16095, 16119, 6402; Payload ID: 7396 relates to Category No.: 6637, 151, 6360, 11511; Payload ID: 7402 relates to Category No.: 4969; Payload ID: 7403 relates to Category No.: 12427, 14033, 1995, 12671, 11115, 10999, 11512, 7618, 11296, 2273, 7954, 8179, 8435; Payload ID: 7404 relates to Category No.: 334, 11926, 14033, 9455; Payload ID: 7405 relates to Category No.: 1204; Payload ID: 7406 relates to Category No.: 5785, 14038, 13186, 7613, 13622, 12993, 14033, 4439, 14057, 16085, 8522, 10075, 11565, 7252, 2143, 10821, 8431, 10226, 10283, 10554, 10553, 8541, 7618; Payload ID: 7407 relates to Category No.: 10331, 14033, 14778, 13867; Payload ID: 7408 relates to Category No.: 14033; Payload ID: 7409 relates to Category No.: 14033, 12948, 13867; Payload ID: 7410 relates to Category No.: 334, 11926, 7613, 10238, 10940, 1066, 7362, 14033, 16197, 12117, 15185, 12101, 2275, 10808, 10814, 10826, 10829, 10851, 1053, 11445, 12049, 13812, 1059, 11457, 2995, 5902, 13969, 13925, 13882, 13867, 13827, 13836, 13970, 8373, 13811, 10790, 13785, 13877, 2273, 3149; Payload ID: 7412 relates to Category No.: 1204; Payload ID: 7413 relates to Category No.: 2986; Payload ID: 7414 relates to Category No.: 13186, 7728, 11109, 10648, 4439, 2083, 12117, 932, 1995, 12101, 10855, 16189, 7966, 8547, 12671, 7915, 11568, 8111, 8313, 1855, 11135, 10551; Payload ID: 7415 relates to Category No.: 7728, 11109, 10648, 2083, 12117, 932, 1995, 12101, 10855, 16189, 7966, 8547, 12671, 11568, 8111, 1855, 11135; Payload ID: 7416 relates to Category No.: 14033, 1995, 12101, 11294, 12671; Payload ID: 7417 relates to Category No.: 14033, 13867, 12101, 8111, 13812, 6532, 14834, 10250, 6535, 11285, 10308, 10468, 15175; Payload ID: 7418 relates to Category No.: 14033, 2275, 11948; Payload ID: 7419 relates to Category No.: 11926, 14033; Payload ID: 7420 relates to Category No.: 7613, 10074, 3684, 3837, 1983, 10366, 1893, 1238, 11927, 15042, 10080, 5855, 919, 11520, 9746, 6504, 13353, 8516, 12508, 13044, 13294, 2020, 11298, 12195, 2239, 2229, 3827, 8756, 15471, 362, 1910, 13831, 2050; Payload ID: 7421 relates to Category No.: 14033, 1995, 12101; Payload ID: 7422 relates to Category No.: 1026, 15490, 3398, 11926, 13186, 8977, 15149, 8731, 3398, 7291, 16182, 14271, 14033, 4439, 16197, 6738, 12125, 932, 1995, 12101, 11646, 12671, 2274, 7982, 12619, 11049, 16182, 2494, 2273; Payload ID: 7423 relates to Category No.: 11926, 7613, 12127, 1893, 11922, 2014, 14025; Payload ID: 7424 relates to Category No.: 8739, 1995, 12671, 3643, 7340; Payload ID: 7427 relates to Category No.: 1026, 13248, 11926, 14565, 12427, 5446, 14033, 9420, 4130, 14663, 14015, 7132, 16085, 4336, 7112, 1995, 13867, 12101, 2275, 9053, 12671, 11111, 13779, 13812, 11948, 2274; Payload ID: 7428 relates to Category No.: 1026, 11926, 5446, 14033, 4130, 14015, 1995, 8503, 13012, 13640, 9292, 6125, 12671, 11111, 16203, 4174, 2020, 10036, 2079, 8373, 10378, 11259, 15606, 14003, 11242, 11291; Payload ID: 7429 relates to Category No.: 11926, 14015, 12137, 7613, 12427, 3684, 5446, 3837, 14096, 3829, 1893, 13882, 13831, 15456, 11927, 13311, 14478, 919, 1912, 300; Payload ID: 7430 relates to Category No.: 12137, 9420, 6107, 4949, 14640, 6375, 14699; Payload ID: 7431 relates to Category No.: 13194; Payload ID: 7433 relates to Category No.: 13589, 3398, 11512, 8739, 1995, 7293, 12671, 5406, 12091, 7743, 13925, 14838, 11051, 8782, 13867, 3605, 4144, 3607, 3012; Payload ID: 7434 relates to Category No.: 13589, 3398, 11512, 15517, 14838; Payload ID: 7435 relates to Category No.: 15517, 14838, 7131; Payload ID: 7436 relates to Category No.: 13594, 13589, 3398, 15490, 3398, 8739, 11512, 1463, 10372, 1729, 10358, 4057, 11942, 5164, 8731, 3398, 11940; Payload ID: 7437 relates to Category No.: 13589, 3398, 15490, 3398; Payload ID: 7438 relates to Category No.: 13589, 3398, 15490, 3398; Payload ID: 7439 relates to Category No.: 13589, 3398, 15490, 3398; Payload ID: 7440 relates to Category No.: 13589, 3398, 15490, 3398; Payload ID: 7441 relates to Category No.: 13589, 3398, 15490, 3398; Payload ID: 7442 relates to Category No.: 13626, 1295, 5949, 14002, 8760, 14216, 3656, 6375, 13923, 7939, 4333, 6814; Payload ID: 7443 relates to Category No.: 5782, 10702, 12153, 3452, 1955, 3354, 3448, 1893, 12120, 3453, 11660, 14838; Payload ID: 7444 relates to Category No.: 12153; Payload ID: 7445 relates to Category No.: 12153, 1730, 14838; Payload ID: 7446 relates to Category No.: 12153, 2885, 5446, 3021, 12732, 8789, 5879, 12748; Payload ID: 7447 relates to Category No.: 15626, 10702, 12153, 2228, 8936, 8920, 7635; Payload ID: 7448 relates to Category No.: 12153, 4969; Payload ID: 7449 relates to Category No.: 13589, 3398, 12154, 15490, 3398, 1721, 12153, 12638, 6733, 4766, 11967, 12365; Payload ID: 7450 relates to Category No.: 12153, 4956, 16136, 8887, 11860, 11969, 7537, 756, 3605, 15740, 8530, 14920; Payload ID: 7451 relates to Category No.: 12153; Payload ID: 7452 relates to Category No.: 11843, 12153; Payload ID: 7453 relates to Category No.: 12153; Payload ID: 7454 relates to Category No.: 12153, 7693; Payload ID: 7455 relates to Category No.: 12153; Payload ID: 7456 relates to Category No.: 12153, 1730, 12096, 5226, 1089, 12058, 11294; Payload ID: 7457 relates to Category No.: 7306, 11294, 6814, 14699, 12074; Payload ID: 7458 relates to Category No.: 8404; Payload ID: 7459 relates to Category No.: 9500, 1512, 8617, 8639, 14641, 3445, 14565, 9410, 12877, 14699, 3814, 8898; Payload ID: 7460 relates to Category No.: 3386, 3356, 3320, 3356, 15183; Payload ID: 7461 relates to Category No.: 6814; Payload ID: 7462 relates to Category No.: 15490, 3398, 11512, 1867, 14663; Payload ID: 7463 relates to Category No.: 1737, 15490, 3398, 7306, 6903, 7154, 6490, 6417, 9726, 16023, 3337, 7613, 2412, 8175, 6814; Payload ID: 7464 relates to Category No.: 3452; Payload ID: 7465 relates to Category No.: 6814, 13589, 3398, 12153, 2409, 13594, 15517, 11512; Payload ID: 7466 relates to Category No.: 13589, 3398, 15490, 3398, 8739, 11512, 7303, 11634, 8929, 2169, 15067, 7305, 4439, 4344; Payload ID: 7469 relates to Category No.: 12091, 12994, 11187; Payload ID: 7470 relates to Category No.: 13589, 3398, 11512, 5785, 10372, 1948, 3854, 287, 10188, 13874, 11187, 12465, 10690, 11174, 11178, 11266, 11510, 8206, 11580, 8739, 10947; Payload ID: 7471 relates to Category No.: 16308, 14565, 6296, 2835, 14663, 815, 11808, 4612, 8252; Payload ID: 7472 relates to Category No.: 15185, 7642, 11371, 8305; Payload ID: 7473 relates to Category No.: 13589, 3398, 15490, 3398, 11512, 1730, 8739, 16286, 8731, 3398, 1060, 1780, 7598, 7280, 8805, 10117, 7835, 11620, 12036, 8732, 724, 8734, 3307, 13594, 12646, 16096, 5406, 7303, 11740, 14565, 9410, 3641, 6269, 4998, 4251, 3587, 7242, 9125, 5015, 3602, 9554, 2603, 4366, 15402, 4254, 7378, 5612, 15426, 11731, 5012, 5019; Payload ID: 7474 relates to Category No.: 2469; Payload ID: 7475 relates to Category No.: 8312, 11082, 11019; Payload ID: 7476 relates to Category No.: 9500, 4982, 690, 15618, 11940, 5785, 13975, 1862, 1727, 10775, 11602, 14663, 12488, 1995, 10174, 13460, 13877, 3973, 2006, 11391, 7967, 3715, 8636, 6335, 10414, 13961, 4978, 5866, 3855, 16295, 8209, 14695, 13599, 4980, 1911, 13598, 1920, 14661, 13882, 13836, 7743, 8373, 12544, 8611, 10226, 7879, 2076, 5808, 8340, 8260, 8261; Payload ID: 7477 relates to Category No.: 9500, 4982, 15618, 1862, 14663, 13882, 10174, 4978, 13975; Payload ID: 7478 relates to Category No.: 16214, 14014; Payload ID: 7479 relates to Category No.: 1703; Payload ID: 7480 relates to Category No.: 6902, 12053, 3337; Payload ID: 7481 relates to Category No.: 5367, 11167, 1862, 1257, 11884, 10648, 8503, 11242, 11316, 11308, 11170, 5866, 2024, 8556, 13905, 11309, 8548, 8681, 10617, 10616, 11540, 5868, 7604, 8555, 7718, 572, 7308, 5261, 6271, 4145, 381, 2025, 13906, 746; Payload ID: 7482 relates to Category No.: 1026, 11512, 8739, 1862, 1257, 372, 1918, 11859, 5866, 7662; Payload ID: 7483 relates to Category No.: 1730, 7306, 13277; Payload ID: 7484 relates to Category No.: 9500, 12427, 1181, 11934, 5300, 14663, 9528, 13877, 10356; Payload ID: 7485 relates to Category No.: 9500, 12427, 1181, 11934, 5300, 14663, 9528, 13877, 10356; Payload ID: 7486 relates to Category No.: 9500, 12427, 12547, 12544, 1181, 11934, 5300, 14663, 1238, 9528, 10075, 13877, 13701, 10356, 11111, 9057; Payload ID: 7487 relates to Category No.: 9528, 1238; Payload ID: 7488 relates to Category No.: 1238, 9528, 8739, 11934; Payload ID: 7489 relates to Category No.: 1238, 9528; Payload ID: 7490 relates to Category No.: 9528, 1238; Payload ID: 7491 relates to Category No.: 9528; Payload ID: 7492 relates to Category No.: 9528; Payload ID: 7493 relates to Category No.: 9528, 8739, 3856; Payload ID: 7494 relates to Category No.: 12427, 1862, 16197, 4985, 4980, 10764, 4996, 10816, 11581, 10785, 13367, 11334; Payload ID: 7495 relates to Category No.: 14212, 4439, 4442, 10031; Payload ID: 7496 relates to Category No.: 1737, 7154, 2198; Payload ID: 7497 relates to Category No.: 1512, 4721, 14663, 4723; Payload ID: 7498 relates to Category No.:

1512, 4721, 14663, 4723, 2469, 6814; Payload ID: 7499 relates to Category No.: 1512, 4721, 14663, 4723, 6814; Payload ID: 7500 relates to Category No.: 1512, 4721, 14663, 5004, 4723, 5004, 3748; Payload ID: 7501 relates to Category No.: 5006; Payload ID: 7502 relates to Category No.: 1512, 4721, 14663, 7814, 4723, 13670, 5004, 3748, 12118; Payload ID: 7503 relates to Category No.: 1512, 4721, 14663, 4723; Payload ID: 7504 relates to Category No.: 1512, 4721, 14663, 4723, 6814; Payload ID: 7505 relates to Category No.: 1512, 8928, 4721, 14663, 4723, 690, 5004, 6371, 5985, 5004, 3748; Payload ID: 7506 relates to Category No.: 1512, 4721, 14663, 4723, 5004, 3748; Payload ID: 7507 relates to Category No.: 5004, 3748, 6814; Payload ID: 7508 relates to Category No.: 690, 1512, 4721, 6253, 1893, 14663, 4020, 4021, 4723, 14086, 4722, 10005, 16211, 2385, 3613, 3631, 1295, 11997, 1567, 2376, 1623; Payload ID: 7509 relates to Category No.: 1512, 14663, 4723, 12066, 4722, 6442; Payload ID: 7510 relates to Category No.: 1512, 1820, 14663, 4723, 11266, 4722, 11148, 12192, 10280, 11595, 5005, 12947, 16294, 692, 10706, 16094, 6814; Payload ID: 7511 relates to Category No.: 1512, 1204, 14663, 4723, 4722, 4021, 10372, 6814; Payload ID: 7512 relates to Category No.: 1026, 14661, 14565, 1713, 5446, 10372, 6606, 348, 4186, 7345, 9891, 12391, 10366, 4127, 3775, 5541, 16085, 8988, 11266, 11623, 1752, 12948, 11391, 10882, 16294, 14927, 10362, 7905; Payload ID: 7513 relates to Category No.: 1722, 1703, 12936, 1892; Payload ID: 7514 relates to Category No.: 13589, 3398, 15517, 7306, 14123, 14620; Payload ID: 7515 relates to Category No.: 16189; Payload ID: 7516 relates to Category No.: 7543, 8004, 8782, 10845, 6626, 10475, 10415, 10940, 10794, 10823, 10490; Payload ID: 7518 relates to Category No.: 12194, 11512, 1713, 10074, 10372, 7154, 10175, 7840, 10366, 7635, 1238, 3812, 10080, 11187, 11178, 11147, 1997, 5022, 8567, 10514, 8098, 12563, 345, 7967, 6269, 1780, 1764, 7388, 13286, 7613, 9411, 5291, 10226, 11055, 11095; Payload ID: 7519 relates to Category No.: 5782, 14565, 3691, 13343, 7743, 3775, 10648, 12026, 6738, 13104, 12125, 8191, 11646, 10595, 6735, 7933; Payload ID: 7520 relates to Category No.: 13594, 13589, 3398, 11512, 16308, 14967, 7743, 11506, 3398, 5783, 15521, 7735, 4439, 1238, 13004, 3632, 15662, 13071, 10424, 6215, 4535, 9944, 13860, 9443, 12937, 15490, 3398, 15517, 12890, 14656, 6219, 14577, 14533, 13827, 13797, 1730, 390, 1814, 3919, 13150, 8519, 15606, 8795, 8611, 10663, 10609, 8318, 7572; Payload ID: 7521 relates to Category No.: 13594, 13589, 3398, 14967, 5783, 15521, 4439, 3632, 11506, 3398; Payload ID: 7523 relates to Category No.: 15490, 3398, 14565, 8739, 3684, 1780, 1893, 5855, 1886; Payload ID: 7524 relates to Category No.: 15490, 3398, 10362; Payload ID: 7525 relates to Category No.: 1780; Payload ID: 7526 relates to Category No.: 5367, 8739, 1862, 3013, 11313, 5954, 13905, 11311, 7308, 8184, 11287, 7981, 8187, 8165, 11512, 5866, 6741, 5910, 8112, 3014, 10392, 7373, 10940, 7667, 8188; Payload ID: 7527 relates to Category No.: 15618, 9500, 1862, 5871, 2679; Payload ID: 7528 relates to Category No.: 9500, 2679; Payload ID: 7529 relates to Category No.: 12194, 11674, 12648, 7613, 10648, 10362, 10180, 7939, 7942, 2548, 11208, 1092, 3147, 14023, 10026, 10724, 11490, 14456, 2353, 7588; Payload ID: 7530 relates to Category No.: 16214, 14014, 6445; Payload ID: 7531 relates to Category No.: 10025, 9420; Payload ID: 7532 relates to Category No.: 12117, 6445, 12122, 11294, 4999, 10603, 1238, 6705, 9420; Payload ID: 7533 relates to Category No.: 1238, 10025, 9420; Payload ID: 7534 relates to Category No.: 12026, 1238, 10025, 6705, 9420; Payload ID: 7535 relates to Category No.: 14033, 14838; Payload ID: 7537 relates to Category No.: 15192, 10475, 10197; Payload ID: 7539 relates to Category No.: 8862, 13589, 3398, 15490, 3398, 11512, 8739, 10372, 8731, 3398, 9125, 11884, 4259, 3632, 10877, 15400, 10248, 9480, 8954, 860, 11294, 16137, 10513, 14941, 11582, 16090, 9785, 8415, 16136, 8009, 8653, 8494, 13457, 1574, 3591, 872, 11027, 3567, 7994, 13594, 14782, 5406, 9599, 8375, 11506, 3398, 13225, 1752, 757, 1741, 11125, 1703, 6269, 6375, 986, 1751, 13582, 11460, 10286, 10034, 7730, 15247, 14699, 9554, 2603, 8888, 5985, 7632, 6866, 1766, 2547, 12861, 13583, 414, 6995, 5067, 4504, 7000, 9317, 15734, 988, 6070, 16009, 8659, 2598, 14935, 13706, 8436, 8115; Payload ID: 7540 relates to Category No.: 15490, 3398, 13589, 3398, 8731, 3398; Payload ID: 7541 relates to Category No.: 15490, 3398, 8739, 11512, 5406, 13225, 8888, 13583, 6995, 5067, 7000, 9317, 15734, 8731, 3398; Payload ID: 7542 relates to Category No.: 13589, 3398, 15490, 3398, 8862, 1730; Payload ID: 7543 relates to Category No.: 13589, 3398, 15490, 3398, 8888, 1295, 1703, 8739, 10372, 11506, 3398, 14699, 12628, 9125, 11884, 13225, 10877, 8375, 8954, 1751, 10286, 11391, 1622, 11582, 13200, 15247, 7625, 1463, 8415, 908, 8653, 8494, 4476, 9349, 2174, 986; Payload ID: 7544 relates to Category No.: 13589, 3398, 15490, 3398, 8739, 13594, 1730, 8862; Payload ID: 7545 relates to Category No.: 13589, 3398, 15490, 3398, 6795, 8739, 8731, 3398, 14793, 14640, 11628, 9125, 13501, 14123; Payload ID: 7546 relates to Category No.: 690, 13589, 3398, 15490, 3398, 11512, 8739, 8731, 3398, 9125, 1549, 8753, 16137, 3813, 8402, 4954, 9124, 1580, 3622, 1585, 12236, 857, 13658, 3439, 5985, 978, 15966, 8748, 16096, 722, 8004, 1240, 9454, 11147, 16139, 859, 3624, 1982; Payload ID: 7547 relates to Category No.: 13589, 3398, 15490, 3398, 11512, 8739, 8731, 3398, 9125, 16130, 1549, 8753, 8004, 9480, 16137, 16096, 16090, 9124, 1580, 1551, 1578, 8734, 1585, 968, 12236, 6772, 857, 13658, 12233, 3439, 5985, 14688, 872, 7353, 15652, 15966, 8750, 7706, 8748, 9599, 722, 12891, 1741, 10710, 1240, 1564, 8402, 1565, 2706, 12516, 16139, 10321, 2547, 859, 3624, 4954, 7698, 977, 1581, 15651, 12171, 4949; Payload ID: 7548 relates to Category No.: 13589, 3398, 11091, 11512, 8731, 3398, 9125, 1549, 9480, 16137, 3813, 7597, 7596, 979, 3622, 1585, 12236, 6772, 15517, 14620, 8004, 4502, 1918, 12217; Payload ID: 7549 relates to Category No.: 13589, 3398, 15490, 3398, 1295, 8731, 3398, 4254, 9120, 9466; Payload ID: 7550 relates to Category No.: 13589, 3398, 9274, 12646, 2006, 5033, 13263; Payload ID: 7551 relates to Category No.: 11506, 3398, 3812, 8739; Payload ID: 7552 relates to Category No.: 7288, 5428, 7291, 16182, 14271, 4439, 13925, 137; Payload ID: 7553 relates to Category No.: 7288, 7291, 16182, 14271, 4439, 16197, 7295, 9169, 14201, 9174, 601, 16182; Payload ID: 7554 relates to Category No.: 7288, 14271, 7295; Payload ID: 7555 relates to Category No.: 7288, 7291, 16182, 14271, 4439, 14275, 8739, 8335, 16182; Payload ID: 7556 relates to Category No.: 7291, 16182, 14271, 4439, 7295; Payload ID: 7557 relates to Category No.: 952, 7291, 16182, 14271, 4439, 9455, 137; Payload ID: 7562 relates to Category No.: 13589, 3398, 15490, 3398, 13186, 14267, 11506, 3398, 7291, 16182, 14271, 4439, 14199, 11546, 12717, 2468, 13835, 1295, 13796, 6269, 10648, 8004, 1964, 2070, 13829, 2235, 13848, 7292, 1906, 2103, 14008, 136, 13997, 5018; Payload ID: 7563 relates to Category No.: 13589, 3398, 15490, 3398, 14267, 12891; Payload ID: 7564 relates to Category No.: 14267, 7291, 16182, 14271, 13445, 4439; Payload ID: 7565 relates to Category No.: 14267, 7291, 16182, 14271, 13445, 4439; Payload ID: 7566 relates to Category No.: 7291, 16182, 14271, 4439; Payload ID: 7567 relates to Category No.: 14267, 7291, 16182, 14271, 3791; Payload ID: 7568 relates to Category No.: 11512, 14565, 7613, 15517, 14267, 7291, 16182, 14271, 4439, 16197, 11316, 13086, 10924, 13075, 8335, 16182, 13038, 1984, 8739, 13594, 496, 6269, 13767, 5949, 14002, 1975, 11094, 11436, 381, 5073, 8004, 2169, 2009, 2235, 2243, 6375, 10501, 10923, 1906, 1463, 9485, 11432, 9738, 2105, 15400, 11345, 8507, 7671, 10494, 11273; Payload ID: 7569 relates to Category No.: 7288, 14267, 7291, 16182, 14271, 4439; Payload ID: 7570 relates to Category No.: 7288, 11345; Payload ID: 7571 relates to Category No.: 7291, 16182, 14271, 4439, 601, 16182, 2041, 11275, 11257, 1929; Payload ID: 7572 relates to Category No.: 7288, 7291, 16182, 14271, 4439, 7710, 2469, 11046, 7278; Payload ID: 7573 relates to Category No.: 2467, 14267, 7291, 16182, 14271, 4439, 9455, 2758, 10648, 1951, 10524; Payload ID: 7574 relates to Category No.: 14038, 14267, 13589, 3398, 15490, 3398, 7291, 16182, 14271, 4439; Payload ID: 7575 relates to Category No.: 1204; Payload ID: 7576 relates to Category No.: 15490, 3398, 8739, 8731, 3398, 7835, 11372, 4949; Payload ID: 7577 relates to Category No.: 15490, 3398, 8739, 8731, 3398, 7835, 8541; Payload ID: 7578 relates to Category No.: 1512, 4706, 1853, 1514, 4531, 15618, 14663, 4538, 1482, 5048, 4541, 3907, 6507, 11026; Payload ID: 7579 relates to Category No.: 15618, 1512, 4706, 14663, 4538, 1853, 4531, 793, 1482, 5048, 4541, 3907, 6507, 11026, 8554, 1514, 12911, 8310, 13909, 5998; Payload ID: 7580 relates to Category No.: 15618, 1512, 4706, 14663, 4538, 1853, 1514, 4531, 1482, 5048, 4541; Payload ID: 7581 relates to Category No.: 1512, 4706, 1853, 1514, 4531, 5045; Payload ID: 7582 relates to Category No.: 1512; Payload ID: 7583 relates to Category No.: 1512, 5291, 14865, 4721, 14663, 5290, 4723, 2385, 2384, 5932, 4729, 5931; Payload ID: 7584 relates to Category No.: 1512, 5291, 14865, 14663, 5290, 4723, 2385, 2384, 5932, 4729, 5931, 11512, 9379, 12648, 14640, 1836, 14456, 8920, 14534, 6296, 7369, 6445, 6226, 9940, 8919, 14586, 6521, 9610, 1893, 4399, 9358, 906, 12663; Payload ID: 7585 relates to Category No.: 9500, 1512, 4538, 9616, 7513, 13768; Payload ID: 7586 relates to Category No.: 13743; Payload ID: 7587 relates to Category No.: 12194; Payload ID: 7588 relates to Category No.: 1204; Payload ID: 7589 relates to Category No.: 9500, 1512, 12427, 1204; Payload ID: 7590 relates to Category No.: 9500, 1512; Payload ID: 7591 relates to Category No.: 5782, 13793; Payload ID: 7592 relates to Category No.: 9500, 7613; Payload ID: 7595 relates to Category No.: 9500, 7613; Payload ID: 7597 relates to Category No.: 6227, 2355; Payload ID: 7598 relates to Category No.: 13589, 3398, 2411, 15490, 3398, 2410, 8739, 8375, 2409; Payload ID: 7599 relates to Category No.: 13589, 3398, 2411, 15490, 3398, 1721, 2410, 1238, 11091, 14620, 8542; Payload ID: 7600 relates to Category No.: 13589, 3398, 11512, 14038, 8731, 3398, 15517, 7743, 11506, 3398, 7803, 1089, 11884, 16197, 3379, 9276, 3882, 14444, 9368, 10400; Payload ID: 7601 relates to Category No.: 1737, 13589, 3398, 11512, 14038, 7613, 8739, 8731, 3398, 10238, 15517, 7306, 11506, 3398, 7154, 2410, 1089, 2376, 4094, 10648, 13509, 12936, 5030, 6773, 3812, 11331, 14944, 7150, 7879, 6799, 10350, 3313, 3132, 2422, 11536, 3643, 7560, 11414, 14444, 9368, 10400, 2379, 12625, 6805, 2421, 5140, 8620, 10399, 7899, 12669, 14782, 472, 6530, 14838, 11051, 10372, 1780, 1782, 10034, 7625, 455, 12938, 4095, 13291, 14565, 11363, 8191, 8172; Payload ID: 7602 relates to Category No.: 13594, 1002, 11512, 5428, 795, 8739, 5446, 2411, 403, 10238, 3353, 10175, 792, 3335, 11765, 8936, 12519, 10878, 3377, 10486, 11037, 10955, 339, 10583, 10852, 1844, 10470, 3046, 7659, 3323, 10513, 5429, 11011, 7374, 13586, 8593, 13428, 16051, 10824, 15780, 11496, 11566, 10851, 1089, 3715, 6460, 10794, 10808, 10811, 11110, 3708, 2403, 11623, 10822, 13262, 11494, 11410, 10068, 7611; Payload ID: 7603 relates to Category No.: 13594, 11512, 1713, 795, 2411, 8731, 3398, 11506, 3398, 9274, 10175, 792, 2410, 3335, 11765, 13925, 13225, 2041, 3016, 10558, 3377, 13827, 3015, 1844, 3323, 10586, 10513, 5429, 16051, 10968, 11131, 13510, 10648, 6530, 14836, 8004, 14838, 7967, 10794, 10811, 14011; Payload ID: 7604 relates to Category No.: 13589, 3398, 2411, 7730, 7306, 3353, 3323; Payload ID: 7605 relates to Category No.: 13589, 3398, 2411; Payload ID: 7607 relates to Category No.: 11512, 2409, 1204, 13005, 13594, 11363; Payload ID: 7609 relates to Category No.: 9296, 3354, 10527, 3559, 15533, 13594, 2410, 12824, 12762, 5034, 14037, 12301, 14036, 11632; Payload ID: 7610 relates to Category No.: 13594, 13589, 3398, 15490, 3398, 7613, 7725, 10372, 2409, 11506, 3398, 10648; Payload ID: 7612 relates to Category No.: 5458, 1295, 13969, 14056, 13919, 1451, 1959, 11293, 356, 10208, 2063, 11190, 8050, 13912, 13783; Payload ID: 7613 relates to Category No.: 14565, 2169; Payload ID: 7614 relates to Category No.: 14565; Payload ID: 7615 relates to Category No.: 15618; Payload ID: 7616 relates to Category No.: 15618; Payload ID: 7617 relates to Category No.: 15618; Payload ID: 7618 relates to Category No.: 2404; Payload ID: 7619 relates to Category No.: 1295, 6902, 13756, 14663, 1878, 11294, 5087, 13859, 13811, 13893, 13883, 13772, 5327, 14028; Payload ID: 7620 relates to Category No.: 4828, 5428, 7191, 14451, 13659, 11601, 5503, 9932, 3757, 1999, 13653, 10798, 16213, 13530, 6758; Payload ID: 7621 relates to Category No.: 4828, 5367, 9929, 14451, 10209, 433, 11601, 4828, 2745, 15149, 3436, 6102, 5084, 16213, 3799, 3246, 13530, 6758, 15471, 4468, 4411, 4417; Payload ID: 7622 relates to Category No.: 4828, 8977, 7581, 14451, 8029, 13256, 8615, 2562, 4828, 2745, 13237; Payload ID: 7623 relates to Category No.: 4828, 5428, 13105, 7581, 14451, 1204, 10486; Payload ID: 7624 relates to Category No.: 3013, 1206, 5954, 3014; Payload ID: 7625 relates to Category No.: 3013, 1206, 5954, 3014; Payload ID: 7626 relates to Category No.: 14663, 1878, 5087, 5088, 5089, 6814; Payload ID: 7627 relates to Category No.: 1533, 14663, 1878, 5087, 1638, 5075, 5091, 1830; Payload ID: 7628 relates to Category No.: 2945, 7340, 7855, 12596, 12953, 13409, 12571, 10710, 13450, 13292, 10707, 12618, 11320, 12948, 1408; Payload ID: 7630 relates to Category No.: 13589, 3398, 15490, 3398, 14565, 5807, 12263, 10307, 6814; Payload ID: 7631 relates to Category No.: 795, 14962; Payload ID: 7632 relates to Category No.: 6814; Payload ID: 7633 relates to Category No.: 690, 7912, 10074, 10238, 12459, 7743, 12891, 2311, 7735, 7598, 1238, 10080, 4180, 7719, 7659, 7721, 8200, 13344, 13293, 12543, 10781, 13319, 3014, 10629, 8806, 10285, 7920; Payload ID: 7634 relates to Category No.: 15588, 4439, 5094, 7108, 15698; Payload ID: 7635 relates to Category No.: 15588, 4439, 5094, 15698; Payload ID: 7636 relates to Category No.: 11941, 6741, 6742, 3829, 12194; Payload ID: 7637 relates to Category No.: 14661, 5785, 14565, 10702, 13485; Payload ID: 7638 relates to Category No.: 403; Payload ID: 7639 relates to Category No.: 7912; Payload ID: 7640 relates to Category No.: 5095, 2409, 2414, 2410, 5741, 5182, 3345, 3364, 3365, 13966; Payload ID: 7641 relates to Category No.: 13594, 13589, 3398, 15490, 3398, 674, 2409, 8408, 3365, 9455, 4418, 7334; Payload ID: 7642 relates to Category No.: 9274, 14838; Payload ID: 7643 relates to Category No.: 8739, 9274, 2410, 12117, 10362, 3901, 10749; Payload ID: 7644 relates to Category No.: 9274, 8739, 9279; Payload ID: 7645 relates to Category No.: 9274, 8739, 9279; Payload ID: 7646 relates to Category No.: 9274, 8739, 9279; Payload ID: 7647 relates to Category No.: 1730, 7306, 9274, 14838, 14831, 1202; Payload ID: 7648 relates to Category No.: 2410, 2412; Payload ID: 7649 relates to Category No.: 7743, 2410, 2412; Payload ID: 7650 relates to Category No.: 7743, 2410, 2412; Payload ID: 7651 relates to Category No.: 2410, 1204, 2412; Payload ID: 7652 relates to Category No.: 7743, 2410, 2412; Payload ID: 7653 relates to Category No.: 2410, 1204, 2412; Payload ID: 7654 relates to Category No.: 2410, 1204, 2412; Payload ID: 7655 relates to Category No.: 2410, 1204, 2412; Payload ID: 7656 relates to Category No.: 2410, 1204, 2412; Payload ID: 7657 relates to Category No.: 2410, 1204, 2412; Payload ID: 7658 relates to Category No.: 2410, 1204, 2412; Payload ID: 7659 relates to Category No.: 2410, 1204, 2412; Payload ID: 7660 relates to Category No.: 9274, 2410, 9276, 14838, 3969, 5428, 10275, 10069, 7220; Payload ID: 7661 relates to Category No.: 9274, 2410, 5447, 729, 3016; Payload ID: 7662 relates to Category No.: 9274, 2410, 5447, 729, 3016; Payload ID: 7663 relates to Category No.: 9274, 2410; Payload ID: 7664 relates to Category No.: 9274, 2410, 5447, 729, 3016; Payload ID: 7665 relates to Category No.: 9274, 2410, 5447, 729, 3016; Payload ID: 7666 relates to Category No.: 9274, 2410, 5447, 729, 3016; Payload ID: 7667 relates to Category No.: 9274, 2410; Payload ID: 7668 relates to Category No.: 9274, 2410, 5447, 729, 3016; Payload ID: 7669 relates to Category No.: 9274, 2410, 5447, 729, 3016; Payload ID: 7670 relates to Category No.: 9274, 2410, 5447, 729, 3016; Payload ID: 7671 relates to Category No.: 9274, 2410; Payload ID: 7672 relates to Category No.: 9274, 2410; Payload ID: 7673 relates to Category No.: 9274, 2410; Payload ID: 7674 relates to Category No.: 9274, 2410; Payload ID: 7675 relates to Category No.: 14661, 9274, 2410, 1893, 4439, 1238, 12891, 3783, 8004, 3783, 10491, 3364, 4442, 2413, 11935, 12893, 3340; Payload ID: 7676 relates to Category No.: 14661, 9274, 2410, 1893, 4439, 1238, 12891, 3783, 8004, 3783, 10491, 3364, 4442, 2413, 11935, 12893, 3340; Payload ID: 7677 relates to Category No.: 14661, 9274, 2410, 1893, 4439, 1238, 12891, 3783, 8004, 3783, 10491, 3364, 4442, 2413, 11935, 12893, 3340; Payload ID: 7678 relates to Category No.: 14661, 9274, 2410, 1893, 4439, 1238, 12891, 3783, 8004, 3783, 10491, 3364, 4442, 2413, 11935, 12893, 3340; Payload ID: 7679 relates to Category No.: 14661, 9274, 2410, 1893, 4439, 1238, 12891, 3783, 8004, 3783, 10491, 3364, 4442, 2413, 11935, 12893, 3340; Payload ID: 7680 relates to Category No.: 14661, 9274, 2410, 1893, 4439, 1238, 12891, 3783, 8004, 3783, 10491, 3364, 4442, 2413, 11935, 12893, 3340; Payload ID: 7681 relates to Category No.: 14661, 9274, 2410, 1893, 4439, 1238, 12891, 3783, 8004, 3783, 10491, 3364, 4442, 2413, 11935, 12893, 3340; Payload ID: 7682 relates to Category No.: 14661, 9274, 2410, 1893, 4439, 1238, 12891, 3783, 8004, 3783, 10491, 3364, 4442, 2413, 11935, 12893, 3340; Payload ID: 7683 relates to Category No.: 14661, 9274, 2410, 1893, 4439, 1238, 12891, 3783, 8004, 3783, 10491, 3364, 4442, 2413, 11935, 12893, 3340; Payload ID: 7684 relates to Category No.: 14661, 9274, 2410, 1893, 4439, 1238, 12891, 3783, 8004, 3783, 10491, 3364, 4442, 2413, 11935, 12893, 3340; Payload ID: 7685 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7686 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7687 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7688 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7689 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7690 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7691 relates to Category No.: 1204; Payload ID: 7692 relates to Category No.: 3399, 5443, 9274, 14661, 2167, 3452, 3354, 3448, 15257, 2410, 1893, 4439, 7132, 3453, 12891, 3783, 8004, 3783, 3364, 3365, 4442, 2413, 11935, 8266, 3340, 5186; Payload ID: 7693 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7694 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7695 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7696 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7697 relates to Category No.: 2410, 1204, 2412; Payload ID: 7698 relates to Category No.: 2410, 1204, 2412; Payload ID: 7699 relates to Category No.: 2410, 1204, 2412; Payload ID: 7700 relates to Category No.: 2410, 1204, 2412; Payload ID: 7701 relates to Category No.: 9274, 2410, 5447, 729, 3016; Payload ID: 7702 relates to Category No.: 9274, 2410; Payload ID: 7704 relates to Category No.: 14661, 9274, 1893, 4439, 1238, 12891, 3783, 8004, 3783, 4442, 2413, 3340; Payload ID: 7705 relates to Category No.: 14661, 9274, 1893, 4439, 1238, 12891, 3783, 8004, 3783, 4442, 2413, 3340; Payload ID: 7706 relates to Category No.: 14661, 9274, 1893, 4439, 1238, 12891, 3783, 8004, 3783, 4442, 2413, 3340; Payload ID: 7707 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7708 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7709 relates to Category No.: 2412, 9276, 16050; Payload ID: 7710 relates to Category No.: 9274, 2410; Payload ID: 7711 relates to Category No.: 3452, 3354, 9274, 3448, 15257, 3453, 11935, 8532; Payload ID: 7712 relates to Category No.: 14661, 2167, 3452, 3354, 3399, 5443, 9274, 3448, 15257, 2410, 1893, 4439, 7132, 3453, 12891, 3783, 8004, 3783, 3364, 3365, 4442, 2413, 11935, 8266, 3340, 5186; Payload ID: 7713 relates to Category No.: 15490, 3398, 11512, 952, 7613, 8739, 2411, 10372, 8731, 3398, 9321, 2467, 2409, 11506, 3398, 15521, 2410, 5113, 9125, 4439, 16197, 7132, 8988, 1238, 15570, 7724, 11897, 5147, 12891, 3783, 8004, 8004, 3783, 3578, 7597, 11310, 7560, 4065, 3769, 5183, 4940, 4326; Payload ID: 7714 relates to Category No.: 6814, 13589, 3398, 15490, 3398, 8739, 8731, 3398, 2409, 2410, 5113, 9125, 11897, 5147, 9349; Payload ID: 7715 relates to Category No.: 6814, 13589, 3398, 15490, 3398, 2409, 5113, 5147, 9349; Payload ID: 7716 relates to Category No.: 15490, 3398, 11512, 952, 7613, 8739, 2411, 10372, 8731, 3398, 9321, 2467, 11506, 3398, 2410, 5113, 4439, 8988, 1238, 7724, 3038, 5147, 12891, 3783, 8611, 8004, 3783, 3578, 8378, 11300, 10446, 8298, 11310, 4065, 3769, 5183, 4940, 4326, 6489, 2110, 13925, 2131, 13827, 2001, 1956, 13775, 13811, 11582, 13961, 13795, 1995, 10578, 13881, 7879, 1564, 11138, 11566, 10823, 1115, 7870, 8444; Payload ID: 7717 relates to Category No.: 15490, 3398, 11512, 7613, 8739, 8731, 3398, 2409, 14894, 2410, 5113, 8408, 9125, 11285, 1867, 14663, 8988, 7724, 11897, 11502, 2469, 13376, 5147, 8192, 11510, 1971, 8611, 13166, 2467, 13189, 7699, 6814; Payload ID: 7718 relates to Category No.: 8862, 15490, 3398, 11512, 5428, 8739, 2411, 10372, 8731, 3398, 1060, 2409, 11506, 3398, 5113, 11363, 5147, 12891, 3783, 13893, 8611, 1053, 1565, 8035, 11292, 13342, 8356, 13822, 9684, 5183, 7743, 14640, 9454, 12595, 8421, 13479, 13517, 11390, 2136, 13827, 11089, 11391, 2051, 11306, 2086, 10889; Payload ID: 7719 relates to Category No.: 15490, 3398, 11512, 5428, 8739, 2411, 8731, 3398, 1060, 2409, 2410, 5113, 9125, 2412, 2009, 11363, 11897, 5147, 12891, 3783, 1053, 7738, 13342, 8356, 13210, 8004, 4949, 9454, 8421, 13479, 13517, 13811, 7315, 2041, 13827, 13767, 8929; Payload ID: 7720 relates to Category No.: 15490, 3398, 5782, 8731, 3398, 11371, 5113, 9420, 6451, 7016, 11897, 1995, 14025, 13376, 5147, 12891, 3783, 13970, 7131, 8510, 494, 10573, 8549, 8434, 13946, 13398, 13865, 2001, 11310, 8094, 12487, 9684, 13148, 6444, 15770, 2129, 10164, 5281, 10408, 10769, 8300, 12096, 15898, 12839, 15899, 7120, 11887, 12861, 2060; Payload ID: 7721 relates to Category No.: 15490, 3398, 2409, 8421, 9125, 1893, 12120, 11660, 5147, 8391, 10368, 8149, 8739, 16096, 1812, 2051, 8374, 8929, 8923, 13589, 3398; Payload ID: 7722 relates to Category No.: 15490, 3398, 8739, 2409, 2410, 14612, 5113, 7132, 5147, 2404, 12720; Payload ID: 7723 relates to Category No.: 15490, 3398, 5428, 8739, 8731, 3398, 4949, 1060, 5113, 9125, 2009, 5147, 1053, 10368, 9684, 5183, 13479, 13517, 2409, 13775, 8929; Payload ID: 7724 relates to Category No.: 13589, 3398, 8731, 3398, 3354, 11506, 3398, 12891, 3309, 10648, 4332, 8004, 5406, 13612, 3900, 7381, 8739, 15490, 3398; Payload ID: 7725 relates to Category No.: 13594, 690, 9500, 795, 1730, 7613, 16197, 12488, 9174; Payload ID: 7726 relates to Category No.: 13594, 15490, 3398, 7291, 16182, 12777, 3559, 16191; Payload ID: 7727 relates to Category No.: 13589, 3398, 15490, 3398, 7306; Payload ID: 7729 relates to Category No.: 5367, 748, 736; Payload ID: 7730 relates to Category No.: 9982, 1204; Payload ID: 7731 relates to Category No.: 13589, 3398, 2411, 16286, 8831, 3699; Payload ID: 7732 relates to Category No.: 13589, 3398, 15490, 3398, 1722, 16286, 11222; Payload ID: 7733 relates to Category No.: 3431, 2493; Payload ID: 7734 relates to Category No.: 11506, 3398, 13594, 11512, 4536, 15517, 5544, 4535, 11531, 13704, 13589, 3398, 13975, 2355, 2411, 13681, 1227, 6269, 14656, 11997, 4977, 13860, 3632, 13004, 3595, 10036, 13739, 1184, 4104, 1277, 1186, 4115, 9585, 14102, 12988, 8739; Payload ID: 7735 relates to Category No.: 11506, 3398, 3632, 5949, 11791, 11531, 13335, 11789, 4450, 8739, 11512, 724, 10648, 7613, 3641, 13681, 6269, 5544, 9125, 3646, 5451, 13860, 5066, 12800, 3577, 1320, 3801, 3819, 16006, 5951, 5015, 8277, 12556, 6810, 8844, 6806, 8845, 6807, 8279, 2467, 13969, 13827, 13799, 5019, 12171, 3598; Payload ID: 7737 relates to Category No.: 1721, 2167, 9274, 2429, 13344, 12767; Payload ID: 7738 relates to Category No.: 1894, 1780, 14663, 5217, 16234, 16275, 1210, 11865, 13791, 5106; Payload ID: 7739 relates to Category No.: 9500, 9410; Payload ID: 7740 relates to Category No.: 13589, 3398, 15490, 3398, 14456, 5458, 674, 7306, 2562, 12534, 860, 9476, 2548, 8919, 3600, 859, 9402, 198, 14437, 2547, 13594, 11512, 724, 673, 5459, 2110, 5066, 8862, 7251, 2177, 14113, 14116, 14117, 4069, 4070; Payload ID: 7741 relates to Category No.: 13589, 3398, 11512, 15517, 7306, 724, 12891, 6530, 14838, 14640, 3595, 14586, 12213, 16041; Payload ID: 7742 relates to Category No.: 13589, 3398, 15490, 3398, 674, 7306, 11506, 3398, 14640, 3595, 3445, 6802, 1318, 3194, 10357, 10429, 1623, 724, 12891, 6530, 6878, 14838, 3578, 12703, 3584, 3610, 14586, 9409, 12213, 16041; Payload ID: 7743 relates to Category No.: 13589, 3398, 15490, 3398, 14640, 11512, 16096, 674, 16136, 9410, 6523, 5458, 11033, 3584, 15425, 3714, 12551, 860, 1316, 3712, 10982, 3593; Payload ID: 7744 relates to Category No.: 13589, 3398, 15490, 3398, 8739, 11512, 9599, 724, 3445, 8375, 7001, 1741, 3613, 2110, 9454, 8421, 1743, 7251, 3614, 14417, 14113, 1298, 14112, 14115; Payload ID: 7745 relates to Category No.: 690, 13589, 3398, 15490, 3398, 724, 9410, 3613, 10372, 15400, 1622, 1250, 15402, 3612, 9580, 14808, 4506, 9407; Payload ID: 7746 relates to Category No.: 13589, 3398, 15490, 3398, 674, 7306; Payload ID: 7747 relates to Category No.: 13589, 3398, 11512, 10238, 15517, 7598, 11310, 11057, 7951, 7303, 9599, 724, 1752, 3613, 14640, 6375, 7242, 13103, 6561, 3814, 6553, 15402, 1625, 13758, 13756, 3612, 6371, 6291, 6378, 15482, 6390, 15478, 1819, 1329, 6788, 5756; Payload ID: 7748 relates to Category No.: 13589, 3398, 15490, 3398, 724, 3613, 3612; Payload ID: 7749 relates to Category No.: 690, 13589, 3398, 11512, 8739, 8731, 3398, 15517, 7754, 8326, 8209, 8195, 724, 3613, 14944; Payload ID: 7750 relates to Category No.: 13589, 3398, 15490, 3398, 7306, 3705, 8349, 724, 12891, 6530, 14838, 3023, 6559, 3584, 3612, 14586, 12213, 16041; Payload ID: 7751 relates to Category No.: 13589, 3398, 15490, 3398, 8739; Payload ID: 7752 relates to Category No.: 13589, 3398, 15490, 3398, 7306, 9599, 11512, 674, 724, 673, 3613, 14116, 14117, 4069, 4070, 14120; Payload ID: 7753 relates to Category No.: 690, 13589, 3398, 15490, 3398, 3781, 14050, 12936, 7242, 11819, 3796, 14022; Payload ID: 7754 relates to Category No.: 13589, 3398, 15490, 3398, 7306, 1237, 724, 3445, 3613, 14641, 7241, 14113, 14116, 4069, 8877; Payload ID: 7755 relates to Category No.: 690, 13589, 3398, 15490, 3398, 8739, 724, 13225, 3613, 3023, 1622, 4969, 15402, 4066, 4506, 14120; Payload ID: 7756 relates to Category No.: 13589, 3398, 15490, 3398, 11512, 4970, 11412, 8739, 724, 3613, 14910, 4998, 3023, 1780, 14641, 7241, 1270, 14781; Payload ID: 7757 relates to Category No.: 13589, 3398, 674, 15517, 11512, 724, 3613, 3612, 3711; Payload ID: 7758 relates to Category No.: 13589, 3398, 15490, 3398, 724, 3613, 3612, 3855; Payload ID: 7759 relates to Category No.: 13589, 3398, 15490, 3398, 7306, 724, 3613, 7372, 10292; Payload ID: 7760 relates to Category No.: 13589, 3398, 15490, 3398, 8349, 724, 3613, 483, 14454, 14641, 4855, 3441, 7306; Payload ID: 7761 relates to Category No.: 13589, 3398, 15490, 3398, 1713, 1483, 11512, 724, 6559, 3612; Payload ID: 7762 relates to Category No.: 13589, 3398, 15490, 3398, 10372, 724, 14885, 14640, 3595, 8919, 12213; Payload ID: 7763 relates to Category No.: 13589, 3398, 11512, 15517, 3641, 724, 6878, 14640, 3578, 3610, 9409, 12213; Payload ID: 7764 relates to Category No.: 13589, 3398, 15490, 3398, 7306; Payload ID: 7765 relates to Category No.: 13589, 3398, 674, 4937, 15517, 11512, 724, 7526, 15460; Payload ID: 7766 relates to Category No.: 13589, 3398, 15490, 3398, 724, 14640, 1622, 3603; Payload ID: 7767 relates to Category No.: 13594, 13589, 3398, 15490, 3398, 724, 3612; Payload ID: 7768 relates to Category No.: 13589, 3398, 13594, 15490, 3398, 7306, 8408, 724, 3612; Payload ID: 7769 relates to Category No.: 13589, 3398, 15490, 3398, 8739, 724, 8929, 14641; Payload ID: 7770 relates to Category No.: 13589, 3398, 15490, 3398, 724, 3613, 3612; Payload ID: 7771 relates to Category No.: 15490, 3398, 8731, 3398, 11506, 3398; Payload ID: 7772 relates to Category No.: 13589, 3398, 15490, 3398, 8929, 14454, 3612; Payload ID: 7773 relates to Category No.: 13589, 3398, 15490, 3398, 11512, 724, 12891, 14885, 3613, 483, 14640, 14636, 3595, 5071, 8919, 14586, 12213, 4264, 9742; Payload ID: 7774 relates to Category No.: 13589, 3398, 15490, 3398, 3445, 1318, 9599, 724, 12891, 6878, 14640, 3578, 3194, 3595, 12703, 3584, 3610, 1623, 14586, 9409, 12213, 10357, 10429; Payload ID: 7775 relates to Category No.: 13589, 3398, 15490, 3398, 9599, 14640, 3578; Payload ID: 7776 relates to Category No.: 13589, 3398, 7306, 15517, 12646, 11512, 9599, 724, 14640, 3578, 6523, 3595, 6194, 12559, 4469, 11819, 7240, 1306, 3593; Payload ID: 7777 relates to Category No.: 13589, 3398, 15490, 3398, 11091, 1820, 9125, 10648, 15402, 724, 1622, 3613, 4506; Payload ID: 7778 relates to Category No.: 13589, 3398, 15490, 3398, 7306, 724, 3613, 14944; Payload ID: 7779 relates to Category No.: 13589, 3398, 7306, 11512, 15517, 722, 3563, 8739, 724, 14641; Payload ID: 7780 relates to Category No.: 13589, 3398, 15490, 3398, 8739, 11512, 724, 12891, 3613, 483, 14636, 6559, 5071, 3584, 3612, 14586, 12213, 4264, 9742; Payload ID: 7781 relates to Category No.: 12091, 13589, 3398, 15490, 3398, 4057, 4039, 13635, 10226, 3023, 3707, 724, 5809, 8929, 10372, 6116, 14699, 3573, 5859, 448, 14058, 3608; Payload ID: 7782 relates to Category No.: 12091, 15490, 3398, 11512, 12619, 9713, 14656, 3854, 11506, 3398, 5809, 3313, 14568, 4057, 10878, 7187, 11363, 7662, 11542, 11242, 5806, 2006, 9716, 10226, 10105, 8739, 724, 483, 8929, 10372, 484, 15570, 10513, 8373, 6116, 14699, 11285, 3573, 5859, 14058, 3608, 16267; Payload ID: 7783 relates to Category No.: 12091, 13589, 3398, 795, 7613, 9713, 8193, 9716, 7293; Payload ID: 7784 relates to Category No.: 12091, 9713, 11858, 5221, 13466; Payload ID: 7785 relates to Category No.: 15149, 11371, 13514, 13796, 9931, 12607, 14624, 1114, 10301, 12570, 14622, 2281; Payload ID: 7786 relates to Category No.: 4814, 13514, 12931, 1453, 1114, 2281; Payload ID: 7787 relates to Category No.: 4814, 13514, 12122; Payload ID: 7789 relates to Category No.: 3100, 11910; Payload ID: 7791 relates to Category No.: 8175, 3684, 14033, 14096, 3829, 1893, 13831, 10581, 7915, 3667, 9746, 15898, 11242, 13383, 12803, 12830, 1836, 7840; Payload ID: 7792 relates to Category No.: 9500, 14663, 1878, 6343, 15835, 15834, 1830; Payload ID: 7793 relates to Category No.: 12137, 7306, 3699, 6445, 3697, 3525, 14834; Payload ID: 7794 relates to Category No.: 12137, 3639, 3699, 6445, 3697, 3525; Payload ID: 7795 relates to Category No.: 12137, 6962, 2902, 3699, 6445, 3697, 3525, 4762, 8370, 12008, 5612, 8954; Payload ID: 7796 relates to Category No.: 13594, 15490, 3398, 7730, 15736, 8739, 4949, 5113, 13342, 12948, 6371, 11421, 11384; Payload ID: 7797 relates to Category No.: 15174, 14838, 6678, 9379, 6687, 6689, 1227, 6690, 12984, 15144; Payload ID: 7798 relates to Category No.: 6687, 6690; Payload ID: 7799 relates to Category No.: 12091, 5785, 14565, 7306; Payload ID: 7800 relates to Category No.: 5936, 3913, 1739, 4969; Payload ID: 7801 relates to Category No.: 13589, 3398, 1721, 8739, 2410, 9420, 10648, 12117, 7122, 5185, 10349, 5189, 5190, 13691, 13344, 15517, 11512, 2079; Payload ID: 7803 relates to Category No.: 13594, 8739, 16197; Payload ID: 7804 relates to Category No.: 13589, 3398; Payload ID: 7806 relates to Category No.: 6212; Payload ID: 7807 relates to Category No.: 7469; Payload ID: 7808 relates to Category No.: 11926, 5874, 12066; Payload ID: 7809 relates to Category No.: 11926, 11237, 12603, 7710, 11298; Payload ID: 7812 relates to Category No.: 11926; Payload ID: 7813 relates to Category No.: 12194, 12633, 7662, 10036, 8756, 2397, 10574, 7860, 3072; Payload ID: 7814 relates to Category No.: 12194, 5808, 10238, 3974, 1888, 2012, 2083, 7724, 1995, 13165, 10471, 10470, 2110, 11294, 11859, 10356, 1993, 8374, 8431, 10601, 483, 484, 8928, 4251, 7122, 13189, 5806, 7728, 13870, 2211, 9612; Payload ID: 7815 relates to Category No.: 12194, 12633, 8756, 7662; Payload ID: 7816 relates to Category No.: 12194, 12633, 8756; Payload ID: 7817 relates to Category No.: 15490, 3398, 14565, 8739, 7306, 8731, 3398; Payload ID: 7818 relates to Category No.: 13589, 3398, 14565, 15517, 7306; Payload ID: 7819 relates to Category No.: 14565, 15517, 7306, 11506, 3398, 14620; Payload ID: 7820 relates to Category No.: 14098, 4771, 7965, 13370, 9406, 3889, 16170, 4766, 10796, 10439, 6102, 674, 724, 16213, 5866, 6103, 7613, 13796, 14838, 795, 13161, 11949, 2169, 8928, 5544, 13530, 6296, 8373, 8374, 1295, 8923, 3691, 1018, 14729, 7112, 8906, 7122, 3833, 901, 4418, 3676, 3167, 4855, 12008, 13158, 6167, 9639, 5263, 12349, 3431, 15993, 9585, 1709, 2486, 5991, 11123, 15016, 9338, 8881, 7295, 7839; Payload ID: 7821 relates to Category No.: 13589, 3398, 334, 15490, 3398, 795, 1730, 12498, 803, 2493, 2506, 11316, 3639; Payload ID: 7822 relates to Category No.: 795, 12427, 2506; Payload ID: 7824 relates to Category No.: 2410, 2412; Payload ID: 7825 relates to Category No.: 12137, 1002, 1295, 15149, 3986, 1779, 12851, 8988, 11997, 726, 10567, 14095, 7649, 13275, 11436, 4342, 10796, 11099, 11123, 2235, 8906, 11087, 7852, 16170, 5332; Payload ID: 7826 relates to Category No.: 3452, 9296, 1955, 3356, 3354, 3448, 5805, 3309, 2022, 7145, 6679, 12091, 7134, 13371, 14034, 7890, 3564; Payload ID: 7827 relates to Category No.: 3452, 9296, 3354, 5805, 3309, 7145, 6679; Payload ID: 7828 relates to Category No.: 1703, 14640, 2169, 4021, 7131; Payload ID: 7829 relates to Category No.: 1703, 14640, 2169, 3869, 4015; Payload ID: 7830 relates to Category No.: 1703, 14640, 2169; Payload ID: 7831 relates to Category No.: 1703, 14640, 2169; Payload ID: 7832 relates to Category No.: 12194, 1703; Payload ID: 7833 relates to Category No.: 13589, 3398, 15490, 3398, 10074, 1238, 10080, 2051, 7879; Payload ID: 7834 relates to Category No.: 5289, 4028, 4015, 1512, 5291, 1703, 4721, 14663, 4723, 7989, 2094, 3940; Payload ID: 7835 relates to Category No.: 1703, 10372, 10366, 2014, 2136, 5289, 4028, 4015, 5949, 1971, 16096, 11591, 2094, 11035, 973, 13723, 3623, 1274, 5291, 11390, 10766, 3940, 10883, 10882, 11425; Payload ID: 7836 relates to Category No.: 1512, 5291, 1703, 11506, 3398, 14663, 4723, 5289, 4028, 4015, 10765; Payload ID: 7837 relates to Category No.: 1512, 5291, 14663, 5290, 4723; Payload ID: 7838 relates to Category No.: 5428, 14038, 1512, 5291, 14663, 7735, 2014, 2136, 5290, 4723, 10362, 5289, 10343, 10765, 13998, 2385, 2384, 1970, 10573, 10574, 10226, 13779, 1622, 2141, 10696, 2094, 2090, 3610; Payload ID: 7839 relates to Category No.: 11512, 14038, 1512, 5291, 14663, 7735, 2014, 2136, 8546, 5290, 8524, 10790, 4723, 5949, 10856, 10852, 13998, 16189, 2131, 11259, 4722, 7214, 7989, 1970, 10600, 8255, 13779, 1622, 2141, 11591, 15558, 4329, 13723, 7308, 3021, 14641, 4969, 7305; Payload ID: 7840 relates to Category No.: 5428, 14038, 1512, 2014, 2136, 5290, 13779, 1622, 2141; Payload ID: 7841 relates to Category No.: 1512, 4722, 2384; Payload ID: 7843 relates to Category No.: 3790, 7306, 2461, 16138, 15479, 1040; Payload ID: 7844 relates to Category No.: 15618, 13041, 12197, 5846, 5848, 14586, 14840, 7304, 14054, 2156, 13983, 2090; Payload ID: 7846 relates to Category No.: 9500, 14663, 1878, 4098, 4743, 4695, 13975; Payload ID: 7847 relates to Category No.: 9500, 4112; Payload ID: 7848 relates to Category No.: 9500, 4110, 4100, 1867, 14663, 13874, 13888, 13827, 13767, 8118; Payload ID: 7849 relates to Category No.: 6814, 9500, 4110, 1592, 4100, 9945, 1867, 14663, 4653, 13888, 13827; Payload ID: 7850 relates to Category No.: 6814, 1592, 4100, 9945, 1867, 14663, 4653; Payload ID: 7851 relates to Category No.: 6915, 4609, 1874, 14663, 12338, 1512, 4615; Payload ID: 7852 relates to Category No.: 6814, 6915; Payload ID: 7853 relates to Category No.: 4110; Payload ID: 7854 relates to Category No.: 4828, 7131, 10491; Payload ID: 7855 relates to Category No.: 4828, 8216, 8999, 11101, 10211; Payload ID: 7856 relates to Category No.: 4828; Payload ID: 7857 relates to Category No.: 9500, 14962, 3932, 14663, 14972, 682, 4512, 7004; Payload ID: 7858 relates to Category No.: 9500, 14962, 14663, 14972, 682, 4512, 7004; Payload ID: 7859 relates to Category No.: 9500, 14663, 14962, 1186, 1189; Payload ID: 7860 relates to Category No.: 9982; Payload ID: 7861 relates to Category No.: 15317, 14663, 9708, 4977, 10174, 12209, 13835, 1911, 1948, 13967, 13969, 13882, 13874, 13827, 13773, 13939, 14054, 13944, 1910, 9411, 13916, 908, 13799, 1951, 14039, 13810, 2032, 1904; Payload ID: 7862 relates to Category No.: 6814, 9500, 2835, 14663, 15570, 7724, 15379, 815, 11808, 4145, 9489, 6263, 9590, 6262, 3493; Payload ID: 7863 relates to Category No.: 6814, 1204; Payload ID: 7864 relates to Category No.: 6814, 9500, 14663, 14972, 4512, 6375; Payload ID: 7865 relates to Category No.: 6814, 9500; Payload ID: 7866 relates to Category No.: 6814, 9500, 14663, 14972, 4512, 4145, 13859, 13882, 13888, 13827, 14011, 13851, 4515, 12549; Payload ID: 7867 relates to Category No.: 6814, 9500, 3932, 14663, 14962, 14972, 3934, 1269, 2054, 15301; Payload ID: 7868 relates to Category No.: 6219, 6814, 9500, 15715, 14663, 1878, 1308, 6163, 11941, 1709; Payload ID: 7869 relates to Category No.: 6814, 9500, 3932, 14663, 14972, 683; Payload ID: 7870 relates to Category No.: 6814, 9500, 4104, 3932, 15660, 6310, 1867, 14663, 4021, 10383; Payload ID: 7871 relates to Category No.: 6814, 9500, 1204, 10910; Payload ID: 7872 relates to Category No.: 6814, 9500, 14963; Payload ID: 7873 relates to Category No.: 6814, 9500, 14962, 14000, 5406, 10036; Payload ID: 7874 relates to Category No.: 6814, 9500, 14663, 14972, 682, 6523, 15301; Payload ID: 7875 relates to Category No.: 6814, 9500, 4100, 1867, 14663, 1186, 1189, 4102, 15979, 587, 9455, 3934, 684, 16146, 6661, 14520, 16144; Payload ID: 7876 relates to Category No.: 6814, 9500, 682, 683; Payload ID: 7877 relates to Category No.: 6814, 9500, 3932, 14663, 2347; Payload ID: 7878 relates to Category No.: 6814, 9500, 4104, 3932, 684, 3934; Payload ID: 7879 relates to Category No.: 6814, 9500; Payload ID: 7880 relates to Category No.: 6814, 9500, 1204; Payload ID: 7881 relates to Category No.: 13589, 3398, 15490, 3398, 5808, 8739, 16286, 7306, 8831, 10516, 14566; Payload ID: 7882 relates to Category No.: 15490, 3398, 8731, 3398; Payload ID: 7883 relates to Category No.: 15618, 13041, 11674, 14740, 15149, 13126, 11676, 5848, 1925, 14067, 780; Payload ID: 7884 relates to Category No.: 15618, 13041, 11674, 14740, 15149, 1816, 13126, 5848, 1925, 1932; Payload ID: 7885 relates to Category No.: 15618, 13041, 11674, 14740, 15149, 13126, 5848, 1956, 13807; Payload ID: 7886 relates to Category No.: 15618, 13041, 11674, 14740, 15149, 1651, 13126, 5848, 1925, 7340, 12594, 12954, 1932, 12953, 1237, 13121, 14336; Payload ID: 7887 relates to Category No.: 8962, 15149, 4132, 11987, 10486, 9932, 10301, 11555, 13238, 3971, 7890, 8489, 3529, 8770; Payload ID: 7888 relates to Category No.: 4828, 2000, 15149, 4132, 12718, 14646, 13980, 8962; Payload ID: 7889 relates to Category No.: 4828, 2000, 15149, 4132, 12718, 14646, 13980, 2471, 9932, 8962; Payload ID: 7890 relates to Category No.: 5340, 14663, 12242, 9256, 12265, 12251, 5398, 5397, 11941, 9236, 12260, 411, 4908, 4752, 10529, 4748, 5338, 2888, 3041, 6296, 3428, 6417, 2176, 2248, 4855, 13775, 15016, 408; Payload ID: 7891 relates to Category No.: 13589, 3398, 11512, 14565, 11506, 3398, 12891, 9125, 13882, 2014, 10558, 10415, 3812, 10682, 11113, 2006, 11224, 13597, 16080, 10573, 10226, 10586, 8433, 1034, 11595, 2642, 11596, 9525, 11310, 10417, 13599, 7294, 11521, 2572, 10761, 13617, 3553, 15490, 3398, 2243, 1730, 12646, 1249, 16213, 1862, 10256, 7613, 9480, 8554, 3437, 4952, 690, 1240, 3592, 4535, 1622, 8373, 7332, 13578, 5998, 12603, 8042, 10802, 1072, 8869, 8728, 8420, 11085, 13953, 3605, 11026, 7664, 3247, 4994, 12481, 16095, 12923, 1585, 14060, 8715, 5756, 3792, 8276, 5341, 5993, 8875, 13835, 1984, 2079, 8739, 13859, 2041, 13936, 10372, 13827, 2001, 13836, 13767, 10238, 11391, 2051, 13860, 1957, 10648, 6626, 381, 13853, 1959, 10378, 2009, 2130, 13786, 13776, 13810, 2039, 13994, 14052, 13770, 8811, 14003, 1928, 2071, 1936, 2038, 12672, 1946; Payload ID: 7892 relates to Category No.: 15490, 3398, 9500, 2006, 13597, 8402, 11062, 11600, 8744, 9679, 9665, 9664; Payload ID: 7893 relates to Category No.: 11512, 13594, 690, 13589, 3398, 795, 8408, 2006, 13597, 15517, 13882; Payload ID: 7894 relates to Category No.: 10372, 14015, 10491, 10475, 10913, 993; Payload ID: 7895 relates to Category No.: 12427, 3684, 1893, 13831, 5855, 2006, 13909, 8100, 7613, 7916, 13882; Payload ID: 7896 relates to Category No.: 5874, 4977; Payload ID: 7897 relates to Category No.: 9982, 1512, 1204, 3204; Payload ID: 7898 relates to Category No.: 6814, 1512, 14663, 4723, 4722, 2385, 2384; Payload ID: 7899 relates to Category No.: 1512, 14663, 4723, 4722, 2385, 2384, 3288, 3107, 14641, 1764, 6194, 6445, 2280; Payload ID: 7907 relates to Category No.: 14589, 13225; Payload ID: 7908 relates to Category No.: 5367, 1816; Payload ID: 7909 relates to Category No.: 15490, 3398, 11512, 1721, 8739, 8731, 3398, 3854, 2409, 6795, 6412, 13589, 3398, 13594, 1060, 11506, 3398, 14056, 10648, 11509, 3900, 11051, 15400, 11344, 4998, 4251, 7537, 4468, 6403, 10265, 9769, 15194, 14063, 11116, 607, 11104; Payload ID: 7910 relates to Category No.: 15490, 3398, 11512, 1204; Payload ID: 7911 relates to Category No.: 13594, 11512, 12498, 1053, 6795, 12531, 12530, 13092, 15517; Payload ID: 7912 relates to Category No.: 15490, 3398, 11512, 8731, 3398; Payload ID: 7913 relates to Category No.: 13589, 3398, 15490, 3398; Payload ID: 7914 relates to Category No.: 14052; Payload ID: 7915 relates to Category No.: 5785, 15207, 15614, 9717, 5446, 403, 12646, 9070, 12091, 14565, 4127, 15185, 2878, 355, 1849, 5606, 5694; Payload ID: 7916 relates to Category No.: 6814, 1204; Payload ID: 7917 relates to Category No.: 15604, 9420, 7108, 7109, 7110, 7111, 13742; Payload ID: 7918 relates to Category No.: 8929, 1767, 13845; Payload ID: 7919 relates to Category No.: 7613, 795, 674, 13420; Payload ID: 7920 relates to Category No.: 12876; Payload ID: 7923 relates to Category No.: 6814; Payload ID: 7924 relates to Category No.: 1002, 5428, 5446; Payload ID: 7927 relates to Category No.: 14565, 8739, 13465, 7840, 13370, 14029, 13893, 1053, 8662, 13148, 11512, 8511, 7618, 10506; Payload ID: 7928 relates to Category No.: 5367, 1070, 12427, 5446, 4127, 9777, 12432, 9777, 3729, 2610, 2488, 4130, 10262, 14057, 729, 12166, 11328, 4494; Payload ID: 7930 relates to Category No.: 5381, 10266, 12994, 14776; Payload ID: 7931 relates to Category No.: 5367, 1070, 12427, 5446, 3013, 4127, 9777, 12432, 9777, 3729, 2610, 2488, 4130, 10262; Payload ID: 7932 relates to Category No.: 1070, 12427, 5446, 2610, 3013, 4127, 9777, 12432, 9777, 3729, 2610, 2488, 4130, 10262; Payload ID: 7933 relates to Category No.: 1070, 12427, 5446, 2610, 3013, 4127, 9777, 12432, 9777, 3729, 2610, 2488, 4130, 10262; Payload ID: 7935 relates to Category No.: 1070, 12427, 5446, 2610, 3013, 4127, 9777, 12432, 9777, 3729, 2610, 2488, 4130, 10262; Payload ID: 7936 relates to Category No.: 1070, 10262, 5286, 5381, 345, 736, 10266, 10955, 3525, 10543, 11178, 3015; Payload ID: 8008 relates to Category No.: 5367, 1070, 12427, 5446, 2610, 3013, 4127, 9777, 12432, 9777, 3729, 2610, 2488, 4130, 12994, 10262; Payload ID: 8048 relates to Category No.: 5367, 12427, 5446, 2610, 4127, 2610, 2488, 4130, 12994; Payload ID: 8054 relates to Category No.: 5367, 12427, 5446, 2610, 4127, 2610, 2488, 4130, 12994; Payload ID: 8073 relates to Category No.: 5367, 12427, 5446, 2610, 4127, 2610, 2488, 4130, 12994; Payload ID: 8080 relates to Category No.: 5367, 5382; Payload ID: 8081 relates to Category No.: 5367, 12427, 5446, 2610, 5382, 4127, 2610, 2488, 4130, 12994; Payload ID: 8082 relates to Category No.: 5367, 12427, 5446, 2610, 4127, 2610, 2488, 4130, 12994; Payload ID: 8134 relates to Category No.: 5367, 1070, 12427, 5446, 3013, 4127, 9777, 12432, 9777, 3729, 2610, 2488, 4130, 10262; Payload ID: 8135 relates to Category No.: 1070, 12427, 5446, 3013, 4127, 9777, 12432, 9777, 3729, 2610, 2488, 4130, 10262; Payload ID: 8136 relates to Category No.: 15588, 13589, 3398, 15490, 3398, 11940, 3356, 3354, 3320, 3353, 14886; Payload ID: 8137 relates to Category No.: 1703; Payload ID: 8138 relates to Category No.: 10257; Payload ID: 8139 relates to Category No.: 8920; Payload ID: 8141 relates to Category No.: 13589, 3398, 14565; Payload ID: 8142 relates to Category No.: 1730, 7306, 9451; Payload ID: 8143 relates to Category No.: 1703, 12936; Payload ID: 8146 relates to Category No.: 5988; Payload ID: 8147 relates to Category No.: 14589, 13225; Payload ID: 8148 relates to Category No.: 5367, 1795; Payload ID: 8149 relates to Category No.: 8862, 1780, 14586, 7252, 14636; Payload ID: 8150 relates to Category No.: 3038, 5255, 13525; Payload ID: 8151 relates to Category No.: 5255, 10793; Payload ID: 8152 relates to Category No.: 1204; Payload ID: 8153 relates to Category No.: 12427, 11170; Payload ID: 8154 relates to Category No.: 1730, 5243, 5544, 13860, 9554; Payload ID: 8155 relates to Category No.: 6814, 5428, 3012, 10234, 3566, 8390, 8789, 8721, 8723, 2012, 8114, 8112, 2061, 2041, 2013, 2014, 2136, 2097, 15437, 11307; Payload ID: 8156 relates to Category No.: 9500, 14663, 12242, 4747, 12251, 12259, 9236, 6417, 13812, 14056; Payload ID: 8157 relates to Category No.: 9500, 12251, 14663, 12242, 4747, 12259, 9236, 2020, 6417, 14056, 11941; Payload ID: 8158 relates to Category No.: 14318; Payload ID: 8159 relates to Category No.: 14318; Payload ID: 8160 relates to Category No.: 11091, 8739, 7728, 1983, 1204, 1905, 8535, 8509, 2001, 8506, 1898, 8937, 2036, 12790, 11552, 2142, 1915, 8745, 13622; Payload ID: 8161 relates to Category No.: 5782, 15506, 14166; Payload ID: 8162 relates to Category No.: 5782, 11949; Payload ID: 8163 relates to Category No.: 12137, 5782, 9075, 11949, 3400, 11949, 15606, 14166, 3364, 3365; Payload ID: 8164 relates to Category No.: 5782, 16197, 9075, 1906, 11949, 3400, 11949, 15606, 14166, 8049, 11259; Payload ID: 8165 relates to Category No.: 5782, 14565, 12603, 11949, 16197, 5446; Payload ID: 8166 relates to Category No.: 5782, 14565, 11949, 4439, 4442; Payload ID: 8167 relates to Category No.: 5782, 11949, 15506; Payload ID: 8168 relates to Category No.: 5785, 1183, 1814, 1749; Payload ID: 8170 relates to Category No.: 1737, 2886, 11997, 7131, 10491, 11300, 3900, 16199, 200, 16188, 10448; Payload ID: 8171 relates to Category No.: 12194, 1816, 7306, 14699, 14640, 1714, 11453, 8105, 4952, 3578, 1622, 10218, 11394, 7590, 14790, 8683, 5593, 1730, 11512, 5406, 7303, 9599, 3604, 1463, 10372, 12936, 3799, 8928, 9455, 1751, 9451, 3577, 1744, 7730, 9554, 4947, 10983, 7238, 2379, 1277, 3573, 9600, 14697, 10446, 16095, 3609, 14072, 12192, 3807, 16239, 7968, 1466, 13835, 8617, 7613, 6626, 12628, 10574, 10429; Payload ID: 8172 relates to Category No.: 9500, 15750, 14663, 1878, 11448, 15752, 4145, 5376, 10238, 5428, 13925, 8138, 8688, 10829, 7571, 7315, 8680, 2880, 11462, 10436, 11569, 5978, 15129; Payload ID: 8173 relates to Category No.: 9500, 15750, 14663, 1878, 15752, 5376; Payload ID: 8174 relates to Category No.: 6902, 616, 14025; Payload ID: 8175 relates to Category No.: 5367, 15192, 14589, 15211; Payload ID: 8176 relates to Category No.: 14565, 403, 3012, 15185, 1053, 15192, 5327, 10197; Payload ID: 8177 relates to Category No.: 14038, 15518, 14271, 16197, 8175; Payload ID: 8178 relates to Category No.: 8862, 14565, 1722, 12619, 1730, 1816, 12498, 11167, 13105, 1729, 14656, 3854, 1795, 14640, 12646, 7724, 9485, 8249, 8468, 13841, 4994, 8128, 7643, 10630, 7993, 6530; Payload ID: 8179 relates to Category No.: 13594, 8862, 11512, 1722, 1730, 1816, 11167, 13105, 1729, 14656, 3854, 7743, 11506, 3398, 1795, 4859, 3012, 10648, 7735, 6530, 372, 4332, 7724, 9540, 13827, 4039, 10394, 10601, 10586, 4969, 9485, 8249, 3643, 8468, 4937, 4994, 8128, 7643, 10630, 7993, 4065, 9320, 15008, 11764, 12883, 11154, 4343, 6796, 6799, 1933, 1974; Payload ID: 8180 relates to Category No.: 1730, 12498, 11167, 13105, 1729, 14656, 4859, 3012, 4094, 372, 2009, 13936, 8118, 2116, 9485, 10630, 7993, 11154, 8066, 10241, 9375, 2033; Payload ID: 8181 relates to Category No.: 12498, 11167, 13105, 1729, 14656, 4859; Payload ID: 8182 relates to Category No.: 12498, 11167, 13105, 1729, 14656, 4859; Payload ID: 8183 relates to Category No.: 8546, 8535, 13695; Payload ID: 8184 relates to Category No.: 7835, 7743, 10241; Payload ID: 8185 relates to Category No.: 690, 15490, 3398, 8731, 3398, 15570, 8611, 1249, 14123, 1244, 8734, 8739, 7613, 4949, 2469, 11912, 8421, 13105, 7879, 1257, 13779, 2572, 3714, 12488, 6384, 6389, 1295, 13969, 2131, 7864, 1956, 10648, 2068, 8929, 10574, 1960, 2087, 10190, 8507, 1802, 7922, 13657, 8592; Payload ID: 8186 relates to Category No.: 15490, 3398, 8731, 3398, 2467, 7306, 11506, 3398, 10648, 8930, 8375, 8004, 8611, 13071, 3743, 11391, 12717, 2158, 10350, 3577, 11533, 6295, 6553, 12886, 8367, 6562, 10282, 3792, 3647, 8739, 6878, 4949, 2469, 1751, 10248, 8421, 1729, 10947, 7879, 9333, 455, 7537, 10606, 9349, 9769, 10586, 7643, 8415, 6757, 2044, 3747, 6141, 1346, 3742; Payload ID: 8187 relates to Category No.: 8731, 3398, 7306, 7345, 8611, 8739, 6878, 9320, 4949, 2169, 2469, 15490, 3398, 8352, 8421, 3791, 9129, 12775, 14050, 10238, 12619, 8929; Payload ID: 8188 relates to Category No.: 13594, 15490, 3398, 8731, 3398, 8739, 11512, 1892, 8375, 10372, 4332, 2174, 2469, 1780, 1295, 7625, 4094, 5073, 11147, 7971, 2248, 8415, 8898; Payload ID: 8189 relates to Category No.: 1721, 7743, 12626, 2409, 7735, 11506, 3398, 11949; Payload ID: 8190 relates to Category No.: 13589, 3398, 15490, 3398, 14565, 10238, 7743, 2409, 11506, 3398, 14838, 14831, 12936, 14834, 11542, 12676, 8178, 13420, 6535, 6528, 14442, 7618; Payload ID: 8191 relates to Category No.: 13589, 3398, 15490, 3398, 10238, 2410, 12936, 5182, 5131, 2409;

Payload ID: 8192 relates to Category No.: 1722, 795, 8731, 3398, 10238, 3356, 7743, 3313, 14568, 2410, 5146, 5189, 5190, 8042, 5184, 11847, 5095; Payload ID: 8193 relates to Category No.: 15490, 3398, 10238, 3356, 7743, 11506, 3398, 2410, 5146, 8042, 11847, 10241, 5095; Payload ID: 8194 relates to Category No.: 12091, 11512, 15207, 5428, 14038, 7613, 5446, 5359, 11109, 2711, 11506, 3398, 1795, 7362, 10775, 13313, 4127, 14992, 15782, 8988, 2136, 15003, 5659, 15456, 15450, 7363, 15448, 15443, 15454, 11573, 5361, 15446, 15653, 15457, 15458, 15451, 3910, 9292, 6125, 13635, 8355, 14494, 9295, 12836, 7651, 11399, 1061, 10334, 14622, 13925, 14025, 10372, 13827, 11094, 8936, 11090, 13843; Payload ID: 8195 relates to Category No.: 12091, 13594, 15499, 5367, 14565, 2410, 10366, 11884, 13360; Payload ID: 8196 relates to Category No.: 12091, 5367, 11940, 5808, 5446, 9038, 10775, 8789, 15456, 15450, 7363, 15448, 5361, 15653, 13891, 2145, 14030; Payload ID: 8197 relates to Category No.: 5367, 15490, 3398, 11512, 15207, 5428, 14038, 795, 5446, 1955, 5359, 11109, 345, 1795, 7362, 10775, 4127, 16197, 14992, 15782, 15003, 5912, 15456, 15450, 7363, 15448, 15443, 15454, 11573, 15446, 15653, 15457, 15458, 15451, 9292, 6125, 13635, 9295, 8374, 3920, 352, 1061; Payload ID: 8198 relates to Category No.: 6902; Payload ID: 8199 relates to Category No.: 14661, 7154, 2886, 7132, 2429; Payload ID: 8200 relates to Category No.: 1204, 2768, 7029; Payload ID: 8201 relates to Category No.: 12194, 1204; Payload ID: 8202 relates to Category No.: 12194, 12100, 1955, 14838, 15113, 9485, 1295, 13755, 1237, 7086, 9489, 2240; Payload ID: 8203 relates to Category No.: 1737, 11512, 2139, 3452, 2411, 3320, 3448, 7159, 14894, 2022, 10362, 11128, 12886, 16050, 6814; Payload ID: 8204 relates to Category No.: 13589, 3398, 15490, 3398, 3354, 3353; Payload ID: 8205 relates to Category No.: 13589, 3398, 15490, 3398, 2411, 3354, 3353, 1204; Payload ID: 8206 relates to Category No.: 13589, 3398, 15490, 3398, 3354, 3353; Payload ID: 8207 relates to Category No.: 13589, 3398, 15490, 3398, 3356, 3354, 3353; Payload ID: 8209 relates to Category No.: 14663, 9236, 3092, 2424, 5906; Payload ID: 8210 relates to Category No.: 14663, 7131, 5501, 5504, 9982; Payload ID: 8214 relates to Category No.: 15618, 14565, 10074, 1415, 5446, 1417, 4186, 5848, 4127, 4130, 3775, 14663, 14992, 16085, 8988, 13882, 1238, 5503, 13004, 3728, 13695, 5810, 355, 7686, 11634, 3667, 16267, 3810, 5846; Payload ID: 8215 relates to Category No.: 15618, 15626, 14565, 10074, 1415, 5446, 4186, 5848, 4127, 4130, 3775, 14663, 14992, 16085, 8988, 13882, 1238, 5503, 13004, 3728, 355, 1925, 1417, 1966; Payload ID: 8216 relates to Category No.: 4828, 15618, 11940, 14565, 10074, 1415, 5446, 4186, 5848, 4127, 4130, 11934, 3775, 14663, 14992, 16085, 8988, 1238, 5503, 13004, 10486, 3728, 355, 13796, 1419, 1417, 6323, 6758, 14462, 14450, 14458, 1925; Payload ID: 8217 relates to Category No.: 9869, 14663, 5501, 9982; Payload ID: 8218 relates to Category No.: 9869, 2885, 10238, 14663, 7735, 15817, 5501, 9814, 9982; Payload ID: 8219 relates to Category No.: 12091, 14663, 9862, 5501, 5498; Payload ID: 8220 relates to Category No.: 9869, 3100, 5480, 11634, 14640, 3631, 3578, 2374, 2385; Payload ID: 8221 relates to Category No.: 9982, 14663, 5501, 8889, 5498; Payload ID: 8222 relates to Category No.: 1703, 3639, 9861, 286, 9858, 9945, 14663, 5501, 3631, 5376, 11634, 7743, 8004, 1867, 4538, 13888, 14328; Payload ID: 8223 relates to Category No.: 14565, 9869, 9815, 14663, 5500, 5501; Payload ID: 8224 relates to Category No.: 14565, 9883, 3100, 9858, 9945, 14663, 5501; Payload ID: 8225 relates to Category No.: 14565, 9883, 3100, 9858, 9945, 14663, 5501, 1836, 8424, 13361, 13260, 12554; Payload ID: 8226 relates to Category No.: 9861, 14663, 5501; Payload ID: 8227 relates to Category No.: 14661, 14565, 9861, 13485, 14663, 5501, 5406, 14838, 14831, 13372; Payload ID: 8228 relates to Category No.: 15207, 14565, 795, 9861, 9858, 9815, 9945, 14663, 1238, 6145, 5501, 5381, 10238, 7743, 5785, 8106, 8041, 8424, 8326, 7644, 7641, 8617, 10265, 10933, 3167, 10586, 7667, 8158, 8387; Payload ID: 8229 relates to Category No.: 9861, 9858, 9945, 9420, 1204, 14663, 9862, 5500, 11094; Payload ID: 8230 relates to Category No.: 9891, 1565, 9860, 13361, 16060; Payload ID: 8231 relates to Category No.: 9861, 9858, 9945, 14663, 5501, 8378, 8446, 8301; Payload ID: 8232 relates to Category No.: 4828, 2000, 8731, 3398, 9861, 3100, 274, 11506, 3398, 9858, 1925, 9945, 14663, 2136, 14328, 2009, 8117, 8524, 8522, 5500, 8535, 8543, 8447, 8446, 1960, 4535, 8661, 8255, 11591, 8025, 7560, 7679, 12129, 8032, 12920, 8031, 8620, 7874, 11326, 5406, 13888; Payload ID: 8233 relates to Category No.: 14565, 9869, 9858, 9815, 14663, 5491, 5500, 5480, 5501; Payload ID: 8234 relates to Category No.: 9869, 14565, 9815, 14663, 5491, 5500, 5480, 5501; Payload ID: 8235 relates to Category No.: 9940, 14663, 5480, 5501; Payload ID: 8236 relates to Category No.: 9982, 14565, 3100, 14663, 1238, 5508, 5501; Payload ID: 8237 relates to Category No.: 9982, 14565, 14663, 5501, 13530, 5491, 12091, 274, 3058, 10503; Payload ID: 8238 relates to Category No.: 14565, 14663, 5501, 6606, 1795, 8349, 11626, 15388, 10218, 13371, 7373, 15194, 8384, 2604, 11305; Payload ID: 8239 relates to Category No.: 9982, 14663, 7131, 5501, 10491; Payload ID: 8240 relates to Category No.: 8862, 3889, 6376; Payload ID: 8242 relates to Category No.: 4828, 13589, 3398, 10372, 1816, 6606, 11109, 381, 11602, 10366, 1893, 14663, 12654, 5541, 4538, 8812, 13004, 3632, 16294, 10955, 10362, 13373, 11187, 11178, 11266, 10358, 3728, 10682, 361, 11113, 10522, 11033, 8508, 10394, 4541, 4535, 8431, 11111, 13363, 10666, 10910, 8216, 7975, 11240, 8021, 11275, 10478, 8549, 10680, 7576, 13627, 8532, 8357, 8033, 10800, 572, 8540, 4108, 8574, 11328, 11170, 10293, 7977, 13914; Payload ID: 8243 relates to Category No.: 6814, 1780, 14663, 14932, 7707, 2355, 5459, 7001, 7974, 15664, 2347, 14012, 8656, 14979, 9540, 2755, 7971; Payload ID: 8244 relates to Category No.: 14663, 14932, 2355, 5459, 7001, 7974, 15664, 2347, 14012, 8656, 14979, 9540, 2755, 13888, 13923, 13843; Payload ID: 8245 relates to Category No.: 12091, 4828, 13589, 3398, 9720, 1512, 15614, 10372, 14569, 345, 12794, 10366, 360, 11285, 5541, 2009, 11858, 10955, 11266, 10682, 361, 10522, 11033, 4953, 4535, 11111, 10666, 11935, 10509, 10680, 11328, 15558, 11506, 3398, 472, 6530, 12869, 9410, 1993, 9717, 3781, 6538, 3980, 10970, 13835, 13967, 13859, 13874, 13888, 13837, 13767, 13934, 8004, 8535, 14022, 14029, 10683, 4094, 14045, 12991, 8772; Payload ID: 8246 relates to Category No.: 1026, 14661, 14565, 5446, 10372, 9854, 6606, 348, 4186, 9891, 12391, 4127, 3775, 5541, 16085, 8988, 2009, 13888, 8117, 10667, 8118, 11186, 5911, 4535, 10666, 10680, 10800, 5552, 10668, 10608, 13981, 12891, 10366, 6212, 12036, 6559, 11980, 10983; Payload ID: 8247 relates to Category No.: 1026, 14661, 14565, 5446, 10372, 6606, 348, 10266, 4186, 9891, 12391, 4127, 3775, 5541, 16085, 8988, 4538, 2009, 10801, 13071, 5911, 6215, 10666, 10680, 13860, 8473, 8198, 10668, 10608, 7642, 10366, 1780, 1295, 6559, 10983, 1984, 2087; Payload ID: 8248 relates to Category No.: 14565, 11371, 5541, 13071; Payload ID: 8249 relates to Category No.: 12091, 9720, 15614, 275, 11858, 1900, 6538; Payload ID: 8250 relates to Category No.: 12194, 11940, 12195, 12099, 5541, 1149, 16189, 11282, 5536, 3167, 1292, 5262, 15891, 5535, 11934, 11941, 1888, 8549; Payload ID: 8251 relates to Category No.: 1816, 14838, 10573, 11623, 5406, 6530, 7613, 10372, 7743, 10309, 439, 9378; Payload ID: 8252 relates to Category No.: 14565, 1816, 7306, 1780, 4145; Payload ID: 8253 relates to Category No.: 1204, 10614; Payload ID: 8254 relates to Category No.: 1204, 7613, 6530, 14838, 14834, 14831, 4167; Payload ID: 8255 relates to Category No.: 11512, 14565, 7613, 10074, 10372, 9854, 3356, 11506, 3398, 7345, 12891, 14640, 9891, 7965, 12391, 1780, 10366, 1893, 1238, 12117, 1273, 10080, 10955, 13867, 11187, 11178, 3846, 12190, 11147, 7252, 11290, 10683, 10682, 11390, 10522, 11033, 10626, 11391, 11305, 10574, 8567, 10296, 10513, 10666, 11584, 10197, 8632, 10324, 11259, 15606, 13189, 11980, 11536, 10803, 10680, 1701, 4696, 14632, 7343, 7416, 7381, 7388, 8417, 11561, 7303, 7743, 6375, 13371, 1729, 5552, 4040, 6559, 15818, 4475, 5458, 1320, 8862, 11266, 7946, 8449, 15824, 1250, 10405, 1984, 6371, 2387, 11822, 6389, 11823, 12843, 3980, 6383, 11819, 16272, 13246, 13367, 11825, 7597, 2010, 11064, 13618, 13967, 13969, 13925, 13859, 13882, 13936, 496, 13966, 13767, 13970, 4145, 14011, 12646, 6758, 13961, 10362, 1959, 1964, 13795, 2009, 10606, 3145, 12573, 8374, 7791; Payload ID: 8256 relates to Category No.: 12091, 5367, 14565, 7613, 15614, 9717, 10372, 9854, 12133, 9891, 10366, 5541, 13049, 11858, 10522, 5552, 5409, 10955, 9410, 8611, 8524, 1295, 6559, 2009, 8256, 3781, 11266, 11033, 1984, 11822, 6538, 3980, 9720; Payload ID: 8257 relates to Category No.: 10331, 13589, 3398, 10074, 10372, 7306, 14640, 11285, 1893, 5541, 4538, 1238, 9451, 10080, 10955, 11291, 11178, 11266, 11033, 11308, 10197, 12892, 10680, 10800, 5542, 10679, 11512, 9410, 11051, 15011, 3980, 13835, 13967, 13969, 16294, 13827, 13837, 2051, 4145, 6758, 13996, 13961, 8361; Payload ID: 8258 relates to Category No.: 8760, 4439, 7295, 12736, 2758, 13187, 8954, 9541, 14210; Payload ID: 8259 relates to Category No.: 674, 8760, 4439, 7295, 12736; Payload ID: 8260 relates to Category No.: 15588, 674, 8760, 4439, 7295, 12736; Payload ID: 8261 relates to Category No.: 15626, 14565, 12427, 5552, 14838, 4828, 12498, 6269, 10238, 14000, 9411, 11634; Payload ID: 8262 relates to Category No.: 14565, 3684, 12633, 1893, 13006, 9746, 10362, 5541, 15427; Payload ID: 8263 relates to Category No.: 13006, 13888, 12633, 1893, 10197, 13835, 14565, 13859, 13936, 496, 13827, 13836, 13966, 13927, 4145, 14000, 14011, 2000; Payload ID: 8264 relates to Category No.: 13006, 12091, 10331, 795, 10238, 12633, 7743, 1893, 8617, 8535, 8635, 8636, 11062, 10955, 12936, 9455, 12913, 10803, 15809; Payload ID: 8265 relates to Category No.: 14565, 12633, 14640, 1780, 3336, 1893, 13006, 10955, 12936, 12913, 10803, 15809, 5428; Payload ID: 8266 relates to Category No.: 14565, 12633, 8760, 2079, 7737, 1925, 1893, 8120, 8635, 8636, 13866, 4939, 12936, 9455, 4535, 4538, 8421, 8042, 11266, 6371, 12913, 4145, 10803, 15011, 6566, 15809, 8346, 8624, 5785, 14637; Payload ID: 8267 relates to Category No.: 12633, 13006, 14565, 7743, 1893; Payload ID: 8268 relates to Category No.: 1703, 12633, 7743, 5458; Payload ID: 8269 relates to Category No.: 14565, 1703, 1893; Payload ID: 8270 relates to Category No.: 12633; Payload ID: 8271 relates to Category No.: 15490, 3398, 1721, 8739, 7743, 12891, 3632, 10358, 8535, 15134, 10350, 13344, 9110, 15536, 11084, 9106, 15806, 9557, 470, 1730, 10372, 10366, 15805, 3634; Payload ID: 8272 relates to Category No.: 13589, 3398, 15490, 3398; Payload ID: 8274 relates to Category No.: 8862, 1893, 7594; Payload ID: 8275 relates to Category No.: 8929, 8378, 10600; Payload ID: 8276 relates to Category No.: 14720, 7613, 7840, 1229, 5453, 15849; Payload ID: 8277 relates to Category No.: 14720; Payload ID: 8278 relates to Category No.: 14720; Payload ID: 8279 relates to Category No.: 14720; Payload ID: 8280 relates to Category No.: 1955, 3354, 7134, 14720, 13904; Payload ID: 8281 relates to Category No.: 14720; Payload ID: 8282 relates to Category No.: 14720; Payload ID: 8283 relates to Category No.: 14565, 14720; Payload ID: 8284 relates to Category No.: 3309, 2022, 14720; Payload ID: 8285 relates to Category No.: 14720; Payload ID: 8286 relates to Category No.: 14720; Payload ID: 8288 relates to Category No.: 4460; Payload ID: 8289 relates to Category No.: 14565, 7345; Payload ID: 8290 relates to Category No.: 15490, 3398, 12137, 11512, 5785, 1730, 1752, 10372, 1820, 5592, 7743, 12942, 12547, 12405, 10359, 7946, 9125, 1206, 11293, 8522, 11125, 11266, 8507, 1246, 7720, 10557, 7989, 361, 5573, 12615, 15762, 2143, 1970, 7386, 11418, 7992, 7738, 8543, 8667, 13009, 10629; Payload ID: 8291 relates to Category No.: 1737, 13589, 3398, 15490, 3398, 14661, 14565, 1703, 2167, 10238, 803, 7154, 9274, 7132, 8988; Payload ID: 8292 relates to Category No.: 1026, 1820, 5592, 7743, 4021, 1238, 7340, 7933, 11200, 1703, 9000, 1852, 11089, 16102, 1713, 8940, 345; Payload ID: 8293 relates to Category No.: 1026, 1820, 5592, 4021, 1238; Payload ID: 8294 relates to Category No.: 1703, 1820, 5592, 7345, 4021, 9455, 1705, 15045, 2591; Payload ID: 8295 relates to Category No.: 1026, 1703, 1820, 5592, 4021, 1238, 16189, 9410, 6799, 1823, 1705, 15045, 2591, 2079, 13969, 10343, 13882, 13953, 11390, 16294, 11182, 3729, 13827, 11391, 2051, 4145, 10790, 1780, 1964, 13772, 10904, 5336, 10573, 10216, 6559, 10371, 10446, 10445, 13915, 10513, 14645, 3900, 11546, 11392, 4229, 11216, 3146, 11555, 5019, 13979; Payload ID: 8296 relates to Category No.: 1026, 1703, 10074, 5592, 4021, 1238, 10080, 1820, 10075, 10904; Payload ID: 8297 relates to Category No.: 1703, 5592, 1820, 13681, 4021, 1238, 6145, 8848, 6799, 13616, 10588, 6375, 14643, 12551, 13703, 8934, 8584, 4004, 3058, 6758, 14593, 13827, 10648, 10383, 11094, 7742, 13863, 6626, 4949, 10573; Payload ID: 8298 relates to Category No.: 15043, 1060, 1820, 5592, 12405, 12994, 4021, 1238, 6145, 6149, 3643, 5041, 6137, 8516, 1821, 1752, 1703, 5037, 4949, 1250, 2393, 4066, 15202, 1948, 10904, 3226, 5399, 10901, 10905, 2507, 11459; Payload ID: 8299 relates to Category No.: 690, 1026, 1703, 5592, 4021, 1238, 6145, 11178, 16189, 1823, 7600, 11596, 3643, 5041, 16294, 14927, 5037, 1825, 6758, 6137, 1808, 10366, 10383; Payload ID: 8300 relates to Category No.: 1703, 11512, 10702, 10238, 5592, 7965, 3246, 4021, 1238, 6145, 1825, 11201, 1823, 1749, 14643, 4990, 3534, 13713, 7526, 609, 4200, 1820, 1334, 1705, 9321, 10379, 1968; Payload ID: 8301 relates to Category No.: 12648, 1820, 5592, 7345, 4021, 3643, 5041, 1249, 1752, 1703; Payload ID: 8302 relates to Category No.: 15043, 1820, 5592, 14589, 4021, 5949, 6799, 3900, 6878, 5459, 6758, 1779, 11542, 14697, 11528, 1295; Payload ID: 8303 relates to Category No.: 1703, 5592, 1026, 4021, 9000, 16294; Payload ID: 8304 relates to Category No.: 5367, 5592, 4021, 5041, 326; Payload ID: 8305 relates to Category No.: 1703, 5592, 4021; Payload ID: 8306 relates to Category No.: 14565, 5428, 1703, 1820, 5592, 12405, 12994, 4021, 1238, 6145, 5037, 7252, 6137, 15187, 1795, 10307, 11460, 326, 10379, 12650, 14589; Payload ID: 8307 relates to Category No.: 1703, 5446, 5592, 4021, 1238, 15456, 15450, 6145, 3534; Payload ID: 8308 relates to Category No.: 690, 1026, 1703, 15043, 1415, 1752, 10372, 1746, 746, 1820, 5592, 4040, 7965, 742, 15223, 742, 16085, 4021, 1238, 6145, 3846, 10343, 16189, 13299, 7553, 1823, 8248, 785, 8219, 3643, 8220, 5041, 8230, 8225, 3745, 12496, 7927, 1240, 10366, 790, 11148; Payload ID: 8309 relates to Category No.: 1703, 5592, 4021, 1238, 6145, 9410, 11294, 5041, 3021; Payload ID: 8310 relates to Category No.: 1026, 14661, 10702, 5255, 1752, 10238, 1060, 1820, 5592, 12994, 4021, 1238, 6145, 16189, 6799, 10588, 1823, 7600, 1849, 1749, 6149, 5041, 6137, 1447, 12721, 1808, 5406, 16213, 12619, 10372, 4332, 8936, 8584, 3041, 14365, 1023, 1744, 1762, 4459, 4278, 7730, 1567, 1557, 1703, 13967, 10366, 1836, 13827, 13767, 2051, 7743, 15425, 12931, 10383, 11094, 7742, 12141, 13863, 10955, 8375, 11091, 10543, 11178, 6626, 1183, 2149, 2022, 14026; Payload ID: 8311 relates to Category No.: 5428, 795, 1703, 12648, 5446, 1816, 1820, 5592, 12405, 12994, 4021, 1238, 9000, 15456, 15450, 6145, 13293, 3643, 5041, 6137, 14589, 496, 11111, 11109, 7533, 10226, 3713, 6147, 1852; Payload ID: 8312 relates to Category No.: 1026, 11926, 1703, 15043, 10074, 1752, 1746, 1820, 5592, 360, 11285, 16085, 4021, 1238, 10558, 10080, 16294, 6145, 1825, 692, 10075, 11178, 16189, 10557, 7553, 6799, 1823, 8248, 785, 8219, 11596, 12555, 14689, 8220, 5041, 15761, 8230, 8225; Payload ID: 8313 relates to Category No.: 1002, 1703, 1820, 5592, 1767, 1714, 3246, 4021, 14050, 6799, 1749, 14643, 4990, 13713, 7526, 609, 4200, 15739; Payload ID: 8314 relates to Category No.: 746, 1820, 5592, 3807, 742, 15223, 742, 4021, 15570, 7340, 16189, 3643, 15000, 1703; Payload ID: 8315 relates to Category No.: 1703, 1820, 5592, 4021, 16189, 5428; Payload ID: 8316 relates to Category No.: 1703, 15043, 1820, 5592, 12405, 12994, 4021, 16189, 6149, 5041, 1821, 6145, 15202; Payload ID: 8317 relates to Category No.: 1703, 5592, 10648, 4021, 8004, 1622, 10035, 4401; Payload ID: 8318 relates to Category No.: 1703; Payload ID: 8319 relates to Category No.: 1703, 4021, 9451, 1993, 9455, 1272; Payload ID: 8320 relates to Category No.: 12091, 15043, 1820, 5592, 11506, 3398, 1780, 10314, 10075, 11201, 1749, 9713, 1318, 9480, 4194, 10372, 10286, 1779, 11980, 14385, 11147, 7370, 8367, 8854, 3926, 1722, 10366, 7613, 11934, 8373, 10955, 12633, 8940, 10495, 7698, 12459, 10257, 8522, 1709, 10954, 7364, 8636, 10261, 11266, 11062, 8635, 10382, 4012; Payload ID: 8321 relates to Category No.: 11910, 9982, 5592; Payload ID: 8322 relates to Category No.: 11285, 10666, 13958; Payload ID: 8324 relates to Category No.: 9500, 13975, 9528; Payload ID: 8325 relates to Category No.: 14724, 11245, 10861, 11530, 14725; Payload ID: 8326 relates to Category No.: 14724, 11530, 14725; Payload ID: 8327 relates to Category No.: 7912, 5291; Payload ID: 8328 relates to Category No.: 7912, 5291; Payload ID: 8329 relates to Category No.: 7912, 5291; Payload ID: 8330 relates to Category No.: 7912, 5291, 13818, 381; Payload ID: 8331 relates to Category No.: 7912, 5291; Payload ID: 8332 relates to Category No.: 7912, 5291; Payload ID: 8333 relates to Category No.: 2885, 1703, 12994, 4021, 6145, 5037, 10583, 16189, 3876, 7919, 5610, 7967, 6137, 13065, 15187, 10388, 6753, 451, 12430, 15189, 1705, 1984, 12614, 13449, 12648, 10702, 13969, 14589, 13925, 2041, 2014, 13882, 2136, 13827, 2006, 13837, 13773, 13775, 11601, 13863, 11178, 13904, 2080, 1901, 13813, 14456, 11111, 11109, 10192, 2077, 1709, 14017, 9485, 380, 3912, 7679; Payload ID: 8334 relates to Category No.: 1703, 14589, 5446, 12994, 14992, 4021; Payload ID: 8335 relates to Category No.: 1703, 5446, 14589, 12994, 14992, 4021; Payload ID: 8336 relates to Category No.: 1703, 14589, 12994, 4021; Payload ID: 8337 relates to Category No.: 1703, 14589, 9777; Payload ID: 8338 relates to Category No.: 14038, 2885, 5910, 1795, 15817, 13640, 11506, 3398, 10814, 3021, 15185, 13293, 10811, 10822, 15813; Payload ID: 8339 relates to Category No.: 14038, 2885, 5910, 1795, 15817, 13640, 13890, 13594, 1780; Payload ID: 8340 relates to Category No.: 14565, 14038, 2885, 5610, 13012; Payload ID: 8341 relates to Category No.: 14038, 2885, 1795, 5610, 13012; Payload ID: 8342 relates to Category No.: 5785, 14038, 2885, 13790, 3021, 7743, 1795, 7737, 12994, 8818, 9451, 13892, 11147, 8817, 15817, 13891, 13890; Payload ID: 8343 relates to Category No.: 13790; Payload ID: 8344 relates to Category No.: 13790, 5367, 14038, 2885, 3021, 8818, 13892, 8817, 15817, 13891, 13890; Payload ID: 8345 relates to Category No.: 5367, 14038, 2885, 13790, 3021, 8818, 13892, 8817, 15817, 13891, 8821, 13890; Payload ID: 8346 relates to Category No.: 13790, 1272, 12553, 1274, 5406; Payload ID: 8347 relates to Category No.: 14038, 5446, 12498, 16197, 8789, 12120, 10808, 10811, 3165, 13641, 2905, 6646; Payload ID: 8348 relates to Category No.: 13589, 3398, 11512, 1722, 795, 12619, 2885, 8731, 3398, 15517, 3021, 7743, 11506, 3398, 2012, 1238, 11573, 10811, 2051, 5610, 15817, 13000, 12477, 13198, 8564, 12611, 579, 12891, 1687, 575, 10828, 12994; Payload ID: 8349 relates to Category No.: 13589, 3398, 11512, 2885, 8739, 15517, 1780, 1238, 5610, 15817; Payload ID: 8350 relates to Category No.: 13589, 3398, 15490, 3398; Payload ID: 8351 relates to Category No.: 13589, 3398, 15490, 3398; Payload ID: 8352 relates to Category No.: 11512, 8739, 3190; Payload ID: 8353 relates to Category No.: 13589, 3398, 795, 2885, 5446, 1955, 15517, 3021, 16197, 8789, 15456, 15450, 7363, 15448, 11573, 10808, 10811, 15653, 5610, 15817, 6461, 6646, 8739, 13788, 13925, 13840, 6248, 2041, 11574, 11766, 15813, 10478, 10775, 1958; Payload ID: 8354 relates to Category No.: 13589, 3398, 11512, 2885, 15517, 11506, 3398, 15185, 5610, 15817, 10839, 15332, 10844, 3019, 10825, 10831, 13576, 5182, 10513, 5146, 12053, 8726, 7377, 9691; Payload ID: 8355 relates to Category No.: 13594, 13589, 3398, 2885, 3021, 15490, 3398, 11512, 10238, 10808, 10811, 10829, 5610, 15817, 13982, 13952; Payload ID: 8356 relates to Category No.: 13589, 3398, 15490, 3398, 1722, 2885, 7743, 11506, 3398, 5610, 15817, 6561, 14643, 1729, 5941, 5939; Payload ID: 8357 relates to Category No.: 13589, 3398, 11512, 14038, 2885, 8739, 5446, 1955, 15517, 11506, 3398, 12994, 15456, 15450, 7363, 15448, 15454, 11573, 10808, 10811, 15653, 5610, 15817, 3921, 13639, 12477, 13198, 6646, 5603, 5602, 13199, 13178, 8244, 5381, 11574, 15813; Payload ID: 8358 relates to Category No.: 13589, 3398, 5367, 15490, 3398, 2885, 8739, 5610, 15817, 3013, 11506, 3398, 9777, 13788, 10814, 3019, 7372, 2041, 11531, 8045, 10829; Payload ID: 8359 relates to Category No.: 13589, 3398, 2885, 15517, 3021, 1795, 5610, 15817, 15813; Payload ID: 8360 relates to Category No.: 14318, 14038, 2885, 3021, 1780, 14216, 3994, 8818, 3305, 3994, 14199, 15817; Payload ID: 8361 relates to Category No.: 9228, 14177; Payload ID: 8362 relates to Category No.: 2885, 5446, 403, 3021, 15186, 7534, 5285, 1060, 11175, 1066, 13840, 3012, 1238, 15817, 13640; Payload ID: 8363 relates to Category No.: 2885, 5446, 403, 3021, 15186, 7534, 5285, 1060, 11175, 1066, 13840, 3012, 1238, 15817, 13640; Payload ID: 8364 relates to Category No.: 2885, 403, 3021, 15186, 7534, 5285, 1060, 11175, 1066, 13840, 3012, 5446, 1238, 15817, 13640; Payload ID: 8365 relates to Category No.: 2885, 5446, 403, 3021, 15186, 7534, 5285, 1060, 11175, 1066, 13840, 3012, 1238, 15817, 13640; Payload ID: 8366 relates to Category No.: 2885, 5446, 403, 3021, 15186, 7534, 5285, 1060, 11175, 1066, 13840, 3012, 1238, 15817, 13640; Payload ID: 8367 relates to Category No.: 14038, 2885, 5446, 403, 3021, 15186, 7534, 5285, 1060, 11175, 1066, 13840, 3012, 1238, 15817, 13640; Payload ID: 8368 relates to Category No.: 5428, 795, 2885, 5446, 8731, 3398, 403, 1816, 3021, 15186, 7534, 5285, 1060, 11175, 1066, 13840, 11506, 3398, 1795, 3012, 1238, 8004, 11201, 8817, 15817, 13640, 11582, 8157, 8144, 8682, 8709; Payload ID: 8369 relates to Category No.: 2885, 5446, 403, 3021, 15186, 7534, 5285, 1060, 11175, 1066, 13840, 3012, 1238, 15817, 13640; Payload ID: 8370 relates to Category No.: 14038, 2885, 5446, 403, 3021, 15186, 7534, 5285, 1060, 11175, 1066, 13840, 3012, 1238, 15817, 13640; Payload ID: 8371 relates to Category No.: 2885, 5446, 403, 3021, 15186, 7534, 5285, 1060, 11175, 1066, 13840, 3012, 1238, 15817, 13640; Payload ID: 8372 relates to Category No.: 2885, 5446, 403, 3021, 15186, 7534, 5285, 1060, 11175, 1066, 13840, 3012, 1238, 15817, 13640; Payload ID: 8373 relates to Category No.: 14038, 2885, 5446, 403, 1816, 3021, 15186, 7534, 5285, 1060, 11175, 1066, 13840, 3012, 1238, 15817, 13640; Payload ID: 8374 relates to Category No.: 2885, 5446, 403, 3021, 15186, 7534, 5285, 1060, 11175, 1066, 13840, 3012, 1238, 15817, 13640; Payload ID: 8378 relates to Category No.: 5367, 2885, 7840, 13692, 15817, 7966, 8305; Payload ID: 8379 relates to Category No.: 11512, 14038, 2885, 5446, 403, 3021, 15186, 7534, 5285, 1060, 11175, 1066, 13840, 1795, 10241, 3012, 8818, 2012, 1238, 7533, 15817, 13640, 10794, 1967, 8682, 8709, 1054, 13141, 3013, 1951, 1958, 2145; Payload ID: 8380 relates to Category No.: 2885, 403, 3021, 15186, 7534, 5285, 1060, 11175, 1066, 13840, 3013, 3012; Payload ID: 8381 relates to Category No.: 5367, 1722, 14038, 795, 2885, 8739, 10372, 403, 5285, 11175, 1795, 10648, 13004, 8004, 10339, 1678, 570, 8145, 10829, 4039, 7252, 11949, 15606, 7937, 5610, 13012, 11150, 10573, 11111, 10978, 8636, 11613, 10295, 10842, 11387, 11581, 10886, 10634, 10635, 11564, 13589, 3398, 11512, 3013, 736, 11506, 3398, 3019, 3021, 11460, 3684, 11566, 2041, 9000, 8045, 12994, 10876, 8999, 10828, 11000, 10822, 8347, 10414, 1687, 576, 10850, 5427, 8046, 2017, 10343, 13827, 7743, 11091, 13234, 11436, 2370, 13571, 14453, 12963; Payload ID: 8382 relates to Category No.: 15490, 3398, 1002, 11512, 5428, 4998, 8739, 5446, 8731, 3398, 3021, 1983, 5809, 1780, 12519, 8818, 8114, 2022, 339, 11573, 12891, 3783, 7217, 7879, 10821, 10475, 5807, 7839, 7372, 333; Payload ID: 8383 relates to Category No.: 9500, 2885, 742, 743, 5610, 7990, 12117; Payload ID: 8384 relates to Category No.: 13589, 3398, 14038, 2885, 403, 3021, 15186, 7534, 5285, 1060, 11175, 1066, 13840, 7743, 3012, 7533, 10794; Payload ID: 8385 relates to Category No.: 5446, 8731, 3398, 3021, 7743, 11506, 3398, 5910, 10780, 10877, 10814, 8682, 11580, 10999, 8786, 8143, 8156, 8275; Payload ID: 8386 relates to Category No.: 5446, 3021, 5910, 10780, 13551, 7298; Payload ID: 8387 relates to Category No.: 5446, 3021, 5910, 10780, 13551, 8818, 11294; Payload ID: 8388 relates to Category No.: 3021, 5910, 10780; Payload ID: 8389 relates to Category No.: 2885, 3021, 7743, 7298, 12749, 14031; Payload ID: 8390 relates to Category No.: 1722, 14038, 2885, 403, 3021, 15186, 7534, 5285, 1060, 11175, 1066, 13840, 3012; Payload ID: 8391 relates to Category No.: 2885, 15817; Payload ID: 8392 relates to Category No.: 14038; Payload ID: 8393 relates to Category No.: 3021, 5367; Payload ID: 8394 relates to Category No.: 14038, 2885, 3021, 8818, 11607, 15817, 8507, 1967, 8060, 5789, 7861, 2137; Payload ID: 8395 relates to Category No.: 3021, 15817; Payload ID: 8396 relates to Category No.: 14038, 2885, 10238, 3021, 793, 15817, 8507, 2011; Payload ID: 8397 relates to Category No.: 14038, 2885, 7613, 3021, 7743, 2011, 15817; Payload ID: 8398 relates to Category No.: 3021, 15817; Payload ID: 8399 relates to Category No.: 7384, 15015, 14638, 7636, 7334, 7819; Payload ID: 8401 relates to Category No.: 2885, 5429; Payload ID: 8402 relates to Category No.: 5367, 14565, 5428, 5446, 11884, 2885, 5661; Payload ID: 8403 relates to Category No.: 14565, 8929, 1415, 13232, 5037, 10495, 11724, 7961; Payload ID: 8404 relates to Category No.: 14565, 2885, 2169; Payload ID: 8405 relates to Category No.: 5367, 381, 7849, 8069, 13859, 4169, 5429, 8147, 5544, 6219; Payload ID: 8406 relates to Category No.: 5659, 14565, 5367, 1795, 13893, 2885, 12999, 1984, 14026, 9489, 13996, 4959, 13833, 13962; Payload ID: 8407 relates to Category No.: 5367, 2885; Payload ID: 8408 relates to Category No.: 5367, 5785, 14565, 8103, 10790, 8129, 10940, 10416, 10848, 5692, 8706, 7743, 2087, 2885; Payload ID: 8409 relates to Category No.: 14565, 5428, 2885, 5446, 5659, 1849, 11452, 10851, 12999; Payload ID: 8410 relates to Category No.: 5367, 5428, 795, 2885, 7743, 10775, 1780, 10648, 10878, 1995, 10583, 11290, 7966, 11033, 10226, 10478, 11595, 4169, 5429, 10839, 13813, 11512, 4040, 2642, 3536; Payload ID: 8411 relates to Category No.: 5367, 14565, 5428, 795, 2885, 5446, 1816, 6606, 11109, 345, 7743, 2079, 11506, 3398, 12993, 11285, 10648, 14992, 3566, 13004, 8117, 11460, 11363, 5289, 11108, 11036, 6248, 10814, 10851, 10855, 2051, 11182, 1957, 7966, 12836, 11033, 11231, 11111, 10226, 8255, 10978, 8216, 7583, 10735, 10756, 10726, 10345, 10692, 11251, 11595, 11980, 14484, 10618, 10295, 4169, 5429, 10839, 11458, 8025, 14686, 11596, 11066, 8218, 10911, 7215, 2080, 11512, 13925, 10775, 4040, 9000, 6145, 10878, 13785, 5616, 10852, 13799, 3536, 10414, 10850, 13835, 1984, 8739, 13969, 13977, 13859, 2041, 13882, 16294, 496, 13867, 13827, 13971, 13966, 13837, 10238, 10486, 8375, 13981, 9489, 1910, 8370, 13951, 10583, 11102, 6758, 8004, 10651, 4715, 1969, 13823, 6103, 13915, 10356, 2039, 9612, 8029, 12242, 14045, 10879, 14729, 11419, 13825, 13856, 8367, 10248, 2432, 7671, 3934, 10135, 10778, 14013, 14010, 2056; Payload ID: 8412 relates to Category No.: 5428, 4998, 7613, 1816, 1060, 1066, 11506, 3398, 12891, 15795, 2041, 8273, 7644, 10877, 11363, 13947, 6138, 8782, 8159, 8141, 2909, 8688, 10478, 7848, 12403, 13859, 8298, 13046, 8163, 10263, 8135, 8146, 8124, 7843, 7784, 11512, 3013, 3019, 8112, 1312, 8045, 8129, 11000, 8350, 7807, 5367, 13925, 13459, 496, 13888, 13827, 13767, 13970, 1964, 8392, 13884, 8781, 13800, 7845; Payload ID: 8413 relates to Category No.: 2885, 13925; Payload ID: 8414 relates to Category No.: 5367, 14565, 5428, 2885, 3021; Payload ID: 8415 relates to Category No.: 11512, 10372, 1816, 6667, 1060, 4094, 10955, 11174, 11178, 8089; Payload ID: 8416 relates to Category No.: 14565, 2885, 3198, 4946, 3566; Payload ID: 8417 relates to Category No.: 14565, 2885, 2013, 10814, 10491, 11456, 5643, 10197, 10981, 11480, 11483, 11482, 5679, 9720; Payload ID: 8418 relates to Category No.: 2885, 10372, 1795, 10814, 13925, 9720, 13818, 5606; Payload ID: 8419 relates to Category No.: 5367, 1722, 14038, 1752, 14036, 13925, 3016, 11041, 11460, 2145, 10498, 8145, 10814, 4039, 10343, 11078, 11077, 11456, 10934, 8636, 11387, 11072, 11583, 11115, 3019, 11452, 2041; Payload ID: 8420 relates to Category No.: 1722, 2885, 1752, 14036, 15329, 10790, 11041, 11460, 12736, 11108, 8145, 10814, 10826, 10829, 11566, 3015, 10343, 7533, 8138, 11150, 10491, 11078, 10813, 10934, 11582, 11584, 10197, 8636, 10692, 10198, 10835, 11387, 14534, 10981, 11072, 11583, 11115, 11480, 11080, 11491, 15336, 5605, 13642, 11117, 11483, 11482, 3019, 3021, 1795, 2041, 2013, 8045, 8113, 14454, 7534; Payload ID: 8421 relates to Category No.: 5367, 14565, 1816, 10785, 10266, 10940, 10961, 1948, 7252, 7919, 7824, 8232, 10927, 5428, 13925, 13936, 13837, 11391, 2051, 11290, 11323, 13961, 8374, 6952, 10870, 13387, 10452, 8357, 11585, 8755, 11165; Payload ID: 8422 relates to Category No.: 2885, 1795; Payload ID: 8423 relates to Category No.: 14565, 2885, 5381, 8108, 8261, 2051; Payload ID: 8424 relates to Category No.: 5367, 14565, 10372, 1816, 10790, 10835, 11491, 15839, 10780, 1751, 11460, 7537, 12749, 6403, 11076, 11080, 13557, 9071, 4038, 11283, 5428, 13967, 496, 2149, 11582, 5291, 8636, 14619; Payload ID: 8425 relates to Category No.: 14565, 2885, 1780, 11076, 13967, 5910, 8378; Payload ID: 8426 relates to Category No.: 13589, 3398, 5367, 15490, 3398, 16197, 5424, 6138; Payload ID: 8427 relates to Category No.: 2885, 1795, 10842, 4181, 10477, 3014, 10790, 10849, 10833, 4839, 1948; Payload ID: 8428 relates to Category No.: 2885, 12633, 3012, 10790, 10849, 10833; Payload ID: 8429 relates to Category No.: 2885, 10477, 3014, 10852, 4839; Payload ID: 8430 relates to Category No.: 1026, 14661, 14565, 2885, 5446, 6606, 348, 4186, 12391, 4127, 3775, 5541, 16085, 8988; Payload ID: 8431 relates to Category No.: 2885, 5428; Payload ID: 8433 relates to Category No.: 5367, 11512, 5428, 795, 1816, 1727, 1795, 11150, 10842, 4181, 10477, 2014, 3014, 10852, 13773, 1982, 11082; Payload ID: 8434 relates to Category No.: 5367, 5428, 1816, 1795, 10477; Payload ID: 8435 relates to Category No.: 5428, 1816, 1795; Payload ID: 8436 relates to Category No.: 5428, 1795; Payload ID: 8437 relates to Category No.: 5428, 7598, 13616, 1622, 6420, 2876, 13020, 13023, 13025, 12934, 11512, 10477, 10852; Payload ID: 8438 relates to Category No.: 690, 5367, 5428, 1816, 6606, 12614, 2079, 15795, 2041, 15329, 10790, 6248, 10814, 11582, 10197, 10692, 10835, 11080, 11491, 5605, 11117, 14646, 2295, 5661, 5644, 4845, 10648, 8352, 7533, 11108; Payload ID: 8439 relates to Category No.: 15329, 4027, 13925, 2136, 2001; Payload ID: 8440 relates to Category No.: 5367, 14565, 10814, 7533, 5658, 11108, 15327; Payload ID: 8441 relates to Category No.: 5367, 14565, 5428, 1795, 1948, 2001; Payload ID: 8442 relates to Category No.: 5367, 14565, 5428, 795, 10877, 10241, 12397, 7965, 10864, 5705; Payload ID: 8443 relates to Category No.: 1026, 5367, 14661, 1703, 7613, 5446, 10372, 403, 1816, 6606, 348, 10266, 4186, 12391, 4127, 3775, 5541, 16085, 8988, 15194, 10790, 10362, 7533, 11584, 10197, 10835, 11491, 7642, 11512, 10814, 11460, 4040, 8112, 10876, 10787, 8240, 13559, 4828, 11987, 13837, 11285, 10486, 8535, 10501, 8054, 11452, 11319; Payload ID: 8444 relates to Category No.: 1026, 5367, 14661, 5428, 795, 5446, 6606, 348, 4186, 1795, 12391, 1780, 4127, 3775, 5541, 16085, 8988, 5686, 8112, 9125, 8688, 10197, 15197, 365, 8240, 13559, 11460, 5429, 11452, 8106, 7860; Payload ID: 8445 relates to Category No.: 1026, 14661, 14565, 2885, 7613, 5446, 6606, 348, 4186, 12391, 4127, 11884, 3775, 16197, 5541, 16085, 8988, 5686, 7533; Payload ID: 8446 relates to Category No.: 1026, 5367, 14661, 14565, 5446, 6606, 348, 4186, 12391, 4127, 3775, 16197, 5541, 16085, 8988, 5686, 5714, 5698, 2885; Payload ID: 8447 relates to Category No.: 5367, 5428, 12999, 10881, 11582, 10566, 11150; Payload ID: 8448 relates to Category No.: 2885, 5243, 10826, 5429, 8688, 8129, 13551, 10845, 8149, 8791, 5372; Payload ID: 8449 relates to Category No.: 2885, 10864, 12555; Payload ID: 8450 relates to Category No.: 5367, 14565, 10372, 10266, 10790, 11460, 1751, 11077, 10475, 10813, 11582, 10835, 11581, 15838, 11491, 10826, 11076, 11074; Payload ID: 8451 relates to Category No.: 7533, 5670; Payload ID: 8452 relates to Category No.: 5428, 1816, 381, 13859; Payload ID: 8453 relates to Category No.: 2885, 1204, 3015; Payload ID: 8454 relates to Category No.: 2885, 13643, 8112; Payload ID: 8455 relates to Category No.: 5428, 13925, 11460, 13892, 10814, 10829, 3015, 8138, 11150, 10491, 11456, 11582, 11584, 10197, 10692, 10198, 10835, 10981, 11583, 11115, 11480, 11080, 13642, 11483, 11482, 5679; Payload ID: 8456 relates to Category No.: 5367, 5428, 5446, 3021, 10790, 11460, 11108, 10814, 10826, 10829, 11566, 3015, 8138, 11150, 10491, 11456, 11582, 11584, 10197, 10692, 15428, 10198, 10835, 10981, 11072, 11583, 11115, 11480, 11080, 11491, 13642, 11117, 11483, 11482, 11512, 15203, 11102; Payload ID: 8457 relates to Category No.: 5367, 5428, 795, 10877, 2041, 16294, 10372, 7743, 11582, 7737, 2020, 14495; Payload ID: 8458 relates to Category No.: 5428, 1795, 1204, 11512, 13854, 13958, 3759, 5645, 5699, 5429; Payload ID: 8459 relates to Category No.: 5367, 11512, 5428, 1816, 10877, 11266, 10583, 11419, 7939, 10478; Payload ID: 8460 relates to Category No.: 5428, 5446, 10813, 13562, 12748, 13575, 13788; Payload ID: 8461 relates to Category No.: 5367, 1795, 11480, 10814, 3016, 8786, 13047, 5683; Payload ID: 8462 relates to Category No.: 8862, 1026, 5367, 14661, 2885, 5446, 10372, 1816, 6606, 348, 4186, 12391, 4127, 3775, 5541, 16085, 8988, 11178, 10522, 11584, 3592, 10963, 11061; Payload ID: 8463 relates to Category No.: 1026, 14661, 5446, 6606, 348, 4186, 12391, 4127, 3775, 5541, 16085, 8988, 2019, 5693, 2885; Payload ID: 8464 relates to Category No.: 5376; Payload ID: 8465 relates to Category No.: 2885, 7613, 15614, 10372, 6606, 11506, 3398, 5910, 3012, 7217, 5244, 11582, 11584, 6468, 8243, 15334, 4471, 380, 3018; Payload ID: 8466 relates to Category No.: 5367, 1703, 3012; Payload ID: 8467 relates to Category No.: 15490, 3398, 11512, 10940, 10790, 10416, 11237, 10648, 3021, 4039, 8209, 10851, 10787, 8129, 10845, 11569, 8109, 10832, 10848, 8706; Payload ID: 8468 relates to Category No.: 10372, 11285, 5428, 5446, 10947, 11038; Payload ID: 8469 relates to Category No.: 5446, 7849, 734, 8145, 5429, 8130, 8159; Payload ID: 8470 relates to Category No.: 5367, 2885, 5446, 5429, 10475, 10851; Payload ID: 8471 relates to Category No.: 5367, 2885, 5446, 5429, 10475, 11452, 10851; Payload ID: 8472 relates to Category No.: 2885, 5446, 1816, 5429, 10475, 8352, 10851, 8353; Payload ID: 8473 relates to Category No.: 5367, 2885, 5429; Payload ID: 8474 relates to Category No.: 5367, 11512, 7613, 8731, 3398, 10266, 1060, 11506, 3398, 11452, 13313, 2355, 15795, 2311, 12994, 3049, 11460, 11363, 8424, 7919, 7377, 1849, 7938, 10832, 15334, 2641, 13046, 11000, 10875, 10876, 7824, 10262, 11178, 3019, 7965, 1053, 8677, 4040, 10961, 11285, 5447, 10197, 11063, 11584, 15328, 10785, 15335, 10414, 1058, 8707, 8829, 13969, 2053, 10372, 14056, 13827, 13966, 13837, 4145, 13818, 12999, 6952, 10826, 8392, 7576, 10491, 7806, 13387, 8243, 11040, 10561; Payload ID: 8475 relates to Category No.: 9500, 14663, 1878, 6343; Payload ID: 8476 relates to Category No.: 2885, 11755, 5367, 5785, 14565, 5698, 5381, 3019, 10961, 11486, 10940, 11063, 10416, 10785, 8705, 13836, 9489, 12646; Payload ID: 8477 relates to Category No.: 1026, 5367, 14661, 2885, 5446, 6606, 348, 10266, 4186, 12391, 4127, 3775, 5541, 16085, 8988, 11178, 11213, 10787, 11506, 3398, 11363, 5428, 10372, 10877, 10563; Payload ID: 8478 relates to Category No.: 1026, 14661, 14565, 5446, 6606, 348, 4186, 12391, 1780, 4127, 3775, 5541, 16085, 8988, 5703, 5429, 2080, 13022, 2885; Payload ID: 8479 relates to Category No.: 5367, 11512, 5428, 2885, 7613, 10074, 10372, 10238, 3021, 5285, 11506, 3398, 381, 10262, 8936, 2041, 3016, 12488, 10415, 3632, 10902, 11460, 10877, 11363, 10955, 7971, 11174, 11178, 7216, 10851, 3015, 11147, 11546, 11391, 11582, 8219, 13859, 10787, 9006, 8999, 5013, 10203, 13650, 13982, 7816, 7786, 4509, 5710, 2001, 15332, 11411, 11570, 12646, 10648, 3019, 10574, 2136, 4535, 12498, 14050, 15185, 7332, 2014, 1317, 7373, 11486, 8089, 3806, 12648, 13967, 13969, 13925, 13936, 16294, 13812, 496, 13867, 13888, 13827, 13796, 7743, 13773, 11091, 10522, 13818, 10583, 1790, 7840, 13829, 13795, 8374, 11111, 1951, 1746, 11555, 13786, 1276, 11259, 15606, 8522, 13779, 13788, 11266, 14053, 7847, 8021, 12718, 9102, 8345; Payload ID: 8480 relates to Category No.: 2885, 10372, 13818, 381, 3016, 10415, 3632, 10902, 10955, 11178, 7216, 10851, 3015, 4039, 11147, 11391, 11582, 9006, 5013, 7816, 5710, 10199, 8163, 2451; Payload ID: 8481 relates to Category No.: 2885, 7613, 10372, 13818, 16197, 11460, 11147, 11582, 10324, 11595, 11581, 10203, 5710, 2451, 9373, 6132, 8161, 10206, 5683, 14565, 10248, 4690, 13257, 5634; Payload ID: 8482 relates to Category No.: 5367, 7613, 10372, 1816, 10266, 5285, 15199, 1277, 11452, 9410, 5243, 12891, 7710, 7966, 7965, 11143; Payload ID: 8483 relates to Category No.: 5367, 14565, 1795, 12773, 5714, 10648, 1746, 5242, 1066, 12649, 1764, 5382, 6403, 15194, 11453, 8685, 2885; Payload ID: 8484 relates to Category No.: 5367, 5428, 10372, 10847, 10362; Payload ID: 8485 relates to Category No.: 14565, 1780, 11294, 5724; Payload ID: 8486 relates to Category No.: 5367, 15490, 3398, 11506, 3398, 6814; Payload ID: 8487 relates to Category No.: 12091, 15490, 3398, 8731, 3398, 3021, 8760, 11506, 3398, 8818; Payload ID: 8488 relates to Category No.: 12091, 5785, 14565, 12153, 7613, 5446, 11109, 345, 11506, 3398, 7362, 10775, 8988, 13925, 8390, 15003, 352, 5659, 15610, 5912, 11858, 15456, 15450, 10954, 7362, 15448, 15443, 15454, 11573, 13893, 6248, 15446, 15653, 15457, 15458, 12066, 15451, 9292, 6125, 9295, 12742, 2885, 13982, 2041, 496, 2006, 11391, 1995; Payload ID: 8489 relates to Category No.: 13589, 3398, 15490, 3398, 5359; Payload ID: 8490 relates to Category No.: 12091, 14565, 5428, 5446, 5359, 11109, 345, 7362, 8390, 15003, 5659, 5912, 15456, 15450, 7363, 15448, 15443, 15454, 13893, 15446, 15653, 15457, 15458, 15451, 9292, 6125, 9295, 12742, 8611, 6248; Payload ID: 8491 relates to Category No.: 12091, 5785, 14565, 14038, 2885, 11109, 13840, 7362, 7849, 13925, 8390, 8114, 5659, 8782, 13893, 8159, 8510, 8508, 8141, 8255, 8247, 13982, 8726, 10949, 13345, 11858; Payload ID: 8492 relates to Category No.: 12091, 5785, 14565, 2885, 5446, 7362, 10775, 15456, 15450, 15443, 15454, 15446, 15457, 15458, 15451, 9006, 9010, 2878, 11391, 5912; Payload ID: 8495 relates to Category No.: 1730, 15042, 5731, 8905, 8862; Payload ID: 8496 relates to Category No.: 16214; Payload ID: 8497 relates to Category No.: 16214; Payload ID: 8498 relates to Category No.: 1026, 14661, 10702, 13435, 3766, 10238, 803, 13485, 8988, 15156, 5785, 8373, 11266, 11201; Payload ID: 8499 relates to Category No.: 10702, 13435, 3639, 11371, 10494; Payload ID: 8500 relates to Category No.: 12091, 5785, 14565, 12619, 7306, 2459, 5793; Payload ID: 8501 relates to Category No.: 13589, 3398, 15490, 3398, 8739, 13594, 13675, 8165; Payload ID: 8502 relates to Category No.: 12153; Payload ID: 8503 relates to Category No.: 2460, 2459, 5792, 12013, 9420, 3587, 8887, 6192, 8639, 1464, 3569, 3445, 7939, 3578, 14700, 3584, 5794, 3590, 3908, 2453, 8641, 14570, 5791; Payload ID: 8504 relates to Category No.: 2459, 5792, 12013, 9420, 12714, 14056, 14641, 13713, 3176, 5793, 2460, 4949, 8890, 13492, 6194, 9996; Payload ID: 8505 relates to Category No.: 2459, 9420, 3445, 8887, 3176, 12099, 4952, 2460, 6107, 4949, 7939, 1295, 9540, 8889, 9125, 3781, 14699, 13492, 14886, 11394, 1269, 6192, 8888, 2902, 5069; Payload ID: 8506 relates to Category No.: 2459, 9420, 12714, 12021, 12517, 5949, 16213, 1557, 8906, 14699, 2197, 8885, 12583, 9996, 9388, 12013; Payload ID: 8507 relates to Category No.: 14661, 5782, 12361, 9420; Payload ID: 8508 relates to Category No.: 14661, 12137, 5782, 14565, 12361, 14699, 9420, 5793; Payload ID: 8509 relates to Category No.: 2460, 5792, 9420; Payload ID: 8510 relates to Category No.: 2459, 9420, 5793, 1204, 12117, 14699; Payload ID: 8511 relates to Category No.: 2460, 9420, 5793, 3445, 3176, 4952, 7939, 3578, 8889, 13372, 14699; Payload ID: 8512 relates to Category No.: 13589, 3398, 334, 15490, 3398, 795, 12498, 2459, 9420, 5793, 8887, 4952, 2460, 7939, 6108, 14699; Payload ID: 8513 relates to Category No.: 2459, 5793, 9420, 5794, 5938, 11512, 3176, 2460, 4949, 7939, 9125, 3781, 10344; Payload ID: 8514 relates to Category No.: 2459, 9420; Payload ID: 8515 relates to Category No.: 2459, 14838, 9420, 5794, 5793; Payload ID: 8516 relates to Category No.: 2460, 9420, 12714, 12517, 2459, 5949, 724, 3445, 3176, 9410, 5462, 13265, 3799, 4949, 6269, 7939, 6375, 3578, 1295, 9540, 11997, 9125, 13372, 1557, 8862, 15247, 3781, 14699, 13492, 9554, 9099, 12868, 4057, 13846, 4254, 6192, 6389, 10803, 8885, 14816, 14884, 2547, 3780, 1580, 12861, 2902, 14837, 4950; Payload ID: 8517 relates to Category No.: 1955, 3354, 13904; Payload ID: 8518 relates to Category No.: 8862, 13492, 2459, 6192, 8196, 4939, 2460, 3578, 7732, 5939, 11394, 13276, 8888, 14884, 7247; Payload ID: 8519 relates to Category No.: 16286, 7693, 5949, 11634, 9554, 9406, 3590; Payload ID: 8520 relates to Category No.: 274, 13156, 1846, 12657; Payload ID: 8521 relates to Category No.: 5939, 9632, 14036, 5936, 5896; Payload ID: 8522 relates to Category No.: 9500, 15405, 14663, 1878; Payload ID: 8523 relates to Category No.: 10702, 274, 12502; Payload ID: 8524 relates to Category No.: 10702, 274, 12502; Payload ID: 8525 relates to Category No.: 10702, 274, 12502; Payload ID: 8526 relates to Category No.: 2460, 14699; Payload ID: 8527 relates to Category No.: 9994, 2459, 9420, 6501; Payload ID: 8536 relates to Category No.: 14834; Payload ID: 8537 relates to Category No.: 14661, 14565, 10702, 12942, 3775, 14663, 13004, 11291, 8049, 3728, 11265, 4499, 1960, 1922, 8937, 1970, 10093, 4186, 12737, 2094, 7874; Payload ID: 8538 relates to Category No.: 14661, 14565, 10702, 12942, 849, 15379, 8049; Payload ID: 8539 relates to Category No.: 14661, 14565, 10702, 12942, 345, 10648, 8004, 4332, 3846, 12649, 12391, 11285, 10953, 2080; Payload ID: 8546 relates to Category No.: 3100, 6814; Payload ID: 8547 relates to Category No.: 6814, 1862, 8760, 5871, 11634, 12891, 5866, 13618, 9459, 12209, 3855, 5751, 496, 2006, 14000, 13907; Payload ID: 8548 relates to Category No.: 5874, 12050, 15090; Payload ID: 8549 relates to Category No.: 5874, 12050, 15090; Payload ID: 8550 relates to Category No.: 1862, 5874, 12, 12050, 14663, 9069; Payload ID: 8551 relates to Category No.: 13589, 3398, 6878, 14806, 12214; Payload ID: 8552 relates to Category No.: 13589, 3398, 6878, 14806, 12214; Payload ID: 8553 relates to Category No.: 13589, 3398, 15490, 3398, 8375, 11091, 6878, 6795, 14806, 12215; Payload ID: 8554 relates to Category No.: 13589, 3398, 4949, 3894; Payload ID: 8555 relates to Category No.: 13589, 3398, 15490, 3398, 16214, 3575, 14014, 4789, 12891, 12953, 1729, 8933, 14063; Payload ID: 8556 relates to Category No.: 13589, 3398; Payload ID: 8557 relates to Category No.: 2885, 5446, 3354, 3021, 3013, 16197, 8818, 8789, 15817, 15605, 8547, 5879, 13011, 14030, 7183, 10586; Payload ID: 8558 relates to Category No.: 13589, 3398, 11512, 8739, 8373, 8169, 9786, 8112, 6773, 10814, 10829, 10851, 11566, 10801, 9480, 8932, 10821, 16133, 9481, 10226, 10692, 11595, 1982, 15655, 10818, 8516, 3622, 14398, 1578, 10689, 968, 14886, 9554, 14464, 9741, 5465, 1543, 10943, 12891, 8375, 14885, 16208, 14069, 8930, 10735, 8929, 10372, 4949, 10513, 10034, 4953, 8869, 7693, 11582, 13457, 9742, 1559, 15517, 1031; Payload ID: 8559 relates to Category No.: 13589, 3398, 8928, 9742, 8375, 14885, 16208, 14069, 8930; Payload ID: 8560 relates to Category No.: 14565, 795, 1816, 1893, 3632, 14454, 7730, 7667, 3529; Payload ID: 8561 relates to Category No.: 8979, 13004, 13356; Payload ID: 8563 relates to Category No.: 6212, 6814; Payload ID: 8564 relates to Category No.: 6814, 1204; Payload ID: 8565 relates to Category No.: 6814, 11912; Payload ID: 8566 relates to Category No.: 9500, 15642, 1867, 14663, 5887, 4742, 84, 7519, 4615, 13975, 13309, 13308, 13969, 14011, 4138; Payload ID: 8567 relates to Category No.: 9500, 1512, 15642, 1874, 14663, 5887, 4742, 84; Payload ID: 8568 relates to Category No.: 9500, 1512, 15642, 1874, 14663; Payload ID: 8569 relates to Category No.: 9500, 15642, 1874, 14663, 5887, 7505, 84; Payload ID: 8570 relates to Category No.: 9500, 1512, 15642, 1874, 14663, 5887, 7505, 84, 8042; Payload ID: 8571 relates to Category No.: 13621, 5891, 4439, 15698, 9455; Payload ID: 8572 relates to Category No.: 13621, 5891, 4439, 7108, 15698; Payload ID: 8573 relates to Category No.: 5898, 14663, 2347, 3266; Payload ID: 8574 relates to Category No.: 5898, 14663, 2347, 3266, 5894; Payload ID: 8575 relates to Category No.: 5898, 12071, 11930, 1026; Payload ID: 8576 relates to Category No.: 1894, 12126, 2776, 5406, 7303, 10372, 6269, 11997, 12053, 13395, 14341, 14347; Payload ID: 8577 relates to Category No.: 6814, 9500, 14663, 1878, 1308, 4101, 6215, 6122; Payload ID: 8580 relates to Category No.: 9296, 3354, 7291, 16182, 4445, 15533, 7263; Payload ID: 8582 relates to Category No.: 15898, 12154, 11843, 5428, 795, 12153, 7613, 5446, 12633, 3021, 9125, 8390, 8789, 11969, 8192, 16189, 11967, 9292, 6125, 9295, 11963, 7860, 13350, 12096, 11243, 11447, 7591; Payload ID: 8583 relates to Category No.: 7288, 13589, 3398, 15490, 3398, 14271, 7295, 13184, 13183, 12979, 12975; Payload ID: 8587 relates to Category No.: 1703, 14586, 4328, 14840, 7304; Payload ID: 8588 relates to Category No.: 1703, 14586, 4328, 14840; Payload ID: 8589 relates to Category No.: 15490, 3398, 11512, 795, 2410, 7735, 7997, 14015, 5146, 5189, 5190, 5184; Payload ID: 8590 relates to Category No.: 14656, 5146, 5189, 5190, 5184; Payload ID: 8591 relates to Category No.: 5146, 5189, 5190, 5184; Payload ID: 8592 relates to Category No.: 8862, 690, 11512, 4998, 12638, 5939, 7306, 1714, 12646, 9125, 15201, 11125, 1743, 9123, 8848, 8954, 4499, 3711, 757, 9124, 1580, 7381, 1578, 12236, 8653, 1574, 12233, 3618, 8375, 1463, 9410, 986, 5458, 7241, 7730, 1250, 11147, 7971, 13952, 11057, 2444, 3290, 6324; Payload ID: 8593 relates to Category No.: 1721, 12638, 1730, 7306, 1714, 14838, 12646, 9125, 15194, 11125, 9123, 987, 15388, 5406, 14640, 13758, 9321, 12614, 7243, 4383, 3789; Payload ID: 8594 relates to Category No.: 12137, 16172, 3986, 3676, 9003, 4843, 3014, 9006, 9010; Payload ID: 8595 relates to Category No.: 12091, 1026, 14661, 5785, 2885, 1730, 15614, 1752, 9717, 5446, 6606, 348, 4186, 12646, 12391, 4127, 3775, 5541, 16085, 8988, 5686, 5610, 13012, 15817, 13640, 13779, 9720, 3754, 2019, 11858; Payload ID: 8596 relates to Category No.: 12091, 1026, 334, 14661, 5785, 14565, 9720, 795, 2885, 1730, 1752, 9717, 5446, 403, 6606, 348, 12498, 3854, 7743, 5910, 4186, 12999, 12646, 12391, 287, 2410, 4127, 3775, 5541, 15782, 16085, 8988, 13925, 1238, 10383, 11858, 14029, 11187, 11178, 11566, 11114, 4039, 336, 7252, 5610, 7879, 4871, 5911, 13012, 6795, 13779, 3754, 15836, 14941, 5181, 5643, 11582, 11584, 341, 10698, 6563, 13895, 11512, 7613, 10241, 7372, 1951, 2041, 2019, 5277, 4828, 10366, 10372, 10238, 13975, 8373, 10486, 10790, 10358, 7698, 11111, 11363, 10513, 11259, 15606, 5814, 5268, 10801, 8054, 10093, 10821, 15839, 1031, 11200, 13878, 7750, 7006, 15838, 15837, 10342; Payload ID: 8597 relates to Category No.: 12091, 1026, 14661, 5785, 9720, 15614, 1752, 9717, 5446, 403, 6606, 348, 12498, 3854, 1060, 4186, 12391, 15197, 4127, 3775, 5541, 16085, 8988, 11460, 8138, 5911, 8141, 3754, 15836, 14941, 8715, 13554, 8705, 5698, 8677, 7867, 7970, 13899, 13900, 13897, 13902, 11858, 2885, 10780, 10486, 10301, 10197, 15839; Payload ID: 8598 relates to Category No.: 12137, 2562; Payload ID: 8601 relates to Category No.: 6219, 15490, 3398, 8739; Payload ID: 8602 relates to Category No.: 6814, 9941, 5428, 3684, 1451, 9945, 1893, 14663, 815, 5855, 4653, 9819, 9839, 9895, 9823, 9833, 9590, 4654; Payload ID: 8603 relates to Category No.: 3837, 14033; Payload ID: 8604 relates to Category No.: 5367, 5446, 403, 14057, 729, 11282, 11328, 4494; Payload ID: 8605 relates to Category No.: 12194; Payload ID: 8606 relates to Category No.: 11915, 12194; Payload ID: 8608 relates to Category No.: 2169; Payload ID: 8609 relates to Category No.: 13589, 3398, 15490, 3398, 9500, 2409, 1238, 6530, 3799, 6529, 14442, 6486, 13738; Payload ID: 8611 relates to Category No.: 7288, 13589, 3398, 15490, 3398, 9500, 13185, 16182, 14271, 2410, 14928, 9690, 5170, 5191, 5949, 14056, 6459, 1240, 4949, 1795, 6375, 790, 15195, 3853, 12433; Payload ID: 8614 relates to Category No.: 15490, 3398, 8731, 3398, 2409, 2169, 4439, 14944, 12891, 3783, 8004, 3783, 10749, 8085, 8739, 12646, 7743, 14910, 15400, 6269; Payload ID: 8615 relates to Category No.: 7154, 2886, 11265, 12646, 793; Payload ID: 8616 relates to Category No.: 13594, 13589, 3398, 15490, 3398, 11512, 12619, 2000, 8739, 13996, 13818, 12626, 12646, 15521, 4439, 13925, 15570, 13827, 13936, 10358, 13797, 15736, 15517, 16096, 5406, 9455, 1922, 3010, 9459, 1886, 5985, 3607, 9457, 13969, 13989, 13815, 4145, 13981, 13921; Payload ID: 8617 relates to Category No.: 13594, 13589, 3398, 11512, 12619, 2000, 8739, 13996, 13818, 12626, 12646, 13925, 13827, 13936, 10358, 13797, 1922, 9454, 11147, 13969, 496, 15517, 13981, 13921, 2469; Payload ID: 8618 relates to Category No.: 13594, 13589, 3398, 15490, 3398, 12970, 8739, 10737, 7971; Payload ID: 8619 relates to Category No.: 13589, 3398, 11512, 10702, 12619, 2000, 5446, 8731, 3398, 13996, 14656, 13818, 12626, 11506, 3398, 7362, 12646, 4127, 13925, 15003, 15570, 15456, 15450, 7363, 15448, 15443, 13827, 13936, 15454, 13460, 15446, 15653, 15457, 15458, 10358, 7879, 10180, 15451, 11224, 13797, 10527, 5443, 14655, 7560, 8743, 7743, 10626, 7613, 10573, 9480, 10583, 690, 6269, 1922, 8373, 10558, 8506, 7217, 13956, 1886, 4065, 6952, 6098, 1031, 15490, 3398, 13969, 10372, 496, 10238, 11089, 11391, 13970, 10522, 2469, 13692, 13877, 6102, 6723, 11038, 2096; Payload ID: 8620 relates to Category No.: 13594, 1722, 10238, 3354, 849, 11363, 298, 2982; Payload ID: 8621 relates to Category No.: 1752, 14589, 3143, 2933, 12646, 1814, 16085, 10314, 448, 12632, 3114, 11363, 450, 12954, 11259, 3910, 1749, 2007, 3716, 1345, 13662, 14643, 1703, 11934, 14565; Payload ID: 8622 relates to Category No.: 14589, 4021, 1238, 6145, 7719; Payload ID: 8623 relates to Category No.: 690, 4021, 1238, 6145, 13241, 1752, 15622, 14838, 403, 1820, 14834, 7379, 7369, 9005, 3871, 6147, 12460, 1031; Payload ID: 8624 relates to Category No.: 14622, 13450, 12026; Payload ID: 8625 relates to Category No.: 13450, 1419, 7345; Payload ID: 8626 relates to Category No.: 1415, 1408, 13450, 11349, 1419, 10486, 12599; Payload ID: 8627 relates to Category No.: 13450, 1419, 6102, 1415, 13236, 8920, 4004, 6758, 6293; Payload ID: 8628 relates to Category No.: 13450, 1419, 6102, 8920, 13530; Payload ID: 8629 relates to Category No.: 13594, 5095, 13589, 3398, 2411, 15517, 5127, 2410, 16197, 5146, 13376, 13165, 11294, 5406, 7303, 8887, 14793, 1780, 8862, 15247, 5184, 10664, 5148, 6882, 6995, 13967, 13969, 2136, 2068, 5772, 10371, 597, 10735, 1557, 11536, 6814; Payload ID: 8630 relates to Category No.: 5095, 13589, 3398, 11512, 1722, 15516, 2411, 7743, 15521, 2410, 9125, 4439, 16197, 5146, 2009, 15520, 14123, 5740, 9683, 11847, 9142, 13339, 11506, 3398, 10664, 7835, 5162, 11094, 6758, 2083, 2086, 11602, 10432, 10740, 10747; Payload ID: 8631 relates to Category No.: 5095, 13589, 3398, 15490, 3398, 11843, 11512, 8739, 3452, 8731, 3398, 687, 3354, 11506, 3398, 3448, 3313, 14568, 2410, 16197, 12936, 3453, 13904, 3455, 1964, 11239, 8149, 6814; Payload ID: 8632 relates to Category No.: 5095, 13589, 3398, 15490, 3398, 8731, 3398, 11506, 3398, 9274, 2410, 5146, 3345, 2158, 7372, 11847, 9406, 14782, 757, 8611, 3592, 4953, 4067; Payload ID: 8633 relates to Category No.: 5095, 13589, 3398, 15490, 3398, 8731, 3398, 11506, 3398, 9274, 2410, 5146, 11512; Payload ID: 8634 relates to Category No.: 13589, 3398, 15490, 3398, 3356, 2410, 5146, 5189, 5190, 5184, 11275, 5095; Payload ID: 8635 relates to Category No.: 5095, 13589, 3398, 15490, 3398, 8731, 3398, 11506, 3398, 2410, 12519, 5185, 5189, 5190, 7372; Payload ID: 8636 relates to Category No.: 10702, 13435, 12091, 8862, 1026, 14661, 5785, 14565, 3766, 16172, 10238, 803, 13485, 8988; Payload ID: 8637 relates to Category No.: 12194; Payload ID: 8638 relates to Category No.: 12194, 9500, 4020, 4021, 1238, 10069, 4180, 1238, 5825, 16342, 10621, 4074, 6271; Payload ID: 8639 relates to Category No.: 12194; Payload ID: 8640 relates to Category No.: 12194, 1721; Payload ID: 8641 relates to Category No.: 12194; Payload ID: 8642 relates to Category No.: 12194; Payload ID: 8643 relates to Category No.: 12099, 12194; Payload ID: 8644 relates to Category No.: 12194, 4167, 8040, 10687, 3782, 14440; Payload ID: 8645 relates to Category No.: 12194; Payload ID: 8646 relates to Category No.: 12194, 14661, 4020, 4021; Payload ID: 8647 relates to Category No.: 12194, 14661, 1893, 7598, 731; Payload ID: 8648 relates to Category No.: 12194, 11878, 4020, 609; Payload ID: 8649 relates to Category No.: 12194, 3781, 10687, 10231; Payload ID: 8650 relates to Category No.: 12194, 12099, 2169, 7369, 12628, 2569, 15427, 14050, 8926, 11859, 10687, 665, 5263, 13232; Payload ID: 8651 relates to Category No.: 12194, 3781, 4020, 4021, 10231; Payload ID: 8652 relates to Category No.: 12194, 1727, 8940, 14050, 5941, 6758, 8347, 7639, 13525, 15143; Payload ID: 8653 relates to Category No.: 12194; Payload ID: 8654 relates to Category No.: 14456, 286, 7252; Payload ID: 8655 relates to Category No.: 795, 2885, 11949, 792, 7162, 11765, 14663, 16197, 16193, 5790, 9075, 7187, 7188, 3888, 1844, 11949, 3400, 11949, 15606, 14166, 7153, 3900, 904, 7139, 12384, 5782; Payload ID: 8656 relates to Category No.: 795, 2885, 11949, 792, 11765, 16197, 16193, 5790, 9075, 7187, 7188, 1844, 11259, 12773; Payload ID: 8657 relates to Category No.: 2885, 3354, 3448, 11949, 3336, 16193, 9075, 7187, 7188, 12773; Payload ID: 8658 relates to Category No.: 2885, 11949, 11884, 16193, 9075, 7187, 7188, 16189, 16196; Payload ID: 8659 relates to Category No.: 2885, 11949, 16193, 9075, 7187, 7188, 13877; Payload ID: 8660 relates to Category No.: 11949, 2885, 16193, 9075, 7187, 7188; Payload ID: 8661 relates to Category No.: 11949, 9075, 11512, 6626; Payload ID: 8662 relates to Category No.: 2885, 11949, 16193, 9075, 7187, 7188; Payload ID: 8663 relates to Category No.: 2410, 5185, 5189, 5190; Payload ID: 8665 relates to Category No.: 2410, 5185, 5189, 5190; Payload ID: 8666 relates to Category No.: 2410, 5185, 5189, 5190; Payload ID: 8667 relates to Category No.: 1737, 6814, 7154, 2902, 6982, 8934, 6967, 11997, 8378; Payload ID: 8668 relates to Category No.: 6814, 2902, 14838, 6982; Payload ID: 8669 relates to Category No.: 2902, 6814, 6982; Payload ID: 8670 relates to Category No.: 1737, 8300, 12122, 6982, 7139, 11005, 11094, 10356; Payload ID: 8672 relates to Category No.: 1730, 12633, 7306, 9451, 4021; Payload ID: 8673 relates to Category No.: 5936; Payload ID: 8674 relates to Category No.: 11674, 5848; Payload ID: 8675 relates to Category No.: 4701; Payload ID: 8676 relates to Category No.: 1204, 4701; Payload ID: 8677 relates to Category No.: 5782, 16172, 12103, 12137; Payload ID: 8678 relates to Category No.: 5782, 16172, 12103; Payload ID: 8679 relates to Category No.: 12137, 16172, 3684, 1893, 12103, 5855; Payload ID: 8683 relates to Category No.: 3684, 12431, 1893, 5855; Payload ID: 8685 relates to Category No.: 12153; Payload ID: 8686 relates to Category No.: 12153; Payload ID: 8687 relates to Category No.: 12154; Payload ID: 8690 relates to Category No.: 12153; Payload ID: 8691 relates to Category No.: 12153; Payload ID: 8692 relates to Category No.: 12153; Payload ID: 8693 relates to Category No.: 12153; Payload ID: 8694 relates to Category No.: 12153; Payload ID: 8696 relates to Category No.: 12153, 1204; Payload ID: 8697 relates to Category No.: 1026, 14661, 12153, 5446, 6606, 348, 4186, 12391, 4127, 1204, 3775, 5541, 16085, 8988; Payload ID: 8698 relates to Category No.: 12153; Payload ID: 8699 relates to Category No.: 12154, 15490, 3398, 12153, 11237, 11831, 2911, 8611, 13589, 3398, 5406, 2020, 12816, 2079, 14023, 13939, 13883, 8004, 6518, 12066, 14421, 4214, 529; Payload ID: 8700 relates to Category No.: 12153, 274, 3038, 484, 6296, 2229; Payload ID: 8701 relates to Category No.: 12153, 6530, 4167, 14834, 5243, 1764, 6524; Payload ID: 8703 relates to Category No.: 16286, 3833, 7693, 2669, 12058; Payload ID: 8704 relates to Category No.: 12153, 7154, 2886; Payload ID: 8705 relates to Category No.: 12153; Payload ID: 8706 relates to Category No.: 12154; Payload ID: 8707 relates to Category No.: 1295, 12153, 274; Payload ID: 8708 relates to Category No.: 12153; Payload ID: 8709 relates to Category No.: 12153; Payload ID: 8710 relates to Category No.: 12154, 12137, 11843, 12153, 7613, 2940, 4770, 13890, 11965; Payload ID: 8711 relates to Category No.: 1737, 12154, 12153, 7154, 12743, 2428; Payload ID: 8712 relates to Category No.: 1737, 7159, 7163, 12058; Payload ID: 8713 relates to Category No.: 12153; Payload ID: 8714 relates to Category No.: 12153; Payload ID: 8715 relates to Category No.: 12154, 12153, 13622; Payload ID: 8716 relates to Category No.: 12153; Payload ID: 8717 relates to Category No.: 12154; Payload ID: 8718 relates to Category No.: 12153; Payload ID: 8719 relates to Category No.: 12154, 12153, 5845, 13711, 11967, 3291; Payload ID: 8720 relates to Category No.: 12153; Payload ID: 8721 relates to Category No.: 13589, 3398, 15490, 3398, 12153; Payload ID: 8722 relates to Category No.: 12154; Payload ID: 8723 relates to Category No.: 12153; Payload ID: 8724 relates to Category No.: 12153; Payload ID: 8726 relates to Category No.: 12153; Payload ID: 8727 relates to Category No.: 12153; Payload ID: 8728 relates to Category No.: 12153, 1204; Payload ID: 8729 relates to Category No.: 12153, 8503, 8547, 14624; Payload ID: 8730 relates to Category No.: 12153, 7390, 15012, 14365, 14620, 13205, 14624, 13207, 13474, 13063; Payload ID: 8731 relates to Category No.: 1737, 11843, 7154, 12096, 13149; Payload ID: 8732 relates to Category No.: 12153, 1204; Payload ID: 8733 relates to Category No.: 1070, 4461; Payload ID: 8734 relates to Category No.: 12154, 12153; Payload ID: 8735 relates to Category No.: 12154, 12153; Payload ID: 8736 relates to Category No.: 12153, 7154, 2886; Payload ID: 8737 relates to Category No.: 12194, 16099; Payload ID: 8738 relates to Category No.: 13975, 14057, 12488, 4180, 2610, 6104, 8112, 3913; Payload ID: 8739 relates to Category No.: 5939, 1922, 3791; Payload ID: 8740 relates to Category No.: 16214, 3819, 2698; Payload ID: 8741 relates to Category No.: 2940, 2110, 13996, 15460; Payload ID: 8742 relates to Category No.: 3781, 1749, 496, 4990, 4934, 5729, 3791, 14054, 13904; Payload ID: 8743 relates to Category No.: 3781, 7131; Payload ID: 8744 relates to Category No.: 5428, 5939, 7242, 5446, 2940, 3781, 7737, 1780, 5936, 3913, 496, 4934, 5940, 5731; Payload ID: 8745 relates to Category No.: 14565, 3781, 4939, 5732, 11546, 7242, 10362, 5936, 10706; Payload ID: 8746 relates to Category No.: 1721, 7613, 674, 16197, 5731, 4773, 4039, 5016, 15782; Payload ID: 8747 relates to Category No.: 16197, 13836, 14365, 9125, 1733; Payload ID: 8748 relates to Category No.: 3781, 5936, 5941, 5940, 5937; Payload ID: 8749 relates to Category No.: 795, 5732; Payload ID: 8752 relates to Category No.: 1204; Payload ID: 8753 relates to Category No.: 496, 4934, 5732, 4939; Payload ID: 8755 relates to Category No.: 1204, 4939; Payload ID: 8756 relates to Category No.: 1204; Payload ID: 8757 relates to Category No.: 3791, 5731; Payload ID: 8758 relates to Category No.: 3781; Payload ID: 8759 relates to Category No.: 3781; Payload ID: 8761 relates to Category No.: 496, 4934; Payload ID: 8762 relates to Category No.: 3781; Payload ID: 8763 relates to Category No.: 674; Payload ID: 8764 relates to Category No.: 1204, 13052; Payload ID: 8768 relates to Category No.: 2940, 3791, 7939; Payload ID: 8770 relates to Category No.: 3781, 1749, 4990; Payload ID: 8771 relates to Category No.: 1730, 7242, 10372, 16294, 7131, 10491; Payload ID: 8772 relates to Category No.: 3532; Payload ID: 8773 relates to Category No.: 5731; Payload ID: 8774 relates to Category No.: 16197; Payload ID: 8775 relates to Category No.: 4939, 5732; Payload ID: 8776 relates to Category No.: 1204; Payload ID: 8777 relates to Category No.: 1204, 7131; Payload ID: 8778 relates to Category No.: 5731; Payload ID: 8779 relates to Category No.: 4969; Payload ID: 8780 relates to Category No.: 2940, 14392, 3781; Payload ID: 8781 relates to Category No.: 1204; Payload ID: 8784 relates to Category No.: 16197, 13974, 4039, 5016, 15782, 1733, 14365, 13879; Payload ID: 8787 relates to Category No.: 1204; Payload ID: 8788 relates to Category No.: 3781, 496, 4934; Payload ID: 8789 relates to Category No.: 4937, 7526, 13052; Payload ID: 8790 relates to Category No.: 3781; Payload ID: 8792 relates to Category No.: 3781, 5732, 14643, 14838; Payload ID: 8805 relates to Category No.: 1204; Payload ID: 8811 relates to Category No.: 1204; Payload ID: 8817 relates to Category No.: 1204; Payload ID: 8856 relates to Category No.: 496, 4934; Payload ID: 8858 relates to Category No.: 496, 4934; Payload ID: 8860 relates to Category No.: 496, 4934; Payload ID: 8861 relates to Category No.: 496, 4934; Payload ID: 8862 relates to Category No.: 496, 4934; Payload ID: 8872 relates to Category No.: 1204; Payload ID: 8873 relates to Category No.: 3781; Payload ID: 8888 relates to Category No.: 1204; Payload ID: 8890 relates to Category No.: 3913, 3194, 10566, 7243, 8655, 12817, 6193, 5938, 8196; Payload ID: 8891 relates to Category No.: 1730; Payload ID: 8893 relates to Category No.: 1512, 16214, 14663, 14014, 4723, 5930, 5932, 5931, 2698; Payload ID: 8894 relates to Category No.: 1512, 14663, 1514, 4305, 4304, 12922, 13888, 13860, 14054, 13852, 14016; Payload ID: 8895 relates to Category No.: 1204; Payload ID: 8897 relates to Category No.: 7288, 15490, 3398, 14565, 1722, 8731, 3398, 1795, 11371, 1780, 4336, 11550, 11342, 13441; Payload ID: 8898 relates to Category No.: 13589, 3398, 15490, 3398; Payload ID: 8899 relates to Category No.: 13589, 3398, 15490, 3398, 14838; Payload ID: 8902 relates to Category No.: 7288, 13589, 3398, 15490, 3398, 13186, 14271, 4439, 7295, 14271, 16183, 7270, 13152; Payload ID: 8905 relates to Category No.: 12619, 1955, 3356, 3354, 14034, 2198, 15605; Payload ID: 8906 relates to Category No.: 4041, 12734; Payload ID: 8907 relates to Category No.: 12137, 14898, 9378, 10109; Payload ID: 8910 relates to Category No.: 8934, 7863; Payload ID: 8913 relates to Category No.: 3837; Payload ID: 8914 relates to Category No.: 15715; Payload ID: 8916 relates to Category No.: 12891, 8454, 9379, 4144, 3448; Payload ID: 8919 relates to Category No.: 14699, 2460, 2459, 12839; Payload ID: 8925 relates to Category No.: 16286, 7693, 8105; Payload ID: 8929 relates to Category No.: 12137, 3691, 3697; Payload ID: 8931 relates to Category No.: 12633, 12821; Payload ID: 8934 relates to Category No.: 1512, 14624, 11266, 10803; Payload ID: 8935 relates to Category No.: 9500, 1204; Payload ID: 8939 relates to Category No.: 3612; Payload ID: 8941 relates to Category No.: 6451, 7966, 2116, 10254, 11594; Payload ID: 8944 relates to Category No.: 7288, 14271, 7285; Payload ID: 8945 relates to Category No.: 6814, 6902, 15715, 15712, 4439; Payload ID: 8946 relates to Category No.: 1703; Payload ID: 8949 relates to Category No.: 14838, 11084; Payload ID: 8951 relates to Category No.: 7131, 10491; Payload ID: 8958 relates to Category No.: 3683, 6192, 1238, 3578, 12703, 3584; Payload ID: 8961 relates to Category No.: 15618, 1517, 14742; Payload ID: 8965 relates to Category No.: 8862, 3386, 3852; Payload ID: 8967 relates to Category No.: 5367; Payload ID: 8968 relates to Category No.: 10286, 4969; Payload ID: 8969 relates to Category No.: 8862, 1730, 7112; Payload ID: 8970 relates to Category No.: 5367, 14565, 12994, 7540; Payload ID: 8971 relates to Category No.: 12994, 1849; Payload ID: 8974 relates to Category No.: 5367, 14565, 5446, 7533; Payload ID: 8976 relates to Category No.: 5367, 12994, 7538; Payload ID: 8977 relates to Category No.: 12994; Payload ID: 8978 relates to Category No.: 5367, 12994; Payload ID: 8979 relates to Category No.: 14565, 12994, 1849; Payload ID: 8984 relates to Category No.: 5367, 14565, 5446, 12994; Payload ID: 8985 relates to Category No.: 1849; Payload ID: 8986 relates to Category No.: 5446; Payload ID: 8988 relates to Category No.: 1795, 12994; Payload ID: 8989 relates to Category No.: 1795, 12994; Payload ID: 8990 relates to Category No.: 14565, 5446, 1849, 7541; Payload ID: 8991 relates to Category No.: 14565, 1849; Payload ID: 8992 relates to Category No.: 1849; Payload ID: 8993 relates to Category No.: 5446, 1795, 12994, 7541; Payload ID: 8994 relates to Category No.: 1795, 12994; Payload ID: 8995 relates to Category No.: 7536, 2883; Payload ID: 8996 relates to Category No.: 5428, 5446, 1795, 12994, 1849; Payload ID: 8998 relates to Category No.: 14565, 1730, 5446, 403, 12994, 7533, 8049, 15192, 11077, 8359, 10814, 2041, 3016, 11111, 14992, 10238, 11078, 11058; Payload ID: 8999 relates to Category No.: 1722, 795; Payload ID: 9000 relates to Category No.: 8535, 14589, 10192, 3973; Payload ID: 9001 relates to Category No.: 1703, 8535, 14589; Payload ID: 9002 relates to Category No.: 4998, 8934, 5725, 11742, 8940, 4503; Payload ID: 9003 relates to Category No.: 7288, 1955, 3356, 3354, 3353, 16197; Payload ID: 9004 relates to Category No.: 13360, 8860, 348, 8988, 11094, 2924, 2068, 5406, 3041; Payload ID: 9005 relates to Category No.: 12091, 690, 16088, 9720, 12648, 7613, 15614, 9717, 10372, 14569, 10366, 11285, 16197, 16085, 4021, 10558, 11858, 10955, 11187, 10583, 11114, 7919, 10557, 2143, 1762, 10226, 16096, 1453, 10629, 3592, 11216, 3725, 11600, 1752, 1741, 10574, 4998, 6375, 1751, 9485, 15121, 1320, 10983, 6371, 1408, 12957, 6404, 11632, 12809, 3711; Payload ID: 9006 relates to Category No.: 14661, 10702, 12942, 1204, 11285, 2222, 12754, 12753; Payload ID: 9007 relates to Category No.: 12091, 1026, 14661, 5785, 5446, 6606, 348, 4186, 12391, 4127, 3775, 5541, 16085, 8988, 10955; Payload ID: 9008 relates to Category No.: 12091, 5785, 10955, 1451; Payload ID: 9009 relates to Category No.: 6984, 12137, 14661; Payload ID: 9010 relates to Category No.: 1737, 6814, 6984, 14905, 7154, 7168, 7162, 1238, 2429, 743, 13169, 7137; Payload ID: 9011 relates to Category No.: 6814, 6984; Payload ID: 9012 relates to Category No.: 6814, 6984, 5782, 2886, 3699, 4774, 6713, 10102, 1600; Payload ID: 9013 relates to Category No.: 6814, 6984, 14565, 12526, 15185, 12122; Payload ID: 9014 relates to Category No.: 6984, 14661, 11843, 12638, 15043, 7613, 10372, 12633, 2941, 12614, 14383, 8373, 2243, 360, 10481, 13227, 2233, 1782, 7153, 3900, 13200, 9333, 12886, 13394, 8121, 5073, 12887, 2221, 2214, 7136, 1737, 12637; Payload ID: 9015 relates to Category No.: 6814, 6984, 7154, 1780, 1238, 743; Payload ID: 9016 relates to Category No.: 6984, 4186, 3775, 3525, 4770, 13402, 3641, 12404, 4277, 6814; Payload ID: 9017 relates to Category No.: 6814, 6984, 1779, 12137, 9420, 16172, 6986, 11888; Payload ID: 9018 relates to Category No.: 6814, 6984, 14661, 12137, 7159, 7132, 1238, 6971, 743, 7153, 13143, 14442, 6532; Payload ID: 9019 relates to Category No.: 6814, 6984, 7159, 1737, 7132, 6971, 12630; Payload ID: 9020 relates to Category No.: 6814, 6984, 1045, 10100; Payload ID: 9021 relates to Category No.: 6814, 6984, 16172, 726; Payload ID: 9022 relates to Category No.: 6814, 6984, 795, 16172, 2941, 8956, 726, 8922, 7124; Payload ID: 9023 relates to Category No.: 6814, 6984, 2941, 14098, 4771; Payload ID: 9024 relates to Category No.: 6814, 6984, 2886, 12137, 16172, 7141, 7132, 6967, 1791; Payload ID: 9025 relates to Category No.: 1737, 6814, 6984, 1722, 10372, 7154, 13171, 8940, 10481, 12835, 11093, 10861, 12028, 11031, 8887, 12839, 13231; Payload ID: 9026 relates to Category No.: 6814, 6984; Payload ID: 9027 relates to Category No.: 6814, 6984; Payload ID: 9028 relates to Category No.: 6984, 3354, 7154, 14612, 1238, 743, 7153, 6881, 6814; Payload ID: 9029 relates to Category No.: 6814, 6984, 7141, 2886, 10481, 7132, 1238, 743, 7165, 7167; Payload ID: 9030 relates to Category No.: 6814, 6984, 2459, 9420, 6971; Payload ID: 9031 relates to Category No.: 6814, 6984, 7159, 9420, 7635; Payload ID: 9032 relates to Category No.: 6984, 3737, 1238, 8617, 743, 12634, 6814; Payload ID: 9033 relates to Category No.: 6814, 6984, 10379, 3871, 16008; Payload ID: 9034 relates to Category No.: 6814, 6984, 14699, 2459, 16138, 3808; Payload ID: 9035 relates to Category No.: 1737, 6814, 6984, 14661, 7154, 7132, 1238, 6971, 743, 12712; Payload ID: 9036 relates to Category No.: 6814, 6984, 1737, 14661, 7154, 1780, 7132, 1238, 6971, 743, 7153, 12712, 3927; Payload ID: 9037 relates to Category No.: 6814, 6984, 2460, 2459, 9420, 6738, 1238, 743, 10102, 5406, 5949, 724, 3445, 3176, 10574, 5462, 4952, 4949, 3070, 3781, 14699, 3444, 9099, 8888, 8885, 3780, 7247, 11316; Payload ID: 9038 relates to Category No.: 6814, 6984, 7168, 7162, 9420, 7137, 6738, 3176, 1238, 743, 726, 10102, 10481; Payload ID: 9039 relates to Category No.: 6814, 6984, 2941, 9420, 1238, 743, 9421; Payload ID: 9040 relates to Category No.: 1026, 6814, 6984, 7141, 9420, 1238, 743, 726, 7167; Payload ID: 9041 relates to Category No.: 1026, 6814, 6984, 7141, 1238, 743, 7167; Payload ID: 9042 relates to Category No.: 1026, 6814, 6984, 14661, 15149, 2941, 1238, 11997, 743; Payload ID: 9043 relates to Category No.: 1026, 6984, 2941, 13126, 1893, 16170, 11997, 10588, 11222, 15002, 11436, 4342, 2891, 10102; Payload ID: 9044 relates to Category No.: 1026, 6814, 6984, 2941, 9420, 7295, 11997; Payload ID: 9045 relates to Category No.: 6814, 6984; Payload ID: 9046 relates to Category No.: 6814, 6984, 14699, 16138, 8639, 11394, 1579, 756, 2705; Payload ID: 9047 relates to Category No.: 6814, 6984, 4020, 1238, 13323, 9414; Payload ID: 9048 relates to Category No.: 1737, 6814, 6984, 7159, 7162, 1238, 7153; Payload ID: 9049 relates to Category No.: 6814, 6984; Payload ID: 9050 relates to Category No.: 6814, 6984, 16214, 3807, 16338, 4766, 6986; Payload ID: 9051 relates to Category No.: 1737, 8862, 6814, 6984, 14661, 1730, 7168, 7162, 7132, 1238, 6971, 743; Payload ID: 9052 relates to Category No.: 6814, 6984, 14661, 16197, 1238, 743, 15002, 1018; Payload ID: 9053 relates to Category No.: 6814, 6984, 14661, 1238, 743, 1018; Payload ID: 9054 relates to Category No.: 6814, 1018; Payload ID: 9055 relates to Category No.: 6814; Payload ID: 9056 relates to Category No.: 6984, 6986, 14565, 11884, 9420, 6738, 1238, 743, 10102, 7743, 7613, 11997, 10305; Payload ID: 9057 relates to Category No.: 1737, 14661, 7154, 7134, 11884, 7132, 12848; Payload ID: 9058 relates to Category No.: 1737, 14905, 7159, 2429, 12515; Payload ID: 9059 relates to Category No.: 5428, 7912, 10074, 10238, 14693, 1238, 10080, 10486, 7719, 1238, 5825, 8549, 7657, 11591, 11325, 16102; Payload ID: 9061 relates to Category No.: 1026, 14661, 12137, 14565, 5446, 10372, 6606, 348, 4186, 12391, 4127, 3775, 11285, 10648, 14992, 5541, 16085, 8988, 1238, 6145, 5782, 9238, 274, 5243, 16213, 8373, 13084, 7730, 3814, 15011, 4249, 13532, 4342, 11304, 3633, 2885, 13859, 11109, 13945, 10954, 14729, 11113; Payload ID: 9062 relates to Category No.: 2940, 7743, 10486, 10955, 11436, 10487, 10928, 4447, 10699; Payload ID: 9063 relates to Category No.: 4828, 8962, 9932, 14565, 7743, 1451, 348, 10762, 817, 11436, 11418; Payload ID: 9064 relates to Category No.: 1026, 14661, 14565, 1703, 5446, 6606, 348, 4186, 9891, 12391, 1780, 4127, 3775, 5541, 16085, 8988, 6530, 10522, 3592, 11178, 7613, 10372, 4040, 8259, 8869, 10904, 10954, 11061, 10963, 10718, 11305, 3536, 10973, 9485; Payload ID: 9065 relates to Category No.: 14905; Payload ID: 9066 relates to Category No.: 1026, 14661, 1512, 5446, 6606, 348, 4186, 9891, 12391, 4127, 3775, 5541, 16085, 8988, 10287, 496, 3728, 1408, 10956; Payload ID: 9067 relates to Category No.: 1026, 14661, 1512, 5446, 6606, 348, 4186, 9891, 12391, 4127, 3775, 5541, 16085, 8988, 10372, 10956; Payload ID: 9069 relates to Category No.: 13589, 3398, 15490, 3398, 7737, 12835, 8117, 7567, 11620, 8667, 8378, 10333, 11623, 8600, 8584, 8201; Payload ID: 9070 relates to Category No.: 15490, 3398, 795, 8739, 7743, 7997, 8169, 8824, 8496; Payload ID: 9073 relates to Category No.: 13589, 3398; Payload ID: 9074 relates to Category No.: 13589, 3398; Payload ID: 9075 relates to Category No.: 13589, 3398, 1204; Payload ID: 9076 relates to Category No.: 3328, 13589, 3398, 15632, 14285; Payload ID: 9078 relates to Category No.: 16286, 1714, 12583; Payload ID: 9079 relates to Category No.: 16286, 1714, 7693; Payload ID: 9080 relates to Category No.: 690, 14661, 1790, 12603, 12835, 7598, 7924, 7923, 7919, 11242; Payload ID: 9081 relates to Category No.: 14318; Payload ID: 9082 relates to Category No.: 13589, 3398, 15490, 3398, 3854, 11506, 3398, 2087; Payload ID: 9083 relates to Category No.: 15490, 3398, 8739, 8731, 3398, 1816, 7743, 14640, 1780, 15570, 12717, 2116, 13589, 3398, 14782, 2469, 1272, 11150, 2087; Payload ID: 9084 relates to Category No.: 795, 8739, 10238, 15517, 7743, 13612, 8731, 3398; Payload ID: 9085 relates to Category No.: 13594, 15490, 3398, 8739, 13589, 3398, 11512; Payload ID: 9086 relates to Category No.: 15517, 13594, 11512, 7743, 7951; Payload ID: 9087 relates to Category No.: 11407; Payload ID: 9088 relates to Category No.: 11512, 15517, 4500, 8444, 2087; Payload ID: 9089 relates to Category No.: 15490, 3398, 8739, 13594, 3431; Payload ID: 9090 relates to Category No.: 13594, 15490, 3398, 8739, 4367; Payload ID: 9092 relates to Category No.: 15490, 3398, 11512, 11506, 3398, 11279, 2029, 11523, 12891, 3783, 5406, 7303, 15818, 1764, 3856, 3855, 2079, 2014, 2136, 2001, 8159, 13913, 2087, 1947; Payload ID: 9093 relates to Category No.: 13589, 3398, 15490, 3398, 7306, 2087; Payload ID: 9094 relates to Category No.: 11512, 8739, 8731, 3398, 15517, 7743, 11506, 3398, 12628, 7840, 4094, 8390, 8112, 7738, 11465, 10394, 14782, 1993, 6801, 14949, 8069, 11638, 8162, 11111, 10719, 11279, 8575, 2029, 7785, 13594, 1730, 12646, 7737, 13970, 3782, 8611, 15490, 3398, 14000, 1483, 3769, 11536, 12525, 11631, 2110, 2079, 2001, 8636, 7946, 13303, 2087, 1947, 8524, 8458, 8343; Payload ID: 9095 relates to Category No.: 11512, 15517, 8739, 13594, 11506, 3398, 14620, 690, 6990, 10606, 13150, 5754; Payload ID: 9096 relates to Category No.: 15490, 3398, 1060, 11506, 3398, 11512, 2079, 16294, 2001, 2087, 1947; Payload ID: 9097 relates to Category No.: 13594, 15490, 3398, 1026, 11506, 3398, 1048, 3041; Payload ID: 9098 relates to Category No.: 13589, 3398, 15490, 3398; Payload ID: 9099 relates to Category No.: 13594, 15490, 3398, 2469, 8196, 2128, 1945; Payload ID: 9101 relates to Category No.: 11674, 13328; Payload ID: 9102 relates to Category No.: 11674, 14565, 15149, 11676, 7340, 13328, 12948, 3121, 6748, 11667, 2525, 12607; Payload ID: 9103 relates to Category No.: 13594, 15490, 3398, 11674, 14565, 795, 12041, 13328, 8739, 1119, 14454, 13978, 13227, 5782; Payload ID: 9104 relates to Category No.: 11674, 12041, 13328; Payload ID: 9105 relates to Category No.: 16172; Payload ID: 9106 relates to Category No.: 7474, 15750, 14663, 1878, 13892, 12349, 2993, 728, 14044, 6272, 15752, 15751; Payload ID: 9107 relates to Category No.: 9500, 15750, 7476, 14400, 14663, 1878, 14003, 12349, 2993, 728, 5981, 15752; Payload ID: 9108 relates to Category No.: 12194, 7345, 8918; Payload ID: 9109 relates to Category No.: 15715, 1204, 15712, 4439; Payload ID: 9110 relates to Category No.: 13589, 3398, 15490, 3398, 4998, 12619, 8731, 3398, 2409, 13171, 13112; Payload ID: 9111 relates to Category No.: 13589, 3398, 15490, 3398, 2409; Payload ID: 9112 relates to Category No.: 13589, 3398, 15490, 3398, 2409, 7372, 6468, 3856, 4844; Payload ID: 9113 relates to Category No.: 13589, 3398, 15490, 3398, 2409; Payload ID: 9114 relates to Category No.: 8862, 1026, 1703, 2311, 10257, 1238, 6145, 5037, 8936, 5255, 1795, 10307, 6137, 5256, 10379, 1808; Payload ID: 9115 relates to Category No.: 9500, 1874, 1893, 14663, 84; Payload ID: 9116 relates to Category No.: 1089, 14590; Payload ID: 9117 relates to Category No.: 6814; Payload ID: 9118 relates to Category No.: 15603, 1780, 15464, 10938, 11546; Payload ID: 9119 relates to Category No.: 7131; Payload ID: 9120 relates to Category No.: 2940, 12640; Payload ID: 9121 relates to Category No.: 11546; Payload ID: 9122 relates to Category No.: 14267, 13618; Payload ID: 9123 relates to Category No.: 14267; Payload ID: 9124 relates to Category No.: 15490, 3398, 8739; Payload ID: 9128 relates to Category No.: 10372, 1451, 1383, 11178, 11323, 10574, 15245, 12021, 11359, 11107; Payload ID: 9129 relates to Category No.: 14565, 795, 1512, 1816, 3013, 14663, 6000; Payload ID: 9130 relates to Category No.: 6814; Payload ID: 9131 relates to Category No.: 6814; Payload ID: 9133 relates to Category No.: 1512, 14663, 10158, 13882, 13874, 13827, 13836, 13966, 14009, 13837, 13970, 13916, 13907, 14016, 13960; Payload ID: 9134 relates to Category No.: 1512; Payload ID: 9135 relates to Category No.: 9500, 1512, 1533, 4706, 1874, 14663, 15042, 12338, 1968, 4534, 13969, 7476, 13882, 13827, 13836, 13966, 10238, 13860, 13797, 13877, 5993, 11639; Payload ID: 9136 relates to Category No.: 9500, 1512, 1533; Payload ID: 9137 relates to Category No.: 9500, 1512, 1533; Payload ID: 9138 relates to Category No.: 9500, 1512, 1533, 1874, 14663, 12338, 7476, 5993; Payload ID: 9139 relates to Category No.: 9500, 1512, 1533, 14831, 927, 12338, 5991, 5994; Payload ID: 9140 relates to Category No.: 9500; Payload ID: 9142 relates to Category No.: 9500, 13975, 3125, 3013, 5300, 15353; Payload ID: 9143 relates to Category No.: 12194, 15490, 3398, 7613, 11109, 5285, 10775, 5848, 1893, 14057, 8818, 1274, 5447, 729, 9451, 12737, 734, 11291, 11147, 11148, 9783, 8819, 8222, 13634, 7631, 5860, 11496, 7558, 5594, 13875, 10288, 8621, 10430, 8780, 8423; Payload ID: 9145 relates to Category No.: 13589, 3398, 15490, 3398, 674, 7345, 8375, 7743, 8930, 4952, 14886, 8931, 13606; Payload ID: 9146 relates to Category No.: 13589, 3398, 15490, 3398; Payload ID: 9147 relates to Category No.: 12194; Payload ID: 9148 relates to Category No.: 795, 12638, 3684, 7345, 11765, 1893, 7132, 1844, 5855, 12036, 2006, 7155, 7156, 3927, 10346, 7965, 8567, 9308, 9165, 14984, 16130, 13365, 14838, 13936, 11147, 7584; Payload ID: 9149 relates to Category No.: 9500, 14663, 2347; Payload ID: 9150 relates to Category No.: 795, 11765, 1844; Payload ID: 9152 relates to Category No.: 1780; Payload ID: 9153 relates to Category No.: 11049, 16182; Payload ID: 9154 relates to Category No.: 1026, 1703, 12638, 12614, 12794, 1795, 4021, 14056, 8936, 7241, 3814, 1317, 15424, 3878, 14064; Payload ID: 9155 relates to Category No.: 1703, 12638, 12614, 12794, 7345, 4021, 1026, 11436, 2370, 7370; Payload ID: 9156 relates to Category No.: 1703, 12638, 3781, 12614, 12794, 4020, 4021, 1749, 4990, 3643; Payload ID: 9157 relates to Category No.: 1703, 12638, 12614, 12794, 1240, 1334, 4021; Payload ID: 9158 relates to Category No.: 690, 1703, 12638, 15043, 1730, 1752, 2940, 5592, 12614, 12794, 1780, 3564, 4020, 4021, 4229, 1789, 3711, 4937, 12646, 2459, 1318, 9410, 6375, 7345, 1320, 8869, 1317, 9321, 7243, 3910, 7239; Payload ID: 9159 relates to Category No.: 1026, 1703, 15043, 10366, 4020, 8936, 4021, 10574, 3643, 8955, 9320, 1752, 3566; Payload ID: 9160 relates to Category No.: 1703, 4021, 16214, 1026, 14056, 15143, 1765, 8936, 8918, 907, 14385, 1025, 6850, 6845; Payload ID: 9161 relates to Category No.: 1703, 3781, 4020, 4021, 1749, 4990, 3643, 1334; Payload ID: 9162 relates to Category No.: 1703; Payload ID: 9163 relates to Category No.: 1026, 1703, 15043, 1752, 11884, 4020, 4021, 10574, 3641, 4990, 8936; Payload ID: 9164 relates to Category No.: 1703, 3781, 4020, 4021, 1749, 4990; Payload ID: 9165 relates to Category No.: 1703, 4021, 16214, 14056, 1765, 907; Payload ID: 9166 relates to Category No.: 6814; Payload ID: 9167 relates to Category No.: 6814, 8731, 3398, 10183; Payload ID: 9168 relates to Category No.: 6814; Payload ID: 9169 relates to Category No.: 14663, 14972, 2347; Payload ID: 9170 relates to Category No.: 6814, 12137, 14177, 9169; Payload ID: 9171 relates to Category No.: 12091, 1737, 10238, 7154, 5268, 7693, 4336, 5072, 4332, 14613, 12465, 11174, 7835, 13344, 13271, 2910, 1892, 5939, 5454, 5452; Payload ID: 9172 relates to Category No.: 12091, 1737, 5785, 10238, 9713, 7154, 5268, 7693, 5072, 4332, 7835, 13271, 1892, 5939, 5454, 5452; Payload ID: 9173 relates to Category No.: 14318; Payload ID: 9174 relates to Category No.: 5939, 9632, 3781, 5936; Payload ID: 9175 relates to Category No.: 5939, 9632, 3781, 5936; Payload ID: 9176 relates to Category No.: 5939, 9632, 3781, 5936; Payload ID: 9177 relates to Category No.: 5939, 9632, 3781, 2562, 5936, 1922; Payload ID: 9178 relates to Category No.: 5939, 9632, 3781, 5936; Payload ID: 9179 relates to Category No.: 5939, 9632, 3781, 5936; Payload ID: 9180 relates to Category No.:

5939, 9632, 3781, 5936; Payload ID: 9181 relates to Category No.: 5939, 9632, 3781, 5936; Payload ID: 9182 relates to Category No.: 5939, 9632, 3781, 5936; Payload ID: 9183 relates to Category No.: 5939, 9632, 3781, 5936; Payload ID: 9184 relates to Category No.: 5939, 9632, 3781, 5936; Payload ID: 9185 relates to Category No.: 5939, 9632, 3781, 5936; Payload ID: 9186 relates to Category No.: 5939, 9632, 3781, 5936; Payload ID: 9187 relates to Category No.: 5939, 9632, 3781, 5936; Payload ID: 9188 relates to Category No.: 5939, 9632, 3781, 5936; Payload ID: 9189 relates to Category No.: 5939, 9632, 3781, 5936; Payload ID: 9190 relates to Category No.: 5939, 9632, 3781, 5936; Payload ID: 9191 relates to Category No.: 5936; Payload ID: 9192 relates to Category No.: 5939, 9632; Payload ID: 9193 relates to Category No.: 6445, 13402, 11502, 3694, 2353, 10955, 1906, 1722, 10702, 1746, 15521, 4439, 5541, 3697, 1892, 6451, 12695, 12696, 6444, 12698; Payload ID: 9194 relates to Category No.: 1026, 14661, 1722, 10702, 5446, 6606, 348, 1746, 4186, 12391, 15521, 4127, 3775, 4439, 5541, 16085, 8988, 1892, 6451, 11502, 1906; Payload ID: 9195 relates to Category No.: 1026, 14661, 1722, 10702, 5446, 6606, 348, 4186, 12391, 15521, 4127, 3775, 4439, 5541, 16085, 8988, 1892, 6451, 11502, 1906, 13588; Payload ID: 9196 relates to Category No.: 1722, 10702, 15521, 4439, 5541, 6451, 11502, 1906, 12649, 12024; Payload ID: 9197 relates to Category No.: 16191, 7840, 1722, 14038, 10702, 7613, 15521, 4439, 5541, 6451, 11502, 1906, 12649, 12024; Payload ID: 9198 relates to Category No.: 4021, 15610, 14483, 16136, 756, 2705; Payload ID: 9199 relates to Category No.: 12105, 15570, 12122, 4012; Payload ID: 9200 relates to Category No.: 4021, 10985, 15560, 10986; Payload ID: 9201 relates to Category No.: 11926, 12633, 7306, 12628, 13386, 4021, 13616, 4873; Payload ID: 9202 relates to Category No.: 5428, 7912, 3161; Payload ID: 9205 relates to Category No.: 15207, 1070, 403; Payload ID: 9206 relates to Category No.: 12091, 334, 15207, 4998, 1070, 10074, 15614, 9717, 5446, 11910, 4186, 9891, 12646, 4127, 3775, 11461, 16197, 8988, 1238, 15194, 2088, 6145, 13827, 10864, 15192, 13695, 11445, 12750, 2165, 13090, 11858, 10648, 9720, 1795, 10642, 11584, 13563, 13405; Payload ID: 9207 relates to Category No.: 12137, 5793, 9994; Payload ID: 9209 relates to Category No.: 14090, 16214, 14086, 10005, 16211, 16216, 10914, 14080; Payload ID: 9210 relates to Category No.: 6219, 2359, 9945, 2355, 6253, 14663, 14102, 16155, 9827, 2353, 2352, 5065, 9825, 6249, 12965, 13859, 13813; Payload ID: 9211 relates to Category No.: 14565, 795, 12498, 10775, 11606, 15192, 10049, 7381, 1984, 2079, 13827, 8378, 7315, 13787, 7755, 10585; Payload ID: 9212 relates to Category No.: 5806; Payload ID: 9213 relates to Category No.: 13552, 13556, 12471, 15190, 9945; Payload ID: 9214 relates to Category No.: 795, 11448; Payload ID: 9215 relates to Category No.: 795, 11448; Payload ID: 9217 relates to Category No.: 7288, 5446, 10175, 14271, 7965, 9000, 7216, 3757, 12858, 3791, 10298, 11040, 8689, 6462, 13562, 7908, 13554, 7220, 8110, 8678, 4021, 14640; Payload ID: 9218 relates to Category No.: 12427, 14565, 1703, 1849; Payload ID: 9219 relates to Category No.: 1703; Payload ID: 9220 relates to Category No.: 795, 5037; Payload ID: 9221 relates to Category No.: 795, 5037; Payload ID: 9222 relates to Category No.: 16313, 15192, 10049; Payload ID: 9223 relates to Category No.: 5428, 11109, 10775, 2311, 10648, 13925, 2013, 10497, 10583, 7543, 4145, 8004, 7787, 8129, 8782, 10845, 10339, 1678, 570, 9538, 11108, 8261, 8361, 7571, 11606, 10822, 6626, 10196, 3846, 13893, 11541, 11036, 2145, 10815, 11567, 10856, 10498, 7717, 579, 10339, 579, 10833, 10852, 10827, 10830, 11446, 10500, 10471; Payload ID: 9227 relates to Category No.: 12137, 14098, 4771, 11182; Payload ID: 9228 relates to Category No.: 12137, 11926, 3833; Payload ID: 9229 relates to Category No.: 11926, 3833, 12063, 2669, 1893, 6738, 1238, 4766, 11660, 11145, 3676; Payload ID: 9231 relates to Category No.: 8739, 12498, 11167, 1746, 13105, 1729, 14656, 4859, 3176, 15570, 4953; Payload ID: 9232 relates to Category No.: 10074, 12498, 11167, 1746, 13105, 1729, 14656, 7306, 4859, 1238, 15570, 10080; Payload ID: 9233 relates to Category No.: 12194, 12195, 5446, 8373, 14663, 15456, 13714, 14972, 16058, 743, 16222, 12404, 7945, 8337, 13765; Payload ID: 9234 relates to Category No.: 286, 7340, 7390, 10108; Payload ID: 9235 relates to Category No.: 286, 7340, 7390, 10108; Payload ID: 9236 relates to Category No.: 286, 7340, 7390, 10108; Payload ID: 9237 relates to Category No.: 12194, 1737, 1703, 7154; Payload ID: 9239 relates to Category No.: 9165, 14620, 8524, 8906, 8256, 4950; Payload ID: 9240 relates to Category No.: 8756, 7662, 7575, 14620, 12619, 690, 12855, 9308, 1245; Payload ID: 9241 relates to Category No.: 12091, 3635, 9713, 7710, 3525, 11858, 15547, 9716, 12414; Payload ID: 9242 relates to Category No.: 12091, 8454, 9720; Payload ID: 9243 relates to Category No.: 4593, 9068; Payload ID: 9244 relates to Category No.: 7306; Payload ID: 9245 relates to Category No.: 1812, 1463, 6111; Payload ID: 9246 relates to Category No.: 15499, 11512, 16286, 7287, 5217, 11509, 8349, 14949, 5218, 5145, 11044, 3644; Payload ID: 9247 relates to Category No.: 14565, 10036, 10509, 481, 7619, 8739, 2355, 5544, 4535, 10877, 4538, 13888, 13824, 13371, 13004, 6219, 455, 1189, 4100, 2176, 13135, 13511, 5263, 12861, 11259, 11411, 3529, 12908, 13365, 13027, 11057, 15836, 8015, 13835, 13967, 14046, 2110, 7613, 13882, 10372, 13966, 13837, 13767, 4145, 10955, 11582, 12544, 4105, 2469, 10475, 11307, 6149, 9492, 8811, 1564, 2030, 6119, 10800, 1273, 10928, 3728, 8219, 4628, 10870, 10630, 8288, 11181, 13077, 7708, 10605, 8030, 10721; Payload ID: 9248 relates to Category No.: 2885, 7306, 1795, 3728, 2355, 8021, 8099; Payload ID: 9249 relates to Category No.: 8191, 11294, 8526, 8043; Payload ID: 9251 relates to Category No.: 8906, 10702, 3986, 2711, 1048, 11884, 4775, 13373, 13257, 3915, 12843; Payload ID: 9252 relates to Category No.: 1737, 8906, 10702, 3986, 2711, 13373, 13257, 3915, 12843, 7303, 11634, 1312, 10036, 5985, 3928; Payload ID: 9254 relates to Category No.: 12194; Payload ID: 9255 relates to Category No.: 1894, 6902, 12498, 12053, 13168, 8509, 2776, 12913; Payload ID: 9256 relates to Category No.: 6902, 15715, 15712, 4439, 16297, 15708; Payload ID: 9257 relates to Category No.: 10775, 10475, 1752, 378; Payload ID: 9259 relates to Category No.: 10331, 6212, 3244; Payload ID: 9260 relates to Category No.: 13594, 15490, 3398, 5446, 8731, 3398, 1204, 11573; Payload ID: 9261 relates to Category No.: 16286, 1204; Payload ID: 9262 relates to Category No.: 1737, 7154; Payload ID: 9263 relates to Category No.: 1048; Payload ID: 9264 relates to Category No.: 1048; Payload ID: 9265 relates to Category No.: 1703, 1048; Payload ID: 9266 relates to Category No.: 1048; Payload ID: 9268 relates to Category No.: 12526, 8988, 7640, 8936, 11980, 2176, 8415; Payload ID: 9269 relates to Category No.: 11431; Payload ID: 9272 relates to Category No.: 1002, 12096, 11878, 15897, 11860, 10254, 7908, 16185, 11624; Payload ID: 9274 relates to Category No.: 1556; Payload ID: 9278 relates to Category No.: 10366, 12430, 7955; Payload ID: 9279 relates to Category No.: 1752, 286, 10366, 10192, 1238, 6018, 15989, 14330, 11418, 11425, 1079, 10891, 7646; Payload ID: 9281 relates to Category No.: 8424, 1270; Payload ID: 9286 relates to Category No.: 1204; Payload ID: 9289 relates to Category No.: 5848; Payload ID: 9297 relates to Category No.: 1204; Payload ID: 9303 relates to Category No.: 5848, 1048; Payload ID: 9307 relates to Category No.: 15143, 13525, 11652; Payload ID: 9309 relates to Category No.: 12153; Payload ID: 9313 relates to Category No.: 13376, 11294; Payload ID: 9316 relates to Category No.: 11431; Payload ID: 9317 relates to Category No.: 12526; Payload ID: 9318 relates to Category No.: 5848; Payload ID: 9320 relates to Category No.: 5848, 1048; Payload ID: 9325 relates to Category No.: 14831, 2461, 9475, 6530, 7245, 3809, 5457, 13740; Payload ID: 9330 relates to Category No.: 13969, 11094; Payload ID: 9331 relates to Category No.: 1048; Payload ID: 9339 relates to Category No.: 708, 710, 1797, 13973, 11690; Payload ID: 9340 relates to Category No.: 5848; Payload ID: 9341 relates to Category No.: 5848, 4094; Payload ID: 9342 relates to Category No.: 5848; Payload ID: 9343 relates to Category No.: 5848; Payload ID: 9345 relates to Category No.: 11431; Payload ID: 9346 relates to Category No.: 14565, 1703; Payload ID: 9347 relates to Category No.: 11431; Payload ID: 9348 relates to Category No.: 16213, 6322; Payload ID: 9349 relates to Category No.: 12153, 6814; Payload ID: 9350 relates to Category No.: 1204, 11431, 6323, 4004, 6296, 12045, 8559, 15143; Payload ID: 9351 relates to Category No.: 11431, 6323, 8559, 15143; Payload ID: 9352 relates to Category No.: 10273, 11431; Payload ID: 9353 relates to Category No.: 15143; Payload ID: 9354 relates to Category No.: 6902, 14456, 985, 8971, 1639; Payload ID: 9355 relates to Category No.: 13589, 3398; Payload ID: 9356 relates to Category No.: 13904; Payload ID: 9357 relates to Category No.: 16136, 859, 8874; Payload ID: 9359 relates to Category No.: 1746, 7280; Payload ID: 9362 relates to Category No.: 9420, 8528, 8527; Payload ID: 9363 relates to Category No.: 7743; Payload ID: 9365 relates to Category No.: 13589, 3398, 15490, 3398, 1721, 8241, 12754; Payload ID: 9366 relates to Category No.: 7154, 2886, 14904, 6982, 9169, 5949, 13713, 7743, 16286, 7693, 8831, 8529, 10356; Payload ID: 9367 relates to Category No.: 2768; Payload ID: 9370 relates to Category No.: 1204, 10226, 1334, 10558, 11542; Payload ID: 9371 relates to Category No.: 13589, 3398, 15490, 3398, 7295, 7124, 13163, 8314; Payload ID: 9372 relates to Category No.: 4828, 5446, 2467, 14838, 10314, 1272, 1276, 9455, 7847, 8726, 4937, 8731, 3398, 11506, 3398, 3246, 2469, 6523, 3801, 15763, 5760, 1486, 1735, 6851, 6866, 10292, 3805; Payload ID: 9373 relates to Category No.: 4828, 10314, 4937, 12646, 5458, 3805, 9376; Payload ID: 9374 relates to Category No.: 4828, 16286, 10366, 10314, 11620; Payload ID: 9375 relates to Category No.: 12091, 14661, 10314, 11178, 8449, 1277, 9458, 10862; Payload ID: 9376 relates to Category No.: 12091, 14661, 12137, 13359, 1002, 5785, 10702, 13975, 12760, 11237, 3639, 6606, 348, 9713, 345, 13126, 1451, 13532, 4588, 8940, 11285, 10314, 11298, 2083, 6445, 4766, 8918, 7122, 11858, 10954, 1892, 10256, 5772, 8535, 11242, 8049, 8926, 8507, 9716, 3971, 8095, 12397, 8374, 7915, 2050, 13540, 1956, 7120, 13224, 8544, 13228, 11227, 3167, 8537, 13080, 4004, 9333, 4892, 13535, 12029, 10530, 7957, 11241, 13156, 13230, 15217, 13055, 13154, 12780, 8202, 8712, 8538, 12565, 8451, 6297, 12583, 2079; Payload ID: 9378 relates to Category No.: 6814, 3986, 12851; Payload ID: 9379 relates to Category No.: 483, 7369, 14385, 7370, 4484, 8933, 4474, 4480; Payload ID: 9380 relates to Category No.: 1204; Payload ID: 9382 relates to Category No.: 12877, 16214; Payload ID: 9386 relates to Category No.: 8862; Payload ID: 9387 relates to Category No.: 14565; Payload ID: 9388 relates to Category No.: 9982, 14838, 1047; Payload ID: 9389 relates to Category No.: 14456, 5465, 9470; Payload ID: 9390 relates to Category No.: 14456, 5465, 13322; Payload ID: 9391 relates to Category No.: 9470; Payload ID: 9395 relates to Category No.: 11431; Payload ID: 9396 relates to Category No.: 1048, 11431; Payload ID: 9397 relates to Category No.: 2409, 2410, 3360, 3901; Payload ID: 9400 relates to Category No.: 8862, 1026, 1780, 8936, 10362, 11436, 11940; Payload ID: 9401 relates to Category No.: 13589, 3398, 674; Payload ID: 9402 relates to Category No.: 12194, 14565, 1816, 746, 12544, 12096, 6738, 742, 4145, 9631, 742, 15224, 14656, 11878; Payload ID: 9403 relates to Category No.: 6129, 13621, 4439, 15698; Payload ID: 9404 relates to Category No.: 6129, 13621, 4439, 15698; Payload ID: 9405 relates to Category No.: 5367, 11512, 10372, 7306, 11175, 10955, 11174, 11178, 11582, 11275, 11581, 10947, 8089, 6132, 10987, 13137, 10741, 14949, 7743, 10648, 8928, 6375, 3566, 3010, 10248, 14944, 7946, 12628, 1250, 6371, 6626, 6389, 7346, 8269, 15740, 6383, 14920, 15838, 13443, 15536, 14056, 7598, 11094, 9411, 908, 10455; Payload ID: 9406 relates to Category No.: 2885, 10372, 13818, 1795, 2451, 9373, 6132, 13969, 9411, 8940, 8340; Payload ID: 9408 relates to Category No.: 14640, 7598, 1622, 12192, 7924, 3714, 8805; Payload ID: 9409 relates to Category No.: 14640, 2311; Payload ID: 9410 relates to Category No.: 403, 1795, 3012, 12994; Payload ID: 9411 relates to Category No.: 14565, 403, 3012; Payload ID: 9412 relates to Category No.: 403; Payload ID: 9413 relates to Category No.: 5446; Payload ID: 9414 relates to Category No.: 403; Payload ID: 9415 relates to Category No.: 14565, 403, 3012; Payload ID: 9416 relates to Category No.: 11512, 14565, 14038, 403, 10238, 3021, 8615, 12994, 10648, 2041, 7724, 3049, 8129, 8361, 5609, 10491, 12409, 8688, 8139, 7848, 8759, 8423, 8128, 4123, 8685, 7679, 5371, 7869, 7908, 8678, 7866, 15204, 10482, 7718, 572, 5606, 8329, 8127, 8781, 7589, 8142, 10641; Payload ID: 9417 relates to Category No.: 5367, 14565, 403, 1816, 1795, 12994, 2041, 11460, 10851, 1849, 8688, 12758, 8106, 5041, 4123, 7679, 11319, 11492, 11462, 5371, 7603; Payload ID: 9418 relates to Category No.: 403, 1795, 3012, 8424; Payload ID: 9419 relates to Category No.: 14565, 403, 8424; Payload ID: 9420 relates to Category No.: 403, 1795, 3012; Payload ID: 9421 relates to Category No.: 1204; Payload ID: 9423 relates to Category No.: 7131, 10491; Payload ID: 9424 relates to Category No.: 12091, 14565, 9720, 7613, 15614, 9854, 1780, 2110, 11094, 10319; Payload ID: 9425 relates to Category No.: 5367, 1764, 12648, 674, 3038, 8240; Payload ID: 9426 relates to Category No.: 403, 12994; Payload ID: 9427 relates to Category No.: 12994; Payload ID: 9428 relates to Category No.: 12194, 5428, 6153, 14663, 815, 9631, 6154, 14054, 13981, 15818; Payload ID: 9429 relates to Category No.: 4828, 6157, 5367, 8962, 7340, 9932, 7252, 14565, 5428; Payload ID: 9430 relates to Category No.: 4828, 6157, 5428, 8962, 7581, 2311, 9932, 14565, 5940; Payload ID: 9431 relates to Category No.: 9500, 6153, 10331, 14663, 815, 6263, 6154, 6262, 13925, 2041, 13886, 13827, 13787, 2147; Payload ID: 9432 relates to Category No.: 13589, 3398, 15490, 3398, 14565, 1703, 11884, 7719, 7645, 12615; Payload ID: 9433 relates to Category No.: 6814, 13501, 9125, 15194, 14793, 6611, 9410, 13257, 8403, 9599, 11125, 11242, 9485, 2609, 4144; Payload ID: 9434 relates to Category No.: 8739, 13594, 15517; Payload ID: 9435 relates to Category No.: 13594, 15517; Payload ID: 9436 relates to Category No.: 13589, 3398, 15490, 3398; Payload ID: 9437 relates to Category No.: 11940, 12154, 15898; Payload ID: 9438 relates to Category No.: 11940; Payload ID: 9439 relates to Category No.: 1737, 7018, 3304, 9296, 674, 3354, 3353, 15257, 1089, 3335, 3336, 7132, 3333, 6006, 9328, 13699, 15533, 3369, 4485, 15259, 15260, 9296, 3322, 3356, 3453, 13877; Payload ID: 9440 relates to Category No.: 1737, 1721, 3304, 3452, 9296, 3354, 3353, 3448, 1089, 3335, 3333, 7122, 15533, 3449, 4485, 7037, 9296, 3322, 1089, 3333, 8306, 7887, 3453; Payload ID: 9441 relates to Category No.: 1737, 1721, 14052, 3304, 3354, 5901, 3353, 3448, 2169, 13856, 8373, 1780, 5391, 3335, 16197, 2424, 3453, 3333, 15208, 14590, 5406, 10626, 14782, 11087, 3882, 8923, 16051, 9296, 3322, 15195, 11745, 3334, 3451, 13904, 2044; Payload ID: 9442 relates to Category No.: 6814, 11930, 12071, 7443, 7332, 4727, 14638, 4711, 14628; Payload ID: 9443 relates to Category No.: 378; Payload ID: 9444 relates to Category No.: 15490, 3398, 1893, 7131, 10491, 10296, 12597, 8739, 8408; Payload ID: 9445 relates to Category No.: 10702, 8731, 3398, 10648, 10383, 2131, 1709, 3900, 1749, 11425, 10629; Payload ID: 9446 relates to Category No.: 1749, 14589, 7613, 7939, 1814, 8367, 10806, 8068; Payload ID: 9449 relates to Category No.: 5848, 11371, 5846; Payload ID: 9450 relates to Category No.: 12153, 12614, 13469; Payload ID: 9451 relates to Category No.: 280, 14330, 7566; Payload ID: 9452 relates to Category No.: 13589, 3398, 15490, 3398, 11512, 8929, 8731, 3398, 7306, 12777, 3559, 10719, 7951, 15534, 5156, 4937, 15517, 14782, 4419, 722, 2235, 2228, 4946, 16286, 10343, 3811, 1843; Payload ID: 9453 relates to Category No.: 13594, 4937, 14782, 11512, 3811, 10385; Payload ID: 9454 relates to Category No.: 14365; Payload ID: 9456 relates to Category No.: 1703, 1204; Payload ID: 9457 relates to Category No.: 12091, 8862, 1026, 14661, 14565, 3766, 5446, 274, 14108, 4130, 10257, 8798, 10190, 11418; Payload ID: 9458 relates to Category No.: 12091, 13313, 9982, 14838; Payload ID: 9459 relates to Category No.: 11512, 8739, 13559; Payload ID: 9460 relates to Category No.: 11512, 7306, 2128, 7294, 3592; Payload ID: 9461 relates to Category No.: 13589, 3398, 15490, 3398, 7946, 10606, 11181, 10661; Payload ID: 9462 relates to Category No.: 15517, 8887, 11512, 16136, 15400, 8509, 14886, 16124, 14882, 12632, 12613; Payload ID: 9463 relates to Category No.: 8731, 3398, 13589, 3398, 15490, 3398, 9982, 14565, 12648, 1752, 2940, 7306, 8421, 7693, 4441, 13882, 8071, 10649, 2904, 9454; Payload ID: 9464 relates to Category No.: 8862, 13589, 3398, 8731, 3398, 1816, 15517, 674, 11506, 3398, 12891, 16041, 14058, 3604, 3608, 11740, 3445, 9599, 5949, 9410, 722, 724, 3614, 11083, 3819, 16005, 7251, 3642, 10292, 16069, 16023, 11634, 673, 8846, 10539, 10647, 4419, 3533, 14882, 2235, 2228, 4260, 2234, 9488, 16038, 9487, 2256, 4946, 9573, 2598, 14935, 13721, 6074, 10229; Payload ID: 9465 relates to Category No.: 13589, 3398, 15490, 3398, 11506, 3398, 4937, 2243, 11512, 3445, 673, 1026, 8887, 14056, 8929, 6795, 1295, 1023, 8862, 15247, 9333, 15248, 8906, 6492, 8753; Payload ID: 9466 relates to Category No.: 13589, 3398, 15490, 3398, 5458, 11506, 3398, 9410, 1730, 11512, 3445, 14885, 7613, 10034, 10036, 7251, 6652, 14882, 16127, 6375; Payload ID: 9467 relates to Category No.: 13589, 3398, 15490, 3398, 7613, 9410, 10036, 7251, 6652; Payload ID: 9468 relates to Category No.: 13589, 3398, 15490, 3398, 12646, 1816, 2235, 2228, 2234, 11506, 3398, 1782, 5073, 14882, 4257; Payload ID: 9469 relates to Category No.: 13589, 3398, 15490, 3398, 1751, 2247, 2252, 2250, 4258, 2248, 4256; Payload ID: 9470 relates to Category No.: 13589, 3398, 15490, 3398, 6103, 4138, 9321, 4257, 4256; Payload ID: 9471 relates to Category No.: 8731, 3398, 7251, 13589, 3398, 6530, 1780, 4138, 4790; Payload ID: 9472 relates to Category No.: 13589, 3398, 15490, 3398, 12891, 2235, 1026, 8375, 3437, 8929, 2169, 12633, 3070, 5073, 2177, 6995, 1295; Payload ID: 9473 relates to Category No.: 13589, 3398, 15490, 3398, 8929, 7306, 3445, 5406; Payload ID: 9474 relates to Category No.: 1002, 1000; Payload ID: 9475 relates to Category No.: 1204; Payload ID: 9476 relates to Category No.: 15490, 3398, 7306, 12891, 12543, 11506, 3398; Payload ID: 9477 relates to Category No.: 3578; Payload ID: 9478 relates to Category No.: 3639; Payload ID: 9479 relates to Category No.: 8862, 14589, 13225, 6297; Payload ID: 9480 relates to Category No.: 13589, 3398, 11697, 14782, 14949, 7011, 14193, 11091, 11546, 14944, 4458, 12894, 7013, 8008, 10377; Payload ID: 9481 relates to Category No.: 13589, 3398, 11697, 7011, 14193; Payload ID: 9482 relates to Category No.: 1721, 12619, 7132, 4336; Payload ID: 9483 relates to Category No.: 15490, 3398, 1721, 12619, 7132, 4336; Payload ID: 9484 relates to Category No.: 13589, 3398, 15490, 3398, 12619, 7132, 4336; Payload ID: 9485 relates to Category No.: 12137, 8977, 15149, 3986, 11884, 914, 6492, 12001, 5458, 15167; Payload ID: 9486 relates to Category No.: 14661, 12137, 8977, 15149, 3986, 914, 6492, 12001; Payload ID: 9487 relates to Category No.: 12137, 8977, 15149, 3986, 914, 6492, 12001, 7241; Payload ID: 9488 relates to Category No.: 15490, 3398, 1721, 12619, 3304, 7132, 4336; Payload ID: 9490 relates to Category No.: 2562; Payload ID: 9491 relates to Category No.: 1026, 5367, 14661, 5785, 15207, 14565, 10074, 5446, 403, 6606, 348, 5592, 4186, 1451, 12391, 13551, 4127, 3775, 5541, 16085, 8988, 1238, 15185, 6615, 11265, 5428, 5242, 6413, 4439; Payload ID: 9492 relates to Category No.: 5785, 1070, 5446, 403, 1451, 4127, 1053, 6615; Payload ID: 9493 relates to Category No.: 6219, 6212, 5243, 5428, 6375, 1780, 2878, 1764, 15428, 4110, 14982; Payload ID: 9494 relates to Category No.: 14663, 6213, 3833, 12105, 10918, 12049, 2438, 11932, 12699, 13630; Payload ID: 9496 relates to Category No.: 6219, 6814, 9941, 14102, 2353, 5065, 9944, 10427, 10731, 13078, 13966, 1780; Payload ID: 9497 relates to Category No.: 6219, 6212; Payload ID: 9498 relates to Category No.: 6219, 6212; Payload ID: 9499 relates to Category No.: 6219, 6212; Payload ID: 9500 relates to Category No.: 6219, 6212; Payload ID: 9501 relates to Category No.: 6219, 6212, 15664, 9500, 6518; Payload ID: 9502 relates to Category No.: 6219, 4104, 14663, 15661, 14102, 16155, 2353, 15662, 5065, 6340, 2438, 6213, 5738, 9826, 2355, 2359, 13967, 13969, 13859, 13882, 13874, 13886, 13827, 13796, 6269, 13773, 13981, 13763, 2000, 13799, 13932, 5004, 2469, 13813, 4110, 15664, 9902, 13923, 2439, 6335, 9837, 8994, 9827, 9820, 4654, 3194, 12066, 13843, 13316; Payload ID: 9503 relates to Category No.: 12091, 6814, 6212, 2355, 14663, 15661, 6303, 3217; Payload ID: 9504 relates to Category No.: 6219, 6212, 6814; Payload ID: 9505 relates to Category No.: 6219, 6212, 6814; Payload ID: 9506 relates to Category No.: 6226, 6212; Payload ID: 9507 relates to Category No.: 15490, 3398, 11512, 3100, 4105, 15660, 9945, 1867, 14663, 7132, 4653, 7155, 9825, 9835, 15665, 9411, 2009; Payload ID: 9508 relates to Category No.: 6219, 15490, 3398, 11512, 3100, 4105, 15660, 9945, 1867, 14663, 4653, 9825, 9835; Payload ID: 9509 relates to Category No.: 11512, 3100, 4105, 15660, 9945, 14663, 4653, 9825, 9835; Payload ID: 9510 relates to Category No.: 12194, 15618, 7912, 14459, 14057, 14014, 6306; Payload ID: 9511 relates to Category No.: 15626; Payload ID: 9512 relates to Category No.: 6219, 15618, 6306; Payload ID: 9513 relates to Category No.: 6219, 15626; Payload ID: 9514 relates to Category No.: 15618, 5446, 1862, 5848, 14554, 4040, 14038, 13967, 2041, 2014, 2136, 13827, 2001, 13975, 13870, 10648, 11942, 10371, 2077, 13788, 13957, 15626; Payload ID: 9515 relates to Category No.: 14586; Payload ID: 9516 relates to Category No.: 15626, 13874; Payload ID: 9517 relates to Category No.: 15626; Payload ID: 9519 relates to Category No.: 5428, 13975, 13925, 6236, 11996, 8887; Payload ID: 9520 relates to Category No.: 6269, 13071; Payload ID: 9523 relates to Category No.: 1204; Payload ID: 9526 relates to Category No.: 5848, 14456, 3147, 991; Payload ID: 9527 relates to Category No.: 5446, 10940, 381, 13925, 2041, 3016, 15456, 15450, 8782, 6248, 10851, 10855, 11566, 3015, 1849, 2043, 9391, 11496, 3150, 6460, 6247, 11329, 11565, 8045, 10415, 6139, 11102, 11182, 3729, 6269, 13125; Payload ID: 9528 relates to Category No.: 13594, 15490, 3398, 14565, 795, 10775, 13925, 2041, 12737, 8389, 496; Payload ID: 9529 relates to Category No.: 6219, 4104, 9945, 6253, 14663, 11365, 15661, 16155, 15664, 15662, 14086, 10005, 16211, 10946, 13860, 2439, 10426, 6212, 13812, 13827, 15660; Payload ID: 9530 relates to Category No.: 12194, 6219, 6227, 7912, 12427, 6253, 14663, 1237; Payload ID: 9531 relates to Category No.: 14456, 1415, 3143; Payload ID: 9532 relates to Category No.: 11996, 1894, 6236; Payload ID: 9533 relates to Category No.: 6219, 1894, 11996; Payload ID: 9534 relates to Category No.: 11860; Payload ID: 9535 relates to Category No.: 3013; Payload ID: 9538 relates to Category No.: 10129, 7710; Payload ID: 9540 relates to Category No.: 14663, 16197, 2540, 16234, 16275, 5540, 8023, 8117, 8524; Payload ID: 9543 relates to Category No.: 12194, 11940, 12195, 13882, 2083, 7122, 7016, 7046, 2275, 7036, 9499, 496, 13874, 1889, 13771; Payload ID: 9544 relates to Category No.: 12194, 12128, 12099, 11950, 7016, 9762, 12862, 13969; Payload ID: 9545 relates to Category No.: 12194; Payload ID: 9546 relates to Category No.: 12194; Payload ID: 9547 relates to Category No.: 12194; Payload ID: 9554 relates to Category No.: 6814, 390, 15660, 6310, 1867, 14663, 6305; Payload ID: 9555 relates to Category No.: 5939, 9632, 5936; Payload ID: 9556 relates to Category No.: 6219, 12427, 3639, 9950, 2359, 6253, 14663, 2353, 16189, 14086, 10005, 16211, 5752, 11558, 13302, 6335, 2354, 2355, 6250, 12697; Payload ID: 9557 relates to Category No.: 15626, 12427, 11371, 2355, 2353, 12428, 11316, 12409, 13342, 12841, 665, 10425; Payload ID: 9560 relates to Category No.: 12427, 13372; Payload ID: 9561 relates to Category No.: 7737, 8756, 7942, 8439, 8628; Payload ID: 9562 relates to Category No.: 12427, 12459, 8831, 6256, 14086, 10005, 16211, 757, 8635, 10422, 12700, 790, 8480, 10914, 13306, 1147, 11987, 496, 8373, 1780, 6253, 2243, 8378, 11295; Payload ID: 9563 relates to Category No.: 3639; Payload ID: 9564 relates to Category No.: 13812, 14009, 13867, 13936, 7315, 14048, 13883; Payload ID: 9565 relates to Category No.: 14565, 12427, 3639, 12936; Payload ID: 9566 relates to Category No.: 12137, 5406, 12427; Payload ID: 9567 relates to Category No.: 6219, 3639, 11930, 1483, 14663, 14972, 16287, 14086, 10005, 16211, 16222, 12427, 16136, 4949, 4251, 1780, 756, 2705, 16234; Payload ID: 9568 relates to Category No.: 12427; Payload ID: 9569 relates to Category No.: 3639, 1483, 15143, 7693, 4021, 3041, 16287, 5949, 14617, 6192, 8420, 7640, 15146, 11935, 11654, 11724, 11223, 4937, 11178, 3445, 672, 16286, 3578, 13371, 11997, 12405, 3595, 9321, 8831, 12213, 11376; Payload ID: 9570 relates to Category No.: 11512, 3639, 16286, 10372, 1483, 8421, 11506, 3398, 12544, 8541, 455, 10314, 1274, 16287, 9454, 13005, 10606, 2353, 14059, 11033, 10983, 4533, 1270, 12583, 14064, 14782, 4419, 1758, 724, 2355, 11363, 12498, 3578, 1276, 6194, 6560, 11148, 1269, 1313, 16095, 14061, 675, 802, 12554, 1819, 4025, 14565; Payload ID: 9572 relates to Category No.: 11512, 15149, 16286, 9321, 1483, 16289, 11506, 3398, 2243, 7693, 8541, 10314, 4067, 11363, 16287, 8522, 8887, 9723, 3604, 2238, 15325, 6995, 6997, 4006, 9540, 2651, 3608, 15478, 11740, 12428, 1014, 8535, 15471, 1497, 10349, 8873, 8866, 8632, 1488, 1933, 11622; Payload ID: 9573 relates to Category No.: 12194, 6219, 14565, 2885, 12427, 8739, 3639, 7191, 11296, 1238, 12449, 10459, 11178, 14086, 10005, 16211, 10503, 10493, 639, 11265, 5073, 6082, 13827, 1993, 2243, 1933; Payload ID: 9574 relates to Category No.: 11926, 12427, 16172, 8507, 4027, 8814, 7648; Payload ID: 9575 relates to Category No.: 3691, 1204; Payload ID: 9579 relates to Category No.: 7306, 13618; Payload ID: 9580 relates to Category No.: 7288, 14271, 4439, 3996, 9223, 3001, 3000, 14271, 16183, 5219, 14949, 8375; Payload ID: 9581 relates to Category No.: 15517, 14271, 15291, 4439, 10637, 7261, 5220; Payload ID: 9582 relates to Category No.: 15517, 15291, 4439, 10637, 7261, 5220, 7262; Payload ID: 9584 relates to Category No.: 7306, 13618, 2904; Payload ID: 9585 relates to Category No.: 7288, 7291, 16182, 14271, 4439, 3996, 9223, 3001; Payload ID: 9586 relates to Category No.: 7288, 7291, 16182, 9223, 4439, 3996, 9223, 3001, 2904; Payload ID: 9587 relates to Category No.: 14271, 14915, 9223, 4439, 3996, 9223, 3001, 14913, 2904, 7131, 10491, 14267; Payload ID: 9588 relates to Category No.: 7288, 7291, 16182, 9223, 4439, 3996, 9223, 3001; Payload ID: 9589 relates to Category No.: 15715, 7291, 16182, 14271, 4439, 3996, 9223, 3001, 6636; Payload ID: 9590 relates to Category No.: 14267, 7291, 16182, 4439, 3996, 9223, 3001; Payload ID: 9591 relates to Category No.: 7291, 16182; Payload ID: 9593 relates to Category No.: 7290, 8666; Payload ID: 9594 relates to Category No.: 7290; Payload ID: 9595 relates to Category No.: 14271, 7290; Payload ID: 9596 relates to Category No.: 1512, 16214, 14663, 4021, 2571, 4723, 5930, 5932, 5931, 11512, 11543, 13969, 13865, 1622; Payload ID: 9597 relates to Category No.: 14565, 1816, 1893, 6530, 9637, 11760; Payload ID: 9598 relates to Category No.: 4828, 2562, 434, 328, 5268, 16041, 14838, 1988, 6530, 4138, 4828, 2745, 9932, 9491, 6394, 10313, 6523, 10798; Payload ID: 9603 relates to Category No.: 1820; Payload ID: 9605 relates to Category No.: 1820; Payload ID: 9610 relates to Category No.: 15626, 1512, 5291, 1703, 674, 1820, 14663, 5290, 4723, 14050, 7252, 14565, 4722; Payload ID: 9611 relates to Category No.: 13594, 13589, 3398, 15490, 3398, 1060, 11506, 3398, 1248, 3023; Payload ID: 9612 relates to Category No.: 1703, 6412, 14013; Payload ID: 9613 relates to Category No.: 1795, 5406, 472, 9408, 9111, 3787, 16133; Payload ID: 9614 relates to Category No.: 1204; Payload ID: 9620 relates to Category No.: 8862, 9410; Payload ID: 9622 relates to Category No.: 5367, 5428, 3639; Payload ID: 9623 relates to Category No.: 5428, 795, 5446, 5285, 1780, 10917; Payload ID: 9624 relates to Category No.: 1703; Payload ID: 9625 relates to Category No.: 5428, 795, 5446, 5359, 1795, 7362, 11765, 13925, 15456, 15450, 7363, 15448, 6248, 3141, 11566, 15446, 15653, 15457, 15458, 4039, 336, 1849, 10917, 2041; Payload ID: 9626 relates to Category No.: 1752, 15186, 280, 4020, 11976, 11213, 13032, 9411; Payload ID: 9627 relates to Category No.: 5367, 5785, 15207, 10074, 15614, 5446, 4127, 1238, 11265, 2883, 6612; Payload ID: 9628 relates to Category No.: 10981, 1687, 579, 10372, 11155; Payload ID: 9629 relates to Category No.: 5367, 5785, 403, 5407, 1053, 8677, 6408, 5387, 749; Payload ID: 9630 relates to Category No.: 11077, 1795, 8677, 8148; Payload ID: 9631 relates to Category No.: 14565, 7252, 1849, 2311, 3012; Payload ID: 9632 relates to Category No.: 11512, 1713, 7613, 14967, 16286, 10372, 8731, 3398, 1483, 15517, 1948, 1066, 11506, 3398, 4446, 1257, 7693, 7840, 10366, 14928, 10648, 5146, 5334, 9600, 8869, 14793, 3812, 13519, 3070, 4259, 4255, 4257, 4278, 3595, 6559, 575, 4064, 9585, 7341, 4067, 801, 2393, 15481, 9319, 9540, 10362, 10690, 5182, 7750, 7879, 10180, 10379, 10578, 9455, 10355, 2020, 8143, 8156, 9003, 7956, 8154, 15327, 10374, 7614, 8739, 13594, 15459, 13681, 1729, 5073, 9321, 14459, 16095, 12650, 8666, 15208, 675, 802, 1703, 13969, 14643, 13927, 5949, 9411; Payload ID: 9633 relates to Category No.: 16160, 14586, 16167, 5376; Payload ID: 9634 relates to Category No.: 5367; Payload ID: 9635 relates to Category No.: 5367, 14565, 1816, 15782, 10828; Payload ID: 9636 relates to Category No.: 5367, 14565, 5428, 795, 7306, 10775, 12646, 16197, 15782, 13925, 10878, 2051, 10600, 7377; Payload ID: 9637 relates to Category No.: 12091, 1026, 14565, 9720, 3766, 10074, 15614, 9717, 5446, 10372, 403, 1955, 14569, 3854, 7743, 7946, 1061, 4127, 13110, 4130, 8936, 16197, 14992, 8721, 8723, 1238, 13874, 11858, 2088, 4124, 10080, 12528, 7644, 12532, 8263, 13320, 3049, 10497, 12737, 6145, 6248, 8535, 15192, 12832, 2110, 5911, 12615, 13371, 13107, 11094, 8255, 10386, 8106, 15439, 5373, 4123, 11580, 12833, 11420, 10963, 13177, 8171, 1070, 11178, 5785, 11186, 10366, 4998, 10267, 12999, 13408, 12740, 8351, 13969, 14025, 13888, 13827, 13773, 13981, 2883, 13799, 1995, 13787, 9349, 10652, 1968, 11201, 11139, 5081, 14012, 10613; Payload ID: 9640 relates to Category No.: 14663; Payload ID: 9644 relates to Category No.: 13594, 13589, 3398, 15490, 3398, 14661, 11512, 9500, 2139, 8739, 8731, 3398, 2410, 1238, 12786, 7333, 11363, 8611, 7879, 8507, 12666, 7883, 14566, 8178, 11906, 5164, 10757, 5157, 1978, 5406, 8081, 1780, 10034, 11414, 11084, 10586, 10761, 4844, 10968, 8080, 13331; Payload ID: 9645 relates to Category No.: 9500, 13589, 3398, 15490, 3398, 7306, 2410, 5157, 12892, 12772, 3339; Payload ID: 9646 relates to Category No.: 13589, 3398, 15490, 3398, 9500, 2410, 3453, 5152, 5406, 7303, 8887, 10648, 7613, 8004, 4952, 8929, 10757, 8900, 6902; Payload ID: 9647 relates to Category No.: 15490, 3398, 9500, 8739, 14838, 8373, 2410, 6995, 5066, 5125, 5152, 5134, 3573, 8367, 6080, 4251, 7000, 4287, 15365, 5444, 10362, 11413; Payload ID: 9648 relates to Category No.: 15490, 3398, 9500, 687, 11506, 3398, 5268, 2410, 5164, 4265, 11512, 12891, 14838, 8081, 13509, 13507, 14837, 5165, 6530, 13882, 10648; Payload ID: 9649 relates to Category No.: 13589, 3398, 15490, 3398, 9500, 2409, 2410, 13807; Payload ID: 9650 relates to Category No.: 15490, 3398, 9500, 8731, 3398, 3354, 3448, 2410, 7635, 16197, 8004, 5125, 5152, 1565, 8082; Payload ID: 9651 relates to Category No.: 5152, 8082, 5164, 13589, 3398, 15490, 3398, 9500, 3354, 2409, 3448, 2410; Payload ID: 9652 relates to Category No.: 13594, 15490, 3398, 14661, 9500, 10372, 2410, 5164; Payload ID: 9653 relates to Category No.: 13589, 3398, 15490, 3398, 9500, 3452, 2410, 2022, 13371, 5164, 10534, 10432; Payload ID: 9654 relates to Category No.: 13589, 3398, 15490, 3398, 9500, 2409, 1955, 8082; Payload ID: 9655 relates to Category No.: 9500, 2467, 15517, 7306, 2409, 11506, 3398, 2410, 8073, 8739, 5157, 14838, 6530; Payload ID: 9656 relates to Category No.: 15490, 3398, 9500, 2410, 14123, 5157, 5157, 15670, 11634, 8731, 3398, 10648, 10953, 6552, 14586, 1313, 16042, 12844, 1970, 13853, 6114; Payload ID: 9657 relates to Category No.: 15490, 3398, 9500, 8731, 3398, 2410, 14123, 5157; Payload ID: 9658 relates to Category No.: 9500, 2410, 5157, 15189; Payload ID: 9659 relates to Category No.: 9500, 5149, 5159, 2410, 5406, 7303, 12891, 14791, 8887, 10648, 1598, 4949, 4953, 1483, 3602, 13758, 8888, 9131, 6799; Payload ID: 9660 relates to Category No.: 11512, 9500, 2410, 3711, 6799, 1557, 12891, 1741, 2001, 5125, 5149, 13767, 5073, 13853, 5429; Payload ID: 9661 relates to Category No.: 15490, 3398, 9500, 5149, 2410, 6995, 5164, 5152, 5186, 11506, 3398; Payload ID: 9662 relates to Category No.: 15490, 3398, 9500, 11506, 3398, 4336, 5152; Payload ID: 9663 relates to Category No.: 13589, 3398, 11512, 795, 2467, 15517, 11506, 3398, 5159, 2410, 11884, 5185, 11557, 12977, 10745, 5160, 3592, 12971, 10396, 5243, 11634, 724, 12891, 16213, 7743, 3337, 14910, 3023, 4004, 2562, 9694, 12976, 13921, 5158, 13464, 12972, 13988, 6723; Payload ID: 9664 relates to Category No.: 13589, 3398, 15490, 3398, 5159, 2410, 2416, 4440, 5160, 9485, 6758, 5202, 12976, 9376, 9489; Payload ID: 9665 relates to Category No.: 13589, 3398, 15490, 3398, 5785, 5159, 2410, 7303, 12891, 10626, 14586, 4065, 6902; Payload ID: 9666 relates to Category No.: 13589, 3398, 15490, 3398, 11512, 10372, 5159, 2410, 2412, 9379, 9377, 10860, 13836, 5406, 12891, 6902; Payload ID: 9667 relates to Category No.: 15490, 3398, 1722, 3854, 11506, 3398, 5159, 3337, 2410, 14083, 10690, 8996, 2110, 9006; Payload ID: 9668 relates to Category No.: 7131; Payload ID: 9674 relates to Category No.: 6814, 1592, 7306, 15660, 9945, 1867, 14663, 4653, 9819, 1694; Payload ID: 9675 relates to Category No.: 4828, 1713, 12648, 10775, 439, 10486, 10955, 11418, 8378, 355, 10487, 11339, 345, 1232, 1295, 10238, 7688, 8906, 7369, 2235, 10501, 10356, 9349, 9396, 2084, 11388, 2708, 1896; Payload ID: 9676 relates to Category No.: 4828, 10486, 355, 345, 10955, 11339; Payload ID: 9677 relates to Category No.: 4828, 15149, 4828, 2745, 10486, 345, 10955, 1232, 10448, 10487, 10301; Payload ID: 9678 relates to Category No.: 4828; Payload ID: 9679 relates to Category No.: 4828, 1204; Payload ID: 9680 relates to Category No.: 4828; Payload ID: 9681 relates to Category No.: 6814, 9940, 15660, 9945, 1867, 14663, 4653, 9819, 9839, 9823, 14056, 15121, 11243, 8455; Payload ID: 9682 relates to Category No.: 6814, 9945, 14663, 6738, 4653, 9823, 10070; Payload ID: 9683 relates to Category No.: 9945, 14663, 4653, 9895, 9823, 9833, 13316, 6814; Payload ID: 9684 relates to Category No.: 6814, 15660, 9945, 1867, 14663, 4653, 9819, 9839, 9895, 9823, 9833; Payload ID: 9685 relates to Category No.: 6814, 9945, 1204, 14663, 4653, 9839; Payload ID: 9686 relates to Category No.: 13248, 4110, 14663, 11909, 9053, 8037, 6814; Payload ID: 9687 relates to Category No.: 4110, 11909, 6814; Payload ID: 9688 relates to Category No.: 1204, 11909, 8037; Payload ID: 9689 relates to Category No.: 15626; Payload ID: 9690 relates to Category No.: 15626; Payload ID: 9691 relates to Category No.: 15626; Payload ID: 9692 relates to Category No.: 3021, 3013, 6713, 6138, 10025, 3700, 7540, 6622, 3019, 13827, 1238, 9945, 6986, 6445, 11072, 14406, 9006, 15201, 10023, 9944; Payload ID: 9693 relates to Category No.: 12117, 4851, 16189, 11077, 11075, 4772, 3908, 13275, 1002, 996; Payload ID: 9694 relates to Category No.: 10074, 1238, 12117, 10080, 2274; Payload ID: 9695 relates to Category No.: 403, 1780; Payload ID: 9697 relates to Category No.: 5428, 3013, 2888, 1893, 14057, 6814; Payload ID: 9698 relates to Category No.: 9655, 1800; Payload ID: 9699 relates to Category No.: 9655, 1800; Payload ID: 9700 relates to Category No.: 6814; Payload ID: 9701 relates to Category No.: 6814; Payload ID: 9702 relates to Category No.: 6814; Payload ID: 9703 relates to Category No.: 6814; Payload ID: 9704 relates to Category No.: 9500, 1894, 4021, 1240, 4949, 2571, 6375, 756, 3550, 16294, 13874, 13827, 14011; Payload ID: 9705 relates to Category No.: 9500, 4021, 11899, 13925, 756; Payload ID: 9706 relates to Category No.: 15490, 3398, 9500, 1703, 12427, 1894, 8731, 3398, 14928, 13882, 5217, 3812, 2571, 3713, 3715, 13813, 496, 10429, 11899; Payload ID: 9707 relates to Category No.: 9500, 12427, 8731, 3398, 3812; Payload ID: 9708 relates to Category No.: 9500, 12427; Payload ID: 9709 relates to Category No.: 15715, 4439, 16197, 15698, 6447, 3223; Payload ID: 9710 relates to Category No.: 5446, 3021, 2812, 339, 11573, 10491, 1967; Payload ID: 9712 relates to Category No.: 674, 1463, 10372; Payload ID: 9713 relates to Category No.: 8862, 4057, 1463, 10372, 3569; Payload ID: 9715 relates to Category No.: 1955, 12246, 11898; Payload ID: 9716 relates to Category No.: 1955, 12246, 11898, 1295; Payload ID: 9717 relates to Category No.: 1737, 1721, 1703, 13166, 3856, 8348, 2940, 3853, 3746; Payload ID: 9719 relates to Category No.: 5428, 7613, 7725, 1533, 5446, 10266, 1795, 10175, 1780, 11174, 11178, 10583, 8004, 11201, 11802, 10626, 13096, 7883, 14566, 8178, 10478, 7723, 11942, 11264, 12646, 10917, 11285, 10954, 8348, 8264, 1709, 3313, 14566, 10413, 7765, 11232, 11060, 10243; Payload ID: 9720 relates to Category No.: 12427, 5446, 1795, 9597, 3639, 790; Payload ID: 9721 relates to Category No.: 12427, 2359, 10946, 10426, 10053, 6256, 2079; Payload ID: 9722 relates to Category No.: 12194, 10648, 3566, 6559, 13098, 10953, 13048, 6552, 7936, 14838, 14831; Payload ID: 9723 relates to Category No.: 12091, 14565, 14038, 9720, 15614, 5446, 10372, 3012, 14586, 10954, 11266, 7252, 6465; Payload ID: 9724 relates to Category No.: 1737, 14661, 7154, 7134, 7132, 7163, 13139, 15400, 8688, 13167; Payload ID: 9725 relates to Category No.: 1737, 14661, 7613, 7134, 7132, 670, 13644, 7163, 8797, 8318, 8508, 11029, 7609; Payload ID: 9726 relates to Category No.: 1737, 15490, 3398, 8739, 12633, 3354, 11506, 3398, 7154, 286, 3852, 3448, 7693, 7163, 8753, 11174, 8611, 15605, 8508, 7942, 8732, 7752, 7609, 3313, 14578; Payload ID: 9727 relates to Category No.: 7134, 12848; Payload ID: 9728 relates to Category No.: 1730, 8731, 3398, 7306, 14838, 4439, 4442, 10031, 3339, 6532, 8739, 1955, 7613, 8004, 15144, 5808, 13271, 4167, 1764; Payload ID: 9738 relates to Category No.: 15490, 3398, 8749, 15512; Payload ID: 9739 relates to Category No.: 13589, 3398, 15490, 3398; Payload ID: 9741 relates to Category No.: 1790, 15618, 2562, 12062, 12063, 1893, 6482, 6480, 11660; Payload ID: 9742 relates to Category No.: 9718; Payload ID: 9743 relates to Category No.: 7288, 14271, 7295, 9223, 9103; Payload ID: 9744 relates to Category No.: 15517, 7291, 16182, 14271, 15291, 4439, 12484, 16182, 13618, 7280, 7261, 9223, 9103; Payload ID: 9745 relates to Category No.: 3699, 12058, 7692, 8040, 12096, 6814; Payload ID: 9746 relates to Category No.: 15618; Payload ID: 9747 relates to Category No.: 15618, 15626, 795, 14767, 15304; Payload ID: 9748 relates to Category No.: 1204; Payload ID: 9749 relates to Category No.: 15626; Payload ID: 9750 relates to Category No.: 15618, 4115, 15535, 3868, 6228, 9950; Payload ID: 9751 relates to Category No.: 15626; Payload ID: 9752 relates to Category No.: 15618, 15626, 12197; Payload ID: 9753 relates to Category No.: 15618; Payload ID: 9754 relates to Category No.: 7195, 15618; Payload ID: 9755 relates to Category No.: 15618; Payload ID: 9757 relates to Category No.: 15618; Payload ID: 9758 relates to Category No.: 15618, 6445; Payload ID: 9759 relates to Category No.: 15618; Payload ID: 9760 relates to Category No.: 5367, 2885, 746, 738, 736, 12994, 16197, 742, 15223, 742, 729, 3016, 10814, 5610, 15817, 11456, 11451, 12750, 742, 15224, 739, 15224, 10340, 579, 10980, 10340, 572; Payload ID: 9761 relates to Category No.: 5367, 736, 2885, 5446, 746, 12994, 16197, 742, 15223, 742, 5610, 15817, 742, 15224; Payload ID: 9762 relates to Category No.: 5367, 736, 2885, 746, 12994, 16197, 742, 15223, 742, 5610, 15817, 742, 15224; Payload ID: 9763 relates to Category No.: 5367, 746; Payload ID: 9764 relates to Category No.: 5367, 746, 2885, 12994, 742, 15223, 742, 5610, 15817, 742, 15224; Payload ID: 9765 relates to Category No.: 5367, 746, 2885, 12994, 742, 15223, 742, 10829, 5610, 15817, 1849, 8688, 742, 15224, 8106, 11319, 11492, 11462, 5371, 7869; Payload ID: 9766 relates to Category No.: 5367, 748, 736, 743, 9624; Payload ID: 9767 relates to Category No.: 5367, 748, 736, 11460, 743, 11446, 9624, 6943; Payload ID: 9768 relates to Category No.: 5367, 14565, 736, 743, 7606; Payload ID: 9769 relates to Category No.: 5367, 14565, 736, 743, 7606; Payload ID: 9770 relates to Category No.: 5367, 15207, 2885, 736, 2013, 11460, 743, 10814, 15192, 5610, 11445; Payload ID: 9771 relates to Category No.: 5367, 15207, 2885, 736, 11460, 743, 10814, 15192, 5610, 11445; Payload ID: 9772 relates to Category No.: 5367, 15207, 2885, 736, 743, 15192, 5610, 748; Payload ID: 9773 relates to Category No.: 5367, 15207, 2885, 736, 743, 15192, 5610, 748; Payload ID: 9774 relates to Category No.: 5367, 748, 736, 15207, 2885, 743, 15192, 5610, 5384, 5286; Payload ID: 9775 relates to Category No.: 5367, 15207, 2885, 736, 743, 15192, 5610, 748; Payload ID: 9776 relates to Category No.: 5367, 748, 736; Payload ID: 9777 relates to Category No.: 5367, 15207, 2885, 736, 743, 15192, 5610, 9624, 5384, 5286, 748; Payload ID: 9778 relates to Category No.: 5367, 736, 748; Payload ID: 9779 relates to Category No.: 5367, 15207, 2885, 736, 743, 15192, 5610; Payload ID: 9780 relates to Category No.: 5367, 15207, 2885, 736, 743, 15192, 5610; Payload ID: 9781 relates to Category No.: 5367, 14565, 5446, 746, 3015, 2879, 5616, 5650; Payload ID: 9782 relates to Category No.: 15618, 15626, 5846, 2164, 4636, 14014, 16274, 16214, 6111, 1479; Payload ID: 9783 relates to Category No.: 12137, 7295, 8546, 8506, 3838, 8619; Payload ID: 9785 relates to Category No.: 12096; Payload ID: 9786 relates to Category No.: 12153, 1204; Payload ID: 9787 relates to Category No.: 12153; Payload ID: 9788 relates to Category No.: 15618, 795, 1730, 2169, 7369, 780, 6747, 10602; Payload ID: 9790 relates to Category No.: 2353; Payload ID: 9791 relates to Category No.: 9500, 1512, 1533, 15642, 4521, 14663, 4538, 6518, 7131, 10491, 7476, 9498, 7505; Payload ID: 9792 relates to Category No.: 9500, 1512, 15642, 6518; Payload ID: 9793 relates to Category No.: 9500, 1512, 1533, 15642, 4521, 1874, 14663, 4538, 6518, 5741, 9498, 7505; Payload ID: 9794 relates to Category No.: 12091, 13589, 3398, 15490, 3398, 12619, 1730, 7306, 9994, 14838, 11858; Payload ID: 9795 relates to Category No.: 11926, 12063, 1893, 11660; Payload ID: 9796 relates to Category No.: 1730, 14838, 6530; Payload ID: 9797 relates to Category No.: 2410, 5185; Payload ID: 9798 relates to Category No.: 12153, 2410, 5185; Payload ID: 9799 relates to Category No.: 15490, 3398, 2411, 2410, 5113, 2412, 5185, 5131, 13589, 3398, 2409; Payload ID: 9800 relates to Category No.: 9500, 1512, 7511, 1867, 14663, 13874, 6518, 13212, 13799, 12133; Payload ID: 9801 relates to Category No.: 9500, 6518, 13212; Payload ID: 9802 relates to Category No.: 9500, 6518, 486, 12338, 9526; Payload ID: 9803 relates to Category No.: 14661; Payload ID: 9804 relates to Category No.: 13589, 3398, 15490, 3398, 1721, 10372, 4279, 1955, 12936, 5858, 14178; Payload ID: 9805 relates to Category No.: 6814, 4104; Payload ID: 9806 relates to Category No.: 4104, 1867, 14663, 13909, 12913, 226, 10611, 6546; Payload ID: 9807 relates to Category No.: 12194, 15207, 12153, 7613, 5446, 11109, 12498, 10775, 4127, 3012, 14992, 11298, 352, 12066, 11445, 11451, 10840, 9169, 1053, 15203, 13854, 13947, 13563, 1071; Payload ID: 9808 relates to Category No.: 1512, 14663, 10158, 6550, 14939; Payload ID: 9809 relates to Category No.: 1512; Payload ID: 9810 relates to Category No.: 2353, 7652; Payload ID: 9812 relates to Category No.: 12137; Payload ID: 9813 relates to Category No.: 1295, 8934, 14882, 2250; Payload ID: 9814 relates to Category No.: 14886, 9599; Payload ID: 9815 relates to Category No.: 12194, 12427, 5446, 2610, 2610, 6104, 7823; Payload ID: 9816 relates to Category No.: 12194, 5446, 2610, 2610, 2488, 2610, 6104; Payload ID: 9817 relates to Category No.: 1512, 4435, 12063, 1893, 3405, 11660, 6585; Payload ID: 9818 relates to Category No.: 12427, 16189, 14565, 2020, 2041, 2013; Payload ID: 9819 relates to Category No.: 3639, 2569, 9455; Payload ID: 9820 relates to Category No.: 6587, 14565, 12427, 3699; Payload ID: 9821 relates to Category No.: 13975, 5446, 381, 2610, 3013, 2610, 2488, 3016, 2610, 6104, 9391, 8819, 8045, 11182, 5953; Payload ID: 9822 relates to Category No.: 15626, 11926, 3405, 9357; Payload ID: 9823 relates to Category No.: 9020, 12063, 1893, 11660; Payload ID: 9824 relates to Category No.: 9020, 12063, 1893, 11660, 4715, 13756, 6371, 6814; Payload ID: 9825 relates to Category No.: 11926, 3837, 12062, 9020, 12063, 1893, 11660, 9359, 4714, 6588, 15672, 11852, 3672, 6814; Payload ID: 9826 relates to Category No.: 12062, 9020, 12063, 1893, 11660, 6814; Payload ID: 9827 relates to Category No.: 1512, 6584, 9020, 12063, 1893, 11660, 11903, 14059, 5406, 6269, 7122, 11087, 13756, 6371, 16068; Payload ID: 9828 relates to Category No.: 1512, 6584, 9020, 12063, 1893, 11660, 11903; Payload ID: 9829 relates to Category No.: 1512, 1894, 6584, 11903, 6103; Payload ID: 9830 relates to Category No.: 1512, 6584, 11903; Payload ID: 9831 relates to Category No.: 1512, 6584, 11903; Payload ID: 9832 relates to Category No.: 1512, 1894, 4712, 6580; Payload ID: 9834 relates to Category No.: 12063, 1893, 11660; Payload ID: 9835 relates to Category No.: 6814; Payload ID: 9836 relates to Category No.: 1512, 11930, 12063, 1893, 11660, 5406, 15948; Payload ID: 9837 relates to Category No.: 1512, 9020, 12063, 1893, 11660, 12062; Payload ID: 9838 relates to Category No.: 1512, 9020, 12063, 1893, 11660, 12062; Payload ID: 9839 relates to Category No.: 12062, 12063, 1893, 11660, 9359, 9357; Payload ID: 9840 relates to Category No.: 12063, 1893, 11660, 12062; Payload ID: 9841 relates to Category No.: 12062; Payload ID: 9842 relates to Category No.: 12062, 12063, 1893, 11660, 1483, 7443; Payload ID: 9843 relates to Category No.: 11926, 12062, 12063, 1893, 11660, 6814; Payload ID: 9846 relates to Category No.: 12091, 11858, 5785, 9713, 4186, 13618, 4040, 13622; Payload ID: 9847 relates to Category No.: 9713, 11858, 12091, 5785, 795, 4998, 1795, 13618, 1911, 4040; Payload ID: 9848 relates to Category No.: 12091, 5785, 16286, 2940, 8934, 6969; Payload ID: 9849 relates to Category No.: 12091, 5785, 16286, 12526, 12746, 7129, 3926, 3871, 360, 11858, 9716, 8934, 11094, 7120; Payload ID: 9850 relates to Category No.: 12091, 1026, 14661, 5446, 6606, 348, 4186, 12391, 4127, 3775, 5541, 16085, 8988, 9982; Payload ID: 9851 relates to Category No.: 12091, 8862, 6969, 9420, 6967, 11227, 16286, 10372, 4336, 4332; Payload ID: 9852 relates to Category No.: 2410, 5146, 7834, 5408; Payload ID: 9854 relates to Category No.: 6969, 8300, 9141; Payload ID: 9855 relates to Category No.: 6969; Payload ID: 9856 relates to Category No.: 6969; Payload ID: 9857 relates to Category No.: 6969, 6980; Payload ID: 9858 relates to Category No.: 10702, 12619, 12498, 345, 1795, 3974, 15782, 12858, 13635, 13391, 12856, 7618; Payload ID: 9859 relates to Category No.: 10372; Payload ID: 9860 relates to Category No.: 795, 10372, 12646, 5573, 12531, 8024, 10783; Payload ID: 9861 relates to Category No.: 1780, 6687, 5024, 2334, 13969, 9411, 1995, 5291, 3336; Payload ID: 9862 relates to Category No.: 1721; Payload ID: 9863 relates to Category No.: 14456, 1183, 1814, 3876; Payload ID: 9864 relates to Category No.: 1183, 1814, 8192, 13973, 7939, 7938, 12004; Payload ID: 9865 relates to Category No.: 4828; Payload ID: 9866 relates to Category No.: 4828, 674, 702, 1780, 11986, 352, 12999, 14838, 6530, 10372, 13827, 13767, 13863, 10522, 13981, 5073, 2088, 8535, 10797; Payload ID: 9867 relates to Category No.: 4828; Payload ID: 9868 relates to Category No.: 4828, 11294; Payload ID: 9869 relates to Category No.: 4828; Payload ID: 9870 relates to Category No.: 4828; Payload ID: 9871 relates to Category No.: 4828, 381; Payload ID: 9872 relates to Category No.: 4828, 14454, 10481, 6612, 6615, 14646; Payload ID: 9873 relates to Category No.: 4828; Payload ID: 9874 relates to Category No.: 4828; Payload ID: 9875 relates to Category No.: 6615, 8257; Payload ID: 9877 relates to Category No.: 15490, 3398, 6530, 13594; Payload ID: 9878 relates to Category No.: 12091, 11512, 15521, 9125, 4439, 11069, 976, 974, 11534, 11053, 7381; Payload ID: 9879 relates to Category No.: 11512, 15521, 9125, 4439; Payload ID: 9880 relates to Category No.: 11512, 15521, 9125, 4439; Payload ID: 9881 relates to Category No.: 12091, 5785, 9720, 795, 4998, 10238, 1780, 4336, 11858, 8885, 5814; Payload ID: 9882 relates to Category No.: 11884, 4021, 2376, 12553, 4883; Payload ID: 9883 relates to Category No.: 1204, 8934, 1026, 8936, 4478, 3042, 13787; Payload ID: 9884 relates to Category No.: 14640, 4021; Payload ID: 9885 relates to Category No.: 4021, 13787; Payload ID: 9886 relates to Category No.: 11658; Payload ID: 9887 relates to Category No.: 11658; Payload ID: 9888 relates to Category No.: 14640, 1206, 7664, 12554; Payload ID: 9889 relates to Category No.: 1730, 12553, 9451, 1621; Payload ID: 9890 relates to Category No.: 12194, 1893, 4020, 16197, 4021, 2569, 1238, 6145, 11282; Payload ID: 9891 relates to Category No.: 12194, 4020, 4021, 2569, 12638; Payload ID: 9892 relates to Category No.: 12194, 7306, 4020, 4021, 2569, 2571, 1093, 7971; Payload ID: 9893 relates to Category No.: 12194, 10577, 4020, 4021, 2569, 16294, 14927, 13969, 13827, 10574; Payload ID: 9894 relates to Category No.: 12194, 4020, 4021, 2569, 1274, 1272, 3631, 1622, 4885, 1893, 9451, 13882, 13936, 13827, 13836, 9631, 9455, 4949, 3940, 9590, 6395, 1971, 3594, 11166; Payload ID: 9895 relates to Category No.: 12194, 10265, 10366, 4020, 4021, 2569, 10362, 8402, 3643, 11069, 1752, 6375, 3631, 16342, 9451, 3575, 1320, 2379, 1269, 2756, 6530, 13969, 13882, 13936, 13874, 13836, 13975, 690, 3715, 11169, 9485, 906, 7992, 15428; Payload ID: 9896 relates to Category No.: 12194, 10331, 1894, 4020, 4021, 2569, 3643, 13835; Payload ID: 9897 relates to Category No.: 12194, 10331, 4020, 4021, 3631, 9451, 3575, 2569, 2379, 1269, 2756; Payload ID: 9898 relates to Category No.: 12194, 10331, 5428; Payload ID: 9899 relates to Category No.: 12194, 690, 1730, 4020, 4021, 2569, 13874, 13797, 6395, 9485, 9492; Payload ID: 9900 relates to Category No.: 12194, 690, 1026, 3766, 1893, 4020, 4021, 2569, 3643, 1906, 13882, 3566, 14641, 1248, 5802, 10794, 4067, 1278; Payload ID: 9901 relates to Category No.: 12194, 4020, 4021, 2569, 12795, 11878, 609; Payload ID: 9902 relates to Category No.: 12194, 3176, 4969, 2705; Payload ID: 9903 relates to Category No.: 12194, 13736; Payload ID: 9904 relates to Category No.: 12194, 10331, 1804, 8954, 4475, 1807, 3161; Payload ID: 9905 relates to Category No.: 12194, 5428, 4943; Payload ID: 9906 relates to Category No.: 12194, 8112, 2569; Payload ID: 9907 relates to Category No.: 12194, 2569; Payload ID: 9908 relates to Category No.: 12194, 8245; Payload ID: 9909 relates to Category No.: 12194, 4020, 4021, 2569, 11282, 8094, 2070, 11157, 12638, 1906; Payload ID: 9910 relates to Category No.: 12194, 4020, 4021, 2569, 12646, 3013, 3015, 13827, 3016, 732, 730, 13967, 496, 2051, 6626, 3940; Payload ID:

9911 relates to Category No.: 12194, 4020, 4021, 2569, 3643; Payload ID: 9912 relates to Category No.: 12194, 1026, 8175, 3766, 7613, 11285, 4020, 4021, 2569, 9451, 6145, 11322, 10882, 10513, 10567, 7713, 3643, 6468, 11309, 7841, 10238, 14640, 3566; Payload ID: 9913 relates to Category No.: 1204; Payload ID: 9915 relates to Category No.: 3880; Payload ID: 9916 relates to Category No.: 1780; Payload ID: 9917 relates to Category No.: 7306; Payload ID: 9918 relates to Category No.: 1737, 7132, 6500; Payload ID: 9919 relates to Category No.: 15490, 3398, 8739, 7306, 1780; Payload ID: 9920 relates to Category No.: 15490, 3398, 8731, 3398; Payload ID: 9921 relates to Category No.: 15490, 3398, 8739, 7743, 8731, 3398; Payload ID: 9922 relates to Category No.: 15490, 3398, 7743, 2911, 8739, 13589, 3398; Payload ID: 9923 relates to Category No.: 8739, 15517, 7306, 7743, 13589, 3398, 12619, 7618, 1709; Payload ID: 9924 relates to Category No.: 13589, 3398, 15490, 3398, 2409, 3612; Payload ID: 9925 relates to Category No.: 14661, 5785, 10702, 13435, 10238, 803, 13485, 8988, 3038; Payload ID: 9926 relates to Category No.: 14661, 5785, 10702, 13435, 10238, 803, 13485, 8988, 11512, 14108; Payload ID: 9927 relates to Category No.: 10702, 13435; Payload ID: 9928 relates to Category No.: 11926, 4949, 14455, 9994, 16214, 2460, 1296, 2459, 2243, 6714, 4094, 3176, 5788, 14729, 14834, 4952, 3147, 4789, 5073, 12716, 2653, 10020, 15016, 7620, 8049, 8004, 11051, 16102, 1622, 13515, 7567, 9099, 2275, 7658, 4066, 861, 6119, 13917; Payload ID: 9929 relates to Category No.: 14056; Payload ID: 9930 relates to Category No.: 1722, 12023, 7743, 8320, 15638; Payload ID: 9931 relates to Category No.: 12154, 12153, 7613, 7725, 11237, 8739, 15149, 5446, 10372, 8731, 3398, 13343, 4186, 9891, 4127, 11884, 3775, 16197, 3313, 14567, 8988, 12036, 2006, 11027, 7883, 14566, 3900, 13779, 11912, 9692, 8618, 12891, 4956, 16136, 1240, 4949, 12953, 979, 3622, 967, 1250, 10349, 1580, 15638, 2079, 14025, 13827, 2001, 13811, 10648, 1965, 14011, 1910, 8537, 13951, 13905, 13799, 8004, 13932, 7840, 13838, 11251, 2148, 2080, 1901, 1993, 2088, 2142; Payload ID: 9932 relates to Category No.: 7613, 7725, 8739, 7743, 1780, 11884, 12117, 3313, 14566, 2006, 8508, 4330, 4956, 16136, 10372, 12953, 979, 3622, 967; Payload ID: 9933 relates to Category No.: 15490, 3398, 795, 12619, 1730, 8731, 3398, 11506, 3398, 2410, 8192, 4974, 8496, 13589, 3398, 12646, 11512, 5406, 11634, 13713, 5428, 13788, 4251, 6486, 3584, 9722, 3594, 10293, 9005; Payload ID: 9934 relates to Category No.: 9982, 3452, 12091, 14565, 1722, 5446, 9713, 1746, 12459, 4186, 4859, 13280, 9891, 15521, 11878, 4127, 7635, 3775, 11285, 10648, 4439, 14015, 5541, 16085, 8988, 11858, 15464, 6451, 1995, 11546, 15192, 2006, 13966, 12671, 10910, 13773, 2077, 11530, 8317, 9716, 11178, 7303, 11634, 1562, 10889, 13888, 10192, 4953, 13360, 12942, 1556, 4458, 1567, 11418, 4958, 3728, 8241, 14330, 13361, 11069, 2996, 13200, 11138, 8388, 16267, 13125, 1542, 1295, 16294, 11391, 14883, 13811, 11094, 6626, 13951, 6322, 16213, 7791, 11111, 8535, 11090, 12584, 7292, 10501, 10356, 10420, 11087, 1709, 10363, 12862, 8547, 1779, 10558, 11266, 12920, 14729, 10652, 11092, 11362, 13422, 8339, 12586, 7748, 12566, 10538, 10693, 11381, 8182; Payload ID: 9935 relates to Category No.: 2460, 2459, 9420, 4946, 8887, 3176, 5462, 3578, 1320, 13492, 9099, 2603, 3811, 3612, 3570, 7247, 12583, 13681, 10038, 13493; Payload ID: 9936 relates to Category No.: 13594, 690, 1764, 11512, 12619, 7613, 8739, 5939, 687, 11506, 3398, 15521, 4094, 10648, 1867, 14663, 4439, 3853, 8375, 3846, 5786, 682, 8196, 10881, 1960, 10586, 11308, 13440, 6111, 2118, 2128, 6666, 7294, 13593, 15406, 3803, 5406, 1463, 9410, 10372, 4949, 6269, 3592, 10860, 3587, 7306, 1295, 5998, 10953, 13676, 15405, 1997, 7217, 3594, 10816, 6555, 3605, 9764, 9411, 16139, 11259, 15606, 6562, 3746, 6554, 10636, 10724, 14072, 12153; Payload ID: 9937 relates to Category No.: 13594, 15521, 4439, 14949, 11512, 12153; Payload ID: 9938 relates to Category No.: 13594, 15490, 3398, 12153; Payload ID: 9939 relates to Category No.: 13594, 11512, 687, 11506, 3398, 8831, 15521, 4439, 5786, 14949, 8887, 14793, 3641, 4949, 11628, 1483, 3602, 14385, 9349, 8888, 14883, 3600, 16286, 10038, 1014, 3570, 12153; Payload ID: 9940 relates to Category No.: 13594, 15490, 3398, 11512; Payload ID: 9941 relates to Category No.: 13594, 11512, 687, 11506, 3398, 15521, 4439, 5786, 15662, 2353, 8717; Payload ID: 9942 relates to Category No.: 13594, 15490, 3398; Payload ID: 9943 relates to Category No.: 13594, 11512, 687, 11506, 3398, 15521, 4439, 5786, 14949; Payload ID: 9944 relates to Category No.: 13594, 15521, 4439, 14949; Payload ID: 9945 relates to Category No.: 13594, 687, 15517, 11506, 3398, 15521, 4439, 5786, 11308, 6814; Payload ID: 9946 relates to Category No.: 13594, 11512, 687, 11506, 3398, 15521, 4439, 5786, 14949, 12153; Payload ID: 9947 relates to Category No.: 13594, 15291; Payload ID: 9948 relates to Category No.: 13594, 15490, 3398; Payload ID: 9949 relates to Category No.: 13594, 15490, 3398, 15517, 15521, 4439, 12153; Payload ID: 9950 relates to Category No.: 13594, 15490, 3398, 11512, 14949, 1227, 12153; Payload ID: 9951 relates to Category No.: 13594, 15490, 3398; Payload ID: 9952 relates to Category No.: 13594, 13589, 3398, 15521, 4439, 10648, 11454; Payload ID: 9953 relates to Category No.: 13594, 687, 11506, 3398, 15521, 4439, 5786, 15517, 14949, 12153, 11934, 5095; Payload ID: 9954 relates to Category No.: 11512, 8739, 15521, 4439, 10350, 7990, 10432, 10967; Payload ID: 9955 relates to Category No.: 13594, 15490, 3398, 15521, 4439; Payload ID: 9956 relates to Category No.: 13594, 15521, 4439, 14949, 12153; Payload ID: 9957 relates to Category No.: 13589, 3398, 15490, 3398, 14949, 8634; Payload ID: 9958 relates to Category No.: 13589, 3398, 15490, 3398; Payload ID: 9959 relates to Category No.: 13594, 687, 11506, 3398, 15521, 4439, 5786, 14949, 12153; Payload ID: 9960 relates to Category No.: 13594, 13589, 3398, 15521, 4439, 7990, 6192, 12153; Payload ID: 9961 relates to Category No.: 13594, 687, 15517, 11506, 3398, 15521, 4439, 5786; Payload ID: 9962 relates to Category No.: 13594, 15490, 3398, 11512, 14257, 15521, 4439, 12153; Payload ID: 9963 relates to Category No.: 13594, 15521, 4439, 14949, 12153; Payload ID: 9964 relates to Category No.: 13594, 12153, 15521, 4439; Payload ID: 9965 relates to Category No.: 13594, 15490, 3398; Payload ID: 9966 relates to Category No.: 13149; Payload ID: 9967 relates to Category No.: 3452, 3354, 3448, 5805, 1893, 12120, 3453, 11660; Payload ID: 9968 relates to Category No.: 5428, 5446, 8112, 9292, 6125, 10469, 8133, 8141, 8251; Payload ID: 9969 relates to Category No.: 15490, 3398, 11512, 11069; Payload ID: 9970 relates to Category No.: 15490, 3398, 14661, 11512, 11537, 14688, 11506, 3398, 7840, 7618, 13594, 7710; Payload ID: 9971 relates to Category No.: 12091, 1730, 7242, 15614, 1752, 9717, 5446, 10372, 1780, 6795; Payload ID: 9972 relates to Category No.: 15626, 16172, 5848, 12066, 1933, 1662, 10863, 13424, 12137; Payload ID: 9973 relates to Category No.: 1730, 14267, 14838, 4134, 2403, 6534; Payload ID: 9974 relates to Category No.: 9228, 3452, 13743, 15144, 4167, 6532, 4141, 6535; Payload ID: 9975 relates to Category No.: 1730, 14838; Payload ID: 9976 relates to Category No.: 6670, 14838, 6107, 2464, 10439; Payload ID: 9977 relates to Category No.: 6668, 4367, 14834, 6687, 6535, 6696; Payload ID: 9978 relates to Category No.: 3353, 14838, 15144, 6678, 9379; Payload ID: 9979 relates to Category No.: 6533, 6691, 4140, 5253, 6690, 2189; Payload ID: 9980 relates to Category No.: 3353, 6670; Payload ID: 9981 relates to Category No.: 13589, 3398, 8349, 15517, 11512, 1249, 8375, 690, 4998, 3023, 6666, 6296, 6117; Payload ID: 9982 relates to Category No.: 13589, 3398, 11512, 8739, 15517, 7306, 8349, 16213, 4057, 13936, 9554, 13865; Payload ID: 9983 relates to Category No.: 13589, 3398, 15517, 11512, 11266, 7618; Payload ID: 9985 relates to Category No.: 4828, 8962, 1795, 4132, 439, 10486, 4448; Payload ID: 9986 relates to Category No.: 4828, 8962, 9932, 6157; Payload ID: 9987 relates to Category No.: 4828, 11512, 5785, 7306, 4828, 2745, 11266, 8782, 10025, 10309, 11268, 16049, 11264, 16050, 6697, 14454; Payload ID: 9988 relates to Category No.: 4828, 8962, 4828, 2745, 10309, 10036; Payload ID: 9989 relates to Category No.: 12007, 10309, 1334; Payload ID: 9990 relates to Category No.: 4132, 3728, 12007, 10309, 3727; Payload ID: 9991 relates to Category No.: 4828, 2467, 4828, 2745, 9932, 10309, 6295, 12868, 12544, 14737, 12953, 442, 5250; Payload ID: 9992 relates to Category No.: 4828, 442, 10289, 10309, 5544, 13888, 13135, 4132, 7977, 12868, 3243, 3728, 12935; Payload ID: 9993 relates to Category No.: 4828, 4828, 2745, 10309; Payload ID: 9994 relates to Category No.: 15490, 3398, 8739, 8402; Payload ID: 9997 relates to Category No.: 1204; Payload ID: 9998 relates to Category No.: 15490, 3398, 8739, 11588, 1888, 8542, 2158, 14566, 8504; Payload ID: 9999 relates to Category No.: 15490, 3398, 8739, 11588, 1888, 8542, 2158, 14566, 8504; Payload ID: 10000 relates to Category No.: 7840, 7915, 8537; Payload ID: 10001 relates to Category No.: 1204; Payload ID: 10002 relates to Category No.: 1204; Payload ID: 10003 relates to Category No.: 1204; Payload ID: 10004 relates to Category No.: 1204; Payload ID: 10005 relates to Category No.: 1204; Payload ID: 10014 relates to Category No.: 1204; Payload ID: 10015 relates to Category No.: 1204; Payload ID: 10018 relates to Category No.: 11588, 1888; Payload ID: 10020 relates to Category No.: 13589, 3398, 795, 2467, 10238, 12498, 803, 4040, 11765, 8988, 4039, 7939, 13594, 8731, 3398, 11506, 3398, 10241, 10954, 12717, 10292; Payload ID: 10024 relates to Category No.: 1204; Payload ID: 10027 relates to Category No.: 795; Payload ID: 10028 relates to Category No.: 15490, 3398, 8731, 3398, 849, 14097, 3698, 11969, 12717, 14123, 10194; Payload ID: 10029 relates to Category No.: 3354, 2410; Payload ID: 10031 relates to Category No.: 690, 1703, 674, 4494, 16094, 10366; Payload ID: 10032 relates to Category No.: 1780; Payload ID: 10033 relates to Category No.: 2353, 15662; Payload ID: 10034 relates to Category No.: 12137, 3986, 3833, 7737, 12063, 1893, 6738, 11660, 16294, 7719, 10904, 2571, 2374, 10287; Payload ID: 10035 relates to Category No.: 5782; Payload ID: 10036 relates to Category No.: 10025, 6705, 6714, 3197; Payload ID: 10037 relates to Category No.: 4828, 1795, 4828, 2745, 10406, 6629, 496, 8118, 2469, 1463; Payload ID: 10038 relates to Category No.: 4828, 15149, 1795, 13004, 4828, 2745, 2469, 4535, 10442, 9102, 8373, 8118, 11555, 7855, 11602, 1463, 7780, 10441, 8770, 13234, 7862; Payload ID: 10039 relates to Category No.: 1703, 1795, 11884, 8926; Payload ID: 10040 relates to Category No.: 14656, 7743, 7737, 12405, 11934, 8524, 11313, 8860, 4499, 11094, 2924, 11200, 7575, 2068, 7133, 10039, 14565, 8909, 11437, 9982; Payload ID: 10041 relates to Category No.: 5785, 795, 16197, 4749, 4425, 10879; Payload ID: 10042 relates to Category No.: 9945, 14663, 4653, 9895, 9833; Payload ID: 10043 relates to Category No.: 9945, 14663, 4653, 9823, 9833; Payload ID: 10044 relates to Category No.: 1893, 9711; Payload ID: 10045 relates to Category No.: 9945, 14663, 4653, 9856, 16138, 9862, 6082; Payload ID: 10046 relates to Category No.: 3564; Payload ID: 10047 relates to Category No.: 15618, 6482, 6480; Payload ID: 10048 relates to Category No.: 12194, 14454, 1948, 1893, 1149, 5949, 9640, 13734, 2141, 696, 2766, 2140; Payload ID: 10049 relates to Category No.: 12194; Payload ID: 10050 relates to Category No.: 14565, 4749, 4425, 13241; Payload ID: 10051 relates to Category No.: 14565, 4749, 4425; Payload ID: 10052 relates to Category No.: 14565, 4749, 4425; Payload ID: 10053 relates to Category No.: 12045; Payload ID: 10054 relates to Category No.: 1183, 1814, 1749, 7241, 10061, 9740, 12031, 3910, 7364; Payload ID: 10055 relates to Category No.: 11884; Payload ID: 10056 relates to Category No.: 11371, 3871, 1183, 11245, 12000; Payload ID: 10057 relates to Category No.: 5367, 12096, 747; Payload ID: 10058 relates to Category No.: 12153; Payload ID: 10059 relates to Category No.: 12153; Payload ID: 10060 relates to Category No.: 12153, 3639; Payload ID: 10061 relates to Category No.: 12153, 3639; Payload ID: 10062 relates to Category No.: 12153; Payload ID: 10063 relates to Category No.: 12096, 11860, 11017, 7723, 12029, 13156; Payload ID: 10064 relates to Category No.: 11967, 11830, 3835; Payload ID: 10065 relates to Category No.: 12153, 8688, 13586; Payload ID: 10066 relates to Category No.: 403, 12096; Payload ID: 10067 relates to Category No.: 12153; Payload ID: 10068 relates to Category No.: 12194, 6219, 3684, 2355, 1893, 14663, 6445, 13831, 6740, 919, 13592; Payload ID: 10069 relates to Category No.: 12194, 3684, 2355, 1893, 14663, 13831, 11363, 6740, 919, 11520; Payload ID: 10070 relates to Category No.: 5285, 1066; Payload ID: 10077 relates to Category No.: 5367, 5446, 4127, 14565, 1795; Payload ID: 10082 relates to Category No.: 12619; Payload ID: 10083 relates to Category No.: 12619; Payload ID: 10086 relates to Category No.: 1204, 5802; Payload ID: 10087 relates to Category No.: 4712, 7443, 11903; Payload ID: 10088 relates to Category No.: 12194, 3244; Payload ID: 10089 relates to Category No.: 12194, 5428, 3244, 15471; Payload ID: 10090 relates to Category No.: 12091, 9720, 9777, 1816, 1795, 1238, 6145, 11182, 8206, 15043, 14056, 14838, 10074, 14404, 790, 11980, 7537, 16069, 8236; Payload ID: 10091 relates to Category No.: 14025, 2810, 5302, 6269, 14883, 5949, 15633, 6814; Payload ID: 10092 relates to Category No.: 16101; Payload ID: 10093 relates to Category No.: 13589, 3398, 7306, 1204, 14790, 4970, 14389, 15517, 11512, 14792; Payload ID: 10094 relates to Category No.: 13589, 3398, 11512, 15517, 7306, 8926, 1237, 690, 14636, 9540, 6192, 14792; Payload ID: 10095 relates to Category No.: 10606; Payload ID: 10097 relates to Category No.: 11926, 16286, 6795, 12007; Payload ID: 10098 relates to Category No.: 13589, 3398, 15490, 3398; Payload ID: 10099 relates to Category No.: 13589, 3398, 15490, 3398; Payload ID: 10100 relates to Category No.: 15490, 3398, 14565, 10775, 10433; Payload ID: 10101 relates to Category No.: 8906, 11512, 8731, 3398, 11506, 3398, 9125, 11125, 4952, 3711, 1557, 8287, 10709, 4418, 14398, 1584, 4877, 1543, 11421, 3591, 1582, 1540, 14608, 1586, 7911, 6072, 14605, 1589, 10722, 15517, 4953, 14577, 6803, 11126, 1588; Payload ID: 10102 relates to Category No.: 13589, 3398, 15490, 3398, 7306, 9125; Payload ID: 10103 relates to Category No.: 6814, 6795, 13072; Payload ID: 10104 relates to Category No.: 1730, 15517, 11512, 14793, 14417; Payload ID: 10105 relates to Category No.: 1703, 1820, 9554; Payload ID: 10106 relates to Category No.: 1820; Payload ID: 10107 relates to Category No.: 14432, 12091, 1026, 11512, 14565, 9720, 15614, 1795, 10175, 1780, 7635, 5022, 1320, 10553, 3714, 8098, 11858, 345, 8004, 1562, 12397, 6269, 4535, 14636, 480, 12674, 1295, 7345, 1556, 7417, 7388, 10036, 10669, 7338, 12563, 8755, 11163; Payload ID: 10108 relates to Category No.: 7613, 8739, 11109, 10775, 10256, 11266, 6248, 10226, 1183; Payload ID: 10109 relates to Category No.: 11512, 8739, 2409, 4439, 14944, 12891, 3783, 8004, 3783, 14417, 10742, 8078, 14949; Payload ID: 10110 relates to Category No.: 6814; Payload ID: 10111 relates to Category No.: 6814, 1204; Payload ID: 10112 relates to Category No.: 4797, 3833, 6814; Payload ID: 10113 relates to Category No.: 6814, 1204; Payload ID: 10114 relates to Category No.: 8862, 6814; Payload ID: 10115 relates to Category No.: 8042, 2156, 1920; Payload ID: 10116 relates to Category No.: 8042, 2156; Payload ID: 10117 relates to Category No.: 8042, 2156, 1920; Payload ID: 10118 relates to Category No.: 8042, 2156, 1920; Payload ID: 10119 relates to Category No.: 7217, 7214, 2143, 8042, 2156, 1939, 1920; Payload ID: 10120 relates to Category No.: 8042, 2156, 1920; Payload ID: 10122 relates to Category No.: 8042, 2156; Payload ID: 10123 relates to Category No.: 13939, 8042, 1963, 2156, 1920; Payload ID: 10124 relates to Category No.: 2885, 1957, 5610, 8042, 1847, 2019, 1963, 2156; Payload ID: 10125 relates to Category No.: 10331, 7613, 8731, 3398, 11506, 3398, 13700, 8373, 1780, 7840, 7635, 11285, 10648, 7735, 13882, 13422, 2083, 12117, 5217, 2350, 10583, 3846, 1957, 11949, 15606, 3728, 907, 361, 2006, 10356, 16332, 8554, 13354, 8434, 11980, 11596, 1920, 2165, 2070, 11522, 16330, 1875, 11082, 7636, 6119, 1866, 1372, 8363, 10937, 7839, 11162, 13975, 8370, 1295, 8374, 8093; Payload ID: 10126 relates to Category No.: 1204, 1875; Payload ID: 10127 relates to Category No.: 1730, 7306, 14838, 13939, 1875; Payload ID: 10128 relates to Category No.: 13594, 11512, 15517, 13939, 11506, 3398, 13975, 13794; Payload ID: 10129 relates to Category No.: 13589, 3398, 15490, 3398, 11843, 14565, 2467, 12999, 3448, 2410, 8408, 13925, 13904, 12891, 3783, 3743, 6295, 11241; Payload ID: 10130 relates to Category No.: 13589, 3398, 952, 2410, 2404, 8739, 11512, 8731, 3398, 3337, 5113, 12879; Payload ID: 10131 relates to Category No.: 13589, 3398, 10372, 10638, 8731, 3398, 2410; Payload ID: 10132 relates to Category No.: 13589, 3398, 15490, 3398, 10359; Payload ID: 10133 relates to Category No.: 1703, 15614, 274, 10061, 7252, 10491, 7939, 1971, 6959, 13718, 4503, 8851, 3805, 5406, 13713, 1272, 286, 287, 449, 10190, 6479; Payload ID: 10134 relates to Category No.: 10061; Payload ID: 10136 relates to Category No.: 12127, 1893; Payload ID: 10137 relates to Category No.: 12127, 1893, 7112; Payload ID: 10138 relates to Category No.: 12127; Payload ID: 10139 relates to Category No.: 10261, 4475; Payload ID: 10140 relates to Category No.: 4094, 8112, 10293, 13812, 13953, 1334, 10559; Payload ID: 10142 relates to Category No.: 16308, 1830, 6902, 9374, 14663, 1878, 14348, 15089; Payload ID: 10143 relates to Category No.: 16308, 6902, 9374, 14663, 14348; Payload ID: 10144 relates to Category No.: 16308, 6902, 12603, 9374, 14663, 14348; Payload ID: 10145 relates to Category No.: 9500, 13975, 1894, 12102, 6888; Payload ID: 10146 relates to Category No.: 9500, 13975, 5446, 12102, 287; Payload ID: 10147 relates to Category No.: 13589, 3398, 9500, 13975, 12102, 287; Payload ID: 10148 relates to Category No.: 9500, 13975, 12102; Payload ID: 10149 relates to Category No.: 12194, 13618, 10075, 10005, 16211, 14111, 13437, 9698, 9150, 6814; Payload ID: 10150 relates to Category No.: 12194, 12099, 11952, 10005, 16211, 14111, 13437, 9698, 9150; Payload ID: 10151 relates to Category No.: 12194, 9698, 9150; Payload ID: 10152 relates to Category No.: 4439, 15698, 6893; Payload ID: 10153 relates to Category No.: 4439, 15698, 6893; Payload ID: 10154 relates to Category No.: 15490, 3398, 8739, 8731, 3398, 6296, 13996, 13589, 3398, 12891, 3783, 5095, 15149, 6102, 11634, 12891, 2235, 16213, 11506, 3398, 3038, 12892, 2412, 483, 8929, 10372, 8936, 15140, 11431, 13882, 6323, 13530, 14940, 8373, 1295, 1112, 6758, 3971, 11997, 16138, 14454, 8921, 14729, 5491, 6322, 7039, 15880, 5203, 8919, 13756, 13417, 8933, 7315, 8072, 4595, 4515, 9827, 8912, 1833, 9594, 11798, 8085, 1596, 1641, 13835, 13969, 13904, 7625, 12772, 13916, 4949; Payload ID: 10155 relates to Category No.: 13996, 3354, 1089, 1089, 762, 3103, 13835; Payload ID: 10156 relates to Category No.: 8739, 8731, 3398, 15517, 6903, 13835, 13967, 13969, 496, 13811, 7625, 12772, 8004, 4949, 8929, 13848; Payload ID: 10157 relates to Category No.: 15490, 3398, 952, 8739, 8731, 3398, 6903, 4439, 12891, 3783, 8004, 3783, 12646, 11620, 1889, 6624; Payload ID: 10158 relates to Category No.: 15490, 3398, 952, 8739, 6903, 2410, 5406, 5095, 15424, 13835, 13967, 1295, 13969, 496, 12772, 4949, 3602; Payload ID: 10159 relates to Category No.: 15490, 3398, 8739, 6903; Payload ID: 10160 relates to Category No.: 8739, 6903; Payload ID: 10161 relates to Category No.: 15490, 3398, 8739, 6903; Payload ID: 10162 relates to Category No.: 15490, 3398, 8739, 6903; Payload ID: 10163 relates to Category No.: 8739, 6903; Payload ID: 10164 relates to Category No.: 8862, 7131, 10491, 4535, 10698, 13189, 14593; Payload ID: 10166 relates to Category No.: 14663, 1878, 16234, 16275, 1210, 1308, 6122, 6814; Payload ID: 10167 relates to Category No.: 6814; Payload ID: 10168 relates to Category No.: 9500, 4237, 9374, 4949, 14663, 6887, 12251, 8887, 15310, 16234, 16275, 14489, 3614, 4233, 5086, 6888, 14491, 28, 3600, 14790, 9005, 15633; Payload ID: 10169 relates to Category No.: 9500, 9374, 4237, 14663, 8887, 15310, 16234, 16275, 3614, 4238, 15311, 4233, 3600, 4270; Payload ID: 10170 relates to Category No.: 9500, 9374, 4237, 15311; Payload ID: 10171 relates to Category No.: 9500, 9374, 4237, 6887, 12251, 15310, 5086, 30; Payload ID: 10172 relates to Category No.: 9500, 1830, 12980, 14663, 15310, 16234, 16275, 1237, 4233, 6888, 5248, 5032, 6887, 13882, 13827, 13773, 13893, 13849, 14042, 14350, 15311; Payload ID: 10173 relates to Category No.: 4100, 1867, 14663, 2540, 16234, 16275, 14541, 2539; Payload ID: 10174 relates to Category No.: 14663, 2540, 16234, 16275, 2539; Payload ID: 10175 relates to Category No.: 14663, 2540, 16234, 16275, 2539; Payload ID: 10176 relates to Category No.: 14663, 2540, 16234, 16275; Payload ID: 10177 relates to Category No.: 4100, 1867, 14663, 14541, 6289; Payload ID: 10178 relates to Category No.: 6814, 4100, 1867, 14663, 2540, 16234, 16275, 14541, 5248, 11634; Payload ID: 10179 relates to Category No.: 14212, 14718, 14719, 8739, 10637, 7802; Payload ID: 10180 relates to Category No.: 9500, 4110, 4104, 14663, 14972, 2347; Payload ID: 10181 relates to Category No.: 9232, 10129, 6285, 14663, 1878, 9256, 12265, 15089, 12260; Payload ID: 10182 relates to Category No.: 10129, 6285, 1874, 14663, 1878, 15089, 6286, 1834; Payload ID: 10183 relates to Category No.: 15715, 15712, 4439, 15708, 14192; Payload ID: 10184 relates to Category No.: 6902; Payload ID: 10185 relates to Category No.: 9149; Payload ID: 10186 relates to Category No.: 6902; Payload ID: 10187 relates to Category No.: 6814, 6902; Payload ID: 10188 relates to Category No.: 9232, 7291, 16182, 4439, 7285, 14949, 7278, 6902; Payload ID: 10189 relates to Category No.: 14308; Payload ID: 10190 relates to Category No.: 14308; Payload ID: 10191 relates to Category No.: 15588, 6902; Payload ID: 10192 relates to Category No.: 6902; Payload ID: 10193 relates to Category No.: 6902; Payload ID: 10194 relates to Category No.: 12053, 9691; Payload ID: 10195 relates to Category No.: 6902; Payload ID: 10196 relates to Category No.: 12053, 9691; Payload ID: 10197 relates to Category No.: 6902; Payload ID: 10198 relates to Category No.: 6902; Payload ID: 10199 relates to Category No.: 6902; Payload ID: 10200 relates to Category No.: 6902; Payload ID: 10201 relates to Category No.: 15708; Payload ID: 10202 relates to Category No.: 15708; Payload ID: 10203 relates to Category No.: 14212, 7285, 7288, 9232, 7291, 16182, 4439, 2469, 14949, 423, 11734, 7278, 11733, 6902; Payload ID: 10204 relates to Category No.: 9232, 6902; Payload ID: 10205 relates to Category No.: 6902; Payload ID: 10206 relates to Category No.: 6902, 6814; Payload ID: 10207 relates to Category No.: 6814, 6902; Payload ID: 10208 relates to Category No.: 6814, 6902; Payload ID: 10209 relates to Category No.: 6902, 5095, 14636, 4094; Payload ID: 10211 relates to Category No.: 10372, 5898, 12063, 1893, 14663, 3405, 2347, 11660, 3407, 5893, 6927; Payload ID: 10212 relates to Category No.: 9982, 5898, 14663, 8112, 2347, 5893, 6927; Payload ID: 10214 relates to Category No.: 12091, 11858, 11182, 10702, 10379, 12003; Payload ID: 10215 relates to Category No.: 7131, 3727, 12861, 2378; Payload ID: 10216 relates to Category No.: 7278, 7283; Payload ID: 10217 relates to Category No.: 6814, 9599, 6611, 11125, 11242; Payload ID: 10218 relates to Category No.: 13589, 3398, 15490, 3398; Payload ID: 10219 relates to Category No.: 1512, 9020, 12063, 1893, 11660; Payload ID: 10220 relates to Category No.: 1512, 9020, 12063, 11660; Payload ID: 10221 relates to Category No.: 5367; Payload ID: 10222 relates to Category No.: 5367, 13975, 2888, 12994, 16197, 4382, 13867, 14000, 7540, 15200, 7861, 5369; Payload ID: 10224 relates to Category No.: 1730, 7306, 14838, 1204; Payload ID: 10225 relates to Category No.: 12427, 3639, 12126, 8936, 14097, 3702, 12020, 6754, 14649, 2068; Payload ID: 10226 relates to Category No.: 3635, 15043, 275, 287, 1183, 8936, 11294; Payload ID: 10227 relates to Category No.: 2243, 12891, 3889, 12999, 1269, 8954, 12008, 12710, 13057, 12681, 7132, 7133; Payload ID: 10228 relates to Category No.: 4021, 3023, 4012; Payload ID: 10229 relates to Category No.: 1204, 4021; Payload ID: 10230 relates to Category No.: 4021, 3582, 11636, 10086; Payload ID: 10231 relates to Category No.: 4021; Payload ID: 10233 relates to Category No.: 1703, 4021, 4012, 2141, 16049, 3550, 12722; Payload ID: 10234 relates to Category No.: 13589, 3398, 11512, 8739, 15517, 11506, 3398, 6705, 11884, 10648, 10527, 5443, 13440, 1730, 12646, 12891, 1463, 7613, 1741, 16286, 1276, 10025, 1487, 13280, 9459; Payload ID: 10235 relates to Category No.: 1204; Payload ID: 10236 relates to Category No.: 1204; Payload ID: 10237 relates to Category No.: 16308, 9500, 14663, 4612, 11942, 2040, 4615, 13925, 13827, 13971, 6163; Payload ID: 10238 relates to Category No.: 10331, 16308, 9500, 6153, 4609, 14663, 4612, 6154, 13925, 13971; Payload ID: 10239 relates to Category No.: 6219, 16308, 14565, 14663, 4612, 9500, 13971; Payload ID: 10240 relates to Category No.: 6227, 2469, 15664, 11995, 6219, 2353, 6256, 6253, 13796, 9950, 14663, 15666, 10052; Payload ID: 10241 relates to Category No.: 13589, 3398, 15490, 3398, 1894, 3354, 3353, 2410, 5185, 5189, 5190; Payload ID: 10242 relates to Category No.: 9500, 14565, 2940, 284, 15092, 8535, 7613, 7840; Payload ID: 10243 relates to Category No.: 9500, 2940, 4949, 11537, 284, 4952, 15092; Payload ID: 10244 relates to Category No.: 9500, 2940, 3986, 11537, 284; Payload ID: 10245 relates to Category No.: 12091, 5785, 2940, 9713; Payload ID: 10246 relates to Category No.: 12091, 5785, 2940, 9713, 13016, 14835; Payload ID: 10247 relates to Category No.: 12091, 5785, 9713; Payload ID: 10248 relates to Category No.: 12091, 5785, 9713, 13016; Payload ID: 10249 relates to Category No.: 12091, 1737, 5785, 12619, 1955, 9713, 7154, 13171, 7132, 4336, 8533, 13116, 4142, 330; Payload ID: 10252 relates to Category No.: 3926, 12519, 11293, 6967, 11006; Payload ID: 10253 relates to Category No.: 6814, 1722, 16286, 10257, 4774, 16294, 11620, 12882, 13149, 12823, 3924, 6796, 11661, 2940; Payload ID: 10254 relates to Category No.: 998, 2073, 9246, 6733, 7129, 6451, 6453, 1002; Payload ID: 10255 relates to Category No.: 998, 2073, 9246, 6733, 7129, 6451, 13165, 6453; Payload ID: 10256 relates to Category No.: 1002; Payload ID: 10257 relates to Category No.: 998, 2073, 9246, 6733, 7129, 6451; Payload ID: 10258 relates to Category No.: 1737, 10481, 2902, 13149, 7167; Payload ID: 10259 relates to Category No.: 6969, 7131, 10491, 9994, 14456, 8300; Payload ID: 10260 relates to Category No.: 8862, 6969, 1886, 3038, 6967, 1048, 10257, 8173, 7124, 1023, 3890; Payload ID: 10261 relates to Category No.: 6969, 8862, 1002, 795, 1295, 8940, 6967, 7124, 12707; Payload ID: 10262 relates to Category No.: 6969, 8936, 2176, 3041, 6967, 3038, 1048, 2080; Payload ID: 10263 relates to Category No.: 1737, 7168, 8936, 6983, 3915; Payload ID: 10264 relates to Category No.: 15626, 6969, 3041, 6444; Payload ID: 10265 relates to Category No.: 6969, 12041, 13973, 3924; Payload ID: 10266 relates to Category No.: 2886, 13171, 7162, 14894; Payload ID: 10267 relates to Category No.: 795, 6969, 4446, 10257, 11765, 12519, 1844, 13146, 11008, 8934, 484, 1048, 1018, 8173, 7124, 1023, 13148, 1295, 13966, 13970, 4145, 5814; Payload ID: 10268 relates to Category No.: 1737, 14661, 7154, 1780, 9420, 7132, 4336, 12028, 8301, 11007; Payload ID: 10269 relates to Category No.: 1737, 14565, 7154, 1780; Payload ID: 10270 relates to Category No.: 1737, 11506, 3398, 7154, 10466, 11007; Payload ID: 10271 relates to Category No.: 6219, 12095, 8300, 10609, 10908, 13068; Payload ID: 10272 relates to Category No.: 6814, 14162, 11884; Payload ID: 10273 relates to Category No.: 8862, 14565, 1730, 10359, 9125, 14050, 472, 2243, 11506, 3398, 8373, 8374, 3070, 1112, 5073, 12534, 14545, 2218, 3011, 13859, 13874, 13827, 1752; Payload ID: 10274 relates to Category No.: 6814, 2885, 6969, 9599, 11419, 5610, 12028, 8300; Payload ID: 10275 relates to Category No.: 12153, 5446, 11109, 10775, 11363, 8817, 12028, 8821, 8820; Payload ID: 10276 relates to Category No.: 8118, 8020; Payload ID: 10277 relates to Category No.: 13618; Payload ID: 10278 relates to Category No.: 795, 7613, 10366, 10628; Payload ID: 10280 relates to Category No.: 690, 1703, 1893, 16197, 14586, 9777, 12432, 9777, 3729, 11182, 10236, 10372, 13836; Payload ID: 10281 relates to Category No.: 12153, 3639, 9125, 5406, 10543, 8375, 4952, 14793, 1240, 4949, 8889; Payload ID: 10282 relates to Category No.: 12153, 10775, 9125; Payload ID: 10283 relates to Category No.: 1955, 3356, 7132, 3360, 4332, 1780; Payload ID: 10284 relates to Category No.: 1955, 3356, 7132, 4134, 4332, 3369, 6522, 3452; Payload ID: 10285 relates to Category No.: 3452, 1955, 3356, 4134, 4367; Payload ID: 10286 relates to Category No.: 1737, 3386, 7154, 14612; Payload ID: 10287 relates to Category No.: 1721, 3356, 7132, 3360, 4332, 3369, 2020, 9274, 3379, 3320; Payload ID: 10288 relates to Category No.: 3356, 3320, 7132, 3360, 4332, 3369; Payload ID: 10289 relates to Category No.: 3356, 11949, 7295, 5376; Payload ID: 10290 relates to Category No.: 3356, 7132, 3360, 4332, 3369, 3379; Payload ID: 10291 relates to Category No.: 3356, 3320, 7132, 3360, 4332, 3369, 1737; Payload ID: 10292 relates to Category No.: 3356, 7132, 3360, 4332, 3369, 3379; Payload ID: 10293 relates to Category No.: 1955, 3356, 13313, 7132, 3360, 4332, 3369, 1780, 3379, 2154, 13827, 2080, 1960, 3320; Payload ID: 10294 relates to Category No.: 3356; Payload ID: 10297 relates to Category No.: 1721, 7154, 1737, 14661, 5965, 7132, 2429; Payload ID: 10298 relates to Category No.: 1737, 2167, 7154, 9274; Payload ID: 10299 relates to Category No.: 1737, 2167, 7154, 9274, 1204, 11294, 2429, 12772; Payload ID: 10300 relates to Category No.: 6814, 7122, 7119; Payload ID: 10301 relates to Category No.: 12091, 5785, 12638, 15149, 13166, 12498, 7306, 275, 360, 8940, 14015, 10878, 5912, 11858, 3041, 12650, 12483, 12652, 8840; Payload ID: 10302 relates to Category No.: 1905, 11502, 1891; Payload ID: 10303 relates to Category No.: 7141, 8507, 1791; Payload ID: 10304 relates to Category No.: 9500, 9043, 3183, 6814; Payload ID: 10305 relates to Category No.: 9500, 9043, 3183, 6814; Payload ID: 10306 relates to Category No.: 11512, 14565, 5446, 3021, 3013, 10775, 11285, 16197, 8818, 8789, 11363, 339, 10808, 10811, 10855, 11566, 13295, 11510, 10411, 10491, 1967, 11259, 15606, 11574, 10871, 14185, 11573; Payload ID: 10307 relates to Category No.: 14164, 8315, 8586; Payload ID: 10308 relates to Category No.: 1451, 10801, 11012, 4535, 7030, 11889, 1414, 7029; Payload ID: 10309 relates to Category No.: 1409, 11012, 7030; Payload ID: 10310 relates to Category No.: 11940, 1409, 3012, 11012, 7030, 7029, 1414; Payload ID: 10311 relates to Category No.: 7030, 8304, 11012; Payload ID: 10313 relates to Category No.: 334, 15626, 13465, 10238, 8950; Payload ID: 10314 relates to Category No.: 12029, 5016, 13159, 15626; Payload ID: 10316 relates to Category No.: 334, 12153, 344, 10775, 7735, 8114, 12120, 12117, 7043, 7122, 8524, 13164, 11017, 8309, 11292, 1967, 7120, 11912, 7861, 8790, 7784, 13162, 13161, 10494, 13376; Payload ID: 10317 relates to Category No.: 11293, 7043, 11017; Payload ID: 10318 relates to Category No.: 11293, 7122, 11256, 11017; Payload ID: 10319 relates to Category No.: 11940, 12127, 7045, 11293, 7043, 9757, 11322, 13692, 13164, 7044, 7121, 11017, 13295; Payload ID: 10320 relates to Category No.: 795, 7043; Payload ID: 10321 relates to Category No.: 7043, 486, 7122; Payload ID: 10322 relates to Category No.: 7043, 486; Payload ID: 10323 relates to Category No.: 7043, 7122, 486; Payload ID: 10324 relates to Category No.: 9228, 7046, 7038, 7037; Payload ID: 10325 relates to Category No.: 1820, 12127, 1893; Payload ID: 10326 relates to Category No.: 1204; Payload ID: 10327 relates to Category No.: 12194, 12100; Payload ID: 10328 relates to Category No.: 1207, 9420, 7108, 2659, 7110, 15603; Payload ID: 10329 relates to Category No.: 15490, 3398, 7287, 5219; Payload ID: 10330 relates to Category No.: 7084, 1874, 1204, 14663, 12338, 7083; Payload ID: 10331 relates to Category No.: 7084, 1874, 14663, 12338, 10802, 7023, 7083; Payload ID: 10332 relates to Category No.: 15588, 9420, 7108, 7109, 7110, 7111; Payload ID: 10333 relates to Category No.: 15588, 14177, 9420, 7108, 7109, 7110, 7111; Payload ID: 10334 relates to Category No.: 15588, 14162, 9420, 7108, 7109, 7110, 7111; Payload ID: 10335 relates to Category No.: 15588, 11506, 3398, 9420, 7108, 7109, 15515, 7110, 7111; Payload ID: 10336 relates to Category No.: 15588, 9420, 7108, 7109, 7110, 7111; Payload ID: 10337 relates to Category No.: 15588, 9420, 7108, 7109, 7110, 7111; Payload ID: 10338 relates to Category No.: 9420, 7108, 7109, 7110, 7111, 15588; Payload ID: 10339 relates to Category No.: 15588, 9420, 7108, 7109, 7110, 7111; Payload ID: 10340 relates to Category No.: 15588, 9420, 7108, 7109, 7046, 7110, 7111; Payload ID: 10341 relates to Category No.: 15588, 9420, 7108, 7109, 7110, 7111, 14312; Payload ID: 10342 relates to Category No.: 15588, 9420, 7108, 7109, 7110, 7111; Payload ID: 10343 relates to Category No.: 15588, 9420, 7108, 7109, 7110, 7111; Payload ID: 10344 relates to Category No.: 15588, 14162, 9420, 7108, 7109, 7110, 7111; Payload ID: 10345 relates to Category No.: 15588, 9420, 7108, 7109, 7110, 7111; Payload ID: 10346 relates to Category No.: 15588, 9420, 7108, 7109, 7110, 7111; Payload ID: 10347 relates to Category No.: 15588, 9420, 7108, 7109, 7110, 7111; Payload ID: 10348 relates to Category No.: 15588, 9420, 7108, 7109, 7110, 7111; Payload ID: 10349 relates to Category No.: 15588, 9420, 7108, 7109, 7110, 7111; Payload ID: 10350 relates to Category No.: 15588, 9420, 7108, 7109, 7110, 7111; Payload ID: 10351 relates to Category No.: 15588, 9420, 7108, 7109, 7110, 7111; Payload ID: 10352 relates to Category No.: 9420, 7108, 7109, 7110, 7111; Payload ID: 10353 relates to Category No.: 15588, 9420, 7108, 7109, 7110, 7111; Payload ID: 10354 relates to Category No.: 9420, 7108, 7109, 7110, 7111, 15588; Payload ID: 10355 relates to Category No.: 15588, 9420, 7108, 7109, 7110, 7111; Payload ID: 10356 relates to Category No.: 15588, 9420, 7108, 7109, 7110, 7111; Payload ID: 10357 relates to Category No.: 15588, 14177, 9420, 7108, 7109, 7110, 7111; Payload ID: 10358 relates to Category No.: 15588, 9420, 7108, 7109, 7110, 7111; Payload ID: 10359 relates to Category No.: 9420, 7108, 7109, 7110, 7111; Payload ID: 10360 relates to Category No.: 9420, 1204, 7108, 7109, 7110, 7111; Payload ID: 10361 relates to Category No.: 15588, 9420, 7108, 7109, 7110, 7111; Payload ID: 10362 relates to Category No.: 674, 9420, 7108, 7109, 7110, 7111; Payload ID: 10363 relates to Category No.: 15588, 795, 1721, 9420, 7108, 7109, 7110, 7111; Payload ID: 10364 relates to Category No.: 15588, 9420, 7108, 7109, 7110, 7111; Payload ID: 10365 relates to Category No.: 15588, 9420, 7108, 7109, 7110, 7111; Payload ID: 10366 relates to Category No.: 14216, 3656, 14267, 9420, 7108, 7109, 7110, 7111; Payload ID: 10367 relates to Category No.: 9420, 7108, 7109, 7110, 7111; Payload ID: 10368 relates to Category No.: 9420, 1204, 7108, 7109, 7110, 7111; Payload ID: 10369 relates to Category No.: 15588, 9420, 1204, 7108, 7109, 7110, 7111; Payload ID: 10370 relates to Category No.: 9420, 7108, 7109, 7110, 7111; Payload ID: 10371 relates to Category No.: 15588, 9420, 7108, 7109, 7110, 7111; Payload ID: 10372 relates to Category No.: 9420, 7108, 7109, 7110, 7111; Payload ID: 10373 relates to Category No.: 15588, 9420, 7108, 7109, 7110, 7111; Payload ID: 10374 relates to Category No.: 15588, 9420, 7108, 7109, 7110, 7111; Payload ID: 10375 relates to Category No.: 9420, 7108, 7109, 7110, 7111; Payload ID: 10376 relates to Category No.: 9420, 7108, 7109, 7110, 7111; Payload ID: 10377 relates to Category No.: 15588, 9420, 7108, 7109, 7110, 7111; Payload ID: 10378 relates to Category No.: 7108, 15588; Payload ID: 10379 relates to Category No.: 15588, 9420, 7108, 7109, 7110, 7111; Payload ID: 10380 relates to Category No.: 9420, 1204, 7108, 7109, 7131, 10491, 7110, 7111; Payload ID: 10381 relates to Category No.: 15588, 14169, 6637, 151, 6360, 9420, 7108, 7109, 7110, 7111, 3313, 3132; Payload ID: 10382 relates to Category No.: 15588, 9420, 7108, 7109, 7110, 7111; Payload ID: 10383 relates to Category No.: 15588, 9420, 7108, 7109, 7110, 7111; Payload ID: 10384 relates to Category No.: 15588, 9420, 7108, 7109, 7110, 7111; Payload ID: 10385 relates to Category No.: 15588, 9420, 7108, 7109, 7110, 7111; Payload ID: 10386 relates to Category No.: 15588, 9420, 7108, 7109, 7110, 7111; Payload ID: 10387 relates to Category No.: 15588, 9420, 7108, 7109, 7110, 7111; Payload ID: 10388 relates to Category No.: 15588, 9420, 7108, 7109, 7110, 7111; Payload ID:

10389 relates to Category No.: 15588, 9420, 7108, 7109, 7110, 7111; Payload ID: 10390 relates to Category No.: 15588, 7108, 7131, 10491; Payload ID: 10391 relates to Category No.: 15588; Payload ID: 10392 relates to Category No.: 9420, 1204, 7108, 7109, 7110, 7111; Payload ID: 10393 relates to Category No.: 15588, 9420, 7108, 7109, 7110, 7111; Payload ID: 10394 relates to Category No.: 15588, 9420, 1204, 7108, 7109, 7110, 7111; Payload ID: 10395 relates to Category No.: 9420, 7108, 7109, 7110, 7111; Payload ID: 10396 relates to Category No.: 9420, 7108, 7109, 7110, 7111, 3313, 3132, 9630; Payload ID: 10397 relates to Category No.: 9420, 7108, 7109, 7110, 7111; Payload ID: 10398 relates to Category No.: 9420, 1204, 7108, 7109, 7110, 7111; Payload ID: 10399 relates to Category No.: 15588, 795, 9420, 7108, 7109, 7110, 7111; Payload ID: 10400 relates to Category No.: 9420, 7108, 7109, 7110, 7111; Payload ID: 10401 relates to Category No.: 15588, 9420, 7108, 7109, 7110, 7111; Payload ID: 10402 relates to Category No.: 7108, 9420, 7109, 7110, 7111; Payload ID: 10403 relates to Category No.: 9420, 7108, 7109, 7110, 7111, 3313, 3132; Payload ID: 10404 relates to Category No.: 15588, 9500, 9420, 7108, 7109, 7110, 7111, 84; Payload ID: 10405 relates to Category No.: 15588, 9420, 7108, 7109, 7110, 7111; Payload ID: 10406 relates to Category No.: 15588, 9420, 7108, 7109, 7110, 7111; Payload ID: 10407 relates to Category No.: 15588, 14169, 9420, 7108, 7109, 7110, 7111; Payload ID: 10408 relates to Category No.: 15588, 6637, 151, 6360, 9420, 7108, 7109, 7110, 7111, 3313, 3132; Payload ID: 10409 relates to Category No.: 9420, 7108, 7111, 14178, 15588; Payload ID: 10410 relates to Category No.: 14177, 13418, 13163; Payload ID: 10411 relates to Category No.: 6814, 14177, 13418, 13163; Payload ID: 10412 relates to Category No.: 14267, 3756; Payload ID: 10413 relates to Category No.: 9500, 4110, 4104; Payload ID: 10414 relates to Category No.: 13589, 3398, 9420, 4439, 7122, 15515, 3323, 3399, 15287, 15289; Payload ID: 10415 relates to Category No.: 13589, 3398, 15490, 3398, 15289; Payload ID: 10416 relates to Category No.: 13589, 3398, 15490, 3398, 8731, 3398, 6451, 6453; Payload ID: 10417 relates to Category No.: 13589, 3398, 14318, 1463, 4949, 12127, 15515, 14175; Payload ID: 10418 relates to Category No.: 13622, 15603, 9420, 7108, 7110, 14178; Payload ID: 10419 relates to Category No.: 15603, 9420, 7108, 7110, 14178; Payload ID: 10420 relates to Category No.: 15604, 7111, 13626; Payload ID: 10421 relates to Category No.: 15604, 9420, 7108, 7111; Payload ID: 10422 relates to Category No.: 15715, 15726, 7115; Payload ID: 10423 relates to Category No.: 934, 13755, 1874, 14663, 7028, 496, 13881; Payload ID: 10424 relates to Category No.: 934, 13755, 1874, 14663, 7028; Payload ID: 10425 relates to Category No.: 5297, 13755, 7039, 15880, 1874, 14663, 13969, 13882, 14025, 13867, 13874, 13827, 13796, 13971, 13966, 13837, 13794, 13938, 12197, 9411, 13858, 13813, 13881, 5328, 13809; Payload ID: 10426 relates to Category No.: 9500, 5297, 13755, 15521, 1874, 14663, 4439, 486, 9506, 496, 13975, 13829, 13813, 2235; Payload ID: 10427 relates to Category No.: 5297, 13755, 15521, 1874, 14663, 4439, 3555, 7039, 2869, 13812, 5998; Payload ID: 10428 relates to Category No.: 5297, 13755, 15521, 1874, 14663, 4439, 13754, 485; Payload ID: 10429 relates to Category No.: 9500, 7039, 7508, 13755, 1874, 14663, 13969, 13827, 13878; Payload ID: 10430 relates to Category No.: 9500, 7039, 7508, 13755, 1874, 14663, 12397; Payload ID: 10431 relates to Category No.: 9500, 7039, 7508, 13755, 1874, 14663, 13874, 13975, 1982, 13920; Payload ID: 10432 relates to Category No.: 9500, 7039, 7508, 13755, 1874, 14663, 933, 13882, 496, 13837, 13961, 2235, 5406; Payload ID: 10433 relates to Category No.: 9500, 7039, 7508, 13755, 1874, 14663, 933; Payload ID: 10434 relates to Category No.: 9500, 7039, 7508, 13755, 1874, 14663, 933, 13882, 13971, 13877; Payload ID: 10435 relates to Category No.: 9500, 13755, 1874, 14663, 13811, 13961, 13877; Payload ID: 10436 relates to Category No.: 11025, 12127, 726, 13164, 2006, 1034, 2118, 14095, 1989; Payload ID: 10437 relates to Category No.: 6814, 7045, 6451, 6453; Payload ID: 10438 relates to Category No.: 795, 8552, 12127, 7045, 14033, 1238, 12043, 6451, 6453, 7063, 8636, 7120, 1228, 1464, 6814; Payload ID: 10439 relates to Category No.: 12091, 1026, 15490, 3398, 14661, 14565, 795, 1721, 10074, 15149, 5446, 6606, 348, 9713, 345, 4186, 12746, 7362, 12391, 2311, 4127, 4130, 3775, 16197, 14015, 5541, 16085, 8988, 1238, 15003, 15456, 15450, 7363, 15448, 15443, 1995, 15454, 13376, 13460, 3846, 15446, 15653, 15457, 15458, 5911, 15451, 9716, 11176, 12671, 12788, 13516, 13833, 1662, 12927, 3838, 1070, 1955, 13925, 9410, 9476, 15400, 13840, 4949, 15207, 6323, 1128, 6248, 7730, 15402, 2930, 1991, 5985, 6384, 4066, 6562, 8865, 15480, 1573, 11506, 3398, 10366, 14025, 10372, 13836, 14454, 2080, 11546, 6608; Payload ID: 10441 relates to Category No.: 12091, 14565, 5446, 345, 7362, 4127, 15003, 5912, 15456, 15450, 7363, 15448, 15443, 15454, 13460, 15446, 15653, 15457, 15458, 15451, 12717, 14123, 13921, 6606; Payload ID: 10442 relates to Category No.: 12091, 15490, 3398, 5785, 14565, 13186, 5446, 345, 7362, 12391, 9420, 10648, 4439, 14015, 16085, 8988, 15003, 7122, 15456, 15450, 7363, 15448, 15443, 15454, 13460, 2145, 10830, 15446, 15653, 15457, 15458, 7334, 11053, 15451, 12593, 7701; Payload ID: 10443 relates to Category No.: 12091, 6606, 13589, 3398, 15490, 3398, 14565, 1722, 9713, 7345, 12391, 9420, 16085, 8988, 11169, 7122, 7334, 11053, 3310, 7381, 7724; Payload ID: 10444 relates to Category No.: 12091, 13589, 3398, 15490, 3398, 5785, 1721, 6606, 9713, 12391, 14015, 16085, 8988, 10790, 10851, 13973; Payload ID: 10445 relates to Category No.: 12091, 13594, 15490, 3398, 5785, 14565, 795, 13186, 10074, 5446, 9713, 345, 1795, 7362, 12391, 2311, 9420, 10648, 4439, 16085, 8988, 2041, 11307, 1238, 15003, 2022, 7122, 15456, 15450, 7363, 15448, 15443, 15454, 13460, 9538, 2145, 10830, 15446, 15653, 15457, 15458, 7252, 7334, 11053, 2143, 15451, 9459, 12739, 10586, 11063, 14571, 137, 11062, 11069, 10461, 15006, 13589, 3398, 11512, 1955, 13925, 690, 14636, 4538, 6248, 10666, 1764, 7693, 2376, 10036, 3309, 1621, 13956, 4112, 10293, 13952, 10321, 11259, 15610, 7382, 15011, 11858, 13860, 6606; Payload ID: 10446 relates to Category No.: 12091, 6606, 11858; Payload ID: 10447 relates to Category No.: 12091, 1026, 14661, 11512, 9982, 795, 1721, 2885, 15516, 10074, 9717, 5446, 6606, 348, 345, 4186, 12746, 7362, 1257, 12391, 4127, 4130, 3775, 11285, 4439, 16197, 5541, 16085, 8988, 1238, 15003, 5659, 15456, 15450, 7363, 15448, 15443, 1995, 15454, 13460, 10583, 15446, 15653, 15457, 15458, 2051, 5911, 15451, 3310, 15520, 12671, 12788, 10735, 10756, 13516, 13833, 10461, 1662, 12927, 1955, 13925, 9410, 9476, 15400, 13840, 15490, 3398, 1622, 1128, 6248, 3846, 14454, 15402, 6384, 4066, 8865, 15480, 1573, 7610, 11506, 3398, 14025, 815, 9713, 11546, 11884, 6608; Payload ID: 10448 relates to Category No.: 12091, 1721, 6606; Payload ID: 10449 relates to Category No.: 12091, 14565, 1721, 6606; Payload ID: 10450 relates to Category No.: 12091, 11512, 14565, 1721, 1730, 5446, 7362, 8988, 8112, 15003, 1477, 15456, 15450, 7363, 15448, 15443, 15454, 15446, 15653, 15457, 15458, 2131, 7919, 15451, 7966, 1993, 8431, 8069, 11279, 8575, 2029, 2001, 7832, 11523, 7689, 6606, 9713, 7613, 8255, 12488, 8388, 7947; Payload ID: 10451 relates to Category No.: 12091, 6606, 795, 7613, 5446, 10238, 9713, 3354, 14034, 803, 3448, 7362, 4127, 11765, 10648, 14015, 8988, 2041, 15003, 5912, 15456, 15450, 7363, 15448, 15443, 15454, 12970, 13460, 15446, 15653, 15457, 15458, 2051, 5806, 8507, 15451, 9716, 12717, 14123, 11279, 13363, 11260, 10489, 10461, 5918, 12891, 10241, 9451, 2001, 11213, 13794, 2070, 11766, 10508; Payload ID: 10452 relates to Category No.: 16172, 11371, 13049, 7834, 13589, 3398, 14565, 8175, 5918, 7613, 8193, 8192; Payload ID: 10453 relates to Category No.: 6606, 13532, 4588, 360, 13049, 14556, 14729, 3041, 3971, 12483, 13398, 13252, 1112, 9089, 5912, 6629, 11419; Payload ID: 10454 relates to Category No.: 16172, 344, 13049, 5406, 11634, 12891, 1026, 4251, 11997, 13756, 6371, 6384, 10879, 5912; Payload ID: 10455 relates to Category No.: 12091, 5446, 7362, 4127, 10648, 14015, 15003, 5912, 15456, 15450, 7363, 15448, 15443, 15454, 13460, 15446, 15653, 15457, 15458, 15451, 12717, 10946, 14123, 10241, 11213, 13794, 11506, 3398, 2041, 2014, 13936, 2136, 14025, 13827, 10238, 13970, 11285, 2139, 12127, 13049, 1993, 8936, 13772, 2169, 13692, 334, 5918, 10369, 11230, 13383, 11231, 10415, 10470, 11111, 11114, 6606, 9982; Payload ID: 10456 relates to Category No.: 8552, 5446, 4186, 9891, 4127, 3775, 16085, 8988, 15042, 15192; Payload ID: 10457 relates to Category No.: 343; Payload ID: 10458 relates to Category No.: 12091, 1026, 14661, 14565, 1722, 9720, 8929, 5446, 6606, 348, 345, 7743, 4186, 7362, 12391, 2311, 4127, 3775, 10648, 5541, 16085, 8988, 15003, 15456, 15450, 7363, 15448, 15443, 15454, 11291, 8004, 15446, 15653, 15457, 15458, 7252, 7131, 15451, 2158, 12788, 13516, 12927, 15400, 4949, 1128, 13371, 10261, 3846, 5986, 5939, 10358, 15402, 2215, 1767, 12525, 6384, 4066, 10035, 15480, 3802; Payload ID: 10459 relates to Category No.: 12091, 1026, 14661, 9720, 5446, 6606, 348, 345, 4186, 12391, 4127, 3775, 5541, 16085, 8988, 11291, 8004, 3846, 12788, 9709, 13516, 12927, 15400, 4949, 13371, 10261, 15402, 12525, 6384, 4066, 15480, 10370, 3802; Payload ID: 10460 relates to Category No.: 13166, 14569, 15004, 12498, 345, 12091, 14565, 9720, 5446, 11506, 3398, 7362, 15003, 15456, 15450, 7363, 15448, 15443, 15454, 15446, 15653, 15457, 15458, 11265, 15451, 6606, 5428, 1562, 12736; Payload ID: 10461 relates to Category No.: 12091, 14565, 9720, 795, 5446, 344, 7362, 4127, 15003, 5912, 15456, 15450, 7363, 15448, 15443, 15454, 15446, 15653, 15457, 15458, 2051, 15451, 6606, 14050, 8331; Payload ID: 10462 relates to Category No.: 12091, 11512, 14565, 9720, 8739, 345, 7840, 8988, 8390, 7738, 7966, 1993, 8069, 8162, 11279, 8575, 2029, 7785, 6606, 4949, 10362, 10574, 3847; Payload ID: 10463 relates to Category No.: 12091, 13589, 3398, 15490, 3398, 14565, 1722, 9720, 5446, 13166, 14569, 15004, 12498, 345, 7362, 15003, 15456, 15450, 7363, 15448, 15443, 15454, 15446, 15653, 15457, 15458, 7334, 11053, 15451, 3310, 9292, 6125, 9295, 6606, 1562, 13909, 13827, 10238, 9491, 11285, 795, 11231, 11114, 2115; Payload ID: 10464 relates to Category No.: 12091, 14565, 9720, 795, 5446, 14034, 344, 7362, 4127, 15003, 5912, 15456, 15450, 7363, 15448, 15443, 15454, 13867, 14029, 15446, 15653, 15457, 15458, 13973, 15451, 14050, 14015, 13180, 11089, 11285, 2115; Payload ID: 10465 relates to Category No.: 12091, 5446, 13166, 12498, 7362, 4127, 360, 15003, 15456, 15450, 15443, 15454, 15446, 15457, 15458, 2051, 15451, 12638, 16294, 1463, 793, 3799, 344, 15570, 10192, 7241, 343, 5912, 4065; Payload ID: 10466 relates to Category No.: 12091, 14565, 795, 8731, 3398, 9713, 344, 14699, 10878, 5912, 11858, 8611, 10879, 9716, 343, 10238, 1727; Payload ID: 10467 relates to Category No.: 12091, 6986, 9720, 345, 344, 1780, 10878, 5912, 11858, 10879, 10238, 11089, 1727, 343; Payload ID: 10468 relates to Category No.: 12091, 5785, 348, 9713, 5912, 11858, 7131, 9716, 5221, 8331; Payload ID: 10469 relates to Category No.: 12091, 348, 11109, 5912, 11858; Payload ID: 10470 relates to Category No.: 12091, 5367, 5446, 6606, 348, 13166, 14569, 15004, 5359, 9038, 12498, 345, 10775, 14992, 15782, 2051, 15192; Payload ID: 10471 relates to Category No.: 12091, 6606, 348; Payload ID: 10472 relates to Category No.: 12091, 348, 13166, 12498, 360, 15003; Payload ID: 10473 relates to Category No.: 12091, 345, 11506, 3398, 344, 2051, 348, 6606; Payload ID: 10474 relates to Category No.: 12091, 5785, 6606, 348, 345, 10775, 11858, 1240, 11163; Payload ID: 10475 relates to Category No.: 12091, 5785, 6606, 348, 345, 10879, 11163, 14037, 12891, 10036, 2397, 6527; Payload ID: 10476 relates to Category No.: 12091, 5446, 10238, 6606, 348, 803, 344, 16197, 10878, 13831, 5912, 10470, 10879, 5810, 5814, 11090, 2001, 345, 11062, 9538, 12626, 11766, 2106, 13909, 11285; Payload ID: 10477 relates to Category No.: 13166, 14569, 15004, 12498, 12091, 14565, 348, 344; Payload ID: 10478 relates to Category No.: 12091, 15490, 3398, 15207, 795, 5446, 348, 5359, 11109, 345, 1795, 7362, 10775, 4127, 14992, 15782, 5146, 15003, 352, 5912, 15456, 15450, 7363, 15448, 15443, 15454, 5361, 15446, 15653, 15457, 15458, 10879, 15451, 11445, 9292, 6125, 9295, 11451, 10840, 14565, 6606, 690, 15570, 13397, 8889, 10878, 7618, 8588; Payload ID: 10479 relates to Category No.: 12091, 14565, 1721, 5446, 348, 13166, 14569, 15004, 12498, 7362, 360, 15003, 15456, 15450, 7363, 15448, 15443, 15454, 15446, 15653, 15457, 15458, 15192, 15451; Payload ID: 10480 relates to Category No.: 12091, 13589, 3398, 15490, 3398, 9720, 795, 344, 11858, 343, 10238, 1727, 6606, 348; Payload ID: 10481 relates to Category No.: 12091; Payload ID: 10482 relates to Category No.: 12091, 5367, 5785, 5446, 13166, 12498, 344, 349, 10878, 5912, 16167, 6606; Payload ID: 10483 relates to Category No.: 12091, 5785, 13166, 12498, 14034, 349, 360, 5912, 14029, 6606; Payload ID: 10484 relates to Category No.: 12091, 6606, 13166, 15004, 360, 8940, 5785, 7613, 13049; Payload ID: 10485 relates to Category No.: 12091, 6606, 13166, 15004, 12498, 349; Payload ID: 10486 relates to Category No.: 12091, 9720, 348, 344, 11858; Payload ID: 10487 relates to Category No.: 12091, 5785, 1722, 1730, 10238, 348, 13996, 1727, 344, 1780, 3309, 14015, 1723, 2940; Payload ID: 10488 relates to Category No.: 12091, 5428, 13186, 5446, 1955, 6606, 9713, 13818, 345, 7362, 12391, 14663, 4439, 14015, 16085, 8988, 13925, 15003, 11858, 15456, 15450, 7363, 15448, 15443, 815, 1995, 15454, 15446, 15653, 15457, 15458, 2143, 15451, 4335, 12671, 13024, 13634, 137, 6154, 6474, 7292, 9538, 11565, 5458; Payload ID: 10489 relates to Category No.: 12091, 14565, 5446, 6606, 9713, 13818, 345, 1795, 7362, 12391, 14015, 16085, 8988, 13925, 15003, 11858, 15456, 15450, 7363, 15448, 15443, 15454, 15446, 15653, 15457, 15458, 15451, 6474; Payload ID: 10490 relates to Category No.: 12091, 14565, 6606, 9713, 345, 8728, 1795, 12391, 13618, 11858, 15006; Payload ID: 10491 relates to Category No.: 4391; Payload ID: 10494 relates to Category No.: 1737, 7154; Payload ID: 10495 relates to Category No.: 11512, 4949, 3246, 3641, 4969, 4418, 3643, 8061, 10988, 15517, 1758, 3642, 4998, 13589, 3398; Payload ID: 10496 relates to Category No.: 12091, 11765, 7548, 11766, 11942; Payload ID: 10497 relates to Category No.: 15490, 3398, 11512, 7345, 14688, 11423, 5406, 1249, 12891, 11506, 3398, 4949, 6269, 4953, 1567, 3602, 4439, 7710; Payload ID: 10499 relates to Category No.: 15490, 3398, 12585, 9238, 13589, 3398; Payload ID: 10500 relates to Category No.: 13594, 13589, 3398, 15490, 3398, 11512, 5785, 7725, 10372, 8731, 3398, 674, 11506, 3398, 1927, 14663, 10609, 15662, 3728, 12813, 10390, 10682, 8446, 4535, 12863, 10910, 4108, 8428, 4537, 8739; Payload ID: 10501 relates to Category No.: 13589, 3398, 15490, 3398, 8739, 8731, 3398, 14663, 3728, 10390, 9238; Payload ID: 10503 relates to Category No.: 15490, 3398, 9296, 1955, 3354, 11506, 3398, 3336, 14663, 5874, 13874, 2429, 9966; Payload ID: 10504 relates to Category No.: 3452, 13729; Payload ID: 10505 relates to Category No.: 12091, 13594, 15499, 11512, 1721, 15516, 9296, 15517, 3354, 12732, 15521, 1780, 11884, 4439, 16197, 7132, 4336, 4332, 182, 12891, 3783, 15533, 11611, 8004, 3783, 15520, 15498, 15290, 4485, 13589, 3398, 13796, 482, 16138, 7613, 11391; Payload ID: 10506 relates to Category No.: 15626; Payload ID: 10507 relates to Category No.: 5072; Payload ID: 10508 relates to Category No.: 5072, 11858, 11201; Payload ID: 10509 relates to Category No.: 274, 11094, 11285; Payload ID: 10513 relates to Category No.: 5808, 10238, 803, 4040, 11322, 4041, 11957; Payload ID: 10514 relates to Category No.: 12648, 10648, 6145, 7252, 3876, 12649, 4469, 3878, 2125, 13093, 6137, 6753, 13273, 11274, 10392, 10536, 11213; Payload ID: 10515 relates to Category No.: 13589, 3398, 7345, 8739, 12891, 10648, 2571, 8352, 15279, 10446, 15276, 15278; Payload ID: 10516 relates to Category No.: 12091, 14565, 12619; Payload ID: 10517 relates to Category No.: 14663, 7207, 16234, 16275, 7200, 7201; Payload ID: 10518 relates to Category No.: 14663, 7207, 16234, 16275, 7200, 6814; Payload ID: 10519 relates to Category No.: 14663, 7207, 16234, 16275, 7200; Payload ID: 10520 relates to Category No.: 14663, 15726, 7207, 12157, 15719, 16234, 16275, 15725, 3750, 7200; Payload ID: 10521 relates to Category No.: 16172, 12105; Payload ID: 10522 relates to Category No.: 16172; Payload ID: 10523 relates to Category No.: 12137, 10702, 16172, 4770; Payload ID: 10524 relates to Category No.: 4634, 15660, 3216; Payload ID: 10525 relates to Category No.: 4634, 15660, 6219, 3216, 5751; Payload ID: 10526 relates to Category No.: 4634, 15660; Payload ID: 10527 relates to Category No.: 16308, 9500, 8977, 15149, 14663, 8971, 8970, 1833, 3427, 14509, 9799; Payload ID: 10528 relates to Category No.: 16308, 9500, 14663, 15042, 5299, 3427, 13925, 14025, 13827, 13837, 13815, 14011, 14004, 8615, 13771, 10529; Payload ID: 10529 relates to Category No.: 12091, 11091, 2888, 11265, 13363; Payload ID: 10530 relates to Category No.: 12091, 11091, 11265, 11305, 13363, 2888; Payload ID: 10531 relates to Category No.: 6219, 5428, 10074, 13465, 12999, 4104, 9945, 14663, 15661, 1238, 815, 4653, 392, 13459, 393, 12796, 12522, 6299; Payload ID: 10532 relates to Category No.: 9500; Payload ID: 10533 relates to Category No.: 1730, 7306, 14838; Payload ID: 10534 relates to Category No.: 4110; Payload ID: 10535 relates to Category No.: 12091, 9713, 12117, 1709, 6508, 7990; Payload ID: 10544 relates to Category No.: 13589, 3398, 2409, 15490, 3398, 3452, 2411, 2410, 5113, 12936, 2412, 5182, 5131, 1780; Payload ID: 10545 relates to Category No.: 15490, 3398, 2411, 3354, 2410, 5113, 12936, 2412, 5182, 5131, 13589, 3398, 2409, 11512, 11421; Payload ID: 10546 relates to Category No.: 11512, 8739; Payload ID: 10548 relates to Category No.: 4949; Payload ID: 10549 relates to Category No.: 4828, 1816; Payload ID: 10550 relates to Category No.: 4828, 3244; Payload ID: 10551 relates to Category No.: 13594, 13589, 3398, 15490, 3398, 674, 5285, 8940, 3632, 14885, 11634, 8934, 8929, 13757, 3444, 9554, 7251, 3228, 8854, 2177, 1766; Payload ID: 10552 relates to Category No.: 13589, 3398, 15490, 3398, 5446, 4186, 9891, 4127, 9125, 3775, 8988, 7276; Payload ID: 10553 relates to Category No.: 7306, 14838, 4439, 4442, 10031, 4458; Payload ID: 10554 relates to Category No.: 14318, 14267, 14271, 8454, 14271, 16183; Payload ID: 10555 relates to Category No.: 6631; Payload ID: 10556 relates to Category No.: 15490, 3398, 8731, 3398, 12772; Payload ID: 10558 relates to Category No.: 1737, 7154; Payload ID: 10559 relates to Category No.: 10074, 1795, 1780, 1238, 15381, 10648, 7613, 5242, 3023, 10086, 13510, 13508, 12691, 2885; Payload ID: 10560 relates to Category No.: 12194; Payload ID: 10561 relates to Category No.: 5458, 7046, 5244, 13397, 4490, 2107; Payload ID: 10562 relates to Category No.: 12397, 8313, 8092; Payload ID: 10563 relates to Category No.: 11024, 7098; Payload ID: 10564 relates to Category No.: 9228, 3452, 5446, 1955, 3354, 12431, 3320, 3353, 3448, 5805, 1089, 14612, 3336, 16197, 3453, 10887, 11573, 15261, 3455, 11240, 13172, 7885, 15144, 1780, 2424, 7150, 4949, 8817, 6670; Payload ID: 10565 relates to Category No.: 13594, 5095, 13589, 3398, 15490, 3398, 2410, 12936; Payload ID: 10567 relates to Category No.: 15618, 1649, 6480, 7059; Payload ID: 10568 relates to Category No.: 14177; Payload ID: 10570 relates to Category No.: 13589, 3398, 1764, 9321, 7735, 12117, 4067, 12036, 10516, 14566, 10865, 3599, 8739, 15517, 11512, 5406, 724, 8731, 3398, 7743, 7613, 7001, 9320, 3812, 4949, 4251, 3578, 9540, 10286, 14944, 7345, 4953, 7879, 1274, 8753, 3595, 3584, 14577, 1625, 3594, 6563, 13264, 8664, 6995, 3813, 10982, 6777, 1258, 350; Payload ID: 10571 relates to Category No.: 13589, 3398, 8739, 8731, 3398, 8753, 9455, 2755, 724, 7743, 16294, 7613, 9480, 9320, 1993, 12498, 9454, 1622, 3578, 10286, 8195, 14944, 9451, 1274, 3595, 2374, 3584, 14577, 10330, 11147, 1257, 7971, 3594, 1964, 1313, 6563, 16294, 14927, 4294, 3615, 7831, 3813, 9481, 1278, 10982, 3629, 3599, 1258, 350, 10238, 15517, 10356; Payload ID: 10572 relates to Category No.: 7018; Payload ID: 10573 relates to Category No.: 14729; Payload ID: 10574 relates to Category No.: 1722, 5446, 12459, 4186, 9891, 15521, 4127, 3775, 4439, 5541, 16085, 8988, 6451, 1995, 11502, 15192, 12671, 11178, 10192, 12942; Payload ID: 10586 relates to Category No.: 3313, 14568, 9324, 1893, 3313, 14567, 11660, 12068, 8732, 7721, 8178, 11523, 13600, 10751, 2110, 13882, 4145, 3791, 5406; Payload ID: 10587 relates to Category No.: 12633, 9324, 1893, 11660, 12068; Payload ID: 10588 relates to Category No.: 6494, 9324, 1893, 11660, 12068; Payload ID: 10589 relates to Category No.: 9324, 1893, 11660, 12068; Payload ID: 10591 relates to Category No.: 9324, 1893, 11660, 12068, 1856; Payload ID: 10593 relates to Category No.: 11940, 9324, 1893, 11660, 12068, 345, 5022; Payload ID: 10594 relates to Category No.: 9324, 1893, 11660, 12068, 7750, 7755; Payload ID: 10596 relates to Category No.: 9324, 1893, 11660, 12068; Payload ID: 10597 relates to Category No.: 1820; Payload ID: 10598 relates to Category No.: 9891, 9324, 1893, 11660, 12068, 4012, 6497; Payload ID: 10599 relates to Category No.: 9324, 1893, 11660, 12068, 3013, 13096; Payload ID: 10600 relates to Category No.: 6494, 9324, 1893, 11660, 12068; Payload ID: 10601 relates to Category No.: 9324, 1893, 11660, 12068; Payload ID: 10602 relates to Category No.: 9324, 1893, 11660, 12068; Payload ID: 10603 relates to Category No.: 15618, 5846, 1415, 1862, 1651, 15547, 13695; Payload ID: 10604 relates to Category No.: 15618, 5846, 1415; Payload ID: 10605 relates to Category No.: 15618, 5846, 1415, 986, 6296; Payload ID: 10606 relates to Category No.: 5367, 14565, 1703, 1820, 5592, 12405, 12994, 4021, 6149, 5041, 10904, 6145, 5939, 496; Payload ID: 10607 relates to Category No.: 13166, 13259, 15490, 3398, 11512, 1721, 2459, 12775, 7245, 2184, 7318; Payload ID: 10608 relates to Category No.: 1703, 10074, 1238, 10080; Payload ID: 10609 relates to Category No.: 690, 8805, 7738; Payload ID: 10610 relates to Category No.: 1451; Payload ID: 10611 relates to Category No.: 7306, 1451; Payload ID: 10612 relates to Category No.: 12137, 3833, 12063, 2669, 1893, 6738, 11660; Payload ID: 10613 relates to Category No.: 5256, 7333, 13193, 14629, 14631, 14634, 13481, 12433; Payload ID: 10614 relates to Category No.: 14058, 5256; Payload ID: 10615 relates to Category No.: 1204; Payload ID: 10616 relates to Category No.: 12891, 1257, 3595, 6194, 10258, 3170, 1758, 3613, 4091, 3591, 2756, 3768, 3590, 6108, 3172, 3176, 2705; Payload ID: 10617 relates to Category No.: 1204; Payload ID: 10618 relates to Category No.: 15490, 3398, 14661, 11512, 8739, 8731, 3398, 1955, 6606, 3354, 14034, 7743, 8421, 5202, 15521, 13856, 4439, 15570, 7724, 9454, 8535, 11542, 11242, 8611, 7835, 8192, 8692, 1984, 1295, 14026, 2088, 7132, 3010, 7939, 7755, 15806, 13638, 12474, 7726; Payload ID: 10619 relates to Category No.: 3100, 14663, 1272, 9451, 5501, 10149; Payload ID: 10620 relates to Category No.: 16197, 1703, 7369; Payload ID: 10621 relates to Category No.: 12137, 12818, 11609, 15899, 16205, 13669; Payload ID: 10622 relates to Category No.: 12137, 12818, 11609, 15899, 16205; Payload ID: 10623 relates to Category No.: 1238, 13690, 2264, 8638; Payload ID: 10624 relates to Category No.: 9228, 3354, 3452, 3448, 3305, 3656, 5750, 13903, 3336; Payload ID: 10625 relates to Category No.: 8862; Payload ID: 10626 relates to Category No.: 14943; Payload ID: 10627 relates to Category No.: 14661, 12137, 5782, 14565, 274, 7306, 7345, 9238, 12391; Payload ID: 10628 relates to Category No.: 12091, 9720, 1730, 15614, 7306, 11285, 10648, 4021, 8918, 11858, 6758, 13529, 14617, 11252, 13589, 3398, 12405, 11089; Payload ID: 10629 relates to Category No.: 8862, 14271, 13445, 3595, 5406, 7381, 12484, 16182, 14636, 7290; Payload ID: 10630 relates to Category No.: 7288, 14271, 13445; Payload ID: 10631 relates to Category No.: 7288, 7306, 14271, 13445, 8352; Payload ID: 10632 relates to Category No.: 15490, 3398, 1730, 7345, 12891; Payload ID: 10633 relates to Category No.: 8739, 7703; Payload ID: 10634 relates to Category No.: 15517, 8739, 9540, 3228, 1321; Payload ID: 10636 relates to Category No.: 14565, 12648, 1820, 275; Payload ID: 10637 relates to Category No.: 14565, 16286, 7693, 7939, 3900, 7938; Payload ID: 10638 relates to Category No.: 7018, 3354, 14776, 1955, 15144, 14838, 9379, 5808, 12431, 14779, 3453, 5253, 6696, 5901, 6532, 6674, 9224, 13743, 14780, 6533, 4140, 6684, 8321, 6694; Payload ID: 10639 relates to Category No.: 7018, 12431, 1955, 11997, 6532, 15174, 4141; Payload ID: 10640 relates to Category No.: 7018, 14052, 3354, 6686, 12431, 14776, 5901, 1060, 3448, 6683, 14036, 5805, 5809, 8563, 11648, 8373, 6530, 14779, 6491, 7887, 10714, 1064, 5406, 1955, 5808, 1722, 4458, 9506, 14780, 3167; Payload ID: 10641 relates to Category No.: 7018, 3354, 6686, 12431, 14779, 6491, 7887, 10714; Payload ID: 10642 relates to Category No.: 7018, 12431, 5253, 2315, 15144, 14838, 9485, 6687, 4134; Payload ID: 10643 relates to Category No.: 12431, 5253, 2315, 7018; Payload ID: 10644 relates to Category No.: 5808, 6686, 12431, 14034, 14776, 5901, 7018, 3354, 16197, 5806, 3167, 14779, 7887, 10714, 10873; Payload ID: 10645 relates to Category No.: 6814, 7018, 3354, 1089, 1089, 762, 3102, 13975; Payload ID: 10646 relates to Category No.: 6814, 14565, 14038, 795, 2885, 5446, 3021, 3012, 8818, 15817, 14030; Payload ID: 10647 relates to Category No.: 6814, 12137, 14038, 12619, 2885, 3021, 3012, 7295, 15817, 13890, 13260; Payload ID: 10648 relates to Category No.: 15490, 3398, 3304, 13589, 3398, 8731, 3398, 2467, 1983, 9238, 10350, 5807, 9455, 10228, 13755; Payload ID: 10649 relates to Category No.: 12891; Payload ID: 10653 relates to Category No.: 15490, 3398, 11512, 2411, 7229, 12638, 12947; Payload ID: 10654 relates to Category No.: 15490, 3398, 8739, 13594; Payload ID: 10655 relates to Category No.: 15517, 13589, 3398, 13594, 14056, 13888, 13971, 8004, 2088, 2116, 8923, 13787, 11884; Payload ID: 10656 relates to Category No.: 13589, 3398, 15490, 3398, 14838; Payload ID: 10657 relates to Category No.: 13589, 3398, 15490, 3398, 12153, 8508, 13363, 7251, 12746, 2178, 1766, 1322; Payload ID: 10658 relates to Category No.: 15490, 3398, 9500, 14177, 8739; Payload ID: 10660 relates to Category No.: 15521, 15291; Payload ID: 10661 relates to Category No.: 1730, 15149, 7306, 14838; Payload ID: 10663 relates to Category No.: 1703, 12526, 8988, 1238, 15042, 6145, 7640, 11055, 8862, 2051, 8375, 8378, 10248; Payload ID: 10664 relates to Category No.: 5367, 15149, 2169, 7369, 15042, 1022, 14025, 6738, 13989, 496, 13938, 14029, 13843, 7640; Payload ID: 10665 relates to Category No.: 15490, 3398, 8929, 7417; Payload ID: 10666 relates to Category No.: 1703, 2169, 16189; Payload ID: 10667 relates to Category No.: 15149, 1813, 7613; Payload ID: 10668 relates to Category No.: 15614, 1816, 14565; Payload ID: 10669 relates to Category No.: 5255, 674, 14589, 15195; Payload ID: 10670 relates to Category No.: 1703, 4021, 4934; Payload ID: 10671 relates to Category No.: 12194, 13589, 3398, 15490, 3398, 11506, 3398, 2173, 9350, 9349, 11055, 2174; Payload ID: 10672 relates to Category No.: 13589, 3398; Payload ID: 10673 relates to Category No.: 13589, 3398, 8862, 15490, 3398, 1730, 11634, 10648, 8004, 13005, 3632, 3228, 1853, 12987; Payload ID: 10674 relates to Category No.: 8862, 13589, 3398, 15490, 3398, 1730; Payload ID: 10675 relates to Category No.: 8862; Payload ID: 10677 relates to Category No.: 5808, 8175, 12498, 13818, 7306, 4040, 1743, 7966, 7600, 12135, 13420, 1856, 11160, 7613, 793; Payload ID: 10678 relates to Category No.: 13589, 3398, 15490, 3398, 1070, 1955, 10238, 7644, 1849; Payload ID: 10679 relates to Category No.: 14565, 5428, 7362, 10775, 7613, 5446, 1795, 12999, 8988, 3016, 15456, 15450, 15443, 15454, 11573, 13893, 10851, 15446, 15457, 15458, 2051, 15451, 10835, 10842, 137, 12646, 5381, 13925, 11566, 6248, 13634, 10878, 8045, 14038, 3877, 11109, 10934, 13982, 13024, 15813, 13948, 5419, 10414, 13243, 12689, 12690, 2885, 11391, 5912, 15441; Payload ID: 10680 relates to Category No.: 15490, 3398, 1722, 7379; Payload ID: 10681 relates to Category No.: 3012; Payload ID: 10682 relates to Category No.: 13589, 3398, 11512, 8739, 15517; Payload ID: 10683 relates to Category No.: 13589, 3398, 15517, 8522; Payload ID: 10684 relates to Category No.: 15490, 3398, 11512; Payload ID: 10685 relates to Category No.: 10238, 11506, 3398, 11322, 4039, 5806, 11013; Payload ID: 10686 relates to Category No.: 13589, 3398, 15490, 3398, 7693, 11620, 10038, 724, 14417; Payload ID: 10687 relates to Category No.: 14565, 10702, 1703, 1816, 1814, 450, 1749, 3877, 2243, 8900, 5242, 15247, 1296, 13267, 449, 12373; Payload ID: 10689 relates to Category No.: 10366, 7567, 8004, 8535, 3876, 6746, 8069, 11425, 12129, 8525; Payload ID: 10691 relates to Category No.: 690, 11512, 795, 7613, 3684, 11285, 1893, 10558, 10955, 11187, 11266, 5855, 10226; Payload ID: 10694 relates to Category No.: 9500, 13975, 7613, 3012, 5300, 6340, 14053, 5329, 13748, 13700, 8045, 3014, 13925, 13936, 496, 13851, 13862; Payload ID: 10696 relates to Category No.: 5785; Payload ID: 10697 relates to Category No.: 13259, 10320, 11512, 15517, 7743, 11506, 3398, 13882, 11392, 11363, 7835, 1557, 11526, 11389, 13487, 7648, 1590, 14688, 12968, 11528, 10326, 8623, 8739, 13594, 16096, 10372, 4949, 3246, 8356, 10513, 7334, 11542, 6371, 16131, 13205, 16041, 3493, 1583, 16019, 12634, 7698, 1845, 2006, 1993, 5014, 1747; Payload ID: 10698 relates to Category No.: 13105, 2526, 10366, 1269, 8936, 7370, 11187, 11266, 11418, 7754, 8661, 9455, 9092, 11425, 10629, 8584, 11013, 14626, 3841; Payload ID: 10699 relates to Category No.: 13589, 3398, 15490, 3398, 11512, 795, 8739, 5446, 15517, 6606, 4949, 7345, 7362, 8988, 15003, 15456, 15450, 7363, 15448, 15443, 3041, 7046, 15454, 1547, 15446, 15653, 15457, 15458, 7334, 11053, 15451, 1922, 7119, 16134, 3847, 11506, 3398; Payload ID: 10700 relates to Category No.: 13589, 3398, 15490, 3398, 11512, 15517, 7345; Payload ID: 10701 relates to Category No.: 8862, 13589, 3398, 11091, 11512, 14038, 795, 1070, 8739, 8929, 5446, 15517, 6606, 10266, 4949, 5285, 1066, 11506, 3398, 6705, 7345, 8928, 7362, 13532, 4588, 8373, 4461, 1061, 2376, 10648, 8988, 2041, 15003, 15456, 13227, 15450, 7363, 15448, 15443, 13530, 1250, 15454, 10320, 8004, 15446, 15653, 15457, 15458, 10287, 11147, 11377, 1957, 2131, 9480, 4952, 7334, 11053, 15451, 8934, 3971, 3631, 1971, 14636, 13718, 4503, 8851, 3805, 1922, 1240, 6103, 9455, 12483, 8420, 8866, 11382, 10321, 13252, 14398, 7417, 10086, 11062, 13238, 13523, 12898, 1584, 10941, 11255, 12759, 10216, 16131, 11730, 14607, 7336, 2133, 13112, 1766, 14688, 13528, 2086, 10271, 1741, 3613, 7939, 9540, 1565, 7217, 3614, 13453, 1625, 10374, 15490, 3398; Payload ID: 10702 relates to Category No.: 8862, 15490, 3398, 11512, 795, 7345, 482, 13589, 3398, 15517, 11506, 3398, 14620, 9455, 3631, 2376; Payload ID: 10703 relates to Category No.: 8739, 3442, 8831, 3564, 2911, 7879, 3613, 344, 13681, 15740; Payload ID: 10704 relates to Category No.: 15490, 3398, 8731, 3398, 11506, 3398, 344, 13681, 16197, 11611, 8519; Payload ID: 10705 relates to Category No.: 7340, 1237, 10065, 1995, 13651; Payload ID: 10706 relates to Category No.: 12091, 13594, 13589, 3398, 11512, 15517, 7345, 13445, 5146, 5182, 7334, 11053, 14636, 7335, 14620, 1964, 11063, 7416, 11062, 11380, 12891, 11506, 3398, 12484, 16182, 14624, 2116, 7417, 15011, 7385, 7381, 8354, 1982, 7384, 7418, 11384, 14623, 2084; Payload ID: 10707 relates to Category No.: 13594, 13589, 3398, 11512, 7345, 7334, 11053, 14636, 7335, 14620, 11063, 11062, 11380, 15517, 4021, 1463, 3613, 14793, 9451, 1621, 12652, 7346, 7352; Payload ID: 10708 relates to Category No.: 13594, 13589, 3398, 11512, 7345, 7334, 11053, 14636, 7335, 14620, 11063, 11062, 11380, 15517, 8731, 3398, 11506, 3398, 14793, 7352, 14638; Payload ID: 10709 relates to Category No.: 13589, 3398, 11512, 1721, 7743, 7345, 7334, 11053, 10350, 14636, 13455, 7335, 14620, 1964, 11063, 13954, 15009, 7294, 11062, 11380, 11069, 11052, 13830, 13822, 13206, 11506, 3398, 1993, 14624, 9451, 7417, 2044, 2110, 13953, 7381, 13864, 14619, 14638, 8035, 2049, 11155; Payload ID: 10710 relates to Category No.: 9528, 4949, 13882, 1334, 3747, 13874, 13877, 14650; Payload ID: 10711 relates to Category No.: 9500, 5482; Payload ID: 10712 relates to Category No.: 7131, 10491, 7340; Payload ID: 10713 relates to Category No.: 7340; Payload ID: 10715 relates to Category No.: 13589, 3398, 15490, 3398; Payload ID: 10716 relates to Category No.: 14365; Payload ID: 10717 relates to Category No.: 7710, 7676; Payload ID: 10718 relates to Category No.: 1703, 13518, 10250, 1562, 16133, 4953, 7342, 13195, 12953, 7340, 12948, 14365, 7396; Payload ID: 10719 relates to Category No.: 1703, 7342, 7340; Payload ID: 10720 relates to Category No.: 1703, 11294, 7342, 7340; Payload ID: 10721 relates to Category No.: 1703, 13518; Payload ID: 10722 relates to Category No.: 1204; Payload ID: 10723 relates to Category No.: 6814, 14456, 16162, 1779, 6990, 13363; Payload ID: 10724 relates to Category No.: 6814, 286, 280, 292, 11646; Payload ID: 10725 relates to Category No.: 6814, 5446, 12126, 10366, 4130, 6738, 7295, 11293, 12122, 10367, 11597, 12538, 15626; Payload ID: 10726 relates to Category No.: 6814, 8454, 1868, 3526; Payload ID: 10727 relates to Category No.: 3639, 292, 4499, 4490, 4494, 16096, 5406, 5949, 4998, 10093, 11638, 9068, 6814; Payload ID: 10728 relates to Category No.: 6814, 1204, 7719, 10366, 12459, 3016, 9002, 13000, 9006; Payload ID: 10729 relates to Category No.: 6814, 4130, 15201, 15202, 9777, 3986, 1823, 1745; Payload ID: 10730 relates to Category No.: 6814; Payload ID: 10731 relates to Category No.: 12091, 14456, 16214, 14014, 11858, 9713, 9716, 5458, 10628; Payload ID: 10732 relates to Category No.: 12091, 16214, 14014, 9713, 9716, 11858, 10628; Payload ID: 10733 relates to Category No.: 6814, 14661, 5785, 14565, 10702, 16214, 13485; Payload ID: 10734 relates to Category No.: 6814, 14661, 5785, 14565, 13485, 14108, 292, 10702, 7216, 6020, 6462, 3871; Payload ID: 10735 relates to Category No.: 12091, 14661, 14693, 286, 10366, 7340, 7131, 10491, 10301, 11623, 1232, 15461, 758, 1859; Payload ID: 10736 relates to Category No.: 12091, 10648, 11858, 9716, 15012, 1562, 1570, 14620, 13195, 8922, 14631; Payload ID: 10737 relates to Category No.: 12091, 2014, 14365, 14366, 1572, 11351, 13654; Payload ID: 10738 relates to Category No.: 12091; Payload ID: 10739 relates to Category No.: 7340, 14636, 5367; Payload ID: 10741 relates to Category No.: 8862, 12153, 7252, 12154, 11912, 11243, 2353, 8229, 13088; Payload ID: 10742 relates to Category No.: 15626, 16172, 1893, 6738, 292, 12041, 2009, 11646, 16169, 16214, 15149, 15143, 6697, 9320, 5544, 3986, 7369, 6705, 6711, 6302, 6699, 13001, 6294, 14410, 6714, 3197, 3670, 6814; Payload ID: 10743 relates to Category No.: 6814, 15618, 12137, 16172, 3694, 16274, 13724; Payload ID: 10744 relates to Category No.: 6814; Payload ID: 10745 relates to Category No.: 6814, 11512, 5782, 15149, 3639, 6738, 292, 3313, 14566, 13458, 3038, 5459, 15140, 986, 13530, 6296, 5458, 1959, 12122, 4581, 13827; Payload ID: 10746 relates to Category No.: 6814, 14456, 16214, 292, 6445, 4059, 14452, 3825, 9777, 5459, 5462, 5782, 986, 5458, 1779, 6650, 991, 9779, 5461, 14449, 11640, 10021, 10024; Payload ID: 10747 relates to Category No.: 5782, 10801; Payload ID: 10748 relates to Category No.: 6814; Payload ID: 10749 relates to Category No.: 1026, 6814, 12648, 5446, 2941, 4130, 12881, 10379, 14565; Payload ID: 10750 relates to Category No.: 6814; Payload ID: 10751 relates to Category No.: 6814, 5459, 14456, 6296; Payload ID: 10753 relates to Category No.: 6814, 7743, 7997, 2235; Payload ID: 10754 relates to Category No.: 7613, 1752, 378, 3336, 4766, 11290, 4768, 4781, 913, 6814; Payload ID: 10755 relates to Category No.: 6814, 16096, 5406, 1563; Payload ID: 10756 relates to Category No.: 6814; Payload ID: 10757 relates to Category No.: 1026, 6814, 14661, 3766, 1703, 7141, 378, 292, 5406, 274, 8934, 14056, 12648, 8936, 4949, 1048, 1780, 8920, 15045, 1740, 1295, 482, 1572, 3986, 6080, 2229, 9187, 1579, 756, 2705, 7390, 16130, 10065, 4287, 15365; Payload ID: 10758 relates to Category No.: 1026, 14661, 3766, 14693, 7340, 1563, 7131, 14627, 3550, 6814; Payload ID: 10759 relates to Category No.: 6814, 7340; Payload ID: 10760 relates to Category No.: 1026, 6814, 14661, 3766, 12648, 14456, 378, 8946, 14622, 7121, 14636, 16242, 292; Payload ID: 10761 relates to Category No.: 6814, 4037; Payload ID: 10762 relates to Category No.: 6814, 5446, 4130, 6738, 7340, 7342, 13767, 10065, 323; Payload ID: 10763 relates to Category No.: 7345, 14622, 292, 932, 3595, 4067, 7342, 14365; Payload ID: 10764 relates to Category No.: 6738, 292, 932, 7340, 7342, 13767; Payload ID: 10765 relates to Category No.: 12544, 932, 7340, 7390, 1563, 12948, 5406, 12953, 15012, 1562, 16133, 482, 7342, 14365, 13571, 966, 12511, 16209, 1483, 1257, 292, 12949; Payload ID: 10766 relates to Category No.: 14622, 932, 7340, 12953, 15012, 1562, 16133, 482, 7342, 13571, 13574, 13483, 15581; Payload ID: 10767 relates to Category No.: 6814; Payload ID: 10768 relates to Category No.: 14622, 932, 7340, 7342; Payload ID: 10769 relates to Category No.: 690, 1026, 14661, 12137, 3766, 12648, 5592, 275, 378, 2886, 9777, 3729, 292, 6145, 10075, 7217, 6739, 11289, 10086, 1244, 7568, 5406, 14589, 1703, 1765, 3884, 7385, 16028, 3918, 6695, 6814; Payload ID: 10770 relates to Category No.: 7340, 7342, 1562; Payload ID: 10771 relates to Category No.: 7340; Payload ID: 10772 relates to Category No.: 1026, 3766, 7340, 10075, 12129, 12648; Payload ID: 10773 relates to Category No.: 1026, 14661, 3766, 7340, 12648; Payload ID: 10774 relates to Category No.: 4949, 4948, 7735, 13518, 16133, 7342, 1572, 13571, 11474, 11634, 1562, 4953, 7341, 7337; Payload ID: 10775 relates to Category No.: 13518, 10250, 1562, 16133, 7342, 13571, 14636; Payload ID: 10776 relates to Category No.: 10250, 1562, 7342, 13571; Payload ID: 10777 relates to Category No.: 13194, 7340; Payload ID: 10778 relates to Category No.: 1026, 14661, 3766, 7340, 7342, 14636; Payload ID: 10779 relates to Category No.: 7340, 7342, 14636; Payload ID: 10780 relates to Category No.: 7340; Payload ID: 10781 relates to Category No.: 1026, 14661, 3766, 13194, 7340, 10075; Payload ID: 10782 relates to Category No.: 12498, 11167, 13105, 1729, 14656, 11506, 3398, 7345, 4859, 8524, 7131, 8352, 10491, 7332, 8627, 8625, 8603, 8354, 15570, 8117, 1951, 8198, 14619, 13859, 13953, 13867, 13836, 13837, 9491, 13829, 14022, 13864, 8344, 14638; Payload ID: 10783 relates to Category No.: 7340; Payload ID: 10784 relates to Category No.: 8929, 11109, 1746, 13618, 13519, 10362, 11279, 10324, 10939, 12533, 2051, 15011, 1640, 14638, 2222; Payload ID: 10785 relates to Category No.: 9718, 12137, 9861, 3100, 11910, 9858, 9945, 14663, 3699, 7121, 5732, 7119, 13649, 7332; Payload ID: 10786 relates to Category No.: 9861, 9718, 3100, 9858, 9945, 14663; Payload ID: 10789 relates to Category No.: 12603, 15471; Payload ID: 10790 relates to Category No.: 9718, 3100, 9858, 9945, 14663, 6451; Payload ID: 10791 relates to Category No.: 9718, 9861, 3100, 11910, 9858, 9945, 14663, 8559, 10536, 7908, 7957, 3058, 8558, 8928, 7364, 9862, 5500, 12133, 8347; Payload ID: 10792 relates to Category No.: 9718, 9861, 3100, 11910, 9858, 9945, 14663, 6451, 12517, 9855; Payload ID: 10793 relates to Category No.: 9718, 3100, 15570, 11910, 8756, 9858, 9945, 14663, 13822; Payload ID: 10794 relates to Category No.: 9718, 11674, 9861, 3100, 11910, 9858, 9945, 14663; Payload ID: 10795 relates to Category No.: 9718, 3100, 11910, 9858, 9945, 14663, 9861, 5500; Payload ID: 10796 relates to Category No.: 9718, 9861, 3100, 12519; Payload ID: 10797 relates to Category No.: 12603; Payload ID: 10798 relates to Category No.: 7390; Payload ID: 10799 relates to Category No.: 1204; Payload ID: 10801 relates to Category No.: 14663, 13004, 3728, 5782, 1295, 11094, 286, 10667, 10503, 11267, 16132, 356, 1823; Payload ID: 10802 relates to Category No.: 13589, 3398, 15490, 3398, 2410, 5189, 5190, 5184, 5131, 5148; Payload ID: 10803 relates to Category No.: 9145, 9139, 5741, 3345, 9148; Payload ID: 10804 relates to Category No.: 9145, 9139, 5741, 9148; Payload ID: 10805 relates to Category No.: 690, 15490, 3398, 1730, 7613, 11506, 3398, 9143, 12117, 9148; Payload ID: 10806 relates to Category No.: 7613, 11506, 3398, 9143, 12117, 9148;

Payload ID: 10807 relates to Category No.: 9143; Payload ID: 10808 relates to Category No.: 9143; Payload ID: 10809 relates to Category No.: 6814, 9143; Payload ID: 10810 relates to Category No.: 7613, 14690; Payload ID: 10811 relates to Category No.: 7613; Payload ID: 10812 relates to Category No.: 6219; Payload ID: 10813 relates to Category No.: 5182, 9148, 7158, 2189, 6814; Payload ID: 10814 relates to Category No.: 9274, 1780, 9143, 2429, 5182, 6814; Payload ID: 10815 relates to Category No.: 6902, 12053, 10362; Payload ID: 10816 relates to Category No.: 6902; Payload ID: 10817 relates to Category No.: 13497; Payload ID: 10818 relates to Category No.: 13497; Payload ID: 10819 relates to Category No.: 13497; Payload ID: 10820 relates to Category No.: 13497; Payload ID: 10821 relates to Category No.: 12137; Payload ID: 10822 relates to Category No.: 15490, 3398, 11940, 10372, 8731, 3398, 7743, 5113, 1891, 11658, 10866, 7998; Payload ID: 10823 relates to Category No.: 12194, 14663, 1878, 1828, 8971; Payload ID: 10824 relates to Category No.: 12194; Payload ID: 10826 relates to Category No.: 1512, 1506, 9359, 4724, 4732, 4700; Payload ID: 10827 relates to Category No.: 7455, 1514, 7458, 7443; Payload ID: 10828 relates to Category No.: 1514, 6445, 9021, 12105; Payload ID: 10829 relates to Category No.: 1514, 9021; Payload ID: 10830 relates to Category No.: 1512, 1894, 11930, 6445, 12125; Payload ID: 10831 relates to Category No.: 8862, 1512, 14663, 4723, 4722, 7001, 5460, 6295, 2229, 6445, 14073; Payload ID: 10832 relates to Category No.: 10129, 14663, 1878, 15993, 823, 4576, 6814; Payload ID: 10833 relates to Category No.: 6814, 12063, 1893, 3405, 11660, 7458; Payload ID: 10834 relates to Category No.: 6814, 3100, 12063, 1893, 3405, 11660, 7440, 7457; Payload ID: 10835 relates to Category No.: 1505, 12063, 1893, 3405, 11660, 6243; Payload ID: 10836 relates to Category No.: 6814, 16308, 14663; Payload ID: 10837 relates to Category No.: 6814, 1204; Payload ID: 10838 relates to Category No.: 3399, 5443, 11506, 3398, 6814; Payload ID: 10839 relates to Category No.: 9143; Payload ID: 10840 relates to Category No.: 6814, 16308, 14663; Payload ID: 10841 relates to Category No.: 6814; Payload ID: 10842 relates to Category No.: 7613, 4615, 10648, 1893, 1149, 13827, 9695; Payload ID: 10844 relates to Category No.: 6814; Payload ID: 10845 relates to Category No.: 9148, 6814; Payload ID: 10849 relates to Category No.: 9941, 14086, 10005, 16211; Payload ID: 10850 relates to Category No.: 6219, 1204; Payload ID: 10851 relates to Category No.: 6219, 14865, 14663, 2211, 4729; Payload ID: 10852 relates to Category No.: 14565, 795, 2211, 14874, 6302, 2207; Payload ID: 10853 relates to Category No.: 14874, 6302, 2207; Payload ID: 10854 relates to Category No.: 6814, 9982, 7511, 7476, 14663, 932, 16234, 16275; Payload ID: 10855 relates to Category No.: 9982, 7511, 7476, 6814; Payload ID: 10856 relates to Category No.: 7474, 7476, 14663, 9068, 16234, 16275; Payload ID: 10857 relates to Category No.: 9500, 14663, 14962, 2347, 4937, 2355, 14699, 5985; Payload ID: 10858 relates to Category No.: 16308, 9500, 10129, 9048, 14663, 12654, 1878, 15149, 2370, 14025, 7710, 13975, 13835, 13969, 496, 13966, 13837, 11089, 13700, 15113; Payload ID: 10859 relates to Category No.: 9500, 6758; Payload ID: 10860 relates to Category No.: 7039, 7508, 13755, 1874, 14663; Payload ID: 10861 relates to Category No.: 7039, 7508, 13755, 1874, 14663, 13827; Payload ID: 10862 relates to Category No.: 13755, 1874, 14663; Payload ID: 10863 relates to Category No.: 9500, 13975, 13755, 13756, 1874, 14663; Payload ID: 10864 relates to Category No.: 8175, 8731, 3398, 803, 13755, 1874, 14663, 7735, 2012, 11169, 11243, 10470, 2110, 12397, 11945; Payload ID: 10865 relates to Category No.: 7039, 7508, 13755, 1874, 14663; Payload ID: 10866 relates to Category No.: 7039, 7508, 13755, 1874, 14663; Payload ID: 10867 relates to Category No.: 7039, 7508, 13755, 1874, 14663; Payload ID: 10869 relates to Category No.: 7039, 7508, 13755; Payload ID: 10870 relates to Category No.: 9500, 13975, 7039, 7508, 13755, 1874, 14663; Payload ID: 10871 relates to Category No.: 7039, 7508, 13755, 1874, 14663, 7108, 933; Payload ID: 10872 relates to Category No.: 7039, 7508, 13755, 1874, 14663; Payload ID: 10873 relates to Category No.: 7039, 7508, 13755, 14742, 1874, 14663, 15885, 9500, 14962; Payload ID: 10874 relates to Category No.: 7039, 7508, 13755, 1874, 14663; Payload ID: 10875 relates to Category No.: 7039, 7508, 13755, 1874, 14663; Payload ID: 10876 relates to Category No.: 13755, 1874, 14663; Payload ID: 10877 relates to Category No.: 7039, 7508, 13755, 1874, 14663; Payload ID: 10878 relates to Category No.: 3555, 7039, 7508, 13755, 1874, 14663; Payload ID: 10879 relates to Category No.: 13975, 7039, 7508, 13755, 1874, 14663, 9500; Payload ID: 10880 relates to Category No.: 7039, 7508, 13755, 1874, 14663; Payload ID: 10881 relates to Category No.: 7039, 7508, 13755, 1874, 14663; Payload ID: 10882 relates to Category No.: 7039, 7508, 13755, 1874, 14663; Payload ID: 10883 relates to Category No.: 7039, 7508, 13755, 1874, 14663, 9500; Payload ID: 10884 relates to Category No.: 14456, 7039, 7508, 13755, 1874, 14663, 7131; Payload ID: 10885 relates to Category No.: 7039, 7508, 4104, 13755, 1874, 14663, 11996; Payload ID: 10886 relates to Category No.: 7039, 7508, 13755, 1874, 14663; Payload ID: 10887 relates to Category No.: 7039, 7508, 13755, 1874, 14663; Payload ID: 10888 relates to Category No.: 7039, 7508, 11884; Payload ID: 10889 relates to Category No.: 13755, 1874, 14663, 1895, 12397, 8119; Payload ID: 10890 relates to Category No.: 13755, 1874, 14663, 7088; Payload ID: 10891 relates to Category No.: 13755, 1874, 14663, 7088, 7504; Payload ID: 10892 relates to Category No.: 6814, 6902, 13755, 1874, 14663, 7088; Payload ID: 10893 relates to Category No.: 1207, 13755, 1874, 14663, 7088; Payload ID: 10894 relates to Category No.: 6902, 13755, 1874, 14663, 7088; Payload ID: 10895 relates to Category No.: 9500, 7039, 7508, 13755, 1874, 14663, 933, 13161, 932, 793, 1895, 12397; Payload ID: 10896 relates to Category No.: 9500, 13975, 7039, 7508, 13755, 1874, 14663; Payload ID: 10897 relates to Category No.: 9500, 8175, 7039, 7508, 13755, 1874, 14663, 7735, 15042, 12397; Payload ID: 10898 relates to Category No.: 3555, 1295, 7039, 7508, 13755, 1874, 14663, 1477, 7088, 10626, 13371, 13797, 1895, 12397; Payload ID: 10899 relates to Category No.: 7039, 7508, 13755, 1874, 14663, 7088; Payload ID: 10900 relates to Category No.: 7039, 7508, 13755, 1874, 14663, 7303, 1598, 7340, 7305, 4110, 7121, 13740; Payload ID: 10901 relates to Category No.: 9500, 7039, 7508, 13755, 1874, 14663, 7088; Payload ID: 10902 relates to Category No.: 9500, 13975, 7039, 7508, 13755, 1874, 14663, 7088; Payload ID: 10903 relates to Category No.: 9500, 7039, 7508, 13755, 1874, 14663, 486; Payload ID: 10904 relates to Category No.: 8862, 9500, 7039, 7508, 1567, 13755, 1874, 14663; Payload ID: 10905 relates to Category No.: 7039, 7508, 13755, 1874, 14663; Payload ID: 10907 relates to Category No.: 7039, 7508, 13755, 1874, 14663, 7108, 933; Payload ID: 10908 relates to Category No.: 9500, 11773, 1204; Payload ID: 10909 relates to Category No.: 9500, 1727, 14663, 5874, 2052; Payload ID: 10910 relates to Category No.: 690, 13041, 14661, 9500, 14565, 5428, 12197, 1752, 10372, 12544, 15113, 11391, 11595, 15110, 13746, 10805, 7513, 5779, 5301, 2161, 10955, 4021, 10878, 2005, 11158, 9526, 13549; Payload ID: 10911 relates to Category No.: 14661, 9500, 15110, 15273, 3135, 13864, 9468; Payload ID: 10912 relates to Category No.: 1764, 9500, 5428, 7743, 15113, 4439, 1709, 12397, 15110, 5248, 10583, 10514, 1557, 11266, 10954, 1277, 1984, 1978, 2131, 13882, 11390, 496, 10238, 11418, 11307, 1925; Payload ID: 10913 relates to Category No.: 10331, 14661, 15113, 12991, 13415; Payload ID: 10914 relates to Category No.: 14661, 4020, 12991, 13415, 15113, 10331; Payload ID: 10915 relates to Category No.: 690, 9500, 795, 12197, 2886, 1780, 11307, 2883, 3715, 15110, 13387, 12885; Payload ID: 10916 relates to Category No.: 16286, 7693, 11243, 14778, 4060, 11620, 10038, 12643, 11121, 7826, 8831; Payload ID: 10917 relates to Category No.: 11237, 16286, 3986, 7693, 4783, 10588, 12129, 11288; Payload ID: 10918 relates to Category No.: 1730, 6111; Payload ID: 10919 relates to Category No.: 13589, 3398, 15490, 3398, 11512, 1730, 12891, 12628, 1780, 8408, 14782, 14949, 3646; Payload ID: 10920 relates to Category No.: 13589, 3398; Payload ID: 10922 relates to Category No.: 1752, 8760, 11129, 3001, 3798; Payload ID: 10923 relates to Category No.: 1730, 7306, 8760, 14838, 11129, 3001, 7270, 8269, 4464; Payload ID: 10924 relates to Category No.: 12619, 7306, 8760, 14838, 11129, 3001, 13618, 4458, 9379, 7618; Payload ID: 10925 relates to Category No.: 12194, 11878, 1893, 6741, 15121; Payload ID: 10926 relates to Category No.: 6814, 12194, 1752, 12099, 1780, 12801, 8918, 10978; Payload ID: 10927 relates to Category No.: 13589, 3398, 15490, 3398, 15588, 12137, 16197, 11383, 14638, 10375, 8663, 4955, 1583, 13479, 8747, 11525; Payload ID: 10928 relates to Category No.: 12137; Payload ID: 10929 relates to Category No.: 8962, 12547, 12544, 15521, 1893, 4439, 2259, 12407, 4145, 13956, 10492, 12964, 12895, 10710, 12514, 10322, 11218, 1565, 13882, 7735, 13888, 2051, 1747, 8676, 7822; Payload ID: 10930 relates to Category No.: 1795, 12547, 12544, 7735, 7598, 2259, 12407, 1265, 13661, 11591, 11325, 13653; Payload ID: 10931 relates to Category No.: 12547, 2259, 9451, 12407, 4884, 12686, 8418, 12580, 4881, 8267, 11634, 13189, 9406, 14588, 13882, 13827, 13837, 7743, 11147, 11602, 10406, 7886, 13489; Payload ID: 10932 relates to Category No.: 12091, 4828, 5785, 1795, 12547, 12544, 7735, 7598, 2259, 2812, 12407, 1265, 13661, 11591, 11325, 13653, 8636, 10406, 3428; Payload ID: 10933 relates to Category No.: 12091, 5785, 14565, 1795, 12544, 2259, 2812, 9451, 12407, 1991, 1269, 8418, 14588, 8267; Payload ID: 10934 relates to Category No.: 14640, 12544, 1468, 439, 1477, 11113, 11591, 9462, 13278, 9891, 9932, 8636, 7581, 9561; Payload ID: 10935 relates to Category No.: 5785, 14565, 12994, 7533, 1849, 13214; Payload ID: 10936 relates to Category No.: 14565, 5446, 12994, 1849; Payload ID: 10937 relates to Category No.: 5367, 5428, 5255, 12994, 5037, 11078, 1789, 15122, 11077, 15123; Payload ID: 10938 relates to Category No.: 12994; Payload ID: 10940 relates to Category No.: 12075, 11926; Payload ID: 10942 relates to Category No.: 1026, 14661, 11512, 15207, 5446, 7728, 4130, 16085, 10192, 14556, 15185, 11460, 7834, 8446, 10548, 7914, 8450, 8743, 11547, 9710, 10317, 10318, 1752, 286, 15045, 1740, 6018, 13974; Payload ID: 10943 relates to Category No.: 1026, 11512, 14565, 3766, 7743, 3775, 16085, 10192, 14556, 15185, 11460, 8446, 12819, 7914, 1752, 286, 6018, 11547, 10548, 8450, 8743, 3056, 5393; Payload ID: 10944 relates to Category No.: 14661, 14565, 5446, 2940, 4130, 9075, 11094; Payload ID: 10945 relates to Category No.: 14661, 795, 5446, 2169, 4130, 16197, 16085, 10889, 12365, 10244, 5406, 1758, 8887, 14793, 3641, 9584, 3583, 6018, 3587, 12117, 13363, 9129, 780, 16340, 3563, 6803, 3569, 3922, 1086, 9586, 9131;

Payload ID: 10946 relates to Category No.: 14661, 10702, 1070, 7613, 5446, 10266, 2711, 1061, 15197, 10265, 2311, 360, 11884, 4130, 16085, 10192, 9000, 11460, 13827, 3853, 8145, 8159, 11201, 10344, 11102, 8355, 10586, 7373, 6487, 10339, 575, 11182, 3729, 10340, 575, 10642, 10933, 298; Payload ID: 10947 relates to Category No.: 1204; Payload ID: 10949 relates to Category No.: 12137, 7295, 9201, 9203, 15144, 14838; Payload ID: 10950 relates to Category No.: 1737, 14661, 7154, 7159, 7168, 7132, 3889, 2429, 981, 982; Payload ID: 10951 relates to Category No.: 6814, 5428, 1512, 4721, 14663, 5004, 4723, 5010, 6606, 9410, 4949, 4251, 4186, 14699, 3614, 1579, 756, 2705, 13756, 3600, 6995, 10155; Payload ID: 10952 relates to Category No.: 1512, 4721, 14663, 5004, 4723, 5010, 1886, 12489, 6814; Payload ID: 10953 relates to Category No.: 5004, 5010; Payload ID: 10954 relates to Category No.: 5004, 5010; Payload ID: 10955 relates to Category No.: 14565, 1730, 16286, 15042, 7845, 7946, 13650, 8636, 13321; Payload ID: 10956 relates to Category No.: 14565, 1730, 14838, 7735; Payload ID: 10957 relates to Category No.: 14565, 1295, 1730, 1746, 14015, 3587, 10583, 4952, 8478, 11094, 8635, 8636, 1560, 16213, 16158, 12797, 1759; Payload ID: 10958 relates to Category No.: 7039, 7508, 5297, 13755, 1874, 14663; Payload ID: 10959 relates to Category No.: 7039, 7508; Payload ID: 10960 relates to Category No.: 1566; Payload ID: 10961 relates to Category No.: 7345, 7342, 14778, 12464; Payload ID: 10962 relates to Category No.: 1204; Payload ID: 10963 relates to Category No.: 12137, 3639; Payload ID: 10964 relates to Category No.: 12137, 3639; Payload ID: 10965 relates to Category No.: 8862, 7743, 12936, 13589, 3398, 15517, 11512, 11634, 8934, 1035, 2169, 8928, 1048, 14454, 1023, 4478, 13758, 13756, 4449, 8988, 7307; Payload ID: 10966 relates to Category No.: 3354, 3353, 1893, 12936, 11298, 12120, 11660; Payload ID: 10967 relates to Category No.: 2139, 8503, 8547; Payload ID: 10968 relates to Category No.: 9982, 9228; Payload ID: 10970 relates to Category No.: 8739, 10718, 8062; Payload ID: 10972 relates to Category No.: 14565, 6819, 1862, 16064, 10775, 11298, 8004, 8772, 8545, 8112, 11243, 15899, 8688, 8786, 8154, 13092, 13047, 8190, 13204; Payload ID: 10973 relates to Category No.: 14565, 6819, 16064, 10775, 11298, 8004, 8772, 8545; Payload ID: 10974 relates to Category No.: 6814, 14565, 12498, 12061, 7145, 13227, 8923; Payload ID: 10975 relates to Category No.: 3100; Payload ID: 10976 relates to Category No.: 8736, 11512, 10745, 15499, 15517, 7306, 4439, 16197, 11611; Payload ID: 10977 relates to Category No.: 15499, 8731, 3398, 15517, 4439, 16197, 8736, 11611; Payload ID: 10978 relates to Category No.: 8731, 3398, 15499, 15517, 4439, 16197, 11611; Payload ID: 10979 relates to Category No.: 15499, 8334, 15517, 1204, 4439, 16197, 11611; Payload ID: 10980 relates to Category No.: 5367, 5428, 5446, 15113; Payload ID: 10982 relates to Category No.: 8421, 12553, 6451, 12066, 13516; Payload ID: 10983 relates to Category No.: 13975, 9296, 3354, 1089, 1089, 762, 3103, 8407; Payload ID: 10984 relates to Category No.: 9296, 3354, 1089, 1089, 762, 3103; Payload ID: 10985 relates to Category No.: 9296, 3354, 1089; Payload ID: 10986 relates to Category No.: 12091, 13589, 3398, 15490, 3398, 5785, 16286, 6606, 8831, 12117, 15570, 9716, 14495, 11858; Payload ID: 10987 relates to Category No.: 1026, 1703, 7334, 11053, 5866, 13589, 3398, 10286, 8540, 7385; Payload ID: 10988 relates to Category No.: 690, 14565, 1713, 1703, 12633, 1816, 7728, 2376, 7735, 8112, 11125, 8118, 7800, 3708, 8325, 8389, 1705, 14689, 8356, 3716, 8629, 4194, 15809, 14690, 4971, 8610, 1275, 12891; Payload ID: 10989 relates to Category No.: 1820, 2136, 4021, 10383, 10583, 11147, 16005, 1318, 1808, 3900, 11542, 11392, 11528, 10026, 10216; Payload ID: 10990 relates to Category No.: 14565, 274, 14589, 1779, 9420, 14056, 3973, 16212, 14835; Payload ID: 10991 relates to Category No.: 16286, 9994, 2460, 7693, 9420, 3176, 5949, 4952, 6375, 3178, 3177, 6501, 3809, 967, 5951, 15999, 2653, 3173, 3179, 13681, 10038, 13315; Payload ID: 10992 relates to Category No.: 14565, 274, 14589, 7693, 9420, 5072, 16212, 14056, 9994, 14831, 9996; Payload ID: 10993 relates to Category No.: 4499, 3973, 4490, 12045, 6606, 1703, 14636, 10192, 5912, 7385, 12846; Payload ID: 10994 relates to Category No.: 275, 3973, 6850; Payload ID: 10995 relates to Category No.: 14661, 7912, 7613, 15614, 10238, 1816, 348, 12526, 803, 9891, 12391, 8373, 8940, 10648, 8988, 7724, 13229, 4041, 10261, 355, 8856, 12734, 5785, 11298, 11094, 10257, 13238, 8923, 4040, 14454, 9738, 11092, 8860, 10448, 13408; Payload ID: 10996 relates to Category No.: 1026, 5367, 5782, 14565, 5428, 7613, 2467, 10238, 12526, 803, 12646, 15782, 8988, 13925, 7724, 10955, 10261, 4535, 6740, 7640, 12734, 12912, 14643, 12891, 10626, 10241, 4939, 2169, 7986, 8854, 3159, 11765, 11137, 8052, 7728, 14050, 8373, 14454, 11090, 8378, 11436, 4588, 2083, 10356, 11266, 14620, 11055, 11436, 2370, 11339, 8305, 13397; Payload ID: 10997 relates to Category No.: 334, 7306, 803, 8988, 12734, 4041; Payload ID: 10998 relates to Category No.: 11512, 1730, 15517, 2169; Payload ID: 10999 relates to Category No.: 15490, 3398, 11512, 1730, 2169, 11363, 13594; Payload ID: 11000 relates to Category No.: 1295, 7710, 2169, 4336, 8507, 14950, 10857, 3571, 11084, 8373, 8862, 1778; Payload ID: 11001 relates to Category No.: 5782, 16172, 15149, 3986, 3833, 5798, 12851, 12063, 2669, 1893, 6738, 10058, 11660, 4774, 11243, 4782, 11315, 11676; Payload ID: 11002 relates to Category No.: 5782, 3833, 14709, 6733, 5798, 12063, 2669, 1893, 6738, 11660, 11646, 8929, 15149, 4588, 1295, 780, 13538; Payload ID: 11003 relates to Category No.: 5782, 14709, 6733, 15149, 4588, 13538; Payload ID: 11004 relates to Category No.: 5782, 6733, 5798, 11884, 12117; Payload ID: 11005 relates to Category No.: 1026, 795, 12391, 15045, 1740, 1689, 10257, 10370, 12638, 8934, 14589, 5459, 10372, 1048, 6559, 6560, 7636, 723, 3893; Payload ID: 11006 relates to Category No.: 1026, 7334, 11053; Payload ID: 11007 relates to Category No.: 1026, 4021, 8944, 12562; Payload ID: 11009 relates to Category No.: 1048; Payload ID: 11010 relates to Category No.: 1048; Payload ID: 11011 relates to Category No.: 7619, 10955; Payload ID: 11012 relates to Category No.: 8929; Payload ID: 11013 relates to Category No.: 8936, 1795, 10307, 12849, 5256, 1703, 1026, 14661, 2885, 5446, 6606, 348, 4186, 12391, 4127, 3775, 5541, 16085, 8988, 4021, 16189, 5610; Payload ID: 11014 relates to Category No.: 8924, 1703; Payload ID: 11015 relates to Category No.: 8862, 1730, 12891, 10287, 11147, 8422, 7833; Payload ID: 11016 relates to Category No.: 8925, 11942, 12936; Payload ID: 11017 relates to Category No.: 1737, 7154, 9420, 7132, 4336, 12008; Payload ID: 11018 relates to Category No.: 12153, 12154, 13041, 2139, 2885, 13126, 8936, 12125, 4518, 11969, 12754, 8805, 11243, 11187, 13329, 6442, 13796, 12409, 15899, 11763, 8644, 12404, 8645, 8746, 15623, 3186, 11132, 8739, 1249, 9480, 403, 12058, 15185, 8918, 13525, 3620, 5367, 13822; Payload ID: 11019 relates to Category No.: 12154, 15618, 15490, 3398, 13041, 11843, 12153, 8739, 5846, 13343, 13126, 8756, 14742, 15521, 4439, 16197, 16193, 15570, 13939, 13127, 12754, 2159, 13329, 10543, 11967, 3973, 8526, 8488, 16272, 10494, 8644, 16129, 8487, 13121, 8643, 10335, 11243, 12058; Payload ID: 11020 relates to Category No.: 12194, 15898, 1894, 674, 12061, 15570, 13594, 11997, 13969; Payload ID: 11021 relates to Category No.: 1737, 14565, 1703, 2940, 5592, 7154, 280, 12936; Payload ID: 11023 relates to Category No.: 13589, 3398, 11512, 15517, 16214, 14014, 13436, 14073, 11340; Payload ID: 11024 relates to Category No.: 8862, 10238, 7743, 11432, 9125, 13618, 10501, 12058, 10628, 1906, 8402, 10922, 5998, 14831, 10568, 14816, 1295, 14636; Payload ID: 11025 relates to Category No.: 12153, 9125, 15897; Payload ID: 11026 relates to Category No.: 5785, 12153, 14365, 7390; Payload ID: 11027 relates to Category No.: 12153; Payload ID: 11029 relates to Category No.: 5785, 3564, 8862, 1026, 14661, 15614, 5446, 8731, 3398, 6606, 348, 4186, 1714, 11296, 9891, 12391, 1780, 4127, 3775, 5541, 16085, 8988, 6559, 16294, 10362, 10343, 7966, 11294, 1557, 8865, 10321, 364, 8605, 13356, 13355, 3838, 3617, 16139, 7698, 1890, 11421, 16131, 1559, 11512, 11178, 8377, 1752, 8930, 4949, 15140, 10257, 8508, 14940, 6296, 1295, 4475, 7345, 11265, 1764, 8906, 11266, 12628, 11187, 10320, 9350, 9738, 8976, 10296, 11273, 11305, 11055, 10501, 1022, 2306, 1548, 4476, 4541, 12544, 7369; Payload ID: 11030 relates to Category No.: 1026, 14661, 5785, 14565, 5446, 6606, 348, 4186, 9891, 12391, 4127, 3775, 5541, 16085, 8988, 9406; Payload ID: 11031 relates to Category No.: 5785, 12633, 9406, 364, 9599, 8377, 6559, 2306, 6570; Payload ID: 11032 relates to Category No.: 1026, 14661, 5785, 5446, 6606, 348, 4186, 9891, 12391, 4127, 3775, 5541, 16085, 8988, 9406; Payload ID: 11033 relates to Category No.: 8862; Payload ID: 11034 relates to Category No.: 1204; Payload ID: 11035 relates to Category No.: 1026, 8977, 15149, 15140, 11431, 11432, 4021, 14729, 6102, 10590, 8920, 8924, 11654, 11436, 4588, 480, 16242, 4453, 8909, 11652, 16241, 13005, 11713, 12935, 690, 14565, 1432, 12412, 7991, 5037, 10588, 2222, 3900, 12483, 12045, 11724, 9078, 13252, 8953, 11885, 15154, 4373, 4923; Payload ID: 11036 relates to Category No.: 14565, 15149, 8924, 8977, 15140, 14729, 11654, 480, 16242, 4453, 8909, 11652, 16241; Payload ID: 11037 relates to Category No.: 1026, 11431, 11432, 14729, 6102, 8924, 480, 16242, 8977, 15140, 15149, 690, 14565; Payload ID: 11039 relates to Category No.: 8962; Payload ID: 11040 relates to Category No.: 8962; Payload ID: 11041 relates to Category No.: 8962; Payload ID: 11045 relates to Category No.: 1204; Payload ID: 11046 relates to Category No.: 8862; Payload ID: 11047 relates to Category No.: 8862; Payload ID: 11048 relates to Category No.: 3691, 11997; Payload ID: 11049 relates to Category No.: 3691; Payload ID: 11050 relates to Category No.: 3691, 10086, 16294, 6666, 1238, 10079; Payload ID: 11051 relates to Category No.: 8862, 11091, 8940, 7662, 3171, 8325, 14477, 14476; Payload ID: 11052 relates to Category No.: 12137, 14098, 4771, 9223, 8405, 9103; Payload ID: 11062 relates to Category No.: 11294; Payload ID: 11066 relates to Category No.: 1026, 14661, 12137, 14565, 5446, 6606, 348, 4186, 12391, 4127, 3775, 14992, 5541, 16085, 8988, 1238, 6145, 3904, 12891, 10626, 13371, 8626; Payload ID: 11067 relates to Category No.: 16172, 15149, 1451, 13541; Payload ID: 11068 relates to Category No.: 1026, 1512, 1703, 14640, 2169, 14663, 4021, 4723, 2385, 2383, 2384, 3106; Payload ID: 11069 relates to Category No.: 8936, 1277, 13236; Payload ID: 11070 relates to Category No.: 14661, 5785, 14565, 10702, 13435, 10238, 12633, 803, 13485, 8988, 2022, 2001, 11425, 7386; Payload ID: 11071 relates to Category No.: 1026, 7369, 9738, 15143, 12038, 15622, 9575, 5041, 2526, 12022, 12129; Payload ID: 11072 relates to Category No.: 1026, 14661, 14565, 10702, 11089, 1295, 8552, 5446, 9854, 10238, 6606, 348, 274, 4949, 4186, 2562, 7737, 12942, 1714, 12391, 2243, 4127, 3775, 5541, 16085, 8988, 13882, 4021, 12488, 7370, 8522, 16294, 2571, 7924, 14883, 9738, 860, 8256, 6878, 6269, 16213, 8255, 9455, 10025, 4254, 472, 7990, 10208, 12555, 15135, 14697, 1464, 12652, 8368, 14385, 4249, 8737, 12545, 12899, 8415, 12646, 7598, 7754, 12891, 7743, 10602, 1995, 14636, 13105, 4041, 8424, 13084, 7625, 10558, 10601, 8888, 659, 13532, 4342, 8551, 4374, 8968, 4581, 8968, 9315, 13085, 8379; Payload ID: 11073 relates to Category No.: 14661, 274, 7743, 7737, 7890, 8191, 7750, 11418, 7754, 8793, 8795, 14388, 12967, 12646, 13225, 3532, 1295, 6796, 6114, 13376, 8256, 5073, 8522, 13222, 10358, 13510, 1814, 9321, 13365, 12902; Payload ID: 11074 relates to Category No.: 1048, 1021, 1775, 8903, 13275, 6969, 5729, 5731, 8905, 9741, 1295, 14883, 13811, 5073, 1964, 8936, 2243, 2083, 9484, 1031, 14007, 13766; Payload ID: 11075 relates to Category No.: 1026, 14661, 15149, 5446, 6606, 348, 4186, 12391, 4127, 3775, 5541, 16085, 8988, 726, 1034, 5732, 14095, 8903, 8940, 6969, 12521, 8920, 8373, 10261, 5729, 6293, 8905, 9737, 14025, 13815, 13970, 14883, 13981, 5073, 2243, 12095, 14007, 13766, 5733; Payload ID: 11076 relates to Category No.: 7131, 8903; Payload ID: 11077 relates to Category No.: 13594, 8862, 15490, 3398, 11091, 11512, 11363, 5459, 1741, 13229, 8929, 8906, 10592; Payload ID: 11078 relates to Category No.: 15490, 3398, 11363, 11512, 8934, 1026, 11091, 1741, 8929, 4251, 1751, 8906, 2176; Payload ID: 11079 relates to Category No.: 8862, 11512, 8739, 2169, 3632, 11363, 9738, 15536, 7306, 3791, 12754, 13589, 3398, 14883, 11091, 15517, 10358, 4251, 5066; Payload ID: 11080 relates to Category No.: 795, 9528; Payload ID: 11081 relates to Category No.: 8862, 5785, 14565, 10923, 901, 15247; Payload ID: 11082 relates to Category No.: 6637, 151, 6360, 13618; Payload ID: 11083 relates to Category No.: 8862, 11940, 7191, 15140, 11431, 1432, 12412, 8936, 15156, 10501, 10628, 13229, 12122, 5037, 10590, 11438, 10862, 8924, 14123, 3900, 12483, 12045, 11654, 11724, 11348, 656, 9078, 10442, 16268, 13252, 7872, 11436, 4588, 11436, 4342, 8953, 15154, 11652, 15165, 2935, 15281, 8892, 11439, 13417, 11437, 15143, 6323, 11935, 11277, 15167, 1703; Payload ID: 11084 relates to Category No.: 7191, 15143, 14589, 15140, 11431, 15156, 10801, 10590, 10793, 8924, 12483, 12045, 11654, 11724, 1813, 11436, 4588, 11436, 4342, 4453, 11652, 13417, 15281, 11277, 6297, 8920, 14454, 11437; Payload ID: 11085 relates to Category No.: 1703, 7191, 15143, 12427, 15140, 11431, 15156, 14729, 1023, 6102, 10590, 8924, 11654, 11724, 11436, 4588, 5440, 480, 16242, 14124, 10217, 13417, 16213, 13532, 4588, 6323, 3971, 13252, 9350, 12483, 7957, 12760, 7872, 13085, 11437, 13569, 10501, 10793, 11277; Payload ID: 11086 relates to Category No.: 8929, 7191, 7191, 15143, 1814, 15156, 14729, 6102, 9408, 8924, 11654, 11724, 2235, 16242, 7957, 1302; Payload ID: 11087 relates to Category No.: 7191, 15156, 14729, 6102, 8924, 11654, 11724, 16242; Payload ID: 11088 relates to Category No.: 12194, 12908, 13480; Payload ID: 11089 relates to Category No.: 14565, 8962, 1816, 10372, 4535, 10486, 10762, 817, 8089; Payload ID: 11090 relates to Category No.: 4828, 9932, 1268; Payload ID: 11091 relates to Category No.: 8962, 6295; Payload ID: 11092 relates to Category No.: 13491, 4828, 14565, 3244, 8962, 10762, 11436, 14454, 11392, 4411, 3529, 9991; Payload ID: 11093 relates to Category No.: 4828, 2331, 8962, 1417, 14693, 1451, 5503, 9932, 11294, 355; Payload ID: 11094 relates to Category No.: 4828, 2331, 1816, 1417, 2169, 2329, 1451, 13491, 4132, 5503, 9932, 10486, 354, 817, 13978, 8962, 4855, 12447; Payload ID: 11095 relates to Category No.: 8934, 6967; Payload ID: 11096 relates to Category No.: 6814, 14455, 14456, 6296, 9396, 13544, 4505, 16070, 8862;

Payload ID: 11098 relates to Category No.: 3431, 2493, 3691, 11315; Payload ID: 11099 relates to Category No.: 13232, 9891, 1415, 10593; Payload ID: 11100 relates to Category No.: 690, 1026, 11091, 14589, 2169, 2526, 15140, 1048, 1035, 12522, 8934, 14069, 5041, 11997, 13232, 8947; Payload ID: 11101 relates to Category No.: 8906, 11091, 11512, 5458, 10238, 11506, 3398, 9052, 5544, 13004, 3070, 3632, 11363, 10358, 3603, 12620, 4535, 8787, 11536, 13860, 2235, 607, 3741, 13028, 15517, 724, 1463, 1741, 13229, 5066, 8191, 14577, 9558, 9563, 1984, 9238, 13827; Payload ID: 11102 relates to Category No.: 13594, 8862, 11091, 12153, 11432, 11363, 1922, 8670, 10307, 11435, 1959, 2214, 15517, 11512, 8928, 1112, 901, 8408; Payload ID: 11103 relates to Category No.: 13589, 3398, 15490, 3398, 10358, 607, 8934, 1463, 1741, 8928, 4475, 9125, 8898, 14056; Payload ID: 11104 relates to Category No.: 1730, 15517, 11512, 3070, 8862, 13589, 3398, 15490, 3398; Payload ID: 11105 relates to Category No.: 14589, 13225, 11094, 6296, 4132; Payload ID: 11106 relates to Category No.: 1026, 14661, 10702, 13435, 3766, 10238, 803, 13485, 12942, 8988, 7872, 1886; Payload ID: 11107 relates to Category No.: 13594, 13589, 3398, 15490, 3398, 2169, 8739, 14940, 6624; Payload ID: 11108 relates to Category No.: 13589, 3398, 15490, 3398, 11512, 2467, 1955, 7728, 11506, 3398, 2169, 1867, 14663, 2469, 10521, 13999, 13420, 6295, 2470; Payload ID: 11109 relates to Category No.: 13594, 13589, 3398, 15490, 3398, 3198, 11506, 3398, 14940, 6296, 6624; Payload ID: 11110 relates to Category No.: 11512, 15517, 11506, 3398, 5440, 1943; Payload ID: 11111 relates to Category No.: 15626, 15149, 2169, 1049; Payload ID: 11112 relates to Category No.: 15149, 901; Payload ID: 11114 relates to Category No.: 13616, 13229, 1031; Payload ID: 11115 relates to Category No.: 9854, 8940; Payload ID: 11116 relates to Category No.: 9854, 8940; Payload ID: 11117 relates to Category No.: 15626, 11996, 10801, 1295, 8929; Payload ID: 11118 relates to Category No.: 690, 1746, 9052, 8373, 4021, 10383, 7919, 2006, 8934, 11094, 16094, 9633, 13909; Payload ID: 11119 relates to Category No.: 15149, 6296, 14267, 14271, 7291, 16182, 13442, 14883, 13184; Payload ID: 11121 relates to Category No.: 4828, 8962; Payload ID: 11122 relates to Category No.: 4828, 2000, 8962, 15149, 1204, 13980; Payload ID: 11123 relates to Category No.: 4828, 2000, 8962, 15149, 13105, 13980, 3117, 12478, 12581; Payload ID: 11124 relates to Category No.: 8962, 15149, 3971, 13459, 13827, 14883, 10486, 8118, 6626, 13951, 10282, 380, 7619, 8057, 13121, 14786, 16109; Payload ID: 11125 relates to Category No.: 8962, 16213, 11436, 4588, 11436, 4342, 10195, 10442, 16268; Payload ID: 11126 relates to Category No.: 4828, 8962, 11323; Payload ID: 11127 relates to Category No.: 8962, 8038; Payload ID: 11128 relates to Category No.: 4828, 8962, 4132; Payload ID: 11129 relates to Category No.: 8962, 15149, 5446, 3244, 1417, 1780, 2243, 8936, 4132, 2176, 729, 3016, 4828, 2745, 12500, 734, 3015, 7252, 1237, 14053, 1111, 481, 10242, 12544; Payload ID: 11130 relates to Category No.: 4828, 8962, 1795, 4132, 439, 4828, 2745, 9480, 1237, 12544, 4538, 6296, 14454, 13189, 13835, 11601, 7855, 8089, 9744; Payload ID: 11131 relates to Category No.: 4828, 8962, 15149, 6296, 1795, 4132, 9480, 1551, 439, 13459, 10442, 9102, 10486, 7688, 10383, 11392, 7977, 7957, 1112, 10531, 9052, 11171, 8672, 8605, 8672, 4588, 14403, 8371; Payload ID: 11132 relates to Category No.: 4828, 8962, 3244, 1795, 4132, 1237; Payload ID: 11133 relates to Category No.: 4828, 8962, 15149, 1795, 4132, 9480, 1551, 7613, 10203, 11391, 8029, 3529, 4447, 8672, 4342; Payload ID: 11134 relates to Category No.: 4828, 8962, 9386, 15149, 4828, 2745, 13135; Payload ID: 11135 relates to Category No.: 4828, 8962, 9386, 15149, 4828, 2745; Payload ID: 11136 relates to Category No.: 6758, 16213, 13084, 12412, 10590, 13236; Payload ID: 11137 relates to Category No.: 13051; Payload ID: 11138 relates to Category No.: 690, 1026, 16088, 14432, 14565, 1816, 10175, 14928, 16085, 10558, 9600, 13668, 11178, 10583, 10093, 3718, 2599, 9410, 10557, 2143, 8934, 1762, 11390, 8854, 14069, 1997, 3708, 16114, 5022, 10258, 860, 1024, 10473, 1049, 691, 14061, 15134, 13430, 15136, 15137, 8870, 14435, 11335, 12016, 3038, 1752, 7965, 1035, 4949, 8928, 8373, 7637, 7636, 7251, 15471, 14433, 4069, 2704, 12523, 3238, 15135, 1322, 15657, 4792, 16128, 15654, 4071, 16179, 4395, 14446, 15656, 9464, 13702, 16115, 14050; Payload ID: 11139 relates to Category No.: 690, 1026, 16088, 8934, 4949, 8869, 7553, 8854, 4069, 1024, 4792, 16128, 15134, 15654, 15136, 15137, 8870, 14435, 4071, 16179, 4395, 14446, 14432, 1703, 16085, 10558, 10557; Payload ID: 11140 relates to Category No.: 5255, 9720, 15614, 11285, 10486, 11094, 6323, 10922, 10624, 10583, 16213, 10923, 10393; Payload ID: 11141 relates to Category No.: 14565, 12547, 13835, 6269, 13815, 2044, 13775, 13811, 2068, 16213, 1951, 3246, 13945, 13787, 5327, 13782; Payload ID: 11142 relates to Category No.: 4828, 7613, 8962, 15149, 483, 13459, 10238, 11323, 6102, 13923, 8676, 10639, 10793, 15273, 10243, 3161, 10674, 10334, 8568, 10797, 12470, 13121, 13416, 2968, 5499, 6168; Payload ID: 11143 relates to Category No.: 4828, 8962, 14449, 1795, 13126, 9932; Payload ID: 11144 relates to Category No.: 1703, 14589, 13225, 8943; Payload ID: 11145 relates to Category No.: 12091, 14661, 10702, 9720, 15614, 348, 11109, 7743, 328, 9891, 12391, 8373, 11285, 8988, 11858, 10583, 1049, 11305, 355, 11094, 10226, 11227, 3200, 15135, 2068, 1060, 2469, 11431, 5465, 8862, 6650, 1116, 13967, 3766, 496, 13827, 13837, 13767, 14454, 13996, 13961, 1993, 13829, 8374, 6103, 3146, 11436, 4588, 1026, 13787, 14520, 13879, 8860, 3161, 2069, 9339, 8987; Payload ID: 11146 relates to Category No.: 9720, 8929, 15614, 10372, 12942, 328, 8373, 2243, 11285, 10648, 8988, 2176, 11858, 10955, 11187, 6102, 8934, 10261, 11094, 1300, 12091, 16096, 14056, 11174, 1906, 2469, 11431, 6323, 8918, 1453, 7600, 6650, 9350, 13135, 4132, 4581, 13361, 14073, 9742, 5428, 2136, 496, 2068, 13921, 6322, 13786, 13238, 12753, 11436, 4588, 1919; Payload ID: 11147 relates to Category No.: 12091, 9720, 15614, 10372, 4949, 345, 337, 10366, 8987, 11285, 10648, 10188, 11174, 8535, 361, 11216, 10238, 2469, 11431, 6114, 6650, 10259, 11858, 7728, 2110, 3766, 13837, 13815, 7625, 2547, 13787, 8934, 8932, 7189; Payload ID: 11148 relates to Category No.: 8862, 14565, 15614, 10372, 1816, 12498, 345, 337, 10175, 8373, 10366, 8940, 10188, 11313, 13229, 11174, 11178, 361, 5424, 8449, 11512, 1026, 8922, 8928, 1295, 3781, 13227, 6650, 14688, 9738, 4446, 8854, 4477, 3737, 7191, 7369, 10651; Payload ID: 11149 relates to Category No.: 3781, 483, 6322, 4396, 14447, 5465, 7728, 6650, 15226; Payload ID: 11150 relates to Category No.: 8862, 1026, 6606, 8936, 8869, 15614, 8854; Payload ID: 11151 relates to Category No.: 6814, 11910, 14656, 16308, 6212; Payload ID: 11152 relates to Category No.: 5785, 14565, 3691, 1795, 15782, 2211, 10404, 10238, 10331; Payload ID: 11153 relates to Category No.: 14661, 9500, 5446, 746, 12126, 15113, 742, 15223, 742, 16085, 9783, 15110, 13746, 3013, 5428, 13788, 1780, 3016, 14053, 13748, 3014, 1849, 8638, 6154, 5299, 6143, 9009, 9007; Payload ID: 11154 relates to Category No.: 14661, 5446, 746, 15113, 742, 15223, 742, 16085, 9783, 1849, 15110, 13746; Payload ID: 11155 relates to Category No.: 10331, 5367, 14661, 9500, 746, 742, 15223, 742, 16085, 9783;

Payload ID: 11156 relates to Category No.: 12091, 1563, 12638, 12746; Payload ID: 11157 relates to Category No.: 5785, 14565, 5428, 1060, 1795, 11363, 10475, 10267, 1070, 12530; Payload ID: 11158 relates to Category No.: 15490, 3398, 8731, 3398, 9125, 11294, 10218, 8739, 14949, 4998, 4974, 15195, 4844; Payload ID: 11160 relates to Category No.: 14661, 12137, 14565, 5359; Payload ID: 11161 relates to Category No.: 14661, 14565, 12137, 5359; Payload ID: 11162 relates to Category No.: 15490, 3398, 8731, 3398; Payload ID: 11163 relates to Category No.: 11884, 14663, 12, 7207, 16234, 16275, 7200, 15089, 5864, 6814; Payload ID: 11164 relates to Category No.: 5874; Payload ID: 11165 relates to Category No.: 8731, 3398, 13589, 3398, 15490, 3398, 12820, 3631, 14386, 7369; Payload ID: 11166 relates to Category No.: 8862, 15490, 3398, 8731, 3398, 1780, 8749, 13589, 3398, 12820, 3631, 14386, 7369; Payload ID: 11167 relates to Category No.: 4712; Payload ID: 11171 relates to Category No.: 1002, 11843, 1512, 12096, 14663, 4538, 4685, 11298; Payload ID: 11172 relates to Category No.: 14319, 15261; Payload ID: 11175 relates to Category No.: 1722, 3452, 1955, 3354, 3320, 3448, 6670, 15257, 7134, 3309, 3453, 10887, 3313, 14566, 7150, 3455, 12776, 11240, 5406, 1780, 8920, 5901, 1229, 5806; Payload ID: 11176 relates to Category No.: 13465, 13344, 11912; Payload ID: 11177 relates to Category No.: 12194, 10331, 1026, 3766, 10238, 803, 12099, 9125, 4020, 8988, 4021, 9123, 6739, 6740, 664, 3801, 1149, 15203, 7373; Payload ID: 11179 relates to Category No.: 16308, 6902, 14663, 13827, 13971, 9411; Payload ID: 11180 relates to Category No.: 1207, 7474, 7476, 14663, 16234, 16275, 2992; Payload ID: 11181 relates to Category No.: 1207, 7474, 7476, 14663, 16234, 16275, 2992; Payload ID: 11182 relates to Category No.: 1207, 7474, 7476, 14663, 16234, 16275, 2992, 14050; Payload ID: 11183 relates to Category No.: 9500, 1790, 12197, 5297, 15642, 1874, 14663, 12397, 7519; Payload ID: 11184 relates to Category No.: 11512, 14565, 7474, 10372, 2467, 1816, 7476, 14663, 2469, 11114, 16234, 16275, 9026, 13969, 11391, 4145; Payload ID: 11185 relates to Category No.: 9982, 7474; Payload ID: 11186 relates to Category No.: 9982, 7474, 8352; Payload ID: 11187 relates to Category No.: 7474, 13975, 7476, 14663, 9031, 16234, 16275, 9026; Payload ID: 11188 relates to Category No.: 1820, 4020, 4021, 1093, 10383, 4490; Payload ID: 11189 relates to Category No.: 1703, 1820, 4021, 1093; Payload ID: 11190 relates to Category No.: 14565, 1002, 2359, 11930, 2351, 2355, 2353, 16189, 1189, 6442, 6746, 3906, 10424, 13827, 484, 3639, 8241, 2118, 2045, 7728, 13794; Payload ID: 11191 relates to Category No.: 14038, 9950, 2359, 4703, 5787, 2351, 2355, 2353, 5768, 13045; Payload ID: 11192 relates to Category No.: 8929, 11506, 3398, 8408; Payload ID: 11193 relates to Category No.: 12091, 6606, 13166, 15004, 12498, 275, 360, 8940, 7743, 343, 9590, 13506; Payload ID: 11194 relates to Category No.: 12091; Payload ID: 11195 relates to Category No.: 12091, 1737, 9720, 6606, 345, 7154, 2459, 7303, 5949, 1955, 13904, 14838; Payload ID: 11196 relates to Category No.: 12091, 10954, 12832, 11240, 12623; Payload ID: 11197 relates to Category No.: 12091, 5785, 5805, 7135, 4335, 5221, 13167; Payload ID: 11198 relates to Category No.: 12091, 1737, 7154, 14894, 6670, 13171, 9420, 7132, 670, 4336, 2429, 11858, 13169, 12515, 2199, 7776, 1227, 7159, 7879, 7162; Payload ID: 11199 relates to Category No.: 12091, 1737, 7154, 8940, 13632, 3871; Payload ID: 11200 relates to Category No.: 12091, 1737, 1955, 13166, 14569, 15004, 12498, 11506, 3398, 7154, 360, 7132, 12676, 13420, 13414; Payload ID: 11201 relates to Category No.: 12091, 10469, 11421; Payload ID: 11202 relates to Category No.: 12091, 14565, 795, 13170, 13166, 9713, 7154, 14894, 10775, 2886, 7132, 2429, 11858, 12676, 4335, 7155; Payload ID: 11203 relates to Category No.: 12091, 13166, 14894, 2886; Payload ID: 11204 relates to Category No.: 12091, 6986, 9410, 12967, 3176, 4949; Payload ID: 11205 relates to Category No.: 12091, 1737, 7154, 7132, 7155; Payload ID: 11206 relates to Category No.: 14216, 3656, 6636, 14171, 2518, 16214; Payload ID: 11207 relates to Category No.: 6962, 2197, 2200; Payload ID: 11208 relates to Category No.: 9420, 7132, 4336; Payload ID: 11209 relates to Category No.: 8862, 1703, 15427, 10382, 5287; Payload ID: 11210 relates to Category No.: 8862, 1703, 15427, 8924; Payload ID: 11211 relates to Category No.: 14175; Payload ID: 11212 relates to Category No.: 6482, 6480; Payload ID: 11213 relates to Category No.: 6482, 6480; Payload ID: 11214 relates to Category No.: 6482, 6480; Payload ID: 11215 relates to Category No.: 6482, 6480; Payload ID: 11216 relates to Category No.: 10737, 1295, 14456, 8739, 8731, 3398, 1955, 12794, 2562, 7132, 3520, 1892, 4067, 4006, 7158, 12944, 9480, 3584, 4264, 4953, 6878, 3577, 4058, 6500, 3194, 2155, 12763, 4366, 16042, 14949, 11512, 11051, 4949, 3575, 4094, 3614, 11146; Payload ID: 11217 relates to Category No.: 14454; Payload ID: 11220 relates to Category No.: 795, 274, 7737, 12365, 12544, 4538, 13532, 4342, 9112; Payload ID: 11221 relates to Category No.: 795, 12626, 14177, 7108, 12668; Payload ID: 11222 relates to Category No.: 11512, 3988, 9500, 11506, 3398, 7385, 9048, 9052, 7658, 11602, 13882, 1238, 7340, 10703, 12594, 13867, 15012, 8489, 8970, 9783, 13497, 1993, 12895, 10735, 825, 7680, 9669, 8099, 7679, 11474, 13450, 7586, 7315, 8616, 11397, 13225, 10213, 13967, 14046, 13969, 13925, 7613, 13459, 496, 13836, 13971, 13837, 13767, 2051, 7743, 4145, 8118, 13981, 12948, 13961, 13916, 11090, 7855, 13962, 10923, 8054, 8811, 1114; Payload ID: 11223 relates to Category No.: 13248, 12498, 10648, 11113, 11111, 11220, 10492, 12955, 11112, 13246, 13664, 12589, 12964, 12895, 11617, 11172; Payload ID: 11224 relates to Category No.: 9500, 5428, 3013, 9048, 9052, 7658, 11602, 15113, 1238, 5447, 13004, 10703, 8004, 3015, 9783, 13788, 825, 10886, 9669, 10903, 12668, 12646, 13925, 1957, 2469, 13882, 8508, 2041, 2013; Payload ID: 11225 relates to Category No.: 13248, 9500, 7743, 12547, 12544, 9048, 9052, 7658, 11602, 13700, 14663, 16085, 1238, 7122, 10703, 1250, 13867, 9053, 3713, 9783, 7967, 10226, 825, 8476, 13546, 14695, 8343, 13846, 5406, 690, 6375, 6248, 13497, 8099, 9492, 8489, 13573, 7679; Payload ID: 11226 relates to Category No.: 13248, 7710, 14663, 9053, 8394, 12153; Payload ID: 11227 relates to Category No.: 14565; Payload ID: 11228 relates to Category No.: 1204, 9068; Payload ID: 11229 relates to Category No.: 4595, 9068, 9498, 877; Payload ID: 11230 relates to Category No.: 13589, 3398, 1204, 8911, 6219, 12913, 12896; Payload ID: 11231 relates to Category No.: 13589, 3398, 7306; Payload ID: 11232 relates to Category No.: 13589, 3398, 15490, 3398, 11512, 1295, 8739, 8731, 3398, 11506, 3398, 7737, 8756, 10648, 13874, 10441, 15402, 7942, 14123, 6375, 3814, 4251, 4489, 13594, 4258, 9599, 673, 8934, 1026, 8930, 9410, 3641, 9945, 10034, 6387, 2242, 15247, 5073, 15246, 15824, 9350, 4252, 2248, 4257, 6163, 2487, 2245, 3196, 13925, 13837, 4132, 5328, 12550, 3187; Payload ID: 11233 relates to Category No.: 13589, 3398, 15490, 3398, 1295, 3632, 11363, 1730, 11512, 8375, 11091, 10648, 8932, 3246, 1729, 8862, 14699, 14886, 12628, 10358, 9349, 15805, 908, 11138, 9558, 15807, 9563, 14888, 14889, 16126, 13969, 13989, 13860, 9396; Payload ID: 11234 relates to Category No.: 13589, 3398, 15490, 3398, 1204, 12646, 11512, 1060, 11634, 14910, 3246, 5367, 15664, 6468, 6145, 9321, 6403, 7299, 9769, 1684, 575, 10049, 6142, 4469, 11635; Payload ID: 11235 relates to Category No.: 13589, 3398, 7306, 1204; Payload ID: 11236 relates to Category No.: 13589, 3398, 11091, 11512, 4998, 1730, 7613, 8739, 10372, 8731, 3398, 15517, 11506, 3398, 7693, 3587, 964, 16130, 9786, 11537, 12594, 11399, 15402, 4952, 1557, 16137, 4953, 482, 1570, 9481, 14910, 16096, 12588, 8356, 11531, 10707, 10327, 968, 1548, 14183, 14470, 7698, 13594, 10648, 9480, 1562, 1598, 4949, 14365, 1483, 1567, 4948, 1560, 1257, 1584, 3590, 16139, 12593, 4954, 1585, 12234, 799, 11758, 1346, 976, 12273, 16134, 974, 975; Payload ID: 11237 relates to Category No.: 13589, 3398, 15490, 3398, 1730, 7613, 10372, 5334, 3587, 15459, 3246, 964, 16130, 9786, 9722, 4949; Payload ID: 11238 relates to Category No.: 13589, 3398, 15490, 3398, 11512, 15517, 6269, 7939, 1048, 6375, 13759; Payload ID: 11239 relates to Category No.: 13589, 3398, 334, 15490, 3398, 11512, 14967, 10372, 8731, 3398, 687, 7306, 7743, 11506, 3398, 10241, 10359, 360, 11285, 10648, 2014, 2136, 11331, 11187, 8004, 1957, 10864, 10470, 8318, 2006, 7939, 11027, 14359, 1320, 10356, 8120, 2118, 11980, 1316, 3806, 7133, 14022, 7941, 7956, 10225, 16023, 6530, 6878, 9786, 14793, 4949, 11821, 3438; Payload ID: 11240 relates to Category No.: 13589, 3398, 15517, 14640, 7799, 8739, 3176, 7613, 7001, 14910, 14641, 9554, 3612, 9406, 3245, 5754, 9407; Payload ID: 11241 relates to Category No.: 13589, 3398, 11512, 8739, 3632, 11363, 9410, 3134, 11571, 15809, 9554, 15808, 1730, 11091, 14699, 12522, 9350, 13607, 13608, 2177, 13231, 8008, 10651, 1948, 13827, 15517, 1780, 13961, 8906, 2088, 10801, 15805; Payload ID: 11242 relates to Category No.: 13589, 3398, 8739, 1730, 2174, 8920, 3632, 9350, 13607, 13608, 7733, 10360, 8008, 10651; Payload ID: 11243 relates to Category No.: 13589, 3398, 15490, 3398, 1743, 4471, 7937; Payload ID: 11244 relates to Category No.: 5446, 16197, 8789, 8126, 8103, 8112, 8159, 8114, 8587; Payload ID: 11245 relates to Category No.: 8862, 5428, 12153, 7613, 5446, 13465, 5434, 8373, 7840, 13773, 13787; Payload ID: 11246 relates to Category No.: 5359, 8390, 15185, 8782, 8159, 8103, 13925, 13383; Payload ID: 11247 relates to Category No.: 334, 11940, 5428, 12153, 5446, 13465, 10238, 11109, 12498, 5434, 3013, 7162, 13227, 339, 9292, 6125, 5617, 12328, 3119, 12734; Payload ID: 11248 relates to Category No.: 11512, 5446, 3021, 8390, 8789, 8790, 10999, 11574, 10816, 13057; Payload ID: 11249 relates to Category No.: 334, 5428, 795, 5446, 12999, 3013, 10822, 9292, 6125, 8923, 13952, 12498; Payload ID: 11250 relates to Category No.: 5446, 403, 10856, 10852, 3015, 3014, 11480, 11483, 3050, 4966; Payload ID: 11251 relates to Category No.: 9500; Payload ID: 11252 relates to Category No.: 334, 14565, 12993, 8390, 8112, 10790, 8617, 10822, 8103, 13693, 7847, 12734, 8506, 10999, 13018, 8158, 8720, 8136, 1948, 7946, 8391, 3050; Payload ID: 11254 relates to Category No.: 1730, 7306, 14838; Payload ID: 11255 relates to Category No.: 5428, 5446, 10822, 10470; Payload ID: 11256 relates to Category No.: 5446, 10238, 8390, 7724, 8446, 8785, 8726; Payload ID: 11257 relates to Category No.: 15490, 3398, 11512, 14565, 5428, 795, 5446, 11109, 3012, 8390, 8112, 2041, 10845, 10822, 12066, 10470, 9292, 6125, 8389, 7576, 8134, 11486, 11569, 11485, 3120, 334, 3021, 5616, 12999, 10832, 10848, 5654, 9074, 5623, 11481; Payload ID: 11258 relates to Category No.: 5428, 5446, 11573, 13639; Payload ID: 11259 relates to Category No.: 8926, 5406, 1892, 9410, 3566, 4167, 13376, 1889, 13446; Payload ID: 11260 relates to Category No.: 4828, 12999, 13788, 16294, 8106, 12519, 8103, 8256, 8113, 7946, 8726, 13188; Payload ID: 11262 relates to Category No.: 8926; Payload ID: 11264 relates to Category No.: 12137, 14165; Payload ID: 11265 relates to Category No.: 1988, 11093, 13227, 13236, 1906, 12754, 11248, 1959; Payload ID: 11266 relates to Category No.: 9254, 4887, 16044, 2779, 14838, 9256, 14834, 14835, 8431, 2459, 16138, 3808; Payload ID: 11267 relates to Category No.: 9254, 4887, 16044, 2779, 3176, 5793, 1295, 3808, 6108, 2453; Payload ID: 11268 relates to Category No.: 1790, 1730, 9254, 4887, 16044, 2779, 7306, 2459, 14838, 14831, 2107; Payload ID: 11269 relates to Category No.: 1790, 9254, 4887, 16044, 2779; Payload ID: 11270 relates to Category No.: 8862, 1730, 3639, 12253, 9254, 4887, 12313, 16044, 2779, 9265, 12498, 7743, 3336, 14663, 9236, 9235, 10574, 10513, 5998, 6559, 1984, 13827, 1957, 11094, 5073, 13797, 8004, 13772, 1969, 14022, 8351; Payload ID: 11271 relates to Category No.: 9254, 4887, 16044, 2779, 11858, 1984, 13866, 10309, 11094, 1969, 12066, 2083, 8351; Payload ID: 11272 relates to Category No.: 795, 12253, 9254, 4887, 12313, 16044, 2779, 9265, 12498; Payload ID: 11273 relates to Category No.: 6227, 12253, 9254, 4887, 12313, 16044, 2779, 9265, 12498, 14663, 9256, 9236, 9235; Payload ID: 11274 relates to Category No.: 9254, 4887, 16044, 2779, 795, 7735, 8320; Payload ID: 11275 relates to Category No.: 13589, 3398, 15490, 3398, 11512, 1703, 7613, 12253, 9254, 4887, 12313, 16044, 2779, 9265, 5592, 14663, 9236, 7131, 9235, 10574, 10881, 9680, 12820; Payload ID: 11276 relates to Category No.: 1089, 3354, 1089, 762, 3102, 3314; Payload ID: 11278 relates to Category No.: 5428, 15517, 13259, 5910, 8789, 8124, 8125, 8114, 11261; Payload ID: 11279 relates to Category No.: 13939, 3313, 14566, 2006, 11409, 12646, 9740, 6612, 7743; Payload ID: 11280 relates to Category No.: 795, 11765, 16197, 9151, 10005, 16211, 5806, 14111, 13437, 11260, 9140, 5406; Payload ID: 11281 relates to Category No.: 16197, 16202, 16198, 5790, 9151, 10005, 16211, 14111, 13437, 9140; Payload ID: 11282 relates to Category No.: 9379, 15517, 11512, 9485; Payload ID: 11283 relates to Category No.: 15490, 3398, 795, 2139, 8175, 8739, 8072, 2403, 7642, 9245; Payload ID: 11284 relates to Category No.: 4094; Payload ID: 11285 relates to Category No.: 7288, 13589, 3398, 2467, 15517, 8421, 14216, 3994, 13925, 10606, 7292, 2469, 8004, 12717, 13842, 3000, 2904, 12794; Payload ID: 11286 relates to Category No.: 11167, 1729, 14656, 4859, 10036, 13509, 11363, 10583, 10470, 10379, 10574, 10226, 7597, 11595, 8778, 11385, 3643, 10202, 11119, 7801, 6793, 8739, 15736, 14949, 11512, 5406, 4419, 1758, 3604, 722, 724, 673, 11740, 12890, 9085, 1752, 1741, 4952, 10372, 3641, 4949, 6269, 13465, 6375, 3587, 1295, 3575, 7730, 8862, 4418, 3605, 6625, 3245, 3247, 16095, 15738, 15426, 3607, 8876, 6106, 9086, 5435, 10112, 7729, 4219, 1012, 4275, 6627, 3767, 15571; Payload ID: 11287 relates to Category No.: 1204; Payload ID: 11288 relates to Category No.: 11912; Payload ID: 11289 relates to Category No.: 1204; Payload ID: 11290 relates to Category No.: 8862, 7730, 8421, 7737, 14640, 1257, 7693, 3812, 16294, 3445, 7662, 3610, 3578, 8439, 7701, 14782, 7001, 9455, 1622, 6192, 3612, 7625, 10292, 7843, 1731, 4190, 10659, 12878, 8739, 11512, 5406, 16023, 16005, 3642, 9599, 673, 1026, 8887, 10574, 8004, 8883, 1009, 2169, 1295, 10034, 6796, 14790, 7251, 7708, 7618, 8888, 14883, 6384, 12551, 1918, 4067, 9131, 6773, 11826, 16007, 13229, 4251; Payload ID: 11291 relates to Category No.: 15618, 6482, 6480; Payload ID: 11292 relates to Category No.: 6482, 6480; Payload ID: 11293 relates to Category No.: 11055, 9739; Payload ID: 11294 relates to Category No.: 3354, 1060, 3353, 3448, 2169, 3453, 15194, 13904, 10908; Payload ID: 11295 relates to Category No.: 7288, 13589, 3398, 15490, 3398, 8731, 3398, 3354, 3353, 7291, 16182, 14271, 2469, 12717, 8433;

Payload ID: 11296 relates to Category No.: 1737, 7154, 7138, 7132, 2430, 2422, 6672; Payload ID: 11297 relates to Category No.: 1737, 7138, 7132; Payload ID: 11298 relates to Category No.: 1737, 7138, 7132; Payload ID: 11299 relates to Category No.: 7138, 1737, 7132, 2430, 6672; Payload ID: 11300 relates to Category No.: 1737, 7154, 7132, 2422, 5453; Payload ID: 11301 relates to Category No.: 7132, 2422; Payload ID: 11302 relates to Category No.: 10372; Payload ID: 11303 relates to Category No.: 14318, 12224, 14177, 15261; Payload ID: 11304 relates to Category No.: 14318, 6637, 151, 6360, 3658, 151, 6360, 6636, 3661, 151, 6360, 3657, 151, 6360, 14171; Payload ID: 11305 relates to Category No.: 14164; Payload ID: 11306 relates to Category No.: 14318, 10372, 6902; Payload ID: 11307 relates to Category No.: 14314; Payload ID: 11308 relates to Category No.: 14314, 11024, 6643; Payload ID: 11309 relates to Category No.: 14318, 6902; Payload ID: 11310 relates to Category No.: 6902; Payload ID: 11311 relates to Category No.: 6902, 14831, 14830; Payload ID: 11312 relates to Category No.: 1737, 15715, 7154, 15712, 4439, 15708, 14834, 6671; Payload ID: 11313 relates to Category No.: 14318, 14316; Payload ID: 11314 relates to Category No.: 14318, 1746, 14316, 14728; Payload ID: 11315 relates to Category No.: 1204; Payload ID: 11316 relates to Category No.: 8862, 14565, 14456, 16286, 1483, 1816, 11506, 3398, 16214, 1780, 16068, 11363, 10036, 14061, 4025; Payload ID: 11317 relates to Category No.: 13589, 3398, 5367, 11512, 1730, 8739, 10372, 8731, 3398, 7306, 4949, 7743, 8421, 11506, 3398, 7710, 2460, 15521, 10366, 9125, 4439, 3176, 1549, 3812, 10877, 9723, 7662, 10248, 4952, 9123, 8352, 8954, 10286, 8370, 15762, 2143, 7738, 16137, 1570, 10578, 2704, 3813, 1757, 7600, 7755, 8420, 10321, 9124, 1580, 12853, 7920, 8356, 979, 3622, 2707, 1581, 11521, 1551, 761, 8415, 4955, 3617, 8009, 1585, 3625, 3627, 12236, 7177, 1546, 1541, 1576, 16139, 4877, 13604, 11534, 6772, 857, 16120, 16097, 1974, 8653, 8494, 12765, 13594, 15517, 12646, 5406, 12638, 12891, 10238, 8375, 13225, 8930, 14620, 1741, 11125, 10574, 8929, 4939, 3641, 6107, 11611, 5285, 6269, 1048, 6375, 4251, 7728, 12824, 4475, 1320, 1744, 7730, 5429, 3781, 3595, 11607, 5939, 7693, 1560, 7681, 3594, 1577, 10881, 11822, 8888, 13952, 14928, 3620, 9127, 2609, 4263, 13257, 987, 13501, 12516, 7632, 8469, 14781, 14407, 12826, 5697, 798, 4495, 2595, 976, 3290, 14838, 1295, 13925, 9411, 908, 10651, 15427, 9350, 10556, 11085, 13814, 12600, 1732; Payload ID: 11318 relates to Category No.: 8862, 13589, 3398, 1722, 795, 4998, 1730, 7613, 1746, 7306, 7743, 5783, 15521, 9125, 4439, 1276, 1743, 6611, 9123, 9410, 11305, 14949, 9124, 968, 12236, 12765, 8739, 13594, 5406, 3013, 7303, 10238, 3176, 10372, 5285, 6269, 10286, 7241, 5429, 3595, 10036, 5799, 6270, 5697, 10035, 7377, 5024, 2334, 2444, 15427; Payload ID: 11319 relates to Category No.: 1730, 7306, 9125; Payload ID: 11320 relates to Category No.: 1730, 7306, 15521, 9125, 4439, 9123, 12765, 8739, 11512, 8375, 8930, 4251, 7730, 11391, 860, 4491; Payload ID: 11321 relates to Category No.: 4998, 1730, 7730, 7306, 11506, 3398, 15521, 9125, 3564, 4439, 9600, 6559, 1743, 9123, 7238, 11534, 7922, 12765; Payload ID: 11322 relates to Category No.: 5949, 14793, 10314, 9125, 14641, 5451, 8318, 4971, 7841, 14164; Payload ID: 11323 relates to Category No.: 9125, 10314, 10558, 9600, 1246, 8402, 8739, 14791, 8682, 8403; Payload ID: 11324 relates to Category No.: 13589, 3398, 15490, 3398, 3604, 3445, 3176, 4952, 2460, 9129, 12714; Payload ID: 11325 relates to Category No.: 16286, 8831, 11908, 6814; Payload ID: 11326 relates to Category No.: 14565, 2359, 6253, 14663, 2347, 5752, 14986, 2353, 13827; Payload ID: 11328 relates to Category No.: 15898, 3837, 3354, 14096, 3829, 4766, 15605, 3851; Payload ID: 11329 relates to Category No.: 12091, 10702, 8728, 1905, 8198; Payload ID: 11330 relates to Category No.: 10702, 8728, 1204, 1905, 16136, 757, 9540, 1567; Payload ID: 11331 relates to Category No.: 1204; Payload ID: 11332 relates to Category No.: 14318; Payload ID: 11333 relates to Category No.: 5785, 12153, 3452, 3354, 11648, 1893, 12120, 11660, 11331; Payload ID: 11334 relates to Category No.: 3452, 1737, 7154, 11032, 1893, 12120, 11660, 2158, 15259, 10950; Payload ID: 11335 relates to Category No.: 3354, 3353, 1893, 12120, 11660, 11331; Payload ID: 11336 relates to Category No.: 11843, 12603, 998, 6733, 4766, 9166; Payload ID: 11337 relates to Category No.: 1737, 14661, 7154, 7132, 2429; Payload ID: 11338 relates to Category No.: 6814, 1512, 14663, 4723, 4722, 12192; Payload ID: 11339 relates to Category No.: 9287, 9500, 3100; Payload ID: 11340 relates to Category No.: 6814, 483, 6758; Payload ID: 11341 relates to Category No.: 12485; Payload ID: 11342 relates to Category No.: 12485; Payload ID: 11343 relates to Category No.: 12105, 12052, 12485; Payload ID: 11344 relates to Category No.: 14905, 2429, 9149, 9137, 9144, 9146, 9147, 9138; Payload ID: 11345 relates to Category No.: 3354, 1089, 7131, 10491, 1089, 762, 3103, 9296, 3327, 169; Payload ID: 11347 relates to Category No.: 12091, 5785, 1703, 1955, 12614, 8728, 1983, 12646, 12676, 13209; Payload ID: 11348 relates to Category No.: 12091, 5785, 795, 7613, 274, 8728, 1983; Payload ID: 11349 relates to Category No.: 7735, 13159; Payload ID: 11350 relates to Category No.: 12224, 14177, 14318; Payload ID: 11351 relates to Category No.: 12137, 1721, 3356, 9274, 1780, 3364, 3365, 5129, 1227, 6530, 14022; Payload ID: 11352 relates to Category No.: 15499, 13622, 15517, 7291, 16182, 14271, 14915, 15291, 4439, 16197, 7272, 16182, 7280, 14211, 7261, 182, 9223, 9103, 11611, 7546, 4442, 5220, 11044, 11703, 7295; Payload ID: 11353 relates to Category No.: 7272, 16182, 15499, 13622, 15517, 7291, 16182, 14271, 14915, 15291, 4439, 16197, 7280, 7261, 182, 9223, 9103, 11611, 7546, 4442, 5220, 14716, 11044, 11342, 11703; Payload ID: 11354 relates to Category No.: 7291, 16182, 7272, 16182; Payload ID: 11356 relates to Category No.: 15517, 11512, 4535, 10800; Payload ID: 11357 relates to Category No.: 1204; Payload ID: 11359 relates to Category No.: 9169; Payload ID: 11360 relates to Category No.: 13589, 3398, 15490, 3398, 8739, 3356, 11512, 15517, 16191, 15142; Payload ID: 11361 relates to Category No.: 13589, 3398, 11512, 8739, 15517, 3356, 2376, 4475, 11742, 718, 7879, 2487, 15818, 15824, 6373, 2599, 8493, 8282, 7940, 7743, 6375, 4251, 5066, 14358, 1736, 15490, 3398; Payload ID: 11362 relates to Category No.: 13589, 3398, 11512, 8739, 15517, 3356, 9321, 8731, 3398; Payload ID: 11363 relates to Category No.: 13589, 3398, 11512, 8739, 15517, 3356, 2235, 2229, 2222, 908, 15490, 3398; Payload ID: 11364 relates to Category No.: 13589, 3398, 11512, 14565, 15517, 3973, 10648, 2878, 12569, 13973; Payload ID: 11365 relates to Category No.: 13589, 3398, 11512, 5785, 5446, 15517, 11506, 3398, 4127, 14992, 1383; Payload ID: 11366 relates to Category No.: 13589, 3398, 1070, 1752, 5446, 1955, 10266, 11506, 3398, 4127, 14992, 13827, 8739, 15517, 11512, 10648, 2878, 7416, 1383, 11063; Payload ID: 11367 relates to Category No.: 12120, 11512, 2878; Payload ID: 11368 relates to Category No.: 13589, 3398, 13594, 11512, 5428, 5446, 15517, 4127, 14992, 1895, 15400, 4949, 1922, 13882, 14624, 7417, 7416, 1250, 1565, 14688, 9600, 7333, 15194, 1383, 2044, 13514, 11506, 3398; Payload ID: 11369 relates to Category No.: 13589, 3398, 5428, 15517, 8739, 11512, 10238, 10241, 5808, 1895, 4949, 2139, 11566, 7864, 14688, 7802, 9600, 7333, 1383, 2044, 8670, 13530; Payload ID: 11370 relates to Category No.: 13589, 3398, 11512, 15207, 14565, 5428, 795, 7613, 8739, 5446, 15517, 5359, 9038, 11109, 11506, 3398, 7362, 4127, 14992, 8988, 10314, 2041, 2014, 15003, 15456, 15450, 7363, 15448, 15443, 2088, 15454, 11573, 15446, 15653, 15457, 15458, 2051, 15451, 10946, 10913, 7672, 6740, 8823, 11010, 10766, 2069, 7796, 7765, 2021, 8731, 3398, 7845, 8112, 13956, 8140, 1958, 2079, 13969, 2136, 13975, 10648, 1927, 13813, 1919, 13788, 2087, 1953, 1985, 13594; Payload ID: 11371 relates to Category No.: 5428, 8739, 5446, 5359, 9038, 13818, 13589, 3398, 11512, 14565, 15517, 11109, 7362, 14992, 15782, 15456, 15450, 7363, 15448, 15443, 15454, 11573, 15446, 15653, 15457, 15458, 15451, 14123, 4021, 14910, 4461, 4245, 13925, 496; Payload ID: 11372 relates to Category No.: 11512, 15207, 795, 7613, 5446, 11109, 7362, 4127, 16197, 14992, 8988, 8390, 15456, 15450, 7363, 15448, 15443, 15454, 11573, 15446, 15653, 15457, 15458, 2911, 7879, 15451, 10394, 2909, 8248, 8219, 10422, 13244, 1938, 12646, 12891, 11506, 3398, 11949, 15606, 13925, 13840, 8349, 6248, 8402, 13956, 13952, 9293, 9294, 1948, 2079; Payload ID: 11373 relates to Category No.: 15490, 3398, 14565, 5446, 11109, 7362, 15456, 15450, 7363, 15448, 15443, 15454, 11573, 15446, 15653, 15457, 15458, 15451, 2041, 2909; Payload ID: 11374 relates to Category No.: 5428, 8103, 8390, 11488, 8683; Payload ID: 11375 relates to Category No.: 2911, 3483; Payload ID: 11376 relates to Category No.: 13594, 15490, 3398, 5428; Payload ID: 11377 relates to Category No.: 5359, 8390, 2041, 8782, 2911, 8222, 8726; Payload ID: 11378 relates to Category No.: 13589, 3398, 5428, 15517, 3354, 3353; Payload ID: 11379 relates to Category No.: 13594, 13589, 3398, 15490, 3398, 7306, 11506, 3398, 1238, 9276, 1237, 4999; Payload ID: 11380 relates to Category No.: 13594, 13589, 3398, 5428, 674, 11506, 3398, 4977, 15517, 11512, 3854; Payload ID: 11381 relates to Category No.: 13589, 3398, 11843, 11512, 12153, 3684, 11831, 10648, 2136, 2083, 7919, 8095, 1971, 8431, 2029, 10581, 9746, 2001, 11523, 15517, 11506, 3398, 5428, 1957, 13831, 10666, 1790, 1983, 11307, 8062, 10280, 12794, 13410, 10677, 7728, 11522; Payload ID: 11382 relates to Category No.: 13594, 13589, 3398, 15517, 11506, 3398, 8739; Payload ID: 11383 relates to Category No.: 13589, 3398, 5367, 15490, 3398, 8739, 15517, 2469, 10648, 2020; Payload ID: 11384 relates to Category No.: 11512, 14267, 1285; Payload ID: 11386 relates to Category No.: 6814, 1955, 14776; Payload ID: 11387 relates to Category No.: 1737, 7154, 7132, 4336, 9308, 3889, 6376, 6670; Payload ID: 11388 relates to Category No.: 1730, 7306, 14838; Payload ID: 11389 relates to Category No.: 12137, 7295; Payload ID: 11397 relates to Category No.: 1204; Payload ID: 11405 relates to Category No.: 13589, 3398, 14663, 5874, 13882, 9525, 4969; Payload ID: 11406 relates to Category No.: 15490, 3398, 11506, 3398, 12891, 8408, 13612; Payload ID: 11407 relates to Category No.: 13589, 3398, 15490, 3398, 1746, 10238, 379, 11884, 11847, 6530, 14025, 11280, 14620, 5809, 7724, 7990, 12869; Payload ID: 11409 relates to Category No.: 15521, 4439; Payload ID: 11410 relates to Category No.: 13589, 3398, 1002, 15521, 4439, 12519, 13831, 13070; Payload ID: 11411 relates to Category No.: 12091, 3833, 15521, 4439; Payload ID: 11412 relates to Category No.: 12091, 8929, 8373, 8241; Payload ID: 11413 relates to Category No.: 15490, 3398, 8739, 11506, 3398, 2410, 13292, 5203, 5154, 12974, 5187, 13443; Payload ID: 11414 relates to Category No.: 13589, 3398, 15490, 3398, 11512, 2000, 687, 11506, 3398, 1184, 2410, 1867, 14663, 1189, 11513, 10238, 11091, 5182, 5987, 13440, 13580, 2127, 12669, 6530, 13835, 13989, 13874, 5073, 14000, 5998, 2235, 5334, 2243, 3940, 10615, 6531, 5095; Payload ID: 11415 relates to Category No.: 5095, 13589, 3398, 15490, 3398, 14661, 11512, 2000, 2467, 1184, 2410, 1867, 14663, 1189, 8739, 8731, 3398, 2469, 6295, 12913, 11308, 2127, 6530, 2235, 10615, 10661; Payload ID: 11416 relates to Category No.: 5095, 13589, 3398, 11512, 2000, 687, 11506, 3398, 10648, 10881, 1964, 13440, 12424, 15517, 7303, 3194, 13510, 13508, 13509, 16069, 5987, 6555, 8653; Payload ID: 11417 relates to Category No.: 15490, 3398, 687, 11506, 3398, 6530, 13874; Payload ID: 11418 relates to Category No.: 13589, 3398, 15490, 3398, 4535, 8117; Payload ID: 11419 relates to Category No.: 13259, 11512, 1295, 1955, 3356, 3354, 3399, 5443, 4949, 11506, 3398, 3353, 15521, 1867, 14663, 13874, 4518, 5773, 7372, 12891, 5160, 5985, 10802, 9485, 11171; Payload ID: 11420 relates to Category No.: 15490, 3398, 11512; Payload ID: 11421 relates to Category No.: 15490, 3398, 8739, 15517, 2409, 14894, 15521, 2410, 9125, 1867, 14663, 4439, 15570, 2469, 8192, 12924, 13074, 12866, 13594, 8731, 3398, 8458, 10737, 2353, 2467, 13189, 1684, 1678, 569, 13580, 2127, 15325, 3022, 14636, 10372, 8004, 5998, 2235; Payload ID: 11422 relates to Category No.: 5406, 8731, 3398, 4535, 4251, 1782, 15818, 4953, 15247, 7971, 16279, 11247, 13835, 13971, 5998, 3940, 15490, 3398, 8739, 15521, 2410, 9125, 1867, 14663, 4439, 15570, 12660; Payload ID: 11423 relates to Category No.: 15490, 3398, 11512, 8739, 687, 2467, 11506, 3398, 2469, 1964, 13594, 6226, 9489, 9486; Payload ID: 11424 relates to Category No.: 12194, 13589, 3398, 15490, 3398; Payload ID: 11425 relates to Category No.: 12194; Payload ID: 11426 relates to Category No.: 13589, 3398, 8739, 14967, 8731, 3398, 5783, 15521, 4439, 5334, 6530, 14962, 11997, 8611, 10034, 472, 4789, 8172, 1730, 14838, 7730, 14532, 14521, 6163, 6538, 13883, 15490, 3398; Payload ID: 11427 relates to Category No.: 13589, 3398, 14967, 15521, 2355, 10648, 4439, 8004, 8611, 9125, 8739, 8731, 3398, 13860, 9411, 10801; Payload ID: 11428 relates to Category No.: 13589, 3398, 1730, 8739, 14967, 8731, 3398, 2467, 11506, 3398, 5783, 15521, 4439, 8723, 2041, 4685, 13005, 2469, 13071, 11830, 12717, 8557, 12909, 13917, 12861, 2472, 13638, 10274, 12697; Payload ID: 11429 relates to Category No.: 13589, 3398, 14967, 8731, 3398, 11506, 3398, 5783, 12999, 15521, 4439, 12813, 13071, 12717, 6215, 14123, 13474, 15490, 3398; Payload ID: 11430 relates to Category No.: 13589, 3398, 15490, 3398, 14967, 11512, 8731, 3398, 11506, 3398, 15521, 4439, 10609, 10918, 10394, 11558, 8248, 7795, 10422, 8220, 8131, 12697, 10427, 8470, 8739, 13594, 1867, 8549, 6215, 2353, 10913, 10730, 11164, 11360, 10648, 15517, 8004, 14083; Payload ID: 11431 relates to Category No.: 13589, 3398, 11512, 8739, 14967, 11506, 3398, 5783, 15521, 4439, 8112, 2041, 2353, 10609, 10918, 15662, 12717, 10424, 6215, 10394, 11558, 8248, 7795, 13989, 10422, 11496, 8220, 11310, 790, 8243, 8131, 14981, 12697, 10427, 8470, 8437, 8607, 15490, 3398, 15517, 8731, 3398, 1867, 8549, 6219, 5541; Payload ID: 11432 relates to Category No.: 13589, 3398, 11512, 14565, 8739, 14967, 5783, 1184, 15521, 14663, 4439, 1189, 7652, 1916, 12539, 12699, 9067, 13646, 5763, 2081, 10671, 15490, 3398, 13594, 9125, 10221, 13925, 13860, 12584, 3246; Payload ID: 11433 relates to Category No.: 13589, 3398, 15490, 3398, 14967, 5783, 11512, 16308, 3988, 14565, 8731, 3398, 11506, 3398, 15521, 4439, 14972, 16309, 3473, 10648; Payload ID: 11434 relates to Category No.: 13589, 3398, 11512, 14565, 14967, 687, 5783, 15521, 4439, 15490, 3398, 8731, 3398, 9455; Payload ID: 11435 relates to Category No.: 13589, 3398, 14967, 15521, 4439, 8739, 8731, 3398, 11336, 15490, 3398; Payload ID: 11436 relates to Category No.: 8862, 13589, 3398, 11512, 1730, 14967, 14838, 15521, 4439, 7131, 15490, 3398, 10539, 2235, 6670, 11062, 9538, 10270; Payload ID: 11437 relates to Category No.: 8862, 13589, 3398, 14967, 15521, 4439, 8739, 15517, 2243, 14782, 11512, 16214, 4021, 8375, 14056, 1463, 7613, 1741, 10226, 10372, 6323, 1295, 3070, 1112, 14729, 7625, 9333, 4478, 11414, 11084, 6082, 10349, 12754, 8367, 2248, 659, 12656, 495, 13583, 4253, 718, 12639; Payload ID: 11438 relates to Category No.: 13589, 3398, 15490, 3398, 14967, 14565, 15517, 5783, 16214, 15521, 4439, 10005, 8739, 11512, 4059, 7743, 14056, 11340; Payload ID: 11439 relates to Category No.: 13589, 3398, 14565, 8739, 14967, 5783, 15521, 4439, 11310, 8934, 4251, 2251, 15490, 3398; Payload ID: 11440 relates to Category No.: 6219, 13594, 13589, 3398, 15490, 3398, 14565, 8739, 14967, 8731, 3398, 11506, 3398, 5783, 7835, 7924, 7923, 13614, 5406, 1249, 724, 8934, 14636, 4251, 4167, 6192, 6625, 10035, 6404, 15740, 12374, 13835; Payload ID: 11441 relates to Category No.: 13589, 3398, 14565, 8739, 14967, 5783, 15521, 4439, 8928, 3161, 3743, 15490, 3398; Payload ID: 11442 relates to Category No.: 13589, 3398, 15490, 3398, 11512, 14565, 14967, 15517, 2409, 15521, 4439, 4518, 4514, 2118, 472, 6560, 11089, 6624, 8017, 12908, 4515, 12905; Payload ID: 11443 relates to Category No.: 13589, 3398, 15490, 3398, 14967, 2159, 3973, 14565, 15521, 4439; Payload ID: 11444 relates to Category No.: 13589, 3398, 5783, 14967, 15517, 10238, 11506, 3398, 14620, 7724, 795, 7840, 4094, 2080, 1944, 11512, 13638, 14565, 5446, 4186, 9891, 15521, 4127, 3775, 4439, 8988, 10558, 2143, 1970, 1762, 3708; Payload ID: 11445 relates to Category No.: 13589, 3398, 15490, 3398, 11512, 14565, 14967, 5783, 15521, 4094, 4439, 3437, 1944, 1968, 15517, 11634, 12891, 8934, 11506, 3398, 483, 8929, 13882, 10331, 12779, 3428, 8373, 2083, 8862, 2178, 3425, 13775, 13416, 2177, 4931, 8933, 4443; Payload ID: 11446 relates to Category No.: 13589, 3398, 11512, 8739, 14967, 5783, 15521, 1204, 4094, 4439, 6615, 12813, 11391, 10574, 1895, 1930, 10324, 4418, 10611, 10960, 10669, 2604, 13489, 11035, 13638, 1944, 2033, 8096, 3727, 12339, 10958, 10614, 1026, 11506, 3398, 7613, 5459, 14439, 480, 8920, 8373, 13877, 6796, 5073, 10349, 16176, 10900, 8432, 15517, 13981, 9411; Payload ID: 11447 relates to Category No.: 13589, 3398, 11512, 14967, 1816, 5783, 5268, 15521, 4439, 15424, 10952, 11737, 13511, 13594, 1730, 11506, 3398, 472, 6530, 6508, 7305, 13737, 6391, 5263, 7978, 15517, 4138, 15490, 3398; Payload ID: 11448 relates to Category No.: 13589, 3398, 11512, 14967, 11506, 3398, 5783, 5268, 15521, 3564, 4439, 3632, 15424, 5244, 11607, 15517, 12646, 1189, 3791, 2353, 9555, 15490, 3398; Payload ID: 11449 relates to Category No.: 13589, 3398, 8739, 14967, 5783, 4367, 14838, 15521, 1780, 4439, 15517, 11512, 15490, 3398; Payload ID: 11450 relates to Category No.: 13594, 11512, 15517, 9420, 7122, 4448, 13835, 13925, 13882, 9411, 13829, 13849; Payload ID: 11451 relates to Category No.: 4439, 16197, 7280, 10117, 15626, 7295; Payload ID: 11452 relates to Category No.: 15626, 7306, 7295, 7280, 10117, 14275; Payload ID: 11453 relates to Category No.: 15626, 7280, 7306, 7295, 10117, 14275; Payload ID: 11454 relates to Category No.: 15626, 7280, 10117; Payload ID: 11455 relates to Category No.: 7306, 7280, 10117, 14275; Payload ID: 11456 relates to Category No.: 7288, 9238, 14271, 12484, 16182, 3198; Payload ID: 11457 relates to Category No.: 13589, 3398, 15517, 11506, 3398, 14663, 14123, 11512, 11414, 13509; Payload ID: 11458 relates to Category No.: 13589, 3398, 15490, 3398, 14663, 11506, 3398; Payload ID: 11459 relates to Category No.: 13594, 13589, 3398, 11926, 14663, 15517, 11512, 11506, 3398; Payload ID: 11460 relates to Category No.: 13589, 3398, 5428, 8739, 15517, 16197, 8298; Payload ID: 11461 relates to Category No.: 13589, 3398, 8739, 15517; Payload ID: 11462 relates to Category No.: 15626, 11949, 15606, 11922, 11259, 8804; Payload ID: 11463 relates to Category No.: 15626, 11922, 14201; Payload ID: 11464 relates to Category No.: 12137, 15626, 7295; Payload ID: 11465 relates to Category No.: 14177, 11465; Payload ID: 11466 relates to Category No.: 3452, 1955, 3354, 7134, 13904; Payload ID: 11467 relates to Category No.: 3452, 1955, 3354, 7134, 13904; Payload ID: 11468 relates to Category No.: 13807, 13378; Payload ID: 11469 relates to Category No.: 13876, 14009, 13860, 7688, 8117, 7619, 7971, 10611, 8015, 5536, 13937, 11473; Payload ID: 11470 relates to Category No.: 14318, 1721, 7154, 9243; Payload ID: 11471 relates to Category No.: 7141, 7159, 7138, 3888, 11033; Payload ID: 11472 relates to Category No.: 14318, 14177; Payload ID: 11474 relates to Category No.: 15490, 3398, 6636, 11535; Payload ID: 11476 relates to Category No.: 12498, 7613, 14271, 5434, 7965, 7290, 12066, 8431, 8567, 13696, 12891, 13882, 8785, 1250, 5806, 13244, 13909, 7698, 1554, 8363, 13885, 8663, 8311, 8339; Payload ID: 11479 relates to Category No.: 14318, 15704; Payload ID: 11481 relates to Category No.: 14318, 3356, 10362; Payload ID: 11482 relates to Category No.: 9982, 14267, 7261, 7207, 6631, 2517, 151, 6360; Payload ID: 11483 relates to Category No.: 14320, 11884, 8454, 14313; Payload ID: 11484 relates to Category No.: 8906, 1204, 14171; Payload ID: 11485 relates to Category No.: 690, 11535, 11512, 14838, 6271, 3639, 7613, 2041, 11566, 13447, 10852; Payload ID: 11486 relates to Category No.: 5782, 14565, 2167, 7613, 10372, 11109, 3354, 7743, 11506, 3398, 9274, 9238, 7777, 16197, 14015, 11997, 7834, 12066, 11546, 1709, 2195, 12799, 14175, 8523, 12677, 12805, 12791, 10353; Payload ID: 11487 relates to Category No.: 2411, 3564, 14586, 12848, 9376, 10971, 11940, 10522, 10331, 10519; Payload ID: 11488 relates to Category No.: 14318, 14320; Payload ID: 11489 relates to Category No.: 15618, 14661, 12137, 15626, 1512, 2885, 15715, 1893, 14663, 4439, 16197, 16193, 7132, 12120, 7187, 7188, 7280, 9201, 11660, 1995, 4442, 7155, 5048, 12914, 4541, 16201, 12671; Payload ID: 11490 relates to Category No.: 15618, 14661, 12137, 1512, 2885, 15715, 1893, 14663, 4439, 16197, 16193, 7132, 12120, 7187, 7188, 7280, 11660, 1995, 4442, 7155, 5048, 12914, 4541, 16201, 12671, 9205, 9584; Payload ID: 11491 relates to Category No.: 15618, 12137, 1512, 2885, 15715, 1893, 14663, 4439, 16197, 16193, 7132, 7295, 12120, 7187, 7188, 9201, 11660, 1995, 16189, 16196, 4442, 7155, 5048, 12914, 4541, 16201, 12671, 8590, 7154; Payload ID: 11492 relates to Category No.: 15618, 1512, 2885, 15715, 1893, 14663, 4439, 16197, 16193, 7132, 12120, 7187, 7188, 11660, 1995, 9165, 4442, 7155, 5048, 12914, 4541, 16201, 12671, 963, 11949, 7280, 9238; Payload ID: 11493 relates to Category No.: 15618, 14661, 12137, 1512, 2885, 15715, 1893, 14663, 4439, 16197, 16193, 7132, 12120, 7187, 7188, 7280, 11660, 1995, 4442, 7155, 5048, 12914, 4541, 16201, 12671; Payload ID: 11494 relates to Category No.: 15618, 12137, 1512, 2885, 15715, 1893, 14663, 4439, 16197, 16193, 7132, 7295, 12120, 7187, 7188, 11660, 1995, 4442, 7155, 5048, 12914, 4541, 16201, 12671; Payload ID: 11495 relates to Category No.: 15618, 1512, 2885, 15715, 9238, 1893, 14663, 4439, 16197, 16193, 7132, 7295, 12120, 7187, 7188, 9201, 11660, 1995, 11949, 3400, 4442, 7155, 5048, 12914, 4541, 16201, 12671; Payload ID: 11496 relates to Category No.: 15618, 12137, 1512, 2885, 15715, 1893, 14663, 4439, 16197, 16193, 7132, 7295, 12120, 7187, 7188, 11660, 1995, 4442, 7155, 5048, 12914, 4541, 16201, 12671; Payload ID: 11497 relates to Category No.: 14834, 14520; Payload ID: 11498 relates to Category No.: 15618, 1512, 2885, 13186, 15715, 1893, 14663, 4439, 16197, 16193, 7132, 12120, 7187, 7188, 11660, 1995, 11922, 4442, 7155, 5048, 12914, 4541, 16201, 12671, 12619, 11949, 7280, 7154; Payload ID: 11499 relates to Category No.: 15618, 12137, 1512, 2885, 15715, 1893, 14663, 4439, 16197, 16193, 7132, 7295, 12120, 7187, 7188, 11660, 1995, 4442, 7155, 5048, 12914, 4541, 16201, 12671; Payload ID: 11500 relates to Category No.: 1737, 15618, 14661, 12137, 1512, 2885, 15715, 7154, 1893, 14663, 4439, 16197, 16193, 7132, 7295, 12120, 7187, 7188, 2429, 11660, 1995, 4442, 7155, 5048, 12914, 4541, 16201, 12671; Payload ID: 11501 relates to Category No.: 1737, 15618, 14661, 12137, 1512, 2885, 15715, 7154, 1893, 14663, 4439, 16197, 16193, 7132, 7295, 12120, 7187, 7188, 2429, 11660, 1995, 4442, 7155, 5048, 12914, 4541, 16201, 12671; Payload ID: 11502 relates to Category No.: 15618, 12137, 1512, 2885, 15715, 1893, 14663, 4439, 16197, 16193, 7132, 7295, 12120, 7187, 7188, 5788, 11660, 1995, 4442, 7155, 5048, 12914, 4541, 16201, 12671; Payload ID: 11503 relates to Category No.: 15618, 1512, 2885, 15715, 1893, 14663, 4439, 16197, 16193, 7132, 7295, 12120, 7187, 7188, 11660, 1995, 4442, 7155, 5048, 12914, 4541, 16201, 12671, 9238, 11940, 11934, 12122, 11935, 11936, 13357; Payload ID: 11504 relates to Category No.: 15618, 12137, 1512, 2885, 15715, 1893, 14663, 4439, 16197, 16193, 7132, 7295, 12120, 7187, 7188, 11660, 1995, 4442, 7155, 5048, 12914, 4541, 16201, 12671, 9238, 11940, 11934, 11935, 11936, 13357; Payload ID: 11505 relates to Category No.: 15618, 15490, 3398, 1512, 2885, 7613, 13465, 7743, 1727, 11506, 3398, 15715, 1795, 10775, 5268, 1893, 14663, 4439, 16197, 16193, 7132, 7295, 12120, 7187, 7188, 11660, 1995, 4442, 7155, 5048, 12914, 4541, 16201, 12671, 8496, 10567, 13395, 14838, 7154, 11949, 11936, 13357; Payload ID: 11506 relates to Category No.: 12137; Payload ID: 11507 relates to Category No.: 15618, 14661, 12137, 1512, 2885, 15715, 1893, 14663, 4439, 16197, 16193, 7132, 7295, 12120, 7187, 7188, 11660, 1995, 4442, 7155, 5048, 12914, 4541, 16201, 12671, 2311, 6018, 6462; Payload ID: 11508 relates to Category No.: 15618, 1512, 2885, 15715, 11949, 1893, 14663, 4439, 16197, 16193, 7132, 12120, 7187, 7188, 7280, 14165, 11660, 1995, 14172, 11922, 4442, 7155, 5048, 12914, 4541, 16201, 12671, 7154; Payload ID: 11509 relates to Category No.: 15618, 15626, 1512, 2885, 15715, 11949, 1893, 14663, 4439, 16197, 16193, 7132, 12120, 7187, 7188, 9201, 11660, 1995, 10117, 7131, 10491, 4442, 7155, 5048, 12914, 4541, 16201, 12671; Payload ID: 11510 relates to Category No.: 15618, 14661, 15626, 1512, 2885, 3356, 15715, 9238, 1893, 14663, 4439, 16197, 16193, 7132, 7295, 12120, 7187, 7188, 9201, 11660, 1995, 11949, 3400, 4442, 7155, 5048, 12914, 4541, 16201, 12671, 9205; Payload ID: 11511 relates to Category No.: 15618, 1512, 2885, 15715, 1893, 14663, 4439, 16197, 16193, 7132, 7295, 12120, 7187, 7188, 11660, 1995, 11922, 4442, 7155, 5048, 12914, 4541, 16201, 12671; Payload ID: 11512 relates to Category No.: 9500, 1730, 16286, 8831, 8547, 1598; Payload ID: 11513 relates to Category No.: 9994; Payload ID: 11514 relates to Category No.: 9994, 16214, 14455, 14449; Payload ID: 11515 relates to Category No.: 3100; Payload ID: 11516 relates to Category No.: 10372, 3356, 9274; Payload ID: 11517 relates to Category No.: 9274, 11091, 10735, 10747, 13508, 10740; Payload ID: 11518 relates to Category No.: 9274; Payload ID: 11519 relates to Category No.: 9274; Payload ID: 11520 relates to Category No.: 9274; Payload ID: 11521 relates to Category No.: 9274; Payload ID: 11522 relates to Category No.: 1746, 1862, 14663, 5874, 7777, 2197, 12003; Payload ID: 11523 relates to Category No.: 14663, 5874; Payload ID: 11524 relates to Category No.: 7088, 7121; Payload ID: 11525 relates to Category No.: 334, 5785, 14565, 5428, 795, 5446, 11109, 12498, 345, 3013, 7362, 10775, 3012, 15003, 5912, 15456, 15450, 7363, 15448, 15443, 15454, 15446, 15653, 15457, 15458, 12066, 10470, 10496, 15451, 9292, 6125, 9295, 2065, 11110, 3119, 3120, 5716, 10583, 11566, 11419, 3016, 10878, 10851, 10356, 10821, 11113; Payload ID: 11526 relates to Category No.: 12498, 11512, 5785, 5446, 11109, 345, 12999, 3013, 7362, 10775, 3012, 6494, 10262, 10878, 15003, 5912, 15456, 15450, 7363, 15448, 15443, 11125, 15454, 10583, 10822, 10826, 10851, 10855, 11566, 15446, 15653, 15457, 15458, 11114, 12066, 11419, 10496, 11186, 15451, 10821, 9292, 6125, 9295, 10574, 9294, 2065, 11110, 2884, 3119, 11161, 10835, 11234, 11569, 347, 13952, 8244, 3120, 10477, 2879, 3151, 10640, 11233, 11182, 10955, 11178, 13925, 13840, 8390, 3016, 8045, 8113, 10764, 8782, 8141, 5447, 10829, 8129, 10794, 13982, 8149, 13241, 8686, 2089, 5384, 8721, 338, 10230, 10277, 8146, 6469; Payload ID: 11527 relates to Category No.: 8739, 15490, 3398, 11940, 10372, 8731, 3398; Payload ID: 11528 relates to Category No.: 5376; Payload ID: 11531 relates to Category No.: 1737, 14661, 7306, 7154, 1780, 7132; Payload ID: 11532 relates to Category No.: 1737, 14661, 6975, 1752, 2196, 2243, 9420, 7137, 7132, 3889, 16170, 3875, 2197, 4336, 2429; Payload ID: 11533 relates to Category No.: 6975, 1752, 7137, 3889, 13232, 16170, 3875, 2197, 14661, 10702, 7132, 2429, 13032, 8934, 6969, 14095, 337, 2250, 2175, 5453, 8937, 8905, 12194, 10260, 8936, 10257, 9163; Payload ID: 11534 relates to Category No.: 13975, 3354, 14663, 9236, 12252, 3351, 3210, 9234, 2972; Payload ID: 11535 relates to Category No.: 14663, 5501; Payload ID: 11536 relates to Category No.: 14663, 5501; Payload ID: 11537 relates to Category No.: 7512, 7475, 6814; Payload ID: 11538 relates to Category No.: 6814; Payload ID: 11539 relates to Category No.: 6814; Payload ID: 11540 relates to Category No.: 14663, 9236, 3210, 9234; Payload ID: 11541 relates to Category No.: 12194, 10372, 3100, 14663, 7270, 9236, 10355, 9234, 423, 10533, 8597, 14713, 3295, 5348, 16305; Payload ID: 11542 relates to Category No.: 6814; Payload ID: 11543 relates to Category No.: 6814; Payload ID: 11544 relates to Category No.: 14663, 9236, 9234, 2959, 3202, 4424, 6814; Payload ID: 11545 relates to Category No.: 6814, 1204; Payload ID: 11546 relates to Category No.: 9232, 795, 13998; Payload ID: 11547 relates to Category No.: 7288, 15517, 12133, 7291, 16182, 14271, 7287, 15291, 4439, 7261; Payload ID: 11548 relates to Category No.: 6814; Payload ID: 11549 relates to Category No.: 1816, 14663, 5501, 3222, 3278; Payload ID: 11550 relates to Category No.: 5785, 1451, 14663, 5788, 5501, 2814, 13441, 2822, 6814; Payload ID: 11551 relates to Category No.: 9287, 14663, 9236, 9234, 3467, 14152, 9232, 6814; Payload ID: 11552 relates to Category No.: 6814, 1204; Payload ID: 11553 relates to Category No.: 1204, 9253, 2553, 233, 1334, 6814; Payload ID: 11554 relates to Category No.: 6814; Payload ID: 11555 relates to Category No.: 14663, 9236, 9234, 5348, 458, 6814; Payload ID: 11556 relates to Category No.: 7154, 1737, 14661, 7132, 2429; Payload ID: 11557 relates to Category No.: 1026, 10366, 9125, 11087, 8530, 6080, 8895, 6376, 1048, 4251, 8402, 8862, 8898, 450, 11214; Payload ID: 11558 relates to Category No.: 8862, 2885, 11087, 12052, 6080, 8895, 1048, 4251, 8898, 450, 10495; Payload ID: 11559 relates to Category No.: 1204; Payload ID: 11560 relates to Category No.: 690, 1730, 3402, 13029, 2353, 12048, 14981; Payload ID: 11568 relates to Category No.: 1204, 14014, 16214; Payload ID: 11569 relates to Category No.: 1204, 3328; Payload ID: 11570 relates to Category No.: 3354, 3337, 3333, 3314, 1955, 12734, 7728, 2079, 13969, 14025, 13827, 13837, 2022, 10521, 13849, 2083, 6561; Payload ID: 11571 relates to Category No.: 12246; Payload ID: 11572 relates to Category No.: 932, 6814; Payload ID: 11573 relates to Category No.: 12091, 14661, 10702, 13435, 10238, 7306, 803, 13485, 8988, 7131, 14365, 12025; Payload ID: 11574 relates to Category No.: 2940, 6969, 13171, 4766, 10495, 1572, 12021; Payload ID: 11575 relates to Category No.: 795, 11884, 1183, 1814, 11765, 1844, 6902, 14350, 14341; Payload ID: 11579 relates to Category No.: 6219, 14661, 14565, 10702, 9861, 13485, 12942, 2459, 9858, 9945, 14663, 5501, 5406; Payload ID: 11580 relates to Category No.: 15618; Payload ID: 11581 relates to Category No.: 16214; Payload ID: 11582 relates to Category No.: 15490, 3398, 11512, 1730, 7613, 8739, 4949, 2376, 10648, 9540, 14944, 3610, 10287, 7937, 3584, 3594, 3578, 3609, 11791, 6812, 10574, 7001, 16005, 6857, 16023, 9320, 6860, 11643, 6844, 10647, 3611, 6872, 1786, 6861, 6768, 14804, 14809, 6808, 8365, 13722, 16004, 6864, 6853, 6854, 9598, 6831, 6878, 2110, 4789, 5735; Payload ID: 11583 relates to Category No.: 11512, 1730, 8739, 10372, 11506, 3398, 2376, 3564, 10648, 1274, 9540, 3610, 10287, 3584, 3594, 3578, 3609, 6878, 6812, 10574, 7001, 4065, 9320, 3613, 3611, 4946, 9457, 15517, 11791, 10647; Payload ID: 11584 relates to Category No.: 5428, 10702, 9321, 12459, 11285, 10648, 1206, 1893, 10577, 14050; Payload ID: 11585 relates to Category No.: 15626, 14455, 14451, 14014; Payload ID: 11586 relates to Category No.: 15626, 14455, 2310; Payload ID: 11587 relates to Category No.: 15626, 14455, 2310; Payload ID: 11588 relates to Category No.: 1207, 4104, 15660, 6211, 6310, 1867, 14663; Payload ID: 11589 relates to Category No.: 8862, 10648, 1549, 12522, 8004, 10578, 8953, 978, 8377, 12066, 12537, 7649; Payload ID: 11590 relates to Category No.: 12105, 11389, 16214, 6296; Payload ID: 11591 relates to Category No.: 4059; Payload ID: 11592 relates to Category No.: 6814, 11940, 1703, 11425, 8106, 8103; Payload ID: 11594 relates to Category No.: 4021; Payload ID: 11595 relates to Category No.: 4021; Payload ID: 11596 relates to Category No.: 7306; Payload ID: 11597 relates to Category No.: 14565, 15149, 14455, 8906; Payload ID: 11598 relates to Category No.: 4828, 3127, 14455; Payload ID: 11599 relates to Category No.: 4828, 3127, 1795; Payload ID: 11600 relates to Category No.: 4828, 3127, 14455; Payload ID: 11601 relates to Category No.: 4828, 3127, 3124; Payload ID: 11602 relates to Category No.: 4828, 3127, 3124; Payload ID: 11603 relates to Category No.: 4828, 3127, 3124; Payload ID: 11604 relates to Category No.: 4828, 3127, 1795; Payload ID: 11605 relates to Category No.: 4828, 14565, 3127; Payload ID: 11606 relates to Category No.: 4828, 3127, 14455; Payload ID: 11607 relates to Category No.: 4828, 3127, 14455; Payload ID: 11608 relates to Category No.: 4828, 3127, 14455; Payload ID: 11609 relates to Category No.: 4828, 3127, 14455; Payload ID: 11610 relates to Category No.: 4828, 3127, 14455; Payload ID: 11611 relates to Category No.: 4828, 3127, 3124; Payload ID: 11612 relates to Category No.: 4828, 3127, 3124, 10481; Payload ID: 11613 relates to Category No.: 4828, 3127, 3124; Payload ID: 11614 relates to Category No.: 4828, 3127, 14455, 3124; Payload ID: 11615 relates to Category No.: 4828, 3127, 14455, 2311, 14586, 7252, 11949, 15606; Payload ID: 11616 relates to Category No.: 4828, 3127, 14455; Payload ID: 11617 relates to Category No.: 4828, 3127, 14455, 3124; Payload ID: 11618 relates to Category No.: 4828, 14565, 3127, 3124, 14451; Payload ID: 11619 relates to Category No.: 4828, 14565, 3127, 3124; Payload ID: 11620 relates to Category No.: 4828, 14565, 3127, 3124; Payload ID: 11621 relates to Category No.: 4828, 3127, 3124; Payload ID: 11622 relates to Category No.: 4828, 3127, 3124; Payload ID: 11623 relates to Category No.: 4828, 3127, 3124; Payload ID: 11624 relates to Category No.: 4828, 3127, 3124; Payload ID: 11625 relates to Category No.: 4828, 3127, 3124; Payload ID: 11626 relates to Category No.: 4828, 3127, 3124; Payload ID: 11627 relates to Category No.: 4828, 3127, 3124; Payload ID: 11628 relates to Category No.: 4828, 3127, 3124; Payload ID: 11629 relates to Category No.: 4828, 3127, 3124; Payload ID: 11630 relates to Category No.: 4828, 3127, 3124; Payload ID: 11631 relates to Category No.: 4828, 3127, 3124; Payload ID: 11632 relates to Category No.: 4828, 3127, 3124; Payload ID: 11633 relates to Category No.: 4828, 3127, 3124; Payload ID: 11634 relates to Category No.: 4828, 3127, 14455, 3124; Payload ID: 11635 relates to Category No.: 4828, 3127, 3124; Payload ID: 11636 relates to Category No.: 4828, 3127, 3124; Payload ID: 11637 relates to Category No.: 4828, 3127, 14455; Payload ID: 11638 relates to Category No.: 4828, 3127, 14455; Payload ID: 11639 relates to Category No.: 4828, 3127, 14455, 1026; Payload ID: 11640 relates to Category No.: 4828, 3127, 14455; Payload ID: 11641 relates to Category No.: 4828, 3127, 14455; Payload ID: 11642 relates to Category No.: 4828, 3127, 14455; Payload ID: 11644 relates to Category No.: 4828, 3127, 14455; Payload ID: 11645 relates to Category No.: 4828, 3127, 14455; Payload ID: 11646 relates to Category No.: 4828, 3127, 14455; Payload ID: 11647 relates to Category No.: 4828, 3127, 14455; Payload ID: 11648 relates to Category No.: 4828, 3127, 14455; Payload ID: 11649 relates to Category No.: 4828, 3127, 14455; Payload ID: 11650 relates to Category No.: 4828, 3127, 14455; Payload ID: 11651 relates to Category No.: 4828, 3127; Payload ID: 11652 relates to Category No.: 4828, 3127, 14455; Payload ID: 11653 relates to Category No.: 4828, 3127, 14455; Payload ID: 11654 relates to Category No.: 4828, 3127, 14455; Payload ID: 11655 relates to Category No.: 4828, 3127; Payload ID: 11656 relates to Category No.: 4828, 3127; Payload ID: 11657 relates to Category No.: 4828, 3127; Payload ID: 11658 relates to Category No.: 4828, 3127, 1204; Payload ID: 11659 relates to Category No.: 4828, 3127; Payload ID: 11660 relates to Category No.: 4828, 3127, 14455, 14451, 14586; Payload ID: 11661 relates to Category No.: 4828, 3127, 3124; Payload ID: 11663 relates to Category No.: 4828, 3127; Payload ID: 11664 relates to Category No.: 4828, 3127, 3124; Payload ID: 11665 relates to Category No.: 4828, 3127, 3124; Payload ID: 11666 relates to Category No.: 4828, 3127, 14455; Payload ID: 11667 relates to Category No.: 4828, 3127, 14455; Payload ID: 11668 relates to Category No.: 4828, 3127, 3124; Payload ID: 11669 relates to Category No.: 4828, 3127, 14455; Payload ID: 11670 relates to Category No.: 4828, 3127, 3124; Payload ID: 11671 relates to Category No.: 4828, 3127, 14455; Payload ID: 11672 relates to Category No.: 4828, 3127, 14455; Payload ID: 11673 relates to Category No.: 4828, 3127, 1795; Payload ID: 11674 relates to Category No.: 4828, 3127, 3124; Payload ID: 11675 relates to Category No.: 4828, 3127, 1795; Payload ID: 11676 relates to Category No.: 4828, 3127, 1795; Payload ID: 11677 relates to Category No.: 4828, 3127, 1795; Payload ID: 11678 relates to Category No.: 4828, 3127, 1795; Payload ID: 11679 relates to Category No.: 4828, 3127, 1795; Payload ID: 11680 relates to Category No.: 4828, 3127; Payload ID: 11681 relates to Category No.: 4828, 3127, 1795; Payload ID:

11683 relates to Category No.: 4828, 3127, 14455, 1204; Payload ID: 11685 relates to Category No.: 4828, 3127, 3124; Payload ID: 11686 relates to Category No.: 4828, 3127; Payload ID: 11687 relates to Category No.: 4828, 3127, 14455; Payload ID: 11688 relates to Category No.: 4828, 3127; Payload ID: 11689 relates to Category No.: 4828, 3127, 14455; Payload ID: 11690 relates to Category No.: 4828, 3127, 14455, 11294; Payload ID: 11691 relates to Category No.: 4828, 3127; Payload ID: 11693 relates to Category No.: 4828, 3127, 14455; Payload ID: 11694 relates to Category No.: 4828, 3127, 14455; Payload ID: 11695 relates to Category No.: 4828, 3127, 14455; Payload ID: 11696 relates to Category No.: 4828, 3127, 1816, 432; Payload ID: 11697 relates to Category No.: 4828, 3127, 3124; Payload ID: 11698 relates to Category No.: 4828, 3127, 14455; Payload ID: 11699 relates to Category No.: 4828, 3127, 14455; Payload ID: 11700 relates to Category No.: 4828, 3127, 14455; Payload ID: 11701 relates to Category No.: 4828, 3127, 14455; Payload ID: 11702 relates to Category No.: 4828, 3127, 14455; Payload ID: 11703 relates to Category No.: 4828, 3127, 14455; Payload ID: 11704 relates to Category No.: 4828, 3127, 14455; Payload ID: 11705 relates to Category No.: 4828, 3127, 14455; Payload ID: 11706 relates to Category No.: 4828, 3127, 14455; Payload ID: 11707 relates to Category No.: 4828, 3127, 14455; Payload ID: 11708 relates to Category No.: 4828, 3127, 14455; Payload ID: 11709 relates to Category No.: 4828, 3127, 3124; Payload ID: 11710 relates to Category No.: 4828, 3127, 3124; Payload ID: 11711 relates to Category No.: 4828, 3127, 3124, 12459, 10481; Payload ID: 11712 relates to Category No.: 4828, 3127, 14455; Payload ID: 11713 relates to Category No.: 4828, 3127, 14455; Payload ID: 11714 relates to Category No.: 4828, 3127, 3124; Payload ID: 11715 relates to Category No.: 4828, 3127, 14455; Payload ID: 11716 relates to Category No.: 4828, 3127, 14455; Payload ID: 11717 relates to Category No.: 4828, 3127, 14455; Payload ID: 11718 relates to Category No.: 4828, 3127, 14455; Payload ID: 11719 relates to Category No.: 4828, 3127, 14455; Payload ID: 11720 relates to Category No.: 4828, 3127; Payload ID: 11721 relates to Category No.: 4828, 3127, 3124; Payload ID: 11722 relates to Category No.: 4828, 3127, 14455; Payload ID: 11723 relates to Category No.: 4828, 3127, 14455; Payload ID: 11724 relates to Category No.: 4828, 3127, 14455; Payload ID: 11725 relates to Category No.: 4828, 3127, 14455; Payload ID: 11726 relates to Category No.: 4828, 3127, 14455; Payload ID: 11727 relates to Category No.: 4828, 3127, 14455; Payload ID: 11728 relates to Category No.: 4828, 3127, 14455; Payload ID: 11729 relates to Category No.: 4828, 3127, 14455; Payload ID: 11730 relates to Category No.: 4828, 14565, 3127, 14455; Payload ID: 11731 relates to Category No.: 4828, 3127, 14455; Payload ID: 11732 relates to Category No.: 4828, 3127, 14455; Payload ID: 11733 relates to Category No.: 4828, 3127, 14455; Payload ID: 11734 relates to Category No.: 4828, 3127, 14455; Payload ID: 11735 relates to Category No.: 4828, 3127, 14455; Payload ID: 11736 relates to Category No.: 4828, 3127, 14455, 3012, 6628; Payload ID: 11737 relates to Category No.: 4828, 3127, 14455; Payload ID: 11738 relates to Category No.: 4828, 3127, 14455; Payload ID: 11739 relates to Category No.: 4828, 3127, 14455; Payload ID: 11740 relates to Category No.: 4828, 3127, 14455; Payload ID: 11741 relates to Category No.: 4828, 3127, 14455, 1204; Payload ID: 11742 relates to Category No.: 4828, 3127, 14455, 1204; Payload ID: 11743 relates to Category No.: 4828, 3127, 14455, 1204; Payload ID: 11744 relates to Category No.: 4828, 3127, 14455, 1204; Payload ID: 11745 relates to Category No.: 4828, 3127, 14455, 1204; Payload ID: 11746 relates to Category No.: 4828, 3127, 14455; Payload ID: 11747 relates to Category No.: 4828, 3127, 14455; Payload ID: 11748 relates to Category No.: 4828, 3127, 14455; Payload ID: 11749 relates to Category No.: 4828, 3127, 14455; Payload ID: 11750 relates to Category No.: 4828, 3127, 14455; Payload ID: 11751 relates to Category No.: 4828, 3127, 14455; Payload ID: 11752 relates to Category No.: 4828, 3127, 14455; Payload ID: 11753 relates to Category No.: 4828, 3127, 14455; Payload ID: 11754 relates to Category No.: 4828, 3127, 14455; Payload ID: 11755 relates to Category No.: 4828, 3127, 14455; Payload ID: 11756 relates to Category No.: 4828, 3127, 14455; Payload ID: 11757 relates to Category No.: 4828, 3127, 14455; Payload ID: 11758 relates to Category No.: 4828, 3127, 14455; Payload ID: 11759 relates to Category No.: 4828, 3127, 14455; Payload ID: 11760 relates to Category No.: 4828, 3127, 14455; Payload ID: 11761 relates to Category No.: 4828, 3127, 14455; Payload ID: 11762 relates to Category No.: 4828, 3127, 14455; Payload ID: 11763 relates to Category No.: 4828, 3127, 14455; Payload ID: 11764 relates to Category No.: 4828, 3127, 14455; Payload ID: 11765 relates to Category No.: 4828, 3127, 14455; Payload ID: 11766 relates to Category No.: 4828, 3127; Payload ID: 11767 relates to Category No.: 4828, 3127, 14455; Payload ID: 11768 relates to Category No.: 4828, 3127, 14455; Payload ID: 11769 relates to Category No.: 4828, 3127, 14455; Payload ID: 11770 relates to Category No.: 4828, 3127, 14455; Payload ID: 11771 relates to Category No.: 4828, 3127, 14455; Payload ID: 11772 relates to Category No.: 4828, 3127, 14455; Payload ID: 11773 relates to Category No.: 4828, 3127, 14455; Payload ID: 11774 relates to Category No.: 4828, 14565, 3127, 3124; Payload ID: 11775 relates to Category No.: 4828, 14565, 3127, 3124, 14451; Payload ID: 11776 relates to Category No.: 4828, 14565, 3127, 3124; Payload ID: 11777 relates to Category No.: 4828, 3127, 3124; Payload ID: 11778 relates to Category No.: 4828, 3127, 3124; Payload ID: 11779 relates to Category No.: 4828, 3127, 3124; Payload ID: 11780 relates to Category No.: 4828, 3127, 3124; Payload ID: 11782 relates to Category No.: 4828, 3127, 3124; Payload ID: 11783 relates to Category No.: 4828, 3127, 3124; Payload ID: 11784 relates to Category No.: 4828, 3127, 3124; Payload ID: 11785 relates to Category No.: 4828, 3127, 3124; Payload ID: 11786 relates to Category No.: 4828, 3127, 3124; Payload ID: 11787 relates to Category No.: 4828, 3127, 3124; Payload ID: 11788 relates to Category No.: 4828, 3127, 3124; Payload ID: 11789 relates to Category No.: 4828, 3127, 3124; Payload ID: 11790 relates to Category No.: 4828, 3127, 3124; Payload ID: 11791 relates to Category No.: 4828, 3127, 3124; Payload ID: 11792 relates to Category No.: 4828, 3127, 14455, 3124; Payload ID: 11793 relates to Category No.: 4828, 3127, 3124; Payload ID: 11794 relates to Category No.: 4828, 3127, 3124; Payload ID: 11795 relates to Category No.: 4828, 3127, 3124; Payload ID: 11796 relates to Category No.: 4828, 3127, 3124; Payload ID: 11797 relates to Category No.: 4828, 3127, 3124; Payload ID: 11798 relates to Category No.: 4828, 3127, 3124; Payload ID: 11799 relates to Category No.: 4828, 3127, 3124; Payload ID: 11800 relates to Category No.: 4828, 3127, 3124; Payload ID: 11801 relates to Category No.: 4828, 3127, 3124; Payload ID: 11802 relates to Category No.: 4828, 3127, 3124; Payload ID: 11803 relates to Category No.: 4828, 3127, 3124; Payload ID: 11804 relates to Category No.: 4828, 3127, 3124; Payload ID: 11805 relates to Category No.: 4828, 3127, 3124;

Payload ID: 11806 relates to Category No.: 4828, 3127, 3124; Payload ID: 11807 relates to Category No.: 4828, 3127, 3124; Payload ID: 11808 relates to Category No.: 4828, 3127, 3124; Payload ID: 11809 relates to Category No.: 4828, 3127, 3124; Payload ID: 11810 relates to Category No.: 4828, 3127, 3124; Payload ID: 11811 relates to Category No.: 4828, 3127, 3124; Payload ID: 11812 relates to Category No.: 4828, 3127, 3124; Payload ID: 11813 relates to Category No.: 4828, 3127, 3124; Payload ID: 11814 relates to Category No.: 4828, 3127, 3124; Payload ID: 11815 relates to Category No.: 4828, 3127, 3124; Payload ID: 11816 relates to Category No.: 4828, 3127, 3124; Payload ID: 11817 relates to Category No.: 4828, 3127, 3124; Payload ID: 11818 relates to Category No.: 4828, 3127, 3124; Payload ID: 11819 relates to Category No.: 4828, 3124, 3127; Payload ID: 11820 relates to Category No.: 4828, 3127, 3124; Payload ID: 11821 relates to Category No.: 4828, 3127, 3124; Payload ID: 11822 relates to Category No.: 4828, 3127, 3124; Payload ID: 11823 relates to Category No.: 4828, 3127; Payload ID: 11824 relates to Category No.: 4828, 3127, 3124; Payload ID: 11825 relates to Category No.: 4828, 3127, 3124; Payload ID: 11826 relates to Category No.: 4828, 3127, 3124; Payload ID: 11827 relates to Category No.: 4828, 3127, 3124; Payload ID: 11828 relates to Category No.: 4828, 3127, 3124; Payload ID: 11829 relates to Category No.: 4828, 3127, 14455; Payload ID: 11830 relates to Category No.: 4828, 3127, 14455; Payload ID: 11832 relates to Category No.: 4828, 3127, 14455; Payload ID: 11833 relates to Category No.: 4828, 3127, 14455; Payload ID: 11834 relates to Category No.: 4828, 3127, 14455; Payload ID: 11835 relates to Category No.: 4828, 3127, 14455; Payload ID: 11836 relates to Category No.: 4828, 3127, 14455; Payload ID: 11837 relates to Category No.: 4828, 3127, 14455; Payload ID: 11838 relates to Category No.: 4828, 3127, 14455; Payload ID: 11839 relates to Category No.: 4828, 3127, 14455; Payload ID: 11840 relates to Category No.: 4828, 3127, 14455; Payload ID: 11841 relates to Category No.: 4828, 3127, 14455; Payload ID: 11842 relates to Category No.: 4828, 3127, 14455; Payload ID: 11843 relates to Category No.: 4828, 3127, 14455; Payload ID: 11844 relates to Category No.: 4828, 3127, 14455; Payload ID: 11845 relates to Category No.: 4828, 3127, 14455; Payload ID: 11846 relates to Category No.: 4828, 3127, 14455; Payload ID: 11847 relates to Category No.: 4828, 3127, 14455; Payload ID: 11848 relates to Category No.: 4828, 3127, 14455; Payload ID: 11849 relates to Category No.: 4828, 3127, 14455; Payload ID: 11851 relates to Category No.: 4828, 3127, 14455; Payload ID: 11852 relates to Category No.: 4828, 3127, 14455; Payload ID: 11853 relates to Category No.: 4828, 3127, 14455; Payload ID: 11854 relates to Category No.: 4828, 3127, 14455; Payload ID: 11855 relates to Category No.: 4828, 3127, 14455; Payload ID: 11857 relates to Category No.: 4828, 14565, 3127, 14455; Payload ID: 11858 relates to Category No.: 4828, 3127, 14455; Payload ID: 11859 relates to Category No.: 4828, 3127, 14455; Payload ID: 11860 relates to Category No.: 4828, 3127, 14455; Payload ID: 11861 relates to Category No.: 4828, 3127, 14455; Payload ID: 11862 relates to Category No.: 4828, 3127, 14455; Payload ID: 11863 relates to Category No.: 4828, 3127, 14455; Payload ID: 11864 relates to Category No.: 4828, 3127, 14455; Payload ID: 11865 relates to Category No.: 4828, 3127, 14455; Payload ID: 11866 relates to Category No.: 4828, 3127, 14455; Payload ID: 11867 relates to Category No.: 4828, 3127, 14455; Payload ID: 11868 relates to Category No.: 4828, 3127, 14455; Payload ID: 11869 relates to Category No.: 4828, 3127, 14455; Payload ID: 11870 relates to Category No.: 4828, 3127, 14455; Payload ID: 11871 relates to Category No.: 4828, 3127, 14455; Payload ID: 11873 relates to Category No.: 4828, 3127, 14455; Payload ID: 11874 relates to Category No.: 4828, 3127, 1816, 432; Payload ID: 11875 relates to Category No.: 4828, 3127; Payload ID: 11876 relates to Category No.: 4828, 3127; Payload ID: 11877 relates to Category No.: 4828, 3127, 14455; Payload ID: 11878 relates to Category No.: 4828, 3127, 14455; Payload ID: 11879 relates to Category No.: 4828, 14565, 3127; Payload ID: 11880 relates to Category No.: 4828, 14565, 3127; Payload ID: 11881 relates to Category No.: 4828, 14565, 3127; Payload ID: 11882 relates to Category No.: 4828, 14565, 3127; Payload ID: 11883 relates to Category No.: 4828, 14565, 3127, 14455; Payload ID: 11884 relates to Category No.: 4828, 14565, 3127, 14455; Payload ID: 11885 relates to Category No.: 4828, 14565, 3127, 14455; Payload ID: 11886 relates to Category No.: 4828, 14565, 3127; Payload ID: 11887 relates to Category No.: 4828, 14565, 3127; Payload ID: 11888 relates to Category No.: 4828, 3127, 14967, 1969, 11327, 10282; Payload ID: 11889 relates to Category No.: 4828, 3127; Payload ID: 11890 relates to Category No.: 4828, 14565, 3127; Payload ID: 11891 relates to Category No.: 4828, 14565, 3127; Payload ID: 11892 relates to Category No.: 4828, 14565, 3127; Payload ID: 11893 relates to Category No.: 4828, 14565, 3127; Payload ID: 11894 relates to Category No.: 4828, 14565, 3127, 14455; Payload ID: 11895 relates to Category No.: 4828, 14565, 3127, 14455; Payload ID: 11896 relates to Category No.: 4828, 3127, 14455; Payload ID: 11897 relates to Category No.: 4828, 14565, 3127; Payload ID: 11898 relates to Category No.: 4828, 14565, 3127, 14455; Payload ID: 11899 relates to Category No.: 4828, 14565, 3127; Payload ID: 11900 relates to Category No.: 4828, 14565, 3127; Payload ID: 11901 relates to Category No.: 4828, 14565, 3127; Payload ID: 11902 relates to Category No.: 4828, 14565, 3127, 14455; Payload ID: 11903 relates to Category No.: 4828, 14565, 3127, 14455; Payload ID: 11904 relates to Category No.: 4828, 14565, 3127, 14455; Payload ID: 11905 relates to Category No.: 4828, 14565, 3127; Payload ID: 11906 relates to Category No.: 4828, 14565, 3127, 2562; Payload ID: 11907 relates to Category No.: 4828, 14565, 3127; Payload ID: 11908 relates to Category No.: 4828, 14565, 3127, 14455; Payload ID: 11909 relates to Category No.: 4828, 14565, 3127; Payload ID: 11910 relates to Category No.: 4828, 14565, 3127; Payload ID: 11911 relates to Category No.: 4828, 14565, 3127; Payload ID: 11912 relates to Category No.: 4828, 14565, 3127; Payload ID: 11913 relates to Category No.: 4828, 14565, 3127; Payload ID: 11914 relates to Category No.: 4828, 14565, 3127; Payload ID: 11915 relates to Category No.: 4828, 14565, 3127; Payload ID: 11916 relates to Category No.: 4828, 14565, 3127; Payload ID: 11917 relates to Category No.: 4828, 14565, 3127; Payload ID: 11918 relates to Category No.: 4828, 14565, 3127; Payload ID: 11919 relates to Category No.: 4828, 14565, 3127; Payload ID: 11920 relates to Category No.: 4828, 14565, 3127; Payload ID: 11921 relates to Category No.: 4828, 14565, 3127; Payload ID: 11922 relates to Category No.: 4828, 14565, 3127; Payload ID: 11923 relates to Category No.: 4828, 14565, 3127; Payload ID: 11924 relates to Category No.: 4828, 14565, 3127; Payload ID: 11925 relates to Category No.: 4828, 14565, 3127; Payload ID: 11926 relates to Category No.: 4828, 14565, 3127; Payload ID: 11927 relates to Category No.: 4828, 14565, 3127; Payload ID: 11928 relates to Category No.: 4828, 3127; Payload ID: 11929 relates to Category No.:

3127, 1816, 432; Payload ID: 11930 relates to Category No.: 4828, 14565, 3127; Payload ID: 11931 relates to Category No.: 3127, 1816, 432; Payload ID: 11932 relates to Category No.: 4828, 3127; Payload ID: 11933 relates to Category No.: 4828, 3127; Payload ID: 11934 relates to Category No.: 4828, 14565, 3127; Payload ID: 11935 relates to Category No.: 4828, 14565, 3127, 14455; Payload ID: 11936 relates to Category No.: 4828, 3127, 14455; Payload ID: 11937 relates to Category No.: 4828, 3127, 14455; Payload ID: 11938 relates to Category No.: 4828, 3127, 14455; Payload ID: 11939 relates to Category No.: 4828, 3127; Payload ID: 11940 relates to Category No.: 4828, 3127, 14455; Payload ID: 11941 relates to Category No.: 4828, 3127, 14455; Payload ID: 11942 relates to Category No.: 4828, 3127; Payload ID: 11943 relates to Category No.: 4828, 3127; Payload ID: 11944 relates to Category No.: 4828, 3127; Payload ID: 11945 relates to Category No.: 4828, 3127; Payload ID: 11946 relates to Category No.: 4828, 3127; Payload ID: 11947 relates to Category No.: 4828, 3127; Payload ID: 11948 relates to Category No.: 4828, 3127; Payload ID: 11949 relates to Category No.: 4828, 3127; Payload ID: 11950 relates to Category No.: 4828, 3127; Payload ID: 11951 relates to Category No.: 4828, 3127; Payload ID: 11952 relates to Category No.: 4828, 3127, 3124; Payload ID: 11953 relates to Category No.: 4828, 3127, 3124; Payload ID: 11954 relates to Category No.: 4828, 3127, 3124; Payload ID: 11955 relates to Category No.: 4828, 3127; Payload ID: 11956 relates to Category No.: 4828, 3127, 14455; Payload ID: 11957 relates to Category No.: 4828, 3127, 3124; Payload ID: 11958 relates to Category No.: 4828, 3127, 14455; Payload ID: 11959 relates to Category No.: 4828, 3127, 14455; Payload ID: 11960 relates to Category No.: 4828, 3127; Payload ID: 11961 relates to Category No.: 4828, 3127; Payload ID: 11962 relates to Category No.: 4828, 3127; Payload ID: 11963 relates to Category No.: 4828, 3127; Payload ID: 11964 relates to Category No.: 4828, 3127, 14455; Payload ID: 11965 relates to Category No.: 4828, 3127; Payload ID: 11966 relates to Category No.: 4828, 3127; Payload ID: 11967 relates to Category No.: 4828, 3127, 14455; Payload ID: 11968 relates to Category No.: 4828, 3127, 14838; Payload ID: 11969 relates to Category No.: 4828, 3127; Payload ID: 11970 relates to Category No.: 4828, 13589, 3398, 3127; Payload ID: 11971 relates to Category No.: 4828, 3127; Payload ID: 11972 relates to Category No.: 4828, 3127; Payload ID: 11973 relates to Category No.: 4828, 3127; Payload ID: 11974 relates to Category No.: 4828, 3127; Payload ID: 11975 relates to Category No.: 4828, 3127; Payload ID: 11976 relates to Category No.: 4828, 3127, 14455, 1026; Payload ID: 11977 relates to Category No.: 4828, 3127, 14455; Payload ID: 11978 relates to Category No.: 4828, 3127, 14455; Payload ID: 11979 relates to Category No.: 4828, 3127, 14455; Payload ID: 11980 relates to Category No.: 4828, 3127, 14455; Payload ID: 11981 relates to Category No.: 4828, 3127, 14455; Payload ID: 11982 relates to Category No.: 4828, 3127, 14455; Payload ID: 11983 relates to Category No.: 4828, 3127, 14455; Payload ID: 11984 relates to Category No.: 4828, 3127, 14455; Payload ID: 11985 relates to Category No.: 4828, 3127, 14455; Payload ID: 11986 relates to Category No.: 4828, 3127; Payload ID: 11987 relates to Category No.: 4828, 3127, 14455; Payload ID: 11988 relates to Category No.: 4828, 3127, 14455; Payload ID: 11989 relates to Category No.: 4828, 3127, 14455; Payload ID: 11990 relates to Category No.: 4828, 3127, 14455; Payload ID: 11991 relates to Category No.: 4828, 3127, 14455; Payload ID: 11993 relates to Category No.: 4828, 3127, 14455; Payload ID: 11994 relates to Category No.: 4828, 3127, 14455; Payload ID: 11995 relates to Category No.: 4828, 3127, 14455; Payload ID: 11996 relates to Category No.: 4828, 3127, 14455; Payload ID: 11997 relates to Category No.: 4828, 3127; Payload ID: 11998 relates to Category No.: 4828, 3127; Payload ID: 11999 relates to Category No.: 4828; Payload ID: 12000 relates to Category No.: 4828, 3127, 1795; Payload ID: 12001 relates to Category No.: 4828, 3127, 1795; Payload ID: 12002 relates to Category No.: 4828; Payload ID: 12003 relates to Category No.: 4828, 3127, 14455; Payload ID: 12004 relates to Category No.: 4828; Payload ID: 12005 relates to Category No.: 4828, 3127, 14455; Payload ID: 12006 relates to Category No.: 4828, 3127, 14455; Payload ID: 12007 relates to Category No.: 4828, 3127, 14455; Payload ID: 12008 relates to Category No.: 4828, 3127, 14455; Payload ID: 12009 relates to Category No.: 15490, 3398, 8739, 8375, 8930, 7369, 8862, 14886, 9350, 15325, 11138, 14888, 14889; Payload ID: 12010 relates to Category No.: 1703, 12526, 8988, 7640, 8941, 12723; Payload ID: 12011 relates to Category No.: 13589, 3398, 15490, 3398, 8930; Payload ID: 12012 relates to Category No.: 15490, 3398, 8739, 12891, 14885, 14886, 14887; Payload ID: 12014 relates to Category No.: 15257, 8692, 10522, 13568, 15262; Payload ID: 12015 relates to Category No.: 8862, 1026, 14661, 14565, 10702, 13485, 15045, 1740, 274, 13532, 4588, 12798, 15156, 8502; Payload ID: 12016 relates to Category No.: 12063; Payload ID: 12018 relates to Category No.: 10331, 11512, 14565, 795, 2467, 9891, 2410, 13888, 12068, 5185, 10690, 2110, 8547, 12923, 13966, 13392, 5189, 5190, 11300, 13003, 10745, 10742, 5160, 12910, 7728, 1984, 2041, 11285, 10648, 8447, 10378, 2009, 8535, 4527, 4251, 8446, 5772, 11942, 11936, 8543, 2130, 7770, 11275, 11306; Payload ID: 12019 relates to Category No.: 12194, 6219, 14015, 4538, 7016, 8309, 3727, 3243, 7077, 7122, 2768; Payload ID: 12022 relates to Category No.: 15988; Payload ID: 12023 relates to Category No.: 5367, 11512, 10372, 7306, 7743, 10359, 1780, 12936, 10955, 11174, 11178, 11582, 10203, 9373, 8089, 10241, 1119, 13867, 9738, 8269, 15838, 15839, 15837; Payload ID: 12024 relates to Category No.: 10372, 13818, 10203, 9373; Payload ID: 12025 relates to Category No.: 13589, 3398, 11512, 1730, 15517, 3632, 13594, 2459, 1060, 674, 1741, 3790, 3641, 14910, 10366, 6269, 4538, 9125, 9554, 8756, 12652; Payload ID: 12026 relates to Category No.: 11512, 1730, 15517, 9410, 2459, 674, 1741, 3790, 10366, 6269, 3632, 9554, 8756, 12652, 9742; Payload ID: 12027 relates to Category No.: 11512, 1730, 15517, 3632, 13594; Payload ID: 12028 relates to Category No.: 5406, 12091, 3604, 3923, 3566, 4167, 1889; Payload ID: 12030 relates to Category No.: 1737, 2167, 7154, 9274, 1714; Payload ID: 12031 relates to Category No.: 4828, 8962, 14454, 9386, 15149, 14449, 439, 10486, 13835, 13459, 11285, 7688, 11591, 7658, 3940, 3529, 8825, 10644, 12579, 11362, 13082; Payload ID: 12032 relates to Category No.: 1703, 14589, 13225, 8943; Payload ID: 12033 relates to Category No.: 9386, 12633; Payload ID: 12035 relates to Category No.: 4828, 5367, 8962, 9386, 15149, 13161, 4828, 2745, 9932, 10459, 11174, 8004, 11949, 15606, 2006, 2130, 8532, 483, 439, 13459, 1993, 12573, 3529; Payload ID: 12036 relates to Category No.: 4828, 5367, 8962, 14454, 9386, 15149, 6296, 3021, 14449, 439, 9932, 13452, 1111, 440, 2041, 13459, 13888, 13836, 13837, 13811, 13951, 13996, 3940, 8233, 3529, 1114, 14460, 13766, 10531, 6624, 11220, 10920, 11163, 12481, 2637, 12813; Payload ID: 12037 relates to Category No.: 4828, 8962, 14454, 9386, 15149, 2064, 1415, 14449, 7743, 7581, 4828, 2745, 2121, 9932, 10486, 1115, 7855, 10583, 10313, 11111, 11087, 7692, 8392, 13252, 8830, 6296, 439, 433, 13925, 16294, 13459, 13837, 13811, 7688, 13951, 13865, 13996, 3940, 13851, 3971, 3529, 380, 440, 10242; Payload ID: 12038 relates to Category No.: 4828, 14565, 16214, 10481, 12166, 14086, 10005, 16211, 10005; Payload ID: 12039 relates to Category No.: 4828, 16214, 10481, 12166, 14086, 10005, 16211, 10005; Payload ID: 12040 relates to Category No.: 4828, 16214, 10481, 12166, 14086, 10005, 16211, 10005; Payload ID: 12041 relates to Category No.: 4828, 16214, 10481, 12166, 14086, 10005, 16211; Payload ID: 12042 relates to Category No.: 4828, 14565, 16214, 10005, 12166, 14086, 10005, 16211; Payload ID: 12043 relates to Category No.: 4828, 10005, 12166, 12717, 3166, 3139; Payload ID: 12044 relates to Category No.: 4828, 16214, 10005, 12166, 12717, 14123, 14111; Payload ID: 12045 relates to Category No.: 4828, 16214, 12166, 10005; Payload ID: 12046 relates to Category No.: 6814, 795, 16214, 7045, 7043, 7122, 7046, 2158, 8567, 7915, 5464, 1034, 8887, 496, 10493, 11092, 11018; Payload ID: 12047 relates to Category No.: 16214, 14014, 13071, 4859, 8919, 7121; Payload ID: 12048 relates to Category No.: 7598; Payload ID: 12049 relates to Category No.: 14565, 1727, 12993, 7132, 12124, 4336, 4766, 6451, 4774, 3015, 16313, 4768, 8561, 1892, 8103; Payload ID: 12050 relates to Category No.: 4828; Payload ID: 12051 relates to Category No.: 4828; Payload ID: 12052 relates to Category No.: 4828; Payload ID: 12055 relates to Category No.: 4828; Payload ID: 12056 relates to Category No.: 1415, 403, 1238, 12573, 10301, 1409, 14997, 6563; Payload ID: 12057 relates to Category No.: 1415, 14997; Payload ID: 12058 relates to Category No.: 1415, 14997; Payload ID: 12059 relates to Category No.: 3354, 3309, 14164, 1204; Payload ID: 12060 relates to Category No.: 2460, 9420, 7132, 4336, 3809, 1047; Payload ID: 12061 relates to Category No.: 15626, 11294; Payload ID: 12062 relates to Category No.: 3356, 7132, 3360, 4332, 13612, 11391, 10636; Payload ID: 12063 relates to Category No.: 8739, 3356, 7132, 3360, 4332; Payload ID: 12064 relates to Category No.: 3356, 7132, 4332, 8885; Payload ID: 12065 relates to Category No.: 3356, 7132, 3360, 4332; Payload ID: 12066 relates to Category No.: 3356, 7132, 3360, 4332; Payload ID: 12067 relates to Category No.: 3356, 7132, 4332, 3386; Payload ID: 12068 relates to Category No.: 2211, 8649; Payload ID: 12069 relates to Category No.: 2211, 8649; Payload ID: 12070 relates to Category No.: 2211, 2160; Payload ID: 12071 relates to Category No.: 16214, 6349, 14663, 1878, 1828, 828, 826, 11937; Payload ID: 12072 relates to Category No.: 1830, 10129, 14663, 1878, 15993, 824, 9439, 2485, 641, 13967, 13888, 13827, 6269, 14054, 7002, 11942, 13791, 9443, 707; Payload ID: 12073 relates to Category No.: 14038, 13343, 10129, 14663, 12654, 1878, 12280, 5949, 10372, 12278; Payload ID: 12074 relates to Category No.: 10129, 7710, 15626, 14663, 12654, 1878, 11243, 10861, 10126, 8481; Payload ID: 12075 relates to Category No.: 10129, 7710, 14663, 12654, 1878, 11243, 10861, 10126, 8481; Payload ID: 12076 relates to Category No.: 7710, 10129, 14838, 14663, 12654, 1878, 11243, 10126, 12283, 8481; Payload ID: 12078 relates to Category No.: 15626, 5428, 381, 8782, 8159, 12995; Payload ID: 12079 relates to Category No.: 15626, 381, 12995; Payload ID: 12080 relates to Category No.: 13589, 3398, 11512, 15517, 7306, 13594, 724, 5459, 4251, 6882, 6995, 3242; Payload ID: 12081 relates to Category No.: 1026, 13589, 3398, 11512, 15517, 7306, 11506, 3398, 13492, 11884, 6995, 11740, 12877, 4251, 10539, 10647, 13594, 1730, 724, 3445, 14791, 8930, 9410, 5459, 1741, 672, 8929, 3641, 2169, 1744, 6882, 4061, 3242; Payload ID: 12082 relates to Category No.: 13589, 3398, 15490, 3398, 11085, 4257, 5332, 8908; Payload ID: 12083 relates to Category No.: 15715, 15712, 4439; Payload ID: 12084 relates to Category No.: 12194, 15721; Payload ID: 12085 relates to Category No.: 12994; Payload ID: 12086 relates to Category No.: 14565, 9451; Payload ID: 12087 relates to Category No.: 2136, 1965, 11150, 7320, 11151, 10948; Payload ID: 12088 relates to Category No.: 1730, 9451, 1795, 8023, 8421, 10406, 3629; Payload ID: 12089 relates to Category No.: 1512, 14663, 4723, 5930, 5932, 5931, 8636; Payload ID: 12090 relates to Category No.: 1512, 1703, 14663, 4723, 5930, 5932, 5931; Payload ID: 12091 relates to Category No.: 15618, 5846, 9459; Payload ID: 12092 relates to Category No.: 12154, 11926, 12153, 3837, 12063, 1893, 13831, 11660, 12103, 8583, 3829, 12122; Payload ID: 12093 relates to Category No.: 14456, 1820, 15622; Payload ID: 12094 relates to Category No.: 6212, 9945, 1204; Payload ID: 12095 relates to Category No.: 14456, 6733, 15157, 2547; Payload ID: 12096 relates to Category No.: 14456, 6039, 483; Payload ID: 12097 relates to Category No.: 14456, 6039; Payload ID: 12099 relates to Category No.: 1206; Payload ID: 12102 relates to Category No.: 14456, 1621; Payload ID: 12103 relates to Category No.: 14456; Payload ID: 12104 relates to Category No.: 11968; Payload ID: 12105 relates to Category No.: 11958, 11971; Payload ID: 12106 relates to Category No.: 11966; Payload ID: 12107 relates to Category No.: 11915, 5446, 13925, 8789, 11968, 11966; Payload ID: 12108 relates to Category No.: 11958, 11962, 11960, 11964; Payload ID: 12109 relates to Category No.: 12999, 11968, 8103, 13000, 11958, 11966, 11916; Payload ID: 12110 relates to Category No.: 8739, 12999, 11968, 7298, 8103, 8163, 13000, 11958, 11966, 11916, 8529, 11915; Payload ID: 12111 relates to Category No.: 5446, 1483, 1795, 14928, 15782, 8390, 8112, 13635, 9294, 11993; Payload ID: 12112 relates to Category No.: 11915, 403, 1955, 3354, 8075, 7897, 11966, 2014; Payload ID: 12113 relates to Category No.: 11915, 11968, 11958, 11966; Payload ID: 12114 relates to Category No.: 12194; Payload ID: 12116 relates to Category No.: 1730, 7306, 14838; Payload ID: 12117 relates to Category No.: 7306, 9420, 12714, 7132, 4336, 14834; Payload ID: 12119 relates to Category No.: 1730, 7306, 14838; Payload ID: 12123 relates to Category No.: 1730, 7306, 14838; Payload ID: 12124 relates to Category No.: 14000; Payload ID: 12125 relates to Category No.: 1512, 14586, 7304, 1202, 2317, 4145, 7654; Payload ID: 12126 relates to Category No.: 12194; Payload ID: 12127 relates to Category No.: 12194; Payload ID: 12128 relates to Category No.: 15517, 8739, 14643, 5949, 14838, 6795, 3781, 8655, 4463, 7175, 8268, 13594; Payload ID: 12129 relates to Category No.: 12619, 15517, 7942, 8732, 8402, 8195, 13053, 11512, 3445, 8731, 3398, 11506, 3398, 7743, 4952, 690, 4949, 3577, 3781, 8869, 3626, 3769, 10881, 8655, 5985, 4954, 8876; Payload ID: 12130 relates to Category No.: 13594, 15490, 3398; Payload ID: 12131 relates to Category No.: 7912; Payload ID: 12132 relates to Category No.: 11954, 9500, 12133, 11884, 486, 7088, 8434, 7631, 7080, 7089; Payload ID: 12133 relates to Category No.: 13975, 9500, 484, 8373, 2002; Payload ID: 12134 relates to Category No.: 1730, 10238, 7306, 7735; Payload ID: 12135 relates to Category No.: 6670; Payload ID: 12136 relates to Category No.: 12091, 13166, 14569, 15004, 12498, 360, 5785, 9716, 13975, 8487, 8488, 8599, 8598, 1859; Payload ID: 12137 relates to Category No.: 2001; Payload ID: 12138 relates to Category No.: 12194, 5428, 1703, 1238, 6145, 1237, 12427, 1727, 6253, 6137, 13877; Payload ID: 12139 relates to Category No.: 9500, 1204; Payload ID: 12141 relates to Category No.: 4828, 12579; Payload ID: 12142 relates to Category No.: 6814, 9500, 15642, 4706, 1874, 14663, 1878, 4448, 6424, 12285, 5073, 2214, 15325, 15217, 15016, 9336, 7505, 15065, 84; Payload ID: 12143 relates to Category No.: 4828; Payload ID: 12144 relates to Category No.: 6814, 9500, 15642, 4706; Payload ID: 12145 relates to Category No.: 14986, 10700; Payload ID: 12146 relates to Category No.: 6227, 14834; Payload ID: 12147 relates to Category No.: 6219, 6227; Payload ID: 12148 relates to Category No.: 6227, 4094, 11365; Payload ID: 12149 relates to Category No.: 6227, 16172, 2355, 743; Payload ID: 12150 relates to Category No.: 6227; Payload ID: 12151 relates to Category No.: 6227; Payload ID: 12152 relates to Category No.: 9950, 2359, 2355, 4775, 6227; Payload ID: 12153 relates to Category No.: 6227; Payload ID: 12154 relates to Category No.: 6227, 11236, 1933; Payload ID: 12155 relates to Category No.: 9950, 4094, 10667, 11266, 361, 8612, 7737, 12034, 10800, 6227; Payload ID: 12156 relates to Category No.: 6227; Payload ID: 12157 relates to Category No.: 4828, 2000, 1795, 13980, 11601, 7340, 13550, 14729, 6624, 5998, 10282, 13835, 13969, 13989, 13827, 13775, 13811, 10486, 4145, 6627, 8002, 13981, 13818, 14011, 6758, 4949, 3940, 11436, 4588, 3246, 3529, 11431, 11168, 15247, 3846, 11593, 14646, 11124, 14822, 12766, 11436, 4342, 15067, 13778; Payload ID: 12158 relates to Category No.: 14565, 13835, 13969, 13859, 13989, 13459, 3469, 13767, 13775, 13811, 10486, 4145, 8002, 11436, 13991, 11325, 11146, 13981, 14000, 14011, 13797, 7658, 6758, 13838, 13829, 4949, 11231, 10615, 6531, 5328, 14016, 12953, 10282, 3529, 11431, 14729, 11168, 10732, 11593, 14646, 6623, 4855, 11124, 8802, 6624, 14822, 12766; Payload ID: 12159 relates to Category No.: 1849; Payload ID: 12163 relates to Category No.: 1204; Payload ID: 12165 relates to Category No.: 12091, 1026, 14661, 15207, 795, 3766, 1752, 5446, 13166, 15004, 12498, 3986, 275, 14108, 10366, 4127, 360, 8940, 4130, 11285, 14992, 16085, 11858, 16294, 11174, 15192, 10879, 10860, 11418, 1320, 7744, 12891, 3056, 3038, 2079, 8918, 12405, 659, 4374, 8968, 4581, 8968, 9315, 13085, 13882, 13970, 2009, 12459; Payload ID: 12166 relates to Category No.: 12091, 1026, 14661, 15207, 9982, 14565, 795, 7613, 1752, 5446, 13166, 14569, 15004, 12498, 9713, 13105, 274, 14108, 11296, 4127, 360, 11765, 16197, 14992, 16085, 12936, 11858, 8522, 11178, 1844, 15192, 10600, 12750, 7842, 3056, 2079; Payload ID: 12167 relates to Category No.: 12091, 1026, 14661, 15207, 3766, 1752, 5446, 6606, 13166, 15004, 12498, 15143, 274, 345, 14108, 1048, 14992, 16085, 3038, 12465, 15192, 3060, 3056, 2079, 11089, 10514, 10503, 13232; Payload ID: 12168 relates to Category No.: 13166, 14569, 15004, 12498, 13105, 274, 14108, 360, 12091, 14565, 795, 1721, 1752, 2940, 1746, 1780, 7252; Payload ID: 12169 relates to Category No.: 1752, 13166, 14569, 15004, 12498, 13105, 274, 14108, 360, 12091, 13589, 3398, 795, 2940; Payload ID: 12170 relates to Category No.: 12091, 7163; Payload ID: 12171 relates to Category No.: 12091, 14565, 795, 1752, 2940, 13166, 14569, 15004, 12498, 1746, 13105, 274, 14108, 1780, 360, 6102, 7965, 6296, 6758; Payload ID: 12172 relates to Category No.: 1649, 13785; Payload ID: 12173 relates to Category No.: 9500, 11042, 1879, 7613, 13827, 13966, 1988, 11415, 7840, 2088, 5740, 10429, 11394, 4112, 1605, 10421, 12699, 1974, 4214, 8213, 3035, 12939, 9042, 9049; Payload ID: 12174 relates to Category No.: 11926; Payload ID: 12175 relates to Category No.: 14565, 795, 7613, 1955, 10238, 11109, 3313, 14567, 334, 10602, 10241, 10600; Payload ID: 12176 relates to Category No.: 15499, 11512, 8739, 16286, 7287, 2041, 5217, 11509, 8349, 12036, 9279, 5218, 5145, 10754, 11044, 3644, 14949; Payload ID: 12177 relates to Category No.: 13589, 3398, 15517, 14640, 11512, 9599, 14793, 15400, 1780, 1274, 1684, 575, 1687, 575, 9580, 14389, 15490, 3398, 7306; Payload ID: 12178 relates to Category No.: 13589, 3398, 15490, 3398, 11512, 9500, 7613, 8731, 3398, 15517, 11506, 3398, 16214, 1296, 1048, 7840, 8887, 14944, 6802, 1743, 4475, 2110, 11791, 6812, 10574, 12397, 5459, 2548, 1318, 6857, 8554, 6785, 1984, 8496, 10292, 11980, 7851, 16023, 2001, 10995, 1463, 6787, 6834, 10987, 13137, 9397, 6860, 6844, 8845, 6865, 2547, 9394, 14072, 9396, 9398, 16178, 13138, 16001, 11788, 9392, 15999, 6841, 8278, 8279, 7615, 7616, 10993, 11142, 13967, 10372, 496, 9406, 1960, 7306; Payload ID: 12179 relates to Category No.: 13589, 3398, 11512, 795, 14456, 15517, 11506, 3398, 2410, 9410, 8739, 8887, 1752, 8930, 10372, 4949, 1780, 7345, 8869, 14882, 8888, 13501, 14628, 6569, 3197; Payload ID: 12180 relates to Category No.: 13589, 3398, 15490, 3398, 1730, 3632, 9410, 8739, 12628, 10358, 8731, 3398, 7613, 14056, 13827, 13797, 2469, 7306; Payload ID: 12181 relates to Category No.: 13589, 3398, 7306, 5285, 14838, 9410, 8739, 15517, 2243, 11512, 14620, 8081, 480, 496, 6080, 3575, 15490, 3398; Payload ID: 12182 relates to Category No.: 13589, 3398, 11512, 12153, 15517, 11506, 3398, 16214, 2169, 10648, 4057, 8930, 14050, 8370, 9410, 5859, 2698, 4535, 1240, 9556, 15490, 3398, 7306, 8739, 13594, 1730, 4059, 12638, 724, 3445, 12891, 8934, 8535, 1026, 8375, 7743, 14056, 13225, 1463, 3889, 1741, 7939, 1048, 4251, 13582, 1295, 2251, 6111, 10034, 15248, 1743, 14699, 5939, 14577, 5988, 11085, 15806, 14360, 12507, 3442, 9542, 9348, 4248, 4252, 2602, 4262, 13607, 13608, 13605, 10572, 12037, 3573, 908, 8367; Payload ID: 12183 relates to Category No.: 13589, 3398, 15490, 3398, 7613, 674, 11512, 12891, 8930, 2411, 14636, 13342, 1622, 14638, 3444, 14882, 3612, 10754, 7352, 12631, 11064, 14630; Payload ID: 12184 relates to Category No.: 13589, 3398, 15490, 3398, 11512, 674, 12498, 11506, 3398, 2169, 15414, 1988, 5949, 15402, 11791, 6812, 5459, 1318, 10292, 16023, 11490, 6787, 10987, 13137, 6844, 6873, 6865, 11788, 6841, 8278, 8279, 7615, 7616, 10993, 9465, 6835, 13581, 1730, 6878, 6810, 14935, 5950, 15517, 15090; Payload ID: 12185 relates to Category No.: 13589, 3398, 8731, 3398, 15517, 11512, 9320, 3641, 1993, 13264, 4067; Payload ID: 12186 relates to Category No.: 14565, 15614, 16197; Payload ID: 12187 relates to Category No.: 15614, 364; Payload ID: 12188 relates to Category No.: 13589, 3398, 11512, 5459, 7001, 3613, 1622, 9540, 3575, 3595, 10983, 11394, 8954, 860, 8931, 13233, 8739; Payload ID: 12189 relates to Category No.: 13589, 3398, 5459, 7001, 3613, 1622, 3575, 3595, 10983, 11394, 860; Payload ID: 12190 relates to Category No.: 13589, 3398, 15490, 3398, 11512, 9107, 3437, 13416, 6995, 14777, 15135, 9579, 9318, 15735, 6298; Payload ID: 12191 relates to Category No.: 13589, 3398, 11512, 5458, 7725, 15517, 12891, 3737, 1918, 10638, 4475, 8934, 15134, 8870, 9107, 3437, 13757, 15135, 9106, 1731, 1302, 13417, 6665, 5068, 995, 9579, 3539, 14101, 8375, 7743, 11091, 14620, 8929, 1729; Payload ID: 12192 relates to Category No.: 13589, 3398, 674, 14640, 15517, 11512, 8731, 3398, 1622, 10034, 5071, 3594, 7383, 1321; Payload ID: 12193 relates to Category No.: 13594, 13589, 3398, 11512, 8739, 3176, 5859, 14910, 4933, 9320, 1463, 3033, 1575, 6107, 14789, 11769, 1788, 12646, 16096, 5406, 12638, 674, 8934, 11506, 3398, 9410, 16286, 4949, 14636, 6375, 3571, 10513, 966, 10034, 3577, 1567, 1557, 16137, 3594, 9600, 3245, 16130, 7385, 3647, 11064, 4037, 977, 12234, 15047, 5333, 16091, 6106, 12237, 15109, 6530, 1295, 13874, 14040, 15517, 9321, 8929, 4138; Payload ID: 12194 relates to Category No.: 13589, 3398, 11506, 3398, 6995, 9410, 3437, 6111, 6117, 15517, 11512, 12891, 8928, 6296, 6114; Payload ID: 12195 relates to Category No.: 8617, 1780, 9540; Payload ID: 12196 relates to Category No.: 2940, 5938, 274, 3799; Payload ID: 12197 relates to Category No.: 12648; Payload ID: 12198 relates to Category No.: 12648; Payload ID: 12199 relates to Category No.: 8862, 12137, 6212, 1295, 7613, 12427, 10028, 8928, 15660, 11878, 8373, 6310, 1867, 14663, 7735, 14014, 11909, 11316, 6746, 6438, 14863, 13527, 11206, 2561, 2560, 16214, 483, 8977, 1888, 901, 6445, 4855, 13306, 1871; Payload ID: 12200 relates to Category No.: 6456, 15660, 6310, 1867, 14663; Payload ID: 12201 relates to Category No.: 6814; Payload ID: 12202 relates to Category No.: 7288, 9224, 10483, 4439, 9223, 3001, 14216, 3994; Payload ID: 12203 relates to Category No.: 12091, 7288, 9224, 10483, 4439, 9223, 3001, 14216, 3994, 3000, 12122; Payload ID: 12204 relates to Category No.: 13589, 3398, 14058, 3632, 15424, 13223, 2235, 9554, 607, 3980, 15517, 1730, 11512, 14059, 11506, 3398, 8930, 1741, 14083, 5066, 4446, 3564; Payload ID: 12205 relates to Category No.: 13589, 3398, 11512, 9052, 5544, 3632, 4448, 9410, 3134, 15806, 8739, 13594, 1730, 12646, 11506, 3398, 7743, 10372, 3246, 6269, 4535, 4538, 7915, 10802, 9554, 7243, 8787, 3980, 15490, 3398, 13967, 15536, 13969, 8731, 3398, 12891, 14050, 13859, 14699, 13827, 13860, 15517, 13818, 9411, 13961, 2169, 13907, 13918, 10513, 14039, 13923, 13843, 10356, 14944, 10801, 13770, 13804, 9412; Payload ID: 12206 relates to Category No.: 6219, 6212, 14663, 14086, 10005, 16211, 6213, 11560, 5752; Payload ID: 12207 relates to Category No.: 6219, 6212; Payload ID: 12208 relates to Category No.: 6219, 6212, 3244, 1849; Payload ID: 12209 relates to Category No.: 6219, 6212; Payload ID: 12210 relates to Category No.: 8962, 1816, 4132, 12500, 3244, 12105, 7131, 10491; Payload ID: 12211 relates to Category No.: 1730, 7306, 1744, 3980; Payload ID: 12212 relates to Category No.: 15149, 1415, 5446, 1816, 1417, 1651, 10822, 9292, 6125, 11937, 15618, 10478, 13785, 13909, 10819; Payload ID: 12213 relates to Category No.: 15149, 1816, 1651, 11937, 15618, 13909; Payload ID: 12214 relates to Category No.: 15618, 1816, 1651, 11937; Payload ID: 12215 relates to Category No.: 9982, 14663, 2552, 16234, 16275, 9567, 2558; Payload ID: 12216 relates to Category No.: 9982, 14663, 2552, 16234, 16275, 9567, 2558, 12864, 13630, 12540, 13161, 14834, 486, 7121; Payload ID: 12217 relates to Category No.: 9982, 2552; Payload ID: 12218 relates to Category No.: 9982, 2552; Payload ID: 12219 relates to Category No.: 7288, 5219, 14217, 4969; Payload ID: 12220 relates to Category No.: 1737, 7288, 14318, 3304, 7154, 5219, 6814; Payload ID: 12221 relates to Category No.: 1737, 3304, 3448, 7138, 14612, 13827; Payload ID: 12222 relates to Category No.: 12194, 7912; Payload ID: 12223 relates to Category No.: 7134; Payload ID: 12224 relates to Category No.: 12194, 12633, 1893, 1274; Payload ID: 12225 relates to Category No.: 1721, 11987, 12126, 1048, 11884, 1183, 1814, 15570, 7370, 8447, 1749, 3924, 912, 11055, 3879, 6969, 773, 2197, 12466, 16294, 14926, 12662; Payload ID: 12226 relates to Category No.: 1737, 1721; Payload ID: 12227 relates to Category No.: 1737, 1721, 1183, 1814, 16197, 15570, 1749, 1813, 8535, 12662; Payload ID: 12228 relates to Category No.: 1737, 1721, 12638, 1048, 11884, 1183, 1814, 1812, 1749, 3924; Payload ID: 12229 relates to Category No.: 1737, 1721, 1183, 1814, 1749; Payload ID: 12230 relates to Category No.: 12648, 7581, 10628, 7252, 7893, 12129, 2940, 11997, 1959, 15142, 7688, 10501; Payload ID: 12231 relates to Category No.: 12648; Payload ID: 12232 relates to Category No.: 7849, 15441, 13925; Payload ID: 12233 relates to Category No.: 10238, 5429; Payload ID: 12234 relates to Category No.: 10238; Payload ID: 12235 relates to Category No.: 10238; Payload ID: 12236 relates to Category No.: 10238; Payload ID: 12240 relates to Category No.: 3100, 9827, 14025, 11557, 10275, 10422, 13841, 846, 1532, 9433, 13967, 6219, 13843, 13847; Payload ID: 12241 relates to Category No.: 6814, 14025, 846, 13975; Payload ID: 12242 relates to Category No.: 3100, 14025, 13841, 846, 1532, 8668, 2742, 9792, 6814; Payload ID: 12243 relates to Category No.: 13589, 3398, 15490, 3398, 8731, 3398, 7291, 16182, 12717, 14123; Payload ID: 12244 relates to Category No.: 3356, 5376; Payload ID: 12245 relates to Category No.: 4828, 11512, 8739, 1836, 12891, 14640, 1277, 10287, 10666, 10309, 5267, 1870, 10680, 1470, 11371, 13967, 13827, 13837, 13794, 11146, 434, 14108, 13916, 1816, 13845, 13979, 14045; Payload ID: 12246 relates to Category No.: 4828, 442, 1795, 14640, 434, 4828, 2745, 9932, 10797, 7743, 10372, 1836, 1272, 1751, 9454, 9451, 2376, 1277, 496, 10486; Payload ID: 12247 relates to Category No.: 8962; Payload ID: 12248 relates to Category No.: 4828, 1795; Payload ID: 12249 relates to Category No.: 1816, 3781, 7743, 12891, 14640, 434, 9454, 4145, 7799, 10309, 1470, 12099, 8611, 10372, 3641, 3631, 15121, 3791, 6371, 6556, 9040, 12703; Payload ID: 12250 relates to Category No.: 7728, 2138, 14834; Payload ID: 12252 relates to Category No.: 12154, 15490, 3398, 11843, 11512, 13975, 12153, 11237, 7728, 2169, 11236, 12096, 10775, 7129, 8373, 10648, 1888, 12519, 12117, 11860, 7043, 13831, 7122, 483, 12058, 6451, 11969, 12781, 13383, 13165, 13379, 8004, 8118, 8535, 8192, 13164, 11017, 7131, 4290, 11967, 11959, 11830, 494, 8374, 8567, 7915, 6453, 11018, 8309, 12913, 7565, 13073, 8020, 2138, 11963, 3835, 12779, 3428, 10513, 11961, 7556, 11098, 16332, 8925, 2050, 11972, 2130, 12674, 8492, 11270, 13540, 8430, 11568, 1956, 8433, 8650, 13397, 8554, 6102, 9111, 12052, 13161, 15149, 3436, 14940, 6296, 15149, 4588, 13238, 7191, 3434, 10494, 12029, 11160, 7916; Payload ID: 12253 relates to Category No.: 1204, 6915, 5990; Payload ID: 12254 relates to Category No.: 12194, 1002, 11512, 5428, 7613, 7728, 12999, 7965, 12391, 8373, 10648, 8542, 14586, 2083, 12117, 6915, 7122, 13161, 13227, 11363, 8522, 8503, 11903, 11174, 11266, 8004, 10855, 8535, 8507, 361, 5990, 8547, 8798, 8095, 8374, 7915, 8430, 8433, 11275, 11536, 2001, 7841, 12487, 11026, 8513, 10224, 8504, 11255, 8096, 8520, 8799, 3181, 1986, 5301, 4694, 3182, 11430, 12874, 11016, 7508, 7857, 8730, 11303, 11579, 10528, 4738, 10895, 10896, 8097, 483, 8508, 15149, 3436, 3434, 13877, 2107, 6723, 6734, 11158, 11306, 8432, 3751, 11156, 13827, 13975; Payload ID: 12255 relates to Category No.: 6915, 12779, 8921, 13532, 3436, 8379; Payload ID: 12256 relates to Category No.: 3354, 7898; Payload ID: 12257 relates to Category No.: 3452, 3354, 3448, 3455, 5406, 7303, 7613, 9410, 2421, 14793, 6795, 11628, 3602, 5453; Payload ID: 12259 relates to Category No.: 2945; Payload ID: 12260 relates to Category No.: 275, 5041, 1703, 3924, 14928, 9481, 323, 14687; Payload ID: 12261 relates to Category No.: 1703, 275, 6018, 1749, 1775, 3925; Payload ID: 12262 relates to Category No.: 1820, 275; Payload ID: 12263 relates to Category No.: 8731, 3398, 7810, 14123; Payload ID: 12264 relates to Category No.: 12091, 11858, 12813, 11546, 8032, 13416, 12904; Payload ID: 12265 relates to Category No.: 6814, 6212, 6219; Payload ID: 12266 relates to Category No.: 6219, 6814, 9945, 14663, 15661, 11559, 4653, 392, 8612, 6223, 6226; Payload ID: 12267 relates to Category No.: 6219, 6814, 15660, 9945, 14663, 15661, 4653, 392, 15658; Payload ID: 12268 relates to Category No.: 6219, 6814, 6212, 1204; Payload ID: 12269 relates to Category No.: 6219, 6814, 6212; Payload ID: 12270 relates to Category No.: 6219, 6814, 6212, 9827, 3198, 9410, 690; Payload ID: 12271 relates to Category No.: 6219, 6814, 3198; Payload ID: 12272 relates to Category No.: 6219, 6814, 4110, 1727, 9945, 14663, 815, 11802, 4653, 9823, 9833, 6203, 817, 9826, 9836; Payload ID: 12273 relates to Category No.: 1295, 8739, 12099, 8421, 14699, 13492, 9786, 3595, 3445, 6194, 8611, 9410, 8639, 1933, 8337, 10422, 14790, 13713, 12129, 8890, 8879, 12646, 5406, 9599, 8731, 3398, 14565, 11506, 3398, 8887, 7743, 1318, 12936, 4535, 7939, 8889, 13166, 6559, 4953, 7732, 13363, 3781, 1743, 3771, 13804, 14886, 3444, 5071, 5941, 10566, 3602, 6560, 6561, 14700, 1734, 1787, 13835, 13969, 13936, 13827, 14000; Payload ID: 12274 relates to Category No.: 14565, 8639, 14643, 4934, 3781, 1743, 3771, 10566; Payload ID: 12275 relates to Category No.: 14699, 2562; Payload ID: 12276 relates to Category No.: 14699, 2353, 13073; Payload ID: 12277 relates to Category No.: 14565, 14834; Payload ID: 12278 relates to Category No.: 14565, 1204; Payload ID: 12279 relates to Category No.: 795, 1730, 8756, 10036; Payload ID: 12280 relates to Category No.: 13589, 3398, 15490, 3398, 795, 8739, 12891, 13594; Payload ID: 12281 relates to Category No.: 15490, 3398, 3354, 3353, 3448, 5159, 11298, 3453, 13904, 3313, 14566, 10745, 10735, 11531, 10744, 10873, 16096, 1955, 3713, 455, 2396; Payload ID: 12282 relates to Category No.: 13589, 3398, 15490, 3398, 11512, 7345, 10754, 11064, 13455; Payload ID: 12283 relates to Category No.: 14565, 1703, 3775, 16085, 14556, 15570, 7340, 4871, 1749, 2107, 1820, 345, 15043, 9720, 2940, 12648, 6018, 11265, 1320, 4229; Payload ID: 12285 relates to Category No.: 13589, 3398, 15517, 11512, 1463, 690, 4998, 3854, 15194; Payload ID: 12286 relates to Category No.: 13589, 3398, 13594; Payload ID: 12287 relates to Category No.: 13589, 3398, 15490, 3398, 11512, 13975, 7266, 16197, 13867, 3882; Payload ID: 12290 relates to Category No.: 15517, 7291, 16182, 14271, 7273, 7287, 15291, 4439, 7261; Payload ID: 12291 relates to Category No.: 13186, 7613, 11506, 3398, 11029, 14910, 7839, 10265; Payload ID: 12292 relates to Category No.: 14565, 1780; Payload ID: 12293 relates to Category No.: 12091; Payload ID: 12294 relates to Category No.: 1737, 7132, 7890, 7158; Payload ID: 12295 relates to Category No.: 1737, 7743, 12646, 1780, 7132, 7158; Payload ID: 12296 relates to Category No.: 8454; Payload ID: 12297 relates to Category No.: 13975, 13589, 3398, 13882; Payload ID: 12299 relates to Category No.: 4949, 286; Payload ID: 12301 relates to Category No.: 12760, 1747, 13523; Payload ID: 12302 relates to Category No.: 1730, 12427, 7306, 9451, 274, 11147; Payload ID: 12303 relates to Category No.: 12091, 7154, 8535, 2139, 8112, 8503, 8662; Payload ID: 12304 relates to Category No.: 15626, 1780, 11293, 3477, 1612, 12492, 10868; Payload ID: 12305 relates to Category No.: 15618, 8977, 5846, 3986, 14663, 914, 6492, 12001, 16234, 16275, 1210, 9567; Payload ID: 12306 relates to Category No.: 1703; Payload ID: 12307 relates to Category No.: 5848, 12407, 8050, 14025, 16274, 2264, 7779; Payload ID: 12308 relates to Category No.: 12153; Payload ID: 12309 relates to Category No.: 3900, 3147, 991, 985; Payload ID: 12310 relates to Category No.: 5785, 2940, 16197, 12640; Payload ID: 12312 relates to Category No.: 12153, 8918; Payload ID: 12313 relates to Category No.: 12153; Payload ID: 12319 relates to Category No.: 5446, 7362, 10775, 15441, 15456, 15450, 15443, 15454, 15446, 15457, 15458, 15451, 10262, 10266, 10475, 13925, 12096, 11298, 11967, 11495, 11496, 8677, 8390, 8688, 13828; Payload ID: 12320 relates to Category No.: 15441, 12153, 5446, 7362, 10775, 11285, 15456, 15450, 15443, 10955, 15454, 15446, 15457, 15458, 15451; Payload ID: 12321 relates to Category No.: 12153, 7965, 15441, 8785; Payload ID: 12322 relates to Category No.: 1737, 1721, 9228, 9223, 9088, 9223, 9105, 14273, 1780, 2424; Payload ID: 12323 relates to Category No.: 12194, 13796; Payload ID: 12324 relates to Category No.: 15691; Payload ID: 12325 relates to Category No.: 7288, 13184, 5949, 12891, 16133, 4949, 6269, 7341, 7122; Payload ID: 12326 relates to Category No.: 9420, 13618, 7108, 7109, 7110, 7111; Payload ID: 12327 relates to Category No.: 5428, 5446, 8817, 7555, 7557, 7960, 8036, 11182, 14053, 11111, 9391; Payload ID: 12329 relates to Category No.: 12194, 3244, 11878, 1893; Payload ID: 12330 relates to Category No.: 12194, 3244, 11878, 1893; Payload ID: 12331 relates to Category No.: 12194, 3244, 11878, 1893; Payload ID: 12332 relates to Category No.: 12194, 12127, 1893, 12100, 6814; Payload ID: 12333 relates to Category No.: 12194, 12099, 7039, 15880, 12127, 1893, 486, 6814; Payload ID: 12334 relates to Category No.: 12194, 1830, 2569, 6814; Payload ID: 12335 relates to Category No.: 12194; Payload ID: 12336 relates to Category No.: 8441, 1204; Payload ID: 12337 relates to Category No.: 8441, 7736; Payload ID: 12338 relates to Category No.: 7912, 2685; Payload ID: 12339 relates to Category No.: 12194, 6814, 8374, 13672, 12749; Payload ID: 12340 relates to Category No.: 6814; Payload ID: 12341 relates to Category No.: 15588, 10372, 9698, 2739, 9150; Payload ID: 12342 relates to Category No.: 4828, 8962, 2940, 1816, 3244, 1780, 4132, 12500, 7252, 3529; Payload ID: 12343 relates to Category No.: 5367, 5446, 3016, 9655, 9597, 3119, 8112, 8129, 8360, 4878; Payload ID: 12344 relates to Category No.: 5446, 3016, 9655, 9597, 3119, 9622, 12999, 8129, 8360, 4878; Payload ID: 12345 relates to Category No.: 5446, 3016, 9655, 9597, 3119, 8129, 8360, 4878; Payload ID: 12346 relates to Category No.: 5446, 3016, 9655, 9597, 3119, 8129, 8360, 4878; Payload ID: 12347 relates to Category No.: 11881; Payload ID: 12348 relates to Category No.: 11881, 15042, 5773, 2416, 7789, 12707, 5172, 8237; Payload ID: 12349 relates to Category No.: 11881; Payload ID: 12350 relates to Category No.: 11881, 13589, 3398, 15490, 3398, 1894, 5446, 2411, 2409, 9274, 2410, 14949, 5172, 5107; Payload ID: 12351 relates to Category No.: 11881, 1892, 2940, 2891, 13619; Payload ID: 12352 relates to Category No.: 9500, 9622, 13835, 13594, 11940, 13859, 13882, 13827, 9491, 6626, 13373, 5998, 13813, 4949, 2169, 13983, 12459, 9320, 6305, 12052, 6192, 9640, 15470, 11853; Payload ID: 12353 relates to Category No.: 12075, 10702, 1721, 2885, 5446, 8756, 7946, 11588, 13171, 11285, 12743, 8789, 7740, 13287, 11089, 8373, 11248, 10363; Payload ID: 12354 relates to Category No.: 14318, 12075; Payload ID: 12355 relates to Category No.: 12075, 11926, 7291, 16182; Payload ID: 12356 relates to Category No.: 12075, 11926, 12153, 12096, 12041, 1238, 6145; Payload ID: 12357 relates to Category No.: 12075, 11926, 7291, 16182; Payload ID: 12358 relates to Category No.: 12075, 11926, 13314; Payload ID: 12359 relates to Category No.: 12075, 11926; Payload ID: 12360 relates to Category No.: 12075, 11926, 10074, 6223, 16197, 16193, 16202, 1238, 10080, 6145, 11290, 11607, 14280, 16199, 3882, 3744, 15970, 13671; Payload ID: 12361 relates to Category No.: 12075, 11926; Payload ID: 12362 relates to Category No.: 12075, 11926; Payload ID: 12363 relates to Category No.: 12075, 11926; Payload ID: 12364 relates to Category No.: 12075, 11926; Payload ID: 12365 relates to Category No.: 12075, 11926; Payload ID: 12366 relates to Category No.: 12075, 11926; Payload ID: 12367 relates to Category No.: 12075, 11926, 2276, 1269, 4021, 12117, 10177, 11051, 10178; Payload ID: 12368 relates to Category No.: 12075, 11926;

Payload ID: 12369 relates to Category No.: 12137, 12075, 11926, 795, 2276, 8739, 10238, 11884, 6223, 11290, 11607, 16199, 2140; Payload ID: 12370 relates to Category No.: 12075, 11926, 7291, 16182; Payload ID: 12371 relates to Category No.: 12075, 11926, 13589, 3398, 9296, 3354, 7291, 16182, 15533, 11607; Payload ID: 12372 relates to Category No.: 12075, 11926, 793, 8175, 7613, 11322, 1911, 13909, 1922, 8567, 7631, 13158, 2001, 13388, 14292, 8428, 13160, 8429, 13975, 7548, 13217, 12498; Payload ID: 12373 relates to Category No.: 12075, 11926, 14271; Payload ID: 12374 relates to Category No.: 12075, 11926, 7291, 16182, 11884, 11607; Payload ID: 12375 relates to Category No.: 6814; Payload ID: 12376 relates to Category No.: 6814, 795, 8004, 7600, 10228; Payload ID: 12377 relates to Category No.: 6814; Payload ID: 12378 relates to Category No.: 15618, 11940, 3021, 2888, 5393, 1849, 3020, 5368; Payload ID: 12379 relates to Category No.: 1022, 8854; Payload ID: 12380 relates to Category No.: 6969, 2459, 9420, 7132, 4336, 10861, 5406, 7303, 8934, 7613, 9333, 14905, 6194, 1296, 8885, 2216; Payload ID: 12381 relates to Category No.: 6961, 2459, 9099, 9420, 2902, 7132, 4336, 2198, 5794, 8370, 10861, 12008, 5612, 8934, 8954, 6962; Payload ID: 12382 relates to Category No.: 6219, 14663, 15661; Payload ID: 12383 relates to Category No.: 1867, 14663, 6226, 6306, 13969, 13827; Payload ID: 12384 relates to Category No.: 16172; Payload ID: 12386 relates to Category No.: 11365, 6223, 10913, 8554, 11558, 8213, 8776, 10909, 7973, 10608, 8452, 6226, 7120, 8216; Payload ID: 12387 relates to Category No.: 15490, 3398, 11512, 8739, 8731, 3398, 2467, 5146, 2469, 5147, 5182, 8192, 12944, 8018, 3743, 12717, 2468, 13497, 3742, 11658, 8103, 12739, 13286, 13921, 13797; Payload ID: 12388 relates to Category No.: 15490, 3398, 12619, 8739, 8731, 3398, 2467, 4110, 4521, 13659, 13225, 13004, 4685, 8753, 2469, 5147, 7972, 13909, 5990, 8547, 12717, 7810, 16279, 12917, 2468; Payload ID: 12389 relates to Category No.: 2467, 15490, 3398, 12718, 14646, 8739, 2469; Payload ID: 12390 relates to Category No.: 4021, 1703, 14640, 15424, 13257, 13835, 2131, 13882, 7754, 13541, 13936, 13953, 11390, 16294, 1970, 2136, 8667, 10409, 8937, 1275; Payload ID: 12391 relates to Category No.: 15626, 6738; Payload ID: 12392 relates to Category No.: 15149, 1727, 9738, 1232, 7364, 7743, 1730, 7369, 8378; Payload ID: 12393 relates to Category No.: 5731; Payload ID: 12394 relates to Category No.: 1703, 16214, 1795, 14056; Payload ID: 12395 relates to Category No.: 13589, 3398, 15490, 3398, 5936; Payload ID: 12396 relates to Category No.: 5936; Payload ID: 12397 relates to Category No.: 5367, 9500, 13975, 5300, 7849, 4021; Payload ID: 12398 relates to Category No.: 9500, 13975, 9228, 5300; Payload ID: 12399 relates to Category No.: 9500, 14640, 15521, 5300, 4439, 14057, 13998, 13975, 1780, 13700, 7540, 13244, 13516, 3855; Payload ID: 12400 relates to Category No.: 9500, 13975, 7613, 12498, 15521, 13700, 5300, 4439, 2083, 13998, 8373; Payload ID: 12401 relates to Category No.: 9500, 13975, 795, 7613, 10372, 11109, 7840, 5300, 13925, 2083, 7122, 13161, 13998, 13877, 2107, 9667, 7372, 8198, 6625; Payload ID: 12402 relates to Category No.: 9500, 5361, 4021, 6530, 14838, 12397, 1790, 148, 12051, 8252; Payload ID: 12403 relates to Category No.: 9500, 5428, 13975, 795, 7613, 15521, 7840, 5300, 4439, 8749, 13998, 10446, 8434, 2107, 12495, 7518, 12395; Payload ID: 12404 relates to Category No.: 9500, 13975, 9941, 13998, 5300; Payload ID: 12405 relates to Category No.: 6814, 12128, 11950, 9762, 6985; Payload ID: 12406 relates to Category No.: 11950, 9762; Payload ID: 12407 relates to Category No.: 9757, 14565, 1867, 14663, 9762, 13297, 1334, 9760; Payload ID: 12408 relates to Category No.: 9757, 11940, 14565, 9762, 13297; Payload ID: 12409 relates to Category No.: 9757, 13297; Payload ID: 12410 relates to Category No.: 12128, 12058, 11950, 9762; Payload ID: 12411 relates to Category No.: 6296, 11950, 3400, 7131, 8934, 10491, 4098, 6985, 2242, 15067; Payload ID: 12412 relates to Category No.: 11940, 6961, 8731, 3398, 11884, 11950, 8611, 9762, 8507, 11950, 15606, 9766, 11950, 15044, 8518, 11950, 3400; Payload ID: 12413 relates to Category No.: 12128, 11950, 11951, 9762, 12134, 12017, 9760, 3845; Payload ID: 12414 relates to Category No.: 15618, 12128, 2276, 12117, 9757, 11951, 9762, 2277, 9760, 3909, 8214; Payload ID: 12415 relates to Category No.: 8739, 12096, 4100, 11950, 9762, 7939, 7990, 11912, 16144, 8934, 8862, 2353, 12694, 1186; Payload ID: 12416 relates to Category No.: 11950, 11951; Payload ID: 12417 relates to Category No.: 622, 9762, 15618, 11951, 7131, 10491, 9760; Payload ID: 12418 relates to Category No.: 12128, 12133, 11950, 3400, 11950, 11951, 11950, 15606, 8518, 8934, 11051, 1867, 1729, 2242, 7122, 4100, 9762, 3676, 8919, 2248, 7063, 16144; Payload ID: 12419 relates to Category No.: 11950, 3400, 12582, 13126, 6505; Payload ID: 12420 relates to Category No.: 12128, 12117, 9762, 11950, 15606; Payload ID: 12421 relates to Category No.: 11950, 3950, 9762, 8934, 3631, 4100, 12128; Payload ID: 12422 relates to Category No.: 1204; Payload ID: 12423 relates to Category No.: 1204; Payload ID: 12424 relates to Category No.: 6814, 9500, 4104, 10012; Payload ID: 12425 relates to Category No.: 1204, 10238, 14838; Payload ID: 12426 relates to Category No.: 13589, 3398, 5783, 6219, 11512, 8739, 14967, 2467, 11506, 3398, 15521, 1867, 14663, 4439, 4115, 2469, 12717, 8035, 8248, 7795, 10611, 8557, 10608, 8612, 7619, 13075, 12925, 12661, 12891, 16294, 12864, 3781, 3615, 10663, 13882, 13888, 7658, 6253, 4949, 8374, 4110, 8507, 1117, 8753; Payload ID: 12427 relates to Category No.: 6219, 13594, 13589, 3398, 795, 8739, 14967, 8731, 3398, 803, 11506, 3398, 5783, 4105, 15521, 4100, 1780, 2355, 4439, 3566, 4538, 4115, 10606, 4448, 4541, 3010, 1022, 1730, 12646, 10648, 16294, 10372, 7939, 8352, 1823, 5941, 455, 10036, 11187, 2006, 12861, 11064, 5940, 13455, 11384, 7613, 2041, 7735, 14040, 13767, 13970, 13860, 9940, 4949, 7816, 11602, 10801, 8636, 4112, 8112, 8635, 16216, 10569, 12192, 7293; Payload ID: 12428 relates to Category No.: 6219, 4828, 13589, 3398, 334, 11512, 14565, 8739, 14967, 1741, 5446, 8731, 3398, 11506, 3398, 12544, 15521, 10036, 4439, 6256, 2009, 11363, 10606, 3791, 7217, 1751, 14000, 12717, 16279, 6215, 13966, 4535, 14123, 9764, 13923, 8636, 8248, 7795, 13929, 6306, 13611, 8131, 8557, 8612, 6338, 12701, 5783, 15490, 3398, 15517, 12891, 7743, 1334, 13824, 2079, 4094, 3243, 12861, 2044, 2110, 13594, 13969, 2100, 13936, 7735, 13812, 11182, 3729, 13827, 14040, 13836, 14009, 10238, 13970, 13883, 9411, 4949, 7816, 13795, 13071, 4112, 11138, 13825, 2101, 2150, 2005, 10611, 7576, 8692, 13940, 8438; Payload ID: 12429 relates to Category No.: 7288, 13589, 3398, 11512, 11025, 687, 2467, 3244, 11506, 3398, 13755, 14009, 14271, 4521, 15521, 8373, 11884, 9420, 2083, 12117, 1853, 7122, 11363, 2469, 12717, 1895, 8374, 15273, 10735, 10611, 10663, 4112, 13953, 1334, 10249, 10559, 13824, 455, 10395, 11014, 11054, 13967, 1984, 13969, 13909, 2041, 2131, 13882, 2136, 13812, 13834, 496, 13827, 2006, 14023, 13767, 11391, 4353, 1964, 13829, 13998, 2235, 8535, 13852, 1969, 13918, 4251, 2021, 10390, 7129, 1921, 8636, 2128, 2095, 2071, 684, 1974, 8635, 14619, 13830, 8035, 13940, 13252, 13965, 1977, 8555, 14010, 11515, 4210, 8308, 10658, 2023, 2109, 13941, 405, 11225; Payload ID: 12430 relates to Category No.: 13589, 3398, 11512, 9420, 7122, 11363, 5773, 11308, 8731, 3398, 11506, 3398, 286, 11150, 9451, 10289, 11201, 2107, 15515, 1278, 10216, 13859, 13797; Payload ID: 12431 relates to Category No.: 15490, 3398, 11512, 9420, 7122, 11363; Payload ID: 12432 relates to Category No.: 1804, 11300, 3116, 333, 5041, 5807, 9125, 609; Payload ID: 12433 relates to Category No.: 8862, 1026, 2169, 1318; Payload ID: 12434 relates to Category No.: 14318, 12619, 14164, 14177, 1780, 6635, 151, 6360, 6632, 151, 6360, 12037, 9243; Payload ID: 12435 relates to Category No.: 11843, 1721, 12153; Payload ID: 12436 relates to Category No.: 7096; Payload ID: 12438 relates to Category No.: 14162; Payload ID: 12439 relates to Category No.: 5785, 10702, 3100, 11910, 7548; Payload ID: 12440 relates to Category No.: 795, 5446, 12498, 13105, 11910, 4186, 9891, 4127, 3775, 8988, 13049, 8524, 13286, 3742, 13552; Payload ID: 12441 relates to Category No.: 6814, 5446, 4186, 9891, 4127, 3775, 8988, 11910, 5073; Payload ID: 12443 relates to Category No.: 7288, 15517; Payload ID: 12444 relates to Category No.: 1955, 12980, 13589, 3398, 15490, 3398, 2409, 4439, 12891, 3783, 8004, 3783, 10742, 8078; Payload ID: 12445 relates to Category No.: 8862, 13589, 3398, 15490, 3398; Payload ID: 12446 relates to Category No.: 13589, 3398, 15490, 3398; Payload ID: 12447 relates to Category No.: 15490, 3398, 8739, 8731, 3398; Payload ID: 12448 relates to Category No.: 1737, 2409, 7138, 7132, 2429; Payload ID: 12449 relates to Category No.: 8739, 7743, 6371, 8281, 8479, 8282; Payload ID: 12450 relates to Category No.: 13589, 3398, 15490, 3398, 2409, 4439, 12891, 3783, 8004, 3783, 10742, 8739, 14949, 14944; Payload ID: 12451 relates to Category No.: 15490, 3398, 9500, 2410, 6269, 11906, 7804, 5164; Payload ID: 12452 relates to Category No.: 13589, 3398, 15490, 3398, 2410, 5185, 5189, 5190; Payload ID: 12454 relates to Category No.: 13589, 3398, 15490, 3398, 8739, 2409, 2410, 1238, 15067; Payload ID: 12455 relates to Category No.: 13589, 3398; Payload ID: 12456 relates to Category No.: 1002, 11298, 7633, 7634; Payload ID: 12458 relates to Category No.: 15490, 3398, 7306; Payload ID: 12459 relates to Category No.: 15490, 3398, 11506, 3398, 7291, 16182, 14271, 4439; Payload ID: 12460 relates to Category No.: 13589, 3398, 15490, 3398; Payload ID: 12462 relates to Category No.: 15490, 3398, 9500, 1295, 5149, 11506, 3398, 2410, 7132, 4332, 11511, 5164, 7804, 5152, 5186; Payload ID: 12463 relates to Category No.: 1207, 8756, 6494, 7939, 7942, 8439, 7938, 8629; Payload ID: 12464 relates to Category No.: 6814, 9500, 843, 14663, 1878, 6343, 8970, 1828, 1638, 12230, 6344, 15833, 11943, 15308; Payload ID: 12465 relates to Category No.: 15715, 4439, 15698, 15696, 9797; Payload ID: 12466 relates to Category No.: 15698, 15696, 9797, 4439; Payload ID: 12467 relates to Category No.: 15588, 4439, 15698, 9797; Payload ID: 12468 relates to Category No.: 6902, 14663, 1878, 1638, 3785; Payload ID: 12469 relates to Category No.: 334, 795, 1955, 10238, 3021, 1983, 15197, 11765, 11322, 13692, 10864, 10470, 5806, 11830, 2006, 11282, 5807, 12397, 10516, 14566, 11260, 10548, 8312, 13158, 10602, 10668, 13828, 5809, 7990, 5808, 14034, 11089, 14052, 5810; Payload ID: 12470 relates to Category No.: 4828, 16214, 7710, 10005; Payload ID: 12471 relates to Category No.: 5785, 14565, 12931, 16214, 5040, 11926, 8539; Payload ID: 12473 relates to Category No.: 690, 11926, 795, 16197, 10558, 10226, 13293, 8548; Payload ID: 12474 relates to Category No.: 7710, 275, 1767, 378, 15000; Payload ID: 12475 relates to Category No.: 7710; Payload ID: 12476 relates to Category No.: 7710; Payload ID: 12477 relates to Category No.: 10331, 12619, 274, 14108, 3737, 8869, 8887, 2524, 8123; Payload ID: 12478 relates to Category No.: 9718, 15207, 795, 1752, 5446, 10372, 1483, 9861, 6296, 3100, 11910, 4949, 7743, 4186, 7737, 12732, 2169, 15140, 1296, 9858, 9891, 15521, 9945, 1780, 4127, 8956, 3775, 14663, 7997, 4439, 8988, 13232, 12117, 14729, 8524, 3070, 11363, 5500, 13376, 8535, 10590, 7992, 5501, 8458, 11299, 11713, 6103, 4254, 7640, 11724, 6295, 3060, 11980, 2173, 7872, 7315, 8419, 7748, 331, 2175, 7836, 12657, 14124, 15142, 7957, 11651, 8673, 7613, 10241, 12619, 10583, 690, 7939, 480, 6323, 3713, 1567, 2006, 12662, 12525, 6531, 6624, 7723, 11823, 13201, 13532, 4342, 8347, 1949, 8586, 12528, 13835, 13969, 6299, 496, 13886, 13827, 13966, 13837, 10238, 13970, 13860, 14054, 6758, 8936, 13785, 13784, 10093, 8453; Payload ID: 12479 relates to Category No.: 9718; Payload ID: 12480 relates to Category No.: 6814, 3100, 9945, 14663, 12553, 1273, 4653, 9825, 9835, 3631; Payload ID: 12481 relates to Category No.: 6814, 3100; Payload ID: 12482 relates to Category No.: 1207, 9945, 14663, 4653, 9825, 1693; Payload ID: 12483 relates to Category No.: 1207, 9945, 14663, 4653, 9825, 1693, 14838, 9485; Payload ID: 12484 relates to Category No.: 1207, 9940, 9945, 14663, 4653, 9835; Payload ID: 12485 relates to Category No.: 12194, 1894, 1816, 14640, 1272, 9434; Payload ID: 12486 relates to Category No.: 6227, 9950, 2355; Payload ID: 12487 relates to Category No.: 1026, 14661, 7912, 5446, 6606, 348, 4186, 12391, 4127, 3775, 5541, 16085, 8988; Payload ID: 12488 relates to Category No.: 6219, 6902, 9945, 1780, 14663, 4653, 11294, 9825, 13827, 13966, 13837, 7743, 13773, 14039, 14350, 14341, 4655, 10919; Payload ID: 12490 relates to Category No.: 9940, 9945, 14663, 9841, 4653, 1594, 3220; Payload ID: 12491 relates to Category No.: 14661, 12137, 11512, 15207, 14565, 9869, 5446, 9854, 9883, 4186, 13485, 9858, 9891, 9945, 4127, 4130, 3775, 14663, 5541, 16085, 8988, 12519, 1238, 1853, 13831, 2009, 13303, 6145, 10667, 11510; Payload ID: 12492 relates to Category No.: 12091, 9869, 3639, 5446, 9883, 998, 1983, 9858, 9891, 2886, 9768, 9945, 14663, 12743, 5541, 3525, 15456, 6451, 15454, 12099, 13373, 13918, 3697; Payload ID: 12493 relates to Category No.: 9869, 9858, 9945, 14663, 7131; Payload ID: 12494 relates to Category No.: 9869, 9858, 9945, 14663; Payload ID: 12495 relates to Category No.: 9869, 9891; Payload ID: 12496 relates to Category No.: 14565, 9869, 12427, 9858, 9891, 9945, 14663; Payload ID: 12497 relates to Category No.: 3691, 12427, 16172, 11506, 3398, 12798, 2493, 2506, 1780, 11884, 10273, 8004, 13363, 12409, 11090, 8562, 5866, 15160, 1600, 5868, 12505, 10246, 8289, 3639, 4998, 1048, 3041; Payload ID: 12498 relates to Category No.: 4797, 2775, 1893, 11660, 11686, 10990; Payload ID: 12499 relates to Category No.: 6593, 4797, 2775, 1893, 11660, 11686, 6814; Payload ID: 12500 relates to Category No.: 4797, 2775, 1893, 11660, 11686; Payload ID: 12501 relates to Category No.: 4797, 2775, 1893, 11660, 11686; Payload ID: 12502 relates to Category No.: 6814, 4797, 2775, 1893, 11660, 11686; Payload ID: 12503 relates to Category No.: 6814, 1894, 4797, 2775, 1893, 11660, 11686; Payload ID: 12504 relates to Category No.: 12194, 11926, 2775, 1893, 980, 11660, 12007; Payload ID: 12505 relates to Category No.: 4797, 2775, 1893, 11660, 11686; Payload ID: 12506 relates to Category No.: 4797, 2775, 1893, 11660, 11686; Payload ID: 12507 relates to Category No.: 6814, 4797, 2775, 1893, 11660, 11686; Payload ID: 12508 relates to Category No.: 6814, 4797, 2775, 1893, 11660, 11686; Payload ID: 12509 relates to Category No.: 4797, 2775, 1893, 11660, 11686; Payload ID: 12510 relates to Category No.: 1512, 4797, 2775, 1893, 11660, 11686; Payload ID: 12511 relates to Category No.: 2775, 1893, 980, 11660; Payload ID: 12512 relates to Category No.: 2775, 1893, 980, 11660, 8929, 8923; Payload ID: 12513 relates to Category No.: 4797, 2775, 1893, 980, 11660, 13048; Payload ID: 12514 relates to Category No.: 6593, 4797, 2775, 1893, 11660, 11686; Payload ID: 12515 relates to Category No.: 4797, 2775, 1893, 4798, 12041, 11660, 11686; Payload ID: 12516 relates to Category No.: 4797, 2775, 1893, 11660, 11686; Payload ID: 12517 relates to Category No.: 4797; Payload ID: 12518 relates to Category No.: 6593, 4797, 6814; Payload ID: 12519 relates to Category No.: 6219, 1026, 15626, 9950, 16214; Payload ID: 12520 relates to Category No.: 6219, 15626, 9950, 9945, 14663, 4653, 5406; Payload ID: 12521 relates to Category No.: 15626, 14565, 9950; Payload ID: 12522 relates to Category No.: 6219, 12137, 15626, 1295, 9950, 10005; Payload ID: 12523 relates to Category No.: 6814, 15626; Payload ID: 12524 relates to Category No.: 5785, 13435, 287, 15113, 8996, 10702, 4828, 12397, 9000, 11425, 10343, 15194, 12753, 12465; Payload ID: 12525 relates to Category No.: 4828, 5785, 10702, 13435, 483, 9854, 3041; Payload ID: 12526 relates to Category No.: 12091, 5428, 1713, 9869, 5446, 403, 9854, 9883, 690, 15207, 10074, 4186, 9858, 9891, 9945, 4127, 4130, 3775, 14663, 5541, 16085, 8988, 1238, 6145, 7131, 15192, 3713, 1562, 7600, 16095, 5542, 360, 11174, 6269, 4538, 8373, 11980, 455, 13189, 1984, 12668, 3727, 7984, 12897, 5330; Payload ID: 12527 relates to Category No.: 12091, 4828, 1002, 15207, 14565, 5428, 1713, 9869, 10074, 15614, 1752, 5446, 403, 9854, 9883, 345, 4186, 9858, 9891, 9945, 2311, 4127, 4130, 3775, 10648, 14663, 5541, 16085, 8988, 1238, 6145, 10256, 10075, 12719, 12652, 5255, 1836, 14050, 692, 3715, 3574; Payload ID: 12528 relates to Category No.: 12091, 15207, 14565, 5428, 9869, 1070, 10074, 5446, 403, 9854, 9883, 4186, 9858, 9891, 9945, 10366, 4127, 3775, 10648, 14663, 8988, 9000, 15194, 15185, 7537, 2878, 6613, 13748, 15191, 7533, 7535, 1056, 1053, 6615, 6616, 9004, 5242, 1795, 1061, 3014; Payload ID: 12529 relates to Category No.: 12091, 4828, 690, 5428, 9869, 10074, 3639, 5446, 403, 9854, 9883, 9858, 9945, 14663, 1238, 9000, 10954, 15185, 10075, 11266, 2878, 13748, 15191, 7535, 6615, 9004, 3046, 12615, 15203, 7702, 9891, 1925, 10331, 13371, 12571, 7984, 10203, 10486, 8776, 14410, 5016; Payload ID: 12530 relates to Category No.: 12091, 5428, 1713, 9869, 10074, 3639, 5446, 403, 9854, 9883, 3986, 2493, 9858, 9945, 3775, 14663, 5541, 16092, 10093, 8837; Payload ID: 12531 relates to Category No.: 12091, 5428, 1713, 9869, 10074, 5446, 403, 9854, 9883, 9858, 9945, 1204, 14663, 11980; Payload ID: 12532 relates to Category No.: 12091, 5428, 1713, 9869, 10074, 5446, 403, 9854, 9883, 9858, 9945, 1204, 14663; Payload ID: 12533 relates to Category No.: 14565, 1713, 9869, 5939, 1752, 9777, 9940, 337, 275, 9858, 9945, 14663, 14328, 9862, 4229, 12129, 4655, 4194; Payload ID: 12534 relates to Category No.: 9869, 9858, 9945, 14663, 9862; Payload ID: 12535 relates to Category No.: 1026, 9869, 9777, 274, 14589, 15157, 9858, 2506, 9945, 14663, 15156, 448, 9000, 9862, 1048, 2933, 10075; Payload ID: 12536 relates to Category No.: 9869, 9862; Payload ID: 12537 relates to Category No.: 9869, 9858, 9945, 14663, 12519, 9862, 10254, 6666; Payload ID: 12538 relates to Category No.: 5785, 9869, 1795, 9858, 9945, 14663, 12519, 9862, 10254; Payload ID: 12539 relates to Category No.: 9869, 12519, 9862, 10254; Payload ID: 12540 relates to Category No.: 6219; Payload ID: 12541 relates to Category No.: 6219, 6212, 14565; Payload ID: 12542 relates to Category No.: 6219, 6212, 14565; Payload ID: 12543 relates to Category No.: 9940, 9945, 14663, 4653, 9835; Payload ID: 12544 relates to Category No.: 9945, 14663, 4653, 9897; Payload ID: 12545 relates to Category No.: 9945, 14663, 4653, 9897; Payload ID: 12546 relates to Category No.: 14565, 1238, 1469, 2260, 13359, 12582; Payload ID: 12547 relates to Category No.: 14565, 1238, 1469, 2260, 6814; Payload ID: 12548 relates to Category No.: 7288, 14216, 3994; Payload ID: 12549 relates to Category No.: 6814, 14565, 5446, 4186, 3775, 8988, 1238, 355; Payload ID: 12550 relates to Category No.: 14565, 795, 5446, 4186, 3775, 8988, 1238, 1469, 7217, 2047, 2260, 1991, 355, 16213, 6296, 12779, 13237, 14509, 13775, 6814; Payload ID: 12551 relates to Category No.: 6814, 14565, 14455, 5446, 4186, 3775, 8988, 355; Payload ID: 12552 relates to Category No.: 6814, 14565, 8739, 1415, 12127, 1238, 1477, 10790, 2051, 7688, 1469, 2264, 7217, 8519, 15606, 1957, 2047, 8807, 11598, 2260, 3876, 1932, 2131, 1991; Payload ID: 12553 relates to Category No.: 6219, 14565, 1238, 1477, 1469, 2264, 8807, 11598, 1932, 2131, 13827, 11140, 9378, 13116, 7613, 13797, 3294; Payload ID: 12554 relates to Category No.: 690, 14565, 7598, 5541, 1238, 2009, 1469, 7719, 7721, 7692, 8216, 4535, 3632, 13004; Payload ID: 12555 relates to Category No.: 14565, 1469, 1957, 14455, 13359, 12582, 6814; Payload ID: 12556 relates to Category No.: 15207, 14565, 2041, 9000, 6145, 10814, 1469, 1957, 10840, 12964, 9005, 1961, 12591, 8565; Payload ID: 12557 relates to Category No.: 14565, 1469, 8118, 6814; Payload ID: 12558 relates to Category No.: 1889; Payload ID: 12559 relates to Category No.: 15207, 14565, 1925, 475, 1477, 10814, 1469, 3876, 12953, 13409, 8446, 10840, 13398, 10848, 13450, 1961, 12618, 12591, 8565, 8054, 477, 7303, 14693, 2041, 9000, 6145, 496, 12580, 6814; Payload ID: 12560 relates to Category No.: 14565, 1238, 2260, 10954, 10324, 13686, 12686, 8688, 2261, 11140, 7702, 6814; Payload ID: 12561 relates to Category No.: 14565, 16214, 2945, 4749, 10005, 16211, 14111, 13437, 14056, 9994, 6814; Payload ID: 12562 relates to Category No.: 14565, 16214, 2945, 4749, 10005, 16211, 14111, 13437, 14056, 3139, 6814; Payload ID: 12563 relates to Category No.: 6814, 14565, 16214, 10005, 16211, 14452, 14067; Payload ID: 12564 relates to Category No.: 6814, 16214, 9420, 14014, 8049; Payload ID: 12565 relates to Category No.: 6814, 16214, 7710, 10005, 16211, 14111, 13437, 345, 10687, 10567; Payload ID: 12566 relates to Category No.: 6814, 16214, 7710, 14014, 345, 10687, 10567; Payload ID: 12567 relates to Category No.: 14565, 1469, 1477; Payload ID: 12568 relates to Category No.: 14565, 15149, 1469, 6814; Payload ID: 12569 relates to Category No.: 13589, 3398, 14565, 9966, 1469, 2814; Payload ID: 12570 relates to Category No.: 9966, 14565, 1469, 2814, 16213, 8920, 1112, 9381, 8657, 8118; Payload ID: 12571 relates to Category No.: 14565, 1238, 2260, 10324, 2261, 2264; Payload ID: 12572 relates to Category No.: 1512, 4521, 14663, 4538, 3474, 13888, 5741, 4535, 4629, 6219, 2096, 11517, 13767, 9498; Payload ID: 12573 relates to Category No.: 4521, 1512, 14663, 4538, 9982; Payload ID: 12574 relates to Category No.: 1512, 4706, 14663, 4538, 4301, 12066, 1482, 13860, 4299, 8118, 4707, 11941; Payload ID: 12575 relates to Category No.: 4706, 4301, 4707, 1512, 14663, 4538, 12066, 1482, 7332, 4535, 1514, 10801, 4686, 4705; Payload ID: 12576 relates to Category No.: 4706, 4301, 4707, 1512, 14663, 4538, 7131, 1482; Payload ID: 12577 relates to Category No.: 16197, 12750, 12129, 12124, 1892, 11242; Payload ID: 12578 relates to Category No.: 795, 998, 16197, 12043, 12129; Payload ID: 12579 relates to Category No.: 1512, 4706, 4521, 14663, 4538, 4685, 4352, 4686, 9432, 13996; Payload ID: 12580 relates to Category No.: 1512, 14663, 4538, 4685, 4352, 4686, 9432, 3097; Payload ID: 12581 relates to Category No.: 9982, 1512, 4538, 9432; Payload ID: 12582 relates to Category No.: 4998, 9432, 1512, 12062, 12063, 1893, 3405, 11660, 12068, 15947, 4527, 14838, 4530; Payload ID: 12583 relates to Category No.: 1512, 1703, 9432; Payload ID: 12584 relates to Category No.: 9500, 9616, 1512, 14663, 9616, 9501, 3205, 9614; Payload ID: 12585 relates to Category No.: 6814, 9500, 1295, 14663, 1878, 6354, 1828, 14489, 12891, 8936, 8906, 8888, 14883, 6356, 4595, 4372, 4333, 4670, 15371, 15234, 4474; Payload ID: 12586 relates to Category No.: 9982, 1512, 4706, 4521, 14663, 4538, 3791, 1482; Payload ID: 12587 relates to Category No.: 9982, 4706, 7131, 14831; Payload ID: 12588 relates to Category No.: 6814, 1512, 3100, 4706, 4521, 14663, 4538, 1482, 12923, 13746, 13289; Payload ID: 12589 relates to Category No.: 6814, 1512, 3100, 4706, 4521, 14663, 4538, 1482, 15012, 13289, 9125, 14838, 13886, 13938; Payload ID: 12590 relates to Category No.: 6814, 3100, 4706, 4521, 13289, 11404; Payload ID: 12591 relates to Category No.: 6814, 9718, 1512, 3100; Payload ID: 12592 relates to Category No.: 11910, 12461, 10370, 7629, 8689, 9677, 8234, 10802; Payload ID: 12593 relates to Category No.: 5785, 9869, 9883, 9858, 14097, 3698, 9945, 14663, 12036, 12517, 9855, 9862, 7364; Payload ID: 12594 relates to Category No.: 12999, 15450, 15454, 11187, 15446, 15453, 11499, 8726; Payload ID: 12595 relates to Category No.: 8458, 8457; Payload ID: 12596 relates to Category No.: 11512, 15207, 14565, 9869, 7613, 10074, 5446, 9854, 4186, 9858, 9891, 9945, 4127, 4130, 3775, 14663, 16197, 5541, 16085, 8988, 1238, 12117, 1853, 13831, 2009, 13303, 6145, 10667, 11510, 15192, 4871, 10588, 10666, 11345, 10550, 5552, 7754, 12091, 1060, 5808, 7719, 10366, 2139, 4041, 11566, 8424, 13515, 9013, 12841; Payload ID: 12597 relates to Category No.: 14661, 12137, 11512, 15207, 14565, 9869, 5446, 9854, 9883, 4186, 13485, 9858, 9891, 9945, 4127, 4130, 3775, 14663, 5541, 16085, 8988, 12519, 1238, 1853, 13831, 2009, 13303, 6145, 10667, 11510; Payload ID: 12598 relates to Category No.: 9869, 9883, 9858, 9945, 14663, 5541, 13303, 10667; Payload ID: 12599 relates to Category No.: 13303, 10667; Payload ID: 12600 relates to Category No.: 12091, 5446, 6063, 1983, 9858, 12130, 9768, 9945, 14663, 12743, 5541, 15456, 6451, 15454, 11186, 12404; Payload ID: 12601 relates to Category No.: 13303, 4828, 10074, 9854, 9858, 9945, 14663, 1238, 10954, 11266; Payload ID: 12602 relates to Category No.: 4828, 690, 10074, 9858, 9945, 14663, 1238, 10954, 13303, 10226, 13214, 9869, 11452; Payload ID: 12604 relates to Category No.: 1417, 7710, 2945, 12573, 12948, 12592, 7675, 7678, 7674, 12578, 13571, 1237, 7631, 13686, 7679, 7676, 8057, 12591, 7687, 13406, 1836, 9125, 1567, 12570, 13409, 8054, 12596, 13407, 13450, 476, 13572, 11940, 13888, 14054, 14022; Payload ID: 12605 relates to Category No.: 6219, 6212, 9902, 6814; Payload ID: 12606 relates to Category No.: 7710; Payload ID: 12607 relates to Category No.: 12427, 3639, 9511, 2878, 13734, 10243, 12397, 10516, 14566, 8461, 7621; Payload ID: 12608 relates to Category No.: 11512, 5785, 6212, 14565, 11109, 345, 10780, 286, 4104, 6153, 9945, 14663, 5447, 729, 3016, 2009, 9000, 9827, 11290, 4653, 9819, 10522, 10626, 9839, 9856, 9895, 9823, 9833, 4541, 353, 9006, 10302, 5717, 7309, 817; Payload ID: 12609 relates to Category No.: 6212, 9945, 14663, 3016, 10790, 10583, 4653, 9819, 9820, 10946, 9839, 9856, 9895, 9823, 9833, 6340, 14782, 12646, 7743, 7939, 12824; Payload ID: 12610 relates to Category No.: 6212, 9945; Payload ID: 12611 relates to Category No.: 6212, 5428, 9945, 14663, 4653, 9819, 9839, 9856, 9895, 9823, 9833, 8677, 8688, 1684, 1678, 569; Payload ID: 12612 relates to Category No.: 6212, 5428, 9945, 14663, 4653, 9819, 9839, 9856, 9895, 9823, 9833; Payload ID: 12613 relates to Category No.: 6212, 9945, 1204, 14663, 4653, 9819, 9839, 9856, 9895, 9823, 9833; Payload ID: 12614 relates to Category No.: 6212, 2460, 9945, 14663, 4653, 9839, 9823, 9833, 264, 1729, 6263, 14816, 9827, 6615; Payload ID: 12615 relates to Category No.: 6814, 10074, 1592, 9941, 9945, 14663, 1238, 815, 4653, 9819, 9839, 9856, 9895, 9823, 9833, 5345, 10070, 12646, 5344, 817, 1910, 13925, 13859, 10372, 496, 13867, 13874, 13796, 13971, 13927, 10238, 13970, 11604, 13944, 10790, 11230, 13877, 10287, 6395, 9492, 3010, 14045, 15121, 10618; Payload ID: 12616 relates to Category No.: 6814, 5428, 3684, 9941, 1451, 9945, 1893, 14663, 815, 5855, 4653, 9819, 9839, 9895, 9823, 9833, 9590, 4654; Payload ID: 12617 relates to Category No.: 6814, 5785, 5428, 9941, 9945, 14663, 815, 4653, 9856, 9823, 9833, 9590, 4654; Payload ID: 12618 relates to Category No.: 6814, 9941, 9945, 14663, 4653, 9819, 9839, 9856, 9895, 9823, 9833; Payload ID: 12619 relates to Category No.: 6814, 9941, 9945, 14663, 4653, 9856, 9895, 9823, 9833; Payload ID: 12620 relates to Category No.: 6814, 9941, 9945, 14663, 4653, 9839, 9856, 9895, 9823, 9833, 817, 1910, 2079, 4115, 11802; Payload ID: 12621 relates to Category No.: 6212, 9945, 14663, 10583, 4653, 9819, 9839, 9856, 9895, 9823, 9833, 11190, 817, 13818, 13797, 6153, 10070; Payload ID: 12622 relates to Category No.: 6219, 6814, 6212, 5446, 1592, 9945, 2311, 4130, 14663, 729, 4653, 9823, 9833, 1594, 11285, 10486, 16020, 6626, 13831, 6758, 10802, 10593, 11602, 10243, 11322, 10404, 13513, 8672, 4588, 11268; Payload ID: 12623 relates to Category No.: 6212, 1893, 10790, 11037, 6340, 6221, 10054; Payload ID: 12624 relates to Category No.: 1026, 6212, 9945, 14663, 815, 2353, 8611, 4653, 9819, 10946, 10913, 10394, 11231, 9839, 9856, 9895, 9823, 9833, 13096, 6436, 10243, 7793; Payload ID: 12625 relates to Category No.: 6212, 9945, 1204, 14663, 4653, 9819, 9839, 9856, 9895, 9823, 9833; Payload ID: 12626 relates to Category No.: 6212, 15662, 2353; Payload ID: 12627 relates to Category No.: 6219, 4105, 2211, 9826, 4655, 9836, 9827; Payload ID: 12628 relates to Category No.: 6212, 9945, 14663, 4653, 9856, 9895, 9823, 9833, 9940, 7724; Payload ID: 12629 relates to Category No.: 14565, 9945, 5428, 10331; Payload ID: 12630 relates to Category No.: 6212, 9945, 14663, 4653, 9856, 9823, 9833; Payload ID: 12631 relates to Category No.: 6212; Payload ID: 12632 relates to Category No.: 6219, 6212, 9945, 14663, 14086, 10005, 16211, 4653, 9823, 10187; Payload ID: 12633 relates to Category No.: 6219, 5785, 6212, 14565, 1295, 12619, 6814, 10702, 15149, 8731, 3398, 12931, 11506, 3398, 4808, 2243, 14663, 10878, 4336, 4579, 5659, 10637, 9862, 10829, 5501, 6758, 5643, 10187, 10509, 5552, 11062, 10539, 12872, 5649, 351, 8327, 10337, 4094; Payload ID: 12634 relates to Category No.: 5785, 6212, 6219, 14565, 15149, 9945, 14663, 5501, 355, 14450, 6814; Payload ID: 12635 relates to Category No.: 6219, 5785, 6212, 14565, 15149, 14663, 5501, 13541, 4828, 11646; Payload ID: 12636 relates to Category No.: 5785, 6219, 6212, 14565, 14663, 5501, 8489; Payload ID: 12637 relates to Category No.: 6219, 5785, 6212, 14565, 9945, 14663, 5501, 12646, 690, 5985; Payload ID: 12638 relates to Category No.: 6219, 5785, 6212, 14565, 14663, 5501, 12646, 690, 5985, 6814; Payload ID: 12639 relates to Category No.: 6219, 5785, 6212, 14565, 9862, 266; Payload ID: 12640 relates to Category No.: 6219, 14661, 5785, 6212, 14565, 10702, 11987, 2940, 12931, 12633, 4949, 345, 1451, 12391, 13491, 9945, 1780, 13360, 3775, 14663, 5503, 9932, 10486, 5501, 4502, 3216, 13395, 4828; Payload ID: 12641 relates to Category No.: 6219, 5785, 6212, 14565, 9891, 14663, 5501; Payload ID: 12642 relates to Category No.: 6814, 5785, 6219, 6212, 14565, 1204, 14663, 5501, 9862; Payload ID: 12643 relates to Category No.: 6219, 1026, 5785, 15207, 14565, 2885, 1752, 5446, 348, 4186, 9941, 1451, 4127, 4130, 3775, 14663, 16197, 16085, 8988, 1238, 6145, 11323, 5501, 10573, 1960, 355, 10226, 10283, 5406, 6814, 6212; Payload ID: 12644 relates to Category No.: 6814, 5785, 6219, 15207, 14565, 1070, 10074, 16286, 5446, 1060, 9941, 1451, 9858, 4127, 4130, 14663, 14992, 1238, 13695, 5501, 12891, 13925, 11313, 363, 5507, 8496, 11573, 4244, 6212; Payload ID: 12645 relates to Category No.: 6219, 5785, 14565, 1417, 3541, 6814, 6212, 7306, 14663, 5501; Payload ID: 12646 relates to Category No.: 6219, 5785, 14565, 4375, 11309, 13532, 4342, 13292, 6212; Payload ID: 12647 relates to Category No.: 6219, 5785, 14565, 1067, 4375, 11309, 13532, 4342, 13292, 7645, 1073, 6212; Payload ID: 12648 relates to Category No.: 6212, 9945, 14663, 9841, 4653, 6814; Payload ID: 12649 relates to Category No.: 6814, 9777, 4969, 6212, 9945, 14663, 9841, 5501, 4653; Payload ID: 12650 relates to Category No.: 6814; Payload ID: 12651 relates to Category No.: 6212, 7045, 9945, 14663, 4439, 9841, 14834, 4653, 4442, 10031, 6687, 11018, 1594, 3339, 9536, 14216, 3656; Payload ID: 12652 relates to Category No.: 14661, 12638, 3986, 1767, 9941, 12391, 9945, 2311, 14663, 9841, 13668, 13150, 4653, 6737, 9819, 9820, 5490, 13299, 3016, 6814; Payload ID: 12653 relates to Category No.: 14661, 12638, 5446, 2940, 3986, 1767, 9941, 9945, 4130, 14663, 9841, 13668, 4653, 6737, 9819, 15164, 9820, 5490, 13299, 12427, 4826, 6814; Payload ID: 12654 relates to Category No.: 6219, 687, 11987, 7743, 14865, 9942, 9945, 14663, 14862, 4459, 13071, 5786, 3100; Payload ID: 12655 relates to Category No.: 14565, 11910, 14865, 9942, 9945, 14663, 14862, 3100; Payload ID: 12656 relates to Category No.: 6219, 11910, 14865, 9942, 9945, 14663, 5256, 14862, 12117, 11363, 8535, 4459, 1494, 1493, 1496, 4419, 11178, 14589, 1703, 13681, 1240, 1128, 1483, 13503; Payload ID: 12657 relates to Category No.: 9942, 5446, 9945, 4130; Payload ID: 12658 relates to Category No.: 14565, 9942, 9945; Payload ID: 12659 relates to Category No.: 6814; Payload ID: 12660 relates to Category No.: 6814, 8356; Payload ID: 12661 relates to Category No.: 8862, 14565, 9942, 9945; Payload ID: 12662 relates to Category No.: 3100; Payload ID: 12663 relates to Category No.: 14565, 9942, 9945; Payload ID: 12664 relates to Category No.: 14565, 9942, 1048, 9945, 5458; Payload ID: 12665 relates to Category No.: 14565, 9942, 9945; Payload ID: 12666 relates to Category No.: 11512, 795, 10074, 15517, 3021, 381, 9947, 10648, 8818, 12867, 10794, 9897, 13107, 13891, 10524; Payload ID: 12667 relates to Category No.: 9947; Payload ID: 12668 relates to Category No.: 9947, 2041; Payload ID: 12669 relates to Category No.: 9947; Payload ID: 12670 relates to Category No.: 6219, 6227, 5065, 10422, 14831, 16229; Payload ID: 12671 relates to Category No.: 11910, 9815; Payload ID: 12672 relates to Category No.: 6814, 6584, 12063, 1893, 4435, 3405, 11660; Payload ID: 12673 relates to Category No.: 6814, 4435, 11930, 12063, 1893, 3405, 11660; Payload ID: 12674 relates to Category No.: 9982, 14663, 2347, 14979, 13805, 5893, 6927, 5898; Payload ID: 12675 relates to Category No.: 14663, 2552, 16234, 16275, 9567, 2558, 6814; Payload ID: 12676 relates to Category No.: 14663, 2552, 16234, 16275, 9567, 2558; Payload ID: 12677 relates to Category No.: 1026, 14661, 15626, 795, 5446, 1517, 6606, 348, 12498, 345, 4186, 12391, 4127, 3309, 3775, 5541, 16085, 8988, 7967, 8023, 10602, 13951; Payload ID: 12678 relates to Category No.: 5785, 15207, 14565, 403, 11371, 13551, 3775, 8677; Payload ID: 12679 relates to Category No.: 2990, 14663, 12242, 9256, 12240, 12251, 12259, 9236, 13827, 5949, 1957, 6626, 9411, 5998, 2009, 11941, 4332, 14160, 4594; Payload ID: 12680 relates to Category No.: 8862, 9982, 1512, 14153, 9283, 14663, 12242, 12251, 12312, 15986, 166, 5337, 1834, 647, 9411, 14160; Payload ID: 12681 relates to Category No.: 14153, 9283, 1834, 6530; Payload ID: 12682 relates to Category No.: 9283, 9982, 9232, 14153, 166, 1834, 647, 9411, 14160; Payload ID: 12683 relates to Category No.: 9232, 9283, 8198; Payload ID: 12684 relates to Category No.: 9283, 9232, 7710, 1269; Payload ID: 12685 relates to Category No.: 9256, 12260; Payload ID: 12686 relates to Category No.: 2990, 12251, 14663, 12242, 12240, 12259, 9236, 407; Payload ID: 12687 relates to Category No.: 4595, 14153, 12251, 2991, 14663, 12242, 12259, 9236, 13827; Payload ID: 12688 relates to Category No.: 1207, 6902, 2991, 14663, 12242, 12240, 12259, 9236, 13886, 13970, 14153, 2235, 2243, 15309, 1302, 4670, 6814; Payload ID: 12689 relates to Category No.: 12091, 1512, 14663, 4690, 4538, 4686, 4448, 11858; Payload ID: 12690 relates to Category No.: 12091, 1512, 1894, 14663, 4538, 4686, 4448; Payload ID: 12691 relates to Category No.: 12091, 1512, 14663, 4690, 4538, 4686, 4448; Payload ID: 12692 relates to Category No.: 12091, 1512, 14663, 4538, 4685, 4686; Payload ID: 12693 relates to Category No.: 12091, 1512, 14663, 4690, 4538, 4685, 4686, 4448, 10681; Payload ID: 12694 relates to Category No.: 1512, 4686, 14663, 4690, 4538, 4535, 7548, 166; Payload ID: 12695 relates to Category No.: 1512, 14663, 4690, 4538, 4686, 13882, 1836, 13970, 13797; Payload ID: 12696 relates to Category No.: 1512, 14663, 4538, 4686; Payload ID: 12697 relates to Category No.: 12137, 14915, 4439, 7546, 14716; Payload ID: 12698 relates to Category No.: 14663, 1878, 6354, 12296, 1828; Payload ID: 12699 relates to Category No.: 6814, 3100, 14663, 1878, 6354, 6356, 1828, 13967, 13936, 14022; Payload ID: 12700 relates to Category No.: 9982, 14427, 14423; Payload ID: 12701 relates to Category No.: 1627, 3791; Payload ID: 12702 relates to Category No.: 11512, 1948, 10648, 2136, 11307, 13161, 8117, 8535, 7121, 3728, 1969, 13397, 2021, 12886, 7955, 8306, 10249, 13157, 10607, 7628, 8024, 8023, 2033; Payload ID: 12703 relates to Category No.: 1867, 14663, 4098, 5899, 6904; Payload ID: 12704 relates to Category No.: 7131, 10491; Payload ID: 12706 relates to Category No.: 9500; Payload ID: 12707 relates to Category No.: 2940, 15157, 15140, 5544, 1477, 12851; Payload ID: 12708 relates to Category No.: 5846, 1651, 10381, 10804, 13126, 1649, 3143; Payload ID: 12709 relates to Category No.: 1651, 13936, 3145, 13126, 1649, 5846; Payload ID: 12710 relates to Category No.: 3354, 3320, 3353, 15257, 7046, 8692, 13566, 8696, 4835; Payload ID: 12712 relates to Category No.: 13589, 3398, 12427; Payload ID: 12717 relates to Category No.: 4797, 10990; Payload ID: 12718 relates to Category No.: 13589, 3398, 15490, 3398, 3791, 7841, 1285; Payload ID: 12720 relates to Category No.: 14831, 1043; Payload ID: 12722 relates to Category No.: 12091, 795, 1721, 7613, 13166, 7306, 1780, 11858, 16225, 8611, 10467, 5291; Payload ID: 12723 relates to Category No.: 12091, 14038, 7613, 13166, 7743, 11506, 3398, 10775, 1780, 12117, 4332, 11858, 10256, 6532, 793; Payload ID: 12724 relates to Category No.: 12091, 795, 1721, 7613, 13166, 11858, 8119; Payload ID: 12725 relates to Category No.: 7743, 8692, 7153, 13565, 15261; Payload ID: 12726 relates to Category No.: 13589, 3398, 15490, 3398, 1703, 7291, 16182; Payload ID: 12727 relates to Category No.: 9500, 14663, 1878, 15311, 6424, 6278; Payload ID: 12728 relates to Category No.: 13589, 3398, 9500, 15517, 7217, 7372; Payload ID: 12730 relates to Category No.: 9950, 9862, 15626; Payload ID: 12731 relates to Category No.:

12194, 10331, 12099, 6814; Payload ID: 12732 relates to Category No.: 1737, 13589, 3398, 7912, 8441, 15517, 3354, 5253, 7154, 14838, 7132, 670, 2424, 8322; Payload ID: 12733 relates to Category No.: 11949, 11298, 7883, 14566, 10392, 8176; Payload ID: 12734 relates to Category No.: 13589, 3398, 8441, 5253, 2424, 8322; Payload ID: 12735 relates to Category No.: 7306, 6670, 4439, 13618, 14834, 4442, 10031, 14838; Payload ID: 12736 relates to Category No.: 7306, 6670, 4439, 9379, 11546, 4442, 10031, 3339, 4464, 14194, 14838, 10747, 10740, 10969; Payload ID: 12737 relates to Category No.: 1730, 7306, 14838, 6670, 13618, 4442; Payload ID: 12738 relates to Category No.: 1730, 7306, 14838, 6670, 4439, 13618, 4442, 10031, 3339; Payload ID: 12740 relates to Category No.: 1730, 10366, 7754, 16294, 14927; Payload ID: 12741 relates to Category No.: 690, 14565, 1730, 10372, 1816, 10359, 16085, 1318, 13179, 13882, 13827, 4145, 14928, 9411, 2000, 10226, 10558; Payload ID: 12742 relates to Category No.: 10036, 14922; Payload ID: 12743 relates to Category No.: 11512, 3013, 7613, 10372, 1334, 13812, 8337; Payload ID: 12745 relates to Category No.: 14565, 795, 1703, 7306, 14589, 11765, 1844, 5729; Payload ID: 12746 relates to Category No.: 4949, 7743, 14589, 7737, 3114, 12954, 11399, 12538, 3910, 16133, 6215, 1553, 6501, 5729, 1717, 4403, 1552, 1345, 13662, 16129, 1817, 449; Payload ID: 12747 relates to Category No.: 14589, 3114, 3910; Payload ID: 12748 relates to Category No.: 10702, 14589, 10481, 1816, 12614, 1812; Payload ID: 12749 relates to Category No.: 6606, 15782, 10388; Payload ID: 12750 relates to Category No.: 12194, 10074, 7743, 1893, 4020, 4021, 1238, 10080, 4180, 7755, 7983, 15428, 10621, 7752; Payload ID: 12751 relates to Category No.: 12194, 1894, 1238, 10069, 4180, 8549, 13882, 10093, 14689; Payload ID: 12752 relates to Category No.: 10069, 4180, 12194, 14565, 2311, 1238, 12615, 13398, 13488, 13682, 13490, 12646, 13882, 14689, 14838, 1984, 2041, 11390, 16294, 10372, 2006, 13767, 2080, 13881, 11307, 690, 3566, 1971, 8926, 14638, 12963, 11154, 13869, 1997, 2117; Payload ID: 12753 relates to Category No.: 14565, 8175, 7613, 2775, 2311, 11285, 1893, 13386, 980, 1238, 11660, 4180, 11322, 7252, 10513, 10567, 7841, 16025; Payload ID: 12754 relates to Category No.: 5428, 2311, 11208; Payload ID: 12757 relates to Category No.: 5848, 14050, 7369; Payload ID: 12758 relates to Category No.: 10588, 11051, 15286, 5753, 13151; Payload ID: 12759 relates to Category No.: 1269, 986; Payload ID: 12760 relates to Category No.: 2169, 10359, 10093, 10522, 10626, 9410, 10372, 3246, 1906, 13293, 1269, 364; Payload ID: 12761 relates to Category No.: 7306, 10359, 1906, 13293, 2094, 2131, 2001, 11391, 10626, 10656, 11039, 11388; Payload ID: 12762 relates to Category No.: 12433; Payload ID: 12763 relates to Category No.: 4828, 5367, 11512, 5428, 2303, 2885, 10074, 12646, 10648, 7598, 13925, 1238, 10902, 10080, 6138, 11566, 10311, 10313, 7966, 10946, 8298, 10947, 8266, 7851; Payload ID: 12764 relates to Category No.: 4828, 5367, 5428, 1713, 2303, 12646, 13925, 10902; Payload ID: 12765 relates to Category No.: 12638, 16294, 14108, 11584; Payload ID: 12766 relates to Category No.: 6219, 6212, 1295, 10938, 14838; Payload ID: 12767 relates to Category No.: 6219, 8862, 6212, 1295, 14838; Payload ID: 12768 relates to Category No.: 14661, 6986, 6212, 15149, 6969, 274, 7154, 1296, 2243, 9420, 7132, 3889, 16170, 4336, 483, 9187, 6977, 8898, 8920, 8934, 6103, 15622, 4458, 14095, 264, 2709, 5073, 6082, 10071, 13144, 10539, 1752, 13143, 12942, 8192, 985, 12105, 2547, 9458, 608, 2717, 10480, 3899, 10503, 9163, 10387, 6970, 1295, 8378, 10257, 14945, 2248, 11027, 3873; Payload ID: 12769 relates to Category No.: 6219, 6212, 7613; Payload ID: 12770 relates to Category No.: 4828, 5367, 2885, 9891, 2311, 4819, 5610, 5428, 13925, 6248, 2878, 5507, 13594, 10850, 11391, 11601, 7658, 15535, 1969, 13823, 11546, 11392, 1925, 11602, 9590, 10901, 10905, 11566, 11191, 10797, 10388, 1992, 11362, 14019, 11103, 13972, 11616, 11538, 10964, 10646, 13760, 1897; Payload ID: 12771 relates to Category No.: 690, 1026, 14661, 10074, 5446, 10372, 1816, 6606, 348, 274, 12459, 4186, 10359, 9891, 12391, 10366, 4127, 3775, 5541, 16085, 8988, 4021, 1238, 10954, 10080, 16294, 10955, 11187, 11266, 10583, 14050, 10093, 9410, 10522, 10626, 7553, 10983, 6371, 11240, 13293, 8476, 13488, 8459, 10997, 14643, 1701, 4937, 1775, 12561, 3597, 3246, 1269, 13835, 13882, 13886, 13827, 13970, 15570, 14000, 5458; Payload ID: 12772 relates to Category No.: 12091, 1026, 14661, 1713, 9720, 10074, 5446, 10372, 8731, 3398, 6606, 348, 9713, 4949, 11506, 3398, 4186, 10175, 11296, 9891, 12391, 10366, 4127, 360, 3775, 10648, 5541, 16085, 8988, 11307, 4021, 1238, 10558, 15570, 10954, 10080, 10955, 11187, 11178, 7216, 10583, 14050, 10093, 11186, 10419, 8507, 361, 11390, 10522, 11033, 10626, 11391, 10298, 12397, 1993, 10466, 11240, 11986, 8476, 10514, 3605, 10655, 8459, 10997, 9569, 10283, 2066, 10656, 6847, 10766, 10996, 13835, 13969, 3356, 13882, 16294, 13888, 13827, 13836, 13970, 12646, 1746, 10359; Payload ID: 12773 relates to Category No.: 12091, 1026, 14661, 1713, 9720, 15614, 5446, 10372, 6606, 348, 4186, 3575, 9891, 12391, 10094, 10366, 4127, 3775, 16197, 5541, 16085, 8988, 11858, 12461, 10486, 16294, 10075, 11187, 10583, 10093, 11186, 10522, 10626, 1572, 3577, 6846, 8476, 2107, 11191, 1701, 10373, 14060, 6391, 3613, 12692, 13132; Payload ID: 12774 relates to Category No.: 12091, 4828, 1026, 14661, 14565, 1713, 9720, 15614, 1752, 5446, 10372, 6606, 348, 12459, 4186, 9891, 12391, 10366, 4127, 3775, 5541, 16085, 8988, 11307, 11858, 9862, 10954, 10095, 11187, 10583, 10093, 11186, 10419, 11390, 11033, 11391, 1572, 10298, 757, 6846, 11200, 10514, 10997, 11191, 1763, 2094, 10373, 1755, 14060, 14687, 6849, 5406, 5949, 472, 14641, 13293, 15425, 14697, 9068, 13835, 5785, 13969, 7613, 16294, 14025, 13836, 14000, 4721, 13877, 13881, 10446, 13923, 6860, 5458, 13846, 6873, 6835, 6858, 6852; Payload ID: 12775 relates to Category No.: 4828, 1204, 10095; Payload ID: 12776 relates to Category No.: 5785, 16159, 10074, 2711, 5592, 275, 1779, 1238, 9862, 15379, 10080, 10191, 10075, 11209, 14330, 10804, 8040, 11986, 4969, 10190, 8116, 10799, 9934, 7686, 12627, 12106; Payload ID: 12777 relates to Category No.: 5785, 274; Payload ID: 12778 relates to Category No.: 14565, 10702, 8929, 12502; Payload ID: 12779 relates to Category No.: 10702, 8929, 12502; Payload ID: 12780 relates to Category No.: 10702, 8929, 12502; Payload ID: 12781 relates to Category No.: 10702, 8929, 12502; Payload ID: 12782 relates to Category No.: 1070, 9854, 8524, 14330, 3900, 2001, 7303, 11634, 14838, 10093, 9540, 14641, 4138, 6391, 4067, 6163, 684, 3934; Payload ID: 12784 relates to Category No.: 1204; Payload ID: 12785 relates to Category No.: 1204; Payload ID: 12786 relates to Category No.: 6227, 12137, 4703, 3830; Payload ID: 12787 relates to Category No.: 1204, 13740; Payload ID: 12789 relates to Category No.: 3807, 16338; Payload ID: 12790 relates to Category No.: 7306, 10005, 12628; Payload ID: 12793 relates to Category No.: 795, 16165, 12041, 3697, 10256, 10864; Payload ID: 12794 relates to Category No.: 12137; Payload ID: 12795 relates to Category No.: 10702, 13435; Payload ID: 12796 relates to Category No.: 14661, 10702, 13435, 10238, 803, 13485, 8988; Payload ID: 12797 relates to Category No.: 10702, 13435; Payload ID: 12798 relates to Category No.: 13435, 337; Payload ID: 12799 relates to Category No.: 10702, 13435; Payload ID: 12800 relates to Category No.: 14661, 10702, 13435, 10238, 803, 13485, 10775, 8988, 3708, 3713; Payload ID: 12801 relates to Category No.: 10702, 13435; Payload ID: 12802 relates to Category No.: 10702, 13435; Payload ID: 12804 relates to Category No.: 7566; Payload ID: 12805 relates to Category No.: 14565; Payload ID: 12807 relates to Category No.: 12137, 1002, 5785; Payload ID: 12808 relates to Category No.: 4766, 13363; Payload ID: 12809 relates to Category No.: 5785; Payload ID: 12811 relates to Category No.: 12648, 6020, 7386, 7385; Payload ID: 12814 relates to Category No.: 11512, 12648, 7613, 10372, 2940, 11506, 3398, 7965, 5541, 12640, 11033, 13371, 10803, 11949, 11176, 11174, 12936; Payload ID: 12815 relates to Category No.: 795, 4092, 10238, 4257; Payload ID: 12816 relates to Category No.: 795; Payload ID: 12817 relates to Category No.: 10238, 674, 5809, 8524; Payload ID: 12818 relates to Category No.: 12827, 12890, 10269, 13143; Payload ID: 12819 relates to Category No.: 6969, 12827, 7992, 8661, 3900, 12890, 8835, 14927, 10269, 13143; Payload ID: 12821 relates to Category No.: 795, 11765, 4021, 1844, 1749, 4990; Payload ID: 12822 relates to Category No.: 11512, 15517, 7303, 10648, 9408, 8004, 11823, 10652, 4469; Payload ID: 12823 relates to Category No.: 11512, 1722, 795, 1730, 15517, 12891, 14620, 13589, 3398, 15490, 3398; Payload ID: 12824 relates to Category No.: 15517, 11294, 2435, 11512, 11634, 10864, 6219; Payload ID: 12825 relates to Category No.: 8862, 10372, 7710, 10359, 15616, 6102, 1272, 9451, 13835, 12648, 2079, 1295, 2094, 13989, 6323, 14056, 13827, 2006, 6269, 13767, 10238, 14883, 7598, 10383, 11094, 2149, 2139, 4949, 7737, 2235, 3940, 15325, 6375, 13959, 14074, 7939, 5066, 13911, 8009, 8272, 3711, 8281, 14287, 13806, 11376, 8372, 10724; Payload ID: 12826 relates to Category No.: 7291, 16182, 14271, 4439, 12036, 10637; Payload ID: 12827 relates to Category No.: 1026, 14565, 12638, 7306, 14433, 1322, 12523, 8937, 3238, 8938, 13488; Payload ID: 12828 relates to Category No.: 1026, 14432, 14565, 12638, 14433, 1322, 12523, 9786, 14793, 1795, 6191, 8888, 2197, 2224; Payload ID: 12829 relates to Category No.: 1026, 14432, 14565, 12638, 7306, 14433, 1322, 12523, 12285, 5073, 7637, 7553, 8937, 4069, 8938, 10485, 15657; Payload ID: 12830 relates to Category No.: 1026, 14432, 14565, 12638, 14433, 1322, 12523, 8940, 8862, 7251, 4069, 16071, 4506, 718, 15135, 15657, 2754, 11645, 15656, 4068, 2309, 13218; Payload ID: 12831 relates to Category No.: 1026, 14432, 5785, 14565, 10702, 12638, 12648, 1752, 12942, 12746, 8940, 1023, 11187, 7719, 10261, 14433, 8422, 9452, 14434; Payload ID: 12832 relates to Category No.: 14432, 14565, 1295, 12638, 12648, 12942, 8887, 8898, 7719, 13371, 10261, 14433, 13231; Payload ID: 12833 relates to Category No.: 1026, 14432, 14565, 1713, 12648, 7737, 10175, 10558, 8049, 7719, 10261, 14433, 8200; Payload ID: 12834 relates to Category No.: 1026, 14565, 1703, 12638, 14433, 1322, 12523, 14432; Payload ID: 12835 relates to Category No.: 690, 1026, 14432, 14565, 12638, 15140, 12488, 3713, 14433, 1322, 12523, 9480, 11242, 1579, 756, 2705, 9600, 3238; Payload ID: 12836 relates to Category No.: 690, 14883; Payload ID: 12839 relates to Category No.: 5592, 13242; Payload ID: 12840 relates to Category No.: 7018; Payload ID: 12841 relates to Category No.: 7018, 9228, 3354, 14776, 1955, 14779, 13827; Payload ID: 12843 relates to Category No.: 1779; Payload ID: 12844 relates to Category No.: 2459, 1780, 14057; Payload ID: 12845 relates to Category No.: 11930; Payload ID: 12846 relates to Category No.: 1721; Payload ID: 12847 relates to Category No.: 1752, 12650, 1703, 10366, 7719, 7750, 13150, 10381, 4499, 3815, 6145; Payload ID: 12848 relates to Category No.: 6149; Payload ID: 12849 relates to Category No.: 7743, 7737; Payload ID: 12851 relates to Category No.: 1764, 12648, 1767, 10386, 6375, 6406, 14565, 14589, 1780, 6371, 12886, 11808; Payload ID: 12852 relates to Category No.: 13589, 3398, 7306; Payload ID: 12853 relates to Category No.: 1737, 5965, 7158; Payload ID: 12854 relates to Category No.: 5255, 1814, 12994, 450, 5037, 16189, 11078, 1789, 15122, 11077, 15123, 1749; Payload ID: 12856 relates to Category No.: 5367, 14565, 5255, 1703, 14589, 1814, 450, 5037, 16189, 1789, 1749, 14056, 5871, 6117, 1464, 3615, 3116, 1026, 13523; Payload ID: 12857 relates to Category No.: 14565, 5255, 1814, 12994, 14834, 450, 5037, 11078, 1789, 15122, 11077, 15123, 1749, 451, 10784, 4329, 13670, 10957, 2697, 264, 14836, 2940, 4167, 2464, 14830, 1771, 3887; Payload ID: 12858 relates to Category No.: 5255, 1814, 450, 5037, 1789, 1749, 14059, 14589, 1703, 4167, 6117; Payload ID: 12859 relates to Category No.: 5255, 1814, 450, 5037, 16189, 1789, 1749; Payload ID: 12860 relates to Category No.: 12091, 14661, 12619, 12153, 7613, 11237, 8739, 13170, 13166, 9713, 7141, 7154, 7159, 2886, 11588, 1780, 9420, 7132, 670, 11587, 13644, 4336, 2198, 6967, 7163, 7835, 4335, 11176, 11300, 7155, 3900, 13174, 12009, 13342, 11912, 6880, 331, 5253, 4140, 15175; Payload ID: 12861 relates to Category No.: 12091, 7613, 10775, 7168, 12391, 7134, 4332, 13530, 6758, 6323, 12387, 12677, 6299, 7132, 11237, 11242, 7870; Payload ID: 12862 relates to Category No.: 12091, 795, 7613, 8739, 1955, 13996, 7134, 2902, 12743, 4336, 4332, 13998, 12630, 13973, 10861, 11980, 4761, 11238, 3654, 7149; Payload ID: 12863 relates to Category No.: 12091, 2186, 2985, 9420, 15740, 7132, 4336, 10403; Payload ID: 12864 relates to Category No.: 12091, 1737, 7154, 4335, 11094, 1993, 15559, 3020, 12886; Payload ID: 12865 relates to Category No.: 1512, 3354, 1089, 1955, 3119; Payload ID: 12866 relates to Category No.: 11851, 15490, 3398, 8739, 3452, 9296, 1955, 15517, 3354, 3448, 15521, 1089, 1893, 4439, 12120, 2083, 15570, 2009, 7122, 11660, 12666, 9296, 3327, 10324, 12092, 6468, 4485, 9296, 3311, 7036, 12057, 7037, 15257, 3336, 12940, 1114, 2123, 13470, 11512, 11536, 11859, 14577, 3313, 3132, 11385; Payload ID: 12867 relates to Category No.: 11851, 3354, 4039, 1089; Payload ID: 12868 relates to Category No.: 6814, 11851, 8818, 8390, 8004, 8519, 15606, 12092, 11857, 7990, 12705, 8521; Payload ID: 12869 relates to Category No.: 6814, 9165; Payload ID: 12870 relates to Category No.: 6814; Payload ID: 12871 relates to Category No.: 13589, 3398, 15490, 3398; Payload ID: 12872 relates to Category No.: 13589, 3398, 15490, 3398, 6814; Payload ID: 12873 relates to Category No.: 6814, 11851, 3684, 7728, 11291, 362, 11857; Payload ID: 12874 relates to Category No.: 11851, 3354, 3448, 15257, 10518, 13175, 12044; Payload ID: 12875 relates to Category No.: 11851, 15626, 5428, 1894, 1955, 3354, 1727, 13827; Payload ID: 12876 relates to Category No.: 6814; Payload ID: 12877 relates to Category No.: 6814; Payload ID: 12878 relates to Category No.: 1752, 3448, 13423, 6814; Payload ID: 12879 relates to Category No.: 15603, 9224, 4439, 9223, 3001, 7292, 11546; Payload ID: 12880 relates to Category No.: 8765, 14838, 6758, 13618, 13085; Payload ID: 12881 relates to Category No.: 8765; Payload ID: 12882 relates to Category No.: 15588, 13186, 15603, 7291, 16182, 9224, 7287, 1893, 8405, 9103, 4439, 9223, 3001, 11130, 11129, 3001, 7292, 9223, 9103, 11546, 4442; Payload ID: 12883 relates to Category No.: 7287, 9378; Payload ID: 12886 relates to Category No.: 7284; Payload ID: 12887 relates to Category No.: 15588, 14267, 1238, 14199; Payload ID: 12890 relates to Category No.:

15517, 14267, 7291, 16182, 14271, 15291, 4439, 16193, 7187, 7188, 7340, 7261, 10117, 7182; Payload ID: 12892 relates to Category No.: 15517, 7291, 16182, 14271, 7287, 15291, 4439, 7261, 13181, 14217, 14193; Payload ID: 12893 relates to Category No.: 7287, 14217, 14193; Payload ID: 12894 relates to Category No.: 7287, 14217, 14193; Payload ID: 12895 relates to Category No.: 13186, 9228, 9224, 4439, 9223, 3001, 14216, 3994, 4134, 7270, 14214, 9223, 9103; Payload ID: 12897 relates to Category No.: 7291, 16182, 14271, 4439; Payload ID: 12898 relates to Category No.: 11843, 5446, 3021, 7291, 16182, 14271, 4439, 8789, 7860, 7284; Payload ID: 12899 relates to Category No.: 7284; Payload ID: 12902 relates to Category No.: 16308, 9500, 10129, 14663, 1878, 10126, 12281, 10127, 12278, 14843, 14848, 11406; Payload ID: 12903 relates to Category No.: 1737, 13589, 3398, 14661, 15517, 7154, 7132, 2429; Payload ID: 12904 relates to Category No.: 13589, 3398, 15490, 3398, 2411, 7743, 7154, 4949, 10036; Payload ID: 12905 relates to Category No.: 13589, 3398, 15490, 3398, 5134; Payload ID: 12906 relates to Category No.: 15490, 3398, 8739, 1893, 12120, 11660, 5406, 5095, 724, 3613, 2001, 3612, 7618; Payload ID: 12907 relates to Category No.: 13589, 3398, 15490, 3398; Payload ID: 12908 relates to Category No.: 15490, 3398, 11512; Payload ID: 12909 relates to Category No.: 15490, 3398, 8731, 3398; Payload ID: 12910 relates to Category No.: 7613, 10372, 14589, 1836, 2459, 8390, 8524, 5949, 5244, 12832, 13588, 12682, 7756; Payload ID: 12911 relates to Category No.: 5367; Payload ID: 12912 relates to Category No.: 13337, 11512, 1722, 5255, 8888, 1415, 674, 9713, 4949, 1820, 5910, 3143, 9420, 3246, 5949, 2911, 11242, 14883, 5406, 11922, 10467, 1320, 6377, 1622, 6806, 3605, 14643, 1447, 6834, 6830, 10035, 4450, 6810, 6871, 6843, 13713, 14589, 1417, 1240, 6269, 1621, 13846, 12614, 13175, 9068, 3871, 6405, 10486; Payload ID: 12913 relates to Category No.: 1415, 14589, 3143, 3153, 6107, 3176, 4949, 6108; Payload ID: 12914 relates to Category No.: 1415, 3143; Payload ID: 12915 relates to Category No.: 1415, 1651, 5949, 1898, 14457, 3128, 1649; Payload ID: 12916 relates to Category No.: 11512, 1722, 8888, 14740, 1415, 1417, 4949, 7743, 5910, 3143, 2196, 12646, 7997, 3176, 8601, 2911, 4952, 14883, 2082, 13695, 10350, 1971, 10467, 6269, 13718, 11111, 1318, 3177, 6806, 2107, 3605, 12570, 12580, 6860, 6873, 6830, 10035, 10796, 6810, 3153, 6867, 756, 13702, 2003, 6872, 6837, 6838, 6842, 5949, 13713, 10648, 11674, 1836, 10486; Payload ID: 12917 relates to Category No.: 11674, 14740, 1415, 14699, 1651, 3143, 11942, 1898, 14457, 3128; Payload ID: 12918 relates to Category No.: 1415, 3143, 1204; Payload ID: 12919 relates to Category No.: 1415, 3143, 266, 12458; Payload ID: 12920 relates to Category No.: 13589, 3398, 15490, 3398, 13445, 8936, 601, 16182, 15001, 12754, 2460; Payload ID: 12921 relates to Category No.: 7306, 5226, 1893, 12120, 11660, 2110; Payload ID: 12922 relates to Category No.: 7306, 1893, 12120, 11660, 14838; Payload ID: 12923 relates to Category No.: 7306, 1893, 12120, 11660; Payload ID: 12924 relates to Category No.: 3356, 3354, 3852, 15605, 2142; Payload ID: 12925 relates to Category No.: 9296, 3356, 3354, 3852, 15533, 15605, 9296, 3327, 4485, 9296, 3322; Payload ID: 12926 relates to Category No.: 3386, 9228, 3452, 3356, 3354, 5750, 15605, 3304; Payload ID: 12927 relates to Category No.: 3386, 3304, 9228, 3356, 3356, 15183, 15257, 1780, 16197, 7132, 3360, 3453, 6006, 4332, 13612, 3369, 15259, 6100, 15260; Payload ID: 12928 relates to Category No.: 3304, 3356, 15257, 7132, 3360, 4332, 3369, 15259, 15260, 11949, 15606; Payload ID: 12929 relates to Category No.: 3304, 3386, 1955, 3354, 1089, 5428, 5808, 795, 14910, 5242, 8923, 14776, 6403, 14360, 14775, 5380, 496, 13837, 13881, 13856, 1089, 4409, 12300; Payload ID: 12930 relates to Category No.: 3386, 3304, 9228, 3363, 7018, 2139, 9296, 3356, 3354, 14034, 15257, 1089, 14663, 7132, 15533, 15605, 9296, 3327, 3369, 3313, 3132, 4108, 4485, 15259, 15260, 9296, 3322, 3371, 1089, 4409; Payload ID: 12931 relates to Category No.: 7018, 9296, 3356, 3354, 15257, 1089, 7132, 15533, 15605, 9296, 3327, 3369, 3313, 3132, 4485, 15259, 15260, 9296, 3322, 3304, 3386; Payload ID: 12932 relates to Category No.: 3386, 3356, 3354, 3852, 15257, 7132, 3360, 4332, 15259, 15260; Payload ID: 12933 relates to Category No.: 3304, 3356, 5146; Payload ID: 12934 relates to Category No.: 9228, 3356, 15257, 7132, 3360, 4332, 15259, 15260, 9296, 3322, 3371, 1089, 4409, 3304, 3602, 3354; Payload ID: 12935 relates to Category No.: 3356, 3354, 15605, 12774, 3851, 14037, 3371, 11648, 12300, 2142; Payload ID: 12936 relates to Category No.: 3356, 3386, 3304, 3336, 7038, 1089, 4409, 496, 1984, 13921, 13881, 13856; Payload ID: 12937 relates to Category No.: 3386, 3304, 3356, 3354, 9420, 7122, 7038, 5406, 7036, 13755, 7121; Payload ID: 12938 relates to Category No.: 3304, 3354, 9296, 3356, 14776, 3448, 3453; Payload ID: 12939 relates to Category No.: 3304, 3354, 3353, 3448, 3453, 1060, 14776; Payload ID: 12940 relates to Category No.: 11940, 3386, 3304, 3452, 1955, 3356, 3354, 14776, 3448, 1089, 3449, 7898; Payload ID: 12941 relates to Category No.: 3356, 7018, 9296, 3354, 15257, 1089, 7132, 15533, 15605, 9296, 3327, 3369, 3313, 3132, 4485, 15259, 15260, 9296, 3322, 3371; Payload ID: 12942 relates to Category No.: 3356, 7018, 3386, 9296, 3354, 15257, 1089, 7132, 15533, 15605, 9296, 3327, 3369, 3313, 3132, 4485, 15259, 15260, 9296, 3322, 3371; Payload ID: 12943 relates to Category No.: 7121; Payload ID: 12944 relates to Category No.: 10117, 11546; Payload ID: 12945 relates to Category No.: 3304, 5146; Payload ID: 12946 relates to Category No.: 15490, 3398, 15516, 4439, 12891, 3783, 8004, 3783, 15520, 15498, 15290; Payload ID: 12947 relates to Category No.: 15490, 3398, 15516, 4439, 12891, 3783, 8004, 3783, 15520, 15498, 15290, 3566, 14320, 9241; Payload ID: 12948 relates to Category No.: 15490, 3398, 15516, 15518, 5446, 4439, 11573, 12891, 3783, 8004, 3783, 15500, 15292, 15520, 15498, 15290; Payload ID: 12949 relates to Category No.: 15516, 15518, 15490, 3398, 5446, 4439, 11573, 12891, 3783, 8004, 3783, 15500, 15292, 15520, 15498, 15290; Payload ID: 12950 relates to Category No.: 15490, 3398, 15516, 14320, 4439, 12891, 3783, 8004, 3783, 15520, 15498, 15290, 14228; Payload ID: 12951 relates to Category No.: 15490, 3398, 15517, 13969, 2084, 13589, 3398, 15499, 9296, 3354, 7291, 16182, 14271, 15521, 4439, 16197, 182, 15533, 11611, 15490, 14286, 4442, 10031, 14782, 11345; Payload ID: 12952 relates to Category No.: 15490, 3398, 15517, 15499, 9296, 3354, 7291, 16182, 14271, 15521, 4439, 16197, 182, 15533, 11611, 4442, 10031, 14782; Payload ID: 12953 relates to Category No.: 15499, 15490, 3398, 9296, 15517, 3354, 7291, 16182, 14271, 15521, 4439, 16197, 182, 15533, 11611, 4442, 10031, 14782; Payload ID: 12954 relates to Category No.: 15499, 15490, 3398, 9296, 15517, 3354, 7291, 16182, 14271, 15521, 1874, 4439, 16197, 9223, 3001, 7281, 12437, 11550, 182, 15533, 11611, 4442, 10031, 14782; Payload ID: 12955 relates to Category No.: 15499, 15490, 3398, 15516, 15518, 9296, 5446, 15517, 3354, 7291, 16182, 14271, 15521, 4439, 16197, 182, 11573, 12891, 3783, 15533, 11611, 8004, 3783, 15500, 15292, 15520, 15498, 15290, 4442, 10031, 14782; Payload ID: 12956 relates to Category No.: 15499, 15490, 3398, 15516, 15518, 9296, 5446, 15517, 3354, 7291, 16182, 14271, 15521, 4439, 16197, 182, 11573, 12891, 3783, 15533, 11611, 8004, 3783, 15500, 15292, 15520, 15498, 15290, 4442, 10031, 14782; Payload ID: 12957 relates to Category No.: 15499, 15490, 3398, 9296, 15517, 3354, 7291, 16182, 14271, 15521, 4439, 16197, 11130, 11550, 9223, 3994, 182, 15533, 11611, 4442, 10031, 14782, 795; Payload ID: 12958 relates to Category No.: 15499, 15490, 3398, 15516, 15518, 9296, 5446, 15517, 3354, 7291, 16182, 14271, 15521, 4439, 16197, 182, 11573, 12891, 3783, 15533, 11611, 8004, 3783, 15500, 15292, 15520, 15498, 15290, 4442, 10031, 14782; Payload ID: 12959 relates to Category No.: 15499, 15490, 3398, 9296, 15517, 3354, 7291, 16182, 14271, 15521, 4439, 16197, 182, 6511, 15533, 11611, 4442, 10031, 14782; Payload ID: 12960 relates to Category No.: 15499, 15490, 3398, 9296, 15517, 3354, 7291, 16182, 14271, 15521, 4439, 16197, 182, 15533, 11611, 4442, 10031, 14782; Payload ID: 12961 relates to Category No.: 15490, 3398, 15517; Payload ID: 12962 relates to Category No.: 15490, 3398, 15517; Payload ID: 12963 relates to Category No.: 15499, 15490, 3398, 15516, 15518, 9296, 5446, 15517, 3354, 7291, 16182, 14271, 15521, 4439, 16197, 182, 11573, 12891, 3783, 15533, 11611, 8004, 3783, 15500, 15292, 15520, 15498, 15290, 4442, 10031, 14782, 13593; Payload ID: 12964 relates to Category No.: 15499, 15490, 3398, 15516, 15518, 9296, 5446, 15517, 3354, 7291, 16182, 14271, 15521, 4439, 16197, 182, 11573, 12891, 3783, 15533, 11611, 8004, 3783, 15500, 15292, 15520, 15498, 15290, 4442, 10031, 14782, 13593; Payload ID: 12965 relates to Category No.: 14197, 6493; Payload ID: 12966 relates to Category No.: 15490, 3398, 15518, 5446, 3021, 4439, 11573, 13165, 10811, 15500, 15292, 11294; Payload ID: 12967 relates to Category No.: 15490, 3398, 15518, 5446, 3021, 4439, 11573, 10811, 10794, 15500, 15292; Payload ID: 12968 relates to Category No.: 15490, 3398, 15518, 13609, 5446, 3021, 4439, 11573, 10811, 10794, 15500, 15292; Payload ID: 12969 relates to Category No.: 15518, 5446, 3021, 4439, 11573, 10811, 10794, 15500, 15292; Payload ID: 12970 relates to Category No.: 15490, 3398, 15518, 5446, 3021, 4439, 11573, 15500, 15292; Payload ID: 12971 relates to Category No.: 15490, 3398, 13609, 15518, 5446, 3021, 4439, 11573, 10811, 10794, 15500, 15292; Payload ID: 12972 relates to Category No.: 13609, 15522, 15518, 5446, 3021, 1780, 4439, 11573, 10811, 10794, 15500, 15292; Payload ID: 12973 relates to Category No.: 13609, 15522, 15518, 5446, 4439, 11573, 15500, 15292; Payload ID: 12974 relates to Category No.: 15490, 3398, 9232, 15522, 15518, 5446, 3021, 4439, 11573, 15500, 15292; Payload ID: 12975 relates to Category No.: 15490, 3398, 15518, 5446, 3021, 4439, 11573, 15500, 15292; Payload ID: 12976 relates to Category No.: 15490, 3398, 9420, 4439, 7122, 15515, 15519; Payload ID: 12977 relates to Category No.: 13589, 3398, 15516, 4439, 15520, 15290; Payload ID: 12978 relates to Category No.: 3125, 12405, 3775, 14057, 5390, 4125; Payload ID: 12979 relates to Category No.: 3301, 13975, 3386, 9228, 13996, 3100, 3354, 1089, 9289, 3313, 3132, 10139, 9296, 3312; Payload ID: 12980 relates to Category No.: 9324, 1893, 11660, 12068, 12069, 12070; Payload ID: 12981 relates to Category No.: 9324, 1893, 11660, 12068; Payload ID: 12982 relates to Category No.: 2460, 9324, 1893, 3176, 11660, 12068, 9123, 9124, 13257, 12070, 6814; Payload ID: 12983 relates to Category No.: 9324, 1893, 11660, 12068; Payload ID: 12984 relates to Category No.: 9324, 1893, 11660, 12068; Payload ID: 12985 relates to Category No.: 9324, 1893, 11660, 12068; Payload ID: 12986 relates to Category No.: 9324, 1893, 11660, 12068, 11930; Payload ID: 12987 relates to Category No.: 11930; Payload ID: 12988 relates to Category No.: 11930; Payload ID: 12989 relates to Category No.: 9324, 1893, 11660, 12068, 5378, 12069, 12070; Payload ID: 12990 relates to Category No.: 1512, 9324, 1893, 11660, 12068, 12069, 12070; Payload ID: 12991 relates to Category No.: 1512, 9324, 1893, 11660, 12068; Payload ID: 12992 relates to Category No.: 4721, 9324, 1893, 11660, 12068; Payload ID: 12993 relates to Category No.: 9324, 1893, 11660, 12068; Payload ID: 12994 relates to Category No.: 1512, 9324, 1893, 11660, 12068, 11930; Payload ID: 12995 relates to Category No.: 9324, 1893, 11660, 12068, 15618, 11940, 5848; Payload ID: 12996 relates to Category No.: 9324, 1893, 11660, 12068, 11930; Payload ID: 12997 relates to Category No.: 14834, 6814; Payload ID: 12998 relates to Category No.: 11930; Payload ID: 12999 relates to Category No.: 7288, 7291, 16182, 14271, 4439, 12484, 16182, 8335, 16182, 8594, 8341, 601, 16182; Payload ID: 13000 relates to Category No.: 7288, 8594, 7290, 13222, 14883, 2235; Payload ID: 13001 relates to Category No.: 7288, 674, 14271, 8594, 3856, 8335, 16182, 12628; Payload ID: 13002 relates to Category No.: 11940, 14267, 11046, 14216, 3994, 2012, 2083, 7270, 14199, 12676, 7121, 8042, 11942, 7133, 12668, 14217, 9196, 14312, 7101, 7064, 11023, 7100, 7102, 14204, 7065, 11009; Payload ID: 13003 relates to Category No.: 1204; Payload ID: 13004 relates to Category No.: 7288, 13589, 3398, 15490, 3398, 795, 14271; Payload ID: 13005 relates to Category No.: 1204; Payload ID: 13006 relates to Category No.: 15618, 12137, 1512, 2885, 15715, 1893, 14663, 4439, 16197, 16193, 7132, 7295, 12120, 7187, 7188, 11660, 1995, 4442, 7155, 5048, 12914, 4541, 16201, 12671; Payload ID: 13011 relates to Category No.: 14216, 3656, 15715, 15694, 14267, 14216, 4439, 15700; Payload ID: 13012 relates to Category No.: 14216, 3656, 14318, 15715, 7273, 4439, 14216; Payload ID: 13013 relates to Category No.: 14216, 3656, 15715, 4439, 14211; Payload ID: 13014 relates to Category No.: 14216, 3656, 15715, 4439; Payload ID: 13015 relates to Category No.: 1204, 13126, 12953, 14604; Payload ID: 13016 relates to Category No.: 1204, 13126; Payload ID: 13017 relates to Category No.: 16286, 11995, 12073, 1483, 4715; Payload ID: 13018 relates to Category No.: 15317, 9708; Payload ID: 13019 relates to Category No.: 5782, 2775, 1893, 980, 4798, 11660, 7391, 3604, 722, 4260, 4946, 14456, 4797, 9228; Payload ID: 13020 relates to Category No.: 12137, 4797, 1955, 5809, 5808, 14571, 8177; Payload ID: 13021 relates to Category No.: 4797, 4798; Payload ID: 13022 relates to Category No.: 6814; Payload ID: 13023 relates to Category No.: 11940, 7862; Payload ID: 13024 relates to Category No.: 11674, 15149, 11676, 1238, 3121, 13796; Payload ID: 13025 relates to Category No.: 11674, 15149, 11676, 325, 13659, 8946, 1238, 3121; Payload ID: 13026 relates to Category No.: 11674, 15149, 325, 11676, 8946, 9815, 1238, 3121; Payload ID: 13027 relates to Category No.: 11674, 15149, 325, 11676, 13659, 8946, 1238, 3121, 13238; Payload ID: 13028 relates to Category No.: 15490, 3398, 11940, 8731, 3398; Payload ID: 13029 relates to Category No.: 11940, 11843, 12153; Payload ID: 13030 relates to Category No.: 11940, 1721, 12153, 12936, 1730, 12646, 11091, 8639, 8862, 8368; Payload ID: 13031 relates to Category No.: 11940; Payload ID: 13032 relates to Category No.: 11940, 11843, 12153, 1752, 3356, 15000, 8584, 10522; Payload ID: 13033 relates to Category No.: 11940; Payload ID: 13034 relates to Category No.: 11940, 7306; Payload ID: 13035 relates to Category No.: 11940, 12931; Payload ID: 13036 relates to Category No.: 11940, 11843, 1779, 3667, 10439; Payload ID: 13037 relates to Category No.: 11940; Payload ID: 13038 relates to Category No.: 11940; Payload ID: 13039 relates to Category No.: 11940; Payload ID: 13040 relates to Category No.: 11940, 11201; Payload ID: 13041 relates to Category No.: 11940; Payload ID: 13042 relates to Category No.: 11940; Payload ID: 13043 relates to Category No.: 11940; Payload ID: 13044 relates to Category No.: 11940, 16197; Payload ID: 13045 relates to Category No.: 11940; Payload ID: 13046 relates to Category No.: 11940; Payload ID: 13047 relates to Category No.: 11940, 12931; Payload ID: 13048 relates to Category No.: 11940; Payload ID: 13049 relates to Category No.: 11674, 15149, 11676; Payload ID: 13050 relates to Category No.: 11674, 15149, 11676, 13328, 5848; Payload ID: 13051 relates to Category No.: 11674, 11676, 15149, 11294; Payload ID: 13052 relates to Category No.: 11674, 15149, 1417, 11676, 3012, 11461, 14936, 5376, 1797, 14357, 11290, 9949, 710, 11667; Payload ID: 13053 relates to Category No.: 15618, 11674, 11676, 5848, 13041, 15149, 10238, 13126, 13882, 1238, 13973, 13796, 1884, 7749, 13800, 6993, 14694, 11940, 14357, 484, 2469, 14456, 8946, 12482, 16102, 986, 6295, 1751, 8920, 4056, 13690; Payload ID: 13054 relates to Category No.: 13041, 15149, 11676, 11670, 3973, 5949, 11634, 1598, 15425, 13711, 12930, 7613, 13988, 2048; Payload ID: 13055 relates to Category No.: 13041, 15149, 11676, 11670, 16214, 11669, 13126, 484, 2174, 13084, 9349, 4580, 13427; Payload ID: 13056 relates to Category No.: 15618, 13041, 11674, 15149, 13126, 11676, 13785, 11670, 14663, 8911, 4538, 13004, 13827, 8118, 3728, 13835, 1984, 13909, 2136, 14022, 2069, 10334; Payload ID: 13057 relates to Category No.: 13041, 15149, 11676, 11670, 7340, 11941, 12948; Payload ID: 13058 relates to Category No.: 13041, 11676, 11670; Payload ID: 13059 relates to Category No.: 13041, 15149, 11676, 11670; Payload ID: 13060 relates to Category No.: 13041, 11670, 11676, 15149; Payload ID: 13061 relates to Category No.: 13041, 11670, 15149, 11676, 1885; Payload ID: 13062 relates to Category No.: 13041, 11674, 11676; Payload ID: 13063 relates to Category No.: 11674, 15149, 11676, 11670, 13127, 11941, 12954, 13427, 13688, 1553, 6727, 1884, 13686, 6751, 6749, 13478, 6482, 1552, 2051, 12953, 12591, 11220; Payload ID: 13064 relates to Category No.: 13041, 15149, 11676, 11670, 13829; Payload ID: 13065 relates to Category No.: 13041, 15149, 11676, 11670, 2051; Payload ID: 13066 relates to Category No.: 13041, 15149, 11676, 11670; Payload ID: 13067 relates to Category No.: 13041, 15149, 11676, 11670; Payload ID: 13068 relates to Category No.: 13041, 15149, 11676, 11670, 13925, 13840, 3021, 4949, 16102, 5949, 13983; Payload ID: 13069 relates to Category No.: 13041, 15149, 11676, 11670; Payload ID: 13070 relates to Category No.: 11674, 11676; Payload ID: 13071 relates to Category No.: 11674, 11676; Payload ID: 13072 relates to Category No.: 15618, 11674, 5848, 13041, 11676, 14586, 14840, 7304; Payload ID: 13073 relates to Category No.: 11674, 14740, 15149, 11676, 14936, 13427, 13961; Payload ID: 13074 relates to Category No.: 13041, 11674, 15626, 14565, 15149, 14936, 6758; Payload ID: 13075 relates to Category No.: 13041, 11674, 14936; Payload ID: 13076 relates to Category No.: 13041, 11674, 15149, 14936; Payload ID: 13077 relates to Category No.: 13041, 11674, 14936; Payload ID: 13078 relates to Category No.: 13041, 11674, 15149, 11676, 14936; Payload ID: 13079 relates to Category No.: 13041, 11674, 15149, 11676, 14936; Payload ID: 13080 relates to Category No.: 15149, 11676, 14936, 11667, 2090; Payload ID: 13081 relates to Category No.: 11674, 14936, 15149, 13126, 4828, 11676, 13936, 2006, 6758, 2547, 10356, 13787, 1583, 7701, 7880, 10397; Payload ID: 13082 relates to Category No.: 11674, 5846, 15149, 11676, 14936, 7131, 1295, 13827, 2006, 2547, 7855, 2156; Payload ID: 13083 relates to Category No.: 11674, 14936, 13041, 14454, 15149, 11676, 14460, 2051, 1969, 1900, 2124, 3148, 6758; Payload ID: 13084 relates to Category No.: 13041, 11674, 11676, 14936, 3973, 1885; Payload ID: 13085 relates to Category No.: 13041, 11674, 15149, 11676, 14936, 13541, 13427, 8676; Payload ID: 13086 relates to Category No.: 13041, 11674, 15149, 11676, 14936; Payload ID: 13087 relates to Category No.: 11674, 15149, 11676, 14936, 1885; Payload ID: 13088 relates to Category No.: 15618, 13041, 11674, 15149, 14569, 13126, 11676, 7385, 5848, 12646, 9966, 5846, 1922, 14940; Payload ID: 13089 relates to Category No.: 15618, 11674, 15149, 6724, 14569, 13126, 5848, 11669, 13127, 13328, 9966, 12954, 1957, 1562, 11220, 13664, 6751, 11667, 16129, 6749, 11668, 8487, 12956, 8486; Payload ID: 13090 relates to Category No.: 15618, 13041, 11674, 15149, 14569, 13126, 11676, 5848, 9966; Payload ID: 13091 relates to Category No.: 15618, 13041, 11674, 15149, 14569, 13126, 11676, 5848, 9966; Payload ID: 13092 relates to Category No.: 15618, 13041, 11674, 15149, 14569, 13126, 5848, 9966, 12887; Payload ID: 13093 relates to Category No.: 15618, 13041, 11674, 15149, 13126, 5848, 12954; Payload ID: 13094 relates to Category No.: 15618, 13041, 11674, 15149, 13126, 5848; Payload ID: 13095 relates to Category No.: 15618, 13041, 11674, 15149, 14569, 13126, 5848, 9966; Payload ID: 13096 relates to Category No.: 15618, 11674, 5848, 14456, 15149, 1925, 13127, 12954, 12948, 1957, 10491, 1562, 11220, 13664, 10710, 12514, 10322, 6751, 11667, 16129, 6749, 963, 1961, 11668, 12892, 4440, 1598; Payload ID: 13097 relates to Category No.: 11674, 15618, 5848; Payload ID: 13098 relates to Category No.: 1026, 15618, 13041, 11674, 15149, 11676, 5848, 6734; Payload ID: 13099 relates to Category No.: 15618, 13041, 11674, 15149, 11676, 5848, 5459, 14456, 8672, 3436; Payload ID: 13100 relates to Category No.: 15618, 13041, 11674, 15149, 5848, 11884, 11676; Payload ID: 13101 relates to Category No.: 15618, 13041, 11940, 11674, 15149, 11676, 5848; Payload ID: 13102 relates to Category No.: 15618, 11940, 11674, 15149, 11676, 5848, 12752, 13041; Payload ID: 13103 relates to Category No.: 15618, 13041, 11940, 11674, 15149, 11676, 5848, 14663, 13004, 12948, 3728; Payload ID: 13104 relates to Category No.: 15618, 13041, 11940, 11674, 15149, 5848; Payload ID: 13105 relates to Category No.: 15618, 13041, 11940, 11674, 15149, 5848; Payload ID: 13106 relates to Category No.: 15618, 13041, 11940, 11674, 15149, 11676, 5848; Payload ID: 13107 relates to Category No.: 15618, 13041, 11940, 11674, 15149, 5848; Payload ID: 13108 relates to Category No.: 15618, 13041, 11940, 11674, 16159, 15149, 325, 11676, 5848, 10303, 14663, 11293, 4579, 13004, 8118, 3728, 4535, 2077, 1984, 12129, 10332, 11124, 12470, 10921, 13180; Payload ID: 13109 relates to Category No.: 15618, 13041, 11940, 11674, 15149, 11676, 5848, 13491, 12129; Payload ID: 13110 relates to Category No.: 15618, 13041, 11940, 11674, 15149, 13126, 11676, 13194, 8946, 5848, 8919, 2048, 1716, 8953, 6479, 3146, 3148, 14940, 1295, 5073, 8898, 1892; Payload ID: 13111 relates to Category No.: 15618, 13041, 11940, 11674, 15149, 11676, 5848; Payload ID: 13112 relates to Category No.: 15618, 13041, 11940, 11674, 14454, 15149, 11676, 8946, 5848, 12781, 12718, 9102, 9398; Payload ID: 13113 relates to Category No.: 15618, 13041, 11940, 11674, 15149, 11676, 5848; Payload ID: 13114 relates to Category No.: 15618, 13041, 11940, 11674, 15149, 11676, 5848; Payload ID: 13115 relates to Category No.: 15618, 11940, 11674, 15149, 13126, 11676, 5848, 13004, 13330, 12954, 12514, 6734, 11667, 963, 6750, 6752, 13659, 9125, 8489, 13882, 13936, 13970, 13877, 13881, 11669, 7855, 12066, 10637, 11064; Payload ID: 13116 relates to Category No.: 15618, 13041, 11940, 11674, 15149, 5848; Payload ID: 13117 relates to Category No.: 13041, 11940, 11674, 15149, 15618, 5848; Payload ID: 13118 relates to Category No.: 15618, 13041, 11940, 11674, 15149, 325, 5848, 2006, 8946, 6295, 14454; Payload ID: 13119 relates to Category No.: 15618, 13041, 11940, 15149, 11676, 5848, 6748, 11667, 1918; Payload ID: 13120 relates to Category No.: 15618, 11940, 11674, 15149, 12133, 11676, 5848, 1295, 14025, 1957, 13041, 13772, 13988, 2235, 13845, 10868, 13786, 13920, 13959, 13328, 11220, 4489; Payload ID: 13121 relates to Category No.: 15618, 11940, 11674, 15149, 5848, 11934, 14663, 13004, 3728, 2070, 9058, 325, 13969, 14025, 5846, 13837, 1907, 13932, 13772, 2130, 13920, 13959, 11220, 4489; Payload ID: 13122 relates to Category No.: 15618, 13041, 11940, 11674, 5848, 15149, 12133, 13238; Payload ID: 13123 relates to Category No.: 15618, 13041, 11940, 11674, 15149, 11676, 5848, 13238; Payload ID: 13124 relates to Category No.: 11674, 9500, 15149, 11676, 13328, 12752, 6103, 13329, 1295, 14636, 7381, 4949, 7862, 3228, 15618; Payload ID: 13125 relates to Category No.: 11674, 9500, 15149, 11676, 13328, 13364, 7518, 4969, 8919; Payload ID: 13126 relates to Category No.: 13041, 11674, 15149, 11676; Payload ID: 13127 relates to Category No.: 11674, 14456, 5848, 12062, 1925, 13328, 12068, 12954, 8543, 11220, 1553, 13664, 6748, 6751, 11667, 16129, 6749, 12752, 7862; Payload ID: 13128 relates to Category No.: 11674, 11236, 5848, 11670, 13127, 13328, 12954, 1957, 1553, 13664, 6748, 11667, 16129, 6749, 12752, 7862, 13039, 496, 15459, 11615, 8826, 12731; Payload ID: 13129 relates to Category No.: 11674, 5848, 13127, 13328, 7862, 13330, 11615, 8826; Payload ID: 13130 relates to Category No.: 13041, 11674, 5848; Payload ID: 13131 relates to Category No.: 11674, 13127, 13328, 12954, 12948, 1562, 11220, 13664, 12514, 6751, 11667, 16129, 963, 8487, 12607; Payload ID: 13132 relates to Category No.: 15618, 13041, 11940, 11674, 15149, 11676, 5848; Payload ID: 13133 relates to Category No.: 15618, 11940, 11674, 15149, 11676, 5848, 12752; Payload ID: 13134 relates to Category No.: 15618, 11940, 11674, 15149, 11676, 5848, 12752; Payload ID: 13135 relates to Category No.: 15618, 13041, 11940, 11674, 15149, 11676, 5848, 14663, 13004, 3728; Payload ID: 13141 relates to Category No.: 14057, 15042; Payload ID: 13142 relates to Category No.: 14057; Payload ID: 13145 relates to Category No.: 14057; Payload ID: 13146 relates to Category No.: 14057; Payload ID: 13148 relates to Category No.: 13589, 3398, 11512, 7743, 11506, 3398, 15517, 1060, 11051, 10372, 10034, 1744, 3167, 13006, 14789, 10798, 14788, 8739, 414, 9221, 15490, 3398; Payload ID: 13149 relates to Category No.: 13589, 3398, 15517, 5285; Payload ID: 13150 relates to Category No.: 13589, 3398, 15518, 8731, 3398, 4439, 6271, 15490, 3398; Payload ID: 13151 relates to Category No.: 13589, 3398, 5285, 15490, 3398, 15517, 11512, 11506, 3398, 1751, 5387, 5388, 6638; Payload ID: 13152 relates to Category No.: 13594, 13589, 3398, 11512, 15517, 3781, 7560, 16294, 5939; Payload ID: 13153 relates to Category No.: 13594, 13589, 3398, 15490, 3398, 1295, 11506, 3398, 10648, 1022, 4251, 7369, 3781, 5939, 14385, 7370; Payload ID: 13154 relates to Category No.: 13594, 13589, 3398, 1295, 10372, 15517, 11512, 8004, 11051, 8929, 2250, 12526, 3781, 907, 14385, 12628, 2080, 7370, 5332, 8908, 4261; Payload ID: 13155 relates to Category No.: 13594, 13589, 3398, 15490, 3398, 1295, 7613, 10372, 8731, 3398, 11506, 3398, 2169, 10648, 6830, 6856, 6874, 6855, 6839, 11512, 5949, 2250, 4261; Payload ID: 13156 relates to Category No.: 13594, 13589, 3398, 1295, 2548, 8276, 14456, 5458, 4257, 15517; Payload ID: 13157 relates to Category No.: 13589, 3398, 11512, 8739, 15140, 1048, 8373, 8932, 15655, 9742, 14464, 5465, 15517, 10238, 13225, 7613, 10350, 8929, 6795, 15067, 8862, 2177, 4931, 16135, 1754, 9743, 11799, 8735; Payload ID: 13158 relates to Category No.: 1026, 13589, 3398, 11512, 8739, 8929, 15517, 6606, 14056, 5773, 10358, 14069, 1048, 14456, 8920, 1023, 14838; Payload ID: 13159 relates to Category No.: 13589, 3398, 11512, 15517, 16214, 13594, 14069, 5459, 14456, 986, 8920, 8923, 5458, 1023, 16177, 5461; Payload ID: 13160 relates to Category No.: 13589, 3398, 11512, 8739, 15517, 674, 12891, 13140, 14050, 14782, 10333, 1227, 11385, 8005, 7294, 1259, 3646, 1543, 12507, 1742, 12950; Payload ID: 13161 relates to Category No.: 13589, 3398, 15490, 3398; Payload ID: 13162 relates to Category No.: 13589, 3398, 15490, 3398, 1295, 4949, 7345; Payload ID: 13163 relates to Category No.: 13589, 3398, 15517, 16214, 2169, 4396, 15490, 3398; Payload ID: 13164 relates to Category No.: 13589, 3398, 15490, 3398; Payload ID: 13165 relates to Category No.: 13589, 3398, 8731, 3398, 15517, 11512, 12891, 11506, 3398, 6530, 14838, 15194; Payload ID: 13166 relates to Category No.: 14162, 4828; Payload ID: 13167 relates to Category No.: 13589, 3398, 15490, 3398, 13953; Payload ID: 13169 relates to Category No.: 6456; Payload ID: 13171 relates to Category No.: 6281, 1094, 833, 6426, 621, 831; Payload ID: 13173 relates to Category No.: 3405; Payload ID: 13174 relates to Category No.: 15490, 3398, 8739, 1851, 6902, 12646, 4059, 5406, 11634, 4956, 16136, 10648, 1741, 8004, 4458, 7644, 8222, 1579, 756, 2705, 7238, 10265, 3605, 860, 6625, 5754, 15740, 14393; Payload ID: 13175 relates to Category No.: 13589, 3398, 15490, 3398, 6902; Payload ID: 13176 relates to Category No.: 13589, 3398, 15490, 3398, 6902; Payload ID: 13177 relates to Category No.: 13594, 8906, 15490, 3398, 6902; Payload ID: 13178 relates to Category No.: 8906, 15490, 3398, 8739, 5203; Payload ID: 13179 relates to Category No.: 15490, 3398, 14782, 8739, 14949, 4464, 12891, 3783, 5243, 12891, 3566, 7986, 4167, 4458, 1764, 1744, 5452, 5173, 12772, 5410; Payload ID: 13180 relates to Category No.: 13589, 3398, 15490, 3398, 6902; Payload ID: 13181 relates to Category No.: 13589, 3398, 15490, 3398, 8739, 8731, 3398, 11506, 3398, 8756, 2410, 8041, 1334, 12668, 14949, 14782, 15459, 9540, 8906, 16279, 10293; Payload ID: 13182 relates to Category No.: 13589, 3398, 15490, 3398, 5202, 3167, 13835; Payload ID: 13183 relates to Category No.: 13589, 3398, 14565, 15517, 1780, 8988, 7724, 5192, 7735, 1993, 2076; Payload ID: 13184 relates to Category No.: 15490, 3398, 8739, 8731, 3398, 5113, 7132, 5166; Payload ID: 13185 relates to Category No.: 15490, 3398, 5202, 8731, 3398, 8906, 8634; Payload ID: 13186 relates to Category No.: 13589, 3398, 5202; Payload ID: 13187 relates to Category No.: 15490, 3398, 8731, 3398, 8906, 5203, 2178, 2709, 5166, 2721; Payload ID: 13188 relates to Category No.: 13589, 3398, 15490, 3398, 6683, 2410, 11317, 11512, 14838, 5159, 5202, 5203, 10969; Payload ID: 13189 relates to Category No.: 12137, 6171; Payload ID: 13190 relates to Category No.: 12153, 11878; Payload ID: 13191 relates to Category No.: 13359, 12153, 5072, 6322; Payload ID: 13192 relates to Category No.: 7613, 10372, 7730, 8731, 3398, 8582; Payload ID: 13193 relates to Category No.: 7613, 10372, 7730, 8731, 3398, 8582; Payload ID: 13194 relates to Category No.: 7613, 10372, 7730, 8731, 3398, 8582; Payload ID: 13195 relates to Category No.: 7613, 10372, 7730, 8731, 3398, 8582; Payload ID: 13196 relates to Category No.: 7613, 10372, 7730, 8731, 3398, 8582; Payload ID: 13197 relates to Category No.: 7613, 10372, 7730, 8731, 3398, 8582; Payload ID: 13198 relates to Category No.: 7613, 10372, 7730, 8731, 3398, 8582; Payload ID: 13199 relates to Category No.: 7613, 10372, 7730, 8731, 3398, 8582; Payload ID: 13200 relates to Category No.: 7613, 10372, 7730, 8731, 3398, 8582; Payload ID: 13201 relates to Category No.: 7613, 10372, 7730, 8731, 3398, 8582; Payload ID: 13202 relates to Category No.: 7613, 10372, 7730, 8731, 3398, 8582; Payload ID: 13203 relates to Category No.: 7613, 10372, 7730, 8731, 3398, 8582; Payload ID: 13204 relates to Category No.: 7613, 10372, 7730, 8731, 3398, 8582; Payload ID: 13205 relates to Category No.: 7613, 10372, 7730, 8731, 3398, 8582; Payload ID: 13206 relates to Category No.: 7613, 10372, 7730, 8731, 3398, 8582; Payload ID: 13207 relates to Category No.: 7613, 10372, 7730, 8731, 3398, 8582; Payload ID: 13208 relates to Category No.: 7613, 10372, 7730, 8731, 3398, 8582; Payload ID: 13209 relates to Category No.: 7613, 10372, 7730, 8731, 3398, 8582; Payload ID: 13210 relates to Category No.: 7613, 10372, 7730, 8731, 3398, 8582; Payload ID: 13211 relates to Category No.: 7613, 10372, 7730, 8731, 3398, 8582; Payload ID: 13212 relates to Category No.: 7613, 10372, 7730, 8731, 3398, 8582; Payload ID: 13213 relates to Category No.: 7613, 10372, 7730, 8731, 3398, 8582; Payload ID: 13214 relates to Category No.: 7613, 10372, 7730, 8731, 3398, 8582; Payload ID: 13215 relates to Category No.: 7613, 10372, 7730, 8731, 3398, 8582; Payload ID: 13217 relates to Category No.: 5367, 5382; Payload ID: 13218 relates to Category No.: 5367, 5382; Payload ID: 13219 relates to Category No.: 13589, 3398, 14533, 14962, 8611, 14782, 15517, 12646, 11512, 16023, 724, 8375, 472, 1318, 9410, 10372, 14910, 15400, 3592, 3595, 3602, 3612, 13276, 12213, 10638; Payload ID: 13220 relates to Category No.: 13589, 3398, 15490, 3398; Payload ID: 13221 relates to Category No.: 13589, 3398, 719, 11642, 15517, 11512, 483, 8928, 13756, 3441, 13417; Payload ID: 13222 relates to Category No.: 13589, 3398, 15517, 11506, 3398; Payload ID: 13223 relates to Category No.: 1730, 8731, 3398, 7306; Payload ID: 13224 relates to Category No.: 15490, 3398, 795, 1730, 7613, 10372, 7730, 8731, 3398, 8582, 12936; Payload ID: 13225 relates to Category No.: 13589, 3398, 11926, 1721, 1893, 2994; Payload ID: 13226 relates to Category No.: 11926, 1893, 2994, 10485; Payload ID: 13227 relates to Category No.: 11926, 1893, 2994; Payload ID: 13228 relates to Category No.: 13589, 3398, 11926, 8731, 3398, 7693, 1893, 2994, 14056; Payload ID: 13229 relates to Category No.: 11926, 1893, 2275, 2994; Payload ID: 13230 relates to Category No.: 4145; Payload ID: 13231 relates to Category No.: 4145; Payload ID: 13232 relates to Category No.: 1752, 4145; Payload ID: 13233 relates to Category No.: 3012, 4145; Payload ID: 13234 relates to Category No.: 4145; Payload ID: 13235 relates to Category No.: 4145; Payload ID: 13236 relates to Category No.: 4145; Payload ID: 13239 relates to Category No.: 4145; Payload ID: 13240 relates to Category No.: 12091; Payload ID: 13241 relates to Category No.: 12194, 1893, 4145; Payload ID: 13242 relates to Category No.: 7912, 4145; Payload ID: 13243 relates to Category No.: 5367, 795, 7613, 9950, 7306, 11448, 13161, 10545, 8567, 13124, 11199, 8312, 13557, 10395; Payload ID: 13244 relates to Category No.: 9950; Payload ID: 13245 relates to Category No.: 9950, 11294; Payload ID: 13246 relates to Category No.: 9950; Payload ID: 13248 relates to Category No.: 6713, 6697; Payload ID: 13249 relates to Category No.: 7288, 14271, 4445, 9211; Payload ID: 13250 relates to Category No.: 12153, 9296, 3354, 7291, 16182, 14271, 12096, 14918, 4439, 3453, 14913, 1892, 11969, 4444, 15533, 11830, 14573, 8375, 10248, 11049, 16182, 5453, 6211; Payload ID: 13251 relates to Category No.: 7288, 7291, 16182, 14271, 14918, 14271, 16183; Payload ID: 13252 relates to Category No.: 7291, 16182, 14918; Payload ID: 13253 relates to Category No.: 7288, 14271; Payload ID: 13254 relates to Category No.: 7288, 14271; Payload ID: 13255 relates to Category No.: 14267, 7266; Payload ID: 13256 relates to Category No.: 14267, 7291, 16182, 14271, 4439, 14271, 16183; Payload ID: 13257 relates to Category No.: 12091, 7291, 16182, 14271; Payload ID: 13258 relates to Category No.: 11512, 14267, 7291, 16182, 14271, 14918, 4439, 14913, 14271, 16183, 14210; Payload ID: 13259 relates to Category No.: 7288, 7291, 16182, 14271, 14918, 4439, 14271, 16183; Payload ID: 13260 relates to Category No.: 5898, 15883, 14663, 11935; Payload ID: 13261 relates to Category No.: 5898, 15883, 14663, 12552, 11935; Payload ID: 13262 relates to Category No.: 9500, 11708, 11706, 11709, 2331, 2329; Payload ID: 13263 relates to Category No.: 9500, 11708, 11706; Payload ID: 13264 relates to Category No.: 8962, 15149, 14565, 14449, 4145; Payload ID: 13265 relates to Category No.: 12194, 5785, 1483, 1149, 14684, 10331, 7613, 1415, 12099, 11506, 3398, 14589, 13313, 4020, 4021, 10501, 9123, 6739, 3667, 664, 8739, 2243, 11237, 11930, 11634, 8934, 8535, 1955, 10238, 13975, 998, 1002, 6103, 4952, 8929, 14793, 15400, 12137, 15186, 1240, 4949, 8928, 1836, 4251, 15207, 13532, 4588, 13342, 13530, 1295, 8923, 348, 6758, 11265, 9125, 14641, 4969, 3801, 2242, 7640, 1744, 7112, 8906, 8548, 3444, 3595, 11285, 8798, 8522, 10954, 6171, 1296, 7618, 12049, 11315, 7377, 6293, 10444, 7378, 12819, 1893, 7934, 14645, 13427, 2367, 15165, 1379, 1148, 14418, 8373, 8886; Payload ID: 13266 relates to Category No.: 12194, 7613, 1417, 1149, 10331, 1026, 5785, 3766, 10238, 803, 12099, 9125, 8988, 9123, 6739, 6740, 664, 4937, 8535, 6103, 1562, 7967, 14793, 8507, 15400, 12137, 15186, 4251, 15207, 13342, 13530, 8509, 6758, 4969, 1744, 3444, 3595, 6371, 1296, 7618, 12049, 6293, 10444, 7378, 12819, 3667, 1893, 13882; Payload ID: 13267 relates to Category No.: 12194, 12099, 13386, 13379, 13397, 6741, 13165, 8567, 8175; Payload ID: 13268 relates to Category No.: 10331, 1026, 3766, 10238, 803, 12099, 9125, 8988, 9123, 6739, 6740, 664; Payload ID: 13269 relates to Category No.: 11947, 12127, 1893, 9451, 7631; Payload ID: 13271 relates to Category No.: 11237, 8731, 3398, 11949, 7693, 11298, 8887, 7700, 756, 2705; Payload ID: 13272 relates to Category No.: 8936, 3926; Payload ID: 13273 relates to Category No.: 1204; Payload ID: 13274 relates to Category No.: 1204; Payload ID: 13275 relates to Category No.: 1779, 10887, 12645; Payload ID: 13276 relates to Category No.: 3356, 14034, 3356, 15183, 13729, 7038, 15605; Payload ID: 13277 relates to Category No.: 3356, 15183, 15257, 7132, 3360, 4332, 3369, 15259, 15260; Payload ID: 13278 relates to Category No.: 3356, 15183, 15257, 7132, 3360, 4332, 3369, 15259, 15260; Payload ID: 13279 relates to Category No.: 1026, 6814, 11940, 1722, 13975, 8129, 7571, 8145, 8535, 8611, 1847, 8149, 8689, 7673, 1939, 7613, 1957, 13363, 13328, 13794, 13813, 6103; Payload ID: 13281 relates to Category No.: 11940, 1847; Payload ID: 13282 relates to Category No.: 15490, 3398, 795, 8739, 10238, 280, 10222, 803, 7644, 8688, 8689, 5661, 13835, 13925, 14050, 2014, 11089, 11105, 1964, 13907, 3146, 10905, 7675, 10195, 11200, 3161, 10732, 2150, 1974, 333, 11321, 11096, 1411; Payload ID: 13283 relates to Category No.: 13714, 8522, 8468, 7834; Payload ID: 13284 relates to Category No.: 795, 10238, 13376, 8503; Payload ID: 13285 relates to Category No.: 7306, 11169, 12194; Payload ID: 13286 relates to Category No.: 11169; Payload ID: 13287 relates to Category No.: 9500, 1894, 3781, 13882, 4021, 5315, 2000, 9689; Payload ID: 13288 relates to Category No.: 9500, 1894, 13882, 4021, 7131, 2000; Payload ID:

13289 relates to Category No.: 9500, 1894, 4021, 5406, 3782, 2571, 16102, 11997, 8888, 3714, 6384, 1091, 2000; Payload ID: 13290 relates to Category No.: 8962, 15149; Payload ID: 13291 relates to Category No.: 8962, 14565, 14940, 6296, 1112, 14454, 495, 13835, 13925, 2131, 13882, 14025, 13834, 496, 13796, 13837, 2149, 13951, 13996, 13961, 9455, 2083, 1925, 6297, 4480, 10271, 4443, 1113, 2145; Payload ID: 13292 relates to Category No.: 10074, 274, 10192, 1238, 12117, 7567, 10080, 10250, 10573, 8661, 7565, 11348, 10190, 13594, 8887; Payload ID: 13293 relates to Category No.: 274, 10192, 12117, 7567, 10250, 11174, 11418, 7938, 10190, 8600, 13535; Payload ID: 13294 relates to Category No.: 274, 12465, 10190; Payload ID: 13295 relates to Category No.: 14475; Payload ID: 13296 relates to Category No.: 12194, 3244, 11878, 10231; Payload ID: 13297 relates to Category No.: 15626, 795, 7306, 10833, 10852, 10692; Payload ID: 13298 relates to Category No.: 7162, 9099, 10826, 8141, 7153, 12008, 8358, 340, 8499, 8794, 11585; Payload ID: 13299 relates to Category No.: 13589, 3398, 11512, 14565, 14967, 1816, 15521, 4439, 8004, 12824, 6559, 9569, 6371, 9492, 3795, 11763, 15295, 15490, 3398; Payload ID: 13301 relates to Category No.: 14967; Payload ID: 13302 relates to Category No.: 1026, 14661, 5446, 6606, 348, 4186, 12391, 4127, 3775, 5541, 16085, 8988, 8535, 8378, 8446, 8255, 12021; Payload ID: 13305 relates to Category No.: 7306, 9379; Payload ID: 13307 relates to Category No.: 14967, 7306, 9379, 14011; Payload ID: 13308 relates to Category No.: 14967, 14011, 7306, 9379; Payload ID: 13309 relates to Category No.: 14565, 795, 7306, 5285, 11448, 15192, 10238, 7613, 8719; Payload ID: 13310 relates to Category No.: 5367, 8129, 7571, 8138, 15192, 11460, 8688; Payload ID: 13311 relates to Category No.: 690, 7613, 10372, 10366, 10648, 12117, 10954, 11125, 11291, 11174, 8004, 11419, 5811, 13877, 3881, 4767, 16294, 14926, 7738, 7660; Payload ID: 13312 relates to Category No.: 7288, 14318, 14267; Payload ID: 13313 relates to Category No.: 334, 795, 10238, 12957, 10718, 11765; Payload ID: 13314 relates to Category No.: 1721; Payload ID: 13315 relates to Category No.: 795, 8731, 3398, 8193, 7724, 1709, 7613, 11387, 13367; Payload ID: 13316 relates to Category No.: 10238, 7743, 10648, 11322, 2131, 10470, 11258, 7783; Payload ID: 13317 relates to Category No.: 12194, 690, 5782, 803, 8728, 10558, 8524, 1995, 8805, 10470, 10557, 10226, 13796, 16087, 334, 795; Payload ID: 13318 relates to Category No.: 12137, 795, 16197, 16193, 10595, 10596, 12682, 1791, 16186, 15902, 12852; Payload ID: 13319 relates to Category No.: 795, 7291, 16182, 14271, 4439, 13859, 10241, 11448; Payload ID: 13320 relates to Category No.: 16214, 14014; Payload ID: 13321 relates to Category No.: 13589, 3398, 14565, 8739, 8731, 3398, 12498, 7743, 11506, 3398, 7946, 5113, 7735, 12117, 7122, 10583, 8018, 8508, 8732, 9455, 7597, 11763, 10687, 2021, 10451, 3304; Payload ID: 13322 relates to Category No.: 15490, 3398, 7613, 8731, 3398, 14612, 12117, 7122, 11363, 10583, 8611, 11949, 15606, 10592, 10352, 8169, 6553, 6555, 8254, 12558; Payload ID: 13323 relates to Category No.: 690, 10372, 345, 10359, 12488, 2469; Payload ID: 13324 relates to Category No.: 4828, 690, 5428, 7613, 8962, 14454, 10372, 345, 14838, 1780, 2311, 11392, 12488, 10486, 2469; Payload ID: 13325 relates to Category No.: 4828, 8962, 1795, 2469, 7613; Payload ID: 13326 relates to Category No.: 4828, 8962, 1795, 2469; Payload ID: 13327 relates to Category No.: 1795, 1780, 1893, 10877, 4145, 5911, 13189, 5998; Payload ID: 13328 relates to Category No.: 7613, 1795, 3566, 14962, 15185, 5911, 341, 364, 5998, 5910, 6561, 6553, 12614, 12821, 6563, 11823, 11771; Payload ID: 13329 relates to Category No.: 13589, 3398, 15490, 3398, 12137, 3684, 3833, 12063, 2669, 1893, 6738, 11660, 5855; Payload ID: 13330 relates to Category No.: 13888, 13824, 13981, 13860, 4094, 6219, 15425, 13189, 3728, 3529, 995, 4828, 4132, 12447; Payload ID: 13331 relates to Category No.: 4828, 8962, 1795, 4132, 4145, 5263; Payload ID: 13332 relates to Category No.: 12194, 15618, 3125, 10648, 14057, 8680, 12995; Payload ID: 13333 relates to Category No.: 7018, 2139, 9296, 3354, 3852, 15257, 1780, 1089, 12775, 7132, 4332, 10521, 15533, 3791, 13612, 15605, 10522, 9296, 3327, 3369, 3313, 3132, 4485, 15259, 6100, 15260, 9296, 3322, 3851, 10505, 13794, 4949, 13923; Payload ID: 13334 relates to Category No.: 13589, 3398, 15490, 3398, 14318, 1722, 1721, 7613, 8731, 3398, 1780, 13618, 10358, 6814; Payload ID: 13338 relates to Category No.: 9500, 11774, 14663, 1878, 11777, 5814, 11775, 147; Payload ID: 13339 relates to Category No.: 9500, 11774, 11775; Payload ID: 13340 relates to Category No.: 12619; Payload ID: 13342 relates to Category No.: 13589, 3398, 15490, 3398; Payload ID: 13345 relates to Category No.: 7306; Payload ID: 13347 relates to Category No.: 11546, 10378; Payload ID: 13373 relates to Category No.: 16214, 14057; Payload ID: 13374 relates to Category No.: 1721, 11285, 11187; Payload ID: 13375 relates to Category No.: 8617, 8535, 12879, 15467, 11285, 11187; Payload ID: 13377 relates to Category No.: 5939, 9632; Payload ID: 13380 relates to Category No.: 1204; Payload ID: 13381 relates to Category No.: 1204; Payload ID: 13382 relates to Category No.: 8971, 3883; Payload ID: 13383 relates to Category No.: 7912, 14057, 13459; Payload ID: 13385 relates to Category No.: 1204; Payload ID: 13386 relates to Category No.: 1965, 15490, 3398, 11512; Payload ID: 13387 relates to Category No.: 1512, 14640, 14663, 4723, 5930, 5932, 5931, 1709; Payload ID: 13389 relates to Category No.: 1737, 11506, 3398, 7735, 6967, 7153, 10466, 11008, 13175, 1886; Payload ID: 13395 relates to Category No.: 4969; Payload ID: 13396 relates to Category No.: 13589, 3398, 15490, 3398; Payload ID: 13397 relates to Category No.: 13589, 3398, 15490, 3398, 3002, 9223, 9103; Payload ID: 13399 relates to Category No.: 1204; Payload ID: 13400 relates to Category No.: 1204, 3015; Payload ID: 13404 relates to Category No.: 13790; Payload ID: 13405 relates to Category No.: 13790, 8921; Payload ID: 13408 relates to Category No.: 3639, 1752, 14565, 5428, 1703, 5446, 9292, 6125; Payload ID: 13409 relates to Category No.: 1752, 2940; Payload ID: 13410 relates to Category No.: 11926, 9500, 2276, 7743, 1269, 4021, 9702, 12117, 13373, 8485, 2572, 11943, 1746, 2571, 13276; Payload ID: 13411 relates to Category No.: 9500, 7743, 4021, 9702, 2572; Payload ID: 13412 relates to Category No.: 9500, 7743, 4021, 9702; Payload ID: 13413 relates to Category No.: 15174; Payload ID: 13414 relates to Category No.: 9500, 9702, 2571, 9704; Payload ID: 13415 relates to Category No.: 9500, 9704, 9702; Payload ID: 13416 relates to Category No.: 9500, 9702; Payload ID: 13417 relates to Category No.: 12194, 11926, 1790, 6253, 14663, 4021, 13831, 13283, 11606, 13998, 2006, 9704, 6814; Payload ID: 13418 relates to Category No.: 9500, 12833; Payload ID: 13419 relates to Category No.: 12194; Payload ID: 13420 relates to Category No.: 12194; Payload ID: 13421 relates to Category No.: 12194, 1238, 1238, 5825, 4535, 13397, 692, 3727, 13580, 10050, 8676; Payload ID: 13422 relates to Category No.: 4439, 15698, 11784; Payload ID: 13423 relates to Category No.: 1730, 8962, 15149, 7306, 14838, 4132; Payload ID: 13424 relates to Category No.: 9994, 4500, 14058, 14059, 1465, 4498, 11083; Payload ID: 13425 relates to Category No.: 12942, 11285, 8470, 7714, 10371; Payload ID: 13426 relates to Category No.: 13589, 3398, 15490, 3398, 11843, 1722, 795, 10737, 5808, 2885, 5446, 8731, 3398, 2467, 3021, 13818, 7743, 5809, 11884, 1893, 7735, 7598, 16197, 3313, 14567, 13882, 12120, 12117, 11660, 12122, 8692, 5610, 3743, 8318, 10491, 13371, 12717, 2158, 10600, 8820, 3667, 6508, 10105, 12574, 8696, 8761, 10240, 8548, 12785, 10626, 2020, 334, 10241, 1741, 4194, 7372, 15570, 4039, 5807, 14083, 13856, 2607, 14655, 14034, 5814, 12614, 1313, 5810, 1709, 8136, 8134, 13141; Payload ID: 13427 relates to Category No.: 11512, 14565, 8962, 1816, 12544, 1893, 12500, 9637, 8782, 4448, 1882, 4535, 12922, 12726; Payload ID: 13428 relates to Category No.: 13589, 3398, 2169, 8739, 15517, 11512, 3445, 1752, 7613, 9410, 1240, 1483, 4468, 414, 5332, 5331, 14789; Payload ID: 13429 relates to Category No.: 4100, 1867, 14663, 16234, 16275, 1210, 14541, 6814, 4997; Payload ID: 13430 relates to Category No.: 4100, 1867, 14663, 16234, 16275, 1210, 14541, 6814, 4104; Payload ID: 13431 relates to Category No.: 4828, 5367, 5428, 1713, 2303, 10074, 4539, 3013, 10359, 12646, 13925, 1238, 10902, 10080, 4541, 6147; Payload ID: 13432 relates to Category No.: 12194, 6814, 1816, 12099, 1893, 13004, 9637, 9630; Payload ID: 13433 relates to Category No.: 7912, 8962, 13824, 13812, 9637; Payload ID: 13434 relates to Category No.: 12194, 1893, 5537, 3733, 5881, 12099, 8862, 9637, 11859; Payload ID: 13435 relates to Category No.: 12194, 12099, 4167, 14817, 266, 1202; Payload ID: 13436 relates to Category No.: 12194, 14558, 1816, 4949, 12099, 16193, 8988, 3566, 9637, 5949, 6194, 724, 3612, 8856, 3576, 9630, 2876, 13759, 13726, 3176, 1579, 2705; Payload ID: 13437 relates to Category No.: 12194, 12099, 8988, 9637, 4715, 8856, 8857, 14404, 12551, 3176, 16340, 3563; Payload ID: 13438 relates to Category No.: 12194, 12099, 9637; Payload ID: 13439 relates to Category No.: 12194, 8906, 795, 11089, 8929, 2009, 13227, 11313, 2353, 5949, 6442, 11859, 6269, 2116, 13398, 8644, 10925, 8229, 8555, 8561, 6339, 2355, 9945, 15664, 6253, 6342, 13088, 12099; Payload ID: 13440 relates to Category No.: 6219, 6227, 10331, 10074, 14865, 14663, 439, 1238, 10080, 13071, 4729, 11823, 3793, 10955, 13105, 3194, 2080, 8095; Payload ID: 13441 relates to Category No.: 6219, 10331, 14865, 439, 13071, 4729, 11823, 3793; Payload ID: 13442 relates to Category No.: 15490, 3398, 11512, 8888, 1295, 8739, 8929, 10372, 8731, 3398, 7743, 11506, 3398, 12891, 5019, 8818, 10558, 3070, 3608, 9342, 5949, 8611, 14059, 8954, 10557, 1557, 12717, 16133, 16137, 10349, 14635, 6269, 2222, 6375, 10466, 6111, 966, 11351, 7652, 16119, 10708, 13614, 6115, 6406, 3626, 6407, 11084, 9554, 16134, 758, 3441, 9464, 9400, 10631, 2469, 5458, 6117, 1743, 6404, 5024, 3711, 5017, 1315, 253, 10351, 13967; Payload ID: 13443 relates to Category No.: 15490, 3398, 11512, 8739, 8929, 1557; Payload ID: 13444 relates to Category No.: 4828, 5428, 6538, 14646, 420, 2099; Payload ID: 13445 relates to Category No.: 4828, 5367, 8962, 15149, 1451, 2311, 4828, 2745, 439, 10687, 8252; Payload ID: 13446 relates to Category No.: 6219, 15626, 2835, 14663, 12718, 14646, 815, 11802, 8252, 13859; Payload ID: 13447 relates to Category No.: 4828, 13925; Payload ID: 13448 relates to Category No.: 4828, 434, 2100, 12646, 13925, 13989; Payload ID: 13449 relates to Category No.: 4828, 15490, 3398, 1727, 5783, 10618, 1204, 13925, 10486, 1181, 4169, 442, 9932, 11591, 13835, 2041, 2014, 13989, 13827, 10442, 9102, 11285, 3111, 4145, 10648, 8400, 12718, 16268, 13256, 5761, 16020, 7688, 10309, 12409, 11601, 8118, 6627, 8002, 8477, 8487, 14002, 7677, 10279, 8003, 11393, 1975, 10792, 7811, 16268, 11065, 10450, 10645, 11810, 11105, 7994; Payload ID: 13450 relates to Category No.: 4828, 5367, 442, 1269, 8112, 5912, 13515, 10790, 13936, 3846, 2051, 7847, 10478, 15336, 8121, 7930, 13925, 13276, 1984, 13969, 10343, 2014, 2100, 11390, 13989, 10372, 13827, 10442, 9102, 13773, 11285, 4145, 10648, 12718, 16268, 10309, 6627, 14002, 11105, 11147, 8442, 8094, 8782, 10855, 13991, 11591, 11325, 7811, 13697, 2304, 11582, 11146, 10289, 8132, 11290, 8395, 11050, 13893, 11623, 3493, 10766, 7901, 8631, 10297, 10418, 11424, 10965, 8783, 7925, 11424, 8968, 14049, 11153, 10235, 10827; Payload ID: 13451 relates to Category No.: 14565, 2835, 14663, 815, 11808, 11802, 7743, 13969, 13925, 13796, 14000, 13818, 2431, 379; Payload ID: 13452 relates to Category No.: 9500, 1790, 11802, 11506, 3398, 14403; Payload ID: 13453 relates to Category No.: 14565, 2835, 15257, 14663, 815, 1995, 11802, 14280, 12671, 2272, 14643, 1780, 6387, 4685, 4518; Payload ID: 13455 relates to Category No.: 4828, 10372, 1453, 9590, 2099, 10648, 13925, 7613, 13835; Payload ID: 13456 relates to Category No.: 6223; Payload ID: 13457 relates to Category No.: 4828, 10702, 1816, 434, 1238, 4828, 2745, 10313, 8478, 10309, 8636, 13925; Payload ID: 13458 relates to Category No.: 16308, 9500, 803, 2835, 7476, 14663, 8390, 8112, 2014, 815, 16234, 16275, 11802, 2006, 10226, 10591, 8392, 2021, 5345, 9026, 11181, 3566, 3010; Payload ID: 13459 relates to Category No.: 9500, 2835, 14663, 815, 6154, 6262, 14025; Payload ID: 13460 relates to Category No.: 9500, 11808; Payload ID: 13461 relates to Category No.: 6219, 16308, 9500, 5428, 13975, 12544, 2835, 14663, 815, 11802, 12646, 11808, 496, 13971, 13815, 8400, 11601, 14454, 6758, 11392, 6102, 13843, 7935, 6485; Payload ID: 13462 relates to Category No.: 9500, 13975, 12999, 12544, 2835, 7476, 14663, 815, 11808, 11541, 7252, 16234, 16275, 11802, 2006, 6263, 11111, 10368, 11595, 10293, 10618, 9026, 11230, 10623, 11211, 12646, 3566, 3010, 1971, 1334, 13835, 5428, 13969, 13925, 13859, 10372, 13827, 13971, 13927, 10238, 11391, 2051, 13970, 7743, 11601, 9489, 13818, 2139, 8638, 14454, 6758, 13996, 13934, 13852, 11392, 11436, 4588, 6102, 14029, 8672, 3436, 13843, 690, 7724, 10356, 14045, 1272, 11108, 6485, 1912, 11435, 4934, 7679; Payload ID: 13467 relates to Category No.: 14050, 7191; Payload ID: 13468 relates to Category No.: 11465; Payload ID: 13472 relates to Category No.: 687, 8756, 15570, 8439, 8628; Payload ID: 13473 relates to Category No.: 13589, 3398, 15490, 3398; Payload ID: 13474 relates to Category No.: 1730, 7306, 14838, 3345, 2422; Payload ID: 13475 relates to Category No.: 1730, 7306, 14838, 3345, 2422; Payload ID: 13476 relates to Category No.: 1730, 7306, 14838, 1204, 2422, 14831; Payload ID: 13477 relates to Category No.: 12194; Payload ID: 13478 relates to Category No.: 12194; Payload ID: 13479 relates to Category No.: 12194, 3244, 14663, 4020, 4021, 2540, 16234, 16275; Payload ID: 13480 relates to Category No.: 12194, 12427, 3986, 16342; Payload ID: 13481 relates to Category No.: 12194, 11878; Payload ID: 13482 relates to Category No.: 12194, 5446, 3244, 4020, 4021, 2569, 10362, 10343; Payload ID: 13483 relates to Category No.: 12194; Payload ID: 13484 relates to Category No.: 12194; Payload ID: 13485 relates to Category No.: 12194; Payload ID: 13486 relates to Category No.: 12194, 5446, 3244, 14663, 2540, 16234, 16275, 3713, 16342; Payload ID: 13487 relates to Category No.: 12194; Payload ID: 13488 relates to Category No.: 12194; Payload ID: 13489 relates to Category No.: 12194; Payload ID: 13490 relates to Category No.: 12194, 1752, 1202, 12049; Payload ID: 13491 relates to Category No.: 12194; Payload ID: 13492 relates to Category No.: 12194, 14838, 4458; Payload ID: 13493 relates to Category No.: 12194; Payload ID: 13494 relates to Category No.: 12194; Payload ID: 13495 relates to Category No.: 12194; Payload ID: 13496 relates to Category No.: 12194; Payload ID: 13497 relates to Category No.: 12194; Payload ID: 13498 relates to Category No.: 12194; Payload ID: 13499 relates to Category No.: 12194; Payload ID: 13500 relates to Category No.: 12194, 1463; Payload ID: 13501 relates to Category No.: 12194; Payload ID: 13502 relates to Category No.: 12194; Payload ID: 13503 relates to Category No.: 12194, 11399; Payload ID: 13505 relates to Category No.: 16197; Payload ID: 13506 relates to Category No.: 11834, 11838, 2223; Payload ID: 13507 relates to Category No.: 11834, 7613, 12619, 7163; Payload ID: 13510 relates to Category No.: 1026, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314; Payload ID: 13511 relates to Category No.: 1026, 14661, 15207, 795, 13186, 7613, 5446, 3837, 6606, 348, 9038, 12498, 746, 4186, 10129, 11344, 11236, 12096, 12391, 11878, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13512 relates to Category No.: 3837, 11344, 11236, 1026, 15898, 14661, 15207, 795, 13186, 7613, 5446, 6606, 348, 9038, 12498, 746, 4186, 10129, 12096, 12391, 11878, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 9455; Payload ID: 13513 relates to Category No.: 3837, 11344, 11236, 11878, 1026, 14661, 15207, 795, 13186, 7613, 5446, 6606, 348, 9038, 12498, 746, 4186, 10129, 12096, 12391, 7693, 4127, 8408, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 1227; Payload ID: 13514 relates to Category No.: 12194, 1026, 14661, 15207, 795, 13186, 7613, 5446, 3837, 6606, 348, 9038, 12498, 746, 4186, 10129, 11344, 11236, 12096, 12391, 11878, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 1227; Payload ID: 13515 relates to Category No.: 3837, 11344, 11236, 1026, 14661, 11843, 15207, 795, 13186, 7613, 5446, 15517, 6606, 348, 9038, 12498, 746, 11506, 3398, 4186, 10129, 12096, 12391, 11878, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 8496, 8731, 3398, 10789; Payload ID: 13516 relates to Category No.: 3837, 11344, 11236, 11878, 10789, 1026, 15898, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13517 relates to Category No.: 1026, 14661, 11843, 15207, 795, 13186, 7613, 5446, 6606, 348, 9038, 12498, 13343, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 12603; Payload ID: 13518 relates to Category No.: 1026, 14661, 15207, 795, 13186, 7613, 11237, 8739, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 8390, 11298, 4332, 11840, 10362, 8797, 8256, 7883, 14566, 8567, 10466, 2909; Payload ID: 13519 relates to Category No.: 1026, 15898, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 11834, 14944, 8797; Payload ID: 13520 relates to Category No.: 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13521 relates to Category No.: 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 11834, 8797, 6668; Payload ID: 13522 relates to Category No.: 1026, 15898, 14661, 13337, 15207, 795, 13186, 7613, 3452, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 3453, 4332, 8797, 10545, 11968, 13837; Payload ID: 13523 relates to Category No.: 1026, 14661, 11843, 15207, 795, 13186, 7613, 5446, 6606, 348, 9038, 12498, 13343, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13524 relates to Category No.: 1026, 15898, 14661, 15207, 795, 13186, 7613, 5446, 6606, 348, 9038, 12498, 13343, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13525 relates to Category No.: 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 11834, 8797, 15898; Payload ID: 13526 relates to Category No.: 11834, 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 11840, 8797; Payload ID: 13527 relates to Category No.: 12194, 1026, 14661, 11843, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13528 relates to Category No.: 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13529 relates to Category No.: 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 11834, 13376, 8797, 11294, 12194; Payload ID: 13530 relates to Category No.: 1026, 15898, 14661, 15207, 795, 13186, 7613, 5446, 6606, 348, 9038, 12498, 746, 11506, 3398, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 11840, 8797, 10801, 8118; Payload ID: 13531 relates to Category No.: 1026, 14661, 13337, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 10545, 741; Payload ID: 13532 relates to Category No.: 1026, 14661, 13337, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 10545; Payload ID: 13533 relates to Category No.: 1026, 14661, 13337, 15207, 795, 13186, 7613, 5446, 6606, 348, 9038, 12498, 746, 4186, 10129, 12096, 7965, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 10545; Payload ID: 13534 relates to Category No.: 1026, 14661, 15207, 795, 13186, 7613, 5446, 1955, 6606, 348, 9038, 12498, 11831, 3354, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 14838, 3969, 11169; Payload ID: 13535 relates to Category No.: 1026, 15898, 14661, 15207, 795, 7912, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 8502; Payload ID: 13536 relates to Category No.: 11834; Payload ID: 13537 relates to Category No.: 1026, 15898, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13538 relates to Category No.: 1026, 15898, 14661, 11843, 15207, 14038, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13539 relates to Category No.: 1026, 15898, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13540 relates to Category No.: 11843, 12195, 11831, 1026, 15898, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13541 relates to Category No.: 1026, 15898, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13542 relates to Category No.: 1026, 14661, 11843, 15207, 795, 13186, 7613, 12195, 5446, 6606, 348, 9038, 11109, 12498, 11831, 746, 4186, 10129, 12999, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 15898; Payload ID: 13543 relates to Category No.: 11843, 12195, 11831, 1026, 15898, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13544 relates to Category No.: 1026, 15898, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314; Payload ID: 13545 relates to Category No.: 1026, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13546 relates to Category No.: 1026, 14661, 11843, 15207, 795, 13186, 7613, 12195, 5446, 6606, 348, 9038, 12498, 11831, 746, 5285, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 1764, 15203; Payload ID: 13547 relates to Category No.: 1026, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 13969, 13971; Payload ID: 13548 relates to Category No.: 1026, 14661, 15207, 795, 13186, 7613, 12195, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13549 relates to Category No.: 1026, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 8113; Payload ID: 13550 relates to Category No.: 11843, 12195, 11831, 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 13975; Payload ID: 13551 relates to Category No.: 1026, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797; Payload ID: 13552 relates to Category No.: 1026, 14661, 11843, 15207, 795, 13186, 7613, 12195, 5446, 6606, 348, 9038, 12498, 11831, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 11294; Payload ID: 13553 relates to Category No.: 11843, 12195, 11831, 1026, 14661, 15207, 795, 2885, 13186, 7613, 5446, 6606, 348, 9038, 12498, 746, 4186, 10129, 12096, 12391, 7693, 4127, 4094, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 15817, 736; Payload ID: 13554 relates to Category No.: 11843, 12195, 11831, 1026, 14661, 15207, 795, 13186, 7613, 5446, 6606, 348, 9038, 12498, 746, 4186, 10129, 12096, 12391, 7693, 4127, 3775, 11765, 14663, 4439, 16197, 7132, 14992, 742, 15223, 12654, 3313, 14567, 5541, 670, 15782, 1878, 742, 16085, 8988, 11587, 13644, 10314, 4332, 8797, 2014, 13827, 6269, 1959, 13770, 14910, 15400, 2145, 7329, 13789; Payload ID: 13555 relates to Category No.: 15257, 3320, 15254, 11468, 8692, 15261, 11465, 10714, 8696, 15255, 10523; Payload ID: 13556 relates to Category No.: 13589, 3398, 9660, 15433, 12053, 1795, 2410, 8936, 5192, 9660, 10719, 10586, 11163, 8266, 5203; Payload ID: 13557 relates to Category No.: 14565, 8731, 3398, 10238, 11506, 3398, 9660, 15433, 5104, 12053, 7997, 8390, 3193, 12487, 5203; Payload ID: 13558 relates to Category No.: 13589, 3398, 9660, 15433, 5104, 12053, 8547; Payload ID: 13559 relates to Category No.: 13589, 3398, 15490, 3398, 2467, 5104, 12053, 14915, 13171, 1780, 2410, 8408, 4439, 3705, 9661, 5192, 4768, 9660, 9660, 15434, 7546, 6271, 12772, 7730, 12832, 11138; Payload ID: 13560 relates to Category No.: 15490, 3398, 8731, 3398, 9660, 15433, 12053, 2410, 1089, 16197, 5192, 5203, 5171, 8739, 1746, 2158; Payload ID: 13561 relates to Category No.: 13589, 3398, 9660, 15433, 5104, 12053, 15490, 3398, 1730, 14915, 2410, 9661, 9660, 9660, 15434, 3339, 13342, 12892, 5203, 9662, 5192; Payload ID: 13562 relates to Category No.: 13589, 3398, 9660, 15433, 5104, 12053, 5192, 9660, 13342, 5203; Payload ID: 13563 relates to Category No.: 12053; Payload ID: 13564 relates to Category No.: 4439, 3996, 9223, 3001, 3000, 2904; Payload ID: 13565 relates to Category No.: 8760, 3000, 2904; Payload ID: 13566 relates to Category No.: 12194, 7613, 1893, 8112, 1238, 7814, 11660, 6145, 9674, 10587, 7657; Payload ID: 13567 relates to Category No.: 5367, 1238, 7814, 6145; Payload ID: 13568 relates to Category No.: 11926, 9500, 1790, 9702, 13831, 11927, 13283, 12103; Payload ID: 13569 relates to Category No.: 12194, 11926, 9500, 14565, 1790, 746, 11949, 12063, 1893, 742, 15223, 742, 13831, 11927, 11660, 12103, 10600, 6814, 4632; Payload ID: 13570 relates to Category No.: 6814, 11926, 1790, 2276, 12105, 13831; Payload ID: 13571 relates to Category No.: 11926, 9500, 1790, 3684, 1893, 13831, 5855; Payload ID: 13572 relates to Category No.: 11926, 1790, 3684, 1893, 13831, 5855; Payload ID: 13573 relates to Category No.: 6814, 11926, 1790, 7306, 1752, 14834; Payload ID: 13574 relates to Category No.: 11928, 10372, 8395, 13818, 10349; Payload ID: 13575 relates to Category No.: 15490, 3398, 2885, 11237, 687, 11506, 3398, 5910, 12646, 1893, 12120, 11660, 5610, 13012, 11292, 8739, 4094, 6814; Payload ID: 13576 relates to Category No.: 687, 11506, 3398, 1893, 12120, 11660, 8611, 7597, 13594, 11512, 15490, 3398, 13277, 6814; Payload ID: 13577 relates to Category No.: 6814, 13589, 3398, 15490, 3398, 8542, 12120, 11292, 13874, 10648, 10977; Payload ID: 13578 relates to Category No.: 15490, 3398, 3452, 16286, 8731, 3398, 3354, 3448, 1893, 12120, 3453, 11660, 11292, 10880, 8739, 8390, 8785, 10866; Payload ID: 13579 relates to Category No.: 6212; Payload ID: 13580 relates to Category No.: 12504, 12405, 11313, 13530, 12091, 15149, 11987, 1983, 14098, 4771, 7210, 7623, 3339, 4474, 6299, 3062, 3058, 1949, 3338, 8950, 12122; Payload ID: 13581 relates to Category No.: 8522, 7834, 7691, 8739, 7710, 12887, 8519; Payload ID: 13582 relates to Category No.: 8522, 7834, 7691; Payload ID: 13583 relates to Category No.: 8522, 7834, 7691, 8739, 8519, 14565; Payload ID: 13584 relates to Category No.: 2940, 12798, 8940, 12026, 15156, 3910, 10493, 6754, 7908; Payload ID: 13585 relates to Category No.: 12798, 274, 1660, 1778, 1662, 12020, 6754, 7908; Payload ID: 13586 relates to Category No.: 3639, 2940, 12798, 10978, 7679, 7908, 6754; Payload ID: 13587 relates to Category No.: 11926, 5785, 5446, 9020, 12063, 1893, 11660, 5406, 8378, 13713, 6269, 9068, 11934; Payload ID: 13588 relates to Category No.: 5785, 12091, 690, 14565, 13186, 1703, 10074, 15149, 5446, 803, 4186, 7581, 328, 10366, 3775, 14663, 4439, 7132, 16085, 8988, 4021, 1238, 10558, 13004, 3114, 13320, 10583, 13893, 10343, 3728, 10005, 16211, 8007, 10557, 14111, 13437, 11027, 7155, 355, 10226, 10324, 10917, 10283, 10947, 5180, 10504, 8535, 7743, 1836, 8023, 8117, 5407, 13194, 9000, 13293, 11285, 8522, 2376, 10790, 13571, 9709, 5806, 5424, 1927; Payload ID: 13589 relates to Category No.: 12091, 13594, 15490, 3398, 5785, 14565, 795, 1070, 10074, 15149, 403, 11109, 10775, 7132, 16085, 6256, 1238, 8117, 1053, 7155, 10226, 8025, 11596, 5180, 10267, 1417, 1836, 13882, 1927; Payload ID: 13590 relates to Category No.: 12091, 5785, 14565, 1713, 9720, 795, 1721, 2885, 13186, 10074, 5446, 12459, 4186, 3013, 4130, 3775, 11765, 4439, 14992, 16085, 8988, 8112, 1238, 7991, 12117, 8117, 7567, 11331, 11248, 1844, 11259, 8007, 8996, 5610, 8507, 9716, 2158, 355, 5814, 8255, 10404, 5221, 11429, 13398, 15293, 8477, 8449, 10544, 2002, 11197, 10670, 11408, 5381, 10241, 1066, 5627, 5638; Payload ID: 13591 relates to Category No.: 2467, 10583, 8524, 2711, 7980; Payload ID: 13592 relates to Category No.: 12091, 1737, 5785, 14565, 795, 1721, 1703, 10074, 5446, 9713, 4186, 10481, 4130, 3775, 8988, 10192, 1238, 6248, 10573, 355, 8644, 11623, 10625, 15486, 10389, 10955, 13695, 6297, 10775, 13005, 10801, 11050, 13071, 13293, 8547, 10383, 11436, 4342, 2006, 13408, 6460, 13951, 11308, 1966, 2100, 10911; Payload ID: 13593 relates to Category No.: 12091, 5785, 14565, 10074, 11109, 1238, 12538, 8007, 10946, 10881, 10267, 10652, 11986; Payload ID: 13594 relates to Category No.: 5785, 12091, 9982, 14565, 10074, 15149, 5446, 4186, 8373, 3775, 8988, 13422, 1238, 8508, 8547, 12717, 355, 14123, 11011, 13951, 13978, 8502, 5465, 13299, 2310, 11858, 6103, 14015; Payload ID: 13595 relates to Category No.: 12091, 5785, 7613, 16172, 2940, 11109, 12126, 3926, 8373, 1183, 1814, 6738, 8988, 2009, 8007, 10588, 11094, 10666, 1749, 10552, 10652, 14403, 4059, 286, 3867, 13893, 13981, 1752, 1892, 4781; Payload ID: 13596 relates to Category No.: 12091, 1026, 13589, 3398, 5785, 15207, 5428, 1713, 795, 12153, 10074, 5446, 12633, 11109, 4127, 11765, 1238, 8117, 13320, 10845, 1844, 10005, 16211, 6739, 14111, 13437, 11445, 10835, 8680, 11483, 11484, 11460, 10839, 13969, 13882, 496, 13867, 13888, 13860, 11418, 11290, 12887, 8929, 13659, 10628, 15427, 11108, 13746; Payload ID: 13597 relates to Category No.: 12091, 5785, 14565, 5428, 10074, 11109, 9713, 3871, 16085, 1238, 15570, 8117, 10583, 10845, 10833, 10827, 8509, 10590, 6323, 10800, 11486, 8449, 10849, 11485, 12041, 6969, 8937, 1795, 7613, 11934, 10372, 10666, 11436, 6322, 1752, 275, 2009, 5541, 16170, 356, 1892, 6723, 11295, 6734, 10382, 361, 8099, 11986; Payload ID: 13598 relates to Category No.: 12091, 690, 11512, 5785, 14565, 5428, 795, 5446, 7728, 11109, 9713, 5592, 14865, 4785, 10775, 1780, 14663, 16085, 2083, 14862, 10558, 4766, 11858, 10459, 11174, 11147, 10557, 2143, 13009, 11094, 10226, 10283, 10554, 10553, 10736, 7908, 13053, 11990, 13408; Payload ID: 13599 relates to Category No.: 12091, 690, 11512, 5785, 15207, 1703, 403, 11109, 9713, 1727, 11461, 16085, 10558, 11858, 11363, 10459, 11174, 10583, 10855, 10343, 7131, 10557, 2143, 10862, 10840, 10226, 10514, 10283, 11596, 10554, 10553, 10736, 3719, 11990, 10624; Payload ID: 13600 relates to Category No.: 12091, 5785, 11987; Payload ID: 13601 relates to Category No.: 12091, 12137, 9720, 1730, 11858, 9540, 10287, 6371, 3576, 8037, 10429, 7303, 14640, 1272, 6194; Payload ID: 13602 relates to Category No.: 12091, 13594, 15490, 3398, 14661, 14565, 344, 5177, 12642, 3798, 8535, 14910, 1055, 1061, 8522, 7644, 13714, 12898, 12996, 5327; Payload ID: 13603 relates to Category No.: 9982, 14565, 12091, 1737, 13589, 3398, 15490, 3398, 14661, 795, 1721, 1703, 10481, 11607, 11027, 12642, 776, 3798; Payload ID: 13604 relates to Category No.: 12091, 14565, 3798; Payload ID: 13605 relates to Category No.: 12091, 13589, 3398, 5785, 14565, 1722, 7613, 16286, 345, 8728, 5230, 1983, 4104, 6211, 15521, 13856, 10648, 4439, 5541, 13882, 2347, 6451, 10256, 12813, 10682, 12717, 4535, 14123, 8216, 2077, 4108, 10421, 8026, 4538, 13877, 14034, 11382, 4112, 2100, 13292, 13798, 11934, 10372, 2001, 2006, 13767, 13795, 13668, 2081, 1966, 2565, 8024; Payload ID: 13606 relates to Category No.: 12091, 13589, 3398, 5785, 14565, 1722, 7613, 16286, 8728, 5230, 1983, 4104, 6211, 15521, 9420, 1867, 14663, 4439, 6738, 14015, 5541, 7122, 2347, 6451, 10256, 10938, 3728, 12813, 1609, 10682, 12717, 4535, 14123, 12863, 2077, 13095, 4108, 12891, 1957, 13953, 2100; Payload ID: 13607 relates to Category No.: 12091, 14565, 1722, 4104, 15521, 13360, 9420, 10648, 4439, 6738, 5541, 7122, 6451, 11934, 12603; Payload ID: 13608 relates to Category No.: 12091, 14565, 1722, 4104, 15521, 13360, 9420, 1867, 14663, 4439, 6738, 5541, 7122, 6451, 3728, 1609, 12863; Payload ID: 13609 relates to Category No.: 12091, 14565, 1722, 4104, 14838, 15521, 9420, 10648, 4439, 6738, 5541, 7122, 6451, 11265, 12923; Payload ID: 13610 relates to Category No.: 5785, 1722, 4104, 15521, 360, 8541, 9420, 1867, 14663, 4439, 6738, 5541, 4690, 7122, 6451, 8522, 3728, 11265, 1609, 11176, 12923, 12863, 927, 14979, 12865, 12864, 12911, 12091, 12603; Payload ID: 13611 relates to Category No.: 5785, 1722, 4104, 15521, 9420, 4439, 6738, 5541, 7122, 6451, 9982, 4541, 4685, 12091; Payload ID: 13612 relates to Category No.: 12091, 15618, 13337, 5785, 14565, 1512, 5446, 9713, 4186, 4521, 9420, 3775, 2945, 14663, 7132, 14992, 8988, 15661, 4538, 4336, 1238, 13004, 14817, 12594, 12596, 16274, 1981, 12538, 3728, 12953, 10350, 355, 13724, 359, 13277, 1984, 1453, 13342, 1717, 13450, 1961; Payload ID: 13613 relates to Category No.: 12091, 15618, 5785, 14565, 1512, 442, 15149, 5446, 4186, 4521, 3775, 14663, 14992, 8988, 15661, 4538, 1238, 13004, 16274, 1981, 3728, 355, 13724, 359, 8887, 8640, 13372, 8267, 13808; Payload ID: 13614 relates to Category No.: 12091, 15618, 5785, 14565, 1512, 5446, 4186, 4521, 14838, 3775, 14663, 14992, 8988, 6530, 15661, 4538, 1238, 13004, 16274, 1981, 3728, 355, 13724, 359; Payload ID: 13615 relates to Category No.: 13594, 15618, 5785, 14565, 5446, 4186, 3775, 14663, 8988, 1238, 13004, 16274, 1981, 7571, 3728, 13371, 355, 13724, 359, 7691, 4949, 14365, 6796, 8522, 1560, 13360, 8269, 4144; Payload ID: 13616 relates to Category No.: 12091, 15618, 14565, 5446, 4186, 3775, 14663, 8988, 1238, 13004, 16274, 1981, 3728, 13371, 355, 13724, 359, 7691, 6103; Payload ID: 13617 relates to Category No.: 15618, 5785, 14565, 5446, 4186, 3775, 14663, 8988, 1238, 13004, 16274, 1981, 3728, 13371, 355, 13724, 359, 7691; Payload ID: 13618 relates to Category No.: 15618, 5785, 14565, 5446, 4186, 9420, 3775, 14663, 7132, 8988, 4336, 1238, 13004, 16274, 1981, 3728, 13371, 355, 13724, 359, 7691, 6102, 4110, 13360, 13782, 13808; Payload ID: 13619 relates to Category No.: 12091, 14565, 274, 12942, 1238, 7131, 8477, 8934, 3038, 4251, 13690, 2264, 8638; Payload ID: 13620 relates to Category No.: 12091, 13248, 14565, 14663, 1238, 9053, 2469, 2467, 12129, 9709; Payload ID: 13621 relates to Category No.: 11512, 7613, 1894, 3452, 5446, 9713, 3354, 3448, 3453, 2009, 11573, 8535, 12717, 14123, 13489, 14575, 10238, 13904, 5808, 14793, 4949, 11912, 1295, 13856, 15257, 15195, 3536, 1063, 6412, 5391, 16051, 15208, 11745, 15199, 13767, 10626, 5382, 8108, 10782, 14910, 15400, 10509, 7773, 8577; Payload ID: 13622 relates to Category No.: 10331, 5367, 14038, 7743, 4439, 11756, 11697, 4442, 11754, 12091, 9476, 7001, 10864, 14641, 2083, 9982; Payload ID: 13623 relates to Category No.: 12091, 12619, 7154, 12732, 13171, 7132, 4336, 8454, 4332, 1721; Payload ID: 13624 relates to Category No.: 12091, 690, 1703, 12638, 9713, 12614, 11858, 3713, 1823, 3715, 7372, 3816, 5951, 12822; Payload ID: 13625 relates to Category No.: 13589, 3398, 9125, 3564, 9324, 4315, 12068, 12067, 14793, 690, 4949, 8862; Payload ID: 13626 relates to Category No.: 1893, 4315, 11660, 12068, 12067, 13458, 12891, 12827, 6796, 4318, 6814; Payload ID: 13627 relates to Category No.: 9125, 11125, 12068, 4701, 1598, 13257; Payload ID: 13628 relates to Category No.: 11930, 12068; Payload ID: 13629 relates to Category No.: 12071, 12068, 8934; Payload ID: 13630 relates to Category No.: 1737, 1721, 2467, 3100, 11910, 8756, 14663, 15661, 4690, 15570, 3743, 12717, 13623, 6375, 1320, 10601, 12920, 12921; Payload ID: 13631 relates to Category No.: 11910, 1737, 14661, 2467, 12614, 8756, 14663, 7132, 15661, 4690, 4336, 15570, 3743, 12717, 12920, 12921, 6814; Payload ID: 13632 relates to Category No.: 1737, 14661, 2467, 11910, 8756, 14663, 7132, 15661, 4690, 15570, 3743, 12717, 8929, 6814; Payload ID: 13633 relates to Category No.: 8467, 8511; Payload ID: 13634 relates to Category No.: 13313, 14661, 7710; Payload ID: 13635 relates to Category No.: 13313, 7710, 12603; Payload ID: 13636 relates to Category No.: 7710, 13313; Payload ID: 13637 relates to Category No.: 7710, 13313, 13348; Payload ID: 13638 relates to Category No.: 5785, 14565, 8522, 4690; Payload ID: 13639 relates to Category No.: 5785, 14565, 12603, 7710, 7834, 16213, 15490, 3398, 13775, 7979; Payload ID: 13640 relates to Category No.: 1737, 5785, 14565, 1721, 10637, 8522, 10362; Payload ID: 13641 relates to Category No.: 13465, 7710, 4690, 13311, 4448; Payload ID: 13642 relates to Category No.: 15490, 3398, 7710, 11949; Payload ID: 13643 relates to Category No.: 14661, 11512, 14565, 11910, 12614, 7710, 7154, 7132, 4336, 2198, 13209, 11067, 13260, 12603; Payload ID: 13644 relates to Category No.: 14565, 10331, 14661, 13194, 7132, 4336; Payload ID: 13645 relates to Category No.: 14565; Payload ID: 13646 relates to Category No.: 15490, 3398, 795, 8739, 7303, 11634, 1562, 3571, 4934, 16132, 1578, 7307, 10358; Payload ID: 13647 relates to Category No.: 795, 7724, 5807; Payload ID: 13648 relates to Category No.: 1722, 795, 1955, 8756, 10648, 13831, 15570, 11511, 11174, 5810, 8467, 8511, 11553, 11200, 13623, 12017, 11173, 8450, 10547, 9710, 7914, 8743, 3684, 12802, 8576, 7728, 2079, 13969, 496, 10238, 7743, 1957, 13811, 11285, 1910, 8447, 8537, 2139, 13883, 12488, 1927, 2057, 1923, 13832, 2085, 1950, 1941, 1987, 2055; Payload ID: 13649 relates to Category No.: 13618, 7914, 8450, 9710, 13975, 13831, 13877, 3827; Payload ID: 13650 relates to Category No.: 12603; Payload ID: 13651 relates to Category No.: 12603, 10558, 12881, 11248, 3876, 8511, 13304, 8445, 10284; Payload ID: 13652 relates to Category No.: 5785, 2169, 13300, 7710; Payload ID: 13655 relates to Category No.: 8454; Payload ID: 13656 relates to Category No.: 8454; Payload ID: 13658 relates to Category No.: 8454; Payload ID: 13659 relates to Category No.: 8454; Payload ID: 13660 relates to Category No.: 8454; Payload ID: 13661 relates to Category No.: 4690; Payload ID: 13662 relates to Category No.: 4690, 12921, 12603, 11910, 12920;

Payload ID: 13663 relates to Category No.: 1512, 12603, 11910, 14663, 4538, 4685, 4690; Payload ID: 13664 relates to Category No.: 11910, 4690, 12920, 12921; Payload ID: 13665 relates to Category No.: 4690, 11910, 12920, 12921; Payload ID: 13666 relates to Category No.: 12920, 12919; Payload ID: 13667 relates to Category No.: 4535, 10680, 10679; Payload ID: 13668 relates to Category No.: 13300; Payload ID: 13669 relates to Category No.: 12603, 1204, 11248, 2429, 1397; Payload ID: 13670 relates to Category No.: 7288, 13589, 3398, 15490, 3398, 7710, 14271, 14216, 14199, 1780, 12603; Payload ID: 13671 relates to Category No.: 286, 1451, 8936, 496, 11094, 2130, 3971, 10501, 8928, 12881, 12465, 12760, 13523, 11265, 8661, 13526, 8228, 10921, 8650; Payload ID: 13672 relates to Category No.: 7191, 12646, 3038, 286, 13371, 2064, 1451, 13268, 12091, 13835, 2079, 13969, 496, 13827, 13971, 13773, 13775, 1957, 13991, 5073, 14011, 13883, 13961, 1964, 2243, 6531, 6102, 284, 13780, 1960, 10393, 2087, 10588, 2038, 3199, 8467, 13740, 13808, 11999, 11272, 13911, 13930, 12006; Payload ID: 13673 relates to Category No.: 13589, 3398, 795, 11910, 12614, 4186, 13681, 14271, 6670, 12628, 12775, 7735, 4439, 7132, 12936, 2211, 5407, 9223, 9103, 11291, 13970, 7942, 8793, 7156, 14401, 6795; Payload ID: 13674 relates to Category No.: 11910, 4186, 12891, 11843, 793, 13831, 13877, 13779, 8552, 6814; Payload ID: 13675 relates to Category No.: 13589, 3398, 795, 11910, 12614, 4186, 13681, 14271, 12628, 12775, 13370, 11884, 9420, 7735, 4439, 7132, 12936, 4336, 2211, 2429, 5407, 9223, 9103, 13970, 8793, 7156, 14401, 7160, 9710, 10601, 4144, 6693, 6690, 2189, 13115; Payload ID: 13676 relates to Category No.: 13370, 11884, 801, 10601; Payload ID: 13677 relates to Category No.: 11910, 13370, 4439, 7132, 4336, 9223, 9103, 7156, 13951, 6902; Payload ID: 13678 relates to Category No.: 14565, 13370, 11248, 7955, 8217; Payload ID: 13679 relates to Category No.: 11910, 16289, 7693, 13370, 10314, 11243, 14790, 14778, 4060, 12643; Payload ID: 13680 relates to Category No.: 795, 13370; Payload ID: 13681 relates to Category No.: 14565, 13370, 3684, 1893, 5855, 11512, 11094, 1993, 11363, 13371, 11245, 10350, 13398, 11100, 13293, 13340, 7996; Payload ID: 13682 relates to Category No.: 1722, 11910, 7132, 4332, 7743, 13370, 7997; Payload ID: 13683 relates to Category No.: 1737, 7154, 13370, 7132, 3975; Payload ID: 13684 relates to Category No.: 8862, 14565, 1512, 5446, 11910, 7362, 13370, 14663, 8988, 4538, 15003, 15456, 15450, 7363, 15448, 15443, 15454, 15446, 15653, 15457, 15458, 3728, 1482, 15451; Payload ID: 13685 relates to Category No.: 14565, 13370; Payload ID: 13686 relates to Category No.: 13370; Payload ID: 13687 relates to Category No.: 14565, 13370, 11843, 7743, 5809, 3313, 14567, 12099; Payload ID: 13688 relates to Category No.: 6969, 1061, 2713, 15197, 10265, 360, 14910, 13154, 12527, 12494; Payload ID: 13689 relates to Category No.: 12075, 10238, 13370, 7169, 13311, 11248, 8467, 8511, 11200, 10331; Payload ID: 13690 relates to Category No.: 11910; Payload ID: 13691 relates to Category No.: 11512, 5446, 3100, 11910, 4127, 14992, 15185, 1383, 1957, 13796, 11107, 11949, 4332, 1417, 11363, 7191, 3971, 14624, 7864, 1565, 7802, 1451, 7315, 10325, 15581, 1984, 13775, 8118; Payload ID: 13692 relates to Category No.: 12091, 11512, 14565, 5446, 3100, 11910, 11506, 3398, 4127, 14992, 13004, 14729, 15185, 13530, 1383, 10802, 1023, 1420, 1957, 6102, 6758, 15203, 11107, 12891, 4949, 13818, 15197, 15194, 6406, 6294, 8685; Payload ID: 13693 relates to Category No.: 11910, 795, 11765, 5806, 11260, 1295, 6814; Payload ID: 13694 relates to Category No.: 11512, 795, 5446, 11910, 4127, 11765, 14992, 1383, 5806, 11260, 11107; Payload ID: 13696 relates to Category No.: 3452, 9038, 3354, 11910, 3448, 12786, 3100, 2014, 6814; Payload ID: 13697 relates to Category No.: 12091, 14565, 12603, 11910; Payload ID: 13698 relates to Category No.: 7288, 1894, 3452, 12603, 3354, 3448, 14271, 12786; Payload ID: 13700 relates to Category No.: 11910, 10663, 13071; Payload ID: 13701 relates to Category No.: 8467, 13375; Payload ID: 13702 relates to Category No.: 1026, 15490, 3398, 14661, 5446, 6606, 348, 3354, 11910, 4186, 7154, 3448, 10775, 12391, 4127, 3775, 5541, 16085, 8988, 13951, 7728, 11934, 2001, 13916, 8374, 8535, 12066, 5126, 10661, 1920; Payload ID: 13703 relates to Category No.: 11910, 3833, 12063, 2669, 1893, 6738, 4332, 11660; Payload ID: 13704 relates to Category No.: 3833, 12063, 2669, 1893, 6738, 11660, 13311; Payload ID: 13706 relates to Category No.: 3833, 12063, 2669, 1893, 6738, 11660, 13311, 4712; Payload ID: 13707 relates to Category No.: 7710, 13370, 11906; Payload ID: 13708 relates to Category No.: 11910, 10005, 16211, 14111, 13437, 3158; Payload ID: 13709 relates to Category No.: 11910, 16214, 13104, 3158, 8447, 8256, 13050; Payload ID: 13710 relates to Category No.: 15490, 3398, 1722, 8739, 16286, 3100, 11910, 11506, 3398, 8756, 10775, 15521, 4439, 5541, 15570, 9151, 11620, 8628, 9715, 8103, 8389, 2131, 7662, 11251; Payload ID: 13711 relates to Category No.: 11910, 2885, 9151, 9715, 8103, 8126, 8389, 7860; Payload ID: 13712 relates to Category No.: 13996, 11910, 7743, 9715, 13788, 4336, 2116; Payload ID: 13713 relates to Category No.: 8522, 1957, 11418, 9715, 11910; Payload ID: 13714 relates to Category No.: 8731, 3398, 10648, 10383, 8522, 1957, 10470, 5806, 10419, 11418, 8446, 9715, 10573, 10696, 10629, 8523, 5126, 11910; Payload ID: 13715 relates to Category No.: 11910, 9715, 1722; Payload ID: 13716 relates to Category No.: 11910; Payload ID: 13717 relates to Category No.: 11910; Payload ID: 13718 relates to Category No.: 11910, 14663, 1878, 1308, 6814; Payload ID: 13719 relates to Category No.: 11910, 14865, 14663, 14862, 6606, 15610; Payload ID: 13720 relates to Category No.: 11910; Payload ID: 13721 relates to Category No.: 11910; Payload ID: 13722 relates to Category No.: 12097; Payload ID: 13723 relates to Category No.: 1737, 14661, 12638, 5592, 7154, 7132, 4229, 10638, 8049, 7992, 8667, 10252, 2427; Payload ID: 13724 relates to Category No.: 14661, 10372, 6969, 2886, 7165; Payload ID: 13725 relates to Category No.: 12194, 7912, 10074, 5446, 1893, 1238, 11660, 10080, 4180, 12724, 6145, 9674, 13925, 11182; Payload ID: 13726 relates to Category No.: 12091, 3176, 4949; Payload ID: 13727 relates to Category No.: 12091; Payload ID: 13728 relates to Category No.: 12519; Payload ID: 13729 relates to Category No.: 12091, 690, 1026, 14661, 9720, 795, 3766, 1703, 1730, 12648, 7613, 10074, 1752, 9717, 5446, 10372, 2940, 6606, 348, 5592, 4186, 12942, 1767, 12746, 12646, 12391, 3871, 10366, 4127, 3564, 10036, 4130, 8864, 3775, 11765, 11285, 5541, 16085, 8988, 1238, 14556, 15570, 11858, 11187, 11266, 1844, 11186, 11265, 7750, 4871, 12615, 13371, 11299, 4953, 12882, 13277, 7600, 12823, 12810, 13520, 16096, 8934, 4021, 6969, 2131, 1240, 3713, 7640, 2175, 8419, 3893, 8669; Payload ID: 13730 relates to Category No.: 12091, 690, 14565, 2303, 9720, 795, 1703, 1730, 12648, 7613, 1752, 9717, 5446, 10372, 403, 2940, 5592, 12614, 7743, 5852, 1795, 1277, 8373, 10366, 11884, 14928, 12835, 3775, 14015, 15782, 16085, 10878, 10192, 14556, 11858, 12461, 11178, 10583, 8349, 6611, 10382, 11186, 11265, 2110, 10590, 10557, 8489, 11094, 6323, 1849, 7664, 13408, 13252, 11436, 4588, 10264, 13384, 13098, 13002, 342, 10226, 1971, 11299, 11113, 12577, 13246, 12687, 12685, 13882, 13936, 6299, 13874, 13827, 13796, 13971, 13837, 13927, 10514, 13860, 13811, 10486, 286, 13797, 13883, 6606, 10362, 8936, 13998, 11111, 13877, 11307, 11546, 4229, 8420, 13973, 10879, 337, 8340, 4480, 10394, 9378, 15000, 1244, 12646, 12553, 13064, 12488; Payload ID: 13731 relates to Category No.: 12091, 15614, 1752, 9717, 5446, 274, 12646, 8546, 11858, 2110, 11094, 15838, 15839, 5755, 8042; Payload ID: 13732 relates to Category No.: 12091, 14565, 9720, 1703, 1752, 1483, 3896, 275, 1013, 2110, 11094, 16136, 8887, 16294, 2548, 4949, 2705, 6390, 10044, 3878, 2651; Payload ID: 13733 relates to Category No.: 9718, 3100, 11910, 2460, 14699; Payload ID: 13734 relates to Category No.: 9718, 1721, 3100, 11910, 7306, 10366; Payload ID: 13735 relates to Category No.: 9718, 3100, 11910; Payload ID: 13736 relates to Category No.: 9718, 3100, 11910, 3713, 9125, 11598, 13652; Payload ID: 13737 relates to Category No.: 9718, 11910, 9945, 14663, 9841, 5500, 4653, 1594, 3100; Payload ID: 13738 relates to Category No.: 9718, 2885, 10074, 3684, 13465, 3100, 11910, 12798, 275, 11296, 7946, 1238, 8117, 10095, 8805, 5610, 5911, 13012, 15817, 13640, 10872, 8255, 362, 8450, 13032, 12962, 9719, 11311, 5541, 344, 13831, 7915, 5855, 13003; Payload ID: 13739 relates to Category No.: 1026, 9718, 1295, 2885, 3766, 5458, 5446, 11910, 4949, 4186, 9891, 4127, 3775, 5541, 8988, 1238, 4067, 6145, 10667, 15192, 5610, 13012, 15817, 13640, 12615, 3838, 4450, 973, 3100, 345, 5243, 7303, 9408, 5268, 10583, 5592, 4535, 1048, 10086, 6666, 10093, 1128, 8118, 15664, 11371, 10762, 6219, 11027, 3309, 2215, 13189, 8089, 13352, 5263, 199, 7721, 6992, 7314, 7830, 8044, 5757; Payload ID: 13740 relates to Category No.: 9718, 3100, 11910, 15427; Payload ID: 13741 relates to Category No.: 9718, 3100, 11910, 13304, 1183; Payload ID: 13742 relates to Category No.: 13589, 3398, 15490, 3398, 9718, 3100, 11910, 7743, 6406, 13352; Payload ID: 13743 relates to Category No.: 9718, 3100, 11910; Payload ID: 13744 relates to Category No.: 9718, 2885, 3100, 11910, 3854, 1060, 7743, 7946, 5541, 8112, 8117, 15194, 5610, 13012, 7933, 8793, 4535, 8219, 8785, 8249, 8689, 7790, 8792, 8795, 8796, 10663, 8131, 8790, 8161, 12962, 8152, 8498, 8155, 8246, 8483, 8480, 8546, 10548, 11180; Payload ID: 13745 relates to Category No.: 9718, 3100, 11910; Payload ID: 13746 relates to Category No.: 9718, 3100, 11910; Payload ID: 13747 relates to Category No.: 9718, 1002, 11910, 8193, 7635, 10648, 8164, 15194, 12532, 11573, 10583, 8004, 8782, 10815, 6248, 2065, 11495, 11496, 8689, 13000, 8435, 8677, 11263, 8160, 8411, 13215, 9904, 13245, 3100, 13563, 10491, 15207, 11510, 13066, 10340, 579, 11497, 11498, 10812, 10695, 10809; Payload ID: 13748 relates to Category No.: 9718, 12137, 3100, 11910, 2460, 15899, 7938, 10536, 10759, 10210; Payload ID: 13749 relates to Category No.: 9718, 3100, 11910, 13496, 8273, 8318, 13122, 6271; Payload ID: 13750 relates to Category No.: 9718, 3100, 11910; Payload ID: 13751 relates to Category No.: 9718, 3100, 11910, 13827, 8255, 13775, 11285, 11094, 13883, 11090, 11259, 15606, 11313, 4004, 10923, 13764, 11294, 11332; Payload ID: 13752 relates to Category No.: 4828, 9718, 9720, 795, 2885, 1730, 10372, 3100, 11910, 7743, 1780, 1238, 6145, 11187, 15192, 12832, 5610, 5911, 13012, 15817, 13640, 12886, 8449, 1070, 5785, 10086, 6666, 4969, 8256, 12530, 8255, 10344, 8090, 10075, 13408, 8688, 7540, 8689, 199, 7645; Payload ID: 13753 relates to Category No.: 9718, 3100, 11910; Payload ID: 13754 relates to Category No.: 9718, 3100, 11910; Payload ID: 13755 relates to Category No.: 1026, 9718, 14661, 5446, 6606, 348, 3100, 11910, 4186, 12391, 4127, 3775, 5541, 16085, 8988, 12091; Payload ID: 13756 relates to Category No.: 9718, 3100, 11910, 9815, 690; Payload ID: 13757 relates to Category No.: 9718, 15207, 11910, 3100, 1060, 1070, 345, 10955, 10600, 5041, 3021, 11626, 8840, 11452, 10219, 6137, 11456, 11458, 12990, 10764, 8506, 15203, 12530, 10642, 10876, 8449, 12532, 12856, 13856; Payload ID: 13758 relates to Category No.: 3012; Payload ID: 13759 relates to Category No.: 9718, 8929, 3100, 11910, 9815, 5037, 10495, 11724, 15616; Payload ID: 13760 relates to Category No.: 9718, 3100, 11910, 8117, 13107, 15616; Payload ID: 13761 relates to Category No.: 9718, 1703, 1752, 3100, 11910, 15616, 8556, 13232, 8941, 12525; Payload ID: 13762 relates to Category No.: 14565, 8977, 15149, 1820, 4581, 8661, 7955; Payload ID: 13763 relates to Category No.: 8977, 15149, 1820, 4581; Payload ID: 13764 relates to Category No.: 8977, 15149, 13464, 4581; Payload ID: 13765 relates to Category No.: 8977, 15149, 4581; Payload ID: 13766 relates to Category No.: 9718, 15614, 3100, 11910, 7938, 15471; Payload ID: 13767 relates to Category No.: 9718, 795, 3100, 11910; Payload ID: 13768 relates to Category No.: 9718, 15207, 3100, 11910, 12614, 7743, 7737, 10175, 7735, 8524, 11266, 10343, 8807, 10093, 8478, 7933, 8255, 8689, 10629, 2647, 16096, 4949, 9350; Payload ID: 13769 relates to Category No.: 9718, 14565, 2139, 1703, 1752, 8731, 3398, 3100, 11910, 7743, 7737, 15570, 7724, 4229, 12007, 8196, 2107, 8936; Payload ID: 13770 relates to Category No.: 9718, 14565, 5255, 3100, 11910, 8936, 7598, 14058, 13827, 7924, 7923, 14069, 11602; Payload ID: 13771 relates to Category No.: 3100, 11910, 5544, 13998, 6391, 5545, 3067, 2885, 13888, 13836, 13860, 13797, 9718; Payload ID: 13772 relates to Category No.: 9718, 3100, 11910, 5545, 8978, 8049; Payload ID: 13773 relates to Category No.: 1026, 1764, 9718, 3100, 11910, 4500, 7693, 7216, 6018, 8378, 4502, 7755, 8580, 8011, 12903, 14648; Payload ID: 13774 relates to Category No.: 9718, 3100, 11910, 5459, 8920, 3147, 4969, 16175; Payload ID: 13775 relates to Category No.: 9718, 3100, 11910, 7946, 5406, 3840, 7938, 8862, 8929; Payload ID: 13776 relates to Category No.: 1703, 3100, 11910, 4021, 9718, 2243, 2235, 5073, 3877, 2708, 14883; Payload ID: 13777 relates to Category No.: 9718, 14565, 5255, 1703, 15614, 3100, 11910; Payload ID: 13778 relates to Category No.: 9718, 1703, 1730, 1483, 3100, 11910, 7743, 14589, 7737, 12007, 15616, 5256, 13859, 9411; Payload ID: 13779 relates to Category No.: 9718, 3100, 11910, 2169, 6103, 9350, 13267, 1048, 4969, 10366, 1295, 12754, 7863, 7743, 11094, 11178, 5073, 16213, 10626, 11090, 8928, 11093, 10493, 1035, 7755, 11355; Payload ID: 13780 relates to Category No.: 12194, 1893, 1238, 11660, 9674; Payload ID: 13781 relates to Category No.: 11881, 13589, 3398, 15490, 3398, 1894, 5446, 2411, 2409, 9274, 2410, 14949, 5172, 5107; Payload ID: 13782 relates to Category No.: 11881, 1892, 2940, 2891, 13619; Payload ID: 13783 relates to Category No.: 12194, 10372, 2569, 1238, 8453, 6641; Payload ID: 13784 relates to Category No.: 7306, 11294, 6814; Payload ID: 13785 relates to Category No.: 14565, 7743, 14015; Payload ID: 13786 relates to Category No.: 1894, 12053, 12102; Payload ID: 13787 relates to Category No.: 1894, 12053; Payload ID: 13788 relates to Category No.: 1894, 12053; Payload ID: 13789 relates to Category No.: 13589, 3398, 1894, 12053; Payload ID: 13790 relates to Category No.: 12091, 1295, 1514, 12068, 8934, 6103, 14454, 8919; Payload ID: 13791 relates to Category No.: 6593, 12068, 1512, 7306, 12071, 1801, 2266, 12804, 4021; Payload ID: 13792 relates to Category No.: 7306, 12071, 12068, 1801, 2266, 12804, 6593; Payload ID: 13793 relates to Category No.: 5367, 3013, 12736, 8138, 10845, 3017; Payload ID: 13794 relates to Category No.: 5367, 8760, 6153, 10854, 8996, 15110, 5075, 1101; Payload ID: 13795 relates to Category No.:

5367, 12427, 1780, 12646, 4974, 8158; Payload ID: 13796 relates to Category No.: 15149, 15042, 1022, 5428, 10648, 2174, 1751, 907, 1021, 6302, 5592, 7369, 4475; Payload ID: 13797 relates to Category No.: 2885, 5846, 5848, 2311; Payload ID: 13798 relates to Category No.: 15490, 3398; Payload ID: 13799 relates to Category No.: 8862, 5255, 1703, 1816; Payload ID: 13800 relates to Category No.: 5255, 1703; Payload ID: 13801 relates to Category No.: 5255, 1703, 8454; Payload ID: 13802 relates to Category No.: 5255, 1703; Payload ID: 13803 relates to Category No.: 5255, 1703, 8943, 5986, 1432, 4690; Payload ID: 13804 relates to Category No.: 5255, 1703, 480, 8672, 11722, 13533; Payload ID: 13805 relates to Category No.: 5255, 1295, 1703, 8862; Payload ID: 13806 relates to Category No.: 5255, 1295, 1703; Payload ID: 13807 relates to Category No.: 5255, 1703; Payload ID: 13808 relates to Category No.: 5255, 1703; Payload ID: 13809 relates to Category No.: 5255, 1703, 1816, 14793, 7243, 15149; Payload ID: 13810 relates to Category No.: 5255, 1703, 4251; Payload ID: 13811 relates to Category No.: 8862, 5255, 1703; Payload ID: 13812 relates to Category No.: 8862, 5255, 1703; Payload ID: 13813 relates to Category No.: 8862, 5255, 1703; Payload ID: 13814 relates to Category No.: 5255, 1703; Payload ID: 13815 relates to Category No.: 5255, 1703; Payload ID: 13816 relates to Category No.: 8862, 5255, 1703; Payload ID: 13817 relates to Category No.: 8862, 5255, 1703; Payload ID: 13818 relates to Category No.: 8862, 5255, 1703; Payload ID: 13819 relates to Category No.: 8862, 5255, 1703; Payload ID: 13820 relates to Category No.: 8862, 5255, 1703; Payload ID: 13821 relates to Category No.: 8862, 5255, 1703; Payload ID: 13822 relates to Category No.: 8862, 5255, 1703; Payload ID: 13823 relates to Category No.: 5255, 1703; Payload ID: 13824 relates to Category No.: 8862, 5255, 1703; Payload ID: 13825 relates to Category No.: 8862, 5255, 1703; Payload ID: 13826 relates to Category No.: 5255, 1703; Payload ID: 13827 relates to Category No.: 5255, 1703, 15149, 15140, 1432; Payload ID: 13828 relates to Category No.: 8862, 5255, 1703, 15149, 15140, 1432; Payload ID: 13829 relates to Category No.: 8862, 5255, 1703; Payload ID: 13830 relates to Category No.: 5255, 1703, 15149, 15140, 1432; Payload ID: 13831 relates to Category No.: 5255, 1703, 15149, 15140, 1432; Payload ID: 13832 relates to Category No.: 8862, 5255, 1703; Payload ID: 13833 relates to Category No.: 5255, 1703, 15149, 15140, 1432; Payload ID: 13834 relates to Category No.: 8862, 5255, 1703, 15149, 15140, 1432; Payload ID: 13835 relates to Category No.: 8862, 5255, 1703, 15149, 15140, 1432; Payload ID: 13836 relates to Category No.: 8862, 5255, 1703, 15149, 15140, 1432; Payload ID: 13837 relates to Category No.: 5255, 1703, 15149, 15140, 1432; Payload ID: 13838 relates to Category No.: 8862, 5255, 1703, 15149, 15140, 1432; Payload ID: 13839 relates to Category No.: 5255, 1703; Payload ID: 13840 relates to Category No.: 5255, 1703; Payload ID: 13841 relates to Category No.: 5255, 1703, 15149, 15140, 1432; Payload ID: 13842 relates to Category No.: 5255, 1703; Payload ID: 13843 relates to Category No.: 5255, 1703; Payload ID: 13844 relates to Category No.: 5255, 1703; Payload ID: 13845 relates to Category No.: 5255, 1703; Payload ID: 13846 relates to Category No.: 5255, 1703; Payload ID: 13847 relates to Category No.: 5255, 1703, 3699, 6232; Payload ID: 13848 relates to Category No.: 5255, 1703; Payload ID: 13849 relates to Category No.: 5255, 1703; Payload ID: 13850 relates to Category No.: 5255, 1703; Payload ID: 13851 relates to Category No.: 5255, 1703; Payload ID: 13852 relates to Category No.: 5255, 1703; Payload ID: 13853 relates to Category No.: 5255, 1703; Payload ID: 13854 relates to Category No.: 5255, 1703; Payload ID: 13855 relates to Category No.: 5255, 1703; Payload ID: 13856 relates to Category No.: 5255, 1703; Payload ID: 13857 relates to Category No.: 5255, 1703, 1432; Payload ID: 13858 relates to Category No.: 5255, 1703, 1204; Payload ID: 13859 relates to Category No.: 5255, 1703; Payload ID: 13860 relates to Category No.: 5255, 1703; Payload ID: 13861 relates to Category No.: 5255, 1703, 1432, 15143; Payload ID: 13862 relates to Category No.: 5255, 1703; Payload ID: 13863 relates to Category No.: 5255, 1703, 15143; Payload ID: 13864 relates to Category No.: 5255, 1703; Payload ID: 13865 relates to Category No.: 5255, 1703, 14456, 5458, 9994, 14452, 3825, 16214, 7303, 5462, 14184, 484, 286, 986, 14940, 6296, 7242, 3147, 9099, 3144, 991, 13796; Payload ID: 13866 relates to Category No.: 7306; Payload ID: 13867 relates to Category No.: 9500, 14663, 10173, 4977, 10174, 12209, 13827, 12210; Payload ID: 13868 relates to Category No.: 7291, 16182; Payload ID: 13869 relates to Category No.: 1737, 1721, 12648, 1752, 2940, 7291, 16182, 12743; Payload ID: 13870 relates to Category No.: 14565; Payload ID: 13871 relates to Category No.: 10148; Payload ID: 13872 relates to Category No.: 795, 6814; Payload ID: 13873 relates to Category No.: 12091, 9720, 15043, 1752, 11858; Payload ID: 13874 relates to Category No.: 6814, 3100, 9287, 1204; Payload ID: 13875 relates to Category No.: 12224, 15715, 15712, 4439, 14214, 11512, 15716; Payload ID: 13876 relates to Category No.: 12224, 15715, 14214; Payload ID: 13877 relates to Category No.: 12224, 14214, 15715, 15716; Payload ID: 13878 relates to Category No.: 12224, 14214, 15715, 15712, 4439; Payload ID: 13879 relates to Category No.: 12224, 15715, 14214; Payload ID: 13880 relates to Category No.: 12224, 15715, 14214; Payload ID: 13881 relates to Category No.: 13259, 3353, 6670; Payload ID: 13883 relates to Category No.: 1204; Payload ID: 13884 relates to Category No.: 11910; Payload ID: 13885 relates to Category No.: 12091, 15898, 13337, 5785, 9982, 13975, 12153, 9713, 10775, 7129, 11588, 8373, 11285, 14015, 11298, 2083, 11169, 12117, 7122, 13161, 6451, 13383, 11174, 11266, 13165, 13379, 8004, 11322, 8192, 10938, 8241, 13164, 11017, 7131, 361, 2006, 11294, 8431, 6453, 2130, 13540, 8430, 13397, 8554, 9709, 13344, 8432, 3907, 6507, 8317, 10249, 13282, 15467, 7633, 11016, 7508, 8097, 8308, 10460, 10633, 11363, 11546, 11248, 13227, 11436, 3436, 10531, 13755, 10332, 12991, 8100; Payload ID: 13886 relates to Category No.: 15490, 3398, 14663, 1878, 6343, 15307, 9500, 11941, 11934, 11506, 3398, 13356; Payload ID: 13887 relates to Category No.: 11506, 3398, 15307, 9500, 11941, 11934; Payload ID: 13888 relates to Category No.: 13621, 1204, 504, 15696; Payload ID: 13891 relates to Category No.: 3100, 11910; Payload ID: 13892 relates to Category No.: 1703; Payload ID: 13894 relates to Category No.: 12619, 14838, 6738, 10649, 483, 14944, 11646, 11341, 11656, 12894, 7278; Payload ID: 13895 relates to Category No.: 10649, 13618, 11341, 12894, 15001; Payload ID: 13896 relates to Category No.: 13618; Payload ID: 13897 relates to Category No.: 9256, 12265, 5367, 9232, 14663, 12242, 11460, 13827, 9236, 5475, 12252, 9029, 7473, 15986, 10218, 5665, 12246; Payload ID: 13898 relates to Category No.: 15626, 14565, 1649, 1415, 13785, 12268, 5848, 1238, 334, 13970, 10074, 13659, 12573, 2206, 10870, 14513, 13655, 13491, 5533, 11940, 11934, 15149, 4588, 12544, 16099, 8946; Payload ID: 13899 relates to Category No.: 11940, 1649, 14456, 5846, 1651, 13785, 12268, 10302, 10307, 15149, 8922, 13970, 1119, 13882, 14624, 8918, 13799, 16020, 9744, 14459, 3138; Payload ID: 13900 relates to Category No.: 15626, 14565, 1649, 5846, 1651, 13785, 12268, 10302, 10307, 15149, 8922, 13970, 1119, 13882, 13812, 13530, 13867, 13936, 5848, 14021, 13799, 16020, 9744, 14459, 11940, 8946, 11362, 1116; Payload ID: 13901 relates to Category No.: 15626, 14565, 1649, 5846, 14454, 803, 1651, 13785, 12268, 12544, 3705, 12594, 6723, 10301, 11231, 13497, 11111, 15425, 1912, 7703, 10302, 13686, 10307, 13846, 1417, 16102, 3971, 9048, 11940, 8946; Payload ID: 13902 relates to Category No.: 1649, 5846, 1651, 13785, 12268, 8862, 15626, 14565, 7131, 10302, 10307; Payload ID: 13903 relates to Category No.: 11940, 15626, 14565, 1649, 5846, 1651, 13785, 12268, 7340, 11934; Payload ID: 13904 relates to Category No.: 1649, 5846, 1651, 13785, 12268, 14454, 5446, 803, 1795, 9947, 10648, 10822, 10287, 6723, 10682, 8256, 9292, 6125, 13497, 10485, 7667, 10302, 7749, 1232, 10482, 10868, 10170, 13056, 10278, 12091, 345, 10955, 5243, 1797, 13827, 2888, 13695, 10238, 5428, 13788, 13925, 12099, 10061, 13796, 13970, 12397, 1417, 10478, 10331, 4039, 2079, 3016, 14641, 1764, 7122, 10851, 11285, 6739, 11290, 11456, 15203, 15157, 12066, 2206, 9949, 13936, 14054, 13846, 9948, 1958, 15197, 2572, 1968, 4439, 9779, 6721, 10819, 11765, 13969, 13829, 10821, 10639, 11146, 10674, 11231, 7478, 7312, 11013, 10932; Payload ID: 13905 relates to Category No.: 4828, 10074, 1795, 11285, 12041, 1238, 9932, 10486, 10583, 14577, 13687, 2079, 10870, 11512, 4478, 13936, 16294, 496, 8400, 10762, 14454, 13865, 422, 4819, 439, 3529, 11168, 13661, 10798, 13398, 7653; Payload ID: 13906 relates to Category No.: 4828; Payload ID: 13907 relates to Category No.: 4828, 15149, 422, 1451, 434, 328, 3012, 4819, 9932, 1912, 8953; Payload ID: 13908 relates to Category No.: 4828, 10702, 10074, 15045, 1740, 439, 1238, 4819, 10075, 1912, 4999, 13142, 2079, 442, 10870, 11674, 4478, 1415, 8400, 7730, 12573, 422, 11980, 1779; Payload ID: 13909 relates to Category No.: 4828, 7581, 1204, 4819, 2079; Payload ID: 13910 relates to Category No.: 4828, 4819; Payload ID: 13911 relates to Category No.: 4828, 4819, 9932, 11050, 1861, 2041, 2014, 11390, 16294, 496, 10486, 11094, 14454, 13865, 11231, 10415, 5406, 8420, 11168, 13661, 2102; Payload ID: 13912 relates to Category No.: 4828, 4819; Payload ID: 13913 relates to Category No.: 13594, 15490, 3398, 1730, 3360, 3379, 8731, 3398, 10372, 8760, 8862; Payload ID: 13914 relates to Category No.: 15490, 3398, 1730, 1780, 13202, 8739, 8731, 3398; Payload ID: 13916 relates to Category No.: 10702, 14111; Payload ID: 13917 relates to Category No.: 2169, 8373, 11094, 9455, 8522, 13973, 10531, 2063; Payload ID: 13919 relates to Category No.: 4279, 15603; Payload ID: 13920 relates to Category No.: 13589, 3398, 15490, 3398; Payload ID: 13921 relates to Category No.: 13589, 3398, 15490, 3398; Payload ID: 13924 relates to Category No.: 9228; Payload ID: 13925 relates to Category No.: 1089, 14590; Payload ID: 13927 relates to Category No.: 15490, 3398; Payload ID: 13928 relates to Category No.: 14169, 6637, 151, 6360; Payload ID: 13932 relates to Category No.: 12091, 5428, 7191, 13126, 7631, 8185; Payload ID: 13933 relates to Category No.: 5446, 15782, 8390, 8522, 10822, 8785; Payload ID: 13934 relates to Category No.: 334, 14565, 5428, 795, 5446, 10238, 11109, 12498, 3021, 5809, 8541, 14992, 15782, 8390, 2041, 2014, 2136, 10878, 10192, 11363, 13376, 339, 10583, 10822, 10856, 10852, 10827, 11322, 10814, 10851, 11566, 3015, 11182, 10470, 11459, 11445, 9292, 6125, 10469, 13635, 10416, 8103, 5807, 10600, 10197, 8126, 7374, 10206, 6474, 7375, 13036, 10233; Payload ID: 13935 relates to Category No.: 11512, 5949, 11634, 14836, 16286, 14834, 12036, 4969; Payload ID: 13936 relates to Category No.: 5406, 5949, 11634, 14836, 16286, 14834, 1295, 9540, 6111, 6559, 3194, 1483, 13103, 12976, 10432, 12968; Payload ID: 13937 relates to Category No.: 9223, 9103, 11546, 3992; Payload ID: 13938 relates to Category No.: 9500; Payload ID: 13939 relates to Category No.: 9500; Payload ID: 13940 relates to Category No.: 9982, 12289, 1780, 14663, 12293, 16234, 16275, 16217; Payload ID: 13941 relates to Category No.: 6814, 11910, 13171, 12743, 10191, 1912, 300, 12294; Payload ID: 13942 relates to Category No.: 1533, 6814; Payload ID: 13943 relates to Category No.: 9500, 12293, 12296, 14663, 7131, 16234, 16275, 16217, 10491; Payload ID: 13944 relates to Category No.: 4828, 4819, 9932, 10486, 15538, 2100; Payload ID: 13945 relates to Category No.: 4828, 4819, 9932, 2079, 15538, 2100, 11390; Payload ID: 13946 relates to Category No.: 1721; Payload ID: 13947 relates to Category No.: 5428, 5446, 8390, 8112, 8389, 8785, 8134, 8397; Payload ID: 13948 relates to Category No.: 8962, 6296, 12868, 10282, 4855; Payload ID: 13949 relates to Category No.: 4828, 2000, 8962, 13980; Payload ID: 13950 relates to Category No.: 12194; Payload ID: 13951 relates to Category No.: 12194; Payload ID: 13952 relates to Category No.: 9815, 4439, 15698, 3277; Payload ID: 13953 relates to Category No.: 9815, 4439, 15698, 3277, 11910; Payload ID: 13954 relates to Category No.: 9500, 11773, 6349, 14663, 1878, 2083, 13161, 8095, 1828; Payload ID: 13955 relates to Category No.: 9500, 11773, 6349, 14663, 1878, 1828; Payload ID: 13956 relates to Category No.: 9500, 11773, 6349, 14663, 1878, 1828; Payload ID: 13957 relates to Category No.: 6219, 1512, 4521, 14663, 4538, 12338, 8004, 16234, 16275, 1210, 10179, 10178, 16200, 6814, 9498; Payload ID: 13958 relates to Category No.: 6814, 9500, 15642, 1874, 14663, 4538, 228, 12338, 12456, 7023; Payload ID: 13959 relates to Category No.: 6814, 15642, 4538, 228, 12338; Payload ID: 13960 relates to Category No.: 6814, 15642, 1874, 14663, 4538, 228, 12338, 12456, 7023, 9500; Payload ID: 13961 relates to Category No.: 6814, 1874, 14663, 12338, 12456, 7023; Payload ID: 13962 relates to Category No.: 12091, 1780, 1874, 14663, 4538, 12338, 12456, 7131, 5814, 12913, 5341; Payload ID: 13963 relates to Category No.: 12091, 13298, 1874, 14663, 5541, 4538, 12338, 12456, 4535, 5807, 12913, 2107, 12908, 2076, 12659; Payload ID: 13964 relates to Category No.: 9713, 1874, 14663, 4538, 12338, 12456, 1969, 9764, 12913, 13397, 1984, 5341; Payload ID: 13965 relates to Category No.: 12091, 13298, 14009, 1874, 14663, 5541, 4538, 12338, 12456, 10491, 1969, 4535, 12397, 7600, 12863, 12913, 2116, 12865, 12659, 12555; Payload ID: 13966 relates to Category No.: 9500, 1874, 14663, 12338, 12456; Payload ID: 13967 relates to Category No.: 1874, 14663, 12338, 12456, 9715, 11910; Payload ID: 13968 relates to Category No.: 11910, 1874, 14663, 12338, 12456; Payload ID: 13969 relates to Category No.: 1512, 4706, 14663, 4538, 3632, 3728, 10390, 1482, 13974, 13969, 13882, 13867, 13966, 13927, 13860, 13939, 13797, 13785, 2009, 12330, 927; Payload ID: 13970 relates to Category No.: 1512, 4706, 11765, 14663, 4538, 1482, 13882, 13888, 6269, 13966, 13970, 9411, 12330, 13955, 13864, 927, 14638; Payload ID: 13971 relates to Category No.: 7288, 14271, 7295, 16096, 10648, 14834, 7369, 7334, 6302, 136, 1022; Payload ID: 13972 relates to Category No.: 15715, 15712, 4439, 12347; Payload ID: 13973 relates to Category No.: 15712, 12347, 15715, 4439; Payload ID: 13974 relates to Category No.: 11926, 9500, 1790, 8241; Payload ID: 13975 relates to Category No.: 11926, 9500, 1790; Payload ID: 13976 relates to Category No.: 6814, 9500, 1830, 14663, 1878, 6343, 3248, 6269, 1957, 13916, 13858, 13771; Payload ID: 13977 relates to Category No.: 7474, 7476, 14663, 12288, 12066, 16234, 16275, 12350; Payload ID: 13983 relates to Category No.: 8441; Payload ID: 13985 relates to Category No.: 1894, 16214, 12097, 11928; Payload ID: 13986 relates to Category No.: 1894, 16214, 11928, 6814; Payload ID: 13987 relates to Category No.: 10702, 1721, 4828; Payload ID: 13988 relates to Category No.: 10702, 13363; Payload ID: 13989 relates to Category No.: 10702, 3639, 12126, 12153, 8535, 8209, 8112, 8552, 8160, 8257, 8261, 8562, 12867, 8199; Payload ID: 13990 relates to Category No.: 14661, 12137, 10702, 6733; Payload ID: 13991 relates to Category No.: 12137, 3699, 3525, 11243, 743, 8508, 5800, 13190, 3704; Payload ID: 13992 relates to Category No.: 3799, 13228, 12138; Payload ID: 13993 relates to Category No.: 3799, 12138; Payload ID: 13994 relates to Category No.: 14661, 12137, 5782, 14565, 12361, 9238; Payload ID: 13995 relates to Category No.: 14661, 12137, 5782, 14565, 12361, 9238; Payload ID: 13996 relates to Category No.: 14661, 12137, 5782, 12361; Payload ID: 13997 relates to Category No.: 14661, 12137; Payload ID: 13998 relates to Category No.: 14661, 12137; Payload ID: 13999 relates to Category No.: 14661, 12137, 5782, 14565, 3691, 12361, 16159, 16172, 12105, 9238, 12851, 1048, 736, 6738, 12041, 2009, 3683, 4775, 4774, 3906, 10113, 3892, 1100, 3903, 1910; Payload ID: 14000 relates to Category No.: 12137, 12453, 7583; Payload ID: 14001 relates to Category No.: 15618, 3871, 12453, 16274, 13724, 5545; Payload ID: 14002 relates to Category No.: 3635, 16172, 2886, 9420, 7583; Payload ID: 14003 relates to Category No.: 3635, 2886, 16197; Payload ID: 14004 relates to Category No.: 12453, 13364, 7583, 1898, 5545; Payload ID: 14005 relates to Category No.: 14661, 12137, 5782, 14565, 12361, 6714, 15618, 16172, 9238, 2886, 7162, 9420, 8936, 12041, 13668, 16274, 10638, 3906, 10573, 7153, 13724, 3908, 904, 10066, 4002, 13190, 7322, 3920, 10257, 13084, 13381; Payload ID: 14006 relates to Category No.: 14661, 5782, 12361, 6714, 12453, 12137, 14565, 9238, 14097, 3702, 15547, 13364, 3906, 12492, 1898, 2646, 12414, 5545, 12797; Payload ID: 14007 relates to Category No.: 14661, 12137, 1002, 5782, 14565, 12361, 16159, 12105, 9238, 12851, 3699, 1888, 12041, 10938; Payload ID: 14008 relates to Category No.: 3635, 14661, 12137, 5782, 14565, 3691, 12361, 2711, 9238, 1183, 8936, 6738, 2009, 3910, 3708, 11976, 15576, 3912, 12005, 12041; Payload ID: 14009 relates to Category No.: 3635, 6814, 14661, 12137, 5782, 14565, 12361, 16172, 4186, 9238, 3013, 3564, 6738, 5788, 4770, 13363, 9780, 1265, 780; Payload ID: 14010 relates to Category No.: 15547, 7131, 10491, 12414; Payload ID: 14011 relates to Category No.: 14661, 12137, 5782, 14565, 12361, 16159, 12105, 9238, 12041, 11318; Payload ID: 14012 relates to Category No.: 3635, 14661, 5782, 12361, 12798, 12881, 12137, 14565, 9238, 2459, 6714, 3886, 15535, 4200, 12753, 5390, 13523; Payload ID: 14013 relates to Category No.: 14661, 12137, 5782, 14565, 1295, 12361, 9238, 4057, 6223, 3683, 6814; Payload ID: 14014 relates to Category No.: 14661, 12137, 5782, 14565, 12361, 9238; Payload ID: 14015 relates to Category No.: 14661, 12137, 1002, 5782, 14565, 12361, 16172, 3639, 1752, 998, 3833, 3013, 12063, 2669, 1893, 16202, 6738, 7132, 16170, 4766, 11660, 4873, 5720, 1599, 10685, 9238, 15043, 6714; Payload ID: 14016 relates to Category No.: 14661, 12137, 1002, 5782, 14565, 12361, 3833, 9238, 16202, 12517, 10685; Payload ID: 14017 relates to Category No.: 14661, 12137, 5782, 14565, 12361, 12798, 9782, 9784; Payload ID: 14018 relates to Category No.: 14661, 12137, 5782, 14565, 12361, 9238, 12851, 11316, 10536, 10495, 12522, 726; Payload ID: 14019 relates to Category No.: 14661, 12137, 5782, 14565, 12361, 3639, 9238, 3697, 13666; Payload ID: 14020 relates to Category No.: 14661, 12137, 5782, 14565, 12361, 998, 9238, 2459, 1849, 8737, 2756, 8887, 8549, 3578, 8862, 13492, 14884; Payload ID: 14021 relates to Category No.: 14661, 12137, 1002, 5782, 14565, 12361, 9238; Payload ID: 14022 relates to Category No.: 14661, 12137, 5782, 14565, 12361, 10372, 3986, 9238, 6714, 13668, 10573, 3799, 12221, 6814; Payload ID: 14023 relates to Category No.: 14661, 12361, 16159, 12105, 12851, 12137, 5782, 14565, 9238, 4774, 12453, 3981; Payload ID: 14024 relates to Category No.: 14661, 12137, 5782, 14565, 12361, 16159, 3986, 12105, 9238, 6714, 736, 10648, 1893, 10593, 7326, 11182, 15167, 11318, 11306, 6711, 7325, 2625, 10453, 4002, 16172, 1238, 10025, 6705, 12122, 7536, 10021, 10024, 2951; Payload ID: 14025 relates to Category No.: 14661, 12137, 5782, 12361, 16159, 12105, 6714, 14565, 9238, 10593, 7326, 12851; Payload ID: 14026 relates to Category No.: 14661, 12137, 14565, 5782, 9238, 15471; Payload ID: 14027 relates to Category No.: 6814, 14661, 12137, 5782, 14565, 12361, 9238, 4766, 4770, 6713, 14097, 10067, 8378, 10861, 13381; Payload ID: 14028 relates to Category No.: 14661, 12137, 5782, 14565, 12361, 9238, 7132, 4766; Payload ID: 14029 relates to Category No.: 14661, 12137, 5782, 14565, 12361, 16172, 9238, 10593; Payload ID: 14030 relates to Category No.: 10702, 1295, 12942, 6223, 5334, 13464, 4067, 3971, 1463, 10254, 3903, 10672, 11271, 12576, 10549, 10648; Payload ID: 14031 relates to Category No.: 10331, 5782, 10702, 12942, 10254, 3903, 11271, 10549; Payload ID: 14032 relates to Category No.: 14661, 12137, 5782, 14565, 12361, 9238, 6223, 4766; Payload ID: 14033 relates to Category No.: 14661, 12137, 5782, 14565, 12361, 9238, 2009, 4774, 12453, 9783, 12409, 4785; Payload ID: 14034 relates to Category No.: 14661, 12137, 5782, 14565, 12361, 9238, 736, 3701, 9783, 6710; Payload ID: 14035 relates to Category No.: 14661, 12137, 5782, 14565, 12361, 9238, 736, 12517; Payload ID: 14036 relates to Category No.: 14661, 12137, 1002, 5782, 14565, 12361, 5798, 9238, 12124, 14641, 12517, 12928, 7825, 13433, 4771; Payload ID: 14037 relates to Category No.: 14661, 12137, 5782, 14565, 12361, 9238, 736, 12041, 4774, 9783, 9784, 6444, 6814, 3639; Payload ID: 14038 relates to Category No.: 3635, 14661, 12137, 5782, 14565, 3691, 12361, 3833, 9238, 2886, 736, 8936, 11997, 2068, 10066, 12020; Payload ID: 14039 relates to Category No.: 14661, 12137, 5782, 14565, 12361, 9238; Payload ID: 14040 relates to Category No.: 14661, 12137, 5782, 14565, 12361, 16159, 12105, 12851, 12041, 9238; Payload ID: 14041 relates to Category No.: 14661, 12137, 5782, 14565, 12361, 9238, 12026, 3701, 9782, 6710, 9420, 10083; Payload ID: 14042 relates to Category No.: 14661, 12137, 1002, 5782, 14565, 12361, 9238, 9782, 9784; Payload ID: 14043 relates to Category No.: 14661, 12137, 5782, 14565, 12361, 16172, 15143, 9238; Payload ID: 14044 relates to Category No.: 10702, 2459, 12126, 9420, 4775, 12037; Payload ID: 14045 relates to Category No.: 12137, 10702; Payload ID: 14046 relates to Category No.: 14661, 12137, 5782, 14565, 8977, 12361, 16159, 15149, 12105, 9238, 15157, 13464, 10593, 4581, 15164, 11318, 13536, 2646, 11634, 8922, 1048, 6375, 7122, 13758, 12851, 15160, 6502, 14461, 13829, 3968, 10250; Payload ID: 14047 relates to Category No.: 14661, 12137, 5782, 14565, 12361, 16159, 12105, 9238, 15157, 12851, 736, 10532, 13666, 9666; Payload ID: 14048 relates to Category No.: 14661, 12137, 5782, 14565, 12361, 16159, 12105, 9238, 15157, 736; Payload ID: 14049 relates to Category No.: 14661, 12137, 5782, 14565, 12361, 16159, 12105, 9238, 15157, 11318, 12851, 9666; Payload ID: 14050 relates to Category No.: 14661, 12137, 5785, 5782, 14565, 12153, 12361, 9238, 12041; Payload ID: 14051 relates to Category No.: 14661, 12137, 5785, 5782, 14565, 12153, 12361, 9238, 12041; Payload ID: 14052 relates to Category No.: 14661, 12137, 5785, 5782, 14565, 12153, 12361, 9238, 12041; Payload ID: 14053 relates to Category No.: 14661, 12137, 5782, 14565, 12361, 12041, 5785, 9238, 12153; Payload ID: 14054 relates to Category No.: 5782, 12361, 14098, 4771, 5798, 14097, 3698, 14661, 12137, 14565, 9238; Payload ID: 14055 relates to Category No.: 14661, 12137, 5782, 12361; Payload ID: 14056 relates to Category No.: 14661, 12137, 5782, 14565, 12361, 9238, 16202, 4766, 14097, 10067, 9783, 15471; Payload ID: 14057 relates to Category No.: 14661, 12137, 5782, 14565, 12361; Payload ID: 14058 relates to Category No.: 14661, 12137, 5782, 14565, 12361, 12798, 9238, 736, 6738, 10250; Payload ID: 14059 relates to Category No.: 14661, 12137, 5782, 14565, 4536, 12361, 12798, 9238; Payload ID: 14060 relates to Category No.: 14661, 12137, 5782, 14565, 9238; Payload ID: 14061 relates to Category No.: 14661, 12137, 5782, 14565, 12361, 3639, 12798, 9238, 1238, 12881, 3525, 10593, 15164, 13535, 12806, 12410; Payload ID: 14062 relates to Category No.: 14661, 12137, 5782, 14565, 12361, 12798, 9238, 736, 10066, 3697; Payload ID: 14063 relates to Category No.: 14661, 12137, 5782, 14565, 12361, 12798, 9238, 10066, 3697; Payload ID: 14064 relates to Category No.: 14661, 12137, 5782, 14565, 12361, 14098, 4771, 9238, 736, 16197, 12124, 3524, 12021, 9666, 7009; Payload ID: 14065 relates to Category No.: 14661, 12137, 5782, 14565, 12361, 14098, 4771, 5798, 9238, 14097, 3698; Payload ID: 14066 relates to Category No.: 14661, 12137, 5782, 14565, 12361, 14098, 4771, 5798, 9238, 14097, 3698, 13827, 12682, 1726; Payload ID: 14067 relates to Category No.: 14661, 12137, 5782, 14565, 12361, 3639, 9238, 14097, 3698, 3699, 12125, 3525, 11609, 11243, 743, 10595, 9783, 12134, 16199, 3773, 6241, 9782, 9784, 12517, 1277; Payload ID: 14068 relates to Category No.: 14661, 12137, 5782, 14565, 11109, 9238, 8723, 10851, 6061, 10968, 8725; Payload ID: 14069 relates to Category No.: 14661, 12137, 5782, 14565, 12361, 16159, 12105, 9238, 15157, 2459, 12851, 1048, 9420, 6738, 7132, 4336, 12041, 2009, 4783, 13084, 13363, 13381; Payload ID: 14070 relates to Category No.: 14661, 12137, 5782, 14565, 12361, 16159, 12105, 9238, 15157, 12851, 736, 12041, 2009, 11951, 4783, 450, 10371, 10455; Payload ID: 14071 relates to Category No.: 12427, 16159; Payload ID: 14072 relates to Category No.: 14661, 12137, 5782, 14565, 12361, 9238, 14097, 3698, 10593, 13363, 7554; Payload ID: 14073 relates to Category No.: 14661, 12137, 5782, 14565, 12361, 9238, 14097, 3698; Payload ID: 14074 relates to Category No.: 10702, 12137, 795, 16172, 3639, 6733; Payload ID: 14075 relates to Category No.: 12137, 10702, 3639; Payload ID: 14076 relates to Category No.: 12137, 3691, 3639, 6063, 4778, 1238, 16067, 4770, 3692; Payload ID: 14077 relates to Category No.: 5782, 12575, 15157, 1421, 1295; Payload ID: 14078 relates to Category No.: 5782, 3986, 12575, 15157, 1421; Payload ID: 14079 relates to Category No.: 14565, 7162, 6984, 14661, 5785, 10702, 13485, 7141, 14838, 10481, 3564, 1238, 743, 8898, 15077, 7167, 12515, 377; Payload ID: 14080 relates to Category No.: 14661, 10702, 795, 13435, 10238, 803, 13485, 8988, 5912, 6018, 1749; Payload ID: 14081 relates to Category No.: 9228, 3452, 1955, 3356, 3354, 3448, 3309, 2022, 15042, 6689; Payload ID: 14082 relates to Category No.: 3452, 1955, 3356, 3354, 3448, 13313, 7134, 3309, 3357, 7890, 1721; Payload ID: 14083 relates to Category No.: 14034, 11648, 12058, 1955, 7728, 3354, 15605, 3313, 3132, 10435, 14838, 7887; Payload ID: 14084 relates to Category No.: 1737, 13594, 795, 12431, 7154, 3353, 3448, 1893, 7132, 12120, 2429, 11660, 12009, 15517, 11512; Payload ID: 14085 relates to Category No.: 3448, 15144, 14838, 3452, 4167, 14442, 15174, 6669; Payload ID: 14086 relates to Category No.: 11843, 9296, 16197, 11607, 13338, 1955; Payload ID: 14087 relates to Category No.: 11843, 9296, 3354, 13338, 4485, 9296, 3311, 1955, 14838, 3602; Payload ID: 14088 relates to Category No.: 3354, 15257, 9228, 3452, 1955, 12431, 3320, 3353, 3448, 16197, 3453, 10887, 15261, 3455, 11240, 13172, 13166, 2424, 2425; Payload ID: 14089 relates to Category No.: 12137, 1721, 4785, 12828, 13468; Payload ID: 14090 relates to Category No.: 3452, 3354, 3448, 2022, 12786, 3455; Payload ID: 14092 relates to Category No.: 3452, 3354, 12431, 3353, 3448, 1238, 13904, 10638, 6680, 7157, 14998, 3455, 5406, 10372, 14790, 1229; Payload ID: 14093 relates to Category No.: 3354, 3452, 12431, 3353, 3448, 14612, 1238, 3352, 13904, 10638, 7157, 14998, 3455, 2425, 14838, 6535, 4143; Payload ID: 14094 relates to Category No.: 3452, 3354, 12431, 3448, 15257, 13904, 6680, 7157, 14998, 3455, 1955, 12619, 2424, 5750, 9296; Payload ID: 14095 relates to Category No.: 3354, 11940, 3452, 1955, 12431, 3353, 3448, 13729, 2022, 12786, 3379, 7157, 14998, 3455, 6687, 2425, 1926, 10518, 5254, 3336, 13371, 1901, 15263, 2004, 13732, 1978, 13969, 14025, 13827, 6686, 14052, 1935, 13839; Payload ID: 14096 relates to Category No.: 3354; Payload ID: 14097 relates to Category No.: 3452, 1955, 3354, 3353, 3448, 1893, 12120, 2083, 11660, 3352, 3454, 7157, 3319, 13262; Payload ID: 14098 relates to Category No.: 3354, 3353; Payload ID: 14099 relates to Category No.: 3452, 12431, 3320, 7157; Payload ID: 14100 relates to Category No.: 3354, 3353, 6687, 3370, 13827, 1955, 3448, 13904, 3452, 2424, 3167; Payload ID: 14101 relates to Category No.: 6814, 11512; Payload ID: 14102 relates to Category No.: 5805, 9228, 3452, 1955, 3356, 3354, 3448, 3309, 3357, 2022, 1723, 10866; Payload ID: 14103 relates to Category No.: 9228, 3452, 3356, 3354, 3448, 5805, 3309, 3357, 2022, 1723; Payload ID: 14104 relates to Category No.: 3309, 2022, 2139, 3452, 3354, 3448, 10636, 12436; Payload ID: 14106 relates to Category No.: 6670, 1047; Payload ID: 14109 relates to Category No.: 1204; Payload ID: 14110 relates to Category No.: 2461, 1047; Payload ID: 14112 relates to Category No.: 2461, 1047, 7245, 2462; Payload ID: 14113 relates to Category No.: 9500, 10173; Payload ID: 14114 relates to Category No.: 6814, 6814, 14038, 2885, 3021, 16197, 8818, 15817, 8540, 11485, 11497, 11684, 572, 1684, 575; Payload ID: 14115 relates to Category No.: 12648, 12942, 10366, 10648, 283, 10637, 3876, 8049, 12649, 3910, 3900, 11976, 2128, 13273, 11274, 10392, 10536, 12462, 13394, 8087, 7748, 13449, 7582, 6990, 780; Payload ID: 14116 relates to Category No.: 12091, 1026, 15618, 14661, 5785, 14565, 795, 13435, 7613, 5846, 10074, 15149, 5446, 6606, 348, 12498, 7743, 4186, 328, 12628, 12391, 1780, 7840, 4127, 3775, 14992, 5541, 16085, 8988, 1238, 16294, 11174, 8509, 12642, 1730, 14782, 11512, 7967, 15400, 11285, 15402, 13956, 4066, 1853, 5731, 5545, 3009, 13882, 4949; Payload ID: 14117 relates to Category No.: 749, 12139, 13840, 3486; Payload ID: 14118 relates to Category No.: 15207, 1070, 13840, 4859, 3486, 15448, 6744, 12027, 15189, 12139, 5650; Payload ID: 14119 relates to Category No.: 14661, 5785, 10702, 13393; Payload ID: 14120 relates to Category No.: 14661, 10702, 13393; Payload ID: 14121 relates to Category No.: 13485, 337, 13589, 3398; Payload ID: 14122 relates to Category No.: 13485, 337, 6738, 12381, 13363, 12850; Payload ID: 14123 relates to Category No.: 13485, 337, 6738, 12381, 13363, 12850, 10702; Payload ID: 14124 relates to Category No.: 14661, 10702, 14565, 12603, 12391, 8988; Payload ID: 14125 relates to Category No.:

14661, 14565, 10702, 1867, 14663; Payload ID: 14126 relates to Category No.: 14661, 14565, 10702, 12391; Payload ID: 14127 relates to Category No.: 14661, 14565, 10702; Payload ID: 14128 relates to Category No.: 14661, 10702; Payload ID: 14129 relates to Category No.: 15618, 14661, 15626, 14565, 10702, 3639, 13485, 12942, 2311; Payload ID: 14130 relates to Category No.: 12427; Payload ID: 14131 relates to Category No.: 11884, 3775; Payload ID: 14132 relates to Category No.: 7291, 16182; Payload ID: 14134 relates to Category No.: 5788, 14565, 10702, 12603, 16197, 14905, 11030, 13796, 1957, 11094, 2034; Payload ID: 14136 relates to Category No.: 5782, 11949, 7295, 11922; Payload ID: 14137 relates to Category No.: 15618, 14661, 12075, 11926, 1512, 2885, 15715, 11949, 1893, 14663, 4439, 16197, 16193, 7132, 7295, 12120, 7187, 7188, 5788, 11660, 1995, 4442, 7155, 5048, 12914, 4541, 16201, 12671, 8020, 12910, 13775; Payload ID: 14138 relates to Category No.: 12137, 5788; Payload ID: 14139 relates to Category No.: 5788; Payload ID: 14140 relates to Category No.: 9075, 11949, 3400, 11949, 15606, 14166; Payload ID: 14141 relates to Category No.: 1026, 6975, 7946, 11884; Payload ID: 14142 relates to Category No.: 14661, 14565, 10702, 7132, 8513, 2088, 13787, 2144; Payload ID: 14143 relates to Category No.: 10702, 3833, 13496, 13126, 12953, 10588, 11273, 13495, 13123, 13121, 11921; Payload ID: 14144 relates to Category No.: 1737, 14661, 12137, 5782, 14565, 687, 11506, 3398, 15715, 7154, 11949, 9238, 7168, 3336, 14663, 4439, 16197, 16193, 5790, 5790, 14165, 11242, 11949, 15606, 14172, 11922, 4442, 11696, 12035, 274, 1891, 6814; Payload ID: 14145 relates to Category No.: 12124, 5788; Payload ID: 14146 relates to Category No.: 12124, 5788; Payload ID: 14147 relates to Category No.: 12124, 5788; Payload ID: 14148 relates to Category No.: 12124, 5788; Payload ID: 14149 relates to Category No.: 12124, 5788; Payload ID: 14150 relates to Category No.: 12124, 5788; Payload ID: 14151 relates to Category No.: 1204, 12124, 5788; Payload ID: 14152 relates to Category No.: 11843, 15207, 5359, 11109, 1795, 12096, 10775, 16197, 15782, 8390, 13635, 11994, 10238, 10600, 8362, 11108, 11512; Payload ID: 14153 relates to Category No.: 14661, 14565, 10702, 15614, 348, 1925, 8988, 8860, 3876, 11094, 12387, 2068, 12636, 14589, 1240, 8524, 10093, 8552, 7946, 7693, 8367; Payload ID: 14154 relates to Category No.: 4828, 1026, 14661, 5785, 14565, 10702, 8962, 5446, 6606, 348, 7743, 4186, 12391, 1925, 4127, 11093, 3775, 8936, 5541, 16085, 8988, 12041, 1477, 10497, 432, 13530, 8860, 16138, 10583, 11242, 3876, 1932, 11265, 10313, 6990, 8934, 1240, 11094, 12387, 2068, 1300, 10312, 11600, 3877, 12636, 7864, 4256, 8270; Payload ID: 14155 relates to Category No.: 690, 14661, 5785, 14565, 10702, 10074, 1925, 1780, 14663, 1238, 1477, 13004, 12461, 11174, 3876, 3728, 11418, 10226, 10310, 12387, 8675, 11251, 11443, 11239, 11512, 2079, 1295, 6271, 2131, 11390, 14883, 1957, 11285, 13961, 7698, 7816, 10378, 859, 10701, 10299, 10770, 2031, 3440, 10188; Payload ID: 14156 relates to Category No.: 4828, 14661, 5785, 14565, 10702, 10074, 14663, 1238, 13004, 3728, 1420, 5544, 1477, 12851; Payload ID: 14157 relates to Category No.: 8862, 14661, 10702, 5785; Payload ID: 14158 relates to Category No.: 14661, 14565, 10702, 12942, 12391, 12041, 6990; Payload ID: 14159 relates to Category No.: 8862, 4828, 14661, 10702, 5785, 14565; Payload ID: 14160 relates to Category No.: 10702, 13485, 14565, 12942, 8303, 11182, 10379, 8375, 8047, 8716, 1980, 12603; Payload ID: 14161 relates to Category No.: 10702, 13485, 12649, 8378; Payload ID: 14162 relates to Category No.: 14661, 10702, 7913, 11012; Payload ID: 14163 relates to Category No.: 14661, 12137, 5782, 14565, 10702, 10074, 348, 9238, 1925, 14663, 8988, 1238, 13004, 8860, 10583, 3876, 3728, 11265, 11094, 12387, 2068, 11600, 12636, 8674, 1984, 2079, 6271, 10666, 1957, 13799, 7816, 11182, 13781; Payload ID: 14164 relates to Category No.: 14661, 12137, 5782, 14565, 10074, 9238, 1925, 12835, 1238, 3876, 12387, 12636; Payload ID: 14165 relates to Category No.: 14661, 12137, 5782, 14565, 275, 9238, 11285, 12041, 13049, 1892, 12754, 1957, 6990, 3900, 11240, 12387, 7737; Payload ID: 14166 relates to Category No.: 14661, 12137, 14565, 10074, 10075, 12387, 13382, 7737, 11240; Payload ID: 14167 relates to Category No.: 14661, 12137, 14565, 13259, 7737, 11240, 12387, 3877, 13382; Payload ID: 14168 relates to Category No.: 690, 13589, 3398, 11512, 16308, 14967, 2467, 11506, 3398, 5783, 13492, 15521, 4439, 8112, 15662, 7971, 2469, 10441, 7334, 2006, 8103, 12913, 11595, 13611, 12697, 13512, 2223, 2119, 15331, 15490, 3398, 2228, 2136, 2014, 9048, 2261, 12717, 13096; Payload ID: 14169 relates to Category No.: 13589, 3398, 14967, 8731, 3398, 8421, 11506, 3398, 5783, 16214, 15521, 4439, 14056, 4059, 2110, 12717, 14123, 14067, 14073, 607, 4828, 1295, 13874, 2469; Payload ID: 14170 relates to Category No.: 13589, 3398, 16308, 14967, 2467, 11506, 3398, 5783, 15521, 455, 4439, 10441, 12913, 6403, 8715, 13611, 12861, 15336, 13512, 2119, 15331, 9769, 2469; Payload ID: 14171 relates to Category No.: 14661, 12137, 14565; Payload ID: 14172 relates to Category No.: 14661, 12137, 14565; Payload ID: 14173 relates to Category No.: 14661, 12137, 5782, 14565, 12361, 9238; Payload ID: 14174 relates to Category No.: 14565, 10702, 3639, 6758, 901, 8671; Payload ID: 14175 relates to Category No.: 14661, 14565, 10702, 3639, 12603; Payload ID: 14176 relates to Category No.: 14565, 10702, 3639; Payload ID: 14178 relates to Category No.: 12137, 10702, 3639; Payload ID: 14179 relates to Category No.: 14565, 1820, 1023; Payload ID: 14180 relates to Category No.: 14565; Payload ID: 14181 relates to Category No.: 14565, 795; Payload ID: 14182 relates to Category No.: 14565; Payload ID: 14183 relates to Category No.: 14565, 3691, 12122; Payload ID: 14184 relates to Category No.: 14565, 1722, 7725, 1955, 12391, 11298, 12117, 5785; Payload ID: 14185 relates to Category No.: 12091, 14565, 1721, 10238, 10878, 12117, 11265, 8446, 11240, 5242, 14640, 1276, 9451, 13280, 3776, 13277, 13245, 8391; Payload ID: 14186 relates to Category No.: 14565; Payload ID: 14187 relates to Category No.: 14565, 1721; Payload ID: 14188 relates to Category No.: 5785, 14565, 795, 7743, 11298, 13365; Payload ID: 14189 relates to Category No.: 14565, 795, 10238; Payload ID: 14190 relates to Category No.: 14565, 15043, 7306; Payload ID: 14191 relates to Category No.: 12194, 1366; Payload ID: 14192 relates to Category No.: 1026, 14661, 5785, 14565, 10702, 10074, 5446, 6606, 348, 4186, 337, 12391, 4127, 3775, 11285, 5541, 16085, 8988, 10878, 1238, 10954, 10583, 10815, 11566, 12066, 12832, 11077, 11305, 10692, 2878, 5429, 13304, 11076, 11453, 14410, 16170, 11072, 6615; Payload ID: 14193 relates to Category No.: 14661, 5785, 14565, 10702, 10074, 12633, 12391, 1238, 1922; Payload ID: 14194 relates to Category No.: 1026, 14661, 5785, 10702, 5446, 6606, 348, 4186, 12391, 4127, 3775, 5541, 16085, 8988, 12942; Payload ID: 14195 relates to Category No.: 1026, 14661, 5785, 10702, 15614, 5446, 12931, 6606, 348, 1746, 4186, 12391, 1780, 4127, 3775, 5541, 16085, 8988, 11305, 355, 7372, 13842; Payload ID: 14196 relates to Category No.: 14661, 12137, 14565, 1722, 15521, 4439, 5541, 11502, 13637, 13588, 11138; Payload ID: 14197 relates to Category No.: 14661, 12137, 14565, 11109, 15464; Payload ID: 14198 relates to Category No.: 1026, 14661, 12137, 11091, 14565, 3766, 12638, 10074, 12526, 274, 12459, 13485, 14108, 10775, 9891, 7162, 10481, 16197, 16085, 8988, 1238, 15570, 15042, 11108, 16294, 14926, 11418, 10261, 7553, 9452, 7640, 785, 776, 10909, 14633, 13278, 2515, 15474; Payload ID: 14199 relates to Category No.: 690, 1026, 14661, 12137, 14565, 795, 1703, 10074, 10238, 13485, 14108, 2886, 3699, 1238, 2022, 7724, 10226, 15559, 2001, 5782; Payload ID: 14200 relates to Category No.: 1026, 14661, 12137, 14565, 13485, 10775, 2886, 16294, 14926, 776, 10909, 14633; Payload ID: 14201 relates to Category No.: 14661, 12137, 5782, 14565, 13485, 9238, 14108, 280, 10366, 6018, 10343, 4229, 12882, 12122, 12461; Payload ID: 14202 relates to Category No.: 14661, 12137, 5782, 14565, 13485, 286, 9238; Payload ID: 14203 relates to Category No.: 1026, 14661, 12137, 5782, 14565, 1713, 10074, 10372, 274, 11506, 3398, 13485, 337, 9238, 14108, 1238, 10588, 12365, 13449; Payload ID: 14204 relates to Category No.: 13589, 3398, 14661, 12137, 14565, 13485, 15194, 8049, 8103, 8468, 6612; Payload ID: 14205 relates to Category No.: 14661, 12137, 14565, 274, 13485, 12648, 14108, 14061; Payload ID: 14206 relates to Category No.: 14661, 12137, 11512, 14565, 2711, 12459, 13485, 5541, 2009, 10628, 10666, 4892, 7955, 12648; Payload ID: 14207 relates to Category No.: 6814, 14661, 12137, 14565, 7071, 13485, 7122, 7124, 1856; Payload ID: 14208 relates to Category No.: 6814, 14661, 12137, 14565, 7071, 13485, 7122, 7124, 1856; Payload ID: 14209 relates to Category No.: 14661, 12137, 5782, 14565, 12648, 2940, 13485, 9238, 11294, 274, 12365, 4332; Payload ID: 14210 relates to Category No.: 14661, 12137, 14565, 13485; Payload ID: 14211 relates to Category No.: 690, 14565, 12942, 7635, 1320, 16096; Payload ID: 14212 relates to Category No.: 1026, 14661, 5785, 14565, 10702, 3766, 12648, 8552, 5446, 6606, 348, 4186, 7141, 12942, 12391, 8373, 4127, 3564, 3775, 5541, 16085, 8988, 12465, 7719, 7754, 1249, 16096, 13442; Payload ID: 14213 relates to Category No.: 8552, 1026, 14661, 5785, 14565, 10702, 5446, 6606, 348, 4186, 12942, 12391, 4127, 3775, 5541, 16085, 8988; Payload ID: 14214 relates to Category No.: 1026, 14661, 5785, 14565, 10702, 1415, 8552, 5446, 6606, 348, 4186, 12942, 12391, 4127, 3775, 5541, 16085, 8988; Payload ID: 14215 relates to Category No.: 1026, 14661, 5785, 14565, 10702, 8552, 5446, 6606, 348, 4186, 12942, 12391, 4127, 3775, 5541, 16085, 8988, 8049, 1922; Payload ID: 14216 relates to Category No.: 5785, 14565, 10702, 8552, 12942; Payload ID: 14217 relates to Category No.: 1026, 14661, 5785, 14565, 10702, 8552, 5446, 6606, 348, 4186, 12942, 12391, 4127, 3775, 5541, 16085, 8988, 10494; Payload ID: 14218 relates to Category No.: 1026, 14661, 14565, 10702, 8552, 5446, 6606, 348, 4186, 12942, 12391, 4127, 3775, 5541, 16085, 8988; Payload ID: 14219 relates to Category No.: 10702, 8552, 1026, 14661, 14565, 5446, 6606, 348, 4186, 12942, 12391, 4127, 3775, 5541, 16085, 8988; Payload ID: 14220 relates to Category No.: 1026, 14661, 5785, 14565, 10702, 13435, 15149, 5446, 6606, 348, 4186, 337, 12391, 4127, 3775, 8936, 5541, 16085, 8988, 13530, 6322, 13392, 11305, 13395, 13236, 1780, 13252; Payload ID: 14221 relates to Category No.: 1026, 14661, 10702, 13435, 15149, 5446, 10238, 6606, 348, 803, 4186, 13485, 12391, 4127, 3775, 5541, 16085, 8988, 6323, 13252; Payload ID: 14222 relates to Category No.: 13589, 3398, 8739, 15517, 7306, 11506, 3398, 12391, 10573, 11425, 10890, 10953, 11623, 14927, 8731, 3398; Payload ID: 14223 relates to Category No.: 14565, 10702, 10383, 1749, 12391, 11084; Payload ID: 14224 relates to Category No.: 4828, 14661, 12137, 5782, 14565, 9238, 8731, 3398, 9052; Payload ID: 14225 relates to Category No.: 14661, 12137, 5782, 14565, 6296, 9238, 11266, 11292, 12582, 15149, 3436, 8547; Payload ID: 14226 relates to Category No.: 1026, 14661, 10702, 1752, 5446, 6606, 348, 4186, 12391, 4127, 3775, 5541, 16085, 8988, 11305; Payload ID: 14227 relates to Category No.: 14661, 10702; Payload ID: 14228 relates to Category No.: 14661, 10702; Payload ID: 14229 relates to Category No.: 14661, 12137, 5782, 14565, 9238, 12391, 8988; Payload ID: 14230 relates to Category No.: 14661, 12137, 5782, 14565, 15149, 9238, 8988; Payload ID: 14231 relates to Category No.: 14661, 12137, 14565, 7743, 7735, 13874; Payload ID: 14232 relates to Category No.: 14661, 12137, 14565; Payload ID: 14233 relates to Category No.: 14661, 12137, 14565, 11170, 13543; Payload ID: 14234 relates to Category No.: 15490, 3398, 14661, 12137, 14565, 11511; Payload ID: 14235 relates to Category No.: 14661, 12137, 14565, 8756; Payload ID: 14236 relates to Category No.: 14661, 12137, 14565; Payload ID: 14237 relates to Category No.: 14661, 12137, 14565, 7735; Payload ID: 14238 relates to Category No.: 1026, 14432, 14661, 12137, 5785, 14565, 5428, 3766, 1703, 12638, 15043, 10074, 5446, 10238, 674, 274, 1820, 803, 13485, 1767, 287, 4127, 4130, 11285, 16197, 16085, 8988, 1238, 10383, 8151, 6018, 14050, 7252, 15192, 14330, 11102, 11418, 12649, 10889, 12750, 11339, 11425, 8562, 10629, 12991, 13415, 6292, 9777, 3729, 5243, 3038, 1752, 12041, 2548, 4828, 3437, 11186, 2940, 12640, 3799, 3639, 14328, 3041, 10192, 2250, 1814, 13230, 2244, 15149, 4342, 16286, 10038, 12879, 990, 5327, 3601, 671, 3730, 2311, 2051, 286, 10522, 1780, 1277, 6613; Payload ID: 14239 relates to Category No.: 1026, 14661, 12137, 5782, 14565, 10074, 13485, 286, 9238, 1238, 11102, 11294, 10889, 12991, 12653, 13415, 6409, 13243, 2311, 274, 4828, 10372, 13360, 13562, 13110, 1775, 13109, 1277; Payload ID: 14240 relates to Category No.: 14661, 12137, 5785, 14565, 274, 13485, 10344, 11425, 1775, 5243, 12640, 8936, 8920, 8919, 13230, 2244, 15149, 4342; Payload ID: 14241 relates to Category No.: 1722, 795, 1727, 15521, 7635, 1905, 4439, 5541, 12519, 7187, 1892, 6451, 11502, 1906, 10482, 11503; Payload ID: 14242 relates to Category No.: 1722, 15521, 1905, 4439, 5541, 12519, 1892, 6451, 11502, 1906, 13588, 2116; Payload ID: 14243 relates to Category No.: 15490, 3398, 14661, 1722, 795, 1746, 14271, 15521, 1905, 4439, 5541, 12519, 1892, 6451, 11502, 1906, 13588, 2116; Payload ID: 14244 relates to Category No.: 1722, 15521, 4439, 5541, 12519, 1892, 6451, 11502, 1906, 2116; Payload ID: 14245 relates to Category No.: 14661, 12137, 14565, 10583, 1780, 8674, 7681, 2079, 1957, 13799, 1989; Payload ID: 14246 relates to Category No.: 13589, 3398, 15490, 3398, 1721, 998, 11285, 12519, 6451, 7613, 7965, 4949, 6269, 10378, 5912; Payload ID: 14247 relates to Category No.: 13589, 3398; Payload ID: 14248 relates to Category No.: 13589, 3398, 15490, 3398, 8731, 3398; Payload ID: 14251 relates to Category No.: 8906, 8739, 9125, 9169, 8402; Payload ID: 14252 relates to Category No.: 12603, 674, 1451, 12569; Payload ID: 14254 relates to Category No.: 13589, 3398, 15490, 3398, 8760, 9224, 14533, 4439, 9223, 3001, 8169, 4442, 10907, 2885, 7270; Payload ID: 14255 relates to Category No.: 14622, 1857; Payload ID: 14256 relates to Category No.: 13589, 3398, 11674, 8739, 8731, 3398, 10238, 7743, 11506, 3398, 2410, 8375, 8004, 7681, 8118, 1957, 10470, 8370, 1982, 7560, 7587, 7829, 5183, 1559, 1959, 7873, 8284, 7593, 15517, 11512, 4969, 15490, 3398, 13594; Payload ID: 14257 relates to Category No.: 10372, 3013, 11307, 13733, 2107; Payload ID: 14258 relates to Category No.: 13589, 3398, 15490, 3398, 11512, 11506, 3398, 2424, 3328; Payload ID: 14259 relates to Category No.: 3353, 6670; Payload ID: 14260 relates to Category No.: 12431, 14838, 14612, 6687, 15144, 3452, 14834, 6535, 4167, 14442, 15174, 9378; Payload ID: 14261 relates to Category No.: 3125, 12126, 11954; Payload ID: 14262 relates to Category No.: 3125, 12126, 11954; Payload ID: 14263 relates to Category No.: 3125, 12126, 11954; Payload ID: 14264 relates to Category No.: 3125, 12126, 11954; Payload ID: 14265 relates to Category No.: 3125, 12126, 11954; Payload ID: 14266 relates to Category No.: 5782, 12931, 690, 12137, 2000, 1417, 12041, 10309, 12409, 11253, 4828; Payload ID: 14267 relates to Category No.: 5782, 12931, 4828, 690, 12137, 2000, 1417, 4949, 12544, 1468, 1183, 14928, 10648, 12041, 448, 8807, 7919, 2143, 10226, 10309, 12409, 16096, 1091, 16090, 11600, 13835, 13882, 13989, 4145; Payload ID: 14268 relates to Category No.: 4828, 690, 12137, 5782, 2000, 8731, 3398, 12931, 1417, 12041, 10588, 10309, 12409, 11315, 1964, 4830; Payload ID: 14269 relates to Category No.: 12091, 334, 11940, 11512, 14565, 795, 5446, 10238, 5359, 11109, 344, 1795, 15190, 10775, 7965, 7840, 11934, 11765, 11285, 1888, 15782, 2136, 11307, 10878, 11858, 15456, 15450, 7363, 15448, 7548, 14029, 11573, 10855, 11566, 15653, 4039, 336, 13217, 11766, 12858, 13635, 7549, 8103, 10600, 9709, 11227, 3009, 10947, 663, 11081, 12510, 14188, 10955, 7966, 1993, 13397, 11201, 14189, 10356; Payload ID: 14270 relates to Category No.: 11954, 3683, 13035; Payload ID: 14271 relates to Category No.: 3683, 10491, 14450, 14458, 12139, 13035; Payload ID: 14272 relates to Category No.: 1737, 7154, 9165, 7156; Payload ID: 14273 relates to Category No.: 1737, 7154, 9165, 7156; Payload ID: 14274 relates to Category No.: 1204; Payload ID: 14275 relates to Category No.: 1204, 13035; Payload ID: 14276 relates to Category No.: 9720, 16286, 15614, 12091; Payload ID: 14277 relates to Category No.: 12091, 9720, 15614, 14565, 7306, 7743, 10366, 1730, 11506, 3398, 5459, 1741, 14793, 14640, 3578, 14656, 10314, 14699, 7693, 1621, 1257, 16286, 10038, 5912, 12583, 3585, 16286, 1424; Payload ID: 14278 relates to Category No.: 15149, 15149, 2370, 11089, 14617, 11088, 13326; Payload ID: 14279 relates to Category No.: 12091, 11512, 15207, 14565, 5428, 9720, 795, 7613, 5446, 403, 10238, 5359, 11109, 12498, 345, 7362, 10775, 8988, 11298, 15003, 5912, 15456, 15450, 7363, 15448, 15443, 15454, 11174, 11178, 10808, 10811, 10829, 15446, 15653, 15457, 15458, 15451, 9292, 6125, 9295, 11176, 9294, 2065, 11480, 10814, 10583, 13840, 10840, 10219, 13893, 11566, 11419, 6248, 2041, 3016, 10878, 10851, 15203, 2043, 10415, 10480, 11479, 2089, 13895, 10777, 9293, 13898; Payload ID: 14280 relates to Category No.: 12091, 11940, 14565, 1894, 5446, 11109, 803, 12471, 15197, 360, 11934, 11765, 11858, 15456, 15450, 7363, 15448, 7548, 11573, 15653, 11766, 15400, 14910, 11183, 6403, 13011, 663, 15195, 12477, 11081, 13560, 12473, 12611, 568, 10864, 11161, 13397, 11247, 5359, 9038, 11307, 10908; Payload ID: 14281 relates to Category No.: 12091, 7242, 11109; Payload ID: 14282 relates to Category No.: 12091, 9720, 1026, 8929, 16286, 8936, 1048, 14641, 7637, 7553, 2599, 2708; Payload ID: 14283 relates to Category No.: 5367, 9228, 1060, 3353, 11860, 5218, 16051, 15195, 11689, 15400, 403, 7840, 11452, 15197, 8680, 8715, 13557; Payload ID: 14284 relates to Category No.: 1060, 2409, 3353, 16051, 15195, 11689, 12153, 15194, 1063, 11143, 15199, 1062; Payload ID: 14285 relates to Category No.: 13589, 3398, 13594, 690, 11512, 8739, 8731, 3398, 3353, 15521, 9125, 4439, 3812, 9480, 10286, 3813, 8420, 10321, 10375, 9124, 11521, 1551, 3627, 16139, 13604, 11534, 973, 3439, 5985, 1247, 1243, 10582, 10565, 14782, 12646, 14392, 1060, 3013, 12891, 7743, 10648, 1741, 8929, 10372, 5285, 4949, 4998, 13582, 10034, 7730, 5429, 3771, 5939, 1250, 14398, 3625, 987, 5697, 860, 7377, 4938, 2487, 10315, 858; Payload ID: 14286 relates to Category No.: 13594, 13589, 3398, 15490, 3398, 14565, 11506, 3398; Payload ID: 14287 relates to Category No.: 14565, 10703, 10005, 16211, 14111, 13437, 16214, 12573, 10005; Payload ID: 14288 relates to Category No.: 3356, 3354, 3320, 3353, 3370; Payload ID: 14289 relates to Category No.: 3353; Payload ID: 14290 relates to Category No.: 1737, 3356, 3354, 3320, 7154, 3353, 3336, 8736, 2430, 6814; Payload ID: 14291 relates to Category No.: 3452, 3356, 3354, 3448, 3455, 7303, 4535, 13824, 13860, 12447; Payload ID: 14292 relates to Category No.: 3452, 3356, 3354, 3448, 3455; Payload ID: 14293 relates to Category No.: 12194, 1026, 9720, 1295, 1703, 7191, 12534, 2169, 11432, 11296, 12449, 10459, 11178, 11265, 4475, 10503, 10590, 8934, 11094, 13978, 13252, 11436, 4588, 5073, 1765, 14890, 2252, 11386, 10923, 10217, 2243, 6102, 12891, 3038, 1752, 4251, 6323, 12045, 6322, 901, 11502, 11187, 6082, 12412, 16123, 11652, 9078, 6074, 10894; Payload ID: 14294 relates to Category No.: 10372; Payload ID: 14295 relates to Category No.: 1780; Payload ID: 14296 relates to Category No.: 7306, 381, 1780, 5037, 10883, 11623, 8195; Payload ID: 14297 relates to Category No.: 381, 7362, 3016, 10883, 11623, 8195; Payload ID: 14299 relates to Category No.: 1836, 10250, 12577, 6050, 14838, 6271, 10702, 7613, 496, 6269, 5949, 10609, 8535, 11558, 8522, 8392, 8049, 7939, 8467, 11430, 10668, 7880, 11183, 7832, 11301, 8648, 10308, 8589, 7663, 7683, 7881, 10535, 8204; Payload ID: 14300 relates to Category No.: 5406; Payload ID: 14301 relates to Category No.: 5782, 8977, 15149, 12603, 16214, 6733, 15157, 11884, 10648, 14014, 12453, 1420, 4581, 10590, 10793, 10494, 13238, 14403, 13126, 13084, 1421, 6323, 3986; Payload ID: 14302 relates to Category No.: 5782, 13126, 1421, 12851, 10648, 1477, 5544, 1420, 10590, 10793, 10494, 14923, 8977; Payload ID: 14303 relates to Category No.: 8979, 13126, 1420, 7131, 13535; Payload ID: 14304 relates to Category No.: 3986, 8979, 13126, 13535; Payload ID: 14305 relates to Category No.: 3101; Payload ID: 14306 relates to Category No.: 15490, 3398, 11512, 10372, 12625, 3101; Payload ID: 14308 relates to Category No.: 13589, 3398, 14565, 12603, 2169, 1451, 12569, 1383, 1237, 13975, 14624, 13311, 13909, 6294, 14545, 14636, 13936, 13836, 8634; Payload ID: 14309 relates to Category No.: 12603, 1451, 12569, 13975, 9125, 1383, 6294, 14545; Payload ID: 14310 relates to Category No.: 11512, 12619, 7743, 2610, 360, 10648, 7598, 11363, 7924, 11418, 2006, 11033, 7659, 10350, 10467, 10578, 7847, 10478, 10446, 7752, 10514, 10597, 10552, 7133, 4181, 7959, 10598, 7985, 8319; Payload ID: 14311 relates to Category No.: 13589, 3398, 15490, 3398, 1721, 2409; Payload ID: 14312 relates to Category No.: 10702; Payload ID: 14313 relates to Category No.: 1737, 10702, 7154, 14894, 7168, 13171, 16197, 2429, 4332; Payload ID: 14314 relates to Category No.: 1737, 14661, 12638, 5592, 7154, 7132, 4229, 10638, 8049, 7992, 8667, 10252, 2427, 3900, 337, 12879, 13449; Payload ID: 14315 relates to Category No.: 8617, 10005, 16211, 14111, 13437, 3140; Payload ID: 14316 relates to Category No.: 5367, 14565, 10702, 12931, 439, 8617; Payload ID: 14317 relates to Category No.: 10702, 8617; Payload ID: 14318 relates to Category No.: 4828, 5785, 10702, 12931, 8617; Payload ID: 14319 relates to Category No.: 15490, 3398, 5785, 14565, 10702, 12931, 12603, 8617, 15288, 8040; Payload ID: 14320 relates to Category No.: 10702, 4828, 8040; Payload ID: 14321 relates to Category No.: 1737, 5785, 14565, 10702, 13975, 14905, 12931, 9238, 7946, 2429, 6322, 10093, 6102, 16213, 16339, 8671, 8255, 12778, 11087, 6323, 7154, 12603; Payload ID: 14322 relates to Category No.: 10702, 12931, 16214, 8617; Payload ID: 14323 relates to Category No.: 10702, 8617; Payload ID: 14324 relates to Category No.: 8617, 10702, 4828, 12931; Payload ID: 14325 relates to Category No.: 4828, 14661, 1002, 10702, 8617; Payload ID: 14326 relates to Category No.: 1721, 12931, 13618, 8255, 8040, 7703, 10322, 13686, 8462, 12480, 14838, 7692, 1334, 13690, 10702, 11008; Payload ID: 14327 relates to Category No.: 10702, 12931, 8617; Payload ID: 14328 relates to Category No.: 10702, 8617; Payload ID: 14329 relates to Category No.: 10702, 8617; Payload ID: 14330 relates to Category No.: 10702, 12931, 5407; Payload ID: 14331 relates to Category No.: 12931, 5407, 10702, 8040; Payload ID: 14332 relates to Category No.: 10702, 12931, 8617; Payload ID: 14333 relates to Category No.: 4828, 5785, 10702, 12931, 8617; Payload ID: 14334 relates to Category No.: 4828, 10702, 5785, 8617, 12931; Payload ID: 14335 relates to Category No.: 8617, 4828; Payload ID: 14336 relates to Category No.: 10702, 8617; Payload ID: 14337 relates to Category No.: 4828, 5785, 12931, 16214, 8617, 10005, 16211, 14111, 13437, 8862, 10702, 13836, 3431; Payload ID: 14338 relates to Category No.: 10702; Payload ID: 14341 relates to Category No.: 795, 1730, 1836; Payload ID: 14342 relates to Category No.: 9232, 3452, 3356, 3354, 3320, 3448, 15257, 14663, 12786, 3455, 11467, 15258, 15267, 11466, 11469, 8691, 8694, 11470, 6814; Payload ID: 14343 relates to Category No.: 1722, 1746, 15521, 4439, 5541, 15464, 6451, 1995, 11502, 1906, 11291, 12649, 12671, 2077, 11530, 13313, 10558; Payload ID: 14344 relates to Category No.: 13594, 13589, 3398, 5367, 15490, 3398; Payload ID: 14345 relates to Category No.: 13594, 13589, 3398, 15490, 3398; Payload ID: 14346 relates to Category No.: 13594, 13589, 3398, 11512, 8731, 3398, 11506, 3398, 2459, 13004, 3632, 1751, 3809, 2465, 11571, 3176, 15490, 3398, 15808; Payload ID: 14347 relates to Category No.: 13589, 3398, 11512, 15517, 2459, 8641, 13594, 4251, 13372, 15247, 3441, 2216, 6995; Payload ID: 14348 relates to Category No.: 13594, 13589, 3398, 15490, 3398, 8739; Payload ID: 14349 relates to Category No.: 13589, 3398, 11512, 15517, 11506, 3398, 13004, 3632, 10802, 4535, 15806, 9557, 9559, 9560; Payload ID: 14350 relates to Category No.: 13594, 13589, 3398; Payload ID: 14351 relates to Category No.: 13594, 15490, 3398, 11512, 12391; Payload ID: 14352 relates to Category No.: 11506, 3398; Payload ID: 14353 relates to Category No.: 13589, 3398, 15490, 3398, 15626, 8771; Payload ID: 14355 relates to Category No.: 1026, 14661, 12137, 5782, 14565, 15149, 9238, 12391, 4067, 12832, 10226, 6141, 13361, 7737; Payload ID: 14356 relates to Category No.: 14661, 12137, 14565, 9455, 13228, 5782, 9238, 10366, 12391, 1886, 6814; Payload ID: 14357 relates to Category No.: 14565, 4145; Payload ID: 14358 relates to Category No.: 10648, 4145, 10226, 10309, 13136; Payload ID: 14360 relates to Category No.: 4828, 1730, 4021, 442, 9590, 6374, 9039; Payload ID: 14361 relates to Category No.: 4828, 6530, 434, 7613, 7743, 10309, 439, 9378; Payload ID: 14362 relates to Category No.: 4828, 8962, 10481, 9932; Payload ID: 14363 relates to Category No.: 4828, 8962, 702, 9932, 10614; Payload ID: 14364 relates to Category No.: 5367, 5428, 12498, 7306, 803, 12646, 15782, 13925, 10955; Payload ID: 14366 relates to Category No.: 10383; Payload ID: 14367 relates to Category No.: 14661, 12137, 3986, 2459, 12851, 1892, 13665; Payload ID: 14368 relates to Category No.: 2167, 2411, 8731, 3398, 3399, 5443, 11506, 3398, 9274, 11611, 7879, 9279; Payload ID: 14369 relates to Category No.: 9500, 13909, 13834, 14002, 13801; Payload ID: 14370 relates to Category No.: 12194, 13105, 12544, 1893, 5949, 696, 6530, 13970, 5268, 1751, 6812, 3469, 12550, 13727, 13925, 13827, 1957, 13797, 13883, 1149, 13803; Payload ID: 14371 relates to Category No.: 12544, 7443, 7455, 7458, 7912, 7710; Payload ID: 14373 relates to Category No.: 10331, 13589, 3398, 15490, 3398, 3386, 9296, 3356, 3354, 3852, 15257, 1089, 7132, 15533, 15261, 15605, 9296, 3327, 3369, 3313, 3132, 4485, 15259, 15260, 9296, 3322, 3851; Payload ID: 14374 relates to Category No.: 3452, 9296, 3356, 3354, 3852, 3448, 15257, 1089, 7132, 15533, 15605, 9296, 3327, 3369, 3313, 3132, 4485, 15259, 15260, 9296, 3322, 3851, 10004, 2333; Payload ID: 14375 relates to Category No.: 3452, 9296, 3356, 3354, 3852, 3448, 15257, 1089, 7132, 15533, 15605, 9296, 3327, 3369, 3313, 3132, 13972, 4485, 15259, 15260, 9296, 3322, 3851, 3371; Payload ID: 14376 relates to Category No.: 3356, 3452, 9296, 3354, 3852, 3448, 15257, 1089, 7132, 15533, 15605, 9296, 3327, 3369, 3313, 3132, 4485, 15259, 15260, 9296, 3322, 3851; Payload ID: 14377 relates to Category No.: 3452, 9296, 3356, 3354, 3852, 3448, 15257, 1089, 7132, 15533, 15605, 9296, 3327, 3369, 3313, 3132, 4485, 15259, 15260, 9296, 3322, 3851; Payload ID: 14378 relates to Category No.: 3356, 12866, 12912; Payload ID: 14379 relates to Category No.: 3356, 7018, 3386, 3452, 9296, 3354, 3353, 3852, 3448, 15257, 1089, 1893, 7132, 5750, 12120, 4332, 11660, 1995, 15533, 15605, 12671, 9296, 3327, 3369, 3313, 3132, 4485, 15259, 15260, 9296, 3322, 3851, 5406, 5243, 10372, 4998, 6687, 2424; Payload ID: 14380 relates to Category No.: 7018, 3452, 9296, 3356, 3354, 3353, 3852, 3448, 7148, 15257, 1089, 7132, 5750, 12786, 4332, 1995, 15533, 15605, 12671, 9296, 3327, 3369, 3313, 3132, 4485, 15259, 15260, 9296, 3322, 3851, 12769; Payload ID: 14381 relates to Category No.: 7018, 3452, 9296, 3356, 3354, 3353, 3852, 3448, 15257, 1089, 7132, 5750, 4332, 1995, 15533, 15605, 12671, 9296, 3327, 3369, 3313, 3132, 4485, 15259, 15260, 9296, 3322, 3851, 12646, 13166; Payload ID: 14382 relates to Category No.: 9296, 3356, 3354, 3353, 3309, 7132, 3360, 4332; Payload ID: 14383 relates to Category No.: 1204; Payload ID: 14384 relates to Category No.: 1721, 3354, 3448, 15257, 3453, 14949, 10534; Payload ID: 14385 relates to Category No.: 13166, 1722; Payload ID: 14387 relates to Category No.: 1026, 11512, 1257, 8887, 11094, 8378, 7639, 7819; Payload ID: 14388 relates to Category No.: 1257, 14565, 11506, 3398, 1703, 1026; Payload ID: 14389 relates to Category No.: 15588, 11024; Payload ID: 14392 relates to Category No.: 14661, 12137, 14565; Payload ID: 14393 relates to Category No.: 1204, 13936, 11390, 496, 13888, 11391, 11436, 7977, 4094, 11226, 10447; Payload ID: 14394 relates to Category No.: 1780; Payload ID: 14396 relates to Category No.: 13589, 3398, 15490, 3398; Payload ID: 14397 relates to Category No.: 13589, 3398, 15490, 3398; Payload ID: 14404 relates to Category No.: 12091, 334, 14565, 5255, 9720, 12614, 11506, 3398, 10366, 10344, 2110, 8924, 11094, 10601, 6741, 13978, 11644, 9770, 10995, 6416, 6606, 16005, 10648, 8929, 15614, 3581, 12526, 8862, 8869, 8933, 10378, 16001, 3737, 11368, 14056, 13827, 11092, 5465; Payload ID: 14406 relates to Category No.: 14098, 4771, 8918, 10588, 14617; Payload ID: 14407 relates to Category No.: 5406, 1463; Payload ID: 14410 relates to Category No.: 8929; Payload ID: 14411 relates to Category No.: 12911, 5781; Payload ID: 14412 relates to Category No.: 795, 16172, 16197, 3683; Payload ID: 14413 relates to Category No.: 795, 12638, 12498, 12526, 1048, 7735, 8988, 1035, 3683, 7640, 7636, 12565, 2249, 8862, 1549, 13221; Payload ID: 14414 relates to Category No.: 9500; Payload ID: 14415 relates to Category No.: 10702, 12526, 1048, 8988, 7640, 7636, 8953; Payload ID: 14416 relates to Category No.: 1031; Payload ID: 14417 relates to Category No.: 1031; Payload ID: 14418 relates to Category No.: 11512, 15517, 16214, 13589, 3398, 9599, 1463, 1295, 6192, 5334; Payload ID: 14419 relates to Category No.: 13589, 3398, 15490, 3398, 16214, 14014; Payload ID: 14420 relates to Category No.: 16214, 14014, 14056; Payload ID: 14422 relates to Category No.: 4828, 16214, 10005, 12166; Payload ID: 14423 relates to Category No.: 1703, 16214, 14059, 12891, 1465, 14060; Payload ID: 14424 relates to Category No.: 4828, 16214, 10005, 12166; Payload ID: 14425 relates to Category No.: 14090, 16214, 16216, 14057, 3140, 14086, 10005, 16211, 14059, 14056, 5541, 1959, 13436, 14071, 13921, 2469, 1463, 8886; Payload ID: 14426 relates to Category No.: 15626, 16214, 16216, 14086, 10005, 16211; Payload ID: 14427 relates to Category No.: 5785, 9994, 16214, 1047, 9993, 14056, 10005, 16211, 14067, 14073, 9996, 14059, 2038; Payload ID: 14428 relates to Category No.: 5785, 1047, 9993, 14056; Payload ID: 14429 relates to Category No.: 1764, 12137, 11926, 10702, 2940, 16214, 9420, 11646; Payload ID: 14430 relates to Category No.: 2562, 14271; Payload ID: 14431 relates to Category No.: 5782, 10702, 16214, 2459, 5793, 4059, 14059, 2038; Payload ID: 14432 relates to Category No.: 16214, 4059, 14014, 14056, 8885; Payload ID: 14433 relates to Category No.: 1204, 15490, 3398, 1722, 13070, 12619, 2411, 8731, 3398, 687, 13166, 11506, 3398, 11032, 12391, 7134, 7997, 16197, 7132, 4332, 8522, 8611, 13612, 1723, 7381, 8742, 14611, 6500, 12010, 2192, 12720, 12679, 8739, 11512, 7743, 14620, 7724, 1737, 8929, 8936, 3246, 7939, 8639, 10947, 5016, 8923, 8318, 8933, 1766, 15011, 2154, 3747, 4473, 8751; Payload ID: 14434 relates to Category No.: 13589, 3398, 15490, 3398, 952, 12619, 2167, 2411, 3356, 7743, 9274, 2410, 4439, 7132, 4336, 12891, 3783, 8004, 3783, 3364, 3365, 2403, 13866; Payload ID: 14435 relates to Category No.: 13589, 3398, 15490, 3398, 1955, 5159, 2410, 13836; Payload ID: 14436 relates to Category No.: 12153, 12154, 1955, 3356, 12775, 5406, 7303, 3602, 14790; Payload ID: 14437 relates to Category No.: 15490, 3398, 2167, 3356, 7306, 9274, 1780, 2410, 7735, 4439, 12891, 3783, 8004, 3783, 1855, 8739, 8731, 3398, 14011; Payload ID: 14438 relates to Category No.: 1737, 13594, 8739, 9228, 3452, 9296, 3354, 7154, 3448, 6670, 3309, 4335, 1723, 3455, 3319, 4332, 1230, 13835; Payload ID: 14439 relates to Category No.: 6814, 12646; Payload ID: 14440 relates to Category No.: 15490, 3398, 11512, 13070, 12619, 2409, 15521, 4439, 16197, 7132, 15570, 8739, 13594, 1721; Payload ID: 14441 relates to Category No.: 13594, 1721, 12619, 15490, 3398, 13070, 2409, 7132; Payload ID: 14442 relates to Category No.: 12994, 7540, 15200, 5367; Payload ID: 14443 relates to Category No.: 5367, 7540; Payload ID: 14444 relates to Category No.: 5367, 7540; Payload ID: 14445 relates to Category No.: 11512, 2467, 11506, 3398, 13594, 14640, 8337; Payload ID: 14447 relates to Category No.: 3564; Payload ID: 14448 relates to Category No.: 7743; Payload ID: 14449 relates to Category No.: 5428, 1730, 2311, 11285, 13069, 10606, 10667, 14086, 10419, 5406, 3576, 10942; Payload ID: 14450 relates to Category No.: 6212, 7743, 9945; Payload ID: 14451 relates to Category No.: 12091, 13589, 3398, 11512, 14565, 14967, 10372, 8731, 3398, 11506, 3398, 15521, 4439, 14083, 1965, 8129, 8782, 10845, 2110, 14000, 10349, 10275, 8041, 10832, 10848, 790, 11486, 8739, 7303, 16005, 8887, 10648, 7613, 8004, 14838, 3571, 2041, 4458, 7730, 7708, 1269, 8765, 6192, 4066, 16131, 4470, 4885, 15477, 9481, 2373, 12933, 14522, 6530, 13835, 12498, 14040, 6269, 13837, 7743, 4145, 11091, 5073, 13818, 8760, 11821, 13200, 13530, 15490, 3398; Payload ID: 14452 relates to Category No.: 13589, 3398, 15490, 3398, 14967, 14083, 14565, 15521, 4439, 3576, 8739, 11512, 7303, 16005, 10238, 7743, 14056, 7613, 10372, 8906, 7708, 1269, 3594, 16131, 7799, 4470, 14072, 4885, 11227, 3582, 9481, 15016, 11091, 13200; Payload ID: 14453 relates to Category No.: 13589, 3398, 11512, 8739, 14967, 1483, 10238, 7743, 15521, 4439, 14083, 3582, 3594, 12649, 14000, 11227, 7303, 724, 12891, 8887, 14056, 10648, 1463, 7613, 10372, 2110, 3571, 1274, 3819, 7730, 2374, 7708, 13739, 4468, 1269, 11822, 6192, 13202, 4066, 7799, 4470, 14072, 4885, 15477, 4944, 4882, 13200; Payload ID: 14454 relates to Category No.: 13589, 3398, 11512, 8739, 14967, 1184, 15521, 2355, 1867, 14663, 4439, 14083, 7187, 11941, 16234, 1189, 14000, 9764, 13594, 5406, 16133, 1463, 3566, 10036, 14407, 6625, 11551, 16131, 12559, 11524, 5428, 13969, 13859, 496, 14040, 6269, 13966, 13837, 10238, 7743, 4145, 7002, 13200, 2009, 14004, 14045, 1031; Payload ID: 14455 relates to Category No.: 13589, 3398, 11512, 14967, 15521, 4439, 15490, 3398, 5406, 14083, 1560, 6625, 16131, 13200, 11308; Payload ID: 14456 relates to Category No.: 13589, 3398, 14967, 15521, 4439, 11512, 14083, 11941, 11524, 15490, 3398; Payload ID: 14457 relates to Category No.: 15626, 16216, 14080, 14090, 12933, 14040, 14078, 14086, 10005, 16211; Payload ID: 14458 relates to Category No.: 15626, 3781, 16216, 14086, 10005, 16211; Payload ID: 14459 relates to Category No.: 12194, 6219, 15626, 16214, 14086, 10005, 16211; Payload ID: 14460 relates to Category No.: 15626, 14090, 4949, 16214, 1567, 4521, 16041, 6494, 4057, 3608, 10801, 3603, 14086, 10005, 16211, 14000, 7701, 4535, 6375, 3612, 4954, 14092, 4136, 10787, 16069, 16019, 13837; Payload ID: 14461 relates to Category No.: 15626; Payload ID: 14462 relates to Category No.: 15626; Payload ID: 14463 relates to Category No.: 6814, 9500, 14090, 16214, 14086, 10005, 16211, 14071, 5406, 6878, 9410, 3571, 3602, 3584, 4789, 3614, 9120, 3519, 1340, 8865, 14078, 11731; Payload ID: 14464 relates to Category No.: 6814, 9500, 14090, 14086, 10005, 16211, 14071, 402; Payload ID: 14465 relates to Category No.: 6814, 9500, 14090, 9994, 16214, 14086, 10005, 16211; Payload ID: 14466 relates to Category No.: 6814, 9500, 4059, 14058, 13872; Payload ID: 14467 relates to Category No.: 6814, 9500, 9455, 14090; Payload ID: 14468 relates to Category No.: 6219, 6814, 9500; Payload ID: 14469 relates to Category No.: 6814, 9500, 14090, 16214, 14086, 10005, 16211; Payload ID: 14470 relates to Category No.: 6814, 9500, 3932, 16214, 14090; Payload ID: 14471 relates to Category No.: 9500, 14090; Payload ID: 14472 relates to Category No.: 1703, 7306, 16214, 14058, 402; Payload ID: 14475 relates to Category No.: 7306; Payload ID: 14476 relates to Category No.: 3356, 3354, 14034, 3852, 15605; Payload ID: 14477 relates to Category No.: 3852, 3386, 9228, 3354, 15605; Payload ID: 14478 relates to Category No.: 7912, 7737, 4021, 3566, 3584, 1248; Payload ID: 14479 relates to Category No.: 9228; Payload ID: 14481 relates to Category No.: 13589, 3398, 9228; Payload ID: 14482 relates to Category No.: 8862, 6814, 1730, 9599, 9410, 11125, 11242, 8402; Payload ID: 14484 relates to Category No.: 6227, 1517, 12063, 1893, 3405, 4702, 11660; Payload ID: 14485 relates to Category No.: 13594, 13589, 3398, 3632, 15490, 3398; Payload ID: 14486 relates to Category No.: 10814, 3900, 15400, 5242, 15207, 10841, 10815, 11460, 11319; Payload ID: 14487 relates to Category No.: 10702, 14097, 3698, 7763; Payload ID: 14488 relates to Category No.: 643, 645; Payload ID: 14489 relates to Category No.: 643, 645; Payload ID: 14490 relates to Category No.: 15618, 643, 645, 15537; Payload ID: 14491 relates to Category No.: 643, 645, 15618, 3791, 5244, 619, 1861, 15537, 13298; Payload ID: 14492 relates to Category No.: 15618, 643, 1181, 14663, 1861, 1522, 645, 7308, 3853; Payload ID: 14493 relates to Category No.: 14661, 1026, 12137, 14565, 286, 7719, 8944; Payload ID: 14494 relates to Category No.: 14661, 12137, 14565, 10448; Payload ID: 14495 relates to Category No.: 14661, 12137, 14565, 1703, 274; Payload ID: 14496 relates to Category No.: 14432, 14661, 10702, 7613, 12603, 12526, 13485, 14108, 8988, 7252, 7719, 10261, 7640, 13363, 12648, 2079, 2051, 7737, 2108; Payload ID: 14497 relates to Category No.: 5367, 14661, 10702, 12603, 274, 7306, 13485, 14108, 7252, 7719, 8778, 2108; Payload ID: 14498 relates to Category No.: 12603, 14661, 10702, 13485, 14108, 7719, 13363; Payload ID: 14499 relates to Category No.: 14661, 14565, 10702, 13485, 14108, 11371, 12942; Payload ID: 14500 relates to Category No.: 14661, 14565, 10702, 795, 12498, 13485, 11765, 7613, 2940; Payload ID: 14501 relates to Category No.: 14661, 14565, 10702, 13485; Payload ID: 14502 relates to Category No.: 14661, 14565, 13485, 2243; Payload ID: 14503 relates to Category No.: 14661, 14565, 10702, 13485, 7241; Payload ID: 14504 relates to Category No.: 14661, 14565, 10702, 12648, 13485; Payload ID: 14505 relates to Category No.: 14661, 14565, 10702, 13485; Payload ID: 14506 relates to Category No.: 14661, 14565, 10702, 12648, 12459, 13485, 12465, 12642; Payload ID: 14507 relates to Category No.: 14565, 14661, 10702, 13485; Payload ID: 14508 relates to Category No.: 14661, 14565, 10702, 13485; Payload ID: 14509 relates to Category No.: 14565, 10702, 4766, 9421, 3881, 6495, 12798; Payload ID: 14510 relates to Category No.: 690, 13589, 3398, 15490, 3398, 14661, 14565, 10702, 1730, 13485; Payload ID: 14511 relates to Category No.: 14661, 14565, 10702, 13485; Payload ID: 14512 relates to Category No.: 690, 14661, 14565, 1730, 13485, 337, 16294, 14927, 8600, 8551; Payload ID: 14513 relates to Category No.: 14565, 10702, 14661, 13485; Payload ID: 14514 relates to Category No.: 8862, 14661, 14565, 10702, 274, 10061, 13485; Payload ID: 14515 relates to Category No.: 14565, 10702, 12427; Payload ID: 14516 relates to Category No.: 14661, 14565, 10702, 13485; Payload ID: 14517 relates to Category No.: 5785, 14565, 14661, 10702, 13485, 14108; Payload ID: 14518 relates to Category No.: 14565, 14661, 10702, 13485; Payload ID: 14519 relates to Category No.: 14661, 14565, 10702, 13485; Payload ID: 14520 relates to Category No.: 14661, 14565, 10702, 13485; Payload ID: 14521 relates to Category No.: 14661, 12137, 14565, 10702, 13485; Payload ID: 14522 relates to Category No.: 1026, 15490, 3398, 14661, 14565, 10702, 8739, 8731, 3398, 13485, 8807, 8887, 1463, 12648, 11094, 4251, 8584; Payload ID: 14523 relates to Category No.: 14661, 14565, 10702, 13485; Payload ID: 14524 relates to Category No.: 1026, 14661, 14565, 13485; Payload ID: 14525 relates to Category No.: 14565, 7737, 14661, 10702, 2940, 10238, 803, 13485, 14108, 11371, 8988, 8862, 7989, 7636; Payload ID: 14526 relates to Category No.: 14565, 14661, 10702, 13485; Payload ID: 14527 relates to Category No.: 14565, 10702; Payload ID: 14528 relates to Category No.: 14661, 14565, 10702, 3986, 13485; Payload ID: 14529 relates to Category No.: 14661, 14565, 10702, 1703, 13485, 14108, 10366, 12649, 10983, 6559; Payload ID: 14530 relates to Category No.: 14661, 14565, 13485, 14108, 11371, 287, 7992, 11190, 355, 8661, 10702, 286, 12942, 4229; Payload ID: 14531 relates to Category No.: 14661, 14565, 10702, 13485, 10583; Payload ID: 14532 relates to Category No.: 14661, 14565, 10702, 13485; Payload ID: 14533 relates to Category No.: 10702, 13435, 12526, 14108, 1780, 8988, 7640; Payload ID: 14534 relates to Category No.: 13435, 337, 2196, 7162, 7370, 11418, 10702; Payload ID: 14535 relates to Category No.: 10702, 13435, 11418, 14932; Payload ID: 14536 relates to Category No.: 4828, 1026, 14661, 10702, 13435, 10238, 12633, 274, 803, 11506, 3398, 13485, 14108, 2886, 3871, 8988, 7252, 15012; Payload ID: 14537 relates to Category No.: 4828, 1026, 14661, 5785, 10702, 13435, 10238, 803, 13485, 8988; Payload ID: 14538 relates to Category No.: 10702, 13435, 12603, 11418, 8670, 14061; Payload ID: 14539 relates to Category No.: 14661, 1713, 13435, 10238, 803, 13485, 337, 8988, 10588, 10702; Payload ID: 14540 relates to Category No.: 14661, 10702, 13435, 10238, 274, 803, 13485, 8988; Payload ID: 14541 relates to Category No.: 13435, 12459, 10702, 16294; Payload ID: 14542 relates to Category No.: 10702, 13435; Payload ID: 14543 relates to Category No.: 10702, 13435; Payload ID: 14544 relates to Category No.: 1026, 5785, 10702, 13435, 3766, 2175, 8905; Payload ID: 14545 relates to Category No.: 14661, 5785, 10702, 13435, 10238, 803, 13485, 14108, 8988; Payload ID: 14546 relates to Category No.: 10702, 13435; Payload ID: 14548 relates to Category No.: 10702, 13435; Payload ID: 14549 relates to Category No.: 10702, 13435; Payload ID: 14550 relates to Category No.: 10702, 13435, 10366; Payload ID: 14551 relates to Category No.: 14661, 5785, 10702, 13435, 10238, 803, 13485, 8988, 6018, 4200; Payload ID: 14552 relates to Category No.: 10702, 13435; Payload ID: 14553 relates to Category No.: 5785, 13435, 12459, 12942, 12746, 11363, 10879, 11418, 11257, 274, 10702, 11213, 7376; Payload ID: 14554 relates to Category No.: 1026, 14661, 5785, 14565, 10702, 13435, 3766, 10238, 803, 13485, 3775, 8988, 4766, 6018, 4229, 7933, 10625, 11425, 10890, 12941, 11242, 4969, 10699; Payload ID: 14555 relates to Category No.: 14661, 10702, 13435, 12648, 10238, 274, 803, 13485, 8988, 15570; Payload ID: 14556 relates to Category No.: 1737, 1764, 14661, 11512, 5785, 5782, 10702, 13435, 5446, 10238, 11109, 803, 13485, 7154, 286, 8362, 8300, 12646, 8988, 2136, 11178, 10851, 11566, 7967, 2065, 1857, 8180, 3889, 8370; Payload ID: 14557 relates to Category No.: 12091, 1026, 14661, 5785, 14565, 795, 3766, 5359, 2711, 274, 12614, 12459, 14693, 14108, 12835, 11765, 7598, 16085, 13515, 6145, 1844, 8507, 7386, 3910, 8355, 12836, 7651, 12882, 12642, 13052, 6149, 10629, 6137, 6753, 773, 8373, 1232, 12466; Payload ID: 14558 relates to Category No.: 12091, 1026, 14661, 5785, 14565, 3766, 5359, 2711, 274, 12614, 12459, 14693, 14108, 2196, 2886, 12835, 11285, 10648, 7598, 16085, 13515, 10557, 3910, 8355, 12836, 7651, 12717, 12882, 12642, 14123, 13052, 2125; Payload ID: 14559 relates to Category No.: 4828, 9420, 12166, 14086, 10005, 16211, 14111, 13437, 201, 16214, 2038, 12091, 14056, 9994, 10005, 14452, 13921, 3139, 12442; Payload ID: 14560 relates to Category No.: 12137, 13337, 1752, 1780, 12818, 13373, 8540; Payload ID: 14561 relates to Category No.: 12137, 12818, 13373, 8540; Payload ID: 14562 relates to Category No.: 12194, 795, 2139, 7613, 11660, 11243, 14835, 6740, 2138, 3835, 11359, 6741, 11288, 6742, 3829; Payload ID: 14563 relates to Category No.: 12194; Payload ID: 14564 relates to Category No.: 12194, 6606, 6269, 11243, 14051, 13373, 8358, 12475; Payload ID: 14565 relates to Category No.: 14565, 12099; Payload ID: 14566 relates to Category No.: 12099; Payload ID: 14567 relates to Category No.: 12099; Payload ID: 14568 relates to Category No.: 14661; Payload ID: 14569 relates to Category No.: 14589, 14108, 2886, 14838, 14831, 4328, 266; Payload ID: 14570 relates to Category No.: 3808; Payload ID: 14571 relates to Category No.: 14661, 14565, 12603; Payload ID: 14572 relates to Category No.: 14661, 14565; Payload ID: 14573 relates to Category No.: 14661, 12137, 14565, 13485; Payload ID: 14574 relates to Category No.: 14661, 12137, 14565, 13485; Payload ID: 14575 relates to Category No.: 14661, 6814, 14097, 3698; Payload ID: 14576 relates to Category No.: 14661, 14565, 795, 14108, 8049; Payload ID: 14577 relates to Category No.: 4998, 14565, 10372; Payload ID: 14578 relates to Category No.: 13589, 3398, 15490, 3398, 7306, 4367, 5786, 14534, 2110; Payload ID: 14579 relates to Category No.: 13589, 3398; Payload ID: 14580 relates to Category No.: 13589, 3398; Payload ID: 14583 relates to Category No.: 9982, 795, 14663, 14126, 16234, 16275, 11070, 14128, 4226, 12397; Payload ID: 14584 relates to Category No.: 1514, 3467, 3468; Payload ID: 14585 relates to Category No.: 3356, 13698, 14216, 3656, 14216, 14199; Payload ID: 14586 relates to Category No.: 14216, 3656, 7018, 3356, 14216, 14211, 3356, 13698, 14199; Payload ID: 14587 relates to Category No.: 14199, 5406, 10626, 8004, 12887, 14216, 3656, 12769, 14156; Payload ID: 14588 relates to Category No.: 14216, 3656, 14199; Payload ID: 14589 relates to Category No.: 12091, 7288, 14216, 3656, 15618, 11512, 2885, 3021, 8818, 15817, 4094, 13186, 10667, 14318; Payload ID: 14590 relates to Category No.: 14216, 3656, 15715, 4439; Payload ID: 14591 relates to Category No.: 14216, 3656, 15715, 14216, 4439, 13827; Payload ID: 14592 relates to Category No.: 14216, 3656, 15715, 4439; Payload ID: 14594 relates to Category No.: 14216, 3656, 15715, 14216, 4439; Payload ID: 14595 relates to Category No.: 14216, 3656, 15715, 14216, 4439; Payload ID: 14596 relates to Category No.: 14216, 3656, 15715, 14216, 4439; Payload ID: 14597 relates to Category No.: 14216, 3656, 14216, 14199; Payload ID: 14598 relates to Category No.: 14216, 3656, 9228; Payload ID: 14599 relates to Category No.: 10379, 5041, 12872, 11404, 6530, 3799, 14442, 14586; Payload ID: 14600 relates to Category No.: 9228; Payload ID: 14603 relates to Category No.: 14216, 3656, 9228, 2311, 14216, 14199, 11294; Payload ID: 14604 relates to Category No.: 9228, 14216, 5447, 729, 3016, 14199; Payload ID: 14605 relates to Category No.: 14216, 3656, 7273; Payload ID: 14606 relates to Category No.: 9228, 5446, 14216, 729, 3016, 3015, 13788, 6730; Payload ID: 14607 relates to Category No.: 14216, 3656; Payload ID: 14608 relates to Category No.: 11405; Payload ID: 14609 relates to Category No.: 9228, 14216, 3012, 14199; Payload ID: 14610 relates to Category No.: 14216, 3656, 14320; Payload ID: 14611 relates to Category No.: 7710, 12488, 7270; Payload ID: 14612 relates to Category No.: 15618, 1512, 2885, 15715, 1893, 14663, 4439, 16197, 16193, 7132, 12120, 7187, 7188, 7280, 11660, 1995, 4442, 7155, 5048, 12914, 4541, 16201, 12671, 2079; Payload ID: 14613 relates to Category No.: 7291, 16182; Payload ID: 14614 relates to Category No.: 7291, 16182; Payload ID: 14615 relates to Category No.: 9500, 3356, 14663, 9236, 9235, 3094, 12066, 11935, 6530, 14056, 13904, 7132, 12303, 1782; Payload ID: 14616 relates to Category No.: 9500, 3356, 3089, 14663, 7132, 4332, 9236, 9235, 13612, 3094, 12066, 11935, 3096; Payload ID: 14617 relates to Category No.: 9500, 15521, 3089, 14663, 4439, 9236, 9235, 3094, 5949, 13975, 3354, 8176, 13714, 7038, 3093, 13772; Payload ID: 14618 relates to Category No.: 15588, 1894, 11930, 14934, 12063, 1893, 4439, 11660; Payload ID: 14619 relates to Category No.: 12062, 15588, 1894, 14934, 12063, 1893, 4439, 11660, 496, 13827; Payload ID: 14620 relates to Category No.: 1512, 14663, 9616, 9101, 9616, 14160; Payload ID: 14621 relates to Category No.: 12498, 12676, 13363, 9455; Payload ID: 14622 relates to Category No.: 15588, 14162, 900, 14177; Payload ID: 14623 relates to Category No.: 6814, 1894; Payload ID: 14624 relates to Category No.: 1894; Payload ID: 14625 relates to Category No.: 15588, 15601, 15603, 14934, 15604, 14162, 1893, 4439, 16197, 16193, 9223, 9103, 16201; Payload ID: 14626 relates to Category No.: 15588, 15601, 15603, 14934, 15604, 1893, 4439, 16197, 16193, 9223, 9103, 16201; Payload ID: 14627 relates to Category No.: 15588, 14838, 14162; Payload ID: 14628 relates to Category No.: 15588, 15601, 14318, 14164, 15603, 14934, 15604, 14162, 1893, 4439, 16197, 16193, 12122, 9223, 9103, 12036, 16201; Payload ID: 14629 relates to Category No.: 15588, 15601, 15603, 14934, 15604, 14162, 1893, 4439, 16197, 16193, 9223, 9103, 16201; Payload ID: 14630 relates to Category No.: 15588, 15601, 15603, 14934, 15604, 1893, 4439, 16197, 16193, 9223, 9103, 16201; Payload ID: 14631 relates to Category No.: 15588, 15601, 15603, 8760, 14934, 15604, 1893, 4439, 16197, 16193, 2013, 9223, 9103, 16201, 7995; Payload ID: 14632 relates to Category No.: 15588, 15601, 14318, 14164, 15603, 14934, 15604, 1893, 4439, 16197, 16193, 9223, 9103, 16201; Payload ID: 14633 relates to Category No.: 15588, 15601, 15603, 14934, 15604, 2921, 1893, 4439, 16197, 16193, 9223, 9103, 16201; Payload ID: 14634 relates to Category No.: 15588, 15601, 15603, 14934, 15604, 2921, 1893, 4439, 16197, 16193, 9223, 9103, 16201; Payload ID: 14635 relates to Category No.: 15588, 15601, 15603, 14934, 15604, 1893, 4439, 16197, 16193, 9223, 9103, 16201; Payload ID: 14636 relates to Category No.: 15588, 15601, 15603, 14934, 15604, 1893, 4439, 16197, 16193, 9223, 9103, 16201; Payload ID: 14637 relates to Category No.: 15588, 15601, 15603, 14934, 15604, 1893, 4439, 16197, 16193, 9223, 9103, 16201; Payload ID: 14638 relates to Category No.: 15588, 15601, 15603, 14934, 15604, 1893, 4439, 16197, 16193, 9223, 9103, 16201; Payload ID: 14639 relates to Category No.: 15588, 15601, 15603, 14934, 15604, 2921, 1893, 4439, 16197, 16193, 9223, 9103, 16201, 575; Payload ID: 14640 relates to Category No.: 15588, 2921; Payload ID: 14641 relates to Category No.: 15588, 15601, 15603, 14934, 15604, 1893, 4439, 16197, 16193, 9223, 9103, 14166, 16201; Payload ID: 14642 relates to Category No.: 15588, 15601, 15603, 14934, 15604, 14162, 1780, 1893, 4439, 16197, 16193, 9223, 9103, 16201; Payload ID: 14643 relates to Category No.: 15588, 15601, 15603, 14934, 15604, 14162, 1893, 4439, 16197, 16193, 9223, 9103, 16201, 900, 14056, 14069, 3975, 7134, 9396; Payload ID: 14644 relates to Category No.: 15588, 15601, 14318, 14164, 15603, 14934, 15604, 2921, 1893, 4439, 16197, 16193, 9223, 9103, 16201; Payload ID: 14645 relates to Category No.: 15588, 15601, 14164, 15603, 14934, 15604, 2921, 1893, 4439, 16197, 16193, 9223, 9103, 16201; Payload ID: 14646 relates to Category No.: 15588, 15601, 15603, 14934, 15604, 1893, 4439, 16197, 16193, 9223, 9103, 16201; Payload ID: 14647 relates to Category No.: 15588, 15601, 15603, 14934, 15604, 2921, 1893, 4439, 16197, 16193, 9223, 9103, 16201; Payload ID: 14648 relates to Category No.: 15588, 15601, 15603, 14934, 15604, 1893, 4439, 16197, 16193, 9223, 9103, 13165, 11294, 16201; Payload ID: 14649 relates to Category No.: 15588, 15601, 15603, 14934, 15604, 2921, 1893, 4439, 16197, 16193, 3566, 9223, 9103, 16201; Payload ID: 14650 relates to Category No.: 15588, 15601, 15603, 14934, 15604, 14162, 1893, 4439, 16197, 16193, 9223, 9103, 16201, 2020; Payload ID: 14651 relates to Category No.: 15588, 15601, 15603, 14934, 15604, 2921, 1893, 4439, 16197, 16193, 9223, 9103, 16201; Payload ID: 14652 relates to Category No.: 15588, 15601, 15603, 14934, 15604, 2921, 1893, 4439, 16197, 16193, 9223, 9103, 16201; Payload ID: 14653 relates to Category No.: 15588, 15601, 15603, 14934, 15604, 1893, 4439, 16197, 16193, 9223, 9103, 16201; Payload ID: 14654 relates to Category No.:

15588, 15601, 15603, 14934, 15604, 14177, 1893, 4439, 16197, 16193, 9223, 9103, 16201; Payload ID: 14655 relates to Category No.: 15588, 15601, 15603, 14934, 15604, 1893, 4439, 16197, 16193, 6635, 151, 6360, 9223, 9103, 16201; Payload ID: 14656 relates to Category No.: 15588, 15601, 14318, 14164, 15603, 14934, 15604, 2921, 1893, 4439, 16197, 16193, 9223, 9103, 16201; Payload ID: 14657 relates to Category No.: 15588, 15601, 15603, 14934, 15604, 2921, 1893, 4439, 16197, 16193, 9223, 9103, 16201; Payload ID: 14658 relates to Category No.: 15588, 15601, 15603, 14934, 15604, 2921, 1893, 4439, 16197, 16193, 9223, 9103, 16201; Payload ID: 14659 relates to Category No.: 15588; Payload ID: 14660 relates to Category No.: 15588, 15601, 15603, 14934, 15604, 1893, 4439, 16197, 16193, 9223, 9103, 16201; Payload ID: 14661 relates to Category No.: 15588, 15601, 15603, 14934, 15604, 1893, 4439, 16197, 16193, 9223, 9103, 16201; Payload ID: 14662 relates to Category No.: 15588, 15601, 15603, 14934, 15604, 1893, 4439, 16197, 16193, 9223, 9103, 16201, 14146, 7001, 1009, 14640, 14456, 9451, 13618, 193; Payload ID: 14663 relates to Category No.: 15588, 15601, 15603, 14934, 15604, 1893, 4439, 16197, 16193, 5447, 729, 3016, 9223, 9103, 16201; Payload ID: 14664 relates to Category No.: 15588, 14838; Payload ID: 14665 relates to Category No.: 15588, 15601, 15603, 14934, 15604, 14162, 1893, 4439, 16197, 16193, 9223, 9103, 16201; Payload ID: 14666 relates to Category No.: 15588, 15601, 15603, 14934, 15604, 2921, 1893, 4439, 16197, 16193, 9223, 9103, 16201; Payload ID: 14667 relates to Category No.: 15588, 15601, 15603, 14934, 15604, 1893, 4439, 16197, 16193, 9223, 9103, 16201; Payload ID: 14668 relates to Category No.: 15588, 15601, 14318, 14164, 15603, 14934, 15604, 14162, 1893, 4439, 16197, 16193, 9223, 9103, 16201; Payload ID: 14669 relates to Category No.: 15588, 15601, 13589, 3398, 15603, 14934, 15604, 2921, 14162, 1893, 4439, 16197, 16193, 9223, 9103, 16201; Payload ID: 14670 relates to Category No.: 15588, 15601, 14318, 14164, 15603, 14934, 15604, 2921, 1893, 4439, 16197, 16193, 6635, 151, 6360, 9223, 9103, 16201; Payload ID: 14671 relates to Category No.: 15588, 15601, 15603, 14934, 15604, 14177, 1893, 4439, 16197, 16193, 9223, 9103, 16201; Payload ID: 14672 relates to Category No.: 2921, 6635, 151, 6360, 1228; Payload ID: 14673 relates to Category No.: 15588, 15601, 15603, 14934, 15604, 2921, 1893, 4439, 16197, 16193, 9223, 9103, 16201; Payload ID: 14674 relates to Category No.: 15588, 15601, 15603, 14934, 15604, 2921, 1893, 4439, 16197, 16193, 9223, 9103, 16201; Payload ID: 14675 relates to Category No.: 15588, 15601, 14169, 15603, 14934, 15604, 1893, 4439, 16197, 16193, 9223, 9103, 16201; Payload ID: 14676 relates to Category No.: 15588, 15601, 15603, 14934, 15604, 1893, 4439, 16197, 16193, 9223, 9103, 16201, 9455; Payload ID: 14677 relates to Category No.: 15588, 15601, 15603, 14934, 15604, 1893, 4439, 16197, 16193, 9223, 9103, 16201; Payload ID: 14678 relates to Category No.: 15588, 15601, 15603, 14934, 15604, 1893, 4439, 16197, 16193, 9223, 9103, 16201, 8594; Payload ID: 14679 relates to Category No.: 15588, 15601, 14169, 6637, 151, 6360, 8739, 15603, 3854, 14934, 15604, 1893, 4439, 16197, 16193, 13618, 6636, 9223, 9103, 16201; Payload ID: 14680 relates to Category No.: 15588, 14169, 15601, 14318, 15603, 14934, 15604, 1893, 4439, 16197, 16193, 9223, 9103, 14172, 16201, 9455, 14171; Payload ID: 14681 relates to Category No.: 15588, 15601, 14038, 10372, 15603, 14934, 15604, 1893, 4439, 16197, 16193, 9223, 9103, 10349, 16201; Payload ID: 14682 relates to Category No.: 15588, 15601, 14318, 6637, 151, 6360, 15603, 14934, 15604, 1893, 4439, 16197, 16193, 9223, 9103, 16201, 14171; Payload ID: 14683 relates to Category No.: 15588, 15601, 14169, 14318, 15603, 14934, 15604, 1893, 4439, 16197, 16193, 9223, 9103, 16201, 3855, 14171; Payload ID: 14684 relates to Category No.: 15588, 15601, 15603, 14934, 15604, 1893, 4439, 16197, 16193, 9223, 9103, 16201; Payload ID: 14685 relates to Category No.: 15588, 15601, 14169, 14318, 6637, 151, 6360, 15603, 3854, 14934, 15604, 12133, 1893, 4439, 16197, 16193, 6636, 9223, 9103, 7216, 16201, 10386, 8574, 14171, 11329, 9243, 13842, 9125; Payload ID: 14687 relates to Category No.: 15588, 15601, 15603, 14934, 15604, 1893, 4439, 16197, 16193, 9223, 9103, 16201, 11539; Payload ID: 14688 relates to Category No.: 15588, 15601, 15603, 14934, 15604, 1893, 4439, 16197, 16193, 9223, 9103, 16201; Payload ID: 14689 relates to Category No.: 15588, 15601, 15603, 14934, 15604, 3658, 151, 6360, 3660, 151, 6360, 1893, 4439, 16197, 16193, 9223, 9103, 16201, 14171; Payload ID: 14690 relates to Category No.: 15588, 15601, 15603, 14934, 15604, 1893, 4439, 16197, 16193, 9223, 9103, 16201; Payload ID: 14691 relates to Category No.: 15588, 15601, 14318, 6637, 151, 6360, 15603, 14934, 15604, 1893, 4439, 16197, 16193, 9223, 9103, 16201, 3855, 14171; Payload ID: 14692 relates to Category No.: 15588, 15601, 15603, 14934, 15604, 1893, 4439, 16197, 16193, 9223, 9103, 16201; Payload ID: 14693 relates to Category No.: 15588, 15601, 15603, 14934, 15604, 1893, 4439, 16197, 16193, 9223, 9103, 16201, 8594; Payload ID: 14694 relates to Category No.: 15588, 15601, 14661, 14169, 15603, 14934, 15604, 1780, 1893, 4439, 16197, 16193, 7132, 9223, 9103, 16201; Payload ID: 14695 relates to Category No.: 1026, 15588, 15601, 15618, 15490, 3398, 14661, 11512, 15207, 3691, 795, 1512, 2885, 13186, 7613, 8739, 5846, 3452, 9296, 5446, 10238, 6606, 348, 5359, 9038, 11109, 12498, 15603, 3354, 746, 14934, 345, 803, 4186, 1795, 15604, 3852, 3448, 8756, 12096, 7362, 10775, 12391, 15521, 7693, 4127, 9125, 3775, 11765, 1893, 14663, 4439, 16197, 16193, 16202, 16198, 6738, 5790, 7132, 14992, 742, 15223, 3313, 14567, 5541, 670, 15782, 742, 16085, 8988, 11587, 13644, 10314, 8789, 4538, 4336, 5750, 15003, 15570, 4332, 5912, 15456, 15450, 7363, 15448, 6451, 15443, 4685, 15454, 2469, 7548, 9223, 9103, 11573, 15533, 15446, 15653, 15457, 15458, 13217, 11766, 8797, 9123, 15451, 2006, 9292, 6125, 13597, 13635, 9295, 15605, 7933, 16201, 9296, 3327, 6453, 3313, 3132, 4485, 9296, 3311, 9296, 3322, 13639, 3851; Payload ID: 14696 relates to Category No.: 15588, 334, 14169, 1955, 3354, 5809, 7148, 11546; Payload ID: 14697 relates to Category No.: 15588, 15601, 14318, 15603, 14934, 15604, 14177, 14311, 1893, 4439, 16197, 16193, 9223, 9103, 16201, 14171; Payload ID: 14698 relates to Category No.: 15588, 15601, 15603, 14934, 15604, 1893, 4439, 16197, 16193, 9223, 9103, 16201; Payload ID: 14699 relates to Category No.: 1737, 15588, 15601, 15490, 3398, 13975, 1955, 11109, 12498, 15603, 3354, 8760, 14934, 7154, 15604, 10241, 14894, 10648, 1893, 4439, 16197, 16193, 2429, 9223, 9103, 10521, 10879, 8547, 16201, 11110, 3313, 3132, 2001, 11008, 10544, 7889, 14024, 10866, 10520, 10472, 2068; Payload ID: 14700 relates to Category No.: 15588, 15601, 1730, 7613, 15603, 14934, 15604, 1893, 4439, 16197, 16193, 9223, 9103, 16201; Payload ID: 14701 relates to Category No.: 15588, 15601, 10372, 15603, 7306, 14934, 15604, 1893, 4439, 16197, 16193, 9223, 9103, 11546, 16201; Payload ID: 14702 relates to Category No.: 15588, 15601, 15603, 7306, 14934, 15604, 1893, 4439, 16197, 16193, 9223, 9103, 16201; Payload ID: 14703 relates to Category No.: 15588, 1204; Payload ID: 14704 relates to Category No.: 15588, 15601, 14169, 15603, 14934, 15604, 13621, 1893, 4439, 16197, 16193, 9223, 9103, 16201; Payload ID: 14705 relates to Category No.: 15588, 15601, 14318, 10238, 15603, 14934, 15604, 1893, 4439, 16197, 16193, 5541, 15464, 9223, 9103, 16201, 4535, 14171; Payload ID: 14706 relates to Category No.: 12091, 14565; Payload ID: 14707 relates to Category No.: 12091, 2009, 14565, 795, 7613, 9891, 5541, 4332, 8117, 15464, 11550, 11546, 11027, 1993, 7965, 1112, 2079, 4458, 11980, 14622, 13969, 13925, 14050, 13859, 13936, 11390, 14025, 496, 13867, 13888, 13827, 13971, 13966, 13837, 11391, 13970, 13773, 13860, 13981, 2000, 6322, 1752, 13858, 13918, 14022, 14029, 14619, 13830, 11383, 12911; Payload ID: 14708 relates to Category No.: 12091, 5785, 15588, 14565, 5446, 4186, 9891, 4127, 3775, 8988, 11550, 11980; Payload ID: 14709 relates to Category No.: 12091, 5785, 1026, 11512, 14565, 1721, 7613, 15149, 5446, 7362, 7840, 8988, 15003, 15456, 15450, 7363, 15448, 15443, 10362, 15454, 15446, 15653, 15457, 15458, 10358, 15451, 12778, 5024, 13620, 10721; Payload ID: 14710 relates to Category No.: 12091, 1026, 5785, 14565, 15149, 5446, 10238, 7743, 7362, 8988, 13618, 15003, 15456, 7724, 15450, 7363, 15448, 15443, 15454, 15446, 15653, 15457, 15458, 15451, 9713, 10648, 4949, 13372, 4948, 9378, 8269, 1927, 1554, 1297; Payload ID: 14711 relates to Category No.: 12091, 1026, 11512, 5785, 14565, 1721, 7613, 15149, 5446, 14640, 2169, 7362, 7840, 8988, 13925, 15003, 15456, 15450, 7363, 15448, 15443, 10362, 15454, 15446, 15653, 15457, 15458, 10358, 15451, 12778, 13620; Payload ID: 14712 relates to Category No.: 12091, 5785, 5174, 1026, 13589, 3398, 11512, 5428, 11109, 5659, 10459, 5176, 10735, 7845, 5221, 10756; Payload ID: 14713 relates to Category No.: 12091, 1026, 13589, 3398, 11512, 5785, 5428, 5446, 8731, 3398, 11109, 5174, 7362, 3775, 14992, 8988, 15003, 5659, 15456, 15450, 7363, 15448, 15443, 15454, 10459, 5176, 15446, 15653, 15457, 15458, 15451, 10735, 7845, 5221, 10756, 5139; Payload ID: 14714 relates to Category No.: 12091, 1026, 5785, 14565, 15149, 2169, 7946, 3313, 14568, 13618, 8286, 7907; Payload ID: 14715 relates to Category No.: 12091, 14565; Payload ID: 14716 relates to Category No.: 15588, 15601, 14318, 15603, 14934, 15604, 1893, 4439, 16197, 16193, 9223, 9103, 16201, 14171; Payload ID: 14717 relates to Category No.: 15588, 15601, 6637, 151, 6360, 15603, 14934, 15604, 1893, 4439, 16197, 16193, 9223, 9103, 16201; Payload ID: 14718 relates to Category No.: 15588, 15601, 10372, 15603, 14934, 15604, 1893, 4439, 16197, 16193, 11549, 9223, 9103, 16201; Payload ID: 14719 relates to Category No.: 15588, 15601, 14169, 1703, 15603, 14934, 15604, 3658, 151, 6360, 3660, 151, 6360, 14311, 1893, 4439, 16197, 16193, 9223, 9103, 16189, 16201, 14589, 3791; Payload ID: 14720 relates to Category No.: 15588, 15601, 15603, 14934, 15604, 14177, 1893, 4439, 16197, 16193, 9223, 9103, 16201; Payload ID: 14721 relates to Category No.: 15588, 15601, 15603, 14934, 15604, 1893, 4439, 16197, 16193, 9223, 9103, 16201; Payload ID: 14722 relates to Category No.: 15588, 15601, 15603, 14934, 15604, 1893, 4439, 16197, 16193, 9223, 9103, 16201; Payload ID: 14723 relates to Category No.: 14314, 14316; Payload ID: 14724 relates to Category No.: 14318; Payload ID: 14727 relates to Category No.: 14318, 8454; Payload ID: 14728 relates to Category No.: 14318, 6637, 151, 6360, 14171; Payload ID: 14729 relates to Category No.: 14169, 14318, 1228; Payload ID: 14730 relates to Category No.: 15490, 3398, 14318, 6902, 2409, 1983, 4439, 12891, 3783, 8004, 3783, 10350, 2413, 13590, 5807; Payload ID: 14731 relates to Category No.: 14318; Payload ID: 14732 relates to Category No.: 14318, 1204; Payload ID: 14733 relates to Category No.: 12137, 15588, 9455; Payload ID: 14734 relates to Category No.: 14164, 14177, 3658, 151, 6360, 14165, 7153, 4969; Payload ID: 14735 relates to Category No.: 14162, 6631, 6634; Payload ID: 14736 relates to Category No.: 14162, 6635, 151, 6360; Payload ID: 14737 relates to Category No.: 6814, 1512, 14663, 9616, 9101, 9615, 1838, 9616; Payload ID: 14738 relates to Category No.: 6814, 1512, 9616; Payload ID: 14739 relates to Category No.: 10702, 14097, 3698, 7763; Payload ID: 14740 relates to Category No.: 15149, 2370, 12007, 11926, 1889, 10486; Payload ID: 14741 relates to Category No.: 4828, 10702, 5406, 1758, 16213, 1093, 439, 4418, 13921, 16095, 1805; Payload ID: 14742 relates to Category No.: 4828, 10702, 12931; Payload ID: 14743 relates to Category No.: 9500; Payload ID: 14744 relates to Category No.: 8454; Payload ID: 14748 relates to Category No.: 12153, 13186, 13563, 9223, 2904, 7644, 7571, 11658, 12898, 8006, 8711, 12891, 14910, 1061, 15203, 6403, 15197, 15212, 11110; Payload ID: 14749 relates to Category No.: 12096, 7303, 11634, 12891, 11658, 14910, 1061, 15203, 6403, 6371, 15197, 6192, 15212, 11110; Payload ID: 14750 relates to Category No.: 12154, 12153, 11237, 3354, 11298, 11860, 15605, 3851; Payload ID: 14751 relates to Category No.: 15898, 12154, 11843, 11967, 7967, 13588, 8785, 8618, 12879, 7842, 5782; Payload ID: 14753 relates to Category No.: 12153, 11237, 3313, 14567, 13904; Payload ID: 14754 relates to Category No.: 12153, 3354, 7148, 13904, 7131, 10491, 12769; Payload ID: 14755 relates to Category No.: 15898, 13589, 3398, 11506, 3398, 11967, 11961, 11972, 12487, 7636; Payload ID: 14756 relates to Category No.: 15490, 3398, 8731, 3398, 1893, 12120, 11660, 5134; Payload ID: 14757 relates to Category No.: 15490, 3398, 11512, 11506, 3398, 11860, 8604, 11055; Payload ID: 14758 relates to Category No.: 12153, 3837, 2169; Payload ID: 14759 relates to Category No.: 12154, 11860, 15898; Payload ID: 14760 relates to Category No.: 15490, 3398, 11512, 12153, 9296, 3354, 11506, 3398, 15521, 4439, 15570, 4485, 9599, 12096, 11298, 11542, 15901; Payload ID: 14761 relates to Category No.: 6814, 11091, 10350, 10651; Payload ID: 14764 relates to Category No.: 1730, 11237, 7306, 12096, 14838; Payload ID: 14765 relates to Category No.: 11860, 11969, 11967, 7933, 15899; Payload ID: 14766 relates to Category No.: 12153, 3684, 3837; Payload ID: 14768 relates to Category No.: 12153; Payload ID: 14769 relates to Category No.: 11237, 5446, 403, 12096, 8789; Payload ID: 14770 relates to Category No.: 12154, 11843, 14097, 3698, 12646, 12058, 11969, 11967, 7933, 15899, 2892; Payload ID: 14771 relates to Category No.: 12154, 13376, 12024, 11244, 7844; Payload ID: 14772 relates to Category No.: 11860; Payload ID: 14773 relates to Category No.: 795, 12153, 11765; Payload ID: 14774 relates to Category No.: 11860; Payload ID: 14775 relates to Category No.: 12153, 5446, 8789, 10811, 13000; Payload ID: 14776 relates to Category No.: 11237, 16286, 12096; Payload ID: 14777 relates to Category No.: 12153, 8760, 7743, 13383, 11299, 3835, 11912, 12828, 13372; Payload ID: 14778 relates to Category No.: 12153, 13594, 13589, 3398, 12154, 15490, 3398, 14565, 11237, 687, 11506, 3398, 12096, 12487; Payload ID: 14779 relates to Category No.: 11860, 13589, 3398; Payload ID: 14780 relates to Category No.: 12154, 11237, 12096, 12153; Payload ID: 14781 relates to Category No.: 12154, 795, 11237, 12096; Payload ID: 14783 relates to Category No.: 12154, 16286, 10314, 11860, 11967; Payload ID: 14785 relates to Category No.: 12153, 1957, 13376, 8256; Payload ID: 14787 relates to Category No.: 12153, 1730, 14838; Payload ID: 14788 relates to Category No.: 795, 1905, 11969, 10256, 11967, 8729; Payload ID: 14791 relates to Category No.: 11237, 12096; Payload ID: 14792 relates to Category No.:

12096, 7724; Payload ID: 14793 relates to Category No.: 15898, 12153, 3452, 1955, 3354, 5901, 3448, 1893, 5750, 12120, 3453, 8736, 11660, 11969, 13904, 10521, 5133, 5134, 5137, 5138, 2139, 12666; Payload ID: 14794 relates to Category No.: 12153, 1955, 7897; Payload ID: 14795 relates to Category No.: 7306, 14834; Payload ID: 14796 relates to Category No.: 12153; Payload ID: 14797 relates to Category No.: 12153, 3684, 3837; Payload ID: 14798 relates to Category No.: 11237, 12096, 14509, 480, 9111, 11298, 12603, 9431; Payload ID: 14799 relates to Category No.: 11860; Payload ID: 14800 relates to Category No.: 12153; Payload ID: 14802 relates to Category No.: 1002, 3837, 11860, 3835; Payload ID: 14804 relates to Category No.: 11843, 10372, 11506, 3398, 11860, 11967; Payload ID: 14805 relates to Category No.: 12154, 11237, 6969, 12096, 12153; Payload ID: 14806 relates to Category No.: 12154, 11237, 403, 12096, 7540, 5609; Payload ID: 14807 relates to Category No.: 15490, 3398, 8739, 1893, 12120, 11660, 8611, 5134, 5136, 4419, 722, 7132, 5226, 4458, 14883, 14000; Payload ID: 14808 relates to Category No.: 15898, 13589, 3398, 8334, 11506, 3398, 7737, 12096, 5218, 5145, 10739, 5226, 10754; Payload ID: 14809 relates to Category No.: 10648, 12594, 10492, 11617, 1817, 12951, 8828, 8827; Payload ID: 14810 relates to Category No.: 11860; Payload ID: 14811 relates to Category No.: 12431, 6683, 2315, 12120; Payload ID: 14813 relates to Category No.: 12153, 11860; Payload ID: 14816 relates to Category No.: 11843, 795, 5446, 16197, 8789, 11967, 12749, 13010; Payload ID: 14817 relates to Category No.: 12154, 11237, 12096, 12153; Payload ID: 14818 relates to Category No.: 11049, 16182; Payload ID: 14819 relates to Category No.: 12153, 10314, 11860; Payload ID: 14820 relates to Category No.: 11843, 11512, 12153, 8542; Payload ID: 14825 relates to Category No.: 12153, 11109; Payload ID: 14826 relates to Category No.: 1204; Payload ID: 14827 relates to Category No.: 12153, 15207, 5359, 11109, 1795, 12096, 10775, 15782, 11294, 13635, 1683, 11994; Payload ID: 14829 relates to Category No.: 12154, 11843, 12153, 11967, 9292, 6125, 7967, 8618, 7842, 13285, 1938; Payload ID: 14830 relates to Category No.: 12153, 6530; Payload ID: 14831 relates to Category No.: 1204; Payload ID: 14832 relates to Category No.: 15490, 3398, 11843, 11512, 12153, 3452, 687, 3354, 11506, 3398, 3448, 8542, 11860, 11969, 11967, 11959, 11972, 13784, 13504, 13058; Payload ID: 14833 relates to Category No.: 15898, 8334, 5218, 5145, 10739, 13981, 11236, 11287; Payload ID: 14834 relates to Category No.: 1002, 12153, 13105, 7743, 7737, 12096, 11307, 11860, 4039, 11830, 13397, 13361, 12891, 11363, 12835, 13202, 13092; Payload ID: 14835 relates to Category No.: 12154, 12153, 16286, 8831, 14950, 16285; Payload ID: 14837 relates to Category No.: 1888, 11969, 11967, 3836, 3835; Payload ID: 14838 relates to Category No.: 12154, 14383, 12061, 13999; Payload ID: 14839 relates to Category No.: 1737, 15898, 12153, 3452, 1955, 3354, 5901, 7154, 3448, 5750, 3453, 11860, 8736, 11969, 14834, 13904, 10521, 11967, 5129, 5145, 5135, 5133; Payload ID: 14840 relates to Category No.: 15898, 15490, 3398, 12153, 8731, 3398, 12385, 8739, 8611, 12784; Payload ID: 14843 relates to Category No.: 15490, 3398, 795, 7306, 5134, 8739; Payload ID: 14844 relates to Category No.: 1026, 12154, 14661, 11843, 12153, 9296, 5446, 6606, 348, 3354, 4186, 14383, 12391, 12061, 7693, 4127, 9125, 3775, 16197, 5541, 16085, 8988, 12058, 15533, 2006, 13597, 15605, 9296, 3327, 3313, 3132, 4485, 9296, 3311, 11878; Payload ID: 14845 relates to Category No.: 12091; Payload ID: 14846 relates to Category No.: 12091; Payload ID: 14847 relates to Category No.: 12091, 2429; Payload ID: 14848 relates to Category No.: 15490, 3398, 8739, 8731, 3398, 3604, 14792, 14791, 12891, 9125, 1274; Payload ID: 14849 relates to Category No.: 8739, 14793, 3604, 14791, 12891, 3176, 11628, 9451, 9125, 1015, 1274; Payload ID: 14850 relates to Category No.: 15490, 3398, 8739, 1204, 3604, 7743, 9786, 4949; Payload ID: 14851 relates to Category No.: 15517, 4439, 16197, 182, 14192; Payload ID: 14852 relates to Category No.: 14267, 15715, 4439, 15718, 16181, 5406, 10036; Payload ID: 14853 relates to Category No.: 14267; Payload ID: 14854 relates to Category No.: 14267, 13618, 11546, 15588, 13812, 11754; Payload ID: 14855 relates to Category No.: 7288, 14271, 1204, 8739, 7743, 137, 8335, 16182, 11387, 13486; Payload ID: 14856 relates to Category No.: 7288, 1730, 7306, 14271, 12484, 16182, 2083; Payload ID: 14859 relates to Category No.: 15490, 3398, 11512, 3356, 3354, 3353, 5113, 13874, 4518, 5773, 7775, 14656; Payload ID: 14860 relates to Category No.: 7291, 16182, 16197, 8739, 14910, 8349, 16137, 9600, 11534, 10035; Payload ID: 14861 relates to Category No.: 7288, 15490, 3398, 14271, 16197, 12484, 16182; Payload ID: 14862 relates to Category No.: 601, 16182; Payload ID: 14863 relates to Category No.: 10491; Payload ID: 14864 relates to Category No.: 7306, 10539; Payload ID: 14865 relates to Category No.: 7288, 4949, 14271, 11345; Payload ID: 14866 relates to Category No.: 7291, 16182, 14915, 7272, 16182, 1957, 11949, 15606, 10861, 11345; Payload ID: 14867 relates to Category No.: 7288; Payload ID: 14868 relates to Category No.: 13186, 1730, 13210; Payload ID: 14869 relates to Category No.: 7288, 12498, 14271, 12484, 16182; Payload ID: 14870 relates to Category No.: 7288, 8454; Payload ID: 14871 relates to Category No.: 7288; Payload ID: 14872 relates to Category No.: 7288, 14271; Payload ID: 14875 relates to Category No.: 7288, 1722, 1721, 1730, 7743, 14271, 13445, 3313, 14568, 3313, 14567, 137, 13210; Payload ID: 14876 relates to Category No.: 7288, 13589, 3398, 15490, 3398, 14267, 14271; Payload ID: 14877 relates to Category No.: 7288, 8765, 1730, 14267, 8760, 14271, 12484, 16182, 15003, 11053, 3743, 2468, 5858, 13260, 8763, 13784, 1500, 8762; Payload ID: 14878 relates to Category No.: 7291, 16182, 3198; Payload ID: 14879 relates to Category No.: 8335, 16182; Payload ID: 14882 relates to Category No.: 8862, 1730; Payload ID: 14884 relates to Category No.: 4969, 2867; Payload ID: 14886 relates to Category No.: 7288, 2467, 14271, 13618, 2469, 3743, 10648; Payload ID: 14887 relates to Category No.: 795, 10238, 14267, 7743, 7291, 16182, 14271, 4439, 12484, 16182, 14913; Payload ID: 14888 relates to Category No.: 14267; Payload ID: 14889 relates to Category No.: 6670; Payload ID: 14890 relates to Category No.: 15517, 7291, 16182, 14271, 15291, 4439, 12484, 16182, 13618, 7280, 7261, 9223, 9103; Payload ID: 14891 relates to Category No.: 11940, 11512, 15517, 7291, 16182, 14271, 4439, 12484, 16182, 2014, 8335, 16182, 6739, 9455, 11049, 16182; Payload ID: 14893 relates to Category No.: 7288, 14271; Payload ID: 14896 relates to Category No.: 7288, 14271, 12484, 16182; Payload ID: 14897 relates to Category No.: 7288, 14271, 14838, 6530; Payload ID: 14898 relates to Category No.: 7288, 14271; Payload ID: 14899 relates to Category No.: 7288, 14271; Payload ID: 14900 relates to Category No.: 7288, 14271, 14838; Payload ID: 14901 relates to Category No.: 7288, 14271, 14838; Payload ID: 14902 relates to Category No.: 3356, 14267; Payload ID: 14903 relates to Category No.: 14267; Payload ID: 14904 relates to Category No.: 11546; Payload ID: 14905 relates to Category No.: 15490, 3398, 10238, 15517, 7291, 16182, 14271, 15291, 4439, 12484, 16182, 7280, 7261, 9223, 9103, 8335, 16182; Payload ID: 14906 relates to Category No.: 13589, 3398, 15490, 3398, 11167, 14267, 7291, 16182, 11385; Payload ID: 14908 relates to Category No.: 8862, 7288, 14271, 13445, 12484, 16182, 14275, 8920; Payload ID: 14909 relates to Category No.: 8862, 7288, 8731, 3398, 14271, 13445, 12646, 12484, 16182, 14211, 5773, 8920, 3041, 12372, 12751; Payload ID: 14910 relates to Category No.: 7288, 14271, 13445, 12484, 16182; Payload ID: 14911 relates to Category No.: 9232, 9228, 9287, 14216, 3994; Payload ID: 14912 relates to Category No.: 7288, 9718, 15517, 14267, 3100, 11910, 4439, 16197, 182, 10141; Payload ID: 14913 relates to Category No.: 14318, 14267, 14212; Payload ID: 14914 relates to Category No.: 15517; Payload ID: 14915 relates to Category No.: 14723, 3101; Payload ID: 14917 relates to Category No.: 12224, 1204, 14214, 15716; Payload ID: 14918 relates to Category No.: 12224, 1204, 14214, 15716; Payload ID: 14919 relates to Category No.: 12224, 14214, 15716; Payload ID: 14920 relates to Category No.: 12224, 14214, 15716; Payload ID: 14921 relates to Category No.: 14267, 14177, 1204, 3659, 151, 6360; Payload ID: 14922 relates to Category No.: 7291, 16182, 14271, 4439, 3198; Payload ID: 14924 relates to Category No.: 16064; Payload ID: 14925 relates to Category No.: 8906, 1295, 9321, 10372, 4998; Payload ID: 14926 relates to Category No.: 12091, 1730, 15614, 1746, 14838, 1780, 12832, 13588, 2597, 8004, 9717, 14569, 13301, 9720; Payload ID: 14927 relates to Category No.: 2464, 3176; Payload ID: 14930 relates to Category No.: 8862, 1026, 334, 5255, 1703, 1762, 10261, 14297, 7789, 2307, 1030, 8254, 8364, 16136, 7743, 4949, 6552, 2705; Payload ID: 14931 relates to Category No.: 1026, 5255, 1295, 2000, 2169, 14069, 10261, 6878, 16005, 8669, 800, 1030, 9334, 8364, 1703; Payload ID: 14932 relates to Category No.: 1026, 1030, 8934, 2599, 2283, 2308; Payload ID: 14933 relates to Category No.: 690, 12638, 1730, 7737; Payload ID: 14934 relates to Category No.: 9500, 5782, 16172; Payload ID: 14937 relates to Category No.: 15588, 2740; Payload ID: 14938 relates to Category No.: 1512; Payload ID: 14941 relates to Category No.: 14177; Payload ID: 14942 relates to Category No.: 14308; Payload ID: 14945 relates to Category No.: 15898, 12195; Payload ID: 14949 relates to Category No.: 3012; Payload ID: 14951 relates to Category No.: 15626; Payload ID: 14952 relates to Category No.: 6902; Payload ID: 14953 relates to Category No.: 13589, 3398; Payload ID: 14954 relates to Category No.: 15898, 12195; Payload ID: 14955 relates to Category No.: 6814; Payload ID: 14956 relates to Category No.: 9256, 12265; Payload ID: 14959 relates to Category No.: 15588, 7852; Payload ID: 14960 relates to Category No.: 15626, 6733; Payload ID: 14962 relates to Category No.: 15588, 13589, 3398; Payload ID: 14963 relates to Category No.: 6814, 9500; Payload ID: 14965 relates to Category No.: 15707, 13621, 2964; Payload ID: 14970 relates to Category No.: 4353; Payload ID: 14972 relates to Category No.: 12194; Payload ID: 14975 relates to Category No.: 7441; Payload ID: 14978 relates to Category No.: 4828, 1795, 2469; Payload ID: 14984 relates to Category No.: 12091, 9720, 15614, 10094; Payload ID: 14985 relates to Category No.: 9500, 15885; Payload ID: 14987 relates to Category No.: 6212, 9945; Payload ID: 14989 relates to Category No.: 6814; Payload ID: 14994 relates to Category No.: 12172; Payload ID: 14996 relates to Category No.: 12638, 1820, 5592, 1825, 692, 10075; Payload ID: 14998 relates to Category No.: 4828, 3127; Payload ID: 15000 relates to Category No.: 4828, 3127; Payload ID: 15002 relates to Category No.: 12194, 1002, 11878; Payload ID: 15003 relates to Category No.: 14271, 4445, 9211; Payload ID: 15004 relates to Category No.: 6358; Payload ID: 15005 relates to Category No.: 14894, 2198; Payload ID: 15007 relates to Category No.: 14661, 5782; Payload ID: 15009 relates to Category No.: 10702, 13435; Payload ID: 15011 relates to Category No.: 6394; Payload ID: 15016 relates to Category No.: 13589, 3398, 2411; Payload ID: 15018 relates to Category No.: 14565, 5446, 7362, 15456, 12740, 10790, 13947, 15454, 7567; Payload ID: 15020 relates to Category No.: 16068; Payload ID: 15021 relates to Category No.: 5798; Payload ID: 15022 relates to Category No.: 15626; Payload ID: 15023 relates to Category No.: 5798; Payload ID: 15025 relates to Category No.: 9982, 3452; Payload ID: 15030 relates to Category No.: 11676; Payload ID: 15034 relates to Category No.: 9500; Payload ID: 15038 relates to Category No.: 15626; Payload ID: 15039 relates to Category No.: 7039, 7508, 9500; Payload ID: 15040 relates to Category No.: 6814, 14661, 12137, 14565; Payload ID: 15041 relates to Category No.: 2459; Payload ID: 15045 relates to Category No.: 3336; Payload ID: 15049 relates to Category No.: 7288; Payload ID: 15053 relates to Category No.: 11843, 12096; Payload ID: 15054 relates to Category No.: 16064; Payload ID: 15055 relates to Category No.: 5782; Payload ID: 15056 relates to Category No.: 12153; Payload ID: 15060 relates to Category No.: 12091; Payload ID: 15063 relates to Category No.: 13589, 3398, 15490, 3398; Payload ID: 15065 relates to Category No.: 12091; Payload ID: 15066 relates to Category No.: 4104; Payload ID: 15070 relates to Category No.: 16159, 16172; Payload ID: 15071 relates to Category No.: 14216, 3656, 14216, 14199; Payload ID: 15073 relates to Category No.: 15490, 3398, 5785; Payload ID: 15077 relates to Category No.: 14270, 7280; Payload ID: 15081 relates to Category No.: 15626, 5848; Payload ID: 15083 relates to Category No.: 6814; Payload ID: 15087 relates to Category No.: 4828, 6814, 6986, 12095; Payload ID: 15090 relates to Category No.: 6814; Payload ID: 15092 relates to Category No.: 11923, 11928; Payload ID: 15093 relates to Category No.: 16172, 3986, 16160; Payload ID: 15095 relates to Category No.: 6814; Payload ID: 15098 relates to Category No.: 4706, 4521; Payload ID: 15099 relates to Category No.: 14661; Payload ID: 15101 relates to Category No.: 3691; Payload ID: 15105 relates to Category No.: 1894; Payload ID: 15106 relates to Category No.: 9982; Payload ID: 15107 relates to Category No.: 286, 14475; Payload ID: 15109 relates to Category No.: 15693, 3656; Payload ID: 15111 relates to Category No.: 6814; Payload ID: 15118 relates to Category No.: 13589, 3398; Payload ID: 15120 relates to Category No.: 12091, 14836, 12603; Payload ID: 15121 relates to Category No.: 1070, 12427, 5446, 3013, 4127, 9777, 12432, 9777, 3729, 2610, 2488, 4130, 10262; Payload ID: 15123 relates to Category No.: 13589, 3398; Payload ID: 15124 relates to Category No.: 15588, 14164, 2921; Payload ID: 15126 relates to Category No.: 5367, 12736; Payload ID: 15129 relates to Category No.: 6227; Payload ID: 15134 relates to Category No.: 9500; Payload ID: 15136 relates to Category No.: 4828, 3127; Payload ID: 15138 relates to Category No.: 6814; Payload ID: 15139 relates to Category No.: 15588, 7112; Payload ID: 15145 relates to Category No.: 14216, 3656; Payload ID: 15152 relates to Category No.: 6902; Payload ID: 15155 relates to Category No.: 15626; Payload ID: 15156 relates to Category No.: 9500, 11773; Payload ID: 15158 relates to Category No.: 15207, 1070; Payload ID: 15159 relates to Category No.: 15207, 1070; Payload ID: 15161 relates to Category No.: 6643; Payload ID: 15163 relates to Category No.: 13589, 3398; Payload ID: 15164 relates to Category No.: 4609; Payload ID: 15165 relates to Category No.: 9500; Payload ID: 15170 relates to Category No.: 1714, 13589, 3398; Payload ID: 15172 relates to Category No.: 15626, 643, 2164, 4636, 16274, 1520; Payload ID: 15174 relates to Category No.: 1795; Payload ID: 15176 relates to Category No.: 3386, 3354, 14034, 3353, 11949; Payload ID: 15177 relates to Category No.: 9420, 8040, 2459, 5406, 5949, 2235, 4946, 3176, 1463, 3924, 2460, 6269, 8890, 1295, 6080, 15247, 9333, 13492, 6194, 3584, 2708, 9722, 3594, 9120, 3896, 2547; Payload ID: 15178 relates to Category No.: 15588, 2921; Payload ID: 15179 relates to Category No.: 15588; Payload ID: 15180 relates to Category No.: 6814; Payload ID: 15181 relates to Category No.: 10331, 5446, 9713, 12459, 4186, 275, 9891, 13313, 3871, 4127, 3564, 3775, 16085, 8988, 15464, 11502, 11266, 15192, 13361, 3922, 11178, 12891, 10192, 13371, 12942, 12999, 12835, 13292, 10558; Payload ID: 15182 relates to Category No.: 15516, 4439, 15520, 5406, 3399, 5443, 11506, 3398, 5242, 1780, 14177, 2891, 9243, 8176, 12777, 5443, 11094; Payload ID: 15183 relates to Category No.: 11285, 10314, 11620, 13401, 12891, 1483, 6532, 11120, 13102; Payload ID: 15184 relates to Category No.: 16286, 10314, 3437, 9455, 1272, 3814, 3584, 3594, 6379, 15478, 8413; Payload ID: 15185 relates to Category No.: 16286, 10314, 690, 1312; Payload ID: 15186 relates to Category No.: 16286, 10314; Payload ID: 15187 relates to Category No.: 9232, 3356, 3354, 3320, 3353, 15257, 12786; Payload ID: 15188 relates to Category No.: 15499, 11512, 8739, 16286, 3399, 5443, 5217, 11509, 14949, 3644, 10745, 5160, 1229; Payload ID: 15189 relates to Category No.: 3639, 12137, 12798; Payload ID: 15191 relates to Category No.: 286, 10366, 10257, 12835, 10861, 7640, 10261, 12526; Payload ID: 15193 relates to Category No.: 12096, 11371; Payload ID: 15194 relates to Category No.: 1204; Payload ID: 15195 relates to Category No.: 1002, 9777, 7635, 5376, 7908, 8457, 7634; Payload ID: 15197 relates to Category No.: 14661, 10703, 10406; Payload ID: 15199 relates to Category No.: 13589, 3398, 11512, 4998, 8929, 15517, 11506, 3398, 10690, 4974, 10840, 10226, 8041, 7372, 9742, 5406, 7743, 8930, 4939, 2131, 14640, 6269, 7379, 2169, 13465, 3592, 1119, 8928, 3023, 12946, 10365; Payload ID: 15200 relates to Category No.: 13589, 3398, 15490, 3398, 8731, 3398, 4448, 12767, 4094; Payload ID: 15201 relates to Category No.: 13594, 4998, 8929, 12628, 2376, 13589, 3398, 8731, 3398, 11506, 3398, 1257, 15521, 4439, 9451, 1918, 11524, 9455, 15517, 11512, 10648, 13265, 10372, 14640, 3631, 1751, 8639, 9454, 12877, 14944, 14641, 3575, 2374, 3584, 11147, 9321, 13276, 15194, 13277, 10429, 9456, 1970, 11146; Payload ID: 15202 relates to Category No.: 12091, 13594, 13589, 3398, 4998, 8739, 8929, 15517, 11506, 3398, 12628, 2376, 7724, 9451, 7939, 9742, 14026, 1026, 10600, 4939, 8936, 1751, 5606; Payload ID: 15203 relates to Category No.: 3320, 1737, 13594, 15490, 3398, 2167, 3354, 7154, 3353, 9274, 14838, 2410, 12936, 13165, 5182, 11294, 5131; Payload ID: 15204 relates to Category No.: 15490, 3398, 11512, 11926, 2139, 2411, 3354, 3320, 3353, 2410, 12936, 5182, 1964, 3901, 10735, 5131, 15527, 7956; Payload ID: 15207 relates to Category No.: 1204; Payload ID: 15208 relates to Category No.: 8390, 11292, 10773; Payload ID: 15210 relates to Category No.: 15618, 5846, 1415, 1417, 1836, 5848, 2945, 13882, 7340, 9480, 13695, 1921, 9452, 14624, 13696, 14643, 13795; Payload ID: 15211 relates to Category No.: 15618, 5846, 1415, 1417, 1836, 1451, 5848, 2945, 13882, 12594, 12596, 13999, 13695, 14369, 12953, 3121, 1562, 1921, 12274, 1564, 13956, 13696, 1453, 10710, 1717, 12595, 11474, 13662, 16129, 1961, 13953, 13795, 1419, 12520, 12512, 11364, 13451, 3591, 6109, 3902, 15804, 10308, 1483, 1257, 2946; Payload ID: 15212 relates to Category No.: 15618, 1415, 1836, 5848, 15012, 7855, 5846, 1417, 11941, 1921, 1922, 1912, 2048; Payload ID: 15213 relates to Category No.: 9232; Payload ID: 15214 relates to Category No.: 12948, 5785, 15042, 8739, 11615; Payload ID: 15215 relates to Category No.: 10702, 6721, 11418, 3910, 11935, 6744, 11425, 10629, 10275; Payload ID: 15216 relates to Category No.: 14565, 7743, 7890; Payload ID: 15217 relates to Category No.: 16308, 5428, 5446, 11109, 3013, 10775, 9000, 2883, 10954, 10790, 6612, 7216, 5954, 3014; Payload ID: 15218 relates to Category No.: 10775, 2883, 6615, 5614, 12648, 10372, 13829, 13813; Payload ID: 15219 relates to Category No.: 795, 3013, 13925, 15450, 1408, 11037, 10688; Payload ID: 15220 relates to Category No.: 13796; Payload ID: 15221 relates to Category No.: 3713; Payload ID: 15223 relates to Category No.: 10775, 3812; Payload ID: 15225 relates to Category No.: 14565, 1048, 10626, 5846; Payload ID: 15226 relates to Category No.: 690, 5939, 5446, 3781, 13925, 11037, 10583, 3015, 13998, 11449, 14480, 10688; Payload ID: 15229 relates to Category No.: 334, 1002, 5428, 5446, 11109, 12746, 3013, 9000, 10790, 10362, 2878, 10864, 3014, 6147, 9669, 14485, 2297, 8998, 907, 11171, 13925, 16294, 13837, 14054, 2431, 379; Payload ID: 15230 relates to Category No.: 334, 1002, 14565, 5428, 5446, 1816, 11109, 12746, 3013, 9000, 10790, 10362, 2878, 10864, 3014, 9670, 6147, 14485, 2297, 8998, 13618, 275, 907, 9669, 6138, 10280, 11171, 13008; Payload ID: 15231 relates to Category No.: 5446, 2169, 10775, 1048, 1780, 6103, 13236, 6758, 12648, 13859, 6323, 10372, 2006, 10238, 11436, 13944, 908, 8623; Payload ID: 15233 relates to Category No.: 13970, 3713; Payload ID: 15236 relates to Category No.: 381; Payload ID: 15237 relates to Category No.: 6814, 9861, 9858, 9945, 1204, 14663; Payload ID: 15238 relates to Category No.: 1737, 7154; Payload ID: 15239 relates to Category No.: 9500; Payload ID: 15240 relates to Category No.: 11926, 8111; Payload ID: 15241 relates to Category No.: 2932, 9165, 9182, 15144, 9451, 13936; Payload ID: 15242 relates to Category No.: 2932, 7168, 10366, 2197, 9187, 9165, 9182, 9188; Payload ID: 15243 relates to Category No.: 2932, 9165; Payload ID: 15244 relates to Category No.: 14838, 2932, 9165; Payload ID: 15245 relates to Category No.: 13589, 3398, 15490, 3398, 795; Payload ID: 15246 relates to Category No.: 13589, 3398, 15490, 3398, 2410, 5146, 3901; Payload ID: 15248 relates to Category No.: 12091, 5785, 1721, 13166, 12628, 11858, 3743, 1557, 13497, 14123, 8021, 7831, 13210, 8775, 10228; Payload ID: 15249 relates to Category No.: 12091, 5785, 11858, 13003, 5541; Payload ID: 15250 relates to Category No.: 14565, 5072, 4937, 10238, 6376, 13271, 7939, 5939, 10606, 16137, 13509, 5755, 7701, 795, 12646; Payload ID: 15251 relates to Category No.: 12096, 10879, 10557, 10226, 11110, 11163, 10917, 13358, 13341; Payload ID: 15252 relates to Category No.: 10266, 5243, 10814, 10840, 11460, 11566, 10826, 10845, 10785, 11143, 10206, 10339, 575, 11451, 10931; Payload ID: 15253 relates to Category No.: 5367, 2885, 3021, 11941, 15817, 13000, 3210, 2972; Payload ID: 15254 relates to Category No.: 7579, 8449, 7641; Payload ID: 15255 relates to Category No.: 13589, 3398, 15490, 3398, 1730, 8739, 10238, 7306, 11512, 5754, 7733, 10360, 6378; Payload ID: 15256 relates to Category No.: 12127, 1893, 2768, 11948, 7086; Payload ID: 15257 relates to Category No.: 14565, 16214, 7710, 1795, 10005, 16211, 14111, 13437; Payload ID: 15258 relates to Category No.: 13589, 3398, 15490, 3398, 13618, 7280; Payload ID: 15259 relates to Category No.: 13589, 3398, 15490, 3398, 795, 4439, 12891, 3783, 8004, 3783, 10356; Payload ID: 15260 relates to Category No.: 13589, 3398, 15490, 3398, 2410, 4439, 12891, 3783, 8004, 3783; Payload ID: 15262 relates to Category No.: 7345, 7340;

Payload ID: 15263 relates to Category No.: 7345, 1556, 7341, 16090; Payload ID: 15264 relates to Category No.: 7345, 1567, 4948, 6738, 7333; Payload ID: 15265 relates to Category No.: 1820, 7345; Payload ID: 15266 relates to Category No.: 7345, 1567, 4948, 6738, 7333; Payload ID: 15267 relates to Category No.: 7345, 1567, 4948, 6738, 7333, 7332; Payload ID: 15268 relates to Category No.: 11926, 7340; Payload ID: 15269 relates to Category No.: 1417, 7710, 12573, 8510, 14369, 7675, 7678, 13407, 7674, 11249, 12578; Payload ID: 15271 relates to Category No.: 9500, 15310, 1204; Payload ID: 15272 relates to Category No.: 1703, 7340; Payload ID: 15273 relates to Category No.: 2186, 2196; Payload ID: 15274 relates to Category No.: 15490, 3398, 795, 8739, 2410, 11765, 16197, 1844, 13589, 3398, 2411, 15185, 3781, 326, 5203, 1684, 575, 1687, 575, 12451; Payload ID: 15275 relates to Category No.: 13594, 15490, 3398, 8739, 11512, 3604, 12891, 8934, 3613, 2411, 9454, 1622, 9540, 2080, 2602, 13589, 3398; Payload ID: 15277 relates to Category No.: 15490, 3398, 2410, 11512, 4859, 5263, 5773, 13594, 13184; Payload ID: 15278 relates to Category No.: 13589, 3398, 15490, 3398; Payload ID: 15279 relates to Category No.: 3452, 1955, 3354, 3448, 2022, 12786, 11245, 2004, 1926, 10533, 12840; Payload ID: 15280 relates to Category No.: 13594, 13589, 3398; Payload ID: 15281 relates to Category No.: 13975, 12427, 16049; Payload ID: 15282 relates to Category No.: 12427, 3639, 1862, 12891, 5869, 12543, 11942, 1995; Payload ID: 15283 relates to Category No.: 1703, 12427, 9950, 2351, 6253, 14663, 14102, 16294, 2353, 15662, 16235, 6248, 3141, 16189, 12433, 10557, 11113, 13299, 5065, 5062, 11558, 13302, 6335, 2354, 10426, 451, 6247, 1244, 3715, 2359, 2350, 5751, 682, 6227, 9777, 12432; Payload ID: 15284 relates to Category No.: 1703, 12125, 16189; Payload ID: 15285 relates to Category No.: 14565, 1703, 12427, 2350, 11094, 8944, 10260; Payload ID: 15286 relates to Category No.: 1703, 12427, 5037; Payload ID: 15287 relates to Category No.: 12427; Payload ID: 15288 relates to Category No.: 12427, 5446, 7306, 3118, 8164, 3015, 3016, 3012, 13026; Payload ID: 15289 relates to Category No.: 3021, 7997; Payload ID: 15294 relates to Category No.: 1730; Payload ID: 15296 relates to Category No.: 1204; Payload ID: 15297 relates to Category No.: 5939, 3781, 3564; Payload ID: 15298 relates to Category No.: 10238, 7743, 14475, 296, 290, 10194, 283, 12703, 1420, 11359, 10968; Payload ID: 15299 relates to Category No.: 8888, 7613, 14699, 2196, 7168, 1780, 3176, 8887, 4952, 3568, 5406, 9129, 4217, 7303, 4251, 12008, 2460, 10466; Payload ID: 15300 relates to Category No.: 15490, 3398, 11512, 1730, 7613, 10372, 11506, 3398, 1257, 2376, 10648, 2571, 10329, 3631, 14521, 15425, 6796, 10446, 15276, 3033, 10647, 4958, 4957, 15277, 15278, 12602, 15517, 8731, 3398, 14620, 2131, 3612, 1918, 4067, 2051, 14389; Payload ID: 15301 relates to Category No.: 16286, 11506, 3398, 7693, 7662, 13936, 8509, 8420, 2086, 8833, 9451, 8831; Payload ID: 15302 relates to Category No.: 16286, 9599, 4939, 7662, 7693, 9321, 7733, 6558; Payload ID: 15303 relates to Category No.: 13589, 3398, 15490, 3398, 1730, 8731, 3398, 2409, 14838, 8345; Payload ID: 15304 relates to Category No.: 13589, 3398, 8004; Payload ID: 15305 relates to Category No.: 2679, 4448, 1847, 13754; Payload ID: 15306 relates to Category No.: 9500, 15521, 4057, 4439, 2679, 1847, 13754, 5406, 13767, 13755, 2674, 7348; Payload ID: 15307 relates to Category No.: 8441; Payload ID: 15308 relates to Category No.: 9950, 2359, 14962; Payload ID: 15309 relates to Category No.: 13589, 3398, 15490, 3398, 8739, 13231; Payload ID: 15310 relates to Category No.: 15490, 3398, 8739, 7967, 13231; Payload ID: 15311 relates to Category No.: 1752, 10238, 337, 14589, 10175, 1780, 16197, 801, 8887, 8318, 11315, 6560, 12000, 3867, 16294, 991, 15156, 7243, 990, 914, 2549, 15165, 906; Payload ID: 15312 relates to Category No.: 12091, 13589, 3398, 15490, 3398, 9720, 14098, 4771; Payload ID: 15313 relates to Category No.: 12091, 7693, 3699, 11313, 10443, 12410; Payload ID: 15314 relates to Category No.: 12091, 1752; Payload ID: 15315 relates to Category No.: 14164, 274, 14165, 12137; Payload ID: 15317 relates to Category No.: 15490, 3398, 795, 8739, 8731, 3398, 10238, 2410, 5113, 4439, 15042, 12891, 3783, 8004, 3783; Payload ID: 15318 relates to Category No.: 9379, 3565, 13589, 3398, 15490, 3398, 1730, 7306, 1204; Payload ID: 15319 relates to Category No.: 1764, 12137, 16159, 16172, 9777, 3833, 14098, 4771, 12063, 2669, 1893, 6738, 11660, 13381, 14025, 11646, 12828, 7633, 15471, 13882; Payload ID: 15320 relates to Category No.: 12137, 16159, 16172, 1204; Payload ID: 15321 relates to Category No.: 15588, 14558, 14934, 1893, 4439, 13004; Payload ID: 15322 relates to Category No.: 15588, 14558, 14934, 1893, 4439, 13004; Payload ID: 15323 relates to Category No.: 14661, 5782, 746, 3833, 12063, 2669, 1893, 6738, 7132, 7295, 11660, 11502, 743; Payload ID: 15325 relates to Category No.: 15626; Payload ID: 15326 relates to Category No.: 15490, 3398, 15626, 11506, 3398, 12694, 10331, 10421; Payload ID: 15327 relates to Category No.: 15626; Payload ID: 15328 relates to Category No.: 15626; Payload ID: 15329 relates to Category No.: 15626; Payload ID: 15330 relates to Category No.: 15626; Payload ID: 15331 relates to Category No.: 2669, 12137, 3676, 3833, 12063, 1893, 6738, 11660, 15042; Payload ID: 15332 relates to Category No.: 12137, 3676, 3833, 12063, 2669, 10648, 1893, 6738, 9757, 11660, 9762, 12017, 11250; Payload ID: 15333 relates to Category No.: 15626, 16161, 12137, 3833; Payload ID: 15334 relates to Category No.: 12137, 15626, 16172, 3833, 12063, 2669, 1893, 6738, 11660, 11243, 13274; Payload ID: 15335 relates to Category No.: 15626, 16161, 12137, 3833; Payload ID: 15336 relates to Category No.: 5782, 16172, 746, 3833, 12063, 2669, 1893, 14663, 6738, 11660, 743; Payload ID: 15337 relates to Category No.: 5782, 3833, 16172; Payload ID: 15338 relates to Category No.: 5782, 3833, 12063, 2669, 1893, 6738, 4766, 11660, 264, 14834, 14586; Payload ID: 15339 relates to Category No.: 5782, 746, 3833, 12063, 2669, 1893, 14663, 6738, 11660, 743, 11290, 10424, 13087; Payload ID: 15340 relates to Category No.: 5782, 16172, 746, 3833, 12063, 2669, 1893, 14663, 6738, 11660, 743, 8887, 9480, 757, 1598, 991, 6384, 990, 2704, 2549, 12233, 6383, 12838, 12601; Payload ID: 15341 relates to Category No.: 5782, 3833, 746, 12063, 2669, 1893, 14663, 6738, 11660, 743; Payload ID: 15342 relates to Category No.: 5782, 746, 3833, 12063, 2669, 1893, 14663, 6738, 11660, 743, 5406; Payload ID: 15343 relates to Category No.: 12137, 3684, 746, 3833, 12063, 2669, 1893, 6738, 11660, 743, 5855, 13796; Payload ID: 15344 relates to Category No.: 12137, 16172; Payload ID: 15345 relates to Category No.: 12137, 3684, 1746, 746, 14934, 3676, 1893, 742, 15223, 742, 12123, 5855, 11661, 13892; Payload ID: 15346 relates to Category No.: 12137, 3684, 746, 1204, 1893, 742, 15223, 742, 5855; Payload ID: 15347 relates to Category No.: 5782, 15588, 3684, 3837, 746, 14934, 14096, 3829, 1893, 4439, 742, 15223, 742, 11949, 15606, 5855; Payload ID: 15348 relates to Category No.: 15588, 12137, 5782, 3684, 746, 14934, 1893, 4439, 742, 15223, 742, 12123, 12122, 5855, 12135; Payload ID: 15349 relates to Category No.: 12137, 3684, 1893, 2740, 5855, 11661; Payload ID: 15350 relates to Category No.: 3684, 14934, 12126, 1893, 11661, 15606, 5855, 11661, 13713, 6269, 7305, 9068;

Payload ID: 15351 relates to Category No.: 12194, 3986; Payload ID: 15352 relates to Category No.: 12194, 3986, 1204; Payload ID: 15353 relates to Category No.: 3986, 12194; Payload ID: 15354 relates to Category No.: 8928, 8405, 9103, 15016, 14423; Payload ID: 15356 relates to Category No.: 1204, 2945; Payload ID: 15357 relates to Category No.: 5367, 14565, 10775, 6795; Payload ID: 15358 relates to Category No.: 12194, 10702, 7613, 10372, 8731, 3398, 1483, 10238, 7743, 3442, 11506, 3398, 7737, 8831, 7693, 7735, 10314, 2014, 2136, 1965, 12488, 9091, 10606, 13827, 10362, 8004, 8118, 1918, 2131, 10382, 11620, 1970, 11418, 2006, 7939, 7942, 10574, 8422, 2100, 1993, 10622, 9455, 7597, 2116, 7666, 1964, 8420, 1996, 4969, 7990, 10629, 7643, 10602, 11394, 4970, 8449, 12625, 7984, 13969, 6764, 2149, 11120, 8833, 7695, 14782, 16005, 724, 8887, 10600, 6530, 14793, 4998, 8421, 8424, 7662, 8193, 4138, 16289, 8888, 16286, 10038, 12559, 3247, 12837, 10044, 11819, 1278, 2155, 3188, 8471, 8867, 15018, 2656, 13276; Payload ID: 15359 relates to Category No.: 11512, 10372, 8731, 3398, 1483, 10238, 1816, 7743, 7737, 8831, 7693, 7735, 10314, 9091, 9600, 10606, 10362, 11174, 8004, 9480, 10344, 4974, 7939, 7942, 10226, 8177, 1551, 8449, 14389, 7875, 13508, 12646, 13827, 724, 8887, 6530, 7967, 795, 14793, 13681, 2571, 7840, 12498, 1622, 11628, 3578, 1274, 7662, 2374, 8287, 8193, 11147, 10333, 10545, 16289, 8888, 1968, 3247, 2652, 12837, 10044, 2155, 7698, 3188, 8471, 13966; Payload ID: 15360 relates to Category No.: 1730, 1483, 10238, 7306, 7743, 9811, 7693, 10648, 10314, 13874, 9091, 11313, 8611, 7131, 10880, 10566, 8647; Payload ID: 15361 relates to Category No.: 14565, 795, 1730, 1483, 674, 7306, 7743, 16214, 7693, 9091, 8524, 8611, 7712, 3924, 8832; Payload ID: 15362 relates to Category No.: 1703, 1701, 8196, 6296, 8921; Payload ID: 15363 relates to Category No.: 1703, 1206, 4020, 3566, 4021, 9451, 14045, 3010, 1971, 9000, 10383, 5428, 13970, 10289, 14011, 1730, 9455, 7821; Payload ID: 15364 relates to Category No.: 7912, 14640, 1276; Payload ID: 15365 relates to Category No.: 14565, 12427, 10074, 7598, 12640, 4021, 1238, 10080, 7924, 10557, 12646, 1993, 1269, 13925, 9451, 13859, 16294, 13796, 13837, 13794, 13981, 13818, 13797, 13916, 4949, 6375, 13915, 13864, 5458; Payload ID: 15366 relates to Category No.: 9561; Payload ID: 15367 relates to Category No.: 4828, 3244, 1795, 3973; Payload ID: 15368 relates to Category No.: 14661, 5782, 16172, 12601, 7707; Payload ID: 15369 relates to Category No.: 14661, 5782, 746, 3833, 12063, 2669, 1893, 14663, 6738, 11660, 743, 16172; Payload ID: 15370 relates to Category No.: 14565, 10702, 8540; Payload ID: 15371 relates to Category No.: 14565, 7710, 3566, 4145, 8739, 12999, 8688, 13186, 8129, 8143, 8154, 8156, 13925, 13977, 13859, 13827, 13970, 13818, 13845, 14051, 14005; Payload ID: 15377 relates to Category No.: 687; Payload ID: 15378 relates to Category No.: 1204; Payload ID: 15380 relates to Category No.: 12646, 7735, 11063; Payload ID: 15381 relates to Category No.: 12427; Payload ID: 15382 relates to Category No.: 690, 5785, 5428, 6606, 12105, 10175, 7965, 10558, 3757, 7924, 7919, 3713, 5424; Payload ID: 15383 relates to Category No.: 10074, 1238, 10080; Payload ID: 15384 relates to Category No.: 5782, 8962, 12988, 9637, 7710; Payload ID: 15385 relates to Category No.: 12137, 11646, 3986; Payload ID: 15386 relates to Category No.: 12137, 11646; Payload ID: 15387 relates to Category No.: 12137, 11646; Payload ID: 15388 relates to Category No.: 12137; Payload ID: 15389 relates to Category No.: 12137, 3986, 10303, 13831, 10478, 7908; Payload ID: 15390 relates to Category No.: 5367, 7912, 5446, 13925, 8818, 729, 8507; Payload ID: 15391 relates to Category No.: 9982, 1512, 12999, 2041, 1514, 9616, 9101, 13096, 2016, 2020; Payload ID: 15392 relates to Category No.: 1737, 15618, 14661, 12137, 1512, 2885, 15715, 1905, 1893, 14663, 4439, 16197, 16193, 7132, 7295, 12120, 7187, 7188, 11660, 1995, 11502, 981, 1891, 4442, 7155, 5048, 12914, 4541, 16201, 12671, 7153, 9205, 3016, 2880; Payload ID: 15393 relates to Category No.: 483, 3971, 13362, 2229, 15142, 12753, 7863, 10493; Payload ID: 15394 relates to Category No.: 483, 13362, 2229, 15142; Payload ID: 15395 relates to Category No.: 483, 13362, 2229, 15142; Payload ID: 15396 relates to Category No.: 2169, 11634, 2709, 13522, 10025; Payload ID: 15397 relates to Category No.: 11926, 3837, 12063, 9125, 14096, 3829, 1893, 12117, 11660, 3835, 13831; Payload ID: 15400 relates to Category No.: 1703, 5428, 12999, 1451, 13925, 1238, 11313, 6145, 14029, 5037, 13893, 355, 6149, 6137, 6147, 293, 10904; Payload ID: 15401 relates to Category No.: 1703, 12994, 1238, 6145, 13785; Payload ID: 15402 relates to Category No.: 1703, 10074, 13925, 1238, 10080, 6145, 11187, 11209, 3015, 13007, 1453, 6137, 5428, 5037, 6149, 10904, 12658, 13969, 14589, 10343; Payload ID: 15403 relates to Category No.: 1703, 1238, 6145, 16189, 2021, 6135, 6149; Payload ID: 15404 relates to Category No.: 12137; Payload ID: 15405 relates to Category No.: 6814, 1830; Payload ID: 15406 relates to Category No.: 9982, 1894; Payload ID: 15407 relates to Category No.: 14421, 14422; Payload ID: 15408 relates to Category No.: 6467, 10491, 1417, 10366, 11460, 11566, 12074, 10852, 13381, 10416, 11036, 11459, 12577, 13747; Payload ID: 15409 relates to Category No.: 7303, 14004, 455, 5263, 2723; Payload ID: 15410 relates to Category No.: 1204, 14624, 2083, 7122, 14638, 13758, 6371, 1921, 7315, 14631, 11378, 13954; Payload ID: 15412 relates to Category No.: 13975, 11634, 14534, 6296, 4859, 1295, 14421; Payload ID: 15413 relates to Category No.: 1790, 4535, 13860, 9554, 5545; Payload ID: 15416 relates to Category No.: 1026, 14432, 11093, 8869, 8934, 8854, 1024, 1049, 15134, 15136, 15137, 8870, 14435, 7637, 7553, 12523, 15135, 9333, 14464, 1035, 12953, 3041, 7636, 7251, 14433, 7938, 4069, 3238, 1322, 15657, 4792, 16128, 15654, 8872, 4071, 10952, 795; Payload ID: 15417 relates to Category No.: 1026, 14432, 1816, 10366, 8869, 7637, 7553; Payload ID: 15418 relates to Category No.: 1026, 14432, 5367, 10366, 8869, 13827, 7637, 7553, 11634, 9480, 14793, 4949, 1250, 6191, 8888, 1578, 3238, 12234; Payload ID: 15419 relates to Category No.: 14432, 10366, 8869, 7637, 7553; Payload ID: 15420 relates to Category No.: 1026, 14432, 12648, 15143, 10366, 14928, 7598, 12461, 9600, 8869, 7754, 7637, 7553; Payload ID: 15421 relates to Category No.: 1026, 14432, 10366, 8869, 8854, 1024, 15134, 15136, 15137, 14435, 7637, 7553, 14433, 4069, 1322, 15657, 16128, 8870; Payload ID: 15422 relates to Category No.: 14432, 10366, 8869, 7637, 7553; Payload ID: 15423 relates to Category No.: 690, 1026, 14432, 10366, 8869, 7637, 7553, 7598, 12648, 1048, 15196, 15327, 12810; Payload ID: 15425 relates to Category No.: 14432, 10366, 8869, 8887, 11419, 7334, 7637, 7553, 1754, 2235; Payload ID: 15426 relates to Category No.: 1026, 14432, 5367, 10702, 1703, 12648, 7613, 8739, 8421, 10366, 11285, 8869, 12754, 11187, 11178, 7719, 7637, 7553, 9452, 14434, 8449, 10448, 7588, 12645, 6136, 10261; Payload ID: 15427 relates to Category No.: 8862, 1026, 14432, 1816, 10366, 8869, 7637, 7553, 7636, 14069; Payload ID: 15428 relates to Category No.: 14432, 10366, 8869, 7637, 7553; Payload ID: 15429 relates to Category No.: 8862, 1026, 14432, 1713, 1703, 1816, 10175, 10366, 10558, 1035, 8869, 10191, 11266, 7919, 7719, 1246, 10258, 7637, 7553, 10226, 10333, 10553, 3241, 14555, 3140, 1023, 1320, 9600, 8937, 8938;

Payload ID: 15430 relates to Category No.: 14432, 10366, 8869, 7637, 7553, 3140, 1023, 8937, 8938; Payload ID: 15431 relates to Category No.: 8862, 1026, 14432, 795, 2940, 1795, 11093, 8869, 9410, 7637, 7553, 8934, 2197; Payload ID: 15432 relates to Category No.: 14432, 10366, 8869, 7637, 7553; Payload ID: 15433 relates to Category No.: 14432, 10366, 8869, 7637, 7553, 1026; Payload ID: 15434 relates to Category No.: 1026, 14432, 10366, 8869, 7637, 7553, 11390, 8635; Payload ID: 15435 relates to Category No.: 1026, 5367, 5428, 5592, 12999, 10366, 10257, 8869, 10583, 7553, 9455, 10945, 8936, 1023, 11285, 9338; Payload ID: 15436 relates to Category No.: 11934, 1893, 729, 7675, 8648, 5533, 2532, 11369, 14534; Payload ID: 15437 relates to Category No.: 11934, 729, 2532, 11369, 14534; Payload ID: 15438 relates to Category No.: 11512, 7613, 1955, 6606, 14267, 3320, 4186, 3353, 3448, 14838, 7290, 2083, 2110, 1970, 11094, 10527, 5443, 11345, 11980, 2001, 10527, 15287, 11472, 10118, 2469, 15291; Payload ID: 15439 relates to Category No.: 12194; Payload ID: 15441 relates to Category No.: 14427, 14423, 6814; Payload ID: 15442 relates to Category No.: 6814, 13248, 9500, 9048, 14663, 15307, 9053, 9111, 3428, 13189, 14509, 1766, 6344, 12228, 15308, 16267; Payload ID: 15443 relates to Category No.: 14896, 6685; Payload ID: 15444 relates to Category No.: 1737, 1721; Payload ID: 15445 relates to Category No.: 1737, 1721, 11934; Payload ID: 15446 relates to Category No.: 1737, 1721; Payload ID: 15447 relates to Category No.: 1737, 1721; Payload ID: 15448 relates to Category No.: 1737, 14699, 7154, 2459, 1721, 12603, 13363, 13067, 8936; Payload ID: 15449 relates to Category No.: 1737, 1721; Payload ID: 15450 relates to Category No.: 1737, 795, 1721, 10238, 12498, 11298, 10864, 14834, 1295, 14817, 14830; Payload ID: 15451 relates to Category No.: 12851, 2886, 13535, 15165, 10593; Payload ID: 15452 relates to Category No.: 2886, 16197; Payload ID: 15453 relates to Category No.: 7154, 2460, 2886, 11934, 12793; Payload ID: 15455 relates to Category No.: 1737, 1721, 11934; Payload ID: 15456 relates to Category No.: 12091, 15898, 1002, 11512, 5785, 3691, 1730, 7613, 10238, 803, 12993, 7129, 14015, 8988, 11997, 6451, 10938, 13164, 7131, 5376, 6453, 13395, 13346, 8045, 11934, 11285; Payload ID: 15457 relates to Category No.: 10074, 12099, 1206, 1238, 10080, 4851, 7847, 7664, 6622, 11829, 15209, 6503, 6496; Payload ID: 15458 relates to Category No.: 5782, 9940, 4798, 4021; Payload ID: 15459 relates to Category No.: 12194, 7658, 11602, 14080; Payload ID: 15460 relates to Category No.: 1830, 4521, 15370, 6355, 12330; Payload ID: 15461 relates to Category No.: 1830, 1204, 15370, 6355; Payload ID: 15462 relates to Category No.: 6814, 1204; Payload ID: 15463 relates to Category No.: 12133, 14663, 1878, 12240, 6355, 4670, 6356, 15310, 16234, 16275, 1308, 1603, 4233, 2126, 3489, 11941, 4661, 4662, 12194, 6814; Payload ID: 15464 relates to Category No.: 9374, 14663, 4670, 6356, 15310, 16234, 16275, 4233, 10372, 11941, 6354, 4661, 4662, 6814; Payload ID: 15465 relates to Category No.: 9940, 14865, 9902, 6358, 10341, 11367; Payload ID: 15466 relates to Category No.: 14865, 6358, 9902, 10341, 11367; Payload ID: 15467 relates to Category No.: 6358, 5446, 3021, 3165, 10548; Payload ID: 15468 relates to Category No.: 6358, 9940; Payload ID: 15469 relates to Category No.: 5446, 9940, 3021, 14865, 9902, 6358, 7369, 3165, 10341, 11367; Payload ID: 15470 relates to Category No.: 1207, 14865, 14663, 14862, 14874, 2206, 14853; Payload ID: 15471 relates to Category No.: 6814, 1207, 14865, 14663, 14862, 14874, 2206, 14867, 14853; Payload ID: 15472 relates to Category No.: 6814, 1207, 14865, 14663, 14862, 14859; Payload ID: 15473 relates to Category No.: 14862; Payload ID: 15474 relates to Category No.: 14862; Payload ID: 15475 relates to Category No.: 8441, 8449, 12458, 8613, 13514, 8393, 7675, 7912; Payload ID: 15476 relates to Category No.: 7912, 7564; Payload ID: 15477 relates to Category No.: 7912; Payload ID: 15478 relates to Category No.: 7912, 10238, 6530, 14838, 14834, 4167, 14442, 6526, 8613; Payload ID: 15479 relates to Category No.: 7912; Payload ID: 15480 relates to Category No.: 7912, 7598, 4021, 3791, 4933, 8106, 13557, 3769, 667, 8549, 12614, 8613, 7602, 8614; Payload ID: 15481 relates to Category No.: 8613; Payload ID: 15482 relates to Category No.: 7912; Payload ID: 15483 relates to Category No.: 7912; Payload ID: 15484 relates to Category No.: 7912; Payload ID: 15485 relates to Category No.: 7912, 4021, 8887, 1312, 3605, 10035, 1918, 10651, 8367; Payload ID: 15486 relates to Category No.: 7912; Payload ID: 15487 relates to Category No.: 7912, 7252, 7750, 7740, 8887, 3924, 1093, 3800, 1918, 8367; Payload ID: 15488 relates to Category No.: 7912; Payload ID: 15489 relates to Category No.: 1295, 1830, 13925, 6356, 11941, 14491, 3481, 12330, 3479, 13969, 496, 13827, 13951; Payload ID: 15490 relates to Category No.: 12091, 5785, 13166, 14569, 15004, 12498, 9713, 360, 14015, 9716, 8488, 8487, 1859, 8599, 8598, 8535, 12544, 12999, 13040, 8437, 11222; Payload ID: 15491 relates to Category No.: 7288, 15517, 7291, 16182, 14271, 15291, 4439, 7280, 7261, 14271, 16183; Payload ID: 15492 relates to Category No.: 7291, 16182; Payload ID: 15494 relates to Category No.: 8862, 7288, 1730, 14271, 13445, 12484, 16182, 14456; Payload ID: 15496 relates to Category No.: 7288, 15517, 7291, 16182, 14271, 7266, 7290, 15291, 4439, 7280, 7261, 601, 16182, 5406, 1562; Payload ID: 15497 relates to Category No.: 13589, 3398, 7291, 16182, 7290, 14918, 7280, 14271, 16183, 8335, 16182, 2924; Payload ID: 15498 relates to Category No.: 7288, 15517, 7291, 16182, 14271, 15291, 4439, 7280, 7261; Payload ID: 15499 relates to Category No.: 7266, 14918, 12484, 16182, 8335, 16182, 2924; Payload ID: 15500 relates to Category No.: 7288, 15517, 7291, 16182, 14271, 15291, 8408, 4439, 7280, 7261, 12484, 16182; Payload ID: 15501 relates to Category No.: 15517, 7291, 16182, 14271, 15291, 4439, 7280, 7261; Payload ID: 15502 relates to Category No.: 7288, 15517, 7291, 16182, 14271, 15291, 4439, 7280, 7261, 14271, 16183, 8335, 16182, 4969; Payload ID: 15503 relates to Category No.: 7288, 15517, 7291, 16182, 14271, 7290, 15291, 4439, 7280, 7261, 14050, 6271, 12619, 2009; Payload ID: 15504 relates to Category No.: 7728, 15517, 7291, 16182, 14271, 7290, 15291, 4439, 12484, 16182, 7280, 7261, 8335, 16182, 601, 16182, 13682, 10575, 8195, 13053; Payload ID: 15505 relates to Category No.: 7288, 15517, 7291, 16182, 14271, 15291, 4439, 7280, 7261, 8335, 16182; Payload ID: 15506 relates to Category No.: 7288, 14271; Payload ID: 15507 relates to Category No.: 7288, 15517, 7291, 16182, 14271, 7290, 15291, 4439, 7280, 7261, 8335, 16182; Payload ID: 15508 relates to Category No.: 12091, 1721, 13166, 14569, 15004, 12498, 360, 11858, 13093, 6409; Payload ID: 15509 relates to Category No.: 12091, 1002, 1722, 1955, 12633, 7743, 3871, 360, 14663, 7735, 5541, 11858, 13904, 11542, 3728, 4535, 5807, 16095, 12863, 2141, 716, 11178, 13681, 14834, 1048, 11626, 15207, 10261, 4762, 1483, 15425, 12754, 3039, 11275, 13361, 7941, 15242; Payload ID: 15510 relates to Category No.: 11997; Payload ID: 15511 relates to Category No.: 12091, 9720, 11858, 11512, 2131, 15517; Payload ID: 15512 relates to Category No.: 12091, 5785, 795, 10238, 10622, 13397; Payload ID: 15513 relates to Category No.: 12091, 5785, 11858, 10622, 795, 11765; Payload ID: 15514 relates to Category No.: 12091; Payload ID: 15515 relates to Category No.: 12091, 14565, 795, 13166, 14569, 15004, 12498, 7737, 3974, 360, 11765, 11858, 1844, 13877, 5814, 12525; Payload ID: 15516 relates to Category No.: 12091, 14565, 13975, 13166, 14569, 15004, 12498, 360, 11858, 11419, 5811, 13877, 4762, 3881, 4767, 3924, 10261; Payload ID: 15517 relates to Category No.: 12091, 5785, 14565, 795, 10238, 6606, 348, 13166, 14569, 15004, 12498, 7693, 12117, 5072, 11363, 11291, 11242, 7743, 10602, 2169, 8889, 5016, 10878, 11266, 10606, 8419, 3625, 11739, 1733, 12629; Payload ID: 15518 relates to Category No.: 12091; Payload ID: 15519 relates to Category No.: 12091, 5785, 9713, 7131; Payload ID: 15520 relates to Category No.: 12091, 5785, 9713; Payload ID: 15521 relates to Category No.: 12091, 5785, 9713; Payload ID: 15522 relates to Category No.: 12091, 11858; Payload ID: 15523 relates to Category No.: 12091; Payload ID: 15524 relates to Category No.: 12091, 2459, 13460, 11394, 11634, 10728, 1295, 3808; Payload ID: 15525 relates to Category No.: 12091, 5785, 1894, 8255; Payload ID: 15526 relates to Category No.: 12091, 5785, 12656; Payload ID: 15527 relates to Category No.: 12091, 1764, 5785, 14565, 795, 10238, 6606, 348, 13166, 14569, 15004, 9713, 7693, 11285, 12117, 5072, 11858, 11291, 11174, 11242, 7743, 10602, 2169, 8889, 5016, 5939, 10606, 8419, 9600, 3625, 11739, 1733, 12629; Payload ID: 15528 relates to Category No.: 12091, 7303, 12891, 7613, 6375, 13105, 13758, 4690, 6371, 6384; Payload ID: 15529 relates to Category No.: 8756, 14915, 6494, 15570, 7939, 7942, 8439, 7938, 8739; Payload ID: 15530 relates to Category No.: 12091; Payload ID: 15531 relates to Category No.: 12091, 795, 13166, 14569, 15004, 12498, 360, 11765, 11858, 1844, 13877, 6990, 12992; Payload ID: 15532 relates to Category No.: 3100, 11910, 14838, 12832, 6607; Payload ID: 15533 relates to Category No.: 5785, 11910; Payload ID: 15534 relates to Category No.: 12091, 1730, 15614, 9717, 5446, 12646; Payload ID: 15537 relates to Category No.: 1737, 12137, 1721, 12743, 14097, 3702; Payload ID: 15538 relates to Category No.: 3871, 9420, 7132, 4336, 15762; Payload ID: 15539 relates to Category No.: 7912; Payload ID: 15540 relates to Category No.: 7912, 1238, 1205; Payload ID: 15541 relates to Category No.: 7912; Payload ID: 15542 relates to Category No.: 7912, 10800, 11187, 8021, 12699, 13630, 8215, 4538; Payload ID: 15544 relates to Category No.: 5428, 7912, 381, 6494, 13071; Payload ID: 15546 relates to Category No.: 7912; Payload ID: 15547 relates to Category No.: 7912, 6227, 14838, 4328, 1238, 8099, 8549; Payload ID: 15548 relates to Category No.: 7912, 15626, 4515; Payload ID: 15549 relates to Category No.: 15412, 7912; Payload ID: 15550 relates to Category No.: 7912; Payload ID: 15551 relates to Category No.: 7912; Payload ID: 15552 relates to Category No.: 7912, 7613, 7131, 10491; Payload ID: 15553 relates to Category No.: 7912; Payload ID: 15554 relates to Category No.: 7912, 8508, 4969; Payload ID: 15555 relates to Category No.: 7912, 14034, 13386, 8194; Payload ID: 15556 relates to Category No.: 7912, 7613, 1238, 4180, 16294; Payload ID: 15557 relates to Category No.: 7912, 8441, 10372, 7710, 8193, 10366, 16189, 10545, 10578, 8549, 9569, 993; Payload ID: 15558 relates to Category No.: 7912, 8441, 13386, 11844; Payload ID: 15559 relates to Category No.: 7912, 7252, 4021, 7242, 12824, 11824; Payload ID: 15560 relates to Category No.: 7912, 14456, 2082; Payload ID: 15561 relates to Category No.: 7912, 10446, 11543, 10656, 11211; Payload ID: 15562 relates to Category No.: 7912; Payload ID: 15563 relates to Category No.: 5367, 795, 7912, 7613, 7840, 10648, 1965, 13788, 11844, 6618, 7561; Payload ID: 15564 relates to Category No.: 7912, 1238, 12543, 5825, 13966, 8112; Payload ID: 15565 relates to Category No.: 7912, 2311, 1238, 1205; Payload ID: 15566 relates to Category No.: 690, 15490, 3398, 11512, 7912, 10074, 7737, 15521, 4439, 2041, 4021, 1238, 15570, 10790, 10080, 4180, 11037, 2469, 10855, 3015, 11316, 7919, 8835, 7967, 10226, 7721, 8635, 10280, 7983, 13398, 7657, 8637, 2433, 8475, 10906, 8809, 12646, 2131, 10036, 12488; Payload ID: 15567 relates to Category No.: 7912, 12638, 1238, 10248, 8549, 7657, 8475, 8537, 8477, 7743, 8441, 14050, 8476, 8645, 8458, 2220, 7735, 6630, 8639, 13582, 3145, 13532, 4588, 6323, 5465, 14441, 11094, 13996, 3566, 14413, 3066; Payload ID: 15568 relates to Category No.: 7912; Payload ID: 15569 relates to Category No.: 7912, 7306, 1780, 7598, 11087, 7941, 2110, 1984, 9490, 14056, 496, 5949, 11094, 8004, 8374, 1951, 7923, 13784, 1936, 14545, 8112, 13765; Payload ID: 15570 relates to Category No.: 7912, 11512, 10074, 381, 10878, 1238, 10080, 4180, 2571, 10583, 11541, 10358, 11418, 11391, 1249, 10380, 10446, 7983, 12548, 8475, 13970; Payload ID: 15571 relates to Category No.: 7912, 10074, 5446, 2610, 2488, 1238, 10080, 4180, 1237, 1238, 5825, 7823, 6104, 496; Payload ID: 15572 relates to Category No.: 7912, 14033, 4021, 2571, 12049, 2568, 2375; Payload ID: 15573 relates to Category No.: 7912, 2169, 9738, 12614; Payload ID: 15574 relates to Category No.: 7912, 7252, 12614; Payload ID: 15575 relates to Category No.: 13186, 12498; Payload ID: 15576 relates to Category No.: 13589, 3398, 15490, 3398, 1780, 8954, 13784, 11734, 11087; Payload ID: 15577 relates to Category No.: 15490, 3398, 10372, 12732, 11512, 11506, 3398; Payload ID: 15578 relates to Category No.: 15490, 3398, 7735, 11506, 3398; Payload ID: 15579 relates to Category No.: 13589, 3398, 15490, 3398, 7735, 11506, 3398; Payload ID: 15581 relates to Category No.: 12427, 10074, 5446, 345, 381, 10175, 1893, 8112, 9000, 10486, 6410, 13373, 10343, 10478, 10824, 6462; Payload ID: 15582 relates to Category No.: 1713, 381, 10175; Payload ID: 15583 relates to Category No.: 1713, 381, 10175; Payload ID: 15586 relates to Category No.: 14661, 11512, 15517, 13818, 4949, 8928, 13882, 11537, 11392, 13874, 11363, 14025, 692, 10358, 4952, 8493, 11224, 1762, 7332, 2158, 11526, 15736, 7294, 13487, 11531, 7648, 13589, 3398, 5406, 274, 11740, 8934, 11506, 3398, 14589, 15400, 10074, 8936, 1820, 10086, 6666, 10257, 286, 11626, 14365, 1572, 3194, 7241, 6796, 5073, 901, 15000, 4418, 15402, 4970, 10628, 1183, 3811, 12614, 9600, 6384, 4066, 3853, 6299, 4065, 15477, 14645, 3807, 4954, 15217, 6141, 1582, 13679, 3439, 1331, 6388, 2648, 1984, 7743, 6322, 7737, 11507; Payload ID: 15587 relates to Category No.: 13589, 3398, 15490, 3398, 6636; Payload ID: 15588 relates to Category No.: 12091, 15618, 5785, 795, 12638, 5846, 12603, 12633, 12498, 9713, 12544, 14742, 12646, 8940, 14015, 13460, 2159, 6322, 11399, 11557, 12889, 13711, 1955, 7613, 12619, 16213, 6971, 10362, 8301, 4514, 10495; Payload ID: 15589 relates to Category No.: 12091, 15618, 5785, 13975, 5846, 12633, 12498, 9713, 12646, 2159, 11399, 11557; Payload ID: 15590 relates to Category No.: 12091, 15618, 5785, 12638, 5846, 12633, 12498, 9713, 12646, 14015, 13460, 2159, 11399, 11557; Payload ID: 15591 relates to Category No.: 15588, 15715, 4439, 14526, 15698, 14427; Payload ID: 15592 relates to Category No.: 4439, 14526, 15698, 14427; Payload ID: 15593 relates to Category No.: 1722, 1955, 7743, 15521, 4439, 13426, 13361; Payload ID: 15594 relates to Category No.: 15521, 4439, 13426, 1002, 4535, 13888, 13371, 13860, 11980, 7122, 15662, 7036, 4536, 4100, 12910, 12581; Payload ID: 15595 relates to Category No.: 13426, 4535, 13888, 13361; Payload ID: 15596 relates to Category No.: 15490, 3398, 5202, 11062, 11069, 8731, 3398, 14620, 2411, 4949; Payload ID: 15597 relates to Category No.: 15490, 3398, 8739, 7743, 2410, 9694, 9688, 12770, 14566, 5203, 5154, 4949; Payload ID: 15598 relates to Category No.: 5202, 2410, 11512, 3900, 11174, 1951, 8522, 9274, 7416; Payload ID: 15599 relates to Category No.: 6902; Payload ID: 15600 relates to Category No.: 10702, 11910, 14838, 12942; Payload ID: 15601 relates to Category No.: 10702, 7369, 12133, 12942; Payload ID: 15603 relates to Category No.: 7725, 9228, 5202, 5159, 1780, 3305, 3656, 13729, 3328, 3453, 7144, 10524, 3318, 5154, 5153, 10534, 7805, 15632, 3395; Payload ID: 15604 relates to Category No.: 13589, 3398, 5202, 15490, 3398, 1955, 2409, 2410, 5033, 9694, 9688, 9691, 12978, 11506, 3398, 13837; Payload ID: 15605 relates to Category No.: 1737, 15490, 3398, 8739, 8731, 3398, 7154, 5202, 2410, 7132, 9694, 12770, 14566; Payload ID: 15606 relates to Category No.: 13589, 3398, 15490, 3398, 5159, 2410; Payload ID: 15607 relates to Category No.: 13589, 3398, 15490, 3398, 5159, 2410, 5202; Payload ID: 15608 relates to Category No.: 5202, 13589, 3398, 15499, 7018, 2410, 5153, 13183, 9278, 5155, 16096, 12891, 8887, 690, 4251, 3575, 3602, 14943, 7238, 5154, 9697, 1763, 6798, 9722, 3606, 2706; Payload ID: 15609 relates to Category No.: 15490, 3398, 11512, 11506, 3398, 5159, 2410, 5154, 9691, 9697, 9694, 9688, 11053, 13259; Payload ID: 15610 relates to Category No.: 14177, 9697, 9694; Payload ID: 15612 relates to Category No.: 5202, 12999, 8390, 14944, 14949, 9694; Payload ID: 15613 relates to Category No.: 6902; Payload ID: 15614 relates to Category No.: 15490, 3398, 5202, 2410, 8739, 5453, 1269, 5168, 13837, 14039; Payload ID: 15615 relates to Category No.: 1737, 8731, 3398, 7154, 5202, 2410, 2429, 4952, 6107, 5166; Payload ID: 15616 relates to Category No.: 13186, 8731, 3398, 3356, 7710, 9274, 9238, 8072, 8373, 13370, 4439, 16197, 7132, 9276; Payload ID: 15617 relates to Category No.: 9274, 15490, 3398, 11512, 3711; Payload ID: 15618 relates to Category No.: 13589, 3398, 15490, 3398, 8731, 3398, 674, 1893, 12120, 11660, 4440, 724, 14838, 2411; Payload ID: 15619 relates to Category No.: 13589, 3398, 15490, 3398, 674; Payload ID: 15620 relates to Category No.: 13589, 3398, 15490, 3398, 674; Payload ID: 15621 relates to Category No.: 13589, 3398, 15490, 3398; Payload ID: 15622 relates to Category No.: 15490, 3398, 1730, 11506, 3398, 10952, 6538, 8739, 6530, 8004, 14532; Payload ID: 15624 relates to Category No.: 9420, 7132, 4336, 8454; Payload ID: 15625 relates to Category No.: 12137, 16172; Payload ID: 15626 relates to Category No.: 16172, 12137, 1204; Payload ID: 15627 relates to Category No.: 12137, 16172; Payload ID: 15628 relates to Category No.: 5446, 7154, 13376, 9292, 6125, 10176; Payload ID: 15629 relates to Category No.: 1816, 11371, 12994, 1849, 5285, 11077; Payload ID: 15630 relates to Category No.: 12994, 6134, 11079, 10794; Payload ID: 15631 relates to Category No.: 690, 14565, 1730, 11371, 16085, 1780; Payload ID: 15632 relates to Category No.: 14661, 10702, 11371, 5912; Payload ID: 15633 relates to Category No.: 14661, 10702, 11371, 5912; Payload ID: 15634 relates to Category No.: 8454; Payload ID: 15637 relates to Category No.: 5367, 5785, 15614, 11371; Payload ID: 15639 relates to Category No.: 5785, 11371, 1238, 6018, 11033, 12768, 14565; Payload ID: 15640 relates to Category No.: 5785, 11371, 274, 5541, 2885, 1334, 749, 12994, 1072, 13135, 8862, 13395; Payload ID: 15641 relates to Category No.: 5785, 11371, 1238, 1730, 4998, 3592, 14565; Payload ID: 15642 relates to Category No.: 5785, 14565, 1995; Payload ID: 15643 relates to Category No.: 5785; Payload ID: 15644 relates to Category No.: 5785, 14622, 8922, 14624; Payload ID: 15645 relates to Category No.: 2933, 11884, 10501, 14729, 6322, 10590, 8920, 7565, 12483, 12045, 3060, 901, 480, 16242, 15142, 3168, 14184, 9331, 4932; Payload ID: 15646 relates to Category No.: 15140, 6323, 4004, 6758, 11436, 4588, 6299, 14729, 6102, 480, 16242; Payload ID: 15647 relates to Category No.: 6606, 6297, 6103, 15140, 7749, 8920, 6323, 13530, 4004, 6296, 7565, 6758, 3581, 3060, 656, 11436, 4588, 1296, 11433, 12760, 6299, 6293, 13083, 10501, 10590, 9078, 10922, 13085, 11651, 4923, 15008, 10923, 10673, 12935, 12535, 10217; Payload ID: 15648 relates to Category No.: 15113, 9460, 12397; Payload ID: 15649 relates to Category No.: 4949, 4057, 1269, 10107, 1730, 14640, 15113, 4020, 455, 12026, 10606; Payload ID: 15650 relates to Category No.: 13449, 9858; Payload ID: 15651 relates to Category No.: 1204; Payload ID: 15652 relates to Category No.: 7370, 13032, 9740, 12831; Payload ID: 15653 relates to Category No.: 11371, 11884; Payload ID: 15654 relates to Category No.: 11371; Payload ID: 15656 relates to Category No.: 9500, 10702, 1790, 12459, 12545, 12463; Payload ID: 15657 relates to Category No.: 12091; Payload ID: 15658 relates to Category No.: 12091, 6606, 13166, 14569, 15004, 12498, 345; Payload ID: 15659 relates to Category No.: 12091; Payload ID: 15660 relates to Category No.: 2940, 6738, 12640, 11646, 10978; Payload ID: 15662 relates to Category No.: 12153, 7613, 7965, 7840; Payload ID: 15663 relates to Category No.: 12153, 8454; Payload ID: 15665 relates to Category No.: 5785, 8546, 7834; Payload ID: 15666 relates to Category No.: 14565, 10702; Payload ID: 15667 relates to Category No.: 14565, 11371; Payload ID: 15668 relates to Category No.: 3639, 12603, 7743, 8728, 7735, 10256, 1906, 8049, 12024; Payload ID: 15669 relates to Category No.: 5785, 14565, 8546, 7834, 8522; Payload ID: 15670 relates to Category No.: 2506, 11316, 6754; Payload ID: 15671 relates to Category No.: 14565, 3639, 2169; Payload ID: 15672 relates to Category No.: 1026, 14565, 2169, 3775, 6738, 8988, 743, 11646, 7933, 15156, 13401; Payload ID: 15673 relates to Category No.: 14565, 3639, 2169; Payload ID: 15674 relates to Category No.: 1002, 795, 1983, 1905, 12743, 10256, 13376, 12066, 11294, 11282, 12404, 10254, 996, 6732, 10979, 12047, 11186, 7122, 9819, 9940, 2994, 11260, 8176, 10865; Payload ID: 15676 relates to Category No.: 795, 12648, 3639, 1752, 2940, 1816, 3775, 7933; Payload ID: 15677 relates to Category No.: 11940; Payload ID: 15678 relates to Category No.: 11949; Payload ID: 15679 relates to Category No.: 5359, 1795, 10775, 15782, 8112, 13635, 11994, 12609, 7122, 3781, 794, 5936, 1295, 11940; Payload ID: 15680 relates to Category No.: 5785, 15614, 12891, 795, 10372, 14944; Payload ID: 15681 relates to Category No.: 1026, 14661, 9720, 10074, 3684, 5446, 10372, 6606, 348, 345, 4186, 12391, 4127, 3775, 1893, 16197, 5541, 16085, 8988, 12936, 1238, 6145, 5855, 10522, 1993, 12819, 12646, 14589, 690, 4949, 275, 13969, 13859, 13882, 14025, 496, 13888, 11391, 11601, 9411, 13961, 274, 8936, 2009, 8929, 13877, 5785; Payload ID: 15682 relates to Category No.: 1026, 14661, 15614, 5446, 6606, 348, 345, 4186, 12391, 4127, 3775, 5541, 16085, 8988, 5785; Payload ID: 15683 relates to Category No.: 1026, 14661, 15614, 5446, 6606, 348, 4186, 2169, 12391, 4127, 3775, 5541, 16085, 8988, 6103, 15149, 4588, 14565; Payload ID: 15684 relates to Category No.: 4186, 13222; Payload ID: 15686 relates to Category No.: 7306; Payload ID: 15687 relates to Category No.: 7306; Payload ID: 15689 relates to Category No.: 10775, 5809, 5807; Payload ID: 15690 relates to Category No.: 13464; Payload ID: 15691 relates to Category No.: 13464; Payload ID: 15692 relates to Category No.: 13464; Payload ID: 15693 relates to Category No.: 13464; Payload ID: 15694 relates to Category No.: 12603, 4186, 12391, 11305; Payload ID: 15695 relates to Category No.: 1026, 12391, 1048, 8940, 15045, 1740, 1689, 8864, 10257, 2893, 3677, 282, 12835, 11093, 13231; Payload ID: 15696 relates to Category No.: 6814, 9500, 14090, 3140, 5941, 14071; Payload ID: 15697 relates to Category No.: 9500; Payload ID: 15698 relates to Category No.: 9500, 14962; Payload ID: 15699 relates to Category No.: 9500, 14962; Payload ID: 15700 relates to Category No.: 6814, 9500; Payload ID: 15701 relates to Category No.: 10938, 13346; Payload ID: 15702 relates to Category No.: 13589, 3398, 15517, 14640; Payload ID: 15703 relates to Category No.: 8862, 13589, 3398, 4949, 14640, 8739, 11512, 4956, 9455, 10261, 3577, 3595, 10983, 2376, 2374, 1541, 12703, 3584, 11394, 3598, 3610, 1623, 11380, 7352, 12565; Payload ID: 15704 relates to Category No.: 10238, 14146, 8597; Payload ID: 15705 relates to Category No.: 1764, 280; Payload ID: 15706 relates to Category No.: 1295, 14740, 1752, 3886, 780, 6713, 6117, 1463, 1464, 3519, 4063, 1881, 7566, 1813; Payload ID: 15707 relates to Category No.: 1764, 780, 9599, 1881, 274, 8887, 12648, 2597; Payload ID: 15708 relates to Category No.: 1295, 274, 2562, 286; Payload ID: 15709 relates to Category No.: 1737, 14661, 7154, 7132, 2429, 982, 2187, 6674; Payload ID: 15710 relates to Category No.: 1737, 14661, 6670, 7132, 2429; Payload ID: 15711 relates to Category No.: 14318, 14177, 6643, 1780, 1272, 6138, 1270, 7174, 5453; Payload ID: 15712 relates to Category No.: 8862, 1026, 15898, 12154, 11843, 795, 1721, 10238, 674, 7306, 14838, 11878, 10864, 8923, 11912; Payload ID: 15713 relates to Category No.: 1026, 15898, 12154, 14661, 11843, 1721, 7613, 7306, 7965, 7693, 7840, 8408, 1888, 13383, 12153; Payload ID: 15714 relates to Category No.: 15898, 12154, 11843, 795, 7306, 13376, 8544; Payload ID: 15715 relates to Category No.: 1512, 12995; Payload ID: 15716 relates to Category No.: 5428, 3639, 1820, 14589, 10600, 11448; Payload ID: 15717 relates to Category No.: 1703; Payload ID: 15718 relates to Category No.: 1703; Payload ID: 15719 relates to Category No.: 1703; Payload ID: 15720 relates to Category No.: 1703, 5446; Payload ID: 15721 relates to Category No.: 5446, 12459, 12555, 2042, 13279; Payload ID: 15722 relates to Category No.: 1703; Payload ID: 15723 relates to Category No.: 1703, 1816; Payload ID: 15724 relates to Category No.: 1703, 12994; Payload ID: 15725 relates to Category No.: 14565, 1703; Payload ID: 15726 relates to Category No.: 1703, 1795, 12994; Payload ID: 15727 relates to Category No.: 6814, 14865, 12063, 1893, 14663, 3405, 11660, 4399, 4729, 9358, 11094, 13207; Payload ID: 15728 relates to Category No.: 14865, 12063, 1893, 14663, 3405, 11660, 4399, 4729, 9358, 13837, 11062, 11069; Payload ID: 15729 relates to Category No.: 1512, 14865, 12063, 1893, 14663, 3405, 11660, 4399, 4729, 9358, 6814; Payload ID: 15730 relates to Category No.: 14865, 4712, 12063, 1893, 14663, 3405, 11660, 4399, 4729, 9358, 6814; Payload ID: 15731 relates to Category No.: 5367, 14565, 3013, 2311, 1238, 6145, 11565, 7719, 1849, 3924, 1795, 8840, 8677, 11460, 803, 12994, 11285, 13993, 12748, 8688, 15192, 8791; Payload ID: 15732 relates to Category No.: 3486; Payload ID: 15733 relates to Category No.: 3486, 4535, 13005, 13860, 1764, 15805, 15809; Payload ID: 15734 relates to Category No.: 5255, 15140, 14058, 1114, 12759; Payload ID: 15735 relates to Category No.: 5255, 15140, 14058, 1465; Payload ID: 15736 relates to Category No.: 15618, 5846, 5848, 5866, 3854; Payload ID: 15737 relates to Category No.: 15618, 5846, 5848, 5866; Payload ID: 15738 relates to Category No.: 15618, 5846, 5848, 5866; Payload ID: 15739 relates to Category No.: 15618, 5846, 5848, 5866; Payload ID: 15740 relates to Category No.: 15618, 5846, 5848, 5866, 2483; Payload ID: 15742 relates to Category No.: 6227, 13227, 8862, 9386; Payload ID: 15743 relates to Category No.: 14558, 12123, 12194, 15588, 14934, 1893, 4439, 13004; Payload ID: 15744 relates to Category No.: 15588, 14558, 14934, 1893, 4439, 13004, 12123; Payload ID: 15745 relates to Category No.: 15588, 14558, 14934, 1893, 4439, 13004; Payload ID: 15746 relates to Category No.: 12994, 6739, 6740, 6741, 12194; Payload ID: 15747 relates to Category No.: 12994, 6739, 6740, 6741, 12194; Payload ID: 15748 relates to Category No.: 12194; Payload ID: 15749 relates to Category No.: 15207, 10486, 11248, 11242, 10296, 6741, 11107, 12194; Payload ID: 15750 relates to Category No.: 11940, 5428, 1238, 3711, 482, 11634; Payload ID: 15752 relates to Category No.: 11940, 11934; Payload ID: 15753 relates to Category No.: 15588, 14934, 1893, 4439, 2740, 12123, 13827; Payload ID: 15754 relates to Category No.: 15588, 14934, 1893, 4439, 2740, 13827; Payload ID: 15755 relates to Category No.: 15588, 14934, 1893, 4439, 12123, 13827, 14934, 15606, 14934, 14563, 6814; Payload ID: 15756 relates to Category No.: 15588, 14934, 1893, 4439, 12123, 13827; Payload ID: 15757 relates to Category No.: 15588, 14934, 1893, 4439, 13827; Payload ID: 15758 relates to Category No.: 15588, 14934, 1893, 4439, 8764; Payload ID: 15759 relates to Category No.: 15588, 15626, 5782, 3684, 14934, 1893, 4439, 2740, 5855; Payload ID: 15760 relates to Category No.: 15588, 14661, 3684, 14934, 1893, 4439, 5855; Payload ID: 15761 relates to Category No.: 15588, 3684, 10372, 14934, 1893, 4439, 2740, 5855; Payload ID: 15762 relates to Category No.: 15588, 14934, 1893, 4439, 2740; Payload ID: 15763 relates to Category No.: 15588, 14934, 1893, 4439; Payload ID: 15764 relates to Category No.: 15588, 14934, 1893, 4439, 2740; Payload ID: 15765 relates to Category No.: 13589, 3398, 11512, 14565, 795, 2885, 8739, 12498, 3021, 13818, 11506, 3398, 5910, 7598, 16197, 15782, 2012, 7924, 5610, 5911, 13012, 15817, 13640, 11391, 13891, 13797, 8103, 10983, 6857, 7562, 1237, 13981, 8285, 13717, 6859, 8294, 13788, 13925, 13840, 15490, 3398, 6248, 8250, 2041, 1948, 2079; Payload ID: 15766 relates to Category No.: 13594, 13589, 3398, 15490, 3398, 14565, 2885, 3021, 5910, 16197, 7131, 15817, 13640, 10491; Payload ID: 15767 relates to Category No.: 13594, 8862, 13589, 3398, 11512, 9982, 14565, 2885, 7613, 2000, 8739, 11506, 3398, 5783, 5910, 11949, 16197, 8988, 11125, 7252, 13835, 4871, 5911, 14782, 12373, 4535, 15273, 5710, 3529, 14534, 4060, 908, 15517, 14949, 8377, 7743, 1780, 13189, 8035, 7728, 1948, 2079, 13969, 496, 13827, 13837, 13970, 381, 13981, 13818, 8374, 13158, 10249, 8092, 10697, 15490, 3398; Payload ID: 15768 relates to Category No.: 13589, 3398, 15490, 3398, 14565, 5910, 11512, 12091, 2885, 1780, 2080; Payload ID: 15769 relates to Category No.: 13594, 13589, 3398, 15490, 3398, 14565, 4110, 5910, 5911, 84, 13189, 2761, 2766, 539, 2481, 15053, 9498, 5889, 16073, 15234, 11771, 11512, 9720, 7613, 11051, 10372, 2885, 11077, 5998, 6559, 13981, 8259, 11027, 10642, 7537, 10790, 6226, 15195, 12614, 6391, 4145, 13512, 12821, 11076, 10197, 15197, 10839, 10265, 10933, 7951, 3190, 3191, 9769, 10962, 11822, 3793, 6563, 10963, 1991; Payload ID: 15770 relates to Category No.: 13594, 13589, 3398, 15490, 3398, 11512, 14565, 2000, 4110, 5910, 13835, 5911, 1960, 1993, 84, 13189, 2761, 2766, 539, 2481, 15053, 9498, 5889, 16073, 15234, 11771, 15517, 7613, 11051, 10372, 2885, 11077, 5998, 11027, 10642, 7537, 10790, 6226, 15195, 12614, 6391, 4145, 13512, 12821, 11076, 10197, 15197, 10839, 10265, 10933, 7951, 3190, 3191, 9769, 14533, 11080, 11761, 13899, 13900, 13897, 6619, 13925, 13882, 6269, 13837, 11391, 381, 13981, 10386; Payload ID: 15771 relates to Category No.: 13594, 13589, 3398, 15490, 3398, 14565, 5446, 11573, 5698, 8739, 12646, 11512, 6562, 15328, 8786, 10875, 6568, 2885, 2001, 13818, 2106; Payload ID: 15772 relates to Category No.: 15614, 10648, 2041, 10188, 8245, 8468, 10267, 8600, 8246, 11182, 3729, 11001, 11122, 11002, 8299; Payload ID: 15774 relates to Category No.: 5782, 14565, 3691, 11371, 3775, 6738, 10595, 7933, 12852; Payload ID: 15775 relates to Category No.: 5782, 3691, 3775, 6738, 7933; Payload ID: 15776 relates to Category No.: 5785, 14565, 10702, 2940, 13485, 1780, 7735, 7724, 7719, 12619, 2152; Payload ID: 15777 relates to Category No.: 3766, 12760, 12526, 13485, 337, 275, 12942, 1204, 13530, 10702, 12754; Payload ID: 15778 relates to Category No.: 10702, 13485; Payload ID: 15779 relates to Category No.: 10702, 13485, 4969; Payload ID: 15780 relates to Category No.: 14565, 10372, 16189, 6408, 12603, 13665; Payload ID: 15781 relates to Category No.: 14565, 403, 13551; Payload ID: 15782 relates to Category No.: 1703, 1238, 6145; Payload ID: 15783 relates to Category No.: 14565, 5446, 1795; Payload ID: 15786 relates to Category No.: 5785, 1703, 10372, 1816, 7743, 1238, 6145, 11445, 10379; Payload ID: 15787 relates to Category No.: 12091, 7303, 3631, 14641, 13363, 6194, 1623; Payload ID: 15788 relates to Category No.: 11926, 5782, 12603; Payload ID: 15789 relates to Category No.: 13589, 3398, 15490, 3398, 11512, 8739, 8731, 3398, 5113, 1867, 14663, 4439, 1238, 11897, 8753, 339, 12891, 3783, 8004, 3783, 10491, 7810, 14123, 8529, 10433, 8077, 5406, 1892, 7613, 3356, 4969, 1984, 10638, 13943, 496, 13971, 1956, 12986, 13599; Payload ID: 15790 relates to Category No.: 13589, 3398, 15490, 3398, 8739, 5113, 1867, 14663, 8731, 3398, 14636, 1567; Payload ID: 15791 relates to Category No.: 15490, 3398, 8739, 2410, 4439, 5146, 12891, 3783, 8004, 3783; Payload ID: 15792 relates to Category No.: 13594, 7288, 15490, 3398, 10238, 14271, 2410, 8408, 4439, 12484, 16182, 12891, 3783, 8004, 3783, 8335, 16182; Payload ID: 15793 relates to Category No.: 13589, 3398, 15490, 3398; Payload ID: 15794 relates to Category No.: 13589, 3398, 15490, 3398, 2410, 4439, 12891, 3783, 8004, 3783, 8739, 14620; Payload ID: 15795 relates to Category No.: 2562, 5459, 14456, 6296, 2547; Payload ID: 15796 relates to Category No.: 14565, 381, 7849, 8611, 8222, 7786; Payload ID: 15797 relates to Category No.: 15490, 3398, 11512, 4946, 11506, 3398, 11884, 10372, 4969, 4947, 10229, 11692, 6998; Payload ID: 15799 relates to Category No.: 13594, 8862, 13589, 3398, 15490, 3398, 1730, 16005; Payload ID: 15800 relates to Category No.: 13594, 8862, 13589, 3398, 15490, 3398, 1730, 8739, 3604, 8731, 3398, 6375; Payload ID: 15801 relates to Category No.: 7030, 7029, 1414; Payload ID: 15805 relates to Category No.: 1204; Payload ID: 15806 relates to Category No.: 3356, 9420, 7122, 10714; Payload ID: 15807 relates to Category No.: 13589, 3398; Payload ID: 15808 relates to Category No.: 3354, 1089, 1089, 762, 3103; Payload ID: 15809 relates to Category No.: 690, 15490, 3398, 11843, 11512, 14318, 13975, 12153, 7613, 8739, 10372, 8731, 3398, 2467, 1955, 10238, 13166, 3356, 3354, 6903, 8728, 7345, 5809, 8756, 12646, 2410, 5113, 11285, 7735, 4439, 16197, 8390, 2136, 2412, 1853, 2022, 13888, 8524, 14590, 11897, 1995, 2353, 7971, 5147, 10521, 12891, 3783, 8004, 8611, 10938, 8004, 3783, 13877, 10470, 2006, 7773, 16279, 1709, 12671, 13357, 15606, 8103, 2413, 8431, 7883, 14566, 7597, 8178, 12913, 2116, 10800, 4108, 10422, 8468, 8060, 11000, 2001, 11912, 12799, 10749, 7691, 13296, 10400, 2162, 12539, 10312, 3371, 15006, 10206, 10941, 8504, 9684, 9683, 16050, 15665, 10433, 8499, 6489, 12301, 3874, 13486, 8076, 8084, 7771, 8444, 14838, 5808, 2469, 10548, 8374, 9492, 5167, 5163, 1120; Payload ID: 15810 relates to Category No.: 1737, 11851, 15490, 3398, 1002, 11843, 11512, 12619, 11237, 8739, 5446, 8731, 3398, 9854, 7743, 7154, 2414, 10359, 6670, 13313, 5113, 7635, 2061, 2412, 2083, 15042, 7370, 11897, 7971, 5147, 13999, 2006, 1997, 5022, 8447, 8508, 2413, 12848, 8666, 10513, 8554, 13200, 11980, 10591, 10252, 1961, 1866, 8744, 9684, 5183, 10971, 4440, 1924, 8416, 15770, 11141, 7859, 11238, 12861, 14189, 8397, 7613, 2169, 8415; Payload ID: 15811 relates to Category No.: 9420, 7122, 486, 11897, 9684, 5147, 8444; Payload ID: 15812 relates to Category No.: 11851, 1955, 4595, 2412, 8118, 10910, 15644, 7976, 9684, 13390, 12918, 2006, 7698, 8538; Payload ID: 15813 relates to Category No.: 2412, 11897, 8554, 13054, 11905, 9686, 11913, 9687, 11901, 9685, 13967, 7698; Payload ID: 15814 relates to Category No.: 11851, 3452, 3354, 3448, 5113, 12786, 5167, 5163, 8731, 3398, 7743, 10626, 4535, 11912, 8023, 1089, 11414, 8035, 13967, 11633; Payload ID: 15815 relates to Category No.: 8739, 14320, 5147, 5183, 11532; Payload ID: 15816 relates to Category No.: 8390, 4039, 16189, 5806, 365, 11022; Payload ID: 15817 relates to Category No.: 13589, 3398, 11512, 795, 5458, 15517, 11506, 3398, 3575, 4446, 8373, 1780, 9409, 13229, 9599, 5949, 3791, 15402, 15400, 12036, 7386, 14636, 5459, 16005, 1318, 10292, 3613, 6860, 11590, 12556, 6811, 8739, 12891, 13713, 7613, 9480, 757, 7001, 8932, 672, 9786, 9465, 11358, 2548, 15459, 14456, 12824, 14641, 13363, 9342, 8906, 13529, 13474, 13455, 10984, 15654, 7670, 16003, 7415, 4068, 4327, 9406; Payload ID: 15818 relates to Category No.: 13589, 3398, 1752, 674, 1780, 5949, 6802, 8848, 722, 3577, 10430, 6787, 8849, 6783, 6774, 12564, 6784, 15517, 11512, 6878, 7001, 3613, 11949, 3575, 7730, 2376, 12703, 13276; Payload ID: 15819 relates to Category No.: 1295, 8731, 3398, 16214, 12646, 4057, 8375, 11949, 15606, 1782, 797, 6111, 6114, 3795, 9401, 12212, 8894, 15247, 4252, 15248, 10034, 13223, 8897, 12624, 13224, 6112, 13222, 15517, 11512, 1463, 11949, 6116, 4248, 8831, 2466, 3241; Payload ID: 15820 relates to Category No.: 13589, 3398, 7613, 8731, 3398, 674, 11506, 3398, 4446, 8373, 15459, 9786, 6530, 9342, 12036, 8603, 14365, 14636, 10292, 6860, 11590, 6538, 12556, 6539, 12824, 7415, 4327, 15654, 14625, 15517, 11512, 12891, 5459, 3613, 672, 15400, 3575, 13363, 13529, 7386; Payload ID: 15821 relates to Category No.: 13589, 3398, 15490, 3398, 11512, 8731, 3398, 7743, 14834, 6111, 8625; Payload ID: 15822 relates to Category No.: 16214, 9410, 15517, 11512; Payload ID: 15823 relates to Category No.: 15618, 5866; Payload ID: 15824 relates to Category No.: 14267, 15712, 5220; Payload ID: 15825 relates to Category No.: 9420, 7132, 4336, 5793, 2453; Payload ID: 15826 relates to Category No.: 1737, 7154; Payload ID: 15827 relates to Category No.: 13589, 3398, 15490, 3398, 8739, 8756, 7662, 8731, 3398; Payload ID: 15828 relates to Category No.: 13589, 3398, 15490, 3398, 8739, 8756, 2228, 2238, 1729, 7662, 11394, 12754, 12684; Payload ID: 15829 relates to Category No.: 15490, 3398, 11512, 8739, 12498, 14656, 7743, 8421, 1767, 8756, 1257, 15521, 1780, 4439, 14056, 1274, 15570, 3595, 4067, 7370, 8887, 9540, 7662, 722, 11620, 14782, 10513, 14624, 6117, 7575, 7990, 1463, 9121, 11942, 8604, 7417, 9333, 1464, 8074; Payload ID: 15831 relates to Category No.: 14199; Payload ID: 15832 relates to Category No.: 8739, 12498, 8756, 15490, 3398, 1722, 7730, 15521, 4439, 15570, 10261, 14636, 13779, 11936, 13865, 11942, 1228, 10602, 6413, 6114, 10866, 14838, 13818; Payload ID: 15834 relates to Category No.: 6975, 2902, 11008, 13146; Payload ID: 15835 relates to Category No.: 12994; Payload ID: 15836 relates to Category No.: 1703, 12994, 7533, 7540; Payload ID: 15837 relates to Category No.: 3013, 1957, 13057, 9782, 13211; Payload ID: 15839 relates to Category No.: 13589, 3398, 15490, 3398; Payload ID: 15840 relates to Category No.: 1764, 9718, 3100, 11910, 12469, 13059, 12526, 274, 1912, 12667; Payload ID: 15841 relates to Category No.: 9718, 3100, 11910, 12469, 13059, 12526, 274; Payload ID: 15842 relates to Category No.: 9718, 3100, 11910, 12469, 13059, 12526; Payload ID: 15843 relates to Category No.: 1048, 7303, 11431, 480, 8862, 5244; Payload ID: 15844 relates to Category No.: 1048, 11431; Payload ID: 15845 relates to Category No.: 1048, 11431; Payload ID: 15846 relates to Category No.: 1048, 11431; Payload ID: 15847 relates to Category No.: 1048, 14643, 15149, 1598, 11431, 480, 3041, 14051, 4855, 15016; Payload ID: 15848 relates to Category No.: 14456, 15140, 1048, 16214, 7303, 8940, 1463, 5459, 483, 11431, 5465, 14940, 6111, 16177, 990, 984, 16176, 6198, 2547; Payload ID: 15849 relates to Category No.: 1026, 12526, 1024, 7553, 7251, 14297, 4254, 8669, 8940, 14069, 1048, 9333, 15246, 3893, 15217, 3443; Payload ID: 15850 relates to Category No.: 1026, 2000, 10238, 7737, 7735, 7567, 8535, 8807, 8049, 7923, 1762, 14069, 1024, 7767, 10261, 7553, 1320, 16005, 8325, 7251, 14297, 13816, 800, 7789, 8208, 8200, 8635, 2307, 2720, 5423, 8630, 1996, 8633, 8328, 8385, 8580, 5406, 8940, 7743, 14589, 6878, 8004, 1048, 9333, 6560, 15246, 7636, 6552, 3443, 13967, 1295, 14883, 8112; Payload ID: 15851 relates to Category No.: 1026, 2000, 12526, 7735, 1024, 7553, 14297, 13816, 800, 7789, 7743, 9410, 8004; Payload ID: 15852 relates to Category No.: 1026, 14661, 14565, 10702, 13485, 7737, 1752, 14108; Payload ID: 15853 relates to Category No.: 14565; Payload ID: 15854 relates to Category No.: 8862; Payload ID: 15855 relates to Category No.: 11093, 7991, 4005, 7870; Payload ID: 15856 relates to Category No.: 14661, 14565, 10702, 13485, 7737; Payload ID: 15857 relates to Category No.: 10583; Payload ID: 15858 relates to Category No.: 5782, 7291, 16182, 1995, 14271, 16183, 601, 16182, 7263; Payload ID: 15859 relates to Category No.: 3386, 9228, 3452, 3354, 3448, 5750, 15240, 11464, 3319; Payload ID: 15860 relates to Category No.: 3386, 9228, 3452, 3354, 3448, 5750, 15240, 11464, 3319; Payload ID: 15862 relates to Category No.: 10331, 3452, 9296, 3356, 3354, 3448, 5750, 15240, 11464, 3319, 13903; Payload ID: 15863 relates to Category No.: 13589, 3398, 15490, 3398, 15570, 11512, 14565, 15517, 14656, 1257, 10648, 3604, 1918, 11524, 14654, 11734, 13594, 6606, 12091, 16005, 4367, 7743, 5428, 1622, 2079, 5066, 1560, 11147, 1269, 10329, 5244, 6995, 9456, 6800; Payload ID: 15864 relates to Category No.: 13589, 3398, 15490, 3398, 11512, 5785, 8739, 1741, 8731, 3398, 11506, 3398, 8756, 15521, 4439, 15570, 372, 9540, 10286, 13616, 14782, 10578, 724, 16341, 14654, 4418, 6796, 2607, 12541, 13805, 9085, 11734, 9586, 11119, 5406, 12091, 16005, 3642, 9599, 11634, 3604, 10648, 9408, 8004, 3641, 3583, 4949, 5544, 6375, 14656, 3194, 3575, 13860, 9554, 9722, 7743, 14577; Payload ID: 15865 relates to Category No.: 13589, 3398, 15570, 13594, 334, 5367, 15490, 3398, 11512, 15626, 5785, 1722, 8739, 11506, 3398, 8756, 15521, 1814, 10648, 7735, 4439, 10314, 13882, 12117, 372, 16294, 4039, 8535, 11510, 8318, 8508, 13616, 10578, 10333, 14654, 3967, 10597, 9085, 13617, 11734, 5406, 8835, 16005, 3604, 4952, 14793, 3641, 3583, 14640, 6269, 9455, 9454, 8421, 15185, 14656, 12824, 8112, 3194, 3575, 6796, 6114, 12994, 4418, 15402, 9722, 9586, 10429, 5375, 13519, 12541, 8422, 15536, 10366, 7613, 7743, 11418, 10287, 10216, 11216, 10821, 14577, 11545, 10629, 336; Payload ID: 15866 relates to Category No.: 13589, 3398, 15490, 3398, 15570, 11512, 5785, 8739, 8731, 3398, 11167, 14656, 1862, 11506, 3398, 1257, 15521, 7735, 4439, 13882, 9540, 1918, 11542, 10286, 8508, 13616, 11524, 10745, 14782, 10578, 14654, 11385, 5710, 10747, 13617, 14026, 13594, 12646, 14392, 5406, 4419, 5949, 724, 14791, 1026, 6743, 8930, 1318, 8866, 3641, 6795, 1780, 7728, 3578, 3194, 4418, 3617, 1579, 1302, 12541, 3705, 3813, 15426, 12947, 978, 6861, 8847, 973, 4275, 10376; Payload ID: 15867 relates to Category No.: 13589, 3398, 15490, 3398, 5785, 14565, 14656, 11506, 3398, 1257, 15570, 3604, 1918, 11524, 11512, 12091, 16005, 1562, 3854, 1622, 2079, 4458, 11147, 1269, 9456, 9451, 7302; Payload ID: 15868 relates to Category No.: 13589, 3398, 5367, 15490, 3398, 5785, 7613, 7743, 8756, 1257, 4094, 15570, 7662, 13913, 8439, 8628, 16341, 1823, 16005, 4956, 16136, 756, 2705, 13836; Payload ID: 15869 relates to Category No.: 13589, 3398, 15490, 3398, 11512, 5785, 11237, 8739, 7737, 8756, 1257, 15521, 4439, 11298, 12117, 448, 15570, 12594, 7662, 8611, 2131, 860, 8447, 8547, 7942, 8732, 13616, 10379, 12474, 8446, 13913, 1891, 8798, 16133, 13663, 9595, 8439, 16137, 16005, 8731, 3398; Payload ID: 15870 relates to Category No.: 13589, 3398, 15490, 3398, 5785, 14656, 1257, 15570, 1918, 11524, 12091, 16005, 1622, 2079, 5066, 1269, 6995; Payload ID: 15871 relates to Category No.: 11294, 11754, 13589, 3398, 5359; Payload ID: 15872 relates to Category No.: 12154, 11843, 12153, 1730, 8756, 12096, 1257, 15570, 7662, 7131, 12007, 10491, 11922, 3532, 11299, 15901, 10494, 12404, 12129, 12131, 8420; Payload ID: 15873 relates to Category No.: 15898, 12154, 15490, 3398, 8739, 8731, 3398, 8756, 1257, 15521, 4439, 10314, 15570, 7662, 13616, 15901, 11562, 12153; Payload ID: 15874 relates to Category No.: 10702, 12719, 10586; Payload ID: 15875 relates to Category No.: 10702; Payload ID: 15876 relates to Category No.: 5255, 5037, 1789, 15122; Payload ID: 15877 relates to Category No.: 8862; Payload ID: 15878 relates to Category No.: 8862; Payload ID: 15879 relates to Category No.: 1204; Payload ID: 15881 relates to Category No.: 10702, 6061; Payload ID: 15882 relates to Category No.: 1722, 10702, 13391, 12387, 10066; Payload ID: 15883 relates to Category No.: 1204, 16197, 10581; Payload ID: 15890 relates to Category No.: 1204; Payload ID: 15891 relates to Category No.: 1204; Payload ID: 15904 relates to Category No.: 1204; Payload ID: 15914 relates to Category No.: 15012; Payload ID: 15915 relates to Category No.: 7291, 16182, 14271, 4439, 11661, 15606, 9455, 2476, 6814; Payload ID: 15916 relates to Category No.: 7291, 16182, 14271, 4439; Payload ID: 15917 relates to Category No.: 7288, 14271, 1204; Payload ID: 15918 relates to Category No.: 7291, 16182, 14271, 4439; Payload ID: 15919 relates to Category No.: 14267, 7291, 16182, 14271, 4439, 14271, 16183; Payload ID: 15920 relates to Category No.: 7291, 16182, 14271, 4439; Payload ID: 15921 relates to Category No.: 7288, 7291, 16182, 14271, 13445, 4439, 12511, 8539, 7782, 11049, 16182; Payload ID: 15922 relates to Category No.: 7291, 16182, 14271, 14915, 4439, 14913, 7131, 7546, 10491, 14267; Payload ID: 15923 relates to Category No.: 7291, 16182, 14271, 14915, 4439, 14913, 7546; Payload ID: 15924 relates to Category No.: 15517, 7291, 16182, 14271, 12053, 14915, 15291, 4439, 14913, 7261, 7546, 5220, 14267; Payload ID: 15925 relates to Category No.: 7291, 16182, 14271, 4439; Payload ID: 15926 relates to Category No.: 7291, 16182, 14271, 4439; Payload ID: 15927 relates to Category No.: 7291, 16182, 14271, 4439, 10491; Payload ID: 15928 relates to Category No.: 7291, 16182, 14915, 7266; Payload ID: 15929 relates to Category No.: 15517, 7291, 16182, 14271, 14915, 15291, 4439, 14913, 7261, 7546, 4934, 5220; Payload ID: 15930 relates to Category No.: 15517, 7291, 16182, 14271, 14915, 15291, 4439, 7261, 7131, 7546, 5220; Payload ID: 15931 relates to Category No.: 15517, 7291, 16182, 14271, 14915, 15291, 4439, 14913, 7261, 7546, 5220; Payload ID: 15932 relates to Category No.: 7291, 16182, 14271, 13874; Payload ID: 15933 relates to Category No.: 15517, 7291, 16182, 14271, 12053, 14915, 15291, 4439, 7261, 7131, 7546, 10491, 5220; Payload ID: 15934 relates to Category No.: 13589, 3398, 15518, 4439; Payload ID: 15935 relates to Category No.: 13589, 3398, 15518, 15517, 4439, 14723; Payload ID: 15936 relates to Category No.: 13589, 3398, 15518, 15517, 4439, 14723; Payload ID: 15937 relates to Category No.: 13589, 3398, 15518, 15517, 4439, 14724, 14725, 14723; Payload ID: 15938 relates to Category No.: 13589, 3398, 15522, 15518, 15517, 4439; Payload ID: 15939 relates to Category No.: 5939, 9632, 3781, 5936; Payload ID: 15940 relates to Category No.: 5939, 9632, 3781, 5936; Payload ID: 15941 relates to Category No.: 5939, 9632, 3781, 5936; Payload ID: 15942 relates to Category No.: 5939, 9632, 3781, 5936; Payload ID: 15943 relates to Category No.: 5939, 9632, 3781, 5936; Payload ID: 15944 relates to Category No.: 5939, 9632, 3781, 5936; Payload ID: 15945 relates to Category No.: 5939, 9632, 3781, 5936; Payload ID: 15946 relates to Category No.: 5939, 9632, 3781, 5936; Payload ID: 15947 relates to Category No.: 5939, 9632, 3781, 5936, 16294; Payload ID: 15948 relates to Category No.: 5939, 9632, 5936; Payload ID: 15949 relates to Category No.: 2885, 11237, 3452, 9296, 8731, 3398, 3354, 3448, 1893, 16197, 12120, 3453, 12117, 11660, 9540, 8611, 5610, 7879, 13012, 11245, 13363, 4485, 7862, 7570, 13589, 3398, 10105, 12034, 13376, 12571, 12591, 10308; Payload ID: 15950 relates to Category No.: 11237, 3452, 9296, 3354, 3448, 1893, 12120, 11660, 4485, 11512; Payload ID: 15951 relates to Category No.: 12120, 9296, 3354, 1893, 11660, 4485, 12036, 11299; Payload ID: 15952 relates to Category No.: 12120; Payload ID: 15953 relates to Category No.: 12105, 7923, 8547; Payload ID: 15954 relates to Category No.: 10256, 8509, 7944, 8583, 3829, 11271, 8813; Payload ID: 15955 relates to Category No.: 1955, 11245, 10533, 10950, 12044; Payload ID: 15956 relates to Category No.: 1955, 11245, 10533, 10950, 12044; Payload ID: 15957 relates to Category No.: 9869, 3452, 9713, 4439, 14015, 7280, 11858, 9223, 9103, 9982; Payload ID: 15958 relates to Category No.: 4439, 7280, 9223, 9103, 12761; Payload ID: 15959 relates to Category No.: 14216, 3656, 15257, 4439, 7280, 9223, 9103, 12761; Payload ID: 15960 relates to Category No.: 4439, 7280, 9223, 9103, 12761; Payload ID: 15961 relates to Category No.: 13360, 4439, 9223, 9103; Payload ID: 15962 relates to Category No.: 4439, 9223, 9103; Payload ID: 15964 relates to Category No.: 7345, 14693; Payload ID: 15965 relates to Category No.: 9713, 13827, 8731, 3398, 11601, 13767, 7346, 8812; Payload ID: 15967 relates to Category No.: 4828, 14699, 1795, 10648, 8004, 4952, 7879, 4254, 1933, 10292, 14790, 13713, 7002, 3174, 10728, 16121, 3122, 6786, 12952, 8739, 2243, 11512, 16096, 5406, 5243, 7303, 9599, 724, 3445, 12891, 8731, 3398, 11506, 3398, 3176, 7613, 10574, 11051, 4939, 10372, 6107, 3246, 2169, 9455, 12036, 12117, 1729, 3070, 14624, 4953, 3194, 9451, 1744, 3444, 3602, 6561, 8869, 10983, 11394, 9555, 15805, 9321, 11085, 13509, 2177, 968, 2216, 14701, 11259, 7386, 7937, 11143, 15325, 3817, 14704, 905, 8052; Payload ID: 15969 relates to Category No.: 6902, 1204; Payload ID: 15970 relates to Category No.: 8739, 11506, 3398, 10366, 3812, 12538, 10578, 9455, 8823, 7883, 14566, 8177, 6796, 9124, 13594, 8731, 3398, 1752, 4939, 6795, 9540, 6108, 1625, 15740, 7731; Payload ID: 15971 relates to Category No.: 15490, 3398, 14456, 8739, 1483, 7693, 10366, 9125, 3812, 12538, 7712, 7966, 7799, 8196, 1960, 9455, 3813, 1757, 8823, 8865, 12691, 7721, 3115, 10025, 7883, 14566, 13277, 3819, 8824, 7751, 8177, 7600, 1752, 7613, 10735, 13996, 9540, 2022, 7720, 10606, 1625, 16279, 8655, 12560, 1970; Payload ID: 15972 relates to Category No.: 15490, 3398, 8739, 13589, 3398, 13594; Payload ID: 15973 relates to Category No.: 5782, 8977, 15157, 8936, 3699, 16197, 6713, 726, 727, 15167, 13342, 10893, 8378, 15149, 15158, 1000, 15160, 15281; Payload ID: 15974 relates to Category No.: 12091, 5785, 7372; Payload ID: 15975 relates to Category No.: 3354, 9274, 12096, 6814; Payload ID: 15976 relates to Category No.: 13594, 5095, 15490, 3398, 16197; Payload ID: 15977 relates to Category No.: 13594, 3635, 15490, 3398, 3691, 13343, 10648, 6738, 3525, 12132, 11243, 10595, 13346, 13669, 13191; Payload ID: 15978 relates to Category No.: 1204; Payload ID: 15979 relates to Category No.: 1204; Payload ID: 15980 relates to Category No.: 14177, 7291, 16182, 14271, 4439; Payload ID: 15981 relates to Category No.: 11949, 14915, 4439, 7546, 14717; Payload ID: 15982 relates to Category No.: 13594, 15490, 3398, 11512, 8739, 8731, 3398, 5809, 7291, 16182, 15521, 9125, 4439, 16197, 14083, 15570, 11542, 2110, 10180, 10745, 11614, 11087, 13431, 11049, 16182, 13676, 14620; Payload ID: 15983 relates to Category No.: 2459, 9420, 2526; Payload ID: 15984 relates to Category No.: 7288, 14271; Payload ID: 15985 relates to Category No.: 15618, 14459, 5846, 14740, 14742, 14014, 14737, 7316, 12552; Payload ID: 15986 relates to Category No.: 15618, 14459, 5846, 14740, 14742, 3973, 14737, 7316, 13882, 13497, 16294, 14927; Payload ID: 15987 relates to Category No.: 14740, 14742, 15618, 14459, 5846, 14014; Payload ID: 15988 relates to Category No.: 15618, 14459, 5846, 14740, 14742, 14014, 3973, 14737, 7316; Payload ID: 15989 relates to Category No.: 15618, 13041, 14740, 6724, 14742, 8946, 5848, 10491, 13126, 484, 8921, 325, 8947; Payload ID: 15990 relates to Category No.: 1026, 1703, 14740, 15149, 13496, 6293, 12954, 1547, 11399, 6723, 1562, 11094, 12513, 1553, 6727, 13664, 8947, 2719, 6728, 14742, 13497, 13995; Payload ID: 15991 relates to Category No.: 15618, 13041, 14740, 6724, 8946, 5848, 14742, 7369, 8923, 8862, 5813; Payload ID: 15992 relates to Category No.: 14740, 15149, 13496, 12954, 1562, 12513, 1553, 6727, 8862, 13995; Payload ID: 15993 relates to Category No.: 15618, 13041, 14740, 6724, 14742, 8946, 5848, 8862, 14050, 1910, 14454, 13995; Payload ID: 15994 relates to Category No.: 14740, 6724, 13496, 14742, 12041, 12954, 11399, 6723, 1562, 13663, 12513, 1553, 6727, 10710, 16129, 963, 14336, 1547, 8862, 14454; Payload ID: 15995 relates to Category No.: 15618, 13041, 14740, 6724, 14742, 8946, 5848, 7340, 11676, 2367, 1651; Payload ID: 15996 relates to Category No.: 14740, 13496, 14742, 12954, 11399, 1562, 1553, 6727, 13664, 1005; Payload ID: 15997 relates to Category No.: 15618, 13041, 14740, 6724, 14742, 8946, 5848, 11634, 5428, 14025, 1119; Payload ID: 15998 relates to Category No.: 15618, 13041, 14740, 14742, 8946, 5848, 1026, 6724, 9321, 12954, 11399, 6723, 12953, 1562, 13663, 10574, 1922, 12513, 1553, 6727, 13664, 15247, 12514, 13822, 16129, 13495, 12591, 10195, 2235, 1006, 14336, 6729, 6728, 1583, 1302, 1005, 1342, 6725, 6726, 10710, 5846; Payload ID: 15999 relates to Category No.: 15618, 13041, 14740, 6724, 14742, 8946, 5848, 7340, 14737; Payload ID: 16000 relates to Category No.: 8862, 15618, 13041, 14454, 14740, 6724, 14742, 8946, 7369, 5848, 9738, 14025, 483, 484, 14456, 6296, 7345, 8919; Payload ID: 16001 relates to Category No.: 15618, 13041, 14740, 6724, 14449, 14742, 8946, 5848, 12594, 12953, 12513, 1005, 1342, 14454, 9321; Payload ID: 16002 relates to Category No.: 15618, 13041, 14740, 6724, 14742, 8946, 5848, 13827, 13459; Payload ID: 16003 relates to Category No.: 15618, 13041, 5846, 14740, 1415, 1409, 6724, 5848; Payload ID: 16004 relates to Category No.: 12519; Payload ID: 16005 relates to Category No.: 15618, 3235, 8977, 15149, 5848, 6169, 4581, 6167, 2968, 7303, 13827, 480, 14050, 10666, 8862, 15247, 7305, 6171, 13773, 16212, 13921, 1968; Payload ID: 16006 relates to Category No.: 15618, 3235, 8977, 15149, 5848, 6169, 4581, 7131, 10491, 8981, 6167, 2968, 13827, 14456, 8920, 14050, 4576, 11436, 6171, 13779, 2753, 13921, 1766, 984, 4567, 4369, 6520; Payload ID: 16007 relates to Category No.: 15618, 3235, 8977, 15149, 5848, 6169, 4581; Payload ID: 16008 relates to Category No.: 15618, 3235, 2331, 15149, 4588, 2562, 2329, 6358, 5848, 6010, 11779, 4597, 7131, 6090, 624, 11780, 15374, 5323; Payload ID: 16009 relates to Category No.: 15618, 3235, 8977, 15149, 5848, 890, 6171, 6056, 4581, 13126, 6169; Payload ID: 16010 relates to Category No.: 15618, 3235, 8977, 15149, 5848, 6169, 4581, 6167, 2968, 2848, 2846, 11940, 10710, 6171; Payload ID: 16011 relates to Category No.: 15618, 8993, 3235, 5848, 4597, 16189, 624; Payload ID: 16012 relates to Category No.: 15618, 15626, 14742, 1184, 14663, 16189, 1189; Payload ID: 16013 relates to Category No.: 15618, 15626, 14742, 1184, 14663, 1189; Payload ID: 16014 relates to Category No.: 15618, 14742, 1184, 14760; Payload ID: 16015 relates to Category No.: 15618, 1184, 13970, 14000; Payload ID: 16016 relates to Category No.: 15618, 14742, 1184; Payload ID: 16017 relates to Category No.: 15618, 14742, 1184; Payload ID: 16018 relates to Category No.: 15618, 14742; Payload ID: 16019 relates to Category No.: 15618, 11512, 15626, 5428, 9777, 1862, 5871, 3013, 360, 6577, 10648, 13925, 16055, 6459, 16294, 7292, 13892, 10814, 3015, 11182, 10496, 10475, 9783, 13788, 7845, 5866, 13746, 7308, 745, 11480, 15204, 15193, 1835, 9065, 5662, 5687, 3019, 6044, 6940, 1373, 3298, 11949, 15606, 6575, 5367; Payload ID: 16020 relates to Category No.: 15626, 334, 15618, 1649, 1862, 6577, 13882, 2083, 2679, 15547, 16329, 2677, 6575, 13905, 2544, 7308, 1373, 3155, 9025, 16077, 4164, 6097, 9023, 4160, 4162, 5871, 6103, 3041, 4977, 12197, 5297, 10173, 3853, 10174; Payload ID: 16021 relates to Category No.: 15618, 15626, 2331, 15149, 2329, 5848, 11670, 1797, 2328, 11669; Payload ID: 16022 relates to Category No.: 15618, 15626, 15149, 2329, 5848, 11670, 1797, 2328, 11669, 1861, 2331, 6102, 7303, 15339, 13827; Payload ID: 16023 relates to Category No.: 690, 15618, 11674, 15626, 2329, 5848, 11670, 1797, 2328, 11669, 1859, 14326, 1860; Payload ID: 16024 relates to Category No.: 15618, 15626, 2329, 5848, 1797; Payload ID: 16025 relates to Category No.: 15618, 15626, 14740, 2329, 14742, 5848, 11670, 1797, 2328, 11669, 14737, 2331; Payload ID: 16026 relates to Category No.: 15618, 15626, 5848, 2329, 5846, 14740, 11670, 1797, 2328, 11669, 14737, 5949, 3973, 2280, 10296, 1858, 11676, 14742, 2331, 3294, 11955; Payload ID: 16027 relates to Category No.: 15618, 15626, 14740, 643, 2329, 5848, 11670, 1797, 2328, 11669, 15538, 14737, 645, 15537, 7303, 3147, 6552, 1313; Payload ID: 16028 relates to Category No.: 15618, 15626, 2329, 11670, 1797, 2328, 11669; Payload ID: 16029 relates to Category No.: 15618, 15626, 2331, 2329, 11670, 1797, 2328, 11669; Payload ID: 16030 relates to Category No.: 15618, 14740, 708, 14742, 15077, 15075; Payload ID: 16031 relates to Category No.: 15618, 14740, 708, 14742, 15077; Payload ID: 16032 relates to Category No.: 15618, 14742, 2483, 15645, 15055, 15647, 15057; Payload ID: 16033 relates to Category No.: 15618, 15626, 3235, 708, 14742; Payload ID: 16034 relates to Category No.: 15618, 14742, 2483, 15055, 3235, 15057, 890, 6056, 9424; Payload ID: 16035 relates to Category No.: 15618, 15996, 15998, 16274; Payload ID: 16036 relates to Category No.: 15618, 15996, 15998, 14048; Payload ID: 16037 relates to Category No.: 15618, 12137, 15626, 12197, 9353, 3244, 5848, 9352, 9642; Payload ID: 16038 relates to Category No.: 15618, 12137, 15626, 12197, 9353, 5848, 3477; Payload ID: 16039 relates to Category No.: 15626, 15618, 12137, 9642, 5848; Payload ID: 16040 relates to Category No.: 15618, 12137, 15626, 9353, 5848; Payload ID: 16041 relates to Category No.: 15618, 12137, 15626, 9642; Payload ID: 16042 relates to Category No.: 15618, 15412, 5846, 845, 5848, 624; Payload ID: 16043 relates to Category No.: 15618, 1874, 14663, 1238, 2198, 10059, 7213, 12338, 6145, 6929, 4535, 13004, 6219, 13851, 1118, 2079, 5995; Payload ID: 16044 relates to Category No.: 15618, 10059, 1874, 14663, 1238, 7213, 12338, 6145; Payload ID: 16045 relates to Category No.: 15618, 10059, 7213; Payload ID: 16046 relates to Category No.: 15618, 10059, 7213, 12341, 5995; Payload ID: 16047 relates to Category No.: 15618, 1874, 14663, 1238, 10059, 7213, 12338, 6145, 5997; Payload ID: 16048 relates to Category No.: 6219, 15618, 5846, 7213; Payload ID: 16049 relates to Category No.: 15618, 10059; Payload ID: 16050 relates to Category No.: 15618, 5846, 7213; Payload ID: 16051 relates to Category No.: 15618, 5846, 7213; Payload ID: 16052 relates to Category No.: 15618, 15626, 15412, 5846, 7213; Payload ID: 16053 relates to Category No.: 15618, 5846, 7213; Payload ID: 16054 relates to Category No.: 15618, 5846, 7213; Payload ID: 16055 relates to Category No.: 15618, 5846, 7213, 15989; Payload ID: 16056 relates to Category No.: 15618, 12197, 710, 5848, 12063, 1893, 3405, 11660, 624, 14550; Payload ID: 16057 relates to Category No.: 15618, 14740, 5848, 9812, 14763, 9814, 15989; Payload ID: 16058 relates to Category No.: 15618, 14740, 9812, 14763, 5846, 12491, 9424, 14742, 9427, 3475, 9814, 15991, 4548, 3477, 15989, 15471; Payload ID: 16059 relates to Category No.: 15618, 8979, 14742, 5848, 6169; Payload ID: 16060 relates to Category No.: 15618, 8977, 14740, 15149, 5848, 9812, 14763, 9814, 6169, 4581, 2331, 2329, 15149, 4588, 3971, 6322, 6167, 15159, 14481, 1295, 8886; Payload ID: 16061 relates to Category No.: 15618, 14456, 8979, 14742, 5848, 6169, 6171, 1295, 2547, 8886; Payload ID: 16062 relates to Category No.: 15618, 3986, 710, 13165, 11294; Payload ID: 16063 relates to Category No.: 15618, 14740, 14742, 9812, 9815, 14763; Payload ID: 16064 relates to Category No.: 15618, 14740, 14742, 9812, 9815, 14763; Payload ID: 16065 relates to Category No.: 15618, 8977, 15149, 643, 221; Payload ID: 16066 relates to Category No.: 15618, 7210, 3475, 3477, 2044, 10531, 14516, 8616; Payload ID: 16067 relates to Category No.: 15618, 8977, 15149, 7210, 3433, 14481, 8972, 8553, 11634, 14025, 6296, 13775, 496, 13827, 14009, 13815, 8979, 14515, 13870, 13939, 14054, 5544, 3635, 1957, 13811, 4535, 8380, 1907; Payload ID: 16068 relates to Category No.: 15618; Payload ID: 16069 relates to Category No.: 15626, 4235, 6896, 15618, 14663, 16234, 16275, 4233, 4145; Payload ID: 16070 relates to Category No.: 15626, 14663, 4235, 3475, 16234, 16275, 15349, 15351, 15347; Payload ID: 16071 relates to Category No.: 15626, 14663, 3475, 16234, 16275, 15349, 15351, 15347; Payload ID: 16072 relates to Category No.: 15618, 1512, 12197, 5046, 4536, 4539, 11884, 14663, 13004, 6000, 3728, 16234, 16275, 5048, 4541, 6051, 1983, 3024, 13973, 16309; Payload ID: 16073 relates to Category No.: 15618, 12197, 5046, 4536, 4539, 4541; Payload ID: 16074 relates to Category No.: 15618, 12197, 5046, 4536, 4539; Payload ID: 16075 relates to Category No.: 15618, 12197, 5046, 4536, 4539, 4541; Payload ID: 16076 relates to Category No.:

15618, 12197, 5046, 4536, 4539; Payload ID: 16077 relates to Category No.: 15618, 12197, 5046, 4536, 1730, 4539, 7306, 14838; Payload ID: 16078 relates to Category No.: 15618, 1512, 12197, 5046, 4536, 4539, 14663, 13004, 3632, 3728, 5048, 4541, 3024, 13860, 1518, 13981, 4307; Payload ID: 16079 relates to Category No.: 15618, 1512, 12197, 5046, 4536, 4539, 14663, 16234, 16275, 5048, 4541, 6051; Payload ID: 16080 relates to Category No.: 15618, 1512, 12197, 5046, 4536, 4539, 14663, 6738, 2009, 5048, 4541, 4535, 1334, 666, 2082, 2006, 13837; Payload ID: 16081 relates to Category No.: 15618, 12197, 5046, 4536, 4539; Payload ID: 16082 relates to Category No.: 15618, 12197, 5046, 4536, 4539; Payload ID: 16083 relates to Category No.: 15618, 1512, 12197, 5046, 4536, 4539, 4541, 5541, 13882, 6535; Payload ID: 16084 relates to Category No.: 15618, 12197, 5046, 4536, 4539, 15989, 4541; Payload ID: 16085 relates to Category No.: 15618, 1512, 12197, 5046, 4536, 4539, 14663, 4307, 5048, 4541, 1977; Payload ID: 16086 relates to Category No.: 15618, 15626, 14565, 10775, 5848, 9812, 9815, 9814, 14742; Payload ID: 16087 relates to Category No.: 15618, 15626, 14740, 5848, 9812, 9814, 16189; Payload ID: 16088 relates to Category No.: 15618, 5846, 708, 9427, 14767, 584, 13716, 710, 11940, 13942; Payload ID: 16089 relates to Category No.: 15618, 5846, 708, 9427; Payload ID: 16090 relates to Category No.: 15618, 5846, 708, 14767, 14025; Payload ID: 16091 relates to Category No.: 708, 14767, 5266, 14542, 15618; Payload ID: 16092 relates to Category No.: 15618, 708, 9427, 14767, 15989; Payload ID: 16093 relates to Category No.: 15618, 708, 9424, 14767, 13827, 15991, 15989, 1856; Payload ID: 16094 relates to Category No.: 15618, 15991, 9429, 9033; Payload ID: 16095 relates to Category No.: 15618, 5846, 643, 8979, 14663, 3475, 9429, 12344, 3433, 9114, 1651, 11940, 7210, 3929, 205, 3788; Payload ID: 16096 relates to Category No.: 1204; Payload ID: 16097 relates to Category No.: 15618, 8977, 5846, 15149, 643, 14663, 3475, 1265, 9429, 12344, 2367, 3433, 8970, 1651, 5082; Payload ID: 16098 relates to Category No.: 15618, 5846, 643, 14663, 3475, 7131, 9429, 12344, 3433, 7210, 12500, 5082, 5083, 15471; Payload ID: 16099 relates to Category No.: 15618, 1730, 7306, 14838, 14831, 14586, 9429, 619, 1612, 1610, 249; Payload ID: 16100 relates to Category No.: 15618, 5846, 14742, 3475, 3477, 12344, 1605, 1612, 12355, 10858, 14761, 7185, 1610; Payload ID: 16101 relates to Category No.: 15618, 5846, 14742, 1265, 9429, 12344, 1605, 1612, 7185, 1610, 15664; Payload ID: 16102 relates to Category No.: 15618, 708, 14767; Payload ID: 16103 relates to Category No.: 15618, 9429; Payload ID: 16104 relates to Category No.: 15618, 5848; Payload ID: 16105 relates to Category No.: 15618, 708, 1862, 9427, 14554, 14565; Payload ID: 16106 relates to Category No.: 15618, 3475, 3477, 3973, 9429; Payload ID: 16107 relates to Category No.: 15618, 708, 9427; Payload ID: 16108 relates to Category No.: 15618, 708, 14767; Payload ID: 16109 relates to Category No.: 15618, 708, 14767; Payload ID: 16110 relates to Category No.: 15618; Payload ID: 16111 relates to Category No.: 15618, 15626, 9232, 1295, 14740, 14742, 14663, 14025, 6052, 16235, 16234, 16275, 6051, 9230, 15539, 3024, 6375; Payload ID: 16112 relates to Category No.: 15618, 15626, 9232, 14742, 14663, 6052, 16235, 16234, 16275, 6051, 7193, 9230, 15539, 13975; Payload ID: 16113 relates to Category No.: 15618, 15626; Payload ID: 16114 relates to Category No.: 15618, 14740, 1417, 16214, 15626, 1415, 1836, 5848, 10005, 16211, 14111, 13920; Payload ID: 16115 relates to Category No.: 15618, 5846, 14740, 1415, 16214, 1836, 11676, 5848, 14014, 6323, 6299, 6102, 1417, 6758; Payload ID: 16116 relates to Category No.: 15618, 14740, 1415, 1836, 11676, 5848; Payload ID: 16117 relates to Category No.: 15618, 14740, 1415, 14455, 1836, 11676, 5848, 14014, 609; Payload ID: 16118 relates to Category No.: 15618, 5846, 14740, 1415, 1836, 11676, 5848, 14014, 8270, 13117; Payload ID: 16119 relates to Category No.: 1512, 4521, 14663, 4538, 890, 6171, 6169, 6056, 13796, 6520; Payload ID: 16120 relates to Category No.: 15626, 1512, 4521, 14663, 4538, 890, 6171, 6169, 6056, 1895, 13796, 927, 6520; Payload ID: 16121 relates to Category No.: 15626, 1867, 14663, 1609; Payload ID: 16122 relates to Category No.: 15618; Payload ID: 16123 relates to Category No.: 385, 383, 15626; Payload ID: 16124 relates to Category No.: 15618, 15626, 14663, 16234, 16275, 9567, 2558; Payload ID: 16125 relates to Category No.: 15626, 12197, 13755, 1874, 14663, 7112, 486; Payload ID: 16126 relates to Category No.: 6171, 6169, 15618, 15626; Payload ID: 16127 relates to Category No.: 15618; Payload ID: 16128 relates to Category No.: 15618, 15626, 8362, 14663, 16197, 13004, 7046, 3728, 4448, 413, 793; Payload ID: 16129 relates to Category No.: 15618, 15626, 10372, 14663, 16197, 13004, 2429, 3728, 413, 8313; Payload ID: 16130 relates to Category No.: 15618, 795, 12127, 1893, 14663, 16197, 16193, 7187, 13004, 3728, 462, 936, 366; Payload ID: 16131 relates to Category No.: 15618, 1512, 15660, 4521, 6310, 1867, 14663, 4538, 2483, 15626; Payload ID: 16132 relates to Category No.: 15618, 1512, 3235, 4521, 5848, 14663, 1878, 4538, 7112, 15089, 15088, 15079, 16037, 15626; Payload ID: 16133 relates to Category No.: 1830, 10129, 14663, 1878, 6326, 15993, 7069, 15626; Payload ID: 16134 relates to Category No.: 15626, 10129, 14663, 1878, 15993; Payload ID: 16135 relates to Category No.: 15626, 1512, 4521, 14663, 4538, 584; Payload ID: 16136 relates to Category No.: 15626, 9290, 4100, 1867, 14663, 4115, 4098, 462, 936, 2555, 4077, 7478, 654, 15618; Payload ID: 16137 relates to Category No.: 15618, 1922, 12668, 13282, 13461, 409, 15994; Payload ID: 16138 relates to Category No.: 15618, 12626, 2083, 7112, 1922, 936; Payload ID: 16139 relates to Category No.: 7303, 1463, 1415, 1895, 932, 13824, 13767, 13851, 455, 15618; Payload ID: 16140 relates to Category No.: 15626, 9812, 4448; Payload ID: 16141 relates to Category No.: 14663, 7112, 4235, 4670, 16234, 16275, 4233, 15626; Payload ID: 16142 relates to Category No.: 15626, 5848, 14663, 5866; Payload ID: 16143 relates to Category No.: 14663, 5866, 5869, 7054, 15626; Payload ID: 16144 relates to Category No.: 15618, 14663, 1878, 6424, 15626; Payload ID: 16145 relates to Category No.: 15626, 15618, 10491, 3083; Payload ID: 16146 relates to Category No.: 10372, 2009, 7122, 13161, 7093, 7046, 10362, 7038, 15515, 12620, 13396, 13282, 12315, 7117, 2010, 7081; Payload ID: 16147 relates to Category No.: 15618, 7122, 13161, 7046, 12315, 15626; Payload ID: 16148 relates to Category No.: 15626, 14345, 14343; Payload ID: 16149 relates to Category No.: 12197, 13755, 1874, 14663, 4448, 15626; Payload ID: 16150 relates to Category No.: 1204, 7112, 15626; Payload ID: 16151 relates to Category No.: 15626; Payload ID: 16152 relates to Category No.: 15626; Payload ID: 16153 relates to Category No.: 15626, 3854, 4977; Payload ID: 16154 relates to Category No.: 15626, 4977, 15618; Payload ID: 16155 relates to Category No.: 15618; Payload ID: 16156 relates to Category No.: 15618; Payload ID: 16157 relates to Category No.: 462, 936, 2555, 654; Payload ID: 16158 relates to Category No.: 15618; Payload ID: 16159 relates to Category No.: 15618; Payload ID: 16160 relates to Category No.: 15618, 15626; Payload ID: 16161 relates to Category No.: 15626, 1204; Payload ID: 16162 relates to Category No.: 15618, 15626; Payload ID: 16163 relates to Category No.:

15618, 15626; Payload ID: 16164 relates to Category No.: 15626; Payload ID: 16165 relates to Category No.: 15626; Payload ID: 16166 relates to Category No.: 15626; Payload ID: 16167 relates to Category No.: 15618, 16308, 1512, 2331, 15075, 13126, 2329, 13031, 1181, 5848, 14663, 4723, 128, 127, 15077, 9495; Payload ID: 16168 relates to Category No.: 15075, 15077, 13126, 2329, 13031, 1181, 9495; Payload ID: 16169 relates to Category No.: 15618, 16308, 1512, 15075, 13126, 2329, 13031, 1181, 5848, 14663, 4723, 128, 127, 15077, 9495, 9451; Payload ID: 16170 relates to Category No.: 2331, 15075, 1181, 13589, 3398, 15618, 13259, 13126, 2329, 710, 13031, 5848, 1925, 14817, 3973, 15077, 9495, 5779, 6734; Payload ID: 16171 relates to Category No.: 15618, 14456, 13298, 15075, 13126, 2329, 13031, 1181, 5848, 15077, 5468, 9495, 13363, 5838; Payload ID: 16172 relates to Category No.: 15618, 12648, 14456, 15075, 13126, 2329, 13031, 1181, 15077, 9495, 13909, 5846, 13827, 14023, 14002, 4307, 708, 2547, 10378, 13988, 13786, 12133, 10370, 14001, 8183; Payload ID: 16173 relates to Category No.: 15618, 2331, 708, 15075, 13126, 2329, 13031, 702, 1181, 5848, 1925, 2013, 14817, 15077, 9495, 11986, 15538, 10512, 5751, 5779, 1977, 15540, 4272, 6581, 3810, 9496; Payload ID: 16174 relates to Category No.: 4411, 15075, 15077, 15618, 2331, 708, 13126, 2329, 710, 13031, 1181, 5848, 9495; Payload ID: 16175 relates to Category No.: 2331, 708, 7306, 15075, 13126, 2329, 710, 13031, 1181, 6670, 14831, 14817, 15077, 9495; Payload ID: 16176 relates to Category No.: 15618, 2331, 15075, 13126, 2329, 710, 13031, 1181, 5848, 10648, 15077, 9495; Payload ID: 16177 relates to Category No.: 15075, 15077, 13126, 2329, 13031, 1181, 9495; Payload ID: 16178 relates to Category No.: 6814, 6305, 4115, 15618, 9858, 1867, 14663, 9841, 9819, 9897, 1594, 9825, 6306, 9835, 8465, 454, 13888, 13812, 11291, 6659, 10713; Payload ID: 16179 relates to Category No.: 6814, 4100, 1867, 14663, 6305, 1186, 1189, 4098, 6904, 6304, 16143, 16144, 4115; Payload ID: 16180 relates to Category No.: 6814, 6305; Payload ID: 16181 relates to Category No.: 6219, 15618, 15626, 6305, 4115, 6304, 6306, 6814, 14643, 16143, 4110, 16144, 6659, 13966; Payload ID: 16182 relates to Category No.: 6305, 4115, 1186, 6814, 1184, 14663, 1189, 16144, 5944, 15665, 10060; Payload ID: 16183 relates to Category No.: 6814, 6305, 4115, 15618, 6306, 16144; Payload ID: 16184 relates to Category No.: 15618, 9232, 9261, 12244, 12305, 9263, 12322, 15626; Payload ID: 16185 relates to Category No.: 15618, 15626, 9232, 12248, 9261; Payload ID: 16186 relates to Category No.: 15618, 15626, 14740, 12244, 12305, 12322, 12248, 12310, 14057; Payload ID: 16187 relates to Category No.: 15618, 15626, 9232, 9261, 9263, 1984, 2006, 5998, 3971, 16015, 14646; Payload ID: 16188 relates to Category No.: 15626, 9261, 15618, 9232, 1780, 9263; Payload ID: 16189 relates to Category No.: 15618, 15626, 9261, 9263; Payload ID: 16190 relates to Category No.: 9261, 7210, 15618, 15626; Payload ID: 16191 relates to Category No.: 15618, 1512, 622, 1830, 5848, 1094, 6090, 624, 1096; Payload ID: 16192 relates to Category No.: 15618, 1512, 14740, 1746, 1417, 13840, 5848, 15754, 1238, 6145, 624, 6123, 6814; Payload ID: 16193 relates to Category No.: 15618, 1651, 1836, 16329, 7675, 13462, 14054, 2165, 16330, 1373, 8379, 8836, 5406, 1409, 3180; Payload ID: 16194 relates to Category No.: 15618, 1651, 16329, 14054, 11366, 16330; Payload ID: 16195 relates to Category No.: 15618, 15626, 1651, 16329, 13462, 14054, 11556, 1649; Payload ID: 16196 relates to Category No.: 15618, 1651, 14025, 16329, 13462, 14054, 16332; Payload ID: 16197 relates to Category No.: 15618, 1651, 1893, 16329, 13462, 14054, 2165, 2544, 16330, 13387, 1649; Payload ID: 16198 relates to Category No.: 15618, 1649, 1651, 1893, 16329, 13462, 14054; Payload ID: 16199 relates to Category No.: 15618, 1651, 1893, 16329, 13462, 14054, 16330, 14485, 1649; Payload ID: 16200 relates to Category No.: 15618, 1651, 1893, 5544, 13668, 16329, 10801, 13462, 14054, 13860, 14485, 2165, 16330, 1649, 13893, 13892; Payload ID: 16201 relates to Category No.: 15618, 15490, 3398, 1649, 9296, 1651, 16330, 11512; Payload ID: 16202 relates to Category No.: 15618, 1651, 6577, 16329, 13462, 14054; Payload ID: 16203 relates to Category No.: 15618, 2679, 2677, 1847, 2675, 3475, 2676, 1935; Payload ID: 16204 relates to Category No.: 2679, 2677, 1847, 12725; Payload ID: 16205 relates to Category No.: 15618, 622, 8977, 15149, 5848, 4678, 4376, 496, 5073; Payload ID: 16206 relates to Category No.: 15618, 15626, 12197, 14656, 1257, 236; Payload ID: 16207 relates to Category No.: 14763, 15618, 14742, 5848, 9811, 1893, 9814, 13938, 13794, 13916, 1276, 13835, 11940, 9451, 13827, 14040, 14023, 13966, 13866, 5949, 13981, 13932, 13988, 4715, 13979, 2086, 13980, 10977, 2054, 15644, 2117, 5417, 3072, 4452, 852, 11402, 11184; Payload ID: 16208 relates to Category No.: 14763, 15618, 14740, 5848, 9812, 1893, 9814, 13836, 1880, 5406; Payload ID: 16209 relates to Category No.: 15618, 14740, 14742, 5848, 9812, 14763, 9814, 1880, 13967, 13932; Payload ID: 16210 relates to Category No.: 15618, 16308, 14565, 1512, 10775, 14663, 4723, 128, 127, 130, 125; Payload ID: 16211 relates to Category No.: 15618, 16308, 1512, 14663, 4723, 128, 7131, 10491, 127; Payload ID: 16212 relates to Category No.: 15618, 1512, 12197, 1894, 1517, 9303, 9290, 12063, 1893, 3405, 11660, 2530; Payload ID: 16213 relates to Category No.: 15618, 708, 1517, 7131, 10491, 8402, 6214; Payload ID: 16214 relates to Category No.: 708, 15932, 11125, 8004, 4318, 12067; Payload ID: 16215 relates to Category No.: 1517, 9303, 15618, 12197, 4353, 15924, 9290, 15626, 15922; Payload ID: 16216 relates to Category No.: 15618, 16308, 708, 1517, 14663, 1854, 15938, 12316, 15942, 3612, 12318, 2383; Payload ID: 16217 relates to Category No.: 15618, 1512, 708, 1517, 4721, 1204, 14663, 4723, 5930, 5932, 12316; Payload ID: 16218 relates to Category No.: 15618, 12197, 1517, 9303, 15950, 15954, 15952, 9290; Payload ID: 16219 relates to Category No.: 15618, 1517, 15954, 15959, 15952, 12908; Payload ID: 16220 relates to Category No.: 12197, 1517; Payload ID: 16221 relates to Category No.: 12197, 1517, 9303, 9290; Payload ID: 16222 relates to Category No.: 15618, 15626, 15922; Payload ID: 16223 relates to Category No.: 708, 1516, 12316; Payload ID: 16224 relates to Category No.: 708, 1516; Payload ID: 16225 relates to Category No.: 708; Payload ID: 16226 relates to Category No.: 708; Payload ID: 16227 relates to Category No.: 708, 9290, 1508; Payload ID: 16228 relates to Category No.: 708; Payload ID: 16229 relates to Category No.: 15626; Payload ID: 16230 relates to Category No.: 15626, 1204; Payload ID: 16231 relates to Category No.: 15349; Payload ID: 16232 relates to Category No.: 15626; Payload ID: 16233 relates to Category No.: 15626; Payload ID: 16234 relates to Category No.: 15626, 10372, 8313; Payload ID: 16235 relates to Category No.: 2945, 1407; Payload ID: 16240 relates to Category No.: 12197, 5297, 4678, 6010, 11779, 15618, 5848, 624, 11780, 8993; Payload ID: 16241 relates to Category No.: 15618, 12197, 5297, 4678, 5848, 6010, 11779, 624, 11780; Payload ID: 16242 relates to Category No.: 622, 15754, 6010, 11779, 11780; Payload ID: 16243 relates to Category No.: 12197, 5297, 4678, 6010, 11779; Payload ID: 16244 relates to Category No.: 15618, 710, 9812, 9811, 15626, 1517; Payload ID: 16245 relates to Category No.: 15618, 15626, 1517, 710, 9812, 9811; Payload ID: 16246 relates to Category No.: 15618, 15626, 13746, 7379, 1836, 10331, 15664, 9000, 2878, 2353, 4690, 9005, 11638, 14972, 5993, 7787, 13969, 13966, 13860, 4548; Payload ID: 16247 relates to Category No.: 15618, 710, 9812, 9811, 15626, 1517; Payload ID: 16248 relates to Category No.: 15618, 622, 8993, 15149, 14742, 5848, 624, 8981, 4597, 4145; Payload ID: 16249 relates to Category No.: 622, 14742, 1269; Payload ID: 16250 relates to Category No.: 622, 14742; Payload ID: 16251 relates to Category No.: 15618, 622, 8977, 15149, 14742, 5848, 4581, 624, 2051, 4145, 2243, 1905, 501, 4659; Payload ID: 16252 relates to Category No.: 15618, 14742, 5848, 6010, 879, 4597, 5092, 6176, 624, 2096, 11517, 1295, 4145, 10676; Payload ID: 16253 relates to Category No.: 15618, 622, 14742, 5848, 624; Payload ID: 16254 relates to Category No.: 15618, 622, 4678, 5848, 624; Payload ID: 16255 relates to Category No.: 622, 14742; Payload ID: 16256 relates to Category No.: 622, 14742, 6358, 6010, 879, 4597, 890, 6171, 5092, 6890, 1649, 6176, 6169, 6036, 6013, 6056, 8993, 1310; Payload ID: 16257 relates to Category No.: 622, 14742; Payload ID: 16258 relates to Category No.: 622, 11502, 1906; Payload ID: 16259 relates to Category No.: 15618, 6819, 1651, 16329, 5406, 3575, 6192, 16330; Payload ID: 16260 relates to Category No.: 15618, 6819, 2165, 10266, 7642, 10267, 16328, 11297; Payload ID: 16261 relates to Category No.: 15618, 6819, 14565, 16328, 13146, 13232; Payload ID: 16262 relates to Category No.: 15618, 6819, 16329, 2165, 2640; Payload ID: 16263 relates to Category No.: 15618, 6819, 16329, 2165, 16328, 5871, 16330, 4164, 4162; Payload ID: 16264 relates to Category No.: 15618, 6819, 16329, 16330; Payload ID: 16265 relates to Category No.: 15618, 6819, 16329, 5406, 3575, 1764, 15197, 6192, 16330; Payload ID: 16266 relates to Category No.: 15618, 6819, 16329, 2165, 16330, 2157; Payload ID: 16267 relates to Category No.: 15618, 6819, 1257, 4057, 16330, 8885, 4334, 11049, 16182, 2157; Payload ID: 16268 relates to Category No.: 15618, 6819, 16329, 2165, 16328; Payload ID: 16269 relates to Category No.: 15618, 6819, 16329, 2165; Payload ID: 16270 relates to Category No.: 15618, 6819, 16330, 1373; Payload ID: 16271 relates to Category No.: 15618, 6819, 16329, 2165, 16330; Payload ID: 16272 relates to Category No.: 15618, 6819, 16330; Payload ID: 16273 relates to Category No.: 15618, 15626, 2331, 2329, 710, 13031, 1181, 5848, 14663, 1861; Payload ID: 16275 relates to Category No.: 2329, 13031, 1181, 15618, 15626, 710, 5848, 14838, 3246; Payload ID: 16276 relates to Category No.: 15618, 15626, 2329, 710, 13031, 1181, 5848; Payload ID: 16277 relates to Category No.: 15618, 15626, 14740, 708, 710, 14742, 13031, 1181, 5848; Payload ID: 16278 relates to Category No.: 15618, 15626, 14740, 708, 710, 13031, 1181, 5848, 13714, 12891, 14056, 3790, 2254, 13541, 7119; Payload ID: 16279 relates to Category No.: 15626, 14740, 708, 710, 13031, 1181, 985, 15618, 5848, 16214, 1465, 2549, 14061, 14066; Payload ID: 16280 relates to Category No.: 15618, 15626, 14740, 708, 710, 13031, 1181, 5848; Payload ID: 16281 relates to Category No.: 15618, 15626, 14740, 708, 710, 13031, 1181, 5848; Payload ID: 16282 relates to Category No.: 15618, 15626, 2331, 14740, 708, 710, 13031, 1181, 5848, 7303, 11634, 6297, 13298, 12285, 5297, 1296, 13921, 12664; Payload ID: 16283 relates to Category No.: 15626, 12197, 14740, 710, 14742, 13031, 1181, 1839, 1279, 4221, 1281, 5845, 708; Payload ID: 16284 relates to Category No.: 15618, 1862, 5869, 7308, 4159, 11512, 5871, 5866, 7613, 14910, 6413, 3725, 13598, 14911; Payload ID: 16285 relates to Category No.: 15618, 1649, 1651; Payload ID: 16286 relates to Category No.: 15618, 1649, 1651; Payload ID: 16287 relates to Category No.: 15618, 1649, 1651; Payload ID: 16288 relates to Category No.: 15618, 8993, 6013, 5848, 624, 6036; Payload ID: 16289 relates to Category No.: 15618, 8993, 6013, 5848, 624; Payload ID: 16290 relates to Category No.: 15618, 1204; Payload ID: 16291 relates to Category No.: 15618, 9945, 14663, 4653, 2367, 9825; Payload ID: 16292 relates to Category No.: 15618, 14565, 10775, 9945, 14663, 4653, 2367, 9825; Payload ID: 16293 relates to Category No.: 15618, 9945, 14663, 4653, 9825; Payload ID: 16294 relates to Category No.: 15618, 9945, 14663, 10362, 4653, 9825, 212, 219; Payload ID: 16295 relates to Category No.: 15618, 9945, 14663, 4653, 9825; Payload ID: 16296 relates to Category No.: 15618, 4541, 4539, 1517; Payload ID: 16297 relates to Category No.: 16214, 14014, 6697, 3197; Payload ID: 16298 relates to Category No.: 15618; Payload ID: 16299 relates to Category No.: 15626; Payload ID: 16300 relates to Category No.: 15618, 5297, 1862, 14663, 4235, 6896, 16234, 16275, 4233, 5759, 4232, 4985; Payload ID: 16301 relates to Category No.: 15618, 15400, 15197, 8680, 13557; Payload ID: 16302 relates to Category No.: 15618, 1204; Payload ID: 16303 relates to Category No.: 15618, 3475, 9429, 5297, 3477; Payload ID: 16304 relates to Category No.: 15618, 3475; Payload ID: 16305 relates to Category No.: 4985; Payload ID: 16306 relates to Category No.: 15618, 15626, 1517, 14742; Payload ID: 16307 relates to Category No.: 15618, 15626, 8977, 15149, 14742, 212, 15149, 2370, 8922, 2367; Payload ID: 16308 relates to Category No.: 15618, 15626, 1512, 4539, 14742, 14663, 5048, 4541, 6878, 5751; Payload ID: 16309 relates to Category No.: 15618, 15626, 1512, 4539, 14742, 4541; Payload ID: 16310 relates to Category No.: 15618, 15626, 795, 1517, 14742; Payload ID: 16311 relates to Category No.: 15618, 15626, 5848, 1925, 1988, 15405, 14663, 1878, 5838, 14740, 14742, 708; Payload ID: 16312 relates to Category No.: 15618, 15626, 14742, 5995; Payload ID: 16313 relates to Category No.: 15618, 15626, 795, 14742, 5848; Payload ID: 16314 relates to Category No.: 15618, 15626, 14742, 14663, 16234, 16275, 1210, 9567, 1211, 9568; Payload ID: 16315 relates to Category No.: 15618, 15626, 14742, 5491, 9738, 13416, 7391; Payload ID: 16316 relates to Category No.: 15618, 15626, 14742; Payload ID: 16317 relates to Category No.: 15618, 15626, 14742; Payload ID: 16318 relates to Category No.: 1517, 1516, 10648, 3783, 4552; Payload ID: 16319 relates to Category No.: 15626, 1184; Payload ID: 16320 relates to Category No.: 1184, 11293, 13376, 11253, 11250, 15626; Payload ID: 16321 relates to Category No.: 16189, 14130; Payload ID: 16322 relates to Category No.: 16189, 14130; Payload ID: 16323 relates to Category No.: 14456, 14663, 16234, 16275, 14128, 14130, 1995; Payload ID: 16324 relates to Category No.: 15618, 15626, 622, 1830, 8979, 5848, 14025, 624; Payload ID: 16325 relates to Category No.: 15618, 15626, 8977, 15149, 8979, 7131, 4376, 13835, 13969, 11940, 14025, 13796, 13971, 13970, 13811, 13916, 6102, 14016, 10639, 13994, 8672, 4342, 4371; Payload ID: 16326 relates to Category No.: 15618, 8977, 15149, 8979, 4376, 1295, 13827; Payload ID: 16327 relates to Category No.: 15618, 15626, 8977, 15149, 8979, 5848, 624, 4376, 13970, 2164, 1857; Payload ID: 16328 relates to Category No.: 15618, 8977, 15149, 8979, 4376; Payload ID: 16329 relates to Category No.: 15618, 15626, 15149, 8979, 7210, 9114, 13978; Payload ID: 16330 relates to Category No.: 15618, 15149, 643, 8979, 7210, 3433, 8970, 3434, 14455, 11051, 6296, 12779, 5998, 13811, 3425, 11713, 414, 3427, 13969, 496, 13827, 13837, 13797, 13961, 13905; Payload ID: 16331 relates to Category No.: 15618, 15149, 8979, 1296, 7210, 14729, 15325, 14025, 14515, 12066, 8419, 14516, 10648, 2080, 10349, 13835, 2110, 1295, 11940, 13882, 13827, 13966, 13970, 8375, 16099, 6758, 2469, 8672, 3436, 1932, 14822, 7778; Payload ID: 16332 relates to Category No.: 15618, 15626, 15149, 8979, 15149, 4680, 4669; Payload ID: 16333 relates to Category No.: 8979, 9424, 15618, 15236, 15626, 622, 1830, 5848, 624; Payload ID: 16334 relates to Category No.: 15618, 15626, 8979, 11779, 11780; Payload ID: 16335 relates to Category No.: 15626, 8979, 10129, 14742, 1204, 14663, 1878, 7340, 2761, 2764, 2762, 15618; Payload ID: 16336 relates to Category No.: 622, 8979, 15618, 15626, 6013, 4678, 13532, 4680, 4676, 8968; Payload ID: 16337 relates to Category No.: 15618, 8993, 14740, 8979, 5848, 6126, 11779, 624, 11780; Payload ID: 16338 relates to Category No.: 622, 8993, 1295, 8979, 4678, 6126, 11780, 501; Payload ID: 16339 relates to Category No.: 15618, 622, 8979, 5848, 624; Payload ID: 16340 relates to Category No.: 15618, 8979, 622, 8993, 5848, 624, 13966; Payload ID: 16341 relates to Category No.: 15618, 622, 8979, 4678, 5848, 624, 11780; Payload ID: 16342 relates to Category No.: 622, 8979, 15618; Payload ID: 16343 relates to Category No.: 15618, 622, 8993, 5848, 11884, 1238, 6145, 6090, 624; Payload ID: 16344 relates to Category No.: 1649, 622, 6036, 6013, 6126, 9794, 15754, 8862, 15618, 15626, 8993, 1730, 1830, 5848, 1238, 6145, 624; Payload ID: 16345 relates to Category No.: 622, 8993, 6036, 6013, 15618, 15626, 1830, 5848, 1238, 6145, 14025, 15471, 9429, 624, 6817; Payload ID: 16346 relates to Category No.: 15618, 15626, 622, 6036, 6013, 1830, 5848, 11884, 1238, 6145, 624; Payload ID: 16347 relates to Category No.: 15618, 15626, 622, 6036, 6013, 1830, 5848, 11884, 1238, 12503, 1094, 6145, 624; Payload ID: 16348 relates to Category No.: 15618, 622, 5848, 1238, 6145, 14025, 6169, 624, 10075, 1295, 13975, 13961, 6114; Payload ID: 16349 relates to Category No.: 622, 6036, 6013; Payload ID: 16350 relates to Category No.: 15618, 15626, 622, 5848, 6045, 6326, 6281, 624, 833; Payload ID: 16351 relates to Category No.: 15618, 15626, 622, 1830, 5848, 6045, 6326, 6281, 1094, 624, 6459, 12999, 9048, 9054, 13096, 6280, 6325, 6047, 833; Payload ID: 16352 relates to Category No.: 15618, 622, 5848, 6045, 6326, 6281, 624, 1094, 833, 6426, 9444, 13588; Payload ID: 16353 relates to Category No.: 15618, 622, 8993, 6358, 5848, 1238, 6145, 2962, 3483, 624; Payload ID: 16354 relates to Category No.: 622, 6036, 6013, 8454; Payload ID: 16355 relates to Category No.: 15626, 622, 1830, 6045, 6326, 6281, 1094; Payload ID: 16356 relates to Category No.: 12137, 4969; Payload ID: 16357 relates to Category No.: 15618, 14740, 1415, 1409, 1417, 1714, 5848, 1238, 7340, 1408, 7855, 12596, 2159, 10287, 16092, 12953, 12617, 1562, 1921, 13956, 6727, 13571, 2107, 13686, 1717, 12595, 11474, 14735, 13689, 1556, 2946, 1419, 14738, 1406, 11634, 3587, 4953, 7341, 14742, 3605, 13882, 1836, 13827, 2006, 13966, 13860, 10486, 13883, 13785, 12573, 13497, 13877, 10625, 1925, 15247; Payload ID: 16358 relates to Category No.: 15618, 14740, 1415, 1417, 1836, 1714, 5848, 13464, 1238, 6102, 6758, 6323; Payload ID: 16359 relates to Category No.: 15618, 14740, 1415, 1417, 1836, 1714, 7369, 5848, 1238, 6102, 2006, 6758, 6323, 13475, 9350, 7030, 7029, 4969, 6819, 14742, 1925, 15247, 1411, 1419, 1407; Payload ID: 16360 relates to Category No.: 15618, 5848, 2945, 14014, 13004, 12592, 4535, 7030, 7029, 14740, 1415; Payload ID: 16361 relates to Category No.: 15618, 5297, 1651, 14742; Payload ID: 16362 relates to Category No.: 15618, 11512, 1512, 5291, 1752, 5297, 13298, 1651, 14742, 13031, 5848, 14663, 5290, 13515, 4723, 2159, 12592, 2051, 12066, 13956, 12882, 10296, 10324, 11107, 12595, 10304, 11474, 1961, 13765, 6487, 14735, 1898, 13572, 14739, 1557, 2079, 13969, 7613, 13459, 13827, 2006, 10238, 1910, 1730, 10362, 1959, 2009, 1746, 8926, 10195, 13571, 1555, 11019, 10862, 14740; Payload ID: 16363 relates to Category No.: 15618, 14740, 5297, 13298, 1651, 14742, 5848, 11997; Payload ID: 16364 relates to Category No.: 15618, 14740, 5297, 13298, 1651, 14742, 5848, 13859, 12427, 2469, 13497; Payload ID: 16365 relates to Category No.: 12648, 16286, 7743, 7946, 11884, 13360, 8524, 10864, 3881, 12649, 8478, 8458, 4469, 6990, 13498, 1191, 4620, 7712, 3893, 3878, 8318, 13701, 3910, 13708, 274, 1892, 7737, 14456, 8645, 991, 433, 1880, 9929, 13712, 8646, 12846; Payload ID: 16366 relates to Category No.: 11884, 5458, 10977; Payload ID: 16367 relates to Category No.: 15618, 14740, 5297, 13298, 1651, 14742, 5848, 3790, 4411; Payload ID: 16368 relates to Category No.: 15618, 14740, 5297, 13298, 1651, 15626, 14742, 5848; Payload ID: 16369 relates to Category No.: 15618, 15626, 14740, 5297, 13298, 1651, 14742, 5848, 8940, 1023, 3039, 3056, 15143, 12197, 13240, 1300; Payload ID: 16370 relates to Category No.: 15618, 11674, 14740, 5297, 13298, 1651, 14742, 5848; Payload ID: 16371 relates to Category No.: 15618, 14740, 5297, 13298, 1651, 14742, 5848, 11674, 11676, 13031; Payload ID: 16372 relates to Category No.: 15618, 14740, 5297, 13298, 1651, 14742, 5848; Payload ID: 16373 relates to Category No.: 15618, 5846, 5297, 1651; Payload ID: 16374 relates to Category No.: 15618, 5846, 5297, 1651, 14742, 9500; Payload ID: 16375 relates to Category No.: 15618, 1730, 5846, 5297, 7306, 1651, 14742, 14838, 14831; Payload ID: 16376 relates to Category No.: 15618, 15626, 708, 1184, 9427, 14663, 14767, 7131, 1189, 5848; Payload ID: 16377 relates to Category No.: 15618, 15626, 708, 1184, 9427, 14663, 14767, 1189; Payload ID: 16378 relates to Category No.: 15626, 5848, 15618, 708, 1184, 9427, 14663, 14767, 1189; Payload ID: 16379 relates to Category No.: 15626; Payload ID: 16380 relates to Category No.: 15618, 15626, 708, 1184, 14767, 1189; Payload ID: 16381 relates to Category No.: 6227, 15618, 15626, 708, 14767, 11812, 5848; Payload ID: 16382 relates to Category No.: 15626, 6269, 1184, 14765, 5848, 15618, 708, 14767; Payload ID: 16383 relates to Category No.: 15618, 15626, 708, 14767, 11812; Payload ID: 16384 relates to Category No.: 15626, 5848, 15618, 15412, 708, 14767, 15407; Payload ID: 16385 relates to Category No.: 15618, 15626, 1730, 708, 7306, 14838, 14767; Payload ID: 16386 relates to Category No.: 15626, 708, 14767; Payload ID: 16387 relates to Category No.: 15626, 708, 14767; Payload ID: 16388 relates to Category No.: 5367, 12427; Payload ID: 16389 relates to Category No.: 4828, 12638, 15149, 1816, 3244, 7743, 1795, 13966, 5267, 13867, 13827, 13971, 13773, 14011, 5327, 13765; Payload ID: 16390 relates to Category No.: 4828, 8962, 15149, 1816, 3244, 7743, 1795, 4828, 2745, 13966, 1964, 14787, 4579, 14838, 14009, 2235, 4251; Payload ID: 16391 relates to Category No.: 4828, 8962, 15149, 1816, 3244, 7743, 4828, 2745, 13966, 1964, 1982, 14787, 439, 14838, 13194, 14009, 2235, 4251, 9744; Payload ID: 16392 relates to Category No.: 4828, 1816, 7743, 9420, 4828, 2745, 5267, 14787, 14838, 14009, 1964, 1982, 2235, 4251; Payload ID: 16393 relates to Category No.: 4828, 8962, 15149, 7743, 4828, 2745, 1982, 14787, 10955, 815, 1752, 4251, 7690; Payload ID: 16394 relates to Category No.: 4828, 8962, 15149, 7743, 10481, 13004, 4828, 2745, 1964, 1982, 14787, 4535, 439; Payload ID: 16395 relates to Category No.: 7288, 12619, 7613, 6969, 14271, 13445, 2886; Payload ID: 16396 relates to Category No.: 1026, 14661, 14565, 10702, 13435, 10074, 5446, 10238, 6606, 348, 803, 4186, 13485, 12391, 4127, 3775, 5541, 16085, 8988, 1238, 6145, 1061, 6413, 13558, 13562, 13332, 10567, 11386; Payload ID: 16397 relates to Category No.: 1026, 14661, 10702, 13435, 10238, 803, 13485, 8988, 1061, 6413, 13558, 13562, 13332, 11386; Payload ID: 16398 relates to Category No.: 12194, 1026, 11512, 7613, 8739, 10372, 7730, 1816, 1729, 7306, 4949, 803, 11506, 3398, 14699, 7737, 2169, 1714, 10359, 12646, 3564, 11453, 13386, 8930, 9600, 8869, 3595, 3604, 6995, 3445, 1744, 9599, 15400, 8898, 4952, 3578, 14943, 5066, 6523, 11821, 7793, 6878, 1320, 1318, 6375, 16096, 10218, 11626, 11394, 684, 16122, 15195, 8840, 14790, 6419, 13713, 4251, 2223, 6859, 5593, 3174, 10728, 10111, 10778, 13264, 1685, 578, 3818, 11357, 13254, 13365, 8801, 11589, 8197, 10885, 10984, 4937, 13589, 3398, 14643, 5949, 724, 673, 3176, 10648, 1463, 5732, 15015, 1741, 672, 8004, 4939, 9320, 3532, 3583, 690, 11620, 3639, 8508, 1780, 1238, 9454, 1128, 12036, 9540, 6377, 3194, 5458, 1483, 15248, 7417, 14886, 3444, 3602, 9554, 3814, 1317, 7693, 10983, 3584, 3598, 10358, 11382, 15402, 9350, 10405, 9349, 9321, 11085, 3594, 8688, 3806, 8503, 3612, 6192, 6191, 14358, 8831, 6384, 12826, 1316, 5070, 14701, 11259, 3247, 15011, 859, 16095, 15482, 6390, 10576, 6778, 9407, 1341, 11378, 11421, 6383, 11820, 3871, 8736, 2044, 7381, 15325, 11138, 13759, 6777, 13336, 15479, 3817, 7896, 4275, 8276, 7590, 14182, 6105, 11736, 13131, 6781, 7317; Payload ID: 16399 relates to Category No.: 1820, 11371, 5541, 2009, 7340, 4229, 4541, 10588, 10666, 10910, 10680, 15000; Payload ID: 16400 relates to Category No.: 1204, 1747, 9125; Payload ID: 16401 relates to Category No.: 1703, 7340, 11418, 10485, 8739, 10955, 1823; Payload ID: 16402 relates to Category No.: 9500, 1512, 14831, 14663, 4538, 4305, 4558, 4303, 14795, 6398, 6399, 14796, 13967, 13874, 13827, 13794, 13813, 13973; Payload ID: 16403 relates to Category No.: 12194, 15626, 14565, 325, 7345, 8601, 12573, 13518, 12948, 13407, 12617, 13409, 12964, 5784, 12618, 8057, 12591, 11323, 1417, 10802, 8753, 2911, 4949; Payload ID: 16404 relates to Category No.: 4828, 4536, 8962, 3639, 16165, 7306, 12891, 3699, 8988, 13888, 4770, 9451, 8860, 4041, 8223, 7417, 10066, 3704, 7971, 10571; Payload ID: 16405 relates to Category No.: 6227, 14565, 12427, 12104, 2355, 12124, 12125, 12122, 11243, 11646, 8370, 8507, 8374, 8255, 12049, 13488, 8532, 7649, 11274, 10542, 8289, 11250, 10428, 8690, 10579, 10537, 7624, 8369; Payload ID: 16406 relates to Category No.: 8962; Payload ID: 16407 relates to Category No.: 8962; Payload ID: 16408 relates to Category No.: 8962, 6102, 6758, 13083; Payload ID: 16409 relates to Category No.: 5782, 16165, 14097, 3698, 3524, 6020, 12409, 8756, 11243, 3691; Payload ID: 16410 relates to Category No.: 3639, 16165, 12137, 2459, 12013, 3697, 9459, 12008; Payload ID: 16411 relates to Category No.: 5782, 3639, 16165; Payload ID: 16412 relates to Category No.: 12137, 3639, 16165, 12798, 8004, 8545, 8508, 7902, 8537; Payload ID: 16413 relates to Category No.: 5782, 10702, 8617; Payload ID: 16414 relates to Category No.: 12137, 1000; Payload ID: 16415 relates to Category No.: 5782; Payload ID: 16416 relates to Category No.: 3699, 12125, 3525; Payload ID: 16417 relates to Category No.: 5782, 14565, 3691, 12798, 14097, 3702, 2350, 12427, 1579, 756, 2705; Payload ID: 16418 relates to Category No.: 12137, 5782, 3691, 10702, 3639, 16165, 7141, 7154, 2515; Payload ID: 16419 relates to Category No.: 2376, 5544, 3067; Payload ID: 16420 relates to Category No.: 5782, 3639, 16165, 14097, 3698, 3524, 12066, 6020; Payload ID: 16421 relates to Category No.: 12137; Payload ID: 16422 relates to Category No.: 12137; Payload ID: 16423 relates to Category No.: 12137; Payload ID: 16424 relates to Category No.: 12137, 8756, 8439, 12404; Payload ID: 16425 relates to Category No.: 6814, 6984; Payload ID: 16426 relates to Category No.: 3639, 13681, 8545, 8817, 6735, 8508, 11094, 13788, 12134, 8453, 5800, 7902, 15547, 4994, 13032, 12667; Payload ID: 16427 relates to Category No.: 5782, 14097, 3702; Payload ID: 16428 relates to Category No.: 12137, 3639, 16165; Payload ID: 16429 relates to Category No.: 12137, 5782, 3691, 3639, 16165, 7141, 7154, 3697, 8526, 10978, 11273, 11944, 7908, 6474, 2515, 6754; Payload ID: 16430 relates to Category No.: 3635, 12137, 3639, 16165, 10734; Payload ID: 16431 relates to Category No.: 5782, 16165, 10028, 14097, 3698; Payload ID: 16432 relates to Category No.: 5782, 3639, 16165, 8731, 3398, 8756, 14097, 3698, 7934; Payload ID: 16433 relates to Category No.: 3639, 16165, 12137; Payload ID: 16434 relates to Category No.: 5782, 3639, 16165, 3524; Payload ID: 16435 relates to Category No.: 16165, 12137, 5782, 3691, 10702, 12427, 3639, 7141, 7154, 6231, 11265, 11282, 10978, 2515, 6754; Payload ID: 16436 relates to Category No.: 12137; Payload ID: 16437 relates to Category No.: 5782, 14565, 3691, 14097, 3702, 3891, 13827; Payload ID: 16438 relates to Category No.: 12137, 3639, 16165; Payload ID: 16443 relates to Category No.: 13594, 13589, 3398, 15490, 3398, 11512, 11506, 3398, 15521, 14663, 4439, 16197, 15570, 10180, 14123, 15736, 15517, 5406, 6269, 3023, 6375, 9451, 3612, 3573, 3605, 6667, 3747, 3607; Payload ID: 16444 relates to Category No.: 15490, 3398, 5428, 2885, 8739, 2411, 8731, 3398, 13818, 11506, 3398, 3313, 14568, 15257, 8408, 1893, 16197, 12120, 14083, 12488, 11660, 11363, 13892, 12858, 8611, 7923, 5610, 7879, 15817, 14000, 8821, 14030, 7756, 8513, 12860; Payload ID: 16445 relates to Category No.: 13589, 3398, 15490, 3398, 14565, 2411, 16197; Payload ID: 16446 relates to Category No.: 13589, 3398, 2411, 3012; Payload ID: 16447 relates to Category No.: 13589, 3398, 2411; Payload ID: 16448 relates to Category No.: 13594, 5367, 15490, 3398, 5406, 7303, 1598, 3602, 4195; Payload ID: 16449 relates to Category No.: 13594, 13589, 3398, 15490, 3398, 11512, 8731, 3398, 11506, 3398, 8739, 15736, 5406, 1060, 6269, 3023, 6375, 3854, 9451, 7537, 7217, 3612, 3573, 3605, 6667, 15194, 4844, 3747, 3607; Payload ID: 16450 relates to Category No.: 13594, 15490, 3398, 12948; Payload ID: 16451 relates to Category No.: 13589, 3398, 15490, 3398, 11628, 2079, 1274; Payload ID: 16452 relates to Category No.: 13589, 3398, 15490, 3398, 10372, 13264; Payload ID: 16453 relates to Category No.: 13594, 15490, 3398, 11512, 9455, 4970, 11412; Payload ID: 16454 relates to Category No.: 13589, 3398, 15490, 3398, 3445, 3595, 12213; Payload ID: 16455 relates to Category No.: 13589, 3398, 15490, 3398, 3595; Payload ID: 16456 relates to Category No.: 8906, 15490, 3398, 11512, 8739, 8731, 3398, 4949, 11506, 3398, 5113, 5949, 3578, 11620, 9476, 16005, 1318, 6192, 10034, 472, 3576, 6787, 4789, 16136, 9335, 9339, 5425, 9336, 5950, 16008, 8887, 11091, 8639, 9333, 5071, 13222, 8888, 10292, 4264, 8285, 6782; Payload ID: 16457 relates to Category No.: 15490, 3398, 14565, 8739, 4057, 8731, 3398, 8888; Payload ID: 16458 relates to Category No.: 8906, 13589, 3398, 14565, 15517, 8639, 5071, 4264, 9334; Payload ID: 16459 relates to Category No.: 13589, 3398, 14565, 15517, 7306, 14782, 8739, 14949, 11512, 5406, 16136, 8887, 4949, 3595, 5453, 15424, 8888; Payload ID: 16460 relates to Category No.: 14838; Payload ID: 16461 relates to Category No.: 14834; Payload ID: 16462 relates to Category No.: 1204; Payload ID: 16469 relates to Category No.: 14565, 1730, 4057, 13277, 6192; Payload ID: 16470 relates to Category No.: 14565, 4021, 10383; Payload ID: 16471 relates to Category No.: 8862, 8906, 14565, 7912, 1703, 12633, 8934, 8378, 7755, 2177; Payload ID: 16472 relates to Category No.: 14565, 15140, 12628, 4021, 10383, 9633; Payload ID: 16473 relates to Category No.: 14565, 7912, 9633; Payload ID: 16474 relates to Category No.: 14565; Payload ID: 16475 relates to Category No.: 1018, 1023; Payload ID: 16476 relates to Category No.: 1737, 13161, 200, 7662, 6223, 455, 8919, 7820; Payload ID: 16477 relates to Category No.: 749; Payload ID: 16478 relates to Category No.: 12194, 8862, 7122, 726; Payload ID: 16479 relates to Category No.: 6814, 11940, 3833, 1048, 10481, 2902, 6967, 6982, 11937, 11005, 2887; Payload ID: 16481 relates to Category No.: 1730, 14838; Payload ID: 16482 relates to Category No.: 1730, 14838; Payload ID: 16483 relates to Category No.: 1730, 14838; Payload ID: 16484 relates to Category No.: 1730, 14838; Payload ID: 16485 relates to Category No.: 1730, 14838; Payload ID: 16486 relates to Category No.: 1730, 14838; Payload ID: 16488 relates to Category No.: 1730, 14838; Payload ID: 16489 relates to Category No.: 1737, 14661, 7154, 7132; Payload ID: 16490 relates to Category No.: 1737, 14661, 7154, 7168, 7132, 2429; Payload ID: 16491 relates to Category No.: 4828, 5428, 795, 442, 15614, 9777, 1816, 14449, 2169, 10209, 1468, 328, 1893, 8988, 1238, 1849, 1237; Payload ID: 16492 relates to Category No.: 11843, 8739, 12154, 8611, 4535, 10548, 11570; Payload ID: 16493 relates to Category No.: 11843, 12153, 8547; Payload ID: 16494 relates to Category No.: 2932, 4766, 7334, 9308, 9182, 3893; Payload ID: 16495 relates to Category No.: 2932, 10366, 2197, 9187, 9188, 4194, 3924, 12036, 9165; Payload ID: 16496 relates to Category No.: 12648, 2940, 2932, 3906; Payload ID: 16497 relates to Category No.: 3878, 7174, 3916, 7172, 7173; Payload ID: 16498 relates to Category No.: 1026, 14661, 5446, 6606, 348, 4186, 286, 12391, 4127, 3775, 5541, 16085, 8988, 283, 274, 10061, 12648, 11242, 4998, 11460, 6413, 10173; Payload ID: 16499 relates to Category No.: 1026, 14661, 795, 5446, 6606, 348, 4186, 12391, 4127, 3775, 11765, 5541, 16085, 8988, 283, 1844, 275; Payload ID: 16500 relates to Category No.: 1026, 14661, 5446, 6606, 348, 4186, 12391, 4127, 3775, 5541, 16085, 8988, 283, 10061, 4998, 10173; Payload ID: 16501 relates to Category No.: 1026, 14661, 5446, 6606, 348, 10061, 4186, 7141, 12391, 4127, 3775, 5541, 16085, 8988, 283, 4774, 13366, 12129, 6718, 10841, 11276, 2607, 14655; Payload ID: 16502 relates to Category No.: 1026, 14661, 16172, 5446, 6606, 348, 4186, 12391, 4127, 3775, 5541, 16085, 8988, 283, 743, 7303, 15140, 480, 2232, 1966; Payload ID: 16503 relates to Category No.: 1026, 14661, 14456, 16172, 5446, 6606, 348, 4186, 2526, 2933, 12391, 1048, 4127, 3775, 5541, 16085, 8988, 283, 1547, 3910, 13497, 15622, 484, 2178, 13292, 8057, 1892, 11051, 480, 4167, 13737; Payload ID: 16504 relates to Category No.: 1026, 11940, 14661, 5446, 6606, 348, 274, 4186, 12391, 4127, 3775, 5541, 16085, 8988, 283, 4766, 6442; Payload ID: 16505 relates to Category No.: 10372, 1955, 7306, 4332, 6532, 10466; Payload ID: 16506 relates to Category No.: 1721; Payload ID: 16507 relates to Category No.: 13360; Payload ID: 16509 relates to Category No.: 13360; Payload ID: 16511 relates to Category No.: 13360; Payload ID: 16512 relates to Category No.: 13360; Payload ID: 16515 relates to Category No.: 12091, 7743, 7345, 5406, 1598, 1556, 13757, 7334; Payload ID: 16516 relates to Category No.: 15490, 3398, 8739, 8731, 3398, 7291, 16182, 9125, 16197, 11087, 11506, 3398; Payload ID: 16517 relates to Category No.: 264, 14838; Payload ID: 16518 relates to Category No.: 14038, 10940, 3016, 9655, 1800, 4167, 11182, 7214, 14840, 6814; Payload ID: 16519 relates to Category No.: 1703; Payload ID: 16520 relates to Category No.: 6814; Payload ID: 16521 relates to Category No.: 6814; Payload ID: 16522 relates to Category No.: 7719, 14586; Payload ID: 16523 relates to Category No.: 1512, 1703, 14586, 4328, 14840, 7304, 1202; Payload ID: 16525 relates to Category No.: 1737, 1721, 1703; Payload ID: 16526 relates to Category No.: 6814, 14586, 1043; Payload ID: 16527 relates to Category No.: 3012; Payload ID: 16528 relates to Category No.: 14838, 3012; Payload ID: 16529 relates to Category No.: 2459, 1047, 6983, 2462, 14816, 1768; Payload ID: 16530 relates to Category No.: 2461, 1047; Payload ID: 16531 relates to Category No.: 2932, 14838, 9165; Payload ID: 16532 relates to Category No.: 1737, 14905, 7159, 2429, 12515, 3915; Payload ID: 16533 relates to Category No.: 1779, 14834; Payload ID: 16535 relates to Category No.: 1204, 11512, 11242; Payload ID: 16536 relates to Category No.: 344, 14838, 14097, 3698, 10366, 7334, 11053, 345, 10955, 11940, 11091, 15011, 8516; Payload ID: 16537 relates to Category No.: 14838, 14586, 1202, 3808; Payload ID: 16538 relates to Category No.: 7306, 4328, 266; Payload ID: 16539 relates to Category No.: 1204; Payload ID: 16540 relates to Category No.: 14838, 2460, 13757, 14641, 4167, 7305, 1047, 1296, 3600, 5375; Payload ID: 16541 relates to Category No.: 14831, 9610; Payload ID: 16542 relates to Category No.: 14838; Payload ID: 16545 relates to Category No.: 14838, 14831, 14827; Payload ID: 16546 relates to Category No.: 7306, 14834, 6651; Payload ID: 16548 relates to Category No.: 1204; Payload ID: 16549 relates to Category No.: 15517, 1730, 11512, 12891, 11506, 3398, 14838, 9379, 9485; Payload ID: 16550 relates to Category No.: 13589, 3398, 15490, 3398, 7306, 14838, 9379; Payload ID: 16552 relates to Category No.: 10702, 13435, 12638, 1752, 6018, 4200; Payload ID: 16553 relates to Category No.: 1730, 7306, 14838; Payload ID: 16555 relates to Category No.: 1955, 7076, 7130, 2121; Payload ID: 16556 relates to Category No.: 1730, 7306, 14838; Payload ID: 16557 relates to Category No.: 1730, 7306, 14838; Payload ID: 16558 relates to Category No.: 6814, 1730, 7306, 14838; Payload ID: 16560 relates to Category No.: 4367, 15144, 4167, 6681, 13114, 13740; Payload ID: 16561 relates to Category No.: 13589, 3398, 15490, 3398, 1730, 7306, 14838; Payload ID: 16562 relates to Category No.: 1730, 14838; Payload ID: 16565 relates to Category No.: 14838; Payload ID: 16569 relates to Category No.: 1730, 7306, 14838; Payload ID: 16571 relates to Category No.: 1730, 7306, 14838, 7245; Payload ID: 16573 relates to Category No.: 9994, 16214, 14014, 12040, 12039, 14838; Payload ID: 16575 relates to Category No.: 1730, 7306, 14838; Payload ID: 16579 relates to Category No.: 13589, 3398, 15490, 3398; Payload ID: 16580 relates to Category No.: 10129, 14663, 1878, 14842; Payload ID: 16581 relates to Category No.: 6814; Payload ID: 16582 relates to Category No.: 6814, 690, 10129, 14663, 1878, 10126, 12281, 12646; Payload ID: 16583 relates to Category No.: 12281, 14841, 14846, 12276, 9117, 6814; Payload ID: 16584 relates to Category No.: 16308, 9500, 10129, 14663, 1878, 10126, 10127, 14848; Payload ID: 16585 relates to Category No.: 10129, 14663, 1878, 14847, 6888; Payload ID: 16586 relates to Category No.: 795; Payload ID: 16588 relates to Category No.: 11512, 6304, 13459, 11444, 8057, 7619, 8571; Payload ID: 16590 relates to Category No.: 15898, 15207, 12153, 5446, 9038, 14383, 7362, 4127, 9125, 16197, 7132, 14992, 670, 15782, 11587, 13644, 4336, 15003, 4332, 15456, 15450, 7363, 15448, 15443, 15454, 2469, 15446, 15653, 15457, 15458, 15451, 5134; Payload ID: 16591 relates to Category No.: 12153, 14489, 14383, 1780, 7132, 670, 4332, 12619, 12096, 15898, 4336, 10860, 11287, 11391, 1931; Payload ID: 16592 relates to Category No.: 3356; Payload ID: 16593 relates to Category No.: 8862, 14565, 14865, 14663, 2206, 11248, 14868, 8255, 14869, 4729, 15293, 13827, 10238, 13811, 6814; Payload ID: 16594 relates to Category No.: 803, 1795, 14865, 14663, 15782, 8988, 14869, 4729, 10404, 5785, 13936, 2206; Payload ID: 16595 relates to Category No.: 1721, 1795, 14865, 14663, 15782, 14868, 10595, 4729, 10404, 4969, 14869, 9639; Payload ID: 16596 relates to Category No.: 6814, 14865, 14663, 2136, 2206, 14868, 4729, 4654; Payload ID: 16597 relates to Category No.: 1204, 14868; Payload ID: 16598 relates to Category No.: 1204, 14868, 6814; Payload ID: 16599 relates to Category No.: 7965, 5428, 2041, 2136, 10648; Payload ID: 16600 relates to Category No.: 9982, 14865, 14663, 14862, 14867; Payload ID: 16601 relates to Category No.: 11926, 5785, 14565, 7613, 11109, 14880, 14865, 1451, 10366, 1893, 14663, 16085, 11298, 14862, 11392, 10362, 11108, 13635, 10626, 11176, 2994, 11027, 10226, 14874, 6225, 14876, 14860, 9982, 5428, 10372, 1240, 1295, 13013, 13969, 13989, 2001, 11285, 4145, 11094, 13893, 13932, 1993, 11097, 2116, 13772, 2835, 13785; Payload ID: 16602 relates to Category No.: 7613, 14880, 14865, 1780, 14663, 14862, 14874, 6225, 14857, 10372, 1240, 1295, 14876, 4145, 9982; Payload ID: 16603 relates to Category No.: 1533, 4110, 803, 14865, 14663, 14862, 2211, 14863, 16096, 5949, 11634, 14838, 4194, 4998, 10093, 9540, 14641, 4138, 13189, 6391, 4067, 6163, 684, 3934, 9068; Payload ID: 16604 relates to Category No.: 14865, 14663, 14862, 3100, 4039, 5806, 14876, 14858; Payload ID: 16605 relates to Category No.: 3100, 14865, 14663, 14862, 14876; Payload ID: 16606 relates to Category No.: 4828, 1703, 1752, 14880, 275, 2311, 12553, 15202, 1248, 6018, 12555, 1569, 4955, 10372, 690, 1295, 439, 12614, 11512, 10366, 10702, 11391, 10487, 8929, 11216, 8661, 15622, 3711; Payload ID: 16607 relates to Category No.: 4828, 10372, 345, 14880, 275, 10587, 11176, 4200, 7957; Payload ID: 16608 relates to Category No.: 4828, 10372, 674, 14880, 10486, 7953, 5428, 9125, 2878, 439, 13013; Payload ID: 16609 relates to Category No.: 4828, 5367, 14880, 10486, 355, 434; Payload ID: 16610 relates to Category No.: 4828, 14880, 13229; Payload ID: 16611 relates to Category No.: 13359; Payload ID: 16612 relates to Category No.: 13589, 3398, 11512, 1730, 8731, 3398, 11506, 3398, 5146, 8004, 3783, 11224, 12833, 5326, 8083, 8739, 13594, 15517, 14782, 3854, 6468, 8298, 7377, 4844, 16095, 6412, 7378, 675, 802, 6419, 1966; Payload ID: 16613 relates to Category No.: 13594, 13589, 3398, 15490, 3398; Payload ID: 16614 relates to Category No.: 13594, 13589, 3398, 15490, 3398, 1730, 11512, 1227; Payload ID: 16615 relates to Category No.: 1737, 7162, 12677, 6881; Payload ID: 16616 relates to Category No.: 1737, 14661, 7154, 13147, 7132, 2429; Payload ID: 16617 relates to Category No.: 1737, 14661, 7154, 13147, 7132, 2429; Payload ID: 16618 relates to Category No.: 1737, 7154, 13147, 2429; Payload ID: 16619 relates to Category No.: 1737, 14661, 7132, 3889, 14899, 7153, 12023; Payload ID: 16620 relates to Category No.: 16286, 7306, 2409, 4367, 6670, 14320, 11620; Payload ID: 16621 relates to Category No.: 1721, 4367; Payload ID: 16622 relates to Category No.: 4367, 795, 1721; Payload ID: 16623 relates to Category No.: 4367; Payload ID: 16624 relates to Category No.: 4367; Payload ID: 16625 relates to Category No.: 6227, 15618, 14880, 6293; Payload ID: 16626 relates to Category No.: 6227, 15618, 14880, 6293, 1061, 6413, 1269, 6403, 15197, 14865, 12989, 6414, 12859; Payload ID: 16627 relates to Category No.: 6227, 15618, 14880, 6293; Payload ID: 16628 relates to Category No.: 12137, 16172, 274, 296, 5788, 2515, 10109, 3884, 4283, 4785; Payload ID: 16629 relates to Category No.: 12137, 16172, 274, 296, 5788, 2515, 10109, 3884, 4283; Payload ID: 16630 relates to Category No.: 5785, 12153; Payload ID: 16631 relates to Category No.: 5785, 12153, 1204; Payload ID: 16632 relates to Category No.: 5785, 12153; Payload ID: 16633 relates to Category No.: 5785, 12153; Payload ID: 16634 relates to Category No.: 12091, 690, 5785, 1070, 1730, 10074, 15614, 9717, 5446, 403, 10961, 5592, 3013, 1780, 10265, 4127, 4130, 16197, 14992, 1238, 9000, 13320, 13460, 10344, 12832, 9410, 10289, 6134, 13635, 13299, 6404, 1249, 13319, 6137, 6460, 10219, 8997, 14513, 13521, 15506, 13242, 2062, 12501, 9713, 11858, 345, 11178, 6153, 9720, 344, 10478, 1795, 1129, 10218, 10307, 10642, 14512, 10843, 10691, 11313, 3754, 11573; Payload ID: 16635 relates to Category No.: 13589, 3398, 15490, 3398, 7291, 16182, 8408, 14913, 7263, 13511, 6163, 6538, 8636; Payload ID: 16636 relates to Category No.: 7288, 14267, 7291, 16182, 14271, 4439, 7263; Payload ID: 16637 relates to Category No.: 7288, 7291, 16182, 14271, 4439, 7263, 11094; Payload ID: 16638 relates to Category No.: 7288, 7291, 16182, 14271, 4439, 14271, 16183, 7263; Payload ID: 16639 relates to Category No.: 7291, 16182, 14271, 4439, 14913, 14271, 16183, 724, 1228; Payload ID: 16640 relates to Category No.: 7288, 7291, 16182, 14271, 4439, 16197; Payload ID: 16641 relates to Category No.: 7288, 7291, 16182, 14271, 11884, 4439, 14271, 16183, 8508; Payload ID: 16642 relates to Category No.: 7288, 7291, 16182, 14271, 4439, 14271, 16183, 11049, 16182; Payload ID: 16643 relates to Category No.: 7291, 16182, 14271, 4439; Payload ID: 16644 relates to Category No.: 7291, 16182, 14271, 4439, 1228; Payload ID: 16645 relates to Category No.: 7288, 15490, 3398, 8739, 3452, 8731, 3398, 14271, 5147, 12717, 7810, 14123, 601, 16182, 11158, 1955, 12619, 2424, 11375; Payload ID: 16646 relates to Category No.: 7288, 13589, 3398, 15490, 3398, 14267, 14271, 8335, 16182, 601, 16182, 7266; Payload ID: 16647 relates to Category No.: 7288, 14271; Payload ID: 16648 relates to Category No.: 12194, 3452; Payload ID: 16649 relates to Category No.: 12431, 14838, 3336, 3305, 3656, 4134, 15144, 9379, 14834, 9485, 6535, 6696, 15174, 12010; Payload ID: 16650 relates to Category No.: 15490, 3398, 8454; Payload ID: 16651 relates to Category No.: 1703, 1893, 11660, 12068, 12067; Payload ID: 16652 relates to Category No.: 1026, 1703, 3013, 5446, 13925, 3021, 11566, 2041, 3014, 10851, 10945, 9391, 5422, 6618; Payload ID: 16653 relates to Category No.: 8552, 7743, 7946, 9409, 13465, 7306, 3775, 7933, 8049, 16005, 3889, 6878, 7986, 8255, 8382, 1340; Payload ID: 16654 relates to Category No.: 7613, 13465, 7306, 4186, 12628, 7946, 3775, 10648, 11291, 11174, 11266, 10583, 8447, 7933, 7742, 8049, 7743, 3889, 5459, 1741, 6375, 14456, 7986, 13757, 1320, 8552, 8255, 6384, 8382, 6379, 1340, 12646; Payload ID: 16655 relates to Category No.: 13465, 7306, 1021; Payload ID: 16656 relates to Category No.: 13465, 7306, 7946, 8255; Payload ID: 16657 relates to Category No.: 1026, 14661, 5446, 13465, 6606, 348, 7306, 4186, 12391, 4127, 3775, 5541, 16085, 8988, 8454, 5407, 8447, 10516, 14566, 13347; Payload ID: 16658 relates to Category No.: 13465, 7306, 5407, 8447, 10516, 14566, 13347; Payload ID: 16659 relates to Category No.: 13465, 7306; Payload ID: 16660 relates to Category No.: 1955, 3354, 14034, 11298, 15605, 3851; Payload ID: 16662 relates to Category No.: 1204; Payload ID: 16664 relates to Category No.: 15499, 15517, 3356, 3354, 4439, 16197, 10527, 3559, 11611, 9276; Payload ID: 16665 relates to Category No.: 13589, 3398, 9274, 1204, 5129, 12705; Payload ID: 16666 relates to Category No.: 13259, 1002, 2410, 4418, 10664; Payload ID: 16667 relates to Category No.: 13594, 13589, 3398, 15517, 11506, 3398, 5127, 2410, 5146, 7131, 10491; Payload ID: 16668 relates to Category No.: 13594, 13589, 3398, 15499, 11512, 8739, 2411, 15517, 4439, 16197, 10527, 3559, 7891, 3559, 11611, 8736, 15490, 3398; Payload ID: 16669 relates to Category No.: 13594, 13589, 3398, 15499, 11512, 1721, 8334, 8739, 2411, 15517, 12777, 3559, 4439, 16197, 10527, 3559, 182, 3399, 3559, 13970, 10938, 7891, 3559, 14591, 11611; Payload ID: 16670 relates to Category No.: 13594, 7288, 13589, 3398, 15490, 3398, 9232, 2411, 14271, 12777, 3559, 16197, 7295, 11509, 8078, 13046, 13184, 13193, 13183; Payload ID: 16671 relates to Category No.: 13589, 3398, 15490, 3398, 2410, 5146, 6508; Payload ID: 16673 relates to Category No.: 9500, 14663, 2347, 14979, 13970, 1832, 2355; Payload ID: 16674 relates to Category No.: 1722, 7291, 16182, 14915, 7272, 16182, 6633, 5806, 10488; Payload ID: 16675 relates to Category No.: 14267, 9274, 7291, 16182, 12891, 14915, 14918, 14913, 10738, 5242, 1764, 4974; Payload ID: 16676 relates to Category No.: 13589, 3398, 15490, 3398, 14834, 14831, 14586, 7121, 8314; Payload ID: 16677 relates to Category No.: 690, 14565, 795, 1730, 11371, 16085; Payload ID: 16679 relates to Category No.: 795; Payload ID: 16681 relates to Category No.: 11512, 15207, 403, 11506, 3398, 11371, 12041, 10343; Payload ID: 16682 relates to Category No.: 14565, 11371, 11884, 1053, 5370; Payload ID: 16683 relates to Category No.: 12638, 15043, 12760, 3986, 11296, 8546, 7719, 8540; Payload ID: 16684 relates to Category No.: 12091, 1026, 14661, 5785, 14565, 9720, 1721, 8175, 12619, 3766, 1703, 1730, 7613, 10074, 9717, 5446, 5592, 4186, 1277, 12646, 7965, 12391, 7840, 4130, 3775, 16197, 6738, 14992, 16085, 8988, 2097, 1238, 14556, 15570, 11858, 2088, 6145, 12650, 11291, 11178, 11266, 13893, 15192, 7992, 10573, 7600, 10804, 12788, 11763, 12555, 13323, 9458, 13653, 10890, 8305, 8517, 12823, 15000, 703, 12608, 9982, 15043, 1752, 9379, 10583, 2131, 11912, 1971, 4251, 13342, 10314, 11213, 2107, 1313, 2094, 13030, 16041, 12644, 13967, 11506, 3398, 14589, 10343, 8731, 3398, 2041, 13936, 11390, 13827, 2006, 10238, 10514, 10648, 1780, 9713, 13829, 2009, 15535, 13877, 1969, 13843, 10466, 13945, 10478, 10954, 14038, 10800, 11240, 11295, 13765, 10668, 361, 11186, 10862, 450, 11212; Payload ID: 16685 relates to Category No.: 11371; Payload ID: 16686 relates to Category No.: 8739, 5783, 11371, 12994, 15185, 7686, 7641, 1064, 749; Payload ID: 16687 relates to Category No.: 12091, 1730, 15614, 1752, 9717, 5446, 274, 12646; Payload ID: 16688 relates to Category No.: 14663, 14932, 7792, 10924, 2355, 13882, 13888, 12864, 12863, 12694, 496; Payload ID: 16689 relates to Category No.: 7288, 14271; Payload ID: 16690 relates to Category No.: 14123; Payload ID: 16691 relates to Category No.: 14271, 7288, 15517; Payload ID: 16692 relates to Category No.: 7288, 14271, 14913, 14271, 16183; Payload ID: 16694 relates to Category No.: 7288, 14271; Payload ID: 16695 relates to Category No.: 12091, 7288, 5785, 5446, 13185, 16182, 14271, 16197, 8818, 2429, 11607, 13184, 14818; Payload ID: 16696 relates to Category No.: 12091, 690, 5785, 11089, 1730, 5446, 10372, 13185, 16182, 14271, 10648, 8818, 14913, 11607, 10349, 9216; Payload ID: 16697 relates to Category No.: 12091, 1730, 7351, 14636; Payload ID: 16698 relates to Category No.: 13589, 3398, 2410, 15517, 11512, 8934, 4251, 6117, 4257, 4256, 16127; Payload ID: 16699 relates to Category No.: 13594, 674, 15517, 1730, 11512, 5406, 11506, 3398, 7613, 1751, 3194, 6705, 8869, 7693, 5988, 9350, 9738, 11085, 3247, 7237, 3737, 10654, 13589, 3398, 8731, 3398, 14944; Payload ID: 16700 relates to Category No.: 15588, 11091, 11512, 8739, 8929, 10372, 7728, 11506, 3398, 14640, 10648, 8753, 8004, 11147, 4943, 14768, 8240, 9480, 14883, 10286, 9107, 2698, 13616, 16137, 11087, 8865, 3577, 6384, 6117, 15135, 10762, 4065, 11414, 14790, 11146, 3613, 6191, 8889, 1584, 4480, 4474, 10733, 8009, 8900, 2524, 14572, 10897, 15517, 14620, 5949, 1780, 9349; Payload ID: 16701 relates to Category No.: 13594, 11512, 1741, 14883, 15517, 12171; Payload ID: 16702 relates to Category No.: 13589, 3398, 15490, 3398, 674, 12888; Payload ID: 16703 relates to Category No.: 8862, 13589, 3398, 15490, 3398, 8739, 8731, 3398, 16214, 13231, 3742; Payload ID: 16704 relates to Category No.: 13594, 13589, 3398, 11512, 1730, 8739, 2410, 6530, 11352, 8666, 7380, 10636, 11064, 14638; Payload ID: 16705 relates to Category No.: 690, 13589, 3398, 11512, 12794, 11506, 3398, 7693, 7735, 3587, 12117, 9480, 4952, 16096, 3642, 11912, 7294, 13713, 3626, 3617, 3583, 1543, 3647, 3591, 1591, 13602, 4950, 8739, 1758, 10648, 14838, 3641, 14944, 1483, 11243, 3602, 5454, 4418, 3645, 14291, 14577, 13134, 8287, 12628, 10358, 11382, 14948, 2603, 4366, 13510, 13508, 8831, 8834, 12587; Payload ID: 16706 relates to Category No.: 690, 11512, 8739, 8731, 3398, 11506, 3398, 3587, 3876, 9480, 4952, 16095, 16096, 7294, 4935, 1244, 6406, 3626, 6407, 3617, 4937, 13589, 3398, 5406, 1240, 4949, 1751, 14948, 13510, 6404; Payload ID: 16707 relates to Category No.: 13589, 3398, 11512, 1722, 5458, 8739, 11506, 3398, 12891, 2410, 7693, 4057, 10955, 8375, 14050, 8954, 7939, 14782, 9455, 10034, 13865, 12734, 4251, 3646, 4476, 13594, 14949, 2243, 14059, 673, 11091, 13225, 8930, 5459, 1741, 11125, 13970, 15459, 14456, 8421, 6523, 14000, 14944, 3147, 9342, 6116, 1744, 7730, 3602, 3814, 3144, 11085, 6371, 10572, 8831, 4257, 414, 3242, 10018, 15517, 10358, 15427, 10379; Payload ID: 16708 relates to Category No.: 13594, 13589, 3398, 15490, 3398, 14944, 4937, 14643, 4934; Payload ID: 16709 relates to Category No.: 13589, 3398, 15490, 3398, 8739, 8928, 2169, 5334, 8375, 14532, 10034, 4066, 14448, 9410, 4251, 14835; Payload ID: 16710 relates to Category No.: 13594, 13589, 3398, 15490, 3398, 13814, 14838; Payload ID: 16711 relates to Category No.: 13589, 3398, 11512, 10372, 1483, 10238, 7728, 15517, 4949, 7743, 11506, 3398, 14640, 3313, 14567, 10314, 12117, 15194, 13376, 10801, 14883, 11546, 11620, 9107, 8547, 16137, 4535, 1984, 3313, 3132, 15135, 7178, 6191, 8513, 1578, 8889, 1584, 4480, 4474, 8900, 11745, 969, 5951, 14886, 872, 11127, 14782, 3632; Payload ID: 16712 relates to Category No.: 15517, 10329, 2131, 10429, 10985, 11512, 5406, 8731, 3398, 1741, 1622, 9350, 2177, 13583; Payload ID: 16713 relates to Category No.: 13589, 3398, 15490, 3398, 7345, 10329, 2131, 10429, 10985, 7306, 8739, 11512, 5406, 11634, 12891, 8731, 3398, 11506, 3398, 1741, 4440, 4998, 3854, 1622, 1764, 1557, 7334, 9350, 9348, 3853, 908; Payload ID: 16714 relates to Category No.: 15490, 3398, 8731, 3398, 7743, 10470, 12583, 3642, 13594, 11506, 3398; Payload ID: 16715 relates to Category No.: 15490, 3398, 11512, 14565, 7613, 1741, 8731, 3398, 11506, 3398, 14838, 3737, 4094, 455, 6530, 14056, 8869, 8352, 11148, 9738, 5406, 9455, 10292, 10884, 9350, 14074, 7237, 13720, 6865, 12986, 10654, 14520, 16002, 10648, 14620, 1751, 910, 8469; Payload ID: 16716 relates to Category No.: 11512, 14565, 7613, 2411, 10372, 8731, 3398, 15517, 12498, 11506, 3398, 9274, 14640, 14838, 12646, 7693, 11884, 3775, 11285, 6530, 2014, 14056, 1477, 3812, 1744, 11187, 3846, 5758, 2051, 1621, 10329, 2131, 8352, 2110, 7799, 7939, 9466, 11821, 14782, 10573, 10574, 1960, 10983, 2548, 14521, 1622, 15425, 8420, 1996, 10292, 4937, 3622, 10884, 10952, 10429, 10985, 8107, 4956, 4958, 2377, 2378, 12625, 6527, 10572, 8469, 14074, 3804, 12647, 7237, 7655, 13720, 6865, 14594, 1730, 5243, 4021, 7743, 14589, 10648, 1318, 1741, 6376, 9465, 8004, 2940, 4949, 2169, 12036, 11824, 6559, 9451, 9125, 3632, 11980, 11243, 3814, 15999, 2376, 2374, 12628, 5988, 9350, 14520, 5799, 12614, 6191, 9129, 910, 10597, 7664, 3630, 7937, 8865, 6538, 15477, 4944, 16002, 6875, 16003, 10375, 8276, 4957, 1331, 12557, 6388, 16004, 12825; Payload ID: 16718 relates to Category No.: 7288, 7287, 3101; Payload ID: 16719 relates to Category No.: 6814; Payload ID: 16720 relates to Category No.: 1512, 1894, 11930, 14551, 12062, 12063, 9324, 1893, 14663, 3405, 11660, 4723, 12068, 4398, 9359, 5930, 5932, 7460, 12091; Payload ID: 16721 relates to Category No.: 1512, 1894, 11930, 14551, 12063, 9324, 1893, 14663, 3405, 11660, 4723, 12068, 4398, 9359, 5930, 5932, 625; Payload ID: 16722 relates to Category No.: 1512, 14551, 12063, 9324, 1893, 14663, 3405, 11660, 4723, 12068, 4398, 9359, 5930, 5932, 11930; Payload ID: 16723 relates to Category No.: 1512, 11930, 14551, 2562, 12063, 9324, 1893, 14663, 3405, 11660, 4723, 12068, 4398, 9359, 5930, 5932; Payload ID: 16724 relates to Category No.: 1512, 11930, 14551, 12063, 9324, 1893, 3405, 11660, 4727, 4398, 9359, 5930; Payload ID: 16725 relates to Category No.: 1512, 1894, 11930, 14551, 12063, 9324, 1893, 14663, 3405, 11660, 4723, 4398, 9359, 5930, 5932, 2021, 4701; Payload ID: 16726 relates to Category No.: 11930, 14551, 12063, 9324, 1893, 3405, 11660, 4398, 9359, 9357; Payload ID: 16727 relates to Category No.: 11930, 14551, 12063, 9324, 1893, 3405, 11660, 12068, 4398, 9359; Payload ID: 16728 relates to Category No.: 11930, 14551, 12063, 9324, 1893, 3405, 11660, 4398, 4715, 9359, 4729, 4733; Payload ID: 16729 relates to Category No.: 11930, 14551, 12063, 9324, 1893, 3405, 11660, 12068, 4398, 9359, 4701; Payload ID: 16730 relates to Category No.: 11930, 14551, 12063, 9324, 1893, 3405, 11660, 4727, 4398, 9359, 9357; Payload ID: 16731 relates to Category No.: 11930, 14551, 12063, 9324, 1893, 3405, 11660, 4398, 4715, 9359, 4729, 9357, 1815, 4733; Payload ID: 16732 relates to Category No.: 11930, 14551, 5285, 12063, 9324, 1893, 3405, 11660, 12068, 9359, 7460, 13837, 11041, 7790, 13520, 12115, 8244; Payload ID: 16733 relates to Category No.: 1512, 11930, 14551, 7306, 4859, 12063, 9324, 1893, 3405, 11660, 9359; Payload ID: 16734 relates to Category No.: 1512, 11930, 14551, 12063, 1893, 3405, 11660, 4727, 10372, 1995; Payload ID: 16735 relates to Category No.: 8862, 1026, 1512, 1894, 11930, 14551, 9020, 12063, 1893, 3405, 11660, 4398, 9359; Payload ID: 16736 relates to Category No.: 11930, 14551, 9020, 12063, 1893, 3405, 11660, 4727, 4398, 4715, 9359; Payload ID: 16737 relates to Category No.: 8862, 1026, 1894, 11930, 14551, 9020, 12063, 1893, 3405, 11660, 4398, 9359; Payload ID: 16738 relates to Category No.: 1512, 11930, 14551, 12063, 1893, 3405, 11660, 4727; Payload ID: 16739 relates to Category No.: 11930, 14551, 1505, 12063, 1893, 11660, 12068, 4398, 4715, 9359, 4699; Payload ID: 16740 relates to Category No.: 9500, 5428, 1703, 12427, 1816, 3013, 7598; Payload ID: 16741 relates to Category No.: 690, 9500, 1512, 5291, 1703, 12427, 3639, 12891, 3013, 14663, 5290, 4723, 12543; Payload ID: 16742 relates to Category No.: 1779, 1938, 10439, 2565; Payload ID: 16744 relates to Category No.: 11915, 8552, 10372, 5910, 7141, 8458, 8373; Payload ID: 16745 relates to Category No.: 12194; Payload ID: 16746 relates to Category No.: 14015, 13762; Payload ID: 16747 relates to Category No.: 7737, 1836, 1269, 7923, 10298, 12492, 3714, 7679, 2379, 12591, 4879, 8570, 13969, 9451, 2006, 1982, 1925, 3566, 3010, 14045; Payload ID: 16748 relates to Category No.: 8004, 12985, 13975, 13831, 3684, 8337, 1408, 13514, 1836, 2006, 13981, 3566, 3010, 14045; Payload ID: 16749 relates to Category No.: 13589, 3398, 15490, 3398, 9228, 16197, 4442, 9455; Payload ID: 16750 relates to Category No.: 7340, 4686, 4708; Payload ID: 16751 relates to Category No.: 2359; Payload ID: 16752 relates to Category No.: 11181, 1191; Payload ID: 16753 relates to Category No.: 14661, 14565, 10702, 13485; Payload ID: 16754 relates to Category No.: 6219, 2359, 2355, 7112, 14972, 11760; Payload ID: 16755 relates to Category No.: 6227; Payload ID: 16756 relates to Category No.: 6227, 14663, 14972, 1354; Payload ID: 16757 relates to Category No.: 6227; Payload ID: 16758 relates to Category No.: 11294; Payload ID: 16759 relates to Category No.: 14661, 14565, 10702, 13485; Payload ID: 16760 relates to Category No.: 6814, 6984, 14894; Payload ID: 16761 relates to Category No.: 3013, 1206, 12553, 14357, 9451, 7664; Payload ID: 16762 relates to Category No.: 5785, 14565, 14038, 12746, 7168, 13147, 8936, 6971, 1048, 8301, 10386, 1295; Payload ID: 16763 relates to Category No.: 8300, 13147, 8936, 6971, 8378, 11094, 8301, 2068, 11005; Payload ID: 16764 relates to Category No.: 12746, 13147, 6971; Payload ID: 16765 relates to Category No.: 8862, 12942, 12746, 13147, 8936, 2902, 6971, 8551; Payload ID: 16766 relates to Category No.: 12746, 13147, 8936, 6971; Payload ID: 16767 relates to Category No.: 11607, 10181, 5777, 2083, 10923; Payload ID: 16768 relates to Category No.: 15626; Payload ID: 16769 relates to Category No.: 12091, 795, 13166, 14569, 15004, 12498, 360, 11858; Payload ID: 16770 relates to Category No.: 12091, 1752, 13166, 14569, 15004, 12498, 13105, 274, 14108, 1722, 360, 5541, 11291, 11922; Payload ID: 16771 relates to Category No.: 12091, 1752, 13166, 14569, 15004, 12498, 13105, 274, 14108, 1722, 360, 5541, 11922, 7966, 1764, 5912; Payload ID: 16773 relates to Category No.: 9500, 2675, 4152, 3639, 13874, 4775, 12453, 5866; Payload ID: 16774 relates to Category No.: 15618, 9500, 795, 1721, 1862, 12105, 2675, 4152, 15547; Payload ID: 16775 relates to Category No.: 9500, 4094, 2675, 4152, 5866; Payload ID: 16776 relates to Category No.: 6219, 9500, 15660, 6310, 1867, 14663, 15978; Payload ID: 16777 relates to Category No.: 6219, 9500, 15978; Payload ID: 16778 relates to Category No.: 15517, 15291, 4439, 7295, 7280, 7261, 5220, 7262, 9161; Payload ID: 16779 relates to Category No.: 14456, 1820, 991, 3147; Payload ID: 16780 relates to Category No.: 14565, 5446, 15456, 15450, 7363, 15448, 12754, 13228, 12498, 13860; Payload ID: 16783 relates to Category No.: 13259, 8739; Payload ID: 16789 relates to Category No.: 13589, 3398, 8760, 11546; Payload ID: 16790 relates to Category No.: 13589, 3398, 15490, 3398; Payload ID: 16793 relates to Category No.: 2206, 14867, 12683; Payload ID: 16795 relates to Category No.: 14945, 14910, 3692, 4969, 13343, 2604; Payload ID: 16796 relates to Category No.: 6219, 9500, 12063, 1893, 14663, 3405, 14972, 11660, 682, 3404, 3407, 10150; Payload ID: 16797 relates to Category No.: 13259, 11308, 13589, 3398, 15490, 3398, 795, 1730, 12498, 1780; Payload ID: 16798 relates to Category No.: 6814, 3781, 14865, 1893, 14663, 11660, 4145, 4729, 14963, 13969, 10372, 14643, 13836, 13981, 13983, 6103; Payload ID: 16799 relates to Category No.: 6219, 9500, 1730, 14533, 14663, 14972, 682, 14532, 6530, 13835, 2125, 2079, 13969, 13953, 13827, 13836, 6269, 13866, 14883, 14962, 5073, 13853, 1993, 1964, 2116, 2009, 1951, 5334, 2243, 15325, 3294, 14022, 1925, 16023, 1269, 13850, 684, 11761, 14509, 10034, 6523, 4135, 2470, 13697, 1961; Payload ID: 16800 relates to Category No.: 6219, 9500, 1730, 1816, 14663, 6530, 14972, 682, 684, 14962, 6523, 13967, 13969, 13827, 13970, 10006, 13981, 1219, 3231, 5073, 14011, 5334, 14022, 1269, 13850, 4135, 14963; Payload ID: 16801 relates to Category No.: 2355, 14663, 14962, 14972, 1354, 1867, 13511, 4515, 6530, 13967, 1984, 2079, 1295, 13969, 2041, 2131, 1970, 14025, 13827, 13836, 13966, 13837, 13815, 13767, 13236, 13970, 8373, 10006, 13870, 10648, 13863, 13981, 9423, 13904, 13887, 1219, 3231, 9791, 14011, 13853, 1910, 1988, 13961, 13916, 1901, 2013, 2046, 2469, 2009, 1951, 13877, 3294, 1925, 11087, 13779, 3932, 2011, 1974, 1186, 2470, 13697, 1961, 1994, 2054, 5532, 15301, 1920, 13917, 11760, 5768, 2359; Payload ID: 16802 relates to Category No.: 6814, 9950, 1867, 14663, 14962, 12041, 1186, 1189, 4102, 15979, 587, 11760, 14986, 10859, 5507, 11416, 6216, 9762; Payload ID: 16803 relates to Category No.: 2351, 2355, 2353, 16150, 6467, 2352, 2358, 10222, 6814; Payload ID: 16804 relates to Category No.: 6814, 2351, 2355, 2353, 16150, 6467, 5752, 2352; Payload ID: 16805 relates to Category No.: 6219, 13594, 11512, 6211, 14663, 2469, 13376, 13165, 13379, 2116, 11558, 8739, 13589, 3398, 11506, 3398, 5541, 8118, 12864, 13860, 12955, 10737, 10421, 13004, 13969, 13989, 496, 13827, 15517, 13981, 14000, 13797, 13858, 2009, 13851, 6375, 1969, 13923, 13843, 2355; Payload ID: 16806 relates to Category No.: 6219, 15490, 3398, 11512, 8739, 2355, 14663, 13165, 11294, 7793, 2029, 2116, 13074, 13929, 10426, 13589, 3398, 12697; Payload ID: 16807 relates to Category No.: 6219, 9500, 4104, 14663, 2347, 2349; Payload ID: 16808 relates to Category No.: 3354, 5965, 1737, 2167, 7154, 9274, 13743, 13729, 11298, 5750; Payload ID: 16809 relates to Category No.: 4949, 2562, 4132, 4067, 5949, 14086, 10005, 16211, 6102, 860, 4135, 1240, 6371, 6389, 3228, 6375, 4947, 3247, 472, 3576, 8919, 4065, 3194, 9121, 14697, 3493, 16136, 3519, 12236, 4946, 9573, 12233, 3572, 16042, 16241, 10270, 605; Payload ID: 16810 relates to Category No.: 3356, 6672, 15144, 14838, 6678, 12431, 13271, 2110, 9485, 4167, 9375, 4143, 6682; Payload ID: 16811 relates to Category No.: 8862; Payload ID: 16812 relates to Category No.: 15898, 12154, 11843, 12153, 11237, 3354, 8756, 12096, 11298, 11860, 15570, 11969, 7016, 15901, 3835, 12049, 2060, 10408, 12907, 8507, 3684, 11588; Payload ID: 16813 relates to Category No.: 11940, 7131, 10491, 13041, 11293, 11609, 10177, 12457; Payload ID: 16814 relates to Category No.: 1204, 14656, 7563; Payload ID: 16815 relates to Category No.: 15207, 1836, 7122, 12066, 7028, 5662, 11021, 7030, 1684, 572, 7077, 6218, 11015, 10328, 15005; Payload ID: 16816 relates to Category No.: 1204, 14565; Payload ID: 16817 relates to Category No.: 3639, 15521; Payload ID: 16818 relates to Category No.: 3639, 12798; Payload ID: 16819 relates to Category No.: 3639, 12798, 15156, 4969; Payload ID: 16820 relates to Category No.: 1417, 13514; Payload ID: 16821 relates to Category No.: 1737, 15490, 3398, 10372, 7154, 12891, 10648, 13161, 11174, 8004, 10638, 13164, 13597, 11176, 10465, 2074, 13155, 13425, 10574, 5458, 11266, 10349, 11152; Payload ID: 16822 relates to Category No.: 3564, 6625; Payload ID: 16823 relates to Category No.: 14661, 14565, 795, 5808, 15521, 7840, 8541, 11765, 4439, 6738, 8522, 13692, 5806, 3913, 11260, 10566, 12817, 5938, 14643, 8196, 12619, 12732, 10362, 5939, 11251, 5936; Payload ID: 16824 relates to Category No.: 13589, 3398, 1204; Payload ID: 16825 relates to Category No.: 15490, 3398, 8731, 3398, 12999, 2041, 2021, 6460, 2015, 2037; Payload ID: 16826 relates to Category No.: 12137, 1894, 3684, 10061, 1893, 14015, 5855, 11634, 14640, 4538, 11546, 10801, 7305, 7346, 10699, 11143, 11930; Payload ID: 16827 relates to Category No.: 12137; Payload ID: 16828 relates to Category No.: 14015; Payload ID: 16829 relates to Category No.: 2711, 12640; Payload ID: 16830 relates to Category No.: 12648, 1752, 2940; Payload ID: 16831 relates to Category No.: 16286, 6296, 7743, 1183, 3038; Payload ID: 16832 relates to Category No.: 11512, 8739, 8731, 3398, 8169, 13835; Payload ID: 16833 relates to Category No.: 1204; Payload ID: 16834 relates to Category No.: 1737, 7154, 1893, 7132, 12120, 2429, 11660, 15517, 11512; Payload ID: 16835 relates to Category No.: 1737, 7154, 6670, 14612, 1893, 7132, 12120, 11660, 7885, 15517, 14949, 11512; Payload ID: 16836 relates to Category No.: 15174, 15144, 12010; Payload ID: 16837 relates to Category No.: 4094, 1420, 13837, 16049, 2235, 16345; Payload ID: 16838 relates to Category No.: 11930, 7306, 12071, 1801, 2266, 12804; Payload ID: 16839 relates to Category No.: 7306, 12071, 1801, 2266, 12804, 12498, 13831, 2060, 3836; Payload ID: 16840 relates to Category No.: 363, 1417, 1238, 12573, 3121, 3615, 1651, 7417, 14997; Payload ID: 16841 relates to Category No.: 1415, 1836, 363, 10301; Payload ID: 16842 relates to Category No.: 1737, 13996, 3354, 7291, 16182, 7159, 14271, 7168, 7134, 14612, 1893, 4439, 7132, 2424, 12120, 11660, 7158, 6687, 14571, 7885, 14949; Payload ID: 16843 relates to Category No.: 2424, 6687, 14612; Payload ID: 16844 relates to Category No.: 7138, 1737, 7132, 2424, 6672, 6674, 5968; Payload ID: 16845 relates to Category No.: 1737, 14565, 3354, 7154, 7168, 12775, 14612, 1893, 7132, 2424, 12120, 11660, 7158, 6687, 7885, 14949; Payload ID: 16846 relates to Category No.: 1737, 7159, 7138, 7132, 2424, 6672, 6674, 5968; Payload ID: 16847 relates to Category No.: 1737, 3452, 1955, 7154, 11032, 1893, 12120, 11660, 2158, 15259, 10950, 10435; Payload ID: 16848 relates to Category No.: 1955, 3354, 1893, 12120, 11660, 2158, 15259, 10435; Payload ID: 16849 relates to Category No.: 2424, 3447, 5411; Payload ID: 16850 relates to Category No.: 13589, 3398, 15499, 2411, 15517, 3356, 3354, 4439, 16197, 11611; Payload ID: 16851 relates to Category No.: 11930, 12063, 1893, 11660, 2739; Payload ID: 16852 relates to Category No.: 11930, 3837, 4712, 12063, 14033, 11660, 2739; Payload ID: 16853 relates to Category No.: 5782, 16172, 16158, 16160; Payload ID: 16854 relates to Category No.: 13594, 13589, 3398, 15517, 11512, 14656; Payload ID: 16856 relates to Category No.: 1204; Payload ID: 16857 relates to Category No.: 5874, 7091; Payload ID: 16858 relates to Category No.: 11910, 7039, 15054, 7693, 12172, 7942; Payload ID: 16859 relates to Category No.: 12908; Payload ID: 16860 relates to Category No.: 5446; Payload ID: 16861 relates to Category No.: 8862, 9500, 15642, 13755, 1874, 14663, 3555, 15053; Payload ID: 16862 relates to Category No.: 9500, 15642, 13755, 1874, 14663, 486, 15053; Payload ID: 16863 relates to Category No.: 9500, 15642, 7039, 15054, 13755, 1874, 14663, 486; Payload ID: 16864 relates to Category No.: 15642, 13755, 1874, 14663; Payload ID: 16865 relates to Category No.: 4828, 1204; Payload ID: 16866 relates to Category No.: 6814, 15642, 1874, 14663, 15065, 15066, 15053; Payload ID: 16867 relates to Category No.: 6814, 9265, 15642, 1874, 14663, 15053, 15065; Payload ID: 16868 relates to Category No.: 6814, 15642, 1874, 14663, 15065; Payload ID: 16869 relates to Category No.: 6814; Payload ID: 16870 relates to Category No.: 1512, 14663, 10158; Payload ID: 16871 relates to Category No.: 6814, 795, 7737, 1269, 7598, 16085, 12877, 5949, 2374, 7924, 10286, 11620, 1622, 4490, 3612, 11595, 4494, 7986, 4482, 5465, 3865, 5006, 8501; Payload ID: 16872 relates to Category No.: 6814, 1269, 5949, 2374, 11620, 1622, 4490, 3612, 11595, 4494, 7986, 4482, 5465, 3865, 5006; Payload ID: 16873 relates to Category No.: 9500, 14865, 1893, 14663, 11660, 4729; Payload ID: 16874 relates to Category No.: 1893, 11660; Payload ID: 16875 relates to Category No.: 9500, 14663, 1878, 15089, 15088, 15079, 16037, 5303; Payload ID: 16876 relates to Category No.: 9500, 13975; Payload ID: 16877 relates to Category No.: 9500, 14663, 1878, 15089, 15088, 15079, 16037, 9041, 13966; Payload ID: 16878 relates to Category No.: 6814, 16308, 14663, 14972, 10606, 128, 15078, 3934, 4145; Payload ID: 16879 relates to Category No.: 16308, 1204, 14663, 14972, 128, 15090; Payload ID: 16880 relates to Category No.: 16308, 616, 14663, 1640, 128, 15078, 4214, 3934, 6814; Payload ID: 16881 relates to Category No.: 6814, 16308, 14663, 14972, 1640, 128, 15078, 9791, 615; Payload ID: 16882 relates to Category No.: 16308, 3684, 1893, 14663, 14972, 1640, 128, 15078, 5855, 4214, 6814; Payload ID: 16883 relates to Category No.: 14972, 1640, 6814; Payload ID: 16884 relates to Category No.: 16308, 14663, 14972, 128, 3791, 15078, 1833, 4214, 9791, 15407, 6814; Payload ID: 16885 relates to Category No.: 16308, 616, 14663, 128, 15078, 6814; Payload ID: 16886 relates to Category No.: 15090; Payload ID: 16887 relates to Category No.: 16308, 14663, 128, 15078; Payload ID: 16888 relates to Category No.: 16308, 3244, 1867, 14663, 14972, 128, 15078, 1187; Payload ID: 16889 relates to Category No.: 16308, 14663, 14972, 128, 15073; Payload ID: 16890 relates to Category No.: 6814; Payload ID: 16891 relates to Category No.: 12194, 11907; Payload ID: 16892 relates to Category No.: 6814, 10331, 12153, 1893, 12120, 11660, 11294, 1894; Payload ID: 16893 relates to Category No.: 12194, 334, 11512, 803, 1893, 12120, 11660, 11914, 8503, 12751; Payload ID: 16894 relates to Category No.: 12194, 1737, 1721, 1893, 12120, 11660, 11914; Payload ID: 16895 relates to Category No.: 12194, 12120, 13504, 13058, 11914, 12056; Payload ID: 16896 relates to Category No.: 12194; Payload ID: 16897 relates to Category No.: 12194, 12137, 16286, 13681, 4094, 1893, 7295, 11298, 12120, 11660, 8547, 11912, 11914, 11512, 4949, 14921, 5986, 7802, 8618, 12886, 7883, 14566, 15740, 12771, 11285, 3442, 8507, 13367; Payload ID: 16898 relates to Category No.: 12194, 11914; Payload ID: 16900 relates to Category No.: 7306, 9451, 11147, 10446, 12554; Payload ID: 16901 relates to Category No.: 7291, 16182, 14199, 6631; Payload ID: 16902 relates to Category No.: 10331, 9500, 14456, 10074, 10238, 6296, 1862, 4615, 345, 4948, 12942, 12544, 14838, 13700, 8373, 13360, 10036, 15113, 14057, 3566, 1238, 13161, 13787, 9740, 10080, 13827, 13867, 726, 13998, 13970, 15400, 13877, 7332, 10475, 1709, 12397, 15622, 7792, 13271, 9485, 13558, 14018, 7373, 14095, 11429, 13189, 13837, 5299, 8905, 13690, 991, 11158, 13975, 7613, 15110, 496, 13967, 13775, 13813, 2083, 13779, 2095, 13782, 1912, 1920, 13800; Payload ID: 16903 relates to Category No.: 9500, 15113, 11634, 4615, 13975, 5866, 7990, 5808, 793, 13161, 15110, 4949, 6269, 4998, 8928, 12544, 13998, 16102, 6296, 13877, 12603, 13856, 13787, 7122, 5814, 13767, 7971, 13755, 11111, 13692, 490, 3155, 16103, 3857, 13881, 13967, 13925, 11940, 7613, 13882, 13812, 496, 13827, 13794, 14054, 13883, 13996, 13934, 13829, 13915, 14004, 13933, 1966, 5301, 13910, 5299, 14005, 13700, 13594, 7743, 8373, 11941, 8431, 14018, 491, 9525; Payload ID: 16904 relates to Category No.: 13700, 9500, 15113, 13998, 13882, 13975, 13813; Payload ID: 16905 relates to Category No.: 2940, 10481, 14636; Payload ID: 16906 relates to Category No.: 11926, 11940, 8539, 2272; Payload ID: 16907 relates to Category No.: 12194, 5939, 8887, 3800; Payload ID: 16908 relates to Category No.: 13589, 3398, 15490, 3398, 8739; Payload ID: 16909 relates to Category No.: 10702, 10583; Payload ID: 16911 relates to Category No.: 7735; Payload ID: 16914 relates to Category No.: 13589, 3398, 15490, 3398, 14661, 7737, 8408, 8584; Payload ID: 16915 relates to Category No.: 5785, 12153, 2885, 5910, 8117, 7834, 8191, 5610, 5911, 13012, 15817, 13640, 13371, 8793, 1906, 4094, 13048, 12740, 12472, 13642, 13835, 13925, 13989, 13827, 13981, 13818, 9411; Payload ID: 16916 relates to Category No.: 5785, 12153, 2885, 7613, 2000, 13465, 12633, 5910, 11371, 8117, 8522, 7834, 8191, 13835, 4871, 5911; Payload ID: 16917 relates to Category No.: 5785, 12153, 2885, 7613, 5910, 12936, 8117, 7834, 8191, 5610, 5911, 13012, 15817, 13640, 13371, 8112, 1312, 12628, 10358, 8617, 10035, 15740, 14920, 13835, 13969, 13925, 13859, 13882, 13989, 496, 13867, 13874, 13888, 13827, 13981, 13818, 9411, 13851, 13788, 13856; Payload ID: 16918 relates to Category No.: 5785, 12153, 2885, 12936, 7834, 8191, 7934; Payload ID: 16919 relates to Category No.: 5785, 12153, 2885, 11237, 1746, 12936, 8617, 7834, 8191, 7934, 11479, 8710, 3775; Payload ID: 16920 relates to Category No.: 5785, 12153, 2885, 5910, 3012, 8522, 7834, 8191, 11830, 12936, 8677; Payload ID: 16921 relates to Category No.: 5785, 12153, 1204, 12936, 8617; Payload ID: 16922 relates to Category No.: 12194, 13589, 3398, 14565, 8739, 7306, 8421, 14640, 8611, 8639, 8737, 14643, 16136, 8887, 3176, 4952, 8640, 8548, 756, 2705, 2911, 14884, 14703, 14702; Payload ID: 16923 relates to Category No.: 5541, 12519, 8021; Payload ID: 16924 relates to Category No.: 5446; Payload ID: 16925 relates to Category No.: 5808, 8175, 4040; Payload ID: 16926 relates to Category No.: 15490, 3398, 14318, 1721, 1730, 8739, 8731, 3398, 1955, 5202, 2410, 4439, 16197, 12891, 3783, 8004, 3783, 2006, 7810, 2413, 5165, 5168, 14123, 5166; Payload ID: 16927 relates to Category No.: 15490, 3398, 1721, 1730, 8739, 2411, 8731, 3398, 5202, 2410, 2404, 2006, 7810, 5165, 5168, 14123, 6902; Payload ID: 16928 relates to Category No.: 13589, 3398, 15490, 3398, 7345, 5188, 5203; Payload ID: 16929 relates to Category No.: 13589, 3398, 15490, 3398, 5188, 5203; Payload ID: 16930 relates to Category No.: 1204; Payload ID: 16932 relates to Category No.: 1893; Payload ID: 16933 relates to Category No.: 6227, 13756, 1893; Payload ID: 16934 relates to Category No.: 13756, 1893; Payload ID: 16935 relates to Category No.: 6219, 10331, 14865, 13756, 1893, 9410; Payload ID: 16936 relates to Category No.: 13756, 1893; Payload ID: 16937 relates to Category No.: 12427, 5446, 3013, 13756, 12994, 1893, 12737, 11182, 12397, 6371, 8688, 15121, 6462, 8148; Payload ID: 16938 relates to Category No.: 9500, 486, 9506, 927, 13754, 5297; Payload ID: 16939 relates to Category No.: 1204; Payload ID: 16940 relates to Category No.: 4766, 11145; Payload ID: 16941 relates to Category No.: 14177; Payload ID: 16943 relates to Category No.: 14267, 7291, 16182, 14271, 4439; Payload ID: 16944 relates to Category No.: 7288, 14267, 14271; Payload ID: 16945 relates to Category No.: 7288, 795, 14913, 14271, 16183; Payload ID: 16946 relates to Category No.: 8862, 7288, 14915, 4439, 14913, 7546; Payload ID: 16947 relates to Category No.: 8862, 7288, 14915, 4439, 14913, 7546; Payload ID: 16949 relates to Category No.: 5367, 12427, 7732, 7726; Payload ID: 16951 relates to Category No.: 5446, 2610, 2488, 12724, 7823, 2488, 7823, 602; Payload ID: 16952 relates to Category No.: 1703, 9125; Payload ID: 16953 relates to Category No.: 1955, 1727; Payload ID: 16954 relates to Category No.: 1820; Payload ID: 16955 relates to Category No.: 1703; Payload ID: 16956 relates to Category No.: 1703, 1002, 13831, 10601, 9779, 7744; Payload ID: 16957 relates to Category No.: 690, 14589, 1767, 11431, 13313, 10368, 16242; Payload ID: 16958 relates to Category No.: 7613, 3320, 3353, 10362, 14199, 7121, 7064, 11023, 7100, 7067, 7066, 2408, 7104; Payload ID: 16960 relates to Category No.: 15490, 3398, 7730, 2410, 4439, 12891, 3783, 8004, 3783, 8739, 5226, 10372, 5203; Payload ID: 16961 relates to Category No.: 15618, 5846; Payload ID: 16962 relates to Category No.: 15618; Payload ID: 16963 relates to Category No.: 10486, 280, 13363, 12469, 5901, 8445, 7566, 10190, 10959, 14773, 7753; Payload ID: 16964 relates to Category No.: 15490, 3398, 952, 1295, 8929, 2411, 11506, 3398, 3370, 6814, 13222; Payload ID: 16965 relates to Category No.: 6814, 13589, 3398, 2411, 13594, 8862, 15490, 3398, 11512, 8739, 8731, 3398, 7743, 11506, 3398, 2410, 7735, 759, 14834; Payload ID: 16966 relates to Category No.: 13594, 8862, 13589, 3398, 15490, 3398, 11512, 952, 8739, 2411, 8731, 3398, 11506, 3398, 2410, 7735, 7997, 11363, 9276, 11620, 10180, 11224, 7597, 8886, 8742, 14834, 6814; Payload ID: 16967 relates to Category No.: 13594, 952, 2167, 2411, 3354, 3399, 5443, 9274, 3448, 4439, 12891, 3783, 8004, 3783, 9279, 2404; Payload ID: 16968 relates to Category No.: 13594, 1955, 3336, 13729, 3370; Payload ID: 16969 relates to Category No.: 2411, 1730, 3354, 7743, 7135, 13594, 8862, 15490, 3398, 11512, 952, 2410, 3328, 11363, 14591, 9276, 10180; Payload ID: 16970 relates to Category No.: 13594, 8862, 15490, 3398, 952, 2411, 11506, 3398, 2410, 9276, 11512, 9410, 5541, 8503, 11821; Payload ID: 16971 relates to Category No.: 13594, 15490, 3398, 952, 2411, 8731, 3398, 11506, 3398, 2410, 9276, 8739, 13603; Payload ID: 16972 relates to Category No.: 13594, 8862, 2411, 9276, 2416, 1969; Payload ID: 16973 relates to Category No.: 13594, 15490, 3398, 952, 2411, 9276; Payload ID: 16974 relates to Category No.: 13594, 15490, 3398, 2411, 11506, 3398, 1867, 14663, 9276, 8886, 11085, 13342, 4953, 7334, 14398, 1577, 11389, 10638; Payload ID: 16975 relates to Category No.: 13594, 952, 2411, 8731, 3398, 9276, 8906; Payload ID: 16976 relates to Category No.: 11940, 952, 2411, 9287, 2409, 11506, 3398, 2430, 5147, 12773, 3318, 5183; Payload ID: 16977 relates to Category No.: 3452, 2022; Payload ID: 16978 relates to Category No.: 3452, 11506, 3398, 1965; Payload ID: 16979 relates to Category No.: 3452, 12117; Payload ID: 16981 relates to Category No.: 7291, 16182, 5406, 3602, 4418, 7150, 10372; Payload ID: 16982 relates to Category No.: 1703, 7287, 11248; Payload ID: 16984 relates to Category No.: 14661, 14565, 13485, 337; Payload ID: 16985 relates to Category No.: 14661, 14565, 13485, 337; Payload ID: 16986 relates to Category No.: 5782, 13790, 11431, 15154; Payload ID: 16987 relates to Category No.: 13790; Payload ID: 16988 relates to Category No.: 6814, 8977, 15149, 13238, 13535; Payload ID: 16989 relates to Category No.: 6814, 8977; Payload ID: 16990 relates to Category No.: 6814, 8977, 13532, 4342; Payload ID: 16991 relates to Category No.: 1026, 14661, 14565, 10702, 8552, 5446, 6606, 348, 4186, 12942, 12391, 4127, 3775, 5541, 16085, 8988, 13530, 9599, 16213, 3038, 8373, 13105, 13084, 7640, 12405, 13527; Payload ID: 16992 relates to Category No.: 15618, 15626, 8979, 1836; Payload ID: 16993 relates to Category No.: 15618, 15626, 8979; Payload ID: 16994 relates to Category No.: 15618, 15626, 8979; Payload ID: 16995 relates to Category No.: 13464, 13084, 12122; Payload ID: 16997 relates to Category No.: 15042, 11557; Payload ID: 16999 relates to Category No.: 9861, 6102, 5500, 15163, 15156, 8979, 15167, 15168, 1295, 14000, 13818, 10654, 11316, 6814, 9858, 9815, 9945, 14663, 9862, 5501, 13537, 11442; Payload ID: 17000 relates to Category No.: 9861, 9858, 9945, 14663, 6814; Payload ID: 17001 relates to Category No.: 7946, 7598, 7924, 7923, 13257, 8651, 12798, 14108, 11313, 12122, 7575, 10202, 11273, 5772; Payload ID: 17002 relates to Category No.: 1737, 15174, 6688, 15176; Payload ID: 17003 relates to Category No.: 15174, 6688, 15176; Payload ID: 17004 relates to Category No.: 1737, 15174; Payload ID: 17005 relates to Category No.: 1737, 12431, 15174, 14838, 10238; Payload ID: 17006 relates to Category No.: 1737, 12431, 15174, 14838, 2315, 13363, 6681, 14818, 6067; Payload ID: 17007 relates to Category No.: 1737, 15174, 7613, 9410, 4167, 6532, 4144, 6524; Payload ID: 17009 relates to Category No.: 1737, 14834, 6535, 14838, 3969, 7154, 15144, 14838, 6687, 2315, 6681, 15174, 14818, 6067; Payload ID: 17010 relates to Category No.: 15626, 3639, 13464, 13236, 13084, 15160, 15162, 13268, 2080; Payload ID: 17011 relates to Category No.: 15626, 15149; Payload ID: 17012 relates to Category No.: 15626, 15042, 1836; Payload ID: 17013 relates to Category No.: 13515, 10190; Payload ID: 17016 relates to Category No.: 15626; Payload ID: 17017 relates to Category No.: 3986, 15158, 15163, 12137, 6733, 6738, 5081, 11646, 16167; Payload ID: 17018 relates to Category No.: 8977, 15149, 15158, 15163, 15157, 15155, 14663, 13004, 4581, 3728, 8981, 12839, 6323, 6296, 901, 13232; Payload ID: 17019 relates to Category No.: 12137, 3986, 15158, 6733, 15163, 2459, 1000, 16167; Payload ID: 17020 relates to Category No.: 3986, 15158, 15163, 6323; Payload ID: 17021 relates to Category No.: 15149, 2493, 12137, 12719, 3639; Payload ID: 17022 relates to Category No.: 14267, 8760, 7291, 16182, 14271, 16197, 2013, 9455, 2758, 2469, 8333, 11546; Payload ID: 17023 relates to Category No.: 11940, 8977, 15149, 12575, 15157, 1421, 13532, 4588, 12851, 15156, 4581, 3121, 10494, 11436, 4093, 13404, 1295, 13796, 11604, 6158, 10303; Payload ID: 17024 relates to Category No.: 12575, 15157, 1421, 15156, 10494; Payload ID: 17025 relates to Category No.: 12575, 15157, 1421, 1420, 10494, 13796, 11604; Payload ID: 17026 relates to Category No.: 12575, 15157, 1421, 10494, 8977, 1295, 8816, 7681; Payload ID: 17027 relates to Category No.: 12575, 15157, 1421, 13004, 10303; Payload ID: 17028 relates to Category No.: 15149, 12575, 15157, 1421, 14663, 15156, 13004, 3728; Payload ID: 17029 relates to Category No.: 12575, 15157, 1421, 263, 266; Payload ID: 17030 relates to Category No.: 12575, 15157, 1421, 10065, 13004, 10303; Payload ID: 17031 relates to Category No.: 15157, 1421, 15156, 266; Payload ID: 17032 relates to Category No.: 12575, 15157, 1421; Payload ID: 17033 relates to Category No.: 12575, 15157, 1421, 8379; Payload ID: 17034 relates to Category No.: 12575, 15157, 1421, 1422; Payload ID: 17035 relates to Category No.: 15157, 1421, 16172; Payload ID: 17036 relates to Category No.: 15157; Payload ID: 17037 relates to Category No.: 12575, 15157, 1421; Payload ID: 17038 relates to Category No.: 15157; Payload ID: 17039 relates to Category No.: 12575, 15157, 1421, 10494; Payload ID: 17040 relates to Category No.: 12575, 15157, 1421; Payload ID: 17041 relates to Category No.: 5782, 12575, 15157, 1421, 3986; Payload ID: 17042 relates to Category No.: 15157, 5782, 16159, 16172, 3986, 8454, 12041, 11050; Payload ID: 17043 relates to Category No.: 5782, 12575, 15157, 1421; Payload ID: 17044 relates to Category No.: 5782, 12575, 15157, 1421, 10593, 7326, 11290, 8118, 3986; Payload ID: 17045 relates to Category No.: 5782, 12575, 15157, 1421, 3986; Payload ID: 17046 relates to Category No.: 5734; Payload ID: 17047 relates to Category No.: 3986; Payload ID: 17048 relates to Category No.: 1512, 1752, 4721, 6253, 14663, 4021, 4723, 14086, 4722, 10005, 16211, 2385, 10595, 10596, 7380, 15010, 16294, 1483, 5428, 13859, 14025, 13796, 13970, 13797, 13877, 9320, 16005, 14520; Payload ID: 17049 relates to Category No.: 1026, 1512, 3766, 1752, 4721, 1204, 14663, 4021, 3041, 12754, 4723, 14086, 4722, 10005, 16211, 2385, 1205, 13882, 16294, 13795; Payload ID: 17050 relates to Category No.: 1752, 1512, 4721, 14663, 4021, 4723, 14086, 4722, 10005, 16211, 2385, 1703; Payload ID: 17051 relates to Category No.: 1512, 1752, 4721, 14663, 4021, 4723, 14086, 4722, 10005, 16211, 2385, 10595, 10596, 8887, 16294, 5462, 12879, 11418, 16005, 11265, 10629; Payload ID: 17052 relates to Category No.: 1026, 5785, 3766, 15149, 274, 12126, 15045, 1740, 10878, 11201, 10595, 10596, 12391; Payload ID: 17053 relates to Category No.: 8862, 5785, 5788; Payload ID: 17054 relates to Category No.: 5731; Payload ID: 17055 relates to Category No.: 5782, 3639; Payload ID: 17057 relates to Category No.: 12154, 11926, 12153, 3684, 3837, 12063, 14096, 3829, 1893, 12117, 11660, 11967, 5855, 7915, 3835; Payload ID: 17058 relates to Category No.: 15490, 3398, 2409, 11506, 3398, 3038, 10495, 12753; Payload ID: 17060 relates to Category No.: 15490, 3398, 11512, 13827, 6969, 5785, 2940, 3766, 1764, 8954; Payload ID: 17061 relates to Category No.: 13589, 3398, 15490, 3398, 8408; Payload ID: 17062 relates to Category No.: 13589, 3398, 15490, 3398, 8408; Payload ID: 17063 relates to Category No.: 1703, 2459, 2198, 5794, 12642, 13392; Payload ID: 17064 relates to Category No.: 13589, 3398, 15490, 3398, 8408; Payload ID: 17065 relates to Category No.: 13589, 3398, 15490, 3398, 8408; Payload ID: 17066 relates to Category No.: 13589, 3398, 15490, 3398, 8408; Payload ID: 17067 relates to Category No.: 13589, 3398, 15490, 3398, 8408; Payload ID: 17068 relates to Category No.: 13589, 3398, 15490, 3398, 8408; Payload ID: 17069 relates to Category No.: 13589, 3398, 15490, 3398, 8408; Payload ID: 17070 relates to Category No.: 13005; Payload ID: 17071 relates to Category No.: 8977, 15155, 1295, 8929; Payload ID: 17072 relates to Category No.: 5782, 16172, 4785, 16160, 14097, 3698, 13363; Payload ID: 17073 relates to Category No.: 5782, 16172, 3986, 15158, 16158, 6733, 9002, 7540, 7536, 15200, 2951; Payload ID: 17074 relates to Category No.: 5782, 16172, 16158, 2351, 16160, 12117; Payload ID: 17075 relates to Category No.: 5782, 16172, 16158, 16160, 14097, 3698, 4768; Payload ID: 17076 relates to Category No.: 5782, 16172, 16158, 3833, 16160, 4766, 12043, 1000, 3687; Payload ID: 17077 relates to Category No.: 5782, 6733, 14098, 4771, 3675, 12928, 10579, 11144; Payload ID: 17078 relates to Category No.: 5782, 16172, 3986, 15158, 16158; Payload ID: 17079 relates to Category No.: 5782, 8977, 16172, 15149, 3986, 15158, 16158, 10303, 1893, 14663, 13004, 4581, 3728, 14404, 10332, 11124, 1420, 10590, 13538, 11097, 12851, 10593, 13864, 15155; Payload ID: 17080 relates to Category No.: 5782, 16172, 3986, 15158, 16158, 12891, 15155, 11097, 10590, 13538, 14923, 12137, 12851; Payload ID: 17081 relates to Category No.: 5782, 14565, 16172, 3986, 15158, 16158, 266, 12066, 9410, 3532, 12543, 13878, 2702, 1730, 3791, 6990, 3247; Payload ID: 17082 relates to Category No.: 5782, 16172, 10372, 3986, 15158, 16158, 15155, 8936, 10343, 10419, 11273, 11276, 6323, 6733; Payload ID: 17083 relates to Category No.: 5782, 16172, 3986, 15158, 16158, 10331, 10074, 10372, 12851, 10366, 6738, 1238, 10802, 11646, 10343, 12858, 10419, 10588, 6323, 11273, 10787, 13878, 10562, 11276, 9415, 14708; Payload ID: 17084 relates to Category No.: 5782, 16172, 16158, 3833, 14097, 3698, 12063, 2669, 16160, 1893, 6738, 3524, 11660, 11243, 4761, 12928, 16161; Payload ID: 17085 relates to Category No.: 5782, 16172, 4785, 14097, 3698, 16160, 4768, 13363, 3697, 12666; Payload ID: 17086 relates to Category No.: 5782, 16172, 16158, 16160, 11456, 9417, 9413, 11314, 13366; Payload ID: 17087 relates to Category No.: 15626, 5782, 16160, 3525, 13366, 16172, 3699; Payload ID: 17088 relates to Category No.: 16159, 16172, 12137, 8977, 15149, 14663, 12041, 13004, 13494, 10080, 10075, 4581, 3728, 15160, 13536, 13538, 1032, 8672, 4342, 8922, 8373, 3986, 10303, 6299, 12117, 10593; Payload ID: 17089 relates to Category No.: 16159, 16172, 12137, 13110, 9002, 6143, 3986; Payload ID: 17090 relates to Category No.: 16159, 16172, 10074, 6738, 1238, 9002, 10075, 7681, 5544, 13888, 1295, 3986, 4541, 12134, 11934; Payload ID: 17091 relates to Category No.: 1955, 12117, 13005, 10883, 10352, 5541, 4541, 12122; Payload ID: 17092 relates to Category No.: 12137, 10702, 16172, 12891, 12851, 13373, 10593, 12543, 3986; Payload ID: 17093 relates to Category No.: 12137, 10702, 16172, 3986, 12851, 13373, 4535, 8118, 11290; Payload ID: 17094 relates to Category No.: 16172, 3986, 13494, 3984, 4775, 7961; Payload ID: 17095 relates to Category No.: 7340, 12953, 13664, 8443, 16129, 13495, 8918, 13660; Payload ID: 17096 relates to Category No.: 7340; Payload ID: 17098 relates to Category No.: 1714, 7131, 10491; Payload ID: 17099 relates to Category No.: 2169; Payload ID: 17100 relates to Category No.: 334, 9500, 7613, 8739, 10238, 8072, 7840, 1893, 15156, 13925, 2083, 12781, 13892, 11291, 11174, 13893, 8772, 10543, 11323, 8478, 4012, 12409, 11315, 8301, 7961, 1939, 11912, 3425, 13932, 6952, 1961, 13907, 8616, 13307, 8330, 3434, 7895, 8401, 10797, 8713, 8307, 7508, 10678, 10768, 13539, 13396, 15149, 13827, 15143, 483, 13080, 13236, 6323, 9945, 15149, 3436, 3428, 8373, 13238, 13397, 3971, 13084, 6738, 11436, 7063, 4110, 7027, 15167, 8995, 13096, 11097, 12916, 12476, 1970, 496, 13811, 8535, 1114, 13228, 7892; Payload ID: 17101 relates to Category No.: 1727, 3428, 13238, 12998; Payload ID: 17102 relates to Category No.: 7710, 15149, 15143, 3428, 8373; Payload ID: 17103 relates to Category No.: 15149, 15143, 483, 13238, 12781, 12105; Payload ID: 17104 relates to Category No.: 12124, 4770, 4774; Payload ID: 17105 relates to Category No.: 12124, 4770, 4774; Payload ID: 17106 relates to Category No.: 13589, 3398, 15490, 3398, 14565, 8739, 11740, 722, 3563, 4953, 11526, 6795, 13594, 11512, 16096, 674, 724, 8887, 10372, 14793, 8883, 6797, 11628, 14656, 1274, 1483, 14577, 1257, 13737, 3612, 9129, 9610, 9130, 3172, 2110; Payload ID: 17108 relates to Category No.: 5255, 5037, 10826, 1789, 8141, 8677; Payload ID: 17211 relates to Category No.: 15207, 14565, 5446, 403, 4186, 9891, 4127, 3775, 11461, 8988, 1849, 10307, 8561, 8771; Payload ID: 17313 relates to Category No.: 8962, 15214, 4145; Payload ID: 17314 relates to Category No.: 5428, 1816, 15214, 12544, 10486, 11350; Payload ID: 17315 relates to Category No.: 4828, 5428, 8962, 15149, 1795, 15214, 11392, 9932, 3117, 13978, 13647, 13835, 13969, 13977, 13989, 13867, 13874, 13837, 10486, 11601, 10762, 11418, 11325, 11146, 12544, 13951, 6322, 13961, 13829, 6103, 10904, 10573, 13786, 11598, 10282, 10574, 3529, 901, 10934, 379, 10195, 1119, 11436, 2370, 9381, 11593, 704, 14822, 11436, 4342, 11350, 495, 13488, 13489, 14694; Payload ID: 17316 relates to Category No.: 4828, 15214, 8962, 15149, 1795, 11392, 7340, 3973, 13647, 5761, 13829, 11598, 8233, 9381, 11593, 11770, 10184, 8968, 10870; Payload ID: 17317 relates to Category No.: 4828, 15214, 13835, 496, 13811, 13951, 5328, 10282, 12868, 10710, 11593, 12779; Payload ID: 17318 relates to Category No.: 5428, 8962, 15149, 5446, 1816, 15214, 729, 3016, 734, 10486, 3015, 14053, 5533, 3117, 14454, 13978, 2068, 13925, 10203, 13874, 11418, 11325, 11146, 12544, 13951, 6322, 10573, 901, 10934, 10195, 11436, 2370, 8057, 10454, 11436, 4342, 11350; Payload ID: 17319 relates to Category No.: 12091, 13594, 5095, 13589, 3398, 15499, 15517, 3399, 5443, 11506, 3398, 15521, 4439, 16197, 6532; Payload ID: 17320 relates to Category No.: 5095, 13589, 3398, 15499, 11512, 1721, 11237, 1955, 15517, 9713, 3399, 5443, 14257, 15521, 4439, 16197, 11858, 9716, 11531; Payload ID: 17321 relates to Category No.: 13589, 3398, 15499, 11940, 15517, 3399, 5443, 5127, 15521, 2410, 4439, 16197, 5146; Payload ID: 17322 relates to Category No.: 13589, 3398, 15499, 15517, 14257, 15521, 4439, 16197, 10180; Payload ID: 17323 relates to Category No.: 15499, 15517, 3399, 5443, 13259, 15521, 2410, 4439, 16197, 5146, 11363; Payload ID: 17324 relates to Category No.: 13594, 15499, 15517, 3399, 5443, 13523, 15521, 4439, 16197; Payload ID: 17325 relates to Category No.: 11506, 3398; Payload ID: 17326 relates to Category No.: 12194, 15499, 11512, 15517, 14257, 15521, 4439, 16197, 4336, 13969; Payload ID: 17327 relates to Category No.: 15499, 8739, 15517, 15521, 4439, 16197, 8611, 6508; Payload ID: 17328 relates to Category No.: 3399, 5443, 13589, 3398; Payload ID: 17329 relates to Category No.: 13589, 3398, 15499, 15517, 3399, 5443, 14838, 15521, 4439, 16197, 9379, 11414; Payload ID: 17330 relates to Category No.: 5095, 13589, 3398, 15499, 15517, 3399, 5443, 2409, 15521, 4439, 16197; Payload ID: 17331 relates to Category No.: 13589, 3398, 15517, 2410, 5146; Payload ID: 17332 relates to Category No.: 3399, 5443, 13589, 3398, 15499, 15517, 7743, 15521, 4439, 16197, 7724, 13460; Payload ID: 17333 relates to Category No.: 13594, 2411, 3399, 5443, 2410, 5146, 13460; Payload ID: 17334 relates to Category No.: 11512, 8739, 8731, 3398, 15517, 3399, 5443, 14257, 8072, 15521, 8522, 14850, 13594, 5773; Payload ID: 17335 relates to Category No.: 13594, 1730, 7306, 14257, 14838, 15521, 1204; Payload ID: 17336 relates to Category No.: 15490, 3398, 1730, 11506, 3398, 6508, 12861, 5453; Payload ID: 17337 relates to Category No.: 15499, 11512, 7613, 1955, 15517, 3399, 5443, 15521, 2410, 4439, 16197, 5146, 12117, 10362, 8503, 13893, 8178, 11330; Payload ID: 17338 relates to Category No.: 15499, 7613, 8739, 15517, 3399, 5443, 15521, 4439, 16197, 12117, 10362, 8178; Payload ID: 17339 relates to Category No.: 6814, 1592, 4998, 4949, 1567, 9945, 14663, 7340, 7027, 7088, 4653, 1562, 14636, 1594, 2768; Payload ID: 17340 relates to Category No.: 1026, 1703, 10074, 3684, 2933, 1893, 16197, 1238, 7340, 10080, 10075, 1812, 7252, 5855, 1825, 2711; Payload ID: 17341 relates to Category No.: 1703, 2933, 1812; Payload ID: 17342 relates to Category No.: 1694, 1594; Payload ID: 17343 relates to Category No.: 12891, 12543; Payload ID: 17344 relates to Category No.: 12091, 11512, 5428, 14038, 5446, 5359, 9713, 3021, 10775, 16197, 8789, 15456, 15450, 7363, 15448, 11573, 11174, 10808, 10811, 15653, 13228, 15814, 8004, 3016, 11624, 10810, 339, 3051; Payload ID: 17345 relates to Category No.: 9224, 4439, 9223, 3001, 15261; Payload ID: 17346 relates to Category No.: 6814, 16286, 14894, 11468, 1737, 11851, 12137, 11512, 9713, 7154, 12096, 7168, 10314, 7295, 7879, 9716, 13567, 12010, 15269, 12092, 11857; Payload ID: 17347 relates to Category No.: 11851, 16286, 12096, 10314, 11468, 12010, 15269, 11857, 7303, 13189; Payload ID: 17348 relates to Category No.: 12091, 6606, 348, 13166, 14569, 15004, 12498, 14661, 1955, 3354, 12746, 3974, 7132, 10878, 11419, 4335; Payload ID: 17349 relates to Category No.: 12091, 795, 12648, 1752, 1955, 12633, 348, 13166, 12498, 274, 12126, 14015, 10878, 15003, 4229, 11419, 4335; Payload ID: 17350 relates to Category No.: 12091, 1955, 6606, 348, 15004, 12498, 3354, 10878, 11858, 7834, 8192, 7150, 11419, 10879; Payload ID: 17351 relates to Category No.: 738, 5367, 746, 9642, 14098, 4771, 11884, 742, 15223, 742, 612, 9626; Payload ID: 17352 relates to Category No.: 5376, 7605; Payload ID: 17353 relates to Category No.: 14456; Payload ID: 17354 relates to Category No.: 13594, 14267, 15708; Payload ID: 17355 relates to Category No.: 11756, 11697, 7012, 13674, 4439, 8522, 14610, 11607, 4442, 11754, 7861, 15225, 7303, 14834, 11546, 14586; Payload ID: 17356 relates to Category No.: 7288, 12619, 14271, 8004, 8535, 7560, 137, 9171, 9177, 15517, 11512, 13831, 10801; Payload ID: 17357 relates to Category No.: 14216, 3994; Payload ID: 17358 relates to Category No.: 5782, 14565, 360, 8320, 11240, 15899; Payload ID: 17359 relates to Category No.: 5782, 14565, 8320; Payload ID: 17360 relates to Category No.: 5782, 12137, 3691, 3639; Payload ID: 17361 relates to Category No.: 12194, 11506, 3398, 6814; Payload ID: 17362 relates to Category No.: 4828, 14462, 3130; Payload ID: 17363 relates to Category No.: 4828, 10481, 14458, 3129; Payload ID: 17364 relates to Category No.: 4828, 14458, 14462, 3129; Payload ID: 17365 relates to Category No.: 4828, 14459, 3125, 2310; Payload ID: 17366 relates to Category No.: 4828, 14459, 3125; Payload ID: 17367 relates to Category No.: 4828, 14459, 3125, 10481; Payload ID: 17368 relates to Category No.: 4828, 14459, 3125; Payload ID: 17369 relates to Category No.: 4828, 14459, 3125; Payload ID: 17370 relates to Category No.: 4828, 14459; Payload ID: 17371 relates to Category No.: 4828, 14459; Payload ID: 17372 relates to Category No.: 4828, 14565, 14459, 3125; Payload ID: 17373 relates to Category No.: 4828, 14459, 3125; Payload ID: 17374 relates to Category No.: 4828, 14459, 3125; Payload ID: 17375 relates to Category No.: 4828, 14459, 3125; Payload ID: 17376 relates to Category No.: 4828, 14459, 3125; Payload ID: 17377 relates to Category No.: 4828, 14565, 14459, 3125, 13756; Payload ID: 17378 relates to Category No.: 4828, 14459, 3125; Payload ID: 17379 relates to Category No.: 4828, 14459; Payload ID: 17380 relates to Category No.: 4828, 14459; Payload ID: 17381 relates to Category No.: 4828, 14459, 3125; Payload ID: 17382 relates to Category No.: 4828, 14459, 3125; Payload ID: 17383 relates to Category No.: 4828, 14565, 14459, 3125, 2310; Payload ID: 17384 relates to Category No.: 4828, 14459, 3125; Payload ID: 17385 relates to Category No.: 4828, 14459, 14450; Payload ID: 17386 relates to Category No.: 4828, 14459, 3125; Payload ID: 17387 relates to Category No.: 4828, 14459, 3125; Payload ID: 17388 relates to Category No.: 4828, 14459, 1204, 3130; Payload ID: 17389 relates to Category No.: 3399, 5443, 15499, 15516, 15518, 15517, 15521, 4439, 16197, 12891, 3783, 8004, 3783, 15520, 15498, 15290, 2413, 14838, 11506, 3398; Payload ID: 17390 relates to Category No.: 15516, 15517, 4439, 12891, 3783, 8004, 3783, 15520, 15498, 15290, 2413; Payload ID: 17391 relates to Category No.: 15490, 3398, 15516, 4439, 12891, 3783, 8004, 3783, 15520, 15498, 15290, 2413, 14228; Payload ID: 17392 relates to Category No.: 15516, 15517, 4439, 12891, 3783, 8004, 3783, 15520, 15498, 15290, 2413; Payload ID: 17393 relates to Category No.: 13589, 3398, 15516, 4439, 12891, 3783, 8004, 3783, 15520, 15498, 15290, 2413; Payload ID: 17394 relates to Category No.: 7306, 3399, 5443, 8731, 3398; Payload ID: 17395 relates to Category No.: 13589, 3398, 13337, 15517, 3013, 10475, 7613, 6530, 264, 14836, 8004, 14834, 2079, 14831, 6393, 6163, 11473; Payload ID: 17396 relates to Category No.: 3305, 9228; Payload ID: 17397 relates to Category No.: 9228, 3684, 3305, 1893, 5855; Payload ID: 17398 relates to Category No.: 9228, 3305; Payload ID: 17399 relates to Category No.: 12091, 12648, 9713, 15042; Payload ID: 17400 relates to Category No.: 12091, 12648, 9713, 14699, 2459, 9420; Payload ID: 17401 relates to Category No.: 795, 5446, 1795, 15782, 8390, 8789, 13635, 7613; Payload ID: 17402 relates to Category No.: 14661, 16286, 337, 14108, 13681, 8831, 8526, 7743; Payload ID: 17403 relates to Category No.: 3986, 1780, 7131, 1053; Payload ID: 17405 relates to Category No.: 13589, 3398, 15490, 3398, 1721, 12619, 12553, 12625; Payload ID: 17408 relates to Category No.: 10702, 6738, 13363; Payload ID: 17409 relates to Category No.: 12091; Payload ID: 17410 relates to Category No.: 10702, 14097, 3698, 11300, 333; Payload ID: 17411 relates to Category No.: 10702, 12942, 14097, 3698; Payload ID: 17412 relates to Category No.: 10702, 14097, 3698, 7946, 7641, 8388; Payload ID: 17413 relates to Category No.: 10702; Payload ID: 17414 relates to Category No.: 10702; Payload ID: 17415 relates to Category No.: 10702, 7635, 12517, 12441; Payload ID: 17416 relates to Category No.: 10702, 12942; Payload ID: 17417 relates to Category No.: 10702; Payload ID: 17418 relates to Category No.: 12137, 1002, 10702, 14097, 3698; Payload ID: 17419 relates to Category No.: 10702; Payload ID: 17420 relates to Category No.: 10702; Payload ID: 17421 relates to Category No.: 10702, 3833, 16202, 4766, 10177, 10181, 1599, 10579, 1463, 6530, 264, 14838, 6111, 14442, 6223, 6115; Payload ID: 17422 relates to Category No.: 10702; Payload ID: 17423 relates to Category No.: 10702; Payload ID: 17424 relates to Category No.: 10702; Payload ID: 17425 relates to Category No.: 13634, 10851, 12999; Payload ID: 17426 relates to Category No.: 10702, 8936; Payload ID: 17427 relates to Category No.: 1002, 10702, 12518; Payload ID: 17428 relates to Category No.: 13589, 3398, 15490, 3398; Payload ID: 17431 relates to Category No.: 10702; Payload ID: 17432 relates to Category No.: 10702; Payload ID: 17433 relates to Category No.: 10702, 7809; Payload ID: 17435 relates to Category No.: 3176, 14056, 1463, 2460, 4949, 3578, 6111, 14699, 14700, 8888, 12013, 14072; Payload ID: 17436 relates to Category No.: 10702; Payload ID: 17437 relates to Category No.: 10702; Payload ID: 17438 relates to Category No.: 10702; Payload ID: 17439 relates to Category No.: 10702; Payload ID: 17440 relates to Category No.: 10702; Payload ID: 17441 relates to Category No.: 10702; Payload ID: 17442 relates to Category No.: 10702; Payload ID: 17443 relates to Category No.: 10702; Payload ID: 17444 relates to Category No.: 10702; Payload ID: 17445 relates to Category No.: 10702; Payload ID: 17446 relates to Category No.: 10702, 16172, 6738, 2009, 8816; Payload ID: 17447 relates to Category No.: 12137, 10702, 14009, 14097, 3698, 11313, 10256, 7131; Payload ID: 17448 relates to Category No.: 8728, 337, 11298, 13865, 7809; Payload ID: 17449 relates to Category No.: 10702, 10372, 1237; Payload ID: 17450 relates to Category No.: 10702; Payload ID: 17451 relates to Category No.: 10702; Payload ID: 17452 relates to Category No.: 10702; Payload ID: 17453 relates to Category No.: 1764, 12638, 12648, 2940, 6495, 6488; Payload ID: 17454 relates to Category No.: 5446; Payload ID: 17455 relates to Category No.: 13594, 690, 13589, 3398, 15490, 3398, 11512, 14456, 10372, 7730, 9321, 4949, 11506, 3398, 3575, 7345, 1780, 11285, 3176, 3520, 9786, 14083, 14729, 8869, 4067, 10955, 1744, 9599, 3791, 15402, 15400, 14768, 9480, 2110, 1970, 860, 4953, 6795, 10574, 1240, 6404, 10983, 9481, 724, 16071, 757, 5459, 9476, 7001, 7335, 15460, 1249, 7346, 3614, 14439, 9580, 7352, 2704, 3615, 2548, 6771, 13272, 11500, 8276, 9467, 11358, 1250; Payload ID: 17456 relates to Category No.: 13594, 13589, 3398, 15490, 3398, 674; Payload ID: 17457 relates to Category No.: 13589, 3398, 15490, 3398, 8739, 3613, 3575; Payload ID: 17458 relates to Category No.: 13589, 3398, 15490, 3398, 8739, 7696, 1730, 722, 673, 10574, 2548, 14793, 14456, 15999, 10983, 14688, 7243, 10379, 14606, 10984; Payload ID: 17459 relates to Category No.: 13594, 13589, 3398, 15490, 3398, 674, 12646, 11512, 1741, 10034, 12628; Payload ID: 17460 relates to Category No.: 13589, 3398, 15490, 3398, 8739, 10372, 8731, 3398, 1567, 3587, 12948, 9787, 9480, 4952, 3578, 1709, 2158, 9481, 757, 10321, 3573, 3622, 13604, 973, 7336, 8056, 7697, 9540, 4953, 9125, 6570, 3195; Payload ID: 17461 relates to Category No.: 13589, 3398, 8739, 8731, 3398, 9723, 3445, 4952, 1570, 9481, 10321, 3642, 3622, 1579, 761, 1578, 12235, 3621, 968, 1546, 3591, 15650, 16208, 4247, 6073, 12237, 15517, 11512, 8934, 11506, 3398, 9480, 1780, 3587, 7340, 9600, 1237, 8628, 760, 3588; Payload ID: 17462 relates to Category No.: 13589, 3398, 15490, 3398, 14038, 7306, 11506, 3398, 6414, 12994, 10876, 2080, 15194; Payload ID: 17463 relates to Category No.: 13589, 3398, 15490, 3398, 8739, 8731, 3398, 7306; Payload ID: 17464 relates to Category No.: 13594, 13589, 3398, 15490, 3398, 7613, 8739, 10372, 8731, 3398, 14640, 6559, 8352, 3584, 3578, 9410, 1709, 722, 3563, 6523, 4135, 6393, 4264, 10349, 4242, 6798, 2158, 14949, 12646, 5406, 11506, 3398, 9480, 4952, 1240, 3587, 9540, 4953, 1557, 6194, 11414, 16137, 3594, 1313, 1558, 7937, 14808, 6570, 972, 6195, 14604; Payload ID: 17465 relates to Category No.: 13589, 3398, 15490, 3398, 7306, 6194, 14641, 690, 6375, 7242, 3595; Payload ID: 17466 relates to Category No.: 13589, 3398, 11512, 1816, 4949, 7743, 11506, 3398, 7737, 15521, 4439, 9722, 3595, 3584, 7942, 4264, 7701, 1550, 16136, 10327, 1756, 12847, 15517, 9599, 11358, 6375, 979, 967, 7242, 1557, 3620, 16132, 10321, 968, 1346, 15536; Payload ID: 17467 relates to Category No.: 13589, 3398, 15490, 3398, 8739, 674, 6795, 11512, 8378, 14791, 6796, 1744, 14577, 8376; Payload ID: 17468 relates to Category No.: 13589, 3398, 15490, 3398, 1295, 11512, 12891, 8929, 5066, 13232, 2638, 2602, 14807, 659, 12524; Payload ID: 17469 relates to Category No.: 3399, 5443, 13589, 3398, 15517, 264, 14836, 3490; Payload ID: 17470 relates to Category No.: 2079, 11243, 8004, 16096, 5949, 11634, 4998, 10093, 9540, 14641, 11851, 4138, 4067, 14697, 684, 3934, 9068, 7311, 6814; Payload ID: 17471 relates to Category No.: 14661, 14565, 10702, 13485; Payload ID: 17472 relates to Category No.: 13594, 15490, 3398, 11512, 4998, 1741, 3854, 6667, 11506, 3398, 10359, 11245, 11027, 10586, 3592, 1103, 10431, 8739, 12646, 8929, 7372, 690, 3023, 10086, 6666, 6296, 4970, 14882, 4446, 13509, 3856, 13202, 910, 4968, 13111; Payload ID: 17473 relates to Category No.: 13594, 15490, 3398, 7303, 11634, 6995, 15325; Payload ID: 17475 relates to Category No.: 13589, 3398, 15517, 11512, 1741, 8929, 10372, 14910, 2169, 9407; Payload ID: 17476 relates to Category No.: 13589, 3398, 15490, 3398, 1204, 6796, 7864, 3737; Payload ID: 17477 relates to Category No.: 13589, 3398, 8934, 8375, 8932, 8929, 2169, 1744, 13756, 13417; Payload ID: 17479 relates to Category No.: 7306, 14949, 8004, 13509; Payload ID: 17481 relates to Category No.: 1026, 14661, 5785, 14565, 10702, 13435, 3766, 1752, 10238, 1820, 803, 13485, 8988, 12365, 10261, 10366, 8937, 13811, 11094, 795, 10503, 1564, 10879, 13005, 12832, 12026, 337, 11353; Payload ID: 17482 relates to Category No.: 14661, 5785, 14565, 10702, 13435, 10238, 803, 13485, 1867, 14663, 8988; Payload ID: 17483 relates to Category No.: 15618, 12197, 934, 5846, 10372, 1862, 931, 5541, 16055, 16060, 15547, 9783, 1849; Payload ID: 17484 relates to Category No.: 13589, 3398, 15490, 3398, 3354, 803, 3353, 6530, 10238; Payload ID: 17485 relates to Category No.: 11926, 1893, 15768, 2994, 15471, 1202, 15607, 13097; Payload ID: 17487 relates to Category No.: 15490, 3398, 8739; Payload ID: 17490 relates to Category No.: 1730, 7306, 14838; Payload ID: 17494 relates to Category No.: 6814, 15626; Payload ID: 17498 relates to Category No.: 9301; Payload ID: 17499 relates to Category No.: 13589, 3398, 5072, 15517, 12646, 11512, 9584, 4949, 2110, 11291, 9129, 3591, 15581, 11413, 6072, 15521, 4439; Payload ID: 17500 relates to Category No.: 13589, 3398, 15521, 4439, 5072, 11512, 16096, 8887, 9584, 2110, 7728, 9129, 3591, 6072, 13507; Payload ID: 17501 relates to Category No.: 13589, 3398, 5072, 13594, 11512, 15521, 4439, 4145, 11413; Payload ID: 17502 relates to Category No.: 13589, 3398, 5072, 15490, 3398, 13594, 7345, 14640, 15521, 4439, 10491; Payload ID: 17503 relates to Category No.: 13589, 3398, 15490, 3398, 724, 7001, 14768, 12891; Payload ID: 17504 relates to Category No.: 13589, 3398, 15490, 3398, 7306, 12891; Payload ID: 17505 relates to Category No.: 15490, 3398, 8731, 3398, 7306, 13417; Payload ID: 17506 relates to Category No.: 12091, 5785, 15207, 9720, 1070, 1730, 15614, 9717, 5446, 403, 5592, 12646, 4127, 15427, 11178, 13319; Payload ID: 17507 relates to Category No.: 2460, 9420, 5406, 8889, 15247, 13492, 3444, 14777, 2170; Payload ID: 17508 relates to Category No.: 14699, 2460, 2459, 9420; Payload ID: 17509 relates to Category No.: 795, 14699, 2460, 9420; Payload ID: 17510 relates to Category No.: 1002, 1000; Payload ID: 17511 relates to Category No.: 1002; Payload ID: 17512 relates to Category No.: 14456, 1820; Payload ID: 17514 relates to Category No.: 12091, 690, 1026, 14661, 14565, 9720, 15043, 7613, 15614, 5446, 1816, 6606, 348, 4949, 4186, 12391, 4127, 14928, 3775, 11285, 7598, 5541, 16085, 8988, 8112, 1238, 10188, 15421, 10558, 11858, 6145, 11187, 11266, 10583, 12066, 7919, 11186, 10557, 10862, 10226, 3715, 4954, 10629, 13653, 3023, 12843, 12807, 12638, 14589, 11174, 1820, 4998, 10343, 12488, 13245, 10479, 11259, 5785, 13882, 13836, 13970, 13981, 13797, 9411, 3631; Payload ID: 17516 relates to Category No.: 14831, 5457; Payload ID: 17517 relates to Category No.: 2460, 14831, 12872; Payload ID: 17518 relates to Category No.: 1779; Payload ID: 17520 relates to Category No.: 13588; Payload ID: 17522 relates to Category No.: 3304, 15257, 7122, 11756, 8004, 11620, 15490, 14286, 14280, 15261, 3368, 14197, 11113, 2006, 13734, 11224, 8495, 7773, 7966, 11414, 10704; Payload ID: 17523 relates to Category No.: 14280, 15259; Payload ID: 17524 relates to Category No.: 13588; Payload ID: 17525 relates to Category No.: 1737, 11940, 10238, 7154, 15257, 4336, 7163, 7890, 15268, 8692, 15261, 11033, 11027, 11008, 8696, 8695, 6696, 13827; Payload ID: 17526 relates to Category No.: 1721, 15257, 10648, 15268, 11845, 8004, 15261, 11113, 7773, 2158, 12010, 15269, 13566, 7723, 8693, 8695, 15255, 7650, 8697, 5406, 11467; Payload ID: 17527 relates to Category No.: 13589, 3398, 15490, 3398, 11109, 10775, 15257, 12786, 11845, 11174, 15261, 12010, 15269, 11239, 8693, 15262, 7888; Payload ID: 17528 relates to Category No.: 8692, 13568; Payload ID: 17529 relates to Category No.: 12091; Payload ID: 17530 relates to Category No.: 1703, 4021, 14050, 9455, 10648, 10372, 8918, 11822, 9737, 6790, 2110, 13936, 16294, 13837, 2149, 9321, 8936, 7719, 1341, 13845, 2099; Payload ID: 17531 relates to Category No.: 1752, 1746, 1820, 1048; Payload ID: 17532 relates to Category No.: 1026, 1703, 4021, 8378, 6297, 15143, 7750, 8920, 6323, 7191, 8924, 901, 15246, 7636, 7638, 8672, 11436, 4588, 11555; Payload ID: 17533 relates to Category No.: 1703, 274, 2572, 3550, 4021, 14589, 1820, 2571, 4012, 15664, 6219, 4110, 13050; Payload ID: 17534 relates to Category No.: 8862, 5367, 15490, 3398, 14565, 13609, 8962, 7743, 10192, 10954, 10628, 11174, 10861; Payload ID: 17535 relates to Category No.: 1026, 15490, 3398, 14565, 8739, 14589, 14428, 10628, 5037, 1453; Payload ID: 17536 relates to Category No.: 14565, 5255, 14428, 11094, 1464; Payload ID: 17537 relates to Category No.: 14565, 8928, 14428, 10647, 11138, 11055, 2172, 4419, 1560, 1544; Payload ID: 17538 relates to Category No.: 7598, 7924, 3714, 1918, 15276; Payload ID: 17539 relates to Category No.: 1825, 4194, 5785; Payload ID: 17540 relates to Category No.: 5785, 11910, 7743, 7303, 5949, 13953, 2572, 7307, 1856; Payload ID: 17541 relates to Category No.: 1752, 10372, 6371, 5785; Payload ID: 17542 relates to Category No.: 795, 11997; Payload ID: 17543 relates to Category No.: 1730, 7613, 10372, 13465, 9713, 4949, 345, 10366, 3564, 2013, 2136, 6559, 11178, 10557, 1970, 1762, 1997, 722, 3563, 14782, 1960, 7238, 2021, 11512, 16096, 5406, 12638, 722, 10626, 10382, 1483, 1557, 4418, 8756, 1257; Payload ID: 17544 relates to Category No.: 15257, 15254, 7939, 12010, 15269, 8696, 11467, 15262, 8505, 12010, 8693; Payload ID: 17545 relates to Category No.: 7287, 14720, 11703; Payload ID: 17546 relates to Category No.: 7743, 11506, 3398, 10648, 12117, 7834, 10690, 2110, 12615, 11401, 12049, 12129, 10968, 7710, 6530, 6667; Payload ID: 17547 relates to Category No.: 7743, 12646; Payload ID: 17549 relates to Category No.: 14838; Payload ID: 17551 relates to Category No.: 11178, 11323, 10899; Payload ID: 17552 relates to Category No.: 12431, 6683, 6670, 7613, 6530, 2315, 4167, 6532, 13743, 6533, 15174; Payload ID: 17553 relates to Category No.: 6681, 15174; Payload ID: 17556 relates to Category No.: 12091, 1737, 7163, 982, 6532, 5598, 7160, 8507, 7850; Payload ID: 17557 relates to Category No.: 5243, 15144, 14838, 6523, 4167, 13363, 6532, 15174, 12786, 12010; Payload ID: 17558 relates to Category No.: 1730, 14838, 6670; Payload ID: 17559 relates to Category No.: 14565, 14865; Payload ID: 17562 relates to Category No.: 3833; Payload ID: 17564 relates to Category No.: 1204; Payload ID: 17566 relates to Category No.: 5095; Payload ID: 17571 relates to Category No.: 7131; Payload ID: 17572 relates to Category No.: 6532; Payload ID: 17575 relates to Category No.: 1730, 9274, 14838, 14533, 1780, 4791; Payload ID: 17576 relates to Category No.: 9274; Payload ID: 17577 relates to Category No.: 9274, 1730, 14838, 4791; Payload ID: 17578 relates to Category No.: 1730, 9274, 14838, 4791; Payload ID: 17579 relates to Category No.: 1730, 9274, 14838, 4791; Payload ID: 17580 relates to Category No.: 1730, 9274, 14838, 4791; Payload ID: 17581 relates to Category No.: 9274; Payload ID: 17582 relates to Category No.: 14838, 1775; Payload ID: 17584 relates to Category No.: 11294; Payload ID: 17586 relates to Category No.: 12091, 9720, 1749, 14838; Payload ID: 17587 relates to Category No.: 12091, 9720, 274, 14838, 4229; Payload ID: 17588 relates to Category No.: 12091, 5785, 7306, 14834; Payload ID: 17589 relates to Category No.: 12091, 5785, 7306, 11858, 14834; Payload ID: 17590 relates to Category No.: 12091, 5785, 1730, 7306, 14838; Payload ID: 17591 relates to Category No.: 12091, 5785, 1730, 7306, 14838, 10459; Payload ID: 17592 relates to Category No.: 12091, 5785, 7306, 14818; Payload ID: 17593 relates to Category No.: 8454; Payload ID: 17594 relates to Category No.: 15490, 3398, 11512, 2409, 4439, 12068, 12891, 3783, 9505, 3316, 14949, 8297, 5451, 12772, 12897; Payload ID: 17595 relates to Category No.: 11512, 1721, 4439, 12068, 12891, 3783, 5160, 9505, 3316, 7372, 161, 5949, 11634, 14910, 5242, 7379, 4998, 4971, 162, 2930, 4996, 6270, 13969; Payload ID: 17596 relates to Category No.: 11512, 4439, 12068, 12891, 3783, 5160, 9505, 3317, 3316; Payload ID: 17597 relates to Category No.: 13589, 3398; Payload ID: 17599 relates to Category No.: 1752, 1795, 1780, 12117, 10543; Payload ID: 17601 relates to Category No.: 1795; Payload ID: 17602 relates to Category No.: 690, 1795, 14058, 12488; Payload ID: 17603 relates to Category No.: 1795, 12571; Payload ID: 17604 relates to Category No.: 11125, 3910, 12049; Payload ID: 17605 relates to Category No.: 11125, 3910, 12049; Payload ID: 17606 relates to Category No.: 1795; Payload ID: 17607 relates to Category No.: 12153, 11125, 3910, 3908; Payload ID: 17608 relates to Category No.: 1795; Payload ID: 17609 relates to Category No.: 1795; Payload ID: 17610 relates to Category No.: 1795, 5428, 7369, 907, 9350, 6951, 1021, 1295; Payload ID: 17611 relates to Category No.: 1795, 1204; Payload ID: 17612 relates to Category No.: 10372, 1795; Payload ID: 17613 relates to Category No.: 1816, 1795, 7743, 3019, 2940, 5592, 1238, 10075, 12748, 4999, 8350; Payload ID: 17614 relates to Category No.: 11125, 3910, 12049; Payload ID: 17615 relates to Category No.: 1795, 11884; Payload ID: 17616 relates to Category No.: 11125, 3910, 12049; Payload ID: 17617 relates to Category No.: 1795, 10775, 8822, 8391; Payload ID: 17618 relates to Category No.: 1795, 16197; Payload ID: 17619 relates to Category No.: 1795, 7657; Payload ID: 17620 relates to Category No.: 1795, 1204; Payload ID: 17622 relates to Category No.: 11926; Payload ID: 17627 relates to Category No.: 287, 2464; Payload ID: 17628 relates to Category No.: 2886, 7093; Payload ID: 17629 relates to Category No.: 2460, 5792, 12013; Payload ID: 17630 relates to Category No.: 2460, 5792, 13594, 12013, 9420, 16138, 14699, 13492, 5794, 4252; Payload ID: 17633 relates to Category No.: 13831; Payload ID: 17636 relates to Category No.: 12137, 14699, 2459, 9420, 5793, 14834; Payload ID: 17637 relates to Category No.: 1204; Payload ID: 17638 relates to Category No.: 1737, 13166, 7154; Payload ID: 17640 relates to Category No.: 15898, 11967, 8375, 7739; Payload ID: 17641 relates to Category No.: 2459, 5793; Payload ID: 17642 relates to Category No.: 2459, 9420, 5793; Payload ID: 17650 relates to Category No.: 1204; Payload ID: 17654 relates to Category No.: 3354, 11512; Payload ID: 17656 relates to Category No.: 1862, 4998; Payload ID: 17658 relates to Category No.: 12137, 2459, 9420, 3866, 14463, 9099, 8049, 7303, 1026, 14455, 13515, 13717, 13363, 9333, 4094, 1465; Payload ID: 17659 relates to Category No.: 12075, 2276; Payload ID: 17660 relates to Category No.: 12075, 2276, 1204; Payload ID: 17661 relates to Category No.: 12075, 2276; Payload ID: 17662 relates to Category No.: 16213, 3058, 7385; Payload ID: 17663 relates to Category No.: 5406; Payload ID: 17666 relates to Category No.: 795, 7613, 5359; Payload ID: 17667 relates to Category No.: 5446, 5359, 11109, 11910, 345, 1795, 7362, 4127, 14992, 15782, 15003, 5912, 15456, 15450, 7363, 15448, 15443, 15454, 15446, 15653, 15457, 15458, 15451, 9292, 6125, 9295, 5406, 15570, 6375, 4953, 1579, 756, 2705, 349; Payload ID: 17668 relates to Category No.: 15207, 5446, 5359, 11109, 4949, 345, 1795, 7362, 10775, 4127, 14992, 15782, 15003, 5912, 15456, 15450, 7363, 15448, 15443, 15454, 15446, 15653, 15457, 15458, 11265, 15451, 9292, 6125, 9295; Payload ID: 17669 relates to Category No.: 5446, 5359, 11109, 345, 1795, 7362, 4127, 14992, 15782, 15003, 5912, 15456, 15450, 7363, 15448, 15443, 15454, 15446, 15653, 15457, 15458, 15451, 9292, 6125, 9295; Payload ID: 17670 relates to Category No.: 13589, 3398, 15490, 3398, 8739, 7306, 15521, 4439, 15570, 3445, 8887, 3176, 7743, 12890, 9085, 11091, 10626, 8582, 14056, 13827, 8004, 1993; Payload ID: 17671 relates to Category No.: 13589, 3398, 15490, 3398, 8739, 15521, 4439, 15570, 12890, 9085, 11091, 14056; Payload ID: 17672 relates to Category No.: 13589, 3398, 15490, 3398; Payload ID: 17673 relates to Category No.: 13589, 3398, 15490, 3398; Payload ID: 17674 relates to Category No.: 13589, 3398; Payload ID: 17676 relates to Category No.: 13589, 3398, 15490, 3398; Payload ID: 17678 relates to Category No.: 1721, 7724; Payload ID: 17680 relates to Category No.: 15490, 3398, 8731, 3398; Payload ID: 17682 relates to Category No.: 3353, 3328, 15632, 3395; Payload ID: 17683 relates to Category No.: 13589, 3398, 15490, 3398, 1721, 13166, 3715; Payload ID: 17686 relates to Category No.: 1730, 7306, 2275, 14838; Payload ID: 17688 relates to Category No.: 15344, 15341, 9982, 14663, 16234, 16275, 15351; Payload ID: 17689 relates to Category No.: 3100, 14663, 15344, 16234, 16275, 4448, 15351, 15342; Payload ID: 17690 relates to Category No.: 12194; Payload ID: 17691 relates to Category No.: 5446, 4110, 4186, 15660, 9891, 4127, 3775, 6310, 1867, 14663, 5541, 8988, 11980, 13159; Payload ID: 17692 relates to Category No.: 4110, 1592, 15660, 6310, 1867, 14663, 6312; Payload ID: 17694 relates to Category No.: 16308, 9232, 6902, 14663; Payload ID: 17695 relates to Category No.: 11926, 9500, 14565, 1790, 5446, 1816, 13996, 15521, 1780, 14663, 4439, 15073, 4632, 2083, 9236, 11174, 11266, 13998, 7252, 9235, 361, 9292, 6125, 8095, 13357, 15606, 10513, 8739, 8513; Payload ID: 17696 relates to Category No.: 11926, 9500, 1790, 15073, 4632, 2083, 13998, 13969, 13882, 13874, 13827, 13966, 13975, 13860, 2077, 13787; Payload ID: 17697 relates to Category No.: 11926, 1790, 13831; Payload ID: 17698 relates to Category No.: 9500, 1790, 7915; Payload ID: 17699 relates to Category No.: 1790; Payload ID: 17700 relates to Category No.: 1790, 1204; Payload ID: 17701 relates to Category No.: 9500, 15782; Payload ID: 17702 relates to Category No.: 11926, 9500, 1790, 15073, 2083, 1730, 7306, 14838, 4632, 14831, 2107; Payload ID: 17703 relates to Category No.: 6814, 11926, 1790, 7613, 6738, 13831, 11646, 790; Payload ID: 17704 relates to Category No.: 11926, 9500, 1790, 7306, 14838, 15073, 4632, 2083, 264; Payload ID: 17705 relates to Category No.: 1790, 1204; Payload ID: 17706 relates to Category No.: 15490, 3398, 1721, 5939, 5446, 9292, 6125, 7732, 2135, 8739, 7710, 13975, 11949, 10093, 13835, 13936, 13989, 13827, 13796, 10238, 13860, 12646, 13877; Payload ID: 17707 relates to Category No.: 9500, 14565, 1790, 15521, 1867, 14663, 4439, 9236, 13998, 9235, 1780, 6796, 4418; Payload ID: 17708 relates to Category No.: 9500, 1790, 13998, 13976; Payload ID: 17709 relates to Category No.: 9500, 1790, 4615; Payload ID: 17711 relates to Category No.: 11926, 9500, 1790, 15073, 4632, 2083; Payload ID: 17712 relates to Category No.: 1737, 7154, 7291, 16182, 14271, 4439, 14913, 14271, 16183; Payload ID: 17713 relates to Category No.: 7291, 16182, 14913, 1721; Payload ID: 17714 relates to Category No.: 11926, 9500, 1790, 13831; Payload ID: 17715 relates to Category No.: 1790, 1204; Payload ID: 17716 relates to Category No.: 11926, 1790, 13831, 9667, 6814; Payload ID: 17717 relates to Category No.: 11926, 9500, 1790, 13831; Payload ID: 17718 relates to Category No.: 14663, 1878, 3791, 15089, 15088, 15079, 16037, 2810, 14312, 14321, 6814; Payload ID: 17720 relates to Category No.: 1204; Payload ID: 17721 relates to Category No.: 7288, 15490, 3398, 14565, 795, 14267, 14271, 12777, 3559, 13729, 7280, 10527, 3559, 7882, 12773, 16194, 8189; Payload ID: 17722 relates to Category No.: 7288, 14271, 7280, 10117, 16194; Payload ID: 17723 relates to Category No.: 7288, 14271, 7280, 16194; Payload ID: 17724 relates to Category No.: 7288, 14271, 7280, 10527, 3559, 7217, 7882, 16194, 11739; Payload ID: 17725 relates to Category No.: 7288, 795, 7613, 2169, 14271, 7280, 16194; Payload ID: 17726 relates to Category No.: 7288, 14271, 7280, 16194; Payload ID: 17727 relates to Category No.: 3305, 3994, 7018, 5446, 3356, 3354, 3353, 3336, 11573, 13639; Payload ID: 17728 relates to Category No.: 3354, 3336, 3305, 3994; Payload ID: 17729 relates to Category No.: 1204, 15369; Payload ID: 17730 relates to Category No.: 3100, 1204, 14490, 82; Payload ID: 17731 relates to Category No.: 15588, 15377, 4439, 15698, 15696; Payload ID: 17732 relates to Category No.: 15377, 4439, 15698, 7107, 15696; Payload ID: 17733 relates to Category No.: 1204, 15377, 15698, 15696; Payload ID: 17734 relates to Category No.: 14565, 1238, 6145, 8476, 7983, 7657, 4145, 13925, 13797, 14052; Payload ID: 17735 relates to Category No.: 10074, 7306, 1780, 11285, 1238, 11266, 10583, 10968, 15381, 10718, 7372; Payload ID: 17736 relates to Category No.: 5428, 7598, 5367, 1722, 1703, 7613, 10074, 1752, 9632, 10940, 345, 7965, 7840, 14033, 10366, 14928, 1893, 13882, 11307, 4021, 1238, 13831, 11660, 10080, 1995, 13827, 12068, 11266, 11565, 11542, 7924, 7923, 11201, 11546, 10419, 10557, 7992, 7754, 7659, 8141, 10226, 13796, 2431, 11543, 10280, 7983, 10283, 10625, 13989, 13860, 7920, 8475, 7607, 7865, 8473, 8393, 7781, 10942, 12686, 13932, 12067, 7986, 3730, 1119, 10602, 10552, 1249, 9480, 10383, 3620, 2070, 4885; Payload ID: 17737 relates to Category No.: 1703, 7598, 11431; Payload ID: 17738 relates to Category No.: 1703, 1820, 4885, 9452, 1278; Payload ID: 17739 relates to Category No.: 1703, 10359, 14033, 7598, 13831, 10558, 11178, 11102, 7386, 15428, 13585, 1119, 3716, 8862, 11940, 8940; Payload ID: 17741 relates to Category No.: 12194, 3550; Payload ID: 17742 relates to Category No.: 690, 1730; Payload ID: 17744 relates to Category No.: 14456; Payload ID: 17745 relates to Category No.: 16308, 9500, 2835, 14663, 815, 5345, 11601, 1841; Payload ID: 17746 relates to Category No.: 4828, 10702, 10074, 1238, 15385, 5428, 13925, 13659, 11392, 14401, 13827, 13966, 10486, 11601, 10226, 10282; Payload ID: 17748 relates to Category No.: 6902; Payload ID: 17749 relates to Category No.: 6902; Payload ID: 17750 relates to Category No.: 690, 15207, 10702, 2940, 14589, 7737, 8522, 4229, 11323, 11445, 7640, 8689, 14067, 11858; Payload ID: 17752 relates to Category No.: 9982, 9232, 3304, 9283, 14663, 12303, 11941, 3090, 12309, 9236, 13967, 14025, 6269, 13813, 3246, 15392, 13816, 14621, 4168; Payload ID: 17753 relates to Category No.: 9982, 9232, 3304, 9283, 14663, 12303, 12309, 9236, 7036, 7038, 3096, 3090, 3076, 15392; Payload ID: 17754 relates to Category No.: 690, 6814, 1730, 12313, 3356, 2311, 14663, 12303, 12308, 7046, 12309, 9236, 12307; Payload ID: 17755 relates to Category No.: 9232, 3304, 6902, 1746, 1780, 14663, 7132, 4332, 12303, 15310, 3490, 3090, 9236, 13612, 13972, 3489, 12306, 13969, 13859, 14025, 13989, 496, 13827, 14040, 13837, 13818, 9411, 2469, 3194, 13849, 1622, 15311, 15985, 5366, 3497, 5756; Payload ID: 17756 relates to Category No.: 15490, 3398, 7018, 3354, 2409, 1089, 3564, 1893, 4439, 12120, 11660, 12891, 3783, 1089, 762, 3103, 9505, 3316, 8739, 8507, 7802; Payload ID: 17757 relates to Category No.: 2661, 11453, 11461; Payload ID: 17759 relates to Category No.: 15207, 403, 11625, 8839; Payload ID: 17760 relates to Category No.: 5428, 1703, 15207; Payload ID: 17761 relates to Category No.: 13589, 3398, 2411; Payload ID: 17762 relates to Category No.: 13589, 3398; Payload ID: 17763 relates to Category No.: 286, 14475; Payload ID: 17764 relates to Category No.: 286, 14475; Payload ID: 17765 relates to Category No.: 286, 14475; Payload ID: 17766 relates to Category No.: 10074, 286, 14475, 1238, 10080; Payload ID: 17767 relates to Category No.: 12469, 286, 14475, 12638, 9455; Payload ID: 17768 relates to Category No.: 1730, 7306, 14838; Payload ID: 17769 relates to Category No.: 14565, 5261, 15402, 5838, 15407, 13200, 13925, 13983, 15535; Payload ID: 17771 relates to Category No.: 7288, 11512, 687, 11506, 3398, 14271, 15521, 9223, 12484, 16182, 7292, 10441, 5786, 11049, 16182, 2469; Payload ID: 17772 relates to Category No.: 14661, 14565, 3639, 274, 13485, 1714; Payload ID: 17773 relates to Category No.: 15517, 13259, 9420, 12124, 16136; Payload ID: 17774 relates to Category No.: 12154, 1955, 3354, 3564, 8075, 7897, 12153; Payload ID: 17775 relates to Category No.: 15517, 12431, 13259, 15174, 3448, 14838, 9379, 14834, 6535, 9378, 4141; Payload ID: 17776 relates to Category No.: 13589, 3398, 15517, 11506, 3398, 5773, 15471; Payload ID: 17777 relates to Category No.: 13589, 3398, 15490, 3398, 10366, 4229, 13693; Payload ID: 17778 relates to Category No.: 13589, 3398, 15490, 3398, 5783, 13594, 14967, 8731, 3398, 15517, 5268, 15521, 4439, 8593, 7891, 5443, 11512, 6103, 9410, 3854, 13812, 12948, 15818, 9451, 1621, 15402, 13580, 4133, 11069, 13201, 2911, 10615, 13069, 13967, 1295, 13827, 6269, 5949, 472, 8611, 6375, 3246, 3602; Payload ID: 17779 relates to Category No.: 13589, 3398, 15490, 3398, 14967, 5783, 15521, 4439, 8739, 13594, 11512, 8731, 3398, 9410, 14456, 12948, 15818, 4133, 7979; Payload ID: 17780 relates to Category No.: 6219, 13589, 3398, 15490, 3398, 13068, 13629; Payload ID: 17781 relates to Category No.: 9500, 15405, 13975, 5261, 5300, 14663, 1878, 3592, 2070, 13923; Payload ID: 17782 relates to Category No.: 4828, 434, 328, 5268, 15414, 1060, 2548, 483, 13080, 11051, 5460, 5462, 3437, 10372, 1816, 4828, 2745; Payload ID: 17783 relates to Category No.: 4828, 1816, 674, 1893, 9637, 14040, 13836, 13796; Payload ID: 17784 relates to Category No.: 13594, 13589, 3398, 15490, 3398, 14123, 11512; Payload ID: 17785 relates to Category No.: 14565, 1816, 5268, 484, 13969, 13882, 13812, 13837, 13815, 13860, 5076, 8029, 10639, 10801, 3529, 7977; Payload ID: 17786 relates to Category No.: 12194, 14565, 1816, 12544, 9631; Payload ID: 17787 relates to Category No.: 4828; Payload ID: 17788 relates to Category No.: 795, 13185, 16182, 8760, 7844, 10571; Payload ID: 17789 relates to Category No.: 13594, 795, 3012, 10372, 14945, 4458; Payload ID: 17794 relates to Category No.: 1204; Payload ID: 17797 relates to Category No.: 4766; Payload ID: 17798 relates to Category No.: 795, 11765, 6738, 5072, 1812, 1844, 3877, 1818; Payload ID: 17799 relates to Category No.: 795, 11765, 4749, 4425, 5072, 1844, 5751, 3877, 13125, 13970; Payload ID: 17800 relates to Category No.: 12886; Payload ID: 17801 relates to Category No.: 1737, 15490, 3398, 3452, 7242, 8731, 3398, 1955, 3354, 7154, 3448, 2469, 1725, 12717, 13762, 3117, 8739, 6375, 1320; Payload ID: 17802 relates to Category No.: 1737, 1721, 3452, 10372, 1955, 3354, 7154, 3448, 5805, 3357, 13730, 1725, 13258, 14034, 3309; Payload ID: 17803 relates to Category No.: 7912, 10074, 10372, 13818, 4020, 4021, 1238, 13874, 8290, 8273, 10080, 13009, 8778, 1701, 7613, 16294, 496, 13970, 13981, 1622; Payload ID: 17804 relates to Category No.: 7912, 13818, 13874, 8290, 8273, 4020, 4021, 7743, 13229, 13105, 12580, 2080, 496, 13827, 10955, 11091, 2169, 8318, 8549, 8552, 10208, 13394; Payload ID: 17805 relates to Category No.: 7912, 13818, 16214, 13874, 8290, 8273, 2080, 13969, 13936, 496, 13836, 13970, 13773, 2169, 13849, 8549, 15427; Payload ID: 17806 relates to Category No.: 7912, 13818, 1204, 13874, 8290, 8273, 9125, 13925, 9490, 13827, 13981, 2169; Payload ID: 17807 relates to Category No.: 7912, 1238, 1238, 4055; Payload ID: 17808 relates to Category No.: 7912, 1238; Payload ID: 17809 relates to Category No.: 9500, 4436, 2989, 6137, 2888, 6814; Payload ID: 17810 relates to Category No.: 12091, 9720, 10074, 12603, 7138, 13360, 1238, 7340, 10080, 1563, 15012, 1562, 1564, 7342, 14635, 14627, 3152, 14365, 14366, 1572, 1570, 13796, 5406, 4953, 482, 16138, 4286, 15010, 4951; Payload ID: 17811 relates to Category No.: 3143, 11884, 14622, 1563, 1562, 1564, 482, 1565, 7342, 14635, 14627, 13956, 3152, 14365, 14366, 1572, 1570, 14793, 9466; Payload ID: 17814 relates to Category No.: 5428, 5446, 15450, 12738; Payload ID: 17815 relates to Category No.: 4828, 803; Payload ID: 17819 relates to Category No.: 15626, 14565; Payload ID: 17823 relates to Category No.: 795, 9947, 4535, 2041, 2353; Payload ID: 17825 relates to Category No.: 14565, 10775; Payload ID: 17826 relates to Category No.: 13589, 3398, 15490, 3398, 1721, 12619, 12646, 2216, 8885; Payload ID: 17828 relates to Category No.: 14565, 795, 11109, 12498, 1795, 11884, 15782, 13635, 12856; Payload ID: 17829 relates to Category No.: 12498, 15782, 352, 13049, 11860, 334, 14565, 795, 5446, 5359, 11109, 1795, 7840, 11884, 11765, 13831, 11969, 11363, 7548, 4039, 336, 13217, 11766, 12858, 10879, 5810, 11445, 13635, 1889, 11451, 10840, 8374, 10600, 3009, 11942, 11255, 10775, 11568, 11878, 12997, 2070, 10776, 11934, 8007; Payload ID: 17830 relates to Category No.: 14565, 795, 12153, 5446, 12498, 13386, 15782, 8390, 8789, 15456, 15450, 7363, 15448, 12737, 15653, 13010, 12748; Payload ID: 17831 relates to Category No.: 2459, 9420, 5793, 8789, 8535, 8509, 7860, 8126, 8890, 3571, 3587, 11628, 3578, 8640; Payload ID: 17832 relates to Category No.: 14565, 795, 12153, 12498, 10878, 11265, 11255, 13756, 13759; Payload ID: 17833 relates to Category No.: 14565, 795, 12153, 11109, 12498, 10775, 11363, 10372; Payload ID: 17834 relates to Category No.: 11512, 15207, 14565, 7613, 8739, 5446, 8731, 3398, 10238, 5359, 11109, 12498, 345, 803, 12096, 7362, 10775, 4127, 360, 14992, 8988, 2041, 11298, 15003, 352, 11860, 5912, 15456, 15450, 7363, 15448, 15443, 11969, 11363, 15454, 13893, 15446, 15653, 15457, 15458, 10879, 15451, 11150, 11445, 9292, 6125, 9295, 11451, 10840, 6740, 11536, 12153, 8887, 9410, 5367, 11460, 1729, 10917, 1276, 9451, 743, 1277, 9321, 12997, 9459, 10828, 5659, 7377, 15329, 10850, 2885, 11391, 11884; Payload ID: 17835 relates to Category No.: 15490, 3398, 795, 12153, 10241, 349, 10955, 8739, 2021, 11292, 13363; Payload ID: 17836 relates to Category No.: 11926, 2276, 14015, 8431, 8553, 15600, 7766; Payload ID: 17837 relates to Category No.: 12194, 15588, 11512, 5428, 7362, 7946, 3012, 8818, 10790, 8103, 4711, 6137, 7186; Payload ID: 17838 relates to Category No.: 15490, 3398, 11512, 5428, 795, 5446, 10940, 7362, 10775, 10262, 2041, 15003, 12117, 5659, 15456, 15450, 7363, 15448, 15443, 15454, 15446, 15653, 15457, 15458, 7919, 15451, 1683, 5359; Payload ID: 17839 relates to Category No.: 5428, 2041, 15450, 7363, 8103; Payload ID: 17840 relates to Category No.: 334, 14565, 795, 10238, 5359, 11109, 1795, 10775, 7840, 11765, 15782, 7548, 4039, 336, 4041, 13217, 11766, 12858, 13635, 3009, 10706, 11934; Payload ID: 17841 relates to Category No.: 5367; Payload ID: 17842 relates to Category No.: 12091, 12594, 12953, 12588, 1343; Payload ID: 17843 relates to Category No.: 6219, 15626, 16236, 5739, 14025, 10036, 3605, 16230, 7952, 7728, 13966, 13983, 3198, 5780; Payload ID: 17844 relates to Category No.: 15626; Payload ID: 17845 relates to Category No.: 1002, 5785, 9982, 14565, 5428, 5446, 1816, 3791, 6133, 12020, 11292; Payload ID: 17846 relates to Category No.: 14565, 5428, 5446, 11109, 10266, 1795, 7362, 10775, 13925, 10878, 3016, 15456, 15450, 10850, 10583, 10829, 10855, 11566, 15446, 15457, 15458, 11102, 1914, 2043, 11495, 10413, 11496, 137, 13000, 8045, 11494, 7372, 13010, 10834, 15423, 11255, 10412; Payload ID: 17847 relates to Category No.: 5367, 14565, 5428, 5446, 7362, 15456, 15450, 10850, 12740, 15442, 6459, 3162, 15446, 15457, 15458, 11565, 2132, 3012; Payload ID: 17848 relates to Category No.: 5367, 14565, 5428, 5446, 7362, 15456, 12740, 10790, 15443, 15451; Payload ID: 17849 relates to Category No.: 5367, 11512, 14565, 5428, 795, 5446, 11109, 7362, 10648, 3016, 15456, 15450, 3131, 10415, 10790, 3162, 11108, 5361, 6248, 10811, 10829, 10851, 10855, 11566, 15446, 15457, 15458, 11114, 11499, 2884, 5627, 10837, 1914, 2043, 1952, 2132, 13788, 10478, 1794, 11565, 8045, 8145, 10904, 8141, 10945, 11111, 13982, 12756, 13948, 2321, 5420, 2089; Payload ID: 17850 relates to Category No.: 11512, 14565, 5428, 795, 5446, 5359, 3021, 13840, 3013, 11765, 10648, 352, 15456, 15450, 7363, 10415, 15448, 10790, 11108, 5361, 10811, 10829, 10851, 10855, 11566, 15653, 8424, 2051, 4039, 336, 5327, 3165, 11499, 10813, 10807, 10810, 7549, 10775, 10878, 14038, 11109, 3012, 12756, 11573, 10414, 11577, 6530, 10238, 1957, 11285, 2013, 1967, 6952, 6953, 2012, 13828, 1958; Payload ID: 17851 relates to Category No.: 5367, 11512, 14565, 795, 5446, 5359, 11109, 345, 3013, 7362, 7946, 11765, 10648, 13925, 2041, 15456, 15450, 15329, 12740, 7363, 10415, 15448, 10790, 6459, 8129, 8782, 11108, 5361, 11209, 3133, 6248, 3141, 8145, 8151, 8159, 10808, 10811, 10814, 10823, 10826, 10829, 10851, 10855, 11566, 15446, 15653, 15457, 15458, 11565, 10828, 10854, 8424, 3015, 11114, 5758, 2051, 4039, 336, 10266, 13788, 10583, 10775, 11419, 10878, 1067, 907, 12999, 10945, 2043, 5606, 11111, 10934, 10810, 339, 9054, 12756, 11000, 11134, 11135; Payload ID: 17852 relates to Category No.: 14565, 5428, 5446, 7362, 15456, 15443, 10855, 2051, 15451, 11499, 6530, 2041, 11111; Payload ID: 17853 relates to Category No.: 5367, 14565, 5428, 5446, 3013, 7362, 10775, 352, 15456, 15450, 15452, 15329, 3131, 10850, 12740, 15446, 15457, 15458, 10879, 1952; Payload ID: 17854 relates to Category No.: 14565, 5428, 5446, 3021, 7362, 15456, 10415, 10790, 15454, 11108, 5361, 10855, 10854, 2051, 10813, 10807, 10810, 13371, 10851, 6952; Payload ID: 17855 relates to Category No.: 14565, 5428, 14038, 5446, 5359, 3021, 15456, 15454, 10854, 2051, 10794, 10813, 10807, 10810, 5381, 13371, 6952; Payload ID: 17856 relates to Category No.: 11512, 14565, 5428, 5446, 11109, 3013, 7362, 10775, 6494, 10648, 5541, 8390, 10878, 15456, 12740, 10415, 10790, 13947, 15454, 11108, 5361, 8159, 10811, 10826, 10829, 10851, 10855, 11566, 3015, 11114, 10879, 11499, 10813, 10807, 10810, 10837, 10692, 8163, 8726, 7687, 15776; Payload ID: 17857 relates to Category No.: 14565, 5428, 795, 5446, 5359, 13840, 10775, 11765, 15456, 15450, 7363, 15448, 15653, 4039, 336, 10262, 10266, 13925, 11298, 11242, 3021, 11566, 803, 6248, 10851, 11109, 11111, 6460, 10810, 11573, 11072, 10414, 13356; Payload ID: 17858 relates to Category No.: 14565, 5428, 795, 5446, 5359, 10775, 11765, 8723, 2041, 15456, 15450, 7363, 15448, 15653, 4039, 336, 10411, 11496, 7784, 15486, 10838, 10814, 10851, 12737, 13895; Payload ID: 17859 relates to Category No.: 12194, 1730, 14640, 4020, 4021; Payload ID: 17860 relates to Category No.: 12194, 1730, 7306, 4020, 4021; Payload ID: 17861 relates to Category No.: 3452, 8408, 13729, 2911; Payload ID: 17862 relates to Category No.: 4279, 3356, 3354, 7145, 13904, 1723, 12776; Payload ID: 17863 relates to Category No.: 9982, 2411, 2467, 3356, 11765, 16197, 2429, 3377, 13827, 2469, 3574; Payload ID: 17864 relates to Category No.: 3356, 3377; Payload ID: 17865 relates to Category No.: 1955, 10238, 7132, 13743, 3333, 2429, 3377, 14613, 3379, 7144, 11607, 12717, 14123, 791, 11373, 11512, 4969, 2422, 3574; Payload ID: 17866 relates to Category No.: 13743, 3377, 14613, 3379, 7144, 8934, 1048, 4251; Payload ID: 17867 relates to Category No.: 3452, 1955, 3354, 3448, 3336, 13904; Payload ID: 17868 relates to Category No.: 6814, 3452, 3354, 3448, 3377, 3455, 6687; Payload ID: 17869 relates to Category No.: 3377, 2429; Payload ID: 17870 relates to Category No.: 15898, 15490, 3398, 11843, 5808, 7613, 1955, 11588, 14058, 12120, 12058, 11967, 12036, 6508, 14067, 14073, 9996, 12646, 11506, 3398, 5809; Payload ID: 17871 relates to Category No.: 3309, 8533; Payload ID: 17872 relates to Category No.: 10250, 12036, 9185; Payload ID: 17873 relates to Category No.: 3676, 10250, 12033; Payload ID: 17874 relates to Category No.: 11940, 1703, 2276, 9420, 8936, 11907, 16294, 14926, 12036, 9165, 5731, 15167, 2273, 12782, 3836, 9185, 2277, 11438, 13364, 13975; Payload ID: 17875 relates to Category No.: 6814, 11940, 3676, 14033, 2273, 9185; Payload ID: 17876 relates to Category No.: 11940, 2273; Payload ID: 17879 relates to Category No.: 12091, 5785, 5782, 1721, 1955, 2409, 12706, 9982; Payload ID: 17880 relates to Category No.: 12091, 5785, 1721, 1955, 9713, 2409, 7635, 2429, 8503, 1978, 12706; Payload ID: 17881 relates to Category No.: 13589, 3398, 15490, 3398, 2411, 11512, 13863, 4138; Payload ID: 17882 relates to Category No.: 15490, 3398, 795, 2411, 11506, 3398, 8373; Payload ID: 17883 relates to Category No.: 13589, 3398, 2411; Payload ID: 17884 relates to Category No.: 6814, 1002, 795, 1955, 3100, 4300, 15521, 4439, 10521, 2006, 13909, 8496, 4299, 13289, 1936, 13419, 10727, 8554, 8374, 13856, 14051, 5754, 10319, 8035, 8242, 8022; Payload ID: 17885 relates to Category No.: 11512, 2139, 7613, 9950, 7840, 3313, 14567, 3313, 14566, 8567, 13124, 8178, 11199; Payload ID: 17886 relates to Category No.: 12091, 15715, 15712, 4439, 15720; Payload ID: 17893 relates to Category No.: 5785, 7735; Payload ID: 17894 relates to Category No.: 15715, 15712, 4439; Payload ID: 17895 relates to Category No.: 1737, 795, 7154, 7162, 1780, 360, 13175; Payload ID: 17897 relates to Category No.: 12194, 6814, 16286, 8831, 12072, 4946; Payload ID: 17898 relates to Category No.: 12194, 6814, 16286, 8831, 12072; Payload ID: 17899 relates to Category No.: 4828, 14451, 10209, 1468; Payload ID: 17900 relates to Category No.: 4828, 14451, 10209; Payload ID: 17901 relates to Category No.: 4828, 14565, 3127, 14451, 10209, 14729; Payload ID: 17902 relates to Category No.: 4828, 14451, 10209; Payload ID: 17903 relates to Category No.: 4828, 14451, 10209; Payload ID: 17904 relates to Category No.: 4828; Payload ID: 17905 relates to Category No.: 14565, 5446, 5359, 15456, 15450, 7363, 15448, 15653; Payload ID: 17906 relates to Category No.: 14565, 795, 12153, 1780, 8785, 5785, 8126; Payload ID: 17907 relates to Category No.: 12091, 5785, 16286, 2940, 6606, 13166, 15004, 12498, 275, 8940, 11285, 12041, 11858, 12754, 6990, 10491, 343; Payload ID: 17908 relates to Category No.: 5785, 10775, 10491, 5285, 5387, 1055; Payload ID: 17910 relates to Category No.: 10702, 3833, 15626, 12063, 2669, 1893, 6738, 11660; Payload ID: 17911 relates to Category No.: 14740, 3833, 5798, 14742, 12063, 2669, 1893, 6738, 3524, 11660; Payload ID: 17912 relates to Category No.: 16172; Payload ID: 17913 relates to Category No.: 12194, 16172; Payload ID: 17915 relates to Category No.: 13589, 3398, 15490, 3398, 15626, 3833, 14640, 12063, 2669, 1893, 6738, 11660; Payload ID: 17916 relates to Category No.: 15626, 3833, 12063, 2669, 1893, 6738, 11660; Payload ID: 17917 relates to Category No.: 16172, 3833, 12063, 2669, 1893, 6738, 11660; Payload ID: 17918 relates to Category No.: 16172; Payload ID: 17919 relates to Category No.: 15626, 10702, 3833, 12063, 2669, 1893, 6738, 4021, 11660, 3038; Payload ID: 17920 relates to Category No.: 3833, 12063, 2669, 1893, 6738, 11660; Payload ID: 17921 relates to Category No.: 3833, 12063, 2669, 1893, 6738, 11660, 10025, 6710; Payload ID: 17922 relates to Category No.: 3833, 12063, 2669, 1893, 6738, 11660; Payload ID: 17923 relates to Category No.: 998, 2802, 9246, 3833, 9768, 12043; Payload ID: 17924 relates to Category No.: 1730, 3833, 12063, 2669, 1893, 6738, 11660; Payload ID: 17925 relates to Category No.: 15490, 3398, 15626, 3833; Payload ID: 17926 relates to Category No.: 13594, 3699, 12122, 12068; Payload ID: 17927 relates to Category No.: 13594, 12122, 12068; Payload ID: 17928 relates to Category No.: 5359; Payload ID: 17930 relates to Category No.: 8114, 13818; Payload ID: 17931 relates to Category No.: 6219, 9500, 15660, 6310, 16142, 1867, 14663, 4107; Payload ID: 17932 relates to Category No.: 6219, 9500; Payload ID: 17933 relates to Category No.: 1512, 14663, 9616, 3728, 16321, 4301, 9616, 9101, 4625; Payload ID: 17934 relates to Category No.: 14663, 2541, 2540, 16234, 16275, 2544; Payload ID: 17935 relates to Category No.: 14663, 2541, 2540, 16234, 16275, 2544; Payload ID: 17936 relates to Category No.: 13594, 15490, 3398, 12777, 3559; Payload ID: 17937 relates to Category No.: 15490, 3398; Payload ID: 17938 relates to Category No.: 13594, 13589, 3398, 15499, 15490, 3398, 9296, 15517, 3354, 12777, 3559, 4439, 16197, 15533, 11611, 11512, 11506, 3398, 3854, 10594, 15601; Payload ID: 17939 relates to Category No.: 13594, 13589, 3398, 15490, 3398, 12777, 3559, 3399, 3559, 11512, 15601; Payload ID: 17940 relates to Category No.: 13594, 13589, 3398, 15490, 3398, 12777, 3559; Payload ID: 17941 relates to Category No.: 15490, 3398, 8739; Payload ID: 17942 relates to Category No.: 13594, 15490, 3398; Payload ID: 17943 relates to Category No.: 13594, 15490, 3398; Payload ID: 17944 relates to Category No.: 13594, 15490, 3398, 15601; Payload ID: 17945 relates to Category No.: 13594, 15490, 3398; Payload ID: 17946 relates to Category No.: 13594, 15490, 3398; Payload ID: 17947 relates to Category No.: 13594, 15490, 3398, 8731, 3398, 8390; Payload ID: 17948 relates to Category No.: 13594, 15490, 3398; Payload ID: 17949 relates to Category No.: 15898, 12154, 11509, 13594, 15499, 15517, 4439, 16197, 11611, 2006, 13597; Payload ID: 17950 relates to Category No.: 15499, 12153, 15517, 11884, 4439, 16197, 11611, 2006, 13597, 15601; Payload ID: 17951 relates to Category No.: 13589, 3398, 15499, 12154, 15490, 3398, 15517, 4439, 16197, 11611, 13594, 15601; Payload ID: 17952 relates to Category No.: 13589, 3398, 15499, 12154, 15490, 3398, 15517, 12777, 3559; Payload ID: 17953 relates to Category No.: 13589, 3398, 15499, 12154, 15490, 3398; Payload ID: 17954 relates to Category No.: 13589, 3398, 15490, 3398; Payload ID: 17955 relates to Category No.: 13589, 3398, 15490, 3398; Payload ID: 17956 relates to Category No.: 13589, 3398, 3336, 15515, 9506; Payload ID: 17957 relates to Category No.: 8739, 15517; Payload ID: 17959 relates to Category No.: 13594, 5367, 11091, 11512, 15517, 7345, 11506, 3398, 10648; Payload ID: 17960 relates to Category No.: 13594, 15490, 3398, 6795, 14643, 724, 12891, 14793, 9584, 12855, 11628, 7345, 14641, 8921, 13758, 3519, 7346, 3529, 3878, 6785; Payload ID: 17961 relates to Category No.: 13594, 15490, 3398, 1780; Payload ID: 17962 relates to Category No.: 13589, 3398, 15490, 3398, 11512; Payload ID: 17963 relates to Category No.: 11512, 8739, 9540, 5949, 3791, 16005, 1318, 7238, 16095, 14532, 1321, 4502, 6371, 14910, 3577, 13739, 4468, 14521, 6384, 6389, 1329, 3228, 13757, 7597, 6857, 6846, 15517, 9410, 14533; Payload ID: 17964 relates to Category No.: 1730, 7345; Payload ID: 17965 relates to Category No.: 13589, 3398, 15490, 3398; Payload ID: 17966 relates to Category No.: 15490, 3398, 8739, 4949; Payload ID: 17967 relates to Category No.: 11091, 13589, 3398, 15490, 3398, 11512, 8739, 10266, 1060, 11506, 3398, 5391, 11363, 7334, 11053, 10349, 1063, 12886, 13594, 13827, 10648, 13925, 5182, 12117, 1729, 5146, 7537, 15195, 9769, 6412; Payload ID: 17968 relates to Category No.: 11091, 11512, 3399, 5443, 11506, 3398, 15521, 12171, 8739, 13589, 3398; Payload ID: 17969 relates to Category No.: 13594, 5367, 15490, 3398, 1483, 4446, 2020, 8739, 13589, 3398, 12646, 16286, 575, 1487, 3577, 8888, 3585, 3593, 15208; Payload ID: 17970 relates to Category No.: 13594, 13589, 3398, 15490, 3398, 1483, 13681, 4446, 2410, 14782, 14643, 8731, 3398, 1011, 14944, 722, 3563, 11516, 13509; Payload ID: 17971 relates to Category No.: 13594, 15490, 3398, 11512, 1722, 8739, 8731, 3398, 1483, 4446, 7965, 1780, 7693, 4094, 11266, 10801, 11242, 8611, 4535, 1240, 8787, 11251, 13860, 13489, 6491, 10720, 1495, 9554, 7383, 12987, 13589, 3398, 14782, 14643, 7303, 11634, 10238, 10574, 16286, 1272, 4538, 7986, 10034, 13005, 2116, 3577, 11558, 7662, 8419, 7971, 9349, 9321, 4690, 8888, 4067, 10910, 1853, 5536, 14410, 13200, 3585, 1644, 12909, 10663, 3593, 13481, 13266; Payload ID: 17972 relates to Category No.: 11512, 3386, 2411, 15517, 11506, 3398, 9420, 4439, 7122, 15515, 15519, 13593, 7086; Payload ID: 17973 relates to Category No.: 13589, 3398, 11512, 11089, 14456, 7613, 8739, 8731, 3398, 15517, 7743, 11506, 3398, 3575, 12628, 10648, 14058, 1274, 9540, 5949, 10287, 3584, 8732, 5459, 8554, 9401, 2024, 9395, 15655, 9318, 4065, 11501, 13925, 13970, 14048, 14385; Payload ID: 17974 relates to Category No.: 13589, 3398, 672, 11512, 11089, 7613, 8739, 10372, 8731, 3398, 7743, 11506, 3398, 12628, 9811, 7840, 11669, 4094, 14058, 4538, 13004, 1408, 5949, 4264, 4535, 13724, 757, 11591, 15135, 3493, 14737, 12551, 6479, 5071, 3290, 2595, 1831, 1848, 2163, 15517, 14643, 795, 8373, 14448, 6862, 13827, 13927; Payload ID: 17975 relates to Category No.: 13594, 15490, 3398, 12646, 672, 11512, 11506, 3398, 8373, 5426; Payload ID: 17976 relates to Category No.: 13594, 12646, 672, 15517, 11512; Payload ID: 17977 relates to Category No.: 13594, 11512, 8739, 1816, 15517, 12646, 6530, 12891, 3783, 15736, 4937, 5938, 13589, 3398, 14949, 4258, 2243, 1730, 4464, 14782, 14643, 12820, 14392, 3237, 3803; Payload ID: 17978 relates to Category No.: 13594, 7725, 8731, 3398, 10238, 7743, 11506, 3398, 3313, 14568, 11884, 7835, 7879, 10180, 7560, 15517, 11512, 8004, 1951, 10471; Payload ID: 17979 relates to Category No.: 13589, 3398, 15490, 3398, 14314, 9420, 7122, 14316; Payload ID: 17980 relates to Category No.: 13589, 3398, 11506, 3398, 14314, 9420, 4439, 7122, 14316, 15515, 15519; Payload ID: 17981 relates to Category No.: 11512, 403, 5285, 10343, 13589, 3398, 15517, 11506, 3398, 13280; Payload ID: 17982 relates to Category No.: 13594, 15490, 3398; Payload ID: 17983 relates to Category No.: 13594, 15490, 3398, 14962, 4145, 8739, 1764, 3167, 2891, 3795, 10696, 14359; Payload ID: 17984 relates to Category No.: 13594, 13589, 3398, 15490, 3398, 1721, 1955, 4332; Payload ID: 17985 relates to Category No.: 13594, 13589, 3398, 15490, 3398, 11512, 795, 1721, 15521, 1780, 9125, 11765, 4439, 7132, 15570, 4332, 5806, 7972, 11260; Payload ID: 17986 relates to Category No.: 13594, 13589, 3398, 15490, 3398, 11512, 1721, 8731, 3398, 15521, 9125, 4439, 7132, 15570; Payload ID: 17987 relates to Category No.: 13589, 3398, 11512, 15517, 1002, 403, 5285, 6445, 10256, 3605, 11506, 3398; Payload ID: 17988 relates to Category No.: 13589, 3398, 11512, 15517, 8408, 1995; Payload ID: 17989 relates to Category No.: 13589, 3398, 1730, 15517, 7306, 14838, 12646, 12628; Payload ID: 17990 relates to Category No.: 13589, 3398, 15516, 1893, 4439, 7890, 12891, 3783, 8004, 3783, 15290, 3399, 15287, 2411, 15520; Payload ID: 17991 relates to Category No.: 7288, 13589, 3398, 14271, 15291, 3399, 15287; Payload ID: 17992 relates to Category No.: 13589, 3398, 15490, 3398, 2410, 5146; Payload ID: 17993 relates to Category No.: 13594, 5095, 7154, 13632, 13371, 13376, 12970; Payload ID: 17994 relates to Category No.: 13594, 5095, 15490, 3398, 2411, 2410, 10735; Payload ID: 17995 relates to Category No.: 13594, 15490, 3398, 11506, 3398, 2410, 10648, 5146, 5773, 7154, 13632, 13371, 13376, 12970; Payload ID: 17996 relates to Category No.: 13594, 15490, 3398, 7306, 11506, 3398, 14962, 2350, 5244, 12985; Payload ID: 17997 relates to Category No.: 8760, 7743, 11371, 11130, 11129, 3001, 8406, 8421, 14655, 7662, 8408; Payload ID: 17998 relates to Category No.: 7743, 4134, 12891, 8424, 11146; Payload ID: 17999 relates to Category No.: 15490, 3398, 11843, 11512, 8739, 1483, 11506, 3398, 2410, 5113, 9125, 1867, 14663, 7303, 12891, 8731, 3398, 13824, 6212, 455, 12580, 16279, 13630, 4095; Payload ID: 18000 relates to Category No.: 13594, 15490, 3398, 5113; Payload ID: 18001 relates to Category No.: 5113, 12194, 15490, 3398, 11843, 11512, 14456, 8739, 1483, 11506, 3398, 2410, 9125, 1867, 14663; Payload ID: 18002 relates to Category No.: 3684, 1983, 2006; Payload ID: 18003 relates to Category No.: 14318, 6637, 151, 6360; Payload ID: 18004 relates to Category No.: 15490, 3398, 14565, 16286, 8731, 3398, 7306, 8831, 9125, 10648, 9410, 8103, 7600, 8739, 13589, 3398, 13594; Payload ID: 18005 relates to Category No.: 15490, 3398, 14565, 16286, 8731, 3398, 7693, 9125, 9410, 13589, 3398; Payload ID: 18006 relates to Category No.: 15490, 3398, 14565, 16286, 9125, 9410, 13589, 3398; Payload ID: 18007 relates to Category No.: 15490, 3398, 9125, 1204, 8739, 8731, 3398, 16286; Payload ID: 18008 relates to Category No.: 13589, 3398, 11091, 11087; Payload ID: 18009 relates to Category No.: 15618, 10074, 1862, 5871, 14057, 1238, 10080, 15547, 13376, 11316, 5866, 2024, 4161; Payload ID: 18010 relates to Category No.: 12427, 1862, 15547, 15618, 16189, 1957, 5867, 10289, 9459, 13882, 496, 13886, 13966, 13970, 381, 14000, 13905, 13934, 13813; Payload ID: 18011 relates to Category No.: 11512, 12427, 1862, 5871, 15547, 10543, 11170, 5866, 2024, 4161, 13905, 11278; Payload ID: 18012 relates to Category No.: 9982, 3354, 5095, 15490, 3398, 5127, 2410, 5182, 5131, 13589, 3398, 7134; Payload ID: 18013 relates to Category No.: 7291, 16182; Payload ID: 18014 relates to Category No.: 7291, 16182, 12484, 16182, 14271, 16183, 11049, 16182, 2251; Payload ID: 18015 relates to Category No.: 1703, 16286, 687, 15517, 7743, 11506, 3398, 8756, 11542, 10578, 15901, 13867; Payload ID: 18016 relates to Category No.: 1722, 3356, 7743, 12117, 9245; Payload ID: 18017 relates to Category No.: 12091, 1722, 10372, 1895; Payload ID: 18018 relates to Category No.: 345, 3833, 1780, 12063, 2669, 3775, 1893, 6738, 11660, 10568, 11033, 10574, 690, 6553, 5024, 7613, 16294, 10372, 13827, 7762; Payload ID: 18019 relates to Category No.: 12498, 1729, 14656, 12091, 11512, 1722, 5428, 12638, 10074, 10372, 7730, 8731, 3398, 6606, 11167, 1746, 7743, 2079, 11506, 3398, 8756, 4859, 7134, 9815, 2376, 10366, 1814, 3775, 11285, 10648, 7735, 16193, 4021, 1238, 7187, 15570, 5290, 7890, 7724, 10954, 13519, 10080, 4015, 7971, 11248, 11174, 11178, 11266, 8004, 6248, 4039, 10287, 14050, 8535, 11598, 2131, 11949, 15606, 11259, 11290, 8352, 11186, 10419, 7750, 13835, 11245, 8318, 7939, 11922, 13616, 9595, 7659, 11176, 10394, 10578, 927, 10874, 6467, 8626, 14654, 14655, 4969, 8091, 11429, 10446, 11595, 7963, 10283, 2642, 2607, 14360, 10625, 8247, 3967, 13989, 10835, 12404, 13357, 11980, 9453, 366, 6403, 12541, 12767, 12546, 11385, 8005, 13805, 10597, 11071, 8530, 11536, 8739, 12646, 16005, 12891, 10626, 10735, 10350, 3641, 1836, 1993, 1780, 8677, 15185, 6559, 9125, 6114, 4459, 10737, 8145, 11136, 13497, 8420, 9349, 8688, 6555, 12558, 15197, 11275, 15194, 4067, 11319, 12461, 13405, 7377, 1701, 15439, 7221, 13685, 1303, 12602, 404, 13021, 11312, 13969, 13882, 16294, 496, 13827, 10238, 13970, 13860, 4145, 9411, 13996, 7369, 1951, 11109, 3246, 13913, 10574, 3812, 10292, 14045, 5458, 8106, 8453, 8568, 7238, 8368, 3014, 5413, 10592, 11389, 4294; Payload ID: 18020 relates to Category No.: 12091, 690, 1764, 1722, 11089, 4998, 10074, 1752, 10372, 1816, 14569, 11167, 1746, 1729, 14656, 4949, 7743, 1727, 10780, 8928, 4859, 10359, 4446, 1780, 360, 3564, 1814, 4057, 7735, 13882, 4021, 1238, 15570, 1549, 9000, 3812, 10080, 16294, 2571, 13827, 10362, 11187, 4039, 14050, 4939, 11290, 11419, 10344, 7939, 9595, 10349, 4953, 10573, 10578, 1587, 1560, 14655, 14360, 8247, 13989, 3576, 8106, 4937, 3425, 9320, 10805, 16040, 11146, 4478, 10330, 10707, 10327, 14781, 7588, 13617, 1628, 1026, 10648, 8930, 10599, 8004, 1240, 14640, 12459, 12498, 12855, 1621, 1250, 4958, 7708, 10201, 10601, 11275, 4067, 10701; Payload ID: 18021 relates to Category No.: 11512, 10074, 10238, 12498, 11167, 1746, 13105, 1729, 14656, 7743, 11506, 3398, 4859, 10359, 12646, 8373, 1814, 13882, 4021, 1238, 15570, 7890, 6559, 4067, 10628, 10080, 9540, 10287, 11290, 5406, 10522, 10578, 6371, 10446, 14360, 8247, 13989, 9453, 11385, 9320, 16040, 3137, 9410, 1993, 16294, 496, 13836, 4145, 345, 3246, 13913, 8756, 5458, 14655, 4294, 3600; Payload ID: 18022 relates to Category No.: 14569, 15610, 12091, 13589, 3398, 5785, 14565, 1722, 795, 10372, 348, 9713, 11167, 4949, 11506, 3398, 3575, 1767, 10241, 8756, 12891, 14640, 7965, 10648, 9786, 8930, 10558, 15570, 12827, 372, 3705, 6773, 1549, 3812, 16294, 2571, 9540, 10362, 13383, 5949, 11266, 15400, 2131, 4459, 5406, 9716, 860, 7799, 9595, 724, 9580, 10386, 11385, 13805, 14641, 4031, 11634, 7613, 6530, 690, 1227, 13342, 6111, 7924, 3713, 10628; Payload ID: 18023 relates to Category No.: 13589, 3398, 5782, 14565, 16172, 3699, 15570, 3692; Payload ID: 18024 relates to Category No.: 12091, 795, 1295, 10372, 14569, 9713, 4949, 3575, 8756, 12646, 360, 12936, 11307, 15570, 9600, 9540, 13827, 9716, 9595, 7377, 1240, 10983, 16096, 13805, 3592, 11462, 11493, 10268, 11116, 5406, 12891, 10573, 10226, 6375, 1622, 6111, 9125, 14699, 4418, 6384, 6568, 15482, 15480, 4885, 6383, 1333, 4882, 1332, 6112, 13969, 13936, 16294, 496, 13836, 13966, 11391, 13970, 7743, 13860, 14011, 9411, 12427, 3246, 3566, 9410, 7701, 2607, 11384; Payload ID: 18025 relates to Category No.: 5367, 5785, 1752, 1746, 1257, 15570, 1549, 3812, 9540, 13991, 7939, 16133, 9595, 4953, 6269, 1560, 4954, 7756, 3023, 13850, 13931, 3022, 13882, 9411, 11884, 8756, 11542, 15568, 13342; Payload ID: 18027 relates to Category No.: 690, 1703, 16214, 1780, 1893, 14014, 4021, 7719, 2376; Payload ID: 18028 relates to Category No.: 6969, 1780, 2243, 1737, 1721, 8906, 13149, 5612; Payload ID: 18029 relates to Category No.: 6969, 1780, 2243, 904, 8906, 13149, 5612; Payload ID: 18030 relates to Category No.: 6969, 1780, 2243, 904, 12619, 4998, 13882, 8906, 2911, 13149, 5612; Payload ID: 18031 relates to Category No.: 7345, 3791; Payload ID: 18032 relates to Category No.: 3791; Payload ID: 18033 relates to Category No.: 2169, 8739; Payload ID: 18034 relates to Category No.: 5939, 1894, 9632, 5936, 1739; Payload ID: 18035 relates to Category No.: 10238, 9632, 10343, 7913, 11012, 790, 1317, 14358, 9932; Payload ID: 18036 relates to Category No.: 5939, 1894, 9632, 12133, 5936, 4939, 1739; Payload ID: 18037 relates to Category No.: 9632; Payload ID: 18038 relates to Category No.: 1894, 9632, 3781; Payload ID: 18039 relates to Category No.: 9632; Payload ID: 18040 relates to Category No.: 9632; Payload ID: 18041 relates to Category No.: 4770; Payload ID: 18042 relates to Category No.: 16172, 12105; Payload ID: 18043 relates to Category No.: 16172, 12105; Payload ID: 18044 relates to Category No.: 16172, 12105; Payload ID: 18045 relates to Category No.: 15618, 5846, 5848, 14454, 1415, 11941, 13970, 13827, 1417, 1795, 13812, 13877, 3146, 13978, 3126, 13969, 15338; Payload ID: 18046 relates to Category No.: 1026, 15618, 5846, 1415, 1417, 5848, 6577, 2945, 6697, 11323, 13796, 14357, 2006; Payload ID: 18047 relates to Category No.: 1026, 15618, 5846, 10074, 1415, 1417, 13785, 5848, 6577, 2945, 1238, 10005, 13796, 10302, 10325; Payload ID: 18048 relates to Category No.: 1026, 15618, 5846, 1415, 1409, 1417, 5848, 6577, 2945, 9350, 4374, 12573; Payload ID: 18049 relates to Category No.: 15898, 15618, 12153, 5846, 1415; Payload ID: 18050 relates to Category No.: 8862, 1026, 15618, 5846, 1415, 1417, 5848, 6577, 2945; Payload ID: 18051 relates to Category No.: 1026, 15618, 5846, 10074, 1415, 1651, 5848, 6577, 2945, 1238, 10301, 10869, 10486, 496, 2001, 2006, 7864, 11091, 8929, 11176; Payload ID: 18052 relates to Category No.: 1026, 15618, 5846, 10074, 1415, 5848, 6577, 2945, 1238, 1417; Payload ID: 18053 relates to Category No.: 15618, 15626, 5846, 1415, 16214, 5848, 4814, 2038, 1419, 1649, 14565, 14073; Payload ID: 18054 relates to Category No.: 6814, 15618, 5846, 14740, 1415, 1417, 5848, 13975, 1649, 6577, 6575, 13878, 3940, 11159, 10801, 1410; Payload ID: 18055 relates to Category No.: 15618, 5846, 1415, 1651, 3159, 14460, 5848, 1649, 4814, 2038; Payload ID: 18056 relates to Category No.: 1649, 13126, 13556, 16099, 1547, 15618, 5846, 1415, 10372, 403, 5848, 10314, 12120, 3046, 1417; Payload ID: 18057 relates to Category No.: 5846, 15618, 13041, 14459, 1415, 14740, 1649, 11674; Payload ID: 18058 relates to Category No.: 12091, 15618, 5846, 1415, 14025, 6819, 1649; Payload ID: 18059 relates to Category No.: 12091, 1651, 1872, 15618, 5846, 1415, 5848, 7548, 11858, 378, 1417, 1433; Payload ID: 18060 relates to Category No.: 15618, 5846, 1415, 3159, 5848, 1417, 1836, 13812, 11941, 11942, 14021, 15338, 1651, 14460; Payload ID: 18061 relates to Category No.: 1512, 15618, 15626, 5846, 1415, 1795, 5848, 1912, 1901, 2310, 15338, 1417, 1119, 14694, 14454, 13978, 4169, 6219, 15273, 3243, 3161, 3126, 16020, 9641, 13971, 14453, 1948, 5428, 14565, 2136, 13867, 10238, 10486, 13981, 2068, 1993, 13983, 11111, 6952, 2124, 4581, 10644, 7952; Payload ID: 18062 relates to Category No.: 15618, 15626, 5846, 1415, 14449, 14021, 5848, 13867, 10298, 10257, 7743; Payload ID: 18063 relates to Category No.: 5846, 15618, 1415, 5848, 8051, 14021, 13867, 10298; Payload ID: 18064 relates to Category No.: 15618, 5846, 1415, 1409, 1417, 275, 286, 1836, 5848, 1797, 10486, 1995, 13936, 1812, 11598, 2082, 8378, 6980, 2717, 7316, 1859, 11005, 9450, 1241, 13973, 16109, 5328, 13424, 5336; Payload ID: 18065 relates to Category No.: 15618, 1415, 5848; Payload ID: 18066 relates to Category No.: 15618, 5846, 1415, 1417, 12575, 5848; Payload ID: 18067 relates to Category No.: 2411, 8731, 3398, 7306, 14838, 14831, 2412, 14590, 14834, 9276, 14836, 14837, 14534, 4167, 3969; Payload ID: 18068 relates to Category No.: 1730, 7306, 14838, 266, 9610, 14831, 1202; Payload ID: 18069 relates to Category No.: 6814, 1512, 14663, 9616, 9101, 9616, 3728, 16321, 4623, 12936; Payload ID: 18070 relates to Category No.: 6814, 15344, 4533; Payload ID: 18071 relates to Category No.: 6814; Payload ID: 18074 relates to Category No.: 13618; Payload ID: 18075 relates to Category No.: 14216, 3656, 3353, 4439, 4442; Payload ID: 18076 relates to Category No.: 14216, 3656, 12137, 1730, 7306, 14838, 4439, 4442; Payload ID: 18077 relates to Category No.: 1730, 7306, 14838, 1204; Payload ID: 18078 relates to Category No.: 14456, 12127, 1893, 2277, 11945; Payload ID: 18079 relates to Category No.: 1820, 12127, 1893; Payload ID: 18080 relates to Category No.: 14456, 12127, 1893, 2277, 12137; Payload ID: 18081 relates to Category No.: 5782, 11947, 12127, 1893; Payload ID: 18082 relates to Category No.: 11947, 12127, 1893, 5782; Payload ID: 18083 relates to Category No.: 11947, 12127, 1893, 7096, 7088; Payload ID: 18084 relates to Category No.: 12127, 1893, 11945; Payload ID: 18085 relates to Category No.: 5782, 11947, 12127, 1893; Payload ID: 18086 relates to Category No.: 5782, 11947, 1204; Payload ID: 18087 relates to Category No.: 11947, 5782, 12127, 1893; Payload ID: 18088 relates to Category No.: 9718, 11910, 11947, 12127, 1893, 13692, 7063, 12137; Payload ID: 18089 relates to Category No.: 8862, 12127, 1893, 2277; Payload ID: 18090 relates to Category No.: 14456, 12127, 1893, 2277, 12137; Payload ID: 18091 relates to Category No.: 14456, 12127, 1893, 2277, 11945, 12137; Payload ID: 18092 relates to Category No.: 13755, 1874, 14663; Payload ID: 18093 relates to Category No.: 5782, 11947, 12127, 1893, 6451, 12122, 6453, 15706, 7073; Payload ID: 18094 relates to Category No.: 5782, 11947, 12122, 15706, 7073; Payload ID: 18095 relates to Category No.: 5782, 11947, 12127, 1893, 6451, 6453, 11948; Payload ID: 18096 relates to Category No.: 12127; Payload ID: 18097 relates to Category No.: 15618, 11947, 12127, 5848, 1893, 6451, 6453; Payload ID: 18098 relates to Category No.: 15618, 11947, 5848, 1204; Payload ID: 18099 relates to Category No.: 12127, 1893, 6451, 6453; Payload ID: 18100 relates to Category No.: 12127, 1893, 6451, 6453; Payload ID: 18101 relates to Category No.: 11947, 12127, 1893, 6451, 13376, 7131, 11294, 6453, 11948; Payload ID: 18102 relates to Category No.: 12127, 1893, 6451, 6453, 12135; Payload ID: 18103 relates to Category No.: 1737, 15618, 1512, 8765, 2885, 8739, 15715, 7154, 11949, 2011, 1204, 1893, 14663, 4439, 16197, 16193, 7132, 12120, 7187, 7188, 7163, 11660, 7281, 1995, 11259, 10861, 4442, 7155, 5048, 12914, 4541, 16201, 12671, 11029, 13174, 11251, 14201, 6608, 14205, 9205, 13173, 10725, 8590, 13833, 11922; Payload ID: 18104 relates to Category No.: 15588, 14934, 1893, 4439, 16197, 2740; Payload ID: 18105 relates to Category No.: 12137; Payload ID: 18106 relates to Category No.: 12137, 2568; Payload ID: 18107 relates to Category No.: 6227, 795, 710, 12127, 1780, 14972, 4977, 12700, 8547, 3907, 6507, 8317, 11307, 8316, 7630, 15149, 5848, 4478, 2041, 2331, 13989, 496, 13827, 10238, 8782, 14962, 472, 10301, 13934, 14022, 13787, 8392, 10652, 9737, 11013, 1119, 11082, 2156, 13978, 14041, 8009, 13511, 2647, 1859; Payload ID: 18108 relates to Category No.: 15626; Payload ID: 18109 relates to Category No.: 12194; Payload ID: 18110 relates to Category No.: 1204; Payload ID: 18114 relates to Category No.: 15427; Payload ID: 18116 relates to Category No.: 1204; Payload ID: 18117 relates to Category No.: 6219, 1204, 13071; Payload ID: 18118 relates to Category No.: 9500, 14663, 2347; Payload ID: 18119 relates to Category No.: 1204; Payload ID: 18120 relates to Category No.: 1002; Payload ID: 18121 relates to Category No.: 15626; Payload ID: 18129 relates to Category No.: 15618, 5297, 1651; Payload ID: 18132 relates to Category No.: 11949; Payload ID: 18134 relates to Category No.: 14565, 15192, 10475, 10226, 10197; Payload ID: 18135 relates to Category No.: 4828; Payload ID: 18136 relates to Category No.: 14267; Payload ID: 18137 relates to Category No.: 1408; Payload ID: 18138 relates to Category No.: 1730, 11634, 12891, 6375, 7341, 6371, 1341; Payload ID: 18140 relates to Category No.: 3837; Payload ID: 18142 relates to Category No.: 4828, 5406, 11634, 3612; Payload ID: 18143 relates to Category No.: 8290, 7967, 10285, 7955, 7969; Payload ID: 18144 relates to Category No.: 795, 7613, 12577; Payload ID: 18146 relates to Category No.: 7613, 14033, 8507, 7915, 7618, 7918, 13919, 8100, 8743, 13831, 5810, 3667, 8109, 14838, 6375; Payload ID: 18147 relates to Category No.: 1415, 3147, 985, 16176; Payload ID: 18148 relates to Category No.: 1415, 3147, 16176; Payload ID: 18149 relates to Category No.: 5848; Payload ID: 18150 relates to Category No.: 5848; Payload ID: 18151 relates to Category No.: 5848; Payload ID: 18152 relates to Category No.: 5848, 1204; Payload ID: 18153 relates to Category No.: 5848; Payload ID: 18154 relates to Category No.: 12633, 5848, 12858, 8507, 16332, 8532; Payload ID: 18156 relates to Category No.: 5459, 14456; Payload ID: 18157 relates to Category No.: 12137, 15626, 14565, 1816; Payload ID: 18158 relates to Category No.: 15626, 5782, 3833, 14098, 4771, 12063, 2669, 1893, 6738, 11660, 12453, 2662, 1600, 2665, 16168, 12537, 4766, 5949, 12066, 13770; Payload ID: 18159 relates to Category No.: 15626, 5782, 3833, 12063, 2669, 1893, 6738, 4766, 11660, 8049, 2662, 12129, 1600, 3598, 5985, 6625; Payload ID: 18160 relates to Category No.: 12137, 15626; Payload ID: 18161 relates to Category No.: 12137, 15626, 14565, 10775; Payload ID: 18162 relates to Category No.: 12137, 15626, 4768; Payload ID: 18163 relates to Category No.: 15626; Payload ID: 18164 relates to Category No.: 12137, 15626; Payload ID: 18165 relates to Category No.: 15626, 4766, 2662, 11145; Payload ID: 18166 relates to Category No.: 15626; Payload ID: 18167 relates to Category No.: 15618, 9718, 14565, 3100, 11910, 5848; Payload ID: 18168 relates to Category No.: 9718, 3100, 11910, 9858, 9945, 14663, 15618, 5848; Payload ID: 18169 relates to Category No.: 12194, 1721; Payload ID: 18170 relates to Category No.: 12194, 1204; Payload ID: 18171 relates to Category No.: 12194, 13756; Payload ID: 18172 relates to Category No.: 12194, 2562; Payload ID: 18173 relates to Category No.: 12194; Payload ID: 18174 relates to Category No.: 12194, 12427, 3913; Payload ID: 18175 relates to Category No.: 12194, 12427; Payload ID: 18176 relates to Category No.: 12194, 12427, 11606, 11859; Payload ID: 18177 relates to Category No.: 12194, 12427, 2159, 14456; Payload ID: 18178 relates to Category No.: 12194, 12427; Payload ID: 18179 relates to Category No.: 12194, 12427; Payload ID: 18180 relates to Category No.: 12194, 690, 11512, 5785, 8739, 8731, 3398, 1862, 14428, 4021, 4180, 6741, 5866, 7662; Payload ID: 18181 relates to Category No.: 12194; Payload ID: 18182 relates to Category No.: 12194, 10069; Payload ID: 18183 relates to Category No.: 1257, 1918, 13459, 11600, 10556, 16096, 5406, 690, 9125, 11980, 3620, 12577, 3813, 857; Payload ID: 18184 relates to Category No.: 14565, 10775; Payload ID: 18185 relates to Category No.: 14565, 795, 13818, 10343, 11459, 13162, 13293, 11449; Payload ID: 18186 relates to Category No.: 1204; Payload ID: 18188 relates to Category No.: 1204; Payload ID: 18189 relates to Category No.: 15626, 3041, 6444; Payload ID: 18190 relates to Category No.: 1204; Payload ID: 18191 relates to Category No.: 2459, 1204, 8890, 3578; Payload ID: 18192 relates to Category No.: 1204; Payload ID: 18193 relates to Category No.: 13041, 7728, 5848, 1978, 5809; Payload ID: 18194 relates to Category No.: 7122; Payload ID: 18195 relates to Category No.: 1204, 363; Payload ID: 18197 relates to Category No.: 12137, 11930, 7743, 14098, 4771; Payload ID: 18198 relates to Category No.: 1204; Payload ID: 18199 relates to Category No.: 1204; Payload ID: 18200 relates to Category No.: 1204, 9455; Payload ID: 18201 relates to Category No.: 11940, 1204, 4094, 11934; Payload ID: 18202 relates to Category No.: 1204, 4094, 11934; Payload ID: 18203 relates to Category No.: 1204; Payload ID: 18204 relates to Category No.: 9369; Payload ID: 18205 relates to Category No.: 1204; Payload ID: 18206 relates to Category No.: 9396; Payload ID: 18207 relates to Category No.: 1204; Payload ID: 18208 relates to Category No.: 7743, 8728, 3697, 13588; Payload ID: 18209 relates to Category No.: 1204; Payload ID: 18210 relates to Category No.: 3837, 12096, 14033, 1204, 14096, 3829; Payload ID: 18212 relates to Category No.: 1204, 12995; Payload ID: 18213 relates to Category No.: 1204; Payload ID: 18214 relates to Category No.: 1204; Payload ID: 18215 relates to Category No.: 1204; Payload ID: 18216 relates to Category No.: 8454; Payload ID: 18220 relates to Category No.: 9762; Payload ID: 18222 relates to Category No.: 2459; Payload ID: 18226 relates to Category No.: 1204, 4969; Payload ID: 18228 relates to Category No.: 4828, 13985; Payload ID: 18229 relates to Category No.: 11912; Payload ID: 18232 relates to Category No.: 4977; Payload ID: 18234 relates to Category No.: 12519, 1627; Payload ID: 18235 relates to Category No.: 12519; Payload ID: 18236 relates to Category No.: 12519; Payload ID: 18245 relates to Category No.: 2139, 2083, 10521, 14000, 8177; Payload ID: 18246 relates to Category No.: 3328; Payload ID: 18249 relates to Category No.: 1836, 12062, 4757, 13094; Payload ID: 18254 relates to Category No.: 14699, 2459; Payload ID: 18258 relates to Category No.: 11512, 795, 5446, 3021, 339, 11573, 11242, 11510, 10491, 1967, 11259, 15606, 13639, 5603, 2012; Payload ID: 18260 relates to Category No.: 11674, 9784, 13094; Payload ID: 18261 relates to Category No.: 7869; Payload ID: 18262 relates to Category No.: 1730, 9410, 7869; Payload ID: 18268 relates to Category No.: 15490, 3398, 1752; Payload ID: 18270 relates to Category No.: 9594; Payload ID: 18273 relates to Category No.: 15626; Payload ID: 18274 relates to Category No.: 15626; Payload ID: 18275 relates to Category No.: 15626; Payload ID: 18279 relates to Category No.: 1204; Payload ID: 18280 relates to Category No.: 12153; Payload ID: 18282 relates to Category No.: 4969; Payload ID: 18286 relates to Category No.: 16286, 7306, 10314; Payload ID: 18288 relates to Category No.: 7306; Payload ID: 18292 relates to Category No.: 4194, 9187; Payload ID: 18294 relates to Category No.: 1836, 14838, 7131, 10491; Payload ID: 18295 relates to Category No.: 14688, 6404, 13651; Payload ID: 18299 relates to Category No.: 1002, 16058; Payload ID: 18305 relates to Category No.: 795; Payload ID: 18307 relates to Category No.: 2460, 2459, 9420; Payload ID: 18310 relates to Category No.: 795; Payload ID: 18315 relates to Category No.: 8454; Payload ID: 18316 relates to Category No.: 13589, 3398; Payload ID: 18319 relates to Category No.: 14699, 2459; Payload ID: 18321 relates to Category No.: 13790; Payload ID: 18325 relates to Category No.: 13681, 2459; Payload ID: 18329 relates to Category No.: 708, 11930, 4437, 1517; Payload ID: 18333 relates to Category No.: 1204; Payload ID: 18345 relates to Category No.: 1204; Payload ID: 18346 relates to Category No.: 1204; Payload ID: 18348 relates to Category No.: 13831, 8374, 10580; Payload ID: 18354 relates to Category No.: 13790; Payload ID: 18355 relates to Category No.: 5846, 1415, 1409, 6724, 1417; Payload ID: 18356 relates to Category No.: 12194, 10303, 10802, 11395, 10220; Payload ID: 18357 relates to Category No.: 9949, 3475, 12020, 11250, 11094, 9950; Payload ID: 18358 relates to Category No.: 6227, 11250; Payload ID: 18361 relates to Category No.: 1204, 3683, 1892, 9201; Payload ID: 18362 relates to Category No.: 1204; Payload ID: 18363 relates to Category No.: 13041, 1415; Payload ID: 18364 relates to Category No.: 11674, 7234, 1649; Payload ID: 18365 relates to Category No.: 1649, 7234, 11674; Payload ID: 18366 relates to Category No.: 7131, 10491; Payload ID: 18367 relates to Category No.: 7131, 10491; Payload ID: 18370 relates to Category No.: 8862; Payload ID: 18372 relates to Category No.: 9185; Payload ID: 18376 relates to Category No.: 1204, 1804; Payload ID: 18377 relates to Category No.: 12071; Payload ID: 18379 relates to Category No.: 1204; Payload ID: 18380 relates to Category No.: 1204; Payload ID: 18382 relates to Category No.: 1204; Payload ID: 18384 relates to Category No.: 1204; Payload ID: 18385 relates to Category No.: 9861; Payload ID: 18386 relates to Category No.: 9861; Payload ID: 18387 relates to Category No.: 1204; Payload ID: 18388 relates to Category No.: 1204, 1295; Payload ID: 18389 relates to Category No.: 1002, 10256, 8537, 7955, 8515, 12194; Payload ID: 18393 relates to Category No.: 6814; Payload ID: 18394 relates to Category No.: 5848; Payload ID: 18395 relates to Category No.: 5848; Payload ID: 18396 relates to Category No.: 1649, 1651; Payload ID: 18397 relates to Category No.: 2945, 11150, 10289, 12511; Payload ID: 18399 relates to Category No.: 2459, 7777, 3837, 2460, 9420, 3176, 4949; Payload ID: 18400 relates to Category No.: 6814; Payload ID: 18402 relates to Category No.: 7080; Payload ID: 18405 relates to Category No.: 1002; Payload ID: 18408 relates to Category No.: 12453, 3913, 3795, 10569, 4939, 2800, 2700; Payload ID: 18413 relates to Category No.: 3951; Payload ID: 18416 relates to Category No.: 16286, 7306; Payload ID: 18419 relates to Category No.: 1703, 1204; Payload ID: 18420 relates to Category No.: 13166, 1820, 12936; Payload ID: 18421 relates to Category No.: 7345, 7385, 10058; Payload ID: 18422 relates to Category No.: 15626, 1204; Payload ID: 18423 relates to Category No.: 13790, 1204, 4969; Payload ID: 18427 relates to Category No.: 12633, 2353; Payload ID: 18430 relates to Category No.: 7306; Payload ID: 18432 relates to Category No.: 6814; Payload ID: 18433 relates to Category No.: 6219, 4828, 496, 3574, 8319; Payload ID: 18436 relates to Category No.: 6814, 15618, 15626, 403, 746, 9642, 738, 742, 15223, 742, 5789, 2943; Payload ID: 18437 relates to Category No.: 15618, 15626, 9642, 6814, 403, 746, 744, 15223, 739, 15223, 10232, 738, 742, 15223, 742, 740, 15223, 5789, 2943, 9627; Payload ID: 18438 relates to Category No.: 5782, 13186, 9420, 4439, 16197, 9075, 11949, 3400, 11949, 15606, 14166; Payload ID: 18439 relates to Category No.: 5782, 9075, 11949, 3400, 11949, 15606, 14166, 11949, 8341; Payload ID: 18440 relates to Category No.: 14919; Payload ID: 18441 relates to Category No.: 15626, 1893, 4021, 14086, 10005, 16211, 14090, 15412; Payload ID: 18442 relates to Category No.: 15626, 14640, 15523; Payload ID: 18443 relates to Category No.: 1512, 3244, 1730, 7743, 13981, 13883, 13905, 6494; Payload ID: 18444 relates to Category No.: 3244, 12638, 10583, 10372, 2303, 8112, 8002, 1451, 8243; Payload ID: 18445 relates to Category No.: 12913, 13981; Payload ID: 18446 relates to Category No.: 1512, 14663, 15640, 15639, 10158, 9410; Payload ID: 18447 relates to Category No.: 15618, 5846, 4948, 1836, 2902, 8601, 7340, 12592, 12617, 13409, 13408, 13696, 11349, 3675, 10348; Payload ID: 18448 relates to Category No.: 12091, 11237, 13925, 13104, 5912, 8522, 7834, 8611, 8635, 8636, 8222, 10947, 8387, 10563; Payload ID: 18449 relates to Category No.: 12091, 11237, 13104, 8522, 7834, 7971, 8137; Payload ID: 18450 relates to Category No.: 11237, 12091, 15490, 3398, 8739, 5446, 8731, 3398, 4186, 9891, 11588, 4127, 3775, 1867, 14663, 5541, 8988, 13831, 13104, 2009, 8522, 7834, 7971, 11242, 5810, 12914, 7974; Payload ID: 18451 relates to Category No.: 5936, 1204, 5732; Payload ID: 18453 relates to Category No.: 795, 1779, 7735, 7809; Payload ID: 18454 relates to Category No.: 13589, 3398, 11512, 8739, 1741, 15517, 1729, 4949, 14640, 3246, 9075, 12703, 15424, 9410, 673, 8731, 3398, 10602, 2376, 15610; Payload ID: 18455 relates to Category No.: 5785, 5446, 5285, 12994, 1238, 6145, 7131, 10491, 1752, 9000, 9008, 2877, 2884, 2296, 9004; Payload ID: 18456 relates to Category No.: 1026, 5446, 5285, 12994, 3049, 11178, 10583, 10307, 11276, 10233, 10336, 10338, 9777, 3729, 3141, 2043, 2089, 3156, 3142; Payload ID: 18457 relates to Category No.: 10074, 5446, 1451, 12994; Payload ID: 18458 relates to Category No.: 12994, 15185; Payload ID: 18459 relates to Category No.: 12994, 9777, 3729, 15189; Payload ID: 18462 relates to Category No.: 13589, 3398, 15490, 3398, 14212, 14915, 1867, 14663, 4439, 7546, 183, 14148, 181, 14149; Payload ID: 18463 relates to Category No.: 9500, 14663, 1878, 1308, 1603, 8434; Payload ID: 18464 relates to Category No.: 2412, 5030; Payload ID: 18465 relates to Category No.: 5446, 4186, 9891, 4127, 9125, 3775, 4439, 8988, 4441, 4442, 8763, 11657, 2116; Payload ID: 18466 relates to Category No.: 5446, 4186, 9891, 4127, 9125, 3775, 4439, 8988, 11130, 11129, 3001, 13618, 4442, 11657; Payload ID: 18467 relates to Category No.: 5446, 4186, 9891, 4127, 9125, 3775, 4439, 8988, 4441, 11130, 11129, 3001, 4442, 8763, 11657, 3642, 3641, 3592, 3602, 12894; Payload ID: 18468 relates to Category No.: 1737, 7154, 1078, 11425, 294, 12459; Payload ID: 18469 relates to Category No.: 12091, 1026, 14661, 10702, 13435, 10238, 803, 13485, 8988, 15616; Payload ID: 18470 relates to Category No.: 1512, 4634, 5446, 14663, 1514, 1838, 4305, 4304, 13000, 8265, 9982; Payload ID: 18471 relates to Category No.: 6814, 1512, 4706, 4521, 14663, 4538, 9616, 1482, 4623, 4630, 7306, 4625; Payload ID: 18472 relates to Category No.: 1204; Payload ID: 18473 relates to Category No.: 12153, 5446, 3021, 11606, 8817, 8821, 8820, 8731, 3398, 8370; Payload ID: 18474 relates to Category No.: 11843, 14565, 5446, 3837, 11109, 674, 10775, 13856, 11860, 10938, 10356, 8821, 8820; Payload ID: 18475 relates to Category No.: 5446, 11109, 11363, 8821; Payload ID: 18476 relates to Category No.: 5446, 11109, 11363, 11573, 6801, 8820, 11341, 8174; Payload ID: 18477 relates to Category No.: 11506, 3398, 5146, 10822, 5182, 14000, 10881, 13972, 11336, 13866, 13589, 3398; Payload ID: 18479 relates to Category No.: 1002, 11860, 13363; Payload ID: 18480 relates to Category No.: 12153, 13227; Payload ID: 18481 relates to Category No.: 1721, 12153, 2885, 5446, 12096, 8390, 11860, 12058, 11363, 11573, 5610, 10349, 8821, 8820, 11912, 13639, 12143, 8512, 11606; Payload ID: 18482 relates to Category No.: 13589, 3398, 5367, 15490, 3398, 14038, 12153, 2885, 11109, 3021, 10775, 8408, 16197, 11363, 5610, 13363, 12143; Payload ID: 18483 relates to Category No.: 10331, 14661, 12137, 5782, 12153, 16197; Payload ID: 18484 relates to Category No.: 12153, 15517, 12498, 11878, 1965, 13376, 11858, 12091, 8731, 3398, 11506, 3398, 7743, 10648, 13676, 1408, 13466; Payload ID: 18485 relates to Category No.: 12154, 2885, 5446, 11109, 3354, 3021, 10775, 16197, 8789, 12058, 11363, 5610, 13836, 15605, 3835, 13670, 13673, 8817, 8820; Payload ID: 18486 relates to Category No.: 2885, 5446, 11363, 8817, 5610, 8820; Payload ID: 18487 relates to Category No.: 15490, 3398, 9720, 8739, 5446, 849, 14838, 14097, 3698, 1780, 11969, 11363, 8522, 8782, 8004, 3783, 5609, 7675, 8821, 7579, 12143, 8150, 8820, 10194; Payload ID: 18488 relates to Category No.: 12153, 5446, 8731, 3398, 3354, 11506, 3398, 15521, 4439, 12120, 3812, 10521, 12066, 11510, 8820, 8739, 11512, 5406, 11858, 12091, 3566, 3606, 2652, 12897, 3338, 7884; Payload ID: 18489 relates to Category No.: 15517, 8739, 8529; Payload ID: 18490 relates to Category No.: 8862, 12137, 12153; Payload ID: 18491 relates to Category No.: 12153, 2885, 5446, 11363, 8817, 5610, 8821, 13673; Payload ID: 18492 relates to Category No.: 12154, 11091, 12153, 5446, 11109, 14034, 12096, 10775, 10366, 4094, 11363, 10362, 11243, 14029, 11573, 10370, 10349, 11300, 11087, 8177, 8821, 8820, 7990, 13639, 11568, 15425, 1021, 301, 10836, 10410; Payload ID: 18493 relates to Category No.: 15490, 3398, 12153, 8739, 8731, 3398, 15521, 4439, 15570, 7662, 13616; Payload ID: 18494 relates to Category No.: 2885, 3021, 11363, 5610, 12143; Payload ID: 18495 relates to Category No.: 795, 5446, 10238, 8318, 8820; Payload ID: 18496 relates to Category No.: 12619, 12153, 266; Payload ID: 18497 relates to Category No.: 15490, 3398, 8739, 11109, 8390, 11860, 11363, 494, 5134, 5136, 7775; Payload ID: 18498 relates to Category No.: 2885, 11109, 10775, 11363, 11606, 5610, 11843, 11967, 7860, 11607, 13010; Payload ID: 18499 relates to Category No.: 795, 12153, 10241, 8548; Payload ID: 18500 relates to Category No.: 12153, 5446, 12143; Payload ID: 18501 relates to Category No.: 12061, 8390, 8508, 8391, 8529; Payload ID: 18502 relates to Category No.: 12153; Payload ID: 18506 relates to Category No.: 1269; Payload ID: 18515 relates to Category No.: 1002, 2885, 5446, 11109, 3021, 10775, 16197, 11969, 11363, 10955, 339, 8817, 5610, 13363, 8820, 9597, 13076, 12143; Payload ID: 18516 relates to Category No.: 6814, 12839; Payload ID: 18517 relates to Category No.: 11109; Payload ID: 18518 relates to Category No.: 6986, 14565, 1730, 7306, 8300; Payload ID: 18519 relates to Category No.: 14565; Payload ID: 18520 relates to Category No.: 5446, 3021, 11969, 11573, 14030, 13639, 5603; Payload ID: 18521 relates to Category No.: 12153; Payload ID: 18522 relates to Category No.: 8103, 5446, 12153, 8817; Payload ID: 18523 relates to Category No.: 13925, 8818, 2012, 11174, 8004, 4290, 10491, 11176, 11536, 12143, 10479, 11574, 8731, 3398, 10648, 12096, 8653, 2145; Payload ID: 18526 relates to Category No.: 12153, 2885, 5446, 11109, 10775, 11363, 5610, 8821, 13670, 13673, 7942; Payload ID: 18527 relates to Category No.: 14565, 12153, 13830, 12891, 11843, 1951, 13859, 13893, 7340, 14619; Payload ID: 18532 relates to Category No.: 8731, 3398; Payload ID: 18533 relates to Category No.: 11094, 8552, 11299; Payload ID: 18534 relates to Category No.: 2885, 11860, 5610, 12487; Payload ID: 18535 relates to Category No.: 795, 12153; Payload ID: 18537 relates to Category No.: 8888, 8760, 4186, 11860, 4332, 13222, 14950, 8763, 12894, 7013, 136, 8887, 2080, 10649, 13367; Payload ID: 18538 relates to Category No.: 11940, 3986, 7345, 10065, 7348, 12153, 11843, 8117, 8356, 8120; Payload ID: 18542 relates to Category No.: 12153, 2885, 5446, 11109, 10775, 11363, 5610, 8820, 14949, 11275, 8821, 8817; Payload ID: 18543 relates to Category No.: 11843, 12153, 15157, 7681, 8642; Payload ID: 18544 relates to Category No.: 12153, 7306; Payload ID: 18545 relates to Category No.: 12153, 13970, 14000; Payload ID: 18547 relates to Category No.: 12194, 6219, 8862, 3684, 2169, 1277, 11878, 1893, 6445, 3791, 5855, 9631, 8920; Payload ID: 18548 relates to Category No.: 12194, 746, 12096; Payload ID: 18550 relates to Category No.: 14565, 3833, 10775, 12063, 2669, 1893, 6738, 11660; Payload ID: 18551 relates to Category No.: 15715, 15708, 15725; Payload ID: 18552 relates to Category No.: 6902, 15715, 15712, 4439, 15708, 1360, 13775; Payload ID: 18553 relates to Category No.: 15715, 15712, 4439, 1207; Payload ID: 18554 relates to Category No.: 15715, 15712, 4439, 15713; Payload ID: 18555 relates to Category No.: 15715, 15712, 4439, 15708; Payload ID: 18556 relates to Category No.: 6902; Payload ID: 18557 relates to Category No.: 6902, 15715, 7101; Payload ID: 18558 relates to Category No.: 15715, 15712, 4439, 15708, 6902; Payload ID: 18559 relates to Category No.: 15715, 15712, 4439, 15708, 9675, 14302; Payload ID: 18560 relates to Category No.: 15715, 15712, 4439; Payload ID: 18561 relates to Category No.: 15708, 15715, 15712, 4439; Payload ID: 18562 relates to Category No.: 15715, 1111; Payload ID: 18563 relates to Category No.: 14267, 14212; Payload ID: 18564 relates to Category No.: 14267, 15715, 14212; Payload ID: 18565 relates to Category No.: 15715, 15712, 4439, 15708; Payload ID: 18566 relates to Category No.: 15715, 15712, 4439, 15708; Payload ID: 18567 relates to Category No.: 15715, 15712, 4439, 15708; Payload ID: 18568 relates to Category No.: 15715, 15712, 4439, 15708; Payload ID: 18569 relates to Category No.: 15708, 11940, 7114; Payload ID: 18570 relates to Category No.: 6814, 16197; Payload ID: 18571 relates to Category No.: 14267, 15715, 12127, 4439, 15691, 15692; Payload ID: 18572 relates to Category No.: 15718, 16181, 13360; Payload ID: 18573 relates to Category No.: 14423; Payload ID: 18574 relates to Category No.: 15715, 15712, 4439, 11941; Payload ID: 18575 relates to Category No.: 9500, 15715, 15712, 4439; Payload ID: 18576 relates to Category No.: 6814, 9500; Payload ID: 18577 relates to Category No.: 6902, 15715, 15712, 4439; Payload ID: 18578 relates to Category No.: 9500, 15715, 15712, 4439, 16297; Payload ID: 18579 relates to Category No.: 5255, 3566, 7735; Payload ID: 18580 relates to Category No.: 1703; Payload ID: 18581 relates to Category No.: 1703, 11431; Payload ID: 18582 relates to Category No.: 12526, 1024, 14297; Payload ID: 18583 relates to Category No.: 286, 7340, 7390, 10108, 7342, 483, 6113; Payload ID: 18584 relates to Category No.: 8862, 286, 7340, 7390, 10108, 3853, 6103, 10687, 8956; Payload ID: 18585 relates to Category No.: 286, 7340, 7390, 10108, 274, 3853, 11028; Payload ID: 18586 relates to Category No.: 286, 7390, 10108, 7340; Payload ID: 18587 relates to Category No.: 2940, 7737, 13194, 7340, 16294, 10250, 12948, 10343, 7252, 14330, 11418, 1562, 16133, 7342, 14365, 2107, 10711, 5406; Payload ID: 18588 relates to Category No.: 7340, 7342, 12511; Payload ID: 18589 relates to Category No.: 7340, 7252, 7342, 1703; Payload ID: 18590 relates to Category No.: 7340, 7252, 7342, 9455, 1703; Payload ID: 18591 relates to Category No.: 13194, 1562, 16133, 7342, 12511, 13196, 15581, 13939, 3227; Payload ID: 18592 relates to Category No.: 13194, 14622, 7342; Payload ID: 18593 relates to Category No.: 14622, 13518, 1562, 7342, 16133, 15581, 13194; Payload ID: 18594 relates to Category No.: 11506, 3398, 14622, 1562, 7342, 13194; Payload ID: 18595 relates to Category No.: 4949, 4948, 1836, 14622, 1562, 16133, 7342, 16096, 7631, 13547, 13194, 15012, 13491; Payload ID: 18596 relates to Category No.: 14622, 7342, 8342, 13194, 15581, 14650; Payload ID: 18597 relates to Category No.: 10250, 12948, 16133, 7342, 13796, 7631, 13194, 4949, 7340, 14365, 966, 1562, 11934, 272, 13196; Payload ID: 18598 relates to Category No.: 14622, 13518, 7342, 12511, 13194; Payload ID: 18599 relates to Category No.: 15518, 2460, 14034, 14699, 5375; Payload ID: 18600 relates to Category No.: 15626, 7737, 11293, 10227; Payload ID: 18601 relates to Category No.: 15626, 10366, 7599, 11293, 4969; Payload ID: 18602 relates to Category No.: 14267, 12224, 15712, 7289, 14214; Payload ID: 18603 relates to Category No.: 14267, 12224, 15715, 14214; Payload ID: 18604 relates to Category No.: 12194, 11940, 12099, 12862; Payload ID: 18605 relates to Category No.: 12194, 3012, 4020, 4021; Payload ID: 18606 relates to Category No.: 12194; Payload ID: 18607 relates to Category No.: 12194; Payload ID: 18608 relates to Category No.: 12194; Payload ID: 18609 relates to Category No.: 9500, 15752, 15751, 15750, 14663, 1878, 15753; Payload ID: 18610 relates to Category No.: 6814, 9500, 843, 14663, 1878, 14508, 5416, 1276, 6553, 10606, 13883, 2469, 8420; Payload ID: 18611 relates to Category No.: 6814, 9500, 843, 14663, 1878, 14508, 5416, 1276, 13967, 13859, 13836, 13796, 13767, 2044, 2469; Payload ID: 18612 relates to Category No.: 15215; Payload ID: 18613 relates to Category No.: 4439, 15698, 15756, 16096; Payload ID: 18614 relates to Category No.: 690, 15588, 7743, 4439, 15698, 12488, 15756, 6814; Payload ID: 18615 relates to Category No.: 15601, 12777, 3559, 9420, 7108, 7109; Payload ID: 18616 relates to Category No.: 13589, 3398, 15517, 10238, 7613, 10372; Payload ID: 18617 relates to Category No.: 13589, 3398, 13973; Payload ID: 18618 relates to Category No.: 13589, 3398, 15618, 5846, 8739, 13973, 8626, 7574; Payload ID: 18619 relates to Category No.: 13589, 3398, 15490, 3398, 8731, 3398, 13973; Payload ID: 18620 relates to Category No.: 7288, 14216, 3656, 15715, 4439, 15718, 16181; Payload ID: 18621 relates to Category No.: 15733, 14216, 3656, 14216, 15718, 16181, 7288, 15715, 4439; Payload ID: 18622 relates to Category No.: 7288, 15733, 14216, 3656, 15715, 14216, 4439, 15718, 16181; Payload ID: 18623 relates to Category No.: 15733, 14216, 3656, 14216, 7288, 15715, 4439, 15718, 16181; Payload ID: 18624 relates to Category No.: 5782, 16172, 16158, 16160; Payload ID: 18626 relates to Category No.: 9274, 1204; Payload ID: 18627 relates to Category No.: 13589, 3398, 15490, 3398, 1721, 3684, 13465, 2409, 9274, 13360, 1893, 7735, 7890, 7724, 5855; Payload ID: 18628 relates to Category No.: 9274; Payload ID: 18629 relates to Category No.: 10372, 9274, 12936, 11298, 11266, 1978; Payload ID: 18630 relates to Category No.: 9274; Payload ID: 18631 relates to Category No.: 14177, 14175; Payload ID: 18632 relates to Category No.: 6637, 151, 6360; Payload ID: 18633 relates to Category No.: 6636; Payload ID: 18635 relates to Category No.: 12891, 1463, 6080, 2709, 8831, 718, 2444; Payload ID: 18636 relates to Category No.: 12091, 9720, 14905, 10372, 11167, 7168, 7163, 2430, 7134; Payload ID: 18637 relates to Category No.: 15601, 9420, 7108, 7109; Payload ID: 18638 relates to Category No.: 11182, 12411, 12040, 9777, 12432, 14056, 9994, 14456, 13874, 12011; Payload ID: 18639 relates to Category No.: 9994, 16214, 14057, 3038, 4059, 11182, 3140, 12411, 12040, 9777, 12432, 16172, 14056; Payload ID: 18640 relates to Category No.: 16214, 12411, 12040; Payload ID: 18641 relates to Category No.: 4828, 13589, 3398, 12931, 12411, 12040, 8639, 724, 8887, 3571, 3578, 8640, 1295, 8889, 13492, 3444, 14700, 1269, 6192, 8888, 3600, 2177, 4394, 8641, 1333; Payload ID: 18642 relates to Category No.: 13589, 3398, 5785, 12153, 12013; Payload ID: 18643 relates to Category No.: 1722, 12619, 8760, 1820, 7743, 8728, 337, 15521, 14311, 4439, 5541, 13618, 12117, 13515, 13888, 8117, 13311, 10629, 12652, 2243, 5949, 8887, 15143, 403, 11676, 13360, 7369, 1779, 1557, 8862, 5073, 4536, 7748, 6760, 11934, 12459, 12882, 12603; Payload ID: 18644 relates to Category No.: 1722, 10702, 12619, 16172, 3639, 5446, 4949, 7743, 8728, 4186, 13485, 12798, 10175, 11949, 8831, 9891, 15521, 4127, 3775, 4439, 16197, 5541, 8988, 11997, 8117, 8524, 8522, 8887, 8458, 13003, 11980, 5552, 11512, 9854, 13882, 2009, 4536, 12140; Payload ID: 18645 relates to Category No.: 11926, 1893, 15768, 2994, 11629; Payload ID: 18646 relates to Category No.: 8862, 1730, 1893, 2994; Payload ID: 18647 relates to Category No.: 1764, 11926, 1893, 2994, 11629; Payload ID: 18648 relates to Category No.: 11926, 10702, 6969, 1183, 1893, 448, 2994, 7755, 11629, 8301; Payload ID: 18649 relates to Category No.: 11926, 1893, 2994, 11629, 15588, 11634, 6969, 483, 1048, 3194, 7329, 9741; Payload ID: 18651 relates to Category No.: 7306, 15149, 480, 12093, 14816, 16162; Payload ID: 18653 relates to Category No.: 6967, 11245, 6980, 11286; Payload ID: 18655 relates to Category No.: 6967, 6980; Payload ID: 18656 relates to Category No.: 1894, 6969, 12522; Payload ID: 18657 relates to Category No.: 12093, 1894, 2460, 3808, 1047, 2464; Payload ID: 18658 relates to Category No.: 1894; Payload ID: 18659 relates to Category No.: 1894, 12093, 6982; Payload ID: 18660 relates to Category No.: 1894; Payload ID: 18661 relates to Category No.: 1894; Payload ID: 18662 relates to Category No.: 1894, 2459, 1047, 12094; Payload ID: 18663 relates to Category No.: 1894, 12093; Payload ID: 18664 relates to Category No.: 1894, 15490, 3398, 14838, 14831, 4167, 12093, 14816; Payload ID: 18665 relates to Category No.: 1894, 12093, 6967, 10440, 6982; Payload ID: 18666 relates to Category No.: 8862, 1730, 1894, 12093; Payload ID: 18667 relates to Category No.: 1894, 2459, 12094; Payload ID: 18668 relates to Category No.: 1894; Payload ID: 18669 relates to Category No.: 1737, 6986, 12095, 11926, 2941, 9420, 1893, 7132, 4336, 2994, 6814; Payload ID: 18670 relates to Category No.: 1737, 6986, 12095, 11926, 2941, 1893, 2994, 2020, 6969, 6814; Payload ID: 18671 relates to Category No.: 6814, 6986, 12095, 1737, 11926, 2941, 1893, 2994; Payload ID: 18672 relates to Category No.: 6986, 12095, 11926, 1893, 2994; Payload ID: 18673 relates to Category No.: 6986, 12095, 11926, 1893, 2994; Payload ID: 18674 relates to Category No.: 6814, 6986, 12095, 1204; Payload ID: 18675 relates to Category No.: 6986, 12095, 11926, 10074, 9420, 1893, 7132, 4336, 1238, 10080, 2994, 6814; Payload ID: 18676 relates to Category No.: 6814, 6986, 1204; Payload ID: 18677 relates to Category No.: 6814, 6986, 12095; Payload ID: 18678 relates to Category No.: 6814, 6986, 12095; Payload ID: 18679 relates to Category No.: 6986, 12095, 11926, 1893, 2994, 14894; Payload ID: 18680 relates to Category No.: 6986, 12095, 11926, 1893, 2994; Payload ID: 18681 relates to Category No.: 6986, 12095, 11926, 1893, 8934, 2994; Payload ID: 18682 relates to Category No.: 6814, 6986, 1026, 12095, 11926, 1893, 2994, 7154, 8929; Payload ID: 18683 relates to Category No.: 6986, 12095, 11926, 9420, 1893, 7132, 4336, 2994, 6814; Payload ID: 18684 relates to Category No.: 6986, 12095, 11926, 9420, 1893, 7132, 4336, 7252, 2994, 7540; Payload ID: 18685 relates to Category No.: 6814, 6986, 12095, 11926, 1893, 2994; Payload ID: 18686 relates to Category No.: 6814, 6986, 12095, 1204; Payload ID: 18687 relates to Category No.: 1737, 6814, 6986, 12095, 2941, 9420, 7132, 4336, 7252, 1886, 7540, 14894; Payload ID: 18688 relates to Category No.: 6814, 6986, 12095, 1730, 7306, 14838; Payload ID: 18689 relates to Category No.: 6814, 6986, 12095, 2195; Payload ID: 18690 relates to Category No.: 6814, 6986, 12095, 6975, 6969, 9420, 2902, 6695, 7132, 4336; Payload ID: 18691 relates to Category No.: 6814, 6986, 12095, 6975, 2902, 7132, 4336; Payload ID: 18692 relates to Category No.: 6975, 6969, 2196, 7162, 11884, 2902, 7132, 4336, 6687, 5746; Payload ID: 18693 relates to Category No.: 6975, 6969, 2196, 7162, 2902, 7132, 14586, 4336, 6687, 5746; Payload ID: 18694 relates to Category No.: 6969, 6975, 2196, 7162, 11884, 2902, 7132, 4336, 6687, 5746; Payload ID: 18695 relates to Category No.: 6969; Payload ID: 18696 relates to Category No.: 6975, 6969, 2196, 7162, 2902, 7132, 4336, 6687, 5746; Payload ID: 18697 relates to Category No.: 5367, 12427, 12194, 1703; Payload ID: 18698 relates to Category No.: 12194, 5367, 3691, 1703, 12427; Payload ID: 18699 relates to Category No.: 1730, 14838, 4439, 4167, 4442, 10031, 3339, 6532; Payload ID: 18700 relates to Category No.: 7306, 14838, 6670, 4439, 4442, 10031, 3339, 4458; Payload ID: 18702 relates to Category No.: 1730, 14270, 7306, 7291, 16182, 12891, 14838, 1204, 4439, 4167, 11294, 4442, 10031, 3339, 6532; Payload ID: 18704 relates to Category No.: 13259, 2409; Payload ID: 18705 relates to Category No.: 14834, 3339, 9536; Payload ID: 18706 relates to Category No.: 7306, 14838, 4439, 4442, 10031, 4458; Payload ID: 18707 relates to Category No.: 14838, 11658, 6117, 6114, 4458; Payload ID: 18708 relates to Category No.: 1730, 14267, 7306, 14838, 4439, 4167, 4442, 10031, 3339, 6532; Payload ID: 18709 relates to Category No.: 1272, 9320; Payload ID: 18710 relates to Category No.: 13589, 3398, 14267, 7291, 16182, 1206, 14914; Payload ID: 18711 relates to Category No.: 5367; Payload ID: 18712 relates to Category No.: 334, 5367, 14565, 795, 10238, 1816, 1795, 10775, 7840, 11765, 7548, 11322, 4039, 336, 13217, 11766, 12858, 10470, 10600; Payload ID: 18713 relates to Category No.: 5367, 11512, 2885, 11109, 15782, 10954, 11363, 7216, 9459, 10760, 11150, 10289, 11445, 10456, 10619, 15432, 10584, 10862, 11940, 9410, 344, 10775, 3846, 9451, 10878, 11266, 6553, 9569, 13280, 11201, 1277, 1408, 6562, 9462, 11149; Payload ID: 18714 relates to Category No.: 690, 5367, 14565, 795, 1730, 803, 15782, 10558, 11243, 3713, 10226, 10600, 4039; Payload ID: 18715 relates to Category No.: 5367, 14565, 13186, 4439, 15782, 10874, 5381, 10372, 12994, 10650, 5383; Payload ID: 18716 relates to Category No.: 5367, 14565, 10372, 1780, 15782, 10266, 5387, 11460, 1061, 12994, 15192, 1058, 10650; Payload ID: 18717 relates to Category No.: 5367, 14565, 795, 15197, 7840, 15782, 15185, 2051, 13693, 15203, 11062, 11063, 15192, 11449; Payload ID: 18718 relates to Category No.: 334, 5367, 14565, 15782, 352, 2877, 795; Payload ID: 18719 relates to Category No.: 5367, 14565, 7613, 403, 1816, 11109, 15782, 10343, 11581, 10904, 13562, 15204, 10790, 11255, 10942, 11037, 8708, 12755; Payload ID: 18720 relates to Category No.: 5367, 14565, 14038, 10372, 8731, 3398, 12999, 10262, 15782, 2041, 10790, 11460, 8129, 10845, 8145, 10814, 10826, 10829, 10851, 8611, 2100, 11451, 379, 10787, 10832, 11486, 12477, 8564, 10981, 3017, 11569, 10784, 6759, 15333, 13963, 10339, 575, 8705, 10219, 2284, 10339, 573, 10846, 2355, 5428, 7847, 11450, 2072, 1684, 573, 10980, 11484, 2878, 10197, 10840, 15203; Payload ID: 18721 relates to Category No.: 5367, 14565, 795, 1816, 1780, 11512, 3016, 1687, 575; Payload ID: 18722 relates to Category No.: 5367, 14565, 795, 1816, 1780, 10488, 10197, 12646, 10851, 7377, 10814, 10829; Payload ID: 18723 relates to Category No.: 334, 5367, 14565, 5428, 795, 7306, 1795, 12646, 7840, 11765, 15782, 13925, 352, 7548, 2051, 4039, 336, 4041, 13217, 15485, 11766, 12858; Payload ID: 18724 relates to Category No.: 334, 5367, 14565, 5428, 795, 12498, 7306, 1795, 10775, 12646, 7840, 11765, 15782, 13925, 352, 13831, 7548, 2051, 4039, 336, 4041, 13217, 11766, 12858, 5810; Payload ID: 18725 relates to Category No.: 5367, 14565, 5428, 7306, 12646, 7840, 15782, 13925, 4041; Payload ID: 18726 relates to Category No.: 5367, 14565, 5428, 7613, 7306, 12646, 7840, 15782, 13925, 4041; Payload ID: 18727 relates to Category No.: 14565, 5428, 10372, 403, 1816, 11109, 12498, 13818, 803, 15782, 13925, 11363, 14029, 7216, 13893, 10879, 9459, 10619, 15432, 10584, 2472, 7306, 9451, 6553, 6403, 13996; Payload ID: 18728 relates to Category No.: 5367, 14565, 5428, 12498, 803, 14640, 12646, 15782, 13925, 10955, 4021, 8413, 13886, 13827, 13836, 13966, 13932, 7667, 13784; Payload ID: 18729 relates to Category No.: 690, 10238, 15782, 10600, 13682, 1703, 15045, 1710, 10257, 4039, 12488; Payload ID: 18730 relates to Category No.: 403, 1795, 15782, 4969, 1061, 7644; Payload ID: 18731 relates to Category No.: 403, 15782, 10266, 11460, 1061, 12994, 10813, 15192, 1058, 10650; Payload ID: 18732 relates to Category No.: 5367, 5428, 12498, 7306, 803, 1795, 12646, 15782, 13925, 10955, 16189, 15192, 11178, 3015, 3016, 10479, 7591, 11459;

Payload ID: 18733 relates to Category No.: 14565, 403, 7306, 1780, 15782, 6413; Payload ID: 18734 relates to Category No.: 5367, 14565, 5428, 7613, 7306, 12646, 15782, 13925, 10343, 4041, 11581, 10904; Payload ID: 18735 relates to Category No.: 795, 15782, 5912, 4937, 10775; Payload ID: 18736 relates to Category No.: 5367, 11512, 14565, 5428, 2885, 5359, 12498, 7306, 1795, 10775, 12646, 16197, 15782, 13925, 8112, 10790, 11808, 2051, 4041, 3910, 13635, 12836, 10404, 3009, 11581, 3013, 5808, 3012; Payload ID: 18737 relates to Category No.: 5367, 5428, 12498, 7306, 803, 12646, 15782, 2041, 10955, 10978, 5808, 1795, 4039, 8112, 14200, 13925, 496, 1993; Payload ID: 18738 relates to Category No.: 5367, 15207, 14565, 5428, 795, 403, 12498, 5285, 803, 7369, 12646, 1867, 14663, 15782, 13925, 2136, 7644, 8347, 1055, 8688, 13266, 8923, 9346, 8157, 8144, 8139; Payload ID: 18739 relates to Category No.: 5367, 14565, 5428, 795, 12498, 7306, 803, 1795, 12646, 15782, 13925, 10955; Payload ID: 18740 relates to Category No.: 5367, 5428, 8731, 3398, 12498, 10266, 7306, 803, 12646, 15782, 13925, 10955, 8611, 16189, 15203, 10787, 13360, 7847, 1849; Payload ID: 18741 relates to Category No.: 5367, 5428, 7613, 7306, 803, 12646, 15782, 13925, 10955; Payload ID: 18742 relates to Category No.: 5367, 14565, 5428, 10238, 7306, 803, 7743, 15782, 13925, 11565, 2051, 11504; Payload ID: 18743 relates to Category No.: 5367, 5428, 795, 12498, 7306, 7743, 15782, 13925, 4041, 12646, 11942, 8139, 8142; Payload ID: 18744 relates to Category No.: 5367, 11940, 11843, 795, 12153, 1752, 3356, 3564, 15000, 8584, 10522; Payload ID: 18745 relates to Category No.: 3986, 3984, 690, 1730; Payload ID: 18746 relates to Category No.: 11915, 5428, 795, 5446, 1795, 12999, 15782, 8390, 8789, 8721, 8723, 8114, 8112, 2041, 15437, 13947, 11243, 8782, 8159, 12066, 11968, 7919, 11967, 9292, 6125, 13635, 9295, 8547, 7967, 8103, 8425, 8636, 7667, 8149, 2001, 1072, 12898, 8722, 11958, 12749, 7641, 13656, 11966, 11916, 7716, 7728, 10392, 7835, 13952, 10724, 8411, 3911, 8133, 7806, 8724, 8410; Payload ID: 18747 relates to Category No.: 14565, 5428, 1703, 1816, 8112; Payload ID: 18748 relates to Category No.: 7613, 7840, 3016, 5616; Payload ID: 18749 relates to Category No.: 8728; Payload ID: 18750 relates to Category No.: 5446, 8112, 8677; Payload ID: 18751 relates to Category No.: 9950, 11266, 10583, 11186, 13071, 5490; Payload ID: 18752 relates to Category No.: 674, 1060, 14403; Payload ID: 18753 relates to Category No.: 10241, 10878, 4336, 10954; Payload ID: 18754 relates to Category No.: 12646; Payload ID: 18756 relates to Category No.: 13589, 3398, 15490, 3398, 795, 1721, 14052, 10737, 2139, 11089, 12133, 11512, 1722, 1730, 7613, 8739, 9296, 8731, 3398, 1955, 10238, 12498, 3354, 7306, 7743, 11506, 3398, 1983, 3448, 5809, 12391, 15521, 3313, 14568, 13856, 7148, 1780, 1089, 9125, 11884, 11765, 10648, 7735, 4439, 16197, 3313, 14567, 11307, 1238, 2022, 11997, 1892, 3313, 14566, 11178, 11322, 9511, 1957, 10864, 5806, 3743, 2006, 13734, 11282, 1709, 10350, 5807, 11520, 11260, 13779, 9346, 2466, 3827, 3370, 7990, 3167, 2403, 13158, 8060, 11488, 10591, 13594, 12646, 5406, 7303, 13827, 2235, 13975, 11949, 15606, 15204, 12619, 2421, 8554, 14793, 15570, 4949, 2169, 8549, 13578, 8923, 2424, 14034, 13227, 3602, 7037, 8318, 12676, 4418, 3565, 8756, 7133, 15195, 12876, 7548, 7890, 14320, 13159, 13692, 8368, 1580, 13909, 10319, 8242, 8022, 2142, 1063, 11521, 15199, 14003, 13585, 11019, 12925, 13037, 5812; Payload ID: 18757 relates to Category No.: 15490, 3398, 11512, 3452, 1955, 3354, 11506, 3398, 3448, 3309, 3453, 11363, 2155; Payload ID: 18758 relates to Category No.: 14565, 1721, 11371, 7724, 5807, 10591, 13904, 4949, 2169, 3565, 11090; Payload ID: 18759 relates to Category No.: 15490, 3398, 1722, 795, 998, 7743, 11506, 3398, 7737, 14015, 10256, 996, 10238, 10241, 2139, 13867, 1966, 2002, 2057; Payload ID: 18760 relates to Category No.: 15490, 3398, 998, 11506, 3398, 10256, 6451, 15898, 9455, 15425, 7764; Payload ID: 18761 relates to Category No.: 7743, 14015; Payload ID: 18763 relates to Category No.: 9500, 7513; Payload ID: 18764 relates to Category No.: 795; Payload ID: 18765 relates to Category No.: 13589, 3398, 11512, 795, 14052, 2139, 7613, 8739, 8731, 3398, 1955, 11506, 3398, 12133, 5809, 15521, 3313, 14568, 13856, 7148, 9125, 4439, 13227, 11125, 11941, 11147, 3913, 7773, 10622, 12817, 10352, 4937, 15517, 1730, 9599, 673, 10241, 9410, 4939, 3790, 2411, 14640, 11628, 8923, 8195, 3781, 3595, 5941, 5939, 10983, 3791, 7305, 11821, 9321, 12734, 8286, 14697, 12213, 3896, 11826, 10883, 1709, 7239, 14931, 3531, 3770, 10113, 14645, 15135, 4136, 16019, 2523, 14838, 13733; Payload ID: 18767 relates to Category No.: 1204; Payload ID: 18768 relates to Category No.: 13589, 3398, 7018, 11512, 795, 14052, 2139, 5808, 8739, 1955, 15517, 13166, 7743, 11506, 3398, 12133, 5809, 12891, 8193, 3313, 14568, 13856, 7148, 8373, 16197, 7701, 10350, 11634, 5428, 10241, 8928, 4251, 1722, 13227, 5073, 2254, 10378, 3247, 10867, 13827, 13971, 12388, 5949, 8375, 345, 11138, 15490, 3398; Payload ID: 18769 relates to Category No.: 14038, 7613, 12498, 1417, 1836, 8177, 14949, 7903; Payload ID: 18773 relates to Category No.: 1721, 1816, 1780, 3015, 9777, 5428, 13161, 1751, 13397, 10826, 8145, 7537, 5648, 13821, 9008, 2291; Payload ID: 18774 relates to Category No.: 15618, 1790, 2562, 12062, 12063, 1893, 6482, 6480, 11660; Payload ID: 18775 relates to Category No.: 13790; Payload ID: 18776 relates to Category No.: 12137, 1894, 1737, 3691, 16197, 16193, 16202, 16198, 6738, 5790, 13104, 11609, 10595, 11610, 15899, 16185, 12852, 13669, 11605, 1730, 8731, 3398, 7743, 12633, 1722, 5939, 11586, 12058, 3699; Payload ID: 18777 relates to Category No.: 16214, 1795, 1780, 8667, 8661, 7740, 7938, 7670, 8600, 12824, 11412, 16009; Payload ID: 18778 relates to Category No.: 16172, 12105; Payload ID: 18779 relates to Category No.: 15618, 2331, 5846, 5871, 2329, 5869, 12492; Payload ID: 18780 relates to Category No.: 2329; Payload ID: 18781 relates to Category No.: 15618, 2331, 5846, 2329; Payload ID: 18782 relates to Category No.: 14475, 7567, 12468, 9720, 1078; Payload ID: 18783 relates to Category No.: 12459, 14475, 1779, 1078, 10257, 7567, 2110, 10889, 11094, 1993, 13151; Payload ID: 18784 relates to Category No.: 15490, 3398, 11512, 8739, 8731, 3398, 8421, 3575, 7345, 10648, 12553, 9451, 11036, 10852, 11566, 10370, 3578, 8458, 2006, 7773, 10578, 9476, 14123, 10226, 7883, 14566, 10527, 5443, 8086, 7897, 11536, 4065, 761, 10608, 2755, 3572, 1785, 1730, 5406, 8934, 8887, 7613, 3613, 8611, 9455, 3622, 7730, 3595, 5071, 3584, 8782, 8626, 3594, 8323, 7178, 8072, 8666, 1574, 1575, 8452, 8429, 10541, 1993, 9540, 9320, 10574, 1269; Payload ID: 18785 relates to Category No.: 15490, 3398, 8731, 3398, 8421, 8739, 13594, 7743, 9455, 8349, 7879, 3575, 8782, 2698, 4067, 10883, 8323, 7613; Payload ID: 18786 relates to Category No.: 15490, 3398, 15516, 4439, 12891, 3783, 8004, 3783, 15520, 15498, 15290; Payload ID: 18787 relates to Category No.: 1730, 1463, 4998, 4251, 8421, 10286, 9451, 6796, 7662, 1257, 15424, 14360; Payload ID: 18788 relates to Category No.: 5846, 1415, 6724, 1417, 15618, 13041, 5848; Payload ID: 18789 relates to Category No.: 15618, 5848, 5846, 1415, 6724, 1417, 14693, 1836, 1451, 5848, 6445, 13695, 14045; Payload ID: 18790 relates to Category No.: 12091, 13594, 11512, 15207, 15614, 9717, 5446, 403, 15517, 12646, 11858, 15194, 10814, 2878, 355, 10816, 9070, 5606, 5694; Payload ID: 18791 relates to Category No.: 1026, 5785, 14565, 5446, 12994, 1849, 5592, 6460, 13279, 8997; Payload ID: 18792 relates to Category No.: 12091, 9720, 14565, 1703, 15043, 10074, 9854, 14569, 14838, 8373, 8114, 8112, 11858, 10075, 9490, 16189, 8925, 11980, 14404, 8726, 790, 4250, 7537, 16069, 8236; Payload ID: 18793 relates to Category No.: 6814, 9500, 16214, 14663, 1878, 6697, 4062, 6698, 15400, 1780, 10025, 13797, 14034, 14045; Payload ID: 18794 relates to Category No.: 9500, 6697, 6814, 10972, 10025, 6705, 6699, 6713, 209; Payload ID: 18795 relates to Category No.: 10331, 1026, 14661, 795, 13186, 5446, 6606, 348, 4186, 12391, 15521, 4127, 3775, 11765, 4439, 16197, 6738, 5541, 16085, 8988, 5072, 5806, 11260, 8511, 2910, 12122, 8731, 3398, 11934; Payload ID: 18796 relates to Category No.: 14661, 5785, 795, 803, 15521, 9420, 11765, 4439, 16197, 6738, 7132, 8988, 4336, 5072, 15042, 13127, 1995, 12954, 13329, 5806, 12671, 11260, 12734, 6751, 12956, 8445, 2243, 8934, 5073, 12122, 8511; Payload ID: 18797 relates to Category No.: 14661, 5782, 795, 6724, 11506, 3398, 13496, 15521, 11765, 4439, 6738, 4518, 15042, 13530, 13229, 5806, 13497, 11260, 4513, 7864; Payload ID: 18798 relates to Category No.: 14661, 795, 13465, 15521, 8541, 9420, 11765, 4439, 6738, 7132, 4336, 13530, 8522, 13229, 5806, 11260, 12122, 2009; Payload ID: 18799 relates to Category No.: 14661, 795, 8731, 3398, 15521, 11765, 4439, 6738, 15042, 5806, 11260, 8183; Payload ID: 18800 relates to Category No.: 14661, 14565, 795, 13186, 7613, 10074, 15521, 11765, 4439, 6738, 1238, 3881, 4767, 5806, 11260, 12626, 12122, 9982; Payload ID: 18801 relates to Category No.: 1207, 1830, 843, 14663, 1878, 6343, 15834, 84, 4576, 842, 13969, 13859, 13938, 13975; Payload ID: 18802 relates to Category No.: 9500, 674, 6296, 4949, 16214, 843, 14663, 1878, 13882, 15149, 3436, 4059, 12948, 6102, 9410, 6758, 4953, 8970, 10025, 1638, 13837, 3426, 3425, 3785, 9110, 3573, 6629, 3529, 13835, 13967, 1984, 13969, 13925, 13827, 13815, 13767, 10006, 13775, 13870, 13939, 14054, 15152, 1957, 13981, 13887, 14011, 13883, 13921, 13865, 13961, 13838, 1901, 1993, 13829, 13995, 14456, 4110, 2243, 2562, 14048, 14865, 7305, 5900, 10010, 14729, 14003, 2050, 2069, 4725, 13910, 15294, 2470; Payload ID: 18803 relates to Category No.: 12091, 1730, 15614, 1752, 9717, 5446, 12646, 5785, 2885, 15817, 13640; Payload ID: 18804 relates to Category No.: 12091, 690, 14565, 9720, 6795, 5406, 7598, 7737, 1240, 14000, 10058, 16096; Payload ID: 18805 relates to Category No.: 12091, 1730, 15614, 1752, 9717, 5446, 12646, 11858, 7735, 8552; Payload ID: 18806 relates to Category No.: 1730, 15614, 1752, 9717, 5446, 12646, 12091, 14661, 9982, 3639, 1795, 11178, 8049, 12719; Payload ID: 18807 relates to Category No.: 12091, 9720; Payload ID: 18808 relates to Category No.: 3354, 9228, 3448, 14590; Payload ID: 18809 relates to Category No.: 9228, 1795, 3448, 8408; Payload ID: 18810 relates to Category No.: 5428, 9721; Payload ID: 18811 relates to Category No.: 9721, 4328, 11726; Payload ID: 18812 relates to Category No.: 14565, 795, 15842, 4439, 15698; Payload ID: 18813 relates to Category No.: 15588, 15842, 4439, 15698, 15696, 7116; Payload ID: 18814 relates to Category No.: 7288, 15517, 7291, 16182, 14271, 15291, 4439, 7280, 7261, 13165, 11294; Payload ID: 18815 relates to Category No.: 7288, 14271; Payload ID: 18817 relates to Category No.: 7288, 15517, 7291, 16182, 14271, 15291, 4439, 7280, 7261, 13165, 8335, 16182, 11294, 11345; Payload ID: 18818 relates to Category No.: 14267; Payload ID: 18819 relates to Category No.: 12091, 1722, 9713, 8936, 11858, 11550, 13352; Payload ID: 18821 relates to Category No.: 7288, 9228, 14271, 15871, 14216, 3994; Payload ID: 18823 relates to Category No.: 12153; Payload ID: 18824 relates to Category No.: 12017, 8583, 3829; Payload ID: 18827 relates to Category No.: 12061; Payload ID: 18828 relates to Category No.: 15883, 6762, 16231, 6814; Payload ID: 18829 relates to Category No.: 13594, 2409, 16197, 8454, 3365; Payload ID: 18830 relates to Category No.: 13594; Payload ID: 18831 relates to Category No.: 3837, 11298, 13831, 13283, 13383, 2006, 10581, 13095, 12517, 492, 7634, 8660, 8722; Payload ID: 18832 relates to Category No.: 1002, 3837, 10581, 13095, 12517, 7813, 8039; Payload ID: 18834 relates to Category No.: 1002, 13338, 7634; Payload ID: 18836 relates to Category No.: 9500, 13755, 7039, 15880, 1874, 14663, 486, 9506; Payload ID: 18837 relates to Category No.: 7093, 11024; Payload ID: 18838 relates to Category No.: 13004, 7093, 13474, 10392, 13282, 11024; Payload ID: 18839 relates to Category No.: 7039, 15880, 7093, 927, 2768, 7094; Payload ID: 18840 relates to Category No.: 9500, 5297, 12099, 13755, 7039, 15880, 1874, 14663, 486, 9506, 13767, 13770; Payload ID: 18841 relates to Category No.: 12194, 12099, 13755, 7039, 15880, 1874, 14663, 486, 9506; Payload ID: 18842 relates to Category No.: 9500, 5297, 13755, 7039, 15880, 1874, 14663, 486, 9506; Payload ID: 18843 relates to Category No.: 5297, 7039, 15880; Payload ID: 18844 relates to Category No.: 5297, 13755, 1874, 14663, 2229, 12285, 5073, 5334, 6995, 15325, 15048, 10167; Payload ID: 18845 relates to Category No.: 5297, 13755, 7039, 15880, 1874, 14663; Payload ID: 18846 relates to Category No.: 5297, 13755, 1874, 14663, 4448; Payload ID: 18847 relates to Category No.: 9500, 5297, 13755, 1874, 14663, 13874, 13827, 13779; Payload ID: 18848 relates to Category No.: 1026, 15588, 15601, 15618, 15490, 3398, 14661, 11512, 15207, 3691, 795, 1512, 2885, 13186, 7613, 8739, 5846, 1894, 3452, 9296, 5446, 10238, 6606, 348, 5359, 9038, 11109, 12498, 15603, 3354, 746, 14934, 345, 803, 4186, 1795, 15604, 3852, 3448, 8756, 12096, 7362, 10775, 12391, 15521, 7693, 4127, 9125, 3775, 11765, 1893, 14663, 4439, 16197, 16193, 16202, 16198, 6738, 5790, 7132, 14992, 742, 15223, 3313, 14567, 5541, 670, 15782, 742, 16085, 8988, 11587, 13644, 10314, 8789, 4538, 4336, 5750, 15003, 15570, 4332, 5912, 15456, 15450, 7363, 15448, 6451, 15443, 4685, 15454, 2469, 7548, 9223, 9103, 11573, 15533, 15446, 15653, 15457, 15458, 13217, 11766, 8797, 9123, 15451, 2006, 10491, 9292, 6125, 13597, 13635, 9295, 15605, 7933, 16201, 9296, 3327, 6453, 3313, 3132, 4485, 9296, 3311, 9296, 3322, 13639, 3851; Payload ID: 18849 relates to Category No.: 12737, 8689; Payload ID: 18850 relates to Category No.: 9718, 8424, 8522, 13280, 13408, 8617, 8477, 7667; Payload ID: 18851 relates to Category No.: 12137, 15899; Payload ID: 18854 relates to Category No.: 1202, 4971; Payload ID: 18855 relates to Category No.: 1026, 15618, 15490, 3398, 14661, 13337, 11512, 15207, 3691, 795, 1512, 2885, 13186, 7613, 8739, 5846, 3452, 9296, 5446, 10238, 6606, 348, 5359, 9038, 11109, 12498, 3354, 746, 345, 803, 4186, 1795, 3852, 3448, 8756, 12096, 7362, 10775, 12391, 15521, 7693, 4127, 8940, 9125, 3775, 11765, 14663, 4439, 16197, 16193, 16202, 16198, 6738, 5790, 7132, 14992, 742, 15223, 3313, 14567, 5541, 670, 15782, 742, 16085, 8988, 11587, 13644, 10314, 8789, 4538, 4336, 11298, 5750, 15003, 15570, 13161, 4332, 5912, 15456, 15450, 7363, 15448, 6451, 15443, 4685, 15454, 2469, 7124, 7548, 11573, 15533, 15446, 15653, 15457, 15458, 13217, 11766, 8797, 9123, 15451, 2006, 9292, 6125, 13597, 13635, 9295, 15605, 7933, 9296, 3327, 6453, 3313, 3132, 13228, 4485, 9296, 3311, 9296, 3322, 13639, 3851, 10865, 11281, 6530, 6535, 14442, 455, 4138, 3727, 4095, 15891, 4141, 5335; Payload ID: 18856 relates to Category No.: 1026, 15618, 15490, 3398, 14661, 11512, 15207, 3691, 795, 1512, 2885, 13186, 7613, 8739, 5846, 3452, 9296, 5446, 10238, 6606, 348, 5359, 9038, 11109, 12498, 3354, 746, 345, 803, 4186, 1795, 3852, 3448, 8756, 12096, 7362, 10775, 12391, 15521, 7693, 4127, 9125, 3775, 11765, 14663, 4439, 16197, 16193, 16202, 16198, 6738, 5790, 7132, 14992, 742, 15223, 3313, 14567, 5541, 670, 15782, 742, 16085, 8988, 11587, 13644, 10314, 8789, 4538, 4336, 5750, 15003, 15570, 4332, 5912, 15456, 15450, 7363, 15448, 6451, 15443, 4685, 15454, 2469, 7548, 11573, 15533, 15446, 15653, 15457, 15458, 13217, 11766, 8797, 9123, 15451, 2006, 9292, 6125, 13597, 13635, 9295, 15605, 7933, 9296, 3327, 6453, 3313, 3132, 4485, 9296, 3311, 9296, 3322, 13639, 3851, 15891; Payload ID: 18857 relates to Category No.: 15898, 11915, 11843, 8255, 484, 1048, 1780, 7341, 8919, 1032, 13909, 3529, 1034, 14454, 12194; Payload ID: 18858 relates to Category No.: 15898, 11915, 11878; Payload ID: 18859 relates to Category No.: 15898, 13589, 3398, 15490, 3398, 13337, 11915, 7912, 3354, 3353, 8756, 15570, 6080, 4254, 6995; Payload ID: 18860 relates to Category No.: 12194, 15898, 12153, 10238, 10775, 13892, 14029, 12055, 7377, 494; Payload ID: 18864 relates to Category No.: 15898, 3354, 14640, 14096, 3829, 3836, 15605, 3851; Payload ID: 18865 relates to Category No.: 15490, 3398, 3452, 8731, 3398, 3354, 3448, 3453, 13904, 10521, 4335, 5132; Payload ID: 18866 relates to Category No.: 12153, 15900, 8728, 11878, 2035, 15898; Payload ID: 18867 relates to Category No.: 15900, 8728, 11878, 2412, 5135, 2035, 14838, 15898, 6535; Payload ID: 18868 relates to Category No.: 15898, 12153, 15900, 14455, 3564, 15067, 5406, 9331; Payload ID: 18869 relates to Category No.: 12154, 16197; Payload ID: 18870 relates to Category No.: 15898, 12154, 1955, 3354, 12096, 1780, 10314, 11259, 15606, 10333, 11763, 8075, 7897, 12153; Payload ID: 18871 relates to Category No.: 12153, 1204; Payload ID: 18872 relates to Category No.: 12194, 15898, 1295, 16197, 11298, 11860, 11967, 12717, 14123, 13384, 12153, 11512, 9485, 687, 11187, 11823, 14824; Payload ID: 18873 relates to Category No.: 12153; Payload ID: 18874 relates to Category No.: 12154, 12096; Payload ID: 18875 relates to Category No.: 12153; Payload ID: 18876 relates to Category No.: 15715, 15712, 4439, 15726, 12157, 15719; Payload ID: 18877 relates to Category No.: 15898, 11843, 13337, 11915, 3354, 14034, 5750, 15605, 12774, 7230, 3313, 3132, 14640; Payload ID: 18878 relates to Category No.: 15898, 1002, 11843, 13337, 11915, 3354, 12519, 3313, 14566, 15605; Payload ID: 18879 relates to Category No.: 15898, 11843, 13337, 11915; Payload ID: 18880 relates to Category No.: 15898, 11915; Payload ID: 18881 relates to Category No.: 15898, 13589, 3398, 1002, 11843, 13337, 11915, 6705, 1780, 12519, 12117, 11968, 10580, 6513; Payload ID: 18882 relates to Category No.: 15898, 11843, 13337, 11915, 7912, 12692, 7944, 15149; Payload ID: 18883 relates to Category No.: 15898, 11843, 13337, 11915, 8756, 1257, 15570, 9595, 7230, 5143; Payload ID: 18884 relates to Category No.: 1737, 13594, 15898, 15490, 3398, 11843, 13337, 11512, 11915, 1721, 12619, 1955, 11506, 3398, 7154, 5127, 11548, 11941, 5132, 7229; Payload ID: 18885 relates to Category No.: 15898, 11915, 795; Payload ID: 18886 relates to Category No.: 15898, 11843, 13337, 11915; Payload ID: 18887 relates to Category No.: 15898, 11843, 13337, 11915; Payload ID: 18888 relates to Category No.: 15898, 11843, 13337, 11915; Payload ID: 18889 relates to Category No.: 15898, 11843, 13337, 11915; Payload ID: 18890 relates to Category No.: 15898, 11843, 13337, 11915; Payload ID: 18891 relates to Category No.: 15898, 11843, 13337, 11915; Payload ID: 18892 relates to Category No.: 15898, 11843, 13337, 11915; Payload ID: 18893 relates to Category No.: 15898, 11843, 13337, 11915; Payload ID: 18894 relates to Category No.: 15898, 11843, 13337, 11915, 10702, 795, 12638, 12498, 12646, 7134, 8049, 11968, 8543, 1723, 10966, 11341, 1366, 8537, 12749, 11966, 13449, 8074; Payload ID: 18895 relates to Category No.: 15898, 11843, 13337, 11915; Payload ID: 18896 relates to Category No.: 15898, 11843, 13337, 11915; Payload ID: 18897 relates to Category No.: 15898, 11843, 13337, 11915; Payload ID: 18898 relates to Category No.: 15898, 11915; Payload ID: 18899 relates to Category No.: 15898, 11915, 795; Payload ID: 18900 relates to Category No.: 15898, 11915, 795; Payload ID: 18901 relates to Category No.: 15898, 11915, 795; Payload ID: 18902 relates to Category No.: 15898, 11915, 795; Payload ID: 18903 relates to Category No.: 15898, 11915, 795; Payload ID: 18904 relates to Category No.: 15898, 11915, 795; Payload ID: 18905 relates to Category No.: 15898, 11915, 795; Payload ID: 18906 relates to Category No.: 15898, 11915, 795; Payload ID: 18907 relates to Category No.: 11915; Payload ID: 18908 relates to Category No.: 15898, 11843, 13337, 11915, 795; Payload ID: 18909 relates to Category No.: 15898, 11915; Payload ID: 18910 relates to Category No.: 15898, 11915; Payload ID: 18911 relates to Category No.: 15898, 11843, 13337, 11915, 2885, 15817, 13640; Payload ID: 18912 relates to Category No.: 15898, 13337, 11915, 3837, 12117, 13831, 13376, 8626, 10355, 12672, 12829, 11966, 8502; Payload ID: 18913 relates to Category No.: 15898, 11843, 13337, 11915, 1721, 8739, 2467, 7345, 12117, 3743, 11027, 6295, 2466, 8626, 11382; Payload ID: 18914 relates to Category No.: 15898, 11843, 13337, 11915, 3639, 12931, 11968, 11966; Payload ID: 18915 relates to Category No.: 15898, 13589, 3398, 11843, 13337, 11915, 5127, 15490, 3398, 11506, 3398, 8936; Payload ID: 18916 relates to Category No.: 15898, 15490, 3398, 11843, 13337, 11915, 1721, 11506, 3398, 5127, 5226, 2410, 3564, 5182, 11027; Payload ID: 18917 relates to Category No.: 15898, 11843, 13337, 11915; Payload ID: 18918 relates to Category No.: 12194, 15898, 11843, 13337, 11915, 1894, 11968, 11966, 7943; Payload ID: 18919 relates to Category No.: 15898, 11843, 13337, 11915; Payload ID: 18920 relates to Category No.: 15898, 11915; Payload ID: 18921 relates to Category No.: 15898, 11843, 13337, 11915, 2139, 1955, 3354, 5809, 1780, 3309, 13904; Payload ID: 18922 relates to Category No.: 11843, 13337, 11915, 15898; Payload ID: 18923 relates to Category No.: 13589, 3398, 11843, 13337, 15898, 11915, 3354, 5127, 7132, 13376; Payload ID: 18924 relates to Category No.: 15898, 11843, 13337, 11915, 7129, 7045, 11958, 11971; Payload ID: 18925 relates to Category No.: 15898, 11843, 13337, 11915; Payload ID: 18926 relates to Category No.: 15898, 11843, 13337, 11915; Payload ID: 18927 relates to Category No.: 1026, 15898, 11843, 13337, 11915, 3639, 1752, 12931, 2196, 12519, 12117, 11242, 11968, 8507, 2116, 11966; Payload ID: 18928 relates to Category No.: 11843, 13337, 15898, 11915, 16286, 10314, 11966; Payload ID: 18929 relates to Category No.: 15898, 11843, 13337, 11915; Payload ID: 18930 relates to Category No.: 11843, 13337, 15898, 11915, 13165, 11294; Payload ID: 18931 relates to Category No.: 1737, 15898, 11843, 13337, 11915, 7154, 4332, 11958, 11966; Payload ID: 18932 relates to Category No.: 15898, 11843, 13337, 11915; Payload ID: 18933 relates to Category No.: 11915, 1737, 7288, 1721, 14271, 14913; Payload ID: 18934 relates to Category No.: 15898, 11843, 13337, 11915, 14918, 13376, 12007, 8547; Payload ID: 18935 relates to Category No.: 15898, 11843, 13337, 11915; Payload ID: 18936 relates to Category No.: 15898, 11843, 13337, 11915; Payload ID:

18937 relates to Category No.: 15898, 11843, 13337, 11915, 1730, 14838; Payload ID: 18938 relates to Category No.: 15898, 11843, 13337, 11915, 3354, 15605; Payload ID: 18939 relates to Category No.: 1737, 15898, 11843, 11915, 7154, 13168, 7609, 13505; Payload ID: 18940 relates to Category No.: 15898, 11843, 13337, 11915, 9296, 3354, 4485; Payload ID: 18941 relates to Category No.: 15898, 11915, 13532, 4342, 14184, 1112, 481, 1115; Payload ID: 18942 relates to Category No.: 15898, 11843, 13337, 11915, 2139, 7613, 8731, 3398, 1955, 1089, 7840, 13827, 10362, 7230, 7999, 8177; Payload ID: 18943 relates to Category No.: 15898, 11843, 13337, 11915; Payload ID: 18944 relates to Category No.: 15898, 11843, 13337, 11915, 7291, 16182, 5143; Payload ID: 18945 relates to Category No.: 15898, 11843, 11915, 11237, 11966; Payload ID: 18946 relates to Category No.: 15898, 13589, 3398, 11843, 13337, 11915, 5127; Payload ID: 18947 relates to Category No.: 15898, 13589, 3398, 11843, 13337, 11915, 5127; Payload ID: 18948 relates to Category No.: 11915, 1204; Payload ID: 18949 relates to Category No.: 11915; Payload ID: 18950 relates to Category No.: 15898, 11843, 13337, 11915, 1894, 13668; Payload ID: 18951 relates to Category No.: 15898, 11843, 13337, 11915, 9296, 3354, 7306, 5127, 6490, 16197, 8390, 13460, 15533; Payload ID: 18952 relates to Category No.: 11843, 13337, 15898, 11915, 7141, 1780, 3697, 11968, 11966, 12391; Payload ID: 18953 relates to Category No.: 1737, 15898, 15490, 3398, 11843, 13337, 11915, 8739, 7154, 1257, 15521, 4439, 4134, 15570, 2429, 1023, 8934, 5406, 11634, 2131, 5073, 8937, 2217; Payload ID: 18954 relates to Category No.: 15898, 11843, 13337, 11915, 1752, 14838, 1257, 15570; Payload ID: 18955 relates to Category No.: 1780, 1378, 11914; Payload ID: 18956 relates to Category No.: 15898, 12153, 12096; Payload ID: 18957 relates to Category No.: 15898, 12154, 11843, 12153, 14034, 4851; Payload ID: 18958 relates to Category No.: 13589, 3398, 15207, 1730, 5446, 11109, 11506, 3398, 12096, 7362, 10775, 11648, 4127, 14992, 15456, 15450, 15443, 11969, 15454, 15446, 15457, 15458, 15451, 9292, 6125, 9295, 12774, 3850, 12153; Payload ID: 18959 relates to Category No.: 12153, 3452, 9296, 3354, 3448, 12096, 11648, 1780, 3453, 11969, 12774, 4485, 3318, 3850; Payload ID: 18960 relates to Category No.: 12153, 3837, 12063, 8583, 3829, 14834, 13633; Payload ID: 18961 relates to Category No.: 3837, 12096, 14033, 11294; Payload ID: 18962 relates to Category No.: 15898, 11843, 10372, 3354, 14034, 746, 12096, 11648, 11860, 11967, 11959, 5135, 5406, 6626, 12153; Payload ID: 18963 relates to Category No.: 15898, 11843, 12153, 1955, 1483, 3354, 14034, 12096, 11648, 14838, 12117, 11860, 12058, 11969, 13827, 11967, 11959, 15605, 7692, 5135, 3313, 3132, 5406, 7613, 2315, 6696, 6489, 14816, 11317, 12981, 8086, 5201, 15176; Payload ID: 18964 relates to Category No.: 1737, 15898, 12153, 13170, 329, 7132, 670, 11587, 13644, 7163, 8797, 7837, 3975, 4290, 10592, 11967, 11959; Payload ID: 18965 relates to Category No.: 15898, 15490, 3398, 15207, 8739, 5446, 12096, 1257, 15521, 4127, 4439, 7132, 14992, 670, 11587, 13644, 11298, 15570, 7163, 15456, 15450, 7363, 15448, 15653, 8797, 11967, 2006, 13597, 6814; Payload ID: 18966 relates to Category No.: 15898, 15207, 12153, 1894, 5446, 12096, 4127, 14992, 11860, 15456, 15450, 7363, 15448, 15653, 11967, 2006, 13597, 6814; Payload ID: 18967 relates to Category No.: 15898, 15490, 3398, 11843, 795, 12153, 8739, 1894, 5446, 3354, 12096, 1257, 15521, 4439, 8789, 11860, 15570, 12058, 15456, 15450, 7363, 15448, 15653, 11967, 11959, 2006, 11294, 13597, 6814; Payload ID: 18968 relates to Category No.: 12153, 11969, 11967, 11959, 11963, 11961, 11972, 6814; Payload ID: 18969 relates to Category No.: 15898, 12153, 2885, 12096, 7132, 670, 11587, 13644, 7163, 8797, 11967, 5218, 5145, 5879, 6814; Payload ID: 18970 relates to Category No.: 1955, 10637, 11969, 11967, 11959, 5879, 6814; Payload ID: 18971 relates to Category No.: 6814, 12936, 11969, 11967, 11959; Payload ID: 18972 relates to Category No.: 12061; Payload ID: 18973 relates to Category No.: 15898, 1888, 11969, 11967, 12153; Payload ID: 18974 relates to Category No.: 15898, 3837, 12063, 1888, 2012, 11967, 8583, 3829, 12153; Payload ID: 18975 relates to Category No.: 15898, 11967, 11959, 11843, 12153; Payload ID: 18976 relates to Category No.: 1737, 15898, 12153, 8739, 1894, 3452, 9296, 8731, 3398, 3354, 7154, 3448, 1893, 16197, 12120, 2429, 11660, 4485, 11428, 10775; Payload ID: 18977 relates to Category No.: 15898, 11843, 2012, 4290, 11967, 11176, 11574, 13338, 5810; Payload ID: 18978 relates to Category No.: 15898, 13589, 3398, 15490, 3398, 12153, 1894, 12096, 11588, 1780, 11298, 1725, 11959, 11294, 2118, 1982; Payload ID: 18979 relates to Category No.: 12153, 2885, 1894, 5446, 3354, 8789, 15605, 7183, 5879, 6814; Payload ID: 18980 relates to Category No.: 12153, 1894, 5446, 9038, 12061, 14992, 15782, 15570, 11089, 6814; Payload ID: 18981 relates to Category No.: 12194, 15207, 12153, 2885, 1894, 3452, 9296, 5446, 11109, 3354, 3448, 5226, 7362, 10775, 11648, 11588, 4127, 14992, 3453, 15456, 15450, 15443, 11969, 15454, 10521, 15446, 15457, 15458, 15451, 9292, 6125, 9295, 12774, 4485, 3318, 10755, 12982, 15898; Payload ID: 18983 relates to Category No.: 14097, 3698, 12058, 11969, 10286; Payload ID: 18984 relates to Category No.: 12153, 3566, 15067, 4167, 13740, 6629, 11770; Payload ID: 18985 relates to Category No.: 11967; Payload ID: 18987 relates to Category No.: 12153; Payload ID: 18988 relates to Category No.: 11843, 12058, 11967; Payload ID: 18989 relates to Category No.: 1737, 1894, 329, 670, 11969, 3975, 4290, 11959, 11963, 11961, 11972, 12153; Payload ID: 18990 relates to Category No.: 1955, 3354, 5750, 11860, 12058, 11969, 11967, 11959, 11963, 11961, 11972; Payload ID: 18991 relates to Category No.: 11843, 3354, 12096, 5226; Payload ID: 18992 relates to Category No.: 11843, 12153, 3354, 12058, 7016, 11959, 2060; Payload ID: 18993 relates to Category No.: 795, 12096, 12154; Payload ID: 18994 relates to Category No.: 13831, 13030, 12155, 11970; Payload ID: 18995 relates to Category No.: 13831, 12155, 11970; Payload ID: 18997 relates to Category No.: 15626, 1894, 15215; Payload ID: 18998 relates to Category No.: 11294; Payload ID: 18999 relates to Category No.: 1894, 7291, 16182, 1204, 11294; Payload ID: 19001 relates to Category No.: 11910; Payload ID: 19002 relates to Category No.: 15898, 12153, 1955, 1894, 6814; Payload ID: 19003 relates to Category No.: 6814, 10331, 1893, 12120, 11660; Payload ID: 19004 relates to Category No.: 12061, 12194, 1894, 5446, 9038, 14992, 15782, 12619, 7132, 3654, 8731, 3398; Payload ID: 19005 relates to Category No.: 13831, 13030, 12155, 11970, 6814; Payload ID: 19006 relates to Category No.: 15898, 12153, 6102, 3056, 12154, 6296, 5073, 659, 6814, 1894; Payload ID: 19007 relates to Category No.: 2885, 1894, 5446, 3354, 8789, 15605, 5879, 7183; Payload ID: 19008 relates to Category No.: 12154, 15490, 3398, 11512, 1721, 8739, 3354, 5226, 6490, 1780, 4439, 11860, 12891, 3783, 10524, 10394, 5218, 3340, 13981; Payload ID: 19009 relates to Category No.: 15898, 1721, 12619, 12153, 1730, 6490, 13140, 1780, 11860, 10350; Payload ID: 19010 relates to Category No.: 9500, 5149, 12891, 5406, 3900, 5152, 4949, 4953, 1483, 3602, 12708, 1555; Payload ID: 19011 relates to Category No.: 15490, 3398, 8739, 6969, 2198, 7124; Payload ID: 19012 relates to Category No.: 12153, 12096; Payload ID: 19013 relates to Category No.: 11843, 8503, 8547, 8520, 7943, 8799; Payload ID: 19015 relates to Category No.: 11843; Payload ID: 19016 relates to Category No.: 11843, 12603, 998, 6733, 4766, 9166, 13383, 13343, 12891; Payload ID: 19017 relates to Category No.: 11843, 12603, 998, 6733, 4766, 9166; Payload ID: 19018 relates to Category No.: 3837, 14033; Payload ID: 19019 relates to Category No.: 1204; Payload ID: 19021 relates to Category No.: 14216, 3656, 3837, 14586; Payload ID: 19022 relates to Category No.: 6814, 16308, 4212, 2000, 4213, 3244, 7710, 14663, 16307, 3474, 14972, 10174, 14080, 7975, 4210, 1854, 8027, 7758, 3934, 4978, 5035, 1197, 8658, 13969, 13925, 13859, 13827, 6269, 13966, 14009, 13837, 13970, 381, 14011, 9411, 1982, 1966, 1218; Payload ID: 19023 relates to Category No.: 6814, 4212, 2000, 4213, 16307, 7975, 4210, 1854, 8027, 7758; Payload ID: 19024 relates to Category No.: 6814, 4212, 2000, 4213, 16307, 14080, 7975, 1854, 8027, 7758; Payload ID: 19025 relates to Category No.: 6814, 16308, 4212, 2000, 4213, 14663, 16307, 10174, 7975, 1854, 8027, 7758, 4978; Payload ID: 19026 relates to Category No.: 6814, 4212, 2000, 4213, 16307; Payload ID: 19027 relates to Category No.: 6814, 16308, 4212, 2000, 4213, 14663, 16307, 7975, 1854, 8027, 7758; Payload ID: 19028 relates to Category No.: 6814, 4212, 2000, 4213, 4110, 7710, 16307, 3474, 2743, 3973, 14080, 7975, 4210, 1854, 8027, 7758; Payload ID: 19029 relates to Category No.: 6814, 4212, 2000, 4213, 4110, 7710, 16307, 3474, 14972, 2743, 14080, 7975, 4210, 1854, 8027, 7758, 8658; Payload ID: 19030 relates to Category No.: 6814, 16308, 4212, 2000, 4213, 1867, 14663, 16307, 14080, 7975, 4210, 1854, 8027, 7758; Payload ID: 19031 relates to Category No.: 6814, 4212, 2000, 4213, 14455, 1854, 3123; Payload ID: 19032 relates to Category No.: 6814, 4212, 2000, 4213, 14455, 1854, 3123; Payload ID: 19033 relates to Category No.: 6814, 4212, 2000, 4213, 1854; Payload ID: 19034 relates to Category No.: 6219, 6814, 4212, 2000, 4213; Payload ID: 19035 relates to Category No.: 6814, 16308, 4212, 2000, 4213, 3934; Payload ID: 19036 relates to Category No.: 6814, 16308, 4212, 2000, 4213, 14972, 1854; Payload ID: 19037 relates to Category No.: 6814, 4212, 2000, 4213, 14972, 1854; Payload ID: 19038 relates to Category No.: 6814, 16308, 4212, 2000, 4213; Payload ID: 19039 relates to Category No.: 6814, 16308, 4212, 2000, 4213, 1854, 3933; Payload ID: 19040 relates to Category No.: 6814, 4212, 2000, 4213, 6219, 1854, 684; Payload ID: 19041 relates to Category No.: 6814, 4212, 2000, 4213; Payload ID: 19042 relates to Category No.: 6814, 4212, 4213, 1979; Payload ID: 19043 relates to Category No.: 6814, 4212, 2000, 4213, 2169, 9738, 4357, 8940, 12038, 9575, 2940; Payload ID: 19044 relates to Category No.: 1512, 11930, 4721, 14663, 5004, 4723, 2385, 2383; Payload ID: 19045 relates to Category No.: 11930, 9357; Payload ID: 19046 relates to Category No.: 11930, 9357; Payload ID: 19047 relates to Category No.: 11930; Payload ID: 19048 relates to Category No.: 11930; Payload ID: 19049 relates to Category No.: 1512, 12062, 12063, 9125, 1893, 14663, 14586, 7304, 1202, 11660, 4723, 6000, 5930, 5932, 9357, 12646, 11930, 4021, 10238, 7743, 16294, 379, 1703, 3790, 6559, 6145, 1320, 692, 4353, 9610, 4711, 3192, 12655, 12458, 10577, 10240, 14050; Payload ID: 19050 relates to Category No.: 1512, 12063, 1893, 14663, 11660, 4723, 5930, 5932; Payload ID: 19051 relates to Category No.: 1512, 12063, 1893, 14663, 11660, 4723, 5930, 5932; Payload ID: 19052 relates to Category No.: 1512, 12063, 1893, 14663, 11660, 4723, 6737, 5930, 5932; Payload ID: 19053 relates to Category No.: 1512, 12063, 9324, 1893, 14663, 11660, 4723, 12068, 5930, 5932; Payload ID: 19054 relates to Category No.: 1512, 12063, 1893, 14663, 11660, 4723, 5930, 5932; Payload ID: 19055 relates to Category No.: 1512, 14663, 4353, 4352; Payload ID: 19056 relates to Category No.: 1512, 11930, 9324, 1893, 14663, 11660, 4723, 12068, 5930, 5932, 10137, 1026, 14455; Payload ID: 19057 relates to Category No.: 11930, 1512, 9324, 1893, 14663, 11660, 4723, 12068, 5930, 5932, 10137; Payload ID: 19058 relates to Category No.: 1512, 11930, 9324, 1893, 14663, 11660, 4723, 12068, 5930, 5932, 10137; Payload ID: 19059 relates to Category No.: 11930, 2169, 9324, 1893, 11660, 12068, 4699, 1295; Payload ID: 19060 relates to Category No.: 11930, 9324, 1893, 11660, 12068, 4711, 9324; Payload ID: 19061 relates to Category No.: 1512, 11930, 9324, 1893, 14663, 11660, 4723, 12068, 5930, 5932; Payload ID: 19062 relates to Category No.: 11930, 9324, 1893, 11660, 12068, 10137; Payload ID: 19063 relates to Category No.: 11930; Payload ID: 19064 relates to Category No.: 6814; Payload ID: 19065 relates to Category No.: 16308, 9500, 1512, 15931, 4721, 14663, 1854, 15938, 4419, 10155; Payload ID: 19066 relates to Category No.: 3781, 14865, 14663, 11294, 4727, 4729, 4554; Payload ID: 19067 relates to Category No.: 11930, 15935, 11926, 12063, 1893, 11660, 2994; Payload ID: 19068 relates to Category No.: 11926, 11930, 12063, 1893, 15935, 11660; Payload ID: 19069 relates to Category No.: 6814, 16308, 1512, 15931, 14663, 4538, 4685, 1854, 15938, 4530; Payload ID: 19070 relates to Category No.: 12133, 15921, 6814; Payload ID: 19071 relates to Category No.: 6814, 12063, 1893, 3405, 11660, 15947, 15950; Payload ID: 19072 relates to Category No.: 6814, 15947; Payload ID: 19073 relates to Category No.: 12137, 9500, 1512, 1894, 1533, 1204; Payload ID: 19074 relates to Category No.: 10372, 8390, 13831, 8547, 13363, 9455, 13338, 13030, 12155, 11970, 12891, 10652, 13919; Payload ID: 19075 relates to Category No.: 12194, 1204; Payload ID: 19076 relates to Category No.: 12194, 13030; Payload ID: 19079 relates to Category No.: 5367, 12994, 7533, 7540; Payload ID: 19080 relates to Category No.: 5367, 7533, 7540; Payload ID: 19081 relates to Category No.: 5367, 12994, 16197, 7533, 7540; Payload ID: 19082 relates to Category No.: 13589, 3398, 15490, 3398, 9599, 12891, 12628, 1621, 3441, 2604, 9335; Payload ID: 19083 relates to Category No.: 15149, 3639, 16214, 11296, 6256, 10005, 7813, 7714; Payload ID: 19084 relates to Category No.: 2460, 9420, 6256; Payload ID: 19085 relates to Category No.: 5785, 8977, 13532, 4588, 10494, 5465, 15149, 4588, 8918, 1149, 15160, 13464, 15155, 11097, 15149; Payload ID: 19086 relates to Category No.: 5785, 15149, 14565, 795, 8977, 15163, 4581, 3973, 11440, 10793, 5465, 15149, 4588, 8918, 13464, 15155; Payload ID: 19087 relates to Category No.: 5785, 15149, 3986; Payload ID: 19088 relates to Category No.: 13110, 10593, 11318, 9777, 3021, 11425, 4848, 4461, 7536; Payload ID: 19089 relates to Category No.: 1730, 7345, 2276; Payload ID: 19090 relates to Category No.: 1730, 7345, 6111, 2276; Payload ID: 19091 relates to Category No.: 12194, 14565, 10775, 10878; Payload ID: 19092 relates to Category No.: 1026, 14565, 795, 4040, 8864, 11765, 8936, 4039, 723; Payload ID: 19093 relates to Category No.: 1026, 14565, 795, 4040, 8373, 11765, 11187, 4039, 7966, 723; Payload ID: 19094 relates to Category No.: 1026, 14565, 795, 12638, 10238, 1295, 723, 8864; Payload ID: 19095 relates to Category No.: 1026, 14565, 795, 1804, 13231, 12286; Payload ID: 19096 relates to Category No.: 12137, 15626, 1795; Payload ID: 19097 relates to Category No.: 12091, 14565, 998, 9713, 14009, 1048, 8936, 12519, 11858, 11997, 6451, 10256, 1023, 10938, 8509, 2077, 8941; Payload ID: 19098 relates to Category No.: 12091, 14565, 998, 14009, 1048, 12519, 11858, 1023, 7819; Payload ID: 19099 relates to Category No.: 12091, 1002, 998, 12519, 11858, 2158, 8639, 11394; Payload ID: 19100 relates to Category No.: 12091, 6969, 13105, 13232, 13049, 13231, 13286, 13362, 2460, 16138, 3808, 2708; Payload ID: 19101 relates to Category No.: 15618, 5846, 7303, 480, 1115; Payload ID: 19102 relates to Category No.: 15618, 5846; Payload ID: 19103 relates to Category No.: 1204; Payload ID: 19104 relates to Category No.: 5782, 5446, 403, 3021, 15456, 15448, 15454, 15453, 743; Payload ID: 19105 relates to Category No.: 12194; Payload ID: 19112 relates to Category No.: 12091; Payload ID: 19113 relates to Category No.: 12137, 11878, 6442, 14404, 3676, 3683, 12828; Payload ID: 19114 relates to Category No.: 12197, 13755, 1874, 14663, 7112, 1334, 13594; Payload ID: 19115 relates to Category No.: 15626, 12197, 13755, 1874, 14663, 13882, 13161, 1984, 6271, 7613, 496, 13860, 4145, 2000, 2009, 13843, 10356, 8119, 1905, 7112, 14018; Payload ID: 19116 relates to Category No.: 6219, 12197, 13755, 13756, 1874, 14663, 7112, 4110, 14018, 13859, 13882, 13812, 496, 13888, 13966, 13767, 14011, 2000; Payload ID: 19117 relates to Category No.: 13594, 15490, 3398, 11512, 6530; Payload ID: 19118 relates to Category No.: 7852, 1766, 8934; Payload ID: 19119 relates to Category No.: 12153; Payload ID: 19121 relates to Category No.: 3356, 3354, 9223, 4439, 7280, 9223, 9103, 5219, 13626, 3447; Payload ID: 19122 relates to Category No.: 4439, 7280, 9223, 9103, 6269, 9411; Payload ID: 19123 relates to Category No.: 9238, 4439, 7295, 9223, 9103, 11546; Payload ID: 19124 relates to Category No.: 15517, 7291, 16182, 14271, 15291, 4439, 7280, 7261, 9223, 9103, 11546; Payload ID: 19125 relates to Category No.: 8421, 5782; Payload ID: 19127 relates to Category No.: 1721; Payload ID: 19128 relates to Category No.: 13594, 15490, 3398, 8731, 3398, 16191, 690; Payload ID: 19129 relates to Category No.: 15516, 2411, 4439, 11511, 12891, 3783, 8004, 3783, 15520, 15498, 15290, 13593, 2413; Payload ID: 19130 relates to Category No.: 12891, 3566, 1229; Payload ID: 19131 relates to Category No.: 13594, 11512, 15517, 14034, 13882, 2009, 6215, 4535, 7983, 13595, 11514, 6065, 1519, 11506, 3398, 13589, 3398, 4538; Payload ID: 19132 relates to Category No.: 11512, 15517, 6215, 13595, 11514, 6065, 13594, 11506, 3398, 5998; Payload ID: 19133 relates to Category No.: 9020; Payload ID: 19134 relates to Category No.: 3354, 1089, 16197, 1089, 762, 3103, 14779, 14776, 10873, 7613; Payload ID: 19135 relates to Category No.: 12303, 12309, 13888, 4145, 5998, 15967; Payload ID: 19136 relates to Category No.: 1204; Payload ID: 19138 relates to Category No.: 1204, 12242, 537, 15987; Payload ID: 19139 relates to Category No.: 14663, 9068, 12303, 9236, 12307, 1142; Payload ID: 19141 relates to Category No.: 13594, 15490, 3398, 14038, 8175, 8739, 12633, 8454, 1993, 2118, 7710; Payload ID: 19142 relates to Category No.: 6814, 14663, 9256, 12303, 2996, 2997, 9236, 12306, 15967, 1957, 4145, 5998, 12312; Payload ID: 19143 relates to Category No.: 9256, 9232, 14663, 12303, 9284, 12309, 9236, 15969, 12307, 12313, 16012, 16010, 1983; Payload ID: 19144 relates to Category No.: 14663, 9256, 12303, 9284, 12309, 9236, 15969, 16012, 12307; Payload ID: 19145 relates to Category No.: 6814, 9982, 14663, 12303, 12309, 9236, 15969, 2780, 9283; Payload ID: 19146 relates to Category No.: 6814, 9982, 16197, 12303, 12309, 15969, 2780; Payload ID: 19147 relates to Category No.: 6814, 9982, 14663, 12303, 12309, 9236, 15969, 2528, 2780; Payload ID: 19148 relates to Category No.: 14663, 1878, 5087, 5088, 5089; Payload ID: 19149 relates to Category No.: 4828, 14456, 11512, 14940, 13786, 13835, 7728, 5428, 7613, 13859, 3469, 8962, 13975, 11285, 4145, 10648, 10309, 8002, 10522, 7658, 8004, 10362, 8936, 8374, 4132, 6103, 10446, 11546, 11598, 13532, 4588, 10455, 486, 11602, 7977, 11174, 901, 8089, 14729, 10851, 10298, 9561, 7619, 13978, 10271, 10322, 4412, 8363, 7748, 8074, 359; Payload ID: 19150 relates to Category No.: 3244, 1468, 434, 14015, 2077, 2006, 13883, 1780, 8004, 1982, 8233, 7993; Payload ID: 19151 relates to Category No.: 3244, 434, 2077; Payload ID: 19152 relates to Category No.: 7743, 5037, 1849, 6137, 9010, 3973, 2280, 13040, 6841, 6830, 6874, 13970; Payload ID: 19153 relates to Category No.: 8441, 12891, 12498, 455, 14586, 1989, 13281, 7314; Payload ID: 19154 relates to Category No.: 1512, 14663, 4723, 2385, 3106, 12118; Payload ID: 19155 relates to Category No.: 1795, 3791, 12066; Payload ID: 19156 relates to Category No.: 1795, 3791; Payload ID: 19157 relates to Category No.: 7306, 6738, 3791; Payload ID: 19158 relates to Category No.: 3791, 11669, 5949, 1764, 14737, 16274, 16019, 15998; Payload ID: 19159 relates to Category No.: 8004; Payload ID: 19160 relates to Category No.: 15517; Payload ID: 19161 relates to Category No.: 14663, 10173, 4977, 10174, 12209, 4980, 13835, 1911, 13969, 6269, 13837, 13938, 13944, 13853, 13905, 13772, 16031; Payload ID: 19162 relates to Category No.: 15317, 14663, 4977, 10174, 12209, 16030, 10173, 1911, 13779, 1904; Payload ID: 19163 relates to Category No.: 15149, 12544, 7340, 13661, 13882, 13827, 10486, 8118, 7658, 10358, 8571, 10626, 10625, 10446, 14022, 10226, 10282, 11602, 10710, 11436, 2370, 8057, 8802, 10442, 16268, 10442, 13697, 8011; Payload ID: 19164 relates to Category No.: 4828, 14565, 8962, 9932, 13661, 1237, 13827, 10486, 11601, 7658, 8571, 10362, 10626, 10226, 10282, 8802, 10442, 16268, 10442, 13697, 8011; Payload ID: 19165 relates to Category No.: 12544, 13661; Payload ID: 19166 relates to Category No.: 14456, 9994, 4336, 14452, 3825, 5459, 5462, 986, 8920, 280, 9571; Payload ID: 19168 relates to Category No.: 14456, 9994, 14452, 3825, 5459, 5462, 5461; Payload ID: 19169 relates to Category No.: 14456, 9994, 16214, 14014, 4933, 6501, 14452, 5461, 3900; Payload ID: 19170 relates to Category No.: 5782, 3833, 6733, 12063, 2669, 1893, 6738, 7132, 16161, 11660, 4782, 15535; Payload ID: 19171 relates to Category No.: 10702, 16202, 4766, 14097, 10067, 10066, 12928; Payload ID: 19172 relates to Category No.: 8862, 14318, 10238; Payload ID: 19173 relates to Category No.: 14318, 1730, 7306, 14838, 6670; Payload ID: 19174 relates to Category No.: 14318; Payload ID: 19175 relates to Category No.: 6637, 151, 6360, 11511, 14318; Payload ID: 19176 relates to Category No.: 14318; Payload ID: 19177 relates to Category No.: 14318, 7743, 3658, 151, 6360, 3661, 151, 6360, 3657, 151, 6360; Payload ID: 19178 relates to Category No.: 14318; Payload ID: 19179 relates to Category No.: 6637, 151, 6360, 1295, 2409; Payload ID: 19180 relates to Category No.: 6637, 151, 6360, 14267; Payload ID: 19181 relates to Category No.: 7330, 7345, 13496, 7340, 10382, 8918; Payload ID: 19182 relates to Category No.: 1002, 3354, 14098, 4771, 12743, 2198, 14708, 13668, 10256, 12404, 3451, 6495, 13374, 2429, 14905, 16189; Payload ID: 19183 relates to Category No.: 1204; Payload ID: 19184 relates to Category No.: 12153, 9296, 3354, 14034, 15533; Payload ID: 19185 relates to Category No.: 13070, 14565, 9858, 9945, 14663, 16197; Payload ID: 19186 relates to Category No.: 12091, 1737, 12648, 3639, 16286, 7154, 5174, 7132, 11858, 7155, 7156, 4761, 5178; Payload ID: 19187 relates to Category No.: 12091, 12648, 3639, 16286, 9713, 13105, 16197, 2083, 11858, 13019; Payload ID: 19188 relates to Category No.: 12091, 12648, 3639, 16286, 9713, 7946, 11200; Payload ID: 19189 relates to Category No.: 5782, 16172, 15471, 1002, 3699, 3692, 13376, 11294, 13273, 10392, 10536; Payload ID: 19190 relates to Category No.: 12130, 12104, 11997, 4770, 6296, 14729, 8862; Payload ID: 19191 relates to Category No.: 12137; Payload ID: 19192 relates to Category No.: 12130, 12104; Payload ID: 19193 relates to Category No.: 12130, 12104; Payload ID: 19194 relates to Category No.: 5782, 3691, 3699, 13494, 1000, 16068, 13648, 9090, 16189; Payload ID: 19195 relates to Category No.: 1002, 5782, 16159, 16172, 3699, 6445, 3697, 13494, 16189; Payload ID: 19196 relates to Category No.: 13589, 3398, 15490, 3398, 3691, 6738, 12132; Payload ID: 19197 relates to Category No.: 3691, 16197, 16193, 16202, 16198, 6738, 5790, 12132, 11243, 8547, 15899, 11586; Payload ID: 19198 relates to Category No.: 12137, 16159, 16172, 3699, 1000, 10086, 6711, 6444, 12764; Payload ID: 19199 relates to Category No.: 12137, 16159, 16172, 6733, 3697, 6711, 6444, 10079, 6666, 13320; Payload ID: 19200 relates to Category No.: 13589, 3398, 15490, 3398, 3691, 6738, 12132; Payload ID: 19201 relates to Category No.: 12137, 3691, 16197, 16193, 16202, 16198, 6738, 5790, 15899; Payload ID: 19202 relates to Category No.: 12137, 3691, 16197, 16193, 16202, 16198, 6738, 5790, 11610, 11605; Payload ID: 19203 relates to Category No.: 12137, 3691, 16197, 16193, 16202, 16198, 6738, 5790; Payload ID: 19204 relates to Category No.: 12137, 3691, 16197, 16193, 16202, 16198, 6738, 5790; Payload ID: 19205 relates to Category No.: 1002, 5782, 16172, 3699, 14097, 3702, 3692, 6062; Payload ID: 19206 relates to Category No.: 1737, 12137, 3691, 16172, 7850, 16197, 16193, 6738, 3692, 16068, 6721, 10595, 9308, 13366, 7153, 13363, 1791, 16186, 11610, 16199, 15899, 15902, 11608, 5768, 200, 11605, 16171; Payload ID: 19207 relates to Category No.: 12137, 3691, 7728, 16197, 16193, 6738, 11609, 16068, 10638, 10595, 9308, 7153, 12682, 1791, 16186, 13672, 13174, 11610, 16199, 3700, 13923, 15899, 11911, 15902, 7962, 10402, 11608, 11676, 3697, 2359; Payload ID: 19208 relates to Category No.: 1002, 5782, 16172, 4785, 12130, 1204, 3699, 13494, 16066, 9090, 3692, 6062, 12453; Payload ID: 19209 relates to Category No.: 5782, 16159, 16172, 1238; Payload ID: 19210 relates to Category No.: 6227, 3635, 12137, 1002, 14097, 3698; Payload ID: 19211 relates to Category No.: 3635, 12137, 3534, 3579; Payload ID: 19212 relates to Category No.: 3635, 12137, 14097, 3698; Payload ID: 19213 relates to Category No.: 12137, 4778, 14097, 3698, 5243, 7354, 4859, 8905; Payload ID: 19214 relates to Category No.: 15490, 3398, 8739, 2410, 5129, 14782; Payload ID: 19215 relates to Category No.: 12137, 3692; Payload ID: 19216 relates to Category No.: 1002, 3986, 3676, 14589, 12519, 4766, 1749, 3566; Payload ID: 19217 relates to Category No.: 12091, 4828, 13248, 5785, 9982, 14565, 13975, 795, 7912, 13186, 12638, 1730, 7613, 1894, 10074, 5446, 9713, 4186, 9891, 9048, 15521, 1780, 7840, 4127, 7635, 3775, 11765, 11285, 14663, 4439, 6738, 5541, 16085, 8988, 13232, 13618, 1238, 10558, 2009, 11858, 3632, 11363, 8522, 10606, 10362, 13867, 11174, 9053, 11949, 15606, 5806, 15192, 11113, 7966, 9716, 6561, 365, 10394, 10467, 10588, 8374, 8431, 11111, 11260, 8567, 10666, 10910, 11275, 13866, 14035, 8549, 10283, 10680, 2068, 8473, 5552, 13889, 3907, 6507, 11026, 10544, 13846, 12920, 10668, 7973, 12621, 11512, 11237, 12153, 5428, 8004, 793, 9455, 4535, 1993, 4538, 3974, 6248, 13874, 2143, 4458, 11980, 11878, 13851, 4541, 1960, 4690, 1991, 5985, 6625, 15011, 2100, 13200, 9740, 10625, 1949, 4687, 2087, 15588, 2079, 496, 2006, 10238, 2051, 14883, 11601, 4685, 1955, 5291, 13363, 1779, 11399, 8192, 7748; Payload ID: 19218 relates to Category No.: 12091, 14565, 12638, 1894, 1517, 4094, 11285, 6738, 5541, 11293, 13618, 4538, 2009, 4685, 12620, 10370, 6561, 10666, 10680, 11604, 8473, 10668, 10608, 5781, 12041, 337, 10667, 9740, 11512, 13967, 2079, 10366, 7613, 13953, 11371, 13888, 10648, 2000, 7840, 11111, 11216, 11980, 11174, 13973, 8594; Payload ID: 19219 relates to Category No.: 12091, 14565, 7046; Payload ID: 19220 relates to Category No.: 334, 11843, 12153, 11237, 3684, 3837, 1955, 12498, 3354, 3448, 12063, 16191, 14096, 3829, 1995, 11243, 11245, 3836, 15605, 3900, 3835, 12481, 3851, 7505, 11021, 4208, 11262, 10936, 11155, 10249, 932, 15898, 494, 11937, 11940, 3833; Payload ID: 19221 relates to Category No.: 12153, 11958, 11966, 4766, 7154, 3674, 4767; Payload ID: 19222 relates to Category No.: 9697; Payload ID: 19223 relates to Category No.: 13621, 16075, 4439, 15698; Payload ID: 19224 relates to Category No.: 16075, 15698, 13621; Payload ID: 19225 relates to Category No.: 14565, 1727, 3833, 6733, 14865, 10775, 14663, 8936, 14862, 7556, 12017, 10179, 10177, 2670; Payload ID: 19226 relates to Category No.: 3684, 3676, 3833, 1836, 14865, 14663, 7187, 14862, 11607, 7556, 362, 7559, 10179, 10177, 7562, 2670; Payload ID: 19227 relates to Category No.: 7306; Payload ID: 19228 relates to Category No.: 7306, 3896, 9099, 780, 8887, 4952, 1760, 4937, 14782, 724, 16294, 2548, 5460, 5462, 13681, 12459, 11628, 5004, 5951, 14108, 4502, 16286, 10038, 14781, 10879, 3926, 2547, 3247, 6757, 7353, 10039, 2654, 9091, 3870, 2652, 2655, 9448, 10048, 6078, 10043, 12837, 3898, 10044; Payload ID: 19229 relates to Category No.: 5428, 13975, 5446, 14589, 11453, 9068, 7252, 8431, 2431, 379, 9567; Payload ID: 19230 relates to Category No.: 9068, 7252, 9567; Payload ID: 19231 relates to Category No.: 1204, 9068, 9567, 6814; Payload ID: 19232 relates to Category No.: 14838, 2410, 14175; Payload ID: 19233 relates to Category No.: 1204; Payload ID: 19234 relates to Category No.: 1295; Payload ID: 19238 relates to Category No.: 9500, 2885, 1703, 1060, 1820, 616, 12994, 16197, 4021, 11460, 5037, 5610, 1453, 6149, 6137, 6753, 4949, 3606, 2393, 1984, 13925, 2143, 13882, 2136, 496, 13966, 13837, 14054, 13904, 13961, 1713, 2431, 379, 14589; Payload ID: 19239 relates to Category No.: 10359, 13594, 8862, 690, 16088, 11512, 12648, 7613, 8739, 10074, 10372, 10175, 4859, 7840, 10366, 360, 11285, 10648, 16085, 13882, 1238, 10558, 10954, 9600, 10080, 1563, 11313, 4059, 10459, 5949, 11174, 11178, 10583, 10343, 3791, 7217, 11598, 9480, 1751, 2599, 11245, 5406, 10557, 15762, 2143, 2006, 1762, 3708, 16114, 10258, 860, 13430, 11335, 3437, 13597, 4953, 6795, 1320, 10574, 10983, 2704, 10226, 10386, 5424, 10959, 6375, 11177, 10368, 16096, 11240, 11163, 9485, 15121, 11268, 10292, 10283, 5998, 11596, 10629, 10554, 6468, 12686, 11216, 10373, 1464, 11085, 11274, 1102, 10904, 2707, 11631, 6405, 11738, 6553, 1581, 11521, 10736, 11269, 1249, 1752, 7750, 1240, 1780, 3713, 6389, 12957, 6406, 16095, 12809, 10930; Payload ID: 19240 relates to Category No.: 7613, 10074, 10175, 10359, 8373, 16085, 1238, 10558, 10080, 11178, 11266, 10583, 8004, 5424, 10959, 11596, 11599, 1562, 12068, 4949, 2705, 13827, 690; Payload ID: 19241 relates to Category No.: 14565, 10074, 10372, 10175, 10359, 16085, 1238, 10080, 5424, 10959, 15045, 11178, 7743, 9410, 10226, 10382, 7243, 10930, 13827, 11290, 7658, 690, 10574, 11240, 11085, 13651, 10283; Payload ID: 19242 relates to Category No.: 13594, 15517, 1849, 690, 3710; Payload ID: 19243 relates to Category No.: 4828, 5446, 10372, 10209, 729, 3016, 734, 7292, 11770, 11243, 3015, 1265, 13363, 14053, 7613, 13459, 6103, 8489, 11602, 8636, 10558, 11168; Payload ID: 19244 relates to Category No.: 4828, 5367, 15149, 10372, 3244, 1795, 4828, 2745, 7340; Payload ID: 19245 relates to Category No.: 4828, 14565, 1816, 1795, 8636, 328; Payload ID: 19246 relates to Category No.: 297, 11941, 1026, 15207, 10192, 1749, 274, 8887; Payload ID: 19247 relates to Category No.: 690, 1722, 7598, 12488, 14050, 12676, 7924, 7923, 7659, 8235; Payload ID: 19248 relates to Category No.: 10558, 12488, 10226; Payload ID: 19249 relates to Category No.: 8756, 7942; Payload ID: 19250 relates to Category No.: 14661, 5785, 10702, 13435, 13589, 3398, 10074, 5446, 10238, 803, 4186, 13485, 12942, 9891, 4127, 4130, 3775, 16085, 8988, 1238, 15192, 12649, 9777, 4828, 12397, 5592, 11077, 5367, 15185, 9000, 10343; Payload ID: 19251 relates to Category No.: 690, 1026, 14661, 5785, 14565, 10702, 13435, 3766, 10074, 5446, 10238, 803, 13485, 12942, 12891, 4127, 4130, 16085, 8988, 1238, 12649, 12543, 1752, 11186, 6018, 1775; Payload ID: 19252 relates to Category No.: 690, 1026, 14661, 5785, 10702, 1070, 13435, 3766, 10074, 5446, 1955, 10238, 10266, 803, 13485, 12942, 11371, 4127, 4130, 16085, 8988, 1238, 13827, 12649, 1752, 11186, 5592, 6018, 9000, 16160, 10343, 1775; Payload ID: 19253 relates to Category No.: 5782, 1790, 3684, 3837, 14096, 3829, 8112, 2041, 2083, 2009, 8782, 8159, 13999, 3900, 7915, 3827, 13860, 8395, 12908, 8032, 8023, 8244, 7577, 13247; Payload ID: 19254 relates to Category No.: 13594, 3766, 10074, 5446, 348, 12459, 12942, 4130, 16085, 8988, 1238, 11371, 13392; Payload ID: 19255 relates to Category No.: 5785, 10372, 348, 12391, 8988, 5912, 9599, 724, 9410, 15400, 1240, 4949, 9580; Payload ID: 19256 relates to Category No.: 13589, 3398, 7306; Payload ID: 19257 relates to Category No.: 15490, 3398, 13589, 3398, 8739, 1730, 8934, 1026, 1463, 14620, 2169, 1295, 9540, 8862, 8368; Payload ID: 19258 relates to Category No.: 13589, 3398, 15490, 3398, 16286, 16214, 3532, 4251, 8739, 14056, 1463, 1048, 3442, 3582; Payload ID: 19260 relates to Category No.: 1512, 1703, 7306, 14640, 2169, 14663, 4021, 4723, 2385, 2383, 2384, 3106, 1789, 9455, 4478, 4949; Payload ID: 19261 relates to Category No.: 15632, 3395; Payload ID: 19262 relates to Category No.: 6227, 8862, 14565, 12427, 8739, 2355, 12449, 6758, 10493, 16152, 4716, 3041, 11265, 16123, 13925, 2041, 2014, 13882, 13874, 13827, 2006, 13966, 4949, 2009, 2243, 1983; Payload ID: 19263 relates to Category No.: 12137, 3691, 16197, 16193, 6738, 7326, 16185; Payload ID: 19264 relates to Category No.: 9500, 8309; Payload ID: 19265 relates to Category No.: 9500; Payload ID: 19266 relates to Category No.: 5782, 16172, 3833, 5798, 4778, 14097, 3698, 12130, 16161, 4768, 16267; Payload ID: 19267 relates to Category No.: 5782, 16159, 16172, 3833, 6733, 5798, 4778, 14097, 3698, 12130, 1780, 16161, 13366; Payload ID: 19268 relates to Category No.: 16172, 3986, 16160, 14708; Payload ID: 19269 relates to Category No.: 12137, 8977, 16172, 15149, 3986, 6733, 15157, 12851, 11884, 16160, 1893, 14663, 6738, 2009, 13004, 4774, 13668, 1420, 11646, 4581, 3728, 10861, 6323, 13860, 3758, 12752; Payload ID: 19270 relates to Category No.: 15043, 16159, 16172, 3986, 6733, 14097, 3698, 11884, 16160, 11315, 8606, 4774, 1420, 14708; Payload ID: 19271 relates to Category No.: 16172, 6969, 3986, 16160, 14708, 4768, 4774, 15471, 12929; Payload ID: 19272 relates to Category No.: 1730, 16172, 3986, 7345, 16160, 4774, 14636; Payload ID: 19273 relates to Category No.: 12137, 15626, 16172, 3833, 16160, 9777, 3729, 3699, 6738, 9002, 7536, 1420, 11646, 10734, 3758, 6733, 4774, 14708, 10495, 13380, 3986, 16170, 16161, 15666; Payload ID: 19274 relates to Category No.: 16172, 16160, 12137, 6738, 1000, 11646, 16189, 13366, 10734, 7301, 8606; Payload ID: 19275 relates to Category No.: 13589, 3398, 15490, 3398, 14565; Payload ID: 19276 relates to Category No.: 13589, 3398, 15490, 3398; Payload ID: 19277 relates to Category No.: 13589, 3398, 15490, 3398, 11512, 14636; Payload ID: 19278 relates to Category No.: 13589, 3398, 15490, 3398; Payload ID: 19279 relates to Category No.: 13589, 3398, 15490, 3398; Payload ID: 19280 relates to Category No.: 13594, 13589, 3398, 1730, 12091, 15490, 3398, 14565, 7306, 1780, 1752, 3620, 3624, 10285; Payload ID: 19281 relates to Category No.: 13589, 3398, 5367, 15490, 3398, 11512, 1730, 15517, 12498, 7743, 11506, 3398, 1767, 12488, 7724, 10557, 10586, 10386, 13779, 10105, 13594, 8112, 13835, 10366, 14050, 13882, 13936, 10372, 2001, 4145, 13893, 692, 5334, 3940, 10226, 13913, 10034, 12854; Payload ID: 19282 relates to Category No.: 13589, 3398, 15490, 3398, 1730, 8739, 11506, 3398, 14640, 11740, 6795, 3535, 11512; Payload ID: 19283 relates to Category No.: 14589, 2392; Payload ID: 19284 relates to Category No.: 3013, 13530, 1509, 13797, 5544, 4535, 13888, 9485, 13824, 4448, 13812, 14534; Payload ID: 19285 relates to Category No.: 12648, 2940, 296, 290, 1078, 287, 10366, 11884, 2893, 3775, 283, 284, 10191, 3791, 10573, 1960, 13788, 13682, 10190, 12467, 13060, 10890, 11051, 7840, 10588, 1997, 15286, 5753, 13151; Payload ID: 19286 relates to Category No.: 2940, 283; Payload ID: 19287 relates to Category No.: 795, 11765, 16197, 1844, 7252, 7342, 8378, 10648, 5732, 1128, 14656, 907, 5734, 6113; Payload ID: 19289 relates to Category No.: 1703, 10074, 7242, 1820, 7737, 3807, 1238, 448, 7340, 10080, 10075, 6018, 7252, 12007, 776, 12638, 1023; Payload ID: 19290 relates to Category No.: 10593, 8118, 10802; Payload ID: 19291 relates to Category No.: 13589, 3398, 15490, 3398, 14014, 16214, 8928, 8933, 14063; Payload ID: 19292 relates to Category No.: 13589, 3398, 15490, 3398, 16214, 14014, 11512, 14059, 7743, 1463, 1741, 10372, 14063; Payload ID: 19293 relates to Category No.: 13589, 3398, 1764, 11512, 14565, 8739, 14967, 8731, 3398, 7743, 15521, 10648, 4439, 16225, 8196, 11612, 10881, 3010, 1192, 12568, 9410, 1417, 14640, 1836, 7306, 5998, 6554, 10240, 5751, 15490, 3398; Payload ID: 19294 relates to Category No.: 9500, 1893, 1269, 1238, 3474, 11660, 9674, 16233; Payload ID: 19295 relates to Category No.: 9500, 2083, 9674, 16233; Payload ID: 19296 relates to Category No.: 1204; Payload ID: 19297 relates to Category No.: 4021, 10383; Payload ID: 19298 relates to Category No.: 5367, 7912, 1703, 12427, 5446, 1820, 4021, 12724, 11178, 11242, 11316, 11390, 7657, 11623, 11596, 3643, 1705, 14691, 10383, 9350; Payload ID: 19299 relates to Category No.: 12091, 1026, 14661, 14565, 5428, 1713, 9720, 4998, 2885, 12648, 15614, 5446, 6606, 348, 3854, 345, 6705, 4186, 275, 9891, 14838, 12646, 12391, 4127, 3775, 5541, 16085, 8988, 3246, 6530, 11858, 15194, 10877, 11363, 10955, 14944, 11187, 6018, 6613, 6615, 6616, 11186, 14949, 10025, 6706, 11582, 11584, 9485, 11581, 4125, 11191, 3147, 3592, 6614, 5364, 3047, 6666, 5973, 3860, 6620, 6703, 10648, 5785, 10372, 13996, 14834, 7379, 4729, 10954, 12764, 2128, 8496, 3197, 3536, 7378, 4972, 6419, 10366, 4459, 16213, 11302, 14782, 11125, 14781, 10922, 3801; Payload ID: 19300 relates to Category No.: 16060; Payload ID: 19301 relates to Category No.: 13589, 3398, 15490, 3398, 13594, 6114, 8739, 15517, 11512, 10648, 1729, 6111, 5458, 2878, 12703; Payload ID: 19302 relates to Category No.: 13594, 13589, 3398, 9052, 5544, 13860, 15517, 11512, 11506, 3398; Payload ID: 19303 relates to Category No.: 13594, 8862, 13589, 3398, 8424, 7951, 14448, 15517, 11512, 5459, 15400, 15195, 13756, 14417, 14117, 1298, 14119; Payload ID: 19304 relates to Category No.: 13594, 13589, 3398, 11512, 15517, 1238, 9590, 5406, 14620, 12816; Payload ID: 19305 relates to Category No.: 13594, 13589, 3398, 11512, 15517, 1238, 12646, 5406, 10648, 480, 12816, 12664; Payload ID: 19306 relates to Category No.: 13594, 13589, 3398, 11512, 15517, 1238, 8862; Payload ID: 19307 relates to Category No.: 12091, 6606, 348, 345, 2410, 6695, 11858, 3885, 8296, 13116; Payload ID: 19308 relates to Category No.: 13589, 3398, 11512, 8739, 2411, 8731, 3398, 11506, 3398, 1238, 10745, 11487, 10749, 5406, 1060, 12891, 4332, 1417, 14945, 7372, 14910, 15400, 3576, 5242, 2021; Payload ID: 19309 relates to Category No.: 13589, 3398, 11512, 15517, 11506, 3398, 4439, 4442, 10031; Payload ID: 19310 relates to Category No.: 11512, 12619, 15517, 7132, 4336, 7162; Payload ID: 19311 relates to Category No.: 13589, 3398, 15490, 3398, 11512, 1722, 2139, 7613, 8739, 2411, 10372, 1955, 1483, 6606, 1862, 11506, 3398, 12891, 15521, 13856, 9125, 4439, 2424, 9528, 15570, 11331, 13827, 1957, 3728, 10470, 10626, 10574, 10983, 1318, 13566, 8662, 4182, 8326, 7990, 7732, 13865, 10992, 10514; Payload ID: 19312 relates to Category No.: 13589, 3398, 12516; Payload ID: 19313 relates to Category No.: 13594, 13589, 3398, 15490, 3398, 11506, 3398; Payload ID: 19314 relates to Category No.: 15618, 795, 12491, 710, 16197, 6451, 13165, 3791, 6453, 12492, 15149, 6102, 8554, 1112, 8956, 708, 7030; Payload ID: 19315 relates to Category No.: 15618, 12491, 710, 12492, 8175, 8536; Payload ID: 19316 relates to Category No.: 15618, 12491, 12714, 710, 12492, 413; Payload ID: 19317 relates to Category No.: 4828, 1204, 13985; Payload ID: 19318 relates to Category No.: 4828, 13985; Payload ID: 19319 relates to Category No.: 4828, 13985; Payload ID: 19320 relates to Category No.: 11926, 6986, 1893, 15768, 2994; Payload ID: 19321 relates to Category No.: 12194, 13589, 3398, 1764, 12153, 7613, 8739, 7743, 11506, 3398, 12117, 10358, 2006, 13597, 8744; Payload ID: 19322 relates to Category No.: 12153, 1244, 4021, 690, 12137, 11830, 13578, 12499, 11878, 9075, 15806, 8101, 8715, 7922, 9557, 13589, 3398, 8739, 11934, 13882, 13837, 8929, 12604; Payload ID: 19323 relates to Category No.: 11940, 1703, 10074, 4021, 1238, 10080, 14050, 1823, 1238, 5825, 4999, 6269, 10036, 13883; Payload ID: 19324 relates to Category No.: 4021, 1119; Payload ID: 19325 relates to Category No.: 11940, 13003, 1447; Payload ID: 19331 relates to Category No.: 1204; Payload ID: 19332 relates to Category No.: 6814; Payload ID: 19334 relates to Category No.: 10372, 13465; Payload ID: 19335 relates to Category No.: 11091, 7662, 10383; Payload ID: 19336 relates to Category No.: 11091, 7662; Payload ID: 19338 relates to Category No.: 15490, 3398, 12153, 8739, 1060, 16197, 16051, 1719, 5141; Payload ID: 19339 relates to Category No.: 5782, 16172; Payload ID: 19340 relates to Category No.: 5782, 14097, 3698, 14097, 3702; Payload ID: 19341 relates to Category No.: 5782, 14097, 3698; Payload ID: 19342 relates to Category No.: 5782, 14097, 3698, 14097, 3702; Payload ID: 19343 relates to Category No.: 13589, 3398, 15490, 3398, 5782, 1730, 14838, 3699; Payload ID: 19344 relates to Category No.: 12137, 5782, 14097, 3698, 14097, 3702, 13376, 15535, 8202, 10314; Payload ID: 19345 relates to Category No.: 3635, 12137; Payload ID: 19346 relates to Category No.: 10702, 934; Payload ID: 19347 relates to Category No.: 6814, 14661, 12137, 5782, 14565, 3986, 275, 9238, 12851, 2886, 12391, 2311, 16197, 6738, 8988, 10628, 6745, 8887; Payload ID: 19348 relates to Category No.: 6814, 14661, 12137, 14565, 12391, 5782, 795, 9238, 2886, 11285, 8988, 11291, 11242, 8507, 2116, 1967, 12849, 12850, 10254; Payload ID: 19349 relates to Category No.: 13589, 3398, 11512, 5428, 8739, 5446, 15517, 5359, 9038, 13818, 10775, 8004, 8126, 11506, 3398, 2878, 10828, 8374; Payload ID: 19350 relates to Category No.: 13589, 3398, 11512, 15207, 5428, 2885, 7613, 8739, 5446, 10372, 8731, 3398, 15517, 5359, 9038, 11109, 3021, 11506, 3398, 12999, 14036, 7362, 10775, 7965, 4127, 16197, 14992, 8988, 2014, 2136, 15456, 15450, 7363, 15448, 15443, 2088, 15454, 11573, 13893, 15446, 15653, 15457, 15458, 13970, 15451, 9294, 6740, 8391, 1849, 11010, 2069, 2001, 2021, 4937, 13788, 9410, 6269, 8508, 2041, 3012, 13956, 13952, 10828, 13969, 13925, 13936, 13989, 496, 13886, 13888, 13827, 13773, 13818, 13797, 13951, 13877, 8117, 10429, 13809, 203, 11354; Payload ID: 19351 relates to Category No.: 13589, 3398, 15490, 3398, 11512, 5428, 8739, 5446, 2467, 5359, 9038, 13818, 14992, 15782, 8126, 736, 8731, 3398, 10648, 15327, 7377, 15329, 2082; Payload ID: 19352 relates to Category No.: 6494, 3799; Payload ID: 19356 relates to Category No.: 2610, 602, 8688, 8149; Payload ID: 19358 relates to Category No.: 5376; Payload ID: 19359 relates to Category No.: 8373; Payload ID: 19364 relates to Category No.: 403, 8677, 10841, 11460, 13993, 5609, 5697; Payload ID: 19365 relates to Category No.: 7912, 12633, 7735, 8835, 8112, 13835, 13827, 7939; Payload ID: 19366 relates to Category No.: 7912; Payload ID: 19367 relates to Category No.: 8441; Payload ID: 19369 relates to Category No.: 7912, 3013; Payload ID: 19370 relates to Category No.: 7912; Payload ID: 19371 relates to Category No.: 12194, 7912, 14838, 8441; Payload ID: 19372 relates to Category No.: 8441, 7912; Payload ID: 19373 relates to Category No.: 7912; Payload ID: 19374 relates to Category No.: 7912; Payload ID: 19375 relates to Category No.: 7912; Payload ID: 19377 relates to Category No.: 7912, 8507, 14640, 9540, 7879, 7341; Payload ID: 19378 relates to Category No.: 7912, 8507, 15570, 14640, 9540, 7879, 7341; Payload ID: 19379 relates to Category No.: 1737, 16197, 7132, 7890, 7802, 12009, 12720, 8622, 10626, 14025, 7154, 12712, 12710; Payload ID: 19380 relates to Category No.: 12137, 3691, 3986, 849, 14097, 3698, 10366, 4020, 11302, 14097, 3702; Payload ID: 19381 relates to Category No.: 287, 11884, 7252, 12365, 10244, 274, 6020; Payload ID: 19382 relates to Category No.: 14661, 442, 5446, 4130, 16197, 16085, 10889, 8661, 274, 12365, 690, 6666, 3639, 6018, 608, 292, 6020; Payload ID: 19383 relates to Category No.: 12648, 2940, 287, 11884, 6018, 9349, 11055; Payload ID: 19384 relates to Category No.: 3833, 286, 10194, 6018, 4229, 288, 6754; Payload ID: 19385 relates to Category No.: 14661, 12648, 3639, 5446, 297, 11884, 4130, 270, 292, 10194, 271, 13974; Payload ID: 19386 relates to Category No.: 14661, 12648, 3639, 5446, 4130, 270, 292, 10194, 271; Payload ID: 19387 relates to Category No.: 14661, 1730, 12648, 3639, 5446, 7306, 14838, 4130, 270, 292, 10194, 271; Payload ID: 19388 relates to Category No.: 6670, 3541, 6537; Payload ID: 19389 relates to Category No.: 12153, 8739, 5406, 7303, 7710, 7974, 4538, 12649, 2009, 1840; Payload ID: 19390 relates to Category No.: 1204, 11495, 11496; Payload ID: 19391 relates to Category No.: 11285, 10606; Payload ID: 19392 relates to Category No.: 3691, 10938, 492; Payload ID: 19393 relates to Category No.: 14267, 5032, 12711; Payload ID: 19394 relates to Category No.: 5785, 12153, 1204; Payload ID: 19395 relates to Category No.: 5785, 12153; Payload ID: 19396 relates to Category No.: 2460, 13363, 12793, 14467, 2459, 5949, 1463, 3900, 12882, 1598, 3578, 9540, 13757, 8862, 14699, 3602, 12835, 2464, 12879, 990, 3245, 4501, 13449; Payload ID: 19397 relates to Category No.: 11465, 15256; Payload ID: 19399 relates to Category No.: 14456, 10074, 1238, 10080, 274, 13664, 14365, 10191, 13266; Payload ID: 19401 relates to Category No.: 14164, 1780, 6635, 151, 6360, 6632, 151, 6360, 9125; Payload ID: 19404 relates to Category No.: 7306; Payload ID: 19405 relates to Category No.: 2459, 5792, 9420; Payload ID: 19407 relates to Category No.: 1905, 11502;

Payload ID: 19411 relates to Category No.: 6637, 151, 6360; Payload ID: 19413 relates to Category No.: 7273, 11648, 14838, 7287; Payload ID: 19414 relates to Category No.: 9420; Payload ID: 19415 relates to Category No.: 2459, 5792, 12013, 9420; Payload ID: 19416 relates to Category No.: 14318, 16214, 1204, 14014, 12522, 14057; Payload ID: 19418 relates to Category No.: 4969; Payload ID: 19419 relates to Category No.: 15715, 15712, 4439, 15708, 14192; Payload ID: 19421 relates to Category No.: 3889, 16170, 9187, 6977, 13736, 13144; Payload ID: 19422 relates to Category No.: 12638; Payload ID: 19423 relates to Category No.: 1002, 998, 2073, 9246, 7129, 12043, 11995; Payload ID: 19424 relates to Category No.: 998, 2073, 9246, 7129, 12043, 11995; Payload ID: 19425 relates to Category No.: 6637, 151, 6360, 1204, 11294; Payload ID: 19426 relates to Category No.: 7306; Payload ID: 19427 relates to Category No.: 11915, 16197, 14643, 7303, 1955, 6530, 10574, 14838, 3452, 5242, 14641, 14442, 3602, 14586, 13368; Payload ID: 19429 relates to Category No.: 15490, 3398, 5159, 2410, 5146, 5185, 5189, 5190; Payload ID: 19432 relates to Category No.: 14318, 14164, 1204, 14211; Payload ID: 19433 relates to Category No.: 1204, 1905, 11502; Payload ID: 19435 relates to Category No.: 1722, 7743, 7635; Payload ID: 19436 relates to Category No.: 1779, 9420; Payload ID: 19437 relates to Category No.: 9223, 3995, 15490, 3398, 11512, 16286, 11509, 8349, 10745, 5160, 10746; Payload ID: 19438 relates to Category No.: 8906, 7168, 2243; Payload ID: 19442 relates to Category No.: 4969; Payload ID: 19444 relates to Category No.: 3615; Payload ID: 19446 relates to Category No.: 1204, 1228, 14211; Payload ID: 19447 relates to Category No.: 13594, 5095, 13165, 11294; Payload ID: 19449 relates to Category No.: 14915, 2410, 4439, 7546, 13594, 7743, 10372, 14407, 7941; Payload ID: 19450 relates to Category No.: 4969; Payload ID: 19451 relates to Category No.: 8906, 3889, 16170, 8454, 9187, 6977, 4458, 14095, 13144; Payload ID: 19452 relates to Category No.: 5159; Payload ID: 19453 relates to Category No.: 1026, 14661, 5446, 6606, 348, 4186, 7291, 16182, 12391, 4127, 3775, 5541, 16085, 8988, 14271, 16183, 9982; Payload ID: 19461 relates to Category No.: 795, 5202; Payload ID: 19462 relates to Category No.: 3555; Payload ID: 19463 relates to Category No.: 4445; Payload ID: 19464 relates to Category No.: 998, 2073, 9246, 7129, 12043, 11995, 1002, 3684, 1893, 6451, 5855, 16167, 15579; Payload ID: 19465 relates to Category No.: 998, 2073, 9246, 7129, 12043, 11995, 6451; Payload ID: 19466 relates to Category No.: 12153; Payload ID: 19467 relates to Category No.: 3691; Payload ID: 19468 relates to Category No.: 1894, 6814; Payload ID: 19469 relates to Category No.: 12091, 1737, 12619, 7154, 7132, 4336, 1238, 4332, 8940, 9720, 6969, 3871; Payload ID: 19470 relates to Category No.: 12091, 9720, 7154, 4144, 4147, 13113, 8418; Payload ID: 19471 relates to Category No.: 3356, 3354, 12776, 3371; Payload ID: 19472 relates to Category No.: 9232, 13975, 9228, 3452, 1955, 12498, 3356, 3354, 3320, 3353, 3448, 15257, 1089, 3336, 1874, 1893, 13729, 12120, 11660, 1709, 3455, 1978, 2116, 496, 10771, 14037, 3371, 7305, 9245, 12940, 13733, 1295; Payload ID: 19473 relates to Category No.: 12117, 11128, 11936; Payload ID: 19474 relates to Category No.: 6814, 13589, 3398, 15490, 3398, 14318, 6902, 2409, 1204; Payload ID: 19475 relates to Category No.: 6902; Payload ID: 19476 relates to Category No.: 1204; Payload ID: 19477 relates to Category No.: 11930; Payload ID: 19479 relates to Category No.: 13594, 13589, 3398, 11512, 7613, 8739, 8731, 3398, 10238, 15517, 4949, 8760, 7743, 11506, 3398, 14271, 4500, 1925, 1988, 7735, 6530, 5949, 3791, 15424, 6523, 16005, 1318, 14532, 4502, 3228, 4490, 16096, 6785, 4458, 472, 1463, 13270, 15368, 4789, 471, 10708, 1558, 16210, 6860, 11643, 6844, 6873, 8292, 10952, 7978, 10998, 12891, 6878, 14838, 795, 14831, 14442, 8279, 14520, 6812, 14586; Payload ID: 19480 relates to Category No.: 7288, 1721, 14271, 4439, 12484, 16182, 7285, 13185, 16182; Payload ID: 19481 relates to Category No.: 13589, 3398, 15490, 3398, 2940, 4441, 13882, 12640, 8071, 10649, 8408; Payload ID: 19482 relates to Category No.: 8929, 16286, 1741, 10372, 1483, 1816, 7306, 10314, 11363, 2131, 2110, 5859, 10626, 6563, 6111, 11512, 966, 10983, 1549, 10575, 11087, 5985, 10321, 6380, 1784, 6375, 10558; Payload ID: 19483 relates to Category No.: 8929, 16286, 1741, 10372, 1483, 1816, 7306, 11506, 3398, 1269, 10314, 11363, 6995, 11125, 7662, 7971, 14050, 7750, 3568, 10626, 10889, 7755, 14571, 10803, 2171, 2236, 1487, 14814, 10507, 7723, 11512, 8930, 1318, 5459, 3437, 7730, 8548, 7417, 11285, 4974, 8756, 14882, 15195, 15901, 4248, 6882, 8931, 7385, 6997, 3241, 6999, 1784, 9411, 2088, 5019, 8928; Payload ID: 19484 relates to Category No.: 8929, 16286, 1741, 7306, 15459, 4939, 2131, 14643, 4937, 9320, 3782, 14392, 10648, 8866, 13265; Payload ID: 19485 relates to Category No.: 8929, 16286, 1741, 1483, 10238, 7306, 2376, 12117, 7971, 2110, 4974, 8739, 13594, 11512, 1925, 10372, 11344, 7939, 11363, 4336, 2079, 14624, 10314, 1722, 6219, 14638, 14699, 10287, 2080, 13338, 11147, 2086, 10572, 14459, 10638, 12861, 7382, 13481, 1278, 13367, 11146, 10223, 4325, 2003; Payload ID: 19486 relates to Category No.: 12091, 10702, 7613, 8929, 16286, 1741, 8731, 3398, 7728, 7306, 11506, 3398, 7737, 7693, 10366, 360, 10648, 7735, 9540, 12007, 2110, 11418, 3612, 472, 2523, 6390, 16009, 7708, 8899, 6806, 11268, 5949, 10238, 9480, 3812, 9455, 1272, 1483, 6492, 14790, 16137, 1183, 860, 11544, 9131, 9585, 10039, 9091, 2652, 10042, 8281, 7985, 13967, 1730; Payload ID: 19487 relates to Category No.: 8929, 16286, 1741, 7306, 5939, 7728, 10648, 10878, 11187, 9511, 13734, 5941, 9393, 1276, 1549; Payload ID: 19488 relates to Category No.: 8929, 16286, 1741, 7306, 2376, 10314, 6530, 4974, 5859, 2698, 6111, 4260, 1483, 2116, 10292, 6380, 6788; Payload ID: 19489 relates to Category No.: 16286, 7306; Payload ID: 19490 relates to Category No.: 11512, 8929, 16286, 1741, 10372, 1483, 7306, 11506, 3398, 7693, 11285, 2661, 10314, 11313, 9540, 10320, 11174, 11242, 2110, 1782, 8370, 8378, 10333, 10507, 8055, 10989, 1484, 5406, 1892, 10266, 724, 1026, 4021, 3176, 10475, 14620, 13143, 5459, 4952, 14793, 6795, 10074, 4998, 9455, 1048, 11363, 10470, 11628, 6559, 12526, 3444, 5073, 7637, 12628, 11382, 11084, 10075, 14882, 7971, 10449, 11536, 1014, 14781, 11296, 1558, 9588, 16288, 10380, 1784, 7896, 10316; Payload ID: 19491 relates to Category No.: 8929, 16286, 1741, 8731, 3398, 1483, 7306, 11506, 3398, 7693, 10314, 6530, 4138, 3812, 5949, 8004, 10287, 11147, 2131, 3910, 682, 6269, 6857, 6563, 472, 10446, 10507, 8656, 10214, 9573, 4148, 9093, 8699, 8253, 10457, 8700, 1730, 8835, 7737, 10702, 4367, 6878, 1318, 672, 10629, 7986, 2116, 3581, 1320, 5951, 6810, 7730, 11418, 14688, 15195, 6812, 14533, 7618, 5263, 15763, 15295, 9375, 13719, 12650, 9091, 15415, 14789, 6785, 8848, 6876, 5365, 10971, 13720, 6862, 6863; Payload ID: 19492 relates to Category No.: 1026, 11512, 7613, 8929, 5939, 16286, 1741, 8731, 3398, 11109, 10940, 7306, 345, 11506, 3398, 344, 7693, 6530, 2041, 2013, 10558, 10790, 1892, 3812, 16294, 9540, 7971, 11243, 10822, 10851, 13970, 2131, 2110, 4974, 11449, 10557, 361, 10626, 1922, 11094, 10226, 1622, 10945, 6111, 3612, 11268, 10414, 11146, 4450, 10479, 9393, 16286, 1424, 9334, 10407, 4066, 11574, 11330, 8281, 11267, 3803, 12091, 10543, 724, 3445, 11740, 8940, 8887, 3176, 10475, 10814, 1752, 5459, 10574, 2548, 3437, 4952, 10372, 11176, 11174, 14793, 7939, 6375, 11628, 3578, 10856, 7242, 7986, 1483, 10878, 13363, 3595, 6194, 14790, 11285, 7662, 7637, 7553, 10983, 2061, 722, 3563, 15805, 16069, 6555, 12558, 8888, 9131, 8270, 10879, 3896, 5070, 5912, 608, 11120, 3247, 10329, 16041, 9585, 6995, 10039, 9091, 2652, 2655, 10044, 16019, 5331, 10042, 3878, 9723, 1013, 2651, 10380, 11488, 6804, 6788, 9092, 6079, 8501, 10971, 7002, 3188, 8669, 2256, 15760, 10045, 10047, 10041, 10040, 10046, 6707, 13835, 13969, 13859, 1730, 11821, 3940, 13881, 14022, 6371, 10379; Payload ID: 19493 relates to Category No.: 8929, 16286, 1741, 7306, 2376, 10366, 4094, 2110, 6113, 7693, 10606, 16294; Payload ID: 19494 relates to Category No.: 8929, 16286, 1741, 9321, 7306, 10648, 2110, 2698, 11501, 11506, 3398, 1318, 1015, 8852, 3817, 8850; Payload ID: 19495 relates to Category No.: 11512, 8929, 16286, 1741, 1483, 7306, 11506, 3398, 11431, 14533, 2376, 10577, 10878, 9540, 1621, 2131, 3568, 1782, 3584, 3594, 16290, 14927, 3578, 14943, 8370, 6113, 14782, 12646, 3445, 10648, 7613, 15143, 13836, 690, 12521, 8977, 1622, 10314, 12526, 3595, 10557, 2222, 6192, 14781, 16041, 914, 16042, 2179, 9487, 9091, 3871, 14632, 14629, 13835, 16294, 10372; Payload ID: 19496 relates to Category No.: 8929, 16286, 1741, 1483, 15143, 7306, 1874, 10878, 2393, 15478, 11147, 5244, 2110, 6113, 5406, 6377, 6384, 6375, 6563, 9525, 14950, 6834, 2179, 6844, 6855, 3602, 4260, 6879, 3928, 4195, 6290, 3195, 3606, 13705, 13707, 9477, 5463, 10648, 10372, 690, 8639, 14688, 9321, 16095, 6390, 675, 802; Payload ID: 19497 relates to Category No.: 8929, 16286, 1741, 7306, 3641, 13363, 1764, 10112, 10111, 12452, 3894, 1483, 10314, 9540, 14000, 1488, 13610, 1484, 8867; Payload ID: 19498 relates to Category No.: 8862, 14565, 8929, 16286, 1741, 7306, 10314, 2110, 13835, 14000, 3171, 4418; Payload ID: 19499 relates to Category No.: 8929, 16286, 1741, 1816, 7306, 7743, 7134, 7693, 2110, 7799, 5859, 2698, 3609, 3613, 672, 7840, 7728, 1483, 3584, 11394, 10358, 7708; Payload ID: 19500 relates to Category No.: 8929, 16286, 1741, 7306, 1816, 2110, 2698, 14000, 5406, 5949, 1318, 10331, 13371, 6523, 9540, 1483, 3575, 2116, 1320, 5951, 6810, 6807, 12507, 16286, 10038, 16042, 13133, 13631, 5952, 6783, 2595, 3897, 8853, 6875, 6876; Payload ID: 19501 relates to Category No.: 5367, 14661, 15207, 5446, 12603, 3781, 297, 11884, 3012, 4130, 1238, 7740, 13553, 15185, 3691, 287, 292; Payload ID: 19502 relates to Category No.: 1737, 1026, 13589, 3398, 15490, 3398, 13248, 14661, 3766, 16165, 5446, 7154, 297, 11884, 4130, 14663, 10628, 6721, 7252, 16169, 9053, 8274, 10443, 8239, 274, 13788, 14900, 13363, 1891; Payload ID: 19503 relates to Category No.: 12091, 5785, 8928, 5848, 8454, 7834, 9716, 12665, 11444, 8437, 8198, 11858, 8541; Payload ID: 19504 relates to Category No.: 12091, 5785, 7743, 7946, 11858, 11398, 13040; Payload ID: 19505 relates to Category No.: 12091, 5785, 7613, 11858, 11399, 10301, 11176, 10588, 11398, 10869, 13040, 11347, 11346, 8437; Payload ID: 19506 relates to Category No.: 12091, 5785, 5848, 5845, 13711, 12665, 3291, 2331, 11997, 8437; Payload ID: 19507 relates to Category No.: 14565, 16286, 7306, 7693, 10606; Payload ID: 19508 relates to Category No.: 1703, 7728, 14565, 16286, 12633, 1816; Payload ID: 19509 relates to Category No.: 14565, 1703, 12633, 1816, 7728; Payload ID: 19510 relates to Category No.: 14565, 1703, 12633, 1816, 7728; Payload ID: 19511 relates to Category No.: 5782, 10775, 10314, 11620, 11619, 722, 16286, 6796, 5066, 6995, 3980; Payload ID: 19512 relates to Category No.: 15490, 3398, 3452, 674, 3354, 2410, 3453, 8739, 13589, 3398, 12839, 2409, 5154, 1269, 970, 969, 12787, 5187, 6757, 10874; Payload ID: 19513 relates to Category No.: 15490, 3398, 2410, 5203, 8731, 3398, 5159, 5150; Payload ID: 19514 relates to Category No.: 14456, 8739, 3684, 3837, 16214, 8373, 1893, 8911, 11298, 12117, 13831, 1408, 5949, 12051, 8611, 5855, 10301, 4535, 13724, 11279, 10696, 3827, 3667, 8496, 7627, 8787, 7915, 10208; Payload ID: 19515 relates to Category No.: 6814; Payload ID: 19517 relates to Category No.: 15490, 3398, 8739, 1752, 3871, 8071, 5072, 10955, 8419, 12967, 13035; Payload ID: 19518 relates to Category No.: 8739, 8071, 8419; Payload ID: 19519 relates to Category No.: 1204; Payload ID: 19520 relates to Category No.: 14318, 14267, 7272, 16182, 13165, 11294, 14271, 12603; Payload ID: 19522 relates to Category No.: 11512, 1965, 3900, 10648, 3783, 10740; Payload ID: 19523 relates to Category No.: 7272, 16182; Payload ID: 19524 relates to Category No.: 13594; Payload ID: 19525 relates to Category No.: 15490, 3398, 1955, 11506, 3398, 8503, 10938, 5218, 4331, 5144; Payload ID: 19526 relates to Category No.: 12154, 15618, 11843, 14565, 12153, 5846, 8731, 3398, 2169, 16189; Payload ID: 19527 relates to Category No.: 12154, 13041, 11843, 12153, 8739, 1894, 8731, 3398, 13126, 11860, 11969, 8004, 8611, 8772, 16189, 8545, 13329, 15517, 11512; Payload ID: 19528 relates to Category No.: 6814, 11512, 9500, 16286, 8831, 14972, 2131, 10600, 14641, 9455, 4039, 5807, 10601; Payload ID: 19529 relates to Category No.: 13589, 3398, 15490, 3398, 11512, 10372, 15521, 7693, 4439, 15570, 5072, 8522, 8535, 7712, 10578, 14945, 13484, 8739, 7303, 12153, 2460, 9455, 14383, 5951, 7971, 4502, 6773, 12583, 13137; Payload ID: 19530 relates to Category No.: 8739, 8071, 8419; Payload ID: 19536 relates to Category No.: 334, 9500, 14663, 12242, 11307, 8524, 9236, 8004, 8535, 7924, 11163, 12252, 8806, 16301, 7922, 8810, 5998, 12821; Payload ID: 19537 relates to Category No.: 690, 15898, 13589, 3398, 5367, 12137, 1002, 11512, 7613, 8739, 3684, 9854, 15517, 10785, 1746, 1983, 7345, 8928, 4104, 11452, 10265, 9420, 11285, 1893, 455, 16085, 2041, 2083, 13831, 2009, 2088, 10606, 10256, 11502, 2353, 1906, 13376, 10852, 11510, 5855, 2143, 1971, 6269, 919, 11520, 2029, 10581, 11529, 7915, 3715, 1984, 10550, 11239, 4108, 10787, 11000, 10724, 11912, 8356, 10552, 10754, 2076, 2162, 14981, 1977, 2020, 11207, 7917, 11194, 10888, 13889, 13594, 11236, 4535, 12519, 3795, 5810, 3980, 3797; Payload ID: 19538 relates to Category No.: 4828, 16189, 1880; Payload ID: 19539 relates to Category No.: 9296, 14034, 3354, 15533, 9296, 3327, 4485, 7303, 13975, 14025, 5808, 13786; Payload ID: 19540 relates to Category No.: 7018, 9296, 3354, 1893, 12120, 11660, 4485, 9296, 3311, 13167, 16050, 1955, 5805, 14036, 13827, 13786; Payload ID: 19541 relates to Category No.: 1204; Payload ID: 19542 relates to Category No.: 795, 2885, 15817, 13891, 8509; Payload ID: 19543 relates to Category No.: 274, 4949; Payload ID: 19544 relates to Category No.: 274, 16136, 1570, 1814, 4949; Payload ID: 19550 relates to Category No.: 3730, 9900; Payload ID: 19553 relates to Category No.: 5434, 795, 12153, 7613, 16286, 1955, 12999, 12646, 2674, 7840, 11765, 10314, 11298, 5806, 11270, 13000, 12551, 13261; Payload ID: 19554 relates to Category No.: 15626, 624, 12521, 1836, 12649, 14624, 7369, 1872; Payload ID: 19555 relates to Category No.: 15490, 3398, 9296, 14267, 3354, 7291, 16182, 4444, 15533, 1227, 2243; Payload ID: 19556 relates to Category No.: 6814, 12194, 1292; Payload ID: 19557 relates to Category No.: 6814, 12194; Payload ID: 19558 relates to Category No.: 12099, 4494; Payload ID: 19559 relates to Category No.: 14052; Payload ID: 19560 relates to Category No.: 3452, 9296, 3354, 3448, 1089, 14590, 15533, 4485, 9296, 3322, 13882, 13827, 13970, 1955; Payload ID: 19561 relates to Category No.: 3452, 3354, 12431, 3448, 7132, 2198, 13904, 6680, 7157, 14998, 3455, 6687, 5406, 7303, 1955, 14793, 8373, 13856, 8906, 14052, 11087, 12876; Payload ID: 19562 relates to Category No.: 3452, 1955, 3354, 12431, 3353, 3448, 13904, 6680, 14998, 3455, 12682, 13744, 11029, 13970; Payload ID: 19563 relates to Category No.: 14052, 3354, 3353, 3448, 3335, 1893, 16197, 12120, 3453, 11660, 3882, 10908, 2044; Payload ID: 19564 relates to Category No.: 15490, 3398, 5446, 8731, 3398, 3354, 3320, 3353, 3448, 15257, 16197, 3453, 11573, 1978, 3882, 13489, 2155, 1780, 4970, 11087; Payload ID: 19565 relates to Category No.: 15490, 3398, 11512, 5446, 8731, 3398, 3354, 3320, 11506, 3398, 3353, 3448, 15257, 16197, 3453, 3333, 11573, 1978, 3882, 13489, 2155; Payload ID: 19566 relates to Category No.: 12194, 12091, 3453; Payload ID: 19568 relates to Category No.: 6456; Payload ID: 19569 relates to Category No.: 12194; Payload ID: 19570 relates to Category No.: 5367, 748, 736; Payload ID: 19571 relates to Category No.: 6814, 15618, 5367, 15626, 748, 744, 15223, 739, 15223, 10232, 9642, 736, 740, 15223; Payload ID: 19574 relates to Category No.: 13360; Payload ID: 19576 relates to Category No.: 6814; Payload ID: 19577 relates to Category No.: 1512, 1894, 12062, 4721, 14663, 4723, 2385, 4012, 12192, 7990; Payload ID: 19578 relates to Category No.: 4721, 5004, 2383, 1995; Payload ID: 19579 relates to Category No.: 4721, 5004, 2383, 12190, 5010; Payload ID: 19580 relates to Category No.: 1512, 14663, 1514, 4448, 16323, 16322, 4558, 3503; Payload ID: 19581 relates to Category No.: 13589, 3398, 11512, 15517, 7291, 16182, 14271, 10359, 4439, 2758, 8739, 5406, 8664, 7613, 10372, 8117; Payload ID: 19582 relates to Category No.: 13589, 3398, 15517, 14838, 15600, 7292, 9379, 14834, 8760, 7653, 9375; Payload ID: 19583 relates to Category No.: 13589, 3398, 15490, 3398, 8362, 2136, 1857, 8180, 13812, 137, 10484, 8739, 5406, 7613, 6530, 14838, 4167, 8626, 11143; Payload ID: 19585 relates to Category No.: 12194, 14318; Payload ID: 19586 relates to Category No.: 1512; Payload ID: 19587 relates to Category No.: 13589, 3398, 8739, 8731, 3398, 2410, 5146; Payload ID: 19588 relates to Category No.: 13589, 3398, 15490, 3398, 11506, 3398, 7154, 2410, 12936, 5182, 5131; Payload ID: 19589 relates to Category No.: 12091, 1730, 15614, 9717, 5446, 12646, 2088, 1026, 3766, 1894, 4130, 1238, 6145, 15192, 13653, 11512, 11178, 2131, 2110, 4541, 2094, 11858; Payload ID: 19590 relates to Category No.: 1955, 15521, 1780, 8408, 4439, 13225, 5072, 1978, 13510, 2647, 14782, 12646, 11512, 16096, 6376, 10372, 7965, 9584, 2110, 10314, 1764, 5939, 13053, 8653, 9129, 3591, 1340, 7937, 12583, 11413, 11143, 6072, 13137; Payload ID: 19591 relates to Category No.: 7131, 10491; Payload ID: 19593 relates to Category No.: 1730; Payload ID: 19595 relates to Category No.: 12137, 16172, 12828; Payload ID: 19596 relates to Category No.: 5754; Payload ID: 19598 relates to Category No.: 12137, 16172, 3684, 1893, 5855; Payload ID: 19602 relates to Category No.: 10400; Payload ID: 19606 relates to Category No.: 6814, 12137, 15626, 16159, 3986, 3833, 14097, 3698, 16160, 16167, 16172; Payload ID: 19607 relates to Category No.: 15490, 3398, 1204, 8739, 13566; Payload ID: 19608 relates to Category No.: 12194, 1780, 7122, 7016; Payload ID: 19609 relates to Category No.: 3684, 3837, 11968, 11958, 11966, 8583, 3829, 11962, 11960, 11964; Payload ID: 19610 relates to Category No.: 8771; Payload ID: 19611 relates to Category No.: 7290; Payload ID: 19612 relates to Category No.: 14267, 14029, 13893, 10177; Payload ID: 19613 relates to Category No.: 11550; Payload ID: 19614 relates to Category No.: 13186, 5285; Payload ID: 19616 relates to Category No.: 15490, 3398, 8731, 3398, 11506, 3398; Payload ID: 19617 relates to Category No.: 13589, 3398, 15490, 3398, 12619; Payload ID: 19618 relates to Category No.: 13594, 15490, 3398, 2139, 1730, 8739, 3452, 1955, 8004, 14037, 13589, 3398, 724, 10648, 14838, 2424, 1464, 14210, 11512, 2014, 13992; Payload ID: 19619 relates to Category No.: 13589, 3398, 15490, 3398; Payload ID: 19621 relates to Category No.: 6814, 5446, 1204, 11573, 11574; Payload ID: 19622 relates to Category No.: 12091, 5367, 5785, 15207, 9720, 1730, 15614, 9717, 5446, 403, 11452, 15202, 15194, 15185, 1053, 11626, 10219, 15188, 11858, 1129, 8840, 15388, 10218, 10307; Payload ID: 19623 relates to Category No.: 13589, 3398, 15490, 3398; Payload ID: 19624 relates to Category No.: 13589, 3398, 15490, 3398; Payload ID: 19625 relates to Category No.: 13589, 3398, 15490, 3398; Payload ID: 19626 relates to Category No.: 13589, 3398, 15490, 3398; Payload ID: 19627 relates to Category No.: 13589, 3398, 15490, 3398, 1204; Payload ID: 19628 relates to Category No.: 13589, 3398, 15490, 3398; Payload ID: 19629 relates to Category No.: 13594, 5785, 8349, 8112, 13186, 8763, 11129, 3001, 14200; Payload ID: 19630 relates to Category No.: 13589, 3398, 13186, 4439, 16096, 7303, 795, 4949, 1780, 14921, 3602, 13618, 2393, 15195, 8888, 9223, 3001, 11758, 7270; Payload ID: 19631 relates to Category No.: 13589, 3398, 4998, 1780, 11129, 3001, 7270, 14782, 3023, 8653, 14781, 15195, 13186, 9223, 3001; Payload ID: 19632 relates to Category No.: 13589, 3398, 15490, 3398; Payload ID: 19634 relates to Category No.: 13589, 3398, 15490, 3398, 6530, 4138, 6687, 5406, 14834, 12897; Payload ID: 19635 relates to Category No.: 13589, 3398, 15490, 3398, 12892, 3338; Payload ID: 19636 relates to Category No.: 13589, 3398, 15490, 3398; Payload ID: 19637 relates to Category No.: 13589, 3398, 15490, 3398, 11049, 16182; Payload ID: 19638 relates to Category No.: 13589, 3398, 15490, 3398; Payload ID: 19639 relates to Category No.: 13589, 3398, 15490, 3398; Payload ID: 19640 relates to Category No.: 13589, 3398, 15490, 3398; Payload ID: 19641 relates to Category No.: 13589, 3398, 15490, 3398, 11506, 3398, 8739, 8731, 3398, 7879; Payload ID: 19642 relates to Category No.: 352, 11969; Payload ID: 19644 relates to Category No.: 13589, 3398, 15490, 3398; Payload ID: 19646 relates to Category No.: 1295, 1730, 11506, 3398, 13492, 9599, 11259, 5459, 15517, 11512, 484, 2169, 14883; Payload ID: 19647 relates to Category No.: 15490, 3398, 1295, 8731, 3398, 11506, 3398, 16214, 11363, 1730, 8887, 2169, 8862, 2464, 3197, 11119; Payload ID: 19648 relates to Category No.: 11512, 1730, 15517, 11506, 3398, 3176, 4952, 14782, 6375, 3178, 3170, 3177, 9599, 724, 3175; Payload ID: 19650 relates to Category No.: 8862, 1730; Payload ID: 19651 relates to Category No.: 15626, 14565, 1649, 5846, 13126, 5848, 8911, 15149, 2370, 14054, 8922, 13961; Payload ID: 19652 relates to Category No.: 11843, 11967; Payload ID: 19653 relates to Category No.: 12153; Payload ID: 19654 relates to Category No.: 15898, 12153, 7693, 14950, 16285, 8399, 1483, 8831, 16286, 10038; Payload ID: 19656 relates to Category No.: 9500, 1204; Payload ID: 19657 relates to Category No.: 1204; Payload ID: 19658 relates to Category No.: 7291, 16182, 14271, 14913; Payload ID: 19659 relates to Category No.: 11512, 7306, 15517, 4998, 14921, 4969; Payload ID: 19660 relates to Category No.: 11940, 8739, 5446, 11452, 15400, 11458, 7294, 11076, 11235, 1060, 15195; Payload ID: 19661 relates to Category No.: 13589, 3398, 15490, 3398; Payload ID: 19662 relates to Category No.: 13589, 3398, 15490, 3398, 1204; Payload ID: 19663 relates to Category No.: 15490, 3398, 8739; Payload ID: 19664 relates to Category No.: 15490, 3398, 8739, 8731, 3398, 4956, 1579, 2705, 13594;

Payload ID: 19665 relates to Category No.: 15490, 3398, 795, 4998, 12153, 8739, 8731, 3398, 11506, 3398, 2169, 10606, 10329, 8349, 6812, 1622, 11146, 7372, 10429, 13589, 3398, 3604, 724, 10238, 7743, 14640, 5071, 3594, 11116, 4264, 6528, 12036, 3578; Payload ID: 19666 relates to Category No.: 15490, 3398, 3684, 1893, 7724, 13165, 5855, 11294, 4419, 11506, 3398, 3532; Payload ID: 19667 relates to Category No.: 15490, 3398, 8739, 8731, 3398, 14636, 2243, 5406, 2235, 5242, 8928, 5073, 12630; Payload ID: 19668 relates to Category No.: 13589, 3398, 15490, 3398; Payload ID: 19669 relates to Category No.: 15490, 3398, 8739, 8731, 3398, 8004, 11566, 10851, 10811; Payload ID: 19670 relates to Category No.: 13594, 15490, 3398, 8731, 3398; Payload ID: 19671 relates to Category No.: 13589, 3398, 15490, 3398; Payload ID: 19672 relates to Category No.: 13589, 3398, 15490, 3398, 4969; Payload ID: 19673 relates to Category No.: 13594, 15490, 3398, 4439; Payload ID: 19674 relates to Category No.: 15490, 3398, 8739, 1204; Payload ID: 19675 relates to Category No.: 15490, 3398, 8739; Payload ID: 19676 relates to Category No.: 8739, 15517, 3354, 5750, 15605, 3313, 3132, 4998, 15203, 12737, 8408; Payload ID: 19677 relates to Category No.: 15490, 3398, 5785, 8739, 16286, 8731, 3398; Payload ID: 19678 relates to Category No.: 13589, 3398, 15490, 3398; Payload ID: 19679 relates to Category No.: 13589, 3398, 15490, 3398; Payload ID: 19680 relates to Category No.: 15490, 3398, 11512, 8731, 3398, 1955, 12775; Payload ID: 19681 relates to Category No.: 13589, 3398, 15490, 3398; Payload ID: 19682 relates to Category No.: 15490, 3398, 8739, 8731, 3398, 1955; Payload ID: 19683 relates to Category No.: 13589, 3398, 15490, 3398, 1955, 1272; Payload ID: 19684 relates to Category No.: 13589, 3398, 15490, 3398; Payload ID: 19685 relates to Category No.: 15490, 3398, 7345, 8739; Payload ID: 19686 relates to Category No.: 13589, 3398, 15490, 3398; Payload ID: 19687 relates to Category No.: 13589, 3398, 15490, 3398; Payload ID: 19688 relates to Category No.: 13589, 3398, 15490, 3398; Payload ID: 19689 relates to Category No.: 13594, 15490, 3398, 7730, 8041, 8326, 8249, 7869, 10500; Payload ID: 19690 relates to Category No.: 13589, 3398, 15490, 3398; Payload ID: 19691 relates to Category No.: 13589, 3398, 15490, 3398; Payload ID: 19692 relates to Category No.: 13594, 15490, 3398, 11512, 1722, 7743; Payload ID: 19693 relates to Category No.: 13589, 3398, 15490, 3398; Payload ID: 19694 relates to Category No.: 15490, 3398, 8739; Payload ID: 19695 relates to Category No.: 15490, 3398, 1730, 8731, 3398, 7306, 8739, 13589, 3398, 13280; Payload ID: 19696 relates to Category No.: 13594, 1730, 15517, 7306, 10648, 3532, 11512, 12610, 575, 12611, 575; Payload ID: 19698 relates to Category No.: 15715, 4439, 15718, 16181; Payload ID: 19699 relates to Category No.: 13589, 3398, 15490, 3398, 1204; Payload ID: 19700 relates to Category No.: 13589, 3398, 15490, 3398; Payload ID: 19701 relates to Category No.: 13589, 3398, 15490, 3398; Payload ID: 19702 relates to Category No.: 13594, 13589, 3398, 15490, 3398; Payload ID: 19703 relates to Category No.: 13589, 3398, 15490, 3398, 8731, 3398, 14782; Payload ID: 19704 relates to Category No.: 13589, 3398, 15490, 3398; Payload ID: 19705 relates to Category No.: 13589, 3398, 15490, 3398; Payload ID: 19706 relates to Category No.: 13594, 15490, 3398, 13589, 3398; Payload ID: 19707 relates to Category No.: 13589, 3398, 15490, 3398, 1730, 7306, 14838; Payload ID: 19708 relates to Category No.: 13589, 3398, 15490, 3398; Payload ID: 19709 relates to Category No.: 13589, 3398, 11512, 15517, 11506, 3398, 15490, 3398; Payload ID: 19710 relates to Category No.: 13589, 3398, 15490, 3398, 1204; Payload ID: 19711 relates to Category No.: 13589, 3398, 15490, 3398; Payload ID: 19712 relates to Category No.: 13589, 3398, 15490, 3398; Payload ID: 19713 relates to Category No.: 13589, 3398, 15490, 3398; Payload ID: 19714 relates to Category No.: 13594, 13589, 3398, 15490, 3398; Payload ID: 19715 relates to Category No.: 13589, 3398, 15490, 3398; Payload ID: 19716 relates to Category No.: 13589, 3398, 15490, 3398; Payload ID: 19717 relates to Category No.: 13594, 15490, 3398, 13589, 3398; Payload ID: 19718 relates to Category No.: 13589, 3398, 15490, 3398, 15262; Payload ID: 19719 relates to Category No.: 13594, 13589, 3398, 15490, 3398; Payload ID: 19720 relates to Category No.: 13594, 13589, 3398, 15490, 3398; Payload ID: 19721 relates to Category No.: 13594, 13589, 3398, 15490, 3398; Payload ID: 19722 relates to Category No.: 13589, 3398, 15490, 3398; Payload ID: 19724 relates to Category No.: 10117; Payload ID: 19725 relates to Category No.: 690, 795, 1730, 9228, 10648, 8390, 2041, 11307, 10606, 10256, 8004, 8782, 8159, 10913, 8392, 8243; Payload ID: 19726 relates to Category No.: 9228; Payload ID: 19727 relates to Category No.: 9228, 1204; Payload ID: 19728 relates to Category No.: 9228, 7735, 7997, 7270, 8688; Payload ID: 19730 relates to Category No.: 13186, 8334; Payload ID: 19731 relates to Category No.: 2885; Payload ID: 19733 relates to Category No.: 7287, 10117, 13183, 7261, 10202; Payload ID: 19735 relates to Category No.: 1204; Payload ID: 19737 relates to Category No.: 16197; Payload ID: 19738 relates to Category No.: 795, 8731, 3398, 15197, 14724, 13779, 11530, 11488, 8683, 14725, 8739; Payload ID: 19739 relates to Category No.: 6814, 14038, 5446, 3021, 10775, 11046, 8818, 10808, 10811, 11341, 1967, 11573, 15118, 12749; Payload ID: 19741 relates to Category No.: 7291, 16182, 14271, 4439; Payload ID: 19742 relates to Category No.: 13594, 5367, 15490, 3398, 11091, 8739, 8731, 3398, 1780, 11512, 9599, 7743, 3613, 14439, 2548, 1906, 2169, 13616, 1622, 13558, 3598, 3573, 9406, 7937, 13487, 13130; Payload ID: 19743 relates to Category No.: 8862, 15490, 3398, 11512, 8739, 10973, 10972, 3197, 6706, 13119, 8887, 14793, 2169, 11620, 1782, 5073, 8869, 3598, 10879, 10898; Payload ID: 19744 relates to Category No.: 13594, 13589, 3398, 15490, 3398; Payload ID: 19745 relates to Category No.: 13589, 3398; Payload ID: 19746 relates to Category No.: 13589, 3398, 15490, 3398, 480; Payload ID: 19747 relates to Category No.: 13589, 3398, 8739, 8731, 3398, 2467, 15517, 11506, 3398, 7345, 8352, 11062, 14026, 13082, 1722, 1295, 13229; Payload ID: 19748 relates to Category No.: 13589, 3398, 15490, 3398; Payload ID: 19749 relates to Category No.: 13589, 3398, 15490, 3398; Payload ID: 19750 relates to Category No.: 13589, 3398, 15490, 3398; Payload ID: 19751 relates to Category No.: 13589, 3398, 15490, 3398; Payload ID: 19752 relates to Category No.: 5541; Payload ID: 19753 relates to Category No.: 13589, 3398, 15490, 3398, 1204; Payload ID: 19754 relates to Category No.: 13589, 3398, 15490, 3398; Payload ID: 19755 relates to Category No.: 13589, 3398, 15490, 3398, 1204; Payload ID: 19756 relates to Category No.: 13589, 3398, 15490, 3398; Payload ID: 19757 relates to Category No.: 13589, 3398, 15490, 3398, 8731, 3398; Payload ID: 19758 relates to Category No.: 13589, 3398, 15490, 3398; Payload ID: 19759 relates to Category No.: 13589, 3398, 15490, 3398; Payload ID: 19760 relates to Category No.: 13594, 15490, 3398, 13589, 3398; Payload ID: 19761 relates to Category No.: 13589, 3398, 15490, 3398; Payload ID: 19762 relates to Category No.: 13589, 3398, 15490, 3398; Payload ID: 19763 relates to Category No.: 13589, 3398, 15490, 3398; Payload ID: 19764 relates to Category No.: 13589, 3398, 15490, 3398, 2940, 12640; Payload ID: 19765 relates to Category No.: 13589, 3398, 8739, 15517; Payload ID: 19766 relates to Category No.: 13589, 3398, 15490, 3398; Payload ID: 19767 relates to Category No.: 13589, 3398, 15490, 3398; Payload ID: 19768 relates to Category No.: 13589, 3398, 15490, 3398; Payload ID: 19769 relates to Category No.: 13589, 3398, 15517, 674, 6194; Payload ID: 19770 relates to Category No.: 13589, 3398, 15490, 3398, 1204; Payload ID: 19771 relates to Category No.: 13594, 13609, 15518, 15517, 4439; Payload ID: 19772 relates to Category No.: 13589, 3398; Payload ID: 19773 relates to Category No.: 8739, 8731, 3398, 15517, 15042, 8004, 1849, 11512, 4367, 11884; Payload ID: 19774 relates to Category No.: 13589, 3398, 15490, 3398, 8731, 3398; Payload ID: 19775 relates to Category No.: 13589, 3398, 15490, 3398; Payload ID: 19776 relates to Category No.: 13589, 3398, 15490, 3398, 8739; Payload ID: 19777 relates to Category No.: 1737, 13589, 3398, 15490, 3398, 1721, 7613, 10372, 10359, 10887, 10586, 10968, 2114, 10354; Payload ID: 19778 relates to Category No.: 13589, 3398, 15490, 3398, 4998; Payload ID: 19779 relates to Category No.: 13589, 3398, 15490, 3398; Payload ID: 19780 relates to Category No.: 13589, 3398, 15490, 3398; Payload ID: 19781 relates to Category No.: 13589, 3398, 15490, 3398; Payload ID: 19782 relates to Category No.: 13589, 3398, 15490, 3398, 8739, 8731, 3398, 13594; Payload ID: 19783 relates to Category No.: 13589, 3398, 15490, 3398, 3021; Payload ID: 19784 relates to Category No.: 13589, 3398, 15490, 3398, 8739; Payload ID: 19785 relates to Category No.: 13594, 13589, 3398, 15490, 3398; Payload ID: 19786 relates to Category No.: 13589, 3398, 15490, 3398; Payload ID: 19787 relates to Category No.: 13589, 3398, 15490, 3398; Payload ID: 19788 relates to Category No.: 13589, 3398, 15490, 3398; Payload ID: 19789 relates to Category No.: 13589, 3398, 15490, 3398; Payload ID: 19791 relates to Category No.: 13589, 3398, 15490, 3398, 8739, 7131, 10491; Payload ID: 19792 relates to Category No.: 13589, 3398, 15490, 3398; Payload ID: 19793 relates to Category No.: 13589, 3398, 15490, 3398; Payload ID: 19794 relates to Category No.: 13589, 3398, 15490, 3398; Payload ID: 19795 relates to Category No.: 13589, 3398, 15490, 3398; Payload ID: 19796 relates to Category No.: 13589, 3398, 15490, 3398; Payload ID: 19797 relates to Category No.: 13589, 3398, 15490, 3398, 1204; Payload ID: 19798 relates to Category No.: 6219, 13589, 3398, 8739, 15517, 13594, 15490, 3398; Payload ID: 19799 relates to Category No.: 13589, 3398, 15490, 3398, 8739, 11022, 10767; Payload ID: 19800 relates to Category No.: 1737, 13589, 3398, 7159, 7162, 6967, 12117, 7163, 982, 6980, 12712; Payload ID: 19801 relates to Category No.: 13589, 3398, 15490, 3398; Payload ID: 19802 relates to Category No.: 13589, 3398, 15490, 3398; Payload ID: 19803 relates to Category No.: 13594, 13589, 3398, 15490, 3398; Payload ID: 19804 relates to Category No.: 13589, 3398, 15490, 3398; Payload ID: 19805 relates to Category No.: 13589, 3398, 15490, 3398; Payload ID: 19806 relates to Category No.: 13589, 3398, 15490, 3398; Payload ID: 19807 relates to Category No.: 8906, 13589, 3398, 15490, 3398, 14565, 8739, 8731, 3398; Payload ID: 19808 relates to Category No.: 4828, 13589, 3398, 15490, 3398, 14565, 8739, 8731, 3398, 7306, 13237; Payload ID: 19809 relates to Category No.: 13589, 3398, 15490, 3398, 9320; Payload ID: 19810 relates to Category No.: 13589, 3398; Payload ID: 19811 relates to Category No.: 13589, 3398, 15490, 3398; Payload ID: 19812 relates to Category No.: 13589, 3398, 15490, 3398, 1204; Payload ID: 19813 relates to Category No.: 13589, 3398, 15490, 3398, 8731, 3398; Payload ID: 19814 relates to Category No.: 13589, 3398, 15490, 3398; Payload ID: 19815 relates to Category No.: 13589, 3398, 15490, 3398; Payload ID: 19816 relates to Category No.: 13589, 3398, 15490, 3398; Payload ID: 19817 relates to Category No.: 13589, 3398, 15490, 3398; Payload ID: 19818 relates to Category No.: 13589, 3398, 15490, 3398; Payload ID: 19819 relates to Category No.: 13589, 3398, 15490, 3398; Payload ID: 19820 relates to Category No.: 13589, 3398, 15490, 3398; Payload ID: 19821 relates to Category No.: 13589, 3398, 15490, 3398; Payload ID: 19822 relates to Category No.: 13589, 3398, 15490, 3398, 8739, 8611; Payload ID: 19823 relates to Category No.: 13589, 3398, 15490, 3398; Payload ID: 19824 relates to Category No.: 13589, 3398, 15490, 3398, 1984; Payload ID: 19825 relates to Category No.: 13589, 3398, 15490, 3398; Payload ID: 19826 relates to Category No.: 13589, 3398, 15490, 3398, 8731, 3398, 7369; Payload ID: 19827 relates to Category No.: 13589, 3398, 15490, 3398; Payload ID: 19828 relates to Category No.: 13589, 3398, 15490, 3398; Payload ID: 19829 relates to Category No.: 13589, 3398, 15490, 3398; Payload ID: 19830 relates to Category No.: 13589, 3398, 15490, 3398; Payload ID: 19831 relates to Category No.: 13589, 3398, 15490, 3398, 8731, 3398; Payload ID: 19832 relates to Category No.: 13589, 3398, 15490, 3398, 8739; Payload ID: 19833 relates to Category No.: 13589, 3398, 15490, 3398, 8731, 3398, 7306; Payload ID: 19834 relates to Category No.: 13589, 3398, 15490, 3398; Payload ID: 19835 relates to Category No.: 13589, 3398, 15490, 3398; Payload ID: 19836 relates to Category No.: 13589, 3398, 15490, 3398, 7306; Payload ID: 19837 relates to Category No.: 13589, 3398, 15490, 3398, 8731, 3398; Payload ID: 19838 relates to Category No.: 13589, 3398, 15490, 3398; Payload ID: 19839 relates to Category No.: 13589, 3398, 15490, 3398; Payload ID: 19840 relates to Category No.: 13589, 3398, 15490, 3398, 7306; Payload ID: 19841 relates to Category No.: 13589, 3398, 15490, 3398, 11512, 1730, 7613, 7725, 8739, 10372, 10238, 13166, 7743, 10366, 11285, 2136, 11243, 10358, 13693, 13355, 11255, 11516; Payload ID: 19842 relates to Category No.: 13589, 3398, 15490, 3398; Payload ID: 19843 relates to Category No.: 13594, 13589, 3398, 15490, 3398, 8408; Payload ID: 19844 relates to Category No.: 13589, 3398, 15490, 3398; Payload ID: 19845 relates to Category No.: 13589, 3398, 15490, 3398; Payload ID: 19846 relates to Category No.: 13589, 3398, 15490, 3398, 2001, 12676; Payload ID: 19847 relates to Category No.: 13589, 3398, 15490, 3398; Payload ID: 19848 relates to Category No.: 13594, 15490, 3398; Payload ID: 19849 relates to Category No.: 13589, 3398, 15490, 3398; Payload ID: 19850 relates to Category No.: 13594, 15490, 3398; Payload ID: 19851 relates to Category No.: 13594, 15490, 3398; Payload ID: 19852 relates to Category No.: 15490, 3398, 8739, 8731, 3398, 11506, 3398, 14944, 8004, 3569; Payload ID: 19853 relates to Category No.: 13589, 3398, 15490, 3398, 8731, 3398; Payload ID: 19854 relates to Category No.: 13589, 3398, 15490, 3398; Payload ID: 19855 relates to Category No.: 13589, 3398, 15490, 3398; Payload ID: 19856 relates to Category No.: 13589, 3398, 15490, 3398; Payload ID: 19857 relates to Category No.: 13589, 3398, 15490, 3398; Payload ID: 19858 relates to Category No.: 13589, 3398, 15490, 3398; Payload ID: 19859 relates to Category No.: 13589, 3398, 15490, 3398, 11506, 3398, 12736; Payload ID: 19860 relates to Category No.: 11512, 15517; Payload ID: 19861 relates to Category No.: 15490, 3398, 14838, 8739; Payload ID: 19862 relates to Category No.: 13589, 3398, 15490, 3398, 1730, 7306, 6133; Payload ID: 19863 relates to Category No.: 13589, 3398, 15490, 3398; Payload ID: 19864 relates to Category No.: 13589, 3398, 15490, 3398; Payload ID: 19865 relates to Category No.: 13589, 3398, 15490, 3398; Payload ID: 19866 relates to Category No.: 13589, 3398, 15490, 3398; Payload ID: 19867 relates to Category No.: 13589, 3398, 15490, 3398; Payload ID: 19868 relates to Category No.: 13589, 3398, 15490, 3398; Payload ID: 19869 relates to Category No.: 13589, 3398, 15490, 3398; Payload ID: 19870 relates to Category No.: 13589, 3398, 15490, 3398, 6670; Payload ID: 19871 relates to Category No.: 13589, 3398, 15490, 3398; Payload ID: 19872 relates to Category No.: 13589, 3398, 15490, 3398; Payload ID: 19873 relates to Category No.: 13589, 3398, 15490, 3398; Payload ID: 19874 relates to Category No.: 13589, 3398, 15490, 3398; Payload ID: 19875 relates to Category No.: 13589, 3398, 15490, 3398; Payload ID: 19876 relates to Category No.: 13589, 3398, 15490, 3398; Payload ID: 19877 relates to Category No.: 7288, 15490, 3398, 14271, 12777, 3559; Payload ID: 19878 relates to Category No.: 13589, 3398, 15490, 3398; Payload ID: 19879 relates to Category No.: 1204; Payload ID: 19880 relates to Category No.: 13589, 3398, 15490, 3398; Payload ID: 19881 relates to Category No.: 13589, 3398, 15490, 3398; Payload ID: 19882 relates to Category No.: 13589, 3398, 15490, 3398; Payload ID: 19883 relates to Category No.: 13589, 3398, 15490, 3398, 1295, 8940, 12891, 3783, 5160, 10934, 11087, 11085, 5406, 12891, 13225, 2248, 1296, 12976; Payload ID: 19884 relates to Category No.: 13589, 3398, 15490, 3398; Payload ID: 19885 relates to Category No.: 13589, 3398, 15490, 3398; Payload ID: 19886 relates to Category No.: 13589, 3398, 15490, 3398; Payload ID: 19887 relates to Category No.: 13589, 3398, 15490, 3398; Payload ID: 19888 relates to Category No.: 13589, 3398, 15490, 3398; Payload ID: 19889 relates to Category No.: 13589, 3398, 15490, 3398; Payload ID: 19890 relates to Category No.: 13609, 15518, 8739, 15517, 13589, 3398; Payload ID: 19891 relates to Category No.: 5807, 10238; Payload ID: 19892 relates to Category No.: 13589, 3398, 15490, 3398; Payload ID: 19893 relates to Category No.: 13589, 3398, 15490, 3398, 14838, 2110; Payload ID: 19894 relates to Category No.: 13589, 3398, 15490, 3398, 11512, 8739, 8731, 3398; Payload ID: 19895 relates to Category No.: 13594, 13589, 3398, 15490, 3398, 14456; Payload ID: 19896 relates to Category No.: 13589, 3398, 15490, 3398; Payload ID: 19897 relates to Category No.: 13589, 3398, 15490, 3398; Payload ID: 19898 relates to Category No.: 13589, 3398, 15490, 3398, 8888, 3584, 14949; Payload ID: 19899 relates to Category No.: 13589, 3398, 15490, 3398; Payload ID: 19901 relates to Category No.: 15490, 3398, 8739, 8169, 13836; Payload ID: 19902 relates to Category No.: 13594, 15490, 3398; Payload ID: 19903 relates to Category No.: 13589, 3398, 15490, 3398; Payload ID: 19904 relates to Category No.: 13589, 3398, 15490, 3398, 11512, 8739, 8731, 3398; Payload ID: 19905 relates to Category No.: 13589, 3398, 15490, 3398; Payload ID: 19906 relates to Category No.: 13589, 3398, 15490, 3398, 11512, 9238, 11290; Payload ID: 19907 relates to Category No.: 13589, 3398, 15490, 3398, 795, 1955, 10606, 8178, 6666, 7283, 10516, 14568, 12745, 6103, 10086, 6296, 10079, 5777, 4999; Payload ID: 19908 relates to Category No.: 5807; Payload ID: 19910 relates to Category No.: 5807; Payload ID: 19911 relates to Category No.: 13589, 3398, 15490, 3398; Payload ID: 19912 relates to Category No.: 13589, 3398, 15490, 3398; Payload ID: 19913 relates to Category No.: 13589, 3398, 15490, 3398; Payload ID: 19914 relates to Category No.: 13589, 3398, 15490, 3398, 8731, 3398, 7369; Payload ID: 19915 relates to Category No.: 13589, 3398, 15490, 3398; Payload ID: 19916 relates to Category No.: 13589, 3398, 15490, 3398, 11506, 3398; Payload ID: 19917 relates to Category No.: 13589, 3398, 15490, 3398; Payload ID: 19918 relates to Category No.: 13589, 3398, 15490, 3398; Payload ID: 19919 relates to Category No.: 13589, 3398, 15490, 3398; Payload ID: 19920 relates to Category No.: 13589, 3398, 15490, 3398; Payload ID: 19921 relates to Category No.: 13589, 3398, 15490, 3398; Payload ID: 19922 relates to Category No.: 13589, 3398, 15490, 3398; Payload ID: 19923 relates to Category No.: 13589, 3398, 15490, 3398; Payload ID: 19924 relates to Category No.: 13589, 3398, 15490, 3398; Payload ID: 19925 relates to Category No.: 13589, 3398, 15490, 3398; Payload ID: 19926 relates to Category No.: 13589, 3398, 15490, 3398, 8731, 3398; Payload ID: 19927 relates to Category No.: 13589, 3398, 15490, 3398; Payload ID: 19928 relates to Category No.: 13589, 3398, 15490, 3398; Payload ID: 19929 relates to Category No.: 8862, 15490, 3398, 1730, 8731, 3398, 11506, 3398, 9125, 10286; Payload ID: 19930 relates to Category No.: 13589, 3398, 15490, 3398, 8731, 3398; Payload ID: 19931 relates to Category No.: 13589, 3398, 15490, 3398; Payload ID: 19933 relates to Category No.: 13589, 3398, 15490, 3398; Payload ID: 19934 relates to Category No.: 13589, 3398, 15490, 3398; Payload ID: 19935 relates to Category No.: 13589, 3398, 15490, 3398, 15042; Payload ID: 19936 relates to Category No.: 13589, 3398, 15490, 3398, 1730, 8739, 8611; Payload ID: 19937 relates to Category No.: 13589, 3398, 15490, 3398; Payload ID: 19938 relates to Category No.: 13589, 3398, 15490, 3398; Payload ID: 19939 relates to Category No.: 13589, 3398, 15490, 3398; Payload ID: 19940 relates to Category No.: 13589, 3398, 15490, 3398, 8731, 3398; Payload ID: 19941 relates to Category No.: 13589, 3398, 15490, 3398; Payload ID: 19942 relates to Category No.: 13589, 3398, 15490, 3398; Payload ID: 19943 relates to Category No.: 13589, 3398, 15490, 3398; Payload ID: 19944 relates to Category No.: 13589, 3398, 15490, 3398; Payload ID: 19945 relates to Category No.: 13589, 3398, 15490, 3398; Payload ID: 19946 relates to Category No.: 13589, 3398, 15490, 3398, 795, 14015; Payload ID: 19947 relates to Category No.: 13594, 13589, 3398, 15490, 3398; Payload ID: 19948 relates to Category No.: 13589, 3398, 15490, 3398; Payload ID: 19949 relates to Category No.: 13594, 13589, 3398, 15490, 3398; Payload ID: 19950 relates to Category No.: 13589, 3398, 15490, 3398; Payload ID: 19951 relates to Category No.: 13589, 3398, 7306, 15521, 4439; Payload ID: 19952 relates to Category No.: 13589, 3398, 15490, 3398; Payload ID: 19953 relates to Category No.: 13589, 3398, 15490, 3398; Payload ID: 19954 relates to Category No.: 13589, 3398, 15490, 3398; Payload ID: 19955 relates to Category No.: 13589, 3398, 15490, 3398; Payload ID: 19956 relates to Category No.: 15490, 3398, 11512, 2410, 7879; Payload ID: 19957 relates to Category No.: 15490, 3398, 13589, 3398; Payload ID: 19958 relates to Category No.: 13589, 3398, 15490, 3398; Payload ID: 19959 relates to Category No.: 13589, 3398, 15490, 3398; Payload ID: 19960 relates to Category No.: 13589, 3398, 15490, 3398; Payload ID: 19961 relates to Category No.: 13589, 3398, 15490, 3398; Payload ID: 19962 relates to Category No.: 13589, 3398, 15517, 15291, 4439, 7261, 5220, 7262; Payload ID: 19964 relates to Category No.: 13589, 3398, 15490, 3398; Payload ID: 19965 relates to Category No.: 13589, 3398, 15490, 3398; Payload ID: 19966 relates to Category No.: 13589, 3398, 15490, 3398; Payload ID: 19967 relates to Category No.: 13589, 3398, 15490, 3398; Payload ID: 19968 relates to Category No.: 13589, 3398, 15490, 3398; Payload ID: 19969 relates to Category No.: 13589, 3398, 15490, 3398; Payload ID: 19970 relates to Category No.:

13589, 3398, 15490, 3398, 1204; Payload ID: 19971 relates to Category No.: 13589, 3398, 15490, 3398; Payload ID: 19972 relates to Category No.: 13594, 15490, 3398, 9349, 8731, 3398, 11138; Payload ID: 19973 relates to Category No.: 13589, 3398, 15490, 3398; Payload ID: 19974 relates to Category No.: 13589, 3398, 15490, 3398; Payload ID: 19975 relates to Category No.: 13589, 3398, 15490, 3398; Payload ID: 19976 relates to Category No.: 13589, 3398, 15490, 3398; Payload ID: 19977 relates to Category No.: 13589, 3398, 15490, 3398, 11506, 3398, 8739, 13594; Payload ID: 19978 relates to Category No.: 13589, 3398, 15490, 3398; Payload ID: 19979 relates to Category No.: 13589, 3398, 15490, 3398; Payload ID: 19980 relates to Category No.: 13589, 3398, 15490, 3398; Payload ID: 19981 relates to Category No.: 13589, 3398, 15490, 3398; Payload ID: 19982 relates to Category No.: 13589, 3398, 15490, 3398, 7743, 8004, 4334, 8885; Payload ID: 19983 relates to Category No.: 13589, 3398, 15490, 3398; Payload ID: 19984 relates to Category No.: 13589, 3398, 15490, 3398; Payload ID: 19985 relates to Category No.: 13589, 3398, 15490, 3398; Payload ID: 19986 relates to Category No.: 13589, 3398, 15490, 3398; Payload ID: 19987 relates to Category No.: 13589, 3398, 15490, 3398; Payload ID: 19988 relates to Category No.: 13589, 3398, 15490, 3398; Payload ID: 19989 relates to Category No.: 13589, 3398, 15490, 3398, 16214, 14014, 14056; Payload ID: 19990 relates to Category No.: 13589, 3398, 15490, 3398; Payload ID: 19991 relates to Category No.: 14565, 15517, 7306, 11506, 3398, 455, 1334, 13812; Payload ID: 19992 relates to Category No.: 13589, 3398, 15490, 3398; Payload ID: 19993 relates to Category No.: 13589, 3398, 15490, 3398; Payload ID: 19994 relates to Category No.: 13594, 15490, 3398; Payload ID: 19995 relates to Category No.: 13589, 3398, 15490, 3398; Payload ID: 19996 relates to Category No.: 13589, 3398, 15490, 3398, 1730, 7306, 8930; Payload ID: 19997 relates to Category No.: 13594, 15490, 3398; Payload ID: 19998 relates to Category No.: 13589, 3398, 15588; Payload ID: 19999 relates to Category No.: 13589, 3398, 15490, 3398; Payload ID: 20000 relates to Category No.: 13589, 3398, 15490, 3398; Payload ID: 20001 relates to Category No.: 13589, 3398, 15490, 3398; Payload ID: 20002 relates to Category No.: 13589, 3398, 15490, 3398; Payload ID: 20003 relates to Category No.: 13589, 3398, 15490, 3398; Payload ID: 20004 relates to Category No.: 13589, 3398, 15490, 3398; Payload ID: 20005 relates to Category No.: 13589, 3398, 15490, 3398; Payload ID: 20006 relates to Category No.: 15490, 3398, 14565, 8739, 7306, 8375, 8582; Payload ID: 20007 relates to Category No.: 13589, 3398, 15490, 3398, 8731, 3398, 8760; Payload ID: 20008 relates to Category No.: 13589, 3398, 15490, 3398, 1730, 7306, 14838; Payload ID: 20009 relates to Category No.: 13589, 3398, 15490, 3398; Payload ID: 20010 relates to Category No.: 13589, 3398, 15490, 3398; Payload ID: 20011 relates to Category No.: 13589, 3398, 15490, 3398; Payload ID: 20012 relates to Category No.: 13589, 3398, 15490, 3398; Payload ID: 20013 relates to Category No.: 13589, 3398, 15490, 3398; Payload ID: 20014 relates to Category No.: 13589, 3398, 15490, 3398; Payload ID: 20015 relates to Category No.: 13589, 3398, 15490, 3398; Payload ID: 20016 relates to Category No.: 13589, 3398, 15490, 3398; Payload ID: 20017 relates to Category No.: 13589, 3398, 15490, 3398, 8731, 3398; Payload ID: 20018 relates to Category No.: 13589, 3398, 15490, 3398; Payload ID: 20019 relates to Category No.: 13589, 3398, 15490, 3398; Payload ID: 20020 relates to Category No.: 13589, 3398, 15490, 3398; Payload ID: 20021 relates to Category No.: 13589, 3398, 15490, 3398; Payload ID: 20022 relates to Category No.: 13589, 3398, 15490, 3398, 1204; Payload ID: 20023 relates to Category No.: 13589, 3398, 15490, 3398; Payload ID: 20024 relates to Category No.: 13589, 3398, 15490, 3398; Payload ID: 20025 relates to Category No.: 13589, 3398, 15490, 3398; Payload ID: 20026 relates to Category No.: 13589, 3398, 15490, 3398; Payload ID: 20027 relates to Category No.: 13589, 3398, 15490, 3398; Payload ID: 20028 relates to Category No.: 13589, 3398, 15490, 3398, 11512, 8739; Payload ID: 20029 relates to Category No.: 13589, 3398, 15490, 3398; Payload ID: 20030 relates to Category No.: 13589, 3398, 15490, 3398; Payload ID: 20031 relates to Category No.: 13589, 3398, 15490, 3398, 11512, 8739; Payload ID: 20032 relates to Category No.: 13589, 3398, 15490, 3398; Payload ID: 20033 relates to Category No.: 13589, 3398, 15490, 3398; Payload ID: 20034 relates to Category No.: 13589, 3398, 15490, 3398; Payload ID: 20035 relates to Category No.: 13589, 3398, 15490, 3398; Payload ID: 20036 relates to Category No.: 13589, 3398, 16193, 15490, 3398; Payload ID: 20037 relates to Category No.: 13589, 3398, 15490, 3398; Payload ID: 20038 relates to Category No.: 13589, 3398, 15490, 3398; Payload ID: 20039 relates to Category No.: 13589, 3398, 15490, 3398; Payload ID: 20040 relates to Category No.: 13589, 3398, 15490, 3398; Payload ID: 20041 relates to Category No.: 13594, 15490, 3398; Payload ID: 20042 relates to Category No.: 13589, 3398, 15490, 3398; Payload ID: 20043 relates to Category No.: 13589, 3398, 15490, 3398; Payload ID: 20044 relates to Category No.: 13589, 3398, 15490, 3398; Payload ID: 20045 relates to Category No.: 13594, 15490, 3398, 5428, 2311, 10648, 10558, 10902, 10855, 10557, 2001; Payload ID: 20046 relates to Category No.: 13594, 15490, 3398; Payload ID: 20047 relates to Category No.: 13589, 3398, 15490, 3398; Payload ID: 20048 relates to Category No.: 13589, 3398, 15490, 3398; Payload ID: 20049 relates to Category No.: 13589, 3398, 15490, 3398; Payload ID: 20050 relates to Category No.: 13589, 3398, 15490, 3398; Payload ID: 20051 relates to Category No.: 13589, 3398, 15490, 3398; Payload ID: 20052 relates to Category No.: 13589, 3398, 15490, 3398; Payload ID: 20053 relates to Category No.: 13589, 3398, 15490, 3398; Payload ID: 20054 relates to Category No.: 13589, 3398, 8731, 3398; Payload ID: 20055 relates to Category No.: 13589, 3398; Payload ID: 20056 relates to Category No.: 13589, 3398, 15490, 3398; Payload ID: 20057 relates to Category No.: 15490, 3398, 8739, 7131; Payload ID: 20058 relates to Category No.: 13589, 3398, 15490, 3398; Payload ID: 20059 relates to Category No.: 13589, 3398; Payload ID: 20060 relates to Category No.: 13589, 3398, 15490, 3398; Payload ID: 20061 relates to Category No.: 13589, 3398, 15490, 3398; Payload ID: 20063 relates to Category No.: 13589, 3398, 15490, 3398; Payload ID: 20064 relates to Category No.: 13589, 3398, 15490, 3398; Payload ID: 20065 relates to Category No.: 13589, 3398, 15490, 3398; Payload ID: 20066 relates to Category No.: 13589, 3398, 15490, 3398; Payload ID: 20067 relates to Category No.: 13589, 3398, 15490, 3398; Payload ID: 20070 relates to Category No.: 13589, 3398, 15490, 3398; Payload ID: 20071 relates to Category No.: 13589, 3398, 15490, 3398; Payload ID: 20072 relates to Category No.: 13589, 3398, 15490, 3398, 11512, 8739; Payload ID: 20073 relates to Category No.: 13589, 3398, 15490, 3398, 1204; Payload ID: 20074 relates to Category No.: 13589, 3398, 15490, 3398; Payload ID: 20075 relates to Category No.: 13589, 3398, 15490, 3398; Payload ID: 20076 relates to Category No.: 13589, 3398, 15490, 3398; Payload ID: 20077 relates to Category No.: 13589, 3398, 15490, 3398; Payload ID:

20078 relates to Category No.: 13589, 3398, 15490, 3398; Payload ID: 20079 relates to Category No.: 13589, 3398, 15490, 3398; Payload ID: 20080 relates to Category No.: 14164, 10238, 10878, 10955, 10887, 5814; Payload ID: 20081 relates to Category No.: 13589, 3398; Payload ID: 20082 relates to Category No.: 13589, 3398, 15490, 3398; Payload ID: 20083 relates to Category No.: 13589, 3398, 15490, 3398; Payload ID: 20084 relates to Category No.: 13589, 3398, 15490, 3398; Payload ID: 20085 relates to Category No.: 13589, 3398, 15490, 3398; Payload ID: 20086 relates to Category No.: 15490, 3398, 13589, 3398; Payload ID: 20087 relates to Category No.: 13589, 3398, 15490, 3398; Payload ID: 20088 relates to Category No.: 13589, 3398, 15490, 3398; Payload ID: 20089 relates to Category No.: 13589, 3398, 15490, 3398, 14271; Payload ID: 20090 relates to Category No.: 11512, 8731, 3398, 15517, 10362, 16189, 10180, 7560; Payload ID: 20091 relates to Category No.: 13594, 13589, 3398, 15490, 3398; Payload ID: 20092 relates to Category No.: 13589, 3398, 15490, 3398; Payload ID: 20093 relates to Category No.: 12153, 12614; Payload ID: 20094 relates to Category No.: 13589, 3398, 15490, 3398; Payload ID: 20095 relates to Category No.: 13589, 3398, 15490, 3398; Payload ID: 20096 relates to Category No.: 13589, 3398, 15490, 3398, 11512, 8739; Payload ID: 20097 relates to Category No.: 13589, 3398, 15490, 3398; Payload ID: 20098 relates to Category No.: 13589, 3398, 15490, 3398; Payload ID: 20099 relates to Category No.: 13589, 3398, 15490, 3398; Payload ID: 20100 relates to Category No.: 13589, 3398, 15490, 3398, 7997; Payload ID: 20101 relates to Category No.: 13589, 3398, 15490, 3398, 8731, 3398, 14177, 2156; Payload ID: 20102 relates to Category No.: 13589, 3398, 15490, 3398; Payload ID: 20103 relates to Category No.: 13589, 3398, 15490, 3398; Payload ID: 20104 relates to Category No.: 13594, 13589, 3398, 15490, 3398; Payload ID: 20105 relates to Category No.: 13589, 3398, 15490, 3398, 1204; Payload ID: 20106 relates to Category No.: 13589, 3398, 15490, 3398; Payload ID: 20107 relates to Category No.: 13594, 13589, 3398, 15490, 3398; Payload ID: 20108 relates to Category No.: 13589, 3398, 15490, 3398; Payload ID: 20109 relates to Category No.: 13589, 3398, 15490, 3398; Payload ID: 20110 relates to Category No.: 13589, 3398, 15490, 3398; Payload ID: 20111 relates to Category No.: 13594, 13589, 3398, 15490, 3398; Payload ID: 20112 relates to Category No.: 13589, 3398, 15490, 3398; Payload ID: 20113 relates to Category No.: 13589, 3398, 15490, 3398; Payload ID: 20114 relates to Category No.: 13589, 3398, 15490, 3398, 2885, 8739, 5359, 1277, 8193, 8390, 8753, 8424, 8192, 8785, 8147; Payload ID: 20115 relates to Category No.: 13589, 3398, 15490, 3398; Payload ID: 20116 relates to Category No.: 13589, 3398, 15490, 3398; Payload ID: 20117 relates to Category No.: 13589, 3398, 15490, 3398; Payload ID: 20118 relates to Category No.: 13589, 3398, 15490, 3398; Payload ID: 20119 relates to Category No.: 13589, 3398, 15490, 3398; Payload ID: 20120 relates to Category No.: 13589, 3398, 15490, 3398, 10491; Payload ID: 20121 relates to Category No.: 13589, 3398, 15490, 3398; Payload ID: 20122 relates to Category No.: 13594, 1026, 15490, 3398, 8739, 8731, 3398, 7537; Payload ID: 20123 relates to Category No.: 13589, 3398, 15490, 3398; Payload ID: 20124 relates to Category No.: 13589, 3398, 15490, 3398; Payload ID: 20125 relates to Category No.: 13589, 3398, 15490, 3398, 1204; Payload ID: 20126 relates to Category No.: 13589, 3398, 15490, 3398, 14620; Payload ID: 20127 relates to Category No.: 13589, 3398, 15490, 3398; Payload ID: 20128 relates to Category No.: 13589, 3398; Payload ID: 20129 relates to Category No.: 13589, 3398, 15490, 3398; Payload ID: 20130 relates to Category No.: 13589, 3398; Payload ID: 20131 relates to Category No.: 13589, 3398, 15490, 3398; Payload ID: 20132 relates to Category No.: 13589, 3398, 15490, 3398, 1204; Payload ID: 20133 relates to Category No.: 13589, 3398, 15490, 3398; Payload ID: 20134 relates to Category No.: 13589, 3398, 15490, 3398, 7306; Payload ID: 20135 relates to Category No.: 13589, 3398, 15490, 3398; Payload ID: 20136 relates to Category No.: 13589, 3398, 15490, 3398; Payload ID: 20137 relates to Category No.: 13589, 3398, 15490, 3398; Payload ID: 20138 relates to Category No.: 13589, 3398, 15490, 3398, 12619, 10372, 8731, 3398, 10366, 448, 6561, 13616, 10578, 1964, 12583, 8087, 10953; Payload ID: 20140 relates to Category No.: 13589, 3398, 15490, 3398; Payload ID: 20141 relates to Category No.: 13589, 3398, 15490, 3398; Payload ID: 20142 relates to Category No.: 13589, 3398, 15490, 3398; Payload ID: 20143 relates to Category No.: 13589, 3398, 15490, 3398; Payload ID: 20144 relates to Category No.: 8731, 3398, 13618, 8654; Payload ID: 20145 relates to Category No.: 13589, 3398, 15490, 3398; Payload ID: 20146 relates to Category No.: 13589, 3398, 15490, 3398; Payload ID: 20147 relates to Category No.: 13589, 3398, 15490, 3398; Payload ID: 20148 relates to Category No.: 13589, 3398, 15490, 3398; Payload ID: 20149 relates to Category No.: 13594, 15490, 3398; Payload ID: 20150 relates to Category No.: 13589, 3398, 15490, 3398, 11506, 3398; Payload ID: 20151 relates to Category No.: 13589, 3398, 15490, 3398; Payload ID: 20152 relates to Category No.: 13589, 3398; Payload ID: 20153 relates to Category No.: 13589, 3398, 15490, 3398; Payload ID: 20154 relates to Category No.: 13589, 3398; Payload ID: 20155 relates to Category No.: 13589, 3398; Payload ID: 20156 relates to Category No.: 13589, 3398; Payload ID: 20157 relates to Category No.: 13589, 3398, 15490, 3398; Payload ID: 20158 relates to Category No.: 13589, 3398, 15490, 3398; Payload ID: 20159 relates to Category No.: 13589, 3398, 15490, 3398; Payload ID: 20160 relates to Category No.: 13589, 3398, 15490, 3398; Payload ID: 20161 relates to Category No.: 13589, 3398; Payload ID: 20162 relates to Category No.: 13589, 3398, 15490, 3398; Payload ID: 20163 relates to Category No.: 13589, 3398, 15490, 3398; Payload ID: 20164 relates to Category No.: 13589, 3398, 15490, 3398; Payload ID: 20165 relates to Category No.: 13589, 3398, 15490, 3398; Payload ID: 20166 relates to Category No.: 13589, 3398, 15490, 3398; Payload ID: 20167 relates to Category No.: 13589, 3398, 15490, 3398; Payload ID: 20168 relates to Category No.: 13589, 3398, 15490, 3398, 12096; Payload ID: 20169 relates to Category No.: 13589, 3398, 15490, 3398, 7306; Payload ID: 20170 relates to Category No.: 13589, 3398, 15490, 3398; Payload ID: 20171 relates to Category No.: 13589, 3398, 15490, 3398, 11512, 8739, 8731, 3398, 11090; Payload ID: 20172 relates to Category No.: 13589, 3398; Payload ID: 20173 relates to Category No.: 13589, 3398, 15490, 3398; Payload ID: 20174 relates to Category No.: 11512, 1730, 15517, 3781; Payload ID: 20175 relates to Category No.: 13589, 3398, 15490, 3398, 1204; Payload ID: 20176 relates to Category No.: 13589, 3398, 15490, 3398; Payload ID: 20177 relates to Category No.: 13594, 15490, 3398, 13609; Payload ID: 20178 relates to Category No.: 13589, 3398; Payload ID: 20179 relates to Category No.: 13594, 13589, 3398, 15490, 3398; Payload ID: 20180 relates to Category No.: 13589, 3398, 15490, 3398; Payload ID: 20181 relates to Category No.: 13589, 3398, 15490, 3398; Payload ID: 20182 relates to Category No.: 13589, 3398, 15490, 3398; Payload ID: 20183 relates to Category No.: 13589, 3398, 15517; Payload ID: 20184 relates to Category No.: 13589, 3398, 15490, 3398, 1204; Payload ID: 20185 relates to Category No.: 13594, 15490, 3398; Payload ID: 20186 relates to Category No.: 13589, 3398, 15490, 3398; Payload ID: 20187 relates to Category No.: 13589, 3398, 15490, 3398; Payload ID: 20188 relates to Category No.: 13589, 3398, 15490, 3398; Payload ID: 20189 relates to Category No.: 13589, 3398, 15490, 3398; Payload ID: 20190 relates to Category No.: 13589, 3398, 15490, 3398; Payload ID: 20191 relates to Category No.: 13589, 3398, 15490, 3398; Payload ID: 20192 relates to Category No.: 13589, 3398, 15490, 3398, 1204; Payload ID: 20193 relates to Category No.: 13589, 3398, 15490, 3398; Payload ID: 20194 relates to Category No.: 13589, 3398, 15490, 3398; Payload ID: 20195 relates to Category No.: 13589, 3398, 15490, 3398; Payload ID: 20196 relates to Category No.: 13589, 3398, 15490, 3398; Payload ID: 20197 relates to Category No.: 13589, 3398, 15490, 3398; Payload ID: 20198 relates to Category No.: 13589, 3398, 15490, 3398, 4969; Payload ID: 20199 relates to Category No.: 13589, 3398, 15490, 3398; Payload ID: 20200 relates to Category No.: 13589, 3398, 15490, 3398; Payload ID: 20202 relates to Category No.: 13589, 3398, 15490, 3398; Payload ID: 20203 relates to Category No.: 13589, 3398, 15490, 3398, 1204; Payload ID: 20204 relates to Category No.: 13589, 3398, 15490, 3398; Payload ID: 20205 relates to Category No.: 13589, 3398, 15490, 3398; Payload ID: 20206 relates to Category No.: 13589, 3398, 15490, 3398; Payload ID: 20207 relates to Category No.: 13589, 3398, 15490, 3398; Payload ID: 20208 relates to Category No.: 13589, 3398, 15490, 3398; Payload ID: 20209 relates to Category No.: 13589, 3398, 15490, 3398, 8739, 1257; Payload ID: 20210 relates to Category No.: 13589, 3398, 15490, 3398; Payload ID: 20211 relates to Category No.: 13589, 3398, 15490, 3398; Payload ID: 20214 relates to Category No.: 13589, 3398, 15490, 3398; Payload ID: 20215 relates to Category No.: 13589, 3398, 15490, 3398; Payload ID: 20216 relates to Category No.: 13589, 3398, 15490, 3398; Payload ID: 20217 relates to Category No.: 13589, 3398, 15490, 3398; Payload ID: 20218 relates to Category No.: 13589, 3398, 15490, 3398; Payload ID: 20219 relates to Category No.: 13589, 3398; Payload ID: 20220 relates to Category No.: 13589, 3398, 15490, 3398; Payload ID: 20221 relates to Category No.: 15490, 3398, 11512; Payload ID: 20222 relates to Category No.: 13589, 3398, 15490, 3398; Payload ID: 20223 relates to Category No.: 13589, 3398, 15490, 3398; Payload ID: 20224 relates to Category No.: 13589, 3398, 15490, 3398; Payload ID: 20225 relates to Category No.: 13589, 3398, 15490, 3398; Payload ID: 20226 relates to Category No.: 1737, 9296, 3354, 7154, 15533, 2424, 1229, 9161, 5758, 7143; Payload ID: 20227 relates to Category No.: 13589, 3398, 14565, 15517, 7306; Payload ID: 20228 relates to Category No.: 13589, 3398, 15490, 3398; Payload ID: 20229 relates to Category No.: 13589, 3398, 15490, 3398; Payload ID: 20230 relates to Category No.: 13589, 3398, 15490, 3398; Payload ID: 20232 relates to Category No.: 13589, 3398, 15490, 3398; Payload ID: 20233 relates to Category No.: 13589, 3398, 15490, 3398; Payload ID: 20235 relates to Category No.: 13589, 3398, 15490, 3398; Payload ID: 20236 relates to Category No.: 13589, 3398, 15490, 3398; Payload ID: 20237 relates to Category No.: 13589, 3398, 15490, 3398; Payload ID: 20238 relates to Category No.: 13589, 3398, 15490, 3398, 8408; Payload ID: 20239 relates to Category No.: 13589, 3398, 15490, 3398; Payload ID: 20240 relates to Category No.: 13589, 3398; Payload ID: 20242 relates to Category No.: 13589, 3398, 15490, 3398; Payload ID: 20243 relates to Category No.: 13589, 3398, 15490, 3398, 1204; Payload ID: 20244 relates to Category No.: 13594, 15490, 3398; Payload ID: 20245 relates to Category No.: 13589, 3398, 15490, 3398; Payload ID: 20246 relates to Category No.: 13589, 3398, 15490, 3398; Payload ID: 20247 relates to Category No.: 13589, 3398; Payload ID: 20248 relates to Category No.: 13589, 3398, 15490, 3398; Payload ID: 20249 relates to Category No.: 13589, 3398, 15490, 3398, 15588; Payload ID: 20250 relates to Category No.: 13589, 3398, 15490, 3398, 8731, 3398, 8774; Payload ID: 20251 relates to Category No.: 13589, 3398, 15490, 3398; Payload ID: 20252 relates to Category No.: 13589, 3398, 15490, 3398, 8731, 3398, 8774; Payload ID: 20253 relates to Category No.: 13589, 3398, 15490, 3398; Payload ID: 20254 relates to Category No.: 13589, 3398, 15490, 3398; Payload ID: 20255 relates to Category No.: 13589, 3398, 15490, 3398; Payload ID: 20256 relates to Category No.: 15490, 3398, 8739, 4949, 3854, 6667, 1238, 7971, 9480, 8507, 16137, 1570, 10813, 3592, 979, 10086, 12751, 15527, 968, 7177, 15337, 15651, 8153, 8262, 11512, 5242, 6666, 12691, 4844, 3022, 11738; Payload ID: 20257 relates to Category No.: 15490, 3398, 11512, 1730, 8739, 8731, 3398, 4949, 4791, 1238, 7971, 16137, 9481, 14183, 16096, 5406, 6375, 7728, 1567, 10952, 7978; Payload ID: 20258 relates to Category No.: 13589, 3398, 15490, 3398, 7306; Payload ID: 20259 relates to Category No.: 13589, 3398, 15490, 3398, 7306; Payload ID: 20260 relates to Category No.: 13589, 3398, 16172; Payload ID: 20261 relates to Category No.: 7306; Payload ID: 20263 relates to Category No.: 13589, 3398, 15490, 3398; Payload ID: 20264 relates to Category No.: 13594, 13589, 3398, 15490, 3398, 1204; Payload ID: 20265 relates to Category No.: 13589, 3398, 15490, 3398, 1002, 8739, 8731, 3398, 11506, 3398, 7635, 6445, 7773; Payload ID: 20266 relates to Category No.: 13589, 3398, 15490, 3398, 7635, 6445; Payload ID: 20267 relates to Category No.: 13589, 3398, 15490, 3398; Payload ID: 20268 relates to Category No.: 13589, 3398, 15490, 3398; Payload ID: 20269 relates to Category No.: 13589, 3398, 15490, 3398; Payload ID: 20272 relates to Category No.: 11237, 1911; Payload ID: 20273 relates to Category No.: 14934, 15606; Payload ID: 20276 relates to Category No.: 1204, 5406, 4194, 10093, 14641, 13758, 4066, 14697, 16095; Payload ID: 20277 relates to Category No.: 12128, 795, 7613, 12993, 2136; Payload ID: 20281 relates to Category No.: 11512, 16286, 10314, 12117, 8535, 11294; Payload ID: 20284 relates to Category No.: 15490, 3398, 8731, 3398; Payload ID: 20286 relates to Category No.: 13589, 3398, 3328; Payload ID: 20290 relates to Category No.: 14267; Payload ID: 20291 relates to Category No.: 1737, 12153, 7154, 7966; Payload ID: 20292 relates to Category No.: 8862, 8918, 14886; Payload ID: 20293 relates to Category No.: 15490, 3398, 8739, 8731, 3398, 7934; Payload ID: 20295 relates to Category No.: 8390, 2878, 13076, 10851, 5710, 7013, 11697, 14949, 7011, 14193, 6814; Payload ID: 20296 relates to Category No.: 15490, 3398, 1257; Payload ID: 20300 relates to Category No.: 7131, 10491; Payload ID: 20305 relates to Category No.: 6902; Payload ID: 20307 relates to Category No.: 6814, 14193; Payload ID: 20309 relates to Category No.: 7291, 16182; Payload ID: 20310 relates to Category No.: 15490, 3398, 8454; Payload ID: 20314 relates to Category No.: 12126, 12074, 9681, 6814; Payload ID: 20315 relates to Category No.: 12126, 9681, 6814; Payload ID: 20316 relates to Category No.: 6814, 12126, 9681; Payload ID: 20317 relates to Category No.: 12126, 12074, 9681, 6814; Payload ID: 20318 relates to Category No.: 6814, 14565, 10775, 6480; Payload ID: 20319 relates to Category No.: 12126, 12074, 9681, 6814; Payload ID: 20320 relates to Category No.: 12126, 12074, 15160, 9681, 3900; Payload ID: 20321 relates to Category No.: 795, 12074, 6814; Payload ID: 20322 relates to Category No.: 14565, 10775, 6256, 6480, 12074, 6814; Payload ID: 20323 relates to Category No.: 12126, 12074, 9681, 1892, 6814; Payload ID: 20324 relates to Category No.: 12126, 9681, 6814; Payload ID: 20325 relates to Category No.: 12126, 1893, 12074, 9681, 6814; Payload ID: 20326 relates to Category No.: 12126, 12074, 9681, 6814; Payload ID: 20327 relates to Category No.: 13248, 12126, 14663, 12074, 9053, 9681, 4937, 14392; Payload ID: 20328 relates to Category No.: 12126, 9681, 12041, 12074; Payload ID: 20329 relates to Category No.: 12126, 9681, 12041, 12074, 6814; Payload ID: 20330 relates to Category No.: 6814, 12126, 9681; Payload ID: 20331 relates to Category No.: 6814, 12126, 12074, 9681, 12122; Payload ID: 20332 relates to Category No.: 12126, 9681; Payload ID: 20333 relates to Category No.: 12074, 6814; Payload ID: 20334 relates to Category No.: 6814, 12126, 12074, 9681; Payload ID: 20335 relates to Category No.: 12126, 12074, 9681, 6814; Payload ID: 20336 relates to Category No.: 12074, 13165, 11294, 6296; Payload ID: 20337 relates to Category No.: 12126, 12074, 9681, 6814; Payload ID: 20338 relates to Category No.: 8454; Payload ID: 20339 relates to Category No.: 14565, 3691, 16165, 12798, 1257, 12125; Payload ID: 20340 relates to Category No.: 1737, 1721, 7850, 200; Payload ID: 20342 relates to Category No.: 3452, 2886; Payload ID: 20343 relates to Category No.: 8936, 8988, 12041; Payload ID: 20344 relates to Category No.: 7933, 7934; Payload ID: 20345 relates to Category No.: 12194, 3639, 8756, 15570, 14654, 14655; Payload ID: 20346 relates to Category No.: 13594, 13589, 3398, 11512, 1730, 15517, 7306, 8739, 14838, 9375; Payload ID: 20348 relates to Category No.: 12970, 5129, 8739, 13562, 7996; Payload ID: 20350 relates to Category No.: 13589, 3398; Payload ID: 20351 relates to Category No.: 14177, 1285; Payload ID: 20352 relates to Category No.: 13594, 13589, 3398, 15490, 3398; Payload ID: 20353 relates to Category No.: 13589, 3398, 15490, 3398; Payload ID: 20354 relates to Category No.: 5807; Payload ID: 20355 relates to Category No.: 7291, 16182; Payload ID: 20356 relates to Category No.: 12137, 1955, 12936, 5807, 10238; Payload ID: 20357 relates to Category No.: 5807; Payload ID: 20358 relates to Category No.: 7291, 16182, 14271, 4439; Payload ID: 20359 relates to Category No.: 15490, 3398, 11512, 16096, 5406, 10626, 4953, 3194, 860, 1709, 16240; Payload ID: 20360 relates to Category No.: 15490, 3398, 11512; Payload ID: 20362 relates to Category No.: 13589, 3398, 15490, 3398, 1204; Payload ID: 20363 relates to Category No.: 2940, 7306, 12640; Payload ID: 20364 relates to Category No.: 2940, 7306, 12640; Payload ID: 20365 relates to Category No.: 13594, 15490, 3398; Payload ID: 20366 relates to Category No.: 2940, 7306, 12640; Payload ID: 20367 relates to Category No.: 9475, 7245, 5457; Payload ID: 20368 relates to Category No.: 15490, 3398, 1721, 8739, 2409, 7965, 1780, 16197, 8192, 8103, 13591; Payload ID: 20370 relates to Category No.: 15490, 3398, 8731, 3398, 14834; Payload ID: 20372 relates to Category No.: 13589, 3398, 8739, 10628, 10501, 7190, 13325, 10502; Payload ID: 20373 relates to Category No.: 13589, 3398; Payload ID: 20374 relates to Category No.: 16286, 1752, 2940, 12640, 11968, 11620, 11916, 11962, 11964; Payload ID: 20375 relates to Category No.: 7288, 13589, 3398, 14271; Payload ID: 20376 relates to Category No.: 9228, 1955, 3354, 14034, 13729, 13730, 3370, 7887, 3366; Payload ID: 20378 relates to Category No.: 795, 12153, 10602, 12096; Payload ID: 20382 relates to Category No.: 8940, 13231; Payload ID: 20383 relates to Category No.: 3452, 12117; Payload ID: 20385 relates to Category No.: 15490, 3398, 11506, 3398; Payload ID: 20386 relates to Category No.: 13589, 3398, 15490, 3398, 1204; Payload ID: 20387 relates to Category No.: 13589, 3398, 15490, 3398, 2410; Payload ID: 20389 relates to Category No.: 15490, 3398, 1730, 8739, 8731, 3398; Payload ID: 20390 relates to Category No.: 15490, 3398, 8739, 8731, 3398, 13594, 14782, 8375, 7270; Payload ID: 20391 relates to Category No.: 8739, 15490, 3398, 1730, 8731, 3398, 11147; Payload ID: 20392 relates to Category No.: 12194, 1366, 11706, 9165; Payload ID: 20393 relates to Category No.: 15490, 3398, 9232, 15516, 4439, 12891, 3783, 8004, 3783, 15520, 15498, 15290; Payload ID: 20395 relates to Category No.: 13589, 3398; Payload ID: 20396 relates to Category No.: 13589, 3398; Payload ID: 20397 relates to Category No.: 13589, 3398; Payload ID: 20398 relates to Category No.: 13589, 3398; Payload ID: 20399 relates to Category No.: 1202, 264; Payload ID: 20400 relates to Category No.: 1202, 264; Payload ID: 20401 relates to Category No.: 14586, 7304, 1202; Payload ID: 20402 relates to Category No.: 5782, 14565, 14586, 7304, 1202, 11726; Payload ID: 20403 relates to Category No.: 5785, 5782, 1415, 8731, 3398, 11506, 3398, 9891, 9375, 6577, 14586, 7304, 1202, 10790, 11460, 11266, 10845, 10814, 11265, 10298, 6575, 11986, 10187, 5286, 10904, 11578, 1228, 10763, 11188, 3543, 7654, 10186, 11153, 10235; Payload ID: 20404 relates to Category No.: 5785, 14586, 7304, 1202, 11460, 11265, 11986, 10187, 11976, 10763, 7654, 263; Payload ID: 20406 relates to Category No.: 12542; Payload ID: 20407 relates to Category No.: 7288, 14565, 6969, 14271, 1780, 10648, 11259, 14883, 1960, 1021, 15737, 1378, 13200, 11345, 3321, 10696, 11533, 797, 11702, 8331, 5453; Payload ID: 20408 relates to Category No.: 1737, 14661, 7159, 7134, 7132, 3883; Payload ID: 20409 relates to Category No.: 1737, 14661, 12137, 7154, 3833, 7159, 7134, 11884, 7132, 3889, 4766, 7163, 7153, 12848, 6687, 12023; Payload ID: 20410 relates to Category No.: 1737, 14661, 7154, 7134, 7132; Payload ID: 20411 relates to Category No.: 15490, 3398, 11506, 3398; Payload ID: 20412 relates to Category No.: 12153, 13645; Payload ID: 20413 relates to Category No.: 12153, 13645; Payload ID: 20414 relates to Category No.: 12153, 13645; Payload ID: 20415 relates to Category No.: 12153, 13645; Payload ID: 20415 relates to Category No.: 7306; Payload ID: 20417 relates to Category No.: 12137; Payload ID: 20418 relates to Category No.: 14057; Payload ID: 20419 relates to Category No.: 14565, 1703, 1816, 1820, 5592, 16197, 15570, 15000, 12999.

Cell Component

In one embodiment, the biocircuit may be classified by the cell component nature of the payload. Shown in the following paragraph are the payloads and classification (category number) for the payloads for the biocircuit systems described herein. Separated by a semi-colon, each payload-classification information describes the payload identifier (Payload ID) and the classifications (category number). For example, for the gene symbol AGPAT1 the payload-classification information is shown as "Payload ID: 2 relates to Category No.: 5561, 6717, 3673, 3666."

In one embodiment, the biocircuit of the invention may be classified by one of the following cell component categories for the payloads described herein such as, but not limited to, Payload ID: 2 relates to Category No.: 5561, 6717, 3673, 3666; Payload ID: 3 relates to Category No.: 5561, 3673, 3666, 6717; Payload ID: 4 relates to Category No.: 5561, 6717, 10056, 3673, 3666, 9162; Payload ID: 5 relates to Category No.: 5561, 3673; Payload ID: 6 relates to Category No.: 5561, 7118, 3673, 7070, 9162; Payload ID: 9 relates to Category No.: 2942, 4010; Payload ID: 10 relates to Category No.: 4030, 9305, 2890, 6717, 6960, 9247, 4010, 6709, 7366, 10056, 7048, 1774, 7070, 9734, 7367, 6989, 7368, 12219; Payload ID: 11 relates to Category No.: 9305, 7118, 2890, 9247, 7060, 4010; Payload ID: 12 relates to Category No.: 9756; Payload ID: 13 relates to Category No.: 5561, 9305, 2890, 6717, 4765, 3673, 3666, 2942, 2938; Payload ID: 14 relates to Category No.: 4029, 9305, 7118, 2890, 2942, 3666; Payload ID: 15 relates to Category No.: 9305, 7118, 2890, 6717, 5776, 2942, 3666, 9734; Payload ID: 16 relates to Category No.: 4030, 2890, 5776, 10056, 2942, 9247; Payload ID: 17 relates to Category No.: 2890, 6717, 9242, 2942; Payload ID: 18 relates to Category No.: 7118; Payload ID: 19 relates to Category No.: 9305, 2890, 9247, 4010; Payload ID: 20 relates to Category No.: 9756, 9753; Payload ID: 21 relates to Category No.: 9305, 2890, 2920; Payload ID: 23 relates to Category No.: 5561, 6717, 4010; Payload ID: 24 relates to Category No.: 5561, 4765, 4755; Payload ID: 25 relates to Category No.: 2890, 2942, 4010; Payload ID: 26 relates to Category No.: 5561, 5762, 3673, 3666, 9754, 5776; Payload ID: 27 relates to Category No.: 9305, 2890, 10056, 2942, 9247; Payload ID: 28 relates to Category No.: 7118, 7060, 7048; Payload ID: 29 relates to Category No.: 5561, 3673, 3666; Payload ID: 30 relates to Category No.: 5561, 3673, 3666; Payload ID: 31 relates to Category No.: 5561, 3673, 3666, 4228; Payload ID: 32 relates to Category No.: 5561, 3673, 3666; Payload ID: 33 relates to Category No.: 2890, 2942, 4010; Payload ID: 34 relates to Category No.: 7118, 2890, 9247, 7060, 7048; Payload ID: 35 relates to Category No.: 2890, 2942, 4010; Payload ID: 36 relates to Category No.: 7060, 7118; Payload ID: 37 relates to Category No.: 7060, 4010, 7118; Payload ID: 38 relates to Category No.: 7118, 7060, 9756, 7048; Payload ID: 39 relates to Category No.: 6717, 2942, 3673, 3666, 9734; Payload ID: 40 relates to Category No.: 4030, 5561, 6717, 3673, 3666; Payload ID: 41 relates to Category No.: 7118, 7060; Payload ID: 42 relates to Category No.: 7118, 7244; Payload ID: 43 relates to Category No.: 7118, 2890; Payload ID: 44 relates to Category No.: 2942; Payload ID: 45 relates to Category No.: 2942; Payload ID: 46 relates to Category No.: 2890, 10056, 2942, 9247, 1774, 4228, 2899, 8951; Payload ID: 47 relates to Category No.: 7118, 7060, 4010, 142, 8935; Payload ID: 48 relates to Category No.: 7118, 4010, 5561; Payload ID: 49 relates to Category No.: 3673, 4755, 4765, 3666, 2942, 4010; Payload ID: 51 relates to Category No.: 9305, 2890, 2942, 4010, 7118; Payload ID: 52 relates to Category No.: 2890, 7060; Payload ID: 53 relates to Category No.: 7118, 7060; Payload ID: 54 relates to Category No.: 9305, 2890, 6717, 10056, 2942, 4755, 5730, 2903; Payload ID: 55 relates to Category No.: 9305, 6717, 9242, 493; Payload ID: 56 relates to Category No.: 6717, 2942, 4010, 7118; Payload ID: 57 relates to Category No.: 7118, 2890, 9247, 7060; Payload ID: 58 relates to Category No.: 7118, 7048, 7060; Payload ID: 59 relates to Category No.: 2890; Payload ID: 61 relates to Category No.: 5561, 10056, 5570; Payload ID: 62 relates to Category No.: 5561, 10056, 5570, 2890; Payload ID: 63 relates to Category No.: 5561, 10056, 5570; Payload ID: 64 relates to Category No.: 5561, 10056, 5570; Payload ID: 65 relates to Category No.: 5561, 10056, 5570; Payload ID: 66 relates to Category No.: 5561, 10056, 5570, 2899, 1017, 1659, 3054, 2890, 2942, 6717, 3036, 8948, 1712; Payload ID: 67 relates to Category No.: 5561, 2890, 10056, 5570, 15139, 1748, 6717, 3036, 8948; Payload ID: 68 relates to Category No.: 5561, 10056, 5570, 2942; Payload ID: 69 relates to Category No.: 5561, 6717, 10056, 8935, 5570, 15139, 1748, 11653, 2890, 1017, 8948; Payload ID: 70 relates to Category No.: 5561, 6717, 10056, 8935, 5570, 15139, 11653, 1792; Payload ID: 71 relates to Category No.: 6717, 10056, 8935, 15139; Payload ID: 72 relates to Category No.: 5561, 6717, 10056, 8935, 15139; Payload ID: 73 relates to Category No.: 6717, 10056, 8935, 15139, 5561; Payload ID: 74 relates to Category No.: 5561, 2890, 6717, 10056, 5570, 3693; Payload ID: 75 relates to Category No.: 5561, 10056, 5570, 4755, 3036, 14293, 9730; Payload ID: 76 relates to Category No.: 5561, 10056, 5570, 2458; Payload ID: 77 relates to Category No.: 5561, 10056, 5570; Payload ID: 78 relates to Category No.: 2890, 5762, 2942; Payload ID: 79 relates to Category No.: 2890, 2942, 9247, 5730; Payload ID: 82 relates to Category No.: 12406, 2942, 7118; Payload ID: 84 relates to Category No.: 2890, 2942; Payload ID: 85 relates to Category No.: 9305, 2890, 2942; Payload ID: 86 relates to Category No.: 2942; Payload ID: 87 relates to Category No.: 2890, 2942, 3666, 7118; Payload ID: 88 relates to Category No.: 2890, 2942; Payload ID: 89 relates to Category No.: 2890, 10056, 6717, 677, 4010, 1792, 15147; Payload ID: 90 relates to Category No.: 2942; Payload ID: 91 relates to Category No.: 7060, 7118; Payload ID: 92 relates to Category No.: 9305, 2890, 6717, 9242, 2942, 14145, 2947, 4010, 4228, 10161; Payload ID: 93 relates to Category No.: 2942, 173; Payload ID: 94 relates to Category No.: 2942, 2890; Payload ID: 95 relates to Category No.: 2942, 9247; Payload ID: 96 relates to Category No.: 2942; Payload ID: 97 relates to Category No.: 2942, 4010; Payload ID: 98 relates to Category No.: 7118, 2890, 2942; Payload ID: 99 relates to Category No.: 6717, 3673, 3666, 5557, 9192, 5776, 5561; Payload ID: 100 relates to Category No.: 9305, 7118, 9247, 11883, 9215, 9181; Payload ID: 101 relates to Category No.: 5561, 7118, 6717, 2942, 7070, 11653, 8917, 7048, 7060, 6222, 7032; Payload ID: 102 relates to Category No.: 7118, 2890, 10056, 2942; Payload ID: 103 relates to Category No.: 2890, 6976, 9756, 11883; Payload ID: 104 relates to Category No.: 2890, 2938, 10056, 1720, 4228; Payload ID: 105 relates to Category No.: 9305, 2890, 6717, 2942, 9734, 5762; Payload ID: 106 relates to Category No.: 2890, 14825; Payload ID: 107 relates to Category No.: 9305, 2890, 9247, 14912, 9215; Payload ID: 109 relates to Category No.: 9305, 2890, 14825, 14833, 262, 7244; Payload ID: 110 relates to Category No.: 9305, 2890, 14825, 14833, 2938, 7244, 1474, 2458, 9734, 16326; Payload ID: 111 relates to Category No.: 10056, 2942, 2938, 2890, 1099, 11883, 3055, 8948, 3054, 9734, 11650, 3040, 3059, 4201, 915; Payload ID: 112 relates to Category No.: 2890, 9734, 14368, 9184, 1659, 9162, 15758, 5920, 1402, 5596; Payload ID: 113 relates to Category No.: 9305, 2942, 2890, 5762, 10056, 779, 6075; Payload ID: 114 relates to Category No.: 9305, 6717, 9247, 9181, 4146, 7118, 4755; Payload ID: 115 relates to Category No.: 9305, 2890, 9247, 9181; Payload ID: 116 relates to Category No.: 16257, 2938, 2194, 5776, 2942, 2477, 4755, 4769, 2890, 2441, 9727; Payload ID: 117 relates to Category No.: 9247; Payload ID: 119 relates to Category No.: 4029, 7118; Payload ID: 120 relates to Category No.: 5561; Payload ID: 121 relates to Category No.: 5561, 7118; Payload ID: 122 relates to Category No.: 5561, 10056, 2942, 7061, 7118; Payload ID: 123 relates to Category No.: 5561, 7118; Payload ID: 124 relates to Category No.: 2194, 447, 11728, 1811, 2183, 2458, 15243, 2441, 9098, 10002; Payload ID: 125 relates to Category No.: 2890; Payload ID: 126 relates to Category No.: 5561; Payload ID: 127 relates to Category No.: 7118, 2942, 7060; Payload ID: 128 relates to Category No.: 7118, 1842; Payload ID: 129 relates to Category No.: 5561, 10056, 657; Payload ID: 131 relates to Category No.: 5561, 6717; Payload ID: 132 relates to Category No.: 5561, 2890, 4010;

Payload ID: 133 relates to Category No.: 9305, 2890, 9242, 2942, 4010; Payload ID: 134 relates to Category No.: 4029, 6717; Payload ID: 135 relates to Category No.: 5561; Payload ID: 137 relates to Category No.: 4029, 6717; Payload ID: 138 relates to Category No.: 4029, 6717; Payload ID: 140 relates to Category No.: 4029; Payload ID: 141 relates to Category No.: 5561; Payload ID: 142 relates to Category No.: 5561, 10056, 1842; Payload ID: 143 relates to Category No.: 3673, 6222; Payload ID: 144 relates to Category No.: 9305, 2890, 5776, 2942, 6222; Payload ID: 145 relates to Category No.: 5561, 7118, 10056, 4010, 657; Payload ID: 146 relates to Category No.: 4010; Payload ID: 147 relates to Category No.: 2890, 6717, 5762, 6017; Payload ID: 148 relates to Category No.: 4030, 4014, 12159, 5749; Payload ID: 149 relates to Category No.: 9305, 7118, 2890, 9242, 2942, 4043, 9247, 273, 9734, 9184, 1750; Payload ID: 150 relates to Category No.: 2942, 4043, 273, 6017, 9773, 3055; Payload ID: 151 relates to Category No.: 9305, 2890, 5762, 2938, 2942, 3666, 1748, 11650, 11653, 6017, 4199, 4860, 4010, 14378, 8935, 1750; Payload ID: 152 relates to Category No.: 2890, 1803, 3036, 2938, 2942, 6017, 4199, 14378; Payload ID: 153 relates to Category No.: 9305, 2890, 7170, 6972, 14906, 6960, 6994, 6692; Payload ID: 154 relates to Category No.: 5561, 6717; Payload ID: 156 relates to Category No.: 1842; Payload ID: 158 relates to Category No.: 9305, 2890, 2942, 499; Payload ID: 159 relates to Category No.: 5762; Payload ID: 160 relates to Category No.: 5762; Payload ID: 161 relates to Category No.: 5561; Payload ID: 162 relates to Category No.: 10056, 8951; Payload ID: 163 relates to Category No.: 5762; Payload ID: 164 relates to Category No.: 5762; Payload ID: 165 relates to Category No.: 5762; Payload ID: 166 relates to Category No.: 5762; Payload ID: 168 relates to Category No.: 5762; Payload ID: 170 relates to Category No.: 5727; Payload ID: 171 relates to Category No.: 14174, 5762; Payload ID: 172 relates to Category No.: 5561; Payload ID: 176 relates to Category No.: 5561; Payload ID: 180 relates to Category No.: 14174; Payload ID: 185 relates to Category No.: 14174; Payload ID: 190 relates to Category No.: 5561, 6717, 10056; Payload ID: 192 relates to Category No.: 5561; Payload ID: 199 relates to Category No.: 5561; Payload ID: 214 relates to Category No.: 5561; Payload ID: 219 relates to Category No.: 5561; Payload ID: 220 relates to Category No.: 9305; Payload ID: 225 relates to Category No.: 5762; Payload ID: 234 relates to Category No.: 9305; Payload ID: 236 relates to Category No.: 14174; Payload ID: 238 relates to Category No.: 14668, 5762; Payload ID: 239 relates to Category No.: 14668, 5762; Payload ID: 240 relates to Category No.: 14668, 5762; Payload ID: 241 relates to Category No.: 14668, 5762; Payload ID: 242 relates to Category No.: 14668, 5762; Payload ID: 243 relates to Category No.: 14668, 5762; Payload ID: 251 relates to Category No.: 7118; Payload ID: 268 relates to Category No.: 5561, 7087; Payload ID: 274 relates to Category No.: 5934; Payload ID: 281 relates to Category No.: 2942; Payload ID: 283 relates to Category No.: 5561; Payload ID: 294 relates to Category No.: 5762; Payload ID: 301 relates to Category No.: 14174; Payload ID: 304 relates to Category No.: 14174; Payload ID: 308 relates to Category No.: 5762; Payload ID: 327 relates to Category No.: 5561; Payload ID: 330 relates to Category No.: 5561; Payload ID: 344 relates to Category No.: 5561; Payload ID: 353 relates to Category No.: 5561; Payload ID: 354 relates to Category No.: 5561; Payload ID: 355 relates to Category No.: 5561; Payload ID: 362 relates to Category No.: 5561; Payload ID: 374 relates to Category No.: 5561; Payload ID: 378 relates to Category No.: 5561; Payload ID: 379 relates to Category No.: 2942; Payload ID: 380 relates to Category No.: 4030, 4029, 9305, 6717, 10056, 677, 15139, 4755, 9734, 1748, 8917, 1083, 15145, 5561, 1792; Payload ID: 381 relates to Category No.: 7118, 7060, 4010, 7048; Payload ID: 382 relates to Category No.: 9305, 2890, 9242, 9247, 4010; Payload ID: 383 relates to Category No.: 6717, 5776, 9756, 9753; Payload ID: 384 relates to Category No.: 7118, 4010, 7048; Payload ID: 385 relates to Category No.: 2890, 9242, 2942, 273, 4010, 7118; Payload ID: 386 relates to Category No.: 9305, 7118, 2942, 3652, 7070; Payload ID: 387 relates to Category No.: 2942; Payload ID: 388 relates to Category No.: 2890; Payload ID: 389 relates to Category No.: 9305, 8948; Payload ID: 390 relates to Category No.: 9305, 2890; Payload ID: 391 relates to Category No.: 9305, 15505; Payload ID: 392 relates to Category No.: 9305, 1842; Payload ID: 393 relates to Category No.: 9305, 1842; Payload ID: 394 relates to Category No.: 9305, 2890, 6717, 2194, 9247, 9199, 9184, 9162; Payload ID: 395 relates to Category No.: 2890, 4010, 2918; Payload ID: 396 relates to Category No.: 5561, 6443, 6717, 4010, 6440, 6437, 8935, 2926; Payload ID: 397 relates to Category No.: 5561, 6443, 2942, 4010, 4030; Payload ID: 398 relates to Category No.: 7118, 2890; Payload ID: 399 relates to Category No.: 4030, 9305, 5762, 10056, 4010, 6440, 16164, 5561, 4199, 778, 7321, 14409, 4759; Payload ID: 400 relates to Category No.: 5561; Payload ID: 401 relates to Category No.: 6717, 10056, 5570, 1792, 5561; Payload ID: 402 relates to Category No.: 5561, 6717, 10056, 5570, 15139, 8948, 8935, 3055; Payload ID: 403 relates to Category No.: 5561, 2890, 6717, 10056, 5570; Payload ID: 404 relates to Category No.: 6717, 5570; Payload ID: 405 relates to Category No.: 5561, 6717, 10056; Payload ID: 406 relates to Category No.: 5561, 6717; Payload ID: 407 relates to Category No.: 9305, 2890, 3666, 9247, 9734; Payload ID: 408 relates to Category No.: 9305, 2890, 9242, 4010; Payload ID: 410 relates to Category No.: 9305, 2899, 15130, 2890; Payload ID: 411 relates to Category No.: 9305; Payload ID: 413 relates to Category No.: 9305, 2890, 10056, 2942, 9247, 4755; Payload ID: 414 relates to Category No.: 7118, 2890, 2942, 3666, 4755, 4010; Payload ID: 415 relates to Category No.: 9305, 7118, 7060, 7366; Payload ID: 416 relates to Category No.: 4029, 9305, 11883, 262, 260, 4786; Payload ID: 417 relates to Category No.: 4029, 9305, 262; Payload ID: 418 relates to Category No.: 262; Payload ID: 419 relates to Category No.: 2890, 273, 6017, 14999, 8951; Payload ID: 420 relates to Category No.: 273, 7389; Payload ID: 421 relates to Category No.: 2890, 6017, 14999; Payload ID: 422 relates to Category No.: 10056, 273, 14364, 7389; Payload ID: 423 relates to Category No.: 2890, 273, 4228; Payload ID: 424 relates to Category No.: 9305, 2890, 10056, 1748, 10106, 5829; Payload ID: 425 relates to Category No.: 2890, 10056; Payload ID: 426 relates to Category No.: 4030, 9305, 6717, 2938, 10056, 2942, 1239, 4010, 4228, 3064, 273, 7366, 7389, 4197; Payload ID: 427 relates to Category No.: 850, 2942, 273, 4010, 7339; Payload ID: 428 relates to Category No.: 850, 2942, 273, 4010, 4228; Payload ID: 429 relates to Category No.: 2890, 2942, 8935, 15139, 273, 4755, 850, 4010, 4228, 10056, 3693, 1750, 7339; Payload ID: 430 relates to Category No.: 6717, 2938, 2942, 273, 850, 4010, 4228, 6017; Payload ID: 431 relates to Category No.: 2942, 273, 850, 4010, 1774; Payload ID: 432 relates to Category No.: 2890, 2942, 273, 850, 4010, 1774, 4228; Payload ID: 433 relates to Category No.: 2890, 273, 850, 4010, 4228; Payload ID: 434 relates to Category No.: 4030, 2942, 273, 14364, 276, 1239, 6017, 4199, 4010, 15014, 14999, 1711; Payload ID: 435 relates to Category No.: 4030, 2890, 2942, 6017, 4199, 4010, 11883, 1711, 2938, 14692; Payload ID: 436 relates to Category No.: 4030, 2890, 6717, 2942, 14364, 276, 1239, 6017, 4199, 4010, 4228, 5342, 1711, 375, 299; Payload ID: 437 relates to Category No.: 4030, 2890, 6717, 2938, 10056, 2942, 14145, 9247, 9157, 1239, 4010, 4228, 11883, 2907, 9153, 7180, 3064; Payload ID: 438 relates to Category No.: 4030, 2890, 2938, 4010; Payload ID: 439 relates to Category No.: 4030, 2890, 2942, 1239, 6017, 4199, 4010, 7395, 1711, 1772; Payload ID: 440 relates to Category No.: 4030, 4029, 2890, 5762, 10056, 2942, 1811, 276, 4010, 1774, 14327, 4228, 16326, 10077, 14999, 12219, 1335, 4089; Payload ID: 441 relates to Category No.: 4029, 2938, 10056, 2942, 276, 4199, 4010, 4228, 3055, 16326, 10077, 12219, 14364, 2710; Payload ID: 442 relates to Category No.: 5762, 14364, 16326, 1335, 2942, 276, 4010, 4228, 12219; Payload ID: 443 relates to Category No.: 4030, 4029, 9305, 2890, 5762, 14145, 273, 9734, 4010, 4228, 11883, 10077, 12219, 14999, 1811, 16326, 2712, 1335, 8935; Payload ID: 445 relates to Category No.: 9305, 10056, 9247, 9157, 15126, 11883, 9133, 5466, 9153, 1077; Payload ID: 446 relates to Category No.: 9305, 9242, 15126, 7544, 1077, 15127; Payload ID: 447 relates to Category No.: 9305, 2890, 2938, 4755, 11883, 6525, 7244; Payload ID: 448 relates to Category No.: 273, 2890; Payload ID: 449 relates to Category No.: 2890, 2938; Payload ID: 450 relates to Category No.: 2890, 2938; Payload ID: 451 relates to Category No.: 2890, 3506; Payload ID: 452 relates to Category No.: 6017; Payload ID: 453 relates to Category No.: 2890, 2938; Payload ID: 454 relates to Category No.: 2890, 2938; Payload ID: 455 relates to Category No.: 2890, 2938, 6525; Payload ID: 456 relates to Category No.: 5561, 4010, 4228, 4008, 8948, 1017; Payload ID: 457 relates to Category No.: 2890, 15505, 9247; Payload ID: 458 relates to Category No.: 9247; Payload ID: 459 relates to Category No.: 9305, 2890, 6717, 5762, 9247, 4755; Payload ID: 460 relates to Category No.: 9247, 9305, 917, 15505; Payload ID: 461 relates to Category No.: 9305, 2890, 9247, 7070, 14614, 6717; Payload ID: 462 relates to Category No.: 9305, 9242, 9247, 2389; Payload ID: 463 relates to Category No.: 9305, 2890, 6976, 8935, 9247, 9195, 918, 917, 6162, 2390, 15505, 3040; Payload ID: 464 relates to Category No.: 9305, 2890, 2194, 9247, 15505; Payload ID: 465 relates to Category No.: 9305, 6717, 4765, 3673, 3666, 9247, 4755, 5557, 9162; Payload ID: 466 relates to Category No.: 9305, 5762, 3673, 4755, 5557, 12170; Payload ID: 467 relates to Category No.: 9305, 2890, 9247, 9195; Payload ID: 468 relates to Category No.: 9305, 2890, 9247, 15505; Payload ID: 469 relates to Category No.: 9305, 2890, 9242, 9247; Payload ID: 470 relates to Category No.: 9305, 2890, 4003; Payload ID: 471 relates to Category No.: 9305, 9242, 15505; Payload ID: 472 relates to Category No.: 6717, 2942, 10056, 5762; Payload ID: 473 relates to Category No.: 6717, 5570, 1792, 3036, 8948, 5561; Payload ID: 474 relates to Category No.: 6717, 5570, 371, 778; Payload ID: 475 relates to Category No.: 6717, 10056, 5570, 4010, 1792, 12406, 371; Payload ID: 476 relates to Category No.: 6717, 10056, 371; Payload ID: 477 relates to Category No.: 2890, 6717, 10056, 5570, 12406, 5433, 1792; Payload ID: 478 relates to Category No.: 2890, 6717, 10056, 5570, 11883, 12406; Payload ID: 479 relates to Category No.: 9305, 4030, 2890, 3036, 1017, 8948; Payload ID: 480 relates to Category No.: 2890, 10056, 3693, 1748, 11650, 11653, 3055, 262, 273; Payload ID: 481 relates to Category No.: 2890, 2942, 4010, 9184; Payload ID: 482 relates to Category No.: 5561, 7118, 6717, 4765, 4755; Payload ID: 484 relates to Category No.: 5561, 9305, 6717, 5776, 9247, 9756, 9754; Payload ID: 485 relates to Category No.: 2890; Payload ID: 487 relates to Category No.: 7118, 7060; Payload ID: 488 relates to Category No.: 9305, 7048, 7061, 9756; Payload ID: 489 relates to Category No.: 7118, 7060; Payload ID: 490 relates to Category No.: 9305, 7118, 3036; Payload ID: 491 relates to Category No.: 9305, 7118, 7060; Payload ID: 492 relates to Category No.: 9305, 7118, 7060, 1017, 4010; Payload ID: 493 relates to Category No.: 7118, 2890, 7060, 7061; Payload ID: 494 relates to Category No.: 7118, 7060, 4010; Payload ID: 495 relates to Category No.: 9305, 7118, 2890, 7048, 9242, 7060, 7068; Payload ID: 496 relates to Category No.: 9305, 6717, 5776, 10056, 9242, 9247, 9756, 9753, 2890, 7118, 9754; Payload ID: 497 relates to Category No.: 9756, 9753; Payload ID: 498 relates to Category No.: 6717, 9756, 9753, 7118; Payload ID: 499 relates to Category No.: 9756, 1842; Payload ID: 500 relates to Category No.: 2890, 2942, 3666, 2899; Payload ID: 501 relates to Category No.: 7118, 2890, 6717, 2942, 5561; Payload ID: 502 relates to Category No.: 7060, 7118; Payload ID: 503 relates to Category No.: 7118, 7060; Payload ID: 504 relates to Category No.: 5561, 7118, 6717, 3673, 7070, 9754, 10056, 3666; Payload ID: 505 relates to Category No.: 5561, 6717, 3673, 3666, 4755, 9734, 7070, 6222, 9754; Payload ID: 506 relates to Category No.: 5561, 2890, 6717, 3673, 7070, 6222, 9754, 4010, 3848, 7118, 9756, 3666, 8948, 7061; Payload ID: 507 relates to Category No.: 5561, 9305, 7118, 6717, 9242, 3673, 3666, 7070, 7048; Payload ID: 508 relates to Category No.: 5561, 6717, 10056, 3673, 7070, 9754; Payload ID: 509 relates to Category No.: 7060, 1239, 4010, 7118, 5561; Payload ID: 510 relates to Category No.: 7118, 7060; Payload ID: 511 relates to Category No.: 7118, 7060, 5561; Payload ID: 512 relates to Category No.: 7060, 1842, 7118; Payload ID: 513 relates to Category No.: 7060, 7118; Payload ID: 514 relates to Category No.: 7060; Payload ID: 515 relates to Category No.: 7118; Payload ID: 516 relates to Category No.: 7060, 7118; Payload ID: 517 relates to Category No.: 2890, 5776, 2942, 9247; Payload ID: 518 relates to Category No.: 7118; Payload ID: 519 relates to Category No.: 2942; Payload ID: 520 relates to Category No.: 2890, 2942, 4010; Payload ID: 521 relates to Category No.: 2942; Payload ID: 522 relates to Category No.: 9305, 7118, 2942, 14893, 4010; Payload ID: 523 relates to Category No.: 7118, 7060, 4010; Payload ID: 524 relates to Category No.: 9756, 9753; Payload ID: 525 relates to Category No.: 2942, 9753; Payload ID: 526 relates to Category No.: 7118, 2890, 2942, 9247, 4010, 8935, 1711; Payload ID: 527 relates to Category No.: 9753, 7118, 9756; Payload ID: 528 relates to Category No.: 7118, 7060; Payload ID: 529 relates to Category No.: 5561, 3673; Payload ID: 530 relates to Category No.: 5561, 3673; Payload ID: 531 relates to Category No.: 7118, 5776, 7070, 6717; Payload ID: 532 relates to Category No.: 4029; Payload ID: 533 relates to Category No.: 4010; Payload ID: 534 relates to Category No.: 7118; Payload ID: 535 relates to Category No.: 9305; Payload ID: 536 relates to Category No.: 5561, 9305, 2890, 6717, 5776, 10056, 4755, 4010, 1792, 4228, 4786, 15318, 9732, 11650, 15573; Payload ID: 537 relates to Category No.: 5561, 10056, 4014; Payload ID: 538 relates to Category No.: 5561, 4029, 7118, 10056, 9247; Payload ID: 539 relates to Category No.: 5561, 10056, 447, 4010, 1774, 1792, 262; Payload ID: 540 relates to Category No.: 2890, 6717, 10056, 5570, 273, 1811, 1792, 6743, 4228, 779, 14329; Payload ID: 541 relates to Category No.: 5561, 6717; Payload ID: 542 relates to Category No.: 5561, 4755; Payload ID: 543 relates to Category No.: 10056, 5570, 5561; Payload ID: 544 relates to Category No.: 5561, 10056; Payload ID: 545 relates to Category No.: 5561, 10056, 8948, 1017, 8935; Payload ID: 546 relates to Category No.: 5561, 10056, 1017; Payload ID: 547 relates to Category No.: 4029, 10056, 5570, 5561; Payload ID: 548 relates to Category No.:

5561, 4029, 10056; Payload ID: 549 relates to Category No.: 5570; Payload ID: 550 relates to Category No.: 5561, 10056; Payload ID: 551 relates to Category No.: 5561; Payload ID: 552 relates to Category No.: 5561; Payload ID: 553 relates to Category No.: 5561, 10056; Payload ID: 554 relates to Category No.: 2890, 10056, 5570, 10106, 1792, 14802, 15296, 9778, 565, 3068, 564; Payload ID: 555 relates to Category No.: 4030, 5561, 4010, 1792, 4228, 5817, 2890, 10056; Payload ID: 557 relates to Category No.: 2890, 4014, 2926, 1090, 12159, 5561; Payload ID: 558 relates to Category No.: 4014, 6948, 12159; Payload ID: 559 relates to Category No.: 12159, 4014; Payload ID: 560 relates to Category No.: 12159, 1792, 3671, 4030; Payload ID: 561 relates to Category No.: 4029, 12159, 4014; Payload ID: 562 relates to Category No.: 12159, 4014; Payload ID: 563 relates to Category No.: 12159, 4014; Payload ID: 564 relates to Category No.: 12159, 4014; Payload ID: 565 relates to Category No.: 12159, 4014; Payload ID: 566 relates to Category No.: 12159, 4014; Payload ID: 567 relates to Category No.: 4029, 12159, 4014; Payload ID: 568 relates to Category No.: 12159, 4014, 4030; Payload ID: 569 relates to Category No.: 4030, 4029, 12159, 4014, 4010; Payload ID: 570 relates to Category No.: 4030, 4029, 12159, 4014, 5561; Payload ID: 571 relates to Category No.: 4029, 12159, 4014, 3671; Payload ID: 572 relates to Category No.: 12159, 4014; Payload ID: 573 relates to Category No.: 12159, 4014, 3671; Payload ID: 574 relates to Category No.: 12159, 4014; Payload ID: 575 relates to Category No.: 12159, 4014, 3666; Payload ID: 576 relates to Category No.: 4029, 1842; Payload ID: 577 relates to Category No.: 12159, 3671, 4014; Payload ID: 578 relates to Category No.: 4014, 4029, 12159; Payload ID: 579 relates to Category No.: 12159; Payload ID: 580 relates to Category No.: 4014, 1842, 3671, 12159, 5749; Payload ID: 581 relates to Category No.: 12159, 4014; Payload ID: 582 relates to Category No.: 9305, 2890, 2942, 9311, 4010, 3696, 3523, 16164; Payload ID: 583 relates to Category No.: 9305, 2890, 9311, 4010, 3696, 3523; Payload ID: 584 relates to Category No.: 15627, 4755, 3521, 6059, 3693; Payload ID: 585 relates to Category No.: 2942, 4765, 6722, 2490, 2927, 6440, 15574, 2503; Payload ID: 586 relates to Category No.: 12439, 2890, 6717, 5776, 2942, 4765, 6722, 4755, 2490, 2927, 804, 6440, 2504, 15574, 2505, 2503, 9734; Payload ID: 587 relates to Category No.: 6717, 4765, 6722, 15627, 4755, 2490, 3696, 4786, 763; Payload ID: 588 relates to Category No.: 6717, 2942, 4765, 2490, 2927, 4010, 6440, 15574, 2503; Payload ID: 589 relates to Category No.: 5776, 2942, 4765, 2490, 2927, 6440, 15574, 2503; Payload ID: 590 relates to Category No.: 6717, 2942, 4765, 6722, 2927, 2534, 4010, 6440, 15574, 2503, 763, 15280; Payload ID: 591 relates to Category No.: 2942, 4765, 6722, 2927, 2534, 804, 6440, 15574, 2503; Payload ID: 592 relates to Category No.: 2942, 4765, 6722, 2927, 2534, 6440, 15574, 2503, 6717; Payload ID: 593 relates to Category No.: 6717, 10056, 2942, 6722, 2497, 2490, 3638, 3651, 2503, 766, 4202, 1099, 11883, 779; Payload ID: 594 relates to Category No.: 6722, 4755, 6717, 2490; Payload ID: 595 relates to Category No.: 6722, 6717, 5776, 10056, 2942, 2490, 3638, 3651, 2503, 766, 15573, 2492; Payload ID: 596 relates to Category No.: 10056, 2942, 2490, 4010, 6440, 3638, 3651, 2503, 766, 7118, 15280; Payload ID: 597 relates to Category No.: 6722, 10056, 2942, 3638, 3651, 2503, 766; Payload ID: 598 relates to Category No.: 6717, 6722, 4755, 2490, 6440, 768, 2505; Payload ID: 599 relates to Category No.: 2890, 6722, 9247, 4755, 768, 2505, 2664; Payload ID: 600 relates to Category No.: 6717, 4765, 6722, 9247, 4755, 3696, 6440, 1017, 15280; Payload ID: 601 relates to Category No.: 6443, 4755, 2490, 2927, 6440; Payload ID: 602 relates to Category No.: 4755, 2490, 2927, 804; Payload ID: 603 relates to Category No.: 6722, 15627, 4755, 2927, 804, 768, 6717; Payload ID: 604 relates to Category No.: 6722, 4755, 2927, 768, 6717; Payload ID: 605 relates to Category No.: 6722, 2490, 15573, 2534, 3695, 15574; Payload ID: 606 relates to Category No.: 6722, 2534, 3695, 15574; Payload ID: 607 relates to Category No.: 2490, 15573, 2534, 4010, 804, 4779, 3695, 15574; Payload ID: 608 relates to Category No.: 2534, 3695, 15574, 6717; Payload ID: 609 relates to Category No.: 804, 6440; Payload ID: 610 relates to Category No.: 6443, 6717, 2942, 804, 6060, 6059, 6440; Payload ID: 611 relates to Category No.: 804, 6443, 9305, 2890, 2942, 9247, 6060, 6059, 6440; Payload ID: 612 relates to Category No.: 9305, 2890, 9247, 804, 770; Payload ID: 613 relates to Category No.: 9157, 4010, 11684, 9305; Payload ID: 614 relates to Category No.: 9247, 9305, 9157; Payload ID: 615 relates to Category No.: 9305; Payload ID: 616 relates to Category No.: 2938, 10056, 5730, 9305, 2942, 9247, 4073, 4228, 6717; Payload ID: 617 relates to Category No.: 10056, 2942, 2899, 4073, 2938; Payload ID: 618 relates to Category No.: 2890, 6717, 2938, 10056, 2942, 9247, 1811, 1720, 2632, 8951, 1335; Payload ID: 619 relates to Category No.: 2890, 2942, 9247, 4010; Payload ID: 620 relates to Category No.: 2890, 4765, 4755, 9734, 2901, 1154, 6968, 276, 1643, 6019; Payload ID: 621 relates to Category No.: 5570; Payload ID: 622 relates to Category No.: 5561; Payload ID: 623 relates to Category No.: 9305, 2890, 2194, 10056, 2942, 1182, 9247, 2901, 1154, 1803, 6017, 5964, 1643, 6075, 14329, 4860, 1017, 1774, 1777, 6978, 1036, 15139, 3036, 11883, 6960, 8935, 8948, 9184, 8942, 1720, 1712; Payload ID: 624 relates to Category No.: 5561, 10056, 5570, 15139, 3055, 1099, 11653, 3036, 11721, 3666, 8948, 15280, 1711, 3652, 11650, 11723, 1016, 915; Payload ID: 625 relates to Category No.: 5561, 6717, 10056, 5570; Payload ID: 626 relates to Category No.: 5561, 5762, 10056, 5570; Payload ID: 627 relates to Category No.: 5561, 10056; Payload ID: 628 relates to Category No.: 6443, 2890, 6717, 10056, 2942, 1748, 4008, 1792, 2900, 4030, 8948, 3037; Payload ID: 629 relates to Category No.: 9305; Payload ID: 631 relates to Category No.: 9305, 2890, 6717, 9242, 9247, 15119; Payload ID: 632 relates to Category No.: 9305, 2890, 9242, 9247; Payload ID: 633 relates to Category No.: 9305; Payload ID: 635 relates to Category No.: 9247, 15731; Payload ID: 637 relates to Category No.: 2942; Payload ID: 638 relates to Category No.: 2890, 2942, 9247, 9305; Payload ID: 639 relates to Category No.: 2942; Payload ID: 640 relates to Category No.: 2942, 1842; Payload ID: 641 relates to Category No.: 2942; Payload ID: 642 relates to Category No.: 2890, 2942, 4010, 6709, 9305, 8935; Payload ID: 643 relates to Category No.: 2890, 2942, 3666, 4010, 779, 5776; Payload ID: 644 relates to Category No.: 2942, 3666, 8935, 5776; Payload ID: 645 relates to Category No.: 2942; Payload ID: 646 relates to Category No.: 5561, 5762, 2890, 10056, 5570, 4010, 6743, 9305; Payload ID: 647 relates to Category No.: 9305, 7118, 2890, 10056, 2942, 9734, 6968, 7244, 6717, 3036, 1017, 8948, 778, 4860, 1084; Payload ID: 648 relates to Category No.: 2890, 6717, 5762, 10056, 5570, 3036, 6743, 5561; Payload ID: 649 relates to Category No.: 5561, 2890, 6717, 10056, 5570, 4755, 2458, 9305, 6743, 5762; Payload ID: 650 relates to Category No.: 5561, 2890, 6717, 10056, 5762, 3036, 11883; Payload ID: 651 relates to Category No.: 5561, 5762, 10056, 2942, 11728, 6717; Payload ID: 652 relates to Category No.: 5561, 6717, 5762, 10056, 2458, 5823, 3693, 6743, 14363, 6991; Payload ID: 653 relates to Category No.: 5561, 5762, 10056, 6717; Payload ID: 654 relates to Category No.: 5561, 6717, 5762, 10056; Payload ID: 655 relates to Category No.: 5561, 5762, 10056, 5570, 3036, 1017; Payload ID: 656 relates to Category No.: 4029, 5762, 4030, 15280; Payload ID: 657 relates to Category No.: 5561, 6717, 10056, 5570, 12406, 2890, 3693, 1659, 1792, 8935, 1182, 14293; Payload ID: 658 relates to Category No.: 2890, 2942, 4010, 10056, 9472, 14826; Payload ID: 659 relates to Category No.: 4010, 7052, 7048, 14826, 7118, 14829, 2942; Payload ID: 660 relates to Category No.: 7118, 7060; Payload ID: 661 relates to Category No.: 7118, 7060, 4010; Payload ID: 662 relates to Category No.: 2890, 6976, 2942; Payload ID: 663 relates to Category No.: 6717, 9247, 1377; Payload ID: 664 relates to Category No.: 9305, 2890, 2942; Payload ID: 665 relates to Category No.: 2942, 14826, 1046; Payload ID: 666 relates to Category No.: 9305, 2890, 9242, 2942, 9247, 9184; Payload ID: 667 relates to Category No.: 2942, 7118; Payload ID: 668 relates to Category No.: 2890, 10056, 2942, 4010; Payload ID: 669 relates to Category No.: 2890, 2942, 5561; Payload ID: 670 relates to Category No.: 5561, 1099, 447, 779; Payload ID: 671 relates to Category No.: 5561, 6717; Payload ID: 672 relates to Category No.: 5561, 6717, 10056, 1792; Payload ID: 673 relates to Category No.: 5561, 6717, 4008; Payload ID: 674 relates to Category No.: 5561, 6717, 10056, 5570, 1811, 11650; Payload ID: 675 relates to Category No.: 5561, 6717, 10056; Payload ID: 676 relates to Category No.: 5561, 6717, 10056; Payload ID: 677 relates to Category No.: 5561, 6717, 10056; Payload ID: 678 relates to Category No.: 5561, 6717; Payload ID: 679 relates to Category No.: 5561, 6717, 5570, 4008, 1772, 10056; Payload ID: 680 relates to Category No.: 5561, 6717, 10056, 14329, 6099; Payload ID: 681 relates to Category No.: 5561, 6717, 4029, 10056, 5565; Payload ID: 682 relates to Category No.: 4030, 5561, 6717, 10056, 5570, 4010, 4228; Payload ID: 683 relates to Category No.: 5561, 4029, 6717, 10056; Payload ID: 684 relates to Category No.: 5561, 6717; Payload ID: 685 relates to Category No.: 5561, 6717; Payload ID: 686 relates to Category No.: 5561, 6717; Payload ID: 687 relates to Category No.: 5561, 6717, 10056, 2926, 1792, 778; Payload ID: 688 relates to Category No.: 5561, 6717, 5762, 5570, 4010, 4483; Payload ID: 689 relates to Category No.: 5561, 6717, 5570, 4010, 1792, 779; Payload ID: 690 relates to Category No.: 5561, 6717, 10056; Payload ID: 691 relates to Category No.: 5561, 6717; Payload ID: 692 relates to Category No.: 5561, 6717; Payload ID: 693 relates to Category No.: 5561, 6717, 10056; Payload ID: 694 relates to Category No.: 5561, 6717; Payload ID: 695 relates to Category No.: 5561, 6717, 5762, 10056, 8935, 15139, 1748, 11723, 1017, 4860, 1700; Payload ID: 696 relates to Category No.: 5561, 6717, 10056; Payload ID: 697 relates to Category No.: 5561, 6717, 5570, 1811, 1017, 10056; Payload ID: 698 relates to Category No.: 5561, 6717, 10056, 2926; Payload ID: 699 relates to Category No.: 5561, 2890, 6717, 10056, 4010, 1792, 12406, 15139, 14953; Payload ID: 700 relates to Category No.: 5561, 16257, 3036, 1017, 9730, 8949; Payload ID: 701 relates to Category No.: 5561, 9305, 10056; Payload ID: 702 relates to Category No.: 5561; Payload ID: 703 relates to Category No.: 5561, 10056, 1182; Payload ID: 704 relates to Category No.: 9305, 2890, 6717, 10056, 5570, 9247, 11836; Payload ID: 705 relates to Category No.: 5561, 6717, 3666, 4010, 1792; Payload ID: 706 relates to Category No.: 2890; Payload ID: 707 relates to Category No.: 9305, 2890, 9247, 4010; Payload ID: 708 relates to Category No.: 5561, 9305, 2890; Payload ID: 709 relates to Category No.: 5561, 6717, 10056, 5823; Payload ID: 710 relates to Category No.: 5561, 10056, 5823; Payload ID: 711 relates to Category No.: 4030, 4029, 2574, 3666, 4010, 1792, 11883; Payload ID: 712 relates to Category No.: 9305, 1842; Payload ID: 713 relates to Category No.: 4029, 6717, 3666, 5561; Payload ID: 714 relates to Category No.: 2942, 5561; Payload ID: 716 relates to Category No.: 5762, 10056, 2942, 4765, 8935, 9734, 11650, 11653, 1750, 4010, 4228, 4755, 14364, 3652, 9754, 6059, 15573, 2664; Payload ID: 717 relates to Category No.: 5762, 4765, 9734, 4010, 4755; Payload ID: 718 relates to Category No.: 6717, 5762, 2942, 4755, 4010, 3055, 14329, 2890, 10056, 5561; Payload ID: 719 relates to Category No.: 5762, 4755, 9734, 4010, 2890, 10056; Payload ID: 720 relates to Category No.: 6717, 5762, 10056, 3693, 6994, 4755, 1720, 3636, 12440, 4010, 14327, 4228, 2514, 4201, 2890, 7366, 3521, 12439; Payload ID: 721 relates to Category No.: 2942, 4788, 15139, 8951, 4765; Payload ID: 722 relates to Category No.: 2890, 10056, 9242, 4765, 4755; Payload ID: 723 relates to Category No.: 2890, 6717, 2942, 4765, 4755; Payload ID: 724 relates to Category No.: 15573, 2890, 9242, 2942, 4765, 9247, 4755, 9734, 14664, 9181; Payload ID: 725 relates to Category No.: 12439, 6717, 6976, 2942, 4765, 2899, 9734, 1748, 15573, 2926, 3055, 915, 1044, 15133, 2890; Payload ID: 726 relates to Category No.: 2890, 2942, 4765, 15574; Payload ID: 727 relates to Category No.: 2890, 10056, 1720, 14327, 15574; Payload ID: 728 relates to Category No.: 5762, 4755, 15573, 6717; Payload ID: 729 relates to Category No.: 2890, 5762, 4765, 4755, 15573, 4010; Payload ID: 730 relates to Category No.: 5762; Payload ID: 731 relates to Category No.: 5762; Payload ID: 732 relates to Category No.: 5762; Payload ID: 733 relates to Category No.: 11728, 2458, 2446, 5762, 1046, 7244; Payload ID: 734 relates to Category No.: 5762, 2899; Payload ID: 735 relates to Category No.: 2890; Payload ID: 737 relates to Category No.: 5762, 4010; Payload ID: 738 relates to Category No.: 5762; Payload ID: 739 relates to Category No.: 5762, 4755; Payload ID: 740 relates to Category No.: 5762, 4755; Payload ID: 741 relates to Category No.: 9305, 5762, 2194, 2942, 7060, 4010, 7052, 6075; Payload ID: 742 relates to Category No.: 9305, 2194, 2942, 6994, 7060, 2458, 14893, 7052; Payload ID: 743 relates to Category No.: 9305, 5762, 2194, 4765, 6994, 4755, 2901, 11728, 14902, 4010, 9998; Payload ID: 744 relates to Category No.: 9305, 2890, 6717, 5762, 10056, 9242; Payload ID: 745 relates to Category No.: 9305, 2890, 5762, 10056, 4199; Payload ID: 746 relates to Category No.: 2890, 6717, 5762, 10056, 9242, 9305; Payload ID: 747 relates to Category No.: 5762; Payload ID: 748 relates to Category No.: 5762; Payload ID: 749 relates to Category No.: 5762; Payload ID: 750 relates to Category No.: 2890, 6717, 5762, 10056, 6722, 11728, 2458, 1107, 4010, 1046, 2446, 1044, 2942; Payload ID: 751 relates to Category No.: 5561, 6717, 14394, 2890, 2942; Payload ID: 752 relates to Category No.: 9305, 9242, 9215; Payload ID: 753 relates to Category No.: 5561, 6717, 3673, 3666, 4010; Payload ID: 754 relates to Category No.: 5561; Payload ID: 755 relates to Category No.: 2890, 6717, 5762, 6994, 4010, 14903, 6060, 6440; Payload ID: 756 relates to Category No.: 2890, 6717, 5762, 6994, 4010, 14903, 6060, 6440; Payload ID: 757 relates to Category No.: 5762; Payload ID: 759 relates to Category No.: 9247, 7060, 2890, 9305, 7118; Payload ID: 760 relates to Category No.: 10056, 5570, 14371, 1792, 677; Payload ID: 761 relates to Category No.: 677, 5570, 4010; Payload ID: 762 relates to Category No.: 6717, 10056, 677; Payload ID: 763 relates to Category No.: 4029, 6717; Payload ID: 764 relates to Category No.: 2890, 6717, 10056, 2942, 11728; Payload ID: 766 relates to Category No.: 5561, 9305, 10056, 2942, 5570, 9184, 6717, 16326, 15758; Payload ID: 767 relates to Category No.: 5561, 9305, 10056, 2942, 5570, 9184; Payload ID: 768 relates to Category No.:

5561, 10056, 2942, 5570; Payload ID: 769 relates to Category No.: 5561, 2890, 10056, 5570, 1099, 12406, 15139; Payload ID: 770 relates to Category No.: 5561, 10056, 5762; Payload ID: 771 relates to Category No.: 5561, 10056, 2890, 5570, 3693, 1017, 1033; Payload ID: 772 relates to Category No.: 5561, 10056, 5570, 3521, 6717; Payload ID: 773 relates to Category No.: 5561, 6443, 10056, 5570, 12406, 9305, 6717, 779, 2890, 3693, 3036, 5776, 1017, 3055, 8949, 14363; Payload ID: 774 relates to Category No.: 5561, 10056, 5570, 12406, 6717, 9305; Payload ID: 775 relates to Category No.: 9218, 9305, 2890, 9247, 2420, 15269, 9158, 15269, 15272; Payload ID: 776 relates to Category No.: 4030, 4029, 2890, 2942; Payload ID: 777 relates to Category No.: 4029; Payload ID: 778 relates to Category No.: 4029; Payload ID: 779 relates to Category No.: 10056, 5570, 5561; Payload ID: 780 relates to Category No.: 2890, 8935, 273, 1017, 1774; Payload ID: 781 relates to Category No.: 4030, 9305, 2890, 4014, 4010; Payload ID: 782 relates to Category No.: 9247, 3861, 9305; Payload ID: 787 relates to Category No.: 15497, 9305; Payload ID: 788 relates to Category No.: 9215; Payload ID: 789 relates to Category No.: 9305, 2890, 9247; Payload ID: 790 relates to Category No.: 9305, 7118, 9242, 9247, 15497, 15532; Payload ID: 791 relates to Category No.: 4030, 4029, 1239, 4010; Payload ID: 792 relates to Category No.: 5561, 7118, 6717, 7048; Payload ID: 793 relates to Category No.: 9305, 2890, 5776, 2942, 9247, 4755, 763; Payload ID: 794 relates to Category No.: 7118, 10000; Payload ID: 795 relates to Category No.: 12159, 1090; Payload ID: 796 relates to Category No.: 7118, 4010; Payload ID: 797 relates to Category No.: 4030, 4029, 4010, 4763, 8948; Payload ID: 798 relates to Category No.: 4030, 4029; Payload ID: 799 relates to Category No.: 5561, 4029, 2890, 10056, 4014, 15139, 1748, 4010, 4763, 1083, 6437, 1792, 1090; Payload ID: 800 relates to Category No.: 2890, 2942, 3666, 4010; Payload ID: 802 relates to Category No.: 9305, 2890, 6717, 10056, 2942, 273, 14363, 4010, 6743, 4228, 6440, 16156, 15758, 2738, 1810; Payload ID: 803 relates to Category No.: 9305, 2890, 10056, 14363, 2927, 16326, 15758, 2738; Payload ID: 806 relates to Category No.: 9305, 6976, 10056, 2942, 1811, 2903, 6017, 4228, 15505; Payload ID: 807 relates to Category No.: 9305, 9247, 9184; Payload ID: 808 relates to Category No.: 9305, 15531; Payload ID: 809 relates to Category No.: 2890; Payload ID: 810 relates to Category No.: 2890, 10056, 9242, 4755, 5257, 4172; Payload ID: 811 relates to Category No.: 2890, 2942, 9247, 15465, 9305, 11883; Payload ID: 813 relates to Category No.: 5561, 7048, 7095; Payload ID: 814 relates to Category No.: 5561; Payload ID: 821 relates to Category No.: 5561; Payload ID: 833 relates to Category No.: 5561; Payload ID: 837 relates to Category No.: 5561; Payload ID: 838 relates to Category No.: 3964, 3954, 3955; Payload ID: 839 relates to Category No.: 3964, 3954, 3955; Payload ID: 843 relates to Category No.: 5561; Payload ID: 853 relates to Category No.: 5561; Payload ID: 859 relates to Category No.: 7060, 9756, 9753; Payload ID: 860 relates to Category No.: 7118, 7060; Payload ID: 861 relates to Category No.: 4030, 2942, 5570, 4010, 6440, 3685, 4008, 16164, 16163, 5561; Payload ID: 862 relates to Category No.: 2890, 6717, 2942, 4010; Payload ID: 863 relates to Category No.: 7118, 2890; Payload ID: 864 relates to Category No.: 9305, 2890; Payload ID: 865 relates to Category No.: 4030, 4029, 9305, 1239, 4010, 11883, 10077, 2890, 7366, 1090; Payload ID: 866 relates to Category No.: 2942; Payload ID: 867 relates to Category No.: 2942; Payload ID: 868 relates to Category No.: 2942; Payload ID: 869 relates to Category No.: 2942; Payload ID: 870 relates to Category No.: 2942, 4010, 7118; Payload ID: 871 relates to Category No.: 2942, 4010; Payload ID: 872 relates to Category No.: 4029, 2942, 5762; Payload ID: 873 relates to Category No.: 7118, 7060; Payload ID: 874 relates to Category No.: 2890, 2942, 4010; Payload ID: 875 relates to Category No.: 2890, 2942, 9734; Payload ID: 876 relates to Category No.: 2890, 2942, 4010; Payload ID: 877 relates to Category No.: 7118, 5776, 9247, 7060; Payload ID: 878 relates to Category No.: 2890, 4010, 7118; Payload ID: 879 relates to Category No.: 7118, 2890, 4010; Payload ID: 880 relates to Category No.: 6717, 4010; Payload ID: 881 relates to Category No.: 7118, 2890, 7048; Payload ID: 882 relates to Category No.: 7060, 4010; Payload ID: 883 relates to Category No.: 2890, 5776, 9247, 10056, 4030, 2942, 3666, 5561; Payload ID: 884 relates to Category No.: 5776, 3673, 9756, 4010, 5561, 3666, 7048, 7118, 9305, 2942, 4044; Payload ID: 885 relates to Category No.: 2890, 10056, 4010, 16156, 2942; Payload ID: 887 relates to Category No.: 7060, 7118; Payload ID: 888 relates to Category No.: 7118, 7060; Payload ID: 889 relates to Category No.: 7118, 9247, 7060, 4010; Payload ID: 890 relates to Category No.: 9305, 7118, 2890, 2942, 7060, 4010; Payload ID: 891 relates to Category No.: 5762, 2942, 4010; Payload ID: 892 relates to Category No.: 2890, 2942, 4010, 7118; Payload ID: 893 relates to Category No.: 2890, 2942, 4010; Payload ID: 894 relates to Category No.: 4030, 2942, 4010, 779; Payload ID: 895 relates to Category No.: 2890, 2942, 9247, 4010, 4030, 9734, 9574, 6617, 14387, 1776, 14384; Payload ID: 896 relates to Category No.: 6443, 2942, 4010; Payload ID: 897 relates to Category No.: 7118, 2942, 7060; Payload ID: 898 relates to Category No.: 2942, 4010; Payload ID: 899 relates to Category No.: 2890; Payload ID: 900 relates to Category No.: 9305, 2890, 5762, 2942, 4010; Payload ID: 902 relates to Category No.: 2890, 2942, 4010; Payload ID: 903 relates to Category No.: 2942, 4010; Payload ID: 904 relates to Category No.: 2890, 4010; Payload ID: 905 relates to Category No.: 2942, 4755, 4010, 7118; Payload ID: 906 relates to Category No.: 2942, 4010; Payload ID: 907 relates to Category No.: 2942, 4010; Payload ID: 908 relates to Category No.: 4030, 4029, 9305, 6717, 2942, 273, 4010, 6449, 5342, 10077; Payload ID: 909 relates to Category No.: 6976, 2942, 4010, 2182, 9305, 2890, 10056, 5776, 6443, 14295, 9734, 14685; Payload ID: 910 relates to Category No.: 2938, 2942, 4010, 7118; Payload ID: 911 relates to Category No.: 5561, 6717, 3673, 3666; Payload ID: 912 relates to Category No.: 3666; Payload ID: 914 relates to Category No.: 5561, 3673; Payload ID: 915 relates to Category No.: 5561, 10056, 3673; Payload ID: 916 relates to Category No.: 5561, 6717, 3673; Payload ID: 917 relates to Category No.: 5561, 6717, 3673, 3666; Payload ID: 918 relates to Category No.: 3673; Payload ID: 919 relates to Category No.: 3673, 5557, 15951; Payload ID: 920 relates to Category No.: 5561, 9305, 2890, 6717, 3673, 9734; Payload ID: 921 relates to Category No.: 5561, 3666, 3673; Payload ID: 922 relates to Category No.: 5561, 6717, 3673; Payload ID: 923 relates to Category No.: 5561, 6717, 3673; Payload ID: 924 relates to Category No.: 5561, 3673; Payload ID: 925 relates to Category No.: 5561, 6717, 3673; Payload ID: 926 relates to Category No.: 5561, 3673, 3666; Payload ID: 927 relates to Category No.: 5561, 4765, 4755, 5559; Payload ID: 928 relates to Category No.: 5561, 3673, 5559, 5557; Payload ID: 929 relates to Category No.: 5561, 10056, 677; Payload ID: 930 relates to Category No.: 5561, 6717, 10056, 677, 4010, 12159, 4026, 4030; Payload ID: 931 relates to Category No.: 5561, 10056, 677, 1792; Payload ID: 932 relates to Category No.: 10056, 677; Payload ID: 933 relates to Category No.: 9305, 7118; Payload ID: 934 relates to Category No.: 9305, 9247, 6968;

Payload ID: 935 relates to Category No.: 9305, 7118, 2890, 9247; Payload ID: 936 relates to Category No.: 9305, 2890, 6994, 2650; Payload ID: 937 relates to Category No.: 9305, 9215; Payload ID: 938 relates to Category No.: 9305, 2890; Payload ID: 939 relates to Category No.: 7060, 7118; Payload ID: 940 relates to Category No.: 9305, 2942, 9247, 6968; Payload ID: 941 relates to Category No.: 5561, 3673, 3666; Payload ID: 942 relates to Category No.: 7118, 6717, 5776, 9242, 9756, 9754, 9753; Payload ID: 944 relates to Category No.: 9305, 2890, 2942, 9734, 276, 6017, 9773, 14329; Payload ID: 945 relates to Category No.: 2890, 273, 276, 4010, 4228, 14329, 11883; Payload ID: 946 relates to Category No.: 5561, 10056, 9734, 9162, 6440; Payload ID: 947 relates to Category No.: 5561, 6717, 4755, 16156; Payload ID: 948 relates to Category No.: 6717, 5559, 4010; Payload ID: 949 relates to Category No.: 2890, 2942, 9247; Payload ID: 950 relates to Category No.: 4995; Payload ID: 951 relates to Category No.: 9305, 9247, 9172, 10104, 15266, 15127, 9158, 5029; Payload ID: 952 relates to Category No.: 6960, 2942, 2534, 1017, 4228, 7161; Payload ID: 953 relates to Category No.: 5561, 6717, 4765; Payload ID: 954 relates to Category No.: 4030, 4029, 1239, 4010; Payload ID: 955 relates to Category No.: 4030, 4029, 10056, 1239, 4010, 5776, 1792; Payload ID: 956 relates to Category No.: 4030, 4029, 9305, 10056, 6934, 4010; Payload ID: 957 relates to Category No.: 4030, 4029, 1239, 4010; Payload ID: 958 relates to Category No.: 4030, 4029, 2942, 1239, 4010, 10077; Payload ID: 959 relates to Category No.: 4030, 4029, 4010; Payload ID: 961 relates to Category No.: 4030, 2890; Payload ID: 963 relates to Category No.: 9247; Payload ID: 964 relates to Category No.: 9305; Payload ID: 965 relates to Category No.: 7118, 2890, 9756, 9753; Payload ID: 966 relates to Category No.: 1842; Payload ID: 967 relates to Category No.: 2890; Payload ID: 968 relates to Category No.: 2194, 2183, 2441; Payload ID: 969 relates to Category No.: 5776, 10056, 9247, 3652, 1842, 3686, 2942, 9734, 4049, 16164, 2918; Payload ID: 970 relates to Category No.: 9305, 9247, 4755, 15505; Payload ID: 971 relates to Category No.: 9305; Payload ID: 972 relates to Category No.: 9305, 15505; Payload ID: 973 relates to Category No.: 9305, 5776, 9247; Payload ID: 974 relates to Category No.: 12159; Payload ID: 975 relates to Category No.: 12159, 1792; Payload ID: 976 relates to Category No.: 12159, 4014; Payload ID: 977 relates to Category No.: 12159, 1811, 1083; Payload ID: 978 relates to Category No.: 2890, 2942; Payload ID: 979 relates to Category No.: 9305; Payload ID: 980 relates to Category No.: 4030, 10056, 1182, 9756, 4010; Payload ID: 981 relates to Category No.: 2890, 10056; Payload ID: 982 relates to Category No.: 5561, 2890, 10056, 3666, 4755, 3521, 1792, 6989; Payload ID: 983 relates to Category No.: 2942, 4030, 9305, 2890, 6717, 3666, 15627, 4755, 1792, 633; Payload ID: 984 relates to Category No.: 9305, 6717, 2942; Payload ID: 985 relates to Category No.: 2890, 2942, 4010; Payload ID: 986 relates to Category No.: 2942, 4010, 779, 2890, 6717; Payload ID: 987 relates to Category No.: 7060, 7118; Payload ID: 989 relates to Category No.: 2942, 4010; Payload ID: 990 relates to Category No.: 7118, 5776, 7060; Payload ID: 991 relates to Category No.: 2942, 4010; Payload ID: 992 relates to Category No.: 9305, 2942, 4010, 4030; Payload ID: 993 relates to Category No.: 7118, 7060; Payload ID: 994 relates to Category No.: 9305, 2942, 4010; Payload ID: 995 relates to Category No.: 9305, 2890, 5762; Payload ID: 996 relates to Category No.: 9305; Payload ID: 998 relates to Category No.: 4030, 5561, 10056, 3636, 4010, 3696, 779, 778; Payload ID: 999 relates to Category No.: 2890, 15151, 273, 1748, 15161, 6099; Payload ID: 1000 relates to Category No.: 4030, 5561, 4765, 3673, 1792, 3832, 3686, 2890, 9305, 5762; Payload ID: 1001 relates to Category No.: 4030, 4010; Payload ID: 1002 relates to Category No.: 4030, 4010; Payload ID: 1003 relates to Category No.: 4030, 4010; Payload ID: 1004 relates to Category No.: 4030, 4029, 4010; Payload ID: 1005 relates to Category No.: 4010; Payload ID: 1006 relates to Category No.: 9305, 2890, 2942, 9247, 5883, 5412, 14368; Payload ID: 1007 relates to Category No.: 4030, 5561, 4029, 2890, 5776, 10056, 2942, 5570, 3693, 15139, 4755, 9734, 3054, 2534, 1017, 4010, 1792, 6743, 3055, 12406, 3695, 15574, 10077, 9164, 2926, 1811, 6717, 8935, 8917, 778, 3831, 14903, 14683, 2454, 15280, 4860, 14293, 6484, 4862, 911, 4861; Payload ID: 1008 relates to Category No.: 15151; Payload ID: 1010 relates to Category No.: 9734; Payload ID: 1011 relates to Category No.: 9305, 2890, 10056, 9247, 15139, 6017, 4860, 9215, 11653, 11883, 3055, 8948, 9734, 11723, 6484, 4862, 4861; Payload ID: 1012 relates to Category No.: 2938, 2942, 6017, 4228, 10056, 15206; Payload ID: 1013 relates to Category No.: 9305, 2890, 6717, 15139, 6017, 4860; Payload ID: 1014 relates to Category No.: 9305, 2890, 273; Payload ID: 1015 relates to Category No.: 5561, 10056, 9734, 1090; Payload ID: 1016 relates to Category No.: 5561, 9305, 6717, 10056, 4010; Payload ID: 1017 relates to Category No.: 9305, 2890, 6960, 2927, 6964; Payload ID: 1018 relates to Category No.: 4030, 4029, 9305, 4014, 1239, 4010; Payload ID: 1019 relates to Category No.: 2194, 2942, 3036, 3521, 6017, 4860, 14327, 11883, 16156, 2890, 11650, 3055, 6717, 5776, 1017, 8935, 8948; Payload ID: 1021 relates to Category No.: 1842, 2890, 9472, 14825, 14826; Payload ID: 1022 relates to Category No.: 668, 2942, 9247, 9305; Payload ID: 1023 relates to Category No.: 2942, 668, 9247, 2890; Payload ID: 1024 relates to Category No.: 9242, 2942, 668, 9247; Payload ID: 1025 relates to Category No.: 668; Payload ID: 1026 relates to Category No.: 668, 5762; Payload ID: 1027 relates to Category No.: 2890, 668; Payload ID: 1028 relates to Category No.: 2942, 668, 9247, 9305; Payload ID: 1029 relates to Category No.: 9305, 2942, 668, 9247; Payload ID: 1030 relates to Category No.: 9305, 2942, 668, 9247; Payload ID: 1031 relates to Category No.: 9305, 2942, 668, 9247; Payload ID: 1032 relates to Category No.: 6717, 5762, 5570, 4010, 11883, 5561; Payload ID: 1033 relates to Category No.: 6717, 5557, 4010, 5279; Payload ID: 1034 relates to Category No.: 9305, 10056, 2890, 2942, 9247, 9157, 11883; Payload ID: 1035 relates to Category No.: 5561, 10056; Payload ID: 1036 relates to Category No.: 5561; Payload ID: 1037 relates to Category No.: 2890, 5762; Payload ID: 1038 relates to Category No.: 9305, 2942, 2477, 3666, 9734; Payload ID: 1039 relates to Category No.: 2890, 1377; Payload ID: 1040 relates to Category No.: 2890, 10056, 1792; Payload ID: 1041 relates to Category No.: 4029, 2890, 9734; Payload ID: 1042 relates to Category No.: 4030, 4029, 9305, 9242, 8948, 4860, 4010, 1083, 693; Payload ID: 1043 relates to Category No.: 5561, 2890, 2942, 1182, 2660, 3636, 276, 4008, 6017, 14327, 1792, 14999, 2926; Payload ID: 1044 relates to Category No.: 2890, 2942, 1182, 1748, 2660, 6017, 2926, 779; Payload ID: 1045 relates to Category No.: 12439, 2942, 1182, 2926, 779; Payload ID: 1046 relates to Category No.: 4030, 4029, 5762, 10056, 4010, 6989, 6743; Payload ID: 1047 relates to Category No.: 4030, 4029, 9305, 10056, 1774; Payload ID: 1048 relates to Category No.: 4030, 4029; Payload ID: 1049 relates to Category No.: 4030, 4010; Payload ID: 1050 relates to Category No.: 4030, 4010; Payload ID: 1051 relates to Category No.: 4030, 1792, 4755, 3521; Payload ID: 1052 relates to Category No.: 4030, 4029, 12159, 1239; Payload ID: 1053 relates to Category No.: 4029; Payload ID: 1054 relates to Category No.: 4010, 14409; Payload ID: 1055 relates to Category No.: 4029; Payload ID: 1056 relates to Category No.: 6717, 4030, 5561, 6443, 4029, 10056, 3693, 4008, 4010; Payload ID: 1057 relates to Category No.: 4030, 5561, 4029, 2890, 6717, 10056, 4010, 1792, 6743; Payload ID: 1058 relates to Category No.: 5561, 5762, 10056, 2942, 5570; Payload ID: 1059 relates to Category No.: 5561, 4029, 10056, 5570, 9734; Payload ID: 1060 relates to Category No.: 5561, 2890, 5776, 4765, 3673, 9247, 2927, 10056, 1720; Payload ID: 1061 relates to Category No.: 4030, 4029, 1239, 4010, 2890; Payload ID: 1062 relates to Category No.: 5776, 9247, 273, 376; Payload ID: 1063 relates to Category No.: 5561, 10056, 5570, 9478; Payload ID: 1065 relates to Category No.: 2938, 10056, 2942, 1099, 14368, 6449, 14813, 9305, 11653, 8935, 16326, 14363, 196, 1016; Payload ID: 1066 relates to Category No.: 5762, 2938, 10056, 2942, 14363, 11653, 1099, 6449, 779, 16326, 15758, 196, 2738, 5596, 2890, 5570, 9734, 8951, 6743, 8935; Payload ID: 1067 relates to Category No.: 6443, 10056, 1182, 3666, 4755, 14363, 11653, 1099, 1792, 6075, 1085, 15758, 9087, 1029, 2738, 5596, 14813, 6717, 15139, 1017, 9577; Payload ID: 1068 relates to Category No.: 5561, 2890, 1803; Payload ID: 1069 relates to Category No.: 2890, 10056, 9242; Payload ID: 1070 relates to Category No.: 9305, 9247, 1842; Payload ID: 1074 relates to Category No.: 6717, 3521, 14100, 4010, 3696, 6440, 6475; Payload ID: 1075 relates to Category No.: 2890, 15892; Payload ID: 1076 relates to Category No.: 2890; Payload ID: 1078 relates to Category No.: 5561; Payload ID: 1079 relates to Category No.: 6717, 3673, 5557; Payload ID: 1081 relates to Category No.: 2458; Payload ID: 1082 relates to Category No.: 5762; Payload ID: 1083 relates to Category No.: 9305, 2890; Payload ID: 1084 relates to Category No.: 5762, 5561; Payload ID: 1085 relates to Category No.: 5762; Payload ID: 1086 relates to Category No.: 5762; Payload ID: 1087 relates to Category No.: 5762; Payload ID: 1088 relates to Category No.: 5762; Payload ID: 1089 relates to Category No.: 5762; Payload ID: 1090 relates to Category No.: 5762; Payload ID: 1091 relates to Category No.: 5762, 5561; Payload ID: 1092 relates to Category No.: 5762, 2790; Payload ID: 1093 relates to Category No.: 5762; Payload ID: 1094 relates to Category No.: 2785, 2790; Payload ID: 1095 relates to Category No.: 5762; Payload ID: 1096 relates to Category No.: 2890, 5762; Payload ID: 1097 relates to Category No.: 5762; Payload ID: 1098 relates to Category No.: 2890; Payload ID: 1099 relates to Category No.: 7118; Payload ID: 1100 relates to Category No.: 2890, 8935, 9247; Payload ID: 1101 relates to Category No.: 2890, 1748, 11650, 11653, 3055, 1377; Payload ID: 1103 relates to Category No.: 3673, 10056; Payload ID: 1104 relates to Category No.: 2890, 2458; Payload ID: 1106 relates to Category No.: 6717, 1690; Payload ID: 1107 relates to Category No.: 9305, 2890, 9242, 2942, 9247, 14364, 5342, 15505, 7389; Payload ID: 1109 relates to Category No.: 9305, 2890, 10056, 9247; Payload ID: 1110 relates to Category No.: 2890, 9247; Payload ID: 1111 relates to Category No.: 10056, 6059; Payload ID: 1112 relates to Category No.: 10056, 6059; Payload ID: 1113 relates to Category No.: 5776, 10056, 3521, 6059; Payload ID: 1114 relates to Category No.: 3673, 3666, 9734; Payload ID: 1116 relates to Category No.: 9305, 2890, 6717, 2402; Payload ID: 1119 relates to Category No.: 14364, 5776, 9305, 2942, 5342, 10104, 3952, 2890, 7389; Payload ID: 1120 relates to Category No.: 10056; Payload ID: 1125 relates to Category No.: 2890, 9247, 273, 9305, 7389, 5596; Payload ID: 1126 relates to Category No.: 9305; Payload ID: 1127 relates to Category No.: 2194; Payload ID: 1128 relates to Category No.: 6443, 2890, 6717, 10056, 8935, 15627, 2927, 3521, 6709, 6059, 15764; Payload ID: 1129 relates to Category No.: 2942, 4765, 9247; Payload ID: 1130 relates to Category No.: 5561; Payload ID: 1131 relates to Category No.: 9305; Payload ID: 1132 relates to Category No.: 1842; Payload ID: 1135 relates to Category No.: 9305, 2942; Payload ID: 1137 relates to Category No.: 2890; Payload ID: 1138 relates to Category No.: 9305, 2890; Payload ID: 1144 relates to Category No.: 9305, 2890; Payload ID: 1145 relates to Category No.: 1842; Payload ID: 1146 relates to Category No.: 1842; Payload ID: 1147 relates to Category No.: 14174; Payload ID: 1149 relates to Category No.: 1842; Payload ID: 1150 relates to Category No.: 5561; Payload ID: 1151 relates to Category No.: 9305; Payload ID: 1152 relates to Category No.: 3693; Payload ID: 1155 relates to Category No.: 9305, 2890, 6994; Payload ID: 1157 relates to Category No.: 9305, 2890; Payload ID: 1166 relates to Category No.: 9305, 6717, 2938, 2942, 2890; Payload ID: 1167 relates to Category No.: 2890, 10014; Payload ID: 1169 relates to Category No.: 4030, 4029, 9305, 2890, 4045, 10056, 3693, 1099, 7244, 4049, 4010, 1792, 4228, 3523, 2701, 779, 16156, 6075, 4046, 14363, 11883, 7061, 6617; Payload ID: 1170 relates to Category No.: 7118; Payload ID: 1171 relates to Category No.: 2890, 6717, 9247, 6994, 14893, 4010, 6709, 14802, 1050, 9162, 9774; Payload ID: 1172 relates to Category No.: 4030, 10056, 9247, 1099, 3985, 4010, 6743, 779; Payload ID: 1173 relates to Category No.: 4030, 9305, 6717, 10056, 4014, 3693, 6994, 1099, 6222, 4010, 1090, 6060, 1792, 6743, 6709, 6440, 16156, 9606, 2890, 2942, 14363, 3521, 4053, 14384, 7368, 11883, 9734, 14327, 1720, 6475; Payload ID: 1175 relates to Category No.: 2890, 6717, 10056, 4010, 9776, 14802, 3036, 1017, 8948; Payload ID: 1176 relates to Category No.: 9305, 2890, 10056, 9734, 4010, 9184, 1792, 16164; Payload ID: 1177 relates to Category No.: 2890, 6717, 5762, 4010, 4228, 4008, 3717, 9305, 2942, 4030, 10056, 3036, 3666, 15151, 1774, 8948, 1033, 16326, 14363, 9730, 5596; Payload ID: 1178 relates to Category No.: 6717, 4010, 6060, 4228, 6709, 6440, 9734, 7118, 9305, 2890, 11883, 779, 14363, 5596; Payload ID: 1179 relates to Category No.: 9305, 6717, 3673, 4010, 2401, 2942, 10056, 9162, 16156; Payload ID: 1180 relates to Category No.: 10056, 2942, 6060; Payload ID: 1181 relates to Category No.: 4010; Payload ID: 1182 relates to Category No.: 2942, 4010, 1792; Payload ID: 1183 relates to Category No.: 2890, 10056, 2324, 4010, 779, 4008, 5561; Payload ID: 1184 relates to Category No.: 5561, 6717, 5762, 10056; Payload ID: 1185 relates to Category No.: 10056, 9247, 2324, 9098, 5561; Payload ID: 1186 relates to Category No.: 5561, 10056; Payload ID: 1187 relates to Category No.: 5561, 5762, 10056; Payload ID: 1188 relates to Category No.: 5561, 5762, 10056, 3673, 16156; Payload ID: 1189 relates to Category No.: 6717, 5762, 10056, 2324, 4010, 1792; Payload ID: 1190 relates to Category No.: 5561, 5762, 10056, 2942, 3666, 1748, 9305; Payload ID: 1191 relates to Category No.: 5561, 10056, 5762; Payload ID: 1192 relates to Category No.: 5561, 10056, 5762; Payload ID: 1193 relates to Category No.: 9305; Payload ID: 1194 relates to Category No.: 4030, 4029, 10056, 12159; Payload ID: 1196 relates to Category No.: 4030, 3666, 7118; Payload ID: 1197 relates to Category No.: 3666, 1842; Payload ID: 1198 relates to Category No.: 5561, 10056, 4010, 3696, 1792, 4201, 6019; Payload ID: 1199 relates to Category No.: 5561, 4029, 10056, 3673, 3696, 4008, 1792; Payload ID: 1200 relates to Category No.: 5561; Payload ID: 1201 relates to Category No.: 4030, 4029, 5570, 4010, 1792, 678; Payload ID: 1202 relates to Category No.: 4029, 2890, 4030; Payload ID: 1203 relates to Category No.: 6717, 5570, 5561; Payload ID: 1204 relates to Category No.: 2942; Payload ID: 1205 relates to Category No.: 9305, 9247, 9157, 11883; Payload ID: 1206 relates to Category No.: 9305, 9247, 9157, 11883, 2402; Payload ID: 1207 relates to Category No.: 9305, 2890, 2942; Payload ID: 1208 relates to Category No.: 9305, 2890, 2942, 2477, 15627, 9734, 3036, 15573, 1017, 9730, 2926, 3686, 4838, 7118; Payload ID: 1210 relates to Category No.: 5561, 10056; Payload ID: 1212 relates to Category No.: 5561; Payload ID: 1215 relates to Category No.: 5561, 5570; Payload ID: 1218 relates to Category No.: 7095; Payload ID: 1221 relates to Category No.: 5561, 7041, 7118; Payload ID: 1223 relates to Category No.: 9305; Payload ID: 1224 relates to Category No.: 5561; Payload ID: 1227 relates to Category No.: 2534, 1750, 2504, 15280, 4053; Payload ID: 1228 relates to Category No.: 2890; Payload ID: 1229 relates to Category No.: 9305, 10056, 2942; Payload ID: 1230 relates to Category No.: 10056; Payload ID: 1231 relates to Category No.: 10056; Payload ID: 1232 relates to Category No.: 4030, 4029, 9734; Payload ID: 1233 relates to Category No.: 5561, 10056, 5570, 6717; Payload ID: 1234 relates to Category No.: 4030, 4029; Payload ID: 1235 relates to Category No.: 9305, 5762, 5776, 9242, 7048, 7118; Payload ID: 1236 relates to Category No.: 9305, 14174, 7118, 2890, 5762, 2194, 9242, 3666, 9247, 9734, 9215, 15505; Payload ID: 1237 relates to Category No.: 5561, 6717, 10056, 3673, 5570, 3666, 4755, 4760; Payload ID: 1238 relates to Category No.: 5561, 10056, 15627; Payload ID: 1239 relates to Category No.: 4029; Payload ID: 1240 relates to Category No.: 2890, 3666, 9247, 786, 9305; Payload ID: 1241 relates to Category No.: 2434; Payload ID: 1242 relates to Category No.: 4030, 2434, 4029, 10056, 2942, 5059, 3521, 3636, 1239, 4010, 2926, 3671, 4032, 16149, 14852, 3637, 14411, 9305, 1792, 3289; Payload ID: 1243 relates to Category No.: 7118, 2890, 5776, 9247, 4030, 4029, 4010, 9305, 2458, 2942, 1711; Payload ID: 1244 relates to Category No.: 2434, 4029, 2942, 5059, 3521, 1239, 4010, 3671, 16149, 14852, 4030; Payload ID: 1245 relates to Category No.: 4030, 2434, 4029, 2942, 5059, 3521, 1239, 4010, 1792, 3671, 16149; Payload ID: 1246 relates to Category No.: 4030, 2434, 4029, 5059, 1239, 16149; Payload ID: 1247 relates to Category No.: 4030, 2434, 4029, 2890, 5776, 10056, 2942, 3673, 273, 4755, 8948, 3521, 4010, 3696, 3671, 3695, 16149, 2503, 6333, 3637, 5737, 6640, 2437, 3666, 16164, 16163; Payload ID: 1248 relates to Category No.: 2890, 9247; Payload ID: 1250 relates to Category No.: 9305, 2890, 9247; Payload ID: 1251 relates to Category No.: 9305; Payload ID: 1252 relates to Category No.: 9305, 2890; Payload ID: 1253 relates to Category No.: 2890, 2903; Payload ID: 1254 relates to Category No.: 2890, 14145, 2903, 786; Payload ID: 1255 relates to Category No.: 2890, 2942, 14145, 2903, 786; Payload ID: 1256 relates to Category No.: 9305, 2890, 2903; Payload ID: 1258 relates to Category No.: 2434, 6717, 10056, 16149, 6333; Payload ID: 1259 relates to Category No.: 2434, 4029, 3666, 5059, 4010, 16149; Payload ID: 1260 relates to Category No.: 2434, 4030, 4029, 3521, 4010, 16149, 6333, 14852, 5737; Payload ID: 1261 relates to Category No.: 4029, 4030, 2434, 3521, 4010, 16149, 14852, 5737, 1700; Payload ID: 1262 relates to Category No.: 5059, 16149; Payload ID: 1263 relates to Category No.: 4030, 4029, 3666, 9734, 8948, 3036, 4010, 2949, 5762; Payload ID: 1264 relates to Category No.: 4030, 2434, 4029, 9305, 2890, 6717, 10056, 4014, 3666, 4755, 8948, 3036, 5059, 3521, 1239, 4010, 4032, 16149, 6333, 3637, 5737; Payload ID: 1265 relates to Category No.: 4029, 5059, 6333; Payload ID: 1266 relates to Category No.: 4030, 2434, 4014, 5059, 4010, 1792, 16149, 10056; Payload ID: 1267 relates to Category No.: 5561, 4029, 10056; Payload ID: 1268 relates to Category No.: 4030, 4029, 5819, 5059, 1239, 16149; Payload ID: 1269 relates to Category No.: 4029, 6717, 3673, 5561; Payload ID: 1270 relates to Category No.: 4029, 2890, 6717; Payload ID: 1271 relates to Category No.: 4030, 4029, 1842; Payload ID: 1272 relates to Category No.: 4029, 2890, 1842; Payload ID: 1273 relates to Category No.: 4029, 2890; Payload ID: 1274 relates to Category No.: 4029, 5570, 5059, 4010, 16149, 6333, 3289, 14852; Payload ID: 1275 relates to Category No.: 4030, 4029, 7118, 4765, 3673, 5059, 16149, 5562, 6333, 6947, 5561; Payload ID: 1276 relates to Category No.: 7118, 6947, 7048; Payload ID: 1277 relates to Category No.: 7118; Payload ID: 1278 relates to Category No.: 9305, 2890, 2194, 9242, 4228; Payload ID: 1279 relates to Category No.: 9305, 9242, 9247, 9184; Payload ID: 1280 relates to Category No.: 9305, 2890, 6717, 9247, 14912; Payload ID: 1281 relates to Category No.: 2942, 5561; Payload ID: 1282 relates to Category No.: 6717, 5762, 3652; Payload ID: 1283 relates to Category No.: 5561, 9734, 3666, 12439, 1036; Payload ID: 1284 relates to Category No.: 1700, 9305, 7118, 7048, 2942, 9734, 7052, 2890; Payload ID: 1285 relates to Category No.: 4030, 5561, 7118, 2890, 2942, 7070, 6222; Payload ID: 1286 relates to Category No.: 7118, 7048, 3666; Payload ID: 1287 relates to Category No.: 2942, 9247, 2630, 4081, 4080; Payload ID: 1288 relates to Category No.: 2890, 10056, 9247, 9305, 2942, 3991, 9215, 871, 9242; Payload ID: 1289 relates to Category No.: 2942, 4010, 789, 9305; Payload ID: 1290 relates to Category No.: 9305, 2890, 9242, 9247, 2402, 9157; Payload ID: 1291 relates to Category No.: 9305, 2942, 9247, 14614, 5561; Payload ID: 1292 relates to Category No.: 9305, 2890, 6717, 10056, 5570, 14363, 1099, 4010, 9184, 1335, 779, 1336, 1085, 778, 15131, 15132, 5561, 1017, 8935, 1033, 8949; Payload ID: 1293 relates to Category No.: 6717, 10056, 5570; Payload ID: 1294 relates to Category No.: 5561, 6717, 10056, 1792, 2942, 3036; Payload ID: 1295 relates to Category No.: 5561, 6717; Payload ID: 1296 relates to Category No.: 5561, 6717; Payload ID: 1297 relates to Category No.: 6717, 5570, 10056, 4755, 1099, 4010, 779, 15628, 2926, 12439; Payload ID: 1298 relates to Category No.: 5561, 2890, 6717, 10056, 5570, 1099, 1811; Payload ID: 1299 relates to Category No.: 2890, 6717, 10056, 5570, 1099, 4008; Payload ID: 1300 relates to Category No.: 6717, 10056, 5570, 4010, 779, 3666, 1085, 6989; Payload ID: 1301 relates to Category No.: 5561, 6717, 779, 5570, 15628; Payload ID: 1302 relates to Category No.: 5561, 6717, 1700, 2890, 10056, 5570, 1811; Payload ID: 1303 relates to Category No.: 5561, 6717, 1700, 10056, 5570, 778; Payload ID: 1304 relates to Category No.: 5561, 6717, 1700, 5776, 10056, 5570, 1099; Payload ID: 1305 relates to Category No.: 9305, 6717, 9247, 14912, 1635; Payload ID: 1306 relates to Category No.: 2890, 6717, 2942, 14363, 4010; Payload ID: 1307 relates to Category No.: 2942; Payload ID: 1308 relates to Category No.: 6717, 10056, 2942, 4043, 6222, 2890; Payload ID: 1309 relates to Category No.: 9305, 2890, 6717, 5762, 2938, 10056, 2942, 4049, 4010; Payload ID: 1310 relates to Category No.: 4030, 2942, 9184, 9162, 9181, 9164, 2890, 9305, 3036, 14363; Payload ID: 1311 relates to Category No.: 5561, 6717, 3673, 3666, 9184, 9162, 9305, 2942; Payload ID: 1312 relates to Category No.: 2890; Payload ID: 1313 relates to Category No.: 2942, 1842, 7118; Payload ID: 1314 relates to Category No.: 2942, 9734, 2890; Payload ID: 1317 relates to Category No.: 2890, 6717, 5776, 2942, 4755, 2663, 3666, 2664; Payload ID: 1318 relates to Category No.: 6717, 12440; Payload ID: 1319 relates to Category No.: 6717, 3696; Payload ID: 1321 relates to Category No.: 9305, 2890, 10056; Payload ID: 1322 relates to Category No.: 2890, 10056, 7041; Payload ID: 1323 relates to Category No.: 5776, 2899, 9199, 8948, 1774; Payload ID: 1324 relates to Category No.: 6717; Payload ID: 1325 relates to Category No.: 2890, 6717, 5762; Payload ID: 1326 relates to Category No.: 9305, 7118, 6717, 9242, 4010, 5762; Payload ID: 1327 relates to Category No.: 2890, 6717, 5762, 9305, 1772; Payload ID: 1332 relates to Category No.: 10056, 2942, 4755, 4760, 2926, 15573; Payload ID: 1333 relates to Category No.: 2942; Payload ID: 1334 relates to Category No.: 2890, 2938, 10056, 2942, 6017, 14327; Payload ID: 1335 relates to Category No.: 6717, 2942, 3055; Payload ID: 1336 relates to Category No.: 10056, 4760; Payload ID: 1337 relates to Category No.: 2890, 14327, 4228; Payload ID: 1338 relates to Category No.: 5561, 15573; Payload ID: 1339 relates to Category No.: 9305, 2890, 2942, 4010, 4030, 8935, 8948, 7070; Payload ID: 1340 relates to Category No.: 7118, 7060; Payload ID: 1341 relates to Category No.: 7118, 9247; Payload ID: 1342 relates to Category No.: 4029, 2942, 4030, 3036, 14409; Payload ID: 1343 relates to Category No.: 5561, 10056, 2942, 5570, 3693, 2926; Payload ID: 1344 relates to Category No.: 5561, 10056, 2942, 5570, 3693; Payload ID: 1345 relates to Category No.: 5561, 10056, 5570, 3693, 3666, 4755, 5762; Payload ID: 1347 relates to Category No.: 9305, 2890, 9215; Payload ID: 1350 relates to Category No.: 9305; Payload ID: 1351 relates to Category No.: 9305, 5110; Payload ID: 1352 relates to Category No.: 2890, 2942, 4010; Payload ID: 1353 relates to Category No.: 2890, 2942, 4010, 9305, 3666, 8935, 8948, 6443, 7070, 9730, 1712; Payload ID: 1354 relates to Category No.: 4030, 4029, 10056, 14409, 4010; Payload ID: 1355 relates to Category No.: 2890; Payload ID: 1356 relates to Category No.: 9305, 2890; Payload ID: 1357 relates to Category No.: 2890, 6717, 2942, 9247, 4010, 7118, 633; Payload ID: 1358 relates to Category No.: 7118, 2890, 7060; Payload ID: 1359 relates to Category No.: 9305, 2890, 2942, 14145, 9247, 10162, 2903, 14190, 14191, 6956; Payload ID: 1360 relates to Category No.: 9305, 2890, 6717, 2942, 14145, 9247, 10162, 2903, 7269, 14190, 14191, 6956, 3036; Payload ID: 1361 relates to Category No.: 2890, 6717, 2942, 2903, 14190, 14191, 6956; Payload ID: 1362 relates to Category No.: 2890, 6717, 2942, 2903, 14190, 14191, 6956; Payload ID: 1364 relates to Category No.: 5561; Payload ID: 1365 relates to Category No.: 2890, 2942, 15892; Payload ID: 1366 relates to Category No.: 9305, 2890, 15892; Payload ID: 1367 relates to Category No.: 9305; Payload ID: 1368 relates to Category No.: 5762; Payload ID: 1369 relates to Category No.: 7118; Payload ID: 1370 relates to Category No.: 5561, 3673, 7118; Payload ID: 1371 relates to Category No.: 9305; Payload ID: 1373 relates to Category No.: 2890, 4010; Payload ID: 1374 relates to Category No.: 9305, 2890, 2938, 9247, 1046, 2443; Payload ID: 1375 relates to Category No.: 2890; Payload ID: 1377 relates to Category No.: 2890; Payload ID: 1379 relates to Category No.: 4010; Payload ID: 1380 relates to Category No.: 5561; Payload ID: 1381 relates to Category No.: 5561; Payload ID: 1382 relates to Category No.: 5564, 5561; Payload ID: 1383 relates to Category No.: 5561; Payload ID: 1385 relates to Category No.: 5561; Payload ID: 1386 relates to Category No.: 5762, 10056, 9247, 1748, 2890, 9305; Payload ID: 1387 relates to Category No.: 2890, 2194, 2942, 6964, 4010, 3506, 7366; Payload ID: 1388 relates to Category No.: 2890, 6717, 2194, 2942, 4010, 3506; Payload ID: 1389 relates to Category No.: 2890, 6717, 2942, 273, 850, 4010, 1774, 4228, 1720, 268; Payload ID: 1390 relates to Category No.: 6717, 2942, 273, 850, 4010, 4228, 6017, 1811, 1335; Payload ID: 1391 relates to Category No.: 2890, 850, 4010, 1774; Payload ID: 1392 relates to Category No.: 850, 4010; Payload ID: 1393 relates to Category No.: 9305, 2890, 5466; Payload ID: 1394 relates to Category No.: 5466, 9153, 9305, 2890, 2938; Payload ID: 1395 relates to Category No.: 9305, 5466; Payload ID: 1396 relates to Category No.: 273, 850; Payload ID: 1397 relates to Category No.: 2890, 10000, 10002, 15139; Payload ID: 1398 relates to Category No.: 10056, 4010, 2926; Payload ID: 1399 relates to Category No.: 10056, 2926; Payload ID: 1400 relates to Category No.: 10056, 3693; Payload ID: 1401 relates to Category No.: 10056, 3693; Payload ID: 1403 relates to Category No.: 5039, 9305, 2890, 10056, 2942, 4765, 9247, 2927, 2402, 2534, 2926, 6440, 12219, 5762, 1099, 11653, 3055, 11650; Payload ID: 1404 relates to Category No.: 9305, 2890, 10056, 2942, 2534, 3636, 2926, 5762, 1099, 11653, 3055, 11650; Payload ID: 1405 relates to Category No.: 9305, 2890, 9242, 3673, 4010, 3666; Payload ID: 1406 relates to Category No.: 2942, 7118; Payload ID: 1407 relates to Category No.: 4030; Payload ID: 1408 relates to Category No.: 5561, 3673, 4755, 2714; Payload ID: 1409 relates to Category No.: 9305, 2890, 15505, 9247, 2944, 9154; Payload ID: 1410 relates to Category No.: 2890, 10056, 2942, 9247, 6717, 864; Payload ID: 1411 relates to Category No.: 9305, 2890, 10000; Payload ID: 1412 relates to Category No.: 9305, 9247, 14253, 2890, 15505; Payload ID: 1413 relates to Category No.: 9305, 15505, 9247, 10104, 2417, 2890, 9155; Payload ID: 1414 relates to Category No.: 9305, 2890, 15505, 9242; Payload ID: 1415 relates to Category No.: 5561, 3673; Payload ID: 1416 relates to Category No.: 5561, 4029; Payload ID: 1418 relates to Category No.: 5561; Payload ID: 1419 relates to Category No.: 9305, 2942, 2890; Payload ID: 1420 relates to Category No.: 9305, 2890, 15505; Payload ID: 1421 relates to Category No.: 2890; Payload ID: 1422 relates to Category No.: 5561, 10056, 2890, 4030, 3693, 6443, 262, 4046, 4010, 3671, 6437; Payload ID: 1423 relates to Category No.: 6443, 4010, 1792, 3671, 6437, 7118, 4755, 14293; Payload ID: 1424 relates to Category No.: 6443, 4010, 3671; Payload ID: 1425 relates to Category No.: 4010, 3671, 4769, 5561; Payload ID: 1426 relates to Category No.: 4010, 3671; Payload ID: 1427 relates to Category No.: 5561, 3671; Payload ID: 1428 relates to Category No.: 4029, 3671; Payload ID: 1429 relates to Category No.: 4029, 3671, 5561; Payload ID: 1430 relates to Category No.: 4029, 3671; Payload ID: 1431 relates to Category No.: 4030, 6443, 3666, 3671; Payload ID: 1432 relates to Category No.: 9305, 2890, 1182, 9247, 4755, 2420, 4010; Payload ID: 1433 relates to Category No.: 9305, 9247, 14529, 5216, 9167; Payload ID: 1434 relates to Category No.: 4029, 5570, 5561; Payload ID: 1435 relates to Category No.: 5561; Payload ID: 1437 relates to Category No.: 9305, 2890, 2942; Payload ID: 1438 relates to Category No.: 2942; Payload ID: 1439 relates to Category No.: 2942, 1842; Payload ID: 1440 relates to Category No.: 2890, 2942, 4010, 7118; Payload ID: 1441 relates to Category No.: 7118, 2890, 7060; Payload ID: 1442 relates to Category No.: 5561, 6717, 10056, 3673, 3666, 2714, 5557, 14371, 5920, 14370, 1402, 2890; Payload ID: 1443 relates to Category No.: 5561; Payload ID: 1444 relates to Category No.: 5561, 6717; Payload ID: 1447 relates to Category No.: 5561; Payload ID: 1448 relates to Category No.: 2890, 9305, 2942, 4010; Payload ID: 1449 relates to Category No.: 9305, 2890, 9247, 1239; Payload ID: 1450 relates to Category No.: 4030, 6443, 3666, 4010; Payload ID: 1451 relates to Category No.: 2890, 6717, 2942, 4010; Payload ID: 1452 relates to Category No.: 9305, 7118, 2890, 9247, 7060; Payload ID: 1453 relates to Category No.: 12159, 4014; Payload ID: 1454 relates to Category No.: 2890, 10056, 15627, 2715; Payload ID: 1456 relates to Category No.: 5561, 1842, 4008, 3693; Payload ID: 1457 relates to Category No.: 3693, 5561, 1773; Payload ID: 1458 relates to Category No.: 9305, 2890; Payload ID: 1459 relates to Category No.: 9305, 2942, 9247, 2630, 2402, 9199, 4010, 9184, 9181, 9195, 9206, 2890; Payload ID: 1461 relates to Category No.: 9305, 1077, 9247, 9157, 15126, 9133, 7544; Payload ID: 1462 relates to Category No.: 2890, 1077, 9247, 15126, 7544, 9305; Payload ID: 1463 relates to Category No.: 10056, 9247, 1077; Payload ID: 1464 relates to Category No.: 2890, 9242, 9247, 4755, 6743, 9305; Payload ID: 1465 relates to Category No.: 9305, 9247; Payload ID: 1466 relates to Category No.: 9305, 6743, 2890; Payload ID: 1467 relates to Category No.: 9305, 9247, 15531; Payload ID: 1468 relates to Category No.: 9305, 2890, 9247, 1842; Payload ID: 1469 relates to Category No.: 9305, 9242, 9247, 15505; Payload ID: 1470 relates to Category No.: 9305, 9247; Payload ID: 1471 relates to Category No.: 7118, 2890, 8935, 7061, 15139, 1748, 3036, 1017; Payload ID: 1472 relates to Category No.: 9305, 2890, 5776, 9247, 9181, 9175, 9212; Payload ID: 1473 relates to Category No.: 4030, 2890, 6717, 10056, 9734, 8948, 3036, 2942; Payload ID: 1474 relates to Category No.: 9305, 9242, 3036; Payload ID: 1475 relates to Category No.: 2890, 9247, 6717, 14145, 4755, 9734, 10162, 15573, 2920; Payload ID: 1476 relates to Category No.: 2890, 6717, 9215, 2920, 5561; Payload ID: 1477 relates to Category No.: 9305, 2890, 2942, 3673, 7061, 9247, 7060, 9181, 9175; Payload ID: 1478 relates to Category No.: 2890, 7060, 7061, 9175, 9305; Payload ID: 1479 relates to Category No.: 9305, 2890, 9242, 9247, 6968, 14937, 9181; Payload ID: 1482 relates to Category No.: 14354, 3492, 9305; Payload ID: 1484 relates to Category No.: 1798; Payload ID: 1485 relates to Category No.: 9305, 6717; Payload ID: 1486 relates to Category No.: 5561, 4765, 3673, 3666, 4755, 1017, 4758, 2890; Payload ID: 1487 relates to Category No.: 5561, 6717, 3673, 3666; Payload ID: 1488 relates to Category No.: 5561, 6717, 3673, 3666; Payload ID: 1489 relates to Category No.: 9305; Payload ID: 1490 relates to Category No.: 9247, 2899, 2420, 15269, 3355, 14893, 9305, 2890; Payload ID: 1491 relates to Category No.: 9305; Payload ID: 1492 relates to Category No.: 9305; Payload ID: 1493 relates to Category No.: 9305, 2890, 9215; Payload ID: 1494 relates to Category No.: 2890, 6717, 10056, 2942, 9247, 4010, 2480, 7118; Payload ID: 1495 relates to Category No.: 7118; Payload ID: 1496 relates to Category No.: 7118, 9215; Payload ID: 1497 relates to Category No.: 7118, 6717, 7048, 10056, 2660, 7060, 4010, 12204, 1633, 12200, 1632, 7079, 7366; Payload ID: 1498 relates to Category No.: 12204, 1633, 12200, 1632, 9305, 7118, 6717, 10056, 7061, 7060, 4010, 1792, 7068, 7079, 7078, 1631, 7048, 7366; Payload ID: 1499 relates to Category No.: 7118, 7048, 7079, 1632, 7060, 12200, 1632, 7079; Payload ID: 1500 relates to Category No.: 7048, 7079, 1632, 7060, 7079; Payload ID: 1501 relates to Category No.: 7118, 7048, 7079, 1632; Payload ID: 1502 relates to Category No.: 7118, 6717, 7048, 7079, 1632, 7060, 4010, 12200, 1632, 7079, 7366; Payload ID: 1503 relates to Category No.: 9305, 7118, 6717, 7048, 10056, 4010, 7079; Payload ID: 1504 relates to Category No.: 9305, 7118, 6717, 7048, 9247, 7060, 4010, 7079, 2751, 7079, 7366, 5561; Payload ID: 1505 relates to Category No.: 5561, 7118, 7048, 12200, 2751, 7079, 12204, 12203; Payload ID: 1506 relates to Category No.: 5561, 7070, 12200, 2751, 7079, 12204, 12203; Payload ID: 1507 relates to Category No.: 5561, 7070, 12200, 2751, 7079, 12204, 12203, 7118; Payload ID: 1508 relates to Category No.: 7118, 2890, 7048, 9247, 4010, 7079, 2751, 7079; Payload ID: 1509 relates to Category No.: 7118, 7048, 7079, 2751, 7079; Payload ID: 1510 relates to Category No.: 5561, 9305, 7048, 4010, 7079, 7118, 7079, 2751; Payload ID: 1511 relates to Category No.: 7118, 7079, 2751, 7048, 7079; Payload ID: 1512 relates to Category No.: 7118, 7048, 4010, 7079, 2751, 7079; Payload ID: 1513 relates to Category No.: 7079, 2751; Payload ID: 1514 relates to Category No.: 7048, 12200, 2751, 7118; Payload ID: 1515 relates to Category No.: 9305, 7118, 2890, 2942; Payload ID: 1516 relates to Category No.: 2942; Payload ID: 1517 relates to Category No.: 2942, 2183, 2441; Payload ID: 1518 relates to Category No.: 2942; Payload ID: 1519 relates to Category No.: 2942, 4755, 2183, 2441; Payload ID: 1520 relates to Category No.: 9305, 2890, 2942, 6994, 7161; Payload ID: 1522 relates to Category No.: 7118; Payload ID: 1523 relates to Category No.: 16059; Payload ID: 1524 relates to Category No.: 6717, 1748, 11653, 9754, 7118; Payload ID: 1525 relates to Category No.: 9305, 9247, 4010; Payload ID: 1526 relates to Category No.: 9305; Payload ID: 1527 relates to Category No.: 5561, 7118, 7048, 7068; Payload ID: 1528 relates to Category No.: 7048; Payload ID: 1530 relates to Category No.: 9305; Payload ID: 1531 relates to Category No.: 7118, 1792, 7079; Payload ID: 1532 relates to Category No.: 5561, 6717, 5776, 3673, 5570; Payload ID: 1533 relates to Category No.: 5561, 6443, 5570, 6440, 6437, 16164; Payload ID: 1534 relates to Category No.: 5561, 6717, 5776, 5570; Payload ID: 1535 relates to Category No.: 5776, 10056, 5570, 5561, 3673; Payload ID: 1536 relates to Category No.: 5561, 5776, 10056, 5570; Payload ID: 1537 relates to Category No.: 5561, 6717, 10056, 3666, 4755, 4010, 2401; Payload ID: 1538 relates to Category No.: 5561, 10056, 3693, 4755, 10002, 6717; Payload ID: 1539 relates to Category No.: 5561, 10056, 14953, 5570, 3666, 4755, 779, 6717, 1336; Payload ID: 1540 relates to Category No.: 5561, 10056, 4755; Payload ID: 1541 relates to Category No.: 5561, 10056, 3666, 4755, 261, 262; Payload ID: 1542 relates to Category No.: 5561, 7118, 6717, 3673, 5570, 9734, 14371, 14368, 5342, 1402, 3685, 10085, 4926; Payload ID: 1543 relates to Category No.: 5561, 6717, 3673, 5570, 3666, 14371, 14368, 10085, 5596, 6321, 1423, 14125, 11883, 9734, 16164, 4043; Payload ID: 1544 relates to Category No.: 5561, 9305, 6717, 10056, 5570, 4010, 1099, 6743, 778, 2918, 8949, 779, 3040, 3059; Payload ID: 1545 relates to Category No.: 5561, 2890, 6717, 5776, 10056, 2942, 5570, 15139, 1748, 4010, 2458, 3666, 8948, 779; Payload ID: 1546 relates to Category No.: 5561, 6717, 10056, 5570, 4755, 4032; Payload ID: 1547 relates to Category No.: 5561, 6717, 5776, 10056, 5570, 11883, 16326, 1659, 15758, 14363, 1099, 8935, 14833; Payload ID: 1548 relates to Category No.: 5561, 6717, 4765, 5570, 4755, 15573; Payload ID: 1549 relates to Category No.: 5561, 4765, 5570, 2926, 9734, 2918; Payload ID: 1550 relates to Category No.: 5561, 3673, 5570, 3666, 14371, 14368, 9184, 10085; Payload ID: 1551 relates to Category No.: 5561, 10056, 4755; Payload ID: 1552 relates to Category No.: 5561, 10056, 3693, 15573, 12439, 9734, 3521, 3523; Payload ID: 1553 relates to Category No.: 10056, 3693, 5561, 15573, 9734; Payload ID: 1554 relates to Category No.: 5561, 10056, 3673, 3666, 5762; Payload ID: 1555 relates to Category No.: 5561, 10056, 3673, 3666, 2927, 5762; Payload ID: 1556 relates to Category No.: 5561, 10056, 3673, 3666, 9247, 5762; Payload ID: 1557 relates to Category No.: 5561, 12439, 6717, 5776, 10056, 3666, 3521, 6440; Payload ID: 1558 relates to Category No.: 5561, 12439, 6717, 10056, 3666, 4755, 3521, 12440, 9176; Payload ID: 1559 relates to Category No.: 5561, 12439, 10056, 3673, 3666, 6440; Payload ID: 1560 relates to Category No.: 5561, 6717, 10056, 2942, 8935, 5570, 3666, 4755, 9734, 8948, 15573, 1099, 6059, 15577, 2926, 1336, 14409; Payload ID: 1561 relates to Category No.: 5561, 7118, 6717, 4765, 5570, 2899, 9734, 15573, 1099, 6059, 10056, 1182; Payload ID: 1562 relates to Category No.: 5561, 6717, 12207, 9776, 3696; Payload ID: 1563 relates to Category No.: 10056, 2942, 4010, 6440, 16059, 5762; Payload ID: 1564 relates to Category No.: 2942, 6709, 16059; Payload ID: 1566 relates to Category No.: 6717, 2942, 12208, 4010, 16059, 12204; Payload ID: 1567 relates to Category No.: 5561, 4010, 9776, 3696, 4228, 6440, 16061, 12207, 12205; Payload ID: 1568 relates to Category No.: 5561, 12207, 12205, 9776, 3696, 16061, 3693; Payload ID: 1569 relates to Category No.: 2942, 3693, 4010, 6440, 779, 12204, 1633, 12204, 2890, 7118, 6989; Payload ID: 1570 relates to Category No.: 2942, 12204, 1633, 262; Payload ID: 1571 relates to Category No.: 6717, 2194, 2942, 2458, 4010, 6440, 12206; Payload ID: 1572 relates to Category No.: 6717, 2194, 4010, 9776, 3696, 6440, 16059, 12207, 3521, 11883, 8935, 15151, 1033, 779; Payload ID: 1573 relates to Category No.: 12207, 6717, 4010, 9776, 3696, 779, 16059, 3521, 3693; Payload ID: 1574 relates to Category No.: 12208, 10056, 2942, 4010, 6440, 12204, 2890, 2926, 778; Payload ID: 1575 relates to Category No.: 2942, 12208, 4010, 6440; Payload ID: 1576 relates to Category No.: 10056, 2942, 16062, 4010, 6440; Payload ID: 1577 relates to Category No.: 2890, 2942, 3652, 1099, 12208, 4010, 6989, 779, 16059, 12204, 1633, 6075, 6717; Payload ID: 1578 relates to Category No.: 5776, 10056, 2942, 3652, 12208, 4010, 6709, 6440, 12204, 1633, 2890, 14327, 7366, 6989, 5561; Payload ID: 1579 relates to Category No.: 10056, 2942, 5570, 12208, 4010, 6440, 12204, 1633, 12204, 7118, 779, 7366, 6989; Payload ID: 1580 relates to Category No.: 5561, 6717, 9776, 3696; Payload ID: 1581 relates to Category No.: 5561, 16057, 12208, 4010, 3696, 12204; Payload ID: 1582 relates to Category No.: 5561, 12208; Payload ID: 1583 relates to Category No.: 5561, 10056, 4008, 4010, 8935, 1711; Payload ID: 1584 relates to Category No.: 5561, 2890, 5776, 10056, 9247, 4755, 4010, 9776, 3696, 6709, 16061, 16059, 12207; Payload ID: 1585 relates to Category No.: 5561, 2890, 10056, 9776, 3696, 4228, 6440, 16061, 16059, 12207, 262; Payload ID: 1586 relates to Category No.: 5561, 10056, 3693, 4010, 9776, 3696, 6440, 779, 16061, 16059, 1336, 12207, 778, 1335; Payload ID: 1587 relates to Category No.: 4030, 5561, 6717, 5776, 10056, 5570; Payload ID: 1588 relates to Category No.: 10056, 14753; Payload ID: 1589 relates to Category No.: 5561, 5776, 10056, 5306, 1099, 779; Payload ID: 1590 relates to Category No.: 5561, 6717, 5776, 10056, 3666, 4755, 14363, 4010, 6709, 11883, 14753, 4032, 1099, 779, 15758, 7366, 8951, 3693, 1659, 6743, 5596; Payload ID: 1591 relates to Category No.: 5561, 2890, 6717, 5776, 10056, 14753, 4032, 2942, 14363, 15758, 7366, 15139, 3693, 1659, 3055, 8935, 5596; Payload ID: 1592 relates to Category No.: 5561, 10056, 3666, 15139, 4755, 14753, 4032, 2890, 9305, 14363, 7366, 1017, 3061, 3057; Payload ID: 1593 relates to Category No.: 5561, 5776, 10056, 5570, 14753; Payload ID: 1594 relates to Category No.: 6717, 10056, 14363, 4010, 14753, 4032, 5596, 1099, 5762, 779, 7366, 1659; Payload ID: 1595 relates to Category No.: 14753, 10056, 2890, 779; Payload ID: 1596 relates to Category No.: 14753, 10056, 4010, 6709, 2890, 1659; Payload ID: 1597 relates to Category No.: 5570, 9176, 14753, 9162, 9305, 2402; Payload ID: 1598 relates to Category No.: 10056, 5570, 9734, 3636, 6743, 9774, 4008, 4755, 5776, 1792, 5059; Payload ID: 1599 relates to Category No.: 5561, 5776; Payload ID: 1600 relates to Category No.: 5561, 2890, 10056, 5570, 3779, 2942, 7048; Payload ID: 1601 relates to Category No.: 5776, 5570; Payload ID: 1602 relates to Category No.: 5561, 6443, 6717, 6976, 3693, 2899, 3696, 6440, 947; Payload ID: 1603 relates to Category No.: 4030, 5561, 6717, 10056, 603, 6016, 604; Payload ID: 1604 relates to Category No.: 6717, 5776, 5570, 9999, 10002; Payload ID: 1605 relates to Category No.: 5561, 6443, 5776, 4765, 6060, 6059, 6440, 4755; Payload ID: 1606 relates to Category No.: 5561, 5776; Payload ID: 1607 relates to Category No.: 5570, 5561, 2890, 10056, 4765, 4755, 9773, 3696, 1792, 947, 14329, 5762, 779, 6717; Payload ID: 1608 relates to Category No.: 5561, 7048, 5776, 10056; Payload ID: 1609 relates to Category No.: 5561, 7118; Payload ID: 1610 relates to Category No.: 5561, 6717, 10056, 4010, 1792; Payload ID: 1611 relates to Category No.: 5561, 7048, 5563, 7118; Payload ID: 1612 relates to Category No.: 5561; Payload ID: 1613 relates to Category No.: 5561, 2890, 6717, 10056, 5570, 4010, 6743, 779, 2504, 5599; Payload ID: 1614 relates to Category No.: 5561, 10056, 5570; Payload ID: 1615 relates to Category No.: 5561, 7118, 10056, 3693, 7041, 3666, 4755, 7070, 4010, 5564, 947; Payload ID: 1616 relates to Category No.: 5561, 7118, 7048, 1700; Payload ID: 1617 relates to Category No.: 5561, 9305, 7118, 6717, 7048, 9242, 7041, 947; Payload ID: 1618 relates to Category No.: 5561, 6443, 5557, 6440; Payload ID: 1619 relates to Category No.: 5561, 6717, 10056, 1099, 4010, 5570; Payload ID: 1620 relates to Category No.: 5561, 10056, 6440; Payload ID: 1621 relates to Category No.: 5561, 10056, 5570, 4010; Payload ID: 1622 relates to Category No.: 5561; Payload ID: 1623 relates to Category No.: 5561, 10056, 5570, 1792, 779, 6717; Payload ID: 1624 relates to Category No.: 5561, 6717, 10056, 5570; Payload ID: 1625 relates to Category No.: 5561, 6717, 10056, 1099, 10082; Payload ID: 1626 relates to Category No.: 5561, 6717, 10056, 5570; Payload ID: 1627 relates to Category No.: 5561, 9305, 10056, 3673, 1099, 6717, 779, 6075; Payload ID: 1628 relates to Category No.: 5561, 16257, 10056, 15161, 14363; Payload ID: 1629 relates to Category No.: 5561, 16257, 10056, 962, 14363, 14364; Payload ID: 1630 relates to Category No.: 5561, 2890, 6717, 5569, 2942, 9734, 9756, 9754, 7118; Payload ID: 1631 relates to Category No.: 5561, 5776, 2942, 9756, 9754; Payload ID: 1632 relates to Category No.: 5561, 6717, 5776, 2942, 9756, 9754, 9753, 7048, 7118; Payload ID: 1633 relates to Category No.: 5561, 9756, 9754, 6440, 947, 3673; Payload ID: 1634 relates to Category No.: 7118, 2890, 6717, 7060; Payload ID: 1635 relates to Category No.: 2890, 6717, 2942, 9247, 9162, 10161, 14174; Payload ID: 1636 relates to Category No.: 6717, 7041, 947, 7118; Payload ID: 1637 relates to Category No.: 6717; Payload ID: 1638 relates to Category No.: 5561, 7118, 12439, 6717, 5776, 10056, 4765, 3673, 5570, 3693, 9247, 4755, 4008; Payload ID: 1639 relates to Category No.: 5561, 9305, 6717, 10056, 7061, 9247; Payload ID: 1640 relates to Category No.: 5561, 6717, 10056; Payload ID: 1641 relates to Category No.: 6717, 10056, 779, 12406, 947, 778, 5561; Payload ID: 1642 relates to Category No.: 6717, 10056, 779, 12406, 947; Payload ID: 1643 relates to Category No.: 9305, 9247; Payload ID: 1644 relates to Category No.: 5561, 9305, 9242, 2942, 3673, 9162, 9247; Payload ID: 1645 relates to Category No.: 9247, 4755, 2420, 10104, 16317; Payload ID: 1646 relates to Category No.: 9305, 2890, 9247, 9734, 1748, 9181; Payload ID: 1647 relates to Category No.: 4030, 6717, 10056, 5570, 4010, 2890; Payload ID: 1648 relates to Category No.: 5561, 6717; Payload ID: 1649 relates to Category No.: 5561, 12439, 10056, 3521; Payload ID: 1650 relates to Category No.: 5561, 12439, 10056, 5570, 3521, 276; Payload ID: 1651 relates to Category No.: 5561, 12439, 10056, 3693, 9734, 3521, 2534, 1792; Payload ID: 1652 relates to Category No.: 5561, 12439, 10056, 5570, 3521; Payload ID: 1653 relates to Category No.: 7118, 7060; Payload ID: 1654 relates to Category No.: 9305, 2194, 2942, 6994, 9734, 2632, 2192, 6968, 14902, 14908, 2426, 14893, 14903, 11793, 6976, 7161, 6692, 1028, 4462; Payload ID: 1655 relates to Category No.: 2890, 2194, 14906; Payload ID: 1656 relates to Category No.: 9305, 7118, 7048, 5776, 9247; Payload ID: 1657 relates to Category No.: 9305, 2942, 6994, 2632, 2192, 14902, 14908, 2426, 14893, 14903, 5964, 2628, 2192, 2419; Payload ID: 1658 relates to Category No.: 2890, 6994, 2632, 2192, 14902, 14908, 2426, 14893, 14903, 2628; Payload ID: 1659 relates to Category No.: 1842, 9305; Payload ID: 1660 relates to Category No.: 5561, 6717, 3673, 9734, 5557, 11883, 3104, 9305, 2890, 3036, 8948, 4860; Payload ID: 1661 relates to Category No.: 9305, 2890, 5762; Payload ID: 1662 relates to Category No.: 5762, 2942; Payload ID: 1663 relates to Category No.: 2942, 11687; Payload ID: 1664 relates to Category No.: 2890, 2942, 9776, 11688, 923, 6717, 11883; Payload ID: 1665 relates to Category No.: 2942, 11687, 7118, 920; Payload ID: 1666 relates to Category No.: 9305, 2890, 2942, 3673, 9247, 997, 1001, 1046, 11688, 4052, 4054, 9849, 9774, 3848; Payload ID: 1667 relates to Category No.: 1001, 2942, 997, 1046, 11688; Payload ID: 1668 relates to Category No.: 9247, 1001; Payload ID: 1669 relates to Category No.: 11687, 4049, 6222, 11688; Payload ID: 1670 relates to Category No.: 11687, 4049, 6222, 11688; Payload ID: 1671 relates to Category No.: 2942, 2925; Payload ID: 1672 relates to Category No.: 2890, 2942; Payload ID: 1673 relates to Category No.: 2890, 2942; Payload ID: 1674 relates to Category No.: 2942, 4029, 2890; Payload ID: 1675 relates to Category No.: 2942, 2890, 7060; Payload ID: 1676 relates to Category No.: 2890, 6717, 2942, 997, 9776, 1046, 11688, 923, 3848; Payload ID: 1677 relates to Category No.: 2890, 2942, 11687, 1046; Payload ID: 1678 relates to Category No.: 997, 5561, 12439, 6717, 3673, 3693, 11687, 15573, 6060, 2926, 6059, 2890; Payload ID: 1679 relates to Category No.: 5561, 1001, 2926, 2890, 997; Payload ID: 1680 relates to Category No.: 7118, 2890, 2942, 7070, 997, 1046, 9774; Payload ID: 1681 relates to Category No.: 5561, 12439; Payload ID: 1682 relates to Category No.: 9305, 2890, 10056, 2942, 2899, 9734, 2901, 1720, 11650, 1154, 1772, 2926, 6075, 11883; Payload ID: 1683 relates to Category No.: 9305, 2890, 2194, 10056, 2942, 9247, 2899, 4755, 2901, 1720, 11650, 1154, 6968; Payload ID: 1684 relates to Category No.: 1842, 2890; Payload ID: 1685 relates to Category No.: 4030, 10056, 5570, 4010, 1792, 5274, 5762, 5561; Payload ID: 1687 relates to Category No.: 4030, 4029, 2890, 4010, 1050; Payload ID: 1688 relates to Category No.: 10056, 5570, 4008; Payload ID: 1689 relates to Category No.: 9305, 2890, 9247; Payload ID: 1691 relates to Category No.: 2194, 2942, 15243, 2441, 2457, 6717; Payload ID: 1692 relates to Category No.: 9305, 2194, 2942, 15243, 2441, 6717, 2457; Payload ID: 1693 relates to Category No.: 5561, 4030, 5570, 4010, 2890; Payload ID: 1694 relates to Category No.: 2890, 9305, 2942, 2918, 1682, 11883, 6743, 16317; Payload ID: 1695 relates to Category No.: 9305, 2890, 2942, 9247, 11883, 6743; Payload ID: 1696 relates to Category No.: 9305, 2890, 6960, 2942, 2420, 2192, 6994, 9158, 2630, 2901, 2183, 14902, 2426, 14893, 5747; Payload ID: 1697 relates to Category No.: 2890, 6717, 6976, 14906, 3693, 6994, 15573; Payload ID: 1698 relates to Category No.: 9305, 2890, 4755; Payload ID: 1699 relates to Category No.: 9305, 2890; Payload ID: 1701 relates to Category No.: 2890, 10056, 2942, 9247, 273, 4199, 4010, 14327, 8935, 3055, 8948, 14409, 11650, 8951; Payload ID: 1702 relates to Category No.: 2890, 10056, 2942, 9247, 273, 4010; Payload ID: 1703 relates to Category No.: 10056, 2942, 9247, 273, 2927, 16164, 1810, 2498; Payload ID: 1704 relates to Category No.: 1700; Payload ID: 1705 relates to Category No.: 2194, 1046, 2441, 1107, 2942, 2446; Payload ID: 1706 relates to Category No.: 2458; Payload ID: 1707 relates to Category No.: 2458; Payload ID: 1708 relates to Category No.: 6717, 1107, 2942, 7244, 2441, 2446; Payload ID: 1709 relates to Category No.: 9305, 2194, 2942, 7244, 2183, 2458, 1107, 2441, 2457, 9098, 2446, 2182, 9727, 10002, 9998, 6717, 10000, 5561; Payload ID: 1710 relates to Category No.: 5762, 2942, 1107, 2441, 2446, 1046; Payload ID: 1711 relates to Category No.: 6717, 2194, 2942, 1107, 1046, 2441, 2446, 9305, 10002; Payload ID: 1712 relates to Category No.: 6717, 1107, 2942, 2458, 2457, 2446, 2182, 9727; Payload ID: 1713 relates to Category No.: 9305; Payload ID: 1714 relates to Category No.: 2890, 9247, 9305; Payload ID: 1715 relates to Category No.: 9305, 2890, 2942, 9247, 2420, 4010, 2628; Payload ID: 1716 relates to Category No.: 9305, 2890; Payload ID: 1717 relates to Category No.: 2890, 10056, 5570, 1099, 11883; Payload ID: 1718 relates to Category No.: 9305; Payload ID: 1719 relates to Category No.: 9242, 15505; Payload ID: 1720 relates to Category No.: 2890, 2441; Payload ID: 1721 relates to Category No.: 5561, 10056, 5570, 4008, 4010, 1792; Payload ID: 1722 relates to Category No.: 9305; Payload ID: 1723 relates to Category No.: 9305; Payload ID: 1724 relates to Category No.: 9305; Payload ID: 1725 relates to Category No.: 9305; Payload ID: 1726 relates to Category No.: 9305, 2890, 4010; Payload ID: 1727 relates to Category No.: 9305; Payload ID: 1728 relates to Category No.: 9305, 2890; Payload ID: 1729 relates to Category No.: 9305; Payload ID: 1730 relates to Category No.: 9305; Payload ID: 1731 relates to Category No.: 9305, 9242, 9247, 4755; Payload ID: 1732 relates to Category No.: 9305; Payload ID: 1733 relates to Category No.: 2890, 6717; Payload ID: 1734 relates to Category No.: 6717; Payload ID: 1735 relates to Category No.: 9305, 2890, 4765, 9247, 4763, 4755; Payload ID: 1736 relates to Category No.: 9305, 2890; Payload ID: 1737 relates to Category No.: 9305; Payload ID: 1738 relates to Category No.: 9305; Payload ID: 1739 relates to Category No.: 9305, 2890; Payload ID: 1741 relates to Category No.: 4030, 9305, 2890; Payload ID: 1742 relates to Category No.: 7118, 6717, 10056, 4765, 5570, 4010, 4228, 6709, 261, 6743, 14363, 5561; Payload ID: 1743 relates to Category No.: 9305, 2890; Payload ID: 1744 relates to Category No.: 9305, 2890, 10056, 9247; Payload ID: 1745 relates to Category No.: 9305, 15139, 1748, 3036, 11721, 3972, 2939, 1792, 1017, 11650, 8951, 8942, 8948, 15573, 14125, 5441; Payload ID: 1746 relates to Category No.: 2890, 6717, 5762, 9247, 4228, 9734, 1750; Payload ID: 1747 relates to Category No.: 2890, 2942, 2458, 1107; Payload ID: 1748 relates to Category No.: 5561, 7118, 7092; Payload ID: 1749 relates to Category No.: 9305, 2890; Payload ID: 1751 relates to Category No.: 6443, 9305, 2890, 10056, 2942, 9734, 2901, 6743, 11883, 6246, 1663, 15206, 5392; Payload ID: 1752 relates to Category No.: 9305, 2890, 9247; Payload ID: 1753 relates to Category No.: 9305, 5762, 8935; Payload ID: 1754 relates to Category No.: 9305, 7118, 2890, 6717, 3673, 3666, 7070, 9184, 10169, 2942, 5762, 7366, 7061; Payload ID: 1755 relates to Category No.: 9305, 2890, 9247, 9734, 11883, 5597, 1110, 1109; Payload ID: 1756 relates to Category No.: 9305, 13728; Payload ID: 1757 relates to Category No.: 9305; Payload ID: 1758 relates to Category No.: 1842; Payload ID: 1759 relates to Category No.: 1842; Payload ID: 1761 relates to Category No.: 2477, 9247, 2890, 9305; Payload ID: 1762 relates to Category No.: 9305, 9242, 9247; Payload ID: 1763 relates to Category No.: 2890, 5762, 10056, 2942; Payload ID: 1764 relates to Category No.: 5561, 6717, 3673, 3666; Payload ID: 1765 relates to Category No.: 7118, 6717, 2942, 3673, 5570, 3666, 6222, 14394, 3686, 5560, 4765, 2504, 4760, 5561; Payload ID: 1767 relates to Category No.: 9305, 2890; Payload ID: 1768 relates to Category No.: 1842; Payload ID: 1769 relates to Category No.: 6443, 7118, 2942, 3666, 7070; Payload ID: 1770 relates to Category No.: 7394, 10056, 2942, 7070, 2890, 273, 262; Payload ID: 1771 relates to Category No.: 9305, 2942; Payload ID: 1772 relates to Category No.: 7118, 2890, 5776, 3666, 14707, 5557, 9162; Payload ID: 1773 relates to Category No.: 2942, 2183, 14908, 2890, 5776, 9734, 9162, 5561; Payload ID: 1774 relates to Category No.: 5561, 9305, 7118, 2890, 7061, 7041, 3666, 9247, 3036, 7070, 5564, 9162, 8951; Payload ID: 1775 relates to Category No.: 5561, 7118, 7041, 3666, 5819, 7070, 9162; Payload ID: 1776 relates to Category No.: 7118, 7070, 5564, 10169, 2942, 3666, 5762, 7061, 6717, 5561; Payload ID: 1777 relates to Category No.: 7118, 2942, 7070, 2890; Payload ID: 1778 relates to Category No.: 9305, 2890, 2942; Payload ID: 1779 relates to Category No.: 2942; Payload ID: 1780 relates to Category No.: 2890, 10056, 2942, 16326, 8935; Payload ID: 1781 relates to Category No.: 9305, 10056, 2942; Payload ID: 1782 relates to Category No.: 9305, 7118, 6717, 2942, 9734, 5412; Payload ID: 1783 relates to Category No.: 9305, 2890, 6717, 5776, 2942, 9247, 1104; Payload ID: 1784 relates to Category No.: 9305, 2890, 9242, 9247, 9215; Payload ID: 1785 relates to Category No.: 9305, 7118, 6717, 2942, 3673, 3666, 7070, 4010, 9162, 10169, 7075, 1108, 1106, 5561, 2890, 5762, 7061, 9734; Payload ID: 1786 relates to Category No.: 5561, 7061, 3652, 7041; Payload ID: 1787 relates to Category No.: 7070, 4010, 2942, 7061, 2890, 7118, 5561; Payload ID: 1788 relates to Category No.: 5561, 9305, 7118, 2890, 6717, 2194, 7048, 9242, 2942, 1748, 7070, 7060, 15161, 9184, 1108, 5762, 7061; Payload ID: 1789 relates to Category No.: 5561, 7118, 6717, 2942, 7070, 9184; Payload ID: 1790 relates to Category No.: 7118, 6960, 2942, 3652, 7070, 1200, 1199, 2890, 4049, 5776; Payload ID: 1791 relates to Category No.: 9305, 6717; Payload ID: 1792 relates to Category No.: 5561, 9305, 7118, 7061; Payload ID: 1793 relates to Category No.: 2890, 6717, 2942, 3652, 5778; Payload ID: 1794 relates to Category No.: 9305, 2942; Payload ID: 1795 relates to Category No.: 7070, 4010, 2942, 7061, 2890, 7118, 5561; Payload ID: 1796 relates to Category No.: 5561, 9305, 7118, 2890, 4765, 3673, 7061, 7070; Payload ID: 1797 relates to Category No.: 7070; Payload ID: 1798 relates to Category No.: 9305, 9603; Payload ID: 1799 relates to Category No.: 2890, 10056, 9247; Payload ID: 1800 relates to Category No.: 7118, 2890, 5727, 10056, 273; Payload ID: 1801 relates to Category No.: 2890, 5727, 10056; Payload ID: 1802 relates to Category No.: 7118, 2942, 3673, 3693, 7061, 3666, 11687, 2899, 9850, 9851, 4049, 997, 3696, 9849, 2890, 11883, 15573, 9774, 9305, 3036; Payload ID: 1803 relates to Category No.: 2890; Payload ID: 1805 relates to Category No.: 9242, 9172; Payload ID: 1807 relates to Category No.: 4755; Payload ID: 1808 relates to Category No.: 9305; Payload ID: 1809 relates to Category No.: 4010; Payload ID: 1810 relates to Category No.: 7118, 2890, 2942; Payload ID: 1811 relates to Category No.: 5561, 5557; Payload ID: 1812 relates to Category No.: 5561, 6717, 10056, 2942, 5570, 1099, 2324; Payload ID: 1813 relates to Category No.: 5570, 2458, 2324; Payload ID: 1814 relates to Category No.: 5570, 2324, 5561; Payload ID: 1815 relates to Category No.: 5570, 2324; Payload ID: 1816 relates to Category No.: 6717, 4765, 3673, 3686, 5561, 2477, 4759; Payload ID: 1817 relates to Category No.: 5561, 6717, 4765, 3693, 4755, 14707, 4769, 5559; Payload ID: 1818 relates to Category No.: 5561, 6717, 3673; Payload ID: 1819 relates to Category No.: 5561, 6717, 4765; Payload ID: 1820 relates to Category No.: 5561, 6717, 4765; Payload ID: 1821 relates to Category No.: 5561, 6717, 2477, 4765, 4755, 4010; Payload ID: 1822 relates to Category No.: 5561, 6717, 4765; Payload ID: 1823 relates to Category No.: 5561, 6717, 4765, 3666; Payload ID: 1824 relates to Category No.: 4765, 4755, 5559, 4010; Payload ID: 1825 relates to Category No.: 6717, 5559, 10056; Payload ID: 1826 relates to Category No.: 5561, 5559; Payload ID: 1827 relates to Category No.: 5561, 4760; Payload ID: 1828 relates to Category No.: 5561, 4760; Payload ID: 1829 relates to Category No.: 4030, 4029, 2890, 6717, 10056, 4765, 4755, 6934, 4010, 9776, 4228, 3523, 3671, 3832, 5049, 3522, 4008; Payload ID: 1830 relates to Category No.: 2942; Payload ID: 1831 relates to Category No.: 7118, 5762, 7060; Payload ID: 1832 relates to Category No.: 4030, 5561, 4029, 5762, 10056; Payload ID: 1834 relates to Category No.: 2890, 2942, 4010; Payload ID: 1835 relates to Category No.: 2890, 2942, 4010; Payload ID: 1836 relates to Category No.: 5561, 10056, 5570, 3693, 4755, 15573, 2927, 3696, 1792, 6059, 3671, 7321, 4787, 2926, 6717, 1017; Payload ID: 1837 relates to Category No.: 5561, 3693, 3666, 4755, 1792; Payload ID: 1838 relates to Category No.: 2942, 9247, 14382; Payload ID: 1839 relates to Category No.: 7118, 2890, 6717, 2942, 7070, 4010, 5563; Payload ID: 1840 relates to Category No.: 7118; Payload ID: 1841 relates to Category No.: 6717, 2938, 2942, 4755, 9734, 2901, 15573, 2926, 15767, 5276; Payload ID: 1842 relates to Category No.: 2890, 2938, 10056, 4755, 2926; Payload ID: 1843 relates to Category No.: 2890; Payload ID: 1844 relates to Category No.: 6717, 5570, 3666, 5557, 5561; Payload ID: 1845 relates to Category No.: 4029, 12159, 4014, 15627, 4010, 1792, 4763, 6437, 5762, 14363; Payload ID: 1846 relates to Category No.: 2942, 9756, 9753; Payload ID: 1847 relates to Category No.: 2890, 2942, 4010; Payload ID: 1848 relates to Category No.: 2890, 10056, 2942, 9247, 4010; Payload ID: 1849 relates to Category No.: 4029, 1792; Payload ID: 1850 relates to Category No.: 4030, 1233, 2942, 7060, 4010, 6440, 7052; Payload ID: 1851 relates to Category No.: 9305, 7118, 2194, 1233, 3693, 4390, 2942, 2890, 12439; Payload ID: 1852 relates to Category No.: 1233, 2942, 15627, 2890; Payload ID: 1853 relates to Category No.: 2890, 1233, 2942; Payload ID: 1854 relates to Category No.: 1233, 15627; Payload ID: 1855 relates to Category No.: 2890, 1233, 2942, 9247, 15627, 14707, 4049, 3693; Payload ID: 1856 relates to Category No.: 2890, 6976, 2630; Payload ID: 1857 relates to Category No.: 9247, 2420; Payload ID: 1858 relates to Category No.: 2890, 6976, 2630; Payload ID: 1859 relates to Category No.: 4030, 4029, 7060, 4010; Payload ID: 1860 relates to Category No.: 7118, 4010; Payload ID: 1861 relates to Category No.: 9305; Payload ID: 1862 relates to Category No.: 5561; Payload ID: 1863 relates to Category No.: 9305, 2890, 2942, 9247, 4010; Payload ID: 1864 relates to Category No.: 4043; Payload ID: 1869 relates to Category No.: 1233, 15627; Payload ID: 1870 relates to Category No.: 14145, 9247, 11715, 6043, 9609, 9242; Payload ID: 1871 relates to Category No.: 5561, 6717, 10056, 1182, 6075, 1777; Payload ID: 1872 relates to Category No.: 9305, 2890, 5762, 9242, 9247, 9158, 2420, 15269, 6066, 10104, 9181; Payload ID: 1873 relates to Category No.: 9305, 2890, 15892, 9247, 9603, 11683; Payload ID: 1874 relates to Category No.: 5561, 2890, 10056; Payload ID: 1875 relates to Category No.: 4030, 4029; Payload ID: 1876 relates to Category No.: 9247, 9305; Payload ID: 1877 relates to Category No.: 9305, 9242;

Payload ID: 1878 relates to Category No.: 2942, 4043, 14329; Payload ID: 1879 relates to Category No.: 6717; Payload ID: 1880 relates to Category No.: 2890, 9247; Payload ID: 1881 relates to Category No.: 5561, 10056, 1036; Payload ID: 1882 relates to Category No.: 4029, 7118; Payload ID: 1883 relates to Category No.: 4010; Payload ID: 1884 relates to Category No.: 4010; Payload ID: 1885 relates to Category No.: 4029, 1842; Payload ID: 1886 relates to Category No.: 5561, 10056, 8935, 8948; Payload ID: 1887 relates to Category No.: 4029, 2890, 4030, 4755, 3036, 1774, 14293, 9730, 6756; Payload ID: 1888 relates to Category No.: 10056, 677, 4049, 4010; Payload ID: 1889 relates to Category No.: 2890, 6717, 10056, 677, 5570, 4755, 4010, 1792, 6743, 6059, 779, 7321; Payload ID: 1890 relates to Category No.: 4029, 12159, 4755, 4030, 6756; Payload ID: 1891 relates to Category No.: 4030, 4029, 2890, 1792, 16326; Payload ID: 1892 relates to Category No.: 4030, 2890; Payload ID: 1893 relates to Category No.: 4030, 4029, 1792, 1256; Payload ID: 1894 relates to Category No.: 4030, 4010; Payload ID: 1895 relates to Category No.: 4030, 4029, 12159, 2890, 6756; Payload ID: 1896 relates to Category No.: 4030, 6756, 1842; Payload ID: 1897 relates to Category No.: 4030, 2890, 6756; Payload ID: 1898 relates to Category No.: 4030, 4029, 4014, 6756; Payload ID: 1899 relates to Category No.: 4030; Payload ID: 1900 relates to Category No.: 4030; Payload ID: 1901 relates to Category No.: 5561, 6717, 10056, 4008, 1659, 5049, 3036, 8948; Payload ID: 1902 relates to Category No.: 6717, 10056, 5570, 12406, 5049, 3036, 8948; Payload ID: 1903 relates to Category No.: 4030, 6717, 10056, 5570, 1659, 14800, 1792, 8951, 2890, 3036, 8948, 1085, 779; Payload ID: 1904 relates to Category No.: 2890; Payload ID: 1905 relates to Category No.: 4029; Payload ID: 1906 relates to Category No.: 4029, 7118, 3036, 3666, 8948; Payload ID: 1907 relates to Category No.: 2942, 6692; Payload ID: 1909 relates to Category No.: 9305, 2890, 9247, 1748; Payload ID: 1910 relates to Category No.: 2890; Payload ID: 1911 relates to Category No.: 4030, 4029; Payload ID: 1912 relates to Category No.: 4029, 4010; Payload ID: 1913 relates to Category No.: 4029; Payload ID: 1914 relates to Category No.: 4030, 4029, 4010; Payload ID: 1915 relates to Category No.: 4030, 4010; Payload ID: 1916 relates to Category No.: 4029, 2890; Payload ID: 1917 relates to Category No.: 4029, 2890; Payload ID: 1918 relates to Category No.: 4029; Payload ID: 1919 relates to Category No.: 4030; Payload ID: 1920 relates to Category No.: 9305, 2890, 2194, 15151, 9247, 1748; Payload ID: 1921 relates to Category No.: 2890, 2194, 3666, 9734; Payload ID: 1922 relates to Category No.: 5561, 10056, 2942, 5570, 3666, 6717, 8935; Payload ID: 1923 relates to Category No.: 5561, 10056, 2942, 5570, 3693; Payload ID: 1924 relates to Category No.: 9305, 10056, 2942, 2890, 8935, 7118, 1711, 6717, 5762; Payload ID: 1925 relates to Category No.: 9305, 2890, 2938, 10056, 1748, 2660, 4860, 4010, 16156, 9215; Payload ID: 1926 relates to Category No.: 2890, 6717; Payload ID: 1927 relates to Category No.: 2890, 9305, 9247, 1323, 1328, 9222; Payload ID: 1928 relates to Category No.: 9305, 2890; Payload ID: 1929 relates to Category No.: 5561; Payload ID: 1930 relates to Category No.: 9305, 2890, 15505; Payload ID: 1931 relates to Category No.: 9305, 2890; Payload ID: 1932 relates to Category No.: 2890, 4010; Payload ID: 1933 relates to Category No.: 5561; Payload ID: 1934 relates to Category No.: 2890, 2899, 9734; Payload ID: 1935 relates to Category No.: 2890, 6717; Payload ID: 1936 relates to Category No.: 9305, 2890, 15505; Payload ID: 1937 relates to Category No.: 2942, 7118, 2890; Payload ID: 1938 relates to Category No.: 7118, 7060; Payload ID: 1939 relates to Category No.: 7118, 7060, 7025; Payload ID: 1940 relates to Category No.: 7118, 7060, 7025; Payload ID: 1941 relates to Category No.: 7118, 7060, 7025; Payload ID: 1942 relates to Category No.: 2890, 2942, 15892, 9184; Payload ID: 1943 relates to Category No.: 9305, 2890, 5762, 9247, 11684; Payload ID: 1944 relates to Category No.: 9305, 2890, 5776, 9242, 15892, 9247, 1323, 1324; Payload ID: 1945 relates to Category No.: 9305, 2890, 9247, 9184; Payload ID: 1946 relates to Category No.: 9305, 15892, 9247, 1323, 1328, 9222; Payload ID: 1947 relates to Category No.: 9305, 2890, 6717; Payload ID: 1948 relates to Category No.: 9305, 9160; Payload ID: 1949 relates to Category No.: 6717, 2942, 1748, 11650, 11653, 4010, 11883, 10056, 2890, 5762; Payload ID: 1950 relates to Category No.: 9305, 2890, 10056, 15892, 14145, 9247, 2420, 11883, 1323, 4392, 1324, 5561, 2628, 2632, 7060; Payload ID: 1951 relates to Category No.: 9305, 2890, 2194, 9247, 14409, 11883, 1325; Payload ID: 1952 relates to Category No.: 2890, 10056, 9242, 2942, 14327, 4228, 6017, 273; Payload ID: 1953 relates to Category No.: 5762; Payload ID: 1954 relates to Category No.: 14584, 9305, 2890, 9247; Payload ID: 1955 relates to Category No.: 14584; Payload ID: 1956 relates to Category No.: 2890, 4010, 11650; Payload ID: 1957 relates to Category No.: 9305, 9242, 9247, 1748, 11691, 14912, 1635, 12218, 3358, 1634; Payload ID: 1958 relates to Category No.: 9305, 2890, 2901, 1750, 5730, 15532, 1772; Payload ID: 1959 relates to Category No.: 1233; Payload ID: 1960 relates to Category No.: 12159, 4029, 4763, 6437, 4030, 677, 15139, 3036; Payload ID: 1961 relates to Category No.: 9247, 15511; Payload ID: 1962 relates to Category No.: 9247; Payload ID: 1963 relates to Category No.: 5561, 7118, 7070; Payload ID: 1964 relates to Category No.: 5561; Payload ID: 1965 relates to Category No.: 2938, 2942, 6017, 4010, 14378; Payload ID: 1966 relates to Category No.: 9305, 2890, 6717, 273, 1017, 5342, 16326, 15758, 9087, 1029, 6230; Payload ID: 1967 relates to Category No.: 2890; Payload ID: 1968 relates to Category No.: 2890, 276; Payload ID: 1969 relates to Category No.: 9305, 2890, 9247, 1323, 1328; Payload ID: 1970 relates to Category No.: 6717, 4010; Payload ID: 1971 relates to Category No.: 9247, 2402, 2415; Payload ID: 1972 relates to Category No.: 2398, 247, 9158; Payload ID: 1973 relates to Category No.: 9247, 9209, 9305, 2628, 9725; Payload ID: 1974 relates to Category No.: 9305, 9242, 2415, 12394; Payload ID: 1975 relates to Category No.: 9305; Payload ID: 1976 relates to Category No.: 9305, 2890, 9247, 7253; Payload ID: 1977 relates to Category No.: 4029, 2942, 7253; Payload ID: 1978 relates to Category No.: 9305, 2890, 9242; Payload ID: 1979 relates to Category No.: 9305; Payload ID: 1980 relates to Category No.: 9305, 9247, 7253, 3036, 9730; Payload ID: 1981 relates to Category No.: 9305, 2890; Payload ID: 1982 relates to Category No.: 9305; Payload ID: 1983 relates to Category No.: 9305, 2890, 9247, 2420, 2632, 9157, 11627; Payload ID: 1984 relates to Category No.: 9305, 2890, 1077; Payload ID: 1985 relates to Category No.: 9305, 7118, 9247, 9153, 15130; Payload ID: 1986 relates to Category No.: 1842; Payload ID: 1987 relates to Category No.: 9247, 9305, 2890, 4010, 9312, 3036, 8935, 1711, 9734; Payload ID: 1988 relates to Category No.: 9305; Payload ID: 1989 relates to Category No.: 9305, 2890, 5776, 10056, 2942, 4043, 6743, 2926; Payload ID: 1990 relates to Category No.: 9305, 9242; Payload ID: 1992 relates to Category No.: 9305; Payload ID: 1993 relates to Category No.: 2903, 11883; Payload ID: 1994 relates to Category No.: 9305, 2890, 9242, 9247; Payload ID: 1995 relates to Category No.: 5561; Payload ID: 1997 relates to Category No.: 4029, 2890, 10056; Payload ID: 1998 relates to Category No.: 2786; Payload ID: 2000 relates to Category No.: 2903; Payload ID: 2001 relates to Category No.: 9305, 2942; Payload ID: 2002 relates to Category No.: 2903; Payload ID: 2003 relates to Category No.: 9305; Payload ID: 2004 relates to Category No.: 2890, 9247; Payload ID: 2006 relates to Category No.: 9305, 2890, 2942, 9247, 2786; Payload ID: 2007 relates to Category No.: 9305, 2890, 2786; Payload ID: 2008 relates to Category No.: 4010; Payload ID: 2009 relates to Category No.: 2890; Payload ID: 2010 relates to Category No.: 9247, 9305, 5561; Payload ID: 2011 relates to Category No.: 2890, 6717, 2942, 9247, 2630, 5964, 2634, 2420, 2192, 2632, 2192; Payload ID: 2012 relates to Category No.: 2890, 6976, 2942, 668, 9734, 2630, 14903, 5964, 2631, 2633; Payload ID: 2013 relates to Category No.: 2942, 9247, 2630, 5964; Payload ID: 2014 relates to Category No.: 9305, 9247, 13741; Payload ID: 2015 relates to Category No.: 9305, 9157, 14912; Payload ID: 2016 relates to Category No.: 2942, 4010, 7118; Payload ID: 2017 relates to Category No.: 4030, 5570, 5561; Payload ID: 2018 relates to Category No.: 5570, 4010; Payload ID: 2019 relates to Category No.: 5561, 4010; Payload ID: 2020 relates to Category No.: 5561, 10056; Payload ID: 2021 relates to Category No.: 5561, 6717, 10056; Payload ID: 2022 relates to Category No.: 5561, 2890, 6717, 10056, 9242, 4755; Payload ID: 2023 relates to Category No.: 5561; Payload ID: 2024 relates to Category No.: 5561, 1842; Payload ID: 2025 relates to Category No.: 5561; Payload ID: 2026 relates to Category No.: 5561; Payload ID: 2027 relates to Category No.: 4029, 1239, 3666, 9164, 4030, 6717, 3671; Payload ID: 2030 relates to Category No.: 9305, 2890, 6717, 5776, 9242, 778, 1774, 9734, 2901; Payload ID: 2031 relates to Category No.: 6722; Payload ID: 2032 relates to Category No.: 9305, 2890, 9242, 9168, 15531; Payload ID: 2033 relates to Category No.: 5561, 4765, 4010; Payload ID: 2034 relates to Category No.: 5561; Payload ID: 2035 relates to Category No.: 4029, 2574, 4030, 2942, 5570; Payload ID: 2036 relates to Category No.: 2574, 4030; Payload ID: 2037 relates to Category No.: 4030, 6717, 1700, 2574, 4010; Payload ID: 2038 relates to Category No.: 4030; Payload ID: 2039 relates to Category No.: 2574, 4010, 5561, 779; Payload ID: 2040 relates to Category No.: 2574, 4030, 5561; Payload ID: 2041 relates to Category No.: 2574, 4030; Payload ID: 2042 relates to Category No.: 4029, 2574; Payload ID: 2043 relates to Category No.: 4029, 2574; Payload ID: 2044 relates to Category No.: 2574, 4010; Payload ID: 2045 relates to Category No.: 4029, 2574; Payload ID: 2047 relates to Category No.: 4029, 9305, 2942; Payload ID: 2048 relates to Category No.: 2194, 2942, 2183, 2182, 2441; Payload ID: 2049 relates to Category No.: 9305, 10056; Payload ID: 2050 relates to Category No.: 10056, 9242, 4228; Payload ID: 2051 relates to Category No.: 10056; Payload ID: 2052 relates to Category No.: 10056; Payload ID: 2053 relates to Category No.: 2890, 6976, 10056, 1720, 2927, 14329; Payload ID: 2055 relates to Category No.: 1842, 5561; Payload ID: 2056 relates to Category No.: 4030, 4029, 10056; Payload ID: 2057 relates to Category No.: 15845; Payload ID: 2059 relates to Category No.: 2942, 15139, 1748, 2927, 2926; Payload ID: 2060 relates to Category No.: 15139, 1748, 2927, 2926, 2899, 11653, 11723; Payload ID: 2061 relates to Category No.: 5561; Payload ID: 2062 relates to Category No.: 9305, 2890, 9247, 4010, 1635; Payload ID: 2063 relates to Category No.: 5561, 4029, 2890, 6717, 10056, 3693, 273, 9734, 1748, 15573, 1803, 6017, 4010, 777, 4228, 493, 1643, 6075, 2918, 2710, 4220; Payload ID: 2064 relates to Category No.: 5561, 6717, 10056; Payload ID: 2065 relates to Category No.: 5561, 6717, 10056, 4010, 2890; Payload ID: 2066 relates to Category No.: 5561, 6717, 10056; Payload ID: 2067 relates to Category No.: 4030, 2890, 6717, 10056, 677, 8935, 4010, 4228, 1659, 4008, 9734, 5561; Payload ID: 2068 relates to Category No.: 5561, 6717, 10056, 4010, 1659, 8917; Payload ID: 2069 relates to Category No.: 5561, 6717, 10056, 4010, 1099; Payload ID: 2070 relates to Category No.: 5561, 6717, 10056, 1099; Payload ID: 2071 relates to Category No.: 5561, 6717, 10056; Payload ID: 2072 relates to Category No.: 5561, 6717, 10056; Payload ID: 2073 relates to Category No.: 5561, 2890, 6717, 10056, 1811, 1803, 6017, 4010, 4228, 1643, 2710, 5596, 1099, 15139, 779, 10063, 4089, 447, 11883; Payload ID: 2074 relates to Category No.: 5561, 6717, 10056; Payload ID: 2075 relates to Category No.: 5561, 6717, 10056; Payload ID: 2076 relates to Category No.: 5561, 6717, 10056, 1811; Payload ID: 2077 relates to Category No.: 5561, 6717, 10056; Payload ID: 2078 relates to Category No.: 5561, 6717, 10056, 1803, 2890; Payload ID: 2079 relates to Category No.: 5561, 6717, 10056; Payload ID: 2080 relates to Category No.: 5561, 6717, 10056, 1748, 1811, 1792, 1182, 4008, 1772, 447; Payload ID: 2081 relates to Category No.: 5561, 6717, 10056, 4010; Payload ID: 2082 relates to Category No.: 5561, 6717, 10056; Payload ID: 2083 relates to Category No.: 5561, 6717, 10056, 1033, 15145; Payload ID: 2084 relates to Category No.: 5561, 6717, 10056; Payload ID: 2085 relates to Category No.: 5561, 6717, 10056, 5570, 9247; Payload ID: 2086 relates to Category No.: 5561, 2890, 6717, 10056; Payload ID: 2087 relates to Category No.: 5561, 6717, 10056; Payload ID: 2088 relates to Category No.: 3666; Payload ID: 2089 relates to Category No.: 5561, 6717, 10056, 2942, 14953, 2194, 15139, 10000, 14955, 5971; Payload ID: 2090 relates to Category No.: 6717, 10056, 5570, 10003, 5561; Payload ID: 2091 relates to Category No.: 5561, 6717, 10056, 1748, 4010, 1335, 779; Payload ID: 2092 relates to Category No.: 6717, 5561, 10056; Payload ID: 2093 relates to Category No.: 5561, 6717, 10056; Payload ID: 2094 relates to Category No.: 5561, 6717, 10056, 4010, 2534; Payload ID: 2095 relates to Category No.: 9305, 2942, 15139, 8948, 3036, 1017, 4010, 2890, 5762, 8935, 1711, 15280; Payload ID: 2096 relates to Category No.: 9305, 2890, 2942, 8935, 15139, 4402, 15280; Payload ID: 2097 relates to Category No.: 2890, 9247, 493; Payload ID: 2098 relates to Category No.: 9305, 2890, 10056, 4765, 3666, 15627, 6968, 4010, 4228, 3685, 2942; Payload ID: 2099 relates to Category No.: 9305, 2890, 10056; Payload ID: 2100 relates to Category No.: 2890, 4010; Payload ID: 2101 relates to Category No.: 5561, 6717, 10056, 2942, 5570, 2458, 262; Payload ID: 2102 relates to Category No.: 5561, 6443, 6717, 10056, 5570, 3693, 3666; Payload ID: 2103 relates to Category No.: 4030, 4029, 2890, 2942, 8948, 5762, 1017, 8935, 15280, 9305; Payload ID: 2104 relates to Category No.: 4029, 1700; Payload ID: 2105 relates to Category No.: 5561, 3673, 4010, 4760; Payload ID: 2106 relates to Category No.: 9305, 2890, 6717, 2194, 10056, 8935, 3666, 9247, 4755, 9734, 14363, 8948, 6017, 4860, 4010, 1772, 779, 16156, 14329, 4202, 3036, 1017; Payload ID: 2107 relates to Category No.: 2890, 2942, 14953, 14363, 1239, 10002, 10000, 8917, 7349; Payload ID: 2110 relates to Category No.: 9305, 2890, 5776, 9157; Payload ID: 2111 relates to Category No.: 9305, 2890, 6717, 2938, 5776, 9734, 997, 1001, 2926; Payload ID: 2112 relates to Category No.: 4030, 2938, 10056, 4765, 9734, 1748, 1720, 11650, 11653; Payload ID: 2113 relates to Category No.: 10056, 4755, 9734; Payload ID: 2114 relates to Category No.: 2942, 4010, 14497, 11883; Payload ID: 2115 relates to Category No.: 2942, 4010; Payload ID: 2116 relates to Category No.: 4029, 2942, 15139, 15280; Payload ID: 2117 relates to Category No.: 2942; Payload ID: 2118 relates to Category No.: 5561, 10056, 9734, 15574; Payload ID: 2119 relates to Category No.: 9305, 2890, 14825, 2938, 9242, 7244, 14833, 14823; Payload ID: 2120 relates to Category No.: 5561, 10056, 1842, 5571; Payload ID: 2121 relates to Category No.: 16247, 4010, 15758, 14368; Payload ID: 2122 relates to Category No.: 16247, 10056; Payload ID: 2123 relates to Category No.: 16247; Payload ID: 2124 relates to Category No.: 16247; Payload ID: 2125 relates to Category No.: 16247, 15758, 14368; Payload ID: 2126 relates to Category No.: 16247, 5570, 14363; Payload ID: 2127 relates to Category No.: 16247, 6717, 2942, 779; Payload ID: 2128 relates to Category No.: 10056, 2942, 16247, 15139, 2918; Payload ID: 2129 relates to Category No.: 5561, 14409; Payload ID: 2130 relates to Category No.: 5561, 16247, 5762; Payload ID: 2131 relates to Category No.: 5561, 10056, 16247, 657, 3638; Payload ID: 2132 relates to Category No.: 5561, 10056, 16247, 657, 3638; Payload ID: 2133 relates to Category No.: 5561, 10056, 16247, 5570, 657, 3638; Payload ID: 2134 relates to Category No.: 5561, 1748, 11650, 657, 11653; Payload ID: 2135 relates to Category No.: 5561, 16247; Payload ID: 2136 relates to Category No.: 5561, 16247, 657; Payload ID: 2137 relates to Category No.: 5561, 10056, 16247, 1748, 11650, 657, 11653, 3638; Payload ID: 2138 relates to Category No.: 16247, 6717, 5561, 2890, 10056, 2942, 11650, 16326, 3054, 8948, 1661; Payload ID: 2139 relates to Category No.: 6717, 10056, 16247, 16326; Payload ID: 2140 relates to Category No.: 5561, 6717, 10056, 16247; Payload ID: 2141 relates to Category No.: 6717, 16247, 2890, 10056, 5342, 15758, 14368; Payload ID: 2142 relates to Category No.: 6717, 10056, 8948, 3036, 16247; Payload ID: 2143 relates to Category No.: 5561, 9305, 2890, 6717, 10056, 2942, 1774, 8948, 3036, 16247; Payload ID: 2144 relates to Category No.: 6717, 10056, 16247; Payload ID: 2145 relates to Category No.: 6717, 10056, 16247, 5561; Payload ID: 2146 relates to Category No.: 5561, 6717, 10056, 16247, 14363, 1659; Payload ID: 2147 relates to Category No.: 6717, 10056, 16247; Payload ID: 2148 relates to Category No.: 2890, 6717, 9734, 14371; Payload ID: 2149 relates to Category No.: 3673, 5570; Payload ID: 2150 relates to Category No.: 5570; Payload ID: 2151 relates to Category No.: 5570; Payload ID: 2152 relates to Category No.: 5561, 6717, 3666; Payload ID: 2153 relates to Category No.: 2942, 9535, 2903, 4010, 2897, 2890; Payload ID: 2154 relates to Category No.: 9305, 2890, 6717, 5762, 9242, 4755; Payload ID: 2155 relates to Category No.: 2890; Payload ID: 2156 relates to Category No.: 9305, 9247, 9242; Payload ID: 2157 relates to Category No.: 9305, 2890, 5762; Payload ID: 2158 relates to Category No.: 9305, 2890; Payload ID: 2159 relates to Category No.: 10056, 4765, 3652, 1398, 2890, 8935; Payload ID: 2160 relates to Category No.: 9305, 7118, 10056, 2942, 9247, 1748, 11723, 3638, 8951; Payload ID: 2161 relates to Category No.: 6976, 10056, 2942, 9247, 14371, 3638, 8951, 14903, 3036, 11650, 9730; Payload ID: 2162 relates to Category No.: 9305, 2890, 6717, 10056, 2942, 9247, 14363, 14371, 3638, 1402, 8948, 5596, 1029, 15758, 8917, 14368, 11883, 9734; Payload ID: 2163 relates to Category No.: 6717, 10056, 2942, 9247, 14371, 3638, 8951; Payload ID: 2164 relates to Category No.: 1748, 11650, 11653, 15139, 3036, 8948; Payload ID: 2165 relates to Category No.: 9305, 2194, 2942; Payload ID: 2166 relates to Category No.: 2890, 9242, 2942, 9247, 4010, 9305; Payload ID: 2167 relates to Category No.: 9305, 2942; Payload ID: 2168 relates to Category No.: 9305, 2890, 5762, 1774; Payload ID: 2169 relates to Category No.: 2890, 10056, 9242, 2942, 273, 11723, 1811, 1090, 4228, 9181, 9178, 2446, 9305, 6717, 1099, 15139, 16156; Payload ID: 2170 relates to Category No.: 7048, 7244, 2890; Payload ID: 2171 relates to Category No.: 5561, 10056, 5570, 9305, 2890, 6717, 1099, 1792, 1017, 8935, 8948, 1033, 779; Payload ID: 2172 relates to Category No.: 2890, 9247, 1154, 4010, 9164; Payload ID: 2173 relates to Category No.: 5561, 5570, 2927, 2926; Payload ID: 2174 relates to Category No.: 9305, 2890, 10056, 4010, 16156; Payload ID: 2176 relates to Category No.: 2890; Payload ID: 2177 relates to Category No.: 2938, 10056, 2942, 273, 7389, 6717, 268; Payload ID: 2178 relates to Category No.: 9305, 2786, 2934; Payload ID: 2179 relates to Category No.: 5561, 3673, 3666, 9162; Payload ID: 2180 relates to Category No.: 5561, 2890; Payload ID: 2181 relates to Category No.: 4029, 9305, 2890, 2194, 10056, 2942, 14906, 9247, 14364, 14902, 4010, 16156, 1402, 8935, 4860; Payload ID: 2182 relates to Category No.: 4029, 9305, 2890, 2194, 10056, 2942, 14906, 9247, 14364, 14902, 4010, 16156, 1402, 8935, 4860; Payload ID: 2183 relates to Category No.: 4029, 9305, 2890, 2194, 10056, 2942, 14906, 9247, 14364, 14902, 4010, 16156, 1402, 8935, 4860; Payload ID: 2184 relates to Category No.: 9305, 2890; Payload ID: 2185 relates to Category No.: 9305; Payload ID: 2186 relates to Category No.: 2890, 6960; Payload ID: 2187 relates to Category No.: 2890, 2194, 6972; Payload ID: 2188 relates to Category No.: 2890, 2194, 16337, 6972; Payload ID: 2189 relates to Category No.: 4010; Payload ID: 2191 relates to Category No.: 4010; Payload ID: 2192 relates to Category No.: 9305, 2890; Payload ID: 2193 relates to Category No.: 9305, 4755, 2890; Payload ID: 2194 relates to Category No.: 5561, 10056, 9734, 15574; Payload ID: 2195 relates to Category No.: 3666, 6717, 3673, 4010, 6709, 3671, 5560, 3848, 5561, 7366, 2890, 14174, 11883, 1017, 3055, 8948, 14293, 14683, 3037; Payload ID: 2196 relates to Category No.: 5762, 2890, 6717, 10056, 2942, 4010, 4228, 7118, 6443; Payload ID: 2197 relates to Category No.: 7118, 2890, 5762, 10056, 1700, 2942; Payload ID: 2198 relates to Category No.: 2890, 5762, 262; Payload ID: 2199 relates to Category No.: 2890, 5762; Payload ID: 2200 relates to Category No.: 2890, 5762; Payload ID: 2201 relates to Category No.: 5762, 9247, 2890; Payload ID: 2202 relates to Category No.: 2890, 5762; Payload ID: 2203 relates to Category No.: 5762, 2890, 10056, 2942, 3666, 4755, 3036, 4010, 6743, 4228, 2710, 9732, 12219, 9305, 6443, 2402; Payload ID: 2204 relates to Category No.: 9305, 2890, 5762, 10056, 2942, 11883, 16326, 7389, 15758; Payload ID: 2205 relates to Category No.: 2890, 5762, 4010, 1792, 4228; Payload ID: 2206 relates to Category No.: 2890, 5762, 9734, 14902, 6960; Payload ID: 2207 relates to Category No.: 2890, 5762, 9247, 4010; Payload ID: 2208 relates to Category No.: 2890, 5762, 4755; Payload ID: 2209 relates to Category No.: 2890, 5762, 1842; Payload ID: 2210 relates to Category No.: 2890, 6717, 10056, 2942, 4010; Payload ID: 2211 relates to Category No.: 2890, 10056; Payload ID: 2212 relates to Category No.: 2890, 6717, 2942, 9305; Payload ID: 2213 relates to Category No.: 2938, 4228; Payload ID: 2214 relates to Category No.: 6717, 2938, 1811, 4010, 4228, 14999; Payload ID: 2215 relates to Category No.: 2890, 273, 4228, 3036, 3055, 8948, 11650; Payload ID: 2216 relates to Category No.: 4030, 4029, 9305, 2890, 6717, 5762, 2942, 12159, 3666, 9734, 10162, 4010, 1792, 4228, 3671, 14370, 6932, 5560, 3637, 4008, 4755, 4014, 11883, 5776, 262, 14368, 14683; Payload ID: 2217 relates to Category No.: 3666, 3671; Payload ID: 2218 relates to Category No.: 7118, 3666, 7060, 14371, 14368, 14683, 14370, 2890, 4755, 7389, 5776, 15758, 14363, 5342, 15282, 15283; Payload ID: 2219 relates to Category No.: 2890, 5762, 16247, 14371, 14368, 16326, 5920, 14370, 1402, 5919; Payload ID: 2220 relates to Category No.: 9305, 6717, 4765, 3673, 1748, 11653, 4010, 1792, 5561, 4029, 8951; Payload ID: 2221 relates to Category No.: 5561, 6717, 4765, 3673, 1792, 11653, 8951; Payload ID: 2222 relates to Category No.: 6717, 5561, 4765, 3673, 4010, 1792, 11883, 11653, 8951; Payload ID: 2223 relates to Category No.: 4029, 6717, 3666, 4755, 6709, 14370, 5776, 3671; Payload ID: 2224 relates to Category No.: 10056, 2927; Payload ID: 2225 relates to Category No.: 9305, 9247, 9167, 918, 15505, 9157, 7118, 7060, 1017, 2402; Payload ID: 2226 relates to Category No.: 5561, 9305, 2890, 6717, 2942, 4765, 3673, 3666, 4755, 8948, 5557, 9155; Payload ID: 2227 relates to Category No.: 5561, 9305, 3673, 3666; Payload ID: 2228 relates to Category No.: 5561, 9305, 3673, 3666; Payload ID: 2229 relates to Category No.: 5561, 9305, 6717, 3673, 3666; Payload ID: 2230 relates to Category No.: 5561, 9305, 4765, 3673, 3666, 4755; Payload ID: 2231 relates to Category No.: 9305, 4010; Payload ID: 2232 relates to Category No.: 9305; Payload ID: 2233 relates to Category No.: 9305, 2890, 15505; Payload ID: 2234 relates to Category No.: 2890, 9247; Payload ID: 2235 relates to Category No.: 2890, 1842; Payload ID: 2239 relates to Category No.: 2942, 9734, 3991, 9215, 2890, 9305, 14145; Payload ID: 2240 relates to Category No.: 4755, 5561; Payload ID: 2241 relates to Category No.: 9305, 2890, 2942, 9247, 2630, 4010, 262; Payload ID: 2242 relates to Category No.: 2890; Payload ID: 2243 relates to Category No.: 2890; Payload ID: 2244 relates to Category No.: 2194; Payload ID: 2247 relates to Category No.: 5561, 9305, 10056; Payload ID: 2270 relates to Category No.: 5561, 10056, 5570, 4860, 1017, 5776, 6743; Payload ID: 2271 relates to Category No.: 5561, 10056, 5570, 3036, 9730, 8935, 8948, 4043; Payload ID: 2272 relates to Category No.: 7366; Payload ID: 2274 relates to Category No.: 5570, 3666; Payload ID: 2275 relates to Category No.: 3671; Payload ID: 2276 relates to Category No.: 4029; Payload ID: 2277 relates to Category No.: 2890, 9247, 9305; Payload ID: 2278 relates to Category No.: 5561, 9305, 2890; Payload ID: 2279 relates to Category No.: 10056, 4010, 4228, 2890, 2710; Payload ID: 2280 relates to Category No.: 10056, 8951; Payload ID: 2281 relates to Category No.: 2890, 6978, 6960, 2194, 5727, 2942, 3693, 2927, 6968, 14327, 5964, 6475, 2901; Payload ID: 2282 relates to Category No.: 6964, 2901, 6978, 6015, 3053; Payload ID: 2283 relates to Category No.: 10056, 2942, 15573, 12440, 6743, 3523, 4769, 15574; Payload ID: 2284 relates to Category No.: 5561; Payload ID: 2285 relates to Category No.: 9305; Payload ID: 2286 relates to Category No.: 4029, 2938, 2942, 273, 16269, 4073, 4010; Payload ID: 2287 relates to Category No.: 5561, 4029, 2942, 273, 4073, 4010, 6717, 2712, 1335; Payload ID: 2288 relates to Category No.: 9305, 4073, 6717, 262, 2712, 2890; Payload ID: 2289 relates to Category No.: 2890, 276, 4073, 2938, 2942, 273, 16269, 14364, 4010, 6017, 6717, 262, 2712, 1335; Payload ID: 2290 relates to Category No.: 9305, 2890, 9242, 9247, 2183, 4073, 4010, 6709, 7161, 4216; Payload ID: 2291 relates to Category No.: 9305, 2890, 2194, 9247, 7118, 12406; Payload ID: 2292 relates to Category No.: 2890, 9242, 7060, 7068, 7118, 11883, 7048; Payload ID: 2293 relates to Category No.: 9305, 2890, 6717, 10056, 2942, 9247, 8948, 4010, 1774, 9181, 15280, 11883; Payload ID: 2294 relates to Category No.: 5561, 6717, 4765, 4755; Payload ID: 2295 relates to Category No.: 5561, 6717, 4765, 5559; Payload ID: 2296 relates to Category No.: 5561, 4765; Payload ID: 2297 relates to Category No.: 5561, 4765; Payload ID: 2298 relates to Category No.: 5561, 4765; Payload ID: 2299 relates to Category No.: 5561, 4765, 4010; Payload ID: 2300 relates to Category No.: 5561, 4765; Payload ID: 2301 relates to Category No.: 5561, 4029, 4765; Payload ID: 2302 relates to Category No.: 5561, 4765; Payload ID: 2303 relates to Category No.: 5561, 4765, 15573, 5818; Payload ID: 2304 relates to Category No.: 5561, 4765, 4755, 5818; Payload ID: 2305 relates to Category No.: 5561, 4765, 4755; Payload ID: 2306 relates to Category No.: 5561, 4765; Payload ID: 2307 relates to Category No.: 5561, 4765, 15573, 5818; Payload ID: 2308 relates to Category No.: 7118, 1842, 2942; Payload ID: 2309 relates to Category No.: 5561, 6717, 4765, 4755; Payload ID: 2310 relates to Category No.: 2942, 4010, 2890; Payload ID: 2311 relates to Category No.: 2890, 10056, 2942, 4010, 778, 7366, 4030, 1099, 1017, 6989; Payload ID: 2312 relates to Category No.: 2942; Payload ID: 2313 relates to Category No.: 6717, 10056, 4755, 9734, 15573, 4010, 1792, 676, 14412, 779, 1336, 3685, 14293, 15628, 678, 677, 5561; Payload ID: 2314 relates to Category No.: 5561, 10056, 9242, 6991, 1099; Payload ID: 2315 relates to Category No.: 7118, 7060; Payload ID: 2316 relates to Category No.: 7118, 7060; Payload ID: 2317 relates to Category No.: 4030, 4029, 4010, 2890, 2942; Payload ID: 2318 relates to Category No.: 2942; Payload ID: 2319 relates to Category No.: 2890; Payload ID: 2320 relates to Category No.: 1842; Payload ID: 2321 relates to Category No.: 4029, 1099; Payload ID: 2322 relates to Category No.: 5561, 10056; Payload ID: 2323 relates to Category No.: 2942, 5776, 7366; Payload ID: 2324 relates to Category No.: 5561, 10056; Payload ID: 2325 relates to Category No.: 2942, 4010, 4032; Payload ID: 2326 relates to Category No.: 4030, 2890, 2942, 9247; Payload ID: 2327 relates to Category No.: 7060, 7118; Payload ID: 2328 relates to Category No.: 2942, 4030, 4755, 11883, 5776, 6743, 16344, 14293, 1842; Payload ID: 2329 relates to Category No.: 4030, 3671; Payload ID: 2330 relates to Category No.: 4030, 3666, 3671; Payload ID: 2331 relates to Category No.: 4030, 4010, 3671; Payload ID: 2332 relates to Category No.: 4030; Payload ID: 2333 relates to Category No.: 4030; Payload ID: 2334 relates to Category No.: 2942, 4010; Payload ID: 2335 relates to Category No.: 4030; Payload ID: 2336 relates to Category No.: 4030, 4029, 16065; Payload ID: 2337 relates to Category No.: 4030, 4029, 15627, 14409; Payload ID: 2338 relates to Category No.: 4030, 1842; Payload ID: 2339 relates to Category No.: 4030; Payload ID: 2340 relates to Category No.: 4030, 12159; Payload ID: 2341 relates to Category No.: 4030; Payload ID: 2342 relates to Category No.: 4010, 4030; Payload ID: 2343 relates to Category No.: 5561, 6717, 4010; Payload ID: 2344 relates to Category No.: 9305, 10056, 4755, 4010, 14412, 15628; Payload ID: 2345 relates to Category No.: 5561, 10056, 677, 4010, 1792; Payload ID: 2346 relates to Category No.: 4030; Payload ID: 2347 relates to Category No.: 4029, 1239, 4010; Payload ID: 2348 relates to Category No.: 4030; Payload ID: 2349 relates to Category No.: 4030, 6443, 2890, 3666, 4755, 4010; Payload ID: 2350 relates to Category No.: 4030; Payload ID: 2351 relates to Category No.: 4030, 4014; Payload ID: 2352 relates to Category No.: 12159, 4010; Payload ID: 2353 relates to Category No.: 4010; Payload ID: 2354 relates to Category No.: 5561, 6717, 10056, 5570, 4010; Payload ID: 2355 relates to Category No.: 4030, 14955; Payload ID: 2357 relates to Category No.: 5561; Payload ID: 2358 relates to Category No.: 5561; Payload ID: 2359 relates to Category No.: 5561; Payload ID: 2360 relates to Category No.: 5561; Payload ID: 2361 relates to Category No.: 6717, 5570, 5561; Payload ID: 2362 relates to Category No.: 677, 5570, 1099, 4010, 5558; Payload ID: 2363 relates to Category No.: 4030, 10056, 677, 5570; Payload ID: 2364 relates to Category No.: 5561, 10056, 677; Payload ID: 2365 relates to Category No.: 4030, 10056, 677, 5570, 4010;

Payload ID: 2366 relates to Category No.: 5561, 6717, 7048, 7118; Payload ID: 2367 relates to Category No.: 9734, 6449, 2738; Payload ID: 2368 relates to Category No.: 4030, 4029; Payload ID: 2369 relates to Category No.: 4029, 5762, 4010, 2769, 2531; Payload ID: 2370 relates to Category No.: 7118, 7048, 3666, 9756, 9753; Payload ID: 2371 relates to Category No.: 5776, 9756, 9753, 7118; Payload ID: 2372 relates to Category No.: 7118, 6717, 7070, 5564, 7048, 5561, 5776; Payload ID: 2373 relates to Category No.: 5561, 7118, 7070, 5776; Payload ID: 2374 relates to Category No.: 3666, 15139, 1748, 3036, 7070, 1017, 7118, 657, 3673, 5561; Payload ID: 2375 relates to Category No.: 7118, 7048, 9242, 9247; Payload ID: 2376 relates to Category No.: 4029; Payload ID: 2377 relates to Category No.: 9305, 2942; Payload ID: 2378 relates to Category No.: 1842; Payload ID: 2379 relates to Category No.: 4030, 14409; Payload ID: 2380 relates to Category No.: 12159, 4010, 4860; Payload ID: 2381 relates to Category No.: 4030, 12159, 3666, 3671, 6454; Payload ID: 2382 relates to Category No.: 12159, 4010; Payload ID: 2383 relates to Category No.: 4030, 12159, 4014, 4010; Payload ID: 2384 relates to Category No.: 4029, 4030, 12159, 4014, 4010; Payload ID: 2385 relates to Category No.: 2890, 2938, 4228; Payload ID: 2386 relates to Category No.: 5561; Payload ID: 2387 relates to Category No.: 4030, 4029; Payload ID: 2388 relates to Category No.: 4029; Payload ID: 2389 relates to Category No.: 4030, 4029; Payload ID: 2390 relates to Category No.: 2890, 6717, 2194, 5934, 2942, 2630, 11728, 7274, 9215, 14145; Payload ID: 2391 relates to Category No.: 2890; Payload ID: 2392 relates to Category No.: 2890, 9305, 2194, 10056, 2942, 4765, 4755, 9734, 14902, 14893, 3686, 8935; Payload ID: 2393 relates to Category No.: 9305, 2890, 2942, 14145; Payload ID: 2394 relates to Category No.: 2890; Payload ID: 2395 relates to Category No.: 2890, 6717, 2942; Payload ID: 2396 relates to Category No.: 2890; Payload ID: 2397 relates to Category No.: 9305, 10056, 2942, 9311, 14583, 9603; Payload ID: 2399 relates to Category No.: 9305, 2942, 9603; Payload ID: 2400 relates to Category No.: 11988, 9305, 2890, 10056, 2942, 4010, 9603; Payload ID: 2401 relates to Category No.: 7118, 2890, 7048, 9247, 7060, 7068, 3664, 7040; Payload ID: 2402 relates to Category No.: 7118, 7060, 3664; Payload ID: 2403 relates to Category No.: 2890; Payload ID: 2404 relates to Category No.: 2890; Payload ID: 2405 relates to Category No.: 9305, 2890; Payload ID: 2406 relates to Category No.: 2890, 2942, 3008, 14187, 6743, 1688; Payload ID: 2407 relates to Category No.: 2890, 5853, 2942, 9073, 499, 9072, 4029, 7118; Payload ID: 2408 relates to Category No.: 2890, 2942, 14187, 1688; Payload ID: 2409 relates to Category No.: 2890, 3666; Payload ID: 2410 relates to Category No.: 9305, 2890, 4010, 5934; Payload ID: 2411 relates to Category No.: 9305, 2890, 2942, 6717, 7118; Payload ID: 2412 relates to Category No.: 2890, 9305, 10056, 2942, 9247, 6743, 3008; Payload ID: 2413 relates to Category No.: 7118, 2890, 3673, 3666, 5853, 9073, 499; Payload ID: 2414 relates to Category No.: 2890, 9072; Payload ID: 2415 relates to Category No.: 2890, 2942, 9247; Payload ID: 2416 relates to Category No.: 9305, 2890, 2942, 9247, 5776; Payload ID: 2418 relates to Category No.: 7118, 2890, 6976, 2938, 2942, 9247, 7070, 3008, 14187, 1688, 9305, 9081, 11883, 6743, 8935, 1711; Payload ID: 2419 relates to Category No.: 2890, 2942, 789, 9305, 7118; Payload ID: 2421 relates to Category No.: 2890, 1663; Payload ID: 2422 relates to Category No.: 2890, 10056, 2942, 4010, 6743, 15206, 5392; Payload ID: 2423 relates to Category No.: 2890, 10056; Payload ID: 2425 relates to Category No.: 2890; Payload ID: 2426 relates to Category No.: 1842; Payload ID: 2427 relates to Category No.: 5561, 9305, 2942, 3673, 7061; Payload ID: 2429 relates to Category No.: 9305, 2890, 9247, 9073; Payload ID: 2430 relates to Category No.: 2890, 10056, 2942; Payload ID: 2431 relates to Category No.: 2890, 5776, 9247; Payload ID: 2432 relates to Category No.: 4030, 4029; Payload ID: 2433 relates to Category No.: 2255, 9167, 5904, 9305; Payload ID: 2434 relates to Category No.: 7118; Payload ID: 2436 relates to Category No.: 7118, 6717, 5776, 9756, 9754, 4010, 4228, 9753, 2942, 4030, 10056, 4755, 3666, 7052, 6443; Payload ID: 2437 relates to Category No.: 5561, 6717, 10056, 2942, 4010, 7118, 11653, 3036, 1017, 3055, 1711; Payload ID: 2438 relates to Category No.: 5561, 7118; Payload ID: 2439 relates to Category No.: 2942, 447, 10056, 273, 1811, 4228, 1643, 6017, 1803, 5596, 4220, 16337, 2890, 262; Payload ID: 2440 relates to Category No.: 2890, 2942, 273, 447, 1017, 1803, 6017, 1099, 8951; Payload ID: 2441 relates to Category No.: 2890, 2938, 4089, 6017, 447; Payload ID: 2442 relates to Category No.: 2938, 10056, 2942, 5762; Payload ID: 2443 relates to Category No.: 9305, 2890, 6717, 15505, 2194, 10056, 2942, 14906, 9247, 9734, 1748, 1720, 1154, 1099, 447, 1811, 1803, 4010, 1772, 4228, 11883, 1643, 6075, 9167, 12170, 1156, 1182, 6017, 5596, 16326, 777, 9220, 778, 1777, 4089, 6991, 14390, 4220, 1645, 15139, 8935, 3054; Payload ID: 2444 relates to Category No.: 9305, 2890, 10056, 2942, 6994, 1811, 4010, 15139, 3055, 6017, 4860, 16337; Payload ID: 2445 relates to Category No.: 9305, 2890, 3036, 447, 9730, 11650, 8935; Payload ID: 2446 relates to Category No.: 9305, 2890, 2942, 9247, 1154; Payload ID: 2447 relates to Category No.: 9305, 2890, 6717, 9247, 14912, 12218; Payload ID: 2448 relates to Category No.: 4029, 2890, 4030, 1774; Payload ID: 2449 relates to Category No.: 7118, 6443, 6717, 5776, 3666, 9247, 4010, 6437; Payload ID: 2450 relates to Category No.: 4030, 6443, 4029, 5762, 5776, 9242, 9734, 4010, 6709, 3650, 7118, 2890, 4008, 1659, 1792, 779, 14363; Payload ID: 2451 relates to Category No.: 4030, 6443, 6717, 4765, 4010, 3671, 3831, 3686, 4755, 3666; Payload ID: 2452 relates to Category No.: 4030, 6443, 4029, 4014, 4010, 6743, 6709, 6437; Payload ID: 2453 relates to Category No.: 3693, 4010; Payload ID: 2454 relates to Category No.: 4030, 6443, 4010, 6437, 4032; Payload ID: 2455 relates to Category No.: 4030, 4029, 9305, 2890, 10056, 4014, 14409, 4010, 1792; Payload ID: 2456 relates to Category No.: 4030, 6443, 2942, 4010, 603, 7323; Payload ID: 2457 relates to Category No.: 4030, 6443, 4029, 3650, 2890; Payload ID: 2458 relates to Category No.: 4030, 6443, 4029, 9305, 4010, 6437, 3650; Payload ID: 2459 relates to Category No.: 4030, 6443; Payload ID: 2460 relates to Category No.: 4030, 6443, 4029, 5776, 6437, 3650, 6717; Payload ID: 2461 relates to Category No.: 4030, 6443, 4029, 4010, 6437, 9305, 2926, 9242, 2890, 4008, 8935, 778, 14409, 9730, 6989, 16065; Payload ID: 2462 relates to Category No.: 4030, 6443, 6717; Payload ID: 2463 relates to Category No.: 4030, 6443, 5776, 10056, 4765, 3666, 4010, 3671, 3831, 3686; Payload ID: 2464 relates to Category No.: 6717, 10056, 7244, 1657; Payload ID: 2465 relates to Category No.: 6717, 10056, 7244, 1657, 14826; Payload ID: 2466 relates to Category No.: 6717, 10056, 7244, 1657, 3666, 262; Payload ID: 2467 relates to Category No.: 5561, 6717, 10056, 1657, 262, 14833; Payload ID: 2468 relates to Category No.: 10056, 2458, 1657; Payload ID: 2469 relates to Category No.: 14833, 10056, 1657; Payload ID: 2470 relates to Category No.: 14833, 1657, 10056; Payload ID: 2471 relates to Category No.: 9305; Payload ID: 2472 relates to Category No.: 9305, 9247, 11883, 2632, 15531; Payload ID: 2473 relates to Category No.: 9305; Payload ID: 2474 relates to Category No.: 6717, 5762, 10056, 4765, 3673, 3693, 3666, 9734, 1099, 6222, 2926, 6743, 4228, 3523, 11883, 779, 1659, 3638, 16111, 5570, 2458, 5561, 4755, 1720, 261, 2890, 2942, 7118, 9754, 1792, 1085; Payload ID: 2475 relates to Category No.: 9305, 6717, 5762, 10056, 4765, 5570, 4043, 15627, 4755, 9734, 2926, 6743, 4228, 11883, 1659, 261, 5561; Payload ID: 2476 relates to Category No.: 10056, 2942, 4765, 3666, 14363, 8917, 6743, 16326, 1659, 3518, 15758, 6717, 2890, 11883, 1792, 16156, 5596; Payload ID: 2477 relates to Category No.: 9305, 2890, 10056, 2942, 9247, 6743; Payload ID: 2478 relates to Category No.: 9305, 4010; Payload ID: 2479 relates to Category No.: 9305, 2890, 10056, 2942, 4220; Payload ID: 2480 relates to Category No.: 15892, 9215; Payload ID: 2481 relates to Category No.: 9305, 2890, 2942; Payload ID: 2482 relates to Category No.: 9305, 2890, 9157; Payload ID: 2483 relates to Category No.: 9305, 2890; Payload ID: 2484 relates to Category No.: 2890, 9734; Payload ID: 2485 relates to Category No.: 9305, 9242, 14253, 15505; Payload ID: 2486 relates to Category No.: 9305, 2890, 9247, 2391, 9181, 2628, 2192, 9157; Payload ID: 2487 relates to Category No.: 9305; Payload ID: 2488 relates to Category No.: 9247; Payload ID: 2489 relates to Category No.: 9305, 9247; Payload ID: 2490 relates to Category No.: 9305; Payload ID: 2491 relates to Category No.: 9305, 9242, 2420, 2192, 9247, 2628; Payload ID: 2492 relates to Category No.: 9305, 2890; Payload ID: 2494 relates to Category No.: 9305, 2942, 3666; Payload ID: 2495 relates to Category No.: 4030, 4029; Payload ID: 2496 relates to Category No.: 4030, 6717, 2942, 9247, 2903, 9754, 1674, 1675; Payload ID: 2497 relates to Category No.: 9305, 6717, 2942, 1674; Payload ID: 2498 relates to Category No.: 9305, 2942, 1674; Payload ID: 2499 relates to Category No.: 9305, 2890, 6717, 2942, 2903, 1674, 1675; Payload ID: 2500 relates to Category No.: 9305, 2942, 2903, 1674, 1675; Payload ID: 2501 relates to Category No.: 9305, 2942, 1674; Payload ID: 2502 relates to Category No.: 9305, 6717, 2942, 1674; Payload ID: 2503 relates to Category No.: 9305, 2890, 2942, 1674; Payload ID: 2504 relates to Category No.: 9305, 6717, 2942, 2903, 1674, 1675, 2890; Payload ID: 2505 relates to Category No.: 9305, 5762, 2942, 2903, 1674, 1675; Payload ID: 2506 relates to Category No.: 5776, 6756, 6440; Payload ID: 2507 relates to Category No.: 5776, 6756, 6440; Payload ID: 2508 relates to Category No.: 5561, 10056, 4010; Payload ID: 2509 relates to Category No.: 4030, 4029, 10056, 677, 1792; Payload ID: 2510 relates to Category No.: 4030, 4029, 10056, 4010, 3696, 676, 6246, 4008, 6743, 1792; Payload ID: 2511 relates to Category No.: 5561, 6717, 10056, 2942, 5570, 1090, 4228; Payload ID: 2512 relates to Category No.: 10056, 678, 5561; Payload ID: 2513 relates to Category No.: 4029, 6717, 10056, 5570, 3638, 5561; Payload ID: 2514 relates to Category No.: 5561, 4029, 6717, 10056; Payload ID: 2515 relates to Category No.: 6443, 4029, 10056, 5570, 3693, 3696, 6440, 5561; Payload ID: 2516 relates to Category No.: 5561; Payload ID: 2517 relates to Category No.: 10056, 677, 4010; Payload ID: 2518 relates to Category No.: 5561, 10056; Payload ID: 2519 relates to Category No.: 5762, 10056, 5570, 4008, 4010, 11883, 5561; Payload ID: 2520 relates to Category No.: 10056, 5570, 3696; Payload ID: 2521 relates to Category No.: 5561, 10056, 3696, 1792, 6440; Payload ID: 2522 relates to Category No.: 10056, 5570, 3696; Payload ID: 2523 relates to Category No.: 2890, 5570, 3696, 1792, 6440; Payload ID: 2524 relates to Category No.: 10056, 4765, 5570, 3521, 6059, 6437; Payload ID: 2525 relates to Category No.: 9305, 2890, 9247, 15870, 9215; Payload ID: 2526 relates to Category No.: 5561, 10056, 5570, 4008, 1792, 4029, 1811, 678, 2918; Payload ID: 2527 relates to Category No.: 10056, 5570, 1803, 5561; Payload ID: 2528 relates to Category No.: 5561, 4029, 10056, 12406; Payload ID: 2529 relates to Category No.: 5561; Payload ID: 2530 relates to Category No.: 5561, 10056, 3636, 3523, 2503; Payload ID: 2531 relates to Category No.: 5561, 2890, 6717, 10056, 4010, 1792; Payload ID: 2532 relates to Category No.: 4010, 5570, 4008, 5561; Payload ID: 2533 relates to Category No.: 10056, 5570, 1803, 1792, 6743, 4008, 5561; Payload ID: 2534 relates to Category No.: 1792, 10056, 2446, 6991, 4008, 676; Payload ID: 2535 relates to Category No.: 5561, 10056, 4008; Payload ID: 2536 relates to Category No.: 5561, 2890, 6717, 10056, 15206, 580; Payload ID: 2537 relates to Category No.: 5561, 12159, 4010, 2890; Payload ID: 2538 relates to Category No.: 4029, 9305, 10056, 8935, 5570, 4010, 4008, 1792, 6717; Payload ID: 2539 relates to Category No.: 5561, 10056, 3652, 4010, 4008, 1792; Payload ID: 2540 relates to Category No.: 5561, 4008, 4010; Payload ID: 2541 relates to Category No.: 10056, 2942, 5570, 4008, 5392; Payload ID: 2542 relates to Category No.: 2890, 10056, 9242, 273, 4010, 14327, 4197, 1811, 3636, 11883, 9734, 1750; Payload ID: 2543 relates to Category No.: 5561, 10056; Payload ID: 2544 relates to Category No.: 5561, 10056; Payload ID: 2545 relates to Category No.: 5561, 10056; Payload ID: 2546 relates to Category No.: 5561, 10056, 1099, 4010, 779, 7324; Payload ID: 2547 relates to Category No.: 5561, 6717, 10056, 4010; Payload ID: 2548 relates to Category No.: 10056, 5570; Payload ID: 2549 relates to Category No.: 5561, 10056, 4010; Payload ID: 2550 relates to Category No.: 5561, 6717, 1720, 4199, 6989; Payload ID: 2551 relates to Category No.: 5561, 6717, 10056, 3666, 4010, 3696; Payload ID: 2552 relates to Category No.: 5561, 10056, 5570, 4008, 4010; Payload ID: 2553 relates to Category No.: 6443, 2890, 10056, 5570, 9734, 4008, 5597, 779, 1085, 4493, 1792, 4029, 6717, 1772, 5561; Payload ID: 2554 relates to Category No.: 4030, 6717, 10056, 2942, 5570, 1792, 1336, 3638, 9774, 10078, 4008, 4755, 6743, 778, 5561; Payload ID: 2555 relates to Category No.: 5561, 6717, 5570, 4010, 5392; Payload ID: 2556 relates to Category No.: 5561, 6717, 4010, 1792, 9305, 2942, 10056, 5776; Payload ID: 2557 relates to Category No.: 5561, 2890, 6717, 10056, 15206, 580; Payload ID: 2558 relates to Category No.: 6717, 5762, 10056, 5570, 4008, 15206, 1811, 5392, 580, 5561; Payload ID: 2559 relates to Category No.: 9305, 7118, 2890, 9242, 9247, 2420, 14227, 3392; Payload ID: 2560 relates to Category No.: 6717, 10056, 5570, 15206, 580; Payload ID: 2561 relates to Category No.: 5561, 10056, 3673, 3521, 4008, 6743, 15206, 1792, 3671; Payload ID: 2562 relates to Category No.: 4030, 5561, 6717, 10056, 5570, 4008; Payload ID: 2563 relates to Category No.: 10056, 5570, 4010, 1792, 1682, 4008, 5776, 2890, 4030; Payload ID: 2564 relates to Category No.: 2890, 10056, 5570, 4755, 4010, 1792, 4228, 6471, 5561, 4008, 1099; Payload ID: 2565 relates to Category No.: 10056, 5570, 4010, 1792, 4228, 5450, 2890, 1099, 4755, 262, 5561; Payload ID: 2566 relates to Category No.: 10056, 4010, 5561, 5570; Payload ID: 2567 relates to Category No.: 6717, 10056, 677, 5570, 4010, 6743, 5561, 4008, 11883, 678; Payload ID: 2568 relates to Category No.: 6717, 10056, 5570, 4008; Payload ID: 2569 relates to Category No.: 4030, 4029, 6717, 1239, 4010; Payload ID: 2570 relates to Category No.: 6717, 2942, 677, 5570; Payload ID: 2571 relates to Category No.: 5561, 10056, 5570, 1811, 4010, 5392, 1792; Payload ID: 2572 relates to Category No.: 4029, 10056, 2942, 677, 5570, 4010, 1792, 6743, 779; Payload ID: 2573 relates to Category No.: 6717, 10056, 677, 5570, 4010, 1792, 5561; Payload ID: 2574 relates to Category No.: 10056, 4030, 6717, 4765, 3673, 4010, 1792, 676, 4228, 3832, 16156, 3686, 14363, 2608; Payload ID: 2575 relates to Category No.: 6717, 5570, 5561; Payload ID: 2576 relates to Category No.: 5561, 4030, 10056, 5570, 4010, 3696, 6060, 1792, 6709, 6440, 3695, 5823, 10082, 7321, 5742, 6443, 6059, 2890, 11883; Payload ID: 2577 relates to Category No.: 5561, 6717, 10056, 3696, 6440; Payload ID: 2578 relates to Category No.: 5570, 4008, 5561; Payload ID: 2579 relates to Category No.: 5561, 6717, 10056, 4010; Payload ID: 2580 relates to Category No.: 4030, 6717, 10056, 5570, 4010, 5561; Payload ID: 2581 relates to Category No.: 10056, 5570, 5561; Payload ID: 2582 relates to Category No.: 5561, 6717, 5762, 10056, 4765, 6942, 4010, 1792, 6440, 3832, 16065, 15574, 3638, 6437, 5560, 2503, 15628, 6471, 4008, 4755, 3666, 6443, 6059, 7321, 9119; Payload ID: 2583 relates to Category No.: 5561, 6717, 10056, 4008, 6743, 7321, 1069; Payload ID: 2584 relates to Category No.: 2890, 6717, 10056, 5570, 9247, 4755, 4010, 4008, 1069; Payload ID: 2585 relates to Category No.: 5561, 5762, 10056, 1792, 4008; Payload ID: 2586 relates to Category No.: 5561, 6717, 10056, 5570, 4010, 4228, 16156, 5392, 779; Payload ID: 2587 relates to Category No.: 5561, 10056, 5570, 4010; Payload ID: 2588 relates to Category No.: 10056, 5570, 4008, 5561; Payload ID: 2589 relates to Category No.: 10056, 5570, 4010; Payload ID: 2590 relates to Category No.: 5561, 10056, 4010, 1792, 4008, 5776; Payload ID: 2591 relates to Category No.: 4029, 10056, 5570, 4008, 15206, 1792, 5561; Payload ID: 2592 relates to Category No.: 4029, 10056, 5570, 3523, 15206, 4008, 1792, 5561; Payload ID: 2593 relates to Category No.: 4030, 5561, 10056, 5570, 4010, 4228, 3638, 4032, 2503, 10078, 4008, 1792, 779; Payload ID: 2594 relates to Category No.: 5561, 10056, 5570, 1792, 2899; Payload ID: 2595 relates to Category No.: 10056, 5570, 5561; Payload ID: 2596 relates to Category No.: 2890, 10056, 5570, 4228, 5561; Payload ID: 2597 relates to Category No.: 5561, 10056, 4228; Payload ID: 2598 relates to Category No.: 9247; Payload ID: 2600 relates to Category No.: 2890, 1811, 1750, 4010, 375, 5762; Payload ID: 2601 relates to Category No.: 2890, 2938, 10056, 1811, 1750, 4010, 375, 5762; Payload ID: 2602 relates to Category No.: 2890, 1750; Payload ID: 2603 relates to Category No.: 2890, 10056, 273, 4755, 4228, 5762; Payload ID: 2604 relates to Category No.: 2890, 6717, 10056, 2942, 3652, 6968; Payload ID: 2605 relates to Category No.: 2890, 10056, 2942, 273, 3652; Payload ID: 2606 relates to Category No.: 2890, 10056, 273, 3652, 6968; Payload ID: 2607 relates to Category No.: 2890, 6717, 2938, 10056, 2942, 3652; Payload ID: 2608 relates to Category No.: 2890, 2942; Payload ID: 2609 relates to Category No.: 2890, 2938, 10056; Payload ID: 2610 relates to Category No.: 2890, 2938, 10056, 4010, 9773, 1774; Payload ID: 2611 relates to Category No.: 9305, 2890; Payload ID: 2612 relates to Category No.: 9305, 9247, 9215; Payload ID: 2613 relates to Category No.: 9305, 6717, 9247, 5730, 262, 9215; Payload ID: 2614 relates to Category No.: 9305; Payload ID: 2615 relates to Category No.: 5561, 7118, 5776, 7070, 4010; Payload ID: 2616 relates to Category No.: 5561, 6717, 5776, 3673, 3666, 7070, 11883; Payload ID: 2617 relates to Category No.: 7118, 5776; Payload ID: 2618 relates to Category No.: 668; Payload ID: 2619 relates to Category No.: 9305, 2942; Payload ID: 2621 relates to Category No.: 2890, 1842; Payload ID: 2622 relates to Category No.: 5561, 6717, 3673, 3666, 14293; Payload ID: 2623 relates to Category No.: 2890, 6976, 6960, 2938, 2194, 2942, 14906, 4755, 9734, 1748, 4010, 9727, 5561; Payload ID: 2624 relates to Category No.: 3652, 9305, 2890, 6717, 6960, 2194, 11883; Payload ID: 2625 relates to Category No.: 9305; Payload ID: 2626 relates to Category No.: 9305, 2890, 9242, 9247, 4837; Payload ID: 2628 relates to Category No.: 5561, 6717, 3673, 3666; Payload ID: 2629 relates to Category No.: 5561, 6717, 7048, 3673; Payload ID: 2630 relates to Category No.: 5561, 6717, 10056, 4765, 3673, 4755; Payload ID: 2631 relates to Category No.: 2890, 10056, 9242; Payload ID: 2632 relates to Category No.: 5561, 7061; Payload ID: 2633 relates to Category No.: 5561, 10056, 4014, 1792; Payload ID: 2634 relates to Category No.: 10056, 5570, 15139, 1099, 1811, 1803, 4010, 5561, 1017, 3036, 15151, 1712, 16078; Payload ID: 2635 relates to Category No.: 10056, 5570, 15139, 1803, 1017; Payload ID: 2636 relates to Category No.: 10056, 5570, 1811, 1803; Payload ID: 2637 relates to Category No.: 5570, 1803, 4010; Payload ID: 2638 relates to Category No.: 5561, 10056, 12159, 4010, 3036, 778; Payload ID: 2639 relates to Category No.: 9305, 2890, 9247, 2976, 9157, 7060, 14912; Payload ID: 2640 relates to Category No.: 2890, 6717, 2942, 5570, 3036, 2903, 2920; Payload ID: 2641 relates to Category No.: 5561; Payload ID: 2642 relates to Category No.: 5561, 6717; Payload ID: 2643 relates to Category No.: 9305, 7118, 2890, 5762, 7041, 6222; Payload ID: 2644 relates to Category No.: 5762, 2942, 9734, 6222; Payload ID: 2645 relates to Category No.: 9305, 5762, 2942, 3666, 6222; Payload ID: 2646 relates to Category No.: 9305; Payload ID: 2647 relates to Category No.: 2890; Payload ID: 2648 relates to Category No.: 9305, 2890, 2194, 14906, 9247, 7161; Payload ID: 2649 relates to Category No.: 9305, 2890, 9242, 9247, 9184, 5561; Payload ID: 2650 relates to Category No.: 2890, 2194, 2942, 668, 9247, 14902, 14893, 9305; Payload ID: 2651 relates to Category No.: 9305, 2890, 2942, 14906, 668, 9247, 14893, 2194, 11883, 9734; Payload ID: 2653 relates to Category No.: 5762, 2942, 668, 9247; Payload ID: 2654 relates to Category No.: 5762, 2942, 9247, 2890, 9305; Payload ID: 2655 relates to Category No.: 2890, 5762, 2194, 2942, 14906, 9247, 9305; Payload ID: 2656 relates to Category No.: 9305, 5762, 2942, 9247, 2890, 9734; Payload ID: 2657 relates to Category No.: 2942, 668, 9247; Payload ID: 2658 relates to Category No.: 9305, 2890, 2194, 2942, 668, 9247, 14902, 14893, 5561; Payload ID: 2659 relates to Category No.: 9305, 2890, 9247; Payload ID: 2660 relates to Category No.: 2890, 2942, 4010, 5283; Payload ID: 2661 relates to Category No.: 2890; Payload ID: 2662 relates to Category No.: 9247, 14912, 1635; Payload ID: 2663 relates to Category No.: 2890, 6717, 5762, 6976, 10056, 2942, 4765, 3673, 8935, 6994, 8948, 4199, 4010, 14903, 4228, 2907, 7161, 1811, 1772, 1774, 7366, 778, 6099, 14995, 14409; Payload ID: 2664 relates to Category No.: 9305, 2890, 2194, 9247, 13731, 9207, 3362; Payload ID: 2665 relates to Category No.: 9305, 2890, 6717, 9242, 9247, 1635, 9215, 12218, 3358, 9734, 12170; Payload ID: 2666 relates to Category No.: 9305, 2890, 2942, 14906, 9247, 4755, 14903; Payload ID: 2667 relates to Category No.: 9305, 2890, 9247, 6968, 5597; Payload ID: 2668 relates to Category No.: 9305, 9247, 1691, 9158, 15269; Payload ID: 2669 relates to Category No.: 9247, 9734; Payload ID: 2670 relates to Category No.: 2890, 9247, 2420; Payload ID: 2671 relates to Category No.: 2942, 1842; Payload ID: 2672 relates to Category No.: 9305; Payload ID: 2673 relates to Category No.: 9305, 2890, 10056, 2942, 2420, 2192, 9247, 2420, 9157, 2563, 2402; Payload ID: 2674 relates to Category No.: 9305, 2890, 9247; Payload ID: 2675 relates to Category No.: 9305, 2890, 9242, 5561; Payload ID: 2676 relates to Category No.: 9305, 9242, 2942, 2420, 2192, 6994, 2426, 14893, 11883, 5597, 2419; Payload ID: 2677 relates to Category No.: 4029; Payload ID: 2678 relates to Category No.: 5561, 5776, 9247; Payload ID: 2679 relates to Category No.: 4029, 9305, 2890, 10056, 3666, 2534, 2505; Payload ID: 2680 relates to Category No.: 5561; Payload ID: 2681 relates to Category No.: 4030, 4010, 15505; Payload ID: 2682 relates to Category No.: 4029, 4755, 3666; Payload ID: 2683 relates to Category No.: 2942, 2890; Payload ID: 2684 relates to Category No.: 2890, 2942, 3666, 9247, 4010, 9305; Payload ID: 2685 relates to Category No.: 2890; Payload ID: 2686 relates to Category No.: 9305; Payload ID: 2688 relates to Category No.: 2890, 2183, 4010; Payload ID: 2689 relates to Category No.: 2194, 14906, 2183, 9998; Payload ID: 2690 relates to Category No.: 5762, 2194, 2942, 9247, 2183, 16314, 2458, 9998, 2441; Payload ID: 2691 relates to Category No.: 2194, 9242, 2183, 9998, 2441, 2457; Payload ID: 2692 relates to Category No.: 2194, 2942, 2183, 11883; Payload ID: 2693 relates to Category No.: 2194, 2183, 2458, 14893, 1017, 1046, 2441, 2457; Payload ID: 2694 relates to Category No.: 2890, 6717, 2194, 2942, 9734; Payload ID: 2695 relates to Category No.: 2890, 2194, 2183; Payload ID: 2696 relates to Category No.: 9305, 2942, 2420, 2192, 9247, 2632, 2192, 9273, 2633, 2629; Payload ID: 2697 relates to Category No.: 9305, 2420, 2192, 2420; Payload ID: 2698 relates to Category No.: 9305, 2890, 2942, 9247, 2630, 2632, 2192, 5964, 9725; Payload ID: 2699 relates to Category No.: 9305, 2890, 6717, 6960, 2942, 2420, 2192, 6994, 5961, 2420, 6968, 5964, 2631, 7166, 2628, 2192, 2633; Payload ID: 2700 relates to Category No.: 9305, 2890, 2942, 2420, 2192, 14906, 9247, 6994, 9734, 2402, 14893, 5964, 2631, 9162, 9181, 11793; Payload ID: 2701 relates to Category No.: 9305, 2942, 9247, 2630, 5964; Payload ID: 2702 relates to Category No.: 5964, 9305, 2890, 2942, 9247; Payload ID: 2703 relates to Category No.: 6960, 2194, 2942, 2183, 4393; Payload ID: 2704 relates to Category No.: 9305, 2942, 9247, 2630; Payload ID: 2705 relates to Category No.: 2942, 2420, 2192, 9247; Payload ID: 2706 relates to Category No.: 2942, 9247, 2630; Payload ID: 2707 relates to Category No.: 9305, 2942, 9247, 2630; Payload ID: 2708 relates to Category No.: 2942, 9247, 2630, 5964; Payload ID: 2709 relates to Category No.: 2942, 2420, 2192, 9247; Payload ID: 2710 relates to Category No.: 2942, 2420, 2192, 9247, 273; Payload ID: 2711 relates to Category No.: 9305, 2942, 2420, 2192, 9247, 2630, 5964; Payload ID: 2712 relates to Category No.: 9305, 6976, 2942, 9247, 2630, 2890; Payload ID: 2713 relates to Category No.: 9305, 2890, 9247, 2630, 6968, 14903, 5964; Payload ID: 2716 relates to Category No.: 9242, 2420, 2192, 9247, 2630, 5964, 9181; Payload ID: 2717 relates to Category No.: 2183; Payload ID: 2718 relates to Category No.: 2890, 2194, 10056, 5441; Payload ID: 2719 relates to Category No.: 2890, 2194; Payload ID: 2720 relates to Category No.: 2890, 2194, 6994, 2443; Payload ID: 2721 relates to Category No.: 2890, 6976, 14906, 2183; Payload ID: 2722 relates to Category No.: 9305, 6976, 2194, 5776, 2942, 9247, 6968, 2183, 2458, 9184, 5597, 262, 2182; Payload ID: 2723 relates to Category No.: 2194, 2942, 2183; Payload ID: 2724 relates to Category No.: 6976, 3185, 2194, 2942, 9247; Payload ID: 2725 relates to Category No.: 2890, 2194, 2942, 9247, 2183, 14893, 1044; Payload ID: 2726 relates to Category No.: 4030, 2194, 2942, 9247, 2183, 2456, 2458; Payload ID: 2727 relates to Category No.: 2890, 6960; Payload ID: 2728 relates to Category No.: 2890, 6960, 2194, 2183, 14893, 9184, 5561; Payload ID: 2729 relates to Category No.: 2194, 2890, 2942, 2183, 9727; Payload ID: 2730 relates to Category No.: 14906, 2183, 2441; Payload ID: 2731 relates to Category No.: 2183, 6976, 2194, 2942, 9734, 2458, 4010, 11883, 14908; Payload ID: 2732 relates to Category No.: 9305, 2890, 6717, 2194, 2942, 15243, 2457, 11883, 9998, 4390, 2182, 10002; Payload ID: 2733 relates to Category No.: 2890, 2938, 2194, 2183; Payload ID: 2734 relates to Category No.: 2890, 6717, 2194, 9247, 14893; Payload ID: 2735 relates to Category No.: 6717, 2194, 2942, 11728, 2183, 2441, 2458; Payload ID: 2736 relates to Category No.: 2890, 2194, 14906, 6994; Payload ID: 2737 relates to Category No.: 6717, 2194, 6994, 2183, 2514, 5597; Payload ID: 2738 relates to Category No.: 2890, 9247, 6968, 9305, 6960, 2194, 2942, 4755; Payload ID: 2739 relates to Category No.: 2890, 6960, 2194, 1842; Payload ID: 2740 relates to Category No.: 2194, 2942, 14906, 2183; Payload ID: 2741 relates to Category No.: 9305, 2890, 6976, 2194, 9247, 1748; Payload ID: 2742 relates to Category No.: 2890, 2194, 2942, 9247, 9184; Payload ID: 2743 relates to Category No.: 2194, 2942; Payload ID: 2744 relates to Category No.: 2194, 2942, 2183, 11883; Payload ID: 2745 relates to Category No.: 2194, 2942; Payload ID: 2746 relates to Category No.: 2183, 2942, 4755, 2456; Payload ID: 2747 relates to Category No.: 2890, 2194, 9242, 14906, 4755; Payload ID: 2748 relates to Category No.: 2890, 2194; Payload ID: 2749 relates to Category No.: 2890, 2194, 10056, 2942, 14906, 2183, 7052, 9098, 2456, 7244; Payload ID: 2750 relates to Category No.: 2890, 2194, 14906, 5561; Payload ID: 2751 relates to Category No.: 2890, 6976, 2194, 2942, 11883; Payload ID: 2752 relates to Category No.: 6960, 2194, 14906, 2890, 9247, 14893; Payload ID: 2753 relates to Category No.: 7244; Payload ID: 2754 relates to Category No.: 5561, 10056, 7118; Payload ID: 2755 relates to Category No.: 2890, 9242, 3666, 4755; Payload ID: 2756 relates to Category No.: 5561, 6717, 5776, 4765, 3673, 3666, 4029; Payload ID: 2757 relates to Category No.: 5561, 3666, 9184, 6717, 3673; Payload ID: 2758 relates to Category No.: 5561, 3673, 3666, 9184, 9305; Payload ID: 2759 relates to Category No.: 5561, 3666, 9305, 3673, 9184; Payload ID: 2760 relates to Category No.: 5561, 9305, 3666, 3673, 9184; Payload ID: 2761 relates to Category No.: 5561, 6717, 3673, 3666, 9184; Payload ID: 2762 relates to Category No.: 2890, 10056, 2942, 4755, 3696, 9192; Payload ID: 2763 relates to Category No.: 4030, 4029; Payload ID: 2765 relates to Category No.: 2890; Payload ID: 2767 relates to Category No.: 4029, 1748, 11653, 15139, 1700; Payload ID: 2768 relates to Category No.: 4030; Payload ID: 2769 relates to Category No.: 3666, 15139, 4755, 1748, 4030; Payload ID: 2770 relates to Category No.: 15139, 1748, 4030, 1700; Payload ID: 2771 relates to Category No.: 9305, 2890, 6717, 9242, 2787; Payload ID: 2772 relates to Category No.: 2890, 11883; Payload ID: 2773 relates to Category No.: 1842; Payload ID: 2774 relates to Category No.: 4029; Payload ID: 2775 relates to Category No.: 10056, 3671; Payload ID: 2776 relates to Category No.: 5561, 6717, 6440, 6443, 9305, 7118, 2890, 10056, 2942, 15151, 4765, 8935, 3666, 4755, 15573, 3521, 5557, 997, 6743, 6059, 1659, 4769, 5762; Payload ID: 2777 relates to Category No.: 6443, 16056, 5561, 3666, 4755, 9734, 4010, 6440; Payload ID: 2778 relates to Category No.: 5561, 6717, 5776, 3673, 3666, 9247, 9184, 3671; Payload ID: 2779 relates to Category No.: 5561, 3673, 3666, 3686, 3685; Payload ID: 2780 relates to Category No.: 4030, 4029, 1239, 4010, 6440, 678; Payload ID: 2781 relates to Category No.: 4029, 6717, 10077, 4030; Payload ID: 2782 relates to Category No.: 9305, 9247; Payload ID: 2783 relates to Category No.: 3394, 10056, 2942, 9247, 3348, 262; Payload ID: 2795 relates to Category No.: 5762; Payload ID: 2796 relates to Category No.: 5561; Payload ID: 2802 relates to Category No.: 2942, 15573; Payload ID: 2803 relates to Category No.: 1842; Payload ID: 2804 relates to Category No.: 2890, 6960, 2942, 4010, 2278, 7366, 1711, 16336; Payload ID: 2805 relates to Category No.: 2890, 6960, 2938, 10056, 2942, 4010, 2278, 7366, 1711, 16336; Payload ID: 2806 relates to Category No.: 2890, 6960, 2194, 2942, 9247, 4010, 6709, 2278, 1711, 16336; Payload ID: 2807 relates to Category No.: 2890, 6960, 2194, 9242, 2942, 4010, 2278, 7366, 1711, 16336; Payload ID: 2808 relates to Category No.: 2890, 6960, 2942, 4010, 2278; Payload ID: 2809 relates to Category No.: 2278; Payload ID: 2810 relates to Category No.: 2890, 6960, 2942, 4010, 2278, 7118, 1711, 16336; Payload ID: 2811 relates to Category No.: 2890, 6960, 2194, 2942, 4010, 5730, 493, 2278, 1711, 16336; Payload ID: 2812 relates to Category No.: 2890; Payload ID: 2813 relates to Category No.: 2942; Payload ID: 2814 relates to Category No.: 6976, 3652, 3521, 4010, 3696, 9181, 2632, 5762; Payload ID: 2815 relates to Category No.: 2942, 6722, 4010, 6060, 3864; Payload ID: 2816 relates to Category No.: 5762, 6717, 2942, 6722, 4010, 6060; Payload ID: 2817 relates to Category No.: 6443, 9305, 7118, 2890, 5762, 10056, 2942, 3693, 9247, 4010, 6060, 6059, 3864; Payload ID: 2818 relates to Category No.: 10056, 2942, 2899, 4010, 6060, 3864; Payload ID: 2819 relates to Category No.: 9305, 2890, 10056, 2942, 6722, 3693, 6994, 2927, 4010, 6060, 2918, 3864, 5762; Payload ID: 2820 relates to Category No.: 9305, 2890, 2942, 6722, 3693, 6994, 4010, 6060, 2918, 3864; Payload ID: 2821 relates to Category No.: 2942, 6994, 4010, 6060, 4216; Payload ID: 2822 relates to Category No.: 2942, 4010, 3696, 9305; Payload ID: 2823 relates to Category No.: 5762, 6717, 2942, 4010, 3696, 6060, 3864; Payload ID: 2824 relates to Category No.: 2942, 3864; Payload ID: 2825 relates to Category No.: 5776, 9247, 4030, 9305, 2194, 2942, 2402, 2420, 15269, 2632, 13728; Payload ID: 2826 relates to Category No.: 9247, 4755, 2420, 15269, 10104, 9305; Payload ID: 2827 relates to Category No.: 9305, 10104; Payload ID: 2828 relates to Category No.: 5561, 10056, 5570; Payload ID: 2829 relates to Category No.: 4030, 4029, 5762; Payload ID: 2830 relates to Category No.: 4030, 4029; Payload ID: 2831 relates to Category No.: 5561, 10056, 2942, 5570, 5762; Payload ID: 2832 relates to Category No.: 4030, 4029, 1700; Payload ID: 2833 relates to Category No.: 4030, 4029, 1700, 5762; Payload ID: 2834 relates to Category No.: 4030, 4029, 1700; Payload ID: 2835 relates to Category No.: 4030, 4029, 1700; Payload ID: 2836 relates to Category No.: 4030, 4029, 1700; Payload ID: 2837 relates to Category No.: 4029, 4030; Payload ID: 2838 relates to Category No.: 4030, 4029; Payload ID: 2839 relates to Category No.: 4030, 4029; Payload ID: 2840 relates to Category No.: 4030, 4029, 5762, 1700; Payload ID: 2841 relates to Category No.: 4029, 4030, 2890, 15139, 3636, 3036, 8948, 1033, 9734, 14293, 9730, 2257; Payload ID: 2842 relates to Category No.: 4029, 4030; Payload ID: 2843 relates to Category No.: 4030, 4029, 5762; Payload ID: 2844 relates to Category No.: 4029, 4030; Payload ID: 2845 relates to Category No.: 4030, 4029, 1700; Payload ID: 2846 relates to Category No.: 4030, 4029; Payload ID: 2847 relates to Category No.: 4030, 4029; Payload ID: 2848 relates to Category No.: 4030, 4029; Payload ID: 2849 relates to Category No.: 4030, 4029; Payload ID: 2850 relates to Category No.: 4030, 4029, 4010, 2942; Payload ID: 2851 relates to Category No.: 4030, 4029; Payload ID: 2852 relates to Category No.: 4030, 4029; Payload ID: 2853 relates to Category No.: 4030, 4029; Payload ID: 2854 relates to Category No.: 4030, 4029; Payload ID: 2855 relates to Category No.: 4030, 4029; Payload ID: 2856 relates to Category No.: 4030, 4029; Payload ID: 2857 relates to Category No.: 4030, 4029, 2890; Payload ID: 2858 relates to Category No.: 4030, 4029, 1700; Payload ID: 2859 relates to Category No.: 5561, 10056, 2942, 5570, 4008; Payload ID: 2860 relates to Category No.: 5561, 10056, 5570, 1792, 2942; Payload ID: 2861 relates to Category No.: 5561, 2890, 10056, 2942, 5570, 9734, 8948, 3036, 9730, 3693, 1792; Payload ID: 2862 relates to Category No.: 5561, 10056, 2942, 5570; Payload ID: 2863 relates to Category No.: 5561, 10056, 2942, 5570, 4008; Payload ID: 2864 relates to Category No.: 5561, 2890, 10056, 2942, 5570, 3693, 4008, 1792; Payload ID: 2865 relates to Category No.: 5561, 10056, 2942, 5570, 1792; Payload ID: 2866 relates to Category No.: 5561, 5762, 10056, 2942, 1792, 4008; Payload ID: 2867 relates to Category No.: 5561, 10056, 2942, 5570; Payload ID: 2868 relates to Category No.: 5561, 10056, 2942, 5570, 1792; Payload ID: 2869 relates to Category No.: 5561, 10056, 5570; Payload ID: 2870 relates to Category No.: 4030, 5561, 4029, 10056, 1792, 2890, 1774, 9734; Payload ID: 2871 relates to Category No.: 5561, 10056, 5570, 8935, 9734, 8949; Payload ID: 2872 relates to Category No.: 4030, 4029, 5762; Payload ID: 2873 relates to Category No.: 4030, 4029, 4008; Payload ID: 2874 relates to Category No.: 4030, 4029; Payload ID: 2875 relates to Category No.: 4029, 4008, 4010, 4030, 10056; Payload ID: 2876 relates to Category No.: 4030, 4029, 2942; Payload ID: 2877 relates to Category No.: 4029, 4030, 4755; Payload ID: 2878 relates to Category No.: 4030, 5561, 4029, 6717, 10056; Payload ID: 2879 relates to Category No.: 4029; Payload ID: 2880 relates to Category No.: 4030, 4029; Payload ID: 2881 relates to Category No.: 4030, 4029; Payload ID: 2882 relates to Category No.: 4030, 4029; Payload ID: 2883 relates to Category No.: 4030, 4029; Payload ID: 2884 relates to Category No.: 4030, 4029, 5762, 1700; Payload ID: 2885 relates to Category No.: 4029, 4008, 4030; Payload ID: 2886 relates to Category No.: 5561, 6717, 10056; Payload ID: 2887 relates to Category No.: 5561, 6717, 5762, 10056, 5570, 1792, 6617, 2942; Payload ID: 2888 relates to Category No.: 5561, 2890, 10056, 2942, 5570, 4008, 1792, 5762; Payload ID: 2889 relates to Category No.: 5561, 6443, 2890, 10056, 2942, 2899, 1748, 3521, 1750, 4010, 2926, 1792, 6059, 3693; Payload ID: 2890 relates to Category No.: 5561, 10056, 5570, 4008; Payload ID: 2891 relates to Category No.: 5561, 10056, 5570; Payload ID: 2892 relates to Category No.: 4030, 5561, 4029, 6717, 1700; Payload ID: 2893 relates to Category No.: 9305, 2942, 9247, 15573, 9215, 2441; Payload ID: 2895 relates to Category No.: 2942, 5762; Payload ID: 2896 relates to Category No.: 6717, 2942, 5762; Payload ID: 2897 relates to Category No.: 4030, 6443, 4029; Payload ID: 2898 relates to Category No.: 4030, 4029, 2890, 12159, 3666, 9734, 4010; Payload ID: 2899 relates to Category No.: 4030, 4029; Payload ID: 2900 relates to Category No.: 4029, 4030, 6443, 9305, 6717, 15573, 4010, 6059; Payload ID: 2901 relates to Category No.: 4029, 2890, 4030; Payload ID: 2902 relates to Category No.: 4030, 6443, 4029, 4010; Payload ID: 2904 relates to Category No.: 4030, 10056, 5570, 5561, 14409, 6989, 16346; Payload ID: 2905 relates to Category No.: 4029, 10056, 5570, 1748, 1085; Payload ID: 2906 relates to Category No.: 10056, 5570, 4010, 779; Payload ID: 2907 relates to Category No.: 9305, 6717, 5776, 3666, 4755, 2324, 5561; Payload ID: 2908 relates to Category No.: 9305, 2890, 2938, 10056, 2942, 9247, 6921, 10016; Payload ID: 2909 relates to Category No.: 6717, 10056, 5570, 2324, 14363; Payload ID: 2910 relates to Category No.: 6717, 10056, 2324, 5561; Payload ID: 2911 relates to Category No.: 6717, 5561, 10056, 15151, 4765, 4755, 3521, 14409, 4008, 6060, 2926, 1792, 6059, 3523, 14802, 16164, 9774, 15628, 3693, 1033, 779; Payload ID: 2912 relates to Category No.: 5561, 6717, 3696, 6060, 3523; Payload ID: 2913 relates to Category No.: 6717, 4765, 5570, 3696, 6440, 778, 3693; Payload ID: 2914 relates to Category No.: 5561, 6717, 3696, 6440; Payload ID: 2915 relates to Category No.: 5561, 6717, 6440, 2926; Payload ID: 2916 relates to Category No.: 6717, 10056, 5570, 2324; Payload ID: 2917 relates to Category No.: 6717, 10056, 5570, 2324, 5561; Payload ID: 2918 relates to Category No.: 4030, 9305, 2890, 6717, 10056, 9734, 2324, 1239, 4010, 9184, 1335, 16156, 9162; Payload ID: 2919 relates to Category No.: 9305, 2890, 5762, 2324; Payload ID: 2920 relates to Category No.: 9305, 2890, 2324, 4010; Payload ID: 2921 relates to Category No.: 7118, 2890, 5762, 2194, 10056, 2942, 6994, 273, 9734, 2927, 6968, 1811, 2324, 4010, 1792, 6989, 9181, 778; Payload ID: 2922 relates to Category No.: 6976, 273, 4755, 1720, 2324, 4010, 14953, 14954; Payload ID: 2923 relates to Category No.: 2890, 10056, 2324, 4010; Payload ID: 2924 relates to Category No.: 4029, 1017, 4030, 3036, 8948, 15280, 9730, 1029, 1028; Payload ID: 2925 relates to Category No.: 5561, 10056, 2942, 5570, 2890, 3693, 3666, 15280, 6443; Payload ID: 2926 relates to Category No.: 5561, 10056, 2942, 5570, 6717; Payload ID: 2927 relates to Category No.: 5561, 2942, 3673; Payload ID: 2928 relates to Category No.: 4030, 4029, 5059, 4010, 16156; Payload ID: 2929 relates to Category No.: 7048, 7118; Payload ID: 2930 relates to Category No.: 2942; Payload ID: 2931 relates to Category No.: 2942; Payload ID: 2932 relates to Category No.: 9305, 2890, 2942, 7118, 8935; Payload ID: 2933 relates to Category No.: 5561, 6717, 5776, 4765, 4755; Payload ID: 2934 relates to Category No.: 5561, 6717, 3673, 9184; Payload ID: 2935 relates to Category No.: 5561, 6717, 10056, 5570, 15139, 1748, 11653, 3036, 1033, 11650, 915; Payload ID: 2936 relates to Category No.: 5561, 10056, 5570, 15139, 1748, 11653, 6717, 3036, 8948, 1033, 915, 15133; Payload ID: 2937 relates to Category No.: 5561, 10056, 5570, 15139, 1748, 11653, 1099, 3036, 1033, 915; Payload ID: 2938 relates to Category No.: 5561, 10056, 5570, 15139, 1748, 11653, 6717, 2890, 8948, 1033, 14363, 11650, 915; Payload ID: 2939 relates to Category No.: 15139, 5561, 10056, 5570, 1748, 11653; Payload ID: 2940 relates to Category No.: 5561, 6717; Payload ID: 2941 relates to Category No.: 5561, 6717, 10056, 8935, 1748, 11653, 8917, 1792, 224; Payload ID: 2942 relates to Category No.: 5561, 6717, 2942, 8935, 15139, 1748, 11653, 224, 1017, 9730; Payload ID: 2943 relates to Category No.: 5561, 6717, 10056, 8935, 15139, 1748, 11653, 224, 1772; Payload ID: 2944 relates to Category No.: 5561, 6717, 10056, 8935, 15139, 1748, 11650, 8948, 3036, 11653, 224; Payload ID: 2945 relates to Category No.: 5561, 6717, 10056, 8935, 15139, 1748, 8948, 3036, 11653, 4008, 224; Payload ID: 2946 relates to Category No.: 5561, 6717, 10056, 8935, 15139, 1748, 11653, 224, 3036, 8948; Payload ID: 2947 relates to Category No.: 5561, 6717, 10056, 8935, 15139, 1748, 11653, 224; Payload ID: 2948 relates to Category No.: 5561, 6717; Payload ID: 2949 relates to Category No.: 5561, 6717, 10056, 2942, 8935, 5570, 15139, 1748, 11653, 224; Payload ID: 2950 relates to Category No.: 5561, 6717, 8935, 5570, 15139, 1748, 11653, 224, 10056; Payload ID: 2951 relates to Category No.: 5561, 6717, 10056, 8935, 15139, 1748, 11653, 4008, 224; Payload ID: 2952 relates to Category No.: 5561, 6717, 10056, 8935, 15139, 1748, 11653; Payload ID: 2953 relates to Category No.: 5561, 6717, 10056, 8935, 5570, 15139, 1748, 11653, 224; Payload ID: 2954 relates to Category No.: 5561, 6717, 11653, 10056, 8935, 15139, 1748, 224; Payload ID: 2955 relates to Category No.: 6717, 10056, 8935, 5570, 15139, 1748, 11653, 224; Payload ID: 2956 relates to Category No.: 6717, 10056, 8935, 5570, 15139, 1748, 11653, 224; Payload ID: 2957 relates to Category No.: 12159; Payload ID: 2958 relates to Category No.: 12159, 4014; Payload ID: 2959 relates to Category No.: 5561, 2942, 4765, 7060, 4760; Payload ID: 2960 relates to Category No.: 4760, 5561, 6717, 4765; Payload ID: 2961 relates to Category No.: 5762, 4765, 5559, 4760; Payload ID: 2962 relates to Category No.: 6717, 4765, 5559, 4760; Payload ID: 2963 relates to Category No.: 4029, 5570, 4010, 1792, 4228, 779, 4763, 6437, 6019, 10056, 1774; Payload ID: 2964 relates to Category No.: 5561, 4029, 6717, 3673, 5570, 4755, 4788, 4763, 6437; Payload ID: 2965 relates to Category No.: 5561, 4029, 6717, 4765, 4760; Payload ID: 2966 relates to Category No.: 5561, 4765, 4760; Payload ID: 2967 relates to Category No.: 5561, 2890, 9734; Payload ID: 2969 relates to Category No.: 4030; Payload ID: 2970 relates to Category No.: 4029; Payload ID: 2971 relates to Category No.: 4030, 2890; Payload ID: 2972 relates to Category No.: 4029; Payload ID: 2973 relates to Category No.: 4029; Payload ID: 2974 relates to Category No.: 4029; Payload ID: 2975 relates to Category No.: 4029; Payload ID: 2976 relates to Category No.: 4029; Payload ID: 2977 relates to Category No.: 4029; Payload ID: 2978 relates to Category No.: 4029, 3666, 6756; Payload ID: 2979 relates to Category No.: 4029, 3666, 6756; Payload ID: 2980 relates to Category No.: 4029, 1842; Payload ID: 2981 relates to Category No.: 2942, 12362; Payload ID: 2982 relates to Category No.: 2890, 2942, 9247, 12362; Payload ID: 2983 relates to Category No.: 5561, 6717, 8935, 15139, 224, 4008, 779, 1016; Payload ID: 2984 relates to Category No.: 3823, 2398; Payload ID: 2985 relates to Category No.: 9305, 9157, 11883, 1375; Payload ID: 2986 relates to Category No.: 9305, 2890, 2942, 9247, 9157, 11883, 1375; Payload ID: 2987 relates to Category No.: 9305, 2942, 9247; Payload ID: 2988 relates to Category No.: 5776, 9242, 9247, 9215, 15501; Payload ID: 2989 relates to Category No.: 9305, 2420, 2192, 9247, 2402, 9172, 14893, 9158, 15269, 4146, 2419, 6536, 9725; Payload ID: 2990 relates to Category No.: 9305, 9247, 9603, 11683, 3952, 5029; Payload ID: 2991 relates to Category No.: 9305, 2420, 2192, 9247, 2402, 9172, 14893, 9176, 9158, 15269, 9162, 9167, 2628, 2192, 9194, 2419, 14443; Payload ID: 2992 relates to Category No.: 9305, 9247, 9215, 9603, 11683, 9155; Payload ID: 2993 relates to Category No.: 9305, 9242, 9247, 9172, 15531, 9158, 15269, 10104, 5110, 9162, 5216, 9194, 5964, 5029, 2419; Payload ID: 2994 relates to Category No.: 9305, 9247, 9603, 5029; Payload ID: 2995 relates to Category No.: 9305, 2890, 9247, 9157, 9603, 11683, 5029; Payload ID: 2996 relates to Category No.: 9305, 9247, 9157, 9603, 11683, 15892, 5029; Payload ID: 2997 relates to Category No.: 9305, 2890; Payload ID: 2998 relates to Category No.: 9305, 2890, 10056, 9247; Payload ID: 2999 relates to Category No.: 9305, 5776, 9242, 9247, 4010; Payload ID: 3000 relates to Category No.: 9305, 2890, 2194, 9242, 9247, 9311, 5730; Payload ID: 3001 relates to Category No.: 9305, 9311, 9247, 2890, 6717, 2194, 9157, 11883, 12170; Payload ID: 3002 relates to Category No.: 9305, 6717, 9311, 5029; Payload ID: 3003 relates to Category No.: 9247, 3393, 2686, 9305; Payload ID: 3004 relates to Category No.: 9305, 9242, 9247; Payload ID: 3005 relates to Category No.: 9305, 9247, 11883, 7179; Payload ID: 3006 relates to Category No.: 9305, 2890, 10056, 9247; Payload ID: 3007 relates to Category No.: 9305, 9247, 5561; Payload ID: 3008 relates to Category No.: 9305; Payload ID: 3009 relates to Category No.: 9305; Payload ID: 3010 relates to Category No.: 9305; Payload ID: 3011 relates to Category No.: 9305; Payload ID: 3012 relates to Category No.: 9305; Payload ID: 3013 relates to Category No.: 4029, 9734, 14409, 6617, 15628; Payload ID: 3014 relates to Category No.: 4029, 14409; Payload ID: 3016 relates to Category No.: 1657; Payload ID: 3022 relates to Category No.: 5561; Payload ID: 3023 relates to Category No.: 2890, 4010; Payload ID: 3025 relates to Category No.: 4010; Payload ID: 3032 relates to Category No.: 5561; Payload ID: 3033 relates to Category No.: 5561; Payload ID: 3036 relates to Category No.: 9305; Payload ID: 3037 relates to Category No.: 5561; Payload ID: 3038 relates to Category No.: 5561, 10056; Payload ID: 3041 relates to Category No.: 2890; Payload ID: 3042 relates to Category No.: 5561; Payload ID: 3044 relates to Category No.: 5561, 12439, 10056, 3521; Payload ID: 3048 relates to Category No.: 5561; Payload ID: 3049 relates to Category No.: 5561; Payload ID: 3050 relates to Category No.: 5561; Payload ID: 3052 relates to Category No.: 5561; Payload ID: 3054 relates to Category No.: 9305, 9247; Payload ID: 3056 relates to Category No.: 4029; Payload ID: 3057 relates to Category No.: 4029, 2890, 9247; Payload ID: 3058 relates to Category No.: 9305; Payload ID: 3060 relates to Category No.: 2890, 4010, 2701; Payload ID: 3064 relates to Category No.: 5561; Payload ID: 3065 relates to Category No.: 7118; Payload ID: 3066 relates to Category No.: 5561; Payload ID: 3072 relates to Category No.: 5561; Payload ID: 3075 relates to Category No.: 7060, 7068, 7118; Payload ID: 3076 relates to Category No.: 5561; Payload ID: 3078 relates to Category No.: 5561, 4008, 10056; Payload ID: 3083 relates to Category No.: 5561; Payload ID: 3086 relates to Category No.: 2890, 2194, 273; Payload ID: 3087 relates to Category No.: 4030, 4029; Payload ID: 3088 relates to Category No.: 9305, 9247; Payload ID: 3090 relates to Category No.: 2890; Payload ID: 3091 relates to Category No.: 5561, 10056, 4755; Payload ID: 3092 relates to Category No.: 9247; Payload ID: 3096 relates to Category No.: 4029; Payload ID: 3097 relates to Category No.: 9247; Payload ID: 3098 relates to Category No.: 4010; Payload ID: 3100 relates to Category No.: 9305, 4010; Payload ID: 3102 relates to Category No.: 1842; Payload ID: 3108 relates to Category No.: 9305, 1748, 5762, 2942, 9247, 4010, 2890; Payload ID: 3114 relates to Category No.: 5561; Payload ID: 3117 relates to Category No.: 4029; Payload ID: 3121 relates to Category No.: 9305, 7118, 9247, 4010; Payload ID: 3123 relates to Category No.: 2890; Payload ID: 3128 relates to Category No.: 4029; Payload ID: 3132 relates to Category No.: 2890; Payload ID: 3134 relates to Category No.: 7118, 7055; Payload ID: 3135 relates to Category No.: 6968, 5597; Payload ID: 3137 relates to Category No.: 4029; Payload ID: 3140 relates to Category No.: 5561, 5570; Payload ID: 3141 relates to Category No.: 5561, 3673, 15627; Payload ID: 3143 relates to Category No.: 7118; Payload ID: 3145 relates to Category No.: 7118, 1842; Payload ID: 3146 relates to Category No.: 9305, 2890, 6976, 2942, 9247, 9734, 15732; Payload ID: 3147 relates to Category No.: 9305, 9242, 9247; Payload ID: 3150 relates to Category No.: 5561, 10056; Payload ID: 3151 relates to Category No.: 5561, 7118, 1842, 7079; Payload ID: 3153 relates to Category No.: 5561; Payload ID: 3154 relates to Category No.: 1842; Payload ID: 3155 relates to Category No.: 2890; Payload ID: 3157 relates to Category No.: 4029; Payload ID: 3158 relates to Category No.: 2890; Payload ID: 3162 relates to Category No.: 9305, 5561, 7118; Payload ID: 3167 relates to Category No.: 4029; Payload ID: 3168 relates to Category No.: 7118, 2890, 2938, 10056; Payload ID: 3171 relates to Category No.: 6968; Payload ID: 3172 relates to Category No.: 9305, 2890, 9247; Payload ID: 3173 relates to Category No.: 5561; Payload ID: 3174 relates to Category No.: 5561; Payload ID: 3175 relates to Category No.: 5561, 6717; Payload ID: 3177 relates to Category No.: 5561, 3521; Payload ID: 3182 relates to Category No.: 9305; Payload ID: 3185 relates to Category No.: 6717, 2942, 4010; Payload ID: 3187 relates to Category No.: 5561; Payload ID: 3188 relates to Category No.: 5561; Payload ID: 3196 relates to Category No.: 7179, 9312; Payload ID: 3201 relates to Category No.: 5561; Payload ID: 3203 relates to Category No.: 4029; Payload ID: 3204 relates to Category No.: 5561; Payload ID: 3205 relates to Category No.: 1842; Payload ID: 3206 relates to Category No.: 5561; Payload ID: 3207 relates to Category No.: 5561, 4010; Payload ID: 3208 relates to Category No.: 7118; Payload ID: 3212 relates to Category No.: 4029; Payload ID: 3217 relates to Category No.: 4029; Payload ID: 3219 relates to Category No.: 6440; Payload ID: 3220 relates to Category No.: 5561, 7118, 3673, 7061, 3666; Payload ID: 3221 relates to Category No.: 5561, 4010; Payload ID: 3222 relates to Category No.: 5561, 4029, 2890; Payload ID: 3224 relates to Category No.: 9305; Payload ID: 3225 relates to Category No.: 273, 4228; Payload ID: 3226 relates to Category No.: 5561; Payload ID: 3230 relates to Category No.: 9247; Payload ID: 3235 relates to Category No.: 1842; Payload ID: 3239 relates to Category No.: 9305, 2890; Payload ID: 3240 relates to Category No.: 7118, 7048, 6947, 7033; Payload ID: 3243 relates to Category No.: 4029; Payload ID: 3247 relates to Category No.: 9305, 4010; Payload ID: 3248 relates to Category No.: 15627, 4030; Payload ID: 3249 relates to Category No.: 9305, 9247, 9184; Payload ID: 3251 relates to Category No.: 7118; Payload ID: 3252 relates to Category No.: 9247, 15732; Payload ID: 3257 relates to Category No.: 4029; Payload ID: 3259 relates to Category No.: 4029; Payload ID: 3260 relates to Category No.: 9305; Payload ID: 3261 relates to Category No.: 11728, 10002; Payload ID: 3264 relates to Category No.: 5561; Payload ID: 3269 relates to Category No.: 5561, 1772; Payload ID: 3270 relates to Category No.: 6717, 5570; Payload ID: 3271 relates to Category No.: 10056; Payload ID: 3273 relates to Category No.: 5561; Payload ID: 3275 relates to Category No.: 4765; Payload ID: 3277 relates to Category No.: 4010; Payload ID: 3280 relates to Category No.: 1842; Payload ID: 3281 relates to Category No.: 1842; Payload ID: 3285 relates to Category No.: 2890, 10056; Payload ID: 3286 relates to Category No.: 7118; Payload ID: 3288 relates to Category No.: 9305, 2942; Payload ID: 3289 relates to Category No.: 1842; Payload ID: 3292 relates to Category No.: 1842; Payload ID: 3293 relates to Category No.: 7118; Payload ID: 3297 relates to Category No.: 4029; Payload ID: 3299 relates to Category No.: 5561, 9305; Payload ID: 3300 relates to Category No.: 5561; Payload ID: 3301 relates to Category No.: 5561, 2890; Payload ID: 3304 relates to Category No.: 4030, 5561; Payload ID: 3307 relates to Category No.: 5561; Payload ID: 3308 relates to Category No.: 5561, 3673; Payload ID: 3309 relates to Category No.: 4030, 4765, 2663, 2664; Payload ID: 3313 relates to Category No.: 5561; Payload ID: 3318 relates to Category No.: 4029; Payload ID: 3319 relates to Category No.: 9305; Payload ID: 3320 relates to Category No.: 5561; Payload ID: 3321 relates to Category No.: 5561; Payload ID: 3325 relates to Category No.: 2890; Payload ID: 3326 relates to Category No.: 2890, 2194; Payload ID: 3327 relates to Category No.: 4029; Payload ID: 3330 relates to Category No.: 5561; Payload ID: 3333 relates to Category No.: 5561; Payload ID: 3334 relates to Category No.: 2890, 2457; Payload ID: 3336 relates to Category No.: 4029; Payload ID: 3337 relates to Category No.: 5561, 2457; Payload ID: 3338 relates to Category No.: 1842; Payload ID: 3339 relates to Category No.: 4010; Payload ID: 3345 relates to Category No.: 7118; Payload ID: 3347 relates to Category No.: 4029; Payload ID: 3348 relates to Category No.: 5561, 9305; Payload ID: 3349 relates to Category No.: 11687, 997, 1842; Payload ID: 3351 relates to Category No.: 4010; Payload ID: 3353 relates to Category No.: 5561, 7118;

Payload ID: 3355 relates to Category No.: 1842, 12159, 5749; Payload ID: 3356 relates to Category No.: 1842; Payload ID: 3359 relates to Category No.: 7118; Payload ID: 3364 relates to Category No.: 5561, 10056, 3666, 4755; Payload ID: 3365 relates to Category No.: 2890; Payload ID: 3368 relates to Category No.: 4030, 4010; Payload ID: 3369 relates to Category No.: 5762; Payload ID: 3370 relates to Category No.: 5561, 2890, 10056, 9242, 4765, 6994; Payload ID: 3373 relates to Category No.: 2890, 2194; Payload ID: 3375 relates to Category No.: 4029; Payload ID: 3377 relates to Category No.: 2890; Payload ID: 3379 relates to Category No.: 7118; Payload ID: 3382 relates to Category No.: 9305; Payload ID: 3384 relates to Category No.: 1842; Payload ID: 3385 relates to Category No.: 5561, 7061; Payload ID: 3390 relates to Category No.: 2890, 10056, 1748; Payload ID: 3391 relates to Category No.: 9305, 2890, 9242, 9215; Payload ID: 3392 relates to Category No.: 9247; Payload ID: 3403 relates to Category No.: 2630, 1842; Payload ID: 3407 relates to Category No.: 5561; Payload ID: 3408 relates to Category No.: 9305, 4010; Payload ID: 3411 relates to Category No.: 1842; Payload ID: 3414 relates to Category No.: 9305, 9734, 6573, 2890; Payload ID: 3415 relates to Category No.: 2890, 9242; Payload ID: 3418 relates to Category No.: 4029; Payload ID: 3420 relates to Category No.: 5561; Payload ID: 3421 relates to Category No.: 1842; Payload ID: 3423 relates to Category No.: 5561, 9305, 2890; Payload ID: 3424 relates to Category No.: 4030, 6443, 9305, 2890, 3693, 9247, 273, 997, 2926, 5597; Payload ID: 3425 relates to Category No.: 2890, 9247; Payload ID: 3428 relates to Category No.: 2901, 262, 2890; Payload ID: 3429 relates to Category No.: 5561, 1842; Payload ID: 3431 relates to Category No.: 9305, 2890, 9247, 2630, 14893, 2628; Payload ID: 3432 relates to Category No.: 2890, 6717, 9247; Payload ID: 3433 relates to Category No.: 9305, 4010; Payload ID: 3435 relates to Category No.: 7118; Payload ID: 3436 relates to Category No.: 4029; Payload ID: 3446 relates to Category No.: 5561; Payload ID: 3447 relates to Category No.: 9247; Payload ID: 3448 relates to Category No.: 2890; Payload ID: 3450 relates to Category No.: 11925; Payload ID: 3452 relates to Category No.: 4030, 4029, 4014, 5762; Payload ID: 3453 relates to Category No.: 4029; Payload ID: 3454 relates to Category No.: 4030; Payload ID: 3455 relates to Category No.: 4030; Payload ID: 3456 relates to Category No.: 4030, 5942; Payload ID: 3457 relates to Category No.: 4030, 4029; Payload ID: 3458 relates to Category No.: 4030; Payload ID: 3459 relates to Category No.: 4030; Payload ID: 3460 relates to Category No.: 4030, 4029; Payload ID: 3461 relates to Category No.: 4030, 4029; Payload ID: 3462 relates to Category No.: 5561, 2938, 1046; Payload ID: 3464 relates to Category No.: 2890, 11728, 2441, 779; Payload ID: 3467 relates to Category No.: 9305, 6960, 2183, 2458, 4010, 2441; Payload ID: 3469 relates to Category No.: 2938, 2458, 1046; Payload ID: 3470 relates to Category No.: 9305, 2890, 1774; Payload ID: 3471 relates to Category No.: 1774; Payload ID: 3472 relates to Category No.: 1774; Payload ID: 3473 relates to Category No.: 9305, 9247, 2458; Payload ID: 3474 relates to Category No.: 9305, 2938, 1046; Payload ID: 3476 relates to Category No.: 2890, 1774; Payload ID: 3477 relates to Category No.: 2458, 1842; Payload ID: 3479 relates to Category No.: 4030, 2458; Payload ID: 3482 relates to Category No.: 2458, 4010; Payload ID: 3484 relates to Category No.: 2938, 1046; Payload ID: 3488 relates to Category No.: 1774; Payload ID: 3489 relates to Category No.: 4030, 2890, 2769; Payload ID: 3490 relates to Category No.: 6717, 677, 4049, 779, 2450, 2531; Payload ID: 3491 relates to Category No.: 2890, 2194, 10056, 273, 2183, 4010, 2454, 10000; Payload ID: 3493 relates to Category No.: 9305, 2890, 10056, 273; Payload ID: 3494 relates to Category No.: 7394, 1182, 1748, 777; Payload ID: 3495 relates to Category No.: 7394, 1182, 273, 777; Payload ID: 3496 relates to Category No.: 9305, 10104; Payload ID: 3497 relates to Category No.: 9242, 15783; Payload ID: 3498 relates to Category No.: 7118, 5561; Payload ID: 3499 relates to Category No.: 9305, 7118, 7060, 4010, 5561; Payload ID: 3500 relates to Category No.: 6717, 2942, 2890, 14327, 273, 16065, 5762; Payload ID: 3501 relates to Category No.: 5561, 6717; Payload ID: 3502 relates to Category No.: 4030, 5561, 6717; Payload ID: 3503 relates to Category No.: 4030, 5561, 9247, 6717; Payload ID: 3504 relates to Category No.: 5561, 6717, 4030, 2890, 9184; Payload ID: 3505 relates to Category No.: 4030, 5561, 6717; Payload ID: 3506 relates to Category No.: 4030, 5561, 6717; Payload ID: 3507 relates to Category No.: 4030, 5561, 6717, 4010; Payload ID: 3508 relates to Category No.: 4030, 5561, 6717; Payload ID: 3509 relates to Category No.: 4030, 5561, 9305, 2890, 6717; Payload ID: 3510 relates to Category No.: 5561, 10056, 6017, 6989, 6960, 14953, 15577, 1084; Payload ID: 3511 relates to Category No.: 5561; Payload ID: 3512 relates to Category No.: 5561, 4010; Payload ID: 3513 relates to Category No.: 9247; Payload ID: 3514 relates to Category No.: 9247, 10104, 1792; Payload ID: 3516 relates to Category No.: 6717, 5776, 2942, 9247, 4755, 9734, 2504; Payload ID: 3517 relates to Category No.: 2890, 6717, 5776, 10056, 2942, 2497, 2495, 14893, 4010, 4228, 6709, 11883, 2504, 15574, 4032, 3651, 2503, 2492, 2498, 5762, 7118, 7366, 6722; Payload ID: 3518 relates to Category No.: 6717, 2497, 2495, 15573, 2534, 14893, 4010, 6059, 2504, 14797, 2535, 5762; Payload ID: 3519 relates to Category No.: 6717, 5776, 10056, 2942, 2497, 2495, 2899, 2501, 15574, 3651, 2492, 2498, 2504, 2534; Payload ID: 3520 relates to Category No.: 2890, 5776, 10056, 2497, 2495, 2501, 2492, 15573, 2446; Payload ID: 3521 relates to Category No.: 5561, 1182, 5570, 10056, 6075, 1748, 779; Payload ID: 3522 relates to Category No.: 5561, 10056, 1182, 2890; Payload ID: 3523 relates to Category No.: 5561, 10056, 1182, 4010, 7366, 1084; Payload ID: 3524 relates to Category No.: 5561, 10056, 1182, 1772, 6075; Payload ID: 3525 relates to Category No.: 5561, 10056, 1182, 3666; Payload ID: 3526 relates to Category No.: 5561, 1182, 6075, 10056; Payload ID: 3527 relates to Category No.: 5561, 10056, 1182; Payload ID: 3528 relates to Category No.: 5561, 10056, 1182; Payload ID: 3529 relates to Category No.: 5561, 10056, 1182; Payload ID: 3530 relates to Category No.: 5561, 1182, 1099, 777, 2890, 9305, 1748; Payload ID: 3531 relates to Category No.: 5561, 10056, 1182, 4010; Payload ID: 3532 relates to Category No.: 5561, 10056, 1182; Payload ID: 3533 relates to Category No.: 5561, 10056, 1182; Payload ID: 3534 relates to Category No.: 5561, 10056, 1182; Payload ID: 3535 relates to Category No.: 5561, 10056, 1182; Payload ID: 3536 relates to Category No.: 5561, 10056, 1182; Payload ID: 3537 relates to Category No.: 5561, 1182, 5570, 4010, 6075, 781; Payload ID: 3538 relates to Category No.: 5561, 10056, 1182; Payload ID: 3539 relates to Category No.: 5561, 10056, 1182, 5570, 781, 1085, 779, 6075; Payload ID: 3540 relates to Category No.: 5561, 10056, 1182, 9577, 14384, 1811, 4010, 781, 2710; Payload ID: 3541 relates to Category No.: 5561, 10056, 1182, 781; Payload ID: 3542 relates to Category No.: 5561, 1182, 6075, 1099, 10056, 781; Payload ID: 3543 relates to Category No.: 5561, 10056, 1182, 3666, 1099, 781; Payload ID: 3544 relates to Category No.: 5561, 10056, 1182; Payload ID: 3545 relates to Category No.: 5561, 1792, 779; Payload ID: 3546 relates to Category No.:

5561; Payload ID: 3547 relates to Category No.: 3693, 15573, 2504, 3523, 15574, 2503; Payload ID: 3548 relates to Category No.: 3693, 15573, 3523, 2504, 15574, 2503; Payload ID: 3549 relates to Category No.: 15728, 2890, 9247, 7275, 9305; Payload ID: 3550 relates to Category No.: 9305, 9247, 7274; Payload ID: 3551 relates to Category No.: 6717, 9247, 7274; Payload ID: 3552 relates to Category No.: 14145, 9247, 7274; Payload ID: 3553 relates to Category No.: 2890, 1239, 5572; Payload ID: 3554 relates to Category No.: 9247, 7274; Payload ID: 3556 relates to Category No.: 9305, 6717, 14145, 9247, 7275, 9578; Payload ID: 3557 relates to Category No.: 9305, 6717, 9247, 7275; Payload ID: 3558 relates to Category No.: 9305, 2890, 5776, 9247; Payload ID: 3559 relates to Category No.: 9305, 9247, 7274, 2513; Payload ID: 3560 relates to Category No.: 9305, 5762; Payload ID: 3561 relates to Category No.: 9305, 5762, 9247; Payload ID: 3562 relates to Category No.: 5561, 6717, 5570, 4008; Payload ID: 3563 relates to Category No.: 9305; Payload ID: 3564 relates to Category No.: 9305, 15505, 5776, 9247, 2420, 2417, 2890; Payload ID: 3565 relates to Category No.: 9305; Payload ID: 3566 relates to Category No.: 7118, 1842; Payload ID: 3567 relates to Category No.: 5561, 6717; Payload ID: 3568 relates to Category No.: 2890; Payload ID: 3569 relates to Category No.: 4030, 4029, 9305, 7118, 2890, 5762, 2942, 4014, 7061, 3666, 4755, 9734, 1239, 4010, 1792, 11883, 10077, 775, 14852, 8901, 2399, 8935, 4860, 493; Payload ID: 3570 relates to Category No.: 2194, 5776, 9247, 11728, 2458, 5797, 2455; Payload ID: 3571 relates to Category No.: 4029; Payload ID: 3572 relates to Category No.: 9305, 2890; Payload ID: 3574 relates to Category No.: 1842; Payload ID: 3576 relates to Category No.: 5561; Payload ID: 3578 relates to Category No.: 2942, 4010; Payload ID: 3579 relates to Category No.: 2890, 6717; Payload ID: 3580 relates to Category No.: 2890, 9247, 7070, 7060, 4010; Payload ID: 3581 relates to Category No.: 9305, 2890, 2942, 9247, 14253; Payload ID: 3582 relates to Category No.: 2890, 5762, 2938, 4010, 9184; Payload ID: 3583 relates to Category No.: 4030, 4029, 10056, 2942, 1239, 4010, 3671, 4763, 4014; Payload ID: 3584 relates to Category No.: 5561, 4029, 10056, 2942, 5570, 4755, 11653, 3521, 8917, 1792, 6059, 1659, 10084; Payload ID: 3585 relates to Category No.: 5561, 10056, 2942, 5570, 4755, 3521, 12219; Payload ID: 3586 relates to Category No.: 5561, 4029, 10056, 5570, 779; Payload ID: 3587 relates to Category No.: 5561, 4029, 10056, 5570; Payload ID: 3588 relates to Category No.: 4030, 5561, 10056, 4014, 4010, 1792, 5817, 2890; Payload ID: 3589 relates to Category No.: 4030, 4029, 10056, 4010, 3671, 4763; Payload ID: 3590 relates to Category No.: 4029, 6717, 10056, 4765, 3671, 3831, 10077, 4032, 3686, 4030, 10076; Payload ID: 3591 relates to Category No.: 4029, 10056, 3671, 4763, 4030, 16156; Payload ID: 3592 relates to Category No.: 4030, 4029, 10056, 4765, 3671, 3831, 10077, 3686; Payload ID: 3593 relates to Category No.: 9305; Payload ID: 3594 relates to Category No.: 9305; Payload ID: 3595 relates to Category No.: 9305; Payload ID: 3596 relates to Category No.: 4029, 10056, 3671, 4763, 5817; Payload ID: 3597 relates to Category No.: 4030, 4029, 6717, 10056, 4010; Payload ID: 3598 relates to Category No.: 4030, 4029, 10056, 4010; Payload ID: 3599 relates to Category No.: 4029, 1239, 10077; Payload ID: 3600 relates to Category No.: 4029; Payload ID: 3601 relates to Category No.: 4030, 2890, 6717, 2942, 6722, 2663, 4010; Payload ID: 3602 relates to Category No.: 2890, 6717, 5776, 10056, 2942, 4765, 6722, 4755, 2663, 4786, 3685, 2664; Payload ID: 3603 relates to Category No.: 2942, 6722, 2663; Payload ID: 3604 relates to Category No.: 2942, 9247, 4755, 2663, 2664; Payload ID: 3605 relates to Category No.: 2942, 4765, 6722, 2663; Payload ID: 3606 relates to Category No.: 2942, 6722, 2663; Payload ID: 3607 relates to Category No.: 6722, 2942, 2663, 6717; Payload ID: 3608 relates to Category No.: 2477, 2663, 3686; Payload ID: 3614 relates to Category No.: 12159, 4014, 4010, 4029; Payload ID: 3615 relates to Category No.: 2890, 10056, 5561, 9305, 3652; Payload ID: 3616 relates to Category No.: 7048; Payload ID: 3617 relates to Category No.: 7048; Payload ID: 3618 relates to Category No.: 5561, 7048, 7118; Payload ID: 3619 relates to Category No.: 7118, 7048, 7060; Payload ID: 3620 relates to Category No.: 7118, 7048; Payload ID: 3621 relates to Category No.: 7118, 7048; Payload ID: 3622 relates to Category No.: 7118, 7048, 4755, 1774; Payload ID: 3623 relates to Category No.: 9305, 7118, 7048; Payload ID: 3624 relates to Category No.: 7118, 7048; Payload ID: 3625 relates to Category No.: 4030, 9305, 2890, 6717, 5762, 4010, 4228, 16156, 9181, 14329, 6019, 1811, 2710, 273; Payload ID: 3626 relates to Category No.: 4030, 5762, 273, 4010, 5342, 9181; Payload ID: 3627 relates to Category No.: 9305, 2890, 2183; Payload ID: 3628 relates to Category No.: 9305, 2890, 6717, 6976, 4010; Payload ID: 3629 relates to Category No.: 9305, 5776, 9247; Payload ID: 3630 relates to Category No.: 2938, 2942, 15243, 2457; Payload ID: 3632 relates to Category No.: 7394; Payload ID: 3634 relates to Category No.: 2890, 7244, 1046; Payload ID: 3635 relates to Category No.: 4010; Payload ID: 3636 relates to Category No.: 2890, 9242, 9247, 9305; Payload ID: 3637 relates to Category No.: 5561; Payload ID: 3638 relates to Category No.: 5561; Payload ID: 3639 relates to Category No.: 7118, 5819, 5562, 1402, 15975; Payload ID: 3640 relates to Category No.: 9305, 2890, 5776, 9242, 4755; Payload ID: 3642 relates to Category No.: 2890, 9247, 11883, 2182; Payload ID: 3643 relates to Category No.: 2458, 1046, 9474; Payload ID: 3644 relates to Category No.: 6443, 6717, 3693; Payload ID: 3645 relates to Category No.: 2890, 2194; Payload ID: 3648 relates to Category No.: 3693, 4860; Payload ID: 3651 relates to Category No.: 2890, 6976, 10056, 6994; Payload ID: 3652 relates to Category No.: 2890; Payload ID: 3653 relates to Category No.: 4029, 6717; Payload ID: 3654 relates to Category No.: 5561; Payload ID: 3656 relates to Category No.: 2194, 1774, 2182; Payload ID: 3657 relates to Category No.: 1842; Payload ID: 3658 relates to Category No.: 4029, 6717; Payload ID: 3659 relates to Category No.: 5561, 7118; Payload ID: 3660 relates to Category No.: 9242; Payload ID: 3662 relates to Category No.: 2194; Payload ID: 3664 relates to Category No.: 2890, 2194; Payload ID: 3668 relates to Category No.: 2183; Payload ID: 3671 relates to Category No.: 2194; Payload ID: 3673 relates to Category No.: 2183, 2458, 1046, 2441; Payload ID: 3676 relates to Category No.: 3521; Payload ID: 3677 relates to Category No.: 5561, 2420, 15269, 9192, 6066; Payload ID: 3682 relates to Category No.: 5561; Payload ID: 3684 relates to Category No.: 5561; Payload ID: 3692 relates to Category No.: 9247; Payload ID: 3697 relates to Category No.: 2183; Payload ID: 3698 relates to Category No.: 5561, 4010; Payload ID: 3699 relates to Category No.: 9247; Payload ID: 3700 relates to Category No.: 1842; Payload ID: 3702 relates to Category No.: 2890; Payload ID: 3705 relates to Category No.: 2194; Payload ID: 3710 relates to Category No.: 3693, 1842; Payload ID: 3712 relates to Category No.: 4010; Payload ID: 3715 relates to Category No.: 2890, 2194; Payload ID: 3716 relates to Category No.: 4029, 3666; Payload ID: 3717 relates to Category No.: 4010; Payload ID: 3721 relates to Category No.: 2890, 2194; Payload ID: 3722 relates to Category No.: 2938, 1046; Payload ID: 3723 relates to Category No.: 2890, 2458, 1046; Payload ID: 3726 relates to Category No.: 5561, 6717, 3666, 14293; Payload ID: 3727 relates to Category No.: 2890; Payload ID: 3728 relates to Category No.: 5561, 7118, 9247; Payload ID: 3729 relates to Category No.: 16269, 5776, 273, 3521; Payload ID: 3732 relates to Category No.: 7118; Payload ID: 3733 relates to Category No.: 9247; Payload ID: 3734 relates to Category No.: 2890, 2938; Payload ID: 3736 relates to Category No.: 2194; Payload ID: 3737 relates to Category No.: 9305, 2890, 10056, 9247; Payload ID: 3739 relates to Category No.: 2890, 2194; Payload ID: 3743 relates to Category No.: 3185, 5561, 2183; Payload ID: 3747 relates to Category No.: 4029, 10056; Payload ID: 3753 relates to Category No.: 6717, 2194; Payload ID: 3754 relates to Category No.: 3185, 9734, 14363, 2183, 14368, 2890; Payload ID: 3755 relates to Category No.: 2420, 15269; Payload ID: 3756 relates to Category No.: 2890, 2194, 10056, 117; Payload ID: 3757 relates to Category No.: 1090, 12159, 5749, 5561; Payload ID: 3758 relates to Category No.: 2890, 2194; Payload ID: 3763 relates to Category No.: 9305, 2890, 2194; Payload ID: 3764 relates to Category No.: 1182, 777; Payload ID: 3765 relates to Category No.: 9305, 9242, 9247; Payload ID: 3767 relates to Category No.: 6717, 10056, 2942, 3666, 2899, 4755, 6017, 2926; Payload ID: 3768 relates to Category No.: 6717; Payload ID: 3769 relates to Category No.: 2890; Payload ID: 3770 relates to Category No.: 9305, 2890; Payload ID: 3772 relates to Category No.: 5561, 7118; Payload ID: 3773 relates to Category No.: 9247, 4755, 6717; Payload ID: 3774 relates to Category No.: 2183; Payload ID: 3775 relates to Category No.: 3521; Payload ID: 3777 relates to Category No.: 2890, 6976; Payload ID: 3778 relates to Category No.: 15851; Payload ID: 3781 relates to Category No.: 4029; Payload ID: 3783 relates to Category No.: 6968; Payload ID: 3784 relates to Category No.: 9305, 7118, 2890, 9242, 9247, 7048; Payload ID: 3785 relates to Category No.: 7118, 7052; Payload ID: 3786 relates to Category No.: 9305, 7118; Payload ID: 3787 relates to Category No.: 9305, 7118, 2890, 7048, 4010, 6947, 5561; Payload ID: 3788 relates to Category No.: 7118, 7052; Payload ID: 3789 relates to Category No.: 7052; Payload ID: 3790 relates to Category No.: 7118, 7048, 6947; Payload ID: 3791 relates to Category No.: 7052, 7118; Payload ID: 3792 relates to Category No.: 9305, 2890, 6717, 9242, 9247, 1377, 4137; Payload ID: 3793 relates to Category No.: 9305, 2890, 9247, 2920; Payload ID: 3794 relates to Category No.: 9305, 2890; Payload ID: 3795 relates to Category No.: 2890, 10056, 4755, 2757, 7048; Payload ID: 3796 relates to Category No.: 4029, 4010; Payload ID: 3797 relates to Category No.: 4029; Payload ID: 3798 relates to Category No.: 4029; Payload ID: 3799 relates to Category No.: 4030, 12159, 2574; Payload ID: 3800 relates to Category No.: 6717, 3671; Payload ID: 3801 relates to Category No.: 3671; Payload ID: 3802 relates to Category No.: 4030, 12159, 2574, 2890; Payload ID: 3803 relates to Category No.: 4030, 4029, 2574, 4014, 3671, 2575, 2890, 12159, 4755, 3666, 14409; Payload ID: 3804 relates to Category No.: 4030, 4029, 2574, 4014, 4010, 3671, 2575, 12159; Payload ID: 3805 relates to Category No.: 4029, 2574, 4014, 3671, 2576, 2890, 1090, 4030, 12159; Payload ID: 3806 relates to Category No.: 4030, 4029, 2574, 4014, 3671, 2577, 12159; Payload ID: 3807 relates to Category No.: 4029, 2574, 4014, 1090, 3671, 2578; Payload ID: 3808 relates to Category No.: 4029, 5776, 2574, 4014, 4010, 3671, 2578, 1090; Payload ID: 3809 relates to Category No.: 4029, 2574, 1090, 3671, 2578; Payload ID: 3810 relates to Category No.: 2942, 3673, 9247, 4755, 9734, 7118; Payload ID: 3811 relates to Category No.: 4029, 2574, 3671, 1083, 2578, 1090; Payload ID: 3812 relates to Category No.: 4029, 2574, 3671, 1090, 8917, 1083, 2578; Payload ID: 3813 relates to Category No.: 4029, 2574, 3671, 2578, 12159, 1090; Payload ID: 3814 relates to Category No.: 4029, 12159, 3671, 2579; Payload ID: 3815 relates to Category No.: 4029, 12159, 3671, 2579; Payload ID: 3816 relates to Category No.: 4029, 12159, 3671, 2579; Payload ID: 3817 relates to Category No.: 4029, 2574, 4014, 4010, 3671, 2580, 1090, 12159; Payload ID: 3818 relates to Category No.: 4029, 2574, 4014, 3671, 2580, 12159; Payload ID: 3819 relates to Category No.: 4029, 2574, 4010, 3671, 2580, 4014; Payload ID: 3820 relates to Category No.: 4029, 6717, 4014, 4010, 11883, 6440, 3671, 2581, 14363, 12159; Payload ID: 3821 relates to Category No.: 4030, 4029, 12159, 2574, 4014, 4010, 11883, 3671, 4032, 14363; Payload ID: 3822 relates to Category No.: 4030, 4029, 12159, 4014, 4010, 3671, 4032, 2581, 14363, 2574; Payload ID: 3823 relates to Category No.: 4029, 12159, 2574, 4014; Payload ID: 3824 relates to Category No.: 4029, 12159, 2574; Payload ID: 3825 relates to Category No.: 4030, 4029, 4765, 4014, 1090, 3671, 3831, 3686, 2582; Payload ID: 3826 relates to Category No.: 4029, 5776, 4014, 4010, 3671, 2583; Payload ID: 3827 relates to Category No.: 4029, 12159, 2574, 4014, 1090, 3671; Payload ID: 3828 relates to Category No.: 4029, 12159, 3671, 1720, 2574; Payload ID: 3829 relates to Category No.: 4029, 2574, 3671, 2584, 12159, 4014; Payload ID: 3830 relates to Category No.: 14174, 2574, 4029, 3671, 2584, 12159; Payload ID: 3831 relates to Category No.: 4030, 4029, 4014, 4010, 3671, 4032, 2585; Payload ID: 3832 relates to Category No.: 4029, 10056, 3671, 2586, 1811; Payload ID: 3833 relates to Category No.: 4030, 4029, 12159, 2574, 4014, 4010, 3671, 2587, 5749; Payload ID: 3834 relates to Category No.: 4029, 12159, 2574, 3671; Payload ID: 3835 relates to Category No.: 4030, 5561, 4029, 4014, 4010, 3671, 2588, 1090, 12159, 2574; Payload ID: 3836 relates to Category No.: 4029, 12159, 3671, 2589; Payload ID: 3837 relates to Category No.: 4029, 10056, 2574, 5570, 1811, 1090, 3671, 4989; Payload ID: 3838 relates to Category No.: 4030, 4029, 2574, 4014, 4010, 3671, 1090; Payload ID: 3839 relates to Category No.: 4030, 4029, 2574, 4014, 3671; Payload ID: 3840 relates to Category No.: 4029, 12159, 2574, 4014, 3671; Payload ID: 3841 relates to Category No.: 4029, 12159, 2574, 3671; Payload ID: 3842 relates to Category No.: 5561, 10056, 2574, 3671; Payload ID: 3843 relates to Category No.: 4029, 12159, 2574, 3671; Payload ID: 3844 relates to Category No.: 5561, 4030, 4029, 10056, 2574, 5570, 3671; Payload ID: 3845 relates to Category No.: 4029, 10056, 12159, 2574, 4014, 3671, 4755, 3666; Payload ID: 3846 relates to Category No.: 4029, 2574, 3671, 4176; Payload ID: 3847 relates to Category No.: 4029, 2574, 1090, 3671; Payload ID: 3848 relates to Category No.: 4030, 2574, 1748, 1083, 15145, 8917; Payload ID: 3849 relates to Category No.: 2890, 6976, 2942, 14893, 8948, 3036; Payload ID: 3850 relates to Category No.: 4029, 2890, 2574; Payload ID: 3851 relates to Category No.: 4029, 2574; Payload ID: 3852 relates to Category No.: 5561, 10056, 2574, 4010, 3638; Payload ID: 3853 relates to Category No.: 5561, 4030, 6717, 10056, 9734, 4010, 2772; Payload ID: 3854 relates to Category No.: 5561, 6717, 10056, 5570, 1792, 2772, 5762; Payload ID: 3855 relates to Category No.: 4029, 5762, 4030; Payload ID: 3856 relates to Category No.: 4029, 6717, 5762, 10056, 5570; Payload ID: 3857 relates to Category No.: 5561, 6717, 5762, 10056, 5570, 4847; Payload ID: 3858 relates to Category No.: 4029, 4030; Payload ID: 3859 relates to Category No.: 4029, 6717, 5570, 5561; Payload ID: 3860 relates to Category No.: 2890; Payload ID:

3861 relates to Category No.: 9305, 2890; Payload ID: 3862 relates to Category No.: 2890; Payload ID: 3863 relates to Category No.: 9305, 2890; Payload ID: 3864 relates to Category No.: 9305, 2890; Payload ID: 3865 relates to Category No.: 9305, 2890; Payload ID: 3866 relates to Category No.: 9305, 2890; Payload ID: 3867 relates to Category No.: 2899, 4010, 5561; Payload ID: 3868 relates to Category No.: 9305, 2890; Payload ID: 3869 relates to Category No.: 9305, 2899; Payload ID: 3871 relates to Category No.: 10056, 5570, 4010, 1792, 5561; Payload ID: 3872 relates to Category No.: 4029, 2890, 6717, 12406; Payload ID: 3873 relates to Category No.: 5561, 10056, 4010, 12406, 4008; Payload ID: 3874 relates to Category No.: 9305, 7118, 2890, 6717, 10056, 9242, 2942, 7060, 1792, 4030; Payload ID: 3875 relates to Category No.: 4029, 2574, 4010, 2612; Payload ID: 3876 relates to Category No.: 4029, 2574, 1239, 4010, 2612; Payload ID: 3877 relates to Category No.: 4030, 4029, 2574, 1239, 4010; Payload ID: 3878 relates to Category No.: 4029, 2574, 1842, 2890; Payload ID: 3879 relates to Category No.: 4029, 2574; Payload ID: 3880 relates to Category No.: 4029, 2574; Payload ID: 3881 relates to Category No.: 2574, 4030; Payload ID: 3882 relates to Category No.: 4029, 1239, 4010; Payload ID: 3883 relates to Category No.: 4030, 4010; Payload ID: 3884 relates to Category No.: 4029, 1239, 4010; Payload ID: 3885 relates to Category No.: 4030, 4029, 4010; Payload ID: 3886 relates to Category No.: 4030, 4029, 10056, 1239, 4010; Payload ID: 3887 relates to Category No.: 5561, 10056, 2942, 5570; Payload ID: 3888 relates to Category No.: 4030, 4029, 10056, 1239, 9463; Payload ID: 3889 relates to Category No.: 4030, 4029, 10056, 9463; Payload ID: 3890 relates to Category No.: 4030, 4029, 10056, 1239, 4010; Payload ID: 3891 relates to Category No.: 4030, 4029, 10056, 1239, 4010, 9463; Payload ID: 3892 relates to Category No.: 4030, 4029, 10056, 1239, 4010, 9463; Payload ID: 3893 relates to Category No.: 4030, 4029, 4010, 6719; Payload ID: 3894 relates to Category No.: 5561, 10056, 2942, 5570, 2899, 1099, 778, 1792; Payload ID: 3895 relates to Category No.: 5561, 10056, 1085, 778; Payload ID: 3896 relates to Category No.: 4029, 4010, 6719; Payload ID: 3897 relates to Category No.: 4029, 4010, 6719; Payload ID: 3898 relates to Category No.: 4030, 4029, 6717, 1239, 4010, 6719; Payload ID: 3899 relates to Category No.: 4029, 6717, 4010, 6719, 4032, 4030; Payload ID: 3900 relates to Category No.: 4029, 1239, 4010, 6719, 4030; Payload ID: 3901 relates to Category No.: 4029, 2890, 10056, 5570, 1239, 4010, 6719; Payload ID: 3902 relates to Category No.: 4030, 4029, 10056, 1239, 4010; Payload ID: 3903 relates to Category No.: 4029, 4010, 10077, 4030; Payload ID: 3904 relates to Category No.: 4030, 4029, 1239, 4010; Payload ID: 3905 relates to Category No.: 4030, 1239, 4010; Payload ID: 3906 relates to Category No.: 4029; Payload ID: 3907 relates to Category No.: 4030, 1239, 4010; Payload ID: 3908 relates to Category No.: 4029; Payload ID: 3909 relates to Category No.: 4029; Payload ID: 3910 relates to Category No.: 4029; Payload ID: 3911 relates to Category No.: 6717, 4030, 4029, 4010; Payload ID: 3912 relates to Category No.: 4030, 4029, 4014, 3671; Payload ID: 3913 relates to Category No.: 2942, 15172, 14707, 15139, 3036, 11883, 8948, 15280, 15170; Payload ID: 3914 relates to Category No.: 2942, 6617, 15172, 14707, 15139, 3036, 8948, 15280, 15171; Payload ID: 3915 relates to Category No.: 15139, 1748, 2942, 6717, 10056; Payload ID: 3916 relates to Category No.: 6717, 1700, 15139, 1748; Payload ID: 3917 relates to Category No.: 4765, 4755, 4780; Payload ID: 3918 relates to Category No.: 4765, 4780, 4769, 2942, 6717; Payload ID: 3919 relates to Category No.: 2890, 6717, 10056, 2477, 9247, 4755, 4780, 4760; Payload ID: 3920 relates to Category No.: 3666, 4765, 4780; Payload ID: 3921 relates to Category No.: 6717, 2942, 4765, 9247, 4755, 4780; Payload ID: 3922 relates to Category No.: 4765, 4780, 5762; Payload ID: 3923 relates to Category No.: 5776, 9242, 4765, 4755, 4780; Payload ID: 3924 relates to Category No.: 4780, 6717, 4765; Payload ID: 3925 relates to Category No.: 9305, 15505; Payload ID: 3926 relates to Category No.: 4029, 5776, 10056, 12159, 4755, 2942, 4030, 2477, 9734, 1720; Payload ID: 3927 relates to Category No.: 10056, 1720, 1811; Payload ID: 3928 relates to Category No.: 2890, 6717, 10056, 4755, 4010, 8951, 11653, 8935, 8948; Payload ID: 3929 relates to Category No.: 2890, 5776, 2942, 9247, 2918, 1682, 5358; Payload ID: 3930 relates to Category No.: 5561, 6717, 10056, 15627, 15573, 11883; Payload ID: 3931 relates to Category No.: 6717, 10056, 677, 4010, 7366, 6743; Payload ID: 3932 relates to Category No.: 10056, 677, 5570, 15139, 7366, 9087, 5921, 1792, 8948, 1017, 8935, 16257; Payload ID: 3933 relates to Category No.: 10056, 677; Payload ID: 3934 relates to Category No.: 4029, 10056, 677, 1017; Payload ID: 3935 relates to Category No.: 2890, 10056, 677; Payload ID: 3936 relates to Category No.: 10056, 677, 5561; Payload ID: 3937 relates to Category No.: 5561, 16257, 5570, 9577, 7366, 1017; Payload ID: 3938 relates to Category No.: 5561, 6717, 16257, 4755, 3521, 1792, 5921, 1016; Payload ID: 3939 relates to Category No.: 5561, 4029, 10056; Payload ID: 3940 relates to Category No.: 5561; Payload ID: 3941 relates to Category No.: 5561, 1748, 11723, 3036; Payload ID: 3942 relates to Category No.: 5561; Payload ID: 3943 relates to Category No.: 9305, 2890, 10056, 9247; Payload ID: 3944 relates to Category No.: 2890, 9247, 2660, 9305; Payload ID: 3945 relates to Category No.: 9305, 2890, 9247, 2660; Payload ID: 3946 relates to Category No.: 9305, 2942, 15151, 9247, 1748, 2660, 4010; Payload ID: 3947 relates to Category No.: 9305, 2890, 15151, 3964, 9247, 9734, 1748, 2660; Payload ID: 3948 relates to Category No.: 2890, 9247, 2660, 4010; Payload ID: 3949 relates to Category No.: 2890, 9247, 2660; Payload ID: 3950 relates to Category No.: 2890, 9247, 2660; Payload ID: 3951 relates to Category No.: 9305, 2890, 9247, 9734, 2660, 4010; Payload ID: 3952 relates to Category No.: 4030, 4010; Payload ID: 3953 relates to Category No.: 9305, 2890, 6717, 10056, 2942, 4010; Payload ID: 3954 relates to Category No.: 9305, 2890, 10056, 4010; Payload ID: 3955 relates to Category No.: 9305, 2890, 10056, 2942, 1748, 4010, 4228; Payload ID: 3956 relates to Category No.: 4010; Payload ID: 3957 relates to Category No.: 9730, 4010, 8948, 8935; Payload ID: 3958 relates to Category No.: 6717, 10056, 3693, 3036, 1017, 9730, 4010, 2890, 2502; Payload ID: 3959 relates to Category No.: 9305, 2890, 10056, 4010; Payload ID: 3960 relates to Category No.: 4010; Payload ID: 3961 relates to Category No.: 9305, 2890, 2942; Payload ID: 3962 relates to Category No.: 9305, 12439, 2890, 9247, 2899, 3521, 4010, 3696, 2785; Payload ID: 3963 relates to Category No.: 7118, 2890, 7052, 6717, 7048, 5561; Payload ID: 3964 relates to Category No.: 6717, 10056, 9734, 1720, 8948, 3036, 276, 1017, 1036, 14327, 3052; Payload ID: 3965 relates to Category No.: 4010; Payload ID: 3966 relates to Category No.: 5561, 6717, 4765; Payload ID: 3967 relates to Category No.: 9305, 6717; Payload ID: 3968 relates to Category No.: 9305; Payload ID: 3969 relates to Category No.: 9305, 9242, 4765, 9247, 5762; Payload ID: 3970 relates to Category No.: 9305, 2890, 6976, 5110, 9215; Payload ID: 3971 relates to Category No.: 5561, 4029, 6717, 10056, 5570, 1792; Payload ID: 3972 relates to Category No.: 3113, 1811, 4010, 2701; Payload ID: 3973 relates to Category No.: 5561, 6717, 4765, 3673, 3832, 3686, 5762;

Payload ID: 3974 relates to Category No.: 5561, 6717, 5762, 4765, 3673, 1748, 11650, 3036, 657, 11653, 3054, 3055, 3832, 3686; Payload ID: 3975 relates to Category No.: 6717, 4765, 3673, 1748, 657, 11653, 3054, 3832, 3686; Payload ID: 3976 relates to Category No.: 5561, 6717, 3666, 3685, 5762; Payload ID: 3977 relates to Category No.: 2890, 4010, 2701; Payload ID: 3978 relates to Category No.: 2890, 6717, 4010; Payload ID: 3979 relates to Category No.: 4755; Payload ID: 3980 relates to Category No.: 273; Payload ID: 3981 relates to Category No.: 5561, 6717, 2942, 4765, 2899, 4755, 15573; Payload ID: 3982 relates to Category No.: 273, 2890, 6717, 10056, 276, 6017, 4010, 9773, 9776, 11883, 5392, 2710, 9774, 1811, 1017, 3521, 1750; Payload ID: 3983 relates to Category No.: 273, 2890, 10056, 2942, 9734, 276, 6017, 1750, 4010, 1772, 4228, 14999; Payload ID: 3984 relates to Category No.: 2890, 273, 6017, 4228, 16156, 6075, 4220; Payload ID: 3985 relates to Category No.: 273, 15531; Payload ID: 3986 relates to Category No.: 2890, 6717, 273; Payload ID: 3987 relates to Category No.: 2890, 16257, 2938, 1720, 2534, 276, 6017, 4860, 4010, 10106, 14327, 4228, 3055, 2712, 7166; Payload ID: 3988 relates to Category No.: 1720, 3055, 15151; Payload ID: 3989 relates to Category No.: 5561, 5819; Payload ID: 3990 relates to Category No.: 5561, 5819; Payload ID: 3991 relates to Category No.: 5561, 5819; Payload ID: 3992 relates to Category No.: 4030, 4029, 2890, 8948, 9730, 16078; Payload ID: 3993 relates to Category No.: 4030, 9305, 5762, 6960, 3036, 14409, 9730, 1033, 7321, 14399, 3065, 16078; Payload ID: 3994 relates to Category No.: 5561, 6717, 10056, 5570, 5823; Payload ID: 3995 relates to Category No.: 5561, 6717, 2942, 10056, 3036, 8948, 778, 15573, 7321, 16156; Payload ID: 3996 relates to Category No.: 5561, 6717, 10056, 5570, 1792, 4755, 3666, 3036, 1017, 8948, 1033, 14293, 9730, 1712, 16078; Payload ID: 3997 relates to Category No.: 4030, 4029; Payload ID: 3998 relates to Category No.: 5561, 7118, 7048, 7061, 2870; Payload ID: 3999 relates to Category No.: 5561, 7118, 7048; Payload ID: 4000 relates to Category No.: 5561, 7118, 7061; Payload ID: 4001 relates to Category No.: 5561, 7061, 1842, 7118; Payload ID: 4002 relates to Category No.: 7118, 2890, 7052; Payload ID: 4003 relates to Category No.: 5561, 5562, 7118; Payload ID: 4004 relates to Category No.: 2890, 7052, 2942; Payload ID: 4005 relates to Category No.: 5561, 7118, 7061; Payload ID: 4006 relates to Category No.: 4030, 4029, 2890, 10056, 1182, 8935, 5570, 9247, 1748, 1099, 447, 1811, 4199, 4860, 8917, 6743, 11883, 262, 781, 5596, 1711; Payload ID: 4016 relates to Category No.: 9305; Payload ID: 4017 relates to Category No.: 2630, 1842; Payload ID: 4018 relates to Category No.: 4030, 4029, 4010; Payload ID: 4019 relates to Category No.: 4030, 2942, 4010, 7118, 7366; Payload ID: 4020 relates to Category No.: 7118, 7048, 4010; Payload ID: 4021 relates to Category No.: 7118, 7048, 4010; Payload ID: 4022 relates to Category No.: 7118, 7048; Payload ID: 4023 relates to Category No.: 2942; Payload ID: 4024 relates to Category No.: 9305, 2890, 9247, 9157, 5102, 9155, 15505, 2631, 14253, 11883; Payload ID: 4025 relates to Category No.: 9305, 2890, 10056, 9247, 15139, 3036, 8948; Payload ID: 4026 relates to Category No.: 9305, 2890, 9247, 4010; Payload ID: 4027 relates to Category No.: 9305, 2890, 9247; Payload ID: 4028 relates to Category No.: 9305; Payload ID: 4029 relates to Category No.: 9305, 2890, 9155; Payload ID: 4030 relates to Category No.: 4029, 10056, 677, 1842; Payload ID: 4031 relates to Category No.: 4029; Payload ID: 4032 relates to Category No.: 9305, 5762, 2890, 11691, 14912, 1635, 9215, 12218, 1634, 11719, 11647; Payload ID: 4033 relates to Category No.: 5561, 4029, 779, 10056, 6989; Payload ID: 4034 relates to Category No.: 5561, 10056, 4010, 6743, 11883; Payload ID: 4035 relates to Category No.: 5561, 10056, 1182, 1748, 4010, 779, 778, 11883; Payload ID: 4036 relates to Category No.: 9305, 7118; Payload ID: 4037 relates to Category No.: 4029, 9305, 2890, 7118; Payload ID: 4038 relates to Category No.: 9305, 2890, 4010; Payload ID: 4039 relates to Category No.: 9305, 2890, 4010, 2942, 10056, 7118, 16326, 7366, 2649, 4755, 1792, 6968, 279, 5342; Payload ID: 4040 relates to Category No.: 9305, 2890; Payload ID: 4041 relates to Category No.: 1842; Payload ID: 4042 relates to Category No.: 1842; Payload ID: 4046 relates to Category No.: 1842; Payload ID: 4047 relates to Category No.: 1842, 2890, 9305; Payload ID: 4048 relates to Category No.: 9305, 2890; Payload ID: 4049 relates to Category No.: 9305, 2890; Payload ID: 4052 relates to Category No.: 9305, 2890, 10056, 9242, 2942, 4755, 4010; Payload ID: 4053 relates to Category No.: 2890, 4010, 9753, 9305, 7118; Payload ID: 4054 relates to Category No.: 2890, 5776, 2942, 4755, 4010; Payload ID: 4055 relates to Category No.: 2942; Payload ID: 4056 relates to Category No.: 9305, 2890, 6717, 2942, 9247, 4010, 9162; Payload ID: 4057 relates to Category No.: 2890, 10056, 2942, 4043, 4010, 1811, 6743; Payload ID: 4058 relates to Category No.: 9305, 2890, 401; Payload ID: 4059 relates to Category No.: 5561; Payload ID: 4060 relates to Category No.: 5561, 1842; Payload ID: 4061 relates to Category No.: 5561, 6717, 3673; Payload ID: 4062 relates to Category No.: 5561, 1842; Payload ID: 4063 relates to Category No.: 5561; Payload ID: 4064 relates to Category No.: 5561; Payload ID: 4065 relates to Category No.: 9305; Payload ID: 4066 relates to Category No.: 5561; Payload ID: 4069 relates to Category No.: 4029; Payload ID: 4071 relates to Category No.: 5561; Payload ID: 4072 relates to Category No.: 10056; Payload ID: 4075 relates to Category No.: 2890; Payload ID: 4077 relates to Category No.: 5561; Payload ID: 4078 relates to Category No.: 5762; Payload ID: 4080 relates to Category No.: 5762; Payload ID: 4081 relates to Category No.: 2890, 11837; Payload ID: 4083 relates to Category No.: 14559; Payload ID: 4085 relates to Category No.: 5762; Payload ID: 4087 relates to Category No.: 9305, 2901, 1154; Payload ID: 4088 relates to Category No.: 9305, 2890, 2194, 14906, 9247, 6994, 273, 14893, 14903; Payload ID: 4089 relates to Category No.: 9305, 4010; Payload ID: 4090 relates to Category No.: 9247; Payload ID: 4091 relates to Category No.: 9305; Payload ID: 4092 relates to Category No.: 9305, 4010; Payload ID: 4093 relates to Category No.: 5561, 2890, 3673, 9184, 8842, 9162, 9305; Payload ID: 4094 relates to Category No.: 5561, 2890, 9184, 8842, 9162; Payload ID: 4095 relates to Category No.: 5762; Payload ID: 4096 relates to Category No.: 5762; Payload ID: 4100 relates to Category No.: 10056, 3521, 3636, 6717, 5762, 9305; Payload ID: 4102 relates to Category No.: 5762; Payload ID: 4103 relates to Category No.: 5762; Payload ID: 4105 relates to Category No.: 16057; Payload ID: 4106 relates to Category No.: 16057; Payload ID: 4110 relates to Category No.: 1323, 1328; Payload ID: 4112 relates to Category No.: 4029; Payload ID: 4113 relates to Category No.: 5762; Payload ID: 4116 relates to Category No.: 9305; Payload ID: 4117 relates to Category No.: 5561; Payload ID: 4119 relates to Category No.: 6717; Payload ID: 4121 relates to Category No.: 5561; Payload ID: 4122 relates to Category No.: 5762; Payload ID: 4125 relates to Category No.: 9305; Payload ID: 4126 relates to Category No.: 5762; Payload ID: 4128 relates to Category No.: 5762; Payload ID: 4134 relates to Category No.: 5762; Payload ID: 4135 relates to Category No.: 5762; Payload ID: 4136 relates to Category No.: 5762; Payload ID: 4139 relates to Category No.: 5561, 7118; Payload ID: 4140 relates to Category No.: 9305, 6653;

Payload ID: 4141 relates to Category No.: 9305, 2890, 9247, 15531, 15505; Payload ID: 4142 relates to Category No.: 9305, 1748, 15531, 15139, 14125; Payload ID: 4143 relates to Category No.: 6717, 2942; Payload ID: 4144 relates to Category No.: 2942, 7118; Payload ID: 4145 relates to Category No.: 1691, 9215, 15532, 9305; Payload ID: 4146 relates to Category No.: 9305, 9158, 15269, 14993; Payload ID: 4147 relates to Category No.: 2890, 273; Payload ID: 4148 relates to Category No.: 5762, 5570, 5561; Payload ID: 4149 relates to Category No.: 5570; Payload ID: 4150 relates to Category No.: 5561, 10056; Payload ID: 4151 relates to Category No.: 4030, 4029, 2890; Payload ID: 4152 relates to Category No.: 5561, 10056; Payload ID: 4153 relates to Category No.: 5561, 10056; Payload ID: 4154 relates to Category No.: 5561, 4010; Payload ID: 4155 relates to Category No.: 3696, 6440; Payload ID: 4156 relates to Category No.: 5561, 1792; Payload ID: 4157 relates to Category No.: 4030, 3693, 3666, 4755; Payload ID: 4158 relates to Category No.: 4029, 3693, 4755, 14368; Payload ID: 4159 relates to Category No.: 4029, 3693, 3666, 4755; Payload ID: 4160 relates to Category No.: 4029; Payload ID: 4161 relates to Category No.: 5561, 10056; Payload ID: 4162 relates to Category No.: 10056, 5570; Payload ID: 4163 relates to Category No.: 6717, 10056, 5570, 3666, 1792, 5561; Payload ID: 4164 relates to Category No.: 5561; Payload ID: 4166 relates to Category No.: 4030, 4029, 2890, 4014, 4010, 4837; Payload ID: 4167 relates to Category No.: 10056, 5570, 5561; Payload ID: 4168 relates to Category No.: 5561, 10056; Payload ID: 4169 relates to Category No.: 5561, 10056; Payload ID: 4170 relates to Category No.: 5561, 10056; Payload ID: 4171 relates to Category No.: 5561; Payload ID: 4172 relates to Category No.: 5561, 10056; Payload ID: 4173 relates to Category No.: 4029, 2890, 6717, 5570, 5561; Payload ID: 4174 relates to Category No.: 10056, 5570, 1792, 5561; Payload ID: 4175 relates to Category No.: 5561, 10056; Payload ID: 4176 relates to Category No.: 5561, 2890, 10056; Payload ID: 4177 relates to Category No.: 5561, 1792; Payload ID: 4178 relates to Category No.: 5561, 10056; Payload ID: 4180 relates to Category No.: 5561; Payload ID: 4181 relates to Category No.: 5561, 10056; Payload ID: 4182 relates to Category No.: 5561, 10056; Payload ID: 4183 relates to Category No.: 5561, 15628, 16346, 16344; Payload ID: 4184 relates to Category No.: 5561, 4029, 10056; Payload ID: 4185 relates to Category No.: 4029; Payload ID: 4186 relates to Category No.: 6717, 10056, 2942, 3636, 4010, 3696, 6440, 779, 1336, 6437, 4046, 2890, 4755, 3666, 3693, 2534, 1335, 778; Payload ID: 4188 relates to Category No.: 2890, 9247, 9184; Payload ID: 4189 relates to Category No.: 9305, 2890, 6717, 14145, 9247; Payload ID: 4190 relates to Category No.: 9305, 2890; Payload ID: 4191 relates to Category No.: 9305, 2890; Payload ID: 4192 relates to Category No.: 9305, 2890; Payload ID: 4193 relates to Category No.: 9305, 2890; Payload ID: 4194 relates to Category No.: 9305, 2890; Payload ID: 4195 relates to Category No.: 2942, 2794, 9247, 14382, 9589; Payload ID: 4196 relates to Category No.: 2794, 9247, 2942, 2785, 9242, 16110; Payload ID: 4197 relates to Category No.: 6717, 2942, 2794, 4765, 9247, 2786, 4010, 10110, 2890, 9305, 4755; Payload ID: 4198 relates to Category No.: 2794, 9247, 2789, 2787; Payload ID: 4199 relates to Category No.: 2890, 10056, 2794, 9247, 4010, 2788, 9305, 2942; Payload ID: 4200 relates to Category No.: 2942, 2794, 2790; Payload ID: 4201 relates to Category No.: 9305, 2890, 2194, 2942, 668, 9247, 4755, 9734, 2791, 117; Payload ID: 4202 relates to Category No.: 2890, 2794; Payload ID: 4203 relates to Category No.: 9305, 2890, 6717, 2794, 15892, 9247, 4010; Payload ID: 4204 relates to Category No.: 9305, 5762; Payload ID: 4205 relates to Category No.: 6717, 4010, 5561; Payload ID: 4206 relates to Category No.: 5561, 1842; Payload ID: 4207 relates to Category No.: 9305, 2890, 9242, 9247; Payload ID: 4208 relates to Category No.: 5559, 9305, 2942, 2890, 8935, 4765; Payload ID: 4209 relates to Category No.: 9305, 4010; Payload ID: 4210 relates to Category No.: 9305, 9247, 14912, 1635; Payload ID: 4211 relates to Category No.: 2890, 9247, 4755, 14912, 1635, 15853, 9215; Payload ID: 4213 relates to Category No.: 1635, 9305; Payload ID: 4214 relates to Category No.: 1842; Payload ID: 4216 relates to Category No.: 7118; Payload ID: 4217 relates to Category No.: 7118; Payload ID: 4218 relates to Category No.: 7118; Payload ID: 4219 relates to Category No.: 5561, 10056, 1182, 2901, 4010, 1792, 6717; Payload ID: 4220 relates to Category No.: 9305, 2890, 9247, 14529, 9215, 5216, 9181; Payload ID: 4221 relates to Category No.: 9305, 2899; Payload ID: 4222 relates to Category No.: 2890, 9247; Payload ID: 4224 relates to Category No.: 2942; Payload ID: 4225 relates to Category No.: 6717, 10056, 5570, 10002, 10003; Payload ID: 4226 relates to Category No.: 6717, 4765, 5570, 4788, 2446; Payload ID: 4227 relates to Category No.: 6717, 5570, 15620, 10056, 2890, 3036, 8948, 10003, 9730; Payload ID: 4228 relates to Category No.: 5570, 6717, 4765, 4788, 2446, 10056, 5771, 9730; Payload ID: 4229 relates to Category No.: 10056, 4765, 5570, 4788, 2446, 15620, 10002, 6717; Payload ID: 4230 relates to Category No.: 5570, 15620, 10002; Payload ID: 4231 relates to Category No.: 9305, 2942, 9247, 6968; Payload ID: 4232 relates to Category No.: 9305, 2890, 9247, 4146, 6536; Payload ID: 4233 relates to Category No.: 5561, 10056; Payload ID: 4234 relates to Category No.: 5561, 1099; Payload ID: 4235 relates to Category No.: 5561, 6717, 10056; Payload ID: 4236 relates to Category No.: 5561, 1099; Payload ID: 4237 relates to Category No.: 9305, 2890, 2194, 2942, 14906, 9247, 2634, 6717; Payload ID: 4238 relates to Category No.: 15173, 2632; Payload ID: 4239 relates to Category No.: 9305, 2194, 2942, 9247, 6968, 6717; Payload ID: 4240 relates to Category No.: 9305, 9247; Payload ID: 4241 relates to Category No.: 9247, 2831, 6653, 9305, 15892; Payload ID: 4242 relates to Category No.: 9305, 2890, 9247; Payload ID: 4243 relates to Category No.: 9305, 6717, 5762, 2942, 9247, 15531, 2831, 2890, 1182; Payload ID: 4244 relates to Category No.: 9305, 9242, 2942, 9247, 2402, 9184, 2831; Payload ID: 4245 relates to Category No.: 9305, 2890, 6717, 9247, 2831; Payload ID: 4246 relates to Category No.: 9305, 2890, 9247; Payload ID: 4247 relates to Category No.: 9305, 2942, 9247, 2831, 2890, 2194; Payload ID: 4248 relates to Category No.: 9305, 2942, 9247; Payload ID: 4249 relates to Category No.: 9305, 14382, 2183; Payload ID: 4250 relates to Category No.: 6717, 5776, 4755, 9734, 4228, 16156; Payload ID: 4251 relates to Category No.: 9305; Payload ID: 4252 relates to Category No.: 2890; Payload ID: 4253 relates to Category No.: 15324, 9305, 9247, 2829, 5238; Payload ID: 4256 relates to Category No.: 9305; Payload ID: 4257 relates to Category No.: 9305; Payload ID: 4258 relates to Category No.: 9305, 2824, 2825; Payload ID: 4259 relates to Category No.: 9305, 9215, 2831; Payload ID: 4260 relates to Category No.: 9305, 5776, 9242, 9247, 1748, 9215, 2831; Payload ID: 4262 relates to Category No.: 9305; Payload ID: 4263 relates to Category No.: 2890, 9247, 9305; Payload ID: 4264 relates to Category No.: 5561; Payload ID: 4265 relates to Category No.: 9305, 9247, 2831, 11627; Payload ID: 4266 relates to Category No.: 9305, 9247, 2831; Payload ID: 4267 relates to Category No.: 9305, 10056, 4010, 2895; Payload ID: 4269 relates to Category No.: 9305, 7118, 2890, 6717, 2194, 2942, 9247, 6994, 14902, 4010, 9158, 15269, 7161; Payload ID: 4271 relates to Category No.: 9305, 2890, 9247; Payload ID: 4273 relates to Category No.: 9305, 9242, 9247, 9215, 2824, 9160; Payload ID: 4274 relates to Category No.: 4030, 2890, 9247, 4755, 9215, 2825, 9160; Payload ID: 4275 relates to Category No.: 9305, 2890, 10056, 2895, 2942; Payload ID: 4277 relates to Category No.: 2890, 10056, 15151, 8935, 4043, 15627, 1748, 6968; Payload ID: 4279 relates to Category No.: 1842; Payload ID: 4280 relates to Category No.: 9305, 2942; Payload ID: 4281 relates to Category No.: 9305, 2890, 2194, 2942, 3693, 9247, 1377, 2831, 15505, 2628, 2420, 15269, 16298, 16324, 5776; Payload ID: 4282 relates to Category No.: 9305, 9734; Payload ID: 4284 relates to Category No.: 9305; Payload ID: 4285 relates to Category No.: 9305, 2890, 2458; Payload ID: 4287 relates to Category No.: 9305, 9242, 2942, 9247, 2402, 9184, 2831, 1182, 15505, 9734; Payload ID: 4288 relates to Category No.: 9305, 2890, 6717, 2942, 1748, 11650, 8948, 3036, 11653, 6017, 1017, 4860, 9730, 8917, 4199, 2938, 2827; Payload ID: 4289 relates to Category No.: 9305, 2890, 6717, 5776, 10056, 2942, 9247, 9734, 11650, 8948, 3036, 1017, 4860, 8917, 3055, 2649, 2827; Payload ID: 4290 relates to Category No.: 10056, 2827, 2890; Payload ID: 4291 relates to Category No.: 9305, 2890, 2194, 2942, 9247, 14327, 2831; Payload ID: 4292 relates to Category No.: 9305, 7118, 2890, 9247, 9734, 5238; Payload ID: 4293 relates to Category No.: 9305, 9247, 6653; Payload ID: 4294 relates to Category No.: 2890, 6717, 5776, 9247, 15497, 10104, 11627, 9305; Payload ID: 4295 relates to Category No.: 9305, 5776, 2942, 9247, 2831, 9605, 2890, 9734; Payload ID: 4296 relates to Category No.: 9305, 2890, 2942, 3693, 9247, 2787, 11883; Payload ID: 4297 relates to Category No.: 9305; Payload ID: 4298 relates to Category No.: 9305, 2890, 2942, 14443, 7118, 9242, 9247, 11883, 9155; Payload ID: 4299 relates to Category No.: 9305, 2890, 2942, 9247; Payload ID: 4300 relates to Category No.: 9305, 2890, 2942; Payload ID: 4301 relates to Category No.: 9305, 2890, 2942; Payload ID: 4302 relates to Category No.: 9305, 2890, 9734; Payload ID: 4303 relates to Category No.: 9305, 2890, 4010; Payload ID: 4304 relates to Category No.: 9305, 2890, 2194, 9247; Payload ID: 4305 relates to Category No.: 2890; Payload ID: 4306 relates to Category No.: 2890; Payload ID: 4307 relates to Category No.: 9305, 2890, 9247, 14329, 3052, 3037; Payload ID: 4308 relates to Category No.: 9305, 260, 2934; Payload ID: 4309 relates to Category No.: 9305, 2934; Payload ID: 4310 relates to Category No.: 2194, 2942, 4043, 9247, 6994, 9734, 2901, 14893, 2455, 2441; Payload ID: 4311 relates to Category No.: 3673, 5561; Payload ID: 4312 relates to Category No.: 9305, 2890, 2942, 9247, 4010; Payload ID: 4313 relates to Category No.: 9305, 2890, 5776, 9242, 2942; Payload ID: 4314 relates to Category No.: 9305, 2890, 5776, 9242, 2942; Payload ID: 4315 relates to Category No.: 9305, 2890; Payload ID: 4316 relates to Category No.: 4029, 2890, 1792; Payload ID: 4317 relates to Category No.: 4029; Payload ID: 4318 relates to Category No.: 4029; Payload ID: 4319 relates to Category No.: 4030, 9305, 2890, 9247, 4010, 2701, 5762; Payload ID: 4320 relates to Category No.: 4030, 2890, 9242, 4010; Payload ID: 4321 relates to Category No.: 4030, 4029, 4010, 2890, 1090, 3666, 1017, 1774, 8948, 6443, 9184, 9734, 7321, 16156, 2649; Payload ID: 4322 relates to Category No.: 4029, 4010; Payload ID: 4323 relates to Category No.: 4010, 2701; Payload ID: 4324 relates to Category No.: 4029, 2890; Payload ID: 4325 relates to Category No.: 4030, 4010; Payload ID: 4326 relates to Category No.: 4030; Payload ID: 4327 relates to Category No.: 4030; Payload ID: 4328 relates to Category No.: 4029; Payload ID: 4329 relates to Category No.: 9305, 4010, 4228; Payload ID: 4330 relates to Category No.: 9305, 4228; Payload ID: 4331 relates to Category No.: 9305, 2938, 16326, 2890; Payload ID: 4332 relates to Category No.: 1842; Payload ID: 4333 relates to Category No.: 7118; Payload ID: 4334 relates to Category No.: 2890, 2942, 9247, 7118; Payload ID: 4335 relates to Category No.: 2942; Payload ID: 4336 relates to Category No.: 4029; Payload ID: 4338 relates to Category No.: 9247, 9734, 2890, 9162, 5561; Payload ID: 4339 relates to Category No.: 5561; Payload ID: 4340 relates to Category No.: 2890, 2701; Payload ID: 4341 relates to Category No.: 5762, 10056, 2899, 5561; Payload ID: 4342 relates to Category No.: 5762, 10056, 1842, 4786, 4755; Payload ID: 4343 relates to Category No.: 9305, 2890, 10056, 3666; Payload ID: 4344 relates to Category No.: 9305, 2890, 9242, 1748, 11650, 8948, 3036, 3054, 3055; Payload ID: 4346 relates to Category No.: 2890; Payload ID: 4347 relates to Category No.: 4014, 1720; Payload ID: 4348 relates to Category No.: 2890; Payload ID: 4349 relates to Category No.: 4030, 4029, 9305; Payload ID: 4350 relates to Category No.: 4030, 4029; Payload ID: 4351 relates to Category No.: 4030, 4029, 12159, 4010, 14802, 5561; Payload ID: 4352 relates to Category No.: 4029, 4010; Payload ID: 4353 relates to Category No.: 4029, 15627, 4010, 12159; Payload ID: 4355 relates to Category No.: 5561, 4010; Payload ID: 4356 relates to Category No.: 5561; Payload ID: 4357 relates to Category No.: 3666, 4755, 4030; Payload ID: 4358 relates to Category No.: 4029, 12159, 4014; Payload ID: 4360 relates to Category No.: 9305; Payload ID: 4361 relates to Category No.: 9305; Payload ID: 4362 relates to Category No.: 9305; Payload ID: 4363 relates to Category No.: 5561, 6717, 10056, 2942, 5570; Payload ID: 4364 relates to Category No.: 5561, 10056, 5570, 1842, 6717; Payload ID: 4365 relates to Category No.: 2890, 2942; Payload ID: 4366 relates to Category No.: 2942, 7060; Payload ID: 4367 relates to Category No.: 6717, 5561, 12439, 2890, 10056, 2942, 1099, 3521, 2324, 4010, 1792, 3523, 11883, 6440, 779, 4788, 3679; Payload ID: 4368 relates to Category No.: 2938, 2942, 11728, 4010, 2446; Payload ID: 4369 relates to Category No.: 5561, 6443, 5776, 10056, 4010, 5730, 6709, 6059, 6440; Payload ID: 4371 relates to Category No.: 4029, 2942; Payload ID: 4372 relates to Category No.: 9305, 2890, 9242, 2942, 9247, 4010; Payload ID: 4373 relates to Category No.: 7118, 2890, 2942, 9247; Payload ID: 4374 relates to Category No.: 9305, 6717, 2942, 9247; Payload ID: 4375 relates to Category No.: 5561, 10056, 4010, 1336; Payload ID: 4376 relates to Category No.: 6717, 10056, 14409, 9776, 7517, 2890, 7118, 3693, 4755, 3036, 8948, 9732, 779, 5561; Payload ID: 4377 relates to Category No.: 10056, 5570, 9776, 7517, 2890, 7118; Payload ID: 4379 relates to Category No.: 4029, 6717, 3652; Payload ID: 4380 relates to Category No.: 5561, 7118, 6717, 4010; Payload ID: 4381 relates to Category No.: 9305, 6717, 7118, 5561; Payload ID: 4382 relates to Category No.: 7118, 2890, 6717, 3673, 3666, 7070, 6222, 4010, 4995, 7048; Payload ID: 4383 relates to Category No.: 3666, 9734; Payload ID: 4384 relates to Category No.: 9305, 9247; Payload ID: 4385 relates to Category No.: 5561, 6717, 3673, 7070, 4010, 7118, 5776, 3666; Payload ID: 4386 relates to Category No.: 5561, 6717, 7070, 7048, 7118, 5776; Payload ID: 4387 relates to Category No.: 5561; Payload ID: 4388 relates to Category No.: 5561, 6060, 6440, 6443; Payload ID: 4389 relates to Category No.: 5561; Payload ID: 4390 relates to Category No.: 5561; Payload ID: 4391 relates to Category No.: 14174, 7118, 2890, 5562, 5561; Payload ID: 4392 relates to Category No.: 7118, 5562; Payload ID: 4393 relates to Category No.: 7052; Payload ID: 4394 relates to Category No.: 7118; Payload ID: 4395 relates to Category No.: 7118; Payload ID: 4396 relates to Category No.: 7052; Payload ID: 4397 relates to Category No.: 5561, 7118, 7048, 7085, 2870; Payload ID: 4398 relates to Category No.: 5561, 9305, 7118, 6717, 7048, 4010, 7095, 7061; Payload ID: 4399 relates to Category No.: 7095, 7118, 7061; Payload ID: 4400 relates to Category No.: 7048, 4010, 7095, 7118, 7366; Payload ID: 4401 relates to Category No.: 7118, 7048, 7041, 4010; Payload ID: 4402 relates to Category No.: 7048, 7095, 7118; Payload ID: 4403 relates to Category No.: 7048, 7095, 7118; Payload ID: 4404 relates to Category No.: 7118, 7048, 7052; Payload ID: 4405 relates to Category No.: 7118, 7052, 7032; Payload ID: 4406 relates to Category No.: 5561, 7118, 7048; Payload ID: 4407 relates to Category No.: 7085, 5561, 7118; Payload ID: 4408 relates to Category No.: 5561, 7085, 7048, 7118; Payload ID: 4409 relates to Category No.: 7085, 7048, 7118; Payload ID: 4410 relates to Category No.: 5561, 7118, 7048, 7085, 13753; Payload ID: 4411 relates to Category No.: 5561, 7118, 7085, 13753; Payload ID: 4412 relates to Category No.: 5561, 7118, 7048; Payload ID: 4413 relates to Category No.: 5561, 7048, 7095; Payload ID: 4414 relates to Category No.: 5561, 7118, 7095; Payload ID: 4415 relates to Category No.: 9305, 7118, 7048, 2942, 13749, 12087, 7052; Payload ID: 4416 relates to Category No.: 5561, 9305, 7118, 6717, 7048, 13749; Payload ID: 4417 relates to Category No.: 3673, 2890, 7118, 5776; Payload ID: 4418 relates to Category No.: 5776, 3673; Payload ID: 4419 relates to Category No.: 7118, 3673, 5561; Payload ID: 4420 relates to Category No.: 7118, 7048, 7060; Payload ID: 4421 relates to Category No.: 7118, 7048; Payload ID: 4422 relates to Category No.: 7118, 7048; Payload ID: 4423 relates to Category No.: 3673, 3666, 8948, 1017, 7118, 5776, 1774; Payload ID: 4424 relates to Category No.: 6717, 3673, 3666, 5561; Payload ID: 4425 relates to Category No.: 2890, 5776, 3673; Payload ID: 4426 relates to Category No.: 2890, 5776, 3673, 2901, 5561; Payload ID: 4427 relates to Category No.: 2890, 5776, 3673, 5561; Payload ID: 4428 relates to Category No.: 2890, 5776, 3673; Payload ID: 4429 relates to Category No.: 2890, 5776, 3673; Payload ID: 4430 relates to Category No.: 2890, 5776, 3673; Payload ID: 4431 relates to Category No.: 2890, 5776, 3673; Payload ID: 4432 relates to Category No.: 2890, 5776, 3673; Payload ID: 4433 relates to Category No.: 2890, 5561, 7118, 3673, 3666; Payload ID: 4434 relates to Category No.: 5561, 7118, 2890; Payload ID: 4435 relates to Category No.: 2890, 5776, 3673, 3666, 7118, 4765, 5815; Payload ID: 4436 relates to Category No.: 2890, 5776, 3673; Payload ID: 4437 relates to Category No.: 2890, 5776, 3673, 4010; Payload ID: 4438 relates to Category No.: 2890, 5776, 3673; Payload ID: 4439 relates to Category No.: 2890, 3673, 3666, 5776, 5561; Payload ID: 4440 relates to Category No.: 5561, 2890, 5776, 3673; Payload ID: 4441 relates to Category No.: 2890, 5776, 10056, 3673, 1792, 3671; Payload ID: 4442 relates to Category No.: 5561, 6717; Payload ID: 4443 relates to Category No.: 3673; Payload ID: 4444 relates to Category No.: 7048, 7118; Payload ID: 4445 relates to Category No.: 3673; Payload ID: 4446 relates to Category No.: 2890, 3673; Payload ID: 4447 relates to Category No.: 5561, 3673; Payload ID: 4448 relates to Category No.: 7060, 7048, 7118; Payload ID: 4449 relates to Category No.: 7118, 2890, 7070; Payload ID: 4450 relates to Category No.: 6717; Payload ID: 4451 relates to Category No.: 5561, 2890, 5776, 3673; Payload ID: 4452 relates to Category No.: 3673, 5561; Payload ID: 4453 relates to Category No.: 5776, 3673, 5561; Payload ID: 4454 relates to Category No.: 3673; Payload ID: 4455 relates to Category No.: 5776, 3673; Payload ID: 4456 relates to Category No.: 2890, 5776, 3673, 4010, 779, 5561; Payload ID: 4457 relates to Category No.: 5561, 3673; Payload ID: 4458 relates to Category No.: 5561, 3673, 5776; Payload ID: 4459 relates to Category No.: 5561, 3673; Payload ID: 4460 relates to Category No.: 5561, 2890, 5776, 3673, 779; Payload ID: 4461 relates to Category No.: 2890, 5776, 3673, 779, 5561; Payload ID: 4462 relates to Category No.: 3673; Payload ID: 4463 relates to Category No.: 5561, 3673; Payload ID: 4464 relates to Category No.: 5561, 3673; Payload ID: 4465 relates to Category No.: 5561, 3673; Payload ID: 4466 relates to Category No.: 5561, 3673; Payload ID: 4467 relates to Category No.: 5561, 3673; Payload ID: 4468 relates to Category No.: 5561, 3673, 3666; Payload ID: 4469 relates to Category No.: 5561, 5776, 6717, 3673, 3666; Payload ID: 4470 relates to Category No.: 5776, 3673; Payload ID: 4471 relates to Category No.: 3673; Payload ID: 4472 relates to Category No.: 5561, 3673, 3666; Payload ID: 4473 relates to Category No.: 2942, 8948, 8935; Payload ID: 4474 relates to Category No.: 2890, 10056, 2942, 4043, 1182; Payload ID: 4475 relates to Category No.: 2890, 9247, 1720, 3521; Payload ID: 4476 relates to Category No.: 2890, 6717, 10056, 4860; Payload ID: 4477 relates to Category No.: 10056, 2942, 4043, 2890, 14327; Payload ID: 4478 relates to Category No.: 10056; Payload ID: 4479 relates to Category No.: 2890, 9242, 9247, 7052, 7118; Payload ID: 4480 relates to Category No.: 2890, 2942, 1842, 10056; Payload ID: 4481 relates to Category No.: 4030, 2769; Payload ID: 4482 relates to Category No.: 5561, 4029, 10056; Payload ID: 4483 relates to Category No.: 2890, 10056, 5561; Payload ID: 4484 relates to Category No.: 5762; Payload ID: 4485 relates to Category No.: 4030; Payload ID: 4486 relates to Category No.: 2942, 8935, 15139, 9734, 6017, 4010, 14327, 4228, 7269, 14378; Payload ID: 4487 relates to Category No.: 2890, 6717, 2942, 8935, 15139, 9734, 1748, 4010; Payload ID: 4488 relates to Category No.: 6717, 2194, 2942, 4755, 2630, 2901, 1720, 14902, 4010, 5964, 4228, 6978, 5967, 1082, 2716, 2193; Payload ID: 4489 relates to Category No.: 2890, 6717, 6976, 6960, 10056, 2942, 4755, 2630, 2901, 1720, 15573, 1750, 1036, 5964, 4228, 5967, 7161, 14329, 1082, 2718; Payload ID: 4490 relates to Category No.: 9305, 2890, 8935, 15139, 1748, 11650, 3036, 11653, 2903, 6813; Payload ID: 4491 relates to Category No.: 9305, 2890, 8935, 15139, 6813, 10162; Payload ID: 4492 relates to Category No.: 9305, 2890, 8935, 15139, 3036, 1674, 6813, 775; Payload ID: 4493 relates to Category No.: 9305, 2890, 8935, 3666, 15139, 11650, 3036, 6813; Payload ID: 4494 relates to Category No.: 2890, 2194, 14906, 2901, 6968; Payload ID: 4495 relates to Category No.: 2890, 2194, 14906; Payload ID: 4496 relates to Category No.: 6717, 2194, 2942, 14906, 6968, 11883, 6978, 4390; Payload ID: 4497 relates to Category No.: 5561, 6717, 2938, 10056, 3673, 3666, 9734, 6222, 4010, 6015; Payload ID: 4498 relates to Category No.: 7181, 2440; Payload ID: 4499 relates to Category No.: 2942, 7118; Payload ID: 4500 relates to Category No.: 7118, 2890, 2942, 11883; Payload ID: 4501 relates to Category No.: 10056, 5570, 1803; Payload ID: 4502 relates to Category No.: 10056, 5570, 4755, 9734, 4008, 2502, 6717; Payload ID: 4503 relates to Category No.: 9305; Payload ID: 4504 relates to Category No.: 7118, 7060; Payload ID: 4505 relates to Category No.: 2890, 7544; Payload ID: 4506 relates to Category No.: 2890, 2194, 5776, 9247, 9157, 9305, 1077; Payload ID: 4507 relates to Category No.: 7544; Payload ID: 4508 relates to Category No.: 5776, 10056, 9242, 2534, 4010, 4228, 6440, 2504, 2505, 15569; Payload ID: 4509 relates to Category No.: 9734, 2942, 6717, 8935, 8948, 778, 11650, 1335; Payload ID: 4510 relates to Category No.: 5824, 2890, 10056, 2942, 8948, 3036, 3636, 1017, 4010, 2227, 8949, 2521, 9572, 500; Payload ID: 4511 relates to Category No.: 9305, 5776, 9242, 9247, 2890, 15505; Payload ID: 4512 relates to Category No.: 9305; Payload ID: 4513 relates to Category No.: 5561, 6717, 10056, 5762, 778; Payload ID: 4514 relates to Category No.: 5561, 6717, 10056, 1842; Payload ID: 4516 relates to Category No.: 11988; Payload ID: 4519 relates to Category No.: 11988; Payload ID: 4520 relates to Category No.: 4030, 9305, 2890, 9247, 4010, 9158, 15269, 2789, 2787, 2788; Payload ID: 4521 relates to Category No.: 9247, 1748, 11883, 2788; Payload ID: 4522 relates to Category No.: 7118, 4755, 9734; Payload ID: 4523 relates to Category No.: 2942, 7070, 9756, 9754, 9753; Payload ID: 4524 relates to Category No.: 4029; Payload ID: 4525 relates to Category No.: 6443; Payload ID: 4527 relates to Category No.: 9756; Payload ID: 4528 relates to Category No.: 16059; Payload ID: 4529 relates to Category No.: 5561; Payload ID: 4530 relates to Category No.: 2890, 9247, 9305; Payload ID: 4531 relates to Category No.: 9305, 2890; Payload ID: 4532 relates to Category No.: 9305, 2890, 2194, 5776, 9247, 2183, 2441, 11883; Payload ID: 4533 relates to Category No.: 2183, 2441; Payload ID: 4534 relates to Category No.: 2890; Payload ID: 4535 relates to Category No.: 9247, 9305; Payload ID: 4536 relates to Category No.: 9305, 2890, 5776, 9247, 493; Payload ID: 4537 relates to Category No.: 5561, 10056, 2942, 1017; Payload ID: 4538 relates to Category No.: 2942, 4010; Payload ID: 4539 relates to Category No.: 9305, 15892; Payload ID: 4540 relates to Category No.: 15892; Payload ID: 4541 relates to Category No.: 10056, 15892, 9734; Payload ID: 4542 relates to Category No.: 9305, 15892; Payload ID: 4543 relates to Category No.: 5561, 15892, 1842; Payload ID: 4544 relates to Category No.: 5561; Payload ID: 4545 relates to Category No.: 5561; Payload ID: 4546 relates to Category No.: 2942; Payload ID: 4547 relates to Category No.: 2789; Payload ID: 4548 relates to Category No.: 9247, 2789; Payload ID: 4549 relates to Category No.: 2890, 2194, 2789; Payload ID: 4550 relates to Category No.: 1842; Payload ID: 4552 relates to Category No.: 9242, 14671, 2789; Payload ID: 4554 relates to Category No.: 2789; Payload ID: 4555 relates to Category No.: 5561, 9242, 2789; Payload ID: 4556 relates to Category No.: 2789; Payload ID: 4559 relates to Category No.: 2789, 7118; Payload ID: 4560 relates to Category No.: 9305, 2890, 9247, 4228, 2789; Payload ID: 4561 relates to Category No.: 2890, 9247, 11883, 2789, 9181; Payload ID: 4562 relates to Category No.: 9305, 2890, 2789; Payload ID: 4565 relates to Category No.: 2890; Payload ID: 4566 relates to Category No.: 2890, 6976, 2942, 4755, 3685; Payload ID: 4567 relates to Category No.: 2890, 4010; Payload ID: 4568 relates to Category No.: 2890, 4010; Payload ID: 4569 relates to Category No.: 3673, 3666; Payload ID: 4570 relates to Category No.: 9305, 2890, 6717, 14145, 9247, 15732, 2920, 2513; Payload ID: 4571 relates to Category No.: 9247, 9305, 6717, 9242; Payload ID: 4572 relates to Category No.: 9305, 6717, 9242, 9247; Payload ID: 4573 relates to Category No.: 6717, 9242; Payload ID: 4574 relates to Category No.: 9305, 2890, 2417, 5762; Payload ID: 4575 relates to Category No.: 9305, 2890, 2950, 3964, 7070, 4010, 9215, 2920; Payload ID: 4576 relates to Category No.: 9305, 6717, 2907; Payload ID: 4577 relates to Category No.: 9305, 2890, 6717, 9247, 9215, 1377; Payload ID: 4578 relates to Category No.: 9305, 6717, 9242, 14145, 9247, 4010, 1635; Payload ID: 4579 relates to Category No.: 6717, 9242; Payload ID: 4580 relates to Category No.: 2890, 6717, 5776, 2942, 2903, 14190, 2920; Payload ID: 4582 relates to Category No.: 6717, 9242; Payload ID: 4583 relates to Category No.: 2890, 6717, 9199, 9184, 5762; Payload ID: 4584 relates to Category No.: 2890, 6717, 9199, 4010, 9184, 9162, 5762; Payload ID: 4585 relates to Category No.: 9305, 2890, 6717, 2938, 2942, 9247, 14681, 14682, 4438, 15531, 14256; Payload ID: 4586 relates to Category No.: 9305, 7118, 10056, 9242, 9247, 4010, 1635, 15870; Payload ID: 4587 relates to Category No.: 9305; Payload ID: 4588 relates to Category No.: 9305, 7118, 2890, 9242, 7068, 14150; Payload ID: 4589 relates to Category No.: 5776, 9242, 4755; Payload ID: 4590 relates to Category No.: 9305, 2890, 6717, 14912; Payload ID: 4591 relates to Category No.: 9247, 9305, 2890, 14912, 15862, 9215, 15501, 15873, 11883, 9181; Payload ID: 4592 relates to Category No.: 2890, 9734, 9535, 10029, 10014, 9305, 14145; Payload ID: 4593 relates to Category No.: 6717, 2942, 1635, 9305, 3666; Payload ID: 4594 relates to Category No.: 5762; Payload ID: 4595 relates to Category No.: 9305, 9215, 1377; Payload ID: 4596 relates to Category No.: 6717, 9242; Payload ID: 4598 relates to Category No.: 9305, 6717, 10056, 9242; Payload ID: 4599 relates to Category No.: 6717, 9242; Payload ID: 4600 relates to Category No.: 9305, 6717, 9242; Payload ID: 4601 relates to Category No.: 9305; Payload ID: 4602 relates to Category No.: 9305, 6717, 9242; Payload ID: 4603 relates to Category No.: 6717; Payload ID: 4604 relates to Category No.: 2890, 2942, 1182, 273, 14329; Payload ID: 4605 relates to Category No.: 9305, 2890, 5762, 5561; Payload ID: 4606 relates to Category No.: 2890, 5730; Payload ID: 4608 relates to Category No.: 9305, 2890, 9242, 14906, 9247, 6994, 9157, 4010; Payload ID: 4610 relates to Category No.: 4029, 9305, 2890, 9242, 9247, 15505; Payload ID: 4611 relates to Category No.: 2890; Payload ID: 4612 relates to Category No.: 2458, 9998, 276, 2441, 10000, 14953, 9729, 14955, 14954, 14952, 14951, 16035, 2890, 4860; Payload ID: 4613 relates to Category No.: 8948; Payload ID: 4614 relates to Category No.: 7118, 2890; Payload ID: 4615 relates to Category No.: 9305, 2890, 9242, 9247, 15848, 15855; Payload ID: 4616 relates to Category No.: 7118, 2890, 7068, 14150; Payload ID: 4617 relates to Category No.: 9305, 2890, 6717, 2194, 9242, 2942, 14145, 9247, 2907, 2757; Payload ID: 4618 relates to Category No.: 9305, 2890, 9247, 14912; Payload ID: 4619 relates to Category No.: 7118, 2890, 3954; Payload ID: 4620 relates to Category No.: 2890, 14912, 7118; Payload ID: 4621 relates to Category No.: 2890, 9242, 9247; Payload ID: 4622 relates to Category No.: 2890, 6717; Payload ID: 4623 relates to Category No.: 2890, 1635; Payload ID: 4624 relates to Category No.: 9305, 2890, 2942, 2420, 15269, 4010, 5561; Payload ID: 4625 relates to Category No.: 2890, 9242; Payload ID: 4626 relates to Category No.: 9305, 2890, 6717, 9247, 1635; Payload ID: 4627 relates to Category No.: 2890; Payload ID: 4628 relates to Category No.: 2890, 9247, 9305, 14912, 1635; Payload ID: 4629 relates to Category No.: 2890, 14912; Payload ID: 4630 relates to Category No.: 9305, 7118, 7048, 9242, 9247, 7105, 14668, 7097, 7060; Payload ID: 4631 relates to Category No.: 5561; Payload ID: 4632 relates to Category No.: 9305, 2890, 11839, 1088; Payload ID: 4633 relates to Category No.: 2890, 9242; Payload ID: 4634 relates to Category No.: 9242, 9247; Payload ID: 4635 relates to Category No.: 9305, 2890, 14893; Payload ID: 4637 relates to Category No.: 2890, 10056, 273; Payload ID: 4638 relates to Category No.: 2890, 2926, 999, 5561; Payload ID: 4639 relates to Category No.: 9305, 2890, 10104, 6743, 276; Payload ID: 4640 relates to Category No.: 9305, 2890, 9242, 2942, 2420, 2192, 10104, 15127; Payload ID: 4641 relates to Category No.: 9305; Payload ID: 4642 relates to Category No.: 9305, 7118, 2890, 2942, 9247; Payload ID: 4644 relates to Category No.: 9305, 6717, 2942, 2903; Payload ID: 4645 relates to Category No.: 9305, 2890, 6717, 5776, 2942, 2903; Payload ID: 4646 relates to Category No.: 5776, 2942, 9247, 1748, 2903, 14190; Payload ID: 4647 relates to Category No.: 4030, 4029, 4014, 4763, 6437, 12159, 2581; Payload ID: 4648 relates to Category No.: 9305, 2890, 6717, 2942, 9247, 5762; Payload ID: 4649 relates to Category No.: 6717, 5762, 4010; Payload ID: 4650 relates to Category No.: 5762, 2942; Payload ID: 4651 relates to Category No.: 6717, 2938, 2942, 3652, 4010, 5762; Payload ID: 4652 relates to Category No.: 2890; Payload ID: 4653 relates to Category No.: 5762, 6717, 2942, 14953, 3652, 14954; Payload ID: 4654 relates to Category No.: 5762, 2890; Payload ID: 4655 relates to Category No.: 2890, 2942, 9734, 5762; Payload ID: 4656 relates to Category No.: 8935, 2660, 1017, 4860, 4228, 1084, 5762; Payload ID: 4657 relates to Category No.: 5762, 6717, 2942, 1750; Payload ID: 4658 relates to Category No.: 5762, 6717, 2942, 3652; Payload ID: 4659 relates to Category No.: 9305; Payload ID: 4660 relates to Category No.: 9305, 2890, 6717, 10056; Payload ID: 4661 relates to Category No.: 5561, 6717, 3673, 9362, 4010; Payload ID: 4662 relates to Category No.: 4030, 4029, 4014, 4010, 4763, 1051; Payload ID: 4663 relates to Category No.: 4030, 4029, 4014, 4010, 4763, 1051; Payload ID: 4664 relates to Category No.: 4030, 4029, 4010, 4763, 1051; Payload ID: 4665 relates to Category No.: 4030, 4029, 1050, 4763; Payload ID: 4666 relates to Category No.: 4030, 4029, 15627, 4763, 14411; Payload ID: 4667 relates to Category No.: 4030, 4029, 4763; Payload ID: 4668 relates to Category No.: 4030, 4029, 4010, 4763; Payload ID: 4669 relates to Category No.: 4029, 4763; Payload ID: 4670 relates to Category No.: 4029, 4763; Payload ID: 4671 relates to Category No.: 4029, 1792; Payload ID: 4672 relates to Category No.: 4029, 1792; Payload ID: 4673 relates to Category No.: 4029; Payload ID: 4674 relates to Category No.: 4029; Payload ID: 4675 relates to Category No.: 4029, 1792; Payload ID: 4676 relates to Category No.: 4029, 1792; Payload ID: 4677 relates to Category No.: 4029; Payload ID: 4678 relates to Category No.: 4029; Payload ID: 4679 relates to Category No.: 4029, 1792; Payload ID: 4680 relates to Category No.: 4029; Payload ID: 4681 relates to Category No.: 4029; Payload ID: 4682 relates to Category No.: 4029; Payload ID: 4683 relates to Category No.: 4029; Payload ID: 4684 relates to Category No.: 4029, 1792; Payload ID: 4685 relates to Category No.: 4029, 1792; Payload ID: 4686 relates to Category No.: 4029, 1792; Payload ID: 4687 relates to Category No.: 4029, 1792; Payload ID: 4688 relates to Category No.: 4029, 1792; Payload ID: 4689 relates to Category No.: 4029, 1792; Payload ID: 4690 relates to Category No.: 4029, 1792; Payload ID: 4691 relates to Category No.: 4029, 1792; Payload ID: 4692 relates to Category No.: 4029, 1792, 4682; Payload ID: 4693 relates to Category No.: 4029, 1842, 1792; Payload ID: 4694 relates to Category No.: 4029, 1792; Payload ID: 4695 relates to Category No.: 4029, 1792; Payload ID: 4696 relates to Category No.: 4029; Payload ID: 4697 relates to Category No.: 4029, 1792; Payload ID: 4698 relates to Category No.: 4029, 1792; Payload ID: 4699 relates to Category No.: 4029; Payload ID: 4700 relates to Category No.: 4029, 1792; Payload ID: 4701 relates to Category No.: 4029, 1792; Payload ID: 4702 relates to Category No.: 4029; Payload ID: 4703 relates to Category No.: 4029, 4763; Payload ID: 4704 relates to Category No.: 4029, 4763; Payload ID: 4705 relates to Category No.: 3673; Payload ID: 4706 relates to Category No.: 7118, 9521; Payload ID: 4707 relates to Category No.: 3666, 7048, 7118; Payload ID: 4708 relates to Category No.: 4029; Payload ID: 4710 relates to Category No.: 4029, 6717; Payload ID: 4711 relates to Category No.: 9305, 7118, 2890, 7060, 4010, 9162; Payload ID: 4712 relates to Category No.: 5561, 3673, 10003; Payload ID: 4713 relates to Category No.: 9305, 7118, 5776, 3673, 9756, 9754, 4010, 9184; Payload ID: 4714 relates to Category No.: 4029; Payload ID: 4715 relates to Category No.: 6717; Payload ID: 4716 relates to Category No.: 5561, 6717, 3673; Payload ID: 4717 relates to Category No.: 4029, 14371, 6321; Payload ID: 4718 relates to Category No.: 3673, 5557; Payload ID: 4720 relates to Category No.: 5561, 10056, 3673; Payload ID: 4721 relates to Category No.: 5561, 6717, 10056; Payload ID: 4722 relates to Category No.: 5561, 10056, 3696; Payload ID: 4723 relates to Category No.: 9305, 2649; Payload ID: 4724 relates to Category No.: 9305, 2890; Payload ID: 4725 relates to Category No.: 9305, 2890; Payload ID: 4726 relates to Category No.: 9305, 2890; Payload ID: 4727 relates to Category No.: 9305, 2890; Payload ID: 4728 relates to Category No.: 9305, 2890, 10162; Payload ID: 4730 relates to Category No.: 2890; Payload ID: 4733 relates to Category No.: 4030, 4029, 2890, 6717, 4049, 4010, 9776, 16346, 5762, 12159; Payload ID: 4734 relates to Category No.: 9305; Payload ID: 4735 relates to Category No.: 5561, 7118, 6717, 3673, 5570, 3666; Payload ID: 4736 relates to Category No.: 5561, 3673; Payload ID: 4737 relates to Category No.: 5561, 10056, 3036, 3521, 8948; Payload ID: 4738 relates to Category No.: 5561, 4029, 6717, 10056, 5570, 447, 6743, 779, 2926; Payload ID: 4739 relates to Category No.: 4030, 5561, 4008; Payload ID: 4740 relates to Category No.: 5561, 4010; Payload ID: 4741 relates to Category No.: 5561; Payload ID: 4742 relates to Category No.: 5561, 6717, 10056; Payload ID: 4743 relates to Category No.: 9305, 2890, 2942; Payload ID: 4744 relates to Category No.: 2890, 9247, 9184; Payload ID: 4745 relates to Category No.: 9305, 2890, 9247; Payload ID: 4746 relates to Category No.: 2890; Payload ID: 4747 relates to Category No.: 2942; Payload ID: 4748 relates to Category No.: 10056, 2942, 2899, 273, 9734, 3652, 276, 10085, 14813, 1777, 6717, 8951, 2712; Payload ID: 4749 relates to Category No.: 9305, 2890, 3673, 9730, 1774, 3059, 10056; Payload ID: 4750 relates to Category No.: 9305, 2890; Payload ID: 4751 relates to Category No.: 5561, 3673, 5570, 5557, 3696, 1792, 3686; Payload ID: 4752 relates to Category No.: 1748, 11723, 2504, 2505, 15139, 8948, 3036; Payload ID: 4753 relates to Category No.: 2942, 2504; Payload ID: 4754 relates to Category No.: 2942, 2504; Payload ID: 4755 relates to Category No.: 2890, 273; Payload ID: 4757 relates to Category No.: 2890; Payload ID: 4758 relates to Category No.: 5762; Payload ID: 4759 relates to Category No.: 9305; Payload ID: 4760 relates to Category No.: 9305, 9247, 4755; Payload ID: 4761 relates to Category No.: 2942, 10056, 5555, 14100; Payload ID: 4762 relates to Category No.: 6717, 15573, 14100, 4755; Payload ID: 4763 relates to Category No.: 5561, 6717; Payload ID: 4764 relates to Category No.: 12439, 2890; Payload ID: 4765 relates to Category No.: 12439; Payload ID: 4766 relates to Category No.: 1842; Payload ID: 4767 relates to Category No.: 9305, 2890, 2194, 5776, 9242, 9247, 2420, 9184, 2787, 2788; Payload ID: 4768 relates to Category No.: 4029, 9305, 2890, 5776, 9242, 12159, 9247; Payload ID: 4769 relates to Category No.: 4029, 2890, 12159; Payload ID: 4770 relates to Category No.: 9305, 2942; Payload ID: 4771 relates to Category No.: 9305, 7118, 7060, 2890, 2942; Payload ID: 4772 relates to Category No.: 2942, 1842; Payload ID: 4773 relates to Category No.: 2942; Payload ID: 4774 relates to Category No.: 9305, 9242, 9247, 5110; Payload ID: 4775 relates to Category No.: 9305, 9242; Payload ID: 4776 relates to Category No.: 9305, 4029, 4010, 9162; Payload ID: 4777 relates to Category No.: 6443, 2890, 4029; Payload ID: 4778 relates to Category No.: 6443, 4010; Payload ID: 4779 relates to Category No.: 9305, 3666, 4010; Payload ID: 4780 relates to Category No.: 4029, 9305, 2890; Payload ID: 4781 relates to Category No.: 9305; Payload ID: 4782 relates to Category No.: 9305, 2890, 4010; Payload ID: 4783 relates to Category No.: 2890, 2942, 7118, 7060, 7052; Payload ID: 4784 relates to Category No.: 2890, 9247, 9305, 7118, 4010; Payload ID: 4785 relates to Category No.: 9305, 9247, 15531; Payload ID: 4786 relates to Category No.: 2942; Payload ID: 4787 relates to Category No.: 5762; Payload ID: 4788 relates to Category No.: 6443, 2942, 9734, 6440, 5363, 5762; Payload ID: 4789 relates to Category No.: 2942, 1842, 5762; Payload ID: 4790 relates to Category No.: 5762; Payload ID: 4791 relates to Category No.: 6717, 7118; Payload ID: 4792 relates to Category No.: 5561, 6717, 3666, 5557, 16111, 5270, 3104, 3105, 6059, 3521; Payload ID: 4793 relates to Category No.: 6717, 3673, 3666, 5557, 6059, 3521, 5561; Payload ID: 4794 relates to Category No.: 5557; Payload ID: 4795 relates to Category No.: 5561, 4765, 3666, 4755; Payload ID: 4796 relates to Category No.: 5561, 4765; Payload ID: 4797 relates to Category No.: 4030, 12159, 4014, 4010; Payload ID: 4798 relates to Category No.: 4030, 4029, 4010; Payload ID: 4799 relates to Category No.: 4030, 4029; Payload ID: 4800 relates to Category No.: 4030, 10056; Payload ID: 4801 relates to Category No.: 5727, 2942, 14363, 4010, 16326, 2890, 5762, 2938, 8917, 2649, 4089; Payload ID: 4802 relates to Category No.: 5561, 6717, 10056, 3113, 4010, 4402; Payload ID: 4803 relates to Category No.: 5561, 6717, 10056, 3113, 4010, 2926, 5596, 1803; Payload ID: 4804 relates to Category No.: 5561, 6717, 10056, 3113, 1811, 2890, 4029; Payload ID: 4805 relates to Category No.: 5561, 6717, 10056, 2942, 3113, 1811, 4010, 2918, 779, 6075; Payload ID: 4806 relates to Category No.: 5561, 6717, 10056, 3113, 1811, 4010, 1792, 5596, 779, 6075; Payload ID: 4807 relates to Category No.: 5561, 6717, 10056, 2942, 3113, 4010; Payload ID: 4808 relates to Category No.: 5561, 6717, 10056, 3113; Payload ID: 4809 relates to Category No.: 9305, 2890, 2938, 5727, 10056, 3113, 4010, 2701, 5596, 1811, 1099, 4089; Payload ID: 4810 relates to Category No.: 5762, 273, 4010, 2890, 2710; Payload ID: 4811 relates to Category No.: 9305, 2890; Payload ID: 4812 relates to Category No.: 2890; Payload ID: 4814 relates to Category No.: 9305; Payload ID: 4815 relates to Category No.: 9305; Payload ID: 4816 relates to Category No.: 9305, 9247; Payload ID: 4817 relates to Category No.: 9305, 2890, 4146, 6536; Payload ID: 4818 relates to Category No.: 9305; Payload ID: 4819 relates to Category No.: 2890; Payload ID: 4820 relates to Category No.: 2890, 6717, 10162; Payload ID: 4821 relates to Category No.: 2890, 6717, 7118; Payload ID: 4822 relates to Category No.: 2890; Payload ID: 4824 relates to Category No.: 9305, 2890, 9242, 9247, 6968, 6955; Payload ID: 4825 relates to Category No.: 7118, 2942, 7052, 2918, 1682, 2890; Payload ID: 4826 relates to Category No.: 6717, 10056, 2942, 5762; Payload ID: 4827 relates to Category No.: 2890, 10056, 5762; Payload ID: 4828 relates to Category No.: 2890, 10056, 2899, 5762; Payload ID: 4829 relates to Category No.: 5561, 2890, 6717, 10056, 5762; Payload ID: 4830 relates to Category No.: 9305, 2890, 10056, 3693, 9184, 5762; Payload ID: 4831 relates to Category No.: 2890, 5776, 10056, 5762; Payload ID: 4832 relates to Category No.: 9247, 9305, 2890, 10056, 15139, 3055, 11883, 9734, 4925, 2942, 11721, 15151, 8948, 1033, 15147, 3972, 8951, 5762; Payload ID: 4833 relates to Category No.: 2890, 10056; Payload ID: 4834 relates to Category No.: 9305, 2890, 2938, 10056, 2942, 9215, 5762; Payload ID: 4835 relates to Category No.: 9305, 2890, 10056, 9247, 6017, 5762; Payload ID: 4836 relates to Category No.: 5561, 10056, 1282, 16078; Payload ID: 4837 relates to Category No.: 5561, 10056, 6440; Payload ID: 4838 relates to Category No.: 5561, 3673, 6717, 5776; Payload ID: 4839 relates to Category No.: 5561, 7118, 3673, 3666, 9734, 5557, 6222, 6717, 5776; Payload ID: 4840 relates to Category No.: 5561, 3673; Payload ID: 4841 relates to Category No.: 2942, 7161, 14329; Payload ID: 4842 relates to Category No.: 7118, 5776, 9242, 2942, 4755, 3521; Payload ID: 4843 relates to Category No.: 2942, 9305, 2890; Payload ID: 4844 relates to Category No.: 3666, 4755, 4010, 9732, 7118; Payload ID: 4845 relates to Category No.: 9305, 10056, 2901, 4010, 1335, 6989; Payload ID: 4846 relates to Category No.: 9305, 2890, 2942, 14191, 819, 6956, 3036, 1017, 4860, 3685; Payload ID: 4847 relates to Category No.: 4030, 4029, 10056, 3523; Payload ID: 4848 relates to Category No.: 4030, 4029; Payload ID: 4849 relates to Category No.: 4030, 4029; Payload ID: 4850 relates to Category No.: 4029, 1842; Payload ID: 4851 relates to Category No.: 4030; Payload ID: 4852 relates to Category No.: 9305, 15505; Payload ID: 4853 relates to Category No.: 5762; Payload ID: 4854 relates to Category No.: 5561; Payload ID: 4855 relates to Category No.: 9305, 1635; Payload ID: 4856 relates to Category No.: 5561; Payload ID: 4857 relates to Category No.: 9305, 12159; Payload ID: 4858 relates to Category No.: 9305; Payload ID: 4859 relates to Category No.: 9305, 9242, 14671; Payload ID: 4860 relates to Category No.: 2942; Payload ID: 4861 relates to Category No.: 2942, 9247, 1842; Payload ID: 4862 relates to Category No.: 7118, 7048, 7060; Payload ID: 4863 relates to Category No.: 7118, 7060, 7068, 7025; Payload ID: 4864 relates to Category No.: 7118, 9247, 7060, 12336, 2458, 7366, 260, 9521; Payload ID: 4865 relates to Category No.: 7118, 7060, 12336, 7082, 7366; Payload ID: 4866 relates to Category No.: 9305, 6717, 7060, 9521, 4010, 7118, 7366, 10056, 5776; Payload ID: 4867 relates to Category No.: 5561, 7118, 2890, 6717, 7048, 9247, 8948; Payload ID: 4868 relates to Category No.: 2890, 2942, 4010; Payload ID: 4869 relates to Category No.: 2890, 6717, 6960, 2942, 4010, 8948, 1017, 7118, 3036, 7366, 11883, 8935, 15280, 4860; Payload ID: 4870 relates to Category No.: 4030, 2890, 2942, 3985, 6017, 4860, 4197, 1711; Payload ID: 4871 relates to Category No.: 2890, 2942; Payload ID: 4872 relates to Category No.: 2890, 2942, 8948, 3036; Payload ID: 4873 relates to Category No.: 2890, 2942; Payload ID: 4874 relates to Category No.: 2942; Payload ID: 4875 relates to Category No.: 2890, 2942, 3666, 7118; Payload ID: 4876 relates to Category No.: 2942; Payload ID: 4877 relates to Category No.: 2942; Payload ID: 4878 relates to Category No.: 9305, 2890, 9242; Payload ID: 4879 relates to Category No.: 2942, 4010, 7118; Payload ID: 4880 relates to Category No.: 7118, 2890, 2194, 2942, 4010; Payload ID: 4881 relates to Category No.: 7060, 7118; Payload ID: 4882 relates to Category No.: 677, 4030, 9305, 10056, 1748, 4010, 779, 6991, 778; Payload ID: 4883 relates to Category No.: 677; Payload ID: 4884 relates to Category No.: 677, 6717; Payload ID: 4885 relates to Category No.: 5561, 6717, 10056; Payload ID: 4886 relates to Category No.: 2890, 10056, 9247, 4010; Payload ID: 4887 relates to Category No.: 5561, 6717, 10056, 3636, 6017, 4010, 1792, 6743, 4228, 6440, 779, 6019, 5830, 5599; Payload ID: 4888 relates to Category No.: 5561, 16257, 10056, 4010, 6717, 1792, 8948; Payload ID: 4889 relates to Category No.: 6443, 5776, 2899, 4755, 4010, 16156, 2942; Payload ID: 4890 relates to Category No.: 2890, 9247; Payload ID: 4891 relates to Category No.: 9305, 2890, 2942; Payload ID: 4892 relates to Category No.: 2890, 2942, 9247, 10056; Payload ID: 4893 relates to Category No.: 2942; Payload ID: 4894 relates to Category No.: 9305, 2942; Payload ID: 4895 relates to Category No.: 9305, 2890, 2942, 9247; Payload ID: 4896 relates to Category No.: 2942, 1842; Payload ID: 4898 relates to Category No.: 2942; Payload ID: 4899 relates to Category No.: 6717, 5762, 10056; Payload ID: 4900 relates to Category No.: 6717, 5762, 10056; Payload ID: 4901 relates to Category No.: 6717, 5762, 10056; Payload ID: 4902 relates to Category No.: 6717, 2942, 9247, 9168, 2897, 4003; Payload ID: 4903 relates to Category No.: 2890, 10162, 2903, 9168, 2897; Payload ID: 4904 relates to Category No.: 2890, 2194, 10056, 9168, 2897; Payload ID: 4905 relates to Category No.: 4030, 6717, 10056, 5570, 4010, 12406, 5561, 1099; Payload ID: 4906 relates to Category No.: 6717, 10056, 5570, 4010, 4228, 5561; Payload ID: 4907 relates to Category No.: 5561; Payload ID: 4908 relates to Category No.: 5570, 1792; Payload ID: 4909 relates to Category No.: 9305, 1792; Payload ID: 4910 relates to Category No.: 9305, 2890, 6717, 4010; Payload ID: 4911 relates to Category No.: 9305, 1842, 5561; Payload ID: 4912 relates to Category No.: 1748, 11653, 1842, 15139, 11650, 8951; Payload ID: 4913 relates to Category No.: 1748, 11650, 8902, 11653; Payload ID: 4914 relates to Category No.: 1748, 11650, 11653, 15139, 10056, 3055, 8948; Payload ID: 4915 relates to Category No.: 6717, 15139; Payload ID: 4916 relates to Category No.: 9305, 2890, 6976, 14908; Payload ID: 4917 relates to Category No.: 9305, 2890, 6960, 10056, 2942, 1182, 3673, 3666, 4755, 9734, 1748, 11650, 14363, 11653, 1099, 5851, 1811, 4010, 7255, 5392, 2918, 5596, 15139, 6075, 6743, 8917, 1083, 1777, 9087, 7367, 6071; Payload ID: 4918 relates to Category No.: 6717, 16257, 10056, 11650, 11653, 5851, 5921, 1748, 8951; Payload ID: 4919 relates to Category No.: 11650, 11653, 1099, 5851, 4030, 10056, 2890, 1182, 1811, 657, 15139, 8948, 4860, 3054; Payload ID: 4920 relates to Category No.: 2890, 16257, 10056, 2942, 15151, 4043, 3666, 15139, 1748, 11650, 657, 11653, 5851, 3055, 3972, 8951, 3638, 3037, 2712, 8942, 5921, 8945, 6717, 1772, 3036, 15147, 2227; Payload ID: 4921 relates to Category No.: 2890, 10056; Payload ID: 4922 relates to Category No.: 2890, 6717, 10056, 2942, 14999; Payload ID: 4923 relates to Category No.: 4010; Payload ID: 4924 relates to Category No.: 2942, 8935, 2899, 15139, 4860, 2926, 6075, 1017, 2504, 3036, 6960, 8948, 6968; Payload ID: 4925 relates to Category No.: 9305, 2890, 10056, 2942, 2926, 2502, 2504, 778; Payload ID: 4926 relates to Category No.: 2942, 2890; Payload ID: 4927 relates to Category No.: 9247, 2890, 2942, 15139, 1748, 1154; Payload ID: 4928 relates to Category No.: 2890, 7118; Payload ID: 4929 relates to Category No.: 2890; Payload ID: 4930 relates to Category No.: 5561, 6717; Payload ID: 4931 relates to Category No.: 5561, 10056, 1842; Payload ID: 4933 relates to Category No.: 5561, 6440; Payload ID: 4935 relates to Category No.: 7118, 6960, 2194, 1748, 11650, 11653, 2443, 2441, 15151, 9305, 3509, 5961, 3666, 1017, 1711, 9734; Payload ID: 4936 relates to Category No.: 9305; Payload ID: 4937 relates to Category No.: 9305; Payload ID: 4938 relates to Category No.: 9305; Payload ID: 4939 relates to Category No.: 9305; Payload ID: 4940 relates to Category No.: 9157, 2890, 9305; Payload ID: 4941 relates to Category No.: 9305; Payload ID: 4942 relates to Category No.: 9305; Payload ID: 4943 relates to Category No.: 2942, 4228; Payload ID: 4944 relates to Category No.: 9305, 2890, 2942, 4228, 1659, 2710, 14329; Payload ID: 4945 relates to Category No.: 9305; Payload ID: 4946 relates to Category No.: 9305; Payload ID: 4947 relates to Category No.: 9305; Payload ID: 4948 relates to Category No.: 9305; Payload ID: 4949 relates to Category No.: 9305; Payload ID: 4950 relates to Category No.: 9305, 16317; Payload ID: 4952 relates to Category No.: 4030, 15151, 1748, 15161; Payload ID: 4953 relates to Category No.: 9305, 9247, 5029, 13728, 9725, 2890, 11883, 8948; Payload ID: 4954 relates to Category No.: 9305, 2890, 9247, 9181, 3952, 5029, 2420, 2192, 9172, 16317; Payload ID: 4955 relates to Category No.: 9305, 5776, 9247, 5029, 9172, 2890; Payload ID: 4956 relates to Category No.: 9305, 2942; Payload ID: 4957 relates to Category No.: 9305, 9242, 9247, 9158, 15269; Payload ID: 4958 relates to Category No.: 2890, 2194, 2420, 15269, 9158, 15269; Payload ID: 4959 relates to Category No.: 9247, 9158, 15269; Payload ID: 4960 relates to Category No.: 9305, 2890; Payload ID: 4961 relates to Category No.: 9305, 2890, 5762, 9242, 2942, 9247, 9157; Payload ID: 4962 relates to Category No.: 9305, 2890, 5762, 2942, 9247, 9157; Payload ID: 4963 relates to Category No.: 9305, 9247, 2420, 2632, 2420, 15269; Payload ID: 4964 relates to Category No.: 9305, 2890, 9247, 9153, 13728; Payload ID: 4965 relates to Category No.: 9305, 2890, 9247; Payload ID: 4966 relates to Category No.: 2420, 2192, 9247, 2402, 2777; Payload ID: 4967 relates to Category No.: 9305, 9247, 4368, 7068; Payload ID: 4969 relates to Category No.: 2890, 9247; Payload ID: 4970 relates to Category No.: 5561, 6443, 2890, 6440; Payload ID: 4971 relates to Category No.: 5561, 6443, 2890, 5776, 4755, 6440; Payload ID: 4972 relates to Category No.: 9305, 2942, 9247, 12170, 2391, 2389, 2390, 765, 2890, 6059; Payload ID: 4973 relates to Category No.: 7118, 2890, 5762, 2942; Payload ID: 4974 relates to Category No.: 2890; Payload ID: 4975 relates to Category No.: 3393, 2686; Payload ID: 4976 relates to Category No.: 9305, 7118, 6717, 2942, 15892, 9734, 4010, 2915; Payload ID: 4977 relates to Category No.: 6717, 2942, 4010, 9305; Payload ID: 4978 relates to Category No.: 9305, 7118, 2890, 5776, 2942, 5360, 1748, 11653, 7060, 276, 8917, 7068, 5358, 4053; Payload ID: 4979 relates to Category No.: 6717, 2942; Payload ID: 4980 relates to Category No.: 9305, 9242, 2942, 9247, 4010; Payload ID: 4981 relates to Category No.: 6717, 3666, 3671, 3668, 7118; Payload ID: 4982 relates to Category No.: 5561, 6717; Payload ID: 4983 relates to Category No.: 1842, 2890, 14826, 1046, 7244; Payload ID: 4984 relates to Category No.: 5561, 6717, 3673; Payload ID: 4985 relates to Category No.: 9305, 2942, 11836, 5412; Payload ID: 4986 relates to Category No.: 2890, 10056, 9247, 2942, 4010; Payload ID: 4987 relates to Category No.: 2942, 9305; Payload ID: 4988 relates to Category No.: 9305, 2890, 6717, 2942, 9247, 9734, 16326; Payload ID: 4990 relates to Category No.: 9305, 2942; Payload ID: 4991 relates to Category No.: 2890, 9242, 3673, 3666, 4010, 3671; Payload ID: 4992 relates to Category No.: 5561; Payload ID: 4993 relates to Category No.: 5561, 6717, 3673, 3666, 9184, 10056; Payload ID: 4994 relates to Category No.: 6717, 3666, 3671, 3668, 5561, 1700; Payload ID: 4995 relates to Category No.: 7118, 4010, 7048; Payload ID: 4997 relates to Category No.: 6717, 16269, 4010, 3696, 3523, 6440, 5561; Payload ID: 4998 relates to Category No.: 5561, 6717, 9242, 3673, 9247, 4010; Payload ID: 4999 relates to Category No.: 5561, 11717, 7048, 7118; Payload ID: 5000 relates to Category No.: 5561, 1700; Payload ID: 5001 relates to Category No.: 9305, 2890; Payload ID: 5002 relates to Category No.: 5561; Payload ID: 5003 relates to Category No.: 5561, 7118, 7048, 11883, 11717; Payload ID: 5004 relates to Category No.: 9305, 2890, 2942, 9247, 9184; Payload ID: 5005 relates to Category No.: 14174; Payload ID: 5006 relates to Category No.: 5561; Payload ID: 5007 relates to Category No.: 5561; Payload ID: 5008 relates to Category No.: 9305, 6717, 5762, 7118; Payload ID: 5009 relates to Category No.: 4780; Payload ID: 5010 relates to Category No.: 2890, 6717, 4010, 3671, 4032, 3679, 14683; Payload ID: 5011 relates to Category No.: 7118; Payload ID: 5012 relates to Category No.: 5561, 6717, 7118; Payload ID: 5013 relates to Category No.: 7118, 6717, 10056, 4010, 6709, 6440, 2509, 15151, 15280; Payload ID: 5014 relates to Category No.: 6717; Payload ID: 5015 relates to Category No.: 6717, 5561; Payload ID: 5016 relates to Category No.: 2942, 15139, 8951; Payload ID: 5017 relates to Category No.: 2890, 6717, 2938, 2942, 9247, 4010; Payload ID: 5018 relates to Category No.: 9247; Payload ID: 5019 relates to Category No.: 4030, 9305, 2890, 10056; Payload ID: 5020 relates to Category No.: 5039; Payload ID: 5021 relates to Category No.: 9305, 2890; Payload ID: 5022 relates to Category No.: 7118; Payload ID: 5023 relates to Category No.: 9305, 2890, 9734; Payload ID: 5024 relates to Category No.: 2942; Payload ID: 5025 relates to Category No.: 2890, 10056; Payload ID: 5026 relates to Category No.: 5762; Payload ID: 5027 relates to Category No.: 5762; Payload ID: 5029 relates to Category No.: 10056, 15139, 1748; Payload ID: 5030 relates to Category No.: 3673, 5557; Payload ID: 5031 relates to Category No.: 5776, 3673, 5557; Payload ID: 5032 relates to Category No.: 5561, 3673, 6717, 5776, 3666, 9362, 11883; Payload ID: 5033 relates to Category No.: 5561, 6717, 5776, 3673, 5557; Payload ID: 5034 relates to Category No.: 9305, 6717, 3673, 3666, 3406, 5776; Payload ID: 5035 relates to Category No.: 3673, 5557, 4735, 3406; Payload ID: 5036 relates to Category No.: 6717, 3673, 3666, 5557, 3406, 6599; Payload ID: 5037 relates to Category No.: 2942, 4010, 2890, 1017, 15151, 8948; Payload ID: 5038 relates to Category No.: 5561, 2942, 6709, 6712, 2890; Payload ID: 5039 relates to Category No.: 5561, 4029, 2890, 6717, 15628, 14411, 2400, 2401; Payload ID: 5040 relates to Category No.: 5561, 10056, 2942, 3673, 5570, 9098, 2446, 9305, 6717, 3036, 1659, 3666, 1017, 3055, 8948, 1033, 3054, 3061, 3057; Payload ID: 5041 relates to Category No.: 5561, 5762, 10056, 2942, 5570, 3036, 1017, 15161, 9098, 2446, 6717, 3636, 3055, 1033, 262, 2926, 11650, 9730, 14826, 6075; Payload ID: 5042 relates to Category No.: 5561, 10056, 5570, 6717, 3636, 1774, 778; Payload ID: 5043 relates to Category No.: 5561, 5570; Payload ID: 5044 relates to Category No.: 5561, 10056, 5570, 9098, 2446, 1336; Payload ID: 5045 relates to Category No.: 4765; Payload ID: 5046 relates to Category No.: 4765, 4010; Payload ID: 5047 relates to Category No.: 4029; Payload ID: 5048 relates to Category No.: 9305; Payload ID: 5049 relates to Category No.: 9305, 9247; Payload ID: 5050 relates to Category No.: 6443, 10056, 8935, 1748, 15161; Payload ID: 5051 relates to Category No.: 2890, 10056; Payload ID: 5052 relates to Category No.: 9305, 9247, 9184; Payload ID: 5053 relates to Category No.: 9305; Payload ID: 5055 relates to Category No.: 2890, 6960, 2938, 2942, 8935, 6964, 3036; Payload ID: 5056 relates to Category No.: 5762; Payload ID: 5057 relates to Category No.: 2890, 2938, 11728, 1046, 5762; Payload ID: 5058 relates to Category No.: 5762; Payload ID: 5059 relates to Category No.: 5762; Payload ID: 5060 relates to Category No.: 5762, 5570, 8951; Payload ID: 5061 relates to Category No.: 2890, 2938, 5762; Payload ID: 5062 relates to Category No.: 9305, 2890; Payload ID: 5063 relates to Category No.: 9305, 2890; Payload ID: 5064 relates to Category No.: 9305, 1842; Payload ID: 5065 relates to Category No.: 9305; Payload ID: 5066 relates to Category No.: 4029, 6717, 10056, 5570, 15139, 1748, 1017, 4860, 5561; Payload ID: 5067 relates to Category No.: 5561, 4030, 10056, 15139, 1748, 1792; Payload ID: 5068 relates to Category No.: 9305, 5762; Payload ID: 5069 relates to Category No.: 1842; Payload ID: 5070 relates to Category No.: 1842; Payload ID: 5071 relates to Category No.: 9305, 401; Payload ID: 5072 relates to Category No.: 9305, 1842; Payload ID: 5073 relates to Category No.: 2942; Payload ID: 5075 relates to Category No.: 5561, 6717, 9176; Payload ID: 5076 relates to Category No.: 5561, 9305, 9176; Payload ID: 5077 relates to Category No.: 5561, 9176; Payload ID: 5078 relates to Category No.: 5561, 9176; Payload ID: 5079 relates to Category No.: 14529; Payload ID: 5080 relates to Category No.: 14529; Payload ID: 5081 relates to Category No.: 9305, 9247, 4755, 15573, 14529, 5216; Payload ID: 5082 relates to Category No.: 9305; Payload ID: 5083 relates to Category No.: 2890, 5762, 10056, 273, 1720, 3036, 4860, 375, 1811, 6717, 4402; Payload ID: 5084 relates to Category No.: 2890, 5762, 10056, 2942, 4765, 1748, 1720, 6017, 4010, 10106, 14327, 2505, 3036, 11650; Payload ID: 5085 relates to Category No.: 9305, 9242, 9247, 6955; Payload ID: 5086 relates to Category No.: 9305, 2890, 7015, 2942; Payload ID: 5089 relates to Category No.: 5561, 2890, 9305; Payload ID: 5090 relates to Category No.: 2890, 1842; Payload ID: 5091 relates to Category No.: 10056, 2942; Payload ID: 5092 relates to Category No.: 5561, 10056, 779; Payload ID: 5093 relates to Category No.: 5561, 10056, 4010, 779; Payload ID: 5094 relates to Category No.: 5561, 3673, 10056; Payload ID: 5095 relates to Category No.: 5561, 3673; Payload ID: 5096 relates to Category No.: 2890, 1748, 1099, 779; Payload ID: 5097 relates to Category No.: 9305, 2890; Payload ID: 5098 relates to Category No.: 9305, 2890, 9247, 4755; Payload ID: 5099 relates to Category No.: 9305, 9215; Payload ID: 5100 relates to Category No.: 9305, 2890; Payload ID: 5101 relates to Category No.: 2890, 5561; Payload ID: 5103 relates to Category No.: 2890, 10056; Payload ID: 5104 relates to Category No.: 9305, 2890, 9247, 2899, 2942; Payload ID: 5105 relates to Category No.: 9305, 2890, 9247, 7052, 4050; Payload ID: 5106 relates to Category No.: 2890; Payload ID: 5107 relates to Category No.: 9305; Payload ID: 5108 relates to Category No.: 9305, 2890, 7060, 4050; Payload ID: 5109 relates to Category No.: 9305, 2890; Payload ID: 5110 relates to Category No.: 9305, 2890, 2942, 4010; Payload ID: 5111 relates to Category No.: 9305, 2890, 4755, 4010, 7118; Payload ID: 5113 relates to Category No.: 5762; Payload ID: 5114 relates to Category No.: 9305, 2890, 2942, 9247, 4010, 5392; Payload ID: 5115 relates to Category No.: 9305, 9247; Payload ID: 5116 relates to Category No.: 9247; Payload ID: 5117 relates to Category No.: 2890, 2942, 9247; Payload ID: 5118 relates to Category No.: 2942, 9247; Payload ID: 5119 relates to Category No.: 9305, 2890; Payload ID: 5120 relates to Category No.: 9305, 2890, 2942; Payload ID: 5121 relates to Category No.: 2890; Payload ID: 5122 relates to Category No.: 9305, 9247, 9215, 14145; Payload ID: 5123 relates to Category No.: 9305; Payload ID: 5124 relates to Category No.: 9305, 2890, 15892, 9247, 14145, 5561; Payload ID: 5125 relates to Category No.: 9305; Payload ID: 5126 relates to Category No.: 9305, 2890, 5776; Payload ID: 5127 relates to Category No.: 2890, 4755; Payload ID: 5128 relates to Category No.: 3509, 2890, 6717, 6960, 2194, 2942, 14906, 14100, 5964, 11883, 1750; Payload ID: 5129 relates to Category No.: 3509, 2890, 6717, 6960, 2194, 2942, 4010, 5964, 3506, 16156, 4860; Payload ID: 5130 relates to Category No.: 2194, 2942, 6994, 9734, 2630, 14893, 3506, 2514, 6964; Payload ID: 5131 relates to Category No.: 9305, 2890, 2194, 2942, 2896, 3506; Payload ID: 5132 relates to Category No.: 2194, 2942, 2630; Payload ID: 5133 relates to Category No.: 2194, 2942, 2630, 3506; Payload ID: 5134 relates to Category No.: 5561, 10056, 4765, 4755; Payload ID: 5135 relates to Category No.: 6960, 10056, 4010, 7366, 10000, 6722, 2890, 4755, 15139, 11883, 15151, 16078; Payload ID: 5136 relates to Category No.: 7118, 2890, 6717, 6960, 5776, 2942, 4755, 9734, 1748, 7070, 2534, 9756, 15161, 11883, 1335; Payload ID: 5137 relates to Category No.: 2890, 6960, 10056, 2942, 4765, 6994, 4755, 11650, 11653, 2534, 4860, 4010, 4228, 3638, 10000, 9305, 1748, 2194, 3693, 11883, 6017, 15573, 9734, 9773, 14329, 2502; Payload ID: 5138 relates to Category No.: 6960, 9734, 11650, 4010, 3055, 7118, 10000, 2890, 4755, 15139, 1017, 3057, 15145; Payload ID: 5139 relates to Category No.: 2890, 2938, 15139, 1748, 4769; Payload ID: 5140 relates to Category No.: 2458; Payload ID: 5141 relates to Category No.: 3509, 4010; Payload ID: 5142 relates to Category No.: 2938, 1046; Payload ID: 5143 relates to Category No.: 2890; Payload ID: 5144 relates to Category No.: 2890, 2938, 7244; Payload ID: 5145 relates to Category No.: 9305, 2890, 10056, 14906, 1046; Payload ID: 5146 relates to Category No.: 2890; Payload ID: 5147 relates to Category No.: 2890; Payload ID: 5148 relates to Category No.: 2890; Payload ID: 5149 relates to Category No.: 3509, 6960, 1042, 14826, 5456; Payload ID: 5150 relates to Category No.: 3509; Payload ID: 5152 relates to Category No.: 3509, 2890, 6960, 7246; Payload ID: 5153 relates to Category No.: 3509, 2890, 6960, 2458; Payload ID: 5154 relates to Category No.: 3509, 2890, 6960, 2458; Payload ID: 5155 relates to Category No.: 3509, 6960, 1042; Payload ID: 5156 relates to Category No.: 3509, 6960, 1042, 7246; Payload ID: 5157 relates to Category No.: 3509, 6960, 1042; Payload ID: 5158 relates to Category No.: 3509, 6960, 1842, 1046, 9474, 1042; Payload ID: 5159 relates to Category No.: 3509, 6960, 1042; Payload ID: 5160 relates to Category No.: 3509, 6960, 2458, 1042, 5456; Payload ID: 5161 relates to Category No.: 3509, 14833, 6960, 1042; Payload ID: 5162 relates to Category No.: 3509, 6960, 2938, 1046; Payload ID: 5163 relates to Category No.: 6960, 2938, 2458, 9474; Payload ID: 5164 relates to Category No.: 6960, 1042, 1046, 14826, 9474, 4008; Payload ID: 5166 relates to Category No.: 3509, 2890, 6960, 10056, 2458, 6964; Payload ID: 5167 relates to Category No.: 2890, 1042, 1046, 4199; Payload ID: 5168 relates to Category No.: 3509, 6717, 6960, 2194, 2942, 2896, 4010, 2890, 4199; Payload ID: 5169 relates to Category No.: 9305, 12439, 2890, 6960, 2942, 14906, 9734, 2630, 2896, 5964, 2907, 16156; Payload ID: 5170 relates to Category No.: 2896, 2890, 6960, 2194, 2942, 16156; Payload ID: 5171 relates to Category No.: 2890, 6717, 6960, 2194, 10056, 14906, 2630, 2896, 5964; Payload ID: 5172 relates to Category No.: 6717, 6960, 2194, 2942, 2896; Payload ID: 5173 relates to Category No.: 3509, 6960, 10056, 2942, 4755, 11728, 2455, 4010, 1046, 778, 7246; Payload ID: 5174 relates to Category No.: 2942, 2901, 11728, 1042, 2455, 1046, 2441, 778, 7246, 5795; Payload ID: 5175 relates to Category No.: 9305, 7118, 2890, 6717, 6960, 2194, 10056, 2942, 2660, 11728, 2896, 2455, 6964, 4010, 5964, 7161, 2458, 2938; Payload ID: 5176 relates to Category No.: 9305, 3509, 7394, 6717, 6960, 2194, 10056, 2942, 11728, 2455, 6964, 2890; Payload ID: 5177 relates to Category No.: 2890, 6717, 6960, 2194, 11728, 2896, 2455; Payload ID: 5178 relates to Category No.: 6960, 11728, 2896, 2455, 4010; Payload ID: 5179 relates to Category No.: 6960, 4755, 2896, 14893, 5270; Payload ID: 5180 relates to Category No.: 9305, 6960, 2630, 2896, 5964, 2890; Payload ID: 5181 relates to Category No.: 2890; Payload ID: 5182 relates to Category No.: 2890; Payload ID: 5183 relates to Category No.: 5561, 10056, 3693, 14363, 2927, 3521, 3636, 4010, 6059, 15758, 6017, 2926; Payload ID: 5184 relates to Category No.: 9305, 2890, 9242, 9247, 1291, 15252, 1288, 1377, 5561; Payload ID: 5185 relates to Category No.: 9305, 2890, 10056; Payload ID: 5186 relates to Category No.: 5561, 9305, 2890, 5727, 2942, 3673, 2899, 273, 1720, 6968, 1017, 1750, 4010, 5730, 1090, 4228, 16326, 6978, 1085, 9162, 4926, 4989, 2938, 8951; Payload ID: 5187 relates to Category No.: 9305, 2890, 1233, 2942, 3673, 8935, 1748, 11650, 14363, 11653, 1017, 4860, 15161, 3696, 3055, 6712, 10056, 14367; Payload ID: 5188 relates to Category No.: 2890, 15139, 1748, 11883, 1017, 1774, 14363, 4043; Payload ID: 5189 relates to Category No.: 2890, 15139; Payload ID: 5190 relates to Category No.: 4030, 5561, 4029, 2890, 6717, 2938, 10056, 9247, 14363, 11653, 6017, 4199, 4010, 1090, 4228, 3518, 2650, 1811, 1770, 6743, 3517, 9087, 1099, 1803, 2738; Payload ID: 5191 relates to Category No.: 1842; Payload ID: 5192 relates to Category No.: 10056, 2942, 3673, 14371, 9184, 5564, 9192; Payload ID: 5193 relates to Category No.: 9305, 2938, 10056, 2942, 15139, 273, 14363, 11653, 4199, 1792, 6743, 11883, 16326, 3518, 6075, 2738, 4201, 8942, 15184, 1824, 1748; Payload ID: 5194 relates to Category No.: 2890, 2938, 10056, 6717, 3036; Payload ID: 5195 relates to Category No.: 10056; Payload ID: 5196 relates to Category No.: 9305, 2890, 9247, 5102, 15505; Payload ID: 5197 relates to Category No.: 9247, 9153, 9215, 15130, 9305; Payload ID: 5198 relates to Category No.: 9305, 15505, 9247, 12392, 2890, 9157; Payload ID: 5199 relates to Category No.: 15505, 9247, 9305; Payload ID: 5200 relates to Category No.: 9305, 2890, 15505, 5776, 9247, 4755; Payload ID: 5201 relates to Category No.: 15505, 9247, 9157, 9305; Payload ID: 5202 relates to Category No.: 9305, 15505, 9242, 9247, 2890, 5561; Payload ID: 5203 relates to Category No.: 9305, 15505, 7179; Payload ID: 5204 relates to Category No.: 9305, 15505; Payload ID: 5205 relates to Category No.: 9305, 15505; Payload ID: 5206 relates to Category No.: 9305, 2890, 9247, 4755; Payload ID: 5207 relates to Category No.: 2890, 9247, 9305, 14893; Payload ID: 5208 relates to Category No.: 9305, 9247; Payload ID: 5209 relates to Category No.: 9305, 2890, 9247; Payload ID: 5210 relates to Category No.: 9305, 2890; Payload ID: 5211 relates to Category No.: 9247, 10104, 9305; Payload ID: 5212 relates to Category No.: 9305, 2890; Payload ID: 5213 relates to Category No.: 9305; Payload ID: 5214 relates to Category No.: 9305; Payload ID: 5215 relates to Category No.: 9305; Payload ID: 5216 relates to Category No.: 9305; Payload ID: 5217 relates to Category No.: 2890, 6717, 2942, 3521, 4010, 3523, 4053, 2926, 3693, 1037, 14498, 12439; Payload ID: 5218 relates to Category No.: 9305, 2890, 9247; Payload ID: 5219 relates to Category No.: 9305, 2890; Payload ID: 5220 relates to Category No.: 9305, 2890; Payload ID: 5221 relates to Category No.: 9305, 2890; Payload ID: 5222 relates to Category No.: 9305, 6717, 9242; Payload ID: 5223 relates to Category No.: 9305, 2890, 9247; Payload ID: 5224 relates to Category No.: 6960, 2942, 9734, 6964, 7170, 7166; Payload ID: 5225 relates to Category No.: 5561, 2890, 6960, 6964, 7161; Payload ID: 5226 relates to Category No.: 2890, 6960; Payload ID: 5227 relates to Category No.: 2890, 6717, 6960; Payload ID: 5228 relates to Category No.: 2890, 6960, 4010; Payload ID: 5229 relates to Category No.: 2890, 6960; Payload ID: 5230 relates to Category No.: 5561; Payload ID: 5231 relates to Category No.: 5570; Payload ID: 5232 relates to Category No.: 9305, 6976, 5776, 2942, 4755, 14893; Payload ID: 5233 relates to Category No.: 5561; Payload ID: 5234 relates to Category No.: 9305, 7118, 2890, 9247; Payload ID: 5235 relates to Category No.: 9305, 2890, 2938, 2786, 9181, 9247, 8948, 9157, 9242; Payload ID: 5236 relates to Category No.: 5561, 4029, 6717, 2938, 5776, 10056, 2574, 5570, 3673, 778;

Payload ID: 5237 relates to Category No.: 5561, 10056, 778; Payload ID: 5238 relates to Category No.: 5561, 10056, 5570, 5762; Payload ID: 5239 relates to Category No.: 4030, 10056; Payload ID: 5240 relates to Category No.: 4030, 2942, 4008; Payload ID: 5241 relates to Category No.: 6717, 10056, 5570, 4010; Payload ID: 5242 relates to Category No.: 6717, 10056, 5570, 4010; Payload ID: 5243 relates to Category No.: 5561, 3673, 4010, 10056, 1083, 1792, 1711, 1777; Payload ID: 5244 relates to Category No.: 5561, 10056; Payload ID: 5245 relates to Category No.: 5561, 5776, 5559, 1001, 2926; Payload ID: 5246 relates to Category No.: 3666, 4010; Payload ID: 5247 relates to Category No.: 5561, 4765, 4010, 4030, 10056, 4755, 1792; Payload ID: 5248 relates to Category No.: 5561, 2927; Payload ID: 5249 relates to Category No.: 5561, 10056, 6717; Payload ID: 5250 relates to Category No.: 4030, 5561, 10056, 5570, 1099, 1792, 6440; Payload ID: 5251 relates to Category No.: 4030, 10056, 5570, 5561; Payload ID: 5252 relates to Category No.: 5570, 9734, 4010, 5561, 10056; Payload ID: 5253 relates to Category No.: 5561, 6717, 10056, 4010; Payload ID: 5254 relates to Category No.: 5561, 4029, 10056; Payload ID: 5255 relates to Category No.: 4029, 10056, 677, 4010; Payload ID: 5256 relates to Category No.: 5561, 6717, 10056, 4755, 6989; Payload ID: 5257 relates to Category No.: 2890; Payload ID: 5258 relates to Category No.: 2942; Payload ID: 5259 relates to Category No.: 9305, 2890; Payload ID: 5265 relates to Category No.: 9305, 2890, 9247; Payload ID: 5270 relates to Category No.: 9305; Payload ID: 5271 relates to Category No.: 11728; Payload ID: 5274 relates to Category No.: 2194, 8948, 1046, 7161, 2458; Payload ID: 5277 relates to Category No.: 4010, 7048, 7118; Payload ID: 5278 relates to Category No.: 6743; Payload ID: 5279 relates to Category No.: 10056, 4010, 5762; Payload ID: 5281 relates to Category No.: 4030, 4029, 12159, 4014, 4010, 2890, 1090; Payload ID: 5282 relates to Category No.: 4029, 4010, 1090, 4032; Payload ID: 5283 relates to Category No.: 3671, 5561; Payload ID: 5284 relates to Category No.: 4010, 4032; Payload ID: 5285 relates to Category No.: 15139, 1748, 1090, 12159, 5749, 1792; Payload ID: 5286 relates to Category No.: 4030, 6717, 12159, 1090; Payload ID: 5287 relates to Category No.: 4030, 4029, 4014; Payload ID: 5288 relates to Category No.: 4029; Payload ID: 5289 relates to Category No.: 9305, 2890, 2942; Payload ID: 5290 relates to Category No.: 9247, 9305, 2942; Payload ID: 5291 relates to Category No.: 9305, 2890, 2942, 9247; Payload ID: 5292 relates to Category No.: 2890, 10056; Payload ID: 5293 relates to Category No.: 6717; Payload ID: 5294 relates to Category No.: 6717, 10056, 6222, 12440, 4010, 3696, 3523, 10085, 2452, 5762, 3636, 9734, 3521, 3693, 7366; Payload ID: 5295 relates to Category No.: 9305, 10056, 2942, 4049, 12440, 4010, 3696, 1659, 6717, 9734; Payload ID: 5296 relates to Category No.: 9305, 2890, 12440, 3696, 4228, 2452, 3636, 9734, 7366, 5762; Payload ID: 5297 relates to Category No.: 9305, 6717, 10056, 3666, 12440, 4010, 3523, 9734, 5762; Payload ID: 5298 relates to Category No.: 9305, 2942; Payload ID: 5299 relates to Category No.: 9305, 7118, 9247, 7068; Payload ID: 5300 relates to Category No.: 4030, 4029, 2890, 14409, 4010, 1792, 15531; Payload ID: 5301 relates to Category No.: 12159, 4029, 3549, 7118, 4030, 4014; Payload ID: 5302 relates to Category No.: 2574, 12159, 4029; Payload ID: 5303 relates to Category No.: 4029, 12159, 2574, 4014; Payload ID: 5304 relates to Category No.: 12159, 4014, 2890; Payload ID: 5308 relates to Category No.: 9305, 2890, 6717, 2942, 9247; Payload ID: 5309 relates to Category No.: 7118, 7060, 4010; Payload ID: 5310 relates to Category No.: 7118, 5776, 7060, 4010; Payload ID: 5311 relates to Category No.: 5561, 7061, 7060, 5562, 7048; Payload ID: 5312 relates to Category No.: 9305; Payload ID: 5313 relates to Category No.: 9305, 9247, 2890, 7118, 3036, 8948, 1033; Payload ID: 5314 relates to Category No.: 9305, 7118, 5776, 9247; Payload ID: 5315 relates to Category No.: 2890, 9247, 9305; Payload ID: 5316 relates to Category No.: 2890, 4765, 15139, 11723, 11721, 5358; Payload ID: 5317 relates to Category No.: 2890, 2938, 1748, 11723, 11721, 4860, 15139; Payload ID: 5318 relates to Category No.: 2890, 9247, 3558, 15497, 9215, 1377; Payload ID: 5319 relates to Category No.: 3558, 15497, 9215, 9247; Payload ID: 5320 relates to Category No.: 5561, 2890, 2458, 2441, 2446; Payload ID: 5321 relates to Category No.: 5561, 9305, 2890, 2938, 2458, 2446; Payload ID: 5322 relates to Category No.: 9247, 9305; Payload ID: 5323 relates to Category No.: 2890, 9247; Payload ID: 5324 relates to Category No.: 6717; Payload ID: 5325 relates to Category No.: 2890, 2938, 14953, 5971; Payload ID: 5326 relates to Category No.: 9247, 15497, 9215, 1377, 15532, 5200; Payload ID: 5327 relates to Category No.: 9305, 9242, 9247, 15497; Payload ID: 5328 relates to Category No.: 5762; Payload ID: 5329 relates to Category No.: 2890, 6717, 9247, 14912, 1635, 9215, 1377, 9305; Payload ID: 5330 relates to Category No.: 2890, 2194, 9247, 15497; Payload ID: 5331 relates to Category No.: 2890, 5102, 15531, 3561, 15497; Payload ID: 5332 relates to Category No.: 2890, 9242, 5102, 3561, 15497; Payload ID: 5333 relates to Category No.: 2890, 9247, 5102, 3561, 15497; Payload ID: 5334 relates to Category No.: 2890, 3561, 9305; Payload ID: 5335 relates to Category No.: 3561, 5561; Payload ID: 5336 relates to Category No.: 5561, 6717, 3673, 3666, 5557; Payload ID: 5337 relates to Category No.: 5561, 3673, 3666; Payload ID: 5338 relates to Category No.: 5561, 3673, 3666; Payload ID: 5339 relates to Category No.: 5561, 3666, 5557; Payload ID: 5340 relates to Category No.: 5561, 6717, 3673, 3666, 8948, 3036, 3063; Payload ID: 5341 relates to Category No.: 5561, 3673, 3666, 5557; Payload ID: 5342 relates to Category No.: 5561, 3673, 3666; Payload ID: 5343 relates to Category No.: 5570, 15139, 1748, 5561; Payload ID: 5344 relates to Category No.: 2890; Payload ID: 5345 relates to Category No.: 9305, 2890, 9242, 9247, 3861, 11793, 14530; Payload ID: 5346 relates to Category No.: 5561, 6717, 6960, 3666, 9176, 9184, 9162, 9192, 9305; Payload ID: 5347 relates to Category No.: 9305, 2890, 9242; Payload ID: 5348 relates to Category No.: 12159, 2574, 4755, 3666; Payload ID: 5349 relates to Category No.: 5561, 3673, 5570, 3666, 5776; Payload ID: 5350 relates to Category No.: 5561, 3673, 3666; Payload ID: 5351 relates to Category No.: 9305, 2890; Payload ID: 5352 relates to Category No.: 9305; Payload ID: 5353 relates to Category No.: 2890, 10056, 2942, 15139, 1748, 6017, 4199, 4228, 14999; Payload ID: 5354 relates to Category No.: 2890, 6717, 2938, 2942, 6017, 4228; Payload ID: 5355 relates to Category No.: 12159; Payload ID: 5356 relates to Category No.: 7048, 1842, 11883, 7118, 5561; Payload ID: 5357 relates to Category No.: 2890, 2942; Payload ID: 5360 relates to Category No.: 4010, 16190; Payload ID: 5361 relates to Category No.: 5561, 10056, 16190; Payload ID: 5363 relates to Category No.: 5561, 16190; Payload ID: 5364 relates to Category No.: 5561; Payload ID: 5365 relates to Category No.: 5561; Payload ID: 5366 relates to Category No.: 5561, 10056, 16190; Payload ID: 5367 relates to Category No.: 4030, 2890, 9247, 4008, 1792, 4228, 12406, 15569, 3717, 5561; Payload ID: 5368 relates to Category No.: 5561, 4029, 10056; Payload ID: 5369 relates to Category No.: 6717, 4010; Payload ID: 5370 relates to Category No.: 7118, 9305, 2942, 9730; Payload ID: 5371 relates to Category No.: 2890, 9242; Payload ID:

5372 relates to Category No.: 4030, 4029, 2890, 10056; Payload ID: 5374 relates to Category No.: 4030, 5561, 4029, 6717, 2942, 3673, 3666, 4010, 3671, 2890, 5776; Payload ID: 5375 relates to Category No.: 5561, 3673, 3671; Payload ID: 5376 relates to Category No.: 3671, 3678; Payload ID: 5377 relates to Category No.: 5561, 6717, 3673; Payload ID: 5378 relates to Category No.: 6717, 5776, 3673, 3666, 3671, 3036; Payload ID: 5379 relates to Category No.: 3673, 3666, 6717; Payload ID: 5380 relates to Category No.: 3671; Payload ID: 5381 relates to Category No.: 6717, 3666, 15627, 4010, 1792, 6709, 14683, 3671; Payload ID: 5382 relates to Category No.: 3673, 4010, 1792, 3671, 3685; Payload ID: 5383 relates to Category No.: 2890, 3673, 3666, 5557, 5854, 5857, 5856, 7118, 9176, 500; Payload ID: 5384 relates to Category No.: 5561, 5857; Payload ID: 5385 relates to Category No.: 5561, 6717, 4765, 3673, 3686, 3685; Payload ID: 5386 relates to Category No.: 2890, 9247; Payload ID: 5387 relates to Category No.: 5561, 10056, 1182, 447, 4010; Payload ID: 5388 relates to Category No.: 5561, 10056, 2942; Payload ID: 5389 relates to Category No.: 5561, 10056, 2942; Payload ID: 5390 relates to Category No.: 4029; Payload ID: 5391 relates to Category No.: 9305, 2890, 5762, 9242, 15508, 4010; Payload ID: 5392 relates to Category No.: 9305, 2890, 15505, 2942, 9247, 9215; Payload ID: 5393 relates to Category No.: 4030, 4029, 2890, 2942, 1084, 14294, 16278; Payload ID: 5394 relates to Category No.: 4030, 4029, 5762, 2942; Payload ID: 5395 relates to Category No.: 4030, 4029, 5762, 1700; Payload ID: 5396 relates to Category No.: 5561, 6717, 10056, 3693, 9734, 3521, 4008, 4010, 6440, 16156, 16278, 5816, 2926, 14409; Payload ID: 5397 relates to Category No.: 5561, 4765, 2927; Payload ID: 5398 relates to Category No.: 5570, 5762; Payload ID: 5399 relates to Category No.: 5561, 10056, 2942, 5570, 6717, 6743, 9184, 15758; Payload ID: 5400 relates to Category No.: 5561, 10056, 5570, 2942, 6717, 6743, 9184; Payload ID: 5401 relates to Category No.: 4029; Payload ID: 5402 relates to Category No.: 9305; Payload ID: 5403 relates to Category No.: 9305, 6717; Payload ID: 5404 relates to Category No.: 2890, 6717, 10056, 2942, 4925; Payload ID: 5405 relates to Category No.: 2890, 6717, 2942, 5561; Payload ID: 5406 relates to Category No.: 2890; Payload ID: 5407 relates to Category No.: 6717, 2942, 2903; Payload ID: 5408 relates to Category No.: 9305, 2890, 6717, 5776, 2942, 9247, 2903; Payload ID: 5409 relates to Category No.: 9305, 9247, 9184, 10015, 9153; Payload ID: 5410 relates to Category No.: 10015; Payload ID: 5411 relates to Category No.: 6994, 6717; Payload ID: 5412 relates to Category No.: 14354, 9199, 15502, 3492; Payload ID: 5413 relates to Category No.: 9247, 3861, 9305; Payload ID: 5414 relates to Category No.: 9305, 2890, 9247, 9157, 3861, 11793; Payload ID: 5415 relates to Category No.: 2901, 6968; Payload ID: 5416 relates to Category No.: 7244, 262, 14833; Payload ID: 5417 relates to Category No.: 4030, 9305, 2890, 6717, 10056, 2942, 9964, 4010, 6449; Payload ID: 5418 relates to Category No.: 9964, 4030, 10056, 2942, 4010, 2890, 8948, 5762, 7366, 10000, 9730; Payload ID: 5419 relates to Category No.: 9964, 4030, 2890, 10056, 2942, 4010, 6717; Payload ID: 5420 relates to Category No.: 9964, 1842; Payload ID: 5421 relates to Category No.: 7118, 1842; Payload ID: 5422 relates to Category No.: 9305, 2942, 4010; Payload ID: 5423 relates to Category No.: 7118, 6717, 9756, 4010; Payload ID: 5424 relates to Category No.: 7118; Payload ID: 5425 relates to Category No.: 7118; Payload ID: 5426 relates to Category No.: 7118, 7060, 4010; Payload ID: 5427 relates to Category No.: 7118, 7060, 4010, 7048; Payload ID: 5428 relates to Category No.: 7118, 6717, 5776, 9247, 9753, 9756; Payload ID: 5430 relates to Category No.: 9756, 7118, 2942; Payload ID: 5432 relates to Category No.: 2942, 2899; Payload ID: 5433 relates to Category No.: 2938, 2701, 2890, 3113, 4010; Payload ID: 5434 relates to Category No.: 2701; Payload ID: 5435 relates to Category No.: 9305, 5762; Payload ID: 5436 relates to Category No.: 4010; Payload ID: 5437 relates to Category No.: 9305, 2890, 9247, 493; Payload ID: 5438 relates to Category No.: 5762, 9247; Payload ID: 5439 relates to Category No.: 9305; Payload ID: 5440 relates to Category No.: 2890, 9247, 2420, 15269, 14675; Payload ID: 5442 relates to Category No.: 4029, 4010, 6443; Payload ID: 5443 relates to Category No.: 5561, 10056, 5570; Payload ID: 5444 relates to Category No.: 5561, 10056, 5570, 4010; Payload ID: 5445 relates to Category No.: 5561, 5762, 10056, 5570, 1792, 4228, 14329, 6019, 6099; Payload ID: 5446 relates to Category No.: 5561, 4029, 10056, 5570, 3521; Payload ID: 5447 relates to Category No.: 5561, 5570, 2890, 10056, 1748, 11650, 3036, 11653, 1017, 3523, 4755, 8917, 3666, 1792, 3055, 1774, 1033, 1711, 7070, 1036, 9730, 4199; Payload ID: 5448 relates to Category No.: 5561, 10056, 5570, 9734, 8948, 3036, 4008, 1017, 14293; Payload ID: 5449 relates to Category No.: 5561, 9247, 10056, 5570, 1842; Payload ID: 5450 relates to Category No.: 5561, 10056, 5570, 11653, 3036, 8917, 8948; Payload ID: 5451 relates to Category No.: 5561, 10056, 8935, 5570, 3523; Payload ID: 5452 relates to Category No.: 5561, 4029, 10056, 2942, 5570, 3036, 4010, 3523; Payload ID: 5453 relates to Category No.: 5561, 4029, 10056, 2942, 5570, 3036, 1017; Payload ID: 5454 relates to Category No.: 5561, 4029, 10056, 2942, 5570, 3036; Payload ID: 5455 relates to Category No.: 5561, 5570, 4029, 10056, 2942, 4010; Payload ID: 5456 relates to Category No.: 5561, 5570; Payload ID: 5457 relates to Category No.: 4029, 6717, 10056, 5570, 4010, 678; Payload ID: 5458 relates to Category No.: 4029, 6717, 10056, 677, 8917, 9730; Payload ID: 5459 relates to Category No.: 4029, 6717, 10056, 677, 5570; Payload ID: 5460 relates to Category No.: 4029, 6717, 10056, 677, 5570; Payload ID: 5461 relates to Category No.: 4029, 6717, 10056, 676, 1659, 5561; Payload ID: 5462 relates to Category No.: 6717, 10056, 5570, 15139, 4010, 2890, 9305, 6743; Payload ID: 5463 relates to Category No.: 6717, 10056, 5570, 4228; Payload ID: 5464 relates to Category No.: 6717, 10056, 5570; Payload ID: 5465 relates to Category No.: 4030, 5561, 4029, 4010, 6440, 10077; Payload ID: 5466 relates to Category No.: 5561, 6717, 4030, 9305, 2890, 10056, 4765, 3673, 3693, 1099, 9184, 3696, 1792, 6743, 4228, 3523, 12406, 766, 14539, 7321, 5743, 3636, 9734, 5762; Payload ID: 5467 relates to Category No.: 2890, 5776, 6717, 10056, 2942, 2534, 3523, 493, 2504, 2446, 2495, 766; Payload ID: 5468 relates to Category No.: 9305, 6717, 10056, 2495; Payload ID: 5469 relates to Category No.: 14953, 1748, 1720, 4860, 4010, 16156, 14329, 15139, 11650, 9079, 1335; Payload ID: 5470 relates to Category No.: 4030, 4029, 1792, 11883; Payload ID: 5471 relates to Category No.: 4030; Payload ID: 5472 relates to Category No.: 4029; Payload ID: 5473 relates to Category No.: 4029; Payload ID: 5474 relates to Category No.: 9305, 2890, 10056, 2942, 3666, 10162; Payload ID: 5475 relates to Category No.: 4030, 12159; Payload ID: 5476 relates to Category No.: 2938; Payload ID: 5477 relates to Category No.: 4030, 4029, 5762, 5570; Payload ID: 5478 relates to Category No.: 5561, 10056, 1182, 1099, 4010, 779, 6075, 1792; Payload ID: 5479 relates to Category No.: 9305, 2890, 5776, 2942, 1182, 6994, 1811, 9184, 7161, 2514, 2181; Payload ID: 5481 relates to Category No.: 5561, 6717, 10056; Payload ID: 5482 relates to Category No.: 5561, 9305, 2890, 10056, 4765, 4755, 2926, 1792, 6743, 779, 1659, 778; Payload ID: 5483 relates to Category No.: 5561, 10056; Payload ID: 5484 relates to Category No.: 4030, 5570, 5762, 5561; Payload ID: 5485 relates to Category No.: 9305; Payload ID: 5486 relates to Category No.: 9305, 9247; Payload ID: 5488 relates to Category No.: 3666, 2890, 9305; Payload ID: 5489 relates to Category No.: 5561, 3673; Payload ID: 5490 relates to Category No.: 2890, 2942, 9756, 4010; Payload ID: 5491 relates to Category No.: 4029, 1842, 5561; Payload ID: 5492 relates to Category No.: 5561; Payload ID: 5493 relates to Category No.: 4030, 4029, 1792, 11883; Payload ID: 5494 relates to Category No.: 2890, 4010, 11883, 14329; Payload ID: 5495 relates to Category No.: 2890, 10056, 4010, 11883, 16156, 14329; Payload ID: 5496 relates to Category No.: 2890; Payload ID: 5497 relates to Category No.: 9305, 2890, 10056, 2534; Payload ID: 5498 relates to Category No.: 2496, 5776, 9247, 4755; Payload ID: 5499 relates to Category No.: 9305, 9734, 4010, 2504, 4053, 2534; Payload ID: 5500 relates to Category No.: 4030, 6717, 10056; Payload ID: 5501 relates to Category No.: 5561, 10056, 5450, 9471, 2890, 9305, 3521, 261; Payload ID: 5502 relates to Category No.: 6717, 3666, 5557, 3678; Payload ID: 5503 relates to Category No.: 4029, 6717, 3666, 3671, 3678; Payload ID: 5504 relates to Category No.: 6717, 3666, 3671, 3678; Payload ID: 5505 relates to Category No.: 5561, 3673, 3666, 11883; Payload ID: 5506 relates to Category No.: 5561, 2890, 10056, 3673, 3666, 4010, 6743, 11883; Payload ID: 5507 relates to Category No.: 5561, 3826, 3666; Payload ID: 5508 relates to Category No.: 5561, 4029, 3826; Payload ID: 5509 relates to Category No.: 2890, 9242, 3666, 3826, 7118; Payload ID: 5510 relates to Category No.: 5561, 6717, 3826; Payload ID: 5511 relates to Category No.: 5561, 3826; Payload ID: 5512 relates to Category No.: 5561, 5557, 3826, 5567; Payload ID: 5513 relates to Category No.: 5561, 3826; Payload ID: 5514 relates to Category No.: 9305, 7118, 2890, 6717, 3826; Payload ID: 5515 relates to Category No.: 2890, 3826; Payload ID: 5516 relates to Category No.: 5561, 3673; Payload ID: 5517 relates to Category No.: 7118, 2890, 7048, 273, 7060, 5730; Payload ID: 5518 relates to Category No.: 9305, 2890, 4043, 2942, 10056; Payload ID: 5519 relates to Category No.: 9305, 2890, 10056, 9247, 1748, 1099, 9184, 1090, 1085, 4989; Payload ID: 5520 relates to Category No.: 5561, 9305, 2890, 6717, 10056, 9734, 1099, 3696, 12406, 2926, 779, 7366; Payload ID: 5521 relates to Category No.: 4030, 5561, 6717, 5762, 10056, 5570, 1099, 12406, 6075, 779; Payload ID: 5522 relates to Category No.: 5561, 4029, 9305, 7118, 6717, 10056, 2942, 9247, 1099, 7060, 12406; Payload ID: 5523 relates to Category No.: 11721; Payload ID: 5525 relates to Category No.: 5561, 9305, 2890, 6717, 5776, 9242, 3673, 4755, 3686; Payload ID: 5526 relates to Category No.: 5561, 6717, 3673, 4755, 3686; Payload ID: 5527 relates to Category No.: 2890, 9242; Payload ID: 5528 relates to Category No.: 2890, 9242; Payload ID: 5529 relates to Category No.: 2890, 2938, 1720, 4010, 5745, 9577, 8948, 4199, 7366; Payload ID: 5530 relates to Category No.: 5561, 10056, 2890, 2926; Payload ID: 5531 relates to Category No.: 9305, 2938, 5776, 10056, 14811, 4755, 4049, 11883, 14813, 2712, 6717, 2890; Payload ID: 5532 relates to Category No.: 2890, 2938, 4049, 1842; Payload ID: 5533 relates to Category No.: 2890, 2938, 1182, 4049, 778; Payload ID: 5534 relates to Category No.: 9305, 2890, 2938, 10056, 4049, 4228, 1750, 14329; Payload ID: 5535 relates to Category No.: 2938, 10056, 2942, 4049, 2890, 8951, 1811; Payload ID: 5536 relates to Category No.: 2938, 9305, 10056, 14811, 9247, 1748, 4049, 2660, 4010, 4228, 2890; Payload ID: 5537 relates to Category No.: 2890, 2938, 10056, 4049, 1811, 5921, 9577, 1016, 8951; Payload ID: 5538 relates to Category No.: 2938, 10056, 6717, 2712; Payload ID: 5539 relates to Category No.: 9305; Payload ID: 5540 relates to Category No.: 4030, 4029, 1792; Payload ID: 5541 relates to Category No.: 5561, 4029, 6717, 5570, 2942, 4008; Payload ID: 5542 relates to Category No.: 6717, 5762, 10056; Payload ID: 5543 relates to Category No.: 4030, 9305, 9242, 9247; Payload ID: 5544 relates to Category No.: 2890, 14953, 1335, 4197, 14955, 14954; Payload ID: 5546 relates to Category No.: 9305, 2890, 9242, 9247, 9157, 9172; Payload ID: 5547 relates to Category No.: 9305; Payload ID: 5548 relates to Category No.: 9247, 2402; Payload ID: 5549 relates to Category No.: 9305, 4755, 9247, 2402, 2419, 14614, 16317, 9194; Payload ID: 5550 relates to Category No.: 2890, 10056, 9247, 2899, 4755, 4010, 3671; Payload ID: 5551 relates to Category No.: 9305, 5561, 2890, 6717, 10056, 2942, 9247, 4755, 9157, 15532, 7118, 11883, 8935, 15280, 15758, 9734, 9730; Payload ID: 5552 relates to Category No.: 9305, 4029, 7118, 9247, 2890, 10056, 8935, 8948, 9734, 2458, 9730, 12170; Payload ID: 5553 relates to Category No.: 5561, 10056, 4765, 4755, 4228, 14409; Payload ID: 5554 relates to Category No.: 9305, 9242, 9247, 6968, 5597; Payload ID: 5555 relates to Category No.: 9305, 9247; Payload ID: 5556 relates to Category No.: 9305, 9247; Payload ID: 5557 relates to Category No.: 9305, 2890; Payload ID: 5558 relates to Category No.: 2890, 6717, 10056, 2942, 9247, 5561; Payload ID: 5559 relates to Category No.: 2942, 1842; Payload ID: 5560 relates to Category No.: 7060, 1842; Payload ID: 5561 relates to Category No.: 5561, 6717, 3673; Payload ID: 5562 relates to Category No.: 7118, 2890, 9247, 7060; Payload ID: 5563 relates to Category No.: 2942, 4010, 5561; Payload ID: 5564 relates to Category No.: 5561, 2890, 6717, 3673, 3666, 4755, 9184; Payload ID: 5565 relates to Category No.: 9305, 9247, 4755; Payload ID: 5566 relates to Category No.: 9305; Payload ID: 5567 relates to Category No.: 9305; Payload ID: 5568 relates to Category No.: 9157, 15531, 14256; Payload ID: 5569 relates to Category No.: 9305; Payload ID: 5570 relates to Category No.: 9305, 9242, 9247, 5762; Payload ID: 5571 relates to Category No.: 9305; Payload ID: 5572 relates to Category No.: 9305, 2890, 9242, 5561; Payload ID: 5573 relates to Category No.: 9305, 9247; Payload ID: 5574 relates to Category No.: 2942, 9247; Payload ID: 5575 relates to Category No.: 9305, 2890, 10056, 9247, 2420; Payload ID: 5576 relates to Category No.: 9305, 5776, 9247, 2420, 5730, 9157; Payload ID: 5577 relates to Category No.: 2890, 2942, 11650; Payload ID: 5578 relates to Category No.: 2890; Payload ID: 5579 relates to Category No.: 9305, 5762, 7118, 14145; Payload ID: 5580 relates to Category No.: 4030, 9305, 2890, 6717, 9242, 2942, 3960, 4010, 2710, 14329; Payload ID: 5581 relates to Category No.: 2890, 7366, 3960, 8948; Payload ID: 5582 relates to Category No.: 2890, 2942, 3666, 3960; Payload ID: 5583 relates to Category No.: 9305, 2890, 9242, 2942, 3666, 3960; Payload ID: 5584 relates to Category No.: 9305, 2890, 2942, 4010, 5561; Payload ID: 5585 relates to Category No.: 9305, 2890, 6717, 2942, 3666, 4010; Payload ID: 5586 relates to Category No.: 9305, 2890, 6717, 10056, 2942, 14145, 4010, 493, 10162, 6743, 10161; Payload ID: 5587 relates to Category No.: 9305, 2890; Payload ID: 5588 relates to Category No.: 5776, 9247, 5730; Payload ID: 5589 relates to Category No.: 2942; Payload ID: 5591 relates to Category No.: 1842; Payload ID: 5592 relates to Category No.: 10162, 2949, 5762; Payload ID: 5593 relates to Category No.: 14174, 6717, 2942, 3955, 10162, 4010, 3961, 7319, 2920, 3963, 2890, 9305, 15594, 4483; Payload ID: 5594 relates to Category No.: 2890, 2942, 3961; Payload ID: 5595 relates to Category No.: 2890, 2942, 4010; Payload ID:

5596 relates to Category No.: 4030, 2890, 1239, 3961; Payload ID: 5597 relates to Category No.: 2890; Payload ID: 5598 relates to Category No.: 9305, 14174, 2890, 6717, 2942, 9734; Payload ID: 5599 relates to Category No.: 2890, 6717, 3673, 3666, 5557, 9734; Payload ID: 5600 relates to Category No.: 2890, 6717, 10056, 2942, 3963; Payload ID: 5601 relates to Category No.: 2890, 2942, 3963; Payload ID: 5602 relates to Category No.: 2890, 2942, 3963; Payload ID: 5603 relates to Category No.: 2890, 2942, 3963; Payload ID: 5604 relates to Category No.: 9305, 2890, 2942, 3963; Payload ID: 5605 relates to Category No.: 9305, 2890, 2950, 9247; Payload ID: 5607 relates to Category No.: 9305, 2890, 6717, 9242, 2942, 3964, 3954, 3955, 3964, 3547; Payload ID: 5608 relates to Category No.: 3964, 2890, 2942, 3954, 3955, 9247, 4010, 3964, 3547; Payload ID: 5609 relates to Category No.: 2942, 3964, 3954, 3955; Payload ID: 5610 relates to Category No.: 3964, 3954, 3955; Payload ID: 5611 relates to Category No.: 2890, 6717, 2942, 3964, 3954, 3955, 3964, 3547; Payload ID: 5612 relates to Category No.: 3964, 9305, 2890, 6717, 2942, 3954, 3955, 9247, 2402, 4010, 10104; Payload ID: 5613 relates to Category No.: 6717, 2942, 3964, 3954, 3955, 3964, 3547; Payload ID: 5614 relates to Category No.: 2890, 2942, 3964, 3954, 3955, 9734; Payload ID: 5615 relates to Category No.: 6717, 2942, 3964, 3954, 3955, 4010, 3964, 3547; Payload ID: 5616 relates to Category No.: 2942, 3964, 3954, 3955, 4010, 3964, 3547; Payload ID: 5617 relates to Category No.: 2890, 2942, 3964, 3954, 3955; Payload ID: 5618 relates to Category No.: 2890, 3964, 9305, 6717, 2942, 3954, 3955, 4010; Payload ID: 5619 relates to Category No.: 2890, 3964, 3954, 3955, 6717, 9247, 9242, 4175; Payload ID: 5620 relates to Category No.: 3964, 3954, 3955, 3964, 3547; Payload ID: 5621 relates to Category No.: 2890, 6717, 2942, 3965; Payload ID: 5622 relates to Category No.: 2890, 6717, 2942, 3965; Payload ID: 5623 relates to Category No.: 2942, 3965; Payload ID: 5624 relates to Category No.: 2890, 6717, 2942, 4010, 3965; Payload ID: 5625 relates to Category No.: 2942, 9734, 3965; Payload ID: 5626 relates to Category No.: 2890, 6717, 2942, 9247, 3991, 1635, 9215, 9305, 3036, 8948, 14145; Payload ID: 5627 relates to Category No.: 2942, 3965; Payload ID: 5628 relates to Category No.: 2890, 2942, 9734, 2903, 4010, 7269, 14190, 2920, 3965, 2417, 11883; Payload ID: 5629 relates to Category No.: 2890, 2942, 9247, 9305, 11883; Payload ID: 5630 relates to Category No.: 2890; Payload ID: 5631 relates to Category No.: 2890, 6717, 3965; Payload ID: 5632 relates to Category No.: 2890, 7269; Payload ID: 5633 relates to Category No.: 2890, 2942, 7269; Payload ID: 5634 relates to Category No.: 2890, 2942, 7269; Payload ID: 5635 relates to Category No.: 9305, 2890, 6717, 5776, 10104, 9215, 2942, 2903; Payload ID: 5636 relates to Category No.: 6717, 2942, 9734, 3965; Payload ID: 5637 relates to Category No.: 2890, 10056, 2942; Payload ID: 5638 relates to Category No.: 9305, 2890, 6717, 2942, 3673, 9199, 4010, 715; Payload ID: 5639 relates to Category No.: 2942, 3673, 9199; Payload ID: 5640 relates to Category No.: 3673, 9199; Payload ID: 5641 relates to Category No.: 2890, 2942; Payload ID: 5642 relates to Category No.: 9305, 2890, 9242, 9247, 4010; Payload ID: 5643 relates to Category No.: 2890, 2942, 15597; Payload ID: 5644 relates to Category No.: 5561, 5776, 10056, 3673, 6440; Payload ID: 5645 relates to Category No.: 5561; Payload ID: 5646 relates to Category No.: 5561; Payload ID: 5647 relates to Category No.: 9305; Payload ID: 5648 relates to Category No.: 9247; Payload ID: 5649 relates to Category No.: 2890; Payload ID: 5650 relates to Category No.: 9305, 2890, 10056, 9242, 9247; Payload ID: 5651 relates to Category No.: 9305, 2890, 9247, 9158, 15269, 9297, 9298, 3844, 15508; Payload ID: 5652 relates to Category No.: 9305, 2890, 9247, 14893, 7181, 2829, 5238, 2693; Payload ID: 5653 relates to Category No.: 9305, 9247, 5238, 2693; Payload ID: 5654 relates to Category No.: 9305, 9247, 2420, 15269, 9158, 15269, 9297, 9298, 3844, 15508; Payload ID: 5655 relates to Category No.: 9305, 9247, 5730, 3393, 5241, 3358, 5238; Payload ID: 5656 relates to Category No.: 9305, 9242, 9247, 15497; Payload ID: 5657 relates to Category No.: 2890, 2194, 10056, 9247, 6717, 2942, 2630; Payload ID: 5658 relates to Category No.: 9305, 7118, 6976; Payload ID: 5659 relates to Category No.: 9305, 9247, 11883, 9181, 9297, 2787; Payload ID: 5660 relates to Category No.: 2890, 6717, 10056, 2942, 3982, 2912; Payload ID: 5661 relates to Category No.: 6717, 5776, 10056, 2942, 3982; Payload ID: 5662 relates to Category No.: 2942, 3982, 14412; Payload ID: 5663 relates to Category No.: 15627, 3982, 14409; Payload ID: 5664 relates to Category No.: 3982, 1842; Payload ID: 5665 relates to Category No.: 3982; Payload ID: 5666 relates to Category No.: 2890, 6717, 10056, 2942, 3982, 6989, 4863, 7367; Payload ID: 5667 relates to Category No.: 2890, 2942; Payload ID: 5668 relates to Category No.: 3982, 10056, 2942; Payload ID: 5669 relates to Category No.: 3982; Payload ID: 5670 relates to Category No.: 6717, 6976, 10056, 2942, 3982, 2182, 4863; Payload ID: 5671 relates to Category No.: 2890, 6717, 10056, 2942, 3982, 4860, 6059; Payload ID: 5672 relates to Category No.: 9305, 9247; Payload ID: 5674 relates to Category No.: 9305, 2890; Payload ID: 5675 relates to Category No.: 9305, 2890; Payload ID: 5676 relates to Category No.: 9305, 2890, 2942, 9247; Payload ID: 5677 relates to Category No.: 3693; Payload ID: 5678 relates to Category No.: 9305, 2890, 9242, 5222; Payload ID: 5679 relates to Category No.: 9305, 2890, 9242, 2942, 9247, 9168, 4003; Payload ID: 5680 relates to Category No.: 9305, 2890, 6717, 5762, 9242, 9247, 9168, 15532, 4003; Payload ID: 5681 relates to Category No.: 9305, 2890, 9242, 2942, 9168, 2897, 4003; Payload ID: 5682 relates to Category No.: 9305, 2890, 9242, 2942, 9168, 2897, 15532, 4003; Payload ID: 5683 relates to Category No.: 9305, 2890, 9242, 2942, 9168, 2897, 15532, 4003; Payload ID: 5684 relates to Category No.: 9305, 2890, 9242, 2942, 9168, 2897, 15532, 4003; Payload ID: 5685 relates to Category No.: 9242, 2942, 9168, 2897, 4003; Payload ID: 5686 relates to Category No.: 9305, 9242, 2942, 9168, 2897, 4003; Payload ID: 5687 relates to Category No.: 9305, 2890, 9242, 2942, 9168, 2897, 4003; Payload ID: 5688 relates to Category No.: 9305, 2890, 9242, 2942, 9247, 9158, 4010, 5730, 9168, 2897, 4003; Payload ID: 5689 relates to Category No.: 5561, 4765, 3673, 3666, 4755, 5557; Payload ID: 5690 relates to Category No.: 5561, 6717, 4765, 3673, 3666, 4755, 4010, 15951; Payload ID: 5691 relates to Category No.: 5561, 3673; Payload ID: 5692 relates to Category No.: 5561, 3673, 3666, 4010; Payload ID: 5693 relates to Category No.: 5561, 3673, 3666; Payload ID: 5694 relates to Category No.: 9305, 2890, 6717, 5776, 9242, 2942, 14145, 9247, 9184, 5964, 9162, 715, 1377, 5762; Payload ID: 5695 relates to Category No.: 2890, 9247, 9199; Payload ID: 5696 relates to Category No.: 9305, 2890, 2942, 9247, 14215; Payload ID: 5697 relates to Category No.: 9305, 2890, 10056, 9242, 9247, 5762; Payload ID: 5698 relates to Category No.: 9305, 2890, 9199, 5762; Payload ID: 5699 relates to Category No.: 2890, 2942, 9247, 9199, 9181; Payload ID: 5700 relates to Category No.: 3666, 9419, 6717, 10056, 5557; Payload ID: 5701 relates to Category No.: 6717, 5570, 4043, 3666, 5815, 9419, 5561; Payload ID: 5702 relates to Category No.: 5570, 4043, 3666, 5815, 9419, 5561; Payload ID: 5703 relates to Category No.: 9305, 2890, 7161, 2194, 2942; Payload ID: 5704 relates to Category No.:

5561, 3036, 4010, 3972; Payload ID: 5705 relates to Category No.: 4030, 5561; Payload ID: 5706 relates to Category No.: 4030, 4029, 12159, 4014, 4010; Payload ID: 5707 relates to Category No.: 5561, 12159, 5749; Payload ID: 5708 relates to Category No.: 9305, 2890, 9247, 11883, 12170; Payload ID: 5709 relates to Category No.: 2890, 2194, 9247, 9305, 7118; Payload ID: 5710 relates to Category No.: 9305, 2890, 2194, 9247, 15505; Payload ID: 5711 relates to Category No.: 9305, 2890; Payload ID: 5712 relates to Category No.: 4010; Payload ID: 5713 relates to Category No.: 4030, 2890, 6717, 2938, 10056, 9242, 2942, 3693, 273, 9734, 1099, 4049, 276, 4199, 4010, 1774, 1772, 14327, 6989, 4228, 1335, 779, 16156, 5392, 6991, 14329, 778, 2712, 10063, 2912, 15241, 5762, 2441, 7366, 16026, 6743, 1711, 15758, 1796, 14387, 911, 6958; Payload ID: 5714 relates to Category No.: 5561, 10056, 1182, 1748, 6968, 1811, 4010, 2926, 14647; Payload ID: 5715 relates to Category No.: 9247, 9305, 7274; Payload ID: 5716 relates to Category No.: 5561, 7118, 7048, 7087; Payload ID: 5717 relates to Category No.: 3671; Payload ID: 5718 relates to Category No.: 5561; Payload ID: 5720 relates to Category No.: 2890, 279; Payload ID: 5721 relates to Category No.: 2890, 273, 279; Payload ID: 5724 relates to Category No.: 9305, 7269; Payload ID: 5729 relates to Category No.: 9305; Payload ID: 5731 relates to Category No.: 12439, 15573, 3521, 2504; Payload ID: 5732 relates to Category No.: 12439, 15573, 3521, 2504; Payload ID: 5733 relates to Category No.: 2890, 6976, 14906; Payload ID: 5734 relates to Category No.: 7118, 2890, 6976; Payload ID: 5735 relates to Category No.: 2890, 6976, 6960, 14906, 9247, 1720; Payload ID: 5737 relates to Category No.: 9305, 2890, 2402; Payload ID: 5739 relates to Category No.: 2890; Payload ID: 5740 relates to Category No.: 1842; Payload ID: 5743 relates to Category No.: 5561; Payload ID: 5744 relates to Category No.: 1377; Payload ID: 5745 relates to Category No.: 2890, 6717, 10056; Payload ID: 5747 relates to Category No.: 9305; Payload ID: 5750 relates to Category No.: 2574; Payload ID: 5754 relates to Category No.: 2890, 10056; Payload ID: 5755 relates to Category No.: 5762; Payload ID: 5759 relates to Category No.: 2890, 6717, 10056, 4010; Payload ID: 5760 relates to Category No.: 9305, 2890, 10056, 9242, 2942, 9247, 273, 447, 4010; Payload ID: 5762 relates to Category No.: 2942; Payload ID: 5763 relates to Category No.: 2942; Payload ID: 5765 relates to Category No.: 4029; Payload ID: 5766 relates to Category No.: 2890, 9247; Payload ID: 5768 relates to Category No.: 4029, 4030; Payload ID: 5769 relates to Category No.: 4029, 4030, 1700; Payload ID: 5772 relates to Category No.: 5561; Payload ID: 5773 relates to Category No.: 2477, 4755, 5557; Payload ID: 5774 relates to Category No.: 5561; Payload ID: 5777 relates to Category No.: 7118, 2890; Payload ID: 5780 relates to Category No.: 4029; Payload ID: 5781 relates to Category No.: 4029; Payload ID: 5782 relates to Category No.: 5561, 6717, 4010; Payload ID: 5787 relates to Category No.: 5561; Payload ID: 5788 relates to Category No.: 5561; Payload ID: 5789 relates to Category No.: 5561, 9162; Payload ID: 5790 relates to Category No.: 5561, 9162; Payload ID: 5791 relates to Category No.: 5561; Payload ID: 5792 relates to Category No.: 5561; Payload ID: 5794 relates to Category No.: 4172; Payload ID: 5797 relates to Category No.: 2890, 2194, 2441, 9998; Payload ID: 5799 relates to Category No.: 5561, 9305, 7118, 2890, 4010; Payload ID: 5800 relates to Category No.: 5561; Payload ID: 5801 relates to Category No.: 5561; Payload ID: 5802 relates to Category No.: 5561; Payload ID: 5803 relates to Category No.: 9305; Payload ID: 5808 relates to Category No.: 5561, 10056, 9734, 1017, 4010; Payload ID: 5809 relates to Category No.: 9176; Payload ID: 5811 relates to Category No.: 9305; Payload ID: 5813 relates to Category No.: 5561, 4010; Payload ID: 5814 relates to Category No.: 5561; Payload ID: 5815 relates to Category No.: 5561; Payload ID: 5816 relates to Category No.: 4029, 3666; Payload ID: 5817 relates to Category No.: 5561; Payload ID: 5818 relates to Category No.: 5561; Payload ID: 5819 relates to Category No.: 5561; Payload ID: 5820 relates to Category No.: 5561; Payload ID: 5821 relates to Category No.: 9305, 9247, 1323; Payload ID: 5822 relates to Category No.: 1328, 2890, 9305; Payload ID: 5828 relates to Category No.: 4029; Payload ID: 5829 relates to Category No.: 5561; Payload ID: 5834 relates to Category No.: 4030; Payload ID: 5836 relates to Category No.: 2890; Payload ID: 5838 relates to Category No.: 11883; Payload ID: 5839 relates to Category No.: 5561; Payload ID: 5840 relates to Category No.: 5561; Payload ID: 5841 relates to Category No.: 9247, 9184; Payload ID: 5843 relates to Category No.: 5561; Payload ID: 5844 relates to Category No.: 5561, 1842; Payload ID: 5845 relates to Category No.: 5561; Payload ID: 5846 relates to Category No.: 4029, 3666; Payload ID: 5847 relates to Category No.: 2890; Payload ID: 5848 relates to Category No.: 4029; Payload ID: 5849 relates to Category No.: 4029; Payload ID: 5850 relates to Category No.: 5561, 4029; Payload ID: 5851 relates to Category No.: 9305; Payload ID: 5853 relates to Category No.: 9305, 2890, 9242, 9247; Payload ID: 5855 relates to Category No.: 9305; Payload ID: 5858 relates to Category No.: 4029; Payload ID: 5859 relates to Category No.: 5561, 4765, 4755; Payload ID: 5861 relates to Category No.: 1700, 3666, 4755, 4010; Payload ID: 5862 relates to Category No.: 5561, 4765, 9247, 4755; Payload ID: 5863 relates to Category No.: 4030, 4755, 4010; Payload ID: 5864 relates to Category No.: 5561; Payload ID: 5867 relates to Category No.: 5561, 9305; Payload ID: 5868 relates to Category No.: 5561; Payload ID: 5869 relates to Category No.: 9215, 9305, 3036; Payload ID: 5871 relates to Category No.: 9305, 2420; Payload ID: 5872 relates to Category No.: 9305, 2890, 9247; Payload ID: 5873 relates to Category No.: 5561, 9305, 4010; Payload ID: 5874 relates to Category No.: 5561, 9305; Payload ID: 5875 relates to Category No.: 16269, 10056, 3521, 3523; Payload ID: 5876 relates to Category No.: 10056, 3693, 16269, 3521, 14100, 3523; Payload ID: 5877 relates to Category No.: 5561, 7118; Payload ID: 5878 relates to Category No.: 5561; Payload ID: 5879 relates to Category No.: 4010; Payload ID: 5881 relates to Category No.: 2890, 4010, 7118; Payload ID: 5882 relates to Category No.: 2890, 2942, 3666, 4010, 7366; Payload ID: 5884 relates to Category No.: 9305; Payload ID: 5892 relates to Category No.: 9305; Payload ID: 5896 relates to Category No.: 9247; Payload ID: 5908 relates to Category No.: 5561, 4010, 1792; Payload ID: 5909 relates to Category No.: 5561; Payload ID: 5910 relates to Category No.: 4029; Payload ID: 5911 relates to Category No.: 4029; Payload ID: 5915 relates to Category No.: 5570; Payload ID: 5916 relates to Category No.: 5570, 4010; Payload ID: 5917 relates to Category No.: 5570; Payload ID: 5918 relates to Category No.: 4029, 1842, 5561; Payload ID: 5919 relates to Category No.: 4030, 4029, 1700, 4010; Payload ID: 5920 relates to Category No.: 4029, 2899, 4755, 4010; Payload ID: 5921 relates to Category No.: 4029, 5561; Payload ID: 5922 relates to Category No.: 9305, 7118, 5776, 9242, 9247; Payload ID: 5935 relates to Category No.: 5762; Payload ID: 5936 relates to Category No.: 4010, 2458; Payload ID: 5937 relates to Category No.: 9305, 9247; Payload ID: 5938 relates to Category No.: 9305; Payload ID: 5939 relates to Category No.: 9305; Payload ID: 5940 relates to Category No.: 1842; Payload ID: 5942 relates to Category No.: 5561, 10056; Payload ID: 5943 relates to Category No.: 5561, 4765, 3673, 3666, 4755; Payload ID: 5944 relates to Category No.: 9305, 2831; Payload ID: 5945 relates to Category No.: 14583; Payload ID: 5946 relates to Category No.: 9305, 9247, 4010; Payload ID: 5947 relates to Category No.: 9247, 1842; Payload ID: 5948 relates to Category No.: 9305, 2890, 9242; Payload ID: 5949 relates to Category No.: 2890, 4010; Payload ID: 5950 relates to Category No.: 7118, 2890, 2938, 4199, 14956, 779; Payload ID: 5952 relates to Category No.: 5561, 3673; Payload ID: 5953 relates to Category No.: 5561, 3673; Payload ID: 5954 relates to Category No.: 5561, 3673; Payload ID: 5955 relates to Category No.: 9305; Payload ID: 5956 relates to Category No.: 9305; Payload ID: 5957 relates to Category No.: 9305; Payload ID: 5958 relates to Category No.: 2890, 9247; Payload ID: 5959 relates to Category No.: 9305; Payload ID: 5960 relates to Category No.: 9305; Payload ID: 5961 relates to Category No.: 9305; Payload ID: 5962 relates to Category No.: 9305; Payload ID: 5963 relates to Category No.: 7118; Payload ID: 5967 relates to Category No.: 5561; Payload ID: 5968 relates to Category No.: 5561; Payload ID: 5969 relates to Category No.: 2890; Payload ID: 5970 relates to Category No.: 9305, 2890, 9247, 9184, 9215, 5561; Payload ID: 5973 relates to Category No.: 5561; Payload ID: 5975 relates to Category No.: 9305; Payload ID: 5977 relates to Category No.: 2890, 6717; Payload ID: 5979 relates to Category No.: 2890, 7170; Payload ID: 5982 relates to Category No.: 9305, 2942; Payload ID: 5983 relates to Category No.: 5934; Payload ID: 5985 relates to Category No.: 2890, 10056; Payload ID: 5990 relates to Category No.: 2890, 1792; Payload ID: 5991 relates to Category No.: 9305, 9242; Payload ID: 5992 relates to Category No.: 9305, 9247; Payload ID: 5993 relates to Category No.: 9305, 5561; Payload ID: 5999 relates to Category No.: 2890, 9247, 1842; Payload ID: 6000 relates to Category No.: 9305, 2890, 9247, 14893, 7181, 2440; Payload ID: 6001 relates to Category No.: 15732; Payload ID: 6002 relates to Category No.: 9305, 2890, 9247, 15732; Payload ID: 6003 relates to Category No.: 15732; Payload ID: 6005 relates to Category No.: 9305, 2890, 9247, 5597; Payload ID: 6006 relates to Category No.: 2890, 9247, 5730, 4081; Payload ID: 6007 relates to Category No.: 9247, 1748, 2420, 4081; Payload ID: 6008 relates to Category No.: 4081, 5776, 9247; Payload ID: 6009 relates to Category No.: 9305, 2890, 9242, 9247, 4081; Payload ID: 6010 relates to Category No.: 9247, 4081; Payload ID: 6011 relates to Category No.: 9305, 2890, 2942, 9247, 4081, 2402; Payload ID: 6012 relates to Category No.: 5776, 9247, 4755, 9305, 2628; Payload ID: 6013 relates to Category No.: 9305, 9247, 4081; Payload ID: 6014 relates to Category No.: 9247, 4081; Payload ID: 6015 relates to Category No.: 7118, 2890, 10056, 9242, 9247, 4081; Payload ID: 6016 relates to Category No.: 9305, 2890, 6717, 10056, 9247; Payload ID: 6017 relates to Category No.: 4081, 2890, 9247, 9162; Payload ID: 6018 relates to Category No.: 9247, 4081, 4080; Payload ID: 6019 relates to Category No.: 9305, 9247; Payload ID: 6020 relates to Category No.: 9305, 2890, 6717; Payload ID: 6021 relates to Category No.: 2890, 2942, 9247, 7118, 5561; Payload ID: 6022 relates to Category No.: 3666, 5561, 3673, 5776; Payload ID: 6023 relates to Category No.: 2890, 2942, 6964, 11925, 1368; Payload ID: 6024 relates to Category No.: 2942, 6964, 11925, 11883; Payload ID: 6025 relates to Category No.: 9305, 2942, 9734, 16111, 1688, 2890, 9162, 5561; Payload ID: 6026 relates to Category No.: 2194, 5934, 2942, 14906, 2183, 777, 2456; Payload ID: 6027 relates to Category No.: 2890, 10056, 2942, 3008, 14187, 1688, 11883, 6743, 8935, 1711; Payload ID: 6028 relates to Category No.: 2890; Payload ID: 6029 relates to Category No.: 5561, 1748, 11653, 6743; Payload ID: 6030 relates to Category No.: 5776, 3666, 6222, 16111; Payload ID: 6031 relates to Category No.: 9305, 2890, 10056, 2942, 8935, 5570, 4010, 1792, 6743, 3008, 1688, 4008, 4029, 4030, 8948, 9734, 779, 14363, 14409, 775, 6717; Payload ID: 6032 relates to Category No.: 4030, 4029, 9305, 6717, 10056, 5570, 4010, 6437, 2900, 4008, 1792, 1659, 6743, 2899, 9734; Payload ID: 6033 relates to Category No.: 7118; Payload ID: 6034 relates to Category No.: 2890, 6960, 10056, 4755, 6968, 2194, 7118, 3036, 1017, 1774; Payload ID: 6036 relates to Category No.: 2890, 2938, 2942, 273, 1811, 6017, 4199, 4860, 4010, 10106, 14327, 6989, 5829, 14999, 1777, 6958, 7366; Payload ID: 6037 relates to Category No.: 2890, 14953, 273; Payload ID: 6038 relates to Category No.: 2938, 273, 2890; Payload ID: 6039 relates to Category No.: 7118; Payload ID: 6040 relates to Category No.: 7118, 7068, 14150; Payload ID: 6041 relates to Category No.: 7118; Payload ID: 6042 relates to Category No.: 7118, 7068, 14150; Payload ID: 6043 relates to Category No.: 9305, 6717, 10056, 5570, 9734, 1811, 4010, 4228, 6017, 4199, 1748, 5561; Payload ID: 6044 relates to Category No.: 5561, 6717, 10056, 9305, 1803, 4010; Payload ID: 6045 relates to Category No.: 5561, 6717, 10056, 3036; Payload ID: 6046 relates to Category No.: 5561, 6717, 10056, 4010, 5762, 778; Payload ID: 6047 relates to Category No.: 9305, 9215, 5561; Payload ID: 6048 relates to Category No.: 3673, 5557; Payload ID: 6049 relates to Category No.: 3673, 5557, 7118; Payload ID: 6050 relates to Category No.: 6717, 10056; Payload ID: 6051 relates to Category No.: 5561, 3673, 3666; Payload ID: 6052 relates to Category No.: 5561, 2938, 3673, 9418; Payload ID: 6053 relates to Category No.: 5561, 6222; Payload ID: 6054 relates to Category No.: 2942, 9247, 4010, 9753, 2890, 9305, 774; Payload ID: 6055 relates to Category No.: 2942; Payload ID: 6056 relates to Category No.: 2942, 5762; Payload ID: 6057 relates to Category No.: 4030, 2942, 4010, 2890, 14367; Payload ID: 6058 relates to Category No.: 9305, 2890, 2942, 6222, 4010; Payload ID: 6059 relates to Category No.: 2890, 2942, 9247, 4010; Payload ID: 6060 relates to Category No.: 2890, 2942; Payload ID: 6061 relates to Category No.: 2942, 1811, 1772, 8948, 1774, 1711, 9305, 2890; Payload ID: 6062 relates to Category No.: 2942, 262; Payload ID: 6063 relates to Category No.: 5561, 9305, 5776, 7118, 6717, 3673; Payload ID: 6064 relates to Category No.: 5561, 6717, 3673, 5570; Payload ID: 6065 relates to Category No.: 5561, 6717, 3673; Payload ID: 6066 relates to Category No.: 5561; Payload ID: 6067 relates to Category No.: 5561; Payload ID: 6068 relates to Category No.: 2890, 6717, 10056, 2942, 4755, 4010, 6709, 7118, 4689; Payload ID: 6069 relates to Category No.: 5561, 9756, 9754, 9753; Payload ID: 6070 relates to Category No.: 9756, 5561, 3673, 9754, 9753; Payload ID: 6071 relates to Category No.: 9305, 2942, 3666, 9247, 15505, 6717, 8935; Payload ID: 6072 relates to Category No.: 9305; Payload ID: 6073 relates to Category No.: 2890, 14382, 15892; Payload ID: 6074 relates to Category No.: 2890, 14382; Payload ID: 6075 relates to Category No.: 2890, 9247, 4755, 14382; Payload ID: 6076 relates to Category No.: 2890, 14382; Payload ID: 6077 relates to Category No.: 2890, 14382; Payload ID: 6078 relates to Category No.: 2890, 14382; Payload ID: 6079 relates to Category No.: 2890, 14382; Payload ID: 6080 relates to Category No.: 2890, 14382; Payload ID: 6081 relates to Category No.: 2890, 6717, 14382; Payload ID: 6082 relates to Category No.: 2890, 14382; Payload ID: 6083 relates to Category No.: 2890, 14382, 16326; Payload ID: 6084 relates to Category No.: 9305, 2890, 2942, 15892, 9247, 14382; Payload ID: 6085 relates to Category No.: 15892, 9247, 14382, 7052; Payload ID: 6086 relates to Category No.: 15892, 9734, 14382; Payload ID: 6087 relates to Category No.: 2890, 14382; Payload ID: 6088 relates to Category No.: 2890, 2194, 15892, 14382; Payload ID: 6091 relates to Category No.: 9305, 2194, 2942, 15892, 14382, 2890; Payload ID: 6093 relates to Category No.: 2890; Payload ID: 6094 relates to Category No.: 15892; Payload ID: 6095 relates to Category No.: 2890, 14382, 2789; Payload ID: 6096 relates to Category No.: 2890, 9242, 9247, 14382, 11883, 9589, 4755, 3666; Payload ID: 6097 relates to Category No.: 2890, 4755, 9734, 2791, 117, 14382; Payload ID: 6099 relates to Category No.: 2890, 15892; Payload ID: 6100 relates to Category No.: 9305, 2890, 9242, 15892, 2420; Payload ID: 6101 relates to Category No.: 14382; Payload ID: 6103 relates to Category No.: 14382; Payload ID: 6104 relates to Category No.: 2942, 3666, 14382, 4010, 9418, 3055; Payload ID: 6105 relates to Category No.: 15892; Payload ID: 6106 relates to Category No.: 16326, 2890, 9305; Payload ID: 6107 relates to Category No.: 15892; Payload ID: 6108 relates to Category No.: 9305, 15892, 14382; Payload ID: 6109 relates to Category No.: 14382; Payload ID: 6111 relates to Category No.: 2890, 9247; Payload ID: 6113 relates to Category No.: 8948, 14382; Payload ID: 6114 relates to Category No.: 9242, 16326; Payload ID: 6116 relates to Category No.: 2890, 9247; Payload ID: 6118 relates to Category No.: 9305, 2890; Payload ID: 6119 relates to Category No.: 14382; Payload ID: 6120 relates to Category No.: 2890, 15892, 14382; Payload ID: 6121 relates to Category No.: 2890; Payload ID: 6124 relates to Category No.: 9305; Payload ID: 6125 relates to Category No.: 14382; Payload ID: 6126 relates to Category No.: 1748, 11653, 11723, 15139, 11650; Payload ID: 6130 relates to Category No.: 9305, 2890, 2942, 9247, 14893; Payload ID: 6131 relates to Category No.: 2890, 14382, 3678; Payload ID: 6132 relates to Category No.: 9305, 7118, 2890, 2942, 15892, 11883; Payload ID: 6133 relates to Category No.: 15892, 15573; Payload ID: 6134 relates to Category No.: 2890, 15892, 14382; Payload ID: 6135 relates to Category No.: 9305, 2402, 14382; Payload ID: 6137 relates to Category No.: 4029, 10056, 5570; Payload ID: 6138 relates to Category No.: 10056, 1792, 5570, 4008, 5762, 5561; Payload ID: 6139 relates to Category No.: 5561, 6717, 10056, 4008, 1792, 4126, 5570; Payload ID: 6140 relates to Category No.: 10056, 5570, 4010, 4008, 5561; Payload ID: 6142 relates to Category No.: 5561, 10056, 3523, 2503; Payload ID: 6143 relates to Category No.: 5561, 10056, 3523, 2503; Payload ID: 6144 relates to Category No.: 5561, 10056, 4010; Payload ID: 6145 relates to Category No.: 5561, 10056; Payload ID: 6146 relates to Category No.: 5561; Payload ID: 6147 relates to Category No.: 5561, 10056, 4008, 4010; Payload ID: 6148 relates to Category No.: 10056, 677, 4010, 5561; Payload ID: 6149 relates to Category No.: 5561, 10056; Payload ID: 6150 relates to Category No.: 5561, 4029; Payload ID: 6151 relates to Category No.: 5561, 10056; Payload ID: 6152 relates to Category No.: 5561, 10056; Payload ID: 6153 relates to Category No.: 5561, 10056; Payload ID: 6154 relates to Category No.: 5561, 10056; Payload ID: 6155 relates to Category No.: 5561, 10056, 4010; Payload ID: 6156 relates to Category No.: 5561, 10056, 12406; Payload ID: 6157 relates to Category No.: 5561, 4008; Payload ID: 6158 relates to Category No.: 4029, 2890; Payload ID: 6159 relates to Category No.: 2890, 3666; Payload ID: 6160 relates to Category No.: 9242, 14671; Payload ID: 6163 relates to Category No.: 10056, 2534, 2504; Payload ID: 6164 relates to Category No.: 10056, 2534, 2504; Payload ID: 6165 relates to Category No.: 5561, 7118, 10056, 5570, 7061; Payload ID: 6166 relates to Category No.: 5561, 10056; Payload ID: 6167 relates to Category No.: 2890; Payload ID: 6168 relates to Category No.: 9305, 2890, 9247; Payload ID: 6169 relates to Category No.: 2890; Payload ID: 6170 relates to Category No.: 9305, 2890, 2942, 4043, 273, 1748, 1720, 6968, 9157, 6017; Payload ID: 6171 relates to Category No.: 5561, 10056; Payload ID: 6172 relates to Category No.: 5561; Payload ID: 6173 relates to Category No.: 9305; Payload ID: 6174 relates to Category No.: 2938, 10056, 2942, 4010; Payload ID: 6175 relates to Category No.: 2890, 2938, 1182, 1099; Payload ID: 6176 relates to Category No.: 2938; Payload ID: 6177 relates to Category No.: 2938, 3055; Payload ID: 6178 relates to Category No.: 2938; Payload ID: 6179 relates to Category No.: 5561, 2890, 2938, 4049; Payload ID: 6180 relates to Category No.: 2890, 2938, 1182; Payload ID: 6181 relates to Category No.: 4030, 2938, 2890, 14327; Payload ID: 6182 relates to Category No.: 5561, 2890, 2938, 4049, 1842; Payload ID: 6183 relates to Category No.: 2890, 2938, 10056, 777; Payload ID: 6184 relates to Category No.: 2938, 4030, 8935, 8948, 4860; Payload ID: 6185 relates to Category No.: 2938; Payload ID: 6186 relates to Category No.: 2890, 2938, 2942, 4043, 1748, 3036, 4199, 3055, 4049; Payload ID: 6187 relates to Category No.: 2890, 2938, 2942, 4049; Payload ID: 6188 relates to Category No.: 2942, 1748, 4228, 14329, 4197; Payload ID: 6189 relates to Category No.: 9305, 2890, 2942, 4043, 9247, 1720, 1792, 4228, 5342, 6019, 2938, 14999, 4197; Payload ID: 6190 relates to Category No.: 6717, 1748, 4010, 1774, 10106; Payload ID: 6191 relates to Category No.: 7118, 7060; Payload ID: 6192 relates to Category No.: 7060; Payload ID: 6193 relates to Category No.: 2890, 7060, 7118, 7048; Payload ID: 6194 relates to Category No.: 2890; Payload ID: 6195 relates to Category No.: 5561; Payload ID: 6196 relates to Category No.: 5561, 10056, 15139, 1748, 1842; Payload ID: 6197 relates to Category No.: 9305, 7118; Payload ID: 6198 relates to Category No.: 1700, 9305, 2942, 4010, 5774, 7118, 5561; Payload ID: 6199 relates to Category No.: 1700; Payload ID: 6200 relates to Category No.: 6717, 2942, 4010, 5774, 1700; Payload ID: 6201 relates to Category No.: 7118, 7048, 7060; Payload ID: 6202 relates to Category No.: 2890, 2942, 4043, 2899, 4755, 6968, 2926, 4228, 5561; Payload ID: 6203 relates to Category No.: 5561, 3666; Payload ID: 6204 relates to Category No.: 4030, 4010; Payload ID: 6205 relates to Category No.: 9305; Payload ID: 6206 relates to Category No.: 9305; Payload ID: 6207 relates to Category No.: 9305; Payload ID: 6208 relates to Category No.: 9305, 6976, 2194, 2942, 9734; Payload ID: 6209 relates to Category No.: 2942, 2890; Payload ID: 6210 relates to Category No.: 9305, 6976, 2194, 7244, 2441, 2182; Payload ID: 6211 relates to Category No.: 2890, 1842; Payload ID: 6212 relates to Category No.: 2938, 7048, 10056, 2942, 4043, 273, 4010, 7052, 14329; Payload ID: 6214 relates to Category No.: 14671, 1286, 9305, 6717, 9242, 4010, 1377; Payload ID: 6215 relates to Category No.: 9242, 14145; Payload ID: 6216 relates to Category No.: 4030, 4029, 12159, 4014, 4010, 1090, 6948; Payload ID: 6217 relates to Category No.: 4029, 12159, 4014, 6948; Payload ID: 6218 relates to Category No.: 12159, 4014; Payload ID: 6219 relates to Category No.: 4030, 4029, 10056, 4179, 4008, 1239, 4010, 1792, 10076, 10077, 4032, 1720, 2890, 14293; Payload ID: 6220 relates to Category No.: 4030, 4029, 10056, 4179, 4008, 1239, 4010, 1792, 10076, 10077, 4032, 1720, 2890; Payload ID: 6221 relates to Category No.: 5561, 6717; Payload ID: 6222 relates to Category No.: 4030, 4029, 10056, 4179, 4008, 1239, 4010, 1792, 10076, 10077, 1720, 2890; Payload ID: 6223 relates to Category No.: 9305; Payload ID: 6224 relates to Category No.: 4179, 4010; Payload ID: 6225 relates to Category No.: 4179, 4010; Payload ID: 6226 relates to Category No.: 4030, 5561, 2890, 10056, 6017, 1792, 4228, 14329, 6019, 5830, 778, 1084; Payload ID: 6227 relates to Category No.: 9305, 7118, 6717, 9247, 3652, 4010; Payload ID: 6228 relates to Category No.: 4030, 4029, 2942, 9247, 1720, 12159, 9305, 2890, 9242; Payload ID: 6229 relates to Category No.: 4030, 4029, 9305, 10056, 4014, 1792; Payload ID: 6230 relates to Category No.: 4029; Payload ID: 6231 relates to Category No.: 4030, 9305, 5762; Payload ID: 6232 relates to Category No.: 4029, 9305, 2890, 6960, 10056, 9242, 8935, 3036, 4199, 1017, 4860, 5596, 2942; Payload ID: 6233 relates to Category No.: 4029, 9305, 5762, 2942; Payload ID: 6234 relates to Category No.: 4030, 4029, 5762; Payload ID: 6235 relates to Category No.: 4030, 4029, 5762; Payload ID: 6236 relates to Category No.: 4030, 4029, 9242; Payload ID: 6237 relates to Category No.: 4029, 5762; Payload ID: 6238 relates to Category No.: 4030, 9305, 2890, 4029; Payload ID: 6239 relates to Category No.: 4029, 5762; Payload ID: 6240 relates to Category No.: 4029, 4030; Payload ID: 6241 relates to Category No.: 4029, 4030, 1792, 9242, 4755; Payload ID: 6242 relates to Category No.: 4030, 4029, 5762, 1700; Payload ID: 6243 relates to Category No.: 4029, 2890, 4755; Payload ID: 6244 relates to Category No.: 4029, 5762; Payload ID: 6245 relates to Category No.: 4030, 4029, 5762; Payload ID: 6246 relates to Category No.: 4029, 4030, 5762, 14363; Payload ID: 6247 relates to Category No.: 4029, 4755, 4030; Payload ID: 6248 relates to Category No.: 4030, 4029, 5762, 4008; Payload ID: 6249 relates to Category No.: 4030, 4029, 4010, 2890, 1090; Payload ID: 6250 relates to Category No.: 4030, 4029, 10056, 1792; Payload ID: 6251 relates to Category No.: 4030; Payload ID: 6252 relates to Category No.: 4029, 4014; Payload ID: 6253 relates to Category No.: 5561, 4029, 9305, 10056, 2942, 5570, 2899, 12406; Payload ID: 6254 relates to Category No.: 5561, 4029, 9305, 2890, 6717, 5776, 10056, 4014, 5570, 9247, 2899, 4755, 1720, 1792, 3972; Payload ID: 6255 relates to Category No.: 5561, 4029, 10056, 5570, 3666, 15627, 4755, 4228, 9734, 6443, 2918, 9305, 2890, 1792; Payload ID: 6256 relates to Category No.: 5561, 4029, 2890, 10056, 5570, 3693, 3666, 9247, 15627, 4755, 1811; Payload ID: 6257 relates to Category No.: 6717, 10056, 5570, 3693, 2890, 1811; Payload ID: 6258 relates to Category No.: 5762, 10056; Payload ID: 6259 relates to Category No.: 5561, 10056, 15627, 4755, 1810; Payload ID: 6260 relates to Category No.: 4030, 4029, 12159, 4014, 4763, 6437; Payload ID: 6261 relates to Category No.: 4030, 4029, 4014, 4179, 1239, 4010, 10077, 3685, 1090, 779, 1083; Payload ID: 6262 relates to Category No.: 12159, 3673, 5570, 9734, 2927, 1811, 2926, 4228, 8942, 8949, 4030; Payload ID: 6263 relates to Category No.: 12159, 3673, 8935, 5570, 15139, 1811, 4010, 4228, 4030; Payload ID: 6264 relates to Category No.: 12159, 3673, 5570, 1036, 4228, 1033, 15147, 1811, 4030; Payload ID: 6265 relates to Category No.: 9247, 2890; Payload ID: 6266 relates to Category No.: 9305, 2890, 5762, 6976, 6960, 2514; Payload ID: 6267 relates to Category No.: 5561, 5762, 1842; Payload ID: 6269 relates to Category No.: 4029, 9247; Payload ID: 6270 relates to Category No.: 5561, 6717, 4765, 4755, 2926, 2942, 262, 16164; Payload ID: 6271 relates to Category No.: 5561; Payload ID: 6272 relates to Category No.: 5561, 10056, 3666; Payload ID: 6273 relates to Category No.: 5561, 4029, 3666, 10056, 9754; Payload ID: 6274 relates to Category No.: 4029; Payload ID: 6275 relates to Category No.: 9305; Payload ID: 6276 relates to Category No.: 5561; Payload ID: 6279 relates to Category No.: 7244; Payload ID: 6281 relates to Category No.: 7118; Payload ID: 6282 relates to Category No.: 4029, 12159, 4030, 4014, 4179, 4010, 3549, 1090; Payload ID: 6283 relates to Category No.: 4029, 12159, 4014, 4010, 4032; Payload ID: 6284 relates to Category No.: 4030, 4029, 12159, 4014, 4010, 3549; Payload ID: 6285 relates to Category No.: 12159, 4010, 4228; Payload ID: 6286 relates to Category No.: 5561; Payload ID: 6287 relates to Category No.: 4029, 2574, 1239, 4010; Payload ID: 6288 relates to Category No.: 4029, 2574, 4046; Payload ID: 6289 relates to Category No.: 4029, 2574, 1239; Payload ID: 6290 relates to Category No.: 2890, 6976, 6960, 9181; Payload ID: 6291 relates to Category No.: 9305, 2890, 9158, 4010; Payload ID: 6292 relates to Category No.: 4765, 3696, 6060, 3523, 4755, 3666, 12439, 5561; Payload ID: 6293 relates to Category No.: 9305, 5727, 5942; Payload ID: 6294 relates to Category No.: 9305, 2890, 4010; Payload ID: 6295 relates to Category No.: 2890, 2938; Payload ID: 6296 relates to Category No.: 9305, 2890, 6717; Payload ID: 6297 relates to Category No.: 4029, 9305, 2890, 6717, 10056, 9242, 2942, 273, 4010, 4228, 7361, 15573, 279, 11883, 8948, 3054, 9734, 276, 2712, 775; Payload ID: 6298 relates to Category No.: 5561, 2890, 10056, 2942, 273, 1720, 4010, 4228, 16326, 14999, 1335; Payload ID: 6299 relates to Category No.: 2942, 1720, 4228, 14999; Payload ID: 6300 relates to Category No.: 2890, 2938, 10056, 2942, 14363, 4228, 16326, 2738, 14367; Payload ID: 6301 relates to Category No.: 4029, 3666, 4755; Payload ID: 6302 relates to Category No.: 4030, 14668, 14174, 5762, 2950, 2942, 1842; Payload ID: 6303 relates to Category No.: 7118, 6717, 5569, 2942, 3666, 9756, 11883, 5564; Payload ID: 6304 relates to Category No.: 2942, 668, 9247, 9184; Payload ID: 6305 relates to Category No.: 2890, 3673, 3671; Payload ID: 6306 relates to Category No.: 5561, 2890, 3673, 6717; Payload ID: 6307 relates to Category No.: 2890, 3673, 3671; Payload ID: 6308 relates to Category No.: 6717, 3521, 1017, 276, 4860; Payload ID: 6309 relates to Category No.: 2890, 6717, 2942, 3673, 4014, 4010, 16326, 15282, 14371, 5776, 1033, 5561; Payload ID: 6310 relates to Category No.: 2890, 6717, 2942, 14371, 16326, 1402, 14368, 5776; Payload ID: 6311 relates to Category No.: 2890, 3673; Payload ID: 6312 relates to Category No.: 2890, 3673, 3666, 4010; Payload ID: 6313 relates to Category No.: 9305, 2890, 3673; Payload ID: 6314 relates to Category No.: 7118, 2890, 6960, 2942, 3673, 9247, 1036, 4010, 9305, 11883, 8935, 8948, 9734; Payload ID: 6315 relates to Category No.: 2890, 6717, 3673, 9247, 4010; Payload ID: 6316 relates to Category No.: 2890, 2942, 3673, 15173; Payload ID: 6317 relates to Category No.: 2890, 3673, 3671, 3666; Payload ID: 6318 relates to Category No.: 2890, 6717, 3673, 7061, 7118, 5557, 7041, 5561; Payload ID: 6319 relates to Category No.: 2890, 3673, 3666; Payload ID: 6320 relates to Category No.: 2890, 3673; Payload ID: 6321 relates to Category No.: 9305, 7118, 6717, 10056, 9242, 9247, 11883, 9158, 15269; Payload ID: 6322 relates to Category No.: 2890, 10056, 2942, 7060; Payload ID: 6323 relates to Category No.: 5561, 3673, 3671, 5776; Payload ID: 6324 relates to Category No.: 5561, 6717, 3673; Payload ID: 6325 relates to Category No.: 5561, 5776, 3673; Payload ID: 6326 relates to Category No.: 5561, 3673; Payload ID: 6327 relates to Category No.: 5561, 3673; Payload ID: 6328 relates to Category No.: 9305; Payload ID: 6329 relates to Category No.: 2890, 6976, 9247, 4228, 1335; Payload ID: 6330 relates to Category No.: 5561, 6717, 6976, 10056, 3693, 1099, 2660, 3521, 1803, 6017, 4010, 2926, 6743, 4228, 6709, 6440, 1659, 2710, 16026, 2182, 4220, 1810; Payload ID: 6331 relates to Category No.: 6717, 10056, 3693, 9734, 1099, 1803, 3636, 6017, 4010, 2926, 4228, 1659, 16156, 2710, 16026, 4220, 1810, 6743, 261;

Payload ID: 6332 relates to Category No.: 9305, 2890; Payload ID: 6333 relates to Category No.: 1842; Payload ID: 6334 relates to Category No.: 2890, 9247; Payload ID: 6336 relates to Category No.: 4030, 6717, 10056, 5570, 3693, 4228, 12406; Payload ID: 6337 relates to Category No.: 6717, 5570, 3671, 4008, 1792, 9305, 2890, 2942, 10056, 11883, 5561; Payload ID: 6338 relates to Category No.: 6717, 5561, 1792, 4030, 5817; Payload ID: 6339 relates to Category No.: 4029, 9305, 2890, 6717, 10056, 5570, 12406; Payload ID: 6340 relates to Category No.: 16269, 3521; Payload ID: 6342 relates to Category No.: 5561, 4228; Payload ID: 6343 relates to Category No.: 2890, 6717, 10056, 4010, 1792, 5570, 5561; Payload ID: 6344 relates to Category No.: 9305, 6717, 10056, 4765, 3673, 5570, 3693, 1099, 4010, 1792, 676, 779, 2504, 3832, 3686, 1336, 678, 1335; Payload ID: 6345 relates to Category No.: 4029, 6717, 1792, 676; Payload ID: 6346 relates to Category No.: 4029, 6717, 4049; Payload ID: 6347 relates to Category No.: 5561, 5570, 1792, 3693, 10056; Payload ID: 6348 relates to Category No.: 4029, 2890, 4010; Payload ID: 6349 relates to Category No.: 4029; Payload ID: 6350 relates to Category No.: 6443, 9305, 2890, 10056, 6994, 11728, 1810; Payload ID: 6351 relates to Category No.: 2890; Payload ID: 6352 relates to Category No.: 2890, 6976, 10056, 9247; Payload ID: 6353 relates to Category No.: 9305, 15505; Payload ID: 6354 relates to Category No.: 4029; Payload ID: 6355 relates to Category No.: 4030, 4029, 4010; Payload ID: 6356 relates to Category No.: 4030, 4029, 9305, 9247, 4755, 8942, 14409; Payload ID: 6357 relates to Category No.: 4029; Payload ID: 6358 relates to Category No.: 4029; Payload ID: 6359 relates to Category No.: 7118, 2890, 7048, 2942, 7060; Payload ID: 6360 relates to Category No.: 9305, 9242, 6989; Payload ID: 6361 relates to Category No.: 9305, 2890; Payload ID: 6362 relates to Category No.: 9305; Payload ID: 6363 relates to Category No.: 9305; Payload ID: 6364 relates to Category No.: 9305; Payload ID: 6365 relates to Category No.: 9305, 2890, 9247, 9172; Payload ID: 6366 relates to Category No.: 9305; Payload ID: 6367 relates to Category No.: 9305; Payload ID: 6368 relates to Category No.: 9305; Payload ID: 6369 relates to Category No.: 9305, 9247, 9157; Payload ID: 6370 relates to Category No.: 9305; Payload ID: 6371 relates to Category No.: 9305; Payload ID: 6372 relates to Category No.: 9305; Payload ID: 6373 relates to Category No.: 9305; Payload ID: 6374 relates to Category No.: 9305; Payload ID: 6375 relates to Category No.: 9305; Payload ID: 6376 relates to Category No.: 9305; Payload ID: 6377 relates to Category No.: 9305, 15505; Payload ID: 6378 relates to Category No.: 9305, 15505; Payload ID: 6379 relates to Category No.: 9305, 15505; Payload ID: 6380 relates to Category No.: 9305; Payload ID: 6381 relates to Category No.: 9305, 15505, 9247, 9157, 373; Payload ID: 6382 relates to Category No.: 9305; Payload ID: 6383 relates to Category No.: 9305; Payload ID: 6384 relates to Category No.: 9305; Payload ID: 6385 relates to Category No.: 9305; Payload ID: 6386 relates to Category No.: 9305, 9242; Payload ID: 6387 relates to Category No.: 9305; Payload ID: 6388 relates to Category No.: 9305, 9242, 9247; Payload ID: 6389 relates to Category No.: 9305, 5776, 9247; Payload ID: 6390 relates to Category No.: 9305; Payload ID: 6391 relates to Category No.: 9305; Payload ID: 6392 relates to Category No.: 9305, 2890, 9247; Payload ID: 6393 relates to Category No.: 9305; Payload ID: 6394 relates to Category No.: 9305, 5776, 9247; Payload ID: 6395 relates to Category No.: 9305; Payload ID: 6396 relates to Category No.: 9305; Payload ID: 6397 relates to Category No.: 9305, 7118, 2890, 2942, 9247; Payload ID: 6398 relates to Category No.: 9305, 2890, 2942, 9247, 6717; Payload ID: 6399 relates to Category No.: 9305, 2890, 2942, 9247; Payload ID: 6400 relates to Category No.: 9305, 2890; Payload ID: 6401 relates to Category No.: 9305, 9247; Payload ID: 6402 relates to Category No.: 9305; Payload ID: 6403 relates to Category No.: 9305, 2890, 11883, 5762; Payload ID: 6404 relates to Category No.: 9305; Payload ID: 6405 relates to Category No.: 9305; Payload ID: 6406 relates to Category No.: 9305; Payload ID: 6407 relates to Category No.: 9305; Payload ID: 6408 relates to Category No.: 9305; Payload ID: 6410 relates to Category No.: 2890, 2942, 4765, 3666, 2183, 4010, 3685, 14685, 4755; Payload ID: 6412 relates to Category No.: 9305, 2890, 10056, 447, 276, 6968; Payload ID: 6413 relates to Category No.: 10056, 9242, 2942, 273, 9734, 1720, 2927, 3666, 3673, 14893, 6989, 276; Payload ID: 6414 relates to Category No.: 6443, 2938, 10056, 2899, 1720, 2534; Payload ID: 6415 relates to Category No.: 2890, 2938, 10056, 2899, 1720, 4010; Payload ID: 6416 relates to Category No.: 9247; Payload ID: 6417 relates to Category No.: 9305, 2890, 6717, 14999, 1231; Payload ID: 6418 relates to Category No.: 2938, 16326, 14364; Payload ID: 6419 relates to Category No.: 6717, 10056, 2942, 1720, 4010, 9774, 1231, 5561; Payload ID: 6420 relates to Category No.: 2942; Payload ID: 6421 relates to Category No.: 2890, 10056, 2942; Payload ID: 6422 relates to Category No.: 5561, 10056, 3693; Payload ID: 6423 relates to Category No.: 5561, 10056; Payload ID: 6424 relates to Category No.: 5561, 10056; Payload ID: 6425 relates to Category No.: 5762, 9247, 9215; Payload ID: 6426 relates to Category No.: 9305, 9247, 2942, 5776, 8935, 11723; Payload ID: 6427 relates to Category No.: 9305, 9247; Payload ID: 6428 relates to Category No.: 9305, 2890, 10056, 2942, 4228; Payload ID: 6429 relates to Category No.: 9305, 9247, 273, 4228, 16326, 6449; Payload ID: 6430 relates to Category No.: 4228, 9305, 14999, 16326; Payload ID: 6431 relates to Category No.: 9305; Payload ID: 6432 relates to Category No.: 4030; Payload ID: 6434 relates to Category No.: 5561, 6717; Payload ID: 6436 relates to Category No.: 9305, 7118, 2890, 2942, 4010; Payload ID: 6437 relates to Category No.: 9305; Payload ID: 6438 relates to Category No.: 9305, 2890, 6717, 9242, 9247, 10162, 7269, 2907, 10161, 3036, 2920, 15139, 1017, 3055, 8935, 3054; Payload ID: 6439 relates to Category No.: 5561, 9242; Payload ID: 6440 relates to Category No.: 9305, 2890, 6717, 9242, 9734, 1017, 3036, 2738, 3055, 14150, 10162; Payload ID: 6441 relates to Category No.: 9305, 2890, 6717, 10162, 2947, 4010, 3036; Payload ID: 6442 relates to Category No.: 5561, 1090; Payload ID: 6443 relates to Category No.: 4030, 5561, 4014, 1090; Payload ID: 6444 relates to Category No.: 5561, 10056, 4010, 1090; Payload ID: 6445 relates to Category No.: 5561, 10056, 4014, 15033, 1090; Payload ID: 6446 relates to Category No.: 7118, 2942, 7060; Payload ID: 6447 relates to Category No.: 5561, 10056, 5570; Payload ID: 6448 relates to Category No.: 5561, 10056, 5570, 1774; Payload ID: 6449 relates to Category No.: 5561, 10056, 5570; Payload ID: 6450 relates to Category No.: 5561, 10056, 5570, 3636; Payload ID: 6451 relates to Category No.: 2942; Payload ID: 6452 relates to Category No.: 2942, 1842; Payload ID: 6453 relates to Category No.: 5561, 6717, 10056, 1792, 4228, 8935; Payload ID: 6454 relates to Category No.: 2890, 6717, 5570, 1792; Payload ID: 6455 relates to Category No.: 5561, 2890, 6717, 10056, 4228, 2503; Payload ID: 6456 relates to Category No.: 5561, 2890, 6717, 10056, 1792, 779, 8948, 1017, 3036, 6075, 11721, 778, 4202; Payload ID: 6457 relates to Category No.: 5561, 6717, 10056, 5570, 4010, 1792, 2503, 1811; Payload ID: 6458 relates to Category No.: 5561, 6717, 10056, 4765, 1792, 3523, 2503, 1182, 4755, 9734, 3521; Payload ID: 6459 relates to Category No.: 5561, 6717, 10056, 5570, 2927, 1792, 779, 778, 781; Payload ID: 6460 relates to Category No.: 5561, 6717, 10056; Payload ID: 6461 relates to Category No.: 5561, 6717, 10056, 4755, 4293; Payload ID: 6462 relates to Category No.: 5561, 2890, 6717, 10056, 1792, 9734, 4201; Payload ID: 6463 relates to Category No.: 4030, 6717; Payload ID: 6464 relates to Category No.: 1842; Payload ID: 6466 relates to Category No.: 2890, 2942, 4010; Payload ID: 6467 relates to Category No.: 9305, 2942, 1748, 4010, 16326; Payload ID: 6468 relates to Category No.: 1720, 14615; Payload ID: 6469 relates to Category No.: 9242, 1635, 16326, 1377; Payload ID: 6470 relates to Category No.: 9305; Payload ID: 6471 relates to Category No.: 9305; Payload ID: 6472 relates to Category No.: 9305; Payload ID: 6473 relates to Category No.: 9305, 9242, 11715, 6043, 11715, 14670; Payload ID: 6474 relates to Category No.: 2890; Payload ID: 6475 relates to Category No.: 7118, 9242; Payload ID: 6476 relates to Category No.: 2890; Payload ID: 6478 relates to Category No.: 2890; Payload ID: 6479 relates to Category No.: 2890, 4010, 6437, 6443; Payload ID: 6480 relates to Category No.: 4030, 4010; Payload ID: 6481 relates to Category No.: 6717, 5570, 4755, 4760; Payload ID: 6482 relates to Category No.: 5561, 6717, 4765, 4755, 4760; Payload ID: 6483 relates to Category No.: 5561, 6717, 4765, 4010, 4760; Payload ID: 6484 relates to Category No.: 5561, 6717, 4755, 4010, 4760; Payload ID: 6485 relates to Category No.: 5561, 6717, 4765, 4010, 4760; Payload ID: 6486 relates to Category No.: 5561, 6717, 4755, 4760, 1792, 1772; Payload ID: 6487 relates to Category No.: 5561, 6717, 4760, 4755; Payload ID: 6488 relates to Category No.: 5561, 6717, 4755, 4010, 4760; Payload ID: 6489 relates to Category No.: 5561, 6717, 4755, 4760; Payload ID: 6490 relates to Category No.: 5561, 2890, 6717, 4765, 4755, 4010, 4760; Payload ID: 6491 relates to Category No.: 5561, 6717, 4755, 4760; Payload ID: 6492 relates to Category No.: 4030, 5561, 9305, 2477, 4765, 3666, 4755; Payload ID: 6493 relates to Category No.: 4030, 5561, 4765, 4755, 14363, 14293, 3518; Payload ID: 6494 relates to Category No.: 7118, 2890, 2942, 7060, 4010, 15643; Payload ID: 6495 relates to Category No.: 2942, 4010; Payload ID: 6496 relates to Category No.: 7118, 2890, 2942, 9247, 7048; Payload ID: 6499 relates to Category No.: 7070, 5564; Payload ID: 6500 relates to Category No.: 9305, 7118, 5564; Payload ID: 6501 relates to Category No.: 5561, 6717, 10056, 4765, 3666, 15573, 4010, 1792, 6743, 15577, 4763, 3673, 4759; Payload ID: 6502 relates to Category No.: 6976, 14906, 1720, 14615; Payload ID: 6503 relates to Category No.: 9305, 9247, 2890, 3036, 3055, 8948, 9734, 10162, 9730, 3057; Payload ID: 6504 relates to Category No.: 2890, 2938, 4010; Payload ID: 6505 relates to Category No.: 6717, 10056, 5570, 14363, 2324, 14753; Payload ID: 6506 relates to Category No.: 6717, 10056, 5570, 4010, 14753, 1099, 5776; Payload ID: 6507 relates to Category No.: 6717, 10056, 5570, 2324, 4010, 3673, 5561; Payload ID: 6508 relates to Category No.: 6717, 10056, 5570; Payload ID: 6509 relates to Category No.: 5570, 6717, 5561; Payload ID: 6510 relates to Category No.: 6717, 10056, 5570; Payload ID: 6511 relates to Category No.: 6717, 5570, 10056; Payload ID: 6512 relates to Category No.: 6717, 5570; Payload ID: 6513 relates to Category No.: 9305, 2942, 273, 10056; Payload ID: 6514 relates to Category No.: 9305, 10056, 2942, 3693, 4043, 6743, 276, 1772, 6717, 7118, 5776, 11650; Payload ID: 6515 relates to Category No.: 9305, 2890, 5762, 4043, 4010, 10056; Payload ID: 6516 relates to Category No.: 5561, 6443, 6717, 997, 2926, 6059; Payload ID: 6517 relates to Category No.: 2890, 2938, 2942, 4755, 6017, 14327; Payload ID: 6518 relates to Category No.: 9305, 2890, 2938, 2942, 4755, 6017, 14327, 3523, 14329; Payload ID: 6519 relates to Category No.: 2890, 2938, 2942, 4755, 6017, 14327; Payload ID: 6520 relates to Category No.: 273, 2890, 2942, 4755, 6017, 4199, 14327; Payload ID: 6521 relates to Category No.: 2890, 2938, 3666, 4755, 3521, 6017, 14327, 14329; Payload ID: 6522 relates to Category No.: 2890, 2938, 4755, 6017, 14327; Payload ID: 6529 relates to Category No.: 1842; Payload ID: 6530 relates to Category No.: 1842; Payload ID: 6536 relates to Category No.: 7118, 5762, 7060; Payload ID: 6537 relates to Category No.: 5762, 7060, 7118; Payload ID: 6538 relates to Category No.: 4755; Payload ID: 6540 relates to Category No.: 9247; Payload ID: 6541 relates to Category No.: 1635; Payload ID: 6543 relates to Category No.: 9242, 9215; Payload ID: 6544 relates to Category No.: 5561; Payload ID: 6547 relates to Category No.: 1842; Payload ID: 6548 relates to Category No.: 9305, 2890, 9247, 2660; Payload ID: 6549 relates to Category No.: 9247, 15531, 9305; Payload ID: 6550 relates to Category No.: 10056, 4860; Payload ID: 6552 relates to Category No.: 5561, 2890, 10056, 5570; Payload ID: 6553 relates to Category No.: 5561, 9305, 12439, 2890, 5762, 10056, 5934, 2942, 4765, 3673, 5570, 7061, 3666, 4755, 9734, 1748, 11650, 3036, 15573, 2927, 3054, 3521, 11723, 11721, 1017, 3059, 8951, 9162, 1033, 3057; Payload ID: 6554 relates to Category No.: 9162, 1033, 3057; Payload ID: 6554 relates to Category No.: 5561, 8935, 5570; Payload ID: 6555 relates to Category No.: 5561, 5570, 12406; Payload ID: 6556 relates to Category No.: 5561, 4755, 3521, 2504; Payload ID: 6557 relates to Category No.: 5561; Payload ID: 6558 relates to Category No.: 5561, 10056, 12406; Payload ID: 6559 relates to Category No.: 5561, 5570; Payload ID: 6560 relates to Category No.: 5561, 10056, 5570; Payload ID: 6561 relates to Category No.: 5561, 10056; Payload ID: 6562 relates to Category No.: 5561; Payload ID: 6563 relates to Category No.: 5561, 6717, 5570, 6440; Payload ID: 6564 relates to Category No.: 5561; Payload ID: 6565 relates to Category No.: 5561, 5570; Payload ID: 6566 relates to Category No.: 5561, 5570; Payload ID: 6567 relates to Category No.: 2890, 10056, 1748, 5561, 5570; Payload ID: 6568 relates to Category No.: 5561, 2890, 6717, 10056, 4755, 6709, 6440, 779, 6712; Payload ID: 6569 relates to Category No.: 5561, 5570; Payload ID: 6570 relates to Category No.: 5561, 10056; Payload ID: 6571 relates to Category No.: 5561, 8935, 5570; Payload ID: 6572 relates to Category No.: 5561, 5570; Payload ID: 6573 relates to Category No.: 5561, 5570; Payload ID: 6574 relates to Category No.: 5561, 5570; Payload ID: 6575 relates to Category No.: 5561, 5570; Payload ID: 6576 relates to Category No.: 5561, 10056; Payload ID: 6577 relates to Category No.: 5561, 5762, 4010; Payload ID: 6578 relates to Category No.: 5561, 10056; Payload ID: 6579 relates to Category No.: 5561, 6717, 10056; Payload ID: 6580 relates to Category No.: 5561, 10056, 6717; Payload ID: 6581 relates to Category No.: 5561, 10056, 12406; Payload ID: 6582 relates to Category No.: 5561, 12439, 5570, 11728, 3638, 2446; Payload ID: 6583 relates to Category No.: 5561, 10056; Payload ID: 6584 relates to Category No.: 5561, 10056, 5570; Payload ID: 6585 relates to Category No.: 5561, 5570; Payload ID: 6586 relates to Category No.: 5561, 10056; Payload ID: 6587 relates to Category No.: 5561, 5570; Payload ID: 6588 relates to Category No.: 5561, 5570; Payload ID: 6589 relates to Category No.: 5561, 10056; Payload ID: 6590 relates to Category No.: 5561, 10056; Payload ID: 6591 relates to Category No.: 5561, 4010; Payload ID: 6592 relates to Category No.: 5561, 5762, 10056; Payload ID: 6593 relates to Category No.: 5561, 10056, 5570; Payload ID: 6594 relates to Category No.: 5561, 5570; Payload ID: 6595 relates to Category No.: 5561, 5570, 12406; Payload ID: 6596 relates to Category No.: 5561, 5570; Payload ID: 6597 relates to Category No.: 5561, 5570; Payload ID: 6598 relates to Category No.: 5561, 5570; Payload ID: 6599 relates to Category No.: 5561, 5570; Payload ID: 6600 relates to Category No.: 5561, 10056; Payload ID: 6601 relates to Category No.: 5561, 5570; Payload ID: 6602 relates to Category No.: 5561, 10056, 5570; Payload ID: 6603 relates to Category No.: 5561, 5570; Payload ID: 6604 relates to Category No.: 5561, 10056; Payload ID: 6605 relates to Category No.: 5561, 5570; Payload ID: 6606 relates to Category No.: 5561, 5570; Payload ID: 6607 relates to Category No.: 5561, 10056, 3673, 15892, 5570, 3666, 12406; Payload ID: 6608 relates to Category No.: 5561, 10056, 12406; Payload ID: 6609 relates to Category No.: 5561, 10056, 5570; Payload ID: 6610 relates to Category No.: 5561, 10056, 5570; Payload ID: 6611 relates to Category No.: 5561, 5570; Payload ID: 6612 relates to Category No.: 5561, 10056; Payload ID: 6613 relates to Category No.: 5561, 5570; Payload ID: 6614 relates to Category No.: 5561, 5570; Payload ID: 6615 relates to Category No.: 5561, 10056, 5570; Payload ID: 6616 relates to Category No.: 5561, 10056, 5570, 2942; Payload ID: 6617 relates to Category No.: 5561, 10056, 1842, 12406; Payload ID: 6618 relates to Category No.: 5561, 10056, 1842, 12406; Payload ID: 6619 relates to Category No.: 5561, 10056, 12406; Payload ID: 6620 relates to Category No.: 5561, 10056, 5570; Payload ID: 6621 relates to Category No.: 5561, 10056, 5570; Payload ID: 6622 relates to Category No.: 5561, 5570; Payload ID: 6623 relates to Category No.: 5561, 10056; Payload ID: 6624 relates to Category No.: 5561, 10056; Payload ID: 6625 relates to Category No.: 5561, 5570, 9098; Payload ID: 6626 relates to Category No.: 5561, 5570, 12406; Payload ID: 6627 relates to Category No.: 5561, 10056, 3666; Payload ID: 6628 relates to Category No.: 5561, 5570; Payload ID: 6629 relates to Category No.: 5561, 5570, 1842; Payload ID: 6630 relates to Category No.: 5561, 4760, 4788, 6717; Payload ID: 6631 relates to Category No.: 5561, 6717, 4765; Payload ID: 6632 relates to Category No.: 2890, 9305; Payload ID: 6633 relates to Category No.: 2890; Payload ID: 6634 relates to Category No.: 9999, 10002; Payload ID: 6635 relates to Category No.: 1720, 9999, 2942, 3036, 8948; Payload ID: 6636 relates to Category No.: 9305, 2890, 10056, 9247, 9184, 4228; Payload ID: 6637 relates to Category No.: 6717, 2942, 10056; Payload ID: 6638 relates to Category No.: 9999; Payload ID: 6639 relates to Category No.: 2890, 6717, 2942, 4228, 493; Payload ID: 6640 relates to Category No.: 9247, 4228; Payload ID: 6641 relates to Category No.: 5561, 5776, 10056, 5570, 2927, 4010; Payload ID: 6642 relates to Category No.: 4030, 5561, 9305, 5776, 10056, 9242, 2927, 4010, 1792; Payload ID: 6643 relates to Category No.: 5561, 7118, 5570, 2927, 4010, 12406, 16156; Payload ID: 6644 relates to Category No.: 5561, 10056; Payload ID: 6645 relates to Category No.: 5561, 10056, 1792, 5762; Payload ID: 6646 relates to Category No.: 7118, 6222; Payload ID: 6647 relates to Category No.: 5762, 2942, 15597; Payload ID: 6648 relates to Category No.: 2942, 15597; Payload ID: 6649 relates to Category No.: 6717, 2901; Payload ID: 6650 relates to Category No.: 2890, 9242; Payload ID: 6651 relates to Category No.: 9305, 9247, 9157; Payload ID: 6652 relates to Category No.: 9305, 9247; Payload ID: 6653 relates to Category No.: 9305; Payload ID: 6654 relates to Category No.: 6960, 2942, 4765, 11687, 4049, 997, 1001, 1046, 2926, 4755, 10056, 6443, 273, 6964, 14683, 1711, 9734; Payload ID: 6655 relates to Category No.: 2942, 11687, 4049, 1001, 7118, 5762, 6960, 3666, 4755, 2927, 997, 1711, 3040, 3037; Payload ID: 6656 relates to Category No.: 2890, 5762, 2942, 4765, 11687, 4755, 4049, 997, 1001, 2926; Payload ID: 6657 relates to Category No.: 2890, 6717, 2942, 4010; Payload ID: 6658 relates to Category No.: 2890; Payload ID: 6659 relates to Category No.: 4010, 6437; Payload ID: 6660 relates to Category No.: 2890, 4010; Payload ID: 6661 relates to Category No.: 2942, 4755; Payload ID: 6662 relates to Category No.: 6717, 4765, 5570, 5561, 4755; Payload ID: 6663 relates to Category No.: 5561, 4755; Payload ID: 6664 relates to Category No.: 5561, 4760; Payload ID: 6665 relates to Category No.: 5561, 6717, 4010, 4760; Payload ID: 6666 relates to Category No.: 6443, 4029, 2890, 4755, 4010, 6437; Payload ID: 6667 relates to Category No.: 2890, 4755, 9734, 4010, 6437, 6443; Payload ID: 6668 relates to Category No.: 4029; Payload ID: 6669 relates to Category No.: 4029; Payload ID: 6671 relates to Category No.: 7118, 6443, 4010, 6437; Payload ID: 6672 relates to Category No.: 5561, 10056, 2942, 5570; Payload ID: 6673 relates to Category No.: 5561, 10056, 2942, 5570; Payload ID: 6674 relates to Category No.: 5561, 10056, 5570; Payload ID: 6675 relates to Category No.: 4030, 4029, 8948, 14409, 2890, 4755; Payload ID: 6676 relates to Category No.: 4029, 1842; Payload ID: 6678 relates to Category No.: 2890; Payload ID: 6680 relates to Category No.: 9734; Payload ID: 6681 relates to Category No.: 2899, 2890, 9305; Payload ID: 6682 relates to Category No.: 5561, 6717, 10056, 8935, 5570, 15139, 1748, 11653, 2324, 4341, 4339; Payload ID: 6683 relates to Category No.: 5561, 6717, 10056, 8935, 5570, 1748, 11653, 2324, 5571, 4341, 1017, 15139; Payload ID: 6684 relates to Category No.: 5561, 6717, 10056, 8935, 5570, 15139, 1748, 11653, 2324, 4341; Payload ID: 6685 relates to Category No.: 5561, 6717, 10056, 8935, 5570, 15139, 1748, 11653, 2324, 4341; Payload ID: 6686 relates to Category No.: 5561, 6717, 10056, 8935, 5570, 15139, 1748, 11653, 2324, 4341, 3036, 1711, 12406, 8949; Payload ID: 6687 relates to Category No.: 5561, 6717, 10056, 8935, 5570, 15139, 1748, 11653, 2324, 4341; Payload ID: 6688 relates to Category No.: 5561, 6717, 10056, 8935, 5570, 15139, 1748, 11653, 2324, 4341, 9305, 2890, 3036, 9162, 12406; Payload ID: 6689 relates to Category No.: 5561, 6717, 10056, 8935, 5570, 15139, 1748, 11653, 2324, 4010, 4341, 2942, 4339; Payload ID: 6690 relates to Category No.: 5561, 6717, 10056, 8935, 5570, 15139, 1748, 11653, 2324, 4341; Payload ID: 6691 relates to Category No.: 5561, 6717, 8935, 5570, 15139, 1748, 11653, 2324, 4341; Payload ID: 6692 relates to Category No.: 5561, 6717, 8935, 5570, 15139, 1748, 11653, 2324, 4341; Payload ID: 6693 relates to Category No.: 5561, 6717, 8935, 5570, 15139, 1748, 11653, 2324, 4341, 12406; Payload ID: 6694 relates to Category No.: 5561, 6717, 10056, 8935, 5570, 15139, 1748, 11653, 2324, 4341, 3040, 1017, 2890; Payload ID: 6695 relates to Category No.: 5561, 6717, 10056, 8935, 5570, 15139, 1748, 11653, 2324, 4341; Payload ID: 6696 relates to Category No.: 5561, 6717, 8935, 5570, 15139, 1748, 11653, 2324, 4341, 10056; Payload ID: 6697 relates to Category No.: 5561, 6717, 10056, 8935, 5570, 15139, 1748, 11653, 2324, 4341; Payload ID: 6698 relates to Category No.: 5561, 6717, 10056, 8935, 5570, 15139, 1748, 11653, 2324, 4341; Payload ID: 6699 relates to Category No.: 5561, 6717, 10056, 1748, 11653, 2324, 1842; Payload ID: 6700 relates to Category No.: 5561, 6717, 10056, 8935, 5570, 15139, 1748, 11653, 2324, 12406, 4341; Payload ID: 6701 relates to Category No.: 5561, 4029, 10056, 5570, 1748, 3036, 11653, 4824, 2890, 6717, 11723, 4823, 4030, 3673, 5776, 6743, 3055, 8935, 15151, 8948, 3054, 7061, 1016; Payload ID: 6702 relates to Category No.:

5561, 10056, 5570, 1748, 11653, 4824, 2890, 8935; Payload ID: 6703 relates to Category No.: 5561, 6717, 3673; Payload ID: 6704 relates to Category No.: 4030, 6443, 9305, 4010, 6709, 16065, 2942; Payload ID: 6705 relates to Category No.: 4010; Payload ID: 6706 relates to Category No.: 2942, 4010; Payload ID: 6707 relates to Category No.: 4030, 5561, 10056, 4010, 676; Payload ID: 6708 relates to Category No.: 10056, 3666, 9734, 4010, 676; Payload ID: 6709 relates to Category No.: 5561, 10056, 676; Payload ID: 6710 relates to Category No.: 5561, 4010, 676; Payload ID: 6711 relates to Category No.: 5561, 676; Payload ID: 6712 relates to Category No.: 676; Payload ID: 6713 relates to Category No.: 4010, 676; Payload ID: 6714 relates to Category No.: 4010, 676; Payload ID: 6715 relates to Category No.: 15573; Payload ID: 6716 relates to Category No.: 9305, 7118, 2890, 6717, 5564; Payload ID: 6717 relates to Category No.: 2890, 5561; Payload ID: 6718 relates to Category No.: 6440; Payload ID: 6719 relates to Category No.: 7118, 10056, 4765, 3673, 5570, 4755, 2644, 4010, 6743, 4228, 4788, 5596, 4402, 2890, 2942, 1811, 6075, 1748, 779, 5727, 2649, 4089, 6717, 3693, 6443, 7070, 3521, 6059, 7321; Payload ID: 6720 relates to Category No.: 5561, 10056, 2644, 4402; Payload ID: 6721 relates to Category No.: 5561, 2644, 10056, 4402, 6743; Payload ID: 6722 relates to Category No.: 5570, 2644, 4402, 5561; Payload ID: 6723 relates to Category No.: 5570, 2644, 5596, 4402, 5561, 1774; Payload ID: 6724 relates to Category No.: 5570, 2644, 10056; Payload ID: 6725 relates to Category No.: 5561, 2644; Payload ID: 6726 relates to Category No.: 5561, 3673, 2644, 2890, 10056, 4402, 3666; Payload ID: 6727 relates to Category No.: 5561, 10056, 2644, 3685, 4402, 2890, 1748, 6075; Payload ID: 6728 relates to Category No.: 5561, 2644, 4402, 2890, 1811; Payload ID: 6729 relates to Category No.: 5561, 2644; Payload ID: 6730 relates to Category No.: 5561, 2644; Payload ID: 6731 relates to Category No.: 5561, 2644, 4402, 2942, 779; Payload ID: 6732 relates to Category No.: 5561, 2644; Payload ID: 6733 relates to Category No.: 5561, 10056, 2644; Payload ID: 6734 relates to Category No.: 5570, 2644, 1792, 4402; Payload ID: 6735 relates to Category No.: 5561, 2644, 10056; Payload ID: 6736 relates to Category No.: 5561, 2644; Payload ID: 6737 relates to Category No.: 5561, 2644, 10056, 3673, 5596, 4402; Payload ID: 6738 relates to Category No.: 5561, 2644, 7366, 4402; Payload ID: 6739 relates to Category No.: 5561, 2644, 7366; Payload ID: 6740 relates to Category No.: 9305, 9242, 9158, 15269, 1291, 15252, 1288; Payload ID: 6741 relates to Category No.: 9734; Payload ID: 6742 relates to Category No.: 2890; Payload ID: 6743 relates to Category No.: 7118, 2890, 6976; Payload ID: 6745 relates to Category No.: 4029, 3671, 14411, 2890, 4030, 8948; Payload ID: 6746 relates to Category No.: 5561, 6717, 10056, 2942; Payload ID: 6747 relates to Category No.: 4030, 4029, 3693, 6989, 779, 6437; Payload ID: 6748 relates to Category No.: 4030, 4029; Payload ID: 6749 relates to Category No.: 4030, 4029; Payload ID: 6750 relates to Category No.: 5561, 10056, 5570; Payload ID: 6751 relates to Category No.: 4029, 1842; Payload ID: 6752 relates to Category No.: 4029, 1084; Payload ID: 6753 relates to Category No.: 9305; Payload ID: 6754 relates to Category No.: 9305; Payload ID: 6755 relates to Category No.: 9305, 15505, 9247, 15531; Payload ID: 6756 relates to Category No.: 15505, 9247, 9305, 11883, 2942, 6617; Payload ID: 6757 relates to Category No.: 9305, 15505, 9242, 9247, 9157; Payload ID: 6758 relates to Category No.: 9305, 9247, 14253; Payload ID: 6759 relates to Category No.: 9305, 15505, 9247; Payload ID: 6760 relates to Category No.: 9305, 15505, 9247; Payload ID: 6761 relates to Category No.: 9305, 9247; Payload ID: 6762 relates to Category No.: 9247, 9305, 9311, 9215; Payload ID: 6763 relates to Category No.: 9247, 9157, 9311, 11883, 9215; Payload ID: 6767 relates to Category No.: 14174, 2890, 6717, 10162; Payload ID: 6768 relates to Category No.: 9305, 2890, 5776, 10056, 9242; Payload ID: 6769 relates to Category No.: 9305; Payload ID: 6770 relates to Category No.: 9305, 9242, 9247, 15855; Payload ID: 6771 relates to Category No.: 10056, 677, 4049, 4010; Payload ID: 6772 relates to Category No.: 10056, 677, 4049; Payload ID: 6773 relates to Category No.: 2890, 5776, 10056, 677, 4049, 4008; Payload ID: 6774 relates to Category No.: 10056, 677, 4010, 4030; Payload ID: 6775 relates to Category No.: 5561, 10056, 5762; Payload ID: 6776 relates to Category No.: 9305, 2890, 9242, 9247, 4755; Payload ID: 6777 relates to Category No.: 2890, 2942, 6994, 4755, 7366, 11883, 8935; Payload ID: 6778 relates to Category No.: 2890, 6717, 2942, 4010, 4228, 16156, 4755, 7366; Payload ID: 6779 relates to Category No.: 2890; Payload ID: 6780 relates to Category No.: 2890, 4010; Payload ID: 6781 relates to Category No.: 2890, 4010; Payload ID: 6782 relates to Category No.: 2890, 4010, 7118; Payload ID: 6783 relates to Category No.: 4030, 4029, 9305, 2890, 10056, 2942, 273, 1239, 4010, 10106, 4228, 2710, 14367, 268, 6017, 11883, 9734, 14327, 7366; Payload ID: 6784 relates to Category No.: 9305, 2890, 9242, 2942, 9247, 14912, 14681, 14682, 4438, 5762; Payload ID: 6785 relates to Category No.: 2890, 6717, 9242, 2942, 9247, 4010, 14664, 14681, 14682, 4438; Payload ID: 6786 relates to Category No.: 9305, 2890, 6717, 2942, 9247, 9155, 14681, 14682, 4438; Payload ID: 6787 relates to Category No.: 9305, 2890, 2942, 9247, 9155, 14681, 14682, 4438; Payload ID: 6788 relates to Category No.: 9305, 2890, 2942, 9247, 9155, 14681, 14682, 4438; Payload ID: 6789 relates to Category No.: 9305, 2890, 2942, 9247, 14681, 14682, 4438; Payload ID: 6790 relates to Category No.: 5762, 2942; Payload ID: 6791 relates to Category No.: 9305; Payload ID: 6792 relates to Category No.: 9305, 2890, 2942, 9247; Payload ID: 6793 relates to Category No.: 2194, 9247, 4010; Payload ID: 6794 relates to Category No.: 2890, 9247, 15507, 9305; Payload ID: 6795 relates to Category No.: 15507, 2890, 9305; Payload ID: 6796 relates to Category No.: 9247, 1748, 15507; Payload ID: 6797 relates to Category No.: 9305, 9242, 9247; Payload ID: 6798 relates to Category No.: 9247, 5730, 15509; Payload ID: 6799 relates to Category No.: 9305, 2890, 9247, 15509; Payload ID: 6800 relates to Category No.: 9305, 9247, 1748, 15510; Payload ID: 6801 relates to Category No.: 9305, 9247, 6968, 15510, 5238; Payload ID: 6802 relates to Category No.: 9247, 2693, 5238, 9305; Payload ID: 6803 relates to Category No.: 9247, 2693, 5238; Payload ID: 6804 relates to Category No.: 2693, 9247, 5238; Payload ID: 6805 relates to Category No.: 9305, 9247, 2693, 5238; Payload ID: 6806 relates to Category No.: 9247, 2693, 9242; Payload ID: 6807 relates to Category No.: 9305, 2890, 6717, 9247, 8948, 1774, 2942; Payload ID: 6808 relates to Category No.: 9305, 9247; Payload ID: 6809 relates to Category No.: 9305, 6717, 9242, 9247, 15513, 14145; Payload ID: 6810 relates to Category No.: 9247, 15513; Payload ID: 6811 relates to Category No.: 9247, 15513, 5561; Payload ID: 6812 relates to Category No.: 9247, 15513; Payload ID: 6813 relates to Category No.: 9247, 15513; Payload ID: 6814 relates to Category No.: 9247, 15513; Payload ID: 6815 relates to Category No.: 2890, 2938, 10056, 1748, 11653, 5762; Payload ID: 6816 relates to Category No.: 2942; Payload ID: 6817 relates to Category No.: 5561, 3673, 3666; Payload ID: 6818 relates to Category No.: 9305, 2890, 2194, 2420, 14893; Payload ID: 6819 relates to Category No.: 9181, 9162; Payload ID:

6820 relates to Category No.: 2890, 10056; Payload ID: 6822 relates to Category No.: 6717, 3666, 9162; Payload ID: 6823 relates to Category No.: 4030, 4029, 2942, 1017, 3671, 14411; Payload ID: 6825 relates to Category No.: 9247, 1748; Payload ID: 6826 relates to Category No.: 2890, 2938, 2786; Payload ID: 6827 relates to Category No.: 5561; Payload ID: 6828 relates to Category No.: 9305, 2890, 9247; Payload ID: 6829 relates to Category No.: 9305, 9247, 13731, 4466; Payload ID: 6830 relates to Category No.: 9247; Payload ID: 6831 relates to Category No.: 13731, 4466, 2890, 9247, 9305; Payload ID: 6832 relates to Category No.: 2890, 6717, 2942, 15151, 2899, 1720, 3054, 4010, 3055, 16164, 3636, 1335; Payload ID: 6833 relates to Category No.: 2890, 4010; Payload ID: 6835 relates to Category No.: 4030, 2890, 6717, 10056, 9199; Payload ID: 6836 relates to Category No.: 9305, 2890, 5776, 2942, 9247, 2455, 2443, 2458, 1046, 11728; Payload ID: 6837 relates to Category No.: 9305, 2942, 9247, 2455, 2443, 2890, 9215, 2458, 6717, 1046, 11728, 7246; Payload ID: 6838 relates to Category No.: 9305, 2890, 2942, 9247, 6653, 2458, 2455, 2443, 9215, 1046, 15531, 11728; Payload ID: 6839 relates to Category No.: 9305; Payload ID: 6840 relates to Category No.: 5561, 4029, 6717, 10056; Payload ID: 6841 relates to Category No.: 4029, 262, 14819; Payload ID: 6842 relates to Category No.: 5561; Payload ID: 6843 relates to Category No.: 4029, 4765, 4010; Payload ID: 6844 relates to Category No.: 5762; Payload ID: 6845 relates to Category No.: 5762; Payload ID: 6846 relates to Category No.: 4029; Payload ID: 6847 relates to Category No.: 9305, 15505; Payload ID: 6848 relates to Category No.: 9305; Payload ID: 6849 relates to Category No.: 2890, 5727, 2942, 6717, 1774, 7366, 1711, 4479, 909, 911; Payload ID: 6850 relates to Category No.: 7118, 6717, 5570; Payload ID: 6852 relates to Category No.: 5762, 5776, 9242; Payload ID: 6853 relates to Category No.: 5561, 10056, 12159, 2574, 4030; Payload ID: 6854 relates to Category No.: 9305; Payload ID: 6855 relates to Category No.: 9305, 2890, 9215; Payload ID: 6856 relates to Category No.: 9305, 9247, 4755; Payload ID: 6857 relates to Category No.: 5561, 6717, 4765; Payload ID: 6858 relates to Category No.: 5762, 2794, 2786, 2785, 2787; Payload ID: 6860 relates to Category No.: 4030, 4029, 10056, 3671, 14411, 2890; Payload ID: 6861 relates to Category No.: 5561, 6717, 10056, 5570, 3693; Payload ID: 6862 relates to Category No.: 5561, 6717, 5762, 10056, 2942; Payload ID: 6863 relates to Category No.: 5561, 6717, 10056; Payload ID: 6864 relates to Category No.: 2942, 4010; Payload ID: 6865 relates to Category No.: 2890, 5561; Payload ID: 6866 relates to Category No.: 9305, 2890, 9247; Payload ID: 6867 relates to Category No.: 2890, 9247, 9305; Payload ID: 6868 relates to Category No.: 2942, 9247, 9305, 7118, 2890, 276, 14409, 1720, 1082; Payload ID: 6869 relates to Category No.: 9305, 2890, 2942, 9247, 7118; Payload ID: 6870 relates to Category No.: 6443, 4010, 6437; Payload ID: 6871 relates to Category No.: 2890, 2942; Payload ID: 6872 relates to Category No.: 2890, 4010; Payload ID: 6873 relates to Category No.: 9305, 2890; Payload ID: 6874 relates to Category No.: 2942, 4765, 3696, 4755, 6059, 3685; Payload ID: 6875 relates to Category No.: 5561, 6717, 4765, 15573, 4759, 4030; Payload ID: 6876 relates to Category No.: 5561, 6717, 4765, 1842; Payload ID: 6877 relates to Category No.: 5561, 6717, 4765, 4010; Payload ID: 6878 relates to Category No.: 5561, 6717, 4765; Payload ID: 6879 relates to Category No.: 5561, 6717, 4765; Payload ID: 6880 relates to Category No.: 6717, 3673, 5557, 3666; Payload ID: 6881 relates to Category No.: 5561, 6717, 3673, 5557, 3666, 5776; Payload ID: 6882 relates to Category No.: 6717, 3673, 5557, 3666; Payload ID: 6883 relates to Category No.: 2890, 6717, 6976, 2194, 5776, 2942, 4010, 2918, 9305; Payload ID: 6884 relates to Category No.: 4030, 2890, 6717, 10056, 2942, 9247, 4010, 8935; Payload ID: 6885 relates to Category No.: 5561, 6717, 3673, 3666, 5557; Payload ID: 6886 relates to Category No.: 4029; Payload ID: 6887 relates to Category No.: 12159; Payload ID: 6888 relates to Category No.: 5561, 6443, 6717, 4010, 6440, 6437; Payload ID: 6889 relates to Category No.: 6717, 4755, 4010, 6709, 3671, 4550; Payload ID: 6891 relates to Category No.: 5561, 6717, 10056, 4765, 3673, 14683; Payload ID: 6892 relates to Category No.: 4010, 6440, 6437; Payload ID: 6894 relates to Category No.: 5561, 4765; Payload ID: 6895 relates to Category No.: 5561; Payload ID: 6896 relates to Category No.: 5561, 4765, 4755; Payload ID: 6897 relates to Category No.: 4030, 6717, 5776, 4010, 6437, 6443; Payload ID: 6898 relates to Category No.: 5762, 10056, 16164, 2509, 11721; Payload ID: 6899 relates to Category No.: 10056, 2942, 4765, 1748, 11723, 2509, 2890, 15139, 1017, 677, 15161, 2926, 9734, 5441; Payload ID: 6901 relates to Category No.: 7118, 2890, 7060; Payload ID: 6902 relates to Category No.: 7118; Payload ID: 6903 relates to Category No.: 10056, 2942, 8935, 3666, 2899, 1748, 11653, 3036, 6743, 12439; Payload ID: 6904 relates to Category No.: 6717, 11653, 3036, 3054; Payload ID: 6905 relates to Category No.: 12439, 6717, 10056, 4765, 3673, 1748, 11650, 8948, 3036, 657, 11653, 1792, 3055, 3059, 3832, 3638, 3686, 8945, 3666, 8935, 15151, 1037, 3040, 5851; Payload ID: 6906 relates to Category No.: 3036, 657, 11653, 6717, 10056, 3673, 5570, 1748, 3638, 15139, 3666, 15151, 15147; Payload ID: 6907 relates to Category No.: 3036, 657, 11653, 6717, 10056, 1748, 3638, 3055, 8948, 15280, 3054, 11650, 9730, 915, 15145; Payload ID: 6908 relates to Category No.: 3036, 657, 11653, 10056, 1748, 3638, 4032, 6717, 15139, 8948, 15280; Payload ID: 6909 relates to Category No.: 6717, 10056, 1748, 3036, 11653, 5851, 4010; Payload ID: 6910 relates to Category No.: 6717, 10056, 5570, 15139, 1748, 3036, 11653, 5851, 3055; Payload ID: 6911 relates to Category No.: 1748, 11653, 15139, 3055; Payload ID: 6912 relates to Category No.: 6717, 10056, 1748, 3036, 11653, 5926, 11723, 5570, 15139, 11650, 8951; Payload ID: 6913 relates to Category No.: 6717, 10056, 5570, 1748, 3036, 11653, 5926, 11723, 8948, 11650, 5851, 15139, 1017, 15280, 9730, 3037; Payload ID: 6914 relates to Category No.: 6717, 10056, 5570, 1748, 3036, 11653, 5926, 11723, 1017, 9730, 15280, 3037; Payload ID: 6915 relates to Category No.: 6717, 10056, 5570, 1748, 3036, 11653, 5926, 11723, 15139; Payload ID: 6916 relates to Category No.: 6717, 10056, 1748, 3036, 11653, 5926, 11723, 3666, 5851, 1017, 8935, 8948, 15280, 11650, 9730; Payload ID: 6917 relates to Category No.: 6717, 10056, 15151, 8935, 5570, 15139, 1748, 11650, 3036, 11653, 1792, 3055, 3972, 9079, 15280, 15145, 5561, 2890, 3666, 8951, 8948, 3045; Payload ID: 6918 relates to Category No.: 6717, 10056, 5570, 1748, 3036, 11653, 1792, 9079, 15139, 3666, 8935, 11650, 11723, 8951, 15151, 5561; Payload ID: 6919 relates to Category No.: 6717, 10056, 8935, 5570, 1748, 11653, 1792, 9079, 15139, 11650, 8951, 15151; Payload ID: 6920 relates to Category No.: 6717, 5762, 10056, 5570, 1748, 3036, 11653, 9079, 11650; Payload ID: 6921 relates to Category No.: 6717, 5762, 10056, 1748, 3036, 11653, 9079, 15139; Payload ID: 6922 relates to Category No.: 5561, 4755, 3666; Payload ID: 6923 relates to Category No.: 5561, 6717, 10056, 8935, 15139, 1748, 11650, 8948, 3036, 11653, 9079; Payload ID: 6924 relates to Category No.: 6717, 10056, 1748, 8948, 3036, 11653, 9079; Payload ID: 6925 relates to Category No.: 5561, 10056, 2942, 5570, 11650, 4823, 4825, 9305, 8935, 3036;

Payload ID: 6926 relates to Category No.: 5561, 10056, 5570, 1748, 3036, 11723, 8935, 5762, 1017; Payload ID: 6927 relates to Category No.: 5561, 10056, 5570, 11723, 1017, 8935, 11653, 11650, 3055; Payload ID: 6928 relates to Category No.: 5561, 5762, 10056, 5570, 11723, 2926; Payload ID: 6929 relates to Category No.: 5561, 10056, 5570, 11650, 4010, 2890, 8935; Payload ID: 6930 relates to Category No.: 5561, 10056, 4765, 3673, 5570, 3036, 11723, 9011; Payload ID: 6931 relates to Category No.: 5570, 11723, 5561, 10056, 1720, 3036, 11653, 3054, 11721, 1017, 12406, 915; Payload ID: 6932 relates to Category No.: 5561, 10056, 5570, 11723; Payload ID: 6933 relates to Category No.: 9305, 7118, 2890, 2942, 4010, 7366, 1711, 4479, 11883, 5776, 8935, 1774, 1033, 14293, 9730; Payload ID: 6934 relates to Category No.: 2942, 4587, 5561; Payload ID: 6935 relates to Category No.: 2942, 4587; Payload ID: 6943 relates to Category No.: 9305, 2890, 9242; Payload ID: 6944 relates to Category No.: 7060, 7118; Payload ID: 6945 relates to Category No.: 9305, 2890, 2942, 4010, 1033, 6443; Payload ID: 6946 relates to Category No.: 2942; Payload ID: 6947 relates to Category No.: 7118, 10056, 7060, 4010, 7048, 7366, 11883, 1792, 9730; Payload ID: 6948 relates to Category No.: 2942, 4010; Payload ID: 6949 relates to Category No.: 7118, 2942, 7060; Payload ID: 6950 relates to Category No.: 7118, 7060; Payload ID: 6953 relates to Category No.: 2942, 4010; Payload ID: 6954 relates to Category No.: 2942; Payload ID: 6955 relates to Category No.: 9247, 1842; Payload ID: 6956 relates to Category No.: 4010; Payload ID: 6957 relates to Category No.: 5561, 6717, 4765, 4755; Payload ID: 6958 relates to Category No.: 7118, 4606; Payload ID: 6959 relates to Category No.: 2890, 2942, 7060; Payload ID: 6960 relates to Category No.: 10056, 5570, 4008, 4010, 2926, 1335, 6440, 779, 778; Payload ID: 6961 relates to Category No.: 2890, 6717, 2942, 14145, 4347, 633; Payload ID: 6962 relates to Category No.: 7118, 2890, 7060; Payload ID: 6963 relates to Category No.: 7118, 4606; Payload ID: 6964 relates to Category No.: 7118, 4606; Payload ID: 6965 relates to Category No.: 2942, 4010, 2890, 9305, 7118; Payload ID: 6966 relates to Category No.: 9305, 7118, 5776, 9247, 3036, 7060, 8948; Payload ID: 6967 relates to Category No.: 1720, 4010, 16326, 9305, 3036; Payload ID: 6968 relates to Category No.: 9305, 7118, 7060, 3036, 8948; Payload ID: 6969 relates to Category No.: 14953, 5971; Payload ID: 6970 relates to Category No.: 14953, 6989; Payload ID: 6971 relates to Category No.: 7118, 7060, 7048; Payload ID: 6972 relates to Category No.: 7118, 2890, 2942, 7060, 4010, 6161; Payload ID: 6973 relates to Category No.: 2890, 2942, 4010; Payload ID: 6974 relates to Category No.: 4030, 4029, 4010; Payload ID: 6975 relates to Category No.: 9305, 7118, 2942, 4010, 9162, 7048; Payload ID: 6976 relates to Category No.: 4030, 14832; Payload ID: 6977 relates to Category No.: 4029; Payload ID: 6978 relates to Category No.: 4029, 3666, 3671; Payload ID: 6979 relates to Category No.: 5561, 3671; Payload ID: 6980 relates to Category No.: 2942, 7060, 4010, 4008, 7118; Payload ID: 6981 relates to Category No.: 2942, 4010; Payload ID: 6982 relates to Category No.: 2942, 4010; Payload ID: 6983 relates to Category No.: 2942, 4010; Payload ID: 6984 relates to Category No.: 2942; Payload ID: 6985 relates to Category No.: 2890, 4010; Payload ID: 6986 relates to Category No.: 5776, 6717, 5762, 7060, 9756, 4010, 7048, 7118; Payload ID: 6987 relates to Category No.: 2890, 2942; Payload ID: 6988 relates to Category No.: 2890, 2942, 4010, 14368; Payload ID: 6989 relates to Category No.: 9305, 2890, 2942, 4010, 14825; Payload ID: 6990 relates to Category No.: 2890, 2942; Payload ID: 6991 relates to Category No.: 2942; Payload ID: 6992 relates to Category No.: 2890, 2942, 4010, 1090, 1017, 1711, 9184, 7366; Payload ID: 6993 relates to Category No.: 2890, 2942, 4010; Payload ID: 6994 relates to Category No.: 4030, 9305, 7118, 2890, 5762, 10056, 2942, 4010, 16156, 15483; Payload ID: 6995 relates to Category No.: 2942, 4010; Payload ID: 6996 relates to Category No.: 2890, 4010; Payload ID: 6997 relates to Category No.: 2890, 2942, 4010; Payload ID: 6998 relates to Category No.: 2890, 7118, 2942; Payload ID: 6999 relates to Category No.: 2890, 4010; Payload ID: 7000 relates to Category No.: 2942, 4010; Payload ID: 7001 relates to Category No.: 9305, 2890, 6717, 5776, 10056, 2942, 14145, 9734, 6968, 6222, 4010, 9184, 16156, 4347; Payload ID: 7002 relates to Category No.: 9305, 2942, 2458, 14825, 7244, 14833, 2890; Payload ID: 7003 relates to Category No.: 7118, 2890; Payload ID: 7004 relates to Category No.: 7118, 2890, 2942, 7070, 4010, 9305; Payload ID: 7005 relates to Category No.: 7118, 2890, 7070, 4010; Payload ID: 7006 relates to Category No.: 7118, 2890; Payload ID: 7007 relates to Category No.: 5561, 7118, 7070; Payload ID: 7008 relates to Category No.: 5561, 3673, 3666; Payload ID: 7009 relates to Category No.: 5561, 6717, 3673, 3666; Payload ID: 7010 relates to Category No.: 5561, 10056, 7070, 7048, 7118, 7061; Payload ID: 7011 relates to Category No.: 2942, 4010, 4641, 7118; Payload ID: 7012 relates to Category No.: 4641, 10056, 2942, 4010, 6717; Payload ID: 7013 relates to Category No.: 4641, 7048, 7118; Payload ID: 7014 relates to Category No.: 6717, 9756, 9754, 9753, 7118; Payload ID: 7015 relates to Category No.: 2942, 2890; Payload ID: 7016 relates to Category No.: 5561, 2890; Payload ID: 7017 relates to Category No.: 5561, 2890, 6717; Payload ID: 7018 relates to Category No.: 5561, 2890, 2938, 10056; Payload ID: 7019 relates to Category No.: 5561, 4010; Payload ID: 7020 relates to Category No.: 5561; Payload ID: 7021 relates to Category No.: 5561, 4860, 6717, 8948, 1017, 9732; Payload ID: 7022 relates to Category No.: 7048, 4010, 7052, 7118; Payload ID: 7023 relates to Category No.: 7118, 9247; Payload ID: 7024 relates to Category No.: 7118, 7060, 4665; Payload ID: 7025 relates to Category No.: 7118, 7060, 4665; Payload ID: 7026 relates to Category No.: 2890; Payload ID: 7027 relates to Category No.: 5561, 6717, 5776, 10056, 8935, 5570, 15139, 1748, 11653, 2324, 4008, 5762, 5441, 3666; Payload ID: 7028 relates to Category No.: 5561, 6717, 10056, 8935, 5570, 15139, 1748, 11653, 2324; Payload ID: 7029 relates to Category No.: 5561, 6717, 10056, 8935, 5570, 15139, 1748, 11653, 2324, 4008, 1033; Payload ID: 7030 relates to Category No.: 5561, 6717, 8935, 5570, 15139, 1748, 11653, 2324; Payload ID: 7031 relates to Category No.: 5561, 6717, 10056, 8935, 5570, 15139, 1748, 11653, 2324; Payload ID: 7032 relates to Category No.: 7118, 7060, 4010; Payload ID: 7033 relates to Category No.: 7118; Payload ID: 7034 relates to Category No.: 7118; Payload ID: 7035 relates to Category No.: 7118, 3666; Payload ID: 7036 relates to Category No.: 7118; Payload ID: 7037 relates to Category No.: 2890, 6717, 2942, 5412; Payload ID: 7038 relates to Category No.: 2890, 2938, 2942, 1720, 2710, 3537; Payload ID: 7039 relates to Category No.: 2942, 1154; Payload ID: 7040 relates to Category No.: 9305, 2890, 2194, 10056, 2942, 9247, 1154, 9734, 4860, 3054, 8948, 14145, 8951, 1711, 6755, 7118, 3036, 11883, 6743, 1017, 3055; Payload ID: 7041 relates to Category No.: 6717, 2942, 4010, 6437; Payload ID: 7042 relates to Category No.: 2942, 6437; Payload ID: 7043 relates to Category No.: 2890, 6717, 2942, 4010; Payload ID: 7044 relates to Category No.: 2890; Payload ID: 7045 relates to Category No.: 5561, 5570, 4008, 6717, 10056, 4010, 1842; Payload ID: 7046 relates to Category No.: 5561, 10056, 5570; Payload ID: 7047 relates to Category No.: 6717, 10056, 5570, 2712; Payload ID: 7048 relates to Category No.: 10056, 5570, 5561; Payload ID: 7049 relates to Category No.: 5561, 6709, 5570, 2899; Payload ID: 7050 relates to Category No.: 10056, 677, 4010; Payload ID: 7051 relates to Category No.: 5570, 4010; Payload ID: 7052 relates to Category No.: 4029; Payload ID: 7053 relates to Category No.: 4029; Payload ID: 7054 relates to Category No.: 4029, 1700; Payload ID: 7055 relates to Category No.: 6717, 10056, 5570, 4010, 1792, 676, 5561; Payload ID: 7056 relates to Category No.: 10056, 5570; Payload ID: 7057 relates to Category No.: 5561, 4010; Payload ID: 7058 relates to Category No.: 10056, 5570; Payload ID: 7059 relates to Category No.: 5561, 10056, 8935, 8948, 4199, 1036, 4010, 3055, 4032; Payload ID: 7060 relates to Category No.: 5561, 10056, 6743; Payload ID: 7061 relates to Category No.: 10056, 5570, 4010; Payload ID: 7062 relates to Category No.: 10056, 4010, 1792, 15318; Payload ID: 7063 relates to Category No.: 5561, 6443, 9305, 2942, 6440; Payload ID: 7064 relates to Category No.: 4801, 5561, 6717, 3673; Payload ID: 7065 relates to Category No.: 1099, 5059, 4008, 676, 779, 1792, 5762, 678; Payload ID: 7066 relates to Category No.: 5762, 10056, 677, 4049; Payload ID: 7067 relates to Category No.: 4030, 2890, 5762, 5776, 12159, 4010, 6440; Payload ID: 7068 relates to Category No.: 4029, 2890; Payload ID: 7069 relates to Category No.: 5561, 6717; Payload ID: 7070 relates to Category No.: 5561, 6717, 4755; Payload ID: 7071 relates to Category No.: 5561, 4755; Payload ID: 7072 relates to Category No.: 5561, 4765, 5776; Payload ID: 7074 relates to Category No.: 2890, 2942, 9247, 7060, 1017, 4010, 7118, 14409; Payload ID: 7075 relates to Category No.: 7118, 4010; Payload ID: 7077 relates to Category No.: 2890, 2942, 4010; Payload ID: 7078 relates to Category No.: 2890, 9247, 4755; Payload ID: 7079 relates to Category No.: 2890, 2942, 4010, 9753; Payload ID: 7080 relates to Category No.: 4030, 6717, 10056, 12159, 677, 5570, 3693, 4010, 6743, 4763, 6437; Payload ID: 7081 relates to Category No.: 4030, 6717, 10056, 12159, 677, 3666, 4763, 6437; Payload ID: 7082 relates to Category No.: 4030, 6717, 10056, 12159, 5570, 4010, 4763, 6437, 677, 6443, 678; Payload ID: 7083 relates to Category No.: 4030, 9305, 6717, 10056, 12159, 677, 5570, 4008, 4010, 4763, 6437; Payload ID: 7084 relates to Category No.: 4030, 4029, 6717, 10056, 12159, 677, 5570, 4763, 6437; Payload ID: 7085 relates to Category No.: 4030, 9305, 6717, 10056, 12159, 677, 5570, 4763, 6437; Payload ID: 7086 relates to Category No.: 4010, 6437, 7118, 2890, 6443, 2918, 774, 5306; Payload ID: 7087 relates to Category No.: 5039, 4029, 9305, 2890, 15627, 9734, 6717, 2942, 4010, 3036, 14327, 10056, 5819, 15574; Payload ID: 7088 relates to Category No.: 5039; Payload ID: 7089 relates to Category No.: 6717, 10056, 2477, 4765, 4755, 15573, 6222, 1750, 3685, 9756, 7118, 3671, 4769; Payload ID: 7090 relates to Category No.: 5561, 6717, 10056, 4765, 4755, 4010, 12159; Payload ID: 7091 relates to Category No.: 5561, 6717, 2477, 9247, 4755, 3636, 3696, 4760, 4763; Payload ID: 7092 relates to Category No.: 4030, 5570, 4755, 4010; Payload ID: 7093 relates to Category No.: 7118, 10056, 2942, 3693, 9247, 4755, 15573, 4760, 7052, 4759; Payload ID: 7094 relates to Category No.: 4765, 4760, 15574; Payload ID: 7095 relates to Category No.: 4765, 4755, 3686; Payload ID: 7096 relates to Category No.: 6717, 4765, 4755; Payload ID: 7097 relates to Category No.: 5561, 6717, 2477, 4765, 4755, 14707, 4764; Payload ID: 7098 relates to Category No.: 5561, 3673, 4755, 14707, 6060, 3832, 6717, 4765, 3686; Payload ID: 7099 relates to Category No.: 2890, 2942, 1104; Payload ID: 7100 relates to Category No.: 5561, 4765, 1282; Payload ID: 7101 relates to Category No.: 5561, 1282, 6717, 4765, 3666; Payload ID: 7102 relates to Category No.: 2890, 6717, 10056, 4755, 1748, 11650, 3036, 11653, 11883, 6440, 4788, 15577; Payload ID: 7103 relates to Category No.: 6717, 5762, 5776, 9247, 4755, 2490, 3696; Payload ID: 7104 relates to Category No.: 5762, 4755, 2490, 15573, 3696, 2504; Payload ID: 7105 relates to Category No.: 5762, 2490, 15573, 3696; Payload ID: 7106 relates to Category No.: 5559, 4755; Payload ID: 7107 relates to Category No.: 5776, 4755, 15573, 4760, 9734; Payload ID: 7108 relates to Category No.: 9305, 6960, 2477, 4765, 14906, 4755, 4760, 3831, 7161, 3686, 4758; Payload ID: 7109 relates to Category No.: 9305, 6717, 9242, 2942, 4765, 9247, 4755, 4780, 4760, 4047; Payload ID: 7110 relates to Category No.: 2890, 5776, 4765, 9247, 4755, 15573, 4010; Payload ID: 7111 relates to Category No.: 5561, 6717, 2477, 4765, 4755, 4759, 4758, 2666, 4779, 4764; Payload ID: 7112 relates to Category No.: 4755; Payload ID: 7113 relates to Category No.: 4755; Payload ID: 7114 relates to Category No.: 4755; Payload ID: 7115 relates to Category No.: 4755; Payload ID: 7117 relates to Category No.: 4755; Payload ID: 7118 relates to Category No.: 4755; Payload ID: 7120 relates to Category No.: 4755; Payload ID: 7122 relates to Category No.: 4755; Payload ID: 7123 relates to Category No.: 4010, 4769, 9552, 5818; Payload ID: 7124 relates to Category No.: 4765; Payload ID: 7125 relates to Category No.: 4755; Payload ID: 7126 relates to Category No.: 4755, 4760; Payload ID: 7127 relates to Category No.: 4755, 4760; Payload ID: 7128 relates to Category No.: 4755; Payload ID: 7129 relates to Category No.: 4755; Payload ID: 7130 relates to Category No.: 4755; Payload ID: 7131 relates to Category No.: 4755; Payload ID: 7132 relates to Category No.: 4755; Payload ID: 7133 relates to Category No.: 4755; Payload ID: 7134 relates to Category No.: 4755; Payload ID: 7135 relates to Category No.: 4755; Payload ID: 7136 relates to Category No.: 4755; Payload ID: 7137 relates to Category No.: 4755; Payload ID: 7138 relates to Category No.: 4755; Payload ID: 7139 relates to Category No.: 4755; Payload ID: 7140 relates to Category No.: 5561, 6717, 4765, 4755, 4769, 3685, 2477; Payload ID: 7141 relates to Category No.: 9305, 2890, 9242, 9247, 4755; Payload ID: 7142 relates to Category No.: 9305; Payload ID: 7143 relates to Category No.: 4030, 4029, 7118, 3036, 8935, 1033, 9730, 4786, 2919, 8966; Payload ID: 7144 relates to Category No.: 4030, 4029; Payload ID: 7145 relates to Category No.: 5561, 6717, 10056, 5570; Payload ID: 7146 relates to Category No.: 9305, 15505; Payload ID: 7147 relates to Category No.: 9305; Payload ID: 7149 relates to Category No.: 9305, 2890; Payload ID: 7150 relates to Category No.: 1842; Payload ID: 7151 relates to Category No.: 11883; Payload ID: 7152 relates to Category No.: 5762; Payload ID: 7154 relates to Category No.: 10056, 2942, 4765, 3673, 9247, 4755; Payload ID: 7155 relates to Category No.: 2890, 1720, 778; Payload ID: 7156 relates to Category No.: 2890, 1842; Payload ID: 7157 relates to Category No.: 9305, 2890, 5776, 9247, 4755; Payload ID: 7158 relates to Category No.: 9305, 6717, 1811; Payload ID: 7159 relates to Category No.: 9305; Payload ID: 7160 relates to Category No.: 5561; Payload ID: 7161 relates to Category No.: 5561, 6717; Payload ID: 7162 relates to Category No.: 5561; Payload ID: 7163 relates to Category No.: 5561; Payload ID: 7164 relates to Category No.: 2901, 5561; Payload ID: 7165 relates to Category No.: 5561, 7061; Payload ID: 7166 relates to Category No.: 2890, 10056, 4010; Payload ID: 7167 relates to Category No.: 5776, 4010, 4030, 7118; Payload ID: 7168 relates to Category No.: 4030; Payload ID: 7169 relates to Category No.: 4029, 9305, 5392; Payload ID: 7170 relates to Category No.:

2890, 5776, 9305, 6717, 2942, 5392, 2889; Payload ID: 7171 relates to Category No.: 2890, 6717, 5776; Payload ID: 7172 relates to Category No.: 4029; Payload ID: 7173 relates to Category No.: 4029, 6717; Payload ID: 7175 relates to Category No.: 2890, 6717; Payload ID: 7176 relates to Category No.: 10056; Payload ID: 7177 relates to Category No.: 4010; Payload ID: 7178 relates to Category No.: 2942, 2890; Payload ID: 7179 relates to Category No.: 2890, 10056, 2942; Payload ID: 7182 relates to Category No.: 5561, 10056; Payload ID: 7183 relates to Category No.: 2890, 2942; Payload ID: 7184 relates to Category No.: 9305, 2890, 2942, 3693, 9247; Payload ID: 7186 relates to Category No.: 4030, 1792; Payload ID: 7187 relates to Category No.: 4029; Payload ID: 7188 relates to Category No.: 7118, 2890, 7068, 14150; Payload ID: 7189 relates to Category No.: 5762; Payload ID: 7190 relates to Category No.: 2890, 10056, 4765, 4755; Payload ID: 7191 relates to Category No.: 9305, 2890, 6717, 9247, 4755, 15573; Payload ID: 7192 relates to Category No.: 3521, 1239; Payload ID: 7193 relates to Category No.: 4030, 4029, 2942, 1239, 4010, 6437, 1017, 9734; Payload ID: 7194 relates to Category No.: 9305, 2890; Payload ID: 7195 relates to Category No.: 9305, 2890; Payload ID: 7196 relates to Category No.: 9305, 2890; Payload ID: 7197 relates to Category No.: 9305, 7118, 7060, 7097; Payload ID: 7198 relates to Category No.: 5561, 10056, 678; Payload ID: 7199 relates to Category No.: 6717, 2942, 276; Payload ID: 7200 relates to Category No.: 2890, 6960, 2938, 14999; Payload ID: 7201 relates to Category No.: 2890, 6960, 2938, 14999; Payload ID: 7202 relates to Category No.: 2890, 6960, 273, 6968, 2938; Payload ID: 7203 relates to Category No.: 4030, 4029, 2890, 4010, 3671, 4763, 10077, 5762; Payload ID: 7204 relates to Category No.: 2890, 14327, 276; Payload ID: 7205 relates to Category No.: 6960, 4755, 7244; Payload ID: 7206 relates to Category No.: 10056, 1748, 11650, 4201, 4863, 2890, 1772, 1017, 8951; Payload ID: 7207 relates to Category No.: 4030; Payload ID: 7208 relates to Category No.: 4030; Payload ID: 7209 relates to Category No.: 4030, 1842, 11883; Payload ID: 7210 relates to Category No.: 4030, 4029, 4010; Payload ID: 7211 relates to Category No.: 4030, 1700, 4010; Payload ID: 7212 relates to Category No.: 4030, 2890; Payload ID: 7213 relates to Category No.: 4030, 4029, 5762, 10056; Payload ID: 7214 relates to Category No.: 7118; Payload ID: 7215 relates to Category No.: 4030; Payload ID: 7216 relates to Category No.: 4030, 4029; Payload ID: 7217 relates to Category No.: 4030, 2890; Payload ID: 7218 relates to Category No.: 9305, 15531, 9155, 9181; Payload ID: 7219 relates to Category No.: 9305, 15505, 9181; Payload ID: 7220 relates to Category No.: 2890, 10056, 2942; Payload ID: 7221 relates to Category No.: 2890, 5776, 10056, 2942, 4765, 3696; Payload ID: 7222 relates to Category No.: 9305, 2890, 10056, 9242, 2942, 3693, 9247, 4755, 2660, 4010, 4852, 1811, 6717, 16164; Payload ID: 7223 relates to Category No.: 10056, 2942, 1774, 4228, 2920; Payload ID: 7224 relates to Category No.: 4029, 7118, 2890, 7052; Payload ID: 7225 relates to Category No.: 4030, 4029, 5762; Payload ID: 7226 relates to Category No.: 4029, 5762; Payload ID: 7227 relates to Category No.: 5561, 7048, 4010, 7118; Payload ID: 7228 relates to Category No.: 4030, 5561, 4029, 6717, 5762, 10056, 5570, 1792, 12406, 4870, 9305, 4049, 2890, 7118, 8948; Payload ID: 7230 relates to Category No.: 4030, 4029, 5762, 15280; Payload ID: 7231 relates to Category No.: 5561, 2890, 6717, 10056, 14409, 9176, 1792, 9181, 9192, 14363; Payload ID: 7232 relates to Category No.: 5561, 10056, 8935, 1792, 6743; Payload ID: 7233 relates to Category No.: 5561, 4010; Payload ID: 7234 relates to Category No.: 5561; Payload ID: 7235 relates to Category No.: 9734, 1748, 11653, 10056; Payload ID: 7236 relates to Category No.: 7118, 7060; Payload ID: 7237 relates to Category No.: 7118, 7060, 7048; Payload ID: 7238 relates to Category No.: 9305; Payload ID: 7239 relates to Category No.: 9305; Payload ID: 7244 relates to Category No.: 5561, 10056, 1748, 915; Payload ID: 7245 relates to Category No.: 5561; Payload ID: 7246 relates to Category No.: 2890; Payload ID: 7247 relates to Category No.: 2693; Payload ID: 7248 relates to Category No.: 2693; Payload ID: 7249 relates to Category No.: 9305, 2890, 9247; Payload ID: 7250 relates to Category No.: 9305; Payload ID: 7251 relates to Category No.: 9305; Payload ID: 7252 relates to Category No.: 6717, 5762, 2942, 2897; Payload ID: 7253 relates to Category No.: 5776; Payload ID: 7254 relates to Category No.: 9305, 7118; Payload ID: 7255 relates to Category No.: 9305, 2890, 6717, 9242, 4755, 9734, 9184; Payload ID: 7256 relates to Category No.: 2890; Payload ID: 7257 relates to Category No.: 6717, 5762, 6994, 14903, 7161, 2918, 9305; Payload ID: 7258 relates to Category No.: 9305, 2890, 2942, 9247, 9184, 2926, 11883; Payload ID: 7259 relates to Category No.: 9305, 2890, 2942, 3036, 9184, 6709, 11883; Payload ID: 7260 relates to Category No.: 5762, 9305, 2890, 10056, 2942, 4228, 2920; Payload ID: 7261 relates to Category No.: 2890, 5762; Payload ID: 7262 relates to Category No.: 6717, 2942, 3693; Payload ID: 7264 relates to Category No.: 5561, 4765, 3673, 3666; Payload ID: 7265 relates to Category No.: 5561, 2890, 6222; Payload ID: 7266 relates to Category No.: 2942; Payload ID: 7267 relates to Category No.: 5561, 6443, 7070; Payload ID: 7268 relates to Category No.: 2942; Payload ID: 7269 relates to Category No.: 2890, 6222; Payload ID: 7270 relates to Category No.: 7118, 2890, 2942, 3666, 9247, 4755; Payload ID: 7271 relates to Category No.: 9242, 2420, 7118; Payload ID: 7272 relates to Category No.: 7118; Payload ID: 7273 relates to Category No.: 5561; Payload ID: 7274 relates to Category No.: 5561; Payload ID: 7275 relates to Category No.: 5561; Payload ID: 7278 relates to Category No.: 5561; Payload ID: 7279 relates to Category No.: 2942, 4010; Payload ID: 7280 relates to Category No.: 5762, 2942, 4010; Payload ID: 7281 relates to Category No.: 2890, 2942; Payload ID: 7282 relates to Category No.: 5039, 10056, 4228, 1336; Payload ID: 7283 relates to Category No.: 5039, 2890, 10056, 4010, 10002, 6440; Payload ID: 7284 relates to Category No.: 5039, 9305, 6717, 10056, 4010, 4228, 6709, 1336, 2942; Payload ID: 7285 relates to Category No.: 5039, 10056, 4010; Payload ID: 7286 relates to Category No.: 5039, 10056, 2942; Payload ID: 7287 relates to Category No.: 5039, 10056, 5762, 3036, 7366, 6717, 11883, 8935; Payload ID: 7288 relates to Category No.: 5039, 10056, 4010; Payload ID: 7289 relates to Category No.: 5039, 9305, 2890, 2194, 10056, 6994, 4010, 6440, 5762, 6717, 11883, 6743; Payload ID: 7290 relates to Category No.: 5039, 2890, 6717, 2194, 10056, 9247, 6994, 4010, 4032, 9305, 2942, 6743; Payload ID: 7291 relates to Category No.: 5039, 2890, 6717, 2194, 10056, 6994, 4010, 6440, 4755, 6743, 16344; Payload ID: 7292 relates to Category No.: 5039, 6717, 10056, 2942, 10002, 10000, 10003, 9999, 9998, 2890, 8948, 779; Payload ID: 7293 relates to Category No.: 5039, 10056, 10002, 10000, 10003, 2942; Payload ID: 7294 relates to Category No.: 5039, 10056, 3666, 4010, 9162, 2942; Payload ID: 7295 relates to Category No.: 9305, 10002, 10056, 7366, 10000; Payload ID: 7296 relates to Category No.: 5039, 6717, 5762, 10056, 4010, 6440, 4032, 9999, 10002, 7366, 2942, 3036, 1711, 10003, 10000; Payload ID: 7297 relates to Category No.: 2918, 2890; Payload ID: 7298 relates to Category No.: 4030, 6717, 10056, 9734, 4010, 4228, 6440, 16156, 7366, 11883, 1711; Payload ID: 7299 relates to Category No.: 14668, 9305, 7118, 2890, 2938, 2942, 6994, 9734, 8948, 3036, 9730, 4010, 9773, 5856, 8935, 1711, 6717; Payload ID: 7300 relates to Category No.: 10056, 4010, 3036, 8935, 1711; Payload ID: 7301 relates to Category No.: 10056, 4010, 6440, 7366; Payload ID: 7302 relates to Category No.: 5039, 10056, 4010; Payload ID: 7303 relates to Category No.: 5039, 10056; Payload ID: 7304 relates to Category No.: 5039, 10056, 4010, 276; Payload ID: 7305 relates to Category No.: 5039, 10056, 3036; Payload ID: 7306 relates to Category No.: 5039, 6717, 10056, 4010; Payload ID: 7307 relates to Category No.: 5039, 10056, 8951, 2942; Payload ID: 7308 relates to Category No.: 5039, 10056, 4010; Payload ID: 7309 relates to Category No.: 5039, 6717, 10056, 4010; Payload ID: 7310 relates to Category No.: 5039, 10056, 4010; Payload ID: 7311 relates to Category No.: 5039, 10056; Payload ID: 7312 relates to Category No.: 5039, 10056, 9999, 10002, 10000; Payload ID: 7313 relates to Category No.: 5039, 10056; Payload ID: 7314 relates to Category No.: 5039, 2890, 10056, 4010, 9184, 10002, 6440, 6717; Payload ID: 7315 relates to Category No.: 5039, 10056, 10002, 10000, 11883, 2890, 1046, 262, 779; Payload ID: 7316 relates to Category No.: 4030, 9305; Payload ID: 7317 relates to Category No.: 9305, 6717, 9242, 5561; Payload ID: 7318 relates to Category No.: 9242, 4030, 9305, 6717, 9247; Payload ID: 7319 relates to Category No.: 9305, 7118, 2890, 6717, 9242, 9247; Payload ID: 7320 relates to Category No.: 2942, 4751; Payload ID: 7321 relates to Category No.: 2942, 4751; Payload ID: 7322 relates to Category No.: 4029, 10056, 2942, 4765; Payload ID: 7323 relates to Category No.: 2942, 4765, 9734; Payload ID: 7324 relates to Category No.: 4765, 9734, 6717; Payload ID: 7325 relates to Category No.: 9305, 4765, 9734; Payload ID: 7326 relates to Category No.: 6717, 4765, 2926; Payload ID: 7327 relates to Category No.: 6717; Payload ID: 7328 relates to Category No.: 4010; Payload ID: 7329 relates to Category No.: 10056, 4919, 14769; Payload ID: 7330 relates to Category No.: 10056, 4919, 14769, 5561, 5762, 11883; Payload ID: 7331 relates to Category No.: 5762, 2890, 5776, 11883, 4919, 14769, 10056; Payload ID: 7332 relates to Category No.: 5561, 10056, 3673, 4919, 14769; Payload ID: 7333 relates to Category No.: 5570, 4919, 14769, 9999, 9192; Payload ID: 7334 relates to Category No.: 5570, 4919, 14769, 9999, 9192, 6717; Payload ID: 7335 relates to Category No.: 10056, 9999, 10002, 6717, 10000; Payload ID: 7336 relates to Category No.: 9999, 10002, 10000; Payload ID: 7337 relates to Category No.: 9999; Payload ID: 7338 relates to Category No.: 4029, 4010; Payload ID: 7339 relates to Category No.: 4029, 4010, 10002; Payload ID: 7340 relates to Category No.: 2942; Payload ID: 7342 relates to Category No.: 7118, 7048; Payload ID: 7343 relates to Category No.: 2890; Payload ID: 7346 relates to Category No.: 9305; Payload ID: 7347 relates to Category No.: 9305, 9247, 273, 4755, 9157, 9273, 9167; Payload ID: 7348 relates to Category No.: 9305, 9157; Payload ID: 7349 relates to Category No.: 9305, 2890, 9273, 4010, 4137; Payload ID: 7350 relates to Category No.: 9305, 9242, 9273; Payload ID: 7351 relates to Category No.: 9305; Payload ID: 7352 relates to Category No.: 9305, 9273, 9190, 15532; Payload ID: 7353 relates to Category No.: 9305, 9273, 9190, 15532; Payload ID: 7354 relates to Category No.: 9305, 9273, 9190, 15532; Payload ID: 7355 relates to Category No.: 9305, 9157, 9273, 4010; Payload ID: 7356 relates to Category No.: 9305, 9157, 9273, 4010; Payload ID: 7357 relates to Category No.: 9305, 9247, 9157, 2420, 15269, 9273, 4010, 14614, 2402, 2632, 6525, 2420, 13728, 16317; Payload ID: 7358 relates to Category No.: 9305, 9242, 9247, 9158, 9157, 9273, 4010, 9158, 15269, 3861, 14530, 1080, 9725, 2628, 2402; Payload ID: 7359 relates to Category No.: 9305, 9247, 9157, 9273, 4010, 9158, 15269, 3861, 1080, 2402; Payload ID: 7360 relates to Category No.: 9305, 9172, 9273, 4010, 9167; Payload ID: 7361 relates to Category No.: 9247, 9273, 9190; Payload ID: 7362 relates to Category No.: 4030, 9305, 9273; Payload ID: 7363 relates to Category No.: 9273, 9184, 9190; Payload ID: 7364 relates to Category No.: 4029, 9305, 9247, 9158, 9273, 4010, 11883, 9190; Payload ID: 7365 relates to Category No.: 4029, 9305, 9247, 9158, 9273, 4010, 11883, 9190; Payload ID: 7366 relates to Category No.: 9273, 9167; Payload ID: 7367 relates to Category No.: 9305; Payload ID: 7368 relates to Category No.: 9305; Payload ID: 7369 relates to Category No.: 9305; Payload ID: 7370 relates to Category No.: 9305, 9155, 5110; Payload ID: 7371 relates to Category No.: 4010; Payload ID: 7372 relates to Category No.: 7118; Payload ID: 7373 relates to Category No.: 4030, 4029, 1239, 4010, 4942, 3637; Payload ID: 7374 relates to Category No.: 4029, 1239, 4010, 14852; Payload ID: 7375 relates to Category No.: 5561, 7118; Payload ID: 7376 relates to Category No.: 9305, 2890, 2194; Payload ID: 7377 relates to Category No.: 9305, 2890, 6717, 5762, 10056, 2942, 4765, 4755, 9734, 5776; Payload ID: 7378 relates to Category No.: 2890, 6960, 2194, 14906, 4945; Payload ID: 7379 relates to Category No.: 2890, 2194, 2942, 9247, 4755, 4945, 14902; Payload ID: 7380 relates to Category No.: 2890, 6960, 2194, 14893, 4945; Payload ID: 7381 relates to Category No.: 2890, 6960, 2194, 14893, 4945; Payload ID: 7382 relates to Category No.: 2890, 6960, 2194, 14893, 4945; Payload ID: 7383 relates to Category No.: 2890, 6976, 6960, 2194, 9247, 14893, 4945; Payload ID: 7384 relates to Category No.: 2890, 6960, 2194, 10056, 9242, 14893, 4945; Payload ID: 7385 relates to Category No.: 2890, 2194, 14906, 4945, 9186; Payload ID: 7386 relates to Category No.: 6717, 5762, 4010, 5561; Payload ID: 7387 relates to Category No.: 6443, 9305, 2942, 4043, 15627, 4755, 276, 1774, 4228, 1659; Payload ID: 7388 relates to Category No.: 7118, 15505, 3666, 2899, 273, 7070, 6017, 14368, 9184, 7052, 9162, 2890; Payload ID: 7389 relates to Category No.: 7118, 3666; Payload ID: 7390 relates to Category No.: 4010, 7118; Payload ID: 7392 relates to Category No.: 9305, 2890, 6717; Payload ID: 7393 relates to Category No.: 9305, 2890, 9242, 9247, 14253; Payload ID: 7394 relates to Category No.: 15505, 9157, 11883, 9305; Payload ID: 7395 relates to Category No.: 5561, 4029, 4008, 1792, 1811; Payload ID: 7396 relates to Category No.: 9305, 7118, 6717, 9242, 14671, 192, 15783; Payload ID: 7400 relates to Category No.: 6717, 4010; Payload ID: 7403 relates to Category No.: 4029, 2890, 2942, 9247, 4010, 3637, 9305, 6960; Payload ID: 7404 relates to Category No.: 7118, 2890, 6717, 7060, 4010; Payload ID: 7405 relates to Category No.: 9305, 2890, 5762, 9247, 4755; Payload ID: 7406 relates to Category No.: 4030, 9305, 2890, 2938, 2942, 11836, 14893, 4010, 4228, 10056, 5762, 16326, 2649; Payload ID: 7407 relates to Category No.: 9305, 2890, 2942; Payload ID: 7408 relates to Category No.: 9305, 2890; Payload ID: 7409 relates to Category No.: 9305, 2890, 1377, 7118, 273; Payload ID: 7410 relates to Category No.: 4030, 7118, 2890, 6717, 7048, 2942, 3521, 2534, 7060, 14409, 4010, 1792, 11883, 6246, 2535, 2829, 10056, 5776, 7366, 4755, 6743, 16344, 14293, 7032; Payload ID: 7412 relates to Category No.: 4010; Payload ID: 7413 relates to Category No.: 14174, 6717, 2942; Payload ID: 7414 relates to Category No.: 2890, 2942, 15892, 9247, 9734, 2183, 1239, 4228, 5412; Payload ID: 7415 relates to Category No.: 2890, 2942, 15892, 9247, 9734, 2183, 1239, 4228, 5412; Payload ID: 7416 relates to Category No.: 2942, 9247, 2660, 1239, 1711, 16336, 7118, 7060; Payload ID: 7417 relates to Category No.: 9305, 6717, 2942, 1239, 4010, 1657, 1792, 7118, 6525, 7366, 15173; Payload ID: 7418 relates to Category No.: 2942, 4010; Payload ID: 7419 relates to Category No.: 9305, 2890, 2942; Payload ID: 7420 relates to Category No.: 9305, 6717, 3673, 3666, 6994, 2660, 5557, 4010, 4228, 6709, 3671, 3685, 3668, 1792, 10056, 7366, 7118, 14683; Payload ID: 7421 relates to Category No.: 2890, 2942, 2660, 2183, 1239, 4010; Payload ID: 7422 relates to Category No.: 4030, 9305, 6717, 5762, 10056, 9242, 2942, 15892, 14145, 9247, 14912, 1239, 4010, 4228, 6709, 6437, 12218, 2509, 7366; Payload ID: 7423 relates to Category No.: 7118, 2890, 9242, 4010, 4228, 7068, 7366; Payload ID: 7424 relates to Category No.: 9305, 9247, 2938; Payload ID: 7426 relates to Category No.: 5776, 3666, 4010; Payload ID: 7427 relates to Category No.: 4029, 9305, 2890, 6717, 10056, 2942, 9247, 4010, 6709, 6437, 3637, 5762, 14329, 7366; Payload ID: 7428 relates to Category No.: 7118, 2890, 6717, 2942, 9247, 2660, 4010, 6709, 5762, 1099, 1792, 1336, 779, 5412; Payload ID: 7429 relates to Category No.: 4029, 9305, 6717, 2942, 3673, 4014, 3666, 6994, 9734, 4010, 4228, 6709, 3671, 3637, 10056, 3668; Payload ID: 7430 relates to Category No.: 11728, 5797, 2455, 4010, 2194, 2458; Payload ID: 7431 relates to Category No.: 9305, 2890; Payload ID: 7432 relates to Category No.: 9305, 2890; Payload ID: 7433 relates to Category No.: 9305, 2890, 2942, 9247, 11793, 11883; Payload ID: 7434 relates to Category No.: 9305, 2890; Payload ID: 7435 relates to Category No.: 2942; Payload ID: 7436 relates to Category No.: 9305, 9247; Payload ID: 7437 relates to Category No.: 9305; Payload ID: 7438 relates to Category No.: 9305, 2890; Payload ID: 7439 relates to Category No.: 9305, 2890; Payload ID: 7440 relates to Category No.: 9305, 2890; Payload ID: 7441 relates to Category No.: 9305, 2890; Payload ID: 7442 relates to Category No.: 9305, 2890, 4010, 7118, 2942, 9756; Payload ID: 7443 relates to Category No.: 9305, 2890, 6717, 9247, 2183, 7048; Payload ID: 7444 relates to Category No.: 2890, 2899; Payload ID: 7445 relates to Category No.: 2890, 2942; Payload ID: 7446 relates to Category No.: 2942, 9734; Payload ID: 7447 relates to Category No.: 2890, 6717, 2942, 4755; Payload ID: 7448 relates to Category No.: 9305, 2890, 2942; Payload ID: 7449 relates to Category No.: 4765, 3666, 4760; Payload ID: 7450 relates to Category No.: 2890; Payload ID: 7451 relates to Category No.: 2890; Payload ID: 7452 relates to Category No.: 2890, 9734; Payload ID: 7454 relates to Category No.: 2942; Payload ID: 7455 relates to Category No.: 2890; Payload ID: 7456 relates to Category No.: 9305, 2890, 6717, 9247, 4010; Payload ID: 7457 relates to Category No.: 5561, 3673; Payload ID: 7458 relates to Category No.: 5561, 3673, 3666, 9734; Payload ID: 7459 relates to Category No.: 4029, 2890, 5570, 2446, 1792; Payload ID: 7460 relates to Category No.: 2890, 544; Payload ID: 7461 relates to Category No.: 9305, 6717, 5561; Payload ID: 7462 relates to Category No.: 6717, 9247; Payload ID: 7463 relates to Category No.: 9305, 2420, 2192, 9725; Payload ID: 7464 relates to Category No.: 9242, 9247; Payload ID: 7465 relates to Category No.: 9305, 2890, 6717, 9242, 9247; Payload ID: 7466 relates to Category No.: 9305, 15505; Payload ID: 7467 relates to Category No.: 9305; Payload ID: 7468 relates to Category No.: 9305, 2890, 10056; Payload ID: 7469 relates to Category No.: 5561, 6717, 10056, 1792; Payload ID: 7470 relates to Category No.: 9305, 7118, 2890, 6717, 15505; Payload ID: 7471 relates to Category No.: 2890, 2942; Payload ID: 7472 relates to Category No.: 9305, 2942, 7118; Payload ID: 7473 relates to Category No.: 9305, 2890, 12170; Payload ID: 7474 relates to Category No.: 4029, 2890, 4010; Payload ID: 7475 relates to Category No.: 7118, 2890, 4010; Payload ID: 7476 relates to Category No.: 4030, 9305, 6717, 3673, 3666, 9734, 2942, 1659, 9242; Payload ID: 7477 relates to Category No.: 6717, 10056, 3673, 5561; Payload ID: 7478 relates to Category No.: 4014, 4010, 1090, 4029, 1720, 1748; Payload ID: 7479 relates to Category No.: 4029, 1090, 1720, 1748, 6717; Payload ID: 7480 relates to Category No.: 7118; Payload ID: 7481 relates to Category No.: 4030, 12439, 10056, 5570, 9734, 3521, 4008, 2926, 5049, 778, 1084, 15285, 5561; Payload ID: 7482 relates to Category No.: 4030, 10056, 677, 5049, 1256, 10062, 1792, 1099; Payload ID: 7483 relates to Category No.: 9247; Payload ID: 7484 relates to Category No.: 4029, 6717, 2950, 2942, 1239, 4010, 4995, 4942, 3637; Payload ID: 7485 relates to Category No.: 4029, 6717, 2950, 2942, 1239, 4010, 4995, 4942, 3637; Payload ID: 7486 relates to Category No.: 4029, 2942, 1239, 4010, 4995, 4942, 3637; Payload ID: 7487 relates to Category No.: 4995, 2942, 1239, 5561; Payload ID: 7488 relates to Category No.: 2942, 1239, 4995; Payload ID: 7489 relates to Category No.: 2942, 4995; Payload ID: 7490 relates to Category No.: 4995, 2942, 1239; Payload ID: 7491 relates to Category No.: 4010, 4995; Payload ID: 7492 relates to Category No.: 4995; Payload ID: 7493 relates to Category No.: 4010, 4995; Payload ID: 7494 relates to Category No.: 4030, 4029, 1239, 4010, 3637; Payload ID: 7495 relates to Category No.: 9535; Payload ID: 7496 relates to Category No.: 5561, 2194, 4765, 6994, 4755, 14893; Payload ID: 7497 relates to Category No.: 5561, 4763; Payload ID: 7498 relates to Category No.: 5561, 4765; Payload ID: 7499 relates to Category No.: 5561, 4765; Payload ID: 7500 relates to Category No.: 4765, 5570; Payload ID: 7501 relates to Category No.: 5561, 4765; Payload ID: 7502 relates to Category No.: 5561, 4765; Payload ID: 7503 relates to Category No.: 5561, 4765; Payload ID: 7504 relates to Category No.: 5561, 6717, 4765; Payload ID: 7505 relates to Category No.: 5561, 4765, 5570; Payload ID: 7506 relates to Category No.: 5561, 4765, 9247, 4010; Payload ID: 7507 relates to Category No.: 5561; Payload ID: 7508 relates to Category No.: 4030, 4029, 10056, 4014, 4010, 4228, 4763, 6437, 1090, 12159, 1083; Payload ID: 7509 relates to Category No.: 5561, 6440; Payload ID: 7510 relates to Category No.: 6443, 4029, 9305, 6717, 5776, 9247, 6440, 6437, 6743; Payload ID: 7511 relates to Category No.: 6717, 5762, 10056, 12159; Payload ID: 7512 relates to Category No.: 4030, 4029, 10056, 5570, 1792, 3638, 2503; Payload ID: 7513 relates to Category No.: 5561, 2890, 1811, 1017, 6717; Payload ID: 7514 relates to Category No.: 9305; Payload ID: 7515 relates to Category No.: 5561, 7244; Payload ID: 7516 relates to Category No.: 5561, 4010, 1792; Payload ID: 7517 relates to Category No.: 2890; Payload ID: 7518 relates to Category No.: 4030, 4029, 6717, 10077; Payload ID: 7519 relates to Category No.: 5762, 2890, 5776, 2942, 3693, 3521, 4010, 3523, 7324; Payload ID: 7520 relates to Category No.: 9305, 2890, 9247, 15505; Payload ID: 7521 relates to Category No.: 9305, 9247; Payload ID: 7523 relates to Category No.: 4030, 2890, 9247, 15531, 9305; Payload ID: 7524 relates to Category No.: 9305, 7118, 9247; Payload ID: 7525 relates to Category No.: 9247, 9305, 2890; Payload ID: 7526 relates to Category No.: 4030, 4029, 1700, 9305, 2890, 774; Payload ID: 7527 relates to Category No.: 5561, 5762, 10056, 1099, 9734; Payload ID: 7528 relates to Category No.: 5561; Payload ID: 7529 relates to Category No.: 5561, 6717, 10056, 3673, 5570, 8948, 1811, 4010, 9184, 1792; Payload ID: 7530 relates to Category No.: 6443, 2890, 5570, 2899, 1236; Payload ID: 7531 relates to Category No.: 1234, 2890; Payload ID: 7532 relates to Category No.: 6443, 2890, 6717, 6709, 1236, 10081, 2899; Payload ID: 7533 relates to Category No.: 1234; Payload ID: 7534 relates to Category No.: 6717, 3666, 3523, 1234; Payload ID: 7535 relates to Category No.: 5561; Payload ID: 7536 relates to Category No.: 4029; Payload ID: 7537 relates to Category No.: 5561, 1842; Payload ID: 7539 relates to Category No.: 9305, 9247, 2890, 5762; Payload ID: 7540 relates to Category No.: 9305; Payload ID: 7541 relates to Category No.: 9305; Payload ID: 7542 relates to Category No.: 9305; Payload ID: 7543 relates to Category No.: 9247, 1842; Payload ID: 7544 relates to Category No.: 9305, 15505; Payload ID: 7545 relates to Category No.: 9305; Payload ID: 7546 relates to Category No.: 9305, 2890, 9247; Payload ID: 7547 relates to Category No.: 9305, 2890, 9247, 15531, 14583; Payload ID: 7548 relates to Category No.: 9305, 2890, 9247; Payload ID: 7549 relates to Category No.: 9305; Payload ID: 7550 relates to Category No.: 9305, 2420, 9273; Payload ID: 7551 relates to Category No.: 9305, 2890, 14145, 9247, 14253; Payload ID: 7552 relates to Category No.: 9305, 14145, 9247; Payload ID: 7553 relates to Category No.: 2890, 6717, 14145, 9247, 14912, 4010, 5730, 1635, 9305; Payload ID: 7554 relates to Category No.: 2890, 14912; Payload ID: 7555 relates to Category No.: 9305, 2890, 6717, 14145, 9247, 14912, 1635; Payload ID: 7556 relates to Category No.: 9305, 14145, 9247, 1635, 2890, 8935, 6813, 14150; Payload ID: 7557 relates to Category No.: 16195, 14145, 9305, 6717, 2942, 9247, 9157, 14912, 4010, 1635, 11883; Payload ID: 7558 relates to Category No.: 9305, 14145; Payload ID: 7559 relates to Category No.: 9305, 14145; Payload ID: 7560 relates to Category No.: 9305; Payload ID: 7561 relates to Category No.: 9305; Payload ID: 7562 relates to Category No.: 9305, 2942, 14145, 9247, 4010; Payload ID: 7563 relates to Category No.: 9305, 2890, 9247, 14912, 4010, 16195, 14145; Payload ID: 7564 relates to Category No.: 9305, 6717, 9247, 1635; Payload ID: 7565 relates to Category No.: 9305, 6717, 9247, 1635; Payload ID: 7566 relates to Category No.: 9305, 6717, 14145, 9247; Payload ID: 7567 relates to Category No.: 9305, 9247, 14912; Payload ID: 7568 relates to Category No.: 9305, 2890, 6717, 9247, 9157, 4010, 1774, 10106, 1635, 4228, 2942, 7118, 3055, 1033, 11650, 1720, 12170; Payload ID: 7569 relates to Category No.: 9305; Payload ID: 7570 relates to Category No.: 9305, 6717, 14145, 16195; Payload ID: 7571 relates to Category No.: 6717, 9242, 4014, 5570, 9247, 14912, 4010, 1635, 9181, 9578, 1792; Payload ID: 7572 relates to Category No.: 2890, 14145, 9247, 14912, 1635, 9305, 3036, 1033, 4860, 16195; Payload ID: 7573 relates to Category No.: 9305, 6717, 14145, 9247, 1792, 1635, 2907, 2757; Payload ID: 7574 relates to Category No.: 9305, 14145, 9247, 16195; Payload ID: 7575 relates to Category No.: 9305, 6717; Payload ID: 7576 relates to Category No.: 9305, 2890, 9247; Payload ID: 7577 relates to Category No.: 9305, 2890, 9247; Payload ID: 7578 relates to Category No.: 2942, 7118, 7070, 2458, 6743, 14833; Payload ID: 7579 relates to Category No.: 6717, 2942, 7070, 7118; Payload ID: 7580 relates to Category No.: 2942, 7118; Payload ID: 7581 relates to Category No.: 2942; Payload ID: 7582 relates to Category No.: 9305, 2890; Payload ID: 7583 relates to Category No.: 6717, 4010, 1050, 6437; Payload ID: 7584 relates to Category No.: 6717, 4010, 1050, 6437, 6443, 262; Payload ID: 7585 relates to Category No.: 3671, 2890, 7118, 5776; Payload ID: 7586 relates to Category No.: 5776; Payload ID: 7587 relates to Category No.: 4030, 4029, 2890, 14293; Payload ID: 7588 relates to Category No.: 1842; Payload ID: 7589 relates to Category No.: 4029, 6717, 1842; Payload ID: 7590 relates to Category No.: 4029; Payload ID: 7591 relates to Category No.: 2890, 4755, 2901, 4010, 4779, 4764, 4047; Payload ID: 7592 relates to Category No.: 5561, 7048, 13749, 11883; Payload ID: 7593 relates to Category No.: 5561; Payload ID: 7594 relates to Category No.: 5561; Payload ID: 7595 relates to Category No.: 5561, 7048, 13749; Payload ID: 7596 relates to Category No.: 5561; Payload ID: 7597 relates to Category No.: 2890, 9305, 10056, 5059; Payload ID: 7598 relates to Category No.: 9305; Payload ID: 7599 relates to Category No.: 9247, 2420; Payload ID: 7600 relates to Category No.: 9305, 15505, 2942, 9247, 4228, 14253, 14443; Payload ID: 7601 relates to Category No.: 9305, 9247, 9158, 14653, 12170, 14443, 2402; Payload ID: 7602 relates to Category No.: 4030, 4029, 9305, 10056, 2942, 9247, 1792, 15531, 3685, 2628, 3521; Payload ID: 7603 relates to Category No.: 4030, 9305, 2890, 1700, 9247, 9734, 9157, 11883, 2628; Payload ID: 7604 relates to Category No.: 9305, 2420; Payload ID: 7605 relates to Category No.: 9305, 2420; Payload ID: 7606 relates to Category No.: 9305, 2890, 2402; Payload ID: 7607 relates to Category No.: 9305, 2890, 9247, 2402; Payload ID: 7608 relates to Category No.: 9305, 2402; Payload ID: 7609 relates to Category No.: 9305, 2402, 2890, 9247; Payload ID: 7610 relates to Category No.: 9305, 5776, 9242, 2402, 9247; Payload ID: 7611 relates to Category No.: 9305; Payload ID: 7612 relates to Category No.: 1017, 8949, 9730, 3040, 3037, 3057; Payload ID: 7613 relates to Category No.: 5762; Payload ID: 7614 relates to Category No.: 4010; Payload ID: 7615 relates to Category No.: 5561; Payload ID: 7616 relates to Category No.: 5561; Payload ID: 7617 relates to Category No.: 5561; Payload ID: 7618 relates to Category No.: 9305, 9242, 9247; Payload ID: 7619 relates to Category No.: 2890, 2942, 8935, 9247, 4010; Payload ID: 7620 relates to Category No.: 5561, 2890, 10056, 5570, 9247; Payload ID: 7621 relates to Category No.: 5561, 10056, 5570; Payload ID: 7622 relates to Category No.: 5561, 10056, 5570; Payload ID: 7623 relates to Category No.: 5561, 10056, 2942, 5570, 6717; Payload ID: 7624 relates to Category No.: 4029; Payload ID: 7625 relates to Category No.: 4029; Payload ID: 7626 relates to Category No.: 2890, 2942; Payload ID: 7627 relates to Category No.: 2942; Payload ID: 7628 relates to Category No.: 2942, 16326, 14370, 14371; Payload ID: 7629 relates to Category No.: 5561; Payload ID: 7630 relates to Category No.: 9305, 2890, 2938, 10056, 4010, 5110; Payload ID: 7631 relates to Category No.: 7118, 9242; Payload ID: 7632 relates to Category No.: 7118, 2890, 9242, 4010; Payload ID: 7633 relates to Category No.: 4029, 10056, 1239, 4010, 10077; Payload ID: 7634 relates to Category No.: 7118, 2890, 2942; Payload ID: 7635 relates to Category No.: 7118, 2890, 7060; Payload ID: 7636 relates to Category No.: 5561, 6717, 10056, 3673, 3666, 1792, 5560, 14293, 3104, 5556; Payload ID: 7637 relates to Category No.: 6717, 2942, 5762; Payload ID: 7639 relates to Category No.: 4030, 2890; Payload ID: 7640 relates to Category No.: 9305, 2890, 5776, 9247, 9157, 11883, 9158, 15269, 9181; Payload ID: 7641 relates to Category No.: 9305, 9247, 9157, 4010, 11883, 10104; Payload ID: 7642 relates to Category No.: 9305, 9157, 9273, 9167; Payload ID: 7643 relates to Category No.: 9305, 9157, 9172, 9273, 4010; Payload ID: 7644 relates to Category No.: 9305, 9273, 9167, 15532; Payload ID: 7645 relates to Category No.: 9305, 9157, 9273, 9167; Payload ID: 7646 relates to Category No.: 9305, 9172, 9273, 4010; Payload ID: 7647 relates to Category No.: 9305, 9273, 5762, 2632; Payload ID: 7648 relates to Category No.: 9305, 9157, 9273, 4010, 9158, 15269; Payload ID: 7649 relates to Category No.: 9305, 9157, 9273, 4010; Payload ID: 7650 relates to Category No.: 9305, 9157, 9273, 4010; Payload ID: 7651 relates to Category No.: 9305, 9157, 9273, 4010;

Payload ID: 7652 relates to Category No.: 9305, 9157, 9273, 4010; Payload ID: 7653 relates to Category No.: 9305, 9157, 9273, 4010; Payload ID: 7654 relates to Category No.: 9305, 9157, 9273, 4010; Payload ID: 7655 relates to Category No.: 9305, 9157, 9273, 4010; Payload ID: 7656 relates to Category No.: 9305, 9157, 9273, 4010; Payload ID: 7657 relates to Category No.: 9305, 9157, 9273, 4010; Payload ID: 7658 relates to Category No.: 9305, 9157, 9273, 4010; Payload ID: 7659 relates to Category No.: 9305, 9157, 9273, 4010; Payload ID: 7660 relates to Category No.: 9305, 9247, 9273, 9190, 9158, 15269, 4053; Payload ID: 7661 relates to Category No.: 9305, 9247, 9273, 9158, 15269, 4030; Payload ID: 7662 relates to Category No.: 4030, 9305, 9247, 9273, 4010, 9190; Payload ID: 7663 relates to Category No.: 9305, 9247, 9273, 4010, 9190; Payload ID: 7664 relates to Category No.: 9273, 4030, 9305, 9247, 4010, 9190; Payload ID: 7665 relates to Category No.: 4030, 9305, 9247, 9273, 4010, 9190; Payload ID: 7666 relates to Category No.: 4030, 9305, 9247, 9273, 4010, 9190; Payload ID: 7667 relates to Category No.: 9305, 9247, 9273, 4010; Payload ID: 7668 relates to Category No.: 4030, 9305, 9247, 9273, 4010, 9190; Payload ID: 7669 relates to Category No.: 4030, 9305, 9247, 9273, 9190; Payload ID: 7670 relates to Category No.: 4030, 9305, 9247, 9273, 9190; Payload ID: 7671 relates to Category No.: 9305, 9247, 9273, 4010, 9190; Payload ID: 7672 relates to Category No.: 9305, 9247, 9273, 4010; Payload ID: 7673 relates to Category No.: 9305, 9247, 9273, 4010, 9190; Payload ID: 7674 relates to Category No.: 9305, 9247, 9273; Payload ID: 7675 relates to Category No.: 4029, 9305, 6717, 9247, 9158, 9273, 4010, 11883, 9190; Payload ID: 7676 relates to Category No.: 4029, 9305, 6717, 9247, 9158, 9273, 4010, 11883, 9190; Payload ID: 7677 relates to Category No.: 4029, 9305, 6717, 9247, 9158, 9273, 4010, 11883, 9190; Payload ID: 7678 relates to Category No.: 4029, 9305, 6717, 9247, 9158, 9273, 4010, 11883, 9190; Payload ID: 7679 relates to Category No.: 9273, 4029, 9305, 6717, 9247, 9158, 4010, 11883, 9190; Payload ID: 7680 relates to Category No.: 4029, 9305, 6717, 9247, 9158, 9273, 4010, 11883, 9190; Payload ID: 7681 relates to Category No.: 4029, 9305, 6717, 9247, 9158, 9273, 4010, 11883, 9190; Payload ID: 7682 relates to Category No.: 4029, 9305, 6717, 9247, 9158, 9273, 4010, 11883, 9190; Payload ID: 7683 relates to Category No.: 4029, 9305, 6717, 9247, 9158, 9273, 4010, 11883, 9190; Payload ID: 7684 relates to Category No.: 4029, 9305, 6717, 9247, 9158, 9273, 4010, 11883, 9190; Payload ID: 7685 relates to Category No.: 4029, 9305, 6717, 9247, 9158, 9273, 4010, 11883, 9158, 15269; Payload ID: 7686 relates to Category No.: 4029, 9305, 6717, 9247, 9158, 9273, 4010, 11883, 9158, 15269; Payload ID: 7687 relates to Category No.: 4029, 9305, 6717, 9247, 9158, 9273, 4010, 11883, 9158, 15269; Payload ID: 7688 relates to Category No.: 4029, 9305, 6717, 9247, 9158, 9273, 4010, 11883, 9158, 15269; Payload ID: 7689 relates to Category No.: 4029, 9305, 6717, 9247, 9158, 9273, 4010, 11883, 9158, 15269; Payload ID: 7690 relates to Category No.: 4029, 9305, 6717, 9247, 9158, 9273, 4010, 11883, 9158, 15269; Payload ID: 7691 relates to Category No.: 9305, 9273; Payload ID: 7692 relates to Category No.: 9305, 9273, 4029, 6717, 9247, 9158, 4010, 11883, 9158, 15269; Payload ID: 7693 relates to Category No.: 4029, 9305, 6717, 9247, 9158, 9273, 4010, 11883, 9158, 15269; Payload ID: 7694 relates to Category No.: 4029, 9305, 6717, 9247, 9158, 9273, 4010, 11883, 9158, 15269; Payload ID: 7695 relates to Category No.: 4029, 9305, 6717, 9247, 9158, 9273, 4010, 11883, 9158, 15269; Payload ID: 7696 relates to Category No.: 4029, 9305, 6717, 9247, 9158, 9273, 4010, 11883, 9158, 15269; Payload ID: 7697 relates to Category No.: 9305, 9157, 9273, 4010; Payload ID: 7698 relates to Category No.: 9305, 9157, 9273, 4010; Payload ID: 7699 relates to Category No.: 9305, 9157, 9273, 4010; Payload ID: 7700 relates to Category No.: 9305, 9157, 9273, 4010; Payload ID: 7701 relates to Category No.: 4030, 9305, 9247, 9273, 4010, 9190; Payload ID: 7702 relates to Category No.: 9305, 9247, 9273, 4010, 9190; Payload ID: 7703 relates to Category No.: 9305, 9273; Payload ID: 7704 relates to Category No.: 4029, 9305, 9247, 9273, 4010; Payload ID: 7705 relates to Category No.: 4029, 9305, 9247, 9273, 4010; Payload ID: 7706 relates to Category No.: 4029, 9305, 9247, 9273, 4010; Payload ID: 7707 relates to Category No.: 4029, 9305, 6717, 9247, 9158, 9273, 4010, 11883, 9158, 15269; Payload ID: 7708 relates to Category No.: 4029, 9305, 6717, 9247, 9158, 9273, 4010, 11883, 9158, 15269; Payload ID: 7709 relates to Category No.: 9305, 9273, 4010, 9190; Payload ID: 7710 relates to Category No.: 9305, 9247, 9273, 9190; Payload ID: 7711 relates to Category No.: 9305, 9247, 9273, 4010, 9190, 9158, 15269; Payload ID: 7712 relates to Category No.: 4029, 9305, 6717, 9247, 9158, 9273, 4010, 11883, 9158, 15269; Payload ID: 7713 relates to Category No.: 9305, 2890, 2942, 2247, 2402, 9157, 9311, 11883, 5110, 14583; Payload ID: 7714 relates to Category No.: 9305, 2890, 9247, 5110; Payload ID: 7715 relates to Category No.: 9305, 10056, 4010, 5110; Payload ID: 7716 relates to Category No.: 9305, 2890, 9247, 9157, 9311, 11883, 14583, 3861, 2402, 5561; Payload ID: 7717 relates to Category No.: 9305, 2890, 10056, 2942, 9247, 4755, 14902, 15531, 5110; Payload ID: 7718 relates to Category No.: 9305, 2890, 9247, 15531, 5110, 2942, 8917, 375, 11883, 16326, 14364, 196; Payload ID: 7719 relates to Category No.: 9305, 2890, 9247, 4755, 5110, 2942, 9155, 11883; Payload ID: 7720 relates to Category No.: 9305, 3509, 2890, 6960, 2942, 9247, 9734, 3036, 6964, 1017, 1750, 9730, 493, 1659, 5110, 5412, 11883, 2901; Payload ID: 7721 relates to Category No.: 9305, 2890, 9247, 5110; Payload ID: 7722 relates to Category No.: 9305, 2890, 10056, 2942, 9247, 9158, 5110; Payload ID: 7723 relates to Category No.: 9305, 2890, 15505, 9247, 5110, 5216; Payload ID: 7724 relates to Category No.: 9305, 9247, 1377; Payload ID: 7725 relates to Category No.: 9305, 2890, 6717, 9162; Payload ID: 7726 relates to Category No.: 9247, 9305, 15851, 15858; Payload ID: 7727 relates to Category No.: 5762, 9305; Payload ID: 7729 relates to Category No.: 5561, 6717, 6942; Payload ID: 7730 relates to Category No.: 9305, 1842; Payload ID: 7731 relates to Category No.: 9312; Payload ID: 7732 relates to Category No.: 9247; Payload ID: 7733 relates to Category No.: 5561, 2927, 4760, 7324; Payload ID: 7734 relates to Category No.: 9305, 9247, 2890, 11883, 10002, 11793, 15505; Payload ID: 7735 relates to Category No.: 9305, 9247, 15505; Payload ID: 7737 relates to Category No.: 9305, 2890, 9242, 2420, 2192, 9247, 2630; Payload ID: 7738 relates to Category No.: 7118, 2890, 2942, 2402, 9181, 9178; Payload ID: 7739 relates to Category No.: 7118, 7048; Payload ID: 7740 relates to Category No.: 9305; Payload ID: 7741 relates to Category No.: 9305, 2890, 15505; Payload ID: 7742 relates to Category No.: 9305, 15505, 11883, 12170; Payload ID: 7743 relates to Category No.: 9305, 9247, 5730; Payload ID: 7744 relates to Category No.: 9247, 9305; Payload ID: 7745 relates to Category No.: 9247; Payload ID: 7746 relates to Category No.: 9305; Payload ID: 7747 relates to Category No.: 9305; Payload ID: 7748 relates to Category No.: 9305; Payload ID: 7749 relates to Category No.: 9305; Payload ID: 7750 relates to Category No.: 9305, 9247, 2890, 15505; Payload ID: 7751 relates to Category No.: 9305, 2890, 9242; Payload ID: 7752 relates to Category No.: 9305; Payload ID: 7753 relates to Category No.: 9247, 15505; Payload ID: 7754 relates to Category No.: 9305, 2890; Payload ID: 7755 relates to Category No.: 9305; Payload ID: 7756 relates to Category No.: 9305; Payload ID: 7757 relates to Category No.: 9305; Payload ID: 7758 relates to Category No.: 9305; Payload ID: 7759 relates to Category No.: 9305, 2890, 9247; Payload ID: 7760 relates to Category No.: 9305; Payload ID: 7761 relates to Category No.: 9305, 7118, 9247; Payload ID: 7762 relates to Category No.: 9247, 2829; Payload ID: 7763 relates to Category No.: 2890, 9247; Payload ID: 7764 relates to Category No.: 9305; Payload ID: 7765 relates to Category No.: 9305; Payload ID: 7766 relates to Category No.: 9305; Payload ID: 7767 relates to Category No.: 9247, 1748; Payload ID: 7768 relates to Category No.: 2890, 9247; Payload ID: 7769 relates to Category No.: 9247, 6968, 9305; Payload ID: 7770 relates to Category No.: 9305; Payload ID: 7771 relates to Category No.: 9305, 2890, 9247, 9158, 15269; Payload ID: 7772 relates to Category No.: 9305; Payload ID: 7773 relates to Category No.: 9305; Payload ID: 7774 relates to Category No.: 9247, 9305; Payload ID: 7775 relates to Category No.: 9305, 15505; Payload ID: 7776 relates to Category No.: 9305; Payload ID: 7777 relates to Category No.: 9247, 9305; Payload ID: 7778 relates to Category No.: 9305; Payload ID: 7779 relates to Category No.: 9305; Payload ID: 7780 relates to Category No.: 9305; Payload ID: 7781 relates to Category No.: 9305, 2890, 9215, 10104; Payload ID: 7782 relates to Category No.: 9305, 2890, 9155, 10104, 14253; Payload ID: 7783 relates to Category No.: 9305, 2890, 10104; Payload ID: 7784 relates to Category No.: 2890, 9305; Payload ID: 7785 relates to Category No.: 10056, 1748, 11653, 8951, 2890, 6717, 1017, 8935, 2738, 11650, 16326, 778; Payload ID: 7786 relates to Category No.: 9305, 2890, 10056, 9242, 9247, 1748, 11653, 8951, 778, 3036, 8948; Payload ID: 7787 relates to Category No.: 2890, 10056, 1748, 11653, 1842, 8951, 2942, 11650, 1084; Payload ID: 7788 relates to Category No.: 4010; Payload ID: 7790 relates to Category No.: 5561; Payload ID: 7791 relates to Category No.: 6717, 3673, 3666, 1402, 6162, 5561; Payload ID: 7792 relates to Category No.: 2942, 4010; Payload ID: 7793 relates to Category No.: 6960, 5257, 4172, 6968; Payload ID: 7794 relates to Category No.: 6960, 2194, 5257, 4172; Payload ID: 7795 relates to Category No.: 2890, 6976, 6960, 2194, 2477, 4755, 9727, 5257, 4172, 2182; Payload ID: 7796 relates to Category No.: 9305; Payload ID: 7797 relates to Category No.: 9305, 2420, 2632, 15173; Payload ID: 7798 relates to Category No.: 9305, 2420, 15173; Payload ID: 7799 relates to Category No.: 2890; Payload ID: 7800 relates to Category No.: 9305, 2890, 9734, 4010, 5942, 1738, 2701; Payload ID: 7801 relates to Category No.: 9305, 7118, 2890, 6717, 9247, 8948, 14529, 5102, 7179, 7180, 401, 14355, 3036, 1017; Payload ID: 7802 relates to Category No.: 2890, 9247; Payload ID: 7803 relates to Category No.: 9305, 2890, 10056, 9247; Payload ID: 7804 relates to Category No.: 9305; Payload ID: 7806 relates to Category No.: 5561, 2890; Payload ID: 7808 relates to Category No.: 7118, 2890, 2194, 10056; Payload ID: 7809 relates to Category No.: 2890; Payload ID: 7810 relates to Category No.: 2890; Payload ID: 7812 relates to Category No.: 2890; Payload ID: 7813 relates to Category No.: 4030, 4029, 2942, 4014, 4010; Payload ID: 7814 relates to Category No.: 9305, 7118, 6717, 2938, 2942, 3673, 7061, 3666, 2402, 7052, 2918, 1682; Payload ID: 7815 relates to Category No.: 4029; Payload ID: 7816 relates to Category No.: 4029; Payload ID: 7817 relates to Category No.: 9305, 7118, 9247; Payload ID: 7818 relates to Category No.: 9247; Payload ID: 7819 relates to Category No.: 9305, 2890; Payload ID: 7820 relates to Category No.: 9305, 2890, 2942, 3666, 9247, 4755, 3036, 2927, 2183, 997, 1017, 6059, 11883, 7118, 2899, 5412, 8948, 2504, 11650, 8952; Payload ID: 7821 relates to Category No.: 9305, 2890, 6717, 2938, 5776, 4755, 2504, 2505; Payload ID: 7822 relates to Category No.: 2890, 5776, 9734, 2504, 2505, 2938, 2534, 6717; Payload ID: 7823 relates to Category No.: 9305, 2890; Payload ID: 7824 relates to Category No.: 9157; Payload ID: 7825 relates to Category No.: 6443, 9305, 7118, 2938, 15151, 3666, 273, 1748, 997, 1017, 5412, 2194, 2899, 2183; Payload ID: 7826 relates to Category No.: 9305, 2890, 9242, 9247, 2279, 14614; Payload ID: 7827 relates to Category No.: 9242, 2279, 14614; Payload ID: 7828 relates to Category No.: 4029, 12159, 4014; Payload ID: 7829 relates to Category No.: 12159; Payload ID: 7830 relates to Category No.: 4030, 12159; Payload ID: 7831 relates to Category No.: 12159; Payload ID: 7832 relates to Category No.: 4030, 4029; Payload ID: 7833 relates to Category No.: 4029, 9305, 2890, 2942, 9247, 14364; Payload ID: 7834 relates to Category No.: 5561, 10056, 5570, 2890, 6717; Payload ID: 7835 relates to Category No.: 5570, 2890; Payload ID: 7836 relates to Category No.: 5561, 10056, 5570, 5288, 2890; Payload ID: 7837 relates to Category No.: 2890, 6717, 10056, 1792; Payload ID: 7838 relates to Category No.: 4030, 6443, 2890, 4010, 2926, 5288, 6437; Payload ID: 7839 relates to Category No.: 6443, 2890, 10056, 2942, 4765, 3666, 2899, 9734, 3636, 2926, 1792, 6989, 676, 6743, 779, 14253, 678; Payload ID: 7840 relates to Category No.: 6443, 4029, 2926; Payload ID: 7841 relates to Category No.: 5561, 1792; Payload ID: 7843 relates to Category No.: 1041; Payload ID: 7844 relates to Category No.: 5561, 6717, 10056, 5570; Payload ID: 7845 relates to Category No.: 9305, 2890, 2194, 10056; Payload ID: 7846 relates to Category No.: 9756, 9753; Payload ID: 7847 relates to Category No.: 9756, 4010, 7118; Payload ID: 7848 relates to Category No.: 7118, 2890, 9247, 7060, 7048; Payload ID: 7849 relates to Category No.: 7118, 7048, 7068, 7042; Payload ID: 7850 relates to Category No.: 7118, 7048, 7041, 3666, 7070, 4010, 7068; Payload ID: 7851 relates to Category No.: 2890, 2942, 7060, 4010, 7118; Payload ID: 7853 relates to Category No.: 7118; Payload ID: 7854 relates to Category No.: 5561, 10056; Payload ID: 7855 relates to Category No.: 5561, 10056; Payload ID: 7856 relates to Category No.: 5561, 10056, 5570; Payload ID: 7857 relates to Category No.: 5561, 7048, 3673, 7052, 14685; Payload ID: 7858 relates to Category No.: 5561, 7048, 3673, 7061, 3666, 7052, 14685; Payload ID: 7859 relates to Category No.: 5561, 3673, 1842; Payload ID: 7860 relates to Category No.: 2890; Payload ID: 7861 relates to Category No.: 2942, 9305, 2890, 1017, 2628; Payload ID: 7862 relates to Category No.: 2942, 4010, 1099; Payload ID: 7863 relates to Category No.: 1842; Payload ID: 7864 relates to Category No.: 5561, 6717, 3673; Payload ID: 7865 relates to Category No.: 4029; Payload ID: 7866 relates to Category No.: 3673, 2890, 5776, 5561; Payload ID: 7867 relates to Category No.: 2890, 2942, 9247, 9184; Payload ID: 7868 relates to Category No.: 7118, 2890, 10056, 7060, 3666, 7048, 7068; Payload ID: 7869 relates to Category No.: 4029, 2890, 2942, 6222; Payload ID: 7870 relates to Category No.: 5561, 3673, 12159; Payload ID: 7871 relates to Category No.: 4029, 6222, 1842; Payload ID: 7872 relates to Category No.: 2942; Payload ID: 7873 relates to Category No.: 5561, 3673; Payload ID: 7874 relates to Category No.: 5776, 3673; Payload ID: 7875 relates to Category No.: 6717, 5776, 9756, 9754, 9753, 7118; Payload ID: 7876 relates to Category No.: 5762, 3666, 3523; Payload ID: 7877 relates to Category No.: 5561, 10056, 3673, 3666; Payload ID: 7878 relates to Category No.: 7060, 6717, 10056, 7118, 7041; Payload ID: 7879 relates to Category No.: 7118; Payload ID: 7880 relates to Category No.: 6717, 9756, 7118; Payload ID: 7881 relates to Category No.: 2890, 9247, 2402; Payload ID: 7882 relates to Category No.: 9305, 10056, 9247; Payload ID: 7883 relates to Category No.: 5561, 6717, 10056, 5570, 1017, 3036; Payload ID: 7884 relates to Category No.: 6717, 16257, 10056, 5570; Payload ID: 7885 relates to Category No.: 6717, 10056, 5570, 15139, 3036, 1017, 8948, 2639; Payload ID: 7886 relates to Category No.: 6717, 10056, 5570, 9734, 5823; Payload ID: 7887 relates to Category No.: 4029, 15151, 1748, 14293, 9734, 2890, 2942, 14409; Payload ID: 7888 relates to Category No.: 5561, 10056, 5570; Payload ID: 7889 relates to Category No.: 5561, 10056, 5570; Payload ID: 7890 relates to Category No.: 2890, 2942, 4010; Payload ID: 7891 relates to Category No.: 9305, 2890, 15505, 9242, 2942, 9247, 9215, 14253, 7244; Payload ID: 7892 relates to Category No.: 9305, 2890, 2942, 9247, 9734; Payload ID: 7893 relates to Category No.: 7118, 2942, 9247, 9215, 2890; Payload ID: 7894 relates to Category No.: 4030, 5561, 6222, 14409, 1792; Payload ID: 7895 relates to Category No.: 4029, 6717, 3666, 4010, 4228, 14683, 3671, 3637, 3668; Payload ID: 7896 relates to Category No.: 7060, 7118; Payload ID: 7898 relates to Category No.: 6437; Payload ID: 7899 relates to Category No.: 4010, 6437, 6443, 2535; Payload ID: 7900 relates to Category No.: 4029; Payload ID: 7901 relates to Category No.: 4030; Payload ID: 7902 relates to Category No.: 4029; Payload ID: 7903 relates to Category No.: 4029; Payload ID: 7904 relates to Category No.: 4030; Payload ID: 7905 relates to Category No.: 5561, 10056; Payload ID: 7907 relates to Category No.: 4029, 10056, 8935, 8948, 1811, 1792; Payload ID: 7908 relates to Category No.: 9305, 4030, 9242, 9247; Payload ID: 7909 relates to Category No.: 9305, 2890, 9247, 11883, 12170, 9725; Payload ID: 7910 relates to Category No.: 9247, 9305; Payload ID: 7911 relates to Category No.: 9305, 2890, 10056, 9247; Payload ID: 7912 relates to Category No.: 9305, 9247; Payload ID: 7913 relates to Category No.: 9247; Payload ID: 7914 relates to Category No.: 5561, 6717, 3673, 3666; Payload ID: 7915 relates to Category No.: 4043, 2942, 1811; Payload ID: 7916 relates to Category No.: 5561, 6717; Payload ID: 7917 relates to Category No.: 7118, 7048, 7055, 7060; Payload ID: 7918 relates to Category No.: 9305, 2890; Payload ID: 7919 relates to Category No.: 5561, 9305; Payload ID: 7920 relates to Category No.: 5561, 6717, 3673, 3666, 4755; Payload ID: 7923 relates to Category No.: 6717; Payload ID: 7924 relates to Category No.: 6717, 4765, 1001, 9773, 9776, 1774; Payload ID: 7926 relates to Category No.: 4029; Payload ID: 7927 relates to Category No.: 2890, 2942, 6960; Payload ID: 7928 relates to Category No.: 4030, 4029, 4008, 1239, 4010, 7219, 14414, 14408; Payload ID: 7930 relates to Category No.: 5561, 4008, 1069; Payload ID: 7931 relates to Category No.: 4029, 4008, 5379, 2473, 1239; Payload ID: 7932 relates to Category No.: 4030, 4029, 4008, 5379, 2473, 1239, 4010, 5561; Payload ID: 7933 relates to Category No.: 4030, 4029, 4008, 5379, 2473, 1239, 4010; Payload ID: 7935 relates to Category No.: 4030, 4029, 4008, 5379, 2473, 1239, 4010; Payload ID: 7936 relates to Category No.: 4008, 5379, 2473, 4030, 1069, 9734; Payload ID: 8008 relates to Category No.: 4029, 10056, 4008, 5379, 2473, 1239, 4010; Payload ID: 8048 relates to Category No.: 4029, 10056, 1239, 4010; Payload ID: 8054 relates to Category No.: 4029, 10056, 4010; Payload ID: 8073 relates to Category No.: 4029, 10056, 1239, 4010; Payload ID: 8080 relates to Category No.: 4030; Payload ID: 8081 relates to Category No.: 4029, 10056, 1239; Payload ID: 8082 relates to Category No.: 4029, 10056; Payload ID: 8134 relates to Category No.: 6717, 4008, 5379, 2473, 1239, 4010; Payload ID: 8135 relates to Category No.: 4008, 5379, 2473, 1239, 4010; Payload ID: 8136 relates to Category No.: 9305, 2890, 6717, 14145, 1017, 4860, 14681, 8948; Payload ID: 8137 relates to Category No.: 4010; Payload ID: 8138 relates to Category No.: 5561, 10056, 1792; Payload ID: 8139 relates to Category No.: 5570, 5561; Payload ID: 8140 relates to Category No.: 5561, 10056; Payload ID: 8141 relates to Category No.: 5561, 4029, 6717; Payload ID: 8142 relates to Category No.: 4029; Payload ID: 8143 relates to Category No.: 5561, 10056, 4010; Payload ID: 8145 relates to Category No.: 5561; Payload ID: 8146 relates to Category No.: 5561, 1792; Payload ID: 8147 relates to Category No.: 5561, 10056, 1182, 8935, 8948, 1811, 1792; Payload ID: 8148 relates to Category No.: 5570, 5561; Payload ID: 8149 relates to Category No.: 5561, 6717, 10056, 4010; Payload ID: 8150 relates to Category No.: 5561, 10056, 1748, 1017, 3036, 5441; Payload ID: 8151 relates to Category No.: 5561, 10056, 8948, 3036, 5441; Payload ID: 8152 relates to Category No.: 9305, 16326; Payload ID: 8153 relates to Category No.: 5561, 10056, 2942, 15648; Payload ID: 8154 relates to Category No.: 5561, 3673; Payload ID: 8155 relates to Category No.: 7118; Payload ID: 8156 relates to Category No.: 9305, 2890, 2942, 9247, 1748; Payload ID: 8157 relates to Category No.: 9305, 2890, 6717, 2942, 9754, 4010; Payload ID: 8158 relates to Category No.: 9305, 9242, 14671, 7254; Payload ID: 8159 relates to Category No.: 9242, 14671, 7254; Payload ID: 8160 relates to Category No.: 2890, 10162, 1842; Payload ID: 8161 relates to Category No.: 5762, 2942, 9162; Payload ID: 8162 relates to Category No.: 2890, 9184; Payload ID: 8163 relates to Category No.: 2890, 6717, 9157, 9199, 9184, 11883, 9195, 5762; Payload ID: 8164 relates to Category No.: 2890, 5776, 9247, 4755, 9184, 9305, 6717, 9242, 9199, 9195, 5762; Payload ID: 8165 relates to Category No.: 2890, 6717, 2942, 9247, 9199, 5762; Payload ID: 8166 relates to Category No.: 2942, 9247, 9162, 5762; Payload ID: 8167 relates to Category No.: 2890, 6717, 2942, 9162; Payload ID: 8168 relates to Category No.: 10056, 1182, 9734, 4010, 779, 778, 11883; Payload ID: 8169 relates to Category No.: 5561; Payload ID: 8170 relates to Category No.: 2194, 2942, 2899, 6994, 4010, 3685, 4216; Payload ID: 8171 relates to Category No.: 4030, 10056, 12159; Payload ID: 8172 relates to Category No.: 2942, 2890, 14692, 14954; Payload ID: 8173 relates to Category No.: 2890, 2942; Payload ID: 8174 relates to Category No.: 2942; Payload ID: 8175 relates to Category No.: 4029, 10056, 5570, 4008; Payload ID: 8176 relates to Category No.: 5561, 10056, 4010; Payload ID: 8177 relates to Category No.: 2890, 15505, 9247, 273, 14912, 9305; Payload ID: 8178 relates to Category No.: 4030, 4029, 5433, 5430, 2890, 8948, 10002, 10000, 5431; Payload ID: 8179 relates to Category No.: 4030, 4029, 1700, 5430, 367, 9734; Payload ID: 8180 relates to Category No.: 4030, 4029, 9734, 1772; Payload ID: 8181 relates to Category No.: 4030, 4029, 4010; Payload ID: 8182 relates to Category No.: 4030; Payload ID: 8183 relates to Category No.: 2890, 6717, 9247; Payload ID: 8184 relates to Category No.: 9305, 2890; Payload ID: 8185 relates to Category No.: 9305, 9247, 4755, 2890, 2194; Payload ID: 8186 relates to Category No.: 9305, 2890, 2194, 2942, 9247, 6968, 11883; Payload ID: 8187 relates to Category No.: 9305, 9247, 6968, 2890; Payload ID: 8188 relates to Category No.: 9305, 2890; Payload ID: 8189 relates to Category No.: 9305; Payload ID: 8190 relates to Category No.: 9305, 2890, 10056, 9247, 4755, 1668, 14583; Payload ID: 8191 relates to Category No.: 9305, 2890, 9242, 9247, 10015, 9153, 15130; Payload ID: 8192 relates to Category No.: 9305, 9247, 5102; Payload ID: 8193 relates to Category No.: 9305, 9247, 7253; Payload ID: 8194 relates to Category No.: 9305, 2890, 2942, 6743, 2918, 1682, 5358, 5776; Payload ID: 8195 relates to Category No.: 2890, 9242, 5102, 3561, 15497; Payload ID: 8196 relates to Category No.: 9305, 2890, 2942, 7061, 9247, 3696, 10104; Payload ID: 8197 relates to Category No.: 2890, 9305, 5762, 2942, 15892, 14906, 7161, 5358; Payload ID: 8199 relates to Category No.: 6960, 2942, 2420, 2192, 2630, 14893, 5964, 11883, 9725, 6066, 15173, 6994, 2419, 2168; Payload ID: 8200 relates to Category No.: 5561, 7118, 7048, 6717, 6947, 7366; Payload ID: 8201 relates to Category No.: 7118, 6717, 7048; Payload ID: 8202 relates to Category No.: 5561, 6717, 7049, 7118; Payload ID: 8203 relates to Category No.: 9305, 6960, 5466; Payload ID: 8204 relates to Category No.: 9305, 2890, 10056, 9242, 9247, 5466; Payload ID: 8205 relates to Category No.: 9242, 5466, 7179; Payload ID: 8206 relates to Category No.: 9305; Payload ID: 8207 relates to Category No.: 9305, 9242, 9247, 5466; Payload ID: 8208 relates to Category No.: 9305, 2890, 10056, 9247, 5466; Payload ID: 8209 relates to Category No.: 2890, 2942; Payload ID: 8210 relates to Category No.: 5762, 2942, 9247; Payload ID: 8211 relates to Category No.: 6717, 10056; Payload ID: 8212 relates to Category No.: 5561, 6717; Payload ID: 8213 relates to Category No.: 5561; Payload ID: 8214 relates to Category No.: 5561, 6717, 3673, 3666, 10085, 10082, 10084, 2890, 9242, 9162, 11883, 11650, 14368, 9176, 1382; Payload ID: 8215 relates to Category No.: 5561, 6717, 10056, 3673, 14371, 12406, 10085, 2890, 1720, 14368; Payload ID: 8216 relates to Category No.: 2890, 6717, 10056, 2942, 3673, 5570, 3666, 8948, 1335, 7366, 12406, 10085, 778, 9192, 9305, 9247, 9242, 3036, 9162, 9734; Payload ID: 8217 relates to Category No.: 9305, 9242, 2942, 9247, 2890; Payload ID: 8218 relates to Category No.: 9305, 9247, 5730; Payload ID: 8219 relates to Category No.: 2890, 2942, 9305; Payload ID: 8220 relates to Category No.: 5561, 6717, 4755; Payload ID: 8221 relates to Category No.: 9305, 9242, 9247; Payload ID: 8222 relates to Category No.: 2890, 2938, 2942, 4755, 6017, 4199, 10056; Payload ID: 8223 relates to Category No.: 2890, 2942; Payload ID: 8224 relates to Category No.: 2942; Payload ID: 8225 relates to Category No.: 2942, 1700, 5561; Payload ID: 8226 relates to Category No.: 6717, 10056, 4010; Payload ID: 8227 relates to Category No.: 2890, 6717, 10056, 2942, 4755, 9776, 3523, 3685, 5561; Payload ID: 8228 relates to Category No.: 6717, 2942; Payload ID: 8229 relates to Category No.: 2938, 10056, 2942, 11728, 1046, 14327, 4760, 4765, 2890; Payload ID: 8230 relates to Category No.: 5762; Payload ID: 8231 relates to Category No.: 2890, 2942, 14327, 10056, 4860, 3054; Payload ID: 8232 relates to Category No.: 9305, 2890, 6717, 10056, 2942, 8935, 3666, 9734, 15573, 14327, 14329; Payload ID: 8233 relates to Category No.: 2890, 2942, 4010; Payload ID: 8234 relates to Category No.: 2890, 2942; Payload ID: 8235 relates to Category No.: 2942; Payload ID: 8236 relates to Category No.: 5762, 2942; Payload ID: 8237 relates to Category No.: 2942, 3055; Payload ID: 8238 relates to Category No.: 2942, 9305, 6717; Payload ID: 8239 relates to Category No.: 9305, 2942; Payload ID: 8240 relates to Category No.: 2890, 778; Payload ID: 8241 relates to Category No.: 4029; Payload ID: 8242 relates to Category No.: 4030, 4029, 3671, 3695, 4763, 14411; Payload ID: 8243 relates to Category No.: 3673, 3666, 14933, 5561; Payload ID: 8244 relates to Category No.: 3673, 14933, 3666, 5561; Payload ID: 8245 relates to Category No.: 5561, 6717, 5776, 10056, 5570, 4010, 3696, 1659, 12406, 5539, 9305, 2942, 15139, 3693; Payload ID: 8246 relates to Category No.: 9305, 2890, 5776, 10056, 2942, 1659, 5539, 2441; Payload ID: 8247 relates to Category No.: 10056, 2942; Payload ID: 8248 relates to Category No.: 10056, 2942; Payload ID: 8249 relates to Category No.: 5561, 6717, 5570, 12406; Payload ID: 8250 relates to Category No.: 4030, 9305, 7118, 2890, 10056, 2942, 9247, 9756, 1792, 9753, 2948; Payload ID: 8251 relates to Category No.: 4029, 4030, 9734; Payload ID: 8252 relates to Category No.: 4030; Payload ID: 8253 relates to Category No.: 4029, 1842; Payload ID: 8254 relates to Category No.: 4029, 1842; Payload ID: 8255 relates to Category No.: 4030, 4029, 10056, 10077, 5548, 5553, 1700, 2890, 8948, 5749; Payload ID: 8256 relates to Category No.: 5561, 6717, 5776, 10056, 5570, 12406; Payload ID: 8257 relates to Category No.: 4029, 10056, 4010, 10077, 4030; Payload ID: 8258 relates to Category No.: 9305, 2890, 2942, 14145, 9734, 6017, 4199, 1017, 4860, 3055, 2920, 2757, 3036; Payload ID: 8259 relates to Category No.: 9305, 2890, 2938, 2942; Payload ID: 8260 relates to Category No.: 9305, 2890, 2942; Payload ID: 8261 relates to Category No.: 5561, 2890, 6717, 5570, 3693, 15573, 3521, 3636, 4010, 1792, 4228, 6059, 6440, 15577, 9305, 9164, 4030, 10056, 9734, 2492; Payload ID: 8262 relates to Category No.: 4029, 4030; Payload ID: 8263 relates to Category No.: 4030, 4029, 4010, 2926, 779; Payload ID: 8264 relates to Category No.: 4029, 4030, 9305, 4010, 5548, 5553; Payload ID: 8265 relates to Category No.: 4030, 4029; Payload ID: 8266 relates to Category No.: 4030, 4029, 5548, 5553; Payload ID: 8267 relates to Category No.: 4030, 4029, 4010, 2890, 4755; Payload ID: 8268 relates to Category No.: 4030, 4029, 4014, 4010; Payload ID: 8269 relates to Category No.: 4030, 4029, 9247, 4010, 5553; Payload ID: 8270 relates to Category No.: 4029; Payload ID: 8271 relates to Category No.: 9305, 9247, 15531; Payload ID: 8272 relates to Category No.: 9305, 2890; Payload ID: 8273 relates to Category No.: 5561; Payload ID: 8274 relates to Category No.: 4030, 4029, 6717, 5776, 10056, 4755, 4010, 3696, 5568, 4788; Payload ID: 8275 relates to Category No.: 5561, 6443, 10056, 4755, 9734, 4010, 6440; Payload ID: 8276 relates to Category No.: 5561, 6717, 9184, 5572, 9305; Payload ID: 8277 relates to Category No.: 5572; Payload ID: 8278 relates to Category No.: 5572; Payload ID: 8279 relates to Category No.: 5561, 6717, 5762, 9184, 5572; Payload ID: 8280 relates to Category No.: 9305, 5572, 14798; Payload ID: 8281 relates to Category No.: 5572; Payload ID: 8282 relates to Category No.: 5561, 9305, 6717, 5572; Payload ID: 8283 relates to Category No.: 9247, 273, 5572; Payload ID: 8284 relates to Category No.: 2420, 5572; Payload ID: 8285 relates to Category No.: 5572; Payload ID: 8286 relates to Category No.: 2890, 9247, 5572; Payload ID: 8287 relates to Category No.: 5561, 4010; Payload ID: 8288 relates to Category No.: 9247, 2942; Payload ID: 8289 relates to Category No.: 16326; Payload ID: 8290 relates to Category No.: 9305, 2890, 6717, 2938, 10056, 2942, 9734, 6017, 4010, 1772, 14327; Payload ID: 8291 relates to Category No.: 9305, 2890, 6717, 2942, 9247, 2630; Payload ID: 8292 relates to Category No.: 6717, 10056, 5591, 4010, 1792, 4228, 5576, 4008, 1084, 6743, 8935, 262, 9730; Payload ID: 8293 relates to Category No.: 10056, 5591, 5574; Payload ID: 8294 relates to Category No.: 6717, 10056, 5591, 4228, 5575; Payload ID: 8295 relates to Category No.: 10056, 5591, 1792, 4228, 5577, 4008, 1084, 9305, 1017, 1774, 1033, 9734, 5561; Payload ID: 8296 relates to Category No.: 10056, 5570, 5591, 1239, 4010, 1792, 10078, 4008, 4228; Payload ID: 8297 relates to Category No.: 5561, 10056, 5591, 4010, 1772, 1792, 4228, 12406, 4201, 5578, 5830, 4008, 1099, 15139, 15147, 3972, 4860, 9734; Payload ID: 8298 relates to Category No.: 6717, 10056, 4010, 1792, 4228, 5579, 4008, 1811, 5591; Payload ID: 8299 relates to Category No.: 10056, 5591, 1811, 14327, 1792, 4228, 14329, 600, 4008, 2926, 15139, 4755, 3666, 2890, 5561; Payload ID: 8300 relates to Category No.: 5591, 10056, 1792, 4228, 4008, 1090, 1099, 1085, 4989, 1084, 5561; Payload ID: 8301 relates to Category No.: 10056, 1792, 2890, 14363, 8917, 5580, 7349, 5591; Payload ID: 8302 relates to Category No.: 10056, 3666, 5591, 1792, 4228, 5581, 778, 11650, 9730, 3059; Payload ID: 8303 relates to Category No.: 5591, 10056, 1085, 6717, 5582; Payload ID: 8304 relates to Category No.: 10056, 5591, 1792; Payload ID: 8305 relates to Category No.: 10056, 5591, 4008; Payload ID: 8306 relates to Category No.: 6717, 10056, 5591, 4010, 1792, 5584, 4008, 1811, 5392, 5561; Payload ID: 8307 relates to Category No.: 4030, 10056, 5591, 4010, 1792, 5561; Payload ID: 8308 relates to Category No.: 6717, 10056, 5570, 5591, 4010, 1792, 4228, 6991, 14329, 9774, 4201, 6019, 5585, 5586, 5587, 599, 4008, 5762; Payload ID: 8309 relates to Category No.: 6717, 10056, 5591, 1792, 4008; Payload ID: 8310 relates to Category No.: 12439, 2890, 6717, 10056, 5591, 14363, 6017, 4199, 4010, 8917, 14327, 1792, 6743, 4228, 6709, 12406, 2514, 14329, 5574, 5576, 5577, 5578, 5581, 5575, 5830, 4008, 2926, 15139, 9734, 5596, 3055, 5580, 15147, 7367, 1090, 262, 1811, 447, 4989, 5582; Payload ID: 8311 relates to Category No.: 6717, 10056, 5591, 4010, 1792, 12406, 4032, 5584; Payload ID: 8312 relates to Category No.: 9305, 10056, 5570, 5591, 4010, 1792, 4228, 6709, 12406, 6991, 14329, 4201, 6019, 600, 10078, 5585, 5561; Payload ID: 8313 relates to Category No.: 5561, 10056, 5591, 1750, 4010, 1792, 12406, 4989, 1090, 1085; Payload ID: 8314 relates to Category No.: 10056, 4010, 1792, 4228, 12406, 9774, 5586, 1750, 5591; Payload ID: 8315 relates to Category No.: 10056, 5591, 4010, 12406, 4008; Payload ID: 8316 relates to Category No.: 6717, 10056, 5591, 4010, 1792, 12406, 5579, 5561; Payload ID: 8317 relates to Category No.: 10056, 5591, 4010, 1792, 5587; Payload ID: 8318 relates to Category No.: 4029; Payload ID: 8319 relates to Category No.: 4030, 4029, 6717, 4014, 6756; Payload ID: 8320 relates to Category No.: 2890, 6717, 10056, 2942, 9247, 1748, 14364, 6017, 4228, 4014, 11883, 1017, 8948, 15280, 1811, 3054, 14999, 2738; Payload ID: 8321 relates to Category No.: 2890; Payload ID: 8322 relates to Category No.: 677, 4010, 6743, 1336, 12406; Payload ID: 8323 relates to Category No.: 4029; Payload ID: 8324 relates to Category No.: 10056, 2942; Payload ID: 8325 relates to Category No.: 15497, 1377, 15532, 5200; Payload ID: 8326 relates to Category No.: 15497, 1377, 15532, 5200, 9305; Payload ID: 8327 relates to Category No.: 4029, 1239, 4010; Payload ID: 8328 relates to Category No.: 4029, 1239, 4010; Payload ID: 8329 relates to Category No.: 4029, 4010; Payload ID: 8330 relates to Category No.: 4029, 1239, 4010, 2890, 10056; Payload ID: 8332 relates to Category No.: 4029; Payload ID: 8333 relates to Category No.: 4030, 6717, 10056, 5570, 4010, 1792, 4228, 4008, 5392, 6743, 5561; Payload ID: 8334 relates to Category No.: 5561, 6717, 10056, 4010, 5570, 1772, 16026; Payload ID: 8335 relates to Category No.: 10056, 5570, 4010, 5561, 6717; Payload ID: 8336 relates to Category No.: 5561, 4029, 10056, 5570, 2890, 4030; Payload ID: 8337 relates to Category No.: 10056, 5570, 6717; Payload ID: 8338 relates to Category No.: 5762, 10056, 5570; Payload ID: 8339 relates to Category No.: 4030, 4029, 5762, 10056, 5570, 5561; Payload ID: 8340 relates to Category No.: 6717, 10056, 5570, 5561; Payload ID: 8341 relates to Category No.: 5561, 10056, 5570, 3666; Payload ID: 8342 relates to Category No.: 5561, 6717, 5762, 10056; Payload ID: 8343 relates to Category No.: 5561, 10056; Payload ID: 8344 relates to Category No.: 5561, 10056; Payload ID: 8345 relates to Category No.: 5561, 10056, 4010, 6060, 6440; Payload ID: 8346 relates to Category No.: 5561, 5570, 10056; Payload ID: 8347 relates to Category No.: 9305, 2942; Payload ID: 8348 relates to Category No.: 9305, 2890, 2942, 9247, 9157; Payload ID: 8349 relates to Category No.: 2890, 2942, 9247, 4228; Payload ID: 8350 relates to Category No.: 5776, 9247, 493; Payload ID: 8351 relates to Category No.: 9305, 2890, 9247; Payload ID: 8352 relates to Category No.: 4030, 9305, 9247; Payload ID: 8353 relates to Category No.: 9305, 2890, 2942, 9247; Payload ID: 8354 relates to Category No.: 9305, 2890, 6717, 2942, 9247, 9190; Payload ID: 8355 relates to Category No.: 9305, 2890, 2942; Payload ID: 8356 relates to Category No.: 9305, 2890, 2942, 4010; Payload ID: 8357 relates to Category No.: 9305, 2890, 2942, 9247, 3696; Payload ID: 8358 relates to Category No.: 2942, 9247, 9305; Payload ID: 8359 relates to Category No.: 9305, 2890, 2942, 9247; Payload ID: 8360 relates to Category No.: 9305, 2890, 9242, 9247, 10104, 1377; Payload ID: 8361 relates to Category No.: 9242, 9247; Payload ID: 8362 relates to Category No.: 4030, 4029; Payload ID: 8363 relates to Category No.: 4030, 4029; Payload ID: 8364 relates to Category No.: 4030, 4029; Payload ID: 8365 relates to Category No.: 4030, 4029; Payload ID: 8366 relates to Category No.: 4030, 4029; Payload ID: 8367 relates to Category No.: 4030, 4029; Payload ID: 8368 relates to Category No.: 4030, 4029; Payload ID: 8369 relates to Category No.: 4030, 4029; Payload ID: 8370 relates to Category No.: 4030, 4029; Payload ID: 8371 relates to Category No.: 4030, 4029; Payload ID: 8372 relates to Category No.: 4030, 4029, 1842; Payload ID: 8373 relates to Category No.: 4030, 4029; Payload ID: 8374 relates to Category No.: 4030, 4029; Payload ID: 8375 relates to Category No.: 5561; Payload ID: 8376 relates to Category No.: 5561; Payload ID: 8377 relates to Category No.: 5561; Payload ID: 8378 relates to Category No.: 5561, 7118, 10056; Payload ID: 8379 relates to Category No.: 4030, 4029; Payload ID: 8380 relates to Category No.: 4030, 4029; Payload ID: 8381 relates to Category No.: 4030, 4029, 5762, 4008; Payload ID: 8382 relates to Category No.: 9305, 2890, 6717, 9242, 2942, 9247, 9215; Payload ID: 8383 relates to Category No.: 6443, 4029, 2890, 5776, 10056, 1748, 6437; Payload ID: 8384 relates to Category No.: 4030, 4029; Payload ID: 8385 relates to Category No.: 4030, 4029, 5762, 5685; Payload ID: 8386 relates to Category No.: 4030, 5762; Payload ID: 8387 relates to Category No.: 4030, 5762; Payload ID: 8388 relates to Category No.: 5762; Payload ID: 8389 relates to Category No.: 5561, 10056, 5685; Payload ID: 8390 relates to Category No.: 4030, 4029; Payload ID: 8391 relates to Category No.: 9305, 2942; Payload ID: 8392 relates to Category No.: 2890; Payload ID: 8393 relates to Category No.: 2890; Payload ID: 8394 relates to Category No.: 2890, 2942, 5270; Payload ID: 8395 relates to Category No.: 2942; Payload ID: 8396 relates to Category No.: 2890, 2942, 3666; Payload ID: 8397 relates to Category No.: 7118, 2890, 2942; Payload ID: 8398 relates to Category No.: 2942, 273, 14329, 778; Payload ID: 8399 relates to Category No.: 2890, 9305; Payload ID: 8400 relates to Category No.: 9305; Payload ID: 8401 relates to Category No.: 4030; Payload ID: 8402 relates to Category No.: 4029, 6717, 10056, 5570, 2890, 11883; Payload ID: 8403 relates to Category No.: 5561, 2890, 10056, 3036, 11653, 1017, 1792; Payload ID: 8404 relates to Category No.: 5561; Payload ID: 8405 relates to Category No.: 4030, 2890, 5762, 10056, 4010, 4029, 16156; Payload ID: 8406 relates to Category No.: 5561, 6717, 10056, 5570, 1792, 9305, 4030, 11883, 1017, 11650; Payload ID: 8407 relates to Category No.: 5561, 4029, 10056; Payload ID: 8408 relates to Category No.: 5561, 5762, 10056, 6717, 12159, 4030, 1792; Payload ID: 8409 relates to Category No.: 5570; Payload ID: 8410 relates to Category No.: 4030, 4029, 2942; Payload ID: 8411 relates to Category No.: 4030, 6443, 4029, 2942, 997, 4010, 16156, 14409; Payload ID: 8412 relates to Category No.: 4030, 2890; Payload ID: 8413 relates to Category No.: 5561, 10056; Payload ID: 8414 relates to Category No.: 5561, 10056, 4010, 5685; Payload ID: 8415 relates to Category No.: 4030, 4029, 2890; Payload ID: 8416 relates to Category No.: 6717, 5570, 5561; Payload ID: 8417 relates to Category No.: 6717, 5641, 5678, 4008; Payload ID: 8418 relates to Category No.: 6717, 5570, 4008; Payload ID: 8419 relates to Category No.: 4030, 4029, 5637, 2890; Payload ID: 8420 relates to Category No.: 4030, 6717, 5637, 5675, 2890; Payload ID: 8421 relates to Category No.: 4030, 4029, 2890, 4008; Payload ID: 8422 relates to Category No.: 6717, 10056, 5647; Payload ID: 8423 relates to Category No.: 4030, 5561, 6717; Payload ID: 8424 relates to Category No.: 4029, 2890, 6717, 5570, 3693, 9247, 4755, 4030, 1792; Payload ID: 8425 relates to Category No.: 5561, 4030, 4765, 3673, 2927, 9184, 2926, 10056; Payload ID: 8426 relates to Category No.: 4030, 9305, 2890, 10056, 5762; Payload ID: 8427 relates to Category No.: 4029, 5570, 10056; Payload ID: 8428 relates to Category No.: 4029, 6717, 5570, 2890, 1792, 5561; Payload ID: 8429 relates to Category No.: 5570, 1792, 10056; Payload ID: 8430 relates to Category No.: 4765, 5570, 9247, 4755; Payload ID: 8431 relates to Category No.: 5570, 4029, 2890; Payload ID: 8433 relates to Category No.: 4029, 4008, 4030, 2890; Payload ID: 8434 relates to Category No.: 4030, 4029; Payload ID: 8435 relates to Category No.: 4030, 4029; Payload ID: 8436 relates to Category No.: 4030, 4029; Payload ID: 8437 relates to Category No.: 4030, 4029; Payload ID: 8438 relates to Category No.: 4030, 4029, 2942, 4010; Payload ID: 8439 relates to Category No.: 4030, 4029, 4010; Payload ID: 8440 relates to Category No.: 5561, 10056; Payload ID: 8441 relates to Category No.: 5561; Payload ID: 8442 relates to Category No.: 4030, 4029; Payload ID: 8443 relates to Category No.: 4030, 4029, 5762, 2942; Payload ID: 8444 relates to Category No.: 5561, 5762, 10056, 4008, 1792; Payload ID: 8445 relates to Category No.: 6717, 5762, 10056, 5570, 4008, 1792; Payload ID: 8446 relates to Category No.: 6717, 5762, 10056, 5570, 4008, 1792; Payload ID: 8447 relates to Category No.: 4030, 4029; Payload ID: 8448 relates to Category No.: 5561, 10056; Payload ID: 8449 relates to Category No.: 5561, 10056; Payload ID: 8450 relates to Category No.: 4030, 4029, 5762; Payload ID: 8451 relates to Category No.: 5561, 6717; Payload ID: 8452 relates to Category No.: 4029, 4030; Payload ID: 8453 relates to Category No.: 5561, 10056; Payload ID: 8454 relates to Category No.: 4030, 5561, 10056, 2942; Payload ID: 8455 relates to Category No.: 12406, 5678; Payload ID: 8456 relates to Category No.: 4029, 5675, 4030; Payload ID: 8457 relates to Category No.: 4030; Payload ID: 8458 relates to Category No.: 4030, 4029; Payload ID: 8459 relates to Category No.: 4030, 2942; Payload ID: 8460 relates to Category No.: 4030; Payload ID: 8461 relates to Category No.: 5570; Payload ID: 8462 relates to Category No.: 4030, 4029, 5762; Payload ID: 8463 relates to Category No.: 5561, 6717, 5762, 10056; Payload ID: 8464 relates to Category No.: 4030; Payload ID: 8465 relates to Category No.: 5561, 5762, 10056, 4008; Payload ID: 8466 relates to Category No.: 4030, 6717; Payload ID: 8467 relates to Category No.: 4030, 9305, 15627, 2420; Payload ID: 8468 relates to Category No.: 4030; Payload ID: 8469 relates to Category No.: 4030; Payload ID: 8470 relates to Category No.: 4030, 4029; Payload ID: 8471 relates to Category No.: 4030, 4029; Payload ID: 8472 relates to Category No.: 4030; Payload ID: 8473 relates to Category No.: 4030, 4029, 9305, 2890, 9242, 2942, 9247; Payload ID: 8474 relates to Category No.: 4030, 4029, 4008; Payload ID: 8475 relates to Category No.: 6443, 4029; Payload ID: 8476 relates to Category No.: 5561, 6717, 5762, 5570, 12406, 4030; Payload ID: 8477 relates to Category No.: 4030, 4029, 5762; Payload ID: 8478 relates to Category No.: 4030, 5561, 6717, 5762, 10056; Payload ID: 8479 relates to Category No.: 4030, 4029, 5709, 4008, 2890; Payload ID: 8480 relates to Category No.: 4030, 4029, 6717, 10056, 1099, 779, 5709, 2450, 5561; Payload ID: 8481 relates to Category No.: 4030, 4029, 6717, 10056, 4010, 5709, 2450, 9372, 4008, 8948, 3036, 1711; Payload ID: 8482 relates to Category No.: 4030, 4029; Payload ID: 8483 relates to Category No.: 5561, 4029, 6717, 10056, 4008; Payload ID: 8484 relates to Category No.: 4029, 4030; Payload ID: 8485 relates to Category No.: 4030, 6717, 5570; Payload ID: 8486 relates to Category No.: 9305, 2890, 6717, 9242, 14145, 9247; Payload ID: 8487 relates to Category No.: 9305, 7118, 2890, 6717, 9242, 14145, 9247; Payload ID: 8488 relates to Category No.: 9305, 2890, 10056, 2942, 6222, 3696, 5622, 6717, 5762; Payload ID: 8489 relates to Category No.: 9305, 2890, 5762; Payload ID: 8490 relates to Category No.: 9305, 2890, 10056, 2942, 3696; Payload ID: 8491 relates to Category No.: 9305, 2890, 10056, 5762; Payload ID: 8492 relates to Category No.: 9305, 2890, 10056, 2942, 3696, 4030; Payload ID: 8493 relates to Category No.: 5727; Payload ID: 8494 relates to Category No.: 5727; Payload ID: 8495 relates to Category No.: 4030, 5727, 9247, 5730, 9184, 2907, 7366, 8902; Payload ID: 8496 relates to Category No.: 12159; Payload ID: 8497 relates to Category No.: 5561, 12159, 12406; Payload ID: 8498 relates to Category No.: 10056, 2942, 8935, 15139, 1748, 2534, 6017, 3636, 5561; Payload ID: 8499 relates to Category No.: 2890, 2194, 4010; Payload ID: 8500 relates to Category No.: 9305, 2942, 2455, 2441; Payload ID: 8501 relates to Category No.: 9305; Payload ID: 8502 relates to Category No.: 2890, 273, 2786; Payload ID: 8503 relates to Category No.: 2890, 6717, 11728, 2458, 5796, 2455, 9998, 2441, 2443; Payload ID: 8504 relates to Category No.: 2194, 11728, 5796, 2455, 1046, 2441, 10002, 2458, 9998, 9098; Payload ID: 8505 relates to Category No.: 11728, 2458, 5797, 2455, 1046, 2441, 4032, 14828, 14833, 14820; Payload ID: 8506 relates to Category No.: 2194, 2477, 4765, 6968, 11728, 2183, 5797, 2455, 4010, 10002, 2458, 9998, 4755, 2441, 3044, 2443, 7244; Payload ID: 8507 relates to Category No.: 11728, 5797, 2455, 2194, 2458, 5762; Payload ID: 8508 relates to Category No.: 6717, 5762, 7244, 11728, 2458, 5797, 2455, 2194, 14828, 14833; Payload ID: 8509 relates to Category No.: 2890, 6976, 6968, 11728, 5796, 2455; Payload ID: 8510 relates to Category No.: 2890, 2194, 7244, 11728, 2458, 5797, 2455, 2441, 7246; Payload ID: 8511 relates to Category No.: 7244, 11728, 2183, 5797, 2455, 2194, 2458, 9998, 3044, 2443; Payload ID: 8512 relates to Category No.: 2194, 4755, 11728, 2458, 5797, 2455, 2441, 9998, 1046, 3044; Payload ID: 8513 relates to Category No.: 2194, 2458, 5797, 2899, 7244, 11728, 2455, 9305; Payload ID: 8514 relates to Category No.: 2890, 2194, 11728, 2458, 5797, 2455; Payload ID: 8515 relates to Category No.: 2194, 7244, 11728, 2458, 5797, 2455, 2441, 14828, 14833; Payload ID: 8516 relates to Category No.: 7244, 11728, 2183, 2458, 5797, 2455, 2441, 2194, 9998, 1046, 2443, 261, 7246, 1038, 5971; Payload ID: 8517 relates to Category No.: 9305, 9247, 14798; Payload ID: 8518 relates to Category No.: 2890, 1792; Payload ID: 8519 relates to Category No.: 9305, 2890, 6717, 6960, 14893, 2445, 2443; Payload ID: 8520 relates to Category No.: 9305, 2890, 3666, 9734; Payload ID: 8521 relates to Category No.: 2890, 4010, 2701; Payload ID: 8522 relates to Category No.: 5561, 10056; Payload ID: 8523 relates to Category No.: 9305, 6717; Payload ID: 8525 relates to Category No.: 11653, 5441; Payload ID: 8526 relates to Category No.: 262, 7244; Payload ID: 8527 relates to Category No.: 2194, 2942, 9247, 6968, 4010, 5597, 9998, 10002; Payload ID: 8530 relates to Category No.: 11728, 7118; Payload ID: 8536 relates to Category No.: 4010; Payload ID: 8537 relates to Category No.: 2890, 6960, 10056, 2942, 8935, 4043, 9247, 6994, 273, 1748, 6968, 276, 1017, 4860, 4010, 14327, 4228, 2907, 14647, 1811, 6717, 6075, 14145, 1750, 11883, 5762; Payload ID: 8538 relates to Category No.: 2890, 6960, 2942, 273, 6017, 4199, 4010, 1792, 4197, 6989, 5762; Payload ID: 8539 relates to Category No.: 2942, 2890, 1811, 6075, 5762; Payload ID: 8546 relates to Category No.: 4029; Payload ID: 8547 relates to Category No.: 2890, 2942, 7118; Payload ID: 8548 relates to Category No.: 7060; Payload ID: 8549 relates to Category No.: 7060, 7118; Payload ID: 8550 relates to Category No.: 7060, 9305, 7118, 2890, 2942; Payload ID: 8551 relates to Category No.: 9305; Payload ID: 8552 relates to Category No.: 9305; Payload ID: 8553 relates to Category No.: 9305, 2890, 1017; Payload ID: 8554 relates to Category No.: 9305; Payload ID: 8555 relates to Category No.: 9305; Payload ID: 8556 relates to Category No.: 9305; Payload ID: 8557 relates to Category No.: 4029, 2942, 9247; Payload ID: 8558 relates to Category No.: 9305, 7118, 2890, 9247; Payload ID: 8559 relates to Category No.: 9305; Payload ID: 8560 relates to Category No.: 4029, 4030, 8948; Payload ID: 8561 relates to Category No.: 2890, 2942, 4765, 1748, 15161, 14412, 15628, 3036, 9734, 4769, 5561; Payload ID: 8563 relates to Category No.: 4010; Payload ID: 8564 relates to Category No.: 9756, 4010; Payload ID: 8565 relates to Category No.: 9305, 7118, 2890; Payload ID: 8566 relates to Category No.: 2890, 2942, 9756, 4010, 9753, 7118; Payload ID: 8567 relates to Category No.: 7118, 7060, 4010, 2942, 7048, 9756; Payload ID: 8568 relates to Category No.: 9305, 7118, 7060, 7366; Payload ID: 8569 relates to Category No.: 7118, 9305, 7060; Payload ID: 8570 relates to Category No.: 7118, 9242, 9247, 7060; Payload ID: 8571 relates to Category No.: 2890, 6717, 2942, 9247, 4010; Payload ID: 8572 relates to Category No.: 7118, 2890, 2942, 7060; Payload ID: 8573 relates to Category No.: 2942, 9756; Payload ID: 8574 relates to Category No.: 2942, 9756; Payload ID: 8576 relates to Category No.: 5561, 6717, 3673, 3666; Payload ID: 8577 relates to Category No.: 7060, 7061, 7118, 9247; Payload ID: 8578 relates to Category No.: 4029; Payload ID: 8579 relates to Category No.: 4029; Payload ID: 8580 relates to Category No.: 9247, 1635, 12218, 1634, 11647, 11649; Payload ID: 8582 relates to Category No.: 9305, 2890, 6717, 10056, 2942, 4010, 2926, 1720; Payload ID: 8583 relates to Category No.: 9305, 2890, 9247; Payload ID: 8584 relates to Category No.: 5561; Payload ID: 8585 relates to Category No.: 5561, 10056; Payload ID: 8586 relates to Category No.: 4029, 9305; Payload ID: 8587 relates to Category No.: 5561, 10056, 262, 261; Payload ID: 8588 relates to Category No.: 10056, 677; Payload ID: 8589 relates to Category No.: 9305, 2890, 10056, 2942, 9247, 5102, 5597; Payload ID: 8590 relates to Category No.: 9247, 5102, 4010; Payload ID: 8591 relates to Category No.: 5102; Payload ID: 8592 relates to Category No.: 5561, 4029, 6717, 10056, 5570, 447, 779, 778; Payload ID: 8593 relates to Category No.: 5561, 6717, 10056, 5570; Payload ID: 8594 relates to Category No.: 5561, 3673, 3666; Payload ID: 8595 relates to Category No.: 9305, 2890, 6717, 2938, 2942, 4043, 3652, 4228; Payload ID: 8596 relates to Category No.: 9305, 2890, 6717, 2938, 2942, 4043, 9247, 6743, 1659, 3695, 9181; Payload ID: 8597 relates to Category No.: 6717, 2938, 2942, 4043, 3652, 2890; Payload ID: 8598 relates to Category No.: 2890, 6960, 14145, 4049, 6968; Payload ID: 8599 relates to Category No.: 4755; Payload ID: 8600 relates to Category No.: 4755; Payload ID: 8601 relates to Category No.: 9305, 15531; Payload ID: 8602 relates to Category No.: 4029, 7048, 2942, 3523; Payload ID: 8603 relates to Category No.: 5561, 3673; Payload ID: 8604 relates to Category No.: 4030, 4029, 1239, 4010, 7219, 3265, 14414, 14408, 9613; Payload ID: 8605 relates to Category No.: 2890, 6717, 10056; Payload ID: 8606 relates to Category No.: 2942; Payload ID: 8607 relates to Category No.: 2890, 9305, 14145; Payload ID: 8608 relates to Category No.: 9305; Payload ID: 8609 relates to Category No.: 5762, 9247; Payload ID: 8611 relates to Category No.: 9305, 9242, 9247, 2942, 10056, 14145; Payload ID: 8613 relates to Category No.: 4010; Payload ID: 8614 relates to Category No.: 9305, 9247, 5216, 3861; Payload ID: 8615 relates to Category No.: 5561, 7118, 2890, 6717, 2194, 5570, 6994, 14893; Payload ID: 8616 relates to Category No.: 15505, 9247, 2402, 9157, 9305; Payload ID: 8617 relates to Category No.: 9305, 15505, 9247, 2402, 9157, 11883, 12170; Payload ID: 8618 relates to Category No.: 9305, 9247; Payload ID: 8619 relates to Category No.: 9305, 15505, 9247, 9158, 9167, 15531, 2942, 9157; Payload ID: 8620 relates to Category No.: 9305, 2890, 2938, 10056, 9247, 1748, 1750; Payload ID: 8621 relates to Category No.: 9305, 2890, 2938, 10056, 2942, 3113, 1811, 1803, 4010, 4228, 1643, 2918, 5596, 16337, 12170, 4381, 6717, 16326, 5727, 273, 6075, 781, 4089; Payload ID: 8622 relates to Category No.: 10056, 1182, 5570, 5561; Payload ID: 8623 relates to Category No.: 4030, 5561, 10056, 4755, 3113, 1810, 1182, 1811, 9574, 14384; Payload ID: 8624 relates to Category No.: 14371, 14368; Payload ID: 8625 relates to Category No.: 5561, 10056, 5920, 5919, 3666, 3673, 16326; Payload ID: 8626 relates to Category No.: 5561, 10056, 5920, 2942, 6717, 16326, 5919; Payload ID: 8627 relates to Category No.: 5561, 10056, 5920, 3666, 3673, 5919; Payload ID: 8628 relates to Category No.: 5561, 10056, 5920, 3054, 14683; Payload ID: 8629 relates to Category No.: 4030, 9305, 9247, 14937, 15514, 401, 5102, 7161, 9157; Payload ID: 8630 relates to Category No.: 9305, 9247, 401, 9601, 5964, 5102, 196, 375, 5342, 2942, 9157; Payload ID: 8631 relates to Category No.: 9305, 9242, 9247, 9734, 10015, 9153, 15130, 15505; Payload ID: 8632 relates to Category No.: 9305, 9242, 9247, 4755, 9273, 7253, 10104; Payload ID: 8633 relates to Category No.: 9305, 9247, 9273, 7253; Payload ID: 8634 relates to Category No.: 9305, 2890, 9247, 5102; Payload ID: 8635 relates to Category No.: 9305, 9247, 5102, 9184, 7296, 7179, 5964; Payload ID: 8636 relates to Category No.: 2942, 273, 4010; Payload ID: 8637 relates to Category No.: 9305, 4010; Payload ID: 8638 relates to Category No.: 4029, 4030, 10056, 4010; Payload ID: 8639 relates to Category No.: 4029; Payload ID: 8640 relates to Category No.: 4029; Payload ID: 8641 relates to Category No.: 4030, 4755, 4010, 4029; Payload ID: 8642 relates to Category No.: 4030, 4010; Payload ID: 8643 relates to Category No.: 4030, 4029, 2890, 4010, 14409; Payload ID: 8644 relates to Category No.: 4030, 4010; Payload ID: 8645 relates to Category No.: 4029; Payload ID: 8646 relates to Category No.: 4029, 5762, 4010; Payload ID: 8647 relates to Category No.: 4030, 4029, 9305, 4010, 11883; Payload ID: 8648 relates to Category No.: 4029; Payload ID: 8649 relates to Category No.: 4030, 3779; Payload ID: 8650 relates to Category No.: 4030, 4029, 7118, 2890, 9242, 3666, 9247, 6968, 9184, 5597; Payload ID: 8651 relates to Category No.: 4030, 4029, 3779; Payload ID: 8652 relates to Category No.: 4030, 2890; Payload ID: 8653 relates to Category No.: 4029; Payload ID: 8654 relates to Category No.: 9305, 6976, 14953, 273, 9734, 4860; Payload ID: 8655 relates to Category No.: 2890, 6717, 2942, 9247, 9199, 4010, 9184, 3682, 9162, 9195, 5762, 11883; Payload ID: 8656 relates to Category No.: 9305, 2890, 2942, 9247, 3036, 9199; Payload ID: 8657 relates to Category No.: 9305, 2890, 6717, 2942, 9247, 9199; Payload ID: 8658 relates to Category No.: 9305, 2890, 2942, 9247, 9199; Payload ID: 8659 relates to Category No.: 9305, 2890, 2942, 9247, 9199, 4010; Payload ID: 8660 relates to Category No.: 9305, 2890, 2942, 9247, 9199; Payload ID: 8661 relates to Category No.: 9305, 2890, 6717, 2942, 9247, 9199; Payload ID: 8662 relates to Category No.: 9305, 2890, 2942, 9247, 9199; Payload ID: 8663 relates to Category No.: 9305, 9247, 2630, 5102, 7179; Payload ID: 8664 relates to Category No.: 5102; Payload ID: 8665 relates to Category No.: 9247, 5102, 9134; Payload ID: 8666 relates to Category No.: 9305, 5776, 9242, 9247, 5102, 9134; Payload ID: 8667 relates to Category No.: 9305, 2890, 6976, 6960, 2194, 14906, 9247, 6994, 14893, 10056, 1017, 6222, 8948, 4860; Payload ID: 8668 relates to Category No.: 2890, 6960, 6968; Payload ID: 8669 relates to Category No.: 2890, 6960; Payload ID: 8670 relates to Category No.: 9305, 2890, 6717, 6960, 2194, 10056, 14906, 6968, 5928, 1017, 8948, 4860, 6994; Payload ID: 8671 relates to Category No.: 9242; Payload ID: 8672 relates to Category No.: 4029, 12159, 5749; Payload ID: 8673 relates to Category No.: 9305, 2890, 2938, 3113, 2701; Payload ID: 8674 relates to Category No.: 5561, 6717; Payload ID: 8675 relates to Category No.: 3671; Payload ID: 8676 relates to Category No.: 1842, 3671; Payload ID: 8677 relates to Category No.: 5561, 6717, 3673, 3686, 3685, 2666, 4755, 3666, 2477; Payload ID: 8678 relates to Category No.: 5561, 3673, 3666, 4755, 4010, 2477; Payload ID: 8679 relates to Category No.: 5561, 3673; Payload ID: 8680 relates to Category No.: 2890; Payload ID: 8681 relates to Category No.: 9305, 2890; Payload ID: 8682 relates to Category No.: 9305; Payload ID: 8683 relates to Category No.: 2890, 2942, 9157; Payload ID: 8685 relates to Category No.: 5561, 2786; Payload ID: 8686 relates to Category No.: 2786; Payload ID: 8687 relates to Category No.: 2786; Payload ID: 8688 relates to Category No.: 2890; Payload ID: 8690 relates to Category No.: 2786; Payload ID: 8691 relates to Category No.: 2786; Payload ID: 8692 relates to Category No.: 2890, 2786; Payload ID: 8693 relates to Category No.: 2786; Payload ID: 8694 relates to Category No.: 2786; Payload ID: 8696 relates to Category No.: 2786, 1842; Payload ID: 8697 relates to Category No.: 2942, 2786, 1842; Payload ID: 8698 relates to Category No.: 4755, 2786, 14893; Payload ID: 8699 relates to Category No.: 2890, 6976, 2942, 9247, 6994, 2786, 276, 3666, 9305, 4228, 1803; Payload ID: 8700 relates to Category No.: 2890, 2938, 2786, 8948, 3036; Payload ID: 8701 relates to Category No.: 2890, 2786; Payload ID: 8703 relates to Category No.: 2942, 4765, 2786, 3831; Payload ID: 8704 relates to Category No.: 6994, 2786; Payload ID: 8705 relates to Category No.: 2942, 3673, 8935, 3666, 2786, 8948; Payload ID: 8706 relates to Category No.: 2786; Payload ID: 8707 relates to Category No.: 4030, 273, 1748, 11650, 2786, 11653, 3037, 8948; Payload ID: 8708 relates to Category No.: 2786; Payload ID: 8709 relates to Category No.: 2890, 2942, 273, 2786, 6017, 14327, 5561; Payload ID: 8710 relates to Category No.: 2890, 273, 4755, 9734, 2786, 3036, 15573, 1017, 10104; Payload ID: 8711 relates to Category No.: 2890, 2194, 2786, 10110; Payload ID: 8712 relates to Category No.: 2890, 2194, 2786, 7161, 10110; Payload ID: 8713 relates to Category No.: 2786; Payload ID: 8714 relates to Category No.: 2890, 2786, 1017, 9730; Payload ID: 8715 relates to Category No.: 2890, 2786; Payload ID: 8716 relates to Category No.: 2786; Payload ID: 8717 relates to Category No.: 2786; Payload ID: 8718 relates to Category No.: 2786; Payload ID: 8719 relates to Category No.: 2938, 2942, 2786; Payload ID: 8720 relates to Category No.: 2786; Payload ID: 8721 relates to Category No.: 2786; Payload ID: 8722 relates to Category No.: 2786; Payload ID: 8723 relates to Category No.: 273, 2786; Payload ID: 8724 relates to Category No.: 4030, 2786; Payload ID: 8726 relates to Category No.: 2786; Payload ID: 8727 relates to Category No.: 2786; Payload ID: 8728 relates to Category No.: 2890, 2938, 2786; Payload ID: 8729 relates to Category No.: 2786, 5342, 196; Payload ID: 8730 relates to Category No.: 9305, 2890, 2938, 10056, 3673, 2786, 14371, 14327, 6449, 12219; Payload ID: 8731 relates to Category No.: 2890, 2786, 14893; Payload ID: 8732 relates to Category No.: 2890, 2938, 2786; Payload ID: 8734 relates to Category No.: 9305, 2890, 10056, 9242, 9247, 2786; Payload ID: 8735 relates to Category No.: 9247, 2786; Payload ID: 8736 relates to Category No.: 6994, 2786; Payload ID: 8737 relates to Category No.: 5561, 10056, 6717; Payload ID: 8738 relates to Category No.: 4030, 9305, 6717, 2938, 5727, 10056, 4014, 1239, 4010, 5934; Payload ID: 8739 relates to Category No.: 4030, 9305, 2890, 6717, 5727, 4010, 5934; Payload ID: 8740 relates to Category No.: 5727, 4010; Payload ID: 8741 relates to Category No.: 9305, 5727, 5934, 4010, 5730; Payload ID: 8742 relates to Category No.: 9305, 2890, 5727, 5934, 2942, 4010, 1772, 5762; Payload ID: 8743 relates to Category No.: 9305, 5727, 4010; Payload ID: 8744 relates to Category No.: 9305, 2938, 5727, 4010; Payload ID: 8745 relates to Category No.: 2890, 5727, 4010, 1772; Payload ID: 8746 relates to Category No.: 2890, 5727, 6976, 5934, 9242, 9734, 4010, 2182, 1772; Payload ID: 8747 relates to Category No.: 5727, 10056, 4010, 1772, 2738, 14363, 16326, 15285, 3518; Payload ID: 8748 relates to Category No.: 4030, 9305, 2890, 6717, 5727, 5934, 4755, 4010, 5730; Payload ID: 8749 relates to Category No.: 2890, 5727; Payload ID: 8750 relates to Category No.: 5727; Payload ID: 8751 relates to Category No.: 5727; Payload ID: 8752 relates to Category No.: 2890, 5727, 4010, 5730; Payload ID: 8753 relates to Category No.: 2890, 5727, 4010; Payload ID: 8754 relates to Category No.: 5727, 4010; Payload ID: 8755 relates to Category No.: 2890, 5727, 4010; Payload ID: 8756 relates to Category No.: 2890, 5727, 4010; Payload ID: 8757 relates to Category No.: 5727, 5934, 4010; Payload ID: 8758 relates to Category No.: 4030, 5727, 4010; Payload ID: 8759 relates to Category No.: 5727, 4010; Payload ID: 8760 relates to Category No.: 4030, 5727; Payload ID: 8761 relates to Category No.: 4030, 5727, 4010; Payload ID: 8762 relates to Category No.: 4030, 5727, 4010; Payload ID: 8763 relates to Category No.: 5727, 4030, 4010; Payload ID: 8764 relates to Category No.: 5727, 4010, 5730; Payload ID: 8765 relates to Category No.: 5727, 4010; Payload ID: 8766 relates to Category No.: 5727, 4010; Payload ID: 8767 relates to Category No.: 5727; Payload ID: 8768 relates to Category No.: 9305, 5727, 5934, 5730, 1792; Payload ID: 8769 relates to Category No.: 5727; Payload ID: 8770 relates to Category No.: 9305, 2890, 6717, 5727, 5934, 2942, 4010, 10056, 7118; Payload ID: 8771 relates to Category No.: 9305, 6717, 5727, 5934, 4010; Payload ID: 8772 relates to Category No.: 5727, 5934, 4010; Payload ID: 8773 relates to Category No.: 5727, 5934, 4010; Payload ID: 8774 relates to Category No.: 9305, 2890, 5727, 5934, 4010; Payload ID: 8775 relates to Category No.: 2890, 5727, 5934, 4010; Payload ID: 8776 relates to Category No.: 5727, 5934, 4010; Payload ID: 8777 relates to Category No.: 9305, 5727, 5934, 4010; Payload ID: 8778 relates to Category No.: 5727, 5934, 2890, 4010; Payload ID: 8779 relates to Category No.: 5727, 5934, 4010, 5762; Payload ID: 8780 relates to Category No.: 9305, 5727, 5934, 4010; Payload ID: 8781 relates to Category No.: 2938, 5727, 5934, 4010; Payload ID: 8782 relates to Category No.: 4030, 5727, 5934, 4010; Payload ID: 8783 relates to Category No.: 5727, 5934, 4010; Payload ID: 8784 relates to Category No.: 9305, 2890, 5727, 9247, 4010, 5730, 9181, 1811, 1772, 14363, 16326, 5934, 2738, 3518; Payload ID: 8785 relates to Category No.: 2890, 5727, 5934; Payload ID: 8786 relates to Category No.: 4030, 5727, 5934; Payload ID: 8787 relates to Category No.: 5727, 5934; Payload ID: 8788 relates to Category No.: 4030, 5727, 5934; Payload ID: 8789 relates to Category No.: 5727, 5934, 4010, 5730; Payload ID: 8790 relates to Category No.: 4030, 5727, 5934; Payload ID: 8791 relates to Category No.: 5727, 4030, 5934, 4010; Payload ID: 8792 relates to Category No.: 4030, 9305, 6717, 5727, 4010; Payload ID: 8793 relates to Category No.: 5934; Payload ID: 8794 relates to Category No.: 5934; Payload ID: 8795 relates to Category No.: 5934; Payload ID: 8796 relates to Category No.: 5934; Payload ID: 8797 relates to Category No.: 5934; Payload ID: 8798 relates to Category No.: 5934; Payload ID: 8799 relates to Category No.: 5934; Payload ID: 8800 relates to Category No.: 5934; Payload ID: 8801 relates to Category No.: 5934; Payload ID: 8802 relates to Category No.: 5934; Payload ID: 8803 relates to Category No.: 5934; Payload ID: 8804 relates to Category No.: 5934; Payload ID: 8805 relates to Category No.: 5934; Payload ID: 8806 relates to Category No.: 5934; Payload ID: 8807 relates to Category No.: 5934; Payload ID: 8808 relates to Category No.: 5934; Payload ID: 8809 relates to Category No.: 5934; Payload ID: 8810 relates to Category No.: 5934; Payload ID: 8811 relates to Category No.: 5934; Payload ID: 8812 relates to Category No.: 5727; Payload ID: 8813 relates to Category No.: 5727; Payload ID: 8814 relates to Category No.: 5727; Payload ID: 8815 relates to Category No.: 5727; Payload ID: 8816 relates to Category No.: 5934; Payload ID: 8817 relates to Category No.: 5934, 1842; Payload ID: 8818 relates to Category No.: 5727; Payload ID: 8819 relates to Category No.: 5934; Payload ID: 8820 relates to Category No.: 5727; Payload ID: 8821 relates to Category No.: 5727; Payload ID: 8822 relates to Category No.: 5727; Payload ID: 8823 relates to Category No.: 5727; Payload ID: 8824 relates to Category No.: 5727; Payload ID: 8825 relates to Category No.: 5727; Payload ID: 8826 relates to Category No.: 5727; Payload ID: 8827 relates to Category No.: 5727; Payload ID: 8828 relates to Category No.: 5727; Payload ID: 8829 relates to Category No.: 5727; Payload ID: 8830 relates to Category No.: 5727; Payload ID: 8831 relates to Category No.: 5727; Payload ID: 8832 relates to Category No.: 5727; Payload ID: 8833 relates to Category No.: 5934; Payload ID: 8834 relates to Category No.: 5727; Payload ID: 8835 relates to Category No.: 5727; Payload ID: 8836 relates to Category No.: 5727; Payload ID: 8837 relates to Category No.: 5934; Payload ID: 8838 relates to Category No.: 5727; Payload ID: 8839 relates to Category No.: 5727; Payload ID: 8840 relates to Category No.: 5934; Payload ID: 8841 relates to Category No.: 5727; Payload ID: 8842 relates to Category No.: 5934; Payload ID: 8843 relates to Category No.: 5934; Payload ID: 8844 relates to Category No.: 5727; Payload ID: 8845 relates to Category No.: 5727; Payload ID: 8846 relates to Category No.: 5727; Payload ID: 8847 relates to Category No.: 5934; Payload ID: 8848 relates to Category No.: 5934; Payload ID: 8849 relates to Category No.: 5934; Payload ID: 8850 relates to Category No.: 5934; Payload ID: 8851 relates to Category No.: 5934; Payload ID: 8852 relates to Category No.: 5934; Payload ID: 8853 relates to Category No.: 5934; Payload ID: 8854 relates to Category No.: 5934; Payload ID: 8855 relates to Category No.: 5934; Payload ID: 8856 relates to Category No.: 5934; Payload ID: 8857 relates to Category No.: 5934; Payload ID: 8858 relates to Category No.: 5934; Payload ID: 8859 relates to Category No.: 5934; Payload ID: 8860 relates to Category No.: 5934; Payload ID: 8861 relates to Category No.: 5934; Payload ID: 8862 relates to Category No.: 5934; Payload ID: 8863 relates to Category No.: 5934; Payload ID: 8864 relates to Category No.: 5934; Payload ID: 8865 relates to Category No.: 5934; Payload ID: 8866 relates to Category No.: 5934; Payload ID: 8867 relates to Category No.: 5934; Payload ID: 8868 relates to Category No.: 5934; Payload ID: 8869 relates to Category No.: 5934; Payload ID: 8870 relates to Category No.: 5727; Payload ID: 8871 relates to Category No.: 5934; Payload ID: 8872 relates to Category No.: 5934; Payload ID: 8873 relates to Category No.: 5934; Payload ID: 8874 relates to Category No.: 5727, 2942; Payload ID: 8875 relates to Category No.: 5727; Payload ID: 8876 relates to Category No.: 5727; Payload ID: 8877 relates to Category No.: 5727; Payload ID: 8878 relates to Category No.: 5727; Payload ID: 8879 relates to Category No.: 5934; Payload ID: 8880 relates to Category No.: 5934; Payload ID: 8881 relates to Category No.: 5934; Payload ID: 8883 relates to Category No.: 5934; Payload ID: 8884 relates to Category No.: 5934; Payload ID: 8885 relates to Category No.: 5934; Payload ID: 8886 relates to Category No.: 5934; Payload ID: 8887 relates to Category No.: 5727; Payload ID: 8888 relates to Category No.: 5561, 9362, 1842; Payload ID: 8889 relates to Category No.: 5561; Payload ID: 8890 relates to Category No.: 2890, 1748, 1720, 1750; Payload ID: 8891 relates to Category No.: 4029; Payload ID: 8892 relates to Category No.: 2890, 4010; Payload ID: 8893 relates to Category No.: 4030, 4029, 12159, 4763, 6437; Payload ID: 8894 relates to Category No.: 2890, 2942, 4010, 9305; Payload ID: 8895 relates to Category No.: 1842; Payload ID: 8897 relates to Category No.: 9305, 6717, 9247, 2890, 4853; Payload ID: 8898 relates to Category No.: 9305; Payload ID: 8899 relates to Category No.: 9305, 9247; Payload ID: 8900 relates to Category No.: 5561; Payload ID: 8902 relates to Category No.: 6717, 2942, 9247, 2920, 9305, 3036, 8948; Payload ID: 8903 relates to Category No.: 5561; Payload ID: 8904 relates to Category No.: 4029; Payload ID: 8905 relates to Category No.: 9305, 2890, 9247, 9734; Payload ID: 8906 relates to Category No.: 7118; Payload ID: 8907 relates to Category No.: 2942, 3666, 16269, 3521; Payload ID: 8910 relates to Category No.: 5561, 10056, 3521, 3523; Payload ID: 8911 relates to Category No.: 5561, 4010, 2926; Payload ID: 8913 relates to Category No.: 9305, 6717, 2194, 3666, 2899, 11836, 3521, 3636, 6059, 3831, 3685, 7321; Payload ID: 8914 relates to Category No.: 7118; Payload ID: 8916 relates to Category No.: 6717, 9756; Payload ID: 8917 relates to Category No.: 2890; Payload ID: 8918 relates to Category No.: 4030, 9305, 10056, 9247; Payload ID: 8919 relates to Category No.: 2890, 2194, 2441; Payload ID: 8920 relates to Category No.: 2890, 2194; Payload ID: 8924 relates to Category No.: 9305; Payload ID: 8925 relates to Category No.: 5561, 2890, 10056, 3666; Payload ID: 8927 relates to Category No.: 5561; Payload ID: 8928 relates to Category No.: 5561; Payload ID: 8929 relates to Category No.: 16269, 1233, 3693, 9247, 3521; Payload ID: 8931 relates to Category No.: 5561, 9305, 6717; Payload ID: 8934 relates to Category No.: 5561, 9184; Payload ID: 8935 relates to Category No.: 2890, 1842; Payload ID: 8939 relates to Category No.: 2890; Payload ID: 8941 relates to Category No.: 6443, 5570, 15573, 4010, 6060, 6059, 6440, 5561; Payload ID: 8942 relates to Category No.: 5561; Payload ID: 8944 relates to Category No.: 9247, 9215, 7014; Payload ID: 8945 relates to Category No.: 2890; Payload ID: 8946 relates to Category No.: 447, 1811, 1748; Payload ID: 8947 relates to Category No.: 5561; Payload ID: 8949 relates to Category No.: 5561, 2890, 10056; Payload ID: 8950 relates to Category No.: 5561; Payload ID: 8951 relates to Category No.: 5561; Payload ID: 8955 relates to Category No.: 5561; Payload ID: 8957 relates to Category No.: 9305, 7118; Payload ID: 8958 relates to Category No.: 5561, 3673, 3682; Payload ID: 8961 relates to Category No.: 5561, 779; Payload ID: 8964 relates to Category No.: 5561, 6717; Payload ID: 8965 relates to Category No.: 16327; Payload ID: 8967 relates to Category No.: 1842; Payload ID: 8968 relates to Category No.: 4030; Payload ID: 8969 relates to Category No.: 7118, 2938; Payload ID: 8970 relates to Category No.: 5561; Payload ID: 8971 relates to Category No.: 10056, 5570, 5561; Payload ID: 8972 relates to Category No.: 5561, 10056; Payload ID: 8974 relates to Category No.: 5561, 10056, 5570; Payload ID: 8975 relates to Category No.: 4029; Payload ID: 8976 relates to Category No.: 10056, 5570, 5561; Payload ID: 8977 relates to Category No.: 5561, 10056; Payload ID: 8978 relates to Category No.: 5561, 10056, 5570; Payload ID: 8979 relates to Category No.: 6717, 10056, 5570, 5561; Payload ID: 8980 relates to Category No.: 5561, 10056; Payload ID: 8981 relates to Category No.: 5561; Payload ID: 8982 relates to Category No.: 5561; Payload ID: 8983 relates to Category No.: 5561; Payload ID: 8984 relates to Category No.: 5561, 10056; Payload ID: 8985 relates to Category No.: 5570; Payload ID: 8986 relates to Category No.: 10056, 5570; Payload ID: 8987 relates to Category No.: 5561; Payload ID: 8988 relates to Category No.: 5561, 10056; Payload ID: 8989 relates to Category No.: 5561, 10056, 5570, 12406; Payload ID: 8990 relates to Category No.: 5561, 10056, 5570, 12406; Payload ID: 8991 relates to Category No.: 5561; Payload ID: 8992 relates to Category No.: 5561; Payload ID: 8993 relates to Category No.: 5561, 10056, 12406, 4008; Payload ID: 8994 relates to Category No.: 6717, 10056, 5570, 5561; Payload ID: 8995 relates to Category No.: 5570; Payload ID: 8996 relates to Category No.: 5561, 10056; Payload ID: 8997 relates to Category No.: 5561; Payload ID: 8998 relates to Category No.: 5561, 10056, 5570, 1792, 4008; Payload ID: 8999 relates to Category No.: 9305; Payload ID: 9000 relates to Category No.: 5561, 10056, 9734, 1811, 4010, 3054, 6743, 1777; Payload ID: 9001 relates to Category No.: 5561, 10056, 1811, 14647; Payload ID: 9002 relates to Category No.: 5561, 4029, 10056, 3054, 1017; Payload ID: 9003 relates to Category No.: 9305, 2890, 5776, 9181; Payload ID: 9004 relates to Category No.: 5561, 9247, 6717, 2942, 6059, 11883; Payload ID: 9005 relates to Category No.: 4029, 9305, 6717, 10056, 5570, 3693, 3666, 2899, 4755, 1748, 3521, 6743, 14797, 4008, 1772; Payload ID: 9006 relates to Category No.: 1842, 8948, 3036, 4925; Payload ID: 9007 relates to Category No.: 6717, 2942, 3673, 3666, 11883, 5762; Payload ID: 9008 relates to Category No.: 2890, 6717, 2942, 10056; Payload ID: 9009 relates to Category No.: 5561, 5557, 6717, 3673, 5570, 3666; Payload ID: 9010 relates to Category No.: 2890, 6717, 6960, 2942, 14906, 5961, 14902, 14893; Payload ID: 9011 relates to Category No.: 6960, 5961; Payload ID: 9012 relates to Category No.: 6960, 2194, 6994, 5961, 3696, 15574; Payload ID: 9013 relates to Category No.: 2890, 6960, 5961, 1017, 2942, 6989, 9577; Payload ID: 9014 relates to Category No.: 9305, 6717, 6960, 10056, 2942, 6994, 5961, 14903; Payload ID: 9015 relates to Category No.: 6960, 5961; Payload ID: 9016 relates to Category No.: 6960, 3693, 5961, 3521, 3523; Payload ID: 9017 relates to Category No.: 6960, 5961, 2942, 11728, 9998, 6968, 1046, 5797, 9729; Payload ID: 9018 relates to Category No.: 9305, 2890, 6976, 2942, 5961, 6968, 14327, 1659, 5967, 5964, 7166; Payload ID: 9019 relates to Category No.: 6960, 5961, 9305, 2890, 10056, 9242, 9247, 6978, 903; Payload ID: 9020 relates to Category No.: 6960, 5961, 2458, 1046; Payload ID: 9021 relates to Category No.: 2890, 6960, 5961, 8948, 8935; Payload ID: 9022 relates to Category No.: 7118, 6960, 8935, 5961, 2927, 6964, 2926; Payload ID: 9023 relates to Category No.: 6960, 3666, 5961, 4755; Payload ID: 9024 relates to Category No.: 6960, 5961, 4755, 9247, 6994, 14893; Payload ID: 9025 relates to Category No.: 9305, 2890, 6960, 2194, 9242, 9247, 6994, 5961, 9734, 1017, 4860, 14903, 7170, 7166, 2650, 6968; Payload ID: 9026 relates to Category No.: 2890, 6960, 5961; Payload ID: 9027 relates to Category No.: 2890, 6960, 5961; Payload ID: 9028 relates to Category No.: 9305, 2890, 6960, 2942, 9247, 5961, 5964, 4228, 7161, 2402, 14893; Payload ID: 9029 relates to Category No.: 9305, 6960, 2194, 2942, 9247, 6994, 5961, 14893, 4228, 7161, 2181, 5597; Payload ID: 9030 relates to Category No.: 6960, 2942, 5961, 2183, 11883; Payload ID: 9031 relates to Category No.: 2890, 6960, 5961; Payload ID: 9032 relates to Category No.: 6960, 2942, 5961; Payload ID: 9033 relates to Category No.: 2890, 6960, 5961; Payload ID: 9034 relates to Category No.: 2890, 6960, 5961, 2458, 4010; Payload ID: 9035 relates to Category No.: 9305, 6976, 6960, 9242, 2942, 5961, 2630, 6968, 14893; Payload ID: 9036 relates to Category No.: 6960, 5961, 9305, 6717, 2942, 2420, 2192, 2630, 2901, 6968, 5964, 6978; Payload ID: 9037 relates to Category No.: 2194, 2942, 6968, 11728, 14902, 2455, 4010, 5963, 6960, 5961, 2458, 9998, 8935, 7246, 5795, 1046, 15151; Payload ID: 9038 relates to Category No.: 6717, 2194, 2942, 6968, 11728, 14902, 2455, 4010, 10099, 5963, 2458, 5795, 14893, 6994; Payload ID: 9039 relates to Category No.: 6960, 2942, 5961, 11728, 2455; Payload ID: 9040 relates to Category No.: 2890, 6717, 2942, 9247, 6994, 5961, 2420, 14902, 9181; Payload ID: 9041 relates to Category No.: 6960, 2942, 9247, 5961, 9181; Payload ID: 9042 relates to Category No.: 6717, 6960, 2942, 5961, 9734; Payload ID: 9043 relates to Category No.: 2890, 6717, 6976, 6960, 5961, 9734, 16156, 3636, 8935, 2454, 6755; Payload ID: 9045 relates to Category No.: 6960, 5961, 2890, 6525; Payload ID: 9046 relates to Category No.: 5961, 2458, 2455, 6960; Payload ID: 9047 relates to Category No.: 2890, 6960, 5961, 10106, 16156; Payload ID: 9048 relates to Category No.: 9305, 6717, 6976, 6960, 5961, 3521, 14893; Payload ID: 9049 relates to Category No.: 2890, 6960, 5961; Payload ID: 9050 relates to Category No.: 6960, 2194, 2927, 4010, 16337, 4755, 5961; Payload ID: 9051 relates to Category No.: 6717, 2194, 2942, 14906, 5961, 14902, 14833; Payload ID: 9052 relates to Category No.: 6717, 6960, 2942, 2899, 5961, 4860, 2890, 2926, 1017, 8935, 2454, 6755; Payload ID: 9053 relates to Category No.: 6717, 6960, 2942, 5961, 11883, 5962, 2890, 8935, 2454; Payload ID: 9054 relates to Category No.: 5961, 6960, 2890, 8935, 7244, 2454; Payload ID: 9055 relates to Category No.: 2890, 6960, 5961; Payload ID: 9056 relates to Category No.: 2194, 2942, 6968, 11728, 14902, 2455, 4010, 2632, 5963, 9998, 4755, 3666, 1046, 2441, 9729, 5795; Payload ID: 9057 relates to Category No.: 2890, 10056, 273, 9305, 2942, 14906, 2630, 5967, 14333; Payload ID: 9058 relates to Category No.: 9305, 2890, 14906, 2630, 6968, 5964, 6978, 7161; Payload ID: 9059 relates to Category No.: 4030, 4029, 10056, 2942, 1239, 4010, 10077; Payload ID: 9060 relates to Category No.: 5561, 2890, 8948, 6968, 2441, 779, 2801, 778, 5971; Payload ID: 9061 relates to Category No.: 2890, 6717, 5762, 10056, 2942, 4043, 4228, 7118, 6743; Payload ID: 9062 relates to Category No.: 4029, 2890, 2942, 4030, 8935, 8948, 779; Payload ID: 9063 relates to Category No.: 5561, 10056, 5570, 1792, 6717, 5762; Payload ID: 9064 relates to Category No.: 4029, 2890, 6717, 2938, 10056, 5561, 4030; Payload ID: 9065 relates to Category No.: 2194, 1774, 5561, 2890; Payload ID: 9066 relates to Category No.: 4030, 5561, 4029, 5762, 10056, 5570, 4010; Payload ID: 9067 relates to Category No.: 5561, 5762, 10056; Payload ID: 9068 relates to Category No.: 5561; Payload ID: 9069 relates to Category No.: 9305, 2890, 14329; Payload ID: 9070 relates to Category No.: 7118, 2890; Payload ID: 9072 relates to Category No.: 2890; Payload ID: 9073 relates to Category No.: 5762; Payload ID: 9074 relates to Category No.: 5762; Payload ID: 9075 relates to Category No.: 5762, 1842; Payload ID: 9076 relates to Category No.: 9305, 5762; Payload ID: 9077 relates to Category No.: 9242; Payload ID: 9078 relates to Category No.: 5561, 6717; Payload ID: 9079 relates to Category No.: 5561, 6717, 10056, 3523; Payload ID: 9080 relates to Category No.: 4030, 6960, 2938, 10056, 1811, 2890, 11883; Payload ID: 9081 relates to Category No.: 9305, 2890, 6717, 9242, 14671, 5597; Payload ID: 9082 relates to Category No.: 9305, 9157; Payload ID: 9083 relates to Category No.: 9305; Payload ID: 9084 relates to Category No.: 9305; Payload ID: 9085 relates to Category No.: 9305; Payload ID: 9086 relates to Category No.: 9305; Payload ID: 9088 relates to Category No.: 9305; Payload ID: 9089 relates to Category No.: 9305; Payload ID: 9090 relates to Category No.: 9305; Payload ID: 9092 relates to Category No.: 9305; Payload ID: 9093 relates to Category No.: 9305; Payload ID: 9094 relates to Category No.: 9247, 9157, 2890, 9305, 9167, 9220, 15505, 2402; Payload ID: 9095 relates to Category No.: 2890, 5776, 10056, 9247, 4755, 9305; Payload ID: 9096 relates to Category No.: 9305; Payload ID: 9097 relates to Category No.: 9305; Payload ID: 9098 relates to Category No.: 9305; Payload ID: 9099 relates to Category No.: 9305, 2890, 10056, 9247; Payload ID: 9101 relates to Category No.: 2890, 16257, 4043, 3036; Payload ID: 9102 relates to Category No.: 2890, 16257; Payload ID: 9103 relates to Category No.: 9305, 16257, 2942, 3666, 4755, 3036, 1017, 1033, 12170; Payload ID: 9104 relates to Category No.: 2890, 16257, 10056, 2942, 3666; Payload ID: 9105 relates to Category No.: 1233; Payload ID: 9106 relates to Category No.: 7118, 2890, 2942, 9247; Payload ID: 9107 relates to Category No.: 5561, 7118, 2942, 7070, 4010, 7048; Payload ID: 9108 relates to Category No.: 2938, 16326; Payload ID: 9109 relates to Category No.: 9305, 1842; Payload ID: 9110 relates to Category No.: 9305, 10056, 9247, 2402, 2628; Payload ID: 9111 relates to Category No.: 9305; Payload ID: 9112 relates to Category No.: 9305; Payload ID: 9113 relates to Category No.: 9305; Payload ID: 9114 relates to Category No.: 5561, 10056, 1036, 1792, 4228, 4008, 6717, 11723, 15280; Payload ID: 9115 relates to Category No.: 5561, 7118, 7048, 5562; Payload ID: 9116 relates to Category No.: 9305; Payload ID: 9118 relates to Category No.: 2890, 6717, 9247, 15465; Payload ID: 9119 relates to Category No.: 9305, 16195, 14145; Payload ID: 9120 relates to Category No.: 6717; Payload ID: 9121 relates to Category No.: 2890, 6717, 9242, 2942, 2920, 10161; Payload ID: 9122 relates to Category No.: 9305, 2890, 14145; Payload ID: 9123 relates to Category No.: 9305, 2890, 14145, 9247, 4755; Payload ID: 9124 relates to Category No.: 9305; Payload ID: 9128 relates to Category No.: 4030, 4029, 14409; Payload ID: 9129 relates to Category No.: 4030, 4765, 4763; Payload ID: 9130 relates to Category No.: 7118, 2890; Payload ID: 9131 relates to Category No.: 7118; Payload ID: 9133 relates to Category No.: 6717, 10056, 5570, 779, 1335; Payload ID: 9134 relates to Category No.: 5561, 3673, 3666, 1335; Payload ID: 9135 relates to Category No.: 9305, 2890, 6717, 2942, 4010, 5561, 14825, 7118; Payload ID: 9136 relates to Category No.: 2890, 4010; Payload ID: 9137 relates to Category No.: 9305, 2890, 7118; Payload ID: 9138 relates to Category No.: 2890, 6717, 2942, 4010, 6743, 7118, 7366; Payload ID: 9139 relates to Category No.: 9305, 2890, 4010, 2458, 7244, 5561; Payload ID: 9140 relates to Category No.: 7118, 7048; Payload ID: 9141 relates to Category No.: 7118; Payload ID: 9142 relates to Category No.: 4030, 1099, 4010, 2890; Payload ID: 9143 relates to Category No.: 4030, 4029, 9305, 2890, 14409, 4010, 1792, 11883, 14802, 9775; Payload ID: 9144 relates to Category No.: 4010, 1090; Payload ID: 9145 relates to Category No.: 9305, 15505; Payload ID: 9146 relates to Category No.: 9305; Payload ID: 9147 relates to Category No.: 5561; Payload ID: 9148 relates to Category No.: 9305, 2890, 5727, 2942, 9247, 9734, 6023, 9184, 9162, 9215, 9178, 9181; Payload ID: 9149 relates to Category No.: 5561, 6717, 5565, 9184, 9162; Payload ID: 9150 relates to Category No.: 5727, 9176, 6023, 6717, 9247, 9184, 9162, 9305, 9181; Payload ID: 9151 relates to Category No.: 5727, 9176, 9305, 9162, 6023; Payload ID: 9152 relates to Category No.: 5727, 2890, 9305, 9162; Payload ID: 9154 relates to Category No.: 4030, 4029, 12159, 4014, 1090, 6028, 6032, 1811, 6025; Payload ID: 9155 relates to Category No.: 4029, 4014, 4010, 1090, 14363, 1083, 3055; Payload ID: 9156 relates to Category No.: 4029, 4010, 1090, 6033; Payload ID: 9157 relates to Category No.: 1083, 4029, 4014, 4010, 1090; Payload ID: 9158 relates to Category No.: 4030, 4029, 9305, 4014, 4010, 1090, 1083, 6029, 6030, 12159, 6033; Payload ID: 9159 relates to Category No.: 4030, 4029, 4014, 9734, 4010, 1090, 6029, 6028, 6031, 6034, 12159, 1083, 6025; Payload ID: 9160 relates to Category No.: 4029, 4014, 4010, 1090, 1083, 6030, 6032, 15139, 6025; Payload ID: 9161 relates to Category No.: 4029, 1090, 6033; Payload ID: 9162 relates to Category No.: 1090; Payload ID: 9163 relates to Category No.: 4030, 4029, 4014, 4010, 1090, 6029, 6030, 6028, 1083, 12159; Payload ID: 9164 relates to Category No.: 4029, 1090, 6033, 4030, 6717, 12159, 9734, 1720, 6031; Payload ID: 9165 relates to Category No.: 4029, 6717, 12159, 1090; Payload ID: 9166 relates to Category No.: 9305, 2890, 4010; Payload ID: 9167 relates to Category No.: 9305, 2890, 10056, 2942, 2710; Payload ID: 9169 relates to Category No.: 6717, 3673, 6222; Payload ID: 9170 relates to Category No.: 9305, 2890, 6717, 2942, 3666, 1377; Payload ID: 9171 relates to Category No.: 6976, 2942, 14906, 5762; Payload ID: 9172 relates to Category No.: 9305, 2890, 6976, 2942, 14906; Payload ID: 9173 relates to Category No.: 2890, 6717, 6976, 9242, 9247, 7179; Payload ID: 9174 relates to Category No.: 2890, 2701; Payload ID: 9175 relates to Category No.: 2890, 2701; Payload ID: 9176 relates to Category No.: 2890, 2701; Payload ID: 9177 relates to Category No.: 2890, 9734, 2701; Payload ID: 9178 relates to Category No.: 2890, 2701; Payload ID: 9179 relates to Category No.: 2890, 2701; Payload ID: 9180 relates to Category No.: 2890, 2701; Payload ID: 9181 relates to Category No.: 2890, 1842, 2701; Payload ID: 9182 relates to Category No.: 2890, 2701; Payload ID: 9183 relates to Category No.: 2890, 2701; Payload ID: 9184 relates to Category No.: 2890, 2701; Payload ID: 9185 relates to Category No.: 2890, 2701; Payload ID: 9186 relates to Category No.: 2890, 2701; Payload ID: 9187 relates to Category No.: 2890, 2701;

Payload ID: 9188 relates to Category No.: 2890, 2701; Payload ID: 9189 relates to Category No.: 2890, 2701; Payload ID: 9190 relates to Category No.: 2890, 2701; Payload ID: 9192 relates to Category No.: 2890, 2701; Payload ID: 9193 relates to Category No.: 5776, 10056, 4755, 6060, 6743, 12378, 6443, 4010, 6440; Payload ID: 9194 relates to Category No.: 4010, 3696, 6059, 6440, 12378; Payload ID: 9195 relates to Category No.: 4010, 3696, 4228, 6440, 12378; Payload ID: 9196 relates to Category No.: 6443, 5776, 6440, 12378; Payload ID: 9197 relates to Category No.: 2890, 6443, 2942, 6440, 12378; Payload ID: 9198 relates to Category No.: 4029, 12159, 4014, 11883, 6948; Payload ID: 9199 relates to Category No.: 4030, 5762, 1700, 12159, 4014, 4010; Payload ID: 9200 relates to Category No.: 4029, 4014, 4010; Payload ID: 9201 relates to Category No.: 4030, 4029, 12159, 4014, 4010; Payload ID: 9202 relates to Category No.: 2890, 4010; Payload ID: 9203 relates to Category No.: 5561, 14327, 1792, 4228; Payload ID: 9205 relates to Category No.: 4030, 5561, 10056; Payload ID: 9206 relates to Category No.: 10056, 2942, 4043, 4010, 6743, 5392, 9727, 1811; Payload ID: 9207 relates to Category No.: 2458, 1046, 2441; Payload ID: 9209 relates to Category No.: 5561, 3673, 9734, 14293, 7321, 5776; Payload ID: 9210 relates to Category No.: 4030, 4029, 5059, 4010, 5561; Payload ID: 9211 relates to Category No.: 4030, 2890, 5762, 12159, 4014, 4010, 9305, 1792; Payload ID: 9212 relates to Category No.: 9305, 7118; Payload ID: 9214 relates to Category No.: 9305; Payload ID: 9215 relates to Category No.: 1842, 5561; Payload ID: 9217 relates to Category No.: 4030, 9305, 2890, 6717, 7048, 10056, 4014, 14912, 4010, 5392, 4008, 12159; Payload ID: 9218 relates to Category No.: 6717, 4030, 12159, 4014, 1239, 4010; Payload ID: 9219 relates to Category No.: 10056, 2942, 4030; Payload ID: 9220 relates to Category No.: 4030, 9305, 2890, 4010; Payload ID: 9221 relates to Category No.: 4030, 9305, 2890, 4010; Payload ID: 9222 relates to Category No.: 4030, 6717, 2942, 4010; Payload ID: 9223 relates to Category No.: 4030, 9305, 2890, 5762, 4010; Payload ID: 9226 relates to Category No.: 5762; Payload ID: 9227 relates to Category No.: 4030, 6717, 4765, 3673, 5570, 4755, 4010, 1792, 3686, 3685; Payload ID: 9228 relates to Category No.: 5561, 6717, 4765, 3673, 4755, 3831; Payload ID: 9229 relates to Category No.: 5561, 6717, 4765, 3673, 4010, 3832, 3686, 3685, 5272, 4755, 14364, 3831; Payload ID: 9230 relates to Category No.: 5561, 6717, 3686; Payload ID: 9231 relates to Category No.: 4030; Payload ID: 9232 relates to Category No.: 4030, 4029, 4014, 10077; Payload ID: 9233 relates to Category No.: 6443, 4010, 6437, 6059, 778; Payload ID: 9234 relates to Category No.: 6717, 2938, 2942, 15014, 7389; Payload ID: 9235 relates to Category No.: 2938, 15014, 7389; Payload ID: 9236 relates to Category No.: 2938, 6449, 15014, 7389, 196; Payload ID: 9237 relates to Category No.: 2890, 6717, 6222, 4228, 5561; Payload ID: 9238 relates to Category No.: 5561; Payload ID: 9239 relates to Category No.: 5565, 6717, 9184, 5561; Payload ID: 9240 relates to Category No.: 5561, 6717, 5565, 9176, 9162; Payload ID: 9241 relates to Category No.: 5561, 12439, 4755, 9734, 3521; Payload ID: 9242 relates to Category No.: 5561, 4765, 3036, 1842, 1017; Payload ID: 9243 relates to Category No.: 10056; Payload ID: 9245 relates to Category No.: 5561, 1748, 10056, 16156; Payload ID: 9246 relates to Category No.: 9242, 9247, 1691; Payload ID: 9247 relates to Category No.: 4030, 4029, 2890, 1700; Payload ID: 9248 relates to Category No.: 5561, 4029, 6717, 10056, 12406; Payload ID: 9249 relates to Category No.: 5561, 4765, 3693, 4755, 3696; Payload ID: 9250 relates to Category No.: 5561; Payload ID: 9251 relates to Category No.: 2890, 2938, 10056, 1017, 3523, 15574, 2710, 4758; Payload ID: 9252 relates to Category No.: 2890, 5776, 10056, 9247, 2710; Payload ID: 9253 relates to Category No.: 5561, 7070, 7118; Payload ID: 9254 relates to Category No.: 9305, 2890, 5762, 9247, 4010, 4228, 7118, 15573; Payload ID: 9255 relates to Category No.: 2942; Payload ID: 9256 relates to Category No.: 2890, 2942; Payload ID: 9257 relates to Category No.: 2890, 375; Payload ID: 9259 relates to Category No.: 4029; Payload ID: 9260 relates to Category No.: 9305, 2890, 2938, 10056, 2942, 1842; Payload ID: 9261 relates to Category No.: 1842; Payload ID: 9262 relates to Category No.: 2890, 2194, 9247, 2183; Payload ID: 9263 relates to Category No.: 5561, 1748, 11650, 11653, 1792; Payload ID: 9264 relates to Category No.: 5561, 1748, 11653, 1792; Payload ID: 9265 relates to Category No.: 5561, 1748, 3036, 11653, 11723, 1017, 1792; Payload ID: 9266 relates to Category No.: 5561, 1792; Payload ID: 9267 relates to Category No.: 5561, 1792; Payload ID: 9268 relates to Category No.: 5561, 10056, 5762; Payload ID: 9269 relates to Category No.: 5561; Payload ID: 9270 relates to Category No.: 5561; Payload ID: 9271 relates to Category No.: 5561; Payload ID: 9272 relates to Category No.: 4029, 2890, 6717; Payload ID: 9273 relates to Category No.: 2890, 6717; Payload ID: 9274 relates to Category No.: 9305, 7118, 14364, 2938, 7389; Payload ID: 9278 relates to Category No.: 5561, 4010, 5762; Payload ID: 9279 relates to Category No.: 9305, 2890, 2942, 6017, 4010, 4197; Payload ID: 9280 relates to Category No.: 2890; Payload ID: 9281 relates to Category No.: 4030; Payload ID: 9282 relates to Category No.: 2890; Payload ID: 9283 relates to Category No.: 5561; Payload ID: 9286 relates to Category No.: 1842; Payload ID: 9287 relates to Category No.: 5561; Payload ID: 9288 relates to Category No.: 5561; Payload ID: 9289 relates to Category No.: 2890, 16257, 2938, 4010; Payload ID: 9293 relates to Category No.: 5561; Payload ID: 9296 relates to Category No.: 5570; Payload ID: 9297 relates to Category No.: 1842; Payload ID: 9299 relates to Category No.: 5561; Payload ID: 9300 relates to Category No.: 5561; Payload ID: 9301 relates to Category No.: 5561; Payload ID: 9302 relates to Category No.: 2890, 5561; Payload ID: 9303 relates to Category No.: 5561, 10056; Payload ID: 9305 relates to Category No.: 5561; Payload ID: 9306 relates to Category No.: 5561; Payload ID: 9307 relates to Category No.: 5561, 1748, 11653, 15139, 3055, 3972, 8945; Payload ID: 9308 relates to Category No.: 6717; Payload ID: 9309 relates to Category No.: 6717, 2890, 9305; Payload ID: 9312 relates to Category No.: 2890, 2194; Payload ID: 9315 relates to Category No.: 2890, 6960; Payload ID: 9316 relates to Category No.: 5561, 1748, 11723, 2227; Payload ID: 9317 relates to Category No.: 4030, 5561, 6717, 1748, 11653; Payload ID: 9318 relates to Category No.: 5561, 10056; Payload ID: 9319 relates to Category No.: 5561; Payload ID: 9320 relates to Category No.: 5561, 10056; Payload ID: 9322 relates to Category No.: 4010; Payload ID: 9324 relates to Category No.: 5561, 6717, 3673, 3666, 9162, 7068; Payload ID: 9325 relates to Category No.: 2890, 2458; Payload ID: 9328 relates to Category No.: 5561; Payload ID: 9330 relates to Category No.: 2890, 1748, 11650, 11653, 10056, 15139, 3055, 8935, 273, 1029, 4199; Payload ID: 9331 relates to Category No.: 5561; Payload ID: 9339 relates to Category No.: 6717, 10056, 1792, 5842; Payload ID: 9340 relates to Category No.: 5561, 10056; Payload ID: 9341 relates to Category No.: 5561, 6717, 10056, 3673, 3666; Payload ID: 9342 relates to Category No.: 5561, 6717, 10056, 3673; Payload ID: 9343 relates to Category No.: 5561, 10056; Payload ID: 9345 relates to Category No.: 5561; Payload ID: 9346 relates to Category No.: 5561; Payload ID: 9347 relates to Category No.: 5561; Payload ID: 9348 relates to Category No.: 4010, 5570; Payload ID: 9350 relates to Category No.: 5561, 3666, 1748, 11653, 1017, 4860, 3972; Payload ID: 9351 relates to Category No.: 5561, 1748, 11653, 3972; Payload ID: 9352 relates to Category No.: 5561, 1748, 11653; Payload ID: 9353 relates to Category No.: 5561, 1748, 11653; Payload ID: 9354 relates to Category No.: 2890, 5561, 1842; Payload ID: 9355 relates to Category No.: 9305; Payload ID: 9357 relates to Category No.: 9305, 6717, 4010; Payload ID: 9358 relates to Category No.: 4029; Payload ID: 9359 relates to Category No.: 9305, 2890; Payload ID: 9361 relates to Category No.: 2890, 2938, 1748, 11650, 11653; Payload ID: 9362 relates to Category No.: 2942; Payload ID: 9363 relates to Category No.: 9305, 9242; Payload ID: 9365 relates to Category No.: 2890, 1748, 11650, 3055, 11653, 15139, 8935, 1711, 3054, 779; Payload ID: 9366 relates to Category No.: 2890, 6960, 2194, 6994; Payload ID: 9367 relates to Category No.: 5561, 7118, 7048; Payload ID: 9368 relates to Category No.: 5561, 7048; Payload ID: 9370 relates to Category No.: 4030, 4029, 6717, 4010; Payload ID: 9371 relates to Category No.: 9305, 7118, 6717, 6960, 2938, 9247, 9734, 9176, 7068, 2632, 9192, 2890, 14145; Payload ID: 9372 relates to Category No.: 5561, 10056, 5570; Payload ID: 9373 relates to Category No.: 5561, 10056, 5570, 15574; Payload ID: 9374 relates to Category No.: 5561, 2890, 10056, 5570, 9247, 16156, 15574; Payload ID: 9375 relates to Category No.: 7118, 2890; Payload ID: 9376 relates to Category No.: 4030, 6443, 7118, 2890, 7048, 10056, 2942, 8935, 3693, 7061, 3666, 4755, 1748, 8948, 3036, 7070, 7060, 1017, 4860, 9730, 4010, 15161, 2926, 4786, 15280, 3037, 5412, 2917, 15139, 6743, 14145, 15573, 15151, 6717, 5776; Payload ID: 9377 relates to Category No.: 4029; Payload ID: 9378 relates to Category No.: 4029, 15151, 8935, 1748; Payload ID: 9379 relates to Category No.: 4029, 4030; Payload ID: 9380 relates to Category No.: 5557; Payload ID: 9381 relates to Category No.: 5561; Payload ID: 9382 relates to Category No.: 5561, 3673; Payload ID: 9385 relates to Category No.: 4029, 2890, 5561; Payload ID: 9386 relates to Category No.: 10104, 5561; Payload ID: 9388 relates to Category No.: 2890, 9247, 262, 6573; Payload ID: 9389 relates to Category No.: 5561; Payload ID: 9390 relates to Category No.: 5561, 2890, 10056; Payload ID: 9391 relates to Category No.: 4030, 5561, 10056, 2927; Payload ID: 9395 relates to Category No.: 5561; Payload ID: 9396 relates to Category No.: 5561; Payload ID: 9397 relates to Category No.: 9305, 2890, 6976, 9191, 9725, 15266; Payload ID: 9398 relates to Category No.: 5561, 2890; Payload ID: 9399 relates to Category No.: 5561; Payload ID: 9400 relates to Category No.: 4030, 4029, 15139, 1748; Payload ID: 9402 relates to Category No.: 4029, 6717, 5762, 10056, 2942, 5570, 2927, 6440, 3522, 9734; Payload ID: 9403 relates to Category No.: 9305, 2890, 2942; Payload ID: 9404 relates to Category No.: 7118, 7060; Payload ID: 9405 relates to Category No.: 4030, 4029, 2890; Payload ID: 9406 relates to Category No.: 6717, 5570, 4010, 12406; Payload ID: 9408 relates to Category No.: 5561, 12159, 3652; Payload ID: 9409 relates to Category No.: 4030, 2890; Payload ID: 9410 relates to Category No.: 5561, 10056; Payload ID: 9411 relates to Category No.: 5561, 4029; Payload ID: 9412 relates to Category No.: 5561; Payload ID: 9413 relates to Category No.: 5561, 4010; Payload ID: 9414 relates to Category No.: 5561; Payload ID: 9415 relates to Category No.: 4029, 10056; Payload ID: 9416 relates to Category No.: 5561; Payload ID: 9417 relates to Category No.: 4030, 2890, 6717, 10056, 5570, 1792, 5561; Payload ID: 9418 relates to Category No.: 5570, 5561; Payload ID: 9419 relates to Category No.: 5561, 10056, 4010; Payload ID: 9420 relates to Category No.: 5561; Payload ID: 9421 relates to Category No.: 1842; Payload ID: 9424 relates to Category No.: 6717, 5762, 10056, 5570, 5561; Payload ID: 9425 relates to Category No.: 5561, 2890, 6717, 4765, 4755; Payload ID: 9426 relates to Category No.: 5561, 10056, 4010; Payload ID: 9427 relates to Category No.: 4029; Payload ID: 9428 relates to Category No.: 2890, 2942, 9247, 4010, 9305; Payload ID: 9429 relates to Category No.: 5561, 10056, 5570, 6743; Payload ID: 9430 relates to Category No.: 5561, 6717, 10056, 5570; Payload ID: 9431 relates to Category No.: 5561, 5776, 3673, 3666, 9162, 9192; Payload ID: 9432 relates to Category No.: 9305, 2890, 6717, 10056, 9734, 1774, 10106, 4228; Payload ID: 9433 relates to Category No.: 4029, 6717, 5559, 4032; Payload ID: 9434 relates to Category No.: 9305; Payload ID: 9435 relates to Category No.: 9305; Payload ID: 9436 relates to Category No.: 9305, 6976, 273, 9181; Payload ID: 9437 relates to Category No.: 2890; Payload ID: 9439 relates to Category No.: 9305, 7118, 2890, 5776, 9247, 4755; Payload ID: 9440 relates to Category No.: 9305, 7118, 2890, 9247, 3331, 2632, 15173; Payload ID: 9441 relates to Category No.: 9305, 2890, 10056, 9247, 4228, 2628, 9095, 3389, 3332; Payload ID: 9442 relates to Category No.: 4755, 5559, 5776, 5561; Payload ID: 9444 relates to Category No.: 4030, 9305, 2890, 4014, 9247; Payload ID: 9445 relates to Category No.: 10056, 2942, 9734, 1811, 4228; Payload ID: 9446 relates to Category No.: 9305, 10056, 2942, 4228; Payload ID: 9447 relates to Category No.: 2890; Payload ID: 9449 relates to Category No.: 4010, 4228, 2710, 2890; Payload ID: 9450 relates to Category No.: 9305, 2890, 15892, 4228, 5561; Payload ID: 9451 relates to Category No.: 10056, 273, 4228, 2890, 2514, 14999, 1335; Payload ID: 9452 relates to Category No.: 9305, 15505, 9157, 11883; Payload ID: 9453 relates to Category No.: 9305, 15505; Payload ID: 9454 relates to Category No.: 2938, 9734, 16326, 12219; Payload ID: 9456 relates to Category No.: 2890, 4228, 9305, 10056; Payload ID: 9457 relates to Category No.: 2890, 9247, 2942, 8935, 9305, 4228, 6717, 4755, 9734, 1036; Payload ID: 9458 relates to Category No.: 2890, 9305, 2477; Payload ID: 9459 relates to Category No.: 9305; Payload ID: 9460 relates to Category No.: 9305, 15505; Payload ID: 9461 relates to Category No.: 2890; Payload ID: 9462 relates to Category No.: 15505; Payload ID: 9463 relates to Category No.: 9305, 2890, 447, 2903, 4228, 14190; Payload ID: 9464 relates to Category No.: 9305, 11883, 5762; Payload ID: 9465 relates to Category No.: 9305, 5762; Payload ID: 9466 relates to Category No.: 9305, 5762, 15505; Payload ID: 9467 relates to Category No.: 9305, 5762; Payload ID: 9468 relates to Category No.: 9305; Payload ID: 9469 relates to Category No.: 9305; Payload ID: 9470 relates to Category No.: 4137; Payload ID: 9471 relates to Category No.: 9305; Payload ID: 9472 relates to Category No.: 9305; Payload ID: 9473 relates to Category No.: 9305; Payload ID: 9474 relates to Category No.: 2890; Payload ID: 9475 relates to Category No.: 1842; Payload ID: 9476 relates to Category No.: 9305, 2890; Payload ID: 9477 relates to Category No.: 5561; Payload ID: 9478 relates to Category No.: 5561, 10056; Payload ID: 9479 relates to Category No.: 10056, 677, 8935, 8948, 1811, 1792, 5561; Payload ID: 9480 relates to Category No.: 9305, 2890, 9242, 2942, 2903, 2920; Payload ID: 9481 relates to Category No.: 9305, 7118, 2890, 9242, 9247, 493; Payload ID: 9482 relates to Category No.: 9247, 15531; Payload ID: 9483 relates to Category No.: 9247, 3470; Payload ID: 9484 relates to Category No.: 9247; Payload ID: 9485 relates to Category No.: 10056, 1182, 8935, 15139, 11650, 11653, 1099, 1811, 4010, 7255, 6717; Payload ID: 9486 relates to Category No.: 5762, 10056, 1182, 8935, 15139, 11650, 11653, 1099, 1811, 7255; Payload ID: 9487 relates to Category No.: 2890, 10056, 1182, 8935, 15139, 11650, 11653, 1099, 1811, 4010, 7255; Payload ID: 9488 relates to Category No.: 9247, 15531; Payload ID: 9491 relates to Category No.: 5561, 6717, 10056, 2660, 6743, 5392, 6617, 1811; Payload ID: 9492 relates to Category No.: 5561, 5762, 10056, 4010, 6743, 6617; Payload ID: 9493 relates to Category No.: 6443, 4010; Payload ID: 9494 relates to Category No.: 5561, 3673, 4755; Payload ID: 9495 relates to Category No.: 5561, 6717, 3673; Payload ID: 9496 relates to Category No.: 4029, 4030, 4755, 3521, 1792; Payload ID: 9498 relates to Category No.: 4029; Payload ID: 9499 relates to Category No.: 4029; Payload ID: 9500 relates to Category No.: 4029; Payload ID: 9501 relates to Category No.: 4029, 1842, 7118; Payload ID: 9502 relates to Category No.: 4030, 4029, 5059, 3671, 1792, 3521, 6059, 6989; Payload ID: 9503 relates to Category No.: 2942, 6222, 1659; Payload ID: 9504 relates to Category No.: 4030, 10056, 4029; Payload ID: 9505 relates to Category No.: 4030, 4029, 6717, 10056; Payload ID: 9506 relates to Category No.: 6222, 3666; Payload ID: 9507 relates to Category No.: 9305, 2890, 2942, 3673, 9247, 7070, 9184, 9162; Payload ID: 9508 relates to Category No.: 9305, 2942, 3673; Payload ID: 9509 relates to Category No.: 9305, 3673; Payload ID: 9510 relates to Category No.: 4030, 4029, 4010; Payload ID: 9511 relates to Category No.: 4029; Payload ID: 9512 relates to Category No.: 4029; Payload ID: 9513 relates to Category No.: 4029; Payload ID: 9514 relates to Category No.: 4030, 4029, 4010, 2942; Payload ID: 9515 relates to Category No.: 4029; Payload ID: 9516 relates to Category No.: 4029; Payload ID: 9517 relates to Category No.: 4029; Payload ID: 9519 relates to Category No.: 7118; Payload ID: 9520 relates to Category No.: 2434, 5561, 10056, 4010, 16149, 6333; Payload ID: 9521 relates to Category No.: 5561; Payload ID: 9522 relates to Category No.: 5561; Payload ID: 9523 relates to Category No.: 5561, 1842; Payload ID: 9524 relates to Category No.: 5561; Payload ID: 9525 relates to Category No.: 5561; Payload ID: 9526 relates to Category No.: 5561, 10056, 779, 14955, 14954; Payload ID: 9527 relates to Category No.: 4030, 4029, 4010, 1792; Payload ID: 9528 relates to Category No.: 2890, 5776, 10056, 9247, 4755, 6440, 5561; Payload ID: 9529 relates to Category No.: 4029, 4030, 2434, 10056, 677, 4010, 16149, 1792, 4014; Payload ID: 9530 relates to Category No.: 4029, 10051; Payload ID: 9531 relates to Category No.: 6717, 14953; Payload ID: 9532 relates to Category No.: 7118, 2890; Payload ID: 9533 relates to Category No.: 7118; Payload ID: 9535 relates to Category No.: 4029; Payload ID: 9538 relates to Category No.: 2942; Payload ID: 9540 relates to Category No.: 5561, 6717, 6440, 10056, 6443, 2502; Payload ID: 9541 relates to Category No.: 5561, 6717; Payload ID: 9543 relates to Category No.: 7118, 2890, 6717, 7060, 7068; Payload ID: 9544 relates to Category No.: 2890, 6717, 9756, 9753, 9305; Payload ID: 9548 relates to Category No.: 5561, 5570; Payload ID: 9552 relates to Category No.: 5561, 7118; Payload ID: 9554 relates to Category No.: 5561, 6717, 10056, 3673, 7070, 9754; Payload ID: 9555 relates to Category No.: 2890, 9247, 2701; Payload ID: 9556 relates to Category No.: 6443, 6717, 10056, 5570, 4755, 1099, 3521, 2534, 4008, 3696, 1792, 6059, 12406, 2503, 778, 6333, 9607, 3693, 5561; Payload ID: 9557 relates to Category No.: 12439, 2942, 8902, 3521, 1017, 1085, 2918, 763, 766, 2890; Payload ID: 9558 relates to Category No.: 5561; Payload ID: 9559 relates to Category No.: 5561; Payload ID: 9560 relates to Category No.: 5561, 10056, 1748, 6717; Payload ID: 9561 relates to Category No.: 5561, 3523; Payload ID: 9562 relates to Category No.: 2890, 9242, 10056, 5570, 2534, 4228, 6440, 12406, 3638, 3693, 3036, 8948, 2504, 5561; Payload ID: 9563 relates to Category No.: 5561, 6717, 2534; Payload ID: 9564 relates to Category No.: 5561, 10056; Payload ID: 9565 relates to Category No.: 5561, 5570, 2534; Payload ID: 9566 relates to Category No.: 5561, 12406, 6717; Payload ID: 9567 relates to Category No.: 5561, 6443, 10056, 2534, 4010, 6440, 779, 12406, 3636, 6717, 4755, 3666, 3693, 1336, 1335, 778; Payload ID: 9568 relates to Category No.: 5561, 2534; Payload ID: 9569 relates to Category No.: 5561, 11650, 8948, 3036, 8917, 1792, 15147, 4220, 10056; Payload ID: 9570 relates to Category No.: 5561, 10056, 3666, 12406, 7118; Payload ID: 9572 relates to Category No.: 5561, 4029, 10056, 3666, 15139, 4755, 8948, 3521, 2926, 1792, 3523, 1659, 12406, 4293, 5762; Payload ID: 9573 relates to Category No.: 5561, 4029, 6717, 10056, 1659, 12406, 3036, 1017, 8948, 6964, 11650; Payload ID: 9574 relates to Category No.: 5561, 4029, 10056, 3666, 1792, 16156, 14294; Payload ID: 9575 relates to Category No.: 5561, 6443, 6717, 10056, 3666, 4755, 3652, 4049, 2899, 5762; Payload ID: 9577 relates to Category No.: 2890; Payload ID: 9578 relates to Category No.: 5561; Payload ID: 9579 relates to Category No.: 14145; Payload ID: 9580 relates to Category No.: 9305, 2890, 2942, 2903, 7269, 6359, 3036, 1017, 8948, 6813; Payload ID: 9581 relates to Category No.: 9305, 9247, 1377, 15877; Payload ID: 9582 relates to Category No.: 9305, 9247, 5222, 15877; Payload ID: 9584 relates to Category No.: 2890, 5776, 2903, 2920; Payload ID: 9585 relates to Category No.: 2942, 9247, 11691, 2903, 1635, 15864, 6359, 15873; Payload ID: 9586 relates to Category No.: 9305, 2942, 11691, 2903, 1635, 15864, 6359, 15873; Payload ID: 9587 relates to Category No.: 2942, 2903, 14912, 15873, 14917, 9305, 8935; Payload ID: 9588 relates to Category No.: 9305, 2942, 14912, 15864, 6359, 15873; Payload ID: 9589 relates to Category No.: 9242, 2942, 14665, 2903, 14912, 4010, 15864, 14664, 15873; Payload ID: 9590 relates to Category No.: 2942, 14665, 15857, 1635, 6359, 15848, 15873, 14917; Payload ID: 9591 relates to Category No.: 11691, 15864, 15873; Payload ID: 9592 relates to Category No.: 2890, 9247; Payload ID: 9593 relates to Category No.: 15845, 15857, 9305; Payload ID: 9594 relates to Category No.: 15845, 15857, 9215; Payload ID: 9595 relates to Category No.: 9305, 9247, 15845, 15857, 9215; Payload ID: 9596 relates to Category No.: 4030, 4029, 12159, 4014, 4010, 4763, 6437, 4176; Payload ID: 9597 relates to Category No.: 4029, 4010; Payload ID: 9598 relates to Category No.: 5561, 10056, 5570, 3693; Payload ID: 9599 relates to Category No.: 9305, 9242; Payload ID: 9600 relates to Category No.: 10056, 677, 3036, 4010; Payload ID: 9601 relates to Category No.: 10056, 677; Payload ID: 9602 relates to Category No.: 10056, 677, 4010; Payload ID: 9603 relates to Category No.: 4030, 678, 5561, 6717; Payload ID: 9604 relates to Category No.: 10056, 677; Payload ID: 9605 relates to Category No.: 10056, 677; Payload ID: 9606 relates to Category No.: 4029; Payload ID: 9607 relates to Category No.: 10056, 677; Payload ID: 9610 relates to Category No.: 6717, 10056, 5570, 4010, 1772, 5561; Payload ID: 9611 relates to Category No.: 9305; Payload ID: 9612 relates to Category No.: 6717, 10056, 677, 1792; Payload ID: 9613 relates to Category No.: 677, 5570, 1700; Payload ID: 9614 relates to Category No.: 4029, 1842; Payload ID: 9616 relates to Category No.: 5561, 10056, 677; Payload ID: 9617 relates to Category No.: 10056, 677, 4199; Payload ID: 9618 relates to Category No.: 5561; Payload ID: 9619 relates to Category No.: 5561, 10056; Payload ID: 9620 relates to Category No.: 10056, 677; Payload ID: 9621 relates to Category No.: 4029, 9305, 2890, 10056, 9242, 677; Payload ID: 9622 relates to Category No.: 5570, 4010; Payload ID: 9623 relates to Category No.: 4030, 10056; Payload ID: 9624 relates to Category No.: 5561, 1792; Payload ID: 9625 relates to Category No.: 4030, 10056, 3696, 5823, 6246; Payload ID: 9626 relates to Category No.: 4030, 2890, 10056, 2942, 273, 276, 4199, 4010, 10106, 14327, 4228, 14999, 14329, 279, 9773; Payload ID: 9627 relates to Category No.: 2942, 10063, 15241, 1811, 5762; Payload ID: 9628 relates to Category No.: 7118, 7097; Payload ID: 9629 relates to Category No.: 5561, 2890, 6717, 10056, 4755; Payload ID: 9630 relates to Category No.: 5561, 4008; Payload ID: 9631 relates to Category No.: 6717, 10056, 273, 4010; Payload ID: 9632 relates to Category No.: 9305, 2890, 15505, 9247, 12170; Payload ID: 9633 relates to Category No.: 5561, 6717, 6976, 3673, 14906, 5570, 2420, 9162, 3666, 5557; Payload ID: 9634 relates to Category No.: 4030, 6717; Payload ID: 9635 relates to Category No.: 4030, 5561, 6717, 10056, 1842; Payload ID: 9636 relates to Category No.: 10056, 5570; Payload ID: 9637 relates to Category No.: 9305, 2890, 10056, 2942, 4043, 4755, 9734, 4010, 6743, 6717, 7052, 1803, 7061, 11650, 7032, 6617, 5577; Payload ID: 9638 relates to Category No.: 9247, 5597, 7118; Payload ID: 9639 relates to Category No.: 7118; Payload ID: 9640 relates to Category No.: 9305, 7060, 7118; Payload ID: 9641 relates to Category No.: 7118; Payload ID: 9642 relates to Category No.: 7060, 7118; Payload ID: 9644 relates to Category No.: 9305, 15505, 9247, 9157, 11883, 3355; Payload ID: 9645 relates to Category No.: 9305, 9247; Payload ID: 9646 relates to Category No.: 9305, 9242, 9247, 9157; Payload ID: 9647 relates to Category No.: 9305, 9242, 9247, 9603; Payload ID: 9648 relates to Category No.: 9305, 2890, 6717, 9247; Payload ID: 9649 relates to Category No.: 9247; Payload ID: 9650 relates to Category No.: 9305, 2890, 9242, 9247, 9725; Payload ID: 9651 relates to Category No.: 9194, 9305, 9247, 1748, 4228; Payload ID: 9652 relates to Category No.: 9247, 9157; Payload ID: 9653 relates to Category No.: 9247, 1239, 14614; Payload ID: 9654 relates to Category No.: 9305, 9725; Payload ID: 9655 relates to Category No.: 9305, 2890, 9242, 9247, 2829, 12170; Payload ID: 9656 relates to Category No.: 9305, 2890, 9247; Payload ID: 9657 relates to Category No.: 9305, 9247; Payload ID: 9658 relates to Category No.: 9247, 1842, 9305; Payload ID: 9659 relates to Category No.: 9305, 9247, 5216; Payload ID: 9660 relates to Category No.: 9305, 9247; Payload ID: 9661 relates to Category No.: 9305, 9242, 9247; Payload ID: 9662 relates to Category No.: 9305; Payload ID: 9663 relates to Category No.: 9305, 2890, 9247, 5216, 7179; Payload ID: 9664 relates to Category No.: 9305, 9247, 5216; Payload ID: 9665 relates to Category No.: 9305, 9247, 5216; Payload ID: 9666 relates to Category No.: 9305, 9247, 5216; Payload ID: 9667 relates to Category No.: 2890, 5776, 10056, 9247, 5597, 9215, 7180; Payload ID: 9669 relates to Category No.: 9242; Payload ID: 9672 relates to Category No.: 5561; Payload ID: 9673 relates to Category No.: 5561; Payload ID: 9674 relates to Category No.: 5561, 6717, 3673, 3666; Payload ID: 9675 relates to Category No.: 5561, 10056, 2942, 5570, 3693, 3636, 1792, 2890, 3055, 8935, 8948, 3054; Payload ID: 9676 relates to Category No.: 5561, 10056, 2942, 5570, 3636, 1792; Payload ID: 9677 relates to Category No.: 5561, 10056, 2942, 5570, 1017; Payload ID: 9678 relates to Category No.: 5561, 10056, 5570; Payload ID: 9679 relates to Category No.: 5561, 10056, 1842; Payload ID: 9680 relates to Category No.: 5561, 10056; Payload ID: 9681 relates to Category No.: 5561, 6717, 4765, 3673, 3666, 4755, 6222; Payload ID: 9682 relates to Category No.: 5561, 4765, 3673, 3666, 6222, 4769; Payload ID: 9683 relates to Category No.: 5561, 6717, 3673; Payload ID: 9684 relates to Category No.: 5561, 6717, 3673, 3666; Payload ID: 9685 relates to Category No.: 5561, 2890, 6717, 3673; Payload ID: 9686 relates to Category No.: 2942, 4010, 7118, 5561; Payload ID: 9687 relates to Category No.: 2890, 4010; Payload ID: 9688 relates to Category No.: 2890, 2942, 4010; Payload ID: 9689 relates to Category No.: 5561, 6717, 4755; Payload ID: 9690 relates to Category No.: 5561, 6717, 3652; Payload ID: 9691 relates to Category No.: 5561, 6443, 5570, 6440; Payload ID: 9692 relates to Category No.: 3652, 6968, 4049, 2942; Payload ID: 9693 relates to Category No.: 6443, 2890, 6717, 10056, 5570, 9734, 4010, 3696, 6059, 4008, 1792, 14363, 3693, 15151, 16156, 2889, 6709, 9774, 7321, 9781, 3036, 8948, 2926, 603, 16065; Payload ID: 9694 relates to Category No.: 4030, 5561, 6443, 6717, 10056, 4010, 6060, 6059, 6440, 10082, 9776; Payload ID: 9695 relates to Category No.: 5561, 6717, 6440, 6443, 604; Payload ID: 9696 relates to Category No.: 5561, 6717, 10056, 3036, 2927, 12440, 3696, 3523, 3686, 3040, 4863; Payload ID: 9697 relates to Category No.: 4030, 4029, 4010; Payload ID: 9698 relates to Category No.: 4029; Payload ID: 9699 relates to Category No.: 4029; Payload ID: 9700 relates to Category No.: 4029; Payload ID: 9701 relates to Category No.: 4029; Payload ID: 9702 relates to Category No.: 4029, 9305; Payload ID: 9703 relates to Category No.: 4029; Payload ID: 9704 relates to Category No.: 4030, 4029, 2574, 9305, 12159; Payload ID: 9705 relates to Category No.: 4030, 4029, 4014, 2890, 12159, 1090, 262; Payload ID: 9706 relates to Category No.: 4030, 9305, 6717, 9247, 2420, 1090; Payload ID: 9707 relates to Category No.: 4030, 4029, 9305, 2890, 6717; Payload ID: 9708 relates to Category No.: 4030, 6717, 4010, 12406; Payload ID: 9709 relates to Category No.: 4029, 9305, 7118, 2890, 10056, 2942, 6968, 7060, 633; Payload ID: 9710 relates to Category No.: 2942; Payload ID: 9712 relates to Category No.: 9305; Payload ID: 9713 relates to Category No.: 9305; Payload ID: 9715 relates to Category No.: 9305, 7118; Payload ID: 9716 relates to Category No.: 9305; Payload ID: 9717 relates to Category No.: 9305, 2890, 2938, 5570, 9247, 14893, 9181, 376, 273; Payload ID: 9718 relates to Category No.: 5561; Payload ID: 9719 relates to Category No.: 4029, 2890, 9247, 4010, 1792, 16156, 4030, 7366; Payload ID: 9720 relates to Category No.: 6717, 10056, 2574, 5570, 3638; Payload ID: 9721 relates to Category No.: 6717, 10056, 2574, 5570, 3638, 6333, 2942, 2926, 5561; Payload ID: 9722 relates to Category No.: 16065; Payload ID: 9723 relates to Category No.: 5561, 5570, 1792, 14999, 10056, 16065; Payload ID: 9724 relates to Category No.: 9305, 2890, 2194, 2942, 273, 2630, 9199, 14893, 5964, 7161, 14906; Payload ID: 9725 relates to Category No.: 9305, 2942, 14906, 9734, 2630, 9199, 5964, 7161; Payload ID: 9726 relates to Category No.: 9305, 2890, 668, 9247, 16327, 14893; Payload ID: 9727 relates to Category No.: 9305, 2890, 5776, 9242, 14893; Payload ID: 9728 relates to Category No.: 9305, 2890, 9535, 10029, 9734, 2402, 1004, 2417, 16317; Payload ID: 9729 relates to Category No.: 9242, 9305; Payload ID: 9735 relates to Category No.: 4030, 5561; Payload ID: 9738 relates to Category No.: 9305, 2890, 5762, 2194, 5776, 9242, 9247, 2942, 10056, 3036, 1017, 9734, 5441; Payload ID: 9739 relates to Category No.: 2890, 9242; Payload ID: 9741 relates to Category No.: 5561, 1700, 6717, 10056, 5570, 9362; Payload ID: 9742 relates to Category No.: 4010; Payload ID: 9743 relates to Category No.: 9305, 3991, 1635, 8948; Payload ID: 9744 relates to Category No.: 9305, 2942, 9247, 3991, 1635, 9215; Payload ID: 9745 relates to Category No.: 9305, 2890, 6717, 10056, 2942, 3521, 4010; Payload ID: 9746 relates to Category No.: 5561; Payload ID: 9747 relates to Category No.: 5561, 2927, 1336; Payload ID: 9748 relates to Category No.: 5561, 1842; Payload ID: 9749 relates to Category No.: 5561, 6440; Payload ID: 9750 relates to Category No.: 2890, 10056, 3673, 5570, 5561; Payload ID: 9751 relates to Category No.: 5561; Payload ID: 9752 relates to Category No.: 5561; Payload ID: 9753 relates to Category No.: 5561; Payload ID: 9754 relates to Category No.: 5561, 6717, 10056; Payload ID: 9755 relates to Category No.: 5561, 6717; Payload ID: 9756 relates to Category No.: 5561; Payload ID: 9757 relates to Category No.: 5561; Payload ID: 9758 relates to Category No.: 5561, 5776, 9247, 6440, 6443; Payload ID: 9759 relates to Category No.: 5561; Payload ID: 9760 relates to Category No.: 6717, 10056, 4765, 5570, 3666, 4755, 6934, 4010, 9776, 1792, 3523, 3832, 5560, 5561; Payload ID: 9761 relates to Category No.: 6717, 10056, 4765, 3666, 4755, 6934, 4010, 9776, 1792, 3523, 3832, 5560; Payload ID: 9762 relates to Category No.: 10056, 4765, 3666, 4755, 6934, 4010, 9776, 1792, 3523, 3832, 5560, 5561; Payload ID: 9763 relates to Category No.: 10056, 4765, 6934, 4010, 9776, 1792, 3523, 3832, 5560, 6938; Payload ID: 9764 relates to Category No.: 5561, 6934, 6717, 10056, 4765, 3666, 9776, 1792, 3523, 3832, 5560; Payload ID: 9765 relates to Category No.: 5561, 6934, 6717, 10056, 4765, 9776, 3523, 3832, 5560; Payload ID: 9766 relates to Category No.: 5561, 6717, 6942, 4010, 6060, 1792, 6440; Payload ID: 9767 relates to Category No.: 5561, 6717, 6942, 6060, 6440; Payload ID: 9768 relates to Category No.: 5561, 6717, 10056, 6942, 3696, 6440; Payload ID: 9769 relates to Category No.: 5561, 6443, 6717, 6942, 3696, 6440; Payload ID: 9770 relates to Category No.: 6717, 10056, 4765, 5570, 6942, 3696, 1792, 6440, 3832, 15574, 3638, 5560, 2503, 15628; Payload ID: 9771 relates to Category No.: 6717, 10056, 4765, 6942, 3696, 1792, 6440, 3832, 15574, 3638, 5560, 2503, 15628; Payload ID: 9772 relates to Category No.: 6717, 6942; Payload ID: 9773 relates to Category No.: 6717, 10056, 4765, 5570, 6942, 3696, 6440, 3832, 15574, 3638, 5560, 2503, 15628, 5561; Payload ID: 9774 relates to Category No.: 5561, 6717, 6942; Payload ID: 9775 relates to Category No.: 6717, 10056, 4765, 6942, 3696, 6440, 3832, 15574, 3638, 5560, 2503, 15628, 5561; Payload ID: 9776 relates to Category No.: 5561, 6717, 6942; Payload ID: 9777 relates to Category No.: 6717, 10056, 4765, 5570, 6942, 4010, 6060, 6440, 3832, 15574, 3638, 5560, 2503, 15628, 5561; Payload ID: 9778 relates to Category No.: 6717, 6942, 5561; Payload ID: 9779 relates to Category No.: 5561, 6717, 6942; Payload ID: 9780 relates to Category No.: 6717, 10056, 4765, 6942, 4010, 6060, 6440, 3832, 15574, 3638, 5560, 2503, 15628; Payload ID: 9781 relates to Category No.: 5561, 4029, 10056, 3673, 3666, 6934; Payload ID: 9782 relates to Category No.: 6717, 10056, 5570, 779, 4402, 5776, 5766; Payload ID: 9783 relates to Category No.: 9305, 2890, 6717, 2938, 14145, 9734, 9199, 4010; Payload ID: 9784 relates to Category No.: 5776, 9242; Payload ID: 9785 relates to Category No.: 1842; Payload ID: 9786 relates to Category No.: 5762; Payload ID: 9787 relates to Category No.: 14145; Payload ID: 9788 relates to Category No.: 6717, 5570, 3693, 3666, 6743, 779, 4049; Payload ID: 9789 relates to Category No.: 5561, 6717, 9734, 3652, 4010, 6743, 779; Payload ID: 9790 relates to Category No.: 5561, 6717, 10056, 4765, 2899, 6743, 2504; Payload ID: 9791 relates to Category No.: 4030, 2890, 2194, 2942, 4010, 7118, 7366; Payload ID: 9793 relates to Category No.: 9305, 7118, 10056, 9247, 7060, 4010, 6717, 7048, 7366; Payload ID: 9794 relates to Category No.: 9305, 2890, 2194, 6994, 10002, 10000, 7161; Payload ID: 9795 relates to Category No.: 5561, 6717, 3673, 3666; Payload ID: 9796 relates to Category No.: 2890; Payload ID: 9797 relates to Category No.: 9247, 7296; Payload ID: 9798 relates to Category No.: 9247, 7296; Payload ID: 9799 relates to Category No.: 9247, 9153, 7296, 9305; Payload ID: 9800 relates to Category No.: 2942, 7118; Payload ID: 9801 relates to Category No.: 7118, 5776, 7060; Payload ID: 9802 relates to Category No.: 7118, 7060; Payload ID: 9803 relates to Category No.: 5762; Payload ID: 9804 relates to Category No.: 2890, 2950, 10056; Payload ID: 9805 relates to Category No.: 7118; Payload ID: 9806 relates to Category No.: 7118, 2890, 7060, 9756, 9753; Payload ID: 9807 relates to Category No.: 9305, 2890, 10056, 9242, 2942, 9734, 11883, 1663; Payload ID: 9808 relates to Category No.: 5561, 10056, 4010, 779; Payload ID: 9809 relates to Category No.: 5561; Payload ID: 9810 relates to Category No.: 5561, 6717, 2890; Payload ID: 9811 relates to Category No.: 6717, 12159, 3666; Payload ID: 9812 relates to Category No.: 5561, 6717; Payload ID: 9813 relates to Category No.: 4030, 6717, 10056, 4755, 678; Payload ID: 9814 relates to Category No.: 6717, 10056, 677, 5561; Payload ID: 9815 relates to Category No.: 4030, 4029; Payload ID: 9816 relates to Category No.: 4029, 4010; Payload ID: 9817 relates to Category No.: 2942, 4010; Payload ID: 9818 relates to Category No.: 10056, 5570, 3696, 1792; Payload ID: 9819 relates to Category No.: 5561, 6717, 4228; Payload ID: 9820 relates to Category No.: 5561, 6448, 6717, 5570, 3693, 9734, 6440, 6059; Payload ID: 9821 relates to Category No.: 4030, 4029, 2574, 1792; Payload ID: 9822 relates to Category No.: 5561, 7118, 6717, 3673, 3666, 4010; Payload ID: 9823 relates to Category No.: 5561, 2890, 6717, 4765, 3666, 4755, 4010, 3685; Payload ID: 9824 relates to Category No.: 5561, 6717, 4765, 3666, 4755, 4010; Payload ID: 9825 relates to Category No.: 5561, 6717, 3673, 3666, 4755, 4032, 3678; Payload ID: 9826 relates to Category No.: 6717, 4765, 3666, 5559, 4010; Payload ID: 9827 relates to Category No.: 5561, 6717, 4765, 4010, 4755, 2477; Payload ID: 9828 relates to Category No.: 5561, 4765; Payload ID: 9829 relates to Category No.: 4030, 6443, 16057, 4010; Payload ID: 9830 relates to Category No.: 16057, 4010; Payload ID: 9831 relates to Category No.: 16065; Payload ID: 9832 relates to Category No.: 6443, 5776; Payload ID: 9833 relates to Category No.: 5561; Payload ID: 9834 relates to Category No.: 5561, 4765, 4755; Payload ID: 9835 relates to Category No.: 5561, 4765; Payload ID: 9836 relates to Category No.: 5561, 6717, 4765, 4010, 4032; Payload ID: 9837 relates to Category No.: 5561, 6717, 4765, 4010; Payload ID: 9838 relates to Category No.: 6717, 5561, 4765; Payload ID: 9839 relates to Category No.: 5561, 6717, 4765, 4755, 4769; Payload ID: 9840 relates to Category No.: 5561, 4765, 4010, 4755; Payload ID: 9841 relates to Category No.: 5561, 4765, 4755; Payload ID: 9842 relates to Category No.: 5561, 6717, 4765; Payload ID: 9843 relates to Category No.: 5561, 6717, 3673, 3666, 4010; Payload ID: 9844 relates to Category No.: 5561; Payload ID: 9845 relates to Category No.: 5561; Payload ID: 9846 relates to Category No.: 2890, 9305, 2942; Payload ID: 9847 relates to Category No.: 9305, 2890, 9242, 9247, 10104; Payload ID: 9848 relates to Category No.: 2890, 2938, 10056, 6968; Payload ID: 9849 relates to Category No.: 7118, 6717, 10056, 276, 6075, 6966, 9305, 1082; Payload ID: 9850 relates to Category No.: 10056, 2942, 4010; Payload ID: 9851 relates to Category No.: 6976, 2194, 2942, 8935, 6968, 2441, 2890, 6960, 4390; Payload ID: 9852 relates to Category No.: 9305, 2890, 9242, 401; Payload ID: 9853 relates to Category No.: 9305, 2942; Payload ID: 9854 relates to Category No.: 6960, 2477, 4786; Payload ID: 9855 relates to Category No.: 2890, 6968, 14893; Payload ID: 9856 relates to Category No.: 2890, 6968; Payload ID: 9857 relates to Category No.: 9305, 2890, 6717, 2194, 9247, 273, 6968, 14893; Payload ID: 9858 relates to Category No.: 5561, 2890, 10056, 2942; Payload ID: 9859 relates to Category No.: 2890, 10056, 4010; Payload ID: 9860 relates to Category No.: 4029, 2890, 3671, 3668; Payload ID: 9861 relates to Category No.: 9305, 6717, 9242, 2890, 2628, 2420, 2192; Payload ID: 9862 relates to Category No.: 5561, 9305, 2890, 6717, 2938, 10056; Payload ID: 9863 relates to Category No.: 5561, 2890, 6717, 1182, 1099, 15648, 2926, 779; Payload ID: 9864 relates to Category No.: 5561, 1182, 2926, 6717; Payload ID: 9865 relates to Category No.: 5561, 2890, 10056, 5570, 9247; Payload ID: 9866 relates to Category No.: 5561, 5762, 10056, 5570, 1792; Payload ID: 9867 relates to Category No.: 4030, 5561, 5570; Payload ID: 9868 relates to Category No.: 5561, 5570; Payload ID: 9869 relates to Category No.: 5561, 5570, 4010; Payload ID: 9870 relates to Category No.: 5561, 5570; Payload ID: 9871 relates to Category No.: 5561, 5570; Payload ID: 9872 relates to Category No.: 5561, 5570, 6617; Payload ID: 9873 relates to Category No.: 5561, 5570; Payload ID: 9874 relates to Category No.: 5561, 5570; Payload ID: 9875 relates to Category No.: 5570, 6617; Payload ID: 9876 relates to Category No.: 5561; Payload ID: 9877 relates to Category No.: 9305, 1842; Payload ID: 9878 relates to Category No.: 9305, 5776, 9247, 9215, 6551; Payload ID: 9879 relates to Category No.: 9305, 9247, 4755, 9215; Payload ID: 9880 relates to Category No.: 9305, 9247, 9215; Payload ID: 9881 relates to Category No.: 2890, 6717, 10056, 1720; Payload ID: 9882 relates to Category No.: 4029, 12159; Payload ID: 9883 relates to Category No.: 12159, 4014, 1090; Payload ID: 9884 relates to Category No.: 4029, 12159; Payload ID: 9885 relates to Category No.: 4029; Payload ID: 9886 relates to Category No.: 9305, 6717, 9247, 9176, 9181; Payload ID: 9887 relates to Category No.: 9305, 6717, 9247, 9176, 9181; Payload ID: 9888 relates to Category No.: 12159; Payload ID: 9889 relates to Category No.: 4029, 12159, 4014, 4010; Payload ID: 9890 relates to Category No.: 4029, 12159, 4014; Payload ID: 9891 relates to Category No.: 4030, 4029, 12159, 4014; Payload ID: 9892 relates to Category No.: 4029, 12159, 4014, 4763; Payload ID: 9893 relates to Category No.: 4029, 12159, 4014; Payload ID: 9894 relates to Category No.: 4029, 4014, 4030, 4755, 6443, 5599, 2574; Payload ID: 9895 relates to Category No.: 2890, 10056, 4014, 5570, 2926, 4228, 6709, 4763, 6475; Payload ID: 9896 relates to Category No.: 10056, 4014, 5570; Payload ID: 9897 relates to Category No.: 10056, 12159, 4014, 5570, 1792, 4763; Payload ID: 9898 relates to Category No.: 12159, 677, 4014, 5570, 5561; Payload ID: 9899 relates to Category No.: 4029, 12159, 4014; Payload ID: 9900 relates to Category No.: 4030, 4029, 9305, 7118, 12159, 4014, 2890, 10056, 14364; Payload ID: 9901 relates to Category No.: 4030, 4029, 12159, 4014; Payload ID: 9902 relates to Category No.: 4029, 4014; Payload ID: 9903 relates to Category No.: 5561, 5762, 12159, 3673, 4014; Payload ID: 9904 relates to Category No.: 12159, 4014, 5570, 4010, 15574; Payload ID: 9905 relates to Category No.: 6717, 10056, 12159, 677, 4014; Payload ID: 9906 relates to Category No.: 12159, 4014; Payload ID: 9907 relates to Category No.: 4014, 4044; Payload ID: 9908 relates to Category No.: 12159, 4014, 2890; Payload ID: 9909 relates to Category No.: 4030, 4029, 12159, 4014; Payload ID: 9910 relates to Category No.: 4029, 12159, 4014, 4010, 4030, 1792; Payload ID: 9911 relates to Category No.: 4030, 4029, 12159, 4014; Payload ID: 9912 relates to Category No.: 4030, 4029, 12159, 4014, 4010; Payload ID: 9913 relates to Category No.: 4010; Payload ID: 9914 relates to Category No.: 5561; Payload ID: 9915 relates to Category No.: 5561, 4010, 1792; Payload ID: 9918 relates to Category No.: 9305, 9247, 2402, 14674; Payload ID: 9919 relates to Category No.: 9305; Payload ID: 9920 relates to Category No.: 9305; Payload ID: 9921 relates to Category No.: 9305; Payload ID: 9922 relates to Category No.: 9305, 2890, 9242; Payload ID: 9923 relates to Category No.: 9305, 9247; Payload ID: 9924 relates to Category No.: 9305; Payload ID: 9925 relates to Category No.: 6717, 2938, 2942, 4010, 5762; Payload ID: 9926 relates to Category No.: 4030, 10056, 2942, 6017, 6717, 5762; Payload ID: 9928 relates to Category No.: 5762, 2194, 2942, 7244, 2441, 5970, 5561; Payload ID: 9929 relates to Category No.: 9305; Payload ID: 9930 relates to Category No.: 2402, 5964; Payload ID: 9931 relates to Category No.: 9305, 2890, 10056, 9242, 2942, 9247, 11883, 9155, 3638, 15139; Payload ID: 9932 relates to Category No.: 9305, 9247; Payload ID: 9933 relates to Category No.: 9305, 2890, 5776, 2942, 9247, 4755, 493, 5110, 9215; Payload ID: 9934 relates to Category No.: 6443, 2890, 6717, 2942, 4765, 3673, 9846, 9247, 3652, 7070, 15466, 6440, 10104, 15465, 9305, 3036, 8948, 6454; Payload ID: 9935 relates to Category No.: 2890, 2194, 2942, 15243, 2441, 6717, 2457, 2183; Payload ID: 9936 relates to Category No.: 9305, 6717, 9242, 9247, 6653, 15892, 2402, 12170; Payload ID: 9937 relates to Category No.: 9247, 6653, 2687, 15892; Payload ID: 9938 relates to Category No.: 6653, 15892; Payload ID: 9939 relates to Category No.: 9305, 6717, 2194, 9242, 9247, 6653, 15892; Payload ID: 9940 relates to Category No.: 6653; Payload ID: 9941 relates to Category No.: 9305, 6717, 9247, 6653; Payload ID: 9942 relates to Category No.: 6653; Payload ID: 9943 relates to Category No.: 9305, 6717, 9247, 6653, 2687; Payload ID: 9944 relates to Category No.: 9305, 9247, 6653, 2890, 6717; Payload ID: 9945 relates to Category No.: 9305, 6717, 9247, 6653; Payload ID: 9946 relates to Category No.: 9305, 6717, 15505, 9247, 6653, 2687, 15892; Payload ID: 9947 relates to Category No.: 6653, 2687; Payload ID: 9948 relates to Category No.: 9305, 6653; Payload ID: 9949 relates to Category No.: 9247, 6653, 15892; Payload ID: 9950 relates to Category No.: 6653, 15892; Payload ID: 9951 relates to Category No.: 2890, 6653; Payload ID: 9952 relates to Category No.: 15505, 9247, 6653; Payload ID: 9953 relates to Category No.: 9305, 9247, 6653, 15892; Payload ID: 9954 relates to Category No.: 9247, 9220; Payload ID: 9955 relates to Category No.: 9305, 9247, 6653; Payload ID: 9956 relates to Category No.: 9305, 2890, 15505, 9242, 9247, 6653, 15892; Payload ID: 9957 relates to Category No.: 6717, 6653, 2938, 2710; Payload ID: 9958 relates to Category No.: 9247, 6653; Payload ID: 9959 relates to Category No.: 9305, 9247, 6653, 15892; Payload ID: 9960 relates to Category No.: 9247, 6653, 2687, 15892; Payload ID: 9961 relates to Category No.: 9305, 6717, 9247, 6653, 2687; Payload ID: 9962 relates to Category No.: 9247, 6653, 9305, 6717, 2687, 15892; Payload ID: 9963 relates to Category No.: 9305, 7118, 15505, 9247, 6653, 9184, 15892; Payload ID: 9964 relates to Category No.: 9247, 6653, 2687; Payload ID: 9965 relates to Category No.: 6653; Payload ID: 9966 relates to Category No.: 9305, 2942, 5561; Payload ID: 9967 relates to Category No.: 9305, 9247, 2420, 4228; Payload ID: 9968 relates to Category No.: 9305, 5762, 6960, 2942, 6964, 6017, 14327; Payload ID: 9969 relates to Category No.: 9305; Payload ID: 9970 relates to Category No.: 9305, 2890, 2942, 9247; Payload ID: 9971 relates to Category No.: 2942, 4043; Payload ID: 9972 relates to Category No.: 5561, 6443, 12439, 2890, 10056, 3693, 3666, 9734, 1099, 3521, 2926, 6743, 1659, 779; Payload ID: 9973 relates to Category No.: 5561, 2890; Payload ID: 9974 relates to Category No.: 9305, 2890, 2420; Payload ID: 9975 relates to Category No.: 9305; Payload ID: 9976 relates to Category No.: 9162, 14826, 1046, 5727; Payload ID: 9977 relates to Category No.: 1700; Payload ID: 9978 relates to Category No.: 6066; Payload ID: 9979 relates to Category No.: 2630, 2632, 2192; Payload ID: 9980 relates to Category No.: 9305; Payload ID: 9981 relates to Category No.: 9305, 15505; Payload ID: 9982 relates to Category No.: 9305, 9734; Payload ID: 9983 relates to Category No.: 9305; Payload ID: 9984 relates to Category No.: 3673, 5570, 4755, 15573, 6709; Payload ID: 9985 relates to Category No.: 5561, 10056, 2942, 5570, 9098, 2446; Payload ID: 9986 relates to Category No.: 5561, 10056, 5570; Payload ID: 9987 relates to Category No.: 5561, 10056, 5570, 5762; Payload ID: 9988 relates to Category No.: 5561, 10056, 5570, 2890; Payload ID: 9989 relates to Category No.: 5561, 10056, 3673, 3666; Payload ID: 9990 relates to Category No.: 5561, 10056, 3673, 3666; Payload ID: 9991 relates to Category No.: 5561, 10056, 5570; Payload ID: 9992 relates to Category No.: 5561, 10056, 9305; Payload ID: 9993 relates to Category No.: 5561, 10056, 5570; Payload ID: 9994 relates to Category No.: 9305, 2890, 10056; Payload ID: 9995 relates to Category No.: 9305; Payload ID: 9996 relates to Category No.: 9305, 2890, 9247; Payload ID: 9997 relates to Category No.: 1842; Payload ID: 9998 relates to Category No.: 9305, 10104; Payload ID: 9999 relates to Category No.: 9305, 10104; Payload ID: 10000 relates to Category No.: 3666; Payload ID: 10001 relates to Category No.: 1842; Payload ID: 10002 relates to Category No.: 1842; Payload ID: 10003 relates to Category No.: 1842; Payload ID: 10004 relates to Category No.: 1842; Payload ID: 10005 relates to Category No.: 1842; Payload ID: 10010 relates to Category No.: 2890; Payload ID: 10014 relates to Category No.: 1842; Payload ID: 10015 relates to Category No.: 1842; Payload ID: 10018 relates to Category No.: 9305, 2890; Payload ID: 10020 relates to Category No.: 9305, 2890, 10056, 2402, 11883; Payload ID: 10021 relates to Category No.: 6717; Payload ID: 10024 relates to Category No.: 9305, 10056, 9734, 3036, 11653, 3518; Payload ID: 10026 relates to Category No.: 4010; Payload ID: 10027 relates to Category No.: 2890; Payload ID: 10028 relates to Category No.: 9305, 3693, 3521, 14100, 2890; Payload ID: 10029 relates to Category No.: 9305; Payload ID: 10030 relates to Category No.: 4010; Payload ID: 10031 relates to Category No.: 5561, 10056, 4008, 4228, 9305, 4030; Payload ID: 10032 relates to Category No.: 4030; Payload ID: 10033 relates to Category No.: 3669, 4029; Payload ID: 10034 relates to Category No.: 5561, 6717, 5776, 3673; Payload ID: 10035 relates to Category No.: 5762, 9734, 3036, 4010; Payload ID: 10036 relates to Category No.: 779, 11883, 6709; Payload ID: 10037 relates to Category No.: 5561, 10056, 5570, 12406, 8948; Payload ID: 10038 relates to Category No.: 5561, 10056, 5570, 2942; Payload ID: 10039 relates to Category No.: 2890, 10056, 1182, 9247, 1748, 447, 1811, 1774; Payload ID: 10040 relates to Category No.: 9305, 2890, 10056, 1182, 15139, 9734, 11650, 3036, 6059, 11883, 14647; Payload ID: 10041 relates to Category No.: 9305, 6717, 10056, 1182, 1811; Payload ID: 10042 relates to Category No.: 5561, 3673; Payload ID: 10043 relates to Category No.: 5561, 3673; Payload ID: 10044 relates to Category No.: 3673, 5557; Payload ID: 10045 relates to Category No.: 5561, 6717, 3673; Payload ID: 10046 relates to Category No.: 5561, 779; Payload ID: 10047 relates to Category No.: 5561, 6717, 4765, 4755, 3521, 3523, 3826; Payload ID: 10048 relates to Category No.: 5561, 2890, 10056, 15151, 5570, 15139, 3036, 1017, 4010, 4228, 1335, 8942, 6717; Payload ID: 10049 relates to Category No.: 5561, 4755, 3666; Payload ID: 10050 relates to Category No.: 6717, 5762, 14953, 5570, 2712; Payload ID: 10051 relates to Category No.: 6717, 5570; Payload ID: 10052 relates to Category No.: 5570; Payload ID: 10053 relates to Category No.: 2890, 5776, 9247, 11723; Payload ID: 10054 relates to Category No.: 2890, 10056, 1182, 9247, 3652, 4010, 14384, 7368, 6071, 11883; Payload ID: 10055 relates to Category No.: 6717, 4010, 10056; Payload ID: 10056 relates to Category No.: 7118, 1182, 1748, 447, 7255; Payload ID: 10057 relates to Category No.: 5561, 6443, 10056, 3673, 3693, 2927, 6060, 3523, 6440, 15574; Payload ID: 10059 relates to Category No.: 5561, 2927; Payload ID: 10060 relates to Category No.: 5561, 3673, 3666, 3696, 2926, 6440; Payload ID: 10061 relates to Category No.: 5561, 6443, 3693, 2927, 3523; Payload ID: 10062 relates to Category No.: 5561, 4765, 15573, 4769; Payload ID: 10063 relates to Category No.: 5561, 6717, 3673, 3666, 7070; Payload ID: 10064 relates to Category No.: 5561, 6717, 5557, 3834; Payload ID: 10066 relates to Category No.: 5561, 6443, 3693, 2927, 3523, 6440; Payload ID: 10067 relates to Category No.: 5561, 4765, 15573, 6440, 4769; Payload ID: 10068 relates to Category No.: 5561, 4765, 3673, 4755, 3671, 4769; Payload ID: 10069 relates to Category No.: 5561, 2890, 4765; Payload ID: 10070 relates to Category No.: 5561, 4030, 5570, 4010, 4008; Payload ID: 10071 relates to Category No.: 5561; Payload ID: 10072 relates to Category No.: 5561; Payload ID: 10073 relates to Category No.: 5561; Payload ID: 10074 relates to Category No.: 5561; Payload ID: 10075 relates to Category No.: 5561; Payload ID: 10076 relates to Category No.: 5561; Payload ID: 10077 relates to Category No.: 5561, 10056, 5570, 4008, 4126; Payload ID: 10078 relates to Category No.: 5561, 9734, 3652, 2890; Payload ID: 10079 relates to Category No.: 5561; Payload ID: 10080 relates to Category No.: 5561; Payload ID: 10081 relates to Category No.: 5561; Payload ID: 10082 relates to Category No.: 5561; Payload ID: 10083 relates to Category No.: 5561; Payload ID: 10084 relates to Category No.: 5561; Payload ID: 10085 relates to Category No.: 5561; Payload ID: 10086 relates to Category No.: 1842; Payload ID: 10087 relates to Category No.: 9305, 6717, 2942; Payload ID: 10088 relates to Category No.: 4030, 6717, 5570, 4010, 6766, 5561; Payload ID: 10089 relates to Category No.: 6717, 4030, 10056, 5570, 5561; Payload ID: 10090 relates to Category No.: 4030, 2890, 10056, 5570, 14103, 10002, 5561; Payload ID: 10091 relates to Category No.: 8935, 15139, 1748, 4010, 7048, 7118, 2890, 2942; Payload ID: 10092 relates to Category No.: 4030, 3666, 9734; Payload ID: 10093 relates to Category No.: 9305, 2890; Payload ID: 10094 relates to Category No.: 9305, 2890, 9215; Payload ID: 10095 relates to Category No.: 2890; Payload ID: 10097 relates to Category No.: 3666, 1842, 10056; Payload ID: 10098 relates to Category No.: 9305; Payload ID: 10099 relates to Category No.: 9305; Payload ID: 10100 relates to Category No.: 2890, 9247, 15531; Payload ID: 10101 relates to Category No.: 9305; Payload ID: 10102 relates to Category No.: 9305, 4010; Payload ID: 10103 relates to Category No.: 5561, 3673, 3666, 4010; Payload ID: 10104 relates to Category No.: 9305; Payload ID: 10105 relates to Category No.: 6717, 10056, 677, 4755, 1792, 4030; Payload ID: 10106 relates to Category No.: 5561, 1792; Payload ID: 10107 relates to Category No.: 5561, 4029, 6717, 10056, 5570, 1792, 1085; Payload ID: 10108 relates to Category No.: 5561, 9305, 2890, 9242, 1182, 3673, 3666, 9734, 9184, 779, 9155, 5599; Payload ID: 10109 relates to Category No.: 9305, 2890, 9247, 3861; Payload ID: 10111 relates to Category No.:

4010; Payload ID: 10112 relates to Category No.: 5561, 2477, 9247, 4755, 3669, 3686, 3685; Payload ID: 10113 relates to Category No.: 1842; Payload ID: 10115 relates to Category No.: 9305, 2890, 9734; Payload ID: 10116 relates to Category No.: 9305, 2890, 9734; Payload ID: 10117 relates to Category No.: 9305, 2890, 9734; Payload ID: 10118 relates to Category No.: 9305, 2890, 9734; Payload ID: 10119 relates to Category No.: 9305, 2890, 9734; Payload ID: 10120 relates to Category No.: 9305, 2890, 9734; Payload ID: 10122 relates to Category No.: 9305, 2890, 9734; Payload ID: 10123 relates to Category No.: 9305, 2890, 9734; Payload ID: 10124 relates to Category No.: 9305, 2890, 2942, 9734; Payload ID: 10125 relates to Category No.: 2890, 5762, 15151, 9734, 5412, 4030, 10056, 14174, 6960, 1017, 3055, 7070, 14293, 11650, 911, 909; Payload ID: 10126 relates to Category No.: 1700; Payload ID: 10127 relates to Category No.: 9305, 2890; Payload ID: 10128 relates to Category No.: 9305, 9247; Payload ID: 10129 relates to Category No.: 9305, 2890, 6960, 5776, 9247, 9162, 9311; Payload ID: 10130 relates to Category No.: 6717, 15505, 9247, 9157, 9311, 11883, 5110, 9305; Payload ID: 10131 relates to Category No.: 9305, 5776, 9247, 2890, 9311, 2563; Payload ID: 10132 relates to Category No.: 9305, 2890; Payload ID: 10133 relates to Category No.: 2890, 273, 3636, 14327, 447; Payload ID: 10136 relates to Category No.: 5561, 7070, 7048, 7118; Payload ID: 10137 relates to Category No.: 7118, 7070; Payload ID: 10138 relates to Category No.: 7070; Payload ID: 10139 relates to Category No.: 4030; Payload ID: 10140 relates to Category No.: 4030, 4010; Payload ID: 10142 relates to Category No.: 2942; Payload ID: 10143 relates to Category No.: 2942, 6885; Payload ID: 10144 relates to Category No.: 9305, 5762, 2942, 4010, 6885, 7118; Payload ID: 10145 relates to Category No.: 7118, 2890, 6717, 9247, 273, 4010; Payload ID: 10146 relates to Category No.: 9305, 2890, 273, 1842; Payload ID: 10147 relates to Category No.: 7118; Payload ID: 10148 relates to Category No.: 7118, 3666; Payload ID: 10149 relates to Category No.: 9305, 2890, 2942; Payload ID: 10150 relates to Category No.: 2890, 10056, 2942; Payload ID: 10151 relates to Category No.: 7118; Payload ID: 10152 relates to Category No.: 2890, 6717, 2942, 4010, 7118; Payload ID: 10153 relates to Category No.: 2890, 7060, 7118; Payload ID: 10154 relates to Category No.: 4030, 9305, 2942, 9247, 5029, 2890, 7118, 11883, 9157; Payload ID: 10155 relates to Category No.: 9305, 9247, 2402; Payload ID: 10156 relates to Category No.: 9305, 9215, 9181, 2890, 9157; Payload ID: 10157 relates to Category No.: 9305, 9247, 9157, 11883, 2890, 2402, 5029, 5110; Payload ID: 10158 relates to Category No.: 9305, 9247, 9157, 9311, 11883, 2890, 2402, 5029; Payload ID: 10159 relates to Category No.: 2890, 10056, 9247; Payload ID: 10160 relates to Category No.: 9305; Payload ID: 10161 relates to Category No.: 9305; Payload ID: 10162 relates to Category No.: 9305; Payload ID: 10163 relates to Category No.: 9305; Payload ID: 10164 relates to Category No.: 9305, 4010, 2419; Payload ID: 10165 relates to Category No.: 9305, 9242, 9247, 2419; Payload ID: 10166 relates to Category No.: 7118, 2942, 7060, 7048; Payload ID: 10167 relates to Category No.: 7118, 2942, 7060; Payload ID: 10168 relates to Category No.: 2942, 6717, 4010, 7118; Payload ID: 10169 relates to Category No.: 7118, 6717, 7060; Payload ID: 10170 relates to Category No.: 4030, 7118; Payload ID: 10171 relates to Category No.: 7118, 7048, 7060; Payload ID: 10172 relates to Category No.: 2942, 8935; Payload ID: 10173 relates to Category No.: 7060; Payload ID: 10174 relates to Category No.: 7060, 7118; Payload ID: 10175 relates to Category No.: 2942, 7118; Payload ID: 10176 relates to Category No.: 7118, 2942; Payload ID: 10177 relates to Category No.: 7118, 7060; Payload ID: 10178 relates to Category No.: 7118, 7060; Payload ID: 10180 relates to Category No.: 5561, 10056, 3673, 3666; Payload ID: 10181 relates to Category No.: 9305, 2890, 2942, 4010; Payload ID: 10182 relates to Category No.: 2890, 9242, 2942, 1774; Payload ID: 10183 relates to Category No.: 9305, 2890, 9242, 9247, 15711; Payload ID: 10184 relates to Category No.: 2890; Payload ID: 10185 relates to Category No.: 9305, 2890; Payload ID: 10186 relates to Category No.: 7118; Payload ID: 10188 relates to Category No.: 9305, 9247, 7014; Payload ID: 10189 relates to Category No.: 5561; Payload ID: 10190 relates to Category No.: 9305; Payload ID: 10191 relates to Category No.: 9305, 14174, 7118, 9247; Payload ID: 10193 relates to Category No.: 7060; Payload ID: 10194 relates to Category No.: 2890; Payload ID: 10195 relates to Category No.: 2890, 5762; Payload ID: 10196 relates to Category No.: 9305; Payload ID: 10197 relates to Category No.: 9305; Payload ID: 10198 relates to Category No.: 5561, 2890; Payload ID: 10199 relates to Category No.: 4029; Payload ID: 10202 relates to Category No.: 5561; Payload ID: 10203 relates to Category No.: 9305, 9247, 9215, 7014; Payload ID: 10207 relates to Category No.: 6717, 3666, 6222, 4010, 5561; Payload ID: 10209 relates to Category No.: 9305, 2890; Payload ID: 10211 relates to Category No.: 2942; Payload ID: 10212 relates to Category No.: 2890, 2942, 4010; Payload ID: 10213 relates to Category No.: 9305, 2903; Payload ID: 10214 relates to Category No.: 2890, 9247, 2903; Payload ID: 10215 relates to Category No.: 9305, 2890; Payload ID: 10216 relates to Category No.: 9305, 9734; Payload ID: 10217 relates to Category No.: 4030, 6717, 5559; Payload ID: 10218 relates to Category No.: 9305, 2890, 9247, 7179, 15505; Payload ID: 10219 relates to Category No.: 5561, 6717, 4765; Payload ID: 10220 relates to Category No.: 6717, 5561, 4029, 4765; Payload ID: 10221 relates to Category No.: 4030, 2890, 10056, 5570, 1792; Payload ID: 10222 relates to Category No.: 5561; Payload ID: 10224 relates to Category No.: 2890; Payload ID: 10225 relates to Category No.: 4049, 12440, 6060, 6059, 3696; Payload ID: 10226 relates to Category No.: 12439, 10056, 2942, 1182, 8935, 1811, 14999, 279; Payload ID: 10227 relates to Category No.: 2890, 6976, 9247; Payload ID: 10228 relates to Category No.: 6948, 4029, 12159; Payload ID: 10229 relates to Category No.: 4029, 6948; Payload ID: 10230 relates to Category No.: 4029, 6948; Payload ID: 10231 relates to Category No.: 5561, 4029, 10056; Payload ID: 10232 relates to Category No.: 5561, 9305, 2890, 10056; Payload ID: 10233 relates to Category No.: 4029, 4014, 4010, 6948, 3549; Payload ID: 10234 relates to Category No.: 9305, 2890, 11883; Payload ID: 10235 relates to Category No.: 4030, 9305; Payload ID: 10236 relates to Category No.: 4030, 2890; Payload ID: 10237 relates to Category No.: 5561, 7118, 3673, 3666, 7070, 9754, 7048, 9305, 778; Payload ID: 10238 relates to Category No.: 5561, 5776, 10056, 3673, 9162, 2890; Payload ID: 10239 relates to Category No.: 5561, 6717, 5776, 3673, 4010, 9162; Payload ID: 10240 relates to Category No.: 3666, 1099, 4755, 1336, 6991, 14293, 6756, 12406, 3671; Payload ID: 10241 relates to Category No.: 2890, 9242, 9247, 273, 1748, 5102, 5466, 7179; Payload ID: 10242 relates to Category No.: 2890, 5727; Payload ID: 10243 relates to Category No.: 9305; Payload ID: 10244 relates to Category No.: 9305, 2890, 2938, 10056, 9247; Payload ID: 10245 relates to Category No.: 5762, 2890, 2938, 10056, 6717; Payload ID: 10246 relates to Category No.: 2890, 10056, 6968; Payload ID: 10247 relates to Category No.: 5762; Payload ID: 10248 relates to Category No.: 2890, 5762; Payload ID: 10249 relates to Category No.: 9305, 2890, 2194, 9247, 2514; Payload ID: 10250 relates to Category No.: 4030, 9305, 7118, 6976, 6960, 10056, 4755, 14893; Payload ID: 10251 relates to Category No.: 9305, 2194, 2901; Payload ID: 10252 relates to Category No.: 4030, 2890, 2938, 14906, 6994, 779, 6075, 781, 6966; Payload ID: 10253 relates to Category No.: 2938, 2890, 6960, 10056, 4755, 14329, 6968, 273, 8951, 5561; Payload ID: 10254 relates to Category No.: 6960, 2942, 11687, 4049, 997, 1001, 2926, 9418, 2890, 6059; Payload ID: 10255 relates to Category No.: 7118, 5762, 6960, 2942, 11687, 3652, 4049, 997, 1001, 1046, 2926, 9418; Payload ID: 10256 relates to Category No.: 6960, 3652, 1001, 2926; Payload ID: 10257 relates to Category No.: 6960, 2942, 11687, 3652, 4049, 997, 1001, 2926, 9418; Payload ID: 10258 relates to Category No.: 2194, 6994, 2901, 7170, 7166; Payload ID: 10259 relates to Category No.: 6960, 6964, 10002, 2942, 8951; Payload ID: 10260 relates to Category No.: 6960, 2890, 10056, 1748, 6964, 3055, 10002, 2942, 11650, 8951; Payload ID: 10261 relates to Category No.: 6960, 9305, 2890, 9242, 2942, 15139, 9734, 1748, 8948, 3036, 14893, 1774, 6968; Payload ID: 10262 relates to Category No.: 2890, 6960, 9242, 8935, 6964, 3054, 8948, 5762, 11650, 8951, 9195, 1711, 1365; Payload ID: 10263 relates to Category No.: 2890, 6960, 10056, 8935, 6968, 6964, 4010, 7161, 8951; Payload ID: 10264 relates to Category No.: 6960, 4755, 9734; Payload ID: 10265 relates to Category No.: 2890, 6960, 9734, 6968, 1099, 6964; Payload ID: 10266 relates to Category No.: 6968, 7161, 7166, 902, 903; Payload ID: 10267 relates to Category No.: 6960, 10056, 2942, 3036, 6964, 1017, 4860, 2907, 9195, 1711, 8901, 15767, 2890, 9305, 6968, 1046, 11650, 8935; Payload ID: 10268 relates to Category No.: 2890, 6960, 2194, 2942, 14893, 2716, 4755, 6968, 1774, 2901, 1777, 6978; Payload ID: 10269 relates to Category No.: 2890, 6968, 6978; Payload ID: 10270 relates to Category No.: 2890, 6994, 9734, 2901, 6968, 6960, 6978; Payload ID: 10271 relates to Category No.: 9305, 6960, 2942, 6968, 2890; Payload ID: 10272 relates to Category No.: 9305, 2890, 6717, 9242, 5730; Payload ID: 10273 relates to Category No.: 4029, 2890, 1774; Payload ID: 10274 relates to Category No.: 5762, 6960, 2942, 2901, 14893, 6964, 5561, 2890, 6968; Payload ID: 10275 relates to Category No.: 5762, 2890, 6960, 4010; Payload ID: 10276 relates to Category No.: 9242, 9305, 2942; Payload ID: 10277 relates to Category No.: 2890, 9242; Payload ID: 10278 relates to Category No.: 2890, 2942, 5824, 9247, 4010; Payload ID: 10280 relates to Category No.: 4030, 4029, 6717, 4014, 4010, 4032, 4008, 4053; Payload ID: 10281 relates to Category No.: 2890, 2194, 10056, 2942, 2926, 11650; Payload ID: 10282 relates to Category No.: 2890, 3521, 15892; Payload ID: 10283 relates to Category No.: 9305, 2890, 9242, 9247, 13731; Payload ID: 10284 relates to Category No.: 9305, 9247, 6645; Payload ID: 10285 relates to Category No.: 9305, 6645; Payload ID: 10286 relates to Category No.: 9305, 2890, 10056, 9247, 6644; Payload ID: 10287 relates to Category No.: 9305, 2890, 9247, 6968, 2402, 6644, 9158, 15269, 9191; Payload ID: 10288 relates to Category No.: 9305, 6717, 2194, 5776, 9247, 9734, 6644, 9158, 15269, 544, 2890; Payload ID: 10289 relates to Category No.: 9305, 2890, 2942, 9247, 9199, 9184; Payload ID: 10290 relates to Category No.: 9305, 6717, 9247, 6644, 9158, 15269; Payload ID: 10291 relates to Category No.: 9305, 6717, 9247, 6644, 9158, 15269; Payload ID: 10292 relates to Category No.: 9305, 9247, 6644, 9158, 15269; Payload ID: 10293 relates to Category No.: 2890, 6717, 9247, 2402, 6644, 9158, 15269, 9305, 2942; Payload ID: 10295 relates to Category No.: 5561, 7118; Payload ID: 10296 relates to Category No.: 9305; Payload ID: 10297 relates to Category No.: 9305, 2420, 2192, 2942, 7015; Payload ID: 10298 relates to Category No.: 9247, 2633; Payload ID: 10299 relates to Category No.: 9305, 2890, 2420, 2192, 9247; Payload ID: 10300 relates to Category No.: 2890, 7070; Payload ID: 10301 relates to Category No.: 2890, 2942, 4755, 1748, 11650, 3036, 11653, 1017, 4010; Payload ID: 10302 relates to Category No.: 9305, 2890, 9247, 1748, 6440, 4420; Payload ID: 10303 relates to Category No.: 5776, 6994, 4049, 4010, 6060; Payload ID: 10304 relates to Category No.: 5561, 7118, 7070, 7048; Payload ID: 10305 relates to Category No.: 5561, 7118, 7070, 9756, 4010, 7048; Payload ID: 10306 relates to Category No.: 5561, 7118, 7061, 7070, 9754, 9756; Payload ID: 10307 relates to Category No.: 7118, 2890, 7060; Payload ID: 10308 relates to Category No.: 7118, 7048, 5562, 1402, 15975, 5561; Payload ID: 10309 relates to Category No.: 5562; Payload ID: 10310 relates to Category No.: 7118, 5762, 7048, 7052, 1402, 5563, 15975; Payload ID: 10311 relates to Category No.: 7118, 7052, 1402, 15975; Payload ID: 10312 relates to Category No.: 5561, 7118; Payload ID: 10313 relates to Category No.: 5561, 7118, 5762, 7048; Payload ID: 10314 relates to Category No.: 5561, 9305, 6717, 7048, 4010, 7118, 7070; Payload ID: 10315 relates to Category No.: 7118; Payload ID: 10316 relates to Category No.: 7118, 2890, 6717, 9247, 8948, 9756, 1017, 5564; Payload ID: 10317 relates to Category No.: 5561, 7118, 7070; Payload ID: 10318 relates to Category No.: 5561, 7118, 7070; Payload ID: 10319 relates to Category No.: 15151, 1748, 7070, 9756, 5563, 7118, 5561; Payload ID: 10320 relates to Category No.: 5561, 7048; Payload ID: 10321 relates to Category No.: 7118, 2890, 10056; Payload ID: 10322 relates to Category No.: 7118; Payload ID: 10323 relates to Category No.: 7118; Payload ID: 10324 relates to Category No.: 7118; Payload ID: 10325 relates to Category No.: 7048, 7052, 7053; Payload ID: 10326 relates to Category No.: 5561, 7118, 7048; Payload ID: 10327 relates to Category No.: 7118, 7060; Payload ID: 10328 relates to Category No.: 7118; Payload ID: 10329 relates to Category No.: 7118, 5776; Payload ID: 10330 relates to Category No.: 5561, 7118, 7048, 1842; Payload ID: 10331 relates to Category No.: 5561, 9305, 7118, 7048; Payload ID: 10332 relates to Category No.: 7118, 7048, 9247, 6041; Payload ID: 10333 relates to Category No.: 7118, 5762, 7048, 7055, 14145, 9247; Payload ID: 10334 relates to Category No.: 14174, 7048, 7055, 7097, 7118; Payload ID: 10335 relates to Category No.: 14174, 7118, 5762, 7048, 7055; Payload ID: 10336 relates to Category No.: 14174, 7048, 7055, 7097, 7118; Payload ID: 10337 relates to Category No.: 14174, 7048, 7118; Payload ID: 10338 relates to Category No.: 7118, 7048, 7055; Payload ID: 10339 relates to Category No.: 14174, 7048, 7055, 7118; Payload ID: 10340 relates to Category No.: 14174, 5762, 7048, 7055, 7118; Payload ID: 10341 relates to Category No.: 4030, 14174, 7118, 5762, 7048, 7097; Payload ID: 10342 relates to Category No.: 9305, 14174, 5762, 7048, 7055, 9184, 7118; Payload ID: 10343 relates to Category No.: 14174, 5762, 7048, 7055, 7118, 6041; Payload ID: 10344 relates to Category No.: 14174, 5762, 7048, 7097, 7118; Payload ID: 10345 relates to Category No.: 14174, 5762, 7048, 7055, 7118; Payload ID: 10346 relates to Category No.: 14174, 7118, 7048, 7055, 6041; Payload ID: 10347 relates to Category No.: 14174, 7118, 5762, 7048, 9242, 7055; Payload ID: 10348 relates to Category No.: 14174, 7118, 5762, 7048; Payload ID: 10349 relates to Category No.: 14174, 5762, 7048, 7055, 7118; Payload ID: 10350 relates to Category No.: 7118, 2890, 7048, 7055, 9247, 7097, 14174; Payload ID: 10351 relates to Category No.: 14174, 5762, 7048, 7055, 7118; Payload ID: 10352 relates to Category No.: 14174, 7118, 7048; Payload ID: 10353 relates to Category No.: 7048, 7055, 6041, 7097, 7118, 14174; Payload ID: 10354 relates to Category No.: 7048, 7055, 14174, 5762, 7118; Payload ID: 10355 relates to Category No.: 14174, 5762, 7048, 7097, 7118; Payload ID: 10356 relates to Category No.: 14174, 7118, 5762, 7048, 7097; Payload ID: 10357 relates to Category No.: 14174, 5762, 7048, 7055, 7118; Payload ID: 10358 relates to Category No.: 14174, 7118, 7048, 7097; Payload ID: 10359 relates to Category No.: 14174, 7048, 7118; Payload ID: 10360 relates to Category No.: 7048, 7097, 7118; Payload ID: 10361 relates to Category No.: 14174, 7048, 7118; Payload ID: 10362 relates to Category No.: 9305, 7118, 7048, 9242, 7097; Payload ID: 10363 relates to Category No.: 7118, 7048, 7055, 14145; Payload ID: 10364 relates to Category No.: 7118, 7048, 10056, 7105, 5561; Payload ID: 10365 relates to Category No.: 7048, 7055, 7097, 7118; Payload ID: 10366 relates to Category No.: 14174, 7048, 1842; Payload ID: 10367 relates to Category No.: 14174, 7118, 7048; Payload ID: 10368 relates to Category No.: 7118, 7048, 7055, 9247, 1748, 1842; Payload ID: 10369 relates to Category No.: 7118, 7048, 7055, 1842, 7097; Payload ID: 10370 relates to Category No.: 7048, 7097; Payload ID: 10371 relates to Category No.: 7055, 14174, 5762, 7048, 7097, 7118; Payload ID: 10372 relates to Category No.: 14174, 7118, 7048; Payload ID: 10373 relates to Category No.: 7048, 7055, 7097, 7118; Payload ID: 10374 relates to Category No.: 7048, 7055, 7118; Payload ID: 10375 relates to Category No.: 14174, 7048, 7118; Payload ID: 10376 relates to Category No.: 14174, 7048, 7118; Payload ID: 10377 relates to Category No.: 14174, 7048, 7055, 7118; Payload ID: 10378 relates to Category No.: 7097, 7118; Payload ID: 10379 relates to Category No.: 7118, 7048, 7097, 14174; Payload ID: 10380 relates to Category No.: 14174, 7118, 7048; Payload ID: 10381 relates to Category No.: 14174, 7118, 7048, 7105; Payload ID: 10382 relates to Category No.: 14668, 14174, 5762, 7048, 7105, 7097, 7118; Payload ID: 10383 relates to Category No.: 14174, 7118, 5762, 7048, 9184, 7105, 7097; Payload ID: 10384 relates to Category No.: 14174, 7118, 5762, 7048, 9184, 7105, 7097; Payload ID: 10385 relates to Category No.: 14174, 7118, 2890, 5762, 7048, 7105; Payload ID: 10386 relates to Category No.: 14174, 5762, 7048, 7105; Payload ID: 10387 relates to Category No.: 14174, 5762, 7048, 7105, 7118; Payload ID: 10388 relates to Category No.: 14174, 7118, 5762, 7048, 9247, 1748, 7105; Payload ID: 10389 relates to Category No.: 14174, 5762, 7048, 7105, 7118; Payload ID: 10390 relates to Category No.: 14174, 7118, 5762, 7105; Payload ID: 10391 relates to Category No.: 14174, 7048, 7118; Payload ID: 10392 relates to Category No.: 7118, 7048, 7105, 7097, 14174; Payload ID: 10393 relates to Category No.: 14174, 7118, 7048, 5730, 9184; Payload ID: 10394 relates to Category No.: 7048, 7105, 7097, 7118; Payload ID: 10395 relates to Category No.: 14174, 7118, 7048; Payload ID: 10396 relates to Category No.: 7118, 7048, 9247, 7105; Payload ID: 10397 relates to Category No.: 14174, 7118, 7048; Payload ID: 10398 relates to Category No.: 7118, 7048, 7105; Payload ID: 10399 relates to Category No.: 14174, 7118, 7048; Payload ID: 10400 relates to Category No.: 7118, 7048, 9242, 7105; Payload ID: 10401 relates to Category No.: 7118, 7048, 7105; Payload ID: 10402 relates to Category No.: 7118, 14174, 7048; Payload ID: 10403 relates to Category No.: 7118, 2890, 7048, 7105; Payload ID: 10404 relates to Category No.: 7118, 7048, 7105, 7074; Payload ID: 10405 relates to Category No.: 14174, 7118, 7048, 7105; Payload ID: 10406 relates to Category No.: 14668, 14174, 7048, 7105, 7118; Payload ID: 10407 relates to Category No.: 7048, 7105, 7118; Payload ID: 10408 relates to Category No.: 14174, 7118, 7048, 9242, 7105; Payload ID: 10409 relates to Category No.: 7118, 7060; Payload ID: 10410 relates to Category No.: 7118, 7048, 7060, 7097; Payload ID: 10411 relates to Category No.: 7048, 7060, 7097, 7118; Payload ID: 10412 relates to Category No.: 7118; Payload ID: 10413 relates to Category No.: 9305, 7118; Payload ID: 10414 relates to Category No.: 7118, 7060, 7068; Payload ID: 10415 relates to Category No.: 7118, 7060, 7068; Payload ID: 10416 relates to Category No.: 7118, 7070; Payload ID: 10417 relates to Category No.: 7118, 2890, 7055; Payload ID: 10418 relates to Category No.: 7118, 5762, 9247; Payload ID: 10419 relates to Category No.: 7118; Payload ID: 10420 relates to Category No.: 7118, 2890; Payload ID: 10421 relates to Category No.: 2890, 7118, 7060; Payload ID: 10422 relates to Category No.: 7118; Payload ID: 10423 relates to Category No.: 5561, 7048, 4010, 12200, 2751, 7079, 7118; Payload ID: 10424 relates to Category No.: 5561, 7048, 7079, 2751, 7079; Payload ID: 10425 relates to Category No.: 7118, 6717, 7048, 7092, 13752, 11883; Payload ID: 10426 relates to Category No.: 5561, 7048, 13753, 7118, 7095; Payload ID: 10427 relates to Category No.: 5561, 7118, 6717, 7048, 4010, 13753; Payload ID: 10428 relates to Category No.: 5561, 6717, 7048, 13753, 7118; Payload ID: 10429 relates to Category No.: 5561, 6717, 7048, 7061, 7087, 7118, 3036, 8948; Payload ID: 10430 relates to Category No.: 5561, 7048, 7087, 7118, 11650; Payload ID: 10431 relates to Category No.: 5561, 7048, 7087, 7118; Payload ID: 10432 relates to Category No.: 5561, 7048, 7087, 7118; Payload ID: 10433 relates to Category No.: 5561, 7048, 7087, 7118; Payload ID: 10434 relates to Category No.: 5561, 7048, 7087, 8935; Payload ID: 10435 relates to Category No.: 5561, 7048, 13749, 7118; Payload ID: 10436 relates to Category No.: 7118, 5564; Payload ID: 10437 relates to Category No.: 5561, 7070, 7118; Payload ID: 10438 relates to Category No.: 5561, 7118, 2942, 7070, 5821, 6968; Payload ID: 10439 relates to Category No.: 9305, 7118, 2890, 6976, 2938, 2942, 9247, 4755, 6968, 3521, 4010, 4228, 6059, 1659, 7161, 12219, 11883, 1017, 9730, 3037; Payload ID: 10441 relates to Category No.: 7118, 2890, 10056, 2942, 9247, 5762, 8951; Payload ID: 10442 relates to Category No.: 2942, 9247; Payload ID: 10443 relates to Category No.: 2890, 9247, 7118, 2942; Payload ID: 10444 relates to Category No.: 2942; Payload ID: 10445 relates to Category No.: 9305, 2890, 2942, 9247, 4010, 7118, 1700, 14906, 5762; Payload ID: 10446 relates to Category No.: 4029, 5762; Payload ID: 10447 relates to Category No.: 9305, 7118, 2938, 2942, 9247, 4755, 6968, 3521, 4010, 4228, 6059, 1659, 9162, 2890, 12219, 11883, 5762; Payload ID: 10448 relates to Category No.: 9305, 2890, 2942, 9247, 5762; Payload ID: 10449 relates to Category No.: 9305, 2890, 2942, 9247; Payload ID: 10450 relates to Category No.: 9305, 2890, 2942, 9247, 10104, 5762; Payload ID: 10451 relates to Category No.: 5762, 9305, 2942, 9247, 2890, 7118, 10106; Payload ID: 10452 relates to Category No.: 9305, 2890, 3673, 7061, 9734, 2942, 6717, 15139, 1017, 8935, 3036, 1711, 3071, 1036, 3052; Payload ID: 10453 relates to Category No.: 2890, 5762, 8951, 8948, 11883; Payload ID: 10454 relates to Category No.: 2890, 4765, 10056, 3036, 1016, 14683; Payload ID: 10455 relates to Category No.: 2942, 9247, 7118, 9305, 2890, 5762;

Payload ID: 10456 relates to Category No.: 9305, 2890, 10056, 2942, 9247, 2899, 4755, 15466; Payload ID: 10457 relates to Category No.: 5762; Payload ID: 10458 relates to Category No.: 9305, 7118, 2890, 5762, 6976, 10056, 2942, 3666, 4755, 3521, 4010, 4228, 6059; Payload ID: 10459 relates to Category No.: 4029, 9305, 7118, 2890, 5762, 6960, 2942, 3666, 4755, 9734, 3521, 1811, 9754, 4228, 6059, 2918, 1720; Payload ID: 10460 relates to Category No.: 2890, 6717, 2942, 9247; Payload ID: 10461 relates to Category No.: 9305, 5762, 2942; Payload ID: 10462 relates to Category No.: 5762, 14893, 9305; Payload ID: 10463 relates to Category No.: 2890, 2938, 2942, 9247; Payload ID: 10464 relates to Category No.: 9305, 2890, 5762, 2942; Payload ID: 10465 relates to Category No.: 2890, 2942, 4197; Payload ID: 10466 relates to Category No.: 2890; Payload ID: 10467 relates to Category No.: 2890, 6717, 6960, 2194; Payload ID: 10468 relates to Category No.: 2890, 6717, 10056, 2942, 4860, 1017; Payload ID: 10469 relates to Category No.: 6717, 5358, 5762; Payload ID: 10470 relates to Category No.: 2890, 2942; Payload ID: 10471 relates to Category No.: 5762; Payload ID: 10472 relates to Category No.: 2890; Payload ID: 10473 relates to Category No.: 2890, 5762, 9247, 9305, 2942; Payload ID: 10474 relates to Category No.: 5762, 2942; Payload ID: 10475 relates to Category No.: 2890, 5762, 9734; Payload ID: 10476 relates to Category No.: 2942, 5857, 11989; Payload ID: 10477 relates to Category No.: 2890; Payload ID: 10478 relates to Category No.: 9305, 2890, 10056, 2942, 9247, 3696, 5358, 401, 8951; Payload ID: 10479 relates to Category No.: 2890, 2942, 5762; Payload ID: 10480 relates to Category No.: 5762, 1842; Payload ID: 10481 relates to Category No.: 2890, 6717; Payload ID: 10482 relates to Category No.: 2890, 4765, 1099, 5561; Payload ID: 10483 relates to Category No.: 2890; Payload ID: 10484 relates to Category No.: 5762, 2890; Payload ID: 10485 relates to Category No.: 5762; Payload ID: 10486 relates to Category No.: 5762, 1842; Payload ID: 10487 relates to Category No.: 9305, 2890; Payload ID: 10488 relates to Category No.: 9305, 2890, 2194, 2942, 9247, 4010; Payload ID: 10489 relates to Category No.: 9305, 2890, 2942, 9247, 9184, 5762; Payload ID: 10490 relates to Category No.: 2890, 2942, 9247; Payload ID: 10491 relates to Category No.: 2194, 14893, 4392; Payload ID: 10492 relates to Category No.: 2194, 14893, 4392; Payload ID: 10493 relates to Category No.: 2194, 14893, 4392; Payload ID: 10494 relates to Category No.: 2938, 5776, 10056, 1720, 4228; Payload ID: 10495 relates to Category No.: 9157, 9305; Payload ID: 10496 relates to Category No.: 2890, 10056, 2942; Payload ID: 10497 relates to Category No.: 9305, 2890; Payload ID: 10499 relates to Category No.: 9305, 7070, 2890; Payload ID: 10500 relates to Category No.: 9305, 2890, 15505, 2942, 9247; Payload ID: 10501 relates to Category No.: 9305, 2890; Payload ID: 10503 relates to Category No.: 9305, 2890, 6717, 9247, 14893, 7181, 2440, 5238; Payload ID: 10504 relates to Category No.: 9247, 6644, 9209, 4072; Payload ID: 10505 relates to Category No.: 9305, 2890, 9247, 5238; Payload ID: 10506 relates to Category No.: 2890, 4755, 9734, 4760, 2942, 6717, 3055, 8948; Payload ID: 10507 relates to Category No.: 2942, 4010; Payload ID: 10508 relates to Category No.: 9305, 2890, 2942, 4010; Payload ID: 10509 relates to Category No.: 9305, 2890, 9242, 9734, 8942; Payload ID: 10510 relates to Category No.: 5762; Payload ID: 10513 relates to Category No.: 7118, 2890, 2942, 7070; Payload ID: 10514 relates to Category No.: 2890, 2938, 4049, 4030, 9305, 10056, 9734, 1239, 4199, 4010, 1772, 6989, 4228, 779, 16156, 6991, 12219, 778, 1099, 7366, 16026; Payload ID: 10515 relates to Category No.: 9305; Payload ID: 10516 relates to Category No.: 2890; Payload ID: 10517 relates to Category No.: 2942, 1842; Payload ID: 10518 relates to Category No.: 9305, 2942, 7204; Payload ID: 10519 relates to Category No.: 2942, 4010, 7204, 9305, 2890; Payload ID: 10520 relates to Category No.: 2942; Payload ID: 10521 relates to Category No.: 1700; Payload ID: 10523 relates to Category No.: 15573, 4010; Payload ID: 10524 relates to Category No.: 5561, 3673, 6717, 3666; Payload ID: 10525 relates to Category No.: 5561, 3673, 3666; Payload ID: 10526 relates to Category No.: 5561, 3673; Payload ID: 10527 relates to Category No.: 5561, 7118, 7070; Payload ID: 10528 relates to Category No.: 5561, 7118, 7041, 7070, 4010, 7048; Payload ID: 10529 relates to Category No.: 5561, 6717, 5570, 4755, 6060, 6440; Payload ID: 10530 relates to Category No.: 5561, 4765, 9734; Payload ID: 10531 relates to Category No.: 6717, 10056, 2942, 3673, 9247, 4049, 15139, 1017, 16078; Payload ID: 10532 relates to Category No.: 5561, 3673; Payload ID: 10533 relates to Category No.: 9305; Payload ID: 10534 relates to Category No.: 9305, 2890, 2942, 9247; Payload ID: 10535 relates to Category No.: 9247, 5730, 10104; Payload ID: 10536 relates to Category No.: 9247; Payload ID: 10537 relates to Category No.: 9305, 9247, 9734; Payload ID: 10541 relates to Category No.: 9305; Payload ID: 10544 relates to Category No.: 9305, 9247, 9153, 14583; Payload ID: 10545 relates to Category No.: 9242, 9247, 9153, 9305; Payload ID: 10546 relates to Category No.: 5561, 9305, 2890, 9734; Payload ID: 10547 relates to Category No.: 5561, 6717; Payload ID: 10548 relates to Category No.: 5561, 3673; Payload ID: 10549 relates to Category No.: 4029; Payload ID: 10550 relates to Category No.: 5561, 10056, 5570; Payload ID: 10551 relates to Category No.: 9305; Payload ID: 10552 relates to Category No.: 4030, 2942, 2903; Payload ID: 10553 relates to Category No.: 5762; Payload ID: 10554 relates to Category No.: 9305, 9242, 14671, 2420, 14665, 7254; Payload ID: 10555 relates to Category No.: 9305, 2890, 9242, 9168, 4003; Payload ID: 10556 relates to Category No.: 9305, 2890, 10056, 9242, 9247, 9172, 4010, 9190; Payload ID: 10557 relates to Category No.: 2890, 6717, 2194, 10056, 4765, 4755, 2183; Payload ID: 10558 relates to Category No.: 9305, 2890, 2194, 9247, 6994, 4755; Payload ID: 10559 relates to Category No.: 6717, 10056, 5570, 4755, 1792, 5561; Payload ID: 10561 relates to Category No.: 5561, 7118, 7048, 9756; Payload ID: 10562 relates to Category No.: 5561, 9756, 9754; Payload ID: 10563 relates to Category No.: 5561, 7048, 7055, 7118; Payload ID: 10564 relates to Category No.: 9305, 2942, 9247, 2402, 2420, 15269, 7256, 9158, 15269, 14614, 9157, 9734, 2632; Payload ID: 10565 relates to Category No.: 9305, 9247, 9153, 4929; Payload ID: 10567 relates to Category No.: 5561, 7048, 7118; Payload ID: 10568 relates to Category No.: 9305, 2890, 5762, 9242, 9247, 9184; Payload ID: 10569 relates to Category No.: 5561; Payload ID: 10570 relates to Category No.: 9305, 2890, 9247; Payload ID: 10571 relates to Category No.: 9305; Payload ID: 10574 relates to Category No.: 2890, 2942, 9247; Payload ID: 10575 relates to Category No.: 4029, 2890; Payload ID: 10576 relates to Category No.: 4029, 2890; Payload ID: 10577 relates to Category No.: 4029, 2890; Payload ID: 10578 relates to Category No.: 4029, 2890; Payload ID: 10579 relates to Category No.: 4029, 2890; Payload ID: 10580 relates to Category No.: 4029, 2890; Payload ID: 10581 relates to Category No.: 4029, 2890; Payload ID: 10582 relates to Category No.: 4029, 2890; Payload ID: 10583 relates to Category No.: 4029, 2890; Payload ID: 10584 relates to Category No.: 4029, 2890;

Payload ID: 10585 relates to Category No.: 4029, 2890; Payload ID: 10586 relates to Category No.: 5561, 4030, 5570, 9157, 4010, 779, 16156, 4763, 2890, 10056; Payload ID: 10587 relates to Category No.: 5570, 4763, 5561; Payload ID: 10588 relates to Category No.: 4030, 5561, 2942, 4010, 779, 4763; Payload ID: 10589 relates to Category No.: 5561, 4029, 10056, 4763; Payload ID: 10590 relates to Category No.: 5561, 4008, 4030; Payload ID: 10591 relates to Category No.: 5561, 4029, 4008, 779, 4763, 6989; Payload ID: 10592 relates to Category No.: 7300; Payload ID: 10593 relates to Category No.: 4029, 779, 1085, 4763, 6991; Payload ID: 10594 relates to Category No.: 5561, 10056, 4010, 4763; Payload ID: 10595 relates to Category No.: 5561; Payload ID: 10596 relates to Category No.: 5561, 4029, 4763; Payload ID: 10597 relates to Category No.: 5561; Payload ID: 10598 relates to Category No.: 4030, 2890, 4010, 4173, 4763; Payload ID: 10599 relates to Category No.: 4030, 4010, 4763; Payload ID: 10600 relates to Category No.: 4029; Payload ID: 10601 relates to Category No.: 4010, 4763; Payload ID: 10602 relates to Category No.: 4029, 6717, 4763; Payload ID: 10603 relates to Category No.: 5561, 2890, 10056, 5570, 3696, 6060, 6440, 12406; Payload ID: 10604 relates to Category No.: 5561, 10056; Payload ID: 10605 relates to Category No.: 5561, 10056, 2890; Payload ID: 10606 relates to Category No.: 5561, 6717, 10056; Payload ID: 10607 relates to Category No.: 9305; Payload ID: 10608 relates to Category No.: 4029, 10077; Payload ID: 10609 relates to Category No.: 4030, 4010, 1090; Payload ID: 10610 relates to Category No.: 5561, 5762; Payload ID: 10611 relates to Category No.: 5561, 6717, 5762; Payload ID: 10612 relates to Category No.: 4765, 3673, 3832, 3686; Payload ID: 10613 relates to Category No.: 5561, 1099, 9773, 1774; Payload ID: 10614 relates to Category No.: 5561; Payload ID: 10615 relates to Category No.: 4029, 1842; Payload ID: 10616 relates to Category No.: 5561, 9305, 6717, 4010; Payload ID: 10617 relates to Category No.: 5561, 1842, 1090; Payload ID: 10618 relates to Category No.: 9305, 2890, 9247, 2942, 2402, 11883, 9181, 2514, 5216; Payload ID: 10619 relates to Category No.: 3666, 4010, 3671; Payload ID: 10620 relates to Category No.: 2890, 1182, 11650, 3036, 11653, 779, 781, 2926, 14384; Payload ID: 10621 relates to Category No.: 2890, 9247, 2194, 5776, 2942, 4010, 3862, 6060, 493, 16156; Payload ID: 10622 relates to Category No.: 9305, 10056, 2942, 3521, 4010, 3862, 6060, 6059, 16156; Payload ID: 10623 relates to Category No.: 5561, 3673, 9734, 14368, 10085, 5762; Payload ID: 10624 relates to Category No.: 9305, 9242, 9247; Payload ID: 10625 relates to Category No.: 9305, 2890, 10162; Payload ID: 10626 relates to Category No.: 2890, 10162; Payload ID: 10627 relates to Category No.: 6717, 5762, 10056, 4010; Payload ID: 10628 relates to Category No.: 5570, 1748, 11653, 8917, 12406, 6717, 15139, 10056, 5561; Payload ID: 10629 relates to Category No.: 9305, 2890, 2194, 9247, 2920; Payload ID: 10630 relates to Category No.: 9305, 2890; Payload ID: 10631 relates to Category No.: 9305, 2890; Payload ID: 10632 relates to Category No.: 2890; Payload ID: 10633 relates to Category No.: 10104, 9162, 9180, 9305; Payload ID: 10634 relates to Category No.: 9305; Payload ID: 10635 relates to Category No.: 9305; Payload ID: 10636 relates to Category No.: 2942, 1720, 14327, 2890; Payload ID: 10637 relates to Category No.: 9305, 2890, 10056, 9247, 6017; Payload ID: 10638 relates to Category No.: 9305, 6717, 9247, 15173, 2314, 7355, 2628, 2632, 6525, 2420; Payload ID: 10639 relates to Category No.: 9305, 15173, 2314, 7019, 2628, 2632, 6525; Payload ID: 10640 relates to Category No.: 6717, 9247, 9158, 9158, 15269, 7359, 7357, 9305; Payload ID: 10641 relates to Category No.: 9305, 6717, 9247, 9158, 7359; Payload ID: 10642 relates to Category No.: 9305, 9158, 15173, 2628, 2632; Payload ID: 10643 relates to Category No.: 9158, 15173; Payload ID: 10644 relates to Category No.: 9158, 2890, 5776, 10056, 9247, 4755, 7357, 9157; Payload ID: 10645 relates to Category No.: 9305, 9247, 7118; Payload ID: 10646 relates to Category No.: 2890, 2942, 3673, 9734, 9184; Payload ID: 10647 relates to Category No.: 9305, 2890, 2942, 9199; Payload ID: 10648 relates to Category No.: 9305, 2890, 6717, 5776, 9242, 9076; Payload ID: 10649 relates to Category No.: 9155; Payload ID: 10652 relates to Category No.: 9305; Payload ID: 10653 relates to Category No.: 9305, 9247, 6968; Payload ID: 10654 relates to Category No.: 9305; Payload ID: 10655 relates to Category No.: 9305, 2890, 9247, 3036, 7179, 10104; Payload ID: 10656 relates to Category No.: 9305, 7118, 2890, 2194; Payload ID: 10657 relates to Category No.: 9305, 6717, 1017, 6968; Payload ID: 10658 relates to Category No.: 9305, 2890, 9242, 2942, 15505; Payload ID: 10659 relates to Category No.: 9305, 5561; Payload ID: 10660 relates to Category No.: 9305, 2890, 9247; Payload ID: 10661 relates to Category No.: 2890, 6717; Payload ID: 10662 relates to Category No.: 7118, 5561; Payload ID: 10663 relates to Category No.: 5561, 10056, 9577, 7366, 14384, 2890, 7368, 6770; Payload ID: 10664 relates to Category No.: 9305, 10056, 8948, 1772, 5745, 2608, 1774, 7366; Payload ID: 10665 relates to Category No.: 9305, 2890, 9247; Payload ID: 10666 relates to Category No.: 5561, 10056; Payload ID: 10667 relates to Category No.: 10056, 5570, 7366, 1099, 6443, 14293; Payload ID: 10668 relates to Category No.: 5570, 1792, 4228; Payload ID: 10669 relates to Category No.: 5561, 2938, 10056; Payload ID: 10670 relates to Category No.: 5561; Payload ID: 10671 relates to Category No.: 5561, 9305, 3673; Payload ID: 10672 relates to Category No.: 5561; Payload ID: 10673 relates to Category No.: 9305, 2890, 9247; Payload ID: 10674 relates to Category No.: 9305; Payload ID: 10675 relates to Category No.: 9734, 7118, 7366; Payload ID: 10676 relates to Category No.: 4030; Payload ID: 10677 relates to Category No.: 5561, 9305, 7118, 2890, 6717, 2942, 9247, 7070, 1108, 7060, 5762; Payload ID: 10678 relates to Category No.: 9305, 2890, 4010; Payload ID: 10679 relates to Category No.: 2890, 10056, 2942, 3696, 11883, 11650; Payload ID: 10680 relates to Category No.: 9305, 2890, 9247; Payload ID: 10681 relates to Category No.: 9305, 2890, 6717; Payload ID: 10682 relates to Category No.: 9305; Payload ID: 10683 relates to Category No.: 9305, 2890, 9242, 9247, 15497; Payload ID: 10684 relates to Category No.: 2890, 9247; Payload ID: 10685 relates to Category No.: 5762, 2890; Payload ID: 10686 relates to Category No.: 9305, 4010, 15497; Payload ID: 10687 relates to Category No.: 10056, 1748, 2890, 9247, 2942, 447, 1811, 1803, 778; Payload ID: 10689 relates to Category No.: 5561, 6717, 10056, 1811, 4010, 14327, 6743, 2710; Payload ID: 10690 relates to Category No.: 5561, 2890, 6717; Payload ID: 10691 relates to Category No.: 4030, 4010, 3671, 3685, 4029; Payload ID: 10694 relates to Category No.: 4030, 6443, 9305, 14409, 4010, 1050, 7118; Payload ID: 10695 relates to Category No.: 7394; Payload ID: 10696 relates to Category No.: 4043, 1748, 5342, 16326, 2710, 5762; Payload ID: 10697 relates to Category No.: 9305; Payload ID: 10698 relates to Category No.: 4030, 7048, 12159, 4014, 3666, 2899, 4755, 7070, 2458, 4010, 2926, 7052, 9087, 14293; Payload ID: 10699 relates to Category No.: 9305, 2890, 15505, 9247, 9157; Payload ID: 10700 relates to Category No.: 9305, 2890, 9247, 1748, 15505; Payload ID: 10701 relates to Category No.: 9305, 2890, 5776, 9247, 11883, 9215; Payload ID: 10702 relates to Category No.: 9305, 5776, 9247, 2890; Payload ID: 10703 relates to Category No.: 9305, 2890; Payload ID: 10704 relates to Category No.: 9247, 4755, 9305, 2890, 9242; Payload ID: 10705 relates to Category No.: 5561, 5776, 10056, 2927, 4010, 9184, 2926, 1659, 9162; Payload ID: 10706 relates to Category No.: 9305, 2890, 15505, 9247, 9157, 7389; Payload ID: 10707 relates to Category No.: 9305, 9247, 14253; Payload ID: 10708 relates to Category No.: 9305, 9247, 14253; Payload ID: 10709 relates to Category No.: 9305, 15505, 9247, 12170; Payload ID: 10710 relates to Category No.: 4010; Payload ID: 10711 relates to Category No.: 2890, 4010, 5412; Payload ID: 10712 relates to Category No.: 6449, 15013, 14364; Payload ID: 10713 relates to Category No.: 7118, 7395, 6449; Payload ID: 10714 relates to Category No.: 6449; Payload ID: 10715 relates to Category No.: 9305; Payload ID: 10716 relates to Category No.: 9305, 5342, 16326; Payload ID: 10717 relates to Category No.: 5561, 14371; Payload ID: 10718 relates to Category No.: 2942, 14364, 196, 15013, 1353, 7389; Payload ID: 10719 relates to Category No.: 2942, 7395; Payload ID: 10720 relates to Category No.: 2942, 7395, 7389; Payload ID: 10721 relates to Category No.: 7395; Payload ID: 10722 relates to Category No.: 1842; Payload ID: 10723 relates to Category No.: 7394, 2890, 1099, 6989, 1335, 4197, 6075, 2710, 1085, 779, 10063, 6743, 8935, 8948, 4860, 273, 1750; Payload ID: 10724 relates to Category No.: 7394, 2890, 10056, 9734, 3521, 276, 4199, 4010, 1772, 3696, 1335, 15574; Payload ID: 10725 relates to Category No.: 7118, 7394, 2890, 6717, 10056, 9242, 2942, 9247, 2899, 9199, 4010, 14327, 6989, 6743, 4197, 15971, 6075, 1085, 14956, 1335, 14953, 7400, 9305; Payload ID: 10726 relates to Category No.: 7394, 8935, 3693, 8948, 1099, 1017, 4010, 2926, 1335, 7366, 775, 14683, 1016, 10063; Payload ID: 10727 relates to Category No.: 7394, 2890, 2938, 273, 447, 1811, 4010, 2502, 1335; Payload ID: 10728 relates to Category No.: 7394, 15971, 2710, 4197; Payload ID: 10729 relates to Category No.: 7394, 6717, 10056, 4010, 9773, 6017, 4199, 6989, 6099; Payload ID: 10730 relates to Category No.: 7394; Payload ID: 10731 relates to Category No.: 7394, 2890, 4199, 4197, 10000, 14955, 4202; Payload ID: 10732 relates to Category No.: 7394, 2890, 10002, 10000, 14955, 4202; Payload ID: 10733 relates to Category No.: 5561, 7394, 2942, 15971, 5762; Payload ID: 10734 relates to Category No.: 7394, 2890, 6717, 2942, 273, 9734, 1720, 4197, 14327, 6017, 4202, 276; Payload ID: 10735 relates to Category No.: 2890, 2942, 6017, 4010, 2514, 14999, 1811; Payload ID: 10736 relates to Category No.: 9305, 2890, 14364; Payload ID: 10737 relates to Category No.: 2890, 2942, 273; Payload ID: 10738 relates to Category No.: 4010; Payload ID: 10739 relates to Category No.: 2942, 6440, 7344; Payload ID: 10740 relates to Category No.: 2890, 273, 4228; Payload ID: 10741 relates to Category No.: 2890, 5762, 2938, 10056, 4049; Payload ID: 10742 relates to Category No.: 6443, 12439, 7394, 2890, 6717, 2942, 8935, 3666, 5555, 3521, 276, 9756, 4860, 4010, 14327, 6059, 16156, 4202, 10002, 4755, 8948, 375, 14409, 5727, 6709, 6978; Payload ID: 10743 relates to Category No.: 12439, 7394, 2927, 4010, 11883, 774; Payload ID: 10744 relates to Category No.: 7394, 4010; Payload ID: 10745 relates to Category No.: 9305, 7394, 2890, 6717, 10056, 2942, 9247, 2899, 4755, 9734, 1720, 2534, 3636, 4010, 9184, 14327, 4197, 6440, 15971, 3393, 5241, 2505, 2502, 14329, 8948, 1017, 16164, 11883, 5776, 778, 6989; Payload ID: 10746 relates to Category No.: 7394, 2890, 2938, 2942, 15139, 1720, 10002, 10000, 6440, 9998, 779, 14953, 6709, 6989, 7413, 15981; Payload ID: 10747 relates to Category No.: 15627, 9734, 3065, 10002, 15139, 273, 3982, 6709, 779, 14412, 5762; Payload ID: 10748 relates to Category No.: 7394, 2938, 4010, 779; Payload ID: 10749 relates to Category No.: 7394, 2890, 2938, 10056, 9242, 2942, 1720, 6017, 14327, 4201, 4202, 8948, 8935, 4199; Payload ID: 10750 relates to Category No.: 7394, 2890, 7070; Payload ID: 10751 relates to Category No.: 7394, 2890, 2938, 14953, 4010, 14954; Payload ID: 10752 relates to Category No.: 7394, 2938, 1335; Payload ID: 10753 relates to Category No.: 7394, 2890, 10056, 9247, 9734, 2942, 6717; Payload ID: 10754 relates to Category No.: 7394, 6717, 4765, 15573, 3685, 375, 2938; Payload ID: 10755 relates to Category No.: 7394, 16326, 4197, 2194, 9247, 14364, 15971; Payload ID: 10756 relates to Category No.: 7394, 7395, 2907, 7344, 5596, 196; Payload ID: 10757 relates to Category No.: 9305, 7118, 7394, 2890, 2942, 6994, 273, 1720, 6017, 4010, 2514, 14999, 7402, 375, 7403, 10056, 4860, 8948, 1017, 8935, 14893, 8917, 3055, 1335; Payload ID: 10758 relates to Category No.: 7394, 2942, 4010, 6709, 7395, 7344; Payload ID: 10759 relates to Category No.: 7394, 4010, 7395, 7389, 7344; Payload ID: 10760 relates to Category No.: 7394, 6717, 2942, 4010, 7402, 375, 7403, 2890, 14999, 4860, 1017, 7366, 1335; Payload ID: 10761 relates to Category No.: 7394, 7395, 7389; Payload ID: 10762 relates to Category No.: 7394, 2942, 14364, 7395, 11883, 7389, 7344, 1811, 4755, 196, 376; Payload ID: 10763 relates to Category No.: 7394, 2942, 14364, 4010, 7395, 7344, 2649; Payload ID: 10764 relates to Category No.: 7394, 14364, 7395, 7389, 7344; Payload ID: 10765 relates to Category No.: 7394, 2890, 2942, 9247, 14364, 4228, 7395, 7389, 7344, 14999, 16326; Payload ID: 10766 relates to Category No.: 7394, 2890, 9247, 14364, 4228, 7395, 7344, 14999, 16326, 7389; Payload ID: 10767 relates to Category No.: 7394, 6717, 7395; Payload ID: 10768 relates to Category No.: 7394, 2890, 2942, 14364, 7395, 7344; Payload ID: 10769 relates to Category No.: 9305, 7394, 2890, 6717, 10056, 2942, 273, 5591, 2660, 1750, 4010, 14327, 4228, 11883, 5392, 2514, 14999, 16026, 376, 7402, 375, 7403, 1803, 1720, 14893, 8917, 2712, 1335; Payload ID: 10770 relates to Category No.: 2942, 14364, 7389, 7344, 2649; Payload ID: 10771 relates to Category No.: 7118, 2942; Payload ID: 10772 relates to Category No.: 7394, 2942, 4010, 14999, 16326, 7402, 11883; Payload ID: 10773 relates to Category No.: 2942, 4010, 14999, 16326, 1335, 778, 7402, 11883; Payload ID: 10774 relates to Category No.: 7394, 2938, 2942, 273, 14364, 7389, 196; Payload ID: 10775 relates to Category No.: 2942, 14364, 5342, 196, 7344, 7394; Payload ID: 10776 relates to Category No.: 7394, 2942, 196; Payload ID: 10777 relates to Category No.: 2942, 7344; Payload ID: 10778 relates to Category No.: 7394, 6717, 2942, 4010, 1335, 15971, 16156; Payload ID: 10779 relates to Category No.: 7394, 2942, 4010, 15971, 7344; Payload ID: 10780 relates to Category No.: 7394, 2942, 196, 3055; Payload ID: 10781 relates to Category No.: 2942, 7344, 14999, 16326, 7402; Payload ID: 10782 relates to Category No.: 4030, 2890; Payload ID: 10783 relates to Category No.: 273, 14363, 16326; Payload ID: 10784 relates to Category No.: 9305, 2942, 9734, 4073, 4010, 2890, 1017; Payload ID: 10785 relates to Category No.: 2890, 10056, 2942, 4199, 4010, 14327, 6059, 5342; Payload ID: 10786 relates to Category No.: 2890, 10056, 2942; Payload ID: 10788 relates to Category No.: 4010; Payload ID: 10789 relates to Category No.: 2890; Payload ID: 10790 relates to Category No.: 2942, 9734, 14327; Payload ID: 10791 relates to Category No.: 9305, 2890, 2942, 15151, 3036, 1017, 4010, 3055, 3523, 8951, 15147, 16057; Payload ID: 10792 relates to Category No.: 2890, 6717, 2942, 9247, 4049; Payload ID: 10793 relates to Category No.: 4030, 2942, 3523; Payload ID: 10794 relates to Category No.: 2890, 2942, 9162; Payload ID: 10795 relates to Category No.: 2942, 6717; Payload ID: 10796 relates to Category No.: 9162; Payload ID: 10797 relates to Category No.: 2890; Payload ID: 10798 relates to Category No.: 9305, 12219, 273; Payload ID: 10799 relates to Category No.: 14364, 16326, 273; Payload ID: 10800 relates to Category No.: 16326; Payload ID: 10801 relates to Category No.: 10056, 273, 4010, 4228, 2890, 2194, 6717, 1720, 4462, 2942, 15139, 6960, 3055, 1033, 6443, 4860, 2417, 9472, 1231, 3045; Payload ID: 10802 relates to Category No.: 2890, 2194, 9242, 9247, 7253, 9153; Payload ID: 10803 relates to Category No.: 9305, 2890, 6717, 5762, 9242, 2949, 7529; Payload ID: 10804 relates to Category No.: 2949, 9305, 7529; Payload ID: 10805 relates to Category No.: 9305, 2890, 6717, 15505, 7529; Payload ID: 10806 relates to Category No.: 9305, 2890, 15505, 4010, 7529; Payload ID: 10807 relates to Category No.: 9305, 2890, 5762, 7530; Payload ID: 10808 relates to Category No.: 2890, 9247, 4755, 7530; Payload ID: 10809 relates to Category No.: 2890, 10162, 7531; Payload ID: 10810 relates to Category No.: 2890, 10162, 7531; Payload ID: 10811 relates to Category No.: 9305, 9247, 2890, 10162, 7531; Payload ID: 10813 relates to Category No.: 2890, 4010, 7529; Payload ID: 10814 relates to Category No.: 4765; Payload ID: 10815 relates to Category No.: 11883; Payload ID: 10816 relates to Category No.: 2890, 4010; Payload ID: 10817 relates to Category No.: 5561, 10056; Payload ID: 10818 relates to Category No.: 5561, 10056; Payload ID: 10819 relates to Category No.: 5561, 10056; Payload ID: 10820 relates to Category No.: 5561, 10056; Payload ID: 10821 relates to Category No.: 9305, 2890; Payload ID: 10822 relates to Category No.: 9305, 9157, 9311, 9155; Payload ID: 10823 relates to Category No.: 5561, 10056; Payload ID: 10824 relates to Category No.: 5561, 779; Payload ID: 10825 relates to Category No.: 5561; Payload ID: 10826 relates to Category No.: 6443, 2890, 4010; Payload ID: 10827 relates to Category No.: 4010; Payload ID: 10828 relates to Category No.: 5561, 9305, 4765, 4755; Payload ID: 10829 relates to Category No.: 4755, 4010, 6717, 4765, 5776; Payload ID: 10830 relates to Category No.: 5561, 4760; Payload ID: 10831 relates to Category No.: 6443, 4010, 6437; Payload ID: 10832 relates to Category No.: 7060; Payload ID: 10833 relates to Category No.: 2942; Payload ID: 10834 relates to Category No.: 2942, 1842; Payload ID: 10835 relates to Category No.: 2890, 2942, 4010; Payload ID: 10836 relates to Category No.: 2942; Payload ID: 10837 relates to Category No.: 9305, 6717, 9242, 9158, 15269; Payload ID: 10838 relates to Category No.: 5561, 9305; Payload ID: 10839 relates to Category No.: 7530; Payload ID: 10840 relates to Category No.: 2942; Payload ID: 10841 relates to Category No.: 2890; Payload ID: 10842 relates to Category No.: 5561, 3673, 4010, 3686, 3685; Payload ID: 10844 relates to Category No.: 5561, 7118, 2890, 7061, 14295; Payload ID: 10845 relates to Category No.: 11883; Payload ID: 10847 relates to Category No.: 2942; Payload ID: 10849 relates to Category No.: 2890, 4010, 10003; Payload ID: 10850 relates to Category No.: 6443, 2890, 4010; Payload ID: 10851 relates to Category No.: 4030, 6443, 4010, 6437; Payload ID: 10852 relates to Category No.: 5561, 4029, 7118, 10056; Payload ID: 10853 relates to Category No.: 4029; Payload ID: 10854 relates to Category No.: 2942; Payload ID: 10855 relates to Category No.: 7118; Payload ID: 10856 relates to Category No.: 2890, 2942; Payload ID: 10857 relates to Category No.: 5561, 5776, 3673, 3666, 6222; Payload ID: 10858 relates to Category No.: 2890, 2942, 4010, 8948; Payload ID: 10859 relates to Category No.: 2890, 9247, 4010; Payload ID: 10860 relates to Category No.: 5561, 7118, 7048, 7061, 7087; Payload ID: 10861 relates to Category No.: 7048, 7060, 7087, 7118, 7366; Payload ID: 10862 relates to Category No.: 5561, 7118, 7048, 7087; Payload ID: 10863 relates to Category No.: 6717, 7118, 2890, 7048, 7087; Payload ID: 10864 relates to Category No.: 5561, 7118, 2890, 7048, 7061, 9247, 7085, 4010, 7087; Payload ID: 10865 relates to Category No.: 7048, 7061, 7087, 7118; Payload ID: 10866 relates to Category No.: 5561, 7118, 7048, 7087; Payload ID: 10868 relates to Category No.: 5561; Payload ID: 10869 relates to Category No.: 7048, 7087, 7118, 13750; Payload ID: 10870 relates to Category No.: 7048, 13749, 7061, 7087, 7118; Payload ID: 10871 relates to Category No.: 7048, 7087, 7097; Payload ID: 10872 relates to Category No.: 7118, 7048, 7087, 7052; Payload ID: 10873 relates to Category No.: 9305, 7061, 7060, 7087; Payload ID: 10874 relates to Category No.: 5561, 7118, 7048, 4010, 7087; Payload ID: 10875 relates to Category No.: 7048, 4010, 7087, 7118; Payload ID: 10876 relates to Category No.: 5561, 7118, 7048, 7087; Payload ID: 10877 relates to Category No.: 7087, 7048, 7118; Payload ID: 10878 relates to Category No.: 7118, 7087, 5561, 7048, 4010; Payload ID: 10879 relates to Category No.: 5561, 7118, 7048, 9247, 4010, 9184, 7087; Payload ID: 10880 relates to Category No.: 5561, 7118, 7048, 9247, 7087; Payload ID: 10881 relates to Category No.: 5561, 7118, 7048, 7061, 9247, 7087; Payload ID: 10882 relates to Category No.: 7118, 7048, 7087, 7052; Payload ID: 10883 relates to Category No.: 5561, 7118, 7048, 3666, 7087; Payload ID: 10884 relates to Category No.: 7118, 7048, 4010, 7087; Payload ID: 10885 relates to Category No.: 7048, 7061, 7060, 7087, 7118; Payload ID: 10886 relates to Category No.: 5561, 7118, 7048, 7087; Payload ID: 10887 relates to Category No.: 5561, 2890, 7048, 7087, 13749; Payload ID: 10888 relates to Category No.: 2890, 7087; Payload ID: 10889 relates to Category No.: 7118, 7048; Payload ID: 10890 relates to Category No.: 9305, 7048, 7118; Payload ID: 10891 relates to Category No.: 7118, 7048, 7061; Payload ID: 10892 relates to Category No.: 7048, 4050, 7118; Payload ID: 10893 relates to Category No.: 9305, 2890, 7048, 7118; Payload ID: 10894 relates to Category No.: 4030, 7118, 7060; Payload ID: 10895 relates to Category No.: 7118, 6717, 7060, 7087, 7052, 7366; Payload ID: 10896 relates to Category No.: 7118, 9247, 7060, 7087; Payload ID: 10897 relates to Category No.: 9305, 7118, 7061, 7060, 7087, 7048, 7366; Payload ID: 10898 relates to Category No.: 7118, 7048, 7087, 13750; Payload ID: 10899 relates to Category No.: 7118, 7048, 7087, 7052; Payload ID: 10900 relates to Category No.: 7048, 7087, 7118; Payload ID: 10901 relates to Category No.: 7060, 7087, 7048, 7118, 8935, 8948, 15147; Payload ID: 10902 relates to Category No.: 7118, 6717, 7060, 7087; Payload ID: 10903 relates to Category No.: 7048, 7087, 7118; Payload ID: 10904 relates to Category No.: 7118, 7048, 7087, 7366; Payload ID: 10905 relates to Category No.: 7118, 7048, 9247, 7087; Payload ID: 10907 relates to Category No.: 7048, 7087, 7097; Payload ID: 10908 relates to Category No.: 1842; Payload ID: 10909 relates to Category No.: 9305, 2890, 2942, 9734, 5730; Payload ID: 10910 relates to Category No.: 5561, 10056, 1748, 3521, 7517, 5830, 2890, 3693; Payload ID: 10911 relates to Category No.: 10056, 4010, 2890, 7517; Payload ID: 10912 relates to Category No.: 5561, 9242, 3673, 4228, 9734, 1772, 7118, 779, 14999, 7517; Payload ID: 10913 relates to Category No.: 2942, 7517; Payload ID: 10914 relates to Category No.: 5762, 10056, 7517; Payload ID: 10915 relates to Category No.: 5561, 3666; Payload ID: 10916 relates to Category No.: 2890, 10056, 12087; Payload ID: 10917 relates to Category No.: 2899, 1099, 1772, 2926, 6075; Payload ID: 10918 relates to Category No.: 2890, 1182, 6017, 4228, 779; Payload ID: 10919 relates to Category No.: 9305, 9242, 9247; Payload ID: 10920 relates to Category No.: 9305; Payload ID: 10921 relates to Category No.: 9305; Payload ID: 10922 relates to Category No.: 2890, 9734; Payload ID: 10923 relates to Category No.: 9305, 2890, 9734, 2903; Payload ID: 10924 relates to Category No.: 9305, 2890, 9734, 2903, 2920; Payload ID: 10925 relates to Category No.: 4030, 6443, 4010, 603, 7323; Payload ID: 10926 relates to Category No.: 2942, 1792, 7118; Payload ID: 10927 relates to Category No.: 9305, 2890, 4010, 7528; Payload ID: 10928 relates to Category No.: 9305, 2890; Payload ID: 10929 relates to Category No.: 4029, 2890, 4030, 9305, 9734, 6617; Payload ID: 10930 relates to Category No.: 4030, 4029, 11883; Payload ID: 10931 relates to Category No.: 4029, 4030, 14409; Payload ID: 10932 relates to Category No.: 5561, 10056, 5570, 12406, 4919, 14769; Payload ID: 10933 relates to Category No.: 5561, 4919, 14769, 10056, 5762; Payload ID: 10934 relates to Category No.: 5561, 5762, 10056, 5570, 4010, 6717; Payload ID: 10935 relates to Category No.: 10056, 5570, 15126; Payload ID: 10936 relates to Category No.: 10056, 5570; Payload ID: 10937 relates to Category No.: 10056, 5570, 1803; Payload ID: 10938 relates to Category No.: 5561, 10056, 16187; Payload ID: 10939 relates to Category No.: 5561, 5570; Payload ID: 10940 relates to Category No.: 6717; Payload ID: 10942 relates to Category No.: 9305, 14174, 2890, 10056, 2942, 3666, 12085, 1811, 16164; Payload ID: 10943 relates to Category No.: 2890, 2942, 3666, 16164, 15139, 8951; Payload ID: 10944 relates to Category No.: 5727, 2942, 2660; Payload ID: 10945 relates to Category No.: 5561, 2942, 4010, 4228, 6019, 14378, 6017; Payload ID: 10946 relates to Category No.: 6717, 2942, 5570, 4010, 14378; Payload ID: 10947 relates to Category No.: 1842; Payload ID: 10949 relates to Category No.: 5561, 6717, 9199, 9184, 2890; Payload ID: 10950 relates to Category No.: 9305, 6717, 2942, 2420, 2192, 2630, 5964, 2633, 2634, 7547; Payload ID: 10951 relates to Category No.: 5561, 4765; Payload ID: 10952 relates to Category No.: 5561, 4765, 4755; Payload ID: 10953 relates to Category No.: 5561, 4765; Payload ID: 10954 relates to Category No.: 5561, 4765; Payload ID: 10955 relates to Category No.: 2890, 6976, 2194, 2942, 9247, 4755, 9734, 4860, 4010, 9305, 5561; Payload ID: 10956 relates to Category No.: 2890, 4010; Payload ID: 10957 relates to Category No.: 7118, 2890, 2942, 3673, 1099, 1777, 5561; Payload ID: 10958 relates to Category No.: 7118, 7048, 4010, 7087, 7095; Payload ID: 10959 relates to Category No.: 7048, 5561, 13749; Payload ID: 10960 relates to Category No.: 4010, 5342, 16326, 14999; Payload ID: 10961 relates to Category No.: 2942, 273, 4010, 16326, 2649, 7389; Payload ID: 10962 relates to Category No.: 4089, 7349, 7389; Payload ID: 10963 relates to Category No.: 6717, 10056, 2534, 2501; Payload ID: 10964 relates to Category No.: 6717, 5762, 10056, 2534, 2501; Payload ID: 10965 relates to Category No.: 9305, 9730, 2890, 2194, 2942, 1774; Payload ID: 10966 relates to Category No.: 2890, 9247, 2420, 15269, 14675; Payload ID: 10967 relates to Category No.: 9242, 10104, 9305; Payload ID: 10968 relates to Category No.: 2890; Payload ID: 10970 relates to Category No.: 9305, 4010, 15531; Payload ID: 10971 relates to Category No.: 2927, 2926; Payload ID: 10972 relates to Category No.: 5561, 4029, 4765, 9734, 3696, 4755, 1720; Payload ID: 10973 relates to Category No.: 5561, 7118, 2890, 5776, 4765, 3666, 4755, 9734, 7324, 5762; Payload ID: 10974 relates to Category No.: 2890, 10056; Payload ID: 10976 relates to Category No.: 8841, 9305, 2890, 9247; Payload ID: 10977 relates to Category No.: 9305, 2890, 9247, 8841; Payload ID: 10978 relates to Category No.: 9305, 6717, 9247, 8841; Payload ID: 10979 relates to Category No.: 9305, 7118, 9247, 8841; Payload ID: 10980 relates to Category No.: 5561, 10056, 3673, 3666; Payload ID: 10981 relates to Category No.: 9305, 2890, 9242; Payload ID: 10982 relates to Category No.: 6443, 7118, 6717, 2942, 11687, 997, 4010, 2926, 6059, 6449; Payload ID: 10983 relates to Category No.: 9305, 2890, 6976, 9247, 2420; Payload ID: 10984 relates to Category No.: 9247, 2890, 6968, 14902; Payload ID: 10985 relates to Category No.: 9305; Payload ID: 10986 relates to Category No.: 9305, 2942, 9247, 5762; Payload ID: 10987 relates to Category No.: 5561, 10056, 5570, 10062; Payload ID: 10988 relates to Category No.: 4029, 2890, 5776, 12159, 4402, 3036, 4014, 1017, 8948; Payload ID: 10989 relates to Category No.: 4029, 6717, 12159, 4010, 1090, 4014, 14692, 5581; Payload ID: 10990 relates to Category No.: 6717, 2938, 2942, 1182, 447, 7244, 1811, 9998, 2457, 2443, 2458; Payload ID: 10991 relates to Category No.: 2942, 11728, 2458; Payload ID: 10992 relates to Category No.: 6717, 2194, 2942, 1182, 1811, 2890, 9998, 2457, 2443, 14125, 2938, 9098; Payload ID: 10993 relates to Category No.: 10056, 5570, 4010, 14647, 5762, 1774; Payload ID: 10994 relates to Category No.: 10056, 5570, 5824, 3666, 1811, 4010, 6743, 11883, 14647; Payload ID: 10995 relates to Category No.: 4029, 3693, 2899, 4763; Payload ID: 10996 relates to Category No.: 4029, 10056, 2942, 8935, 5570, 3693, 9247, 1792, 2890, 8951, 9305, 4755, 4008, 9162, 6743, 8949, 14293, 9730, 3040, 2535, 2502; Payload ID: 10997 relates to Category No.: 9305, 2890, 2942; Payload ID: 10998 relates to Category No.: 9305; Payload ID: 10999 relates to Category No.: 9305, 15505; Payload ID: 11000 relates to Category No.: 2890, 5727, 5730; Payload ID: 11001 relates to Category No.: 2890, 10056, 2942, 4765, 11650, 3054, 4010, 6440, 4769, 7366; Payload ID: 11002 relates to Category No.: 6717, 2942, 4765, 16057, 14707, 4010, 7366, 15280, 15169; Payload ID: 11003 relates to Category No.: 16057, 14707, 4010, 7366, 15169; Payload ID: 11004 relates to Category No.: 14707, 7118, 4010, 6440, 7366; Payload ID: 11005 relates to Category No.: 4029, 2890, 1090; Payload ID: 11006 relates to Category No.: 12159, 1842, 4029, 4755; Payload ID: 11007 relates to Category No.: 10056, 1090; Payload ID: 11008 relates to Category No.: 4029; Payload ID: 11009 relates to Category No.: 678, 10056; Payload ID: 11010 relates to Category No.: 678, 10056, 1017; Payload ID: 11011 relates to Category No.: 4030, 9305, 6717, 9247, 3652; Payload ID: 11012 relates to Category No.: 4029, 9305; Payload ID: 11013 relates to Category No.: 5561, 1811, 4860, 8948, 1017, 2890, 10056, 6717, 677, 4765, 4008, 4010, 1792; Payload ID: 11014 relates to Category No.: 5561, 10056, 1017; Payload ID: 11015 relates to Category No.: 4029, 2890, 9734, 9162; Payload ID: 11016 relates to Category No.: 2890, 4030, 6717, 3036, 9730; Payload ID: 11017 relates to Category No.: 2194, 10056, 9242, 2942, 14906, 9247, 2183, 2441, 9727, 2890, 778; Payload ID: 11018 relates to Category No.: 2890, 10056, 2942, 15892, 4755, 9734, 1720, 2402, 4010, 781, 6717, 6743, 6989; Payload ID: 11019 relates to Category No.: 5762, 10056, 2942, 9247, 4010; Payload ID: 11020 relates to Category No.: 9305, 2942, 4010; Payload ID: 11021 relates to Category No.: 9305, 2890, 4755, 1720, 14893, 6017, 4228, 14906; Payload ID: 11022 relates to Category No.: 5561; Payload ID: 11023 relates to Category No.: 9305; Payload ID: 11024 relates to Category No.: 10056, 9734, 1748, 11650, 11653, 9730, 3055, 775; Payload ID: 11025 relates to Category No.: 3521; Payload ID: 11026 relates to Category No.: 7349, 16110; Payload ID: 11028 relates to Category No.: 2183; Payload ID: 11029 relates to Category No.: 5561, 5762, 4030, 4029, 9305, 6717, 779, 2890, 5570, 4008, 15139, 10056, 1017, 3036, 8917, 1711, 1016; Payload ID: 11030 relates to Category No.: 4030, 5561, 4029, 5762, 10056; Payload ID: 11031 relates to Category No.: 4030, 4029, 5570, 5762, 5561; Payload ID: 11032 relates to Category No.: 4030, 5561, 4029, 5762, 10056; Payload ID: 11033 relates to Category No.: 5561, 8935, 15627, 2899, 8948, 4860; Payload ID: 11034 relates to Category No.: 5561, 15627, 10056, 8948, 2899; Payload ID: 11035 relates to Category No.: 5561, 11723, 10056, 5570, 3666, 1748, 8948, 9184, 1792, 16156, 1700, 11883, 3636, 1036; Payload ID: 11036 relates to Category No.: 5561, 1700, 11723, 11883; Payload ID: 11037 relates to Category No.: 5570, 1700, 11883, 5561; Payload ID: 11038 relates to Category No.: 4029; Payload ID: 11039 relates to Category No.: 4029; Payload ID: 11040 relates to Category No.: 4029; Payload ID: 11041 relates to Category No.: 4029, 1842; Payload ID: 11042 relates to Category No.: 4029, 5561; Payload ID: 11043 relates to Category No.: 5561; Payload ID: 11044 relates to Category No.: 4029; Payload ID: 11045 relates to Category No.: 4010; Payload ID: 11046 relates to Category No.: 10056, 677, 15139, 1748, 657; Payload ID: 11047 relates to Category No.: 10056, 677; Payload ID: 11048 relates to Category No.: 5762, 3652, 4049, 10056, 2942, 15573; Payload ID: 11049 relates to Category No.: 5762, 3652, 4049; Payload ID: 11050 relates to Category No.: 6717, 3666, 3652, 4049, 5762; Payload ID: 11051 relates to Category No.: 4030; Payload ID: 11052 relates to Category No.: 2890, 6717, 9242, 3673, 3666, 4755, 9184, 3485, 5762, 5561; Payload ID: 11054 relates to Category No.: 5561; Payload ID: 11055 relates to Category No.: 2890; Payload ID: 11058 relates to Category No.: 2890; Payload ID: 11062 relates to Category No.: 2890; Payload ID: 11063 relates to Category No.: 2890; Payload ID: 11064 relates to Category No.: 2890; Payload ID: 11066 relates to Category No.: 6717, 5762, 10056, 4765, 4755, 4010; Payload ID: 11067 relates to Category No.: 5762, 2942, 2497, 4010; Payload ID: 11068 relates to Category No.: 4029, 12159, 4763, 6437; Payload ID: 11069 relates to Category No.: 6717, 2942, 8948, 3036, 8935; Payload ID: 11070 relates to Category No.: 9305, 2942, 10056, 5762; Payload ID: 11071 relates to Category No.: 5561, 5762, 10056, 4010, 4228, 9087, 1029, 1017, 9577, 9574, 7366, 14387; Payload ID: 11072 relates to Category No.: 9305, 2890, 6717, 9242, 2942, 5824, 3036, 1017; Payload ID: 11073 relates to Category No.: 9305, 2890, 6717, 2938, 10056, 9242, 9734, 4049, 3521, 14329, 4201, 14327, 6017, 8935, 4199, 1711, 778, 2514, 2710, 447, 15139, 11883, 6743; Payload ID: 11074 relates to Category No.: 2890, 5727, 8902, 1017, 8901, 7118, 7366, 8951, 9305, 9730; Payload ID: 11075 relates to Category No.: 2890, 5727, 2942, 8902, 1017, 15757, 8935, 7366, 4860; Payload ID: 11076 relates to Category No.: 5727, 8902, 1017, 8901; Payload ID: 11077 relates to Category No.: 9305, 8948, 9730; Payload ID: 11078 relates to Category No.: 9305; Payload ID: 11079 relates to Category No.: 9305, 5762, 2890; Payload ID: 11080 relates to Category No.: 7118, 9730; Payload ID: 11081 relates to Category No.: 5762, 9305, 2890, 15139, 3036, 1017, 8948, 7061, 11650, 3057, 15578; Payload ID: 11082 relates to Category No.: 2890, 9242, 14671, 2420, 2192, 3036, 4199, 1017; Payload ID: 11083 relates to Category No.: 10056, 5570, 15139, 4755, 1748, 11650, 3036, 11653, 1792, 3055, 3972, 8951, 4202, 4008, 9079, 3054; Payload ID: 11084 relates to Category No.: 6717, 5570, 15139, 1748, 11653, 11723, 1792, 5441; Payload ID: 11085 relates to Category No.: 5570, 15139, 1748, 3636, 1792, 3972, 3036, 8948, 5441; Payload ID: 11086 relates to Category No.: 5561, 10056, 5570, 15139, 1748, 11650, 3036, 11653, 1792, 3972; Payload ID: 11087 relates to Category No.: 5570, 15139, 1748, 11650, 11653, 1792, 5561; Payload ID: 11088 relates to Category No.: 7052, 10056, 7118, 2942; Payload ID: 11089 relates to Category No.: 4029, 2942, 8935; Payload ID: 11090 relates to Category No.: 5561, 2890, 10056, 5570; Payload ID: 11091 relates to Category No.: 4029; Payload ID: 11092 relates to Category No.: 4029, 15280; Payload ID: 11093 relates to Category No.: 5561, 5762, 10056, 5570; Payload ID: 11094 relates to Category No.: 5561, 5762, 10056, 2942; Payload ID: 11095 relates to Category No.: 2890, 6960, 6968; Payload ID: 11096 relates to Category No.: 9247, 12159, 5749; Payload ID: 11097 relates to Category No.: 9192, 9305, 9162; Payload ID: 11098 relates to Category No.: 5561, 9305, 2890, 4765, 6075, 11653, 3693; Payload ID: 11099 relates to Category No.: 2890, 5776, 10056, 9734, 1748, 11650, 11653, 4010, 4760, 1017, 3036, 2942, 3065, 2926; Payload ID: 11100 relates to Category No.: 4029, 10056, 8935, 5570, 4008, 1029, 5561, 15139, 1017; Payload ID: 11101 relates to Category No.: 9305, 2890, 9247, 14253, 5762; Payload ID: 11102 relates to Category No.: 9305; Payload ID: 11103 relates to Category No.: 9305; Payload ID: 11104 relates to Category No.: 9305; Payload ID: 11105 relates to Category No.: 10056, 677, 8935, 8948, 1811, 4010, 1792; Payload ID: 11106 relates to Category No.: 6717, 2942, 4860; Payload ID: 11107 relates to Category No.: 9305; Payload ID: 11108 relates to Category No.: 9305, 15505, 2942, 9247, 2890; Payload ID: 11109 relates to Category No.: 2890, 9247, 9305; Payload ID: 11110 relates to Category No.: 9305, 15505; Payload ID: 11111 relates to Category No.: 15627; Payload ID: 11112 relates to Category No.: 4029, 1842; Payload ID: 11113 relates to Category No.: 5561; Payload ID: 11114 relates to Category No.: 2890, 9305; Payload ID: 11115 relates to Category No.: 5762; Payload ID: 11116 relates to Category No.: 5762; Payload ID: 11117 relates to Category No.: 2890; Payload ID: 11118 relates to Category No.: 4029, 5762, 4014, 12159; Payload ID: 11119 relates to Category No.: 9305, 5776, 9242; Payload ID: 11120 relates to Category No.: 9305; Payload ID: 11121 relates to Category No.: 4029; Payload ID: 11122 relates to Category No.: 5561, 10056, 5570; Payload ID: 11123 relates to Category No.: 5561, 10056, 5570, 273; Payload ID: 11124 relates to Category No.: 4030, 4029, 3036, 9730, 1033, 2942, 16156; Payload ID: 11125 relates to Category No.: 4029; Payload ID: 11126 relates to Category No.: 5561, 2890, 10056, 5570; Payload ID: 11127 relates to Category No.: 4029; Payload ID: 11128 relates to Category No.: 4029; Payload ID: 11129 relates to Category No.: 4030, 4029, 1700, 4755, 2890; Payload ID: 11130 relates to Category No.: 5561, 10056, 5570, 2942, 1017, 15151; Payload ID: 11131 relates to Category No.: 5561, 10056, 9098, 2942, 6717, 5762, 5570; Payload ID: 11132 relates to Category No.: 5561, 10056, 5570; Payload ID: 11133 relates to Category No.: 5561, 10056, 5570, 6717, 8935, 2890; Payload ID: 11134 relates to Category No.: 5561, 10056, 8935, 5570; Payload ID: 11135 relates to Category No.: 5561, 10056, 8935, 5570; Payload ID: 11136 relates to Category No.: 4029, 1748, 11650, 11653, 5926, 3972, 15139; Payload ID: 11137 relates to Category No.:

5926, 15139, 11650, 5561; Payload ID: 11138 relates to Category No.: 5561, 6717, 4030, 10056, 2942, 3521, 1017, 2926, 4228, 12406, 14431, 14797, 8902, 1792, 8948, 4860; Payload ID: 11139 relates to Category No.: 5561, 6717, 1017, 4029, 10056, 14431; Payload ID: 11140 relates to Category No.: 5561, 2942, 11723, 1792, 3036, 15147, 11650, 5441; Payload ID: 11141 relates to Category No.: 4029, 15627, 1033, 8948; Payload ID: 11142 relates to Category No.: 5561, 10056, 5570, 6743, 2890, 7118, 4755, 15139, 3036, 3666, 1792, 1017, 3055, 8948, 15280, 1033, 3054, 2918, 9730, 15133, 8945; Payload ID: 11143 relates to Category No.: 5561, 10056, 5570, 6717; Payload ID: 11144 relates to Category No.: 10056, 677, 8935, 8948, 1811, 1792; Payload ID: 11145 relates to Category No.: 6717, 10056, 5570, 3693, 3521, 6060, 6059, 3523, 11883, 12406, 2890, 1017, 3036, 1792, 8948, 2926; Payload ID: 11146 relates to Category No.: 5570, 3696, 12406, 6717, 2942, 10056, 5762, 11653, 3693, 8951, 15280, 2890, 3036, 11721, 1792, 1017, 3055, 8948, 1033, 4860, 14293, 11650, 9730, 3972; Payload ID: 11147 relates to Category No.: 6717, 5570, 12406, 5561, 2890; Payload ID: 11148 relates to Category No.: 4029, 2899; Payload ID: 11149 relates to Category No.: 4029, 3671; Payload ID: 11150 relates to Category No.: 4029, 5762, 1017; Payload ID: 11151 relates to Category No.: 5561, 6717, 3666; Payload ID: 11152 relates to Category No.: 2890, 2942, 3652, 4049, 5762; Payload ID: 11153 relates to Category No.: 2942, 4049, 7517, 9778, 2890; Payload ID: 11154 relates to Category No.: 2890, 9242, 2942, 7517, 9778, 262; Payload ID: 11155 relates to Category No.: 6717, 2942, 3696, 7517, 9778, 2890; Payload ID: 11156 relates to Category No.: 16326, 2938, 4228, 1822; Payload ID: 11157 relates to Category No.: 5561, 6717, 5762, 10056, 1792, 6743; Payload ID: 11158 relates to Category No.: 2890, 9247; Payload ID: 11160 relates to Category No.: 2890, 6717, 1842, 5762; Payload ID: 11161 relates to Category No.: 6717, 2890, 1842, 5762; Payload ID: 11162 relates to Category No.: 9305, 9242, 3666; Payload ID: 11163 relates to Category No.: 9305, 7118, 2890, 5776, 9242, 2942, 9247, 7060; Payload ID: 11164 relates to Category No.: 9305, 7118, 2890, 2942, 9247; Payload ID: 11165 relates to Category No.: 9305; Payload ID: 11166 relates to Category No.: 9305; Payload ID: 11167 relates to Category No.: 2890; Payload ID: 11169 relates to Category No.: 4010; Payload ID: 11171 relates to Category No.: 9305, 2942, 3666, 9734; Payload ID: 11172 relates to Category No.: 2890, 9247, 14665, 9158, 15269, 1291, 15252, 1288, 9242; Payload ID: 11175 relates to Category No.: 9305, 9242, 2942, 9247, 7256, 9158, 15269, 14614, 10104, 9175, 13728, 2420, 15269; Payload ID: 11176 relates to Category No.: 5561, 6717, 3673; Payload ID: 11177 relates to Category No.: 5561, 6717, 10056, 5570, 3666, 4755, 4010, 4228, 6709, 6440; Payload ID: 11178 relates to Category No.: 9305, 6960; Payload ID: 11179 relates to Category No.: 2942; Payload ID: 11180 relates to Category No.: 9305, 9247; Payload ID: 11181 relates to Category No.: 4765, 4755, 15139, 6059, 15573; Payload ID: 11182 relates to Category No.: 7118, 2942; Payload ID: 11183 relates to Category No.: 7048, 5561, 7118, 6717, 7085; Payload ID: 11184 relates to Category No.: 4030, 9305, 2942, 4010, 2890; Payload ID: 11186 relates to Category No.: 5762; Payload ID: 11187 relates to Category No.: 9305, 2890, 9247, 4755, 2942, 4010; Payload ID: 11188 relates to Category No.: 4029, 4014, 4010, 1090, 1772, 12159, 1083; Payload ID: 11189 relates to Category No.: 4029, 4014, 4010, 1090, 12159; Payload ID: 11190 relates to Category No.: 5561, 6717, 6443, 4029, 5570, 3666, 9734, 4010, 6060, 6440, 9162, 4755, 10056, 6743, 3693, 16156; Payload ID: 11191 relates to Category No.: 6443, 3666, 4010; Payload ID: 11192 relates to Category No.: 7118, 9305, 2890; Payload ID: 11193 relates to Category No.: 2890, 5561; Payload ID: 11195 relates to Category No.: 9305, 2890, 5762, 2194, 9727; Payload ID: 11196 relates to Category No.: 11989; Payload ID: 11197 relates to Category No.: 9242, 9247; Payload ID: 11198 relates to Category No.: 9305, 2890, 6960, 2194, 9242, 2942, 14906, 2630, 5964, 11883, 5597, 2632, 6994; Payload ID: 11199 relates to Category No.: 9305, 2890, 1017; Payload ID: 11200 relates to Category No.: 2890, 2458; Payload ID: 11202 relates to Category No.: 9305, 2890, 6976, 6960, 2942, 14906, 9215; Payload ID: 11203 relates to Category No.: 2890, 6976, 6960, 14906, 9247; Payload ID: 11204 relates to Category No.: 11728, 2890, 2938, 2458, 2445, 2443; Payload ID: 11205 relates to Category No.: 9305, 2942; Payload ID: 11206 relates to Category No.: 9305, 11715, 14670; Payload ID: 11207 relates to Category No.: 2194, 9242, 6960, 14906, 2183; Payload ID: 11208 relates to Category No.: 6976, 6960, 2942; Payload ID: 11209 relates to Category No.: 5561; Payload ID: 11210 relates to Category No.: 5561, 5570; Payload ID: 11211 relates to Category No.: 9305, 9242; Payload ID: 11212 relates to Category No.: 5561; Payload ID: 11213 relates to Category No.: 5561; Payload ID: 11214 relates to Category No.: 5561; Payload ID: 11215 relates to Category No.: 5561; Payload ID: 11216 relates to Category No.: 9305, 9247, 4010, 14674, 2402; Payload ID: 11217 relates to Category No.: 7118, 6717, 7048, 15147; Payload ID: 11218 relates to Category No.: 9305, 2942; Payload ID: 11220 relates to Category No.: 12439, 6717, 10056, 2942, 3521; Payload ID: 11221 relates to Category No.: 7118, 4050, 7048; Payload ID: 11222 relates to Category No.: 7118, 2890, 2938, 2942, 15139, 9734, 14363, 14368, 6743, 3055, 10000, 11883, 14331, 16326, 15758, 1659, 14371, 9305, 6717, 10056, 3036, 9184, 7070, 16164, 11650, 1050; Payload ID: 11223 relates to Category No.: 9305, 7118, 2942, 9734, 14363, 14371, 9184, 16326, 1659, 15758, 5834, 6365; Payload ID: 11224 relates to Category No.: 9305, 2890, 5762, 2942, 9756, 9734, 2712; Payload ID: 11225 relates to Category No.: 9305, 2890, 2938, 10056, 2942, 4765, 1659, 3638; Payload ID: 11226 relates to Category No.: 9305, 2890, 2942, 4765, 9247; Payload ID: 11227 relates to Category No.: 9305, 2938, 10056, 3638; Payload ID: 11228 relates to Category No.: 9305, 7118, 4010; Payload ID: 11229 relates to Category No.: 2890, 2194, 4010, 7118; Payload ID: 11230 relates to Category No.: 9305; Payload ID: 11231 relates to Category No.: 9305; Payload ID: 11232 relates to Category No.: 9305, 9247, 15505; Payload ID: 11233 relates to Category No.: 9247, 9305, 5762; Payload ID: 11234 relates to Category No.: 9305, 1842; Payload ID: 11235 relates to Category No.: 9305, 1842; Payload ID: 11236 relates to Category No.: 9305, 15505, 14253, 2890; Payload ID: 11237 relates to Category No.: 9305; Payload ID: 11238 relates to Category No.: 9305, 1842; Payload ID: 11239 relates to Category No.: 9305, 5762; Payload ID: 11240 relates to Category No.: 9305; Payload ID: 11241 relates to Category No.: 9305, 9247, 4010; Payload ID: 11242 relates to Category No.: 9305; Payload ID: 11243 relates to Category No.: 9305; Payload ID: 11244 relates to Category No.: 7070, 7118; Payload ID: 11245 relates to Category No.: 9305, 2890, 1099, 4010, 8935, 8948, 9730; Payload ID: 11246 relates to Category No.: 2890; Payload ID: 11247 relates to Category No.: 9305, 2890, 5762, 2942, 5853, 14902; Payload ID: 11248 relates to Category No.: 9305, 2890, 2942; Payload ID: 11249 relates to Category No.: 9305, 5762, 2942, 9072; Payload ID: 11250 relates to Category No.: 2890, 4053; Payload ID: 11252 relates to Category No.: 2890; Payload ID: 11255 relates to Category No.: 2890; Payload ID: 11256 relates to Category No.: 9305, 2890; Payload ID: 11257 relates to Category No.: 4029, 9305, 2890, 2942, 3666, 9073; Payload ID: 11258 relates to Category No.: 2942, 4010; Payload ID: 11259 relates to Category No.: 7118, 9242, 2890, 2942, 11883, 1720, 774; Payload ID: 11260 relates to Category No.: 2890, 10056, 9184; Payload ID: 11262 relates to Category No.: 2890, 1842; Payload ID: 11263 relates to Category No.: 2890; Payload ID: 11264 relates to Category No.: 9305, 2890, 6717, 9242, 9247; Payload ID: 11265 relates to Category No.: 9247, 9305, 2890, 6717, 8935, 15139, 1748, 11650, 3036, 11653, 9730, 9184, 9162, 9181, 775, 2712, 9167; Payload ID: 11266 relates to Category No.: 5762, 1842, 14826; Payload ID: 11267 relates to Category No.: 5762, 2194, 2441; Payload ID: 11268 relates to Category No.: 5762, 9474, 14833, 14820; Payload ID: 11269 relates to Category No.: 2890, 5762, 2938; Payload ID: 11270 relates to Category No.: 9305, 2890, 6717, 5762, 2942, 4010, 14329, 7118, 7366, 5727, 2194, 7070, 9734; Payload ID: 11271 relates to Category No.: 5727, 9734, 7061; Payload ID: 11272 relates to Category No.: 5762, 2942, 4010, 7118; Payload ID: 11273 relates to Category No.: 7118, 5762, 7048, 2942, 7060, 7052; Payload ID: 11274 relates to Category No.: 5762, 7118; Payload ID: 11275 relates to Category No.: 9305, 2890, 5762, 2942, 6017, 4010, 1772, 14327; Payload ID: 11276 relates to Category No.: 5561, 9247, 7068; Payload ID: 11277 relates to Category No.: 9305, 2890, 9734; Payload ID: 11278 relates to Category No.: 2890, 9247; Payload ID: 11279 relates to Category No.: 9305, 2890, 6960, 2194, 10056, 2942, 9734, 6968, 1803, 12440, 4010, 7366; Payload ID: 11280 relates to Category No.: 2890, 10056, 2942, 273, 1748, 4049; Payload ID: 11281 relates to Category No.: 2890, 10056, 2942, 4755, 4049; Payload ID: 11282 relates to Category No.: 9305, 2890; Payload ID: 11283 relates to Category No.: 9305, 9242, 9247; Payload ID: 11284 relates to Category No.: 9305, 9242, 9215; Payload ID: 11285 relates to Category No.: 9305, 2890, 9247, 9734, 2903; Payload ID: 11286 relates to Category No.: 4030, 4029; Payload ID: 11287 relates to Category No.: 5561, 6717; Payload ID: 11288 relates to Category No.: 5561, 3673; Payload ID: 11289 relates to Category No.: 5561, 1842; Payload ID: 11290 relates to Category No.: 4030, 4029; Payload ID: 11291 relates to Category No.: 5561, 10056, 3521; Payload ID: 11292 relates to Category No.: 5561, 10056, 3521; Payload ID: 11293 relates to Category No.: 5570, 14384, 9577; Payload ID: 11294 relates to Category No.: 9305, 9247, 9095; Payload ID: 11295 relates to Category No.: 9305, 6717, 9242, 9247, 9215, 9181, 14253, 9578; Payload ID: 11296 relates to Category No.: 9305, 2890, 6717, 2942, 9247, 9158, 2635, 9159, 2628, 2628, 2192, 2636; Payload ID: 11297 relates to Category No.: 9305, 2890, 6717, 2194, 2942, 273, 2635, 2628; Payload ID: 11298 relates to Category No.: 9305, 2890, 6717, 2942, 2635; Payload ID: 11299 relates to Category No.: 9159, 6717, 9247, 2628, 2192, 9194, 2628, 4462; Payload ID: 11300 relates to Category No.: 9305, 6717, 9247; Payload ID: 11301 relates to Category No.: 6717, 9247, 2420; Payload ID: 11302 relates to Category No.: 2890, 4010; Payload ID: 11303 relates to Category No.: 14665, 1291, 15252, 1288, 1287; Payload ID: 11304 relates to Category No.: 9305, 7118, 6717, 9242, 14671, 192, 9082; Payload ID: 11305 relates to Category No.: 9305, 5776, 9242; Payload ID: 11306 relates to Category No.: 9242; Payload ID: 11307 relates to Category No.: 7055; Payload ID: 11308 relates to Category No.: 7055, 7118; Payload ID: 11309 relates to Category No.: 9305, 9242; Payload ID: 11312 relates to Category No.: 9305, 2890, 9242, 9247, 14893, 2417; Payload ID: 11313 relates to Category No.: 2890, 6717, 9242, 14671, 9247, 14665, 1286, 11718; Payload ID: 11314 relates to Category No.: 9305, 2890, 6717, 9242, 14671, 14665, 1286, 11718, 1377; Payload ID: 11315 relates to Category No.: 1842; Payload ID: 11316 relates to Category No.: 4030, 4014, 1792; Payload ID: 11317 relates to Category No.: 5561, 4029, 9305, 6717, 10056, 2942, 4765, 3673, 9247, 447, 779, 12406, 6551, 2890, 1792, 2926, 3666, 1772, 4755, 262; Payload ID: 11318 relates to Category No.: 5561, 4029, 9305, 6717, 10056, 4765, 3673, 5570, 9247, 1792, 12406, 2458; Payload ID: 11319 relates to Category No.: 4029, 2890; Payload ID: 11320 relates to Category No.: 5561, 4029, 2890, 6717, 10056, 2942, 4765, 3673, 9247, 273, 12406, 9305; Payload ID: 11321 relates to Category No.: 5561, 4029, 9305, 6717, 10056, 2942, 4765, 3673, 5570, 9247, 1792; Payload ID: 11322 relates to Category No.: 9305, 9242; Payload ID: 11324 relates to Category No.: 9305; Payload ID: 11325 relates to Category No.: 4029; Payload ID: 11326 relates to Category No.: 5561, 6717, 10056, 2927, 779, 1336; Payload ID: 11328 relates to Category No.: 9305, 2942, 3666, 9247, 16111, 9193, 15961; Payload ID: 11329 relates to Category No.: 5363; Payload ID: 11330 relates to Category No.: 1842, 5363; Payload ID: 11331 relates to Category No.: 1842; Payload ID: 11332 relates to Category No.: 9305, 9242, 14145; Payload ID: 11333 relates to Category No.: 9305, 2890, 5776, 9247, 2420, 15269, 14675; Payload ID: 11334 relates to Category No.: 14675, 9305, 9247, 2420, 15269, 10104; Payload ID: 11335 relates to Category No.: 9247, 2420, 15269, 14675; Payload ID: 11336 relates to Category No.: 9305, 2890, 10056, 2942, 9247, 2420, 5730, 4769, 16112; Payload ID: 11337 relates to Category No.: 9305, 2942, 7015; Payload ID: 11338 relates to Category No.: 4010, 6437; Payload ID: 11339 relates to Category No.: 2890; Payload ID: 11340 relates to Category No.: 2890, 9305; Payload ID: 11341 relates to Category No.: 9305, 2890, 9247; Payload ID: 11342 relates to Category No.: 2890; Payload ID: 11343 relates to Category No.: 9305, 2890, 3673, 4758, 3666; Payload ID: 11344 relates to Category No.: 9305, 2890, 9247; Payload ID: 11345 relates to Category No.: 9305, 7118, 9247; Payload ID: 11346 relates to Category No.: 5561; Payload ID: 11347 relates to Category No.: 9305, 2890, 9242, 9291, 6968; Payload ID: 11348 relates to Category No.: 2890, 9291; Payload ID: 11349 relates to Category No.: 9305, 7118, 10056, 9247; Payload ID: 11350 relates to Category No.: 9305, 2890, 14665; Payload ID: 11351 relates to Category No.: 9247, 9305, 2890, 9157, 11883; Payload ID: 11352 relates to Category No.: 9305, 7118, 2890, 2942, 14145, 9247, 7269, 9156; Payload ID: 11353 relates to Category No.: 9247, 9156, 9305, 2890, 2942, 7269; Payload ID: 11354 relates to Category No.: 9156; Payload ID: 11356 relates to Category No.: 9305, 2890; Payload ID: 11357 relates to Category No.: 5561, 9176, 9162; Payload ID: 11358 relates to Category No.: 5561, 9176; Payload ID: 11359 relates to Category No.: 9305; Payload ID: 11360 relates to Category No.: 9305, 5762, 9247, 1748; Payload ID: 11361 relates to Category No.: 9305, 5762, 9242, 9247, 2227; Payload ID: 11362 relates to Category No.: 9305, 5762, 9242, 9247; Payload ID: 11363 relates to Category No.: 9305, 5762, 9247; Payload ID: 11364 relates to Category No.: 9305, 2890, 5561; Payload ID: 11365 relates to Category No.: 9305, 2890, 2942, 9247, 9157; Payload ID: 11366 relates to Category No.: 9305, 2890, 10056, 2942, 9247, 273, 15505, 14145, 9220; Payload ID: 11367 relates to Category No.: 9305, 2890; Payload ID: 11368 relates to Category No.: 9305, 2890, 9242, 9247, 2942; Payload ID: 11369 relates to Category No.: 9305, 2890, 5730, 2942, 15505; Payload ID: 11370 relates to Category No.: 9305, 7118, 2890, 2942, 9247, 5360, 11883, 8935; Payload ID: 11371 relates to Category No.: 2942, 9305, 2890, 9247, 1109; Payload ID: 11372 relates to Category No.: 9305, 2890, 10056, 2942, 5360, 11883; Payload ID: 11373 relates to Category No.: 9305, 2942, 2890; Payload ID: 11374 relates to Category No.: 9305; Payload ID: 11375 relates to Category No.: 2890, 2942, 4755, 9734; Payload ID: 11376 relates to Category No.: 9305; Payload ID: 11377 relates to Category No.: 9305, 9247, 5730; Payload ID: 11378 relates to Category No.: 9305, 9247, 5466; Payload ID: 11379 relates to Category No.: 9305, 2890, 9247, 273, 10104; Payload ID: 11380 relates to Category No.: 5561, 9305, 2890, 3673; Payload ID: 11381 relates to Category No.: 9305, 2890, 2194, 10056, 2942, 9247, 12170, 2402; Payload ID: 11382 relates to Category No.: 9305, 2890; Payload ID: 11383 relates to Category No.: 9305; Payload ID: 11384 relates to Category No.: 9305, 9242, 9247, 11721, 11883, 2949, 15497, 9181, 11718, 9728; Payload ID: 11385 relates to Category No.: 9305, 2890, 6717, 10161; Payload ID: 11386 relates to Category No.: 9305; Payload ID: 11387 relates to Category No.: 4765, 9305, 2890, 2942, 14906, 9247, 1720, 2420, 14902, 14893, 4010, 9181, 7170, 778, 3036, 8948; Payload ID: 11388 relates to Category No.: 9247, 9176, 4010; Payload ID: 11389 relates to Category No.: 9199, 9184, 5561; Payload ID: 11395 relates to Category No.: 5561; Payload ID: 11396 relates to Category No.: 4029; Payload ID: 11397 relates to Category No.: 5561, 1842; Payload ID: 11398 relates to Category No.: 5561; Payload ID: 11399 relates to Category No.: 5561; Payload ID: 11401 relates to Category No.: 4029; Payload ID: 11404 relates to Category No.: 9305, 9242, 6023, 9178, 9180; Payload ID: 11405 relates to Category No.: 2942, 2440; Payload ID: 11406 relates to Category No.: 9305, 2890, 9247, 4438, 1377; Payload ID: 11407 relates to Category No.: 9305, 2890; Payload ID: 11409 relates to Category No.: 9247, 4010; Payload ID: 11410 relates to Category No.: 2890, 9247, 2899, 997, 9849; Payload ID: 11411 relates to Category No.: 6717, 9247, 3652, 1720, 6017, 9734; Payload ID: 11412 relates to Category No.: 6717, 9247; Payload ID: 11413 relates to Category No.: 9305, 9242, 9247, 2420; Payload ID: 11414 relates to Category No.: 9305, 9247, 9157, 2890, 8935; Payload ID: 11415 relates to Category No.: 9305, 9247, 2890, 4755, 3036, 11721, 6960, 3055, 8948, 14293, 11650; Payload ID: 11416 relates to Category No.: 9305, 2890, 9247, 9157, 4010, 14253; Payload ID: 11417 relates to Category No.: 9305; Payload ID: 11418 relates to Category No.: 4030, 9305, 9247, 273; Payload ID: 11419 relates to Category No.: 9305, 15505, 5776, 9247, 5216, 11883; Payload ID: 11420 relates to Category No.: 9305, 5762; Payload ID: 11421 relates to Category No.: 9305, 6717, 9247, 9157, 14902, 15531, 5110, 14583, 2890, 15505, 9734; Payload ID: 11422 relates to Category No.: 9247, 5110, 9305, 2402, 6717, 15531, 9155, 9181; Payload ID: 11423 relates to Category No.: 9305, 9242, 9247, 1748, 9157, 9215, 5110; Payload ID: 11424 relates to Category No.: 9305, 2890; Payload ID: 11426 relates to Category No.: 9305, 2890, 6717, 9247, 10161; Payload ID: 11427 relates to Category No.: 9305, 2890, 9247, 11883; Payload ID: 11428 relates to Category No.: 9305, 2890, 9247, 3036, 9157, 3055; Payload ID: 11429 relates to Category No.: 9305, 9247; Payload ID: 11430 relates to Category No.: 9305, 2890, 9247; Payload ID: 11431 relates to Category No.: 9305, 9247, 9157, 12406, 14253, 2890; Payload ID: 11432 relates to Category No.: 9305, 9247, 9167; Payload ID: 11433 relates to Category No.: 9305, 9247; Payload ID: 11434 relates to Category No.: 9305, 2890, 2938, 9247, 2942; Payload ID: 11435 relates to Category No.: 9305, 9247, 10104; Payload ID: 11436 relates to Category No.: 9305, 9247; Payload ID: 11437 relates to Category No.: 9305, 9247; Payload ID: 11438 relates to Category No.: 9305, 9247, 15505; Payload ID: 11439 relates to Category No.: 9305, 9247; Payload ID: 11440 relates to Category No.: 9305; Payload ID: 11441 relates to Category No.: 9305, 9247; Payload ID: 11442 relates to Category No.: 9305, 2890, 9247, 7060, 2942, 6717, 5762; Payload ID: 11443 relates to Category No.: 9305, 3673, 9247, 12406; Payload ID: 11444 relates to Category No.: 9305, 2890, 9247, 9184, 15505; Payload ID: 11445 relates to Category No.: 9305, 2890, 9247; Payload ID: 11446 relates to Category No.: 9305, 9247, 15505, 6617; Payload ID: 11447 relates to Category No.: 9305, 9247, 14253; Payload ID: 11448 relates to Category No.: 9305, 2890, 9247, 14253; Payload ID: 11449 relates to Category No.: 9305, 15505, 9247; Payload ID: 11450 relates to Category No.: 9305, 9247, 4010, 2890; Payload ID: 11451 relates to Category No.: 9305, 2890, 2942, 9247, 9215, 15501, 5762; Payload ID: 11452 relates to Category No.: 9305, 2890, 5762, 9212; Payload ID: 11453 relates to Category No.: 9305, 2890, 5762, 9212; Payload ID: 11454 relates to Category No.: 9305, 2890, 5762, 9247, 9212; Payload ID: 11455 relates to Category No.: 9305, 2890; Payload ID: 11456 relates to Category No.: 9305, 14145, 9215; Payload ID: 11457 relates to Category No.: 9305, 9247, 1668, 12170; Payload ID: 11458 relates to Category No.: 9305, 9247, 1668, 12170; Payload ID: 11459 relates to Category No.: 9305, 9247, 1668, 12170; Payload ID: 11460 relates to Category No.: 9305, 2890, 10056, 9247; Payload ID: 11461 relates to Category No.: 5561, 9305, 6717; Payload ID: 11462 relates to Category No.: 5762, 2942, 9199, 4010, 9192, 9200; Payload ID: 11463 relates to Category No.: 2890, 5762, 9215, 9199; Payload ID: 11464 relates to Category No.: 9305, 2890, 5762; Payload ID: 11465 relates to Category No.: 9305, 7118, 2890, 6717, 10056, 9242, 9247, 15252; Payload ID: 11466 relates to Category No.: 9305, 2890, 9247, 14798; Payload ID: 11467 relates to Category No.: 2890, 9247, 9305, 14798; Payload ID: 11468 relates to Category No.: 4030, 6717, 4755, 6968, 4010, 3685, 9305, 2890, 4029, 2477, 3521, 15573, 4760, 14293, 4786, 4047, 6370; Payload ID: 11469 relates to Category No.: 2890, 9305, 3666, 9192, 4030, 4764; Payload ID: 11470 relates to Category No.: 2890, 9242, 9247, 1377; Payload ID: 11471 relates to Category No.: 9305, 2890, 9242, 2420, 14902, 7161, 6960, 14893; Payload ID: 11472 relates to Category No.: 5561, 9305, 9242, 14671, 9184, 9082; Payload ID: 11473 relates to Category No.: 9305, 9242; Payload ID: 11474 relates to Category No.: 9305, 9242, 15783; Payload ID: 11475 relates to Category No.: 9242; Payload ID: 11476 relates to Category No.: 7118, 2890, 9242, 2942, 14368, 14367; Payload ID: 11477 relates to Category No.: 9305, 9242; Payload ID: 11478 relates to Category No.: 2890, 9247; Payload ID: 11479 relates to Category No.: 9305, 7118, 9242, 14671, 2798, 16048, 2632; Payload ID: 11480 relates to Category No.: 9305, 7118, 9242; Payload ID: 11481 relates to Category No.: 9305, 2890, 9242; Payload ID: 11482 relates to Category No.: 9305, 6717, 9242; Payload ID: 11483 relates to Category No.: 9305, 2890, 9242, 9247, 2632; Payload ID: 11484 relates to Category No.: 9305, 9242; Payload ID: 11485 relates to Category No.: 9305, 6717, 9242, 14145, 9247, 1720, 4010, 2907, 2890, 1792, 3069, 4175; Payload ID:

11486 relates to Category No.: 9305, 2890, 6717, 2194, 9242, 2942, 14145, 9247, 14908, 4228; Payload ID: 11487 relates to Category No.: 9305, 9157, 2894; Payload ID: 11488 relates to Category No.: 9242; Payload ID: 11489 relates to Category No.: 6717, 2194, 2942, 9247, 2630, 9199, 9184, 5964, 9162, 9195, 9206; Payload ID: 11490 relates to Category No.: 6717, 2942, 2630, 9199, 9184, 2631, 9162, 9206; Payload ID: 11491 relates to Category No.: 2890, 9242, 9247, 9199, 9184, 9195, 9175, 9204, 11883, 715; Payload ID: 11492 relates to Category No.: 6717, 9199, 9184, 9162; Payload ID: 11493 relates to Category No.: 2942, 9199, 5964, 9162, 9206; Payload ID: 11494 relates to Category No.: 6717, 9199, 9162; Payload ID: 11495 relates to Category No.: 2890, 6717, 9247, 9199, 9184, 9162, 9195; Payload ID: 11496 relates to Category No.: 5561, 6717, 3673, 9199, 9184, 9162; Payload ID: 11497 relates to Category No.: 5561; Payload ID: 11498 relates to Category No.: 9305, 5776, 2942, 9247, 9199, 4228, 9162; Payload ID: 11499 relates to Category No.: 5776, 10056, 9247, 9199, 5730, 9184, 9162, 9178; Payload ID: 11500 relates to Category No.: 9305, 2942, 9247, 2630, 5964, 9162, 9206; Payload ID: 11501 relates to Category No.: 2942, 2630, 5964, 9162, 9206; Payload ID: 11502 relates to Category No.: 2890, 9247, 9199, 9184, 5561; Payload ID: 11503 relates to Category No.: 2890, 9247, 9199, 9184, 9162, 11883; Payload ID: 11504 relates to Category No.: 9199, 9184, 9162, 11883; Payload ID: 11505 relates to Category No.: 2890, 5776, 14906, 14145, 9199, 9184, 9162, 4216, 10169, 9237, 11883, 715; Payload ID: 11506 relates to Category No.: 9199; Payload ID: 11507 relates to Category No.: 6717, 2942, 2630, 14893, 9184, 5964, 9162, 9206, 9305; Payload ID: 11508 relates to Category No.: 2942, 9247, 9199; Payload ID: 11509 relates to Category No.: 6717, 9199, 9184, 9162, 9195, 5762; Payload ID: 11510 relates to Category No.: 2942, 9247, 9199, 9184, 5964, 9162, 9195, 9175, 9204, 9206; Payload ID: 11511 relates to Category No.: 9305, 2890, 2942, 9247, 9199, 9184, 10002; Payload ID: 11512 relates to Category No.: 9305, 2942; Payload ID: 11513 relates to Category No.: 9192, 7118; Payload ID: 11515 relates to Category No.: 6717, 4010; Payload ID: 11516 relates to Category No.: 9305, 6717, 6709; Payload ID: 11517 relates to Category No.: 9305; Payload ID: 11518 relates to Category No.: 9305; Payload ID: 11519 relates to Category No.: 9305, 2890; Payload ID: 11520 relates to Category No.: 9305; Payload ID: 11521 relates to Category No.: 9305; Payload ID: 11522 relates to Category No.: 2890, 10056, 2942, 4010; Payload ID: 11523 relates to Category No.: 9305, 2890, 14908; Payload ID: 11524 relates to Category No.: 7118; Payload ID: 11525 relates to Category No.: 2890, 2942, 1099, 779; Payload ID: 11526 relates to Category No.: 2890, 2938, 10056, 2942, 1099, 2660, 1792, 11883, 16156; Payload ID: 11527 relates to Category No.: 9305, 2890, 5776, 9247, 1748, 9155; Payload ID: 11528 relates to Category No.: 9305, 2890, 9247; Payload ID: 11529 relates to Category No.: 2890, 5762, 6976, 14906, 2630, 6968, 4010; Payload ID: 11531 relates to Category No.: 5561, 2890, 6960, 2942, 9247; Payload ID: 11532 relates to Category No.: 6717, 6960, 2194, 2942, 5961, 2630, 14908, 5964, 2514; Payload ID: 11533 relates to Category No.: 2890, 2194, 9242, 5961, 6960, 2942, 2630, 14893, 5964, 1017, 1750, 15151, 6976, 6964, 1028, 8904, 9162, 1711; Payload ID: 11534 relates to Category No.: 9305, 7118, 2890, 2942, 7060, 4010; Payload ID: 11535 relates to Category No.: 2942; Payload ID: 11536 relates to Category No.: 5762, 2942; Payload ID: 11537 relates to Category No.: 9305, 9756; Payload ID: 11538 relates to Category No.: 7118; Payload ID: 11539 relates to Category No.: 2890, 4010; Payload ID: 11540 relates to Category No.: 2942; Payload ID: 11541 relates to Category No.: 9305, 2890, 9242, 9247; Payload ID: 11542 relates to Category No.: 2890; Payload ID: 11544 relates to Category No.: 2942; Payload ID: 11545 relates to Category No.: 7118, 9756, 1842; Payload ID: 11546 relates to Category No.: 7060, 7118; Payload ID: 11547 relates to Category No.: 9305, 2194, 9247, 7275, 9578; Payload ID: 11548 relates to Category No.: 9247; Payload ID: 11549 relates to Category No.: 2942, 4010; Payload ID: 11550 relates to Category No.: 5762, 2942; Payload ID: 11551 relates to Category No.: 9305, 5762, 2942, 4010; Payload ID: 11552 relates to Category No.: 9305, 7118, 1842; Payload ID: 11553 relates to Category No.: 9756; Payload ID: 11554 relates to Category No.: 7118; Payload ID: 11555 relates to Category No.: 5762, 7060, 4010; Payload ID: 11556 relates to Category No.: 2420, 2192, 9305, 6717, 2942, 2630, 7547; Payload ID: 11557 relates to Category No.: 10056, 5570, 4228, 2504, 2890, 9305, 1099, 2899, 3521, 778, 4053; Payload ID: 11558 relates to Category No.: 2890; Payload ID: 11559 relates to Category No.: 5561, 9305, 6717, 9247, 9176, 9162; Payload ID: 11560 relates to Category No.: 5561, 3673, 6717; Payload ID: 11567 relates to Category No.: 9305, 2890; Payload ID: 11568 relates to Category No.: 5762, 12159; Payload ID: 11569 relates to Category No.: 5561, 1842; Payload ID: 11570 relates to Category No.: 9305, 6717, 9247; Payload ID: 11572 relates to Category No.: 2890, 6717, 2194, 9242, 4010; Payload ID: 11573 relates to Category No.: 2942, 6449, 16326, 7389, 14364; Payload ID: 11574 relates to Category No.: 2890, 2194, 4755, 9734, 6449, 16326, 5596, 117; Payload ID: 11575 relates to Category No.: 5561, 6717, 10056, 1182, 1748, 1811, 2926, 3636, 779, 781, 2942; Payload ID: 11576 relates to Category No.: 5561; Payload ID: 11577 relates to Category No.: 6717, 3693, 7118; Payload ID: 11578 relates to Category No.: 3693, 7048, 7118; Payload ID: 11579 relates to Category No.: 9305, 2890, 10056, 2942, 15573, 3521, 2534, 4010, 9776, 10002, 3523, 2504, 4786, 4769; Payload ID: 11580 relates to Category No.: 5561, 2890, 3673, 3696, 6440, 6712; Payload ID: 11582 relates to Category No.: 9305; Payload ID: 11583 relates to Category No.: 9305; Payload ID: 11584 relates to Category No.: 4030, 4029, 9305, 2890, 4173, 1772; Payload ID: 11585 relates to Category No.: 4029, 1842; Payload ID: 11586 relates to Category No.: 4029, 1842; Payload ID: 11587 relates to Category No.: 4029, 1842; Payload ID: 11589 relates to Category No.: 4030, 1700, 3666, 1748, 8948, 1017, 9730, 1036, 15147, 657; Payload ID: 11590 relates to Category No.: 4029, 9305, 2890, 1748, 657, 15147; Payload ID: 11591 relates to Category No.: 15139, 1748, 4755, 4030, 657; Payload ID: 11592 relates to Category No.: 4030, 7118, 10056, 9734, 4010, 14802; Payload ID: 11593 relates to Category No.: 4029; Payload ID: 11594 relates to Category No.: 12159; Payload ID: 11595 relates to Category No.: 4029, 12159; Payload ID: 11596 relates to Category No.: 4032; Payload ID: 11597 relates to Category No.: 9305, 2942, 8948, 1017, 2890; Payload ID: 11598 relates to Category No.: 5561, 10056; Payload ID: 11599 relates to Category No.: 5561, 5570; Payload ID: 11600 relates to Category No.: 5561, 10056; Payload ID: 11601 relates to Category No.: 5561, 10056; Payload ID: 11602 relates to Category No.: 5561, 10056; Payload ID: 11603 relates to Category No.: 5561, 10056; Payload ID: 11604 relates to Category No.: 5561, 10056, 5570; Payload ID: 11605 relates to Category No.: 5561, 10056; Payload ID: 11606 relates to Category No.: 5561, 10056, 5570; Payload ID: 11607 relates to Category No.: 5561, 10056, 5570; Payload ID: 11608 relates to Category No.: 5561, 10056, 5570; Payload ID: 11609 relates to Category No.: 5561, 10056, 5570; Payload ID: 11610 relates to Category No.: 5561, 10056, 5570; Payload ID: 11611 relates to Category No.: 5561, 10056; Payload ID: 11612 relates to Category No.: 5561, 10056; Payload ID: 11613 relates to Category No.: 5561, 10056; Payload ID: 11614 relates to Category No.: 5561, 10056; Payload ID: 11615 relates to Category No.: 5561, 5762, 10056, 5570; Payload ID: 11616 relates to Category No.: 5561, 10056; Payload ID: 11617 relates to Category No.: 5561, 10056; Payload ID: 11618 relates to Category No.: 5561, 10056, 5570; Payload ID: 11619 relates to Category No.: 5561, 10056; Payload ID: 11620 relates to Category No.: 5561, 10056; Payload ID: 11621 relates to Category No.: 5561, 10056; Payload ID: 11622 relates to Category No.: 5561, 10056; Payload ID: 11623 relates to Category No.: 5561, 10056; Payload ID: 11624 relates to Category No.: 5561, 10056; Payload ID: 11625 relates to Category No.: 5561, 10056; Payload ID: 11626 relates to Category No.: 5561, 10056; Payload ID: 11627 relates to Category No.: 5561, 10056; Payload ID: 11628 relates to Category No.: 5561, 10056; Payload ID: 11629 relates to Category No.: 5561, 10056; Payload ID: 11630 relates to Category No.: 5561, 10056; Payload ID: 11631 relates to Category No.: 5561, 10056; Payload ID: 11632 relates to Category No.: 5561, 10056; Payload ID: 11633 relates to Category No.: 5561, 10056; Payload ID: 11634 relates to Category No.: 5561, 10056; Payload ID: 11635 relates to Category No.: 5561, 10056; Payload ID: 11636 relates to Category No.: 5561, 10056; Payload ID: 11637 relates to Category No.: 5561, 10056; Payload ID: 11638 relates to Category No.: 5561, 10056; Payload ID: 11639 relates to Category No.: 5561, 10056; Payload ID: 11640 relates to Category No.: 5561, 10056; Payload ID: 11641 relates to Category No.: 5561, 10056; Payload ID: 11642 relates to Category No.: 5561, 10056; Payload ID: 11644 relates to Category No.: 5561, 10056; Payload ID: 11645 relates to Category No.: 5561, 10056; Payload ID: 11646 relates to Category No.: 5561; Payload ID: 11647 relates to Category No.: 5561, 10056; Payload ID: 11648 relates to Category No.: 5561, 10056; Payload ID: 11649 relates to Category No.: 5561, 10056; Payload ID: 11650 relates to Category No.: 5561, 10056; Payload ID: 11651 relates to Category No.: 5561, 10056; Payload ID: 11652 relates to Category No.: 5561, 10056; Payload ID: 11653 relates to Category No.: 5561, 10056; Payload ID: 11654 relates to Category No.: 5561, 10056; Payload ID: 11655 relates to Category No.: 5561, 10056; Payload ID: 11656 relates to Category No.: 5561, 10056; Payload ID: 11657 relates to Category No.: 5561, 10056; Payload ID: 11658 relates to Category No.: 5561, 10056; Payload ID: 11659 relates to Category No.: 5561, 10056; Payload ID: 11660 relates to Category No.: 5561, 10056, 5570; Payload ID: 11661 relates to Category No.: 5561, 10056; Payload ID: 11663 relates to Category No.: 5561, 10056; Payload ID: 11664 relates to Category No.: 5561, 10056; Payload ID: 11665 relates to Category No.: 5561, 10056; Payload ID: 11666 relates to Category No.: 5561, 10056; Payload ID: 11667 relates to Category No.: 5561, 10056, 5570; Payload ID: 11668 relates to Category No.: 5561, 10056; Payload ID: 11669 relates to Category No.: 5561, 10056; Payload ID: 11670 relates to Category No.: 5561, 10056; Payload ID: 11671 relates to Category No.: 5561, 10056, 5570; Payload ID: 11672 relates to Category No.: 5561, 10056, 5570; Payload ID: 11673 relates to Category No.: 5561, 5570; Payload ID: 11674 relates to Category No.: 5561, 10056; Payload ID: 11675 relates to Category No.: 5561, 10056, 5570; Payload ID: 11676 relates to Category No.: 5561, 10056, 5570; Payload ID: 11677 relates to Category No.: 5561, 10056, 5570; Payload ID: 11678 relates to Category No.: 5561, 5570; Payload ID: 11679 relates to Category No.: 5561, 10056, 5570; Payload ID: 11680 relates to Category No.: 5561, 10056; Payload ID: 11681 relates to Category No.: 5561, 10056, 5570; Payload ID: 11683 relates to Category No.: 5561, 10056, 5570, 4010; Payload ID: 11685 relates to Category No.: 5561, 10056; Payload ID: 11686 relates to Category No.: 5561, 10056; Payload ID: 11687 relates to Category No.: 5561, 10056, 5570; Payload ID: 11688 relates to Category No.: 5561, 10056; Payload ID: 11689 relates to Category No.: 5561, 10056; Payload ID: 11690 relates to Category No.: 5561, 10056; Payload ID: 11691 relates to Category No.: 5561, 10056; Payload ID: 11693 relates to Category No.: 5561, 10056; Payload ID: 11694 relates to Category No.: 5561, 10056; Payload ID: 11695 relates to Category No.: 5561, 10056; Payload ID: 11696 relates to Category No.: 5561, 10056, 5570; Payload ID: 11697 relates to Category No.: 5561, 10056; Payload ID: 11698 relates to Category No.: 5561, 10056; Payload ID: 11699 relates to Category No.: 5561, 10056; Payload ID: 11700 relates to Category No.: 5561, 10056, 5570; Payload ID: 11701 relates to Category No.: 5561, 10056, 5570; Payload ID: 11702 relates to Category No.: 5561, 10056, 5570; Payload ID: 11703 relates to Category No.: 5561, 10056, 5570; Payload ID: 11704 relates to Category No.: 5561, 10056, 5570; Payload ID: 11705 relates to Category No.: 5561, 10056, 5570; Payload ID: 11706 relates to Category No.: 5561, 10056; Payload ID: 11707 relates to Category No.: 5561, 10056; Payload ID: 11708 relates to Category No.: 5561, 10056; Payload ID: 11709 relates to Category No.: 5561, 10056; Payload ID: 11710 relates to Category No.: 5561, 10056; Payload ID: 11711 relates to Category No.: 5561, 12439, 10056, 2514, 7170, 7166, 4216; Payload ID: 11712 relates to Category No.: 5561, 10056; Payload ID: 11713 relates to Category No.: 5561, 10056; Payload ID: 11714 relates to Category No.: 5561, 10056; Payload ID: 11715 relates to Category No.: 5561, 10056; Payload ID: 11716 relates to Category No.: 5561, 10056; Payload ID: 11717 relates to Category No.: 5561, 10056; Payload ID: 11718 relates to Category No.: 5561, 10056; Payload ID: 11719 relates to Category No.: 5561, 10056; Payload ID: 11720 relates to Category No.: 5561, 10056; Payload ID: 11721 relates to Category No.: 5561, 10056; Payload ID: 11722 relates to Category No.: 5561, 10056; Payload ID: 11723 relates to Category No.: 5561, 10056; Payload ID: 11724 relates to Category No.: 5561, 10056; Payload ID: 11725 relates to Category No.: 5561, 10056; Payload ID: 11726 relates to Category No.: 5561, 10056, 1720; Payload ID: 11727 relates to Category No.: 5561, 10056; Payload ID: 11728 relates to Category No.: 5561, 10056; Payload ID: 11729 relates to Category No.: 5561, 10056; Payload ID: 11730 relates to Category No.: 5561, 10056; Payload ID: 11731 relates to Category No.: 5561, 10056; Payload ID: 11732 relates to Category No.: 5561, 10056; Payload ID: 11733 relates to Category No.: 5561, 10056; Payload ID: 11734 relates to Category No.: 5561, 10056; Payload ID: 11735 relates to Category No.: 5561, 10056; Payload ID: 11736 relates to Category No.: 5561, 10056; Payload ID: 11737 relates to Category No.: 5561, 10056; Payload ID: 11738 relates to Category No.: 5561, 10056; Payload ID: 11739 relates to Category No.: 5561, 10056; Payload ID: 11740 relates to Category No.: 5561, 10056; Payload ID: 11741 relates to Category No.: 5561, 10056; Payload ID: 11742 relates to Category No.: 5561, 10056; Payload ID: 11743 relates to Category No.: 5561, 10056; Payload ID: 11744 relates to Category No.: 5561, 10056; Payload ID: 11745 relates to
Category No.: 5561, 10056; Payload ID: 11746 relates to
Category No.: 5561, 10056; Payload ID: 11747 relates to
Category No.: 5561, 10056; Payload ID: 11748 relates to
Category No.: 5561, 10056; Payload ID: 11749 relates to
Category No.: 5561, 10056; Payload ID: 11750 relates to
Category No.: 5561, 10056; Payload ID: 11751 relates to
Category No.: 5561, 10056; Payload ID: 11752 relates to
Category No.: 5561, 10056; Payload ID: 11753 relates to
Category No.: 5561, 10056; Payload ID: 11754 relates to
Category No.: 5561, 10056; Payload ID: 11755 relates to
Category No.: 5561, 10056; Payload ID: 11756 relates to
Category No.: 5561, 10056; Payload ID: 11757 relates to
Category No.: 5561, 10056; Payload ID: 11758 relates to
Category No.: 5561, 10056; Payload ID: 11759 relates to
Category No.: 5561, 10056; Payload ID: 11760 relates to
Category No.: 5561, 10056; Payload ID: 11761 relates to
Category No.: 5561, 10056; Payload ID: 11762 relates to
Category No.: 5561, 10056; Payload ID: 11763 relates to
Category No.: 5561, 10056; Payload ID: 11764 relates to
Category No.: 5561, 10056; Payload ID: 11765 relates to
Category No.: 5561, 10056; Payload ID: 11766 relates to
Category No.: 5561, 10056; Payload ID: 11767 relates to
Category No.: 5561, 10056; Payload ID: 11768 relates to
Category No.: 5561, 10056; Payload ID: 11769 relates to
Category No.: 5561, 10056; Payload ID: 11770 relates to
Category No.: 5561, 10056; Payload ID: 11771 relates to
Category No.: 5561, 10056; Payload ID: 11772 relates to
Category No.: 5561, 10056; Payload ID: 11773 relates to
Category No.: 5561, 10056; Payload ID: 11774 relates to
Category No.: 5561, 10056; Payload ID: 11775 relates to
Category No.: 5561, 10056, 5570; Payload ID: 11776 relates to Category No.: 5561, 10056; Payload ID: 11777 relates to
Category No.: 5561, 10056; Payload ID: 11778 relates to
Category No.: 5561, 10056; Payload ID: 11779 relates to
Category No.: 5561, 10056; Payload ID: 11780 relates to
Category No.: 5561, 10056; Payload ID: 11782 relates to
Category No.: 5561, 10056; Payload ID: 11783 relates to
Category No.: 5561, 10056; Payload ID: 11784 relates to
Category No.: 5561, 10056; Payload ID: 11785 relates to
Category No.: 5561, 10056; Payload ID: 11786 relates to
Category No.: 5561, 10056; Payload ID: 11787 relates to
Category No.: 5561, 10056; Payload ID: 11788 relates to
Category No.: 5561, 10056; Payload ID: 11789 relates to
Category No.: 5561, 10056; Payload ID: 11790 relates to
Category No.: 5561, 10056; Payload ID: 11791 relates to
Category No.: 5561, 10056; Payload ID: 11792 relates to
Category No.: 5561, 10056; Payload ID: 11793 relates to
Category No.: 5561, 10056; Payload ID: 11794 relates to
Category No.: 5561, 10056; Payload ID: 11795 relates to
Category No.: 5561, 10056; Payload ID: 11796 relates to
Category No.: 5561, 10056; Payload ID: 11797 relates to
Category No.: 5561, 10056; Payload ID: 11798 relates to
Category No.: 5561, 10056; Payload ID: 11799 relates to
Category No.: 5561, 10056; Payload ID: 11800 relates to
Category No.: 5561, 10056; Payload ID: 11801 relates to
Category No.: 5561, 10056; Payload ID: 11802 relates to
Category No.: 5561, 10056; Payload ID: 11803 relates to
Category No.: 5561, 10056; Payload ID: 11804 relates to
Category No.: 5561, 10056; Payload ID: 11805 relates to
Category No.: 5561, 10056; Payload ID: 11806 relates to
Category No.: 5561, 10056; Payload ID: 11807 relates to
Category No.: 5561, 10056; Payload ID: 11808 relates to
Category No.: 5561, 10056; Payload ID: 11809 relates to
Category No.: 5561, 10056; Payload ID: 11810 relates to
Category No.: 5561, 10056; Payload ID: 11811 relates to
Category No.: 5561, 10056; Payload ID: 11812 relates to
Category No.: 5561, 10056; Payload ID: 11813 relates to
Category No.: 5561, 10056; Payload ID: 11814 relates to
Category No.: 5561, 10056; Payload ID: 11815 relates to
Category No.: 5561, 10056; Payload ID: 11816 relates to
Category No.: 5561, 10056; Payload ID: 11817 relates to
Category No.: 5561, 10056; Payload ID: 11818 relates to
Category No.: 5561, 10056; Payload ID: 11819 relates to
Category No.: 5561, 10056; Payload ID: 11820 relates to
Category No.: 5561, 10056; Payload ID: 11821 relates to
Category No.: 5561, 10056; Payload ID: 11822 relates to
Category No.: 5561, 10056; Payload ID: 11823 relates to
Category No.: 5561, 10056; Payload ID: 11824 relates to
Category No.: 5561, 10056; Payload ID: 11825 relates to
Category No.: 5561, 10056; Payload ID: 11826 relates to
Category No.: 5561, 10056; Payload ID: 11827 relates to
Category No.: 5561, 10056; Payload ID: 11828 relates to
Category No.: 5561, 10056; Payload ID: 11829 relates to
Category No.: 5561, 10056, 5570; Payload ID: 11830 relates to Category No.: 5561, 10056, 5570; Payload ID: 11832 relates to Category No.: 5561, 10056, 5570; Payload ID: 11833 relates to Category No.: 5561, 10056, 5570; Payload ID: 11834 relates to Category No.: 5561, 10056, 5570; Payload ID: 11835 relates to Category No.: 5561, 10056, 5570; Payload ID: 11836 relates to Category No.: 5561, 10056, 5570; Payload ID: 11837 relates to Category No.: 5561, 10056, 5570; Payload ID: 11838 relates to Category No.: 5561, 10056, 5570; Payload ID: 11839 relates to Category No.: 5561, 10056, 5570; Payload ID: 11840 relates to Category No.: 5561, 10056, 5570; Payload ID: 11841 relates to Category No.: 5561, 10056, 5570; Payload ID: 11842 relates to Category No.: 5561, 10056, 5570; Payload ID: 11843 relates to Category No.: 5561, 10056, 5570; Payload ID: 11844 relates to Category No.: 5561, 10056, 5570; Payload ID: 11845 relates to Category No.: 5561, 10056, 5570; Payload ID: 11846 relates to Category No.: 5561, 10056, 5570; Payload ID: 11847 relates to Category No.: 5561, 10056, 5570; Payload ID: 11848 relates to Category No.: 5561, 10056, 5570; Payload ID: 11849 relates to Category No.: 5561, 10056; Payload ID: 11851 relates to Category No.: 5561, 10056, 5570; Payload ID: 11852 relates to Category No.: 5561, 10056, 5570; Payload ID: 11853 relates to Category No.: 5561, 10056, 5570; Payload ID: 11854 relates to Category No.: 5561, 10056, 5570; Payload ID: 11855 relates to Category No.: 5561, 10056, 5570; Payload ID: 11857 relates to Category No.: 5561, 10056, 5570; Payload ID: 11858 relates to Category No.: 5561, 10056, 5570; Payload ID: 11859 relates to Category No.: 5561, 10056, 5570; Payload ID: 11860 relates to Category No.: 5561, 10056, 5570; Payload ID: 11861 relates to Category No.: 5561, 10056, 5570; Payload ID: 11862 relates to Category No.: 5561, 10056, 5570; Payload ID: 11863 relates to Category No.: 5561, 10056, 5570; Payload ID: 11864 relates to Category No.: 5561, 10056, 5570; Payload ID: 11865 relates to Category No.: 5561, 10056, 5570; Payload ID: 11866 relates to Category No.: 5561, 10056, 5570; Payload ID: 11867 relates to Category No.: 5561, 10056, 5570; Payload ID: 11868 relates to Category No.: 5561, 10056, 5570; Payload ID: 11869 relates to Category No.: 5561, 10056, 5570; Payload ID: 11870 relates to Category No.: 5561, 10056, 5570; Payload ID: 11871 relates to Category No.: 5561, 10056, 5570; Payload ID: 11872 relates to Category No.: 5561, 10056, 5570; Payload ID: 11873 relates to Category No.: 5561, 10056, 5570; Payload ID: 11874 relates to Category No.: 5561, 10056, 5570; Payload ID: 11875 relates to Category No.: 5561, 10056; Payload ID: 11877 relates to Category No.: 5561, 10056; Payload ID: 11878 relates to Category No.: 5561, 10056, 5570; Payload ID: 11879 relates to Category No.: 5561, 10056; Payload ID: 11880 relates to Category No.: 5561, 10056; Payload ID: 11881 relates to Category No.: 5561, 10056; Payload ID: 11882 relates to Category No.: 5561, 10056; Payload ID: 11883 relates to Category No.: 5561, 10056; Payload ID: 11884 relates to Category No.: 5561, 10056; Payload ID: 11885 relates to Category No.: 5561, 10056; Payload ID: 11886 relates to Category No.: 5561, 10056; Payload ID: 11887 relates to Category No.: 5561, 10056; Payload ID: 11888 relates to Category No.: 5561, 10056; Payload ID: 11889 relates to Category No.: 5561, 10056; Payload ID: 11890 relates to Category No.: 5561, 10056; Payload ID: 11891 relates to Category No.: 5561, 10056; Payload ID: 11892 relates to Category No.: 5561, 10056; Payload ID: 11893 relates to Category No.: 5561, 10056; Payload ID: 11894 relates to Category No.: 5561, 10056; Payload ID: 11895 relates to Category No.: 5561, 10056; Payload ID: 11896 relates to Category No.: 5561, 10056; Payload ID: 11897 relates to Category No.: 5561, 10056; Payload ID: 11898 relates to Category No.: 5561, 10056; Payload ID: 11899 relates to Category No.: 5561, 10056; Payload ID: 11900 relates to Category No.: 5561, 10056; Payload ID: 11901 relates to Category No.: 5561, 10056; Payload ID: 11902 relates to Category No.: 5561, 10056; Payload ID: 11903 relates to Category No.: 5561, 10056, 5570; Payload ID: 11904 relates to Category No.: 5561, 10056; Payload ID: 11905 relates to Category No.: 5561, 10056; Payload ID: 11906 relates to Category No.: 5561, 10056; Payload ID: 11907 relates to Category No.: 5561, 10056; Payload ID: 11908 relates to Category No.: 5561, 10056; Payload ID: 11909 relates to Category No.: 5561, 10056; Payload ID: 11910 relates to Category No.: 5561, 10056; Payload ID: 11911 relates to Category No.: 5561, 10056; Payload ID: 11912 relates to Category No.: 5561, 10056; Payload ID: 11913 relates to Category No.: 5561, 10056; Payload ID: 11914 relates to Category No.: 5561, 10056; Payload ID: 11915 relates to Category No.: 5561, 10056; Payload ID: 11916 relates to Category No.: 5561, 10056; Payload ID: 11917 relates to Category No.: 5561, 10056; Payload ID: 11918 relates to Category No.: 5561, 10056; Payload ID: 11919 relates to Category No.: 5561, 10056; Payload ID: 11920 relates to Category No.: 5561, 10056; Payload ID: 11921 relates to Category No.: 5561, 10056; Payload ID: 11922 relates to Category No.: 5561, 10056; Payload ID: 11923 relates to Category No.: 5561, 10056; Payload ID: 11924 relates to Category No.: 5561, 10056; Payload ID: 11925 relates to Category No.: 5561, 10056; Payload ID: 11926 relates to Category No.: 5561, 10056; Payload ID: 11927 relates to Category No.: 5561, 10056; Payload ID: 11928 relates to Category No.: 5561, 10056; Payload ID: 11929 relates to Category No.: 5561, 10056, 5570; Payload ID: 11930 relates to Category No.: 5561, 10056; Payload ID: 11931 relates to Category No.: 5561, 10056, 5570; Payload ID: 11932 relates to Category No.: 5561, 10056; Payload ID: 11933 relates to Category No.: 5561, 10056; Payload ID: 11934 relates to Category No.: 5561, 10056; Payload ID: 11935 relates to Category No.: 5561, 10056; Payload ID: 11936 relates to Category No.: 5561, 10056; Payload ID: 11937 relates to Category No.: 5561, 10056, 5570; Payload ID: 11938 relates to Category No.: 5561, 10056, 5570; Payload ID: 11939 relates to Category No.: 5561, 10056; Payload ID: 11940 relates to Category No.: 5561, 10056; Payload ID: 11941 relates to Category No.: 5561, 10056; Payload ID: 11942 relates to Category No.: 5561, 10056; Payload ID: 11943 relates to Category No.: 5561, 10056; Payload ID: 11944 relates to Category No.: 5561, 10056; Payload ID: 11945 relates to Category No.: 5561, 10056; Payload ID: 11946 relates to Category No.: 5561, 10056; Payload ID: 11947 relates to Category No.: 5561, 10056; Payload ID: 11948 relates to Category No.: 5561, 10056; Payload ID: 11949 relates to Category No.: 5561, 10056; Payload ID: 11950 relates to Category No.: 5561, 10056; Payload ID: 11951 relates to Category No.: 5561, 10056; Payload ID: 11952 relates to Category No.: 5561, 10056; Payload ID: 11953 relates to Category No.: 5561, 10056; Payload ID: 11954 relates to Category No.: 5561, 10056; Payload ID: 11955 relates to Category No.: 5561, 10056; Payload ID: 11956 relates to Category No.: 5561, 10056; Payload ID: 11957 relates to Category No.: 5561, 10056; Payload ID: 11958 relates to Category No.: 5561, 10056, 5570; Payload ID: 11959 relates to Category No.: 5561, 10056, 5570; Payload ID: 11960 relates to Category No.: 5561, 10056; Payload ID: 11961 relates to Category No.: 5561, 10056; Payload ID: 11962 relates to Category No.: 5561, 10056; Payload ID: 11963 relates to Category No.: 5561, 10056; Payload ID: 11964 relates to Category No.: 5561, 10056; Payload ID: 11965 relates to Category No.: 5561, 10056; Payload ID: 11966 relates to Category No.: 5561, 10056; Payload ID: 11967 relates to Category No.: 5561, 10056; Payload ID: 11968 relates to Category No.: 5561, 10056; Payload ID: 11969 relates to Category No.: 5561, 10056; Payload ID: 11970 relates to Category No.: 5561, 10056; Payload ID: 11971 relates to Category No.: 5561, 10056; Payload ID: 11972 relates to Category No.: 5561, 10056; Payload ID: 11973 relates to Category No.: 5561, 10056; Payload ID: 11974 relates to Category No.: 5561, 10056; Payload ID: 11975 relates to Category No.: 5561, 10056; Payload ID: 11976 relates to Category No.: 5561, 10056, 5570; Payload ID: 11977 relates to Category No.: 5561, 10056, 5570; Payload ID: 11978 relates to Category No.: 5561, 10056, 5570; Payload ID: 11979 relates to Category No.: 5561, 10056, 5570; Payload ID: 11980 relates to Category No.: 5561, 10056, 5570; Payload ID: 11981 relates to Category No.: 5561, 10056, 5570; Payload ID: 11982 relates to Category No.: 5561, 10056, 5570; Payload ID: 11983 relates to Category No.: 5561, 10056, 5570; Payload ID: 11984 relates to Category No.: 5561, 10056, 5570; Payload ID: 11985 relates to Category No.: 5561, 10056; Payload ID: 11986 relates to Category No.: 5561, 10056; Payload ID: 11987 relates to Category No.: 5561, 10056, 5570; Payload ID: 11988 relates to Category No.: 5561, 10056, 5570; Payload ID: 11989 relates to Category No.: 5561, 10056, 5570; Payload ID: 11990 relates to Category No.: 5561, 10056, 5570; Payload ID: 11991 relates to Category No.: 5561, 10056, 5570; Payload ID: 11993 relates to Category No.: 5561, 10056, 5570; Payload ID: 11994 relates to Category No.: 5561, 10056, 5570; Payload ID: 11995 relates to Category No.: 5561, 10056, 5570; Payload ID: 11996 relates to Category No.: 5561, 10056; Payload ID: 11997 relates to Category No.: 5561, 10056; Payload ID: 11998 relates to Category No.: 5561, 10056; Payload ID: 11999 relates to Category No.: 5561; Payload ID: 12000 relates to Category No.: 5561, 10056; Payload ID: 12001 relates to Category No.: 5561, 10056, 5570; Payload ID: 12002 relates to Category No.: 5561; Payload ID: 12003 relates to Category No.: 5561, 10056, 5570; Payload ID: 12004 relates to Category No.: 5561; Payload ID: 12005 relates to Category No.: 5561, 10056, 5570; Payload ID: 12006 relates to Category No.: 5561, 10056, 5570; Payload ID: 12007 relates to Category No.: 5561, 10056, 5570; Payload ID: 12008 relates to Category No.: 5561, 10056, 5570; Payload ID: 12009 relates to Category No.: 9305, 2890; Payload ID: 12010 relates to Category No.: 10056, 677; Payload ID: 12011 relates to Category No.: 9305; Payload ID: 12012 relates to Category No.: 9305; Payload ID: 12013 relates to Category No.: 5561, 10056, 4755, 1810; Payload ID: 12014 relates to Category No.: 9305, 5776, 9242, 9247, 5730, 9158, 15269, 14993; Payload ID: 12015 relates to Category No.: 2942, 1748, 3055, 2890, 3036, 273, 15280; Payload ID: 12016 relates to Category No.: 5561, 9362; Payload ID: 12017 relates to Category No.: 5561, 3673; Payload ID: 12018 relates to Category No.: 9305, 7118, 2890, 6976, 10056, 2942, 9247, 5102, 7180, 8935, 8948, 3952, 16344; Payload ID: 12019 relates to Category No.: 5561, 7048, 7061, 7118; Payload ID: 12022 relates to Category No.: 9162; Payload ID: 12023 relates to Category No.: 4030, 4029, 5762; Payload ID: 12024 relates to Category No.: 779, 9372, 6717, 4008, 5561; Payload ID: 12025 relates to Category No.: 9305; Payload ID: 12026 relates to Category No.: 9305, 9247, 273; Payload ID: 12027 relates to Category No.: 9305, 15505; Payload ID: 12028 relates to Category No.: 11883, 1720, 778; Payload ID: 12029 relates to Category No.: 4029; Payload ID: 12030 relates to Category No.: 9305, 2890, 2420, 2192, 9247, 2402, 1377, 2419; Payload ID: 12031 relates to Category No.: 5561; Payload ID: 12032 relates to Category No.: 10056, 677, 8935, 8948, 1811, 4010, 1792; Payload ID: 12033 relates to Category No.: 9305, 2890, 6717, 1842; Payload ID: 12034 relates to Category No.: 6717; Payload ID: 12035 relates to Category No.: 5561, 10056, 8935, 5570, 5823, 6717, 2890, 11653, 6743, 1033, 16156, 3040; Payload ID: 12036 relates to Category No.: 5561, 10056, 8935, 5570, 15139, 3036, 8948, 1033, 9730; Payload ID: 12037 relates to Category No.: 5561, 8935, 10056, 2942, 5570, 3666, 4755, 6717, 2890, 3036, 6743, 4228, 14363, 9730, 3040, 3037; Payload ID: 12038 relates to Category No.: 5561, 5570, 10003; Payload ID: 12039 relates to Category No.: 5561, 10056, 5570, 10003; Payload ID: 12040 relates to Category No.: 5561, 10056, 5570, 10003; Payload ID: 12041 relates to Category No.: 5561, 10056, 5570, 10003; Payload ID: 12042 relates to Category No.: 5561, 5570, 10003, 10002; Payload ID: 12043 relates to Category No.: 5561, 5570; Payload ID: 12044 relates to Category No.: 5561, 10056; Payload ID: 12045 relates to Category No.: 5561; Payload ID: 12046 relates to Category No.: 5561, 7118, 2890, 6717, 7048, 9247, 3036, 7070, 7052, 7032, 4050; Payload ID: 12047 relates to Category No.: 7118; Payload ID: 12048 relates to Category No.: 12159; Payload ID: 12049 relates to Category No.: 9305, 12439, 2890, 2942, 4765, 9247, 2899, 4755, 9734, 15573, 997; Payload ID: 12050 relates to Category No.: 5561; Payload ID: 12051 relates to Category No.: 5561; Payload ID: 12052 relates to Category No.: 5561; Payload ID: 12055 relates to Category No.: 5561; Payload ID: 12056 relates to Category No.: 5561, 6717, 5570, 997, 2926, 1099, 11883; Payload ID: 12057 relates to Category No.: 5561, 6717, 4860; Payload ID: 12058 relates to Category No.: 5561, 6717; Payload ID: 12059 relates to Category No.: 2279, 1842; Payload ID: 12060 relates to Category No.: 9305, 6717, 2194, 2942, 6968, 2183, 2458, 2441, 2182; Payload ID: 12061 relates to Category No.: 1085; Payload ID: 12062 relates to Category No.: 9305, 2890, 10056, 9242, 2942, 9247, 9436, 9191; Payload ID: 12063 relates to Category No.: 9305, 6717, 2194, 10056, 9247, 9158, 15269, 9436, 9191, 5029, 2402, 2629; Payload ID: 12064 relates to Category No.: 9247, 9158, 15269, 9436, 9191; Payload ID: 12065 relates to Category No.: 9305, 2890, 9242, 9247, 273, 9158, 15269, 9436, 9191; Payload ID: 12066 relates to Category No.: 9305, 2890, 9247, 9158, 15269, 9436, 9191; Payload ID: 12067 relates to Category No.: 9191, 9305, 6717, 10056, 9247, 9436; Payload ID: 12068 relates to Category No.: 5561, 3673; Payload ID: 12069 relates to Category No.: 5561, 3673, 3666; Payload ID: 12070 relates to Category No.: 5561, 3673, 3666, 14925; Payload ID: 12071 relates to Category No.: 7118, 7060, 2890; Payload ID: 12072 relates to Category No.: 7118, 2890, 7060, 7048; Payload ID: 12073 relates to Category No.: 2890, 2942, 1842, 9734; Payload ID: 12074 relates to Category No.: 2942; Payload ID: 12075 relates to Category No.: 9305, 2942; Payload ID: 12076 relates to Category No.: 2890, 9305, 2942, 1239; Payload ID: 12077 relates to Category No.: 5561, 2890, 2942, 3666, 9734, 6968; Payload ID: 12078 relates to Category No.: 4030, 4029, 1239, 4010; Payload ID: 12079 relates to Category No.: 4030, 1239, 4010; Payload ID: 12080 relates to Category No.: 9305; Payload ID: 12081 relates to Category No.: 9305, 4860, 11883, 2890; Payload ID: 12082 relates to Category No.: 9305; Payload ID: 12083 relates to Category No.: 9305, 2890, 3548; Payload ID: 12084 relates to Category No.: 7118, 3548; Payload ID: 12085 relates to Category No.: 5561, 4029, 10056, 4010; Payload ID: 12086 relates to Category No.: 2890, 5762, 4010; Payload ID: 12087 relates to Category No.: 5561; Payload ID: 12088 relates to Category No.: 4030; Payload ID: 12089 relates to Category No.: 4030, 4029, 12159, 4014, 4010, 4763, 6437, 4032; Payload ID: 12090 relates to Category No.: 4030, 4029, 12159, 4010, 4763, 6437; Payload ID: 12091 relates to Category No.: 5561, 9305, 2890, 5776, 6440, 2942; Payload ID: 12092 relates to Category No.: 3673, 3671, 5278, 3666; Payload ID: 12093 relates to Category No.: 12159, 677, 1792, 779; Payload ID: 12094 relates to Category No.: 4029, 1842; Payload ID: 12095 relates to Category No.: 5561, 2942, 3673, 1748, 1099, 15161, 2890, 10056, 3666, 778, 1084, 1700; Payload ID: 12096 relates to Category No.: 4029, 4030, 779; Payload ID: 12097 relates to Category No.: 4029; Payload ID: 12098 relates to Category No.: 4029, 2574; Payload ID: 12099 relates to Category No.: 4030, 5561; Payload ID: 12100 relates to Category No.: 5561; Payload ID: 12101 relates to Category No.: 5561; Payload ID: 12102 relates to Category No.: 4029; Payload ID: 12103 relates to Category No.: 4029; Payload ID: 12106 relates to Category No.: 1842; Payload ID: 12107 relates to Category No.: 2942; Payload ID: 12109 relates to Category No.: 9305, 2890; Payload ID: 12110 relates to Category No.: 9305, 2890; Payload ID: 12111 relates to Category No.: 2890, 2942, 6368; Payload ID: 12112 relates to Category No.: 9305, 2890, 4010; Payload ID: 12113 relates to Category No.: 9305; Payload ID: 12115 relates to Category No.: 4010; Payload ID: 12116 relates to Category No.: 9305, 9472; Payload ID: 12117 relates to Category No.: 9305, 6960, 2194, 2942, 14906, 11728, 2183, 2441, 2458, 9472; Payload ID: 12118 relates to Category No.: 2194; Payload ID: 12119 relates to Category No.: 9472; Payload ID: 12122 relates to Category No.: 2901; Payload ID: 12123 relates to Category No.: 5561, 9472, 7244; Payload ID: 12124 relates to Category No.: 2890, 9305; Payload ID: 12125 relates to Category No.: 4029, 2942, 15627, 3542, 9745; Payload ID: 12126 relates to Category No.: 4029; Payload ID: 12128 relates to Category No.: 9305; Payload ID: 12129 relates to Category No.: 9305; Payload ID: 12130 relates to Category No.: 9305; Payload ID: 12131 relates to Category No.: 4030, 4029; Payload ID: 12132 relates to Category No.: 5561, 7118, 7048, 7061, 7085, 11883, 5563; Payload ID: 12133 relates to Category No.: 7118, 1842, 9242; Payload ID: 12134 relates to Category No.: 1842; Payload ID: 12135 relates to Category No.: 1842; Payload ID: 12136 relates to Category No.: 2890, 4010, 5762; Payload ID: 12138 relates to Category No.: 6717, 5776, 10056, 5570, 9247, 4010, 6743, 12406, 5561; Payload ID: 12139 relates to Category No.: 1842, 7118; Payload ID: 12140 relates to Category No.: 7118; Payload ID: 12141 relates to Category No.: 5561, 10056; Payload ID: 12142 relates to Category No.: 7118, 9521, 7061, 7060; Payload ID: 12143 relates to Category No.: 5561, 10056; Payload ID: 12144 relates to Category No.: 7118, 7060, 9521; Payload ID: 12145 relates to Category No.: 9305, 2890, 6717, 9242, 2942, 4765, 3673, 9247, 4755, 9734, 1748; Payload ID: 12146 relates to Category No.: 6717, 775; Payload ID: 12147 relates to Category No.: 2890, 2938; Payload ID: 12148 relates to Category No.: 4755, 6060; Payload ID: 12149 relates to Category No.: 9305, 2890, 5762, 9247, 4010, 6059, 6440; Payload ID: 12151 relates to Category No.: 6717, 10056, 2942, 9184, 9732; Payload ID: 12152 relates to Category No.: 5561, 6717, 2942, 3673; Payload ID: 12153 relates to Category No.: 10056, 2942, 9184, 9732; Payload ID: 12154 relates to Category No.: 10056, 2942, 997, 9732; Payload ID: 12155 relates to Category No.: 5561, 6717, 3673, 3666, 2714, 9184; Payload ID: 12156 relates to Category No.: 2890, 4755, 6060; Payload ID: 12157 relates to Category No.: 5561, 10056, 5570, 2942, 5762, 1803, 779, 6989; Payload ID: 12158 relates to Category No.: 4029, 2890, 2942, 4030, 15280, 14409; Payload ID: 12163 relates to Category No.: 1842; Payload ID: 12165 relates to Category No.: 2890, 10056, 2942, 4755, 3036, 1811, 1017, 9184, 14327, 4228, 5829, 11883, 4197, 16326, 14329, 5596, 9305, 4860, 8951, 6717, 5762; Payload ID: 12166 relates to Category No.: 2890, 10056, 2942, 9247, 9734, 5762; Payload ID: 12167 relates to Category No.: 2890, 10056, 2942, 3693; Payload ID: 12168 relates to Category No.: 2890, 4755, 4228; Payload ID: 12169 relates to Category No.: 2890, 9305; Payload ID: 12171 relates to Category No.: 9305, 7118, 2890; Payload ID: 12172 relates to Category No.: 5570; Payload ID: 12173 relates to Category No.: 6717, 5776, 2942, 3673, 7118, 5561; Payload ID: 12174 relates to Category No.: 2890, 11693; Payload ID: 12175 relates to Category No.: 9305, 2890, 4755; Payload ID: 12176 relates to Category No.: 2890, 6717, 1691; Payload ID: 12177 relates to Category No.: 9305; Payload ID: 12178 relates to Category No.: 9305, 6976, 11883, 2182, 12170, 6443; Payload ID: 12179 relates to Category No.: 9247, 9305; Payload ID: 12180 relates to Category No.: 9247, 9305; Payload ID: 12181 relates to Category No.: 9305; Payload ID: 12182 relates to Category No.: 9305, 2890, 9247, 9157, 5762; Payload ID: 12183 relates to Category No.: 9305; Payload ID: 12184 relates to Category No.: 9305, 9247; Payload ID: 12185 relates to Category No.: 9305; Payload ID: 12186 relates to Category No.: 5570, 4010; Payload ID: 12187 relates to Category No.: 5561, 5570; Payload ID: 12188 relates to Category No.: 9305, 9242; Payload ID: 12189 relates to Category No.: 9305; Payload ID: 12190 relates to Category No.: 9157, 9305; Payload ID: 12191 relates to Category No.: 9157, 9305; Payload ID: 12192 relates to Category No.: 9305, 9242, 2890, 15505; Payload ID: 12193 relates to Category No.: 9305, 15505, 9247, 2890; Payload ID: 12194 relates to Category No.: 9305; Payload ID: 12195 relates to Category No.: 10056, 9242, 9247; Payload ID: 12196 relates to Category No.: 9305, 7118, 2890, 10056, 273, 276, 6017, 14327, 4228, 16326; Payload ID: 12197 relates to Category No.: 6717; Payload ID: 12198 relates to Category No.: 2890, 6717, 3055; Payload ID: 12199 relates to Category No.: 6443, 4029, 9305, 6717, 2942, 15151, 4755, 1017, 4010, 6743, 6437, 4030, 8948, 3036, 15139, 8935; Payload ID: 12200 relates to Category No.: 6443, 4010, 6437, 5561; Payload ID: 12201 relates to Category No.: 5561; Payload ID: 12202 relates to Category No.: 9305, 2942, 2903, 9553; Payload ID: 12203 relates to Category No.: 2942, 2903, 9553; Payload ID: 12204 relates to Category No.: 9305, 2890, 15505, 5762; Payload ID: 12205 relates to Category No.: 2942, 9215, 9305, 5762, 2890; Payload ID: 12206 relates to Category No.: 4029; Payload ID: 12207 relates to Category No.: 4029; Payload ID: 12208 relates to Category No.: 4029; Payload ID: 12209 relates to Category No.: 4029; Payload ID: 12210 relates to Category No.: 4029, 4030, 2890; Payload ID: 12212 relates to Category No.: 5561, 6717, 10056, 3673, 3666, 4402, 1231, 11883; Payload ID: 12213 relates to Category No.: 5561, 10056, 4402, 2890; Payload ID: 12214 relates to Category No.: 5561, 10056, 4402; Payload ID: 12215 relates to Category No.: 2942, 9305, 1772, 12439, 2492; Payload ID: 12216 relates to Category No.: 7118, 7052, 2942; Payload ID: 12217 relates to Category No.: 2890; Payload ID: 12218 relates to Category No.: 2890; Payload ID: 12219 relates to Category No.: 9213, 9305, 2942; Payload ID: 12220 relates to Category No.: 2890, 9242, 1842; Payload ID: 12221 relates to Category No.: 9305, 2890, 9247; Payload ID: 12222 relates to Category No.: 4014, 1090, 12159; Payload ID: 12223 relates to Category No.: 9305, 5776, 9247; Payload ID: 12224 relates to Category No.: 4029, 5762, 4010; Payload ID: 12225 relates to Category No.: 10056, 2942, 1182, 3652, 1748, 1720, 1811, 5745, 2890, 11883, 1803, 14893, 778, 447, 8948, 1036; Payload ID: 12226 relates to Category No.: 6717, 1182, 3652; Payload ID: 12227 relates to Category No.: 9305, 10056, 2942, 1182, 14327, 2890, 11883, 1720, 778, 8948, 1036; Payload ID: 12228 relates to Category No.: 2890, 10056, 2942, 1182, 4010, 9305, 1720, 778, 11883; Payload ID: 12229 relates to Category No.: 10056, 2942, 1182; Payload ID: 12230 relates to Category No.: 9305, 6717, 5776, 10056, 5570, 9247, 2899, 1099, 1017, 3055, 781, 4201, 2890, 4199, 8951, 8945, 3040, 3059; Payload ID: 12231 relates to Category No.: 6717, 10056; Payload ID: 12232 relates to Category No.: 2890, 10056; Payload ID: 12233 relates to Category No.: 2890, 9242, 4228; Payload ID: 12234 relates to Category No.: 9242; Payload ID: 12235 relates to Category No.: 9242; Payload ID: 12240 relates to Category No.: 4030, 4029, 5059, 1239, 4010, 14852, 5776; Payload ID: 12241 relates to Category No.: 4029, 10056, 9305, 7118, 5776, 6443; Payload ID: 12242 relates to Category No.: 4030, 4010, 5776; Payload ID: 12243 relates to Category No.: 2890, 9242, 9247, 9215, 9181, 9578; Payload ID: 12244 relates to Category No.: 9305; Payload ID: 12245 relates to Category No.: 4030, 4029, 5762, 1700; Payload ID: 12246 relates to Category No.: 5561, 2890, 6717, 10056, 5570, 1099, 4010, 779, 12406, 5762, 9305, 2942, 1336; Payload ID: 12247 relates to Category No.: 4029; Payload ID: 12248 relates to Category No.: 5561, 6717, 10056, 5570; Payload ID: 12249 relates to Category No.: 4030, 4029, 2890, 9247, 4755, 5762; Payload ID: 12250 relates to Category No.: 9305, 2942, 8935, 16156, 2458, 7118, 1711, 14828, 5561; Payload ID: 12252 relates to Category No.: 9305, 7118, 2890, 2942, 15892, 3666, 4755, 9734, 6368, 493, 6161, 9589, 11883, 8935; Payload ID: 12253 relates to Category No.: 4010; Payload ID: 12254 relates to Category No.: 9305, 7118, 2890, 10056, 2942, 2402, 1017, 4010, 6743, 7087, 10104, 3666, 8935, 7052, 7060, 1711; Payload ID: 12255 relates to Category No.: 9305, 7118, 6717; Payload ID: 12256 relates to Category No.: 9247, 2890, 2402; Payload ID: 12257 relates to Category No.: 9247; Payload ID: 12258 relates to Category No.: 9305, 9242; Payload ID: 12259 relates to Category No.: 4010, 2890, 1017, 9305, 2942, 11883, 8948, 15280; Payload ID: 12260 relates to Category No.: 2890, 273, 4228, 9305, 6017;

Payload ID: 12261 relates to Category No.: 2938, 10056, 2942, 6017, 4228, 16326; Payload ID: 12262 relates to Category No.: 2890, 2938, 10056, 4228; Payload ID: 12263 relates to Category No.: 9305, 9247, 2771; Payload ID: 12264 relates to Category No.: 9305, 2890, 4755; Payload ID: 12265 relates to Category No.: 2890; Payload ID: 12266 relates to Category No.: 5561, 5776, 10056, 3673, 6222, 2942; Payload ID: 12267 relates to Category No.: 5561, 6717, 3673; Payload ID: 12268 relates to Category No.: 1842; Payload ID: 12270 relates to Category No.: 5561, 6717, 3673, 3666; Payload ID: 12271 relates to Category No.: 5561, 7061, 3666, 9184, 6440; Payload ID: 12272 relates to Category No.: 5561, 6717, 5762, 4765, 3673, 9734, 9756, 9754; Payload ID: 12273 relates to Category No.: 5561, 6717, 5776, 10056, 4755, 9734, 1659, 3638, 2446, 6994, 11728, 1036, 11650, 3052; Payload ID: 12274 relates to Category No.: 5561, 6717; Payload ID: 12275 relates to Category No.: 5561, 6717, 10056; Payload ID: 12276 relates to Category No.: 5561, 6717, 3666, 9184; Payload ID: 12277 relates to Category No.: 5561, 6717, 1842, 14828; Payload ID: 12278 relates to Category No.: 5561, 6717, 1842; Payload ID: 12279 relates to Category No.: 9305, 2890; Payload ID: 12280 relates to Category No.: 9305, 2890, 9247; Payload ID: 12281 relates to Category No.: 9305, 9247, 9181, 5216; Payload ID: 12282 relates to Category No.: 9305, 2942; Payload ID: 12283 relates to Category No.: 2890, 10056, 2942, 9247, 1720, 6964, 6017, 4228, 14999, 2938, 1750; Payload ID: 12284 relates to Category No.: 9305, 5216; Payload ID: 12285 relates to Category No.: 9305, 2890, 15505; Payload ID: 12286 relates to Category No.: 9305, 2890, 6968, 273; Payload ID: 12287 relates to Category No.: 9305, 2942, 9247, 9172, 9195, 15532; Payload ID: 12290 relates to Category No.: 2890, 9247, 7275; Payload ID: 12291 relates to Category No.: 1842; Payload ID: 12293 relates to Category No.: 9247; Payload ID: 12294 relates to Category No.: 10056, 2942, 2420, 2192, 9247, 2420, 2402; Payload ID: 12295 relates to Category No.: 9305, 2942, 2420, 2192, 9247, 2420, 2402; Payload ID: 12296 relates to Category No.: 9247, 6968, 5597; Payload ID: 12297 relates to Category No.: 2890, 2938, 4228, 15505; Payload ID: 12298 relates to Category No.: 273, 4228, 9305, 4010, 2710, 14999; Payload ID: 12299 relates to Category No.: 2890, 16326, 273; Payload ID: 12301 relates to Category No.: 6717, 2942, 8935, 273, 1748, 11650, 11653, 16326; Payload ID: 12302 relates to Category No.: 9305, 2890, 273, 4228, 14999, 14327; Payload ID: 12303 relates to Category No.: 9305, 1842; Payload ID: 12304 relates to Category No.: 2890, 10056, 4010, 1336, 6743, 779, 6991; Payload ID: 12305 relates to Category No.: 4029, 2942, 15139, 1099, 1811; Payload ID: 12306 relates to Category No.: 4029, 9305, 2890, 3666, 1811; Payload ID: 12307 relates to Category No.: 2942, 1335, 778, 15032; Payload ID: 12308 relates to Category No.: 1720; Payload ID: 12309 relates to Category No.: 4030, 9305, 2458, 14951, 16035; Payload ID: 12310 relates to Category No.: 6717, 5762; Payload ID: 12312 relates to Category No.: 8917; Payload ID: 12314 relates to Category No.: 5561, 4010; Payload ID: 12315 relates to Category No.: 5561; Payload ID: 12316 relates to Category No.: 5561; Payload ID: 12317 relates to Category No.: 5561; Payload ID: 12318 relates to Category No.: 5561; Payload ID: 12319 relates to Category No.: 2942, 9305; Payload ID: 12320 relates to Category No.: 2942; Payload ID: 12321 relates to Category No.: 2942; Payload ID: 12322 relates to Category No.: 9305, 2890; Payload ID: 12323 relates to Category No.: 2890, 6717, 4010; Payload ID: 12324 relates to Category No.: 7118, 7060; Payload ID: 12325 relates to Category No.: 7118; Payload ID: 12326 relates to Category No.: 7118, 7048; Payload ID: 12327 relates to Category No.: 4030, 4029; Payload ID: 12328 relates to Category No.: 4029; Payload ID: 12329 relates to Category No.: 4010, 7323; Payload ID: 12330 relates to Category No.: 4010, 7323; Payload ID: 12331 relates to Category No.: 4010, 7323; Payload ID: 12332 relates to Category No.: 4030, 7118, 7048, 7060; Payload ID: 12333 relates to Category No.: 7060, 7092, 7048, 7118; Payload ID: 12334 relates to Category No.: 4010; Payload ID: 12335 relates to Category No.: 4029; Payload ID: 12336 relates to Category No.: 4029, 4010; Payload ID: 12337 relates to Category No.: 5561, 4029, 4010, 4030; Payload ID: 12338 relates to Category No.: 4029, 12159, 4010; Payload ID: 12339 relates to Category No.: 4010; Payload ID: 12340 relates to Category No.: 9247, 4010; Payload ID: 12341 relates to Category No.: 7118; Payload ID: 12342 relates to Category No.: 4030, 4029; Payload ID: 12343 relates to Category No.: 4029, 4010; Payload ID: 12344 relates to Category No.: 6717, 5762, 4010; Payload ID: 12345 relates to Category No.: 4029, 6717, 5762; Payload ID: 12346 relates to Category No.: 4029, 6717, 5762; Payload ID: 12347 relates to Category No.: 2890, 4010; Payload ID: 12348 relates to Category No.: 2890, 4010, 15532; Payload ID: 12349 relates to Category No.: 2890; Payload ID: 12350 relates to Category No.: 2890, 9305, 9247; Payload ID: 12351 relates to Category No.: 9305, 2890, 5730; Payload ID: 12352 relates to Category No.: 5561, 6717, 4010, 4030, 10056, 1792, 8935, 8948, 15573, 9734, 14409, 9730, 14412; Payload ID: 12353 relates to Category No.: 9305, 9247, 6994, 9215, 2890, 2942, 7118, 8935; Payload ID: 12354 relates to Category No.: 9305, 2890, 9242, 7060, 14893, 4010, 11715; Payload ID: 12355 relates to Category No.: 4010, 1635; Payload ID: 12356 relates to Category No.: 9305, 2890, 10056, 9247, 4763; Payload ID: 12357 relates to Category No.: 1635, 5561; Payload ID: 12358 relates to Category No.: 9305; Payload ID: 12360 relates to Category No.: 4030, 4029, 9305, 6717, 2942, 4010, 4228; Payload ID: 12361 relates to Category No.: 2890, 4010; Payload ID: 12362 relates to Category No.: 2890; Payload ID: 12363 relates to Category No.: 2890; Payload ID: 12364 relates to Category No.: 2890; Payload ID: 12365 relates to Category No.: 2890; Payload ID: 12366 relates to Category No.: 2890; Payload ID: 12367 relates to Category No.: 9305, 6717, 3666, 9734, 4010, 4228, 6709, 3671, 6454, 3668, 14683; Payload ID: 12368 relates to Category No.: 2890, 4010; Payload ID: 12369 relates to Category No.: 9305, 2890, 9242, 9247; Payload ID: 12370 relates to Category No.: 9305, 9247, 1635; Payload ID: 12371 relates to Category No.: 9305, 9247, 1635; Payload ID: 12372 relates to Category No.: 7118, 7060, 6717, 7079, 7048; Payload ID: 12373 relates to Category No.: 9305, 2890, 9247, 9215, 9181; Payload ID: 12374 relates to Category No.: 2890, 14912, 15864, 9215, 15863; Payload ID: 12375 relates to Category No.: 7118; Payload ID: 12376 relates to Category No.: 7118, 6717, 2942, 5561; Payload ID: 12377 relates to Category No.: 4010; Payload ID: 12378 relates to Category No.: 5561, 6717, 10056, 3695, 2889, 2899; Payload ID: 12379 relates to Category No.: 9305, 2890, 10056, 7366; Payload ID: 12380 relates to Category No.: 2890, 6717, 6960, 2194, 2942, 2183, 2182, 2441, 2477, 6976, 5597, 7244, 9727; Payload ID: 12381 relates to Category No.: 2890, 6717, 2194, 2942, 9184, 11883, 2182, 9727, 2441, 2183; Payload ID: 12382 relates to Category No.: 3666, 6222, 5561; Payload ID: 12383 relates to Category No.: 4029, 10056, 3666, 6222, 2890, 9305, 2942; Payload ID: 12384 relates to Category No.: 2890, 6717, 5776, 3693, 4755, 6222, 3696;

Payload ID: 12385 relates to Category No.: 2890, 10056, 6222; Payload ID: 12386 relates to Category No.: 7118, 2890, 6222, 2942; Payload ID: 12387 relates to Category No.: 9305, 2890; Payload ID: 12388 relates to Category No.: 9305, 2890, 9242, 9247, 9734; Payload ID: 12389 relates to Category No.: 9305, 2890; Payload ID: 12390 relates to Category No.: 4030, 12159, 4014, 15573, 2890, 8917; Payload ID: 12391 relates to Category No.: 2890, 4010, 7366; Payload ID: 12392 relates to Category No.: 5561, 10056, 1182, 2608; Payload ID: 12393 relates to Category No.: 6717, 5727, 4010, 10002, 1017, 10003, 8902, 2257, 15827; Payload ID: 12394 relates to Category No.: 5561, 5570, 10002; Payload ID: 12395 relates to Category No.: 2890, 9247, 5776, 4755, 2420; Payload ID: 12396 relates to Category No.: 9305, 7118, 2938, 10056, 3113, 4010; Payload ID: 12397 relates to Category No.: 4030, 12159, 4014, 3666, 4010; Payload ID: 12398 relates to Category No.: 4030, 2890; Payload ID: 12399 relates to Category No.: 4030, 9305, 2890, 2942, 4010, 6709, 7118, 7366; Payload ID: 12400 relates to Category No.: 2890, 2942, 4010; Payload ID: 12401 relates to Category No.: 7118, 2890, 2942, 3521, 7060, 4010, 5358, 7366; Payload ID: 12402 relates to Category No.: 9305, 4010, 2890, 2942, 3666, 7118, 4030, 14683; Payload ID: 12403 relates to Category No.: 4030, 9305, 7118, 2890, 5776, 2942, 9734, 7060, 9756, 4010, 2926, 9753; Payload ID: 12404 relates to Category No.: 4030, 6443, 2890, 6717, 2942, 2899, 4010; Payload ID: 12405 relates to Category No.: 2890, 5776, 2942, 9756, 9754, 4010; Payload ID: 12406 relates to Category No.: 5762, 5569, 9756, 9754; Payload ID: 12407 relates to Category No.: 5569, 9756, 9754, 11883; Payload ID: 12408 relates to Category No.: 5569, 6717, 9756, 9754, 4010, 11883; Payload ID: 12409 relates to Category No.: 5569, 9756, 11883, 5822; Payload ID: 12410 relates to Category No.: 5569, 9756, 9754, 9751; Payload ID: 12411 relates to Category No.: 5561, 6717, 5569, 5776, 9756, 9754; Payload ID: 12412 relates to Category No.: 5561, 9305, 6717, 5762, 5776, 9242, 9756, 9754, 11883; Payload ID: 12413 relates to Category No.: 6717, 5569, 3673, 3666, 9756, 9754; Payload ID: 12414 relates to Category No.: 5561, 9305, 2890, 5776, 2942, 9247, 9756, 9754, 11883, 1336; Payload ID: 12415 relates to Category No.: 6717, 5569, 9754, 1691, 9756, 5561; Payload ID: 12416 relates to Category No.: 5569, 9756; Payload ID: 12417 relates to Category No.: 5569, 6717, 5776, 3666, 9247, 9756, 9754, 11883, 12177, 2942; Payload ID: 12418 relates to Category No.: 2890, 4755, 6717, 5762, 2942, 9756, 9754, 11883, 9753, 7118; Payload ID: 12419 relates to Category No.: 2942, 9754, 12406, 2890, 3036; Payload ID: 12420 relates to Category No.: 2890, 2942, 9756, 9754; Payload ID: 12421 relates to Category No.: 2942, 9756, 9753; Payload ID: 12422 relates to Category No.: 5561, 2890, 6717, 9754, 11883, 7118; Payload ID: 12423 relates to Category No.: 5561, 9756, 9754; Payload ID: 12424 relates to Category No.: 5776, 9756, 9754, 7118; Payload ID: 12425 relates to Category No.: 9756, 9305; Payload ID: 12426 relates to Category No.: 9305, 9247; Payload ID: 12427 relates to Category No.: 9305, 9247; Payload ID: 12428 relates to Category No.: 9305, 2942, 9247, 14253, 9734; Payload ID: 12429 relates to Category No.: 9305, 9247, 3393, 2686, 10104, 2890, 2942, 8948, 775, 2949, 9167, 15037, 5611; Payload ID: 12430 relates to Category No.: 9305, 9247, 6653, 7118; Payload ID: 12431 relates to Category No.: 9305, 9247; Payload ID: 12432 relates to Category No.: 5561, 1748, 3113, 5570, 4755, 7118; Payload ID: 12433 relates to Category No.: 4030; Payload ID: 12434 relates to Category No.: 9305, 2890, 6717, 9242, 9247, 11715, 6043, 9609, 2628, 2420; Payload ID: 12435 relates to Category No.: 9305, 9247; Payload ID: 12436 relates to Category No.: 5561, 7118; Payload ID: 12437 relates to Category No.: 7118; Payload ID: 12438 relates to Category No.: 9305, 9242, 11715, 6043; Payload ID: 12439 relates to Category No.: 5561, 7118, 7070; Payload ID: 12440 relates to Category No.: 9305, 10056, 2942; Payload ID: 12441 relates to Category No.: 9305, 2890, 2942, 10003, 10000; Payload ID: 12443 relates to Category No.: 6717; Payload ID: 12444 relates to Category No.: 9305, 2890, 6976, 9247, 14614, 3861; Payload ID: 12445 relates to Category No.: 9133; Payload ID: 12446 relates to Category No.: 9305; Payload ID: 12447 relates to Category No.: 9305, 9242, 9247, 15531, 14583; Payload ID: 12448 relates to Category No.: 9305, 9247; Payload ID: 12449 relates to Category No.: 9305; Payload ID: 12450 relates to Category No.: 9247, 3861; Payload ID: 12451 relates to Category No.: 9305, 2890, 9242, 9247, 2630; Payload ID: 12452 relates to Category No.: 2890, 9247, 5102, 9184, 7179; Payload ID: 12454 relates to Category No.: 9247, 5110, 3355, 9305; Payload ID: 12455 relates to Category No.: 9305; Payload ID: 12456 relates to Category No.: 9305, 2890; Payload ID: 12458 relates to Category No.: 9305, 1842; Payload ID: 12459 relates to Category No.: 9247, 11691, 1635, 15851, 9215, 15848, 9181; Payload ID: 12460 relates to Category No.: 9305, 9242, 9247, 2630; Payload ID: 12461 relates to Category No.: 9305, 6976, 9247; Payload ID: 12462 relates to Category No.: 9305, 9242, 9247, 9184; Payload ID: 12463 relates to Category No.: 2890, 4010; Payload ID: 12464 relates to Category No.: 2942, 4010; Payload ID: 12465 relates to Category No.: 7118, 2890, 7060; Payload ID: 12466 relates to Category No.: 2890, 9796, 6717, 2942; Payload ID: 12467 relates to Category No.: 2890, 6717, 2942, 9796; Payload ID: 12468 relates to Category No.: 2942; Payload ID: 12469 relates to Category No.: 9305, 7118, 2942, 7070; Payload ID: 12470 relates to Category No.: 9305, 2942, 10002, 10000; Payload ID: 12471 relates to Category No.: 2890; Payload ID: 12473 relates to Category No.: 2890; Payload ID: 12474 relates to Category No.: 9305, 2942, 15139, 1748; Payload ID: 12476 relates to Category No.: 9247, 9181; Payload ID: 12477 relates to Category No.: 2890, 6017, 5762; Payload ID: 12478 relates to Category No.: 4029, 9305, 2890, 10056, 2942, 8935, 9247, 1774, 779, 10104, 2918, 7368, 14384, 11653, 7118, 3055; Payload ID: 12479 relates to Category No.: 9305, 2942; Payload ID: 12480 relates to Category No.: 2942; Payload ID: 12482 relates to Category No.: 2942, 3673, 4689; Payload ID: 12483 relates to Category No.: 2890, 3673; Payload ID: 12484 relates to Category No.: 3673, 1842; Payload ID: 12485 relates to Category No.: 10056, 5570, 4755, 3666, 9734; Payload ID: 12486 relates to Category No.: 2942; Payload ID: 12487 relates to Category No.: 9305, 2942, 4010; Payload ID: 12488 relates to Category No.: 5561, 3673, 7061, 7118, 6717, 1336, 14363; Payload ID: 12489 relates to Category No.: 6443, 4010, 5561; Payload ID: 12490 relates to Category No.: 7118, 7048, 3666; Payload ID: 12491 relates to Category No.: 9305, 2942, 9846; Payload ID: 12492 relates to Category No.: 2890, 6717, 2942, 11687, 9850, 9851, 6994, 9756, 997, 1046, 6059, 9849, 9774; Payload ID: 12493 relates to Category No.: 7118, 6717, 1233, 2942, 8935, 5570, 3693, 2899, 5819, 4755, 1748, 8948, 3036, 11723, 2926, 6743, 6440, 4858, 5273; Payload ID: 12494 relates to Category No.: 2890, 6717, 2942; Payload ID: 12495 relates to Category No.: 2890, 10056; Payload ID: 12496 relates to Category No.: 2890, 6717, 2942, 4765, 3693, 9734, 7070, 14295, 5762, 10056; Payload ID: 12497 relates to Category No.: 9305, 6717, 5776, 2495, 4755, 9734, 8948, 11653, 11723, 2534, 16156, 766, 8901, 2504, 5762; Payload ID: 12498 relates to Category No.: 5561, 6717, 3673, 4735; Payload ID: 12499 relates to Category No.: 5561, 3673; Payload ID: 12500 relates to Category No.: 5561, 3673, 4735; Payload ID: 12501 relates to Category No.: 5561, 3673; Payload ID: 12502 relates to Category No.: 5557, 6717, 3673, 3666; Payload ID: 12503 relates to Category No.: 5561, 3673, 3666, 4735; Payload ID: 12504 relates to Category No.: 6717, 3673, 5557, 4801; Payload ID: 12505 relates to Category No.: 5561, 3673; Payload ID: 12506 relates to Category No.: 5561, 3673; Payload ID: 12507 relates to Category No.: 5561, 6717, 3673; Payload ID: 12508 relates to Category No.: 5561, 6717, 3673; Payload ID: 12509 relates to Category No.: 5561, 3673, 4735, 3666; Payload ID: 12510 relates to Category No.: 4735, 5561, 3673; Payload ID: 12511 relates to Category No.: 6717, 3673, 4801; Payload ID: 12512 relates to Category No.: 6717, 3673, 5557, 4801, 2890, 2899; Payload ID: 12513 relates to Category No.: 5561, 6717, 10056, 3673, 5557, 4801; Payload ID: 12514 relates to Category No.: 5561, 3673, 6599; Payload ID: 12515 relates to Category No.: 5561, 3673; Payload ID: 12516 relates to Category No.: 3673, 5561; Payload ID: 12517 relates to Category No.: 5561, 10056, 3673, 4735; Payload ID: 12518 relates to Category No.: 5561, 3673, 3666; Payload ID: 12519 relates to Category No.: 2890, 5762, 4010, 7366; Payload ID: 12520 relates to Category No.: 5762, 4765, 3673, 4010; Payload ID: 12521 relates to Category No.: 5762, 2890, 9247; Payload ID: 12522 relates to Category No.: 2890, 6717, 5762, 3673, 6994, 6222, 4760, 2514; Payload ID: 12523 relates to Category No.: 5561, 5762, 5776, 3652; Payload ID: 12524 relates to Category No.: 2890, 5776, 10056, 2942, 4860, 3054, 9734; Payload ID: 12525 relates to Category No.: 5762, 10056; Payload ID: 12526 relates to Category No.: 2890, 10056, 2942, 9846, 9847, 6017; Payload ID: 12527 relates to Category No.: 9305, 2890, 10056, 2942, 9846; Payload ID: 12528 relates to Category No.: 2890, 10056, 2942, 9846, 6617; Payload ID: 12529 relates to Category No.: 2890, 6717, 10056, 2942, 9848, 6617, 5762, 9846; Payload ID: 12530 relates to Category No.: 9305, 2890, 6717, 10056, 2942, 9846, 4755, 4010, 2504, 16156, 5762; Payload ID: 12531 relates to Category No.: 9305, 2890, 10056, 2942, 9846, 3666, 3636; Payload ID: 12532 relates to Category No.: 2890, 10056, 9846, 2942; Payload ID: 12533 relates to Category No.: 9305, 2890, 10056, 2942, 9247, 6017, 4228, 7274, 9215, 14329; Payload ID: 12534 relates to Category No.: 6717, 2942, 3652, 16026; Payload ID: 12535 relates to Category No.: 9305, 2942, 3652, 9773, 4228, 16026, 14329, 1700; Payload ID: 12536 relates to Category No.: 2890, 6717, 1774; Payload ID: 12537 relates to Category No.: 9305, 10056, 2942, 997, 1842; Payload ID: 12538 relates to Category No.: 10056, 2942, 3673, 9247, 997; Payload ID: 12539 relates to Category No.: 6717, 997, 4010, 3666; Payload ID: 12543 relates to Category No.: 9305, 7118; Payload ID: 12544 relates to Category No.: 5561, 6717, 3673; Payload ID: 12545 relates to Category No.: 5561, 6717, 3673, 5762; Payload ID: 12546 relates to Category No.: 2942, 6717, 8948, 9730; Payload ID: 12547 relates to Category No.: 2942, 1842, 9730; Payload ID: 12548 relates to Category No.: 7060, 7118; Payload ID: 12549 relates to Category No.: 2942; Payload ID: 12550 relates to Category No.: 2942, 8948; Payload ID: 12551 relates to Category No.: 2458, 2942; Payload ID: 12552 relates to Category No.: 9305, 2890, 10056, 2942, 3666, 4755, 9734, 11723, 7060, 6743; Payload ID: 12553 relates to Category No.: 5561, 2942, 6717; Payload ID: 12554 relates to Category No.: 5561, 6717, 2942, 3666, 4755, 4925; Payload ID: 12555 relates to Category No.: 6717, 2942, 9734, 14329, 2890; Payload ID: 12556 relates to Category No.: 2942, 16247, 16326, 2194, 6717, 1772, 11650, 15151, 3055, 3972, 4390; Payload ID: 12557 relates to Category No.: 4030, 2942, 11728; Payload ID: 12558 relates to Category No.: 9305, 2890, 6976, 2194, 4755, 7389; Payload ID: 12559 relates to Category No.: 6717, 2942, 16247, 779, 1402, 2194; Payload ID: 12560 relates to Category No.: 2942, 1842; Payload ID: 12561 relates to Category No.: 10056, 2942, 9999; Payload ID: 12562 relates to Category No.: 10056, 2942, 9999, 10002, 5561; Payload ID: 12563 relates to Category No.: 10056; Payload ID: 12564 relates to Category No.: 2938, 2942, 2927, 11728, 2926; Payload ID: 12565 relates to Category No.: 10056, 9999; Payload ID: 12567 relates to Category No.: 2942; Payload ID: 12568 relates to Category No.: 2942; Payload ID: 12569 relates to Category No.: 2942, 4010; Payload ID: 12570 relates to Category No.: 2942, 1842; Payload ID: 12571 relates to Category No.: 2942, 3666, 4755, 9734, 14363, 14329, 9730; Payload ID: 12572 relates to Category No.: 2890, 2942, 4010; Payload ID: 12573 relates to Category No.: 7118, 7060, 4010; Payload ID: 12574 relates to Category No.: 2890, 6717, 2942, 4010, 175; Payload ID: 12575 relates to Category No.: 2890, 2942, 4010, 779, 175, 14833; Payload ID: 12576 relates to Category No.: 9305, 2890, 6717, 2942, 4010; Payload ID: 12577 relates to Category No.: 2942, 2664, 9734; Payload ID: 12578 relates to Category No.: 7118, 3666, 3671; Payload ID: 12579 relates to Category No.: 2890, 2942, 273, 4010; Payload ID: 12580 relates to Category No.: 2942, 4010; Payload ID: 12581 relates to Category No.: 2942; Payload ID: 12582 relates to Category No.: 2942, 1842; Payload ID: 12583 relates to Category No.: 14363, 1803, 4228, 16326, 3518, 2918, 14999, 2738, 5596, 14924, 1824; Payload ID: 12584 relates to Category No.: 9305, 2942, 4010; Payload ID: 12585 relates to Category No.: 2942, 4010, 7366; Payload ID: 12586 relates to Category No.: 6717, 2942, 4010, 6743; Payload ID: 12587 relates to Category No.: 9305, 2890, 4010, 2458, 14825; Payload ID: 12588 relates to Category No.: 2890, 6717, 2942, 4010; Payload ID: 12589 relates to Category No.: 9305, 2942, 4010; Payload ID: 12590 relates to Category No.: 14833, 2942, 4010; Payload ID: 12592 relates to Category No.: 2942, 4010; Payload ID: 12593 relates to Category No.: 4765, 3696, 6060, 6743, 3523, 2926, 2942, 1811, 9734, 16164, 5762; Payload ID: 12594 relates to Category No.: 6717, 10056, 2942, 2890; Payload ID: 12595 relates to Category No.: 5561, 10056, 4010; Payload ID: 12596 relates to Category No.: 9305, 2890, 6717, 10056, 2942, 9846, 9847, 1811, 2477, 9733; Payload ID: 12597 relates to Category No.: 9305, 2942, 9846; Payload ID: 12598 relates to Category No.: 2942, 9846; Payload ID: 12599 relates to Category No.: 9846; Payload ID: 12600 relates to Category No.: 6717, 2942, 9850, 9851, 9199, 997, 1046, 2926, 6059, 9310, 9849; Payload ID: 12601 relates to Category No.: 9848, 9305, 2890, 6717, 2942, 9846; Payload ID: 12602 relates to Category No.: 9848, 6717, 2942; Payload ID: 12603 relates to Category No.: 5561; Payload ID: 12604 relates to Category No.: 7118, 6717, 2942, 7061, 3666, 9734, 14371, 1423, 14368, 11883, 16156; Payload ID: 12605 relates to Category No.: 4010, 261, 4029; Payload ID: 12606 relates to Category No.: 4029; Payload ID: 12607 relates to Category No.: 5561, 4029, 10056, 5570, 4010, 1792, 12406; Payload ID: 12608 relates to Category No.: 4030, 4029, 1792, 14409; Payload ID: 12609 relates to Category No.: 4030, 4029, 3673, 3666, 4010, 7118, 9734, 14409; Payload ID: 12610 relates to Category No.: 4029; Payload ID: 12611 relates to Category No.: 4029; Payload ID: 12612 relates to Category No.: 4029; Payload ID: 12613 relates to Category No.: 4029, 2942; Payload ID: 12614 relates to Category No.: 4030, 4029, 10056, 2183, 6617; Payload ID: 12615 relates to Category No.: 2890, 7048, 2942, 3673, 2899, 4755, 3666, 9305, 5776, 9734, 16344; Payload ID: 12616 relates to Category No.: 4029, 7048, 2942, 3523; Payload ID: 12617 relates to Category No.: 6717, 2942, 3673, 9247, 9162, 1720; Payload ID: 12618 relates to Category No.: 2942, 2927, 2890; Payload ID: 12619 relates to Category No.: 2942, 6440, 2890; Payload ID: 12620 relates to Category No.: 2942, 6440, 2890, 14329, 16156; Payload ID: 12621 relates to Category No.: 4029, 1792, 10056, 4755, 9734; Payload ID: 12622 relates to Category No.: 4030, 2890, 6717, 6976, 2942, 7118, 5561; Payload ID: 12623 relates to Category No.: 4029, 6333, 2890, 4030; Payload ID: 12624 relates to Category No.: 4029; Payload ID: 12625 relates to Category No.: 4029, 4755, 3666, 5762; Payload ID: 12626 relates to Category No.: 4029; Payload ID: 12627 relates to Category No.: 4030, 6443, 6717, 4010, 7118; Payload ID: 12628 relates to Category No.: 5561, 2942, 9734, 1842, 3666, 2890, 6717; Payload ID: 12629 relates to Category No.: 4010; Payload ID: 12630 relates to Category No.: 4030, 6443, 2942; Payload ID: 12631 relates to Category No.: 4010, 6437, 6443; Payload ID: 12632 relates to Category No.: 5561, 10056, 779; Payload ID: 12633 relates to Category No.: 9305, 2890, 2942, 9157, 4010, 9184, 9215, 7366; Payload ID: 12634 relates to Category No.: 5762, 2942, 2890; Payload ID: 12635 relates to Category No.: 2942, 9247, 11883, 14363; Payload ID: 12636 relates to Category No.: 5762, 2942, 9305, 3036, 11650, 14683, 2890; Payload ID: 12637 relates to Category No.: 2890, 10056, 4010, 2942; Payload ID: 12638 relates to Category No.: 10056, 2514, 2942, 6717, 5762; Payload ID: 12639 relates to Category No.: 2890, 10056, 3666, 9184, 5762; Payload ID: 12640 relates to Category No.: 2890, 10056, 2942, 4765; Payload ID: 12641 relates to Category No.: 2890, 5776, 10056, 2942, 6717; Payload ID: 12642 relates to Category No.: 5762, 2890, 10056, 1842; Payload ID: 12643 relates to Category No.: 2890, 10056, 2942, 2660, 6017, 1774, 14327, 1811, 5762; Payload ID: 12644 relates to Category No.: 5762, 10056, 2942, 4010; Payload ID: 12645 relates to Category No.: 2942, 9305, 9734; Payload ID: 12646 relates to Category No.: 2890, 10056, 5762; Payload ID: 12647 relates to Category No.: 2890, 5762; Payload ID: 12648 relates to Category No.: 5561, 3673, 4010; Payload ID: 12649 relates to Category No.: 5561, 9305, 3666, 15574, 9774, 3673; Payload ID: 12650 relates to Category No.: 5561; Payload ID: 12651 relates to Category No.: 5561, 7070; Payload ID: 12652 relates to Category No.: 6717, 4765, 3673, 3693, 4755, 9734, 3636, 6060, 6440, 779; Payload ID: 12653 relates to Category No.: 10056, 3673, 4755, 16156, 1336; Payload ID: 12654 relates to Category No.: 6717, 10056, 5570, 4010, 5561; Payload ID: 12655 relates to Category No.: 6717, 10056, 5570, 5561; Payload ID: 12656 relates to Category No.: 6717, 10056, 5570, 4755, 447, 4010, 3673; Payload ID: 12657 relates to Category No.: 5561, 10056, 5570; Payload ID: 12658 relates to Category No.: 2890, 10056, 5570, 5561; Payload ID: 12659 relates to Category No.: 5561; Payload ID: 12660 relates to Category No.: 5561, 3673, 9162; Payload ID: 12661 relates to Category No.: 5561, 5570; Payload ID: 12662 relates to Category No.: 5561; Payload ID: 12663 relates to Category No.: 5570, 5561; Payload ID: 12664 relates to Category No.: 5570, 4008; Payload ID: 12665 relates to Category No.: 5570; Payload ID: 12666 relates to Category No.: 9305, 6717, 10056, 9242, 2942, 4014, 5570, 4755, 4010, 6743; Payload ID: 12667 relates to Category No.: 10056, 5561, 9305; Payload ID: 12668 relates to Category No.: 5561, 10056, 4010; Payload ID: 12669 relates to Category No.: 10056; Payload ID: 12670 relates to Category No.: 4030, 4029; Payload ID: 12671 relates to Category No.: 9305, 2890, 2942, 9247; Payload ID: 12672 relates to Category No.: 2890, 2942, 8948; Payload ID: 12673 relates to Category No.: 2890, 2942, 4010, 8948; Payload ID: 12674 relates to Category No.: 2890, 6717, 2942, 9756, 4010; Payload ID: 12675 relates to Category No.: 2942; Payload ID: 12676 relates to Category No.: 2942, 4010; Payload ID: 12677 relates to Category No.: 2942, 6964; Payload ID: 12678 relates to Category No.: 5561, 5762, 10056, 6743; Payload ID: 12679 relates to Category No.: 2942; Payload ID: 12680 relates to Category No.: 2942, 11883, 14159; Payload ID: 12682 relates to Category No.: 4010, 11883, 14159; Payload ID: 12683 relates to Category No.: 11883, 14159; Payload ID: 12684 relates to Category No.: 11883, 14159; Payload ID: 12685 relates to Category No.: 2890, 2942; Payload ID: 12686 relates to Category No.: 6717, 2942, 4010; Payload ID: 12687 relates to Category No.: 2890, 2942, 4010; Payload ID: 12688 relates to Category No.: 2890, 2942, 4010; Payload ID: 12689 relates to Category No.: 10056, 2942, 9979; Payload ID: 12690 relates to Category No.: 10056, 2942, 9979; Payload ID: 12691 relates to Category No.: 9979, 10056, 2942; Payload ID: 12692 relates to Category No.: 2942, 9979; Payload ID: 12693 relates to Category No.: 2942, 9979, 1842; Payload ID: 12694 relates to Category No.: 2890, 10056, 2942, 4010; Payload ID: 12695 relates to Category No.: 2890, 2942, 4010, 14368; Payload ID: 12696 relates to Category No.: 2890, 6717, 4010; Payload ID: 12697 relates to Category No.: 9305, 5776, 9242, 2942, 9247, 1377, 2890, 8948; Payload ID: 12698 relates to Category No.: 2890, 2942, 4010; Payload ID: 12699 relates to Category No.: 2890, 2942, 8935; Payload ID: 12700 relates to Category No.: 7118; Payload ID: 12701 relates to Category No.: 4010; Payload ID: 12702 relates to Category No.: 2890, 9247; Payload ID: 12703 relates to Category No.: 9756, 9753, 7118; Payload ID: 12705 relates to Category No.: 2890, 7118; Payload ID: 12707 relates to Category No.: 6717, 2938, 15139, 1748, 4010, 2939, 5762, 11650, 11721, 5561; Payload ID: 12708 relates to Category No.: 5561, 10056, 3673, 3666, 3686; Payload ID: 12709 relates to Category No.: 5561; Payload ID: 12710 relates to Category No.: 7118, 13728, 9158, 15269; Payload ID: 12711 relates to Category No.: 4029; Payload ID: 12712 relates to Category No.: 9305, 6717; Payload ID: 12716 relates to Category No.: 5561; Payload ID: 12717 relates to Category No.: 7118, 3673, 4735; Payload ID: 12718 relates to Category No.: 11718, 12356; Payload ID: 12720 relates to Category No.: 2890; Payload ID: 12721 relates to Category No.: 5561, 1099, 447; Payload ID: 12722 relates to Category No.: 9305, 2890, 10056; Payload ID: 12723 relates to Category No.: 2890; Payload ID: 12724 relates to Category No.: 2890; Payload ID: 12725 relates to Category No.: 9305, 7118, 2890, 5776, 9242, 9247, 9158, 2630, 2420, 15269, 14893, 5964; Payload ID: 12726 relates to Category No.: 6717, 5727, 10056, 9247, 3113, 1811, 3991, 1635, 9215; Payload ID: 12727 relates to Category No.: 9756, 9753; Payload ID: 12728 relates to Category No.: 9305, 2890; Payload ID: 12729 relates to Category No.: 9305; Payload ID: 12730 relates to Category No.: 5561, 5762, 3652; Payload ID: 12731 relates to Category No.: 7118, 7060; Payload ID: 12732 relates to Category No.: 9305, 2890, 2942; Payload ID: 12733 relates to Category No.: 5561, 9305, 2890, 6717, 4010; Payload ID: 12734 relates to Category No.: 9305, 2890; Payload ID: 12735 relates to Category No.: 2890, 9535, 2417; Payload ID: 12736 relates to Category No.: 2890, 9535, 2417, 10014, 10162, 3064, 9736; Payload ID: 12737 relates to Category No.: 2890; Payload ID: 12738 relates to Category No.: 9305, 2890, 9535, 10029; Payload ID: 12740 relates to Category No.: 677, 4008, 779; Payload ID: 12741 relates to Category No.: 4029, 6717, 4030; Payload ID: 12742 relates to Category No.: 4029, 1842; Payload ID: 12744 relates to Category No.: 4029; Payload ID: 12745 relates to Category No.: 9305, 5776, 5727, 10056, 9247, 3113, 4010; Payload ID: 12746 relates to Category No.: 5561, 9305, 5727, 10056, 9247, 1748, 3113, 447, 1811, 5596; Payload ID: 12747 relates to Category No.: 9305, 3113, 10056, 1811; Payload ID: 12748 relates to Category No.: 2890, 2938, 10056, 14906, 6994, 9734, 3113, 1811, 14903, 7161, 2918, 1810, 11650; Payload ID: 12749 relates to Category No.: 9734, 4010, 1792, 1659, 5561; Payload ID: 12750 relates to Category No.: 4030, 4029, 10056, 1239, 4010, 1792, 10077, 4046; Payload ID: 12751 relates to Category No.: 4030, 4029, 2890, 4010, 1792, 14409, 778; Payload ID: 12752 relates to Category No.: 4030, 4029, 10056, 4010, 1792, 4228, 6717; Payload ID: 12753 relates to Category No.: 5561, 10056, 677, 3673, 4049, 4010, 4228, 3671, 5830, 5570; Payload ID: 12754 relates to Category No.: 5570, 7118; Payload ID: 12755 relates to Category No.: 4029; Payload ID: 12756 relates to Category No.: 4029; Payload ID: 12757 relates to Category No.: 5561, 6717, 4010, 6743, 2608; Payload ID: 12758 relates to Category No.: 4010, 1335, 2890, 15285; Payload ID: 12759 relates to Category No.: 2890, 14953; Payload ID: 12760 relates to Category No.: 4030, 4029, 9305, 2890, 6717, 10056, 4765, 4010, 1792, 3671; Payload ID: 12761 relates to Category No.: 4029, 6717, 4765, 4010, 3671, 4030; Payload ID: 12762 relates to Category No.: 5561, 9773; Payload ID: 12763 relates to Category No.: 4030, 4029, 10077; Payload ID: 12764 relates to Category No.: 4030, 4029; Payload ID: 12765 relates to Category No.: 5561, 4008, 6717, 1772, 6743, 14692; Payload ID: 12766 relates to Category No.: 2890, 10056, 9242, 4010, 2942; Payload ID: 12767 relates to Category No.: 2890, 6717, 4010, 2942; Payload ID: 12768 relates to Category No.: 2194, 2942, 9734, 1720, 6964, 1750, 4010, 9184, 5964, 9162, 903, 7246, 2890, 6968, 5961, 1017, 8935, 8948, 4860, 16156; Payload ID: 12769 relates to Category No.: 2890; Payload ID: 12770 relates to Category No.: 5561, 6717, 5776, 10056, 5570, 9247; Payload ID: 12771 relates to Category No.: 4030, 4029, 6717, 4765, 1792, 6989, 3671, 10077; Payload ID: 12772 relates to Category No.: 4030, 4029, 2890, 6717, 4765, 1099, 1792, 3671, 10077; Payload ID: 12773 relates to Category No.: 9305, 2890, 6717, 10056, 2942, 5570, 11883, 5823; Payload ID: 12774 relates to Category No.: 5561, 9305, 2890, 6717, 10056, 2899, 4010, 4228, 779, 5823, 6437, 1792; Payload ID: 12775 relates to Category No.: 4029, 1842; Payload ID: 12776 relates to Category No.: 4029, 2890, 6717, 2942, 14329; Payload ID: 12777 relates to Category No.: 2890, 2938, 6019, 5762; Payload ID: 12778 relates to Category No.: 10056, 1748, 14327, 5561; Payload ID: 12779 relates to Category No.: 5561, 1748, 8948, 3036; Payload ID: 12780 relates to Category No.: 1748, 11650, 11653, 6717; Payload ID: 12781 relates to Category No.: 6717, 10056, 1748; Payload ID: 12782 relates to Category No.: 2890, 10056, 9247, 4010, 14329; Payload ID: 12784 relates to Category No.: 6717, 4755, 1842; Payload ID: 12785 relates to Category No.: 2890, 6717, 1842; Payload ID: 12786 relates to Category No.: 2890, 6717, 15573; Payload ID: 12787 relates to Category No.: 6717, 2942; Payload ID: 12789 relates to Category No.: 9305, 2890, 1748, 2194, 4010, 16337; Payload ID: 12790 relates to Category No.: 5561, 2890; Payload ID: 12791 relates to Category No.: 12440; Payload ID: 12793 relates to Category No.: 6443, 9305, 3693, 9734, 3696, 6440; Payload ID: 12794 relates to Category No.: 3666, 15627, 3523; Payload ID: 12796 relates to Category No.: 2942; Payload ID: 12800 relates to Category No.: 2890, 2942, 9734, 1811, 3636, 6017, 10056; Payload ID: 12801 relates to Category No.: 2890, 14906, 2514; Payload ID: 12803 relates to Category No.: 2938; Payload ID: 12804 relates to Category No.: 2890, 2938, 10056, 6017, 2710; Payload ID: 12805 relates to Category No.: 4030, 2938; Payload ID: 12807 relates to Category No.: 3696, 6440, 5762; Payload ID: 12808 relates to Category No.: 2890; Payload ID: 12809 relates to Category No.: 5762; Payload ID: 12810 relates to Category No.: 10056; Payload ID: 12811 relates to Category No.: 9305, 2890, 10056, 14329, 7339; Payload ID: 12814 relates to Category No.: 9305, 4010; Payload ID: 12815 relates to Category No.: 10056, 9247, 9242, 2927; Payload ID: 12816 relates to Category No.: 2890, 6717; Payload ID: 12817 relates to Category No.: 2890, 10056, 4010; Payload ID: 12818 relates to Category No.: 1082; Payload ID: 12819 relates to Category No.: 2890, 10056, 1750, 5730, 4228, 1082, 5561; Payload ID: 12821 relates to Category No.: 2890, 2938, 10056, 2942, 14363, 4010, 5730, 4228, 2738, 14367, 4989, 1335, 2649; Payload ID: 12822 relates to Category No.: 9305; Payload ID: 12823 relates to Category No.: 9305, 5776, 9247, 4755; Payload ID: 12824 relates to Category No.: 9305; Payload ID: 12825 relates to Category No.: 4030, 3666, 2890, 4029, 6717, 1090, 8917, 1792, 9734; Payload ID: 12826 relates to Category No.: 9247, 11691, 1635, 2789, 9215, 12218, 3358, 5561; Payload ID: 12827 relates to Category No.: 9305, 2890, 6717, 10056, 5570, 4010, 14431; Payload ID: 12828 relates to Category No.: 6717, 10056, 5570, 14431; Payload ID: 12829 relates to Category No.: 6717, 10056, 5570, 14431; Payload ID: 12830 relates to Category No.: 6717, 10056, 5570, 14431; Payload ID: 12831 relates to Category No.: 4029, 6717, 5762, 10056, 5570, 14431; Payload ID: 12832 relates to Category No.: 6717, 5570, 4010, 1792, 14431; Payload ID: 12833 relates to Category No.: 6717, 10056, 5570, 14431; Payload ID: 12834 relates to Category No.: 6717, 10056, 5570, 14431; Payload ID: 12835 relates to Category No.: 6717, 10056, 5570, 6017, 14431; Payload ID: 12836 relates to Category No.: 4030, 5561, 4029, 2890, 6717, 5762, 10056, 1182, 12406, 3036, 8948; Payload ID: 12837 relates to Category No.: 5561, 6717, 4010; Payload ID: 12840 relates to Category No.: 9305, 7355; Payload ID: 12841 relates to Category No.: 9305, 2890, 9247, 7355, 6968; Payload ID: 12842 relates to Category No.: 9305, 2890, 9247, 9215; Payload ID: 12843 relates to Category No.: 2194, 14906, 2183, 2441; Payload ID: 12844 relates to Category No.: 2194, 14906, 2183, 2441; Payload ID: 12845 relates to Category No.: 5561, 4765; Payload ID: 12846 relates to Category No.: 2194, 2183; Payload ID: 12847 relates to Category No.: 4030, 2890, 10056, 5570, 6017, 4199, 4010, 14327, 6743, 779, 6991, 14647, 1711; Payload ID: 12848 relates to Category No.: 5570; Payload ID: 12849 relates to Category No.: 4030, 2890, 12159; Payload ID: 12850 relates to Category No.: 12159; Payload ID: 12851 relates to Category No.: 5561, 10056, 5570, 6017, 4199, 14327, 6991, 14329, 4201, 6019, 4008; Payload ID: 12852 relates to Category No.: 5762, 9305; Payload ID: 12853 relates to Category No.: 9305, 2890, 9247, 9157; Payload ID: 12854 relates to Category No.: 5561, 4030, 2890, 10056, 5570, 1803, 4010, 1792, 4228; Payload ID: 12855 relates to Category No.: 5561; Payload ID: 12856 relates to Category No.: 5561, 4029, 6717, 10056, 5570, 447, 11723, 1803, 15139, 5776, 1017, 8935, 1643, 4863; Payload ID: 12857 relates to Category No.: 5561, 10056, 5570, 1811, 1803, 4010, 1792, 4228, 16337; Payload ID: 12858 relates to Category No.: 10056, 5570, 11653, 1803, 777, 1811; Payload ID: 12859 relates to Category No.: 10056, 5570, 1803, 4010; Payload ID: 12860 relates to Category No.: 9305, 2890, 2194, 9242, 2942, 14906, 9247, 6994, 6968, 14902, 14893, 14903, 5964, 2634, 2402, 15173, 2632, 2192; Payload ID: 12861 relates to Category No.: 5762, 2194, 3036, 2183, 2402; Payload ID: 12862 relates to Category No.: 9305, 2890, 2194, 9242, 4769, 2402, 3036, 8948; Payload ID: 12863 relates to Category No.: 3185, 2194, 9242, 2942, 2183, 2514, 16317; Payload ID: 12864 relates to Category No.: 2890, 9242; Payload ID: 12865 relates to Category No.: 9305, 2890, 5776, 9247, 7060, 2942; Payload ID: 12866 relates to Category No.: 9305, 7118, 6717, 15505, 9242, 9247, 11883, 9158, 15269, 9162; Payload ID: 12867 relates to Category No.: 9305, 9242, 9247; Payload ID: 12868 relates to Category No.: 9247, 4755, 9305, 2890, 9242; Payload ID: 12869 relates to Category No.: 9162; Payload ID: 12870 relates to Category No.: 9305; Payload ID: 12871 relates to Category No.: 9305, 2890, 6717, 10056; Payload ID: 12872 relates to Category No.: 9305; Payload ID: 12873 relates to Category No.: 5561, 6717, 3673, 3666, 3682, 9162; Payload ID: 12874 relates to Category No.: 9305, 2183, 14614; Payload ID: 12875 relates to Category No.: 9305, 2890, 6717, 14145, 14902, 4010; Payload ID: 12877 relates to Category No.: 5762; Payload ID: 12878 relates to Category No.: 9305, 2890, 6717, 2942; Payload ID: 12879 relates to Category No.: 2890, 2942; Payload ID: 12880 relates to Category No.: 2890; Payload ID: 12881 relates to Category No.: 2890; Payload ID: 12882 relates to Category No.: 9305, 2890, 6717, 2942, 14145, 4010, 1635, 4228, 2907, 2920; Payload ID: 12883 relates to Category No.: 4010; Payload ID: 12884 relates to Category No.: 4010; Payload ID: 12885 relates to Category No.: 4010; Payload ID: 12886 relates to Category No.: 2890, 4010; Payload ID: 12887 relates to Category No.: 2890, 9305, 14145, 2920; Payload ID: 12889 relates to Category No.: 7060; Payload ID: 12890 relates to Category No.: 9305, 2890, 14145, 9247, 9175; Payload ID: 12891 relates to Category No.: 2890; Payload ID: 12892 relates to Category No.: 9305, 2890, 9247; Payload ID: 12893 relates to Category No.: 9305, 2890; Payload ID: 12894 relates to Category No.: 9305, 2890, 6717, 9247; Payload ID: 12895 relates to Category No.: 9305, 2890, 9242, 2942; Payload ID: 12896 relates to Category No.: 5561, 9305; Payload ID: 12897 relates to Category No.: 2890, 6717, 5776, 14145, 9247, 4010; Payload ID: 12898 relates to Category No.: 9305, 2890, 6717, 2942, 14145, 9247, 4010, 4228; Payload ID: 12899 relates to Category No.: 9305, 2942, 14145, 4010; Payload ID: 12900 relates to Category No.: 2890, 14145; Payload ID: 12901 relates to Category No.: 2890; Payload ID: 12902 relates to Category No.: 9753; Payload ID: 12903 relates to Category No.: 9305, 15505, 2942, 7015; Payload ID: 12904 relates to Category No.: 1077, 9158, 5964; Payload ID: 12905 relates to Category No.: 9305, 9247, 9603; Payload ID: 12906 relates to Category No.: 9305, 9247, 9157, 9603, 11683, 14530, 9155; Payload ID: 12907 relates to Category No.: 9305, 9247, 9603, 5561; Payload ID: 12908 relates to Category No.: 9305, 2194, 9242, 9603; Payload ID: 12909 relates to Category No.: 9305, 9603, 11683; Payload ID: 12910 relates to Category No.: 5561, 2890, 2194, 9734, 11728, 4010, 2441, 676, 779, 7161; Payload ID: 12911 relates to Category No.: 4030, 5561, 2942, 2458; Payload ID: 12912 relates to Category No.: 5561, 9305, 2890, 6717, 10056, 4765, 5570, 1099, 11728, 2458, 4010, 4788, 2446, 7246, 10132, 1792, 2942, 4755, 6075; Payload ID: 12913 relates to Category No.: 6717, 2458, 9098, 2446, 1402, 5561; Payload ID: 12914 relates to Category No.: 5561, 6717; Payload ID: 12915 relates to Category No.: 6717, 10056, 4010, 1792, 12406, 1648; Payload ID: 12916 relates to Category No.: 2890, 10056, 3673, 5570, 3666, 1811, 2458, 6017, 4010, 2441, 4197, 9098, 7161, 1085, 2446, 5560, 1082, 7246, 10132, 5556, 2942, 6717, 5561; Payload ID: 12917 relates to Category No.: 5561, 6717, 5776, 10056, 3666, 1792, 9098, 12406, 2446, 1402, 1648; Payload ID: 12918 relates to Category No.: 6717, 5561; Payload ID: 12919 relates to Category No.: 5561, 6717, 10056; Payload ID: 12920 relates to Category No.: 9305, 2890, 9247, 9215, 2920, 8952, 2194, 11728, 2443; Payload ID: 12921 relates to Category No.: 9305, 9247, 9603, 11683, 14530, 9155; Payload ID: 12922 relates to Category No.: 9305, 9247, 9603, 11683, 5029; Payload ID: 12923 relates to Category No.: 9305, 5776, 9247, 273, 9603, 11683; Payload ID: 12924 relates to Category No.: 9305, 5762, 5776, 9247; Payload ID: 12925 relates to Category No.: 9247, 9305; Payload ID: 12926 relates to Category No.: 9305, 2890, 5776, 9247; Payload ID: 12927 relates to Category No.: 2890, 9247, 9305, 9242, 2402, 544, 9162, 9181; Payload ID: 12928 relates to Category No.: 2890, 9247, 544, 9305; Payload ID: 12929 relates to Category No.: 9305, 2890, 6960, 9247, 14902, 11883; Payload ID: 12930 relates to Category No.: 2890, 9247, 493, 3027, 9305, 6717, 9297; Payload ID: 12931 relates to Category No.: 9305, 9247; Payload ID: 12932 relates to Category No.: 9305, 5776, 9247, 3823; Payload ID: 12933 relates to Category No.: 9305, 3823, 401; Payload ID: 12934 relates to Category No.: 9305, 2890, 10056, 9247, 3823; Payload ID: 12935 relates to Category No.: 2890, 9247; Payload ID: 12936 relates to Category No.: 4368, 7118, 4010, 11883, 7068, 7048, 15280; Payload ID: 12937 relates to Category No.: 7060, 4010, 7068, 7031, 7118; Payload ID: 12938 relates to Category No.: 9305, 9247; Payload ID: 12939 relates to Category No.: 9305, 9247; Payload ID: 12940 relates to Category No.: 9247, 2420; Payload ID: 12941 relates to Category No.: 9305, 7118, 9247, 3027; Payload ID: 12942 relates to Category No.: 9305, 9247, 3027; Payload ID: 12943 relates to Category No.: 9305, 7118, 7068; Payload ID: 12944 relates to Category No.: 5776, 9247, 2890, 3991, 9215, 15501; Payload ID: 12945 relates to Category No.: 9305, 3823, 401; Payload ID: 12946 relates to Category No.: 9305, 2890, 9242, 3392, 9247; Payload ID: 12947 relates to Category No.: 9305, 2890, 9242, 3392, 9247; Payload ID: 12948 relates to Category No.: 2942, 3394, 9247, 3392; Payload ID: 12949 relates to Category No.: 3394, 3392, 2942, 9247; Payload ID: 12950 relates to Category No.: 9305, 9242, 3392, 9247; Payload ID: 12951 relates to Category No.: 3393, 2686, 9167, 9305, 9247, 12218; Payload ID: 12952 relates to Category No.: 9305, 6717, 9247, 3393, 2686; Payload ID: 12953 relates to Category No.: 9305, 2890, 9247, 3393, 2686, 6968; Payload ID: 12954 relates to Category No.: 9305, 9247, 3393, 2686, 2903; Payload ID: 12955 relates to Category No.: 9305, 2942, 3394, 3392, 9247, 3393, 2686; Payload ID: 12956 relates to Category No.: 9305, 9242, 2942, 3394, 3392, 9247, 3393, 2686; Payload ID: 12957 relates to Category No.: 9305, 9242, 9247, 3393, 2686, 2903; Payload ID: 12958 relates to Category No.: 9305, 2942, 3394, 3392, 9247, 3393, 2686; Payload ID: 12959 relates to Category No.: 9305, 9242, 9247, 3393, 2686; Payload ID: 12960 relates to Category No.: 9305, 9247, 3393, 2686; Payload ID: 12961 relates to Category No.: 3393, 2686; Payload ID: 12962 relates to Category No.: 3393, 2686; Payload ID: 12963 relates to Category No.: 9305, 2942, 3394, 3392, 9247, 3393, 2686; Payload ID: 12964 relates to Category No.: 9305, 2942, 3394, 3392, 9247, 3393, 2686; Payload ID: 12965 relates to Category No.: 3393, 5241, 9162, 8948; Payload ID: 12966 relates to Category No.: 6717, 2942, 3394, 9247; Payload ID: 12967 relates to Category No.: 2942, 3394, 9247; Payload ID: 12968 relates to Category No.: 9247, 9305, 2942, 3394; Payload ID: 12969 relates to Category No.: 2890, 2942, 3394, 9247, 9157; Payload ID: 12970 relates to Category No.: 9305, 2194, 2942, 3394, 9247; Payload ID: 12971 relates to Category No.: 2942, 3394, 9247; Payload ID: 12972 relates to Category No.: 2942, 3394, 9247, 9157; Payload ID: 12973 relates to Category No.: 2942, 3394, 9247, 9157; Payload ID: 12974 relates to Category No.: 2194, 5776, 2942, 3394, 9247; Payload ID: 12975 relates to Category No.: 9242, 2942, 3394, 9247; Payload ID: 12976 relates to Category No.: 7118, 7060, 7068; Payload ID: 12977 relates to Category No.: 9305, 7118, 2890, 5776, 10056, 2942, 3666, 9247, 6743, 11883, 1659; Payload ID: 12978 relates to Category No.: 4030, 10056, 5570, 4010, 12406; Payload ID: 12979 relates to Category No.: 9242, 9247, 9305, 6717; Payload ID: 12980 relates to Category No.: 5561, 4029, 6717, 4765, 4755, 9734, 4760; Payload ID: 12981 relates to Category No.: 5561, 4765; Payload ID: 12982 relates to Category No.: 5561, 4765; Payload ID: 12983 relates to Category No.: 5561, 4765; Payload ID: 12984 relates to Category No.: 5561, 4765; Payload ID: 12985 relates to Category No.: 5561, 4765; Payload ID: 12986 relates to Category No.: 5561, 4765, 15627; Payload ID: 12987 relates to Category No.: 5561, 4765, 4010; Payload ID: 12988 relates to Category No.: 5561, 4765; Payload ID: 12989 relates to Category No.: 6717, 4765, 4755, 9734, 5559, 4010, 4760, 4769; Payload ID: 12990 relates to Category No.: 5561, 6717, 4765, 4755, 9734, 4010, 4760; Payload ID: 12991 relates to Category No.: 5561, 4765, 4755, 9734, 4010; Payload ID: 12992 relates to Category No.: 5561, 4765, 1842; Payload ID: 12993 relates to Category No.: 5561, 4765, 4755, 9734; Payload ID: 12994 relates to Category No.: 5561, 6717, 4765, 4010; Payload ID: 12995 relates to Category No.: 5561, 4765, 6717; Payload ID: 12996 relates to Category No.: 5561, 4765; Payload ID: 12997 relates to Category No.: 5561, 6060; Payload ID: 12998 relates to Category No.: 5561, 4765; Payload ID: 12999 relates to Category No.: 9305, 6717, 9242, 9247, 4010; Payload ID: 13000 relates to Category No.: 9305, 14912, 8948, 4860; Payload ID: 13001 relates to Category No.: 9305; Payload ID: 13002 relates to Category No.: 7118, 2890, 6717, 7052, 7034; Payload ID: 13003 relates to Category No.: 1842; Payload ID: 13004 relates to Category No.: 7118, 14145, 9247, 4755, 2829; Payload ID: 13005 relates to Category No.: 1842; Payload ID: 13006 relates to Category No.: 5561, 3673, 9199, 9184, 9162; Payload ID: 13007 relates to Category No.: 5561; Payload ID: 13011 relates to Category No.: 4030, 9247, 14140, 9240; Payload ID: 13012 relates to Category No.: 9247, 14140, 14142, 9240; Payload ID: 13013 relates to Category No.: 9247, 9240; Payload ID: 13014 relates to Category No.: 9305, 2890, 9247, 9240; Payload ID: 13015 relates to Category No.: 5561, 6717; Payload ID: 13016 relates to Category No.: 5561, 6717; Payload ID: 13017 relates to Category No.: 3673, 3666, 5561, 5557, 657; Payload ID: 13019 relates to Category No.: 5561, 3673, 3666, 5762; Payload ID: 13020 relates to Category No.: 5561, 4765, 3673, 9305; Payload ID: 13021 relates to Category No.: 5561, 4765, 5815; Payload ID: 13023 relates to Category No.: 3666; Payload ID: 13024 relates to Category No.: 6717, 16257, 10056, 5561; Payload ID: 13025 relates to Category No.: 5561, 6717, 16257, 10056, 5570; Payload ID: 13026 relates to Category No.: 2890, 6717, 16257, 10056, 5570; Payload ID: 13027 relates to Category No.: 6717, 16257, 10056, 5570; Payload ID: 13028 relates to Category No.: 9305; Payload ID: 13029 relates to Category No.: 2890, 9247, 2786, 15243; Payload ID: 13030 relates to Category No.: 2890; Payload ID: 13031 relates to Category No.: 1748, 11653, 11723, 4010; Payload ID: 13032 relates to Category No.: 9305, 9247, 2786; Payload ID: 13035 relates to Category No.: 1748, 11653, 11723, 12406; Payload ID: 13036 relates to Category No.: 2890, 3666, 2786; Payload ID: 13040 relates to Category No.: 2890, 5561; Payload ID: 13044 relates to Category No.: 9305, 2942; Payload ID: 13046 relates to Category No.: 10056, 2942; Payload ID: 13047 relates to Category No.: 1748, 11653, 11723, 12406, 5561; Payload ID: 13049 relates to Category No.: 5561, 16257, 10056, 8948; Payload ID: 13050 relates to Category No.: 5561, 10056, 8948, 1792, 3055, 14363, 16326, 15758, 14683; Payload ID: 13051 relates to Category No.: 5561, 10056, 8948, 2890; Payload ID: 13052 relates to Category No.: 5561, 10056, 8948, 16257, 1099, 6743, 779; Payload ID: 13053 relates to Category No.: 5561, 6717, 16257, 10056, 4010, 779, 1659, 2890, 4008, 3666, 11653, 15280; Payload ID: 13054 relates to Category No.: 5561, 16257, 10056, 5570; Payload ID: 13055 relates to Category No.: 5561, 10056, 5570, 1099; Payload ID: 13056 relates to Category No.: 5561, 16257, 10056, 5570, 15758, 962, 2942, 7118, 3693, 9162, 5776, 3666, 8948, 14363, 1712, 7366, 1016, 5596; Payload ID: 13057 relates to Category No.: 5561, 10056, 5570, 5819; Payload ID: 13058 relates to Category No.: 5561, 5570; Payload ID: 13059 relates to Category No.: 5561, 16257, 10056, 5570, 3036, 8948; Payload ID: 13060 relates to Category No.: 6717, 5561, 10056, 5570; Payload ID: 13061 relates to Category No.: 5570, 5561, 16257, 10056; Payload ID: 13062 relates to Category No.: 5561, 10056; Payload ID: 13063 relates to Category No.: 5561, 16257, 10056, 5570, 5819, 4755, 3036, 3055, 8948, 15758, 14293, 14683, 5596; Payload ID: 13064 relates to Category No.: 5561, 16257, 10056, 5570, 4008, 1792, 15758; Payload ID: 13065 relates to Category No.: 5561, 16257, 10056, 5570, 1748, 11653, 2927, 1099, 3036, 8948; Payload ID: 13066 relates to Category No.: 5561, 16257, 10056, 5570, 4008, 15758; Payload ID: 13067 relates to Category No.: 5561, 16257, 10056, 5570, 4755; Payload ID: 13068 relates to Category No.: 5561, 16257, 10056, 5570, 7389, 6717, 7118, 5776, 14363, 962; Payload ID: 13069 relates to Category No.: 5561, 10056, 5570; Payload ID: 13070 relates to Category No.: 6717, 16257; Payload ID: 13071 relates to Category No.: 6717, 16257; Payload ID: 13072 relates to Category No.: 6717, 16257, 10056; Payload ID: 13073 relates to Category No.: 5561, 12439, 6717, 16257, 10056, 5570, 2899, 15139, 1748, 3036, 9730, 779, 11663, 3693, 5834, 2890, 1336; Payload ID: 13074 relates to Category No.: 10056, 5570; Payload ID: 13075 relates to Category No.: 5570; Payload ID: 13076 relates to Category No.: 10056, 5570; Payload ID: 13077 relates to Category No.: 6717, 5570; Payload ID: 13078 relates to Category No.: 10056, 5570; Payload ID: 13079 relates to Category No.: 6717, 10056, 5570; Payload ID: 13080 relates to Category No.: 10056, 5570; Payload ID: 13081 relates to Category No.: 5570, 10056, 3673, 3666, 16257, 9305, 1792, 1017, 8935, 8948, 1033, 779, 911, 1462; Payload ID: 13082 relates to Category No.: 6717, 10056, 5570, 2942, 5561; Payload ID:

13083 relates to Category No.: 10056, 5570, 11663, 5561; Payload ID: 13084 relates to Category No.: 5570; Payload ID: 13085 relates to Category No.: 6717, 16257, 10056, 5570; Payload ID: 13086 relates to Category No.: 10056, 5570, 6717; Payload ID: 13087 relates to Category No.: 6717, 10056, 5570, 15151; Payload ID: 13088 relates to Category No.: 2890, 6717, 16257, 10056, 5570, 9247, 9176, 3523, 15139, 3036, 1792, 1017, 8948, 9734, 11723, 1016; Payload ID: 13089 relates to Category No.: 6717, 16257, 10056, 5570, 9734, 1792, 2890, 9162, 5762; Payload ID: 13090 relates to Category No.: 5561, 6717, 5762, 10056, 5570; Payload ID: 13091 relates to Category No.: 6717, 16257, 5762, 10056, 5570; Payload ID: 13092 relates to Category No.: 6717, 5762, 10056, 5570, 1792; Payload ID: 13093 relates to Category No.: 6717, 10056, 5570; Payload ID: 13094 relates to Category No.: 6717, 10056, 5570; Payload ID: 13095 relates to Category No.: 6717, 5762, 10056, 5570; Payload ID: 13096 relates to Category No.: 5561, 6717, 16257, 6443, 10056, 2927, 1099, 3521, 6059; Payload ID: 13097 relates to Category No.: 5561, 6717, 16257, 10056, 9087, 1029, 1792; Payload ID: 13098 relates to Category No.: 5561, 6717, 16257, 10056, 9087, 1029, 1792; Payload ID: 13099 relates to Category No.: 5561, 6717, 16257, 10056, 1085, 2890, 8935; Payload ID: 13100 relates to Category No.: 5561, 6717, 16257, 10056; Payload ID: 13101 relates to Category No.: 5561, 6717, 16257, 10056; Payload ID: 13102 relates to Category No.: 5561, 6717, 16257, 5776, 10056; Payload ID: 13103 relates to Category No.: 5561, 6717, 16257, 10056, 4010; Payload ID: 13104 relates to Category No.: 5561, 6717, 16257, 10056, 3666; Payload ID: 13105 relates to Category No.: 5561, 6717, 16257, 10056; Payload ID: 13106 relates to Category No.: 6717, 16257, 10056, 5570; Payload ID: 13107 relates to Category No.: 5561, 6717, 16257, 10056; Payload ID: 13108 relates to Category No.: 5561, 6717, 16257, 5762, 10056, 1748, 14363, 3036, 11653, 1017, 9730, 6075, 8949; Payload ID: 13109 relates to Category No.: 5561, 6717, 16257, 5762, 10056, 3036, 9730, 8949; Payload ID: 13110 relates to Category No.: 6717, 16257, 10056, 2942, 5570, 3666, 2899, 15139, 1748, 8948, 3036, 11723, 9730, 1033, 5921, 9577, 1792, 1017, 779, 11663; Payload ID: 13111 relates to Category No.: 5561, 6717, 16257, 10056; Payload ID: 13112 relates to Category No.: 6717, 16257, 10056, 3673, 5570, 1748, 3036, 11723, 6017, 1017, 9730, 1033, 6019, 8949, 5921; Payload ID: 13113 relates to Category No.: 5561, 6717, 16257, 10056, 1017, 5570, 6743; Payload ID: 13114 relates to Category No.: 5561, 6717, 16257, 10056, 5570, 1017; Payload ID: 13115 relates to Category No.: 6717, 16257, 10056, 5570, 4755, 6743, 1659, 11663, 5596, 2942, 3666, 16326, 9734, 5766; Payload ID: 13116 relates to Category No.: 5561, 6717, 16257, 10056; Payload ID: 13117 relates to Category No.: 5561, 16257, 10056, 3036, 1842, 6717, 8948; Payload ID: 13118 relates to Category No.: 6717, 16257, 10056, 5570, 1748, 11653, 9730, 3055, 5823, 10063, 8949, 8948, 3036; Payload ID: 13119 relates to Category No.: 5561, 6717, 16257, 10056, 14363, 3036, 5570, 8935, 8948, 9732; Payload ID: 13120 relates to Category No.: 5561, 6717, 16257, 10056, 8949, 1016, 3040, 3036, 1792, 8948, 8939; Payload ID: 13121 relates to Category No.: 5561, 6717, 16257, 5762, 10056, 5570, 15139, 1748, 3036, 11653, 1099, 11723, 1017, 9730, 779, 8949, 8948, 15280, 16156, 1016; Payload ID: 13122 relates to Category No.: 5561, 6717, 16257, 10056, 8917, 1016, 1033, 8949, 3040; Payload ID: 13123 relates to Category No.: 5561, 6717, 16257, 10056, 8917, 1033; Payload ID: 13124 relates to Category No.: 2890, 10056, 2942, 4043, 11663, 6717, 16257, 1017, 8948, 9730, 12211, 3037, 5921, 5561; Payload ID: 13125 relates to Category No.: 5561, 2890, 6717, 16257, 6960, 10056, 2942, 4043, 1748, 5921, 10027, 1017, 11650, 1033; Payload ID: 13126 relates to Category No.: 5561, 2890, 10056; Payload ID: 13127 relates to Category No.: 6443, 6717, 16257, 10056, 1792, 779, 16326; Payload ID: 13128 relates to Category No.: 6443, 6717, 16257, 10056, 1792, 5561; Payload ID: 13129 relates to Category No.: 2890, 6717, 16257, 3036, 9730, 8949, 10056; Payload ID: 13130 relates to Category No.: 5561, 6717, 779; Payload ID: 13131 relates to Category No.: 16257; Payload ID: 13132 relates to Category No.: 6717, 16257, 10056, 5570, 11663, 1017, 1033; Payload ID: 13133 relates to Category No.: 5561, 6717, 16257, 10056, 9734; Payload ID: 13134 relates to Category No.: 5561, 6717, 16257, 10056, 9734; Payload ID: 13135 relates to Category No.: 5561, 2890, 6717, 16257, 10056, 4755; Payload ID: 13140 relates to Category No.: 10056; Payload ID: 13141 relates to Category No.: 4030, 1239, 4010; Payload ID: 13142 relates to Category No.: 4030, 1720, 1239, 4010; Payload ID: 13144 relates to Category No.: 5561; Payload ID: 13145 relates to Category No.: 4030, 4010; Payload ID: 13146 relates to Category No.: 4030, 4010; Payload ID: 13147 relates to Category No.: 5561; Payload ID: 13148 relates to Category No.: 2890, 9247, 9305; Payload ID: 13149 relates to Category No.: 9305; Payload ID: 13150 relates to Category No.: 9305, 5776, 9247; Payload ID: 13151 relates to Category No.: 9305, 2890; Payload ID: 13152 relates to Category No.: 9305, 2890, 9247, 15505; Payload ID: 13153 relates to Category No.: 9305, 15505; Payload ID: 13154 relates to Category No.: 9305, 15505; Payload ID: 13155 relates to Category No.: 9305; Payload ID: 13156 relates to Category No.: 9305, 5762; Payload ID: 13157 relates to Category No.: 9305, 8935, 9157; Payload ID: 13158 relates to Category No.: 9305, 9215; Payload ID: 13159 relates to Category No.: 9247, 9305; Payload ID: 13160 relates to Category No.: 9305, 2890, 15505, 2942, 9247; Payload ID: 13161 relates to Category No.: 9305; Payload ID: 13162 relates to Category No.: 9305, 9247, 273; Payload ID: 13163 relates to Category No.: 9305; Payload ID: 13164 relates to Category No.: 9305; Payload ID: 13165 relates to Category No.: 9305, 2890, 9247; Payload ID: 13166 relates to Category No.: 11715, 6043, 5561; Payload ID: 13167 relates to Category No.: 9305, 2890; Payload ID: 13169 relates to Category No.: 5561, 6443; Payload ID: 13170 relates to Category No.: 5561; Payload ID: 13171 relates to Category No.: 5776, 5568, 6440, 5561; Payload ID: 13173 relates to Category No.: 5561, 3666; Payload ID: 13174 relates to Category No.: 9305, 2890; Payload ID: 13175 relates to Category No.: 9305; Payload ID: 13176 relates to Category No.: 9305, 2890; Payload ID: 13177 relates to Category No.: 9305; Payload ID: 13178 relates to Category No.: 9305; Payload ID: 13179 relates to Category No.: 9247, 9305; Payload ID: 13180 relates to Category No.: 9305, 9247; Payload ID: 13181 relates to Category No.: 9305, 2942, 15531; Payload ID: 13182 relates to Category No.: 9305, 4755; Payload ID: 13183 relates to Category No.: 5216, 2890, 9305; Payload ID: 13184 relates to Category No.: 9305; Payload ID: 13185 relates to Category No.: 9305; Payload ID: 13186 relates to Category No.: 9305, 5762, 2420; Payload ID: 13187 relates to Category No.: 9305; Payload ID: 13188 relates to Category No.: 9305, 5762, 9247, 2420; Payload ID: 13189 relates to Category No.: 5561, 3696; Payload ID: 13190 relates to Category No.: 2890; Payload ID: 13191 relates to Category No.: 2890, 10056, 4765, 3673, 1748, 11650, 11653; Payload ID: 13216 relates to Category No.: 5561; Payload ID: 13217 relates to Category No.: 4030; Payload ID: 13218 relates to Category No.: 4030, 3666; Payload ID: 13219 relates to Category No.: 9305, 9247, 2890, 15505; Payload ID: 13220 relates to Category No.: 9305, 15505; Payload ID: 13221 relates to Category No.: 9305, 15505; Payload ID: 13222 relates to Category No.: 9305, 16317; Payload ID: 13223 relates to Category No.: 9305, 6960, 2942; Payload ID: 13224 relates to Category No.: 9305, 10056; Payload ID: 13225 relates to Category No.: 11693; Payload ID: 13226 relates to Category No.: 9305, 7118, 2890, 9242, 9247, 4010, 11693; Payload ID: 13227 relates to Category No.: 9305, 7118, 2890, 2942, 11693; Payload ID: 13228 relates to Category No.: 9305, 2890, 11693; Payload ID: 13229 relates to Category No.: 2890, 11693; Payload ID: 13230 relates to Category No.: 4029; Payload ID: 13231 relates to Category No.: 4029; Payload ID: 13232 relates to Category No.: 4029, 1842; Payload ID: 13233 relates to Category No.: 4029; Payload ID: 13234 relates to Category No.: 4010, 5561; Payload ID: 13235 relates to Category No.: 4029; Payload ID: 13236 relates to Category No.: 4029; Payload ID: 13238 relates to Category No.: 4029; Payload ID: 13239 relates to Category No.: 4029; Payload ID: 13240 relates to Category No.: 9305, 2890; Payload ID: 13241 relates to Category No.: 4029; Payload ID: 13242 relates to Category No.: 4030, 4029, 1239, 4010; Payload ID: 13243 relates to Category No.: 7118, 9247, 11883, 7052; Payload ID: 13244 relates to Category No.: 7052, 7118; Payload ID: 13245 relates to Category No.: 7052, 7118; Payload ID: 13246 relates to Category No.: 7052, 7118; Payload ID: 13247 relates to Category No.: 1182; Payload ID: 13248 relates to Category No.: 5561, 4029, 10056, 3673, 4755, 6709, 7324; Payload ID: 13249 relates to Category No.: 9305, 14912, 15870, 15864, 15856, 9215; Payload ID: 13250 relates to Category No.: 9305, 2890, 6717, 9247, 6222, 14893, 1635, 14614, 15853, 9215, 12218, 3358; Payload ID: 13251 relates to Category No.: 9305, 2890, 9247, 14912, 15864, 9215, 1377, 11883; Payload ID: 13252 relates to Category No.: 9305, 11691, 15864, 15862, 9215, 7179, 1377, 15858, 15866; Payload ID: 13253 relates to Category No.: 9305, 11691, 9184; Payload ID: 13254 relates to Category No.: 11691; Payload ID: 13255 relates to Category No.: 5762, 2601, 15845, 15857; Payload ID: 13256 relates to Category No.: 9305, 9247, 14912, 15864, 9215, 1377, 15863, 14916; Payload ID: 13257 relates to Category No.: 9247, 1635, 2420; Payload ID: 13258 relates to Category No.: 9305, 6717, 5762, 9247, 14912, 1635, 15870, 15864, 9215; Payload ID: 13259 relates to Category No.: 9305, 6717, 9247, 1635, 15870, 9215; Payload ID: 13260 relates to Category No.: 7060, 15543, 7118; Payload ID: 13261 relates to Category No.: 2890, 7060, 15543, 7118; Payload ID: 13262 relates to Category No.: 16057, 6443, 4010, 16149, 10056; Payload ID: 13263 relates to Category No.: 4029, 6717, 16057; Payload ID: 13264 relates to Category No.: 4029; Payload ID: 13265 relates to Category No.: 5561, 9305, 7048, 9734, 1720, 8948, 3054, 1017, 4860, 8917, 1792, 6440, 779, 16326, 2454, 14683, 7118, 6717, 2194, 10056, 4765, 3673, 5570, 3666, 4755, 9184, 5964, 6743, 493, 4388, 14293, 9192, 2926, 5762, 3036, 6755, 11883, 8935; Payload ID: 13266 relates to Category No.: 9305, 7048, 9734, 1720, 8948, 3054, 1017, 4860, 8917, 1792, 6743, 6440, 779, 16326, 2454, 5561, 6717, 2194, 10056, 4765, 3673, 5570, 3666, 4755, 9176, 5964, 11883, 2942, 2441; Payload ID: 13267 relates to Category No.: 5561, 9305, 7118, 7048; Payload ID: 13268 relates to Category No.: 10056, 3673, 5570, 3666, 4755, 4760, 4388, 5561; Payload ID: 13269 relates to Category No.: 7050, 7060, 11883, 4050, 11717; Payload ID: 13271 relates to Category No.: 9305, 2942, 9184; Payload ID: 13272 relates to Category No.: 2890, 9184, 6075, 781; Payload ID: 13273 relates to Category No.: 1842; Payload ID: 13274 relates to Category No.: 9305; Payload ID: 13275 relates to Category No.: 2899, 15573, 2441, 9305; Payload ID: 13276 relates to Category No.: 9305, 7060; Payload ID: 13277 relates to Category No.: 6717, 9247, 11741; Payload ID: 13278 relates to Category No.: 9247, 11741; Payload ID: 13279 relates to Category No.: 9305, 2890, 6717, 10056, 677, 3666, 4755, 4049, 4010, 1792, 6743; Payload ID: 13280 relates to Category No.: 4029; Payload ID: 13281 relates to Category No.: 6717, 10056, 677; Payload ID: 13282 relates to Category No.: 9305, 2890, 10056, 273, 276, 1017, 8935, 8948; Payload ID: 13283 relates to Category No.: 9242, 4010; Payload ID: 13284 relates to Category No.: 9242; Payload ID: 13285 relates to Category No.: 4030, 4014, 4010; Payload ID: 13286 relates to Category No.: 4029, 4010; Payload ID: 13287 relates to Category No.: 3673, 3666, 4010, 14295; Payload ID: 13288 relates to Category No.: 3673, 3666, 4010, 14295; Payload ID: 13289 relates to Category No.: 3666, 3673, 4010, 14295; Payload ID: 13290 relates to Category No.: 4029, 10056, 2890, 8948; Payload ID: 13291 relates to Category No.: 4029, 3036, 1017, 8948, 1033, 9730, 1712, 15133; Payload ID: 13292 relates to Category No.: 9305, 2890, 6717, 2938, 2942, 1720, 1239, 4010, 4228; Payload ID: 13293 relates to Category No.: 2890, 2938, 4010, 15280, 5561; Payload ID: 13294 relates to Category No.: 9305, 2890, 2938; Payload ID: 13295 relates to Category No.: 273, 1720; Payload ID: 13296 relates to Category No.: 4030, 4010; Payload ID: 13297 relates to Category No.: 4029; Payload ID: 13298 relates to Category No.: 4030, 9305, 2194, 2182; Payload ID: 13299 relates to Category No.: 9305, 9247, 7070; Payload ID: 13300 relates to Category No.: 5561, 6717, 9242, 3673, 3666, 3652, 4010; Payload ID: 13301 relates to Category No.: 5561, 6717, 3652; Payload ID: 13302 relates to Category No.: 5561, 4765, 4755; Payload ID: 13303 relates to Category No.: 5561; Payload ID: 13304 relates to Category No.: 5561; Payload ID: 13305 relates to Category No.: 5561; Payload ID: 13306 relates to Category No.: 5561; Payload ID: 13307 relates to Category No.: 5561, 10056; Payload ID: 13308 relates to Category No.: 5561, 10056; Payload ID: 13309 relates to Category No.: 5561, 10056, 4008; Payload ID: 13310 relates to Category No.: 5561, 10056, 3652, 4010; Payload ID: 13311 relates to Category No.: 2890, 10056, 2942, 4765, 4755, 4010; Payload ID: 13312 relates to Category No.: 9305, 5762, 9242, 14671, 2942; Payload ID: 13313 relates to Category No.: 9305, 2890, 4010; Payload ID: 13314 relates to Category No.: 2890, 6717; Payload ID: 13315 relates to Category No.: 9305, 2890, 2942, 9247; Payload ID: 13316 relates to Category No.: 9305, 2890, 4010; Payload ID: 13317 relates to Category No.: 9305, 2890, 3673, 3693, 3666, 4010, 9184, 2926, 3669; Payload ID: 13318 relates to Category No.: 2890, 6717, 6976, 2942, 4010, 4228, 6709, 3669, 5392, 4032, 7366; Payload ID: 13319 relates to Category No.: 9247, 15848; Payload ID: 13320 relates to Category No.: 5561, 2890; Payload ID: 13321 relates to Category No.: 9305, 7118, 2890, 6717, 7048, 10056, 5570, 9247, 3521, 4010, 1792, 7366; Payload ID: 13322 relates to Category No.: 6717, 9305, 7118, 2890, 7048, 7070, 4010, 1772, 1792, 11883, 9181; Payload ID: 13323 relates to Category No.: 4029; Payload ID: 13324 relates to Category No.: 4029, 2942; Payload ID: 13325 relates to Category No.: 5561, 10056, 5570; Payload ID: 13326 relates to Category No.: 5561, 10056, 5570; Payload ID: 13327 relates to Category No.: 4029, 5762; Payload ID: 13328 relates to Category No.: 5561, 4029, 6717, 10056, 1792, 3695, 5762; Payload ID:

13329 relates to Category No.: 5561, 9305, 6717, 4765, 3673; Payload ID: 13330 relates to Category No.: 4029, 2890; Payload ID: 13331 relates to Category No.: 5561, 10056, 5570; Payload ID: 13332 relates to Category No.: 4030, 4029, 9305, 4010, 779; Payload ID: 13333 relates to Category No.: 9305, 2890, 2194, 9247, 4010, 9158, 15269, 3359, 9209, 9604, 9605; Payload ID: 13334 relates to Category No.: 9305, 2890, 6717, 9242, 14145, 9247, 4010; Payload ID: 13338 relates to Category No.: 7048, 7060; Payload ID: 13339 relates to Category No.: 7048, 7118; Payload ID: 13340 relates to Category No.: 9305, 2890, 6717; Payload ID: 13342 relates to Category No.: 9305; Payload ID: 13364 relates to Category No.: 4010; Payload ID: 13373 relates to Category No.: 4030; Payload ID: 13374 relates to Category No.: 15466; Payload ID: 13375 relates to Category No.: 15466, 7118; Payload ID: 13376 relates to Category No.: 5561, 1748, 11653; Payload ID: 13377 relates to Category No.: 2890, 2701; Payload ID: 13378 relates to Category No.: 4029, 5570, 5561; Payload ID: 13379 relates to Category No.: 4029, 5570; Payload ID: 13380 relates to Category No.: 4029, 5561; Payload ID: 13381 relates to Category No.: 5561, 4029; Payload ID: 13382 relates to Category No.: 5561, 15139, 1748, 5823; Payload ID: 13383 relates to Category No.: 4030, 4029; Payload ID: 13385 relates to Category No.: 2890, 5762, 4010, 7118; Payload ID: 13386 relates to Category No.: 9305, 9242, 9247, 2890, 6717, 7179, 15532; Payload ID: 13387 relates to Category No.: 4030, 4029, 12159, 4014, 4010, 4763, 6437, 4032; Payload ID: 13389 relates to Category No.: 2890, 2942, 14906, 9247, 6994, 6968, 14902, 14893; Payload ID: 13390 relates to Category No.: 4029; Payload ID: 13392 relates to Category No.: 4755; Payload ID: 13393 relates to Category No.: 9305, 2890, 6717, 5776, 4010; Payload ID: 13395 relates to Category No.: 6717; Payload ID: 13396 relates to Category No.: 9305; Payload ID: 13397 relates to Category No.: 9305, 2903; Payload ID: 13399 relates to Category No.: 4029, 1842; Payload ID: 13400 relates to Category No.: 4029; Payload ID: 13403 relates to Category No.: 4030; Payload ID: 13404 relates to Category No.: 5561, 10056, 15139, 1748; Payload ID: 13405 relates to Category No.: 5561, 10056, 15139, 1748; Payload ID: 13406 relates to Category No.: 5561; Payload ID: 13407 relates to Category No.: 5561; Payload ID: 13408 relates to Category No.: 6717, 2938, 2942, 9734, 6017, 2514, 16026; Payload ID: 13409 relates to Category No.: 6717, 2942, 2938; Payload ID: 13410 relates to Category No.: 6717, 12159, 3666, 4010, 3671, 6454, 2890, 9305; Payload ID: 13411 relates to Category No.: 3666, 4755, 1090, 3671; Payload ID: 13412 relates to Category No.: 3671; Payload ID: 13413 relates to Category No.: 9242, 2632, 15173; Payload ID: 13414 relates to Category No.: 7118, 6717, 5776, 3666, 3671, 11751; Payload ID: 13415 relates to Category No.: 9305, 2890, 5776, 3666, 3671, 11751; Payload ID: 13416 relates to Category No.: 3666, 3671; Payload ID: 13417 relates to Category No.: 4029, 3666, 4008, 4010, 4228, 6709, 3671, 3685, 11751, 3668, 1700; Payload ID: 13418 relates to Category No.: 5561, 3673; Payload ID: 13419 relates to Category No.: 2890, 6717, 9305; Payload ID: 13420 relates to Category No.: 2942, 4755, 2938; Payload ID: 13421 relates to Category No.: 6443, 10056, 4010, 1084; Payload ID: 13422 relates to Category No.: 7060, 7118; Payload ID: 13423 relates to Category No.: 4029, 9305; Payload ID: 13424 relates to Category No.: 5561, 4030, 10056, 3666, 4010, 1792, 10002, 779, 16156, 6991, 3685, 10003, 5570, 1774, 1335, 14953, 6989; Payload ID: 13425 relates to Category No.: 5561, 5570, 1099, 2458, 4010, 1774, 2926, 1792, 6989, 6743, 779, 6991, 2446, 6958, 11785, 10056; Payload ID: 13426 relates to Category No.: 9305, 2890, 5762, 9242, 2942, 9247, 9184, 3523, 10104, 9181, 4044; Payload ID: 13427 relates to Category No.: 4030, 4029, 2890, 14409, 9753, 14411; Payload ID: 13428 relates to Category No.: 9305, 15505; Payload ID: 13429 relates to Category No.: 2942, 7060, 7118, 4029; Payload ID: 13430 relates to Category No.: 7118, 2942, 7060, 232; Payload ID: 13431 relates to Category No.: 4030, 4029, 10077; Payload ID: 13432 relates to Category No.: 4030, 15627, 14411; Payload ID: 13433 relates to Category No.: 4010, 4030, 15573, 14409; Payload ID: 13434 relates to Category No.: 4030, 6717, 15627, 14411, 3036, 8948, 14409, 9730; Payload ID: 13435 relates to Category No.: 4030, 5561, 261; Payload ID: 13436 relates to Category No.: 4030, 5561, 4755, 14409, 4763; Payload ID: 13437 relates to Category No.: 4030, 6717, 4014, 3666, 1792, 4763; Payload ID: 13438 relates to Category No.: 5559, 5561; Payload ID: 13439 relates to Category No.: 4030, 6443, 2890, 10056, 3666, 4755, 9734, 3521, 1792, 6059, 4046, 9607, 9606, 4029, 3831, 14293; Payload ID: 13440 relates to Category No.: 4030, 5561, 6443, 4029, 5776, 9242, 9247, 4755, 4010, 6440, 6437, 7118; Payload ID: 13441 relates to Category No.: 4030, 6443, 2890, 6440; Payload ID: 13442 relates to Category No.: 9305, 2890; Payload ID: 13443 relates to Category No.: 9305; Payload ID: 13444 relates to Category No.: 5561, 10056; Payload ID: 13445 relates to Category No.: 5561, 5762, 10056, 8935, 5570; Payload ID: 13446 relates to Category No.: 4030, 4029, 3673, 4755, 9734, 4010, 9184, 14293; Payload ID: 13447 relates to Category No.: 5561, 10056, 5570; Payload ID: 13448 relates to Category No.: 5561, 10056, 5570; Payload ID: 13449 relates to Category No.: 5561, 10056, 5570, 9162, 2942, 1792, 8935, 8948, 1336, 9184, 12216; Payload ID: 13450 relates to Category No.: 5561, 5762, 10056, 8948, 9184, 8942; Payload ID: 13451 relates to Category No.: 5561, 6717, 3673, 2890, 9164, 5776, 9734; Payload ID: 13452 relates to Category No.: 5561, 7118, 4765, 9734, 9305, 2942; Payload ID: 13453 relates to Category No.: 9305, 2890, 2942, 9247, 2420, 15269, 4010, 15252; Payload ID: 13455 relates to Category No.: 5561, 4029, 2890, 10056, 5570; Payload ID: 13456 relates to Category No.: 5561, 3673, 4755, 1792; Payload ID: 13457 relates to Category No.: 5561, 10056, 2942, 5570; Payload ID: 13458 relates to Category No.: 4030, 5561, 9305, 3673, 3666, 1659, 2890; Payload ID: 13459 relates to Category No.: 2890, 4010; Payload ID: 13460 relates to Category No.: 2890, 4010; Payload ID: 13461 relates to Category No.: 9305, 2890, 5776, 3673, 4010, 10002, 9162; Payload ID: 13462 relates to Category No.: 9305, 2890, 3673, 8935, 3666, 3671, 11883, 1659; Payload ID: 13463 relates to Category No.: 9305, 2890; Payload ID: 13464 relates to Category No.: 4029; Payload ID: 13465 relates to Category No.: 4030; Payload ID: 13466 relates to Category No.: 4029; Payload ID: 13467 relates to Category No.: 262; Payload ID: 13468 relates to Category No.: 5561, 10056, 4765, 4755, 3521, 3696, 6059; Payload ID: 13469 relates to Category No.: 9305; Payload ID: 13470 relates to Category No.: 9305, 5561; Payload ID: 13471 relates to Category No.: 10056, 677, 4010; Payload ID: 13472 relates to Category No.: 5561, 10056, 4765, 3696, 3523; Payload ID: 13473 relates to Category No.: 9305, 5776, 10056, 9734; Payload ID: 13474 relates to Category No.: 9305, 9247, 9273; Payload ID: 13475 relates to Category No.: 9305, 9247, 9273; Payload ID: 13476 relates to Category No.: 9305, 9273, 1842, 2890; Payload ID: 13478 relates to Category No.: 4029, 10056; Payload ID: 13479 relates to Category No.: 4030, 4029, 1239, 4010; Payload ID: 13480 relates to Category No.: 6717, 10056, 1017, 2926, 15139, 3036, 15280, 15145; Payload ID: 13481 relates to Category No.: 5561, 6443, 3693, 2899; Payload ID: 13482 relates to Category No.: 4030, 4029, 4014; Payload ID: 13483 relates to Category No.: 2890, 6717, 10056, 677; Payload ID: 13484 relates to Category No.: 4029; Payload ID: 13485 relates to Category No.: 9305, 4010; Payload ID: 13486 relates to Category No.: 4030, 4029, 4010; Payload ID: 13487 relates to Category No.: 4030; Payload ID: 13488 relates to Category No.: 4029, 7118; Payload ID: 13489 relates to Category No.: 2890, 12159; Payload ID: 13490 relates to Category No.: 4029, 9305; Payload ID: 13491 relates to Category No.: 4029; Payload ID: 13492 relates to Category No.: 4029, 2890, 678; Payload ID: 13495 relates to Category No.: 4029; Payload ID: 13496 relates to Category No.: 2890, 3666; Payload ID: 13497 relates to Category No.: 4029, 2890; Payload ID: 13498 relates to Category No.: 4029, 2890; Payload ID: 13499 relates to Category No.: 5561, 2942; Payload ID: 13500 relates to Category No.: 3666; Payload ID: 13501 relates to Category No.: 4029; Payload ID: 13502 relates to Category No.: 4029; Payload ID: 13503 relates to Category No.: 4030, 5561, 4029, 10056, 4010; Payload ID: 13504 relates to Category No.: 4029, 4010; Payload ID: 13505 relates to Category No.: 11836, 5561; Payload ID: 13506 relates to Category No.: 9305, 2890, 3666; Payload ID: 13507 relates to Category No.: 9305; Payload ID: 13508 relates to Category No.: 11836; Payload ID: 13510 relates to Category No.: 9305, 2890, 2942, 11837; Payload ID: 13511 relates to Category No.: 9305, 2890, 6717, 2942, 9247, 11836, 1748, 11839, 1088, 9208, 2948, 11832, 11839; Payload ID: 13512 relates to Category No.: 11839, 1088, 9208, 2948, 9305, 2890, 6717, 2942, 9247, 11836, 2903, 11832; Payload ID: 13513 relates to Category No.: 2890, 11839, 1088, 9208, 2948, 9305, 6717, 2942, 9247, 11836, 2903, 11832; Payload ID: 13514 relates to Category No.: 9305, 2890, 6717, 2942, 9247, 11836, 11839, 1088, 9208, 2948, 11832, 5412; Payload ID: 13515 relates to Category No.: 11839, 1088, 9208, 2948, 9305, 2890, 6717, 2942, 9247, 11836, 1239, 4010, 2926, 11832, 11839, 5412; Payload ID: 13516 relates to Category No.: 2890, 11839, 1088, 9208, 2948, 11832, 5412, 9305, 6717, 2942, 9247, 11836, 4010; Payload ID: 13517 relates to Category No.: 9305, 6717, 2942, 9247, 11836, 11839, 1088, 4010, 11839, 11832, 11841; Payload ID: 13518 relates to Category No.: 9305, 2890, 2942, 9247, 11836, 11839, 1088, 5730, 11839; Payload ID: 13519 relates to Category No.: 9305, 6717, 2942, 9247, 11836, 4010, 11832, 11839; Payload ID: 13520 relates to Category No.: 6717, 2942, 9247, 11836, 9208, 4010, 11839, 11839, 6179, 11832; Payload ID: 13521 relates to Category No.: 9305, 6717, 2942, 9247, 11836, 4010, 11839, 11839, 6179, 11832; Payload ID: 13522 relates to Category No.: 9305, 2942, 9247, 11836, 4010, 11839, 6179, 11832, 2948; Payload ID: 13523 relates to Category No.: 9305, 6717, 2942, 9247, 11836, 11839, 1088, 4010, 11839, 11832, 11841; Payload ID: 13524 relates to Category No.: 9305, 2890, 6717, 2942, 9247, 11836, 4010, 11839, 6179, 11832, 11839; Payload ID: 13525 relates to Category No.: 2890, 2942, 9247, 11836, 11839, 1088, 11832; Payload ID: 13526 relates to Category No.: 2942, 9247, 11836, 11839, 1088, 11832; Payload ID: 13527 relates to Category No.: 2942, 9247, 11836, 4010, 11839, 11832; Payload ID: 13528 relates to Category No.: 9305, 6717, 2942, 9247, 11836, 4010, 11839; Payload ID: 13529 relates to Category No.: 9305, 2942, 9247, 11836, 4010, 11839, 11839, 6179, 11832; Payload ID: 13530 relates to Category No.: 9305, 2890, 2942, 9247, 11839, 1088, 11839; Payload ID: 13531 relates to Category No.: 2890, 2942, 11833, 9247, 11836, 4010; Payload ID: 13532 relates to Category No.: 11833, 6717, 2942, 9247, 11836, 4010; Payload ID: 13533 relates to Category No.: 11833, 9305, 2890, 6717, 2942, 9247, 11836; Payload ID: 13534 relates to Category No.: 9305, 2942, 9215, 14839; Payload ID: 13535 relates to Category No.: 2890, 6717, 2942, 11837, 3666, 9247; Payload ID: 13536 relates to Category No.: 9305, 2890, 2942, 3666, 9247, 9418; Payload ID: 13537 relates to Category No.: 9305, 11837, 595, 2890, 2194, 2942, 11837, 9247, 11836, 10162, 4010; Payload ID: 13538 relates to Category No.: 9305, 11837, 595, 2890, 2942, 11837, 9247, 11836, 2903, 4010; Payload ID: 13539 relates to Category No.: 9305, 11837, 595, 2890, 2942, 11837, 9247, 11836, 4010; Payload ID: 13540 relates to Category No.: 11837, 9305, 11837, 595, 2890, 5776, 10056, 2942, 9247, 11836, 2903, 4010; Payload ID: 13541 relates to Category No.: 9305, 11837, 595, 2890, 2942, 11837, 9247, 11836, 4010; Payload ID: 13542 relates to Category No.: 9305, 11837, 595, 2890, 2942, 11837, 9247, 11836, 10162, 14364, 2903, 4010, 7389, 9181; Payload ID: 13543 relates to Category No.: 2890, 11837, 9305, 11837, 595, 2942, 9247, 11836, 4010; Payload ID: 13544 relates to Category No.: 9305, 11837, 595, 2890, 2942, 11837, 4010, 14839; Payload ID: 13545 relates to Category No.: 9305, 2890, 2942, 11837, 9247, 11836, 4010; Payload ID: 13546 relates to Category No.: 2890, 2942, 11837, 9247, 11836, 14839; Payload ID: 13547 relates to Category No.: 9305, 2890, 6717, 2942, 11837, 9247, 11836, 4010; Payload ID: 13548 relates to Category No.: 9305, 7118, 2890, 2942, 11837, 9247, 273, 11836, 4755, 4010; Payload ID: 13549 relates to Category No.: 9305, 2890, 2942, 11837, 9247, 11836, 4010; Payload ID: 13550 relates to Category No.: 2890, 11837, 9305, 2194, 2942, 9247, 11836, 4010; Payload ID: 13551 relates to Category No.: 9305, 2890, 2942, 11837, 9247, 11836, 4755, 4010; Payload ID: 13552 relates to Category No.: 9305, 2890, 2942, 11837, 9247, 11836, 4010; Payload ID: 13553 relates to Category No.: 2890, 11837, 2942, 9247, 11836, 4010, 14839, 9305; Payload ID: 13555 relates to Category No.: 9305, 2890, 9247, 2420, 15269, 9218, 9158, 15269, 15272; Payload ID: 13556 relates to Category No.: 2942, 9305, 2890, 9247; Payload ID: 13557 relates to Category No.: 9305, 2890, 9242, 2942, 9247, 12392; Payload ID: 13558 relates to Category No.: 2890, 2942, 14174, 5561; Payload ID: 13559 relates to Category No.: 9305, 2890, 2942, 9247, 4755, 6921, 5216, 11883; Payload ID: 13560 relates to Category No.: 9305, 2942, 9247; Payload ID: 13561 relates to Category No.: 9305, 10056, 9242, 2942, 9247; Payload ID: 13562 relates to Category No.: 10056, 2942; Payload ID: 13564 relates to Category No.: 5776, 2942, 2903, 1674, 10104, 9215; Payload ID: 13565 relates to Category No.: 9305, 2890, 14145, 2903; Payload ID: 13566 relates to Category No.: 4029, 3666, 4755, 3671, 4763, 4030; Payload ID: 13567 relates to Category No.: 4029, 10056, 5570, 4010, 1792, 4228, 2194; Payload ID: 13568 relates to Category No.: 3666, 3671, 1700; Payload ID: 13569 relates to Category No.: 9305, 3666, 4010, 1792, 4228, 6709, 3671, 7366, 1700; Payload ID: 13570 relates to Category No.: 3666, 1792, 6709, 3671, 1700; Payload ID: 13571 relates to Category No.: 3673, 3671, 1700; Payload ID: 13572 relates to Category No.: 10056, 3673, 3666, 4010, 6709, 3671, 3685, 3668; Payload ID: 13573 relates to Category No.: 3666; Payload ID: 13574 relates to Category No.: 1368; Payload ID: 13575 relates to Category No.: 9305, 9247, 10104, 9215; Payload ID: 13576 relates to Category No.: 9305, 9247, 10104, 9215, 9155; Payload ID: 13577 relates to Category No.: 9305, 2890, 15139, 3036; Payload ID: 13578 relates to Category No.: 9305, 2890, 9247, 10104, 9181, 15543; Payload ID: 13579 relates to Category No.:

4029; Payload ID: 13580 relates to Category No.: 15139, 2890, 2938, 10056, 8935, 4755, 9734, 1748, 11653, 11723, 3638, 7118, 8951; Payload ID: 13581 relates to Category No.: 9305, 2890; Payload ID: 13582 relates to Category No.: 9305, 2890; Payload ID: 13583 relates to Category No.: 9305, 2890; Payload ID: 13584 relates to Category No.: 2890, 6717, 10056, 2942, 3693, 15139, 9734, 1748, 2927, 6756, 1033, 14329, 7366, 2664; Payload ID: 13585 relates to Category No.: 3693, 6756, 2890, 2938, 5776, 9247, 2927, 4049, 3521, 12440, 4010, 4228, 1659, 14329, 2942, 1811; Payload ID: 13586 relates to Category No.: 2890, 10056, 3693, 9247, 6756, 4010; Payload ID: 13587 relates to Category No.: 5762, 3666, 3671; Payload ID: 13588 relates to Category No.: 2890, 10056, 7118, 2942, 7061, 3666, 9247, 9734, 4010, 9305, 10002, 6717, 8948, 3036, 778, 5762; Payload ID: 13589 relates to Category No.: 9305, 2890, 10056, 2942, 9247, 4010, 6717, 5762; Payload ID: 13590 relates to Category No.: 9305, 7118, 2890, 10056, 2942, 3666, 9247, 9734, 4010, 1811, 6717, 9181, 5762; Payload ID: 13591 relates to Category No.: 2890, 11883, 1659; Payload ID: 13592 relates to Category No.: 9305, 2890, 2938, 10056, 2942, 3666, 4755, 9734, 1772, 6717, 7118; Payload ID: 13593 relates to Category No.: 5762, 2890, 10056, 2942, 4010, 1811, 6717; Payload ID: 13594 relates to Category No.: 5762, 10056, 2942, 9734, 3036, 2890, 9305, 1811, 8951, 15147, 8935; Payload ID: 13595 relates to Category No.: 9305, 2890, 10056, 2942, 3693, 6968, 4010, 5597, 779, 778, 14384, 4765, 11883, 1182, 1750; Payload ID: 13596 relates to Category No.: 10056, 2942, 2890, 5392, 9305, 6717, 8917, 14363, 5762; Payload ID: 13597 relates to Category No.: 2890, 6717, 10056, 2942, 3693, 1748, 1811, 4010, 16156, 9305, 1182, 9181, 9162, 11883, 1720, 779, 6976, 1028, 774, 7367, 5776, 6743, 9734, 1750, 4197, 5762; Payload ID: 13598 relates to Category No.: 2890, 10056, 2942, 5570, 4755, 15573, 9305, 1811, 1720, 5762; Payload ID: 13599 relates to Category No.: 9305, 2890, 10056, 9247, 4755, 5762; Payload ID: 13600 relates to Category No.: 2890, 6717, 9247, 5762; Payload ID: 13601 relates to Category No.: 4029, 4755; Payload ID: 13602 relates to Category No.: 9305, 2890, 10056, 2942, 3693, 9247, 6994, 2514, 2899; Payload ID: 13603 relates to Category No.: 5561, 2194, 9247, 5730, 9305, 2890, 10056, 2942, 6994, 9734, 1748, 6017, 777, 2514; Payload ID: 13604 relates to Category No.: 9305, 4755, 9734; Payload ID: 13605 relates to Category No.: 9305, 2890, 5762, 2942, 9247, 9291, 11883, 779; Payload ID: 13606 relates to Category No.: 2890, 2942, 9247, 9291, 9305; Payload ID: 13607 relates to Category No.: 2942, 9305, 11883, 9291; Payload ID: 13608 relates to Category No.: 2942, 9247, 9291, 1474; Payload ID: 13609 relates to Category No.: 6717, 2942, 9291, 4010, 9305; Payload ID: 13610 relates to Category No.: 4030, 2942, 9247, 9291; Payload ID: 13611 relates to Category No.: 4030, 2942, 9291; Payload ID: 13612 relates to Category No.: 9305, 7118, 6717, 2194, 2942, 9247, 9291, 7244, 4010, 2443, 14828, 1402, 10063, 1474; Payload ID: 13613 relates to Category No.: 2194, 10056, 2942, 9247, 4010, 2443, 1474, 9305, 2890, 9734; Payload ID: 13614 relates to Category No.: 2942, 9247, 2443; Payload ID: 13615 relates to Category No.: 2890, 6717, 2942, 9291, 11883, 2443, 5392, 10063, 1474, 8917; Payload ID: 13616 relates to Category No.: 10056, 2942, 2443, 1474; Payload ID: 13617 relates to Category No.: 2890, 6717, 2194, 10056, 2942, 9291, 4010, 4228, 2443, 10063, 1474; Payload ID: 13618 relates to Category No.: 2890, 2194, 10056, 2942, 3054, 4010, 3055, 2443, 1474, 3036, 7048, 6743, 8948, 9734; Payload ID: 13619 relates to Category No.: 2890, 10056, 2942, 4755; Payload ID: 13620 relates to Category No.: 2942, 779, 10056, 6717, 9184; Payload ID: 13621 relates to Category No.: 9305, 6717, 15505, 9242, 2942, 9247, 9158, 15269, 9095, 3389; Payload ID: 13622 relates to Category No.: 2890, 6717, 2942, 9247, 9734, 5762; Payload ID: 13623 relates to Category No.: 6717, 2942, 4765, 3673, 3666, 9247, 4755, 2890, 9305; Payload ID: 13624 relates to Category No.: 9305, 2890; Payload ID: 13625 relates to Category No.: 6717, 3666; Payload ID: 13626 relates to Category No.: 3673, 4755; Payload ID: 13627 relates to Category No.: 4010, 3671; Payload ID: 13628 relates to Category No.: 5561, 4765; Payload ID: 13629 relates to Category No.: 5561, 3673, 3666; Payload ID: 13630 relates to Category No.: 9305, 2890, 10056, 9242, 2942, 9247, 4010, 12231, 7180, 3055, 8935, 8948, 9730, 4689, 12085; Payload ID: 13631 relates to Category No.: 9305, 9242, 2942, 9247, 4010, 4228, 12231, 7180, 2890, 4689, 12085; Payload ID: 13632 relates to Category No.: 9305, 7118, 2890, 9242, 2942, 6994, 2630, 4228, 11883, 9215, 2514, 12231, 7180, 3055; Payload ID: 13633 relates to Category No.: 9305, 12085, 2890; Payload ID: 13634 relates to Category No.: 2890, 2942; Payload ID: 13635 relates to Category No.: 2890; Payload ID: 13636 relates to Category No.: 2890, 6717; Payload ID: 13637 relates to Category No.: 2890; Payload ID: 13638 relates to Category No.: 2890, 4030; Payload ID: 13639 relates to Category No.: 2890, 2942, 9305, 8948; Payload ID: 13640 relates to Category No.: 2890; Payload ID: 13641 relates to Category No.: 12085; Payload ID: 13642 relates to Category No.: 9305, 9247, 2402, 12231; Payload ID: 13643 relates to Category No.: 2890, 2194, 2942, 9247, 273, 5964, 4228, 2649, 16326, 196, 12231; Payload ID: 13644 relates to Category No.: 2942, 9247, 16326, 196; Payload ID: 13645 relates to Category No.: 2890; Payload ID: 13646 relates to Category No.: 9305, 2890, 1748, 5597; Payload ID: 13647 relates to Category No.: 9305, 2890, 10056, 9247; Payload ID: 13648 relates to Category No.: 7118, 2890, 6717, 2942, 3673, 3666, 4755, 7070, 12085; Payload ID: 13649 relates to Category No.: 12085; Payload ID: 13650 relates to Category No.: 10056; Payload ID: 13651 relates to Category No.: 9305, 10056, 9734, 1774; Payload ID: 13652 relates to Category No.: 5762, 1842; Payload ID: 13653 relates to Category No.: 2890, 2938; Payload ID: 13654 relates to Category No.: 6717; Payload ID: 13655 relates to Category No.: 9242, 9247; Payload ID: 13661 relates to Category No.: 5561; Payload ID: 13662 relates to Category No.: 5776, 4689, 12085; Payload ID: 13663 relates to Category No.: 2942; Payload ID: 13664 relates to Category No.: 5776, 4689; Payload ID: 13665 relates to Category No.: 4689; Payload ID: 13666 relates to Category No.: 5561, 6717; Payload ID: 13667 relates to Category No.: 2890; Payload ID: 13668 relates to Category No.: 2890, 6976, 2194, 6968, 6573; Payload ID: 13669 relates to Category No.: 9305, 2890, 2420, 4010; Payload ID: 13670 relates to Category No.: 9305, 2890, 9247, 14912, 9215; Payload ID: 13671 relates to Category No.: 2890, 273, 1748, 11650, 3036, 4199, 3055, 2710, 2942, 2938, 15139, 8917, 6017, 8935, 8948, 4860, 3061, 4862; Payload ID: 13672 relates to Category No.: 2710, 3055, 8935, 8948, 4860, 273, 11650, 3061, 3059, 3057, 2913; Payload ID: 13673 relates to Category No.: 9305, 7118, 6717, 2942, 2420, 2192, 14906, 6968, 12087, 4010, 2890, 10056; Payload ID: 13674 relates to Category No.: 9305, 2942, 2420, 2192, 14906, 12087, 4010, 2890; Payload ID: 13675 relates to Category No.: 9305, 7118, 6717, 2942, 2420, 2192, 6968, 12087, 4010; Payload ID: 13676 relates to Category No.: 4010, 6743; Payload ID: 13677 relates to Category No.: 2942, 9247, 12087; Payload ID: 13678 relates to Category No.: 9305, 2890, 6717, 2420, 2192, 12087, 6449, 16326; Payload ID: 13679 relates to Category No.: 12087; Payload ID: 13680 relates to Category No.: 7118, 2938, 7070, 12087; Payload ID: 13681 relates to Category No.: 12087, 2890, 2942; Payload ID: 13682 relates to Category No.: 9305, 9247, 12087; Payload ID: 13683 relates to Category No.: 2890, 12087; Payload ID: 13684 relates to Category No.: 9305, 2942, 9247, 12087; Payload ID: 13685 relates to Category No.: 2890, 12087; Payload ID: 13686 relates to Category No.: 12087; Payload ID: 13687 relates to Category No.: 12087, 9305, 2420, 2192, 5561; Payload ID: 13688 relates to Category No.: 14893, 9305, 2890, 2194; Payload ID: 13689 relates to Category No.: 9305, 2890, 9247, 12087, 4010, 1402; Payload ID: 13691 relates to Category No.: 2890, 2942, 9247, 14363, 1382, 9305, 7118, 16326, 6717; Payload ID: 13692 relates to Category No.: 10056, 2942, 9247, 1382, 16326, 15758; Payload ID: 13693 relates to Category No.: 2942, 4010; Payload ID: 13694 relates to Category No.: 2942, 9247, 14363, 1382; Payload ID: 13696 relates to Category No.: 9305, 2890, 6976, 10056, 9247, 12079; Payload ID: 13697 relates to Category No.: 12079; Payload ID: 13698 relates to Category No.: 9305, 2890, 2194, 9247, 12079; Payload ID: 13699 relates to Category No.: 9305, 2890, 6976; Payload ID: 13700 relates to Category No.: 2890, 6976, 9247, 9305, 12079; Payload ID: 13701 relates to Category No.: 2890, 12112; Payload ID: 13702 relates to Category No.: 9305, 2890, 6717, 5776, 2942, 9247, 8935, 8948, 1772, 9730, 12211; Payload ID: 13703 relates to Category No.: 2942, 4765; Payload ID: 13704 relates to Category No.: 2890, 2942, 4765; Payload ID: 13705 relates to Category No.: 2890, 5776; Payload ID: 13706 relates to Category No.: 2890, 10056, 2942, 4765, 9247; Payload ID: 13708 relates to Category No.: 2942; Payload ID: 13709 relates to Category No.: 2890, 10002, 10000; Payload ID: 13710 relates to Category No.: 9305, 6717, 2942, 9247; Payload ID: 13711 relates to Category No.: 6717, 2942; Payload ID: 13712 relates to Category No.: 9305; Payload ID: 13713 relates to Category No.: 9305, 9242, 11883, 2890, 7118; Payload ID: 13714 relates to Category No.: 2942, 11883, 9734; Payload ID: 13715 relates to Category No.: 9305, 2890, 9247; Payload ID: 13716 relates to Category No.: 9305, 2890; Payload ID: 13718 relates to Category No.: 7060, 7118; Payload ID: 13719 relates to Category No.: 5561, 3673, 4010, 5762; Payload ID: 13720 relates to Category No.: 9305; Payload ID: 13722 relates to Category No.: 2890, 15543; Payload ID: 13723 relates to Category No.: 6717, 6960, 9242, 2942, 6994, 7166, 2420, 2190; Payload ID: 13724 relates to Category No.: 9305, 2890, 10056, 2942, 14906, 9247, 6994, 6968, 14902, 14893, 2650; Payload ID: 13725 relates to Category No.: 4030, 4029, 10056, 4765, 3673, 1239, 4010, 4763, 10077, 11883, 5561; Payload ID: 13726 relates to Category No.: 6976, 10056, 3673, 4755, 1842, 9215; Payload ID: 13728 relates to Category No.: 4030, 5561; Payload ID: 13729 relates to Category No.: 9305, 2890, 6976, 2938, 10056, 2942, 4043, 1720, 4228, 14999, 6017, 779; Payload ID: 13730 relates to Category No.: 9305, 2890, 2938, 2942, 4043, 9247, 9734, 1720, 11650, 8948, 3036, 6017, 4860, 4228, 9079, 775, 1711, 6743, 1017; Payload ID: 13731 relates to Category No.: 9305, 2890, 4043, 9247, 14327; Payload ID: 13732 relates to Category No.: 5570, 1811, 4228, 6717, 10056, 5561; Payload ID: 13733 relates to Category No.: 2890, 9247; Payload ID: 13734 relates to Category No.: 9305, 2890, 3666, 3521, 14893, 4010, 2918; Payload ID: 13735 relates to Category No.: 9305, 2890, 10056, 3521, 4010; Payload ID: 13736 relates to Category No.: 9305, 2890, 10056, 3521; Payload ID: 13737 relates to Category No.: 9305, 7118, 5562; Payload ID: 13738 relates to Category No.: 10056, 2942, 3666, 3521, 14797, 2915, 2890, 2926, 5561; Payload ID: 13739 relates to Category No.: 9305, 2890, 2942, 7118, 11883; Payload ID: 13740 relates to Category No.: 2890, 10056, 1774, 10106, 4228, 2942; Payload ID: 13741 relates to Category No.: 9305, 2890, 2938, 10056, 6017, 4010, 8935, 1711; Payload ID: 13742 relates to Category No.: 9305, 2890, 2938, 9247; Payload ID: 13743 relates to Category No.: 9305, 2890; Payload ID: 13744 relates to Category No.: 9305, 10056, 3666, 9247, 3685, 5561; Payload ID: 13745 relates to Category No.: 9305, 2890, 6976, 6960; Payload ID: 13746 relates to Category No.: 2890, 2938; Payload ID: 13747 relates to Category No.: 9305, 2890, 9734, 2918; Payload ID: 13748 relates to Category No.: 9305, 2890, 3693, 9247, 2899, 3521, 4010, 2441; Payload ID: 13749 relates to Category No.: 2890, 2938, 2918, 4049; Payload ID: 13750 relates to Category No.: 2890, 2938, 2918, 4049; Payload ID: 13751 relates to Category No.: 5561, 3673, 2942, 6717, 3666, 1017, 8948, 9730, 12211; Payload ID: 13752 relates to Category No.: 9305, 2890, 6717, 9242, 2942, 4010, 1811, 580; Payload ID: 13753 relates to Category No.: 2890, 2938, 2942, 2918; Payload ID: 13754 relates to Category No.: 2890; Payload ID: 13755 relates to Category No.: 5762, 10056, 5570, 4010, 12406, 5561; Payload ID: 13756 relates to Category No.: 5570, 12406; Payload ID: 13757 relates to Category No.: 5561, 1772, 10056, 5570, 1792; Payload ID: 13758 relates to Category No.: 5561, 10056; Payload ID: 13759 relates to Category No.: 5570, 4010, 5561; Payload ID: 13760 relates to Category No.: 5561, 9305, 2890, 10056; Payload ID: 13761 relates to Category No.: 5570, 4010, 8948, 8935, 5561; Payload ID: 13762 relates to Category No.: 2890, 2942, 11721, 4228, 5561; Payload ID: 13763 relates to Category No.: 2890, 2942, 11721, 4010, 1792, 15139; Payload ID: 13764 relates to Category No.: 2942, 11721, 1792; Payload ID: 13765 relates to Category No.: 11721, 5762, 2942, 15139, 1792; Payload ID: 13766 relates to Category No.: 5570, 4010, 5561; Payload ID: 13767 relates to Category No.: 2890, 5570; Payload ID: 13768 relates to Category No.: 10056, 5570, 9247, 1748, 1811, 4010, 1792, 5392, 14329, 5561; Payload ID: 13769 relates to Category No.: 5561, 6717, 5570, 447, 1811, 1792, 6099; Payload ID: 13770 relates to Category No.: 2890, 6717, 5570, 9734, 1811, 1803, 6017, 5561; Payload ID: 13771 relates to Category No.: 5561, 10056, 15151, 3693, 15139, 4755, 8948, 14409, 1033, 6717; Payload ID: 13772 relates to Category No.: 5570, 15161, 14412, 12406, 15628, 14409, 2890, 15280, 3671; Payload ID: 13773 relates to Category No.: 5561, 10056, 8935, 5570, 6017, 1017, 4860, 4010, 3055, 779, 6075; Payload ID: 13774 relates to Category No.: 5561, 14954; Payload ID: 13775 relates to Category No.: 4030, 5561, 10056, 9734; Payload ID: 13776 relates to Category No.: 5570, 4010, 5561; Payload ID: 13777 relates to Category No.: 5561, 6717, 10056, 1792; Payload ID: 13778 relates to Category No.: 6717, 10056, 5570, 1811; Payload ID: 13779 relates to Category No.: 5570, 12159, 9731, 2890, 4030, 6717, 11653, 3036, 1017, 3055, 6017, 8948, 4860, 4199, 14329; Payload ID: 13780 relates to Category No.: 4029, 4010, 3671, 4763; Payload ID: 13781 relates to Category No.: 2890, 9305, 9247; Payload ID: 13782 relates to Category No.: 9305, 2890, 5730; Payload ID: 13783 relates to Category No.: 4030, 10056, 2942, 4014, 4010; Payload ID: 13784 relates to Category No.: 5561, 3673; Payload ID: 13785 relates to Category No.: 9305; Payload ID: 13786 relates to Category No.: 2890, 5561, 3666, 4010, 4032; Payload ID: 13787 relates to Category No.: 2890; Payload ID: 13788 relates to Category No.: 2890;

Payload ID: 13789 relates to Category No.: 9305, 2890; Payload ID: 13790 relates to Category No.: 5561, 3673; Payload ID: 13791 relates to Category No.: 5561, 6717, 3673, 3666, 3417, 262, 14368; Payload ID: 13792 relates to Category No.: 5561, 6717, 3417; Payload ID: 13793 relates to Category No.: 4029, 15627, 4010; Payload ID: 13794 relates to Category No.: 4029; Payload ID: 13795 relates to Category No.: 4030; Payload ID: 13796 relates to Category No.: 5561, 10056, 7366; Payload ID: 13797 relates to Category No.: 5561, 6717, 10056, 3673, 3666, 4010; Payload ID: 13798 relates to Category No.: 2890, 9247, 9305, 4010; Payload ID: 13799 relates to Category No.: 6717, 10056, 5570, 1811, 5561; Payload ID: 13800 relates to Category No.: 5561, 6717, 10056; Payload ID: 13801 relates to Category No.: 6717, 10056, 5570, 4010, 5561; Payload ID: 13802 relates to Category No.: 5561, 6717, 10056; Payload ID: 13803 relates to Category No.: 6717, 10056, 5570, 4010, 1811; Payload ID: 13804 relates to Category No.: 5561, 6717, 10056; Payload ID: 13805 relates to Category No.: 5561, 6717, 10056; Payload ID: 13806 relates to Category No.: 5561, 6717, 10056; Payload ID: 13807 relates to Category No.: 5561, 6717, 10056; Payload ID: 13808 relates to Category No.: 6717, 10056, 5570, 5561; Payload ID: 13809 relates to Category No.: 6717, 10056, 5570, 1748, 3036, 11653, 11723; Payload ID: 13810 relates to Category No.: 5561, 6717, 10056, 4860, 1810; Payload ID: 13811 relates to Category No.: 4029, 6717, 10056, 5570, 3666; Payload ID: 13812 relates to Category No.: 4029, 6717, 10056, 5570; Payload ID: 13813 relates to Category No.: 6717, 10056, 5570; Payload ID: 13814 relates to Category No.: 5561, 6717, 10056; Payload ID: 13815 relates to Category No.: 5561, 6717, 10056; Payload ID: 13816 relates to Category No.: 6717, 10056, 5570, 9305, 3666; Payload ID: 13817 relates to Category No.: 6717, 10056, 5570; Payload ID: 13818 relates to Category No.: 6717, 10056, 5570, 5561; Payload ID: 13819 relates to Category No.: 6717, 10056, 5570; Payload ID: 13820 relates to Category No.: 4029, 6717, 10056, 5570; Payload ID: 13821 relates to Category No.: 6717, 10056, 5570; Payload ID: 13822 relates to Category No.: 6717, 10056, 5570; Payload ID: 13823 relates to Category No.: 5561, 6717, 10056; Payload ID: 13824 relates to Category No.: 6717, 10056, 5570; Payload ID: 13825 relates to Category No.: 6717, 10056, 5570; Payload ID: 13826 relates to Category No.: 5561, 6717, 10056; Payload ID: 13827 relates to Category No.: 5561, 6717, 10056; Payload ID: 13828 relates to Category No.: 5561, 6717, 10056, 5570; Payload ID: 13829 relates to Category No.: 6717, 10056, 5570; Payload ID: 13830 relates to Category No.: 5561, 6717, 10056, 9998, 15139, 11653, 9999; Payload ID: 13831 relates to Category No.: 5561, 6717, 10056; Payload ID: 13832 relates to Category No.: 6717, 10056, 5570; Payload ID: 13833 relates to Category No.: 5561, 6717, 10056; Payload ID: 13834 relates to Category No.: 5561, 6717, 10056, 5570; Payload ID: 13835 relates to Category No.: 5561, 6717, 10056, 5570; Payload ID: 13836 relates to Category No.: 5561, 2890, 6717, 10056, 5570, 5730; Payload ID: 13837 relates to Category No.: 5561, 6717, 10056; Payload ID: 13838 relates to Category No.: 5561, 6717, 10056, 5570; Payload ID: 13839 relates to Category No.: 5561, 6717, 10056; Payload ID: 13840 relates to Category No.: 5561, 6717, 10056; Payload ID: 13841 relates to Category No.: 5561, 6717, 10056; Payload ID: 13842 relates to Category No.: 5561, 6717, 10056; Payload ID: 13843 relates to Category No.: 5561, 6717, 10056; Payload ID: 13844 relates to Category No.: 5561, 6717, 10056; Payload ID: 13845 relates to Category No.: 5561, 6717, 10056; Payload ID: 13846 relates to Category No.: 5561, 6717, 10056; Payload ID: 13847 relates to Category No.: 5561, 6717, 10056, 5762; Payload ID: 13848 relates to Category No.: 5561, 6717, 10056; Payload ID: 13849 relates to Category No.: 5561, 6717, 10056; Payload ID: 13850 relates to Category No.: 5561, 6717, 10056; Payload ID: 13851 relates to Category No.: 5561, 6717, 10056; Payload ID: 13852 relates to Category No.: 5561, 6717, 10056; Payload ID: 13853 relates to Category No.: 5561, 6717, 10056; Payload ID: 13854 relates to Category No.: 5561, 6717, 10056, 4860; Payload ID: 13855 relates to Category No.: 5561, 6717, 10056; Payload ID: 13856 relates to Category No.: 5561, 6717, 10056; Payload ID: 13857 relates to Category No.: 5561, 6717, 10056; Payload ID: 13858 relates to Category No.: 5561, 6717, 10056, 4010; Payload ID: 13859 relates to Category No.: 5561, 6717, 10056; Payload ID: 13860 relates to Category No.: 5561, 6717, 10056; Payload ID: 13861 relates to Category No.: 5561, 6717, 10056, 4010; Payload ID: 13862 relates to Category No.: 5561, 6717, 10056; Payload ID: 13863 relates to Category No.: 5561, 6717, 10056, 4010; Payload ID: 13864 relates to Category No.: 5561, 6717, 10056; Payload ID: 13865 relates to Category No.: 5561, 6717, 10056, 14953, 4030, 15139, 4010, 10002, 2890; Payload ID: 13866 relates to Category No.: 4030, 5561; Payload ID: 13867 relates to Category No.: 7061, 7052, 5820, 7118, 5562; Payload ID: 13868 relates to Category No.: 15845, 15857, 9215; Payload ID: 13869 relates to Category No.: 2890, 6717, 9247, 15845, 15857, 9215, 9181; Payload ID: 13871 relates to Category No.: 2890, 9305, 4228; Payload ID: 13872 relates to Category No.: 5561, 2890; Payload ID: 13873 relates to Category No.: 2890, 10056, 9247, 273, 4228; Payload ID: 13874 relates to Category No.: 4010; Payload ID: 13875 relates to Category No.: 9305, 7118, 9242, 15505, 9157; Payload ID: 13877 relates to Category No.: 9305; Payload ID: 13878 relates to Category No.: 9305; Payload ID: 13880 relates to Category No.: 5776; Payload ID: 13881 relates to Category No.: 9305, 1842; Payload ID: 13883 relates to Category No.: 4029, 1842; Payload ID: 13884 relates to Category No.: 7118; Payload ID: 13885 relates to Category No.: 9305, 7118, 2890, 6717, 2938, 7048, 2942, 15892, 9734, 2402, 7072, 7070, 1017, 15466, 7052, 5564, 6161, 1711, 911; Payload ID: 13886 relates to Category No.: 2890, 2942, 9247, 4010, 9305; Payload ID: 13887 relates to Category No.: 1842, 9305, 7118; Payload ID: 13888 relates to Category No.: 9305, 2890; Payload ID: 13892 relates to Category No.: 10056, 4228; Payload ID: 13893 relates to Category No.: 4030, 5762; Payload ID: 13894 relates to Category No.: 2942, 2903, 2920, 2890; Payload ID: 13895 relates to Category No.: 2890, 9734, 9184, 2920; Payload ID: 13896 relates to Category No.: 9242, 3666; Payload ID: 13897 relates to Category No.: 2890, 5762, 2938, 2942, 4010, 9305, 4029; Payload ID: 13898 relates to Category No.: 10056, 5570, 5565, 11653, 4007, 11883, 6743, 8935; Payload ID: 13899 relates to Category No.: 5570, 5565, 779, 12406, 10056, 5762; Payload ID: 13900 relates to Category No.: 5570, 5565, 12406, 1017, 8935, 6717, 4755, 6743, 3055, 8948, 15280, 14293; Payload ID: 13901 relates to Category No.: 6717, 10056, 5570, 9734, 1748, 5565, 4010, 6440, 778, 15139, 3036, 1017, 3055, 8948, 15280, 11650; Payload ID: 13902 relates to Category No.: 5570, 5565; Payload ID: 13903 relates to Category No.: 2890, 5570, 1748, 5565, 6717, 3055, 8948, 11650; Payload ID: 13904 relates to Category No.: 5570, 5565, 2890, 6717, 10056, 1231, 4008, 1811, 15139, 8948, 8917; Payload ID: 13905 relates to Category No.: 5561, 10056, 2942, 5570, 3036, 11653, 1792, 8951, 1711, 1099, 7118, 779; Payload ID:

13906 relates to Category No.: 5561, 10056; Payload ID: 13907 relates to Category No.: 5561, 5762, 10056, 5570; Payload ID: 13908 relates to Category No.: 5561, 10056, 5570, 5819, 1792, 5762, 7118, 4008, 1659, 1085; Payload ID: 13909 relates to Category No.: 5561, 10056, 5570, 3666; Payload ID: 13910 relates to Category No.: 5561, 10056, 5570; Payload ID: 13911 relates to Category No.: 5561, 10056, 5570, 2942, 1099, 7118, 6443, 3521, 779; Payload ID: 13912 relates to Category No.: 5561, 10056; Payload ID: 13913 relates to Category No.: 9305, 9158, 15269, 3358, 2890, 8948, 3036; Payload ID: 13914 relates to Category No.: 9305, 9247, 3358; Payload ID: 13915 relates to Category No.: 9305; Payload ID: 13916 relates to Category No.: 8948; Payload ID: 13917 relates to Category No.: 9305, 2942, 2890, 1017, 8935, 8902; Payload ID: 13919 relates to Category No.: 5762; Payload ID: 13920 relates to Category No.: 5561, 9305, 2890, 9242, 3666, 2477; Payload ID: 13921 relates to Category No.: 9305, 3666; Payload ID: 13922 relates to Category No.: 5561; Payload ID: 13923 relates to Category No.: 9305; Payload ID: 13924 relates to Category No.: 9242, 4010; Payload ID: 13925 relates to Category No.: 9305; Payload ID: 13927 relates to Category No.: 9305, 9242, 4755; Payload ID: 13928 relates to Category No.: 2890, 9242, 14671, 12284; Payload ID: 13930 relates to Category No.: 9247; Payload ID: 13932 relates to Category No.: 9305, 2890, 6976, 10056, 11883; Payload ID: 13933 relates to Category No.: 9305, 2942, 5358; Payload ID: 13934 relates to Category No.: 9305, 7118, 2890, 9242, 2942, 3666, 9073, 499, 5358, 9072; Payload ID: 13935 relates to Category No.: 9247, 9305; Payload ID: 13936 relates to Category No.: 9247; Payload ID: 13937 relates to Category No.: 2890, 9242, 9247, 3991; Payload ID: 13939 relates to Category No.: 5762; Payload ID: 13940 relates to Category No.: 9305, 2890, 2942, 9247, 4010; Payload ID: 13941 relates to Category No.: 10056, 2942, 6994, 273, 6017, 4010, 2514, 14329, 2650, 6019; Payload ID: 13942 relates to Category No.: 5776, 4755; Payload ID: 13943 relates to Category No.: 2890, 2942, 9247, 4010; Payload ID: 13944 relates to Category No.: 5561, 10056, 2942, 5570, 1099, 779; Payload ID: 13945 relates to Category No.: 5561, 10056, 5570, 1099, 779; Payload ID: 13946 relates to Category No.: 9215; Payload ID: 13947 relates to Category No.: 9305, 2890; Payload ID: 13948 relates to Category No.: 4029, 1842; Payload ID: 13949 relates to Category No.: 5561, 5570, 10056; Payload ID: 13950 relates to Category No.: 2942; Payload ID: 13952 relates to Category No.: 2890, 2942, 4010; Payload ID: 13953 relates to Category No.: 2890, 7060, 4010, 7118; Payload ID: 13954 relates to Category No.: 7118, 7060; Payload ID: 13955 relates to Category No.: 7060; Payload ID: 13956 relates to Category No.: 2942; Payload ID: 13957 relates to Category No.: 7118, 2890, 2942, 7060; Payload ID: 13958 relates to Category No.: 9305, 7118, 5776, 7060, 12336, 7366; Payload ID: 13959 relates to Category No.: 9305, 5776, 7060, 7118, 12336; Payload ID: 13960 relates to Category No.: 9305, 7118, 9247, 7060, 4010, 12336; Payload ID: 13961 relates to Category No.: 7060, 12336, 7118; Payload ID: 13962 relates to Category No.: 7118, 7060, 7082; Payload ID: 13963 relates to Category No.: 7118, 2890, 9247, 7060, 7082; Payload ID: 13964 relates to Category No.: 7118, 7060; Payload ID: 13965 relates to Category No.: 7118, 7060, 7048; Payload ID: 13966 relates to Category No.: 2890, 7060, 7118; Payload ID: 13967 relates to Category No.: 7060, 7118; Payload ID: 13968 relates to Category No.: 7060, 7118; Payload ID: 13969 relates to Category No.: 2942, 4010; Payload ID: 13970 relates to Category No.: 9305, 7118, 2890, 10056, 2942, 4014, 4010, 16156, 4032, 2458, 7366; Payload ID: 13971 relates to Category No.: 9305, 2890; Payload ID: 13972 relates to Category No.: 9305, 2890, 7070, 7118; Payload ID: 13973 relates to Category No.: 7118, 2890, 7070; Payload ID: 13974 relates to Category No.: 4030, 5776, 4755, 5559, 4010, 5597, 1700; Payload ID: 13975 relates to Category No.: 4030, 10056, 5559, 9184; Payload ID: 13976 relates to Category No.: 2890, 2942, 4010, 7118, 8935; Payload ID: 13977 relates to Category No.: 2890, 2942, 4010; Payload ID: 13978 relates to Category No.: 3991; Payload ID: 13979 relates to Category No.: 3991; Payload ID: 13981 relates to Category No.: 9305; Payload ID: 13982 relates to Category No.: 9305; Payload ID: 13983 relates to Category No.: 4029; Payload ID: 13984 relates to Category No.: 5561, 6717, 10056, 15151, 4755, 1748; Payload ID: 13985 relates to Category No.: 12362; Payload ID: 13986 relates to Category No.: 12362; Payload ID: 13987 relates to Category No.: 2194, 2942, 6964, 5561; Payload ID: 13988 relates to Category No.: 9305, 4755, 3521, 5561; Payload ID: 13989 relates to Category No.: 12439, 3521, 16156; Payload ID: 13990 relates to Category No.: 5762; Payload ID: 13991 relates to Category No.: 6443, 9776, 6060, 6059, 6440, 11883, 7118; Payload ID: 13992 relates to Category No.: 2890, 2194, 10056, 2942, 9247, 11728; Payload ID: 13993 relates to Category No.: 2890, 2194, 2942, 11728, 4010; Payload ID: 13994 relates to Category No.: 6717, 5762; Payload ID: 13995 relates to Category No.: 6717, 5762; Payload ID: 13996 relates to Category No.: 5762; Payload ID: 13997 relates to Category No.: 9305, 2890, 2194, 9242, 5762; Payload ID: 13999 relates to Category No.: 12439, 6717, 5762, 10056, 3673, 3693, 4755, 15573, 5555, 2927, 11728, 3982, 12440, 4010, 9776, 3696, 4228, 3682, 9734; Payload ID: 14000 relates to Category No.: 12439, 2890, 5776, 9776; Payload ID: 14001 relates to Category No.: 2890, 5776, 10056, 3693, 9247, 2927, 12440; Payload ID: 14002 relates to Category No.: 12439, 6976, 2194, 5776, 2942, 3693, 9247, 6994, 3636, 12440, 5597, 2514; Payload ID: 14003 relates to Category No.: 4030, 2194, 3693, 6994, 3636, 12440, 2514; Payload ID: 14004 relates to Category No.: 7118, 12439, 2890, 6976, 5776, 4765, 4755, 3521, 7070, 12440, 14409, 3523, 15628; Payload ID: 14005 relates to Category No.: 6717, 5762, 1700, 12439, 2194, 10056, 2942, 14906, 4755, 15573, 2927, 12440, 4010, 9776, 2926, 11883, 5967, 16156, 2514, 9774, 7321, 2890, 9734, 1017, 7118, 15627; Payload ID: 14006 relates to Category No.: 12439, 6717, 5762, 15151, 1748, 12440, 4010, 9776, 15161, 9774, 2890, 7118, 2899; Payload ID: 14007 relates to Category No.: 6443, 6717, 5762, 4765, 4755, 12440, 997, 3696, 6440; Payload ID: 14008 relates to Category No.: 12439, 2890, 6717, 5762, 10056, 1182, 8935, 15573, 5555, 2927, 3636, 12440, 6017, 4010, 2926, 6075, 15628, 1811, 4755; Payload ID: 14009 relates to Category No.: 6443, 12439, 6717, 5762, 5776, 10056, 2942, 4765, 9734, 15573, 2927, 3521, 4010, 9776, 6059, 3523, 6440, 15577, 4769, 14293, 9774, 9193, 15627, 779, 603; Payload ID: 14010 relates to Category No.: 12439, 9734, 3696, 3523; Payload ID: 14011 relates to Category No.: 2890, 6717, 5762, 10056, 9734, 11728, 4010, 3696, 1700; Payload ID: 14012 relates to Category No.: 10056, 3521, 12440, 12439, 6717, 5762, 8948, 3036, 1099, 3636, 4010, 6709, 779; Payload ID: 14013 relates to Category No.: 6717, 5762, 10056, 4755, 4010, 3682; Payload ID: 14014 relates to Category No.: 6717, 5762, 3693, 4755, 10056, 4010; Payload ID: 14015 relates to Category No.: 6717, 5762, 2942, 4765, 3673, 4755, 3521, 4010, 6709; Payload ID: 14016 relates to Category No.: 6717, 5762, 4765, 3673, 4755, 4010, 11688, 7118, 3685; Payload ID: 14017 relates to Category No.: 6717, 5762, 5776, 4755, 3521, 9776, 9774; Payload ID: 14018 relates to Category No.: 6717, 5762, 3673, 3693, 15573, 2927, 3521, 4010, 4760, 4228, 2514, 2918, 16164, 2914, 8935; Payload ID: 14019 relates to Category No.: 6717, 5762, 10056, 3521, 4010, 9776, 3696, 14327, 9774, 273; Payload ID: 14020 relates to Category No.: 2890, 6717, 5762, 10056, 997, 4010, 9776, 3696, 9774; Payload ID: 14021 relates to Category No.: 6717, 5762, 2942, 3693, 3636, 997, 7118; Payload ID: 14022 relates to Category No.: 12439, 6717, 5762, 2899, 4010, 2926, 12219, 12220; Payload ID: 14023 relates to Category No.: 10056, 3693, 14412, 6717, 5762, 4765, 5823, 15628; Payload ID: 14024 relates to Category No.: 6443, 6717, 5762, 3036, 3985, 14409, 4010, 6709, 6059, 7324, 10002, 4755, 779, 14412, 16278; Payload ID: 14025 relates to Category No.: 4755, 14409, 6717, 5762, 4010, 6709, 15577, 4769, 7324, 779, 16346, 14412; Payload ID: 14026 relates to Category No.: 6717, 5762, 2890, 10056, 2441, 2454; Payload ID: 14027 relates to Category No.: 2890, 6717, 5762, 2938, 10056, 4755, 9734, 15573, 4010, 6709, 16065, 16156; Payload ID: 14028 relates to Category No.: 9305, 6717, 5762, 4765, 3673, 4010, 6709, 6440, 3686, 4755; Payload ID: 14029 relates to Category No.: 6717, 5762, 10056, 4765, 3673, 4010; Payload ID: 14030 relates to Category No.: 2890, 4755, 6222, 4010, 11883, 3682; Payload ID: 14031 relates to Category No.: 2890, 10056, 11883; Payload ID: 14032 relates to Category No.: 2890, 6717, 5762, 2477, 4755, 15573, 4769, 4759; Payload ID: 14033 relates to Category No.: 6717, 5762, 3521, 9776, 15574, 9774, 6059, 15573; Payload ID: 14034 relates to Category No.: 7118, 6717, 5762, 15573, 3521, 9776, 6709, 9774; Payload ID: 14035 relates to Category No.: 6717, 5762, 10056, 4755; Payload ID: 14036 relates to Category No.: 6717, 5762, 4765, 4755, 4010, 4763; Payload ID: 14037 relates to Category No.: 6717, 5762, 4755, 9734, 4010, 9776, 16156, 4769, 4759, 9774, 14327, 3521; Payload ID: 14038 relates to Category No.: 6717, 5762, 10056, 2534, 4010, 3696, 6709, 5597, 2502, 1777, 7118; Payload ID: 14039 relates to Category No.: 6717, 5762, 4765, 4755; Payload ID: 14040 relates to Category No.: 6717, 5762, 10056, 3693, 14412, 3685, 14409; Payload ID: 14041 relates to Category No.: 6717, 5762, 10056, 15573, 3521, 9776, 6709, 9774, 2890, 2942, 4755, 3666, 16156; Payload ID: 14042 relates to Category No.: 6443, 6717, 5762, 10056, 4755, 9776, 9774; Payload ID: 14043 relates to Category No.: 6717, 5762, 10056, 8935, 4755, 16156; Payload ID: 14044 relates to Category No.: 9305, 2938, 2194, 2942, 6017, 2441; Payload ID: 14046 relates to Category No.: 6717, 5762, 10056, 15151, 3693, 1017, 14412, 4032, 15280, 2509, 2508, 2510, 2511, 262, 2942, 11883, 5778; Payload ID: 14047 relates to Category No.: 2890, 6717, 5762, 10056, 15151, 3693, 9734, 4010, 14412, 16156, 14409, 2942; Payload ID: 14048 relates to Category No.: 6717, 5762, 10056, 15151, 3693, 9734, 14412, 16156, 2942; Payload ID: 14049 relates to Category No.: 6717, 5762, 10056, 15151, 3693, 4010, 14412, 7118, 16344, 15627; Payload ID: 14050 relates to Category No.: 6717, 5762, 10056, 3696; Payload ID: 14051 relates to Category No.: 7118, 2890, 6717, 5762, 10056, 3696; Payload ID: 14052 relates to Category No.: 6717, 5762, 10056, 3696; Payload ID: 14053 relates to Category No.: 6717, 5762, 3696, 10056, 9734; Payload ID: 14054 relates to Category No.: 4755, 6717, 5762; Payload ID: 14055 relates to Category No.: 6717, 4755; Payload ID: 14056 relates to Category No.: 6717, 5762, 3693, 4755, 4010, 9776, 9774; Payload ID: 14057 relates to Category No.: 6717, 5762, 10056; Payload ID: 14058 relates to Category No.: 6717, 5762, 3693, 9734, 5555, 4010, 16156, 2890, 2942, 10056, 5776, 12439; Payload ID: 14059 relates to Category No.: 12439, 6717, 5762, 10056, 9734, 5555; Payload ID: 14060 relates to Category No.: 6717, 5762; Payload ID: 14061 relates to Category No.: 2890, 6717, 5762, 10056, 2942, 15151, 3693, 8948, 3036, 3521, 3636, 1017, 4010, 3696, 14327, 6709, 15280, 1033, 14783, 2914, 6743, 273, 9774; Payload ID: 14062 relates to Category No.: 6717, 5762, 10056, 3693, 3521, 3636, 4010, 6709, 3523; Payload ID: 14063 relates to Category No.: 6717, 5762, 5776, 10056, 3521, 6222, 3636, 4010, 6709, 3523, 6440; Payload ID: 14064 relates to Category No.: 6717, 5762, 2942, 4765, 4755, 15573, 4010, 2926, 3703; Payload ID: 14065 relates to Category No.: 6717, 5762, 4765, 2899, 4755; Payload ID: 14066 relates to Category No.: 9305, 6717, 5762, 2194, 4755; Payload ID: 14067 relates to Category No.: 6443, 6717, 5762, 5776, 16057, 6222, 14100, 1001, 4010, 9776, 6060, 6059, 6440, 6712, 9774, 4048, 2890, 4755, 11688, 15280, 2926, 603; Payload ID: 14068 relates to Category No.: 6443, 6717, 5762, 4755, 15573, 9776, 6059, 9774; Payload ID: 14069 relates to Category No.: 9305, 6717, 5762, 2194, 10056, 9242, 2942, 15151, 4765, 3693, 9247, 2927, 11728, 12440, 2458, 4010, 9776, 14412, 9098, 15577, 9774, 2441, 12439, 4755, 3036, 8948, 2899, 11650; Payload ID: 14070 relates to Category No.: 6717, 5762, 10056, 15151, 3693, 9754, 4010, 9776, 14412, 15577, 9774, 7118, 2926, 9734, 1796; Payload ID: 14071 relates to Category No.: 5776, 10056, 3693, 3696; Payload ID: 14072 relates to Category No.: 6443, 6717, 5762, 10056, 4765, 3673, 4010, 9776, 6059, 9774; Payload ID: 14073 relates to Category No.: 6443, 6717, 5762, 10056, 9776, 6059, 9774; Payload ID: 14074 relates to Category No.: 12439, 5776, 3693, 3521, 3636; Payload ID: 14075 relates to Category No.: 2890, 5776, 3521; Payload ID: 14076 relates to Category No.: 5776, 10056, 3693, 4010, 3696, 3523, 2916; Payload ID: 14077 relates to Category No.: 5762, 10056, 2942, 15151, 8935, 15139, 4755, 1748, 4049, 14409, 15161, 11883; Payload ID: 14078 relates to Category No.: 2890, 10056, 15628; Payload ID: 14079 relates to Category No.: 9305, 6960, 2942, 4043, 9247, 6994, 4010, 14903, 262, 7161, 2514, 2181; Payload ID: 14080 relates to Category No.: 5762, 2942, 6017, 1811; Payload ID: 14081 relates to Category No.: 9305, 5776, 9247, 2420, 2279; Payload ID: 14082 relates to Category No.: 9305, 9247, 2420, 15269, 12367; Payload ID: 14083 relates to Category No.: 9305, 12370, 2194, 13728, 9247, 14614, 9175, 2402, 16317; Payload ID: 14084 relates to Category No.: 6717, 2942, 2420, 2192, 9247, 9158, 2420, 2563, 2402, 2632, 9183; Payload ID: 14085 relates to Category No.: 9305, 2420, 6676, 9158, 6066, 2632, 9183; Payload ID: 14086 relates to Category No.: 9305, 2890, 9247, 11836; Payload ID: 14087 relates to Category No.: 9247, 9305, 2890, 11836, 16314; Payload ID: 14088 relates to Category No.: 7256, 9305, 6717, 9247, 9158, 15269, 14614, 11793; Payload ID: 14089 relates to Category No.: 3673, 3666, 3485; Payload ID: 14090 relates to Category No.: 9305, 9247; Payload ID: 14092 relates to Category No.: 12368, 9305, 13728, 9247, 5561; Payload ID: 14093 relates to Category No.: 9305, 7118, 2890, 13728, 9247, 9734, 12368, 2632, 12369, 5237; Payload ID: 14094 relates to Category No.: 9305, 2194, 13728, 9247, 12368, 2420, 15269, 2890; Payload ID: 14095 relates to Category No.: 2890, 9242, 9305, 7118, 6976, 9247, 9158, 9734, 2402, 7060, 14614, 10104, 2632, 2628, 6066; Payload ID: 14097 relates to Category No.: 9305, 9247, 11883; Payload ID: 14098 relates to Category No.: 2890, 9242, 10104, 1377; Payload ID: 14099 relates to Category No.: 9305; Payload ID: 14100 relates to Category No.: 9305, 9247; Payload ID: 14101 relates to Category No.: 9215, 9305; Payload ID: 14102 relates to Category No.:

2279, 9305, 9247, 2890; Payload ID: 14103 relates to Category No.: 9247, 2279; Payload ID: 14104 relates to Category No.: 9305, 9247, 2420; Payload ID: 14106 relates to Category No.: 9305, 2942, 7244; Payload ID: 14109 relates to Category No.: 1842; Payload ID: 14110 relates to Category No.: 9305, 2938, 9242, 9247, 7244, 1046, 12375; Payload ID: 14111 relates to Category No.: 5762; Payload ID: 14112 relates to Category No.: 2938, 7244, 1046; Payload ID: 14113 relates to Category No.: 7118, 2890; Payload ID: 14114 relates to Category No.: 7118, 7048, 3673, 3666, 4755, 7070, 6222; Payload ID: 14115 relates to Category No.: 4030, 2890, 2938, 10056, 4049, 6017, 4199, 4010, 1772, 6989, 4228, 779, 2514, 2710, 14327, 7366, 14953, 778; Payload ID: 14116 relates to Category No.: 9305, 2890, 10056, 2942, 4755, 7070, 12219, 5762; Payload ID: 14117 relates to Category No.: 2890, 10056, 6743; Payload ID: 14118 relates to Category No.: 2890, 10056, 3693, 4010, 6743, 11883; Payload ID: 14119 relates to Category No.: 2890, 10056, 1842, 5762; Payload ID: 14120 relates to Category No.: 2890, 10056, 5762; Payload ID: 14121 relates to Category No.: 2890, 9305; Payload ID: 14122 relates to Category No.: 4030, 2890, 10056; Payload ID: 14123 relates to Category No.: 5762; Payload ID: 14124 relates to Category No.: 5762, 9305, 2942, 1335; Payload ID: 14125 relates to Category No.: 2942, 1842; Payload ID: 14126 relates to Category No.: 5762, 1842; Payload ID: 14127 relates to Category No.: 5762; Payload ID: 14128 relates to Category No.: 5762, 2899; Payload ID: 14129 relates to Category No.: 6717, 2942; Payload ID: 14130 relates to Category No.: 10056, 2534; Payload ID: 14131 relates to Category No.: 2890; Payload ID: 14132 relates to Category No.: 9305, 1635; Payload ID: 14133 relates to Category No.: 9305; Payload ID: 14134 relates to Category No.: 5762, 9305, 2890, 9162, 2194, 1776, 1020; Payload ID: 14135 relates to Category No.: 9305, 2942; Payload ID: 14136 relates to Category No.: 2890, 9199, 5762; Payload ID: 14137 relates to Category No.: 6717, 2942, 9199, 9184, 9175, 9204, 7118, 9202, 2906; Payload ID: 14138 relates to Category No.: 9305, 2890, 9247; Payload ID: 14139 relates to Category No.: 5762; Payload ID: 14140 relates to Category No.: 2890, 9184, 9195; Payload ID: 14141 relates to Category No.: 9305, 2942, 6964; Payload ID: 14142 relates to Category No.: 2890, 2942, 14906, 2630, 9199, 9184, 5964, 9734, 9305, 3036, 7161, 1020, 9202, 2906; Payload ID: 14143 relates to Category No.: 9305, 2890, 10056, 9247, 1659, 14293, 5596; Payload ID: 14144 relates to Category No.: 9305, 12439, 2890, 6717, 5762, 9242, 2942, 9247, 6994, 2402, 2183, 9199, 4010, 6709, 14215, 9162; Payload ID: 14145 relates to Category No.: 5762; Payload ID: 14146 relates to Category No.: 5762; Payload ID: 14147 relates to Category No.: 5762; Payload ID: 14148 relates to Category No.: 5762; Payload ID: 14149 relates to Category No.: 2890; Payload ID: 14150 relates to Category No.: 2890; Payload ID: 14151 relates to Category No.: 9199, 5762; Payload ID: 14152 relates to Category No.: 2942, 6368; Payload ID: 14153 relates to Category No.: 2942, 3693, 3521, 5762; Payload ID: 14154 relates to Category No.: 2890, 6717, 10056, 2942, 1182, 8935, 5570, 15139, 9734, 8948, 1811, 3636, 6059, 11883, 779; Payload ID: 14155 relates to Category No.: 6717, 5762, 10056, 3652, 6017, 4199, 4010, 6989, 2710, 8948, 1033, 1336, 778, 4860, 9734, 1085, 9418, 1772, 14125, 1098, 14288, 9997; Payload ID: 14156 relates to Category No.: 6717, 10056, 2942, 5762; Payload ID: 14157 relates to Category No.: 9305, 5762; Payload ID: 14158 relates to Category No.: 10056, 2942, 3636, 779, 5762; Payload ID: 14159 relates to Category No.: 6717, 5762; Payload ID: 14160 relates to Category No.: 6717, 2942, 4765, 3036, 1017, 8948, 3521; Payload ID: 14161 relates to Category No.: 2890, 2194, 10056, 2942, 9734, 9184, 8935; Payload ID: 14162 relates to Category No.: 7118, 2942, 3666, 4010; Payload ID: 14163 relates to Category No.: 2890, 6717, 5762, 10056, 2942, 9734, 1748, 3521, 4010, 6059, 8935, 7366, 4925; Payload ID: 14164 relates to Category No.: 6717, 5762, 10056, 2942, 1811, 6222, 4010; Payload ID: 14165 relates to Category No.: 12439, 6717, 5762, 10056, 6994, 12440, 4010, 2942; Payload ID: 14166 relates to Category No.: 6717, 5762, 10056, 2942, 1182, 12440, 4010, 6743, 1810, 12439; Payload ID: 14167 relates to Category No.: 2890, 6717, 5762, 10056, 1182, 12440, 4010, 1810, 2942, 12439; Payload ID: 14168 relates to Category No.: 9305, 9247; Payload ID: 14169 relates to Category No.: 9305, 9247; Payload ID: 14170 relates to Category No.: 9305, 9247; Payload ID: 14171 relates to Category No.: 6717, 5762, 10056; Payload ID: 14172 relates to Category No.: 6717, 5762; Payload ID: 14173 relates to Category No.: 6717, 5762, 9734; Payload ID: 14174 relates to Category No.: 2890, 2938, 10056, 8948, 3036; Payload ID: 14175 relates to Category No.: 2890, 1842; Payload ID: 14176 relates to Category No.: 2899, 3521, 2926; Payload ID: 14178 relates to Category No.: 2899, 14327, 273; Payload ID: 14179 relates to Category No.: 2890, 2938, 10056, 6017, 4199, 1750; Payload ID: 14180 relates to Category No.: 6976, 2942, 14906; Payload ID: 14181 relates to Category No.: 2890, 6976; Payload ID: 14183 relates to Category No.: 2942, 3693, 4010, 15578; Payload ID: 14184 relates to Category No.: 9305, 2890, 6976, 6960, 10056, 14906, 6968; Payload ID: 14185 relates to Category No.: 9305, 2890, 11883; Payload ID: 14186 relates to Category No.: 2890, 6960, 10056; Payload ID: 14188 relates to Category No.: 2890, 6960, 9305, 5762; Payload ID: 14190 relates to Category No.: 6960; Payload ID: 14191 relates to Category No.: 6717, 3673, 5570, 5557, 5561; Payload ID: 14192 relates to Category No.: 6717, 10056, 2942, 4765, 3673, 4755, 6617, 5762; Payload ID: 14193 relates to Category No.: 10056, 2942, 8935, 15139, 1748, 14329, 5762; Payload ID: 14194 relates to Category No.: 10056, 5570, 5762, 2890, 9734, 4925; Payload ID: 14195 relates to Category No.: 6717, 10056, 2942, 5762; Payload ID: 14196 relates to Category No.: 6717, 5762, 2942, 4765, 3673, 4010, 6440, 14912; Payload ID: 14197 relates to Category No.: 2890, 6717, 5762, 3652; Payload ID: 14198 relates to Category No.: 6717, 5762, 2938, 10056, 2942, 3673, 3693, 6994, 1748, 1720, 6017, 4010, 1772, 777, 4228, 16156, 2514; Payload ID: 14199 relates to Category No.: 9305, 6717, 5762, 10056, 2942, 4010, 3696, 6060, 4228, 2514, 6059, 3521; Payload ID: 14200 relates to Category No.: 6717, 5762, 10056, 2942, 4010, 2514, 9305; Payload ID: 14201 relates to Category No.: 6717, 5762, 10056, 2942, 3521, 3696; Payload ID: 14202 relates to Category No.: 6717, 5762, 2938, 10056, 2942, 4010; Payload ID: 14203 relates to Category No.: 6717, 5762, 10056, 2942, 3673, 4010, 4228; Payload ID: 14204 relates to Category No.: 2890, 6717, 5762, 10056, 2942, 5392; Payload ID: 14205 relates to Category No.: 6717, 5762, 10056, 2942, 4010; Payload ID: 14206 relates to Category No.: 6717, 5762, 10056, 2942, 276, 4010, 4788, 6743; Payload ID: 14207 relates to Category No.: 7118, 6717, 5762, 10056, 2942, 5564, 5561; Payload ID: 14208 relates to Category No.: 7118, 6717, 5762, 10056, 2942, 4010, 5564; Payload ID: 14209 relates to Category No.: 6717, 5762, 10056, 2942, 4765, 1774, 10106, 4228; Payload ID: 14210 relates to Category No.: 6717, 5762, 10056, 2942, 3696; Payload ID: 14211 relates to Category No.: 9734, 4769; Payload ID: 14212 relates to Category No.: 2890, 2942, 5824, 14327, 10056; Payload ID: 14213 relates to Category No.: 2890, 5824, 2942, 9734; Payload ID: 14214 relates to Category No.: 2890, 2942, 5824; Payload ID: 14215 relates to Category No.: 2890, 10056, 2942, 5824; Payload ID: 14216 relates to Category No.: 2890, 2942, 5824; Payload ID: 14217 relates to Category No.: 2890, 10056, 2942, 5824; Payload ID: 14218 relates to Category No.: 2890, 2942, 5824; Payload ID: 14219 relates to Category No.: 2890, 5824, 6717, 2942, 4010; Payload ID: 14220 relates to Category No.: 10056, 2942, 8935, 4860; Payload ID: 14221 relates to Category No.: 10056, 2942, 3673, 5762; Payload ID: 14222 relates to Category No.: 9305, 2890, 9242, 9247, 4010, 9155, 9215; Payload ID: 14223 relates to Category No.: 2942, 4010, 4228, 5762; Payload ID: 14224 relates to Category No.: 9305, 6717, 5762, 10056, 9734, 14368; Payload ID: 14225 relates to Category No.: 6717, 5762, 10056; Payload ID: 14226 relates to Category No.: 2942, 5762; Payload ID: 14227 relates to Category No.: 6994, 3521, 6059, 5762; Payload ID: 14228 relates to Category No.: 5762; Payload ID: 14229 relates to Category No.: 6717, 5762, 10056; Payload ID: 14230 relates to Category No.: 9305, 6717, 5762, 10056; Payload ID: 14231 relates to Category No.: 9305, 6717, 5762, 2942; Payload ID: 14232 relates to Category No.: 10056, 9242, 6717, 5762; Payload ID: 14233 relates to Category No.: 6717, 5762, 10056; Payload ID: 14234 relates to Category No.: 6717, 5762, 9242; Payload ID: 14235 relates to Category No.: 6717, 5762; Payload ID: 14236 relates to Category No.: 6717, 5762; Payload ID: 14237 relates to Category No.: 6717, 5762, 10056; Payload ID: 14238 relates to Category No.: 2890, 6717, 5762, 10056, 2942, 3673, 15573, 276, 6017, 4010, 4228, 6709, 2907, 9305, 2899, 1774, 14329, 9773, 3523, 4053, 4765, 2926; Payload ID: 14239 relates to Category No.: 6717, 5762, 10056, 2942, 276, 6017, 4010, 9776, 4228, 2890, 9162; Payload ID: 14240 relates to Category No.: 6717, 5762, 10056, 2942, 8935, 9734, 3652, 8948, 6017, 4860, 4010, 1772, 4197, 2938; Payload ID: 14241 relates to Category No.: 6443, 9305, 2890, 5776, 2942, 4755, 6440, 5363, 3544, 4902; Payload ID: 14242 relates to Category No.: 6443, 2890, 5776, 2942, 4755, 6440, 3544, 4902; Payload ID: 14243 relates to Category No.: 6443, 9305, 2890, 5776, 2942, 9247, 3544, 4902; Payload ID: 14244 relates to Category No.: 6443, 9305, 2890, 2942, 3544, 4902; Payload ID: 14245 relates to Category No.: 6717, 5762, 10056, 2942; Payload ID: 14246 relates to Category No.: 2890, 2942, 9184, 11688, 920, 11687; Payload ID: 14247 relates to Category No.: 5762; Payload ID: 14248 relates to Category No.: 9305, 5762; Payload ID: 14249 relates to Category No.: 4030; Payload ID: 14251 relates to Category No.: 9305, 2890, 2194, 9247, 4755; Payload ID: 14252 relates to Category No.: 2890; Payload ID: 14253 relates to Category No.: 2890, 10056; Payload ID: 14254 relates to Category No.: 9305, 6717, 2942, 2903, 1674, 1675; Payload ID: 14255 relates to Category No.: 276; Payload ID: 14256 relates to Category No.: 9305, 9247, 15531, 2942, 11883, 2402; Payload ID: 14257 relates to Category No.: 5561, 7118, 7048; Payload ID: 14258 relates to Category No.: 9305; Payload ID: 14260 relates to Category No.: 9305, 9158, 6066, 2632, 6525, 15173, 2633, 2632, 2192, 6676, 9183; Payload ID: 14261 relates to Category No.: 5561, 5762, 10056, 1792; Payload ID: 14262 relates to Category No.: 5561, 5762, 10056, 1792; Payload ID: 14263 relates to Category No.: 5561, 2890; Payload ID: 14264 relates to Category No.: 5561, 2890; Payload ID: 14265 relates to Category No.: 5561, 5762, 1792; Payload ID: 14266 relates to Category No.: 5561, 5762, 10056, 5570, 1792, 12406, 4030; Payload ID: 14267 relates to Category No.: 5561, 5762, 6443, 2890, 10056, 5570, 2534, 1792, 12406; Payload ID: 14268 relates to Category No.: 5561, 6443, 5762, 10056, 5570, 1792, 12406; Payload ID: 14269 relates to Category No.: 7118, 2890, 2942, 12406, 3008, 14187, 11883, 6743; Payload ID: 14270 relates to Category No.: 5561, 2890, 6717, 7061, 3666, 3673; Payload ID: 14271 relates to Category No.: 5561, 3666, 2901, 4010, 5570, 3673, 6717; Payload ID: 14272 relates to Category No.: 5561, 6960, 3673; Payload ID: 14273 relates to Category No.: 5561, 6960, 3673, 3666; Payload ID: 14274 relates to Category No.: 5561, 4010; Payload ID: 14275 relates to Category No.: 5561, 9305, 3673, 778, 14289; Payload ID: 14276 relates to Category No.: 2890, 10056, 5570, 12406, 5561; Payload ID: 14277 relates to Category No.: 5561, 10056, 5570, 2503, 5762; Payload ID: 14278 relates to Category No.: 2890, 2194, 10056, 15139, 1748, 11653, 6717, 4755, 8917; Payload ID: 14279 relates to Category No.: 2890, 2938, 2942, 11883, 16156; Payload ID: 14280 relates to Category No.: 7118, 10056, 2942, 5762, 14187; Payload ID: 14281 relates to Category No.: 9305, 2890, 6717; Payload ID: 14282 relates to Category No.: 5561, 2890, 9305, 6717, 10056; Payload ID: 14283 relates to Category No.: 9305, 9247; Payload ID: 14284 relates to Category No.: 9305, 9247; Payload ID: 14285 relates to Category No.: 9305, 2890, 9242, 9247, 6551, 15505; Payload ID: 14286 relates to Category No.: 9305, 15505; Payload ID: 14288 relates to Category No.: 9305, 6717, 9247; Payload ID: 14290 relates to Category No.: 9305, 2890, 9242, 9247, 9184, 3393, 5241; Payload ID: 14291 relates to Category No.: 9305, 9247; Payload ID: 14292 relates to Category No.: 9305, 2890, 9247; Payload ID: 14293 relates to Category No.: 4030, 2890, 12159, 3036; Payload ID: 14294 relates to Category No.: 4010; Payload ID: 14295 relates to Category No.: 4010; Payload ID: 14296 relates to Category No.: 4030, 2890; Payload ID: 14297 relates to Category No.: 4029, 2890; Payload ID: 14298 relates to Category No.: 4029, 2890; Payload ID: 14299 relates to Category No.: 9305, 2890, 9247, 2942; Payload ID: 14300 relates to Category No.: 4029, 3666, 4755; Payload ID: 14301 relates to Category No.: 10056, 2942, 1748, 11723, 11721, 15139, 11650, 6717; Payload ID: 14302 relates to Category No.: 5762, 1748, 11723, 11721, 4010; Payload ID: 14303 relates to Category No.: 1748, 11721; Payload ID: 14304 relates to Category No.: 1748, 11721, 15147; Payload ID: 14305 relates to Category No.: 3393, 5241; Payload ID: 14306 relates to Category No.: 9305, 3393, 5241; Payload ID: 14307 relates to Category No.: 3393, 5241; Payload ID: 14308 relates to Category No.: 9305, 2890; Payload ID: 14309 relates to Category No.: 2890, 1842; Payload ID: 14310 relates to Category No.: 9305, 2890, 2194; Payload ID: 14311 relates to Category No.: 9305, 2890; Payload ID: 14312 relates to Category No.: 262; Payload ID: 14313 relates to Category No.: 9247, 9184, 9305, 2890, 9157, 2632; Payload ID: 14314 relates to Category No.: 6717, 6960, 9242, 2942, 6994, 7166, 2420, 2190, 9305, 10056, 3523; Payload ID: 14315 relates to Category No.: 5561, 10002; Payload ID: 14316 relates to Category No.: 2890, 10056; Payload ID: 14317 relates to Category No.: 9305, 2890, 10056; Payload ID: 14318 relates to Category No.: 5039, 2890, 10056, 11883, 3044; Payload ID: 14319 relates to Category No.: 9305, 2890, 10056, 9242, 9181, 2632, 2942, 11883, 8948, 775; Payload ID: 14320 relates to Category No.: 2890, 10056, 9305, 2942; Payload ID: 14321 relates to Category No.: 9305, 2890, 6960, 2194, 10056, 14906, 1748, 11650, 3036, 11653, 14893, 3055, 9155, 10104; Payload ID: 14322 relates to Category No.: 2890, 10056, 6743; Payload ID: 14323 relates to Category No.: 9305, 2890, 10056; Payload ID: 14324 relates to Category No.: 2890, 10056; Payload ID: 14325 relates to Category No.: 5039, 2890, 6717, 10056, 4755, 6743, 2504, 1335; Payload ID: 14326 relates to Category No.: 9305, 7118, 2890, 10056, 9242, 2942, 2918, 8935; Payload ID: 14327 relates to Category No.: 9305, 2890, 10056, 15573; Payload ID: 14328 relates to Category No.: 2890, 10056; Payload ID: 14329 relates to Category No.: 9305, 2890, 10056; Payload ID: 14330 relates to Category No.: 2890, 10056, 2942, 9247, 9305; Payload ID: 14331 relates to Category No.: 9305, 2890, 10056, 2942, 6717, 11883; Payload ID: 14332 relates to Category No.: 2890, 10056; Payload ID: 14333 relates to Category No.: 5039, 2890, 10056; Payload ID: 14334 relates to Category No.: 5039, 2890, 10056, 9305, 3044; Payload ID: 14335 relates to Category No.: 9305, 2890, 10056; Payload ID: 14336 relates to Category No.: 2890, 10056; Payload ID: 14337 relates to Category No.: 5039, 2890, 10056, 10002, 10000, 9305; Payload ID: 14338 relates to Category No.: 2890, 10056, 5561; Payload ID: 14339 relates to Category No.: 6960, 2194, 14906, 7118; Payload ID: 14340 relates to Category No.: 5561, 2890, 6960, 14906, 7118; Payload ID: 14341 relates to Category No.: 5561, 9305, 7118, 6960, 14906, 7070; Payload ID: 14342 relates to Category No.: 9305, 9247; Payload ID: 14343 relates to Category No.: 6443, 2890, 5776, 2942, 9247, 6440, 15465, 3036, 8948; Payload ID: 14344 relates to Category No.: 9305, 5776, 9247; Payload ID: 14345 relates to Category No.: 9305; Payload ID: 14346 relates to Category No.: 9305, 15505, 9157; Payload ID: 14347 relates to Category No.: 9305; Payload ID: 14348 relates to Category No.: 9305; Payload ID: 14349 relates to Category No.: 9305; Payload ID: 14350 relates to Category No.: 9305; Payload ID: 14351 relates to Category No.: 9305, 2890, 9247, 5597; Payload ID: 14352 relates to Category No.: 9305; Payload ID: 14353 relates to Category No.: 9305, 5776, 10056, 9247, 4755, 1748; Payload ID: 14355 relates to Category No.: 6717, 5762, 10056, 4010, 4228; Payload ID: 14356 relates to Category No.: 6717, 5762, 10056, 3666, 4010, 4228; Payload ID: 14357 relates to Category No.: 4029; Payload ID: 14358 relates to Category No.: 4029; Payload ID: 14359 relates to Category No.: 4029; Payload ID: 14360 relates to Category No.: 5561, 10056; Payload ID: 14361 relates to Category No.: 5561, 10056; Payload ID: 14362 relates to Category No.: 5561, 10056, 5570, 2942; Payload ID: 14363 relates to Category No.: 5561, 10056, 5570; Payload ID: 14364 relates to Category No.: 2890, 5570, 4010; Payload ID: 14365 relates to Category No.: 5561, 10056, 6968; Payload ID: 14366 relates to Category No.: 5561, 10056, 1090, 12159; Payload ID: 14367 relates to Category No.: 2890, 9247, 2441; Payload ID: 14368 relates to Category No.: 9305, 9247, 14323; Payload ID: 14369 relates to Category No.: 4030; Payload ID: 14370 relates to Category No.: 4030, 6443, 4029, 10056, 5762, 2890; Payload ID: 14371 relates to Category No.: 4010; Payload ID: 14372 relates to Category No.: 12159, 2701; Payload ID: 14373 relates to Category No.: 9305, 9247, 4755, 1748, 4010, 3359; Payload ID: 14374 relates to Category No.: 9247, 4755, 3359; Payload ID: 14375 relates to Category No.: 9247, 3359; Payload ID: 14376 relates to Category No.: 9305, 2890, 9247, 3359; Payload ID: 14377 relates to Category No.: 9247, 3359; Payload ID: 14378 relates to Category No.: 9305, 9247, 9191, 2942, 9184, 6222, 2949; Payload ID: 14379 relates to Category No.: 9305, 9247, 9158, 15269, 10104, 3358, 2628, 6066, 2632, 6525; Payload ID: 14380 relates to Category No.: 9305, 9247, 2402, 2420, 15269, 9158, 15269, 14614, 10104, 3358; Payload ID: 14381 relates to Category No.: 9305, 9247, 3358; Payload ID: 14382 relates to Category No.: 9305, 9247, 3358; Payload ID: 14383 relates to Category No.: 1842; Payload ID: 14384 relates to Category No.: 9305, 2890, 10056, 9247, 2420, 15269, 14893, 4146, 6536; Payload ID: 14385 relates to Category No.: 5561, 2890; Payload ID: 14386 relates to Category No.: 5561; Payload ID: 14387 relates to Category No.: 10056, 677, 3666, 4010, 1792, 8935; Payload ID: 14388 relates to Category No.: 10056, 678, 3685, 6743; Payload ID: 14389 relates to Category No.: 7118; Payload ID: 14392 relates to Category No.: 6717, 5762; Payload ID: 14393 relates to Category No.: 4029, 4010, 4030, 9305; Payload ID: 14394 relates to Category No.: 4029, 1842; Payload ID: 14395 relates to Category No.: 9247; Payload ID: 14396 relates to Category No.: 9305; Payload ID: 14397 relates to Category No.: 9305; Payload ID: 14404 relates to Category No.: 2890, 6717, 5776, 10056, 5570, 3696, 12406, 3036, 6743, 1017, 8948, 3521, 5561; Payload ID: 14405 relates to Category No.: 4029; Payload ID: 14406 relates to Category No.: 5561, 4755, 5559, 1792, 3685; Payload ID: 14407 relates to Category No.: 3666, 3671; Payload ID: 14408 relates to Category No.: 9242, 3666, 3671; Payload ID: 14409 relates to Category No.: 3671; Payload ID: 14410 relates to Category No.: 5561, 3673, 3652, 5557, 3666; Payload ID: 14411 relates to Category No.: 3666, 3652, 5557, 15758, 15282, 5561, 3673; Payload ID: 14412 relates to Category No.: 4030, 5561, 4765, 3673, 3666, 3652, 4010; Payload ID: 14413 relates to Category No.: 5762, 10056, 3666, 3652, 5557, 4010, 9162, 1774, 8951, 5561, 3673; Payload ID: 14414 relates to Category No.: 7118; Payload ID: 14415 relates to Category No.: 10056, 677, 8935, 5570, 3666, 8948, 1036, 4010, 1792, 4860; Payload ID: 14416 relates to Category No.: 4010, 1792, 678, 4008, 6743; Payload ID: 14417 relates to Category No.: 4010, 1792, 678, 4008, 6743; Payload ID: 14418 relates to Category No.: 9305; Payload ID: 14419 relates to Category No.: 9305; Payload ID: 14422 relates to Category No.: 5561, 5570; Payload ID: 14423 relates to Category No.: 5561, 5570, 10002, 10003; Payload ID: 14424 relates to Category No.: 5561, 5570; Payload ID: 14425 relates to Category No.: 6717, 10056, 3666, 9418, 1711; Payload ID: 14426 relates to Category No.: 2942, 1842, 1711, 5762; Payload ID: 14427 relates to Category No.: 6960, 6964, 1046, 10002, 10000, 9998, 2458; Payload ID: 14428 relates to Category No.: 1046, 10002, 9998; Payload ID: 14429 relates to Category No.: 2890, 10056, 11728, 4010, 2441, 2926, 4755, 2183, 9729; Payload ID: 14430 relates to Category No.: 9305, 2890, 9247, 14561; Payload ID: 14431 relates to Category No.: 2194, 4755, 2441, 10002, 14826, 2890, 2458, 9998, 1774, 11728; Payload ID: 14432 relates to Category No.: 9998, 2458, 1046, 9098; Payload ID: 14433 relates to Category No.: 1842, 9305, 9247, 2402, 15126, 10104, 12392, 15505, 14893; Payload ID: 14434 relates to Category No.: 9305, 9247, 9157, 9311, 11883, 14583, 3861, 9312, 1375; Payload ID: 14435 relates to Category No.: 9305, 9242, 9247, 14529, 5216, 7179; Payload ID: 14436 relates to Category No.: 9305, 2890, 6976, 9242, 9247, 2420; Payload ID: 14437 relates to Category No.: 9305, 9247, 9311, 3861; Payload ID: 14438 relates to Category No.: 9305, 9242, 9247, 15531; Payload ID: 14439 relates to Category No.: 9305, 2890, 9242, 9247, 4010; Payload ID: 14440 relates to Category No.: 9305, 9247, 15505; Payload ID: 14441 relates to Category No.: 15505, 9305, 2890, 9242, 9247, 4010; Payload ID: 14442 relates to Category No.: 5561, 4029, 10056; Payload ID: 14443 relates to Category No.: 5561, 4029, 10056, 677, 3666; Payload ID: 14444 relates to Category No.: 10056, 677; Payload ID: 14445 relates to Category No.:

9305, 7118, 9247; Payload ID: 14446 relates to Category No.: 9305, 2890, 9247, 273, 1720, 7118; Payload ID: 14447 relates to Category No.: 1842; Payload ID: 14448 relates to Category No.: 5561, 4010; Payload ID: 14449 relates to Category No.: 4029, 4014, 4010; Payload ID: 14450 relates to Category No.: 5561; Payload ID: 14451 relates to Category No.: 9305, 2890, 9247, 273, 9157, 1792, 8948, 3036, 8935, 9734; Payload ID: 14452 relates to Category No.: 9305, 2890, 9247; Payload ID: 14453 relates to Category No.: 5561, 9305, 15505, 9247, 9157; Payload ID: 14454 relates to Category No.: 9305, 9247, 9157, 12406, 14253, 1017; Payload ID: 14455 relates to Category No.: 9305, 9247; Payload ID: 14456 relates to Category No.: 9305, 9247; Payload ID: 14457 relates to Category No.: 2942, 1711; Payload ID: 14458 relates to Category No.: 2942; Payload ID: 14459 relates to Category No.: 4030, 4029, 4032, 5748; Payload ID: 14460 relates to Category No.: 4030, 4029, 2942, 4010, 11883; Payload ID: 14461 relates to Category No.: 2890, 4010; Payload ID: 14462 relates to Category No.: 2890; Payload ID: 14463 relates to Category No.: 5561, 2890, 3673, 6717, 1711; Payload ID: 14464 relates to Category No.: 5561, 5762, 3673, 10000; Payload ID: 14465 relates to Category No.: 5762, 10001; Payload ID: 14466 relates to Category No.: 7048, 7118; Payload ID: 14467 relates to Category No.: 9305, 6717, 3673, 3666, 6440, 7118; Payload ID: 14468 relates to Category No.: 5561, 5776, 3673; Payload ID: 14469 relates to Category No.: 3673, 3671, 1711; Payload ID: 14470 relates to Category No.: 2890; Payload ID: 14471 relates to Category No.: 6717, 3673, 9184, 9192; Payload ID: 14472 relates to Category No.: 4030, 4029, 4053; Payload ID: 14475 relates to Category No.: 5561; Payload ID: 14476 relates to Category No.: 9247; Payload ID: 14477 relates to Category No.: 16327, 9247, 9242; Payload ID: 14478 relates to Category No.: 6717, 10056, 677; Payload ID: 14479 relates to Category No.: 9247; Payload ID: 14481 relates to Category No.: 9305, 9242; Payload ID: 14482 relates to Category No.: 4029, 6717, 5559, 4010; Payload ID: 14484 relates to Category No.: 5561, 3673; Payload ID: 14485 relates to Category No.: 9305; Payload ID: 14486 relates to Category No.: 2890, 6717, 1811, 5392, 4073; Payload ID: 14487 relates to Category No.: 6717, 2942, 11883, 14181; Payload ID: 14488 relates to Category No.: 6717, 5570, 5561; Payload ID: 14489 relates to Category No.: 6717, 5570, 5561; Payload ID: 14490 relates to Category No.: 6717, 10056, 5570, 2927, 1099, 678, 14813, 5561; Payload ID: 14491 relates to Category No.: 5561, 6717, 10056, 5570, 1099, 4010, 2926, 779; Payload ID: 14492 relates to Category No.: 6717, 10056, 5570, 5561; Payload ID: 14493 relates to Category No.: 5762, 6717, 2938, 10056, 2942, 447; Payload ID: 14494 relates to Category No.: 6717, 5762, 261, 3521; Payload ID: 14495 relates to Category No.: 6717, 5762, 4765, 4010, 4228; Payload ID: 14496 relates to Category No.: 2890, 2938, 2942, 4010, 9305, 6717, 5392, 4030; Payload ID: 14497 relates to Category No.: 2890, 2938, 2942, 2899, 4010, 6717; Payload ID: 14498 relates to Category No.: 2890, 2942, 2899, 6717; Payload ID: 14499 relates to Category No.: 2890, 2942, 4010, 14327, 10056, 1750, 9734, 5561; Payload ID: 14500 relates to Category No.: 10056, 2942, 9734; Payload ID: 14501 relates to Category No.: 2942; Payload ID: 14502 relates to Category No.: 2942; Payload ID: 14503 relates to Category No.: 2942; Payload ID: 14504 relates to Category No.: 6717, 2942; Payload ID: 14505 relates to Category No.: 2890, 2942, 1182, 10056; Payload ID: 14506 relates to Category No.: 2890, 2942; Payload ID: 14507 relates to Category No.: 9305, 2942; Payload ID: 14508 relates to Category No.: 2942; Payload ID: 14509 relates to Category No.: 2938, 4765, 4755, 1748, 2927, 10056; Payload ID: 14510 relates to Category No.: 9305, 2942, 4228; Payload ID: 14511 relates to Category No.: 2942, 4010; Payload ID: 14512 relates to Category No.: 2938, 2942, 1774, 4228; Payload ID: 14513 relates to Category No.: 2942; Payload ID: 14514 relates to Category No.: 2938, 2942, 1842, 4228; Payload ID: 14515 relates to Category No.: 2890, 6717, 5762; Payload ID: 14516 relates to Category No.: 2942, 9247, 1748; Payload ID: 14517 relates to Category No.: 5762, 2942; Payload ID: 14518 relates to Category No.: 5776, 2942, 2899; Payload ID: 14519 relates to Category No.: 2942, 6017, 4228, 5762; Payload ID: 14520 relates to Category No.: 2942, 4765, 3673, 1748, 1720, 11650, 11653, 3696, 3055, 273; Payload ID: 14521 relates to Category No.: 2942, 2890, 10056; Payload ID: 14522 relates to Category No.: 9305, 2942, 2890, 273, 5762; Payload ID: 14523 relates to Category No.: 2942; Payload ID: 14524 relates to Category No.: 9305, 2938, 2942; Payload ID: 14525 relates to Category No.: 2890, 9247, 4228, 2942, 4755, 6960, 4860; Payload ID: 14526 relates to Category No.: 2942; Payload ID: 14528 relates to Category No.: 12439, 2890, 2942, 1748, 3055, 6099; Payload ID: 14529 relates to Category No.: 2890, 6717, 2942, 5762; Payload ID: 14530 relates to Category No.: 2890, 2942, 273, 276; Payload ID: 14531 relates to Category No.: 2890, 2942; Payload ID: 14532 relates to Category No.: 2942; Payload ID: 14533 relates to Category No.: 2890, 10056, 2942; Payload ID: 14534 relates to Category No.: 2194, 2942; Payload ID: 14535 relates to Category No.: 2890, 2942; Payload ID: 14536 relates to Category No.: 2890, 6717, 5762, 2942; Payload ID: 14537 relates to Category No.: 2890, 6717, 2942, 4010; Payload ID: 14538 relates to Category No.: 2890, 3036; Payload ID: 14539 relates to Category No.: 2942; Payload ID: 14540 relates to Category No.: 2942; Payload ID: 14542 relates to Category No.: 10056, 2942, 14364, 7389; Payload ID: 14543 relates to Category No.: 14327; Payload ID: 14544 relates to Category No.: 10056, 2942; Payload ID: 14545 relates to Category No.: 5762, 2942; Payload ID: 14548 relates to Category No.: 2890; Payload ID: 14549 relates to Category No.: 2890; Payload ID: 14550 relates to Category No.: 10056; Payload ID: 14551 relates to Category No.: 2942, 14329, 5762; Payload ID: 14552 relates to Category No.: 2890; Payload ID: 14553 relates to Category No.: 9305, 2890, 1772, 5762; Payload ID: 14554 relates to Category No.: 2942, 8935, 1720, 8948, 6017, 14327, 4228, 11883, 5762, 10056, 14995; Payload ID: 14555 relates to Category No.: 2890, 2938, 2942, 1748, 4010, 779, 778; Payload ID: 14556 relates to Category No.: 2890, 6960, 2938, 2942, 1182, 2899, 4755, 14893, 4228, 11883, 16156, 14329, 3054, 8948, 8951, 5762; Payload ID: 14557 relates to Category No.: 2938, 10056, 2942, 4765, 2183, 6017, 14327, 1231; Payload ID: 14558 relates to Category No.: 9305, 2194, 10056, 2942, 2907, 5762; Payload ID: 14559 relates to Category No.: 5561, 10056, 4765, 5570, 4755, 10002, 10000, 4788, 2446, 10003, 9999, 10001, 1811, 14295; Payload ID: 14560 relates to Category No.: 5561, 4765, 3673; Payload ID: 14561 relates to Category No.: 5561, 10056, 3673; Payload ID: 14562 relates to Category No.: 5561, 7118, 3673, 3666, 5557, 3678; Payload ID: 14563 relates to Category No.: 5561, 9305, 9247, 4755, 9734, 4765; Payload ID: 14564 relates to Category No.: 5561, 5762, 2942; Payload ID: 14565 relates to Category No.: 5561, 6717, 5570; Payload ID: 14566 relates to Category No.: 5561, 10056; Payload ID: 14567 relates to Category No.: 5561; Payload ID: 14568 relates to Category No.: 9305, 2890; Payload ID: 14569 relates to Category No.: 2890, 7244; Payload ID: 14570 relates to Category No.: 2890, 7244; Payload ID: 14571 relates to Category No.: 2942; Payload ID: 14572 relates to Category No.: 2890, 5776, 2942, 9247, 9734; Payload ID: 14573 relates to Category No.: 6717, 5762, 10056, 2942; Payload ID: 14574 relates to Category No.: 6717, 5762, 10056, 2942; Payload ID: 14575 relates to Category No.: 5762, 4755, 4010, 2890; Payload ID: 14576 relates to Category No.: 2942, 1842; Payload ID: 14577 relates to Category No.: 10056; Payload ID: 14578 relates to Category No.: 9305; Payload ID: 14579 relates to Category No.: 9305; Payload ID: 14580 relates to Category No.: 9305; Payload ID: 14583 relates to Category No.: 2890, 2942, 7118; Payload ID: 14584 relates to Category No.: 4010; Payload ID: 14585 relates to Category No.: 7118; Payload ID: 14586 relates to Category No.: 9305, 14136; Payload ID: 14587 relates to Category No.: 9305, 9247, 14136; Payload ID: 14588 relates to Category No.: 9305, 14136; Payload ID: 14589 relates to Category No.: 2942, 7060, 1842, 9181; Payload ID: 14590 relates to Category No.: 9305, 9247; Payload ID: 14591 relates to Category No.: 9247, 9240; Payload ID: 14592 relates to Category No.: 6976, 9247; Payload ID: 14593 relates to Category No.: 9305; Payload ID: 14594 relates to Category No.: 9305, 9247, 9240; Payload ID: 14595 relates to Category No.: 9305, 9247, 9240; Payload ID: 14596 relates to Category No.: 9305, 9247, 9240; Payload ID: 14597 relates to Category No.: 4030, 6443, 4029, 4010, 3671, 6437; Payload ID: 14598 relates to Category No.: 4010; Payload ID: 14599 relates to Category No.: 4029; Payload ID: 14600 relates to Category No.: 4029; Payload ID: 14601 relates to Category No.: 4029; Payload ID: 14602 relates to Category No.: 4029; Payload ID: 14603 relates to Category No.: 6443, 4029, 4010; Payload ID: 14604 relates to Category No.: 4030, 4029, 4010; Payload ID: 14605 relates to Category No.: 4029, 4010; Payload ID: 14606 relates to Category No.: 4029, 4010; Payload ID: 14607 relates to Category No.: 4029; Payload ID: 14608 relates to Category No.: 4029; Payload ID: 14609 relates to Category No.: 4029, 4010; Payload ID: 14610 relates to Category No.: 5561, 1842; Payload ID: 14611 relates to Category No.: 2890, 4010, 693; Payload ID: 14612 relates to Category No.: 9305, 2890, 2938, 9242, 9199, 9162, 9192; Payload ID: 14613 relates to Category No.: 9305, 2890; Payload ID: 14614 relates to Category No.: 9305, 2890; Payload ID: 14615 relates to Category No.: 2890, 2942, 9247, 4010, 14155, 9162, 1774, 8948, 5561; Payload ID: 14616 relates to Category No.: 9305, 2890, 2942, 9247, 14155; Payload ID: 14617 relates to Category No.: 2890, 2942, 9247, 4010, 14155, 5561; Payload ID: 14618 relates to Category No.: 5561, 6717, 3673, 3666, 9362, 6709, 14293; Payload ID: 14619 relates to Category No.: 5561, 9362, 9305, 6717, 3673, 3666, 14293, 1001; Payload ID: 14620 relates to Category No.: 2942, 5776; Payload ID: 14621 relates to Category No.: 6717, 9242; Payload ID: 14622 relates to Category No.: 9305, 9242, 2947, 14174; Payload ID: 14623 relates to Category No.: 2890; Payload ID: 14624 relates to Category No.: 2890; Payload ID: 14625 relates to Category No.: 14174, 6717, 5762, 2942, 3666, 2947; Payload ID: 14626 relates to Category No.: 9305, 2890, 6717, 9242, 2942, 6041, 2947, 4010, 4228, 7118; Payload ID: 14627 relates to Category No.: 9305, 14174, 6717, 5762, 2947, 10162; Payload ID: 14628 relates to Category No.: 14174, 2890, 6717, 5762, 9242, 2942, 2947, 4010; Payload ID: 14629 relates to Category No.: 14174, 6717, 2942, 2947, 4010, 4228; Payload ID: 14630 relates to Category No.: 9305, 14174, 2890, 6717, 5762, 9242, 2942, 2947, 2949; Payload ID: 14631 relates to Category No.: 9305, 14174, 2890, 6717, 9242, 2942, 14145, 6041, 2947, 4228, 4347; Payload ID: 14632 relates to Category No.: 14174, 2890, 6717, 5762, 2942, 2947, 4010; Payload ID: 14633 relates to Category No.: 9305, 14174, 5762, 2942, 2947, 4010; Payload ID: 14634 relates to Category No.: 9305, 14174, 5762, 2942, 6041, 2947; Payload ID: 14635 relates to Category No.: 9305, 14174, 2890, 6717, 5762, 9242, 2942, 2947, 4228; Payload ID: 14636 relates to Category No.: 14174, 6717, 2942, 2947; Payload ID: 14637 relates to Category No.: 14174, 2890, 6717, 5762, 9242, 2942, 2947, 4228; Payload ID: 14638 relates to Category No.: 14174, 2890, 6717, 5762, 9242, 2942, 2947; Payload ID: 14639 relates to Category No.: 14174, 5762, 9305, 2890, 2942, 14145, 2947, 4010, 4228; Payload ID: 14640 relates to Category No.: 14174, 5762, 2947; Payload ID: 14641 relates to Category No.: 14174, 2890, 6717, 2942, 2947, 4010, 4228, 9242; Payload ID: 14642 relates to Category No.: 9305, 14174, 2890, 5762, 9242, 2942, 2947, 4010, 15466; Payload ID: 14643 relates to Category No.: 6717, 2942, 2947, 4010, 14174; Payload ID: 14644 relates to Category No.: 14174, 6717, 5762, 2942, 6041, 2947, 4010; Payload ID: 14645 relates to Category No.: 14174, 5762, 2942, 6041, 2947, 4010; Payload ID: 14646 relates to Category No.: 9305, 14174, 6717, 5762, 2942, 14145, 2947, 4010, 4228; Payload ID: 14647 relates to Category No.: 14174, 6717, 5762, 2942, 2947; Payload ID: 14648 relates to Category No.: 2890, 6717, 2942, 3036, 2947, 4010, 2907, 1711, 14174; Payload ID: 14649 relates to Category No.: 14174, 6717, 5762, 2942, 2947; Payload ID: 14650 relates to Category No.: 14174, 2890, 5762, 9242, 9247, 9305, 2942, 2947, 4010, 4228; Payload ID: 14651 relates to Category No.: 9305, 2890, 6717, 2942, 2947, 4010, 4228, 14174; Payload ID: 14652 relates to Category No.: 14174, 6717, 5762, 2942, 2947, 4010, 4228; Payload ID: 14653 relates to Category No.: 14174, 2890, 6717, 5762, 2194, 2942, 2947; Payload ID: 14654 relates to Category No.: 14174, 2890, 5762, 9242, 2942, 2947, 4010; Payload ID: 14655 relates to Category No.: 14174, 5762, 2890, 6717, 9242, 2942, 2947; Payload ID: 14656 relates to Category No.: 14174, 6717, 5762, 2942, 2947, 4010, 7118; Payload ID: 14657 relates to Category No.: 14174, 2890, 6717, 5762, 9242, 2942, 2947; Payload ID: 14658 relates to Category No.: 14174, 5762, 2942, 2947; Payload ID: 14659 relates to Category No.: 14174, 5762, 2947; Payload ID: 14660 relates to Category No.: 14174, 5762, 2942, 2947; Payload ID: 14661 relates to Category No.: 9305, 14174, 5762, 2942, 2947, 4010, 4228; Payload ID: 14662 relates to Category No.: 14174, 5762, 2942, 2947, 4228, 3956; Payload ID: 14663 relates to Category No.: 4030, 14174, 5762, 2942, 2947; Payload ID: 14664 relates to Category No.: 14174, 5762, 2947; Payload ID: 14665 relates to Category No.: 14174, 6717, 5762, 2942, 2947; Payload ID: 14666 relates to Category No.: 9305, 14174, 2890, 6717, 9242, 2942, 14145, 2947, 4010, 4228; Payload ID: 14667 relates to Category No.: 14174, 2942, 2947; Payload ID: 14668 relates to Category No.: 9305, 14174, 2890, 6717, 5762, 9242, 2942, 14145, 2947, 4010, 4228; Payload ID: 14669 relates to Category No.: 9305, 14174, 6717, 5762, 2942, 2947, 4228, 2907; Payload ID: 14670 relates to Category No.: 14174, 9305, 2890, 6717, 9242, 2942, 14145, 2947, 4010, 4228, 10162; Payload ID: 14671 relates to Category No.: 9305, 2890, 6717, 9242, 2942, 14145, 2947, 4010, 4228, 10161, 14174; Payload ID: 14672 relates to Category No.: 2947, 9242; Payload ID: 14673 relates to Category No.: 14174, 2890, 6717, 5762, 9242, 2942, 2947, 4228; Payload ID: 14674 relates to Category No.: 9305, 14174, 2890, 6717, 5762, 9242, 2942, 2947, 4228; Payload ID: 14675 relates to Category No.: 2890, 14174, 6717, 2950, 9242, 2942, 4010, 4228; Payload ID: 14676 relates to Category No.: 14174, 2890, 6717, 5762, 2950, 9242, 2942, 4010, 4228; Payload ID: 14677 relates to Category No.: 14174, 6717, 5762, 2950, 2942; Payload ID: 14678 relates to Category No.: 14174, 5762, 9305, 6717, 2950, 9242, 2942, 4010, 4228; Payload ID: 14679 relates to Category No.: 14174, 2890, 6717, 2950, 9242, 2942, 4010, 4228, 7118; Payload ID: 14680 relates to Category No.: 14668, 14174, 2890, 9305, 6717, 2950, 2942, 9247, 4228; Payload ID: 14681 relates to Category No.: 14174, 2890, 6717, 2950, 2942, 4010; Payload ID: 14682 relates to Category No.: 14174, 14668, 6717, 2950, 2942, 4010, 4228; Payload ID: 14683 relates to Category No.: 14174, 6717, 5762, 2950, 2942, 4010, 4228; Payload ID: 14684 relates to Category No.: 14668, 9305, 14174, 2890, 6717, 5762, 2950, 2942, 4010, 4228, 2574; Payload ID: 14685 relates to Category No.: 14174, 2890, 6717, 5762, 2950, 9242, 2942, 4010, 4228; Payload ID: 14686 relates to Category No.: 2890, 9242, 9247; Payload ID: 14687 relates to Category No.: 14668, 9305, 14174, 2890, 6717, 2950, 2942, 9247, 4010, 4228; Payload ID: 14688 relates to Category No.: 14668, 14174, 2890, 6717, 5762, 2950, 2942, 4010; Payload ID: 14689 relates to Category No.: 14668, 14174, 2890, 5762, 2950, 2942; Payload ID: 14690 relates to Category No.: 14668, 14174, 2890, 6717, 5762, 2950, 9242, 2942; Payload ID: 14691 relates to Category No.: 14668, 9305, 14174, 2890, 6717, 5762, 2950, 2942; Payload ID: 14692 relates to Category No.: 14668, 9305, 14174, 2890, 2950, 9242, 2942, 4010; Payload ID: 14693 relates to Category No.: 14668, 14174, 2890, 6717, 5762, 2950, 9242, 2942, 4010; Payload ID: 14694 relates to Category No.: 9305, 14174, 5762, 2950, 2942; Payload ID: 14695 relates to Category No.: 4030, 14668, 9305, 14174, 2890, 6717, 2950, 10056, 9242, 2942, 9247, 4010, 3696, 3638, 7366; Payload ID: 14696 relates to Category No.: 9305, 14174, 5762, 2950; Payload ID: 14697 relates to Category No.: 14668, 14174, 2890, 5762, 2950, 2942, 4010; Payload ID: 14698 relates to Category No.: 14668, 14174, 2890, 5762, 2950, 2942, 4010, 4228; Payload ID: 14699 relates to Category No.: 14668, 9305, 14174, 2890, 6717, 2950, 7048, 10056, 9242, 2942, 14145, 9015, 10162, 7060, 4010, 4228, 7161, 14329, 3036, 3652; Payload ID: 14700 relates to Category No.: 9305, 14174, 2890, 5762, 2950, 9242, 2942, 14145, 4010, 4228; Payload ID: 14701 relates to Category No.: 14668, 14174, 6717, 5762, 2950, 2942, 14145, 10162, 4010, 4228, 2907; Payload ID: 14702 relates to Category No.: 9305, 14174, 6717, 5762, 2950, 2942, 10162; Payload ID: 14703 relates to Category No.: 14174, 5762, 2950, 1842; Payload ID: 14704 relates to Category No.: 14668, 6717, 2950, 2942, 14145, 4010, 4228; Payload ID: 14705 relates to Category No.: 14668, 9305, 14174, 2890, 6717, 5762, 2950, 9242, 2942, 14145, 3036, 2907, 1711; Payload ID: 14706 relates to Category No.: 2890, 6717, 5776, 3521; Payload ID: 14707 relates to Category No.: 9305, 7118, 2890, 2942, 8935, 9247, 15139, 1748, 7070, 1792, 9734; Payload ID: 14708 relates to Category No.: 2890, 9247; Payload ID: 14709 relates to Category No.: 5762, 9305, 2890, 2942, 9247, 14893; Payload ID: 14710 relates to Category No.: 9305, 2890, 2942, 9247, 9184, 14893, 14174; Payload ID: 14711 relates to Category No.: 2890, 2942, 9247; Payload ID: 14712 relates to Category No.: 2890, 9247, 9305, 5762; Payload ID: 14713 relates to Category No.: 9305, 2890, 9247, 5762; Payload ID: 14714 relates to Category No.: 9305, 7118, 2890, 9242, 2942, 9247; Payload ID: 14715 relates to Category No.: 2890, 5776, 14174; Payload ID: 14716 relates to Category No.: 9305, 14174, 2890, 6717, 5762, 2950, 6976, 9242, 14671, 2942, 14145, 192, 4010, 4228; Payload ID: 14717 relates to Category No.: 9305, 14174, 2890, 6717, 5762, 2950, 2942, 14145, 4010, 4228; Payload ID: 14718 relates to Category No.: 14668, 9305, 14174, 2890, 6717, 5762, 2950, 9242, 2942, 14145, 4010, 4228; Payload ID: 14719 relates to Category No.: 14668, 9305, 14174, 2890, 6717, 5762, 2950, 10056, 2942, 192, 4010, 1090, 4014, 8948; Payload ID: 14720 relates to Category No.: 9305, 2890, 6717, 5762, 2942, 14145, 2947, 4010, 4228, 2907, 14174; Payload ID: 14721 relates to Category No.: 2890, 2942, 2947, 4010, 4228; Payload ID: 14722 relates to Category No.: 6717, 2942, 2947, 4010, 4228, 14174; Payload ID: 14723 relates to Category No.: 5561; Payload ID: 14724 relates to Category No.: 9305, 9242, 11715, 14670; Payload ID: 14725 relates to Category No.: 5561, 9242, 9184; Payload ID: 14726 relates to Category No.: 9305, 7118, 9242; Payload ID: 14727 relates to Category No.: 9305, 9242, 2942, 11715, 14670, 3952, 5029; Payload ID: 14728 relates to Category No.: 9305, 9242, 192; Payload ID: 14729 relates to Category No.: 2798, 16048, 2890; Payload ID: 14730 relates to Category No.: 9305, 2890, 10056, 9242, 9247, 2415, 12394; Payload ID: 14731 relates to Category No.: 9305, 9242, 14671, 1286; Payload ID: 14732 relates to Category No.: 7118, 1842; Payload ID: 14733 relates to Category No.: 5557, 14174, 6717, 3666; Payload ID: 14734 relates to Category No.: 9305, 9242, 11715, 6043, 2632, 3666; Payload ID: 14735 relates to Category No.: 11715, 6043, 9242; Payload ID: 14736 relates to Category No.: 9305, 9242; Payload ID: 14737 relates to Category No.: 2942, 4010; Payload ID: 14739 relates to Category No.: 5561, 6717, 2942, 11883, 14181; Payload ID: 14740 relates to Category No.: 5776, 4765, 3673, 8935, 8948, 5561, 3666, 2942; Payload ID: 14741 relates to Category No.: 2890, 10056, 6717; Payload ID: 14742 relates to Category No.: 2890, 2194, 10056, 2942, 1720; Payload ID: 14744 relates to Category No.: 10056, 15139, 1748; Payload ID: 14748 relates to Category No.: 2903, 2920, 2890; Payload ID: 14749 relates to Category No.: 2890, 6717, 9247, 2903, 1792; Payload ID: 14750 relates to Category No.: 9305, 2890, 15892, 9247, 9215; Payload ID: 14751 relates to Category No.: 2890, 6717, 10056, 2942, 12440, 3696, 15779, 2899; Payload ID: 14752 relates to Category No.: 4029; Payload ID: 14753 relates to Category No.: 2890, 2194, 2942, 9247, 4228, 9215, 4765, 5561; Payload ID: 14754 relates to Category No.: 9305, 2890, 14614, 10104; Payload ID: 14755 relates to Category No.: 9305, 2890, 5776, 1017, 9184, 10104; Payload ID: 14757 relates to Category No.: 9305, 2890; Payload ID: 14758 relates to Category No.: 5561, 3673, 3666; Payload ID: 14759 relates to Category No.: 9305, 12439, 15892, 3521, 4010; Payload ID: 14760 relates to Category No.: 9305, 2890, 9247, 9242, 11883; Payload ID: 14761 relates to Category No.: 5561, 2890, 9305; Payload ID: 14764 relates to Category No.: 9305, 2890, 5762; Payload ID: 14765 relates to Category No.: 2942; Payload ID: 14766 relates to Category No.: 5561, 4765, 3673; Payload ID: 14767 relates to Category No.: 5561, 3666, 4755; Payload ID: 14768 relates to Category No.: 2890; Payload ID: 14769 relates to Category No.: 5762; Payload ID: 14770 relates to Category No.: 9305, 2890; Payload ID: 14771 relates to Category No.: 5561, 2938, 9734, 4755, 3666, 6059; Payload ID: 14772 relates to Category No.: 5561, 4765, 3673, 9176, 6060, 6440; Payload ID: 14773 relates to Category No.: 5561, 9305, 2890, 9247; Payload ID: 14774 relates to Category No.: 5561, 3673; Payload ID: 14775 relates to Category No.: 2890, 2942; Payload ID: 14776 relates to Category No.: 9305; Payload ID: 14777 relates to Category No.: 5561, 3666, 3104; Payload ID: 14778 relates to Category No.: 9305, 2890, 15892; Payload ID: 14780 relates to Category No.: 5561, 10056, 15892, 4755, 2927; Payload ID: 14781 relates to Category No.: 5561, 2890, 15892, 7061; Payload ID: 14782 relates to Category No.: 5561; Payload ID: 14783 relates to Category No.: 9305, 2942; Payload ID: 14784 relates to Category No.: 5561; Payload ID: 14785 relates to Category No.: 5561, 6717, 4010; Payload ID: 14786 relates to Category No.: 5561; Payload ID: 14787 relates to Category No.: 9305, 2890; Payload ID: 14788 relates to Category No.: 6443, 5568, 6440; Payload ID: 14791 relates to Category No.: 5762; Payload ID: 14792 relates to Category No.: 5561, 2890, 3652; Payload ID: 14793 relates to Category No.: 9305, 2890, 15892, 9247, 11883, 14614, 3355; Payload ID: 14794 relates to Category No.: 9305, 9247, 14614; Payload ID: 14795 relates to Category No.: 9305, 2890; Payload ID: 14796 relates to Category No.: 5561, 3673; Payload ID: 14797 relates to Category No.: 5561, 4765, 3673; Payload ID: 14798 relates to Category No.: 5561, 5815, 9162; Payload ID: 14800 relates to Category No.: 5561, 2890; Payload ID: 14801 relates to Category No.: 5561; Payload ID: 14802 relates to Category No.: 5561, 3673, 3666, 7070, 3104; Payload ID: 14803 relates to Category No.: 5561; Payload ID: 14804 relates to Category No.: 9305, 2890, 9247; Payload ID: 14805 relates to Category No.: 5561, 2890, 2194, 15892; Payload ID: 14806 relates to Category No.: 5561, 2890, 15892, 2889; Payload ID: 14807 relates to Category No.: 9305, 15892, 9247, 9603, 11683, 7179, 3952, 5029, 14530, 9155; Payload ID: 14808 relates to Category No.: 9305, 9242, 15892, 9247, 5284; Payload ID: 14809 relates to Category No.: 5762, 9734; Payload ID: 14810 relates to Category No.: 2890, 9247; Payload ID: 14811 relates to Category No.: 15173; Payload ID: 14813 relates to Category No.: 2890, 6717, 9242; Payload ID: 14815 relates to Category No.: 5561; Payload ID: 14816 relates to Category No.: 9305, 2890, 2942, 9247; Payload ID: 14817 relates to Category No.: 5561, 2890, 15892; Payload ID: 14819 relates to Category No.: 2890; Payload ID: 14820 relates to Category No.: 5561, 15104; Payload ID: 14821 relates to Category No.: 5561; Payload ID: 14823 relates to Category No.: 5561; Payload ID: 14824 relates to Category No.: 5561, 4765; Payload ID: 14825 relates to Category No.: 9305, 2942; Payload ID: 14826 relates to Category No.: 5561, 1842; Payload ID: 14827 relates to Category No.: 6368, 5762, 2942, 2918, 1682; Payload ID: 14828 relates to Category No.: 3693, 493; Payload ID: 14829 relates to Category No.: 9305, 2890, 10056, 2942, 3652, 9215; Payload ID: 14830 relates to Category No.: 9305, 9247, 14826; Payload ID: 14831 relates to Category No.: 2890, 1842; Payload ID: 14832 relates to Category No.: 9305, 2890, 9247, 15104, 10104; Payload ID: 14833 relates to Category No.: 9305, 6717, 15892, 8935, 9247, 5284, 2942, 4049, 11883, 1033; Payload ID: 14834 relates to Category No.: 2942; Payload ID: 14835 relates to Category No.: 10056, 3673, 5570, 9162, 5561; Payload ID: 14837 relates to Category No.: 5561, 7061, 3104; Payload ID: 14838 relates to Category No.: 9305, 2890, 9247, 2786, 2785, 2791, 9214, 2789, 2790; Payload ID: 14839 relates to Category No.: 9305, 9242, 15892, 9247, 6994, 2420, 15269, 14614; Payload ID: 14840 relates to Category No.: 9305, 2890, 9247, 15531; Payload ID: 14841 relates to Category No.: 5561; Payload ID: 14842 relates to Category No.: 5561; Payload ID: 14843 relates to Category No.: 2890, 9247, 9603, 9305; Payload ID: 14844 relates to Category No.: 2942, 2794, 9247, 2786, 14382, 2785, 2791, 9214, 2787, 2788, 2790, 16110; Payload ID: 14848 relates to Category No.: 9305; Payload ID: 14849 relates to Category No.: 9305; Payload ID: 14850 relates to Category No.: 9305; Payload ID: 14851 relates to Category No.: 9305, 9242, 9247, 7269, 12406; Payload ID: 14852 relates to Category No.: 9305, 2890, 3673, 9247, 15732, 9162; Payload ID: 14853 relates to Category No.: 9305, 9247; Payload ID: 14854 relates to Category No.: 9305, 2890, 6041, 3036; Payload ID: 14855 relates to Category No.: 9305, 9247; Payload ID: 14856 relates to Category No.: 9305, 9247, 9215; Payload ID: 14857 relates to Category No.: 9247; Payload ID: 14859 relates to Category No.: 15505, 9242, 14145, 9247, 6653; Payload ID: 14860 relates to Category No.: 9247, 9184, 9215, 9305; Payload ID: 14861 relates to Category No.: 9247; Payload ID: 14862 relates to Category No.: 9247, 14912; Payload ID: 14864 relates to Category No.: 9305, 2890, 6717, 9242, 9247, 2420; Payload ID: 14865 relates to Category No.: 9305; Payload ID: 14866 relates to Category No.: 9305, 2890, 9247, 1635, 15853, 12218, 15854; Payload ID: 14867 relates to Category No.: 9305, 6717; Payload ID: 14868 relates to Category No.: 9305, 2890; Payload ID: 14869 relates to Category No.: 2890, 9247, 14912, 9215; Payload ID: 14871 relates to Category No.: 2890, 9247, 9215; Payload ID: 14872 relates to Category No.: 9242, 14912; Payload ID: 14874 relates to Category No.: 9305, 9242; Payload ID: 14875 relates to Category No.: 9305, 2942, 9247; Payload ID: 14876 relates to Category No.: 9305, 6976, 9247, 6968, 9215; Payload ID: 14877 relates to Category No.: 9305, 2890, 9242, 9247, 9215, 2920; Payload ID: 14878 relates to Category No.: 15848; Payload ID: 14879 relates to Category No.: 9305, 2890; Payload ID: 14881 relates to Category No.: 2890, 5597; Payload ID: 14882 relates to Category No.: 9305, 2890, 9247; Payload ID: 14884 relates to Category No.: 9305; Payload ID: 14885 relates to Category No.: 9247; Payload ID: 14886 relates to Category No.: 9242; Payload ID: 14887 relates to Category No.: 9305, 9247, 14912; Payload ID: 14888 relates to Category No.: 9305; Payload ID: 14889 relates to Category No.: 9305, 9247; Payload ID: 14890 relates to Category No.: 9305, 2890, 2942, 9247, 3991, 1635, 9215, 3036, 8948; Payload ID: 14891 relates to Category No.: 4030, 9305, 6717, 14145, 9247, 4010, 1635, 9167, 15119; Payload ID: 14893 relates to Category No.: 9305, 14145; Payload ID: 14894 relates to Category No.: 9305, 14145; Payload ID: 14896 relates to Category No.: 9305; Payload ID: 14897 relates to Category No.: 9305; Payload ID: 14898 relates to Category No.: 9305; Payload ID: 14899 relates to Category No.: 9305; Payload ID: 14900 relates to Category No.: 9305, 1842; Payload ID: 14901 relates to Category No.: 9305, 1842; Payload ID: 14902 relates to Category No.: 9305; Payload ID: 14903 relates to Category No.: 9305; Payload ID: 14904 relates to Category No.: 2890; Payload ID: 14905 relates to Category No.: 9305, 2890, 2942, 9247, 3991, 9215, 871; Payload ID: 14906 relates to Category No.: 2890, 9247; Payload ID: 14908 relates to Category No.: 9305, 2890, 15573; Payload ID: 14909 relates to Category No.: 9305, 2890, 9247; Payload ID: 14910 relates to Category No.: 9305, 2890, 8948, 5762, 9730; Payload ID: 14911 relates to Category No.: 9305, 7118, 9242, 7060, 4228, 7052; Payload ID: 14912 relates to Category No.: 9305, 9247; Payload ID: 14913 relates to Category No.: 7118; Payload ID: 14914 relates to Category No.: 9305; Payload ID: 14915 relates to Category No.: 9305, 2890, 9242, 3393, 5241; Payload ID: 14917 relates to Category No.: 7118, 1842; Payload ID: 14918 relates to Category No.: 7118, 1842; Payload ID: 14919 relates to Category No.: 7118; Payload ID: 14920 relates to Category No.: 7118; Payload ID: 14921 relates to Category No.: 9242; Payload ID: 14922 relates to Category No.: 9305, 9247, 15848; Payload ID: 14923 relates to Category No.: 5561; Payload ID: 14925 relates to Category No.: 5762, 9162; Payload ID: 14926 relates to Category No.: 5561, 6717, 10056, 1792, 9734; Payload ID: 14927 relates to Category No.: 2890, 2194, 2441; Payload ID: 14928 relates to Category No.: 9305; Payload ID: 14929 relates to Category No.: 9305; Payload ID: 14930 relates to Category No.: 2890, 10056, 5570, 1792, 1016, 5561; Payload ID: 14931 relates to Category No.: 5561, 4010, 1792, 1016, 6717; Payload ID: 14932 relates to Category No.: 5561, 1017; Payload ID: 14933 relates to Category No.: 5561, 4010, 4008; Payload ID: 14934 relates to Category No.: 6717, 5762; Payload ID: 14936 relates to Category No.: 5561, 7118; Payload ID: 14937 relates to Category No.: 5561, 14174, 14394; Payload ID: 14940 relates to Category No.: 5561; Payload ID: 14941 relates to Category No.: 7118; Payload ID: 14942 relates to Category No.: 5561, 2890; Payload ID: 14945 relates to Category No.: 9305, 11837, 595, 11837; Payload ID: 14947 relates to Category No.: 9305; Payload ID: 14949 relates to Category No.: 4029; Payload ID: 14951 relates to Category No.: 5561, 6717; Payload ID: 14953 relates to Category No.: 5762; Payload ID: 14954 relates to Category No.: 5561, 9305, 11837, 595, 2890, 11837; Payload ID: 14956 relates to Category No.: 2890; Payload ID: 14959 relates to Category No.: 9305, 14174, 2890, 5762, 8935, 15139, 6813; Payload ID: 14960 relates to Category No.: 4755; Payload ID: 14962 relates to Category No.: 14174, 5762; Payload ID: 14964 relates to Category No.: 5561; Payload ID: 14965 relates to Category No.: 2890; Payload ID: 14970 relates to Category No.: 1792; Payload ID: 14972 relates to Category No.: 5561; Payload ID: 14975 relates to Category No.: 5561, 9305; Payload ID: 14978 relates to Category No.: 5570; Payload ID: 14983 relates to Category No.: 5561; Payload ID: 14984 relates to Category No.: 6717; Payload ID: 14985 relates to Category No.: 7087; Payload ID: 14986 relates to Category No.: 5561, 10056, 5570, 1748, 11653, 3059, 5823, 8935, 2942, 6717, 4008, 15139, 3036, 8948; Payload ID: 14987 relates to Category No.: 4029; Payload ID: 14993 relates to Category No.: 5561; Payload ID: 14994 relates to Category No.: 7118; Payload ID: 14996 relates to Category No.: 5591; Payload ID: 14998 relates to Category No.: 5561, 10056; Payload ID: 15000 relates to Category No.: 5561, 10056; Payload ID: 15002 relates to Category No.: 4030, 6443; Payload ID: 15003 relates to Category No.: 14912, 15870, 15864, 15856; Payload ID: 15004 relates to Category No.: 5561, 6717; Payload ID: 15005 relates to Category No.: 4945; Payload ID: 15007 relates to Category No.: 5762; Payload ID: 15011 relates to Category No.: 5561; Payload ID: 15016 relates to Category No.: 5466; Payload ID: 15018 relates to Category No.: 5561, 5762, 10056; Payload ID: 15021 relates to Category No.: 4780; Payload ID: 15022 relates to Category No.: 5561; Payload ID: 15023 relates to Category No.: 4780; Payload ID: 15029 relates to Category No.: 5762; Payload ID: 15030 relates to Category No.: 6717; Payload ID: 15037 relates to Category No.: 5561; Payload ID: 15038 relates to Category No.: 5561, 6717; Payload ID: 15039 relates to Category No.: 5561, 7118, 7087; Payload ID: 15040 relates to Category No.: 6717, 5762; Payload ID: 15041 relates to Category No.: 5762, 2194, 2458, 5797; Payload ID: 15042 relates to Category No.: 5561; Payload ID: 15043 relates to Category No.: 5561, 6717, 6440; Payload ID: 15046 relates to Category No.: 5561; Payload ID: 15049 relates to Category No.: 9247; Payload ID: 15053 relates to Category No.: 9305, 2890; Payload ID: 15054 relates to Category No.: 5561, 5762; Payload ID: 15055 relates to Category No.: 5561, 5762; Payload ID: 15056 relates to Category No.: 6368; Payload ID: 15057 relates to Category No.: 5561; Payload ID: 15063 relates to Category No.: 5561, 9305; Payload ID: 15070 relates to Category No.: 1700; Payload ID: 15071 relates to Category No.: 4029; Payload ID: 15072 relates to Category No.: 5561; Payload ID: 15073 relates to Category No.: 5762; Payload ID: 15074 relates to Category No.: 3666; Payload ID: 15077 relates to Category No.: 5762; Payload ID: 15078 relates to Category No.: 6717; Payload ID: 15081 relates to Category No.: 5561, 6717, 10056; Payload ID: 15087 relates to Category No.: 5561, 6960, 11883; Payload ID: 15089 relates to Category No.: 9756; Payload ID: 15090 relates to Category No.: 5561; Payload ID: 15092 relates to Category No.: 11925, 1368; Payload ID: 15093 relates to Category No.: 5561, 15151, 14707; Payload ID: 15096 relates to Category No.: 7072; Payload ID: 15099 relates to Category No.: 5762; Payload ID: 15100 relates to Category No.: 5561, 6717; Payload ID: 15101 relates to Category No.: 7118, 1233; Payload ID: 15106 relates to Category No.: 2890; Payload ID: 15107 relates to Category No.: 2890; Payload ID: 15108 relates to Category No.: 1107; Payload ID: 15112 relates to Category No.: 5561; Payload ID: 15116 relates to Category No.: 5561; Payload ID: 15120 relates to Category No.: 15139, 10056; Payload ID: 15121 relates to Category No.: 4008, 5379, 2473, 1239; Payload ID: 15123 relates to Category No.: 9305; Payload ID: 15124 relates to Category No.: 14174, 5762, 6041, 2947; Payload ID: 15126 relates to Category No.: 5561, 4029; Payload ID: 15127 relates to Category No.: 9305, 2890; Payload ID: 15129 relates to Category No.: 5561; Payload ID: 15136 relates to Category No.: 5561, 10056; Payload ID: 15138 relates to Category No.: 7118; Payload ID: 15139 relates to Category No.: 5561, 14174, 7118, 5762, 7061; Payload ID: 15142 relates to Category No.: 5727; Payload ID: 15144 relates to Category No.: 9305, 9273; Payload ID: 15147 relates to Category No.: 5561; Payload ID: 15149 relates to Category No.: 5561, 10056, 1182; Payload ID: 15155 relates to Category No.: 5561; Payload ID: 15160 relates to Category No.: 5561; Payload ID: 15163 relates to Category No.: 5762; Payload ID: 15167 relates to Category No.: 5561; Payload ID: 15170 relates to Category No.: 5561, 2644; Payload ID: 15172 relates to Category No.: 6717, 5570, 1099; Payload ID: 15174 relates to Category No.: 5561, 4029, 5570; Payload ID: 15176 relates to Category No.: 9305, 2890, 9242, 10104; Payload ID: 15177 relates to Category No.: 2890, 2194, 2942, 1182, 1811, 2458, 1046, 2441, 2457; Payload ID: 15178 relates to Category No.: 14174, 5762, 6041, 2947; Payload ID: 15179 relates to Category No.: 14174, 5762, 2947; Payload ID: 15180 relates to Category No.: 2890; Payload ID: 15181 relates to Category No.: 2942, 15466; Payload ID: 15182 relates to Category No.: 9305, 9242, 9247; Payload ID: 15183 relates to Category No.: 4030, 4029, 9305; Payload ID: 15184 relates to Category No.: 4030, 4029, 1792; Payload ID: 15185 relates to Category No.: 4030, 4029; Payload ID: 15186 relates to Category No.: 4030, 4029; Payload ID: 15187 relates to Category No.: 9305; Payload ID: 15188 relates to Category No.: 9305, 1691, 9242; Payload ID: 15189 relates to Category No.: 9305, 2890, 5776, 3523; Payload ID: 15190 relates to Category No.: 9305; Payload ID: 15191 relates to Category No.: 2890, 6717, 3652, 1748, 3036, 6017, 4199, 1017, 4860, 9730, 5829, 8948; Payload ID: 15193 relates to Category No.: 9305, 2890, 6960, 2899, 4755, 1748, 11650, 11653, 6968, 3521, 2926; Payload ID: 15194 relates to Category No.: 2942, 4010, 2926; Payload ID: 15195 relates to Category No.: 6443, 4755, 3521, 6059; Payload ID: 15197 relates to Category No.: 2942, 10056; Payload ID: 15199 relates to Category No.: 9305, 2890, 5776, 9247, 1090; Payload ID: 15200 relates to Category No.: 9305, 7118, 2890, 9247, 9181; Payload ID: 15201 relates to Category No.: 9247, 9157, 2890, 9305, 15505; Payload ID: 15202 relates to Category No.: 9305, 2890, 5776, 9242, 4755, 9157; Payload ID: 15203 relates to Category No.: 2890, 5776, 9247, 4755, 9305, 6717, 6976, 4010, 5466, 9153, 9181, 7179, 15130; Payload ID: 15204 relates to Category No.: 9305, 2890, 6717, 5762, 9247, 4010, 5466, 9153, 9181, 7179, 15130, 9167, 14145; Payload ID: 15207 relates to Category No.: 1842; Payload ID: 15208 relates to Category No.: 9305, 2890; Payload ID: 15210 relates to Category No.: 5561, 2890, 6717, 10056, 2942, 5570, 1720, 14371, 4010, 14368, 5342, 5920, 15282, 11883, 15758, 5919, 14683, 1700; Payload ID: 15211 relates to Category No.: 5561, 6717, 10056, 2942, 14371, 4010, 14368, 11883, 16326, 5920, 1402, 14364, 14683, 1700; Payload ID: 15212 relates to Category No.: 5561, 6717, 5919, 14371, 2942, 3666, 9734, 1700; Payload ID: 15214 relates to Category No.: 9305, 14368, 11883, 2890, 8935, 16326, 6449, 196, 5342; Payload ID: 15215 relates to Category No.: 4010, 6743, 4053; Payload ID: 15216 relates to Category No.: 4030, 9305, 2890, 9247, 4010, 14327; Payload ID: 15217 relates to Category No.: 4029, 9305, 2890, 2938, 10056, 2942; Payload ID: 15218 relates to Category No.: 4030, 9305, 2890, 2942, 9734, 4010, 6617; Payload ID: 15219 relates to Category No.: 2890, 10056, 9247, 9734, 1748, 6968, 4010; Payload ID: 15220 relates to Category No.: 2890, 10056, 9242, 2942, 4010, 9305; Payload ID: 15221 relates to Category No.: 1842; Payload ID: 15222 relates to Category No.: 2890, 9242; Payload ID: 15223 relates to Category No.: 4030, 9305, 9734, 4010, 8935; Payload ID: 15224 relates to Category No.: 9305, 8948; Payload ID: 15225 relates to Category No.: 9305, 2890, 2942, 4043, 9734, 4010, 14327, 9162; Payload ID: 15226 relates to Category No.: 4029, 9305, 2890, 2942, 3666, 4010, 4228; Payload ID: 15227 relates to Category No.: 2890; Payload ID: 15229 relates to Category No.: 4030, 4029, 9305, 2938, 10056, 2942, 4010; Payload ID: 15230 relates to Category No.: 4030, 4029, 9305, 2938, 10056, 2942, 4010; Payload ID: 15231 relates to Category No.: 4029, 9305, 2890, 5776, 9734, 14327, 8948, 4030; Payload ID: 15232 relates to Category No.: 1099, 779; Payload ID: 15233 relates to Category No.: 9305, 2890, 4010, 6991; Payload ID: 15235 relates to Category No.: 9305; Payload ID: 15236 relates to Category No.: 4029; Payload ID: 15237 relates to Category No.: 5561, 4765, 3673, 4755, 657, 5557; Payload ID: 15238 relates to Category No.: 2890, 6976, 14893; Payload ID: 15239 relates to Category No.: 9305, 7118, 6717, 6994, 6222; Payload ID: 15240 relates to Category No.: 9305, 7118, 2890, 3036, 1017, 1712; Payload ID: 15241 relates to Category No.: 5776, 6196, 9184, 9162, 5561, 2890, 9305, 5565, 261; Payload ID: 15242 relates to Category No.: 5561, 6196, 9176, 9184, 3696, 9162, 2632, 9158, 15269; Payload ID: 15243 relates to Category No.: 5561, 9162, 6196; Payload ID: 15244 relates to Category No.: 5561, 9176, 1842, 9162; Payload ID: 15245 relates to Category No.: 9247; Payload ID: 15246 relates to Category No.: 401, 14355; Payload ID: 15247 relates to Category No.: 9305, 2890; Payload ID: 15248 relates to Category No.: 9305, 2890; Payload ID: 15249 relates to Category No.: 2890, 9305; Payload ID: 15250 relates to Category No.: 2890, 9305, 2942, 5762; Payload ID: 15251 relates to Category No.: 11883, 6717; Payload ID: 15252 relates to Category No.: 2890, 9305; Payload ID: 15253 relates to Category No.: 9305, 5762, 10056, 9247; Payload ID: 15254 relates to Category No.: 9305, 14327, 2942; Payload ID: 15255 relates to Category No.: 9305; Payload ID: 15256 relates to Category No.: 5561, 7118, 7070, 4010, 9478, 7106, 7048; Payload ID: 15257 relates to Category No.: 2942, 10002, 10000; Payload ID: 15258 relates to Category No.: 9305, 5776, 9247, 9215, 15501; Payload ID: 15259 relates to Category No.: 9305, 9247, 5730; Payload ID: 15260 relates to Category No.: 9242, 9247; Payload ID: 15261 relates to Category No.: 14370; Payload ID: 15262 relates to Category No.: 6717, 14362, 5561, 2890, 2938, 14363, 3518, 1811, 6743, 3517; Payload ID: 15263 relates to Category No.: 5561, 2890, 2938, 5570, 14362, 14363, 3518, 3517; Payload ID: 15264 relates to Category No.: 5561, 2890, 2938, 10056, 14362, 14363, 3518, 3517; Payload ID: 15265 relates to Category No.: 5561, 14362, 6717, 2938, 10056, 5570, 4755, 14363, 3036, 3518, 3040; Payload ID: 15266 relates to Category No.: 5561, 2890, 2938, 10056, 14362, 14363, 3517; Payload ID: 15267 relates to Category No.: 5561, 2890, 2938, 14362, 14363, 10056; Payload ID: 15268 relates to Category No.: 6976, 5570, 14363, 11693, 14683, 5561; Payload ID: 15269 relates to Category No.: 5561, 6717, 14371, 14368; Payload ID: 15270 relates to Category No.: 9305, 9247; Payload ID: 15271 relates to Category No.: 7118, 7060; Payload ID: 15272 relates to Category No.: 5561, 5570, 3518, 15627, 1748, 14363, 11653; Payload ID: 15273 relates to Category No.: 3185, 2194, 2183; Payload ID: 15274 relates to Category No.: 9305, 9247, 10104, 9181, 2402, 9172; Payload ID: 15275 relates to Category No.: 2890, 9247, 9181, 15505, 5110; Payload ID: 15276 relates to Category No.: 5561, 5776, 2927; Payload ID: 15277 relates to Category No.: 9305, 9247; Payload ID: 15278 relates to Category No.: 2890, 5776, 9247, 4010; Payload ID: 15279 relates to Category No.: 9247, 9158; Payload ID: 15280 relates to Category No.: 9305; Payload ID: 15281 relates to Category No.: 5561, 2574, 4765, 3673; Payload ID: 15282 relates to Category No.: 6717, 5570, 1792; Payload ID: 15283 relates to Category No.: 5561, 6717, 10056, 4010, 1792, 6440, 1659, 3638, 2890, 5570, 6991; Payload ID: 15284 relates to Category No.: 5561, 6717, 4010, 4228, 6440, 6437, 6443; Payload ID: 15285 relates to Category No.: 5561, 10056, 3638; Payload ID: 15286 relates to Category No.: 5561, 4228; Payload ID: 15287 relates to Category No.: 6717, 4010; Payload ID: 15288 relates to Category No.: 6717, 4030, 2890, 5762, 4014; Payload ID: 15289 relates to Category No.: 9305, 2890, 9247, 493; Payload ID: 15291 relates to Category No.: 5561; Payload ID: 15292 relates to Category No.: 5762; Payload ID: 15294 relates to Category No.: 9305; Payload ID: 15296 relates to Category No.: 2890; Payload ID: 15297 relates to Category No.: 2890, 4010, 2701; Payload ID: 15298 relates to Category No.: 2890, 2938, 1720, 4010, 1335; Payload ID: 15299 relates to Category No.: 2890, 2194, 2942, 2183; Payload ID: 15300 relates to Category No.: 9305, 15505; Payload ID: 15301 relates to Category No.: 4030, 4029, 12159, 4014, 4755; Payload ID: 15302 relates to Category No.: 4030; Payload ID: 15303 relates to Category No.: 9305, 9247; Payload ID: 15304 relates to Category No.: 9305, 5776, 9247, 493; Payload ID: 15305 relates to Category No.: 7118, 7048, 7389; Payload ID: 15306 relates to Category No.: 7118, 7048, 9247, 7060, 7389; Payload ID: 15307 relates to Category No.: 2890; Payload ID: 15309 relates to Category No.: 9305; Payload ID: 15310 relates to Category No.: 9157, 9305; Payload ID: 15311 relates to Category No.: 10056, 9247, 11653, 11723, 1811, 1803, 6017, 1750, 4010, 14390, 1099, 7367, 2890; Payload ID: 15312 relates to Category No.: 9305, 2890, 6717, 6976, 2477, 4755, 2663, 3685; Payload ID: 15313 relates to Category No.: 4755, 9734, 3696, 2504; Payload ID: 15314 relates to Category No.: 2890, 4755, 6017; Payload ID: 15315 relates to Category No.: 1700, 9305, 9242; Payload ID: 15316 relates to Category No.: 9305; Payload ID: 15317 relates to Category No.:

9305, 2890, 9247, 14584, 14583; Payload ID: 15318 relates to Category No.: 9305, 1842; Payload ID: 15319 relates to Category No.: 10056, 2942, 2477, 3673, 14707, 4780, 4760, 4786, 5561, 1700; Payload ID: 15320 relates to Category No.: 1700, 1842; Payload ID: 15321 relates to Category No.: 5561, 6717, 3673, 4010; Payload ID: 15322 relates to Category No.: 5561, 6717, 3673; Payload ID: 15323 relates to Category No.: 2942, 4765, 3673, 4010, 5964, 3832, 9162, 9206, 4420; Payload ID: 15324 relates to Category No.: 1402; Payload ID: 15325 relates to Category No.: 5561, 6717, 4755; Payload ID: 15326 relates to Category No.: 5561, 9305, 2890, 4010, 2942, 5762; Payload ID: 15327 relates to Category No.: 5561, 5762, 4010; Payload ID: 15328 relates to Category No.: 5561, 5762; Payload ID: 15329 relates to Category No.: 5561, 5762; Payload ID: 15330 relates to Category No.: 5561, 5762; Payload ID: 15331 relates to Category No.: 4765, 2890, 2942, 3673, 4755; Payload ID: 15332 relates to Category No.: 5776, 2942, 4765, 3673; Payload ID: 15333 relates to Category No.: 14707, 3673, 5561; Payload ID: 15334 relates to Category No.: 5561, 3673, 6709, 3832, 3686, 3685, 4765; Payload ID: 15335 relates to Category No.: 5561, 14707, 3673, 3666; Payload ID: 15336 relates to Category No.: 2942, 4765, 3673, 3666, 2668, 3832, 14685, 9734, 3831; Payload ID: 15337 relates to Category No.: 5776, 2668, 6717, 4765, 3673, 3652, 3686, 9734; Payload ID: 15338 relates to Category No.: 2890, 5776, 2942, 4765, 3831, 3832, 3685, 9734, 2477, 3669, 9732; Payload ID: 15339 relates to Category No.: 2942, 4765, 3673, 9734, 2668, 3832; Payload ID: 15340 relates to Category No.: 6717, 2942, 4765, 3673, 9734, 2668, 3832, 3831; Payload ID: 15341 relates to Category No.: 2668, 2942, 4765, 3673, 9734, 3832; Payload ID: 15342 relates to Category No.: 2942, 4765, 3673, 9734, 2668, 3832; Payload ID: 15343 relates to Category No.: 2890, 5776, 2942, 4765, 3673, 3666, 9734, 2668, 3831, 3669, 3832, 16157; Payload ID: 15344 relates to Category No.: 3673, 3832, 16157; Payload ID: 15345 relates to Category No.: 5561, 6717, 2942, 5557, 14293; Payload ID: 15346 relates to Category No.: 5561, 6717, 2942, 3673; Payload ID: 15347 relates to Category No.: 5561, 14394, 6717, 2942, 3673, 3666, 3679; Payload ID: 15348 relates to Category No.: 5561, 6717, 2942, 3673; Payload ID: 15349 relates to Category No.: 5561, 6717, 2942, 3673, 3666, 5730, 493, 14293; Payload ID: 15350 relates to Category No.: 5561, 6717, 2942, 3673, 3666, 5762; Payload ID: 15351 relates to Category No.: 9305, 2890, 9184, 1700; Payload ID: 15352 relates to Category No.: 1700, 4010; Payload ID: 15353 relates to Category No.: 1700; Payload ID: 15354 relates to Category No.: 7118, 9247, 14145; Payload ID: 15356 relates to Category No.: 4029, 9305, 2890, 2942, 8935, 15139, 15628; Payload ID: 15357 relates to Category No.: 4030, 5561, 10056, 4755, 4010; Payload ID: 15358 relates to Category No.: 4030, 4029, 5762, 10056, 2942, 12159, 4014, 4010, 1792; Payload ID: 15359 relates to Category No.: 4030, 4014; Payload ID: 15360 relates to Category No.: 4030, 9305, 2890, 1792, 4029; Payload ID: 15361 relates to Category No.: 4030; Payload ID: 15362 relates to Category No.: 4030, 4029, 4010; Payload ID: 15363 relates to Category No.: 4030, 4029, 4010, 2890, 778, 1774, 9734, 6756; Payload ID: 15364 relates to Category No.: 4029, 4010; Payload ID: 15365 relates to Category No.: 4030, 4029, 2890, 12159, 1090, 1792, 10076, 9181, 10077, 3637, 10078, 9305, 5762, 6756; Payload ID: 15366 relates to Category No.: 4029, 1842; Payload ID: 15367 relates to Category No.: 5561, 6717, 10056, 5570, 2901; Payload ID: 15368 relates to Category No.: 5762, 4755, 4010, 3666, 14368; Payload ID: 15369 relates to Category No.: 5762, 2942, 3673, 4760, 3832, 3666, 4755; Payload ID: 15370 relates to Category No.: 9305, 2890, 9242, 5730; Payload ID: 15371 relates to Category No.: 4010, 2890, 5762, 4030, 9162, 3666, 14409, 14293; Payload ID: 15372 relates to Category No.: 4029; Payload ID: 15373 relates to Category No.: 4029; Payload ID: 15374 relates to Category No.: 4030; Payload ID: 15375 relates to Category No.: 4030; Payload ID: 15376 relates to Category No.: 4029; Payload ID: 15377 relates to Category No.: 4030; Payload ID: 15378 relates to Category No.: 1842; Payload ID: 15379 relates to Category No.: 4029; Payload ID: 15380 relates to Category No.: 4030, 4010; Payload ID: 15381 relates to Category No.: 4029, 3637; Payload ID: 15382 relates to Category No.: 4030, 14409; Payload ID: 15383 relates to Category No.: 4029, 2926, 15628, 14411; Payload ID: 15384 relates to Category No.: 4029, 14409; Payload ID: 15385 relates to Category No.: 5561, 15573, 12440, 2504, 15139, 15161, 16346; Payload ID: 15386 relates to Category No.: 5561, 5776, 9247, 4755, 12440, 4010, 15574, 15627; Payload ID: 15387 relates to Category No.: 5561, 4010; Payload ID: 15388 relates to Category No.: 5561, 15627; Payload ID: 15389 relates to Category No.: 5561, 10056, 4765, 1748, 14707, 12440, 15161, 15574; Payload ID: 15390 relates to Category No.: 4030, 4029, 4014, 4010; Payload ID: 15391 relates to Category No.: 2890; Payload ID: 15392 relates to Category No.: 2942, 2630, 5964, 9162, 9206, 4420; Payload ID: 15393 relates to Category No.: 5561, 10056, 3666, 4030, 9734, 3054, 8948, 3055, 775; Payload ID: 15394 relates to Category No.: 5561, 3673, 3666, 8948; Payload ID: 15395 relates to Category No.: 5561, 10056, 3673, 3666, 8948; Payload ID: 15396 relates to Category No.: 9756, 4010; Payload ID: 15397 relates to Category No.: 5561, 3673, 3104, 5278; Payload ID: 15398 relates to Category No.: 5561; Payload ID: 15399 relates to Category No.: 5561, 9305, 9247; Payload ID: 15400 relates to Category No.: 5561, 4030, 10056, 9734, 2534, 6743, 1659, 2712; Payload ID: 15401 relates to Category No.: 10056, 5570, 4008, 1792; Payload ID: 15402 relates to Category No.: 2890, 6717, 9247, 4030, 10056, 5570, 4008, 10082, 10078, 5561; Payload ID: 15403 relates to Category No.: 5561, 6717, 10056, 5570, 16026; Payload ID: 15404 relates to Category No.: 4030, 6717, 9242, 2942, 4010; Payload ID: 15405 relates to Category No.: 2942; Payload ID: 15406 relates to Category No.: 2890, 10056, 9184; Payload ID: 15408 relates to Category No.: 5561; Payload ID: 15409 relates to Category No.: 4755, 3666; Payload ID: 15410 relates to Category No.: 3673; Payload ID: 15412 relates to Category No.: 4029, 4010, 4030, 5561; Payload ID: 15413 relates to Category No.: 5561, 1700, 3666; Payload ID: 15415 relates to Category No.: 2890; Payload ID: 15416 relates to Category No.: 4030, 4029, 1017, 3036; Payload ID: 15417 relates to Category No.: 4030, 6717, 3666, 4010; Payload ID: 15418 relates to Category No.: 4030, 4010; Payload ID: 15419 relates to Category No.: 4030, 5561; Payload ID: 15420 relates to Category No.: 4030, 4029; Payload ID: 15421 relates to Category No.: 4030; Payload ID: 15422 relates to Category No.: 4030, 6717, 4010; Payload ID: 15423 relates to Category No.: 4030, 5561, 6717, 10056; Payload ID: 15424 relates to Category No.: 5561, 6717, 15139, 10056; Payload ID: 15425 relates to Category No.: 4030, 5561, 6717, 1748, 11650, 11653, 15161; Payload ID: 15426 relates to Category No.: 4030, 6717, 10056, 5570; Payload ID: 15427 relates to Category No.: 4030, 6717, 10056, 5570, 3666, 5561, 11653, 15139; Payload ID: 15428 relates to Category No.: 4030, 5561, 6717, 10056; Payload ID: 15429 relates to Category No.: 5561, 6717, 10056, 4010; Payload ID: 15430 relates to Category No.: 5561, 6717, 10056; Payload ID: 15431 relates to Category No.: 5561, 6717, 5570, 1017; Payload ID: 15432 relates to Category No.: 6717, 5570; Payload ID: 15433 relates to Category No.: 6717, 5570; Payload ID: 15434 relates to Category No.: 2890, 6717, 10056, 5570, 5561; Payload ID: 15435 relates to Category No.: 6717, 10056, 677, 4008; Payload ID: 15436 relates to Category No.: 4030, 4029, 9305, 14409, 4010, 11883; Payload ID: 15437 relates to Category No.: 4030, 4029, 9305, 14409, 4010; Payload ID: 15438 relates to Category No.: 9305, 2890, 9242, 9247, 9158, 2420, 15269, 1017, 4860; Payload ID: 15440 relates to Category No.: 2458; Payload ID: 15441 relates to Category No.: 9305, 2890; Payload ID: 15442 relates to Category No.: 2890, 2942, 9247, 4010, 7118; Payload ID: 15443 relates to Category No.: 6994, 6692; Payload ID: 15444 relates to Category No.: 2890, 2938; Payload ID: 15445 relates to Category No.: 2890, 1748, 1017, 4010, 3055, 14999; Payload ID: 15446 relates to Category No.: 6994, 9734, 6968, 14893, 14466, 2514, 14999, 14815; Payload ID: 15447 relates to Category No.: 2890, 2938; Payload ID: 15448 relates to Category No.: 9305, 2890, 9242, 9247, 6994, 273, 2630, 1720, 14893, 4010, 2514, 2446, 1792, 15139, 10056, 1774, 7366, 2457, 9734, 3982; Payload ID: 15449 relates to Category No.: 2890, 2938, 15139, 1748; Payload ID: 15450 relates to Category No.: 9305, 7118, 2938, 14826, 1774, 7366, 7244, 14815; Payload ID: 15451 relates to Category No.: 2938, 10056, 15151, 15139, 1720, 15280, 1033; Payload ID: 15452 relates to Category No.: 6994, 2630, 14893, 14466, 2514, 15151, 1033; Payload ID: 15453 relates to Category No.: 9305, 2890, 10056, 9242, 2942, 6994, 273, 2630, 6968, 14893, 4010, 1046, 14466, 779, 2514, 14999, 15139, 1720, 1033; Payload ID: 15454 relates to Category No.: 2890, 2938, 7366; Payload ID: 15455 relates to Category No.: 2890, 6960, 273, 9734, 14999; Payload ID: 15456 relates to Category No.: 493, 6443, 2890, 2942, 3666, 9247, 2903, 997, 4010, 2926, 6059, 10104, 5412, 11687; Payload ID: 15457 relates to Category No.: 4030, 4029, 4755, 14409, 6617, 10077, 4765, 16344; Payload ID: 15458 relates to Category No.: 5561, 7118, 2890, 3666, 9247, 12159; Payload ID: 15459 relates to Category No.: 2942, 4010; Payload ID: 15460 relates to Category No.: 7118, 2890; Payload ID: 15461 relates to Category No.: 2890, 4010, 7118; Payload ID: 15462 relates to Category No.: 7118, 9734, 9756, 1842, 2899; Payload ID: 15463 relates to Category No.: 9305, 2890, 2942, 9247, 4010, 7118; Payload ID: 15464 relates to Category No.: 9305, 7118, 2890, 7048, 6968, 7060, 4010, 7068, 7052; Payload ID: 15465 relates to Category No.: 5561, 6717, 10056, 3673, 4010; Payload ID: 15466 relates to Category No.: 5561, 6717, 4010; Payload ID: 15467 relates to Category No.: 5561, 6717, 10056, 4755; Payload ID: 15468 relates to Category No.: 5561, 6717; Payload ID: 15469 relates to Category No.: 5561, 6717, 10056, 3673, 4010, 4755, 7366; Payload ID: 15470 relates to Category No.: 5561, 3673, 14488, 14925; Payload ID: 15471 relates to Category No.: 5561, 3673, 14488, 7118; Payload ID: 15472 relates to Category No.: 5561, 3673, 14488; Payload ID: 15473 relates to Category No.: 5561, 14488; Payload ID: 15474 relates to Category No.: 5561, 14488; Payload ID: 15475 relates to Category No.: 4010, 4030; Payload ID: 15476 relates to Category No.: 4029; Payload ID: 15477 relates to Category No.: 4029; Payload ID: 15478 relates to Category No.: 4029, 2890, 8935, 262; Payload ID: 15479 relates to Category No.: 4029; Payload ID: 15480 relates to Category No.: 4029, 2890, 2942, 3673, 3666, 9734, 1720, 4010, 3779; Payload ID: 15481 relates to Category No.: 4029; Payload ID: 15482 relates to Category No.: 4029; Payload ID: 15483 relates to Category No.: 4029; Payload ID: 15484 relates to Category No.: 4029; Payload ID: 15485 relates to Category No.: 4030, 4029, 6717, 4010, 10056, 5561; Payload ID: 15486 relates to Category No.: 4029; Payload ID: 15487 relates to Category No.: 5561, 4029, 2890, 10056, 9305; Payload ID: 15488 relates to Category No.: 4029; Payload ID: 15489 relates to Category No.: 2890, 8948, 10056, 778; Payload ID: 15490 relates to Category No.: 9305, 2890, 6717, 1099, 779, 2938; Payload ID: 15491 relates to Category No.: 9305, 2942, 9247, 1635, 9215, 9181, 14912; Payload ID: 15492 relates to Category No.: 9247, 1635, 9215, 1377; Payload ID: 15494 relates to Category No.: 9305; Payload ID: 15496 relates to Category No.: 9305, 2890, 9247, 3991, 4010, 1635, 9215; Payload ID: 15497 relates to Category No.: 9305, 2890, 9247, 9215; Payload ID: 15498 relates to Category No.: 9305, 9247; Payload ID: 15499 relates to Category No.: 9247; Payload ID: 15500 relates to Category No.: 9305, 2890, 9247, 4010, 9215, 14912; Payload ID: 15501 relates to Category No.: 2890, 9247, 9305; Payload ID: 15502 relates to Category No.: 9305, 9247, 9215; Payload ID: 15503 relates to Category No.: 9305, 2890, 9242, 9247, 9215; Payload ID: 15504 relates to Category No.: 9247, 9215, 9305; Payload ID: 15505 relates to Category No.: 9305, 2890, 9247, 4010; Payload ID: 15506 relates to Category No.: 9305; Payload ID: 15507 relates to Category No.: 9242, 9247; Payload ID: 15508 relates to Category No.: 2890, 10056, 4010; Payload ID: 15509 relates to Category No.: 9305, 7118, 2890, 6717, 2942, 4010, 15241; Payload ID: 15510 relates to Category No.: 2890, 5776, 6440; Payload ID: 15511 relates to Category No.: 2890, 6717, 9734, 4786; Payload ID: 15512 relates to Category No.: 9305; Payload ID: 15513 relates to Category No.: 9305, 10056, 3685, 273; Payload ID: 15515 relates to Category No.: 9305, 2890, 6717, 9242, 2942, 9247, 4010, 5762; Payload ID: 15516 relates to Category No.: 2890, 4755, 4010, 4765, 5762; Payload ID: 15517 relates to Category No.: 9305, 2890, 2942, 11883; Payload ID: 15518 relates to Category No.: 262; Payload ID: 15519 relates to Category No.: 5762, 10056; Payload ID: 15520 relates to Category No.: 5762; Payload ID: 15521 relates to Category No.: 5762; Payload ID: 15522 relates to Category No.: 9734; Payload ID: 15523 relates to Category No.: 2890, 9242; Payload ID: 15524 relates to Category No.: 9305, 2890; Payload ID: 15525 relates to Category No.: 9305, 2890, 7180; Payload ID: 15526 relates to Category No.: 2890, 6717, 273; Payload ID: 15527 relates to Category No.: 9305, 2890, 2942, 9247, 11883, 5762; Payload ID: 15528 relates to Category No.: 2890, 9247; Payload ID: 15529 relates to Category No.: 9305, 2890, 10056, 2942, 9247, 14681, 14682; Payload ID: 15531 relates to Category No.: 9305, 2890, 2194, 2942, 4765, 9247, 4755, 9734, 4010, 1772, 779, 4786, 5762; Payload ID: 15532 relates to Category No.: 9305, 2890, 2942; Payload ID: 15533 relates to Category No.: 5762; Payload ID: 15534 relates to Category No.: 5561, 10056, 4043; Payload ID: 15535 relates to Category No.: 5561; Payload ID: 15536 relates to Category No.: 5561; Payload ID: 15537 relates to Category No.: 12439, 3693, 6994, 3521, 14100; Payload ID: 15538 relates to Category No.: 2194, 2942, 1811, 2183; Payload ID: 15539 relates to Category No.: 4030; Payload ID: 15540 relates to Category No.: 4030, 4010; Payload ID: 15541 relates to Category No.: 4030; Payload ID: 15542 relates to Category No.: 4030, 10056; Payload ID: 15543 relates to Category No.: 4030; Payload ID: 15544 relates to Category No.: 4030, 4029, 9305, 5762, 1239, 4010; Payload ID: 15546 relates to Category No.: 4030, 4010; Payload ID: 15547 relates to Category No.: 4030, 4029, 6717, 4008, 4010, 11883, 10076, 261, 10084, 11876, 11875, 11872, 11873, 11874, 11870, 11871, 11867, 11868, 11869; Payload ID: 15548 relates to Category No.: 4030, 4010; Payload ID: 15549 relates to Category No.: 4029, 4010; Payload ID: 15550 relates to Category No.: 4030, 2890, 6717; Payload ID: 15551 relates to Category No.: 4030, 2890, 6717, 4010; Payload ID: 15552 relates to Category No.: 4030, 9305, 2890; Payload ID: 15553 relates to Category No.: 4030, 2890; Payload ID: 15554 relates to Category No.: 4030, 2890, 4010; Payload ID: 15555 relates to Category No.: 4030, 2890, 9247, 4010, 5561; Payload ID: 15556 relates to Category No.: 4030, 4029, 2890, 10056; Payload ID: 15557 relates to Category No.: 4030, 9305, 2890, 4010, 2926, 16156; Payload ID: 15558 relates to Category No.: 4030, 2890, 5762, 4010; Payload ID: 15559 relates to Category No.: 4030, 2890, 4010; Payload ID: 15560 relates to Category No.: 4030, 2890, 2942, 4010, 11883; Payload ID: 15561 relates to Category No.: 4030, 2890; Payload ID: 15562 relates to Category No.: 4030, 2890, 2942, 4010; Payload ID: 15563 relates to Category No.: 4030, 9305, 2890, 6717, 5762, 2942, 4010; Payload ID: 15564 relates to Category No.: 4030, 4029, 10056, 1239, 4010; Payload ID: 15565 relates to Category No.: 4030, 4029, 4010; Payload ID: 15566 relates to Category No.: 4030, 4029, 10056, 4014, 4010, 10077; Payload ID: 15567 relates to Category No.: 4030, 4029, 2942, 4014, 8917, 10076, 4032, 4046, 6717, 8948; Payload ID: 15568 relates to Category No.: 4030; Payload ID: 15569 relates to Category No.: 4030, 4029, 4014, 4010, 6709, 1090, 1017, 8948, 9734, 1028; Payload ID: 15571 relates to Category No.: 4030, 4029, 1239, 4010, 10077; Payload ID: 15572 relates to Category No.: 3666, 4010, 6743, 3671, 3685, 2890; Payload ID: 15573 relates to Category No.: 4030, 4010; Payload ID: 15574 relates to Category No.: 4030, 4010; Payload ID: 15575 relates to Category No.: 9305, 2890, 6717, 9734, 4010, 10056; Payload ID: 15576 relates to Category No.: 9305, 2890, 9247; Payload ID: 15578 relates to Category No.: 9305, 2890; Payload ID: 15579 relates to Category No.: 9305; Payload ID: 15581 relates to Category No.: 4030, 4029, 2942, 2901, 5059, 4010, 3637; Payload ID: 15582 relates to Category No.: 4030, 4029, 5059, 4010; Payload ID: 15583 relates to Category No.: 4030, 4029, 5059, 4010; Payload ID: 15584 relates to Category No.: 4030; Payload ID: 15585 relates to Category No.: 2890, 2942, 6743, 1659; Payload ID: 15586 relates to Category No.: 9305, 2890, 9247, 9157; Payload ID: 15587 relates to Category No.: 9305, 9734, 192; Payload ID: 15588 relates to Category No.: 7118, 2890, 10056, 2942, 3673, 9247, 9305, 8935, 9734; Payload ID: 15589 relates to Category No.: 9305, 5762, 2942, 1842; Payload ID: 15590 relates to Category No.: 12439, 2942, 2899, 3521; Payload ID: 15591 relates to Category No.: 2890, 2942, 4010, 7118; Payload ID: 15592 relates to Category No.: 7118, 2890, 7060; Payload ID: 15593 relates to Category No.: 9305, 2942; Payload ID: 15594 relates to Category No.: 9305, 2890, 2942, 7118; Payload ID: 15595 relates to Category No.: 9305; Payload ID: 15596 relates to Category No.: 9305, 2890; Payload ID: 15597 relates to Category No.: 9305, 2890, 2942, 9247; Payload ID: 15598 relates to Category No.: 2890, 9247, 9305; Payload ID: 15600 relates to Category No.: 5561, 9305; Payload ID: 15601 relates to Category No.: 6717, 16057; Payload ID: 15602 relates to Category No.: 9305; Payload ID: 15603 relates to Category No.: 9305, 14614, 2628; Payload ID: 15604 relates to Category No.: 2420, 9242, 9247, 9305; Payload ID: 15605 relates to Category No.: 9305, 9242, 9247, 2420; Payload ID: 15606 relates to Category No.: 9305, 9247, 14529, 9215, 5216; Payload ID: 15607 relates to Category No.: 2890, 9247, 2420, 14529, 9215, 5216, 9305; Payload ID: 15608 relates to Category No.: 9305, 9247, 2420; Payload ID: 15609 relates to Category No.: 9247, 9157; Payload ID: 15610 relates to Category No.: 9242; Payload ID: 15612 relates to Category No.: 9305, 2890, 9247; Payload ID: 15614 relates to Category No.: 9305, 2890, 5776, 10056, 9247, 9157, 2420; Payload ID: 15615 relates to Category No.: 9305, 9247, 2420; Payload ID: 15616 relates to Category No.: 9305, 2890, 2942, 3666, 9247, 9734, 11883; Payload ID: 15617 relates to Category No.: 9305, 2890; Payload ID: 15618 relates to Category No.: 9305, 9247, 2419; Payload ID: 15619 relates to Category No.: 9305; Payload ID: 15620 relates to Category No.: 9305, 9603; Payload ID: 15621 relates to Category No.: 9305; Payload ID: 15622 relates to Category No.: 9305, 2890, 9247, 9215, 9220; Payload ID: 15623 relates to Category No.: 4029, 4010; Payload ID: 15624 relates to Category No.: 2942, 2183; Payload ID: 15625 relates to Category No.: 5561; Payload ID: 15626 relates to Category No.: 5561, 4010; Payload ID: 15627 relates to Category No.: 5561; Payload ID: 15628 relates to Category No.: 9305, 2890, 2942, 15892, 5964; Payload ID: 15629 relates to Category No.: 2890, 2942; Payload ID: 15630 relates to Category No.: 5762, 2942; Payload ID: 15631 relates to Category No.: 2890, 2942; Payload ID: 15632 relates to Category No.: 5762, 2942; Payload ID: 15633 relates to Category No.: 2890, 6717; Payload ID: 15634 relates to Category No.: 2890; Payload ID: 15636 relates to Category No.: 1748, 11650, 11653; Payload ID: 15637 relates to Category No.: 2890; Payload ID: 15639 relates to Category No.: 5762, 9305, 6717, 2942; Payload ID: 15640 relates to Category No.: 14999, 14327, 276, 2890; Payload ID: 15641 relates to Category No.: 2942; Payload ID: 15642 relates to Category No.: 2942; Payload ID: 15643 relates to Category No.: 5762; Payload ID: 15644 relates to Category No.: 5762; Payload ID: 15645 relates to Category No.: 2890, 6717, 5762, 10056, 8935, 1748, 3036, 11653, 5851, 3055, 3972, 9079, 8951, 15139; Payload ID: 15646 relates to Category No.: 10002, 10056, 8935, 11653, 3055, 10000, 5851, 8902, 1748, 11650, 8948, 1842, 4860, 779, 1336, 2446; Payload ID: 15647 relates to Category No.: 10056, 8935, 8945; Payload ID: 15648 relates to Category No.: 2890, 1748, 1774, 10106; Payload ID: 15649 relates to Category No.: 2890, 1748, 1774, 10106; Payload ID: 15650 relates to Category No.: 14329; Payload ID: 15651 relates to Category No.: 1842; Payload ID: 15652 relates to Category No.: 2926, 10056, 12439; Payload ID: 15653 relates to Category No.: 2942; Payload ID: 15654 relates to Category No.: 4030, 9305, 2890, 4010; Payload ID: 15655 relates to Category No.: 9247, 4010; Payload ID: 15656 relates to Category No.: 9305, 2890, 6017, 4010, 1700; Payload ID: 15657 relates to Category No.: 2890; Payload ID: 15658 relates to Category No.: 2890; Payload ID: 15660 relates to Category No.: 10056, 2942, 9247, 4755; Payload ID: 15661 relates to Category No.: 4010; Payload ID: 15662 relates to Category No.: 2942, 4755, 9734, 6017; Payload ID: 15663 relates to Category No.: 9247; Payload ID: 15665 relates to Category No.: 2890; Payload ID: 15666 relates to Category No.: 2890; Payload ID: 15668 relates to Category No.: 9305, 2890, 2534, 4010, 2504; Payload ID: 15669 relates to Category No.: 7118, 2890; Payload ID: 15670 relates to Category No.: 2890, 10056, 2534, 2504, 766; Payload ID: 15671 relates to Category No.: 2890, 1748, 1774, 10106, 3523; Payload ID: 15672 relates to Category No.: 2890, 10056, 2942, 4765, 4010, 2503; Payload ID: 15673 relates to Category No.: 2890, 4010, 3523, 3521; Payload ID: 15674 relates to Category No.: 2890, 4765, 6994, 7070, 1001, 4010, 2926, 6717, 11883; Payload ID: 15675 relates to Category No.: 9305, 2890, 9247; Payload ID: 15676 relates to Category No.: 2938, 10056, 2942, 8935, 15139, 2927, 4228, 1811; Payload ID: 15678 relates to Category No.: 10056, 677, 9305, 2942, 9242, 6717, 16156; Payload ID: 15679 relates to Category No.: 9305, 2890, 2942, 9247, 1748, 6368, 3036, 11650; Payload ID: 15680 relates to Category No.: 5762, 10056, 1748, 11653; Payload ID: 15681 relates to Category No.: 10056, 2942, 7060, 14539, 9305, 2890, 3696, 5762; Payload ID: 15682 relates to Category No.: 10056, 2942, 1842, 5762; Payload ID: 15683 relates to Category No.: 10056, 2942, 1842; Payload ID: 15686 relates to Category No.: 5561, 3673; Payload ID: 15687 relates to Category No.: 5561, 3673; Payload ID: 15688 relates to Category No.: 5561; Payload ID: 15689 relates to Category No.: 5561, 3673, 4010, 9184, 3666, 9162; Payload ID: 15690 relates to Category No.: 15139, 657, 5561; Payload ID: 15691 relates to Category No.: 15139, 657, 5561; Payload ID: 15692 relates to Category No.: 15139, 657, 5561; Payload ID: 15693 relates to Category No.: 15139, 1748, 657, 5851, 3059; Payload ID: 15694 relates to Category No.: 9305, 2890, 9247, 12085; Payload ID: 15695 relates to Category No.: 9734, 6968, 6964, 6017, 4199, 1017, 4860, 1750, 9730, 1036; Payload ID: 15696 relates to Category No.: 5561, 3673; Payload ID: 15697 relates to Category No.: 9305; Payload ID: 15698 relates to Category No.: 5561; Payload ID: 15700 relates to Category No.: 2890, 9242; Payload ID: 15701 relates to Category No.: 2942, 4765, 3693, 15573; Payload ID: 15702 relates to Category No.: 9305; Payload ID: 15703 relates to Category No.: 7118, 9247, 9184, 9305; Payload ID: 15704 relates to Category No.: 2890, 2942, 9247; Payload ID: 15705 relates to Category No.: 2890, 6960, 7402; Payload ID: 15706 relates to Category No.: 6960, 2938, 10056, 1182, 1803, 4010, 779, 2710, 2890, 1811, 8948, 1720, 777, 4197, 1700; Payload ID: 15707 relates to Category No.: 2890, 6960, 2938, 447, 777, 779, 778; Payload ID: 15708 relates to Category No.: 2890, 273, 4197, 779, 1085, 2918, 2710, 14999, 7402; Payload ID: 15709 relates to Category No.: 9305, 2890, 2194, 2942, 2420, 2192, 14906, 9247, 2630, 5964, 2628, 2192, 7140, 2632, 2192; Payload ID: 15710 relates to Category No.: 2942, 2420, 2192, 9247, 2630, 7140; Payload ID: 15711 relates to Category No.: 9305, 2890, 9242, 14906, 9247; Payload ID: 15712 relates to Category No.: 9305, 2890, 2942, 1154, 10056, 3521; Payload ID: 15713 relates to Category No.: 9305, 2890, 5776, 2942, 9247, 8935, 8948, 3521; Payload ID: 15714 relates to Category No.: 9305, 7118; Payload ID: 15715 relates to Category No.: 4030, 6443, 4010; Payload ID: 15716 relates to Category No.: 5561, 4029, 10056; Payload ID: 15717 relates to Category No.: 5561, 4029, 10056; Payload ID: 15718 relates to Category No.: 5561; Payload ID: 15719 relates to Category No.: 5561; Payload ID: 15720 relates to Category No.: 5561, 10056; Payload ID: 15721 relates to Category No.: 5561, 10056, 11883; Payload ID: 15722 relates to Category No.: 5561; Payload ID: 15723 relates to Category No.: 4029, 6717, 5570; Payload ID: 15724 relates to Category No.: 10056, 5570; Payload ID: 15725 relates to Category No.: 5561; Payload ID: 15726 relates to Category No.: 10056, 5570, 5561; Payload ID: 15727 relates to Category No.: 5561, 6443, 6717, 5776, 10056, 2899, 1748, 4010, 6440, 6437, 1792; Payload ID: 15728 relates to Category No.: 2890, 6717, 5776, 2942; Payload ID: 15729 relates to Category No.: 2890, 5776, 10056, 5570; Payload ID: 15730 relates to Category No.: 6443, 6437, 9416; Payload ID: 15731 relates to Category No.: 4030, 6717, 10056, 4010, 1792, 5561, 5570, 4008, 1090, 16026; Payload ID: 15732 relates to Category No.: 5561; Payload ID: 15733 relates to Category No.: 5561, 6440; Payload ID: 15734 relates to Category No.: 5561, 10056, 15139, 1748, 4010; Payload ID: 15735 relates to Category No.: 5561, 10056, 15139, 1748; Payload ID: 15736 relates to Category No.: 7118, 6717, 5561, 7048; Payload ID: 15737 relates to Category No.: 6717, 5561, 7048; Payload ID: 15738 relates to Category No.: 5561, 6717, 7061, 7118; Payload ID: 15739 relates to Category No.: 5561, 6717, 7048, 5776; Payload ID: 15740 relates to Category No.: 5561, 6717, 7048, 7118; Payload ID: 15741 relates to Category No.: 5561; Payload ID: 15742 relates to Category No.: 5561, 3673, 5570, 1748, 6222, 9176, 4860, 9162, 9192; Payload ID: 15743 relates to Category No.: 5561, 14557, 3673, 5557; Payload ID: 15744 relates to Category No.: 5561, 3673, 14557; Payload ID: 15745 relates to Category No.: 5561, 3673, 14557, 3666; Payload ID: 15746 relates to Category No.: 5561, 6717, 4010, 6060, 6059, 6440, 4788, 5560, 5556; Payload ID: 15747 relates to Category No.: 5561, 6717, 10056, 3696, 6440, 4788, 5560, 5556; Payload ID: 15748 relates to Category No.: 5561; Payload ID: 15749 relates to Category No.: 5561, 6717, 4788, 3686, 5560, 14293, 5556, 2942; Payload ID: 15750 relates to Category No.: 4030, 4008, 1792, 4053; Payload ID: 15751 relates to Category No.: 4029; Payload ID: 15752 relates to Category No.: 4029, 1792; Payload ID: 15753 relates to Category No.: 9305, 2890, 9242, 2942, 14559, 4010, 5597, 14559, 3681; Payload ID: 15754 relates to Category No.: 9305, 7118, 2890, 9242, 2942, 9247, 14559, 14559, 3681; Payload ID: 15755 relates to Category No.: 9305, 2890, 9242, 2942, 14559, 14559, 3681, 9215, 5762; Payload ID: 15756 relates to Category No.: 14174, 2890, 9242, 2942, 3666, 4228, 14559, 3681, 5762; Payload ID: 15757 relates to Category No.: 2890, 10056, 9242, 2942, 3666, 14559, 14559, 3681, 5762; Payload ID: 15758 relates to Category No.: 2942, 14559, 4010, 14559, 3681, 14561; Payload ID: 15759 relates to Category No.: 5561, 6717, 3673, 3666, 4010, 14561; Payload ID: 15760 relates to Category No.: 5561, 2890, 6717, 5762, 3673, 2901; Payload ID: 15761 relates to Category No.: 5561, 3673, 3666; Payload ID: 15762 relates to Category No.: 5561, 3673, 3666; Payload ID: 15763 relates to Category No.: 5561, 3666, 4010, 14394; Payload ID: 15764 relates to Category No.: 5557, 14394; Payload ID: 15765 relates to Category No.: 9305, 2890, 9242, 2942, 9247, 9734, 3036, 9157, 1017; Payload ID: 15766 relates to Category No.: 9305, 2890, 10056, 2942, 9247; Payload ID: 15767 relates to Category No.: 9305, 2890, 10056, 2942, 9247, 9157, 14253, 7118, 7048; Payload ID: 15768 relates to Category No.: 9305, 2890, 9247; Payload ID: 15769 relates to Category No.: 9305, 2942, 9247, 2890; Payload ID: 15770 relates to Category No.: 9305, 2890, 2942, 9247; Payload ID: 15771 relates to Category No.: 9305, 2890, 2942, 9247, 9157, 6743; Payload ID: 15772 relates to Category No.: 9305, 7118, 2890, 11883; Payload ID: 15773 relates to Category No.: 2890, 10056; Payload ID: 15774 relates to Category No.: 2942, 3523, 5762; Payload ID: 15775 relates to Category No.: 2890, 5776, 2942, 9247, 3523; Payload ID: 15776 relates to Category No.: 9305, 10056, 9242, 2942, 4755, 9734, 11883, 15627; Payload ID: 15777 relates to Category No.: 2890, 2938, 1748, 11650, 11653, 1842, 3055; Payload ID: 15779 relates to Category No.: 4030; Payload ID: 15780 relates to Category No.: 5561, 4010, 1792, 4008, 9774; Payload ID: 15781 relates to Category No.: 10056, 5570, 4010, 5561; Payload ID: 15782 relates to Category No.: 5561, 6717, 10056, 4010; Payload ID: 15783 relates to Category No.: 10056, 5570, 4010, 5561; Payload ID: 15784 relates to Category No.: 5561; Payload ID: 15785 relates to Category No.: 4029; Payload ID: 15786 relates to Category No.: 5561, 6717, 5762, 10056; Payload ID: 15787 relates to Category No.: 2890; Payload ID: 15788 relates to Category No.: 4030, 3666, 3671; Payload ID: 15789 relates to Category No.: 9305, 2890, 9242, 9247, 2402, 5597, 14583, 15505, 5964, 15531, 11883; Payload ID: 15790 relates to Category No.: 9305, 9247, 2402, 14583, 2890, 1004, 16317, 16298, 16324; Payload ID: 15791 relates to Category No.: 9247, 14937; Payload ID: 15792 relates to Category No.: 2890, 9247, 3991, 5110, 9215, 871; Payload ID: 15793 relates to Category No.: 9305, 2890; Payload ID: 15794 relates to Category No.: 9247, 5110, 9305; Payload ID: 15795 relates to Category No.: 9305; Payload ID: 15796 relates to Category No.: 5561, 6717; Payload ID: 15797 relates to Category No.: 9305, 11883; Payload ID: 15798 relates to Category No.: 5561, 9305; Payload ID: 15799 relates to Category No.: 9305; Payload ID: 15800 relates to Category No.: 9305, 9247; Payload ID: 15801 relates to Category No.: 5562, 15975; Payload ID: 15802 relates to Category No.: 5561; Payload ID: 15803 relates to Category No.: 5561; Payload ID: 15804 relates to Category No.: 5561; Payload ID: 15805 relates to Category No.: 5561, 1842; Payload ID: 15806 relates to Category No.: 9305, 7118, 7060, 4010, 7068; Payload ID: 15807 relates to Category No.: 9305, 2890; Payload ID: 15808 relates to Category No.: 5776, 9242, 9247; Payload ID: 15809 relates to Category No.: 9305, 7118, 2890, 9242, 9247, 9157, 9172, 9176, 2415, 10104, 9162, 12394, 3861, 9167, 2402; Payload ID: 15810 relates to Category No.: 9305, 2890, 6960, 2194, 10056, 2942, 6994, 9734, 2420, 2183, 9172, 14893, 4860, 9730, 2415, 7366, 7161, 5921, 14384, 9577, 9574, 6071, 6692, 4479, 7367, 15284; Payload ID: 15811 relates to Category No.: 7118, 7060, 2890, 6717, 7048; Payload ID: 15812 relates to Category No.: 7118, 7060, 7048; Payload ID: 15813 relates to Category No.: 9305, 7118, 2942, 7060, 7052, 7048; Payload ID: 15814 relates to Category No.: 9305, 5776, 9242, 9247, 9219, 2890; Payload ID: 15815 relates to Category No.: 9305, 2890, 9242, 9244; Payload ID: 15816 relates to Category No.: 9305, 7118, 2890, 9247; Payload ID: 15817 relates to Category No.: 9305, 2890, 15505, 9242, 9247; Payload ID: 15818 relates to Category No.: 9305, 2890, 10056, 9247, 9184; Payload ID: 15819 relates to Category No.: 9305; Payload ID: 15820 relates to Category No.: 9305, 2890; Payload ID: 15821 relates to Category No.: 2890, 5776, 9247, 4755, 9305; Payload ID: 15822 relates to Category No.: 9305; Payload ID: 15823 relates to Category No.: 6717, 10056, 5570, 1811, 3696, 5561; Payload ID: 15824 relates to Category No.: 9305, 14145, 9158, 15269; Payload ID: 15825 relates to Category No.: 9305, 2194, 2942, 2441; Payload ID: 15827 relates to Category No.: 9305, 2890, 8948, 3036, 15505; Payload ID: 15828 relates to Category No.: 9305, 2890; Payload ID: 15829 relates to Category No.: 9305, 2890, 15505, 2194, 9247, 11883, 15531, 9155, 10104; Payload ID: 15831 relates to Category No.: 9305, 9247, 14642; Payload ID: 15832 relates to Category No.: 9305, 2890, 9247, 11883, 10104, 262; Payload ID: 15834 relates to Category No.: 2890, 2194, 9242, 9247, 6968, 6978; Payload ID: 15835 relates to Category No.: 5561, 10056, 4010; Payload ID: 15836 relates to Category No.: 5561, 10056, 3666; Payload ID: 15837 relates to Category No.: 5561, 1700; Payload ID: 15838 relates to Category No.: 5561; Payload ID: 15839 relates to Category No.: 9305, 2890, 9247; Payload ID: 15840 relates to Category No.: 2890, 2938, 10056, 9247, 6994, 6017, 2514, 5561; Payload ID: 15841 relates to Category No.: 4030, 2890, 2938; Payload ID: 15842 relates to Category No.: 9305, 2890, 2938; Payload ID: 15843 relates to Category No.: 5561; Payload ID: 15844 relates to Category No.: 5561; Payload ID: 15845 relates to Category No.: 5561; Payload ID: 15846 relates to Category No.: 5561; Payload ID: 15847 relates to Category No.: 5561, 12406; Payload ID: 15848 relates to Category No.: 5570, 1792, 1772; Payload ID: 15849 relates to Category No.: 4030, 12159, 1700; Payload ID: 15850 relates to Category No.: 4030, 4029, 2890, 6717, 10056, 12159, 4010, 1792; Payload ID: 15851 relates to Category No.: 4030, 7118, 12159, 4029; Payload ID: 15852 relates to Category No.: 2890, 2942; Payload ID: 15853 relates to Category No.: 2890, 9247; Payload ID: 15856 relates to Category No.: 2890, 2942; Payload ID: 15857 relates to Category No.: 5561, 6717, 5392, 15318, 6099, 16027; Payload ID: 15858 relates to Category No.: 9305, 2890, 6717, 5776, 9247, 14912, 1635, 14664, 9215; Payload ID: 15859 relates to Category No.: 9247, 14651; Payload ID: 15860 relates to Category No.: 9247, 14651; Payload ID: 15862 relates to Category No.: 9305, 2890, 9247, 1748, 9157, 9158, 15269, 5237, 3844, 14651; Payload ID: 15863 relates to Category No.: 9305, 5762, 15505, 5561, 2890, 2942, 9247, 9176, 11883, 14653; Payload ID: 15864 relates to Category No.: 9305, 2890, 5762, 15505, 2942, 9247, 9157, 14653, 373, 14657, 11883, 5561; Payload ID: 15865 relates to Category No.: 5762, 15505, 9305, 2890, 2942, 9247, 9157, 9176, 12406, 14653, 14657, 10056, 11883; Payload ID: 15866 relates to Category No.: 9305, 5762, 15505, 2890, 2194, 2942, 9247, 9157, 14653, 373, 14253; Payload ID: 15867 relates to Category No.: 5561, 9305, 2890, 5762, 15505, 2942, 9247, 11883, 14653; Payload ID: 15868 relates to Category No.: 9305, 2890, 5762, 15505, 2942, 11883; Payload ID: 15869 relates to Category No.: 9305, 2890, 5762, 15505, 10056, 2942, 9247, 1803, 11883, 1643; Payload ID: 15870 relates to Category No.: 9305, 2890, 5762, 15505, 2942, 9247, 14653; Payload ID: 15871 relates to Category No.: 2890, 9247, 9305; Payload ID: 15872 relates to Category No.: 7118, 2890, 10056, 2942, 9247, 4010, 1017, 8948; Payload ID: 15873 relates to Category No.: 9305, 10056, 2942, 15892, 9247, 6743; Payload ID: 15874 relates to Category No.: 10056, 2890; Payload ID: 15875 relates to Category No.: 2890, 9247; Payload ID: 15876 relates to Category No.: 10056, 5570, 9247, 1748, 2927, 1803, 5561; Payload ID: 15877 relates to Category No.: 1842, 5561; Payload ID: 15878 relates to Category No.: 1842, 5561; Payload ID: 15879 relates to Category No.: 9305, 2942; Payload ID: 15880 relates to Category No.: 4755; Payload ID: 15881 relates to Category No.: 2890; Payload ID: 15882 relates to Category No.: 2942; Payload ID: 15883 relates to Category No.: 2890, 6717, 2942; Payload ID: 15885 relates to Category No.: 5561, 4010; Payload ID: 15886 relates to Category No.: 5561; Payload ID: 15890 relates to Category No.: 5561, 1842; Payload ID: 15891 relates to Category No.: 5561, 1842; Payload ID: 15892 relates to Category No.: 5561; Payload ID: 15893 relates to Category No.: 5561; Payload ID: 15894 relates to Category No.: 5561, 3673, 3666; Payload ID: 15895 relates to Category No.: 5561; Payload ID: 15896 relates to Category No.: 5561; Payload ID: 15897 relates to Category No.: 5561; Payload ID: 15898 relates to Category No.: 5561; Payload ID: 15899 relates to Category No.: 5561; Payload ID: 15900 relates to Category No.: 5561; Payload ID: 15901 relates to Category No.: 5561; Payload ID: 15902 relates to Category No.: 5561; Payload ID: 15903 relates to Category No.: 5561, 10056; Payload ID: 15904 relates to Category No.: 5561, 4010; Payload ID: 15905 relates to Category No.: 5561; Payload ID: 15906 relates to Category No.: 5561; Payload ID: 15907 relates to Category No.: 5561; Payload ID: 15908 relates to Category No.: 5561; Payload ID: 15909 relates to Category No.: 5561;

Payload ID: 15910 relates to Category No.: 5561; Payload ID: 15911 relates to Category No.: 5561, 10056; Payload ID: 15912 relates to Category No.: 5561; Payload ID: 15914 relates to Category No.: 2890, 9305, 2738, 6449, 2649, 7349; Payload ID: 15915 relates to Category No.: 9305, 6717, 9247, 14912, 1635, 15870, 16195, 14145; Payload ID: 15916 relates to Category No.: 2890, 9247, 5597, 9305, 15848; Payload ID: 15917 relates to Category No.: 11691, 1842; Payload ID: 15918 relates to Category No.: 9305, 9247, 11691, 2601, 15848; Payload ID: 15919 relates to Category No.: 2890, 9247, 14665, 11691, 1635, 15870, 5561; Payload ID: 15920 relates to Category No.: 2890, 9247, 15848; Payload ID: 15921 relates to Category No.: 9305, 9247, 11691, 2601, 15845, 15857, 14912, 9215; Payload ID: 15922 relates to Category No.: 9305, 2942, 9247, 11691, 2601, 15845, 1635, 15870, 15851, 6921, 10016, 15862, 14664, 14682, 15848, 11719, 14917, 2890; Payload ID: 15923 relates to Category No.: 2942, 9247, 11691, 15845, 14912, 4010, 1635, 15870, 15851, 15864, 6921, 10016, 15862, 14664, 14682, 15848; Payload ID: 15924 relates to Category No.: 2890, 2942, 9247, 11691, 2601, 15845, 14912, 4010, 1635, 15870, 15851, 6921, 10016, 15862, 14664, 14682, 15848, 11719, 15877, 14917, 9305; Payload ID: 15925 relates to Category No.: 2890, 9242, 9247, 15845, 14912; Payload ID: 15926 relates to Category No.: 9247, 14912, 1635, 15851, 14664, 16195, 14145; Payload ID: 15927 relates to Category No.: 9242, 9247, 14912, 1635, 15851; Payload ID: 15928 relates to Category No.: 9305, 9247, 2601, 15845, 15857, 1377, 11719; Payload ID: 15929 relates to Category No.: 9305, 2942, 9247, 11691, 15845, 14912, 4010, 1635, 15870, 15851, 15864, 6921, 10016, 15862, 14664, 14682, 15848, 15877; Payload ID: 15930 relates to Category No.: 2942, 9247, 14665, 15845, 14912, 1635, 6921, 10016, 15862, 14664, 14682, 15848, 15877; Payload ID: 15931 relates to Category No.: 2942, 9247, 14665, 11691, 15845, 15857, 9535, 14912, 1635, 15870, 15851, 6921, 15862, 14664, 14682, 15848, 15877, 14917; Payload ID: 15932 relates to Category No.: 2890, 15845, 15857, 14912, 1635, 15870, 15851, 15864, 15862, 14664; Payload ID: 15933 relates to Category No.: 2890, 2942, 9247, 15845, 15857, 14912, 4010, 1635, 15870, 15851, 15864, 6921, 15862, 14664, 14682, 15848, 15877, 9305, 5222; Payload ID: 15934 relates to Category No.: 9247; Payload ID: 15935 relates to Category No.: 9305, 2890, 9247; Payload ID: 15936 relates to Category No.: 9305, 9242, 9247; Payload ID: 15937 relates to Category No.: 9305, 9247, 14726; Payload ID: 15938 relates to Category No.: 9305, 9242, 9247; Payload ID: 15939 relates to Category No.: 2890, 2701; Payload ID: 15940 relates to Category No.: 2890, 4010, 2701; Payload ID: 15941 relates to Category No.: 2890, 2701; Payload ID: 15942 relates to Category No.: 2890, 2701; Payload ID: 15943 relates to Category No.: 2890, 2701; Payload ID: 15944 relates to Category No.: 2890, 2701; Payload ID: 15945 relates to Category No.: 2890, 2701; Payload ID: 15946 relates to Category No.: 2890, 2701; Payload ID: 15947 relates to Category No.: 2890, 4010, 2701; Payload ID: 15948 relates to Category No.: 2890, 1720, 2701; Payload ID: 15949 relates to Category No.: 9305, 2890, 16257, 10056, 9242, 9247, 9199, 9184, 9155, 10104, 9215, 15139, 3036, 5029, 4175, 16317; Payload ID: 15950 relates to Category No.: 9305, 9247, 10104; Payload ID: 15951 relates to Category No.: 9305, 2890, 9247, 4010, 5964, 10104, 9155; Payload ID: 15952 relates to Category No.: 9305; Payload ID: 15953 relates to Category No.: 4029, 778; Payload ID: 15954 relates to Category No.: 10056, 677, 4765, 3673, 4010, 14685, 3104; Payload ID: 15955 relates to Category No.: 9305, 2890, 2194, 9273, 14614, 9175; Payload ID: 15956 relates to Category No.: 4030, 9305, 5776, 2402, 14614; Payload ID: 15957 relates to Category No.: 9305, 2890, 2942; Payload ID: 15958 relates to Category No.: 9305, 2890, 2942; Payload ID: 15959 relates to Category No.: 9305, 2890, 9242, 2942, 2420, 15269, 3991, 15252; Payload ID: 15960 relates to Category No.: 2890, 5730, 9305, 2942; Payload ID: 15961 relates to Category No.: 2942, 1842; Payload ID: 15962 relates to Category No.: 5762, 2942; Payload ID: 15963 relates to Category No.: 9247; Payload ID: 15964 relates to Category No.: 9247, 273, 2890, 2938; Payload ID: 15965 relates to Category No.: 2890, 9305, 6449, 5342, 2649; Payload ID: 15967 relates to Category No.: 5561, 6717, 5776, 10056, 4755, 11728, 2455, 4010, 1659, 3638, 2446, 2890, 2458; Payload ID: 15968 relates to Category No.: 9305, 2890; Payload ID: 15969 relates to Category No.: 1842; Payload ID: 15970 relates to Category No.: 9305, 2890; Payload ID: 15971 relates to Category No.: 9305, 2890, 9157; Payload ID: 15972 relates to Category No.: 9305, 15505; Payload ID: 15973 relates to Category No.: 1233, 9242, 15151, 4765, 15627, 15139, 4755, 9734, 1748, 2927, 14409, 15161, 2942; Payload ID: 15974 relates to Category No.: 9305, 2890; Payload ID: 15975 relates to Category No.: 9305, 9273; Payload ID: 15976 relates to Category No.: 9305, 9247, 4755, 9734, 11883; Payload ID: 15977 relates to Category No.: 9305, 12439, 2890, 6717, 15505, 10056, 2942, 9247, 9734, 4010, 3696, 6060, 3863; Payload ID: 15978 relates to Category No.: 9305; Payload ID: 15979 relates to Category No.: 9305; Payload ID: 15980 relates to Category No.: 9305, 9242, 14145, 9247, 14912, 1286, 11883; Payload ID: 15981 relates to Category No.: 9305, 2890, 2942, 9199, 4010; Payload ID: 15982 relates to Category No.: 9305, 9247, 14912, 1635, 9181, 11627, 14658, 2402, 14653; Payload ID: 15983 relates to Category No.: 2194, 2942, 2183, 4010, 2456, 2498; Payload ID: 15984 relates to Category No.: 9305, 9242, 9215; Payload ID: 15985 relates to Category No.: 5561, 6717, 10056, 5570, 7244, 4010, 779, 2446, 14731, 4008, 2942, 2710; Payload ID: 15986 relates to Category No.: 5561, 6717, 10056, 5570, 2927, 4010, 779, 14731, 4008, 1792; Payload ID: 15987 relates to Category No.: 5561, 6717, 10056, 273; Payload ID: 15988 relates to Category No.: 5561, 6717, 10056, 5570, 4010, 779, 14731, 4008; Payload ID: 15989 relates to Category No.: 6717, 10056, 16265, 16326, 8948, 1017, 5596, 1029, 15758, 9087, 14731; Payload ID: 15990 relates to Category No.: 4029, 16265, 15758, 9087, 5596, 14731; Payload ID: 15991 relates to Category No.: 5561, 6717, 10056, 5570, 16265, 1017, 5823, 9087, 14731, 5762, 5596, 9577, 15758; Payload ID: 15992 relates to Category No.: 16265; Payload ID: 15993 relates to Category No.: 6717, 10056, 16265, 2890, 1017, 8948, 5561; Payload ID: 15994 relates to Category No.: 5561, 10056, 16265, 16326; Payload ID: 15995 relates to Category No.: 6717, 10056, 16265, 5570; Payload ID: 15996 relates to Category No.: 16265, 5823, 5596, 10056; Payload ID: 15997 relates to Category No.: 6717, 10056, 16265, 5561; Payload ID: 15998 relates to Category No.: 6717, 16265, 5561, 5762, 10056, 3666, 14363, 1792, 16326, 1659, 6075, 15758, 5596; Payload ID: 15999 relates to Category No.: 6717, 10056, 16265, 4479; Payload ID: 16000 relates to Category No.: 5561, 6717, 10056, 2899, 16265, 16326, 9087, 1029, 8948, 3036, 14731; Payload ID: 16001 relates to Category No.: 6717, 10056, 16265, 4010, 5561, 2498; Payload ID: 16002 relates to Category No.: 6717, 10056, 16265, 4010, 1017, 2257; Payload ID: 16003 relates to Category No.: 5561, 6717, 10056; Payload ID: 16004 relates to Category No.: 4030, 5561; Payload ID: 16005 relates to Category No.: 5561, 6717, 10056, 1792, 1017, 1016; Payload ID: 16006 relates to Category No.: 5561, 6717, 10056, 1792, 1772, 8948, 8935, 1774, 4173, 1099, 15139, 7048, 3055; Payload ID: 16007 relates to Category No.: 5561, 6717, 10056; Payload ID: 16008 relates to Category No.: 5561, 6717, 6976, 2194, 5727, 10056, 5570, 4010, 1792, 6709, 3036, 8948; Payload ID: 16009 relates to Category No.: 5561, 6717, 10056, 5570, 4755; Payload ID: 16010 relates to Category No.: 6717, 10056, 5570, 4010, 779, 5561; Payload ID: 16011 relates to Category No.: 6717, 10056, 5570, 4755, 4010, 6709, 5561; Payload ID: 16012 relates to Category No.: 6717, 10056, 5570, 1099; Payload ID: 16013 relates to Category No.: 6717, 10056, 5570, 6989; Payload ID: 16014 relates to Category No.: 6717, 10056, 5570; Payload ID: 16015 relates to Category No.: 6717, 5570; Payload ID: 16016 relates to Category No.: 6717, 5570; Payload ID: 16017 relates to Category No.: 6717, 5570; Payload ID: 16018 relates to Category No.: 5561; Payload ID: 16019 relates to Category No.: 6443, 6717, 10056, 5570, 9776, 6060, 6059, 15297, 1770, 3696, 1842; Payload ID: 16020 relates to Category No.: 5561, 6443, 9305, 12439, 2890, 6717, 10056, 5570, 9734, 15573, 3521, 7070, 14100, 6060, 2926, 1792, 6059, 6440, 779, 16065, 778, 1084, 9570, 3693, 1336, 1335, 3652; Payload ID: 16021 relates to Category No.: 5561, 6717, 10056, 5570, 6440; Payload ID: 16022 relates to Category No.: 5561, 6717, 10056, 5570, 3054, 8948; Payload ID: 16023 relates to Category No.: 5561, 6717, 10056, 5570, 1099; Payload ID: 16024 relates to Category No.: 5561, 6717, 10056, 5570; Payload ID: 16025 relates to Category No.: 5561, 6717, 10056, 5570, 4010, 779, 2942, 16156; Payload ID: 16026 relates to Category No.: 5561, 6717, 10056, 5570, 4010, 779, 1792; Payload ID: 16027 relates to Category No.: 5561, 6717, 10056, 5570, 4010, 779, 4032, 1099; Payload ID: 16028 relates to Category No.: 6717, 5570, 5561; Payload ID: 16029 relates to Category No.: 5561, 6717, 5570, 4010; Payload ID: 16030 relates to Category No.: 6717, 10056, 5570, 5561; Payload ID: 16031 relates to Category No.: 6717, 10056, 5570, 5561; Payload ID: 16032 relates to Category No.: 6717, 10056, 5570, 5561; Payload ID: 16033 relates to Category No.: 6717, 10056, 5570, 4010, 5561; Payload ID: 16034 relates to Category No.: 6717, 10056, 5570, 4010, 5561; Payload ID: 16035 relates to Category No.: 5561, 10056, 5570, 1099; Payload ID: 16036 relates to Category No.: 5561, 6717, 10056, 5570, 779; Payload ID: 16037 relates to Category No.: 5561, 6717, 10056, 5570, 1335, 1842; Payload ID: 16038 relates to Category No.: 5561, 6717, 10056, 4010, 5570; Payload ID: 16039 relates to Category No.: 6717, 5561, 5776, 6440; Payload ID: 16040 relates to Category No.: 5561, 6717, 6440; Payload ID: 16041 relates to Category No.: 5561, 6717; Payload ID: 16042 relates to Category No.: 5561, 10056, 5570, 1099; Payload ID: 16043 relates to Category No.: 5561, 6717, 2194, 10056, 5570, 4010, 7118; Payload ID: 16044 relates to Category No.: 5561, 5570, 6717, 10056, 273, 9184; Payload ID: 16045 relates to Category No.: 5561, 6717, 5570; Payload ID: 16046 relates to Category No.: 5561, 10056, 5570, 2890; Payload ID: 16047 relates to Category No.: 5561, 6717, 10056, 5570, 1085; Payload ID: 16048 relates to Category No.: 5561, 3673; Payload ID: 16049 relates to Category No.: 5561; Payload ID: 16050 relates to Category No.: 5561, 4765, 4755; Payload ID: 16051 relates to Category No.: 5561, 10056; Payload ID: 16052 relates to Category No.: 5561, 6717, 5570; Payload ID: 16053 relates to Category No.: 5561, 6717, 5570; Payload ID: 16054 relates to Category No.: 5561, 6717, 5570; Payload ID: 16055 relates to Category No.: 5561, 10056; Payload ID: 16056 relates to Category No.: 5561, 6443, 2890, 6717, 10056, 5570, 1748, 15161, 6440, 2899; Payload ID: 16057 relates to Category No.: 5561, 6717, 10056, 5570; Payload ID: 16058 relates to Category No.: 5561, 2890, 10056, 3673, 5570, 9734, 779, 1336; Payload ID: 16059 relates to Category No.: 5561, 8935, 1748, 15161; Payload ID: 16060 relates to Category No.: 5561, 10056, 1748, 15161, 2510, 15151, 3972, 2227, 15139, 11721, 5778; Payload ID: 16061 relates to Category No.: 5561, 8935, 1748, 15161, 2890, 15139, 3036, 8948, 1033, 2899, 7321, 9730, 3972, 775, 4483, 1097, 9724; Payload ID: 16062 relates to Category No.: 5561, 1700; Payload ID: 16063 relates to Category No.: 5561, 6717, 5570; Payload ID: 16064 relates to Category No.: 5561, 6717, 5570, 779; Payload ID: 16065 relates to Category No.: 5561, 6717, 10056, 5570, 2508, 2890, 8935, 15280; Payload ID: 16066 relates to Category No.: 5561, 3673, 2511, 2890; Payload ID: 16067 relates to Category No.: 5561, 6717, 10056, 15151, 5570, 2511, 2890, 8935, 15161, 3065, 1774, 8948, 15280, 1033, 1711; Payload ID: 16068 relates to Category No.: 5561; Payload ID: 16069 relates to Category No.: 6717, 5570, 10056, 1099, 779, 1336; Payload ID: 16070 relates to Category No.: 5561, 6717, 10056, 5570; Payload ID: 16071 relates to Category No.: 5561, 6717, 10056, 5570; Payload ID: 16072 relates to Category No.: 5561, 6717, 10056, 4765, 5570, 6994, 1239, 4010, 6709, 2710, 2890, 2942, 1099, 5762, 6743, 4146, 16156, 1659, 1811; Payload ID: 16073 relates to Category No.: 5561, 2890, 10056, 5570, 9734, 3652; Payload ID: 16074 relates to Category No.: 5561, 6717, 10056, 5570; Payload ID: 16075 relates to Category No.: 5561, 10056, 5570, 9734, 3652; Payload ID: 16076 relates to Category No.: 5561, 6717, 10056, 5570; Payload ID: 16077 relates to Category No.: 5561, 9305, 6717, 5570; Payload ID: 16078 relates to Category No.: 5561, 6717, 10056, 5570, 2890, 1811, 1335, 2942, 1099, 3693, 1336; Payload ID: 16079 relates to Category No.: 5561, 6717, 10056, 5570, 4010; Payload ID: 16080 relates to Category No.: 5561, 6717, 10056, 9734, 3652, 5555, 4008, 2504, 16164, 5570, 2942, 4010, 14363, 6743, 3693, 15577, 5776, 1792, 15758, 2534, 7321, 16156; Payload ID: 16081 relates to Category No.: 5561, 6717, 10056, 5570; Payload ID: 16082 relates to Category No.: 5561, 6717, 10056, 5570; Payload ID: 16083 relates to Category No.: 5561, 6717, 10056, 2927, 6440, 5570, 15151; Payload ID: 16084 relates to Category No.: 5561, 6717, 10056, 5570, 1099, 779; Payload ID: 16085 relates to Category No.: 5561, 6717, 10056, 5570, 4010, 779; Payload ID: 16086 relates to Category No.: 6717, 10056, 5570, 5561; Payload ID: 16087 relates to Category No.: 6717, 10056, 5570, 4010, 5561; Payload ID: 16088 relates to Category No.: 5561, 10056, 5570, 1099, 4010, 11883, 1659; Payload ID: 16089 relates to Category No.: 5561, 6717, 10056, 5570, 1099; Payload ID: 16090 relates to Category No.: 5561, 10056, 5570, 1099, 4010; Payload ID: 16091 relates to Category No.: 5570, 1099, 5561; Payload ID: 16092 relates to Category No.: 5561, 10056, 5570, 4008, 4010, 779; Payload ID: 16093 relates to Category No.: 5561, 10056, 5570, 4010, 779, 1336; Payload ID: 16094 relates to Category No.: 5561, 5570, 4010, 779; Payload ID: 16095 relates to Category No.: 5561, 6717, 10056, 5570, 1099; Payload ID: 16096 relates to Category No.: 1842; Payload ID: 16097 relates to Category No.: 5561, 6717, 10056, 5570, 4010, 1099; Payload ID: 16098 relates to Category No.: 5561, 6717, 10056, 5570; Payload ID: 16099 relates to Category No.: 5561, 10056, 5570; Payload ID: 16100 relates to Category No.: 5561, 10056, 5570, 4010, 779, 1336; Payload ID: 16101 relates to Category No.: 5561, 7118, 10056, 5570, 779; Payload ID: 16102 relates to Category No.: 5561, 5570; Payload ID: 16103 relates to Category No.: 5561, 5570; Payload ID: 16104 relates to Category No.: 5561; Payload ID: 16105 relates to Category No.: 5561, 10056, 5570, 16057, 5568; Payload ID: 16106 relates to Category No.: 5561; Payload ID: 16107 relates to Category No.: 5561, 5570; Payload ID: 16108 relates to Category No.: 5561, 5570; Payload ID: 16109 relates to Category No.: 5561, 5570; Payload ID: 16110 relates to Category No.: 5561; Payload ID: 16111 relates to Category No.: 2890, 6717, 10056, 5570, 5778, 4010, 779, 1085; Payload ID: 16112 relates to Category No.: 5561, 6717, 10056, 1099, 779, 2890, 1085, 5570; Payload ID: 16113 relates to Category No.: 5561, 6717; Payload ID: 16114 relates to Category No.: 5561, 6717, 10056, 5570, 9478; Payload ID: 16115 relates to Category No.: 5561, 10056, 5570, 6717, 5823; Payload ID: 16116 relates to Category No.: 5561, 10056, 5570; Payload ID: 16117 relates to Category No.: 5561, 2890, 6717, 10056, 5570; Payload ID: 16118 relates to Category No.: 5561, 15573, 6709, 15574; Payload ID: 16119 relates to Category No.: 5561, 7118, 7048, 7366; Payload ID: 16120 relates to Category No.: 7118, 7048, 5570; Payload ID: 16121 relates to Category No.: 5561, 7118, 2890, 7048; Payload ID: 16122 relates to Category No.: 5561, 7048; Payload ID: 16123 relates to Category No.: 5561, 7048, 7118; Payload ID: 16124 relates to Category No.: 5561, 7048, 7118; Payload ID: 16125 relates to Category No.: 5561, 7118, 7048, 5570, 7041, 7061; Payload ID: 16126 relates to Category No.: 5561, 7118, 7048, 9247; Payload ID: 16127 relates to Category No.: 5561, 9305, 7118, 7048, 7244; Payload ID: 16128 relates to Category No.: 9305, 7118, 7048, 5570, 7366, 5561; Payload ID: 16129 relates to Category No.: 9305, 7118, 6717, 7048, 5570, 4010, 7068, 7181, 7366; Payload ID: 16130 relates to Category No.: 5561, 9305, 7118, 7048, 7050; Payload ID: 16131 relates to Category No.: 5561, 9305, 7048, 4010, 7118; Payload ID: 16132 relates to Category No.: 5561, 9305, 7048; Payload ID: 16133 relates to Category No.: 5561, 7048, 7118; Payload ID: 16134 relates to Category No.: 5561, 7048, 7118; Payload ID: 16135 relates to Category No.: 9305, 7118, 7048, 5570, 5561; Payload ID: 16136 relates to Category No.: 5561, 5776, 6717, 5569, 9756, 9754, 7118, 7048; Payload ID: 16137 relates to Category No.: 5561, 7048, 7118; Payload ID: 16138 relates to Category No.: 5561, 7118, 2890, 7048; Payload ID: 16139 relates to Category No.: 5561, 7118, 7048, 5776, 4010; Payload ID: 16140 relates to Category No.: 7118, 6717, 7048, 5570, 4010, 5561, 7366; Payload ID: 16141 relates to Category No.: 5561, 7048, 7118; Payload ID: 16142 relates to Category No.: 5561, 7048, 7118; Payload ID: 16143 relates to Category No.: 5561, 7048; Payload ID: 16144 relates to Category No.: 5561, 7048, 7118; Payload ID: 16145 relates to Category No.: 5561, 9305, 7048, 7118; Payload ID: 16146 relates to Category No.: 5561, 7048, 7061, 7118; Payload ID: 16147 relates to Category No.: 5561, 7118, 7048; Payload ID: 16148 relates to Category No.: 5561, 7118, 7048; Payload ID: 16149 relates to Category No.: 5561, 7118, 7048; Payload ID: 16150 relates to Category No.: 5561, 7118, 7048; Payload ID: 16151 relates to Category No.: 5561, 7118, 7048; Payload ID: 16152 relates to Category No.: 5561, 7048, 7118; Payload ID: 16153 relates to Category No.: 5561, 7048; Payload ID: 16154 relates to Category No.: 5561, 7048, 7118; Payload ID: 16155 relates to Category No.: 5561, 7048, 7118; Payload ID: 16156 relates to Category No.: 5561, 7048, 7118; Payload ID: 16157 relates to Category No.: 5561, 9305, 7118, 7048; Payload ID: 16158 relates to Category No.: 5561, 7048, 7118; Payload ID: 16159 relates to Category No.: 5561, 7048, 7118; Payload ID: 16160 relates to Category No.: 5561, 7048, 7118; Payload ID: 16161 relates to Category No.: 5561, 7048, 1842, 7118; Payload ID: 16162 relates to Category No.: 5561, 7048, 7118; Payload ID: 16163 relates to Category No.: 5561, 7048, 7118; Payload ID: 16164 relates to Category No.: 5561, 7048; Payload ID: 16165 relates to Category No.: 5561; Payload ID: 16166 relates to Category No.: 5561, 7048; Payload ID: 16167 relates to Category No.: 5561, 10056, 5570, 6717; Payload ID: 16168 relates to Category No.: 5561, 10056, 5570, 3666, 4755, 4010, 6440; Payload ID: 16169 relates to Category No.: 5561, 6717, 10056, 5570, 4010; Payload ID: 16170 relates to Category No.: 5570, 5561, 6717, 10056, 779, 14828, 1336; Payload ID: 16171 relates to Category No.: 5561, 6717, 10056, 5570, 4010, 779, 1336; Payload ID: 16172 relates to Category No.: 5561, 6717, 5570, 1099, 10056, 6075, 2890; Payload ID: 16173 relates to Category No.: 5561, 6717, 5762, 10056, 5570, 3666, 2927, 1099, 6756, 2324, 779, 1336, 14828, 16164; Payload ID: 16174 relates to Category No.: 5561, 1099, 2890, 10056, 5570, 3693, 12440; Payload ID: 16175 relates to Category No.: 5561, 10056, 5570, 6717; Payload ID: 16176 relates to Category No.: 5561, 6717, 10056, 5570, 4010, 1792, 779; Payload ID: 16177 relates to Category No.: 5561, 5570; Payload ID: 16178 relates to Category No.: 5561, 6717, 10056, 3666, 7118, 1659, 5776, 7048; Payload ID: 16179 relates to Category No.: 5569, 3673, 5557, 9754, 4010, 3671, 7118, 5561; Payload ID: 16180 relates to Category No.: 5561, 6717, 7061; Payload ID: 16181 relates to Category No.: 5561, 6717, 10056, 3673, 3666, 1336, 6989; Payload ID: 16182 relates to Category No.: 5561, 3673, 3666, 5557, 1085, 11883, 5776; Payload ID: 16183 relates to Category No.: 5561, 10056, 14363; Payload ID: 16184 relates to Category No.: 6717, 10056, 5570, 5561, 779; Payload ID: 16185 relates to Category No.: 6717, 10056, 5570; Payload ID: 16186 relates to Category No.: 6717, 10056, 3673, 5570; Payload ID: 16187 relates to Category No.: 5561, 6717, 10056, 5570, 1099, 779; Payload ID: 16188 relates to Category No.: 5561, 5570, 10056, 9242, 1099, 9184; Payload ID: 16189 relates to Category No.: 5561, 6060, 6440; Payload ID: 16190 relates to Category No.: 5561, 10056, 779; Payload ID: 16191 relates to Category No.: 6717, 10056, 4010, 1336, 7048, 5570, 16057, 5561; Payload ID: 16192 relates to Category No.: 5561, 9305, 2890, 6717, 10056, 9247, 4010, 1792, 6709, 779; Payload ID: 16193 relates to Category No.: 5561, 2890, 10056, 3666, 4755, 9184, 15758; Payload ID: 16194 relates to Category No.: 5561, 2890, 10056, 2899, 6059, 6440; Payload ID: 16195 relates to Category No.: 5561, 2890, 6717, 15151, 8935, 5570, 3693, 1748, 15161, 6060, 6059, 6440; Payload ID: 16196 relates to Category No.: 5561, 2890, 6717, 2899, 6060, 6059, 6440; Payload ID: 16197 relates to Category No.: 5561, 9305, 6717, 9242, 5570, 4755, 14409, 14412, 779; Payload ID: 16198 relates to Category No.: 5561, 4765, 4755, 7118; Payload ID: 16199 relates to Category No.: 5561, 2890, 6717, 4755, 4010, 16156, 9734, 2899; Payload ID: 16200 relates to Category No.: 5561, 10056, 2899, 14409, 14412, 15628, 2926; Payload ID: 16201 relates to Category No.: 5561, 9305, 2938; Payload ID: 16202 relates to Category No.: 5561, 10056; Payload ID: 16203 relates to Category No.: 5561, 10056, 5570, 6059, 12439, 2890, 8948; Payload ID: 16204 relates to Category No.: 5561, 5570, 6717, 6059, 12439; Payload ID: 16205 relates to Category No.: 5561, 10056, 8935, 3036, 15161, 8942, 2509, 11721, 3044, 2639, 1796, 15139, 15151, 5441, 5778; Payload ID: 16206 relates to Category No.: 5561, 6717, 4765, 3673, 5570; Payload ID: 16207 relates to Category No.: 10056, 6717, 5570, 1336, 1099, 6756, 3693, 5823, 6743, 1792, 9734, 779; Payload ID: 16208 relates to Category No.: 5561, 6717, 10056, 5570, 779, 1336, 16156, 1335; Payload ID: 16209 relates to Category No.: 5561, 6717, 10056, 779, 1335, 1336, 2926; Payload ID: 16210 relates to Category No.: 5561, 6717, 4765, 4755; Payload ID: 16211 relates to Category No.: 5561, 5776, 4765, 4755, 7118; Payload ID: 16212 relates to Category No.: 5561, 4765, 5570, 4755; Payload ID: 16213 relates to Category No.: 5561, 6717, 4765, 4755; Payload ID: 16214 relates to Category No.: 5561, 2477, 4755, 3686, 3685; Payload ID: 16215 relates to Category No.: 5561, 4765, 9305, 3666, 4755; Payload ID: 16216 relates to Category No.: 5561, 3673, 3666; Payload ID: 16217 relates to Category No.: 5561, 4765, 1842; Payload ID: 16218 relates to Category No.: 5561, 4765, 4755; Payload ID: 16219 relates to Category No.: 5561, 4765, 3666, 4755; Payload ID: 16220 relates to Category No.: 5561, 4765; Payload ID: 16221 relates to Category No.: 5561, 4765; Payload ID: 16222 relates to Category No.: 5561, 5776, 3673; Payload ID: 16223 relates to Category No.: 5561; Payload ID: 16224 relates to Category No.: 5561, 6717, 3666; Payload ID: 16225 relates to Category No.: 5561, 6717; Payload ID: 16226 relates to Category No.: 5561, 6717; Payload ID: 16227 relates to Category No.: 5561; Payload ID: 16228 relates to Category No.: 5561, 6717; Payload ID: 16229 relates to Category No.: 5561; Payload ID: 16230 relates to Category No.: 5561, 1842; Payload ID: 16231 relates to Category No.: 5561, 6717; Payload ID: 16232 relates to Category No.: 5561, 6717; Payload ID: 16233 relates to Category No.: 5561, 6717; Payload ID: 16234 relates to Category No.: 5561, 7118, 4010, 6440, 6443; Payload ID: 16235 relates to Category No.: 5561, 6717, 10056, 2942, 3673; Payload ID: 16236 relates to Category No.: 5561, 6717, 10056, 5570, 4755; Payload ID: 16237 relates to Category No.: 5561, 6717; Payload ID: 16238 relates to Category No.: 5561, 6717; Payload ID: 16239 relates to Category No.: 5561, 6717; Payload ID: 16240 relates to Category No.: 5561, 10056, 3666, 6440, 6443; Payload ID: 16241 relates to Category No.: 5561, 10056, 16057, 4010; Payload ID: 16242 relates to Category No.: 5561, 16057; Payload ID: 16243 relates to Category No.: 5561, 16057; Payload ID: 16244 relates to Category No.: 5561, 6717; Payload ID: 16245 relates to Category No.: 5561, 4010; Payload ID: 16246 relates to Category No.: 5561, 5776; Payload ID: 16247 relates to Category No.: 5561; Payload ID: 16248 relates to Category No.: 5561, 10056, 5570, 4010, 6717, 1017; Payload ID: 16249 relates to Category No.: 5561, 4755; Payload ID: 16250 relates to Category No.: 5561, 3666; Payload ID: 16251 relates to Category No.: 10056, 5570, 3036, 1017, 8948, 14363, 1335; Payload ID: 16252 relates to Category No.: 5561, 10056, 5570, 6717, 1099; Payload ID: 16253 relates to Category No.: 10056, 5570; Payload ID: 16254 relates to Category No.: 10056, 5570; Payload ID: 16255 relates to Category No.: 10056, 5570; Payload ID: 16256 relates to Category No.: 5561, 8948, 1017; Payload ID: 16257 relates to Category No.: 5561; Payload ID: 16258 relates to Category No.: 5561, 6443, 6059, 6440, 12378; Payload ID: 16259 relates to Category No.: 5561, 6717, 10056, 3673; Payload ID: 16260 relates to Category No.: 5561, 6717, 10056; Payload ID: 16261 relates to Category No.: 5561, 6717, 4032, 9734, 10056; Payload ID: 16262 relates to Category No.: 5561, 6717, 3673, 4755, 9734, 5559; Payload ID: 16263 relates to Category No.: 5561, 6717, 10056, 5570, 3666, 4755, 6017; Payload ID: 16264 relates to Category No.: 6717, 10056, 5570, 2899; Payload ID: 16265 relates to Category No.: 5561, 6717, 10056; Payload ID: 16266 relates to Category No.: 5561, 6717, 10056, 2899, 12440, 4010, 3693, 779; Payload ID: 16267 relates to Category No.: 5561, 6717, 1099, 4010; Payload ID: 16268 relates to Category No.: 6717, 10056, 5570, 1792, 6019, 3666, 5561; Payload ID: 16269 relates to Category No.: 5561, 6717, 3673, 3666, 9247, 4755; Payload ID: 16270 relates to Category No.: 5561, 6717, 10056, 9418; Payload ID: 16271 relates to Category No.: 5561, 9305, 2890, 6717, 10056, 4755; Payload ID: 16272 relates to Category No.: 5561, 6717; Payload ID: 16273 relates to Category No.: 5561, 6717, 10056, 5570, 1099, 1239, 4010, 16326, 2712, 1700; Payload ID: 16274 relates to Category No.: 9305, 2890, 5776, 10056, 9247; Payload ID: 16275 relates to Category No.: 5570, 5561, 6717, 10056, 4228, 1099, 779; Payload ID: 16276 relates to Category No.: 5561, 6717, 10056, 5570, 1700; Payload ID: 16277 relates to Category No.: 5561, 6717, 10056, 5570, 1099, 4010; Payload ID: 16278 relates to Category No.: 5561, 6717, 10056, 5570, 779; Payload ID: 16279 relates to Category No.: 5561, 6717, 5570, 10056, 14953, 1099, 779, 15139, 2926; Payload ID: 16280 relates to Category No.: 5561, 6717, 10056, 5570, 8935, 8949; Payload ID: 16281 relates to Category No.: 5561, 6717, 10056, 5570, 1099; Payload ID: 16282 relates to Category No.: 5561, 6717, 10056, 5570, 1099, 8948, 775, 1097, 1365; Payload ID: 16283 relates to Category No.: 5561, 5570, 1099; Payload ID: 16284 relates to Category No.: 5561, 2890, 5762, 10056, 5570, 1099, 15151, 7321; Payload ID: 16285 relates to Category No.: 5561, 10056; Payload ID: 16286 relates to Category No.: 5561, 10056; Payload ID: 16287 relates to Category No.: 5561, 10056; Payload ID: 16288 relates to Category No.: 5561, 10056, 5570; Payload ID: 16289 relates to Category No.: 5561, 10056, 5570; Payload ID: 16290 relates to Category No.: 5561, 1842; Payload ID: 16291 relates to Category No.: 5561, 6717, 10056, 7070, 4010; Payload ID: 16292 relates to Category No.: 5561, 10056, 4010, 6440; Payload ID: 16293 relates to Category No.: 5561, 10056; Payload ID: 16294 relates to Category No.: 5561, 10056, 4010; Payload ID: 16295 relates to Category No.: 5561, 10056; Payload ID: 16296 relates to Category No.: 5561; Payload ID: 16297 relates to Category No.: 5561, 6712; Payload ID: 16298 relates to Category No.: 5561; Payload ID: 16299 relates to Category No.: 5561; Payload ID: 16300 relates to Category No.: 5561, 2890, 10056, 1792, 779, 1336; Payload ID: 16301 relates to Category No.: 5561, 10056, 1792; Payload ID: 16302 relates to Category No.: 5561, 4010; Payload ID: 16303 relates to Category No.: 5561, 6717, 10056, 6756; Payload ID: 16304 relates to Category No.: 5561, 6717, 10056; Payload ID: 16305 relates to Category No.: 5561, 3696, 6440; Payload ID: 16306 relates to Category No.: 5561, 6717; Payload ID: 16307 relates to Category No.: 5561, 6717, 10056, 8948, 15139, 3036, 1017, 15151, 3521, 779, 9730, 2502, 10063; Payload ID: 16308 relates to Category No.: 6717, 10056, 5570, 4010, 779, 1335, 1336, 1811; Payload ID: 16309 relates to Category No.: 5561, 6717, 10056, 4010, 1336; Payload ID: 16310 relates to Category No.: 5561, 6717, 10056; Payload ID: 16311 relates to Category No.: 5561, 9305, 6717, 10056, 4010, 4032; Payload ID: 16312 relates to Category No.: 5561, 6717, 4010, 779; Payload ID: 16313 relates to Category No.: 5561, 6717, 10056, 4010, 779; Payload ID: 16314 relates to Category No.: 6717, 10056, 5570, 1336, 16164, 5561; Payload ID: 16315 relates to Category No.: 5561, 6717, 10056, 5570; Payload ID: 16316 relates to Category No.: 5561, 6717, 10056, 4010; Payload ID: 16317 relates to Category No.: 5561, 6717, 10056, 4010; Payload ID: 16318 relates to Category No.: 5561, 9305, 10056, 4765, 4755, 3652; Payload ID: 16319 relates to Category No.: 5561, 10056, 3673, 11883; Payload ID: 16320 relates to Category No.: 5561, 10056, 11883; Payload ID: 16321 relates to Category No.: 5570, 5561; Payload ID: 16322 relates to Category No.: 5561, 5570; Payload ID: 16323 relates to Category No.: 10056, 5570, 779; Payload ID: 16324 relates to Category No.: 5561, 10056, 5570, 4010, 16156, 1336; Payload ID: 16325 relates to Category No.: 5561, 6717, 10056, 8935, 5570, 1017, 1792; Payload ID: 16326 relates to Category No.: 5561, 10056, 8935, 5570, 2890, 6717, 1774; Payload ID: 16327 relates to Category No.: 5561, 10056, 8935, 5570; Payload ID: 16328 relates to Category No.: 5561, 10056, 8935, 5570, 4010; Payload ID: 16329 relates to Category No.: 5561, 6717, 10056, 8935, 5570; Payload ID: 16330 relates to Category No.: 5561, 2890, 10056, 5570, 8948, 1017, 1792, 4220, 8935; Payload ID: 16331 relates to Category No.: 5561, 10056, 2942, 8935, 5570, 3652, 3696, 6743; Payload ID: 16332 relates to Category No.: 5561, 10056, 5570; Payload ID: 16333 relates to Category No.: 5561, 5570, 10056; Payload ID: 16334 relates to Category No.: 5561, 6717, 10056, 5570; Payload ID: 16335 relates to Category No.: 5561, 10056, 5570, 1842; Payload ID: 16336 relates to Category No.: 5561, 5570, 6717, 10056; Payload ID: 16337 relates to Category No.: 5561, 10056, 5570; Payload ID: 16338 relates to Category No.: 5561, 15151, 5570, 1748, 15161; Payload ID: 16339 relates to Category No.: 5561, 10056, 5570, 1336; Payload ID: 16340 relates to Category No.: 5561, 10056, 5570, 4010, 1336; Payload ID: 16341 relates to Category No.: 5561, 10056, 5570, 779; Payload ID: 16342 relates to Category No.: 5561, 5762, 5570; Payload ID: 16343 relates to Category No.: 6717, 10056, 5570, 779, 1336; Payload ID: 16344 relates to Category No.: 6717, 5570, 5561, 9305, 2890, 5776, 10056, 9242, 2942, 4010, 779; Payload ID: 16345 relates to Category No.: 5561, 6717, 2890, 10056, 5570, 1099, 4010; Payload ID: 16346 relates to Category No.: 6717, 10056, 5570, 1099, 5561; Payload ID: 16347 relates to Category No.: 6717, 10056, 5570, 1099, 5561; Payload ID: 16348 relates to Category No.: 5561, 6717, 10056, 5570, 1792, 2938, 5776, 14293; Payload ID: 16349 relates to Category No.: 6717, 5570; Payload ID: 16350 relates to Category No.: 5561, 6717, 10056, 5570; Payload ID: 16351 relates to Category No.: 5561, 6717, 10056, 5570; Payload ID: 16352 relates to Category No.: 5561, 6717, 10056, 5570; Payload ID: 16353 relates to Category No.: 6717, 10056, 5570, 3036, 5561; Payload ID: 16354 relates to Category No.: 6717, 5570, 6440; Payload ID: 16355 relates to Category No.: 5561, 6717, 5570; Payload ID: 16356 relates to Category No.: 9305, 2890; Payload ID: 16357 relates to Category No.: 5561, 6717, 10056, 2942, 5570, 14363, 16326, 15758, 5596, 1099, 7118, 6960, 3055, 1774, 3054; Payload ID: 16358 relates to Category No.: 5561, 6717, 10056, 5570; Payload ID: 16359 relates to Category No.: 5561, 6717, 10056, 3673, 5570, 9734, 14363, 7070, 8917, 5823, 7118, 6960, 3055, 1774, 8948; Payload ID: 16360 relates to Category No.: 5561, 10056, 2942, 7032, 5563, 7118, 7048, 14363; Payload ID: 16361 relates to Category No.: 5561; Payload ID: 16362 relates to Category No.: 5561, 2890, 10056, 3673, 5570, 3666, 9247, 6017, 4010, 6743, 4228, 1656, 6717, 779, 1099, 7118, 1792, 15758, 9734, 14363, 5596; Payload ID: 16363 relates to Category No.: 5561, 10056; Payload ID: 16364 relates to Category No.: 5561, 10056, 4010, 1792, 1335, 779, 1336, 6756; Payload ID: 16365 relates to Category No.: 5776, 10056, 2890, 6717, 2194, 273, 9734, 3652, 4199, 4010, 1772, 14327, 6989, 779, 16156, 6991, 14828, 1336, 14953, 778, 14955, 6743; Payload ID: 16366 relates to Category No.: 10056, 9305, 3652, 4010, 4228, 779, 2890, 11883; Payload ID: 16367 relates to Category No.: 5561, 10056, 1099, 779; Payload ID: 16368 relates to Category No.: 5561, 10056; Payload ID: 16369 relates to Category No.: 5561, 5776, 10056, 3673, 12440, 3523, 2926, 15139, 7118, 6059, 3036, 3521, 3693, 12439, 1033, 1037; Payload ID: 16370 relates to Category No.: 5561, 4765, 15573, 12440; Payload ID: 16371 relates to Category No.: 5561, 4765, 4755; Payload ID: 16372 relates to Category No.: 5561, 12439, 6060; Payload ID: 16373 relates to Category No.: 5561, 10056; Payload ID: 16374 relates to Category No.: 5561, 7048, 7061; Payload ID: 16375 relates to Category No.: 5561, 10056, 7244; Payload ID: 16376 relates to Category No.: 6717, 10056, 5570, 5561; Payload ID: 16377 relates to Category No.: 6717, 10056, 5570, 1099; Payload ID: 16378 relates to Category No.: 5561, 6717, 10056, 5570, 1099; Payload ID: 16379 relates to Category No.: 5561, 6717, 10056; Payload ID: 16380 relates to Category No.: 6717, 10056, 5570; Payload ID: 16381 relates to Category No.: 6717, 10056, 5570, 5561; Payload ID: 16382 relates to Category No.: 6717, 5561, 779, 10056, 5570; Payload ID: 16383 relates to Category No.: 6717, 10056, 5570, 5561; Payload ID: 16384 relates to Category No.: 5561, 6717, 10056, 5570; Payload ID: 16385 relates to Category No.: 6717, 10056, 5570, 1099, 4010; Payload ID: 16386 relates to Category No.: 6717, 5570, 5561; Payload ID: 16387 relates to Category No.: 6717, 5570, 5561; Payload ID: 16388 relates to Category No.: 12159, 4014; Payload ID: 16389 relates to Category No.: 4030, 4029, 8948; Payload ID: 16390 relates to Category No.: 5561, 10056, 8935, 5570, 6717, 2890; Payload ID: 16391 relates to Category No.: 5561, 2890, 10056, 8935, 5570, 6717; Payload ID: 16392 relates to Category No.: 5561, 10056, 5570, 9098, 2446, 2458, 2890; Payload ID: 16393 relates to Category No.: 5561, 10056, 8935, 5570, 2890; Payload ID: 16394 relates to Category No.: 5561, 10056, 8935, 5570, 2890; Payload ID: 16395 relates to Category No.: 9247, 9215; Payload ID: 16396 relates to Category No.: 10056, 2942, 8948, 11650, 5762; Payload ID: 16397 relates to Category No.: 2942; Payload ID: 16398 relates to Category No.: 4030, 4029, 10056, 2942, 1792, 6743, 3671, 6717, 5762, 12159; Payload ID: 16399 relates to Category No.: 9305, 2890, 2194, 10056, 2942, 9247, 1803, 6743, 4228, 9181, 14999, 5539, 16337, 1822; Payload ID: 16400 relates to Category No.: 9305, 273, 9734, 6017, 4228, 779, 16326, 10056; Payload ID: 16401 relates to Category No.: 9305, 2938, 2942, 4228, 2890; Payload ID: 16402 relates to Category No.: 4030, 6717, 2942, 7061, 7244, 4010, 7118; Payload ID: 16403 relates to Category No.: 2890, 6717, 2942, 3673, 9247, 14371, 4010, 14368, 16326, 15758, 2401, 10056, 5762, 16156, 7118, 1017, 1033, 14683, 3061; Payload ID: 16404 relates to Category No.: 5561, 10056, 3673, 2899, 4755, 9734, 3521, 2534, 9184, 3696, 4760, 1792, 6440, 2504, 15577, 3036, 5776, 8948; Payload ID: 16405 relates to Category No.: 4030, 5561, 12439, 6717, 5570, 3693, 3666, 4755, 15573, 3521, 4010, 4759, 6333, 9164; Payload ID: 16406 relates to Category No.: 5561, 6717; Payload ID: 16407 relates to Category No.: 5561, 6717; Payload ID: 16408 relates to Category No.: 5561, 6717, 8951; Payload ID: 16409 relates to Category No.: 3693, 4049, 14100, 5776, 2890, 6717, 4755, 6017, 3696, 3523, 11883, 14099, 15765, 2942, 3521; Payload ID: 16410 relates to Category No.: 3693, 9305, 4045, 2194, 3666; Payload ID: 16411 relates to Category No.: 5762, 4049, 3693; Payload ID: 16412 relates to Category No.: 4049, 3521, 4010; Payload ID: 16413 relates to Category No.: 3521, 3523, 5561; Payload ID: 16414 relates to Category No.: 5561, 6443, 3036, 6060, 6059, 6440;

Payload ID: 16415 relates to Category No.: 2890, 6717, 5776, 9242, 2942, 2927; Payload ID: 16416 relates to Category No.: 6443, 4045, 3521, 6060, 6059, 3523; Payload ID: 16417 relates to Category No.: 2890, 6717, 5776, 2942, 3693, 2899, 4755, 2927, 3521, 3696, 11883; Payload ID: 16418 relates to Category No.: 3693, 4043, 2899, 2927, 4010, 3696, 2504, 4860, 8948; Payload ID: 16419 relates to Category No.: 2890, 2927, 3523; Payload ID: 16420 relates to Category No.: 2890, 6717, 5776, 3693, 4049, 14100, 6017, 4010, 3696, 3523, 11883, 14099, 15765; Payload ID: 16421 relates to Category No.: 9305, 10056, 3523; Payload ID: 16422 relates to Category No.: 2927; Payload ID: 16423 relates to Category No.: 2927; Payload ID: 16424 relates to Category No.: 1842, 3696, 3693; Payload ID: 16425 relates to Category No.: 4010, 5961; Payload ID: 16426 relates to Category No.: 2890, 5776, 2942, 4049, 3521, 14100, 4010, 3696, 3523, 2504, 3527; Payload ID: 16427 relates to Category No.: 3521, 11883, 2938; Payload ID: 16428 relates to Category No.: 3693, 4049; Payload ID: 16429 relates to Category No.: 6717, 2942, 3693, 2899, 2927, 4049; Payload ID: 16430 relates to Category No.: 2890, 6717, 10056, 3693, 14707, 4049, 2896, 3523, 11883; Payload ID: 16431 relates to Category No.: 4045, 3693, 4043, 2927, 14100, 9773, 14327, 3523, 14099, 15765, 15764, 6473; Payload ID: 16432 relates to Category No.: 9305, 2890, 5762, 3693, 2899, 4049, 14100, 3523, 14099, 15765, 15764, 5776; Payload ID: 16433 relates to Category No.: 3693, 4049, 2927; Payload ID: 16434 relates to Category No.: 5776, 3693, 4049, 14100, 3523; Payload ID: 16435 relates to Category No.: 3693, 2890, 10056, 4043, 2899, 15573, 2927, 4010, 14327, 2504; Payload ID: 16436 relates to Category No.: 2927, 3523; Payload ID: 16437 relates to Category No.: 2890, 2942, 9247, 16269, 3521, 14100, 3523, 5392, 3693; Payload ID: 16438 relates to Category No.: 2890, 3693, 4049; Payload ID: 16443 relates to Category No.: 9305, 2890, 9247, 9157, 12170; Payload ID: 16444 relates to Category No.: 9305, 2890, 9242, 9247, 7256, 9158, 15269, 10104, 9195; Payload ID: 16445 relates to Category No.: 9305, 9242; Payload ID: 16446 relates to Category No.: 9305, 2890, 9247, 10104, 9162; Payload ID: 16447 relates to Category No.: 9305; Payload ID: 16448 relates to Category No.: 9305, 9247; Payload ID: 16449 relates to Category No.: 9305, 2890, 10056, 9247, 4755, 10104, 15531; Payload ID: 16450 relates to Category No.: 9305, 2890, 9247, 6968, 5597; Payload ID: 16451 relates to Category No.: 9305; Payload ID: 16452 relates to Category No.: 9305, 2942; Payload ID: 16453 relates to Category No.: 9305, 2890; Payload ID: 16454 relates to Category No.: 9305; Payload ID: 16455 relates to Category No.: 9305; Payload ID: 16456 relates to Category No.: 9305, 2890, 9311, 5029, 2419; Payload ID: 16457 relates to Category No.: 9305, 9311; Payload ID: 16458 relates to Category No.: 9305; Payload ID: 16459 relates to Category No.: 2890, 5776, 9247, 9305, 11883, 5029; Payload ID: 16460 relates to Category No.: 9305, 2890; Payload ID: 16461 relates to Category No.: 9305, 2890; Payload ID: 16462 relates to Category No.: 9305, 2890; Payload ID: 16463 relates to Category No.: 9305, 2890; Payload ID: 16469 relates to Category No.: 12159, 1090; Payload ID: 16470 relates to Category No.: 12159, 1090, 5749, 5561; Payload ID: 16471 relates to Category No.: 4030, 2890, 12159, 11650, 8917, 9087, 14367; Payload ID: 16472 relates to Category No.: 12159; Payload ID: 16473 relates to Category No.: 4030, 12159, 4014; Payload ID: 16474 relates to Category No.: 4030, 12159, 4010; Payload ID: 16475 relates to Category No.: 5561, 2890, 10056, 9242, 2942, 4010, 2926, 6440, 15139, 1017, 3036; Payload ID: 16476 relates to Category No.: 2890, 10056, 6994, 7070, 15139, 6222; Payload ID: 16477 relates to Category No.: 9305, 2890, 2942, 9247, 3696, 15577; Payload ID: 16478 relates to Category No.: 5561, 7118, 6717, 7061; Payload ID: 16479 relates to Category No.: 5561, 9305, 2890, 6960, 2194, 3693, 3666, 6994, 9734, 6968, 14893, 4010, 2926; Payload ID: 16481 relates to Category No.: 5561; Payload ID: 16482 relates to Category No.: 5561; Payload ID: 16483 relates to Category No.: 5561; Payload ID: 16484 relates to Category No.: 5561; Payload ID: 16485 relates to Category No.: 5561; Payload ID: 16486 relates to Category No.: 5561; Payload ID: 16488 relates to Category No.: 5561; Payload ID: 16489 relates to Category No.: 9305, 9242, 2942, 2630, 7547; Payload ID: 16490 relates to Category No.: 9305, 2942, 2630, 7547; Payload ID: 16491 relates to Category No.: 5561, 6717, 10056, 5570; Payload ID: 16492 relates to Category No.: 9305, 9247, 2786, 9215; Payload ID: 16493 relates to Category No.: 9305, 2786; Payload ID: 16494 relates to Category No.: 5561, 9305, 2890, 2938, 9247, 4755, 6196, 11653, 14364, 9184, 9162, 9192; Payload ID: 16495 relates to Category No.: 5561, 9305, 7118, 2890, 9247, 6196, 14371, 4010, 5730, 14368, 9184, 4228, 16326, 493, 9162, 4201, 6019, 9192, 9180, 7389; Payload ID: 16496 relates to Category No.: 5561, 6717, 6196, 9162, 14293, 9192; Payload ID: 16497 relates to Category No.: 5561, 2890, 6196, 5566, 7171; Payload ID: 16498 relates to Category No.: 2942, 5824, 14811, 273, 14813, 6717, 2712, 2801; Payload ID: 16499 relates to Category No.: 6717, 5776, 2942, 14811, 6968, 4010, 4032, 6075, 16326, 2712, 2801, 4089, 10056, 11883; Payload ID: 16500 relates to Category No.: 2890, 2942, 5824, 14811, 273, 1792, 11883, 14813, 6717, 10056, 2712; Payload ID: 16501 relates to Category No.: 2890, 9242, 2942, 14811, 4010, 6449, 14813, 1016, 9305, 6717, 10056, 8951, 2712, 2801; Payload ID: 16502 relates to Category No.: 4030, 2890, 2942, 14811, 1748, 8948, 779, 10056, 3693, 4765, 15151, 9734; Payload ID: 16503 relates to Category No.: 14811, 2890, 6717, 10056, 2942, 8948, 447, 4010, 10104, 9181, 9087, 1029, 1028, 1712, 1017, 9577; Payload ID: 16504 relates to Category No.: 2890, 6717, 2942, 14811, 4010, 9998, 9999; Payload ID: 16505 relates to Category No.: 9305; Payload ID: 16506 relates to Category No.: 9305, 2890; Payload ID: 16515 relates to Category No.: 9305; Payload ID: 16516 relates to Category No.: 9247, 4010, 15531, 9305; Payload ID: 16517 relates to Category No.: 5561, 261; Payload ID: 16518 relates to Category No.: 5561, 6443, 4029, 14409, 261, 262; Payload ID: 16519 relates to Category No.: 10056, 677, 262; Payload ID: 16520 relates to Category No.: 4029; Payload ID: 16521 relates to Category No.: 4029; Payload ID: 16522 relates to Category No.: 4029, 262; Payload ID: 16523 relates to Category No.: 10056, 677; Payload ID: 16524 relates to Category No.: 9305; Payload ID: 16525 relates to Category No.: 2890, 14893, 4402; Payload ID: 16526 relates to Category No.: 2890, 9247, 6968; Payload ID: 16527 relates to Category No.: 4029; Payload ID: 16528 relates to Category No.: 4029; Payload ID: 16529 relates to Category No.: 2938, 7244, 1046, 2890, 9305, 1039; Payload ID: 16530 relates to Category No.: 2890, 6960, 9247, 7244, 1039; Payload ID: 16531 relates to Category No.: 5561, 2890, 2938, 7244, 9162; Payload ID: 16532 relates to Category No.: 9305, 2890, 6976, 14906, 9247, 6994, 2630, 14902, 5964, 6978, 7161; Payload ID: 16533 relates to Category No.: 9305, 6960, 6968, 7244, 1046; Payload ID: 16534 relates to Category No.: 9305; Payload ID: 16535 relates to Category No.: 6717, 262, 2890, 9305; Payload ID: 16536 relates to Category No.: 5561, 2890, 2942, 9734, 4010, 262, 5762; Payload ID: 16537 relates to Category No.: 2890, 6717, 14825, 14833, 7244, 11728, 2458, 4008; Payload ID: 16538 relates to Category No.: 262; Payload ID: 16539 relates to Category No.: 2938, 1842, 1046, 2890, 7244; Payload ID: 16540 relates to Category No.: 2890, 4755, 14828, 6573; Payload ID: 16541 relates to Category No.: 7118, 2890, 7061; Payload ID: 16542 relates to Category No.: 9305, 2890; Payload ID: 16543 relates to Category No.: 9305, 2890, 10056, 9247; Payload ID: 16544 relates to Category No.: 2899; Payload ID: 16545 relates to Category No.: 5561, 2890; Payload ID: 16546 relates to Category No.: 9305, 2890, 6968; Payload ID: 16547 relates to Category No.: 2890, 2194; Payload ID: 16548 relates to Category No.: 1842; Payload ID: 16549 relates to Category No.: 9305, 2890; Payload ID: 16550 relates to Category No.: 9305; Payload ID: 16552 relates to Category No.: 2890, 9247, 6017, 4199, 14329; Payload ID: 16553 relates to Category No.: 4755; Payload ID: 16554 relates to Category No.: 2890; Payload ID: 16555 relates to Category No.: 2890, 5776, 7070; Payload ID: 16556 relates to Category No.: 7070; Payload ID: 16557 relates to Category No.: 9305, 2890, 9242; Payload ID: 16558 relates to Category No.: 4029; Payload ID: 16560 relates to Category No.: 2420; Payload ID: 16561 relates to Category No.: 9305, 2890, 9247, 9242; Payload ID: 16562 relates to Category No.: 5561, 1842; Payload ID: 16564 relates to Category No.: 1842, 5561; Payload ID: 16565 relates to Category No.: 9734; Payload ID: 16566 relates to Category No.: 9305, 2942, 2890; Payload ID: 16567 relates to Category No.: 1842, 2890; Payload ID: 16569 relates to Category No.: 7118, 2890; Payload ID: 16570 relates to Category No.: 2890; Payload ID: 16571 relates to Category No.: 4029, 14819; Payload ID: 16573 relates to Category No.: 6968, 1046, 2441, 9998; Payload ID: 16575 relates to Category No.: 5561; Payload ID: 16577 relates to Category No.: 2890; Payload ID: 16578 relates to Category No.: 9305, 2890, 9242, 11883; Payload ID: 16579 relates to Category No.: 9305, 2890; Payload ID: 16580 relates to Category No.: 2942; Payload ID: 16582 relates to Category No.: 5762, 2942; Payload ID: 16583 relates to Category No.: 2890, 4010; Payload ID: 16584 relates to Category No.: 9305, 2890, 2942; Payload ID: 16585 relates to Category No.: 2942, 4010; Payload ID: 16586 relates to Category No.: 9305, 2890; Payload ID: 16588 relates to Category No.: 4030, 15627; Payload ID: 16589 relates to Category No.: 9305, 2890, 3666, 9247; Payload ID: 16590 relates to Category No.: 2942, 9247, 14382, 4010, 2791, 9603; Payload ID: 16591 relates to Category No.: 9305, 2890, 9242, 2942, 9247, 14382, 493; Payload ID: 16593 relates to Category No.: 6443, 10056, 3693, 4010, 6437, 4030, 6015, 5561; Payload ID: 16594 relates to Category No.: 10056, 5570, 6717, 5762, 1659; Payload ID: 16595 relates to Category No.: 10056, 4765, 4755, 4758, 5561; Payload ID: 16596 relates to Category No.: 5561, 4765, 3673, 3666, 4755, 15573; Payload ID: 16597 relates to Category No.: 4030, 4010; Payload ID: 16598 relates to Category No.: 4030, 4010; Payload ID: 16599 relates to Category No.: 5561; Payload ID: 16600 relates to Category No.: 10056, 5570, 4755, 5559, 5561; Payload ID: 16601 relates to Category No.: 9305, 2890, 10056, 2942, 1017, 8935, 15151; Payload ID: 16602 relates to Category No.: 6717, 2942, 6440; Payload ID: 16603 relates to Category No.: 3673, 3666, 5557, 5561; Payload ID: 16604 relates to Category No.: 5561, 3673, 6717, 3666; Payload ID: 16605 relates to Category No.: 5561, 3673, 3666; Payload ID: 16606 relates to Category No.: 5561, 10056, 3693, 6743, 5823, 4008, 2942; Payload ID: 16607 relates to Category No.: 5561, 10056; Payload ID: 16608 relates to Category No.: 5561, 10056, 2942, 5570; Payload ID: 16609 relates to Category No.: 5561, 10056, 2942, 5570; Payload ID: 16610 relates to Category No.: 5561, 10056; Payload ID: 16611 relates to Category No.: 7118, 2890, 4010, 16326; Payload ID: 16612 relates to Category No.: 9157, 9305, 5561; Payload ID: 16613 relates to Category No.: 9305, 2890; Payload ID: 16614 relates to Category No.: 9305; Payload ID: 16615 relates to Category No.: 2890, 2194, 2183, 14893; Payload ID: 16616 relates to Category No.: 2942, 6968, 14902, 2631; Payload ID: 16617 relates to Category No.: 2942, 14902, 2631; Payload ID: 16618 relates to Category No.: 2890, 14902, 2631; Payload ID: 16619 relates to Category No.: 9305, 6976, 2942, 14906, 2631; Payload ID: 16620 relates to Category No.: 9305, 9242, 14893; Payload ID: 16621 relates to Category No.: 1842; Payload ID: 16622 relates to Category No.: 9305; Payload ID: 16625 relates to Category No.: 5561, 16156, 7048, 6440; Payload ID: 16626 relates to Category No.: 5561, 6440, 16156; Payload ID: 16627 relates to Category No.: 5561, 6440, 16156; Payload ID: 16628 relates to Category No.: 2938, 10056, 9734, 1720, 2927, 2514, 4755; Payload ID: 16629 relates to Category No.: 2938, 10056, 2942, 9734, 1720, 2927, 2514; Payload ID: 16630 relates to Category No.: 2890; Payload ID: 16631 relates to Category No.: 2890, 1842; Payload ID: 16632 relates to Category No.: 5762; Payload ID: 16633 relates to Category No.: 2890; Payload ID: 16634 relates to Category No.: 9305, 2890, 10056, 2942, 4043, 11883, 3527, 15206, 1069; Payload ID: 16635 relates to Category No.: 9305, 14174, 9247, 14912; Payload ID: 16636 relates to Category No.: 9247, 15857, 14912, 1635, 15851, 15858; Payload ID: 16637 relates to Category No.: 9305, 9247, 15857, 14912, 1635, 15851, 14664, 9215; Payload ID: 16638 relates to Category No.: 9305, 9247, 14912, 1635, 9215; Payload ID: 16639 relates to Category No.: 9305, 9247, 15857, 14912, 1635, 15851, 9215, 15848, 15846, 9181, 2402, 14664; Payload ID: 16640 relates to Category No.: 9305, 9247, 11691, 14912, 1635, 15851, 15848, 15858; Payload ID: 16641 relates to Category No.: 9305, 9247, 14912, 1635, 14664, 15848; Payload ID: 16642 relates to Category No.: 9247, 14912, 15848; Payload ID: 16643 relates to Category No.: 9305, 9247, 11691, 15851, 15848; Payload ID: 16644 relates to Category No.: 9247, 11691, 1635, 15851, 15848, 15858, 9305; Payload ID: 16645 relates to Category No.: 9247, 9305, 2890, 2402, 9181, 14253, 9578; Payload ID: 16646 relates to Category No.: 9305; Payload ID: 16647 relates to Category No.: 9247, 14912; Payload ID: 16648 relates to Category No.: 9305, 11836, 5572; Payload ID: 16649 relates to Category No.: 9305, 2420, 2420, 15269; Payload ID: 16650 relates to Category No.: 9305; Payload ID: 16651 relates to Category No.: 4030, 12159, 4014, 3671; Payload ID: 16652 relates to Category No.: 12159, 4010, 4030; Payload ID: 16653 relates to Category No.: 6717, 10056, 2942, 1700; Payload ID: 16654 relates to Category No.: 9305, 6717, 6960, 2938, 10056, 2942, 6968, 14329; Payload ID: 16655 relates to Category No.: 2890, 6717; Payload ID: 16656 relates to Category No.: 6717, 2890, 4755, 4228, 14329; Payload ID: 16657 relates to Category No.: 2890, 6717, 10056, 9247, 1659; Payload ID: 16658 relates to Category No.: 2890, 6717, 9247, 15628, 2926, 10056; Payload ID: 16659 relates to Category No.: 6717; Payload ID: 16660 relates to Category No.: 9305, 9247, 2420, 9215; Payload ID: 16662 relates to Category No.: 9305, 7118; Payload ID: 16664 relates to Category No.: 9305, 9247, 2420; Payload ID: 16665 relates to Category No.: 9242, 1842; Payload ID: 16666 relates to Category No.: 9242, 14354, 14355; Payload ID: 16667 relates to Category No.: 9305, 9247, 14354, 14937, 15514; Payload ID: 16668 relates to Category No.:

9305, 9247, 3484; Payload ID: 16669 relates to Category No.: 9305, 9247, 3484; Payload ID: 16670 relates to Category No.: 9305; Payload ID: 16671 relates to Category No.: 9305, 14937; Payload ID: 16673 relates to Category No.: 5561, 3673, 5776; Payload ID: 16674 relates to Category No.: 2890, 2942, 9247, 4755, 1635, 15864, 1377; Payload ID: 16675 relates to Category No.: 9305, 2890, 5762, 9247, 15864, 9215, 1377, 15863, 15867, 15875; Payload ID: 16676 relates to Category No.: 9305, 7118, 2890, 9734, 14826, 14145, 262; Payload ID: 16677 relates to Category No.: 10056, 2942; Payload ID: 16681 relates to Category No.: 9305, 2890, 10056, 2942, 1811, 15206; Payload ID: 16682 relates to Category No.: 2890, 10056, 2942, 9247; Payload ID: 16683 relates to Category No.: 2890, 15139, 273, 11650, 3036, 11653, 1017; Payload ID: 16684 relates to Category No.: 6443, 9305, 7118, 2890, 7048, 10056, 2942, 4043, 4010, 6059, 1659, 276, 9734, 14329, 8935, 11650; Payload ID: 16685 relates to Category No.: 3693; Payload ID: 16686 relates to Category No.: 2890, 10056, 2899, 3696, 6059; Payload ID: 16687 relates to Category No.: 2890, 4043; Payload ID: 16688 relates to Category No.: 5561, 4765, 3673, 3666, 4755, 3832, 11883, 5776; Payload ID: 16691 relates to Category No.: 9305; Payload ID: 16692 relates to Category No.: 9305, 9242, 9247; Payload ID: 16693 relates to Category No.: 9247; Payload ID: 16694 relates to Category No.: 9247, 14912, 9181; Payload ID: 16695 relates to Category No.: 9305, 2890, 10056, 3666, 9247, 9181; Payload ID: 16696 relates to Category No.: 9305, 2890, 9242, 9247; Payload ID: 16697 relates to Category No.: 1842; Payload ID: 16698 relates to Category No.: 9305; Payload ID: 16699 relates to Category No.: 9305, 2890, 4051; Payload ID: 16700 relates to Category No.: 9305, 2890; Payload ID: 16701 relates to Category No.: 9305, 1842, 12170; Payload ID: 16702 relates to Category No.: 9305, 9247; Payload ID: 16703 relates to Category No.: 1842, 9220; Payload ID: 16704 relates to Category No.: 9305, 2890, 9220; Payload ID: 16705 relates to Category No.: 9305, 15505, 9247, 9220; Payload ID: 16706 relates to Category No.: 9305, 9157, 9220; Payload ID: 16707 relates to Category No.: 9305, 2890, 15505, 2942, 9247, 9220; Payload ID: 16708 relates to Category No.: 9305, 1842; Payload ID: 16709 relates to Category No.: 9247; Payload ID: 16710 relates to Category No.: 9305; Payload ID: 16711 relates to Category No.: 9305, 7118, 2890, 9247, 9220; Payload ID: 16712 relates to Category No.: 9305, 9220; Payload ID: 16713 relates to Category No.: 9305, 9247; Payload ID: 16714 relates to Category No.: 9305, 2890, 9247; Payload ID: 16715 relates to Category No.: 9305, 2890, 9220; Payload ID: 16716 relates to Category No.: 9305, 9247, 11883, 15505, 9220; Payload ID: 16717 relates to Category No.: 2890; Payload ID: 16718 relates to Category No.: 9305, 2890; Payload ID: 16720 relates to Category No.: 6717, 4765, 5559, 4010, 4760, 5561, 4755; Payload ID: 16721 relates to Category No.: 4029, 4765, 5559, 4760; Payload ID: 16722 relates to Category No.: 5561, 4029, 4765, 5559, 4760, 4755; Payload ID: 16723 relates to Category No.: 6717, 4765, 5559, 4010, 4760, 5561, 4755; Payload ID: 16724 relates to Category No.: 5561, 4765, 5570, 5559; Payload ID: 16725 relates to Category No.: 5561, 4765, 5559, 4010, 4755; Payload ID: 16726 relates to Category No.: 5561, 4755, 4765; Payload ID: 16727 relates to Category No.: 4765, 5559, 5561, 4755; Payload ID: 16728 relates to Category No.: 5561, 4765, 4755; Payload ID: 16729 relates to Category No.: 5561, 4765, 4755; Payload ID: 16730 relates to Category No.: 5561, 4765, 5559, 4755; Payload ID: 16731 relates to Category No.: 5561, 2890, 10056, 4765, 4755; Payload ID: 16732 relates to Category No.: 4765, 5559, 4010, 4760, 3666, 4779, 4764, 5561, 4755; Payload ID: 16733 relates to Category No.: 5561, 4765, 4760, 4755; Payload ID: 16734 relates to Category No.: 5561, 4765, 5559, 4755; Payload ID: 16735 relates to Category No.: 4765, 5559, 3521, 12439; Payload ID: 16736 relates to Category No.: 4765, 5559, 5561, 4755; Payload ID: 16737 relates to Category No.: 4765, 5559; Payload ID: 16738 relates to Category No.: 4765, 5559; Payload ID: 16739 relates to Category No.: 5561, 4755, 4765, 5559; Payload ID: 16740 relates to Category No.: 10056, 5570, 3638, 5561; Payload ID: 16741 relates to Category No.: 2890, 10056, 5570, 4008, 3638; Payload ID: 16742 relates to Category No.: 2183, 2441, 7246, 14826, 1044; Payload ID: 16744 relates to Category No.: 9305, 2890, 10056, 9247, 3521, 4010, 2514; Payload ID: 16745 relates to Category No.: 6717; Payload ID: 16746 relates to Category No.: 5561, 7070; Payload ID: 16747 relates to Category No.: 4029, 9305, 2890, 4030, 779; Payload ID: 16748 relates to Category No.: 4030, 4029, 3666, 9734, 4755; Payload ID: 16749 relates to Category No.: 9305, 2890, 6717, 4010, 6709, 14190, 7118, 3064; Payload ID: 16750 relates to Category No.: 6717, 3673, 5570, 9734, 11688; Payload ID: 16751 relates to Category No.: 5561, 6717, 5776, 6060, 6440, 6059; Payload ID: 16752 relates to Category No.: 6717, 2942, 6989, 5599; Payload ID: 16753 relates to Category No.: 2942, 7061, 6222; Payload ID: 16754 relates to Category No.: 5561, 2890, 6060, 6440, 7118, 3693, 6059; Payload ID: 16755 relates to Category No.: 2899; Payload ID: 16756 relates to Category No.: 2942; Payload ID: 16758 relates to Category No.: 7118; Payload ID: 16759 relates to Category No.: 2942, 4228; Payload ID: 16760 relates to Category No.: 9305, 2890, 9247, 5961, 4755, 2183; Payload ID: 16761 relates to Category No.: 4029; Payload ID: 16762 relates to Category No.: 2890, 5762, 6960, 8935, 4010, 2942, 6717; Payload ID: 16763 relates to Category No.: 2890, 6717, 8935, 3693, 4755, 9734, 8948, 6017, 1017, 4860, 16156; Payload ID: 16764 relates to Category No.: 2890; Payload ID: 16765 relates to Category No.: 2890, 8935, 4755, 1017, 4860; Payload ID: 16766 relates to Category No.: 2890, 8935, 4755, 1017, 4860; Payload ID: 16767 relates to Category No.: 2890, 6717, 10056, 3666, 3036, 6964, 4010, 2907, 2920, 14293, 1711, 14145, 8935, 8948; Payload ID: 16768 relates to Category No.: 6717, 6960, 9242, 3666; Payload ID: 16769 relates to Category No.: 2890, 4010; Payload ID: 16770 relates to Category No.: 5762, 9305, 2890, 2942, 9247; Payload ID: 16771 relates to Category No.: 5561, 5762, 9305, 2890, 2942; Payload ID: 16772 relates to Category No.: 5570; Payload ID: 16773 relates to Category No.: 5776, 5570, 10056, 2942, 5559, 3521, 3696, 15577, 3693; Payload ID: 16774 relates to Category No.: 5570, 3696, 7321; Payload ID: 16775 relates to Category No.: 10056, 4765, 5570, 4010, 3693; Payload ID: 16776 relates to Category No.: 5561, 6717, 3673, 3666; Payload ID: 16777 relates to Category No.: 5561, 3673; Payload ID: 16778 relates to Category No.: 9305, 2890, 2942, 14145, 9247, 5222; Payload ID: 16779 relates to Category No.: 14953, 1792, 14955, 5971; Payload ID: 16780 relates to Category No.: 7118, 2890, 6960, 2942, 15139, 1748, 3036, 1017, 6968, 4051; Payload ID: 16783 relates to Category No.: 9305; Payload ID: 16789 relates to Category No.: 2890, 1748, 3036, 15139; Payload ID: 16790 relates to Category No.: 2890, 9305; Payload ID: 16791 relates to Category No.: 5561; Payload ID: 16793 relates to Category No.: 5561, 5557; Payload ID: 16794 relates to Category No.: 2890, 5776; Payload ID: 16795 relates to Category No.: 3521; Payload ID: 16796 relates to Category No.: 5561, 2890, 3673, 3666; Payload ID: 16797 relates to Category No.: 9305, 2890, 10056, 14145, 9247, 6968, 5597; Payload ID: 16798 relates to Category No.: 6443, 6717, 5776, 10056, 3673, 3693, 3666, 4755, 3671, 5561, 9162; Payload ID: 16799 relates to Category No.: 5561, 2890, 6717, 3673, 5776, 8948, 9734, 1712, 7366; Payload ID: 16800 relates to Category No.: 5561, 2890, 6717, 3673, 8948, 1712; Payload ID: 16801 relates to Category No.: 7052, 7118, 2942, 8935, 8948, 7032; Payload ID: 16802 relates to Category No.: 7118, 2890, 6717, 5776, 9247, 9756, 4010, 11883, 9753; Payload ID: 16803 relates to Category No.: 5561, 6717, 3673, 3666; Payload ID: 16804 relates to Category No.: 5561, 6717, 3673, 3666, 1335; Payload ID: 16805 relates to Category No.: 5561, 9305, 2890, 2942, 4765, 3673, 3666, 9247, 3832, 9162, 6717, 11883, 5776; Payload ID: 16806 relates to Category No.: 9305, 2890, 9242, 2942, 4765, 3673, 3666, 9247, 3832, 14933, 6717; Payload ID: 16807 relates to Category No.: 5561, 3673, 5776; Payload ID: 16808 relates to Category No.: 9247, 2630, 4081, 4080; Payload ID: 16809 relates to Category No.: 5561, 10056, 11883; Payload ID: 16810 relates to Category No.: 9305, 2890; Payload ID: 16811 relates to Category No.: 4030; Payload ID: 16812 relates to Category No.: 2890, 10056, 2942, 15892, 3666, 9247, 4010, 5730, 9175, 15890; Payload ID: 16813 relates to Category No.: 4030, 7118, 2890, 6717, 2938, 5570, 3666, 1239, 4010, 6743, 6709, 16156, 9734, 5561; Payload ID: 16814 relates to Category No.: 5561, 1842, 2926, 10056, 6717; Payload ID: 16815 relates to Category No.: 2938, 7048, 273, 2660, 6743, 7052, 5392, 15206, 4053, 7118, 6717; Payload ID: 16816 relates to Category No.: 5570, 1842, 2458, 6743; Payload ID: 16817 relates to Category No.: 15507; Payload ID: 16818 relates to Category No.: 2890, 6717; Payload ID: 16819 relates to Category No.: 2890, 6717, 9242, 8935, 1748, 15151, 2504; Payload ID: 16820 relates to Category No.: 5557; Payload ID: 16821 relates to Category No.: 9305, 2890, 2194, 9242, 9247, 1720; Payload ID: 16822 relates to Category No.: 1842; Payload ID: 16823 relates to Category No.: 4030, 9305, 2890, 2942, 2927, 4010; Payload ID: 16824 relates to Category No.: 1842; Payload ID: 16825 relates to Category No.: 1842; Payload ID: 16826 relates to Category No.: 5561, 14174, 2942, 3673, 3666, 2901; Payload ID: 16827 relates to Category No.: 5561, 3666, 3673; Payload ID: 16828 relates to Category No.: 9305, 4755, 7366, 11883; Payload ID: 16829 relates to Category No.: 9305, 2890, 4010; Payload ID: 16830 relates to Category No.: 2890; Payload ID: 16831 relates to Category No.: 2890, 6717, 1182, 11650, 8948, 11653, 12087, 3055; Payload ID: 16832 relates to Category No.: 9305, 2890, 10056, 9247, 4755, 8948, 3036, 12087, 11883; Payload ID: 16833 relates to Category No.: 2890, 6717, 12087, 3055, 11883; Payload ID: 16834 relates to Category No.: 9305, 2942, 2420, 2192, 9247, 2420, 2402; Payload ID: 16835 relates to Category No.: 9305, 6717, 10056, 9242, 2942, 2420, 2192, 9247, 273, 2420, 2402, 5730; Payload ID: 16836 relates to Category No.: 4030, 9305, 9242, 2420, 2192, 15173, 6676, 6066, 2632, 6525, 15634, 9183; Payload ID: 16837 relates to Category No.: 2890, 6717, 10056, 4755, 4010, 6059, 4763, 1231; Payload ID: 16838 relates to Category No.: 4030, 6717, 3417; Payload ID: 16839 relates to Category No.: 6717, 3671, 3417, 3668, 3666; Payload ID: 16840 relates to Category No.: 5557, 6960, 3673, 5570, 3666, 2714, 11883; Payload ID: 16841 relates to Category No.: 5561, 10056, 3673, 3666; Payload ID: 16842 relates to Category No.: 9305, 2890, 9242, 2942, 2420, 2192, 9247, 2630, 2420, 5964, 2564, 2632, 6676; Payload ID: 16843 relates to Category No.: 2890, 2420, 2192, 9247, 2420, 6676, 6066, 2632, 15173, 9183; Payload ID: 16844 relates to Category No.: 2635, 9305, 2890, 2942, 9247, 9158, 2420, 4010, 2628; Payload ID: 16845 relates to Category No.: 9305, 2890, 2942, 2420, 2192, 14906, 9247, 2420, 2402, 2564, 9181, 2563, 6676, 6066, 9183, 1090; Payload ID: 16846 relates to Category No.: 9305, 2890, 2942, 9247, 2420, 2635; Payload ID: 16847 relates to Category No.: 9305, 9247, 1748, 2420, 15269, 14614, 14675, 10104, 14531, 5600; Payload ID: 16848 relates to Category No.: 9305, 5762, 9242, 9247, 2420, 15269, 14614, 14675, 10104, 14531, 5600; Payload ID: 16849 relates to Category No.: 2420, 1080; Payload ID: 16850 relates to Category No.: 9305, 2890, 9242, 9247, 2420; Payload ID: 16851 relates to Category No.: 5561, 6717, 3673, 9362; Payload ID: 16852 relates to Category No.: 5561, 6717, 3666, 9362; Payload ID: 16853 relates to Category No.: 5561, 6717, 5776, 9242, 3652, 14707; Payload ID: 16854 relates to Category No.: 9305, 15505, 9242, 4010; Payload ID: 16855 relates to Category No.: 4029; Payload ID: 16856 relates to Category No.: 4030, 4010; Payload ID: 16857 relates to Category No.: 7118, 7060; Payload ID: 16858 relates to Category No.: 7118, 7060; Payload ID: 16859 relates to Category No.: 7060, 7052, 7118; Payload ID: 16860 relates to Category No.: 7060, 7118; Payload ID: 16861 relates to Category No.: 7118, 7048, 7090, 15052, 7366; Payload ID: 16862 relates to Category No.: 7118, 7048, 7090, 15052, 4010, 13751; Payload ID: 16863 relates to Category No.: 5561, 7118, 6717, 7048, 7090, 15052, 13751, 15051; Payload ID: 16864 relates to Category No.: 5561, 7118, 7048, 7041, 7090, 15052; Payload ID: 16865 relates to Category No.: 5561, 10056, 4010; Payload ID: 16866 relates to Category No.: 7118, 7060, 4010, 7366; Payload ID: 16867 relates to Category No.: 7118, 2890, 10056, 7060, 4010, 7048; Payload ID: 16868 relates to Category No.: 7118, 10056, 7060; Payload ID: 16869 relates to Category No.: 7118; Payload ID: 16870 relates to Category No.: 5561, 10056, 4755, 4010, 1335, 779, 6717; Payload ID: 16871 relates to Category No.: 4030, 10056, 3666, 4755, 1792, 6743, 4769; Payload ID: 16872 relates to Category No.: 4030, 10056, 3666, 4755, 1792, 4769; Payload ID: 16873 relates to Category No.: 3671, 3666; Payload ID: 16874 relates to Category No.: 3666, 3671; Payload ID: 16875 relates to Category No.: 7048; Payload ID: 16876 relates to Category No.: 2942; Payload ID: 16877 relates to Category No.: 7060, 7052, 7118, 2942; Payload ID: 16878 relates to Category No.: 2942, 2890; Payload ID: 16879 relates to Category No.: 2942, 2890; Payload ID: 16880 relates to Category No.: 2942, 5561; Payload ID: 16881 relates to Category No.: 2942; Payload ID: 16882 relates to Category No.: 2942; Payload ID: 16883 relates to Category No.: 2890; Payload ID: 16884 relates to Category No.: 2942; Payload ID: 16885 relates to Category No.: 2890, 2942, 4010; Payload ID: 16886 relates to Category No.: 2890; Payload ID: 16887 relates to Category No.: 2942, 1842; Payload ID: 16888 relates to Category No.: 2942; Payload ID: 16889 relates to Category No.: 9305, 2890, 5776, 2942, 3666, 4010; Payload ID: 16890 relates to Category No.: 2890; Payload ID: 16891 relates to Category No.: 2890; Payload ID: 16892 relates to Category No.: 9305, 5776, 9247, 2890, 15096; Payload ID: 16893 relates to Category No.: 9305, 2890, 9247, 9184, 4228; Payload ID: 16894 relates to Category No.: 9305, 5776, 9242, 9247; Payload ID: 16895 relates to Category No.: 2890, 9247; Payload ID: 16896 relates to Category No.: 9305, 5762; Payload ID: 16897 relates to Category No.: 9247, 9199, 9184, 10104, 2890, 9305, 2926, 9155; Payload ID: 16898 relates to Category No.: 9305, 2890, 9242, 7179; Payload ID: 16900 relates to Category No.: 5561, 6717, 14295, 14293; Payload ID: 16901 relates to Category No.: 9305, 9242, 9247, 1635, 4003; Payload ID: 16902 relates to Category No.: 4030, 4029, 9305, 7118, 2890, 10056, 2942, 4014, 9247, 8948, 7060, 9756, 4010, 2926, 11883, 7052, 3037, 7366, 8935, 3065, 6443, 14409; Payload ID: 16903 relates to Category No.: 7048, 7366, 2890, 7068, 7118, 7060, 4010; Payload ID: 16904 relates to Category No.: 2890, 4030, 4029, 4014, 4010, 4763, 15573, 9305; Payload ID: 16905 relates to Category No.: 9305, 2890, 10056, 6994, 273, 10106, 4228, 5829, 2514, 2738, 6972; Payload ID: 16906 relates to Category No.: 2890, 4010, 2942, 11883; Payload ID: 16907 relates to Category No.: 6717, 10056, 5570, 4010, 4029, 4053, 4030, 1099; Payload ID: 16908 relates to Category No.: 9305; Payload ID: 16910 relates to Category No.: 5561; Payload ID: 16911 relates to Category No.: 5561; Payload ID: 16913 relates to Category No.: 9305, 2890, 9242; Payload ID: 16914 relates to Category No.: 5561, 9305, 2890, 9247, 9184; Payload ID: 16915 relates to Category No.: 9305, 2890, 2942, 2899; Payload ID: 16916 relates to Category No.: 2890, 2942; Payload ID: 16917 relates to Category No.: 2890, 2942; Payload ID: 16918 relates to Category No.: 2890; Payload ID: 16919 relates to Category No.: 2890; Payload ID: 16920 relates to Category No.: 2890, 5392; Payload ID: 16921 relates to Category No.: 9305, 2890, 5776, 10056, 9242; Payload ID: 16922 relates to Category No.: 9305, 2890, 2942, 9247, 2455, 2443, 2458, 11728; Payload ID: 16923 relates to Category No.: 4030, 4010; Payload ID: 16924 relates to Category No.: 2942; Payload ID: 16925 relates to Category No.: 7070; Payload ID: 16926 relates to Category No.: 9305, 2420, 2192, 9247, 2415, 2632, 9178, 12394, 5029; Payload ID: 16927 relates to Category No.: 9305, 2420, 2192, 9247, 2402; Payload ID: 16928 relates to Category No.: 2632, 2192; Payload ID: 16929 relates to Category No.: 9247, 9172, 9725, 2632, 2192; Payload ID: 16930 relates to Category No.: 4010, 2890; Payload ID: 16931 relates to Category No.: 4029; Payload ID: 16932 relates to Category No.: 4029, 3673, 2502, 6015; Payload ID: 16933 relates to Category No.: 4030, 4029, 12159, 2574, 3673, 2502, 6015; Payload ID: 16934 relates to Category No.: 4030, 4029, 12159, 2574, 3673, 2502, 6015; Payload ID: 16935 relates to Category No.: 4030, 6443, 4029, 3673, 9247, 2502, 7321, 603, 7323, 6015, 2890; Payload ID: 16936 relates to Category No.: 4030, 4029, 3673, 2502, 7323, 6015, 2890, 5561; Payload ID: 16937 relates to Category No.: 4030, 6443, 4029, 12159, 2574, 3673, 3636, 2502, 2890; Payload ID: 16938 relates to Category No.: 5561, 6717, 7085, 7118; Payload ID: 16939 relates to Category No.: 9305, 10056, 9242, 1842; Payload ID: 16940 relates to Category No.: 5561, 4765, 3673, 3686, 3685; Payload ID: 16941 relates to Category No.: 9242, 9247, 4837; Payload ID: 16942 relates to Category No.: 9242, 9247, 4837; Payload ID: 16943 relates to Category No.: 9247, 14912; Payload ID: 16944 relates to Category No.: 9247; Payload ID: 16945 relates to Category No.: 9305, 2890, 9247, 14912, 5730, 9215, 1377; Payload ID: 16946 relates to Category No.: 9305, 2890, 2942, 9247, 14912, 16326, 14681, 14682, 4438, 1377; Payload ID: 16947 relates to Category No.: 9305, 2890, 2942, 9247, 14912, 16326, 14681, 14682, 4438, 1377; Payload ID: 16948 relates to Category No.: 5561; Payload ID: 16949 relates to Category No.: 5561, 10056, 4010; Payload ID: 16950 relates to Category No.: 5561, 10056; Payload ID: 16951 relates to Category No.: 5561, 4029; Payload ID: 16952 relates to Category No.: 5561; Payload ID: 16953 relates to Category No.: 5561, 1842; Payload ID: 16954 relates to Category No.: 4010; Payload ID: 16955 relates to Category No.: 4029, 2890, 6717; Payload ID: 16956 relates to Category No.: 6717, 1792, 3666, 997; Payload ID: 16957 relates to Category No.: 4030, 2890, 1748, 1792, 3972, 15147; Payload ID: 16958 relates to Category No.: 9305, 7118, 7060, 7068, 7034; Payload ID: 16960 relates to Category No.: 9305, 9242, 9247, 3861, 14530, 12170; Payload ID: 16961 relates to Category No.: 5561, 15151, 1748, 15161; Payload ID: 16962 relates to Category No.: 5561; Payload ID: 16963 relates to Category No.: 9305, 10056, 6017, 2942; Payload ID: 16964 relates to Category No.: 9305, 2255, 9312, 9157; Payload ID: 16965 relates to Category No.: 9305, 5776, 9247, 15126, 5730, 9157, 9133, 7544, 1077; Payload ID: 16966 relates to Category No.: 4030, 9305, 6717, 9242, 9247, 9157, 15126, 11883, 9133, 7544; Payload ID: 16967 relates to Category No.: 9305, 9242, 9247, 2628, 9312, 14323, 9209, 2415, 5904; Payload ID: 16968 relates to Category No.: 9305, 9247, 14614, 3358; Payload ID: 16969 relates to Category No.: 9158, 9305, 9242, 9247, 9157, 15126, 11883, 9133, 7544; Payload ID: 16970 relates to Category No.: 9247, 9157, 15126, 11883, 9133, 7544, 9305, 5762, 1077, 16317; Payload ID: 16971 relates to Category No.: 9247, 9157, 15126, 11883, 15531, 9133, 7544, 1077; Payload ID: 16972 relates to Category No.: 15126, 9133, 7544, 1077, 9305; Payload ID: 16973 relates to Category No.: 9305, 9157, 15126, 11883, 1077; Payload ID: 16974 relates to Category No.: 9305, 2890, 9247, 9157, 15126, 9133, 7544, 1077; Payload ID: 16975 relates to Category No.: 9305, 9247, 9158, 9157, 15126, 11883, 15531, 9133, 7544, 1077, 1233; Payload ID: 16976 relates to Category No.: 9247, 14614, 9181, 5029, 9209, 9305; Payload ID: 16977 relates to Category No.: 9305, 15128; Payload ID: 16978 relates to Category No.: 9305, 15128; Payload ID: 16979 relates to Category No.: 9305, 14546; Payload ID: 16981 relates to Category No.: 9305, 1635, 12218, 1634, 11719, 11647; Payload ID: 16982 relates to Category No.: 2890, 2938, 10056, 1182, 9247; Payload ID: 16983 relates to Category No.: 2890, 9247, 4755, 4010, 9305; Payload ID: 16984 relates to Category No.: 2942; Payload ID: 16985 relates to Category No.: 2942; Payload ID: 16986 relates to Category No.: 5561, 5570, 1748, 11650, 11653, 3054, 3055, 3523, 3972, 1711; Payload ID: 16987 relates to Category No.: 5561, 4755; Payload ID: 16988 relates to Category No.: 15151, 4755, 1748, 15161, 7366, 2942, 15139, 3036, 11721, 15280, 5778; Payload ID: 16989 relates to Category No.: 15139, 7366, 8951, 15161, 15151; Payload ID: 16990 relates to Category No.: 15151, 1748, 15161, 15139, 8951; Payload ID: 16991 relates to Category No.: 2890, 2942, 5824; Payload ID: 16992 relates to Category No.: 5561, 2890, 6717, 10056, 15151, 3666, 15161, 1811, 8935, 11721, 8917, 15139, 15280; Payload ID: 16993 relates to Category No.: 5561, 6717, 10056, 15151, 1748, 15161, 262; Payload ID: 16994 relates to Category No.: 5561, 6717, 10056, 15151, 1748, 15161; Payload ID: 16995 relates to Category No.: 5561, 6717, 1748, 15161, 8917, 6709, 15151, 15280; Payload ID: 16996 relates to Category No.: 5561, 6717, 4010, 15161, 8917, 15151; Payload ID: 16997 relates to Category No.: 15161, 8917, 5561, 6717, 15151, 1748, 15139; Payload ID: 16998 relates to Category No.: 5561, 6717, 15161, 8917; Payload ID: 16999 relates to Category No.: 6722, 2890, 11883, 8935, 2942; Payload ID: 17000 relates to Category No.: 6717, 2942; Payload ID: 17001 relates to Category No.: 5561, 7118, 7070, 1792, 5564; Payload ID: 17002 relates to Category No.: 15173, 2168, 677; Payload ID: 17003 relates to Category No.: 15173; Payload ID: 17004 relates to Category No.: 2168; Payload ID: 17005 relates to Category No.: 9305, 2420, 2168; Payload ID: 17006 relates to Category No.: 15173, 2632, 6525, 2420, 2168, 15634; Payload ID: 17007 relates to Category No.: 9305, 15173, 6066; Payload ID: 17008 relates to Category No.: 9247; Payload ID: 17009 relates to Category No.: 9305, 2628, 6066, 2632, 6525, 2420, 15173, 2632, 2192, 15634; Payload ID: 17010 relates to Category No.: 6717, 15151, 8935, 1748, 15161, 5571, 15139, 11723, 15280, 8942, 3972; Payload ID: 17011 relates to Category No.: 5561, 6717, 5570, 2927, 4010, 6709, 5571, 14409; Payload ID: 17012 relates to Category No.: 6717, 5571; Payload ID: 17013 relates to Category No.: 2890, 1182, 273, 11650, 11653, 9730, 3055, 14999; Payload ID: 17014 relates to Category No.: 9305, 273, 4228, 16326; Payload ID: 17015 relates to Category No.: 2938, 9305, 16326; Payload ID: 17016 relates to Category No.: 6717, 15151, 8935, 1748, 15161, 5571; Payload ID: 17017 relates to Category No.: 8935, 1700, 5561, 2890, 10056, 9247, 15139, 14707, 4010, 4228, 14802, 1050, 6617, 2926; Payload ID: 17018 relates to Category No.: 2890, 6717, 16257, 1233, 10056, 2942, 8935, 9734, 1748, 14707, 11723, 15170, 4860, 16156, 15139, 15573, 7366; Payload ID: 17019 relates to Category No.: 2890, 2194, 10056, 4765, 14707, 1001, 2926, 2452, 1700; Payload ID: 17020 relates to Category No.: 1233, 10056, 9734, 3652, 14707, 6717, 8948, 3036; Payload ID: 17021 relates to Category No.: 10056, 2534, 2504; Payload ID: 17022 relates to Category No.: 9305, 6717, 14145, 3666, 9247, 1635, 2757, 5222, 4347, 2890, 8948, 12211, 16195; Payload ID: 17023 relates to Category No.: 5561, 10056, 15151, 8935, 1748, 15161, 2401, 2509, 2508, 2510, 2511, 11723, 14409, 14707, 3065, 15280, 3972, 5778; Payload ID: 17024 relates to Category No.: 5561, 5776, 10056, 1748, 15161, 2401; Payload ID: 17025 relates to Category No.: 10056, 5561, 3693, 1748, 15161; Payload ID: 17026 relates to Category No.: 5561, 5776, 10056, 1748, 15161, 9734, 8935, 3065, 6717, 1700; Payload ID: 17027 relates to Category No.: 5561, 10056, 1748, 15161, 3065, 14409, 14412; Payload ID: 17028 relates to Category No.: 5561, 10056, 1748, 12440, 15161, 9734, 8948, 8935, 3065; Payload ID: 17029 relates to Category No.: 10056, 5561, 2942, 1748, 4049, 15161, 9732; Payload ID: 17030 relates to Category No.: 5561, 10056, 1748, 4010, 15161, 6443, 3065, 15280; Payload ID: 17031 relates to Category No.: 5561, 10056, 15161, 262, 2890, 6756; Payload ID: 17032 relates to Category No.: 5561, 10056, 1748, 15161; Payload ID: 17033 relates to Category No.: 10056, 15151, 1748, 15161, 5570; Payload ID: 17034 relates to Category No.: 5561, 10056, 1748, 15161; Payload ID: 17035 relates to Category No.: 10056, 15627, 5570; Payload ID: 17036 relates to Category No.: 5561, 10056; Payload ID: 17037 relates to Category No.: 10056, 5561; Payload ID: 17038 relates to Category No.: 10056; Payload ID: 17039 relates to Category No.: 10056, 15573; Payload ID: 17040 relates to Category No.: 10056, 5561; Payload ID: 17041 relates to Category No.: 3985, 10056, 4010, 6709, 4053, 6717; Payload ID: 17042 relates to Category No.: 1700, 9305, 2890, 6717, 10056, 9247, 4755, 3985, 6709, 4053; Payload ID: 17043 relates to Category No.: 10056, 3985, 4053; Payload ID: 17044 relates to Category No.: 2890, 2194, 10056, 3693, 9247, 4049, 3985, 15628, 14409, 779, 14412; Payload ID: 17045 relates to Category No.: 10056, 3985; Payload ID: 17046 relates to Category No.: 5727, 9734, 2890, 2942, 14363, 16326, 8917; Payload ID: 17047 relates to Category No.: 14412, 15628; Payload ID: 17048 relates to Category No.: 2890, 10056, 5570, 4010, 1792, 4228, 4763, 6437, 6717, 4008, 11883; Payload ID: 17049 relates to Category No.: 5561, 10056, 1792, 4763, 6437, 15139, 8948; Payload ID: 17050 relates to Category No.: 5561, 1792, 6717, 10056, 4763, 6437, 11883, 1017, 8935; Payload ID: 17051 relates to Category No.: 10056, 5570, 4010, 1792, 4763, 6437, 6743, 4228, 2738; Payload ID: 17052 relates to Category No.: 4030, 9305, 2890, 6717, 2938, 10056, 2942, 3673, 447, 1239, 4010, 4228, 6709, 5702, 4032, 5561, 5762; Payload ID: 17053 relates to Category No.: 2890, 10056, 4010; Payload ID: 17054 relates to Category No.: 5727, 447, 2738, 8904, 6717; Payload ID: 17055 relates to Category No.: 2890, 4755, 763; Payload ID: 17056 relates to Category No.: 7061; Payload ID: 17057 relates to Category No.: 6717, 3673, 3666, 9247, 5557, 14683, 3104, 5278, 3678, 5561; Payload ID: 17058 relates to Category No.: 9305, 2630, 5964, 2632, 2192, 7544, 9155; Payload ID: 17060 relates to Category No.: 9305, 2901, 9133; Payload ID: 17061 relates to Category No.: 9305, 5762; Payload ID: 17062 relates to Category No.: 9305, 5762; Payload ID: 17063 relates to Category No.: 9305, 447, 2441, 11883, 2182, 1750, 1803; Payload ID: 17064 relates to Category No.: 9305, 5762; Payload ID: 17065 relates to Category No.: 9305, 5762; Payload ID: 17066 relates to Category No.: 9305, 5762; Payload ID: 17067 relates to Category No.: 9305, 5762; Payload ID: 17068 relates to Category No.: 9305, 5762; Payload ID: 17069 relates to Category No.: 9305, 5762; Payload ID: 17070 relates to Category No.: 5561, 7118, 6960, 5776, 4765, 9247, 2899, 16156, 3064; Payload ID: 17071 relates to Category No.: 5561, 2890, 8935, 15139, 1748, 2901, 7118, 10056, 8948, 7061, 11723; Payload ID: 17072 relates to Category No.: 5561, 6717, 14707, 4765, 9734, 15573, 16156; Payload ID: 17073 relates to Category No.: 5561, 6717, 10056, 15151, 4755, 3652, 14707; Payload ID: 17074 relates to Category No.: 5561, 6717, 1233, 4765, 3652, 14707, 4010, 3696, 6743, 9774, 5762; Payload ID: 17075 relates to Category No.: 5561, 6717, 5776, 9242, 3652, 2890, 2942, 4765, 3666, 4755, 9734, 15573, 14707, 4228, 4759, 5762; Payload ID: 17076 relates to Category No.: 5561, 7118, 6717, 2942, 3673, 3652, 14707, 1001, 3831, 3832, 3686, 3685, 3848, 14685, 5257, 3666, 5762; Payload ID: 17077 relates to Category No.: 6717, 14707, 5561, 4765, 3673, 3666; Payload ID: 17078 relates to Category No.: 5561, 6717, 10056, 15151, 3652, 14707; Payload ID: 17079 relates to Category No.: 5561, 4029, 6717, 16257, 10056, 2942, 15151, 8935, 3652, 1748, 14707, 15161, 15169, 11883, 14409, 5778, 375, 15170, 15171; Payload ID: 17080 relates to Category No.: 5561, 9305, 6717, 6976, 10056, 2942, 15151, 3652, 14707, 14893; Payload ID: 17081 relates to Category No.: 4030, 5561, 6717, 5776, 10056, 15151, 3652, 1099, 14707, 6017, 4010, 1792, 2926, 1811, 6743, 15627, 6994; Payload ID: 17082 relates to Category No.: 5561, 6717, 10056, 15151, 8935, 3652, 14707, 1811, 6017, 4860, 4010, 779, 16065, 14802, 1050, 3036, 14409; Payload ID: 17083 relates to Category No.: 5561, 6717, 15151, 3652, 4030, 5762, 10056, 2942, 3693, 15139, 1099, 14707, 6017, 4010, 1792, 3055, 16065, 14802, 14783, 2890, 9734, 15573, 14995, 7368, 6071; Payload ID: 17084 relates to Category No.: 5561, 6717, 4765, 3673, 9247, 4755, 3652, 14707, 3832, 16156, 3686, 3666; Payload ID: 17085 relates to Category No.: 5561, 6717, 10056, 4755, 9734, 15573, 14707, 3521, 2504, 15574, 9774, 15280; Payload ID: 17086 relates to Category No.: 5561, 6443, 12439, 6717, 5776, 10056, 3693, 9734, 3652, 14707, 3521, 3636, 4010, 6059, 3523, 6440, 16156, 5392, 1050, 15296; Payload ID: 17087 relates to Category No.: 12439, 5570, 3693, 3666, 9734, 15573, 14707, 3521, 6059, 16156, 6440, 6060, 5561; Payload ID: 17088 relates to Category No.: 1700, 7118, 2890, 10056, 2942, 9247, 4010, 11883, 10076, 7366, 15280; Payload ID: 17089 relates to Category No.: 1700, 10056, 2942, 14707, 4010, 14802, 1050, 15296, 2889, 779, 5561; Payload ID: 17090 relates to Category No.: 10056, 2942, 4010, 14802, 10076, 15296, 779, 1099; Payload ID: 17091 relates to Category No.: 2890, 9247, 4010, 5730; Payload ID: 17092 relates to Category No.: 5561, 2890, 10056, 15151, 1748, 2927, 14707, 14409, 224; Payload ID: 17093 relates to Category No.: 5561, 10056, 14707, 14409; Payload ID: 17094 relates to Category No.: 5561, 10056, 3982; Payload ID: 17095 relates to Category No.: 2890, 5762, 2938, 1748, 14363, 11883, 6075, 15184, 11653, 8917; Payload ID: 17096 relates to Category No.: 2890, 2938, 14363, 4228, 11883, 3518, 15139; Payload ID: 17097 relates to Category No.: 2890, 6717, 6960, 4010, 4228, 11883, 3518, 15628, 15139; Payload ID: 17098 relates to Category No.: 9305, 2890, 2938, 14329, 15184; Payload ID: 17099 relates to Category No.: 2890, 2938, 14363, 15184; Payload ID: 17100 relates to Category No.: 4030, 6443, 4029, 9305, 7118, 2890, 6717, 10056, 2942, 273, 9734, 1748, 1720, 1017, 4860, 4173, 7087, 10078, 5412, 15139, 2938, 4755, 14174, 5776, 15151, 15280, 1033, 14293, 2927, 9192; Payload ID: 17101 relates to Category No.: 2890, 15151, 8948, 11723; Payload ID: 17102 relates to Category No.: 2890, 9247, 4755, 5412, 15139, 7118, 8948, 15280, 1033, 4860; Payload ID: 17103 relates to Category No.: 2890, 6976, 9734, 14893, 4010, 8948, 1017; Payload ID: 17104 relates to Category No.: 4765, 15573, 5559; Payload ID: 17105 relates to Category No.: 15573, 5559; Payload ID: 17106 relates to Category No.: 9305, 9157, 2890, 2402; Payload ID: 17107 relates to Category No.: 7118; Payload ID: 17108 relates to Category No.: 5561, 5570, 1803, 1792; Payload ID: 17109 relates to Category No.: 5561; Payload ID: 17211 relates to Category No.: 5762, 10056, 5570, 15206; Payload ID: 17212 relates to Category No.: 5561; Payload ID: 17213 relates to Category No.: 5561; Payload ID: 17296 relates to Category No.: 5561; Payload ID: 17297 relates to Category No.: 5561; Payload ID: 17311 relates to Category No.: 5570; Payload ID: 17312 relates to Category No.: 5561; Payload ID: 17313 relates to Category No.: 4030, 4029, 4010; Payload ID: 17314 relates to Category No.: 4030, 2942; Payload ID: 17315 relates to Category No.: 5561, 10056, 5570, 1772, 2890, 2942, 3036, 1792, 1711; Payload ID: 17316 relates to Category No.: 5561, 10056, 5570, 6717; Payload ID: 17317 relates to Category No.: 5561, 10056, 5570, 9305, 2890, 6717, 8949, 3040; Payload ID: 17318 relates to Category No.: 4029, 2942, 8948, 1017, 4030, 10056; Payload ID: 17319 relates to Category No.: 9247, 15508, 1842; Payload ID: 17320 relates to Category No.: 9247, 15508, 7179; Payload ID: 17321 relates to Category No.: 9305, 2890, 9247, 9734, 15508, 14937, 15514, 9601; Payload ID: 17322 relates to Category No.: 9305, 9247, 4755, 15508; Payload ID: 17323 relates to Category No.: 9247, 15508, 14937, 15514, 9601, 9305; Payload ID: 17324 relates to Category No.: 9305, 9242, 9247, 15508; Payload ID: 17325 relates to Category No.: 9305, 2890, 9247; Payload ID: 17326 relates to Category No.: 9247, 15508, 15514; Payload ID: 17327 relates to Category No.: 9305, 9247, 15508; Payload ID: 17328 relates to Category No.: 15508; Payload ID: 17329 relates to Category No.: 2890, 9242, 9247, 15508; Payload ID: 17330 relates to Category No.: 9305, 5776, 9247, 273, 15508, 15514; Payload ID: 17331 relates to Category No.: 9305, 9247, 14937, 15514; Payload ID: 17332 relates to Category No.: 9305, 2890, 9247, 15508, 15514, 7179; Payload ID: 17333 relates to Category No.: 9305, 4010, 14937, 5110; Payload ID: 17334 relates to Category No.: 9247, 4755, 15508, 15514, 7179, 11627, 2890, 9305; Payload ID: 17335 relates to Category No.: 2890, 15508; Payload ID: 17336 relates to Category No.: 9305, 9247, 9734, 15508; Payload ID: 17337 relates to Category No.: 9247, 15508, 14937, 15514, 7179, 11718, 9601; Payload ID: 17338 relates to Category No.: 9247, 15508, 15514; Payload ID: 17339 relates to Category No.: 7061, 5819, 5561, 7118, 7048, 2890, 9305, 2942, 6717; Payload ID: 17340 relates to Category No.: 4029, 2890, 6976, 2938, 10056, 2942, 1811, 4010, 14327, 1792, 4228, 14329; Payload ID: 17341 relates to Category No.: 2890, 2938, 10056, 15139, 273, 1811, 14327, 4228, 4089; Payload ID: 17342 relates to Category No.: 4050, 7118; Payload ID: 17343 relates to Category No.: 9305, 10056, 1842; Payload ID: 17344 relates to Category No.: 2890, 2942, 3696; Payload ID: 17345 relates to Category No.: 9305, 2890, 2938, 10056, 2942, 9247, 1674, 9219; Payload ID: 17346 relates to Category No.: 2942, 2420, 2192, 4765, 14906, 4755, 9199, 2420, 15269, 9184, 9158, 15269, 9727; Payload ID: 17347 relates to Category No.: 9305, 2890, 2942, 4765, 9734, 9158, 15269, 9162, 9727; Payload ID: 17348 relates to Category No.: 9305, 2890, 2942, 4010; Payload ID: 17349 relates to Category No.: 5561, 9305, 2890, 2938, 9242, 2899, 3036, 2927, 12406; Payload ID: 17350 relates to Category No.: 9305, 2890, 10056; Payload ID: 17351 relates to Category No.: 5561, 4765, 3673, 3666, 15219, 6932, 5560; Payload ID: 17352 relates to Category No.: 5561, 10056, 4765, 3673; Payload ID: 17353 relates to Category No.: 14953; Payload ID: 17354 relates to Category No.: 9305; Payload ID: 17355 relates to Category No.: 14190, 9305, 2890, 2942, 9247, 9734, 14191, 6956; Payload ID: 17356 relates to Category No.: 9305, 9247, 2890, 9215, 9728, 5600; Payload ID: 17357 relates to Category No.: 9305, 2890, 9242, 9247, 9215, 1377; Payload ID: 17358 relates to Category No.: 6443, 2890, 5762, 2942, 3693, 4010, 3696, 4769; Payload ID: 17359 relates to Category No.: 5762, 4010; Payload ID: 17360 relates to Category No.: 5762, 2890, 6717, 2942, 3693, 3521, 4010; Payload ID: 17362 relates to Category No.: 5561, 10056; Payload ID: 17363 relates to Category No.: 5561, 10056, 12406, 15125; Payload ID: 17364 relates to Category No.: 5561, 10056, 15125; Payload ID: 17365 relates to Category No.: 5561, 10056; Payload ID: 17366 relates to Category No.: 5561, 10056; Payload ID: 17367 relates to Category No.: 5561, 10056; Payload ID: 17368 relates to Category No.: 5561, 10056; Payload ID: 17369 relates to Category No.: 5561, 10056, 3666, 15573, 4008; Payload ID: 17370 relates to Category No.: 5561, 10056; Payload ID: 17371 relates to Category No.: 5561, 10056; Payload ID: 17372 relates to Category No.: 5561, 10056; Payload ID: 17373 relates to Category No.: 5561, 10056; Payload ID: 17374 relates to Category No.: 5561, 10056; Payload ID: 17375 relates to Category No.: 5561, 10056; Payload ID: 17376 relates to Category No.: 5561, 10056; Payload ID: 17377 relates to Category No.: 5561, 10056, 2446; Payload ID: 17378 relates to Category No.: 5561, 10056; Payload ID: 17379 relates to Category No.: 5561, 10056; Payload ID: 17380 relates to Category No.: 5561, 10056; Payload ID: 17381 relates to Category No.: 5561, 10056, 7244, 2446; Payload ID: 17382 relates to Category No.: 5561, 10056, 2446; Payload ID: 17383 relates to Category No.: 5561, 10056; Payload ID: 17384 relates to Category No.: 5561, 10056; Payload ID: 17385 relates to Category No.: 5561, 10056; Payload ID: 17386 relates to Category No.: 5561, 10056; Payload ID: 17387 relates to Category No.: 5561, 10056; Payload ID: 17388 relates to Category No.: 5561, 10056; Payload ID: 17389 relates to Category No.: 9247, 15508, 15507, 9167, 2890, 9305, 11793, 4146, 6536; Payload ID: 17390 relates to Category No.: 9305, 5776, 9247, 6968, 14227; Payload ID: 17391 relates to Category No.: 9305, 9247, 4010, 14266, 14224; Payload ID: 17392 relates to Category No.: 9247, 14227; Payload ID: 17393 relates to Category No.: 9305, 6976, 9247, 14266; Payload ID: 17394 relates to Category No.: 9305, 2890; Payload ID: 17395 relates to Category No.: 9305, 4765, 4755, 3666; Payload ID: 17396 relates to Category No.: 5778, 9305; Payload ID: 17397 relates to Category No.: 9247, 5778; Payload ID: 17398 relates to Category No.: 9305, 5778, 7118; Payload ID: 17399 relates to Category No.: 2890; Payload ID: 17400 relates to Category No.: 4030, 9305, 2890, 2942, 2183, 2441, 2457, 5727, 5934; Payload ID: 17401 relates to Category No.: 2942, 4010; Payload ID: 17402 relates to Category No.: 9305, 2890, 10056, 2942, 273, 4010, 5762; Payload ID: 17403 relates to Category No.: 4029, 2890, 6717; Payload ID: 17404 relates to Category No.: 2890; Payload ID: 17405 relates to Category No.: 2942, 9184; Payload ID: 17406 relates to Category No.: 6440; Payload ID: 17408 relates to Category No.: 9305, 2942; Payload ID: 17410 relates to Category No.: 5762, 10056, 4010, 6989; Payload ID: 17411 relates to Category No.: 2890, 10056; Payload ID: 17412 relates to Category No.: 6717, 5762, 10056, 4201; Payload ID: 17415 relates to Category No.: 12439, 4755, 997; Payload ID: 17416 relates to Category No.: 2890, 4010, 4029, 7118; Payload ID: 17418 relates to Category No.: 2942, 997, 2926; Payload ID: 17420 relates to Category No.: 2899, 1748, 2926; Payload ID: 17421 relates to Category No.: 3673, 3666, 5559, 9184; Payload ID: 17422 relates to Category No.: 4010, 262; Payload ID: 17426 relates to Category No.: 2890, 8917, 15280; Payload ID: 17427 relates to Category No.: 997, 2926; Payload ID: 17428 relates to Category No.: 9305, 5762; Payload ID: 17432 relates to Category No.: 10056; Payload ID: 17433 relates to Category No.: 10056, 11728, 2441; Payload ID: 17434 relates to Category No.: 2194; Payload ID: 17435 relates to Category No.: 2890, 2458; Payload ID: 17436 relates to Category No.: 10056; Payload ID: 17437 relates to Category No.: 10056; Payload ID: 17438 relates to Category No.: 10056; Payload ID: 17439 relates to Category No.: 10056; Payload ID: 17440 relates to Category No.: 10056; Payload ID: 17441 relates to Category No.: 10056; Payload ID: 17442 relates to Category No.: 10056; Payload ID: 17443 relates to Category No.: 10056; Payload ID: 17444 relates to Category No.: 10056; Payload ID: 17445 relates to Category No.: 10056; Payload ID: 17446 relates to Category No.: 2890, 2927, 4010, 6756; Payload ID: 17447 relates to Category No.: 997, 14100, 3696, 920, 766; Payload ID: 17448 relates to Category No.: 2899, 2441, 2926; Payload ID: 17449 relates to Category No.: 6717; Payload ID: 17452 relates to Category No.: 5561; Payload ID: 17453 relates to Category No.: 2890, 14908; Payload ID: 17455 relates to Category No.: 9305; Payload ID: 17456 relates to Category No.: 9305; Payload ID: 17457 relates to Category No.: 9305, 15431; Payload ID: 17458 relates to Category No.: 9305; Payload ID: 17459 relates to Category No.: 9305; Payload ID: 17460 relates to Category No.: 9305, 15505; Payload ID: 17461 relates to Category No.: 9305, 2890; Payload ID: 17462 relates to Category No.: 9305, 8948; Payload ID: 17463 relates to Category No.: 9305; Payload ID: 17464 relates to Category No.: 9305; Payload ID: 17465 relates to Category No.: 9305; Payload ID: 17466 relates to Category No.: 9305, 2890, 9247; Payload ID: 17467 relates to Category No.: 9305; Payload ID: 17468 relates to Category No.: 9305; Payload ID: 17469 relates to Category No.: 2890, 9305, 15507; Payload ID: 17470 relates to Category No.: 9305; Payload ID: 17471 relates to Category No.: 2942; Payload ID: 17472 relates to Category No.: 9305, 15505, 9157, 5110, 6352, 11883; Payload ID: 17473 relates to Category No.: 9305; Payload ID: 17474 relates to Category No.: 5561; Payload ID: 17475 relates to Category No.: 9305; Payload ID: 17476 relates to Category No.: 9305, 1842, 2890; Payload ID: 17477 relates to Category No.: 9305; Payload ID: 17478 relates to Category No.: 5561; Payload ID: 17479 relates to Category No.: 3666, 9305, 11793, 1720; Payload ID: 17481 relates to Category No.: 2942, 4043, 1811, 1810, 10056, 9305, 2890, 15139, 6960, 3055, 8948, 1036, 14329, 14783, 6484; Payload ID: 17482 relates to Category No.: 2942, 6017, 4199, 4860, 4010, 2890, 6717, 5762; Payload ID: 17483 relates to Category No.: 10056, 5570, 9776, 3696, 6440, 779, 16061, 16059, 12207, 7118; Payload ID: 17484 relates to Category No.: 9305, 2890, 9242, 9247, 9184, 5466; Payload ID: 17485 relates to Category No.: 6960, 2194, 2942, 4010, 2278, 4755, 262, 7366, 6976, 1711, 9727, 16336, 9172, 5029, 2890; Payload ID: 17486 relates to Category No.: 2942; Payload ID: 17487 relates to Category No.: 9305; Payload ID: 17490 relates to Category No.: 5561; Payload ID: 17491 relates to Category No.: 6960; Payload ID: 17494 relates to Category No.: 3509, 2890, 6717, 6960; Payload ID: 17497 relates to Category No.: 14826, 2890, 9305, 1046, 262, 6976; Payload ID: 17499 relates to Category No.: 9305, 2890, 9247, 4755; Payload ID: 17500 relates to Category No.: 9305, 9247, 15505; Payload ID: 17501 relates to Category No.: 9305, 9247, 15505; Payload ID: 17502 relates to Category No.: 9305, 9247; Payload ID: 17503 relates to Category No.: 9305; Payload ID: 17504 relates to Category No.: 9305; Payload ID: 17505 relates to Category No.: 9305, 9247, 4860; Payload ID: 17506 relates to Category No.: 2938, 2942, 4043, 1811; Payload ID: 17507 relates to Category No.: 2938, 2942, 15243, 6717, 4030, 2457; Payload ID: 17508 relates to Category No.: 5561, 2890, 2938, 15243, 2446; Payload ID: 17509 relates to Category No.: 5561, 4010, 2446; Payload ID: 17510 relates to Category No.: 5561, 1001, 2926, 6440; Payload ID: 17512 relates to Category No.: 10056, 12159, 677, 4010; Payload ID: 17513 relates to Category No.: 10056, 12159, 677; Payload ID: 17514 relates to Category No.: 4029, 10056, 5570, 1099, 1811, 276, 1792, 6989, 6743, 4228, 779, 1085, 14999, 9734; Payload ID: 17515 relates to Category No.: 9305, 2890, 6960, 2458, 6968; Payload ID: 17516 relates to Category No.: 9305, 2890, 6960, 7244; Payload ID: 17517 relates to Category No.: 9305, 6960, 4010, 261, 14826, 2890; Payload ID: 17518 relates to Category No.: 9305, 2890, 6960, 7244; Payload ID: 17519 relates to Category No.: 9305, 2890, 6960, 2458; Payload ID: 17520 relates to Category No.: 2890, 15466, 15465; Payload ID: 17521 relates to Category No.: 2890, 2194, 9247; Payload ID: 17522 relates to Category No.: 9242, 9247, 2420, 15269, 9218, 10104, 7068, 15251, 15252, 14283, 15298, 7118, 9305, 2890; Payload ID: 17523 relates to Category No.: 2890, 14145, 2420, 15269, 9181, 15252; Payload ID: 17524 relates to Category No.: 9305, 2890, 6717, 5762, 2420, 15269, 15466, 15465; Payload ID: 17525 relates to Category No.: 9305, 2890, 9242, 9247, 2420, 15269, 14893, 9218, 9158, 15269, 15272; Payload ID: 17526 relates to Category No.: 9305, 2890, 9247, 4755, 2420, 15269, 7256, 9218, 9158, 15269, 15272, 6525; Payload ID: 17527 relates to Category No.: 9305, 2890, 9247, 9158, 2420, 15269, 7256, 9218, 9158, 15269, 15272, 9162; Payload ID: 17528 relates to Category No.: 9305, 9158, 15269, 14993; Payload ID: 17530 relates to Category No.: 4030, 4029, 6717, 4014, 4228, 1090, 5749, 12159; Payload ID: 17531 relates to Category No.: 12159, 1842, 1792; Payload ID: 17532 relates to Category No.: 4029, 9305, 2890, 12159, 9247, 1792, 6743, 9731; Payload ID: 17533 relates to Category No.: 4030, 5762, 12159, 4014, 4010, 4176, 4029; Payload ID: 17534 relates to Category No.: 5561, 4029, 9305, 2890, 2938, 10056, 5570, 3666, 4755, 9734, 9215, 9181; Payload ID: 17535 relates to Category No.: 5561, 9305, 5762, 10056, 8935, 5570, 3666, 15139, 4755, 1748, 3036, 11653, 1811, 4199, 4860, 3055, 10104; Payload ID: 17536 relates to Category No.: 5561, 6717, 1017; Payload ID: 17537 relates to Category No.: 5561, 9305, 2890, 8935, 5570; Payload ID: 17538 relates to Category No.: 5561, 2890, 9162; Payload ID: 17539 relates to Category No.: 2890, 2938, 1792, 4228, 1824, 5762; Payload ID: 17540 relates to Category No.: 5762, 10056, 4228; Payload ID: 17541 relates to Category No.: 2890, 4228, 5762; Payload ID: 17542 relates to Category No.: 2890, 2938, 4228; Payload ID: 17543 relates to Category No.: 4030, 10056, 677, 1792, 6743, 779, 4053, 2890, 9305, 4755, 9734; Payload ID: 17544 relates to Category No.: 9305, 9247, 2420, 15269, 9218, 9158, 15269, 9181, 15272, 9736; Payload ID: 17545 relates to Category No.: 9242, 9247, 5597, 7274, 9215; Payload ID: 17546 relates to Category No.: 9305, 2890, 10056, 9247, 6017, 14327, 14329; Payload ID: 17547 relates to Category No.: 9305, 2890, 10056, 1748, 4228, 11883; Payload ID: 17548 relates to Category No.: 2942; Payload ID: 17549 relates to Category No.: 9305, 2890; Payload ID: 17550 relates to Category No.: 5561, 2890, 9242, 9184, 7179; Payload ID: 17551 relates to Category No.: 10056, 677, 261, 6743; Payload ID: 17552 relates to Category No.: 15173, 2632, 2168; Payload ID: 17553 relates to Category No.: 2168; Payload ID: 17556 relates to Category No.: 2890, 1700, 6994, 2630, 4010, 5964, 5597; Payload ID: 17558 relates to Category No.: 2890; Payload ID: 17559 relates to Category No.: 5561; Payload ID: 17560 relates to Category No.: 262, 2890; Payload ID: 17562 relates to Category No.: 5559, 5557, 3831; Payload ID: 17563 relates to Category No.: 4010; Payload ID: 17564 relates to Category No.: 5561; Payload ID: 17565 relates to Category No.: 5561; Payload ID: 17566 relates to Category No.: 9305; Payload ID: 17568 relates to Category No.: 9305, 6968; Payload ID: 17570 relates to Category No.: 9305; Payload ID: 17571 relates to Category No.: 5561; Payload ID: 17575 relates to Category No.: 9305, 2890, 1842; Payload ID: 17576 relates to Category No.: 9305; Payload ID: 17577 relates to Category No.: 9305, 2890; Payload ID: 17578 relates to Category No.: 9305, 2890; Payload ID: 17579 relates to Category No.: 9305, 2890; Payload ID: 17580 relates to Category No.: 9305, 2890; Payload ID: 17581 relates to Category No.: 9305; Payload ID: 17582 relates to Category No.: 2890, 1842, 9184, 8935, 7244; Payload ID: 17585 relates to Category No.: 4029; Payload ID: 17586 relates to Category No.: 2942; Payload ID: 17587 relates to Category No.: 9305, 9247, 2890; Payload ID: 17588 relates to Category No.: 2890, 7244, 262; Payload ID: 17589 relates to Category No.: 9305, 2890, 2183, 262; Payload ID: 17590 relates to Category No.: 2890; Payload ID: 17591 relates to Category No.: 2890; Payload ID: 17592 relates to Category No.: 9305, 2890; Payload ID: 17593 relates to Category No.: 2183, 262; Payload ID: 17594 relates to Category No.: 9305; Payload ID: 17596 relates to Category No.: 2890, 6536, 9305, 4146; Payload ID: 17597 relates to Category No.: 9305; Payload ID: 17598 relates to Category No.: 9305; Payload ID: 17599 relates to Category No.: 5561, 2890, 6717, 10056, 5570, 9734, 4010, 6440, 16156; Payload ID: 17600 relates to Category No.: 5561; Payload ID: 17601 relates to Category No.: 5561, 5570; Payload ID: 17602 relates to Category No.: 5561, 6717, 5570; Payload ID: 17603 relates to Category No.: 5561, 6717, 5570, 10056; Payload ID: 17604 relates to Category No.: 5561, 10056, 5570, 1792, 15318; Payload ID: 17605 relates to Category No.: 5561, 10056, 5570, 4010, 1792, 15318; Payload ID: 17606 relates to Category No.: 5561, 5570; Payload ID: 17607 relates to Category No.: 5561, 15892, 5570; Payload ID: 17608 relates to Category No.: 5561, 5570; Payload ID: 17609 relates to Category No.: 5561, 5570; Payload ID: 17610 relates to Category No.: 5561, 5570, 10056, 7366; Payload ID: 17611 relates to Category No.: 5561, 5570, 4010; Payload ID: 17612 relates to Category No.: 5561, 6717, 5570; Payload ID: 17613 relates to Category No.: 5561, 5570, 1792, 5762, 5583; Payload ID: 17614 relates to Category No.: 5561, 10056, 5570, 1792, 15318; Payload ID: 17615 relates to Category No.: 5561, 10056, 5570, 4228, 16156; Payload ID: 17616 relates to Category No.: 5561, 10056, 5570; Payload ID: 17617 relates to Category No.: 5561, 5570, 4010; Payload ID: 17618 relates to Category No.: 5561, 5570; Payload ID: 17619 relates to Category No.: 5561, 5570, 4010; Payload ID: 17620 relates to Category No.: 5561, 10056, 5570, 4228, 15318, 6717; Payload ID: 17622 relates to Category No.: 2890, 9754; Payload ID: 17627 relates to Category No.: 2890, 10056, 273; Payload ID: 17628 relates to Category No.: 7118, 2194, 7048, 6994; Payload ID: 17629 relates to Category No.: 2458, 5796; Payload ID: 17630 relates to Category No.: 2458, 2890, 2938, 11728, 5796, 2455, 9157; Payload ID: 17633 relates to Category No.: 2890, 6976, 6994, 14893; Payload ID: 17635 relates to Category No.: 2890; Payload ID: 17636 relates to Category No.: 11728, 5797, 2455, 2194, 2458, 2441; Payload ID: 17637 relates to Category No.: 1842; Payload ID: 17638 relates to Category No.: 2890, 2194, 14906, 6994; Payload ID: 17640 relates to Category No.: 7118, 9247, 9305, 16065; Payload ID: 17641 relates to Category No.: 2458, 5797; Payload ID: 17642 relates to Category No.: 11728, 2458, 5797, 2455; Payload ID: 17648 relates to Category No.: 9305, 2890, 9247, 15532, 14642; Payload ID: 17649 relates to Category No.: 4010; Payload ID: 17650 relates to Category No.: 1842; Payload ID: 17654 relates to Category No.: 2890, 9247, 9305; Payload ID: 17656 relates to Category No.: 1700; Payload ID: 17658 relates to Category No.: 2194, 2942, 2458, 1107, 2441, 2446, 9998, 6717; Payload ID: 17659 relates to Category No.: 2890, 3673; Payload ID: 17660 relates to Category No.: 2890, 3673, 1842; Payload ID: 17661 relates to Category No.: 2890, 3673; Payload ID: 17662 relates to Category No.: 1748, 11650, 11653, 8948, 3036, 1033; Payload ID: 17666 relates to Category No.: 9305; Payload ID: 17667 relates to Category No.: 2890, 2942, 9247, 3696; Payload ID: 17668 relates to Category No.: 10056, 2942, 3696; Payload ID: 17669 relates to Category No.: 2890, 10056, 2942, 9247, 4010, 3696; Payload ID: 17670 relates to Category No.: 9305, 9247; Payload ID: 17671 relates to Category No.: 9305, 2194, 9247; Payload ID: 17672 relates to Category No.: 9305; Payload ID: 17673 relates to Category No.: 9305; Payload ID: 17674 relates to Category No.: 5561, 7118; Payload ID: 17676 relates to Category No.: 2890, 9247, 5597; Payload ID: 17678 relates to Category No.: 9305, 9247; Payload ID: 17679 relates to Category No.: 6968; Payload ID: 17680 relates to Category No.: 2420, 9215; Payload ID: 17683 relates to Category No.: 9305, 10104; Payload ID: 17684 relates to Category No.: 9242; Payload ID: 17686 relates to Category No.: 9305; Payload ID: 17688 relates to Category No.: 2942; Payload ID: 17689 relates to Category No.: 2942; Payload ID: 17690 relates to Category No.: 2890; Payload ID: 17691 relates to Category No.: 7118, 7048, 10056, 2942, 7060, 7052, 14329; Payload ID: 17692 relates to Category No.: 7060, 7118; Payload ID: 17693 relates to Category No.: 4029; Payload ID: 17694 relates to Category No.: 2942, 4010; Payload ID: 17695 relates to Category No.: 9305, 7118, 2890, 2942, 9247, 4010; Payload ID: 17696 relates to Category No.: 7118, 2890, 9242, 7060, 3036, 8948; Payload ID: 17697 relates to Category No.: 5561, 3673, 1700; Payload ID: 17698 relates to Category No.: 3671, 3666; Payload ID: 17699 relates to Category No.: 5561, 1700; Payload ID: 17700 relates to Category No.: 4010, 3671, 1700; Payload ID: 17701 relates to Category No.: 2942, 4010; Payload ID: 17702 relates to Category No.: 7118, 9305, 2890, 9242, 9247, 14826, 9472; Payload ID: 17703 relates to Category No.: 3666, 4010, 3671, 6437; Payload ID: 17704 relates to Category No.: 7118, 2890, 4755, 4010, 262, 14826; Payload ID: 17705 relates to Category No.: 9305, 2890, 6994, 1842, 2194; Payload ID: 17706 relates to Category No.: 2890, 2942, 9305, 7052; Payload ID: 17707 relates to Category No.: 9242, 2942, 9247, 4010, 2890, 9305, 7118, 1700; Payload ID: 17708 relates to Category No.: 1700, 7118, 7060; Payload ID: 17709 relates to Category No.: 1700; Payload ID: 17711 relates to Category No.: 9305, 2890, 11836, 4010, 1700; Payload ID: 17712 relates to Category No.: 9247, 14912, 15870, 15864, 9305, 2890; Payload ID: 17713 relates to Category No.: 14912, 15870, 15864; Payload ID: 17714 relates to Category No.: 5561, 9242, 3673, 3666, 1700; Payload ID: 17715 relates to Category No.: 5561, 1700, 1842; Payload ID: 17716 relates to Category No.: 5561, 3673, 1792, 1700; Payload ID: 17717 relates to Category No.: 5561, 1700; Payload ID: 17718 relates to Category No.: 4030, 7118, 7060, 4010, 7048; Payload ID: 17719 relates to Category No.: 2890, 9734, 7118; Payload ID: 17720 relates to Category No.: 1842; Payload ID: 17721 relates to Category No.: 2890, 9247, 5597, 15367, 9305, 9215, 9181, 15501, 15366; Payload ID: 17722 relates to Category No.: 15367, 9247, 9215, 15501, 15366; Payload ID: 17723 relates to Category No.: 15367, 5776, 9247, 4755, 9215, 15501, 5561; Payload ID: 17724 relates to Category No.: 15367, 9305, 2890, 9247, 9215, 15501, 15366; Payload ID: 17725 relates to Category No.: 15367, 9305, 9247, 9215, 15501, 15366; Payload ID: 17726 relates to Category No.: 15367, 9305, 2890, 9247, 9215, 15501, 15366; Payload ID: 17727 relates to Category No.: 5561, 9305, 9242, 2942, 3673, 9162; Payload ID: 17728 relates to Category No.: 9305; Payload ID: 17729 relates to Category No.: 9305, 7118, 2890, 9247, 1842; Payload ID: 17730 relates to Category No.: 2890, 4030, 1842; Payload ID: 17731 relates to Category No.: 2890, 2942, 273, 4010; Payload ID: 17732 relates to Category No.: 2890, 7060, 1842, 7118; Payload ID: 17733 relates to Category No.: 2890, 1842; Payload ID: 17734 relates to Category No.: 5561, 10056, 5570, 1792, 4030; Payload ID: 17735 relates to Category No.: 4030, 4029; Payload ID: 17736 relates to Category No.: 4030, 4029, 4014, 4179, 3666, 14409, 4008, 4010, 14368, 1792, 3671, 10076, 10077; Payload ID: 17737 relates to Category No.: 4029, 10076, 1090, 12159, 4014; Payload ID: 17738 relates to Category No.: 4029, 9734; Payload ID: 17739 relates to Category No.: 4030, 4029, 4014, 3666, 4010, 14368, 1090, 12159, 8917; Payload ID: 17740 relates to Category No.: 5561, 4029, 2890; Payload ID: 17741 relates to Category No.: 4014, 4010, 12159, 6948; Payload ID: 17742 relates to Category No.: 5561, 10056, 4010; Payload ID: 17743 relates to Category No.: 5561; Payload ID: 17744 relates to Category No.: 4029, 14953, 1792; Payload ID: 17745 relates to Category No.: 5561, 3673; Payload ID: 17746 relates to Category No.: 5561, 10056, 5570, 2942, 262; Payload ID: 17749 relates to Category No.: 2890, 9242; Payload ID: 17750 relates to Category No.: 10056, 5570, 3666, 4008, 4860, 4010, 6743, 4228, 779, 3036, 7366, 676, 2942, 678; Payload ID: 17751 relates to Category No.: 4030; Payload ID: 17752 relates to Category No.: 2942; Payload ID: 17753 relates to Category No.: 7060, 7048, 7118; Payload ID: 17754 relates to Category No.: 2942; Payload ID: 17755 relates to Category No.: 9305, 7118, 2890, 7048, 2942, 9247, 7060, 9242; Payload ID: 17756 relates to Category No.: 9305, 10056, 9247, 10104; Payload ID: 17757 relates to Category No.: 2890, 3673, 2660; Payload ID: 17758 relates to Category No.: 9305, 2890, 9242; Payload ID: 17759 relates to Category No.: 9305, 2890, 2660, 1811; Payload ID: 17760 relates to Category No.: 2890, 9305; Payload ID: 17761 relates to Category No.: 9305; Payload ID: 17762 relates to Category No.: 5561, 9305, 2890, 6717, 9176, 9184, 9162, 2402, 3673; Payload ID: 17763 relates to Category No.: 2890, 2938; Payload ID: 17764 relates to Category No.: 2890, 2938; Payload ID: 17765 relates to Category No.: 2890, 2938; Payload ID: 17766 relates to Category No.: 4029, 2938, 10077; Payload ID: 17767 relates to Category No.: 2890, 2938, 9305, 2942; Payload ID: 17768 relates to Category No.: 2942, 9305; Payload ID: 17769 relates to Category No.: 4029, 4030, 4755, 11883, 3666, 9734; Payload ID: 17770 relates to Category No.: 5561; Payload ID: 17771 relates to Category No.: 9305, 9247, 6653, 3991, 4010, 9215; Payload ID: 17772 relates to Category No.: 5776, 9247, 6443, 2890, 2938, 2942, 4755, 9734, 1720, 4010, 9773, 1774; Payload ID: 17773 relates to Category No.: 9305, 2938, 4765, 4755, 2477, 261, 5450, 9471, 5762; Payload ID: 17774 relates to Category No.: 9305, 2890, 9247; Payload ID: 17775 relates to Category No.: 9305, 6525; Payload ID: 17776 relates to Category No.: 9305, 2890, 6976, 2942, 9247; Payload ID: 17777 relates to Category No.: 9305, 2890, 2938, 10056, 4228, 5622; Payload ID: 17778 relates to Category No.: 9305, 2942, 9247, 2890, 7118; Payload ID: 17779 relates to Category No.: 9305, 9247, 4010, 9157; Payload ID: 17780 relates to Category No.: 2942, 9247; Payload ID: 17781 relates to Category No.: 5561, 4030, 10056, 5570, 1792, 7118; Payload ID: 17782 relates to Category No.: 5561, 10056, 5570, 12406; Payload ID: 17783 relates to Category No.: 4029, 2890; Payload ID: 17784 relates to Category No.: 9305; Payload ID: 17785 relates to Category No.: 4029, 9305, 2890, 10056, 14409; Payload ID: 17786 relates to Category No.: 2890, 5570, 4010, 6717; Payload ID: 17787 relates to Category No.: 5561, 10056, 5570; Payload ID: 17788 relates to Category No.: 2890, 9247, 2920, 9217, 9305, 14145; Payload ID: 17789 relates to Category No.: 6443, 9305, 2890, 4010, 2920, 14145; Payload ID: 17790 relates to Category No.: 9305; Payload ID: 17791 relates to Category No.: 9305; Payload ID: 17792 relates to Category No.: 9305; Payload ID: 17793 relates to Category No.: 9305; Payload ID: 17794 relates to Category No.: 9305, 1842; Payload ID: 17795 relates to Category No.: 9305; Payload ID: 17796 relates to Category No.: 9305; Payload ID: 17797 relates to Category No.: 1182, 9247, 4755, 2890, 10056, 3693, 15573; Payload ID: 17798 relates to Category No.: 2890, 10056, 2942, 1182, 1748, 1099, 777, 4402, 778; Payload ID: 17799 relates to Category No.: 1182, 2890, 10056, 2942, 9247, 1748, 447; Payload ID: 17800 relates to Category No.: 9305, 1182, 9247, 1748, 779; Payload ID: 17801 relates to Category No.: 9305, 9242, 9247, 6968, 9157; Payload ID: 17802 relates to Category No.: 9305, 2890, 5776, 9247, 4755, 9157; Payload ID: 17803 relates to Category No.: 4030, 4029, 12159, 4010, 10077, 1090, 4014; Payload ID: 17804 relates to Category No.: 4030, 12159, 4029, 4010, 1792, 1090, 8935, 8948, 4860; Payload ID: 17805 relates to Category No.: 4030, 9305, 12159, 4014, 4010, 1090, 2890; Payload ID: 17806 relates to Category No.: 4030, 12159, 14364; Payload ID: 17807 relates to Category No.: 4030, 4029, 10056, 677, 3666, 1792, 9418; Payload ID: 17808 relates to Category No.: 9305, 12159; Payload ID: 17809 relates to Category No.: 2890, 4010;

Payload ID: 17810 relates to Category No.: 4029, 2942, 4010, 6449, 5342, 16326, 15014, 2632, 7344, 14364, 196; Payload ID: 17811 relates to Category No.: 2942, 5342, 16326; Payload ID: 17812 relates to Category No.: 5561, 10056; Payload ID: 17813 relates to Category No.: 5561; Payload ID: 17814 relates to Category No.: 6246; Payload ID: 17815 relates to Category No.: 9247, 5570, 9305, 5561; Payload ID: 17816 relates to Category No.: 5561; Payload ID: 17817 relates to Category No.: 5561; Payload ID: 17818 relates to Category No.: 5561; Payload ID: 17819 relates to Category No.: 5561; Payload ID: 17820 relates to Category No.: 5561; Payload ID: 17821 relates to Category No.: 5561; Payload ID: 17823 relates to Category No.: 5561, 10056, 7061; Payload ID: 17824 relates to Category No.: 5561; Payload ID: 17825 relates to Category No.: 5561, 3523, 6440; Payload ID: 17826 relates to Category No.: 9305, 9167; Payload ID: 17827 relates to Category No.: 5561; Payload ID: 17828 relates to Category No.: 2890, 2942; Payload ID: 17829 relates to Category No.: 2890, 2942, 15892, 2918, 1682, 5857, 15483, 6743, 16164, 500, 11883, 1720, 5762; Payload ID: 17830 relates to Category No.: 7118, 2942, 3693, 2918, 1682; Payload ID: 17831 relates to Category No.: 2194, 11728, 2458, 5797, 2455, 1046, 2441; Payload ID: 17832 relates to Category No.: 9305, 2890, 2938, 10056, 1182, 9734; Payload ID: 17833 relates to Category No.: 2890, 2194, 2942, 2918, 1682; Payload ID: 17834 relates to Category No.: 9305, 7118, 2890, 10056, 9242, 2942, 9734, 1720, 6222, 3696, 11883, 2918, 1682; Payload ID: 17835 relates to Category No.: 5776, 10056, 15892, 2899, 9305, 2942, 9734; Payload ID: 17836 relates to Category No.: 7118, 6717, 7048, 9247, 6222, 7060, 4010, 7052; Payload ID: 17837 relates to Category No.: 9305, 2890, 5762; Payload ID: 17838 relates to Category No.: 9305, 2890, 2942, 9247; Payload ID: 17840 relates to Category No.: 9305, 2890, 2938, 10056, 2942, 12406, 3008, 11883, 6743; Payload ID: 17841 relates to Category No.: 4030, 6717; Payload ID: 17842 relates to Category No.: 9305, 2890; Payload ID: 17843 relates to Category No.: 2942, 6059; Payload ID: 17844 relates to Category No.: 6717, 5762; Payload ID: 17845 relates to Category No.: 2890, 2942, 4010, 5622, 5656, 9734, 9155; Payload ID: 17846 relates to Category No.: 2890, 10056, 2942, 9247, 3636, 5597, 14329; Payload ID: 17847 relates to Category No.: 5561, 6717, 10056, 5570, 9776, 15444; Payload ID: 17848 relates to Category No.: 5561, 6717, 10056; Payload ID: 17849 relates to Category No.: 5561, 2890, 10056, 5570, 1792, 5823, 15444, 4008, 15447; Payload ID: 17850 relates to Category No.: 2890, 6717, 5762, 4765, 3673, 5570, 3696, 6440, 3651, 1792, 5561; Payload ID: 17851 relates to Category No.: 5561, 2890, 10056, 5570, 9734, 4008, 3696, 1792, 5823, 6246; Payload ID: 17852 relates to Category No.: 5561, 10056, 6717; Payload ID: 17853 relates to Category No.: 5561, 10056, 5570, 9776, 15447; Payload ID: 17854 relates to Category No.: 5561, 6443, 2890, 10056, 4765, 3673, 3693, 3666, 3696, 12406, 3651, 3527; Payload ID: 17855 relates to Category No.: 5561, 4765, 3673, 3696, 3651; Payload ID: 17856 relates to Category No.: 5561, 6443, 4029, 2890, 10056, 4765, 3673, 3693, 3666, 1099, 3696, 779, 3651, 3527; Payload ID: 17857 relates to Category No.: 2942, 997, 3696, 2926, 14187; Payload ID: 17858 relates to Category No.: 10056, 3666, 4755, 3521, 3696, 6060, 6059, 3523, 3693; Payload ID: 17859 relates to Category No.: 4029, 5561; Payload ID: 17860 relates to Category No.: 4029; Payload ID: 17861 relates to Category No.: 2890, 9247, 6644, 3358, 9209, 4072; Payload ID: 17862 relates to Category No.: 9305, 9247; Payload ID: 17863 relates to Category No.: 9305, 9242, 9247, 9158, 2420, 2903, 13731, 2890, 9730; Payload ID: 17864 relates to Category No.: 9305, 7118, 2420, 7068; Payload ID: 17865 relates to Category No.: 9305, 9242, 9247, 9158, 2183, 11883, 3374, 16192, 2628; Payload ID: 17866 relates to Category No.: 3374, 9305, 2890, 2942, 9247, 5029; Payload ID: 17867 relates to Category No.: 9305, 2890, 2194, 14906, 9247, 273, 4755, 2420, 10104, 2632, 6525; Payload ID: 17868 relates to Category No.: 9305, 9247, 2420, 10104; Payload ID: 17869 relates to Category No.: 9305, 9247, 2628; Payload ID: 17870 relates to Category No.: 9305, 15892, 14906, 6994, 2183, 2896, 2441, 10104, 9998, 4390, 9215; Payload ID: 17871 relates to Category No.: 2890, 5776; Payload ID: 17872 relates to Category No.: 5561, 9305, 9176, 9162; Payload ID: 17873 relates to Category No.: 5561, 9305, 2890, 5776, 3673, 3666, 9184; Payload ID: 17874 relates to Category No.: 6717, 2938, 5776, 15151, 3666, 15627, 1748, 2927, 14409, 4860, 4010, 9184, 3671, 9162, 4044, 2890, 9305, 8935; Payload ID: 17875 relates to Category No.: 3666, 4010, 9184, 3671, 9162, 2890; Payload ID: 17876 relates to Category No.: 4029, 3666, 3671; Payload ID: 17877 relates to Category No.: 3666, 4010, 3671; Payload ID: 17878 relates to Category No.: 5561; Payload ID: 17879 relates to Category No.: 9305; Payload ID: 17880 relates to Category No.: 9305, 5727, 9734; Payload ID: 17881 relates to Category No.: 9247, 9305; Payload ID: 17882 relates to Category No.: 9305; Payload ID: 17883 relates to Category No.: 9247, 2402, 12231; Payload ID: 17884 relates to Category No.: 9305, 2890, 5762, 2942, 7070, 7118; Payload ID: 17885 relates to Category No.: 7118, 9734, 11883, 7052; Payload ID: 17886 relates to Category No.: 9305, 6717, 2942, 3548; Payload ID: 17887 relates to Category No.: 9305, 2890; Payload ID: 17890 relates to Category No.: 9305, 2890; Payload ID: 17891 relates to Category No.: 9305, 2890; Payload ID: 17892 relates to Category No.: 9305, 2890; Payload ID: 17893 relates to Category No.: 9305, 2890; Payload ID: 17894 relates to Category No.: 9305, 2890, 2942; Payload ID: 17895 relates to Category No.: 9305, 2890, 6960, 14906, 9247, 6968, 14893, 1028; Payload ID: 17897 relates to Category No.: 5570, 5568; Payload ID: 17898 relates to Category No.: 5570, 4010, 5568; Payload ID: 17899 relates to Category No.: 5561, 10056, 5570; Payload ID: 17900 relates to Category No.: 5561, 5570; Payload ID: 17901 relates to Category No.: 5561, 5570; Payload ID: 17902 relates to Category No.: 5561, 5570; Payload ID: 17903 relates to Category No.: 5561, 5570; Payload ID: 17904 relates to Category No.: 5561, 10056; Payload ID: 17905 relates to Category No.: 2890, 2942; Payload ID: 17906 relates to Category No.: 9242, 9734; Payload ID: 17907 relates to Category No.: 9305, 12439, 2890, 2938, 9247, 4010, 779, 5762; Payload ID: 17908 relates to Category No.: 5762, 1842, 1700; Payload ID: 17909 relates to Category No.: 5561; Payload ID: 17910 relates to Category No.: 2890, 2477, 15635, 2942, 4765, 3666; Payload ID: 17911 relates to Category No.: 5561, 2942, 4765, 15636; Payload ID: 17912 relates to Category No.: 4755; Payload ID: 17913 relates to Category No.: 3685; Payload ID: 17915 relates to Category No.: 9305, 5762, 2942, 4765, 3666, 9734, 2890; Payload ID: 17916 relates to Category No.: 2890, 5762, 2942, 4765, 3666, 9734; Payload ID: 17917 relates to Category No.: 2942, 4765, 3666, 15635; Payload ID: 17918 relates to Category No.: 3666, 4755; Payload ID: 17919 relates to Category No.: 2942, 15151, 2477, 4765, 3666, 15139, 3036, 15635, 4769, 2890; Payload ID: 17920 relates to Category No.: 2942, 4765, 3666, 15635; Payload ID: 17921 relates to Category No.: 2942, 4765, 3666; Payload ID: 17922 relates to Category No.: 2942, 4765, 3666; Payload ID: 17923 relates to Category No.: 11687, 2926, 15637; Payload ID: 17924 relates to Category No.: 2942, 4765, 3666, 15573; Payload ID: 17925 relates to Category No.: 9305, 5762, 3666, 4755, 9734; Payload ID: 17926 relates to Category No.: 9305, 7118, 2890, 3521; Payload ID: 17927 relates to Category No.: 7118, 2890, 10056, 3521, 9305; Payload ID: 17928 relates to Category No.: 5762; Payload ID: 17931 relates to Category No.: 5561, 9305, 2890, 3673, 3666, 5557; Payload ID: 17932 relates to Category No.: 5561, 2890; Payload ID: 17933 relates to Category No.: 9305, 2890, 2942, 4010, 5776; Payload ID: 17934 relates to Category No.: 4030, 4029; Payload ID: 17935 relates to Category No.: 4029, 3693, 4010, 6437, 4030; Payload ID: 17936 relates to Category No.: 9305; Payload ID: 17937 relates to Category No.: 9305; Payload ID: 17938 relates to Category No.: 9305, 9242, 9247; Payload ID: 17939 relates to Category No.: 9305, 2194, 9247, 15497; Payload ID: 17940 relates to Category No.: 9305; Payload ID: 17941 relates to Category No.: 9305, 9247; Payload ID: 17942 relates to Category No.: 9305; Payload ID: 17943 relates to Category No.: 9305; Payload ID: 17944 relates to Category No.: 9305; Payload ID: 17945 relates to Category No.: 9305; Payload ID: 17946 relates to Category No.: 9305; Payload ID: 17947 relates to Category No.: 9305; Payload ID: 17948 relates to Category No.: 9305; Payload ID: 17949 relates to Category No.: 3562, 2942, 9247; Payload ID: 17950 relates to Category No.: 3562, 2942, 9247, 16110, 4010, 2785, 2790; Payload ID: 17951 relates to Category No.: 4030, 5561, 9305, 3562, 2890, 9247; Payload ID: 17952 relates to Category No.: 5561, 9305, 3562; Payload ID: 17953 relates to Category No.: 5561, 9305, 3562; Payload ID: 17954 relates to Category No.: 5561, 9305; Payload ID: 17955 relates to Category No.: 5561, 9305; Payload ID: 17956 relates to Category No.: 7118, 14145, 7060, 7068; Payload ID: 17957 relates to Category No.: 9305, 9242, 273; Payload ID: 17959 relates to Category No.: 9305, 2890, 9157, 14253, 15505; Payload ID: 17960 relates to Category No.: 9305; Payload ID: 17961 relates to Category No.: 9305; Payload ID: 17962 relates to Category No.: 9305, 9247; Payload ID: 17963 relates to Category No.: 9305; Payload ID: 17964 relates to Category No.: 9305; Payload ID: 17965 relates to Category No.: 9305; Payload ID: 17966 relates to Category No.: 9305; Payload ID: 17967 relates to Category No.: 9305, 2890, 15505, 9247, 9157, 11883, 14253, 9190; Payload ID: 17968 relates to Category No.: 9305, 15505; Payload ID: 17969 relates to Category No.: 9305, 15505, 9247, 9167; Payload ID: 17970 relates to Category No.: 9305, 15505, 9247; Payload ID: 17971 relates to Category No.: 9305, 2890, 15505, 9247, 9157, 10104, 12170, 1156; Payload ID: 17972 relates to Category No.: 9305, 7118, 2942, 7060, 7068; Payload ID: 17973 relates to Category No.: 9305, 2890, 2194, 5776, 9247, 4755, 2942; Payload ID: 17974 relates to Category No.: 9305; Payload ID: 17975 relates to Category No.: 9305, 15505; Payload ID: 17976 relates to Category No.: 9305; Payload ID: 17977 relates to Category No.: 9305; Payload ID: 17978 relates to Category No.: 9305, 15531; Payload ID: 17979 relates to Category No.: 7060, 7068, 7118; Payload ID: 17980 relates to Category No.: 7118, 7060, 7068; Payload ID: 17981 relates to Category No.: 9305, 2890, 9247; Payload ID: 17982 relates to Category No.: 9305, 1842; Payload ID: 17983 relates to Category No.: 9305, 2890, 6717; Payload ID: 17984 relates to Category No.: 9305, 2890, 15505; Payload ID: 17985 relates to Category No.: 9305, 15505, 9247; Payload ID: 17986 relates to Category No.: 9305, 15505, 9247; Payload ID: 17987 relates to Category No.: 9247, 9305, 2890, 15505; Payload ID: 17988 relates to Category No.: 9305, 2890, 9247; Payload ID: 17989 relates to Category No.: 9305, 6525; Payload ID: 17990 relates to Category No.: 9305, 2890, 10056, 9242, 9247; Payload ID: 17991 relates to Category No.: 2890, 14912, 15497; Payload ID: 17992 relates to Category No.: 2890, 9247, 4228, 14937, 14355; Payload ID: 17993 relates to Category No.: 9305, 2420, 9602, 401; Payload ID: 17994 relates to Category No.: 14355, 14937; Payload ID: 17995 relates to Category No.: 9305, 5762, 9247, 14937, 15514, 401, 7161; Payload ID: 17996 relates to Category No.: 9305, 2890, 9247; Payload ID: 17997 relates to Category No.: 9305, 2890, 1674; Payload ID: 17998 relates to Category No.: 9305, 2890; Payload ID: 17999 relates to Category No.: 9305, 9247, 14902, 15531, 5110; Payload ID: 18000 relates to Category No.: 5110; Payload ID: 18001 relates to Category No.: 9305, 9247, 14902, 15531, 5110; Payload ID: 18002 relates to Category No.: 3666, 5557; Payload ID: 18003 relates to Category No.: 9305, 9242, 14671, 12284; Payload ID: 18004 relates to Category No.: 9305, 2890, 9242, 2942, 9247, 15505; Payload ID: 18005 relates to Category No.: 4030, 9305, 9247; Payload ID: 18006 relates to Category No.: 9305, 9247; Payload ID: 18007 relates to Category No.: 9305, 9247; Payload ID: 18008 relates to Category No.: 9305, 11883, 1720; Payload ID: 18009 relates to Category No.: 4030, 4029, 12439, 2899, 9734, 3521, 2534, 3636, 1239, 4010, 3696, 1792, 6059, 779, 16156, 1085, 5049, 4046, 14411, 1084; Payload ID: 18010 relates to Category No.: 10056, 5776, 4030, 4029, 12439, 6717, 5570, 3693, 2899, 9734, 1099, 2534, 4008, 1239, 4010, 1792, 6709, 5049, 4032, 7118, 12440, 5561; Payload ID: 18011 relates to Category No.: 5570, 4008, 2926, 5049, 5561; Payload ID: 18012 relates to Category No.: 9305, 9247, 4755, 9153, 14937, 15514, 15130, 9601, 15505; Payload ID: 18013 relates to Category No.: 9305, 5776, 9242; Payload ID: 18014 relates to Category No.: 9305; Payload ID: 18015 relates to Category No.: 2890, 5762, 2938, 4014, 4228, 9181; Payload ID: 18016 relates to Category No.: 9305, 5776, 9247; Payload ID: 18017 relates to Category No.: 7118; Payload ID: 18018 relates to Category No.: 4030, 10056, 4765, 3673, 5570, 9734, 1099, 2926, 1792, 3832, 3686, 9305; Payload ID: 18019 relates to Category No.: 4029, 4030, 9305, 2890, 10056, 12159, 1239, 1792, 6989, 4763, 10077, 1017, 8948, 14409; Payload ID: 18020 relates to Category No.: 4030, 4029, 4014, 8948, 1017, 10077, 3693; Payload ID: 18021 relates to Category No.: 4030, 4029, 10056, 4014, 10077, 12159, 9305, 2890, 1792, 8948, 15758, 14409; Payload ID: 18022 relates to Category No.: 5561, 6717, 5762, 10056, 1700, 1182, 12406, 15569, 3693; Payload ID: 18023 relates to Category No.: 6717, 3521, 2736; Payload ID: 18024 relates to Category No.: 5561, 6717, 10056, 2942, 4008, 1659, 12406, 15569, 2890, 5570, 6743, 1792; Payload ID: 18025 relates to Category No.: 4030, 5570, 4008, 4010, 1792, 12406, 5433, 2890, 12159; Payload ID: 18026 relates to Category No.: 5561; Payload ID: 18027 relates to Category No.: 4030, 4029, 10056, 12159, 4014, 15573, 4010, 1090; Payload ID: 18028 relates to Category No.: 2890, 6968, 5730, 9305, 6976; Payload ID: 18029 relates to Category No.: 9305, 2890, 6976, 9242, 9247, 6968; Payload ID: 18030 relates to Category No.: 6968, 2890, 2194; Payload ID: 18031 relates to Category No.: 2890; Payload ID: 18032 relates to Category No.: 4010, 16156; Payload ID: 18033 relates to Category No.: 9305, 7366; Payload ID: 18034 relates to Category No.: 5819, 4010, 2701; Payload ID: 18035 relates to Category No.: 7118, 2942, 3666, 4010, 4228, 5823, 2890; Payload ID: 18036 relates to Category No.: 2890, 4043, 4010; Payload ID: 18037 relates to Category No.: 2890, 4014, 4755, 4010; Payload ID: 18038 relates to Category No.: 2890; Payload ID: 18039 relates to Category No.: 2890; Payload ID: 18041 relates to Category No.: 5561, 10056, 3693, 9247, 15627, 4755, 15573, 15577; Payload ID: 18042 relates to Category No.: 5561, 5559; Payload ID: 18043 relates to Category No.: 5561, 5559; Payload ID: 18044 relates to Category No.: 5561, 5559; Payload ID: 18045 relates to Category No.: 5561, 6717, 10056, 5570, 14954; Payload ID: 18046 relates to Category No.: 5561, 6717, 10056, 2942, 5570, 12406, 2890, 1099, 11883, 14364, 2738, 6743; Payload ID: 18047 relates to Category No.: 5561, 6717, 10056, 2942, 5570; Payload ID: 18048 relates to Category No.: 5561, 6717, 10056, 2942, 5570, 1099, 1811, 1792, 1402, 2712, 11883, 6743, 1659, 2890; Payload ID: 18049 relates to Category No.: 10056, 2787; Payload ID: 18050 relates to Category No.: 5561, 6717, 10056, 2942, 5570, 1402; Payload ID: 18051 relates to Category No.: 5561, 2890, 6717, 10056, 5570, 2942, 14647; Payload ID: 18052 relates to Category No.: 5561, 6717, 10056, 2942, 5570, 9162, 2477, 9734; Payload ID: 18053 relates to Category No.: 5561, 6717; Payload ID: 18054 relates to Category No.: 6717, 10056, 5570, 5561, 5762, 8935, 8948; Payload ID: 18055 relates to Category No.: 5561, 6717, 10056; Payload ID: 18056 relates to Category No.: 5561, 6717, 10056, 3666, 9247, 4755; Payload ID: 18057 relates to Category No.: 5561, 10056, 3036, 8948; Payload ID: 18058 relates to Category No.: 5561, 10056, 779, 1336; Payload ID: 18059 relates to Category No.: 5561, 1700, 6717, 10056, 14327; Payload ID: 18060 relates to Category No.: 5561, 6717, 10056, 3673, 6743, 4008; Payload ID: 18061 relates to Category No.: 5561, 10056, 5570, 1748, 11653, 3059, 5823, 8935, 2942, 6717, 4008, 15139, 3036, 8948; Payload ID: 18062 relates to Category No.: 5561, 6717, 10056, 5570, 6709, 1792, 5762, 1017, 1711, 4863, 1036, 2890, 6017; Payload ID: 18063 relates to Category No.: 5561, 6717, 10056, 12406; Payload ID: 18064 relates to Category No.: 5561, 6717, 10056, 2942, 2901, 447, 2458, 6017, 4199, 4860, 4228, 779, 2710, 14329, 1792, 2926; Payload ID: 18065 relates to Category No.: 5561, 6717; Payload ID: 18066 relates to Category No.: 5561, 6717, 10056, 5570, 4010; Payload ID: 18067 relates to Category No.: 9305, 9273, 6525; Payload ID: 18068 relates to Category No.: 9305, 9273, 6525; Payload ID: 18069 relates to Category No.: 9305, 2942, 9247, 9756, 4010, 16156, 7366; Payload ID: 18070 relates to Category No.: 9305, 2890; Payload ID: 18071 relates to Category No.: 2890; Payload ID: 18072 relates to Category No.: 9305, 9242; Payload ID: 18074 relates to Category No.: 9305, 7118, 9247; Payload ID: 18075 relates to Category No.: 2890, 9305, 2942; Payload ID: 18076 relates to Category No.: 9305, 2890, 2942, 4755, 9734; Payload ID: 18077 relates to Category No.: 2890, 9734, 1842; Payload ID: 18078 relates to Category No.: 7118, 7048, 7050, 7052, 7053; Payload ID: 18079 relates to Category No.: 7048, 7052, 7053; Payload ID: 18080 relates to Category No.: 7118, 7048, 9242, 7053; Payload ID: 18081 relates to Category No.: 7048, 7050, 5562, 7118; Payload ID: 18082 relates to Category No.: 7048, 7050, 5562, 5561, 7118; Payload ID: 18083 relates to Category No.: 5561, 7050, 7118; Payload ID: 18084 relates to Category No.: 5561, 7048, 7051; Payload ID: 18085 relates to Category No.: 7118, 7048, 7050, 7052, 5562; Payload ID: 18086 relates to Category No.: 7050, 1842, 5562, 5561; Payload ID: 18087 relates to Category No.: 2890, 7118, 7048, 7060; Payload ID: 18088 relates to Category No.: 5561, 7118, 7048, 9247, 7050, 9215; Payload ID: 18089 relates to Category No.: 7118, 7048, 7052; Payload ID: 18090 relates to Category No.: 4030, 7048, 7053, 7118; Payload ID: 18091 relates to Category No.: 7118, 7048, 7052, 7053, 7051; Payload ID: 18092 relates to Category No.: 5561, 7118, 7048, 9247; Payload ID: 18093 relates to Category No.: 7118, 7072, 7070, 5564, 3848, 7041; Payload ID: 18094 relates to Category No.: 7072, 5564, 5561; Payload ID: 18095 relates to Category No.: 5561, 7118, 6717, 7072, 7070, 5564, 7048; Payload ID: 18096 relates to Category No.: 5561, 9305, 2890, 6717, 9247, 7070, 7118; Payload ID: 18097 relates to Category No.: 5561, 7118, 2890, 9247, 7072, 7070, 4010, 5564, 10169, 5563; Payload ID: 18098 relates to Category No.: 7072, 7070, 11883, 10169, 7118; Payload ID: 18099 relates to Category No.: 7072, 5561, 7118, 7070; Payload ID: 18100 relates to Category No.: 7118, 7072, 7070; Payload ID: 18101 relates to Category No.: 7118, 7072, 7070, 5564, 5561; Payload ID: 18102 relates to Category No.: 5561, 7118, 6717, 7072, 7070, 4010; Payload ID: 18103 relates to Category No.: 9305, 2890, 9247, 4049, 9199, 2896, 1842, 9184, 5964, 7161, 9162, 9195, 9175, 9204; Payload ID: 18104 relates to Category No.: 5561, 3673, 3666; Payload ID: 18105 relates to Category No.: 5561, 3673; Payload ID: 18106 relates to Category No.: 5561; Payload ID: 18107 relates to Category No.: 5561, 7118, 2890, 5776, 4010, 9184, 7070; Payload ID: 18108 relates to Category No.: 5561, 3673, 3666; Payload ID: 18109 relates to Category No.: 5561; Payload ID: 18110 relates to Category No.: 5561, 5570; Payload ID: 18111 relates to Category No.: 5561; Payload ID: 18112 relates to Category No.: 5561; Payload ID: 18113 relates to Category No.: 5561, 10056; Payload ID: 18114 relates to Category No.: 5561; Payload ID: 18115 relates to Category No.: 5561, 5570; Payload ID: 18116 relates to Category No.: 5561, 6440; Payload ID: 18117 relates to Category No.: 5561, 3673, 3686; Payload ID: 18118 relates to Category No.: 5561, 6717, 3673, 5570, 3666, 5557, 12406; Payload ID: 18119 relates to Category No.: 5561, 10056, 4010; Payload ID: 18120 relates to Category No.: 5561, 1001, 2926, 6440; Payload ID: 18121 relates to Category No.: 5561, 5570, 3693, 4010, 3696; Payload ID: 18122 relates to Category No.: 5561; Payload ID: 18123 relates to Category No.: 5561; Payload ID: 18124 relates to Category No.: 5561, 3673; Payload ID: 18125 relates to Category No.: 5561; Payload ID: 18126 relates to Category No.: 5561; Payload ID: 18127 relates to Category No.: 5561, 6717, 4765, 3673, 3666; Payload ID: 18128 relates to Category No.: 5561, 9305; Payload ID: 18129 relates to Category No.: 5561; Payload ID: 18130 relates to Category No.: 5561; Payload ID: 18131 relates to Category No.: 5561; Payload ID: 18132 relates to Category No.: 5561, 9305, 2890; Payload ID: 18133 relates to Category No.: 5561; Payload ID: 18134 relates to Category No.: 5561, 10056; Payload ID: 18135 relates to Category No.: 5561; Payload ID: 18136 relates to Category No.: 5561, 5762, 7118; Payload ID: 18137 relates to Category No.: 5561, 3673, 3666; Payload ID: 18138 relates to Category No.: 5561; Payload ID: 18139 relates to Category No.: 5561; Payload ID: 18140 relates to Category No.: 5561, 2890, 9247; Payload ID: 18141 relates to Category No.: 5561; Payload ID: 18142 relates to Category No.: 5561; Payload ID: 18143 relates to Category No.: 5561, 4755, 4010, 3696, 6440; Payload ID: 18144 relates to Category No.: 5561, 4765, 4769; Payload ID: 18146 relates to Category No.: 5561, 9305, 2890, 6717, 3673, 5570, 7061, 3666; Payload ID: 18147 relates to Category No.: 5561, 4008, 14955; Payload ID: 18148 relates to Category No.: 5561, 14955; Payload ID: 18149 relates to Category No.: 5561; Payload ID: 18150 relates to Category No.: 5561, 4010; Payload ID: 18151 relates to Category No.: 5561, 4010;

Payload ID: 18152 relates to Category No.: 5561, 2890, 3673, 3666, 4755, 4010, 9184; Payload ID: 18153 relates to Category No.: 5561; Payload ID: 18154 relates to Category No.: 4030, 5561, 2890, 3673, 3666, 4755, 4010, 9184; Payload ID: 18155 relates to Category No.: 5561; Payload ID: 18156 relates to Category No.: 5561; Payload ID: 18157 relates to Category No.: 5561, 10056, 3673, 3666, 4755, 3686, 3685; Payload ID: 18158 relates to Category No.: 5561, 10056, 2477, 4765, 3673, 3666, 4755, 4010, 6709, 14412, 3832, 15577, 4388, 3686, 3685, 2664, 16346, 5776; Payload ID: 18159 relates to Category No.: 5561, 5776, 3673, 3666, 4755, 4760, 3832, 3686, 3685, 2666, 2664, 16346; Payload ID: 18160 relates to Category No.: 5561, 3673, 3666, 4755, 2663, 4760, 3686, 3685; Payload ID: 18161 relates to Category No.: 5561, 3673, 4010; Payload ID: 18162 relates to Category No.: 5561, 2477, 3673, 4755, 3669, 3686, 3685; Payload ID: 18163 relates to Category No.: 5561, 3673; Payload ID: 18164 relates to Category No.: 5561, 3673, 3666, 4755, 2663, 4010, 2668, 3686, 3685; Payload ID: 18165 relates to Category No.: 5561, 4765, 3673, 3666, 4755, 4010, 15577, 3686, 3685; Payload ID: 18166 relates to Category No.: 5561; Payload ID: 18167 relates to Category No.: 5561, 6717; Payload ID: 18168 relates to Category No.: 5561, 4765, 3673, 6717; Payload ID: 18169 relates to Category No.: 4029, 5570, 5561; Payload ID: 18170 relates to Category No.: 4029, 10056, 5570, 4010; Payload ID: 18171 relates to Category No.: 4029, 5570, 4010; Payload ID: 18172 relates to Category No.: 4029, 5570, 10056, 5561; Payload ID: 18173 relates to Category No.: 4029, 5570; Payload ID: 18174 relates to Category No.: 5561, 6717, 1239; Payload ID: 18175 relates to Category No.: 5561, 6717, 1335; Payload ID: 18176 relates to Category No.: 6717, 10056, 5570, 4010, 5561; Payload ID: 18177 relates to Category No.: 5561, 6717, 3673, 3666, 8948; Payload ID: 18178 relates to Category No.: 5561, 6717; Payload ID: 18179 relates to Category No.: 5561, 6717, 10056, 8948; Payload ID: 18180 relates to Category No.: 4030, 5561, 5762, 10056; Payload ID: 18181 relates to Category No.: 5561, 10056; Payload ID: 18182 relates to Category No.: 5570, 5561; Payload ID: 18183 relates to Category No.: 5561, 10056, 3666, 9734, 9730; Payload ID: 18184 relates to Category No.: 5561, 1842; Payload ID: 18185 relates to Category No.: 5561, 5762, 10056, 1792, 11883; Payload ID: 18186 relates to Category No.: 5561, 1842; Payload ID: 18187 relates to Category No.: 5561; Payload ID: 18188 relates to Category No.: 5561, 4010; Payload ID: 18189 relates to Category No.: 5561, 5776, 4010, 6060, 6440; Payload ID: 18190 relates to Category No.: 5561, 3673, 1842; Payload ID: 18191 relates to Category No.: 5561, 1842; Payload ID: 18192 relates to Category No.: 5561, 1842; Payload ID: 18193 relates to Category No.: 5561, 14371, 4010, 9192; Payload ID: 18194 relates to Category No.: 5570, 5562, 7118; Payload ID: 18195 relates to Category No.: 5561, 3673, 2714, 1842; Payload ID: 18196 relates to Category No.: 5561, 779, 781; Payload ID: 18197 relates to Category No.: 5561, 9305, 4755, 4780, 4760; Payload ID: 18198 relates to Category No.: 5561, 1842; Payload ID: 18199 relates to Category No.: 5561, 3666; Payload ID: 18200 relates to Category No.: 5561, 1842, 3666; Payload ID: 18201 relates to Category No.: 5561, 9176, 1842; Payload ID: 18202 relates to Category No.: 5561, 9176, 1842; Payload ID: 18203 relates to Category No.: 5561, 1842; Payload ID: 18204 relates to Category No.: 5561, 4008; Payload ID: 18205 relates to Category No.: 5561, 1842; Payload ID: 18206 relates to Category No.: 5561, 7118, 7048; Payload ID: 18207 relates to Category No.: 5561, 7061, 1842; Payload ID: 18208 relates to Category No.: 5561, 2890, 10056, 3521; Payload ID: 18209 relates to Category No.: 5561, 1842; Payload ID: 18210 relates to Category No.: 5561, 3673, 3666, 1842; Payload ID: 18211 relates to Category No.: 5561, 4765; Payload ID: 18212 relates to Category No.: 5561, 6717, 1842; Payload ID: 18213 relates to Category No.: 5561, 4765, 3673, 4010; Payload ID: 18214 relates to Category No.: 5561, 1842; Payload ID: 18215 relates to Category No.: 5561, 1842; Payload ID: 18216 relates to Category No.: 5561; Payload ID: 18217 relates to Category No.: 5561; Payload ID: 18218 relates to Category No.: 5561; Payload ID: 18219 relates to Category No.: 5561; Payload ID: 18220 relates to Category No.: 5561, 9756; Payload ID: 18221 relates to Category No.: 5561; Payload ID: 18222 relates to Category No.: 5561, 16057, 2458; Payload ID: 18223 relates to Category No.: 5561; Payload ID: 18224 relates to Category No.: 5561; Payload ID: 18225 relates to Category No.: 5561; Payload ID: 18226 relates to Category No.: 5561, 7118; Payload ID: 18227 relates to Category No.: 5561; Payload ID: 18228 relates to Category No.: 5561; Payload ID: 18229 relates to Category No.: 5561, 3673; Payload ID: 18230 relates to Category No.: 5561, 6717; Payload ID: 18231 relates to Category No.: 5561, 6717; Payload ID: 18232 relates to Category No.: 5561, 6717, 7061; Payload ID: 18233 relates to Category No.: 5561, 6717; Payload ID: 18234 relates to Category No.: 6443, 10056, 5561; Payload ID: 18235 relates to Category No.: 5561, 6443; Payload ID: 18236 relates to Category No.: 5561, 6443; Payload ID: 18237 relates to Category No.: 5561; Payload ID: 18238 relates to Category No.: 5561; Payload ID: 18239 relates to Category No.: 5561; Payload ID: 18240 relates to Category No.: 4029; Payload ID: 18241 relates to Category No.: 5561; Payload ID: 18242 relates to Category No.: 5561; Payload ID: 18243 relates to Category No.: 5561; Payload ID: 18244 relates to Category No.: 5561, 7118; Payload ID: 18245 relates to Category No.: 5561; Payload ID: 18246 relates to Category No.: 5561; Payload ID: 18247 relates to Category No.: 1748, 15161, 3523, 5571; Payload ID: 18248 relates to Category No.: 5561; Payload ID: 18249 relates to Category No.: 5561, 6717, 5776, 4755, 3696, 6060, 3523, 6440, 15574; Payload ID: 18250 relates to Category No.: 5561, 4765; Payload ID: 18251 relates to Category No.: 5561, 4765; Payload ID: 18252 relates to Category No.: 5561, 15627; Payload ID: 18253 relates to Category No.: 5561; Payload ID: 18254 relates to Category No.: 5561, 15243, 2457, 2446, 6717; Payload ID: 18255 relates to Category No.: 5561; Payload ID: 18256 relates to Category No.: 5561; Payload ID: 18257 relates to Category No.: 5561; Payload ID: 18258 relates to Category No.: 5561, 10056, 3673, 9734, 2927, 7070, 4755, 3666, 9756; Payload ID: 18259 relates to Category No.: 5561, 3673; Payload ID: 18260 relates to Category No.: 5561, 6443, 3693, 3696, 6440; Payload ID: 18261 relates to Category No.: 5561; Payload ID: 18262 relates to Category No.: 5561, 9184; Payload ID: 18263 relates to Category No.: 5561; Payload ID: 18264 relates to Category No.: 5561; Payload ID: 18265 relates to Category No.: 5561; Payload ID: 18266 relates to Category No.: 5561; Payload ID: 18267 relates to Category No.: 5561; Payload ID: 18268 relates to Category No.: 5561, 2890, 9184; Payload ID: 18269 relates to Category No.: 5561; Payload ID: 18270 relates to Category No.: 5561; Payload ID: 18271 relates to Category No.: 5561; Payload ID: 18272 relates to Category No.: 5561; Payload ID: 18273 relates to Category No.: 5561, 3523; Payload ID: 18274 relates to Category No.: 5561; Payload ID: 18275 relates to Category No.: 5561; Payload ID: 18276 relates to Category No.: 5561, 3036; Payload ID: 18277 relates to Category No.: 5561; Payload ID: 18278 relates to Category No.: 5561, 7118; Payload ID: 18279 relates to Category No.: 5561, 15627; Payload ID: 18280 relates to Category No.: 5561, 2890, 3673; Payload ID: 18281 relates to Category No.: 5561; Payload ID: 18282 relates to Category No.: 5561, 9305, 5450; Payload ID: 18283 relates to Category No.: 5561; Payload ID: 18284 relates to Category No.: 5561, 6443, 9734, 4010, 6059, 6440; Payload ID: 18285 relates to Category No.: 5561; Payload ID: 18286 relates to Category No.: 5561, 10056, 2899; Payload ID: 18287 relates to Category No.: 5561, 3652; Payload ID: 18288 relates to Category No.: 5561, 4010; Payload ID: 18289 relates to Category No.: 5561; Payload ID: 18290 relates to Category No.: 5561; Payload ID: 18291 relates to Category No.: 5561; Payload ID: 18292 relates to Category No.: 5561, 9176, 9184; Payload ID: 18293 relates to Category No.: 5561; Payload ID: 18294 relates to Category No.: 5561, 3673, 3666; Payload ID: 18295 relates to Category No.: 5561, 10056, 447; Payload ID: 18296 relates to Category No.: 5561, 4010; Payload ID: 18297 relates to Category No.: 5561, 1792; Payload ID: 18298 relates to Category No.: 5561; Payload ID: 18299 relates to Category No.: 5561, 3673, 16065; Payload ID: 18300 relates to Category No.: 5561; Payload ID: 18301 relates to Category No.: 5561; Payload ID: 18302 relates to Category No.: 5561; Payload ID: 18303 relates to Category No.: 5561; Payload ID: 18304 relates to Category No.: 5561; Payload ID: 18305 relates to Category No.: 5561, 2890, 3673, 3666, 4755, 2901; Payload ID: 18306 relates to Category No.: 5561; Payload ID: 18307 relates to Category No.: 5561, 2938, 2942, 2458, 15243, 2457; Payload ID: 18308 relates to Category No.: 5561; Payload ID: 18309 relates to Category No.: 5561; Payload ID: 18310 relates to Category No.: 5561, 10056; Payload ID: 18311 relates to Category No.: 5561; Payload ID: 18312 relates to Category No.: 5561; Payload ID: 18313 relates to Category No.: 5561; Payload ID: 18314 relates to Category No.: 5561; Payload ID: 18315 relates to Category No.: 5561; Payload ID: 18316 relates to Category No.: 5561, 5271; Payload ID: 18317 relates to Category No.: 5561; Payload ID: 18318 relates to Category No.: 5561; Payload ID: 18319 relates to Category No.: 5561, 15243, 2457, 2446; Payload ID: 18320 relates to Category No.: 5561; Payload ID: 18321 relates to Category No.: 5561; Payload ID: 18322 relates to Category No.: 5561; Payload ID: 18323 relates to Category No.: 5561, 3666, 2890, 779; Payload ID: 18324 relates to Category No.: 5561; Payload ID: 18325 relates to Category No.: 5561, 6717, 2457; Payload ID: 18326 relates to Category No.: 5561; Payload ID: 18327 relates to Category No.: 5561; Payload ID: 18328 relates to Category No.: 5561, 1748, 15147; Payload ID: 18329 relates to Category No.: 5561; Payload ID: 18330 relates to Category No.: 5561; Payload ID: 18331 relates to Category No.: 5561; Payload ID: 18332 relates to Category No.: 5561; Payload ID: 18333 relates to Category No.: 5561; Payload ID: 18334 relates to Category No.: 5561; Payload ID: 18335 relates to Category No.: 5561, 3666; Payload ID: 18336 relates to Category No.: 5561; Payload ID: 18337 relates to Category No.: 5561; Payload ID: 18338 relates to Category No.: 5561, 4029, 10056; Payload ID: 18339 relates to Category No.: 5561; Payload ID: 18340 relates to Category No.: 5561; Payload ID: 18341 relates to Category No.: 5561; Payload ID: 18342 relates to Category No.: 5561; Payload ID: 18343 relates to Category No.: 5561; Payload ID: 18344 relates to Category No.: 5561; Payload ID: 18345 relates to Category No.: 5561, 4010; Payload ID: 18346 relates to Category No.: 5561, 1842; Payload ID: 18347 relates to Category No.: 5561; Payload ID: 18348 relates to Category No.: 5561, 3673, 3666; Payload ID: 18349 relates to Category No.: 5561; Payload ID: 18350 relates to Category No.: 5561; Payload ID: 18351 relates to Category No.: 5561; Payload ID: 18352 relates to Category No.: 5561; Payload ID: 18353 relates to Category No.: 5561; Payload ID: 18354 relates to Category No.: 5561; Payload ID: 18355 relates to Category No.: 5561, 10056; Payload ID: 18356 relates to Category No.: 5561, 2890, 4010, 1336; Payload ID: 18357 relates to Category No.: 5561, 6717, 3666, 4755, 779, 15628; Payload ID: 18358 relates to Category No.: 5561, 6717, 10056; Payload ID: 18359 relates to Category No.: 5561; Payload ID: 18360 relates to Category No.: 5561; Payload ID: 18361 relates to Category No.: 5561, 3666, 9199, 4010, 6709; Payload ID: 18362 relates to Category No.: 5561, 2899, 9754, 1842; Payload ID: 18363 relates to Category No.: 5561; Payload ID: 18364 relates to Category No.: 5561, 6717, 14371, 4010, 9184; Payload ID: 18365 relates to Category No.: 6717, 5561, 9305, 14371, 9184; Payload ID: 18366 relates to Category No.: 5561; Payload ID: 18367 relates to Category No.: 5561; Payload ID: 18368 relates to Category No.: 5561; Payload ID: 18369 relates to Category No.: 5561; Payload ID: 18370 relates to Category No.: 5561; Payload ID: 18371 relates to Category No.: 5561; Payload ID: 18372 relates to Category No.: 4755, 3671, 9176, 5565; Payload ID: 18373 relates to Category No.: 5561; Payload ID: 18374 relates to Category No.: 5561; Payload ID: 18375 relates to Category No.: 5561; Payload ID: 18376 relates to Category No.: 5561, 10056, 1748, 1811; Payload ID: 18377 relates to Category No.: 4765, 5570, 4755, 5561; Payload ID: 18378 relates to Category No.: 5561, 3666, 2890; Payload ID: 18379 relates to Category No.: 5561, 10056, 3666; Payload ID: 18380 relates to Category No.: 5561, 1842; Payload ID: 18381 relates to Category No.: 5561; Payload ID: 18382 relates to Category No.: 5561, 4010; Payload ID: 18383 relates to Category No.: 5561, 9305; Payload ID: 18384 relates to Category No.: 5561, 1842; Payload ID: 18385 relates to Category No.: 5561, 6060, 6440; Payload ID: 18386 relates to Category No.: 5561, 6060, 6440; Payload ID: 18387 relates to Category No.: 5561, 1842; Payload ID: 18388 relates to Category No.: 5561, 9305, 15139, 1017, 9184, 8942, 8935; Payload ID: 18389 relates to Category No.: 5561, 6443, 10056, 4765, 4010, 6060, 6059, 6440, 4779, 4764, 4758; Payload ID: 18390 relates to Category No.: 5561, 6717, 4765; Payload ID: 18391 relates to Category No.: 5561; Payload ID: 18392 relates to Category No.: 5561; Payload ID: 18393 relates to Category No.: 5561; Payload ID: 18394 relates to Category No.: 5561, 6717, 4010, 6440; Payload ID: 18395 relates to Category No.: 5561, 6717; Payload ID: 18396 relates to Category No.: 5561, 6717; Payload ID: 18397 relates to Category No.: 5561, 2942, 3666; Payload ID: 18398 relates to Category No.: 5561, 7118; Payload ID: 18399 relates to Category No.: 15243, 5561, 2194, 3673, 2927, 2446; Payload ID: 18400 relates to Category No.: 5561; Payload ID: 18401 relates to Category No.: 5561; Payload ID: 18402 relates to Category No.: 7118, 7048, 9247, 5563; Payload ID: 18403 relates to Category No.: 5561; Payload ID: 18404 relates to Category No.: 5561; Payload ID: 18405 relates to Category No.: 5561, 1001, 2926, 6440; Payload ID: 18406 relates to Category No.: 5561; Payload ID: 18407 relates to Category No.: 5561; Payload ID: 18408 relates to Category No.: 5561, 6440, 15574, 2890; Payload ID: 18409 relates to Category No.: 5561; Payload ID: 18410 relates to Category No.: 5561; Payload ID: 18411 relates to Category No.: 5561; Payload ID: 18412 relates to Category No.: 5561; Payload ID: 18413 relates to Category No.: 5561, 2890, 6717; Payload ID: 18414 relates to Category No.: 5561; Payload ID: 18415 relates to Category No.: 5561; Payload ID: 18416 relates to Category No.: 5561, 10056; Payload ID: 18417 relates to Category No.: 5561; Payload ID: 18418 relates to Category No.: 5561, 9305; Payload ID: 18419 relates to Category No.: 10056, 5570, 4010, 6440, 5561; Payload ID: 18420 relates to Category No.: 5561, 9305, 7118, 10056, 3666, 1792; Payload ID: 18421 relates to Category No.: 5561, 10056; Payload ID: 18422 relates to Category No.: 5561, 6443, 6060, 6059, 6440; Payload ID: 18423 relates to Category No.: 5561, 1842; Payload ID: 18424 relates to Category No.: 5561; Payload ID: 18425 relates to Category No.: 5561, 9247; Payload ID: 18426 relates to Category No.: 5561; Payload ID: 18427 relates to Category No.: 5561, 6443, 10056, 9184, 14293; Payload ID: 18428 relates to Category No.: 5561, 3666; Payload ID: 18429 relates to Category No.: 5561; Payload ID: 18430 relates to Category No.: 5561, 10056; Payload ID: 18431 relates to Category No.: 5561, 4029; Payload ID: 18432 relates to Category No.: 5561; Payload ID: 18433 relates to Category No.: 5561; Payload ID: 18434 relates to Category No.: 7118; Payload ID: 18435 relates to Category No.: 5561; Payload ID: 18436 relates to Category No.: 5561, 6717, 3673, 15219, 5557, 5270; Payload ID: 18437 relates to Category No.: 5561, 6717, 3673, 15219, 5557, 5270; Payload ID: 18438 relates to Category No.: 9305, 2890, 2942, 11728, 4010, 9184, 9195, 5762; Payload ID: 18439 relates to Category No.: 9305, 2890, 9184, 9195, 5762; Payload ID: 18440 relates to Category No.: 2890, 5776, 9184; Payload ID: 18441 relates to Category No.: 4030, 4029, 2890, 4010, 11883; Payload ID: 18442 relates to Category No.: 9305, 2890, 9242; Payload ID: 18443 relates to Category No.: 4030; Payload ID: 18444 relates to Category No.: 4010, 4030, 5762; Payload ID: 18445 relates to Category No.: 14409; Payload ID: 18446 relates to Category No.: 10056, 4010, 678; Payload ID: 18447 relates to Category No.: 5561, 2890, 6717, 10056, 16247, 3666, 14371, 14368, 5920, 14370, 5919; Payload ID: 18448 relates to Category No.: 9305, 2890; Payload ID: 18449 relates to Category No.: 9305, 2890, 2938; Payload ID: 18450 relates to Category No.: 9305, 10056, 2942, 9247, 9242, 9184; Payload ID: 18451 relates to Category No.: 2938; Payload ID: 18453 relates to Category No.: 7118, 2890, 2194, 10056, 5934, 774; Payload ID: 18454 relates to Category No.: 9305, 15505, 9247; Payload ID: 18455 relates to Category No.: 5561, 4029, 5762, 10056, 1700; Payload ID: 18456 relates to Category No.: 5561, 4029, 5776, 10056; Payload ID: 18457 relates to Category No.: 5561, 2890, 10056, 1792, 10076; Payload ID: 18458 relates to Category No.: 5561, 10056, 1792; Payload ID: 18459 relates to Category No.: 4029, 10056; Payload ID: 18460 relates to Category No.: 5762; Payload ID: 18461 relates to Category No.: 5762; Payload ID: 18462 relates to Category No.: 4030, 9305, 2890, 2942, 9247, 14664, 1377; Payload ID: 18463 relates to Category No.: 7118, 7060; Payload ID: 18464 relates to Category No.: 9305, 7118, 2890, 9247, 2402, 9184, 2415; Payload ID: 18465 relates to Category No.: 2942, 9247, 2903, 6956; Payload ID: 18466 relates to Category No.: 2942, 2903; Payload ID: 18467 relates to Category No.: 2942; Payload ID: 18468 relates to Category No.: 9305, 2890, 6976, 6994, 273, 4228; Payload ID: 18469 relates to Category No.: 2942; Payload ID: 18470 relates to Category No.: 9305, 2942, 4010; Payload ID: 18471 relates to Category No.: 4030, 9305, 2942, 4010; Payload ID: 18472 relates to Category No.: 2890, 5762; Payload ID: 18473 relates to Category No.: 2890, 9305, 5762; Payload ID: 18474 relates to Category No.: 5762, 5561, 2890, 3673, 9732; Payload ID: 18475 relates to Category No.: 2890, 5762; Payload ID: 18476 relates to Category No.: 5762; Payload ID: 18477 relates to Category No.: 2890, 10104, 5762; Payload ID: 18478 relates to Category No.: 2890; Payload ID: 18479 relates to Category No.: 5762, 1842; Payload ID: 18480 relates to Category No.: 5762, 2890; Payload ID: 18481 relates to Category No.: 9305, 2890, 5762, 2942, 14145, 9247, 14382, 2903; Payload ID: 18482 relates to Category No.: 9305, 2890, 5762, 2942, 9247, 9215, 1377; Payload ID: 18483 relates to Category No.: 5762, 4765, 4010, 6440, 2890, 9305; Payload ID: 18484 relates to Category No.: 9305, 5762, 2942, 9247, 2890, 9167, 9728; Payload ID: 18485 relates to Category No.: 2890, 2942, 9247; Payload ID: 18486 relates to Category No.: 5762, 2942, 1842; Payload ID: 18487 relates to Category No.: 9305, 2890, 6717, 5762, 5570, 3693, 9247, 3521, 14100, 9184, 10104; Payload ID: 18488 relates to Category No.: 5762, 9305, 9247, 14253, 2402, 9167, 9172; Payload ID: 18489 relates to Category No.: 2890, 5762, 9247, 5730; Payload ID: 18490 relates to Category No.: 2890, 5762, 3521; Payload ID: 18491 relates to Category No.: 7118, 5762, 2942; Payload ID: 18492 relates to Category No.: 9305, 2890, 5762, 2942, 15013; Payload ID: 18493 relates to Category No.: 9305, 5762, 5776, 9247; Payload ID: 18494 relates to Category No.: 2890, 5762, 2942; Payload ID: 18495 relates to Category No.: 9305, 2890, 5762, 9247; Payload ID: 18496 relates to Category No.: 5762, 2938, 4010, 262; Payload ID: 18497 relates to Category No.: 2890, 5762, 2942, 9734, 9756, 493, 3861; Payload ID: 18498 relates to Category No.: 5762, 2942, 1842; Payload ID: 18499 relates to Category No.: 7118, 5762, 2942; Payload ID: 18500 relates to Category No.: 5762, 2890, 10056; Payload ID: 18501 relates to Category No.: 5762, 5358; Payload ID: 18502 relates to Category No.: 2890, 5762, 9242; Payload ID: 18503 relates to Category No.: 5762; Payload ID: 18504 relates to Category No.: 5762; Payload ID: 18505 relates to Category No.: 5762; Payload ID: 18506 relates to Category No.: 2890, 5762, 9247, 5597; Payload ID: 18507 relates to Category No.: 5762; Payload ID: 18508 relates to Category No.: 9305, 2890, 5762; Payload ID: 18509 relates to Category No.: 5762; Payload ID: 18510 relates to Category No.: 5762; Payload ID: 18511 relates to Category No.: 5762; Payload ID: 18512 relates to Category No.: 5762; Payload ID: 18513 relates to Category No.: 5762; Payload ID: 18514 relates to Category No.: 5762; Payload ID: 18515 relates to Category No.: 9305, 2890, 5762, 2942, 2903, 9366; Payload ID: 18516 relates to Category No.: 2890, 5762, 493; Payload ID: 18517 relates to Category No.: 5762; Payload ID: 18518 relates to Category No.: 5762, 6960, 16326, 6964; Payload ID: 18519 relates to Category No.: 9305, 2890, 5762, 6960; Payload ID: 18520 relates to Category No.: 2890, 5762, 2942; Payload ID: 18521 relates to Category No.: 5762; Payload ID: 18522 relates to Category No.: 5561, 5762, 3673, 3666; Payload ID: 18523 relates to Category No.: 2890, 5762, 9305, 2942; Payload ID: 18524 relates to Category No.: 5762; Payload ID: 18525 relates to Category No.: 5762; Payload ID: 18526 relates to Category No.: 2890, 5762, 2942; Payload ID: 18527 relates to Category No.: 9305, 2890, 5762, 6960, 6449, 16326, 2649; Payload ID: 18528 relates to Category No.: 5762; Payload ID: 18529 relates to Category No.: 5762; Payload ID: 18530 relates to Category No.: 5762; Payload ID: 18531 relates to Category No.: 5762; Payload ID: 18532 relates to Category No.: 5762, 9247, 493, 9305, 2419; Payload ID: 18533 relates to Category No.: 5762, 2890, 2938; Payload ID: 18534 relates to Category No.: 9305, 2890, 5762, 9242, 2942, 9247, 4755, 9734; Payload ID: 18535 relates to Category No.: 9305, 2890, 10056, 9215, 5776, 9242, 4755; Payload ID: 18536 relates to Category No.: 9305, 2890, 5762; Payload ID: 18537 relates to Category No.: 5762, 2903; Payload ID: 18538 relates to Category No.: 5762, 14363, 2927; Payload ID: 18539 relates to Category No.: 5762; Payload ID: 18540 relates to Category No.: 5762; Payload ID: 18541 relates to Category No.: 5762; Payload ID: 18542 relates to Category No.: 2890, 5776, 2942, 9247, 10104, 9305; Payload ID: 18543 relates to Category No.: 2890, 5762, 2938, 15151, 1748, 3036; Payload ID: 18545 relates to Category No.: 5762; Payload ID: 18546 relates to Category No.: 5762; Payload ID: 18547 relates to Category No.: 6443, 4010, 6709, 6437, 7118; Payload ID: 18548 relates to Category No.: 9305, 2890, 2942, 9247; Payload ID: 18549 relates to Category No.: 5561, 3673; Payload ID: 18550 relates to Category No.: 2890, 2942, 4765, 4010; Payload ID: 18551 relates to Category No.: 7118; Payload ID: 18552 relates to Category No.: 2890, 9247; Payload ID: 18553 relates to Category No.: 7118, 1842; Payload ID: 18554 relates to Category No.: 9305, 7118, 9247; Payload ID: 18555 relates to Category No.: 9305, 9242, 4010; Payload ID: 18557 relates to Category No.: 7118, 9247, 7068; Payload ID: 18559 relates to Category No.: 4010, 11883; Payload ID: 18564 relates to Category No.: 7118; Payload ID: 18565 relates to Category No.: 2890; Payload ID: 18566 relates to Category No.: 9305, 7060; Payload ID: 18567 relates to Category No.: 9247, 15687; Payload ID: 18568 relates to Category No.: 9305, 9247, 15687; Payload ID: 18569 relates to Category No.: 15687, 7118; Payload ID: 18571 relates to Category No.: 7118, 5762, 9247; Payload ID: 18573 relates to Category No.: 9305, 2890; Payload ID: 18574 relates to Category No.: 7118, 2942; Payload ID: 18575 relates to Category No.: 2890, 9247, 5561; Payload ID: 18576 relates to Category No.: 5561; Payload ID: 18578 relates to Category No.: 2890; Payload ID: 18579 relates to Category No.: 10056, 5570, 2890, 9305; Payload ID: 18580 relates to Category No.: 2890; Payload ID: 18581 relates to Category No.: 5570, 1792, 2890, 3666; Payload ID: 18582 relates to Category No.: 4030, 5561, 12159; Payload ID: 18583 relates to Category No.: 2938, 2942, 2660, 15014, 7389, 6717, 14364, 2712, 9305, 2890; Payload ID: 18584 relates to Category No.: 2938, 15014, 7389, 8935, 4860; Payload ID: 18585 relates to Category No.: 2938, 15014, 7389; Payload ID: 18586 relates to Category No.: 2938, 15014, 7389; Payload ID: 18587 relates to Category No.: 2938, 2942, 14364, 14999, 14329, 1231, 7350, 2890, 7389, 4197, 5561; Payload ID: 18588 relates to Category No.: 2942, 7350; Payload ID: 18589 relates to Category No.: 2938, 2942, 4010, 14999, 7350, 2890, 4860, 8935, 2712, 10106, 2514, 4197; Payload ID: 18590 relates to Category No.: 6717, 2938, 2942, 4010, 4228, 14999, 7350, 2890, 2712, 10106, 4197; Payload ID: 18591 relates to Category No.: 7118, 2942, 15743, 9247, 273, 2649; Payload ID: 18592 relates to Category No.: 2942, 15743; Payload ID: 18593 relates to Category No.: 2942, 15743; Payload ID: 18594 relates to Category No.: 9305, 2942, 15743; Payload ID: 18595 relates to Category No.: 2942, 15743, 14364, 2890, 7389, 2649; Payload ID: 18596 relates to Category No.: 2942, 15743; Payload ID: 18597 relates to Category No.: 2942, 15743, 14364, 15014, 2890, 7389; Payload ID: 18598 relates to Category No.: 2942, 15743; Payload ID: 18599 relates to Category No.: 2890, 14145, 9247, 9305; Payload ID: 18600 relates to Category No.: 10056; Payload ID: 18601 relates to Category No.: 10056; Payload ID: 18603 relates to Category No.: 2890; Payload ID: 18604 relates to Category No.: 6717, 9756; Payload ID: 18605 relates to Category No.: 4030, 4029, 4014; Payload ID: 18606 relates to Category No.: 4029; Payload ID: 18607 relates to Category No.: 4029; Payload ID: 18608 relates to Category No.: 5570; Payload ID: 18609 relates to Category No.: 2942; Payload ID: 18610 relates to Category No.: 2942, 2890, 8935; Payload ID: 18611 relates to Category No.: 2942, 8935; Payload ID: 18612 relates to Category No.: 5561, 9305, 3673; Payload ID: 18613 relates to Category No.: 2890, 7060, 7118; Payload ID: 18614 relates to Category No.: 9305, 2890, 2942, 4010; Payload ID: 18615 relates to Category No.: 9305, 7118, 5762, 9247, 7060; Payload ID: 18616 relates to Category No.: 9305, 2890; Payload ID: 18618 relates to Category No.: 9305, 2942, 2890; Payload ID: 18619 relates to Category No.: 9305, 2890; Payload ID: 18620 relates to Category No.: 9242, 9247; Payload ID: 18621 relates to Category No.: 15728, 2890, 2194, 9247, 9242; Payload ID: 18622 relates to Category No.: 15728, 9305, 9247; Payload ID: 18623 relates to Category No.: 15728, 9242, 9247; Payload ID: 18624 relates to Category No.: 5561, 6717, 3652, 14707; Payload ID: 18626 relates to Category No.: 9305, 9242; Payload ID: 18627 relates to Category No.: 9305, 2890, 2194, 10056, 9242, 9247; Payload ID: 18628 relates to Category No.: 9305; Payload ID: 18629 relates to Category No.: 9305; Payload ID: 18630 relates to Category No.: 9305; Payload ID: 18631 relates to Category No.: 9305, 9242; Payload ID: 18632 relates to Category No.: 9305; Payload ID: 18634 relates to Category No.: 2890; Payload ID: 18635 relates to Category No.: 4030; Payload ID: 18636 relates to Category No.: 6717, 14893; Payload ID: 18637 relates to Category No.: 7118, 6717, 5762, 4010, 7068; Payload ID: 18638 relates to Category No.: 4029, 9305, 2890, 10056, 2458, 2942; Payload ID: 18639 relates to Category No.: 4029, 10056, 15139, 1748, 2458, 1774, 10002, 10000, 2942, 1033; Payload ID: 18640 relates to Category No.: 4029, 2890, 2458; Payload ID: 18641 relates to Category No.: 4029, 9305, 10056, 9242, 11728, 2458, 5796, 2443, 1046; Payload ID: 18642 relates to Category No.: 2890, 2458, 5762; Payload ID: 18643 relates to Category No.: 2890, 6717, 10056, 2942, 1720, 276, 6017, 11883, 15757, 2938, 5776, 4860; Payload ID: 18644 relates to Category No.: 6443, 9305, 2890, 6717, 2942, 4755, 9734, 15757; Payload ID: 18645 relates to Category No.: 2890, 6960, 9242, 6968, 4010; Payload ID: 18646 relates to Category No.: 2890, 6960, 9247, 6968; Payload ID: 18647 relates to Category No.: 2890, 6960, 2938, 9998; Payload ID: 18648 relates to Category No.: 2890, 6960, 1182, 447, 6075; Payload ID: 18649 relates to Category No.: 2890, 6960, 14174, 5762; Payload ID: 18650 relates to Category No.: 2890, 2938; Payload ID: 18651 relates to Category No.: 2890, 6960, 2194, 3036, 7244, 1017; Payload ID: 18652 relates to Category No.: 2890, 6960; Payload ID: 18653 relates to Category No.: 9305, 2890, 6960, 9734, 7366; Payload ID: 18654 relates to Category No.: 2890; Payload ID: 18655 relates to Category No.: 2890, 6960, 4010; Payload ID: 18657 relates to Category No.: 2890, 6960; Payload ID: 18659 relates to Category No.: 2890, 6960, 2458; Payload ID: 18662 relates to Category No.: 6960, 6968, 2458, 1046; Payload ID: 18663 relates to Category No.: 2890, 6960, 2458; Payload ID: 18664 relates to Category No.: 9305, 2890, 6960, 2194, 2458; Payload ID: 18665 relates to Category No.: 2890, 6960, 2441; Payload ID: 18666 relates to Category No.: 2890, 6960, 3036, 2458, 9730; Payload ID: 18667 relates to Category No.: 2458, 6968, 1046, 6960; Payload ID: 18668 relates to Category No.: 2890, 6960, 2458; Payload ID: 18669 relates to Category No.: 9305, 12439, 6960, 2942, 4010, 11883, 2907, 2901, 7366; Payload ID: 18670 relates to Category No.: 6960, 4010, 11883, 2901, 7366; Payload ID: 18671 relates to Category No.: 6960, 11883, 2901, 9305, 2890, 16156; Payload ID: 18672 relates to Category No.: 9305, 2890, 6960, 11883; Payload ID: 18673 relates to Category No.: 9305, 2890, 6960, 11883; Payload ID: 18674 relates to Category No.: 9305, 2890, 6960, 11883; Payload ID: 18675 relates to Category No.: 4029, 6960, 2942, 4010, 11883; Payload ID: 18676 relates to Category No.: 2890, 6960, 1842; Payload ID: 18677 relates to Category No.: 6960, 2890, 11883, 5561; Payload ID: 18678 relates to Category No.: 2890, 6960, 11883; Payload ID: 18679 relates to Category No.: 2890, 6960, 4010, 11883; Payload ID: 18680 relates to Category No.: 9305, 2890, 6960, 4010, 11883, 4032; Payload ID: 18681 relates to Category No.: 9305, 2890, 6960, 11883; Payload ID: 18682 relates to Category No.: 6960, 9305, 3036, 4010, 11883, 2890, 1772, 8948, 5762, 6968, 1017; Payload ID: 18683 relates to Category No.: 9305, 6960, 2942, 4010, 11883, 2890, 2458, 8948, 1774, 7366, 5745; Payload ID: 18684 relates to Category No.: 9305, 6960, 2938, 2942, 4010, 11883, 4032, 7366; Payload ID: 18685 relates to Category No.: 6960, 9305, 2890, 4010, 11883; Payload ID: 18686 relates to Category No.: 6960, 11883, 2890, 4010; Payload ID: 18687 relates to Category No.: 9305, 6960, 2938, 2942, 4010, 11883, 2907, 1711, 9164; Payload ID: 18688 relates to Category No.: 2890, 6960, 9247, 2183, 11883, 5561, 9305; Payload ID: 18689 relates to Category No.: 6960, 11883, 9727; Payload ID: 18690 relates to Category No.: 12439, 2890, 6960, 2194, 2942, 11883, 4390, 2632, 10110, 2458, 14902, 2901, 2441, 1750, 9098, 2183, 778, 9727; Payload ID: 18691 relates to Category No.: 6960, 2942, 6968, 11883, 4390, 2194, 14902, 2901, 9727; Payload ID: 18692 relates to Category No.: 6717, 6976, 2194, 2942, 14906, 9247, 2901, 3824, 14907, 4393; Payload ID: 18693 relates to Category No.: 2890, 6717, 6976, 2194, 2942, 14906, 2183, 14893, 10110, 3824, 14907, 4393; Payload ID: 18694 relates to Category No.: 6976, 14906, 12439, 6717, 6960, 2194, 2942, 6968, 4390, 4392, 7171, 3824; Payload ID: 18695 relates to Category No.: 6976, 14906; Payload ID: 18696 relates to Category No.: 6717, 6976, 6960, 2194, 2942, 14906, 4010, 4392, 3824, 14907; Payload ID: 18697 relates to Category No.: 4030, 1090; Payload ID: 18698 relates to Category No.: 4030, 4029, 4014, 4010, 2890; Payload ID: 18699 relates to Category No.: 5561, 7118, 10029, 10014, 2890; Payload ID: 18700 relates to Category No.: 2890, 9535, 10014, 14145, 2417; Payload ID: 18702 relates to Category No.: 1842; Payload ID: 18704 relates to Category No.: 9305, 2890, 3991; Payload ID: 18705 relates to Category No.: 2417, 10014; Payload ID: 18706 relates to Category No.: 2890, 2417, 3666, 14145, 9535; Payload ID: 18707 relates to Category No.: 2890, 2417, 14150, 14145, 9535, 7060; Payload ID: 18708 relates to Category No.: 9305, 2890, 9535, 10029; Payload ID: 18709 relates to Category No.: 4029, 2890; Payload ID: 18710 relates to Category No.: 9305, 2890, 14912, 1635, 9215, 15855, 12159; Payload ID: 18711 relates to Category No.: 4030, 4029, 12439, 6717, 10056, 5570, 4008, 9773, 1792, 6743, 5762; Payload ID: 18712 relates to Category No.: 4030, 4029, 6717, 5570, 4010; Payload ID: 18713 relates to Category No.: 4030, 4029, 2890, 6717, 10056, 5570; Payload ID: 18714 relates to Category No.: 4030, 4029, 6717, 10056, 5570, 9734; Payload ID: 18715 relates to Category No.: 4030, 6717, 4029, 2890, 2942, 9247, 4010, 5561, 4008; Payload ID: 18716 relates to Category No.: 4030, 5561, 4029, 2890, 6717, 10056, 9734; Payload ID: 18717 relates to Category No.: 4030, 5561, 2890, 6717, 10056; Payload ID: 18718 relates to Category No.: 4030, 5561, 6717, 5762, 10056, 5570; Payload ID: 18719 relates to Category No.: 4030, 5561, 6717, 10056, 1792; Payload ID: 18720 relates to Category No.: 4030, 6717, 10056, 5570, 1792; Payload ID: 18721 relates to Category No.: 4030, 6717, 5570, 5561; Payload ID: 18722 relates to Category No.: 4030, 5561, 6717, 10056; Payload ID: 18723 relates to Category No.: 5561, 5762, 10056, 5570, 1792; Payload ID: 18724 relates to Category No.: 5561, 5762, 10056, 5570, 1792; Payload ID: 18725 relates to Category No.: 677, 5570; Payload ID: 18726 relates to Category No.: 5570; Payload ID: 18727 relates to Category No.: 10056, 5570, 4008, 1792; Payload ID: 18728 relates to Category No.: 4030, 4029, 10056, 5570, 12159; Payload ID: 18729 relates to Category No.: 5561, 10056, 14327, 1792; Payload ID: 18730 relates to Category No.: 5570, 10056, 4008; Payload ID: 18731 relates to Category No.: 5561, 10056, 4008; Payload ID: 18732 relates to Category No.: 5561, 10056, 5570, 4008; Payload ID: 18733 relates to Category No.: 5561, 10056, 3652; Payload ID: 18734 relates to Category No.: 4029, 10056, 5570, 4008; Payload ID: 18735 relates to Category No.: 5561, 5762; Payload ID: 18736 relates to Category No.: 4030, 4029, 7118, 10056, 4765, 5570, 6743, 12406, 1792, 5561; Payload ID: 18737 relates to Category No.: 4029, 10056, 5570, 6743, 6717, 9305, 1017, 8948, 9734, 16078; Payload ID: 18738 relates to Category No.: 10056, 5570, 5823, 1017; Payload ID: 18739 relates to Category No.: 4029, 10056, 2942, 5570; Payload ID: 18740 relates to Category No.: 10056, 5570, 1792, 4008; Payload ID: 18741 relates to Category No.: 4030, 4029, 5570; Payload ID: 18742 relates to Category No.: 2890, 5570, 4010; Payload ID: 18743 relates to Category No.: 5570, 5561, 4008, 4030; Payload ID: 18744 relates to Category No.: 2890, 9242, 3693, 2786; Payload ID: 18745 relates to Category No.: 3982, 4030; Payload ID: 18746 relates to Category No.: 6443, 9305, 2890, 2194, 2942, 4010; Payload ID: 18748 relates to Category No.: 2890; Payload ID: 18749 relates to Category No.: 2890; Payload ID: 18750 relates to Category No.: 2890; Payload ID: 18751 relates to Category No.: 2890, 10056; Payload ID: 18752 relates to Category No.: 2890, 3666, 9734; Payload ID: 18753 relates to Category No.: 2890, 9734; Payload ID: 18754 relates to Category No.: 2890, 9734; Payload ID: 18756 relates to Category No.: 9305, 2890, 13728, 7118, 9242, 2942, 3666, 9247, 15508, 9157, 7060, 11883, 9155, 10104, 9181, 14614; Payload ID: 18757 relates to Category No.: 9305, 2890, 9247, 2630, 2420, 15269, 5964, 9158, 15269, 13728, 3355; Payload ID: 18758 relates to Category No.: 9305, 2890, 9734; Payload ID: 18759 relates to Category No.: 9305, 2942, 997, 2926, 10104; Payload ID: 18760 relates to Category No.: 9305, 2942, 997, 2926, 10104; Payload ID: 18761 relates to Category No.: 5561; Payload ID: 18762 relates to Category No.: 5561, 2890, 10056; Payload ID: 18763 relates to Category No.: 4010; Payload ID: 18764 relates to Category No.: 7118; Payload ID: 18765 relates to Category No.: 9305, 2890, 15505, 2942, 9247, 3036, 9157, 11883, 8935, 14293; Payload ID: 18766 relates to Category No.: 2890; Payload ID: 18767 relates to Category No.: 15151, 1748, 4010; Payload ID: 18768 relates to Category No.: 9305, 15505, 5776, 2942, 9247, 4755, 1748, 2402, 2890; Payload ID: 18769 relates to Category No.: 4030, 9305, 2890, 4010, 7321, 15767, 9247; Payload ID: 18773 relates to Category No.: 7118; Payload ID: 18774 relates to Category No.: 7118, 10056, 3673, 5570, 9362, 5561, 1700; Payload ID: 18775 relates to Category No.: 5561; Payload ID: 18776 relates to Category No.: 2890, 10056, 9242, 3693, 3521, 4010, 3862, 3696, 6060, 6059, 7321, 9305; Payload ID: 18777 relates to Category No.: 6717, 2942, 5570, 4010, 6075, 1085, 9305, 4030, 10056; Payload ID: 18778 relates to Category No.: 5561, 5559; Payload ID: 18779 relates to Category No.: 5561, 10056, 2324; Payload ID: 18780 relates to Category No.: 10056, 2324; Payload ID: 18781 relates to Category No.: 10056, 2324, 4010; Payload ID: 18782 relates to Category No.: 2890, 5762, 273, 9734, 1811, 4199, 4228, 7389, 14329; Payload ID: 18783 relates to Category No.: 2890, 5762, 2938, 14953, 9734, 6017, 4199, 4860, 4010, 7389, 1700; Payload ID: 18784 relates to Category No.: 9305; Payload ID: 18785 relates to Category No.: 9305, 2890, 15505; Payload ID: 18786 relates to Category No.: 9305, 9242, 3392, 9247, 6968; Payload ID: 18787 relates to Category No.: 4010, 4030; Payload ID: 18788 relates to Category No.: 10056, 5561, 6717, 3696, 6440; Payload ID: 18789 relates to Category No.: 5561, 6717, 10056, 3696, 6440, 6443; Payload ID: 18790 relates to Category No.: 9305, 2890, 4043; Payload ID: 18791 relates to Category No.: 5561, 5762, 10056, 5570, 1792; Payload ID: 18792 relates to Category No.: 5561, 9305, 3673, 5570, 9162; Payload ID: 18793 relates to Category No.: 5561, 6443, 2890, 9734, 6709, 6712, 4786, 9305, 2942; Payload ID: 18794 relates to Category No.: 6712, 5561, 3696, 6709, 2503; Payload ID: 18795 relates to Category No.: 2890, 6717, 2942, 9734, 2927, 4010, 4228, 6709, 9305, 11883, 15531; Payload ID: 18796 relates to Category No.: 6717, 2942, 2927, 4010, 4228, 6709, 7118, 5961, 1017; Payload ID: 18797 relates to Category No.: 2890, 10056, 2942, 2927, 4010, 5596; Payload ID: 18798 relates to Category No.: 6717, 2942, 2927, 4010, 4228, 5762, 7366, 6756; Payload ID: 18799 relates to Category No.: 2890, 6717, 2942, 2927, 4010, 4228, 11883; Payload ID: 18800 relates to Category No.: 4030, 9305, 2890, 2942, 9247, 2927, 1239, 4010, 4228, 6709, 7118; Payload ID: 18801 relates to Category No.: 2942, 1842, 7118; Payload ID: 18802 relates to Category No.: 9305, 2890, 2942, 8935, 9730, 2926, 6712, 14683, 2918, 1017, 7118, 3036, 15151, 8948, 15280, 2927; Payload ID: 18803 relates to Category No.: 4043, 2938, 9305, 2890, 6717, 2942, 4010; Payload ID: 18804 relates to Category No.: 5570, 10056; Payload ID: 18805 relates to Category No.: 2890, 6717, 4043, 2942; Payload ID: 18806 relates to Category No.: 4043, 9305, 2890, 6717, 10056, 3693, 2927, 447, 2534, 2504, 4852, 4860, 8948, 1017, 3036; Payload ID: 18808 relates to Category No.: 9305, 2890; Payload ID: 18809 relates to Category No.: 9305, 2890, 9242, 9247, 5597, 10104; Payload ID: 18810 relates to Category No.: 5561, 6717, 4765, 4755; Payload ID: 18811 relates to Category No.: 5561, 6717, 4765, 3666, 4755, 4010; Payload ID: 18812 relates to Category No.: 4030, 9305, 2890, 2942; Payload ID: 18813 relates to Category No.: 7118, 2890, 2942, 7060; Payload ID: 18814 relates to Category No.: 9247, 14912, 1635, 9215, 1377, 15852; Payload ID: 18815 relates to Category No.: 9305, 2890, 14912, 9215; Payload ID: 18816 relates to Category No.: 9215; Payload ID: 18817 relates to Category No.: 9305, 9247, 15857, 14912, 9215, 12218, 15852; Payload ID: 18818 relates to Category No.: 9305, 9247; Payload ID: 18819 relates to Category No.: 9305, 1017, 3037, 8952; Payload ID: 18821 relates to Category No.: 9305; Payload ID: 18823 relates to Category No.: 2890, 10056, 4755, 4010; Payload ID: 18824 relates to Category No.: 5561, 3666; Payload ID: 18827 relates to Category No.: 2890; Payload ID: 18828 relates to Category No.: 5561, 9305, 2890, 6717, 3673, 7061, 3666, 5559; Payload ID: 18829 relates to Category No.: 9305, 1182, 9247, 10104; Payload ID: 18830 relates to Category No.: 9305, 4030, 9247; Payload ID: 18831 relates to Category No.: 2890, 10056, 3666, 9247, 11836, 9734, 997, 2926, 11883, 493; Payload ID: 18832 relates to Category No.: 9305, 2890, 10056, 997, 2926; Payload ID: 18834 relates to Category No.: 9305, 2890, 2942, 3673, 9734, 9208, 2948, 997, 2926; Payload ID: 18836 relates to Category No.: 7048, 7085, 7092, 7118; Payload ID: 18837 relates to Category No.: 7048, 2899, 7118; Payload ID: 18838 relates to Category No.: 9305, 7118, 7048, 7060, 7052, 7068; Payload ID: 18839 relates to Category No.: 7092, 5562; Payload ID: 18840 relates to Category No.: 7118, 7048, 7085, 7092, 7366; Payload ID: 18841 relates to Category No.: 7118, 7048, 4010, 7092, 7366; Payload ID: 18842 relates to Category No.: 7118, 7048, 7085; Payload ID: 18843 relates to Category No.: 7048, 13749; Payload ID: 18844 relates to Category No.: 7118, 7048, 13749; Payload ID: 18845 relates to Category No.: 7048, 4010, 7092, 7118; Payload ID: 18846 relates to Category No.: 5561, 7048, 13749; Payload ID: 18847 relates to Category No.: 7118, 7048, 7366, 7061, 7092; Payload ID: 18848 relates to Category No.: 4030, 9305, 14174, 10056, 2942, 9247, 2947, 4010, 3696, 6440, 3638, 5762, 7366; Payload ID: 18849 relates to Category No.: 9305, 2942, 4010; Payload ID: 18850 relates to Category No.: 9305, 2890; Payload ID: 18851 relates to Category No.: 2890, 10056, 2942, 4755, 3862; Payload ID: 18854 relates to Category No.: 9603, 401; Payload ID: 18855 relates to Category No.: 4030, 9305, 7118, 10056, 2942, 8935, 9247, 8948, 4010, 3696, 3638, 7366; Payload ID: 18856 relates to Category No.: 4030, 9305, 10056, 2942, 9247, 4010, 3696, 3638, 7366, 2890; Payload ID: 18857 relates to Category No.: 5762, 2890, 10056, 3673, 9247, 4010, 2942, 8948, 1017, 7366, 8942; Payload ID: 18858 relates to Category No.: 9305, 2890, 5762, 9247, 4010; Payload ID: 18859 relates to Category No.: 9305, 2890, 5762, 2942, 11836, 5466; Payload ID: 18860 relates to Category No.: 9305, 2890, 493; Payload ID: 18862 relates to Category No.: 2890; Payload ID: 18864 relates to Category No.: 9305, 2942, 9247, 16111, 15961, 2890; Payload ID: 18865 relates to Category No.: 9305, 9247, 1323; Payload ID: 18866 relates to Category No.: 2890, 2942, 15892, 11836; Payload ID: 18867 relates to Category No.: 2890, 10056, 15892, 9247, 2402; Payload ID: 18868 relates to Category No.: 5561, 2890, 15892; Payload ID: 18869 relates to Category No.: 5561, 2890, 6717, 2194, 9247; Payload ID: 18870 relates to Category No.: 9305, 2890, 6717, 9247; Payload ID: 18872 relates to Category No.: 9305, 2890, 11836, 2942; Payload ID: 18873 relates to Category No.: 2890; Payload ID: 18874 relates to Category No.: 9305, 2890, 5762, 11836; Payload ID: 18875 relates to Category No.: 2890; Payload ID: 18876 relates to Category No.: 2890, 2942, 4010; Payload ID: 18877 relates to Category No.: 9305, 9247; Payload ID: 18878 relates to Category No.: 9305, 2890, 9247, 3521, 5762; Payload ID: 18879 relates to Category No.: 2890, 9305; Payload ID: 18880 relates to Category No.: 1842; Payload ID: 18881 relates to Category No.: 6443; Payload ID: 18882 relates to Category No.: 9305, 2890, 10056, 2899, 11836, 4010, 1792, 15139; Payload ID: 18883 relates to Category No.: 9305, 2890; Payload ID: 18884 relates to Category No.: 9305, 2890; Payload ID: 18885 relates to Category No.: 9305, 3666; Payload ID: 18886 relates to Category No.: 9305, 3666; Payload ID: 18887 relates to Category No.: 9305, 3666; Payload ID: 18888 relates to Category No.: 9305, 3666; Payload ID: 18889 relates to Category No.: 9305, 3666; Payload ID: 18890 relates to Category No.: 9305, 3666; Payload ID: 18891 relates to Category No.: 9305, 3666; Payload ID: 18892 relates to Category No.: 9305, 3666; Payload ID: 18893 relates to Category No.: 9305, 3666; Payload ID: 18894 relates to Category No.: 9305, 3673; Payload ID: 18895 relates to Category No.: 9305, 3666; Payload ID: 18896 relates to Category No.: 9305, 3666; Payload ID: 18897 relates to Category No.: 9305, 3666; Payload ID: 18898 relates to Category No.: 9305, 3666; Payload ID: 18899 relates to Category No.: 9242, 3666; Payload ID: 18900 relates to Category No.: 9242, 3666; Payload ID: 18901 relates to Category No.: 9242, 3666; Payload ID: 18902 relates to Category No.: 9242, 3666; Payload ID: 18903 relates to Category No.: 9242, 3666; Payload ID: 18904 relates to Category No.: 9242, 3666; Payload ID: 18905 relates to Category No.: 9305, 3666; Payload ID: 18906 relates to Category No.: 9242, 3666; Payload ID: 18907 relates to Category No.: 9305, 3666; Payload ID: 18908 relates to Category No.: 9305, 3666; Payload ID: 18909 relates to Category No.: 9305, 3666; Payload ID: 18910 relates to Category No.: 9305, 3666; Payload ID: 18911 relates to Category No.: 9305, 2942; Payload ID: 18912 relates to Category No.: 2890, 5561, 2942, 3673; Payload ID: 18913 relates to Category No.: 9305, 2890, 9734, 1720, 2194; Payload ID: 18914 relates to Category No.: 2194, 9734; Payload ID: 18915 relates to Category No.: 9305, 2890, 10056, 9247, 1842; Payload ID: 18916 relates to Category No.: 14354, 14355; Payload ID: 18918 relates to Category No.: 9305, 2890, 3666; Payload ID: 18919 relates to Category No.: 9305; Payload ID: 18921 relates to Category No.: 9305, 9242, 9247, 11883; Payload ID: 18922 relates to Category No.: 9305, 1842; Payload ID: 18923 relates to Category No.: 9305, 9157; Payload ID: 18924 relates to Category No.: 5561, 7118, 7070; Payload ID: 18925 relates to Category No.: 9305; Payload ID: 18926 relates to Category No.: 2890, 6717, 4755; Payload ID: 18927 relates to Category No.: 2890, 2194, 4755, 9734, 16110, 997, 5730, 1711; Payload ID: 18928 relates to Category No.: 9305, 2890, 2942; Payload ID: 18930 relates to Category No.: 9305, 9242; Payload ID: 18931 relates to Category No.: 9305; Payload ID: 18933 relates to Category No.: 14912; Payload ID: 18934 relates to Category No.: 6443, 9305, 2890, 10056; Payload ID: 18935 relates to Category No.: 9305, 2890; Payload ID: 18936 relates to Category No.: 9305; Payload ID: 18938 relates to Category No.: 9247; Payload ID: 18939 relates to Category No.: 9305, 9242, 6968; Payload ID: 18940 relates to Category No.: 9247; Payload ID: 18942 relates to Category No.: 9305, 2890, 14382; Payload ID: 18943 relates to Category No.: 7118, 2890, 9247, 11653, 6743; Payload ID: 18944 relates to Category No.: 9305; Payload ID: 18945 relates to Category No.: 6443; Payload ID: 18946 relates to Category No.: 14354; Payload ID: 18947 relates to Category No.: 14354; Payload ID: 18948 relates to Category No.: 1842; Payload ID: 18950 relates to Category No.: 6443, 12439, 2890, 10056; Payload ID: 18951 relates to Category No.: 9305, 2890, 2942, 9247, 9155, 10104; Payload ID: 18952 relates to Category No.: 4045, 2890, 2942, 9247, 6994, 4755, 3521, 4053, 5762, 262; Payload ID: 18953 relates to Category No.: 2890, 6717, 2942, 4860, 778; Payload ID: 18954 relates to Category No.: 2890; Payload ID: 18955 relates to Category No.: 4030, 1377; Payload ID: 18956 relates to Category No.: 2890, 15892; Payload ID: 18957 relates to Category No.: 9305, 2890, 15892; Payload ID: 18958 relates to Category No.: 9305, 2890, 2942, 15892, 4010, 11883, 15879, 15890; Payload ID: 18959 relates to Category No.: 9305, 2890, 9247, 4010, 15878; Payload ID: 18960 relates to Category No.: 5561, 2890, 3673; Payload ID: 18961 relates to Category No.: 2890, 3666, 5561, 3673, 15892; Payload ID: 18962 relates to Category No.: 2890, 2942, 2402, 9157, 5284, 16317; Payload ID: 18963 relates to Category No.: 9305, 2890, 10056, 13728, 9247, 2402, 9157, 5284, 16317; Payload ID: 18964 relates to Category No.: 9305, 2890, 2942, 668, 9247; Payload ID: 18965 relates to Category No.: 2890, 2942, 15892, 9247, 11883; Payload ID: 18966 relates to Category No.: 2942, 15892, 9247, 4010, 11883; Payload ID: 18967 relates to Category No.: 10056, 2942, 9247, 4010, 3696; Payload ID: 18969 relates to Category No.: 9305, 2942, 15892, 9247; Payload ID: 18971 relates to Category No.: 9305, 2890; Payload ID: 18972 relates to Category No.: 2890; Payload ID: 18973 relates to Category No.: 2890, 4010; Payload ID: 18974 relates to Category No.: 2890, 2942, 3666; Payload ID: 18975 relates to Category No.: 2890; Payload ID: 18976 relates to Category No.: 9305, 2890, 9247, 15173, 10104, 15543, 15105, 9155; Payload ID: 18977 relates to Category No.: 9305, 2890, 273, 4010, 5730, 4202; Payload ID: 18978 relates to Category No.: 9305, 2890, 15892, 4010; Payload ID: 18979 relates to Category No.: 2942, 9247; Payload ID: 18980 relates to Category No.: 2890, 2942, 4010; Payload ID: 18981 relates to Category No.: 9305, 2890, 2942, 15892, 9247, 4010, 11883, 15878, 15879; Payload ID: 18983 relates to Category No.: 9305, 2890, 9247; Payload ID: 18984 relates to Category No.: 9305, 2942, 4199; Payload ID: 18985 relates to Category No.: 2890; Payload ID: 18987 relates to Category No.: 9305; Payload ID: 18988 relates to Category No.: 2890; Payload ID: 18989 relates to Category No.: 2890, 668; Payload ID: 18990 relates to Category No.: 9305, 2890, 9247; Payload ID: 18991 relates to Category No.: 2890, 9157, 5284; Payload ID: 18992 relates to Category No.: 9305, 2890, 5561; Payload ID: 18993 relates to Category No.: 2890, 9247; Payload ID: 18994 relates to Category No.: 9305, 2890, 4010; Payload ID: 18995 relates to Category No.: 4010; Payload ID: 18996 relates to Category No.: 5762, 10056, 4010; Payload ID: 18997 relates to Category No.: 9305, 2890, 6717, 2942, 1104; Payload ID: 18998 relates to Category No.: 2890; Payload ID: 18999 relates to Category No.: 9305, 2890; Payload ID: 19001 relates to Category No.: 9305, 9242; Payload ID: 19002 relates to Category No.: 9305, 7118, 2890, 3113, 4010, 3696, 6440, 14295, 5029; Payload ID: 19003 relates to Category No.: 9305, 2890, 9247, 15096; Payload ID: 19004 relates to Category No.: 9305, 2942; Payload ID: 19005 relates to Category No.: 9305, 2890, 5776; Payload ID: 19006 relates to Category No.: 2890; Payload ID: 19007 relates to Category No.: 2942, 9247; Payload ID: 19008 relates to Category No.: 9305, 13728, 9157, 9181, 5029, 3952, 9172, 10056, 2926; Payload ID: 19009 relates to Category No.: 9305, 9247, 9172; Payload ID: 19010 relates to Category No.: 9305, 11883; Payload ID: 19011 relates to Category No.: 9305, 2890, 2938, 2194, 4390; Payload ID: 19012 relates to Category No.: 9305, 9155; Payload ID: 19013 relates to Category No.: 2890, 2942, 3666, 11836, 16111, 9305, 3036, 8948; Payload ID: 19015 relates to Category No.: 2890, 2938; Payload ID: 19016 relates to Category No.: 9305, 2942, 3666, 2477; Payload ID: 19017 relates to Category No.: 9305, 2942, 3666, 4755; Payload ID: 19018 relates to Category No.: 2890, 3673, 3666, 9162; Payload ID: 19019 relates to Category No.: 9305, 2890, 6976, 9242, 4010; Payload ID: 19020 relates to Category No.: 9247, 16111; Payload ID: 19021 relates to Category No.: 5561, 5557; Payload ID: 19022 relates to Category No.: 3673, 3666, 5570, 3668, 5776, 2870; Payload ID: 19023 relates to Category No.: 5561, 3673, 3666; Payload ID: 19024 relates to Category No.: 5561, 3673, 3666; Payload ID: 19025 relates to Category No.: 5561, 3673, 3666; Payload ID: 19026 relates to Category No.: 5561, 5776, 3673; Payload ID: 19027 relates to Category No.: 5561, 3673, 3666, 4010; Payload ID: 19028 relates to Category No.: 5561, 3673, 3666; Payload ID: 19029 relates to Category No.: 5561, 3673, 3666; Payload ID: 19030 relates to Category No.: 5561, 3673, 3666, 4010; Payload ID: 19031 relates to Category No.:

5561, 5776; Payload ID: 19032 relates to Category No.: 5561, 5776; Payload ID: 19033 relates to Category No.: 5561, 5776; Payload ID: 19034 relates to Category No.: 5561, 5776, 3673; Payload ID: 19035 relates to Category No.: 5561, 5776, 3673; Payload ID: 19036 relates to Category No.: 5561, 5776, 3673; Payload ID: 19037 relates to Category No.: 5561, 6717, 5776, 3673; Payload ID: 19038 relates to Category No.: 5561, 3673, 3666; Payload ID: 19039 relates to Category No.: 5561, 5776, 3673; Payload ID: 19040 relates to Category No.: 5561, 5776, 6717, 3673, 4010; Payload ID: 19041 relates to Category No.: 5561, 5776, 15951; Payload ID: 19042 relates to Category No.: 5561, 5776; Payload ID: 19043 relates to Category No.: 5561, 5776; Payload ID: 19044 relates to Category No.: 5561, 6717, 4765, 4760, 4764; Payload ID: 19045 relates to Category No.: 5561, 6717, 4765; Payload ID: 19046 relates to Category No.: 5561, 6717, 4765; Payload ID: 19047 relates to Category No.: 5561, 6717, 4765; Payload ID: 19048 relates to Category No.: 5561, 6717, 4765, 3666, 4755; Payload ID: 19049 relates to Category No.: 4030, 5561, 6717, 10056, 4765, 4755, 3113, 1099, 4008, 4199, 4010, 4760, 1336, 4779, 4682, 1792; Payload ID: 19050 relates to Category No.: 5561, 4765, 4760; Payload ID: 19051 relates to Category No.: 5561, 2890, 4765, 4755, 4010, 4760; Payload ID: 19052 relates to Category No.: 5561, 4765, 4760; Payload ID: 19053 relates to Category No.: 5561, 4765, 4010, 4760; Payload ID: 19054 relates to Category No.: 5561, 4765, 4760; Payload ID: 19055 relates to Category No.: 2942, 4010; Payload ID: 19056 relates to Category No.: 5561, 6717, 4765, 4010; Payload ID: 19057 relates to Category No.: 5561, 6717, 4755, 4765, 5570; Payload ID: 19058 relates to Category No.: 5561, 6717, 4765; Payload ID: 19059 relates to Category No.: 5561, 6717, 5762, 4765; Payload ID: 19060 relates to Category No.: 6717, 5561, 4765; Payload ID: 19061 relates to Category No.: 5561, 6717, 4765; Payload ID: 19062 relates to Category No.: 5561, 6717, 4765, 4010; Payload ID: 19063 relates to Category No.: 5561, 6717, 4765; Payload ID: 19065 relates to Category No.: 2942, 9247, 4010; Payload ID: 19066 relates to Category No.: 5561, 6717, 4765; Payload ID: 19067 relates to Category No.: 3666, 4010, 3671, 3685; Payload ID: 19068 relates to Category No.: 3671, 3685; Payload ID: 19069 relates to Category No.: 9305, 2942, 4010, 2890; Payload ID: 19070 relates to Category No.: 5561, 4010, 4760, 7118, 4755; Payload ID: 19071 relates to Category No.: 2890, 10056, 2942, 9247; Payload ID: 19072 relates to Category No.: 2942; Payload ID: 19073 relates to Category No.: 4010; Payload ID: 19074 relates to Category No.: 9305, 2890, 6717, 2942, 3673, 3666, 9247, 11883, 8935; Payload ID: 19075 relates to Category No.: 4010; Payload ID: 19076 relates to Category No.: 9305, 2890, 3666; Payload ID: 19079 relates to Category No.: 10056, 3666, 678; Payload ID: 19080 relates to Category No.: 4030, 1792, 678; Payload ID: 19081 relates to Category No.: 10056, 678; Payload ID: 19082 relates to Category No.: 9305; Payload ID: 19083 relates to Category No.: 2194, 2942, 14906, 14903, 5597; Payload ID: 19084 relates to Category No.: 2942, 11728, 2457; Payload ID: 19085 relates to Category No.: 2890, 8935, 1748, 11723, 11721, 15139, 1017, 8917, 5762; Payload ID: 19086 relates to Category No.: 5762, 2890, 10056, 2942, 4755, 1748, 11721, 15280, 8917; Payload ID: 19087 relates to Category No.: 2890, 10056, 1748, 11723, 11721; Payload ID: 19088 relates to Category No.: 6443, 12439, 6717, 3985, 6059, 16278; Payload ID: 19089 relates to Category No.: 2890, 9247, 4755, 9734; Payload ID: 19090 relates to Category No.: 2890, 2942; Payload ID: 19091 relates to Category No.: 5561, 2890, 6717; Payload ID: 19092 relates to Category No.: 5561, 10056, 5823, 8949, 8939; Payload ID: 19093 relates to Category No.: 5561; Payload ID: 19094 relates to Category No.: 5561; Payload ID: 19095 relates to Category No.: 5561, 1792; Payload ID: 19096 relates to Category No.: 5559, 9176, 4755, 4765; Payload ID: 19097 relates to Category No.: 2890, 2942, 11687, 997, 11688, 920, 4052, 4054, 4042; Payload ID: 19098 relates to Category No.: 2942, 11687, 2927, 11688; Payload ID: 19099 relates to Category No.: 2890, 6717, 2942, 11687, 2455; Payload ID: 19101 relates to Category No.: 5561, 10056; Payload ID: 19102 relates to Category No.: 5561, 10056; Payload ID: 19103 relates to Category No.: 5561, 10056; Payload ID: 19104 relates to Category No.: 5561, 6443, 4765, 3673, 3693, 3666, 3527; Payload ID: 19111 relates to Category No.: 4029; Payload ID: 19113 relates to Category No.: 5561, 3673, 3666; Payload ID: 19114 relates to Category No.: 5561, 7118, 7048, 7041; Payload ID: 19115 relates to Category No.: 5561, 7048, 7118, 2890, 7061; Payload ID: 19116 relates to Category No.: 5561, 7118, 7048, 7061; Payload ID: 19117 relates to Category No.: 9305; Payload ID: 19118 relates to Category No.: 10162; Payload ID: 19119 relates to Category No.: 9305, 2890; Payload ID: 19121 relates to Category No.: 9305, 2890, 2942, 9247, 2402, 2903, 3991, 15119; Payload ID: 19122 relates to Category No.: 9305, 2890, 2942, 9734, 3991; Payload ID: 19123 relates to Category No.: 9305, 2890, 5776, 10056, 2942, 9247, 3991; Payload ID: 19124 relates to Category No.: 9305, 2890, 2942, 9247, 3991; Payload ID: 19125 relates to Category No.: 12159, 4030, 9734, 493, 5557; Payload ID: 19126 relates to Category No.: 5561, 4010, 7079, 7048, 7118; Payload ID: 19127 relates to Category No.: 9305, 2890; Payload ID: 19128 relates to Category No.: 9305, 2890, 9247; Payload ID: 19129 relates to Category No.: 9242, 9247, 9305, 4175; Payload ID: 19130 relates to Category No.: 9305, 2890; Payload ID: 19131 relates to Category No.: 9305, 15505, 9247; Payload ID: 19132 relates to Category No.: 9305, 9247; Payload ID: 19133 relates to Category No.: 9305, 4765, 3666; Payload ID: 19134 relates to Category No.: 9305, 7118, 9247; Payload ID: 19135 relates to Category No.: 9305, 2942; Payload ID: 19136 relates to Category No.: 9242; Payload ID: 19137 relates to Category No.: 9305, 9242, 493; Payload ID: 19138 relates to Category No.: 9756, 1842; Payload ID: 19139 relates to Category No.: 2942, 4010; Payload ID: 19141 relates to Category No.: 9305, 7118, 2890, 3393, 2686, 3036; Payload ID: 19142 relates to Category No.: 9305, 2890, 2942; Payload ID: 19143 relates to Category No.: 2890, 2942; Payload ID: 19144 relates to Category No.: 2890, 2942, 15827; Payload ID: 19145 relates to Category No.: 2942; Payload ID: 19146 relates to Category No.: 9305, 2942; Payload ID: 19147 relates to Category No.: 2942, 1842; Payload ID: 19148 relates to Category No.: 2942; Payload ID: 19149 relates to Category No.: 4029, 3036, 1017, 8948, 1033, 9730, 16078; Payload ID: 19150 relates to Category No.: 4030, 4029; Payload ID: 19151 relates to Category No.: 4030; Payload ID: 19152 relates to Category No.: 677, 14906, 1099, 4049, 11728, 4010, 779, 2446, 4030, 4755, 6743, 2926, 778, 4029, 12159, 5561; Payload ID: 19153 relates to Category No.: 5561, 4029, 2890, 4008, 4030; Payload ID: 19154 relates to Category No.: 5561, 4765; Payload ID: 19155 relates to Category No.: 5561, 10056, 5570, 3666, 4010, 779; Payload ID: 19156 relates to Category No.: 5561, 5570, 4010, 779; Payload ID: 19157 relates to Category No.: 5570, 5557, 4010, 779; Payload ID: 19158 relates to Category No.: 5561, 3673, 4010, 779; Payload ID: 19159 relates to Category No.: 5561, 10056, 4010; Payload ID: 19160 relates to Category No.: 5561, 3393, 2686; Payload ID: 19161 relates to Category No.: 2890, 2942, 9247; Payload ID: 19162 relates to Category No.: 7118, 2942; Payload ID: 19163 relates to Category No.: 4029, 2942, 4030; Payload ID: 19164 relates to Category No.: 5561, 6717, 10056, 5570, 2942, 3521, 12439; Payload ID: 19165 relates to Category No.: 4029; Payload ID: 19166 relates to Category No.: 2890, 2938, 2942, 14953, 1335, 778, 10002, 15139, 10056, 10000; Payload ID: 19168 relates to Category No.: 10056, 2942, 273, 2890, 9998, 2441, 10000; Payload ID: 19169 relates to Category No.: 5561, 2890, 1090, 779, 14956, 14952, 14954, 9998, 2441, 10000, 9729, 16035; Payload ID: 19170 relates to Category No.: 2890, 6717, 9242, 2942, 4765, 3666, 4755, 3832, 4769, 9734; Payload ID: 19171 relates to Category No.: 10056, 2899, 4755, 2926; Payload ID: 19172 relates to Category No.: 4030, 2890, 9242, 14671; Payload ID: 19173 relates to Category No.: 9242, 14671; Payload ID: 19174 relates to Category No.: 9242, 14671; Payload ID: 19175 relates to Category No.: 14671, 15783, 9305, 2890, 9242, 1748; Payload ID: 19176 relates to Category No.: 9305, 9242, 14671, 12284, 5561; Payload ID: 19177 relates to Category No.: 2890, 9242, 14671, 9247, 192, 11715, 14670; Payload ID: 19178 relates to Category No.: 9242, 14671; Payload ID: 19179 relates to Category No.: 9305, 9242, 14671; Payload ID: 19180 relates to Category No.: 5762, 9242, 14671, 12284; Payload ID: 19181 relates to Category No.: 2890, 6717, 2938, 10056, 9247, 1748, 11653, 4199, 4010, 11883, 2650, 4201, 15139, 14363, 8917, 3518, 4860, 2710; Payload ID: 19182 relates to Category No.: 6443, 2890, 2194, 2420, 2192, 3666, 6994, 3521, 6059, 3388, 11883, 9774; Payload ID: 19183 relates to Category No.: 4029, 9305, 7118, 2890, 2938, 9247, 4010; Payload ID: 19184 relates to Category No.: 9247, 2420; Payload ID: 19185 relates to Category No.: 9591, 4765, 3666, 3696, 6060, 3523; Payload ID: 19186 relates to Category No.: 9305, 2890, 9242, 2942, 9247, 14893, 4769, 5561; Payload ID: 19187 relates to Category No.: 5561, 9305, 2890, 3673, 7061, 3666, 11883, 6717; Payload ID: 19188 relates to Category No.: 9305, 2890; Payload ID: 19189 relates to Category No.: 276, 768, 2736, 5762, 6443, 3693, 3521, 3636, 997, 6060, 6059, 6440, 2504, 5257; Payload ID: 19190 relates to Category No.: 5762, 4049, 3065, 1700; Payload ID: 19192 relates to Category No.: 5762, 1700, 4049, 4010; Payload ID: 19193 relates to Category No.: 5762, 1700, 4049, 4010; Payload ID: 19194 relates to Category No.: 6443, 12439, 2890, 3521, 997, 6060, 6059, 6440, 2504, 5257, 276, 3693, 1017, 8948; Payload ID: 19195 relates to Category No.: 6443, 3521, 997, 6060, 6059, 6440, 2504, 5257, 276, 768, 2736, 1700; Payload ID: 19196 relates to Category No.: 9305, 2890, 9242, 2942, 9247, 4010, 3696, 3863, 7118; Payload ID: 19197 relates to Category No.: 2890, 10056, 2942, 3693, 3521, 4010, 3862, 3696, 6060, 5762; Payload ID: 19198 relates to Category No.: 9734, 3521, 997, 6060, 6059, 6440, 2504, 768, 2498, 5257, 1700; Payload ID: 19199 relates to Category No.: 6443, 12439, 2890, 9734, 6060, 6059, 3523, 6440, 2504, 10076, 768, 2498, 5257, 1700; Payload ID: 19200 relates to Category No.: 9305, 2942, 3693, 4010, 6060, 3863, 6443, 6059; Payload ID: 19201 relates to Category No.: 2890, 2194, 5776, 9247, 3862, 3696, 6060; Payload ID: 19202 relates to Category No.: 2890, 10056, 3693, 6994, 4010, 3862, 3696, 6060; Payload ID: 19203 relates to Category No.: 4010, 3862, 3696, 6060; Payload ID: 19204 relates to Category No.: 4010, 3862, 3696, 6060; Payload ID: 19205 relates to Category No.: 6060, 6440, 5257, 768; Payload ID: 19206 relates to Category No.: 6443, 9305, 2890, 2194, 10056, 2942, 14906, 3693, 6994, 9734, 16057, 3521, 4010, 6060, 6059, 4216, 3864; Payload ID: 19207 relates to Category No.: 9305, 2890, 2194, 2942, 14906, 3693, 4010, 3696, 6060, 4216; Payload ID: 19208 relates to Category No.: 6717, 2942, 4755, 3521, 3696, 6060, 6059, 6440, 2736, 2504, 4786, 768, 2498, 5257, 6968; Payload ID: 19209 relates to Category No.: 5561, 4765, 4755, 1842, 3696, 1700; Payload ID: 19210 relates to Category No.: 4780, 5561, 12439, 4755, 4410, 3528; Payload ID: 19211 relates to Category No.: 12439, 4755, 9734, 3696, 3528; Payload ID: 19212 relates to Category No.: 12439, 4755, 9734, 3696, 4410, 3528, 5762; Payload ID: 19213 relates to Category No.: 9247, 4755, 9734, 15573, 4410, 5762; Payload ID: 19214 relates to Category No.: 9305, 9247, 11883; Payload ID: 19215 relates to Category No.: 3521, 2736; Payload ID: 19216 relates to Category No.: 5561, 6717, 10056, 3666, 11687, 3652, 1001, 3686; Payload ID: 19217 relates to Category No.: 9305, 2890, 10056, 2942, 9247, 6968, 16156, 1811, 7118, 2441, 14893; Payload ID: 19218 relates to Category No.: 9305, 10056, 2942, 9247, 1720, 14329, 5776, 16156, 5555; Payload ID: 19219 relates to Category No.: 2890, 10056, 9247, 4755; Payload ID: 19220 relates to Category No.: 9305, 2890, 5776, 2942, 3673, 3666, 9247, 11836, 9734, 6222, 4010, 14614, 16111, 3104, 16112, 11883, 7366; Payload ID: 19221 relates to Category No.: 2890, 3666, 4769; Payload ID: 19222 relates to Category No.: 2890, 1842; Payload ID: 19223 relates to Category No.: 2942, 7118; Payload ID: 19224 relates to Category No.: 7118; Payload ID: 19225 relates to Category No.: 5561, 10056, 1182, 4765, 3673, 3666, 9734, 16156, 6968; Payload ID: 19226 relates to Category No.: 5561, 4765, 3673, 3666, 4755; Payload ID: 19227 relates to Category No.: 5561, 6075; Payload ID: 19228 relates to Category No.: 5561, 10056, 1811, 779, 6075, 14999, 1099, 1772, 3831, 1773; Payload ID: 19229 relates to Category No.: 5561, 10056, 677, 4010; Payload ID: 19230 relates to Category No.: 10056, 677; Payload ID: 19231 relates to Category No.: 10056, 677, 1842, 4030; Payload ID: 19232 relates to Category No.: 9305, 9242; Payload ID: 19233 relates to Category No.: 1842; Payload ID: 19234 relates to Category No.: 9305, 9242; Payload ID: 19235 relates to Category No.: 9305, 9242; Payload ID: 19238 relates to Category No.: 4030, 5561, 10056, 3666, 4755, 3521, 4008, 4199, 4010, 10106, 1792, 6989, 778, 565, 1772, 14363; Payload ID: 19239 relates to Category No.: 6717, 4030, 4029, 2890, 12159, 14409, 1792, 10077; Payload ID: 19240 relates to Category No.: 4030, 4029, 6717, 10077, 5762; Payload ID: 19241 relates to Category No.: 4029, 6717, 10077, 4030; Payload ID: 19242 relates to Category No.: 9305, 2890, 9247; Payload ID: 19243 relates to Category No.: 4029, 1700, 8948; Payload ID: 19244 relates to Category No.: 5561, 6717, 10056, 5570, 12406; Payload ID: 19245 relates to Category No.: 5561, 6717, 10056, 5570; Payload ID: 19246 relates to Category No.: 2938, 2890, 10056, 2942, 1182, 273, 4010, 4228, 4201, 6019, 6017, 4199; Payload ID: 19247 relates to Category No.: 4030, 2890, 3666, 778; Payload ID: 19248 relates to Category No.: 4029, 2890; Payload ID: 19249 relates to Category No.: 4030, 5561, 4010, 1792, 6440, 10056, 7118; Payload ID: 19250 relates to Category No.: 5762, 10056, 2942, 1811; Payload ID: 19251 relates to Category No.: 2942, 2890, 10056; Payload ID: 19252 relates to Category No.: 2942, 4010, 2890, 10056, 5762; Payload ID: 19253 relates to Category No.: 10056, 3666, 2901, 5557, 16149, 6333, 3104, 3105; Payload ID: 19254 relates to Category No.: 9305, 2890, 10056, 2942, 4010, 273; Payload ID: 19255 relates to Category No.: 2942, 3693, 4010, 2890; Payload ID: 19256 relates to Category No.: 9305; Payload ID: 19257 relates to Category No.: 9305; Payload ID: 19258 relates to Category No.: 9305, 2890; Payload ID: 19259 relates to Category No.: 10056; Payload ID: 19260 relates to Category No.: 4030, 4029, 6717, 5776, 12159, 4014, 4763, 6437; Payload ID: 19262 relates to Category No.: 5561, 6717, 10056, 2534, 12406, 16149, 4030, 9305, 1792, 778, 9734; Payload ID: 19263 relates to Category No.: 2942, 4010, 3696, 2890; Payload ID: 19264 relates to Category No.: 5561, 7070, 4010; Payload ID: 19266 relates to Category No.: 5561, 6717, 15151, 4765, 3673, 3693, 4755, 9734, 8948, 14707, 6060, 2504, 3832, 8942; Payload ID: 19267 relates to Category No.: 5561, 12439, 2890, 6717, 5776, 15151, 3673, 4755, 9734, 8948, 14707, 6060, 6440, 3832, 16156; Payload ID: 19268 relates to Category No.: 5561, 2942, 15151, 5570, 1748, 14707, 7070, 15161, 14803, 15297, 1792, 7118, 15280; Payload ID: 19269 relates to Category No.: 5561, 6717, 16257, 5776, 10056, 2942, 15151, 8935, 5570, 15139, 9734, 1748, 15573, 14707, 15170, 14409, 4010, 15161, 2926, 14412, 2504, 16156, 8942, 2509, 2510, 2511, 16346, 15171, 15169, 14995, 15280, 5778; Payload ID: 19270 relates to Category No.: 5561, 12439, 5762, 5776, 10056, 2942, 15151, 8935, 1748, 14707, 2504, 1792, 2926, 14409, 779, 5778, 2505; Payload ID: 19271 relates to Category No.: 5561, 6443, 4765, 3693, 4755, 14707, 1792, 15573; Payload ID: 19272 relates to Category No.: 5561, 10056, 15151, 9734, 2927, 14707, 4010, 1792, 5568, 6059, 5596, 5570; Payload ID: 19273 relates to Category No.: 5561, 2890, 6717, 5776, 10056, 3673, 8935, 15139, 4755, 1748, 15573, 14707, 14409, 6017, 4010, 9776, 6060, 14412, 6440, 10076, 12219, 9774, 15628, 1052, 1792, 9734, 778, 15627; Payload ID: 19274 relates to Category No.: 5561, 12439, 2890, 6717, 10056, 2942, 9734, 14707, 3521, 4010, 6060, 3523, 14412, 6440, 16156, 1052, 7297; Payload ID: 19275 relates to Category No.: 3693, 2927, 5568, 5561; Payload ID: 19276 relates to Category No.: 9305; Payload ID: 19277 relates to Category No.: 9305, 2890; Payload ID: 19278 relates to Category No.: 9305; Payload ID: 19279 relates to Category No.: 9305; Payload ID: 19280 relates to Category No.: 9305, 2890, 14145; Payload ID: 19281 relates to Category No.: 9305, 2890, 9247, 5597, 15505; Payload ID: 19282 relates to Category No.: 9305, 9247; Payload ID: 19283 relates to Category No.: 5561, 2890, 10056, 9247, 447, 262, 9305, 14952; Payload ID: 19284 relates to Category No.: 4030, 15627, 2926; Payload ID: 19285 relates to Category No.: 2890, 6017, 4199, 4010, 14327, 6989, 1335, 279, 4202; Payload ID: 19286 relates to Category No.: 273; Payload ID: 19287 relates to Category No.: 2890, 2938, 5727, 10056, 2942, 9756, 4010, 5730, 4228, 8935, 1774, 1750; Payload ID: 19288 relates to Category No.: 2890; Payload ID: 19289 relates to Category No.: 4029, 2938, 10056, 1700, 2942, 273, 447, 1811, 1803, 4010, 6743, 4228, 11883, 1335, 4032, 2738, 1824, 16337, 9473, 5455, 15285, 2890, 4089; Payload ID: 19290 relates to Category No.: 2942, 6717; Payload ID: 19291 relates to Category No.: 9305, 1842; Payload ID: 19292 relates to Category No.: 9305, 2890, 5762; Payload ID: 19293 relates to Category No.: 9305, 9247, 12406, 14253; Payload ID: 19294 relates to Category No.: 5561, 3673; Payload ID: 19295 relates to Category No.: 5561, 3673; Payload ID: 19296 relates to Category No.: 4010; Payload ID: 19297 relates to Category No.: 12159, 5749; Payload ID: 19298 relates to Category No.: 4030, 4029, 4014, 1239, 4010, 600, 12159; Payload ID: 19299 relates to Category No.: 4030, 5561, 6717, 10056, 6617, 4008, 1792, 1811, 2890, 262, 2918; Payload ID: 19300 relates to Category No.: 5561, 6443, 3673, 2668, 3686; Payload ID: 19301 relates to Category No.: 9305, 2402, 2890; Payload ID: 19302 relates to Category No.: 9305; Payload ID: 19303 relates to Category No.: 9305, 15505; Payload ID: 19304 relates to Category No.: 9305, 9247; Payload ID: 19305 relates to Category No.: 9305, 9247; Payload ID: 19306 relates to Category No.: 9305, 9247; Payload ID: 19307 relates to Category No.: 2942; Payload ID: 19308 relates to Category No.: 9181, 9305, 2942, 5561; Payload ID: 19309 relates to Category No.: 9305; Payload ID: 19310 relates to Category No.: 9247, 9305, 7361; Payload ID: 19311 relates to Category No.: 9305, 9242, 2942, 9247, 11883; Payload ID: 19312 relates to Category No.: 9305; Payload ID: 19313 relates to Category No.: 9305, 2402; Payload ID: 19314 relates to Category No.: 9305, 7118, 6717, 10056, 7070, 4010, 6743, 7068, 10169, 7366, 11883, 15151, 5561; Payload ID: 19315 relates to Category No.: 5561, 7070, 7118, 9305, 4010, 6743, 7068, 10169, 7048, 7366, 15151; Payload ID: 19316 relates to Category No.: 7070, 7118, 9305, 4010, 10169; Payload ID: 19317 relates to Category No.: 5561, 10056; Payload ID: 19318 relates to Category No.: 5561, 10056; Payload ID: 19319 relates to Category No.: 5561, 10056; Payload ID: 19320 relates to Category No.: 11693, 9305, 2890, 5776, 10162; Payload ID: 19321 relates to Category No.: 9305, 7118, 6717, 2942, 3666, 9247, 16110, 5730; Payload ID: 19322 relates to Category No.: 9305, 2890, 2458, 9242, 2785, 2942, 7118, 16110; Payload ID: 19323 relates to Category No.: 4029, 12159, 4014, 3666, 4010, 10076, 10077, 16278, 4008; Payload ID: 19324 relates to Category No.: 4030, 4010, 1090, 4029, 12159, 5749; Payload ID: 19325 relates to Category No.: 4030, 4010, 4029, 1090; Payload ID: 19326 relates to Category No.: 4029; Payload ID: 19328 relates to Category No.: 9305, 9247; Payload ID: 19329 relates to Category No.: 4029; Payload ID: 19331 relates to Category No.: 4029, 1842; Payload ID: 19332 relates to Category No.: 4029, 7118; Payload ID: 19333 relates to Category No.: 5561, 2890; Payload ID: 19334 relates to Category No.: 4029; Payload ID: 19335 relates to Category No.: 4030, 15139, 1748, 1090, 12159, 657, 5749; Payload ID: 19336 relates to Category No.: 15139, 1748, 4030, 657; Payload ID: 19337 relates to Category No.: 4029; Payload ID: 19338 relates to Category No.: 9305, 2890, 9242, 2660; Payload ID: 19339 relates to Category No.: 5762; Payload ID: 19340 relates to Category No.: 5776, 2942, 3693, 3521, 14100, 4010, 3696, 16156, 14099, 1602, 15764, 5762; Payload ID: 19341 relates to Category No.: 5776, 2942, 3521, 14100, 6059, 14099, 1602, 5561, 5762; Payload ID: 19342 relates to Category No.: 2890, 5776, 2942, 3693, 3521, 14100, 4010, 3696, 6059, 14099, 1602, 5762; Payload ID: 19343 relates to Category No.: 12439, 2890, 2899, 3521, 6059, 5257; Payload ID: 19344 relates to Category No.: 2942, 3693, 3521, 14100, 4010, 6059, 6440, 14099, 1602, 15764, 2890, 8951; Payload ID: 19345 relates to Category No.: 12439, 6717, 4010, 3528; Payload ID: 19347 relates to Category No.: 6717, 5762, 10056, 6994, 2927, 3636, 4010, 1792, 4228, 2514, 7366; Payload ID: 19348 relates to Category No.: 6717, 5762, 10056, 6994, 3982, 997, 4010; Payload ID: 19349 relates to Category No.: 9305, 2942, 9247, 5360, 2890, 15505; Payload ID: 19350 relates to Category No.: 9305, 2890, 15505, 2942, 9247, 5360, 9015, 11883; Payload ID: 19351 relates to Category No.: 9305, 2890, 6976, 2942, 9247, 5360; Payload ID: 19352 relates to Category No.: 5561, 1099, 10056; Payload ID: 19353 relates to Category No.: 5561; Payload ID: 19354 relates to Category No.: 5561; Payload ID: 19355 relates to Category No.: 6717, 5570; Payload ID: 19356 relates to Category No.: 5561, 4010; Payload ID: 19357 relates to Category No.: 5561, 5762; Payload ID: 19358 relates to Category No.: 4030, 5561; Payload ID:

19359 relates to Category No.: 4029, 2890; Payload ID: 19360 relates to Category No.: 4029; Payload ID: 19361 relates to Category No.: 5561; Payload ID: 19362 relates to Category No.: 5561, 4029, 10056; Payload ID: 19363 relates to Category No.: 5561; Payload ID: 19364 relates to Category No.: 5561, 4008; Payload ID: 19365 relates to Category No.: 4030, 4029; Payload ID: 19366 relates to Category No.: 4029; Payload ID: 19367 relates to Category No.: 4029; Payload ID: 19368 relates to Category No.: 4029; Payload ID: 19369 relates to Category No.: 4029; Payload ID: 19370 relates to Category No.: 4029; Payload ID: 19371 relates to Category No.: 4030, 4029, 4010; Payload ID: 19372 relates to Category No.: 4029; Payload ID: 19373 relates to Category No.: 4029; Payload ID: 19374 relates to Category No.: 4029; Payload ID: 19375 relates to Category No.: 4029; Payload ID: 19376 relates to Category No.: 4029; Payload ID: 19377 relates to Category No.: 4029; Payload ID: 19378 relates to Category No.: 4029; Payload ID: 19379 relates to Category No.: 9305, 2890, 5776, 2942, 2420, 2192, 9247, 2420, 6968, 2402, 2563, 15173; Payload ID: 19380 relates to Category No.: 12439, 16269, 3521, 3982, 2183, 12440, 997, 2926, 6059, 3523, 5829; Payload ID: 19381 relates to Category No.: 2938, 15139, 273, 4228, 14378, 2890, 6017, 7118, 7070; Payload ID: 19382 relates to Category No.: 5762, 2942, 273, 6017, 4010, 14378, 14327, 1811, 3521; Payload ID: 19383 relates to Category No.: 2890, 2938, 4010, 6017; Payload ID: 19384 relates to Category No.: 2890, 6960, 4765, 2927, 3686; Payload ID: 19385 relates to Category No.: 2942, 2899, 273, 276, 14327, 269; Payload ID: 19386 relates to Category No.: 2942, 276, 269; Payload ID: 19387 relates to Category No.: 2942, 276, 269; Payload ID: 19388 relates to Category No.: 9735; Payload ID: 19389 relates to Category No.: 9305, 2942; Payload ID: 19390 relates to Category No.: 9305, 2942, 3521; Payload ID: 19391 relates to Category No.: 3521, 16156, 2890; Payload ID: 19392 relates to Category No.: 2890, 3652, 4049, 997, 9184, 923, 10104, 9162, 5412, 4042, 5762; Payload ID: 19393 relates to Category No.: 2890, 9247, 2420, 2192; Payload ID: 19394 relates to Category No.: 5762; Payload ID: 19395 relates to Category No.: 5762; Payload ID: 19396 relates to Category No.: 2938, 10056, 1720, 1046, 779, 1038; Payload ID: 19397 relates to Category No.: 9305, 2890, 9247, 15252, 1377; Payload ID: 19398 relates to Category No.: 2890, 2194; Payload ID: 19399 relates to Category No.: 4029, 2890, 2942, 1748, 4010, 1774, 10106, 7366, 276; Payload ID: 19400 relates to Category No.: 5561, 9305, 2890, 6717, 6968, 6440, 2458; Payload ID: 19401 relates to Category No.: 9242, 9247, 11715, 6043, 9609, 9305; Payload ID: 19402 relates to Category No.: 2890, 9247; Payload ID: 19403 relates to Category No.: 5561; Payload ID: 19404 relates to Category No.: 2890, 9247; Payload ID: 19405 relates to Category No.: 2890, 2938, 9247, 7244, 11728, 2458, 5796, 2455, 9098, 9998; Payload ID: 19407 relates to Category No.: 4420; Payload ID: 19409 relates to Category No.: 2890, 9247; Payload ID: 19410 relates to Category No.: 9247; Payload ID: 19411 relates to Category No.: 9305, 9242, 14671, 12284, 9184; Payload ID: 19413 relates to Category No.: 9305, 9242, 2574, 9247, 7274; Payload ID: 19414 relates to Category No.: 2890, 11728, 2183, 2455, 1046, 2441, 2896; Payload ID: 19415 relates to Category No.: 2194, 11728, 2458, 5796, 2455, 1046, 2441; Payload ID: 19416 relates to Category No.: 9242, 14671, 12284, 1842; Payload ID: 19419 relates to Category No.: 9305, 2890, 9247; Payload ID: 19420 relates to Category No.: 6440; Payload ID: 19421 relates to Category No.: 6960, 2194, 9242, 1720, 6964, 5964; Payload ID: 19422 relates to Category No.: 2942, 4755, 9734, 3696, 6960; Payload ID: 19423 relates to Category No.: 5561, 2942, 4049, 11688; Payload ID: 19424 relates to Category No.: 2942, 4049, 11688; Payload ID: 19425 relates to Category No.: 9242, 14671, 192, 1842; Payload ID: 19426 relates to Category No.: 2890, 6960; Payload ID: 19427 relates to Category No.: 6443, 9305, 5776; Payload ID: 19429 relates to Category No.: 9305, 9247, 14529, 5102, 5216, 7179, 401; Payload ID: 19432 relates to Category No.: 2890, 9242, 1842; Payload ID: 19433 relates to Category No.: 1842, 4420; Payload ID: 19435 relates to Category No.: 11883, 2890, 10056, 2660; Payload ID: 19436 relates to Category No.: 4030, 11728, 2455, 4010, 2458; Payload ID: 19437 relates to Category No.: 9305, 2890, 9247, 1691, 15532, 14642; Payload ID: 19438 relates to Category No.: 9305, 2890, 14906, 9247; Payload ID: 19442 relates to Category No.: 2890, 15151; Payload ID: 19444 relates to Category No.: 2890, 3693; Payload ID: 19445 relates to Category No.: 2942, 14906, 2514; Payload ID: 19446 relates to Category No.: 9305, 9242; Payload ID: 19447 relates to Category No.: 9242, 9247, 14354; Payload ID: 19449 relates to Category No.: 9305, 2890, 2942, 9247, 4755, 6921; Payload ID: 19451 relates to Category No.: 7118, 6960, 2194, 1720, 6964, 5964; Payload ID: 19452 relates to Category No.: 2402, 14529, 5216, 12231, 9305; Payload ID: 19453 relates to Category No.: 14912, 3696, 1635, 2890, 9305; Payload ID: 19454 relates to Category No.: 5561; Payload ID: 19456 relates to Category No.: 2890; Payload ID: 19463 relates to Category No.: 1635; Payload ID: 19464 relates to Category No.: 2942, 4049, 2890, 2938, 4765, 11687, 15573, 1001, 3696, 11688, 2504; Payload ID: 19465 relates to Category No.: 2890, 6717, 2942, 9247, 11687, 4049, 997, 11883, 11688; Payload ID: 19467 relates to Category No.: 5561, 5762, 3652, 4049; Payload ID: 19468 relates to Category No.: 9305, 2942; Payload ID: 19469 relates to Category No.: 9305, 9247, 2890; Payload ID: 19470 relates to Category No.: 9305, 2890, 9247; Payload ID: 19471 relates to Category No.: 9305, 6717, 9734; Payload ID: 19472 relates to Category No.: 5762, 2194, 9242, 9247, 7355, 9305, 8935; Payload ID: 19473 relates to Category No.: 9305, 4010; Payload ID: 19474 relates to Category No.: 2890, 9242, 1842; Payload ID: 19476 relates to Category No.: 1842, 7118; Payload ID: 19477 relates to Category No.: 5561, 4765; Payload ID: 19478 relates to Category No.: 5561; Payload ID: 19479 relates to Category No.: 9305, 2890, 9242, 9247, 9215; Payload ID: 19480 relates to Category No.: 9305, 9247, 9184, 9215, 7014; Payload ID: 19481 relates to Category No.: 9305, 447, 2903; Payload ID: 19482 relates to Category No.: 4030, 4029, 2890, 10056, 12159, 4014; Payload ID: 19483 relates to Category No.: 4030, 4029, 2890, 10056, 12159, 4010, 3671, 4763, 3638, 1792; Payload ID: 19484 relates to Category No.: 4030, 4029, 12159; Payload ID: 19485 relates to Category No.: 4030, 4029, 12159; Payload ID: 19486 relates to Category No.: 4030, 4029, 2890, 12159; Payload ID: 19487 relates to Category No.: 4029, 12159, 4030, 2890; Payload ID: 19488 relates to Category No.: 4030, 4029, 12159; Payload ID: 19489 relates to Category No.: 4030, 4029, 10056, 12159, 4010, 3671, 4763, 3638; Payload ID: 19490 relates to Category No.: 4030, 4029, 10056, 12159, 4010, 1792, 3523, 3671, 4763, 3638; Payload ID: 19491 relates to Category No.: 4030, 4029, 2890, 10056, 12159, 4010, 1792, 3671, 4763, 3638; Payload ID: 19492 relates to Category No.: 4030, 4029, 10056, 12159, 4010, 3671, 4763, 3638, 2503, 1792, 2890, 5561; Payload ID: 19493 relates to Category No.: 4030, 4029, 12159, 10056, 4010, 3671, 4763, 3638, 1792; Payload ID: 19494 relates to Category No.: 4030, 4029, 10056, 12159, 4010, 3671, 4763, 3638, 1792; Payload ID: 19495 relates to Category No.: 4030, 4029, 10056, 12159, 4010, 3671, 4763, 3638, 1792; Payload ID: 19496 relates to Category No.: 4030, 4029, 10056, 12159, 4010, 3671, 4763, 3638; Payload ID: 19497 relates to Category No.: 4030, 4029, 12159; Payload ID: 19498 relates to Category No.: 4030, 4029, 12159; Payload ID: 19499 relates to Category No.: 4030, 4029, 12159, 4010; Payload ID: 19500 relates to Category No.: 4029, 4030, 12159; Payload ID: 19501 relates to Category No.: 2942, 273, 4010, 1811, 5762, 16164; Payload ID: 19502 relates to Category No.: 9305, 10056, 2942, 2899, 273, 4010, 3638, 6017, 268, 4765; Payload ID: 19503 relates to Category No.: 2890; Payload ID: 19504 relates to Category No.: 2890, 10056; Payload ID: 19505 relates to Category No.: 2890, 1182, 447; Payload ID: 19506 relates to Category No.: 1182, 2890; Payload ID: 19507 relates to Category No.: 4029; Payload ID: 19508 relates to Category No.: 12159, 4030, 4029, 2890; Payload ID: 19509 relates to Category No.: 4030, 4029, 12159, 4010, 10056; Payload ID: 19510 relates to Category No.: 4030, 4029, 12159; Payload ID: 19511 relates to Category No.: 5561, 10056, 4765, 2899, 4755, 15573, 3521, 4010, 3523, 3638, 2926, 3040, 3037; Payload ID: 19512 relates to Category No.: 9305, 2890, 9247, 2420; Payload ID: 19513 relates to Category No.: 9305, 9247, 2420; Payload ID: 19514 relates to Category No.: 3673, 3666, 3036, 5557, 11836, 5561; Payload ID: 19515 relates to Category No.: 5561; Payload ID: 19516 relates to Category No.: 5561; Payload ID: 19517 relates to Category No.: 9305, 2890, 2942, 9734, 14329, 11883; Payload ID: 19518 relates to Category No.: 2942; Payload ID: 19519 relates to Category No.: 1842, 5561; Payload ID: 19520 relates to Category No.: 9305, 2890, 9247, 14912, 9215; Payload ID: 19521 relates to Category No.: 5561; Payload ID: 19522 relates to Category No.: 9157; Payload ID: 19523 relates to Category No.: 9305, 10056, 9247, 9215, 14912; Payload ID: 19524 relates to Category No.: 9305; Payload ID: 19525 relates to Category No.: 9305, 9247, 9215, 14912; Payload ID: 19526 relates to Category No.: 9305, 10056, 2942, 15892, 4010; Payload ID: 19527 relates to Category No.: 9305, 2890, 6717, 15892, 4010; Payload ID: 19528 relates to Category No.: 9305, 7118, 2890, 10056, 2942, 4755, 6989, 14253; Payload ID: 19529 relates to Category No.: 9305, 2890, 2942, 9247, 15505; Payload ID: 19530 relates to Category No.: 2942; Payload ID: 19536 relates to Category No.: 4030, 2942, 9756, 14368; Payload ID: 19537 relates to Category No.: 5561, 9305, 2890, 2942, 3673, 3666, 9247, 5557; Payload ID: 19538 relates to Category No.: 5561, 2890, 10056, 5570, 4755; Payload ID: 19539 relates to Category No.: 9305, 5597, 2890, 9247, 4755, 3358; Payload ID: 19540 relates to Category No.: 9305, 2890, 10056, 9242, 9247, 4010, 9299, 16314; Payload ID: 19541 relates to Category No.: 5570, 5561; Payload ID: 19542 relates to Category No.: 9305, 7118, 2942; Payload ID: 19543 relates to Category No.: 1748; Payload ID: 19544 relates to Category No.: 1748, 16326; Payload ID: 19545 relates to Category No.: 5561, 10056; Payload ID: 19546 relates to Category No.: 5561, 6717; Payload ID: 19547 relates to Category No.: 5561; Payload ID: 19548 relates to Category No.: 5561, 6717; Payload ID: 19549 relates to Category No.: 5561, 6717; Payload ID: 19550 relates to Category No.: 5561, 10056; Payload ID: 19551 relates to Category No.: 5561, 6717; Payload ID: 19552 relates to Category No.: 5561, 10056; Payload ID: 19553 relates to Category No.: 9305, 2890, 2942, 9247; Payload ID: 19554 relates to Category No.: 5561, 10056, 1700; Payload ID: 19555 relates to Category No.: 9305, 6717, 5762, 9247, 1635, 12218, 1634, 11719, 11647; Payload ID: 19556 relates to Category No.: 2890, 4010; Payload ID: 19557 relates to Category No.: 6717, 10056, 677, 4010; Payload ID: 19558 relates to Category No.: 7118, 4010; Payload ID: 19559 relates to Category No.: 9305, 2890; Payload ID: 19560 relates to Category No.: 9305, 9247; Payload ID: 19561 relates to Category No.: 2890, 2194, 13728, 9247, 12368; Payload ID: 19562 relates to Category No.: 9305, 7118, 2890, 13728, 9247, 9734, 12368, 12369; Payload ID: 19563 relates to Category No.: 9305, 2194, 2942, 9247, 1748, 9095, 3389, 3332; Payload ID: 19564 relates to Category No.: 9305, 6717, 10056, 9242, 2942, 9247, 9218, 5976, 9158, 15269, 9095, 2890; Payload ID: 19565 relates to Category No.: 9305, 6717, 15505, 2942, 9247, 9218, 5976, 9158, 15269, 9095; Payload ID: 19566 relates to Category No.: 3389; Payload ID: 19568 relates to Category No.: 6443; Payload ID: 19570 relates to Category No.: 5561, 6717, 6942; Payload ID: 19571 relates to Category No.: 5561, 6717, 6942, 15219; Payload ID: 19574 relates to Category No.: 11988; Payload ID: 19575 relates to Category No.: 5561; Payload ID: 19576 relates to Category No.: 5561, 3673; Payload ID: 19577 relates to Category No.: 5561, 4765, 4014, 4755, 4760; Payload ID: 19578 relates to Category No.: 5561, 4029, 6717, 4765, 3673; Payload ID: 19579 relates to Category No.: 5561, 6717, 4765, 3673, 1842; Payload ID: 19580 relates to Category No.: 2890, 2942, 4010; Payload ID: 19581 relates to Category No.: 9305, 2890, 5776, 14145, 9247, 4010, 9184, 2920, 15848, 2757, 5222, 3036, 9734, 6813; Payload ID: 19582 relates to Category No.: 9305, 2890, 9242, 14145, 10162; Payload ID: 19583 relates to Category No.: 9305, 2890, 1182, 9734, 14145, 10162; Payload ID: 19585 relates to Category No.: 9305, 9247, 7118; Payload ID: 19587 relates to Category No.: 401, 9305, 7161; Payload ID: 19588 relates to Category No.: 2890, 9242, 9247, 9153, 9181, 9305; Payload ID: 19589 relates to Category No.: 2890, 10056, 4043, 6976, 2942, 4755, 4010, 4228, 276; Payload ID: 19590 relates to Category No.: 9305, 2890, 2942, 9247, 1748, 6717, 15505; Payload ID: 19591 relates to Category No.: 5561, 6717, 15627; Payload ID: 19592 relates to Category No.: 5561, 6717, 15627; Payload ID: 19593 relates to Category No.: 5561, 5776, 10056, 9247, 15627, 4755; Payload ID: 19594 relates to Category No.: 5561, 6717, 5776, 10056, 3666, 4755; Payload ID: 19595 relates to Category No.: 5561, 6717, 3673, 4760, 3831, 3669, 9193; Payload ID: 19596 relates to Category No.: 5561, 6717, 3666, 15573, 2477, 3831; Payload ID: 19597 relates to Category No.: 5561, 6717, 3673; Payload ID: 19598 relates to Category No.: 5561, 6976, 5776, 4755, 4765, 3673, 3685; Payload ID: 19599 relates to Category No.: 5561; Payload ID: 19600 relates to Category No.: 9305; Payload ID: 19601 relates to Category No.: 9242; Payload ID: 19602 relates to Category No.: 9242; Payload ID: 19603 relates to Category No.: 9242; Payload ID: 19606 relates to Category No.: 7118, 2890, 2942, 4765, 5570, 3693, 3666, 4755, 2927, 14707, 4010, 5561, 6717, 8948, 775, 1097, 1700; Payload ID: 19607 relates to Category No.: 9305, 2890, 9247, 9215; Payload ID: 19608 relates to Category No.: 5561, 6717, 7048, 7118; Payload ID: 19610 relates to Category No.: 7118, 6717; Payload ID: 19611 relates to Category No.: 9305, 9247, 9155; Payload ID: 19612 relates to Category No.: 2890, 3666; Payload ID: 19613 relates to Category No.: 2890; Payload ID: 19614 relates to Category No.: 2903; Payload ID: 19616 relates to Category No.: 9305, 2890, 9247; Payload ID: 19617 relates to Category No.: 9305, 2890; Payload ID: 19618 relates to Category No.: 9305, 5466, 9181, 15505, 9603, 2890; Payload ID: 19619 relates to Category No.: 9305; Payload ID: 19621 relates to Category No.: 9305, 2890, 2942; Payload ID: 19622 relates to Category No.: 2890, 10056, 2942, 4043, 6743, 5392, 15206, 1811, 6717; Payload ID: 19623 relates to Category No.: 9305, 5762; Payload ID: 19624 relates to Category No.: 9305, 5762; Payload ID: 19625 relates to Category No.: 9305; Payload ID: 19626 relates to Category No.: 9305, 5762; Payload ID: 19627 relates to Category No.: 9305, 1842; Payload ID: 19628 relates to Category No.: 5762, 9305; Payload ID: 19629 relates to Category No.: 2942, 9305, 2890; Payload ID: 19630 relates to Category No.: 9305, 2942, 2890; Payload ID: 19631 relates to Category No.: 9305, 2890; Payload ID: 19632 relates to Category No.: 9305, 5762; Payload ID: 19634 relates to Category No.: 9305, 2890, 11883; Payload ID: 19635 relates to Category No.: 5762, 9305, 9172; Payload ID: 19636 relates to Category No.: 9305; Payload ID: 19637 relates to Category No.: 9305; Payload ID: 19638 relates to Category No.: 9305, 5762; Payload ID: 19639 relates to Category No.: 9305, 5762; Payload ID: 19640 relates to Category No.: 9305, 5762; Payload ID: 19641 relates to Category No.: 5762, 9305; Payload ID: 19642 relates to Category No.: 9305; Payload ID: 19644 relates to Category No.: 9305, 5762; Payload ID: 19646 relates to Category No.: 9305, 2890, 9247; Payload ID: 19647 relates to Category No.: 9305, 2890; Payload ID: 19648 relates to Category No.: 9305, 2890, 9247; Payload ID: 19649 relates to Category No.: 9305; Payload ID: 19650 relates to Category No.: 9305; Payload ID: 19651 relates to Category No.: 6717, 10056, 8935, 15139, 224; Payload ID: 19652 relates to Category No.: 6443, 6717, 2942, 3693, 1748, 15161; Payload ID: 19653 relates to Category No.: 2890, 10056, 1748, 2927, 11723, 3696, 11883, 6440; Payload ID: 19654 relates to Category No.: 10056, 5570; Payload ID: 19655 relates to Category No.: 5561, 2890; Payload ID: 19656 relates to Category No.: 9756, 7118; Payload ID: 19657 relates to Category No.: 9305, 14145; Payload ID: 19658 relates to Category No.: 9305, 15848; Payload ID: 19659 relates to Category No.: 2942, 9247; Payload ID: 19660 relates to Category No.: 9305, 9247, 9155; Payload ID: 19661 relates to Category No.: 9247; Payload ID: 19662 relates to Category No.: 9247; Payload ID: 19663 relates to Category No.: 9305; Payload ID: 19664 relates to Category No.: 9305, 2890, 9247; Payload ID: 19665 relates to Category No.: 9305, 9242, 15531, 9155, 10104, 9215, 2942, 10056; Payload ID: 19666 relates to Category No.: 9247, 9305; Payload ID: 19667 relates to Category No.: 9305, 9247, 9158, 6968, 5597; Payload ID: 19668 relates to Category No.: 9305; Payload ID: 19669 relates to Category No.: 9305, 9247; Payload ID: 19670 relates to Category No.: 9305; Payload ID: 19671 relates to Category No.: 9305; Payload ID: 19672 relates to Category No.: 9305; Payload ID: 19673 relates to Category No.: 2890, 9247; Payload ID: 19674 relates to Category No.: 2890, 9247, 1842; Payload ID: 19675 relates to Category No.: 9305; Payload ID: 19676 relates to Category No.: 9305, 9247, 9158; Payload ID: 19677 relates to Category No.: 9305, 2890, 10056, 9242, 9247; Payload ID: 19678 relates to Category No.: 9247; Payload ID: 19679 relates to Category No.: 9305; Payload ID: 19680 relates to Category No.: 9305, 2420, 1239; Payload ID: 19681 relates to Category No.: 9305; Payload ID: 19682 relates to Category No.: 9305, 2420; Payload ID: 19683 relates to Category No.: 9305; Payload ID: 19684 relates to Category No.: 9305; Payload ID: 19685 relates to Category No.: 9305, 2890, 9247; Payload ID: 19686 relates to Category No.: 9305; Payload ID: 19687 relates to Category No.: 9305; Payload ID: 19688 relates to Category No.: 9305; Payload ID: 19689 relates to Category No.: 9305; Payload ID: 19690 relates to Category No.: 9305; Payload ID: 19691 relates to Category No.: 2890, 9247; Payload ID: 19692 relates to Category No.: 9305, 2890; Payload ID: 19693 relates to Category No.: 9305; Payload ID: 19694 relates to Category No.: 9305; Payload ID: 19695 relates to Category No.: 9305; Payload ID: 19696 relates to Category No.: 9305, 9247; Payload ID: 19698 relates to Category No.: 9305, 9247, 4010, 15732; Payload ID: 19699 relates to Category No.: 9305, 1842; Payload ID: 19700 relates to Category No.: 9305; Payload ID: 19701 relates to Category No.: 9305; Payload ID: 19702 relates to Category No.: 9305; Payload ID: 19703 relates to Category No.: 9305, 9247; Payload ID: 19704 relates to Category No.: 9305; Payload ID: 19705 relates to Category No.: 9305; Payload ID: 19706 relates to Category No.: 9305; Payload ID: 19707 relates to Category No.: 9247, 9305; Payload ID: 19708 relates to Category No.: 9247; Payload ID: 19709 relates to Category No.: 9305; Payload ID: 19710 relates to Category No.: 9305; Payload ID: 19711 relates to Category No.: 9305, 4010; Payload ID: 19712 relates to Category No.: 9305; Payload ID: 19713 relates to Category No.: 9305; Payload ID: 19714 relates to Category No.: 9305; Payload ID: 19715 relates to Category No.: 9305; Payload ID: 19716 relates to Category No.: 9305; Payload ID: 19717 relates to Category No.: 9305; Payload ID: 19718 relates to Category No.: 9305, 9158, 15269; Payload ID: 19719 relates to Category No.: 9305; Payload ID: 19720 relates to Category No.: 9305; Payload ID: 19721 relates to Category No.: 9305; Payload ID: 19722 relates to Category No.: 9305; Payload ID: 19724 relates to Category No.: 5762, 15501; Payload ID: 19725 relates to Category No.: 2890, 10056, 9247; Payload ID: 19727 relates to Category No.: 1842; Payload ID: 19728 relates to Category No.: 9305, 2890, 2903; Payload ID: 19729 relates to Category No.: 9247, 9215; Payload ID: 19730 relates to Category No.: 9305, 2890, 9242, 9247, 9215; Payload ID: 19731 relates to Category No.: 2890, 9242; Payload ID: 19732 relates to Category No.: 9247; Payload ID: 19733 relates to Category No.: 9305, 7274; Payload ID: 19735 relates to Category No.: 1842; Payload ID: 19736 relates to Category No.: 9305; Payload ID: 19737 relates to Category No.: 9305; Payload ID: 19738 relates to Category No.: 9305, 15497, 1377, 15532, 5200; Payload ID: 19739 relates to Category No.: 9305, 2890, 4755, 6443, 6059; Payload ID: 19741 relates to Category No.: 9247, 15848; Payload ID: 19742 relates to Category No.: 9305, 2890, 9247, 15505; Payload ID: 19743 relates to Category No.: 9305; Payload ID: 19744 relates to Category No.: 9305, 5762; Payload ID: 19745 relates to Category No.: 5762; Payload ID: 19746 relates to Category No.: 9305; Payload ID: 19747 relates to Category No.: 9305, 2890, 15505, 5776, 9242, 9247, 9155, 7118; Payload ID: 19748 relates to Category No.: 9305; Payload ID: 19749 relates to Category No.: 5762, 9305; Payload ID: 19750 relates to Category No.: 9305, 5762; Payload ID: 19751 relates to Category No.: 9305, 5762; Payload ID: 19752 relates to Category No.: 9242, 2942, 6717; Payload ID: 19753 relates to Category No.: 9305, 1842, 5762; Payload ID: 19754 relates to Category No.: 9305, 5762; Payload ID: 19755 relates to Category No.: 9305, 4010, 5762; Payload ID: 19756 relates to Category No.: 9305; Payload ID: 19757 relates to Category No.: 9305, 5762, 2194, 9247; Payload ID: 19758 relates to Category No.: 9305; Payload ID: 19759 relates to Category No.: 9305, 5762; Payload ID: 19760 relates to Category No.: 9305; Payload ID: 19761 relates to Category No.: 9305, 5762; Payload ID: 19762 relates to Category No.: 9305, 5762; Payload ID: 19763 relates to Category No.: 9305; Payload ID: 19764 relates to Category No.: 9305, 5762; Payload ID: 19765 relates to Category No.: 9305, 5762; Payload ID: 19766 relates to Category No.: 5762, 9305, 5561; Payload ID: 19767 relates to Category No.: 9305, 5762; Payload ID: 19768 relates to Category No.: 9305, 5762; Payload ID: 19769 relates to Category No.: 5762, 9305; Payload ID: 19770 relates to Category No.: 9305, 1842; Payload ID: 19771 relates to Category No.: 9247; Payload ID: 19772 relates to Category No.: 9305, 2890, 9242; Payload ID: 19773 relates to Category No.: 9247, 4755, 9305; Payload ID: 19774 relates to Category No.: 9305, 5762, 9247; Payload ID: 19775 relates to Category No.: 5762, 9305; Payload ID: 19776 relates to Category No.: 9305, 5762; Payload ID: 19777 relates to Category No.: 9305; Payload ID: 19778 relates to Category No.: 9305, 5762; Payload ID: 19779 relates to Category No.: 9305; Payload ID: 19780 relates to Category No.: 9305, 5762; Payload ID: 19781 relates to Category No.: 9305, 5762; Payload ID: 19782 relates to Category No.: 9305, 2890, 9247, 273; Payload ID: 19783 relates to Category No.: 2890, 5762, 9247, 5730; Payload ID: 19784 relates to Category No.: 9305, 5762, 1239; Payload ID: 19785 relates to Category No.: 9305, 5762; Payload ID: 19786 relates to Category No.: 9305, 5762; Payload ID: 19787 relates to Category No.: 5762, 9305; Payload ID: 19788 relates to Category No.: 9305, 5762; Payload ID: 19789 relates to Category No.: 9305, 5762; Payload ID: 19790 relates to Category No.: 2890, 10056, 273, 4228; Payload ID: 19791 relates to Category No.: 9305, 5762; Payload ID: 19792 relates to Category No.: 5762, 9305; Payload ID: 19793 relates to Category No.: 5762, 9305; Payload ID: 19794 relates to Category No.: 9305, 5762; Payload ID: 19795 relates to Category No.: 5762, 9305; Payload ID: 19796 relates to Category No.: 5762, 9305; Payload ID: 19797 relates to Category No.: 9305; Payload ID: 19798 relates to Category No.: 9305, 7118, 5762, 9247; Payload ID: 19799 relates to Category No.: 9305, 5762; Payload ID: 19800 relates to Category No.: 9305, 6960, 9242, 2630, 5964, 14901; Payload ID: 19801 relates to Category No.: 5762, 9305; Payload ID: 19802 relates to Category No.: 5762, 9247; Payload ID: 19803 relates to Category No.: 9305, 5762; Payload ID: 19804 relates to Category No.: 9305, 5762; Payload ID: 19805 relates to Category No.: 9305, 5762; Payload ID: 19806 relates to Category No.: 9305, 5762; Payload ID: 19807 relates to Category No.: 9247, 5110; Payload ID: 19808 relates to Category No.: 5561, 9305; Payload ID: 19809 relates to Category No.: 9305, 9247; Payload ID: 19810 relates to Category No.: 5762; Payload ID: 19811 relates to Category No.: 5762, 9305; Payload ID: 19812 relates to Category No.: 9305, 5762; Payload ID: 19813 relates to Category No.: 5762, 9305, 9247, 9184, 15531; Payload ID: 19814 relates to Category No.: 5762, 9305; Payload ID: 19815 relates to Category No.: 5762, 9305; Payload ID: 19816 relates to Category No.: 9305, 5762; Payload ID: 19817 relates to Category No.: 5762, 9305; Payload ID: 19818 relates to Category No.: 9305, 5762; Payload ID: 19819 relates to Category No.: 9305, 5762; Payload ID: 19820 relates to Category No.: 9305; Payload ID: 19821 relates to Category No.: 5762, 9305; Payload ID: 19822 relates to Category No.: 9305, 5762; Payload ID: 19823 relates to Category No.: 5762, 9305; Payload ID: 19824 relates to Category No.: 9305; Payload ID: 19825 relates to Category No.: 9305; Payload ID: 19826 relates to Category No.: 9305, 9247; Payload ID: 19827 relates to Category No.: 5762, 9305; Payload ID: 19828 relates to Category No.: 9305, 5762; Payload ID: 19829 relates to Category No.: 5762, 9305; Payload ID: 19830 relates to Category No.: 9305, 5762; Payload ID: 19831 relates to Category No.: 9305, 5762; Payload ID: 19832 relates to Category No.: 5762, 9305; Payload ID: 19833 relates to Category No.: 9305, 5762, 9247; Payload ID: 19834 relates to Category No.: 5762, 9305; Payload ID: 19835 relates to Category No.: 5762, 9305; Payload ID: 19836 relates to Category No.: 2890, 9247; Payload ID: 19837 relates to Category No.: 9305, 2890, 5762, 9247, 6968; Payload ID: 19838 relates to Category No.: 9305, 5762; Payload ID: 19839 relates to Category No.: 9305, 5762; Payload ID: 19840 relates to Category No.: 9305, 5762; Payload ID: 19841 relates to Category No.: 9305, 2890, 5762, 273; Payload ID: 19842 relates to Category No.: 9305, 5762; Payload ID: 19843 relates to Category No.: 9305, 2890, 5762, 2194, 9242, 9247; Payload ID: 19844 relates to Category No.: 9305; Payload ID: 19845 relates to Category No.: 9305; Payload ID: 19846 relates to Category No.: 9305; Payload ID: 19847 relates to Category No.: 9305, 5762; Payload ID: 19848 relates to Category No.: 9305; Payload ID: 19849 relates to Category No.: 9305; Payload ID: 19850 relates to Category No.: 9305; Payload ID: 19851 relates to Category No.: 9305; Payload ID: 19852 relates to Category No.: 9305, 9247; Payload ID: 19853 relates to Category No.: 9305, 5762; Payload ID: 19854 relates to Category No.: 9305, 5762; Payload ID: 19855 relates to Category No.: 9305, 5762; Payload ID: 19856 relates to Category No.: 9305, 5762; Payload ID: 19857 relates to Category No.: 9305, 5762, 5561; Payload ID: 19858 relates to Category No.: 9305; Payload ID: 19859 relates to Category No.: 9305, 5762; Payload ID: 19860 relates to Category No.: 9305; Payload ID: 19861 relates to Category No.: 9305, 1842; Payload ID: 19862 relates to Category No.: 9305, 5762; Payload ID: 19863 relates to Category No.: 9305, 5762; Payload ID: 19864 relates to Category No.: 5762, 9305; Payload ID: 19865 relates to Category No.: 5762, 9305; Payload ID: 19866 relates to Category No.: 5762, 9247; Payload ID: 19867 relates to Category No.: 9305, 5762; Payload ID: 19868 relates to Category No.: 9305, 5762; Payload ID: 19869 relates to Category No.: 9305, 5762; Payload ID: 19870 relates to Category No.: 2890, 9247, 9305; Payload ID: 19871 relates to Category No.: 9305; Payload ID: 19872 relates to Category No.: 9305; Payload ID: 19873 relates to Category No.: 5762, 9305; Payload ID: 19874 relates to Category No.: 9305, 2890, 2194; Payload ID: 19875 relates to Category No.: 9305, 5762; Payload ID: 19876 relates to Category No.: 9305, 5762; Payload ID: 19877 relates to Category No.: 9305, 5776, 9247, 2976, 14912, 9181; Payload ID: 19878 relates to Category No.: 9305; Payload ID: 19879 relates to Category No.: 9305, 9242, 2420, 2192, 6994; Payload ID: 19880 relates to Category No.: 9305, 5762; Payload ID: 19881 relates to Category No.: 5762, 9305; Payload ID: 19882 relates to Category No.: 9305, 5762; Payload ID: 19883 relates to Category No.: 9305, 5216; Payload ID: 19884 relates to Category No.: 9305, 5762; Payload ID: 19885 relates to Category No.: 9305, 5762; Payload ID: 19886 relates to Category No.: 5762, 9305; Payload ID: 19887 relates to Category No.: 9305, 5762; Payload ID: 19888 relates to Category No.: 9305; Payload ID: 19889 relates to Category No.: 9305, 5762; Payload ID: 19890 relates to Category No.: 9305; Payload ID: 19891 relates to Category No.: 9305, 9247, 2890, 9242; Payload ID: 19892 relates to Category No.: 9305, 5762; Payload ID: 19893 relates to Category No.: 9305, 1700, 9734; Payload ID: 19894 relates to Category No.: 9305, 5762, 9247, 15531, 9181; Payload ID: 19895 relates to Category No.: 9305, 5762; Payload ID: 19896 relates to Category No.: 9305, 5762; Payload ID: 19897 relates to Category No.: 2890, 5762, 9184, 9305; Payload ID: 19898 relates to Category No.: 9305; Payload ID: 19899 relates to Category No.: 9305; Payload ID: 19900 relates to Category No.: 2890, 6976; Payload ID: 19901 relates to Category No.: 9305; Payload ID: 19902 relates to Category No.: 9305, 9247; Payload ID: 19903 relates to Category No.: 9305, 5762; Payload ID: 19904 relates to Category No.: 5762, 9247, 9305; Payload ID: 19905 relates to Category No.: 9305, 2890, 5762; Payload ID: 19906 relates to Category No.: 9305, 4228; Payload ID: 19907 relates to Category No.: 2890, 9242, 8948, 3036, 9157; Payload ID: 19908 relates to Category No.: 9305; Payload ID: 19910 relates to Category No.: 9305; Payload ID: 19911 relates to Category No.: 9305; Payload ID: 19912 relates to Category No.: 9305, 2890, 5762, 9247; Payload ID: 19913 relates to Category No.: 9305, 2890; Payload ID: 19914 relates to Category No.: 9305, 2890; Payload ID: 19915 relates to Category No.: 9305, 2890; Payload ID: 19916 relates to Category No.: 9305, 5762; Payload ID: 19917 relates to Category No.: 9305, 5762; Payload ID: 19918 relates to Category No.: 9305; Payload ID: 19919 relates to Category No.: 9305; Payload ID: 19920 relates to Category No.: 9305, 5762; Payload ID: 19921 relates to Category No.: 9305; Payload ID: 19922 relates to Category No.: 9305; Payload ID: 19923 relates to Category No.: 5762, 2890, 9242, 6968; Payload ID: 19924 relates to Category No.: 9305, 5762; Payload ID: 19925 relates to Category No.: 5762, 9305; Payload ID: 19926 relates to Category No.: 5762, 9247; Payload ID: 19927 relates to Category No.: 5762, 9247; Payload ID: 19928 relates to Category No.: 5762, 9305, 4010; Payload ID: 19929 relates to Category No.: 9305; Payload ID: 19930 relates to Category No.: 9305, 2890, 5762; Payload ID: 19931 relates to Category No.: 9305, 5762; Payload ID: 19933 relates to Category No.: 9305, 5762; Payload ID: 19934 relates to Category No.: 9305, 5762; Payload ID: 19935 relates to Category No.: 9305, 5762; Payload ID: 19936 relates to Category No.: 5762, 9305; Payload ID: 19937 relates to Category No.: 9305, 5762; Payload ID: 19938 relates to Category No.: 9305, 5762; Payload ID: 19939 relates to Category No.: 2890, 5762, 9247; Payload ID: 19940 relates to Category No.: 9305, 2890, 9247; Payload ID: 19941 relates to Category No.: 5762, 9305; Payload ID: 19942 relates to Category No.: 5762, 9305; Payload ID: 19943 relates to Category No.: 9305, 5762; Payload ID: 19944 relates to Category No.: 5762, 9305; Payload ID: 19945 relates to Category No.: 9305, 5762; Payload ID: 19946 relates to Category No.: 9305, 5762; Payload ID: 19947 relates to Category No.: 9305; Payload ID: 19948 relates to Category No.: 9305, 5762, 4010; Payload ID: 19949 relates to Category No.: 9305, 5762, 4030; Payload ID: 19950 relates to Category No.: 9305; Payload ID: 19951 relates to Category No.: 5762, 9247; Payload ID: 19952 relates to Category No.: 9305, 5561; Payload ID: 19953 relates to Category No.: 9305, 5762; Payload ID: 19954 relates to Category No.: 9305, 5762; Payload ID: 19955 relates to Category No.: 5762, 9305; Payload ID: 19956 relates to Category No.: 9305; Payload ID: 19957 relates to Category No.: 9305; Payload ID: 19958 relates to Category No.: 9305, 5762; Payload ID: 19959 relates to Category No.: 9305; Payload ID: 19960 relates to Category No.: 5762, 9247; Payload ID: 19961 relates to Category No.: 9305, 5762; Payload ID: 19962 relates to Category No.: 5762, 9247, 1377; Payload ID: 19964 relates to Category No.: 9305, 5762; Payload ID: 19965 relates to Category No.: 9305; Payload ID: 19966 relates to Category No.: 2890, 5762, 9247; Payload ID: 19967 relates to Category No.: 9305, 5762; Payload ID: 19968 relates to Category No.: 9305, 5762; Payload ID: 19969 relates to Category No.: 9305, 5762; Payload ID: 19970 relates to Category No.: 5762, 9305, 4010; Payload ID: 19971 relates to Category No.: 5762, 9305; Payload ID: 19972 relates to Category No.: 9305; Payload ID: 19973 relates to Category No.: 9305, 5762; Payload ID: 19974 relates to Category No.: 9305; Payload ID: 19975 relates to Category No.: 9305, 5762; Payload ID: 19976 relates to Category No.: 5762, 9305; Payload ID: 19977 relates to Category No.: 9305, 5762, 9155; Payload ID: 19978 relates to Category No.: 9305; Payload ID: 19979 relates to Category No.: 9305, 5762; Payload ID: 19980 relates to Category No.: 9305; Payload ID: 19981 relates to Category No.: 9305; Payload ID: 19982 relates to Category No.: 9305; Payload ID: 19983 relates to Category No.: 5762, 9242; Payload ID: 19984 relates to Category No.: 9305; Payload ID: 19985 relates to Category No.: 9305, 5762; Payload ID: 19986 relates to Category No.: 9305; Payload ID: 19987 relates to Category No.: 9305, 9247; Payload ID: 19988 relates to Category No.: 9305; Payload ID: 19989 relates to Category No.: 9305; Payload ID: 19990 relates to Category No.: 9305, 5762; Payload ID: 19991 relates to Category No.: 9305; Payload ID: 19992 relates to Category No.: 9305, 5762; Payload ID: 19993 relates to Category No.: 9305; Payload ID: 19994 relates to Category No.: 9305; Payload ID: 19995 relates to Category No.: 5762, 9305; Payload ID: 19996 relates to Category No.: 9305; Payload ID: 19997 relates to Category No.: 9305; Payload ID: 19998 relates to Category No.: 5762, 14174; Payload ID: 19999 relates to Category No.: 9305; Payload ID: 20000 relates to Category No.: 5762, 9305; Payload ID: 20001 relates to Category No.: 5762, 9305; Payload ID: 20002 relates to Category No.: 9305, 5762; Payload ID: 20003 relates to Category No.: 5762, 9305; Payload ID: 20004 relates to Category No.: 9305; Payload ID: 20005 relates to Category No.: 5762, 9305; Payload ID: 20006 relates to Category No.: 9305; Payload ID: 20007 relates to Category No.: 9305, 2890, 5762, 5776, 9247; Payload ID: 20008 relates to Category No.: 9305, 5110; Payload ID: 20009 relates to Category No.: 9305, 5762; Payload ID: 20010 relates to Category No.: 5762, 9305; Payload ID: 20011 relates to Category No.: 5762, 5561; Payload ID: 20012 relates to Category No.: 9305, 5762; Payload ID: 20013 relates to Category No.: 5762, 9247; Payload ID: 20014 relates to Category No.: 5762, 9247; Payload ID: 20015 relates to Category No.: 5762, 9305; Payload ID: 20016 relates to Category No.: 5762, 9247; Payload ID: 20017 relates to Category No.: 5762, 9247; Payload ID: 20018 relates to Category No.: 9305, 5762; Payload ID: 20019 relates to Category No.: 9305, 5762; Payload ID: 20020 relates to Category No.: 5762, 9305; Payload ID: 20021 relates to Category No.: 9305, 5762; Payload ID: 20022 relates to Category No.: 9305, 5762, 1842; Payload ID: 20023 relates to Category No.: 5762, 9305; Payload ID: 20024 relates to Category No.: 9305, 5762; Payload ID: 20025 relates to Category No.: 5762, 9247; Payload ID: 20026 relates to Category No.: 9305, 5762; Payload ID: 20027 relates to Category No.: 9305, 5762; Payload ID: 20028 relates to Category No.: 5762, 9247; Payload ID: 20029 relates to Category No.: 9305, 5762; Payload ID: 20030 relates to Category No.: 5561, 9305, 5762; Payload ID: 20031 relates to Category No.: 5762, 9247; Payload ID: 20032 relates to Category No.: 5762, 9305; Payload ID: 20033 relates to Category No.: 9305, 5762; Payload ID: 20034 relates to Category No.: 9305, 5762; Payload ID: 20035 relates to Category No.: 5762, 9247; Payload ID: 20036 relates to Category No.: 5762, 16187, 9305; Payload ID: 20037 relates to Category No.: 9305; Payload ID: 20038 relates to Category No.: 9305, 5762; Payload ID: 20039 relates to Category No.: 9305; Payload ID: 20040 relates to Category No.: 9305; Payload ID: 20041 relates to Category No.: 9305; Payload ID: 20042 relates to Category No.: 5762, 9305; Payload ID: 20043 relates to Category No.: 9305, 5762; Payload ID: 20044 relates to Category No.: 9305; Payload ID: 20045 relates to Category No.: 9305; Payload ID: 20046 relates to Category No.: 9305; Payload ID: 20047 relates to Category No.: 5762, 9305; Payload ID: 20048 relates to Category No.: 5762, 9247; Payload ID: 20049 relates to Category No.: 5762, 9247; Payload ID: 20050 relates to Category No.: 5762, 9305; Payload ID: 20051 relates to Category No.: 9305, 5762; Payload ID: 20052 relates to Category No.: 9247, 5762; Payload ID: 20053 relates to Category No.: 9305, 5762; Payload ID: 20054 relates to Category No.: 5762, 9247; Payload ID: 20055 relates to Category No.: 9305, 5762; Payload ID: 20056 relates to Category No.: 9247; Payload ID: 20057 relates to Category No.: 9305, 9242; Payload ID: 20058 relates to Category No.: 9305; Payload ID: 20059 relates to Category No.: 5762; Payload ID: 20060 relates to Category No.: 5762, 9305; Payload ID: 20061 relates to Category No.: 9305, 5762; Payload ID: 20063 relates to Category No.: 9305, 5762; Payload ID: 20064 relates to Category No.: 9305, 5762; Payload ID: 20065 relates to Category No.: 9305, 5762; Payload ID: 20066 relates to Category No.: 2890, 5762, 9247; Payload ID: 20067 relates to Category No.: 9305, 5762; Payload ID: 20069 relates to Category No.: 9305; Payload ID: 20070 relates to Category No.: 9305, 5762; Payload ID: 20071 relates to Category No.: 5762, 9305; Payload ID: 20072 relates to Category No.: 5762, 9247; Payload ID: 20073 relates to Category No.: 9305, 5762, 1842; Payload ID: 20074 relates to Category No.: 9305, 5762; Payload ID: 20075 relates to Category No.: 9305, 5762; Payload ID: 20076 relates to Category No.: 9305; Payload ID: 20077 relates to Category No.: 9305, 5762; Payload ID: 20078 relates to Category No.: 5762, 9305; Payload ID: 20079 relates to Category No.: 9305, 5762; Payload ID: 20080 relates to Category No.: 2890, 9242, 4755, 2947, 11715, 6043; Payload ID: 20081 relates to Category No.: 9305; Payload ID: 20082 relates to Category No.: 9305, 5762; Payload ID: 20083 relates to Category No.: 5762, 9305; Payload ID: 20084 relates to Category No.: 9305, 5762; Payload ID: 20085 relates to Category No.: 9305, 5762; Payload ID: 20086 relates to Category No.: 9305; Payload ID: 20087 relates to Category No.: 9305; Payload ID: 20088 relates to Category No.: 5762, 9305; Payload ID: 20089 relates to Category No.: 9305, 2890, 5776, 9247, 9215; Payload ID: 20090 relates to Category No.: 9305, 9247; Payload ID: 20091 relates to Category No.: 9305, 2890, 5762, 9247; Payload ID: 20092 relates to Category No.: 9305; Payload ID: 20093 relates to Category No.: 2890; Payload ID: 20094 relates to Category No.: 9305; Payload ID: 20095 relates to Category No.: 9305; Payload ID: 20096 relates to Category No.: 4030, 9305, 5762, 9247; Payload ID: 20097 relates to Category No.: 9305; Payload ID: 20098 relates to Category No.: 9305; Payload ID: 20099 relates to Category No.: 9305; Payload ID: 20100 relates to Category No.: 9305, 2890, 5762, 9242; Payload ID: 20101 relates to Category No.: 5762, 9305; Payload ID: 20102 relates to Category No.: 5762, 5561; Payload ID: 20103 relates to Category No.: 9247; Payload ID: 20104 relates to Category No.: 9305, 5762; Payload ID: 20105 relates to Category No.: 9305; Payload ID: 20106 relates to Category No.: 9305, 5762; Payload ID: 20107 relates to Category No.: 9305, 5762; Payload ID: 20108 relates to Category No.: 9305; Payload ID: 20109 relates to Category No.: 9305, 5762; Payload ID: 20110 relates to Category No.: 9305, 5762; Payload ID: 20111 relates to Category No.: 9305, 5762; Payload ID: 20112 relates to Category No.: 9305; Payload ID: 20113 relates to Category No.: 9305, 5762; Payload ID: 20114 relates to Category No.: 5762, 9305, 9734; Payload ID: 20115 relates to Category No.: 9305, 5762; Payload ID: 20116 relates to Category No.: 9305, 5762; Payload ID: 20117 relates to Category No.: 9305, 5762; Payload ID: 20118 relates to Category No.: 9305, 5762; Payload ID: 20119 relates to Category No.: 9305, 5762; Payload ID: 20120 relates to Category No.: 9305, 5762; Payload ID: 20121 relates to Category No.: 5762, 9305; Payload ID: 20122 relates to Category No.: 9305; Payload ID: 20123 relates to Category No.: 9305, 5762; Payload ID: 20124 relates to Category No.: 9305, 5776, 9242; Payload ID: 20125 relates to Category No.: 9305, 5762, 1842; Payload ID: 20126 relates to Category No.: 9305, 5762; Payload ID: 20127 relates to Category No.: 9305, 5762; Payload ID: 20128 relates to Category No.: 9247; Payload ID: 20129 relates to Category No.: 9305; Payload ID: 20130 relates to Category No.: 5762, 9305; Payload ID: 20131 relates to Category No.: 9305; Payload ID: 20132 relates to Category No.: 9305, 1842; Payload ID: 20133 relates to Category No.: 9305, 5762; Payload ID: 20134 relates to Category No.: 5762, 9305, 5561; Payload ID: 20135 relates to Category No.: 9305; Payload ID: 20136 relates to Category No.: 9305, 5762; Payload ID: 20137 relates to Category No.: 5762, 9305; Payload ID: 20138 relates to Category No.: 9305, 2890, 11883, 9181; Payload ID: 20140 relates to Category No.: 5762, 9305; Payload ID: 20141 relates to Category No.: 9305, 5762; Payload ID: 20142 relates to Category No.: 9305, 5762; Payload ID: 20143 relates to Category No.: 9305, 5762; Payload ID: 20144 relates to Category No.: 9305, 2890; Payload ID: 20145 relates to Category No.: 5762, 9305; Payload ID: 20146 relates to Category No.: 9305, 5762, 5561; Payload ID: 20147 relates to Category No.: 9305, 5762; Payload ID: 20148 relates to Category No.: 9305; Payload ID: 20149 relates to Category No.: 9305; Payload ID: 20150 relates to Category No.: 9305, 9247, 4010; Payload ID: 20151 relates to Category No.: 5762, 9305; Payload ID: 20152 relates to Category No.: 5762; Payload ID: 20153 relates to Category No.: 9305, 5762; Payload ID: 20154 relates to Category No.: 5762; Payload ID: 20155 relates to Category No.: 5762; Payload ID: 20156 relates to Category No.: 5762; Payload ID: 20157 relates to Category No.: 5762, 9305; Payload ID: 20158 relates to Category No.: 9305, 5762; Payload ID: 20159 relates to Category No.: 5762, 9305; Payload ID: 20160 relates to Category No.: 9305, 5762; Payload ID: 20161 relates to Category No.: 5762; Payload ID: 20162 relates to Category No.: 9305, 5762; Payload ID: 20163 relates to Category No.: 5762, 9305; Payload ID: 20164 relates to Category No.: 9305, 5762; Payload ID: 20165 relates to Category No.: 9305, 5762; Payload ID: 20166 relates to Category No.: 9305, 5762; Payload ID: 20167 relates to Category No.: 9305, 5762; Payload ID: 20168 relates to Category No.: 9305, 5762; Payload ID: 20169 relates to Category No.: 5762, 9247, 273; Payload ID: 20170 relates to Category No.: 9305; Payload ID: 20171 relates to Category No.: 9305, 2890, 5762; Payload ID: 20172 relates to Category No.: 5762; Payload ID: 20173 relates to Category No.: 9305, 5762; Payload ID: 20174 relates to Category No.: 9305, 5776, 9242; Payload ID: 20175 relates to Category No.: 9305, 5762; Payload ID: 20176 relates to Category No.: 9305, 5762; Payload ID: 20177 relates to Category No.: 9305; Payload ID: 20178 relates to Category No.: 5762;

Payload ID: 20179 relates to Category No.: 9305, 5762, 4010; Payload ID: 20180 relates to Category No.: 9305, 5762; Payload ID: 20181 relates to Category No.: 9305, 5762; Payload ID: 20182 relates to Category No.: 9305, 5762; Payload ID: 20183 relates to Category No.: 3393, 2686; Payload ID: 20184 relates to Category No.: 9305, 5762; Payload ID: 20185 relates to Category No.: 9305; Payload ID: 20186 relates to Category No.: 9305; Payload ID: 20187 relates to Category No.: 5762, 9247; Payload ID: 20188 relates to Category No.: 5762, 9247; Payload ID: 20189 relates to Category No.: 9305; Payload ID: 20190 relates to Category No.: 9305; Payload ID: 20191 relates to Category No.: 9305, 5762; Payload ID: 20192 relates to Category No.: 9305, 5762, 1842; Payload ID: 20193 relates to Category No.: 5762, 9305; Payload ID: 20194 relates to Category No.: 5762, 9305; Payload ID: 20195 relates to Category No.: 9305, 5762; Payload ID: 20196 relates to Category No.: 9305; Payload ID: 20197 relates to Category No.: 9305, 5762; Payload ID: 20198 relates to Category No.: 9305; Payload ID: 20199 relates to Category No.: 9305, 5762; Payload ID: 20200 relates to Category No.: 9305, 5762; Payload ID: 20202 relates to Category No.: 5762, 9247; Payload ID: 20203 relates to Category No.: 5762, 9247; Payload ID: 20204 relates to Category No.: 9305, 5762; Payload ID: 20205 relates to Category No.: 9305, 5762; Payload ID: 20206 relates to Category No.: 5762, 9247; Payload ID: 20207 relates to Category No.: 5762, 9247; Payload ID: 20208 relates to Category No.: 9305, 5762; Payload ID: 20209 relates to Category No.: 5762, 9247, 9305; Payload ID: 20210 relates to Category No.: 9305; Payload ID: 20211 relates to Category No.: 9305; Payload ID: 20214 relates to Category No.: 9305, 5762; Payload ID: 20215 relates to Category No.: 9305, 5762; Payload ID: 20216 relates to Category No.: 9305, 5762; Payload ID: 20217 relates to Category No.: 5762, 9247; Payload ID: 20218 relates to Category No.: 9305, 5762; Payload ID: 20219 relates to Category No.: 5762; Payload ID: 20220 relates to Category No.: 9305, 5762, 5561; Payload ID: 20221 relates to Category No.: 9247; Payload ID: 20222 relates to Category No.: 9305, 5762; Payload ID: 20223 relates to Category No.: 9305; Payload ID: 20224 relates to Category No.: 9305, 5762; Payload ID: 20225 relates to Category No.: 5762, 9305; Payload ID: 20226 relates to Category No.: 2890, 9247, 9215, 9305; Payload ID: 20227 relates to Category No.: 9305; Payload ID: 20228 relates to Category No.: 9305; Payload ID: 20229 relates to Category No.: 9305, 5762; Payload ID: 20230 relates to Category No.: 9247; Payload ID: 20232 relates to Category No.: 5762, 9305; Payload ID: 20233 relates to Category No.: 9305, 5762; Payload ID: 20235 relates to Category No.: 9305, 5762; Payload ID: 20236 relates to Category No.: 5762, 9305; Payload ID: 20237 relates to Category No.: 5762, 9305; Payload ID: 20238 relates to Category No.: 5762, 9305, 9247; Payload ID: 20239 relates to Category No.: 5762, 9305; Payload ID: 20240 relates to Category No.: 9305, 5762; Payload ID: 20242 relates to Category No.: 9305, 5762; Payload ID: 20243 relates to Category No.: 9305, 5762, 1842; Payload ID: 20244 relates to Category No.: 9305; Payload ID: 20245 relates to Category No.: 9305, 5762; Payload ID: 20246 relates to Category No.: 9305, 5762; Payload ID: 20247 relates to Category No.: 5762; Payload ID: 20248 relates to Category No.: 9305, 5762; Payload ID: 20249 relates to Category No.: 5762, 9305, 14174; Payload ID: 20250 relates to Category No.: 5762, 9305; Payload ID: 20251 relates to Category No.: 9305, 5762; Payload ID: 20252 relates to Category No.: 5762, 9305; Payload ID: 20253 relates to Category No.: 9305, 5762; Payload ID: 20254 relates to Category No.: 9305, 5762; Payload ID: 20255 relates to Category No.: 5762, 9247; Payload ID: 20256 relates to Category No.: 9305, 15505, 9247, 15531, 2890; Payload ID: 20257 relates to Category No.: 9305, 9247, 2890; Payload ID: 20258 relates to Category No.: 9305, 9247; Payload ID: 20259 relates to Category No.: 9305, 9247; Payload ID: 20260 relates to Category No.: 5561, 9305, 4755; Payload ID: 20261 relates to Category No.: 2890, 9247, 2420; Payload ID: 20263 relates to Category No.: 9305, 5762; Payload ID: 20264 relates to Category No.: 9305, 5762, 1842; Payload ID: 20265 relates to Category No.: 9305, 2890, 5762; Payload ID: 20266 relates to Category No.: 9305, 5762; Payload ID: 20267 relates to Category No.: 9305, 5762; Payload ID: 20268 relates to Category No.: 9305, 5762; Payload ID: 20269 relates to Category No.: 9305, 5762; Payload ID: 20272 relates to Category No.: 9305, 2890, 11836; Payload ID: 20273 relates to Category No.: 3666; Payload ID: 20276 relates to Category No.: 2890, 1842; Payload ID: 20277 relates to Category No.: 2890, 1842; Payload ID: 20278 relates to Category No.: 5762; Payload ID: 20279 relates to Category No.: 9158; Payload ID: 20281 relates to Category No.: 6717, 2942; Payload ID: 20282 relates to Category No.: 9305, 2890, 9247; Payload ID: 20284 relates to Category No.: 9305, 9242; Payload ID: 20285 relates to Category No.: 9247, 7118; Payload ID: 20290 relates to Category No.: 4030, 5762; Payload ID: 20291 relates to Category No.: 9305, 9184; Payload ID: 20292 relates to Category No.: 9305, 2890, 1748, 11653; Payload ID: 20293 relates to Category No.: 9305; Payload ID: 20295 relates to Category No.: 9305, 4030, 2890, 9242, 4010; Payload ID: 20296 relates to Category No.: 9215; Payload ID: 20300 relates to Category No.: 9305, 5776, 9242, 14145, 5730, 2947; Payload ID: 20302 relates to Category No.: 2890; Payload ID: 20307 relates to Category No.: 2890; Payload ID: 20308 relates to Category No.: 9305, 2890, 9242; Payload ID: 20309 relates to Category No.: 9305, 9247, 1635; Payload ID: 20310 relates to Category No.: 9242; Payload ID: 20314 relates to Category No.: 5561, 3666, 4755, 4010; Payload ID: 20315 relates to Category No.: 5561, 3666, 4755; Payload ID: 20316 relates to Category No.: 5561, 3666, 4755; Payload ID: 20317 relates to Category No.: 5561, 3666, 4755; Payload ID: 20318 relates to Category No.: 5561, 6717, 5776, 4765, 3666, 4755, 4788; Payload ID: 20319 relates to Category No.: 5561, 3666, 4755; Payload ID: 20320 relates to Category No.: 5561, 3666, 4755, 4010; Payload ID: 20321 relates to Category No.: 5561, 3673; Payload ID: 20322 relates to Category No.: 5561, 2890, 5776, 4765, 4755, 4788; Payload ID: 20323 relates to Category No.: 5561, 3666, 4755; Payload ID: 20324 relates to Category No.: 5561, 3666, 4755; Payload ID: 20325 relates to Category No.: 10056, 3666, 4755, 5570, 12440, 5561; Payload ID: 20326 relates to Category No.: 5561, 6717, 10056, 3666, 4755; Payload ID: 20327 relates to Category No.: 5561, 10056, 4765, 3666, 4755; Payload ID: 20328 relates to Category No.: 5561, 3666, 4755; Payload ID: 20329 relates to Category No.: 5561, 3666, 4755; Payload ID: 20330 relates to Category No.: 5561, 3666, 4755; Payload ID: 20331 relates to Category No.: 5561, 6717, 4765, 3666, 4755; Payload ID: 20332 relates to Category No.: 5561, 3666, 4755; Payload ID: 20333 relates to Category No.: 5561, 2890, 6717, 10056, 3036; Payload ID: 20334 relates to Category No.: 5561, 3673, 3666, 4755; Payload ID: 20335 relates to Category No.: 5561, 9305, 5776, 9242, 4765, 3666, 9247, 4755; Payload ID: 20336 relates to Category No.: 5561, 4755, 2927, 7118; Payload ID: 20337 relates to Category No.: 5561, 2890, 3673, 3666, 4755, 9552, 5818; Payload ID: 20338 relates to Category No.: 6717, 3666, 11687, 9734, 997, 4769, 3848, 4052; Payload ID: 20339 relates to Category No.: 2890, 5776, 3521, 3523; Payload ID: 20340 relates to Category No.: 2890, 2194, 6994, 2514; Payload ID: 20341 relates to Category No.: 3693, 2899, 4228; Payload ID: 20342 relates to Category No.: 2194, 6994, 6440; Payload ID: 20343 relates to Category No.: 5561, 3673, 3666, 3036, 12440, 1017, 3682, 4863, 2890; Payload ID: 20344 relates to Category No.: 2942, 3523; Payload ID: 20345 relates to Category No.: 3521, 3523; Payload ID: 20346 relates to Category No.: 9305, 15505; Payload ID: 20347 relates to Category No.: 5561; Payload ID: 20348 relates to Category No.: 9305, 15130; Payload ID: 20350 relates to Category No.: 5762; Payload ID: 20351 relates to Category No.: 4010, 11718; Payload ID: 20352 relates to Category No.: 9305, 5762, 1842; Payload ID: 20353 relates to Category No.: 9305, 5762; Payload ID: 20354 relates to Category No.: 9305; Payload ID: 20355 relates to Category No.: 15864; Payload ID: 20356 relates to Category No.: 9242; Payload ID: 20357 relates to Category No.: 9305; Payload ID: 20358 relates to Category No.: 9247, 15848; Payload ID: 20359 relates to Category No.: 2890, 5776, 9247, 9215; Payload ID: 20360 relates to Category No.: 9305, 7118, 9247, 9209; Payload ID: 20361 relates to Category No.: 9305; Payload ID: 20362 relates to Category No.: 2942, 10104; Payload ID: 20363 relates to Category No.: 9305; Payload ID: 20364 relates to Category No.: 9305, 2890, 9242, 9247; Payload ID: 20365 relates to Category No.: 9305; Payload ID: 20366 relates to Category No.: 9305; Payload ID: 20367 relates to Category No.: 2890, 2182; Payload ID: 20368 relates to Category No.: 9305, 9247, 2420, 5561; Payload ID: 20369 relates to Category No.: 5762; Payload ID: 20370 relates to Category No.: 9305, 2890; Payload ID: 20371 relates to Category No.: 2890, 10056, 6717, 15139; Payload ID: 20372 relates to Category No.: 9305, 2890, 3055, 3054; Payload ID: 20373 relates to Category No.: 9305; Payload ID: 20374 relates to Category No.: 9305, 2890, 9247; Payload ID: 20375 relates to Category No.: 9305, 9247; Payload ID: 20376 relates to Category No.: 9209; Payload ID: 20377 relates to Category No.: 9305; Payload ID: 20381 relates to Category No.: 4030; Payload ID: 20383 relates to Category No.: 9305, 14546; Payload ID: 20385 relates to Category No.: 9305; Payload ID: 20386 relates to Category No.: 9305; Payload ID: 20387 relates to Category No.: 9305, 9242, 9184, 401; Payload ID: 20389 relates to Category No.: 9305, 9247; Payload ID: 20390 relates to Category No.: 9305, 2890, 10056, 9247; Payload ID: 20391 relates to Category No.: 9305, 9247; Payload ID: 20392 relates to Category No.: 5561, 6717, 3673, 9176, 4010; Payload ID: 20393 relates to Category No.: 3392, 9247; Payload ID: 20394 relates to Category No.: 5561; Payload ID: 20395 relates to Category No.: 5762; Payload ID: 20396 relates to Category No.: 5762; Payload ID: 20397 relates to Category No.: 5762; Payload ID: 20398 relates to Category No.: 5762; Payload ID: 20399 relates to Category No.: 4029, 9305, 262, 1711, 16336, 5561; Payload ID: 20400 relates to Category No.: 4029, 9305, 262, 1711, 16336; Payload ID: 20401 relates to Category No.: 5561, 4029, 10056, 12159, 4755, 4014, 14409; Payload ID: 20402 relates to Category No.: 5561, 4029, 10056, 12159, 4014, 3666, 4755, 14409, 7321; Payload ID: 20403 relates to Category No.: 4030, 5561, 4029, 2890, 10056, 12159, 4014, 3666, 4755, 9734, 14409, 262, 7321, 9471; Payload ID: 20404 relates to Category No.: 5561, 4029, 5762, 10056, 12159; Payload ID: 20405 relates to Category No.: 5561; Payload ID: 20406 relates to Category No.: 5561, 6717; Payload ID: 20407 relates to Category No.: 9305, 2890, 9242, 9247, 9734, 8948, 1017, 4860, 9730, 14681, 4438, 1377; Payload ID: 20408 relates to Category No.: 9305, 2890, 2942, 2630, 5964, 3036, 5776, 8935; Payload ID: 20409 relates to Category No.: 9305, 2890, 6717, 2942, 2420, 2192, 3673, 14906, 3666, 2630, 3485, 5964, 5967, 14333; Payload ID: 20410 relates to Category No.: 2942, 2630, 5964, 14333; Payload ID: 20411 relates to Category No.: 9305, 1842; Payload ID: 20412 relates to Category No.: 2785; Payload ID: 20413 relates to Category No.: 2785; Payload ID: 20414 relates to Category No.: 2785; Payload ID: 20415 relates to Category No.: 2890; Payload ID: 20416 relates to Category No.: 2890; Payload ID: 20417 relates to Category No.: 12159, 4014, 4763, 2900, 16346; Payload ID: 20418 relates to Category No.: 4030, 4010; Payload ID: 20419 relates to Category No.: 9305, 2890, 10056, 5570, 1803, 4228, 14999.

Molecular Function

In one embodiment, the biocircuit may be classified by the molecular function nature of the payload. Shown in the following paragraph are the payloads and classification (category number) for the payloads for the biocircuit systems described herein. Separated by a semi-colon, each payload-classification information describes the payload identifier (Payload ID) and the classifications (category number). For example, for the gene symbol AGPAT1 the payload-classification information is shown as "Payload ID: 2 relates to Category No.: 15542, 15548, 11861, 47."

In one embodiment, the biocircuit of the invention may be classified by one of the following molecular function categories for the payloads described herein such as, but not limited to, Payload ID: 2 relates to Category No.: 15542, 15548, 11861, 47; Payload ID: 3 relates to Category No.: 15542, 15548, 47; Payload ID: 4 relates to Category No.: 15542, 15548, 47, 6430; Payload ID: 5 relates to Category No.: 15542, 15548, 11861, 47; Payload ID: 6 relates to Category No.: 15542, 15548, 11861, 47; Payload ID: 7 relates to Category No.: 11939, 12292, 11861; Payload ID: 8 relates to Category No.: 1630, 12292; Payload ID: 9 relates to Category No.: 1630, 9917, 5804, 9989, 1225, 1223, 67; Payload ID: 10 relates to Category No.: 14196, 68, 2811; Payload ID: 11 relates to Category No.: 9518, 314, 7515, 70, 9518; Payload ID: 12 relates to Category No.: 12402, 70, 15488, 9518; Payload ID: 13 relates to Category No.: 4207, 9518, 1630, 9625, 3752, 9518, 308, 9518, 319, 7477, 3029, 3030; Payload ID: 14 relates to Category No.: 926, 16331, 6816, 14196, 15542, 9304, 3464, 11861, 75; Payload ID: 15 relates to Category No.: 926, 16331, 6816, 14196, 15542, 9304, 3464, 11861, 75; Payload ID: 16 relates to Category No.: 926, 6816, 14196, 15542, 9304, 3464, 11861, 75; Payload ID: 17 relates to Category No.: 926, 3303, 14196, 15542, 3464, 10116, 11861, 15409; Payload ID: 18 relates to Category No.: 6816, 9518, 317, 5414, 2839, 11861; Payload ID: 19 relates to Category No.: 11939, 9249, 3087; Payload ID: 20 relates to Category No.: 6478, 1630, 12402, 11861, 15346, 5347, 2559, 1526, 6401; Payload ID: 21 relates to Category No.: 5865, 9518, 9518, 315, 16283, 9518, 315, 16283, 83, 679, 6049, 9701, 9699; Payload ID: 22 relates to Category No.: 5865, 9518, 9518, 315, 16283, 6049, 3274; Payload ID: 23 relates to Category No.: 5865, 9518, 9518, 315, 16283, 6049, 3274; Payload ID: 24 relates to Category No.: 248, 9804, 11861; Payload ID: 25 relates to Category No.: 6478, 88, 5522; Payload ID: 26 relates to Category No.: 9518, 321, 7477, 11861, 7510, 5320, 2557, 7515, 5321, 11939, 12077; Payload ID: 27 relates to Category No.: 1630, 5322, 11939, 3471, 5892, 9422; Payload ID: 28 relates to Category No.: 1630, 5322; Payload ID: 29 relates to Category No.: 6401, 107, 3752, 5314; Payload ID:

30 relates to Category No.: 11861, 107, 3752; Payload ID: 31 relates to Category No.: 4894, 11861, 107, 3752; Payload ID: 32 relates to Category No.: 107, 3752; Payload ID: 33 relates to Category No.: 6816, 5865, 3554, 11861, 4158, 109; Payload ID: 34 relates to Category No.: 9518, 110, 9939; Payload ID: 35 relates to Category No.: 9518, 7472, 9518, 319, 7477, 110, 69; Payload ID: 36 relates to Category No.: 9518, 7472, 9914, 111; Payload ID: 37 relates to Category No.: 1630, 112; Payload ID: 38 relates to Category No.: 6816, 6478, 11939, 1630, 12402, 6574, 5319, 4117, 1531; Payload ID: 39 relates to Category No.: 6816, 1630, 5319; Payload ID: 40 relates to Category No.: 9518, 102; Payload ID: 41 relates to Category No.: 11939, 2536, 122; Payload ID: 42 relates to Category No.: 2536, 122; Payload ID: 43 relates to Category No.: 1630, 15542, 15549, 124; Payload ID: 44 relates to Category No.: 926, 9304, 446, 15072; Payload ID: 45 relates to Category No.: 926, 9304, 446, 15072; Payload ID: 46 relates to Category No.: 11978, 926, 12109, 11861, 131, 9923, 9925, 11981, 5538; Payload ID: 47 relates to Category No.: 6816, 11939, 5875, 12292, 15489, 141, 15063, 9; Payload ID: 48 relates to Category No.: 6401, 11939, 143; Payload ID: 49 relates to Category No.: 6816, 146, 9518, 317; Payload ID: 50 relates to Category No.: 6816, 146, 9518, 317; Payload ID: 51 relates to Category No.: 163, 6816, 9281, 12311, 9804; Payload ID: 52 relates to Category No.: 926, 6816, 159, 4230; Payload ID: 53 relates to Category No.: 9282, 6816, 163, 9281; Payload ID: 54 relates to Category No.: 3303, 9226, 10116, 11861, 3993, 154; Payload ID: 55 relates to Category No.: 16331, 9226, 9225, 10116, 3993, 154, 15526, 155, 11861; Payload ID: 56 relates to Category No.: 11939, 1630, 5395, 9969, 11861; Payload ID: 57 relates to Category No.: 15542, 12292, 11861, 156, 1630; Payload ID: 58 relates to Category No.: 15542, 12292, 11861, 4660, 2557, 156; Payload ID: 59 relates to Category No.: 11861; Payload ID: 60 relates to Category No.: 3303, 9619; Payload ID: 61 relates to Category No.: 4820, 14510, 11861; Payload ID: 62 relates to Category No.: 4820, 14510, 11861, 3471, 14507; Payload ID: 63 relates to Category No.: 4820, 14510, 14507; Payload ID: 64 relates to Category No.: 4820, 14510, 11861, 14507; Payload ID: 65 relates to Category No.: 4820, 14510, 14507; Payload ID: 66 relates to Category No.: 4820, 14510, 3471, 16206, 14507, 25, 11861, 11886, 4804; Payload ID: 67 relates to Category No.: 4894, 4820, 14510, 3471, 4804, 14507; Payload ID: 68 relates to Category No.: 4820, 14510, 3471, 14507, 25, 4833; Payload ID: 69 relates to Category No.: 12399, 14510, 4013, 222, 216, 211, 14507, 16251, 14518; Payload ID: 70 relates to Category No.: 5840, 4013, 222, 216, 211; Payload ID: 71 relates to Category No.: 14510, 4013, 222, 14518, 216, 211; Payload ID: 72 relates to Category No.: 14510, 222, 14518, 216, 211, 4013; Payload ID: 73 relates to Category No.: 14510, 4013, 222, 14518, 216, 211; Payload ID: 74 relates to Category No.: 4820, 14510, 11861; Payload ID: 75 relates to Category No.: 4820, 14510; Payload ID: 76 relates to Category No.: 4820, 5079, 14510, 11861; Payload ID: 77 relates to Category No.: 4820, 14510; Payload ID: 78 relates to Category No.: 16331, 6816, 11861, 6889, 14353, 2538; Payload ID: 79 relates to Category No.: 4225, 9518, 315, 16283, 7486, 680, 5865, 4207, 9518, 7523, 11861, 4075, 7510, 7515, 9518, 9516, 7477, 22, 805; Payload ID: 80 relates to Category No.: 6816, 163; Payload ID: 81 relates to Category No.: 163, 6816; Payload ID: 82 relates to Category No.: 163, 6816; Payload ID: 83 relates to Category No.: 6816, 163; Payload ID: 84 relates to Category No.: 9282, 6478, 163; Payload ID: 85 relates to Category No.: 9282, 6478, 163; Payload ID: 86 relates to Category No.: 9282, 6816, 11861, 163, 9260; Payload ID: 87 relates to Category No.: 9282, 6478, 163, 85; Payload ID: 88 relates to Category No.: 6478, 163, 9282, 11861; Payload ID: 89 relates to Category No.: 9282, 6816, 5308, 5308, 311, 163, 4158; Payload ID: 90 relates to Category No.: 926, 5308, 1630, 165; Payload ID: 91 relates to Category No.: 6401, 12292, 11861, 5347, 15489; Payload ID: 92 relates to Category No.: 14196, 15027, 10116, 11861; Payload ID: 93 relates to Category No.: 926, 1630, 11861, 5347, 172, 4309, 5957, 4310; Payload ID: 94 relates to Category No.: 926, 172, 1630, 11981, 11861, 4309, 5957; Payload ID: 95 relates to Category No.: 926, 1630, 172, 4309; Payload ID: 96 relates to Category No.: 926, 1630, 172, 4309; Payload ID: 97 relates to Category No.: 176, 7225; Payload ID: 98 relates to Category No.: 6816, 11861, 5347, 177, 11939; Payload ID: 99 relates to Category No.: 9518, 319, 7477, 180; Payload ID: 100 relates to Category No.: 2963, 1630, 3655, 11861, 9513, 9512, 188, 6965, 3343; Payload ID: 101 relates to Category No.: 9226, 14196, 10116, 11861, 11975, 11981, 11920, 6965, 1173, 12081, 11890, 12078; Payload ID: 103 relates to Category No.: 12076, 11973, 11890, 11975, 11974; Payload ID: 104 relates to Category No.: 11861, 11973, 429; Payload ID: 105 relates to Category No.: 14564, 6816, 14107, 11861, 1473, 14106, 11890, 11973; Payload ID: 106 relates to Category No.: 11973; Payload ID: 107 relates to Category No.: 9282, 10116, 11861, 11973; Payload ID: 109 relates to Category No.: 11861, 11973; Payload ID: 110 relates to Category No.: 11973, 11861; Payload ID: 111 relates to Category No.: 1457, 11861, 11975, 11973, 429, 11981, 11920, 267, 4338, 11886, 5957, 1369, 4821, 12078; Payload ID: 112 relates to Category No.: 11890, 11861, 5841, 11975, 11854, 11973, 429; Payload ID: 113 relates to Category No.: 9282, 11861, 11973, 11981, 11975; Payload ID: 114 relates to Category No.: 3303, 10116, 11975, 11861, 16331, 3459; Payload ID: 115 relates to Category No.: 3303, 6816, 10116, 11861, 2999, 5956; Payload ID: 116 relates to Category No.: 11890, 12402, 11861, 11665, 5841, 11975, 5956; Payload ID: 117 relates to Category No.: 11861; Payload ID: 119 relates to Category No.: 926, 12109; Payload ID: 120 relates to Category No.: 926, 12109, 11978; Payload ID: 121 relates to Category No.: 926, 5956, 11861, 456; Payload ID: 122 relates to Category No.: 12109; Payload ID: 123 relates to Category No.: 12109, 11861; Payload ID: 124 relates to Category No.: 11861, 5347; Payload ID: 125 relates to Category No.: 5308, 6829, 629; Payload ID: 126 relates to Category No.: 1536, 11861, 7192, 5308; Payload ID: 127 relates to Category No.: 5308, 5311; Payload ID: 128 relates to Category No.: 1536, 7192; Payload ID: 129 relates to Category No.: 396; Payload ID: 130 relates to Category No.: 5308; Payload ID: 131 relates to Category No.: 5308; Payload ID: 132 relates to Category No.: 5308; Payload ID: 133 relates to Category No.: 5308, 11861; Payload ID: 134 relates to Category No.: 5308; Payload ID: 135 relates to Category No.: 5308, 11861; Payload ID: 136 relates to Category No.: 5308; Payload ID: 137 relates to Category No.: 5308, 11861; Payload ID: 138 relates to Category No.: 5308; Payload ID: 139 relates to Category No.: 5308; Payload ID: 141 relates to Category No.: 1536, 7192; Payload ID: 142 relates to Category No.: 9921, 9822, 9894, 46; Payload ID: 143 relates to Category No.: 1536; Payload ID: 144 relates to Category No.: 9619, 1536, 47, 6430, 11861; Payload ID: 145 relates to Category No.: 9924, 396; Payload ID: 146 relates to Category No.: 5308; Payload ID: 147 relates to Category No.: 11861; Payload ID: 148 relates to Category No.: 11861, 4720, 5009, 2566; Payload ID: 149 relates to Category No.: 11978, 926, 3303, 6478, 11895, 12402, 9096, 15180, 12145, 295, 11861, 6574, 14537, 7125, 11782, 9035, 11920, 277, 5956; Payload ID: 150 relates to Category No.: 11978, 926, 6478, 12402, 9096, 277, 12145, 295, 11861, 6574; Payload ID: 151 relates to Category No.: 11861, 2936, 11886, 12144; Payload ID: 152 relates to Category No.: 11861, 3303, 15895, 12363, 2931, 14537, 11886, 5957, 11782; Payload ID: 153 relates to Category No.: 11861, 1201, 1457; Payload ID: 154 relates to Category No.: 15542, 15554, 4718, 4319; Payload ID: 156 relates to Category No.: 1504, 7192; Payload ID: 157 relates to Category No.: 1504; Payload ID: 158 relates to Category No.: 3459, 11861, 5347; Payload ID: 159 relates to Category No.: 9226, 6816; Payload ID: 160 relates to Category No.: 9226; Payload ID: 162 relates to Category No.: 4813; Payload ID: 163 relates to Category No.: 9226; Payload ID: 164 relates to Category No.: 9226; Payload ID: 165 relates to Category No.: 9226; Payload ID: 166 relates to Category No.: 9226; Payload ID: 168 relates to Category No.: 9226; Payload ID: 170 relates to Category No.: 15029; Payload ID: 171 relates to Category No.: 15027; Payload ID: 176 relates to Category No.: 4820; Payload ID: 180 relates to Category No.: 15027; Payload ID: 182 relates to Category No.: 3554, 15881; Payload ID: 185 relates to Category No.: 15027; Payload ID: 189 relates to Category No.: 11978, 926, 12109; Payload ID: 190 relates to Category No.: 6818, 16333; Payload ID: 213 relates to Category No.: 9036, 15542, 15555; Payload ID: 215 relates to Category No.: 11861; Payload ID: 216 relates to Category No.: 3303, 15503, 14471; Payload ID: 220 relates to Category No.: 3303; Payload ID: 225 relates to Category No.: 9226; Payload ID: 233 relates to Category No.: 11861; Payload ID: 234 relates to Category No.: 11978, 926, 12109; Payload ID: 236 relates to Category No.: 15027; Payload ID: 238 relates to Category No.: 14196, 15027, 14309; Payload ID: 239 relates to Category No.: 14196, 15027, 14309; Payload ID: 240 relates to Category No.: 14196, 15027, 14309; Payload ID: 241 relates to Category No.: 14196, 15027, 14309; Payload ID: 242 relates to Category No.: 14196, 15027, 14309; Payload ID: 243 relates to Category No.: 14196, 15027, 14309; Payload ID: 245 relates to Category No.: 14503; Payload ID: 256 relates to Category No.: 11861; Payload ID: 269 relates to Category No.: 4896; Payload ID: 273 relates to Category No.: 16331; Payload ID: 281 relates to Category No.: 9282, 1630, 3391, 835; Payload ID: 284 relates to Category No.: 11861; Payload ID: 289 relates to Category No.: 4886; Payload ID: 294 relates to Category No.: 9226, 6816; Payload ID: 301 relates to Category No.: 15027; Payload ID: 304 relates to Category No.: 15027; Payload ID: 308 relates to Category No.: 9226, 6816; Payload ID: 316 relates to Category No.: 9226, 1630; Payload ID: 324 relates to Category No.: 16331; Payload ID: 341 relates to Category No.: 11861; Payload ID: 342 relates to Category No.: 11861; Payload ID: 344 relates to Category No.: 8982; Payload ID: 345 relates to Category No.: 11861; Payload ID: 346 relates to Category No.: 11861; Payload ID: 349 relates to Category No.: 11861; Payload ID: 353 relates to Category No.: 4820; Payload ID: 355 relates to Category No.: 5865, 4976, 9518, 315, 16283, 841, 7223; Payload ID: 358 relates to Category No.: 11861; Payload ID: 359 relates to Category No.: 11861; Payload ID: 362 relates to Category No.: 5865, 4976, 9518, 315, 16283, 841, 7223; Payload ID: 368 relates to Category No.: 9706; Payload ID: 371 relates to Category No.: 11861; Payload ID: 373 relates to Category No.: 1405, 11861; Payload ID: 374 relates to Category No.: 5865, 4976, 9518, 315, 16283, 9518, 315, 16283, 12444, 680, 7223; Payload ID: 375 relates to Category No.: 5865, 4976, 9518, 315, 16283; Payload ID: 376 relates to Category No.: 5865, 4976, 9518, 315, 16283; Payload ID: 378 relates to Category No.: 5865, 4976, 9518, 315, 16283, 9518, 315, 16283, 12444, 680, 7223; Payload ID: 379 relates to Category No.: 926, 1630, 11861, 208, 1349; Payload ID: 380 relates to Category No.: 5308, 11939, 6024, 11861, 1146, 211, 2371, 2566, 225, 14492, 12107; Payload ID: 381 relates to Category No.: 6816, 1630, 15542, 15549, 229, 11939, 3752, 2557; Payload ID: 382 relates to Category No.: 1630, 11861, 15542, 15549, 229; Payload ID: 383 relates to Category No.: 1630, 11861, 15542, 15549, 230, 9550; Payload ID: 384 relates to Category No.: 1630, 10116, 11861, 15542, 15549, 230; Payload ID: 385 relates to Category No.: 926, 6816, 6188, 1209, 11861, 231; Payload ID: 386 relates to Category No.: 926, 6816, 6188, 1209, 11861, 231; Payload ID: 387 relates to Category No.: 11939, 6924, 9367, 5347, 244, 14351; Payload ID: 388 relates to Category No.: 6924, 9367, 11861, 7192; Payload ID: 389 relates to Category No.: 3303, 15503, 14471, 14234, 1178, 11917, 11861, 15530, 14233, 3530, 15503, 15504, 14471, 2405, 11939, 3459; Payload ID: 390 relates to Category No.: 15503, 14471, 14234, 11917, 15530, 14233, 3530, 14471; Payload ID: 391 relates to Category No.: 3303, 11917, 14243, 11861, 15530, 14255; Payload ID: 392 relates to Category No.: 3303, 11917, 11861; Payload ID: 393 relates to Category No.: 3303, 11917, 7192; Payload ID: 394 relates to Category No.: 11861, 7192; Payload ID: 395 relates to Category No.: 248, 11861, 9097, 9804, 12150; Payload ID: 396 relates to Category No.: 248, 9962, 9990; Payload ID: 397 relates to Category No.: 5308, 248, 4151, 4158; Payload ID: 398 relates to Category No.: 248, 6432; Payload ID: 399 relates to Category No.: 248, 9804, 5347, 163, 15345, 6432, 2361; Payload ID: 400 relates to Category No.: 248; Payload ID: 401 relates to Category No.: 6187, 14730, 11861, 251, 1647, 5844, 5840; Payload ID: 402 relates to Category No.: 6187, 14730, 11861, 1647, 5840, 5844; Payload ID: 403 relates to Category No.: 1647, 6187, 14730, 3740, 11861, 9608; Payload ID: 404 relates to Category No.: 5840, 14730, 14741; Payload ID: 405 relates to Category No.: 14730, 5296, 6187; Payload ID: 406 relates to Category No.: 14730; Payload ID: 407 relates to Category No.: 10116, 11861; Payload ID: 408 relates to Category No.: 5105, 11861, 14218; Payload ID: 409 relates to Category No.: 11861; Payload ID: 410 relates to Category No.: 5105, 11861, 9806; Payload ID: 412 relates to Category No.: 14351, 11861, 3752, 11877; Payload ID: 413 relates to Category No.: 254; Payload ID: 414 relates to Category No.: 6816, 14196, 138, 11861, 5873, 257; Payload ID: 415 relates to Category No.: 5865, 138, 257, 11861, 87; Payload ID: 416 relates to Category No.: 3303, 16331, 14503, 2672, 11861, 4314, 3471, 6583, 610, 9619; Payload ID: 417 relates to Category No.: 7192; Payload ID: 419 relates to Category No.: 16331, 267, 11861; Payload ID: 420 relates to Category No.: 16331, 267; Payload ID: 421 relates to Category No.: 16331, 267, 11861; Payload ID: 422 relates to Category No.: 267; Payload ID: 423 relates to Category No.: 267; Payload ID: 424 relates to Category No.: 11861; Payload ID: 425 relates to Category No.: 12144, 14536, 14537, 14580; Payload ID: 426 relates to Category No.: 926, 15021, 15895, 11861, 5347; Payload ID: 427 relates to Category No.: 277, 267, 11861; Payload ID: 428 relates to Category No.: 11861, 15021, 277; Payload ID: 429 relates to Category No.: 15021, 277, 11861; Payload ID: 430 relates to Category No.: 15021, 277, 11861; Payload ID: 431 relates to Category No.: 15021, 11861, 1327, 277, 11861, 3752; Payload ID: 432 relates to Category No.: 15021, 277, 11861; Payload ID: 433 relates to Category No.: 267, 7192; Payload ID: 434 relates to Category No.: 926, 15021, 11861, 7393, 456; Payload ID: 435 relates to Category No.: 926, 11981, 11861; Payload ID: 436 relates to Category No.: 926, 942, 7393, 11861; Payload ID: 437 relates to Category No.: 926, 15021, 14234, 5960, 9271, 11861, 5347, 14240, 15229, 9060; Payload ID: 438 relates to Category No.: 926, 7192; Payload ID: 439 relates to Category No.: 926; Payload ID: 440 relates to Category No.: 1405, 11939, 5588, 277, 3464, 11861, 5841, 6185, 16184; Payload ID: 441 relates to Category No.: 1405, 11939, 11917, 5588, 11920, 15429, 11861, 2936, 5347, 5841, 9887, 15024, 4121, 15430, 6185, 6190, 15410; Payload ID: 442 relates to Category No.: 1405, 11861, 267, 11939, 5588, 5841, 15024; Payload ID: 443 relates to Category No.: 1405, 11861; Payload ID: 445 relates to Category No.: 14234, 2405, 15491, 9271, 11861, 14240; Payload ID: 446 relates to Category No.: 15021, 15491, 11861; Payload ID: 447 relates to Category No.: 15021, 11861; Payload ID: 448 relates to Category No.: 15021; Payload ID: 449 relates to Category No.: 11861; Payload ID: 451 relates to Category No.: 11861; Payload ID: 452 relates to Category No.: 11861; Payload ID: 455 relates to Category No.: 11861; Payload ID: 456 relates to Category No.: 12402, 11861; Payload ID: 457 relates to Category No.: 14196, 11861, 9226; Payload ID: 458 relates to Category No.: 11861; Payload ID: 459 relates to Category No.: 926, 9226, 12142, 10116, 11861, 948; Payload ID: 460 relates to Category No.: 3303, 15503, 14471, 11861, 14471, 14243, 15528, 14255, 11933, 11886, 15503, 14239; Payload ID: 461 relates to Category No.: 6816, 15503, 14471, 14471, 1471, 15491, 11981, 14243, 11861, 5096, 15503, 14239, 1472, 14240, 14229, 15528, 14255, 15503, 14252, 3732, 15528, 14233, 3303, 2405, 11933, 15504, 9226; Payload ID: 462 relates to Category No.: 15503, 14471, 14471, 14234, 11939, 11933, 15524, 15495, 15503, 14233, 14243, 11861, 5347, 15525, 15528, 14255, 15530, 14233, 3303; Payload ID: 463 relates to Category No.: 3303, 15503, 14471, 11933, 14471, 15524, 14251, 14471, 14243, 11861, 2691, 14252, 6127, 15503, 14252, 15528, 14233, 14234, 11895, 15504; Payload ID: 464 relates to Category No.: 15503, 14471, 2405, 14471, 15524, 14251, 14471, 15495, 14243, 11861, 15766, 5957, 15528, 14255, 4961; Payload ID: 465 relates to Category No.: 15503, 14471, 11933, 14471, 15491, 14243, 11861, 15895; Payload ID: 466 relates to Category No.: 15503, 14471, 14471, 15524, 11861; Payload ID: 467 relates to Category No.: 6816, 15503, 14471, 14234, 14471, 15504, 11861, 15530, 14233, 3752, 7125, 9226; Payload ID: 468 relates to Category No.: 11861, 15495, 942; Payload ID: 469 relates to Category No.: 11861; Payload ID: 470 relates to Category No.: 16331, 5308, 15895, 1630, 5308, 307, 5402, 11861, 2865; Payload ID: 471 relates to Category No.: 3303, 9282, 15491, 10116, 11861; Payload ID: 472 relates to Category No.: 4894, 14107, 4924, 11861; Payload ID: 473 relates to Category No.: 926, 12418, 11978, 6816, 12109, 11981, 14652, 11861, 15564, 15561, 15609, 368, 15572, 369; Payload ID: 474 relates to Category No.: 11978, 926, 6816, 11939, 12109, 14652, 11861, 12418, 15561, 15609, 368, 9636, 369, 4865, 15564; Payload ID: 475 relates to Category No.: 11978, 926, 6816, 15895, 12109, 14652, 11861, 15609, 4865, 368, 374, 369, 5432, 12418; Payload ID: 476 relates to Category No.: 11978, 926, 6816, 12418, 15609, 4865, 9084, 369; Payload ID: 477 relates to Category No.: 11978, 926, 6816, 12109, 2694, 11861, 12418, 15609, 368, 374, 12107, 9608, 4865, 5432; Payload ID: 478 relates to Category No.: 11978, 926, 6816, 12109, 11861, 12418, 15609, 4865, 370, 12114, 368, 5432; Payload ID: 479 relates to Category No.: 3303, 6816, 11861, 2405, 9629, 1173, 2672; Payload ID: 480 relates to Category No.: 11861; Payload ID: 481 relates to Category No.: 14503, 9363, 14506, 10116, 11861; Payload ID: 482 relates to Category No.: 4117, 11861, 11975; Payload ID: 483 relates to Category No.: 6210, 4117; Payload ID: 484 relates to Category No.: 6210, 4117, 7192; Payload ID: 485 relates to Category No.: 6210, 4117, 11861; Payload ID: 486 relates to Category No.: 6210, 4117; Payload ID: 487 relates to Category No.: 5308, 3554, 4207, 387, 4117, 9518, 319, 9518, 319, 16281; Payload ID: 488 relates to Category No.: 3554, 4207, 387, 4117, 9518, 319, 9518, 319, 16281, 6663, 6315, 16148; Payload ID: 489 relates to Category No.: 3554, 4207, 387, 4117, 9518, 319, 9518, 319, 16281; Payload ID: 490 relates to Category No.: 3554, 4207, 387, 4117, 11861, 9518, 319, 9518, 319, 16281; Payload ID: 491 relates to Category No.: 3554, 4207, 387, 4117, 9518, 319, 1350; Payload ID: 492 relates to Category No.: 3554, 4207, 387, 4117, 5347, 9518, 319, 9518, 319, 16281, 6663, 5892; Payload ID: 493 relates to Category No.: 3554, 4207, 387, 4117, 9518, 319, 9518, 319, 16281, 9550, 6315; Payload ID: 494 relates to Category No.: 3554, 4207, 387, 4117, 9518, 319, 9518, 319, 16281; Payload ID: 495 relates to Category No.: 3554, 4207, 387, 4117, 9518, 319, 9518, 319, 16281, 6315, 16148; Payload ID: 496 relates to Category No.: 3554, 4207, 12402, 387, 4117, 4075, 391, 9518, 319, 9608, 12064, 9518, 319, 16281, 9550; Payload ID: 497 relates to Category No.: 4207, 387, 391, 9518, 319, 3554, 12402, 4117, 11744, 9518, 319, 16281, 99, 4103; Payload ID: 498 relates to Category No.: 3554, 4207, 12402, 387, 4117, 391, 9518, 319, 11744, 9518, 319, 16281; Payload ID: 499 relates to Category No.: 3554, 4207, 387, 4117, 391, 7192, 9518, 319, 9518, 319, 16281; Payload ID: 500 relates to Category No.: 926, 1630, 6308, 16145; Payload ID: 501 relates to Category No.: 1630, 926, 6308, 388; Payload ID: 502 relates to Category No.: 926, 1630, 6188, 11861; Payload ID: 503 relates to Category No.: 1630, 926, 252, 6548; Payload ID: 504 relates to Category No.: 1630, 6188, 926, 6308; Payload ID: 505 relates to Category No.: 926, 1630, 11981, 11920, 6308; Payload ID: 506 relates to Category No.: 926, 1630, 6308, 16145, 810; Payload ID: 507 relates to Category No.: 926, 1630, 6308; Payload ID: 508 relates to Category No.: 926, 11939, 1630, 3752, 6308; Payload ID: 509 relates to Category No.: 926, 6816, 4886, 1630, 1349, 389, 4109; Payload ID: 510 relates to Category No.: 1630, 926, 6816, 1349; Payload ID: 511 relates to Category No.: 926, 6816, 1630, 7192, 1349; Payload ID: 512 relates to Category No.: 926, 6816, 1630, 7192, 1349, 4109; Payload ID: 513 relates to Category No.: 926, 6816, 1630, 1349, 4120; Payload ID: 514 relates to Category No.: 926, 6816, 4886, 1630, 1349; Payload ID: 515 relates to Category No.: 1630, 926, 6816, 4886, 1349; Payload ID: 516 relates to Category No.: 926, 1630, 11861, 646, 207; Payload ID: 517 relates to Category No.: 1630, 926, 646, 207; Payload ID: 518 relates to Category No.: 1630, 926, 207; Payload ID: 519 relates to Category No.: 15358, 1536, 388, 9549; Payload ID: 520 relates to Category No.: 6210, 1536, 388; Payload ID: 521 relates to Category No.: 6210, 1536, 234, 926; Payload ID: 522 relates to Category No.: 388; Payload ID: 523 relates to Category No.: 15358, 12402, 1536, 388, 9549; Payload ID: 524 relates to Category No.: 15358, 12402, 1536, 388, 9549, 15064; Payload ID: 525 relates to Category No.: 1536; Payload ID: 526 relates to Category No.: 11939, 1536, 4117, 11861, 9549, 6309, 388; Payload ID: 527 relates to Category No.: 12402, 1536, 11861, 388, 9549, 2372, 6655; Payload ID: 528 relates to Category No.: 1536, 234; Payload ID: 529 relates to Category No.: 15542, 15549, 6316; Payload ID: 530 relates to Category No.: 15542, 15549, 14091, 6316; Payload ID: 531 relates to Category No.: 926, 3219, 395; Payload ID: 532 relates to Category No.: 6252, 1630, 5308, 311, 398; Payload ID: 533 relates to Category No.: 399;

Payload ID: 534 relates to Category No.: 399, 11861; Payload ID: 535 relates to Category No.: 6816, 14196; Payload ID: 536 relates to Category No.: 16331, 11939, 6825, 6829, 12402, 5588, 3663, 11981, 11861, 14537; Payload ID: 537 relates to Category No.: 16331, 6825, 6829, 5588, 11861; Payload ID: 538 relates to Category No.: 16331, 6825, 6829, 11861, 14537; Payload ID: 539 relates to Category No.: 16331, 6825, 6829, 5588, 11861, 14537; Payload ID: 540 relates to Category No.: 16331, 6825, 6829, 5588, 11861, 14537, 5708, 9608, 9122; Payload ID: 541 relates to Category No.: 16331, 6825, 6829; Payload ID: 542 relates to Category No.: 16331, 6825, 11861, 14537; Payload ID: 543 relates to Category No.: 16331, 6825, 6829, 5588; Payload ID: 544 relates to Category No.: 16331, 6825, 6829; Payload ID: 545 relates to Category No.: 16331, 6825, 6829; Payload ID: 546 relates to Category No.: 16331, 6825, 5588, 11861; Payload ID: 547 relates to Category No.: 16331, 6825, 6829, 5588, 11861; Payload ID: 548 relates to Category No.: 16331, 6825, 6829, 11861; Payload ID: 549 relates to Category No.: 16331, 6825, 6829; Payload ID: 550 relates to Category No.: 16331, 6825, 6829, 11861; Payload ID: 551 relates to Category No.: 16331, 6825, 11861; Payload ID: 552 relates to Category No.: 16331, 6825, 11861; Payload ID: 553 relates to Category No.: 16331, 6825, 3663; Payload ID: 554 relates to Category No.: 1405, 16331, 6825, 6829, 11861, 1706, 12107; Payload ID: 555 relates to Category No.: 16331, 6825, 6829, 5588, 6024, 11861, 14537, 11983, 2566; Payload ID: 556 relates to Category No.: 6825; Payload ID: 557 relates to Category No.: 16331, 6825, 6829, 11861, 5009; Payload ID: 558 relates to Category No.: 16331, 6825, 9619, 11861, 7192; Payload ID: 559 relates to Category No.: 16331, 6825, 9619, 11861; Payload ID: 560 relates to Category No.: 1405, 16331, 6825, 6829, 5588, 11861, 3663, 9619; Payload ID: 561 relates to Category No.: 16331, 6825, 9619; Payload ID: 562 relates to Category No.: 16331, 6825; Payload ID: 563 relates to Category No.: 16331, 6825, 9619; Payload ID: 564 relates to Category No.: 16331, 6816, 6825, 9619; Payload ID: 565 relates to Category No.: 16331, 6825, 9619; Payload ID: 566 relates to Category No.: 16331, 6825, 9619; Payload ID: 567 relates to Category No.: 16331, 6825, 6829, 9619; Payload ID: 568 relates to Category No.: 16331, 6825, 3663; Payload ID: 569 relates to Category No.: 16331, 6825, 9619, 5009, 3663, 11861; Payload ID: 570 relates to Category No.: 16331, 6825, 6829, 9619, 11861, 11828; Payload ID: 571 relates to Category No.: 16331, 6825, 6829, 5588, 11861; Payload ID: 572 relates to Category No.: 16331, 6825, 6829, 9619; Payload ID: 573 relates to Category No.: 16331, 6825, 6829, 9619, 11861; Payload ID: 574 relates to Category No.: 16331, 6825, 6829, 5588, 5009, 6331; Payload ID: 575 relates to Category No.: 16331, 6825, 6829; Payload ID: 576 relates to Category No.: 16331, 6825; Payload ID: 577 relates to Category No.: 16331, 6829, 9619, 11861, 6825; Payload ID: 578 relates to Category No.: 16331, 6825, 9619, 11861, 6949; Payload ID: 579 relates to Category No.: 16331, 6829, 9619, 11861; Payload ID: 580 relates to Category No.: 6825, 11861, 11828, 9619; Payload ID: 581 relates to Category No.: 16331, 6825, 11861, 6829; Payload ID: 582 relates to Category No.: 11861, 5347, 11979; Payload ID: 583 relates to Category No.: 11861; Payload ID: 584 relates to Category No.: 5960, 764; Payload ID: 585 relates to Category No.: 15629, 12142, 11981, 11861, 1201; Payload ID: 586 relates to Category No.: 15629, 12142, 5960, 12359, 11861, 4899, 1201; Payload ID: 587 relates to Category No.: 12142, 11861, 1201; Payload ID: 588 relates to Category No.: 11861; Payload ID: 589 relates to Category No.: 11861; Payload ID: 590 relates to Category No.: 12142, 11861; Payload ID: 591 relates to Category No.: 12142, 11861; Payload ID: 592 relates to Category No.: 12142, 11861; Payload ID: 593 relates to Category No.: 12142, 11981, 11861, 2489, 1201, 11895, 11886; Payload ID: 594 relates to Category No.: 1201, 12142, 11981, 6210, 11861, 7192, 2489, 11886; Payload ID: 595 relates to Category No.: 1201, 12142, 11861, 2491, 14562, 2489, 11886; Payload ID: 596 relates to Category No.: 15629, 6210, 11861, 14562, 6337, 2489; Payload ID: 597 relates to Category No.: 12142, 15629, 11861, 2489; Payload ID: 598 relates to Category No.: 12081, 4899, 1201; Payload ID: 599 relates to Category No.: 15629, 1201; Payload ID: 600 relates to Category No.: 15629, 12142, 1201, 11861; Payload ID: 601 relates to Category No.: 12359, 11861; Payload ID: 603 relates to Category No.: 15629, 12142, 11861; Payload ID: 604 relates to Category No.: 12142; Payload ID: 605 relates to Category No.: 12142, 1201, 15629, 11861; Payload ID: 606 relates to Category No.: 1201; Payload ID: 607 relates to Category No.: 15629, 11861; Payload ID: 608 relates to Category No.: 12142, 15629; Payload ID: 609 relates to Category No.: 11861; Payload ID: 611 relates to Category No.: 11861; Payload ID: 612 relates to Category No.: 11861; Payload ID: 613 relates to Category No.: 3303, 6816, 14082, 15491, 15495, 11861, 9763; Payload ID: 614 relates to Category No.: 3303, 6816, 9763; Payload ID: 615 relates to Category No.: 3303, 6816; Payload ID: 616 relates to Category No.: 267, 11939, 11933, 15504, 277, 1457, 10116, 11861, 14812, 15029; Payload ID: 617 relates to Category No.: 267, 11939, 11933, 277, 1457, 14812; Payload ID: 618 relates to Category No.: 267, 15021, 1457, 15029, 11861, 11983; Payload ID: 619 relates to Category No.: 646, 410, 406, 15542; Payload ID: 620 relates to Category No.: 1153, 11861, 1201, 6965, 4380; Payload ID: 621 relates to Category No.: 16293; Payload ID: 623 relates to Category No.: 1153, 11861, 1201, 6965, 11981, 11992, 6979, 4380, 11886; Payload ID: 624 relates to Category No.: 4820, 4809, 11861, 11933, 4961, 4805, 4821, 9926, 12245, 5038; Payload ID: 625 relates to Category No.: 4820, 4809, 11861, 5347, 3752; Payload ID: 626 relates to Category No.: 4820, 4809; Payload ID: 627 relates to Category No.: 4820, 4809; Payload ID: 628 relates to Category No.: 16331, 3003, 11861, 418, 12245; Payload ID: 629 relates to Category No.: 14196, 418; Payload ID: 630 relates to Category No.: 14196, 418; Payload ID: 631 relates to Category No.: 3303, 6816, 14196, 10116, 11861, 3463, 418; Payload ID: 632 relates to Category No.: 6816, 14196, 3464, 10116, 7268, 11861, 3463, 418; Payload ID: 633 relates to Category No.: 6816, 14196, 3464, 10116, 14602, 418; Payload ID: 634 relates to Category No.: 14196, 418, 6816, 15729; Payload ID: 635 relates to Category No.: 16331, 5308, 1630, 11861, 15730; Payload ID: 636 relates to Category No.: 16331, 1630; Payload ID: 637 relates to Category No.: 6816, 3003, 418; Payload ID: 638 relates to Category No.: 926, 6816, 10116, 9988, 512, 419; Payload ID: 639 relates to Category No.: 6816, 3003, 649, 7398; Payload ID: 640 relates to Category No.: 649, 6816, 3003, 11861; Payload ID: 641 relates to Category No.: 649, 6816, 3003; Payload ID: 642 relates to Category No.: 11861, 425, 7472, 5347, 427; Payload ID: 643 relates to Category No.: 14196, 11861, 425; Payload ID: 644 relates to Category No.: 11861, 425; Payload ID: 645 relates to Category No.: 426, 12277; Payload ID: 646 relates to Category No.: 9282, 9976, 926, 6816, 1457, 428, 1400; Payload ID: 647 relates to Category No.: 926, 6478, 428, 9976, 1179, 6574, 943; Payload ID: 648 relates to Category No.: 926, 6478, 11933, 428, 9976, 6574, 429, 9282; Payload ID: 649 relates to Category No.: 926, 6816, 1457, 428, 9976, 11861, 1400, 9282; Payload ID: 650 relates to Category No.: 926, 6816, 428, 11861, 9976, 4805; Payload ID: 651 relates to Category No.: 926, 6816, 11933, 428, 9976, 429, 11861, 9282; Payload ID: 652 relates to Category No.: 926, 6816, 11981, 428, 11861, 9976, 14377, 1400, 12402; Payload ID: 653 relates to Category No.: 926, 6816, 428, 9976; Payload ID: 654 relates to Category No.: 926, 6816, 428, 9976, 1400, 9282; Payload ID: 655 relates to Category No.: 926, 6816, 428, 9976; Payload ID: 656 relates to Category No.: 5259, 12402, 11861, 8959, 9638, 10032, 12417, 10033; Payload ID: 657 relates to Category No.: 4820, 15617, 12399, 11861, 16098, 8957, 467, 429; Payload ID: 658 relates to Category No.: 926, 9231, 9252, 443; Payload ID: 659 relates to Category No.: 926, 9231, 443, 9988, 9808; Payload ID: 660 relates to Category No.: 926, 4886, 9231, 11861, 443, 9264, 9988, 9808; Payload ID: 661 relates to Category No.: 926, 9231, 443, 4886, 9252, 9264, 9988, 9808; Payload ID: 662 relates to Category No.: 926, 9231, 9252, 443; Payload ID: 663 relates to Category No.: 11933; Payload ID: 664 relates to Category No.: 926, 9252, 443, 2868, 9231; Payload ID: 665 relates to Category No.: 926, 9252, 11861, 443, 2868; Payload ID: 666 relates to Category No.: 926, 9231, 9252, 9259; Payload ID: 667 relates to Category No.: 1630, 7428, 7, 6401; Payload ID: 668 relates to Category No.: 4886, 6478, 11861, 445, 9809; Payload ID: 669 relates to Category No.: 4886, 6478, 445, 9809, 11861, 11939, 4895, 277; Payload ID: 671 relates to Category No.: 4820, 15617; Payload ID: 672 relates to Category No.: 11861, 4820, 15617; Payload ID: 673 relates to Category No.: 4820, 15617, 11861; Payload ID: 674 relates to Category No.: 4820, 15617, 11861; Payload ID: 675 relates to Category No.: 4820, 15617, 11861; Payload ID: 676 relates to Category No.: 4894, 4820, 15617, 11861; Payload ID: 677 relates to Category No.: 4820, 15617; Payload ID: 678 relates to Category No.: 4820, 15617; Payload ID: 679 relates to Category No.: 1405, 4820, 15617, 11861; Payload ID: 680 relates to Category No.: 1405, 4820, 15617, 11861, 2382; Payload ID: 681 relates to Category No.: 4820, 15617, 1405, 11861; Payload ID: 682 relates to Category No.: 1405, 4820, 15617, 11861; Payload ID: 683 relates to Category No.: 4820, 15617; Payload ID: 684 relates to Category No.: 4820, 15617; Payload ID: 685 relates to Category No.: 4820, 15617; Payload ID: 686 relates to Category No.: 4820, 15617; Payload ID: 687 relates to Category No.: 4820, 15617, 11861; Payload ID: 688 relates to Category No.: 4820, 15617, 4016, 2566; Payload ID: 689 relates to Category No.: 4820, 15617; Payload ID: 690 relates to Category No.: 4820, 15617; Payload ID: 691 relates to Category No.: 4820, 15617; Payload ID: 692 relates to Category No.: 4820, 15617; Payload ID: 693 relates to Category No.: 4820, 15617; Payload ID: 694 relates to Category No.: 4820, 15617, 11861; Payload ID: 695 relates to Category No.: 4820, 15617, 1504, 11861, 1706, 6081; Payload ID: 696 relates to Category No.: 4820, 15617, 1504, 6081; Payload ID: 697 relates to Category No.: 1405, 4820, 15617, 1504, 11861; Payload ID: 698 relates to Category No.: 4820, 15617, 1405, 11861, 11917; Payload ID: 699 relates to Category No.: 4820, 1405, 15617, 11861; Payload ID: 700 relates to Category No.: 11861, 11665; Payload ID: 701 relates to Category No.: 11861; Payload ID: 702 relates to Category No.: 11861; Payload ID: 703 relates to Category No.: 11939, 5588, 11861, 1706; Payload ID: 704 relates to Category No.: 11861, 11828, 3662, 11835; Payload ID: 705 relates to Category No.: 15017, 868; Payload ID: 706 relates to Category No.: 11861; Payload ID: 707 relates to Category No.: 7192; Payload ID: 709 relates to Category No.: 6816, 12399, 11981, 453, 452, 11861, 5347, 11933; Payload ID: 710 relates to Category No.: 6816, 12399, 5260, 453, 452, 5347, 11933; Payload ID: 711 relates to Category No.: 11939, 5259, 12402, 2874, 11861, 5347, 14548; Payload ID: 712 relates to Category No.: 3303, 6816, 11861, 7192; Payload ID: 713 relates to Category No.: 6816, 468, 5956, 9988, 512; Payload ID: 714 relates to Category No.: 6816, 5308, 465, 1699; Payload ID: 715 relates to Category No.: 6478, 11861, 466; Payload ID: 716 relates to Category No.: 4886, 4895, 10116, 11861, 12417, 6478, 4422, 9935; Payload ID: 717 relates to Category No.: 4886, 4895; Payload ID: 718 relates to Category No.: 4886, 4895, 11861, 3774; Payload ID: 719 relates to Category No.: 4886, 4895, 11861; Payload ID: 720 relates to Category No.: 4886, 4895, 11861, 15355, 12064; Payload ID: 721 relates to Category No.: 6816, 4894, 11861; Payload ID: 722 relates to Category No.: 6816, 4894; Payload ID: 723 relates to Category No.: 6816, 4894, 12142, 11861; Payload ID: 724 relates to Category No.: 820, 1201, 4924, 11861, 7393, 11975; Payload ID: 725 relates to Category No.: 4924, 820, 11861, 4338, 11975, 1201, 7393; Payload ID: 726 relates to Category No.: 11920, 9888; Payload ID: 727 relates to Category No.: 4886, 12363, 11920, 11861, 4899, 9888; Payload ID: 728 relates to Category No.: 4886, 4895, 11861; Payload ID: 729 relates to Category No.: 3749, 6816, 4886, 4895, 11920; Payload ID: 730 relates to Category No.: 4886; Payload ID: 731 relates to Category No.: 4886, 11861; Payload ID: 732 relates to Category No.: 4886; Payload ID: 733 relates to Category No.: 4886, 11861; Payload ID: 734 relates to Category No.: 4886, 11861; Payload ID: 735 relates to Category No.: 11861; Payload ID: 737 relates to Category No.: 4886, 7192; Payload ID: 738 relates to Category No.: 4886, 11861; Payload ID: 739 relates to Category No.: 4886; Payload ID: 740 relates to Category No.: 4886; Payload ID: 741 relates to Category No.: 4886, 4895, 11861, 4897, 4422; Payload ID: 742 relates to Category No.: 15491, 11861, 4898; Payload ID: 743 relates to Category No.: 6816, 4886, 6965, 11861, 4422, 4895; Payload ID: 744 relates to Category No.: 4886, 11861; Payload ID: 745 relates to Category No.: 4886, 4895, 598, 11861; Payload ID: 746 relates to Category No.: 4886, 4895, 11861; Payload ID: 747 relates to Category No.: 4886; Payload ID: 748 relates to Category No.: 4886; Payload ID: 749 relates to Category No.: 4886; Payload ID: 750 relates to Category No.: 6816, 4886, 9939, 11861; Payload ID: 751 relates to Category No.: 11861; Payload ID: 752 relates to Category No.: 10116, 11861; Payload ID: 753 relates to Category No.: 11861, 7192; Payload ID: 754 relates to Category No.: 11861; Payload ID: 755 relates to Category No.: 4886, 4895, 598, 11861, 1173; Payload ID: 756 relates to Category No.: 4886, 4895, 598, 1173, 4422; Payload ID: 757 relates to Category No.: 4886; Payload ID: 758 relates to Category No.: 6478, 466; Payload ID: 759 relates to Category No.: 6816, 10120; Payload ID: 760 relates to Category No.: 7485, 7489; Payload ID: 761 relates to Category No.: 7485, 7489; Payload ID: 762 relates to Category No.: 7485; Payload ID: 763 relates to Category No.: 7485, 7489, 7493; Payload ID: 764 relates to Category No.: 11978, 926, 12109, 11861, 4827, 560, 3538, 1141; Payload ID: 765 relates to Category No.: 11978, 926, 12109, 1141, 4827; Payload ID: 766 relates to Category No.: 11933, 4820, 558; Payload ID: 767 relates to Category No.: 11933, 4820, 558; Payload ID: 768 relates to Category No.: 4820, 558; Payload ID: 769 relates to Category No.: 11939, 11933, 4820, 11981, 11861, 561, 15355, 3784, 9109, 559, 563, 5038, 473; Payload ID: 770 relates to Category No.: 4820, 473, 561; Payload ID: 771 relates to Category No.: 4820, 561, 11939, 11933, 11861, 3784, 560; Payload ID: 772 relates to Category No.: 11933, 4820, 11861, 12417, 9608, 12389, 3784, 9109, 1140, 560, 1134; Payload ID: 773 relates to Category No.: 11939, 4820, 11861, 11665, 1136, 3784, 9109, 3752, 429, 5850, 11886, 3471, 4804, 3424, 1074; Payload ID: 774 relates to Category No.: 11939, 4820, 11861, 3784, 9109, 1140, 1139, 1138; Payload ID: 775 relates to Category No.: 3303, 11861, 3347; Payload ID: 776 relates to Category No.: 5259, 12402, 11861, 479; Payload ID: 777 relates to Category No.: 5259, 11886; Payload ID: 779 relates to Category No.: 15617, 12399, 11861, 5347, 14335; Payload ID: 780 relates to Category No.: 267, 11861; Payload ID: 781 relates to Category No.: 16331, 15503, 14471, 6822, 1457, 14243, 15530, 14255, 1538, 15495; Payload ID: 782 relates to Category No.: 9226, 6816, 11861, 15530, 14233, 3303, 14234, 15495; Payload ID: 783 relates to Category No.: 1630, 15093; Payload ID: 787 relates to Category No.: 15503, 14471, 11861; Payload ID: 788 relates to Category No.: 4836; Payload ID: 789 relates to Category No.: 3459; Payload ID: 790 relates to Category No.: 15503, 14471, 11861; Payload ID: 791 relates to Category No.: 16228; Payload ID: 792 relates to Category No.: 926, 16331, 15973, 6825, 11861; Payload ID: 793 relates to Category No.: 2491; Payload ID: 795 relates to Category No.: 5293, 11861, 1405; Payload ID: 796 relates to Category No.: 6816, 497, 5308, 307, 5404; Payload ID: 797 relates to Category No.: 12402, 8959; Payload ID: 798 relates to Category No.: 12402; Payload ID: 799 relates to Category No.: 1405, 3516, 15021, 5003, 6024, 11861, 14548, 2382, 218; Payload ID: 800 relates to Category No.: 11861, 2271, 941; Payload ID: 801 relates to Category No.: 11861, 2271, 941; Payload ID: 802 relates to Category No.: 11861, 10116, 14335, 15030; Payload ID: 803 relates to Category No.: 11861; Payload ID: 806 relates to Category No.: 16331, 15495, 11861, 581, 2405, 277; Payload ID: 807 relates to Category No.: 11861; Payload ID: 808 relates to Category No.: 3752, 11861; Payload ID: 810 relates to Category No.: 15895, 15893, 11861; Payload ID: 811 relates to Category No.: 11861; Payload ID: 813 relates to Category No.: 2873; Payload ID: 838 relates to Category No.: 15592, 11861; Payload ID: 839 relates to Category No.: 15592, 11861; Payload ID: 846 relates to Category No.: 16331, 11861; Payload ID: 859 relates to Category No.: 11939, 12292, 12402, 11861, 15489, 620, 12107, 14499, 502; Payload ID: 860 relates to Category No.: 12292, 5347, 15489, 502, 5, 1145; Payload ID: 861 relates to Category No.: 16331, 637, 6829, 12399, 9629, 6821, 16206; Payload ID: 862 relates to Category No.: 926, 9282, 9226, 6816, 15699, 503, 620, 6188, 4282, 11861, 630; Payload ID: 863 relates to Category No.: 926, 9282, 9226, 6816, 15699, 503, 620, 6188, 4282; Payload ID: 864 relates to Category No.: 926, 9282, 9226, 6816, 11861, 7192, 15699, 503, 6188, 4282, 14524, 630; Payload ID: 865 relates to Category No.: 3303, 9524, 12292, 2672, 753, 11861, 2271, 3471, 4103, 15468, 16331, 3752; Payload ID: 866 relates to Category No.: 16331, 9518, 11861, 511, 16335, 508; Payload ID: 867 relates to Category No.: 16331, 9518, 511, 16335; Payload ID: 868 relates to Category No.: 16331, 9518, 508; Payload ID: 869 relates to Category No.: 16331, 9518, 9518, 318, 7477, 7472, 511, 16335, 3941, 14089, 7520, 508, 14088, 540, 1124, 519; Payload ID: 870 relates to Category No.: 16331, 3554, 9518, 4103, 508, 4267, 14334, 11939; Payload ID: 871 relates to Category No.: 16331, 9518, 508; Payload ID: 872 relates to Category No.: 16331, 9518, 511, 16335, 3941, 14089, 12401, 508, 14088, 518; Payload ID: 873 relates to Category No.: 6816, 9518, 5312; Payload ID: 874 relates to Category No.: 4894, 9518, 14068, 101, 516, 681, 1123; Payload ID: 875 relates to Category No.: 9518, 14062, 14068, 101, 516; Payload ID: 876 relates to Category No.: 9518, 14068, 516, 11939, 517, 15403, 7490; Payload ID: 877 relates to Category No.: 9518, 516; Payload ID: 878 relates to Category No.: 9518, 1630, 6924, 516, 4285, 5317, 4284, 11861; Payload ID: 879 relates to Category No.: 9518, 1630, 6924, 516, 4285, 5317, 4284; Payload ID: 880 relates to Category No.: 9518, 516; Payload ID: 881 relates to Category No.: 926, 9518, 1630, 10116, 11861, 4565, 4583; Payload ID: 882 relates to Category No.: 3554, 9518, 516, 517, 9518, 318, 7477; Payload ID: 883 relates to Category No.: 9518, 101, 516, 1123, 517, 509, 9518, 318, 7477; Payload ID: 884 relates to Category No.: 9518, 101, 516, 517, 6317, 6318, 6664; Payload ID: 885 relates to Category No.: 9518, 11861, 101, 517, 9518, 318, 7477; Payload ID: 886 relates to Category No.: 9518, 101, 516, 517; Payload ID: 887 relates to Category No.: 3554, 9518, 516, 5347, 64; Payload ID: 888 relates to Category No.: 11939, 9518, 516, 15062, 15061, 7472, 1531; Payload ID: 889 relates to Category No.: 9518, 10116, 4117, 516, 6544, 6917, 15358; Payload ID: 890 relates to Category No.: 9518, 11861, 516, 6038, 1166; Payload ID: 891 relates to Category No.: 9518, 14068, 516; Payload ID: 892 relates to Category No.: 9518, 101, 516, 634, 63, 149, 9518, 318, 7477, 11939, 7472, 614; Payload ID: 893 relates to Category No.: 6816, 5865, 3554, 4207, 9518, 5875, 1630, 65, 7472, 9518, 308, 518, 16302, 7199; Payload ID: 894 relates to Category No.: 3554, 9518, 519, 6166; Payload ID: 895 relates to Category No.: 3554, 9518, 519, 520, 4622; Payload ID: 896 relates to Category No.: 9518, 11861, 14068, 520, 4456, 5415; Payload ID: 897 relates to Category No.: 9518, 9518, 321, 7477, 3930; Payload ID: 898 relates to Category No.: 9518, 11861, 519, 520, 5415, 9518, 314, 12354, 1185, 1531, 42, 9788, 5948, 15487, 688; Payload ID: 899 relates to Category No.: 9518, 519, 9518, 314, 12354, 1185, 1531, 9788, 5948, 15487; Payload ID: 900 relates to Category No.: 9518, 14068, 14089, 15302, 519, 520, 4456, 5415, 9518, 314, 12354, 689, 15299, 9788, 3262, 11804, 5947, 11817, 40, 5948, 15487, 3031; Payload ID: 901 relates to Category No.: 9518; Payload ID: 902 relates to Category No.: 3554, 9518, 14068, 520, 9518, 314, 12354, 1193, 689, 2322; Payload ID: 903 relates to Category No.: 9518, 14961, 3031; Payload ID: 904 relates to Category No.: 9518, 27; Payload ID: 905 relates to Category No.: 3554, 519, 9789; Payload ID: 906 relates to Category No.: 3554, 520; Payload ID: 907 relates to Category No.: 9518; Payload ID: 908 relates to Category No.: 267, 4311, 10116, 11861, 2936, 5347, 15766, 4302; Payload ID: 909 relates to Category No.: 4311, 11861, 2936, 5347, 943, 4302, 4308, 9824; Payload ID: 910 relates to Category No.: 4311, 11861, 2936; Payload ID: 911 relates to Category No.: 6598, 2320, 15542, 15553; Payload ID: 912 relates to Category No.: 6598; Payload ID: 913 relates to Category No.: 15542, 15553; Payload ID: 914 relates to Category No.: 3414; Payload ID: 915 relates to Category No.: 3414; Payload ID: 916 relates to Category No.: 4433; Payload ID: 917 relates to Category No.: 6598, 15542, 15553, 556, 3420; Payload ID: 918 relates to Category No.: 15542, 15554, 2861, 10116, 11861, 7447; Payload ID: 919 relates to Category No.: 11854, 7447; Payload ID: 920 relates to Category No.: 11933, 11861, 1439, 12064, 551, 4432; Payload ID: 921 relates to Category No.: 15542, 15554, 551, 3418; Payload ID: 922 relates to Category No.: 9361, 3416, 3412, 3413; Payload ID: 923 relates to Category No.: 15542, 15554, 3409, 4557; Payload ID: 924 relates to Category No.: 15542, 15554, 3409, 551; Payload ID: 925 relates to Category No.: 6598, 15542, 15553, 3421, 3419; Payload ID: 926 relates to Category No.: 5308, 307, 5403, 2201, 3249; Payload ID: 927 relates to Category No.: 5308, 307, 5403, 2201, 3249; Payload ID: 928 relates to Category No.: 5308, 307, 5403, 10011; Payload ID: 929 relates to Category No.: 16331, 6478, 1630, 9804, 525, 11861, 11828;

Payload ID: 930 relates to Category No.: 6816, 1630, 9804, 525, 12327, 11861; Payload ID: 931 relates to Category No.: 16331, 6478, 1630, 9804, 525, 11861; Payload ID: 932 relates to Category No.: 6816, 1630, 9804, 525; Payload ID: 933 relates to Category No.: 9518, 4158, 3380, 6908; Payload ID: 934 relates to Category No.: 9518, 4158, 3397, 2928, 9518, 315, 16283, 83, 679; Payload ID: 935 relates to Category No.: 9518, 6049, 11861, 4158, 3397, 9518, 315, 16283, 83, 679, 2928; Payload ID: 936 relates to Category No.: 6816, 267, 9518, 9518, 315, 16283, 83, 679, 11861, 3034; Payload ID: 937 relates to Category No.: 6816, 10116, 9518, 315, 16283, 83, 679, 9508; Payload ID: 938 relates to Category No.: 6816, 9518, 11861, 3274; Payload ID: 939 relates to Category No.: 6816, 3274; Payload ID: 940 relates to Category No.: 16331, 5865, 9518, 6924, 9518, 315, 16283, 83, 679, 11861, 15699, 15689, 9226, 9282; Payload ID: 941 relates to Category No.: 5865, 9518, 4656; Payload ID: 942 relates to Category No.: 4207, 9518, 1630, 11861, 4075, 9518, 308, 534; Payload ID: 943 relates to Category No.: 536; Payload ID: 944 relates to Category No.: 1405, 277, 7192, 11861; Payload ID: 945 relates to Category No.: 1405, 277; Payload ID: 946 relates to Category No.: 11861, 7192; Payload ID: 947 relates to Category No.: 15542, 15554, 15542, 15553; Payload ID: 948 relates to Category No.: 4363, 6003, 15468; Payload ID: 949 relates to Category No.: 11861; Payload ID: 950 relates to Category No.: 15973, 11861, 4993; Payload ID: 951 relates to Category No.: 926, 3303, 16331, 4965, 6900, 5105, 11861, 3325, 2418, 3378, 2405; Payload ID: 952 relates to Category No.: 2557, 15771; Payload ID: 953 relates to Category No.: 242; Payload ID: 954 relates to Category No.: 11861, 7192; Payload ID: 955 relates to Category No.: 11939, 4976, 14504, 11861, 14662, 5350, 1403, 1425; Payload ID: 956 relates to Category No.: 9625, 11861, 14134, 4710, 12136; Payload ID: 957 relates to Category No.: 2858, 5958; Payload ID: 958 relates to Category No.: 14504, 12402, 11861, 3665, 1439, 3752, 11828, 5715, 5618, 4865, 15775; Payload ID: 959 relates to Category No.: 14504, 9620, 3665; Payload ID: 960 relates to Category No.: 15023; Payload ID: 961 relates to Category No.: 6816; Payload ID: 962 relates to Category No.: 926, 12109, 5956; Payload ID: 963 relates to Category No.: 926, 12109, 11861; Payload ID: 964 relates to Category No.: 926, 12109, 11861; Payload ID: 965 relates to Category No.: 1630, 12402, 589; Payload ID: 966 relates to Category No.: 11861, 7192; Payload ID: 967 relates to Category No.: 4894, 14107, 5347; Payload ID: 969 relates to Category No.: 11861, 7192; Payload ID: 970 relates to Category No.: 3303, 15503, 14471, 14471, 15495, 14243, 11861, 15528, 14255, 11933, 11939; Payload ID: 971 relates to Category No.: 3303, 14471; Payload ID: 972 relates to Category No.: 3303, 14471, 14243, 15503, 14471, 11861, 11933, 15528, 14255, 5235; Payload ID: 973 relates to Category No.: 9282, 9226; Payload ID: 974 relates to Category No.: 4864, 15028; Payload ID: 975 relates to Category No.: 4864, 15028, 11861, 5347, 5314; Payload ID: 976 relates to Category No.: 15028; Payload ID: 977 relates to Category No.: 7192; Payload ID: 978 relates to Category No.: 6816, 7192, 5308, 307, 5308, 307, 5401, 5362; Payload ID: 979 relates to Category No.: 5308, 5308, 307, 6816, 11861, 7445; Payload ID: 980 relates to Category No.: 1405, 16331, 11939, 1647, 12399, 5009, 2672, 11727, 12352, 14730, 3471, 11886, 3225, 5078, 6922, 11794; Payload ID: 981 relates to Category No.: 3554, 2672, 11727, 12352, 15747, 626, 524, 9790; Payload ID: 982 relates to Category No.: 1405, 11939, 11933, 1647, 2672, 11727, 12352, 11861, 15747, 626, 524, 9790; Payload ID: 983 relates to Category No.: 11939, 2874, 11861, 15699, 4896; Payload ID: 984 relates to Category No.: 11861; Payload ID: 985 relates to Category No.: 5308, 6829, 629, 6816; Payload ID: 986 relates to Category No.: 6816, 11861, 7192, 5308, 311, 5308, 307, 5403, 629, 5347; Payload ID: 987 relates to Category No.: 11939, 12292, 5983, 78, 1630; Payload ID: 988 relates to Category No.: 926, 1630, 252; Payload ID: 989 relates to Category No.: 6478, 5239, 11861; Payload ID: 990 relates to Category No.: 9518, 14339, 6283, 14338, 6172; Payload ID: 991 relates to Category No.: 6816, 5308, 11861, 635; Payload ID: 992 relates to Category No.: 16331, 6816, 1630, 5347, 10172, 6095; Payload ID: 993 relates to Category No.: 15489, 636; Payload ID: 994 relates to Category No.: 16331, 6829, 637, 9629, 6821; Payload ID: 995 relates to Category No.: 637, 11861, 6574, 6828; Payload ID: 996 relates to Category No.: 15495, 11861; Payload ID: 998 relates to Category No.: 12402; Payload ID: 999 relates to Category No.: 9939, 11861; Payload ID: 1000 relates to Category No.: 2874, 11861, 3774, 4864; Payload ID: 1001 relates to Category No.: 6816, 1630, 1646, 11861, 567; Payload ID: 1002 relates to Category No.: 6816, 1630, 1646, 11861, 567; Payload ID: 1003 relates to Category No.: 6816, 1630, 1646, 11861, 567; Payload ID: 1004 relates to Category No.: 1405, 1630, 1646, 567, 2327; Payload ID: 1005 relates to Category No.: 6816, 1630, 1646, 567; Payload ID: 1006 relates to Category No.: 1630, 11861, 4688, 139, 662, 10163, 10154, 1504; Payload ID: 1007 relates to Category No.: 3303, 14504, 12402, 5009, 15583, 11861, 5347, 3752, 217, 12227, 9617, 4867; Payload ID: 1008 relates to Category No.: 11861, 9608, 11886, 1146, 9887; Payload ID: 1009 relates to Category No.: 11861; Payload ID: 1010 relates to Category No.: 11861, 3753, 3752, 1146; Payload ID: 1011 relates to Category No.: 2405, 15504, 5105, 11861, 1146, 11782, 11886, 15230; Payload ID: 1012 relates to Category No.: 11861; Payload ID: 1013 relates to Category No.: 15504, 11861, 1146; Payload ID: 1014 relates to Category No.: 15504, 11861, 1146; Payload ID: 1015 relates to Category No.: 5009, 15583, 11861, 5347, 560, 563, 562; Payload ID: 1016 relates to Category No.: 5009, 15583, 3303, 14504, 11861, 5347; Payload ID: 1017 relates to Category No.: 6974, 11861; Payload ID: 1018 relates to Category No.: 1405, 15973, 1504, 2613, 16204; Payload ID: 1019 relates to Category No.: 11939, 14107, 4924, 12359, 11861, 12360, 12108, 12364, 12383; Payload ID: 1020 relates to Category No.: 11861; Payload ID: 1021 relates to Category No.: 11861, 7192; Payload ID: 1022 relates to Category No.: 11861; Payload ID: 1024 relates to Category No.: 16331, 15908, 15893, 11861, 2793, 15916; Payload ID: 1028 relates to Category No.: 15895, 15893; Payload ID: 1029 relates to Category No.: 15908, 11861, 12081; Payload ID: 1030 relates to Category No.: 11861, 12081; Payload ID: 1031 relates to Category No.: 11861, 12081; Payload ID: 1032 relates to Category No.: 11978, 926, 15612, 12145, 11861, 5347, 9016; Payload ID: 1033 relates to Category No.: 11861, 15887, 15907; Payload ID: 1034 relates to Category No.: 3303, 16331, 15503, 14471, 14471, 685, 14961, 11861, 11680, 14234, 2405, 15504, 11917, 15524, 12402, 1153, 14251, 6183, 15528, 14233, 3752, 14252, 943, 681; Payload ID: 1036 relates to Category No.: 11861; Payload ID: 1037 relates to Category No.: 1434, 4976, 9524, 11861; Payload ID: 1038 relates to Category No.: 11920, 3957; Payload ID: 1039 relates to Category No.: 7265; Payload ID: 1040 relates to Category No.: 5009, 11861; Payload ID: 1041 relates to Category No.: 9226, 11861; Payload ID: 1042 relates to Category No.: 3303, 14309, 267, 11939, 12402, 3655, 5009, 2672, 11861, 9629, 14134; Payload ID: 1043 relates to Category No.: 12399, 11861, 694; Payload ID: 1044 relates to Category No.: 11861, 5347; Payload ID: 1045 relates to Category No.:

11861, 5347; Payload ID: 1046 relates to Category No.: 11861, 12425, 12402; Payload ID: 1047 relates to Category No.: 6816, 12402, 11861, 12425; Payload ID: 1048 relates to Category No.: 12425, 15611; Payload ID: 1049 relates to Category No.: 12402; Payload ID: 1050 relates to Category No.: 12402; Payload ID: 1051 relates to Category No.: 4864, 5588, 3753, 9938; Payload ID: 1052 relates to Category No.: 11861, 3753; Payload ID: 1056 relates to Category No.: 6829, 9671, 16331, 267, 7126, 3663, 1538, 11861, 3471, 7125, 15677, 2327, 3998, 1294, 6816; Payload ID: 1057 relates to Category No.: 16331, 6829, 3663, 1538, 9671, 11861, 4710, 16206; Payload ID: 1058 relates to Category No.: 11933, 4820, 701, 11861, 1294, 700; Payload ID: 1059 relates to Category No.: 4820, 701, 11861, 12401, 15504, 9636; Payload ID: 1060 relates to Category No.: 11861, 701; Payload ID: 1061 relates to Category No.: 4864, 5259, 14504, 14733, 11861, 15114, 15784, 15791, 699; Payload ID: 1062 relates to Category No.: 267, 11861; Payload ID: 1063 relates to Category No.: 9813, 5473, 5471; Payload ID: 1064 relates to Category No.: 9226, 14196, 11861; Payload ID: 1065 relates to Category No.: 15021, 15029, 11861, 2931, 3752, 943, 14812; Payload ID: 1066 relates to Category No.: 11861, 11861, 1327, 11981, 5841, 3752, 943, 14812, 11665, 15021; Payload ID: 1067 relates to Category No.: 15021, 11861, 1327, 1369, 11861, 2936, 5841, 14812; Payload ID: 1068 relates to Category No.: 15491, 11861, 9173, 1201; Payload ID: 1069 relates to Category No.: 15590, 11861; Payload ID: 1070 relates to Category No.: 11933, 11861, 7192; Payload ID: 1071 relates to Category No.: 11861; Payload ID: 1072 relates to Category No.: 11861; Payload ID: 1073 relates to Category No.: 1405, 11861; Payload ID: 1074 relates to Category No.: 6816, 12359, 11861, 9865; Payload ID: 1075 relates to Category No.: 16331, 15893, 11861, 15889, 15908, 6816; Payload ID: 1076 relates to Category No.: 9226, 14196, 10116, 11861; Payload ID: 1077 relates to Category No.: 11978, 926, 12109, 11861; Payload ID: 1078 relates to Category No.: 11861; Payload ID: 1079 relates to Category No.: 11861, 12088, 12077; Payload ID: 1080 relates to Category No.: 6816, 11861; Payload ID: 1081 relates to Category No.: 6816, 11861; Payload ID: 1082 relates to Category No.: 11861, 7192; Payload ID: 1083 relates to Category No.: 11861; Payload ID: 1084 relates to Category No.: 11861; Payload ID: 1085 relates to Category No.: 11861; Payload ID: 1086 relates to Category No.: 11861; Payload ID: 1087 relates to Category No.: 11861; Payload ID: 1088 relates to Category No.: 11861; Payload ID: 1089 relates to Category No.: 11861; Payload ID: 1091 relates to Category No.: 11861; Payload ID: 1092 relates to Category No.: 11861; Payload ID: 1093 relates to Category No.: 11861; Payload ID: 1094 relates to Category No.: 11861, 15893, 15908, 15895, 3752; Payload ID: 1095 relates to Category No.: 11861; Payload ID: 1096 relates to Category No.: 11861; Payload ID: 1097 relates to Category No.: 11861; Payload ID: 1098 relates to Category No.: 11861; Payload ID: 1099 relates to Category No.: 11861; Payload ID: 1100 relates to Category No.: 11861; Payload ID: 1101 relates to Category No.: 11861, 3765; Payload ID: 1102 relates to Category No.: 11861; Payload ID: 1103 relates to Category No.: 11861; Payload ID: 1104 relates to Category No.: 11861; Payload ID: 1105 relates to Category No.: 11861; Payload ID: 1106 relates to Category No.: 6816, 15911, 11861; Payload ID: 1107 relates to Category No.: 3303, 9539, 15495, 5109, 15429, 11861, 14252, 14324, 14246, 15504; Payload ID: 1108 relates to Category No.: 11861; Payload ID: 1109 relates to Category No.: 11861; Payload ID: 1110 relates to Category No.: 11861; Payload ID: 1111 relates to Category No.: 11861; Payload ID: 1112 relates to Category No.: 11861; Payload ID: 1113 relates to Category No.: 11861; Payload ID: 1114 relates to Category No.: 12402, 11861; Payload ID: 1115 relates to Category No.: 11861; Payload ID: 1116 relates to Category No.: 9226, 14196, 2405, 10116, 11861; Payload ID: 1117 relates to Category No.: 11861; Payload ID: 1118 relates to Category No.: 11861; Payload ID: 1119 relates to Category No.: 15429, 11861, 15024, 11979, 14245, 2405; Payload ID: 1120 relates to Category No.: 11861; Payload ID: 1121 relates to Category No.: 11861; Payload ID: 1122 relates to Category No.: 11861; Payload ID: 1123 relates to Category No.: 11861; Payload ID: 1124 relates to Category No.: 11861; Payload ID: 1125 relates to Category No.: 15429, 11861; Payload ID: 1126 relates to Category No.: 11861; Payload ID: 1127 relates to Category No.: 11861; Payload ID: 1128 relates to Category No.: 4894, 4924, 14706, 12359, 11861; Payload ID: 1129 relates to Category No.: 11861; Payload ID: 1130 relates to Category No.: 11861; Payload ID: 1131 relates to Category No.: 11861, 3303, 15503, 14471; Payload ID: 1132 relates to Category No.: 11861, 7192; Payload ID: 1133 relates to Category No.: 11861; Payload ID: 1134 relates to Category No.: 11861; Payload ID: 1135 relates to Category No.: 11861; Payload ID: 1136 relates to Category No.: 11861; Payload ID: 1137 relates to Category No.: 11861; Payload ID: 1138 relates to Category No.: 11861; Payload ID: 1139 relates to Category No.: 11861; Payload ID: 1140 relates to Category No.: 11861; Payload ID: 1141 relates to Category No.: 11861; Payload ID: 1142 relates to Category No.: 11861; Payload ID: 1143 relates to Category No.: 11861, 5843; Payload ID: 1144 relates to Category No.: 11861; Payload ID: 1145 relates to Category No.: 11861, 7192; Payload ID: 1146 relates to Category No.: 11861, 7192; Payload ID: 1147 relates to Category No.: 11861, 15027; Payload ID: 1148 relates to Category No.: 11861; Payload ID: 1149 relates to Category No.: 11861, 7192; Payload ID: 1150 relates to Category No.: 11861; Payload ID: 1151 relates to Category No.: 11861; Payload ID: 1152 relates to Category No.: 11861; Payload ID: 1153 relates to Category No.: 11861; Payload ID: 1154 relates to Category No.: 11861; Payload ID: 1155 relates to Category No.: 11861, 11886, 11992; Payload ID: 1156 relates to Category No.: 11861; Payload ID: 1157 relates to Category No.: 11861; Payload ID: 1158 relates to Category No.: 11861; Payload ID: 1159 relates to Category No.: 11861; Payload ID: 1160 relates to Category No.: 11861; Payload ID: 1161 relates to Category No.: 11861; Payload ID: 1162 relates to Category No.: 11861; Payload ID: 1163 relates to Category No.: 11861; Payload ID: 1164 relates to Category No.: 11861; Payload ID: 1165 relates to Category No.: 11861; Payload ID: 1166 relates to Category No.: 11861, 15493, 6334, 5109; Payload ID: 1167 relates to Category No.: 14564, 11861; Payload ID: 1168 relates to Category No.: 11861; Payload ID: 1169 relates to Category No.: 1405, 1438, 15029, 12402, 11861, 1327, 9939, 11861, 1439, 9922, 9938, 11939, 4965, 14597, 14602, 714, 3461; Payload ID: 1170 relates to Category No.: 1405, 1438, 11861; Payload ID: 1171 relates to Category No.: 1405, 1438, 10116, 11861, 1439, 14335, 6944, 9834; Payload ID: 1172 relates to Category No.: 1405, 1438, 9896, 9840; Payload ID: 1173 relates to Category No.: 1405, 1438, 10116, 11861, 2936, 1439, 9887, 11828, 14335, 12398, 9922, 12359, 9938; Payload ID: 1175 relates to Category No.: 1405, 1438, 1439, 9922, 9938; Payload ID: 1176 relates to Category No.: 1405, 1438, 5347, 1439, 9938, 9014; Payload ID: 1177 relates to Category No.: 1405, 1438, 9939, 9938, 11861, 1455, 12425, 9636; Payload ID: 1178 relates to Category No.: 1405, 1438, 4886, 11939, 6210, 11861, 1439, 2346, 6186, 11886; Payload ID: 1179 relates to Category No.: 1405, 1438, 5588, 10116, 11861, 1439; Payload ID: 1180 relates to Category No.: 1405, 1438, 277, 9887, 9874, 9877; Payload ID: 1181 relates to Category No.: 1405, 1438; Payload ID: 1182 relates to Category No.: 1405, 11939, 1438, 9939, 11861, 216, 9896; Payload ID: 1183 relates to Category No.: 16249, 11861, 2323, 5764, 1393, 5837, 11939, 11933; Payload ID: 1184 relates to Category No.: 5764, 1393; Payload ID: 1185 relates to Category No.: 5764, 11861, 11939, 11933; Payload ID: 1186 relates to Category No.: 9946; Payload ID: 1187 relates to Category No.: 5764, 9946; Payload ID: 1188 relates to Category No.: 5764; Payload ID: 1189 relates to Category No.: 16249, 11861, 16250, 5764, 1393, 11939, 9946; Payload ID: 1190 relates to Category No.: 5764, 9946; Payload ID: 1191 relates to Category No.: 5764; Payload ID: 1192 relates to Category No.: 5764, 9946; Payload ID: 1193 relates to Category No.: 3303, 14471; Payload ID: 1194 relates to Category No.: 4023, 14504, 9620, 5009, 11861; Payload ID: 1196 relates to Category No.: 3516, 11939, 11861, 3774; Payload ID: 1197 relates to Category No.: 3516, 11861; Payload ID: 1198 relates to Category No.: 6816, 15617, 12399, 277, 11861, 2566; Payload ID: 1199 relates to Category No.: 6816, 12399, 11861; Payload ID: 1200 relates to Category No.: 6816, 12399; Payload ID: 1201 relates to Category No.: 5865, 11861; Payload ID: 1202 relates to Category No.: 4864, 5259, 12402, 11861, 15567; Payload ID: 1203 relates to Category No.: 11978, 926, 6816, 12399, 11861, 12418, 15609, 5260, 751, 15563, 15821; Payload ID: 1204 relates to Category No.: 6816, 2672, 11861, 2671, 6823, 2681, 2678; Payload ID: 1205 relates to Category No.: 2405, 5105, 11861; Payload ID: 1206 relates to Category No.: 11861, 5105; Payload ID: 1207 relates to Category No.: 1630, 11861, 9440; Payload ID: 1208 relates to Category No.: 1630, 11861, 9440, 12282; Payload ID: 1210 relates to Category No.: 11861, 5628; Payload ID: 1211 relates to Category No.: 12199, 14292; Payload ID: 1215 relates to Category No.: 15629, 15071, 4540, 15619; Payload ID: 1218 relates to Category No.: 2873; Payload ID: 1221 relates to Category No.: 15050; Payload ID: 1227 relates to Category No.: 11978, 926, 12109, 11861, 9122, 767; Payload ID: 1228 relates to Category No.: 6816, 16331, 11861, 5347, 6923; Payload ID: 1229 relates to Category No.: 1153, 11861, 9887; Payload ID: 1230 relates to Category No.: 11861, 9887; Payload ID: 1231 relates to Category No.: 6210, 11861; Payload ID: 1232 relates to Category No.: 5259, 12402, 4821, 771; Payload ID: 1233 relates to Category No.: 4820, 12399; Payload ID: 1234 relates to Category No.: 5259, 771; Payload ID: 1235 relates to Category No.: 3303, 16331, 3655, 9225, 3457, 3380; Payload ID: 1236 relates to Category No.: 3303, 6816, 9518, 2963, 94, 3655, 15491, 15495, 9225, 14284, 10116, 9974, 3640, 11861, 3457, 9908, 15984, 3380, 2406, 14616, 14801, 11886, 9014, 3688; Payload ID: 1237 relates to Category No.: 11861, 3663; Payload ID: 1238 relates to Category No.: 9619, 11861; Payload ID: 1239 relates to Category No.: 11933, 5259; Payload ID: 1240 relates to Category No.: 9282, 9226, 14196, 11861, 14602; Payload ID: 1241 relates to Category No.: 3749; Payload ID: 1242 relates to Category No.: 2360, 9939, 6210, 11861, 1146, 9824, 5347, 3752, 2346, 9830, 2305, 788, 784, 5064, 5061, 6254, 6229, 9951, 6208; Payload ID: 1243 relates to Category No.: 7509, 7524, 9282, 6816, 11861, 11939; Payload ID: 1244 relates to Category No.: 11939, 11933, 6229, 2360, 9939, 6210, 11861, 9824, 2346, 9830, 788, 5064, 5061, 6208; Payload ID: 1245 relates to Category No.: 11939, 6229, 2360, 6210, 2672, 753, 11861, 9824, 2346, 9830; Payload ID: 1246 relates to Category No.: 3749, 2360, 9939, 5009, 6210, 9824, 3752, 2346, 9830, 6337, 6251, 6207, 6255, 6205; Payload ID: 1247 relates to Category No.: 6229, 2360, 9939, 5009, 11861, 6337, 6207, 1201, 6210; Payload ID: 1248 relates to Category No.: 16331, 14196, 5308, 1630, 5308, 307, 5402, 11861, 2865, 992, 11920, 7268, 3749, 14147, 2929; Payload ID: 1249 relates to Category No.: 16331, 14196, 1630, 5308, 307, 5402, 2865; Payload ID: 1250 relates to Category No.: 16331, 5308, 1630, 11861, 2865, 3074; Payload ID: 1251 relates to Category No.: 16331, 5308, 1630, 5308, 307, 5402, 10116, 3074; Payload ID: 1252 relates to Category No.: 16331, 5308, 1630, 5308, 307, 5402, 10116, 11861; Payload ID: 1253 relates to Category No.: 16331, 5308, 1630, 5308, 307, 5402; Payload ID: 1254 relates to Category No.: 16331, 14196, 5308, 1630, 5308, 307, 5402, 10116, 11861, 2865; Payload ID: 1255 relates to Category No.: 16331, 14196, 5308, 11939, 1630, 5308, 307, 5402, 11861, 2865, 3074; Payload ID: 1256 relates to Category No.: 16331, 5308, 1630, 5308, 307, 5402, 11861, 2865; Payload ID: 1257 relates to Category No.: 16331, 5308, 307, 5402; Payload ID: 1258 relates to Category No.: 16153; Payload ID: 1259 relates to Category No.: 9824, 9938, 9830, 4103, 6208; Payload ID: 1260 relates to Category No.: 3749, 11939, 6210, 9923, 9925, 6208, 6251; Payload ID: 1261 relates to Category No.: 6210, 9939, 3755, 2346, 5064, 6208; Payload ID: 1262 relates to Category No.: 6229; Payload ID: 1263 relates to Category No.: 6229, 11861, 2346, 15629, 6210, 14662; Payload ID: 1264 relates to Category No.: 11939, 6229, 2360, 9939, 5009, 6210, 753, 11861, 1146, 5347, 2346, 9830, 15230, 6337, 6815, 16154, 6254; Payload ID: 1265 relates to Category No.: 6229, 12402, 2346; Payload ID: 1266 relates to Category No.: 9939, 5009, 6210, 11861, 5347, 4710, 6251; Payload ID: 1267 relates to Category No.: 6210; Payload ID: 1268 relates to Category No.: 6210, 11861, 2323; Payload ID: 1269 relates to Category No.: 12402, 6210, 5061; Payload ID: 1270 relates to Category No.: 14564, 6229, 6210; Payload ID: 1271 relates to Category No.: 6210, 7192, 11861; Payload ID: 1272 relates to Category No.: 6210, 5061; Payload ID: 1273 relates to Category No.: 6210; Payload ID: 1274 relates to Category No.: 6229, 9939, 753; Payload ID: 1275 relates to Category No.: 11861; Payload ID: 1276 relates to Category No.: 11861; Payload ID: 1278 relates to Category No.: 10116, 11861, 6127; Payload ID: 1279 relates to Category No.: 9226, 11861, 3993; Payload ID: 1280 relates to Category No.: 10116, 11861, 4183, 1201; Payload ID: 1281 relates to Category No.: 15908, 6188, 15893; Payload ID: 1282 relates to Category No.: 11861; Payload ID: 1283 relates to Category No.: 11978, 926, 12109, 11861, 12145; Payload ID: 1284 relates to Category No.: 11917, 4207, 9518, 3554, 9518, 314, 11861, 7488, 3303, 4075; Payload ID: 1285 relates to Category No.: 3303, 4207, 9518, 7502, 3557; Payload ID: 1286 relates to Category No.: 6816, 4207, 9518, 65; Payload ID: 1287 relates to Category No.: 3303, 11933, 2405, 3459, 11861; Payload ID: 1288 relates to Category No.: 9282, 9226, 942, 10116, 11861, 3752; Payload ID: 1289 relates to Category No.: 926, 9282, 11861, 456, 2853, 5347, 4961; Payload ID: 1290 relates to Category No.: 6816, 2405, 2963, 3459, 1630, 3464, 3302, 11861, 9918, 12064, 9961, 10140, 3303; Payload ID: 1291 relates to Category No.: 9282, 6816, 94, 3640, 11861, 3380, 4820; Payload ID: 1292 relates to Category No.: 15629, 15619, 644, 11861, 4631, 11662, 5767, 16270, 1521, 16273, 11675, 4635, 9056, 3765; Payload ID: 1293 relates to Category No.: 15629, 15997, 4631, 16270; Payload ID: 1294 relates to Category No.: 15629, 7192; Payload ID: 1295 relates to Category No.: 15629; Payload ID: 1296 relates to Category No.: 15629; Payload ID: 1297 relates to Category No.: 15629, 4631, 16270, 16273, 4635; Payload ID: 1298 relates to Category No.: 15629, 15997, 4631, 16270; Payload ID: 1299 relates to Category No.: 15629, 4631, 16270, 16273; Payload ID: 1300 relates to Category No.: 15629, 11861, 4631, 16270; Payload ID: 1301 relates to Category No.: 15629, 4631, 16270, 706, 9045; Payload ID: 1302 relates to Category No.: 15629, 15997, 4631, 16270; Payload ID: 1303 relates to Category No.: 15629, 4631, 16270; Payload ID: 1304 relates to Category No.: 15629, 15997, 4631, 16270, 618, 12243, 12304, 16273, 10145, 10171, 1534; Payload ID: 1305 relates to Category No.: 10116, 11861; Payload ID: 1306 relates to Category No.: 6816, 5865, 9518, 317, 5414, 11861, 6199, 806, 5028, 5025; Payload ID: 1307 relates to Category No.: 6816, 5865, 9518, 317, 5414, 11861, 806, 6200, 1630; Payload ID: 1308 relates to Category No.: 6816, 5865, 9518, 317, 5414, 11861, 9887, 807, 806, 3762, 5025, 5028; Payload ID: 1309 relates to Category No.: 1405, 6816, 5865, 6210, 9518, 317, 5414, 11861, 6199, 807, 809; Payload ID: 1310 relates to Category No.: 6816, 5865, 9518, 317, 5414, 11861, 808; Payload ID: 1311 relates to Category No.: 3749, 11861, 12064, 813, 11939, 11933, 3752, 808; Payload ID: 1312 relates to Category No.: 6816, 9518, 317, 5414, 11861, 6401, 5865, 5025; Payload ID: 1313 relates to Category No.: 11978, 926, 6816, 12109, 11861, 12417; Payload ID: 1314 relates to Category No.: 7462, 11861, 818, 866, 37; Payload ID: 1315 relates to Category No.: 16331, 6816, 6829; Payload ID: 1316 relates to Category No.: 16331, 6829; Payload ID: 1317 relates to Category No.: 10116; Payload ID: 1318 relates to Category No.: 6816, 4894, 11861; Payload ID: 1319 relates to Category No.: 6816, 4894, 11861, 12359; Payload ID: 1320 relates to Category No.: 6816, 4894, 11861; Payload ID: 1321 relates to Category No.: 6816, 4894, 11861, 5477; Payload ID: 1322 relates to Category No.: 6816, 4894, 11861, 1327, 11861, 9887, 9874, 9877, 5477; Payload ID: 1323 relates to Category No.: 3303, 6816, 14196, 4894, 11861; Payload ID: 1324 relates to Category No.: 4894, 6816, 7192; Payload ID: 1325 relates to Category No.: 6816, 4886, 4894, 9939, 11861; Payload ID: 1326 relates to Category No.: 6816, 4886, 4894, 11861, 11981, 11977; Payload ID: 1327 relates to Category No.: 6816, 4886, 4894, 11861, 10163, 4895; Payload ID: 1328 relates to Category No.: 6816, 4894, 11861; Payload ID: 1329 relates to Category No.: 6816, 4894, 11861; Payload ID: 1330 relates to Category No.: 4894, 11861, 6816; Payload ID: 1331 relates to Category No.: 6816, 4894; Payload ID: 1332 relates to Category No.: 6816, 4894, 11861, 9874, 15784; Payload ID: 1333 relates to Category No.: 6816, 4894, 11861, 9874; Payload ID: 1334 relates to Category No.: 4894, 6816, 11861, 9874, 9877; Payload ID: 1335 relates to Category No.: 4894, 11861, 6816, 9887, 9874; Payload ID: 1336 relates to Category No.: 3749, 6816, 4894, 11861; Payload ID: 1337 relates to Category No.: 11861, 4894; Payload ID: 1338 relates to Category No.: 820, 1201; Payload ID: 1339 relates to Category No.: 6816, 821, 5308, 307, 5404, 6574; Payload ID: 1340 relates to Category No.: 6816, 821, 5308, 307, 5404; Payload ID: 1341 relates to Category No.: 11861; Payload ID: 1342 relates to Category No.: 11978, 14564, 12402, 2859, 8959, 8907, 16052, 11861, 16053; Payload ID: 1343 relates to Category No.: 4820, 11861, 9629, 16108, 11983, 9636, 16052; Payload ID: 1344 relates to Category No.: 4820, 9629, 16108, 11983; Payload ID: 1345 relates to Category No.: 9629, 4820, 11861, 16108; Payload ID: 1346 relates to Category No.: 11861; Payload ID: 1347 relates to Category No.: 11861; Payload ID: 1348 relates to Category No.: 10116, 11861; Payload ID: 1349 relates to Category No.: 11861; Payload ID: 1350 relates to Category No.: 3303, 14471; Payload ID: 1351 relates to Category No.: 3303, 16331, 15503, 14471, 2405, 14471, 11861, 10134, 14249, 14246; Payload ID: 1352 relates to Category No.: 1630, 11861, 835; Payload ID: 1353 relates to Category No.: 926, 10116, 11861, 5347, 620, 837, 15468; Payload ID: 1354 relates to Category No.: 16331, 637, 6829, 9629, 6828, 6821, 3821, 1201; Payload ID: 1355 relates to Category No.: 16331, 6829, 9629, 6821, 1201; Payload ID: 1356 relates to Category No.: 11861, 838; Payload ID: 1357 relates to Category No.: 926, 9282, 11861, 632, 834, 15699, 822; Payload ID: 1358 relates to Category No.: 926, 9282, 10116, 632, 834; Payload ID: 1359 relates to Category No.: 9226, 11861, 14196, 3464, 10116, 14232, 2688, 14602, 7010, 14234, 15524; Payload ID: 1360 relates to Category No.: 9226, 6816, 11895, 15592, 3688, 3464, 10116, 11861, 14232, 2688, 14602, 14609, 7010, 14195, 3688, 2520, 3688, 2519, 14196, 7268; Payload ID: 1361 relates to Category No.: 15592, 11861, 9226, 3464, 10116, 14602, 7010, 14196; Payload ID: 1362 relates to Category No.: 9226, 3464, 11861, 14602, 7010, 14196; Payload ID: 1365 relates to Category No.: 16331, 15908, 15895, 15893, 6188, 11861, 15889, 15906, 6816; Payload ID: 1366 relates to Category No.: 15908, 16331, 9226, 15893, 6188, 11861, 15889; Payload ID: 1367 relates to Category No.: 3303, 14471, 14251, 14471, 14240, 2405, 15530, 14239; Payload ID: 1368 relates to Category No.: 4886; Payload ID: 1369 relates to Category No.: 6816, 11861, 1201; Payload ID: 1370 relates to Category No.: 1201; Payload ID: 1371 relates to Category No.: 1201; Payload ID: 1372 relates to Category No.: 11861, 1201; Payload ID: 1373 relates to Category No.: 11861, 1201; Payload ID: 1374 relates to Category No.: 11861, 1201; Payload ID: 1375 relates to Category No.: 11861, 1201; Payload ID: 1376 relates to Category No.: 11861, 1201; Payload ID: 1377 relates to Category No.: 11861, 1201; Payload ID: 1378 relates to Category No.: 11861, 1201; Payload ID: 1379 relates to Category No.: 11861, 1201; Payload ID: 1380 relates to Category No.: 11861, 1201; Payload ID: 1381 relates to Category No.: 11861, 1201; Payload ID: 1382 relates to Category No.: 11861, 1201; Payload ID: 1383 relates to Category No.: 11861, 1201; Payload ID: 1384 relates to Category No.: 11861, 1201; Payload ID: 1386 relates to Category No.: 11861, 1201; Payload ID: 1387 relates to Category No.: 926; Payload ID: 1388 relates to Category No.: 926, 11861; Payload ID: 1389 relates to Category No.: 926, 15021, 277; Payload ID: 1390 relates to Category No.: 926, 15021, 277, 11861; Payload ID: 1391 relates to Category No.: 926, 267, 7192; Payload ID: 1392 relates to Category No.: 926, 267, 7192; Payload ID: 1393 relates to Category No.: 11861; Payload ID: 1394 relates to Category No.: 11861; Payload ID: 1395 relates to Category No.: 926, 11861; Payload ID: 1397 relates to Category No.: 11861, 9961, 9387, 11920; Payload ID: 1400 relates to Category No.: 11861, 1138; Payload ID: 1403 relates to Category No.: 15504, 4894, 15524, 15895, 5551, 11861, 3753, 699, 7126, 2859, 3936, 9961, 5841, 4241, 2489, 16054, 767, 557, 559, 12090; Payload ID: 1404 relates to Category No.: 11890, 15895, 12402, 4821, 11861, 3752, 6337, 699, 11979, 11920, 11886, 7125, 15784, 37, 4241, 2953, 557, 559, 15796, 10073; Payload ID: 1405 relates to Category No.: 926, 6816, 15629, 942, 11861, 855; Payload ID: 1406 relates to Category No.: 14351, 854, 6899; Payload ID: 1407 relates to Category No.: 4864, 12402, 11861; Payload ID: 1409 relates to Category No.: 3303, 15503, 14471, 11933, 15504, 11917, 15524, 14251, 6183, 11861, 5282, 3530, 3731, 14471, 15503, 14239; Payload ID: 1410 relates to Category No.:

14564, 15504, 15973, 15491, 11861, 4346, 15493, 863; Payload ID: 1411 relates to Category No.: 15973, 11861, 4085; Payload ID: 1412 relates to Category No.: 15503, 14471, 11933, 14471, 15504, 11917, 11861, 15503, 14239, 863, 3731, 3303, 15491, 15503, 15504, 862; Payload ID: 1413 relates to Category No.: 11917, 3303, 14471, 15503, 14233, 11861, 2688, 15525, 13735, 863, 5282, 3530, 15503, 14471, 11933, 15528, 14252, 2691, 1178; Payload ID: 1414 relates to Category No.: 15503, 14471, 11917, 15503, 14233, 3530, 11861; Payload ID: 1415 relates to Category No.: 5308, 15663, 1630, 1536, 2998, 6206, 14492; Payload ID: 1416 relates to Category No.: 5308, 1536; Payload ID: 1417 relates to Category No.: 5308; Payload ID: 1418 relates to Category No.: 5308, 1536; Payload ID: 1419 relates to Category No.: 5308, 869; Payload ID: 1420 relates to Category No.: 15503, 14471, 11933, 11917, 863, 15528, 14233, 3303, 14234; Payload ID: 1421 relates to Category No.: 3303, 11917, 15530, 14252; Payload ID: 1422 relates to Category No.: 1630, 15093, 870, 1405, 11861, 2253; Payload ID: 1423 relates to Category No.: 6816, 1630, 15093, 870, 7436; Payload ID: 1424 relates to Category No.: 6816, 1630, 15093, 870; Payload ID: 1425 relates to Category No.: 6816, 1630, 15093, 870; Payload ID: 1426 relates to Category No.: 6816, 1630, 15093, 870; Payload ID: 1427 relates to Category No.: 6816, 1630, 15093, 870; Payload ID: 1428 relates to Category No.: 6816, 1630, 15093, 11861, 870; Payload ID: 1429 relates to Category No.: 6816, 1630, 15093, 870; Payload ID: 1430 relates to Category No.: 6816, 1630, 15093, 870; Payload ID: 1431 relates to Category No.: 6816, 1630, 15093, 870; Payload ID: 1432 relates to Category No.: 3303, 16331, 2405, 5229, 11861, 5207, 5208; Payload ID: 1433 relates to Category No.: 3303, 6816, 15524, 1153, 5208, 11861, 3953; Payload ID: 1434 relates to Category No.: 6816, 1504, 11861, 11939, 873; Payload ID: 1435 relates to Category No.: 1504, 11861, 873; Payload ID: 1436 relates to Category No.: 11861, 6434, 874, 51; Payload ID: 1437 relates to Category No.: 5308, 874, 1150; Payload ID: 1438 relates to Category No.: 926, 11939, 11861, 878, 2559; Payload ID: 1439 relates to Category No.: 878, 11939, 7192; Payload ID: 1440 relates to Category No.: 926, 9282, 9226, 632, 880; Payload ID: 1441 relates to Category No.: 926, 9282, 9226, 632, 880; Payload ID: 1442 relates to Category No.: 1405, 15029, 3554, 11861, 5841, 15024, 9646; Payload ID: 1443 relates to Category No.: 3274; Payload ID: 1444 relates to Category No.: 6816, 3274; Payload ID: 1445 relates to Category No.: 9518, 7510, 887; Payload ID: 1446 relates to Category No.: 11861; Payload ID: 1447 relates to Category No.: 894; Payload ID: 1448 relates to Category No.: 5308, 311, 6816, 11861, 5308, 307, 5403, 629, 897; Payload ID: 1449 relates to Category No.: 16331, 637, 6829, 11861; Payload ID: 1450 relates to Category No.: 5308, 9619, 7427, 12107; Payload ID: 1451 relates to Category No.: 926, 9282, 9226, 10116, 11861, 632, 629, 891; Payload ID: 1452 relates to Category No.: 926, 9282, 9226, 11939, 6188, 11861, 15699, 632, 891, 892; Payload ID: 1453 relates to Category No.: 1405, 11861, 2566; Payload ID: 1454 relates to Category No.: 16331, 6825, 6829, 9619, 896, 4591, 11861; Payload ID: 1455 relates to Category No.: 9225, 11861; Payload ID: 1456 relates to Category No.: 11861; Payload ID: 1457 relates to Category No.: 11861; Payload ID: 1458 relates to Category No.: 11861; Payload ID: 1459 relates to Category No.: 3303, 15503, 14471; Payload ID: 1460 relates to Category No.: 3303; Payload ID: 1461 relates to Category No.: 3303, 15491, 11861, 6184, 1201, 9275; Payload ID: 1462 relates to Category No.: 3303, 15491, 11861; Payload ID: 1463 relates to Category No.: 3303, 6816, 11861, 1201; Payload ID: 1464 relates to Category No.: 3303, 11861, 14243, 15503, 14471, 11939, 2405, 15528, 14255; Payload ID: 1465 relates to Category No.: 3303, 14240, 15528, 14233, 14234, 15528, 14239; Payload ID: 1466 relates to Category No.: 3303, 11861, 2405; Payload ID: 1467 relates to Category No.: 3303, 15503, 14471, 15524; Payload ID: 1468 relates to Category No.: 15524, 3303, 11861, 7192; Payload ID: 1469 relates to Category No.: 3303, 15524, 11861, 15504, 2405; Payload ID: 1470 relates to Category No.: 3303, 15524, 15491, 14243, 15530, 14255, 11861; Payload ID: 1471 relates to Category No.: 5960, 11861, 16296; Payload ID: 1472 relates to Category No.: 3303, 14196, 11895, 11861, 5347, 12107, 10121, 10122, 2405; Payload ID: 1473 relates to Category No.: 11861, 1201, 3752, 5347; Payload ID: 1474 relates to Category No.: 3303, 14196, 11861; Payload ID: 1475 relates to Category No.: 14196, 11895, 10116, 11861, 3774; Payload ID: 1476 relates to Category No.: 10116, 11861; Payload ID: 1477 relates to Category No.: 15911, 15895, 9363, 11861, 5347, 943, 6422, 6421; Payload ID: 1478 relates to Category No.: 15911, 9363, 11861, 14242, 5108; Payload ID: 1479 relates to Category No.: 11861, 2405; Payload ID: 1480 relates to Category No.: 11861; Payload ID: 1482 relates to Category No.: 16331, 15491, 11861, 6185; Payload ID: 1484 relates to Category No.: 1630, 547; Payload ID: 1485 relates to Category No.: 14234, 15528, 14233; Payload ID: 1486 relates to Category No.: 4886, 4895, 11861, 5347; Payload ID: 1487 relates to Category No.: 4886, 4895, 11861, 5347; Payload ID: 1488 relates to Category No.: 4886, 4895, 5347; Payload ID: 1489 relates to Category No.: 6816, 11861, 3508, 15524; Payload ID: 1490 relates to Category No.: 12109, 1201, 926, 3303, 11917, 57, 11861, 9988, 512, 11886, 12064, 3387; Payload ID: 1491 relates to Category No.: 15503, 14471, 11917, 15528, 14233, 3303, 11861, 14471, 14234, 2406; Payload ID: 1492 relates to Category No.: 3303, 11917; Payload ID: 1493 relates to Category No.: 15503, 14471, 11917, 3530, 15504, 327; Payload ID: 1494 relates to Category No.: 926, 6816, 1630, 11861, 15542, 15548, 386, 2559, 928; Payload ID: 1495 relates to Category No.: 11861; Payload ID: 1496 relates to Category No.: 11861; Payload ID: 1497 relates to Category No.: 926, 942, 12202, 14292, 12199, 14292, 15619, 10116, 11861, 5308, 305, 1636, 6933; Payload ID: 1498 relates to Category No.: 926, 5308, 305, 1636, 12199, 14292, 15629, 942, 12202, 14292, 15619, 11861, 6933; Payload ID: 1499 relates to Category No.: 926, 15629, 942, 12202, 14292, 12199, 14292, 15619, 456; Payload ID: 1500 relates to Category No.: 942, 12202, 14292, 12199, 14292, 15619; Payload ID: 1501 relates to Category No.: 942, 12202, 14292, 12199, 14292; Payload ID: 1502 relates to Category No.: 942, 12202, 14292, 12199, 14292, 15619, 10116; Payload ID: 1503 relates to Category No.: 12199, 14292, 15629, 942, 15619, 11861, 3471; Payload ID: 1504 relates to Category No.: 942, 12199, 14292, 15619, 11861, 5298; Payload ID: 1505 relates to Category No.: 15629, 6210, 11861, 5298; Payload ID: 1506 relates to Category No.: 15629, 6210, 5298; Payload ID: 1507 relates to Category No.: 15629, 6210, 5298; Payload ID: 1508 relates to Category No.: 942, 15619, 5298; Payload ID: 1509 relates to Category No.: 942, 15619, 5298; Payload ID: 1510 relates to Category No.: 942, 15619; Payload ID: 1511 relates to Category No.: 5298, 15629, 942, 15619; Payload ID: 1512 relates to Category No.: 942, 15619, 5298; Payload ID: 1513 relates to Category No.: 5298; Payload ID: 1514 relates to Category No.: 6816, 5298; Payload ID: 1515 relates to Category No.: 16331, 6822, 15766, 1201, 11861; Payload ID: 1516 relates to Category No.: 16331, 6822, 15766, 1201, 11861; Payload ID: 1517 relates to Category No.: 16331, 6822; Payload ID: 1518 relates to Category No.: 16331, 6822; Payload ID: 1519 relates to Category No.: 16331, 6822, 15766, 11861; Payload ID: 1520 relates to Category No.: 16331, 6822, 15766; Payload ID: 1523 relates to Category No.: 5308, 305, 1636; Payload ID: 1524 relates to Category No.: 926; Payload ID: 1525 relates to Category No.: 2405, 5105, 926, 942, 11861; Payload ID: 1526 relates to Category No.: 926, 942, 2405, 11861, 6427; Payload ID: 1527 relates to Category No.: 926; Payload ID: 1528 relates to Category No.: 926; Payload ID: 1529 relates to Category No.: 926; Payload ID: 1530 relates to Category No.: 926; Payload ID: 1531 relates to Category No.: 11939, 1457, 3753, 943, 944, 694, 11861; Payload ID: 1532 relates to Category No.: 926, 9282, 6816, 942, 7192, 1655; Payload ID: 1533 relates to Category No.: 926, 9282, 6816, 942, 11861, 1655, 5308; Payload ID: 1534 relates to Category No.: 926, 9282, 6816, 942, 1655; Payload ID: 1535 relates to Category No.: 926, 6816, 1655, 9282, 942; Payload ID: 1536 relates to Category No.: 926, 9282, 6816, 942, 1655; Payload ID: 1537 relates to Category No.: 926, 6478, 9953, 9282, 6816, 11861, 1655; Payload ID: 1538 relates to Category No.: 926, 9282, 6816, 6478, 9953; Payload ID: 1539 relates to Category No.: 926, 9282, 6816, 6478, 9953, 11861, 1593, 6229; Payload ID: 1540 relates to Category No.: 926, 9282, 6816, 6478, 9953, 11861; Payload ID: 1541 relates to Category No.: 926, 9282, 6816, 6478, 9953; Payload ID: 1542 relates to Category No.: 1405, 926, 9282, 6816, 11939, 1455, 11861, 5308; Payload ID: 1543 relates to Category No.: 1405, 926, 9282, 6816, 11895, 1455, 11861, 3752, 14335, 1456, 6396; Payload ID: 1544 relates to Category No.: 926, 9282, 6816, 1457, 1455, 11861, 9608; Payload ID: 1545 relates to Category No.: 1405, 926, 9282, 6816, 11895, 1457, 1455, 11861, 9608, 1431; Payload ID: 1546 relates to Category No.: 926, 9282, 6816, 1457, 1455, 9608; Payload ID: 1547 relates to Category No.: 926, 9282, 6816, 1457, 14733, 1455, 11861, 9608, 14377, 9060, 12078, 9061; Payload ID: 1548 relates to Category No.: 926, 9282, 6816, 1455, 1405, 14564, 6574, 6578; Payload ID: 1549 relates to Category No.: 926, 9282, 6816, 1455, 11861, 6578; Payload ID: 1550 relates to Category No.: 926, 9282, 6816, 1455, 11861; Payload ID: 1551 relates to Category No.: 926, 6478, 9953, 9282, 6816; Payload ID: 1552 relates to Category No.: 926, 9282, 6478, 9953, 6816; Payload ID: 1553 relates to Category No.: 9953, 926, 9282, 6816, 6478; Payload ID: 1554 relates to Category No.: 926, 9282, 6816, 6478, 9953, 11861; Payload ID: 1555 relates to Category No.: 926, 9282, 6816, 6478, 9953, 11861; Payload ID: 1556 relates to Category No.: 926, 9282, 6816, 6478, 9953, 11861; Payload ID: 1557 relates to Category No.: 926, 9282, 6816, 6478, 9953, 11861; Payload ID: 1558 relates to Category No.: 926, 9282, 6816, 6478, 9953, 5847, 11861; Payload ID: 1559 relates to Category No.: 926, 9282, 6816, 6478, 9953, 11861; Payload ID: 1560 relates to Category No.: 926, 9282, 6816, 2672, 11861, 1655, 15112, 2681, 2678, 2682; Payload ID: 1561 relates to Category No.: 926, 9282, 6816, 2672, 11861, 1655, 2682, 2683, 16331, 2678, 5308; Payload ID: 1562 relates to Category No.: 12202, 14292, 5298, 942, 2747; Payload ID: 1563 relates to Category No.: 11861, 5308, 305, 1636, 943, 942, 5307, 9984; Payload ID: 1564 relates to Category No.: 5308, 305, 1636; Payload ID: 1565 relates to Category No.: 5308, 305, 1636, 943; Payload ID: 1566 relates to Category No.: 12202, 14292, 11861, 5298, 942, 2747, 942, 15972; Payload ID: 1567 relates to Category No.: 15895, 12202, 14292, 12199, 14292, 11861, 5298; Payload ID: 1568 relates to Category No.: 5298, 15629, 12202, 14292; Payload ID: 1569 relates to Category No.: 12202, 14292, 11861, 15542, 15549, 943, 5307, 9984; Payload ID: 1570 relates to Category No.: 12202, 14292, 11861, 15542, 15549, 5307, 9984; Payload ID: 1571 relates to Category No.: 942, 2748, 11861; Payload ID: 1572 relates to Category No.: 11861, 5298, 5307, 9984, 11886; Payload ID: 1573 relates to Category No.: 5298, 11861; Payload ID: 1574 relates to Category No.: 5298, 15629, 12202, 14292, 11861, 5307, 9984; Payload ID: 1575 relates to Category No.: 11917, 11861, 5298, 5307, 9984; Payload ID: 1576 relates to Category No.: 942, 12202, 14292, 3755, 11861, 5308, 305, 1636, 1201; Payload ID: 1577 relates to Category No.: 926, 5298, 5308, 305, 1636, 11886; Payload ID: 1578 relates to Category No.: 926, 12202, 14292, 11861, 5298, 5308, 305, 1636; Payload ID: 1579 relates to Category No.: 926, 12202, 14292, 5308, 305, 1636; Payload ID: 1580 relates to Category No.: 15629, 12202, 14292, 5298, 942, 2747; Payload ID: 1581 relates to Category No.: 926, 15629, 12202, 14292, 12199, 14292, 12359; Payload ID: 1582 relates to Category No.: 12202, 14292, 12199, 14292; Payload ID: 1583 relates to Category No.: 894, 12399, 11861, 3752, 1630; Payload ID: 1584 relates to Category No.: 12202, 14292, 11861, 5298, 943; Payload ID: 1585 relates to Category No.: 12202, 14292, 11861, 5298, 943; Payload ID: 1586 relates to Category No.: 12202, 14292, 11861, 5298, 943; Payload ID: 1587 relates to Category No.: 926, 9282, 6816, 6478, 14751, 5305, 11933; Payload ID: 1588 relates to Category No.: 11861, 5305; Payload ID: 1589 relates to Category No.: 926, 9282, 6816, 14751, 5305, 11861; Payload ID: 1590 relates to Category No.: 926, 9282, 6816, 14751, 11861, 2271, 11666, 14734, 14966, 9804, 11981, 11920, 456, 712, 9844; Payload ID: 1591 relates to Category No.: 926, 9282, 6816, 942, 14751, 11861, 2271, 3471, 11666, 14734, 14966, 1655; Payload ID: 1592 relates to Category No.: 926, 9282, 6816, 14751, 2271, 14966, 5003, 14752, 11861, 2953, 5308; Payload ID: 1593 relates to Category No.: 926, 9282, 6816, 14751, 5308; Payload ID: 1594 relates to Category No.: 926, 942, 14751, 11861, 3471, 11666, 943, 941, 14734, 6944, 11895; Payload ID: 1595 relates to Category No.: 14751, 11861, 943, 941; Payload ID: 1596 relates to Category No.: 14751, 943, 941, 11861; Payload ID: 1597 relates to Category No.: 7233, 11861; Payload ID: 1598 relates to Category No.: 926, 942, 942, 2748, 12402, 9951, 2360, 9939, 15180, 11861, 782, 2346, 943, 787, 709, 14660, 783; Payload ID: 1599 relates to Category No.: 942, 2748, 926, 942; Payload ID: 1600 relates to Category No.: 926, 942, 942, 2748, 6229, 12402, 9951, 2360, 11861, 784, 6233; Payload ID: 1601 relates to Category No.: 926, 942, 2748, 9951, 2360, 942; Payload ID: 1602 relates to Category No.: 926, 9282, 942, 942, 2748; Payload ID: 1603 relates to Category No.: 926, 15629, 942, 942, 2748; Payload ID: 1604 relates to Category No.: 926, 15629, 942, 942, 2748, 9951, 2360, 9953; Payload ID: 1605 relates to Category No.: 926, 942, 942, 2748; Payload ID: 1606 relates to Category No.: 926, 942, 942, 2748; Payload ID: 1607 relates to Category No.: 942, 2748, 9951, 2360, 926, 15629, 942, 783, 11861; Payload ID: 1608 relates to Category No.: 926, 942, 942, 2748, 15629; Payload ID: 1609 relates to Category No.: 926, 942, 942, 2748; Payload ID: 1610 relates to Category No.: 926, 15629, 942, 942, 2748, 11861, 16311; Payload ID: 1611 relates to Category No.: 926, 15629, 942, 942, 2748, 11861, 11939; Payload ID: 1612 relates to Category No.: 926, 15629, 942, 942, 2748, 1478, 14764, 9984, 1195; Payload ID: 1613 relates to Category No.: 926, 942, 942, 2748, 11861, 16311, 9828, 9832; Payload ID: 1614 relates to Category No.: 926, 942, 942, 2748, 3540; Payload ID: 1615 relates to Category No.: 926, 942, 942, 2748, 4976, 4986, 3540, 4988; Payload ID: 1616 relates to Category No.:

926, 942, 942, 2748, 4986; Payload ID: 1617 relates to Category No.: 942, 2748, 926, 15629, 942; Payload ID: 1618 relates to Category No.: 926, 942, 11939, 942, 2748, 9653, 11861, 15046, 9355; Payload ID: 1619 relates to Category No.: 926, 15629, 942, 942, 2748; Payload ID: 1620 relates to Category No.: 926, 942, 942, 2748; Payload ID: 1621 relates to Category No.: 926, 942, 942, 2748, 9426, 12255; Payload ID: 1622 relates to Category No.: 926, 942, 942, 2748; Payload ID: 1623 relates to Category No.: 926, 15629, 942, 942, 2748, 11861, 9426, 11920; Payload ID: 1624 relates to Category No.: 926, 942, 2748, 9426, 15629, 942; Payload ID: 1625 relates to Category No.: 926, 942, 942, 2748, 38; Payload ID: 1626 relates to Category No.: 926, 942, 942, 2748, 9426; Payload ID: 1627 relates to Category No.: 926, 15629, 942, 942, 2748; Payload ID: 1628 relates to Category No.: 926, 942, 942, 2748, 5841, 11662, 15084, 11675, 11861, 15180; Payload ID: 1629 relates to Category No.: 926, 15629, 942, 942, 2748, 11665, 5841, 15084, 11662; Payload ID: 1630 relates to Category No.: 926, 15629, 942, 11939, 942, 2748, 11861, 5347, 3752, 6307, 9750; Payload ID: 1631 relates to Category No.: 926, 942, 11939, 942, 2748, 11861; Payload ID: 1632 relates to Category No.: 926, 942, 11939, 942, 2748, 11861, 6307, 12107; Payload ID: 1633 relates to Category No.: 926, 942, 942, 2748; Payload ID: 1634 relates to Category No.: 926, 942, 11861, 14138; Payload ID: 1635 relates to Category No.: 926, 942, 14176, 10116, 11861, 15591, 14196, 15589; Payload ID: 1636 relates to Category No.: 926, 15629, 942; Payload ID: 1637 relates to Category No.: 926, 942, 11861; Payload ID: 1638 relates to Category No.: 926, 942, 11939, 11933, 11917, 9951, 2360, 9939, 11861, 2346, 456, 15472, 14989, 4717; Payload ID: 1639 relates to Category No.: 926, 15629, 942, 11939, 942, 2748, 11861, 4986, 16311; Payload ID: 1640 relates to Category No.: 926, 942, 11939, 11933, 2360, 11861, 14989; Payload ID: 1641 relates to Category No.: 926, 942, 11933, 942, 2748, 2360, 11861; Payload ID: 1642 relates to Category No.: 926, 942, 11933, 942, 2748, 2360, 11861, 14987; Payload ID: 1643 relates to Category No.: 5923, 11861; Payload ID: 1644 relates to Category No.: 3993, 9226, 6816, 11939, 94, 14597, 11861, 96, 3987, 7356, 7358, 5923; Payload ID: 1645 relates to Category No.: 11917, 9988, 512, 11978, 926, 3303, 12109, 11861, 7356, 7358, 1201, 5956; Payload ID: 1646 relates to Category No.: 15495, 11920, 11861; Payload ID: 1647 relates to Category No.: 1504, 11861, 12399; Payload ID: 1648 relates to Category No.: 1504, 11861; Payload ID: 1649 relates to Category No.: 4820, 15617, 12399, 1664, 2294; Payload ID: 1650 relates to Category No.: 4820, 14379, 2805, 2298, 11861, 1664, 1665; Payload ID: 1651 relates to Category No.: 4820, 14379, 2694, 11861, 2805, 2804; Payload ID: 1652 relates to Category No.: 4820, 14379, 11861, 2298, 2294; Payload ID: 1653 relates to Category No.: 1630, 7265, 3736, 6913; Payload ID: 1654 relates to Category No.: 11978, 926, 12109, 11981, 5225, 11861, 12114, 15895; Payload ID: 1655 relates to Category No.: 11861; Payload ID: 1656 relates to Category No.: 11861; Payload ID: 1657 relates to Category No.: 11978, 926, 6816, 12109, 5225, 11861, 12114; Payload ID: 1658 relates to Category No.: 11978, 926, 5225, 12114; Payload ID: 1659 relates to Category No.: 2405, 7192, 11861; Payload ID: 1660 relates to Category No.: 16331, 15908, 15893, 11861, 1327, 12399, 6188, 11861, 15894, 2271, 15916, 1105, 15915; Payload ID: 1661 relates to Category No.: 3303, 16331, 2405, 15524, 5105, 14243, 11861, 15493, 15595, 15528, 14255, 5347; Payload ID: 1662 relates to Category No.: 6188, 922; Payload ID: 1663 relates to Category No.: 11861, 5347, 11886; Payload ID: 1664 relates to Category No.: 11861, 925; Payload ID: 1665 relates to Category No.: 11981, 11861; Payload ID: 1666 relates to Category No.: 11861; Payload ID: 1667 relates to Category No.: 11861, 5347, 15906; Payload ID: 1668 relates to Category No.: 11861; Payload ID: 1669 relates to Category No.: 11861; Payload ID: 1671 relates to Category No.: 6188, 11861, 3752, 925, 922, 15906; Payload ID: 1672 relates to Category No.: 2854, 2861, 11861; Payload ID: 1673 relates to Category No.: 2854, 2861, 3663, 11861; Payload ID: 1674 relates to Category No.: 2861, 2854, 9619; Payload ID: 1675 relates to Category No.: 2854; Payload ID: 1676 relates to Category No.: 11861, 925; Payload ID: 1677 relates to Category No.: 11939, 15504, 11861, 15886, 14666, 921, 924; Payload ID: 1678 relates to Category No.: 11861; Payload ID: 1680 relates to Category No.: 15895, 11861; Payload ID: 1682 relates to Category No.: 14564, 11939, 4894, 11890, 15895, 12416, 1153, 11981, 840, 14652, 11861, 5347, 3752, 5882, 9539, 11920, 11895, 12107, 14324; Payload ID: 1683 relates to Category No.: 4894, 15895, 1153, 11981, 840, 11861, 3752, 5882; Payload ID: 1684 relates to Category No.: 11861, 11920; Payload ID: 1685 relates to Category No.: 11978, 926, 15612, 12145, 11861, 16206, 9896, 11933; Payload ID: 1687 relates to Category No.: 14503, 5003, 9619, 5009, 11861, 15468; Payload ID: 1688 relates to Category No.: 11861, 12399; Payload ID: 1689 relates to Category No.: 3303; Payload ID: 1691 relates to Category No.: 4964, 11861; Payload ID: 1692 relates to Category No.: 11861, 4389; Payload ID: 1693 relates to Category No.: 6210, 6242; Payload ID: 1694 relates to Category No.: 2859, 16331, 15908, 15491, 6188, 11861, 12064; Payload ID: 1695 relates to Category No.: 16331, 15908, 6188, 2859, 11861; Payload ID: 1696 relates to Category No.: 15908, 11861, 16331, 6816, 11939, 11933, 6965, 12382, 2858, 2859, 5347, 2271, 3752, 15766, 2559, 2542; Payload ID: 1697 relates to Category No.: 15908, 2858, 6188, 11861, 15888; Payload ID: 1698 relates to Category No.: 16331, 15908, 2858, 6188, 2859, 11861, 3752; Payload ID: 1699 relates to Category No.: 16331, 15908, 2859, 11861; Payload ID: 1700 relates to Category No.: 2405; Payload ID: 1701 relates to Category No.: 11895, 11861, 5347, 2931, 11782, 9608; Payload ID: 1702 relates to Category No.: 267, 11861, 2931, 11782; Payload ID: 1703 relates to Category No.: 9939, 11861, 2931; Payload ID: 1704 relates to Category No.: 11895, 11861; Payload ID: 1705 relates to Category No.: 11861, 14244, 9592, 14698; Payload ID: 1706 relates to Category No.: 926, 11861, 14244; Payload ID: 1707 relates to Category No.: 926, 11861; Payload ID: 1708 relates to Category No.: 11861, 14244; Payload ID: 1709 relates to Category No.: 6974, 598, 11861, 1173, 14244, 3505; Payload ID: 1710 relates to Category No.: 11861, 9882, 14244; Payload ID: 1711 relates to Category No.: 11861, 14244; Payload ID: 1712 relates to Category No.: 11861, 7192; Payload ID: 1713 relates to Category No.: 3303, 14471, 14243, 15528, 14255, 15528, 14233; Payload ID: 1714 relates to Category No.: 3303, 14471, 14243, 11861, 15528, 14255, 15528, 14233, 15503, 14471; Payload ID: 1715 relates to Category No.: 3303, 11861, 11939; Payload ID: 1716 relates to Category No.: 3303; Payload ID: 1717 relates to Category No.: 2323, 11861, 2326; Payload ID: 1718 relates to Category No.: 3303, 15503, 14471, 14471, 14243, 15528, 14255; Payload ID: 1719 relates to Category No.: 3303, 14471, 14243, 15528, 14255, 15503, 14471, 11861, 2405; Payload ID: 1721 relates to Category No.: 11861, 11895, 15617, 6024, 6026; Payload ID: 1722 relates to Category No.: 11861, 4962; Payload ID: 1723 relates to Category No.: 11861, 4962; Payload ID: 1724 relates to Category No.: 11861, 4962; Payload ID: 1725 relates to Category No.: 3303, 2405, 11917; Payload ID: 1726 relates to Category No.: 11939, 1201; Payload ID: 1727 relates to Category No.: 11917, 14243, 11939, 15528, 14255, 3303; Payload ID: 1728 relates to Category No.: 3303, 11933, 11917, 11861; Payload ID: 1729 relates to Category No.: 11917; Payload ID: 1730 relates to Category No.: 11917, 3303; Payload ID: 1731 relates to Category No.: 3303, 15503, 14471, 11939, 1178, 11933, 11917, 14251, 14471, 15495, 11920, 11861, 15530, 14233, 15530, 14252, 15503, 14239, 3530, 14229, 7257; Payload ID: 1732 relates to Category No.: 3303, 14234, 11939, 1178, 11933, 11917, 15495, 5109, 11861, 15530, 14233, 15530, 14252, 15503, 14239, 3530, 14229, 7257, 14251, 14471; Payload ID: 1733 relates to Category No.: 10116, 11861, 1201; Payload ID: 1734 relates to Category No.: 11861, 1201; Payload ID: 1735 relates to Category No.: 3303, 15503, 14471, 15895, 11861, 3752; Payload ID: 1736 relates to Category No.: 15503, 14471, 14234, 14471, 15503, 14233, 11861, 15528, 14233; Payload ID: 1737 relates to Category No.: 15503, 14471, 14234, 14471, 15503, 14233, 11861, 3303; Payload ID: 1738 relates to Category No.: 15503, 14471, 14234, 14471, 15495, 11861, 15530, 14233; Payload ID: 1739 relates to Category No.: 10116, 11861; Payload ID: 1740 relates to Category No.: 11861; Payload ID: 1742 relates to Category No.: 11861, 6583; Payload ID: 1743 relates to Category No.: 3303, 6816, 15503, 14471; Payload ID: 1744 relates to Category No.: 6816, 3303, 16331; Payload ID: 1745 relates to Category No.: 6816, 11861; Payload ID: 1746 relates to Category No.: 16331, 11861; Payload ID: 1747 relates to Category No.: 11861; Payload ID: 1748 relates to Category No.: 926, 11861; Payload ID: 1749 relates to Category No.: 6924, 14213, 9367, 11861; Payload ID: 1751 relates to Category No.: 11895, 15504, 15895, 15491, 11981, 11861, 15887, 3752, 11828, 5957, 12107, 9014, 11979, 5955; Payload ID: 1752 relates to Category No.: 6816, 14234, 11939, 11933, 11861, 15530, 14233, 15495; Payload ID: 1753 relates to Category No.: 6816, 14471, 15524, 11861, 15528, 14233, 14234, 9226; Payload ID: 1754 relates to Category No.: 11939, 11933, 14471, 15895, 11861, 5347, 11828, 2267, 2268, 1176, 15504, 12081, 12077; Payload ID: 1755 relates to Category No.: 15504, 11861, 1327, 11861, 3303, 15503, 14471; Payload ID: 1756 relates to Category No.: 6816, 15503, 14471, 2405, 14471, 14243, 15530, 14255, 11861, 3303, 2406, 5827; Payload ID: 1757 relates to Category No.: 6816, 14243, 15530, 14255, 11861, 3303; Payload ID: 1758 relates to Category No.: 11861, 7192; Payload ID: 1759 relates to Category No.: 267, 11861; Payload ID: 1761 relates to Category No.: 11861, 1153; Payload ID: 1762 relates to Category No.: 15491, 1153; Payload ID: 1763 relates to Category No.: 11861, 14538, 15613; Payload ID: 1765 relates to Category No.: 11861, 11886, 6933; Payload ID: 1766 relates to Category No.: 11861; Payload ID: 1767 relates to Category No.: 11861, 15493, 3752, 5957; Payload ID: 1769 relates to Category No.: 11861, 943, 4710; Payload ID: 1770 relates to Category No.: 11861; Payload ID: 1771 relates to Category No.: 11861, 5347; Payload ID: 1772 relates to Category No.: 14705, 11861; Payload ID: 1773 relates to Category No.: 5347, 1405, 4894, 11861; Payload ID: 1774 relates to Category No.: 11939, 11933, 11861, 5347, 4896; Payload ID: 1775 relates to Category No.: 11939, 11933, 11861, 5347, 6022; Payload ID: 1776 relates to Category No.: 6816, 11939, 11933, 11861, 5347, 5841, 4961, 2271, 1175; Payload ID: 1777 relates to Category No.: 9939, 11981, 6210, 11861, 2853, 11933, 12081, 37, 12078, 11979; Payload ID: 1778 relates to Category No.: 11861, 2271, 12417, 9961; Payload ID: 1779 relates to Category No.: 11861, 5347, 2271; Payload ID: 1780 relates to Category No.: 11861, 2271, 11886; Payload ID: 1781 relates to Category No.: 15895, 10116, 11861, 2271, 12417; Payload ID: 1782 relates to Category No.: 15895, 11981, 11861, 2271; Payload ID: 1783 relates to Category No.: 11861, 15895, 14176, 11835, 15915, 7017, 10163; Payload ID: 1784 relates to Category No.: 3303, 10116, 11861; Payload ID: 1785 relates to Category No.: 11939, 11933, 6210, 11861, 5347, 2267, 1176, 11886, 4961, 2271, 1175; Payload ID: 1786 relates to Category No.: 11861, 11933, 1175; Payload ID: 1787 relates to Category No.: 9226, 11939, 11933, 11861, 1175; Payload ID: 1788 relates to Category No.: 11939, 11933, 11981, 11861, 5347, 1176; Payload ID: 1789 relates to Category No.: 11939, 11933, 11861; Payload ID: 1790 relates to Category No.: 6965, 11861; Payload ID: 1791 relates to Category No.: 11861, 9539; Payload ID: 1792 relates to Category No.: 11861, 2853; Payload ID: 1793 relates to Category No.: 11981, 11861; Payload ID: 1794 relates to Category No.: 11861; Payload ID: 1795 relates to Category No.: 9226, 11939, 11933, 11861, 1175; Payload ID: 1796 relates to Category No.: 11939, 11933, 11861, 11917, 1175; Payload ID: 1797 relates to Category No.: 11939, 11933, 11861; Payload ID: 1798 relates to Category No.: 11861, 15908, 15504, 15524, 4961, 15495, 5109; Payload ID: 1799 relates to Category No.: 11861; Payload ID: 1800 relates to Category No.: 15021, 15029, 11861, 15023; Payload ID: 1801 relates to Category No.: 15021, 15029, 11861, 15023; Payload ID: 1802 relates to Category No.: 15895, 11861, 9844; Payload ID: 1803 relates to Category No.: 11861, 11886; Payload ID: 1805 relates to Category No.: 11861, 12393; Payload ID: 1807 relates to Category No.: 11861; Payload ID: 1808 relates to Category No.: 14249, 2405; Payload ID: 1809 relates to Category No.: 11861; Payload ID: 1810 relates to Category No.: 11861, 1127; Payload ID: 1811 relates to Category No.: 11861, 7192; Payload ID: 1812 relates to Category No.: 2323; Payload ID: 1813 relates to Category No.: 2323, 7192; Payload ID: 1814 relates to Category No.: 2323, 7192; Payload ID: 1815 relates to Category No.: 2323, 7192; Payload ID: 1816 relates to Category No.: 11861, 15180; Payload ID: 1817 relates to Category No.: 11861, 14705; Payload ID: 1818 relates to Category No.: 15542, 15553; Payload ID: 1819 relates to Category No.: 6816, 4362, 15925; Payload ID: 1820 relates to Category No.: 6816, 4362; Payload ID: 1821 relates to Category No.: 6816, 4562, 4362, 11861, 12080; Payload ID: 1822 relates to Category No.: 4363, 4361, 15925; Payload ID: 1823 relates to Category No.: 4363; Payload ID: 1824 relates to Category No.: 6816, 4562, 7452; Payload ID: 1825 relates to Category No.: 15542, 15554, 3, 241, 15542; Payload ID: 1826 relates to Category No.: 241, 15542, 15554; Payload ID: 1827 relates to Category No.: 241, 7432; Payload ID: 1828 relates to Category No.: 241, 7432; Payload ID: 1829 relates to Category No.: 11861, 5347, 4710; Payload ID: 1830 relates to Category No.: 6816, 7223, 1151; Payload ID: 1831 relates to Category No.: 6816, 9518, 317, 5414; Payload ID: 1832 relates to Category No.: 11861, 4864, 3774; Payload ID: 1833 relates to Category No.: 1504; Payload ID: 1834 relates to Category No.: 16331, 14353, 1167; Payload ID: 1835 relates to Category No.: 16331, 14353, 1167, 14680; Payload ID: 1836 relates to Category No.: 894, 9619, 11861, 1146, 3752, 1150, 3663; Payload ID: 1837 relates to Category No.: 894, 1146; Payload ID: 1838 relates to Category No.: 15908, 11917, 6188, 11861, 15893, 1153, 12090; Payload ID: 1839 relates to Category No.: 11861, 3007, 15895; Payload ID: 1841 relates to Category No.: 15021, 12359, 11861, 2931, 3508, 12165, 3505, 15503, 14471, 14471; Payload ID: 1842 relates to Category No.: 12359, 11861; Payload ID: 1843 relates to Category No.: 9226, 14196, 10116, 11861; Payload ID: 1844 relates to Category No.: 16331, 15893, 11861, 1327, 11861, 1626; Payload ID: 1845 relates to Category No.: 4023, 11861, 4720, 4016; Payload ID: 1846 relates to Category No.: 15358, 12402, 1536, 11861, 9549, 6655, 7471, 4673, 6300, 16141; Payload ID: 1847 relates to Category No.: 16331, 9518, 11861, 1198; Payload ID: 1848 relates to Category No.: 1198, 14129; Payload ID: 1849 relates to Category No.: 5009; Payload ID: 1850 relates to Category No.: 11861; Payload ID: 1851 relates to Category No.: 11895, 11861, 4389; Payload ID: 1852 relates to Category No.: 11861, 7192, 12136; Payload ID: 1853 relates to Category No.: 11861; Payload ID: 1854 relates to Category No.: 11861; Payload ID: 1855 relates to Category No.: 11939, 277, 15180, 11861, 5347; Payload ID: 1857 relates to Category No.: 3303; Payload ID: 1859 relates to Category No.: 5308, 307, 5403, 5308, 307, 1216; Payload ID: 1860 relates to Category No.: 5308; Payload ID: 1861 relates to Category No.: 3303, 1630, 14597, 3655, 9225, 5308, 311; Payload ID: 1862 relates to Category No.: 11861; Payload ID: 1863 relates to Category No.: 2854, 637, 2861, 1538, 11861, 9619; Payload ID: 1864 relates to Category No.: 11978, 926, 12402, 9096, 12145, 11861; Payload ID: 1865 relates to Category No.: 11861; Payload ID: 1866 relates to Category No.: 11861; Payload ID: 1868 relates to Category No.: 11861; Payload ID: 1870 relates to Category No.: 10116, 11861, 14147; Payload ID: 1871 relates to Category No.: 15029, 11861, 1467; Payload ID: 1872 relates to Category No.: 926, 3303, 9282, 9226, 942, 4965, 9539, 954, 1630, 14597, 953, 5308, 305, 5405, 11861, 1338, 714, 948, 4834, 4289; Payload ID: 1873 relates to Category No.: 16331, 6816, 11861, 14186; Payload ID: 1874 relates to Category No.: 4291, 15826; Payload ID: 1875 relates to Category No.: 11861; Payload ID: 1876 relates to Category No.: 11978, 926, 12109, 9807; Payload ID: 1877 relates to Category No.: 926, 10116; Payload ID: 1878 relates to Category No.: 11978, 926, 14564, 6816, 9096, 12145, 11861; Payload ID: 1879 relates to Category No.: 15542, 15554; Payload ID: 1880 relates to Category No.: 3303; Payload ID: 1881 relates to Category No.: 11861; Payload ID: 1882 relates to Category No.: 11861; Payload ID: 1883 relates to Category No.: 5956, 11917; Payload ID: 1885 relates to Category No.: 7192; Payload ID: 1886 relates to Category No.: 4820, 1267; Payload ID: 1887 relates to Category No.: 1405, 15029, 5314, 15019; Payload ID: 1888 relates to Category No.: 15542, 7493, 9976, 7481; Payload ID: 1889 relates to Category No.: 14564, 11939, 10116, 11861, 6826; Payload ID: 1890 relates to Category No.: 1405, 16331, 4864, 6825, 6829, 9619, 2874, 11861; Payload ID: 1891 relates to Category No.: 4864, 5259, 2874, 15567, 11861, 15249, 12415; Payload ID: 1892 relates to Category No.: 4864, 2874, 15567; Payload ID: 1893 relates to Category No.: 4864, 11933, 12402, 2874, 15567, 14652, 11861, 9803, 1255, 14089, 2696; Payload ID: 1894 relates to Category No.: 4864, 12402, 2874, 15567, 1255; Payload ID: 1895 relates to Category No.: 4864, 2874, 15567, 2282, 11861, 1255, 2696, 5009, 11939; Payload ID: 1896 relates to Category No.: 4864, 2874, 15567, 1255, 11861; Payload ID: 1897 relates to Category No.: 4864, 11933, 2874, 15567, 1255, 11861; Payload ID: 1898 relates to Category No.: 4864, 2874, 15567, 11861, 1255, 5009; Payload ID: 1899 relates to Category No.: 4864, 2874, 15567, 1255; Payload ID: 1900 relates to Category No.: 4864, 2874, 15567, 1255; Payload ID: 1901 relates to Category No.: 11978, 926, 6816, 11939, 12109, 14652, 11861, 12418, 15609, 4710, 14251, 14471; Payload ID: 1902 relates to Category No.: 11978, 926, 6816, 12109, 14652, 11861, 12418, 15609, 4710, 15564; Payload ID: 1903 relates to Category No.: 11978, 926, 6816, 11861, 12418, 15609, 1253, 370, 4865; Payload ID: 1904 relates to Category No.: 11861; Payload ID: 1907 relates to Category No.: 11981, 11861; Payload ID: 1909 relates to Category No.: 3303, 11917; Payload ID: 1910 relates to Category No.: 9282, 9226, 14196, 11861, 15589; Payload ID: 1911 relates to Category No.: 6210, 11861, 7192; Payload ID: 1912 relates to Category No.: 6210, 11861, 6242; Payload ID: 1913 relates to Category No.: 6210; Payload ID: 1914 relates to Category No.: 6210, 7192; Payload ID: 1915 relates to Category No.: 6210; Payload ID: 1916 relates to Category No.: 6210; Payload ID: 1917 relates to Category No.: 6210; Payload ID: 1918 relates to Category No.: 6210; Payload ID: 1919 relates to Category No.: 9939, 6210, 6242; Payload ID: 1920 relates to Category No.: 11978, 926, 6478, 12109, 4389, 15231, 11861, 11981; Payload ID: 1921 relates to Category No.: 11978, 926, 6478, 12109, 943, 15231, 945, 11861, 11981; Payload ID: 1922 relates to Category No.: 4820, 11861, 9629, 1293; Payload ID: 1923 relates to Category No.: 11933, 9868, 4820, 11861, 11828, 1293, 15784, 1135; Payload ID: 1924 relates to Category No.: 11978, 926, 12109, 1405, 11861, 5347, 12417, 11933, 6602, 7126; Payload ID: 1925 relates to Category No.: 15524, 15495, 11920, 11861; Payload ID: 1927 relates to Category No.: 15777, 11861, 10163, 9765; Payload ID: 1928 relates to Category No.: 11861; Payload ID: 1929 relates to Category No.: 11861; Payload ID: 1930 relates to Category No.: 11861, 14229; Payload ID: 1932 relates to Category No.: 11861; Payload ID: 1933 relates to Category No.: 5347; Payload ID: 1934 relates to Category No.: 4864, 12402, 8990, 11861; Payload ID: 1935 relates to Category No.: 11861, 5956; Payload ID: 1936 relates to Category No.: 3303, 14471, 15528, 14233, 15503, 14471, 11861, 14234; Payload ID: 1937 relates to Category No.: 1630, 6275, 6397, 6265, 1311, 5347; Payload ID: 1938 relates to Category No.: 1630, 6275, 6397, 6265, 1311; Payload ID: 1939 relates to Category No.: 6816, 1537, 11861, 9518, 318, 3292, 583, 119; Payload ID: 1940 relates to Category No.: 1537, 11861, 119, 1630, 583; Payload ID: 1941 relates to Category No.: 926, 5956, 12109, 11861, 13, 11978; Payload ID: 1942 relates to Category No.: 16331, 9282, 15908, 15893, 6188, 11861, 15887, 9179; Payload ID: 1943 relates to Category No.: 2405, 15911, 9619, 11861; Payload ID: 1944 relates to Category No.: 16331, 14196, 15908, 11939, 11933, 6188, 11861, 5957; Payload ID: 1945 relates to Category No.: 926, 3303, 9226, 6816, 954, 138, 953, 5308, 305, 5405, 11861; Payload ID: 1946 relates to Category No.: 6816, 15911, 6829, 3755, 11861, 10163; Payload ID: 1947 relates to Category No.: 11861, 1201; Payload ID: 1948 relates to Category No.: 10116, 11861, 5959; Payload ID: 1949 relates to Category No.: 926, 5956, 4894, 14107, 12109, 4924, 12145, 11861, 3752; Payload ID: 1950 relates to Category No.: 3303, 16331, 6816, 14196, 15908, 15524, 15895, 15491, 6188, 11861, 3752, 15766, 686, 2963, 2405; Payload ID: 1951 relates to Category No.: 14597, 11861, 11828, 4389, 4930, 4927; Payload ID: 1952 relates to Category No.: 14564, 11981, 11861, 14537; Payload ID: 1953 relates to Category No.: 4924, 11861; Payload ID: 1954 relates to Category No.: 5109, 5108, 11861, 9014; Payload ID: 1955 relates to Category No.: 5109, 11861, 5108; Payload ID: 1957 relates to Category No.: 11861; Payload ID: 1958 relates to Category No.: 2405, 15504, 5105, 11861, 9173, 1173, 245, 5101; Payload ID: 1960 relates to Category No.: 5293, 11861, 1504; Payload ID: 1961 relates to Category No.: 16331, 15239; Payload ID: 1962 relates to Category No.: 16331; Payload ID: 1964 relates to Category No.: 11861; Payload ID: 1965 relates to Category No.: 12363, 11861, 11886; Payload ID: 1966 relates to Category No.: 11861, 5347, 15230, 14218; Payload ID: 1967 relates to Category No.: 11861; Payload ID: 1968 relates to Category No.: 11861, 2931; Payload ID: 1969 relates to Category No.: 11861; Payload ID: 1971 relates to Category No.: 2405, 11861, 15525; Payload ID: 1972 relates to Category No.: 16331, 11861; Payload ID: 1973 relates to Category No.: 926, 16331, 2405, 9096, 12145, 11861, 6427, 5193, 5105, 16223; Payload ID: 1974 relates to Category No.: 3303, 16331, 11861, 14196, 6184, 6427; Payload ID: 1975 relates to Category No.: 3303, 16331, 11861; Payload ID: 1976 relates to Category No.: 3303, 16331, 6816, 11861; Payload ID: 1977 relates to Category No.: 16331, 11861; Payload ID: 1978 relates to Category No.: 11861, 7192; Payload ID: 1979 relates to Category No.: 11861; Payload ID: 1980 relates to Category No.: 11861, 16331, 5105; Payload ID: 1981 relates to Category No.: 11861, 2405, 6427; Payload ID: 1982 relates to Category No.: 2405, 11861, 6427; Payload ID: 1983 relates to Category No.: 2405, 9539, 11861, 6427, 3303; Payload ID: 1984 relates to Category No.: 15504, 9539, 15524, 5105, 15491, 15495, 11861, 6427; Payload ID: 1985 relates to Category No.: 15503, 14471, 11861, 15408; Payload ID: 1986 relates to Category No.: 9226, 11861, 6427; Payload ID: 1987 relates to Category No.: 16331, 11861, 14471, 15504, 3385; Payload ID: 1988 relates to Category No.: 5105, 15491, 11861, 6427; Payload ID: 1989 relates to Category No.: 11978, 926, 6816, 9096, 12145, 11861, 5347, 9874; Payload ID: 1990 relates to Category No.: 10116; Payload ID: 1992 relates to Category No.: 926, 3303, 15503, 14471, 4965, 1201; Payload ID: 1993 relates to Category No.: 11861; Payload ID: 1994 relates to Category No.: 11861; Payload ID: 1995 relates to Category No.: 11933, 11861; Payload ID: 1997 relates to Category No.: 11861; Payload ID: 1998 relates to Category No.: 15908, 11861; Payload ID: 1999 relates to Category No.: 11861; Payload ID: 2000 relates to Category No.: 11861; Payload ID: 2001 relates to Category No.: 11861; Payload ID: 2002 relates to Category No.: 11861; Payload ID: 2003 relates to Category No.: 11861; Payload ID: 2004 relates to Category No.: 15503, 14471, 11861, 15525; Payload ID: 2005 relates to Category No.: 11861; Payload ID: 2006 relates to Category No.: 3303, 15908, 15503, 14471, 14471, 4976, 11861, 15530, 14233, 14240, 15528, 14239, 15530, 14239; Payload ID: 2007 relates to Category No.: 3303, 15908, 15503, 14471, 14471, 11861, 14240, 15530, 14239; Payload ID: 2008 relates to Category No.: 11861, 15530, 14233; Payload ID: 2009 relates to Category No.: 11861; Payload ID: 2010 relates to Category No.: 3303, 11861, 9539; Payload ID: 2011 relates to Category No.: 11978, 926, 12109, 11861; Payload ID: 2012 relates to Category No.: 11978, 926, 12109, 11861; Payload ID: 2013 relates to Category No.: 11861; Payload ID: 2014 relates to Category No.: 10116, 11861; Payload ID: 2015 relates to Category No.: 15503, 14471, 11861, 6185, 9173; Payload ID: 2016 relates to Category No.: 16331, 5865, 9518, 9518, 315, 16283, 83, 679, 11861, 4379; Payload ID: 2017 relates to Category No.: 12399, 11861; Payload ID: 2018 relates to Category No.: 11861, 7192; Payload ID: 2019 relates to Category No.: 11861; Payload ID: 2020 relates to Category No.: 11861; Payload ID: 2021 relates to Category No.: 11861; Payload ID: 2022 relates to Category No.: 11861; Payload ID: 2023 relates to Category No.: 11861, 12402; Payload ID: 2024 relates to Category No.: 11861, 7192; Payload ID: 2025 relates to Category No.: 11861; Payload ID: 2026 relates to Category No.: 11861; Payload ID: 2027 relates to Category No.: 1630, 1146, 5347, 3752, 2371, 225, 2361; Payload ID: 2030 relates to Category No.: 10116, 11861; Payload ID: 2031 relates to Category No.: 12142; Payload ID: 2032 relates to Category No.: 14196, 11861, 3303, 15495, 6184; Payload ID: 2033 relates to Category No.: 11861, 4719, 10147; Payload ID: 2035 relates to Category No.: 11861, 2566; Payload ID: 2036 relates to Category No.: 11861, 5347, 12402; Payload ID: 2037 relates to Category No.: 11861, 7192; Payload ID: 2038 relates to Category No.: 2874, 11861; Payload ID: 2039 relates to Category No.: 11861, 7192; Payload ID: 2040 relates to Category No.: 11861, 5347; Payload ID: 2041 relates to Category No.: 11861; Payload ID: 2042 relates to Category No.: 11861; Payload ID: 2043 relates to Category No.: 5259, 11861, 5347; Payload ID: 2044 relates to Category No.: 11861; Payload ID: 2045 relates to Category No.: 11861; Payload ID: 2047 relates to Category No.: 11861; Payload ID: 2048 relates to Category No.: 11861; Payload ID: 2049 relates to Category No.: 1405, 1438, 11861; Payload ID: 2050 relates to Category No.: 1405, 1438, 11861; Payload ID: 2051 relates to Category No.: 1405, 1438, 11861; Payload ID: 2052 relates to Category No.: 1405, 1438, 11861; Payload ID: 2053 relates to Category No.: 1405, 1438, 11861; Payload ID: 2055 relates to Category No.: 11861, 7192, 5534; Payload ID: 2056 relates to Category No.: 14504, 11861, 3665; Payload ID: 2057 relates to Category No.: 7268; Payload ID: 2058 relates to Category No.: 11978, 926, 12109, 9857; Payload ID: 2059 relates to Category No.: 6816, 11981, 6210, 11861; Payload ID: 2060 relates to Category No.: 6816, 6210, 11861; Payload ID: 2062 relates to Category No.: 10116, 11861; Payload ID: 2063 relates to Category No.: 1405, 1153, 11861, 1706, 4380, 4710, 4893, 712; Payload ID: 2064 relates to Category No.: 1405; Payload ID: 2065 relates to Category No.: 1405; Payload ID: 2066 relates to Category No.: 1405; Payload ID: 2067 relates to Category No.: 1405, 1369, 6334, 6254, 453, 11861, 11939; Payload ID: 2068 relates to Category No.: 1405, 11861; Payload ID: 2069 relates to Category No.: 1405; Payload ID: 2070 relates to Category No.: 1405, 15629, 12198, 11861; Payload ID: 2071 relates to Category No.: 1405; Payload ID: 2072 relates to Category No.: 1405; Payload ID: 2073 relates to Category No.: 1405, 1153, 11861, 581, 4380, 3752, 12081, 11981, 11886, 9060; Payload ID: 2074 relates to Category No.: 1405; Payload ID: 2075 relates to Category No.: 1405; Payload ID: 2076 relates to Category No.: 1405, 1153, 581, 3032; Payload ID: 2077 relates to Category No.: 1405; Payload ID: 2078 relates to Category No.: 1405, 7192; Payload ID: 2079 relates to Category No.: 1405; Payload ID: 2080 relates to Category No.: 1405, 12402, 1153, 11861, 5841, 12081; Payload ID: 2081 relates to Category No.: 1405; Payload ID: 2082 relates to Category No.: 1405; Payload ID: 2083 relates to Category No.: 1405; Payload ID: 2084 relates to Category No.: 1405, 7192; Payload ID: 2085 relates to Category No.: 1405, 11917, 4820, 15617, 11861; Payload ID: 2086 relates to Category No.: 1405, 4820, 15617, 11861; Payload ID: 2087 relates to Category No.: 1405, 4820, 15617, 11861; Payload ID: 2089 relates to Category No.: 1405, 11861; Payload ID: 2090 relates to Category No.: 1405, 11861; Payload ID: 2091 relates to Category No.: 1405, 11861; Payload ID: 2092 relates to Category No.: 1405, 16206; Payload ID: 2093 relates to Category No.: 1405; Payload ID: 2094 relates to Category No.: 1405; Payload ID: 2095 relates to Category No.: 1405, 16331, 11861, 16220; Payload ID: 2096 relates to Category No.: 1405; Payload ID: 2097 relates to Category No.: 11861, 9275, 12082, 11920, 12078; Payload ID: 2098 relates to Category No.: 1405, 15629, 6965, 11861, 1439, 11665, 11991, 5957; Payload ID: 2099 relates to Category No.: 1405, 11861; Payload ID: 2100 relates to Category No.: 6816, 5308, 9962; Payload ID: 2101 relates to Category No.: 4820, 15617, 1387, 12142, 12399, 11861, 1384; Payload ID: 2102 relates to Category No.: 4820, 15617, 12142, 1387, 11861, 478, 1386; Payload ID: 2103 relates to Category No.: 5259, 12402, 11861, 11886, 5347, 1388; Payload ID: 2104 relates to Category No.: 5259, 8959; Payload ID: 2105 relates to Category No.: 1405, 14564, 12327, 16016, 4914; Payload ID: 2106 relates to Category No.: 1405, 11861, 11854, 12110, 12388, 1442, 5841, 11981, 11895; Payload ID: 2107 relates to Category No.: 1405, 6478, 11939, 11861, 11886, 5588; Payload ID: 2108 relates to Category No.: 1405, 6478, 11861; Payload ID: 2109 relates to Category No.: 1405, 6478, 11861; Payload ID: 2110 relates to Category No.: 14471, 11895, 15524, 15491, 1153, 840, 11861, 15493, 2688, 6185, 2405; Payload ID: 2111 relates to Category No.: 11939, 11861; Payload ID: 2112 relates to Category No.: 1405, 11861, 3753, 1439, 9179; Payload ID: 2113 relates to Category No.: 1405; Payload ID: 2114 relates to Category No.: 11861, 5957, 11977, 12108, 1201, 12109; Payload ID: 2115 relates to Category No.: 11861, 1201; Payload ID: 2116 relates to Category No.: 1405; Payload ID: 2117 relates to Category No.: 1405, 11861; Payload ID: 2118 relates to Category No.: 1405; Payload ID: 2119 relates to Category No.: 1405, 11933, 3752, 14537, 11861, 11920; Payload ID: 2120 relates to Category No.: 1401, 11861, 7192; Payload ID: 2121 relates to Category No.: 6816, 16244, 1404, 11861; Payload ID: 2122 relates to Category No.: 1404, 6816, 16244; Payload ID: 2123 relates to Category No.: 6816, 1401, 1404, 16250; Payload ID: 2124 relates to Category No.: 6816, 16244, 1404; Payload ID: 2125 relates to Category No.: 16244, 5051, 11861, 11981, 11920, 9961; Payload ID: 2126 relates to Category No.: 16244, 1401, 5051, 11861, 11981, 11920, 1404, 9961; Payload ID: 2127 relates to Category No.: 16244, 5051, 11861, 11981; Payload ID: 2128 relates to Category No.: 16244, 5051, 11861, 11981; Payload ID: 2130 relates to Category No.: 11861, 16244; Payload ID: 2131 relates to Category No.: 11861, 2269, 16244, 5850; Payload ID: 2132 relates to Category No.: 16244, 2269; Payload ID: 2133 relates to Category No.: 16244, 2269; Payload ID: 2134 relates to Category No.: 16244, 5847, 2269, 11861; Payload ID: 2135 relates to Category No.: 16244, 1401, 16250; Payload ID: 2136 relates to Category No.: 16244, 2269; Payload ID: 2137 relates to Category No.: 16244, 2269; Payload ID: 2138 relates to Category No.: 16244, 5840, 6816, 5051, 1457, 11861, 566; Payload ID: 2139 relates to Category No.: 6816, 16244, 5051, 5840, 712, 566, 16245, 16246, 11861; Payload ID: 2140 relates to Category No.: 6816, 16244, 5051, 5840; Payload ID: 2141 relates to Category No.: 16244, 5840, 6816, 5051, 11861; Payload ID: 2142 relates to Category No.: 1405, 926, 11895, 16244, 5051, 5840, 11861; Payload ID: 2143 relates to Category No.: 6816, 16244, 5051, 5840, 15180, 11861; Payload ID: 2144 relates to Category No.: 5051, 5840, 1405, 16244; Payload ID: 2145 relates to Category No.: 5840, 6328, 14377, 11861, 16244, 16250; Payload ID: 2146 relates to Category No.: 6816, 5840, 6328, 14377, 11861; Payload ID: 2147 relates to Category No.: 16244, 5840, 11861; Payload ID: 2148 relates to Category No.: 9226, 14196, 10116, 11861, 5841; Payload ID: 2149 relates to Category No.: 16250, 5347, 1393, 16244; Payload ID: 2150 relates to Category No.: 1647; Payload ID: 2151 relates to Category No.: 1647; Payload ID: 2152 relates to Category No.: 11861, 1706; Payload ID: 2153 relates to Category No.: 3303, 9226, 11861, 9805, 7265; Payload ID: 2154 relates to Category No.: 1405, 4886, 4895, 11861; Payload ID: 2155 relates to Category No.: 1405, 11861; Payload ID: 2156 relates to Category No.: 3303, 15503, 14471, 15528, 14233, 14234; Payload ID: 2157 relates to Category No.: 11978, 926, 1457, 1459, 11861; Payload ID: 2158 relates to Category No.: 11978, 926, 1457, 1459; Payload ID: 2159 relates to Category No.: 11978, 926, 1457, 1459, 12109; Payload ID: 2160 relates to Category No.: 11978, 926, 11939, 5956, 12109, 1457, 1459, 11861, 4578; Payload ID: 2161 relates to Category No.: 11978, 926, 267, 11939, 1457, 1459, 11861, 12109, 11981, 9925; Payload ID: 2162 relates to Category No.: 11978, 926, 11939, 12109, 1457, 15429, 1459, 11861, 5841, 14732, 9060; Payload ID: 2163 relates to Category No.: 11978, 926, 11939, 1457, 1459, 11861, 1444, 12109; Payload ID: 2164 relates to Category No.: 11991, 11981, 1442; Payload ID: 2165 relates to Category No.: 11991, 1442, 11981; Payload ID: 2166 relates to Category No.: 11978, 926, 1457, 1443, 1459, 11861; Payload ID: 2167 relates to Category No.: 11978, 926, 12109, 1459, 11861, 1457; Payload ID: 2168 relates to Category No.: 1405, 11978, 926, 1457, 12145, 1459, 11861; Payload ID: 2169 relates to Category No.: 11978, 926, 12109, 1457, 11861, 4922, 8893; Payload ID: 2170 relates to Category No.: 1405; Payload ID: 2171 relates to Category No.: 9868, 4820, 11861, 6478, 11981, 1405, 5588, 3471, 5841, 10125; Payload ID: 2172 relates to Category No.: 11939, 11861; Payload ID: 2173 relates to Category No.: 2500, 11886; Payload ID: 2174 relates to Category No.: 1405; Payload ID: 2175 relates to Category No.: 1405; Payload ID: 2176 relates to Category No.: 1405; Payload ID: 2177 relates to Category No.: 267, 1457, 7393, 15741; Payload ID: 2178 relates to Category No.: 15908, 11861; Payload ID: 2179 relates to Category No.: 1405, 15973, 11861, 11864; Payload ID: 2180 relates to Category No.: 267, 11861; Payload ID: 2181 relates to Category No.: 1405, 11981, 11920, 15429, 11861, 5841, 15355, 9925, 12108, 12080, 9136, 12064, 9060, 3755, 1439, 9844, 429, 15799, 9062, 5956; Payload ID: 2182 relates to Category No.: 1405, 11981, 11920, 15429, 11861, 5841, 15355, 9925, 12108, 12080, 9136, 12064, 9060, 3755, 1439, 9844, 429, 15799, 9062, 5956; Payload ID: 2183 relates to Category No.: 1405, 11981, 11920, 15429, 11861, 5841, 15355, 9925, 12108, 12080, 9136, 12064, 9060, 3755, 1439, 9844, 429, 15799, 9062, 5956; Payload ID: 2184 relates to Category No.: 3303, 14471, 11861, 15528, 14233; Payload ID: 2185 relates to Category No.: 3303, 2405, 14471, 15504, 5109, 11861, 15528, 14233; Payload ID: 2186 relates to Category No.: 6965, 1457, 11861, 14812; Payload ID: 2187 relates to Category No.: 6965, 11861, 6973; Payload ID: 2188 relates to Category No.: 6965, 11861, 6973; Payload ID: 2189 relates to Category No.: 1405, 11861; Payload ID: 2190 relates to Category No.: 1405; Payload ID: 2191 relates to Category No.: 1405; Payload ID: 2192 relates to Category No.: 1405; Payload ID: 2193 relates to Category No.: 1461; Payload ID: 2194 relates to Category No.: 1405; Payload ID: 2195 relates to Category No.: 1405, 15973, 1504, 10116, 11861, 5850, 4710, 787; Payload ID: 2196 relates to Category No.: 1434, 1405, 11861, 2936; Payload ID: 2197 relates to Category No.: 1434, 14706, 2936; Payload ID: 2198 relates to Category No.: 1434, 1405, 9619; Payload ID: 2199 relates to Category No.: 1434, 1405; Payload ID: 2200 relates to Category No.: 1434; Payload ID: 2201 relates to Category No.: 1434, 1405; Payload ID: 2202 relates to Category No.: 16331, 1434, 15503, 14471, 9619, 2861; Payload ID: 2203 relates to Category No.: 1434, 1405, 2861, 11861, 2936, 9619, 11933; Payload ID: 2204 relates to Category No.: 1434, 1405, 14564, 11890, 1630, 9619, 2861, 15429, 11861, 14734, 15024, 6189; Payload ID: 2205 relates to Category No.: 1434, 11861; Payload ID: 2206 relates to Category No.: 1434, 6965, 11861; Payload ID: 2207 relates to Category No.: 1434, 3663, 11861, 7021; Payload ID: 2208 relates to Category No.: 1434, 1405; Payload ID: 2209 relates to Category No.: 1434, 1405; Payload ID: 2210 relates to Category No.: 1434, 1405, 11861; Payload ID: 2211 relates to Category No.: 1434, 1405; Payload ID: 2212 relates to Category No.: 10116, 11861, 3665, 11828, 1435; Payload ID: 2213 relates to Category No.: 1457, 11861, 267; Payload ID: 2214 relates to Category No.: 267, 1457, 11861; Payload ID: 2215 relates to Category No.: 267, 1457, 11861, 6965; Payload ID: 2216 relates to Category No.: 1405, 3303, 16331, 15973, 15895, 1504, 5588, 10116, 7268, 11861, 2271, 4710, 686, 11864, 2613, 5865, 9629, 5260; Payload ID: 2217 relates to Category No.: 1405, 15973, 1504, 11861, 11864; Payload ID: 2218 relates to Category No.: 1405; Payload ID: 2219 relates to Category No.: 1405, 11939, 11861, 1439; Payload ID: 2220 relates to Category No.: 1405, 5960, 11861, 1146, 16299; Payload ID: 2221 relates to Category No.: 1405; Payload ID: 2222 relates to Category No.: 1405, 11861; Payload ID: 2223 relates to Category No.: 1405, 11861, 3752, 3753; Payload ID: 2224 relates to Category No.: 11978, 926, 1457; Payload ID: 2225 relates to Category No.: 15503, 14471, 14234, 14471, 1471, 11861, 15493, 15528, 14233, 3752, 15503, 14239, 14240, 14229, 15528, 14252, 3303, 15504, 3459, 15524, 13683, 5280, 5101, 851; Payload ID: 2226 relates to Category No.: 3303, 15503, 14471, 14234, 11939, 2405, 14471, 1670, 11917, 1471, 15503, 14233, 14243, 11861, 15528, 14233, 1472; Payload ID: 2227 relates to Category No.: 15503, 14471, 2405, 14471, 15524, 1471, 11861, 15528, 14233; Payload ID: 2228 relates to Category No.: 15503, 14471, 14471, 15524, 1471, 15528, 14233, 14234; Payload ID: 2229 relates to Category No.: 15503, 14471, 11939, 11933, 14471, 1471, 14243, 11861, 15525, 15528, 14255; Payload ID: 2230 relates to Category No.: 3303, 15503, 14471, 14471, 1471, 14243, 15528, 14255; Payload ID: 2231 relates to Category No.: 6816, 15503, 14471, 14471, 11861, 9226; Payload ID: 2232 relates to Category No.: 15503, 14471, 14471; Payload ID: 2233 relates to Category No.: 15503, 14471, 14471, 11861, 3303, 1472, 2691; Payload ID: 2234 relates to Category No.: 12402, 12088, 11665, 12082, 9806, 12077; Payload ID: 2235 relates to Category No.: 9226, 1457, 7192; Payload ID: 2236 relates to Category No.: 11861; Payload ID: 2239 relates to Category No.: 15895, 10116, 11861, 5347, 3752, 14196; Payload ID: 2241 relates to Category No.: 11861; Payload ID: 2242 relates to Category No.: 11861; Payload ID: 2243 relates to Category No.: 11861; Payload ID: 2244 relates to Category No.: 11861, 7192; Payload ID: 2245 relates to Category No.: 11861; Payload ID: 2251 relates to Category No.: 11861; Payload ID: 2270 relates to Category No.: 4820, 1480, 11861, 3471; Payload ID: 2271 relates to Category No.: 4820, 1480; Payload ID: 2274 relates to Category No.: 11861; Payload ID: 2275 relates to Category No.: 12402; Payload ID: 2276 relates to Category No.: 12402; Payload ID: 2277 relates to Category No.: 9226, 6924, 7260, 11861; Payload ID: 2278 relates to Category No.: 6924; Payload ID: 2279 relates to Category No.: 267, 11861; Payload ID: 2280 relates to Category No.: 267, 11861; Payload ID: 2281 relates to Category No.: 16331, 9226, 6816, 11939, 6965, 11861, 15766, 6979; Payload ID: 2282 relates to Category No.: 11861, 6979; Payload ID: 2283 relates to Category No.: 6965, 11861, 4397; Payload ID: 2284 relates to Category No.: 11861; Payload ID: 2285 relates to Category No.: 3303, 11861, 2405; Payload ID: 2286 relates to Category No.: 267, 11861; Payload ID: 2287 relates to Category No.: 267, 11861; Payload ID: 2288 relates to Category No.: 267; Payload ID: 2289 relates to Category No.: 267, 277, 11861, 1173; Payload ID: 2290 relates to Category No.: 267, 11920, 11861, 11886; Payload ID: 2291 relates to Category No.: 14196, 12402, 11861; Payload ID: 2292 relates to Category No.: 1503, 926, 6816, 11861, 1502, 7184, 3663, 1405, 11886, 9939, 4566; Payload ID: 2293 relates to Category No.: 11978, 926, 16331, 6816, 5347, 5308, 307, 3752, 1503, 620, 885, 1502, 5308, 307, 5401, 3258, 883, 1530, 5308; Payload ID: 2294 relates to Category No.: 15086, 7433, 2380, 7434; Payload ID: 2295 relates to Category No.: 15086, 126, 2380; Payload ID: 2296 relates to Category No.: 15086, 7433, 2380; Payload ID: 2297 relates to Category No.: 15086, 7439, 2381, 12193; Payload ID: 2298 relates to Category No.: 15086, 7439, 5933; Payload ID: 2299 relates to Category No.: 15086, 9809, 7433, 11861; Payload ID: 2300 relates to Category No.: 15086, 7433; Payload ID: 2301 relates to Category No.: 15086, 7433; Payload ID: 2302 relates to Category No.: 15086, 126, 7434; Payload ID: 2303 relates to Category No.: 15086, 7439; Payload ID: 2304 relates to Category No.: 15086, 7439; Payload ID: 2305 relates to Category No.: 15086, 7439; Payload ID: 2306 relates to Category No.: 15086, 7439, 2381; Payload ID: 2307 relates to Category No.: 15086, 7439; Payload ID: 2308 relates to Category No.: 926, 11861, 7192, 956, 464; Payload ID: 2309 relates to Category No.: 15086, 5236; Payload ID: 2310 relates to Category No.: 16331, 1525, 11861, 868, 5309; Payload ID: 2311 relates to Category No.: 16331, 1525, 11861, 868; Payload ID: 2312 relates to Category No.: 16331, 1525, 9022, 9804; Payload ID: 2313 relates to Category No.: 16331, 1525, 11861; Payload ID: 2314 relates to Category No.: 16331, 1525; Payload ID: 2315 relates to Category No.: 16331, 1525; Payload ID: 2316 relates to Category No.: 16331, 1525; Payload ID: 2317 relates to Category No.: 16331, 1525, 11861; Payload ID: 2318 relates to Category No.: 16331, 1525; Payload ID: 2319 relates to Category No.: 16331, 1525, 11861; Payload ID: 2320 relates to Category No.: 7192; Payload ID: 2322 relates to Category No.: 16331, 1525; Payload ID: 2323 relates to Category No.: 16331, 1525; Payload ID: 2324 relates to Category No.: 6816, 1525; Payload ID: 2325 relates to Category No.: 9518, 9518, 314, 12354, 1529, 39, 11815; Payload ID: 2326 relates to Category No.: 9518, 1529, 7515, 115; Payload ID: 2327 relates to Category No.: 9518, 12352, 11861, 7515, 7487, 7516; Payload ID: 2328 relates to Category No.: 11886, 1536, 15663, 6434, 14980, 4726, 14094, 7192; Payload ID: 2329 relates to Category No.: 15663, 1536, 6925, 14980; Payload ID: 2330 relates to Category No.: 1536, 6925, 5308; Payload ID: 2331 relates to Category No.: 15663, 14980, 5308; Payload ID: 2332 relates to Category No.: 1536, 5308; Payload ID: 2333 relates to Category No.: 15663, 14980, 5308; Payload ID: 2334 relates to Category No.: 5308; Payload ID: 2335 relates to Category No.: 16331, 6822, 1538, 3998; Payload ID: 2336 relates to Category No.: 16331, 6822, 1538, 11861; Payload ID: 2337 relates to Category No.: 16331, 6822, 1538, 9619; Payload ID: 2338 relates to Category No.: 16331, 6822, 1538; Payload ID: 2339 relates to Category No.: 1538, 16331, 6822, 9619; Payload ID: 2340 relates to Category No.: 16331, 6822, 1538; Payload ID: 2341 relates to Category No.: 16331, 6822, 1538; Payload ID: 2342 relates to Category No.: 16331, 6822, 1538; Payload ID: 2343 relates to Category No.: 16331, 6822, 14502; Payload ID: 2344 relates to Category No.: 16331, 6822, 8893, 1538, 1706; Payload ID: 2345 relates to Category No.: 16331, 6822, 14502, 1538; Payload ID: 2346 relates to Category No.: 16331, 6822, 1538; Payload ID: 2347 relates to Category No.: 3755, 11861; Payload ID: 2348 relates to Category No.: 16331, 6822; Payload ID: 2349 relates to Category No.: 6816, 11939, 1538, 6824; Payload ID: 2350 relates to Category No.: 16331, 6822; Payload ID: 2351 relates to Category No.: 16331, 6822; Payload ID: 2352 relates to Category No.: 16331, 6822, 11861; Payload ID: 2353 relates to Category No.: 14502; Payload ID: 2354 relates to Category No.: 11939, 11861, 7192; Payload ID: 2355 relates to Category No.: 11861, 5347; Payload ID: 2356 relates to Category No.: 11861; Payload ID: 2357 relates to Category No.: 11861; Payload ID: 2358 relates to Category No.: 11861; Payload ID: 2359 relates to Category No.: 11861, 12399; Payload ID: 2360 relates to Category No.: 11861; Payload ID: 2361 relates to Category No.: 11861; Payload ID: 2362 relates to Category No.: 11939, 11861, 5347, 4796; Payload ID: 2363 relates to Category No.: 11861; Payload ID: 2364 relates to Category No.: 11861; Payload ID: 2365 relates to Category No.: 11861; Payload ID: 2366 relates to Category No.: 9988, 4246, 1597, 1696; Payload ID: 2367 relates to Category No.: 11861, 5347; Payload ID: 2368 relates to Category No.: 2874, 11861, 6131; Payload ID: 2369 relates to Category No.: 4864, 11933, 12402, 2874, 11861, 2449; Payload ID: 2370 relates to Category No.: 12402, 15542, 15548, 1606; Payload ID: 2371 relates to Category No.: 12402, 15542, 15548, 1607; Payload ID: 2372 relates to Category No.: 15542, 15548, 1608, 9544, 11861, 5347; Payload ID: 2373 relates to Category No.: 15542, 15548, 11861, 1608; Payload ID: 2374 relates to Category No.: 15542, 15542, 15548, 11861, 1608; Payload ID: 2375 relates to Category No.: 15542, 15548, 1608; Payload ID: 2376 relates to Category No.: 6816, 5308, 6829, 3275, 1538, 15676; Payload ID: 2377 relates to Category No.: 1615; Payload ID: 2378 relates to Category No.: 926, 6816, 942, 1616; Payload ID: 2379 relates to Category No.: 11861, 7192; Payload ID: 2380 relates to Category No.: 1405, 11861; Payload ID: 2381 relates to Category No.: 11886; Payload ID: 2382 relates to Category No.: 11861; Payload ID: 2383 relates to Category No.: 11861; Payload ID: 2384 relates to Category No.: 1405, 11861, 5003, 4023, 5009, 11828, 2566; Payload ID: 2385 relates to Category No.: 11861, 9965; Payload ID: 2386 relates to Category No.: 11861; Payload ID: 2387 relates to Category No.: 15629; Payload ID: 2388 relates to Category No.: 1405, 15629, 3753; Payload ID: 2389 relates to Category No.: 11861, 7192; Payload ID: 2390 relates to Category No.: 11978, 926, 12109, 11861, 5956; Payload ID: 2391 relates to Category No.: 11978, 926, 12109; Payload ID: 2392 relates to Category No.: 12109, 11978, 926, 11861, 15231, 4710, 9629, 9961; Payload ID: 2393 relates to Category No.: 11978, 926, 12109, 10116, 11861; Payload ID: 2394 relates to Category No.: 11978, 926, 12109, 11861, 6478, 4710, 9629, 9961; Payload ID: 2395 relates to Category No.: 11978, 926, 12109, 11861, 6478, 4710, 9629, 9961; Payload ID: 2396 relates to Category No.: 11978, 926, 12109; Payload ID: 2397 relates to Category No.: 11978, 926, 12109, 11861, 12064, 5282; Payload ID: 2398 relates to Category No.: 11978, 926, 12109, 11861; Payload ID: 2399 relates to Category No.: 11978, 926, 11861, 12064, 12109; Payload ID: 2400 relates to Category No.: 5956, 11992, 6816, 2405, 15504, 12402, 12109, 11920, 11861, 5347; Payload ID: 2401 relates to Category No.: 926, 6816, 942, 15973, 11861, 957, 9617; Payload ID: 2402 relates to Category No.: 14503, 9619, 11861, 5347; Payload ID: 2403 relates to Category No.: 11861, 11920; Payload ID: 2404 relates to Category No.: 11861, 7192; Payload ID: 2405 relates to Category No.: 11861, 1327, 11861, 3004, 11828; Payload ID: 2406 relates to Category No.: 3749, 2854, 2861, 2856, 3005, 11861, 11828, 11886, 3007; Payload ID: 2407 relates to Category No.: 2854, 2861, 3663, 11861, 2853, 9619; Payload ID: 2408 relates to Category No.: 2854, 15895, 2861, 2856, 3005, 11861; Payload ID: 2409 relates to Category No.: 2854, 2861, 11861; Payload ID: 2410 relates to Category No.: 2854, 2861, 2856, 11861; Payload ID: 2411 relates to Category No.: 2854, 2861, 2856, 11920, 11861, 3752, 2855; Payload ID: 2412 relates to Category No.: 2854, 2861, 894, 9619, 2857, 11861, 2855, 2833, 11828, 11886, 3007, 9920; Payload ID: 2413 relates to Category No.: 2854, 2861; Payload ID: 2414 relates to Category No.: 2854, 2861; Payload ID: 2415 relates to Category No.: 2854, 2861, 2857, 11861, 5347, 3663; Payload ID: 2416 relates to Category No.: 2854, 2861, 2857, 11861, 2855, 894; Payload ID: 2417 relates to Category No.: 3303, 11861, 5347, 11828, 2853; Payload ID: 2418 relates to Category No.: 2854, 15895, 9619, 2861, 2856, 3005, 11861, 14377, 2855, 11933, 3663, 15777, 11886, 3007; Payload ID: 2419 relates to Category No.: 2854, 2861, 2856, 3749, 9619, 11981, 11861, 14537; Payload ID: 2421 relates to Category No.: 12416, 11861; Payload ID: 2422 relates to Category No.: 11861, 4922, 1539; Payload ID: 2423 relates to Category No.: 11861, 1539; Payload ID: 2424 relates to Category No.: 2858; Payload ID: 2425 relates to Category No.: 2858; Payload ID: 2426 relates to Category No.: 2858; Payload ID: 2427 relates to Category No.: 1539; Payload ID: 2429 relates to Category No.: 11939, 11861, 2853, 7463; Payload ID: 2430 relates to Category No.: 11939, 11861, 1539, 11920; Payload ID: 2431 relates to Category No.: 3303, 6816; Payload ID: 2432 relates to Category No.: 16331, 4864, 11939, 5009, 3003, 418, 12189, 421; Payload ID: 2433 relates to Category No.: 11861; Payload ID: 2436 relates to Category No.: 6816, 11939, 4976, 12402, 753, 7510, 3752, 1629, 9518, 316, 629; Payload ID: 2437 relates to Category No.: 6478, 9367, 11861, 1637; Payload ID: 2438 relates to Category No.: 9367, 11861; Payload ID: 2439 relates to Category No.: 277, 1153, 1369, 15029, 10116, 11861, 4380, 16184; Payload ID: 2440 relates to Category No.: 15021, 15029, 277, 1369, 11861; Payload ID: 2441 relates to Category No.: 277, 1153, 1369, 11861, 1708; Payload ID: 2442 relates to Category No.: 277, 1369, 11861; Payload ID: 2443 relates to Category No.: 14564, 11895, 15504, 15524, 15491, 1369, 14652, 11861, 3936, 5841, 3752, 9173, 581, 5957, 12081, 14324, 14229, 5882, 686, 3953, 1201, 3303, 15503, 14471, 2405, 3459, 13735, 5850, 11886, 9060; Payload ID: 2444 relates to Category No.: 12402, 1369, 11861, 1201, 11981, 1706; Payload ID: 2445 relates to Category No.: 1153, 11861, 1201; Payload ID: 2446 relates to Category No.: 1153, 840, 11861; Payload ID: 2447 relates to Category No.: 11861, 3752, 1201; Payload ID: 2449 relates to Category No.: 14502, 11861, 3749, 1538; Payload ID: 2450 relates to Category No.: 2861, 2854, 9619, 11861, 2566, 12189, 3663, 11886, 9629, 12107, 5969; Payload ID: 2451 relates to Category No.: 2854, 2861, 11861, 9805, 2271, 2853, 14503, 9618, 5347, 12107, 2327; Payload ID: 2452 relates to Category No.: 894, 11861; Payload ID: 2453 relates to Category No.: 894, 11939; Payload ID: 2454 relates to Category No.: 2854, 2861; Payload ID: 2455 relates to Category No.: 14503, 9619, 5009, 11861; Payload ID: 2456 relates to Category No.: 2854, 14503, 15403, 637, 9619, 2861, 3663, 11861, 2853, 5231, 9618; Payload ID: 2457 relates to Category No.: 2854, 2861, 11861, 4196, 2566, 12189; Payload ID: 2458 relates to Category No.: 2854, 5105, 2861, 11861, 4196, 2566, 12189, 14519; Payload ID: 2459 relates to Category No.:

2854, 2861; Payload ID: 2460 relates to Category No.: 2854, 2861, 6024, 4196, 2566, 12189, 9619; Payload ID: 2461 relates to Category No.: 2861, 11861, 5105, 2852, 2854, 11886, 9629, 637, 5969; Payload ID: 2462 relates to Category No.: 2854, 2861; Payload ID: 2463 relates to Category No.: 2854, 2861, 11861; Payload ID: 2464 relates to Category No.: 16244, 5840, 11861; Payload ID: 2465 relates to Category No.: 16244, 5840, 11861, 1393; Payload ID: 2466 relates to Category No.: 16244, 5840, 11861; Payload ID: 2467 relates to Category No.: 16244, 5840, 11861; Payload ID: 2468 relates to Category No.: 11861; Payload ID: 2469 relates to Category No.: 11861; Payload ID: 2471 relates to Category No.: 3303, 14471, 11861, 14240, 15528, 14239; Payload ID: 2472 relates to Category No.: 3303, 15503, 14471, 14471, 15530, 14255, 14240, 11861, 15495, 3459; Payload ID: 2473 relates to Category No.: 3303, 14234, 14471, 11861, 15528, 14233; Payload ID: 2474 relates to Category No.: 15029, 11890, 12402, 11981, 12363, 11861, 5347, 5841, 3752, 9617, 2346, 943, 9060, 9592, 5835, 11933, 11861, 1327, 14706, 5957, 15180, 6647, 14226; Payload ID: 2475 relates to Category No.: 11939, 2953, 11861, 11981, 11933, 14377, 11890, 11861, 1327; Payload ID: 2476 relates to Category No.: 11895, 11890, 14733, 1404, 11861, 5841, 11886, 11664, 2643, 598, 3752, 9060; Payload ID: 2477 relates to Category No.: 15908, 11861, 1405, 16331, 14564, 6188, 9990, 11981; Payload ID: 2478 relates to Category No.: 1405, 16331, 14564, 15893, 6188, 11861, 3774, 14537, 9990; Payload ID: 2479 relates to Category No.: 1405, 16331, 14564, 15908, 15503, 14471, 15893, 6188, 11861, 14537, 9990, 3765, 11981; Payload ID: 2480 relates to Category No.: 16331, 15908, 15893, 6188, 11861, 5347, 9226; Payload ID: 2481 relates to Category No.: 15503, 14471, 11939, 2405, 11895, 15524, 15491, 11861, 2737, 6083; Payload ID: 2482 relates to Category No.: 15503, 14471, 2405, 15491, 15495, 11861, 14249, 5101, 6083, 14652, 14229, 14246; Payload ID: 2483 relates to Category No.: 15491; Payload ID: 2484 relates to Category No.: 14196, 11861, 1201; Payload ID: 2485 relates to Category No.: 3303, 15503, 14471, 11939, 14471, 15504, 15524, 15491, 11861, 15503, 14239, 5957, 15528, 14255, 14225, 15528, 14233, 14234; Payload ID: 2486 relates to Category No.: 3303, 15503, 14471, 11939, 11933, 14471, 14243, 11861, 15503, 14239, 15528, 14233, 2405, 15524, 5109, 5957, 5101, 15905, 15504, 14234, 4517; Payload ID: 2487 relates to Category No.: 15503, 14471, 14471, 11861, 14234, 15528, 14233; Payload ID: 2488 relates to Category No.: 15503, 14471, 14234, 14471, 15528, 14233, 11939, 3303, 11933; Payload ID: 2489 relates to Category No.: 3303, 15503, 14471, 11933, 14471, 15504, 11861, 15528, 14233, 14234, 3459, 14234, 1121; Payload ID: 2490 relates to Category No.: 3303, 14234, 10116, 15528, 14233, 1201; Payload ID: 2491 relates to Category No.: 16331, 6816, 15503, 14471, 14234, 14471, 15524, 15495, 11861, 15530, 14233, 2407, 3303, 2405, 15528, 14255; Payload ID: 2492 relates to Category No.: 3303, 6816, 14234, 14471, 15524, 5105, 11861, 15528, 14233, 9226; Payload ID: 2493 relates to Category No.: 11917; Payload ID: 2494 relates to Category No.: 16331, 9226, 15503, 14471, 10116, 11861, 14597, 14602; Payload ID: 2496 relates to Category No.: 11890, 14082, 840, 11920, 10116, 11861, 3936, 10119; Payload ID: 2497 relates to Category No.: 11861; Payload ID: 2498 relates to Category No.: 11861, 7192; Payload ID: 2499 relates to Category No.: 14248, 11861, 10119, 14250; Payload ID: 2500 relates to Category No.: 11861; Payload ID: 2501 relates to Category No.: 16331, 9282, 9226, 6816, 15908, 6188, 10116, 11861; Payload ID: 2502 relates to Category No.: 6816, 14196, 11861, 10119, 4000; Payload ID: 2503 relates to Category No.: 6816, 11861, 10119; Payload ID: 2504 relates to Category No.: 14564, 9226, 6816, 14196, 15503, 14471, 11861, 10119, 97, 4000; Payload ID: 2505 relates to Category No.: 9226, 6816, 14196, 15503, 14471, 11861, 10119, 97; Payload ID: 2508 relates to Category No.: 11861, 5308, 307, 5401; Payload ID: 2509 relates to Category No.: 14504, 3665, 15561; Payload ID: 2510 relates to Category No.: 11861, 6242, 9657, 9390, 6258; Payload ID: 2511 relates to Category No.: 5588, 11861; Payload ID: 2512 relates to Category No.: 12402, 12399, 11861, 6936; Payload ID: 2513 relates to Category No.: 14379, 11861; Payload ID: 2514 relates to Category No.: 14379; Payload ID: 2515 relates to Category No.: 11861; Payload ID: 2517 relates to Category No.: 11861; Payload ID: 2518 relates to Category No.: 11861; Payload ID: 2519 relates to Category No.: 11861, 12417; Payload ID: 2520 relates to Category No.: 11861, 1137, 3648, 3989, 6240; Payload ID: 2521 relates to Category No.: 11861, 1137, 3648, 3989, 6240; Payload ID: 2522 relates to Category No.: 4698, 11861, 1137, 3648, 3989, 6240; Payload ID: 2523 relates to Category No.: 5105, 12399, 11861, 1706, 1137, 3648, 3989, 6240, 6209; Payload ID: 2524 relates to Category No.: 11861, 1137, 3648, 3989, 6240; Payload ID: 2525 relates to Category No.: 11861, 14147; Payload ID: 2526 relates to Category No.: 12402, 12399, 11861, 11939; Payload ID: 2527 relates to Category No.: 11861, 11939, 12402, 12399, 1706; Payload ID: 2528 relates to Category No.: 11861; Payload ID: 2529 relates to Category No.: 11861; Payload ID: 2530 relates to Category No.: 1504, 6583; Payload ID: 2531 relates to Category No.: 6816, 1504, 9625, 11861, 6583, 16206, 16204; Payload ID: 2532 relates to Category No.: 11861, 1504; Payload ID: 2533 relates to Category No.: 11861, 11939, 12399, 5588, 11981, 1706; Payload ID: 2534 relates to Category No.: 11861, 1504; Payload ID: 2535 relates to Category No.: 12399, 11861; Payload ID: 2536 relates to Category No.: 11939, 15617, 11861, 5347; Payload ID: 2537 relates to Category No.: 1405, 1504, 11861, 7192, 4016; Payload ID: 2538 relates to Category No.: 15617, 2859, 11861, 15781; Payload ID: 2539 relates to Category No.: 11861; Payload ID: 2540 relates to Category No.: 11861, 12402; Payload ID: 2541 relates to Category No.: 2694, 11861, 5347, 11828, 14538, 11981; Payload ID: 2542 relates to Category No.: 15021, 11861, 14537, 11895, 1153, 11886, 1369, 16084; Payload ID: 2543 relates to Category No.: 11861; Payload ID: 2544 relates to Category No.: 11861; Payload ID: 2545 relates to Category No.: 11861; Payload ID: 2546 relates to Category No.: 11861, 5356; Payload ID: 2547 relates to Category No.: 11861, 9834, 9896, 14582; Payload ID: 2548 relates to Category No.: 15617, 11861; Payload ID: 2549 relates to Category No.: 11861; Payload ID: 2550 relates to Category No.: 1504; Payload ID: 2551 relates to Category No.: 4864, 11861, 2538; Payload ID: 2552 relates to Category No.: 11861, 1504, 12399; Payload ID: 2553 relates to Category No.: 15504, 1504, 15074; Payload ID: 2554 relates to Category No.: 6210, 15561, 6341, 15382, 6334, 6254, 11861, 5061, 6259; Payload ID: 2555 relates to Category No.: 11861; Payload ID: 2556 relates to Category No.: 15542, 7493, 9976, 7481, 5308, 313; Payload ID: 2557 relates to Category No.: 11933, 15617, 15491, 11861; Payload ID: 2558 relates to Category No.: 11933, 15617, 12416, 11981, 11861, 14537, 12417, 15205, 14564; Payload ID: 2559 relates to Category No.: 10116, 3391, 11861; Payload ID: 2560 relates to Category No.: 11933, 15617, 12416, 11861, 15205; Payload ID: 2561 relates to Category No.: 16331, 11939, 4023, 15617, 12399, 11981, 2694, 11861, 3752, 6941, 4710, 16206, 12146, 5377; Payload ID: 2562 relates to Category No.: 2874, 15777, 11861, 1681; Payload ID: 2563 relates to Category No.: 14564, 15895, 12399, 11861, 3752, 15781, 735; Payload ID: 2564 relates to Category No.: 2881, 5293, 11861, 5295, 2566; Payload ID: 2565 relates to Category No.: 12399, 1369, 11861, 16206, 3663, 3753, 2611; Payload ID: 2566 relates to Category No.: 11861, 15382; Payload ID: 2567 relates to Category No.: 12399, 11861, 735; Payload ID: 2568 relates to Category No.: 15617, 14379, 12399, 11861; Payload ID: 2569 relates to Category No.: 14379; Payload ID: 2571 relates to Category No.: 11861; Payload ID: 2572 relates to Category No.: 6210, 11861, 16206, 3753; Payload ID: 2573 relates to Category No.: 12402, 11861; Payload ID: 2574 relates to Category No.: 2611, 11861; Payload ID: 2575 relates to Category No.: 14379, 11861; Payload ID: 2576 relates to Category No.: 11861, 11886; Payload ID: 2578 relates to Category No.: 15617, 1504, 11861, 1405; Payload ID: 2579 relates to Category No.: 11861, 12399; Payload ID: 2580 relates to Category No.: 12402, 2874, 15777, 11861, 11828; Payload ID: 2581 relates to Category No.: 15617, 12402, 1504, 11861; Payload ID: 2582 relates to Category No.: 2881, 11861, 1146, 5347, 6941, 2875, 11864, 6944, 6470, 6941, 16180, 9060; Payload ID: 2583 relates to Category No.: 15617, 11861; Payload ID: 2584 relates to Category No.: 15617, 11861; Payload ID: 2585 relates to Category No.: 2694, 11861, 16206; Payload ID: 2586 relates to Category No.: 11861, 15545, 6944; Payload ID: 2587 relates to Category No.: 11861; Payload ID: 2588 relates to Category No.: 11861; Payload ID: 2589 relates to Category No.: 12399, 11861; Payload ID: 2590 relates to Category No.: 12399, 2694, 11861, 16206, 12402; Payload ID: 2591 relates to Category No.: 2694, 11861, 6933, 11939, 11981; Payload ID: 2592 relates to Category No.: 2694, 11861, 6933; Payload ID: 2593 relates to Category No.: 11861, 5588; Payload ID: 2594 relates to Category No.: 1405, 15617, 1504, 12399, 11861, 2613; Payload ID: 2595 relates to Category No.: 11861; Payload ID: 2597 relates to Category No.: 11861; Payload ID: 2598 relates to Category No.: 5956, 2834, 11861; Payload ID: 2599 relates to Category No.: 2834; Payload ID: 2600 relates to Category No.: 11978, 926, 6478, 12109, 11861, 5347, 6816; Payload ID: 2601 relates to Category No.: 11978, 926, 6478, 12109, 11861, 14106, 6816; Payload ID: 2602 relates to Category No.: 11978, 926, 6478, 12109, 11861; Payload ID: 2603 relates to Category No.: 4894, 11861, 4901; Payload ID: 2604 relates to Category No.: 4894, 11861, 4901, 9383; Payload ID: 2605 relates to Category No.: 4894, 4901, 2937, 11861; Payload ID: 2606 relates to Category No.: 4894, 10116, 11861, 4901; Payload ID: 2607 relates to Category No.: 4894, 4901, 11861; Payload ID: 2608 relates to Category No.: 14107, 11861; Payload ID: 2609 relates to Category No.: 15029, 4897; Payload ID: 2610 relates to Category No.: 15029, 11861; Payload ID: 2611 relates to Category No.: 11978, 926, 12109, 9096, 11861, 12114, 12145; Payload ID: 2612 relates to Category No.: 11978, 926, 12109, 11861, 12114; Payload ID: 2613 relates to Category No.: 11978, 926, 12109, 10116, 11861, 12114, 12145, 5956; Payload ID: 2614 relates to Category No.: 11978, 926, 12109, 11861, 12114, 12145; Payload ID: 2615 relates to Category No.: 6816, 65; Payload ID: 2616 relates to Category No.: 6816, 11939, 65, 10116, 11861; Payload ID: 2617 relates to Category No.: 6816, 65; Payload ID: 2618 relates to Category No.: 15895, 15893, 11981, 11861; Payload ID: 2619 relates to Category No.: 11861; Payload ID: 2621 relates to Category No.: 1630, 138, 6816, 15542, 5875, 11981, 11992, 11886; Payload ID: 2622 relates to Category No.: 6816, 15542, 5875, 1630, 138, 11861, 7192, 7430, 15688; Payload ID: 2623 relates to Category No.: 6965, 15524, 11981, 1457, 11861, 15766, 11886; Payload ID: 2624 relates to Category No.: 11981, 11861, 2823, 7125, 9014, 15905, 6647, 11886; Payload ID: 2625 relates to Category No.: 16331, 9226, 6816, 11861, 2823; Payload ID: 2626 relates to Category No.: 14196, 9539, 11861; Payload ID: 2628 relates to Category No.: 15542, 15556, 9816, 3218; Payload ID: 2629 relates to Category No.: 15542, 15556, 9816; Payload ID: 2630 relates to Category No.: 9988, 4246, 11861, 1697, 6574, 1504, 3215, 506, 15542; Payload ID: 2631 relates to Category No.: 7192; Payload ID: 2633 relates to Category No.: 11861; Payload ID: 2634 relates to Category No.: 11939, 12402, 12399, 11861, 1706, 9608; Payload ID: 2635 relates to Category No.: 11939, 12402, 12399, 11861, 1706; Payload ID: 2636 relates to Category No.: 11939, 12402, 12399, 11861, 1706; Payload ID: 2637 relates to Category No.: 11939, 12402, 12399, 11861, 1706; Payload ID: 2638 relates to Category No.: 11861, 11828; Payload ID: 2639 relates to Category No.: 10116, 11861, 3753, 14232, 3752; Payload ID: 2640 relates to Category No.: 14196, 10116; Payload ID: 2642 relates to Category No.: 11861, 7192; Payload ID: 2643 relates to Category No.: 11939, 11861; Payload ID: 2644 relates to Category No.: 11861, 5347; Payload ID: 2645 relates to Category No.: 7192; Payload ID: 2646 relates to Category No.: 11861, 7192; Payload ID: 2648 relates to Category No.: 12150, 12151, 9804, 9962, 12111, 11861; Payload ID: 2649 relates to Category No.: 12150, 12151, 9804, 12111, 11861; Payload ID: 2650 relates to Category No.: 11861; Payload ID: 2651 relates to Category No.: 11895, 11861, 3752, 5109; Payload ID: 2652 relates to Category No.: 11861; Payload ID: 2653 relates to Category No.: 15908, 11861; Payload ID: 2654 relates to Category No.: 12150, 11981, 11861; Payload ID: 2655 relates to Category No.: 12150, 11981, 11861; Payload ID: 2656 relates to Category No.: 12150, 11981, 11861, 16296; Payload ID: 2657 relates to Category No.: 11861; Payload ID: 2658 relates to Category No.: 11861, 12081; Payload ID: 2659 relates to Category No.: 926, 15908, 15895, 15893, 11861, 15888, 6188; Payload ID: 2660 relates to Category No.: 4961, 15973, 11981, 11861, 2271, 5957, 5282, 11992; Payload ID: 2661 relates to Category No.: 4961, 15973, 2271, 11861; Payload ID: 2662 relates to Category No.: 10116, 11861, 14395; Payload ID: 2663 relates to Category No.: 4886, 4895, 15893, 11981, 11861, 5347, 15355, 784, 4899, 14105, 7127; Payload ID: 2664 relates to Category No.: 2405, 14597, 11861, 3361, 93; Payload ID: 2665 relates to Category No.: 3303, 10116, 11861, 16277, 11981, 12076, 15496, 6127; Payload ID: 2666 relates to Category No.: 926, 9282, 11861, 5957; Payload ID: 2667 relates to Category No.: 11978, 926, 6816, 5956, 12109, 11861; Payload ID: 2668 relates to Category No.: 11861, 14232; Payload ID: 2669 relates to Category No.: 15491, 15495, 10116, 11861, 2688, 6185; Payload ID: 2671 relates to Category No.: 11861, 7192; Payload ID: 2672 relates to Category No.: 11861; Payload ID: 2673 relates to Category No.: 2405, 11861; Payload ID: 2675 relates to Category No.: 11861; Payload ID: 2676 relates to Category No.: 11861; Payload ID: 2677 relates to Category No.: 1405; Payload ID: 2678 relates to Category No.: 16331, 11861; Payload ID: 2679 relates to Category No.: 5293, 11861, 2499, 5295, 3828; Payload ID: 2681 relates to Category No.: 9518, 4225, 15495, 15504; Payload ID: 2682 relates to Category No.: 9518, 4225; Payload ID: 2683 relates to Category No.: 15629, 6210, 11861, 14062, 14085, 14088, 14077; Payload ID: 2684 relates to Category No.: 15629, 6210, 11861, 14062, 14085, 14088, 14077; Payload ID: 2686 relates to Category No.: 3303; Payload ID: 2687 relates to Category No.: 4894, 11861; Payload ID: 2688 relates to Category No.: 11861, 1327, 11981, 11920, 9965; Payload ID: 2689 relates to Category No.: 1405, 11861, 6965, 4805, 5038; Payload ID: 2690 relates to Category No.: 1405, 11861, 6965, 4805, 5038; Payload ID: 2691 relates to Category No.: 1405, 11861, 6965, 4805; Payload ID: 2692 relates to Category No.: 11861; Payload ID: 2694 relates to Category No.: 11861; Payload ID: 2695 relates to Category No.: 11920, 11861; Payload ID: 2696 relates to Category No.: 3303, 11933, 2405, 11861; Payload ID: 2697 relates to Category No.: 3303, 9226, 2405, 14471, 2191, 14374; Payload ID: 2698 relates to Category No.: 3303, 2191, 11861; Payload ID: 2699 relates to Category No.: 926, 6974, 942, 6965, 11861, 5966; Payload ID: 2700 relates to Category No.: 11939, 2405, 11895, 15504, 11861, 3508; Payload ID: 2701 relates to Category No.: 11861, 5966; Payload ID: 2702 relates to Category No.: 11861; Payload ID: 2703 relates to Category No.: 11981, 11920, 11861, 15766; Payload ID: 2704 relates to Category No.: 11861; Payload ID: 2705 relates to Category No.: 11861; Payload ID: 2708 relates to Category No.: 11861; Payload ID: 2709 relates to Category No.: 11861; Payload ID: 2711 relates to Category No.: 3303, 11933, 11861; Payload ID: 2712 relates to Category No.: 11861; Payload ID: 2713 relates to Category No.: 7192, 1528; Payload ID: 2714 relates to Category No.: 1528; Payload ID: 2715 relates to Category No.: 1528; Payload ID: 2716 relates to Category No.: 3303, 11933, 11861; Payload ID: 2717 relates to Category No.: 1201; Payload ID: 2718 relates to Category No.: 11861; Payload ID: 2719 relates to Category No.: 11861, 11895; Payload ID: 2720 relates to Category No.: 11861; Payload ID: 2722 relates to Category No.: 11939, 11861, 7192, 11886; Payload ID: 2723 relates to Category No.: 11895, 11861; Payload ID: 2724 relates to Category No.: 11981, 11861; Payload ID: 2725 relates to Category No.: 11861; Payload ID: 2726 relates to Category No.: 11861; Payload ID: 2727 relates to Category No.: 11861; Payload ID: 2728 relates to Category No.: 11861; Payload ID: 2729 relates to Category No.: 11861, 9805; Payload ID: 2730 relates to Category No.: 11861; Payload ID: 2731 relates to Category No.: 11895, 11981, 11920, 11861; Payload ID: 2732 relates to Category No.: 11861; Payload ID: 2734 relates to Category No.: 6965, 11861; Payload ID: 2735 relates to Category No.: 11861; Payload ID: 2736 relates to Category No.: 11861; Payload ID: 2737 relates to Category No.: 11861; Payload ID: 2738 relates to Category No.: 6965, 5347, 4389, 11939, 11861, 4183; Payload ID: 2739 relates to Category No.: 5347, 4389, 6965, 11861, 7192; Payload ID: 2740 relates to Category No.: 11861; Payload ID: 2741 relates to Category No.: 11981, 11920, 11861; Payload ID: 2742 relates to Category No.: 11861; Payload ID: 2743 relates to Category No.: 11861; Payload ID: 2744 relates to Category No.: 11861; Payload ID: 2746 relates to Category No.: 11861, 7192; Payload ID: 2747 relates to Category No.: 11861; Payload ID: 2749 relates to Category No.: 11861; Payload ID: 2750 relates to Category No.: 11861; Payload ID: 2751 relates to Category No.: 1457, 11861; Payload ID: 2752 relates to Category No.: 11861; Payload ID: 2753 relates to Category No.: 6826, 11861; Payload ID: 2754 relates to Category No.: 926, 6478, 5956, 11861, 2210; Payload ID: 2755 relates to Category No.: 5956; Payload ID: 2756 relates to Category No.: 14877, 7192, 4864; Payload ID: 2757 relates to Category No.: 14877, 3303, 11861; Payload ID: 2758 relates to Category No.: 3303, 14877; Payload ID: 2759 relates to Category No.: 14877, 3303; Payload ID: 2760 relates to Category No.: 3303, 14877; Payload ID: 2761 relates to Category No.: 3303, 14877; Payload ID: 2762 relates to Category No.: 9951, 9939, 4704, 4698, 2202, 2204; Payload ID: 2763 relates to Category No.: 11939, 2874, 1253, 7236; Payload ID: 2764 relates to Category No.: 11861; Payload ID: 2765 relates to Category No.: 11861, 7192; Payload ID: 2767 relates to Category No.: 11861, 11939; Payload ID: 2768 relates to Category No.: 11861; Payload ID: 2769 relates to Category No.: 11861; Payload ID: 2770 relates to Category No.: 11861; Payload ID: 2771 relates to Category No.: 957, 6816, 11861; Payload ID: 2772 relates to Category No.: 11861; Payload ID: 2773 relates to Category No.: 7192, 11861; Payload ID: 2774 relates to Category No.: 4864; Payload ID: 2776 relates to Category No.: 15973, 11861; Payload ID: 2777 relates to Category No.: 11861, 6583; Payload ID: 2778 relates to Category No.: 11939, 11861; Payload ID: 2780 relates to Category No.: 9518, 2672, 2271, 4166; Payload ID: 2781 relates to Category No.: 4864, 2282, 10092, 16084, 11861, 11939, 16083; Payload ID: 2782 relates to Category No.: 3459, 14243, 15530, 14255, 11861; Payload ID: 2783 relates to Category No.: 14258, 9282, 1630, 11861, 3391, 1386; Payload ID: 2786 relates to Category No.: 11861; Payload ID: 2787 relates to Category No.: 11861; Payload ID: 2788 relates to Category No.: 11861; Payload ID: 2789 relates to Category No.: 11861; Payload ID: 2790 relates to Category No.: 11861; Payload ID: 2793 relates to Category No.: 11861; Payload ID: 2794 relates to Category No.: 11861; Payload ID: 2795 relates to Category No.: 11978, 926, 6478, 12109; Payload ID: 2796 relates to Category No.: 11861; Payload ID: 2800 relates to Category No.: 11861; Payload ID: 2802 relates to Category No.: 15542, 15548, 11861, 9122; Payload ID: 2803 relates to Category No.: 15542, 15548, 7192; Payload ID: 2804 relates to Category No.: 926, 15973, 15895, 11861; Payload ID: 2805 relates to Category No.: 926, 15973, 10116, 11861; Payload ID: 2806 relates to Category No.: 926, 15973, 10116, 11861; Payload ID: 2807 relates to Category No.: 926, 15973, 11861, 1173, 4806; Payload ID: 2808 relates to Category No.: 926, 15973, 10116, 11861; Payload ID: 2809 relates to Category No.: 926, 15973, 12142; Payload ID: 2810 relates to Category No.: 926, 15973, 11861, 5347; Payload ID: 2811 relates to Category No.: 926, 15973, 11861, 942, 2744; Payload ID: 2812 relates to Category No.: 926, 1430, 706; Payload ID: 2813 relates to Category No.: 1504, 11861, 6434, 2855; Payload ID: 2814 relates to Category No.: 16331, 11939, 6829, 11920, 11861; Payload ID: 2815 relates to Category No.: 11920, 11861; Payload ID: 2816 relates to Category No.: 11920, 11861, 9824; Payload ID: 2817 relates to Category No.: 11920, 11861; Payload ID: 2818 relates to Category No.: 11939, 11861, 9824, 15915; Payload ID: 2819 relates to Category No.: 11939, 6210, 11861, 5347, 943; Payload ID: 2820 relates to Category No.: 11939, 11861, 5347; Payload ID: 2821 relates to Category No.: 11939, 11861; Payload ID: 2822 relates to Category No.: 11861; Payload ID: 2823 relates to Category No.: 11861, 12064; Payload ID: 2824 relates to Category No.: 12142; Payload ID: 2825 relates to Category No.: 11978, 926, 12109, 11861, 5196; Payload ID: 2826 relates to Category No.: 11978, 926, 11861, 6816, 11939, 15895, 12109, 11981, 5347, 5956; Payload ID: 2827 relates to Category No.: 16331, 9282, 15908, 6188, 11861, 15893; Payload ID: 2828 relates to Category No.: 4820, 12399, 11861, 2298; Payload ID: 2829 relates to Category No.: 11939, 2293, 1669, 2300; Payload ID: 2830 relates to Category No.: 2293, 11861, 1669; Payload ID: 2831 relates to Category No.: 4820, 2298; Payload ID: 2832 relates to Category No.: 2293, 1669, 11861, 2874; Payload ID: 2833 relates to Category No.: 2293, 11861, 1669; Payload ID: 2834 relates to Category No.: 2293, 12402, 1669; Payload ID: 2835 relates to Category No.: 2293, 1669; Payload ID: 2836 relates to Category No.: 2293, 12402, 5009, 2282, 1669; Payload ID: 2837 relates to Category No.: 2293, 2282, 1669; Payload ID: 2838 relates to Category No.: 2293, 12402, 1669; Payload ID: 2839 relates to Category No.: 2293, 11861, 1669; Payload ID: 2840 relates to Category No.: 2293, 1669, 2300, 1677, 1671; Payload ID: 2841 relates to Category No.: 2293, 11978, 12402, 1672, 11861, 4821, 5009; Payload ID: 2842 relates to Category No.: 2293, 11861, 1669, 2874; Payload ID: 2843 relates to Category No.: 2293, 1669, 2300, 1677; Payload ID: 2844 relates to Category No.: 2293, 1669; Payload ID: 2845 relates to Category No.: 2293, 1670, 5009; Payload ID: 2846 relates to Category No.: 2293, 1669, 2874; Payload ID: 2847 relates to Category No.: 2293, 5259, 2300, 1671, 11861; Payload ID: 2848 relates to Category No.: 2293, 1669; Payload ID: 2849 relates to Category No.: 2293; Payload ID: 2850 relates to Category No.: 2293, 11861; Payload ID: 2851 relates to Category No.: 11978, 5956, 2293, 1670, 1676, 2282, 11861, 5347, 9923, 1441; Payload ID: 2852 relates to Category No.: 2293, 1669; Payload ID: 2854 relates to Category No.: 2293; Payload ID: 2855 relates to Category No.: 2293, 11861, 1669; Payload ID: 2856 relates to Category No.: 11978, 11939, 2293, 1670, 1673, 1676, 9868, 2282, 11861, 2300, 12107, 9923, 12420, 2299, 5009; Payload ID: 2857 relates to Category No.: 2293, 1670, 5009, 11861, 1672; Payload ID: 2858 relates to Category No.: 11978, 2293, 5009, 1669, 9923, 1672; Payload ID: 2859 relates to Category No.: 9868, 4820, 11861, 2298, 1665, 1664, 2292, 2290; Payload ID: 2860 relates to Category No.: 4820, 1665, 2298; Payload ID: 2861 relates to Category No.: 11939, 4820, 2298, 1665, 1672, 11861, 11981, 2290; Payload ID: 2862 relates to Category No.: 4820, 11861, 2298, 1665; Payload ID: 2863 relates to Category No.: 4820, 2298, 1665; Payload ID: 2864 relates to Category No.: 267, 9868, 4820, 2694, 11861, 2298, 1665, 16206, 1664, 2290; Payload ID: 2865 relates to Category No.: 4820, 12399, 2298, 1665, 11861; Payload ID: 2866 relates to Category No.: 4820, 1665, 2285, 2288, 1666, 1667, 11861; Payload ID: 2867 relates to Category No.: 4820, 2694, 2298, 11861; Payload ID: 2868 relates to Category No.: 4820, 2298, 11861, 1665; Payload ID: 2869 relates to Category No.: 4820, 2298, 1669, 2300; Payload ID: 2870 relates to Category No.: 2293, 12402, 11861, 1669; Payload ID: 2871 relates to Category No.: 4820, 11861, 2298, 2803, 2881; Payload ID: 2872 relates to Category No.: 3749, 4864, 2293, 12402, 2806; Payload ID: 2873 relates to Category No.: 2293, 12402, 5009, 11861, 2807, 1476; Payload ID: 2874 relates to Category No.: 2293, 5009, 11861, 2807; Payload ID: 2875 relates to Category No.: 4864, 2293, 12402, 2282, 2806, 2300; Payload ID: 2876 relates to Category No.: 11933, 2293, 5009, 4183, 12400, 2807, 1671, 2809; Payload ID: 2877 relates to Category No.: 2293, 11861; Payload ID: 2878 relates to Category No.: 2293, 14379, 6341, 2300; Payload ID: 2880 relates to Category No.: 2293, 11861, 2806; Payload ID: 2881 relates to Category No.: 2293, 2806; Payload ID: 2882 relates to Category No.: 2293, 2806; Payload ID: 2883 relates to Category No.: 2293, 5009, 2806; Payload ID: 2884 relates to Category No.: 2293, 11861, 5719; Payload ID: 2885 relates to Category No.: 2293, 2874, 11861, 2807; Payload ID: 2886 relates to Category No.: 4820, 5715, 2298, 5718; Payload ID: 2887 relates to Category No.: 4820, 2805, 5715, 14564, 11861, 5718; Payload ID: 2888 relates to Category No.: 4820, 12399, 2298, 2804, 2294, 2805; Payload ID: 2889 relates to Category No.: 267, 15895, 4820, 2694, 11861, 15887, 2805, 2875, 16206, 7405, 3471; Payload ID: 2890 relates to Category No.: 4820, 11861, 2805; Payload ID: 2891 relates to Category No.: 4820, 2694, 2805, 2804; Payload ID: 2892 relates to Category No.: 2293; Payload ID: 2893 relates to Category No.: 1153, 11861, 5347; Payload ID: 2895 relates to Category No.: 6816, 4894, 11861, 14538, 3765; Payload ID: 2896 relates to Category No.: 6816, 4894, 11861, 14538; Payload ID: 2897 relates to Category No.: 5308, 5311, 2319, 2316, 3628; Payload ID: 2898 relates to Category No.: 4023, 5308, 5311, 1504, 2319, 2316; Payload ID: 2899 relates to Category No.: 5308, 5311, 1504, 2319, 2316; Payload ID: 2900 relates to Category No.: 2319, 2316, 5308, 5311, 11861, 9356; Payload ID: 2901 relates to Category No.: 5308, 5311, 2319, 2316, 6446, 1504, 5957; Payload ID: 2902 relates to Category No.: 5308, 5311, 2319, 2316; Payload ID: 2904 relates to Category No.: 6816, 6829, 2323, 5764; Payload ID: 2905 relates to Category No.: 6816, 6829, 2323, 5764, 6186; Payload ID: 2906 relates to Category No.: 6816, 6829, 2323, 5764; Payload ID: 2907 relates to Category No.: 2323; Payload ID: 2908 relates to Category No.: 11933, 10116, 11861; Payload ID: 2909 relates to Category No.: 16249, 5840, 11861, 2323; Payload ID: 2910 relates to Category No.: 16249, 5840; Payload ID: 2911 relates to Category No.: 16249, 5840, 926, 11939, 11933, 754, 11861, 2323, 9608, 16266, 16250; Payload ID: 2912 relates to Category No.: 926, 754, 16249, 5840, 2323; Payload ID: 2913 relates to Category No.: 926, 754, 16249, 5840, 2323; Payload ID: 2914 relates to Category No.: 926, 754, 16249, 5840; Payload ID: 2915 relates to Category No.: 926, 754, 16249, 5840, 2323, 11861; Payload ID: 2916 relates to Category No.: 6816, 16249, 5840; Payload ID: 2917 relates to Category No.: 6816, 16249, 5840; Payload ID: 2918 relates to Category No.: 11861, 16250, 2323; Payload ID: 2919 relates to Category No.: 4617, 11861, 16250, 2323; Payload ID: 2920 relates to Category No.: 11861, 16250, 2323; Payload ID: 2921 relates to Category No.: 11861, 16250, 2323; Payload ID: 2922 relates to Category No.: 11861, 16250, 2323; Payload ID: 2923 relates to Category No.: 11861, 16250, 2323, 3430; Payload ID: 2924 relates to Category No.: 5259, 11861, 8959; Payload ID: 2925 relates to Category No.: 4820, 9629, 2337; Payload ID: 2926 relates to Category No.: 9868, 4820, 11861, 58, 4416, 2337, 15803; Payload ID: 2927 relates to Category No.: 5865, 14971, 9518, 2344; Payload ID: 2928 relates to Category No.: 6229, 9951, 2360, 6210, 9824, 2346, 15659; Payload ID: 2929 relates to Category No.: 4207, 11861, 9518, 308, 2362; Payload ID: 2930 relates to Category No.: 14564, 3471, 2363, 3945, 11939, 2371, 926, 2361; Payload ID: 2931 relates to Category No.: 926, 2363, 3945; Payload ID: 2932 relates to Category No.: 15542, 15548, 2365, 2361; Payload ID: 2933 relates to Category No.: 6816, 9988, 4246, 3215, 3218; Payload ID: 2934 relates to Category No.: 6816, 9988, 4246, 3949, 3218; Payload ID: 2935 relates to Category No.: 9868, 4820, 3471, 4807; Payload ID: 2936 relates to Category No.: 4820, 4807, 3471; Payload ID: 2937 relates to Category No.: 9868, 4820, 12399, 11861, 211, 4807, 3471; Payload ID: 2938 relates to Category No.: 4820, 4807, 11861, 4924; Payload ID: 2939 relates to Category No.: 9868, 4820, 4807; Payload ID: 2940 relates to Category No.: 4013; Payload ID: 2941 relates to Category No.: 5840, 4013, 222, 216, 211, 11861; Payload ID: 2942 relates to Category No.: 12402, 1401, 4013, 222, 216, 211; Payload ID: 2943 relates to Category No.: 4013, 222, 216, 211, 3471; Payload ID: 2944 relates to Category No.: 4013, 222, 216, 211, 6186, 11933, 3471; Payload ID: 2945 relates to Category No.: 4013, 222, 216, 211, 6186, 11861, 5840; Payload ID: 2946 relates to Category No.: 4013, 11861, 222, 216, 211, 6186, 11933; Payload ID: 2947 relates to Category No.: 4013, 216, 211, 11861, 222; Payload ID: 2948 relates to Category No.: 11939, 4013, 222, 1146, 216, 211, 2326, 15468, 223; Payload ID: 2949 relates to Category No.: 1401, 4013, 222, 216, 211, 223, 11861; Payload ID: 2950 relates to Category No.: 4013, 222, 216, 211, 2267, 6186, 11861; Payload ID: 2951 relates to Category No.: 4013, 11861, 222, 216, 211, 6186, 11933, 3471; Payload ID: 2952 relates to Category No.: 4013, 222, 216, 211, 2267, 3471; Payload ID: 2953 relates to Category No.: 4013, 222, 216, 211, 6186, 11861, 11933, 3471; Payload ID: 2954 relates to Category No.: 4013, 222, 216, 211, 11861, 6186; Payload ID: 2955 relates to Category No.: 4013, 216, 211, 1650, 222; Payload ID: 2956 relates to Category No.: 4013, 11861, 222, 216, 211, 2267; Payload ID: 2957 relates to Category No.: 11861; Payload ID: 2958 relates to Category No.: 11861, 2566, 2570; Payload ID: 2959 relates to Category No.: 6816, 11861, 241, 4560, 7438, 15542, 15553; Payload ID: 2960 relates to Category No.: 241, 7438; Payload ID: 2961 relates to Category No.: 6816, 4562, 241, 4560, 4564, 9656; Payload ID: 2962 relates to Category No.: 6816, 11861, 241, 4564; Payload ID: 2963 relates to Category No.: 14564, 11981, 11861; Payload ID: 2964 relates to Category No.: 4864, 11861; Payload ID: 2965 relates to Category No.: 6816, 241, 4560, 7438, 15542, 15553; Payload ID: 2966 relates to Category No.: 6816, 241, 4560, 7438; Payload ID: 2967 relates to Category No.: 1504; Payload ID: 2969 relates to Category No.: 11861, 2875, 5009, 15179; Payload ID: 2970 relates to Category No.: 11861; Payload ID: 2971 relates to Category No.: 11861; Payload ID: 2972 relates to Category No.: 5259; Payload ID: 2973 relates to Category No.: 5259; Payload ID: 2974 relates to Category No.: 5259; Payload ID: 2975 relates to Category No.: 5259; Payload ID: 2976 relates to Category No.: 5259; Payload ID: 2977 relates to Category No.: 5259; Payload ID: 2978 relates to Category No.: 6816, 5259; Payload ID: 2979 relates to Category No.: 6816, 5259; Payload ID: 2980 relates to Category No.: 5259, 6816; Payload ID: 2981 relates to Category No.: 4894, 12359, 12358; Payload ID: 2982 relates to Category No.: 4894, 12359; Payload ID: 2983 relates to Category No.: 4013; Payload ID: 2984 relates to Category No.: 3303, 11933, 3390, 11861; Payload ID: 2985 relates to Category No.: 2405, 15973, 11861, 5347, 2418; Payload ID: 2986 relates to Category No.: 2405, 15973, 5105, 11861; Payload ID: 2987 relates to Category No.: 3303, 11861; Payload ID: 2988 relates to Category No.: 10116, 11861; Payload ID: 2989 relates to Category No.: 2405, 11861, 3752, 5215, 5347, 11939; Payload ID: 2990 relates to Category No.: 3303, 11861, 2405, 6900; Payload ID: 2991 relates to Category No.: 11920, 11861, 5347, 3752, 5215; Payload ID: 2992 relates to Category No.: 15101, 6188, 15495, 11861, 3752, 15097, 2405, 15524, 6900, 14602, 9961; Payload ID: 2993 relates to Category No.: 6900, 11861, 1327, 11861, 13735, 11939, 2405, 5109; Payload ID: 2994 relates to Category No.: 11861, 14602; Payload ID: 2995 relates to Category No.: 11861, 2405, 6900, 14602; Payload ID: 2996 relates to Category No.: 6900, 11861, 14602, 15907; Payload ID: 2997 relates to Category No.: 926, 3303, 6900, 953, 11861; Payload ID: 2998 relates to Category No.: 926, 953, 9282, 9226, 942, 954, 11861; Payload ID: 2999 relates to Category No.: 926, 3303, 5105, 953, 10116, 11861, 2691, 4965; Payload ID: 3000 relates to Category No.: 926, 3303, 16331, 9226, 4965, 954, 953, 10116, 5308, 305, 5405, 11861; Payload ID: 3001 relates to Category No.: 926, 3303, 16331, 9226, 6965, 954, 5308, 305, 5405, 11861, 14234, 953, 9271, 14240, 14244, 15504; Payload ID: 3002 relates to Category No.: 926, 3303, 16331, 9226, 954, 5308, 305, 5405, 11861, 4928; Payload ID: 3003 relates to Category No.: 926, 3303, 9226, 954, 5308, 305, 3385, 11861, 15494; Payload ID: 3004 relates to Category No.: 926, 2405, 4965, 5308, 305, 11861, 14234; Payload ID: 3005 relates to Category No.: 926, 3303, 2405, 9539, 6900, 5105, 5308, 305, 3385, 1153, 11861, 3325, 840; Payload ID: 3006 relates to Category No.: 926, 3303, 4965, 5308, 305, 11861; Payload ID: 3007 relates to Category No.: 6900, 1630, 15495, 11861, 5096; Payload ID: 3008 relates to Category No.: 1630, 11861, 6900; Payload ID: 3009 relates to Category No.: 6900, 1630, 5096; Payload ID: 3010 relates to Category No.: 6900, 1630, 5096; Payload ID: 3011 relates to Category No.: 1630, 5096; Payload ID: 3012 relates to Category No.: 1630, 5096; Payload ID: 3013 relates to Category No.: 11861; Payload ID: 3014 relates to Category No.: 5259, 11861; Payload ID: 3017 relates to Category No.: 11861; Payload ID: 3019 relates to Category No.: 11861; Payload ID: 3020 relates to Category No.: 11861; Payload ID: 3023 relates to Category No.: 11861, 7192; Payload ID: 3025 relates to Category No.: 7192; Payload ID: 3027 relates to Category No.: 10116; Payload ID: 3035 relates to Category No.: 11861; Payload ID: 3036 relates to Category No.: 11861; Payload ID: 3039 relates to Category No.: 11861; Payload ID: 3042 relates to Category No.: 10116; Payload ID: 3043 relates to Category No.: 11861; Payload ID: 3045 relates to Category No.: 11861; Payload ID: 3047 relates to Category No.: 1201; Payload ID: 3051 relates to Category No.: 10116, 11861; Payload ID: 3052 relates to Category No.: 9518; Payload ID: 3053 relates to Category No.: 11861; Payload ID: 3054 relates to Category No.: 10116; Payload ID: 3060 relates to Category No.: 15029, 7192; Payload ID: 3063 relates to Category No.: 11861; Payload ID: 3068 relates to Category No.: 11861; Payload ID: 3070 relates to Category No.: 11861; Payload ID: 3075 relates to Category No.: 926, 14597, 3325, 11828, 152; Payload ID: 3076 relates to Category No.: 11861; Payload ID: 3078 relates to Category No.: 11861; Payload ID: 3080 relates to Category No.: 11861; Payload ID: 3083 relates to Category No.: 1201; Payload ID: 3085 relates to Category No.: 5347; Payload ID: 3087 relates to Category No.: 2874; Payload ID: 3088 relates to Category No.: 7192; Payload ID: 3092 relates to Category No.: 11861; Payload ID: 3093 relates to Category No.: 10116; Payload ID: 3097 relates to Category No.: 11861; Payload ID: 3100 relates to Category No.: 16331, 11861, 5308, 311; Payload ID: 3101 relates to Category No.: 11861; Payload ID: 3102 relates to Category No.: 7192; Payload ID: 3104 relates to Category No.: 11861; Payload ID: 3105 relates to Category No.: 10116, 11861; Payload ID: 3108 relates to Category No.: 12142, 5280; Payload ID: 3114 relates to Category No.: 11861; Payload ID: 3121 relates to Category No.: 7192; Payload ID: 3124 relates to Category No.: 11861; Payload ID: 3128 relates to Category No.: 11861; Payload ID: 3129 relates to Category No.: 11861; Payload ID: 3134 relates to Category No.: 14176, 631, 15596, 15596, 2550; Payload ID: 3140 relates to Category No.: 926, 12267, 4009; Payload ID: 3141 relates to Category No.: 7192; Payload ID: 3145 relates to Category No.: 11861, 7192; Payload ID: 3146 relates to Category No.: 14196, 10116, 11861, 14232, 5347; Payload ID: 3147 relates to Category No.: 5865, 9518, 315, 16283, 83, 679, 11861, 5118, 5117; Payload ID: 3151 relates to Category No.: 7192; Payload ID: 3154 relates to Category No.: 7192; Payload ID: 3155 relates to Category No.: 2491; Payload ID: 3157 relates to Category No.: 10116, 11861; Payload ID: 3163 relates to Category No.: 10116; Payload ID: 3168 relates to Category No.: 4894, 4901; Payload ID: 3171 relates to Category No.: 11861; Payload ID: 3176 relates to Category No.: 11861; Payload ID: 3177 relates to Category No.:

11861; Payload ID: 3178 relates to Category No.: 11861; Payload ID: 3180 relates to Category No.: 11861; Payload ID: 3181 relates to Category No.: 11861; Payload ID: 3184 relates to Category No.: 11861; Payload ID: 3185 relates to Category No.: 11939; Payload ID: 3196 relates to Category No.: 3303; Payload ID: 3201 relates to Category No.: 11861; Payload ID: 3203 relates to Category No.: 11861; Payload ID: 3205 relates to Category No.: 7192; Payload ID: 3207 relates to Category No.: 7192; Payload ID: 3209 relates to Category No.: 11861; Payload ID: 3210 relates to Category No.: 11861; Payload ID: 3214 relates to Category No.: 6188, 11861; Payload ID: 3215 relates to Category No.: 14564; Payload ID: 3216 relates to Category No.: 11973; Payload ID: 3219 relates to Category No.: 11861; Payload ID: 3221 relates to Category No.: 7192; Payload ID: 3223 relates to Category No.: 11861; Payload ID: 3225 relates to Category No.: 11978; Payload ID: 3226 relates to Category No.: 11861; Payload ID: 3228 relates to Category No.: 11861; Payload ID: 3230 relates to Category No.: 11861; Payload ID: 3235 relates to Category No.: 11861, 7192; Payload ID: 3236 relates to Category No.: 11861; Payload ID: 3237 relates to Category No.: 11861; Payload ID: 3239 relates to Category No.: 15893, 11861, 16331; Payload ID: 3242 relates to Category No.: 11861; Payload ID: 3243 relates to Category No.: 5259, 11861; Payload ID: 3246 relates to Category No.: 10116; Payload ID: 3249 relates to Category No.: 11861; Payload ID: 3250 relates to Category No.: 5957, 11861; Payload ID: 3252 relates to Category No.: 7192; Payload ID: 3253 relates to Category No.: 11861; Payload ID: 3255 relates to Category No.: 11861; Payload ID: 3262 relates to Category No.: 11861; Payload ID: 3270 relates to Category No.: 15350; Payload ID: 3271 relates to Category No.: 11975, 11861; Payload ID: 3275 relates to Category No.: 1160; Payload ID: 3277 relates to Category No.: 11861; Payload ID: 3280 relates to Category No.: 7192; Payload ID: 3281 relates to Category No.: 7192; Payload ID: 3285 relates to Category No.: 11861, 7192; Payload ID: 3289 relates to Category No.: 7192; Payload ID: 3292 relates to Category No.: 11861, 7192; Payload ID: 3293 relates to Category No.: 11861; Payload ID: 3295 relates to Category No.: 11861; Payload ID: 3308 relates to Category No.: 11861; Payload ID: 3310 relates to Category No.: 11861; Payload ID: 3316 relates to Category No.: 11861; Payload ID: 3318 relates to Category No.: 11861; Payload ID: 3322 relates to Category No.: 11861; Payload ID: 3325 relates to Category No.: 11861; Payload ID: 3332 relates to Category No.: 11861; Payload ID: 3334 relates to Category No.: 11861; Payload ID: 3337 relates to Category No.: 11861; Payload ID: 3338 relates to Category No.: 7192; Payload ID: 3339 relates to Category No.: 7192; Payload ID: 3349 relates to Category No.: 11861, 15887, 7192; Payload ID: 3355 relates to Category No.: 7192; Payload ID: 3356 relates to Category No.: 7192; Payload ID: 3362 relates to Category No.: 11861; Payload ID: 3364 relates to Category No.: 5009; Payload ID: 3369 relates to Category No.: 7192; Payload ID: 3371 relates to Category No.: 11861; Payload ID: 3373 relates to Category No.: 11861; Payload ID: 3377 relates to Category No.: 11861; Payload ID: 3378 relates to Category No.: 10116, 11861; Payload ID: 3381 relates to Category No.: 14298; Payload ID: 3384 relates to Category No.: 7192; Payload ID: 3388 relates to Category No.: 11861; Payload ID: 3391 relates to Category No.: 11861, 9122; Payload ID: 3394 relates to Category No.: 11861; Payload ID: 3397 relates to Category No.: 11861; Payload ID: 3403 relates to Category No.: 6924, 10116; Payload ID: 3404 relates to Category No.: 11861; Payload ID: 3408 relates to Category No.: 11939, 11861; Payload ID: 3411 relates to Category No.: 11861, 7192; Payload ID: 3414 relates to Category No.: 11861, 598; Payload ID: 3415 relates to Category No.: 16331, 637, 6829, 9629, 6821, 3821, 1201; Payload ID: 3417 relates to Category No.: 11861; Payload ID: 3421 relates to Category No.: 7192; Payload ID: 3423 relates to Category No.: 4886, 11861; Payload ID: 3424 relates to Category No.: 12359, 11861; Payload ID: 3428 relates to Category No.: 11861, 1439; Payload ID: 3429 relates to Category No.: 7192; Payload ID: 3431 relates to Category No.: 9226, 6816, 11861; Payload ID: 3432 relates to Category No.: 926, 3303; Payload ID: 3433 relates to Category No.: 3303; Payload ID: 3438 relates to Category No.: 11861; Payload ID: 3443 relates to Category No.: 10116, 11861; Payload ID: 3450 relates to Category No.: 16331, 11924, 1630; Payload ID: 3451 relates to Category No.: 16331; Payload ID: 3452 relates to Category No.: 14503, 14506, 9629; Payload ID: 3453 relates to Category No.: 14503, 9619, 11861; Payload ID: 3454 relates to Category No.: 14503, 9619; Payload ID: 3455 relates to Category No.: 6816, 14503; Payload ID: 3456 relates to Category No.: 14503, 14492; Payload ID: 3457 relates to Category No.: 14503; Payload ID: 3458 relates to Category No.: 14503; Payload ID: 3459 relates to Category No.: 14503, 9619; Payload ID: 3460 relates to Category No.: 14503; Payload ID: 3461 relates to Category No.: 14503; Payload ID: 3464 relates to Category No.: 11861; Payload ID: 3467 relates to Category No.: 10116; Payload ID: 3468 relates to Category No.: 11861; Payload ID: 3469 relates to Category No.: 1457; Payload ID: 3470 relates to Category No.: 11861; Payload ID: 3471 relates to Category No.: 11861; Payload ID: 3472 relates to Category No.: 11861; Payload ID: 3474 relates to Category No.: 9619; Payload ID: 3475 relates to Category No.: 11861; Payload ID: 3476 relates to Category No.: 11861; Payload ID: 3477 relates to Category No.: 11861, 7192; Payload ID: 3478 relates to Category No.: 11861; Payload ID: 3479 relates to Category No.: 11861; Payload ID: 3481 relates to Category No.: 1201; Payload ID: 3482 relates to Category No.: 11861, 7192; Payload ID: 3485 relates to Category No.: 11861; Payload ID: 3489 relates to Category No.: 4864, 11861, 5708, 2449; Payload ID: 3490 relates to Category No.: 2881, 12402, 11861, 2875, 2448; Payload ID: 3491 relates to Category No.: 15029, 5960, 11861, 267; Payload ID: 3493 relates to Category No.: 1457, 11861; Payload ID: 3494 relates to Category No.: 7249, 267, 11861, 6965; Payload ID: 3495 relates to Category No.: 7249; Payload ID: 3496 relates to Category No.: 11861, 2691, 3530; Payload ID: 3497 relates to Category No.: 11861, 10116; Payload ID: 3498 relates to Category No.: 6478, 1630, 6519; Payload ID: 3499 relates to Category No.: 2479, 15542, 15548, 386, 10116; Payload ID: 3500 relates to Category No.: 11978, 926, 6816, 12109, 11861, 14537, 9608, 14377; Payload ID: 3502 relates to Category No.: 2874; Payload ID: 3503 relates to Category No.: 2874; Payload ID: 3504 relates to Category No.: 2874, 11861; Payload ID: 3505 relates to Category No.: 2874; Payload ID: 3506 relates to Category No.: 2874, 11861; Payload ID: 3507 relates to Category No.: 2874; Payload ID: 3508 relates to Category No.: 2874; Payload ID: 3509 relates to Category No.: 2874; Payload ID: 3513 relates to Category No.: 3303, 11861, 669; Payload ID: 3514 relates to Category No.: 926, 11861, 4886, 11895, 5956, 15524, 15491, 15542, 15548, 11886, 327; Payload ID: 3515 relates to Category No.: 11861, 1201; Payload ID: 3516 relates to Category No.: 6210, 2491, 11861; Payload ID: 3517 relates to Category No.: 15029, 11981, 3464, 10116, 2500, 11861, 1201; Payload ID: 3518 relates to Category No.: 14564, 15029, 11861, 1201; Payload ID: 3519 relates to Category No.: 15029, 11861, 7192, 2499, 9629; Payload ID: 3520 relates to Category No.: 15029, 11861, 2499, 9629; Payload ID: 3521 relates to Category No.: 15029, 11861, 5347, 16206; Payload ID: 3522 relates to Category No.: 15029, 5347; Payload ID: 3523 relates to Category No.: 15029, 5347, 11861; Payload ID: 3524 relates to Category No.: 15029, 5347; Payload ID: 3525 relates to Category No.: 15029, 5347, 11861; Payload ID: 3526 relates to Category No.: 15029, 5347; Payload ID: 3527 relates to Category No.: 15029, 11861, 5347, 6481; Payload ID: 3528 relates to Category No.: 15029, 5347; Payload ID: 3529 relates to Category No.: 15029, 5347; Payload ID: 3530 relates to Category No.: 15029, 5347; Payload ID: 3531 relates to Category No.: 15029, 11861, 5347; Payload ID: 3532 relates to Category No.: 15029, 5347; Payload ID: 3533 relates to Category No.: 15029, 5347; Payload ID: 3534 relates to Category No.: 15029, 5347; Payload ID: 3535 relates to Category No.: 15029; Payload ID: 3536 relates to Category No.: 15029; Payload ID: 3537 relates to Category No.: 15029, 15617, 11861, 5347; Payload ID: 3538 relates to Category No.: 15029; Payload ID: 3539 relates to Category No.: 15029, 15617, 5347, 11861; Payload ID: 3540 relates to Category No.: 15029, 11861, 5347; Payload ID: 3541 relates to Category No.: 15029, 5347, 11861; Payload ID: 3542 relates to Category No.: 15029, 11861, 5347, 1706; Payload ID: 3543 relates to Category No.: 15029, 11861, 5347; Payload ID: 3544 relates to Category No.: 15029, 5347; Payload ID: 3547 relates to Category No.: 9880, 15629; Payload ID: 3548 relates to Category No.: 15629, 9880; Payload ID: 3549 relates to Category No.: 926, 4886, 958, 959, 10133; Payload ID: 3550 relates to Category No.: 9226, 11861, 3752, 7264; Payload ID: 3551 relates to Category No.: 14196, 11861; Payload ID: 3552 relates to Category No.: 6816, 14196, 3688, 11861, 154; Payload ID: 3553 relates to Category No.: 5308, 11861; Payload ID: 3554 relates to Category No.: 16331, 9226, 6816, 10116, 11861; Payload ID: 3555 relates to Category No.: 6816, 14196; Payload ID: 3556 relates to Category No.: 9282, 9226, 14196, 10116, 7268, 11861; Payload ID: 3557 relates to Category No.: 9282, 9226, 10116, 11861; Payload ID: 3558 relates to Category No.: 11861, 14196, 10116; Payload ID: 3559 relates to Category No.: 9282, 9226, 14196, 10116, 11861; Payload ID: 3560 relates to Category No.: 9282, 9226, 10116, 11861, 14196; Payload ID: 3561 relates to Category No.: 7268, 14196, 10116, 11861; Payload ID: 3562 relates to Category No.: 11861; Payload ID: 3564 relates to Category No.: 3303, 15503, 14471, 14234, 14471, 11917, 15503, 14233, 11861, 5096, 2688, 3530, 15528, 14252, 2406, 2691; Payload ID: 3565 relates to Category No.: 11861; Payload ID: 3566 relates to Category No.: 926, 942, 11861, 7192; Payload ID: 3568 relates to Category No.: 7268; Payload ID: 3569 relates to Category No.: 15895, 11861, 2271, 7017, 12064; Payload ID: 3570 relates to Category No.: 11861; Payload ID: 3572 relates to Category No.: 11861; Payload ID: 3573 relates to Category No.: 10116; Payload ID: 3574 relates to Category No.: 11861, 7192; Payload ID: 3577 relates to Category No.: 11861; Payload ID: 3578 relates to Category No.: 5308, 6816, 6829, 3275, 1538, 15676, 9619; Payload ID: 3579 relates to Category No.: 11861; Payload ID: 3580 relates to Category No.: 926, 1630, 11861, 3099, 9565; Payload ID: 3581 relates to Category No.: 15524, 15491, 6924, 1153, 5227, 12162, 11861, 12054, 6185, 12161, 6427, 5204, 5211, 11939; Payload ID: 3582 relates to Category No.: 267, 11861, 3752; Payload ID: 3583 relates to Category No.: 1405, 4864, 14503, 12402, 11861, 15382, 9619; Payload ID: 3584 relates to Category No.: 4820, 12402, 11861, 15378, 4806, 4804; Payload ID: 3585 relates to Category No.: 4820, 15378, 12402, 12399, 11861, 4806, 4804; Payload ID: 3586 relates to Category No.: 9868, 4820, 11861, 15378; Payload ID: 3587 relates to Category No.: 4820, 15378; Payload ID: 3588 relates to Category No.: 2881, 9939, 11861, 11828; Payload ID: 3589 relates to Category No.: 1405, 14503, 3663, 11861, 9619; Payload ID: 3590 relates to Category No.: 2672, 11861; Payload ID: 3591 relates to Category No.: 1405, 14503, 14506, 11861, 4710, 3663, 12402; Payload ID: 3592 relates to Category No.: 9518, 2672, 11861; Payload ID: 3593 relates to Category No.: 7192; Payload ID: 3594 relates to Category No.: 7192; Payload ID: 3595 relates to Category No.: 7192; Payload ID: 3596 relates to Category No.: 1405, 14503, 11861, 9939; Payload ID: 3597 relates to Category No.: 14503, 5009, 11861, 14501; Payload ID: 3598 relates to Category No.: 1405, 14503, 11861, 7017, 9619; Payload ID: 3599 relates to Category No.: 6816, 12173; Payload ID: 3601 relates to Category No.: 15029, 5259, 11861; Payload ID: 3602 relates to Category No.: 15029, 11861, 1201; Payload ID: 3603 relates to Category No.: 15029, 11861; Payload ID: 3604 relates to Category No.: 15029, 11861; Payload ID: 3605 relates to Category No.: 15029, 11861, 1201; Payload ID: 3606 relates to Category No.: 15029, 1201; Payload ID: 3609 relates to Category No.: 926; Payload ID: 3610 relates to Category No.: 926; Payload ID: 3611 relates to Category No.: 926; Payload ID: 3612 relates to Category No.: 926; Payload ID: 3613 relates to Category No.: 926; Payload ID: 3614 relates to Category No.: 11861, 2566; Payload ID: 3615 relates to Category No.: 11861; Payload ID: 3618 relates to Category No.: 11711, 144, 145; Payload ID: 3619 relates to Category No.: 9367, 86, 5042, 103; Payload ID: 3621 relates to Category No.: 14351, 6924; Payload ID: 3622 relates to Category No.: 4207, 7223, 4075, 9518, 315, 16283, 7486, 680; Payload ID: 3623 relates to Category No.: 6816, 2405, 7223, 11861; Payload ID: 3624 relates to Category No.: 11939, 6210, 11861; Payload ID: 3625 relates to Category No.: 267, 11861; Payload ID: 3626 relates to Category No.: 267, 11861; Payload ID: 3627 relates to Category No.: 11861; Payload ID: 3628 relates to Category No.: 14564, 14251, 14471, 11861, 15530, 14233, 14234; Payload ID: 3629 relates to Category No.: 14251, 14471, 11861, 15530, 14233, 14234; Payload ID: 3630 relates to Category No.: 11861; Payload ID: 3632 relates to Category No.: 7249; Payload ID: 3633 relates to Category No.: 11861; Payload ID: 3634 relates to Category No.: 11939, 11861; Payload ID: 3636 relates to Category No.: 11861; Payload ID: 3638 relates to Category No.: 10116, 11861; Payload ID: 3639 relates to Category No.: 1403, 11861; Payload ID: 3640 relates to Category No.: 11861; Payload ID: 3641 relates to Category No.: 11861; Payload ID: 3642 relates to Category No.: 11861; Payload ID: 3643 relates to Category No.: 11861; Payload ID: 3645 relates to Category No.: 11861; Payload ID: 3646 relates to Category No.: 11861; Payload ID: 3647 relates to Category No.: 11861; Payload ID: 3648 relates to Category No.: 11861; Payload ID: 3649 relates to Category No.: 11861; Payload ID: 3651 relates to Category No.: 10116; Payload ID: 3653 relates to Category No.: 555; Payload ID: 3655 relates to Category No.: 12402; Payload ID: 3656 relates to Category No.: 11861; Payload ID: 3657 relates to Category No.: 11861; Payload ID: 3659 relates to Category No.: 11861; Payload ID: 3660 relates to Category No.: 10116; Payload ID: 3662 relates to Category No.: 11861; Payload ID: 3664 relates to Category No.: 11861; Payload ID: 3668 relates to Category No.: 11861; Payload ID: 3669 relates to Category No.: 11861; Payload ID: 3672 relates to Category No.: 11861; Payload ID: 3673 relates to Category No.: 11861; Payload ID: 3675 relates to Category No.: 11861; Payload ID: 3677 relates to Category No.: 11861, 5347, 3510; Payload ID: 3687 relates to Category No.: 11861; Payload ID: 3688 relates to Category No.: 11861; Payload ID: 3690 relates to Category No.: 11861; Payload ID: 3700 relates to Category No.: 7192; Payload ID: 3702 relates to Category No.: 11861; Payload ID: 3703 relates to Category No.: 11861; Payload ID: 3705 relates to Category No.: 6965; Payload ID: 3710 relates to Category No.: 11861, 2793; Payload ID: 3711 relates to Category No.: 11861; Payload ID: 3712 relates to Category No.: 11861; Payload ID: 3714 relates to Category No.: 11861; Payload ID: 3715 relates to Category No.: 11861; Payload ID: 3718 relates to Category No.: 11861; Payload ID: 3720 relates to Category No.: 11861; Payload ID: 3723 relates to Category No.: 7192; Payload ID: 3724 relates to Category No.: 11861; Payload ID: 3725 relates to Category No.: 11861; Payload ID: 3726 relates to Category No.: 1405, 10116, 11861; Payload ID: 3727 relates to Category No.: 15895, 11861; Payload ID: 3729 relates to Category No.: 11861; Payload ID: 3731 relates to Category No.: 11861; Payload ID: 3733 relates to Category No.: 10116, 11861; Payload ID: 3734 relates to Category No.: 15021, 11861, 14537; Payload ID: 3735 relates to Category No.: 11861; Payload ID: 3737 relates to Category No.: 3936, 6185; Payload ID: 3739 relates to Category No.: 12359, 3505, 11861; Payload ID: 3740 relates to Category No.: 11861, 12359; Payload ID: 3743 relates to Category No.: 11861; Payload ID: 3744 relates to Category No.: 11861; Payload ID: 3747 relates to Category No.: 11861; Payload ID: 3755 relates to Category No.: 3303, 1201; Payload ID: 3757 relates to Category No.: 4720, 5009, 4196; Payload ID: 3763 relates to Category No.: 11861; Payload ID: 3765 relates to Category No.: 10116, 11861; Payload ID: 3766 relates to Category No.: 6965, 11861; Payload ID: 3767 relates to Category No.: 267, 11939, 6965, 9857, 11979, 11861; Payload ID: 3769 relates to Category No.: 9608, 12107, 11861; Payload ID: 3770 relates to Category No.: 11861; Payload ID: 3771 relates to Category No.: 10116; Payload ID: 3773 relates to Category No.: 5347; Payload ID: 3774 relates to Category No.: 11861; Payload ID: 3775 relates to Category No.: 11861; Payload ID: 3776 relates to Category No.: 11861; Payload ID: 3780 relates to Category No.: 11861; Payload ID: 3783 relates to Category No.: 6965; Payload ID: 3784 relates to Category No.: 10116, 11861; Payload ID: 3785 relates to Category No.: 7192; Payload ID: 3786 relates to Category No.: 14471, 15504, 11861; Payload ID: 3787 relates to Category No.: 11890, 15530, 14255, 11861, 9805; Payload ID: 3788 relates to Category No.: 11919, 11861; Payload ID: 3790 relates to Category No.: 11861; Payload ID: 3792 relates to Category No.: 11895, 11861, 5347, 3293; Payload ID: 3793 relates to Category No.: 9282, 9226, 10116, 15598, 11861, 14669, 7265; Payload ID: 3794 relates to Category No.: 3303, 9226, 14196, 11861, 15504; Payload ID: 3795 relates to Category No.: 3303, 9226, 10116, 11861; Payload ID: 3796 relates to Category No.: 3749; Payload ID: 3797 relates to Category No.: 3749; Payload ID: 3798 relates to Category No.: 3749; Payload ID: 3799 relates to Category No.: 1405, 11861, 11828, 2566; Payload ID: 3800 relates to Category No.: 11746; Payload ID: 3801 relates to Category No.: 11861, 11746; Payload ID: 3802 relates to Category No.: 11861, 4291, 16293; Payload ID: 3803 relates to Category No.: 6816, 4023, 11861, 5347, 10091; Payload ID: 3804 relates to Category No.: 6816, 4023, 11861, 1327, 11861, 5347, 10091, 14652; Payload ID: 3805 relates to Category No.: 6816, 4023, 11861, 5347, 10091, 4024; Payload ID: 3806 relates to Category No.: 6816, 4023, 5588, 11861, 10091, 14652; Payload ID: 3807 relates to Category No.: 4023, 11861, 10091, 4018; Payload ID: 3808 relates to Category No.: 4023, 11861; Payload ID: 3809 relates to Category No.: 15029, 4023, 5588, 11861, 6826; Payload ID: 3810 relates to Category No.: 6210, 11978, 11861, 9888, 2205, 2213, 5956; Payload ID: 3811 relates to Category No.: 4023; Payload ID: 3812 relates to Category No.: 4023; Payload ID: 3813 relates to Category No.: 4023, 15029; Payload ID: 3814 relates to Category No.: 6816, 4024; Payload ID: 3815 relates to Category No.: 4024; Payload ID: 3816 relates to Category No.: 4024; Payload ID: 3817 relates to Category No.: 6816, 4023, 5588, 5009, 12189, 10091, 11861; Payload ID: 3818 relates to Category No.: 6816, 4023, 11861, 7192, 14652; Payload ID: 3819 relates to Category No.: 4023, 2566, 5009, 12189; Payload ID: 3820 relates to Category No.: 10091; Payload ID: 3821 relates to Category No.: 11861; Payload ID: 3822 relates to Category No.: 14504, 11861; Payload ID: 3823 relates to Category No.: 11861; Payload ID: 3825 relates to Category No.: 14504, 11861, 5347; Payload ID: 3826 relates to Category No.: 11861; Payload ID: 3827 relates to Category No.: 4023, 11861, 1327, 11861; Payload ID: 3828 relates to Category No.: 6816, 11861; Payload ID: 3829 relates to Category No.: 6816, 4023, 11861, 1327, 4016; Payload ID: 3830 relates to Category No.: 4023; Payload ID: 3831 relates to Category No.: 11861, 4024; Payload ID: 3832 relates to Category No.: 5009, 11861; Payload ID: 3833 relates to Category No.: 11861, 4023, 11861, 1327, 10116, 2566; Payload ID: 3834 relates to Category No.: 4023, 11861, 1327; Payload ID: 3835 relates to Category No.: 15029, 4023; Payload ID: 3836 relates to Category No.: 5588, 11861; Payload ID: 3837 relates to Category No.: 11861; Payload ID: 3838 relates to Category No.: 6816, 15029, 11861, 5347; Payload ID: 3839 relates to Category No.: 11861; Payload ID: 3842 relates to Category No.: 11861; Payload ID: 3843 relates to Category No.: 4023, 11861; Payload ID: 3844 relates to Category No.: 5009, 1146; Payload ID: 3845 relates to Category No.: 11861; Payload ID: 3846 relates to Category No.: 6816, 4023; Payload ID: 3847 relates to Category No.: 14504; Payload ID: 3848 relates to Category No.: 11861; Payload ID: 3849 relates to Category No.: 5308, 11861, 5308, 307; Payload ID: 3850 relates to Category No.: 6583; Payload ID: 3851 relates to Category No.: 6583; Payload ID: 3852 relates to Category No.: 6816, 14379, 4351, 14581, 6334; Payload ID: 3853 relates to Category No.: 4864, 2874, 11939, 11861, 6464; Payload ID: 3854 relates to Category No.: 11978, 926, 15612, 11861, 2875, 11939, 12145, 6463, 12081; Payload ID: 3855 relates to Category No.: 4864, 11861, 4846, 2874; Payload ID: 3856 relates to Category No.: 2881, 12399, 11861, 4841, 4840; Payload ID: 3857 relates to Category No.: 2881, 12399, 11861, 5688, 5700; Payload ID: 3858 relates to Category No.: 2874, 5708, 3752, 4842, 4864; Payload ID: 3859 relates to Category No.: 2881, 12399, 11861; Payload ID: 3861 relates to Category No.: 11861; Payload ID: 3862 relates to Category No.: 11861; Payload ID: 3863 relates to Category No.: 11861; Payload ID: 3864 relates to Category No.: 11861; Payload ID: 3865 relates to Category No.: 11861; Payload ID: 3866 relates to Category No.: 11861, 9014; Payload ID: 3867 relates to Category No.: 11861, 9014; Payload ID: 3868 relates to Category No.: 11861; Payload ID: 3869 relates to Category No.: 11861; Payload ID: 3870 relates to Category No.: 16331, 6816, 11861; Payload ID: 3871 relates to Category No.: 2618, 16206, 2616, 2619, 2617; Payload ID: 3873 relates to Category No.: 3303, 11939, 15617, 2611, 16206, 2623, 11861, 12399; Payload ID: 3874 relates to Category No.: 15504, 15495, 5293, 7268, 11861, 2613, 5969, 474, 7099, 11983; Payload ID: 3875 relates to Category No.: 11861; Payload ID: 3876 relates to Category No.: 11861, 11939; Payload ID: 3877 relates to Category No.: 11861; Payload ID: 3878 relates to Category No.: 11861, 7192; Payload ID: 3879 relates to Category No.: 11861, 5347; Payload ID: 3880 relates to Category No.: 11861; Payload ID: 3881 relates to Category No.: 11861, 5347; Payload ID: 3882 relates to Category No.: 1405, 14503, 14506, 11861; Payload ID: 3883 relates to Category No.: 14503; Payload ID: 3884 relates to Category No.: 1405, 14503, 11861, 5347; Payload ID: 3885 relates to Category No.: 14503, 6816, 11861; Payload ID: 3886 relates to Category No.: 12402, 11861, 3665, 1363, 6210, 2559; Payload ID: 3887 relates to Category No.: 9868, 4820, 2615, 2614, 1357; Payload ID: 3888 relates to Category No.: 10116, 11861; Payload ID: 3889 relates to Category No.: 11861; Payload ID: 3890 relates to Category No.: 11861, 3665, 2613; Payload ID: 3891 relates to Category No.: 1504, 11861, 3665, 2611; Payload ID: 3892 relates to Category No.: 1504, 11861, 3665, 2611; Payload ID: 3893 relates to Category No.: 2293, 12402, 11861, 3665; Payload ID: 3894 relates to Category No.: 4820, 2621, 1362, 2620; Payload ID: 3895 relates to Category No.: 4820, 11861, 1362; Payload ID: 3896 relates to Category No.: 11861; Payload ID: 3897 relates to Category No.: 11861; Payload ID: 3898 relates to Category No.: 11861, 11886, 2611; Payload ID: 3899 relates to Category No.: 11861, 11886; Payload ID: 3900 relates to Category No.: 14088, 11886, 2611; Payload ID: 3901 relates to Category No.: 11861; Payload ID: 3902 relates to Category No.: 14503, 2611; Payload ID: 3903 relates to Category No.: 14503, 14506; Payload ID: 3904 relates to Category No.: 5003, 5009, 11861; Payload ID: 3908 relates to Category No.: 6229; Payload ID: 3911 relates to Category No.: 14503, 14379, 11861, 6816; Payload ID: 3913 relates to Category No.: 15180, 8980, 14706, 15181; Payload ID: 3914 relates to Category No.: 15180, 14706, 15181, 1439; Payload ID: 3915 relates to Category No.: 15180, 14706, 8980; Payload ID: 3916 relates to Category No.: 15180, 14706; Payload ID: 3917 relates to Category No.: 11861; Payload ID: 3918 relates to Category No.: 12142, 11861, 11886; Payload ID: 3919 relates to Category No.: 12142, 11861; Payload ID: 3920 relates to Category No.: 11861; Payload ID: 3921 relates to Category No.: 11861, 7192; Payload ID: 3923 relates to Category No.: 11861; Payload ID: 3924 relates to Category No.: 11861; Payload ID: 3925 relates to Category No.: 3303, 15503, 14471, 14234, 14471, 11861, 15528, 14233, 9173, 6127, 14243, 2405; Payload ID: 3926 relates to Category No.: 11895, 5588, 5547, 5009, 11861, 4864, 4196; Payload ID: 3927 relates to Category No.: 11861, 1327, 11861, 5956; Payload ID: 3928 relates to Category No.: 11861, 5347; Payload ID: 3929 relates to Category No.: 11978, 926, 11939, 11933, 11861, 14377, 5357; Payload ID: 3930 relates to Category No.: 11861, 9805, 2643; Payload ID: 3931 relates to Category No.: 11861, 4710, 1504; Payload ID: 3932 relates to Category No.: 11861, 5347, 4710, 1504, 12107; Payload ID: 3933 relates to Category No.: 11861; Payload ID: 3934 relates to Category No.: 11861; Payload ID: 3935 relates to Category No.: 11861; Payload ID: 3936 relates to Category No.: 11861; Payload ID: 3937 relates to Category No.: 12399, 11861, 14537, 14538; Payload ID: 3938 relates to Category No.: 11861, 3752; Payload ID: 3939 relates to Category No.: 11861; Payload ID: 3940 relates to Category No.: 11861; Payload ID: 3941 relates to Category No.: 11861; Payload ID: 3942 relates to Category No.: 11861; Payload ID: 3943 relates to Category No.: 5105, 11861; Payload ID: 3944 relates to Category No.: 11861, 14564, 15495; Payload ID: 3945 relates to Category No.: 11861; Payload ID: 3946 relates to Category No.: 11861, 7552; Payload ID: 3947 relates to Category No.: 6816, 15911, 6829, 15491, 15592, 11861; Payload ID: 3948 relates to Category No.: 11861; Payload ID: 3949 relates to Category No.: 11861; Payload ID: 3950 relates to Category No.: 11861; Payload ID: 3951 relates to Category No.: 11861; Payload ID: 3952 relates to Category No.: 11861; Payload ID: 3953 relates to Category No.: 1405, 15629, 11939, 1438, 3663, 11861, 9014, 9896; Payload ID: 3954 relates to Category No.: 11861; Payload ID: 3955 relates to Category No.: 15629, 1438, 12109, 10116, 11861, 1439, 12425; Payload ID: 3956 relates to Category No.: 11861; Payload ID: 3957 relates to Category No.: 11861, 7192; Payload ID: 3958 relates to Category No.: 1405, 15629, 11861, 9896; Payload ID: 3959 relates to Category No.: 15629, 11861; Payload ID: 3960 relates to Category No.: 11861, 7192; Payload ID: 3961 relates to Category No.: 16331, 6816, 11919, 2672, 11861, 15111, 15112, 2678; Payload ID: 3962 relates to Category No.: 11939, 2672, 11861, 5347, 9880, 9887, 9874, 9877, 9818; Payload ID: 3963 relates to Category No.: 2684, 11939, 15023, 5347; Payload ID: 3964 relates to Category No.: 267, 295, 11861; Payload ID: 3965 relates to Category No.: 267, 295; Payload ID: 3966 relates to Category No.: 4719, 6816, 15542, 15553, 11861; Payload ID: 3967 relates to Category No.: 15491, 15503, 14471, 11861, 3303; Payload ID: 3968 relates to Category No.: 6816, 15503, 14471, 15495, 11861; Payload ID: 3969 relates to Category No.: 6816, 15503, 14471, 15495, 11861, 2405; Payload ID: 3970 relates to Category No.: 15503, 14471, 15495, 11861, 15503, 14239; Payload ID: 3971 relates to Category No.: 14503, 11861; Payload ID: 3972 relates to Category No.: 11939; Payload ID: 3974 relates to Category No.: 11861; Payload ID: 3975 relates to Category No.: 2269; Payload ID: 3976 relates to Category No.: 1676, 11861; Payload ID: 3978 relates to Category No.: 1405; Payload ID: 3979 relates to Category No.: 11861; Payload ID: 3980 relates to Category No.: 277, 11861; Payload ID: 3981 relates to Category No.: 267, 11861; Payload ID: 3982 relates to Category No.: 277, 11861, 267, 11939, 11895, 295, 10116, 2936, 9844, 7398, 5347; Payload ID: 3983 relates to Category No.: 11861, 277, 5347, 848; Payload ID: 3984 relates to Category No.: 277, 11861, 12363; Payload ID: 3985 relates to Category No.: 277, 11861; Payload ID: 3986 relates to Category No.: 267, 277, 11861; Payload ID: 3987 relates to Category No.: 11861, 11759; Payload ID: 3988 relates to Category No.: 11861, 14537; Payload ID: 3992 relates to Category No.: 5259, 12402, 11861, 8959, 2731, 2730; Payload ID: 3993 relates to Category No.: 11861, 9629, 2729; Payload ID: 3994 relates to Category No.: 4820, 15617, 11861, 2724; Payload ID: 3995 relates to Category No.: 4820, 15617, 11861, 11886, 9629, 4804, 2732, 2729; Payload ID: 3996 relates to Category No.: 4820, 15617, 11861, 5259, 2724, 9636, 2732; Payload ID: 3997 relates to Category No.: 5259, 4821, 8959; Payload ID: 3998 relates to Category No.: 2873, 11711, 4087, 12196; Payload ID: 3999 relates to Category No.: 3554, 2672, 2873, 11861; Payload ID: 4001 relates to Category No.: 7192; Payload ID: 4002 relates to Category No.: 2672, 11861, 2671; Payload ID: 4003 relates to Category No.: 12142; Payload ID: 4006 relates to Category No.: 12402, 5588, 1153, 11861, 5347, 1706, 9608, 16206, 2643; Payload ID: 4007 relates to Category No.: 9226; Payload ID: 4008 relates to Category No.: 6816; Payload ID: 4016 relates to Category No.: 3303; Payload ID: 4017 relates to Category No.: 7192; Payload ID: 4018 relates to Category No.: 1405, 11861, 6337, 2613, 6334, 2361; Payload ID: 4019 relates to Category No.: 926, 5956, 15895, 15542, 15556, 11861, 2760; Payload ID: 4020 relates to Category No.: 926, 5956, 15542, 15556, 2760; Payload ID: 4021 relates to Category No.: 926, 5956, 15542, 15556, 2760; Payload ID: 4022 relates to Category No.: 926, 5956, 15542, 15556, 2760; Payload ID: 4023 relates to Category No.: 926, 5956, 15542, 15556, 11861, 2760; Payload ID: 4024 relates to Category No.: 16331, 14564, 15503, 14471, 2405, 15504, 9539, 2963, 15491, 2690, 11861, 5096, 15493, 15530, 14233, 15530, 14252, 14252, 246, 14229, 7257, 14246, 14243, 3303, 15528, 14255, 14652, 9763, 327; Payload ID: 4025 relates to Category No.: 11861, 1472; Payload ID: 4026 relates to Category No.: 1472, 11861, 2405; Payload ID: 4027 relates to Category No.: 1472; Payload ID: 4028 relates to Category No.: 3303, 15503, 14471, 14471, 11861, 5347; Payload ID: 4029 relates to Category No.: 15503, 14471, 14471, 11861; Payload ID: 4030 relates to Category No.: 11861, 7192, 9084; Payload ID: 4031 relates to Category No.: 11861; Payload ID: 4032 relates to Category No.: 11861, 14196, 10116; Payload ID: 4033 relates to Category No.: 1405, 11861; Payload ID: 4034 relates to Category No.: 1405, 11861, 3752, 895; Payload ID: 4035 relates to Category No.: 11920, 11861, 14537; Payload ID: 4036 relates to Category No.: 3303, 9282, 3459, 11861, 15887, 9805, 2688, 9173, 15503, 15504, 1251, 15504, 11981, 5109, 5957, 2691; Payload ID: 4037 relates to Category No.: 3303, 2963, 14597, 11861, 4075, 15887, 9805, 15525, 15503, 15504, 1251, 11981, 9173, 5957; Payload ID: 4038 relates to Category No.: 15023, 6816, 15973, 11861, 5347; Payload ID: 4039 relates to Category No.: 15023, 6816, 11939, 15973, 11861, 5347, 6965, 2936; Payload ID: 4040 relates to Category No.: 15023, 11861, 7192, 11939; Payload ID: 4041 relates to Category No.: 15023, 11861, 7192, 11939; Payload ID: 4042 relates to Category No.: 11861, 7192, 15023; Payload ID: 4043 relates to Category No.: 11861, 15023; Payload ID: 4044 relates to Category No.: 15029, 5347, 11939, 15023; Payload ID: 4045 relates to Category No.: 11861; Payload ID: 4046 relates to Category No.: 15023; Payload ID: 4047 relates to Category No.: 15023; Payload ID: 4048 relates to Category No.: 15023, 11861; Payload ID: 4049 relates to Category No.: 15023, 11861; Payload ID: 4051 relates to Category No.: 15023; Payload ID: 4052 relates to Category No.: 11939, 9518, 108, 7490, 6175; Payload ID: 4053 relates to Category No.: 11939, 15403, 15495, 7510, 15359, 5260; Payload ID: 4054 relates to Category No.: 16331, 9518, 7265, 7515, 7520; Payload ID: 4055 relates to Category No.: 16331, 9518, 7510, 7520; Payload ID: 4056 relates to Category No.: 12382, 11861, 9170, 1201; Payload ID: 4057 relates to Category No.: 11978, 926, 6816, 11895, 12402, 9096, 12145, 11861, 5347, 11974, 12081, 11782; Payload ID: 4058 relates to Category No.: 7462, 11861, 5096, 6190; Payload ID: 4061 relates to Category No.: 3749, 11861; Payload ID: 4065 relates to Category No.: 14504; Payload ID: 4068 relates to Category No.: 4207, 15701; Payload ID: 4069 relates to Category No.: 5259; Payload ID: 4072 relates to Category No.: 820; Payload ID: 4075 relates to Category No.: 926, 9282, 14500, 632; Payload ID: 4076 relates to Category No.: 3303; Payload ID: 4078 relates to Category No.: 4924, 11861; Payload ID: 4079 relates to Category No.: 9518, 318, 3292; Payload ID: 4080 relates to Category No.: 9226, 15503, 14471; Payload ID: 4081 relates to Category No.: 15376, 3663; Payload ID: 4083 relates to Category No.: 184; Payload ID: 4085 relates to Category No.: 9226, 15503, 14471; Payload ID: 4087 relates to Category No.: 1153, 11861, 4380; Payload ID: 4088 relates to Category No.: 9962, 3391, 2773, 11861; Payload ID: 4089 relates to Category No.: 6816, 9804, 11861, 2773; Payload ID: 4090 relates to Category No.: 6816, 9804, 11861, 2773; Payload ID: 4091 relates to Category No.: 9804, 9962; Payload ID: 4092 relates to Category No.: 6816, 9804, 7192, 2773; Payload ID: 4093 relates to Category No.: 9804, 12111, 11861; Payload ID: 4094 relates to Category No.: 11861; Payload ID: 4095 relates to Category No.: 9226; Payload ID: 4096 relates to Category No.: 9226, 6816; Payload ID: 4097 relates to Category No.: 11861; Payload ID: 4100 relates to Category No.: 4895, 4886, 5096; Payload ID: 4101 relates to Category No.: 9226; Payload ID: 4102 relates to Category No.: 9226; Payload ID: 4103 relates to Category No.: 9226, 6816; Payload ID: 4104 relates to Category No.: 9226, 6816, 15503, 14471; Payload ID: 4105 relates to Category No.: 1630, 1504, 588, 6592; Payload ID: 4106 relates to Category No.: 1630, 588; Payload ID: 4109 relates to Category No.: 6816, 14107; Payload ID: 4113 relates to Category No.: 9226, 6816; Payload ID: 4115 relates to Category No.: 6816, 3554, 5875, 65; Payload ID: 4116 relates to Category No.: 9226; Payload ID: 4119 relates to Category No.: 6816, 6829, 1538, 9671; Payload ID: 4122 relates to Category No.: 9226, 15503, 14471; Payload ID: 4125 relates to Category No.: 3303, 9282, 15503, 14471, 14471, 14251, 14471; Payload ID: 4126 relates to Category No.: 9226; Payload ID: 4128 relates to Category No.: 6816, 9226; Payload ID: 4133 relates to Category No.: 6229; Payload ID: 4134 relates to Category No.: 9226; Payload ID: 4135 relates to Category No.: 9226; Payload ID: 4136 relates to Category No.: 9226; Payload ID: 4137 relates to Category No.: 516; Payload ID: 4140 relates to Category No.: 3303, 15491, 14248; Payload ID: 4141 relates to Category No.: 11939, 11895, 15504, 9518, 321, 7477, 7472, 11920, 11861, 14249, 13735, 7501, 15503, 14471; Payload ID: 4142 relates to Category No.: 11939, 15495, 9518, 321, 7477, 7472, 11861, 7501, 15491, 2405, 14082; Payload ID: 4143 relates to Category No.: 926, 2781; Payload ID: 4144 relates to Category No.: 926, 11861, 2781; Payload ID: 4145 relates to Category No.: 11861, 14232, 14536; Payload ID: 4146 relates to Category No.: 14597, 11861, 15265, 4854, 15253; Payload ID: 4147 relates to Category No.: 11861, 12077; Payload ID: 4148 relates to Category No.: 15617, 1504; Payload ID: 4149 relates to Category No.: 15617, 1504, 11861; Payload ID: 4150 relates to Category No.: 1504; Payload ID: 4151 relates to Category No.: 4864, 1504; Payload ID: 4152 relates to Category No.: 1504; Payload ID: 4153 relates to Category No.: 1504; Payload ID: 4154 relates to Category No.: 1504; Payload ID: 4155 relates to Category No.: 11861; Payload ID: 4156 relates to Category No.: 6816, 4314, 6583; Payload ID: 4157 relates to Category No.: 11861, 10154; Payload ID: 4158 relates to Category No.: 1504, 11861; Payload ID: 4159 relates to Category No.: 11861, 10154; Payload ID: 4160 relates to Category No.: 1504; Payload ID: 4161 relates to Category No.: 11939, 1504, 11861; Payload ID: 4162 relates to Category No.: 1504; Payload ID: 4163 relates to Category No.: 15617, 1504; Payload ID: 4164 relates to Category No.: 1504; Payload ID: 4165 relates to Category No.: 1504; Payload ID: 4166 relates to Category No.: 1405, 1504, 5009, 5974; Payload ID: 4167 relates to Category No.: 15617, 1504; Payload ID: 4168 relates to Category No.: 1504; Payload ID: 4169 relates to Category No.: 1504, 5386; Payload ID: 4170 relates to Category No.: 1504, 11861, 12399; Payload ID: 4171 relates to Category No.: 1504; Payload ID: 4172 relates to Category No.: 11861, 16206, 10154; Payload ID: 4173 relates to Category No.: 6816, 1504, 12399, 9625, 1439, 6583, 16206, 16204, 5343; Payload ID: 4174 relates to Category No.: 1504, 16206, 11861; Payload ID: 4175 relates to Category No.: 1504, 11861; Payload ID: 4176 relates to Category No.: 6816, 1504, 6946, 11861, 14581; Payload ID: 4177 relates to Category No.: 1504; Payload ID: 4178 relates to Category No.: 1504; Payload ID: 4184 relates to Category No.: 11861; Payload ID: 4186 relates to Category No.: 1405, 15629, 11939, 12399, 11861, 2538; Payload ID: 4187 relates to Category No.: 11861; Payload ID: 4188 relates to Category No.: 11861; Payload ID: 4189 relates to Category No.: 9282, 9226, 14196, 10116, 7268, 11861, 15598, 9226, 1326, 15593; Payload ID: 4190 relates to Category No.: 9282, 9226, 14196, 10116; Payload ID: 4191 relates to Category No.: 9282, 9226, 14196, 7268; Payload ID: 4192 relates to Category No.: 9282, 9226, 15598, 9226, 1326, 7268; Payload ID: 4193 relates to Category No.: 9282, 9226, 14196; Payload ID: 4194 relates to Category No.: 9282, 9226, 14196; Payload ID: 4195 relates to Category No.: 15895, 15893, 11861; Payload ID: 4196 relates to Category No.: 15895, 15893, 11861, 11886; Payload ID: 4197 relates to Category No.: 15908, 15895, 15893, 11861, 11681, 11939, 11933, 2823; Payload ID: 4198 relates to Category No.: 15895, 15893, 11861; Payload ID: 4199 relates to Category No.: 2963, 15895, 15893, 11861; Payload ID: 4200 relates to Category No.: 15895, 15893, 1401, 12399, 11861, 11933; Payload ID: 4201 relates to Category No.: 15895, 11861, 1201; Payload ID: 4202 relates to Category No.: 926, 16331, 15895, 11861, 1201; Payload ID: 4203 relates to Category No.: 11861, 1201, 15239; Payload ID: 4204 relates to Category No.: 11861, 1201, 15239; Payload ID: 4205 relates to Category No.: 11861, 3752; Payload ID: 4207 relates to Category No.: 2672, 11861; Payload ID: 4208 relates to Category No.: 3303, 14471, 14243, 2405, 15528, 14239, 11861, 1327; Payload ID: 4209 relates to Category No.: 3303, 14471, 14243, 15530, 14233, 14234; Payload ID: 4210 relates to Category No.: 14196, 11861; Payload ID: 4211 relates to Category No.: 14196, 11861, 1201; Payload ID: 4213 relates to Category No.: 9706; Payload ID: 4214 relates to Category No.: 1630, 7192; Payload ID: 4215 relates to Category No.: 1630; Payload ID: 4216 relates to Category No.: 6816; Payload ID: 4219 relates to Category No.: 11861; Payload ID: 4220 relates to Category No.: 3303, 16331, 5208, 11861, 15977, 2690; Payload ID: 4221 relates to Category No.: 3303, 16331, 11861, 9608; Payload ID: 4222 relates to Category No.: 3303, 16331, 14564, 14471, 15504, 11861; Payload ID: 4224 relates to Category No.: 1467; Payload ID: 4225 relates to Category No.: 16251, 5840, 11861, 2258, 5765, 5767; Payload ID: 4226 relates to Category No.: 16251, 1457, 5840, 2258, 5765, 5767, 1467; Payload ID: 4227 relates to Category No.: 16251, 5840, 2258, 5765, 5767, 6186, 11861, 5770, 11895; Payload ID: 4228 relates to Category No.: 16251, 2258, 5765, 5767, 5840, 1467, 5770; Payload ID: 4229 relates to Category No.: 16251, 11861, 2258, 5765, 5767, 1467, 6186, 2815; Payload ID: 4230 relates to Category No.: 16251, 5765, 2258, 5767, 11861; Payload ID: 4231 relates to Category No.: 11861; Payload ID: 4232 relates to Category No.: 11861, 11981; Payload ID: 4235 relates to Category No.: 11861; Payload ID: 4236 relates to Category No.: 6481, 14741; Payload ID: 4237 relates to Category No.: 11981, 11861, 9592, 5956, 5193; Payload ID: 4238 relates to Category No.: 16331, 15893, 6188, 11861; Payload ID: 4239 relates to Category No.: 11861; Payload ID: 4240 relates to Category No.: 11861; Payload ID: 4241 relates to Category No.: 11981, 11861, 2834, 15893; Payload ID: 4242 relates to Category No.: 3303, 15503, 14471; Payload ID: 4243 relates to Category No.: 15504, 15495, 5109, 11981, 11861, 3752, 11782, 11978, 5956, 2834, 11886; Payload ID: 4244 relates to Category No.: 11981, 11861; Payload ID: 4245 relates to Category No.: 11981, 11861, 2832; Payload ID: 4246 relates to Category No.: 11861; Payload ID: 4247 relates to Category No.: 15491, 11861, 686, 11981, 5956, 2834, 11886; Payload ID: 4248 relates to Category No.: 11861, 2834, 11981; Payload ID: 4249 relates to Category No.: 11861; Payload ID: 4250 relates to Category No.: 11978, 926, 12109, 11861, 5956; Payload ID: 4251 relates to Category No.: 11861; Payload ID: 4253 relates to Category No.: 11981, 2834, 3385, 11861, 14231, 5956; Payload ID: 4257 relates to Category No.: 11861; Payload ID: 4258 relates to Category No.: 11981, 11861, 2834, 2832, 14231; Payload ID: 4259 relates to Category No.: 11981, 11861, 2834; Payload ID: 4260 relates to Category No.: 11981, 11861, 2834; Payload ID: 4263 relates to Category No.: 15984; Payload ID: 4264 relates to Category No.: 11981; Payload ID: 4265 relates to Category No.: 3303, 11981, 11861, 2834, 2405, 15524, 14715; Payload ID: 4266 relates to Category No.: 11981, 2834; Payload ID: 4267 relates to Category No.: 11981, 11861, 2834; Payload ID: 4268 relates to Category No.: 11981; Payload ID: 4269 relates to Category No.: 11978, 926, 12109, 11861, 2832, 14231, 5193, 5280, 5956, 2823; Payload ID: 4270 relates to Category No.: 11978, 926, 11861, 2832, 2830, 5956; Payload ID: 4271 relates to Category No.: 11978, 926, 12109, 2832; Payload ID: 4272 relates to Category No.: 11978, 926; Payload ID: 4273 relates to Category No.: 11978, 926, 11861, 2823, 2832, 14231; Payload ID: 4274 relates to Category No.: 11978, 926, 10116, 11861, 2823, 2832, 14231; Payload ID: 4275 relates to Category No.: 11978, 926, 11861, 2823, 2832; Payload ID: 4276 relates to Category No.: 11978, 926, 6816, 12109, 11861, 2832; Payload ID: 4277 relates to Category No.: 11978, 926, 12109, 11861, 2832; Payload ID: 4278 relates to Category No.: 11978, 926, 11861, 2832; Payload ID: 4279 relates to Category No.: 11978, 926, 11861, 2832; Payload ID: 4280 relates to Category No.: 11978, 926, 2832, 3752; Payload ID: 4281 relates to Category No.: 11978, 926, 6816, 11861, 2823, 2832, 5193, 5956, 11886, 12109; Payload ID: 4282 relates to Category No.: 11861, 3347; Payload ID: 4284 relates to Category No.: 11861; Payload ID: 4285 relates to Category No.: 11978, 926, 11861, 2832; Payload ID: 4286 relates to Category No.: 11978, 926, 2832; Payload ID: 4287 relates to Category No.: 11978, 926, 11861, 2823, 2834, 2832, 5956, 11886, 12109; Payload ID: 4288 relates to Category No.: 11978, 926, 5956, 12109, 11861, 3842, 15231, 3839, 215, 9539, 11981, 2936, 3765, 2832; Payload ID: 4289 relates to Category No.: 1405, 11978, 5956, 11981, 1369, 11861, 2826, 12108, 3765, 2832; Payload ID: 4290 relates to Category No.: 6210, 2826; Payload ID: 4291 relates to Category No.: 11978, 926, 11861, 2823, 2832, 5956; Payload ID: 4292 relates to Category No.: 11978, 926, 11895, 15491, 3385, 11861, 686, 2832, 14231, 5956; Payload ID: 4293 relates to Category No.: 11978, 926, 11861, 2832, 14231; Payload ID: 4294 relates to Category No.: 11978, 926, 3303, 11861, 2832, 14231, 2405, 15524, 14237, 14715, 15504; Payload ID: 4295 relates to Category No.: 6816, 15895, 11861, 2833, 2828, 2823, 11886; Payload ID: 4296 relates to Category No.: 11861, 2833, 2853, 12081, 15562, 2898, 11886, 2271, 5280; Payload ID: 4297 relates to Category No.: 2833, 11861; Payload ID: 4298 relates to Category No.: 11981, 10116, 11861, 2833, 9014, 3303, 15504, 9539, 6647, 15909, 5956; Payload ID: 4299 relates to Category No.: 11981, 11861, 2833; Payload ID: 4300 relates to Category No.: 11981, 11861, 2833; Payload ID: 4301 relates to Category No.: 11981, 11861, 2833; Payload ID: 4302 relates to Category No.: 12150, 12151, 9804, 9962, 12111, 11861; Payload ID: 4303 relates to Category No.: 11978, 926, 2832; Payload ID: 4304 relates to Category No.: 11978, 926, 2832; Payload ID: 4305 relates to Category No.:

11978, 926, 11861, 2832, 5956; Payload ID: 4306 relates to Category No.: 11978, 926, 2832; Payload ID: 4307 relates to Category No.: 11978, 926, 5956, 12109, 12363, 2832; Payload ID: 4308 relates to Category No.: 15021, 15029; Payload ID: 4309 relates to Category No.: 15021; Payload ID: 4310 relates to Category No.: 16331, 15917, 15911, 11981, 11861, 11782, 6422; Payload ID: 4311 relates to Category No.: 5865, 4976, 7223, 9518, 315, 16283, 9524, 841, 9518, 315, 16283, 12444, 680; Payload ID: 4312 relates to Category No.: 12292, 1457, 11861, 2838, 1528, 6088, 5247, 6085; Payload ID: 4313 relates to Category No.: 6816, 11939, 4976, 15895, 9524, 12292, 11861, 5347, 3752, 9047, 7184, 2837, 9064, 1523, 14342; Payload ID: 4314 relates to Category No.: 6816, 11939, 4976, 15895, 9524, 12292, 11861, 5347, 3752, 9047, 7184, 2837, 9064, 1523, 14342; Payload ID: 4315 relates to Category No.: 2858; Payload ID: 4316 relates to Category No.: 2858; Payload ID: 4317 relates to Category No.: 2858; Payload ID: 4318 relates to Category No.: 2858, 11861; Payload ID: 4319 relates to Category No.: 15029, 2858, 11861, 1327, 11828; Payload ID: 4320 relates to Category No.: 2858, 10116, 3665, 11828, 11861; Payload ID: 4321 relates to Category No.: 2858, 11861, 1146, 3665, 5347, 11828, 9620; Payload ID: 4322 relates to Category No.: 2858, 11861; Payload ID: 4323 relates to Category No.: 2858; Payload ID: 4324 relates to Category No.: 2858, 11861, 3665; Payload ID: 4325 relates to Category No.: 2858; Payload ID: 4326 relates to Category No.: 2858, 11861; Payload ID: 4327 relates to Category No.: 2858, 11861; Payload ID: 4328 relates to Category No.: 2858; Payload ID: 4329 relates to Category No.: 16331, 10116, 11861; Payload ID: 4330 relates to Category No.: 16331, 11861, 7192; Payload ID: 4331 relates to Category No.: 16331, 11861, 15024, 322, 15249; Payload ID: 4332 relates to Category No.: 11861, 5282, 16331; Payload ID: 4333 relates to Category No.: 12292, 10116, 5983, 2849, 5982, 11939, 1630; Payload ID: 4334 relates to Category No.: 11939, 12292, 11861, 15489, 5983, 6347, 4599, 2849, 6174, 1630; Payload ID: 4335 relates to Category No.: 5865, 2844, 4158; Payload ID: 4336 relates to Category No.: 5547; Payload ID: 4337 relates to Category No.: 1537, 12292, 15081; Payload ID: 4338 relates to Category No.: 16331, 11861; Payload ID: 4339 relates to Category No.: 7192; Payload ID: 4340 relates to Category No.: 15029, 11861; Payload ID: 4342 relates to Category No.: 11861, 7192; Payload ID: 4343 relates to Category No.: 11861; Payload ID: 4344 relates to Category No.: 6965, 11861, 9608, 11886, 14377; Payload ID: 4345 relates to Category No.: 16331; Payload ID: 4346 relates to Category No.: 16331, 9629, 3303, 1121, 916; Payload ID: 4347 relates to Category No.: 16331, 11861; Payload ID: 4348 relates to Category No.: 16331; Payload ID: 4349 relates to Category No.: 1404; Payload ID: 4351 relates to Category No.: 7192; Payload ID: 4352 relates to Category No.: 7192; Payload ID: 4353 relates to Category No.: 4720, 5009; Payload ID: 4355 relates to Category No.: 7192; Payload ID: 4356 relates to Category No.: 1405, 11861; Payload ID: 4357 relates to Category No.: 11861, 1405; Payload ID: 4358 relates to Category No.: 5588, 5547, 5009, 11861, 4016; Payload ID: 4359 relates to Category No.: 11861; Payload ID: 4360 relates to Category No.: 15503, 14471, 11861, 7192, 14471, 15528, 14255; Payload ID: 4361 relates to Category No.: 15503, 14471, 11861, 9805, 14471, 15528, 14255; Payload ID: 4362 relates to Category No.: 15503, 14471, 14471, 15528, 14255; Payload ID: 4363 relates to Category No.: 4820, 4816, 11861, 6156, 2862; Payload ID: 4364 relates to Category No.: 4820, 4816, 11861, 6156, 2862; Payload ID: 4365 relates to Category No.: 926, 9282, 6816, 11939, 2851, 11861, 15699, 632; Payload ID: 4366 relates to Category No.: 926, 9282, 6816, 2851, 632; Payload ID: 4367 relates to Category No.: 2323, 926, 942, 942, 2748, 11861, 3752, 2270, 9608, 2325, 1180, 2330, 946; Payload ID: 4368 relates to Category No.: 11861; Payload ID: 4369 relates to Category No.: 6089; Payload ID: 4370 relates to Category No.: 16331, 5308, 1630; Payload ID: 4371 relates to Category No.: 16331, 5308, 11939, 1630, 9248, 11861, 2865, 5347; Payload ID: 4372 relates to Category No.: 926, 9231, 9252, 16017, 2868, 16011; Payload ID: 4373 relates to Category No.: 926, 9252, 15394, 2868, 15968, 16017; Payload ID: 4374 relates to Category No.: 7466; Payload ID: 4375 relates to Category No.: 6816, 11861, 4155, 9518, 9516; Payload ID: 4376 relates to Category No.: 6816, 11933, 4976, 3554, 11861, 15115, 14537; Payload ID: 4377 relates to Category No.: 6816, 11933, 4976, 3554, 4207, 9518, 11861, 16250, 15115; Payload ID: 4378 relates to Category No.: 6816; Payload ID: 4379 relates to Category No.: 4976; Payload ID: 4380 relates to Category No.: 9518, 11861, 7192, 2872, 314; Payload ID: 4381 relates to Category No.: 9518, 11861, 2872, 314; Payload ID: 4382 relates to Category No.: 9518, 4075, 2872, 314, 11861, 4207, 7472, 456, 646; Payload ID: 4383 relates to Category No.: 6816, 4976, 9518, 7488, 2872, 314, 9518, 314, 4984, 11861, 4207, 7523; Payload ID: 4384 relates to Category No.: 9518, 2872, 314; Payload ID: 4385 relates to Category No.: 6816, 4976, 2873, 3752, 520; Payload ID: 4386 relates to Category No.: 6816, 4976, 3749; Payload ID: 4387 relates to Category No.: 6816, 9518, 11861, 4155, 15608; Payload ID: 4388 relates to Category No.: 6816, 9518, 11861; Payload ID: 4389 relates to Category No.: 6816; Payload ID: 4390 relates to Category No.: 6816; Payload ID: 4391 relates to Category No.: 15027; Payload ID: 4392 relates to Category No.: 11861; Payload ID: 4394 relates to Category No.: 11861; Payload ID: 4395 relates to Category No.: 2873, 10116; Payload ID: 4397 relates to Category No.: 2873, 9518, 319, 9518, 314, 4984; Payload ID: 4398 relates to Category No.: 2873, 11861; Payload ID: 4399 relates to Category No.: 2873; Payload ID: 4400 relates to Category No.: 6816, 3554, 11861, 2873; Payload ID: 4401 relates to Category No.: 6816, 11861, 2873; Payload ID: 4402 relates to Category No.: 2873; Payload ID: 4403 relates to Category No.: 2873; Payload ID: 4404 relates to Category No.: 2873; Payload ID: 4405 relates to Category No.: 11861, 2873; Payload ID: 4406 relates to Category No.: 2873; Payload ID: 4407 relates to Category No.: 2873; Payload ID: 4408 relates to Category No.: 2873; Payload ID: 4409 relates to Category No.: 2873; Payload ID: 4410 relates to Category No.: 2873; Payload ID: 4411 relates to Category No.: 2873; Payload ID: 4412 relates to Category No.: 2873; Payload ID: 4413 relates to Category No.: 11861, 2873; Payload ID: 4414 relates to Category No.: 2873; Payload ID: 4415 relates to Category No.: 6816, 4976, 3554, 12111, 11861, 3556, 15551; Payload ID: 4416 relates to Category No.: 6816, 4976, 3554, 3556, 15551, 11861; Payload ID: 4417 relates to Category No.: 5865, 4976, 9518, 7223, 9518, 315, 16283, 9524, 841, 11861, 16219, 9518, 315, 16283, 12444, 680, 1630, 3752, 14971, 9518, 310, 4211, 3034; Payload ID: 4418 relates to Category No.: 5865, 4976, 3554, 9518, 7223, 9518, 315, 16283, 9518, 315, 16283, 12444, 680, 841, 3752, 3034, 1376; Payload ID: 4419 relates to Category No.: 5865, 4976, 7223, 9518, 315, 16283, 9518, 315, 16283, 12444, 680, 9524, 841; Payload ID: 4420 relates to Category No.: 5865, 4976, 9518, 315, 16283, 9518, 315, 16283, 7486, 680, 2356, 7223; Payload ID: 4421 relates to Category No.: 5865, 4976, 7223, 9518, 315, 16283, 9518, 315, 16283, 7486, 680, 14957, 2722; Payload ID: 4422 relates to Category No.: 5865, 4976, 9518, 315, 16283, 9518, 315, 16283, 7486, 680, 14957, 2722; Payload ID: 4423 relates to Category No.: 5865, 4976, 9518, 315, 16283, 9524, 14958, 43; Payload ID: 4424 relates to Category No.: 5865, 4976, 3554, 9518, 315, 16283, 9518, 315, 16283, 12444, 680, 9524, 841; Payload ID: 4425 relates to Category No.: 5865, 814, 14971, 4976, 9518, 315, 16283, 9518, 315, 16283, 12444, 680, 9524, 841; Payload ID: 4426 relates to Category No.: 5865, 814, 14971, 4976, 9518, 315, 16283, 9518, 315, 16283, 12444, 680, 9524, 3752, 2741; Payload ID: 4427 relates to Category No.: 5865, 814, 14971, 4976, 9518, 315, 16283, 9518, 315, 16283, 12444, 680, 9524, 841; Payload ID: 4428 relates to Category No.: 5865, 814, 14971, 4976, 7223, 9518, 315, 16283, 9518, 315, 16283, 12444, 680, 9524; Payload ID: 4429 relates to Category No.: 5865, 814, 14971, 4976, 7223, 9518, 315, 16283, 9518, 315, 16283, 12444, 680, 9524, 841; Payload ID: 4430 relates to Category No.: 5865, 814, 14971, 4976, 9518, 7223, 9518, 315, 16283, 9518, 315, 16283, 12444, 680, 9524, 3752, 10, 11, 6; Payload ID: 4431 relates to Category No.: 5865, 814, 14971, 4976, 9518, 315, 16283, 9518, 315, 16283, 12444, 680, 9524, 7223, 841, 1376; Payload ID: 4432 relates to Category No.: 5865, 814, 14971, 4976, 9518, 7223, 9518, 315, 16283, 9518, 315, 16283, 12444, 680, 9524, 841, 3471, 1376, 10, 11, 6; Payload ID: 4434 relates to Category No.: 5865, 4976, 9518, 315, 16283, 9518, 315, 16283, 12444, 680, 7223; Payload ID: 4435 relates to Category No.: 5865, 814, 14971, 4976, 9518, 7223, 9518, 315, 16283, 9518, 315, 16283, 12444, 680, 9524, 9518, 315, 16283, 7486, 680, 3752; Payload ID: 4436 relates to Category No.: 5865, 814, 14971, 4976, 7223, 9518, 315, 16283, 9518, 315, 16283, 12444, 680, 9524, 841; Payload ID: 4437 relates to Category No.: 5865, 814, 14971, 4976, 9518, 315, 16283, 9518, 315, 16283, 12444, 680, 9524, 841, 812, 811, 6202; Payload ID: 4438 relates to Category No.: 5865, 14971, 4976, 9518, 315, 16283, 9518, 315, 16283, 12444, 680, 9524, 16227; Payload ID: 4439 relates to Category No.: 5865, 814, 14971, 4976, 9518, 315, 16283, 9518, 315, 16283, 12444, 680, 9524, 841, 11861; Payload ID: 4440 relates to Category No.: 5865, 14971, 4976, 9518, 315, 16283, 9518, 315, 16283, 12444, 680, 9524, 841; Payload ID: 4441 relates to Category No.: 5865, 14971, 4976, 9518, 315, 16283, 9518, 315, 16283, 12444, 680, 9524; Payload ID: 4442 relates to Category No.: 5865, 4976, 7223, 9518, 315, 16283; Payload ID: 4443 relates to Category No.: 5865, 4976, 9518, 315, 16283, 14959, 14971, 14961, 7223; Payload ID: 4444 relates to Category No.: 5865, 4976, 9518, 9518, 315, 16283, 54, 73; Payload ID: 4445 relates to Category No.: 5865, 4976, 9518, 315, 16283, 9524, 14077, 14076; Payload ID: 4446 relates to Category No.: 5865, 4976, 9518, 315, 16283, 14077, 14076, 7223; Payload ID: 4447 relates to Category No.: 5865, 4976, 9518, 315, 16283, 14077, 14076; Payload ID: 4448 relates to Category No.: 5865, 14971, 4976, 9518, 315, 16283, 2340; Payload ID: 4449 relates to Category No.: 5865, 4976, 9518, 315, 16283, 1380, 7223; Payload ID: 4450 relates to Category No.: 5865, 4976, 7223, 9518, 315, 16283; Payload ID: 4451 relates to Category No.: 5865, 14971, 4976, 9518, 7223, 9518, 315, 16283, 9524, 14961, 841, 3752, 16219, 1376, 16227, 15238, 505, 12348, 15300; Payload ID: 4452 relates to Category No.: 5865, 4976, 7223, 9518, 315, 16283, 841; Payload ID: 4453 relates to Category No.: 5865, 4976, 9518, 7223, 9518, 315, 16283, 9524, 841; Payload ID: 4454 relates to Category No.: 5865, 4976, 7223, 9518, 315, 16283, 9524, 841; Payload ID: 4455 relates to Category No.: 5865, 4976, 9518, 315, 16283, 9531, 72, 14960, 7223; Payload ID: 4456 relates to Category No.: 5865, 814, 4976, 9518, 315, 16283, 528, 6159, 7223; Payload ID: 4457 relates to Category No.: 5865, 4976, 7223, 9518, 315, 16283; Payload ID: 4458 relates to Category No.: 5865, 4976, 9518, 315, 16283, 9524, 841, 3471, 15468, 4223, 7223; Payload ID: 4459 relates to Category No.: 5865, 4976, 9518, 315, 16283, 9518, 315, 16283, 7486, 680, 7223; Payload ID: 4460 relates to Category No.: 5865, 4976, 7223, 9518, 315, 16283, 814, 841, 528, 6159; Payload ID: 4461 relates to Category No.: 5865, 814, 4976, 9518, 315, 16283, 11861, 9518, 315, 16283, 7486, 680, 528, 6159, 816, 596, 15435, 7223; Payload ID: 4462 relates to Category No.: 5865, 4976, 7223, 9518, 315, 16283; Payload ID: 4463 relates to Category No.: 5865, 4976, 7223, 9518, 315, 16283, 6159, 596; Payload ID: 4464 relates to Category No.: 5865, 4976, 9518, 315, 16283, 841, 528; Payload ID: 4465 relates to Category No.: 5865, 4976, 7223, 9518, 315, 16283; Payload ID: 4466 relates to Category No.: 5865, 4976, 9518, 315, 16283, 841; Payload ID: 4467 relates to Category No.: 5865, 4976, 9518, 315, 16283, 841; Payload ID: 4468 relates to Category No.: 5865, 4976, 9518, 315, 16283, 14971, 2343; Payload ID: 4469 relates to Category No.: 5865, 4976, 9518, 315, 16283, 14976, 7223; Payload ID: 4470 relates to Category No.: 5865, 4976, 9518, 315, 16283, 2345; Payload ID: 4471 relates to Category No.: 5865, 4976, 9518, 315, 16283, 74, 9531; Payload ID: 4472 relates to Category No.: 5865, 4976, 7223, 9518, 315, 16283, 9524, 14975, 179; Payload ID: 4473 relates to Category No.: 5865, 4976, 9524, 9747, 11861, 9529, 9050, 1629, 4113; Payload ID: 4474 relates to Category No.: 820, 6210, 11861; Payload ID: 4475 relates to Category No.: 11861; Payload ID: 4476 relates to Category No.: 820, 6210, 11861, 5478; Payload ID: 4477 relates to Category No.: 820, 11861, 9874; Payload ID: 4478 relates to Category No.: 820, 6210; Payload ID: 4479 relates to Category No.: 6816, 3554, 5875, 6924, 65, 11861; Payload ID: 4480 relates to Category No.: 11861, 7192, 11991; Payload ID: 4481 relates to Category No.: 11933, 12399, 2874, 11861, 2875, 2449; Payload ID: 4482 relates to Category No.: 11861; Payload ID: 4483 relates to Category No.: 11861; Payload ID: 4484 relates to Category No.: 11861, 14538; Payload ID: 4485 relates to Category No.: 12402; Payload ID: 4486 relates to Category No.: 277, 12363, 11861, 11886; Payload ID: 4487 relates to Category No.: 11861; Payload ID: 4488 relates to Category No.: 3516, 6965, 11861, 5966, 6979, 1201; Payload ID: 4489 relates to Category No.: 1201, 11861, 3516, 6965, 277, 6979, 12146; Payload ID: 4490 relates to Category No.: 9282, 9226, 6816, 14176, 15598, 9226, 7265, 15591, 14196, 7264; Payload ID: 4491 relates to Category No.: 9282, 9226, 14176, 10116, 15598, 9226, 7265, 15591, 14196, 14163, 4897, 14170, 7264, 11861, 10152; Payload ID: 4492 relates to Category No.: 9282, 9226, 14196, 14176, 10116, 11861, 15598, 9226, 7265, 15591, 14196, 14272, 7264; Payload ID: 4493 relates to Category No.: 9282, 9226, 14176, 10116, 11861, 15598, 9226, 7265, 15591, 14196, 14196; Payload ID: 4496 relates to Category No.: 11861, 1201; Payload ID: 4497 relates to Category No.: 10116; Payload ID: 4498 relates to Category No.: 11861; Payload ID: 4499 relates to Category No.: 9304, 11861, 15699; Payload ID: 4500 relates to Category No.: 9304, 11861, 15699; Payload ID: 4501 relates to Category No.: 11939, 12402, 12399, 11861, 1706; Payload ID: 4502 relates to Category No.: 11861; Payload ID: 4503 relates to Category No.: 15503, 14471, 14471, 14243, 15528, 14233; Payload ID: 4504 relates to Category No.: 4207, 9518, 1630, 9518, 308, 4; Payload ID: 4505 relates to Category No.: 16331, 11861, 9226, 6816; Payload ID: 4506 relates to Category No.: 16331, 6816, 14234, 11861; Payload ID: 4507 relates to Category No.: 16331, 6816, 11861; Payload ID: 4508 relates to Category No.: 11895, 14652, 11861, 2489, 1601; Payload ID: 4509 relates to Category No.: 11861, 9844; Payload ID: 4510 relates to Category No.: 4894, 11861, 11939, 7126, 11981, 5347, 9882, 14537, 14580, 9844, 11886, 5957, 7127, 37, 12077, 9888, 16082, 3007, 9853; Payload ID: 4511 relates to Category No.: 3303, 11861, 15530, 14233, 15503, 14471, 15503, 14236; Payload ID: 4512 relates to Category No.: 3303; Payload ID: 4513 relates to Category No.: 1405; Payload ID: 4514 relates to Category No.: 1405, 7192; Payload ID: 4515 relates to Category No.: 11861; Payload ID: 4516 relates to Category No.: 11992; Payload ID: 4517 relates to Category No.: 926, 9282, 632, 834, 11861; Payload ID: 4518 relates to Category No.: 11861; Payload ID: 4519 relates to Category No.: 11992; Payload ID: 4520 relates to Category No.: 3303, 9226, 2963, 11861; Payload ID: 4521 relates to Category No.: 11861, 3303, 15908, 2963; Payload ID: 4522 relates to Category No.: 3749, 3752; Payload ID: 4523 relates to Category No.: 9518, 2966, 4075, 11917, 12402, 11861, 2559; Payload ID: 4524 relates to Category No.: 7236, 11861; Payload ID: 4525 relates to Category No.: 9546, 15358; Payload ID: 4527 relates to Category No.: 9518, 12402, 11861, 2966, 4075, 2559, 2969; Payload ID: 4528 relates to Category No.: 5308, 305, 1636; Payload ID: 4529 relates to Category No.: 11861; Payload ID: 4530 relates to Category No.: 9282, 9226, 14196, 10116, 14272; Payload ID: 4531 relates to Category No.: 11861, 16296; Payload ID: 4532 relates to Category No.: 6816, 11861; Payload ID: 4533 relates to Category No.: 6816, 11861; Payload ID: 4534 relates to Category No.: 16331, 14196, 15908, 6188, 10116, 11861, 9805, 10163; Payload ID: 4535 relates to Category No.: 3749, 16331, 9226; Payload ID: 4536 relates to Category No.: 16331, 9226, 11981, 11861, 11977; Payload ID: 4537 relates to Category No.: 15617, 11861; Payload ID: 4538 relates to Category No.: 16331, 5308, 1630, 11861, 2978; Payload ID: 4539 relates to Category No.: 11861, 15889, 15903, 2793; Payload ID: 4540 relates to Category No.: 11861, 15889, 15903, 2793; Payload ID: 4541 relates to Category No.: 15889, 15903, 2793, 7192; Payload ID: 4542 relates to Category No.: 11861, 15889, 15903, 2793, 7192; Payload ID: 4543 relates to Category No.: 11861, 15889, 15903, 2793, 7192; Payload ID: 4544 relates to Category No.: 16331, 11861; Payload ID: 4546 relates to Category No.: 6478, 11861, 5347, 9270, 2980, 12327, 12298; Payload ID: 4547 relates to Category No.: 11861; Payload ID: 4548 relates to Category No.: 11861; Payload ID: 4549 relates to Category No.: 11861; Payload ID: 4550 relates to Category No.: 11861, 7192; Payload ID: 4551 relates to Category No.: 11861; Payload ID: 4552 relates to Category No.: 11861, 10116; Payload ID: 4554 relates to Category No.: 11861; Payload ID: 4556 relates to Category No.: 11861; Payload ID: 4557 relates to Category No.: 11861; Payload ID: 4558 relates to Category No.: 11861; Payload ID: 4559 relates to Category No.: 11861; Payload ID: 4560 relates to Category No.: 11861, 6185; Payload ID: 4561 relates to Category No.: 11861; Payload ID: 4562 relates to Category No.: 11861; Payload ID: 4563 relates to Category No.: 11861; Payload ID: 4564 relates to Category No.: 11861; Payload ID: 4565 relates to Category No.: 6816, 5308; Payload ID: 4566 relates to Category No.: 6816, 5308, 11861; Payload ID: 4567 relates to Category No.: 3422, 2981; Payload ID: 4568 relates to Category No.: 6401; Payload ID: 4569 relates to Category No.: 11861, 15905; Payload ID: 4570 relates to Category No.: 926, 3303, 9226, 2405, 10115, 954, 961, 9225, 10116, 11861, 15493, 3993, 14203, 3367, 3464; Payload ID: 4571 relates to Category No.: 926, 9226, 961, 14196, 15491, 10116, 11861, 3936, 14203, 14279; Payload ID: 4572 relates to Category No.: 926, 9226, 14196, 14309, 4965, 961, 14712, 10116, 11861, 185, 3464; Payload ID: 4573 relates to Category No.: 926, 9226, 961, 10116, 14203; Payload ID: 4574 relates to Category No.: 926, 9226, 14196, 961; Payload ID: 4575 relates to Category No.: 926, 3303, 9226, 14196, 942, 4895, 15504, 10115, 961, 953, 10116, 11861, 15593, 3957, 7267, 9269, 14272, 14170, 2784, 4965; Payload ID: 4576 relates to Category No.: 926, 3303, 9226, 14196, 961; Payload ID: 4577 relates to Category No.: 961, 926, 9226, 10116, 11861; Payload ID: 4578 relates to Category No.: 961, 926, 9226, 15491, 10116, 5308, 305, 5405, 11861, 15493, 3936, 14203, 686, 11700, 1457, 3752, 1439; Payload ID: 4579 relates to Category No.: 926, 9226, 961, 10116, 4965; Payload ID: 4580 relates to Category No.: 926, 9226, 4965, 961, 11920, 10116, 11861, 14203; Payload ID: 4581 relates to Category No.: 926, 9226, 961, 10116, 14203, 14196; Payload ID: 4582 relates to Category No.: 926, 9226, 961, 10116, 11861, 4965; Payload ID: 4583 relates to Category No.: 926, 9226, 14196, 961, 11861, 7192; Payload ID: 4584 relates to Category No.: 926, 9226, 961, 14196, 4965, 11861; Payload ID: 4585 relates to Category No.: 926, 3303, 9226, 961, 11861, 13735, 5109, 11861, 1327, 11920; Payload ID: 4586 relates to Category No.: 926, 9226, 961, 10116, 11861; Payload ID: 4587 relates to Category No.: 926, 9226, 961, 10116; Payload ID: 4588 relates to Category No.: 926, 9226, 14309, 961, 10116; Payload ID: 4589 relates to Category No.: 926, 9226, 961, 10116, 11861, 14196; Payload ID: 4590 relates to Category No.: 926, 9226, 961, 10116, 11861; Payload ID: 4591 relates to Category No.: 926, 9226, 4965; Payload ID: 4592 relates to Category No.: 926, 9226, 961, 11861; Payload ID: 4593 relates to Category No.: 926, 16331, 9226, 961, 10116, 11861, 3303; Payload ID: 4594 relates to Category No.: 926, 9226, 14196, 961; Payload ID: 4595 relates to Category No.: 926, 9226, 961, 10116; Payload ID: 4596 relates to Category No.: 926, 9226, 961, 10116, 11861; Payload ID: 4597 relates to Category No.: 926, 9226, 961, 10116; Payload ID: 4598 relates to Category No.: 926, 9226, 14196, 4965, 961, 10116; Payload ID: 4599 relates to Category No.: 926, 9226, 961, 10116; Payload ID: 4600 relates to Category No.: 926, 9226, 4965, 10116; Payload ID: 4601 relates to Category No.: 926, 9226, 14196, 961; Payload ID: 4602 relates to Category No.: 926, 9226, 14196, 12402, 961, 15495, 10116, 5308, 305, 5405, 3936, 4965; Payload ID: 4603 relates to Category No.: 926, 9226, 961, 10116, 11861, 14196; Payload ID: 4604 relates to Category No.: 926, 3303, 9226, 5308, 305, 16331, 4965, 3464, 11861, 5347, 14602, 3459; Payload ID: 4605 relates to Category No.: 926, 9226, 6816, 14196, 961; Payload ID: 4606 relates to Category No.: 926, 9226, 4965, 3459, 3464, 11861, 14602, 14196; Payload ID: 4607 relates to Category No.: 926, 9226, 14196, 4965; Payload ID: 4608 relates to Category No.: 926, 3303, 9226, 6816, 14196, 4965, 3459, 954, 14597, 3385, 138, 953, 5308, 305, 5405, 11861; Payload ID: 4610 relates to Category No.: 3303, 6816, 15503, 14471, 11861; Payload ID: 4612 relates to Category No.: 11861, 11939, 11933; Payload ID: 4614 relates to Category No.: 926, 9226, 6816, 4965, 954, 961, 10116, 11861; Payload ID: 4615 relates to Category No.: 926, 9226, 4965, 954, 961, 3464, 10116, 11861, 14203; Payload ID: 4616 relates to Category No.: 926, 9226, 2405, 4965, 954, 961, 3464, 10116, 11861; Payload ID: 4617 relates to Category No.: 926, 3303, 9226, 4965, 954, 961, 953, 10116, 11861, 14252, 14203; Payload ID: 4618 relates to Category No.: 926, 9226, 4965, 954, 961, 10116, 11861, 14203; Payload ID: 4619 relates to Category No.: 926, 9226, 4965, 954, 15592, 961, 10116, 14170; Payload ID: 4620 relates to Category No.: 4965, 961, 10116, 926, 11861; Payload ID:

4621 relates to Category No.: 926, 9226, 4965, 954, 961, 10116, 12393, 327; Payload ID: 4622 relates to Category No.: 926, 9226, 4965, 961, 10116; Payload ID: 4623 relates to Category No.: 926, 9226, 4965, 954, 961, 10116; Payload ID: 4624 relates to Category No.: 926, 9226, 4965, 15524, 954, 961, 3385, 5109, 3464, 10116, 11861, 2688, 4834, 4836; Payload ID: 4625 relates to Category No.: 926, 9226, 4965, 961, 10116; Payload ID: 4626 relates to Category No.: 926, 9226, 4965, 954, 961, 10116, 11861; Payload ID: 4627 relates to Category No.: 926, 9226, 4965, 954, 961, 10116; Payload ID: 4628 relates to Category No.: 926, 9226, 4965, 954, 961, 10116, 11861, 5347; Payload ID: 4629 relates to Category No.: 961, 10116, 926, 4965; Payload ID: 4630 relates to Category No.: 15027, 10116, 11861; Payload ID: 4631 relates to Category No.: 3004, 4820; Payload ID: 4632 relates to Category No.: 11861; Payload ID: 4633 relates to Category No.: 3303, 11861; Payload ID: 4634 relates to Category No.: 3303, 12416, 11861; Payload ID: 4635 relates to Category No.: 16331, 10116, 11861; Payload ID: 4636 relates to Category No.: 3004; Payload ID: 4637 relates to Category No.: 11978, 926, 4886, 12109, 1457, 1459, 11861, 15181, 5347; Payload ID: 4638 relates to Category No.: 11978, 926, 1459, 12109, 1457, 11861, 5347; Payload ID: 4639 relates to Category No.: 11978, 926, 11939, 12109, 1459, 11861, 14106, 5347, 1472, 6127, 11895, 5956; Payload ID: 4640 relates to Category No.: 11939, 15504, 9539, 4961, 15895, 5105, 15495, 11981, 11861, 3752, 12417, 11977, 12064, 686; Payload ID: 4641 relates to Category No.: 6816, 5308, 10116, 5308, 311, 14207; Payload ID: 4642 relates to Category No.: 5308, 1630, 11861, 14195, 6450; Payload ID: 4643 relates to Category No.: 9282, 6478, 7268, 154, 14268; Payload ID: 4644 relates to Category No.: 5308, 11861, 5347; Payload ID: 4645 relates to Category No.: 5308, 3755, 7268, 11861; Payload ID: 4646 relates to Category No.: 14196, 5308, 11861, 6574, 4000, 11753, 6450; Payload ID: 4647 relates to Category No.: 10116, 11861, 4720, 4016, 12064, 2566; Payload ID: 4648 relates to Category No.: 4894, 4924, 11861, 14537, 1201; Payload ID: 4649 relates to Category No.: 11861, 7192, 1201, 14107, 14106, 4924; Payload ID: 4650 relates to Category No.: 4924, 1201, 11861, 14107, 14106; Payload ID: 4651 relates to Category No.: 11861, 12364, 15205, 1201, 4894, 4924; Payload ID: 4652 relates to Category No.: 4924, 11861, 14537, 1201; Payload ID: 4653 relates to Category No.: 4924, 4894, 12363, 11861, 14537, 12425, 9608; Payload ID: 4654 relates to Category No.: 4924, 11861, 1201; Payload ID: 4655 relates to Category No.: 4924; Payload ID: 4656 relates to Category No.: 4924, 12363; Payload ID: 4657 relates to Category No.: 4924, 11861, 1201; Payload ID: 4658 relates to Category No.: 4924, 1201, 11861, 14107, 14106; Payload ID: 4660 relates to Category No.: 11861; Payload ID: 4661 relates to Category No.: 3411, 9361; Payload ID: 4664 relates to Category No.: 7192; Payload ID: 4667 relates to Category No.: 11861; Payload ID: 4683 relates to Category No.: 6242; Payload ID: 4688 relates to Category No.: 11861, 7192; Payload ID: 4693 relates to Category No.: 11861; Payload ID: 4705 relates to Category No.: 15542, 15550, 11861, 10151; Payload ID: 4706 relates to Category No.: 9520, 15346, 9518, 318, 3292; Payload ID: 4707 relates to Category No.: 9518, 11861; Payload ID: 4708 relates to Category No.: 9518; Payload ID: 4709 relates to Category No.: 9518; Payload ID: 4710 relates to Category No.: 9518; Payload ID: 4711 relates to Category No.: 9518, 11861, 1529; Payload ID: 4712 relates to Category No.: 9282, 3554, 9518, 7525, 14089; Payload ID: 4713 relates to Category No.: 9518, 12402, 9518, 314, 12354, 1529, 115, 510; Payload ID: 4714 relates to Category No.: 9518; Payload ID: 4715 relates to Category No.: 9518; Payload ID: 4716 relates to Category No.: 9518, 7192; Payload ID: 4717 relates to Category No.: 9518, 14089; Payload ID: 4718 relates to Category No.: 9518, 14089, 15302, 508, 12366; Payload ID: 4719 relates to Category No.: 9518; Payload ID: 4720 relates to Category No.: 15419, 14420; Payload ID: 4721 relates to Category No.: 15895, 14420, 15419; Payload ID: 4722 relates to Category No.: 15419, 15420; Payload ID: 4723 relates to Category No.: 3303, 5105, 10116; Payload ID: 4724 relates to Category No.: 9282, 9226, 14196, 11861, 15589; Payload ID: 4725 relates to Category No.: 9282, 9226, 14196; Payload ID: 4726 relates to Category No.: 9282, 9226, 14196; Payload ID: 4727 relates to Category No.: 9282, 9226, 14196; Payload ID: 4728 relates to Category No.: 9282, 9226, 14196, 11861, 15589, 5347, 7265; Payload ID: 4730 relates to Category No.: 7192; Payload ID: 4731 relates to Category No.: 11861; Payload ID: 4733 relates to Category No.: 14379, 11861, 1439, 14581, 16343; Payload ID: 4734 relates to Category No.: 11861; Payload ID: 4735 relates to Category No.: 14864, 3554; Payload ID: 4736 relates to Category No.: 14864, 14875; Payload ID: 4737 relates to Category No.: 1405, 15617, 2491, 11861, 9122; Payload ID: 4738 relates to Category No.: 1405, 11861, 9122, 15229; Payload ID: 4739 relates to Category No.: 11861, 1405, 7192; Payload ID: 4740 relates to Category No.: 1405, 11861, 11939; Payload ID: 4741 relates to Category No.: 1405, 11861, 9122; Payload ID: 4742 relates to Category No.: 1405, 11861, 9122; Payload ID: 4743 relates to Category No.: 16331, 15895, 15491, 6188, 11861, 14537, 9122; Payload ID: 4744 relates to Category No.: 16331, 6816, 11861; Payload ID: 4745 relates to Category No.: 16331, 15908, 5105, 6188, 11861; Payload ID: 4746 relates to Category No.: 16331, 6188, 11861; Payload ID: 4747 relates to Category No.: 16331, 6188, 11861; Payload ID: 4748 relates to Category No.: 267, 12402, 11861, 14812, 12107; Payload ID: 4749 relates to Category No.: 14234, 15503, 14233, 11861; Payload ID: 4750 relates to Category No.: 3303, 11861; Payload ID: 4751 relates to Category No.: 11861; Payload ID: 4752 relates to Category No.: 12360, 11861, 14537; Payload ID: 4753 relates to Category No.: 12360; Payload ID: 4754 relates to Category No.: 12360; Payload ID: 4755 relates to Category No.: 12360; Payload ID: 4756 relates to Category No.: 12360; Payload ID: 4757 relates to Category No.: 11861, 12360; Payload ID: 4758 relates to Category No.: 11861, 12360; Payload ID: 4759 relates to Category No.: 3303, 12360; Payload ID: 4760 relates to Category No.: 12360; Payload ID: 4762 relates to Category No.: 1401, 11861, 12360, 12359; Payload ID: 4763 relates to Category No.: 1401, 11861, 12360; Payload ID: 4764 relates to Category No.: 12360; Payload ID: 4765 relates to Category No.: 12360; Payload ID: 4766 relates to Category No.: 15592, 11861, 7192; Payload ID: 4767 relates to Category No.: 15908, 11861; Payload ID: 4768 relates to Category No.: 1405, 5588, 4016; Payload ID: 4769 relates to Category No.: 1405, 4023, 2566; Payload ID: 4770 relates to Category No.: 926, 11939, 3471, 9255, 3075; Payload ID: 4771 relates to Category No.: 926, 9255, 3078; Payload ID: 4772 relates to Category No.: 6816, 11861, 3080, 1201; Payload ID: 4773 relates to Category No.: 11861, 3081; Payload ID: 4774 relates to Category No.: 3303, 11939, 9275, 11861; Payload ID: 4775 relates to Category No.: 10116; Payload ID: 4776 relates to Category No.: 3640, 3084, 267, 3640, 11753, 11861, 3085; Payload ID: 4777 relates to Category No.: 3086, 3640; Payload ID: 4778 relates to Category No.: 3303, 3086, 3640; Payload ID: 4779 relates to Category No.: 3303, 3640, 3640, 11753, 3084;

Payload ID: 4780 relates to Category No.: 1405, 3303, 3640, 3640, 11753, 3084; Payload ID: 4781 relates to Category No.: 1405, 3640, 3640, 11753, 3084, 3655, 3303; Payload ID: 4782 relates to Category No.: 6401, 3098; Payload ID: 4783 relates to Category No.: 926, 16017, 15394, 9259; Payload ID: 4784 relates to Category No.: 5308, 6478, 3499, 10116, 11861; Payload ID: 4785 relates to Category No.: 4894, 11861; Payload ID: 4786 relates to Category No.: 4894; Payload ID: 4788 relates to Category No.: 4894, 11886; Payload ID: 4789 relates to Category No.: 7192; Payload ID: 4790 relates to Category No.: 11861; Payload ID: 4791 relates to Category No.: 926, 3099; Payload ID: 4792 relates to Category No.: 15895, 12399, 11861, 11828, 943, 6933, 15915; Payload ID: 4793 relates to Category No.: 11861; Payload ID: 4794 relates to Category No.: 11861; Payload ID: 4795 relates to Category No.: 2388; Payload ID: 4796 relates to Category No.: 15086; Payload ID: 4798 relates to Category No.: 9619, 10116, 11861; Payload ID: 4799 relates to Category No.: 11861; Payload ID: 4800 relates to Category No.: 1405, 16331, 9619, 11861, 9592; Payload ID: 4801 relates to Category No.: 15021, 15029, 11861, 2936, 5347; Payload ID: 4802 relates to Category No.: 1405, 11861; Payload ID: 4803 relates to Category No.: 1405, 11861, 1708; Payload ID: 4804 relates to Category No.: 1405, 4380; Payload ID: 4805 relates to Category No.: 1405, 4380, 15468; Payload ID: 4806 relates to Category No.: 1405, 1706, 1708; Payload ID: 4807 relates to Category No.: 1405; Payload ID: 4808 relates to Category No.: 1405; Payload ID: 4809 relates to Category No.: 15021, 15029, 11861, 1327, 10116, 11861, 1706, 11983, 14377, 1708; Payload ID: 4810 relates to Category No.: 267, 11861; Payload ID: 4811 relates to Category No.: 9619, 11861, 5347; Payload ID: 4812 relates to Category No.: 9619; Payload ID: 4813 relates to Category No.: 11861; Payload ID: 4814 relates to Category No.: 3303, 14471; Payload ID: 4815 relates to Category No.: 3303, 14471; Payload ID: 4816 relates to Category No.: 2405; Payload ID: 4817 relates to Category No.: 6900, 11861; Payload ID: 4818 relates to Category No.: 11861; Payload ID: 4819 relates to Category No.: 14196; Payload ID: 4820 relates to Category No.: 4886, 15504, 11861, 5347; Payload ID: 4821 relates to Category No.: 4886, 11861; Payload ID: 4822 relates to Category No.: 926, 3303, 16331, 5308, 4965, 5308, 305, 3464, 11861, 14602; Payload ID: 4824 relates to Category No.: 6816, 11939, 4976, 3464, 11861, 14137, 11732; Payload ID: 4825 relates to Category No.: 11861; Payload ID: 4826 relates to Category No.: 1405, 926, 5956, 3219, 9939; Payload ID: 4827 relates to Category No.: 1405, 926, 5956, 3219; Payload ID: 4828 relates to Category No.: 926, 6816, 11939, 11933, 5956, 3219, 11861, 3215; Payload ID: 4829 relates to Category No.: 926, 6816, 5956, 3219; Payload ID: 4830 relates to Category No.: 926, 6816, 5956, 3219, 11861; Payload ID: 4831 relates to Category No.: 1405, 926, 5956, 3219, 6816; Payload ID: 4832 relates to Category No.: 926, 5956, 3219, 11861, 6816, 12388, 4897; Payload ID: 4833 relates to Category No.: 926, 6816, 5956, 3219; Payload ID: 4834 relates to Category No.: 926, 6816, 5956, 3219, 11861, 5957, 9925, 327; Payload ID: 4835 relates to Category No.: 926, 6816, 11895, 5956, 3219, 11861, 6217, 3753; Payload ID: 4836 relates to Category No.: 6816, 6206; Payload ID: 4837 relates to Category No.: 6816, 6206; Payload ID: 4838 relates to Category No.: 15542, 15548, 9314, 11861, 3221, 14091, 76; Payload ID: 4839 relates to Category No.: 15542, 15549, 11939, 3221, 14091, 76; Payload ID: 4840 relates to Category No.: 15542, 15549; Payload ID: 4841 relates to Category No.: 267, 12402, 10116, 11861, 14106, 5841, 1201, 11759; Payload ID: 4842 relates to Category No.: 267, 12402, 14106, 1201; Payload ID: 4843 relates to Category No.: 267, 14106, 1201; Payload ID: 4844 relates to Category No.: 11917, 6210, 4117, 6309, 1127; Payload ID: 4845 relates to Category No.: 9518, 9518, 314, 12354, 6400, 9518, 308; Payload ID: 4846 relates to Category No.: 926, 3303, 9226, 6816, 14196, 4965, 3688, 3464, 11920, 11861, 14609, 14137, 3085, 11695, 3688, 11753, 7010; Payload ID: 4847 relates to Category No.: 14564, 4864, 11861, 6337, 2696, 12401; Payload ID: 4850 relates to Category No.: 7192; Payload ID: 4851 relates to Category No.: 14564, 11861; Payload ID: 4852 relates to Category No.: 3303, 15503, 14471, 14471, 14243, 11939, 11933, 15530, 14255; Payload ID: 4853 relates to Category No.: 16331; Payload ID: 4855 relates to Category No.: 11861, 7192; Payload ID: 4856 relates to Category No.: 11861, 1504; Payload ID: 4857 relates to Category No.: 7192; Payload ID: 4858 relates to Category No.: 11861; Payload ID: 4859 relates to Category No.: 14309, 10116, 11861, 15859; Payload ID: 4860 relates to Category No.: 3554, 9518, 7484, 15487, 3501; Payload ID: 4861 relates to Category No.: 7268, 4230, 3471, 3252, 7515, 6895, 7510; Payload ID: 4862 relates to Category No.: 7268, 7510, 3252; Payload ID: 4863 relates to Category No.: 15895, 15542, 15548, 3255; Payload ID: 4864 relates to Category No.: 4207, 9518, 303, 7480, 9518, 3254, 12334, 7472, 6235; Payload ID: 4865 relates to Category No.: 15542, 15548, 11861, 3256, 12334; Payload ID: 4866 relates to Category No.: 15542, 15548, 3257, 4961, 2271, 15542; Payload ID: 4867 relates to Category No.: 9518, 319, 3259, 3471, 4225, 15882; Payload ID: 4868 relates to Category No.: 16331, 5308, 5308, 307, 3260, 9961, 620, 15982, 15396; Payload ID: 4869 relates to Category No.: 5308, 6965, 11861, 5308, 307, 3260, 11981; Payload ID: 4870 relates to Category No.: 5308, 11861, 5308, 307, 14537, 2382; Payload ID: 4871 relates to Category No.: 5308, 11861, 5308, 307; Payload ID: 4872 relates to Category No.: 6965, 5308, 307, 5308, 11861; Payload ID: 4873 relates to Category No.: 6816, 11939, 4207, 5875, 138, 11861, 7510, 9518, 319, 3261; Payload ID: 4874 relates to Category No.: 4207, 15701; Payload ID: 4875 relates to Category No.: 4207, 15701, 1630, 3464, 11861, 11991; Payload ID: 4876 relates to Category No.: 4207, 15701, 6816, 10116; Payload ID: 4877 relates to Category No.: 4207, 15701; Payload ID: 4878 relates to Category No.: 10116, 14299, 14315, 45; Payload ID: 4879 relates to Category No.: 6816, 1630, 3268, 620, 5308; Payload ID: 4880 relates to Category No.: 1630, 11861, 3268, 620; Payload ID: 4881 relates to Category No.: 3554, 9518, 10116, 3269; Payload ID: 4882 relates to Category No.: 6816, 6829, 3275, 16331, 2859, 11861, 6828, 3276, 4796, 6824, 7184; Payload ID: 4883 relates to Category No.: 6816, 3275, 6828, 3276, 3998, 6829; Payload ID: 4884 relates to Category No.: 6816, 3275, 6828, 3276, 11861, 9619; Payload ID: 4885 relates to Category No.: 14506, 11665; Payload ID: 4886 relates to Category No.: 3276, 16331, 6829, 11861; Payload ID: 4887 relates to Category No.: 11939, 14503, 12402, 14506, 11861, 5347, 3276, 11828, 16206; Payload ID: 4888 relates to Category No.: 14506, 11665, 11861; Payload ID: 4889 relates to Category No.: 14506, 3276; Payload ID: 4890 relates to Category No.: 14506, 3276; Payload ID: 4891 relates to Category No.: 637, 14506, 5347; Payload ID: 4892 relates to Category No.: 248, 5511, 5487, 3279, 926, 5484, 5486; Payload ID: 4893 relates to Category No.: 926, 248, 5511, 5487, 3279, 5484, 5486; Payload ID: 4894 relates to Category No.: 11861; Payload ID: 4895 relates to Category No.: 6816, 11861; Payload ID: 4896 relates to Category No.: 6924, 3283; Payload ID: 4897 relates to Category No.: 11861, 3282; Payload ID: 4898 relates to Category No.: 926, 3284; Payload ID: 4899 relates to Category No.: 4886, 4895; Payload ID: 4900 relates to Category No.: 4886; Payload ID: 4901 relates to Category No.: 4886, 4895, 11861; Payload ID: 4902 relates to Category No.: 14196, 3655, 4924, 11861, 97; Payload ID: 4903 relates to Category No.: 6478, 11861, 97, 14134, 10122; Payload ID: 4904 relates to Category No.: 14196, 11861, 97, 3752; Payload ID: 4905 relates to Category No.: 11978, 926, 6816, 15612, 12145, 11861, 12147, 2566; Payload ID: 4906 relates to Category No.: 11978, 926, 15612, 12145, 11861, 12147, 2566; Payload ID: 4907 relates to Category No.: 9356; Payload ID: 4908 relates to Category No.: 11861; Payload ID: 4909 relates to Category No.: 15504, 1630, 11861; Payload ID: 4910 relates to Category No.: 15504, 1630, 7192; Payload ID: 4911 relates to Category No.: 15504, 1630, 7192; Payload ID: 4912 relates to Category No.: 11861, 11920, 11886; Payload ID: 4913 relates to Category No.: 11861; Payload ID: 4914 relates to Category No.: 11861, 1146, 11920; Payload ID: 4915 relates to Category No.: 11861; Payload ID: 4916 relates to Category No.: 9962, 11861; Payload ID: 4917 relates to Category No.: 11895, 7126, 11981, 9962, 5850, 11861, 2936, 9805, 11665, 5841, 4922, 5984, 11890; Payload ID: 4918 relates to Category No.: 5850, 11861, 4922, 5957; Payload ID: 4919 relates to Category No.: 5850, 11861, 4922, 9805, 5957, 15895, 11895, 11920, 9608, 12081; Payload ID: 4920 relates to Category No.: 11895, 2953, 5850, 11861, 4922, 9608, 217, 11886, 5957, 12081, 14377, 8910, 1130, 9537; Payload ID: 4921 relates to Category No.: 11861, 12416, 1153, 2936; Payload ID: 4922 relates to Category No.: 267, 11861, 14106, 5347, 1201; Payload ID: 4923 relates to Category No.: 267, 14106, 1201; Payload ID: 4924 relates to Category No.: 11981, 4291, 11861, 5347, 3752, 12363; Payload ID: 4925 relates to Category No.: 4291, 11861, 5347, 11920, 12107; Payload ID: 4926 relates to Category No.: 11933, 12402, 1153, 4291, 11861, 11828; Payload ID: 4927 relates to Category No.: 1153, 11861, 11983, 3032, 11973; Payload ID: 4928 relates to Category No.: 15504, 1153, 11983, 3032, 11973, 11861; Payload ID: 4929 relates to Category No.: 1153, 11983, 3032, 11973, 11861, 5347; Payload ID: 4930 relates to Category No.: 4964, 11861, 9643; Payload ID: 4931 relates to Category No.: 7192; Payload ID: 4935 relates to Category No.: 11861, 11890, 11886, 5960; Payload ID: 4936 relates to Category No.: 3303, 14471, 14243, 2405; Payload ID: 4937 relates to Category No.: 3303, 15503, 14471, 14471, 11861, 14243, 2405, 15528, 14255, 14602; Payload ID: 4938 relates to Category No.: 3303, 15503, 14471, 14471, 15528, 14233, 2405; Payload ID: 4939 relates to Category No.: 3303, 15503, 14471, 14234, 14471, 11861, 15530, 14233; Payload ID: 4940 relates to Category No.: 3303, 14234, 14471, 15524, 15528, 14233, 11861, 5235; Payload ID: 4941 relates to Category No.: 3303, 15503, 14471, 14471; Payload ID: 4942 relates to Category No.: 3303, 14471; Payload ID: 4943 relates to Category No.: 267, 11861, 4389, 11920; Payload ID: 4944 relates to Category No.: 4894, 6210, 11861, 14536; Payload ID: 4945 relates to Category No.: 6816, 15503, 14471, 11939, 14471, 2690, 11861; Payload ID: 4946 relates to Category No.: 6816, 15503, 14471, 11939, 14471, 2690, 11861, 11933; Payload ID: 4947 relates to Category No.: 6816, 11939, 14471, 11861; Payload ID: 4948 relates to Category No.: 15503, 14471, 11939, 2690; Payload ID: 4949 relates to Category No.: 15503, 14471, 11939, 2690; Payload ID: 4950 relates to Category No.: 6816, 15503, 14471, 11939, 14471, 2690; Payload ID: 4951 relates to Category No.: 11861; Payload ID: 4952 relates to Category No.: 12359, 11861; Payload ID: 4953 relates to Category No.: 15504, 3303, 16331, 2405, 6924, 11861, 3396, 3300, 14196, 6905, 3936, 11920, 3459, 5109, 15977, 3300, 309; Payload ID: 4954 relates to Category No.: 3303, 6816, 6924, 11861, 3396, 5347, 3300, 2405, 15977, 3300, 309; Payload ID: 4955 relates to Category No.: 6816, 6924, 15495, 11861, 3396, 3300, 3303, 2405, 5109, 15977, 3300, 309; Payload ID: 4956 relates to Category No.: 3749, 6816, 11861, 3752; Payload ID: 4957 relates to Category No.: 2963, 153; Payload ID: 4958 relates to Category No.: 2963, 11861, 154, 153; Payload ID: 4959 relates to Category No.: 2963, 3655, 14598, 154, 153; Payload ID: 4961 relates to Category No.: 5308, 3084, 3752, 3303, 11861, 9225; Payload ID: 4962 relates to Category No.: 11861; Payload ID: 4963 relates to Category No.: 926, 3303, 9282, 3459, 14597, 3385, 3640, 11861, 4288, 12434; Payload ID: 4964 relates to Category No.: 15495, 11861, 14244; Payload ID: 4965 relates to Category No.: 3303, 6816, 3390, 9304, 11861, 3346, 3344; Payload ID: 4966 relates to Category No.: 11861, 3306; Payload ID: 4967 relates to Category No.: 14600, 158, 926, 3303, 6816, 942, 4965, 138, 9225, 11861, 3325, 152, 14616, 14801; Payload ID: 4968 relates to Category No.: 894, 11861; Payload ID: 4969 relates to Category No.: 894, 11861; Payload ID: 4970 relates to Category No.: 11861; Payload ID: 4972 relates to Category No.: 3303, 15503, 14471, 14234, 11933, 14471, 15504, 15524, 15495, 11861, 15525, 15528, 14233, 1472, 6127; Payload ID: 4973 relates to Category No.: 37; Payload ID: 4974 relates to Category No.: 11861; Payload ID: 4975 relates to Category No.: 3303, 11917, 14230, 3391; Payload ID: 4976 relates to Category No.: 926, 6816, 4961, 15973, 15895, 4821, 11861, 2271, 5280, 6337, 1358; Payload ID: 4977 relates to Category No.: 926, 6816, 4961, 15973, 11861, 2271, 4710; Payload ID: 4978 relates to Category No.: 926, 6816, 15504, 4961, 15973, 11981, 11861, 2271, 9014, 5608; Payload ID: 4979 relates to Category No.: 926, 6816, 4961, 15973, 11861, 2271; Payload ID: 4980 relates to Category No.: 15973, 11861, 2271, 943, 941, 5280; Payload ID: 4981 relates to Category No.: 15973, 11861; Payload ID: 4983 relates to Category No.: 15973, 7192; Payload ID: 4985 relates to Category No.: 15973, 11861, 2271, 11835, 5280, 10163; Payload ID: 4986 relates to Category No.: 15973, 11861, 2271; Payload ID: 4987 relates to Category No.: 15973, 11861, 2271; Payload ID: 4988 relates to Category No.: 4961, 15973, 11861, 2271, 941, 3303; Payload ID: 4989 relates to Category No.: 2271; Payload ID: 4990 relates to Category No.: 15973, 2271, 11864; Payload ID: 4991 relates to Category No.: 11861, 7017; Payload ID: 4993 relates to Category No.: 3303, 11861, 941, 2271; Payload ID: 4994 relates to Category No.: 11919, 11861, 9518, 303, 3292, 2271, 943, 941, 5280, 3293, 7017; Payload ID: 4995 relates to Category No.: 11861; Payload ID: 4997 relates to Category No.: 11861, 1201; Payload ID: 4999 relates to Category No.: 12142, 11861, 941; Payload ID: 5001 relates to Category No.: 9282, 14196; Payload ID: 5003 relates to Category No.: 12142, 11861, 941; Payload ID: 5004 relates to Category No.: 3303, 2405, 5105, 10116, 15887, 5280, 11861; Payload ID: 5005 relates to Category No.: 16331, 9226, 6816, 10116, 11861; Payload ID: 5006 relates to Category No.: 15973, 2271; Payload ID: 5008 relates to Category No.: 4886, 4895, 11861; Payload ID: 5009 relates to Category No.: 11861; Payload ID: 5010 relates to Category No.: 11861, 11991, 2271, 7017; Payload ID: 5012 relates to Category No.: 15973, 11861; Payload ID: 5013 relates to Category No.: 11861, 4710, 960; Payload ID: 5014 relates to Category No.: 11861; Payload ID: 5016 relates to Category No.: 11861, 12150, 14537; Payload ID: 5017 relates to Category No.: 4961, 11861; Payload ID: 5019 relates to Category No.: 4961; Payload ID: 5020 relates to Category No.: 14564; Payload ID: 5021 relates to Category No.: 9282, 9226, 992, 11861; Payload ID: 5022 relates to Category No.: 2271, 16331; Payload ID: 5023 relates to Category No.: 5538, 11861, 12417; Payload ID: 5024 relates to Category No.: 5538, 12417, 15613; Payload ID: 5025 relates to Category No.: 5538, 11861; Payload ID: 5026 relates to Category No.: 5538, 11861, 12417; Payload ID: 5027 relates to Category No.: 5538, 11861, 12417; Payload ID: 5028 relates to Category No.: 5538, 11861; Payload ID: 5029 relates to Category No.: 11981, 6210, 5538; Payload ID: 5030 relates to Category No.: 11861, 3403; Payload ID: 5031 relates to Category No.: 3410; Payload ID: 5032 relates to Category No.: 3411, 11861, 9361; Payload ID: 5033 relates to Category No.: 15542, 15553, 9956, 15955; Payload ID: 5034 relates to Category No.: 11861, 3416, 3412, 6583, 506; Payload ID: 5035 relates to Category No.: 3755, 11861, 3412; Payload ID: 5036 relates to Category No.: 11861, 3412; Payload ID: 5037 relates to Category No.: 1537, 12292, 11861, 3752, 847, 6093, 11920, 620; Payload ID: 5038 relates to Category No.: 9518, 2672, 3422, 6816; Payload ID: 5039 relates to Category No.: 7223, 1630, 2672, 6049, 9518, 315, 16283, 12443, 680, 3423; Payload ID: 5040 relates to Category No.: 4820, 4810, 11861, 3429, 3424, 3429, 2750, 11933, 12402, 11886, 3471, 12081, 4804, 943, 699, 2955; Payload ID: 5041 relates to Category No.: 4820, 11861, 5347, 11665, 3471, 3424, 3429, 2749, 3429, 11939, 11933, 5850, 12402; Payload ID: 5042 relates to Category No.: 4820, 4810, 11861, 3471, 3429, 2749, 3429, 11920, 3424, 2953; Payload ID: 5043 relates to Category No.: 4820, 4810, 11861, 3429, 5347, 11665, 14537, 3471, 3424, 3429, 2749; Payload ID: 5044 relates to Category No.: 4820, 4810, 3429, 3424, 3429, 2750; Payload ID: 5046 relates to Category No.: 7192; Payload ID: 5047 relates to Category No.: 11861; Payload ID: 5048 relates to Category No.: 3303, 14471; Payload ID: 5049 relates to Category No.: 3303, 15504, 5229, 5209, 11861, 5204; Payload ID: 5050 relates to Category No.: 1405, 1438, 15180, 2491, 11861; Payload ID: 5051 relates to Category No.: 1405, 1438, 11861, 15180; Payload ID: 5052 relates to Category No.: 3303, 15525; Payload ID: 5053 relates to Category No.: 3303; Payload ID: 5054 relates to Category No.: 16331; Payload ID: 5055 relates to Category No.: 1457, 1459, 1443, 6965, 11981, 11861; Payload ID: 5057 relates to Category No.: 11861; Payload ID: 5058 relates to Category No.: 11861; Payload ID: 5060 relates to Category No.: 11978, 926, 12109, 12417; Payload ID: 5061 relates to Category No.: 11978, 926, 12109; Payload ID: 5062 relates to Category No.: 11978, 926, 12109; Payload ID: 5063 relates to Category No.: 6816, 15503, 14471, 11939, 11933, 14471, 2690, 14243, 2405, 15528, 14255; Payload ID: 5064 relates to Category No.: 14471, 6816, 15503, 14471, 11939, 2690, 7192, 14243; Payload ID: 5065 relates to Category No.: 6816, 15503, 14471, 11939, 11933, 14471, 2690, 11861; Payload ID: 5066 relates to Category No.: 11861; Payload ID: 5067 relates to Category No.: 11861, 11939; Payload ID: 5068 relates to Category No.: 12142, 7192; Payload ID: 5069 relates to Category No.: 7192; Payload ID: 5070 relates to Category No.: 11861, 7192; Payload ID: 5071 relates to Category No.: 3303, 11933, 15504, 15495, 15239, 11861; Payload ID: 5072 relates to Category No.: 7192; Payload ID: 5073 relates to Category No.: 11861, 66; Payload ID: 5074 relates to Category No.: 14506; Payload ID: 5075 relates to Category No.: 6598; Payload ID: 5076 relates to Category No.: 6598; Payload ID: 5077 relates to Category No.: 6598; Payload ID: 5078 relates to Category No.: 6598; Payload ID: 5079 relates to Category No.: 5208, 11861; Payload ID: 5080 relates to Category No.: 5208; Payload ID: 5081 relates to Category No.: 11939, 5208, 11861, 5347; Payload ID: 5082 relates to Category No.: 3303, 15503, 14471, 11933, 11861, 15504, 15495; Payload ID: 5083 relates to Category No.: 267, 11861, 11759; Payload ID: 5084 relates to Category No.: 3749, 267, 277, 11861, 11920, 11895; Payload ID: 5085 relates to Category No.: 6816, 14196, 11939, 3464, 10116, 11861, 14137, 6242, 11732, 3688; Payload ID: 5086 relates to Category No.: 11861; Payload ID: 5089 relates to Category No.: 630, 3491, 5308, 311, 3303, 6816; Payload ID: 5090 relates to Category No.: 630, 3491, 11861, 7192, 5308, 311; Payload ID: 5091 relates to Category No.: 9939, 11861, 9874, 9877; Payload ID: 5092 relates to Category No.: 1405, 4976, 9518, 9747, 7510, 7488, 11861; Payload ID: 5093 relates to Category No.: 1405, 4976, 9518, 9747, 7488; Payload ID: 5094 relates to Category No.: 11861; Payload ID: 5096 relates to Category No.: 11978, 926, 12109, 12145, 12114; Payload ID: 5097 relates to Category No.: 12150, 12151, 9804, 11861, 6605, 9097, 4865, 12152; Payload ID: 5098 relates to Category No.: 12150, 12151, 9804, 9962, 6605, 6604; Payload ID: 5099 relates to Category No.: 14196, 12150, 12151, 9804, 10116, 9288, 312, 10143; Payload ID: 5100 relates to Category No.: 12151, 16331, 6816, 12150, 9804, 11861, 5957, 9962; Payload ID: 5101 relates to Category No.: 12150, 12151, 9804, 11861; Payload ID: 5102 relates to Category No.: 12150, 12151, 9804, 10116, 11861, 6605; Payload ID: 5103 relates to Category No.: 12151, 11861, 12150, 9804; Payload ID: 5104 relates to Category No.: 12150, 12151, 9804, 9962, 6605, 11861; Payload ID: 5105 relates to Category No.: 12151, 12150, 9804, 6605; Payload ID: 5106 relates to Category No.: 12150, 12151, 9804, 6610, 11861, 11991, 11977, 7127, 5917, 12152; Payload ID: 5107 relates to Category No.: 12150, 12151, 9804, 11861, 6605, 12152, 7125, 9962; Payload ID: 5108 relates to Category No.: 12150, 12151, 9804, 11861, 6605; Payload ID: 5109 relates to Category No.: 12151, 9804, 12150, 11861; Payload ID: 5110 relates to Category No.: 12150, 12151, 9804, 12111, 11861; Payload ID: 5111 relates to Category No.: 12150, 12151, 9539, 9804, 9962, 11861, 9986, 14229; Payload ID: 5112 relates to Category No.: 12151, 9804; Payload ID: 5113 relates to Category No.: 12150, 12151, 9804; Payload ID: 5114 relates to Category No.: 12150, 12151, 9804, 11981, 6604, 9962; Payload ID: 5115 relates to Category No.: 12150, 12151, 9804, 6605, 12152; Payload ID: 5116 relates to Category No.: 12150, 12151, 9804, 11861, 6605; Payload ID: 5117 relates to Category No.: 12150, 12151, 9804, 6605, 11861, 9962; Payload ID: 5118 relates to Category No.: 12150, 12151, 9804, 11861, 6605; Payload ID: 5119 relates to Category No.: 12150, 12151, 9804, 6605; Payload ID: 5120 relates to Category No.: 12150, 12151, 9804, 9962, 11861, 6605; Payload ID: 5121 relates to Category No.: 12150, 12151, 9804; Payload ID: 5122 relates to Category No.: 11978, 926, 12109, 9096, 12145, 11861, 12114, 15230, 12107, 5956, 5347; Payload ID: 5123 relates to Category No.: 11978, 926, 12109, 15491, 12145, 11861, 12114; Payload ID: 5124 relates to Category No.: 11978, 926, 6478, 12109, 12145, 11861, 15887, 6574, 12114; Payload ID: 5125 relates to Category No.: 11978, 926, 6478, 12109, 12145, 12114, 11861; Payload ID: 5126 relates to Category No.: 11978, 926, 6816, 12109, 12145, 11861, 12114; Payload ID: 5127 relates to Category No.: 11861, 3752; Payload ID: 5128 relates to Category No.: 7249, 11861; Payload ID: 5129 relates to Category No.: 7249, 11861, 14812; Payload ID: 5130 relates to Category No.: 15029, 11861; Payload ID: 5131 relates to Category No.: 11861, 12064; Payload ID: 5132 relates to Category No.: 11861; Payload ID: 5134 relates to Category No.: 11861; Payload ID: 5135 relates to Category No.: 4886, 4895, 11981, 10116, 11861, 5347, 11917, 11895, 11886, 9060, 2954; Payload ID: 5136 relates to Category No.: 4886, 11939, 4895, 15895, 6210, 11861, 5347; Payload ID: 5137 relates to Category No.: 4886, 4895, 6965, 11861, 3752, 14537, 11981, 11886, 9060, 16296, 9853, 2954; Payload ID: 5138 relates to Category No.: 4886, 4895, 11861, 9060, 15789, 15802; Payload ID: 5139 relates to Category No.: 14107, 4924, 11861; Payload ID: 5140 relates to Category No.: 11861; Payload ID: 5141 relates to Category No.: 6974; Payload ID: 5143 relates to Category No.: 11861; Payload ID: 5144 relates to Category No.: 11861; Payload ID: 5145 relates to Category No.: 11861, 3508; Payload ID: 5146 relates to Category No.: 11861; Payload ID: 5148 relates to Category No.: 11861, 3512, 1201; Payload ID: 5149 relates to Category No.: 926, 6974, 942; Payload ID: 5150 relates to Category No.: 926, 6974, 942; Payload ID: 5152 relates to Category No.: 926, 6974, 942; Payload ID: 5153 relates to Category No.: 926, 6974, 942; Payload ID: 5154 relates to Category No.: 926, 6974; Payload ID: 5155 relates to Category No.: 6974, 926, 942, 11861; Payload ID: 5156 relates to Category No.: 926, 6974, 942; Payload ID: 5157 relates to Category No.: 926, 6974; Payload ID: 5158 relates to Category No.: 926, 6974, 942; Payload ID: 5159 relates to Category No.: 926, 6974, 942; Payload ID: 5160 relates to Category No.: 1405, 926, 6974, 942; Payload ID: 5161 relates to Category No.: 926, 6974, 942; Payload ID: 5162 relates to Category No.: 926, 6974, 942, 7249; Payload ID: 5163 relates to Category No.: 7249, 11861; Payload ID: 5164 relates to Category No.: 6974, 11861; Payload ID: 5165 relates to Category No.: 11861; Payload ID: 5166 relates to Category No.: 7249, 11861; Payload ID: 5167 relates to Category No.: 6974, 11861, 3511; Payload ID: 5168 relates to Category No.: 926, 6974, 942, 10116, 11861, 3514; Payload ID: 5169 relates to Category No.: 6974, 7249, 6965, 11861, 14812; Payload ID: 5170 relates to Category No.: 6974, 11861, 11886; Payload ID: 5171 relates to Category No.: 926, 6974, 10116, 11861; Payload ID: 5172 relates to Category No.: 926, 6974, 11861; Payload ID: 5173 relates to Category No.: 926, 6974, 942, 7249; Payload ID: 5174 relates to Category No.: 7249, 11861, 3511; Payload ID: 5175 relates to Category No.: 7249, 11861, 11920, 11895, 11939, 3752, 9062; Payload ID: 5176 relates to Category No.: 7249, 11861, 2936; Payload ID: 5177 relates to Category No.: 6974, 11861; Payload ID: 5178 relates to Category No.: 11861, 6974; Payload ID: 5179 relates to Category No.: 7249, 11861, 5347; Payload ID: 5180 relates to Category No.: 7249, 11861, 5347; Payload ID: 5182 relates to Category No.: 11861; Payload ID: 5183 relates to Category No.: 1405, 1438, 9939, 11861; Payload ID: 5184 relates to Category No.: 14196, 12223, 10116, 11861, 15250, 15270; Payload ID: 5185 relates to Category No.: 11861, 3936; Payload ID: 5186 relates to Category No.: 1405, 267, 11939, 11895, 5588, 11861, 6979, 942, 6965, 2936; Payload ID: 5187 relates to Category No.: 11861; Payload ID: 5188 relates to Category No.: 16331, 11861, 9608; Payload ID: 5189 relates to Category No.: 16331, 11861; Payload ID: 5190 relates to Category No.: 1405, 267, 11861, 14536, 15766, 15024, 16184, 16206, 6027, 566, 11886, 3516; Payload ID: 5191 relates to Category No.: 11861, 7192; Payload ID: 5192 relates to Category No.: 11978, 926, 6816, 12109, 11861, 7408, 4961; Payload ID: 5193 relates to Category No.: 16331, 3516, 267, 15021, 11861, 7393, 15024, 16184, 9060; Payload ID: 5194 relates to Category No.: 16331, 11861; Payload ID: 5195 relates to Category No.: 16331; Payload ID: 5196 relates to Category No.: 3303, 16331, 2405, 11895, 15504, 2963, 15491, 15542, 15548, 1153, 11861, 5096, 15493, 2688, 9173, 246, 14229, 686, 327, 6425, 304, 9539, 15528, 14255, 14252, 14237, 2406, 11704; Payload ID: 5197 relates to Category No.: 926, 3303, 4965, 11861, 2405, 11855; Payload ID: 5198 relates to Category No.: 3303, 15503, 14471, 14471, 15504, 11861, 2688, 15524, 11981; Payload ID: 5199 relates to Category No.: 15503, 14471; Payload ID: 5200 relates to Category No.: 15503, 14471, 11861, 2688, 3303; Payload ID: 5201 relates to Category No.: 3303, 15503, 14471, 14234, 15504, 11920, 11861, 15528, 14233, 15528, 14255; Payload ID: 5202 relates to Category No.: 3303, 15503, 14471, 15504, 11861; Payload ID: 5203 relates to Category No.: 15503, 14471, 15495, 11861, 3303; Payload ID: 5204 relates to Category No.: 15503, 14471, 15495, 11861, 2688, 5347, 14243, 15530, 14255, 3303; Payload ID: 5205 relates to Category No.: 15503, 14471, 14234, 15495, 11861, 2688, 15530, 14233, 3303, 5347, 11939; Payload ID: 5207 relates to Category No.: 3303, 6816, 15503, 14471, 1471, 15491, 6188, 15495, 14243, 15530, 14255, 11861, 9226; Payload ID: 5208 relates to Category No.: 15503, 14471, 14234, 14471, 11861, 15528, 14233; Payload ID: 5209 relates to Category No.: 15503, 14471, 14471, 14251, 14471, 11861; Payload ID: 5210 relates to Category No.: 15503, 14471, 14471, 14251, 14471, 15491, 11861, 15528, 14233, 3303, 14234; Payload ID: 5211 relates to Category No.: 15503, 14471, 14234, 14471, 11861, 15528, 14233; Payload ID: 5212 relates to Category No.: 15503, 14471, 14471, 14251, 14471, 14243, 15528, 14255; Payload ID: 5213 relates to Category No.: 6816, 11917, 11861, 15528, 14233, 3303, 15503, 14471, 14234, 1356; Payload ID: 5214 relates to Category No.: 6816, 11917, 11861, 15528, 14233, 3303, 2405, 14234; Payload ID: 5215 relates to Category No.: 6816, 11917, 11861, 15528, 14233, 14234, 3303; Payload ID: 5216 relates to Category No.: 3303, 11861, 6816, 11917, 15528, 14233, 14243, 15504, 15528, 14255; Payload ID: 5217 relates to Category No.: 16331, 6816, 11939, 1457, 56, 11861, 4899; Payload ID: 5218 relates to Category No.: 3303, 6816, 15503, 14471, 14471, 14243, 11861, 15525, 5101, 15528, 14233, 15524, 15503, 14233; Payload ID: 5219 relates to Category No.: 6816, 15503, 14471, 14234, 2405, 15524, 15895, 6188, 11861, 15528, 14233, 14229, 3303, 5235; Payload ID: 5220 relates to Category No.: 3303, 6816, 15503, 14471; Payload ID: 5221 relates to Category No.: 9226, 6816, 15503, 14471, 3303; Payload ID: 5222 relates to Category No.: 10116; Payload ID: 5223 relates to Category No.: 15491, 11861; Payload ID: 5224 relates to Category No.: 11861, 1405, 6965, 15766; Payload ID: 5225 relates to Category No.: 11861, 6965, 15766, 11895, 12402; Payload ID: 5226 relates to Category No.: 11861; Payload ID: 5227 relates to Category No.: 11861, 7192; Payload ID: 5228 relates to Category No.: 1630, 11861, 7192; Payload ID: 5229 relates to Category No.: 11861; Payload ID: 5230 relates to Category No.: 15617; Payload ID: 5232 relates to Category No.: 4894, 12359, 11861; Payload ID: 5233 relates to Category No.: 4894, 12359, 11861; Payload ID: 5234 relates to Category No.: 9518, 314, 11861; Payload ID: 5235 relates to Category No.: 267, 11861; Payload ID: 5236 relates to Category No.: 12402, 15777, 11861; Payload ID: 5237 relates to Category No.: 15617, 12399, 11861; Payload ID: 5238 relates to Category No.: 12399, 11861, 15781; Payload ID: 5239 relates to Category No.: 9282, 9226, 9518, 11861; Payload ID: 5240 relates to Category No.: 9282, 9226, 11919, 11861; Payload ID: 5241 relates to Category No.: 926, 5308, 11861; Payload ID: 5242 relates to Category No.: 926, 5308, 11861; Payload ID: 5243 relates to Category No.: 926, 5308, 11861, 9268, 9269, 942, 5347, 424; Payload ID: 5244 relates to Category No.: 926, 5308, 11861, 9268, 9269; Payload ID: 5245 relates to Category No.: 5308, 16016; Payload ID: 5246 relates to Category No.: 5308, 11861, 16016, 4914; Payload ID: 5247 relates to Category No.: 5308, 16016, 4913, 9268, 9269; Payload ID: 5248 relates to Category No.: 6816, 5308; Payload ID: 5249 relates to Category No.: 926, 6816, 5308, 9268, 9269; Payload ID: 5250 relates to Category No.: 1405, 926, 16331, 9226, 6816, 5308, 11939, 14379, 1630, 5538, 11861, 10154, 9908, 9285, 7507, 9270, 126; Payload ID: 5251 relates to Category No.: 1405, 16331, 9226, 6816, 5308, 15504, 14379, 1630, 10154, 9908, 9285, 6434, 535; Payload ID: 5252 relates to Category No.: 9226, 6816, 5308, 14379, 1630, 10154, 9908, 9285, 7507, 9270; Payload ID: 5253 relates to Category No.: 6816, 1630, 1220; Payload ID: 5254 relates to Category No.: 6816, 5308, 1630; Payload ID: 5255 relates to Category No.: 1630, 9974, 4648, 4650; Payload ID: 5256 relates to Category No.: 1630, 14871; Payload ID: 5258 relates to Category No.: 11861; Payload ID: 5259 relates to Category No.: 15590, 4619; Payload ID: 5260 relates to Category No.: 1405; Payload ID: 5261 relates to Category No.: 1405; Payload ID: 5262 relates to Category No.: 1405; Payload ID: 5263 relates to Category No.: 1405; Payload ID: 5264 relates to Category No.: 1405, 11861; Payload ID: 5266 relates to Category No.: 1405; Payload ID: 5267 relates to Category No.: 1405; Payload ID: 5268 relates to Category No.: 1405; Payload ID: 5269 relates to Category No.: 1405; Payload ID: 5270 relates to Category No.: 1405; Payload ID: 5271 relates to Category No.: 1405; Payload ID: 5272 relates to Category No.: 1405, 11861; Payload ID: 5273 relates to Category No.: 1405; Payload ID: 5274 relates to Category No.: 1405, 11895, 11861; Payload ID: 5275 relates to Category No.: 1405, 11861; Payload ID: 5276 relates to Category No.: 1405; Payload ID: 5277 relates to Category No.: 1405; Payload ID: 5278 relates to Category No.: 1405, 11861; Payload ID: 5279 relates to Category No.: 1201; Payload ID: 5280 relates to Category No.: 1201; Payload ID: 5281 relates to Category No.: 1405, 4864, 11861, 3774, 3777; Payload ID: 5282 relates to Category No.: 1405, 4023, 11861; Payload ID: 5283 relates to Category No.: 15542, 15553, 12060; Payload ID: 5284 relates to Category No.: 1405, 5588, 11861; Payload ID: 5285 relates to Category No.: 1405, 11861, 4720; Payload ID: 5286 relates to Category No.: 1405, 5588, 11861; Payload ID: 5287 relates to Category No.: 1405, 11861, 9122; Payload ID: 5288 relates to Category No.: 1405, 11861; Payload ID: 5289 relates to Category No.: 5865, 9518, 9518, 315, 16283, 9518, 315, 16283, 83, 679, 6049, 11861, 3752, 9700, 9701; Payload ID: 5290 relates to Category No.: 5865, 9518, 9518, 315, 16283, 9518, 315, 16283, 83, 679, 6049, 11861, 4158, 9700, 9527, 9701; Payload ID: 5291 relates to Category No.: 5865, 9518, 9518, 315, 16283, 9518, 315, 16283, 83, 679, 6049, 11861, 9700; Payload ID: 5292 relates to Category No.: 11861; Payload ID: 5293 relates to Category No.: 11861, 7192; Payload ID: 5294 relates to Category No.: 1405, 926, 4886, 12359, 11861; Payload ID: 5295 relates to Category No.: 1405, 926, 9226, 4886, 5308, 11861, 11920; Payload ID: 5296 relates to Category No.: 1405, 926, 9226, 4886, 11861; Payload ID: 5297 relates to Category No.: 1405, 926, 9226, 4886, 11861; Payload ID: 5298 relates to Category No.: 134, 6816, 3688, 11753; Payload ID: 5299 relates to Category No.: 6816, 10116, 134; Payload ID: 5300 relates to Category No.: 14503, 9619, 5009, 3663, 11861, 14249, 11828, 2875; Payload ID: 5301 relates to Category No.: 4023, 11861, 4016, 4018; Payload ID: 5302 relates to Category No.: 11861, 5347, 4018; Payload ID: 5303 relates to Category No.: 11861, 4018; Payload ID: 5304 relates to Category No.: 11861; Payload ID: 5305 relates to Category No.: 9282, 9226, 14196, 10116, 11861, 7265; Payload ID: 5306 relates to Category No.: 9282, 9226, 14196, 992; Payload ID: 5307 relates to Category No.: 9282, 9226, 14196, 7265, 992, 7268; Payload ID: 5308 relates to Category No.: 9282, 9226, 14196, 11981, 3464, 10116, 7268, 11861, 7265, 992, 7264; Payload ID: 5309 relates to Category No.: 3554, 4207, 9518, 387, 4117, 9518, 319, 16281, 11861; Payload ID: 5310 relates to Category No.: 3554; Payload ID: 5311 relates to Category No.: 6816, 3554, 4207, 9518, 138, 12352, 15882, 3557, 9518, 9517, 5875; Payload ID: 5312 relates to Category No.: 15590, 6816; Payload ID: 5313 relates to Category No.: 15503, 14471, 14234, 14471, 11861, 15528, 14233, 3459, 2405, 2688; Payload ID: 5314 relates to Category No.: 15503, 14471, 14234, 14471, 15495, 11861, 15528, 14233, 12269, 3303; Payload ID: 5315 relates to Category No.: 3303, 15503, 14471, 2405, 14471, 14251, 14471, 11861, 15493, 2688; Payload ID: 5316 relates to Category No.: 12359, 11861, 9608, 6127; Payload ID: 5317 relates to Category No.: 11861; Payload ID: 5318 relates to Category No.: 11861; Payload ID: 5319 relates to Category No.: 14243, 11861, 15528, 14255; Payload ID: 5320 relates to Category No.: 11861; Payload ID: 5321 relates to Category No.: 11861; Payload ID: 5322 relates to Category No.: 3303; Payload ID: 5323 relates to Category No.: 4894; Payload ID: 5324 relates to Category No.: 4894; Payload ID: 5325 relates to Category No.: 4894, 11861; Payload ID: 5326 relates to Category No.: 11861, 9805; Payload ID: 5327 relates to Category No.: 3731, 11861; Payload ID: 5328 relates to Category No.: 4886, 4895, 14176; Payload ID: 5329 relates to Category No.: 4886, 4895, 10116, 11861; Payload ID: 5331 relates to Category No.: 5105, 11861, 14232, 15530, 14252, 11981; Payload ID: 5332 relates to Category No.: 6816, 7462, 5875, 1630, 11861, 14232, 4930, 9980, 4927; Payload ID: 5333 relates to Category No.: 11861, 5096, 14232, 9980; Payload ID: 5334 relates to Category No.: 11861; Payload ID: 5335 relates to Category No.: 7192; Payload ID: 5336 relates to Category No.: 11861, 4106; Payload ID: 5337 relates to Category No.: 11861, 4106, 15542, 15549; Payload ID: 5338 relates to Category No.: 15542, 11861; Payload ID: 5339 relates to Category No.: 15542, 11861, 4817; Payload ID: 5340 relates to Category No.: 11861, 4106, 15542; Payload ID: 5341 relates to Category No.: 11861, 15542, 15549, 15542; Payload ID: 5342 relates to Category No.: 15542, 11861; Payload ID: 5343 relates to Category No.: 11861; Payload ID: 5344 relates to Category No.: 11920, 11861, 14537; Payload ID: 5345 relates to Category No.: 11861, 5347, 5204, 2405; Payload ID: 5346 relates to Category No.: 267, 11861, 1173; Payload ID: 5347 relates to Category No.: 14196, 14309, 6924, 10116, 11861, 14304; Payload ID: 5348 relates to Category No.: 11861; Payload ID: 5349 relates to Category No.: 15617, 2341, 3476, 14965, 1364; Payload ID: 5350 relates to Category No.: 2341; Payload ID: 5351 relates to Category No.: 3303, 14471, 11861; Payload ID: 5352 relates to Category No.: 3303, 14471, 11861; Payload ID: 5353 relates to Category No.: 267, 11861, 16296, 14537; Payload ID: 5354 relates to Category No.: 267, 11861, 14537, 11759; Payload ID: 5356 relates to Category No.: 9225, 9226, 6816, 5308, 3655; Payload ID: 5357 relates to Category No.: 6594; Payload ID: 5360 relates to Category No.: 7192; Payload ID: 5367 relates to Category No.: 11939, 15617, 11861, 15561, 4351, 15820, 368, 1253, 15826, 4720, 15572, 15562, 2898; Payload ID: 5369 relates to Category No.: 9226, 6816, 5308, 3655; Payload ID: 5370 relates to Category No.: 9226, 6816, 5308, 3655, 9225, 11861, 3084; Payload ID: 5371 relates to Category No.: 3655, 6478, 3640, 11753, 14602, 15031, 3688, 11753; Payload ID: 5372 relates to Category No.: 14196, 4864, 14379, 3688, 14506, 10154, 5308, 311, 6574; Payload ID: 5373 relates to Category No.: 3303; Payload ID: 5374 relates to Category No.: 16331, 637, 6829, 11861, 9629, 6828, 5708, 6821, 5613, 15825, 9619, 15777; Payload ID: 5375 relates to Category No.: 16331, 637, 6829, 9629, 6821; Payload ID: 5376 relates to Category No.: 15973, 11861, 4710; Payload ID: 5377 relates to Category No.: 6816, 6829; Payload ID: 5378 relates to Category No.: 9518, 11918, 11861, 9518, 303, 3292, 11919; Payload ID: 5379 relates to Category No.: 9518, 15973, 11918, 11861, 9518, 303, 3292, 11919; Payload ID: 5380 relates to Category No.: 11861; Payload ID: 5381 relates to Category No.: 11939, 11861, 2271; Payload ID: 5382 relates to Category No.: 11918, 11861; Payload ID: 5383 relates to Category No.: 11978, 926, 6478, 11939, 12109, 3688, 11861, 5347, 3752, 456, 14134, 5282, 5280, 3655; Payload ID: 5384 relates to Category No.: 11978, 926, 11861, 14134, 6478, 3655, 12109; Payload ID: 5385 relates to Category No.: 11861; Payload ID: 5386 relates to Category No.: 12402, 12088, 12082, 9806, 5843, 11664, 12077; Payload ID: 5387 relates to Category No.: 11861; Payload ID: 5390 relates to Category No.: 5588, 5547, 5021; Payload ID: 5391 relates to Category No.: 3303, 14471, 15491, 1457, 10116, 11861; Payload ID: 5392 relates to Category No.: 11917, 14251, 14471, 3303, 11933, 14471, 15504, 11861, 5101, 15528, 14233, 15503, 14471; Payload ID: 5393 relates to Category No.: 5259, 2874, 11861, 3720, 3721, 12402; Payload ID: 5394 relates to Category No.: 5259, 3721; Payload ID: 5395 relates to Category No.: 5259, 12402, 3721; Payload ID: 5396 relates to Category No.: 6816, 11939, 6825, 3663, 11861, 9636; Payload ID: 5397 relates to Category No.: 6816, 6825, 6924, 11861; Payload ID: 5398 relates to Category No.: 6825, 6816, 6829; Payload ID: 5399 relates to Category No.: 9868, 4820, 11861, 3723; Payload ID: 5400 relates to Category No.: 4820, 11861, 3723, 9636, 15784; Payload ID: 5402 relates to Category No.: 3303, 14234, 14471, 15530, 14233, 11861; Payload ID: 5403 relates to Category No.: 3303, 14471; Payload ID: 5404 relates to Category No.: 11861, 14537, 1201; Payload ID: 5405 relates to Category No.: 11861, 14537, 12425, 1201; Payload ID: 5406 relates to Category No.: 1201, 11861, 14537; Payload ID: 5407 relates to Category No.: 14196, 11861, 5347, 9907; Payload ID: 5408 relates to Category No.: 11861; Payload ID: 5409 relates to Category No.: 11861, 5096; Payload ID: 5411 relates to Category No.: 10116, 11861; Payload ID: 5412 relates to Category No.: 2405, 15491, 6185; Payload ID: 5413 relates to Category No.: 5229, 11861, 2405; Payload ID: 5414 relates to Category No.: 5229, 3303, 2405, 11861, 2688, 2406, 5204, 12181, 5206, 14196, 14471, 14147, 13683; Payload ID: 5415 relates to Category No.: 11861; Payload ID: 5416 relates to Category No.: 1457, 14537, 11861; Payload ID: 5417 relates to Category No.: 3303, 15503, 14471, 6478, 15495, 9963, 10116, 11861, 4896; Payload ID: 5418 relates to Category No.: 6478, 9963; Payload ID: 5419 relates to Category No.: 6478, 9963, 11861, 11939, 11933; Payload ID: 5420 relates to Category No.: 6478, 9963, 7192; Payload ID: 5421 relates to Category No.: 6478, 5892, 6164, 1630; Payload ID: 5422 relates to Category No.: 5308, 6478, 255; Payload ID: 5423 relates to Category No.: 1630, 12402, 11861, 5892; Payload ID: 5424 relates to Category No.: 6401, 1630; Payload ID: 5425 relates to Category No.: 1630; Payload ID: 5426 relates to Category No.: 1630, 11861, 3736; Payload ID: 5427 relates to Category No.: 1630, 3401, 5803, 5347, 5892; Payload ID: 5428 relates to Category No.: 1630, 12402, 4117, 3401, 5803, 15631; Payload ID: 5429 relates to Category No.: 1630; Payload ID: 5430 relates to Category No.: 9518, 1630, 12402, 108, 11861, 3752, 3401, 3736; Payload ID: 5433 relates to Category No.: 15029, 5728, 11861, 1327; Payload ID: 5434 relates to Category No.: 15029, 5728; Payload ID: 5435 relates to Category No.: 3303, 15503, 14471, 14471, 15530, 14252, 14229, 14243, 2405; Payload ID: 5436 relates to Category No.: 6816, 4976, 9747; Payload ID: 5437 relates to Category No.: 15495, 11861, 5101, 5103; Payload ID: 5438 relates to Category No.: 14652, 11861; Payload ID: 5440 relates to Category No.: 11861, 5347; Payload ID: 5441 relates to Category No.: 11861; Payload ID: 5442 relates to Category No.: 1405; Payload ID: 5443 relates to Category No.: 11978, 926, 11981, 12145, 3764, 11861, 15621; Payload ID: 5444 relates to Category No.: 11978, 926, 11861, 3764, 15621; Payload ID: 5445 relates to Category No.: 11978, 926, 15612, 12145, 3764, 11861; Payload ID: 5446 relates to Category No.: 11978, 926, 12145, 3764, 11861, 4802; Payload ID: 5447 relates to Category No.: 11978, 926, 12145, 3764, 11861, 15621, 4802, 9771, 3213, 5347, 3765; Payload ID: 5448 relates to Category No.: 11978, 926, 12145, 3764, 11861, 15621, 4802; Payload ID: 5449 relates to Category No.: 926, 3764, 11861, 11978, 12145, 7192; Payload ID: 5450 relates to Category No.: 11978, 926, 12145, 3764, 11861, 2305, 4802, 1027, 3765; Payload ID: 5451 relates to Category No.: 926, 3764, 11861, 4802, 11978, 12145; Payload ID: 5452 relates to Category No.: 926, 3764, 11978, 12145, 11861, 15621; Payload ID: 5453 relates to Category No.: 11978, 926, 12145, 3764, 11861, 15621; Payload ID: 5454 relates to Category No.: 11978, 926, 12145, 3764, 11861, 1027; Payload ID: 5455 relates to Category No.: 11978, 926, 12145, 3764, 11861, 15612; Payload ID: 5456 relates to Category No.: 11978, 926, 3764, 11861; Payload ID: 5457 relates to Category No.: 12402, 11861, 3765; Payload ID: 5458 relates to Category No.: 11861, 3765; Payload ID: 5459 relates to Category No.: 11861, 3765, 15621; Payload ID: 5460 relates to Category No.: 11861, 3765, 15621; Payload ID: 5461 relates to Category No.: 8990, 15611, 3765, 8989, 8991, 11861, 2305; Payload ID: 5462 relates to Category No.: 11861, 3765; Payload ID: 5463 relates to Category No.: 11861, 16206, 3765, 12402; Payload ID: 5464 relates to Category No.: 16206, 3765, 15621; Payload ID: 5465 relates to Category No.: 1405, 4864, 11861, 3774, 15611; Payload ID: 5466 relates to Category No.: 11978, 926, 15612, 12145, 12421, 11933, 2405, 3459, 15895, 15617, 6602, 277, 11861, 5347, 3752, 12081, 3777, 9062, 14564, 5956; Payload ID: 5467 relates to Category No.: 1405, 11861, 14537, 10163, 5347; Payload ID: 5468 relates to Category No.: 1405, 11861; Payload ID: 5469 relates to Category No.: 267, 11861, 14580, 12363, 14538; Payload ID: 5470 relates to Category No.: 14504, 9620, 11861; Payload ID: 5472 relates to Category No.: 11861, 7192; Payload ID: 5474 relates to Category No.: 12151, 9886, 12150, 1504, 9804, 12111, 11861, 14938, 1513; Payload ID: 5475 relates to Category No.: 5009, 11861, 4720; Payload ID: 5477 relates to Category No.: 4864, 11861, 3774; Payload ID: 5478 relates to Category No.: 11861, 11886, 1370; Payload ID: 5479 relates to Category No.: 14564, 11939, 4894, 14107, 4924, 11861, 14106; Payload ID: 5480 relates to Category No.: 14107, 11861; Payload ID: 5481 relates to Category No.: 11861; Payload ID: 5482 relates to Category No.: 5588, 11981, 11861, 5957; Payload ID: 5483 relates to Category No.: 11861; Payload ID: 5484 relates to Category No.: 4864, 11861, 3774; Payload ID: 5485 relates to Category No.: 9282, 9226, 7268, 11861; Payload ID: 5486 relates to Category No.: 9282, 9226, 10116, 7268;

Payload ID: 5488 relates to Category No.: 11861; Payload ID: 5489 relates to Category No.: 3821, 2478; Payload ID: 5490 relates to Category No.: 5308, 6478, 11939, 12402, 9804, 6224, 15468, 3821, 31, 1630; Payload ID: 5491 relates to Category No.: 7192, 3821; Payload ID: 5492 relates to Category No.: 3821; Payload ID: 5493 relates to Category No.: 14504, 9620, 11861; Payload ID: 5494 relates to Category No.: 11861, 267, 14107, 12364, 15205, 5956; Payload ID: 5495 relates to Category No.: 11861, 267, 14107, 12364; Payload ID: 5496 relates to Category No.: 11861; Payload ID: 5497 relates to Category No.: 6210, 11861; Payload ID: 5498 relates to Category No.: 6210, 11861; Payload ID: 5499 relates to Category No.: 6210, 11861, 3545; Payload ID: 5500 relates to Category No.: 2881, 2874, 11861, 5682; Payload ID: 5501 relates to Category No.: 11861; Payload ID: 5502 relates to Category No.: 1405, 6595, 11861, 7017, 4710; Payload ID: 5503 relates to Category No.: 1405, 6595, 4710; Payload ID: 5504 relates to Category No.: 1405, 6595, 4713; Payload ID: 5505 relates to Category No.: 11861, 2346; Payload ID: 5506 relates to Category No.: 15895, 11861, 2346; Payload ID: 5509 relates to Category No.: 11861; Payload ID: 5510 relates to Category No.: 7192; Payload ID: 5512 relates to Category No.: 11861; Payload ID: 5513 relates to Category No.: 1504; Payload ID: 5515 relates to Category No.: 11861; Payload ID: 5517 relates to Category No.: 14196, 14309, 4886, 10116, 11861, 14170; Payload ID: 5518 relates to Category No.: 4894, 11981, 11861, 5957, 14537, 14660; Payload ID: 5519 relates to Category No.: 15021, 12402, 5588, 11861, 3839; Payload ID: 5520 relates to Category No.: 11978, 926, 11933, 11895, 11917, 15612, 15617, 12145, 12421, 11861, 5347, 12081, 4865, 14221, 3842; Payload ID: 5521 relates to Category No.: 11978, 926, 11939, 11933, 15612, 15617, 12144, 12421, 11861, 5347, 4865, 12145; Payload ID: 5522 relates to Category No.: 11978, 926, 11939, 15612, 15524, 12145, 12421, 11861, 3774; Payload ID: 5525 relates to Category No.: 11861; Payload ID: 5527 relates to Category No.: 16331, 9226, 97; Payload ID: 5528 relates to Category No.: 9226, 97, 6816, 10116, 11861; Payload ID: 5529 relates to Category No.: 277, 267; Payload ID: 5530 relates to Category No.: 11861; Payload ID: 5531 relates to Category No.: 267, 15021, 15029, 1457, 56, 11861, 2936, 14812; Payload ID: 5532 relates to Category No.: 2936, 7192; Payload ID: 5533 relates to Category No.: 15021, 2936, 11861; Payload ID: 5534 relates to Category No.: 2936, 11861, 11920; Payload ID: 5535 relates to Category No.: 267, 15029, 2936, 11861; Payload ID: 5536 relates to Category No.: 267, 15029, 2936, 11861, 9771; Payload ID: 5537 relates to Category No.: 267, 15021, 15029, 11861, 2936; Payload ID: 5538 relates to Category No.: 926, 15021, 12173, 11861; Payload ID: 5539 relates to Category No.: 11861; Payload ID: 5540 relates to Category No.: 5259, 11861, 3859, 11977; Payload ID: 5541 relates to Category No.: 2881, 15617, 11861, 5347, 3858; Payload ID: 5542 relates to Category No.: 4886; Payload ID: 5543 relates to Category No.: 10116; Payload ID: 5544 relates to Category No.: 267, 277, 11861, 14537; Payload ID: 5545 relates to Category No.: 11861; Payload ID: 5546 relates to Category No.: 3303, 6816, 3655, 9225, 11861; Payload ID: 5547 relates to Category No.: 3303, 3655, 9225; Payload ID: 5548 relates to Category No.: 6816, 15542, 15548; Payload ID: 5549 relates to Category No.: 6816, 6425, 304; Payload ID: 5550 relates to Category No.: 1536, 11861, 5308, 311, 14535, 6925; Payload ID: 5551 relates to Category No.: 3303, 14961, 3935, 16331, 15503, 14471, 14234, 2405, 14471, 15504, 1153, 14968, 11861, 2691, 5347, 15528, 14233, 3752, 943, 3937, 9062, 14251, 3938, 14251, 6183, 11886, 5260, 15492, 15789, 9853; Payload ID: 5552 relates to Category No.: 3303, 16331, 15503, 14471, 14471, 14961, 14968, 3935, 15491, 14251, 6183, 11861, 2691, 3752, 3937, 12401, 3471, 5260, 9763, 14966, 3931; Payload ID: 5553 relates to Category No.: 9618, 11861; Payload ID: 5554 relates to Category No.: 3303, 16331, 15503, 14471, 14471, 14961, 14968, 14251, 6183, 11920, 11861, 15528, 14233, 15530, 14233, 14234; Payload ID: 5555 relates to Category No.: 3303, 16331, 15503, 14471, 14471, 14961, 14968, 15504, 15491, 14251, 6183, 14240; Payload ID: 5556 relates to Category No.: 3303, 16331, 15503, 14471, 14471, 14961, 14968, 11861, 14081, 488, 14243, 15528, 14255; Payload ID: 5557 relates to Category No.: 3303, 14471, 14243, 15530, 14255; Payload ID: 5558 relates to Category No.: 926, 11861, 3945; Payload ID: 5559 relates to Category No.: 926, 3945; Payload ID: 5560 relates to Category No.: 12292, 5347, 15489, 3948; Payload ID: 5561 relates to Category No.: 9988, 4246, 6816, 3949; Payload ID: 5562 relates to Category No.: 5865, 15091; Payload ID: 5563 relates to Category No.: 1630, 1537, 6918; Payload ID: 5565 relates to Category No.: 3303, 15503, 14471, 14234, 14471, 15528, 14233; Payload ID: 5566 relates to Category No.: 15503, 14471, 14234, 14471, 11861, 15528, 14233; Payload ID: 5567 relates to Category No.: 15503, 14471, 14471, 14251, 14471, 15528, 14233, 14234; Payload ID: 5568 relates to Category No.: 15503, 14471, 14471, 14251, 14471, 7192, 14243, 11861, 15530, 14255, 2999; Payload ID: 5569 relates to Category No.: 15503, 14471, 14471, 14251, 14471; Payload ID: 5570 relates to Category No.: 15503, 14471, 14234, 14471, 14251, 14471, 11861, 15528, 14233, 3303; Payload ID: 5571 relates to Category No.: 3303, 15503, 14471, 14471, 15524, 14243, 11861, 15528, 14255; Payload ID: 5572 relates to Category No.: 15503, 14471, 14471, 14251, 14471, 11920, 14243, 15530, 14255, 11861, 15528, 14233, 3303, 14234; Payload ID: 5573 relates to Category No.: 15503, 14471, 14471, 14243, 15530, 14255, 11861; Payload ID: 5574 relates to Category No.: 15503, 14471, 14471, 14251, 14471, 15495; Payload ID: 5575 relates to Category No.: 16331, 9539, 6924, 5229, 11861, 5210, 12181, 5206, 1356; Payload ID: 5576 relates to Category No.: 16331, 5229, 11861, 14243, 5210, 5206, 9539, 1356, 12181; Payload ID: 5577 relates to Category No.: 1405, 11978, 926, 12109, 1457, 15591, 14196, 3560; Payload ID: 5578 relates to Category No.: 11861, 12181; Payload ID: 5579 relates to Category No.: 4886, 15590, 4895, 11861, 15699, 14147, 14424; Payload ID: 5580 relates to Category No.: 4886, 15590, 4895, 11981, 10116, 11861, 15699; Payload ID: 5581 relates to Category No.: 4886, 15590, 4895, 11981, 11861, 15591, 14196; Payload ID: 5582 relates to Category No.: 15590, 11861; Payload ID: 5583 relates to Category No.: 3303, 14564, 15590, 4961, 11861, 15591, 14196, 327; Payload ID: 5584 relates to Category No.: 15590, 4619, 11861; Payload ID: 5585 relates to Category No.: 15590, 4619, 11861; Payload ID: 5586 relates to Category No.: 4886, 15590, 4895, 11981, 10116, 11861, 14196, 277, 14176, 9539, 168; Payload ID: 5587 relates to Category No.: 15592, 10116, 15591, 14196; Payload ID: 5588 relates to Category No.: 14196, 15592, 11861; Payload ID: 5589 relates to Category No.: 14196, 15592, 10116, 11861, 15591, 14196; Payload ID: 5590 relates to Category No.: 14196, 15592, 11861; Payload ID: 5591 relates to Category No.: 15592, 10116; Payload ID: 5592 relates to Category No.: 11978, 926, 12109, 11861, 3962, 11939; Payload ID: 5593 relates to Category No.: 9226, 14196, 15592, 14176, 10116, 11861; Payload ID: 5594 relates to Category No.: 6816, 14196, 15592, 10116, 11861, 15591, 14196; Payload ID: 5595 relates to Category No.: 4886, 4895, 15592, 11861, 15591, 14196; Payload ID: 5596 relates to Category No.: 15592, 14176, 11861, 15699; Payload ID: 5597 relates to Category No.: 11978, 926, 11939, 4976, 3962, 11861; Payload ID: 5598 relates to Category No.: 11978, 926, 12109, 9096, 3464, 10116, 11861, 12088, 3962; Payload ID: 5599 relates to Category No.: 11978, 926, 12109, 11939, 11861, 5347, 3752, 12081, 3962, 5282; Payload ID: 5600 relates to Category No.: 15592, 4924, 11861; Payload ID: 5601 relates to Category No.: 926, 4886, 15592, 4924, 11861; Payload ID: 5602 relates to Category No.: 9304, 15592, 4924, 11861, 15591, 14196; Payload ID: 5603 relates to Category No.: 15592, 4924, 11861, 15593; Payload ID: 5604 relates to Category No.: 15592, 4924, 11861, 15593, 1201; Payload ID: 5605 relates to Category No.: 14196, 15592, 12399, 11861; Payload ID: 5606 relates to Category No.: 11861; Payload ID: 5607 relates to Category No.: 15029, 15592, 10116, 11861; Payload ID: 5608 relates to Category No.: 15592, 11861, 15593, 9282, 9226, 14196, 11890; Payload ID: 5609 relates to Category No.: 15592, 10116, 11861, 15593; Payload ID: 5610 relates to Category No.: 15592, 11861, 15593; Payload ID: 5611 relates to Category No.: 15592, 10116, 11861; Payload ID: 5612 relates to Category No.: 15592, 11861, 10116, 12064; Payload ID: 5613 relates to Category No.: 15911, 15592, 11861, 15593; Payload ID: 5614 relates to Category No.: 9282, 9226, 15592, 10116, 11861; Payload ID: 5615 relates to Category No.: 15592, 10116, 11861; Payload ID: 5616 relates to Category No.: 11861, 15592; Payload ID: 5617 relates to Category No.: 15592, 11861; Payload ID: 5618 relates to Category No.: 15592, 14176, 1201, 11861; Payload ID: 5619 relates to Category No.: 15592, 10116, 11861; Payload ID: 5620 relates to Category No.: 15592, 11861, 1201, 15593; Payload ID: 5621 relates to Category No.: 14196, 15592, 10116, 11861, 3957, 15591, 14196, 1201; Payload ID: 5622 relates to Category No.: 14196, 15592, 11861, 1201, 10116, 15591, 14196; Payload ID: 5623 relates to Category No.: 14196, 15592, 10116, 11861, 14198, 15591, 14196, 1201; Payload ID: 5624 relates to Category No.: 961, 926, 9226, 4965, 15592, 3464, 10116, 7268, 11861, 14198, 15591, 14196; Payload ID: 5625 relates to Category No.: 961, 926, 9226, 942, 4965, 15592, 10116, 11861; Payload ID: 5626 relates to Category No.: 926, 9226, 10115, 961, 10116, 7268, 11861, 14147, 14424, 14272; Payload ID: 5627 relates to Category No.: 9282, 9226, 14196, 15592, 10116, 11861; Payload ID: 5628 relates to Category No.: 14196, 15592, 10116, 11861, 14198, 3752, 3958, 13735; Payload ID: 5629 relates to Category No.: 15598, 11861, 3957, 12077, 15593; Payload ID: 5630 relates to Category No.: 15598, 11861, 3957; Payload ID: 5631 relates to Category No.: 15598, 11861, 3957; Payload ID: 5632 relates to Category No.: 15592, 14196; Payload ID: 5633 relates to Category No.: 14196, 15895, 15592, 10116, 11861, 14198, 15591, 14196; Payload ID: 5634 relates to Category No.: 14196, 15592; Payload ID: 5635 relates to Category No.: 12142, 10116, 11861, 7268; Payload ID: 5636 relates to Category No.: 9282, 9226, 14196, 15592, 10116, 11861, 15591, 14196; Payload ID: 5637 relates to Category No.: 4886, 4895, 15592, 10116, 11861, 15591, 14196, 1201; Payload ID: 5638 relates to Category No.: 14196, 15590, 14176, 10116, 11861, 15872, 12064; Payload ID: 5639 relates to Category No.: 14196, 15590, 14176, 11861; Payload ID: 5640 relates to Category No.: 14196, 15590, 14176; Payload ID: 5641 relates to Category No.: 4886, 4895, 15592, 10116, 11861; Payload ID: 5642 relates to Category No.: 14176, 15592, 11861, 14163; Payload ID: 5643 relates to Category No.: 14196, 14176, 15596, 2551, 10116, 11861, 15596, 15599; Payload ID: 5645 relates to Category No.: 11861; Payload ID: 5646 relates to Category No.: 1504; Payload ID: 5647 relates to Category No.: 3303, 15503, 14471, 14471; Payload ID: 5648 relates to Category No.: 3303, 14471; Payload ID: 5650 relates to Category No.: 16331, 9282, 9226, 14196, 1457, 10116, 11861, 5347; Payload ID: 5651 relates to Category No.: 3303, 11895, 2963, 14597, 3655, 11920, 11861, 14598, 15031, 15321; Payload ID: 5652 relates to Category No.: 11978, 926, 3303, 9226, 6816, 11895, 954, 3385, 138, 953, 5308, 305, 5405, 11861, 12064, 14231, 152; Payload ID: 5653 relates to Category No.: 11978, 926, 3303, 5308, 942, 11895, 15504, 2963, 3385, 953, 11861, 93, 12064, 14231, 4886, 9629, 2970; Payload ID: 5654 relates to Category No.: 11895, 2963, 14597, 3640, 11861, 14598, 12064, 15031, 3303, 9226, 3655, 9225, 15321; Payload ID: 5655 relates to Category No.: 3303, 6816, 11939, 3459, 1630, 14597, 3655, 9225, 3640, 11861, 5308, 311, 12064, 1338; Payload ID: 5656 relates to Category No.: 926, 3303, 2405, 11895, 3385, 12144, 11861, 11886, 12064; Payload ID: 5657 relates to Category No.: 926, 3303, 4965, 11861; Payload ID: 5658 relates to Category No.: 926, 3303, 9226, 954, 11861; Payload ID: 5659 relates to Category No.: 15908, 11861, 11886; Payload ID: 5660 relates to Category No.: 11861, 4901, 9887; Payload ID: 5661 relates to Category No.: 11981, 11861, 12379, 12064; Payload ID: 5662 relates to Category No.: 14706, 11861; Payload ID: 5663 relates to Category No.: 14706, 7192, 11861; Payload ID: 5664 relates to Category No.: 14706, 7192; Payload ID: 5665 relates to Category No.: 14706; Payload ID: 5666 relates to Category No.: 11861, 12379, 12064, 9608; Payload ID: 5667 relates to Category No.: 12379, 12064; Payload ID: 5670 relates to Category No.: 11861; Payload ID: 5671 relates to Category No.: 11861, 12379; Payload ID: 5672 relates to Category No.: 3303, 6816, 1630, 9225, 14284, 11861, 3993, 5308, 311, 154, 153, 14596, 4205, 3458, 15031; Payload ID: 5673 relates to Category No.: 9226, 94, 11861; Payload ID: 5674 relates to Category No.: 9226, 94; Payload ID: 5675 relates to Category No.: 94, 9226, 6816; Payload ID: 5676 relates to Category No.: 3303, 6816, 11939, 138, 14595, 14596; Payload ID: 5677 relates to Category No.: 12359, 11861; Payload ID: 5678 relates to Category No.: 9226, 6816, 14309, 94, 14176, 97, 5224; Payload ID: 5679 relates to Category No.: 14196, 11861; Payload ID: 5680 relates to Category No.: 9282, 9226, 1630, 94, 10116, 11861, 4000; Payload ID: 5681 relates to Category No.: 14196, 184, 11861, 97; Payload ID: 5682 relates to Category No.: 14196, 11861, 97; Payload ID: 5683 relates to Category No.: 11861, 97, 992; Payload ID: 5684 relates to Category No.: 14196, 11861, 97; Payload ID: 5685 relates to Category No.: 10116; Payload ID: 5686 relates to Category No.: 14196, 10116, 11861, 97, 992; Payload ID: 5687 relates to Category No.: 10116, 11861, 992; Payload ID: 5688 relates to Category No.: 14196, 10116, 11861, 97, 992; Payload ID: 5689 relates to Category No.: 6816, 11939, 11933, 4562, 15542, 15553, 242, 5002, 4561, 7449; Payload ID: 5690 relates to Category No.: 6816, 11933, 4562, 15542, 15553, 242, 5002, 4561, 7449, 11939; Payload ID: 5691 relates to Category No.: 4561; Payload ID: 5692 relates to Category No.: 6816, 4563, 553; Payload ID: 5693 relates to Category No.: 6816, 4563, 12399; Payload ID: 5694 relates to Category No.: 14196, 15629, 12382, 11861, 9239, 1201, 12142, 11920; Payload ID: 5695 relates to Category No.: 12382, 11861, 9170, 1201; Payload ID: 5696 relates to Category No.: 14196, 12382, 10116, 7268, 11861, 11695, 1201, 12142, 15699; Payload ID: 5697 relates to Category No.: 12382, 12142, 11861, 1201; Payload ID: 5698 relates to Category No.: 12382, 11861, 9170, 1201; Payload ID: 5699 relates to Category No.: 12382, 15699, 9233, 1201; Payload ID: 5700 relates to Category No.: 9939, 6816, 11861; Payload ID: 5701 relates to Category No.: 1405, 1438, 9857, 11861, 9834, 9824, 5347; Payload ID: 5702 relates to Category No.: 6816, 9939, 11861; Payload ID: 5703 relates to Category No.: 2854, 1630, 9619, 2861, 11861; Payload ID: 5704 relates to Category No.: 11861, 9805, 12082; Payload ID: 5705 relates to Category No.: 11861, 9805, 12082; Payload ID: 5706 relates to Category No.: 14564, 11895, 6024, 11861, 3752, 11828, 5664; Payload ID: 5707 relates to Category No.: 5588, 5009, 11861, 2590, 2566; Payload ID: 5708 relates to Category No.: 6816, 12150, 11861, 14196; Payload ID: 5709 relates to Category No.: 6478, 12150, 11861, 6816; Payload ID: 5710 relates to Category No.: 6816, 12150, 11861, 2405, 12151; Payload ID: 5711 relates to Category No.: 6816, 12150, 11861; Payload ID: 5712 relates to Category No.: 1405, 11861, 7192; Payload ID: 5713 relates to Category No.: 267, 6965, 277, 11920, 10116, 11861, 2936, 1706, 11975, 943, 14335, 11974, 11886; Payload ID: 5714 relates to Category No.: 11861, 9608, 16206; Payload ID: 5715 relates to Category No.: 10116, 11861; Payload ID: 5716 relates to Category No.: 9518; Payload ID: 5717 relates to Category No.: 4207, 7223, 11861, 4710; Payload ID: 5720 relates to Category No.: 11861, 4198; Payload ID: 5721 relates to Category No.: 4198; Payload ID: 5722 relates to Category No.: 11861; Payload ID: 5724 relates to Category No.: 14196, 10116, 11861; Payload ID: 5725 relates to Category No.: 11861; Payload ID: 5729 relates to Category No.: 11861, 7192; Payload ID: 5731 relates to Category No.: 11939, 11861; Payload ID: 5732 relates to Category No.: 11939, 11861; Payload ID: 5733 relates to Category No.: 11861; Payload ID: 5735 relates to Category No.: 598, 11861; Payload ID: 5737 relates to Category No.: 11861; Payload ID: 5738 relates to Category No.: 11861; Payload ID: 5739 relates to Category No.: 11861; Payload ID: 5740 relates to Category No.: 12250; Payload ID: 5742 relates to Category No.: 11861; Payload ID: 5743 relates to Category No.: 11861; Payload ID: 5744 relates to Category No.: 11861; Payload ID: 5745 relates to Category No.: 10116; Payload ID: 5748 relates to Category No.: 10116; Payload ID: 5752 relates to Category No.: 11861; Payload ID: 5753 relates to Category No.: 11861; Payload ID: 5754 relates to Category No.: 14564; Payload ID: 5755 relates to Category No.: 11861; Payload ID: 5756 relates to Category No.: 11861; Payload ID: 5757 relates to Category No.: 11861; Payload ID: 5758 relates to Category No.: 11861; Payload ID: 5759 relates to Category No.: 11861, 7192; Payload ID: 5762 relates to Category No.: 4894; Payload ID: 5763 relates to Category No.: 4894; Payload ID: 5764 relates to Category No.: 11861; Payload ID: 5767 relates to Category No.: 11861; Payload ID: 5768 relates to Category No.: 5259, 11861; Payload ID: 5769 relates to Category No.: 5259, 11861, 11939; Payload ID: 5770 relates to Category No.: 11861; Payload ID: 5771 relates to Category No.: 10116; Payload ID: 5773 relates to Category No.: 11861; Payload ID: 5774 relates to Category No.: 11861; Payload ID: 5775 relates to Category No.: 1536; Payload ID: 5776 relates to Category No.: 1536; Payload ID: 5782 relates to Category No.: 7192; Payload ID: 5783 relates to Category No.: 11861; Payload ID: 5786 relates to Category No.: 11861; Payload ID: 5789 relates to Category No.: 6900, 11861; Payload ID: 5790 relates to Category No.: 6900, 11861; Payload ID: 5794 relates to Category No.: 11861; Payload ID: 5797 relates to Category No.: 11861; Payload ID: 5799 relates to Category No.: 11861; Payload ID: 5805 relates to Category No.: 11861; Payload ID: 5807 relates to Category No.: 11861; Payload ID: 5811 relates to Category No.: 3303, 6816; Payload ID: 5815 relates to Category No.: 3303; Payload ID: 5821 relates to Category No.: 11861, 10163; Payload ID: 5822 relates to Category No.: 10163, 11861; Payload ID: 5826 relates to Category No.: 1201; Payload ID: 5827 relates to Category No.: 1201; Payload ID: 5834 relates to Category No.: 11861, 7192; Payload ID: 5839 relates to Category No.: 11861; Payload ID: 5840 relates to Category No.: 11861; Payload ID: 5841 relates to Category No.: 11861; Payload ID: 5844 relates to Category No.: 7192; Payload ID: 5845 relates to Category No.: 11861, 16296; Payload ID: 5846 relates to Category No.: 11861; Payload ID: 5849 relates to Category No.: 11861; Payload ID: 5851 relates to Category No.: 11861; Payload ID: 5853 relates to Category No.: 11861; Payload ID: 5854 relates to Category No.: 11861; Payload ID: 5855 relates to Category No.: 11861; Payload ID: 5861 relates to Category No.: 11861, 12108; Payload ID: 5862 relates to Category No.: 926, 6816, 5956, 9988, 512; Payload ID: 5863 relates to Category No.: 926, 12109, 11861, 6574, 1405; Payload ID: 5864 relates to Category No.: 9226, 11861; Payload ID: 5865 relates to Category No.: 9226; Payload ID: 5869 relates to Category No.: 11861; Payload ID: 5870 relates to Category No.: 11861; Payload ID: 5871 relates to Category No.: 10116; Payload ID: 5872 relates to Category No.: 11861; Payload ID: 5873 relates to Category No.: 7192; Payload ID: 5875 relates to Category No.: 6210; Payload ID: 5876 relates to Category No.: 11861, 9890, 9882, 9880, 9887, 9874, 9877, 9888; Payload ID: 5879 relates to Category No.: 11861; Payload ID: 5881 relates to Category No.: 753; Payload ID: 5882 relates to Category No.: 9518, 321, 7477, 11817; Payload ID: 5883 relates to Category No.: 11861; Payload ID: 5884 relates to Category No.: 11861; Payload ID: 5889 relates to Category No.: 11861; Payload ID: 5908 relates to Category No.: 7192; Payload ID: 5915 relates to Category No.: 1647; Payload ID: 5916 relates to Category No.: 1647; Payload ID: 5917 relates to Category No.: 1647; Payload ID: 5918 relates to Category No.: 7192, 11861; Payload ID: 5919 relates to Category No.: 2874; Payload ID: 5920 relates to Category No.: 2874, 11861; Payload ID: 5921 relates to Category No.: 2874; Payload ID: 5922 relates to Category No.: 10116, 11861; Payload ID: 5924 relates to Category No.: 11861; Payload ID: 5925 relates to Category No.: 11861; Payload ID: 5927 relates to Category No.: 10116, 11861; Payload ID: 5928 relates to Category No.: 11861; Payload ID: 5929 relates to Category No.: 11861; Payload ID: 5930 relates to Category No.: 11861; Payload ID: 5936 relates to Category No.: 11861; Payload ID: 5937 relates to Category No.: 10116; Payload ID: 5938 relates to Category No.: 11861; Payload ID: 5940 relates to Category No.: 7192; Payload ID: 5941 relates to Category No.: 11861; Payload ID: 5943 relates to Category No.: 14877; Payload ID: 5944 relates to Category No.: 11981, 11861, 2834, 11977; Payload ID: 5945 relates to Category No.: 11861; Payload ID: 5946 relates to Category No.: 11861; Payload ID: 5947 relates to Category No.: 7192; Payload ID: 5948 relates to Category No.: 11861; Payload ID: 5949 relates to Category No.: 7192, 1201; Payload ID: 5950 relates to Category No.: 11861, 1201; Payload ID: 5952 relates to Category No.: 11861; Payload ID: 5953 relates to Category No.: 11861; Payload ID: 5957 relates to Category No.: 11861; Payload ID: 5963 relates to Category No.: 11861; Payload ID: 5969 relates to Category No.: 7552; Payload ID: 5970 relates to Category No.: 11861, 7552; Payload ID: 5975 relates to Category No.: 11861; Payload ID: 5976 relates to Category No.: 11981, 11861, 9853; Payload ID: 5977 relates to Category No.: 11981, 3774, 9853, 9845; Payload ID: 5978 relates to Category No.: 11981; Payload ID: 5979 relates to Category No.: 6965, 11981, 5960, 11861; Payload ID: 5980 relates to Category No.: 11981; Payload ID: 5982 relates to Category No.: 11861; Payload ID: 5983 relates to Category No.: 11981, 5935; Payload ID: 5985 relates to Category No.: 11861; Payload ID: 5986 relates to Category No.: 6924; Payload ID: 5987 relates to Category No.: 6924; Payload ID: 5988 relates to Category No.: 6924, 11861; Payload ID: 5990 relates to Category No.: 15496, 11861; Payload ID: 5991 relates to Category No.: 11861; Payload ID: 5992 relates to Category No.: 11861; Payload ID: 5993 relates to Category No.: 11861; Payload ID: 5994 relates to Category No.: 16331, 9226, 11861; Payload ID: 5995 relates to Category No.: 16331, 9226; Payload ID: 5997 relates to Category No.: 11861; Payload ID: 5999 relates to Category No.: 6816, 11861, 7192; Payload ID: 6000 relates to Category No.: 11861; Payload ID: 6001 relates to Category No.: 10116, 11861; Payload ID: 6002 relates to Category No.: 10116; Payload ID: 6003 relates to Category No.: 10116; Payload ID: 6005 relates to Category No.: 3303, 6478, 11861, 15887, 5308, 311, 9908, 158, 154, 4206; Payload ID: 6006 relates to Category No.: 3303, 11861; Payload ID: 6007 relates to Category No.: 6816, 5923, 11861, 15887, 10163; Payload ID: 6008 relates to Category No.: 3303, 2405, 11861; Payload ID: 6009 relates to Category No.: 11861; Payload ID: 6010 relates to Category No.: 11861; Payload ID: 6011 relates to Category No.: 11861; Payload ID: 6012 relates to Category No.: 11861, 3347; Payload ID: 6013 relates to Category No.: 7192; Payload ID: 6014 relates to Category No.: 11861, 7192, 15893; Payload ID: 6015 relates to Category No.: 2963, 11861; Payload ID: 6016 relates to Category No.: 3303, 11861, 3347; Payload ID: 6017 relates to Category No.: 16331, 15908, 15895, 15893, 6188, 11861; Payload ID: 6018 relates to Category No.: 926, 3303, 9226, 2405, 4965, 9225, 11861; Payload ID: 6019 relates to Category No.: 9226, 14196, 15503, 14471, 14597, 10116, 11861, 15528, 14239; Payload ID: 6020 relates to Category No.: 9226, 14196, 14234, 10116, 11861, 15528, 14233; Payload ID: 6021 relates to Category No.: 6816, 10116, 3267, 4457, 15542; Payload ID: 6022 relates to Category No.: 15542, 9518, 15542, 15550, 4086, 14930; Payload ID: 6023 relates to Category No.: 6965, 598, 11861, 12098, 11924, 1367, 11929, 12425, 12358, 218; Payload ID: 6024 relates to Category No.: 16331, 1630, 11861, 11924, 4087, 3471, 9629, 5897; Payload ID: 6025 relates to Category No.: 4961, 15895, 11981, 11861, 15887, 11992, 9014, 11920; Payload ID: 6026 relates to Category No.: 11861; Payload ID: 6027 relates to Category No.: 3005, 11861, 5347, 11828, 15778, 15777, 11886, 3007; Payload ID: 6028 relates to Category No.: 11861; Payload ID: 6030 relates to Category No.: 15895, 11861, 15887, 6208, 6207; Payload ID: 6031 relates to Category No.: 14564, 12399, 11861, 5347, 5957, 15781, 11828, 11886, 15617; Payload ID: 6032 relates to Category No.: 12402, 2874, 15777, 11861; Payload ID: 6033 relates to Category No.: 11978, 926, 12109, 11861, 4088; Payload ID: 6034 relates to Category No.: 11861, 4389, 12064, 11983; Payload ID: 6035 relates to Category No.: 11861; Payload ID: 6036 relates to Category No.: 267, 11861, 1327, 277, 10116, 11861, 3471; Payload ID: 6037 relates to Category No.: 267, 11861, 1327, 277, 11886; Payload ID: 6038 relates to Category No.: 11861, 1327, 277; Payload ID: 6039 relates to Category No.: 11978, 10116; Payload ID: 6040 relates to Category No.: 11978, 14309, 10116; Payload ID: 6041 relates to Category No.: 11978, 10116, 11861; Payload ID: 6042 relates to Category No.: 11978, 14309, 10116, 11861; Payload ID: 6043 relates to Category No.: 1405, 11861; Payload ID: 6044 relates to Category No.: 1405, 11861; Payload ID: 6045 relates to Category No.: 1405, 11861; Payload ID: 6046 relates to Category No.: 1405, 11861; Payload ID: 6047 relates to Category No.: 4158, 3397, 9508, 9504; Payload ID: 6048 relates to Category No.: 7192; Payload ID: 6049 relates to Category No.: 7192; Payload ID: 6050 relates to Category No.: 1405, 11861; Payload ID: 6051 relates to Category No.: 5865, 4976, 9518, 4097, 6816; Payload ID: 6052 relates to Category No.: 1527, 16282, 11861, 4099, 396; Payload ID: 6053 relates to Category No.: 5308, 1527, 16282; Payload ID: 6054 relates to Category No.: 15629, 6210, 753, 11861, 2405, 9939, 4103, 3471, 1185, 6307; Payload ID: 6055 relates to Category No.: 6210, 15629; Payload ID: 6056 relates to Category No.: 15629, 6210, 11861, 4103; Payload ID: 6057 relates to Category No.: 15629, 6210, 11861, 2936, 6431, 6301, 9329, 6307, 5346; Payload ID: 6058 relates to Category No.: 15629, 6210, 4103; Payload ID: 6059 relates to Category No.: 15629, 6210, 11861, 4103; Payload ID: 6060 relates to Category No.: 15629, 6210, 1185; Payload ID: 6061 relates to Category No.: 15629, 6210; Payload ID: 6062 relates to Category No.: 15629, 6210; Payload ID: 6063 relates to Category No.: 9518, 9518, 315, 16284, 1361; Payload ID: 6064 relates to Category No.: 9518, 6204, 14942; Payload ID: 6065 relates to Category No.: 9518, 7192; Payload ID: 6067 relates to Category No.: 5865, 9518; Payload ID: 6068 relates to Category No.: 9518, 1630, 10116, 11861, 5308, 311, 4114, 15, 16, 124, 123, 114, 3735, 1337, 9330, 7419, 9548, 3735, 899, 113, 9957, 11939, 3471, 5347, 7515, 6924; Payload ID: 6069 relates to Category No.: 4119, 6320; Payload ID: 6070 relates to Category No.: 4119, 6320; Payload ID: 6071 relates to Category No.: 15503, 14471, 14234, 14471, 15504, 15524, 15503, 14233, 11861, 14324, 15528, 14233, 3303, 2405, 14237, 11933, 3459; Payload ID: 6072 relates to Category No.: 3303, 14234, 15504, 15503, 14233, 15503, 14471, 14471, 15528, 14233, 3459; Payload ID: 6073 relates to Category No.: 11861, 15893; Payload ID: 6074 relates to Category No.: 15893, 11861; Payload ID: 6075 relates to Category No.: 15908, 15893, 11861; Payload ID: 6076 relates to Category No.: 11861, 15908, 15893; Payload ID: 6077 relates to Category No.: 15893, 11861; Payload ID: 6078 relates to Category No.: 15893, 11861; Payload ID: 6079 relates to Category No.: 15893, 11861; Payload ID: 6080 relates to Category No.: 3303, 16331, 11861, 15893; Payload ID: 6081 relates to Category No.: 15908, 15893, 1457, 11861, 12081, 9853; Payload ID: 6082 relates to Category No.: 15893, 11861; Payload ID: 6083 relates to Category No.: 15893, 11861; Payload ID: 6084 relates to Category No.: 15908, 15893, 11861; Payload ID: 6085 relates to Category No.: 15893, 11861; Payload ID: 6086 relates to Category No.: 15908, 5865, 15893, 11861; Payload ID: 6087 relates to Category No.: 15908, 15893, 11861; Payload ID: 6088 relates to Category No.: 15908, 15893, 11861; Payload ID: 6089 relates to Category No.: 11861; Payload ID: 6090 relates to Category No.: 11861; Payload ID: 6091 relates to Category No.: 15908, 11917, 11861, 15893; Payload ID: 6092 relates to Category No.: 11861; Payload ID: 6093 relates to Category No.: 15908, 11861; Payload ID: 6094 relates to Category No.: 11861, 7192; Payload ID: 6095 relates to Category No.: 11981, 11861; Payload ID: 6096 relates to Category No.: 15895, 11861, 1327, 11861, 2823, 5347, 15907, 15503, 14471; Payload ID: 6097 relates to Category No.: 15908, 11861; Payload ID: 6098 relates to Category No.: 11861; Payload ID: 6099 relates to Category No.: 15908, 11861; Payload ID: 6100 relates to Category No.: 16331, 15908, 11861, 12161; Payload ID: 6101 relates to Category No.: 11861; Payload ID: 6102 relates to Category No.: 11861; Payload ID: 6103 relates to Category No.: 11861, 4710; Payload ID: 6104 relates to Category No.: 15908, 11861, 1146, 4710, 1504; Payload ID: 6105 relates to Category No.: 3303, 15908, 11861; Payload ID: 6106 relates to Category No.: 15908, 11861; Payload ID: 6107 relates to Category No.: 11861, 15908; Payload ID: 6108 relates to Category No.: 15908, 267, 11861; Payload ID: 6109 relates to Category No.: 11861, 4710; Payload ID: 6110 relates to Category No.: 11861; Payload ID: 6111 relates to Category No.: 15908, 11861; Payload ID: 6112 relates to Category No.: 16331, 15908, 11861; Payload ID: 6113 relates to Category No.: 11861, 2823; Payload ID: 6114 relates to Category No.: 11861; Payload ID: 6115 relates to Category No.: 11861; Payload ID: 6116 relates to Category No.: 11861; Payload ID: 6117 relates to Category No.: 11861; Payload ID: 6118 relates to Category No.: 11861; Payload ID: 6119 relates to Category No.: 11861; Payload ID: 6120 relates to Category No.: 15908, 11939, 11861; Payload ID: 6121 relates to Category No.: 16331, 15908, 11861, 7192; Payload ID: 6122 relates to Category No.: 11861; Payload ID: 6123 relates to Category No.: 11861; Payload ID: 6124 relates to Category No.: 6816, 11861; Payload ID: 6125 relates to Category No.: 11861; Payload ID: 6126 relates to Category No.: 11861; Payload ID: 6127 relates to Category No.: 11861; Payload ID: 6128 relates to Category No.: 11861; Payload ID: 6129 relates to Category No.: 11861; Payload ID: 6130 relates to Category No.: 6816, 11981, 11861; Payload ID: 6131 relates to Category No.: 11861, 4710, 15893, 1504; Payload ID: 6132 relates to Category No.: 15908, 11861, 11981; Payload ID: 6133 relates to Category No.: 820, 11861; Payload ID: 6134 relates to Category No.: 15908, 11861; Payload ID: 6135 relates to Category No.: 926, 5308, 3459, 14597, 953, 11861, 3325, 93, 3378, 3303; Payload ID: 6136 relates to Category No.: 11861; Payload ID: 6137 relates to Category No.: 11861, 5350; Payload ID: 6138 relates to Category No.: 11861, 5351, 5352; Payload ID: 6139 relates to Category No.: 15617, 11861, 5353, 5351, 5352; Payload ID: 6140 relates to Category No.: 6816, 1504, 5588, 11861, 5351; Payload ID: 6141 relates to Category No.: 11861; Payload ID: 6142 relates to Category No.: 11861, 5353, 12417; Payload ID: 6143 relates to Category No.: 11861, 5353, 5385; Payload ID: 6144 relates to Category No.: 11861, 5353; Payload ID: 6145 relates to Category No.: 11861, 5353; Payload ID: 6146 relates to Category No.: 11861; Payload ID: 6147 relates to Category No.: 11861, 5353; Payload ID: 6148 relates to Category No.: 11861, 5353; Payload ID: 6149 relates to Category No.: 11861, 5353, 1137, 5355; Payload ID: 6150 relates to Category No.: 11861; Payload ID: 6151 relates to Category No.: 11861, 15617, 5350, 5356; Payload ID: 6152 relates to Category No.: 11861; Payload ID: 6153 relates to Category No.: 11861, 14538; Payload ID: 6154 relates to Category No.: 11861; Payload ID: 6155 relates to Category No.: 11861; Payload ID: 6156 relates to Category No.: 11861; Payload ID: 6157 relates to Category No.: 11861, 12081; Payload ID: 6158 relates to Category No.: 11861; Payload ID: 6159 relates to Category No.: 11861; Payload ID: 6160 relates to Category No.: 10116; Payload ID: 6161 relates to Category No.: 11861; Payload ID: 6162 relates to Category No.: 11861; Payload ID: 6163 relates to Category No.: 11861, 767; Payload ID: 6164 relates to Category No.: 9857, 11861, 9887, 9896; Payload ID: 6165 relates to Category No.: 15629, 11861, 4986; Payload ID: 6166 relates to Category No.: 4976, 4986; Payload ID: 6167 relates to Category No.: 15908, 11861, 3763; Payload ID: 6168 relates to Category No.: 15908, 11861, 3007; Payload ID: 6169 relates to Category No.: 11861; Payload ID: 6170 relates to Category No.: 11978, 926, 9096, 6210, 12145, 11861, 3774, 12076; Payload ID: 6171 relates to Category No.: 11861; Payload ID: 6172 relates to Category No.: 11861; Payload ID: 6173 relates to Category No.: 11917, 11861, 14243, 15530, 14255; Payload ID: 6174 relates to Category No.: 11861; Payload ID: 6175 relates to Category No.: 56, 11861; Payload ID: 6176 relates to Category No.: 11861; Payload ID: 6177 relates to Category No.: 11861, 9887; Payload ID: 6179 relates to Category No.: 2936; Payload ID: 6180 relates to Category No.: 11861, 1327; Payload ID: 6181 relates to Category No.: 11861; Payload ID: 6182 relates to Category No.: 11861, 2936, 7192; Payload ID: 6183 relates to Category No.: 11861; Payload ID: 6184 relates to Category No.: 7192, 11861; Payload ID: 6185 relates to Category No.: 11861; Payload ID: 6186 relates to Category No.: 14107, 2936, 12364, 12363; Payload ID: 6187 relates to Category No.: 14107, 2936, 12364; Payload ID: 6189 relates to Category No.: 11861, 9874; Payload ID: 6190 relates to Category No.: 5588, 11861; Payload ID: 6191 relates to Category No.: 5865, 3554, 5875, 65; Payload ID: 6192 relates to Category No.: 6816, 3554, 5875, 65, 11861; Payload ID: 6193 relates to Category No.: 7522, 9518, 11861, 4150, 7515; Payload ID: 6194 relates to Category No.: 926, 6478, 14306, 11861, 15699, 9795; Payload ID: 6195 relates to Category No.: 6816, 4155; Payload ID: 6196 relates to Category No.: 7192; Payload ID: 6197 relates to Category No.: 4151, 4166; Payload ID: 6198 relates to Category No.: 4151, 5865, 11861, 4166; Payload ID: 6199 relates to Category No.: 4151; Payload ID: 6200 relates to Category No.: 5865, 4151, 11861, 5347; Payload ID: 6201 relates to Category No.: 65, 11861, 4158, 4157, 5865, 4976, 5873, 15316; Payload ID: 6202 relates to Category No.: 11978, 926, 9857, 9096, 12145, 11861, 5386, 6965; Payload ID: 6203 relates to Category No.: 11861; Payload ID: 6204 relates to Category No.: 2858, 7192, 6826; Payload ID: 6205 relates to Category No.: 15503, 14471, 14471, 14251, 14471, 15495; Payload ID: 6206 relates to Category No.: 6816, 14243, 15530, 14255, 14234; Payload ID: 6207 relates to Category No.: 6816, 14243, 15530, 14255, 2405, 14234, 15528, 14255; Payload ID: 6208 relates to Category No.: 11939, 11981, 12145, 11861, 12148; Payload ID: 6209 relates to Category No.: 11861, 11939; Payload ID: 6210 relates to Category No.: 11861; Payload ID: 6211 relates to Category No.: 9988, 512, 5956, 7192; Payload ID: 6212 relates to Category No.: 11978, 926, 9096, 11981, 12145, 11861, 5386, 9990, 4128; Payload ID: 6214 relates to Category No.: 14196, 6924, 14315, 10116, 11861, 5228; Payload ID: 6215 relates to Category No.: 14196, 6924; Payload ID: 6216 relates to Category No.: 1405, 4023, 5588, 11861, 11886, 4018; Payload ID: 6217 relates to Category No.: 1405, 4023, 11861, 4018; Payload ID: 6218 relates to Category No.: 1405, 4023, 11861; Payload ID: 6219 relates to Category No.: 15029, 12402, 11861, 1327, 11861, 1706; Payload ID: 6220 relates to Category No.: 15029, 12402, 11861, 1327, 11861, 2271, 1706; Payload ID: 6221 relates to Category No.: 6816, 11861, 2316; Payload ID: 6222 relates to Category No.: 6816, 15029, 12402, 11861, 1327, 1706; Payload ID: 6223 relates to Category No.: 11861, 5347; Payload ID: 6226 relates to Category No.: 14506, 11939, 14503, 11917, 6825, 9619, 5588, 3663, 11861, 3276, 11828; Payload ID: 6227 relates to Category No.: 4183; Payload ID: 6228 relates to Category No.: 4864, 5009, 4185, 11861, 14335, 5280; Payload ID: 6229 relates to Category No.: 4864, 5009, 2282, 4185, 11861, 15792; Payload ID: 6230 relates to Category No.: 4864; Payload ID: 6231 relates to Category No.: 4864, 5009, 14733, 11861, 5841; Payload ID: 6232 relates to Category No.: 4864, 6965, 14733, 11861, 5841, 1173, 11977; Payload ID: 6233 relates to Category No.: 4864, 5009; Payload ID: 6234 relates to Category No.: 4864, 4185; Payload ID: 6235 relates to Category No.: 4864, 15792, 15785; Payload ID: 6236 relates to Category No.: 4864, 15792, 15785; Payload ID: 6237 relates to Category No.: 4864, 4185, 11861; Payload ID: 6238 relates to Category No.: 4864, 11861, 4185, 5009, 2874, 2282, 6185; Payload ID: 6239 relates to Category No.: 4864, 4185; Payload ID: 6240 relates to Category No.: 4864, 11861; Payload ID: 6241 relates to Category No.: 4864, 4185, 11861; Payload ID: 6242 relates to Category No.: 4864, 11861, 15785; Payload ID: 6243 relates to Category No.: 4864, 4185, 11861; Payload ID: 6244 relates to Category No.: 4864, 5009, 11861, 4185; Payload ID: 6245 relates to Category No.: 4864, 4185; Payload ID: 6246 relates to Category No.: 4864, 4185; Payload ID: 6247 relates to Category No.: 4864, 2282, 11861, 5009, 15792, 4185; Payload ID: 6248 relates to Category No.: 4864, 4185, 15792, 15785, 2282; Payload ID: 6249 relates to Category No.: 4864, 5009, 4185; Payload ID: 6250 relates to Category No.: 5009, 11861, 4183; Payload ID: 6251 relates to Category No.: 4865; Payload ID: 6252 relates to Category No.: 5009, 4183; Payload ID: 6253 relates to Category No.: 11978, 926, 11939, 5009, 4193, 12145, 11861, 5347, 4183, 1706, 11886, 4710; Payload ID: 6254 relates to Category No.: 11978, 926, 11939, 5009, 4193, 12145, 11861, 4183; Payload ID: 6255 relates to Category No.: 11978, 926, 4193, 12145, 11861, 4183; Payload ID: 6256 relates to Category No.: 11978, 926, 5009, 4193, 12145, 11861, 4183, 15612; Payload ID: 6257 relates to Category No.: 4185, 5538, 11861, 9803, 8989, 15613; Payload ID: 6258 relates to Category No.: 4185, 5538, 11861, 5347; Payload ID: 6259 relates to Category No.: 5009, 4193, 11861, 4183; Payload ID: 6260 relates to Category No.: 5009, 11861; Payload ID: 6261 relates to Category No.: 5588, 5009, 11861, 11828, 2566, 9617, 6767; Payload ID: 6262 relates to Category No.: 11861, 1327, 11861, 12417, 4185; Payload ID: 6263 relates to Category No.: 11861, 1327, 11861, 12417, 2305, 4185; Payload ID: 6264 relates to Category No.: 11939, 11861, 1327, 11861, 12417, 2305, 4185; Payload ID: 6265 relates to Category No.: 11861; Payload ID: 6266 relates to Category No.: 11861; Payload ID: 6267 relates to Category No.: 11861, 7192; Payload ID: 6268 relates to Category No.: 11861; Payload ID: 6269 relates to Category No.: 11861; Payload ID: 6270 relates to Category No.: 10116, 11861; Payload ID: 6271 relates to Category No.: 10116, 11861; Payload ID: 6272 relates to Category No.: 11861; Payload ID: 6273 relates to Category No.: 11861, 5259, 7192; Payload ID: 6274 relates to Category No.: 11861; Payload ID: 6275 relates to Category No.: 11861; Payload ID: 6276 relates to Category No.: 11861; Payload ID: 6278 relates to Category No.: 10116; Payload ID: 6280 relates to Category No.: 11861; Payload ID: 6281 relates to Category No.: 11861; Payload ID: 6282 relates to Category No.: 1405, 11861, 9617, 11895, 4023, 5588, 5347, 4196, 11886, 4178; Payload ID: 6283 relates to Category No.: 1405, 4023, 11861, 4016; Payload ID: 6284 relates to Category No.: 1405, 11861, 11939, 11895, 5588; Payload ID: 6285 relates to Category No.: 1405, 5009, 11861; Payload ID: 6286 relates to Category No.: 926, 11861, 11849; Payload ID: 6287 relates to Category No.: 11861, 735, 1439, 12189, 6579; Payload ID: 6288 relates to Category No.: 6816, 1504, 4821, 11861, 14548, 14581; Payload ID: 6289 relates to Category No.: 1504, 11861, 735; Payload ID: 6290 relates to Category No.: 6988, 926, 11895; Payload ID: 6291 relates to Category No.: 926, 5308, 6478, 11861, 6988; Payload ID: 6292 relates to Category No.: 11861, 9975, 9879, 9881, 9859, 9889; Payload ID: 6293 relates to Category No.: 1405, 15029, 11861; Payload ID: 6294 relates to Category No.: 1405, 15029; Payload ID: 6296 relates to Category No.: 7192; Payload ID: 6297 relates to Category No.: 277, 11861, 14564, 11939, 15504, 12363, 10116, 14106, 12379, 4710, 14660, 4128, 267, 11983, 11886, 14652, 7360; Payload ID: 6298 relates to Category No.: 267, 10116, 11861, 5347; Payload ID: 6299 relates to Category No.: 16331, 11861, 4198; Payload ID: 6300 relates to Category No.: 267, 11861, 2936, 712; Payload ID: 6302 relates to Category No.: 14196, 15027, 10116, 11861; Payload ID: 6303 relates to Category No.: 12402, 11861; Payload ID: 6304 relates to Category No.: 11861; Payload ID: 6305 relates to Category No.: 9706, 4204, 1405, 11861; Payload ID: 6306 relates to Category No.: 9706, 4204; Payload ID: 6307 relates to Category No.: 1405, 9706, 4204; Payload ID: 6308 relates to Category No.: 9706, 267, 11861; Payload ID: 6309 relates to Category No.: 14564, 9706, 15567, 14652, 4204, 11861, 5841, 15820, 368, 6452, 11939, 3471, 3752, 5280; Payload ID: 6310 relates to Category No.: 9706, 12402, 14332, 4204, 11861, 5841, 1403, 2811; Payload ID: 6311 relates to Category No.: 9706, 4204, 1403; Payload ID: 6312 relates to Category No.: 9706, 4204, 11861; Payload ID: 6313 relates to Category No.: 9706, 12399, 10116, 4204, 11861; Payload ID: 6314 relates to Category No.: 9706, 4961, 11861, 1327, 10116, 4204, 11861, 926, 4886, 9961, 4517, 15230, 2681; Payload ID: 6315 relates to Category No.: 9706, 4961, 4204, 11861; Payload ID: 6316 relates to Category No.: 9706, 11861, 5282, 4204; Payload ID: 6317 relates to Category No.: 1405, 9706, 4204, 11861; Payload ID: 6318 relates to Category No.: 6816, 9706, 4204, 11861, 5347; Payload ID: 6319 relates to Category No.: 1405, 9706, 4204; Payload ID: 6320 relates to Category No.: 9706, 4204, 11861; Payload ID: 6321 relates to Category No.: 3303, 2963, 3459, 1630, 3655, 9225, 14284, 11861, 3993, 5308, 311, 158, 154, 3460, 6478, 6574, 4205; Payload ID: 6322 relates to Category No.: 4224, 926, 1630, 11861; Payload ID: 6323 relates to Category No.: 4207, 7423, 7510, 7223; Payload ID: 6324 relates to Category No.: 4207, 7223, 7423, 7510; Payload ID: 6325 relates to Category No.: 4207, 7423, 7510, 15668, 620; Payload ID: 6326 relates to Category No.: 4207, 7423, 7510; Payload ID: 6327 relates to Category No.: 4207, 7423, 7510; Payload ID: 6328 relates to Category No.: 14251, 14471, 14471, 3303, 15503, 14471, 11861, 14240, 15528, 14233, 2405, 14234; Payload ID: 6329 relates to Category No.: 267, 11861; Payload ID: 6330 relates to Category No.: 11933, 11861, 11828; Payload ID: 6331 relates to Category No.: 11933, 11861, 5850, 11828; Payload ID: 6332 relates to Category No.: 9226, 6816, 12425, 11861; Payload ID: 6333 relates to Category No.: 10116; Payload ID: 6334 relates to Category No.: 3303, 6816; Payload ID: 6336 relates to Category No.: 11978, 926, 16089, 15612, 12145, 11861, 4865, 16113, 16116, 10037; Payload ID: 6337 relates to Category No.: 11978, 926, 16089, 11939, 15612, 2881, 12145, 11861, 9844, 11886, 4517; Payload ID: 6338 relates to Category No.: 2874, 12402, 11939, 12425; Payload ID: 6339 relates to Category No.: 11978, 926, 16089, 15612, 12145, 11861, 12081, 4865; Payload ID: 6340 relates to Category No.: 598, 267; Payload ID: 6342 relates to Category No.: 11861, 1201; Payload ID: 6343 relates to Category No.: 6816, 6822, 9619, 202, 15312, 3275, 1538; Payload ID: 6344 relates to Category No.: 12399, 4230, 3471, 4236, 6895; Payload ID: 6345 relates to Category No.: 4230, 3471, 4236, 6895, 4234; Payload ID: 6346 relates to Category No.: 4230; Payload ID: 6347 relates to Category No.: 4820, 4816, 11861, 4240, 9636; Payload ID: 6348 relates to Category No.: 5259, 11861, 4239; Payload ID: 6350 relates to Category No.: 11861, 11886; Payload ID: 6351 relates to Category No.: 4924, 11861; Payload ID: 6352 relates to Category No.: 11861; Payload ID: 6353 relates to Category No.: 14471, 15504, 11917, 15528, 14233, 14234; Payload ID: 6354 relates to Category No.: 14564, 11861, 368, 5003; Payload ID: 6355 relates to Category No.: 1405, 5009, 11861; Payload ID: 6356 relates to Category No.: 11861, 4196, 368; Payload ID: 6357 relates to Category No.: 1405, 11861; Payload ID: 6358 relates to Category No.: 1405, 11861; Payload ID: 6359 relates to Category No.: 926, 6188, 15315; Payload ID: 6360 relates to Category No.: 3303, 15503, 14471, 14471, 15504, 15524, 14251, 14471, 11920, 15528, 14233, 15528, 14255; Payload ID: 6361 relates to Category No.: 3303, 15503, 14471, 14234, 14471, 15504, 15524, 14251, 14471, 11920, 15528, 14239, 15528, 14255, 15503, 14239; Payload ID: 6362 relates to Category No.: 15503, 14471, 14471, 15504, 14251, 14471, 11920, 15524, 3303; Payload ID: 6363 relates to Category No.: 15503, 14471, 14471, 14251, 14471, 11861; Payload ID: 6364 relates to Category No.: 15503, 14471, 14471, 14251, 14471; Payload ID: 6365 relates to Category No.: 3303, 15503, 14471, 14471, 15504, 15524, 14251, 14471, 14243, 11861, 3303, 1121, 15528, 14255, 15503, 14239; Payload ID: 6366 relates to Category No.: 15503, 14471, 14471, 15524, 11861, 15528, 14233, 2406, 3303, 15503, 14239; Payload ID: 6367 relates to Category No.: 3303, 15503, 14471, 14471, 14251, 14471, 3303, 1121; Payload ID: 6368 relates to Category No.: 15503, 14471, 14471, 14251, 14471; Payload ID: 6369 relates to Category No.: 15503, 14471, 14471, 14243, 15530, 14255, 11861, 15524; Payload ID: 6370 relates to Category No.: 15503, 14471, 14471, 14251, 14471, 3303, 1121; Payload ID: 6371 relates to Category No.: 15503, 14471, 14471, 14251, 14471; Payload ID: 6372 relates to Category No.: 15503, 14471, 14471, 14251, 14471; Payload ID: 6373 relates to Category No.: 15503, 14471, 14471, 14251, 14471; Payload ID: 6374 relates to Category No.: 15503, 14471, 14471, 14251, 14471; Payload ID: 6375 relates to Category No.: 15503, 14471, 14471, 11861; Payload ID: 6376 relates to Category No.: 3303, 15503, 14471, 14471, 14251, 14471; Payload ID: 6377 relates to Category No.: 3303, 15503, 14471, 14471, 14251, 14471; Payload ID: 6378 relates to Category No.: 3303, 15503, 14471, 14471, 14243, 15503, 14239, 15528, 14255; Payload ID: 6379 relates to Category No.: 3303, 15503, 14471, 14471, 15504, 14243, 15528, 14255; Payload ID: 6380 relates to Category No.: 3303, 15503, 14471, 14471, 11861; Payload ID: 6381 relates to Category No.: 3303, 15503, 14471, 1178, 14471, 15524, 14251, 14471, 14652, 11920, 11861, 14324, 2737, 686, 3731, 15528, 14239, 15528, 14252, 14248; Payload ID: 6382 relates to Category No.: 15503, 14471, 14234, 14471, 15524, 15528, 14233, 3303, 1121; Payload ID: 6383 relates to Category No.: 15503, 14471, 14471, 14251, 14471; Payload ID: 6384 relates to Category No.: 15503, 14471, 14471; Payload ID: 6385 relates to Category No.: 3303, 15503, 14471, 14471, 14251, 14471, 15525, 15528, 14233, 14234; Payload ID: 6386 relates to Category No.: 15503, 14471, 14234, 14471, 11861, 15528, 14233; Payload ID: 6387 relates to Category No.: 14251, 14471, 15503, 14471, 14471; Payload ID: 6388 relates to Category No.: 15503, 14471, 14471, 14251, 14471, 11861, 14243, 3303; Payload ID: 6389 relates to Category No.: 15503, 14471, 6478, 14234, 14471, 11861, 15528, 14233; Payload ID: 6390 relates to Category No.: 15503, 14471, 14471, 14251, 14471, 3303, 3303, 1121; Payload ID: 6391 relates to Category No.: 3303, 15503, 14471, 14471, 14251, 14471, 11861, 15889, 2860, 15528, 14233, 14234, 3936; Payload ID: 6392 relates to Category No.: 3303, 15503, 14471, 14471, 14251, 14471, 11981, 11861, 15524; Payload ID: 6393 relates to Category No.: 14251, 14471, 15503, 14471, 14471; Payload ID: 6394 relates to Category No.: 15503, 14471, 14471; Payload ID: 6395 relates to Category No.: 15503, 14471, 14471, 11895, 11861; Payload ID: 6396 relates to Category No.: 15503, 14471, 14471, 2405, 3732; Payload ID: 6397 relates to Category No.: 15503, 14471, 2405, 14471, 15895, 14251, 14471, 11861, 12077, 15530, 14233, 3303, 15504, 15530, 14255, 15503, 15504, 15492; Payload ID: 6398 relates to Category No.: 3303, 15503, 14471, 14471, 14251, 14471, 11981, 15530, 14255, 11861, 2688, 2406, 15528, 14255, 15494; Payload ID: 6399 relates to Category No.: 3303, 15503, 14471, 14471, 15504, 14251, 14471, 11861, 3752; Payload ID: 6400 relates to Category No.: 15503, 14471, 14471, 14251, 14471, 11861; Payload ID: 6401 relates to Category No.: 6816, 15503, 14471, 14471, 14251, 14471, 11861, 686; Payload ID: 6402 relates to Category No.: 3303, 6816, 15503, 14471, 11939, 14471, 11861, 15530, 14233, 11933, 14234; Payload ID: 6403 relates to Category No.: 6816, 15503, 14471, 11939, 14471, 14251, 14471, 5109, 11861, 2688, 9014, 5101, 9012, 15495, 15503, 14239; Payload ID: 6404 relates to Category No.: 6816, 15503, 14471, 14471, 11861; Payload ID: 6405 relates to Category No.: 15503, 14471, 14471, 14251, 14471; Payload ID: 6406 relates to Category No.: 15503, 14471, 14471, 14251, 14471, 11861; Payload ID: 6407 relates to Category No.: 15503, 14471, 14471, 14251, 14471, 11861; Payload ID: 6408 relates to Category No.: 3303, 15503, 14471, 14471, 14251, 14471; Payload ID: 6409 relates to Category No.: 11861; Payload ID: 6410 relates to Category No.: 15542, 6965, 1630, 11861, 4230, 4281, 4575, 4280; Payload ID: 6411 relates to Category No.: 15542, 4230; Payload ID: 6412 relates to Category No.: 267, 6965, 11861, 14537; Payload ID: 6413 relates to Category No.: 267, 7192, 6965; Payload ID: 6414 relates to Category No.: 6210, 11861, 5347; Payload ID: 6415 relates to Category No.: 11861, 6210; Payload ID: 6416 relates to Category No.: 11861; Payload ID: 6417 relates to Category No.: 267, 11861, 5347, 1201; Payload ID: 6418 relates to Category No.: 267, 11861, 1201; Payload ID: 6419 relates to Category No.: 267, 277, 12363, 11861, 14106, 7192, 4893, 1201, 11759; Payload ID: 6420 relates to Category No.: 267, 14106, 1201; Payload ID: 6421 relates to Category No.: 267, 14106, 4893, 1201, 11861; Payload ID: 6422 relates to Category No.: 4820, 12399, 11861, 9017, 12377; Payload ID: 6423 relates to Category No.: 4820, 9017; Payload ID: 6424 relates to Category No.: 4820, 9017; Payload ID: 6425 relates to Category No.: 7268, 10116, 11861; Payload ID: 6426 relates to Category No.: 15503, 14471, 14234, 15503, 14233, 11861, 14471, 14243, 3303, 15528, 14233; Payload ID: 6427 relates to Category No.: 15503, 14471, 14234, 14471, 15503, 14233, 11861, 14243, 2405; Payload ID: 6428 relates to Category No.: 16331, 11861, 7192, 5841; Payload ID: 6429 relates to Category No.: 16331, 15504, 15491, 11861, 5347, 686; Payload ID: 6430 relates to Category No.: 16331, 11861, 267; Payload ID: 6431 relates to Category No.: 16331, 11861, 15491; Payload ID: 6434 relates to Category No.: 15629; Payload ID: 6435 relates to Category No.: 11978, 926, 11861; Payload ID: 6436 relates to Category No.: 9282, 5308, 15895, 1630, 11861, 5347, 1220; Payload ID: 6437 relates to Category No.: 11861; Payload ID: 6438 relates to Category No.: 9226, 14196, 10116, 7268, 11861, 6965; Payload ID: 6440 relates to Category No.: 7268, 9226, 14196, 10116, 11861, 7265, 4836; Payload ID: 6441 relates to Category No.: 9226, 14196, 10116, 7268, 11861, 5347; Payload ID: 6442 relates to Category No.: 6816, 1504; Payload ID: 6443 relates to Category No.: 6816; Payload ID: 6444 relates to Category No.: 1405; Payload ID: 6445 relates to Category No.: 6816, 11861; Payload ID: 6446 relates to Category No.: 5875, 65, 4151, 11861, 4158, 4166, 5863; Payload ID: 6447 relates to Category No.: 4820, 4924, 6210, 1203; Payload ID: 6448 relates to Category No.: 4820, 6210, 11861; Payload ID: 6449 relates to Category No.: 4820, 6210; Payload ID: 6450 relates to Category No.: 4820, 4103, 15227, 11861; Payload ID: 6452 relates to Category No.: 7192; Payload ID: 6453 relates to Category No.: 4820, 15617, 12402, 4291, 11861, 16293, 16291, 9608; Payload ID: 6454 relates to Category No.: 4820, 16293, 15617, 11861, 16291; Payload ID: 6455 relates to Category No.: 4820, 15617, 11861, 16293, 16291, 9608; Payload ID: 6456 relates to Category No.: 4820, 16291, 15617, 11861, 16293, 9608; Payload ID: 6457 relates to Category No.: 11939, 11933, 15895, 4820, 15617, 11861, 16293, 16291, 2875, 9608; Payload ID: 6458 relates to Category No.: 15895, 4820, 15617, 11981, 11861, 16293, 16291; Payload ID: 6459 relates to Category No.: 15895, 4820, 15617, 11861, 16293, 16291; Payload ID: 6460 relates to Category No.: 4820, 15617, 4291, 11861, 16293, 16291, 9608; Payload ID: 6461 relates to Category No.: 15895, 4820, 15617, 11861, 16293, 16291, 9608, 12402; Payload ID: 6462 relates to Category No.: 11939, 11933, 4820, 15617, 11861, 16293, 16291; Payload ID: 6463 relates to Category No.: 11861, 16293; Payload ID: 6464 relates to Category No.: 4297; Payload ID: 6465 relates to Category No.: 5956; Payload ID: 6466 relates to Category No.: 6816, 11861, 9975, 5347, 7225, 4298, 646; Payload ID: 6467 relates to Category No.: 6816, 11861, 9975, 4298; Payload ID: 6468 relates to Category No.: 1201; Payload ID: 6469 relates to Category No.: 267, 10116, 11861; Payload ID: 6473 relates to Category No.: 6924, 10116, 11861, 14305, 14301, 14315; Payload ID: 6474 relates to Category No.: 6924, 15710; Payload ID: 6475 relates to Category No.: 6924, 14305; Payload ID: 6476 relates to Category No.: 926, 15542, 15556, 4313, 5956, 9988, 512; Payload ID: 6477 relates to Category No.: 5892, 12366, 306, 4314, 7225; Payload ID: 6478 relates to Category No.: 15542, 15556, 4886, 1630, 4316; Payload ID: 6479 relates to Category No.: 586, 4317, 1504; Payload ID: 6480 relates to Category No.: 11861, 586; Payload ID: 6481 relates to Category No.: 4354, 4320; Payload ID: 6482 relates to Category No.: 4320, 545; Payload ID: 6483 relates to Category No.: 11861, 4320, 545; Payload ID: 6484 relates to Category No.: 4354, 4320; Payload ID: 6485 relates to Category No.: 4320, 105, 545; Payload ID: 6486 relates to Category No.: 4320, 545; Payload ID: 6487 relates to Category No.: 4320, 105, 545; Payload ID: 6488 relates to Category No.: 4320, 105, 545; Payload ID: 6489 relates to Category No.: 4320, 545; Payload ID: 6490 relates to Category No.: 11861, 14537, 4709, 546, 15542, 15553; Payload ID: 6491 relates to Category No.: 4320, 545; Payload ID: 6492 relates to Category No.: 15542; Payload ID: 6493 relates to Category No.: 15542; Payload ID: 6494 relates to Category No.: 6401, 1630, 11861, 4321; Payload ID: 6495 relates to Category No.: 1630, 4323, 6816, 11861; Payload ID: 6496 relates to Category No.: 6816, 1630, 9497, 243, 4324, 400; Payload ID: 6497 relates to Category No.: 6816, 5308, 1630; Payload ID: 6498 relates to Category No.: 6816, 5308, 1630; Payload ID: 6499 relates to Category No.: 11861; Payload ID: 6501 relates to Category No.: 6816, 14503, 14504, 9619, 3663, 11861, 9629, 11828, 8855; Payload ID: 6502 relates to Category No.: 3753, 1201; Payload ID: 6503 relates to Category No.: 3303, 16331, 9282, 9226, 14196, 15491, 10116, 11861, 5347, 3936, 5850, 14087, 15409, 7410; Payload ID: 6505 relates to Category No.: 5840, 14733, 2323, 5841; Payload ID: 6506 relates to Category No.: 15629, 5840, 14733, 11861, 14751; Payload ID: 6507 relates to Category No.: 5840, 14733, 2323, 11861, 943; Payload ID: 6508 relates to Category No.: 5840, 14733, 943, 11861, 11662; Payload ID: 6509 relates to Category No.: 14733, 5840, 267, 1369; Payload ID: 6510 relates to Category No.: 5840, 14733, 11861, 7192; Payload ID: 6511 relates to Category No.: 5840, 14733, 11861, 943; Payload ID: 6512 relates to Category No.: 5840, 14733; Payload ID: 6513 relates to Category No.: 12402, 11861, 11886; Payload ID: 6514 relates to Category No.: 11978, 926, 6816, 9096, 12145, 11861, 4710, 4867, 3765, 5841, 15766, 4821, 12402, 11886, 9638, 15205, 9844, 1680, 1686; Payload ID: 6515 relates to Category No.: 11978, 926, 12402, 9096, 12145, 11861; Payload ID: 6516 relates to Category No.: 926, 6816, 11861; Payload ID: 6517 relates to Category No.: 6816, 14107, 4924, 14660, 11861; Payload ID: 6518 relates to Category No.: 6816, 14107, 4924, 11861, 14660; Payload ID: 6519 relates to Category No.: 6816, 14107, 4924, 14660; Payload ID: 6520 relates to Category No.: 6816, 14107, 267, 4924, 14660; Payload ID: 6521 relates to Category No.: 6816, 14107, 4924, 11861, 14660; Payload ID: 6522 relates to Category No.: 6816, 14107, 4924, 14660; Payload ID: 6523 relates to Category No.: 11861; Payload ID: 6526 relates to Category No.: 11861; Payload ID: 6527 relates to Category No.: 11861; Payload ID: 6528 relates to Category No.: 11861; Payload ID: 6529 relates to Category No.: 11861, 7192; Payload ID: 6530 relates to Category No.: 11861, 7192; Payload ID: 6536 relates to Category No.: 4886, 15590, 4895, 10116, 11861; Payload ID: 6537 relates to Category No.: 4886, 4895, 11861; Payload ID: 6538 relates to Category No.: 11861, 5956; Payload ID: 6539 relates to Category No.: 9226, 11861; Payload ID: 6540 relates to Category No.: 9226, 11861, 7192; Payload ID: 6541 relates to Category No.: 9226; Payload ID: 6542 relates to Category No.: 9226, 11861; Payload ID: 6543 relates to Category No.: 9226; Payload ID: 6544 relates to Category No.: 11861; Payload ID: 6545 relates to Category No.: 9226; Payload ID: 6546 relates to Category No.: 9226; Payload ID: 6547 relates to Category No.: 9226, 6816, 10116, 11861; Payload ID: 6548 relates to Category No.: 11861, 4897; Payload ID: 6549 relates to Category No.: 15495, 11861, 4897; Payload ID: 6550 relates to Category No.: 9961; Payload ID: 6551 relates to Category No.: 11861; Payload ID: 6552 relates to Category No.: 4820, 1190, 4811; Payload ID: 6553 relates to Category No.: 2405, 4820, 14961, 11861, 3935, 7005, 3471, 5260, 14968; Payload ID: 6554 relates to Category No.: 4820, 8957; Payload ID: 6555 relates to Category No.: 4820, 1140; Payload ID: 6556 relates to Category No.: 11861, 2499; Payload ID: 6558 relates to Category No.: 4820, 9824; Payload ID: 6559 relates to Category No.: 4820, 9824; Payload ID: 6560 relates to Category No.: 4820; Payload ID: 6561 relates to Category No.: 4820; Payload ID: 6565 relates to Category No.: 4820, 4816, 11917, 8960; Payload ID: 6566 relates to Category No.: 4820; Payload ID: 6567 relates to Category No.: 4820, 4816; Payload ID: 6568 relates to Category No.: 4820, 11861, 3424, 6094, 6091, 15832; Payload ID: 6569 relates to Category No.: 4820; Payload ID: 6570 relates to Category No.: 4820; Payload ID: 6571 relates to Category No.: 4820, 8957; Payload ID: 6572 relates to Category No.: 4820; Payload ID: 6573 relates to Category No.: 4820; Payload ID: 6574 relates to Category No.: 4820; Payload ID: 6575 relates to Category No.: 4820; Payload ID: 6576 relates to Category No.: 4820; Payload ID: 6577 relates to Category No.: 7192; Payload ID: 6578 relates to Category No.: 4820, 4812; Payload ID: 6579 relates to Category No.: 4820, 15617; Payload ID: 6580 relates to Category No.: 4820, 11861; Payload ID: 6581 relates to Category No.: 4820; Payload ID: 6582 relates to Category No.: 4820, 4810; Payload ID: 6583 relates to Category No.: 4820; Payload ID: 6584 relates to Category No.: 4820, 2298; Payload ID: 6585 relates to Category No.: 4820, 4818; Payload ID: 6586 relates to Category No.: 4820, 4794; Payload ID: 6587 relates to Category No.: 4820, 1203; Payload ID: 6588 relates to Category No.: 4820; Payload ID: 6589 relates to Category No.: 4820; Payload ID: 6590 relates to Category No.: 4820; Payload ID: 6592 relates to Category No.: 4820, 15617, 478; Payload ID: 6593 relates to Category No.: 4820, 9532; Payload ID: 6594 relates to Category No.: 4820; Payload ID: 6595 relates to Category No.: 4820; Payload ID: 6596 relates to Category No.: 4820, 4810; Payload ID: 6597 relates to Category No.: 4820, 9629; Payload ID: 6598 relates to Category No.: 4820, 11861; Payload ID: 6599 relates to Category No.: 4820; Payload ID: 6600 relates to Category No.: 4820; Payload ID: 6601 relates to Category No.: 4820, 11861; Payload ID: 6602 relates to Category No.: 4820; Payload ID: 6603 relates to Category No.: 4820; Payload ID: 6604 relates to Category No.: 4820; Payload ID: 6605 relates to Category No.: 4820, 4818; Payload ID: 6606 relates to Category No.: 4820; Payload ID: 6607 relates to Category No.: 4961, 15895, 4820, 4816, 11861, 9629, 5280, 11801; Payload ID: 6608 relates to Category No.: 4820, 4816, 11861, 9629, 11801; Payload ID: 6609 relates to Category No.: 6816, 4820; Payload ID: 6610 relates to Category No.: 4820; Payload ID: 6611 relates to Category No.: 4820; Payload ID: 6612 relates to Category No.: 4820; Payload ID: 6613 relates to Category No.: 4820, 6716, 11861, 5347; Payload ID: 6614 relates to Category No.: 4820, 4810; Payload ID: 6615 relates to Category No.: 4820, 1480; Payload ID: 6616 relates to Category No.: 4820, 14879; Payload ID: 6617 relates to Category No.: 4820; Payload ID: 6618 relates to Category No.: 4820; Payload ID: 6619 relates to Category No.: 4820, 7192; Payload ID: 6620 relates to Category No.: 4820; Payload ID: 6621 relates to Category No.: 4820; Payload ID: 6622 relates to Category No.: 4820, 1665; Payload ID: 6623 relates to Category No.: 4820; Payload ID: 6624 relates to Category No.: 4820; Payload ID: 6625 relates to Category No.: 4820, 8963; Payload ID: 6626 relates to Category No.: 4820, 4816; Payload ID: 6627 relates to Category No.: 4820, 11861; Payload ID: 6628 relates to Category No.: 4820, 4818; Payload ID: 6629 relates to Category No.: 4820; Payload ID: 6630 relates to Category No.: 14564, 16243; Payload ID: 6631 relates to Category No.: 16250; Payload ID: 6632 relates to Category No.: 11861, 1201; Payload ID: 6633 relates to Category No.: 11861, 1201, 1146; Payload ID: 6634 relates to Category No.: 11978, 926, 12109; Payload ID: 6635 relates to Category No.: 11978, 926, 12109, 4827, 14110; Payload ID: 6636 relates to Category No.: 11978, 926, 12109, 9939, 11861, 4827, 11983, 1141; Payload ID: 6637 relates to Category No.: 11978, 926, 4827, 12109, 11861, 1141; Payload ID: 6638 relates to Category No.: 11978, 926, 12109, 4827, 14110; Payload ID: 6639 relates to Category No.: 6816, 4894, 11861, 11886; Payload ID: 6640 relates to Category No.: 6816, 4894, 11861, 11886; Payload ID: 6641 relates to Category No.: 4820, 11861; Payload ID: 6642 relates to Category No.: 4820, 11981, 4821, 11977; Payload ID: 6643 relates to Category No.: 4820; Payload ID: 6644 relates to Category No.: 4820; Payload ID: 6645 relates to Category No.: 4820; Payload ID: 6646 relates to Category No.: 11861, 7192; Payload ID: 6647 relates to Category No.: 4886, 4895, 10116, 11861, 15596; Payload ID: 6648 relates to Category No.: 4886, 4895, 10116, 11861, 15596; Payload ID: 6649 relates to Category No.: 11861, 7192; Payload ID: 6650 relates to Category No.: 16331, 15908, 6188, 11861, 15893; Payload ID: 6651 relates to Category No.: 3303, 15503, 14471, 14234, 11933, 14471, 15524, 15491, 11861, 15528, 14233, 15528, 14255, 2405; Payload ID: 6652 relates to Category No.: 15503, 14471, 11933, 15524, 11861; Payload ID: 6653 relates to Category No.: 11933, 15524, 11861, 11939; Payload ID: 6654 relates to Category No.: 6965, 15895, 11861, 4338, 1173; Payload ID: 6655 relates to Category No.: 6965, 4338, 15895, 11861, 1173, 15229; Payload ID: 6656 relates to Category No.: 6965, 15895, 14706, 11861, 4338, 1173, 943; Payload ID: 6657 relates to Category No.: 926, 4349, 4351, 11861; Payload ID: 6658 relates to Category No.: 926, 4349, 7435; Payload ID: 6659 relates to Category No.: 6816, 1630, 15093, 7436, 7437; Payload ID: 6660 relates to Category No.: 1630, 1504, 5892, 521; Payload ID: 6661 relates to Category No.: 16331, 1630, 15934, 11861; Payload ID: 6662 relates to Category No.: 15086, 4360; Payload ID: 6663 relates to Category No.: 4360; Payload ID: 6664 relates to Category No.: 1504, 4360, 126, 4350, 12193; Payload ID: 6665 relates to Category No.: 4360, 126, 4350, 12193; Payload ID: 6666 relates to Category No.: 5308, 5311, 582, 5308, 11939, 1630, 12402, 11861, 12376, 4355; Payload ID: 6667 relates to Category No.: 5308, 5311, 11861, 1159, 4355; Payload ID: 6668 relates to Category No.: 1159; Payload ID: 6669 relates to Category No.: 5308, 5311, 1159; Payload ID: 6670 relates to Category No.: 1159; Payload ID: 6671 relates to Category No.: 4356; Payload ID: 6672 relates to Category No.: 4820, 11861, 4365, 9636, 8957; Payload ID: 6673 relates to Category No.: 4820, 11861, 4365, 9636, 8957; Payload ID: 6674 relates to Category No.: 4820, 4365, 9636; Payload ID: 6675 relates to Category No.: 5259, 11861, 8959, 15786, 15793, 15797; Payload ID: 6676 relates to Category No.: 5259; Payload ID: 6677 relates to Category No.: 1504, 11861; Payload ID: 6678 relates to Category No.: 6816; Payload ID: 6679 relates to Category No.: 6816; Payload ID: 6680 relates to Category No.: 11861, 11917, 15895; Payload ID: 6681 relates to Category No.: 11861; Payload ID: 6682 relates to Category No.: 4340, 4013, 2323, 3471, 5437, 1126, 4337, 11861; Payload ID: 6683 relates to Category No.: 4340, 4013, 2323, 5437, 1126; Payload ID: 6684 relates to Category No.: 4340, 4013, 2323, 5437, 1126; Payload ID: 6685 relates to Category No.: 4340, 4013, 2323, 5437, 1126; Payload ID: 6686 relates to Category No.: 15629, 12399, 4340, 4013, 2323, 5437, 1126, 11861, 4338; Payload ID: 6687 relates to Category No.: 4340, 4013, 2323, 5437, 1126; Payload ID: 6688 relates to Category No.: 4013, 4340, 2323, 6186, 706, 4338; Payload ID: 6689 relates to Category No.: 4340, 4013, 2323, 11861, 5437, 4337; Payload ID: 6690 relates to Category No.: 4340, 4013, 2323, 4345; Payload ID: 6691 relates to Category No.: 4013, 11861, 2323, 4340; Payload ID: 6692 relates to Category No.: 4340, 4013, 2323, 5437, 1126; Payload ID: 6693 relates to Category No.: 4340, 4013, 2323, 5437, 1126, 4338; Payload ID: 6694 relates to Category No.: 4340, 4013, 11861, 2323, 5437, 1126; Payload ID: 6695 relates to Category No.: 4340, 4013, 2323, 5437, 1126; Payload ID: 6696 relates to Category No.: 4340, 4013, 2323; Payload ID: 6697 relates to Category No.: 4340, 4013, 2323, 11861, 11939, 11933, 11920, 4337; Payload ID: 6698 relates to Category No.: 4013, 2323, 4340, 11920; Payload ID: 6699 relates to Category No.: 4340, 4013, 2323, 11920; Payload ID: 6700 relates to Category No.: 15617, 4340, 4013, 2323, 8980; Payload ID: 6701 relates to Category No.: 4820, 11861, 4812, 15504; Payload ID: 6702 relates to Category No.: 4820, 11861, 4812; Payload ID: 6703 relates to Category No.: 4384; Payload ID: 6704 relates to Category No.: 5308, 1630, 9363, 3998, 4386; Payload ID: 6705 relates to Category No.: 11861, 4385; Payload ID: 6706 relates to Category No.: 4385, 11939; Payload ID: 6707 relates to Category No.: 11861, 4387, 4614; Payload ID: 6708 relates to Category No.: 4387; Payload ID: 6709 relates to Category No.: 4387, 4614; Payload ID: 6710 relates to Category No.: 4387, 4614; Payload ID: 6711 relates to Category No.: 11861, 4387, 4614; Payload ID: 6712 relates to Category No.: 4387; Payload ID: 6713 relates to Category No.: 4387; Payload ID: 6714 relates to Category No.: 4387; Payload ID: 6715 relates to Category No.: 1146; Payload ID: 6716 relates to Category No.: 4619, 11861; Payload ID: 6717 relates to Category No.: 4619, 11861; Payload ID: 6718 relates to Category No.: 11861; Payload ID: 6719 relates to Category No.: 14564, 5847, 11861, 4404, 4406, 4407, 12402, 14377, 1173, 11920, 9608, 14537, 2643; Payload ID: 6720 relates to Category No.: 4404; Payload ID: 6721 relates to Category No.: 11861, 5347, 4404; Payload ID: 6722 relates to Category No.: 11861; Payload ID: 6723 relates to Category No.: 4406, 4408, 4405, 4404, 2643; Payload ID: 6724 relates to Category No.: 2267, 11861, 4404; Payload ID: 6726 relates to Category No.: 11939, 4404; Payload ID: 6727 relates to Category No.: 11861, 4404; Payload ID: 6728 relates to Category No.: 4404, 11861; Payload ID: 6731 relates to Category No.: 11861; Payload ID: 6733 relates to Category No.: 4404, 11861; Payload ID: 6734 relates to Category No.: 11861, 5840, 4404; Payload ID: 6737 relates to Category No.: 11861, 5840, 4404; Payload ID: 6738 relates to Category No.: 4404; Payload ID: 6739 relates to Category No.: 11939; Payload ID: 6740 relates to Category No.: 1647, 10116; Payload ID: 6743 relates to Category No.: 7192; Payload ID: 6744 relates to Category No.: 11861; Payload ID: 6745 relates to Category No.: 5259, 11861, 12402; Payload ID: 6746 relates to Category No.: 4820, 15617, 9636, 4413; Payload ID: 6747 relates to Category No.: 2538; Payload ID: 6748 relates to Category No.: 5259, 11861; Payload ID: 6749 relates to Category No.: 12402, 8959; Payload ID: 6750 relates to Category No.: 4820, 4816, 1267, 11861; Payload ID: 6751 relates to Category No.: 7192; Payload ID: 6753 relates to Category No.: 3303, 14471; Payload ID: 6754 relates to Category No.: 3303, 15503, 14471, 14471, 14243, 14237, 15528, 14252; Payload ID: 6755 relates to Category No.: 3303, 16331, 15503, 14471, 14471, 14243, 11861, 2688, 15530, 14233, 15525, 14252, 2406, 15528, 14255, 14237, 1356, 14251, 14471, 15528, 14233, 9539, 2405, 14234, 3732, 3303, 1121; Payload ID: 6756 relates to Category No.: 16331, 15503, 14471, 2405, 14471, 15504, 14243, 11861, 14252, 15528, 14255, 3732, 1356, 14240, 15528, 14233, 3303, 14237; Payload ID: 6757 relates to Category No.: 3303, 16331, 15503, 14471, 2405, 14471, 15504, 15524, 15491, 2690, 14243, 11861, 2691, 15530, 14233, 15525, 14252, 3530, 15528, 14255, 5235, 9227, 15528, 14233, 11917, 14237, 3732, 5664; Payload ID: 6758 relates to Category No.: 16331, 15503, 14471, 14471, 3303, 2405, 15504, 15524, 15491, 14243, 11861, 14252, 2737, 15528, 14255, 327, 15503, 14252, 14251, 14471, 15503, 14239, 11981, 3732, 9012; Payload ID: 6759 relates to Category No.: 3303, 16331, 15503, 14471, 2405, 14471, 15524, 14243, 14252, 15528, 14255, 11861, 15503, 14239, 3732; Payload ID: 6760 relates to Category No.: 3303, 16331, 15503, 14471, 2405, 14471, 15504, 15524, 14251, 14471, 11981, 14243, 11861, 14252, 15528, 14255, 14237, 15503, 14239, 14244; Payload ID: 6761 relates to Category No.: 16331, 15503, 14471, 14471; Payload ID: 6762 relates to Category No.: 16331, 15503, 14471, 14471, 11861, 1327, 14243, 11861; Payload ID: 6763 relates to Category No.: 16331, 15503, 14471, 14234, 14471, 9271, 11861, 14240; Payload ID: 6765 relates to Category No.: 11861; Payload ID: 6767 relates to Category No.: 10116, 15591, 14196, 1201; Payload ID: 6768 relates to Category No.: 15503, 14471, 11861, 3303; Payload ID: 6769 relates to Category No.: 3303, 15503, 14471; Payload ID: 6770 relates to Category No.: 3303, 15503, 14471, 14234, 15530, 14233; Payload ID: 6771 relates to Category No.: 12402, 4481; Payload ID: 6772 relates to Category No.: 4481, 12399; Payload ID: 6773 relates to Category No.: 12402, 11861, 1027; Payload ID: 6774 relates to Category No.: 4481; Payload ID: 6776 relates to Category No.: 6816, 14234, 14471, 11861, 15530, 14233, 14240, 15530, 14239; Payload ID: 6777 relates to Category No.: 4894, 4429, 11861, 12357, 12359; Payload ID: 6778 relates to Category No.: 10116, 11861, 4894, 14660, 12357; Payload ID: 6779 relates to Category No.: 9282, 5308, 9304, 4924, 4428; Payload ID: 6780 relates to Category No.: 1630, 11861, 2557, 4434, 7514; Payload ID: 6781 relates to Category No.: 15542, 9304, 11861; Payload ID: 6782 relates to Category No.: 4886, 15542, 9304, 11861, 6589; Payload ID: 6783 relates to Category No.: 1405, 267, 11920, 11861, 7401; Payload ID: 6784 relates to Category No.: 11861; Payload ID: 6785 relates to Category No.: 11861; Payload ID: 6786 relates to Category No.: 10116, 11861, 14715; Payload ID: 6787 relates to Category No.: 11861; Payload ID: 6788 relates to Category No.: 11861; Payload ID: 6789 relates to Category No.: 11861; Payload ID: 6790 relates to Category No.: 6816, 4894, 11861; Payload ID: 6791 relates to Category No.: 2405; Payload ID: 6792 relates to Category No.: 5109, 11861, 15495, 13735; Payload ID: 6793 relates to Category No.: 3303, 6816, 1630, 9225, 2770; Payload ID: 6794 relates to Category No.: 3303, 11933, 15504, 15491, 15239, 11861, 14244; Payload ID: 6795 relates to Category No.: 3303, 15491, 11861; Payload ID: 6796 relates to Category No.: 11939, 11933, 15504, 15491, 15239, 11861, 14244; Payload ID: 6797 relates to Category No.: 16331, 15504, 15239, 11861, 15409, 2688, 3303; Payload ID: 6798 relates to Category No.: 14471, 6816, 11861, 14232, 15503, 2692, 15503, 14252, 15322; Payload ID: 6799 relates to Category No.: 3303, 10116, 11861; Payload ID: 6800 relates to Category No.: 3303, 15504, 1630, 15491, 10116, 11861, 9803; Payload ID: 6801 relates to Category No.: 926, 3303, 4965, 1630, 11861, 15503, 2692; Payload ID: 6802 relates to Category No.: 11978, 3385, 11861, 14231, 2405; Payload ID: 6803 relates to Category No.: 11978, 16331, 9226, 6816, 15503, 14471, 3385, 11861, 15591, 14196, 12064, 14231; Payload ID: 6804 relates to Category No.: 11978, 6816, 15503, 14471, 2963, 3385, 11861, 15591, 14196, 12064, 14231; Payload ID: 6805 relates to Category No.: 11978, 15503, 14471, 3459, 3385, 953, 11861, 14231; Payload ID: 6806 relates to Category No.: 12393; Payload ID: 6807 relates to Category No.: 3303, 15503, 14471, 11861, 7125; Payload ID: 6808 relates to Category No.: 6816, 14196, 3303, 9226; Payload ID: 6809 relates to Category No.: 3303, 11861; Payload ID: 6810 relates to Category No.: 3303, 11861; Payload ID: 6811 relates to Category No.: 3303, 11861; Payload ID: 6812 relates to Category No.: 3749, 3303, 11861, 5096; Payload ID: 6813 relates to Category No.: 3303, 11861; Payload ID: 6814 relates to Category No.: 3303, 11861; Payload ID: 6815 relates to Category No.: 926, 6816, 7198, 7202; Payload ID: 6816 relates to Category No.: 6816, 11861, 3267, 4087, 4457, 15542; Payload ID: 6817 relates to Category No.: 11861, 14218; Payload ID: 6818 relates to Category No.: 11978, 926, 11861, 5197; Payload ID: 6819 relates to Category No.: 11861; Payload ID: 6820 relates to Category No.: 267, 11981, 11861, 7401; Payload ID: 6822 relates to Category No.: 7192; Payload ID: 6823 relates to Category No.: 5259, 4821, 12144, 11861, 4874, 4465; Payload ID: 6825 relates to Category No.: 11861; Payload ID: 6826 relates to Category No.: 15908, 11861, 7192; Payload ID: 6827 relates to Category No.: 4886; Payload ID: 6828 relates to Category No.: 11861; Payload ID: 6829 relates to Category No.: 11861, 93; Payload ID: 6831 relates to Category No.: 93, 11861; Payload ID: 6832 relates to Category No.: 267, 11939, 12402, 11861, 7393, 9608; Payload ID: 6833 relates to Category No.: 11861, 7192; Payload ID: 6834 relates to Category No.: 11861; Payload ID: 6835 relates to Category No.: 11861, 5347; Payload ID: 6836 relates to Category No.: 9226, 6816, 3303, 2405, 14471, 15524, 11861, 6965, 15503, 14239; Payload ID: 6837 relates to Category No.: 16331, 6816, 15503, 14471, 14471, 11861, 15528, 14233, 3303, 2405, 14234, 15524, 9226; Payload ID: 6838 relates to Category No.: 6816, 15503, 14471, 14234, 5109, 1153, 11861, 15528, 14233, 5101, 14471, 2405; Payload ID: 6839 relates to Category No.: 15503, 14471, 3303, 6816, 7192; Payload ID: 6843 relates to Category No.: 11939; Payload ID: 6844 relates to Category No.: 848, 3749, 14564, 4864, 267, 11991; Payload ID: 6845 relates to Category No.: 267, 848, 3749, 4864, 11991; Payload ID: 6846 relates to Category No.: 4864, 11939, 12402, 11861; Payload ID: 6847 relates to Category No.: 3303, 15503, 14471, 14234, 15504, 14251, 14471, 5109, 11861, 15528, 14233, 16331; Payload ID: 6848 relates to Category No.: 3303, 6816, 14471, 11861; Payload ID: 6849 relates to Category No.: 15029, 11861, 5588, 5957, 15021; Payload ID: 6850 relates to Category No.: 11861; Payload ID: 6851 relates to Category No.: 11861; Payload ID: 6852 relates to Category No.: 10116; Payload ID: 6853 relates to Category No.: 11861, 11863; Payload ID: 6854 relates to Category No.: 6816, 14243, 3303, 15528, 14255, 15530, 14255, 9226; Payload ID: 6855 relates to Category No.: 6816, 15524, 11861, 15528, 14233, 3303; Payload ID: 6856 relates to Category No.: 6816, 3303, 15503, 14471; Payload ID: 6857 relates to Category No.: 6816, 15542, 15554, 4486; Payload ID: 6858 relates to Category No.: 15895, 11861, 15909, 5021; Payload ID: 6860 relates to Category No.: 5259, 12402, 11861, 5347, 4508; Payload ID: 6861 relates to Category No.: 4820, 15617, 4924, 4507, 9636; Payload ID: 6862 relates to Category No.: 4820, 15617, 11861, 4507; Payload ID: 6863 relates to Category No.: 4820, 15617, 4507; Payload ID: 6864 relates to Category No.: 5308, 5311, 1630, 1646, 26; Payload ID: 6866 relates to Category No.: 3303, 6816, 14234, 15491, 15528, 14233, 15503, 14471, 11861; Payload ID: 6867 relates to Category No.: 3303, 15491, 6816, 14234; Payload ID: 6868 relates to Category No.: 926, 9988, 512, 4532, 11861, 4520, 5043, 6478, 12081, 456; Payload ID: 6869 relates to Category No.: 5956, 1504, 11861, 11920, 3752, 3753, 4310; Payload ID: 6870 relates to Category No.: 1630, 15093, 7446, 6816, 11861; Payload ID: 6871 relates to Category No.: 926, 6816, 5308, 5311, 11861, 15945, 7465; Payload ID: 6872 relates to Category No.: 5308, 4528, 11861; Payload ID: 6873 relates to Category No.: 4528, 5308, 11861; Payload ID: 6874 relates to Category No.: 7462, 5347, 4524, 7225; Payload ID: 6875 relates to Category No.: 242, 11861, 1132; Payload ID: 6876 relates to Category No.: 242, 7453; Payload ID: 6877 relates to Category No.: 242, 1132, 7453, 240; Payload ID: 6878 relates to Category No.: 242, 1132, 7453; Payload ID: 6879 relates to Category No.: 242; Payload ID: 6880 relates to Category No.: 4544; Payload ID: 6881 relates to Category No.: 4544, 9809, 9988, 512; Payload ID: 6882 relates to Category No.: 4544; Payload ID: 6883 relates to Category No.: 11939, 11861, 7510, 5347, 4532, 4545, 1504; Payload ID: 6884 relates to Category No.: 4546, 4864, 15895, 2874, 5804, 7225; Payload ID: 6885 relates to Category No.: 15629, 4547; Payload ID: 6886 relates to Category No.: 9518, 11861; Payload ID: 6887 relates to Category No.: 9518; Payload ID: 6888 relates to Category No.: 1630, 1504, 5308, 5311, 552, 6549; Payload ID: 6889 relates to Category No.: 1504, 10116, 4510, 5308, 5311, 1630, 11861; Payload ID: 6890 relates to Category No.: 1630, 1504, 5308, 5311, 552, 6549; Payload ID: 6891 relates to Category No.: 1630, 4553, 1164; Payload ID: 6892 relates to Category No.: 12402, 4553, 11861; Payload ID: 6893 relates to Category No.: 5308, 5311; Payload ID: 6894 relates to Category No.: 15542, 15553, 15960; Payload ID: 6895 relates to Category No.: 15542, 15553, 15960; Payload ID: 6896 relates to Category No.: 12366, 306, 5011, 15937; Payload ID: 6897 relates to Category No.: 5308, 5311, 12402, 11920, 1165; Payload ID: 6898 relates to Category No.: 1537, 12292, 11861, 4571, 11933, 12064, 4566; Payload ID: 6899 relates to Category No.: 1537, 12292, 11861, 4571, 11933, 4566; Payload ID: 6900 relates to Category No.: 1537, 12292, 882, 15081; Payload ID: 6901 relates to Category No.: 926, 4886, 9518, 7490, 11861, 5347, 456, 4573, 4574, 6121; Payload ID: 6902 relates to Category No.: 4886, 9518, 456, 4573, 4574, 6121; Payload ID: 6903 relates to Category No.: 11895, 12416, 15491, 1153, 11861, 686, 4517; Payload ID: 6904 relates to Category No.: 12416, 11861, 11895; Payload ID: 6905 relates to Category No.: 5849, 4034, 11861, 9608, 4577, 655; Payload ID: 6906 relates to Category No.: 4034, 5849, 11861, 655; Payload ID: 6907 relates to Category No.: 4034, 5849, 655, 11861; Payload ID: 6908 relates to Category No.: 4034, 5849, 655, 11861; Payload ID: 6909 relates to Category No.: 5849, 4034; Payload ID: 6910 relates to Category No.: 5849, 4034, 9608, 4577, 14377, 11861; Payload ID: 6911 relates to Category No.: 11861; Payload ID: 6912 relates to Category No.: 5849, 4034, 5925, 11861; Payload ID: 6913 relates to Category No.: 5849, 4034, 5925, 11861, 15889, 11939, 9608, 15895, 5347, 4577; Payload ID: 6914 relates to Category No.: 5849, 4034, 4577, 5925, 430, 11861; Payload ID: 6915 relates to Category No.: 5849, 4034, 5925, 11861; Payload ID: 6916 relates to Category No.: 5849, 4034, 5925, 11861, 9608, 5347, 14537, 4577; Payload ID: 6917 relates to Category No.: 1405, 1401, 1457, 5849, 4034, 11861, 4660, 9077, 8969, 4566, 12402, 1647, 11917, 11933, 3752, 4578, 16248; Payload ID: 6918 relates to Category No.: 16331, 5849, 4034, 11861, 1647, 9077, 1401; Payload ID: 6919 relates to Category No.: 16331, 5849, 4034, 11861, 4660, 1647, 9077, 1401; Payload ID: 6920 relates to Category No.: 5849, 4034, 11861, 1647, 9077, 9608, 12064; Payload ID: 6921 relates to Category No.: 5849, 4034, 11861, 9077; Payload ID: 6922 relates to Category No.: 5841; Payload ID: 6923 relates to Category No.: 5849, 4034, 11861, 5347, 4660, 9077, 12077, 1401; Payload ID: 6924 relates to Category No.: 1647, 1401, 5849, 4034, 4660, 9077, 8974, 8969; Payload ID: 6925 relates to Category No.: 4820, 11861, 4577; Payload ID: 6926 relates to Category No.: 4820, 1404, 11861, 4856, 4577; Payload ID: 6927 relates to Category No.: 4820, 4856, 4577, 1404; Payload ID: 6928 relates to Category No.: 4820, 4857, 4577; Payload ID: 6929 relates to Category No.: 4820, 4577, 11861; Payload ID: 6930 relates to Category No.: 11939, 4820, 4857, 11861, 4577, 430; Payload ID: 6931 relates to Category No.: 1404, 1405, 4820, 4857, 9608, 4577, 14486, 4566, 431, 16244; Payload ID: 6932 relates to Category No.: 4820, 4857, 4577; Payload ID: 6933 relates to Category No.: 4584, 5347, 4571, 11861, 926, 6478, 6574, 3513; Payload ID: 6934 relates to Category No.: 926, 6478, 4585, 456, 2557, 4566, 11933; Payload ID: 6935 relates to Category No.: 3755, 4585, 4586, 11933; Payload ID: 6937 relates to Category No.: 11861; Payload ID: 6943 relates to Category No.: 10116, 11861; Payload ID: 6944 relates to Category No.: 12292, 6011, 1630; Payload ID: 6945 relates to Category No.: 1630, 12292, 5347, 6058, 6346, 6087, 9899, 1531; Payload ID: 6946 relates to Category No.: 12292, 5347, 6058, 15489; Payload ID: 6947 relates to Category No.: 1630, 12292, 10116, 5347, 6058, 5983, 6346, 11939, 9939, 3752, 620, 1531; Payload ID: 6948 relates to Category No.: 12292, 6011; Payload ID: 6949 relates to Category No.: 4592, 11861; Payload ID: 6950 relates to Category No.: 4592, 11861; Payload ID: 6953 relates to Category No.: 1504, 4598, 620; Payload ID: 6954 relates to Category No.: 1504, 4598; Payload ID: 6955 relates to Category No.: 11861, 7192; Payload ID: 6956 relates to Category No.: 16331, 4601; Payload ID: 6957 relates to Category No.: 16331, 4601; Payload ID: 6958 relates to Category No.: 926, 1527, 16282, 4603; Payload ID: 6959 relates to Category No.: 926, 9282, 632, 6188, 4282, 11861, 4600; Payload ID: 6960 relates to Category No.: 16331, 637, 6829, 9629, 6821, 9619; Payload ID: 6961 relates to Category No.: 926, 9282, 11861, 4896, 632, 6188, 4282, 4589, 14272, 11783; Payload ID: 6962 relates to Category No.: 926, 9282, 15699, 632, 6188, 4282, 4589, 4590; Payload ID: 6963 relates to Category No.: 926, 6188, 1527, 16282, 15591, 14196, 4603, 15542; Payload ID: 6964 relates to Category No.: 926, 11861, 4603; Payload ID: 6965 relates to Category No.: 3554, 11919, 12064, 4613, 4616; Payload ID: 6966 relates to Category No.: 6816, 3554, 11919, 65, 11918, 4613, 853; Payload ID: 6967 relates to Category No.: 6816, 3554, 11919, 5875, 10116, 11861, 11983; Payload ID: 6968 relates to Category No.: 6816, 3554, 11919, 65; Payload ID: 6969 relates to Category No.: 3554, 11919, 7192; Payload ID: 6970 relates to Category No.: 4961, 15973; Payload ID: 6971 relates to Category No.: 3554, 4207, 387, 4117, 9518, 319, 9518, 319, 16281, 4607; Payload ID: 6972 relates to Category No.: 4617, 14537, 11861; Payload ID: 6973 relates to Category No.: 4617, 3554; Payload ID: 6974 relates to Category No.: 15504, 4617, 14420, 11861; Payload ID: 6975 relates to Category No.: 4617, 9952; Payload ID: 6976 relates to Category No.: 4617; Payload ID: 6977 relates to Category No.: 4617; Payload ID: 6978 relates to Category No.: 4617, 9747, 11861, 1629; Payload ID: 6979 relates to Category No.: 4617, 9747; Payload ID: 6980 relates to Category No.: 3554, 4207, 9518, 303, 7480, 9518, 7510, 4621; Payload ID: 6981 relates to Category No.: 4619, 11861; Payload ID: 6982 relates to Category No.: 4619, 11861; Payload ID: 6983 relates to Category No.: 4619, 11861; Payload ID: 6984 relates to Category No.: 11939, 4619, 11861; Payload ID: 6985 relates to Category No.: 4619, 11861; Payload ID: 6986 relates to Category No.: 11919, 4617, 12402, 4619, 11861; Payload ID: 6987 relates to Category No.: 11939, 4619, 11861, 3752, 4608; Payload ID: 6988 relates to Category No.: 4619, 11861, 11939, 12402, 3752, 4608; Payload ID: 6989 relates to Category No.: 11939, 4619, 11861, 5347, 3752, 4608; Payload ID: 6990 relates to Category No.: 11939, 4619, 11861, 3752, 4608; Payload ID: 6991 relates to Category No.: 4619, 11861; Payload ID: 6992 relates to Category No.: 9518, 4619, 11861, 4611, 6898; Payload ID: 6993 relates to Category No.: 9518, 4619, 11861, 4611, 6898; Payload ID: 6994 relates to Category No.: 4619, 5914, 11861, 5959, 14711, 3270, 9047, 3471, 4608; Payload ID: 6995 relates to Category No.: 15542, 11861, 4617, 4619; Payload ID: 6996 relates to Category No.: 11861, 4619; Payload ID: 6997 relates to Category No.: 15542, 11861; Payload ID: 6998 relates to Category No.: 15542, 1630, 11861, 5892, 11939, 4617, 4619, 6541; Payload ID: 6999 relates to Category No.: 11861, 7192; Payload ID: 7000 relates to Category No.: 926, 6478, 11939, 4608, 4618, 4660, 9629; Payload ID: 7001 relates to Category No.: 6965, 9518, 318, 7477, 7472, 11861, 7510, 5347, 4624, 9668; Payload ID: 7002 relates to Category No.: 9518, 318, 7477, 7472, 11861, 7510, 4624; Payload ID: 7003 relates to Category No.: 926, 11861, 4627; Payload ID: 7004 relates to Category No.: 926, 11861, 9988, 512, 4633, 5105; Payload ID: 7005 relates to Category No.: 926, 9988, 512, 4633; Payload ID: 7006 relates to Category No.: 926, 9988, 512, 4633; Payload ID: 7007 relates to Category No.: 15542, 15548, 4643, 9314; Payload ID: 7008 relates to Category No.: 15542, 15548, 47, 4643; Payload ID: 7009 relates to Category No.: 15542, 15548, 4643; Payload ID: 7010 relates to Category No.: 15542, 15548, 9314, 4643; Payload ID: 7011 relates to Category No.: 11939, 9518, 321, 7477, 7472, 4639, 4640; Payload ID: 7012 relates to Category No.: 9518, 321, 7477, 7472, 4639, 11939, 14733, 5841; Payload ID: 7013 relates to Category No.: 9518, 14710, 4640, 1405; Payload ID: 7014 relates to Category No.: 15542, 15548, 9314, 12402, 9549, 4646, 11861, 1630; Payload ID: 7015 relates to Category No.: 1504, 9974, 4650, 14938, 4649; Payload ID: 7016 relates to Category No.: 6816, 9974, 4650, 4651; Payload ID: 7017 relates to Category No.: 9974, 4650, 6816; Payload ID: 7018 relates to Category No.: 6816, 9974, 4650, 4652; Payload ID: 7019 relates to Category No.: 6816, 9974, 4650; Payload ID: 7020 relates to Category No.: 6816, 9974, 4650; Payload ID: 7021 relates to Category No.: 9974, 11861, 4650, 4649; Payload ID: 7022 relates to Category No.: 4657; Payload ID: 7023 relates to Category No.: 15542, 12292, 4663, 1630; Payload ID: 7024 relates to Category No.: 636; Payload ID: 7025 relates to Category No.: 6401, 3554, 4660, 4667; Payload ID: 7026 relates to Category No.: 11861, 4230, 4660, 4674; Payload ID: 7027 relates to Category No.: 4013, 11861, 4660, 15624, 4035, 15232, 4036; Payload ID: 7028 relates to Category No.: 4013, 4660, 15624, 4035; Payload ID: 7029 relates to Category No.: 4013, 4660, 15624, 4035; Payload ID: 7030 relates to Category No.: 4013, 4660, 15624, 4035; Payload ID: 7031 relates to Category No.: 4013, 11861, 4660, 4035, 4036, 3471; Payload ID: 7032 relates to Category No.: 4671, 15542, 15548, 11861, 4672; Payload ID: 7033 relates to Category No.: 4671, 4596; Payload ID: 7034 relates to Category No.: 4671; Payload ID: 7035 relates to Category No.: 4671; Payload ID: 7036 relates to Category No.: 4671; Payload ID: 7037 relates to Category No.: 11981, 11861, 4683, 4692, 15552, 4532; Payload ID: 7038 relates to Category No.: 11939, 4683, 4692, 15552, 4532; Payload ID: 7039 relates to Category No.: 11978, 926, 12109, 11861, 11974, 15231, 11981; Payload ID: 7040 relates to Category No.: 11978, 926, 5956, 9539, 15895, 12109, 1153, 11981, 11861, 14252, 9014, 11974, 15231, 5850, 5588, 15504, 15230; Payload ID: 7041 relates to Category No.: 6816, 15542, 15553, 11861, 4693; Payload ID: 7042 relates to Category No.: 15542, 15553, 4693; Payload ID: 7043 relates to Category No.: 6210, 4704, 4698, 11861; Payload ID: 7044 relates to Category No.: 4704, 4698; Payload ID: 7045 relates to Category No.: 11939, 5347, 16206, 7192; Payload ID: 7046 relates to Category No.: 11861; Payload ID: 7047 relates to Category No.: 11861; Payload ID: 7049 relates to Category No.: 5588, 5009; Payload ID: 7051 relates to Category No.: 12399, 11861; Payload ID: 7052 relates to Category No.: 5259; Payload ID: 7053 relates to Category No.: 5259; Payload ID: 7054 relates to Category No.: 5259, 11861; Payload ID: 7055 relates to Category No.: 11861, 15378; Payload ID: 7056 relates to Category No.: 15617, 11861; Payload ID: 7058 relates to Category No.: 11861; Payload ID: 7059 relates to Category No.: 11861, 1401; Payload ID: 7060 relates to Category No.: 7192; Payload ID: 7061 relates to Category No.: 11861, 2566; Payload ID: 7062 relates to Category No.: 15617, 12399, 11861, 2566; Payload ID: 7063 relates to Category No.: 15503, 14471, 15524, 14251, 6183, 6185; Payload ID: 7064 relates to Category No.: 11861, 4800, 15766, 4796; Payload ID: 7065 relates to Category No.: 6210, 12136, 6207, 6254, 2436, 5061; Payload ID: 7067 relates to Category No.: 14733, 9936, 4734, 11861; Payload ID: 7068 relates to Category No.: 15542, 15553; Payload ID: 7069 relates to Category No.: 15542, 15554; Payload ID: 7070 relates to Category No.: 15542, 15553; Payload ID: 7071 relates to Category No.: 15542, 15553; Payload ID: 7072 relates to Category No.: 15542, 15553, 4562, 6574, 16319, 3516; Payload ID: 7073 relates to Category No.: 15542, 15553; Payload ID: 7074 relates to Category No.: 926, 9282, 11917, 632, 4681, 11861; Payload ID: 7077 relates to Category No.: 16331, 6816, 6005; Payload ID: 7078 relates to Category No.: 7472, 9914, 3303, 6900, 11861; Payload ID: 7079 relates to Category No.: 11939, 9518, 321, 7477, 7472, 7515, 4626, 5325, 4745, 7510, 1531; Payload ID: 7080 relates to Category No.: 5003, 2672, 6024, 4183; Payload ID: 7081 relates to Category No.: 5003; Payload ID: 7082 relates to Category No.: 5003, 11861, 9672; Payload ID: 7083 relates to Category No.: 5003; Payload ID: 7084 relates to Category No.: 5003; Payload ID: 7085 relates to Category No.: 5003; Payload ID: 7086 relates to Category No.: 3749, 1172, 6229, 9923, 1169; Payload ID: 7087 relates to Category No.: 14564, 4895, 4805, 7360, 2730, 5551, 1135, 2953, 5850, 7192, 6816, 4886, 4915, 11861, 428; Payload ID: 7088 relates to Category No.: 14564; Payload ID: 7089 relates to Category No.: 820, 11861, 9880, 9874, 1201; Payload ID: 7090 relates to Category No.: 12402; Payload ID: 7092 relates to Category No.: 11861; Payload ID: 7093 relates to Category No.: 11861, 3752, 9888; Payload ID: 7094 relates to Category No.: 11861, 9888; Payload ID: 7095 relates to Category No.: 11861; Payload ID: 7096 relates to Category No.: 11861; Payload ID: 7097 relates to Category No.: 14706, 14705, 11861; Payload ID: 7098 relates to Category No.: 14706, 14705, 15629, 11861; Payload ID: 7099 relates to Category No.: 11861, 2271; Payload ID: 7100 relates to Category No.: 6206; Payload ID: 7101 relates to Category No.: 6206, 14564; Payload ID: 7102 relates to Category No.: 11861, 5841; Payload ID: 7103 relates to Category No.: 11861, 7192; Payload ID: 7104 relates to Category No.: 467, 11861; Payload ID: 7105 relates to Category No.: 467, 11861; Payload ID: 7107 relates to Category No.: 11861; Payload ID: 7108 relates to Category No.: 6965, 11981, 15180, 11861, 5400; Payload ID: 7109 relates to Category No.: 15629, 11861; Payload ID: 7110 relates to Category No.: 11861, 4896; Payload ID: 7111 relates to Category No.: 11939, 12359, 11861, 11861, 1327; Payload ID: 7118 relates to Category No.: 11861; Payload ID: 7123 relates to Category No.: 11861; Payload ID: 7128 relates to Category No.: 11861; Payload ID: 7129 relates to Category No.: 11861; Payload ID: 7135 relates to Category No.: 11861; Payload ID: 7140 relates to Category No.: 15503, 14471, 14471, 10116, 11861; Payload ID: 7141 relates to Category No.: 11861; Payload ID: 7142 relates to Category No.: 3303; Payload ID: 7143 relates to Category No.: 5259, 4795, 4793; Payload ID: 7144 relates to Category No.: 5259, 4793, 4795; Payload ID: 7145 relates to Category No.: 4820, 9629, 4794; Payload ID: 7146 relates to Category No.: 3303, 14471, 14252, 14244, 11861; Payload ID: 7147 relates to Category No.: 3303, 15503, 14471, 14471, 11861; Payload ID: 7149 relates to Category No.: 4886, 5308, 11861; Payload ID: 7150 relates to Category No.: 4886, 5308, 7192; Payload ID: 7151 relates to Category No.: 4886, 4895, 11861; Payload ID: 7152 relates to Category No.: 11861; Payload ID: 7154 relates to Category No.: 4429, 11861, 4898, 4804; Payload ID: 7155 relates to Category No.: 11861, 5347, 4898; Payload ID: 7156 relates to Category No.: 4898, 11861, 7192; Payload ID: 7157 relates to Category No.: 14234, 14471, 15524, 15528, 14233, 2406; Payload ID: 7158 relates to Category No.: 15503, 14471, 14471, 11861, 2406, 15528, 14255, 5827, 2405; Payload ID: 7159 relates to Category No.: 15503, 14471, 14471, 11861, 2406, 15528, 14255, 14251, 14471, 3303; Payload ID: 7160 relates to Category No.: 11861; Payload ID: 7162 relates to Category No.: 11861; Payload ID: 7164 relates to Category No.: 11861; Payload ID: 7166 relates to Category No.: 1434, 1405, 11939, 11933, 11861; Payload ID: 7167 relates to Category No.: 4864, 2874, 10116, 11861; Payload ID: 7169 relates to Category No.: 11939, 14503, 11861, 14506; Payload ID: 7170 relates to Category No.: 14503, 14506, 11861; Payload ID: 7171 relates to Category No.: 14503; Payload ID: 7172 relates to Category No.: 14503, 14506; Payload ID: 7173 relates to Category No.: 14503, 14506, 11861, 3663; Payload ID: 7174 relates to Category No.: 11861; Payload ID: 7175 relates to Category No.: 10116, 11861; Payload ID: 7176 relates to Category No.: 11861, 11782; Payload ID: 7178 relates to Category No.: 11861, 14538, 14564; Payload ID: 7179 relates to Category No.: 11861, 9874, 9877, 15613; Payload ID: 7180 relates to Category No.: 11861; Payload ID: 7183 relates to Category No.: 11861, 14538; Payload ID: 7184 relates to Category No.: 11861, 14538; Payload ID: 7185 relates to Category No.: 11861, 14538; Payload ID: 7186 relates to Category No.: 2874, 11861, 12400, 1253, 7236, 15611, 16082; Payload ID: 7187 relates to Category No.: 5009, 2874, 11939, 1253; Payload ID: 7188 relates to Category No.: 9282, 9226, 14196, 10116, 7268; Payload ID: 7190 relates to Category No.: 11861; Payload ID: 7191 relates to Category No.: 11861, 5347; Payload ID: 7192 relates to Category No.: 7192; Payload ID: 7193 relates to Category No.: 267, 16220, 16237, 1381, 11861; Payload ID: 7194 relates to Category No.: 11861, 2688; Payload ID: 7195 relates to Category No.: 11861; Payload ID: 7196 relates to Category No.: 11861; Payload ID: 7197 relates to Category No.: 11861; Payload ID: 7198 relates to Category No.: 11861; Payload ID: 7199 relates to Category No.: 11861; Payload ID: 7200 relates to Category No.: 11861, 6965, 2931, 15409; Payload ID: 7201 relates to Category No.: 6965, 277, 11861, 2931; Payload ID: 7202 relates to Category No.: 267, 6965, 11861; Payload ID: 7203 relates to Category No.: 1405, 12402, 16244, 2859, 12144, 11861, 12425, 12400, 1201, 1327, 9896; Payload ID: 7204 relates to Category No.: 15503, 14471, 11861, 277; Payload ID: 7205 relates to Category No.: 7192, 12359; Payload ID: 7206 relates to Category No.: 1457, 11861, 9896, 6431, 9865; Payload ID: 7207 relates to Category No.: 4864, 2874, 15567; Payload ID: 7208 relates to Category No.: 4864, 2874, 15567; Payload ID: 7209 relates to Category No.: 4864, 2874, 15567, 11861; Payload ID: 7210 relates to Category No.: 15567, 4864, 2874; Payload ID: 7211 relates to Category No.: 4864, 2874, 15567, 11861; Payload ID: 7212 relates to Category No.: 4864, 2874, 15567, 11981, 11861; Payload ID: 7213 relates to Category No.: 4864, 2874, 15567, 11861, 5347, 1253, 12402; Payload ID: 7215 relates to Category No.: 4864, 2874, 15567, 11939; Payload ID: 7216 relates to Category No.: 4864, 2874, 15567, 11861, 11939; Payload ID: 7217 relates to Category No.: 4864, 2874, 15567; Payload ID: 7218 relates to Category No.: 16331, 6816, 15524, 14243, 11861, 15530, 14233; Payload ID: 7219 relates to Category No.: 6816, 14251, 14471, 14243, 11861, 14252; Payload ID: 7220 relates to Category No.: 5538, 11861, 14538; Payload ID: 7221 relates to Category No.: 11861, 14538; Payload ID: 7222 relates to Category No.: 11981, 10116, 11861, 3774, 5347, 14537, 5543, 14538, 3765, 8989, 11920, 12081; Payload ID: 7223 relates to Category No.: 14196, 9857, 11981, 11861, 5347, 14538; Payload ID: 7224 relates to Category No.: 4864, 11919, 4207, 11861, 15357; Payload ID: 7225 relates to Category No.: 6816, 4864, 5259, 11861, 4869, 11768; Payload ID: 7226 relates to Category No.: 5259; Payload ID: 7227 relates to Category No.: 11861, 7192; Payload ID: 7228 relates to Category No.: 11939, 2881, 11981, 11861, 11782, 4865, 9636, 4868, 12081, 14536; Payload ID: 7229 relates to Category No.: 4894; Payload ID: 7230 relates to Category No.: 5259, 4874, 4876, 11861; Payload ID: 7231 relates to Category No.: 4820, 15617, 11861, 4865, 4875, 9636; Payload ID: 7232 relates to Category No.: 4820, 4875, 4872, 11861, 5260, 9636; Payload ID: 7235 relates to Category No.: 11861, 9608, 5347, 467; Payload ID: 7236 relates to Category No.: 11939, 15973, 2271, 444; Payload ID: 7237 relates to Category No.: 11939, 2271, 444, 15973; Payload ID: 7238 relates to Category No.: 3303, 14471, 15528, 14233, 14234; Payload ID: 7239 relates to Category No.: 3303, 14471; Payload ID: 7243 relates to Category No.: 11861; Payload ID: 7244 relates to Category No.: 11861; Payload ID: 7247 relates to Category No.: 16331, 6816, 11861; Payload ID: 7248 relates to Category No.: 16331, 6816, 11861; Payload ID: 7249 relates to Category No.: 3303, 15503, 14471, 15503, 14239; Payload ID: 7250 relates to Category No.: 9226, 3303, 11861; Payload ID: 7251 relates to Category No.: 3303, 9226; Payload ID: 7252 relates to Category No.: 4886, 4895, 15592, 10116; Payload ID: 7253 relates to Category No.: 4886, 4895, 15592, 11861; Payload ID: 7254 relates to Category No.: 4886, 4895, 11861; Payload ID: 7255 relates to Category No.: 4886, 4895, 10116, 11861; Payload ID: 7256 relates to Category No.: 4886, 14176; Payload ID: 7257 relates to Category No.: 4886, 6478, 4895, 1457, 11861, 4422; Payload ID: 7258 relates to Category No.: 16331, 4886, 11939, 11861, 4889, 1405, 2557, 4899; Payload ID: 7259 relates to Category No.: 11861, 4888, 3752, 620, 3753, 4899, 5308; Payload ID: 7260 relates to Category No.: 926, 3303, 9226, 3655, 961, 953, 10116, 11861, 7268; Payload ID: 7261 relates to Category No.: 9282, 9226, 12416, 10116, 11861; Payload ID: 7262 relates to Category No.: 4894, 4924, 4893, 11861; Payload ID: 7263 relates to Category No.: 4894; Payload ID: 7264 relates to Category No.: 4886; Payload ID: 7265 relates to Category No.: 4886; Payload ID: 7266 relates to Category No.: 4886; Payload ID: 7267 relates to Category No.: 4886, 11861; Payload ID: 7268 relates to Category No.: 4886; Payload ID: 7269 relates to Category No.: 4886, 11939, 4895, 11861; Payload ID: 7270 relates to Category No.: 4886; Payload ID: 7271 relates to Category No.: 4886, 6478, 4895, 10116, 11861; Payload ID: 7272 relates to Category No.: 6816, 4886; Payload ID: 7273 relates to Category No.: 11861; Payload ID: 7274 relates to Category No.: 11861; Payload ID: 7275 relates to Category No.: 11861; Payload ID: 7276 relates to Category No.: 11861; Payload ID: 7277 relates to Category No.: 11861; Payload ID: 7278 relates to Category No.: 11861; Payload ID: 7279 relates to Category No.: 6924, 4903, 11939, 14351; Payload ID: 7280 relates to Category No.: 16331, 5308, 4905, 5308, 307, 11861; Payload ID: 7281 relates to Category No.: 926, 12327, 4754, 4753; Payload ID: 7282 relates to Category No.: 14564, 6816, 4886, 4895, 4805, 4915, 11861, 2957; Payload ID: 7283 relates to Category No.: 14564, 6816, 4886, 4895, 4805, 4915, 15796; Payload ID: 7284 relates to Category No.: 14564, 6816, 4886, 4895, 4805, 4915, 11861, 2957, 15784, 4821; Payload ID: 7285 relates to Category No.: 14564, 6816, 4886, 4895, 4805, 4915, 4821, 11861; Payload ID: 7286 relates to Category No.: 14564, 6816, 4886, 4895, 4805, 4915, 4821; Payload ID: 7287 relates to Category No.: 14564, 6816, 4895, 4805, 4831, 7360, 2730, 4915, 11861, 4886, 11886, 4893; Payload ID: 7288 relates to Category No.: 14564, 6816, 4886, 4895, 4805, 4915, 4821; Payload ID: 7289 relates to Category No.: 14564, 4805, 4831, 6816, 4886, 4895, 4915, 11861, 4893, 4422; Payload ID: 7290 relates to Category No.: 14564, 6816, 4886, 4895, 4805, 4915, 4821, 11861; Payload ID: 7291 relates to Category No.: 14564, 6816, 4886, 4895, 4805, 4831, 4915, 11861, 11920, 4893; Payload ID: 7292 relates to Category No.: 14564, 6816, 4886, 4895, 4805, 4915, 11981, 4821, 4422, 382, 11861; Payload ID: 7293 relates to Category No.: 14564, 6816, 4886, 4895, 4805, 4915, 4821, 4817; Payload ID: 7294 relates to Category No.: 14564, 6816, 4886, 4895, 4805, 4831, 4915, 12417; Payload ID: 7295 relates to Category No.: 14564, 4895, 11861, 2271, 4832; Payload ID: 7296 relates to Category No.: 14564, 4895, 11861, 4896, 11886, 4821, 14812, 15784; Payload ID: 7297 relates to Category No.: 11861, 7192; Payload ID: 7298 relates to Category No.: 14564, 4895, 11861, 4896, 11886, 1404; Payload ID: 7299 relates to Category No.: 11861, 11939, 11890, 12402, 10116, 14536, 3752, 14580, 12425, 11983, 2853, 12081, 5843, 12148; Payload ID: 7300 relates to Category No.: 14564, 4895, 11861, 4896, 14812; Payload ID: 7301 relates to Category No.: 14564, 11861, 11886; Payload ID: 7302 relates to Category No.: 14564, 4895, 11861; Payload ID: 7303 relates to Category No.: 14564, 4895; Payload ID: 7304 relates to Category No.: 14564, 11861, 9608, 9809; Payload ID: 7305 relates to Category No.: 14564, 4806; Payload ID: 7306 relates to Category No.: 14564, 4806; Payload ID: 7307 relates to Category No.: 14564, 4895, 4821, 15784; Payload ID: 7308 relates to Category No.: 14564, 11861; Payload ID: 7309 relates to Category No.: 14564, 4895, 11861, 9608; Payload ID: 7310 relates to Category No.: 14564; Payload ID: 7311 relates to Category No.: 14564, 4895, 11861; Payload ID: 7312 relates to Category No.: 14564, 4895, 11861; Payload ID: 7313 relates to Category No.: 14564, 4895; Payload ID: 7314 relates to Category No.: 14564, 6816, 4886, 4895, 4894, 4805, 4915, 15796, 11861; Payload ID: 7315 relates to Category No.: 14564, 6816, 4895, 4805, 4915, 4821, 4886; Payload ID: 7316 relates to Category No.: 4886, 4895, 15029; Payload ID: 7317 relates to Category No.: 4886, 4895, 10116; Payload ID: 7318 relates to Category No.: 4895, 4886, 10116, 11861; Payload ID: 7319 relates to Category No.: 4886, 4895, 10116, 11861; Payload ID: 7320 relates to Category No.: 6816, 9518, 1630, 4750; Payload ID: 7321 relates to Category No.: 6816, 9518, 1630, 4750; Payload ID: 7322 relates to Category No.: 4886, 267, 4895, 11861, 5347, 3752, 2875, 5282, 14812; Payload ID: 7323 relates to Category No.: 4886, 4895, 11861; Payload ID: 7324 relates to Category No.: 4886, 4895, 11861; Payload ID: 7325 relates to Category No.: 4886, 4895; Payload ID: 7326 relates to Category No.: 4886, 4895, 11861, 5347; Payload ID: 7327 relates to Category No.: 4886, 4895; Payload ID: 7328 relates to Category No.: 4886, 4895;

Payload ID: 7329 relates to Category No.: 4886, 4976, 9976, 4918, 11861; Payload ID: 7330 relates to Category No.: 4976, 12399, 11861, 9976, 4918, 9282, 4886, 11933, 5839; Payload ID: 7331 relates to Category No.: 9282, 4976, 9976, 4918, 11861, 11933, 5839, 5282, 6816, 4886, 12399; Payload ID: 7332 relates to Category No.: 11978, 926, 4886, 11861, 9976, 4918, 15468; Payload ID: 7333 relates to Category No.: 11978, 926, 4886, 12399, 9976, 4918; Payload ID: 7334 relates to Category No.: 11978, 926, 4886, 12399, 9976, 4918, 11861, 11939, 11933; Payload ID: 7335 relates to Category No.: 1405, 1426, 4921; Payload ID: 7336 relates to Category No.: 1405, 1426, 4921; Payload ID: 7337 relates to Category No.: 1405, 1426; Payload ID: 7338 relates to Category No.: 5259, 4917; Payload ID: 7339 relates to Category No.: 1426, 4917; Payload ID: 7340 relates to Category No.: 926, 4922; Payload ID: 7341 relates to Category No.: 11861; Payload ID: 7342 relates to Category No.: 4886, 4895; Payload ID: 7343 relates to Category No.: 14564, 11861; Payload ID: 7346 relates to Category No.: 3303, 9226; Payload ID: 7347 relates to Category No.: 3303, 10116, 11861, 2406; Payload ID: 7348 relates to Category No.: 926, 3303; Payload ID: 7349 relates to Category No.: 3303, 9271; Payload ID: 7350 relates to Category No.: 3303, 10116, 11861; Payload ID: 7351 relates to Category No.: 3303, 14471, 11861; Payload ID: 7352 relates to Category No.: 3303, 11933; Payload ID: 7353 relates to Category No.: 3303, 11933; Payload ID: 7354 relates to Category No.: 3303, 11933; Payload ID: 7355 relates to Category No.: 3303, 11933, 7192; Payload ID: 7356 relates to Category No.: 3303, 11933, 7192; Payload ID: 7357 relates to Category No.: 3303, 11933, 5105, 11861, 3752, 2963; Payload ID: 7358 relates to Category No.: 3303, 11933, 15524, 3462, 11981, 9271, 14243, 11861, 2691, 2406, 12110, 12393, 14237, 2405; Payload ID: 7359 relates to Category No.: 3303, 11933, 15524, 14243, 2406; Payload ID: 7360 relates to Category No.: 3303, 14234, 11933, 9271, 11861, 14240, 2406, 14237; Payload ID: 7361 relates to Category No.: 3303, 11933; Payload ID: 7362 relates to Category No.: 3303, 11933; Payload ID: 7363 relates to Category No.: 3303, 11933; Payload ID: 7364 relates to Category No.: 3303, 11933, 5105, 9271, 11861, 14240, 14237; Payload ID: 7365 relates to Category No.: 3303, 11933, 5105, 9271, 11861, 14240, 14237; Payload ID: 7366 relates to Category No.: 3303, 11933, 9271, 11861; Payload ID: 7367 relates to Category No.: 3303, 14471, 14243, 15530, 14255; Payload ID: 7368 relates to Category No.: 3303, 14471; Payload ID: 7369 relates to Category No.: 3303, 14471, 14243; Payload ID: 7370 relates to Category No.: 3303, 6816, 15503, 14471, 9518, 11861, 15495, 5109, 16224, 15409; Payload ID: 7371 relates to Category No.: 6816, 11861, 3752; Payload ID: 7372 relates to Category No.: 5308, 11861; Payload ID: 7373 relates to Category No.: 14503, 753, 11861, 4993; Payload ID: 7374 relates to Category No.: 14503, 4993; Payload ID: 7375 relates to Category No.: 11861; Payload ID: 7376 relates to Category No.: 6816, 9225; Payload ID: 7377 relates to Category No.: 4886, 4895, 11895, 11861; Payload ID: 7378 relates to Category No.: 11861, 7192; Payload ID: 7379 relates to Category No.: 7192; Payload ID: 7380 relates to Category No.: 11861, 7192; Payload ID: 7381 relates to Category No.: 7192; Payload ID: 7382 relates to Category No.: 7192; Payload ID: 7383 relates to Category No.: 7192; Payload ID: 7384 relates to Category No.: 15355; Payload ID: 7385 relates to Category No.: 6965, 7192; Payload ID: 7386 relates to Category No.: 4886, 15590, 4895; Payload ID: 7387 relates to Category No.: 11978, 926, 12402, 9096, 12145, 11861; Payload ID: 7388 relates to Category No.: 11861, 5618, 12064; Payload ID: 7389 relates to Category No.: 9857, 11861; Payload ID: 7390 relates to Category No.: 11861; Payload ID: 7391 relates to Category No.: 6816, 11861, 4891, 4912; Payload ID: 7392 relates to Category No.: 7192; Payload ID: 7393 relates to Category No.: 14234, 11939, 1178, 15504, 11917, 15524, 15491, 15495, 11861, 15530, 14233, 5347, 3303, 14471, 11933, 3752; Payload ID: 7394 relates to Category No.: 11917, 11939, 15504, 15524, 15491, 14243, 11861, 15528, 14233, 3530, 327, 916, 14471, 11933; Payload ID: 7395 relates to Category No.: 1405, 11861; Payload ID: 7396 relates to Category No.: 14712, 10116, 11861, 1201; Payload ID: 7397 relates to Category No.: 1201; Payload ID: 7398 relates to Category No.: 11861, 1201; Payload ID: 7399 relates to Category No.: 1201; Payload ID: 7400 relates to Category No.: 1201, 11861; Payload ID: 7401 relates to Category No.: 10116, 1201; Payload ID: 7402 relates to Category No.: 1201; Payload ID: 7403 relates to Category No.: 926, 11861, 598; Payload ID: 7404 relates to Category No.: 926, 15973, 10116, 11861, 2271; Payload ID: 7405 relates to Category No.: 11861, 5347; Payload ID: 7406 relates to Category No.: 11981, 10116, 11861, 15887, 5347, 11983, 11985; Payload ID: 7407 relates to Category No.: 3749, 11861; Payload ID: 7409 relates to Category No.: 11895, 11861, 4198; Payload ID: 7410 relates to Category No.: 926, 942, 9539, 15973, 15895, 14597, 3464, 10116, 11861, 2271, 3361, 6242, 11933, 11828, 11886, 5534, 7017; Payload ID: 7411 relates to Category No.: 926, 11861; Payload ID: 7412 relates to Category No.: 926, 7192; Payload ID: 7413 relates to Category No.: 926, 11861; Payload ID: 7414 relates to Category No.: 926, 942, 4961, 15973, 15895, 12402, 4821, 11861, 942, 2744, 3752, 16206, 11864, 1358; Payload ID: 7415 relates to Category No.: 926, 942, 4961, 15973, 15895, 12402, 4821, 11861, 942, 2744, 3752, 16206, 11864, 1358; Payload ID: 7416 relates to Category No.: 926, 4961, 15973, 15895, 11861; Payload ID: 7417 relates to Category No.: 926, 15973, 11861, 3752, 4698; Payload ID: 7418 relates to Category No.: 926, 11861; Payload ID: 7419 relates to Category No.: 926; Payload ID: 7420 relates to Category No.: 1405, 926, 942, 15973, 15895, 11920, 11861, 2271, 3752, 4710, 7017, 14176; Payload ID: 7421 relates to Category No.: 926, 4961, 15973, 942, 2744, 3752; Payload ID: 7422 relates to Category No.: 926, 942, 4961, 15973, 15895, 4821, 10116, 11861, 942, 2744, 3752, 6944, 1358; Payload ID: 7423 relates to Category No.: 926, 15973, 15895, 10116, 11861, 3752, 4961, 4183; Payload ID: 7424 relates to Category No.: 15495, 11861; Payload ID: 7426 relates to Category No.: 926, 11861; Payload ID: 7427 relates to Category No.: 926, 9282, 942, 11939, 15973, 10116, 11861, 5347, 4896, 15473, 9062, 6944; Payload ID: 7428 relates to Category No.: 926, 15973, 3464, 10116, 11861, 5957, 15473, 9062, 6944, 11981, 4886, 5841, 16043, 2778, 15085, 2970; Payload ID: 7429 relates to Category No.: 926, 15973, 1405, 14196, 11861, 12081, 6337, 16204; Payload ID: 7430 relates to Category No.: 6816, 11861; Payload ID: 7431 relates to Category No.: 15023, 11939, 11861; Payload ID: 7432 relates to Category No.: 11861; Payload ID: 7433 relates to Category No.: 3303, 15503, 14471, 14471, 14234, 11861, 15530, 14233, 14241, 2405; Payload ID: 7434 relates to Category No.: 3303, 15503, 14471, 14471, 15491, 14243, 11861, 15528, 14255, 14241, 11939; Payload ID: 7435 relates to Category No.: 1201, 11861; Payload ID: 7436 relates to Category No.: 15503, 14471, 14471, 15495, 12081; Payload ID: 7437 relates to Category No.: 15503, 14471, 14471; Payload ID: 7438 relates to Category No.: 15503, 14471, 14471, 11861; Payload ID: 7439 relates to Category No.: 15503, 14471, 14471, 11861; Payload ID: 7440 relates to Category No.: 15503, 14471, 14471, 11861; Payload ID: 7441 relates to Category No.: 15503, 14471, 14471, 11861; Payload ID: 7442 relates to Category No.: 3003, 10116, 11939, 5839, 15583, 3688, 11752, 6301, 10097, 16312; Payload ID: 7443 relates to Category No.: 16331, 6816, 15908, 15895, 15893, 4924, 6188, 11861, 15097; Payload ID: 7444 relates to Category No.: 15908, 15893, 6188; Payload ID: 7445 relates to Category No.: 15908, 15893, 6188; Payload ID: 7446 relates to Category No.: 15908, 15893, 6188, 10116, 11861, 5878; Payload ID: 7447 relates to Category No.: 15908, 6188, 820, 11861; Payload ID: 7448 relates to Category No.: 15908, 15893, 6188; Payload ID: 7449 relates to Category No.: 15908, 15893, 6188, 12363, 12359, 11861; Payload ID: 7450 relates to Category No.: 15908, 6188, 6816, 15893, 11861, 1201; Payload ID: 7451 relates to Category No.: 15893, 6188, 15908; Payload ID: 7452 relates to Category No.: 15908, 15893, 6188, 11861, 15180; Payload ID: 7453 relates to Category No.: 15908, 6188; Payload ID: 7454 relates to Category No.: 15908, 15893, 6188, 11861; Payload ID: 7455 relates to Category No.: 15908, 15893, 6188, 11861; Payload ID: 7456 relates to Category No.: 15908, 6188, 3303, 15893, 10116, 11861, 1201; Payload ID: 7457 relates to Category No.: 4886, 15542, 9551; Payload ID: 7458 relates to Category No.: 11861; Payload ID: 7459 relates to Category No.: 16331, 12352, 11861, 4963, 9518, 321, 12354; Payload ID: 7460 relates to Category No.: 926, 949, 14601, 953; Payload ID: 7461 relates to Category No.: 926, 6816, 4965, 10116; Payload ID: 7462 relates to Category No.: 926, 3303, 6816, 4965, 10116, 11861, 6185; Payload ID: 7463 relates to Category No.: 926, 4965, 11861, 2405; Payload ID: 7464 relates to Category No.: 926, 9226, 4965; Payload ID: 7465 relates to Category No.: 926, 16331, 9226, 5308, 305, 5405, 11861, 3303, 4965, 6188, 10116, 15528, 14233, 14234, 942; Payload ID: 7466 relates to Category No.: 3303, 11917, 15530, 14233, 15503, 14471, 11939, 14234; Payload ID: 7469 relates to Category No.: 12402, 11861, 9844; Payload ID: 7470 relates to Category No.: 267, 11981, 11861, 14252, 14537, 11886; Payload ID: 7471 relates to Category No.: 1405, 6478, 11939, 4619, 11861, 11813; Payload ID: 7472 relates to Category No.: 11861, 14538; Payload ID: 7473 relates to Category No.: 3303, 14234, 11939, 14471, 15504, 15524, 15239, 11861, 15530, 14233, 13735, 3957, 3303, 1121, 14243, 15503, 14471, 2405, 15530, 14255, 5235; Payload ID: 7474 relates to Category No.: 4976; Payload ID: 7475 relates to Category No.: 11861; Payload ID: 7476 relates to Category No.: 6816, 4983, 14564, 11939, 4976, 11861, 3752, 9518, 9936; Payload ID: 7477 relates to Category No.: 6816, 4983, 11861; Payload ID: 7478 relates to Category No.: 1405, 11861; Payload ID: 7479 relates to Category No.: 1405, 11861; Payload ID: 7480 relates to Category No.: 3303, 9226, 6924, 11861, 12054, 9080; Payload ID: 7481 relates to Category No.: 12402, 11861, 15545, 2696, 1137; Payload ID: 7482 relates to Category No.: 12402, 2694, 11861, 4710, 1253, 15545, 1254; Payload ID: 7483 relates to Category No.: 11861; Payload ID: 7484 relates to Category No.: 5865, 4976, 9524, 9747, 11861, 9529, 4941; Payload ID: 7485 relates to Category No.: 5865, 4976, 9524, 9747, 11861, 9529, 4941; Payload ID: 7486 relates to Category No.: 5865, 4976, 9524, 9747, 11861, 4993, 9529, 4941; Payload ID: 7487 relates to Category No.: 5865, 4976, 9524, 9529, 11861; Payload ID: 7488 relates to Category No.: 5865, 4976, 9524, 9529, 4992; Payload ID: 7489 relates to Category No.: 5865, 4976, 9524, 9529; Payload ID: 7490 relates to Category No.: 5865, 4976, 9524, 9529; Payload ID: 7491 relates to Category No.: 5865, 4976, 9524, 9529; Payload ID: 7492 relates to Category No.: 5865, 4976, 9524, 11861, 9529; Payload ID: 7493 relates to Category No.: 5865, 4976, 9524, 11861, 9529; Payload ID: 7494 relates to Category No.: 6816, 11861, 4986; Payload ID: 7495 relates to Category No.: 14213, 9367, 6816, 14196, 11861; Payload ID: 7496 relates to Category No.: 11861; Payload ID: 7497 relates to Category No.: 15086, 17; Payload ID: 7498 relates to Category No.: 15086, 18; Payload ID: 7499 relates to Category No.: 15086, 19; Payload ID: 7500 relates to Category No.: 15086, 17, 19; Payload ID: 7501 relates to Category No.: 15086, 17; Payload ID: 7502 relates to Category No.: 15086, 11861, 17, 126; Payload ID: 7503 relates to Category No.: 15086, 17; Payload ID: 7504 relates to Category No.: 15086; Payload ID: 7505 relates to Category No.: 15086, 5000; Payload ID: 7506 relates to Category No.: 15086, 5000; Payload ID: 7507 relates to Category No.: 15086, 5000; Payload ID: 7508 relates to Category No.: 1405, 6816, 11895, 11861; Payload ID: 7509 relates to Category No.: 15542, 15548, 5007; Payload ID: 7510 relates to Category No.: 11917, 5308, 313, 11861, 15179, 1165, 5008; Payload ID: 7511 relates to Category No.: 5003, 5308, 313, 5008; Payload ID: 7512 relates to Category No.: 4864, 5009, 11861, 3774; Payload ID: 7513 relates to Category No.: 12399, 11861; Payload ID: 7514 relates to Category No.: 3303, 15503, 14471, 14471, 3459; Payload ID: 7515 relates to Category No.: 11861, 16206; Payload ID: 7516 relates to Category No.: 11861; Payload ID: 7518 relates to Category No.: 4864, 14503, 2282, 11861, 5347, 11933; Payload ID: 7519 relates to Category No.: 6816, 11920, 11861; Payload ID: 7520 relates to Category No.: 3303, 16331, 15503, 14471, 11939, 14471, 15524, 12402, 14968, 14251, 6183, 11861, 15528, 14233, 14229, 4103, 15528, 14255, 14237, 15503, 14239, 4117, 15504, 9549; Payload ID: 7521 relates to Category No.: 16331, 15503, 14471, 14471, 14968, 14251, 6183; Payload ID: 7523 relates to Category No.: 3303, 9282, 4864, 5009, 10116, 14249, 15496, 11861; Payload ID: 7524 relates to Category No.: 3303, 11861, 2405; Payload ID: 7525 relates to Category No.: 4864; Payload ID: 7526 relates to Category No.: 5259, 12402, 5862, 2672; Payload ID: 7527 relates to Category No.: 9518, 2672, 4158, 4166; Payload ID: 7528 relates to Category No.: 9518, 2672, 4166; Payload ID: 7529 relates to Category No.: 14503, 9619, 1430, 14506, 11861, 14505; Payload ID: 7530 relates to Category No.: 11917, 11861; Payload ID: 7532 relates to Category No.: 11939, 11917, 11861; Payload ID: 7533 relates to Category No.: 11861; Payload ID: 7534 relates to Category No.: 12359, 4899, 11861; Payload ID: 7535 relates to Category No.: 11861; Payload ID: 7537 relates to Category No.: 11861, 7192; Payload ID: 7538 relates to Category No.: 11861; Payload ID: 7539 relates to Category No.: 3303, 15503, 14471, 11939, 14471, 15504, 11917, 5109, 11861, 15530, 14233, 7545, 14251, 14471, 2271; Payload ID: 7540 relates to Category No.: 15504, 11917, 3303, 3459; Payload ID: 7541 relates to Category No.: 3303, 15504, 11917; Payload ID: 7542 relates to Category No.: 3303, 11917, 15504; Payload ID: 7543 relates to Category No.: 3303, 15504, 11917, 15530, 14233; Payload ID: 7544 relates to Category No.: 3303, 15503, 14471, 15504, 11917, 15493, 14243, 15530, 14255; Payload ID: 7545 relates to Category No.: 3303, 15504, 11917; Payload ID: 7546 relates to Category No.: 3303, 15503, 14471, 15504, 11917, 11861, 15503, 14235, 15503, 11861, 6957, 14471; Payload ID: 7547 relates to Category No.: 3303, 11917, 15503, 14471, 14471, 15504, 5109, 11861, 14229, 15503, 14235, 15503, 11861, 6957; Payload ID: 7548 relates to Category No.: 3303, 15503, 14471, 11933, 15504, 11917, 15495, 11861, 15503, 14235, 15503, 11861, 6957, 487, 15528, 14233, 14471, 11939, 14237, 14249; Payload ID: 7549 relates to Category No.: 3303, 14471, 11861, 2405, 11895, 12064; Payload ID: 7550 relates to Category No.: 3303, 9275, 11861; Payload ID: 7551 relates to Category No.: 9282, 9226, 14196, 15503, 14471, 14471, 10116, 7268; Payload ID: 7552 relates to Category No.: 9282, 9226, 14196, 11981, 10116, 992; Payload ID: 7553 relates to Category No.: 9282, 9226, 14196, 14597, 10116, 11861, 14602; Payload ID: 7554 relates to Category No.: 9282, 9226, 14196; Payload ID: 7555 relates to Category No.: 9282, 9226, 14196, 10116, 11861, 14603, 11704; Payload ID: 7556 relates to Category No.: 9282, 9226, 14196, 10116, 11861, 7268, 14274; Payload ID: 7557 relates to Category No.: 9282, 9226, 14196, 14234, 9271, 10116, 11861, 5347, 7265, 14240, 10122, 7429; Payload ID: 7558 relates to Category No.: 9282, 9226, 10116; Payload ID: 7559 relates to Category No.: 9226; Payload ID: 7560 relates to Category No.: 9282, 9226, 14196; Payload ID: 7561 relates to Category No.: 9226; Payload ID: 7562 relates to Category No.: 9282, 9226, 14196, 10116, 11861, 15265, 15504, 2405, 5109, 7264, 916; Payload ID: 7563 relates to Category No.: 3303, 9282, 9226, 3459, 10115, 14597, 10116, 10121; Payload ID: 7564 relates to Category No.: 9282, 9226, 14196, 10116, 11861, 14602, 15239, 15504; Payload ID: 7565 relates to Category No.: 9282, 9226, 14196, 10116, 11861, 10122; Payload ID: 7566 relates to Category No.: 9282, 9226, 14196, 10116, 11861; Payload ID: 7567 relates to Category No.: 9282, 9226, 14196, 10116, 11861; Payload ID: 7568 relates to Category No.: 9226, 14196, 14234, 14597, 10116, 11861, 15528, 14233, 11920, 15504, 4961, 322, 3459, 943, 14147, 7265, 2689, 7271, 6022, 11698, 2767; Payload ID: 7569 relates to Category No.: 9282, 9226, 14196, 15524, 10116, 11861; Payload ID: 7570 relates to Category No.: 9282, 9226, 14196, 10116, 7268, 11861; Payload ID: 7571 relates to Category No.: 9282, 9226, 14196, 11920, 10116, 11861, 11855, 1439; Payload ID: 7572 relates to Category No.: 9282, 9226, 14196, 10116, 11861, 7265; Payload ID: 7573 relates to Category No.: 926, 3303, 14196, 10116, 11861, 2688, 14147, 10121, 3731; Payload ID: 7574 relates to Category No.: 11861, 14196, 10116, 3752; Payload ID: 7575 relates to Category No.: 10116, 11861; Payload ID: 7576 relates to Category No.: 11861, 2833, 14715; Payload ID: 7577 relates to Category No.: 11861, 2833, 14715; Payload ID: 7578 relates to Category No.: 926, 9988, 512, 4520, 4532, 4295, 6582, 5043, 11861; Payload ID: 7579 relates to Category No.: 926, 11861, 9988, 512, 4520, 4295, 6582, 5043, 4532; Payload ID: 7580 relates to Category No.: 926, 9988, 512, 4520, 4532, 4295, 6582, 5043; Payload ID: 7581 relates to Category No.: 926, 9988, 512, 4520, 4532, 4295, 6582, 5043; Payload ID: 7582 relates to Category No.: 5308, 5311, 1172; Payload ID: 7583 relates to Category No.: 11933, 5308, 5311, 242, 1172; Payload ID: 7584 relates to Category No.: 5308, 5311, 11939, 11933, 242, 1172; Payload ID: 7585 relates to Category No.: 7510, 4545, 176, 4529, 1504; Payload ID: 7586 relates to Category No.: 926, 9226, 4965; Payload ID: 7587 relates to Category No.: 14503, 14506, 11861; Payload ID: 7588 relates to Category No.: 7192, 1201; Payload ID: 7589 relates to Category No.: 14379, 12352, 7192, 9518, 321, 12354; Payload ID: 7590 relates to Category No.: 12352, 11861, 9518, 321, 12354; Payload ID: 7591 relates to Category No.: 11861; Payload ID: 7597 relates to Category No.: 9226, 14196, 6210, 10116, 11861; Payload ID: 7598 relates to Category No.: 2405, 3303, 15503, 14471, 11861, 11933; Payload ID: 7599 relates to Category No.: 2405, 3303, 11861, 11933; Payload ID: 7600 relates to Category No.: 3303, 15503, 14471, 2405, 15504, 14082, 11861, 3752, 6185, 3380, 157, 15528, 14239, 14087, 916, 9763; Payload ID: 7601 relates to Category No.: 3303, 15504, 1471, 13683, 9271, 14652, 11861, 2688, 15530, 14233, 15528, 14233, 3380, 15503, 15504, 157, 1356, 916, 3387, 6931, 6930, 3752; Payload ID: 7602 relates to Category No.: 3303, 6401, 15503, 14471, 2405, 15504, 2963, 3459, 14597, 2874, 2282, 10116, 11861, 13735, 3303, 1121, 6242, 4288, 3347, 15106, 1338, 12377, 2804, 3464, 14602; Payload ID: 7603 relates to Category No.: 3303, 15503, 14471, 2405, 15504, 2963, 3459, 15524, 14597, 2282, 10116, 11861, 3471, 3303, 1121, 4288, 15106, 12377, 3732, 9104, 1121, 11920; Payload ID: 7604 relates to Category No.: 3303, 2405, 3459, 10116, 11861, 3303, 1121, 4288; Payload ID: 7605 relates to Category No.: 3303, 2405, 11861; Payload ID: 7606 relates to Category No.: 9271, 10116; Payload ID: 7607 relates to Category No.: 9271, 15409; Payload ID: 7608 relates to Category No.: 9271; Payload ID: 7609 relates to Category No.: 9271, 3303, 2405; Payload ID: 7610 relates to Category No.: 2405, 9271, 10116; Payload ID: 7611 relates to Category No.: 3303; Payload ID: 7612 relates to Category No.: 1405, 267, 11861, 5957; Payload ID: 7613 relates to Category No.: 1405, 11861, 11895, 11920, 1404; Payload ID: 7614 relates to Category No.: 1405, 11861; Payload ID: 7615 relates to Category No.: 15629, 15046; Payload ID: 7616 relates to Category No.: 15629, 15046; Payload ID: 7617 relates to Category No.: 15629; Payload ID: 7618 relates to Category No.: 11861; Payload ID: 7619 relates to Category No.: 9080, 5077; Payload ID: 7620 relates to Category No.: 4820, 5079, 5074; Payload ID: 7621 relates to Category No.: 4820, 5079; Payload ID: 7622 relates to Category No.: 4820, 5079, 5074; Payload ID: 7623 relates to Category No.: 4820, 5079, 5074; Payload ID: 7624 relates to Category No.: 11861, 5314; Payload ID: 7625 relates to Category No.: 6816, 11861; Payload ID: 7626 relates to Category No.: 1630, 642, 5085; Payload ID: 7627 relates to Category No.: 1537, 12292, 11861, 5090; Payload ID: 7628 relates to Category No.: 1405, 11861, 5841, 943; Payload ID: 7630 relates to Category No.: 9282, 5308, 1630, 11983; Payload ID: 7631 relates to Category No.: 9282, 5308, 1630; Payload ID: 7632 relates to Category No.: 9282, 5308, 1630; Payload ID: 7633 relates to Category No.: 16331, 6816, 4976, 5003, 2858, 12402, 5009, 11861, 5377; Payload ID: 7634 relates to Category No.: 926, 5093, 632; Payload ID: 7635 relates to Category No.: 926, 11939, 10116, 11861, 5093, 632, 9282; Payload ID: 7636 relates to Category No.: 894, 11939, 15895, 9619, 11861, 893, 5801; Payload ID: 7637 relates to Category No.: 6816, 4894, 11861; Payload ID: 7639 relates to Category No.: 14504; Payload ID: 7640 relates to Category No.: 5096, 5105, 11861, 4930; Payload ID: 7641 relates to Category No.: 15503, 14471, 15495, 11861; Payload ID: 7642 relates to Category No.: 3303, 11861, 2406; Payload ID: 7643 relates to Category No.: 3303, 5109, 10116, 2406; Payload ID: 7644 relates to Category No.: 3303, 10116, 11861, 2406; Payload ID: 7645 relates to Category No.: 3303, 10116, 2406, 11861; Payload ID: 7646 relates to Category No.: 3303, 10116, 11861, 2406; Payload ID: 7647 relates to Category No.: 3303; Payload ID: 7648 relates to Category No.: 3303, 11933; Payload ID: 7649 relates to Category No.: 3303, 11933; Payload ID: 7650 relates to Category No.: 3303, 11933, 7192; Payload ID: 7651 relates to Category No.: 3303, 11933, 7192; Payload ID: 7652 relates to Category No.: 3303, 11933; Payload ID: 7653 relates to Category No.: 3303, 11933, 11861, 3752; Payload ID: 7654 relates to Category No.: 3303, 11933, 7192; Payload ID: 7655 relates to Category No.: 3303, 11933, 11861, 3752; Payload ID: 7656 relates to Category No.: 3303, 11933, 7192; Payload ID: 7657 relates to Category No.: 3303, 11933, 11861, 3752; Payload ID: 7658 relates to Category No.: 3303, 11933, 11861, 3752; Payload ID: 7659 relates to Category No.: 3303, 11933, 11861, 3752; Payload ID: 7660 relates to Category No.: 3303, 11933, 7192; Payload ID: 7661 relates to Category No.: 3303, 11933, 11861; Payload ID: 7662 relates to Category No.: 3303, 11933, 11861; Payload ID: 7663 relates to Category No.: 3303, 11933, 7192; Payload ID: 7664 relates to Category No.: 3303, 11933, 11861; Payload ID: 7665 relates to Category No.: 3303, 11933, 11861; Payload ID: 7666 relates to Category No.: 3303, 11933, 11861; Payload ID: 7667 relates to Category No.: 3303, 11933; Payload ID: 7668 relates to Category No.: 3303, 11933, 11861; Payload ID: 7669 relates to Category No.: 3303, 11933; Payload ID: 7670 relates to Category No.: 3303, 11933, 7192; Payload ID: 7671 relates to Category No.: 3303, 11933; Payload ID: 7672 relates to Category No.: 3303, 11933; Payload ID: 7673 relates to Category No.: 3303, 11933; Payload ID: 7674 relates to Category No.: 3303, 11933; Payload ID: 7675 relates to Category No.: 3303, 11933, 5105, 11861; Payload ID: 7676 relates to Category No.: 3303, 11933, 5105, 11861; Payload ID: 7677 relates to Category No.: 3303, 11933, 5105, 11861; Payload ID: 7678 relates to Category No.: 3303, 11933, 5105, 11861; Payload ID: 7679 relates to Category No.: 3303, 11933, 5105, 11861; Payload ID: 7680 relates to Category No.: 3303, 11933, 5105, 11861; Payload ID: 7681 relates to Category No.: 3303, 11933, 5105, 11861; Payload ID: 7682 relates to Category No.: 3303, 11933, 5105, 11861; Payload ID: 7683 relates to Category No.: 3303, 11933, 5105, 11861; Payload ID: 7684 relates to Category No.: 3303, 11933, 5105, 11861; Payload ID: 7685 relates to Category No.: 3303, 11933, 5105, 10116, 11861, 5123; Payload ID: 7686 relates to Category No.: 3303, 11933, 5105, 10116, 11861, 5123; Payload ID: 7687 relates to Category No.: 3303, 11933, 5105, 10116, 11861, 5123; Payload ID: 7688 relates to Category No.: 3303, 11933, 5105, 10116, 11861, 5123; Payload ID: 7689 relates to Category No.: 3303, 11933, 5105, 10116, 11861, 5123; Payload ID: 7690 relates to Category No.: 3303, 11933, 5105, 10116, 11861, 5123; Payload ID: 7691 relates to Category No.: 3303, 11933, 11861, 7192; Payload ID: 7692 relates to Category No.: 3303, 11933, 5105, 10116, 11861, 5123; Payload ID: 7693 relates to Category No.: 3303, 11933, 5105, 10116, 11861, 5123; Payload ID: 7694 relates to Category No.: 3303, 11933, 5105, 10116, 11861, 5123; Payload ID: 7695 relates to Category No.: 3303, 11933, 5105, 10116, 11861, 5123; Payload ID: 7696 relates to Category No.: 3303, 11933, 5105, 10116, 11861, 5123; Payload ID: 7697 relates to Category No.: 3303, 11933, 7192; Payload ID: 7698 relates to Category No.: 3303, 11933, 7192; Payload ID: 7699 relates to Category No.: 3303, 11933, 7192; Payload ID: 7700 relates to Category No.: 3303, 11933, 7192; Payload ID: 7701 relates to Category No.: 3303, 11933; Payload ID: 7702 relates to Category No.: 3303, 11933, 7192; Payload ID: 7703 relates to Category No.: 3303, 11933; Payload ID: 7704 relates to Category No.: 3303, 11933, 5105, 11861; Payload ID: 7705 relates to Category No.: 3303, 11933, 5105, 11861; Payload ID: 7706 relates to Category No.: 3303, 11933, 5105, 11861; Payload ID: 7707 relates to Category No.: 3303, 11933, 5105, 10116, 11861, 5123; Payload ID: 7708 relates to Category No.: 3303, 11933, 5105, 10116, 11861, 5123; Payload ID: 7709 relates to Category No.: 3303, 11933; Payload ID: 7710 relates to Category No.: 3303, 11933, 7192; Payload ID: 7711 relates to Category No.: 3303, 11933, 5105, 11861; Payload ID: 7712 relates to Category No.: 3303, 11933, 5105, 10116, 11861, 5123; Payload ID: 7713 relates to Category No.: 15503, 14471, 14234, 15504, 15524, 5109, 9271, 11861, 14249, 2688, 2998, 5108, 15525, 3752, 13735, 7496, 12064, 14240, 14244, 11896, 9014, 327; Payload ID: 7714 relates to Category No.: 5308, 5109, 11861, 5108, 3752, 7496, 11896; Payload ID: 7715 relates to Category No.: 5308, 15504, 5108, 7496, 11861; Payload ID: 7716 relates to Category No.: 14234, 2405, 14471, 15504, 9271, 10116, 11861, 2998, 5108, 3752, 7496, 14240, 14244, 11896, 9014, 4961, 2688; Payload ID: 7717 relates to Category No.: 2405, 15504, 15495, 5109, 11861, 2823, 5108, 3752, 7496, 11896, 9014, 3303, 2406, 5308; Payload ID: 7718 relates to Category No.: 16331, 14471, 15504, 15524, 5109, 11861, 2688, 5108, 11666, 13735, 7496, 11896, 327, 14261, 3303, 11981, 2405, 15495; Payload ID: 7719 relates to Category No.: 6816, 15504, 15524, 5109, 11861, 2688, 5108, 13735, 11983, 7496, 11896, 14261, 15495, 2405; Payload ID: 7720 relates to Category No.: 16331, 267, 6965, 15895, 5109, 1153, 598, 11861, 2688, 5108, 3752, 7496, 5282, 15230, 7017, 3510, 10163, 15769, 15887, 1173; Payload ID: 7721 relates to Category No.: 6816, 11981, 11861, 5108, 13735, 11983, 7496, 37, 327, 2405, 15495; Payload ID: 7722 relates to Category No.: 6816, 15504, 5108, 7496; Payload ID: 7723 relates to Category No.: 6816, 15504, 15495, 5109, 11861, 5108, 13735, 11983, 7496, 11896; Payload ID: 7724 relates to Category No.: 3303, 6816, 15503, 14471, 15524, 5105, 15491, 11861, 3752, 15530, 14233, 2405, 14234; Payload ID: 7725 relates to Category No.: 9518, 15491, 11861, 9518, 318, 7477, 7472; Payload ID: 7726 relates to Category No.: 9282, 9226, 10116; Payload ID: 7727 relates to Category No.: 9226, 6816, 3303; Payload ID: 7729 relates to Category No.: 11861; Payload ID: 7730 relates to Category No.: 3303, 5956; Payload ID: 7731 relates to Category No.: 2405, 3303; Payload ID: 7732 relates to Category No.: 3303, 14196, 11861; Payload ID: 7733 relates to Category No.: 2500; Payload ID: 7734 relates to Category No.: 3303, 15503, 14471, 11939, 11933, 11917, 15524, 11861, 15528, 14233, 15528, 14255, 14237, 14471, 15504, 3459, 15494; Payload ID: 7735 relates to Category No.: 3303, 15503, 14471, 11939, 11861, 11933, 15524, 15503, 14239, 14471, 11886, 2689; Payload ID: 7736 relates to Category No.: 11861; Payload ID: 7737 relates to Category No.: 3303, 5105, 11861, 5347; Payload ID: 7738 relates to Category No.: 926, 11861, 1212, 3752, 1208, 1213, 1214, 1215, 1217, 11939; Payload ID: 7739 relates to Category No.: 6816, 5240, 11861; Payload ID: 7740 relates to Category No.: 3303, 14471, 11861; Payload ID: 7741 relates to Category No.: 3303, 14234, 14471, 5109, 11861, 15528, 14233; Payload ID: 7742 relates to Category No.: 3303, 14471, 11861; Payload ID: 7743 relates to Category No.: 3303, 14471, 15503, 14471, 11861, 15524; Payload ID: 7744 relates to Category No.: 3303, 15503, 14471, 14471, 15530, 14233, 14234; Payload ID: 7745 relates to Category No.: 3303, 15503, 14471, 14471, 11861, 5235; Payload ID: 7746 relates to Category No.: 3303, 15503, 14471, 14471; Payload ID: 7747 relates to Category No.: 3303, 15503, 14471, 14234, 14471, 11861, 15528, 14233; Payload ID: 7748 relates to Category No.: 3303, 15503, 14471, 14471; Payload ID: 7749 relates to Category No.: 3303, 15503, 14471, 14234, 14471, 15504, 15528, 14233; Payload ID: 7750 relates to Category No.: 3303, 14471, 11861, 3752; Payload ID: 7751 relates to Category No.: 3303, 15503, 14471, 15495, 11861; Payload ID: 7752 relates to Category No.: 3303, 14471, 11920; Payload ID: 7753 relates to Category No.: 3303, 14471, 11861; Payload ID: 7754 relates to Category No.: 3303, 15503, 14471, 14471; Payload ID: 7755 relates to Category No.: 3303, 15503, 14471, 14471, 14237; Payload ID: 7756 relates to Category No.: 3303, 15503, 14471, 14471; Payload ID: 7757 relates to Category No.: 3303, 15503, 14471, 14471, 11861, 14240, 15528, 14239; Payload ID: 7758 relates to Category No.: 3303, 15503, 14471, 14471, 10116, 11861; Payload ID: 7759 relates to Category No.: 3303, 15503, 14471, 14471, 11861; Payload ID: 7760 relates to Category No.: 3303, 14471, 15503, 14471; Payload ID: 7761 relates to Category No.: 3303, 14471, 11861; Payload ID: 7762 relates to Category No.: 3303, 14471; Payload ID: 7763 relates to Category No.: 3303, 14234, 14471, 15528, 14233; Payload ID: 7764 relates to Category No.: 3303, 14471; Payload ID: 7765 relates to Category No.: 3303, 14471, 11861, 15528, 14233, 2405; Payload ID: 7766 relates to Category No.: 3303, 15503, 14471, 14471, 11861, 5235; Payload ID: 7767 relates to Category No.: 3303, 15503, 14471, 14471; Payload ID: 7768 relates to Category No.: 3303, 15503, 14471, 14471, 15495; Payload ID: 7769 relates to Category No.: 3303, 15503, 14471, 14471; Payload ID: 7770 relates to Category No.: 3303, 14471, 11861; Payload ID: 7771 relates to Category No.: 3303, 11861; Payload ID: 7772 relates to Category No.: 3303, 14471; Payload ID: 7773 relates to Category No.: 3303, 14471, 15503, 14471, 11861, 2405; Payload ID: 7774 relates to Category No.: 3303, 14471; Payload ID: 7775 relates to Category No.: 3303, 14471, 11861; Payload ID: 7776 relates to Category No.: 3303, 14471, 15528, 14233, 15503, 14471, 2405, 14234; Payload ID: 7777 relates to Category No.: 3303, 15503, 14471, 14471, 11861; Payload ID: 7778 relates to Category No.: 3303, 15503, 14471, 14471; Payload ID: 7779 relates to Category No.: 3303, 15503, 14471, 14471, 14243, 15528, 14255; Payload ID: 7780 relates to Category No.: 3303, 14471, 14243, 15530, 14255, 15503, 14471; Payload ID: 7781 relates to Category No.: 11978, 926, 12109, 11861; Payload ID: 7782 relates to Category No.: 11978, 926, 12109, 15495, 14652, 11861, 14229, 14246, 16204; Payload ID: 7783 relates to Category No.: 11978, 926, 12109, 11861; Payload ID: 7784 relates to Category No.: 11978, 926, 12109, 11861; Payload ID: 7785 relates to Category No.: 11861, 5841, 14580, 4813; Payload ID: 7786 relates to Category No.: 11861, 4813, 267, 4467, 11939, 11933, 11920, 4578; Payload ID: 7787 relates to Category No.: 11861, 4813, 11920, 11895; Payload ID: 7788 relates to Category No.: 11861; Payload ID: 7789 relates to Category No.: 12150, 12151, 9804, 11861; Payload ID: 7791 relates to Category No.: 11861, 7192, 5841; Payload ID: 7792 relates to Category No.: 6816, 5249; Payload ID: 7793 relates to Category No.: 11861, 5347, 267; Payload ID: 7794 relates to Category No.: 11861, 5347; Payload ID: 7795 relates to Category No.: 6965, 11861, 5347; Payload ID: 7796 relates to Category No.: 3303, 11861; Payload ID: 7797 relates to Category No.: 11861; Payload ID: 7798 relates to Category No.: 11861; Payload ID: 7799 relates to Category No.: 11978, 926, 12109; Payload ID: 7800 relates to Category No.: 1405; Payload ID: 7801 relates to Category No.: 15503, 14471, 2405, 15491, 11861, 5347, 5099, 5100, 5098, 15528, 14239; Payload ID: 7803 relates to Category No.: 15491, 11861; Payload ID: 7804 relates to Category No.: 3303, 14471; Payload ID: 7806 relates to Category No.: 5308, 15542, 15548; Payload ID: 7807 relates to Category No.: 11861, 7471; Payload ID: 7808 relates to Category No.: 6816, 11861, 7192, 2271; Payload ID: 7809 relates to Category No.: 11861, 3753, 444, 1201; Payload ID: 7810 relates to Category No.: 11861; Payload ID: 7812 relates to Category No.: 926; Payload ID: 7813 relates to Category No.: 14503, 5547, 14506, 11861; Payload ID: 7814 relates to Category No.: 14503, 15973, 9619, 14506, 11861; Payload ID: 7815 relates to Category No.: 14503, 5547, 3663, 14506, 11861; Payload ID: 7816 relates to Category No.: 14503, 5547, 3663, 11861; Payload ID: 7817 relates to Category No.: 3303, 6816, 14471, 15524, 11861, 15530, 14239, 14240, 9226; Payload ID: 7818 relates to Category No.: 3303, 6816, 15503, 14471, 14471, 15524; Payload ID: 7819 relates to Category No.: 6816, 15503, 14471, 14471, 15524, 3303; Payload ID: 7820 relates to Category No.: 15504, 9539, 11861, 5347, 5841, 1173, 11759, 3505, 3512, 1201, 3229, 12402; Payload ID: 7821 relates to Category No.: 267, 15021, 9857, 9939, 2491, 11861; Payload ID: 7822 relates to Category No.: 267, 9857, 9939, 2491, 11861; Payload ID: 7823 relates to Category No.: 11861; Payload ID: 7824 relates to Category No.: 3303, 11933, 11861; Payload ID: 7825 relates to Category No.: 11861, 5841, 1299; Payload ID: 7826 relates to Category No.: 11861; Payload ID: 7828 relates to Category No.: 5293, 11861; Payload ID: 7829 relates to Category No.: 5293, 11861; Payload ID: 7830 relates to Category No.: 5293, 11861; Payload ID: 7831 relates to Category No.: 5293, 11861; Payload ID: 7832 relates to Category No.: 1405, 14503, 11861, 4720; Payload ID: 7833 relates to Category No.: 11861; Payload ID: 7834 relates to Category No.: 5292; Payload ID: 7835 relates to Category No.: 5292; Payload ID: 7836 relates to Category No.: 5292; Payload ID: 7837 relates to Category No.: 5293, 11861; Payload ID: 7838 relates to Category No.: 15504, 5295, 5292; Payload ID: 7839 relates to Category No.: 5293, 11861, 3752, 12425, 15561, 5295, 16206, 5294, 12422, 14246; Payload ID: 7840 relates to Category No.: 11861, 5295, 5294; Payload ID: 7841 relates to Category No.: 5295; Payload ID: 7844 relates to Category No.: 5840, 16248, 16258, 16250; Payload ID: 7845 relates to Category No.: 11861; Payload ID: 7846 relates to Category No.: 9518, 12402, 4225, 8, 16147, 6313, 6662, 4697, 4744; Payload ID: 7847 relates to Category No.: 9518, 4225, 12402, 8, 16147, 6313, 6662; Payload ID: 7848 relates to Category No.: 9518, 108, 7490; Payload ID: 7849 relates to Category No.: 9518, 1630, 108, 11861, 229, 3736, 6314, 4117, 7472, 11886, 230, 6319; Payload ID: 7850 relates to Category No.: 1630, 15542, 15549, 108, 10116, 11861, 230, 3736, 6314; Payload ID: 7851 relates to Category No.: 5313, 6816; Payload ID: 7852 relates to Category No.: 6816, 5308, 5313; Payload ID: 7853 relates to Category No.: 6401; Payload ID: 7854 relates to Category No.: 4820; Payload ID: 7855 relates to Category No.: 4820, 9037; Payload ID: 7856 relates to Category No.: 4820; Payload ID: 7857 relates to Category No.: 9518, 321, 7477, 100, 14965; Payload ID: 7858 relates to Category No.: 9518, 321, 7477, 100, 14965; Payload ID: 7859 relates to Category No.: 9518, 321, 7477, 11861, 100, 2339; Payload ID: 7860 relates to Category No.: 5316, 11861; Payload ID: 7861 relates to Category No.: 5318, 11861, 614, 1531, 2557, 16032; Payload ID: 7862 relates to Category No.: 11939, 9518, 1630, 7472, 7490, 11805, 38; Payload ID: 7863 relates to Category No.: 11861, 7192, 5324; Payload ID: 7864 relates to Category No.: 9518, 32, 33; Payload ID: 7865 relates to Category No.: 9518; Payload ID: 7866 relates to Category No.: 9518, 7472, 14961, 33; Payload ID: 7867 relates to Category No.: 9518, 1630, 3930, 15302; Payload ID: 7868 relates to Category No.: 9518, 108, 10116, 11861, 2335, 15303, 106, 3936, 7472, 14961, 5347, 1146, 3930, 210; Payload ID: 7869 relates to Category No.: 9518, 3930, 14964; Payload ID: 7870 relates to Category No.: 9518, 3930, 11861, 5009, 4196, 2566; Payload ID: 7871 relates to Category No.: 9518, 7192; Payload ID: 7872 relates to Category No.: 9518, 3930, 11861, 15299; Payload ID: 7873 relates to Category No.: 9518, 3930, 15302, 42; Payload ID:

7874 relates to Category No.: 9518, 15299; Payload ID: 7875 relates to Category No.: 11939, 9518, 12402, 108, 5892, 6319, 98, 44; Payload ID: 7876 relates to Category No.: 3554, 9518, 1630, 3930, 14089, 15302; Payload ID: 7877 relates to Category No.: 9518, 3930, 115; Payload ID: 7878 relates to Category No.: 9518, 108, 3930, 11861, 15302; Payload ID: 7879 relates to Category No.: 9518; Payload ID: 7880 relates to Category No.: 9518, 7192; Payload ID: 7881 relates to Category No.: 11861, 6816, 15503, 14471, 14471, 5109; Payload ID: 7882 relates to Category No.: 3303, 6816, 11895, 11861; Payload ID: 7883 relates to Category No.: 16251, 5840, 16259, 11662, 5765, 1467, 11861, 5347; Payload ID: 7884 relates to Category No.: 16251, 5840, 16259, 5347, 5765, 1467, 11861; Payload ID: 7885 relates to Category No.: 16251, 5840, 16259, 1467, 11861; Payload ID: 7886 relates to Category No.: 16251, 5840, 16259, 5347, 5765, 1467; Payload ID: 7887 relates to Category No.: 15787, 15794; Payload ID: 7888 relates to Category No.: 4820, 8960, 9405, 9629, 9636; Payload ID: 7889 relates to Category No.: 4820, 8960, 9405, 9629, 9636; Payload ID: 7890 relates to Category No.: 9282, 6478, 11939, 11861, 5339, 4907, 5347; Payload ID: 7891 relates to Category No.: 15503, 14471, 11933, 14471, 15504, 11917, 15895, 11981, 11861, 3752, 9173, 15503, 14239, 5282, 15503, 15504, 15528, 14255, 5101, 14251, 14471, 15528, 14233, 3303, 5109, 15503, 14252, 11886; Payload ID: 7892 relates to Category No.: 16331, 11939, 5865, 9518, 315, 16283, 83, 679, 11861, 9122, 2559, 9014, 1531, 9527, 9678, 9663, 713; Payload ID: 7893 relates to Category No.: 11917, 14251, 14471, 15491, 15495, 3303, 15503, 14471, 11861; Payload ID: 7894 relates to Category No.: 12402, 11861; Payload ID: 7895 relates to Category No.: 926; Payload ID: 7896 relates to Category No.: 15542, 10116; Payload ID: 7897 relates to Category No.: 926, 5956, 7192, 4522; Payload ID: 7898 relates to Category No.: 6816, 1630, 15093, 5349; Payload ID: 7899 relates to Category No.: 5308, 5311, 6181, 12402; Payload ID: 7901 relates to Category No.: 11861; Payload ID: 7904 relates to Category No.: 11861; Payload ID: 7905 relates to Category No.: 11861; Payload ID: 7906 relates to Category No.: 11861; Payload ID: 7907 relates to Category No.: 11861; Payload ID: 7908 relates to Category No.: 11861, 5347; Payload ID: 7909 relates to Category No.: 3303, 6816, 15503, 14471, 15524, 11861, 14240, 14471, 11933, 14237, 10152, 9226; Payload ID: 7910 relates to Category No.: 9226, 6816, 15503, 14471, 15524, 11861, 7192, 11939, 11933; Payload ID: 7911 relates to Category No.: 6816, 15503, 14471, 11939, 11933, 14471, 15524, 11861, 14243, 15528, 14255, 9226; Payload ID: 7912 relates to Category No.: 6816, 15503, 14471, 15524, 11861, 14471, 11939, 11933, 1178, 9226; Payload ID: 7913 relates to Category No.: 6816, 15503, 14471, 14243; Payload ID: 7914 relates to Category No.: 11861; Payload ID: 7915 relates to Category No.: 11861, 11978, 926, 6816, 9096, 12145; Payload ID: 7916 relates to Category No.: 6478, 15542, 1630, 11861, 15346, 7192; Payload ID: 7917 relates to Category No.: 15596, 14176, 631, 15596, 2550; Payload ID: 7918 relates to Category No.: 3303; Payload ID: 7919 relates to Category No.: 11861; Payload ID: 7923 relates to Category No.: 4886, 5308; Payload ID: 7924 relates to Category No.: 4886, 5308; Payload ID: 7925 relates to Category No.: 4886; Payload ID: 7926 relates to Category No.: 11861; Payload ID: 7927 relates to Category No.: 11861, 12088, 12077, 11920, 7126, 11886; Payload ID: 7928 relates to Category No.: 11861, 735, 5386; Payload ID: 7929 relates to Category No.: 11861; Payload ID: 7930 relates to Category No.: 11861; Payload ID: 7931 relates to Category No.: 11861, 735, 5386; Payload ID: 7932 relates to Category No.: 11861, 735, 5386; Payload ID: 7933 relates to Category No.: 11861, 735, 5386; Payload ID: 7934 relates to Category No.: 11861; Payload ID: 7935 relates to Category No.: 11861, 735, 5386; Payload ID: 7936 relates to Category No.: 11861, 735, 15617; Payload ID: 7974 relates to Category No.: 11861; Payload ID: 7975 relates to Category No.: 11861; Payload ID: 7976 relates to Category No.: 11861; Payload ID: 7977 relates to Category No.: 11861; Payload ID: 7978 relates to Category No.: 11861; Payload ID: 7979 relates to Category No.: 11861; Payload ID: 7980 relates to Category No.: 11861; Payload ID: 7981 relates to Category No.: 11861; Payload ID: 7982 relates to Category No.: 11861; Payload ID: 7983 relates to Category No.: 11861; Payload ID: 7984 relates to Category No.: 11861; Payload ID: 7985 relates to Category No.: 11861; Payload ID: 7986 relates to Category No.: 11861; Payload ID: 7987 relates to Category No.: 11861; Payload ID: 7988 relates to Category No.: 11861; Payload ID: 7989 relates to Category No.: 11861; Payload ID: 7990 relates to Category No.: 11861; Payload ID: 7991 relates to Category No.: 11861; Payload ID: 7992 relates to Category No.: 11861; Payload ID: 7993 relates to Category No.: 11861; Payload ID: 7994 relates to Category No.: 11861; Payload ID: 7995 relates to Category No.: 11861; Payload ID: 7996 relates to Category No.: 11861; Payload ID: 7997 relates to Category No.: 11861; Payload ID: 7998 relates to Category No.: 11861; Payload ID: 7999 relates to Category No.: 11861; Payload ID: 8000 relates to Category No.: 11861; Payload ID: 8001 relates to Category No.: 11861; Payload ID: 8002 relates to Category No.: 11861; Payload ID: 8003 relates to Category No.: 11861; Payload ID: 8004 relates to Category No.: 11861; Payload ID: 8005 relates to Category No.: 11861; Payload ID: 8006 relates to Category No.: 11861; Payload ID: 8007 relates to Category No.: 11861; Payload ID: 8008 relates to Category No.: 11861, 735, 5386; Payload ID: 8009 relates to Category No.: 11861; Payload ID: 8010 relates to Category No.: 11861; Payload ID: 8011 relates to Category No.: 11861; Payload ID: 8012 relates to Category No.: 11861; Payload ID: 8013 relates to Category No.: 11861; Payload ID: 8014 relates to Category No.: 11861; Payload ID: 8015 relates to Category No.: 11861; Payload ID: 8016 relates to Category No.: 11861; Payload ID: 8017 relates to Category No.: 11861; Payload ID: 8018 relates to Category No.: 11861; Payload ID: 8019 relates to Category No.: 11861; Payload ID: 8020 relates to Category No.: 11861; Payload ID: 8021 relates to Category No.: 11861; Payload ID: 8022 relates to Category No.: 11861; Payload ID: 8023 relates to Category No.: 11861; Payload ID: 8024 relates to Category No.: 11861; Payload ID: 8025 relates to Category No.: 11861; Payload ID: 8026 relates to Category No.: 11861; Payload ID: 8027 relates to Category No.: 11861; Payload ID: 8028 relates to Category No.: 11861; Payload ID: 8029 relates to Category No.: 11861; Payload ID: 8030 relates to Category No.: 11861; Payload ID: 8031 relates to Category No.: 11861; Payload ID: 8032 relates to Category No.: 11861; Payload ID: 8033 relates to Category No.: 11861; Payload ID: 8034 relates to Category No.: 11861; Payload ID: 8040 relates to Category No.: 11861; Payload ID: 8041 relates to Category No.: 11861; Payload ID: 8042 relates to Category No.: 11861; Payload ID: 8043 relates to Category No.: 11861; Payload ID: 8044 relates to Category No.: 11861; Payload ID: 8045 relates to Category No.: 11861; Payload ID: 8046 relates to Category No.: 11861; Payload ID: 8047 relates to Category No.: 11861; Payload ID: 8048 relates to Category No.: 11861, 735; Payload ID: 8049 relates to Category No.: 11861; Payload ID: 8050 relates to Category No.: 11861; Payload ID: 8051 relates to Category No.: 11861; Payload ID: 8052 relates to Category No.: 11861; Payload ID: 8053 relates to Category No.: 11861; Payload ID: 8054 relates to Category No.: 11861, 735; Payload ID: 8055 relates to Category No.: 11861; Payload ID: 8056 relates to Category No.: 11861; Payload ID: 8057 relates to Category No.: 11861; Payload ID: 8058 relates to Category No.: 11861; Payload ID: 8059 relates to Category No.: 11861; Payload ID: 8060 relates to Category No.: 11861; Payload ID: 8061 relates to Category No.: 11861; Payload ID: 8062 relates to Category No.: 11861; Payload ID: 8063 relates to Category No.: 11861; Payload ID: 8064 relates to Category No.: 11861; Payload ID: 8065 relates to Category No.: 11861; Payload ID: 8066 relates to Category No.: 11861; Payload ID: 8067 relates to Category No.: 11861; Payload ID: 8068 relates to Category No.: 11861; Payload ID: 8069 relates to Category No.: 11861; Payload ID: 8070 relates to Category No.: 11861; Payload ID: 8071 relates to Category No.: 11861; Payload ID: 8072 relates to Category No.: 11861; Payload ID: 8073 relates to Category No.: 11861, 735; Payload ID: 8074 relates to Category No.: 11861; Payload ID: 8075 relates to Category No.: 11861; Payload ID: 8076 relates to Category No.: 11861; Payload ID: 8077 relates to Category No.: 11861; Payload ID: 8078 relates to Category No.: 11861; Payload ID: 8079 relates to Category No.: 11861; Payload ID: 8080 relates to Category No.: 11861; Payload ID: 8081 relates to Category No.: 11861, 735; Payload ID: 8082 relates to Category No.: 11861, 735; Payload ID: 8083 relates to Category No.: 11861; Payload ID: 8084 relates to Category No.: 11861; Payload ID: 8085 relates to Category No.: 11861; Payload ID: 8086 relates to Category No.: 11861; Payload ID: 8087 relates to Category No.: 11861; Payload ID: 8088 relates to Category No.: 11861; Payload ID: 8089 relates to Category No.: 11861; Payload ID: 8097 relates to Category No.: 11861; Payload ID: 8098 relates to Category No.: 11861; Payload ID: 8099 relates to Category No.: 11861; Payload ID: 8100 relates to Category No.: 11861; Payload ID: 8101 relates to Category No.: 11861; Payload ID: 8102 relates to Category No.: 11861; Payload ID: 8103 relates to Category No.: 11861; Payload ID: 8104 relates to Category No.: 11861; Payload ID: 8105 relates to Category No.: 11861; Payload ID: 8106 relates to Category No.: 11861; Payload ID: 8107 relates to Category No.: 11861; Payload ID: 8108 relates to Category No.: 11861; Payload ID: 8109 relates to Category No.: 11861; Payload ID: 8110 relates to Category No.: 11861; Payload ID: 8111 relates to Category No.: 11861; Payload ID: 8112 relates to Category No.: 11861; Payload ID: 8113 relates to Category No.: 11861; Payload ID: 8114 relates to Category No.: 11861; Payload ID: 8115 relates to Category No.: 11861; Payload ID: 8116 relates to Category No.: 11861; Payload ID: 8117 relates to Category No.: 11861; Payload ID: 8118 relates to Category No.: 11861; Payload ID: 8119 relates to Category No.: 11861; Payload ID: 8120 relates to Category No.: 11861; Payload ID: 8121 relates to Category No.: 11861; Payload ID: 8122 relates to Category No.: 11861; Payload ID: 8123 relates to Category No.: 11861; Payload ID: 8124 relates to Category No.: 11861; Payload ID: 8125 relates to Category No.: 11861; Payload ID: 8126 relates to Category No.: 11861; Payload ID: 8127 relates to Category No.: 11861; Payload ID: 8128 relates to Category No.: 11861; Payload ID: 8129 relates to Category No.: 11861; Payload ID: 8130 relates to Category No.: 11861; Payload ID: 8131 relates to Category No.: 11861; Payload ID: 8132 relates to Category No.: 11861; Payload ID: 8133 relates to Category No.: 11861; Payload ID: 8134 relates to Category No.: 735, 5386, 11861; Payload ID: 8135 relates to Category No.: 11861, 735, 5386; Payload ID: 8136 relates to Category No.: 926, 3303, 16331, 9226, 14196, 15504, 14597, 14176, 3385, 11861, 15699, 3325, 949, 14279, 951; Payload ID: 8137 relates to Category No.: 11861; Payload ID: 8138 relates to Category No.: 11861; Payload ID: 8139 relates to Category No.: 11861; Payload ID: 8140 relates to Category No.: 11861; Payload ID: 8141 relates to Category No.: 12399, 11861, 5432, 2694; Payload ID: 8142 relates to Category No.: 11861; Payload ID: 8143 relates to Category No.: 11861; Payload ID: 8144 relates to Category No.: 11861; Payload ID: 8145 relates to Category No.: 11861; Payload ID: 8146 relates to Category No.: 11861, 7192; Payload ID: 8147 relates to Category No.: 11861, 9608; Payload ID: 8148 relates to Category No.: 15617, 11861; Payload ID: 8149 relates to Category No.: 11861; Payload ID: 8150 relates to Category No.: 11861, 11862; Payload ID: 8151 relates to Category No.: 11861, 5957; Payload ID: 8152 relates to Category No.: 11861; Payload ID: 8153 relates to Category No.: 11861, 5063; Payload ID: 8154 relates to Category No.: 11861; Payload ID: 8155 relates to Category No.: 6401, 256; Payload ID: 8156 relates to Category No.: 1630, 3303, 9226, 6816, 14196, 9518, 5396; Payload ID: 8157 relates to Category No.: 9518, 1630, 5396, 3303, 9282, 6816, 14196, 11861; Payload ID: 8158 relates to Category No.: 14196, 14712, 10116, 11861; Payload ID: 8159 relates to Category No.: 14712, 11861, 14317; Payload ID: 8160 relates to Category No.: 11861, 7192; Payload ID: 8161 relates to Category No.: 12382, 1201, 12142, 11861; Payload ID: 8162 relates to Category No.: 12382, 12142, 11861, 9179, 1201; Payload ID: 8163 relates to Category No.: 12382, 12142, 11861, 9179, 1201; Payload ID: 8164 relates to Category No.: 12382, 1201, 12142, 10116, 11861, 9179, 4897; Payload ID: 8165 relates to Category No.: 15629, 12382, 12142, 11861, 4898, 1201, 5105; Payload ID: 8166 relates to Category No.: 12382, 12142, 11861, 1201; Payload ID: 8167 relates to Category No.: 12382, 5105, 12142, 11861, 1201; Payload ID: 8168 relates to Category No.: 11861; Payload ID: 8170 relates to Category No.: 11920, 11861, 11886, 7021; Payload ID: 8171 relates to Category No.: 1405, 9619, 9592; Payload ID: 8172 relates to Category No.: 4976, 6816, 3554, 15748, 5418, 11861; Payload ID: 8173 relates to Category No.: 6816, 4976, 15748, 5418; Payload ID: 8174 relates to Category No.: 6924, 11861, 15356, 617; Payload ID: 8175 relates to Category No.: 11861; Payload ID: 8176 relates to Category No.: 12402, 11861; Payload ID: 8177 relates to Category No.: 11861; Payload ID: 8178 relates to Category No.: 4864, 5259, 12402, 2874, 15567, 11861, 11933, 5432; Payload ID: 8179 relates to Category No.: 4864, 5259, 2874, 15567, 11861, 5347, 9636, 15822, 12402, 11933, 5432; Payload ID: 8180 relates to Category No.: 4864, 11939, 5259, 2874, 15567, 11861, 5275; Payload ID: 8181 relates to Category No.: 4864, 5259, 2874, 15567; Payload ID: 8182 relates to Category No.: 4864, 2874, 15567, 5259; Payload ID: 8183 relates to Category No.: 11981, 11861, 12148; Payload ID: 8184 relates to Category No.: 11861, 2823, 2833; Payload ID: 8185 relates to Category No.: 11917, 11861, 15503, 14471, 11939, 11895, 15504, 12064, 11835; Payload ID: 8186 relates to Category No.: 11917, 11861, 5841; Payload ID: 8187 relates to Category No.: 11917, 15495, 11861, 15503, 14471, 15504, 11920; Payload ID: 8188 relates to Category No.: 11917, 15495, 11861, 14252; Payload ID: 8189 relates to Category No.: 16331, 6900, 11861; Payload ID: 8190 relates to Category No.: 3303, 16331, 2405, 6900, 9857, 11861, 11886; Payload ID: 8191 relates to Category No.: 16331, 6900, 11861, 5096; Payload ID: 8192 relates to Category No.: 16331, 6900, 15491, 11861; Payload ID:

8193 relates to Category No.: 16331, 6900, 11861, 2405; Payload ID: 8194 relates to Category No.: 11978, 926, 11939, 11933, 12109, 11981, 11861, 14377, 5357; Payload ID: 8195 relates to Category No.: 14564, 11861, 14232, 9980; Payload ID: 8196 relates to Category No.: 11978, 926, 15895, 11861, 5357, 9016, 5922; Payload ID: 8197 relates to Category No.: 14564, 6816, 11939, 11933, 15895, 11920, 11861, 6197, 5923, 9763; Payload ID: 8198 relates to Category No.: 6924; Payload ID: 8199 relates to Category No.: 11861; Payload ID: 8200 relates to Category No.: 10116, 11861; Payload ID: 8201 relates to Category No.: 14506, 7192; Payload ID: 8202 relates to Category No.: 9619, 14506; Payload ID: 8203 relates to Category No.: 926, 3303, 942, 267, 5308, 305, 598, 11861, 3325; Payload ID: 8204 relates to Category No.: 6816, 11861; Payload ID: 8205 relates to Category No.: 7192; Payload ID: 8207 relates to Category No.: 11861; Payload ID: 8209 relates to Category No.: 9282, 6816, 5308, 3296, 5907, 16316, 9270; Payload ID: 8210 relates to Category No.: 926, 5497; Payload ID: 8212 relates to Category No.: 11861; Payload ID: 8214 relates to Category No.: 9857, 1401, 5840, 11861, 5479, 5775, 1403, 1416, 1201; Payload ID: 8215 relates to Category No.: 1401, 5840, 1416, 1201, 9857, 1454, 5479; Payload ID: 8216 relates to Category No.: 1401, 5840, 11861, 5478, 5479, 5477, 5775, 5489, 9857, 1405; Payload ID: 8217 relates to Category No.: 926, 5487, 5519, 5484, 5486, 11861; Payload ID: 8218 relates to Category No.: 926, 11861, 5487, 5519, 5484, 5486; Payload ID: 8219 relates to Category No.: 926, 5487, 5519, 5484, 5486, 5488; Payload ID: 8220 relates to Category No.: 6478, 5492, 5493, 5494, 88, 120; Payload ID: 8221 relates to Category No.: 926, 5519, 5521, 5506; Payload ID: 8222 relates to Category No.: 5308, 267, 11861, 14536, 14537; Payload ID: 8223 relates to Category No.: 6478, 5522, 5516; Payload ID: 8224 relates to Category No.: 11861, 9876, 9885; Payload ID: 8225 relates to Category No.: 11861, 9876, 9885, 6210, 9871, 9859; Payload ID: 8226 relates to Category No.: 11861, 5531, 5520, 9771, 5513, 5308; Payload ID: 8227 relates to Category No.: 6816, 11861, 9886, 5520, 5308; Payload ID: 8228 relates to Category No.: 11861, 5531, 14537, 9871, 12227, 5308; Payload ID: 8229 relates to Category No.: 9886, 5531; Payload ID: 8230 relates to Category No.: 9975; Payload ID: 8231 relates to Category No.: 11861, 14537, 5531, 5520, 5513, 9873, 5308; Payload ID: 8232 relates to Category No.: 6224, 11861, 16108, 5531, 9864, 5520, 5513, 5481, 9873, 9871, 5509, 5308; Payload ID: 8233 relates to Category No.: 6478, 11939, 11861, 5347, 6574, 6266, 5492, 5493, 5494, 5495; Payload ID: 8234 relates to Category No.: 6478, 11939, 11861, 5492, 5493, 5494; Payload ID: 8235 relates to Category No.: 11861, 5529; Payload ID: 8236 relates to Category No.: 926, 6816, 6478, 1630, 5892, 5505, 5518, 5517, 5510, 5515, 5514, 5526; Payload ID: 8237 relates to Category No.: 5519, 926, 1457, 1459, 12363; Payload ID: 8238 relates to Category No.: 926, 1457, 11861, 5519; Payload ID: 8239 relates to Category No.: 926, 1457, 5519, 11861, 5956; Payload ID: 8240 relates to Category No.: 11861, 1201; Payload ID: 8241 relates to Category No.: 5259; Payload ID: 8242 relates to Category No.: 5259, 5551, 5538, 11861, 5347, 11828; Payload ID: 8243 relates to Category No.: 11861; Payload ID: 8244 relates to Category No.: 11861, 15504; Payload ID: 8245 relates to Category No.: 11978, 926, 4886, 15612, 12145, 5551, 12421, 11861, 5550, 9844, 5543, 5549, 12227, 5546, 5534, 11981, 11920, 11886, 12081, 132, 6239; Payload ID: 8246 relates to Category No.: 14564, 5551, 5538, 11861, 14536, 9844, 11983, 15613, 11981; Payload ID: 8247 relates to Category No.: 14564, 5538, 11861, 9844, 11981, 11920, 12081, 37; Payload ID: 8248 relates to Category No.: 14564, 5538, 11861, 9844, 14538; Payload ID: 8249 relates to Category No.: 11978, 926, 15612, 12145, 11861, 9844, 5543; Payload ID: 8250 relates to Category No.: 926, 16331, 6816, 11939, 6825, 1630, 12402, 11861, 15887, 9629, 4710, 16206, 5534, 942, 1146, 9636, 1157; Payload ID: 8251 relates to Category No.: 5259, 12402, 5538, 11828, 4821; Payload ID: 8252 relates to Category No.: 5259, 12402, 5551; Payload ID: 8253 relates to Category No.: 5259; Payload ID: 8254 relates to Category No.: 5259; Payload ID: 8255 relates to Category No.: 4864, 5259, 5588, 5551, 5538, 11861, 14961; Payload ID: 8256 relates to Category No.: 11978, 926, 15612, 5547, 12145, 5538, 11861, 5347, 9844, 5543, 5549, 5534, 5554; Payload ID: 8257 relates to Category No.: 4864, 5259, 5551, 5538, 11861, 12108, 12398; Payload ID: 8258 relates to Category No.: 9282, 9226, 14196, 10116, 7268, 11861, 7265, 15595, 7267; Payload ID: 8259 relates to Category No.: 9282, 9226, 14196, 10116, 11861, 7265, 15595, 7267, 7268; Payload ID: 8260 relates to Category No.: 9282, 9226, 14196, 10116, 11861, 7265, 15595, 7267; Payload ID: 8261 relates to Category No.: 15629, 12399, 11861, 5347, 4710, 9961, 5554, 5547, 6583, 4820, 3752, 4804, 14077, 5550; Payload ID: 8262 relates to Category No.: 5547, 5550, 5549; Payload ID: 8263 relates to Category No.: 5550, 5547, 11861, 5549; Payload ID: 8264 relates to Category No.: 4196, 5550, 6816, 5547, 11861, 5549, 12149; Payload ID: 8265 relates to Category No.: 5547, 5550, 5549; Payload ID: 8266 relates to Category No.: 5547, 11861, 4196, 5550, 5549; Payload ID: 8267 relates to Category No.: 5547, 5550, 5549; Payload ID: 8268 relates to Category No.: 5547, 11861; Payload ID: 8269 relates to Category No.: 5547, 11861; Payload ID: 8270 relates to Category No.: 5547, 11861; Payload ID: 8271 relates to Category No.: 6816, 15503, 14471, 14234, 5109, 2823, 2688, 15530, 14233, 2406, 11861; Payload ID: 8272 relates to Category No.: 3303, 6816; Payload ID: 8273 relates to Category No.: 11861; Payload ID: 8274 relates to Category No.: 11861, 1146, 926; Payload ID: 8275 relates to Category No.: 11861, 1146, 926; Payload ID: 8276 relates to Category No.: 1201; Payload ID: 8277 relates to Category No.: 11861; Payload ID: 8278 relates to Category No.: 16331, 11861; Payload ID: 8279 relates to Category No.: 11861; Payload ID: 8280 relates to Category No.: 11861; Payload ID: 8281 relates to Category No.: 11861, 1201; Payload ID: 8282 relates to Category No.: 11861; Payload ID: 8283 relates to Category No.: 15617, 11861; Payload ID: 8284 relates to Category No.: 11861, 1201; Payload ID: 8285 relates to Category No.: 11861; Payload ID: 8286 relates to Category No.: 11861; Payload ID: 8287 relates to Category No.: 11861; Payload ID: 8288 relates to Category No.: 11861; Payload ID: 8289 relates to Category No.: 11861, 14537, 1405, 16331, 5588; Payload ID: 8290 relates to Category No.: 12142, 4429, 5588, 11861, 11886, 11981, 5957; Payload ID: 8291 relates to Category No.: 14564, 11895, 11861; Payload ID: 8292 relates to Category No.: 6816, 11861, 2566, 12081, 2567, 12402; Payload ID: 8293 relates to Category No.: 6816, 2566, 2567; Payload ID: 8294 relates to Category No.: 6816, 2566, 2567, 2573; Payload ID: 8295 relates to Category No.: 6816, 11861, 2566, 16206, 2567, 2573, 11933, 11886, 5588, 6024; Payload ID: 8296 relates to Category No.: 6816, 11861, 5347, 4016, 4178; Payload ID: 8297 relates to Category No.: 6816, 11933, 11861, 11828, 4710, 11920, 5588, 4196, 2566, 6024; Payload ID: 8298 relates to Category No.: 6816, 11861, 1706, 4196, 11855, 735; Payload ID: 8299 relates to Category No.: 6816, 11861, 16206, 10092, 16082, 5588, 1706, 3774; Payload ID: 8300 relates to Category No.: 6816, 11861, 5588; Payload ID: 8301 relates to Category No.: 6816, 11861, 6024; Payload ID: 8302 relates to Category No.: 6816; Payload ID: 8303 relates to Category No.: 6816, 11861, 2566, 6024; Payload ID: 8304 relates to Category No.: 6816; Payload ID: 8305 relates to Category No.: 6816; Payload ID: 8306 relates to Category No.: 6816, 11861, 1706, 5343, 11933, 11886; Payload ID: 8307 relates to Category No.: 6816, 11861, 4710; Payload ID: 8308 relates to Category No.: 6816, 16244, 11861, 4196, 4016, 11828, 15561, 5549, 11983, 16206, 4022, 9389; Payload ID: 8309 relates to Category No.: 6816, 12399, 11861; Payload ID: 8310 relates to Category No.: 6816, 267, 11933, 11861, 4196, 1706, 11828, 16206, 2567, 12399, 5588, 6024, 11981, 11920, 12402, 11886, 5957, 4710, 2566, 9629, 566; Payload ID: 8311 relates to Category No.: 6816, 11981, 11861, 1706, 4710, 5343, 12399, 11933, 11886; Payload ID: 8312 relates to Category No.: 11918, 11861, 5347, 4196, 4016, 3752, 1706, 11828, 16206, 10092, 16082; Payload ID: 8313 relates to Category No.: 12399, 4821, 11861; Payload ID: 8314 relates to Category No.: 11861, 16206, 5588, 12399; Payload ID: 8315 relates to Category No.: 16206, 5588, 12399; Payload ID: 8316 relates to Category No.: 6816, 11861, 1706, 16206, 12399; Payload ID: 8317 relates to Category No.: 12399, 4022, 12402; Payload ID: 8318 relates to Category No.: 11861; Payload ID: 8319 relates to Category No.: 7192; Payload ID: 8320 relates to Category No.: 11978, 926, 12109, 11981, 11861, 14564, 5588, 14537; Payload ID: 8321 relates to Category No.: 6816, 1630, 1646, 12111, 11861, 5956; Payload ID: 8322 relates to Category No.: 1504; Payload ID: 8323 relates to Category No.: 1504; Payload ID: 8324 relates to Category No.: 9747, 9529, 11861, 11920; Payload ID: 8325 relates to Category No.: 11939, 11861; Payload ID: 8326 relates to Category No.: 11861; Payload ID: 8327 relates to Category No.: 1405, 14504; Payload ID: 8328 relates to Category No.: 14504, 3665; Payload ID: 8329 relates to Category No.: 14504, 3665; Payload ID: 8330 relates to Category No.: 14504, 11861, 3665; Payload ID: 8331 relates to Category No.: 14504; Payload ID: 8332 relates to Category No.: 14504; Payload ID: 8333 relates to Category No.: 15617, 12399, 5588, 11861, 16206, 11886; Payload ID: 8334 relates to Category No.: 11861, 5588; Payload ID: 8335 relates to Category No.: 12402, 5588, 11861; Payload ID: 8336 relates to Category No.: 5588, 11861; Payload ID: 8337 relates to Category No.: 5588, 11861; Payload ID: 8338 relates to Category No.: 11861, 15815, 5601; Payload ID: 8339 relates to Category No.: 11981, 11861, 15815, 15812; Payload ID: 8340 relates to Category No.: 11861, 2875, 5607; Payload ID: 8341 relates to Category No.: 11861, 5607; Payload ID: 8342 relates to Category No.: 11861, 12417; Payload ID: 8345 relates to Category No.: 11861; Payload ID: 8347 relates to Category No.: 926, 3303, 16331, 5308, 4965, 5308, 305, 3464, 11861, 14147, 14602; Payload ID: 8348 relates to Category No.: 3303, 15503, 14471, 14234, 13683, 11861, 15528, 14233, 14471; Payload ID: 8349 relates to Category No.: 3303, 15503, 14471, 13683, 14243, 11861, 15528, 14255; Payload ID: 8350 relates to Category No.: 6816, 6188, 11861; Payload ID: 8351 relates to Category No.: 6816; Payload ID: 8352 relates to Category No.: 6816, 7192; Payload ID: 8353 relates to Category No.: 3303, 15503, 14471, 11939, 13683, 11861, 15493, 5347, 15530, 14233, 14234; Payload ID: 8354 relates to Category No.: 15503, 14471, 14234, 14471, 15504, 13683, 11861, 15528, 14233, 12181; Payload ID: 8355 relates to Category No.: 15503, 14471, 13683, 11861; Payload ID: 8356 relates to Category No.: 3303, 15503, 14471, 13683, 11861; Payload ID: 8357 relates to Category No.: 15503, 14471, 11861, 3303, 13683, 15503, 14233, 14237; Payload ID: 8358 relates to Category No.: 15503, 14471, 13683, 11861, 15503, 14239, 3303; Payload ID: 8359 relates to Category No.: 15503, 14471, 13683, 11861, 2688; Payload ID: 8360 relates to Category No.: 9226, 6816, 15844, 3993, 97, 15859, 15850, 14595, 4001; Payload ID: 8361 relates to Category No.: 9226, 10116, 11861, 3993; Payload ID: 8362 relates to Category No.: 2874, 15816, 2882; Payload ID: 8363 relates to Category No.: 2874, 15816, 2882; Payload ID: 8364 relates to Category No.: 2874, 15816, 2882; Payload ID: 8365 relates to Category No.: 2874, 15816, 2882; Payload ID: 8366 relates to Category No.: 2874, 15816, 2882; Payload ID: 8367 relates to Category No.: 2874, 15816, 2882; Payload ID: 8368 relates to Category No.: 2874, 15816, 2882, 11861; Payload ID: 8369 relates to Category No.: 2874, 15816, 2882; Payload ID: 8370 relates to Category No.: 2874, 15816, 2882, 11861; Payload ID: 8371 relates to Category No.: 2874, 15816, 2882; Payload ID: 8372 relates to Category No.: 2874, 15816, 2882; Payload ID: 8373 relates to Category No.: 2874, 15816, 2882; Payload ID: 8374 relates to Category No.: 2874, 15816, 2882; Payload ID: 8378 relates to Category No.: 11861; Payload ID: 8379 relates to Category No.: 2874, 15816, 2882; Payload ID: 8380 relates to Category No.: 2874, 15816, 2882; Payload ID: 8381 relates to Category No.: 2874, 5608, 11861; Payload ID: 8382 relates to Category No.: 14234, 15504, 3459, 10116, 11861, 2688, 15530, 14233, 5347; Payload ID: 8383 relates to Category No.: 11861, 9518, 303; Payload ID: 8384 relates to Category No.: 2874, 15816, 2882; Payload ID: 8385 relates to Category No.: 12402, 2874, 5684; Payload ID: 8386 relates to Category No.: 12402, 2874; Payload ID: 8387 relates to Category No.: 12402, 2874; Payload ID: 8388 relates to Category No.: 2874; Payload ID: 8389 relates to Category No.: 2881, 11861; Payload ID: 8390 relates to Category No.: 2874, 15816, 2882; Payload ID: 8391 relates to Category No.: 11861; Payload ID: 8394 relates to Category No.: 14196, 11861; Payload ID: 8395 relates to Category No.: 14196, 11861; Payload ID: 8396 relates to Category No.: 10116, 11861; Payload ID: 8397 relates to Category No.: 14196, 11861, 7192, 5347; Payload ID: 8398 relates to Category No.: 14196, 10116, 11861, 15699, 14602; Payload ID: 8399 relates to Category No.: 1201; Payload ID: 8400 relates to Category No.: 11861, 7192, 1201; Payload ID: 8401 relates to Category No.: 2874, 5621; Payload ID: 8402 relates to Category No.: 14564, 11861, 5619; Payload ID: 8403 relates to Category No.: 12402, 16244, 11861; Payload ID: 8404 relates to Category No.: 11861, 5619, 5613, 15823; Payload ID: 8405 relates to Category No.: 2874, 5621, 5620, 5613, 15819, 5613, 15825, 5624, 5625; Payload ID: 8406 relates to Category No.: 5613, 15810, 11861, 14564, 15617, 5619, 10092, 11828, 5850; Payload ID: 8407 relates to Category No.: 11861, 5619, 5613, 15823; Payload ID: 8408 relates to Category No.: 2881, 11861, 12417, 5619, 5690, 5691; Payload ID: 8409 relates to Category No.: 11861, 5613, 15810, 5619; Payload ID: 8410 relates to Category No.: 2874, 2672, 11861, 5621; Payload ID: 8411 relates to Category No.: 2874, 11920, 5621; Payload ID: 8412 relates to Category No.: 4864, 2874, 5629; Payload ID: 8413 relates to Category No.: 14564, 12399, 11861, 5628, 5626; Payload ID: 8414 relates to Category No.: 12399, 11861, 5628; Payload ID: 8415 relates to Category No.: 4864, 2874, 11861, 5633; Payload ID: 8416 relates to Category No.: 14564, 2881, 15617, 11861; Payload ID: 8417 relates to Category No.: 2881, 11861, 5640, 5639, 5674, 5676, 2875; Payload ID: 8418 relates to Category No.: 2881, 11861, 11981; Payload ID: 8419 relates to Category No.: 4864, 11933, 2874, 11861, 5640, 5636, 5680; Payload ID: 8420 relates to Category No.: 4864, 11933, 2881, 2874, 11861, 5347, 5640, 5635, 5677, 11939, 2882; Payload ID: 8421 relates to Category No.: 5646, 2874, 2882, 11861; Payload ID: 8422 relates to Category No.: 2881, 11861; Payload ID: 8423 relates to Category No.: 14564, 2881, 11861; Payload ID: 8424 relates to Category No.: 2874, 2882, 11861; Payload ID: 8425 relates to Category No.: 14564, 2881, 11861; Payload ID: 8426 relates to Category No.: 11861, 2874; Payload ID: 8427 relates to Category No.: 11861, 5651, 12402; Payload ID: 8428 relates to Category No.: 2881, 5651; Payload ID: 8429 relates to Category No.: 5651, 11861, 12402; Payload ID: 8430 relates to Category No.: 11861, 5651; Payload ID: 8431 relates to Category No.: 5651, 11861; Payload ID: 8433 relates to Category No.: 2874, 2882, 11861; Payload ID: 8434 relates to Category No.: 2874, 2882; Payload ID: 8435 relates to Category No.: 2874, 2882; Payload ID: 8436 relates to Category No.: 2874, 2882; Payload ID: 8437 relates to Category No.: 11939, 2874, 2882, 11861, 2875; Payload ID: 8438 relates to Category No.: 2874, 11861; Payload ID: 8439 relates to Category No.: 11861, 12401, 5653; Payload ID: 8440 relates to Category No.: 12399, 11861, 5619, 5655; Payload ID: 8441 relates to Category No.: 12399, 11861; Payload ID: 8442 relates to Category No.: 2874; Payload ID: 8443 relates to Category No.: 4864, 2874, 5955, 5664, 1504, 4726, 5927; Payload ID: 8444 relates to Category No.: 5660, 11861, 5663, 3471; Payload ID: 8445 relates to Category No.: 2881, 11861, 5660, 5663; Payload ID: 8446 relates to Category No.: 2881, 11861, 5660, 5663, 5712, 5695, 5711; Payload ID: 8447 relates to Category No.: 2874, 5673, 5667; Payload ID: 8448 relates to Category No.: 2881, 11861, 5666; Payload ID: 8449 relates to Category No.: 2881, 11861, 5666; Payload ID: 8450 relates to Category No.: 2874, 2882, 5664; Payload ID: 8451 relates to Category No.: 2881, 11861, 5668; Payload ID: 8452 relates to Category No.: 2874, 5673; Payload ID: 8453 relates to Category No.: 11861, 5601, 5666; Payload ID: 8454 relates to Category No.: 11861, 5671, 5672; Payload ID: 8455 relates to Category No.: 11861, 5640, 5674, 5676; Payload ID: 8456 relates to Category No.: 2874, 11861, 5708, 5677; Payload ID: 8457 relates to Category No.: 2874, 11861; Payload ID: 8458 relates to Category No.: 2874, 5652; Payload ID: 8459 relates to Category No.: 2874; Payload ID: 8460 relates to Category No.: 12402, 2874, 5682, 11861; Payload ID: 8461 relates to Category No.: 15617, 11861, 5681; Payload ID: 8462 relates to Category No.: 4864, 2874, 5689; Payload ID: 8463 relates to Category No.: 2881, 11861, 5688; Payload ID: 8464 relates to Category No.: 2874, 11861, 2882, 9371; Payload ID: 8465 relates to Category No.: 2881, 15491, 11981, 11861, 2875; Payload ID: 8466 relates to Category No.: 2874, 11861; Payload ID: 8467 relates to Category No.: 2874, 11861; Payload ID: 8468 relates to Category No.: 6464, 4864, 2874; Payload ID: 8469 relates to Category No.: 2874, 11861, 5621, 5620; Payload ID: 8470 relates to Category No.: 2874, 5621; Payload ID: 8471 relates to Category No.: 2874, 5621; Payload ID: 8472 relates to Category No.: 2874, 5621; Payload ID: 8473 relates to Category No.: 2874, 5621; Payload ID: 8474 relates to Category No.: 4864, 2874, 2882, 11861, 5696; Payload ID: 8475 relates to Category No.: 9518, 6037; Payload ID: 8476 relates to Category No.: 2881, 11861, 12417, 5695; Payload ID: 8477 relates to Category No.: 4864, 2874, 11861, 5701; Payload ID: 8478 relates to Category No.: 2881, 11861, 5700; Payload ID: 8479 relates to Category No.: 4864, 2874, 11861, 5708, 12402; Payload ID: 8480 relates to Category No.: 11939, 2881, 11861, 3752, 5708, 5704, 2447, 2448, 5707; Payload ID: 8481 relates to Category No.: 11939, 2881, 11861, 5708, 4865, 2449, 5704, 2448, 5707, 5681, 6130, 9370, 5632, 5631; Payload ID: 8482 relates to Category No.: 4864, 2874, 2882, 5713, 11861; Payload ID: 8483 relates to Category No.: 2881, 11861, 735, 5712; Payload ID: 8484 relates to Category No.: 4864, 2882, 2874, 5723; Payload ID: 8485 relates to Category No.: 2881, 11861, 5722; Payload ID: 8486 relates to Category No.: 926, 3303, 14196, 15542, 3464, 10116, 11861; Payload ID: 8487 relates to Category No.: 3303, 14196, 3464, 10116, 11861; Payload ID: 8488 relates to Category No.: 11978, 926, 15908, 11939, 11933, 5956, 12109, 11861, 9016, 5621, 4961; Payload ID: 8489 relates to Category No.: 11861; Payload ID: 8490 relates to Category No.: 11978, 926, 11939, 11933, 12109, 11861; Payload ID: 8491 relates to Category No.: 11978, 926, 6478, 11939, 11933, 12109, 11861; Payload ID: 8492 relates to Category No.: 11978, 926, 6478, 12109, 11861, 5621; Payload ID: 8494 relates to Category No.: 15029; Payload ID: 8495 relates to Category No.: 15021, 15029, 11861; Payload ID: 8496 relates to Category No.: 4023, 11861; Payload ID: 8497 relates to Category No.: 4023, 5293, 11861, 5009; Payload ID: 8498 relates to Category No.: 1405, 11890, 14107, 4924, 11861, 11782, 5955; Payload ID: 8499 relates to Category No.: 1405, 14107, 11861, 14538; Payload ID: 8500 relates to Category No.: 11978, 926, 6478, 12109, 11861, 2832; Payload ID: 8501 relates to Category No.: 3303, 14471, 15530, 14255; Payload ID: 8502 relates to Category No.: 15908, 267, 11861; Payload ID: 8503 relates to Category No.: 11861; Payload ID: 8504 relates to Category No.: 7192, 11861; Payload ID: 8505 relates to Category No.: 11861, 1201; Payload ID: 8506 relates to Category No.: 11861, 9387; Payload ID: 8507 relates to Category No.: 4886, 4895; Payload ID: 8508 relates to Category No.: 4886, 4895, 11861; Payload ID: 8509 relates to Category No.: 11861; Payload ID: 8510 relates to Category No.: 11895, 7192, 11861; Payload ID: 8511 relates to Category No.: 11895, 11861; Payload ID: 8512 relates to Category No.: 3303, 11861; Payload ID: 8513 relates to Category No.: 1173, 2405; Payload ID: 8514 relates to Category No.: 11861; Payload ID: 8515 relates to Category No.: 15766, 11861; Payload ID: 8516 relates to Category No.: 11861, 5960; Payload ID: 8517 relates to Category No.: 11861; Payload ID: 8518 relates to Category No.: 11861; Payload ID: 8519 relates to Category No.: 1457, 11861; Payload ID: 8520 relates to Category No.: 267, 14106, 1201; Payload ID: 8521 relates to Category No.: 15029, 11861, 1327; Payload ID: 8522 relates to Category No.: 9518, 11861; Payload ID: 8523 relates to Category No.: 820, 6210, 11861; Payload ID: 8524 relates to Category No.: 820, 11861; Payload ID: 8525 relates to Category No.: 820, 11861; Payload ID: 8526 relates to Category No.: 11861; Payload ID: 8527 relates to Category No.: 1457, 11861, 3752, 1201; Payload ID: 8528 relates to Category No.: 11861; Payload ID: 8529 relates to Category No.: 11861; Payload ID: 8530 relates to Category No.: 11861; Payload ID: 8531 relates to Category No.: 11861; Payload ID: 8532 relates to Category No.: 11861; Payload ID: 8533 relates to Category No.: 11861; Payload ID: 8534 relates to Category No.: 11861; Payload ID: 8535 relates to Category No.: 11861; Payload ID: 8536 relates to Category No.: 11861; Payload ID: 8537 relates to Category No.: 1405, 4894, 11981, 1457, 11920, 11861, 9874, 12081, 4897, 14335, 12108, 12363, 14106, 11886; Payload ID: 8538 relates to Category No.: 267, 4894, 277, 1457, 12363, 11861, 14106, 9874, 848, 4897; Payload ID: 8539 relates to Category No.: 4894, 1457, 11861, 7412, 14106, 12388; Payload ID: 8540 relates to Category No.: 11861; Payload ID: 8543 relates to Category No.: 926, 11861; Payload ID: 8544 relates to Category No.: 926, 11861; Payload ID: 8546 relates to Category No.: 6816, 248, 5308; Payload ID: 8547 relates to Category No.: 15598, 5873, 6816, 14196, 138, 11861; Payload ID: 8548 relates to Category No.: 15029, 5875, 65, 138, 4158; Payload ID: 8549 relates to Category No.: 15029, 5875, 65, 138, 11861, 4158; Payload ID: 8550 relates to Category No.: 5865, 5875, 65, 138, 4158, 5876, 11890, 11861; Payload ID: 8551 relates to Category No.: 3303, 14471; Payload ID: 8552 relates to Category No.: 3303, 14471; Payload ID: 8553 relates to Category No.: 3303, 14471; Payload ID: 8554 relates to Category No.: 3303, 14471; Payload ID: 8555 relates to Category No.: 3303, 14471, 16220; Payload ID: 8556 relates to Category No.: 3303, 14471; Payload ID: 8557 relates to Category No.: 11861, 12121; Payload ID: 8558 relates to Category No.: 3303, 16331, 1178, 14471, 11861, 3936, 6184, 14229, 14246, 3732, 2405, 14234, 15528, 14233; Payload ID: 8559 relates to Category No.: 3303, 16331, 14471; Payload ID: 8560 relates to Category No.: 5259, 12402, 5347; Payload ID: 8561 relates to Category No.: 11920, 11861, 7192; Payload ID: 8562 relates to Category No.: 11920, 11861; Payload ID: 8563 relates to Category No.: 5308, 311; Payload ID: 8564 relates to Category No.: 1630, 11861, 7192; Payload ID: 8565 relates to Category No.: 1630, 11861; Payload ID: 8566 relates to Category No.: 6478, 11939, 12402, 9518, 321, 7477, 7472, 5885, 5886, 7510; Payload ID: 8567 relates to Category No.: 6478, 9518, 321, 7477, 7472, 5885, 5886; Payload ID: 8568 relates to Category No.: 6478, 9518, 321, 7477, 7472, 5884; Payload ID: 8569 relates to Category No.: 6478, 9518, 321, 7477, 7472, 5884, 3554; Payload ID: 8570 relates to Category No.: 926, 6478, 9518, 321, 7477, 7472, 5884; Payload ID: 8571 relates to Category No.: 926, 9282, 630, 5890, 11861, 4896, 632; Payload ID: 8572 relates to Category No.: 926, 9282, 630, 5890, 632; Payload ID: 8573 relates to Category No.: 6816, 5308, 6478, 6574, 5895; Payload ID: 8574 relates to Category No.: 6816, 5308, 5895; Payload ID: 8575 relates to Category No.: 1630, 79; Payload ID: 8576 relates to Category No.: 11891, 11894, 1472; Payload ID: 8577 relates to Category No.: 4207, 387, 9518, 319, 5903, 3554, 4117, 9518, 319, 16281; Payload ID: 8580 relates to Category No.: 10116, 11861, 4203; Payload ID: 8582 relates to Category No.: 15908, 15893, 11861, 14147, 2806, 6188; Payload ID: 8583 relates to Category No.: 3303, 11861; Payload ID: 8585 relates to Category No.: 11939; Payload ID: 8587 relates to Category No.: 11939, 12402, 11861; Payload ID: 8588 relates to Category No.: 12399, 11861; Payload ID: 8589 relates to Category No.: 16331, 11861, 14246; Payload ID: 8590 relates to Category No.: 16331, 11861; Payload ID: 8591 relates to Category No.: 16331, 11861; Payload ID: 8592 relates to Category No.: 1405, 4864, 15029, 11861, 9122; Payload ID: 8593 relates to Category No.: 1405, 4864, 11861, 9122; Payload ID: 8594 relates to Category No.: 11861; Payload ID: 8595 relates to Category No.: 11978, 926, 15895, 9096, 12145, 11861, 12081, 4869, 1676; Payload ID: 8596 relates to Category No.: 11978, 926, 4976, 5105, 12402, 9096, 11981, 12145, 11861, 14536, 5640, 4869, 5199, 11895, 217, 9638, 15784, 9844, 5543; Payload ID: 8597 relates to Category No.: 11978, 926, 9096, 12145, 11861, 5264, 12081; Payload ID: 8598 relates to Category No.: 14196, 6965, 11861, 4338, 5957, 5960; Payload ID: 8599 relates to Category No.: 6965, 11861, 5957; Payload ID: 8600 relates to Category No.: 6965, 5957; Payload ID: 8601 relates to Category No.: 9226, 6816, 15495; Payload ID: 8602 relates to Category No.: 11861, 9924, 1405, 1438, 6434, 1436; Payload ID: 8603 relates to Category No.: 15895; Payload ID: 8604 relates to Category No.: 11939, 14597, 9824, 735, 5386, 9654, 5350; Payload ID: 8605 relates to Category No.: 9363, 11861; Payload ID: 8606 relates to Category No.: 15911, 9363; Payload ID: 8607 relates to Category No.: 3303, 9226, 7268; Payload ID: 8608 relates to Category No.: 3303, 9226; Payload ID: 8609 relates to Category No.: 6816, 11861, 3274, 15409; Payload ID: 8610 relates to Category No.: 11861; Payload ID: 8611 relates to Category No.: 14196, 5865, 11861, 5347, 14602, 5121, 5124, 9682, 12399, 11939; Payload ID: 8612 relates to Category No.: 11861; Payload ID: 8614 relates to Category No.: 3303, 2405, 14243, 11861, 15530, 14255; Payload ID: 8615 relates to Category No.: 11981; Payload ID: 8616 relates to Category No.: 3303, 15503, 14471, 14234, 14471, 15504, 14251, 14471, 15491, 15495, 11861, 14243, 15528, 14233, 3459; Payload ID: 8617 relates to Category No.: 3303, 15503, 14471, 14234, 14471, 15504, 15524, 14251, 14471, 15491, 11861, 3752, 3459, 6184; Payload ID: 8618 relates to Category No.: 15503, 14471, 14234, 14471, 15503, 14233, 11861, 15530, 14233, 3303, 2405, 11933, 3459; Payload ID: 8619 relates to Category No.: 3303, 15503, 14471, 14234, 14471, 15504, 4894, 15524, 14251, 14471, 1471, 15491, 10116, 11861, 3752, 15503, 14239, 14324, 14240, 14229, 15528, 14252, 2405, 3459, 327, 15528, 14233, 5235; Payload ID: 8620 relates to Category No.: 267, 15491, 11861; Payload ID: 8621 relates to Category No.: 14564, 11939, 15029, 15491, 1369, 11861, 1706, 581, 12081, 15020, 1708, 1201, 11981; Payload ID: 8622 relates to Category No.: 11861, 11933; Payload ID: 8623 relates to Category No.: 5588, 11861, 11939, 11933; Payload ID: 8624 relates to Category No.: 11861; Payload ID: 8625 relates to Category No.: 7192, 15024; Payload ID: 8626 relates to Category No.: 11861, 9890, 9882, 9880, 9887, 9874, 9888, 9896, 1454, 9818; Payload ID: 8627 relates to Category No.: 7192, 1454; Payload ID: 8629 relates to Category No.: 7462, 15504, 15491, 5109, 11861, 5096, 4927, 2405, 246, 5097, 12081; Payload ID: 8630 relates to Category No.: 7462, 15504, 15491, 5109, 11981, 11861, 5096, 15493, 2833, 246, 11886, 6425, 304, 14243, 2405, 5101; Payload ID: 8631 relates to Category No.: 6816, 15491, 11861, 15542, 15549, 5096, 13735, 246, 686; Payload ID: 8632 relates to Category No.: 3303, 16331, 15504, 15491, 11861, 15542, 15549, 5096, 246, 2405; Payload ID: 8633 relates to Category No.: 3303, 16331, 15504, 11861, 15542, 15549, 5096, 246, 11886; Payload ID: 8634 relates to Category No.: 16331, 15503, 14471, 11861, 15542, 15549, 5096; Payload ID: 8635 relates to Category No.: 6816, 15504, 6900, 11861, 15542, 15549, 5096, 246, 5099, 5100, 5098, 3752; Payload ID: 8636 relates to Category No.: 14107, 11861, 926, 6816, 12109, 4924, 11978; Payload ID: 8637 relates to Category No.: 14503; Payload ID: 8638 relates to Category No.: 5865, 4976, 14503, 7223, 9518, 315, 16283, 11861; Payload ID: 8639 relates to Category No.: 14503; Payload ID: 8640 relates to Category No.: 14503, 14506; Payload ID: 8641 relates to Category No.: 14503, 14506; Payload ID: 8642 relates to Category No.: 14503, 9619, 14506; Payload ID: 8643 relates to Category No.: 14503, 5308, 11861, 3663; Payload ID: 8644 relates to Category No.: 14503; Payload ID: 8645 relates to Category No.: 14503, 14506, 11861; Payload ID: 8646 relates to Category No.: 14503; Payload ID: 8647 relates to Category No.: 14503, 3663, 14506, 11861, 5308, 307, 5403; Payload ID: 8648 relates to Category No.: 14503, 6816, 14506, 11861; Payload ID: 8649 relates to Category No.: 14503, 9619, 14506, 11861; Payload ID: 8650 relates to Category No.: 14503, 11861, 9619; Payload ID: 8651 relates to Category No.: 14503, 9619, 14506; Payload ID: 8652 relates to Category No.: 14503, 11861; Payload ID: 8653 relates to Category No.: 14503; Payload ID: 8654 relates to Category No.: 267; Payload ID: 8655 relates to Category No.: 16331, 12382, 12142, 11920, 10116, 11861, 9179, 3752, 1201; Payload ID: 8656 relates to Category No.: 12142, 11861, 9179, 1201; Payload ID: 8657 relates to Category No.: 12142, 5109, 10116, 11861, 9179, 1201; Payload ID: 8658 relates to Category No.: 12142, 11861, 9179, 1201, 11895; Payload ID: 8659 relates to Category No.: 12142, 11861, 9179, 1201; Payload ID: 8660 relates to Category No.: 12142, 1201, 11861, 9179; Payload ID: 8661 relates to Category No.: 12142, 11861, 9179, 1201; Payload ID: 8662 relates to Category No.: 12142, 11861, 9179, 1201; Payload ID: 8663 relates to Category No.: 11861, 5099, 5100, 5098; Payload ID: 8665 relates to Category No.: 11861, 5099, 5100, 5098; Payload ID: 8666 relates to Category No.: 5099, 5100, 5098; Payload ID: 8667 relates to Category No.: 926, 11933, 6965, 11861, 6988, 942, 3508; Payload ID: 8668 relates to Category No.: 926, 6965, 11861, 6988; Payload ID: 8669 relates to Category No.: 926, 6988, 11861, 6965; Payload ID: 8670 relates to Category No.: 11933, 6965, 11861, 6988, 3508; Payload ID: 8671 relates to Category No.: 11861; Payload ID: 8672 relates to Category No.: 5547, 11861; Payload ID: 8673 relates to Category No.: 11861; Payload ID: 8674 relates to Category No.: 16251; Payload ID: 8675 relates to Category No.: 11861, 4557; Payload ID: 8676 relates to Category No.: 11861, 7192, 4557; Payload ID: 8677 relates to Category No.: 3828, 5929; Payload ID: 8678 relates to Category No.: 3828, 5929; Payload ID: 8679 relates to Category No.: 3828; Payload ID: 8681 relates to Category No.: 11861; Payload ID: 8682 relates to Category No.: 11861; Payload ID: 8683 relates to Category No.: 2405, 11861; Payload ID: 8684 relates to Category No.: 11861; Payload ID: 8685 relates to Category No.: 15908, 11861; Payload ID: 8686 relates to Category No.: 15908, 11861; Payload ID: 8687 relates to Category No.: 15908, 11861; Payload ID: 8688 relates to Category No.: 11861; Payload ID: 8690 relates to Category No.: 15908, 11861; Payload ID: 8691 relates to Category No.: 15908, 11861; Payload ID: 8692 relates to Category No.: 15908, 11861; Payload ID: 8693 relates to Category No.: 15908, 11861; Payload ID: 8694 relates to Category No.: 15908, 11861; Payload ID: 8695 relates to Category No.: 11861; Payload ID: 8696 relates to Category No.: 15908, 11861, 7192; Payload ID: 8697 relates to Category No.: 15908, 11861, 7192; Payload ID: 8698 relates to Category No.: 11861, 15908; Payload ID: 8699 relates to Category No.: 15908, 15504, 11861; Payload ID: 8700 relates to Category No.: 15908, 267, 11861; Payload ID: 8701 relates to Category No.: 11861, 15908; Payload ID: 8702 relates to Category No.: 11861; Payload ID: 8703 relates to Category No.: 15908, 11861; Payload ID: 8704 relates to Category No.: 11861, 15908; Payload ID: 8705 relates to Category No.: 15908, 11861; Payload ID: 8706 relates to Category No.: 15908, 11861; Payload ID: 8707 relates to Category No.: 15908, 11890, 277, 11861, 11681; Payload ID: 8708 relates to Category No.: 11861, 15908; Payload ID: 8709 relates to Category No.: 15908, 267, 11861; Payload ID: 8710 relates to Category No.: 15908, 267, 11861, 5604; Payload ID: 8711 relates to Category No.: 15908, 11861; Payload ID: 8712 relates to Category No.: 15908, 11861; Payload ID: 8713 relates to Category No.: 11861, 15908; Payload ID: 8714 relates to Category No.: 15908, 11861; Payload ID: 8715 relates to Category No.: 11861; Payload ID: 8716 relates to Category No.: 15908, 11861; Payload ID: 8717 relates to Category No.: 15908, 11861; Payload ID: 8718 relates to Category No.: 15908, 11861; Payload ID: 8719 relates to Category No.: 15908, 267, 15029, 11861; Payload ID: 8720 relates to Category No.: 15908, 11861; Payload ID: 8721 relates to Category No.: 15908, 11861; Payload ID: 8722 relates to Category No.: 15908, 11861; Payload ID: 8723 relates to Category No.: 15908, 267, 11861; Payload ID: 8724 relates to Category No.: 15908, 11861; Payload ID: 8725 relates to Category No.: 11861; Payload ID: 8726 relates to Category No.: 15908, 11861; Payload ID: 8727 relates to Category No.: 15908, 11861; Payload ID: 8728 relates to Category No.: 15908, 267, 11861, 7192; Payload ID: 8729 relates to Category No.: 15908, 11861; Payload ID: 8730 relates to Category No.: 15908, 11861; Payload ID: 8731 relates to Category No.: 15908, 11861; Payload ID: 8732 relates to Category No.: 15908, 267, 11861, 7192; Payload ID: 8733 relates to Category No.: 11861; Payload ID: 8734 relates to Category No.: 15908, 11939, 11861, 5347; Payload ID: 8735 relates to Category No.: 15908, 11861; Payload ID: 8736 relates to Category No.: 15908, 11861; Payload ID: 8737 relates to Category No.: 6816, 6825, 11861, 6829; Payload ID: 8738 relates to Category No.: 15029, 1504, 12399, 11861; Payload ID: 8739 relates to Category No.: 15029, 15022; Payload ID: 8740 relates to Category No.: 15029; Payload ID: 8741 relates to Category No.: 15029, 11861; Payload ID: 8742 relates to Category No.: 15021, 15029, 11861, 5935; Payload ID: 8743 relates to Category No.: 15021, 15029, 11861, 14377; Payload ID: 8744 relates to Category No.: 15021, 15029, 11861; Payload ID: 8745 relates to Category No.: 15021, 15029, 11861, 6941, 6945; Payload ID: 8746 relates to Category No.: 15029, 10116, 11861, 14377; Payload ID: 8747 relates to Category No.: 15021, 15029, 11861, 15024, 11886; Payload ID: 8748 relates to Category No.: 15021, 15029, 11861; Payload ID: 8749 relates to Category No.: 15021, 15029, 11861; Payload ID: 8750 relates to Category No.: 15029; Payload ID: 8751 relates to Category No.: 15029; Payload ID: 8752 relates to Category No.: 15029, 7192; Payload ID: 8753 relates to Category No.: 15029, 7192, 11861; Payload ID: 8754 relates to Category No.: 15029; Payload ID: 8755 relates to Category No.: 15029, 7192; Payload ID: 8756 relates to Category No.: 15029, 7192; Payload ID: 8757 relates to Category No.: 15029; Payload ID: 8758 relates to Category No.: 15021, 15029, 11861; Payload ID: 8759 relates to Category No.: 15029; Payload ID: 8760 relates to Category No.: 15029; Payload ID: 8761 relates to Category No.: 15029, 11861; Payload ID: 8762 relates to Category No.: 15029; Payload ID: 8763 relates to Category No.: 15029; Payload ID: 8764 relates to Category No.: 15029, 15022; Payload ID: 8765 relates to Category No.: 15029; Payload ID: 8766 relates to Category No.: 15029, 11861; Payload ID: 8767 relates to Category No.: 15029; Payload ID: 8768 relates to Category No.: 15029, 11861; Payload ID: 8769 relates to Category No.: 15029, 11861; Payload ID: 8770 relates to Category No.: 15021, 15029, 11861, 14377; Payload ID: 8771 relates to Category No.: 15021, 15029, 11861; Payload ID: 8772 relates to Category No.: 15021, 15029, 11861; Payload ID: 8773 relates to Category No.: 15029, 11861; Payload ID: 8774 relates to Category No.: 15029, 11861; Payload ID: 8775 relates to Category No.: 15029, 11861; Payload ID: 8776 relates to Category No.: 15029, 11861, 7192; Payload ID: 8777 relates to Category No.: 15029, 11861, 7192; Payload ID: 8778 relates to Category No.: 15029, 5935; Payload ID: 8779 relates to Category No.: 15029; Payload ID: 8780 relates to Category No.: 15029; Payload ID: 8781 relates to Category No.: 15029, 7192; Payload ID: 8782 relates to Category No.: 15029; Payload ID: 8783 relates to Category No.: 15029, 11861, 3752; Payload ID: 8784 relates to Category No.: 15029, 11861, 14377, 11886; Payload ID: 8785 relates to Category No.: 15029, 11861; Payload ID: 8786 relates to Category No.: 15029, 11861; Payload ID: 8787 relates to Category No.: 15029, 15022; Payload ID: 8788 relates to Category No.: 15029, 11861; Payload ID: 8789 relates to Category No.: 15021, 15029, 15022; Payload ID: 8790 relates to Category No.: 15029; Payload ID: 8791 relates to Category No.: 15029, 11861; Payload ID: 8792 relates to Category No.: 15021, 15029; Payload ID: 8795 relates to Category No.: 11861; Payload ID: 8799 relates to Category No.: 11861; Payload ID: 8800 relates to Category No.: 11861, 5347; Payload ID: 8802 relates to Category No.: 11861, 5347; Payload ID: 8803 relates to Category No.: 11861; Payload ID: 8804 relates to Category No.: 11861; Payload ID: 8806 relates to Category No.: 15029; Payload ID: 8807 relates to Category No.: 11861; Payload ID: 8808 relates to Category No.: 11861; Payload ID: 8810 relates to Category No.: 11861; Payload ID: 8811 relates to Category No.: 15022; Payload ID: 8814 relates to Category No.: 11861; Payload ID: 8817 relates to Category No.: 7192; Payload ID: 8825 relates to Category No.: 11861; Payload ID: 8827 relates to Category No.: 11861; Payload ID: 8840 relates to Category No.: 11861; Payload ID: 8841 relates to Category No.: 11861; Payload ID: 8843 relates to Category No.: 15029; Payload ID: 8845 relates to Category No.: 11861; Payload ID: 8848 relates to Category No.: 15029, 11861; Payload ID: 8849 relates to Category No.: 15029, 11861; Payload ID: 8850 relates to Category No.: 15029, 11861; Payload ID: 8852 relates to Category No.: 11861; Payload ID: 8853 relates to Category No.: 11861; Payload ID: 8855 relates to Category No.: 11861; Payload ID: 8860 relates to Category No.: 11861; Payload ID: 8870 relates to Category No.: 11861; Payload ID: 8872 relates to Category No.: 15022; Payload ID: 8873 relates to Category No.: 11861; Payload ID: 8878 relates to Category No.: 11861; Payload ID: 8880 relates to Category No.: 11861; Payload ID: 8882 relates to Category No.: 11861; Payload ID: 8887 relates to Category No.: 15029; Payload ID: 8888 relates to Category No.: 7192; Payload ID: 8893 relates to Category No.: 11861, 7192; Payload ID: 8894 relates to Category No.: 926, 11861, 5943; Payload ID: 8895 relates to Category No.: 14196, 7192; Payload ID: 8896 relates to Category No.: 14196; Payload ID: 8897 relates to Category No.: 3303, 9226, 14196, 10115, 10116, 11861, 5347, 14538, 10122, 11886, 14537; Payload ID: 8898 relates to Category No.: 9226, 14196, 11861, 11933, 14537, 10122, 14536, 10115; Payload ID: 8899 relates to Category No.: 9226, 14196, 10116, 11861, 14537; Payload ID: 8900 relates to Category No.: 14196; Payload ID: 8902 relates to Category No.: 3303, 9226, 14196, 10116, 7268, 7265; Payload ID: 8903 relates to Category No.: 11861; Payload ID: 8904 relates to Category No.: 11861; Payload ID: 8905 relates to Category No.: 2405, 11861; Payload ID: 8906 relates to Category No.: 11861; Payload ID: 8907 relates to Category No.: 11861; Payload ID: 8909 relates to Category No.: 926; Payload ID: 8910 relates to Category No.: 11861; Payload ID: 8911 relates to Category No.: 11861; Payload ID: 8913 relates to Category No.: 11861, 7192, 1201; Payload ID: 8915 relates to Category No.: 11861; Payload ID: 8916 relates to Category No.: 9282, 9226, 14196, 7192; Payload ID: 8919 relates to Category No.: 11861; Payload ID: 8920 relates to Category No.: 11861; Payload ID: 8924 relates to Category No.: 14196, 11861; Payload ID: 8931 relates to Category No.: 11861; Payload ID: 8932 relates to Category No.: 11861; Payload ID: 8934 relates to Category No.: 5308, 5311, 11861; Payload ID: 8935 relates to Category No.: 9518, 7192; Payload ID: 8939 relates to Category No.: 11861, 7192; Payload ID: 8941 relates to Category No.: 10116; Payload ID: 8943 relates to Category No.: 11861; Payload ID: 8944 relates to Category No.: 10116, 1201; Payload ID: 8945 relates to Category No.: 6924; Payload ID: 8947 relates to Category No.: 11861, 1201; Payload ID: 8949 relates to Category No.: 11861, 1201; Payload ID: 8953 relates to Category No.: 9226; Payload ID: 8957 relates to Category No.: 11861; Payload ID: 8958 relates to Category No.: 6816; Payload ID: 8960 relates to Category No.: 3303; Payload ID: 8961 relates to Category No.: 15138; Payload ID: 8962 relates to Category No.: 11861; Payload ID: 8965 relates to Category No.: 3390; Payload ID: 8966 relates to Category No.: 11861; Payload ID: 8968 relates to Category No.: 11861; Payload ID: 8969 relates to Category No.: 5960, 11861; Payload ID: 8970 relates to Category No.: 11861; Payload ID: 8972 relates to Category No.: 11861; Payload ID: 8973 relates to Category No.: 11861; Payload ID: 8974 relates to Category No.: 11861, 6936; Payload ID: 8975 relates to Category No.: 11861; Payload ID: 8976 relates to Category No.: 11861; Payload ID: 8977 relates to Category No.: 11861; Payload ID: 8978 relates to Category No.: 12399, 11861, 735; Payload ID: 8979 relates to Category No.: 11861; Payload ID: 8980 relates to Category No.: 11861; Payload ID: 8981 relates to Category No.: 11861; Payload ID: 8982 relates to Category No.: 11861; Payload ID: 8983 relates to Category No.: 11861; Payload ID: 8984 relates to Category No.: 15617, 11861; Payload ID: 8985 relates to Category No.: 11861; Payload ID: 8986 relates to Category No.: 11861; Payload ID: 8987 relates to Category No.: 11861; Payload ID: 8988 relates to Category No.: 15617, 1504; Payload ID: 8989 relates to Category No.: 15617, 1504, 11861, 6935; Payload ID: 8990 relates to Category No.: 15617, 1504, 11861, 6935, 11855; Payload ID: 8991 relates to Category No.: 15617, 1504; Payload ID: 8993 relates to Category No.: 15617, 1504, 11861, 6935, 11855, 6937, 16180; Payload ID: 8994 relates to Category No.: 15617, 1504, 6936; Payload ID: 8995 relates to Category No.: 11939, 1504, 11861; Payload ID: 8996 relates to Category No.: 1504, 12399, 11861; Payload ID: 8997 relates to Category No.: 1504; Payload ID: 8998 relates to Category No.: 1504, 12399, 11861, 11939, 5957, 6933, 6939; Payload ID: 8999 relates to Category No.: 3303; Payload ID: 9000 relates to Category No.: 11861, 7393; Payload ID: 9001 relates to Category No.: 11861; Payload ID: 9002 relates to Category No.: 11861; Payload ID: 9003 relates to Category No.: 3303, 6816, 14196, 3459; Payload ID: 9004 relates to Category No.: 11861, 11992, 9608; Payload ID: 9005 relates to Category No.: 11978, 926, 16089, 15612, 5588, 12145, 12421, 11861, 5282, 4865, 16079; Payload ID: 9006 relates to Category No.: 4924, 7192, 12389, 11861; Payload ID: 9007 relates to Category No.: 11978, 926, 6816, 11895, 11861, 6610, 7126, 11982; Payload ID: 9008 relates to Category No.: 11978, 926, 6816, 12109, 11861, 7126, 6610; Payload ID: 9009 relates to Category No.: 5960, 10116, 11861; Payload ID: 9010 relates to Category No.: 926, 6974, 6965, 955, 10101, 11981, 11886; Payload ID: 9011 relates to Category No.: 926, 6974, 942, 6965; Payload ID: 9012 relates to Category No.: 926, 6974, 942, 6965, 11861; Payload ID: 9013 relates to Category No.: 926, 6974, 942, 6965, 11981, 11861, 37; Payload ID: 9014 relates to Category No.: 926, 6974, 942, 6965, 955, 10101, 11981, 11861, 15766, 9608; Payload ID: 9015 relates to Category No.: 926, 6974, 6965, 942; Payload ID: 9016 relates to Category No.: 926, 6974, 6965, 9857, 955, 10101, 11861, 9882, 9880, 9874, 9877, 12359; Payload ID: 9017 relates to Category No.: 926, 6974, 6965, 955, 10101, 11861; Payload ID: 9018 relates to Category No.: 926, 6974, 267, 6965, 955, 10101, 11861, 15887, 6979, 15772; Payload ID: 9019 relates to Category No.: 926, 6974, 6965, 955, 10101, 7249, 5960, 11861; Payload ID: 9020 relates to Category No.: 926, 6974, 6965, 955, 10101; Payload ID: 9021 relates to Category No.: 926, 6974, 7249, 6965, 955, 10101, 11861; Payload ID: 9022 relates to Category No.: 926, 6974, 942, 6965, 955, 10101, 5960, 11861; Payload ID: 9023 relates to Category No.: 926, 6974, 7249, 6965, 955, 10101, 10116, 11861; Payload ID: 9024 relates to Category No.: 926, 6974, 942, 6965, 15629, 11981, 11861; Payload ID: 9025 relates to Category No.: 926, 6974, 942, 11939, 6965, 955, 10101, 11861, 16296; Payload ID: 9026 relates to Category No.: 926, 6974, 942, 6965, 11861; Payload ID: 9027 relates to Category No.: 926, 6974, 942, 6965, 11861; Payload ID: 9028 relates to Category No.: 926, 3303, 6974, 942, 6965, 11861; Payload ID: 9029 relates to Category No.: 926, 6974, 942, 6965, 11861; Payload ID: 9030 relates to Category No.: 926, 6974, 942, 6965, 11861; Payload ID: 9031 relates to Category No.: 926, 6974, 942, 6965; Payload ID: 9032 relates to Category No.: 926, 6974, 6965, 11861; Payload ID: 9033 relates to Category No.: 926, 6974, 6965; Payload ID: 9034 relates to Category No.: 926, 6974, 942, 6965, 11861; Payload ID: 9035 relates to Category No.: 926, 6974, 942, 6965; Payload ID: 9036 relates to Category No.: 926, 6974, 942, 6965, 11861, 6979, 2191; Payload ID: 9037 relates to Category No.: 926, 6974, 6965, 955, 10101, 11861, 14812, 11886; Payload ID: 9038 relates to Category No.: 926, 6974, 6965, 955, 10101, 11861, 14106; Payload ID: 9039 relates to Category No.: 926, 6974, 942, 7249, 6965, 11861; Payload ID: 9040 relates to Category No.: 926, 3303, 6974, 942, 6965, 11861; Payload ID: 9041 relates to Category No.: 926, 3303, 6974, 942, 6965; Payload ID: 9042 relates to Category No.: 926, 6974, 7249, 6965, 955, 10101, 11861; Payload ID: 9043 relates to Category No.: 926, 6974, 6965, 955, 10101, 11861; Payload ID: 9044 relates to Category No.: 926, 6974, 6965; Payload ID: 9045 relates to Category No.: 926, 6974, 942, 6965, 11861; Payload ID: 9046 relates to Category No.: 926, 6974, 942, 6965, 11861; Payload ID: 9047 relates to Category No.: 926, 6974, 942, 6965, 11917, 11861; Payload ID: 9048 relates to Category No.: 926, 6974, 6965, 955, 7008; Payload ID: 9049 relates to Category No.: 926, 6974, 942, 6965; Payload ID: 9050 relates to Category No.: 926, 6974, 942, 6965, 11861; Payload ID: 9051 relates to Category No.: 926, 6974, 942, 7249, 6965, 11861; Payload ID: 9052 relates to Category No.: 6974, 7249, 11861; Payload ID: 9053 relates to Category No.: 6974, 5960, 11861; Payload ID: 9054 relates to Category No.: 6974, 11861, 6965, 5960; Payload ID: 9055 relates to Category No.: 6974, 11861; Payload ID: 9056 relates to Category No.: 5960, 11861, 1201; Payload ID: 9057 relates to Category No.: 11861; Payload ID: 9058 relates to Category No.: 11861; Payload ID: 9059 relates to Category No.: 16331, 2858, 12402, 5009, 11861; Payload ID: 9061 relates to Category No.: 4886, 11861, 11886, 4895, 4422, 4746, 6351; Payload ID: 9062 relates to Category No.: 11861, 5972; Payload ID: 9063 relates to Category No.: 4820, 11861, 8960, 4816, 8957; Payload ID: 9064 relates to Category No.: 4864, 11861, 14947, 2874; Payload ID: 9065 relates to Category No.: 11981, 11861; Payload ID: 9066 relates to Category No.: 14564, 5259, 5308, 5311, 16220, 4183, 1165, 1164, 11861, 4185; Payload ID: 9067 relates to Category No.: 5308, 5311, 4185, 11861, 4183; Payload ID: 9069 relates to Category No.: 1153, 11861; Payload ID: 9070 relates to Category No.: 11861; Payload ID: 9071 relates to Category No.: 11861; Payload ID: 9072 relates to Category No.: 11861; Payload ID: 9073 relates to Category No.: 9226; Payload ID: 9074 relates to Category No.: 9226; Payload ID: 9075 relates to Category No.: 9226, 7192; Payload ID: 9076 relates to Category No.: 9226, 3303; Payload ID: 9077 relates to Category No.: 10116; Payload ID: 9078 relates to Category No.: 11861; Payload ID: 9079 relates to Category No.: 11861; Payload ID: 9080 relates to Category No.: 6965, 11861, 9887, 4898, 11886; Payload ID: 9081 relates to Category No.: 9226, 14196, 10116, 11861; Payload ID: 9082 relates to Category No.: 6816, 15503, 14471, 15524, 2690; Payload ID: 9083 relates to Category No.: 6816, 15503, 14471, 11861, 2691; Payload ID: 9084 relates to Category No.: 6816, 15503, 14471, 15524, 14251, 14471, 11861; Payload ID: 9085 relates to Category No.: 3303, 6816, 15503, 14471, 15495, 11861, 14243, 15530, 14255, 9226; Payload ID: 9086 relates to Category No.: 6816, 11861, 9226; Payload ID: 9087 relates to Category No.: 9226, 6816, 2405; Payload ID: 9088 relates to Category No.: 6816, 15524, 11861, 15528, 14233; Payload ID: 9089 relates to Category No.: 6816, 15530, 14233, 3303, 15503, 14471, 14234, 9226; Payload ID: 9090 relates to Category No.: 6816, 15503, 14471, 15524, 11861, 15530, 14233, 14234; Payload ID: 9091 relates to Category No.: 6816; Payload ID: 9092 relates to Category No.: 6816, 15503, 14471, 11861, 14471; Payload ID: 9093 relates to Category No.: 3303, 6816, 15503, 14471, 11861; Payload ID: 9094 relates to Category No.: 16331, 6816, 15503, 14471, 15524, 2690, 11861, 15528, 14233, 14252, 15528, 14252, 15503, 14472, 2688, 15504, 14471, 13683, 1153, 3459, 5109, 15494, 9852, 9226; Payload ID: 9095 relates to Category No.: 6816, 14234, 11861, 15528, 14233, 15503, 14471; Payload ID: 9096 relates to Category No.: 6816, 11861, 15503, 14471, 3459; Payload ID: 9097 relates to Category No.: 3303, 16331, 6816, 15491, 15503, 14471; Payload ID: 9098 relates to Category No.: 3303, 6816; Payload ID: 9099 relates to Category No.: 3303, 6816, 15503, 14471; Payload ID: 9100 relates to Category No.: 926, 11861; Payload ID: 9101 relates to Category No.: 1405, 11861, 16250, 11665, 11662; Payload ID: 9102 relates to Category No.: 1405, 11861, 5347, 11665, 5841, 3828, 12064, 983; Payload ID: 9103 relates to Category No.: 1405, 3303, 15495, 11861, 16250, 11665, 11662, 15530, 14233, 14234, 11895, 1439, 14471, 5841; Payload ID: 9104 relates to Category No.: 1405, 16250, 11665, 11662; Payload ID: 9105 relates to Category No.: 11861; Payload ID: 9106 relates to Category No.: 11939, 12292, 5979; Payload ID: 9107 relates to Category No.: 4207, 4075, 5980, 7488; Payload ID: 9108 relates to Category No.: 9619; Payload ID: 9109 relates to Category No.: 11861, 7192; Payload ID: 9110 relates to Category No.: 16331, 15503, 14471, 2405, 6900, 5105, 9275, 11861, 5347, 9272, 14361; Payload ID: 9111 relates to Category No.: 16331, 6900, 5105, 11861; Payload ID: 9112 relates to Category No.: 11861, 7192; Payload ID: 9113 relates to Category No.: 16331, 15503, 14471, 11861; Payload ID: 9114 relates to Category No.: 11861, 5347, 12107, 5588, 14548; Payload ID: 9115 relates to Category No.: 9518, 81; Payload ID: 9116 relates to Category No.: 2963; Payload ID: 9117 relates to Category No.: 11778, 5309, 15587; Payload ID: 9118 relates to Category No.: 10116, 11861, 14198, 15593, 3957, 7265, 7267, 15589; Payload ID: 9119 relates to Category No.: 10116, 11861; Payload ID: 9120 relates to Category No.: 10116, 11861, 9226; Payload ID: 9121 relates to Category No.: 10116, 11861; Payload ID: 9122 relates to Category No.: 9282, 14196, 11861; Payload ID: 9123 relates to Category No.: 9282, 9226, 14196, 10116, 11861; Payload ID: 9124 relates to Category No.: 15503, 14471; Payload ID: 9128 relates to Category No.: 4864, 4196, 2566, 12064, 4710, 6027; Payload ID: 9129 relates to Category No.: 1405, 6001, 11861; Payload ID: 9130 relates to Category No.: 5308; Payload ID: 9131 relates to Category No.: 6816, 5308, 11861; Payload ID: 9133 relates to Category No.: 5308, 5311, 5989, 4731, 15542; Payload ID: 9134 relates to Category No.: 5308, 5311; Payload ID: 9135 relates to Category No.: 9518, 1630, 6274, 9518, 321, 7477, 11861, 5992, 7472, 5957, 5347; Payload ID: 9136 relates to Category No.: 9518, 1630, 6274, 9518, 321, 7477; Payload ID: 9137 relates to Category No.: 9518, 1630, 6274, 9518, 321, 7477, 11861; Payload ID: 9138 relates to Category No.: 9518, 1630, 6274, 9518, 321, 7477, 11861, 7472, 5957, 5347, 5992; Payload ID: 9139 relates to Category No.: 9518, 1630, 6274, 9518, 321, 7477, 11861; Payload ID: 9140 relates to Category No.: 4207, 9518, 1630, 11861, 9518, 308, 3299; Payload ID: 9141 relates to Category No.: 926, 11861; Payload ID: 9142 relates to Category No.: 6816, 4976, 9747, 15354; Payload ID: 9143 relates to Category No.: 3303, 5865, 14503, 5009, 11861, 12108, 9619; Payload ID: 9144 relates to Category No.: 15029; Payload ID: 9145 relates to Category No.: 3303, 14471, 15503, 14471, 11861; Payload ID: 9146 relates to Category No.: 3303; Payload ID: 9147 relates to Category No.: 16331, 6829; Payload ID: 9148 relates to Category No.: 15029, 11861, 12076; Payload ID: 9149 relates to Category No.: 3303, 10116, 11861, 9518, 319, 9518, 319, 7477, 6022, 2418; Payload ID: 9150 relates to Category No.: 15029, 9925; Payload ID: 9151 relates to Category No.: 15029; Payload ID: 9152 relates to Category No.: 15029; Payload ID: 9154 relates to Category No.: 4023, 12402, 11861, 4726; Payload ID: 9155 relates to Category No.: 15029, 12402, 11861; Payload ID: 9156 relates to Category No.: 15029, 12402, 11861; Payload ID: 9157 relates to Category No.: 12402, 11861, 4023; Payload ID: 9158 relates to Category No.: 15029, 12402, 5588, 11861; Payload ID: 9159 relates to Category No.: 11861, 15029, 4023, 3752, 5588, 4726; Payload ID: 9160 relates to Category No.: 15029, 11861, 5588; Payload ID: 9161 relates to Category No.: 15029, 11861, 11886; Payload ID: 9163 relates to Category No.: 4023, 11861, 4726; Payload ID: 9164 relates to Category No.: 11861, 5009; Payload ID: 9165 relates to Category No.: 15029, 11861; Payload ID: 9166 relates to Category No.: 16331, 4820, 1630, 11861, 14537, 4608, 6337; Payload ID: 9167 relates to Category No.: 926, 4886, 1630, 11861, 9890, 9882, 9888; Payload ID: 9168 relates to Category No.: 1630; Payload ID: 9169 relates to Category No.: 5804; Payload ID: 9170 relates to Category No.: 4886, 4895; Payload ID: 9171 relates to Category No.: 11978, 926, 6478, 12109, 11981, 11861; Payload ID: 9172 relates to Category No.: 11978, 926, 6816, 12109, 11861; Payload ID: 9173 relates to Category No.: 10116; Payload ID: 9174 relates to Category No.: 15029; Payload ID: 9175 relates to Category No.: 15029, 11861; Payload ID: 9176 relates to Category No.: 15029; Payload ID: 9177 relates to Category No.: 15029; Payload ID: 9178 relates to Category No.: 15029; Payload ID: 9179 relates to Category No.: 15029; Payload ID: 9180 relates to Category No.: 15029, 11861; Payload ID: 9181 relates to Category No.: 15029, 7192; Payload ID: 9182 relates to Category No.: 15029; Payload ID: 9183 relates to Category No.: 15029, 11861; Payload ID: 9184 relates to Category No.: 15029; Payload ID: 9185 relates to Category No.: 15029; Payload ID: 9186 relates to Category No.: 15029, 11861; Payload ID: 9187 relates to Category No.: 15029; Payload ID: 9188 relates to Category No.: 15029, 11861; Payload ID: 9189 relates to Category No.: 15029, 11861; Payload ID: 9190 relates to Category No.: 15029; Payload ID: 9192 relates to Category No.: 15029; Payload ID: 9193 relates to Category No.: 11890, 4924, 11861; Payload ID: 9194 relates to Category No.: 11890, 4924, 11861; Payload ID: 9195 relates to Category No.: 11890, 4924, 11861; Payload ID: 9196 relates to Category No.: 11890, 4924, 11861; Payload ID: 9197 relates to Category No.: 11890, 4924, 11861; Payload ID: 9198 relates to Category No.: 1405, 11861, 15561, 15572, 6949; Payload ID: 9199 relates to Category No.: 1405, 5009, 11861, 4865; Payload ID: 9200 relates to Category No.: 1405, 11861, 15561; Payload ID: 9201 relates to Category No.: 1405, 11861, 5588, 15561, 4720, 15572; Payload ID: 9202 relates to Category No.: 5009, 11861, 6826; Payload ID: 9203 relates to Category No.: 1504, 5293; Payload ID: 9206 relates to Category No.: 11978, 926, 11895, 9096, 11981, 12145, 12111, 11861, 5347, 14536, 9844, 943, 12081, 4710, 1680, 1686, 11855; Payload ID: 9207 relates to Category No.: 11861, 11886; Payload ID: 9208 relates to Category No.: 11861; Payload ID: 9209 relates to Category No.: 15542, 15548, 9829, 9314, 14088, 14077; Payload ID: 9210 relates to Category No.: 9314, 11861, 782, 9831, 9921; Payload ID: 9211 relates to Category No.: 14564, 1504, 10116, 11861, 11939, 4710, 6024, 5999; Payload ID: 9212 relates to Category No.: 1504, 5999; Payload ID: 9213 relates to Category No.: 1504, 11861, 6434; Payload ID: 9214 relates to Category No.: 1504, 11861; Payload ID: 9215 relates to Category No.: 1504, 5999; Payload ID: 9216 relates to Category No.: 1504, 11861, 4355; Payload ID: 9217 relates to Category No.: 1504, 2282, 6024, 10116, 11861, 5351; Payload ID: 9218 relates to Category No.: 14379, 11861; Payload ID: 9219 relates to Category No.: 1504, 11861, 4355; Payload ID: 9220 relates to Category No.: 1504; Payload ID: 9221 relates to Category No.: 1504; Payload ID: 9222 relates to Category No.: 1504, 11861; Payload ID: 9223 relates to Category No.: 14564, 1504, 3752, 4351, 3287; Payload ID: 9224 relates to Category No.: 1504, 11861; Payload ID: 9225 relates to Category No.: 1504, 11861; Payload ID: 9226 relates to Category No.: 1504, 11861; Payload ID: 9227 relates to Category No.: 6816, 4961, 1504, 6583, 4710; Payload ID: 9228 relates to Category No.: 6816, 6583; Payload ID: 9229 relates to Category No.: 6816, 15973, 11861, 6583; Payload ID: 9230 relates to Category No.: 1504; Payload ID: 9231 relates to Category No.: 4864, 2874, 15567; Payload ID: 9232 relates to Category No.: 4864, 2874, 15567; Payload ID: 9233 relates to Category No.: 2854, 9619; Payload ID: 9234 relates to Category No.: 267, 15741; Payload ID: 9235 relates to Category No.: 267, 15741; Payload ID: 9236 relates to Category No.: 295, 15741, 11861; Payload ID: 9237 relates to Category No.: 6816, 6825; Payload ID: 9240 relates to Category No.: 3303, 9282, 11861; Payload ID: 9241 relates to Category No.: 11978, 926, 12109, 11861, 12082, 7411; Payload ID: 9242 relates to Category No.: 11978, 926, 6816, 12109, 7192, 12145; Payload ID: 9243 relates to Category No.: 4584, 11861; Payload ID: 9244 relates to Category No.: 3303; Payload ID: 9245 relates to Category No.: 15023; Payload ID: 9246 relates to Category No.: 11861, 14238; Payload ID: 9247 relates to Category No.: 5259, 11861, 4864, 12402, 9638; Payload ID: 9248 relates to Category No.: 2881, 15617, 11861, 5347; Payload ID: 9249 relates to Category No.: 12402, 11861; Payload ID: 9250 relates to Category No.: 11861; Payload ID: 9251 relates to Category No.: 15029, 4894, 11981, 12359, 11861; Payload ID: 9252 relates to Category No.: 11861, 4894, 12359, 9608; Payload ID: 9253 relates to Category No.: 11861; Payload ID: 9254 relates to Category No.: 637, 6574, 6828, 9619; Payload ID: 9255 relates to Category No.: 14351, 6924, 11861, 11891, 11892, 12054; Payload ID: 9256 relates to Category No.: 14351, 6924, 11861, 15710; Payload ID: 9257 relates to Category No.: 11861; Payload ID: 9259 relates to Category No.: 3749; Payload ID: 9260 relates to Category No.: 3303, 11939, 3464, 11861; Payload ID: 9261 relates to Category No.: 11861, 6351; Payload ID: 9262 relates to Category No.: 11861; Payload ID: 9263 relates to Category No.: 11861; Payload ID: 9264 relates to Category No.: 11861; Payload ID: 9265 relates to Category No.: 11861; Payload ID: 9266 relates to Category No.: 11861; Payload ID: 9267 relates to Category No.: 11861; Payload ID: 9268 relates to Category No.: 11861, 3774; Payload ID: 9269 relates to Category No.: 11861; Payload ID: 9270 relates to Category No.: 11861; Payload ID: 9271 relates to Category No.: 11861; Payload ID: 9272 relates to Category No.: 16331, 15908, 5259, 15893, 6188, 11861; Payload ID: 9273 relates to Category No.: 11861; Payload ID: 9274 relates to Category No.: 11861, 267, 566; Payload ID: 9275 relates to Category No.: 11861; Payload ID: 9278 relates to Category No.: 6024, 11861, 4196, 2566; Payload ID: 9279 relates to Category No.: 11886; Payload ID: 9281 relates to Category No.: 11861; Payload ID: 9282 relates to Category No.: 11861; Payload ID: 9283 relates to Category No.: 11861; Payload ID: 9284 relates to Category No.: 11861; Payload ID: 9285 relates to Category No.: 11861; Payload ID: 9286 relates to Category No.: 11861, 7192; Payload ID: 9287 relates to Category No.: 11861; Payload ID: 9289 relates to Category No.: 11861, 11665; Payload ID: 9290 relates to Category No.: 11861; Payload ID: 9291 relates to Category No.: 11861; Payload ID: 9292 relates to Category No.: 11861; Payload ID: 9293 relates to Category No.: 11861; Payload ID: 9294 relates to Category No.: 11861; Payload ID: 9295 relates to Category No.: 11861; Payload ID: 9296 relates to Category No.: 11861; Payload ID: 9297 relates to Category No.: 7192; Payload ID: 9298 relates to Category No.: 11861; Payload ID: 9299 relates to Category No.: 11861; Payload ID: 9300 relates to Category No.: 11861; Payload ID: 9301 relates to Category No.: 11861; Payload ID: 9302 relates to Category No.: 11861; Payload ID: 9303 relates to Category No.: 11861; Payload ID: 9304 relates to Category No.: 11861; Payload ID: 9305 relates to Category No.: 11861; Payload ID: 9306 relates to Category No.: 11861; Payload ID: 9307 relates to Category No.: 11861; Payload ID: 9308 relates to Category No.: 11861; Payload ID: 9309 relates to Category No.: 11861, 11939; Payload ID: 9311 relates to Category No.: 11861; Payload ID: 9312 relates to Category No.: 11861; Payload ID: 9313 relates to Category No.: 11861; Payload ID: 9314 relates to Category No.: 14196, 10116, 11861, 9795; Payload ID: 9315 relates to Category No.: 11861; Payload ID: 9316 relates to Category No.: 11861, 12402; Payload ID: 9317 relates to Category No.: 11861; Payload ID: 9318 relates to Category No.: 11861; Payload ID: 9319 relates to Category No.: 11861; Payload ID: 9320 relates to Category No.: 11861; Payload ID: 9321 relates to Category No.: 11861; Payload ID: 9322 relates to Category No.: 11861; Payload ID: 9323 relates to Category No.: 11861; Payload ID: 9324 relates to Category No.: 10116, 11861; Payload ID: 9325 relates to Category No.: 11861, 7192; Payload ID: 9326 relates to Category No.: 11861; Payload ID: 9327 relates to Category No.: 11861; Payload ID: 9328 relates to Category No.: 11861; Payload ID: 9329 relates to Category No.: 11861; Payload ID: 9330 relates to Category No.: 11861, 11895; Payload ID: 9331 relates to Category No.: 11861; Payload ID: 9333 relates to Category No.: 11861; Payload ID: 9339 relates to Category No.: 11861, 706; Payload ID: 9340 relates to Category No.: 11861; Payload ID: 9341 relates to Category No.: 11861; Payload ID: 9342 relates to Category No.: 11861; Payload ID: 9343 relates to Category No.: 11861; Payload ID: 9344 relates to Category No.: 11861; Payload ID: 9345 relates to Category No.: 11861; Payload ID: 9346 relates to Category No.: 12399, 11861; Payload ID: 9347 relates to Category No.: 11861; Payload ID: 9348 relates to Category No.: 11861; Payload ID: 9349 relates to Category No.: 11861, 5892; Payload ID: 9350 relates to Category No.: 11861, 7192; Payload ID: 9351 relates to Category No.: 11861, 8893; Payload ID: 9352 relates to Category No.: 11861; Payload ID: 9353 relates to Category No.: 11861; Payload ID: 9354 relates to Category No.: 9367, 11861, 1637; Payload ID: 9355 relates to Category No.: 3303, 14471; Payload ID: 9356 relates to Category No.: 1153; Payload ID: 9359 relates to Category No.: 14597, 10116, 11861, 14602; Payload ID: 9362 relates to Category No.: 11861, 5347, 11886; Payload ID: 9363 relates to Category No.: 11861; Payload ID: 9365 relates to Category No.: 3303, 15503, 14471, 11861; Payload ID: 9366 relates to Category No.: 11861; Payload ID: 9367 relates to Category No.: 1405, 11861; Payload ID: 9370 relates to Category No.: 11861, 7192, 15567; Payload ID: 9371 relates to Category No.: 14196, 6965, 15895, 10116, 11861, 1173, 14597; Payload ID: 9372 relates to Category No.: 4820, 15617, 11861; Payload ID: 9373 relates to Category No.: 4820, 15617, 11861; Payload ID: 9374 relates to Category No.: 4820, 15617, 11861; Payload ID: 9375 relates to Category No.: 11978, 926, 6816, 4886, 12109, 11861, 5347; Payload ID: 9376 relates to Category No.: 1201, 11861, 11978, 926, 4886, 267, 11939, 4895, 5956, 4894, 12416, 12109, 14706, 6601, 2491, 15181, 14106, 5347, 5841, 15766, 4710, 11973, 4900, 9748, 1155; Payload ID: 9377 relates to Category No.: 11861; Payload ID: 9378 relates to Category No.: 1630, 11861; Payload ID: 9379 relates to Category No.: 11861; Payload ID: 9380 relates to Category No.: 11861, 7192; Payload ID: 9381 relates to Category No.: 11861; Payload ID: 9382 relates to Category No.: 11861; Payload ID: 9383 relates to Category No.: 11861; Payload ID: 9384 relates to Category No.: 11861; Payload ID: 9385 relates to Category No.: 11861; Payload ID: 9386 relates to Category No.: 11861; Payload ID: 9387 relates to Category No.: 11861; Payload ID: 9388 relates to Category No.: 926, 5956, 11861; Payload ID: 9389 relates to Category No.: 11861; Payload ID: 9390 relates to Category No.: 11861; Payload ID: 9391 relates to Category No.: 11861; Payload ID: 9392 relates to Category No.: 11861; Payload ID: 9393 relates to Category No.: 11861; Payload ID: 9394 relates to Category No.: 11861; Payload ID: 9395 relates to Category No.: 11861; Payload ID: 9396 relates to Category No.: 11861; Payload ID: 9397 relates to Category No.: 2405, 6900, 6905, 11861; Payload ID: 9398 relates to Category No.: 11861; Payload ID: 9399 relates to Category No.: 11861; Payload ID: 9400 relates to Category No.: 12402, 11861; Payload ID: 9401 relates to Category No.: 15503, 14471, 11861; Payload ID: 9402 relates to Category No.: 16331, 637, 6829, 11861, 9629, 6821; Payload ID: 9403 relates to Category No.: 926, 9282, 6128, 630, 11861, 632; Payload ID: 9404 relates to Category No.: 926, 9282, 6128, 630, 632; Payload ID: 9405 relates to Category No.: 4864, 12402, 2874, 15503, 14254, 6131; Payload ID: 9406 relates to Category No.: 2881, 11861, 4865, 2449, 2448, 6130, 9370, 11933, 2875; Payload ID: 9409 relates to Category No.: 5347; Payload ID: 9410 relates to Category No.: 11861, 15617, 735; Payload ID: 9411 relates to Category No.: 11861, 12399, 735; Payload ID: 9412 relates to Category No.: 11861; Payload ID: 9413 relates to Category No.: 11861; Payload ID: 9414 relates to Category No.: 11861; Payload ID: 9415 relates to Category No.: 12399, 11861, 735; Payload ID: 9416 relates to Category No.: 11939, 11861, 14536, 12076, 6933, 6936, 5233, 5232; Payload ID: 9417 relates to Category No.: 12399, 11861, 1706, 12076, 6933, 6937, 5439; Payload ID: 9418 relates to Category No.: 11861; Payload ID: 9419 relates to Category No.: 11861; Payload ID: 9420 relates to Category No.: 15617, 11861; Payload ID: 9421 relates to Category No.: 11861, 7192; Payload ID: 9422 relates to Category No.: 11861; Payload ID: 9423 relates to Category No.: 6816; Payload ID: 9424 relates to Category No.: 11978, 926, 15612, 12145; Payload ID: 9426 relates to Category No.: 11861; Payload ID: 9427 relates to Category No.: 11861; Payload ID: 9428 relates to Category No.: 16331, 637, 6829, 9619, 10116, 9629, 6821, 3821, 6158, 1201, 11861; Payload ID: 9429 relates to Category No.: 4820, 6156, 9282, 4816, 6152, 11861; Payload ID: 9430 relates to Category No.: 4820, 6156, 4816, 6152; Payload ID: 9431 relates to Category No.: 4617, 4619, 3749, 6210, 11861, 6160, 11933, 4608; Payload ID: 9432 relates to Category No.: 16331, 11861, 15493; Payload ID: 9433 relates to Category No.: 6816, 15542, 15553, 7192, 9323; Payload ID: 9434 relates to Category No.: 3303, 11861, 15503, 14471, 15504; Payload ID: 9435 relates to Category No.: 3303, 11861; Payload ID: 9436 relates to Category No.: 14082, 11861; Payload ID: 9437 relates to Category No.: 16331, 6188, 11861, 6816, 15908, 9608; Payload ID: 9438 relates to Category No.: 16331, 6816, 11861, 9608; Payload ID: 9439 relates to Category No.: 926, 3303, 6816, 3329, 3330; Payload ID: 9440 relates to Category No.: 926, 3303, 16331, 11861, 3329, 3330; Payload ID: 9441 relates to Category No.: 926, 3303, 6816, 11895, 6188, 11861, 3329, 3330; Payload ID: 9442 relates to Category No.: 15542, 4562, 15542, 15553, 242, 6574, 16319, 11861; Payload ID: 9443 relates to Category No.: 16331, 267, 11861; Payload ID: 9444 relates to Category No.: 16331, 15495, 11861; Payload ID: 9445 relates to Category No.: 16331, 11981, 11861; Payload ID: 9446 relates to Category No.: 16331, 11861; Payload ID: 9447 relates to Category No.: 16331; Payload ID: 9448 relates to Category No.: 16331, 11861; Payload ID: 9449 relates to Category No.: 16331, 5847, 11861, 14538, 277; Payload ID: 9450 relates to Category No.: 16331, 15908, 11861; Payload ID: 9451 relates to Category No.: 16331, 277, 295, 11861; Payload ID: 9452 relates to Category No.: 11939, 15495, 11861, 3752, 6190, 14229, 3303, 2405, 12107, 3732, 15503, 15504; Payload ID: 9453 relates to Category No.: 15493, 6190, 11861, 3752, 15503, 15504; Payload ID: 9454 relates to Category No.: 16331, 11861, 2936, 11983, 7328; Payload ID: 9455 relates to Category No.: 16331, 11861; Payload ID: 9456 relates to Category No.: 16331, 11861; Payload ID: 9457 relates to Category No.: 11978, 926, 16331, 11861, 4961, 12109, 11933; Payload ID: 9458 relates to Category No.: 11978, 926, 16331, 11861, 12109, 11933; Payload ID: 9459 relates to Category No.: 16331, 11861; Payload ID: 9460 relates to Category No.: 16331, 1178, 14251, 14471, 14243, 11861, 3530, 14229, 2559, 15528, 14252, 15528, 14255, 2405; Payload ID: 9461 relates to Category No.: 16331, 11861; Payload ID: 9462 relates to Category No.: 16331, 15503, 14471, 15504, 11861, 3732; Payload ID: 9463 relates to Category No.: 16331, 15495, 11861; Payload ID: 9464 relates to Category No.: 3303, 16331, 15503, 14471, 14471, 15495; Payload ID: 9465 relates to Category No.: 16331, 3303, 14471, 11861, 2405, 15503, 14252; Payload ID: 9466 relates to Category No.: 3303, 16331, 14471, 11861, 15503, 14252; Payload ID: 9467 relates to Category No.: 3303, 16331, 14471, 11861; Payload ID: 9468 relates to Category No.: 3303, 16331, 14471; Payload ID: 9469 relates to Category No.: 3303, 16331, 15503, 14471, 14471, 11861; Payload ID: 9470 relates to Category No.: 3303, 16331, 14471, 11861; Payload ID: 9471 relates to Category No.: 3303, 16331, 14471, 15495, 11861; Payload ID: 9472 relates to Category No.: 3303, 16331, 14471, 11861; Payload ID: 9473 relates to Category No.: 3303, 16331, 15503, 14471, 14471, 11861; Payload ID: 9475 relates to Category No.: 7192; Payload ID: 9479 relates to Category No.: 11861; Payload ID: 9480 relates to Category No.: 3303, 16331, 9226, 14196, 11861, 7268, 7010, 15593; Payload ID: 9481 relates to Category No.: 3303, 16331, 9226, 14196, 10116, 11861; Payload ID: 9482 relates to Category No.: 11861; Payload ID: 9484 relates to Category No.: 3303, 11861; Payload ID: 9485 relates to Category No.: 11861, 5984; Payload ID: 9486 relates to Category No.: 11920, 11861, 5984, 9608; Payload ID: 9487 relates to Category No.: 11920, 11861, 2936, 5984, 9608; Payload ID: 9488 relates to Category No.: 11861; Payload ID: 9491 relates to Category No.: 11981, 11861, 14538; Payload ID: 9492 relates to Category No.: 11861, 14536; Payload ID: 9493 relates to Category No.: 5308, 311, 6206, 14980; Payload ID: 9494 relates to Category No.: 11861; Payload ID: 9495 relates to Category No.: 11861; Payload ID: 9496 relates to Category No.: 6252, 1536, 5009, 11861, 9924, 9822; Payload ID: 9497 relates to Category No.: 5308, 311; Payload ID: 9498 relates to Category No.: 5308, 311; Payload ID: 9499 relates to Category No.: 5308, 311; Payload ID: 9500 relates to Category No.: 5308, 311; Payload ID: 9501 relates to Category No.: 15663, 6210, 5308, 311, 6517; Payload ID: 9502 relates to Category No.: 15663, 5009, 1536, 11861, 787, 9924, 6334, 6206, 6210, 5003, 15542, 15548, 6434, 9822, 396; Payload ID: 9503 relates to Category No.: 5308, 11861, 6206, 5269, 11981, 15663; Payload ID: 9504 relates to Category No.: 5009, 1536, 9924; Payload ID: 9505 relates to Category No.: 5009, 1536, 9924; Payload ID: 9506 relates to Category No.: 6206; Payload ID: 9507 relates to Category No.: 15491, 9817, 7192; Payload ID: 9508 relates to Category No.: 15491, 9817; Payload ID: 9509 relates to Category No.: 15491, 9817; Payload ID: 9510 relates to Category No.: 2858; Payload ID: 9512 relates to Category No.: 15629, 14077; Payload ID: 9513 relates to Category No.: 15629, 14662; Payload ID: 9514 relates to Category No.: 15629, 5865, 14662, 11861, 11939, 11828; Payload ID: 9517 relates to Category No.: 15629, 9801; Payload ID: 9519 relates to Category No.: 6816, 5875, 1630, 138, 6238; Payload ID: 9520 relates to Category No.: 11861; Payload ID: 9521 relates to Category No.: 3303; Payload ID: 9523 relates to Category No.: 7192; Payload ID: 9526 relates to Category No.: 11861; Payload ID: 9527 relates to Category No.: 12402, 6210, 11861, 6242, 6258; Payload ID: 9528 relates to Category No.: 14564, 11861, 16296; Payload ID: 9529 relates to Category No.: 6252, 15663, 12402, 5009, 1536, 11861, 787, 9924, 15659; Payload ID: 9530 relates to Category No.: 14503, 5009, 11861, 3665, 4196, 787; Payload ID: 9531 relates to Category No.: 1401, 11861; Payload ID: 9532 relates to Category No.: 6264, 6188, 9316, 11861; Payload ID: 9533 relates to Category No.: 15542, 15548; Payload ID: 9534 relates to Category No.: 16331, 6188, 11861, 1201, 15893, 15908; Payload ID: 9538 relates to Category No.: 9442; Payload ID: 9539 relates to Category No.: 10116; Payload ID: 9540 relates to Category No.: 2538, 5538; Payload ID: 9543 relates to Category No.: 926, 14471, 14503, 14597, 11861, 957, 456, 14602, 3347, 4834, 7057, 7047, 942; Payload ID: 9544 relates to Category No.: 926, 14503, 12402, 9619, 11861, 957, 3752, 11828; Payload ID: 9545 relates to Category No.: 16331, 11861, 957; Payload ID: 9546 relates to Category No.: 16331, 11861, 957; Payload ID: 9547 relates to Category No.: 16331, 11861, 957; Payload ID: 9554 relates to Category No.: 926, 11939, 1630, 3752, 6308; Payload ID: 9555 relates to Category No.:

15021, 15029, 11861, 1327, 11861; Payload ID: 9556 relates to Category No.: 1405, 12399, 11861, 11828, 2499, 6341, 4710, 16206, 16153, 6334; Payload ID: 9557 relates to Category No.: 12416, 2491, 11861, 1146, 9887, 14580, 9990, 767, 6337, 2489; Payload ID: 9558 relates to Category No.: 11861; Payload ID: 9559 relates to Category No.: 11861; Payload ID: 9560 relates to Category No.: 11861, 1146; Payload ID: 9561 relates to Category No.: 11861, 14324; Payload ID: 9562 relates to Category No.: 1405, 11861, 12399, 10116, 11886, 787, 6255, 6257, 11828; Payload ID: 9563 relates to Category No.: 11861; Payload ID: 9564 relates to Category No.: 11861, 9961; Payload ID: 9565 relates to Category No.: 11861, 6341; Payload ID: 9566 relates to Category No.: 1405, 11861, 6341; Payload ID: 9567 relates to Category No.: 1405, 11861, 16293, 14537, 16291; Payload ID: 9568 relates to Category No.: 11861; Payload ID: 9569 relates to Category No.: 1405, 11861, 16293, 12425, 16291, 14377, 11939, 787; Payload ID: 9570 relates to Category No.: 11861, 16293, 16291; Payload ID: 9572 relates to Category No.: 11939, 12402, 4291, 11861, 5347, 16293, 16291, 787, 6341, 15472, 5958, 2695; Payload ID: 9573 relates to Category No.: 1405, 15617, 11861, 787, 16153, 12448, 5960, 5061; Payload ID: 9574 relates to Category No.: 15973, 5009, 11861, 6337, 12401, 16154, 873, 6207; Payload ID: 9575 relates to Category No.: 9939, 11861, 7192, 1201; Payload ID: 9576 relates to Category No.: 11861; Payload ID: 9577 relates to Category No.: 11861; Payload ID: 9578 relates to Category No.: 11861; Payload ID: 9579 relates to Category No.: 10116; Payload ID: 9580 relates to Category No.: 10116, 11861, 14198, 7268, 11700; Payload ID: 9581 relates to Category No.: 11861, 5223; Payload ID: 9582 relates to Category No.: 11861, 15876; Payload ID: 9584 relates to Category No.: 10116; Payload ID: 9585 relates to Category No.: 10116, 11861, 15872, 12379, 11981; Payload ID: 9586 relates to Category No.: 10116, 11861; Payload ID: 9587 relates to Category No.: 10116, 11861, 15872; Payload ID: 9588 relates to Category No.: 14196, 11861; Payload ID: 9589 relates to Category No.: 10116, 11861; Payload ID: 9590 relates to Category No.: 14196, 11861, 15872; Payload ID: 9591 relates to Category No.: 10116, 11861, 15872; Payload ID: 9592 relates to Category No.: 11861; Payload ID: 9593 relates to Category No.: 7268, 11861, 5347, 14322; Payload ID: 9594 relates to Category No.: 7268, 10116, 11861, 3752; Payload ID: 9595 relates to Category No.: 3303, 10116, 7268, 11861; Payload ID: 9596 relates to Category No.: 4023, 11861, 2566; Payload ID: 9597 relates to Category No.: 5259, 12402; Payload ID: 9598 relates to Category No.: 4820, 4816, 6392, 2395, 2394; Payload ID: 9599 relates to Category No.: 6816, 10116, 11861; Payload ID: 9603 relates to Category No.: 6024; Payload ID: 9605 relates to Category No.: 6024; Payload ID: 9610 relates to Category No.: 12399, 5293, 11861, 15617; Payload ID: 9611 relates to Category No.: 3303, 11917, 14251, 14471, 14243, 11861; Payload ID: 9614 relates to Category No.: 11992, 7192; Payload ID: 9617 relates to Category No.: 11861; Payload ID: 9619 relates to Category No.: 11861; Payload ID: 9620 relates to Category No.: 11861; Payload ID: 9622 relates to Category No.: 1504, 12399, 11861; Payload ID: 9624 relates to Category No.: 12399, 11861, 7192; Payload ID: 9625 relates to Category No.: 2694, 11861, 6245; Payload ID: 9626 relates to Category No.: 1405, 267, 277, 11861, 4896, 5347; Payload ID: 9627 relates to Category No.: 11861; Payload ID: 9628 relates to Category No.: 11861; Payload ID: 9629 relates to Category No.: 11981, 11861, 14536; Payload ID: 9630 relates to Category No.: 11861, 735, 6941, 15617; Payload ID: 9631 relates to Category No.: 14564, 267; Payload ID: 9632 relates to Category No.: 3303, 15503, 14471, 2405, 14471, 15524, 5105, 1153, 840, 2859, 14243, 11861, 3936, 15503, 14239, 3303, 1121, 3935, 4380, 15528, 14255, 3731, 1356, 15528, 14233, 15504, 14234; Payload ID: 9634 relates to Category No.: 12402, 2874, 15777, 11861; Payload ID: 9635 relates to Category No.: 12402, 2874, 15777, 11861; Payload ID: 9636 relates to Category No.: 15895, 11861, 5347, 15781; Payload ID: 9637 relates to Category No.: 11978, 926, 12402, 9096, 12145, 12421, 11861, 5841, 3752, 14537, 11886, 15895, 5588, 9961, 4389, 4726, 10092; Payload ID: 9639 relates to Category No.: 11861; Payload ID: 9644 relates to Category No.: 3303, 2405, 15504, 4207, 9518, 9539, 15524, 11861, 3752, 6185, 7257, 686, 3034, 5114, 5118, 5119, 5115, 15503, 14471, 14252; Payload ID: 9645 relates to Category No.: 9518, 3303, 16331, 5115, 5120, 4207, 11861; Payload ID: 9646 relates to Category No.: 3303, 16331, 11861, 5117, 15977, 6924; Payload ID: 9647 relates to Category No.: 3303, 16331, 14309, 11861, 5114, 5117, 14237; Payload ID: 9648 relates to Category No.: 5865, 3274, 686, 2688, 15503, 14471, 11861, 15525; Payload ID: 9649 relates to Category No.: 6816, 3274, 753; Payload ID: 9650 relates to Category No.: 16331, 15895, 6900, 11861, 5117, 5114; Payload ID: 9651 relates to Category No.: 16331, 11861, 5114, 5119, 3274; Payload ID: 9652 relates to Category No.: 16331, 11861, 3752, 3274, 686, 5114, 5119; Payload ID: 9653 relates to Category No.: 6816, 3274, 5119; Payload ID: 9654 relates to Category No.: 6816, 3274, 2963, 2406, 5114; Payload ID: 9655 relates to Category No.: 3303, 16331, 15503, 14471, 15491, 9518, 315, 16283, 83, 679, 11861, 2405, 2406; Payload ID: 9656 relates to Category No.: 3303, 16331, 15503, 14471, 15495, 9518, 315, 16283, 83, 679, 11861, 5118, 5115, 5122; Payload ID: 9657 relates to Category No.: 3303, 16331, 9518, 315, 16283, 83, 679, 11861, 5118; Payload ID: 9658 relates to Category No.: 3303, 16331, 9518, 315, 16283, 83, 679, 11861, 5118; Payload ID: 9659 relates to Category No.: 6816, 11861, 3274, 5347, 14234, 2406, 5116; Payload ID: 9660 relates to Category No.: 6816, 5116, 11861, 3274, 14471, 1153, 2405; Payload ID: 9661 relates to Category No.: 16331, 5865, 6900, 5116, 9518, 315, 16283, 83, 679, 11861, 5119, 5117, 5123; Payload ID: 9662 relates to Category No.: 6816, 2405, 5117; Payload ID: 9663 relates to Category No.: 3303, 16331, 15503, 14471, 11939, 15524, 5208, 11861, 2691, 5347, 6427, 916, 15977, 2405; Payload ID: 9664 relates to Category No.: 3303, 16331, 15503, 14471, 5208, 11861; Payload ID: 9665 relates to Category No.: 16331, 11861, 3303, 10116, 5208, 6924; Payload ID: 9666 relates to Category No.: 3303, 16331, 15524, 5208, 11861, 6924; Payload ID: 9667 relates to Category No.: 16331, 15491, 5208, 11861, 3752; Payload ID: 9669 relates to Category No.: 10116; Payload ID: 9670 relates to Category No.: 11861; Payload ID: 9674 relates to Category No.: 15542, 15548, 11861, 47; Payload ID: 9675 relates to Category No.: 4820, 11861, 6433, 6431, 9608, 9939, 4804; Payload ID: 9676 relates to Category No.: 4820, 6210, 11861, 6433, 9608; Payload ID: 9677 relates to Category No.: 4820, 6210, 6433, 9939, 4804; Payload ID: 9678 relates to Category No.: 4820, 6210, 6431, 6433; Payload ID: 9679 relates to Category No.: 4820, 7192; Payload ID: 9680 relates to Category No.: 4820; Payload ID: 9681 relates to Category No.: 1405, 15542, 15548, 48, 52, 49, 53; Payload ID: 9682 relates to Category No.: 1405, 15542, 15548, 47, 48, 52; Payload ID: 9683 relates to Category No.: 48, 15542, 15548; Payload ID: 9684 relates to Category No.: 15542, 15548, 48, 50, 52, 6435; Payload ID: 9685 relates to Category No.: 15542, 15548, 7192; Payload ID: 9686 relates to Category No.: 5308, 6206, 6434, 9547; Payload ID: 9687 relates to Category No.: 5308, 1536, 9547; Payload ID: 9688 relates to Category No.: 5308, 1536, 6434, 9547; Payload ID: 9690 relates to Category No.: 11861; Payload ID: 9691 relates to Category No.: 11861; Payload ID: 9692 relates to Category No.: 9939, 11861, 1201; Payload ID: 9693 relates to Category No.: 11861, 3752, 16206, 11920; Payload ID: 9694 relates to Category No.: 11861, 3752, 11920; Payload ID: 9697 relates to Category No.: 6446, 5347; Payload ID: 9698 relates to Category No.: 6446; Payload ID: 9699 relates to Category No.: 6446; Payload ID: 9700 relates to Category No.: 6446; Payload ID: 9701 relates to Category No.: 6446; Payload ID: 9702 relates to Category No.: 6446; Payload ID: 9703 relates to Category No.: 6446; Payload ID: 9704 relates to Category No.: 2672, 11861, 9518, 320, 9523, 12180; Payload ID: 9705 relates to Category No.: 2672, 9518, 320, 9523; Payload ID: 9706 relates to Category No.: 2405, 3554, 6900, 14379, 15495, 2672, 11861, 9518, 320, 9523, 9356, 12180; Payload ID: 9707 relates to Category No.: 14379, 2672, 11861, 9518, 320, 9523, 12180; Payload ID: 9708 relates to Category No.: 14379, 2672, 11861, 9518, 320, 9523, 12180; Payload ID: 9709 relates to Category No.: 926, 9282, 9226, 6816, 11861, 15699, 632, 6428, 620; Payload ID: 9710 relates to Category No.: 926, 3303, 6816, 4886, 2820; Payload ID: 9711 relates to Category No.: 11886; Payload ID: 9712 relates to Category No.: 11861; Payload ID: 9713 relates to Category No.: 11861; Payload ID: 9714 relates to Category No.: 11861; Payload ID: 9715 relates to Category No.: 5308, 313, 11861, 2998; Payload ID: 9716 relates to Category No.: 5308, 313, 2998; Payload ID: 9717 relates to Category No.: 267, 11861; Payload ID: 9719 relates to Category No.: 12402, 2874, 2882, 2282, 11861, 3422, 9800; Payload ID: 9720 relates to Category No.: 15617, 14379, 14581; Payload ID: 9721 relates to Category No.: 14379, 11861, 6334; Payload ID: 9722 relates to Category No.: 14503; Payload ID: 9723 relates to Category No.: 11978, 926, 15612, 12145, 11861, 3752, 6463; Payload ID: 9724 relates to Category No.: 11861; Payload ID: 9725 relates to Category No.: 11939, 11861, 5347; Payload ID: 9726 relates to Category No.: 5914, 11861, 14229; Payload ID: 9727 relates to Category No.: 11861; Payload ID: 9728 relates to Category No.: 14471, 11861; Payload ID: 9729 relates to Category No.: 1201; Payload ID: 9730 relates to Category No.: 1201; Payload ID: 9731 relates to Category No.: 1201; Payload ID: 9732 relates to Category No.: 1201; Payload ID: 9733 relates to Category No.: 1201; Payload ID: 9734 relates to Category No.: 1201; Payload ID: 9735 relates to Category No.: 1201; Payload ID: 9736 relates to Category No.: 1201; Payload ID: 9737 relates to Category No.: 1201; Payload ID: 9738 relates to Category No.: 14259, 14262, 14263, 14264, 11861, 4338; Payload ID: 9740 relates to Category No.: 11861; Payload ID: 9741 relates to Category No.: 6481; Payload ID: 9742 relates to Category No.: 6816, 12150, 9804; Payload ID: 9743 relates to Category No.: 10116, 11861; Payload ID: 9744 relates to Category No.: 10116, 11861; Payload ID: 9745 relates to Category No.: 16331, 15908, 6188, 11861, 15893; Payload ID: 9746 relates to Category No.: 15046; Payload ID: 9747 relates to Category No.: 9426, 15305, 15046; Payload ID: 9748 relates to Category No.: 7192; Payload ID: 9750 relates to Category No.: 9951, 15138; Payload ID: 9752 relates to Category No.: 14772; Payload ID: 9754 relates to Category No.: 7194, 11861, 15046; Payload ID: 9758 relates to Category No.: 15046; Payload ID: 9759 relates to Category No.: 15629, 15046; Payload ID: 9760 relates to Category No.: 12402, 9625, 10116, 11861, 1137, 15205, 15218; Payload ID: 9761 relates to Category No.: 11861, 9625, 2271, 15218; Payload ID: 9762 relates to Category No.: 11861, 9625, 15218; Payload ID: 9763 relates to Category No.: 9625, 11861; Payload ID: 9764 relates to Category No.: 9625, 11861, 12402, 15220, 15221; Payload ID: 9765 relates to Category No.: 9625, 11861, 11939, 12402; Payload ID: 9766 relates to Category No.: 11861, 6944; Payload ID: 9767 relates to Category No.: 11861, 6944; Payload ID: 9768 relates to Category No.: 11861, 6944, 6945; Payload ID: 9769 relates to Category No.: 11861, 6944, 6945; Payload ID: 9770 relates to Category No.: 9625, 11861, 6945; Payload ID: 9771 relates to Category No.: 9625, 11861; Payload ID: 9772 relates to Category No.: 9625, 11861, 6945; Payload ID: 9773 relates to Category No.: 11861, 6945; Payload ID: 9774 relates to Category No.: 11861, 9625, 6945; Payload ID: 9775 relates to Category No.: 11861, 6945; Payload ID: 9776 relates to Category No.: 11861; Payload ID: 9777 relates to Category No.: 9625, 11861, 6945; Payload ID: 9778 relates to Category No.: 11861; Payload ID: 9779 relates to Category No.: 11861; Payload ID: 9780 relates to Category No.: 9625, 11861; Payload ID: 9781 relates to Category No.: 9625, 11861, 6936; Payload ID: 9782 relates to Category No.: 15629, 1457, 4631, 16270, 11861, 15023; Payload ID: 9783 relates to Category No.: 11981, 11861, 12081; Payload ID: 9784 relates to Category No.: 10116; Payload ID: 9785 relates to Category No.: 16331, 6816, 15908, 6188, 10116, 11861, 2405; Payload ID: 9786 relates to Category No.: 16331, 6816, 6188, 10116, 11861; Payload ID: 9787 relates to Category No.: 16331, 6816, 6188, 11861; Payload ID: 9788 relates to Category No.: 6210, 11861, 15025, 9618, 2267; Payload ID: 9789 relates to Category No.: 11861; Payload ID: 9790 relates to Category No.: 11861; Payload ID: 9791 relates to Category No.: 9518, 1630, 9518, 321, 7477, 6517, 6284, 6542, 3263, 7472; Payload ID: 9792 relates to Category No.: 1630, 9518, 321, 7477, 6517; Payload ID: 9793 relates to Category No.: 9518, 1630, 9518, 321, 7477, 10116, 6517, 6284, 11861, 12107, 6516; Payload ID: 9794 relates to Category No.: 11978, 926, 15491, 11861, 2832; Payload ID: 9795 relates to Category No.: 1504, 3752; Payload ID: 9796 relates to Category No.: 11861; Payload ID: 9797 relates to Category No.: 2405; Payload ID: 9798 relates to Category No.: 16331, 15893, 6188, 11861; Payload ID: 9799 relates to Category No.: 3303, 6900; Payload ID: 9800 relates to Category No.: 3554, 7472, 7510, 6574, 456, 6514, 6542, 9497, 6515, 11861; Payload ID: 9801 relates to Category No.: 6816, 3554, 7472, 6514, 6542, 9497; Payload ID: 9802 relates to Category No.: 6816, 7472, 6514, 2559, 6542, 9497, 6515; Payload ID: 9803 relates to Category No.: 4886, 11861; Payload ID: 9804 relates to Category No.: 14196, 15592; Payload ID: 9805 relates to Category No.: 15542, 1630, 10116, 16; Payload ID: 9806 relates to Category No.: 12402, 6547; Payload ID: 9807 relates to Category No.: 14564, 15908, 2854, 9619, 11861, 12107, 5955, 11828; Payload ID: 9808 relates to Category No.: 5308, 5311, 1630, 1504, 4511, 552, 6549, 660; Payload ID: 9809 relates to Category No.: 5308, 5311, 1630, 1504, 4511; Payload ID: 9810 relates to Category No.: 11861; Payload ID: 9812 relates to Category No.: 11861; Payload ID: 9813 relates to Category No.: 11861, 7192; Payload ID: 9814 relates to Category No.: 11861; Payload ID: 9815 relates to Category No.: 1405, 11939, 14503, 9619, 11861, 1439; Payload ID: 9816 relates to Category No.: 1405, 14503, 9619, 11861, 1439, 2618; Payload ID: 9817 relates to Category No.: 16331, 6590; Payload ID: 9818 relates to Category No.: 12399, 11861, 16206, 15617, 6583; Payload ID: 9819 relates to Category No.: 1504, 11861, 2566; Payload ID: 9820 relates to Category No.: 6583, 6586, 15617; Payload ID: 9821 relates to Category No.: 1405, 12402, 11861, 1439, 6583; Payload ID: 9822 relates to Category No.: 11861; Payload ID: 9823 relates to Category No.: 1405, 6595, 6592; Payload ID: 9824 relates to Category No.: 1405, 6595; Payload ID: 9825 relates to Category No.: 1405, 6595; Payload ID: 9826 relates to Category No.: 1405, 6595; Payload ID: 9827 relates to Category No.: 16331, 5308, 5311, 1630, 1504, 588, 6592, 6596, 5308, 5310; Payload ID: 9828 relates to Category No.: 16331, 5308, 5311, 1630, 1504, 588, 6592, 6596, 5308, 5310; Payload ID: 9829 relates to Category No.: 16331, 5308, 5311, 1630, 1504, 588, 6592, 6583; Payload ID: 9830 relates to Category No.: 16331, 5308, 5311, 1630, 1504, 588, 6592; Payload ID: 9831 relates to Category No.: 16331, 5308, 5311, 1630, 1504, 588, 6592; Payload ID: 9832 relates to Category No.: 5308, 5311, 1168, 6583; Payload ID: 9833 relates to Category No.: 11861; Payload ID: 9834 relates to Category No.: 4713, 588; Payload ID: 9835 relates to Category No.: 5308; Payload ID: 9836 relates to Category No.: 6816, 242, 549; Payload ID: 9837 relates to Category No.: 6816, 15542, 15554, 550, 242, 15542, 15553; Payload ID: 9838 relates to Category No.: 15542, 15554, 6816, 550, 242, 15542, 15553; Payload ID: 9839 relates to Category No.: 554, 1504; Payload ID: 9840 relates to Category No.: 555, 242, 15542, 15553; Payload ID: 9841 relates to Category No.: 6816, 11861, 555; Payload ID: 9842 relates to Category No.: 1133, 15542, 15553; Payload ID: 9843 relates to Category No.: 1630, 6597, 4549; Payload ID: 9846 relates to Category No.: 11978, 926, 1457, 1459, 1443, 12109, 11861; Payload ID: 9847 relates to Category No.: 1457, 1459, 1443, 11978, 926, 6816, 12109, 11861; Payload ID: 9848 relates to Category No.: 11978, 926, 6478, 12109, 9887, 9896, 15231, 9818; Payload ID: 9849 relates to Category No.: 11978, 926, 6478, 12109, 6210, 10116, 11861, 11977, 15231; Payload ID: 9850 relates to Category No.: 11978, 926, 12109, 11861, 5956; Payload ID: 9851 relates to Category No.: 11978, 926, 6965, 12109, 11861, 15887, 4389, 15231; Payload ID: 9852 relates to Category No.: 11861, 5347, 11991; Payload ID: 9853 relates to Category No.: 11861; Payload ID: 9854 relates to Category No.: 6965, 1457; Payload ID: 9855 relates to Category No.: 15029; Payload ID: 9856 relates to Category No.: 15029; Payload ID: 9857 relates to Category No.: 6965, 15029, 15766; Payload ID: 9858 relates to Category No.: 11861, 12360, 11977, 3007; Payload ID: 9859 relates to Category No.: 267, 1457, 11861; Payload ID: 9860 relates to Category No.: 11861; Payload ID: 9861 relates to Category No.: 926, 11895, 10116, 11861; Payload ID: 9863 relates to Category No.: 11861; Payload ID: 9864 relates to Category No.: 11861, 7127; Payload ID: 9865 relates to Category No.: 4820; Payload ID: 9866 relates to Category No.: 4820, 701, 9629, 698, 9636; Payload ID: 9867 relates to Category No.: 4820; Payload ID: 9868 relates to Category No.: 4820; Payload ID: 9869 relates to Category No.: 4820; Payload ID: 9870 relates to Category No.: 4820; Payload ID: 9871 relates to Category No.: 4820; Payload ID: 9872 relates to Category No.: 4820, 8957, 6621; Payload ID: 9873 relates to Category No.: 4820; Payload ID: 9874 relates to Category No.: 4820; Payload ID: 9875 relates to Category No.: 11861; Payload ID: 9877 relates to Category No.: 7192; Payload ID: 9878 relates to Category No.: 15491, 9625, 11981, 11861; Payload ID: 9879 relates to Category No.: 15491; Payload ID: 9880 relates to Category No.: 15491; Payload ID: 9881 relates to Category No.: 1405, 11978, 926, 12109, 9096, 6210, 11861; Payload ID: 9882 relates to Category No.: 1405, 4023, 11861; Payload ID: 9883 relates to Category No.: 1405, 11861, 7192; Payload ID: 9884 relates to Category No.: 1405, 4023, 11861; Payload ID: 9885 relates to Category No.: 1405, 11861; Payload ID: 9886 relates to Category No.: 16331, 9282, 9226, 15029, 10116, 11861; Payload ID: 9887 relates to Category No.: 16331, 9282, 9226, 15029, 10116, 11861; Payload ID: 9888 relates to Category No.: 4023, 11861, 4022; Payload ID: 9889 relates to Category No.: 1405, 4023, 11861, 15019; Payload ID: 9890 relates to Category No.: 1405, 16331, 6825, 6829, 3663; Payload ID: 9891 relates to Category No.: 1405, 16331, 6825, 6829; Payload ID: 9892 relates to Category No.: 1405, 16331, 6825, 6829; Payload ID: 9893 relates to Category No.: 1405, 16331, 6825, 6829, 3663; Payload ID: 9894 relates to Category No.: 1405, 16331, 6825, 6829, 2566, 9619, 4196, 1439, 6337; Payload ID: 9895 relates to Category No.: 1405, 16331, 6825, 6829, 11861, 5588, 9617; Payload ID: 9896 relates to Category No.: 1405, 3749, 16331, 6825, 6829, 11861; Payload ID: 9897 relates to Category No.: 1405, 3749, 16331, 6825, 6829; Payload ID: 9898 relates to Category No.: 1405, 3749, 16331, 6825, 6829, 6816; Payload ID: 9899 relates to Category No.: 1405, 16331, 6825, 6829; Payload ID: 9900 relates to Category No.: 16331, 14503, 6825, 6829, 11861; Payload ID: 9901 relates to Category No.: 1405, 16331, 6825, 6829, 11861; Payload ID: 9902 relates to Category No.: 1405, 16331, 6825, 6829; Payload ID: 9903 relates to Category No.: 16331, 6825, 6829, 11861; Payload ID: 9904 relates to Category No.: 1405, 3749, 16331, 6825, 6829, 1369; Payload ID: 9905 relates to Category No.: 1405, 16331, 6825, 6829; Payload ID: 9906 relates to Category No.: 16331, 6825, 6829; Payload ID: 9907 relates to Category No.: 1405, 16331, 6825, 6829; Payload ID: 9909 relates to Category No.: 1405, 16331, 6825, 6829, 3663, 11861; Payload ID: 9910 relates to Category No.: 16331, 6825, 6829, 9619, 5009; Payload ID: 9911 relates to Category No.: 1405, 16331, 14503, 6825, 6829; Payload ID: 9912 relates to Category No.: 16331, 6825, 6829, 3663, 11861, 5347, 2566, 9619; Payload ID: 9913 relates to Category No.: 11861, 7192; Payload ID: 9915 relates to Category No.: 11861, 7192; Payload ID: 9918 relates to Category No.: 11861, 12064; Payload ID: 9919 relates to Category No.: 11917, 15503, 14471, 14234, 15495, 11861, 15493, 15530, 14233; Payload ID: 9920 relates to Category No.: 11917, 11861, 3303; Payload ID: 9921 relates to Category No.: 11917, 15495, 11861, 3303; Payload ID: 9922 relates to Category No.: 3303, 11917, 15495, 11861; Payload ID: 9923 relates to Category No.: 15503, 14471, 11917, 15491, 15495, 14243, 15530, 14255, 3303, 11861, 2405; Payload ID: 9924 relates to Category No.: 16331; Payload ID: 9925 relates to Category No.: 14107, 4924, 11861; Payload ID: 9926 relates to Category No.: 14107, 4924, 11861, 56; Payload ID: 9927 relates to Category No.: 14107; Payload ID: 9928 relates to Category No.: 926, 15973, 11861, 14244; Payload ID: 9930 relates to Category No.: 11861; Payload ID: 9931 relates to Category No.: 16331, 15908, 9539, 15895, 15893, 6188, 11861, 5347, 3752, 14377, 9763; Payload ID: 9932 relates to Category No.: 16331, 11861, 3752; Payload ID: 9933 relates to Category No.: 3303, 6816, 15503, 14471, 11939, 11861, 9226; Payload ID: 9934 relates to Category No.: 926, 5956, 11917, 11861, 9988, 512, 3471, 12109, 9961, 14262, 14263, 14264, 15323, 1201, 14176, 11981, 11920; Payload ID: 9935 relates to Category No.: 11861; Payload ID: 9936 relates to Category No.: 2405, 15504, 14251, 14471, 14082, 15491, 12399, 14248, 11861, 15493, 2688, 3936, 6185, 9173, 6184, 16224, 15409, 9763, 15410, 6654, 6083, 3303, 11886, 15893, 14234, 2406; Payload ID: 9937 relates to Category No.: 14248, 11861, 15893; Payload ID: 9938 relates to Category No.: 14248, 11861, 15893; Payload ID:

9939 relates to Category No.: 11895, 15491, 12399, 1153, 14248, 11920, 11861, 15493, 6185, 14246, 16224, 15409, 14240, 15504, 2405, 15528, 14252, 15893; Payload ID: 9940 relates to Category No.: 1153, 14248, 14246, 15504; Payload ID: 9941 relates to Category No.: 15491, 12399, 14248, 15493, 6185, 16224, 15409; Payload ID: 9942 relates to Category No.: 14248; Payload ID: 9943 relates to Category No.: 15491, 12399, 14248, 11861, 15493, 6185, 16224; Payload ID: 9944 relates to Category No.: 14248, 11861; Payload ID: 9945 relates to Category No.: 1630, 15491, 12399, 11861, 15493, 16224, 15409, 15410; Payload ID: 9946 relates to Category No.: 15491, 12399, 14248, 11861, 15493, 6185, 16224, 15409, 15893; Payload ID: 9947 relates to Category No.: 14248, 11861; Payload ID: 9948 relates to Category No.: 14248, 11861; Payload ID: 9949 relates to Category No.: 15491, 14248, 11861, 3391, 15893; Payload ID: 9950 relates to Category No.: 15491, 14248, 11861, 3391, 15893; Payload ID: 9951 relates to Category No.: 14248; Payload ID: 9952 relates to Category No.: 15491, 11861; Payload ID: 9953 relates to Category No.: 12399, 14248, 11861, 15493, 6185, 16224, 15409, 15893, 15491, 5096; Payload ID: 9954 relates to Category No.: 15504, 14082, 11861, 14087; Payload ID: 9955 relates to Category No.: 3303, 15491, 14248, 11861; Payload ID: 9956 relates to Category No.: 15491, 11861, 15893; Payload ID: 9957 relates to Category No.: 267, 11861; Payload ID: 9958 relates to Category No.: 11861; Payload ID: 9959 relates to Category No.: 12399, 14248, 11861, 15493, 6185, 16224, 15409, 15893; Payload ID: 9960 relates to Category No.: 15491, 14248, 11861, 15893; Payload ID: 9961 relates to Category No.: 12399, 14248, 11861, 15493, 6185, 16224, 15409; Payload ID: 9962 relates to Category No.: 14248, 15504, 15491, 11861, 14247, 15893; Payload ID: 9963 relates to Category No.: 15491, 14248, 11861, 15893; Payload ID: 9964 relates to Category No.: 14234, 14248, 11861; Payload ID: 9965 relates to Category No.: 14248, 11861; Payload ID: 9966 relates to Category No.: 11861; Payload ID: 9967 relates to Category No.: 11895, 11861, 4171; Payload ID: 9968 relates to Category No.: 16331, 267, 11861; Payload ID: 9969 relates to Category No.: 11861, 15503, 14252; Payload ID: 9970 relates to Category No.: 267, 15491, 295, 11861, 14246, 6127, 15503, 14471, 15525, 12082; Payload ID: 9971 relates to Category No.: 11978, 926, 12402, 9096, 12145, 11861; Payload ID: 9972 relates to Category No.: 15629, 12142, 11861, 11886; Payload ID: 9973 relates to Category No.: 11861, 7192; Payload ID: 9974 relates to Category No.: 2405, 14597, 14595, 11861; Payload ID: 9976 relates to Category No.: 5347; Payload ID: 9977 relates to Category No.: 1201; Payload ID: 9978 relates to Category No.: 11861; Payload ID: 9979 relates to Category No.: 11861; Payload ID: 9980 relates to Category No.: 3303; Payload ID: 9981 relates to Category No.: 3303, 11861, 15528, 14233, 14471, 11933, 2405, 14234, 15503, 14239; Payload ID: 9982 relates to Category No.: 3303, 15503, 14471, 14234, 14471, 15504, 15495, 11861, 15493, 15528, 14233; Payload ID: 9983 relates to Category No.: 3303, 14471, 15528, 14233, 2405; Payload ID: 9984 relates to Category No.: 11861; Payload ID: 9985 relates to Category No.: 4820, 8960, 6701, 12402; Payload ID: 9986 relates to Category No.: 4820, 4816, 2862; Payload ID: 9987 relates to Category No.: 4820, 6708, 15895, 4816, 11861, 6702; Payload ID: 9988 relates to Category No.: 4820, 11861, 6702, 2727; Payload ID: 9989 relates to Category No.: 11861, 15798, 15800, 15788, 2725, 15801; Payload ID: 9990 relates to Category No.: 11861, 5347, 15798, 15800, 15788, 2725, 15801; Payload ID: 9991 relates to Category No.: 4820, 8957, 11861, 6708, 6702, 9636; Payload ID: 9992 relates to Category No.: 15895, 4820, 8957, 11861, 6708, 6702, 9636; Payload ID: 9993 relates to Category No.: 4820, 6702, 11861, 5260; Payload ID: 9994 relates to Category No.: 5109, 11861; Payload ID: 9996 relates to Category No.: 11861; Payload ID: 9997 relates to Category No.: 7192; Payload ID: 9998 relates to Category No.: 15895, 5109, 11861, 13735; Payload ID: 9999 relates to Category No.: 15895, 5109, 11861, 13735; Payload ID: 10000 relates to Category No.: 11861, 1626; Payload ID: 10001 relates to Category No.: 11861, 7192; Payload ID: 10002 relates to Category No.: 11861, 7192; Payload ID: 10003 relates to Category No.: 11861, 7192; Payload ID: 10004 relates to Category No.: 11861, 7192; Payload ID: 10005 relates to Category No.: 11861, 7192; Payload ID: 10010 relates to Category No.: 11861; Payload ID: 10011 relates to Category No.: 11861; Payload ID: 10013 relates to Category No.: 11861; Payload ID: 10014 relates to Category No.: 7192; Payload ID: 10015 relates to Category No.: 11861, 7192; Payload ID: 10017 relates to Category No.: 11861; Payload ID: 10018 relates to Category No.: 15895, 11861; Payload ID: 10020 relates to Category No.: 11861, 15491; Payload ID: 10024 relates to Category No.: 11861; Payload ID: 10026 relates to Category No.: 11861; Payload ID: 10027 relates to Category No.: 11861; Payload ID: 10028 relates to Category No.: 15908, 11861; Payload ID: 10029 relates to Category No.: 9275, 11861; Payload ID: 10031 relates to Category No.: 11861; Payload ID: 10032 relates to Category No.: 4864, 11861; Payload ID: 10033 relates to Category No.: 11861; Payload ID: 10034 relates to Category No.: 11861; Payload ID: 10035 relates to Category No.: 12359, 6816, 11861; Payload ID: 10036 relates to Category No.: 11861; Payload ID: 10037 relates to Category No.: 4820, 6716, 11861, 5260, 9430; Payload ID: 10038 relates to Category No.: 4820, 6716, 11861; Payload ID: 10039 relates to Category No.: 11861; Payload ID: 10040 relates to Category No.: 12416, 14652, 11861, 9805, 15822, 1130, 14564, 5956, 11890; Payload ID: 10041 relates to Category No.: 926, 11890, 11861, 4922, 4291; Payload ID: 10042 relates to Category No.: 15542, 15549; Payload ID: 10043 relates to Category No.: 47; Payload ID: 10044 relates to Category No.: 14493; Payload ID: 10045 relates to Category No.: 11861; Payload ID: 10046 relates to Category No.: 11861, 7192; Payload ID: 10047 relates to Category No.: 6481; Payload ID: 10048 relates to Category No.: 16331, 6825, 3663, 11861, 9629, 3998, 9619; Payload ID: 10049 relates to Category No.: 6825; Payload ID: 10050 relates to Category No.: 11861, 4922; Payload ID: 10051 relates to Category No.: 11861, 4922, 9608; Payload ID: 10052 relates to Category No.: 11861, 4922, 9608; Payload ID: 10053 relates to Category No.: 11861; Payload ID: 10054 relates to Category No.: 11920, 11861; Payload ID: 10055 relates to Category No.: 11861, 9608; Payload ID: 10056 relates to Category No.: 11933, 11890, 11920, 11861, 14580; Payload ID: 10057 relates to Category No.: 16331, 15908, 6188, 6946, 15893; Payload ID: 10058 relates to Category No.: 16331, 6188, 11861; Payload ID: 10059 relates to Category No.: 16331, 6188; Payload ID: 10060 relates to Category No.: 16331, 15908, 6188, 11861; Payload ID: 10061 relates to Category No.: 16331, 6188; Payload ID: 10062 relates to Category No.: 16331, 15908, 6188; Payload ID: 10063 relates to Category No.: 16331, 15908, 6188, 11861, 4896; Payload ID: 10064 relates to Category No.: 16331, 15908, 6188, 15889, 15894, 3752, 15915; Payload ID: 10065 relates to Category No.: 16331, 6188; Payload ID: 10066 relates to Category No.: 16331, 15908, 6188, 15893, 6941; Payload ID: 10067 relates to Category No.: 16331, 6188; Payload ID: 10068 relates to Category No.: 14503, 3663;

Payload ID: 10069 relates to Category No.: 6816, 6825, 11861; Payload ID: 10070 relates to Category No.: 11861, 6944, 3774; Payload ID: 10071 relates to Category No.: 11861; Payload ID: 10072 relates to Category No.: 11861; Payload ID: 10077 relates to Category No.: 5351; Payload ID: 10078 relates to Category No.: 11861; Payload ID: 10086 relates to Category No.: 7192; Payload ID: 10087 relates to Category No.: 5295, 1170; Payload ID: 10088 relates to Category No.: 16331, 6825, 6829, 11861; Payload ID: 10089 relates to Category No.: 16331, 6825, 6829, 11861; Payload ID: 10090 relates to Category No.: 11978, 926, 15612, 12145, 11861; Payload ID: 10091 relates to Category No.: 15364, 118, 5347; Payload ID: 10093 relates to Category No.: 3303, 15503, 14471, 14471, 11861, 2691, 7192, 15528, 14233, 2405, 14234, 5235; Payload ID: 10094 relates to Category No.: 3303, 15503, 14471, 14234, 14471, 11861, 15528, 14233, 14240, 15528, 14239; Payload ID: 10096 relates to Category No.: 11861; Payload ID: 10097 relates to Category No.: 7192, 11861, 6337; Payload ID: 10098 relates to Category No.: 3303; Payload ID: 10099 relates to Category No.: 3303; Payload ID: 10100 relates to Category No.: 3303, 14564, 11861; Payload ID: 10101 relates to Category No.: 15503, 14471, 11917, 15524, 15528, 14233, 14234, 3731; Payload ID: 10102 relates to Category No.: 3303, 11917; Payload ID: 10103 relates to Category No.: 5308, 1630; Payload ID: 10104 relates to Category No.: 3303, 11917, 2405, 15528, 14255; Payload ID: 10105 relates to Category No.: 11861; Payload ID: 10107 relates to Category No.: 14429, 11861, 11978, 926, 15612, 12145, 12081, 5023; Payload ID: 10108 relates to Category No.: 15491, 3464, 10116, 11861, 14252, 9014; Payload ID: 10109 relates to Category No.: 3303, 16331, 6900, 11861; Payload ID: 10110 relates to Category No.: 6816, 5308; Payload ID: 10111 relates to Category No.: 6816, 5308, 7192; Payload ID: 10112 relates to Category No.: 9974, 11861, 6574, 4796, 5308; Payload ID: 10113 relates to Category No.: 5308, 7192; Payload ID: 10114 relates to Category No.: 6816, 5308, 11861; Payload ID: 10115 relates to Category No.: 16331, 6816, 11861; Payload ID: 10116 relates to Category No.: 16331, 6816; Payload ID: 10117 relates to Category No.: 16331, 6816; Payload ID: 10118 relates to Category No.: 16331, 6816, 11861; Payload ID: 10119 relates to Category No.: 16331, 6816, 11861; Payload ID: 10120 relates to Category No.: 16331, 6816, 11861; Payload ID: 10121 relates to Category No.: 6816, 11861; Payload ID: 10122 relates to Category No.: 16331, 6816; Payload ID: 10123 relates to Category No.: 16331, 6816; Payload ID: 10124 relates to Category No.: 16331, 6816, 11861, 3471; Payload ID: 10125 relates to Category No.: 6816, 16331, 2672, 2859, 753, 11861, 3471, 11977, 1371; Payload ID: 10126 relates to Category No.: 6816; Payload ID: 10127 relates to Category No.: 6816; Payload ID: 10128 relates to Category No.: 3303, 6816, 15503, 14471, 14234, 15491, 11861, 2688, 15528, 14233, 14237, 5101; Payload ID: 10129 relates to Category No.: 3303, 16331, 15503, 14471, 2405, 14471, 15491, 15495, 11861, 2691, 2688, 14244; Payload ID: 10130 relates to Category No.: 3303, 16331, 15503, 14471, 14234, 2405, 14471, 9271, 11861, 14252, 14240, 14244, 15524, 5108, 15503, 15504, 5109; Payload ID: 10131 relates to Category No.: 3303, 16331, 15503, 14471, 2405, 14471, 11861; Payload ID: 10132 relates to Category No.: 4864; Payload ID: 10133 relates to Category No.: 267, 12402, 295, 11861, 5347, 277; Payload ID: 10134 relates to Category No.: 267; Payload ID: 10137 relates to Category No.: 11861; Payload ID: 10140 relates to Category No.: 5259, 7192; Payload ID: 10141 relates to Category No.: 9282, 9226, 10116; Payload ID: 10142 relates to Category No.: 926, 6816, 6884; Payload ID: 10143 relates to Category No.: 926, 6816, 11861, 6884; Payload ID: 10144 relates to Category No.: 11861, 3752, 6886, 1630, 2557; Payload ID: 10145 relates to Category No.: 9649; Payload ID: 10146 relates to Category No.: 16331, 267, 9648, 6891; Payload ID: 10147 relates to Category No.: 16331, 15503, 14471, 267, 9648; Payload ID: 10148 relates to Category No.: 16331, 9648, 11861; Payload ID: 10149 relates to Category No.: 6816, 637, 6828, 5308; Payload ID: 10150 relates to Category No.: 637, 6828, 6816, 10116, 6821, 11861; Payload ID: 10151 relates to Category No.: 6816, 637, 6828; Payload ID: 10152 relates to Category No.: 926, 9282, 15699, 632, 6892; Payload ID: 10153 relates to Category No.: 926, 9282, 632, 6892; Payload ID: 10154 relates to Category No.: 3303, 6905, 15495, 3462, 5109, 11920, 10116, 11861, 12064, 15503, 14471, 15504, 2405, 7268, 14609, 3752, 4288, 2406, 15977; Payload ID: 10155 relates to Category No.: 3303, 1630, 3640, 11861, 14374, 12324; Payload ID: 10156 relates to Category No.: 3303, 16331, 6905, 3462, 11861, 2405; Payload ID: 10157 relates to Category No.: 3303, 14234, 6905, 9271, 11920, 11861, 14240, 14374, 1356, 2405, 7268, 14609; Payload ID: 10158 relates to Category No.: 3303, 14234, 6905, 9271, 11861, 14240, 2405; Payload ID: 10159 relates to Category No.: 6905; Payload ID: 10160 relates to Category No.: 6905; Payload ID: 10161 relates to Category No.: 6905; Payload ID: 10162 relates to Category No.: 6905; Payload ID: 10163 relates to Category No.: 6905; Payload ID: 10164 relates to Category No.: 3303, 2405; Payload ID: 10165 relates to Category No.: 3303, 2405; Payload ID: 10166 relates to Category No.: 926, 6816, 1209, 11861, 1208, 6907; Payload ID: 10167 relates to Category No.: 6188, 926, 11861, 6907; Payload ID: 10168 relates to Category No.: 926, 1630, 4274, 6910, 6883, 6909, 6911; Payload ID: 10169 relates to Category No.: 926, 11939, 1630, 4274, 6910; Payload ID: 10170 relates to Category No.: 6478, 1630, 6883, 6909, 6910, 9809; Payload ID: 10171 relates to Category No.: 1630, 6883, 6909, 6910; Payload ID: 10172 relates to Category No.: 4207, 11886, 7184, 6912, 7510; Payload ID: 10173 relates to Category No.: 4886, 5308; Payload ID: 10174 relates to Category No.: 926, 2537; Payload ID: 10175 relates to Category No.: 11861, 2538; Payload ID: 10177 relates to Category No.: 6816, 11861, 6919; Payload ID: 10178 relates to Category No.: 6816, 1630, 5892, 5804, 2538, 7184, 6920; Payload ID: 10179 relates to Category No.: 14351, 6924, 14213, 10116; Payload ID: 10180 relates to Category No.: 5865, 9518, 1359; Payload ID: 10181 relates to Category No.: 1630, 11861, 15542, 15555, 14676, 9977; Payload ID: 10182 relates to Category No.: 5347, 14677; Payload ID: 10183 relates to Category No.: 11861, 15699, 15686; Payload ID: 10184 relates to Category No.: 6924; Payload ID: 10185 relates to Category No.: 6924, 9152; Payload ID: 10186 relates to Category No.: 6924; Payload ID: 10187 relates to Category No.: 6924, 11861; Payload ID: 10188 relates to Category No.: 14196, 6924, 7258, 11861; Payload ID: 10189 relates to Category No.: 6924, 11861, 14300; Payload ID: 10190 relates to Category No.: 6924, 10116, 71; Payload ID: 10191 relates to Category No.: 6924, 2672, 11861; Payload ID: 10192 relates to Category No.: 6924; Payload ID: 10193 relates to Category No.: 6924; Payload ID: 10194 relates to Category No.: 11861, 943, 5280, 12181; Payload ID: 10195 relates to Category No.: 6924; Payload ID: 10196 relates to Category No.: 11861, 12181; Payload ID: 10197 relates to Category No.: 6924; Payload ID: 10198 relates to Category No.: 6924; Payload ID: 10199 relates to Category No.: 6924; Payload ID: 10200 relates to Category No.: 6924; Payload ID: 10201 relates to Category No.: 15681; Payload ID: 10202 relates to Category No.: 15681; Payload ID: 10203 relates to Category No.: 7258, 14196, 6924, 14213; Payload ID: 10204 relates to Category No.: 9226, 6924; Payload ID: 10205 relates to Category No.: 9226, 6924; Payload ID: 10206 relates to Category No.: 6924; Payload ID: 10207 relates to Category No.: 14351, 6924; Payload ID: 10208 relates to Category No.: 14351, 6924; Payload ID: 10209 relates to Category No.: 6924, 5096; Payload ID: 10210 relates to Category No.: 11861; Payload ID: 10211 relates to Category No.: 926, 11939, 1537, 5280, 3281; Payload ID: 10212 relates to Category No.: 926, 6926, 5347; Payload ID: 10213 relates to Category No.: 16331, 9226, 14196, 10116, 11861; Payload ID: 10214 relates to Category No.: 1405, 16331, 9226, 14196, 10116, 11861, 4893; Payload ID: 10215 relates to Category No.: 16331, 9226, 14196, 6188, 10116, 11861; Payload ID: 10216 relates to Category No.: 16331, 9226, 14196, 10116, 11861, 992; Payload ID: 10217 relates to Category No.: 6816, 15542, 15553, 9323, 11861; Payload ID: 10218 relates to Category No.: 3303, 15503, 14471, 11917; Payload ID: 10219 relates to Category No.: 6816, 15542, 15554, 550; Payload ID: 10220 relates to Category No.: 15542, 15554, 550; Payload ID: 10221 relates to Category No.: 11861; Payload ID: 10222 relates to Category No.: 11861; Payload ID: 10223 relates to Category No.: 11861; Payload ID: 10224 relates to Category No.: 7125; Payload ID: 10225 relates to Category No.: 16331, 12359, 11861, 5347, 9818; Payload ID: 10226 relates to Category No.: 16331, 277, 11861, 4198, 12359, 322; Payload ID: 10227 relates to Category No.: 11861, 5347; Payload ID: 10228 relates to Category No.: 4023, 11861; Payload ID: 10229 relates to Category No.: 10116, 11861; Payload ID: 10230 relates to Category No.: 11861, 4196, 4178; Payload ID: 10231 relates to Category No.: 11861; Payload ID: 10232 relates to Category No.: 11861; Payload ID: 10233 relates to Category No.: 11861, 7192; Payload ID: 10234 relates to Category No.: 14234, 11917, 15530, 14255, 11861, 15528, 14233, 3303, 15503, 14471, 2405, 14237, 15503, 14239; Payload ID: 10235 relates to Category No.: 11861, 7192; Payload ID: 10236 relates to Category No.: 7192; Payload ID: 10237 relates to Category No.: 4617, 4619, 11861, 11939, 5347, 4608; Payload ID: 10238 relates to Category No.: 3749, 4617, 4619, 6160; Payload ID: 10239 relates to Category No.: 4617, 4619, 9747, 11861; Payload ID: 10240 relates to Category No.: 6229, 11861, 11933, 787, 9951, 6210; Payload ID: 10241 relates to Category No.: 11861, 5099, 5100, 5098; Payload ID: 10242 relates to Category No.: 16331, 267, 11861, 4075, 9518, 315, 16283, 7486, 680, 14537, 7223, 12359; Payload ID: 10243 relates to Category No.: 16331, 267, 11861, 4075, 9518, 315, 16283, 7486, 680, 7521; Payload ID: 10244 relates to Category No.: 16331, 267, 11861, 4075, 9518, 315, 16283, 7486, 680, 7521; Payload ID: 10245 relates to Category No.: 11978, 926, 6478, 12109, 11861; Payload ID: 10246 relates to Category No.: 11978, 926, 6478, 6965, 12109, 11861, 9805; Payload ID: 10247 relates to Category No.: 11978, 926, 6478, 12109, 11861; Payload ID: 10248 relates to Category No.: 11978, 926, 6478, 12109, 11861; Payload ID: 10249 relates to Category No.: 11978, 926, 5956, 12109, 12077; Payload ID: 10251 relates to Category No.: 11939, 6965, 11861; Payload ID: 10252 relates to Category No.: 11939, 6965, 10116, 11861; Payload ID: 10253 relates to Category No.: 1405, 942, 267, 6965, 11861, 277, 10116, 2936; Payload ID: 10254 relates to Category No.: 6965, 15895, 9939, 11861, 9834; Payload ID: 10255 relates to Category No.: 6965, 15895, 11861; Payload ID: 10257 relates to Category No.: 6965, 15895, 11861; Payload ID: 10258 relates to Category No.: 6965; Payload ID: 10259 relates to Category No.: 15029, 11861, 6965, 267, 2566; Payload ID: 10260 relates to Category No.: 6965, 15029, 11861; Payload ID: 10261 relates to Category No.: 6965, 3303, 277, 11861, 15766, 1173, 5347; Payload ID: 10262 relates to Category No.: 3516, 6965, 15029, 1457, 11861, 15766; Payload ID: 10263 relates to Category No.: 6965, 15766, 15029, 10116, 11861; Payload ID: 10264 relates to Category No.: 1457, 11861, 6965; Payload ID: 10265 relates to Category No.: 15029, 12402; Payload ID: 10267 relates to Category No.: 15021, 6965, 11861, 3752, 14537, 15766, 787, 6254, 11981, 11920, 11886, 12077; Payload ID: 10268 relates to Category No.: 6965, 11895, 10116, 11861, 6979; Payload ID: 10269 relates to Category No.: 6965, 11861; Payload ID: 10270 relates to Category No.: 6965, 11861; Payload ID: 10271 relates to Category No.: 11861, 11895; Payload ID: 10272 relates to Category No.: 926, 942, 15973, 11861; Payload ID: 10273 relates to Category No.: 4864, 5009; Payload ID: 10274 relates to Category No.: 16331, 11939, 11933, 6965, 15895, 6188, 11861, 5347, 9961; Payload ID: 10275 relates to Category No.: 16331, 11861, 11939, 11933, 6965, 6188, 9961; Payload ID: 10276 relates to Category No.: 11861, 5957; Payload ID: 10277 relates to Category No.: 14196, 11895, 11861, 1201; Payload ID: 10278 relates to Category No.: 11861; Payload ID: 10279 relates to Category No.: 11861; Payload ID: 10280 relates to Category No.: 11861, 5588, 9896, 9834; Payload ID: 10281 relates to Category No.: 16331, 6816, 15908, 6188, 11861; Payload ID: 10282 relates to Category No.: 16331, 14564, 6816, 15908, 267, 6188, 11861, 15893; Payload ID: 10283 relates to Category No.: 6816, 3459, 14597, 11861, 5347, 3361; Payload ID: 10284 relates to Category No.: 926, 3303, 4965, 11861; Payload ID: 10285 relates to Category No.: 926, 3303, 4965, 11861; Payload ID: 10286 relates to Category No.: 2405, 11861; Payload ID: 10287 relates to Category No.: 926, 3303, 6816, 11861, 3325, 5105, 3361; Payload ID: 10288 relates to Category No.: 926, 3303, 11861, 3325; Payload ID: 10289 relates to Category No.: 3303, 15542, 15548; Payload ID: 10290 relates to Category No.: 926, 3303, 953, 11861, 14597, 3325; Payload ID: 10291 relates to Category No.: 926, 3303, 2405, 11861, 3325, 3361; Payload ID: 10292 relates to Category No.: 926, 3303, 953, 11861, 5347, 14597, 3325; Payload ID: 10293 relates to Category No.: 926, 3303, 953, 11861, 14597, 3325; Payload ID: 10294 relates to Category No.: 926, 3303; Payload ID: 10296 relates to Category No.: 11861; Payload ID: 10297 relates to Category No.: 11861; Payload ID: 10298 relates to Category No.: 3303, 11861; Payload ID: 10299 relates to Category No.: 11861, 7192; Payload ID: 10300 relates to Category No.: 4895, 7192; Payload ID: 10301 relates to Category No.: 11978, 926, 12109, 11861; Payload ID: 10302 relates to Category No.: 11861; Payload ID: 10303 relates to Category No.: 11939, 9857, 11920, 11861; Payload ID: 10304 relates to Category No.: 1630, 12292, 7197, 7199, 9044; Payload ID: 10305 relates to Category No.: 1630, 12292, 7197, 7199, 9044; Payload ID: 10306 relates to Category No.: 14564, 11981, 11861, 1539; Payload ID: 10307 relates to Category No.: 11861, 14163; Payload ID: 10308 relates to Category No.: 1401, 11861, 15976, 5347; Payload ID: 10309 relates to Category No.: 11861; Payload ID: 10310 relates to Category No.: 1405, 11933, 11861, 5347; Payload ID: 10311 relates to Category No.: 1405, 11933, 11861; Payload ID: 10312 relates to Category No.: 1405; Payload ID: 10313 relates to Category No.: 11861; Payload ID: 10316 relates to Category No.: 16331, 14564, 15908, 15895, 15101, 6188, 11861, 5347; Payload ID: 10317 relates to Category No.: 11861, 5347, 456, 4422; Payload ID: 10318 relates to Category No.: 11861; Payload ID: 10319 relates to Category No.: 11939, 11861; Payload ID: 10322 relates to Category No.: 11861; Payload ID: 10323 relates to Category No.: 11861; Payload ID: 10324 relates to Category No.: 14599; Payload ID: 10325 relates to Category No.: 6816; Payload ID: 10326 relates to Category No.: 11861, 7192; Payload ID: 10327 relates to Category No.: 6816, 6825; Payload ID: 10328 relates to Category No.: 1630, 5317, 4284, 6894; Payload ID: 10329 relates to Category No.: 926, 6478, 11939, 10116, 11861, 10144, 5347, 6574, 16043; Payload ID: 10330 relates to Category No.: 7192, 12342; Payload ID: 10331 relates to Category No.: 12342; Payload ID: 10332 relates to Category No.: 14196, 15027, 10116, 11861; Payload ID: 10333 relates to Category No.: 15027, 10116, 11861; Payload ID: 10334 relates to Category No.: 15027, 14309, 10116, 11861; Payload ID: 10335 relates to Category No.: 14196, 15027, 11861; Payload ID: 10336 relates to Category No.: 15027, 10116, 7268, 11861; Payload ID: 10337 relates to Category No.: 15027, 10116; Payload ID: 10338 relates to Category No.: 15027, 10116, 11861; Payload ID: 10339 relates to Category No.: 15027, 14309; Payload ID: 10340 relates to Category No.: 15027, 11920; Payload ID: 10341 relates to Category No.: 15027, 168; Payload ID: 10342 relates to Category No.: 15027; Payload ID: 10343 relates to Category No.: 15027, 15542, 10116, 14196; Payload ID: 10344 relates to Category No.: 15027, 14309, 10116, 11861; Payload ID: 10345 relates to Category No.: 14196, 15027, 10116; Payload ID: 10346 relates to Category No.: 15027, 10116; Payload ID: 10347 relates to Category No.: 9282, 14196, 15027, 11861; Payload ID: 10348 relates to Category No.: 15027; Payload ID: 10349 relates to Category No.: 15027, 10116, 11861; Payload ID: 10350 relates to Category No.: 15027, 10116, 11861; Payload ID: 10351 relates to Category No.: 14196, 15027, 10116; Payload ID: 10353 relates to Category No.: 15027, 10116; Payload ID: 10354 relates to Category No.: 15027; Payload ID: 10355 relates to Category No.: 15027; Payload ID: 10356 relates to Category No.: 15027; Payload ID: 10357 relates to Category No.: 15027; Payload ID: 10358 relates to Category No.: 15027, 10116; Payload ID: 10360 relates to Category No.: 9282, 10116; Payload ID: 10361 relates to Category No.: 15027, 10116, 11861; Payload ID: 10362 relates to Category No.: 10116, 11861; Payload ID: 10363 relates to Category No.: 15027, 10116, 11861; Payload ID: 10364 relates to Category No.: 15027, 10116; Payload ID: 10365 relates to Category No.: 15027, 10116, 11861; Payload ID: 10366 relates to Category No.: 14196, 10116, 11861, 14137; Payload ID: 10367 relates to Category No.: 10116, 11861; Payload ID: 10368 relates to Category No.: 15027, 5308, 7192; Payload ID: 10369 relates to Category No.: 15027, 7192; Payload ID: 10370 relates to Category No.: 11861; Payload ID: 10371 relates to Category No.: 15027, 11861; Payload ID: 10373 relates to Category No.: 15027, 11861; Payload ID: 10374 relates to Category No.: 15027; Payload ID: 10375 relates to Category No.: 11861; Payload ID: 10376 relates to Category No.: 10116; Payload ID: 10377 relates to Category No.: 15027; Payload ID: 10378 relates to Category No.: 15027; Payload ID: 10379 relates to Category No.: 15027, 10116, 11861; Payload ID: 10380 relates to Category No.: 7192; Payload ID: 10381 relates to Category No.: 15027, 10116, 14669, 7267; Payload ID: 10382 relates to Category No.: 15027, 10116, 11861; Payload ID: 10383 relates to Category No.: 15027, 10116, 11861; Payload ID: 10384 relates to Category No.: 15027, 10116; Payload ID: 10385 relates to Category No.: 15027, 11861; Payload ID: 10386 relates to Category No.: 15027, 14309; Payload ID: 10387 relates to Category No.: 15027; Payload ID: 10388 relates to Category No.: 15027; Payload ID: 10389 relates to Category No.: 15027; Payload ID: 10390 relates to Category No.: 15027; Payload ID: 10391 relates to Category No.: 15027; Payload ID: 10392 relates to Category No.: 15027; Payload ID: 10393 relates to Category No.: 15027, 10116, 11861; Payload ID: 10394 relates to Category No.: 15027, 10116; Payload ID: 10395 relates to Category No.: 15027; Payload ID: 10396 relates to Category No.: 10116; Payload ID: 10397 relates to Category No.: 11861; Payload ID: 10398 relates to Category No.: 10116; Payload ID: 10399 relates to Category No.: 15027, 10116; Payload ID: 10400 relates to Category No.: 15027, 11920, 10116, 11861; Payload ID: 10401 relates to Category No.: 15027; Payload ID: 10403 relates to Category No.: 15027, 10116; Payload ID: 10404 relates to Category No.: 15027, 9520; Payload ID: 10405 relates to Category No.: 14196, 15027, 10116; Payload ID: 10406 relates to Category No.: 15027, 14309, 11861, 14669; Payload ID: 10407 relates to Category No.: 15027, 14309, 10116, 7268; Payload ID: 10408 relates to Category No.: 15027, 10116, 11861; Payload ID: 10409 relates to Category No.: 14163; Payload ID: 10410 relates to Category No.: 4886, 4895; Payload ID: 10411 relates to Category No.: 4886, 6478, 4895; Payload ID: 10412 relates to Category No.: 14196, 6924, 14213, 10116, 11861, 14303; Payload ID: 10413 relates to Category No.: 16331, 9518, 15488; Payload ID: 10414 relates to Category No.: 3459, 10116, 11861; Payload ID: 10415 relates to Category No.: 9226, 3459, 15524, 11939; Payload ID: 10416 relates to Category No.: 3459, 15524, 11861; Payload ID: 10417 relates to Category No.: 14309, 3459, 11861, 1201; Payload ID: 10418 relates to Category No.: 4886, 4895, 15592, 10116, 15591, 14196, 14170; Payload ID: 10419 relates to Category No.: 15592, 11861, 15591, 14196, 14170; Payload ID: 10420 relates to Category No.: 14176, 15596, 2551, 15596; Payload ID: 10421 relates to Category No.: 15596, 2551, 15596, 14176; Payload ID: 10422 relates to Category No.: 4207, 10116; Payload ID: 10423 relates to Category No.: 942, 15619, 5298; Payload ID: 10424 relates to Category No.: 942, 15619, 5298; Payload ID: 10425 relates to Category No.: 6816, 3554, 9518, 15881, 11886; Payload ID: 10426 relates to Category No.: 5865, 4976, 3554, 11861, 2873; Payload ID: 10427 relates to Category No.: 9518, 2672, 11861, 2873; Payload ID: 10428 relates to Category No.: 11861, 2873, 4987; Payload ID: 10429 relates to Category No.: 7502, 11861; Payload ID: 10430 relates to Category No.: 7502, 11981, 5850; Payload ID: 10431 relates to Category No.: 7502, 11861; Payload ID: 10432 relates to Category No.: 7502; Payload ID: 10433 relates to Category No.: 7502, 9518, 314; Payload ID: 10434 relates to Category No.: 7502; Payload ID: 10435 relates to Category No.: 7502; Payload ID: 10436 relates to Category No.: 11861; Payload ID: 10437 relates to Category No.: 4886, 4895, 11861; Payload ID: 10438 relates to Category No.: 4886, 4895, 15895, 11861; Payload ID: 10439 relates to Category No.: 11978, 926, 3303, 12109, 11861, 9805, 6600, 14231, 5956, 9990, 11981, 15504, 7127; Payload ID: 10440 relates to Category No.: 11861; Payload ID: 10441 relates to Category No.: 11978, 926, 6601, 11861, 6600, 5913; Payload ID: 10442 relates to Category No.: 11978, 926, 12109, 11861, 6600; Payload ID: 10443 relates to Category No.: 11978, 926, 6600, 6478, 12109, 11861; Payload ID: 10444 relates to Category No.: 11978, 926, 12109, 11861, 6600; Payload ID: 10445 relates to Category No.: 11978, 926, 12109, 6601, 11861, 6600, 3752, 12081, 9012, 5956, 11895; Payload ID: 10446 relates to Category No.: 11978, 926, 11861, 6600, 14537; Payload ID: 10447 relates to Category No.: 11978, 926, 11861, 9805, 6600, 9990, 14377; Payload ID: 10448 relates to Category No.: 11978, 926, 11939, 12109, 11981, 11861, 6600, 11933; Payload ID: 10449 relates to Category No.: 11978, 926, 12109, 11861, 6600, 11981, 11933; Payload ID: 10450 relates to Category No.: 11978, 926, 11861, 6600, 7125, 12109; Payload ID: 10451 relates to Category No.: 11978, 926, 6600, 12109, 5109, 11861, 3752, 5913, 5112, 5956; Payload ID: 10452 relates to Category No.: 6610, 5960, 11861, 11991, 11981, 7127, 5347, 7126, 5914; Payload ID: 10453 relates to Category No.: 15029, 11981, 6610, 5960, 11861, 1146, 11977, 11886; Payload ID: 10454 relates to Category No.: 12416, 6610, 5914, 5960, 11861, 7126, 7127; Payload ID: 10455 relates to Category No.: 11978, 926, 15504, 11861, 6600, 5913, 7127, 2853, 5956; Payload ID: 10456 relates to Category No.: 11981, 11861, 9880, 9887, 9874, 9877, 12388, 9818; Payload ID: 10457 relates to Category No.: 11861; Payload ID: 10458 relates to Category No.: 11978, 926, 11895, 12109, 6601, 12145, 11861, 12114, 12064, 12108, 12423; Payload ID: 10459 relates to Category No.: 11978, 926, 12109, 6601, 12145, 11861, 12114, 9608, 14377, 12108, 11890; Payload ID: 10460 relates to Category No.: 12109, 11978, 926, 11981, 12145, 11861, 6601; Payload ID: 10461 relates to Category No.: 11978, 926, 12109, 12145, 11861, 5915; Payload ID: 10462 relates to Category No.: 11978, 926, 6816, 12109, 6601, 12145, 11861; Payload ID: 10463 relates to Category No.: 11978, 926, 12109, 11981, 12145, 11861, 6601; Payload ID: 10464 relates to Category No.: 11978, 926, 6478, 12109, 6601, 11981, 12145, 11861, 3752, 5915, 12081, 11895, 7127; Payload ID: 10465 relates to Category No.: 11978, 926, 16331, 6602, 11981, 11861, 1201, 2936, 5916; Payload ID: 10466 relates to Category No.: 11978, 926, 11939, 1178, 12109, 6602, 15495, 11861, 5916, 12145; Payload ID: 10467 relates to Category No.: 11978, 926, 11939, 12109, 6602, 12145, 11861, 5347, 7127, 5916, 12363, 7126; Payload ID: 10468 relates to Category No.: 11978, 926, 11939, 12109, 6602, 11981, 11861; Payload ID: 10469 relates to Category No.: 11978, 926, 6816, 11939, 12109, 6602, 11981, 11861, 5347; Payload ID: 10470 relates to Category No.: 11978, 926, 12109, 6602, 6601, 11861, 9016; Payload ID: 10471 relates to Category No.: 11978, 926, 6816, 6602; Payload ID: 10472 relates to Category No.: 11978, 926, 6602; Payload ID: 10473 relates to Category No.: 11978, 926, 6816, 12109, 6602, 6601, 11981, 11861; Payload ID: 10474 relates to Category No.: 11978, 926, 6816, 6602, 6601, 11861; Payload ID: 10475 relates to Category No.: 11978, 926, 6816, 6602, 6601, 11861; Payload ID: 10476 relates to Category No.: 11978, 926, 6478, 11939, 6602, 11861, 12081, 11981; Payload ID: 10477 relates to Category No.: 11978, 926, 6478, 6602; Payload ID: 10478 relates to Category No.: 11978, 926, 6478, 12109, 6602, 11861, 14377, 6601; Payload ID: 10479 relates to Category No.: 11978, 926, 6478, 12109, 6602, 11861; Payload ID: 10480 relates to Category No.: 11978, 926, 11939, 12109, 6602, 6601, 12145, 11861, 5916; Payload ID: 10481 relates to Category No.: 11978, 926, 12109, 6603, 11861; Payload ID: 10482 relates to Category No.: 11978, 926, 12109, 6603, 11861, 7127; Payload ID: 10483 relates to Category No.: 11978, 926, 12109, 6603, 11861; Payload ID: 10484 relates to Category No.: 11978, 926, 12109, 11861, 2760; Payload ID: 10485 relates to Category No.: 11978, 926, 6603; Payload ID: 10486 relates to Category No.: 11978, 926, 11861, 11939, 6602, 12145; Payload ID: 10487 relates to Category No.: 11978, 926, 6478, 12109, 6602, 10116, 11861; Payload ID: 10488 relates to Category No.: 11978, 926, 14564, 12109, 1457, 1459, 11861, 1443, 7125; Payload ID: 10489 relates to Category No.: 11978, 926, 14564, 12109, 6601, 1457, 1459, 11861, 1443, 7125; Payload ID: 10490 relates to Category No.: 11978, 926, 14564, 9539, 12109, 6601, 1457, 1459, 11861, 1443, 7125; Payload ID: 10491 relates to Category No.: 11861; Payload ID: 10493 relates to Category No.: 11861; Payload ID: 10494 relates to Category No.: 267; Payload ID: 10495 relates to Category No.: 3303, 14234, 11939, 2690, 15528, 14233, 14252, 14240, 14244, 15528, 14252, 15528, 14239, 14471; Payload ID: 10496 relates to Category No.: 926, 12109, 11861, 11886, 11978, 11981; Payload ID: 10497 relates to Category No.: 15491, 11861, 14246, 15503, 14471, 267, 12082; Payload ID: 10499 relates to Category No.: 3303, 15503, 14471, 11917, 11861; Payload ID: 10500 relates to Category No.: 3303, 15503, 14471, 11933, 15504, 1515, 11917, 15530, 14233, 11861, 14234; Payload ID: 10501 relates to Category No.: 3303, 15503, 14471, 11939, 11933, 15504, 11917, 14243, 15530, 14255, 11861; Payload ID: 10503 relates to Category No.: 1201, 12416, 11861, 1327, 15491, 11861, 3936; Payload ID: 10504 relates to Category No.: 11861, 1201; Payload ID: 10505 relates to Category No.: 16331, 3385, 11861, 12064, 14231; Payload ID: 10506 relates to Category No.: 6816, 11861, 5957; Payload ID: 10507 relates to Category No.: 6816, 11861; Payload ID: 10508 relates to Category No.: 6816, 11861, 5957, 5955; Payload ID: 10509 relates to Category No.: 6816; Payload ID: 10510 relates to Category No.: 6816; Payload ID: 10511 relates to Category No.: 6816, 11861; Payload ID: 10512 relates to Category No.: 6816, 11861; Payload ID: 10513 relates to Category No.: 15895, 11861; Payload ID: 10514 relates to Category No.: 2936, 267, 15021, 12402, 11981, 3464, 11861, 1706; Payload ID: 10515 relates to Category No.: 3303, 14471, 14251, 14471, 11861, 14252; Payload ID: 10516 relates to Category No.: 11978, 926, 12109, 2832; Payload ID: 10517 relates to Category No.: 6401, 15542, 1630, 12292, 11861, 7197, 7208; Payload ID: 10518 relates to Category No.: 6816, 4886, 5875, 1630, 138, 2817; Payload ID: 10519 relates to Category No.: 9282, 7203; Payload ID: 10520 relates to Category No.: 926, 6816, 9304, 11861, 15364, 14666, 15094, 16021, 7206, 7205; Payload ID: 10522 relates to Category No.: 11861; Payload ID: 10523 relates to Category No.: 820, 11861, 1201; Payload ID: 10524 relates to Category No.: 15542, 15549, 76, 3221; Payload ID: 10525 relates to Category No.: 15542, 15549, 76, 246; Payload ID: 10526 relates to Category No.: 15542, 15549, 3221, 76; Payload ID: 10527 relates to Category No.: 9518, 11727, 11861, 4207, 14507; Payload ID: 10528 relates to Category No.: 3554, 9518, 11727, 11939, 4207; Payload ID: 10529 relates to Category No.: 11978, 12399; Payload ID: 10530 relates to Category No.: 11978; Payload ID: 10531 relates to Category No.: 11939, 6434, 396; Payload ID: 10532 relates to Category No.: 7223, 1630, 2672, 11861, 9518, 315, 16283, 12443, 680; Payload ID: 10533 relates to Category No.: 16331; Payload ID: 10534 relates to Category No.: 16331; Payload ID: 10535 relates to Category No.: 16331; Payload ID: 10536 relates to Category No.: 16331, 11861; Payload ID: 10537 relates to Category No.: 11861; Payload ID: 10538 relates to Category No.: 11861, 5347; Payload ID: 10540 relates to Category No.: 11861; Payload ID: 10541 relates to Category No.: 11861; Payload ID: 10542 relates to Category No.: 11861; Payload ID: 10544 relates to Category No.: 11861, 12064, 2405; Payload ID: 10545 relates to Category No.: 11861; Payload ID: 10549 relates to Category No.: 5259, 12402; Payload ID: 10550 relates to Category No.: 4820, 4875; Payload ID: 10551 relates to Category No.: 3303, 15503, 14471, 14471; Payload ID: 10552 relates to Category No.: 926, 4965, 10116, 11861; Payload ID: 10553 relates to Category No.: 926, 14196, 6478, 961; Payload ID:

10554 relates to Category No.: 10116, 11861; Payload ID: 10555 relates to Category No.: 14196, 11861; Payload ID: 10556 relates to Category No.: 6900, 11861; Payload ID: 10558 relates to Category No.: 11861; Payload ID: 10559 relates to Category No.: 2881, 15617, 11861, 15380; Payload ID: 10560 relates to Category No.: 9619, 11861; Payload ID: 10561 relates to Category No.: 7192; Payload ID: 10562 relates to Category No.: 12402, 7192; Payload ID: 10564 relates to Category No.: 3303, 5308, 11895, 3459, 94, 3655, 953, 9225, 3640, 11861, 3993, 6574, 14598; Payload ID: 10565 relates to Category No.: 11861; Payload ID: 10566 relates to Category No.: 1201; Payload ID: 10567 relates to Category No.: 6481; Payload ID: 10568 relates to Category No.: 10116; Payload ID: 10569 relates to Category No.: 11861; Payload ID: 10570 relates to Category No.: 3303, 14471, 9539, 14243, 11861, 15528, 14255, 15530, 14255, 15503, 14233; Payload ID: 10571 relates to Category No.: 3303, 14471, 15524, 11861, 15493, 14243, 15504, 15530, 14255, 15503, 15504, 14234, 15503, 14233; Payload ID: 10572 relates to Category No.: 926, 7020; Payload ID: 10573 relates to Category No.: 6816; Payload ID: 10574 relates to Category No.: 11861; Payload ID: 10586 relates to Category No.: 14234, 9539, 11861, 15493; Payload ID: 10587 relates to Category No.: 7192; Payload ID: 10588 relates to Category No.: 11939, 11861; Payload ID: 10591 relates to Category No.: 11861, 9608, 4017, 6369; Payload ID: 10592 relates to Category No.: 11861; Payload ID: 10593 relates to Category No.: 11861; Payload ID: 10596 relates to Category No.: 11861, 4023, 4017, 6369; Payload ID: 10597 relates to Category No.: 11861; Payload ID: 10598 relates to Category No.: 4023, 11861; Payload ID: 10599 relates to Category No.: 11861; Payload ID: 10600 relates to Category No.: 4023; Payload ID: 10601 relates to Category No.: 11861; Payload ID: 10603 relates to Category No.: 1647, 7431; Payload ID: 10606 relates to Category No.: 11861, 5589; Payload ID: 10607 relates to Category No.: 15491, 11861, 5347; Payload ID: 10608 relates to Category No.: 1405, 11861; Payload ID: 10609 relates to Category No.: 11861; Payload ID: 10610 relates to Category No.: 1405, 11861; Payload ID: 10611 relates to Category No.: 11861, 1405; Payload ID: 10612 relates to Category No.: 1405; Payload ID: 10613 relates to Category No.: 11861; Payload ID: 10614 relates to Category No.: 11861; Payload ID: 10615 relates to Category No.: 1405, 11861; Payload ID: 10616 relates to Category No.: 1405, 11861; Payload ID: 10617 relates to Category No.: 11861; Payload ID: 10618 relates to Category No.: 2405, 3459, 15524, 11861, 1327, 5229, 16325, 11861, 12064, 4288, 14324; Payload ID: 10619 relates to Category No.: 248, 9804, 9919, 1224, 5485; Payload ID: 10620 relates to Category No.: 11895, 11861; Payload ID: 10621 relates to Category No.: 6210, 11861, 15887, 14537; Payload ID: 10622 relates to Category No.: 6210, 11861; Payload ID: 10623 relates to Category No.: 11861; Payload ID: 10624 relates to Category No.: 3303, 9225, 6816, 11861, 104; Payload ID: 10625 relates to Category No.: 9282, 9226, 14196, 10116, 10122, 14602; Payload ID: 10626 relates to Category No.: 9282, 9226, 10116, 11861, 10122, 14602; Payload ID: 10627 relates to Category No.: 4886, 4895, 11861, 4899; Payload ID: 10628 relates to Category No.: 11978, 926, 6816, 15612, 12145, 11861; Payload ID: 10629 relates to Category No.: 6816, 14196, 3464, 10116, 11861, 13684; Payload ID: 10630 relates to Category No.: 6816, 10116; Payload ID: 10631 relates to Category No.: 6816, 10116, 11861; Payload ID: 10633 relates to Category No.: 15530, 14252; Payload ID: 10634 relates to Category No.: 15503, 14471, 11917, 15495, 14240, 15530, 14239; Payload ID: 10636 relates to Category No.: 11861; Payload ID: 10637 relates to Category No.: 12399, 11861, 1405; Payload ID: 10638 relates to Category No.: 926, 7020, 942, 14597, 11861, 7358, 15031; Payload ID: 10639 relates to Category No.: 926, 7020, 942, 14597, 11861, 14374, 2405, 2191; Payload ID: 10640 relates to Category No.: 926, 3303, 7020, 6478, 942, 11939, 11895, 3459, 14597, 3385, 11981, 16325, 5036, 3456, 11861, 3752, 456, 4288, 9512, 3271, 7356, 14587, 3272, 4909, 14592, 2963, 2191; Payload ID: 10641 relates to Category No.: 926, 7020, 14597, 3385, 16325, 5036, 3456, 11861, 3752, 9512, 3271, 14587, 3272, 3303, 2963, 2191; Payload ID: 10642 relates to Category No.: 926, 3303, 7020, 3385, 11861; Payload ID: 10643 relates to Category No.: 7020, 3385, 926, 11861; Payload ID: 10643 relates to Category No.: 7020, 3385, 926, 11861; Payload ID: 10644 relates to Category No.: 3385, 926, 7020, 6478, 942, 3459, 6900, 11861, 456, 4288, 9512, 7356, 14587, 4909, 14592, 3303, 2405, 2963; Payload ID: 10645 relates to Category No.: 5308, 6816, 1630, 138, 5308, 313, 11861, 7358, 3343; Payload ID: 10646 relates to Category No.: 4886, 4895, 11861; Payload ID: 10647 relates to Category No.: 4886, 4895, 11861; Payload ID: 10648 relates to Category No.: 3303, 3390, 1201, 15504, 15495, 10116, 11861, 2688, 14471; Payload ID: 10651 relates to Category No.: 5347; Payload ID: 10652 relates to Category No.: 3303; Payload ID: 10653 relates to Category No.: 3303, 6816, 15911, 5105, 6829, 15491, 11861, 11886; Payload ID: 10654 relates to Category No.: 15530, 14233, 3303, 15503, 14471, 11939, 14234; Payload ID: 10655 relates to Category No.: 15503, 14471, 11917, 15491, 11861, 15493, 3303, 14234, 15503, 14235, 11939, 11933, 14471, 11886; Payload ID: 10656 relates to Category No.: 15491, 11861; Payload ID: 10657 relates to Category No.: 16331, 6188, 11861, 11939; Payload ID: 10658 relates to Category No.: 6816, 3274, 15530, 14252; Payload ID: 10660 relates to Category No.: 6816, 10116, 11861, 14237, 14251, 14471, 3303, 2405, 9226; Payload ID: 10661 relates to Category No.: 11861; Payload ID: 10662 relates to Category No.: 11861; Payload ID: 10663 relates to Category No.: 11861, 1504, 11981, 12402; Payload ID: 10664 relates to Category No.: 11861, 15025, 11828; Payload ID: 10665 relates to Category No.: 9282, 9226, 3303, 10116, 11861; Payload ID: 10666 relates to Category No.: 11861, 16206; Payload ID: 10667 relates to Category No.: 15029, 11861; Payload ID: 10668 relates to Category No.: 15029, 11861; Payload ID: 10669 relates to Category No.: 11861; Payload ID: 10670 relates to Category No.: 11861; Payload ID: 10671 relates to Category No.: 3303, 15503, 14471, 9619; Payload ID: 10672 relates to Category No.: 3303, 15503, 14471; Payload ID: 10673 relates to Category No.: 16331, 15503, 14471; Payload ID: 10674 relates to Category No.: 3303, 16331, 15503, 14471, 11861; Payload ID: 10675 relates to Category No.: 11861, 15025; Payload ID: 10677 relates to Category No.: 11939, 11933, 11861, 11880, 1176; Payload ID: 10678 relates to Category No.: 3303, 11861; Payload ID: 10679 relates to Category No.: 15422, 11861, 5347, 3007, 12402, 5621, 15440; Payload ID: 10680 relates to Category No.: 3303, 11920, 11861; Payload ID: 10681 relates to Category No.: 11861; Payload ID: 10682 relates to Category No.: 6816, 15503, 14471, 14234, 11939, 15524, 11861, 15530, 14233, 15528, 14233; Payload ID: 10683 relates to Category No.: 3303, 11861; Payload ID: 10684 relates to Category No.: 3303, 16331, 15503, 14471, 11861; Payload ID: 10685 relates to Category No.: 7192; Payload ID: 10686 relates to Category No.: 11861; Payload ID: 10687 relates to Category No.: 11861, 11895, 12388, 1706; Payload ID: 10688 relates to Category No.: 16331, 11861; Payload ID: 10689 relates to Category No.: 7192; Payload ID: 10691 relates to Category No.: 11861; Payload ID: 10694 relates to Category No.: 6816, 2405, 4976, 5009, 9747; Payload ID: 10695 relates to Category No.: 926, 7249, 11861; Payload ID: 10696 relates to Category No.: 11861; Payload ID: 10697 relates to Category No.: 15491, 15504, 11861, 2691, 15528, 14233, 14246, 15528, 14255, 15503, 14252, 5109, 5101, 14324; Payload ID: 10698 relates to Category No.: 6816, 4291, 11861, 4196, 7405, 12425; Payload ID: 10699 relates to Category No.: 3303, 11917, 15503, 14471, 14234, 11933, 2405, 14471, 14251, 14471, 5109, 14652, 14243, 11861, 15528, 14233, 14252, 14246, 327, 5101, 11981, 15503, 14239; Payload ID: 10700 relates to Category No.: 3303, 11917, 15503, 14471, 14234, 5109, 15528, 14233; Payload ID: 10701 relates to Category No.: 3303, 15503, 14471, 11933, 11917, 15524, 14251, 14471, 14243, 11861, 15528, 14233, 327, 15503, 14235, 916, 7010, 14240, 14471, 2405, 14234, 15528, 14239, 5109, 15503, 14239, 2690, 2691, 5235; Payload ID: 10702 relates to Category No.: 3303, 15503, 14471, 11917, 14251, 14471, 5109, 14243, 11861, 327, 15528, 14233, 11939, 11933, 14234, 3752; Payload ID: 10703 relates to Category No.: 11861, 15504; Payload ID: 10704 relates to Category No.: 15504, 11861, 2823, 15229; Payload ID: 10705 relates to Category No.: 11861, 9939; Payload ID: 10706 relates to Category No.: 3303, 14234, 11933, 11917, 15491, 14243, 11861, 2688, 9173, 15503, 14239, 3530, 2406, 15528, 14255, 15503, 14471, 15504, 14471, 2405, 15895, 3752; Payload ID: 10707 relates to Category No.: 3303, 14234, 11933, 11917, 11861, 15503, 14239, 3530, 15528, 14255, 14471; Payload ID: 10708 relates to Category No.: 3303, 15503, 14471, 14234, 11933, 11917, 15503, 14239, 3530, 15528, 14255; Payload ID: 10709 relates to Category No.: 3303, 15503, 14471, 14234, 11933, 14471, 11917, 14243, 11861, 2688, 15503, 14239, 3530, 2406, 15528, 14255, 15528, 14233, 2690; Payload ID: 10710 relates to Category No.: 6816, 4976, 9524, 9529; Payload ID: 10711 relates to Category No.: 5865, 4151, 5496, 520, 9518, 317, 9518, 314; Payload ID: 10712 relates to Category No.: 11939, 11861, 5347, 15024; Payload ID: 10713 relates to Category No.: 11861, 15024; Payload ID: 10714 relates to Category No.: 11939, 11861; Payload ID: 10715 relates to Category No.: 3303, 16331, 6816, 15503, 14471, 11861, 9226; Payload ID: 10716 relates to Category No.: 267, 11861, 2936, 14537, 7328; Payload ID: 10717 relates to Category No.: 3753; Payload ID: 10718 relates to Category No.: 6816, 267, 15429, 11861, 7393, 5347, 941, 15024, 7398; Payload ID: 10719 relates to Category No.: 267, 11861, 15024; Payload ID: 10720 relates to Category No.: 11861, 267, 15429, 15024; Payload ID: 10721 relates to Category No.: 11861, 15024; Payload ID: 10722 relates to Category No.: 11861, 7192; Payload ID: 10723 relates to Category No.: 926, 7249, 1457, 11861, 277; Payload ID: 10724 relates to Category No.: 926, 7249, 277, 1457, 11861, 9887, 9874, 6950, 267, 302; Payload ID: 10725 relates to Category No.: 926, 7249, 267, 12402, 1457, 11861, 12379, 11895, 302; Payload ID: 10726 relates to Category No.: 926, 7249, 277, 1457, 11920, 11861, 302, 1439, 6950; Payload ID: 10727 relates to Category No.: 926, 7249, 9857, 277, 1457, 11861, 942, 2744, 6950; Payload ID: 10728 relates to Category No.: 926, 7249, 267, 1457, 11861; Payload ID: 10729 relates to Category No.: 926, 7249, 267, 1457, 9887, 9874, 9877; Payload ID: 10730 relates to Category No.: 926, 7249, 11861, 267; Payload ID: 10731 relates to Category No.: 11978, 926, 7249, 1457, 11861, 456, 6950, 302, 10098, 12109, 277; Payload ID: 10732 relates to Category No.: 11978, 926, 7249, 267, 11861, 12109, 6950; Payload ID: 10733 relates to Category No.: 926, 6816, 7249, 267, 4894, 11861; Payload ID: 10734 relates to Category No.: 926, 6816, 942, 7249, 267, 4894, 1457, 11861, 456, 6950, 16331, 277, 302, 960; Payload ID: 10735 relates to Category No.: 11978, 926, 6816, 267, 1457, 1459, 11861, 7406; Payload ID: 10736 relates to Category No.: 11978, 926, 1457, 1459, 11861, 7406; Payload ID: 10737 relates to Category No.: 11978, 926, 1459, 7406; Payload ID: 10738 relates to Category No.: 11978, 926, 12109; Payload ID: 10739 relates to Category No.: 1405, 15024; Payload ID: 10740 relates to Category No.: 267, 11861; Payload ID: 10741 relates to Category No.: 16331, 15908, 15893, 6188, 11861, 2936; Payload ID: 10742 relates to Category No.: 926, 7249, 12359, 10116, 11861, 6950, 1405, 1457, 267, 277; Payload ID: 10743 relates to Category No.: 926, 7249, 267, 1457, 12359, 11861, 6950; Payload ID: 10744 relates to Category No.: 926, 7249, 267, 1457, 11861; Payload ID: 10745 relates to Category No.: 926, 7249, 267, 277, 1457, 11861, 456, 7007; Payload ID: 10746 relates to Category No.: 926, 7249, 277, 1457, 11861, 14812, 6950, 11920, 11939, 267, 11886, 12064, 302, 456; Payload ID: 10747 relates to Category No.: 16331, 12359, 11861, 267, 11973; Payload ID: 10748 relates to Category No.: 926, 7249, 267, 11861; Payload ID: 10749 relates to Category No.: 926, 7249, 277, 1457, 11861, 9874, 14812, 302, 10098; Payload ID: 10750 relates to Category No.: 926, 7249, 267, 11861; Payload ID: 10751 relates to Category No.: 926, 7249, 267, 1457, 11861; Payload ID: 10752 relates to Category No.: 926, 7249, 11861; Payload ID: 10753 relates to Category No.: 926, 7249, 277, 11861, 267, 11886, 12081; Payload ID: 10754 relates to Category No.: 926, 3303, 7249, 3385, 277, 10116, 11861, 456; Payload ID: 10755 relates to Category No.: 926, 7249, 11861, 267; Payload ID: 10756 relates to Category No.: 926, 7249, 267, 1457, 11861; Payload ID: 10757 relates to Category No.: 926, 7249, 267, 277, 1457, 11861, 456, 6950, 302; Payload ID: 10758 relates to Category No.: 926, 7249, 277, 1457, 11861, 15024; Payload ID: 10759 relates to Category No.: 926, 7249, 267, 1457, 11861, 6950; Payload ID: 10760 relates to Category No.: 926, 7249, 277, 1457, 11861, 302, 267, 6950; Payload ID: 10761 relates to Category No.: 926, 7249, 267, 1457; Payload ID: 10762 relates to Category No.: 926, 7249, 267, 1457, 11861, 6950; Payload ID: 10763 relates to Category No.: 926, 7249, 277, 1457, 11861, 942, 2744, 6950; Payload ID: 10764 relates to Category No.: 926, 942, 7249, 267, 1457, 3464, 11861, 6950; Payload ID: 10765 relates to Category No.: 926, 942, 7249, 267, 11981, 1457, 11861, 6950, 302; Payload ID: 10766 relates to Category No.: 926, 942, 7249, 267, 1457, 11861, 6950, 302, 11939, 11933; Payload ID: 10767 relates to Category No.: 926, 7249, 267, 11861; Payload ID: 10768 relates to Category No.: 926, 942, 7249, 277, 1457, 11861, 15024, 6950, 7405; Payload ID: 10769 relates to Category No.: 926, 942, 7249, 267, 11939, 277, 1457, 11920, 10116, 11861, 456, 11854, 6950, 302; Payload ID: 10770 relates to Category No.: 1405, 15024; Payload ID: 10771 relates to Category No.: 1405, 11861; Payload ID: 10772 relates to Category No.: 1405, 11861, 4578; Payload ID: 10773 relates to Category No.: 1405, 11861, 7398; Payload ID: 10774 relates to Category No.: 1405, 295, 11861, 15024, 7398; Payload ID: 10775 relates to Category No.: 1405, 295, 15024, 7404, 7249; Payload ID: 10776 relates to Category No.: 1405, 277, 295, 7404; Payload ID: 10777 relates to Category No.: 1405, 15024; Payload ID: 10778 relates to Category No.: 1405, 7249, 11861, 15024, 302; Payload ID: 10779 relates to Category No.: 1405, 7249, 11861, 15024; Payload ID: 10780 relates to Category No.: 1405, 11861; Payload ID: 10781 relates to Category No.: 1405, 15024, 7398; Payload ID: 10782 relates to Category No.: 4864, 12402, 5009, 2874, 15567, 11861, 5347; Payload ID: 10783 relates to Category No.: 11861, 267, 15024, 566; Payload ID: 10784 relates to Category No.: 11861, 14471; Payload ID: 10785 relates to Category No.: 12150, 9857, 9804, 9962, 11861, 5728, 9881, 9878; Payload ID: 10786 relates to Category No.: 9881, 9878, 12150, 9804; Payload ID: 10789 relates to Category No.: 9807, 11861; Payload ID: 10790 relates to Category No.: 12150, 9804, 11861, 9881; Payload ID: 10791 relates to Category No.: 12150, 12151, 9804, 11861, 9881, 9878, 11939, 9867; Payload ID: 10792 relates to Category No.: 6816, 12150, 9804, 12111, 9881, 9878; Payload ID: 10793 relates to Category No.: 6816, 12150, 9804, 12111, 11861; Payload ID: 10794 relates to Category No.: 12150, 1430, 9804, 12111, 11861, 9867; Payload ID: 10795 relates to Category No.: 12150, 9804, 11861, 9867; Payload ID: 10796 relates to Category No.: 12150, 9804, 9881, 9878; Payload ID: 10797 relates to Category No.: 11861, 3755; Payload ID: 10798 relates to Category No.: 11861, 4121; Payload ID: 10799 relates to Category No.: 11861, 15249, 12078, 267; Payload ID: 10800 relates to Category No.: 11861; Payload ID: 10801 relates to Category No.: 277, 1457, 11861, 11983, 9939, 9896; Payload ID: 10802 relates to Category No.: 11861; Payload ID: 10803 relates to Category No.: 7462, 14176, 11861, 9652, 9647, 9621, 246; Payload ID: 10804 relates to Category No.: 9652, 9647, 7462, 11861, 9621; Payload ID: 10805 relates to Category No.: 14176, 10116, 11861, 9621, 246, 7462; Payload ID: 10806 relates to Category No.: 14176, 11861, 9621, 246; Payload ID: 10807 relates to Category No.: 7462, 9621; Payload ID: 10808 relates to Category No.: 11861, 9621; Payload ID: 10809 relates to Category No.: 7462, 11861, 9621; Payload ID: 10810 relates to Category No.: 11861; Payload ID: 10811 relates to Category No.: 11861; Payload ID: 10812 relates to Category No.: 7462; Payload ID: 10813 relates to Category No.: 7462, 11861, 9621, 4930, 9696, 304; Payload ID: 10814 relates to Category No.: 7462, 9621, 4930; Payload ID: 10815 relates to Category No.: 9226, 6924, 12054, 11861; Payload ID: 10816 relates to Category No.: 9226, 6924; Payload ID: 10817 relates to Category No.: 943; Payload ID: 10822 relates to Category No.: 14234, 11939, 5109, 11861, 15530, 14233, 5108, 15503, 14252; Payload ID: 10823 relates to Category No.: 6816, 6829, 3275, 14506, 1538, 3276, 9619, 9018; Payload ID: 10824 relates to Category No.: 6816, 6829, 9619, 3275, 1538; Payload ID: 10825 relates to Category No.: 11861; Payload ID: 10826 relates to Category No.: 11939, 5308, 5311, 582, 590; Payload ID: 10827 relates to Category No.: 926, 11861, 7442, 7465; Payload ID: 10828 relates to Category No.: 1405, 15504, 15542, 15556, 11861, 15956; Payload ID: 10829 relates to Category No.: 11939, 15956; Payload ID: 10830 relates to Category No.: 11861, 7444; Payload ID: 10831 relates to Category No.: 592; Payload ID: 10832 relates to Category No.: 7462, 822, 238, 15542; Payload ID: 10833 relates to Category No.: 6401, 11861, 7459; Payload ID: 10834 relates to Category No.: 5308, 7467; Payload ID: 10835 relates to Category No.: 7466, 7468, 7461, 1630; Payload ID: 10836 relates to Category No.: 246, 866; Payload ID: 10837 relates to Category No.: 926, 7462, 10116; Payload ID: 10838 relates to Category No.: 3303, 7462; Payload ID: 10839 relates to Category No.: 7462, 9621; Payload ID: 10840 relates to Category No.: 11861, 246, 866; Payload ID: 10841 relates to Category No.: 7462; Payload ID: 10842 relates to Category No.: 7462, 11861, 6425, 304, 2850; Payload ID: 10844 relates to Category No.: 7462, 889; Payload ID: 10845 relates to Category No.: 7462, 11861; Payload ID: 10846 relates to Category No.: 11861; Payload ID: 10847 relates to Category No.: 926, 11861; Payload ID: 10848 relates to Category No.: 11861; Payload ID: 10849 relates to Category No.: 16331, 7470, 9924; Payload ID: 10850 relates to Category No.: 15504, 5308, 307; Payload ID: 10851 relates to Category No.: 1630, 2201; Payload ID: 10852 relates to Category No.: 2201; Payload ID: 10853 relates to Category No.: 2201; Payload ID: 10854 relates to Category No.: 926, 6816, 7492, 11861; Payload ID: 10855 relates to Category No.: 926, 11939, 7492; Payload ID: 10856 relates to Category No.: 926, 4592, 11861, 7494, 5308, 307; Payload ID: 10857 relates to Category No.: 9518, 321, 7477, 100, 14988; Payload ID: 10858 relates to Category No.: 10116, 11861, 5347, 2872, 314, 7487, 15111; Payload ID: 10859 relates to Category No.: 6816, 3554, 11861, 7516; Payload ID: 10860 relates to Category No.: 7502; Payload ID: 10861 relates to Category No.: 7502; Payload ID: 10863 relates to Category No.: 3554, 7502; Payload ID: 10864 relates to Category No.: 926, 7502, 11861, 7503; Payload ID: 10865 relates to Category No.: 7502; Payload ID: 10866 relates to Category No.: 7502; Payload ID: 10867 relates to Category No.: 7502; Payload ID: 10869 relates to Category No.: 7502, 9518, 314; Payload ID: 10870 relates to Category No.: 7502; Payload ID: 10871 relates to Category No.: 15027, 7502; Payload ID: 10872 relates to Category No.: 7502, 11886; Payload ID: 10873 relates to Category No.: 1630, 7502, 11861, 2557, 11886, 7503, 9518, 321, 7477, 100; Payload ID: 10874 relates to Category No.: 7502, 7503; Payload ID: 10875 relates to Category No.: 7502, 11861; Payload ID: 10876 relates to Category No.: 11861; Payload ID: 10877 relates to Category No.: 7502; Payload ID: 10878 relates to Category No.: 7502; Payload ID: 10879 relates to Category No.: 7502; Payload ID: 10880 relates to Category No.: 7502; Payload ID: 10881 relates to Category No.: 7502; Payload ID: 10882 relates to Category No.: 7502, 7503; Payload ID: 10883 relates to Category No.: 7502, 7503; Payload ID: 10884 relates to Category No.: 7502, 11861; Payload ID: 10885 relates to Category No.: 1405, 7502, 258, 4103; Payload ID: 10886 relates to Category No.: 7502; Payload ID: 10887 relates to Category No.: 7502; Payload ID: 10888 relates to Category No.: 15973, 11861; Payload ID: 10889 relates to Category No.: 7502; Payload ID: 10890 relates to Category No.: 11861; Payload ID: 10891 relates to Category No.: 1457, 11861; Payload ID: 10892 relates to Category No.: 6924, 7192; Payload ID: 10893 relates to Category No.: 15542; Payload ID: 10894 relates to Category No.: 6924, 3752; Payload ID: 10895 relates to Category No.: 6816, 3554, 9518, 5875, 7502, 65, 138, 9518, 314, 11861; Payload ID: 10896 relates to Category No.: 6816, 3554, 15895, 7502, 138, 12352, 7472, 9518, 314, 11861, 7503; Payload ID: 10897 relates to Category No.: 3554, 7502, 9518, 314, 11861, 7503; Payload ID: 10898 relates to Category No.: 9518, 314, 7502; Payload ID: 10899 relates to Category No.: 7502; Payload ID: 10900 relates to Category No.: 3554, 7502; Payload ID: 10901 relates to Category No.: 6816, 5875, 7502, 138, 12352, 11861, 7503, 9518, 314, 12354, 11828; Payload ID: 10902 relates to Category No.: 6816, 7502, 138, 9518, 314, 7503; Payload ID: 10903 relates to Category No.: 6816, 7502, 4225, 138, 7472, 9518, 314, 7503, 11861; Payload ID: 10904 relates to Category No.: 6816, 3554, 9518, 7502, 65; Payload ID: 10905 relates to Category No.: 7502, 10116; Payload ID: 10907 relates to Category No.: 15027, 7502; Payload ID: 10908 relates to Category No.: 12329, 7192; Payload ID: 10909 relates to Category No.: 5865, 4207, 9518, 4225, 7523, 11861, 7510, 9518, 315, 16285, 7486, 680; Payload ID: 10910 relates to Category No.: 6816, 9518, 12363, 11861, 7510, 15115, 16258; Payload ID: 10911 relates to Category No.: 9518, 11861, 15115; Payload ID: 10912 relates to Category No.: 9282, 4976, 3554, 4207, 9518, 7488, 7184, 9527, 15115, 11861, 9518, 314, 9523; Payload ID: 10913 relates to Category No.: 12363, 11861, 3752, 14537, 15114; Payload ID: 10914 relates to Category No.: 9857, 9939, 11861, 5347, 3752, 15114; Payload ID: 10915 relates to Category No.: 1405, 4976, 4207, 9518, 11861, 7510, 15115, 5296; Payload ID: 10916 relates to Category No.: 1405, 11861, 9608; Payload ID: 10917 relates to Category No.: 1405, 15895, 11861, 4865; Payload ID: 10919 relates to Category No.: 3303, 14471, 15503, 14471, 15495; Payload ID: 10920 relates to Category No.: 3303, 14471; Payload ID: 10921 relates to Category No.: 3303; Payload ID: 10922 relates to Category No.: 16331, 14196, 15598, 11861; Payload ID: 10923 relates to Category No.: 16331, 11861, 7268; Payload ID: 10924 relates to Category No.: 16331, 14196, 11861; Payload ID: 10925 relates to Category No.: 894, 9619, 3663, 11861; Payload ID: 10926 relates to Category No.: 6816, 1630, 16331, 6825, 11861, 3772; Payload ID: 10927 relates to Category No.: 3303, 15491, 11861; Payload ID: 10929 relates to Category No.: 5259, 12402, 11861, 8959, 8961, 9638; Payload ID: 10930 relates to Category No.: 5259, 12402, 11861, 3297; Payload ID: 10931 relates to Category No.: 5259, 12402, 11939, 9638; Payload ID: 10932 relates to Category No.: 11978, 926, 4816, 9976, 4918, 7532, 5260, 11861, 11981, 4886, 9636; Payload ID: 10933 relates to Category No.: 11978, 926, 15617, 12399, 9976, 4918, 7532, 5260, 5347, 4886, 9636; Payload ID: 10934 relates to Category No.: 4816, 9636, 7532, 5260, 11939; Payload ID: 10935 relates to Category No.: 11861; Payload ID: 10936 relates to Category No.: 15617, 11861; Payload ID: 10937 relates to Category No.: 11939, 12402, 12399, 11861, 1706; Payload ID: 10938 relates to Category No.: 15029, 11861; Payload ID: 10939 relates to Category No.: 11861; Payload ID: 10940 relates to Category No.: 9706, 2836; Payload ID: 10942 relates to Category No.: 12416, 12402, 11861, 1327, 11861, 2931, 12425, 11991, 14538, 3959, 11920; Payload ID: 10943 relates to Category No.: 12416, 11861, 2931, 14538, 11886, 14377; Payload ID: 10944 relates to Category No.: 11861, 2936, 14537; Payload ID: 10945 relates to Category No.: 12363, 11861, 11886; Payload ID: 10946 relates to Category No.: 4894, 11861, 11886, 11977; Payload ID: 10949 relates to Category No.: 15026; Payload ID: 10950 relates to Category No.: 15021, 11861, 5347; Payload ID: 10951 relates to Category No.: 5308, 20, 15086, 2998; Payload ID: 10952 relates to Category No.: 5308, 15086, 20, 2998; Payload ID: 10953 relates to Category No.: 5308, 15086, 20, 2998; Payload ID: 10954 relates to Category No.: 5308, 15086, 20, 2998; Payload ID: 10955 relates to Category No.: 11861, 7192; Payload ID: 10956 relates to Category No.: 7192; Payload ID: 10957 relates to Category No.: 11861, 7192; Payload ID: 10958 relates to Category No.: 7502, 11861, 2873, 11886; Payload ID: 10959 relates to Category No.: 7502; Payload ID: 10960 relates to Category No.: 277, 11861, 2936, 15741, 15024, 4198, 16331; Payload ID: 10961 relates to Category No.: 267, 11861, 15024; Payload ID: 10962 relates to Category No.: 16331, 267, 7328, 11861, 16184; Payload ID: 10963 relates to Category No.: 11861; Payload ID: 10965 relates to Category No.: 15528, 14233, 11861, 14234, 4389; Payload ID: 10966 relates to Category No.: 11861; Payload ID: 10967 relates to Category No.: 11861; Payload ID: 10968 relates to Category No.: 926, 3655, 11861, 958; Payload ID: 10970 relates to Category No.: 11861, 14249, 7192, 3752; Payload ID: 10971 relates to Category No.: 11861; Payload ID: 10972 relates to Category No.: 14564, 11861; Payload ID: 10973 relates to Category No.: 14564, 11861, 16296; Payload ID: 10974 relates to Category No.: 14666, 11933, 15895, 11861, 7550; Payload ID: 10975 relates to Category No.: 11861, 9804; Payload ID: 10976 relates to Category No.: 2405, 11861; Payload ID: 10977 relates to Category No.: 11861; Payload ID: 10978 relates to Category No.: 11861; Payload ID: 10979 relates to Category No.: 9282, 9226, 14196, 10116, 11861; Payload ID: 10980 relates to Category No.: 11861; Payload ID: 10981 relates to Category No.: 11861; Payload ID: 10982 relates to Category No.: 16331, 11861, 15887, 7125; Payload ID: 10983 relates to Category No.: 16331, 9226, 11895, 2963, 5308, 313, 5308, 5310, 3380, 3343, 6401; Payload ID: 10984 relates to Category No.: 16331, 9226, 2963, 11861, 5308, 5310, 3380, 6965; Payload ID: 10985 relates to Category No.: 3303, 16331, 9226, 2963, 3459, 14597, 5308, 5310, 3380, 1338, 3343; Payload ID: 10986 relates to Category No.: 11978, 926, 6478, 15504, 15895, 12109, 11861, 14536, 6600; Payload ID: 10987 relates to Category No.: 11861, 2696, 12399, 1369; Payload ID: 10988 relates to Category No.: 4864, 5588, 5547, 5009, 11861, 9122; Payload ID: 10989 relates to Category No.: 1405, 5588, 11861; Payload ID: 10990 relates to Category No.: 15029, 11861; Payload ID: 10991 relates to Category No.: 11861; Payload ID: 10992 relates to Category No.: 15029, 11861; Payload ID: 10993 relates to Category No.: 11861, 7393; Payload ID: 10994 relates to Category No.: 11861; Payload ID: 10995 relates to Category No.: 4864, 12402, 11861, 6826, 8859, 12417; Payload ID: 10996 relates to Category No.: 14564, 15895, 15617, 12399, 12359, 11861, 15781, 8855, 3006, 1146, 8989, 8984, 11712; Payload ID: 10997 relates to Category No.: 6816, 11861, 2853, 3007, 8859; Payload ID: 10998 relates to Category No.: 11917, 14243, 15528, 14255; Payload ID: 10999 relates to Category No.: 11917, 14251, 14471, 14243, 11861, 14229; Payload ID: 11000 relates to Category No.: 15029, 7192, 5728, 11861; Payload ID: 11001 relates to Category No.: 926, 6816, 942, 11981, 12359, 11861, 15181, 9608, 11886, 15180, 942, 2744; Payload ID: 11002 relates to Category No.: 14770, 15180, 11861, 14706; Payload ID: 11003 relates to Category No.: 14770, 15180, 11861; Payload ID: 11004 relates to Category No.: 14770, 15180, 11861; Payload ID: 11005 relates to Category No.: 11861; Payload ID: 11006 relates to Category No.: 11861, 7192, 12402; Payload ID: 11007 relates to Category No.: 11861, 6027; Payload ID: 11008 relates to Category No.: 11861; Payload ID: 11009 relates to Category No.: 11861; Payload ID: 11010 relates to Category No.: 11861, 7192; Payload ID: 11011 relates to Category No.: 6816, 4976, 4864; Payload ID: 11012 relates to Category No.: 10116; Payload ID: 11013 relates to Category No.: 11861, 5347, 16206; Payload ID: 11014 relates to Category No.: 11861; Payload ID: 11015 relates to Category No.: 1405, 11861; Payload ID: 11016 relates to Category No.: 1405, 11861, 5009, 5347, 11983; Payload ID: 11017 relates to Category No.: 11861; Payload ID: 11018 relates to Category No.: 15908, 6188, 11861, 15893, 11920, 1135, 15887, 11782, 14218, 9985, 14732, 9987, 11895; Payload ID: 11019 relates to Category No.: 15908, 15893, 6188, 14733, 11861, 11665, 5841, 11664, 14732; Payload ID: 11020 relates to Category No.: 15895, 11861; Payload ID: 11021 relates to Category No.: 11861; Payload ID: 11022 relates to Category No.: 11861; Payload ID: 11023 relates to Category No.: 3303, 15503, 14471, 14234, 14471, 11861, 15528, 14233, 6127; Payload ID: 11024 relates to Category No.: 16331, 15908, 6188, 11861, 15591, 9100, 15893; Payload ID: 11025 relates to Category No.: 16331, 6188, 11861; Payload ID: 11026 relates to Category No.: 11861; Payload ID: 11027 relates to Category No.: 16331, 6188, 11861, 15893; Payload ID: 11028 relates to Category No.: 11861; Payload ID: 11029 relates to Category No.: 12402, 11861, 4864, 2874, 12144, 15493, 12425, 15611, 3842, 2305, 3839; Payload ID: 11030 relates to Category No.: 4864, 12402, 11861; Payload ID: 11031 relates to Category No.: 4864, 12402, 11861, 12425, 15611, 2305; Payload ID: 11032 relates to Category No.: 4864, 12402, 11861; Payload ID: 11033 relates to Category No.: 11861; Payload ID: 11034 relates to Category No.: 7192; Payload ID: 11035 relates to Category No.: 11861, 1405, 12399, 1404, 1706, 217, 8910, 6816, 15617, 12402, 1439; Payload ID: 11036 relates to Category No.: 6816, 15617, 1706, 8910, 1404, 11861; Payload ID: 11037 relates to Category No.: 11861, 6816, 12399, 1706, 8910, 1404, 15617; Payload ID: 11038 relates to Category No.: 12402; Payload ID: 11039 relates to Category No.: 7192; Payload ID: 11040 relates to Category No.: 7192, 12402; Payload ID: 11041 relates to Category No.: 7192; Payload ID: 11045 relates to Category No.: 7192; Payload ID: 11048 relates to Category No.: 9939, 11861, 1201, 11981; Payload ID: 11049 relates to Category No.: 9939, 11861, 1201; Payload ID: 11050 relates to Category No.: 9939, 11861, 1201; Payload ID: 11051 relates to Category No.: 11939, 11861, 1253, 7236; Payload ID: 11052 relates to Category No.: 14706, 1201, 11861; Payload ID: 11057 relates to Category No.: 1405, 11861; Payload ID: 11059 relates to Category No.: 1405, 11861; Payload ID: 11066 relates to Category No.: 4886, 11886, 11861; Payload ID: 11067 relates to Category No.: 1405, 267, 2491, 11861, 15766, 598; Payload ID: 11068 relates to Category No.: 1405, 1504, 5293, 11861; Payload ID: 11069 relates to Category No.: 11861, 1201; Payload ID: 11070 relates to Category No.: 14107, 4924, 11861, 4901; Payload ID: 11071 relates to Category No.: 11861, 11863, 11920; Payload ID: 11072 relates to Category No.: 4894, 11861, 9834, 9824, 1201; Payload ID: 11073 relates to Category No.: 267, 11861, 2936, 11920, 1153, 5588; Payload ID: 11074 relates to Category No.: 15021, 6965, 15029, 11861, 1327, 11981, 5960, 3508, 11933, 15468; Payload ID: 11075 relates to Category No.: 15021, 11895, 15029, 11861, 1327, 11861, 5347, 11933, 11920, 9925; Payload ID: 11076 relates to Category No.: 15021, 6965, 15029, 11861; Payload ID: 11077 relates to Category No.: 3303, 15503, 14471, 2405, 11917, 11861, 3530, 15503, 15504; Payload ID: 11078 relates to Category No.: 11917, 3530, 11861, 14471; Payload ID: 11079 relates to Category No.: 14234, 11917, 15491, 11861, 2688, 15530, 14233, 2406, 15503, 14471, 3459, 15528, 14233; Payload ID: 11080 relates to Category No.: 6816, 4976, 9524, 11861, 9529; Payload ID: 11081 relates to Category No.: 1457, 11861, 9874, 9818; Payload ID: 11082 relates to Category No.: 10116, 11861; Payload ID: 11083 relates to Category No.: 11917, 12399, 8893, 1706, 9608, 14377, 11861; Payload ID: 11084 relates to Category No.: 12399, 8893, 1706, 11861; Payload ID: 11085 relates to Category No.: 8893, 12399, 11861, 1706, 14377; Payload ID: 11086 relates to Category No.: 11939, 12399, 8893, 11861, 1706, 14377, 2327; Payload ID: 11087 relates to Category No.: 12399, 8893, 11861, 1706, 14377; Payload ID: 11088 relates to Category No.: 6816, 6825, 9619, 9629, 9351; Payload ID: 11089 relates to Category No.: 5259, 11861, 8913; Payload ID: 11090 relates to Category No.: 4820, 1267; Payload ID: 11091 relates to Category No.: 4821; Payload ID: 11092 relates to Category No.: 12402, 11861, 8916; Payload ID: 11093 relates to Category No.: 4820, 8960, 8915; Payload ID: 11094 relates to Category No.: 4886, 4820, 11861, 5764, 8915, 8914, 8960; Payload ID: 11095 relates to Category No.: 926, 11861; Payload ID: 11096 relates to Category No.: 926, 4965, 11861, 5009; Payload ID: 11097 relates to Category No.: 11861, 926; Payload ID: 11098 relates to Category No.: 2500, 11861, 12402; Payload ID: 11099 relates to Category No.: 1405, 16244, 11861, 6478, 11981; Payload ID: 11100 relates to Category No.: 11861, 712, 11863; Payload ID: 11101 relates to Category No.: 15503, 14471, 11933, 2405, 14471, 15504, 11917, 15491, 11861, 3530, 14229, 14246, 15528, 14233, 3303, 14234, 3459; Payload ID: 11102 relates to Category No.: 15503, 14471, 11933, 11917, 15495, 3530, 14243, 3303, 11861, 15528, 14255; Payload ID: 11103 relates to Category No.: 3303, 11917; Payload ID: 11104 relates to Category No.: 11917, 15528, 14233, 14234, 3303; Payload ID: 11105 relates to Category No.: 11861; Payload ID: 11106 relates to Category No.: 14107, 4924, 11861; Payload ID: 11107 relates to Category No.: 3303, 15503, 14471, 11917, 14251, 14471, 11861; Payload ID: 11108 relates to Category No.: 3303, 6816, 15503, 14471, 11917, 11861, 2688, 5282; Payload ID: 11109 relates to Category No.: 11917, 14251, 14471, 11861, 3303; Payload ID: 11110 relates to Category No.: 14234, 11917, 11861, 15528, 14233, 3303, 11933, 14242; Payload ID: 11111 relates to Category No.: 6816; Payload ID: 11112 relates to Category No.: 6816, 1504, 7192; Payload ID: 11113 relates to Category No.: 6816; Payload ID: 11114 relates to Category No.: 11861; Payload ID: 11115 relates to Category No.: 11861; Payload ID: 11116 relates to Category No.: 11861; Payload ID: 11118 relates to Category No.: 5009, 11861, 4720; Payload ID: 11119 relates to Category No.: 14196, 9226, 10116, 7268; Payload ID: 11120 relates to Category No.: 9226, 14196, 10116; Payload ID: 11121 relates to Category No.: 4821, 11861; Payload ID: 11122 relates to Category No.: 4820, 8960, 9629; Payload ID: 11123 relates to Category No.: 4820, 8960, 9629, 9385; Payload ID: 11124 relates to Category No.: 12402, 4821, 8959; Payload ID: 11126 relates to Category No.: 4820, 8960, 16108; Payload ID: 11128 relates to Category No.: 4821, 11861; Payload ID: 11129 relates to Category No.: 5259, 4820, 12402, 1404, 8959, 8964, 4821; Payload ID: 11130 relates to Category No.: 4820, 11861, 8963, 9562, 9644; Payload ID: 11131 relates to Category No.: 4820, 12399, 1404, 11861, 8963, 9644; Payload ID: 11132 relates to Category No.: 4820, 9562, 9644, 9629; Payload ID: 11133 relates to Category No.: 4820, 8963, 9644, 9562; Payload ID: 11134 relates to Category No.: 4820, 8957, 11861, 8960, 9384; Payload ID: 11135 relates to Category No.: 4820, 8957, 11861, 8960, 9384; Payload ID: 11136 relates to Category No.: 11861, 5850; Payload ID: 11137 relates to Category No.: 11861, 5850; Payload ID: 11138 relates to Category No.: 16089, 14429, 6816, 5009, 2694, 11861, 2875, 4865, 16079; Payload ID: 11139 relates to Category No.: 16089, 14429, 6816, 11861, 12399, 5009, 2875, 4865; Payload ID: 11140 relates to Category No.: 15612, 11861, 1706, 15785, 5841, 4185; Payload ID: 11141 relates to Category No.: 8959, 11861; Payload ID: 11142 relates to Category No.: 4820, 11861, 4815, 11939, 11933, 12064; Payload ID: 11143 relates to Category No.: 4820, 4815; Payload ID: 11144 relates to Category No.: 11861; Payload ID: 11145 relates to Category No.: 11978, 926, 11939, 15612, 12145, 11861, 8858, 8984, 8855, 5957, 8985, 4802, 8986; Payload ID: 11146 relates to Category No.: 926, 11939, 11861, 8984, 1299, 1301, 11978, 15612, 12145, 8986, 12425; Payload ID: 11147 relates to Category No.: 11978, 926, 15612, 9539, 12145, 11861, 8986, 8984, 4802; Payload ID: 11148 relates to Category No.: 4864, 12402, 2282, 8985, 11861, 8855; Payload ID: 11149 relates to Category No.: 4864, 12402, 11861; Payload ID: 11150 relates to Category No.: 4864, 12402; Payload ID: 11151 relates to Category No.: 5308, 1536, 14492, 9809; Payload ID: 11152 relates to Category No.: 9939, 11861, 12417, 14870; Payload ID: 11153 relates to Category No.: 3554, 9857, 11861, 15115, 9877, 14537; Payload ID: 11154 relates to Category No.: 11895, 3554, 11861, 12363; Payload ID: 11155 relates to Category No.: 9857, 11861, 11917, 9882, 15114; Payload ID: 11156 relates to Category No.: 1459, 277, 11861, 15024; Payload ID: 11157 relates to Category No.: 15617; Payload ID: 11158 relates to Category No.: 2405, 10116, 11861, 2406; Payload ID: 11160 relates to Category No.: 4886, 4895; Payload ID: 11161 relates to Category No.: 4886, 4895; Payload ID: 11162 relates to Category No.: 3303, 9226, 10116, 11861; Payload ID: 11163 relates to Category No.: 6816, 11939, 5875, 12292, 11861, 2843, 1630; Payload ID: 11164 relates to Category No.: 5865, 5875, 138, 11861; Payload ID: 11165 relates to Category No.: 15504; Payload ID: 11166 relates to Category No.: 15495, 11861, 15504; Payload ID: 11167 relates to Category No.: 6816, 11861, 9650; Payload ID: 11168 relates to Category No.: 11861; Payload ID: 11169 relates to Category No.: 11861; Payload ID: 11170 relates to Category No.: 11861; Payload ID: 11171 relates to Category No.: 16331, 15908, 6188, 11861, 15893; Payload ID: 11172 relates to Category No.: 14712, 10116, 11861, 15270, 14196; Payload ID: 11175 relates to Category No.: 15504, 2963, 953, 11861, 12064; Payload ID: 11176 relates to Category No.: 11861; Payload ID: 11177 relates to Category No.: 11861, 3663, 9619; Payload ID: 11179 relates to Category No.: 6924, 9027; Payload ID: 11180 relates to Category No.: 1630, 9304, 926, 11861, 9035, 9030; Payload ID: 11181 relates to Category No.: 926, 1630, 9035, 9030; Payload ID: 11182 relates to Category No.: 1630, 9304, 926, 9035, 9030; Payload ID: 11183 relates to Category No.: 9518, 7484, 7472, 7510, 7482, 7483; Payload ID: 11184 relates to Category No.: 9036, 11861, 9028, 11939, 2874, 3471; Payload ID: 11185 relates to Category No.: 926, 6816, 11861, 14179, 5956; Payload ID: 11186 relates to Category No.: 926, 6816, 11861, 14179; Payload ID: 11187 relates to Category No.: 9036, 9032, 6188, 11861; Payload ID: 11188 relates to Category No.: 1405, 6024, 11861, 2566, 12189, 4016, 6027; Payload ID: 11189 relates to Category No.: 1405, 11861, 2566; Payload ID: 11190 relates to Category No.: 4964, 15617, 12399, 11861, 2346, 16206, 14987; Payload ID: 11191 relates to Category No.: 11861, 3752, 2346; Payload ID: 11192 relates to Category No.: 15504, 11861, 5347; Payload ID: 11193 relates to Category No.: 11978, 926; Payload ID: 11194 relates to Category No.: 11978, 926, 6478, 12109; Payload ID: 11195 relates to Category No.: 11978, 926, 6816, 5956, 12109, 6601, 12145, 11861; Payload ID: 11196 relates to Category No.: 11978, 926, 6816, 12109, 1201; Payload ID: 11197 relates to Category No.: 11978, 926, 6816, 12109, 11861; Payload ID: 11198 relates to Category No.: 11978, 926, 6816, 12109, 11861, 12081; Payload ID: 11199 relates to Category No.: 11978, 926, 12109, 6816, 11861; Payload ID: 11200 relates to Category No.: 11978, 926, 12109, 6574; Payload ID: 11201 relates to Category No.: 11978, 926, 12109, 6816; Payload ID: 11202 relates to Category No.: 11978, 926, 14564, 6478, 12109, 11981, 5960, 11861; Payload ID: 11203 relates to Category No.: 11978, 926, 6816, 12109; Payload ID: 11204 relates to Category No.: 11978, 926, 12109, 6816, 11861; Payload ID: 11205 relates to Category No.: 11978, 926, 6816, 12109, 11981, 11861; Payload ID: 11206 relates to Category No.: 6816, 3688; Payload ID: 11207 relates to Category No.: 1405, 4886, 11861; Payload ID: 11208 relates to Category No.: 1405, 11861; Payload ID: 11209 relates to Category No.: 11861; Payload ID: 11210 relates to Category No.: 11861; Payload ID: 11211 relates to Category No.: 14196, 10116, 11861; Payload ID: 11212 relates to Category No.: 6481; Payload ID: 11213 relates to Category No.: 6481; Payload ID: 11214 relates to Category No.: 11861, 6481; Payload ID: 11215 relates to Category No.: 6481; Payload ID: 11216 relates to Category No.: 11895, 5109, 11861, 12064, 2418, 1201, 2405, 6654; Payload ID: 11217 relates to Category No.: 11861, 8969; Payload ID: 11218 relates to Category No.: 11861; Payload ID: 11220 relates to Category No.: 9857, 11861, 5347, 5588; Payload ID: 11221 relates to Category No.: 4886, 4895, 10116, 11861; Payload ID: 11222 relates to Category No.: 5865, 4976, 4207, 9518, 4225, 1457, 14733, 7523, 9059, 11861, 7510, 5841, 14377, 1371, 15306, 822, 11939, 3752; Payload ID: 11223 relates to Category No.: 11861, 9060; Payload ID: 11224 relates to Category No.: 11939, 5865, 4976, 4207, 9518, 12402, 4225, 1457, 7523, 9059, 11861, 7510, 15306, 822; Payload ID: 11225 relates to Category No.: 5865, 4976, 4207, 9518, 4225, 1457, 295, 7523, 9059, 11861, 7510, 1371, 15306, 822, 14377; Payload ID: 11226 relates to Category No.: 10116, 11861, 15908; Payload ID: 11227 relates to Category No.: 11861; Payload ID: 11228 relates to Category No.: 5308, 307, 9063; Payload ID: 11229 relates to Category No.: 5308, 307, 9364; Payload ID: 11230 relates to Category No.: 3303, 14471; Payload ID: 11231 relates to Category No.: 3303, 14471, 11861; Payload ID: 11232 relates to Category No.: 3303, 15503, 14471, 14471, 15524, 14243, 11861, 2688, 3752, 14242, 5827, 5826, 15503, 14239; Payload ID: 11233 relates to Category No.: 3303, 2405, 14471, 15491, 2689, 15503, 14471, 11861, 15504; Payload ID: 11234 relates to Category No.: 3303, 14471, 7192; Payload ID: 11235 relates to Category No.: 3303, 14471, 7192; Payload ID: 11236 relates to Category No.: 3303, 15503, 14471, 14234, 11933, 2405, 14471, 15504, 15524, 11861, 15528, 14233, 15528, 14255, 14525, 11939, 15528, 14252, 15503, 14239, 14248; Payload ID: 11237 relates to Category No.: 3303, 15503, 14471, 14471; Payload ID: 11238 relates to Category No.: 3303, 15503, 14471, 14234, 14471, 3459, 15528, 14233; Payload ID: 11239 relates to Category No.: 3303, 15503, 14471, 14471, 15504, 15524, 685, 5109, 11861, 2688, 3936, 15525, 3935, 2853, 11977, 12107, 15503, 14235, 6476; Payload ID: 11240 relates to Category No.: 3303, 14471, 15530, 14233, 14234; Payload ID: 11241 relates to Category No.: 3303, 14471, 15503, 14471, 14234, 2405, 15530, 14233; Payload ID: 11242 relates to Category No.: 3303, 15503, 14471, 14471, 15530, 14233, 14234; Payload ID: 11243 relates to Category No.: 14471, 3303; Payload ID: 11244 relates to Category No.: 926, 11861; Payload ID: 11245 relates to Category No.: 926, 6816, 15908, 2859, 11861; Payload ID: 11246 relates to Category No.: 926, 7192, 11861; Payload ID: 11247 relates to Category No.: 926, 15908, 6478, 11939, 2858, 11861, 5347; Payload ID: 11248 relates to Category No.: 926, 11861, 14237; Payload ID: 11249 relates to Category No.: 926, 11920, 11861, 3752, 2853; Payload ID: 11251 relates to Category No.: 926, 10116, 9518, 315, 16283, 12443, 680; Payload ID: 11252 relates to Category No.: 926, 11861, 2853; Payload ID: 11253 relates to Category No.: 926; Payload ID: 11254 relates to Category No.: 926; Payload ID: 11255 relates to Category No.: 926; Payload ID: 11257 relates to Category No.: 926, 14471, 15504, 11861, 9654; Payload ID: 11258 relates to Category No.: 926; Payload ID: 11259 relates to Category No.: 926, 11861; Payload ID: 11260 relates to Category No.: 926, 16108; Payload ID: 11261 relates to Category No.: 926; Payload ID: 11262 relates to Category No.: 926, 7192; Payload ID: 11263 relates to Category No.: 926; Payload ID: 11264 relates to Category No.: 11861, 1327, 10116, 14163; Payload ID: 11265 relates to Category No.: 11861, 1439;

Payload ID: 11266 relates to Category No.: 9252, 11861; Payload ID: 11267 relates to Category No.: 926, 6816, 9252, 11861; Payload ID: 11268 relates to Category No.: 6965, 9252; Payload ID: 11269 relates to Category No.: 9252; Payload ID: 11270 relates to Category No.: 926, 4886, 6478, 9252, 10116, 11861, 3084, 5347, 14170, 11981, 14243, 14597, 3752, 4389, 5728; Payload ID: 11271 relates to Category No.: 9252, 12109, 4103, 3471, 3752, 5728; Payload ID: 11272 relates to Category No.: 926, 6816, 9252, 11861; Payload ID: 11273 relates to Category No.: 926, 6816, 9252, 6210, 11861; Payload ID: 11274 relates to Category No.: 926, 9252, 6816; Payload ID: 11275 relates to Category No.: 926, 6816, 15503, 14471, 9252, 11861, 11938; Payload ID: 11276 relates to Category No.: 3303, 1630, 533, 2963, 11861, 3381, 3384, 3383, 3382; Payload ID: 11278 relates to Category No.: 11861, 15493; Payload ID: 11279 relates to Category No.: 6965, 1369, 12359, 11861, 4389; Payload ID: 11280 relates to Category No.: 4736, 7420; Payload ID: 11281 relates to Category No.: 4736; Payload ID: 11282 relates to Category No.: 3303, 15528, 14233, 15503, 14471, 14471, 14234; Payload ID: 11283 relates to Category No.: 2405, 5105, 15495, 10116, 9275, 11861, 13735, 1201; Payload ID: 11284 relates to Category No.: 2405, 10116, 1201; Payload ID: 11285 relates to Category No.: 6816, 15503, 14471, 7268, 10119, 11861; Payload ID: 11286 relates to Category No.: 4864, 2874, 15567, 15811, 7236, 11861, 12400; Payload ID: 11287 relates to Category No.: 1504, 7192; Payload ID: 11288 relates to Category No.: 1504, 11861; Payload ID: 11289 relates to Category No.: 1504, 7192; Payload ID: 11290 relates to Category No.: 11939, 11861, 2875, 11886; Payload ID: 11291 relates to Category No.: 6481; Payload ID: 11292 relates to Category No.: 6481, 11861; Payload ID: 11293 relates to Category No.: 15025; Payload ID: 11294 relates to Category No.: 3303, 11861; Payload ID: 11295 relates to Category No.: 9282, 9226, 2405, 10116, 11861, 2688, 5347, 15525, 14240; Payload ID: 11296 relates to Category No.: 2405, 5105, 11861, 1201; Payload ID: 11297 relates to Category No.: 11861, 1201; Payload ID: 11298 relates to Category No.: 11861; Payload ID: 11299 relates to Category No.: 1201, 2405, 6900, 11861; Payload ID: 11300 relates to Category No.: 6900, 11861, 1201; Payload ID: 11301 relates to Category No.: 11861; Payload ID: 11303 relates to Category No.: 14712, 11861, 15270; Payload ID: 11304 relates to Category No.: 14712, 10116, 3752; Payload ID: 11305 relates to Category No.: 10116; Payload ID: 11306 relates to Category No.: 14196, 14351, 6924, 10116, 11861; Payload ID: 11307 relates to Category No.: 14196, 6924; Payload ID: 11308 relates to Category No.: 6924, 11861, 14669; Payload ID: 11309 relates to Category No.: 6924, 10116; Payload ID: 11310 relates to Category No.: 14196, 6924; Payload ID: 11311 relates to Category No.: 14196, 6924; Payload ID: 11312 relates to Category No.: 6924, 10116, 15699, 15682; Payload ID: 11313 relates to Category No.: 14196, 14712, 10116, 11861; Payload ID: 11314 relates to Category No.: 14712, 10116, 11861; Payload ID: 11315 relates to Category No.: 14196, 10116, 1201; Payload ID: 11316 relates to Category No.: 4864, 11939, 4291, 11861, 2874; Payload ID: 11317 relates to Category No.: 1405, 12399, 11861, 3753, 2688, 3752, 15528, 14252, 15503, 14471, 14471, 11933, 2405, 2406, 9122; Payload ID: 11318 relates to Category No.: 1405, 12399, 11861, 15503, 6182; Payload ID: 11319 relates to Category No.: 1405, 11861; Payload ID: 11320 relates to Category No.: 1405, 11861, 3752; Payload ID: 11321 relates to Category No.: 1405, 11933, 12399, 11861; Payload ID: 11322 relates to Category No.: 11861; Payload ID: 11323 relates to Category No.: 11861; Payload ID: 11324 relates to Category No.: 3303; Payload ID: 11325 relates to Category No.: 5308, 9545; Payload ID: 11326 relates to Category No.: 4964, 12359, 11861, 7410, 3471; Payload ID: 11327 relates to Category No.: 11861; Payload ID: 11328 relates to Category No.: 16331, 15895, 11861, 15887; Payload ID: 11329 relates to Category No.: 11978, 4894, 11861; Payload ID: 11330 relates to Category No.: 4894, 7192; Payload ID: 11331 relates to Category No.: 7192; Payload ID: 11332 relates to Category No.: 10116; Payload ID: 11333 relates to Category No.: 16331, 15908, 6188, 11861; Payload ID: 11334 relates to Category No.: 16331, 15101, 6188, 11861; Payload ID: 11335 relates to Category No.: 11861; Payload ID: 11336 relates to Category No.: 11861, 15887, 12086, 9939, 943; Payload ID: 11337 relates to Category No.: 11861; Payload ID: 11338 relates to Category No.: 1630, 15093, 6816, 9135, 11861; Payload ID: 11339 relates to Category No.: 9282, 6478, 163, 9518; Payload ID: 11340 relates to Category No.: 12183; Payload ID: 11341 relates to Category No.: 1405; Payload ID: 11342 relates to Category No.: 1405, 11861; Payload ID: 11343 relates to Category No.: 1405, 11861; Payload ID: 11344 relates to Category No.: 6924, 12054, 9152; Payload ID: 11345 relates to Category No.: 3303, 6816, 3459, 1630, 3655, 138, 11861, 3380, 9515, 3343; Payload ID: 11347 relates to Category No.: 11978, 926, 6816, 9539, 12109, 11861; Payload ID: 11348 relates to Category No.: 11978, 926, 6478, 12109, 11861; Payload ID: 11349 relates to Category No.: 11861, 7192; Payload ID: 11350 relates to Category No.: 14196, 10116, 11861, 15270; Payload ID: 11351 relates to Category No.: 11861, 11886, 5282, 5105; Payload ID: 11352 relates to Category No.: 14196, 10116, 11861, 14198, 1201; Payload ID: 11353 relates to Category No.: 9282, 14198, 9226, 10116, 11861, 14195; Payload ID: 11354 relates to Category No.: 9282, 9226, 14198; Payload ID: 11355 relates to Category No.: 9282, 10116; Payload ID: 11356 relates to Category No.: 10116, 15528, 14233; Payload ID: 11357 relates to Category No.: 7192, 11861; Payload ID: 11360 relates to Category No.: 3303, 15503, 14471, 14234, 15504, 15528, 14233, 2405; Payload ID: 11361 relates to Category No.: 3303, 15503, 14471, 14234, 14251, 14471, 14249, 15528, 14233, 3459; Payload ID: 11362 relates to Category No.: 15503, 14471, 14234, 15528, 14233, 11861, 3303, 3459, 2689; Payload ID: 11363 relates to Category No.: 3303, 15503, 14471, 11861, 15503, 14239; Payload ID: 11364 relates to Category No.: 15503, 14471, 3303, 14234, 11861, 15528, 14233; Payload ID: 11365 relates to Category No.: 3303, 15503, 14471, 4204, 11861, 15503, 14239, 14252, 14240, 7128, 15528, 14239, 14243; Payload ID: 11366 relates to Category No.: 3303, 15503, 14471, 11861, 15528, 14233, 15530, 14233, 15504, 14471, 2405, 14234, 15524; Payload ID: 11367 relates to Category No.: 11861, 12121; Payload ID: 11368 relates to Category No.: 3303, 15503, 14471, 11861, 14234, 15528, 14233, 15504, 14471, 2405, 15528, 14255; Payload ID: 11369 relates to Category No.: 3303, 15503, 14471, 15491, 11861, 14251, 14471, 15530, 14233, 15504, 14234, 9763; Payload ID: 11370 relates to Category No.: 3303, 15503, 14471, 11933, 2405, 15504, 15524, 13683, 14243, 15530, 14255, 11861, 5347, 15525, 14240, 322, 15528, 14239, 14471, 11939, 4961, 3459; Payload ID: 11371 relates to Category No.: 2405, 3303, 15503, 14471, 14234, 15491, 11861, 15528, 14233; Payload ID: 11372 relates to Category No.: 15504, 15895, 11861, 5347, 9179, 3752, 9014, 11886, 4961; Payload ID: 11373 relates to Category No.: 11861, 14564, 15491; Payload ID: 11374 relates to Category No.: 11861, 9014; Payload ID: 11375 relates to Category No.: 11861; Payload ID: 11376 relates to Category No.: 15493, 11861; Payload ID: 11377 relates to Category No.: 11861; Payload ID: 11378 relates to Category No.: 3303, 11861, 11828; Payload ID: 11379 relates to Category No.: 3303, 15503, 14471, 14471, 15491, 11861, 15525, 12064, 16296; Payload ID: 11380 relates to Category No.: 3303, 15503, 14471, 14471, 11861, 15493, 15525, 14240, 15528, 14239, 15528, 14252; Payload ID: 11381 relates to Category No.: 3303, 15503, 14471, 14471, 15524, 11920, 11861, 15525, 14229, 14240, 15528, 14239, 15494; Payload ID: 11382 relates to Category No.: 3303, 15503, 14471, 14471, 15491, 11861, 15525, 15530, 14233, 14234; Payload ID: 11383 relates to Category No.: 3303, 15503, 14471, 14471, 15495, 14243, 11861, 15530, 14233, 14237; Payload ID: 11384 relates to Category No.: 3303, 6816, 14196, 11861, 1327, 14712, 11861, 5347; Payload ID: 11385 relates to Category No.: 14196, 10116, 11861; Payload ID: 11386 relates to Category No.: 4886, 5308; Payload ID: 11387 relates to Category No.: 15029, 11861, 6965; Payload ID: 11388 relates to Category No.: 7192; Payload ID: 11393 relates to Category No.: 11861; Payload ID: 11397 relates to Category No.: 7192; Payload ID: 11404 relates to Category No.: 6022; Payload ID: 11405 relates to Category No.: 6816, 5875, 138; Payload ID: 11406 relates to Category No.: 11895, 15491, 15495, 11861, 12064; Payload ID: 11407 relates to Category No.: 3303, 7192, 2405; Payload ID: 11409 relates to Category No.: 11861; Payload ID: 11410 relates to Category No.: 11861; Payload ID: 11411 relates to Category No.: 11978, 926, 11939, 11861, 5347; Payload ID: 11412 relates to Category No.: 11978, 926; Payload ID: 11413 relates to Category No.: 16331, 2405, 14082, 15495, 5229, 11861, 15493, 5213, 3936, 686, 14237, 15409, 14087, 5207; Payload ID: 11414 relates to Category No.: 11917, 15491, 11861, 5096, 3752, 6185, 9173, 12064, 6184, 14246, 686, 3303, 15504, 2405, 3936, 11762, 11886, 14082, 14242, 14087; Payload ID: 11415 relates to Category No.: 11917, 15491, 11861, 5096, 6185, 9173, 6184, 15504, 2405, 12402, 14234, 14241, 15410, 3936, 11762, 9608, 11886, 14082, 4517, 14087, 15409, 3347, 3303; Payload ID: 11416 relates to Category No.: 11917, 15491, 11861, 5096, 6185, 9173, 12064, 6184, 686, 15409, 15528, 14233, 2405, 15503, 14254; Payload ID: 11417 relates to Category No.: 15491, 686; Payload ID: 11418 relates to Category No.: 10116, 11861, 2405; Payload ID: 11419 relates to Category No.: 15491, 2405, 11861, 3936, 3752, 6185, 15409, 14087, 11939, 11920, 9173, 14082, 9763, 4517, 6184; Payload ID: 11420 relates to Category No.: 11861, 6185, 9173; Payload ID: 11421 relates to Category No.: 3303, 15524, 15495, 5109, 11861, 9173, 6184, 14229, 15409, 15503, 14471, 14471, 14082, 5112, 14087, 3936, 11920, 2405, 9763, 14242; Payload ID: 11422 relates to Category No.: 3303, 11861, 14471, 2405, 11886, 14082, 4517, 14242, 6184, 14087, 15504, 15495, 5109, 12064, 9122; Payload ID: 11423 relates to Category No.: 15491, 15495, 11861, 2691, 3936, 9173, 686, 4517, 12402, 5109, 14082, 14087, 15493; Payload ID: 11424 relates to Category No.: 894, 11861; Payload ID: 11425 relates to Category No.: 894, 11861; Payload ID: 11426 relates to Category No.: 3303, 14196, 11939, 14471, 15504, 15495, 14968, 14251, 6183, 11920, 11861, 3324, 14969, 488; Payload ID: 11427 relates to Category No.: 3303, 11939, 15504, 15495, 14968, 11920, 11861, 11886, 14082, 9763, 14087, 15409; Payload ID: 11428 relates to Category No.: 16331, 15503, 14471, 14234, 14471, 4976, 15524, 15495, 14968, 14251, 6183, 14243, 11861, 2691, 15530, 14233, 15496, 3303; Payload ID: 11429 relates to Category No.: 16331, 15503, 14471, 14471, 14968, 14251, 6183, 11861, 2691, 3303; Payload ID: 11430 relates to Category No.: 16331, 15503, 14471, 14471, 14968, 3303, 14234, 11861, 15528, 14233, 943, 784, 14251, 6183, 14087, 14251, 14474; Payload ID: 11431 relates to Category No.: 3303, 16331, 15503, 14471, 14471, 15524, 15491, 14968, 14251, 6183, 11861, 2346, 14985, 15528, 14233, 14234, 11933, 14087; Payload ID: 11432 relates to Category No.: 16331, 15503, 14471, 14471, 15491, 15495, 14968, 14251, 6183, 11861, 15528, 14233, 15408, 15503, 14239, 14240, 6184, 15528, 14252, 1185, 1190, 2313, 14087, 3303, 12399, 9629, 3459; Payload ID: 11433 relates to Category No.: 16331, 15503, 14471, 14471, 14968, 15408, 15491, 14251, 6183, 14243, 11861, 3471, 15528, 14255; Payload ID: 11434 relates to Category No.: 3303, 16331, 15503, 14471, 14471, 685, 15491, 14251, 6183, 14243, 15408, 15528, 14255, 14968, 11861; Payload ID: 11435 relates to Category No.: 3303, 16331, 15503, 14471, 14471, 12399, 14968, 11861, 15530, 14233, 11939, 14234, 5109; Payload ID: 11436 relates to Category No.: 16331, 15503, 14471, 11933, 14471, 15491, 12399, 14968, 11861, 3303; Payload ID: 11437 relates to Category No.: 16331, 15503, 14471, 14471, 14968, 15528, 14233, 15530, 14233, 3303, 11861, 3752, 5109; Payload ID: 11438 relates to Category No.: 16331, 15503, 14471, 14471, 14968, 14251, 6183, 11861; Payload ID: 11439 relates to Category No.: 16331, 15503, 14471, 14471, 15491, 14968, 14251, 6183, 11861; Payload ID: 11440 relates to Category No.: 16331, 15503, 14471, 11939, 14471, 15495, 14968, 14251, 6183, 11861, 14077, 3303; Payload ID: 11441 relates to Category No.: 3303, 16331, 15503, 14471, 14471, 14968, 14251, 6183, 11861, 15408, 14240, 15530, 14255; Payload ID: 11442 relates to Category No.: 3303, 16331, 15503, 14471, 14234, 14471, 14961, 11861, 15528, 14233, 4516, 4519, 14966, 11917; Payload ID: 11443 relates to Category No.: 16331, 15503, 14471, 14471, 14961, 14968, 11861; Payload ID: 11444 relates to Category No.: 3303, 14251, 6183, 16331, 15503, 14471, 14471, 14968, 15528, 14233, 11861, 11939, 11933, 15504, 4517; Payload ID: 11445 relates to Category No.: 16331, 15503, 14471, 11933, 14471, 14968, 14251, 6183, 11861, 15528, 14233, 14243, 3303, 15528, 14255, 14237, 4517; Payload ID: 11446 relates to Category No.: 3303, 16331, 15503, 14471, 11939, 14471, 11981, 14968, 11861, 2691, 15528, 14233, 15408, 14234, 5101, 15492, 4517; Payload ID: 11447 relates to Category No.: 3303, 16331, 15503, 14471, 2405, 14471, 9939, 15491, 14968, 14251, 6183, 11861, 15525, 3752, 15503, 14239, 14240, 3459; Payload ID: 11448 relates to Category No.: 3303, 16331, 15503, 14471, 2405, 14471, 15524, 9939, 14968, 14251, 6183, 11861, 15525, 15503, 14239, 14240, 15528, 14233, 14234, 3459; Payload ID: 11449 relates to Category No.: 3303, 16331, 15503, 14471, 11939, 14471, 14968, 14251, 6183, 15528, 14233, 11861, 14234; Payload ID: 11450 relates to Category No.: 14234, 11939, 11861, 2691, 15528, 14233; Payload ID: 11451 relates to Category No.: 9282, 14196, 10116, 11861, 14602; Payload ID: 11452 relates to Category No.: 9282, 14196, 10116, 11861; Payload ID: 11453 relates to Category No.: 9282, 14196, 11861, 10116; Payload ID: 11454 relates to Category No.: 9282, 14196, 10116, 11861, 7268; Payload ID: 11455 relates to Category No.: 9282, 14196, 10116, 11861; Payload ID: 11456 relates to Category No.: 10116, 7268, 11861; Payload ID: 11457 relates to Category No.: 3303, 15503, 14471, 15524, 11861, 2691, 15504, 15494; Payload ID: 11458 relates to Category No.: 3303, 11933, 14471, 15524, 11861, 13735, 15503, 14471, 11886; Payload ID: 11459 relates to Category No.: 3303, 15503, 14471, 11933, 15524, 15491, 11861, 15528, 14233, 14234, 15504; Payload ID: 11460 relates to Category No.: 16331, 9226, 15503, 14471, 6188, 10116, 14243, 11861, 15530, 14233; Payload ID: 11461 relates to Category No.: 16331, 15503, 14471, 14243, 11861, 15530, 14233; Payload ID: 11462 relates to Category No.: 15629, 12382, 11861; Payload ID: 11463 relates to Category No.: 11861, 12382; Payload ID: 11464 relates to Category No.: 11861; Payload ID: 11465 relates to Category No.: 926, 10116, 11861, 11716; Payload ID: 11466 relates to Category No.: 9226, 14597, 11861, 14196; Payload ID: 11467 relates to Category No.: 9226, 14597, 11861; Payload ID: 11468 relates to Category No.: 1405, 3303, 11861, 4804; Payload ID: 11469 relates to Category No.: 1405, 15777; Payload ID: 11470 relates to Category No.: 926, 4886, 10116, 11861; Payload ID: 11471 relates to Category No.: 3303, 6965, 10116, 11861; Payload ID: 11472 relates to Category No.: 10116, 11861, 1201; Payload ID: 11473 relates to Category No.: 10116, 11861; Payload ID: 11474 relates to Category No.: 10116, 11861; Payload ID: 11475 relates to Category No.: 14309, 10116, 11861; Payload ID: 11476 relates to Category No.: 1405, 14196, 2859, 11861, 5347, 1626, 12402, 3005, 3007; Payload ID: 11477 relates to Category No.: 14196, 11861; Payload ID: 11478 relates to Category No.: 11861; Payload ID: 11479 relates to Category No.: 10116, 11861; Payload ID: 11480 relates to Category No.: 10116; Payload ID: 11481 relates to Category No.: 9282, 9226, 10116, 11861; Payload ID: 11482 relates to Category No.: 926, 14196, 4886, 11861, 10142; Payload ID: 11483 relates to Category No.: 9282, 9226, 14196, 10116, 11861; Payload ID: 11484 relates to Category No.: 14196, 10116, 11861, 1201; Payload ID: 11485 relates to Category No.: 9282, 9226, 14196, 11895, 10116, 11861, 5347, 15265, 14471, 1405, 14597, 12402, 6024, 5105, 14424, 14317, 3843; Payload ID: 11486 relates to Category No.: 14196, 11939, 11933, 15973, 5105, 15491, 11981, 10116, 11861, 11991, 14163, 15229, 14170, 9014, 9226; Payload ID: 11487 relates to Category No.: 9226, 5105, 11861, 2405, 3752; Payload ID: 11488 relates to Category No.: 10116, 11861; Payload ID: 11489 relates to Category No.: 15026, 11861, 9239; Payload ID: 11490 relates to Category No.: 11861, 9239; Payload ID: 11491 relates to Category No.: 3303, 16331, 15629, 15026, 11861, 5347, 11854, 9239, 9179, 3459, 2405, 12382; Payload ID: 11492 relates to Category No.: 15629, 15026, 11861; Payload ID: 11493 relates to Category No.: 11861, 9239; Payload ID: 11494 relates to Category No.: 1201; Payload ID: 11495 relates to Category No.: 15026, 11861; Payload ID: 11496 relates to Category No.: 11917; Payload ID: 11498 relates to Category No.: 15629, 11861, 9239, 9179; Payload ID: 11499 relates to Category No.: 11861; Payload ID: 11500 relates to Category No.: 11861; Payload ID: 11501 relates to Category No.: 11861; Payload ID: 11502 relates to Category No.: 11861; Payload ID: 11503 relates to Category No.: 11861, 9239; Payload ID: 11504 relates to Category No.: 11861, 9179, 9239; Payload ID: 11505 relates to Category No.: 2405, 12416, 15026, 11861, 15887, 14536, 9239, 15409, 5960; Payload ID: 11506 relates to Category No.: 15026, 11861; Payload ID: 11507 relates to Category No.: 11861; Payload ID: 11508 relates to Category No.: 15629, 11861; Payload ID: 11509 relates to Category No.: 15026; Payload ID: 11510 relates to Category No.: 15629, 15026, 11861, 9179, 9629; Payload ID: 11511 relates to Category No.: 6816, 10116, 9170; Payload ID: 11512 relates to Category No.: 12169, 11861, 15363; Payload ID: 11515 relates to Category No.: 926, 10116, 9288, 312, 9269; Payload ID: 11516 relates to Category No.: 10116, 11861; Payload ID: 11517 relates to Category No.: 11861, 2405, 5105; Payload ID: 11519 relates to Category No.: 15973, 10116, 11861; Payload ID: 11522 relates to Category No.: 926, 9282, 6816, 5875, 138, 11861; Payload ID: 11523 relates to Category No.: 926, 9282, 6816, 138, 11861; Payload ID: 11524 relates to Category No.: 926, 6816, 138; Payload ID: 11525 relates to Category No.: 926, 11939, 11861, 5347, 2853, 1539, 9654; Payload ID: 11526 relates to Category No.: 926, 267, 11981, 11861, 3752, 5282, 5280, 1539, 9654, 7327; Payload ID: 11527 relates to Category No.: 14243, 15530, 14255, 11861; Payload ID: 11528 relates to Category No.: 11861; Payload ID: 11529 relates to Category No.: 11861; Payload ID: 11530 relates to Category No.: 11861; Payload ID: 11531 relates to Category No.: 11861; Payload ID: 11532 relates to Category No.: 6965, 11861; Payload ID: 11533 relates to Category No.: 6965, 11861, 1173, 598, 11886, 9351; Payload ID: 11534 relates to Category No.: 6816, 5308, 4895, 14712, 11861, 189, 187, 4890, 929; Payload ID: 11535 relates to Category No.: 6816, 5308, 11861, 3280, 5483, 5525, 5528, 5530, 5523, 5524, 5527; Payload ID: 11536 relates to Category No.: 6816, 5308, 3280, 5483, 5525, 5528, 5530, 5523, 5524, 5527; Payload ID: 11537 relates to Category No.: 6816, 5308, 11861, 7507, 7491; Payload ID: 11538 relates to Category No.: 6816, 5308; Payload ID: 11539 relates to Category No.: 6816, 5308, 5308, 305, 5405, 11861, 15957, 465; Payload ID: 11540 relates to Category No.: 6816, 5308, 189, 187; Payload ID: 11541 relates to Category No.: 4886, 5308, 6478, 11939, 14712, 7268, 5347, 9288, 312, 6574, 6828, 2542, 6450, 3296, 5476, 3240, 16315, 5905; Payload ID: 11542 relates to Category No.: 5308, 14712, 10116, 11861; Payload ID: 11543 relates to Category No.: 6816, 5308; Payload ID: 11544 relates to Category No.: 5308, 6478, 11861, 190, 191, 186; Payload ID: 11545 relates to Category No.: 6816, 5308, 12402; Payload ID: 11546 relates to Category No.: 4886, 5308, 11861, 1221, 1222; Payload ID: 11547 relates to Category No.: 14196, 5308, 11939, 5109, 10116, 7268, 11861, 992; Payload ID: 11548 relates to Category No.: 5308, 11861; Payload ID: 11549 relates to Category No.: 5308, 6478, 3280, 5483, 5525, 5528, 5530, 5523, 5524, 5527; Payload ID: 11550 relates to Category No.: 6816, 5308, 14712, 11861, 3280, 5483, 5525, 5528, 5530, 5523, 5524, 5527; Payload ID: 11551 relates to Category No.: 5308, 6478, 465, 14712, 469, 9268; Payload ID: 11552 relates to Category No.: 5308, 4864; Payload ID: 11553 relates to Category No.: 5308, 6478, 12402, 14712, 5308, 305, 5405, 7192, 6574, 234; Payload ID: 11554 relates to Category No.: 6816, 5308; Payload ID: 11555 relates to Category No.: 5308, 465, 469, 424; Payload ID: 11556 relates to Category No.: 11861, 7192; Payload ID: 11557 relates to Category No.: 11861, 1153, 1369, 581; Payload ID: 11558 relates to Category No.: 11861; Payload ID: 11559 relates to Category No.: 11861, 7192; Payload ID: 11560 relates to Category No.: 11861, 7192, 11711, 15542, 15550; Payload ID: 11567 relates to Category No.: 11861; Payload ID: 11568 relates to Category No.: 11861, 7192; Payload ID: 11569 relates to Category No.: 9226, 7192; Payload ID: 11570 relates to Category No.: 3303, 2963, 1630, 6924, 3396, 6901, 1405; Payload ID: 11571 relates to Category No.: 11861, 2998, 12245; Payload ID: 11572 relates to Category No.: 926, 6816, 4886, 942, 14176, 11861, 14163; Payload ID: 11573 relates to Category No.: 926, 6816, 14107, 12109, 1457, 15429, 11861, 15024, 712, 11978; Payload ID: 11574 relates to Category No.: 11861, 2931; Payload ID: 11575 relates to Category No.: 11920, 11861, 14351, 15360; Payload ID: 11577 relates to Category No.: 11861; Payload ID: 11579 relates to Category No.: 4894, 12363, 11861, 9886, 5502; Payload ID: 11580 relates to Category No.: 15629, 11861, 6366; Payload ID: 11582 relates to Category No.: 9226, 6816, 11861; Payload ID: 11583 relates to Category No.: 9226, 6816, 14471, 11861, 14243, 15528, 14255; Payload ID: 11584 relates to Category No.: 11861; Payload ID: 11585 relates to Category No.: 9322; Payload ID: 11586 relates to Category No.: 9322; Payload ID: 11587 relates to Category No.: 9322; Payload ID: 11588 relates to Category No.: 5308, 311, 9330, 7419, 9548; Payload ID: 11589 relates to Category No.: 11861, 1146; Payload ID: 11590 relates to Category No.: 11861; Payload ID: 11591 relates to Category No.: 11861; Payload ID: 11592 relates to Category No.: 11939, 1630, 1369, 11861; Payload ID: 11594 relates to Category No.: 11939, 4016; Payload ID: 11595 relates to Category No.: 4016; Payload ID: 11597 relates to Category No.: 14564; Payload ID: 11598 relates to Category No.: 4820, 9343; Payload ID: 11599 relates to Category No.: 4820, 9343; Payload ID: 11600 relates to Category No.: 4820, 9343; Payload ID: 11601 relates to Category No.: 4820, 15617, 9343; Payload ID: 11602 relates to Category No.: 4820, 15617, 9343; Payload ID: 11603 relates to Category No.: 4820, 15617, 9343; Payload ID: 11604 relates to Category No.: 4820, 9343; Payload ID: 11605 relates to Category No.: 4820, 9343; Payload ID: 11606 relates to Category No.: 4820, 9343, 9322; Payload ID: 11607 relates to Category No.: 4820, 9343, 9322; Payload ID: 11608 relates to Category No.: 4820, 9343, 9322; Payload ID: 11609 relates to Category No.: 4820, 9343, 9322; Payload ID: 11610 relates to Category No.: 4820, 9343, 9322; Payload ID: 11611 relates to Category No.: 4820, 9343; Payload ID: 11612 relates to Category No.: 4820, 9343; Payload ID: 11613 relates to Category No.: 4820, 15617, 9343; Payload ID: 11614 relates to Category No.: 4820, 9343; Payload ID: 11615 relates to Category No.: 4820, 9343; Payload ID: 11616 relates to Category No.: 4820, 9343; Payload ID: 11617 relates to Category No.: 4820, 15617, 9343; Payload ID: 11618 relates to Category No.: 4820, 15617, 9343, 12399; Payload ID: 11619 relates to Category No.: 4820, 9343; Payload ID: 11620 relates to Category No.: 4820, 15617, 9343; Payload ID: 11621 relates to Category No.: 4820, 15617, 9343; Payload ID: 11622 relates to Category No.: 4820, 15617, 9343; Payload ID: 11623 relates to Category No.: 4820, 15617, 9343; Payload ID: 11624 relates to Category No.: 4820, 15617, 9343; Payload ID: 11625 relates to Category No.: 4820, 15617, 9343; Payload ID: 11626 relates to Category No.: 4820, 9343; Payload ID: 11627 relates to Category No.: 4820, 9343; Payload ID: 11628 relates to Category No.: 4820, 9343; Payload ID: 11629 relates to Category No.: 4820, 9343; Payload ID: 11630 relates to Category No.: 4820, 9343; Payload ID: 11631 relates to Category No.: 4820, 9343; Payload ID: 11632 relates to Category No.: 4820, 15617, 9343; Payload ID: 11633 relates to Category No.: 4820, 15617, 9343; Payload ID: 11634 relates to Category No.: 4820, 9343; Payload ID: 11635 relates to Category No.: 4820, 15617, 9343; Payload ID: 11636 relates to Category No.: 4820, 15617, 9343; Payload ID: 11637 relates to Category No.: 4820, 9343; Payload ID: 11638 relates to Category No.: 4820, 9343; Payload ID: 11639 relates to Category No.: 4820, 9343; Payload ID: 11640 relates to Category No.: 4820, 9343; Payload ID: 11641 relates to Category No.: 4820, 9343; Payload ID: 11642 relates to Category No.: 4820, 9343; Payload ID: 11644 relates to Category No.: 4820, 9343; Payload ID: 11645 relates to Category No.: 4820, 9343; Payload ID: 11646 relates to Category No.: 4820; Payload ID: 11647 relates to Category No.: 4820, 9343; Payload ID: 11648 relates to Category No.: 4820, 9343; Payload ID: 11649 relates to Category No.: 4820, 9343; Payload ID: 11650 relates to Category No.: 4820, 9343; Payload ID: 11651 relates to Category No.: 4820, 9343; Payload ID: 11652 relates to Category No.: 4820, 9343; Payload ID: 11653 relates to Category No.: 4820, 9343; Payload ID: 11654 relates to Category No.: 4820, 9343; Payload ID: 11655 relates to Category No.: 4820, 9343; Payload ID: 11656 relates to Category No.: 4820, 9343; Payload ID: 11657 relates to Category No.: 4820, 9343; Payload ID: 11658 relates to Category No.: 4820, 9343, 7192; Payload ID: 11659 relates to Category No.: 4820, 9343; Payload ID: 11660 relates to Category No.: 4820, 9343, 9322; Payload ID: 11661 relates to Category No.: 4820, 15617, 9343; Payload ID: 11663 relates to Category No.: 4820, 9343; Payload ID: 11664 relates to Category No.: 4820, 15617, 9343; Payload ID: 11665 relates to Category No.: 4820, 15617, 9343; Payload ID: 11666 relates to Category No.: 4820, 9343; Payload ID: 11667 relates to Category No.: 4820, 9343, 9322; Payload ID: 11668 relates to Category No.: 4820, 15617, 9343; Payload ID: 11669 relates to Category No.: 4820, 9343; Payload ID: 11670 relates to Category No.: 4820, 15617, 9343; Payload ID: 11671 relates to Category No.: 4820, 9343, 9322; Payload ID: 11672 relates to Category No.: 4820, 9343, 9322; Payload ID: 11673 relates to Category No.: 4820, 9343; Payload ID: 11674 relates to Category No.: 4820, 15617, 9343; Payload ID: 11675 relates to Category No.: 4820, 9343; Payload ID: 11676 relates to Category No.: 4820, 9343; Payload ID: 11677 relates to Category No.: 4820, 9343; Payload ID: 11678 relates to Category No.: 4820, 9343; Payload ID: 11679 relates to Category No.: 4820, 9343; Payload ID: 11680 relates to Category No.: 4820, 9343; Payload ID: 11681 relates to Category No.: 4820, 9343; Payload ID: 11683 relates to Category No.: 4820, 9343, 9322, 7192; Payload ID: 11685 relates to Category No.: 4820, 15617, 9343; Payload ID: 11686 relates to Category No.: 4820, 15617, 9343; Payload ID: 11687 relates to Category No.: 4820, 9343, 9322; Payload ID: 11688 relates to Category No.: 4820, 9343; Payload ID: 11689 relates to Category No.: 4820, 9343; Payload ID: 11690 relates to Category No.: 4820, 9343; Payload ID: 11691 relates to Category No.: 4820, 9343; Payload ID: 11693 relates to Category No.: 4820, 9343; Payload ID: 11694 relates to Category No.: 4820, 9343; Payload ID: 11695 relates to Category No.: 4820, 9343; Payload ID: 11696 relates to Category No.: 4820, 9343; Payload ID: 11697 relates to Category No.: 4820, 15617, 9343; Payload ID: 11698 relates to Category No.: 4820, 9343; Payload ID: 11699 relates to Category No.: 4820, 9343; Payload ID: 11700 relates to Category No.: 4820, 9343, 9322; Payload ID: 11701 relates to Category No.: 4820, 9343, 9322; Payload ID: 11702 relates to Category No.: 4820, 9343, 9322; Payload ID: 11703 relates to Category No.: 4820, 9343, 9322; Payload ID: 11704 relates to Category No.: 4820, 9343, 9322; Payload ID: 11705 relates to Category No.: 4820, 9343, 9322; Payload ID: 11706 relates to Category No.: 4820, 9343; Payload ID: 11707 relates to Category No.: 4820, 9343; Payload ID: 11708 relates to Category No.: 4820, 9343; Payload ID: 11709 relates to Category No.: 4820, 15617, 9343; Payload ID: 11710 relates to Category No.: 4820, 15617, 9343; Payload ID: 11711 relates to Category No.: 4820, 15617, 9343, 7192; Payload ID: 11712 relates to Category No.: 4820, 9343; Payload ID: 11713 relates to Category No.: 4820, 9343; Payload ID: 11714 relates to Category No.: 4820, 15617, 9343; Payload ID: 11715 relates to Category No.: 4820, 9343; Payload ID: 11716 relates to Category No.: 4820, 9343, 11861; Payload ID: 11717 relates to Category No.: 4820, 9343; Payload ID: 11718 relates to Category No.: 4820, 9343; Payload ID: 11719 relates to Category No.: 4820, 9343; Payload ID: 11720 relates to Category No.:

4820, 9343; Payload ID: 11721 relates to Category No.: 4820, 15617, 9343; Payload ID: 11722 relates to Category No.: 4820, 9343; Payload ID: 11723 relates to Category No.: 4820, 9343; Payload ID: 11724 relates to Category No.: 4820, 9343; Payload ID: 11725 relates to Category No.: 4820, 9343; Payload ID: 11726 relates to Category No.: 4820, 9343; Payload ID: 11727 relates to Category No.: 4820, 9343; Payload ID: 11728 relates to Category No.: 4820, 9343; Payload ID: 11729 relates to Category No.: 4820, 9343; Payload ID: 11730 relates to Category No.: 4820, 9343; Payload ID: 11731 relates to Category No.: 4820, 9343; Payload ID: 11732 relates to Category No.: 4820, 9343; Payload ID: 11733 relates to Category No.: 4820, 9343; Payload ID: 11734 relates to Category No.: 4820, 9343; Payload ID: 11735 relates to Category No.: 4820, 9343; Payload ID: 11736 relates to Category No.: 4820, 9343; Payload ID: 11737 relates to Category No.: 4820, 9343; Payload ID: 11738 relates to Category No.: 4820, 9343; Payload ID: 11739 relates to Category No.: 4820, 9343; Payload ID: 11740 relates to Category No.: 4820, 9343; Payload ID: 11741 relates to Category No.: 4820, 9343, 11861; Payload ID: 11742 relates to Category No.: 4820, 9343, 7192; Payload ID: 11743 relates to Category No.: 4820, 9343, 7192; Payload ID: 11744 relates to Category No.: 4820, 9343, 7192; Payload ID: 11745 relates to Category No.: 4820, 9343, 7192; Payload ID: 11746 relates to Category No.: 4820, 9343; Payload ID: 11747 relates to Category No.: 4820, 9343; Payload ID: 11748 relates to Category No.: 4820, 9343; Payload ID: 11749 relates to Category No.: 4820, 9343; Payload ID: 11750 relates to Category No.: 4820, 9343; Payload ID: 11751 relates to Category No.: 4820, 9343; Payload ID: 11752 relates to Category No.: 4820, 9343; Payload ID: 11753 relates to Category No.: 4820, 9343; Payload ID: 11754 relates to Category No.: 4820, 9343; Payload ID: 11755 relates to Category No.: 4820, 9343; Payload ID: 11756 relates to Category No.: 4820, 9343; Payload ID: 11757 relates to Category No.: 4820, 9343; Payload ID: 11758 relates to Category No.: 4820, 9343; Payload ID: 11759 relates to Category No.: 4820, 9343; Payload ID: 11760 relates to Category No.: 4820, 9343; Payload ID: 11761 relates to Category No.: 4820, 9343; Payload ID: 11762 relates to Category No.: 4820, 9343; Payload ID: 11763 relates to Category No.: 4820, 9343; Payload ID: 11764 relates to Category No.: 4820, 9343; Payload ID: 11765 relates to Category No.: 4820, 9343; Payload ID: 11766 relates to Category No.: 4820, 9343; Payload ID: 11767 relates to Category No.: 4820, 9343; Payload ID: 11768 relates to Category No.: 4820, 9343; Payload ID: 11769 relates to Category No.: 4820, 9343; Payload ID: 11770 relates to Category No.: 4820, 9343; Payload ID: 11771 relates to Category No.: 4820, 9343; Payload ID: 11772 relates to Category No.: 4820, 9343; Payload ID: 11773 relates to Category No.: 4820, 9343; Payload ID: 11774 relates to Category No.: 4820, 9343; Payload ID: 11775 relates to Category No.: 4820, 9343, 12399; Payload ID: 11776 relates to Category No.: 4820, 9343; Payload ID: 11777 relates to Category No.: 4820, 15617, 9343; Payload ID: 11778 relates to Category No.: 4820, 15617, 9343; Payload ID: 11779 relates to Category No.: 4820, 15617, 9343; Payload ID: 11780 relates to Category No.: 4820, 15617, 9343; Payload ID: 11782 relates to Category No.: 4820, 15617, 9343; Payload ID: 11783 relates to Category No.: 4820, 15617, 9343; Payload ID: 11784 relates to Category No.: 4820, 15617, 9343; Payload ID: 11785 relates to Category No.: 4820, 15617, 9343; Payload ID: 11786 relates to Category No.: 4820, 15617, 9343; Payload ID: 11787 relates to Category No.: 4820, 15617, 9343; Payload ID: 11788 relates to Category No.: 4820, 15617, 9343; Payload ID: 11789 relates to Category No.: 4820, 15617, 9343; Payload ID: 11790 relates to Category No.: 4820, 15617, 9343; Payload ID: 11791 relates to Category No.: 4820, 15617, 9343; Payload ID: 11792 relates to Category No.: 4820, 15617, 9343; Payload ID: 11793 relates to Category No.: 4820, 15617, 9343; Payload ID: 11794 relates to Category No.: 4820, 15617, 9343; Payload ID: 11795 relates to Category No.: 4820, 15617, 9343; Payload ID: 11796 relates to Category No.: 4820, 15617, 9343; Payload ID: 11797 relates to Category No.: 4820, 15617, 9343; Payload ID: 11798 relates to Category No.: 4820, 15617, 9343; Payload ID: 11799 relates to Category No.: 4820, 15617, 9343; Payload ID: 11800 relates to Category No.: 4820, 15617, 9343; Payload ID: 11801 relates to Category No.: 4820, 15617, 9343; Payload ID: 11802 relates to Category No.: 4820, 15617, 9343; Payload ID: 11803 relates to Category No.: 4820, 15617, 9343; Payload ID: 11804 relates to Category No.: 4820, 15617, 9343; Payload ID: 11805 relates to Category No.: 4820, 15617, 9343; Payload ID: 11806 relates to Category No.: 4820, 15617, 9343; Payload ID: 11807 relates to Category No.: 4820, 15617, 9343; Payload ID: 11808 relates to Category No.: 4820, 15617, 9343; Payload ID: 11809 relates to Category No.: 4820, 15617, 9343; Payload ID: 11810 relates to Category No.: 4820, 15617, 9343; Payload ID: 11811 relates to Category No.: 4820, 15617, 9343; Payload ID: 11812 relates to Category No.: 4820, 15617, 9343; Payload ID: 11813 relates to Category No.: 4820, 15617, 9343; Payload ID: 11814 relates to Category No.: 4820, 15617, 9343; Payload ID: 11815 relates to Category No.: 4820, 15617, 9343; Payload ID: 11816 relates to Category No.: 4820, 15617, 9343; Payload ID: 11817 relates to Category No.: 4820, 15617, 9343; Payload ID: 11818 relates to Category No.: 4820, 15617, 9343; Payload ID: 11819 relates to Category No.: 4820, 15617, 9343; Payload ID: 11820 relates to Category No.: 15617, 4820, 9343; Payload ID: 11821 relates to Category No.: 4820, 15617, 9343; Payload ID: 11822 relates to Category No.: 4820, 15617, 9343; Payload ID: 11823 relates to Category No.: 4820, 9343; Payload ID: 11824 relates to Category No.: 4820, 15617, 9343; Payload ID: 11825 relates to Category No.: 4820, 15617, 9343; Payload ID: 11826 relates to Category No.: 4820, 15617, 9343; Payload ID: 11827 relates to Category No.: 4820, 15617, 9343; Payload ID: 11828 relates to Category No.: 4820, 15617, 9343; Payload ID: 11829 relates to Category No.: 4820, 9343, 9322; Payload ID: 11830 relates to Category No.: 4820, 9343, 9322; Payload ID: 11832 relates to Category No.: 4820, 9343, 9322; Payload ID: 11833 relates to Category No.: 4820, 9343, 9322; Payload ID: 11834 relates to Category No.: 4820, 9343, 9322; Payload ID: 11835 relates to Category No.: 4820, 9343, 9322; Payload ID: 11836 relates to Category No.: 4820, 9343, 9322; Payload ID: 11837 relates to Category No.: 4820, 9343, 9322; Payload ID: 11838 relates to Category No.: 4820, 9343, 9322; Payload ID: 11839 relates to Category No.: 4820, 9343, 9322; Payload ID: 11840 relates to Category No.: 4820, 9343, 9322; Payload ID: 11841 relates to Category No.: 4820, 9343, 9322; Payload ID: 11842 relates to Category No.: 4820, 9343, 9322; Payload ID: 11843 relates to Category No.: 4820, 9343, 9322; Payload ID: 11844 relates to Category No.: 4820, 9343, 9322; Payload ID: 11845 relates to Category No.: 4820, 9343, 9322; Payload ID: 11846 relates to Category No.: 4820, 9343, 9322; Payload ID: 11847 relates to Category No.: 4820, 9343, 9322; Payload ID: 11848 relates to Category No.: 4820, 9343, 9322; Payload ID: 11849 relates to Category No.: 4820, 9343; Payload ID: 11851 relates to Category No.: 4820, 9343, 9322; Payload ID: 11852 relates to Category No.: 4820, 9343, 9322; Payload ID: 11853 relates to Category No.: 4820, 9343, 9322; Payload ID: 11854 relates to Category No.: 4820, 9343, 9322; Payload ID: 11855 relates to Category No.: 4820, 9343, 9322; Payload ID: 11857 relates to Category No.: 4820, 9343, 9322; Payload ID: 11858 relates to Category No.: 4820, 9343, 9322; Payload ID: 11859 relates to Category No.: 4820, 9343, 9322; Payload ID: 11860 relates to Category No.: 4820, 9343, 9322; Payload ID: 11861 relates to Category No.: 4820, 9343, 9322; Payload ID: 11862 relates to Category No.: 4820, 9343, 9322; Payload ID: 11863 relates to Category No.: 4820, 9343, 9322; Payload ID: 11864 relates to Category No.: 4820, 9343, 9322; Payload ID: 11865 relates to Category No.: 4820, 9343, 9322; Payload ID: 11866 relates to Category No.: 4820, 9343, 9322; Payload ID: 11867 relates to Category No.: 4820, 9343, 9322; Payload ID: 11868 relates to Category No.: 4820, 9343, 9322; Payload ID: 11869 relates to Category No.: 4820, 9343, 9322; Payload ID: 11870 relates to Category No.: 4820, 9343, 9322; Payload ID: 11871 relates to Category No.: 4820, 9343, 9322; Payload ID: 11872 relates to Category No.: 4820, 9343, 9322; Payload ID: 11873 relates to Category No.: 4820, 9343, 9322; Payload ID: 11874 relates to Category No.: 4820, 9343; Payload ID: 11875 relates to Category No.: 4820, 9343; Payload ID: 11876 relates to Category No.: 4820, 9343; Payload ID: 11877 relates to Category No.: 4820, 9343; Payload ID: 11878 relates to Category No.: 4820, 9343, 9322; Payload ID: 11879 relates to Category No.: 4820, 9343; Payload ID: 11880 relates to Category No.: 4820, 9343; Payload ID: 11881 relates to Category No.: 4820, 9343; Payload ID: 11882 relates to Category No.: 4820, 9343; Payload ID: 11883 relates to Category No.: 4820, 9343; Payload ID: 11884 relates to Category No.: 4820, 9343; Payload ID: 11885 relates to Category No.: 4820, 9343; Payload ID: 11886 relates to Category No.: 4820, 9343; Payload ID: 11887 relates to Category No.: 4820, 9343; Payload ID: 11888 relates to Category No.: 4820, 9343, 14968, 14582; Payload ID: 11889 relates to Category No.: 4820, 9343; Payload ID: 11890 relates to Category No.: 4820, 9343; Payload ID: 11891 relates to Category No.: 4820, 9343; Payload ID: 11892 relates to Category No.: 4820, 9343; Payload ID: 11893 relates to Category No.: 4820, 9343; Payload ID: 11894 relates to Category No.: 4820, 9343; Payload ID: 11895 relates to Category No.: 4820, 9343; Payload ID: 11896 relates to Category No.: 4820, 9343; Payload ID: 11897 relates to Category No.: 4820, 9343; Payload ID: 11898 relates to Category No.: 4820, 9343; Payload ID: 11899 relates to Category No.: 4820, 9343; Payload ID: 11900 relates to Category No.: 4820, 9343; Payload ID: 11901 relates to Category No.: 4820, 9343; Payload ID: 11902 relates to Category No.: 4820, 9343; Payload ID: 11903 relates to Category No.: 4820, 15617, 9343; Payload ID: 11904 relates to Category No.: 4820, 9343; Payload ID: 11905 relates to Category No.: 4820, 9343; Payload ID: 11906 relates to Category No.: 4820, 9343; Payload ID: 11907 relates to Category No.: 4820, 9343; Payload ID: 11908 relates to Category No.: 4820, 9343; Payload ID: 11909 relates to Category No.: 4820, 9343; Payload ID: 11910 relates to Category No.: 4820, 9343; Payload ID: 11911 relates to Category No.: 4820, 9343; Payload ID: 11912 relates to Category No.: 4820, 9343; Payload ID: 11913 relates to Category No.: 4820, 9343; Payload ID: 11914 relates to Category No.: 4820, 9343; Payload ID: 11915 relates to Category No.: 4820, 9343; Payload ID: 11916 relates to Category No.: 4820, 9343; Payload ID: 11917 relates to Category No.: 4820, 9343; Payload ID: 11918 relates to Category No.: 4820, 9343; Payload ID: 11919 relates to Category No.: 4820, 9343; Payload ID: 11920 relates to Category No.: 4820, 9343; Payload ID: 11921 relates to Category No.: 4820, 9343; Payload ID: 11922 relates to Category No.: 4820, 9343; Payload ID: 11923 relates to Category No.: 4820, 9343; Payload ID: 11924 relates to Category No.: 4820, 9343; Payload ID: 11925 relates to Category No.: 4820, 9343; Payload ID: 11926 relates to Category No.: 4820, 9343; Payload ID: 11927 relates to Category No.: 4820, 9343; Payload ID: 11928 relates to Category No.: 4820, 9343; Payload ID: 11929 relates to Category No.: 9343; Payload ID: 11930 relates to Category No.: 4820, 9343; Payload ID: 11931 relates to Category No.: 9343; Payload ID: 11932 relates to Category No.: 4820, 9343; Payload ID: 11933 relates to Category No.: 4820, 9343; Payload ID: 11934 relates to Category No.: 4820, 9343; Payload ID: 11935 relates to Category No.: 4820, 9343; Payload ID: 11936 relates to Category No.: 4820, 9343; Payload ID: 11937 relates to Category No.: 4820, 9343, 9322; Payload ID: 11938 relates to Category No.: 4820, 9343, 9322; Payload ID: 11939 relates to Category No.: 4820, 9343; Payload ID: 11940 relates to Category No.: 4820, 9343; Payload ID: 11941 relates to Category No.: 4820, 9343; Payload ID: 11942 relates to Category No.: 4820, 9343; Payload ID: 11943 relates to Category No.: 4820, 9343; Payload ID: 11944 relates to Category No.: 4820, 9343; Payload ID: 11945 relates to Category No.: 4820, 9343; Payload ID: 11946 relates to Category No.: 4820, 9343; Payload ID: 11947 relates to Category No.: 4820, 9343; Payload ID: 11948 relates to Category No.: 4820, 9343; Payload ID: 11949 relates to Category No.: 4820, 9343; Payload ID: 11950 relates to Category No.: 4820, 9343; Payload ID: 11951 relates to Category No.: 4820, 9343; Payload ID: 11952 relates to Category No.: 4820, 15617, 9343; Payload ID: 11953 relates to Category No.: 4820, 15617, 9343; Payload ID: 11954 relates to Category No.: 4820, 15617, 9343; Payload ID: 11955 relates to Category No.: 4820, 9343; Payload ID: 11956 relates to Category No.: 4820, 9343; Payload ID: 11957 relates to Category No.: 4820, 15617, 9343; Payload ID: 11958 relates to Category No.: 4820, 9343, 9322; Payload ID: 11959 relates to Category No.: 4820, 9343, 9322; Payload ID: 11960 relates to Category No.: 4820, 9343; Payload ID: 11961 relates to Category No.: 4820, 9343; Payload ID: 11962 relates to Category No.: 4820, 9343; Payload ID: 11963 relates to Category No.: 4820, 9343; Payload ID: 11964 relates to Category No.: 4820, 9343; Payload ID: 11965 relates to Category No.: 4820, 9343; Payload ID: 11966 relates to Category No.: 4820, 9343; Payload ID: 11967 relates to Category No.: 4820, 9343; Payload ID: 11968 relates to Category No.: 4820, 9343; Payload ID: 11969 relates to Category No.: 4820, 9343; Payload ID: 11970 relates to Category No.: 4820, 9343; Payload ID: 11971 relates to Category No.: 4820, 9343; Payload ID: 11972 relates to Category No.: 4820, 9343; Payload ID: 11973 relates to Category No.: 4820, 9343; Payload ID: 11974 relates to Category No.: 4820, 9343; Payload ID: 11975 relates to Category No.: 4820, 9343; Payload ID: 11976 relates to Category No.: 4820, 9343, 9322; Payload ID: 11977 relates to Category No.: 4820, 9343, 9322; Payload ID: 11978 relates to Category No.: 4820, 9343, 9322; Payload ID: 11979 relates to Category No.: 4820, 9343, 9322; Payload ID: 11980 relates to Category No.: 4820, 9343, 9322; Payload ID: 11981 relates to Category No.: 4820, 9343, 9322; Payload ID: 11982 relates to Category No.: 4820, 9343, 9322; Payload ID: 11983 relates to Category No.: 4820, 9343, 9322; Payload ID: 11984 relates to Category No.: 4820, 9343, 9322; Payload ID: 11985 relates to Category No.: 4820, 9343; Payload ID: 11986 relates to Category No.: 4820, 9343; Payload ID: 11987 relates to Category No.: 4820, 9343, 9322; Payload ID: 11988 relates to Category No.: 4820, 9343, 9322; Payload ID: 11989 relates to Category No.: 4820, 9343, 9322; Payload ID: 11990 relates to Category No.: 4820, 9343, 9322; Payload ID: 11991 relates to Category No.: 4820, 9343, 9322; Payload ID: 11993 relates to Category No.: 4820, 9343, 9322; Payload ID: 11994 relates to Category No.: 4820, 9343, 9322; Payload ID: 11995 relates to Category No.: 4820, 9343, 9322; Payload ID: 11996 relates to Category No.: 4820, 9343, 9322; Payload ID: 11997 relates to Category No.: 4820, 9343; Payload ID: 11998 relates to Category No.: 4820, 9343; Payload ID: 11999 relates to Category No.: 4820; Payload ID: 12000 relates to Category No.: 4820, 9343; Payload ID: 12001 relates to Category No.: 4820, 9343; Payload ID: 12002 relates to Category No.: 4820; Payload ID: 12003 relates to Category No.: 4820, 9343, 9322; Payload ID: 12004 relates to Category No.: 4820; Payload ID: 12005 relates to Category No.: 4820, 9343, 9322; Payload ID: 12006 relates to Category No.: 4820, 9343, 9322; Payload ID: 12007 relates to Category No.: 4820, 9343, 9322; Payload ID: 12008 relates to Category No.: 4820, 9343, 9322; Payload ID: 12009 relates to Category No.: 3303, 11917, 11861, 11939, 15503, 14239, 5235; Payload ID: 12010 relates to Category No.: 11861, 5347; Payload ID: 12011 relates to Category No.: 3303, 11917, 11861; Payload ID: 12012 relates to Category No.: 3303, 11917, 11861, 14249; Payload ID: 12014 relates to Category No.: 9226, 14597, 11861, 14603, 15265, 15253; Payload ID: 12015 relates to Category No.: 9939, 11861, 4894, 267, 5850; Payload ID: 12016 relates to Category No.: 11861, 3411; Payload ID: 12018 relates to Category No.: 3749, 242, 11861, 9874, 12060, 12065, 5099, 5100, 5098, 11920, 15504, 9629, 7225; Payload ID: 12019 relates to Category No.: 6825, 6816; Payload ID: 12020 relates to Category No.: 1405; Payload ID: 12021 relates to Category No.: 1405; Payload ID: 12022 relates to Category No.: 1405, 11861; Payload ID: 12023 relates to Category No.: 4864, 2874, 9371; Payload ID: 12024 relates to Category No.: 11861, 4865, 9370, 2881, 2875; Payload ID: 12025 relates to Category No.: 3303, 15528, 14233, 15503, 14471, 15528, 14255; Payload ID: 12026 relates to Category No.: 3303, 14234, 15528, 14233, 15503, 14471; Payload ID: 12027 relates to Category No.: 3303, 15528, 14233, 14243, 15503, 14471, 15528, 14255; Payload ID: 12028 relates to Category No.: 14196, 11861; Payload ID: 12030 relates to Category No.: 11861; Payload ID: 12031 relates to Category No.: 4820, 8957, 11861, 9083, 11895; Payload ID: 12032 relates to Category No.: 11861; Payload ID: 12033 relates to Category No.: 12399, 9384; Payload ID: 12034 relates to Category No.: 12399; Payload ID: 12035 relates to Category No.: 4820, 8957, 11861, 3734, 9384; Payload ID: 12036 relates to Category No.: 4820, 3515, 8957, 11861, 9384; Payload ID: 12037 relates to Category No.: 4820, 8957, 1158, 4806, 7235, 16244, 11861, 4804, 9384, 11895, 11920, 4198; Payload ID: 12038 relates to Category No.: 4820, 9992; Payload ID: 12039 relates to Category No.: 4820, 9992; Payload ID: 12040 relates to Category No.: 4820, 9992; Payload ID: 12041 relates to Category No.: 4820, 9992; Payload ID: 12042 relates to Category No.: 4820, 12399, 9992; Payload ID: 12043 relates to Category No.: 4820, 9992, 4817; Payload ID: 12044 relates to Category No.: 4820, 4817, 34, 9992; Payload ID: 12045 relates to Category No.: 4820, 9992, 34; Payload ID: 12046 relates to Category No.: 4886, 6478, 4895, 11861; Payload ID: 12048 relates to Category No.: 4023, 11861; Payload ID: 12049 relates to Category No.: 11895, 11861, 1327, 5923, 12359, 11861, 5347, 10163; Payload ID: 12050 relates to Category No.: 4820; Payload ID: 12051 relates to Category No.: 4820; Payload ID: 12052 relates to Category No.: 4820; Payload ID: 12055 relates to Category No.: 4820; Payload ID: 12056 relates to Category No.: 1457, 11861, 5347, 14996; Payload ID: 12057 relates to Category No.: 14996, 11861; Payload ID: 12058 relates to Category No.: 11861, 14996; Payload ID: 12059 relates to Category No.: 7192; Payload ID: 12060 relates to Category No.: 598, 11861, 4389; Payload ID: 12062 relates to Category No.: 926, 3303, 2405, 11861; Payload ID: 12063 relates to Category No.: 11861, 3361; Payload ID: 12064 relates to Category No.: 3303, 11861, 3361; Payload ID: 12065 relates to Category No.: 926, 3303, 9282, 11861, 3361; Payload ID: 12066 relates to Category No.: 926, 9282, 11861, 7192, 3361; Payload ID: 12067 relates to Category No.: 3303, 11861; Payload ID: 12070 relates to Category No.: 11861; Payload ID: 12071 relates to Category No.: 12292, 5347, 15489, 9445; Payload ID: 12072 relates to Category No.: 620, 9438, 1530, 9939, 9809; Payload ID: 12073 relates to Category No.: 11939, 1630, 11861, 9441; Payload ID: 12074 relates to Category No.: 9442, 11861, 3753; Payload ID: 12075 relates to Category No.: 9442, 11861, 3753; Payload ID: 12076 relates to Category No.: 9442, 3753, 11861, 12282; Payload ID: 12077 relates to Category No.: 11861; Payload ID: 12078 relates to Category No.: 11861; Payload ID: 12080 relates to Category No.: 3303, 15503, 14471, 14234, 14471, 11861, 15528, 14233; Payload ID: 12081 relates to Category No.: 3303, 15503, 14471, 14234, 14471, 11861, 15528, 14233, 3957, 11933; Payload ID: 12082 relates to Category No.: 3303, 14471; Payload ID: 12083 relates to Category No.: 6816, 7422; Payload ID: 12084 relates to Category No.: 6816, 6825, 7422; Payload ID: 12085 relates to Category No.: 11861; Payload ID: 12086 relates to Category No.: 11861, 14537; Payload ID: 12088 relates to Category No.: 5259, 12402; Payload ID: 12089 relates to Category No.: 4864, 5009, 11861; Payload ID: 12090 relates to Category No.: 11861; Payload ID: 12091 relates to Category No.: 11861; Payload ID: 12092 relates to Category No.: 1504, 11861, 4710, 11828; Payload ID: 12094 relates to Category No.: 1405, 9921, 7192; Payload ID: 12095 relates to Category No.: 1405, 11861, 7192, 767, 11886; Payload ID: 12096 relates to Category No.: 15029, 585, 11861; Payload ID: 12097 relates to Category No.: 585; Payload ID: 12098 relates to Category No.: 11861; Payload ID: 12101 relates to Category No.: 6816; Payload ID: 12102 relates to Category No.: 11861; Payload ID: 12104 relates to Category No.: 15911; Payload ID: 12105 relates to Category No.: 15911; Payload ID: 12106 relates to Category No.: 15911, 10116, 11861; Payload ID: 12107 relates to Category No.: 15911; Payload ID: 12108 relates to Category No.: 15911; Payload ID: 12109 relates to Category No.: 3303, 16331, 15911, 5923, 11861; Payload ID: 12110 relates to Category No.: 3303, 16331, 15911, 2861, 5923, 11861, 6421; Payload ID: 12111 relates to Category No.: 15911, 2861, 11861; Payload ID: 12112 relates to Category No.: 5308, 15911, 15895, 11861, 15887, 7552; Payload ID: 12113 relates to Category No.: 5308, 15911, 11861, 15887, 7552; Payload ID: 12114 relates to Category No.: 2861; Payload ID: 12116 relates to Category No.: 11861, 11920; Payload ID: 12117 relates to Category No.: 15029, 12359, 11861; Payload ID: 12124 relates to Category No.: 5308; Payload ID: 12125 relates to Category No.: 5308, 5311, 2319, 2316; Payload ID: 12126 relates to Category No.: 14503, 6816; Payload ID: 12127 relates to Category No.: 14503; Payload ID: 12128 relates to Category No.: 6816, 14251, 14471, 15530, 14233, 14234, 9226; Payload ID: 12129 relates to Category No.: 6816, 15524, 14251, 14471, 3303, 2405, 15528, 14255; Payload ID: 12130 relates to Category No.: 6816, 9226, 14251, 14471; Payload ID: 12131 relates to Category No.: 3665; Payload ID: 12132 relates to Category No.: 11939, 11861, 7099; Payload ID: 12133 relates to Category No.: 11861, 7192, 9518; Payload ID: 12134 relates to Category No.: 4864, 11861; Payload ID: 12135 relates to Category No.: 7192; Payload ID: 12136 relates to Category No.: 11978, 926, 12109, 6478, 11861; Payload ID: 12138 relates to Category No.: 1504, 11861, 6341; Payload ID: 12139 relates to Category No.: 9518, 7192; Payload ID: 12141 relates to Category No.: 4820, 164, 160, 150; Payload ID: 12142 relates to Category No.: 9520, 15346, 9518, 318, 3292, 6816, 9519, 4961, 2271; Payload ID: 12143 relates to Category No.: 4820; Payload ID: 12144 relates to Category No.: 6816, 11861, 9520, 15346, 9518, 318, 3292; Payload ID: 12145 relates to Category No.: 11920, 11861, 14987, 9888, 9532; Payload ID: 12146 relates to Category No.: 11861, 2346; Payload ID: 12147 relates to Category No.: 2346, 9896; Payload ID: 12148 relates to Category No.: 6210; Payload ID: 12149 relates to Category No.: 9939, 11861, 2346; Payload ID: 12150 relates to Category No.: 11861, 2346; Payload ID: 12151 relates to Category No.: 11861, 2346; Payload ID: 12152 relates to Category No.: 9951, 2346, 9888, 9896, 9532; Payload ID: 12153 relates to Category No.: 6210, 11861; Payload ID: 12154 relates to Category No.: 11861, 2346; Payload ID: 12155 relates to Category No.: 9951, 2346, 9888, 9896, 11861; Payload ID: 12156 relates to Category No.: 6210; Payload ID: 12157 relates to Category No.: 4820, 9629, 16108, 11861, 9636, 9533; Payload ID: 12158 relates to Category No.: 8907, 11861, 9534; Payload ID: 12159 relates to Category No.: 11861; Payload ID: 12160 relates to Category No.: 11861; Payload ID: 12162 relates to Category No.: 11861; Payload ID: 12163 relates to Category No.: 7192; Payload ID: 12165 relates to Category No.: 11978, 926, 12109, 12363, 11861, 2566, 11981; Payload ID: 12166 relates to Category No.: 11978, 926, 12109, 11981, 12363, 12144, 11861, 5347; Payload ID: 12167 relates to Category No.: 11978, 926, 6816, 12109, 6601, 12363, 11861, 14537, 14106, 4896; Payload ID: 12168 relates to Category No.: 12109, 12363, 11978, 926, 11861; Payload ID: 12169 relates to Category No.: 12109, 12363, 11978, 926, 11861; Payload ID: 12170 relates to Category No.: 11978, 926; Payload ID: 12171 relates to Category No.: 11978, 926, 12109, 12363; Payload ID: 12172 relates to Category No.: 12267, 4009; Payload ID: 12173 relates to Category No.: 5865, 4225, 7523, 11861, 9518, 315, 16283, 7486, 680, 9518, 4207, 7510, 5308, 3554, 3752, 2872, 314, 9050, 5872; Payload ID: 12174 relates to Category No.: 15973; Payload ID: 12175 relates to Category No.: 11861, 3007; Payload ID: 12176 relates to Category No.: 11861, 14232, 2405; Payload ID: 12177 relates to Category No.: 3303; Payload ID: 12178 relates to Category No.: 3303, 15504, 15524, 2690, 11861, 15115; Payload ID: 12179 relates to Category No.: 3303, 15503, 14471, 14471, 11861, 2405, 15503, 14239, 5235; Payload ID: 12180 relates to Category No.: 3303, 14471, 14240, 15530, 14239, 3459, 11861; Payload ID: 12181 relates to Category No.: 3303, 11861, 15528, 14233, 15503, 14471, 14234; Payload ID: 12182 relates to Category No.: 3303, 15908, 15503, 14471, 14471, 15504, 14251, 14471, 11981, 11861, 14324, 14237, 5101, 15528, 14233, 2405, 14234, 15895, 15524, 15528, 14255, 15530, 14255, 2737, 5235; Payload ID: 12183 relates to Category No.: 3303, 15503, 14471, 14471, 11861, 15503, 14235; Payload ID: 12184 relates to Category No.: 3303, 15503, 14471, 15524, 11861, 15413, 14237, 14471, 14234, 15528, 14233; Payload ID: 12185 relates to Category No.: 3303, 11861, 14243, 15528, 14255; Payload ID: 12186 relates to Category No.: 11861, 6933; Payload ID: 12187 relates to Category No.: 11861, 6933; Payload ID: 12188 relates to Category No.: 3303, 14471, 15491, 14246, 5235; Payload ID: 12189 relates to Category No.: 3303, 15503, 14471, 14471; Payload ID: 12190 relates to Category No.: 3303, 15503, 14471, 14471, 14243; Payload ID: 12191 relates to Category No.: 3303, 14234, 14471, 14243, 15528, 14233; Payload ID: 12192 relates to Category No.: 3303, 15503, 14471, 14471, 11861, 15528, 14233, 14234, 15528, 14252; Payload ID: 12193 relates to Category No.: 3303, 15503, 14471, 11939, 14471, 15504, 11861, 15530, 14233, 5347, 15525, 15530, 14252, 14147, 14252, 14229, 9961, 14246, 14251, 14471, 2405, 2406, 14234, 15528, 14233; Payload ID: 12194 relates to Category No.: 3303, 15503, 14471, 14471, 15528, 14233, 11861, 14234; Payload ID: 12195 relates to Category No.: 11861; Payload ID: 12196 relates to Category No.: 267, 11861, 7328; Payload ID: 12199 relates to Category No.: 9546, 9547, 9549; Payload ID: 12200 relates to Category No.: 15358, 9546; Payload ID: 12201 relates to Category No.: 16331, 12167; Payload ID: 12202 relates to Category No.: 9226, 11861, 10119, 97; Payload ID: 12203 relates to Category No.: 11978, 926, 6816, 10116, 11861, 10119; Payload ID: 12204 relates to Category No.: 3303, 11917, 15528, 14233, 11861, 14471, 2405, 3530, 14240; Payload ID: 12205 relates to Category No.: 3303, 15503, 14471, 14471, 11861, 2405, 14234, 11933, 2691, 11886, 15504, 15503, 14239; Payload ID: 12206 relates to Category No.: 6816, 15663, 1536, 11861; Payload ID: 12207 relates to Category No.: 15663, 1405, 1536, 11861; Payload ID: 12208 relates to Category No.: 15663, 1536, 11861; Payload ID: 12209 relates to Category No.: 15663, 1536, 11861; Payload ID: 12210 relates to Category No.: 5259, 4821, 8959, 12402; Payload ID: 12212 relates to Category No.: 12402, 1401, 4408, 6101, 11861, 267, 277, 2267, 11933, 11828, 5841, 4404, 14377; Payload ID: 12213 relates to Category No.: 16280, 4408, 2267; Payload ID: 12214 relates to Category No.: 16280, 4408; Payload ID: 12215 relates to Category No.: 926, 9566; Payload ID: 12216 relates to Category No.: 926, 9566; Payload ID: 12217 relates to Category No.: 926, 9566; Payload ID: 12218 relates to Category No.: 926, 9566; Payload ID: 12219 relates to Category No.: 926, 6816, 11861, 10144; Payload ID: 12220 relates to Category No.: 3303, 6816, 3390, 9304, 10116, 10144; Payload ID: 12221 relates to Category No.: 3303, 6816, 3390, 9304, 10144, 14673; Payload ID: 12222 relates to Category No.: 16331, 14504, 6825, 9619, 11861; Payload ID: 12223 relates to Category No.: 11861; Payload ID: 12224 relates to Category No.: 16331, 6829, 11861; Payload ID: 12225 relates to Category No.: 11861, 9882, 9887, 9874, 11983, 12081; Payload ID: 12226 relates to Category No.: 11861; Payload ID: 12227 relates to Category No.: 11861, 15504, 14106, 4899, 11983; Payload ID: 12228 relates to Category No.: 11861; Payload ID: 12229 relates to Category No.: 11861; Payload ID: 12230 relates to Category No.: 11861, 2955; Payload ID: 12232 relates to Category No.: 926, 11861; Payload ID: 12233 relates to Category No.: 11861; Payload ID: 12234 relates to Category No.: 11861; Payload ID: 12235 relates to Category No.: 16331, 9226; Payload ID: 12236 relates to Category No.: 11861, 5347; Payload ID:

12237 relates to Category No.: 11861; Payload ID: 12240 relates to Category No.: 1405, 11939, 9939, 868, 867; Payload ID: 12241 relates to Category No.: 868, 6816, 5347; Payload ID: 12242 relates to Category No.: 6816, 11939, 868, 867, 89, 3250; Payload ID: 12243 relates to Category No.: 9282, 9226, 10116, 11861, 2688, 15525, 14196; Payload ID: 12245 relates to Category No.: 5259, 15503, 14239, 9582, 9638, 15790; Payload ID: 12246 relates to Category No.: 4820, 15617, 11861, 9581, 12107, 9636; Payload ID: 12248 relates to Category No.: 4820, 15617, 11861, 9581; Payload ID: 12249 relates to Category No.: 5259, 9638; Payload ID: 12250 relates to Category No.: 267, 4961, 15895, 4821, 598, 2271, 1173, 5282, 5280; Payload ID: 12251 relates to Category No.: 11861, 1201; Payload ID: 12252 relates to Category No.: 16331, 15908, 267, 4961, 15895, 15893, 6188, 5109, 11981, 4821, 11861, 15889, 2793, 15887, 15894, 5347, 2271, 3752, 14537, 15766, 9608, 5957, 5280, 9925, 15915, 4122, 6816; Payload ID: 12253 relates to Category No.: 7192, 4740; Payload ID: 12254 relates to Category No.: 11939, 15504, 12402, 9619, 15491, 2672, 7268, 11861, 5347, 3752, 13735, 2875, 15112, 5957, 14377, 686, 15915, 9518, 316, 15904, 4740, 15830, 6092, 14667, 6767, 2795, 2797, 4739, 9749; Payload ID: 12255 relates to Category No.: 6816, 11861, 5313; Payload ID: 12256 relates to Category No.: 3303, 11861; Payload ID: 12257 relates to Category No.: 11861, 3303; Payload ID: 12258 relates to Category No.: 9226, 14196, 10116; Payload ID: 12259 relates to Category No.: 1405, 11939, 11933; Payload ID: 12260 relates to Category No.: 11861, 267; Payload ID: 12261 relates to Category No.: 267, 11861; Payload ID: 12262 relates to Category No.: 267, 11861; Payload ID: 12263 relates to Category No.: 15492; Payload ID: 12264 relates to Category No.: 11978, 926, 12109, 9857, 11861; Payload ID: 12265 relates to Category No.: 5308; Payload ID: 12266 relates to Category No.: 15663, 11861; Payload ID: 12267 relates to Category No.: 15663, 9921, 7222, 3273; Payload ID: 12268 relates to Category No.: 15663, 7192; Payload ID: 12269 relates to Category No.: 5308; Payload ID: 12270 relates to Category No.: 6434; Payload ID: 12271 relates to Category No.: 6434, 1536; Payload ID: 12272 relates to Category No.: 926, 6434, 1448; Payload ID: 12273 relates to Category No.: 4964, 11861, 2823, 2346, 14698, 4963, 11886, 5009, 9592; Payload ID: 12274 relates to Category No.: 4964, 14698, 4963; Payload ID: 12275 relates to Category No.: 4964, 7192; Payload ID: 12276 relates to Category No.: 4964, 7192; Payload ID: 12277 relates to Category No.: 4964, 7192; Payload ID: 12278 relates to Category No.: 4964, 7192; Payload ID: 12279 relates to Category No.: 3303, 16331, 9226, 10116, 11861; Payload ID: 12280 relates to Category No.: 9226, 6816, 15503, 14471, 14251, 14471; Payload ID: 12281 relates to Category No.: 11861; Payload ID: 12282 relates to Category No.: 14234; Payload ID: 12283 relates to Category No.: 16331, 1153, 11861, 16184, 1177, 11981, 11886, 5588; Payload ID: 12284 relates to Category No.: 11861; Payload ID: 12285 relates to Category No.: 3303, 15503, 14471, 11861, 14471, 11933, 15528, 14255, 15503, 14239; Payload ID: 12286 relates to Category No.: 3303, 14243, 14471, 277, 295; Payload ID: 12287 relates to Category No.: 2405, 10116, 11861, 14246, 327, 15106; Payload ID: 12288 relates to Category No.: 11861; Payload ID: 12289 relates to Category No.: 11861; Payload ID: 12290 relates to Category No.: 7268, 14232; Payload ID: 12291 relates to Category No.: 11861; Payload ID: 12292 relates to Category No.: 10116; Payload ID: 12293 relates to Category No.: 11978, 926, 12109, 11861; Payload ID: 12294 relates to Category No.: 11861, 1201; Payload ID: 12295 relates to Category No.: 926, 3303, 11861, 1201; Payload ID: 12296 relates to Category No.: 11861; Payload ID: 12297 relates to Category No.: 16331, 11861, 15491; Payload ID: 12298 relates to Category No.: 11861, 16331, 566, 4198, 7328, 7398; Payload ID: 12299 relates to Category No.: 16331, 11861, 2936; Payload ID: 12300 relates to Category No.: 16331, 11861; Payload ID: 12301 relates to Category No.: 16331, 267, 11861, 11983, 322, 12064; Payload ID: 12302 relates to Category No.: 16331, 11861; Payload ID: 12303 relates to Category No.: 11978, 926, 12109, 11861; Payload ID: 12304 relates to Category No.: 15629, 11861, 9608, 11886, 14380; Payload ID: 12305 relates to Category No.: 11895, 11861; Payload ID: 12306 relates to Category No.: 11861; Payload ID: 12307 relates to Category No.: 11861, 4920, 11895, 5843; Payload ID: 12308 relates to Category No.: 15893, 11861; Payload ID: 12309 relates to Category No.: 11861, 11939, 11933; Payload ID: 12310 relates to Category No.: 6816, 11861; Payload ID: 12311 relates to Category No.: 11861; Payload ID: 12312 relates to Category No.: 15893, 11861, 16331, 15908, 6188; Payload ID: 12313 relates to Category No.: 16331, 15893, 11861; Payload ID: 12318 relates to Category No.: 11861; Payload ID: 12319 relates to Category No.: 6188, 11861, 15893, 15908; Payload ID: 12320 relates to Category No.: 6188, 11861; Payload ID: 12321 relates to Category No.: 6188, 11861; Payload ID: 12322 relates to Category No.: 6816, 3655, 11861; Payload ID: 12323 relates to Category No.: 1434, 1405, 11933, 11917, 10116, 11861; Payload ID: 12324 relates to Category No.: 10116, 15699; Payload ID: 12325 relates to Category No.: 10116; Payload ID: 12326 relates to Category No.: 14309, 10116, 14170; Payload ID: 12327 relates to Category No.: 2613, 16204, 1; Payload ID: 12328 relates to Category No.: 6816; Payload ID: 12329 relates to Category No.: 894; Payload ID: 12330 relates to Category No.: 894; Payload ID: 12331 relates to Category No.: 894; Payload ID: 12332 relates to Category No.: 16331, 6816, 6825, 1630, 3663; Payload ID: 12333 relates to Category No.: 16331, 6816, 6825, 1630; Payload ID: 12334 relates to Category No.: 6822, 637, 3275, 6574, 9619, 5308; Payload ID: 12335 relates to Category No.: 1405, 14503, 11861; Payload ID: 12336 relates to Category No.: 9620; Payload ID: 12337 relates to Category No.: 9620; Payload ID: 12338 relates to Category No.: 14504, 9620, 3665; Payload ID: 12339 relates to Category No.: 6816, 5308, 9619, 7192; Payload ID: 12340 relates to Category No.: 5308; Payload ID: 12341 relates to Category No.: 5865, 9634; Payload ID: 12342 relates to Category No.: 5259, 4821, 11861, 8959; Payload ID: 12343 relates to Category No.: 16331, 7456, 9654, 9657; Payload ID: 12344 relates to Category No.: 16331, 7456, 9654, 9657; Payload ID: 12345 relates to Category No.: 16331, 7456, 9654, 9657; Payload ID: 12346 relates to Category No.: 16331, 7456, 9654, 9657; Payload ID: 12347 relates to Category No.: 1405, 12160; Payload ID: 12348 relates to Category No.: 1405, 3936, 12160; Payload ID: 12349 relates to Category No.: 1405, 12160; Payload ID: 12350 relates to Category No.: 1405, 12160, 11861, 829; Payload ID: 12351 relates to Category No.: 1405, 12160, 11861; Payload ID: 12352 relates to Category No.: 16331, 7223, 1630, 2672, 6049, 11861, 9518, 315, 16283, 12443, 680, 9676, 9658, 11981, 1405; Payload ID: 12353 relates to Category No.: 9706, 11861, 5892, 7126, 4893, 9985, 9987; Payload ID: 12354 relates to Category No.: 3303, 9706, 3459, 10116, 11861, 5892, 1122; Payload ID: 12355 relates to Category No.: 9706, 11861; Payload ID: 12356 relates to Category No.: 15908, 9706, 15893, 6188, 11861, 15916; Payload ID: 12357 relates to Category No.: 9706, 11861; Payload ID: 12358 relates to Category No.:

9282, 9226, 9706, 10116; Payload ID: 12359 relates to Category No.: 9706; Payload ID: 12360 relates to Category No.: 9706, 15973, 10116, 11861, 9629, 16204; Payload ID: 12361 relates to Category No.: 9706; Payload ID: 12362 relates to Category No.: 9706; Payload ID: 12363 relates to Category No.: 9706; Payload ID: 12364 relates to Category No.: 9706; Payload ID: 12365 relates to Category No.: 9706; Payload ID: 12366 relates to Category No.: 9706; Payload ID: 12367 relates to Category No.: 9706, 15973, 10116, 11861, 9629, 2566, 11886, 14218; Payload ID: 12368 relates to Category No.: 9706, 11861, 2836; Payload ID: 12369 relates to Category No.: 9706, 15504, 4961, 11861, 3936, 5282, 5280, 2836; Payload ID: 12370 relates to Category No.: 9706, 11861; Payload ID: 12371 relates to Category No.: 9706, 9282, 9226, 14196, 10116, 11861, 2836; Payload ID: 12372 relates to Category No.: 9706, 11861, 9629, 2836; Payload ID: 12373 relates to Category No.: 9706, 10116, 11861, 2836; Payload ID: 12374 relates to Category No.: 9706, 11861, 14147, 2836; Payload ID: 12375 relates to Category No.: 631, 10116, 11861; Payload ID: 12376 relates to Category No.: 631, 11861; Payload ID: 12377 relates to Category No.: 631; Payload ID: 12378 relates to Category No.: 1405, 11861, 16280; Payload ID: 12379 relates to Category No.: 11861, 7192; Payload ID: 12380 relates to Category No.: 1457, 11861; Payload ID: 12381 relates to Category No.: 11861, 5347; Payload ID: 12382 relates to Category No.: 6210; Payload ID: 12383 relates to Category No.: 11861; Payload ID: 12384 relates to Category No.: 11861; Payload ID: 12386 relates to Category No.: 11861, 5347, 6207; Payload ID: 12387 relates to Category No.: 14234, 15895, 5957, 3530, 15503, 15504, 2406, 11861, 15504, 15525; Payload ID: 12388 relates to Category No.: 15491, 11861, 15887, 15525, 15503, 15504; Payload ID: 12389 relates to Category No.: 11861, 15895, 5957; Payload ID: 12390 relates to Category No.: 11861, 1706, 5009; Payload ID: 12391 relates to Category No.: 15629, 6210, 11861, 2346, 4103; Payload ID: 12392 relates to Category No.: 11861; Payload ID: 12393 relates to Category No.: 15029, 11861, 11933; Payload ID: 12395 relates to Category No.: 10116, 11861; Payload ID: 12396 relates to Category No.: 15021, 11861; Payload ID: 12397 relates to Category No.: 6816, 4976, 4023, 9747, 11861, 5620; Payload ID: 12398 relates to Category No.: 4976, 9747, 11861, 6816, 3655; Payload ID: 12399 relates to Category No.: 9518, 9747, 10116, 9749, 753, 11861, 15362, 5347; Payload ID: 12400 relates to Category No.: 9518, 753, 9749, 15362; Payload ID: 12401 relates to Category No.: 11895, 9518, 11981, 2859, 9749, 753, 11861, 5957, 15362, 532, 5347; Payload ID: 12402 relates to Category No.: 9518, 753, 9749, 11861, 15362, 11939; Payload ID: 12403 relates to Category No.: 11917, 9518, 12402, 9747, 2859, 9749, 753, 14260, 9767; Payload ID: 12404 relates to Category No.: 9518, 4617, 15895, 9921, 9749, 753, 11861; Payload ID: 12405 relates to Category No.: 926, 11895, 11861, 942, 2744, 11886; Payload ID: 12406 relates to Category No.: 16331, 11895, 11861; Payload ID: 12407 relates to Category No.: 11939, 11861; Payload ID: 12408 relates to Category No.: 11939, 11861; Payload ID: 12409 relates to Category No.: 11861; Payload ID: 12410 relates to Category No.: 16331, 15908, 11895, 11861; Payload ID: 12411 relates to Category No.: 11861; Payload ID: 12412 relates to Category No.: 6965, 12402, 15495, 11861, 1173, 12064; Payload ID: 12413 relates to Category No.: 11895, 11861; Payload ID: 12414 relates to Category No.: 11861, 943, 12064, 9761; Payload ID: 12415 relates to Category No.: 16331, 6816, 15908, 11861; Payload ID: 12416 relates to Category No.: 11895, 11861, 11886, 943; Payload ID: 12417 relates to Category No.: 623, 11917, 6210, 11861; Payload ID: 12418 relates to Category No.: 11895, 11861, 3752, 12064, 14660, 9765, 9758; Payload ID: 12419 relates to Category No.: 11861, 14660, 9765, 9758; Payload ID: 12420 relates to Category No.: 926, 942, 11895, 11861, 942, 2744, 11886; Payload ID: 12421 relates to Category No.: 11861, 11939, 3752, 9759; Payload ID: 12422 relates to Category No.: 11861; Payload ID: 12423 relates to Category No.: 11861; Payload ID: 12424 relates to Category No.: 9518, 12402, 15488; Payload ID: 12425 relates to Category No.: 7192, 11861; Payload ID: 12426 relates to Category No.: 3303, 14251, 6183, 16331, 15503, 14471, 14471, 14234, 6210, 14968, 11861, 15889, 15530, 14233, 15528, 14233, 3471, 14244, 12399, 15528, 14252, 11920, 11886, 9805, 15492, 6647, 9012; Payload ID: 12427 relates to Category No.: 3303, 16331, 15503, 14471, 14471, 6210, 14968, 14251, 6183, 11861, 3471, 6201, 11933, 15491, 4103, 9014; Payload ID: 12428 relates to Category No.: 3303, 16331, 15503, 14471, 2405, 14471, 15524, 14968, 14251, 6183, 11861, 2691, 3752, 3471, 6185, 327, 813, 566, 14087, 11809, 15528, 14255, 14242, 3936, 15504, 12081; Payload ID: 12429 relates to Category No.: 3303, 9282, 9226, 14196, 14471, 15504, 15895, 15491, 14248, 11861, 6185, 6184, 2406, 686, 3936, 598, 2405, 9763, 11786; Payload ID: 12430 relates to Category No.: 9282, 9226, 14196, 15504, 14248, 3936, 6185, 12398, 488, 11861; Payload ID: 12431 relates to Category No.: 9282, 9226, 15504, 14248, 10116, 6185; Payload ID: 12433 relates to Category No.: 4864, 12402; Payload ID: 12434 relates to Category No.: 10116, 11861, 14147; Payload ID: 12435 relates to Category No.: 11861; Payload ID: 12438 relates to Category No.: 14309, 10116; Payload ID: 12439 relates to Category No.: 4894, 9804, 11886, 12419; Payload ID: 12440 relates to Category No.: 6816, 1630, 9962, 11861; Payload ID: 12441 relates to Category No.: 1630, 11861, 6816, 12111; Payload ID: 12443 relates to Category No.: 16331, 11861, 14218, 11920; Payload ID: 12444 relates to Category No.: 16331, 6900, 11861, 15503, 14471; Payload ID: 12445 relates to Category No.: 16331, 11861; Payload ID: 12446 relates to Category No.: 16331, 11861; Payload ID: 12447 relates to Category No.: 16331, 2405, 5105, 9857, 14243, 11861, 14249, 15496; Payload ID: 12448 relates to Category No.: 16331, 2405, 6900, 11861; Payload ID: 12449 relates to Category No.: 16331, 11861; Payload ID: 12450 relates to Category No.: 16331, 6900, 11861; Payload ID: 12451 relates to Category No.: 16331, 5865, 6900, 15491, 11861, 3274, 5119; Payload ID: 12452 relates to Category No.: 3303, 16331, 6816, 11861, 5099, 5100, 5098; Payload ID: 12453 relates to Category No.: 16331, 11861, 6816; Payload ID: 12454 relates to Category No.: 16331, 2405, 5105, 14243, 11861, 15493, 3303; Payload ID: 12455 relates to Category No.: 16331, 11861, 2405, 5105, 14243, 15493; Payload ID: 12456 relates to Category No.: 16331, 11861; Payload ID: 12457 relates to Category No.: 1405; Payload ID: 12458 relates to Category No.: 16331, 11861, 7192; Payload ID: 12459 relates to Category No.: 3303, 15503, 14471, 10116, 11861; Payload ID: 12460 relates to Category No.: 3303, 16331, 5105, 5109, 10116, 11861, 3752, 14147, 15766, 14377, 9961; Payload ID: 12461 relates to Category No.: 16331, 11861; Payload ID: 12462 relates to Category No.: 16331, 2405, 5865, 6900, 5116, 9518, 315, 16283, 83, 679, 11861, 5114, 5119, 5117, 5123; Payload ID: 12463 relates to Category No.: 1630, 11861, 5892, 7192; Payload ID: 12464 relates to Category No.: 5865, 7223, 620, 9518, 315, 16283, 12446, 680, 9793, 11939, 2559; Payload ID: 12465 relates to Category No.: 926, 9282, 6478, 11861, 15699, 632, 9795; Payload ID: 12466 relates to Category No.: 926, 9282, 15699, 632, 9795, 10116, 11861; Payload ID: 12467 relates to Category No.: 926, 9282, 14196, 6478, 9795; Payload ID: 12468 relates to Category No.: 6924, 9798; Payload ID: 12469 relates to Category No.: 11861; Payload ID: 12470 relates to Category No.: 9938; Payload ID: 12471 relates to Category No.: 11861, 12417, 11886; Payload ID: 12473 relates to Category No.: 11861, 11864, 16082; Payload ID: 12474 relates to Category No.: 267, 12082, 12076, 12086; Payload ID: 12475 relates to Category No.: 267, 12082, 11861; Payload ID: 12476 relates to Category No.: 267, 12082, 12076, 12086; Payload ID: 12477 relates to Category No.: 267, 12076, 12084; Payload ID: 12478 relates to Category No.: 6478, 12150, 12151, 9804, 6210, 9962, 12111, 11861, 5347, 3752, 9608, 9881, 669, 9872, 5512, 9875, 11981, 10092; Payload ID: 12479 relates to Category No.: 12150, 11861; Payload ID: 12480 relates to Category No.: 6816, 9804, 12327, 9905, 9911; Payload ID: 12481 relates to Category No.: 6816, 9804, 11861, 12291; Payload ID: 12482 relates to Category No.: 1630, 2369, 11861, 11939, 6210; Payload ID: 12483 relates to Category No.: 1630, 2369; Payload ID: 12484 relates to Category No.: 1630, 3947; Payload ID: 12485 relates to Category No.: 16331, 6825, 637; Payload ID: 12486 relates to Category No.: 6210, 11861, 9824, 9828; Payload ID: 12487 relates to Category No.: 926, 14504, 11981, 10116, 11861, 9834, 3752; Payload ID: 12488 relates to Category No.: 9080, 9893, 9838, 9892, 14351, 9834; Payload ID: 12489 relates to Category No.: 11861; Payload ID: 12490 relates to Category No.: 1405, 926, 1630, 9988, 4246, 1696; Payload ID: 12491 relates to Category No.: 11933, 57, 11861, 12425, 58, 12081; Payload ID: 12492 relates to Category No.: 926, 57, 11861, 9988, 512, 1201, 11978, 9843, 5956; Payload ID: 12493 relates to Category No.: 926, 6478, 55, 11861, 9988, 512, 769; Payload ID: 12494 relates to Category No.: 926, 55, 9988, 512; Payload ID: 12495 relates to Category No.: 55, 9988, 512, 1201; Payload ID: 12496 relates to Category No.: 926, 55, 11861, 9988, 512; Payload ID: 12497 relates to Category No.: 9939, 2491, 56, 11861, 2499, 2489; Payload ID: 12498 relates to Category No.: 11861, 9863, 15943; Payload ID: 12499 relates to Category No.: 6598, 15542, 15553; Payload ID: 12500 relates to Category No.: 1630, 9863; Payload ID: 12501 relates to Category No.: 3949; Payload ID: 12502 relates to Category No.: 1630, 9988, 4246, 2752; Payload ID: 12503 relates to Category No.: 9863, 1630; Payload ID: 12504 relates to Category No.: 9619, 2861, 11918, 11861, 4800, 4796; Payload ID: 12505 relates to Category No.: 7448; Payload ID: 12506 relates to Category No.: 15542, 15554; Payload ID: 12507 relates to Category No.: 15542, 1630, 6591; Payload ID: 12508 relates to Category No.: 1630, 7192, 6591, 11861; Payload ID: 12509 relates to Category No.: 9863; Payload ID: 12510 relates to Category No.: 9863; Payload ID: 12511 relates to Category No.: 11861, 4800; Payload ID: 12512 relates to Category No.: 11861, 4800; Payload ID: 12513 relates to Category No.: 4800, 4796; Payload ID: 12514 relates to Category No.: 3415, 6598; Payload ID: 12515 relates to Category No.: 15542, 15548; Payload ID: 12518 relates to Category No.: 6598, 15542, 15553, 548; Payload ID: 12519 relates to Category No.: 6210, 9870, 9828; Payload ID: 12520 relates to Category No.: 6210; Payload ID: 12521 relates to Category No.: 6210, 11861, 9870; Payload ID: 12522 relates to Category No.: 6816, 11861, 9870; Payload ID: 12523 relates to Category No.: 1405, 6816, 6210, 11861; Payload ID: 12524 relates to Category No.: 11861, 4894, 14107, 9939, 4924, 3752; Payload ID: 12525 relates to Category No.: 4894, 14107, 4924, 11861, 12364; Payload ID: 12526 relates to Category No.: 60, 926, 5956, 12109, 57, 11861, 9988, 512, 9884, 9843, 1201, 11977, 5543; Payload ID: 12527 relates to Category No.: 926, 60, 11861, 9988, 512, 9884, 9843, 1201, 57, 5543; Payload ID: 12528 relates to Category No.: 926, 57, 60, 11861, 9988, 512, 9884, 9843, 1201; Payload ID: 12529 relates to Category No.: 11978, 926, 12109, 60, 11861, 9988, 512, 9884, 9843, 3765, 1201, 57; Payload ID: 12530 relates to Category No.: 926, 9857, 60, 11861, 9988, 512, 9843, 1201, 57; Payload ID: 12531 relates to Category No.: 926, 9857, 57, 60, 11861, 9988, 512, 1201, 6217; Payload ID: 12532 relates to Category No.: 57, 60, 926, 9866, 9857, 11861, 9988, 512, 1201; Payload ID: 12533 relates to Category No.: 926, 9866, 11861, 5957, 61; Payload ID: 12534 relates to Category No.: 926, 9866, 11861, 61; Payload ID: 12535 relates to Category No.: 926, 9866, 11861, 61, 15216; Payload ID: 12536 relates to Category No.: 926, 9866, 61, 11861; Payload ID: 12537 relates to Category No.: 926, 9866, 61, 62; Payload ID: 12538 relates to Category No.: 926, 9866, 11861, 12417, 61, 62; Payload ID: 12539 relates to Category No.: 926, 9866, 5347, 62, 61; Payload ID: 12540 relates to Category No.: 9974; Payload ID: 12541 relates to Category No.: 14564, 9974; Payload ID: 12542 relates to Category No.: 14564, 9974; Payload ID: 12543 relates to Category No.: 9899; Payload ID: 12544 relates to Category No.: 15542; Payload ID: 12545 relates to Category No.: 1698; Payload ID: 12546 relates to Category No.: 6816, 92, 9974, 11861, 2258, 1467, 2265, 91, 3471, 2821; Payload ID: 12547 relates to Category No.: 6816, 92, 9974, 11861, 2258, 2821, 2265, 91, 1467; Payload ID: 12548 relates to Category No.: 6816, 10119; Payload ID: 12549 relates to Category No.: 6816, 92, 1457, 9974, 1458; Payload ID: 12550 relates to Category No.: 6816, 92, 1457, 9974, 1458, 2821, 90, 1399; Payload ID: 12551 relates to Category No.: 6816, 92, 9974, 1457, 1458; Payload ID: 12552 relates to Category No.: 6816, 11939, 92, 1401, 9974, 11861, 2258, 3471, 1467, 2821, 2265, 15473; Payload ID: 12553 relates to Category No.: 6816, 92, 9974, 90, 1467, 2263; Payload ID: 12554 relates to Category No.: 6816, 92, 9974, 11861, 11979, 2263; Payload ID: 12555 relates to Category No.: 6816, 92, 9974, 11861, 1467, 90; Payload ID: 12556 relates to Category No.: 6816, 92, 9974, 5841, 1467, 90, 11861, 4389; Payload ID: 12557 relates to Category No.: 6816, 92, 9974, 11861, 3471, 90; Payload ID: 12558 relates to Category No.: 11861, 3752; Payload ID: 12559 relates to Category No.: 6816, 92, 15895, 1135, 9974, 11861, 5841, 3752, 3471, 1467, 943, 14377, 90; Payload ID: 12560 relates to Category No.: 6816, 92, 9974, 11861, 2258, 91, 2821; Payload ID: 12561 relates to Category No.: 6816, 92, 9974, 11861, 91; Payload ID: 12562 relates to Category No.: 6816, 92, 9974, 11861, 91; Payload ID: 12563 relates to Category No.: 6816, 92, 9974, 11861, 2258, 91; Payload ID: 12564 relates to Category No.: 92, 12359, 11861, 4897; Payload ID: 12565 relates to Category No.: 92, 2258, 11861, 3753, 91, 14812; Payload ID: 12566 relates to Category No.: 92, 11861, 3753, 2258, 91; Payload ID: 12567 relates to Category No.: 6816, 92, 9974, 90, 2821; Payload ID: 12568 relates to Category No.: 6816, 92, 9974, 90; Payload ID: 12569 relates to Category No.: 6816, 92, 9974, 90; Payload ID: 12570 relates to Category No.: 6816, 92, 9974, 90; Payload ID: 12571 relates to Category No.: 6816, 92, 9974, 11861, 91; Payload ID: 12572 relates to Category No.: 4886, 6478, 9909, 6574, 9910, 1531, 12250, 4422; Payload ID: 12573 relates to Category No.: 4886, 9909, 9910, 12250, 6816, 11861, 5956; Payload ID: 12574 relates to Category No.: 926, 6816, 11861, 5347, 174, 5957, 4302, 4310, 7225; Payload ID: 12575 relates to Category No.: 174, 926, 6816, 11895, 11861, 5347, 5957, 4302, 11939, 9912; Payload ID: 12576 relates to Category No.: 174, 926, 6816, 11886;

Payload ID: 12577 relates to Category No.: 11861, 5841; Payload ID: 12578 relates to Category No.: 5841; Payload ID: 12579 relates to Category No.: 6478, 5804, 9989, 9913; Payload ID: 12580 relates to Category No.: 6478, 11861, 5804, 9989, 9913, 9960; Payload ID: 12581 relates to Category No.: 6816, 5804, 9989, 4543; Payload ID: 12582 relates to Category No.: 5804, 9989, 6478, 9903, 9913; Payload ID: 12583 relates to Category No.: 6478, 15029, 5804, 9989, 11861; Payload ID: 12584 relates to Category No.: 7510, 9914; Payload ID: 12585 relates to Category No.: 3554, 9518, 321, 7477, 7472, 9915; Payload ID: 12586 relates to Category No.: 926, 11861, 9916; Payload ID: 12587 relates to Category No.: 926, 9916; Payload ID: 12588 relates to Category No.: 1630, 11981, 11861, 9917, 5804, 9989, 1225, 1223, 67; Payload ID: 12589 relates to Category No.: 1630, 9917, 5804, 9989, 1225, 1223, 67, 11861, 2559; Payload ID: 12590 relates to Category No.: 1630, 9917, 5804, 9989, 1225, 1223, 67; Payload ID: 12591 relates to Category No.: 6478, 12150, 9804, 9918, 9288, 312; Payload ID: 12592 relates to Category No.: 9962, 5841, 1403, 9919; Payload ID: 12593 relates to Category No.: 926, 6816, 11861, 61, 9879, 59, 9866, 16331; Payload ID: 12594 relates to Category No.: 9853, 11861, 5347; Payload ID: 12595 relates to Category No.: 11861, 9845; Payload ID: 12596 relates to Category No.: 15504, 5551, 5538, 11861, 9844, 5543, 58, 9852, 12081, 3842, 5534, 8989, 15613, 11933, 9853; Payload ID: 12597 relates to Category No.: 11933, 57, 11861, 12425, 58, 12081; Payload ID: 12598 relates to Category No.: 57, 11861, 58; Payload ID: 12599 relates to Category No.: 9852; Payload ID: 12600 relates to Category No.: 11978, 926, 12109, 11861, 1201; Payload ID: 12601 relates to Category No.: 58, 4805; Payload ID: 12602 relates to Category No.: 58, 11861, 9884; Payload ID: 12604 relates to Category No.: 1404, 11861, 3753, 5347, 943, 944; Payload ID: 12605 relates to Category No.: 1536, 9822; Payload ID: 12606 relates to Category No.: 9938; Payload ID: 12607 relates to Category No.: 1504, 12399, 9925; Payload ID: 12608 relates to Category No.: 1405, 12402, 9921, 1185, 1436; Payload ID: 12609 relates to Category No.: 1405, 9939, 9921, 1436; Payload ID: 12610 relates to Category No.: 1405, 9921, 1436; Payload ID: 12611 relates to Category No.: 1405, 9921, 5009, 5003; Payload ID: 12612 relates to Category No.: 1405, 9921; Payload ID: 12613 relates to Category No.: 1405, 9921; Payload ID: 12614 relates to Category No.: 1405, 9921, 1436; Payload ID: 12615 relates to Category No.: 1405, 1438, 9921, 11861, 6434, 9924, 1436, 5101; Payload ID: 12616 relates to Category No.: 1405, 1438, 11861, 6434, 9924, 1436; Payload ID: 12617 relates to Category No.: 9939, 9924, 1448; Payload ID: 12618 relates to Category No.: 6816, 9921, 11861, 9924; Payload ID: 12619 relates to Category No.: 6816, 9921, 11861, 9924; Payload ID: 12620 relates to Category No.: 6816, 11861, 9924, 9921, 1436, 6434; Payload ID: 12621 relates to Category No.: 1405, 9921, 5009, 1436; Payload ID: 12622 relates to Category No.: 1457, 9921, 11861, 11981, 960, 1448; Payload ID: 12623 relates to Category No.: 9939, 51, 1448; Payload ID: 12624 relates to Category No.: 1405, 9921, 9924; Payload ID: 12625 relates to Category No.: 1405, 9921, 1436; Payload ID: 12626 relates to Category No.: 1405, 9921; Payload ID: 12627 relates to Category No.: 9939, 9314, 6434, 1448; Payload ID: 12628 relates to Category No.: 9921, 11861, 9822, 9894, 46; Payload ID: 12629 relates to Category No.: 11861, 1201, 9920; Payload ID: 12630 relates to Category No.: 5308; Payload ID: 12631 relates to Category No.: 5308; Payload ID: 12632 relates to Category No.: 9921, 5308, 311, 6206, 6434; Payload ID: 12633 relates to Category No.: 1405, 14564, 9868, 9974, 11861, 11939, 4894, 1457, 9887, 3752, 6022; Payload ID: 12634 relates to Category No.: 1405, 9868, 14564, 9974, 11861, 9926; Payload ID: 12635 relates to Category No.: 1405, 14564, 9868, 1457, 9974, 11861, 9926; Payload ID: 12636 relates to Category No.: 1405, 14564, 9868, 9974, 11861, 9926, 7125; Payload ID: 12637 relates to Category No.: 1405, 14564, 9868, 9974, 11861, 4893, 9926, 9818, 9896, 9865; Payload ID: 12638 relates to Category No.: 14564, 6816, 9868, 9974, 11861; Payload ID: 12639 relates to Category No.: 1405, 14564, 9868, 9974, 11861, 9926; Payload ID: 12640 relates to Category No.: 9868, 4924, 9974, 11861, 3752, 12417, 9926, 12388; Payload ID: 12641 relates to Category No.: 1405, 14564, 9868, 9974, 11861, 1437; Payload ID: 12642 relates to Category No.: 9926, 1405, 14564, 9868, 9974, 11861, 7192; Payload ID: 12643 relates to Category No.: 1405, 14564, 9868, 11981, 9974, 11861, 12417, 9926, 8989, 12425, 4578; Payload ID: 12644 relates to Category No.: 9868, 14564, 9974, 11861, 9926; Payload ID: 12645 relates to Category No.: 9868, 9974, 9926, 11861, 14564, 1405; Payload ID: 12646 relates to Category No.: 14564, 9868, 9974, 11861, 9926; Payload ID: 12647 relates to Category No.: 14564, 9868, 9974, 11861, 4338; Payload ID: 12648 relates to Category No.: 1630, 11861, 9936, 7470; Payload ID: 12649 relates to Category No.: 1630, 11861, 9868, 9936, 7470; Payload ID: 12650 relates to Category No.: 1630; Payload ID: 12651 relates to Category No.: 6816, 11939, 1630, 1597, 1595, 3688; Payload ID: 12652 relates to Category No.: 1630, 9857, 11861, 9936, 7470; Payload ID: 12653 relates to Category No.: 1630, 9857, 11861, 9936, 7470; Payload ID: 12654 relates to Category No.: 9817, 6224; Payload ID: 12655 relates to Category No.: 9962, 9817, 6224, 11861; Payload ID: 12656 relates to Category No.: 9962, 9817, 6224, 11861, 14878, 5588; Payload ID: 12657 relates to Category No.: 9817; Payload ID: 12658 relates to Category No.: 9817; Payload ID: 12659 relates to Category No.: 5308; Payload ID: 12660 relates to Category No.: 5308; Payload ID: 12661 relates to Category No.: 6224; Payload ID: 12662 relates to Category No.: 9817; Payload ID: 12663 relates to Category No.: 9817, 6224; Payload ID: 12664 relates to Category No.: 9817, 6224, 11861; Payload ID: 12665 relates to Category No.: 6224; Payload ID: 12666 relates to Category No.: 1405, 3303, 11861, 3774, 9946, 15528, 14233, 3752, 14537, 1680; Payload ID: 12667 relates to Category No.: 9946, 1405; Payload ID: 12668 relates to Category No.: 1405, 11861, 9946, 3752, 14537, 1680; Payload ID: 12669 relates to Category No.: 9946; Payload ID: 12670 relates to Category No.: 6210; Payload ID: 12671 relates to Category No.: 6478, 11939, 5470, 9919; Payload ID: 12672 relates to Category No.: 6816, 1630, 11861, 9954; Payload ID: 12673 relates to Category No.: 1630, 9954, 11861; Payload ID: 12674 relates to Category No.: 926, 9955; Payload ID: 12675 relates to Category No.: 1630, 11861, 9959; Payload ID: 12676 relates to Category No.: 9958; Payload ID: 12677 relates to Category No.: 11861; Payload ID: 12678 relates to Category No.: 11861, 14536, 14538; Payload ID: 12679 relates to Category No.: 6816, 138, 613; Payload ID: 12680 relates to Category No.: 926, 6478, 11939, 5956, 11861, 14158, 1504, 456, 646, 4422; Payload ID: 12681 relates to Category No.: 6478, 14158; Payload ID: 12682 relates to Category No.: 6478, 14158, 926, 11939, 5956, 11861, 5347, 1504, 456, 646, 4422; Payload ID: 12683 relates to Category No.: 6478, 11861, 14158, 3753, 5957, 3755; Payload ID: 12684 relates to Category No.: 6478, 14158, 3753; Payload ID: 12685 relates to Category No.: 9282, 6478, 11939, 11861, 5339; Payload ID: 12686 relates to Category No.: 926, 9970, 11861, 5347, 9968; Payload ID: 12687 relates to Category No.: 926, 6816, 9972; Payload ID: 12688 relates to Category No.: 926, 6816, 6924, 5317, 4284, 9967, 9971, 9973, 1630; Payload ID: 12689 relates to Category No.: 1630, 1457, 9978; Payload ID: 12690 relates to Category No.: 1630, 1457, 9978; Payload ID: 12691 relates to Category No.: 1630, 9978, 1457, 11861; Payload ID: 12692 relates to Category No.: 11978, 926, 1457, 9978, 15231, 12109, 3752; Payload ID: 12693 relates to Category No.: 11978, 926, 12109, 9978, 15231, 1457, 3752; Payload ID: 12694 relates to Category No.: 12292, 9977, 4691, 926, 11939, 11861, 3471, 4532, 12239, 1185, 646, 16218, 1504; Payload ID: 12695 relates to Category No.: 12292, 11861, 9977, 4691, 3471, 1504, 646; Payload ID: 12696 relates to Category No.: 12292, 11861, 9977, 4691; Payload ID: 12697 relates to Category No.: 14196, 15468; Payload ID: 12698 relates to Category No.: 9382; Payload ID: 12699 relates to Category No.: 1405, 6478, 11939, 9804, 9986; Payload ID: 12700 relates to Category No.: 926, 5956, 15699; Payload ID: 12701 relates to Category No.: 16331, 7192, 5308, 311; Payload ID: 12702 relates to Category No.: 11861; Payload ID: 12703 relates to Category No.: 6816, 6049, 11861, 2559, 10009, 1630; Payload ID: 12704 relates to Category No.: 11861; Payload ID: 12705 relates to Category No.: 11861; Payload ID: 12706 relates to Category No.: 6816, 3274; Payload ID: 12707 relates to Category No.: 1405, 6816, 1438, 11861, 11759; Payload ID: 12708 relates to Category No.: 6648, 1647; Payload ID: 12709 relates to Category No.: 1647, 6648; Payload ID: 12710 relates to Category No.: 926, 6478, 4965, 3325, 15265, 949, 4834, 15253, 14601, 950; Payload ID: 12712 relates to Category No.: 15503, 14471, 14471, 14379, 11861; Payload ID: 12717 relates to Category No.: 11861; Payload ID: 12718 relates to Category No.: 11861; Payload ID: 12719 relates to Category No.: 11861, 12379; Payload ID: 12720 relates to Category No.: 11861, 2271; Payload ID: 12722 relates to Category No.: 11978, 926, 15504, 12109, 11861, 6574, 14170; Payload ID: 12723 relates to Category No.: 11978, 926, 12109, 11861; Payload ID: 12724 relates to Category No.: 11978, 926, 12109, 11861; Payload ID: 12725 relates to Category No.: 9226, 11861, 15270, 15253; Payload ID: 12726 relates to Category No.: 3303, 15029, 10116; Payload ID: 12727 relates to Category No.: 9518, 12402, 14373, 6348; Payload ID: 12728 relates to Category No.: 6816, 11861, 15493, 12345; Payload ID: 12730 relates to Category No.: 1405, 6816, 6210, 11861, 12425, 9870; Payload ID: 12731 relates to Category No.: 3749, 16331, 6816, 6825, 1630; Payload ID: 12732 relates to Category No.: 15503, 14471, 2858, 9620, 11861, 14537; Payload ID: 12733 relates to Category No.: 9539, 11861, 7192; Payload ID: 12734 relates to Category No.: 9620, 7192, 14537; Payload ID: 12735 relates to Category No.: 9226, 7268, 11861, 10030; Payload ID: 12736 relates to Category No.: 9226, 11861, 10030, 7268; Payload ID: 12737 relates to Category No.: 9226, 14196, 11861; Payload ID: 12738 relates to Category No.: 9226, 11861, 10030; Payload ID: 12741 relates to Category No.: 4864, 5009, 11861, 11939, 11933; Payload ID: 12742 relates to Category No.: 7192; Payload ID: 12743 relates to Category No.: 11861, 2405; Payload ID: 12744 relates to Category No.: 11861; Payload ID: 12745 relates to Category No.: 14564, 11861, 5728, 6022, 15022, 1201; Payload ID: 12746 relates to Category No.: 11890, 14733, 11861, 7192, 5841, 5728, 581, 11983, 1708, 1201; Payload ID: 12747 relates to Category No.: 11861, 1706, 581, 1201; Payload ID: 12748 relates to Category No.: 11861, 1201; Payload ID: 12749 relates to Category No.: 11861, 11939; Payload ID: 12750 relates to Category No.: 12402, 11920, 14503, 14506, 11861, 787; Payload ID: 12751 relates to Category No.: 14503, 12402, 11861, 4710, 9961; Payload ID: 12752 relates to Category No.: 14503, 11861, 9619; Payload ID: 12753 relates to Category No.: 12402, 12399, 11920, 11861, 3752, 16024; Payload ID: 12754 relates to Category No.: 11861; Payload ID: 12757 relates to Category No.: 11861; Payload ID: 12758 relates to Category No.: 1405, 15021, 277, 11861; Payload ID: 12759 relates to Category No.: 1405, 267, 11861; Payload ID: 12760 relates to Category No.: 4864, 11939, 11861, 10092; Payload ID: 12761 relates to Category No.: 4864; Payload ID: 12762 relates to Category No.: 11861; Payload ID: 12763 relates to Category No.: 2293, 5009, 2807; Payload ID: 12764 relates to Category No.: 2293, 5009, 2806; Payload ID: 12765 relates to Category No.: 11861; Payload ID: 12766 relates to Category No.: 10088, 51, 11861, 11939, 11933; Payload ID: 12767 relates to Category No.: 11861, 5347, 10088, 51, 11933; Payload ID: 12768 relates to Category No.: 11861, 11939, 6965, 5009, 9961, 9925, 3508, 3505, 11886, 3512; Payload ID: 12769 relates to Category No.: 9939, 51; Payload ID: 12770 relates to Category No.: 4820, 9939, 4818, 10072, 6245, 6242, 11861, 7125; Payload ID: 12771 relates to Category No.: 4864, 11939, 11933, 11861, 2566, 10092, 10091; Payload ID: 12772 relates to Category No.: 4864, 11939, 11933, 2282, 11861, 5347, 2566, 10092, 15114, 10091; Payload ID: 12773 relates to Category No.: 11978, 926, 16089, 11939, 15612, 12145, 11861, 10089, 16079, 10092, 10091; Payload ID: 12774 relates to Category No.: 11978, 926, 15612, 12402, 11981, 12145, 11861, 10090, 16079, 10092, 10091, 10072, 10096, 14564, 5956, 9844; Payload ID: 12775 relates to Category No.: 11861, 10090, 10072; Payload ID: 12776 relates to Category No.: 11939, 11861, 9877, 11983; Payload ID: 12778 relates to Category No.: 14564, 9939, 820, 11861; Payload ID: 12779 relates to Category No.: 9939, 820; Payload ID: 12780 relates to Category No.: 820, 9939; Payload ID: 12781 relates to Category No.: 9939, 820; Payload ID: 12782 relates to Category No.: 11861, 9877, 9608; Payload ID: 12783 relates to Category No.: 11861, 56, 9608; Payload ID: 12784 relates to Category No.: 9939, 56; Payload ID: 12785 relates to Category No.: 56; Payload ID: 12786 relates to Category No.: 4704, 4698, 9888, 2205; Payload ID: 12787 relates to Category No.: 56, 11861, 9882, 9880, 9890, 9888; Payload ID: 12789 relates to Category No.: 11861, 3032; Payload ID: 12790 relates to Category No.: 14564, 11861, 11939, 11895; Payload ID: 12791 relates to Category No.: 11861; Payload ID: 12793 relates to Category No.: 6816, 11861, 9890, 9882, 9888; Payload ID: 12794 relates to Category No.: 6816, 11861; Payload ID: 12795 relates to Category No.: 14107; Payload ID: 12796 relates to Category No.: 14107, 11861; Payload ID: 12797 relates to Category No.: 14107; Payload ID: 12798 relates to Category No.: 14107, 11861; Payload ID: 12799 relates to Category No.: 14107; Payload ID: 12800 relates to Category No.: 14564, 14107, 11861; Payload ID: 12801 relates to Category No.: 4894, 14107, 11861; Payload ID: 12802 relates to Category No.: 14107; Payload ID: 12804 relates to Category No.: 267, 11861, 5347; Payload ID: 12807 relates to Category No.: 6816; Payload ID: 12808 relates to Category No.: 5960, 11861; Payload ID: 12809 relates to Category No.: 6816; Payload ID: 12810 relates to Category No.: 11861; Payload ID: 12811 relates to Category No.: 11861; Payload ID: 12813 relates to Category No.: 11861; Payload ID: 12814 relates to Category No.: 5538, 11861, 6427; Payload ID: 12815 relates to Category No.: 11861; Payload ID: 12817 relates to Category No.: 9890, 9882, 9880, 9887, 9874, 9877; Payload ID: 12818 relates to Category No.: 11861; Payload ID: 12819 relates to Category No.: 11861; Payload ID: 12820 relates to Category No.: 3752; Payload ID: 12821 relates to Category No.: 267, 10116, 11861, 15024, 712, 2936; Payload ID: 12822 relates to Category No.: 6816, 15503, 14471, 14234, 15528, 14233; Payload ID: 12823 relates to Category No.: 3303, 6816, 14243, 15528, 14255, 11861, 9226, 15503, 14471; Payload ID: 12824 relates to Category No.: 6816, 15503, 14471, 14471, 15528, 14233; Payload ID: 12825 relates to Category No.: 4864, 12082, 11861, 5009, 2386, 4720, 16079, 12189, 5001; Payload ID: 12826 relates to Category No.: 11861; Payload ID: 12827 relates to Category No.: 14429, 12399, 11861; Payload ID: 12828 relates to Category No.: 14429, 11861; Payload ID: 12829 relates to Category No.: 14429, 15617, 11861; Payload ID: 12830 relates to Category No.: 14429, 11861; Payload ID: 12831 relates to Category No.: 14429, 15617, 12399, 11861, 14430, 4893; Payload ID: 12832 relates to Category No.: 14429, 11861; Payload ID: 12833 relates to Category No.: 14429, 11920, 11861, 14105; Payload ID: 12834 relates to Category No.: 14429, 12402, 11861; Payload ID: 12835 relates to Category No.: 14429, 11920, 11861; Payload ID: 12836 relates to Category No.: 11861; Payload ID: 12837 relates to Category No.: 11861; Payload ID: 12839 relates to Category No.: 6210, 11861; Payload ID: 12840 relates to Category No.: 926, 3303, 7020, 942, 14597; Payload ID: 12841 relates to Category No.: 926, 3303, 7020, 942, 14597, 3655, 11861, 7358, 14585; Payload ID: 12842 relates to Category No.: 10116; Payload ID: 12843 relates to Category No.: 11861; Payload ID: 12844 relates to Category No.: 11861; Payload ID: 12845 relates to Category No.: 6816, 15542, 15553, 1504; Payload ID: 12846 relates to Category No.: 11861; Payload ID: 12847 relates to Category No.: 11861; Payload ID: 12848 relates to Category No.: 11861, 4720; Payload ID: 12849 relates to Category No.: 11861, 2566; Payload ID: 12850 relates to Category No.: 11861; Payload ID: 12852 relates to Category No.: 9226, 3303, 11861; Payload ID: 12853 relates to Category No.: 3303, 9226, 6816, 11861; Payload ID: 12854 relates to Category No.: 11861, 11939, 12402, 12399, 1706, 16206; Payload ID: 12856 relates to Category No.: 11939, 12402, 2694, 11861, 1706, 16206, 12399, 11933, 1504, 16204; Payload ID: 12857 relates to Category No.: 11939, 12402, 2694, 11861, 5347, 1706, 16206; Payload ID: 12858 relates to Category No.: 11861, 11939, 12402, 12399, 1706; Payload ID: 12859 relates to Category No.: 11939, 12402, 12399, 11861, 1706, 16206; Payload ID: 12860 relates to Category No.: 11978, 926, 6965, 5956, 12109, 11981, 11861, 669; Payload ID: 12861 relates to Category No.: 11978, 926, 14564, 12109, 11861, 11886; Payload ID: 12862 relates to Category No.: 11978, 926, 9539, 12109, 11861; Payload ID: 12863 relates to Category No.: 11978, 926, 12109, 11861, 5347; Payload ID: 12864 relates to Category No.: 11978, 926; Payload ID: 12865 relates to Category No.: 10120; Payload ID: 12866 relates to Category No.: 3303, 16331, 7489, 15504, 11981, 7472, 10116, 11861, 5347, 3752, 12064, 2405, 11850, 5109, 14324; Payload ID: 12867 relates to Category No.: 3303, 7489, 11861; Payload ID: 12868 relates to Category No.: 7489, 5923, 11861, 9282; Payload ID: 12869 relates to Category No.: 7489, 11861; Payload ID: 12870 relates to Category No.: 7489, 6816, 10116; Payload ID: 12871 relates to Category No.: 7489, 11861; Payload ID: 12872 relates to Category No.: 7489; Payload ID: 12873 relates to Category No.: 7489, 11861, 5957, 12108; Payload ID: 12874 relates to Category No.: 7489, 1630; Payload ID: 12875 relates to Category No.: 3303, 7489, 11861, 3752; Payload ID: 12876 relates to Category No.: 7489; Payload ID: 12877 relates to Category No.: 7489; Payload ID: 12878 relates to Category No.: 7489, 11861; Payload ID: 12879 relates to Category No.: 14196, 11861, 15589, 1201; Payload ID: 12880 relates to Category No.: 15598, 11861, 7268; Payload ID: 12881 relates to Category No.: 11861, 15598, 9226; Payload ID: 12882 relates to Category No.: 14196, 9282, 9226, 11895, 10115, 10116, 11861, 10122, 15589; Payload ID: 12883 relates to Category No.: 9282, 9226, 14196; Payload ID: 12884 relates to Category No.: 9282, 9226, 14196; Payload ID: 12885 relates to Category No.: 9282, 9226, 14196; Payload ID: 12886 relates to Category No.: 9282, 9226, 14196, 10115; Payload ID: 12887 relates to Category No.: 14196, 9282, 9226, 10115, 10116, 11861, 10122; Payload ID: 12888 relates to Category No.: 9282, 9226, 14196; Payload ID: 12889 relates to Category No.: 9282, 9226, 14196; Payload ID: 12890 relates to Category No.: 9282, 9226, 14196, 10116, 11861; Payload ID: 12891 relates to Category No.: 9282, 9226, 14196; Payload ID: 12892 relates to Category No.: 926, 14196, 6478, 9304, 11861, 10144, 6574; Payload ID: 12893 relates to Category No.: 926, 6816, 14196, 9304, 10144; Payload ID: 12894 relates to Category No.: 926, 6816, 14196, 9304, 10144; Payload ID: 12895 relates to Category No.: 9282, 9226, 6816, 14196, 11981, 9225, 10116, 11861, 10119, 7265; Payload ID: 12896 relates to Category No.: 9226; Payload ID: 12897 relates to Category No.: 9226, 14196, 14597, 10116, 7268, 11861; Payload ID: 12898 relates to Category No.: 3303, 9226, 14196, 15895, 10116, 11861, 3752; Payload ID: 12899 relates to Category No.: 3303, 9226, 14196, 10116; Payload ID: 12900 relates to Category No.: 3303, 9226, 14196, 10116; Payload ID: 12902 relates to Category No.: 9518, 12402, 10130, 7421, 14851, 14845, 7425, 7424; Payload ID: 12903 relates to Category No.: 15491, 11861, 6127; Payload ID: 12904 relates to Category No.: 3303, 2405, 11861; Payload ID: 12905 relates to Category No.: 16331, 6816, 11895, 11861; Payload ID: 12906 relates to Category No.: 16331, 6816, 11861; Payload ID: 12907 relates to Category No.: 6816, 16331, 11861; Payload ID: 12908 relates to Category No.: 16331, 6816, 11861; Payload ID: 12909 relates to Category No.: 3303, 16331, 6816, 15503, 14471, 11861, 14243, 15530, 14255; Payload ID: 12910 relates to Category No.: 12399, 11861; Payload ID: 12911 relates to Category No.: 12399, 11861; Payload ID: 12912 relates to Category No.: 1401, 1504, 11981, 11920, 11861, 5841; Payload ID: 12913 relates to Category No.: 1401, 11861; Payload ID: 12914 relates to Category No.: 1405, 1401, 1504, 11861; Payload ID: 12915 relates to Category No.: 1647, 1401, 1504, 11861, 1650, 14799; Payload ID: 12916 relates to Category No.: 1405, 11939, 12402, 16244, 16259, 11861, 16250, 2936, 5347, 5841, 11662, 943, 9961, 322, 16248, 5234, 1450, 2267, 566, 7328; Payload ID: 12917 relates to Category No.: 1405, 1647, 1401, 1430, 14730, 11861, 2936, 5347, 1393, 1650, 566, 14799, 7328; Payload ID: 12918 relates to Category No.: 1401, 1405; Payload ID: 12919 relates to Category No.: 1405, 1401, 11861; Payload ID: 12920 relates to Category No.: 3303, 15491, 11861, 14147, 11895; Payload ID: 12921 relates to Category No.: 3303, 16331, 11861, 2405; Payload ID: 12922 relates to Category No.: 3303, 16331, 11861, 5347; Payload ID: 12923 relates to Category No.: 11861, 3303, 16331; Payload ID: 12924 relates to Category No.: 6816, 2963, 3390, 11861; Payload ID: 12925 relates to Category No.: 3303, 6816, 2963, 3390; Payload ID: 12926 relates to Category No.: 3303, 3390, 11861, 2823, 154; Payload ID: 12927 relates to Category No.: 3303, 9282, 9226, 9248, 3390, 94, 6816, 2405, 138, 11981, 3350, 11861, 11933; Payload ID: 12928 relates to Category No.: 3303, 11933, 3390, 7192, 11861; Payload ID: 12929 relates to Category No.: 3303, 3346, 6401, 6965, 3390, 9304, 11861, 3752, 6816, 2963; Payload ID: 12930 relates to Category No.: 3303, 9282, 9226, 3390, 94, 96, 6816, 2405, 2963, 138, 11861; Payload ID: 12931 relates to Category No.: 3303, 3390, 11861; Payload ID: 12932 relates to Category No.: 3303, 3390, 11861; Payload ID: 12933 relates to Category No.: 3303, 11933, 3390, 11861; Payload ID: 12934 relates to Category No.: 3303, 16331, 9282, 9226, 2405, 3390, 94, 138; Payload ID: 12935 relates to Category No.: 6816, 2963, 3390, 11861; Payload ID: 12936 relates to Category No.: 3303, 9226, 2405, 3390, 94, 11861, 11828, 3993; Payload ID: 12937 relates to Category No.: 3303, 3390, 11861, 5347; Payload ID: 12938 relates to Category No.: 3303, 3390, 9304, 3346, 6816, 6401, 11861; Payload ID: 12939 relates to Category No.: 3303, 6816, 3390, 11861, 3346, 9304; Payload ID: 12940 relates to Category No.: 926, 3303, 9226, 2405, 2963, 3390, 11861, 14600, 157; Payload ID: 12941 relates to Category No.: 3390, 11861; Payload ID: 12942 relates to Category No.: 3390, 11861; Payload ID: 12943 relates to Category No.: 3303, 11861; Payload ID: 12944 relates to Category No.: 9282, 9226, 10116, 11861; Payload ID: 12945 relates to Category No.: 3303, 11933, 3390, 11861; Payload ID: 12946 relates to Category No.: 3303, 16331, 14220, 11861, 3391; Payload ID: 12947 relates to Category No.: 3303, 6816, 14220, 11861, 14151, 3391; Payload ID: 12948 relates to Category No.: 3303, 11917, 14258, 14220, 3391, 11861; Payload ID: 12949 relates to Category No.: 14258, 14220, 3303, 11917, 11861, 3391; Payload ID: 12950 relates to Category No.: 3303, 14220, 3391, 11861, 14226; Payload ID: 12951 relates to Category No.: 3303, 14230, 3391, 2688, 11861, 6816, 15895, 10116, 14282; Payload ID: 12952 relates to Category No.: 3303, 14230, 14151, 3391, 6816, 10116, 11861, 2405; Payload ID: 12953 relates to Category No.: 3303, 11917, 14230, 11861, 3391; Payload ID: 12954 relates to Category No.: 9282, 1630, 14597, 15593, 3391, 14602; Payload ID: 12955 relates to Category No.: 3303, 14258, 14220, 14230, 11861, 3391; Payload ID: 12956 relates to Category No.: 3303, 14258, 14220, 14230, 3391; Payload ID: 12957 relates to Category No.: 9226, 14597, 15593, 3391, 14602; Payload ID: 12958 relates to Category No.: 3303, 14258, 14220, 14230; Payload ID: 12959 relates to Category No.: 3303, 16331, 9226, 3391; Payload ID: 12960 relates to Category No.: 3303, 11917, 14230, 11861, 3391, 6351; Payload ID: 12961 relates to Category No.: 3303, 11917, 14230, 3391; Payload ID: 12962 relates to Category No.: 11917, 14230, 3303, 3391; Payload ID: 12963 relates to Category No.: 3303, 16331, 14258, 14220, 14230, 3391; Payload ID: 12964 relates to Category No.: 3303, 16331, 14258, 14220, 14230, 11861, 3391; Payload ID: 12965 relates to Category No.: 3391; Payload ID: 12966 relates to Category No.: 3303, 6816, 14258, 3391, 2405; Payload ID: 12967 relates to Category No.: 3303, 6816, 14258, 14151, 3391; Payload ID: 12968 relates to Category No.: 3303, 14258, 3391, 11861; Payload ID: 12969 relates to Category No.: 3303, 14258, 3391, 2405; Payload ID: 12970 relates to Category No.: 14258, 3391; Payload ID: 12971 relates to Category No.: 3303, 14258, 11861, 3391; Payload ID: 12972 relates to Category No.: 14258, 3391; Payload ID: 12973 relates to Category No.: 14258, 11861; Payload ID: 12974 relates to Category No.: 3303, 14258, 3391; Payload ID: 12975 relates to Category No.: 3303, 16331, 9226, 14258, 3391; Payload ID: 12976 relates to Category No.: 3303, 10116, 11861, 3391; Payload ID: 12977 relates to Category No.: 10116, 11861, 14317; Payload ID: 12978 relates to Category No.: 11861, 10136; Payload ID: 12979 relates to Category No.: 11861, 926, 2963, 3459, 3655, 958, 10140, 12250, 9286; Payload ID: 12980 relates to Category No.: 1504, 6574, 10147; Payload ID: 12981 relates to Category No.: 6816, 1504, 10147; Payload ID: 12982 relates to Category No.: 6816, 1504, 9122, 10147, 15542; Payload ID: 12983 relates to Category No.: 6816, 1504, 10147; Payload ID: 12984 relates to Category No.: 6816, 1504, 10147; Payload ID: 12985 relates to Category No.: 6816, 1504, 10147; Payload ID: 12986 relates to Category No.: 6816, 1504, 10147, 15542, 15553; Payload ID: 12987 relates to Category No.: 6816, 1504, 10147; Payload ID: 12988 relates to Category No.: 6816, 1504, 10147; Payload ID: 12989 relates to Category No.: 1504, 11861, 6574, 10147; Payload ID: 12990 relates to Category No.: 1405, 1504, 11861, 6574, 10147; Payload ID: 12991 relates to Category No.: 6816, 1504, 10147; Payload ID: 12992 relates to Category No.: 6816, 1504, 10147; Payload ID: 12993 relates to Category No.: 6816, 1504, 10147; Payload ID: 12994 relates to Category No.: 6816, 1504, 10147, 15542, 15553; Payload ID: 12995 relates to Category No.: 6816, 1504, 10147, 5840, 11861; Payload ID: 12996 relates to Category No.: 6816, 1504, 10147, 15542, 15553, 11861; Payload ID: 12997 relates to Category No.: 6816, 15542; Payload ID: 12998 relates to Category No.: 6816, 1504, 10147, 15542, 15553; Payload ID: 12999 relates to Category No.: 9282, 9226, 14196, 10116, 11861, 11700, 10152; Payload ID: 13000 relates to Category No.: 9282, 9226, 14196, 10116, 11861, 7268, 11700; Payload ID: 13001 relates to Category No.: 9282, 9226, 14196, 10116; Payload ID: 13002 relates to Category No.: 9226, 14196, 10116, 11861, 97, 10153, 10121, 10122, 7010; Payload ID: 13003 relates to Category No.: 7192; Payload ID: 13004 relates to Category No.: 9226, 3303, 9282, 10116, 11861, 5347; Payload ID: 13005 relates to Category No.: 7192; Payload ID: 13006 relates to Category No.: 11861; Payload ID: 13011 relates to Category No.: 14141, 14139, 10116, 11861; Payload ID: 13012 relates to Category No.: 14196, 14143, 14139, 11861, 14141, 14134; Payload ID: 13013 relates to Category No.: 11861, 14141, 14134; Payload ID: 13014 relates to Category No.: 9226, 10116, 11861, 14141; Payload ID: 13015 relates to Category No.: 7192, 1467; Payload ID: 13016 relates to Category No.: 7192; Payload ID: 13017 relates to Category No.: 9544, 11861, 16293; Payload ID: 13018 relates to Category No.: 5318; Payload ID: 13019 relates to Category No.: 9225, 9975, 5308, 311; Payload ID: 13020 relates to Category No.: 12142, 11861; Payload ID: 13021 relates to Category No.: 5308, 311; Payload ID: 13022 relates to Category No.: 16331, 6816, 6188; Payload ID: 13023 relates to Category No.: 11861, 5347; Payload ID: 13024 relates to Category No.: 1430, 11665; Payload ID: 13025 relates to Category No.: 1430, 11665, 5843; Payload ID: 13026 relates to Category No.: 6478, 1430, 5470, 11665; Payload ID: 13027 relates to Category No.: 1430, 11861, 11665; Payload ID: 13028 relates to Category No.: 15504, 15495, 11861; Payload ID: 13029 relates to Category No.: 15908, 11861; Payload ID: 13031 relates to Category No.: 10116, 11861; Payload ID: 13032 relates to Category No.: 15908, 11861, 4901, 5347, 11920; Payload ID: 13033 relates to Category No.: 11861; Payload ID: 13034 relates to Category No.: 11861; Payload ID: 13035 relates to Category No.: 11861; Payload ID: 13036 relates to Category No.: 11861, 2793, 5347; Payload ID: 13039 relates to Category No.: 11861, 11886; Payload ID: 13040 relates to Category No.: 11861; Payload ID: 13041 relates to Category No.: 11861; Payload ID: 13042 relates to Category No.: 11861; Payload ID: 13043 relates to Category No.: 11861; Payload ID: 13044 relates to Category No.: 11861, 11886; Payload ID: 13045 relates to Category No.: 11861, 712; Payload ID: 13046 relates to Category No.: 11861, 3303, 16331; Payload ID:

13047 relates to Category No.: 11861; Payload ID: 13048 relates to Category No.: 11861; Payload ID: 13049 relates to Category No.: 1430, 1457, 14659, 11933; Payload ID: 13050 relates to Category No.: 11939, 1430, 1457, 14659, 11920, 566, 5840; Payload ID: 13051 relates to Category No.: 1430, 1457, 14659; Payload ID: 13052 relates to Category No.: 1457, 5726, 1430, 14659, 11861, 12081, 11662; Payload ID: 13053 relates to Category No.: 1430, 5840, 6816, 267, 16251, 11861, 6040, 11662; Payload ID: 13054 relates to Category No.: 926, 940, 5833, 9887, 11666, 9629; Payload ID: 13055 relates to Category No.: 926, 11861, 940, 5833, 11662; Payload ID: 13056 relates to Category No.: 926, 16251, 940, 5841, 5833, 11666, 712, 11861, 11895, 4961; Payload ID: 13057 relates to Category No.: 5833; Payload ID: 13058 relates to Category No.: 5833; Payload ID: 13059 relates to Category No.: 5833; Payload ID: 13060 relates to Category No.: 5833, 11861, 11662; Payload ID: 13061 relates to Category No.: 5833, 11861; Payload ID: 13062 relates to Category No.: 5833; Payload ID: 13063 relates to Category No.: 5833, 9887, 16254, 11861, 5347; Payload ID: 13064 relates to Category No.: 11861, 5833, 4803; Payload ID: 13065 relates to Category No.: 11861, 5833, 9608; Payload ID: 13066 relates to Category No.: 11861, 5833, 4803; Payload ID: 13067 relates to Category No.: 11861, 5833, 4803; Payload ID: 13068 relates to Category No.: 940, 5833, 926, 11861, 15085; Payload ID: 13069 relates to Category No.: 11861, 5833, 4803; Payload ID: 13070 relates to Category No.: 16251, 1430; Payload ID: 13071 relates to Category No.: 926, 16251, 1430; Payload ID: 13072 relates to Category No.: 16251, 5840, 6040, 1430, 11662; Payload ID: 13073 relates to Category No.: 14730, 5833, 11662, 11672; Payload ID: 13074 relates to Category No.: 16250, 11662, 11672; Payload ID: 13075 relates to Category No.: 16250, 11672; Payload ID: 13076 relates to Category No.: 16250, 11662, 11672; Payload ID: 13077 relates to Category No.: 11662, 11672; Payload ID: 13078 relates to Category No.: 11861, 16250, 11662, 11672; Payload ID: 13079 relates to Category No.: 16250, 11662, 11672; Payload ID: 13080 relates to Category No.: 11662, 9482, 11672, 11861, 1430; Payload ID: 13081 relates to Category No.: 9482, 11672, 11664, 11861, 16251; Payload ID: 13082 relates to Category No.: 5840, 11662, 11672, 14335, 11861, 11939, 11933, 11895, 9380; Payload ID: 13083 relates to Category No.: 11672, 16250, 11662, 15274, 6649; Payload ID: 13084 relates to Category No.: 11662, 11672, 16251; Payload ID: 13085 relates to Category No.: 5833, 11662, 11672; Payload ID: 13086 relates to Category No.: 16250, 11662, 11672; Payload ID: 13087 relates to Category No.: 11662, 11672, 16251, 11939, 11933; Payload ID: 13088 relates to Category No.: 3026, 1457, 5840, 11861, 9965, 11981, 11933, 5347, 5841, 37; Payload ID: 13089 relates to Category No.: 3026, 11939, 15895, 16251, 5840, 11861, 5347, 5833, 9965, 14377, 1358, 16254, 16256; Payload ID: 13090 relates to Category No.: 16251, 5840, 11861, 9965; Payload ID: 13091 relates to Category No.: 16251, 5840, 9965; Payload ID: 13092 relates to Category No.: 16251, 1457, 5840, 9965, 11933, 5841; Payload ID: 13093 relates to Category No.: 16251, 5840; Payload ID: 13094 relates to Category No.: 16251, 5840; Payload ID: 13095 relates to Category No.: 16251, 5840, 9965; Payload ID: 13096 relates to Category No.: 16251, 5840, 3026, 1457, 11861, 5841, 11975, 12076, 14377, 11974, 16254, 16256, 16252; Payload ID: 13097 relates to Category No.: 3026, 16251, 5840, 11662, 712, 1457, 16250; Payload ID: 13098 relates to Category No.: 3026, 16251, 5840, 11662, 1457, 16250; Payload ID: 13099 relates to Category No.: 3026, 5840, 11662, 16251; Payload ID: 13100 relates to Category No.: 3026, 5840, 5833, 16251; Payload ID: 13101 relates to Category No.: 3026, 5840, 11662; Payload ID: 13102 relates to Category No.: 3026, 5840, 11861, 11662; Payload ID: 13103 relates to Category No.: 3026, 5840, 11861; Payload ID: 13104 relates to Category No.: 3026, 5840, 11861; Payload ID: 13105 relates to Category No.: 3026, 5840, 5841; Payload ID: 13106 relates to Category No.: 3026, 5840, 11861, 11665, 5843, 11662; Payload ID: 13107 relates to Category No.: 3026, 5840; Payload ID: 13108 relates to Category No.: 3026, 11933, 16251, 5840, 11861, 15903, 5841; Payload ID: 13109 relates to Category No.: 3026, 11933, 16251, 5840, 11861; Payload ID: 13110 relates to Category No.: 3026, 16251, 5840, 11861, 11662, 11675; Payload ID: 13111 relates to Category No.: 3026, 5840, 11861, 5770; Payload ID: 13112 relates to Category No.: 3026, 16251, 5840, 11861, 11662; Payload ID: 13113 relates to Category No.: 3026, 5840, 11861, 16250, 9482; Payload ID: 13114 relates to Category No.: 16251, 5840, 11861, 11666, 11662; Payload ID: 13115 relates to Category No.: 3026, 11981, 5840, 11861, 9482, 14377, 566, 16253, 16252, 16255, 16251, 11664, 12402; Payload ID: 13116 relates to Category No.: 3026, 5840, 11861; Payload ID: 13117 relates to Category No.: 6816, 3026, 5840, 11861; Payload ID: 13118 relates to Category No.: 6816, 16251, 5840, 11861, 983; Payload ID: 13119 relates to Category No.: 6816, 5840, 11861, 5841, 983, 16251, 11662; Payload ID: 13120 relates to Category No.: 3026, 16251, 5840, 11861, 5960, 5841; Payload ID: 13121 relates to Category No.: 3026, 16251, 5840, 11861, 5841; Payload ID: 13122 relates to Category No.: 3026, 5840, 11861, 16251; Payload ID: 13123 relates to Category No.: 3026, 16251, 5840, 11861, 11662; Payload ID: 13124 relates to Category No.: 16251, 11665, 520, 7515, 11861, 5841; Payload ID: 13125 relates to Category No.: 16251, 11665, 520, 11861; Payload ID: 13126 relates to Category No.: 16251, 11665; Payload ID: 13127 relates to Category No.: 3026, 16251, 11861, 11665, 15249, 16254, 16256; Payload ID: 13128 relates to Category No.: 3026, 16251, 11665, 5841, 5833, 16256, 11861, 11939; Payload ID: 13129 relates to Category No.: 16251, 11665, 5841; Payload ID: 13130 relates to Category No.: 16251; Payload ID: 13131 relates to Category No.: 16251, 11665, 5841, 16254; Payload ID: 13132 relates to Category No.: 3026, 16251, 5840, 11861; Payload ID: 13133 relates to Category No.: 3026, 5840, 11861, 11665; Payload ID: 13134 relates to Category No.: 3026, 5840, 11861; Payload ID: 13135 relates to Category No.: 3026, 5840, 11861, 11665, 16251; Payload ID: 13136 relates to Category No.: 11861; Payload ID: 13137 relates to Category No.: 11861; Payload ID: 13138 relates to Category No.: 11861; Payload ID: 13139 relates to Category No.: 11861; Payload ID: 13140 relates to Category No.: 11861; Payload ID: 13141 relates to Category No.: 11861, 7192; Payload ID: 13142 relates to Category No.: 11861; Payload ID: 13143 relates to Category No.: 11861; Payload ID: 13144 relates to Category No.: 11861; Payload ID: 13145 relates to Category No.: 11861, 7192; Payload ID: 13146 relates to Category No.: 11861; Payload ID: 13147 relates to Category No.: 11861; Payload ID: 13148 relates to Category No.: 3303, 15503, 14471, 14471, 14229, 14246, 15528, 14233, 11861, 15504, 2405, 14234, 15495; Payload ID: 13149 relates to Category No.: 15491, 11861, 15493, 3303; Payload ID: 13150 relates to Category No.: 3303, 15503, 14471, 14471, 11861, 12402, 2405, 15525; Payload ID: 13151 relates to Category No.: 3303, 15503, 14471, 14471, 15528, 14233, 11920, 14234; Payload ID: 13152 relates to Category No.: 3303, 15503, 14471, 14234, 14471, 11861, 15528, 14233, 11917; Payload ID: 13153 relates to Category No.: 3303, 15503, 14471, 14471, 14246; Payload ID: 13154 relates to Category No.: 3303, 15503, 14471, 14471, 11861, 5347, 15528, 14233, 14234, 14246; Payload ID: 13155 relates to Category No.: 3303, 15503, 14471, 14471, 11861, 5235; Payload ID: 13156 relates to Category No.: 3303, 15503, 14471, 14471, 14243, 3459, 916; Payload ID: 13157 relates to Category No.: 3303, 15503, 14471, 14471, 15503, 14239, 14240, 15528, 14233, 11861, 15528, 14239; Payload ID: 13158 relates to Category No.: 3303, 15503, 14471, 14234, 14471, 15530, 14233, 15528, 14233, 2405; Payload ID: 13159 relates to Category No.: 3303, 15503, 14471, 14234, 14471, 15528, 14233; Payload ID: 13160 relates to Category No.: 3303, 15503, 14471, 14471, 15504, 15524, 15895, 14251, 14471, 10116, 15530, 14255, 11861, 15525, 7010; Payload ID: 13161 relates to Category No.: 3303, 15503, 14471, 14471; Payload ID: 13162 relates to Category No.: 3303, 15503, 14471, 14243, 14471; Payload ID: 13163 relates to Category No.: 3303, 15503, 14471; Payload ID: 13164 relates to Category No.: 3303, 15503, 14471; Payload ID: 13165 relates to Category No.: 3303, 6816, 11861, 15528, 14233, 2405, 14234; Payload ID: 13166 relates to Category No.: 14309, 4820; Payload ID: 13169 relates to Category No.: 9546, 15358; Payload ID: 13171 relates to Category No.: 832, 6282, 1095; Payload ID: 13174 relates to Category No.: 6816, 15503, 14471, 14234, 6924, 11861, 15530, 14233, 14471, 5109, 9226; Payload ID: 13175 relates to Category No.: 3303, 6816, 6924, 11861, 9226; Payload ID: 13176 relates to Category No.: 6924, 11861, 2405; Payload ID: 13177 relates to Category No.: 6816, 14251, 14471, 6924, 14243, 11861; Payload ID: 13178 relates to Category No.: 6816, 14251, 14471, 14243, 11861, 2405, 5204; Payload ID: 13179 relates to Category No.: 6816, 6924, 11861, 14196, 2406; Payload ID: 13180 relates to Category No.: 9226, 6816, 11861, 15503, 14471, 6924, 14243; Payload ID: 13181 relates to Category No.: 9226, 6816, 11861, 14471, 15491, 327, 14652; Payload ID: 13182 relates to Category No.: 11861, 3303, 16331, 15503, 14471, 5229, 6816; Payload ID: 13183 relates to Category No.: 3303, 16331, 6816, 6924, 11861, 5215, 3007; Payload ID: 13184 relates to Category No.: 6816, 14234, 14471, 15524, 6924, 11861, 15530, 14233, 15525, 13735, 9226; Payload ID: 13185 relates to Category No.: 9226, 6816, 5229, 11861, 11939; Payload ID: 13186 relates to Category No.: 9226, 5229, 11861; Payload ID: 13187 relates to Category No.: 3303, 6816, 11861, 2405, 15495, 5204, 5210; Payload ID: 13188 relates to Category No.: 6816, 11861, 9226, 14471, 5208, 12435; Payload ID: 13190 relates to Category No.: 15893, 16331, 6188, 11861; Payload ID: 13191 relates to Category No.: 16331, 15908, 15893, 6188, 11861, 11975, 11974; Payload ID: 13192 relates to Category No.: 14082; Payload ID: 13193 relates to Category No.: 14082; Payload ID: 13194 relates to Category No.: 14082; Payload ID: 13195 relates to Category No.: 14082; Payload ID: 13196 relates to Category No.: 14082; Payload ID: 13197 relates to Category No.: 14082; Payload ID: 13198 relates to Category No.: 14082; Payload ID: 13199 relates to Category No.: 14082; Payload ID: 13200 relates to Category No.: 14082; Payload ID: 13201 relates to Category No.: 14082; Payload ID: 13202 relates to Category No.: 14082; Payload ID: 13203 relates to Category No.: 14082; Payload ID: 13204 relates to Category No.: 14082; Payload ID: 13205 relates to Category No.: 14082; Payload ID: 13206 relates to Category No.: 14082; Payload ID: 13207 relates to Category No.: 14082; Payload ID: 13208 relates to Category No.: 14082; Payload ID: 13209 relates to Category No.: 14082; Payload ID: 13210 relates to Category No.: 14082; Payload ID: 13211 relates to Category No.: 14082; Payload ID: 13212 relates to Category No.: 14082; Payload ID: 13213 relates to Category No.: 14082; Payload ID: 13214 relates to Category No.: 14082; Payload ID: 13215 relates to Category No.: 14082; Payload ID: 13216 relates to Category No.: 11861; Payload ID: 13217 relates to Category No.: 11861; Payload ID: 13218 relates to Category No.: 11861; Payload ID: 13219 relates to Category No.: 15503, 14471, 3303, 14471, 15504, 11861, 15528, 14233, 11933, 14234; Payload ID: 13220 relates to Category No.: 3303, 15503, 14471, 14471, 15504, 11861; Payload ID: 13221 relates to Category No.: 3303, 15503, 14471, 14471, 11861, 14240, 15528, 14239; Payload ID: 13222 relates to Category No.: 15503, 14471, 3303, 14471, 11861; Payload ID: 13223 relates to Category No.: 15495, 11861; Payload ID: 13224 relates to Category No.: 14082, 11861; Payload ID: 13225 relates to Category No.: 15503, 14471, 15973, 11864; Payload ID: 13226 relates to Category No.: 15973, 11861, 11864; Payload ID: 13227 relates to Category No.: 15973, 11861, 2271; Payload ID: 13228 relates to Category No.: 15973, 15495, 11861; Payload ID: 13229 relates to Category No.: 15973, 2271, 11861; Payload ID: 13230 relates to Category No.: 11861; Payload ID: 13231 relates to Category No.: 11861; Payload ID: 13232 relates to Category No.: 11861, 7192; Payload ID: 13233 relates to Category No.: 11861; Payload ID: 13234 relates to Category No.: 11861, 12399; Payload ID: 13235 relates to Category No.: 11861; Payload ID: 13236 relates to Category No.: 11861, 7192; Payload ID: 13237 relates to Category No.: 11861; Payload ID: 13238 relates to Category No.: 11861; Payload ID: 13239 relates to Category No.: 11861; Payload ID: 13240 relates to Category No.: 11978, 926, 1457, 1459, 12109; Payload ID: 13241 relates to Category No.: 16331, 6825, 6829, 3663; Payload ID: 13242 relates to Category No.: 14504, 3665; Payload ID: 13243 relates to Category No.: 11861, 9821; Payload ID: 13244 relates to Category No.: 9821; Payload ID: 13245 relates to Category No.: 9821; Payload ID: 13246 relates to Category No.: 9821; Payload ID: 13247 relates to Category No.: 267; Payload ID: 13248 relates to Category No.: 11861; Payload ID: 13249 relates to Category No.: 14395; Payload ID: 13250 relates to Category No.: 15908, 15893, 6188, 11861, 5347, 15916; Payload ID: 13251 relates to Category No.: 10116, 11861, 5347; Payload ID: 13252 relates to Category No.: 10116, 11861, 14147, 15861, 15865, 14727; Payload ID: 13253 relates to Category No.: 10116, 11861; Payload ID: 13254 relates to Category No.: 10116; Payload ID: 13255 relates to Category No.: 11699; Payload ID: 13256 relates to Category No.: 11861, 15872, 15861; Payload ID: 13257 relates to Category No.: 11978, 926, 12109, 10116, 11861; Payload ID: 13258 relates to Category No.: 14196, 15491, 10116, 11861, 14147, 686; Payload ID: 13259 relates to Category No.: 9226, 14196, 5923, 10116, 15844, 11861, 14395, 15872, 15850, 15869, 11704; Payload ID: 13260 relates to Category No.: 6816, 11933, 15580, 15625, 15542; Payload ID: 13261 relates to Category No.: 11933, 15580, 15625; Payload ID: 13262 relates to Category No.: 11710, 9518, 303, 9523, 2332; Payload ID: 13263 relates to Category No.: 11710, 9518, 303, 9523; Payload ID: 13264 relates to Category No.: 9383, 11861, 8959; Payload ID: 13265 relates to Category No.: 894, 1369, 1401, 3663, 1153, 11861, 9608, 9619; Payload ID: 13266 relates to Category No.: 3663, 894, 11861; Payload ID: 13267 relates to Category No.: 14503, 3663, 11861; Payload ID: 13268 relates to Category No.: 11861; Payload ID: 13269 relates to Category No.: 11861; Payload ID: 13271 relates to Category No.: 16331, 11861, 15504; Payload ID: 13272 relates to Category No.: 16331, 11861; Payload ID: 13273 relates to Category No.: 16331, 11861;

Payload ID: 13274 relates to Category No.: 16331; Payload ID: 13275 relates to Category No.: 11981, 5960, 12359, 11861, 4389, 1173; Payload ID: 13276 relates to Category No.: 2405, 3390, 3350, 11861, 6574; Payload ID: 13277 relates to Category No.: 3350, 6816, 11861; Payload ID: 13278 relates to Category No.: 3303, 6816, 138, 3350, 9304; Payload ID: 13279 relates to Category No.: 6965, 2672, 11861, 5347, 15766, 5841, 2271, 960, 6022, 6816; Payload ID: 13281 relates to Category No.: 2672; Payload ID: 13282 relates to Category No.: 267, 15495, 11861, 3752, 6127, 12076, 11983; Payload ID: 13283 relates to Category No.: 11981, 3464, 11861, 11991; Payload ID: 13285 relates to Category No.: 5009, 11861, 9617, 2566; Payload ID: 13286 relates to Category No.: 11861, 5009, 9617, 2566; Payload ID: 13287 relates to Category No.: 11939, 5865, 9518, 9518, 315, 16283, 6049, 11748, 9629, 4158; Payload ID: 13288 relates to Category No.: 5865, 9518, 9518, 315, 16283, 6049, 11748; Payload ID: 13289 relates to Category No.: 5865, 9518, 9518, 315, 16283, 6049, 11748, 11861, 11747, 11746; Payload ID: 13290 relates to Category No.: 9383, 11861; Payload ID: 13291 relates to Category No.: 11861, 8959, 9383; Payload ID: 13292 relates to Category No.: 267, 295, 10116, 11861, 9887, 444, 11782, 14106; Payload ID: 13293 relates to Category No.: 267, 295, 11861, 9887, 444; Payload ID: 13294 relates to Category No.: 267, 6210, 11861; Payload ID: 13295 relates to Category No.: 6210, 295; Payload ID: 13296 relates to Category No.: 894; Payload ID: 13297 relates to Category No.: 11861, 14662; Payload ID: 13298 relates to Category No.: 11861, 5696; Payload ID: 13299 relates to Category No.: 3303, 16331, 15503, 14471, 14234, 14471, 12402, 14961, 14968, 11861, 15528, 14233, 3752, 943, 14251, 6183; Payload ID: 13300 relates to Category No.: 4976, 14961, 11861; Payload ID: 13301 relates to Category No.: 4976, 14961, 14968; Payload ID: 13302 relates to Category No.: 12399; Payload ID: 13303 relates to Category No.: 12399; Payload ID: 13304 relates to Category No.: 12399; Payload ID: 13305 relates to Category No.: 14961, 12399, 11861; Payload ID: 13306 relates to Category No.: 12399; Payload ID: 13307 relates to Category No.: 14961, 14968; Payload ID: 13308 relates to Category No.: 14961, 14968; Payload ID: 13309 relates to Category No.: 14564, 11861; Payload ID: 13310 relates to Category No.: 11861, 7192; Payload ID: 13311 relates to Category No.: 11939, 11981, 11861, 12064; Payload ID: 13312 relates to Category No.: 9226, 15504, 10116, 11861; Payload ID: 13313 relates to Category No.: 3303, 6816, 11861, 3752; Payload ID: 13315 relates to Category No.: 14196, 11861, 1201; Payload ID: 13316 relates to Category No.: 3303, 5009, 11861, 1173, 245; Payload ID: 13317 relates to Category No.: 1434, 1405, 11917, 11861, 5347, 1439, 11854, 1201, 1327, 11939; Payload ID: 13318 relates to Category No.: 11939, 11861, 1439, 12165, 11917; Payload ID: 13321 relates to Category No.: 11895, 15524, 5109, 11861, 3752, 2616, 2614, 12165, 14251, 14471; Payload ID: 13322 relates to Category No.: 11895, 11861, 3936, 12064, 611; Payload ID: 13323 relates to Category No.: 4864, 4821; Payload ID: 13324 relates to Category No.: 4821; Payload ID: 13325 relates to Category No.: 4820, 8963; Payload ID: 13326 relates to Category No.: 4820, 8963; Payload ID: 13327 relates to Category No.: 5259, 11861, 11768; Payload ID: 13328 relates to Category No.: 6816, 11939, 2881, 11861, 9440, 9636, 11767; Payload ID: 13329 relates to Category No.: 3303, 11861; Payload ID: 13330 relates to Category No.: 5259, 8959, 11772; Payload ID: 13331 relates to Category No.: 4820, 11861, 8960, 8963; Payload ID: 13332 relates to Category No.: 894, 267, 11917, 11861, 5353, 4710; Payload ID: 13333 relates to Category No.: 3303, 2405, 2963, 11861, 5347, 12425, 3347, 5101, 12270, 3349, 3271, 7356, 3936; Payload ID: 13334 relates to Category No.: 3303, 15503, 14471, 15895, 10116, 11861, 5308; Payload ID: 13338 relates to Category No.: 11776, 4075; Payload ID: 13339 relates to Category No.: 11776; Payload ID: 13341 relates to Category No.: 3303; Payload ID: 13342 relates to Category No.: 11861; Payload ID: 13347 relates to Category No.: 11861; Payload ID: 13349 relates to Category No.: 11861; Payload ID: 13352 relates to Category No.: 11861; Payload ID: 13366 relates to Category No.: 6816, 10116, 11861; Payload ID: 13375 relates to Category No.: 15895; Payload ID: 13377 relates to Category No.: 15029; Payload ID: 13378 relates to Category No.: 1405; Payload ID: 13379 relates to Category No.: 1405, 11861; Payload ID: 13380 relates to Category No.: 1405; Payload ID: 13381 relates to Category No.: 1405, 7192; Payload ID: 13382 relates to Category No.: 3752, 11854; Payload ID: 13383 relates to Category No.: 9620, 3665; Payload ID: 13385 relates to Category No.: 12292; Payload ID: 13386 relates to Category No.: 1201, 11861, 2405, 15504, 10116; Payload ID: 13387 relates to Category No.: 4023, 5009, 11861; Payload ID: 13389 relates to Category No.: 6965, 11861; Payload ID: 13390 relates to Category No.: 11861, 6816; Payload ID: 13392 relates to Category No.: 11861; Payload ID: 13393 relates to Category No.: 10116, 11861; Payload ID: 13394 relates to Category No.: 10116, 11861; Payload ID: 13395 relates to Category No.: 11895, 10116; Payload ID: 13396 relates to Category No.: 11861; Payload ID: 13397 relates to Category No.: 11861; Payload ID: 13399 relates to Category No.: 7192; Payload ID: 13403 relates to Category No.: 11861; Payload ID: 13408 relates to Category No.: 11861; Payload ID: 13409 relates to Category No.: 267, 11861; Payload ID: 13410 relates to Category No.: 5865, 9518, 9518, 315, 16283, 6049, 7192, 2566, 11886, 11749; Payload ID: 13411 relates to Category No.: 5865, 9518, 9518, 315, 16283, 6049, 11749; Payload ID: 13412 relates to Category No.: 5865, 9518, 9518, 315, 16283, 6049, 11749; Payload ID: 13414 relates to Category No.: 5865, 9518, 9518, 315, 16283, 9518, 317, 5414, 6049, 11861, 11750; Payload ID: 13415 relates to Category No.: 5865, 3554, 9518, 9518, 315, 16283, 9518, 317, 5414, 6049, 11861, 11750; Payload ID: 13416 relates to Category No.: 5865, 9518, 317, 5414, 6049, 11861, 11750, 9518, 9518, 315, 16283; Payload ID: 13417 relates to Category No.: 11933, 5588, 3663, 11918, 10116, 11861, 5892, 11750, 3752; Payload ID: 13418 relates to Category No.: 1405, 5865, 9518, 9518, 315, 16283, 9518, 315, 16283, 83, 679, 6049; Payload ID: 13419 relates to Category No.: 14503, 14506, 11861, 14505; Payload ID: 13420 relates to Category No.: 14503, 14506, 14505; Payload ID: 13421 relates to Category No.: 14502, 14506, 11861; Payload ID: 13422 relates to Category No.: 926, 9282, 632, 11783; Payload ID: 13423 relates to Category No.: 6700; Payload ID: 13424 relates to Category No.: 1369, 11861, 322; Payload ID: 13425 relates to Category No.: 2346; Payload ID: 13426 relates to Category No.: 3303, 16331, 11939, 11933, 15895, 15491, 11861, 15097, 2542, 14652; Payload ID: 13427 relates to Category No.: 5259, 12402, 4821, 15798, 15800, 15788; Payload ID: 13428 relates to Category No.: 3303, 14471, 11861, 14240, 2405, 15528, 14239, 11895, 1153, 15530, 14239; Payload ID: 13429 relates to Category No.: 926, 6816, 1209, 3752, 11797, 1208; Payload ID: 13430 relates to Category No.: 926, 6188, 11797, 231; Payload ID: 13431 relates to Category No.: 4864, 2293, 4540, 2806; Payload ID: 13432 relates to Category No.: 14503, 3663; Payload ID: 13433 relates to Category No.: 12402, 3665, 14504; Payload ID:

13434 relates to Category No.: 14503, 11861, 3663, 11886; Payload ID: 13435 relates to Category No.: 14503; Payload ID: 13436 relates to Category No.: 14503, 9619, 11861, 9629, 3663; Payload ID: 13437 relates to Category No.: 14503, 9619, 5009, 3663, 11861, 8855; Payload ID: 13438 relates to Category No.: 14503, 9619; Payload ID: 13439 relates to Category No.: 14503, 10116, 11861, 787, 12107, 6337, 788, 16154, 6334, 14732, 16151, 12408; Payload ID: 13440 relates to Category No.: 3749, 6210, 4821, 11861; Payload ID: 13441 relates to Category No.: 3749, 4821; Payload ID: 13442 relates to Category No.: 3303, 15503, 14471, 15524, 15495, 11861, 2691, 15530, 14233, 15503, 14239, 6184, 6083, 2975, 14251, 14471, 14471; Payload ID: 13443 relates to Category No.: 3303, 15530, 14233; Payload ID: 13444 relates to Category No.: 4820, 11861, 11803, 11807; Payload ID: 13445 relates to Category No.: 4820, 8957, 11803, 11806, 11807; Payload ID: 13446 relates to Category No.: 15629, 11861, 14085, 4103, 11813, 14662; Payload ID: 13447 relates to Category No.: 4820, 11805; Payload ID: 13448 relates to Category No.: 4820, 11805; Payload ID: 13449 relates to Category No.: 4820, 14251, 6183, 11805, 11861; Payload ID: 13450 relates to Category No.: 4820, 11805, 11861; Payload ID: 13451 relates to Category No.: 4608, 11814; Payload ID: 13452 relates to Category No.: 6401, 4976, 3554, 11919, 11861, 4608, 11814, 3303; Payload ID: 13453 relates to Category No.: 15973, 11861, 11814, 15250; Payload ID: 13455 relates to Category No.: 4820, 11806; Payload ID: 13456 relates to Category No.: 11861; Payload ID: 13457 relates to Category No.: 4820, 4924; Payload ID: 13458 relates to Category No.: 5865, 4976, 7223, 9518, 315, 16283, 11861, 11818; Payload ID: 13459 relates to Category No.: 16331, 9518, 77, 36, 41; Payload ID: 13460 relates to Category No.: 36, 41, 16331, 9518; Payload ID: 13461 relates to Category No.: 6816, 4976, 9747, 11816, 11861, 3274, 6210; Payload ID: 13462 relates to Category No.: 6816, 4976, 9747, 11816, 11861, 3752, 807, 11939, 6210, 9518, 317, 5414; Payload ID: 13464 relates to Category No.: 11861; Payload ID: 13472 relates to Category No.: 11861, 14324, 16296; Payload ID: 13474 relates to Category No.: 3303; Payload ID: 13475 relates to Category No.: 3303; Payload ID: 13476 relates to Category No.: 3303, 7192; Payload ID: 13477 relates to Category No.: 14503; Payload ID: 13478 relates to Category No.: 14503; Payload ID: 13479 relates to Category No.: 14503, 6816; Payload ID: 13480 relates to Category No.: 14503, 14379, 14506, 9619; Payload ID: 13481 relates to Category No.: 14506; Payload ID: 13482 relates to Category No.: 1405, 14503, 11861; Payload ID: 13483 relates to Category No.: 14503, 14506, 11861; Payload ID: 13484 relates to Category No.: 14503; Payload ID: 13485 relates to Category No.: 14503; Payload ID: 13486 relates to Category No.: 1405, 14503, 14506, 11861; Payload ID: 13487 relates to Category No.: 14503, 14506; Payload ID: 13488 relates to Category No.: 14503; Payload ID: 13489 relates to Category No.: 14503; Payload ID: 13490 relates to Category No.: 14503; Payload ID: 13491 relates to Category No.: 14503; Payload ID: 13492 relates to Category No.: 14503; Payload ID: 13493 relates to Category No.: 14503; Payload ID: 13494 relates to Category No.: 14503; Payload ID: 13495 relates to Category No.: 14503; Payload ID: 13496 relates to Category No.: 15376, 14503; Payload ID: 13497 relates to Category No.: 14503; Payload ID: 13498 relates to Category No.: 14503; Payload ID: 13499 relates to Category No.: 14503; Payload ID: 13500 relates to Category No.: 14503; Payload ID: 13501 relates to Category No.: 14503; Payload ID: 13502 relates to Category No.: 14503; Payload ID: 13503 relates to Category No.: 14503, 14506, 11861; Payload ID: 13504 relates to Category No.: 11861; Payload ID: 13505 relates to Category No.: 11861; Payload ID: 13506 relates to Category No.: 11861, 11835; Payload ID: 13507 relates to Category No.: 11861; Payload ID: 13510 relates to Category No.: 15376, 3663; Payload ID: 13511 relates to Category No.: 926, 5308, 942, 15239, 11842, 10116, 11861; Payload ID: 13512 relates to Category No.: 15239, 11842, 926, 5308, 942, 11861; Payload ID: 13513 relates to Category No.: 926, 5308, 15239, 11842, 942, 15491, 15495, 11861; Payload ID: 13514 relates to Category No.: 926, 5308, 942, 15239, 11842, 11861; Payload ID: 13515 relates to Category No.: 926, 15239, 11842, 5308, 942, 15504, 11861, 15493, 15418, 12402; Payload ID: 13516 relates to Category No.: 926, 5308, 15239, 11842, 942, 11861, 1327, 11861; Payload ID: 13517 relates to Category No.: 3663, 3755, 1201; Payload ID: 13518 relates to Category No.: 15504, 11861; Payload ID: 13519 relates to Category No.: 11861; Payload ID: 13520 relates to Category No.: 11861; Payload ID: 13521 relates to Category No.: 15029, 11861; Payload ID: 13522 relates to Category No.: 6816, 6829, 11861, 3662, 11835; Payload ID: 13523 relates to Category No.: 3663, 3755, 11861, 1201; Payload ID: 13524 relates to Category No.: 3755, 11861; Payload ID: 13525 relates to Category No.: 10116, 11861, 5347, 10163, 15504; Payload ID: 13526 relates to Category No.: 11861, 1201; Payload ID: 13527 relates to Category No.: 942, 11861; Payload ID: 13528 relates to Category No.: 11939, 11861; Payload ID: 13530 relates to Category No.: 1178, 15491, 11861; Payload ID: 13531 relates to Category No.: 3662, 11861; Payload ID: 13532 relates to Category No.: 3662; Payload ID: 13533 relates to Category No.: 9539, 11861, 5347, 3662, 6647; Payload ID: 13534 relates to Category No.: 11861, 9617, 6427, 1201; Payload ID: 13535 relates to Category No.: 11861, 3665, 11835; Payload ID: 13536 relates to Category No.: 11861; Payload ID: 13537 relates to Category No.: 14196, 15376, 3663, 11861; Payload ID: 13538 relates to Category No.: 15376, 3663, 11861; Payload ID: 13539 relates to Category No.: 15376, 3663, 11861; Payload ID: 13540 relates to Category No.: 15376, 3663, 11861; Payload ID: 13541 relates to Category No.: 15376, 3663, 11861; Payload ID: 13542 relates to Category No.: 14196, 15376, 3663, 11861, 9014, 12261; Payload ID: 13543 relates to Category No.: 15376, 3663, 11861, 5347; Payload ID: 13544 relates to Category No.: 15376, 3663; Payload ID: 13545 relates to Category No.: 15376, 3663, 11861; Payload ID: 13546 relates to Category No.: 15376, 3663, 11861; Payload ID: 13547 relates to Category No.: 15376, 3663, 11861; Payload ID: 13548 relates to Category No.: 15376, 3663, 11861; Payload ID: 13549 relates to Category No.: 15376, 3663, 11861, 6242; Payload ID: 13550 relates to Category No.: 15376, 3663, 11861, 9619; Payload ID: 13551 relates to Category No.: 15376, 3663; Payload ID: 13552 relates to Category No.: 15376, 3663, 11861; Payload ID: 13553 relates to Category No.: 15376, 3663, 11861; Payload ID: 13554 relates to Category No.: 15376, 3663, 11861, 11835; Payload ID: 13555 relates to Category No.: 14603, 3303, 11861, 4854, 15253, 2999; Payload ID: 13556 relates to Category No.: 6924, 12162, 10116, 11861, 5347, 3752, 12054, 9080, 12161, 5204, 7128, 5214; Payload ID: 13557 relates to Category No.: 14564, 11939, 14082, 15491, 6924, 5227, 12162, 11861, 3936, 12161, 686, 5204, 15409, 9763, 11762; Payload ID: 13558 relates to Category No.: 6816, 6924, 5227, 12162, 11861, 12161; Payload ID: 13559 relates to Category No.: 11933, 6924, 15495, 5227, 11861, 2691, 14147, 12161, 12164, 11886; Payload ID: 13560 relates to Category No.: 5105, 6924, 5227, 12162, 11861, 5204, 12163, 5214, 5212, 5205, 2405, 12161; Payload ID: 13561 relates to Category No.: 12162, 6924, 5105, 14351, 5227, 14147, 12164, 12163, 5214, 23, 11861; Payload ID: 13562 relates to Category No.: 11939, 11933, 14351, 6924, 5227, 12162, 11861, 5347, 12163, 5214; Payload ID: 13563 relates to Category No.: 6924, 11861; Payload ID: 13564 relates to Category No.: 14196, 10116, 11861, 10121, 10122; Payload ID: 13565 relates to Category No.: 14196, 11861; Payload ID: 13566 relates to Category No.: 1405, 14503, 11861, 9619; Payload ID: 13567 relates to Category No.: 12399, 11861; Payload ID: 13568 relates to Category No.: 14961, 11918, 11861, 5892, 9700, 3293; Payload ID: 13569 relates to Category No.: 2854, 11918, 10116, 11861, 5892, 9926, 3293, 11919; Payload ID: 13570 relates to Category No.: 11918, 10116, 11861, 5892; Payload ID: 13571 relates to Category No.: 9518, 11918, 11861; Payload ID: 13572 relates to Category No.: 11918, 11861, 5892; Payload ID: 13573 relates to Category No.: 11918, 9700, 11861; Payload ID: 13574 relates to Category No.: 16331, 1630, 1367, 11929, 11861, 3471, 9629, 5897; Payload ID: 13575 relates to Category No.: 3303, 16331, 15491, 6188, 15495, 11861, 3752, 686, 15099, 15504, 15895, 15101; Payload ID: 13576 relates to Category No.: 16331, 15504, 15491, 6188, 11861, 686, 15099, 3303, 15895, 15101; Payload ID: 13577 relates to Category No.: 16331, 15101, 11895, 6188, 11861, 3752, 11665, 12064; Payload ID: 13578 relates to Category No.: 16331, 15895, 15101, 6188, 11861, 15099, 3303, 11895; Payload ID: 13579 relates to Category No.: 1405, 9921; Payload ID: 13580 relates to Category No.: 11983, 6816, 942, 11895, 12402, 277, 4821, 11920, 11861, 5347, 3752, 848; Payload ID: 13581 relates to Category No.: 11861, 11974, 1475; Payload ID: 13582 relates to Category No.: 1475; Payload ID: 13583 relates to Category No.: 1475; Payload ID: 13584 relates to Category No.: 9939, 11861, 2936; Payload ID: 13585 relates to Category No.: 11861, 2936, 15629, 5347, 9818, 6210; Payload ID: 13586 relates to Category No.: 9939, 6210, 11861, 2936, 1403; Payload ID: 13587 relates to Category No.: 1405, 11861, 5841, 11983, 9961, 14196; Payload ID: 13588 relates to Category No.: 6816, 11861, 11978, 926, 16331, 12109, 11982, 3752, 5198, 1441; Payload ID: 13589 relates to Category No.: 11978, 926, 16331, 2405, 5105, 12109, 11982, 11861, 6185, 11983, 686, 5198, 1404; Payload ID: 13590 relates to Category No.: 11861, 11978, 926, 3749, 6816, 12109, 9096, 11982, 3752, 5543, 5957, 1449; Payload ID: 13591 relates to Category No.: 11861, 11983; Payload ID: 13592 relates to Category No.: 11861, 11978, 926, 3749, 14564, 6816, 12109, 11982, 295, 3752, 1449, 37, 12398, 3941; Payload ID: 13593 relates to Category No.: 11978, 926, 11861, 6816, 12109, 11982, 3752, 12379, 1449; Payload ID: 13594 relates to Category No.: 11861, 11978, 926, 16331, 12109, 11982, 12114, 1441; Payload ID: 13595 relates to Category No.: 11978, 926, 6816, 12109, 9939, 11982, 11861, 11920; Payload ID: 13596 relates to Category No.: 11978, 926, 6816, 15908, 12109, 11982, 11861; Payload ID: 13597 relates to Category No.: 11978, 926, 6816, 12109, 11982, 11861, 5543, 11981, 11920, 11665, 37, 9925; Payload ID: 13598 relates to Category No.: 11978, 926, 6816, 12109, 11982, 11861, 5347; Payload ID: 13599 relates to Category No.: 11978, 926, 6816, 12109, 11982, 11861; Payload ID: 13600 relates to Category No.: 11978, 926, 6816, 5956, 11982, 11861; Payload ID: 13601 relates to Category No.: 11978, 926, 9096; Payload ID: 13602 relates to Category No.: 11978, 926, 2405, 5105, 12109, 5109, 12363, 11982, 11861, 4901, 6185, 11983, 5196, 686; Payload ID: 13603 relates to Category No.: 5956, 11861, 11978, 926, 12109, 5109, 11982, 10116, 14218; Payload ID: 13604 relates to Category No.: 11978, 926, 12109, 11982, 11861; Payload ID: 13605 relates to Category No.: 11978, 926, 6816, 2405, 5225, 11861, 658, 15231, 1473, 21, 14, 12109, 11895, 5957; Payload ID: 13606 relates to Category No.: 11978, 926, 6816, 2405, 12109, 5225, 11861, 12114, 658, 21, 14; Payload ID: 13607 relates to Category No.: 11978, 11861, 11981, 658; Payload ID: 13608 relates to Category No.: 11861, 5347, 658, 11981; Payload ID: 13609 relates to Category No.: 11978, 926, 11981, 11861, 456, 658, 1476, 646, 1473; Payload ID: 13610 relates to Category No.: 926, 11981, 456, 11977, 9980, 1476, 1475, 646, 658; Payload ID: 13611 relates to Category No.: 926, 11981, 5956, 658; Payload ID: 13612 relates to Category No.: 11978, 926, 15895, 12109, 11981, 11861, 11975, 12114, 1473; Payload ID: 13613 relates to Category No.: 11978, 926, 6478, 15895, 12109, 11861, 1473; Payload ID: 13614 relates to Category No.: 11978, 926, 12109, 1473; Payload ID: 13615 relates to Category No.: 15895, 11861, 11974, 1476, 1475, 1467; Payload ID: 13616 relates to Category No.: 1467, 11974, 1476, 1475; Payload ID: 13617 relates to Category No.: 15895, 11861, 1467, 11974, 1476, 1475; Payload ID: 13618 relates to Category No.: 15895, 11974, 1476, 1475, 11861, 11981, 11920, 1467; Payload ID: 13619 relates to Category No.: 11978, 926, 12109, 2262, 1404, 11861, 2258; Payload ID: 13620 relates to Category No.: 11978, 926, 12109, 2262, 2258, 11861, 11939; Payload ID: 13621 relates to Category No.: 11978, 926, 3303, 15504, 12109, 10116, 11861, 9988, 512, 3387, 1201, 3459, 3752; Payload ID: 13622 relates to Category No.: 3749, 11939, 3464, 10116, 11861, 5347, 3752, 5956; Payload ID: 13623 relates to Category No.: 11978, 926, 12109, 6816, 5956, 11861; Payload ID: 13624 relates to Category No.: 11978, 926, 12109, 11861, 1473; Payload ID: 13625 relates to Category No.: 4320, 9651; Payload ID: 13626 relates to Category No.: 9651, 4320, 15542, 15553; Payload ID: 13627 relates to Category No.: 12158, 15960, 4557, 15936; Payload ID: 13628 relates to Category No.: 242, 11861, 1131; Payload ID: 13629 relates to Category No.: 15542, 15553, 242, 11861, 12065; Payload ID: 13630 relates to Category No.: 6816, 5308, 9804, 11861, 9962, 11886, 12076, 14147; Payload ID: 13631 relates to Category No.: 5308, 9962, 6816, 9804, 11981, 11861, 7407, 7414, 12111; Payload ID: 13632 relates to Category No.: 6816, 5308, 9804, 11981, 9962, 12111, 10116, 11861, 12064, 11895, 11920, 11886, 12076, 12081, 6022; Payload ID: 13633 relates to Category No.: 12076, 12113, 11861; Payload ID: 13634 relates to Category No.: 12082; Payload ID: 13635 relates to Category No.: 12082, 12086, 9806; Payload ID: 13636 relates to Category No.: 12113; Payload ID: 13637 relates to Category No.: 12082; Payload ID: 13638 relates to Category No.: 12082, 11861, 12113; Payload ID: 13639 relates to Category No.: 11861, 12082, 12086, 11991, 12113, 2957, 2953, 2955, 2954, 2956; Payload ID: 13640 relates to Category No.: 12082, 12113; Payload ID: 13641 relates to Category No.: 11861, 12082, 12113; Payload ID: 13642 relates to Category No.: 3303, 6816, 10116, 12082; Payload ID: 13643 relates to Category No.: 14564, 11981, 9807, 11861, 3753, 37, 9962; Payload ID: 13644 relates to Category No.: 9807, 11861, 3749; Payload ID: 13645 relates to Category No.: 9807, 11861; Payload ID: 13646 relates to Category No.: 15504, 15495, 11861, 5347; Payload ID: 13647 relates to Category No.: 15504, 11861; Payload ID: 13648 relates to Category No.: 11981, 11861, 12076, 12086, 12084, 12083, 12081; Payload ID: 13649 relates to Category No.: 11861, 12111; Payload ID: 13650 relates to Category No.: 11861, 12086; Payload ID: 13651 relates to Category No.: 11861, 12086; Payload ID: 13652 relates to Category No.: 12082, 12113, 9806;

Payload ID: 13653 relates to Category No.: 267, 11861, 9805; Payload ID: 13654 relates to Category No.: 9805; Payload ID: 13655 relates to Category No.: 11861, 9805, 12082; Payload ID: 13656 relates to Category No.: 11861, 9805, 12082; Payload ID: 13657 relates to Category No.: 11861, 9805; Payload ID: 13658 relates to Category No.: 9805, 12082; Payload ID: 13659 relates to Category No.: 9805, 12082; Payload ID: 13660 relates to Category No.: 11861, 9805, 12082; Payload ID: 13661 relates to Category No.: 11861; Payload ID: 13662 relates to Category No.: 11861, 3752, 9962, 12083; Payload ID: 13663 relates to Category No.: 12111, 11861, 12083, 12081; Payload ID: 13664 relates to Category No.: 12111, 11861, 3752, 9962; Payload ID: 13665 relates to Category No.: 11861, 9962; Payload ID: 13666 relates to Category No.: 12081, 4684, 11861; Payload ID: 13667 relates to Category No.: 11861, 12081, 4684; Payload ID: 13668 relates to Category No.: 11861, 267, 15766, 3508; Payload ID: 13669 relates to Category No.: 11861, 3755, 12086; Payload ID: 13670 relates to Category No.: 3303, 14196, 3655, 11861, 12113, 14135, 12086; Payload ID: 13671 relates to Category No.: 277, 11861, 11981, 11939, 11895, 11920, 11886, 12076, 5841, 4896; Payload ID: 13672 relates to Category No.: 267, 11861, 12076, 11895, 11978, 11886, 5957, 277, 5841, 12082, 2954; Payload ID: 13673 relates to Category No.: 6816, 5308, 9962, 11861, 11895, 4338; Payload ID: 13674 relates to Category No.: 6816, 5308, 12111, 11861, 11895, 9962; Payload ID: 13675 relates to Category No.: 11933, 11861, 12088, 735, 1201, 12111; Payload ID: 13676 relates to Category No.: 11861, 12088, 1201; Payload ID: 13677 relates to Category No.: 12111, 11861, 12088, 11886, 15230, 12077, 14351; Payload ID: 13678 relates to Category No.: 11861, 12088, 5957, 1201; Payload ID: 13679 relates to Category No.: 1405, 11861, 12088; Payload ID: 13680 relates to Category No.: 11861, 12088; Payload ID: 13681 relates to Category No.: 12088, 1201, 11861; Payload ID: 13682 relates to Category No.: 1405; Payload ID: 13683 relates to Category No.: 11861, 12088; Payload ID: 13684 relates to Category No.: 12111, 11861, 12088, 1201; Payload ID: 13685 relates to Category No.: 11861, 12088, 1201; Payload ID: 13686 relates to Category No.: 11861, 12088; Payload ID: 13687 relates to Category No.: 12088, 11861, 1201, 9619; Payload ID: 13688 relates to Category No.: 6816, 11861; Payload ID: 13689 relates to Category No.: 926, 942, 11939, 11933, 9706, 12402, 11861, 12088, 9803, 12077, 12149; Payload ID: 13690 relates to Category No.: 1630, 12111; Payload ID: 13691 relates to Category No.: 1405, 11917, 1457, 12111, 11861, 3752, 3471, 1460, 5308, 9962, 11933, 1444; Payload ID: 13692 relates to Category No.: 1405, 5308, 11917, 1457, 12111, 11861, 3752, 3471, 12078, 1460, 9962; Payload ID: 13693 relates to Category No.: 5308, 9962, 6816, 1457, 11861; Payload ID: 13694 relates to Category No.: 1405, 1457, 11920, 11861, 1444; Payload ID: 13695 relates to Category No.: 1405, 11861; Payload ID: 13696 relates to Category No.: 6816, 5308, 12111, 11861, 9016, 11886, 9804, 6022, 9962; Payload ID: 13697 relates to Category No.: 9962, 11861, 12089, 1201; Payload ID: 13698 relates to Category No.: 11861, 1327, 11861, 12089; Payload ID: 13699 relates to Category No.: 1201; Payload ID: 13700 relates to Category No.: 1201, 11861; Payload ID: 13701 relates to Category No.: 11861, 12083, 1201; Payload ID: 13702 relates to Category No.: 14564, 6816, 5308, 6210, 9962, 12111, 11861, 5347, 14196, 6965, 4961, 4804; Payload ID: 13703 relates to Category No.: 6816, 5308, 12111, 11861, 9962; Payload ID: 13704 relates to Category No.: 11861, 12081, 1201; Payload ID: 13705 relates to Category No.: 11861, 1201; Payload ID: 13706 relates to Category No.: 11861, 12081, 1201; Payload ID: 13707 relates to Category No.: 1536, 12088, 12082, 12081, 12077, 11893, 11981; Payload ID: 13708 relates to Category No.: 1405, 5308, 5865, 9962, 12111, 11861, 6574; Payload ID: 13709 relates to Category No.: 1405, 5308, 5865, 9962, 12111, 11861, 6574, 5282, 5280, 7127; Payload ID: 13710 relates to Category No.: 14564, 6478, 1630, 9962, 1646, 12111, 11861, 6574, 14324, 1460, 6816; Payload ID: 13711 relates to Category No.: 6478, 1630, 9962, 1646, 12111, 6574, 11861; Payload ID: 13712 relates to Category No.: 6816, 1630, 1646, 12111, 11861, 7125; Payload ID: 13713 relates to Category No.: 6816, 1630, 1646, 12111, 11861; Payload ID: 13714 relates to Category No.: 6816, 1630, 9804, 1646, 12111, 11861, 1460; Payload ID: 13715 relates to Category No.: 6816, 1630, 1646, 12111, 11861, 9962; Payload ID: 13716 relates to Category No.: 1630, 9962, 12111; Payload ID: 13717 relates to Category No.: 1630, 12111, 11861; Payload ID: 13718 relates to Category No.: 6816, 1630, 1646, 12111, 11861; Payload ID: 13719 relates to Category No.: 6816, 1630, 1646, 12111, 11861; Payload ID: 13720 relates to Category No.: 1630, 12111, 6574, 2773, 9962; Payload ID: 13721 relates to Category No.: 6478, 9962, 12111, 6574, 1630; Payload ID: 13722 relates to Category No.: 12098; Payload ID: 13723 relates to Category No.: 6965, 11981, 12363, 11920, 10116, 11861, 14660; Payload ID: 13724 relates to Category No.: 6965, 11981, 5960, 11861, 5347; Payload ID: 13725 relates to Category No.: 1405, 11861, 3665, 11886; Payload ID: 13726 relates to Category No.: 11978, 926, 12109, 11861; Payload ID: 13727 relates to Category No.: 11978, 926, 12109; Payload ID: 13729 relates to Category No.: 11978, 926, 14564, 267, 12402, 9096, 11981, 5914, 12145, 11861, 14536; Payload ID: 13730 relates to Category No.: 11978, 926, 14564, 12402, 9096, 12145, 1459, 11861, 9077, 11886, 132; Payload ID: 13731 relates to Category No.: 11978, 926, 12402, 9096, 12145, 11861, 5347; Payload ID: 13732 relates to Category No.: 11978, 926, 12145, 11861; Payload ID: 13733 relates to Category No.: 12150, 12151, 9804; Payload ID: 13734 relates to Category No.: 12150, 12151, 9804; Payload ID: 13735 relates to Category No.: 12150, 9804, 11707; Payload ID: 13736 relates to Category No.: 12150, 12151, 9804, 11707; Payload ID: 13737 relates to Category No.: 12150, 12151, 11861, 9886, 9842, 9804; Payload ID: 13738 relates to Category No.: 16331, 12150, 9804, 11981, 10116, 11861, 3752, 12425, 3765, 5538, 12077; Payload ID: 13739 relates to Category No.: 12150, 9962, 5538, 11861, 14538, 9097, 9804, 12425, 9638, 11920, 9925, 5543, 2953; Payload ID: 13740 relates to Category No.: 12150, 9804, 11861, 14537, 9097, 9962; Payload ID: 13741 relates to Category No.: 12150, 9804, 11861, 9853; Payload ID: 13742 relates to Category No.: 12150, 9804, 11861, 15493, 12425; Payload ID: 13743 relates to Category No.: 12150, 9804, 11861, 9097; Payload ID: 13744 relates to Category No.: 12150, 5588, 9804, 11981, 15180, 11861, 12425, 9097; Payload ID: 13745 relates to Category No.: 12150, 9804; Payload ID: 13746 relates to Category No.: 12150, 9804, 11861; Payload ID: 13747 relates to Category No.: 12150, 15895, 9804, 11861, 14537, 5957; Payload ID: 13748 relates to Category No.: 12150, 9804, 11981, 11861; Payload ID: 13749 relates to Category No.: 12150, 9804, 14733, 11861, 2936, 9990, 943; Payload ID: 13750 relates to Category No.: 12150, 9804, 11861, 2936, 9097; Payload ID: 13751 relates to Category No.: 12150, 9804, 11861, 9990, 11981, 7125, 4578; Payload ID: 13752 relates to Category No.: 12150, 9804, 11981, 11861, 15615, 14537, 14536, 9990; Payload ID: 13753 relates to Category No.: 12150, 9804, 11861; Payload ID: 13754 relates to Category No.: 12150, 9804, 11861, 9097; Payload ID: 13755 relates to Category No.: 12150, 9804, 11861, 15615; Payload ID: 13756 relates to Category No.: 12150, 9804, 11861, 15615; Payload ID: 13757 relates to Category No.: 12150, 11861, 9804, 5009, 5003; Payload ID: 13759 relates to Category No.: 12150, 12402, 9804, 11861, 1706, 15615; Payload ID: 13760 relates to Category No.: 12150, 9804, 11861, 15615, 11939; Payload ID: 13761 relates to Category No.: 12150, 5009, 9804, 11861, 15615, 11886, 2386; Payload ID: 13762 relates to Category No.: 14564, 11861; Payload ID: 13763 relates to Category No.: 11861, 11886; Payload ID: 13764 relates to Category No.: 11861; Payload ID: 13765 relates to Category No.: 11861; Payload ID: 13766 relates to Category No.: 12150, 9804, 11861, 5347, 15615; Payload ID: 13767 relates to Category No.: 12150, 9804, 11861, 15615; Payload ID: 13768 relates to Category No.: 12150, 9804, 1153, 11981, 11861, 7125, 4380, 3032, 10092; Payload ID: 13769 relates to Category No.: 12150, 9804, 1153, 11981, 11861, 4380, 15615; Payload ID: 13770 relates to Category No.: 12150, 9804, 1369, 11861, 5347, 15615; Payload ID: 13771 relates to Category No.: 12150, 9804, 11861, 14812, 4896; Payload ID: 13772 relates to Category No.: 12150, 9804, 15615, 11861; Payload ID: 13773 relates to Category No.: 12150, 11939, 9804, 11861, 16293, 15615; Payload ID: 13774 relates to Category No.: 11861, 12150, 9804; Payload ID: 13775 relates to Category No.: 12150, 9804, 11981, 11861, 15615; Payload ID: 13776 relates to Category No.: 12150, 9804, 11861, 15615; Payload ID: 13777 relates to Category No.: 12150, 9804, 1153, 1369, 11861, 581, 4380, 3032, 566, 15358; Payload ID: 13778 relates to Category No.: 12150, 9804, 1153, 11861, 15615; Payload ID: 13779 relates to Category No.: 12150, 9804, 11861, 15615, 4183; Payload ID: 13780 relates to Category No.: 1405, 14503, 11861; Payload ID: 13781 relates to Category No.: 1405, 12160, 11861, 829; Payload ID: 13782 relates to Category No.: 1405, 12160, 11861; Payload ID: 13783 relates to Category No.: 14503, 14506, 3752; Payload ID: 13784 relates to Category No.: 4886, 15542; Payload ID: 13785 relates to Category No.: 3303, 9226, 6816, 11917, 11861; Payload ID: 13786 relates to Category No.: 12179, 11861; Payload ID: 13787 relates to Category No.: 12179; Payload ID: 13788 relates to Category No.: 12179; Payload ID: 13789 relates to Category No.: 16331, 15503, 14471, 12179; Payload ID: 13790 relates to Category No.: 11978, 926, 9988, 512, 1510; Payload ID: 13791 relates to Category No.: 6598, 6816, 3416; Payload ID: 13792 relates to Category No.: 6816, 6598, 3416; Payload ID: 13793 relates to Category No.: 1504, 5009; Payload ID: 13794 relates to Category No.: 1504; Payload ID: 13795 relates to Category No.: 14379, 10154; Payload ID: 13796 relates to Category No.: 15029, 11861, 15025; Payload ID: 13797 relates to Category No.: 5847, 11861, 2294; Payload ID: 13798 relates to Category No.: 11861; Payload ID: 13799 relates to Category No.: 1405, 11861; Payload ID: 13800 relates to Category No.: 1405; Payload ID: 13801 relates to Category No.: 1405; Payload ID: 13802 relates to Category No.: 1405; Payload ID: 13803 relates to Category No.: 1405; Payload ID: 13804 relates to Category No.: 1405, 11861; Payload ID: 13805 relates to Category No.: 1405, 11861; Payload ID: 13806 relates to Category No.: 1405; Payload ID: 13807 relates to Category No.: 1405, 10116; Payload ID: 13808 relates to Category No.: 1405, 11861; Payload ID: 13809 relates to Category No.: 1405; Payload ID: 13810 relates to Category No.: 1405, 11861; Payload ID: 13811 relates to Category No.: 1405; Payload ID: 13812 relates to Category No.: 1405; Payload ID: 13813 relates to Category No.: 1405; Payload ID: 13814 relates to Category No.: 1405; Payload ID: 13815 relates to Category No.: 1405; Payload ID: 13816 relates to Category No.: 1405; Payload ID: 13817 relates to Category No.: 1405; Payload ID: 13818 relates to Category No.: 1405, 11861; Payload ID: 13819 relates to Category No.: 1405; Payload ID: 13820 relates to Category No.: 1405; Payload ID: 13821 relates to Category No.: 1405; Payload ID: 13822 relates to Category No.: 1405; Payload ID: 13823 relates to Category No.: 1405; Payload ID: 13824 relates to Category No.: 1405; Payload ID: 13825 relates to Category No.: 1405; Payload ID: 13826 relates to Category No.: 1405; Payload ID: 13827 relates to Category No.: 1405; Payload ID: 13828 relates to Category No.: 1405; Payload ID: 13829 relates to Category No.: 1405; Payload ID: 13830 relates to Category No.: 1405; Payload ID: 13831 relates to Category No.: 1405, 11861; Payload ID: 13832 relates to Category No.: 1405; Payload ID: 13833 relates to Category No.: 1405; Payload ID: 13834 relates to Category No.: 1405; Payload ID: 13835 relates to Category No.: 1405; Payload ID: 13836 relates to Category No.: 1405; Payload ID: 13837 relates to Category No.: 1405; Payload ID: 13838 relates to Category No.: 1405; Payload ID: 13839 relates to Category No.: 1405; Payload ID: 13840 relates to Category No.: 1405; Payload ID: 13841 relates to Category No.: 1405; Payload ID: 13842 relates to Category No.: 1405; Payload ID: 13843 relates to Category No.: 1405; Payload ID: 13844 relates to Category No.: 1405; Payload ID: 13845 relates to Category No.: 1405; Payload ID: 13846 relates to Category No.: 1405; Payload ID: 13847 relates to Category No.: 1405, 11861; Payload ID: 13848 relates to Category No.: 1405; Payload ID: 13849 relates to Category No.: 1405; Payload ID: 13850 relates to Category No.: 1405; Payload ID: 13851 relates to Category No.: 1405; Payload ID: 13852 relates to Category No.: 1405; Payload ID: 13853 relates to Category No.: 1405, 10116; Payload ID: 13854 relates to Category No.: 1405, 11861; Payload ID: 13855 relates to Category No.: 1405, 11861; Payload ID: 13856 relates to Category No.: 1405; Payload ID: 13857 relates to Category No.: 1405; Payload ID: 13858 relates to Category No.: 1405, 7192, 11861; Payload ID: 13859 relates to Category No.: 1405; Payload ID: 13860 relates to Category No.: 1405; Payload ID: 13861 relates to Category No.: 1405; Payload ID: 13862 relates to Category No.: 1405; Payload ID: 13863 relates to Category No.: 1405; Payload ID: 13864 relates to Category No.: 1405, 10116; Payload ID: 13865 relates to Category No.: 1405, 11861, 11886, 12064; Payload ID: 13866 relates to Category No.: 11861; Payload ID: 13867 relates to Category No.: 4207, 9518, 9530; Payload ID: 13868 relates to Category No.: 11861, 14196; Payload ID: 13869 relates to Category No.: 10116, 11861, 11782; Payload ID: 13871 relates to Category No.: 12327, 3999, 6816, 11861, 5470; Payload ID: 13872 relates to Category No.: 6816, 12327; Payload ID: 13873 relates to Category No.: 11978, 926, 9096, 11861; Payload ID: 13874 relates to Category No.: 6816, 5308, 7192, 12222; Payload ID: 13875 relates to Category No.: 14196, 12223, 10116, 12225, 11861, 6185; Payload ID: 13876 relates to Category No.: 14196, 12223; Payload ID: 13877 relates to Category No.: 14196, 12223; Payload ID: 13878 relates to Category No.: 14196, 12223, 10116, 3752; Payload ID: 13879 relates to Category No.: 14196, 12223, 11861; Payload ID: 13880 relates to Category No.: 14196, 12223; Payload ID: 13881 relates to Category No.: 3303, 6185; Payload ID: 13883 relates to Category No.: 7192; Payload ID: 13884 relates to Category No.: 6816, 1630, 9962; Payload ID: 13885 relates to Category No.: 11978, 926, 6478, 5956, 15895, 12109, 11861, 9617, 11828, 11979, 1358, 1440; Payload ID: 13886 relates to Category No.: 11861, 5347, 140, 9793, 15491; Payload ID: 13887 relates to Category No.: 11861, 140, 9793; Payload ID: 13888 relates to Category No.: 926, 9282, 9226, 6816, 11861, 7192, 15699, 503, 6188, 4282, 14524; Payload ID: 13891 relates to Category No.: 12150, 9804, 11861; Payload ID: 13892 relates to Category No.: 11861; Payload ID: 13893 relates to Category No.: 11861, 7192; Payload ID: 13894 relates to Category No.: 14196, 1201, 10116, 11861, 7265; Payload ID: 13895 relates to Category No.: 14196, 10116, 11861, 7265, 1201; Payload ID: 13896 relates to Category No.: 7268, 3303, 14196, 10116, 1201; Payload ID: 13897 relates to Category No.: 1630, 9248, 3471, 15542, 15555, 12266, 9809, 12239; Payload ID: 13898 relates to Category No.: 1647, 1401, 12267, 4009, 926, 11861, 16331, 3471; Payload ID: 13899 relates to Category No.: 926, 12267, 4009, 5347, 6186; Payload ID: 13900 relates to Category No.: 926, 12267, 4009; Payload ID: 13901 relates to Category No.: 926, 16331, 11939, 12402, 2672, 1369, 12267, 4009, 11861, 3471; Payload ID: 13902 relates to Category No.: 926, 12267, 4009, 15617, 5840; Payload ID: 13903 relates to Category No.: 926, 15617, 12267, 4009, 5347, 2267; Payload ID: 13904 relates to Category No.: 926, 12267, 4009, 11939, 12402, 11861, 6242, 12399, 2267; Payload ID: 13905 relates to Category No.: 4820, 12399, 11861, 4818, 14377, 939, 926, 11933, 456, 197, 463; Payload ID: 13906 relates to Category No.: 4820; Payload ID: 13907 relates to Category No.: 4820, 12399, 4818, 8974, 939; Payload ID: 13908 relates to Category No.: 4820, 4924, 460, 4809; Payload ID: 13909 relates to Category No.: 4820, 4818; Payload ID: 13910 relates to Category No.: 4820, 4818, 15920; Payload ID: 13911 relates to Category No.: 4820, 12399, 4818, 926, 16047; Payload ID: 13912 relates to Category No.: 4820, 4818; Payload ID: 13913 relates to Category No.: 15504, 14597, 10116, 11861, 15503, 14239, 3465, 3303, 15503, 14471, 3459, 14652, 12269, 15598, 9226; Payload ID: 13914 relates to Category No.: 15504, 14597, 10116, 7268, 14196, 14243, 15503, 14471, 11861, 3459, 14652, 15530, 14255; Payload ID: 13915 relates to Category No.: 3303, 10116; Payload ID: 13916 relates to Category No.: 4898, 4924; Payload ID: 13917 relates to Category No.: 1457, 14196; Payload ID: 13919 relates to Category No.: 4886, 4895, 15592; Payload ID: 13920 relates to Category No.: 3303, 15503, 14471; Payload ID: 13921 relates to Category No.: 3303; Payload ID: 13924 relates to Category No.: 9282, 9226, 14196, 3993; Payload ID: 13925 relates to Category No.: 2963; Payload ID: 13927 relates to Category No.: 11861; Payload ID: 13928 relates to Category No.: 14712, 10116, 11861; Payload ID: 13929 relates to Category No.: 11861; Payload ID: 13930 relates to Category No.: 11861; Payload ID: 13931 relates to Category No.: 9857; Payload ID: 13932 relates to Category No.: 11978, 926, 267, 11895, 9857; Payload ID: 13933 relates to Category No.: 11861; Payload ID: 13934 relates to Category No.: 11939, 11861, 5347, 3752, 1255, 11828, 5708, 15741, 2853, 12325, 7399; Payload ID: 13935 relates to Category No.: 16331, 11861; Payload ID: 13936 relates to Category No.: 16331, 11861, 2405, 5105, 5103; Payload ID: 13937 relates to Category No.: 14176, 10116, 11861; Payload ID: 13938 relates to Category No.: 9518, 11861; Payload ID: 13939 relates to Category No.: 9518, 11861; Payload ID: 13940 relates to Category No.: 12290, 926, 16331, 6478, 11939, 12292, 11666, 14734, 6266; Payload ID: 13941 relates to Category No.: 6478, 4961, 9804, 9962, 11861, 9986, 12291; Payload ID: 13942 relates to Category No.: 1537, 12292, 1630; Payload ID: 13943 relates to Category No.: 9518, 4225, 12295, 9518, 320; Payload ID: 13944 relates to Category No.: 4820, 4818, 16013, 16047, 926; Payload ID: 13945 relates to Category No.: 4820, 11861, 4818, 15920; Payload ID: 13947 relates to Category No.: 11861; Payload ID: 13948 relates to Category No.: 8959, 9404; Payload ID: 13949 relates to Category No.: 4820, 9629, 8963; Payload ID: 13950 relates to Category No.: 2861, 12326; Payload ID: 13951 relates to Category No.: 2861; Payload ID: 13952 relates to Category No.: 6478, 5470, 12327; Payload ID: 13953 relates to Category No.: 6478, 5470, 12111; Payload ID: 13954 relates to Category No.: 12329, 11861, 5347; Payload ID: 13955 relates to Category No.: 12329; Payload ID: 13956 relates to Category No.: 12329, 11861, 5347; Payload ID: 13957 relates to Category No.: 3303, 926, 6816, 1630, 1209, 11861, 1208, 12331, 1531; Payload ID: 13958 relates to Category No.: 9518, 318, 3292, 12332, 12335, 12334; Payload ID: 13959 relates to Category No.: 12332, 9518, 318, 3292; Payload ID: 13960 relates to Category No.: 1630, 11861, 12332, 12334, 12335; Payload ID: 13961 relates to Category No.: 15542, 15548, 11861, 12334; Payload ID: 13962 relates to Category No.: 11978, 926, 11861, 12333; Payload ID: 13963 relates to Category No.: 11978, 926, 11939, 12333, 11861; Payload ID: 13964 relates to Category No.: 11978, 926, 12109, 11861, 12333; Payload ID: 13965 relates to Category No.: 11978, 926, 12333; Payload ID: 13966 relates to Category No.: 9518; Payload ID: 13967 relates to Category No.: 6816, 1630, 1646, 12111, 11861, 24, 1405, 11886, 6483; Payload ID: 13968 relates to Category No.: 1630, 1646, 12111, 6816, 24, 6483; Payload ID: 13969 relates to Category No.: 926, 6478, 5956, 1630, 12337, 11666; Payload ID: 13970 relates to Category No.: 926, 6478, 5956, 1630, 10116, 11861, 12337, 11666, 6944, 456; Payload ID: 13971 relates to Category No.: 9226, 14196, 10116, 11861, 14537, 7268; Payload ID: 13972 relates to Category No.: 6816, 12346, 11861; Payload ID: 13973 relates to Category No.: 12346, 16331; Payload ID: 13974 relates to Category No.: 11918, 4209, 15357; Payload ID: 13975 relates to Category No.: 11918, 4209, 15357; Payload ID: 13976 relates to Category No.: 3554, 9518, 171, 11939, 7501, 7515; Payload ID: 13977 relates to Category No.: 11939, 9036, 15542, 15555; Payload ID: 13978 relates to Category No.: 9226, 9282; Payload ID: 13979 relates to Category No.: 9282, 11861; Payload ID: 13980 relates to Category No.: 9226, 10116; Payload ID: 13981 relates to Category No.: 9226, 10116, 11861; Payload ID: 13982 relates to Category No.: 9226; Payload ID: 13983 relates to Category No.: 9620; Payload ID: 13984 relates to Category No.: 11861, 5347, 11895, 11782; Payload ID: 13985 relates to Category No.: 11861, 16331, 12359, 12098, 12358; Payload ID: 13986 relates to Category No.: 16331, 1630, 12359, 11861, 12358; Payload ID: 13987 relates to Category No.: 3303, 4894, 12359, 11861, 15766, 4820; Payload ID: 13988 relates to Category No.: 4894, 12359, 11861; Payload ID: 13989 relates to Category No.: 3303, 16331, 12359, 11861, 12360, 15893; Payload ID: 13990 relates to Category No.: 16331, 4924, 11861; Payload ID: 13991 relates to Category No.: 12359, 11861; Payload ID: 13992 relates to Category No.: 11861; Payload ID: 13993 relates to Category No.: 5347; Payload ID: 13994 relates to Category No.: 4886, 4895, 11861; Payload ID: 13995 relates to Category No.: 4886, 4895; Payload ID: 13996 relates to Category No.: 4886, 4895; Payload ID: 13997 relates to Category No.: 4886, 4895; Payload ID: 13998 relates to Category No.: 4886, 11861; Payload ID: 13999 relates to Category No.: 4886, 4895, 11861, 4422, 7410; Payload ID: 14000 relates to Category No.: 12359, 11861; Payload ID: 14001 relates to Category No.: 11939, 11981, 12359, 11861; Payload ID: 14002 relates to Category No.: 1405, 11939, 467, 12359, 11861; Payload ID: 14003 relates to Category No.: 1405, 11939, 467, 12359, 11861; Payload ID: 14004 relates to Category No.: 12359, 11861, 4389; Payload ID: 14005 relates to Category No.: 4886, 4895, 6965, 15180, 11861, 7410; Payload ID: 14006 relates to Category No.: 4886, 4895, 11861, 4422, 7410; Payload ID: 14007 relates to Category No.: 4886, 4895, 4422; Payload ID: 14008 relates to Category No.: 4886, 4895, 11861, 11974; Payload ID: 14009 relates to Category No.: 4886, 4895, 11861, 4422, 7410, 4710; Payload ID: 14010 relates to Category No.: 11861; Payload ID: 14011 relates to Category No.: 4886, 4895, 11861; Payload ID: 14012 relates to Category No.: 4886, 4895, 11861, 4422; Payload ID: 14013 relates to Category No.: 4886, 4895, 11861, 4422; Payload ID: 14014 relates to Category No.: 4886, 4895; Payload ID: 14015 relates to Category No.: 4886, 4895, 11861; Payload ID: 14016 relates to Category No.: 4886, 4895, 11861; Payload ID: 14017 relates to Category No.: 4886, 4895; Payload ID: 14018 relates to Category No.: 4886, 4895, 11861, 4422; Payload ID: 14019 relates to Category No.: 4886, 4895, 11861, 4422; Payload ID: 14020 relates to Category No.: 4886, 4895, 11861; Payload ID: 14021 relates to Category No.: 4886, 4895, 11861; Payload ID: 14022 relates to Category No.: 4886, 4895, 11861, 7410; Payload ID: 14023 relates to Category No.: 4886, 4895, 11861, 4746; Payload ID: 14024 relates to Category No.: 4886, 4895, 11861, 4422, 7410, 11920; Payload ID: 14025 relates to Category No.: 4886, 4895, 11920, 11861, 4422, 7410; Payload ID: 14026 relates to Category No.: 4886, 4895, 4422; Payload ID: 14027 relates to Category No.: 4886, 4895, 11861, 4422; Payload ID: 14028 relates to Category No.: 4886, 4895, 11861, 4422; Payload ID: 14029 relates to Category No.: 4886, 4895, 11861; Payload ID: 14030 relates to Category No.: 4894, 12359, 12360; Payload ID: 14031 relates to Category No.: 3749, 11933, 4894, 3755, 12359, 12360; Payload ID: 14032 relates to Category No.: 4886, 4895; Payload ID: 14033 relates to Category No.: 4886, 4895, 4422; Payload ID: 14034 relates to Category No.: 4886, 4895, 11861, 4899, 764, 769, 1235; Payload ID: 14035 relates to Category No.: 4886, 4895, 11861; Payload ID: 14036 relates to Category No.: 4886, 4895, 11861; Payload ID: 14037 relates to Category No.: 4886, 4895, 11861, 12379, 4915; Payload ID: 14038 relates to Category No.: 4886, 4895, 11861, 9887, 4422; Payload ID: 14039 relates to Category No.: 4886, 4895; Payload ID: 14040 relates to Category No.: 4886, 4895, 11861; Payload ID: 14041 relates to Category No.: 4886, 4895, 11861, 4899, 764, 769, 1235; Payload ID: 14042 relates to Category No.: 4886, 4895, 11861; Payload ID: 14043 relates to Category No.: 4886, 4895, 11861, 7410; Payload ID: 14044 relates to Category No.: 11861, 12360; Payload ID: 14045 relates to Category No.: 11861, 12360; Payload ID: 14046 relates to Category No.: 4886, 4895, 11861, 7410, 11895, 943, 941, 4896; Payload ID: 14047 relates to Category No.: 4886, 4895, 11861, 4422, 7410; Payload ID: 14048 relates to Category No.: 4886, 4895, 11861, 7410; Payload ID: 14049 relates to Category No.: 4886, 4895, 7410, 11861, 4896; Payload ID: 14050 relates to Category No.: 4886, 4895; Payload ID: 14051 relates to Category No.: 4886, 4895; Payload ID: 14052 relates to Category No.: 4886, 4895; Payload ID: 14053 relates to Category No.: 4886, 4895, 4422; Payload ID: 14054 relates to Category No.: 4895, 4886, 11861; Payload ID: 14055 relates to Category No.: 4886, 4895; Payload ID: 14056 relates to Category No.: 4886, 4895, 11861; Payload ID: 14057 relates to Category No.: 4886, 4895, 1405; Payload ID: 14058 relates to Category No.: 4886, 4895, 11861, 4422, 12142, 5850, 15180, 943, 941; Payload ID: 14059 relates to Category No.: 4886, 4895, 11861, 7192; Payload ID: 14060 relates to Category No.: 4886, 4895; Payload ID: 14061 relates to Category No.: 4886, 4895, 11861, 4422, 4915; Payload ID: 14062 relates to Category No.: 4886, 4895, 11861, 4422, 4899; Payload ID: 14063 relates to Category No.: 4886, 4895, 11861, 4422; Payload ID: 14064 relates to Category No.: 4886, 4895, 11920, 11861, 7410; Payload ID: 14065 relates to Category No.: 4886, 4895, 11861, 7410; Payload ID: 14066 relates to Category No.: 4886, 4895; Payload ID: 14067 relates to Category No.: 4886, 4895, 11861, 4422, 12363; Payload ID: 14068 relates to Category No.: 4886, 4895; Payload ID: 14069 relates to Category No.: 4886, 4895, 12359, 11861, 4422, 7410, 11981; Payload ID: 14070 relates to Category No.: 4886, 4895, 12402, 11861, 4422, 15473; Payload ID: 14071 relates to Category No.: 11861; Payload ID: 14072 relates to Category No.: 4886, 4895, 11861, 4422; Payload ID: 14073 relates to Category No.: 4886, 4895, 11861, 4422; Payload ID: 14074 relates to Category No.: 4864, 4894, 11939, 11861; Payload ID: 14075 relates to Category No.: 4864, 4894; Payload ID: 14076 relates to Category No.: 16331, 6816, 12359, 11861; Payload ID: 14077 relates to Category No.: 1405, 1438, 15180, 2491, 12359, 16331, 14420, 11861, 5478, 9887, 11886, 9809, 9865; Payload ID: 14078 relates to Category No.: 1405, 1438, 15180, 12359, 2491, 11861, 2936; Payload ID: 14079 relates to Category No.: 6816, 6965, 4894, 11981, 598, 11861, 9874, 4389, 1173; Payload ID: 14080 relates to Category No.: 4894, 14107, 11861; Payload ID: 14081 relates to Category No.: 2963, 94, 11861, 3987; Payload ID: 14082 relates to Category No.: 926, 11861, 3306; Payload ID: 14083 relates to Category No.: 15893, 14600, 3303, 16331, 6816, 2963, 15895, 6188, 16325, 11861, 11886, 10163; Payload ID: 14084 relates to Category No.: 11861, 15528, 14255; Payload ID: 14085 relates to Category No.: 11861; Payload ID: 14086 relates to Category No.: 11861, 2963, 14597, 15915, 10163; Payload ID: 14087 relates to Category No.: 11861, 2963, 14597, 10163; Payload ID: 14088 relates to Category No.: 942, 926, 3303, 6816, 94, 11861, 1327, 953, 11861, 14598; Payload ID: 14089 relates to Category No.: 11861; Payload ID: 14090 relates to Category No.: 14196, 3459, 14597, 11861; Payload ID: 14092 relates to Category No.: 926, 3303, 3385, 3459, 14597, 3640, 11861, 4288, 12434; Payload ID: 14093 relates to Category No.: 926, 3303, 3385, 3459, 14597, 11861, 4288, 12434, 2770, 9282; Payload ID: 14094 relates to Category No.: 926, 3303, 3459, 14597, 3385, 3640, 11861, 4389, 4288, 12434; Payload ID: 14095 relates to Category No.: 926, 3303, 9282, 3385, 11895, 3459, 14597, 3640, 11861, 5347, 14600, 4288, 3347, 12434, 2405; Payload ID: 14096 relates to Category No.: 926, 3303, 16331, 3385, 11861; Payload ID: 14097 relates to Category No.: 3303, 2963, 11861, 5347; Payload ID: 14098 relates to Category No.: 3303, 9282, 9226, 14196, 11861; Payload ID: 14099 relates to Category No.: 926, 3303, 3325, 14203, 3378; Payload ID: 14100 relates to Category No.: 926, 3303, 4965, 5308, 305, 11861, 714; Payload ID: 14101 relates to Category No.: 926, 3303, 4965, 11861, 11981, 942, 15493; Payload ID: 14102 relates to Category No.: 94, 5109, 11981, 11861, 3752, 14537, 3987; Payload ID: 14103 relates to Category No.: 94, 11861; Payload ID: 14104 relates to Category No.: 11861; Payload ID: 14105 relates to Category No.: 11861; Payload ID: 14106 relates to Category No.: 11861; Payload ID: 14109 relates to Category No.: 11861, 7192, 1201; Payload ID: 14110 relates to Category No.: 7192; Payload ID: 14112 relates to Category No.: 11861; Payload ID: 14113 relates to Category No.: 6816, 5875, 1630, 138, 2684; Payload ID: 14114 relates to Category No.: 5875, 1630, 6816, 138, 11861, 12107; Payload ID: 14115 relates to Category No.: 267, 11939, 10116, 11861, 2936, 943, 11973, 11920; Payload ID: 14116 relates to Category No.: 11978, 926, 6816, 12109, 11861, 5347, 12417, 12388, 11933, 7126; Payload ID: 14118 relates to Category No.: 3464; Payload ID: 14119 relates to Category No.: 4924, 12380; Payload ID: 14120 relates to Category No.: 4924; Payload ID: 14121 relates to Category No.: 4894, 11933, 1201; Payload ID: 14122 relates to Category No.: 4894, 1201, 11933; Payload ID: 14123 relates to Category No.: 11933, 4894; Payload ID: 14124 relates to Category No.: 4924, 11861, 4898; Payload ID: 14125 relates to Category No.: 4924, 12380; Payload ID: 14126 relates to Category No.: 4924, 11861, 12389; Payload ID: 14127 relates to Category No.: 4924, 11861, 12380, 12388; Payload ID: 14128 relates to Category No.: 4924; Payload ID: 14129 relates to Category No.: 942, 4894, 15619, 12363, 11861, 12379, 942, 2746; Payload ID: 14130 relates to Category No.: 1405, 11861, 14537; Payload ID: 14131 relates to Category No.: 1405, 11861; Payload ID: 14132 relates to Category No.: 9282, 9226, 14196, 10116, 11861; Payload ID: 14133 relates to Category No.: 9282, 9226, 10116, 11861, 5347; Payload ID: 14134 relates to Category No.: 12382, 4894, 4429, 11861; Payload ID: 14135 relates to Category No.: 11861; Payload ID: 14136 relates to Category No.: 4886, 12382, 9170, 1201; Payload ID: 14137 relates to Category No.: 16331, 14196, 9706, 12382, 6188, 11861, 11886; Payload ID: 14138 relates to Category No.: 12382, 11861, 14324; Payload ID: 14140 relates to Category No.: 12142, 11861, 9179, 1201; Payload ID: 14141 relates to Category No.: 12382, 11861, 3752; Payload ID: 14142 relates to Category No.: 4894, 11861, 15895, 12382; Payload ID: 14143 relates to Category No.: 12382, 12142, 4924, 14733, 5841, 12383; Payload ID: 14144 relates to Category No.: 4886, 4895, 2405, 15491, 10116, 11861, 4422, 686, 11695; Payload ID: 14145 relates to Category No.: 11861; Payload ID: 14146 relates to Category No.: 11861; Payload ID: 14147 relates to Category No.: 11861; Payload ID: 14148 relates to Category No.: 11861; Payload ID: 14149 relates to Category No.: 11861; Payload ID: 14150 relates to Category No.: 11861; Payload ID: 14151 relates to Category No.: 12382, 11861; Payload ID: 14152 relates to Category No.: 16331, 11861, 15908, 6188, 15887, 3459, 11983; Payload ID: 14153 relates to Category No.: 4924, 11861, 14537, 12386; Payload ID: 14154 relates to Category No.: 1405, 14564, 4894, 4924, 11861, 3215, 1467, 9608, 12389, 12386, 16296, 1130, 9818; Payload ID: 14155 relates to Category No.: 4924, 11920, 11861, 1467, 12386, 5841; Payload ID: 14156 relates to Category No.: 4924, 11861, 1467, 12389, 12388; Payload ID: 14157 relates to Category No.: 4924, 4899, 12389, 12386; Payload ID: 14158 relates to Category No.: 4924, 11861, 4899, 12388, 9818; Payload ID: 14159 relates to Category No.: 4924, 12417; Payload ID: 14160 relates to Category No.: 4894, 4898, 11939, 4895, 11861, 12388; Payload ID: 14161 relates to Category No.: 4894, 11861; Payload ID: 14162 relates to Category No.: 11861, 1201, 4894; Payload ID: 14163 relates to Category No.: 4886, 4895, 12142, 11861, 11886, 12386, 12388; Payload ID: 14164 relates to Category No.: 4886, 4895, 11861, 11886, 4422; Payload ID: 14165 relates to Category No.: 4886, 4895, 11861; Payload ID: 14166 relates to Category No.: 4886, 11861, 4422, 11920; Payload ID: 14167 relates to Category No.: 4886, 15491, 4422; Payload ID: 14168 relates to Category No.: 3303, 16331, 15503, 14471, 14471, 15504, 14968, 14251, 6183, 14243, 11861, 2691, 15492, 15496, 9532, 15503, 3285, 1153; Payload ID: 14169 relates to Category No.: 16331, 15503, 14471, 14471, 14968, 14251, 6183, 11861, 15504, 6716; Payload ID: 14170 relates to Category No.: 3303, 16331, 15503, 14471, 14471, 14968, 14251, 6183, 11861, 9532, 15503, 3285; Payload ID: 14171 relates to Category No.: 4886, 4895; Payload ID: 14172 relates to Category No.: 4886, 1457; Payload ID: 14173 relates to Category No.: 1405, 4886, 4895; Payload ID: 14174 relates to Category No.: 4894, 11861, 12388; Payload ID: 14175 relates to Category No.: 4894, 12360, 4898; Payload ID: 14176 relates to Category No.: 4894, 12359, 11861, 12360; Payload ID: 14178 relates to Category No.: 4894, 4924, 11861; Payload ID: 14179 relates to Category No.: 11861; Payload ID: 14181 relates to Category No.: 11861; Payload ID: 14183 relates to Category No.: 15629, 11861; Payload ID: 14184 relates to Category No.: 16331, 11861, 5347, 12064; Payload ID: 14185 relates to Category No.: 11978, 11861; Payload ID: 14186 relates to Category No.: 11861, 5347; Payload ID: 14187 relates to Category No.: 11861; Payload ID: 14188 relates to Category No.: 6816, 11861; Payload ID: 14189 relates to Category No.: 11861; Payload ID: 14190 relates to Category No.: 11861; Payload ID: 14191 relates to Category No.: 3663; Payload ID: 14192 relates to Category No.: 1405, 16331, 11939, 4924, 6210, 9824, 3215, 12389, 9896; Payload ID: 14193 relates to Category No.: 1405, 4924, 6210, 3215; Payload ID: 14194 relates to Category No.: 1405, 14564, 4894, 4924, 11861, 3215, 5957, 12389, 12388; Payload ID: 14195 relates to Category No.: 1405, 4924, 3215, 4899, 12389; Payload ID: 14196 relates to Category No.: 6816, 4886, 4895, 11861, 11981; Payload ID: 14197 relates to Category No.: 6816, 4886, 11861; Payload ID: 14198 relates to Category No.: 4886, 4895, 11861, 7393; Payload ID: 14199 relates to Category No.: 4886, 4895, 11861, 4422; Payload ID: 14200 relates to Category No.: 14564, 4886, 11861; Payload ID: 14201 relates to Category No.: 4886, 4895, 11981; Payload ID: 14202 relates to Category No.: 4886, 4895; Payload ID: 14203 relates to Category No.: 4886, 4895, 11861; Payload ID: 14204 relates to Category No.: 4886, 11861, 14106, 4897, 5958; Payload ID: 14205 relates to Category No.: 4886, 4895, 11861; Payload ID: 14206 relates to Category No.: 4886, 4895, 11759, 4421, 11861; Payload ID: 14207 relates to Category No.: 1405, 4886, 4895, 11861, 7192; Payload ID: 14208 relates to Category No.: 1405, 4886, 4895, 11861; Payload ID: 14209 relates to Category No.: 6816, 4886, 4895, 11861; Payload ID: 14210 relates to Category No.: 6816, 4886, 11861; Payload ID: 14211 relates to Category No.: 11861; Payload ID: 14212 relates to Category No.: 4894, 12402, 11861, 4896, 4710, 11664; Payload ID: 14213 relates to Category No.: 6816, 11861, 4894; Payload ID: 14214 relates to Category No.: 6816, 4894, 11861, 1454; Payload ID: 14215 relates to Category No.: 6816, 4894, 11861; Payload ID: 14216 relates to Category No.: 6816, 4894, 11861; Payload ID: 14217 relates to Category No.: 6816, 4894, 9939, 11861; Payload ID: 14218 relates to Category No.: 4894, 11861; Payload ID: 14219 relates to Category No.: 4894, 11861; Payload ID: 14220 relates to Category No.: 14107, 4924, 11861, 12389, 4578; Payload ID: 14221 relates to Category No.: 14107, 4924, 1457, 11861; Payload ID: 14222 relates to Category No.: 6816, 15503, 14471, 14237, 9226; Payload ID: 14223 relates to Category No.: 11861; Payload ID: 14224 relates to Category No.: 4886, 4895, 11861; Payload ID: 14225 relates to Category No.: 4886, 4895, 4806, 11861, 15889; Payload ID: 14226 relates to Category No.: 4924, 12389; Payload ID: 14227 relates to Category No.: 4924, 12389; Payload ID: 14228 relates to Category No.: 4924; Payload ID: 14229 relates to Category No.: 4886, 4895, 1457, 11861; Payload ID: 14230 relates to Category No.: 4886, 4895, 1457, 11861; Payload ID: 14231 relates to Category No.: 4886, 4895, 3936, 4422; Payload ID: 14232 relates to Category No.: 4886, 4895; Payload ID: 14233 relates to Category No.: 4886, 11861; Payload ID: 14234 relates to Category No.: 4886, 11861; Payload ID: 14235 relates to Category No.: 4886, 11861, 15567; Payload ID: 14236 relates to Category No.: 4886; Payload ID: 14237 relates to Category No.: 4886, 4895, 1457, 11861; Payload ID: 14238 relates to Category No.: 4886, 4895, 11861, 3752, 15355, 14105, 4899, 11981, 12359, 5109; Payload ID: 14239 relates to Category No.: 4886, 4895, 11992; Payload ID: 14240 relates to Category No.: 4886, 4895, 11861, 1439; Payload ID: 14241 relates to Category No.: 4886, 11939, 11933, 4895, 15895, 11861, 9961; Payload ID: 14242 relates to Category No.: 4886, 4895, 11861, 4916; Payload ID: 14243 relates to Category No.: 4886, 6478, 11933, 4895, 11861, 4422; Payload ID: 14244 relates to Category No.: 4886, 11933, 4895, 11861; Payload ID: 14245 relates to Category No.: 4886, 11861; Payload ID: 14246 relates to Category No.: 11981, 11861; Payload ID: 14247 relates to Category No.: 9226; Payload ID: 14248 relates to Category No.: 16331, 9226, 6816; Payload ID: 14250 relates to Category No.: 16331, 9226, 9282; Payload ID: 14251 relates to Category No.: 11861, 15766; Payload ID: 14252 relates to Category No.: 14196, 1445, 11861, 15744; Payload ID: 14254 relates to Category No.: 11939, 11920, 11861, 1201; Payload ID: 14255 relates to Category No.: 277; Payload ID: 14256 relates to Category No.: 6816, 15503, 14471, 2405, 15504, 15524, 11861, 2691, 2688, 15530, 14233, 9482, 3303, 15528, 14255, 11886, 9226, 14251, 14471; Payload ID: 14257 relates to Category No.: 7192; Payload ID: 14258 relates to Category No.: 3303, 16331, 6816, 11861; Payload ID: 14259 relates to Category No.: 11861; Payload ID: 14260 relates to Category No.: 11861; Payload ID: 14261 relates to Category No.: 9344; Payload ID: 14262 relates to Category No.: 11861, 9344; Payload ID: 14263 relates to Category No.: 11861, 9344; Payload ID: 14264 relates to Category No.: 11861, 9344; Payload ID: 14265 relates to Category No.: 11861, 9344; Payload ID: 14266 relates to Category No.: 12142, 12399, 1387, 2694, 11861, 1388; Payload ID: 14267 relates to Category No.: 12142, 2694, 11861; Payload ID: 14268 relates to Category No.: 12142, 12399, 2694, 11861; Payload ID: 14269 relates to Category No.: 11978, 926, 15895, 12109, 11861, 5347, 3004, 11886, 3007; Payload ID: 14270 relates to Category No.: 6965, 11861, 9344; Payload ID: 14271 relates to Category No.: 15228; Payload ID: 14273 relates to Category No.: 6965; Payload ID: 14274 relates to Category No.: 11861, 7192; Payload ID: 14275 relates to Category No.: 11861, 7192; Payload ID: 14276 relates to Category No.: 926, 15612, 11861, 16293, 11978; Payload ID: 14277 relates to Category No.: 11978, 926, 15612, 11861, 6816, 16293, 4291; Payload ID: 14278 relates to Category No.: 16331, 11861, 217, 11854, 5850; Payload ID: 14279 relates to Category No.: 11978, 926, 14564, 11939, 12402, 12109, 9096, 11861, 6190, 1539; Payload ID: 14280 relates to Category No.: 11978, 926, 12109, 15491, 11861, 5347, 11886, 9016; Payload ID: 14281 relates to Category No.: 11978, 926, 12109, 11861; Payload ID: 14282 relates to Category No.: 11978, 926, 12145, 11861, 4291, 16293, 16291; Payload ID: 14283 relates to Category No.: 3303, 16331, 6816, 15908, 11939, 14471, 5105, 3655, 11861, 5308, 311, 250; Payload ID: 14284 relates to Category No.: 3303, 16331, 2405, 6900, 9857, 9880, 9887, 9874, 9877, 11861, 15893; Payload ID: 14285 relates to Category No.: 3303, 15503, 14471, 14234, 15503, 14233, 14471, 15504, 11861, 15528, 14233, 14244, 12434, 2405, 15528, 14255, 14237, 12064; Payload ID: 14286 relates to Category No.: 3303, 15503, 14471, 14234, 15503, 14233, 2405; Payload ID: 14287 relates to Category No.: 1405, 1426; Payload ID: 14288 relates to Category No.: 926, 3303, 9226, 954, 953, 11861, 3325, 714, 948; Payload ID: 14289 relates to Category No.: 926, 9226, 954, 16331; Payload ID: 14290 relates to Category No.: 926, 9226, 954, 14232, 3325; Payload ID: 14291 relates to Category No.: 11861; Payload ID: 14292 relates to Category No.: 3303; Payload ID: 14293 relates to Category No.: 6816, 14506, 11861, 12114, 16154, 6255; Payload ID: 14294 relates to Category No.: 4864, 1504; Payload ID: 14295 relates to Category No.: 1504; Payload ID: 14296 relates to Category No.: 1504, 11861; Payload ID: 14297 relates to Category No.: 1504; Payload ID: 14298 relates to Category No.: 5009, 6579; Payload ID: 14299 relates to Category No.: 1405, 16331, 3755, 4523; Payload ID: 14301 relates to Category No.: 6816, 12359, 10116, 11861, 4898, 5841, 14537; Payload ID: 14302 relates to Category No.: 6816, 12359, 11861, 5841; Payload ID: 14303 relates to Category No.: 11861, 5841; Payload ID: 14304 relates to Category No.: 11861, 5841; Payload ID: 14305 relates to Category No.: 11861; Payload ID: 14306 relates to Category No.: 11861, 14232; Payload ID: 14308 relates to Category No.: 3303, 15503, 14471, 1445, 11861, 5347; Payload ID: 14309 relates to Category No.: 9282, 1445; Payload ID: 14310 relates to Category No.: 11981, 11861, 11977, 14324; Payload ID: 14311 relates to Category No.: 11861; Payload ID: 14312 relates to Category No.: 11861, 12383; Payload ID: 14313 relates to Category No.: 2405, 5105, 9271, 11861, 12383; Payload ID: 14314 relates to Category No.: 6965, 11981, 12363, 11920, 10116, 11861, 14660; Payload ID: 14316 relates to Category No.: 4894, 1457; Payload ID: 14317 relates to Category No.: 4894, 11861; Payload ID: 14318 relates to Category No.: 14564, 4894, 4806; Payload ID: 14319 relates to Category No.: 4894, 11861, 12417, 4898, 4804; Payload ID: 14320 relates to Category No.: 4894, 11861; Payload ID: 14321 relates to Category No.: 6965, 4894, 12416, 4429, 12417, 4898, 11861, 4893, 11981, 4804; Payload ID: 14322 relates to Category No.: 4894, 1457, 11861; Payload ID: 14323 relates to Category No.: 4894, 11861; Payload ID: 14324 relates to Category No.: 4894; Payload ID: 14325 relates to Category No.: 4894, 11861, 4804; Payload ID: 14326 relates to Category No.: 4894, 1457, 11861, 1173; Payload ID: 14327 relates to Category No.: 4894, 11861; Payload ID: 14328 relates to Category No.: 4894; Payload ID: 14329 relates to Category No.: 4894; Payload ID: 14330 relates to Category No.: 4894, 11861; Payload ID: 14331 relates to Category No.: 4894, 1457, 4804; Payload ID: 14332 relates to Category No.: 4894; Payload ID: 14333 relates to Category No.: 14564, 4894, 11861; Payload ID: 14334 relates to Category No.: 14564, 4894, 4806, 11861; Payload ID: 14335 relates to Category No.: 11861; Payload ID: 14336 relates to Category No.: 4894, 11861; Payload ID: 14337 relates to Category No.: 14564, 4894, 11886; Payload ID: 14338 relates to Category No.: 4894; Payload ID: 14339 relates to Category No.: 11861; Payload ID: 14340 relates to Category No.: 11861; Payload ID: 14341 relates to Category No.: 11861; Payload ID: 14342 relates to Category No.: 926, 3303, 9226, 6816, 954, 138, 953, 5308, 305, 5405, 11861, 5308; Payload ID: 14343 relates to Category No.: 11981, 11861, 11886, 37, 14262, 14263, 14264, 15323, 1201; Payload ID: 14344 relates to Category No.: 3303, 14234, 11861, 15503, 14239; Payload ID: 14345 relates to Category No.: 3303, 15503, 14471, 14234; Payload ID: 14346 relates to Category No.: 3303, 15503, 14471, 14234, 15524, 11861, 15503, 14239, 14471; Payload ID: 14347 relates to Category No.: 3303, 14234, 11861, 15528, 14233, 2405; Payload ID: 14348 relates to Category No.: 3303, 15503, 14471, 14234, 11861;

Payload ID: 14349 relates to Category No.: 3303, 14234, 15524, 14243, 11861, 15528, 14255; Payload ID: 14350 relates to Category No.: 3303, 15503, 14471, 14234; Payload ID: 14351 relates to Category No.: 3303, 15503, 14471, 11861, 15493, 5109; Payload ID: 14352 relates to Category No.: 15503, 14471, 15491, 3303; Payload ID: 14353 relates to Category No.: 5843; Payload ID: 14354 relates to Category No.: 1457; Payload ID: 14355 relates to Category No.: 4886, 4895, 11861, 11886, 4422; Payload ID: 14356 relates to Category No.: 4886, 4895, 11861; Payload ID: 14357 relates to Category No.: 5259; Payload ID: 14358 relates to Category No.: 5259; Payload ID: 14359 relates to Category No.: 5259, 11861, 4821; Payload ID: 14360 relates to Category No.: 4820, 11861, 6816, 5260; Payload ID: 14361 relates to Category No.: 4820, 11861, 12176, 9636; Payload ID: 14362 relates to Category No.: 4820, 4816; Payload ID: 14363 relates to Category No.: 4820, 4816, 701, 11861; Payload ID: 14364 relates to Category No.: 15781; Payload ID: 14366 relates to Category No.: 11861, 2566; Payload ID: 14367 relates to Category No.: 4886, 11861; Payload ID: 14368 relates to Category No.: 16331, 5105, 11861; Payload ID: 14369 relates to Category No.: 9518; Payload ID: 14370 relates to Category No.: 894, 12402, 9619, 3663, 5551; Payload ID: 14371 relates to Category No.: 1630, 3665, 7464, 926, 11939, 3753, 12250; Payload ID: 14372 relates to Category No.: 1405; Payload ID: 14373 relates to Category No.: 926, 3749, 3303, 11861, 3306; Payload ID: 14374 relates to Category No.: 926, 3303, 11861, 3306, 6477; Payload ID: 14375 relates to Category No.: 3303, 942, 11861, 3306; Payload ID: 14376 relates to Category No.: 926, 3303, 11861, 3306; Payload ID: 14377 relates to Category No.: 926, 3303, 11861, 3306, 3752; Payload ID: 14378 relates to Category No.: 6816, 3303, 10116, 9226; Payload ID: 14379 relates to Category No.: 3303, 9226, 6816, 2963, 14597, 11861, 2405; Payload ID: 14380 relates to Category No.: 3303, 9226, 2963, 15895, 14597, 11861, 3752, 12081, 12064; Payload ID: 14381 relates to Category No.: 3303, 2963, 14597, 11861; Payload ID: 14382 relates to Category No.: 3303, 9226, 14597; Payload ID: 14383 relates to Category No.: 7192; Payload ID: 14384 relates to Category No.: 1201, 11861; Payload ID: 14385 relates to Category No.: 11861; Payload ID: 14387 relates to Category No.: 2694, 4710, 15545, 11861; Payload ID: 14388 relates to Category No.: 2694, 5347; Payload ID: 14389 relates to Category No.: 11861; Payload ID: 14390 relates to Category No.: 11861; Payload ID: 14391 relates to Category No.: 11861; Payload ID: 14392 relates to Category No.: 4886; Payload ID: 14393 relates to Category No.: 5259; Payload ID: 14394 relates to Category No.: 5259, 7192; Payload ID: 14395 relates to Category No.: 3303; Payload ID: 14396 relates to Category No.: 3303; Payload ID: 14397 relates to Category No.: 3303, 11861, 3752; Payload ID: 14398 relates to Category No.: 16331, 11861; Payload ID: 14399 relates to Category No.: 16331, 11861; Payload ID: 14400 relates to Category No.: 16331, 11861; Payload ID: 14401 relates to Category No.: 16331, 11861; Payload ID: 14402 relates to Category No.: 16331, 11861; Payload ID: 14403 relates to Category No.: 16331, 11861; Payload ID: 14404 relates to Category No.: 1405, 11978, 926, 15612, 12399, 12145, 11861; Payload ID: 14406 relates to Category No.: 7192, 217; Payload ID: 14407 relates to Category No.: 1405, 11861; Payload ID: 14408 relates to Category No.: 1405, 11861; Payload ID: 14409 relates to Category No.: 1405, 11861; Payload ID: 14410 relates to Category No.: 11861; Payload ID: 14411 relates to Category No.: 11861; Payload ID: 14412 relates to Category No.: 11861; Payload ID: 14413 relates to Category No.: 10116, 11861; Payload ID: 14414 relates to Category No.: 16331, 9518; Payload ID: 14415 relates to Category No.: 11861, 12399, 8891; Payload ID: 14416 relates to Category No.: 12399, 11861; Payload ID: 14417 relates to Category No.: 12399, 11861; Payload ID: 14418 relates to Category No.: 14234, 15528, 14233, 3303, 14471; Payload ID: 14419 relates to Category No.: 3303, 14471; Payload ID: 14420 relates to Category No.: 11861; Payload ID: 14422 relates to Category No.: 4820, 11861, 9992; Payload ID: 14424 relates to Category No.: 4820, 9992; Payload ID: 14425 relates to Category No.: 6816, 9824, 9896, 543, 35, 542, 35, 1593, 14070; Payload ID: 14426 relates to Category No.: 15629, 14088, 34; Payload ID: 14427 relates to Category No.: 6965, 11861; Payload ID: 14429 relates to Category No.: 4886, 267, 4894, 15973, 11861; Payload ID: 14430 relates to Category No.: 16331, 10116, 11861, 9226; Payload ID: 14431 relates to Category No.: 4924, 10116, 11861; Payload ID: 14432 relates to Category No.: 11861; Payload ID: 14433 relates to Category No.: 7192, 3303, 15503, 14471, 15504, 15895, 15491, 11861, 2688, 5347, 5957, 9961, 686, 3752, 14229; Payload ID: 14434 relates to Category No.: 14234, 5105, 3385, 5109, 9271, 11861, 14240; Payload ID: 14435 relates to Category No.: 15524, 6900, 5208, 11861; Payload ID: 14436 relates to Category No.: 16331, 9226, 15908, 11861, 15893, 6188, 10116; Payload ID: 14437 relates to Category No.: 11861, 14196; Payload ID: 14438 relates to Category No.: 2963, 11861, 14249, 14598, 14244; Payload ID: 14439 relates to Category No.: 5308, 11861; Payload ID: 14440 relates to Category No.: 15504, 11861; Payload ID: 14441 relates to Category No.: 3303, 11861; Payload ID: 14442 relates to Category No.: 7539; Payload ID: 14443 relates to Category No.: 7539; Payload ID: 14444 relates to Category No.: 7539; Payload ID: 14445 relates to Category No.: 16331, 15503, 14471, 11861, 3731; Payload ID: 14446 relates to Category No.: 11861; Payload ID: 14447 relates to Category No.: 11861, 7192; Payload ID: 14449 relates to Category No.: 12402, 11861; Payload ID: 14450 relates to Category No.: 9921, 11861; Payload ID: 14451 relates to Category No.: 16331, 15503, 14471, 11933, 14471, 15504, 12402, 15491, 15495, 14968, 11920, 11861, 14081, 3752, 14077, 2406, 11973, 11979, 14084, 566, 14243, 3303, 15524, 13683, 14251, 6183, 14242, 3471, 15598, 9226, 5109, 7267; Payload ID: 14452 relates to Category No.: 16331, 15503, 14471, 14471, 14968, 14081, 3303, 11861, 14243, 11886, 3471, 14087; Payload ID: 14453 relates to Category No.: 3303, 16331, 15503, 14471, 14471, 14968, 11861, 14087, 14243, 14081; Payload ID: 14454 relates to Category No.: 3303, 16331, 15503, 14471, 11933, 14471, 15524, 15491, 14968, 14251, 6183, 14243, 11861, 14081, 3752, 16224, 14084, 16226, 15504, 2406, 194, 11920, 11886, 3459, 14082; Payload ID: 14455 relates to Category No.: 16331, 15503, 14471, 14471, 15491, 14968, 14251, 6183, 14243, 11861, 15528, 14255, 3303, 14240, 11939, 194, 11933, 14082, 16224, 15409, 15410; Payload ID: 14456 relates to Category No.: 16331, 15503, 14471, 14471, 14968, 11861, 14243, 194; Payload ID: 14457 relates to Category No.: 15629, 6210, 14088, 14062, 14085; Payload ID: 14458 relates to Category No.: 15629, 6210, 14062, 14085; Payload ID: 14459 relates to Category No.: 14506, 14062, 14085, 14088; Payload ID: 14460 relates to Category No.: 15629, 11861, 14062, 14085, 14088, 14093, 11933, 14662; Payload ID: 14461 relates to Category No.: 15629, 11861, 14062, 14085, 14088; Payload ID: 14462 relates to Category No.: 15629, 6210, 11861, 14062, 14088, 14085; Payload ID: 14463 relates to Category No.: 9518, 14089, 7525; Payload ID: 14464 relates to Category No.: 9518, 14089, 7525; Payload ID: 14465 relates to Category No.:

9518, 11861, 14089; Payload ID: 14466 relates to Category No.: 9518; Payload ID: 14467 relates to Category No.: 9518, 509; Payload ID: 14468 relates to Category No.: 3554, 9518, 14089; Payload ID: 14469 relates to Category No.: 9518, 14089; Payload ID: 14470 relates to Category No.: 9518, 3930, 14089; Payload ID: 14471 relates to Category No.: 9518, 541; Payload ID: 14472 relates to Category No.: 9882, 9880, 9887, 9874, 9877, 9896, 9890, 9888; Payload ID: 14476 relates to Category No.: 6478, 2963, 9304, 11861, 3077; Payload ID: 14477 relates to Category No.: 3303, 9282, 9226, 6816, 3390, 94, 138, 11861; Payload ID: 14478 relates to Category No.: 14504, 11861, 3665, 6826; Payload ID: 14479 relates to Category No.: 9226, 3993; Payload ID: 14480 relates to Category No.: 9226; Payload ID: 14481 relates to Category No.: 9226, 15503, 14471, 10116, 3993; Payload ID: 14482 relates to Category No.: 6816, 15542, 15553, 7192, 9323; Payload ID: 14484 relates to Category No.: 6229; Payload ID: 14485 relates to Category No.: 3303, 15503, 14471, 14234; Payload ID: 14486 relates to Category No.: 11861; Payload ID: 14487 relates to Category No.: 12359, 11861, 12360; Payload ID: 14488 relates to Category No.: 644; Payload ID: 14489 relates to Category No.: 644; Payload ID: 14490 relates to Category No.: 644, 712; Payload ID: 14491 relates to Category No.: 644, 712; Payload ID: 14492 relates to Category No.: 644, 712; Payload ID: 14493 relates to Category No.: 4886, 4895, 12402, 11861; Payload ID: 14494 relates to Category No.: 4886, 4895, 11861, 12064; Payload ID: 14495 relates to Category No.: 4886, 4895, 11861; Payload ID: 14496 relates to Category No.: 4894, 11861, 14104, 11981, 4103, 14106, 5282; Payload ID: 14497 relates to Category No.: 4895, 4894, 14104; Payload ID: 14498 relates to Category No.: 14104, 4894, 11861, 4898, 4429; Payload ID: 14499 relates to Category No.: 4894, 11861, 14537, 14538; Payload ID: 14500 relates to Category No.: 11861, 4894; Payload ID: 14501 relates to Category No.: 4894; Payload ID: 14503 relates to Category No.: 4894, 11861; Payload ID: 14504 relates to Category No.: 4894; Payload ID: 14505 relates to Category No.: 4894, 11861, 14537; Payload ID: 14506 relates to Category No.: 4894; Payload ID: 14507 relates to Category No.: 4894; Payload ID: 14508 relates to Category No.: 4894; Payload ID: 14509 relates to Category No.: 4894, 11861; Payload ID: 14510 relates to Category No.: 4894, 11861; Payload ID: 14511 relates to Category No.: 4894, 11861; Payload ID: 14512 relates to Category No.: 11861, 4894; Payload ID: 14513 relates to Category No.: 4894; Payload ID: 14514 relates to Category No.: 4894, 9939, 11861; Payload ID: 14515 relates to Category No.: 11861, 4894, 14537; Payload ID: 14516 relates to Category No.: 4894; Payload ID: 14517 relates to Category No.: 6816, 4894, 9608, 11861; Payload ID: 14518 relates to Category No.: 4894; Payload ID: 14519 relates to Category No.: 11861, 4894, 14537; Payload ID: 14520 relates to Category No.: 4894, 9857, 11861; Payload ID: 14521 relates to Category No.: 9857, 11861, 4894; Payload ID: 14522 relates to Category No.: 3303, 4886, 4894, 15495, 14243, 15530, 14255; Payload ID: 14523 relates to Category No.: 4894; Payload ID: 14524 relates to Category No.: 11861; Payload ID: 14525 relates to Category No.: 12363, 11861, 4894, 14538; Payload ID: 14526 relates to Category No.: 4894; Payload ID: 14527 relates to Category No.: 4894, 11861; Payload ID: 14528 relates to Category No.: 4894, 9939, 11861; Payload ID: 14529 relates to Category No.: 4886, 4895, 4894, 11861, 14536; Payload ID: 14530 relates to Category No.: 14537, 14538, 9923, 9925, 4894; Payload ID: 14531 relates to Category No.: 4894, 11861; Payload ID: 14532 relates to Category No.: 4894, 11861, 9874; Payload ID: 14533 relates to Category No.: 4894, 14107, 10116, 11861; Payload ID: 14534 relates to Category No.: 14107, 5960, 11861; Payload ID: 14535 relates to Category No.: 14107, 11861, 4894; Payload ID: 14536 relates to Category No.: 4894, 14107, 4821, 11861; Payload ID: 14537 relates to Category No.: 4894, 14107, 4924, 4821, 11861; Payload ID: 14538 relates to Category No.: 4894, 14107, 11861; Payload ID: 14539 relates to Category No.: 14107, 11861, 14106, 12425, 9608; Payload ID: 14540 relates to Category No.: 14107, 4924, 11861; Payload ID: 14541 relates to Category No.: 4894, 14107, 11861; Payload ID: 14542 relates to Category No.: 14107; Payload ID: 14543 relates to Category No.: 14107, 11861; Payload ID: 14544 relates to Category No.: 6816, 14196, 14107, 11861; Payload ID: 14545 relates to Category No.: 14107, 4924, 11861; Payload ID: 14546 relates to Category No.: 14107; Payload ID: 14548 relates to Category No.: 14107, 11861; Payload ID: 14549 relates to Category No.: 14107, 11861; Payload ID: 14550 relates to Category No.: 14107, 11861; Payload ID: 14551 relates to Category No.: 14107, 4924, 11920, 11861, 12364; Payload ID: 14552 relates to Category No.: 14107, 11861; Payload ID: 14553 relates to Category No.: 4886, 14107, 4924, 11861; Payload ID: 14554 relates to Category No.: 14107, 4924, 11981, 11861; Payload ID: 14555 relates to Category No.: 14107, 4924; Payload ID: 14556 relates to Category No.: 16331, 6965, 15504, 14107, 12363, 11861, 14106, 12364, 6816; Payload ID: 14557 relates to Category No.: 11978, 926, 6816, 12109, 11861, 14106; Payload ID: 14558 relates to Category No.: 11978, 926, 6816, 15029, 12109, 10116, 11861, 14106, 4901, 14109; Payload ID: 14559 relates to Category No.: 6816, 4820, 11861, 9992, 14062; Payload ID: 14560 relates to Category No.: 14503, 4865; Payload ID: 14561 relates to Category No.: 14503, 4865; Payload ID: 14562 relates to Category No.: 14503, 3663, 11861, 9619; Payload ID: 14563 relates to Category No.: 14503; Payload ID: 14564 relates to Category No.: 14503, 11861; Payload ID: 14565 relates to Category No.: 14503; Payload ID: 14566 relates to Category No.: 14503; Payload ID: 14567 relates to Category No.: 14503, 1405; Payload ID: 14568 relates to Category No.: 11861; Payload ID: 14569 relates to Category No.: 11939, 11933, 12416, 11861; Payload ID: 14570 relates to Category No.: 11861; Payload ID: 14571 relates to Category No.: 11861, 4898; Payload ID: 14572 relates to Category No.: 11861; Payload ID: 14573 relates to Category No.: 4886, 11861; Payload ID: 14574 relates to Category No.: 4886, 11861; Payload ID: 14575 relates to Category No.: 4886, 926, 942, 12359, 11861; Payload ID: 14576 relates to Category No.: 4886, 11861, 4901, 4897, 14106; Payload ID: 14578 relates to Category No.: 3303, 15503, 14471, 14471; Payload ID: 14579 relates to Category No.: 3303, 14471, 11861; Payload ID: 14580 relates to Category No.: 3303, 14471; Payload ID: 14581 relates to Category No.: 11861; Payload ID: 14583 relates to Category No.: 926, 6816, 14127, 11861; Payload ID: 14584 relates to Category No.: 926, 9988, 512, 14132; Payload ID: 14585 relates to Category No.: 9226, 14196, 6478, 14284, 14134; Payload ID: 14586 relates to Category No.: 9226, 6816, 14196, 14284, 14134; Payload ID: 14587 relates to Category No.: 14284; Payload ID: 14588 relates to Category No.: 14284; Payload ID: 14589 relates to Category No.: 11978, 926, 6816, 14196, 3688, 11861, 14134, 14147, 14309; Payload ID: 14590 relates to Category No.: 14196, 14141, 14134; Payload ID: 14591 relates to Category No.: 6816, 14141; Payload ID: 14592 relates to Category No.: 9226, 10116, 11861, 14141; Payload ID: 14593 relates to Category No.: 9226, 10116, 11861; Payload ID: 14594 relates to Category No.: 1630, 10116, 11861, 14141, 14134; Payload ID: 14595 relates to Category No.: 11861, 14141; Payload ID: 14596 relates to Category No.: 14141; Payload ID: 14597 relates to Category No.: 14196, 3688, 14144, 14134; Payload ID: 14598 relates to Category No.: 9226, 11861, 14133, 3655; Payload ID: 14599 relates to Category No.: 9226; Payload ID: 14600 relates to Category No.: 9226; Payload ID: 14601 relates to Category No.: 9226; Payload ID: 14602 relates to Category No.: 9226; Payload ID: 14603 relates to Category No.: 9226, 3655, 14134, 14133; Payload ID: 14604 relates to Category No.: 9226, 3655, 14134; Payload ID: 14605 relates to Category No.: 9226, 3655, 14134, 14133; Payload ID: 14606 relates to Category No.: 9226, 3655, 14134, 6242, 9654; Payload ID: 14607 relates to Category No.: 9226, 14133; Payload ID: 14608 relates to Category No.: 9226; Payload ID: 14609 relates to Category No.: 9226, 3655, 14134; Payload ID: 14610 relates to Category No.: 3688; Payload ID: 14611 relates to Category No.: 11861, 14138; Payload ID: 14612 relates to Category No.: 14196, 6965, 11861; Payload ID: 14613 relates to Category No.: 9282, 9226, 10116; Payload ID: 14614 relates to Category No.: 9282, 9226, 10116, 11861; Payload ID: 14615 relates to Category No.: 926, 11861, 14154, 15361, 12250; Payload ID: 14616 relates to Category No.: 6816, 11861, 14154, 15361, 9518; Payload ID: 14617 relates to Category No.: 6816, 11861, 14154, 15361, 9518; Payload ID: 14618 relates to Category No.: 10116, 11861, 3411; Payload ID: 14619 relates to Category No.: 3411, 14176; Payload ID: 14620 relates to Category No.: 11861, 14161, 1504, 7225; Payload ID: 14621 relates to Category No.: 10116, 11861, 14196; Payload ID: 14622 relates to Category No.: 15027, 10116, 11861; Payload ID: 14623 relates to Category No.: 926, 1630, 6816, 7454; Payload ID: 14624 relates to Category No.: 926, 6816, 7454, 2484; Payload ID: 14625 relates to Category No.: 15027, 10116, 11861; Payload ID: 14626 relates to Category No.: 14196, 15027, 10116, 11861; Payload ID: 14627 relates to Category No.: 15027, 10116; Payload ID: 14628 relates to Category No.: 14196, 15027, 14309, 10116, 11861; Payload ID: 14629 relates to Category No.: 15027, 14309, 10116, 11861; Payload ID: 14630 relates to Category No.: 14196, 15027, 10116, 11861; Payload ID: 14631 relates to Category No.: 15027, 10116, 7268; Payload ID: 14632 relates to Category No.: 14196, 15027, 10116, 11861; Payload ID: 14633 relates to Category No.: 14196, 15027, 10116, 11861; Payload ID: 14634 relates to Category No.: 15027, 10116; Payload ID: 14635 relates to Category No.: 14196, 15027; Payload ID: 14636 relates to Category No.: 14196, 15027, 10116; Payload ID: 14637 relates to Category No.: 14196, 15027, 10116; Payload ID: 14638 relates to Category No.: 14196, 15027, 10116; Payload ID: 14639 relates to Category No.: 15027, 14196, 10116, 11861, 5009; Payload ID: 14640 relates to Category No.: 15027, 10116; Payload ID: 14641 relates to Category No.: 15027, 10116, 11861, 6042; Payload ID: 14642 relates to Category No.: 9282, 15027, 14309, 10116, 11861; Payload ID: 14643 relates to Category No.: 14196, 15027, 10116; Payload ID: 14644 relates to Category No.: 14196, 15027, 10116, 11861; Payload ID: 14645 relates to Category No.: 15027, 10116; Payload ID: 14646 relates to Category No.: 15027, 10116; Payload ID: 14647 relates to Category No.: 14196, 15027, 10116, 11861; Payload ID: 14648 relates to Category No.: 14196, 15027, 10116, 11861; Payload ID: 14649 relates to Category No.: 14196, 15027, 5009, 10116; Payload ID: 14650 relates to Category No.: 15027, 14196, 10116; Payload ID: 14651 relates to Category No.: 14196, 15027, 10116, 11861; Payload ID: 14652 relates to Category No.: 14196, 15027, 10116; Payload ID: 14653 relates to Category No.: 15027, 10116; Payload ID: 14654 relates to Category No.: 14196, 15027; Payload ID: 14655 relates to Category No.: 15027, 10116, 7268; Payload ID: 14656 relates to Category No.: 15027, 10116, 15699; Payload ID: 14657 relates to Category No.: 15027, 10116; Payload ID: 14658 relates to Category No.: 15027, 10116; Payload ID: 14659 relates to Category No.: 15027, 11861; Payload ID: 14660 relates to Category No.: 6816, 14196, 15027, 14309; Payload ID: 14661 relates to Category No.: 6816, 15027, 10116, 11861; Payload ID: 14662 relates to Category No.: 14196, 15027; Payload ID: 14663 relates to Category No.: 14196, 15027; Payload ID: 14664 relates to Category No.: 14196, 15027, 11861; Payload ID: 14665 relates to Category No.: 14196, 15027, 10116; Payload ID: 14666 relates to Category No.: 14196, 15027, 10116, 11861; Payload ID: 14667 relates to Category No.: 14196, 15027; Payload ID: 14668 relates to Category No.: 14196, 15027, 10116, 11861, 168; Payload ID: 14669 relates to Category No.: 3303, 14196, 15027, 10116; Payload ID: 14670 relates to Category No.: 3303, 14196, 15027, 11939, 10116, 7268, 11861; Payload ID: 14671 relates to Category No.: 14196, 15027, 10116, 11861; Payload ID: 14672 relates to Category No.: 15027, 10116; Payload ID: 14673 relates to Category No.: 14196, 15027, 14309, 10116, 11861; Payload ID: 14674 relates to Category No.: 14196, 15027, 14309, 11861; Payload ID: 14675 relates to Category No.: 15027, 10116, 11861; Payload ID: 14676 relates to Category No.: 15027, 14309, 10116, 11861; Payload ID: 14677 relates to Category No.: 15027, 10116; Payload ID: 14678 relates to Category No.: 15027, 14669, 10116, 7268, 11861; Payload ID: 14679 relates to Category No.: 14196, 15027, 10116, 11861, 14669, 15595, 7267; Payload ID: 14680 relates to Category No.: 14196, 15027, 3303, 10116, 11861; Payload ID: 14681 relates to Category No.: 14196, 15027, 10116; Payload ID: 14682 relates to Category No.: 15027, 14196, 10116, 11861; Payload ID: 14683 relates to Category No.: 15027, 10116; Payload ID: 14684 relates to Category No.: 9226, 14196, 15027, 14309, 10116, 11861; Payload ID: 14685 relates to Category No.: 15027, 11939, 11981, 10116, 11861, 4183; Payload ID: 14686 relates to Category No.: 10116, 11861, 3752; Payload ID: 14687 relates to Category No.: 14196, 15027, 10116, 7268, 11861, 3752, 4183; Payload ID: 14688 relates to Category No.: 14196, 15027, 10116, 11861; Payload ID: 14689 relates to Category No.: 15027, 10116, 12064, 11861; Payload ID: 14690 relates to Category No.: 15027, 10116, 11861; Payload ID: 14691 relates to Category No.: 9282, 15027, 10116, 15593; Payload ID: 14692 relates to Category No.: 14196, 10116, 11861; Payload ID: 14693 relates to Category No.: 15027, 10116, 7268, 11861; Payload ID: 14694 relates to Category No.: 3303, 16331, 15027, 10116, 11861; Payload ID: 14695 relates to Category No.: 6816, 15027, 10116, 11861; Payload ID: 14696 relates to Category No.: 6816, 15027, 10116, 11861, 2853, 15589; Payload ID: 14697 relates to Category No.: 15027, 10116, 11861; Payload ID: 14698 relates to Category No.: 16331, 15027; Payload ID: 14699 relates to Category No.: 3303, 14196, 15027, 6965, 15504, 2963, 5875, 11981, 10116, 7268, 3640, 11861, 3752, 14669, 15766, 9513, 5957, 3380, 15097, 5282, 5280, 9014, 9512, 11973, 15106, 9514, 15904; Payload ID: 14700 relates to Category No.: 14196, 15027, 10116, 11861; Payload ID: 14701 relates to Category No.: 14196, 15027, 14309, 10116; Payload ID: 14702 relates to Category No.: 14196, 15027, 14309, 10116; Payload ID: 14703 relates to Category No.: 14196, 15027, 14309, 10116, 7192; Payload ID: 14704 relates to Category No.: 14196, 15027, 14309, 10116, 7268, 11861; Payload ID: 14705 relates to Category No.: 15027, 11981, 10116, 11861; Payload ID: 14706 relates to Category No.: 11978, 926, 12109, 9857, 11861; Payload ID: 14707 relates to Category No.: 11978, 926, 14167, 12109, 11861, 12114, 9608, 9629, 5347, 12077; Payload ID: 14708 relates to Category No.: 11978, 926, 14167, 12109, 9629; Payload ID: 14709 relates to Category No.: 14167, 11978, 926, 6478, 12109, 2859, 11861, 12114; Payload ID: 14710 relates to Category No.: 11978, 926, 6478, 12109, 11861, 14167, 12114; Payload ID: 14711 relates to Category No.: 11978, 926, 6478, 12109, 2859, 11861, 14167, 11981; Payload ID: 14712 relates to Category No.: 11978, 926, 6478, 12109, 5195, 11861, 14167, 7128; Payload ID: 14713 relates to Category No.: 11978, 926, 6478, 12109, 5195, 11861; Payload ID: 14714 relates to Category No.: 11978, 926, 6478, 12109, 14167; Payload ID: 14715 relates to Category No.: 12109, 11978, 926; Payload ID: 14716 relates to Category No.: 14196, 15027, 10116, 11861; Payload ID: 14717 relates to Category No.: 15027, 10116; Payload ID: 14718 relates to Category No.: 14196, 15027, 14309, 10116, 11861, 15595; Payload ID: 14719 relates to Category No.: 15027, 14176, 6024, 10116, 11861, 6026, 16206; Payload ID: 14720 relates to Category No.: 14196, 15027, 10116, 11861; Payload ID: 14721 relates to Category No.: 14196, 15027, 11861; Payload ID: 14722 relates to Category No.: 14196, 15027, 11861; Payload ID: 14723 relates to Category No.: 14299, 14315; Payload ID: 14724 relates to Category No.: 10116; Payload ID: 14725 relates to Category No.: 10116, 1201; Payload ID: 14727 relates to Category No.: 10116, 11861; Payload ID: 14728 relates to Category No.: 10116; Payload ID: 14729 relates to Category No.: 9282, 10116, 11861; Payload ID: 14730 relates to Category No.: 6900, 14351, 6924, 10116, 11861; Payload ID: 14731 relates to Category No.: 10116, 11861, 15859; Payload ID: 14732 relates to Category No.: 11861, 7192; Payload ID: 14733 relates to Category No.: 12399, 10116, 11861; Payload ID: 14734 relates to Category No.: 10116, 11861; Payload ID: 14735 relates to Category No.: 14317, 14196, 10116, 11861; Payload ID: 14736 relates to Category No.: 14309, 10116; Payload ID: 14737 relates to Category No.: 6816, 11939, 1630, 5347, 12366, 306, 14180; Payload ID: 14738 relates to Category No.: 6816, 1630, 12366, 306, 14180; Payload ID: 14739 relates to Category No.: 12359, 11861, 12360; Payload ID: 14740 relates to Category No.: 217, 11864; Payload ID: 14741 relates to Category No.: 4894, 4924, 11861, 4804, 1201; Payload ID: 14742 relates to Category No.: 4894, 4924, 1201, 4804; Payload ID: 14743 relates to Category No.: 6816, 9518, 65, 11861; Payload ID: 14744 relates to Category No.: 11861; Payload ID: 14745 relates to Category No.: 11861; Payload ID: 14746 relates to Category No.: 11861; Payload ID: 14747 relates to Category No.: 11861; Payload ID: 14748 relates to Category No.: 16331, 6816, 15893, 10116, 11861, 7265, 7268; Payload ID: 14749 relates to Category No.: 3303, 16331, 6816, 15908, 6188, 10116, 11861, 7268; Payload ID: 14750 relates to Category No.: 16331, 15908, 11939, 9539, 6188, 11861, 12402; Payload ID: 14751 relates to Category No.: 16331, 9539, 15895, 15893, 6188, 11981, 11861, 11828; Payload ID: 14752 relates to Category No.: 16331, 11861, 1201; Payload ID: 14753 relates to Category No.: 16331, 6816, 11861, 15893, 6188; Payload ID: 14754 relates to Category No.: 16331, 15908, 9539, 6188, 11861, 6647; Payload ID: 14755 relates to Category No.: 16331, 15908, 6188, 11861, 686, 3303, 15893; Payload ID: 14756 relates to Category No.: 16331, 6816, 6188, 11861; Payload ID: 14757 relates to Category No.: 16331, 15908, 15524, 11861; Payload ID: 14758 relates to Category No.: 16331, 15908, 6188, 11861; Payload ID: 14759 relates to Category No.: 3303, 16331, 15908, 11861; Payload ID: 14760 relates to Category No.: 16331, 15893, 6188, 11861, 15100, 14652; Payload ID: 14761 relates to Category No.: 16331, 11861, 6816, 4886, 4895; Payload ID: 14762 relates to Category No.: 16331, 6816, 11861; Payload ID: 14763 relates to Category No.: 16331, 6816, 11861; Payload ID: 14764 relates to Category No.: 16331, 6816, 15893, 6188, 11861, 15889; Payload ID: 14765 relates to Category No.: 16331, 15908, 15893, 6188, 11861; Payload ID: 14766 relates to Category No.: 16331, 15893, 11861; Payload ID: 14767 relates to Category No.: 16331, 11861; Payload ID: 14768 relates to Category No.: 16331, 6188, 11861; Payload ID: 14769 relates to Category No.: 16331, 15893, 6188, 11861, 15889, 15908; Payload ID: 14770 relates to Category No.: 16331, 15893, 6188, 11861, 3774; Payload ID: 14771 relates to Category No.: 16331, 15893, 6188, 11861; Payload ID: 14772 relates to Category No.: 16331, 15908, 6188, 11861, 15893; Payload ID: 14773 relates to Category No.: 16331, 11861, 15908, 6188; Payload ID: 14774 relates to Category No.: 16331, 6188, 11861; Payload ID: 14775 relates to Category No.: 16331, 15908, 6188, 11861, 14147; Payload ID: 14776 relates to Category No.: 16331, 6816, 15893, 6188, 11981, 11861, 15889; Payload ID: 14777 relates to Category No.: 16331, 15908, 12399, 6188, 11861, 11828, 15906; Payload ID: 14778 relates to Category No.: 16331, 15908, 11861, 15893, 15491, 6188, 15889, 686, 15906; Payload ID: 14779 relates to Category No.: 16331, 15908, 11861, 3303; Payload ID: 14780 relates to Category No.: 16331, 15893, 6188, 11861, 15889, 15908; Payload ID: 14781 relates to Category No.: 16331, 15908, 15893, 6188, 11861, 15889; Payload ID: 14782 relates to Category No.: 16331, 11861; Payload ID: 14783 relates to Category No.: 16331, 6816, 15908, 15893, 6188, 11861, 10124; Payload ID: 14784 relates to Category No.: 16331, 11861; Payload ID: 14785 relates to Category No.: 16331, 11861, 6188, 15893; Payload ID: 14786 relates to Category No.: 16331, 11861; Payload ID: 14787 relates to Category No.: 16331, 11861, 15908; Payload ID: 14788 relates to Category No.: 16331, 15908, 15893, 6188, 11861, 14660; Payload ID: 14789 relates to Category No.: 16331, 11861; Payload ID: 14790 relates to Category No.: 16331, 11861; Payload ID: 14791 relates to Category No.: 16331, 15893, 11861, 15889; Payload ID: 14792 relates to Category No.: 16331, 15908, 6188, 11861; Payload ID: 14793 relates to Category No.: 16331, 15908, 2405, 5105, 6188, 5923, 9275, 11861, 15887; Payload ID: 14794 relates to Category No.: 16331, 6188, 5923, 9275, 11861; Payload ID: 14795 relates to Category No.: 16331, 11861, 11939; Payload ID: 14796 relates to Category No.: 16331, 6816, 6188, 11861; Payload ID: 14797 relates to Category No.: 16331, 15893, 11861; Payload ID: 14798 relates to Category No.: 16331, 15893, 6188, 15889, 11861; Payload ID: 14799 relates to Category No.: 16331, 11861, 15908, 6188; Payload ID: 14800 relates to Category No.: 16331, 15908, 6188, 11861; Payload ID: 14801 relates to Category No.: 16331, 11861; Payload ID: 14802 relates to Category No.: 16331, 6188, 11861, 15894, 15904; Payload ID: 14803 relates to Category No.: 16331, 11861; Payload ID: 14804 relates to Category No.: 16331, 6816, 15908, 6188, 11861; Payload ID: 14805 relates to Category No.: 16331, 15504, 15893, 6188, 11861, 15889, 15908; Payload ID: 14806 relates to Category No.: 16331, 15893, 6188, 11861, 15889; Payload ID: 14807 relates to Category No.: 16331, 6816, 15908, 2405, 6188, 11861, 14186, 15893; Payload ID: 14808 relates to Category No.: 16331, 6816, 15908, 9539, 15895, 5105, 15491, 6188, 11861, 7265, 2405; Payload ID: 14809 relates to Category No.: 16331, 6816, 11861, 5841, 2271, 5280; Payload ID: 14810 relates to Category No.: 16331, 15908, 11861; Payload ID: 14811 relates to Category No.: 16331, 11861, 6188;

Payload ID: 14812 relates to Category No.: 16331, 11861; Payload ID: 14813 relates to Category No.: 16331, 6816, 15908, 942, 11861, 6188; Payload ID: 14814 relates to Category No.: 16331, 11861; Payload ID: 14815 relates to Category No.: 16331, 11861; Payload ID: 14816 relates to Category No.: 6816, 6188, 11861; Payload ID: 14817 relates to Category No.: 16331, 15908, 15893, 6188, 15889, 6816; Payload ID: 14818 relates to Category No.: 16331, 11861; Payload ID: 14819 relates to Category No.: 16331, 15908, 6188, 11861, 15893; Payload ID: 14820 relates to Category No.: 16331, 15504, 15893, 11861, 15100; Payload ID: 14821 relates to Category No.: 16331, 11861; Payload ID: 14822 relates to Category No.: 16331, 11861; Payload ID: 14823 relates to Category No.: 16331, 11861; Payload ID: 14824 relates to Category No.: 16331, 11861; Payload ID: 14825 relates to Category No.: 16331, 15908, 15893, 6188, 11861, 9014; Payload ID: 14826 relates to Category No.: 16331, 11861; Payload ID: 14827 relates to Category No.: 16331, 15908, 15895, 6188, 11861, 15887, 6816; Payload ID: 14828 relates to Category No.: 16331, 11861; Payload ID: 14829 relates to Category No.: 16331, 9539, 15895, 15893, 6188, 11861, 9865, 15908; Payload ID: 14830 relates to Category No.: 16331, 15908, 6188, 11861; Payload ID: 14831 relates to Category No.: 16331, 11861; Payload ID: 14832 relates to Category No.: 3303, 16331, 15908, 15503, 14471, 15504, 15893, 15491, 6188, 9275, 11861, 5347, 15100, 686; Payload ID: 14833 relates to Category No.: 16331, 6816, 15908, 11939, 15895, 6188, 11861, 7265, 15889, 11886, 15181; Payload ID: 14834 relates to Category No.: 16331, 6816, 15908, 15893, 11861, 250, 12121, 12379, 3859, 5689; Payload ID: 14835 relates to Category No.: 16331, 15908, 6188, 4291, 11861; Payload ID: 14836 relates to Category No.: 16331, 11861; Payload ID: 14837 relates to Category No.: 16331, 15908, 6188, 11861, 15894; Payload ID: 14838 relates to Category No.: 16331, 15893, 2672, 11861, 2793, 7551; Payload ID: 14839 relates to Category No.: 16331, 15908, 11939, 2405, 15895, 5105, 6188, 11861; Payload ID: 14840 relates to Category No.: 16331, 15908, 6188, 15495, 11861, 15893; Payload ID: 14841 relates to Category No.: 16331, 11861; Payload ID: 14842 relates to Category No.: 16331, 11861; Payload ID: 14843 relates to Category No.: 16331, 11861, 3303, 15495; Payload ID: 14844 relates to Category No.: 16331, 15908, 15895, 15893, 6188, 11861, 2793, 15916, 7551, 11886; Payload ID: 14845 relates to Category No.: 926, 12109; Payload ID: 14846 relates to Category No.: 926, 12109; Payload ID: 14847 relates to Category No.: 926, 12109, 11861; Payload ID: 14848 relates to Category No.: 11861; Payload ID: 14849 relates to Category No.: 11861; Payload ID: 14850 relates to Category No.: 11861; Payload ID: 14851 relates to Category No.: 14196, 11861, 7259; Payload ID: 14852 relates to Category No.: 926, 6816, 10116, 11861, 16184, 14208, 14209; Payload ID: 14853 relates to Category No.: 926, 14196, 1630, 10116, 14278; Payload ID: 14854 relates to Category No.: 9282, 9226, 14196, 10116, 11861, 14163; Payload ID: 14855 relates to Category No.: 16331, 9282, 9226, 6816, 10116, 11861, 5347, 11886; Payload ID: 14856 relates to Category No.: 9282, 9226, 11939, 11861, 10122; Payload ID: 14857 relates to Category No.: 9282, 9226, 10116; Payload ID: 14858 relates to Category No.: 9282, 9226, 10116, 11861; Payload ID: 14859 relates to Category No.: 9282, 9226, 14196, 11861, 1327, 14248, 10116, 11861, 6185; Payload ID: 14860 relates to Category No.: 9282, 9226, 10116, 11861; Payload ID: 14861 relates to Category No.: 9282, 9226, 14196, 10116, 11861; Payload ID: 14862 relates to Category No.: 9282, 9226, 14196, 11861; Payload ID: 14863 relates to Category No.: 9282, 9226, 14196; Payload ID: 14864 relates to Category No.: 9282, 9226, 10116; Payload ID: 14865 relates to Category No.: 16331, 9282, 9226, 14196; Payload ID: 14866 relates to Category No.: 9282, 9226, 6816, 10116, 11861, 1439, 15872, 9239, 11700; Payload ID: 14867 relates to Category No.: 9282, 9226, 14196, 11861; Payload ID: 14868 relates to Category No.: 9282, 9226, 7265; Payload ID: 14869 relates to Category No.: 9282, 9226, 10116, 7268, 11861; Payload ID: 14870 relates to Category No.: 9282, 9226, 6816, 10116, 11861, 14196; Payload ID: 14871 relates to Category No.: 9282, 9226, 6816, 10116; Payload ID: 14872 relates to Category No.: 9282, 9226, 10116; Payload ID: 14873 relates to Category No.: 9282, 10116, 9226; Payload ID: 14874 relates to Category No.: 9282, 9226, 10116; Payload ID: 14875 relates to Category No.: 9282, 9226, 10116, 7268, 7265; Payload ID: 14876 relates to Category No.: 9282, 9226, 14196, 10116, 11861; Payload ID: 14877 relates to Category No.: 16331, 9282, 9226, 14196, 10116, 7268, 11861, 7265, 11704, 7010, 11705; Payload ID: 14878 relates to Category No.: 9282, 9226, 11861, 11704, 15847; Payload ID: 14879 relates to Category No.: 9282, 9226, 10116, 11861; Payload ID: 14880 relates to Category No.: 9282, 9226, 14196; Payload ID: 14881 relates to Category No.: 9282, 9226, 11861, 11939, 14196; Payload ID: 14882 relates to Category No.: 9282, 9226, 14196, 10116, 11861; Payload ID: 14883 relates to Category No.: 9282, 9226, 14196; Payload ID: 14884 relates to Category No.: 9282, 9226, 10116, 14196, 11861; Payload ID: 14885 relates to Category No.: 14196, 9282; Payload ID: 14886 relates to Category No.: 16331, 9282, 9226, 10116, 11861; Payload ID: 14887 relates to Category No.: 3303, 16331, 9282, 9226, 6816, 14196, 10116, 7268, 11861; Payload ID: 14888 relates to Category No.: 3303, 9282, 9226, 14196, 10116, 11861; Payload ID: 14889 relates to Category No.: 9282, 9226, 10116; Payload ID: 14890 relates to Category No.: 9226, 9282, 14196, 10116, 7268, 11861; Payload ID: 14891 relates to Category No.: 9282, 9226, 14196, 2405, 10116, 7268, 11861, 2688; Payload ID: 14892 relates to Category No.: 9282, 9226, 10116, 11861; Payload ID: 14893 relates to Category No.: 9282, 9226, 14196; Payload ID: 14894 relates to Category No.: 9282, 9226, 14196; Payload ID: 14895 relates to Category No.: 9282, 9226, 14196; Payload ID: 14896 relates to Category No.: 9282, 9226, 7268, 11861; Payload ID: 14897 relates to Category No.: 9282, 9226, 14196, 11861; Payload ID: 14898 relates to Category No.: 9282, 9226, 14196; Payload ID: 14899 relates to Category No.: 9282, 9226, 14196; Payload ID: 14900 relates to Category No.: 9282, 9226, 14196, 11861; Payload ID: 14901 relates to Category No.: 9282, 9226, 14196, 11861; Payload ID: 14902 relates to Category No.: 9282, 9226, 14196, 3459, 14597, 10116, 11861; Payload ID: 14903 relates to Category No.: 9282, 9226, 14196, 10116; Payload ID: 14904 relates to Category No.: 9282, 9226, 14196, 7265; Payload ID: 14905 relates to Category No.: 9282, 9226, 10116, 11861, 7265; Payload ID: 14906 relates to Category No.: 9282, 9226, 10115, 15491, 10116, 11861, 14715; Payload ID: 14907 relates to Category No.: 9282, 9226; Payload ID: 14908 relates to Category No.: 9282, 9226, 14196, 11895, 7268, 11861; Payload ID: 14909 relates to Category No.: 9282, 9226, 14196, 15504, 15495, 10116, 7268, 11861; Payload ID: 14910 relates to Category No.: 9282, 9226, 14196, 7268, 3303, 11861; Payload ID: 14911 relates to Category No.: 9226, 94, 97; Payload ID: 14912 relates to Category No.: 4886, 12150, 12151, 9804, 7282, 10143, 14202, 15678; Payload ID: 14913 relates to Category No.: 14196, 6924, 14213, 10116, 11861; Payload ID: 14914 relates to Category No.: 3303, 11861, 3391; Payload ID:

14915 relates to Category No.: 6816, 2773; Payload ID: 14916 relates to Category No.: 11861; Payload ID: 14917 relates to Category No.: 14196, 12223, 3003, 7192; Payload ID: 14918 relates to Category No.: 14196, 12223, 3003, 10116; Payload ID: 14919 relates to Category No.: 14196, 12223, 3003, 10116, 11861; Payload ID: 14920 relates to Category No.: 14196, 12223, 3003, 10116, 11861; Payload ID: 14921 relates to Category No.: 14196, 1630, 3688; Payload ID: 14922 relates to Category No.: 9282, 9226, 11704, 15847; Payload ID: 14923 relates to Category No.: 3303; Payload ID: 14926 relates to Category No.: 11978, 926, 15612, 12145, 11861, 12081; Payload ID: 14927 relates to Category No.: 1201; Payload ID: 14928 relates to Category No.: 11861; Payload ID: 14930 relates to Category No.: 11861, 5347, 6351, 1027; Payload ID: 14931 relates to Category No.: 11861, 5347, 1027; Payload ID: 14932 relates to Category No.: 11861; Payload ID: 14933 relates to Category No.: 12399, 11861; Payload ID: 14934 relates to Category No.: 9518; Payload ID: 14937 relates to Category No.: 15027; Payload ID: 14938 relates to Category No.: 5308, 5311; Payload ID: 14939 relates to Category No.: 9226; Payload ID: 14940 relates to Category No.: 11861; Payload ID: 14941 relates to Category No.: 4886, 4895; Payload ID: 14942 relates to Category No.: 15542, 15553, 14306; Payload ID: 14945 relates to Category No.: 15376, 3663; Payload ID: 14950 relates to Category No.: 9226; Payload ID: 14951 relates to Category No.: 15629; Payload ID: 14952 relates to Category No.: 6924; Payload ID: 14953 relates to Category No.: 9226; Payload ID: 14954 relates to Category No.: 15376, 3663; Payload ID: 14955 relates to Category No.: 1528; Payload ID: 14956 relates to Category No.: 1630, 15542, 15555, 14676; Payload ID: 14957 relates to Category No.: 16331, 11861; Payload ID: 14958 relates to Category No.: 9226; Payload ID: 14959 relates to Category No.: 9226, 15027; Payload ID: 14960 relates to Category No.: 14705; Payload ID: 14962 relates to Category No.: 9226, 15027; Payload ID: 14963 relates to Category No.: 9518, 516; Payload ID: 14965 relates to Category No.: 630, 3491, 5308, 311; Payload ID: 14970 relates to Category No.: 16331, 1630, 11861, 15934; Payload ID: 14972 relates to Category No.: 14503; Payload ID: 14975 relates to Category No.: 7445; Payload ID: 14976 relates to Category No.: 9282, 9226; Payload ID: 14978 relates to Category No.: 6716; Payload ID: 14984 relates to Category No.: 11978, 926, 15612, 12145; Payload ID: 14985 relates to Category No.: 7503; Payload ID: 14986 relates to Category No.: 9988, 512, 926, 15617, 1401, 1457, 5840, 11861, 9961, 1454, 3970, 15275, 6186, 1647, 5347, 2326, 1650; Payload ID: 14987 relates to Category No.: 1405, 9921; Payload ID: 14988 relates to Category No.: 16331; Payload ID: 14989 relates to Category No.: 5308; Payload ID: 14996 relates to Category No.: 12399; Payload ID: 14997 relates to Category No.: 9226; Payload ID: 14998 relates to Category No.: 4820, 9343; Payload ID: 14999 relates to Category No.: 11861; Payload ID: 15000 relates to Category No.: 4820, 9343; Payload ID: 15001 relates to Category No.: 11861; Payload ID: 15002 relates to Category No.: 894; Payload ID: 15003 relates to Category No.: 14395; Payload ID: 15004 relates to Category No.: 6357; Payload ID: 15006 relates to Category No.: 926, 3303; Payload ID: 15007 relates to Category No.: 4886; Payload ID: 15009 relates to Category No.: 14107, 11861; Payload ID: 15011 relates to Category No.: 6392; Payload ID: 15018 relates to Category No.: 267, 15617, 11861, 5621; Payload ID: 15020 relates to Category No.: 926; Payload ID: 15025 relates to Category No.: 5956, 11917; Payload ID: 15028 relates to Category No.: 16331; Payload ID: 15029 relates to Category No.: 16331, 11861; Payload ID: 15030 relates to Category No.: 1430; Payload ID: 15034 relates to Category No.: 5865, 4976, 7223, 9518, 315, 16283; Payload ID: 15037 relates to Category No.: 11861; Payload ID: 15038 relates to Category No.: 15629; Payload ID: 15039 relates to Category No.: 7502, 7503; Payload ID: 15040 relates to Category No.: 4886, 1630; Payload ID: 15041 relates to Category No.: 16331, 11861; Payload ID: 15045 relates to Category No.: 3640, 11753; Payload ID: 15049 relates to Category No.: 9282, 9226, 6816, 14196; Payload ID: 15050 relates to Category No.: 1405, 11861; Payload ID: 15053 relates to Category No.: 15895, 15893; Payload ID: 15055 relates to Category No.: 12382, 1201; Payload ID: 15056 relates to Category No.: 6816, 15908, 11861; Payload ID: 15057 relates to Category No.: 11861; Payload ID: 15058 relates to Category No.: 1405; Payload ID: 15060 relates to Category No.: 11978, 926, 12109; Payload ID: 15063 relates to Category No.: 3303; Payload ID: 15065 relates to Category No.: 11978, 926; Payload ID: 15066 relates to Category No.: 6547; Payload ID: 15067 relates to Category No.: 6816, 16331, 11861; Payload ID: 15069 relates to Category No.: 6816; Payload ID: 15071 relates to Category No.: 14196, 3688, 14144; Payload ID: 15073 relates to Category No.: 11917; Payload ID: 15074 relates to Category No.: 1405; Payload ID: 15077 relates to Category No.: 961, 926, 9226; Payload ID: 15081 relates to Category No.: 15629, 11861; Payload ID: 15083 relates to Category No.: 9988, 512; Payload ID: 15087 relates to Category No.: 4886, 15021, 4895, 4820; Payload ID: 15089 relates to Category No.: 11861; Payload ID: 15090 relates to Category No.: 5308, 15086, 20; Payload ID: 15092 relates to Category No.: 11924, 1367; Payload ID: 15093 relates to Category No.: 14705, 15180; Payload ID: 15095 relates to Category No.: 5308; Payload ID: 15098 relates to Category No.: 4546; Payload ID: 15099 relates to Category No.: 4886; Payload ID: 15106 relates to Category No.: 5956, 9988, 512; Payload ID: 15107 relates to Category No.: 295; Payload ID: 15108 relates to Category No.: 11861; Payload ID: 15109 relates to Category No.: 134; Payload ID: 15111 relates to Category No.: 6974, 11861; Payload ID: 15114 relates to Category No.: 11861; Payload ID: 15118 relates to Category No.: 6816, 15503, 14471, 14471; Payload ID: 15120 relates to Category No.: 11978, 926, 11861, 11939, 4291, 11895, 4898; Payload ID: 15121 relates to Category No.: 11861, 735, 5386; Payload ID: 15123 relates to Category No.: 3303, 14471; Payload ID: 15124 relates to Category No.: 15027, 10116; Payload ID: 15125 relates to Category No.: 9282, 9226; Payload ID: 15129 relates to Category No.: 6229; Payload ID: 15134 relates to Category No.: 9518; Payload ID: 15136 relates to Category No.: 4820, 9343; Payload ID: 15137 relates to Category No.: 6816, 11861; Payload ID: 15138 relates to Category No.: 1630; Payload ID: 15139 relates to Category No.: 15027; Payload ID: 15142 relates to Category No.: 15029; Payload ID: 15144 relates to Category No.: 3303, 11933; Payload ID: 15145 relates to Category No.: 9226, 14284; Payload ID: 15146 relates to Category No.: 9226, 6816; Payload ID: 15149 relates to Category No.: 15029; Payload ID: 15152 relates to Category No.: 6924; Payload ID: 15156 relates to Category No.: 12329; Payload ID: 15157 relates to Category No.: 11861; Payload ID: 15159 relates to Category No.: 9226, 6816; Payload ID: 15161 relates to Category No.: 14176; Payload ID: 15162 relates to Category No.: 9282, 9226, 11861; Payload ID: 15163 relates to Category No.: 9226; Payload ID: 15164 relates to Category No.: 4385; Payload ID: 15165 relates to Category No.: 16331, 9518; Payload ID: 15167 relates to Category No.: 15086; Payload ID: 15170 relates to Category No.: 15491; Payload ID:

15172 relates to Category No.: 15629, 644, 4631, 16270, 1521; Payload ID: 15174 relates to Category No.: 1405; Payload ID: 15176 relates to Category No.: 6816, 11886; Payload ID: 15177 relates to Category No.: 11861, 15384; Payload ID: 15178 relates to Category No.: 15027, 10116; Payload ID: 15179 relates to Category No.: 15027; Payload ID: 15180 relates to Category No.: 5308; Payload ID: 15181 relates to Category No.: 3749, 11981, 11861, 1201, 14176; Payload ID: 15182 relates to Category No.: 14218; Payload ID: 15183 relates to Category No.: 12402, 4821, 11861, 5009; Payload ID: 15184 relates to Category No.: 12402, 4821, 11861, 5009; Payload ID: 15185 relates to Category No.: 12402, 4821, 4291, 5009; Payload ID: 15186 relates to Category No.: 5009, 4821; Payload ID: 15187 relates to Category No.: 926, 3303, 9226, 6816, 954, 138, 953, 5308, 305, 5405; Payload ID: 15188 relates to Category No.: 3303, 14597, 10116, 11861; Payload ID: 15189 relates to Category No.: 16331, 6816, 6210, 11861, 12142; Payload ID: 15190 relates to Category No.: 6816; Payload ID: 15191 relates to Category No.: 11861, 6816; Payload ID: 15192 relates to Category No.: 6816, 11861; Payload ID: 15193 relates to Category No.: 267, 11861, 14538; Payload ID: 15194 relates to Category No.: 12359, 11861; Payload ID: 15195 relates to Category No.: 11861; Payload ID: 15197 relates to Category No.: 11861, 4898, 9638, 4917; Payload ID: 15199 relates to Category No.: 1405, 926, 3303, 15503, 14471, 11939, 11933, 15504, 13683, 14243, 11861, 2688, 15528, 14255, 13735; Payload ID: 15200 relates to Category No.: 3303, 6816, 15503, 14471, 15495, 11861, 5347, 11939; Payload ID: 15201 relates to Category No.: 14251, 14471, 926, 3303, 15503, 14471, 11861, 15528, 14233, 11920, 2405, 14234, 15524, 13735, 14237, 1178, 15504, 5109; Payload ID: 15202 relates to Category No.: 926, 3303, 15503, 14471, 14251, 14471, 14243, 11861; Payload ID: 15203 relates to Category No.: 926, 3325, 949, 11861; Payload ID: 15204 relates to Category No.: 926, 942, 2963, 15973, 953, 11861, 5347, 3325, 949, 14240, 2406, 14237; Payload ID: 15205 relates to Category No.: 11861; Payload ID: 15206 relates to Category No.: 11861; Payload ID: 15207 relates to Category No.: 11861, 7192; Payload ID: 15208 relates to Category No.: 11861; Payload ID: 15209 relates to Category No.: 11861; Payload ID: 15210 relates to Category No.: 16244, 1401, 1457, 5840, 14332, 11861, 1454, 3752, 11828; Payload ID: 15211 relates to Category No.: 1405, 1401, 1457, 5840, 14332, 11861, 5347, 5841, 3752, 11975, 11974, 5775, 1454, 1450, 15120, 11981, 12107, 9430; Payload ID: 15212 relates to Category No.: 1405, 1401, 5840, 14332, 11861, 1201, 1450, 1457, 1454; Payload ID: 15213 relates to Category No.: 9226, 14196; Payload ID: 15214 relates to Category No.: 1405, 11939, 11861, 5347, 943, 14335, 1439; Payload ID: 15215 relates to Category No.: 1405, 11939, 11861, 5841; Payload ID: 15216 relates to Category No.: 1405, 11939, 11861, 1439, 14335; Payload ID: 15217 relates to Category No.: 1405, 16331, 2672, 11861, 12377; Payload ID: 15218 relates to Category No.: 1405, 16331, 11939, 6210, 2672, 11861, 4183, 12377; Payload ID: 15219 relates to Category No.: 1405, 11861, 2300; Payload ID: 15220 relates to Category No.: 1405, 11939, 10116, 11861; Payload ID: 15221 relates to Category No.: 1405, 11861, 5347; Payload ID: 15222 relates to Category No.: 1405, 16331; Payload ID: 15223 relates to Category No.: 1405, 10116, 11861, 12377, 5347, 267, 1439; Payload ID: 15224 relates to Category No.: 1405, 16331, 11939, 2672; Payload ID: 15225 relates to Category No.: 1405, 11939, 11861, 1439, 15741, 14335, 16331, 5847; Payload ID: 15226 relates to Category No.: 1405, 16331, 11861, 12377; Payload ID: 15227 relates to Category No.: 1405, 12107; Payload ID: 15228 relates to Category No.: 1405; Payload ID: 15229 relates to Category No.: 1405, 16331, 6965, 11861, 12377, 15449, 813; Payload ID: 15230 relates to Category No.: 1405, 16331, 14564, 6965, 753, 11861, 12377, 15449, 813; Payload ID: 15231 relates to Category No.: 1405, 16331, 11939, 11861, 5347, 1439, 15230, 14335, 12377, 12402; Payload ID: 15232 relates to Category No.: 1405, 16220; Payload ID: 15233 relates to Category No.: 1405, 6478, 11861, 1439, 12377; Payload ID: 15234 relates to Category No.: 1405; Payload ID: 15235 relates to Category No.: 1439; Payload ID: 15237 relates to Category No.: 9975, 9804, 11861, 9889, 9881, 9859; Payload ID: 15238 relates to Category No.: 11861; Payload ID: 15239 relates to Category No.: 9518; Payload ID: 15240 relates to Category No.: 2271, 11835, 5280, 11861; Payload ID: 15241 relates to Category No.: 11861, 11854, 6022; Payload ID: 15242 relates to Category No.: 6965, 11861, 5347, 11854, 6022; Payload ID: 15243 relates to Category No.: 11854, 11861; Payload ID: 15244 relates to Category No.: 7192, 11854; Payload ID: 15245 relates to Category No.: 9282, 9226, 10116; Payload ID: 15246 relates to Category No.: 6900, 11861; Payload ID: 15248 relates to Category No.: 11978, 926, 6478, 12109, 11981, 11861, 1472, 37; Payload ID: 15249 relates to Category No.: 11978, 926, 6478, 12109, 11861; Payload ID: 15250 relates to Category No.: 11861, 11890; Payload ID: 15251 relates to Category No.: 11895, 11890, 11981, 11861, 7127; Payload ID: 15252 relates to Category No.: 11861; Payload ID: 15253 relates to Category No.: 16331, 9226, 14196, 11861, 3212, 3209; Payload ID: 15254 relates to Category No.: 10116, 11861, 9990; Payload ID: 15255 relates to Category No.: 15503, 14471, 14471, 14251, 14471; Payload ID: 15256 relates to Category No.: 11861; Payload ID: 15257 relates to Category No.: 12082, 9961, 9387; Payload ID: 15258 relates to Category No.: 3303, 10116, 11861; Payload ID: 15259 relates to Category No.: 11861; Payload ID: 15260 relates to Category No.: 3303, 6816, 11861; Payload ID: 15261 relates to Category No.: 4886; Payload ID: 15262 relates to Category No.: 1405, 11861; Payload ID: 15264 relates to Category No.: 11861; Payload ID: 15265 relates to Category No.: 11861; Payload ID: 15266 relates to Category No.: 11861; Payload ID: 15267 relates to Category No.: 11861; Payload ID: 15268 relates to Category No.: 15973, 11861; Payload ID: 15269 relates to Category No.: 3755, 11861, 3753, 943; Payload ID: 15271 relates to Category No.: 9518, 14372, 4207, 4230; Payload ID: 15273 relates to Category No.: 11861; Payload ID: 15274 relates to Category No.: 3303, 3459, 14243, 15530, 14255, 11861, 15503, 14471, 2405; Payload ID: 15275 relates to Category No.: 3303, 14471, 11861, 2405; Payload ID: 15277 relates to Category No.: 9282, 9226, 3459, 10116, 11861, 2688, 2405, 11981, 14471; Payload ID: 15278 relates to Category No.: 3303, 9282, 9226, 10116, 11861, 5347; Payload ID: 15279 relates to Category No.: 11861; Payload ID: 15280 relates to Category No.: 15503, 14471, 14251, 14471, 15491, 11861, 5347; Payload ID: 15281 relates to Category No.: 14379, 11861; Payload ID: 15282 relates to Category No.: 14379, 4156, 11861; Payload ID: 15283 relates to Category No.: 15629, 56, 11861, 782, 787, 6242, 6245, 16206, 9896, 6334, 5063, 5061, 11939; Payload ID: 15284 relates to Category No.: 11861, 3752, 16206, 12399; Payload ID: 15285 relates to Category No.: 15617, 14379, 11861, 6334; Payload ID: 15286 relates to Category No.: 11861, 14379; Payload ID: 15287 relates to Category No.: 14379; Payload ID: 15288 relates to Category No.: 14379, 6024, 11861, 4196, 4016; Payload ID: 15289 relates to Category No.: 926, 15699; Payload ID: 15290 relates to Category No.: 926; Payload ID:

15291 relates to Category No.: 926; Payload ID: 15292 relates to Category No.: 926; Payload ID: 15293 relates to Category No.: 926; Payload ID: 15294 relates to Category No.: 926; Payload ID: 15295 relates to Category No.: 926; Payload ID: 15296 relates to Category No.: 11861, 5347; Payload ID: 15297 relates to Category No.: 16331, 11861; Payload ID: 15298 relates to Category No.: 1405, 267, 277, 56, 9887, 9896; Payload ID: 15299 relates to Category No.: 11861; Payload ID: 15300 relates to Category No.: 3303, 1178, 11933, 14471, 11917, 3530, 14240, 11861, 15528, 14239; Payload ID: 15301 relates to Category No.: 15504, 5009, 11861; Payload ID: 15302 relates to Category No.: 11861; Payload ID: 15303 relates to Category No.: 5105, 15495, 11861; Payload ID: 15304 relates to Category No.: 5105, 11861; Payload ID: 15305 relates to Category No.: 2672; Payload ID: 15306 relates to Category No.: 2672; Payload ID: 15307 relates to Category No.: 9620, 11861; Payload ID: 15308 relates to Category No.: 14987, 14978; Payload ID: 15309 relates to Category No.: 3303, 6816, 15503, 14471, 11861; Payload ID: 15310 relates to Category No.: 3303, 6816, 15530, 14233; Payload ID: 15311 relates to Category No.: 11861; Payload ID: 15312 relates to Category No.: 11978, 926, 3303, 12145, 1201, 11861; Payload ID: 15313 relates to Category No.: 11978, 926, 1201, 12402, 11861; Payload ID: 15314 relates to Category No.: 11978, 926, 11861, 1201; Payload ID: 15315 relates to Category No.: 7192, 1201; Payload ID: 15317 relates to Category No.: 5109, 11861, 5108, 3752; Payload ID: 15318 relates to Category No.: 3303, 7192; Payload ID: 15319 relates to Category No.: 15180, 11861, 12064; Payload ID: 15320 relates to Category No.: 7192; Payload ID: 15321 relates to Category No.: 9619, 14506; Payload ID: 15322 relates to Category No.: 9619, 14506; Payload ID: 15323 relates to Category No.: 11861; Payload ID: 15324 relates to Category No.: 11861, 9890, 9882, 9880, 9887, 9877, 9888, 9818; Payload ID: 15326 relates to Category No.: 15629, 9939, 16228, 3749, 15542, 15550; Payload ID: 15327 relates to Category No.: 15629, 6210; Payload ID: 15328 relates to Category No.: 15629, 6210, 11861; Payload ID: 15329 relates to Category No.: 15629; Payload ID: 15330 relates to Category No.: 15629; Payload ID: 15331 relates to Category No.: 11861; Payload ID: 15332 relates to Category No.: 11861; Payload ID: 15333 relates to Category No.: 14706, 14705, 15629, 11861; Payload ID: 15334 relates to Category No.: 11861, 15180; Payload ID: 15335 relates to Category No.: 14706, 14705, 11861; Payload ID: 15336 relates to Category No.: 16331, 11861; Payload ID: 15337 relates to Category No.: 16331, 11861; Payload ID: 15338 relates to Category No.: 6816, 10116, 11861; Payload ID: 15339 relates to Category No.: 16331, 11861, 7192; Payload ID: 15340 relates to Category No.: 16331, 15629, 11861; Payload ID: 15341 relates to Category No.: 16331, 11861, 7192; Payload ID: 15342 relates to Category No.: 16331, 11861, 7192; Payload ID: 15343 relates to Category No.: 11861, 1439; Payload ID: 15344 relates to Category No.: 11861; Payload ID: 15345 relates to Category No.: 14176, 11861; Payload ID: 15346 relates to Category No.: 7192, 14176; Payload ID: 15347 relates to Category No.: 10116, 11861, 3772, 14176; Payload ID: 15348 relates to Category No.: 12142, 11861, 11682; Payload ID: 15349 relates to Category No.: 12142, 12399; Payload ID: 15350 relates to Category No.: 12142, 12399, 10116, 11861; Payload ID: 15351 relates to Category No.: 3275, 11861, 7192; Payload ID: 15352 relates to Category No.: 3275, 7192; Payload ID: 15353 relates to Category No.: 3275; Payload ID: 15354 relates to Category No.: 10116, 11861, 7265, 14147, 14424; Payload ID: 15355 relates to Category No.: 10116, 11861; Payload ID: 15356 relates to Category No.: 1405; Payload ID: 15357 relates to Category No.: 14564, 2874, 11861; Payload ID: 15358 relates to Category No.: 2854, 5009, 4291, 11861, 5347, 16293, 3471; Payload ID: 15359 relates to Category No.: 5588, 11861, 4196, 16293, 12400, 3662, 6827; Payload ID: 15360 relates to Category No.: 11861, 16293; Payload ID: 15361 relates to Category No.: 11861, 16293; Payload ID: 15362 relates to Category No.: 2874; Payload ID: 15363 relates to Category No.: 2874, 11861, 4016; Payload ID: 15364 relates to Category No.: 3665; Payload ID: 15365 relates to Category No.: 1405, 11861, 2566, 4016; Payload ID: 15366 relates to Category No.: 5259; Payload ID: 15367 relates to Category No.: 4820, 15617, 14402; Payload ID: 15368 relates to Category No.: 4886; Payload ID: 15369 relates to Category No.: 6816, 4886, 4895; Payload ID: 15370 relates to Category No.: 11861, 12383; Payload ID: 15371 relates to Category No.: 11861, 9922, 10131; Payload ID: 15374 relates to Category No.: 11933; Payload ID: 15377 relates to Category No.: 11933; Payload ID: 15378 relates to Category No.: 11861, 7192; Payload ID: 15380 relates to Category No.: 2874; Payload ID: 15381 relates to Category No.: 11861; Payload ID: 15382 relates to Category No.: 2874, 2282, 11861; Payload ID: 15383 relates to Category No.: 10116; Payload ID: 15384 relates to Category No.: 4886, 15973, 11861, 3753; Payload ID: 15385 relates to Category No.: 11861; Payload ID: 15386 relates to Category No.: 11861; Payload ID: 15387 relates to Category No.: 15895; Payload ID: 15389 relates to Category No.: 11861; Payload ID: 15390 relates to Category No.: 14504, 9620, 11861, 3665, 3752; Payload ID: 15391 relates to Category No.: 926, 9988, 512, 14415; Payload ID: 15392 relates to Category No.: 11861; Payload ID: 15396 relates to Category No.: 11861, 7192; Payload ID: 15397 relates to Category No.: 11861; Payload ID: 15400 relates to Category No.: 11861, 15617, 9356, 14548, 9925; Payload ID: 15401 relates to Category No.: 1504, 5009, 11861, 11828, 4726, 1706; Payload ID: 15402 relates to Category No.: 11861, 5009, 4314, 9356, 6242, 14548, 4726, 4710, 1439, 1504; Payload ID: 15403 relates to Category No.: 12402, 11861, 16206; Payload ID: 15404 relates to Category No.: 14420, 11861; Payload ID: 15405 relates to Category No.: 1630, 15542, 14425; Payload ID: 15406 relates to Category No.: 926, 4886, 11939, 11933, 11861, 5347, 14419, 16271; Payload ID: 15407 relates to Category No.: 926, 14419, 16271; Payload ID: 15410 relates to Category No.: 1405, 11861, 7192; Payload ID: 15412 relates to Category No.: 14420; Payload ID: 15413 relates to Category No.: 14420; Payload ID: 15415 relates to Category No.: 753; Payload ID: 15416 relates to Category No.: 11861, 14430, 8965, 2305; Payload ID: 15417 relates to Category No.: 11861, 14430, 8965, 2305; Payload ID: 15418 relates to Category No.: 11861, 14430, 8965, 2305; Payload ID: 15419 relates to Category No.: 11861, 14430, 8965, 2305; Payload ID: 15420 relates to Category No.: 11861, 14430, 8965, 2305; Payload ID: 15421 relates to Category No.: 11861, 14430, 8965, 2305; Payload ID: 15422 relates to Category No.: 11861, 14430, 8965, 2305; Payload ID: 15423 relates to Category No.: 11861, 14430, 2305; Payload ID: 15424 relates to Category No.: 11861; Payload ID: 15425 relates to Category No.: 11861, 14430, 2305; Payload ID: 15426 relates to Category No.: 15617, 12402, 12399, 11861, 14430, 2305; Payload ID: 15427 relates to Category No.: 11861, 14430, 2305; Payload ID: 15428 relates to Category No.: 11861, 14430, 2305; Payload ID: 15429 relates to Category No.: 5003, 11861, 15179, 14430, 2305, 2386, 1027; Payload ID: 15430 relates to Category No.: 11861, 14430, 2305; Payload ID: 15431 relates to Category No.: 11861, 14430, 2305, 15617; Payload ID: 15432 relates to Category No.: 11861, 14430, 2305; Payload ID: 15433 relates to Category No.: 11861, 14430, 2305; Payload ID: 15434 relates to Category No.: 11861, 14430, 2305; Payload ID: 15435 relates to Category No.: 5588, 11861, 8965; Payload ID: 15436 relates to Category No.: 6816, 15029, 11861; Payload ID: 15437 relates to Category No.: 6816, 15029, 11861, 11828; Payload ID: 15438 relates to Category No.: 926, 3303, 11861, 5347, 3325, 15526; Payload ID: 15439 relates to Category No.: 2861; Payload ID: 15441 relates to Category No.: 15542, 11861, 15699, 15542, 15557; Payload ID: 15442 relates to Category No.: 9518, 7510, 520, 14465; Payload ID: 15443 relates to Category No.: 4886; Payload ID: 15444 relates to Category No.: 4886, 11861; Payload ID: 15445 relates to Category No.: 4886, 11861; Payload ID: 15446 relates to Category No.: 926, 3303, 9282, 4886, 11939, 9857, 11861, 4422; Payload ID: 15447 relates to Category No.: 4886, 11861; Payload ID: 15448 relates to Category No.: 4886, 11861, 11890, 3755; Payload ID: 15449 relates to Category No.: 4886, 11861, 7192; Payload ID: 15450 relates to Category No.: 4886, 4895, 15029, 11861; Payload ID: 15451 relates to Category No.: 4886, 4895, 15029, 11861, 15180; Payload ID: 15452 relates to Category No.: 4886, 11861; Payload ID: 15453 relates to Category No.: 4886, 15029, 11861, 5347; Payload ID: 15454 relates to Category No.: 4886, 11861; Payload ID: 15455 relates to Category No.: 4886, 4895, 11861; Payload ID: 15456 relates to Category No.: 16331, 15895, 12109, 11981, 11861, 15887, 5347, 14536, 12425, 11983, 5923, 11939; Payload ID: 15457 relates to Category No.: 11861, 2566; Payload ID: 15458 relates to Category No.: 5308, 311, 1201; Payload ID: 15459 relates to Category No.: 14502; Payload ID: 15460 relates to Category No.: 11939, 12292, 6361, 6353; Payload ID: 15461 relates to Category No.: 12292, 7192, 6361, 6353; Payload ID: 15462 relates to Category No.: 5308, 7192; Payload ID: 15463 relates to Category No.: 15542, 11939, 12292, 11861, 4668, 14486, 620, 5347, 6012, 9363; Payload ID: 15464 relates to Category No.: 15542, 2405, 12292, 11861, 4668, 620, 5347, 6012; Payload ID: 15465 relates to Category No.: 6357, 11861; Payload ID: 15466 relates to Category No.: 6357; Payload ID: 15467 relates to Category No.: 6357; Payload ID: 15468 relates to Category No.: 6357; Payload ID: 15469 relates to Category No.: 6357; Payload ID: 15470 relates to Category No.: 12292, 11861, 14487; Payload ID: 15471 relates to Category No.: 15542, 12292, 14487; Payload ID: 15472 relates to Category No.: 15489, 15542, 12292, 14487, 1630; Payload ID: 15473 relates to Category No.: 11861, 14487; Payload ID: 15474 relates to Category No.: 11861, 14487; Payload ID: 15475 relates to Category No.: 11861, 3665, 9620, 14504; Payload ID: 15476 relates to Category No.: 14504, 11861; Payload ID: 15477 relates to Category No.: 14504, 11861; Payload ID: 15478 relates to Category No.: 14504, 11861, 3665; Payload ID: 15479 relates to Category No.: 11861, 14504; Payload ID: 15480 relates to Category No.: 14504, 11861, 9620; Payload ID: 15481 relates to Category No.: 11861; Payload ID: 15482 relates to Category No.: 14504, 11861; Payload ID: 15483 relates to Category No.: 14504, 11861; Payload ID: 15484 relates to Category No.: 11861, 14504; Payload ID: 15485 relates to Category No.: 14504, 11861; Payload ID: 15486 relates to Category No.: 14504; Payload ID: 15487 relates to Category No.: 14504, 3665; Payload ID: 15488 relates to Category No.: 14504; Payload ID: 15489 relates to Category No.: 12292, 3478, 1405, 926, 6478, 11939, 4660, 9608, 6353, 15372, 14496, 11861; Payload ID: 15490 relates to Category No.: 11978, 926, 12109, 11861, 12418, 11981; Payload ID: 15491 relates to Category No.: 3303, 10116, 11861; Payload ID: 15492 relates to Category No.: 10116, 11861, 12064, 1356; Payload ID: 15494 relates to Category No.: 7268; Payload ID: 15496 relates to Category No.: 9282, 9226, 14196, 10116, 7268, 11861, 14322; Payload ID: 15497 relates to Category No.: 9282, 9226, 14196, 15973, 10116, 11861, 14322; Payload ID: 15498 relates to Category No.: 9282, 9226, 10116, 11861; Payload ID: 15499 relates to Category No.: 9282, 9226, 14196, 15973, 10116, 14322; Payload ID: 15500 relates to Category No.: 9282, 9226, 15495, 10116, 11861, 11700; Payload ID: 15501 relates to Category No.: 9282, 9226, 14196, 10116, 11861, 14473; Payload ID: 15502 relates to Category No.: 9282, 9226, 10116, 14473; Payload ID: 15503 relates to Category No.: 9282, 9226, 10116, 11861, 14322; Payload ID: 15504 relates to Category No.: 9282, 9226, 14196, 10116, 11861, 11700; Payload ID: 15505 relates to Category No.: 16331, 9282, 9226, 10116, 11861; Payload ID: 15506 relates to Category No.: 9282, 9226, 10116, 11861; Payload ID: 15507 relates to Category No.: 9282, 9226, 10116, 11861; Payload ID: 15508 relates to Category No.: 11978, 926, 11939, 12109, 11861, 5347, 10114; Payload ID: 15509 relates to Category No.: 11978, 926, 6478, 9539, 12109, 11861, 11977, 6351; Payload ID: 15510 relates to Category No.: 11861, 11981; Payload ID: 15511 relates to Category No.: 11978, 926, 9096, 11861, 12109, 15528, 14233; Payload ID: 15512 relates to Category No.: 11978, 926, 12109; Payload ID: 15513 relates to Category No.: 11978, 926, 12109, 11861; Payload ID: 15514 relates to Category No.: 926, 12109; Payload ID: 15515 relates to Category No.: 11978, 926, 6816, 12109, 11861; Payload ID: 15516 relates to Category No.: 11978, 926, 6816, 11939, 12109, 11861; Payload ID: 15517 relates to Category No.: 11978, 926, 6478, 11917, 12109, 6602, 11861, 12108; Payload ID: 15518 relates to Category No.: 11978, 926, 12109, 11861; Payload ID: 15519 relates to Category No.: 11978, 926, 6816, 12109; Payload ID: 15520 relates to Category No.: 11978, 926, 6816, 12109; Payload ID: 15521 relates to Category No.: 11978, 926, 6816, 12109; Payload ID: 15522 relates to Category No.: 11978, 926, 12109, 11861; Payload ID: 15523 relates to Category No.: 11978, 926, 12109; Payload ID: 15524 relates to Category No.: 11978, 926, 6478, 15504, 12109, 11861, 1201; Payload ID: 15525 relates to Category No.: 11978, 926, 6478, 12109, 11861, 7127; Payload ID: 15526 relates to Category No.: 11978, 926, 6478, 267, 12109, 11861; Payload ID: 15527 relates to Category No.: 11978, 926, 6478, 11939, 15504, 11917, 12109, 6602, 11861, 5347, 12108; Payload ID: 15528 relates to Category No.: 11978, 926, 12109, 11861; Payload ID: 15529 relates to Category No.: 10116, 11861, 12402; Payload ID: 15530 relates to Category No.: 11978, 926, 12109, 1201; Payload ID: 15531 relates to Category No.: 11978, 926, 6478, 11939, 12109, 11861, 5347; Payload ID: 15532 relates to Category No.: 12151, 9804, 11861; Payload ID: 15533 relates to Category No.: 12151; Payload ID: 15534 relates to Category No.: 11978, 926, 9096, 11861; Payload ID: 15537 relates to Category No.: 11861; Payload ID: 15538 relates to Category No.: 11861; Payload ID: 15539 relates to Category No.: 14504, 11861, 5347, 11828, 4710; Payload ID: 15540 relates to Category No.: 14504, 5009; Payload ID: 15541 relates to Category No.: 14504; Payload ID: 15542 relates to Category No.: 14504, 11861; Payload ID: 15544 relates to Category No.: 3303, 14504, 11861; Payload ID: 15546 relates to Category No.: 14504; Payload ID: 15547 relates to Category No.: 14504, 5009, 11861, 9824, 11828, 14077, 4720, 259; Payload ID: 15548 relates to Category No.: 14504, 14961; Payload ID: 15549 relates to Category No.: 14504; Payload ID: 15550 relates to Category No.: 14504; Payload ID: 15551 relates to Category No.: 14504; Payload ID: 15552 relates to Category No.: 14504; Payload ID: 15553 relates to Category No.: 14504; Payload ID: 15554 relates to Category No.: 14504, 3752; Payload ID: 15555 relates to Category No.: 2858, 14504, 11828; Payload ID: 15556 relates to Category No.: 14504; Payload ID: 15557 relates to Category No.: 2858, 14504, 11828, 16206; Payload ID: 15558 relates to Category No.: 14504, 3752, 11828; Payload ID: 15559 relates to Category No.: 14504, 11861; Payload ID: 15560 relates to Category No.: 14504, 11828; Payload ID: 15561 relates to Category No.: 14504; Payload ID: 15562 relates to Category No.: 14504, 11861; Payload ID: 15563 relates to Category No.: 14504, 2859, 11861, 11828; Payload ID: 15564 relates to Category No.: 14504, 11861, 11828, 5009; Payload ID: 15565 relates to Category No.: 14504, 5009, 3665; Payload ID: 15566 relates to Category No.: 14504, 12402, 11861, 11828; Payload ID: 15567 relates to Category No.: 14504, 12402, 5009, 11861, 4720; Payload ID: 15568 relates to Category No.: 14504; Payload ID: 15569 relates to Category No.: 14504, 11861; Payload ID: 15570 relates to Category No.: 11939, 14504, 11861, 3665, 11828; Payload ID: 15571 relates to Category No.: 14504, 11861; Payload ID: 15572 relates to Category No.: 14504, 10116, 2566, 11861, 15973; Payload ID: 15573 relates to Category No.: 14504; Payload ID: 15574 relates to Category No.: 14504, 11861; Payload ID: 15575 relates to Category No.: 10116, 11861, 7265; Payload ID: 15576 relates to Category No.: 3303, 10116, 11861; Payload ID: 15577 relates to Category No.: 11861; Payload ID: 15578 relates to Category No.: 11861, 15491; Payload ID: 15579 relates to Category No.: 11861; Payload ID: 15581 relates to Category No.: 5009, 4821, 2282; Payload ID: 15582 relates to Category No.: 2282; Payload ID: 15583 relates to Category No.: 2282; Payload ID: 15584 relates to Category No.: 1201; Payload ID: 15585 relates to Category No.: 9939, 11861, 11983, 9896; Payload ID: 15586 relates to Category No.: 3303, 15503, 14471, 14234, 11939, 15504, 11917, 11861, 15528, 14233, 15528, 14255, 14525, 11732, 15503, 14235, 2405, 2406, 15503, 14239, 15503, 14252, 14471, 5109; Payload ID: 15587 relates to Category No.: 10116, 11861; Payload ID: 15588 relates to Category No.: 11978, 926, 12109, 9857, 14733, 1404, 11861, 11665, 12114, 2326, 15230, 132, 2559; Payload ID: 15589 relates to Category No.: 11978, 926, 12109, 14733, 1404, 11665, 2326; Payload ID: 15590 relates to Category No.: 11978, 926, 12109, 9857, 14733, 1404, 11861, 11665, 2326; Payload ID: 15591 relates to Category No.: 926, 9282, 14196, 14500, 632; Payload ID: 15592 relates to Category No.: 926, 9282, 10116, 14500, 632; Payload ID: 15594 relates to Category No.: 11861; Payload ID: 15596 relates to Category No.: 3303, 6816, 5229, 11861, 15495; Payload ID: 15597 relates to Category No.: 6816, 9539, 11861, 14232, 12181, 5207; Payload ID: 15598 relates to Category No.: 6816, 5229, 11861, 14232, 14237, 14241; Payload ID: 15599 relates to Category No.: 6816, 6924, 11861; Payload ID: 15600 relates to Category No.: 12151, 9807, 12360; Payload ID: 15601 relates to Category No.: 11861, 12360, 11939, 9857, 9805, 9807; Payload ID: 15602 relates to Category No.: 3303, 11861; Payload ID: 15603 relates to Category No.: 3303, 16331, 11939, 3459, 14597, 3655, 5229, 5208, 11861, 14598, 15031, 3373, 5207; Payload ID: 15604 relates to Category No.: 5229, 9539, 11861, 12181, 2405; Payload ID: 15605 relates to Category No.: 9539, 15495, 5229, 11861, 12181; Payload ID: 15606 relates to Category No.: 9282, 9226, 14196, 1153, 5208, 11861; Payload ID: 15607 relates to Category No.: 9282, 9226, 14196, 5208, 11861, 5229; Payload ID: 15608 relates to Category No.: 5229, 11861, 5207; Payload ID: 15609 relates to Category No.: 15491, 5208, 11861, 5207, 14229; Payload ID: 15610 relates to Category No.: 11861, 12181; Payload ID: 15611 relates to Category No.: 11861; Payload ID: 15612 relates to Category No.: 11861, 9014, 12181; Payload ID: 15613 relates to Category No.: 6924, 11861; Payload ID: 15614 relates to Category No.: 3303, 16331, 5229, 11861; Payload ID: 15615 relates to Category No.: 3303, 16331, 5229, 11861, 5210; Payload ID: 15616 relates to Category No.: 3303, 5105, 11861, 12088, 12082; Payload ID: 15617 relates to Category No.: 2405; Payload ID: 15618 relates to Category No.: 3303, 15503, 14471, 11861; Payload ID: 15619 relates to Category No.: 3303, 15503, 14471, 11861; Payload ID: 15620 relates to Category No.: 3303, 15503, 14471, 11861; Payload ID: 15621 relates to Category No.: 3303, 11861; Payload ID: 15622 relates to Category No.: 3303, 15503, 14471, 15504, 1457, 15503, 14239, 14251, 14471, 11861, 11933, 3303, 1121; Payload ID: 15623 relates to Category No.: 681; Payload ID: 15624 relates to Category No.: 11861, 9805; Payload ID: 15626 relates to Category No.: 7192; Payload ID: 15628 relates to Category No.: 11861; Payload ID: 15629 relates to Category No.: 11861, 14538; Payload ID: 15630 relates to Category No.: 11861, 1327, 11861; Payload ID: 15631 relates to Category No.: 11861, 14537, 14538; Payload ID: 15632 relates to Category No.: 4924, 11861, 14538; Payload ID: 15633 relates to Category No.: 4924, 11861, 14538; Payload ID: 15634 relates to Category No.: 11861, 9805; Payload ID: 15636 relates to Category No.: 11861; Payload ID: 15637 relates to Category No.: 14538, 15613; Payload ID: 15639 relates to Category No.: 14564, 14580, 11861; Payload ID: 15640 relates to Category No.: 14564, 11861, 15613, 5347, 14580; Payload ID: 15641 relates to Category No.: 14564, 11861, 14580; Payload ID: 15642 relates to Category No.: 6816, 11861; Payload ID: 15643 relates to Category No.: 6816, 11861; Payload ID: 15644 relates to Category No.: 6816, 11861, 5347; Payload ID: 15645 relates to Category No.: 11895, 5850, 11861, 5347, 14537, 11886, 14377, 4467, 713, 14785, 12416; Payload ID: 15646 relates to Category No.: 11861, 5850, 14537, 4467; Payload ID: 15647 relates to Category No.: 11861, 14377, 11895, 5850; Payload ID: 15648 relates to Category No.: 9857, 11861; Payload ID: 15649 relates to Category No.: 9857, 11861, 9890, 9882, 14536, 9880, 9888; Payload ID: 15650 relates to Category No.: 9857, 11861, 9805; Payload ID: 15651 relates to Category No.: 11861; Payload ID: 15652 relates to Category No.: 11861; Payload ID: 15653 relates to Category No.: 14537, 14538; Payload ID: 15654 relates to Category No.: 14537, 14538; Payload ID: 15655 relates to Category No.: 14537; Payload ID: 15656 relates to Category No.: 4894, 3554, 11919, 14430; Payload ID: 15657 relates to Category No.: 11978, 926, 12109; Payload ID: 15658 relates to Category No.: 11978, 926, 12109, 6601; Payload ID: 15659 relates to Category No.: 11978, 926, 12109; Payload ID: 15660 relates to Category No.: 11861, 11782; Payload ID: 15661 relates to Category No.: 11861; Payload ID: 15662 relates to Category No.: 16331, 6816, 6188, 11861; Payload ID: 15663 relates to Category No.: 16331, 6816, 6188, 11861, 9805, 12082, 12076; Payload ID: 15664 relates to Category No.: 16331, 6816, 11861; Payload ID: 15665 relates to Category No.: 14537, 11991; Payload ID: 15666 relates to Category No.: 4894, 11861, 14537; Payload ID: 15667 relates to Category No.: 11861, 14538, 14537; Payload ID: 15668 relates to Category No.: 4429, 11861, 5347, 12388; Payload ID: 15669 relates to Category No.: 11861, 14537, 11991; Payload ID: 15670 relates to Category No.: 6965, 9939, 11861, 14537, 15766; Payload ID: 15671 relates to Category No.: 6210, 11861, 5347, 9805, 4896; Payload ID: 15672 relates to Category No.: 6210, 11861, 5347; Payload ID: 15673 relates to Category No.: 6210, 11861, 5347; Payload ID: 15674 relates to Category No.: 11939, 6210, 11861, 5347, 4103, 6430; Payload ID: 15675 relates to Category No.: 11861; Payload ID: 15676 relates to Category No.: 11861, 14537; Payload ID: 15677 relates to Category No.: 11861; Payload ID: 15678 relates to Category No.: 9226; Payload ID: 15679 relates to Category No.: 16331, 11861, 10163, 11886, 5347; Payload ID: 15680 relates to Category No.: 11981, 11861, 12425, 11920; Payload ID: 15681 relates to Category No.: 9939, 11981, 12145, 5551, 5538, 11861, 3774, 3765, 8989, 15613, 12425, 11886, 9961, 9990, 12077; Payload ID: 15682 relates to Category No.: 11981, 11861, 12425; Payload ID: 15683 relates to Category No.: 14564, 11981, 11861, 12425; Payload ID: 15684 relates to Category No.: 11861, 14536; Payload ID: 15685 relates to Category No.: 11861; Payload ID: 15687 relates to Category No.: 11861; Payload ID: 15689 relates to Category No.: 14564, 11861, 16296; Payload ID: 15694 relates to Category No.: 11861, 12076, 12081, 12083; Payload ID: 15695 relates to Category No.: 277, 11861, 5960; Payload ID: 15696 relates to Category No.: 9518, 14089; Payload ID: 15697 relates to Category No.: 9518, 1630, 2557; Payload ID: 15698 relates to Category No.: 9518, 321, 7477, 100; Payload ID: 15699 relates to Category No.: 9518, 321, 7477, 100; Payload ID: 15700 relates to Category No.: 9518, 14089; Payload ID: 15701 relates to Category No.: 11861; Payload ID: 15702 relates to Category No.: 3303, 15503, 14471, 14471, 11861; Payload ID: 15703 relates to Category No.: 3303, 14471; Payload ID: 15704 relates to Category No.: 11861; Payload ID: 15705 relates to Category No.: 277; Payload ID: 15706 relates to Category No.: 267, 6187, 277, 1153, 11861, 11920; Payload ID: 15707 relates to Category No.: 277, 11861, 267; Payload ID: 15708 relates to Category No.: 277, 11861; Payload ID: 15709 relates to Category No.: 11861, 5957; Payload ID: 15710 relates to Category No.: 11861; Payload ID: 15711 relates to Category No.: 14309, 6965, 14176, 10116, 11861; Payload ID: 15712 relates to Category No.: 16331, 15908, 11895, 15893, 6188, 11861, 5347; Payload ID: 15713 relates to Category No.: 16331, 15893, 6188, 15495, 11861, 15889, 15908; Payload ID: 15714 relates to Category No.: 6816, 15893, 11861; Payload ID: 15715 relates to Category No.: 14547; Payload ID: 15716 relates to Category No.: 11861, 1504; Payload ID: 15717 relates to Category No.: 1504, 11861; Payload ID: 15718 relates to Category No.: 1504, 11861; Payload ID: 15719 relates to Category No.: 11861, 1504; Payload ID: 15720 relates to Category No.: 1504, 11861; Payload ID: 15721 relates to Category No.: 11861; Payload ID: 15722 relates to Category No.: 1504, 11861; Payload ID: 15723 relates to Category No.: 1504, 11861; Payload ID: 15724 relates to Category No.: 11861, 1504, 12399; Payload ID: 15725 relates to Category No.: 1504, 11861, 15617, 1504; Payload ID: 15726 relates to Category No.: 1504, 11861; Payload ID: 15727 relates to Category No.: 3979, 3976, 3977, 3978, 11861; Payload ID: 15728 relates to Category No.: 11861, 3976, 3977, 3978, 3979; Payload ID: 15729 relates to Category No.: 3979, 3976, 3977, 3978, 594; Payload ID: 15730 relates to Category No.: 11861, 3979, 3976, 3977, 3978; Payload ID: 15731 relates to Category No.: 15617, 11861; Payload ID: 15732 relates to Category No.: 14274; Payload ID: 15733 relates to Category No.: 14274; Payload ID: 15734 relates to Category No.: 11861, 5347; Payload ID: 15735 relates to Category No.: 11861; Payload ID: 15736 relates to Category No.: 5847; Payload ID: 15737 relates to Category No.: 5847; Payload ID: 15738 relates to Category No.: 5847; Payload ID: 15739 relates to Category No.: 5847; Payload ID: 15740 relates to Category No.: 5847, 2482; Payload ID: 15741 relates to Category No.: 11861; Payload ID: 15742 relates to Category No.: 3471, 11861, 12399, 9384; Payload ID: 15743 relates to Category No.: 9619, 14176, 11861, 7192; Payload ID: 15744 relates to Category No.: 9619; Payload ID: 15745 relates to Category No.: 9619; Payload ID: 15746 relates to Category No.: 894, 11939, 11861, 893, 5801; Payload ID: 15747 relates to Category No.: 894, 11939, 11861, 893, 5801; Payload ID: 15748 relates to Category No.: 894; Payload ID: 15749 relates to Category No.: 894, 11939, 11861, 893, 5801; Payload ID: 15750 relates to Category No.: 1405, 11933, 11861, 5347; Payload ID: 15751 relates to Category No.: 1405, 11861; Payload ID: 15752 relates to Category No.: 1405, 11861; Payload ID: 15753 relates to Category No.: 14196, 184, 10116, 11861, 3680; Payload ID: 15754 relates to Category No.: 184, 10116; Payload ID: 15755 relates to Category No.: 4886, 4895, 184, 10116, 3471, 14147, 3680, 4422; Payload ID: 15756 relates to Category No.: 184, 10116, 3680, 14562, 14560; Payload ID: 15757 relates to Category No.: 184, 10116, 11861, 14560; Payload ID: 15758 relates to Category No.: 14196, 184, 14560; Payload ID: 15759 relates to Category No.: 4886, 4895, 10116, 14560; Payload ID: 15760 relates to Category No.: 4886; Payload ID: 15761 relates to Category No.: 11861; Payload ID: 15765 relates to Category No.: 15503, 14471, 14564, 14234, 11939, 3459, 15777, 11861, 5347, 3752, 14237, 15503, 14235, 3303; Payload ID: 15766 relates to Category No.: 3303, 14564, 15503, 14471, 11861, 5347; Payload ID: 15767 relates to Category No.: 3303, 14564, 15503, 14471, 14234, 15504, 11917, 15524, 11981, 14251, 6183, 11861, 15528, 14233, 12081, 14244, 15528, 14255, 14251, 14471, 14471, 4517, 1676; Payload ID: 15768 relates to Category No.: 14564, 15503, 14471, 11861, 14243, 3303, 14471; Payload ID: 15769 relates to Category No.: 14564, 15503, 14471, 11861, 3303, 14237; Payload ID: 15770 relates to Category No.: 3303, 14564, 15503, 14471, 2405, 11917, 11861, 4517, 15528, 14233, 14237, 12081, 14471, 3459; Payload ID: 15771 relates to Category No.: 14564, 15503, 14471, 11861, 5347, 12081, 3303, 14471, 14237; Payload ID: 15772 relates to Category No.: 9939, 11981, 11861, 9990, 14538, 15613, 12425, 6464; Payload ID: 15773 relates to Category No.: 11861; Payload ID: 15774 relates to Category No.: 11861, 14538; Payload ID: 15775 relates to Category No.: 11861; Payload ID: 15776 relates to Category No.: 4894, 11861, 11895; Payload ID: 15777 relates to Category No.: 4894, 11861, 7192, 3765; Payload ID: 15778 relates to Category No.: 4894, 11861; Payload ID: 15779 relates to Category No.: 4894, 11861; Payload ID: 15780 relates to Category No.: 15617, 12399, 11861, 735, 16206; Payload ID: 15781 relates to Category No.: 11861, 14536, 5957; Payload ID: 15782 relates to Category No.: 11861, 14537; Payload ID: 15783 relates to Category No.: 11861; Payload ID: 15784 relates to Category No.: 11861; Payload ID: 15785 relates to Category No.: 11861; Payload ID: 15786 relates to Category No.: 11861; Payload ID: 15787 relates to Category No.: 11978, 926, 11861; Payload ID: 15788 relates to Category No.: 15973, 11861, 444, 1201; Payload ID: 15789 relates to Category No.: 11861, 14249, 5108, 15525, 14229, 11896, 3303, 15503, 14471, 15504, 2405, 15495, 14244, 14196, 11886; Payload ID: 15790 relates to Category No.: 11861, 14249, 5108, 2405, 15495; Payload ID: 15791 relates to Category No.: 15491, 5096; Payload ID: 15792 relates to Category No.: 15495, 10116, 11861; Payload ID: 15794 relates to Category No.: 3303, 6816, 15495, 11861; Payload ID: 15795 relates to Category No.: 6816, 15100;

Payload ID: 15796 relates to Category No.: 11861; Payload ID: 15797 relates to Category No.: 14597, 11861; Payload ID: 15798 relates to Category No.: 14597, 11861; Payload ID: 15799 relates to Category No.: 3303, 15503, 14471, 11917, 14251, 14471, 11861, 11933; Payload ID: 15800 relates to Category No.: 3303, 15503, 14471, 11917, 14251, 14471, 11861, 11933; Payload ID: 15804 relates to Category No.: 11861; Payload ID: 15805 relates to Category No.: 11861, 7192; Payload ID: 15806 relates to Category No.: 2405, 14597, 10116, 11861; Payload ID: 15807 relates to Category No.: 14597, 11861; Payload ID: 15808 relates to Category No.: 3303, 11861, 15984, 9515, 3343, 14594; Payload ID: 15809 relates to Category No.: 6816, 1178, 11895, 15504, 9539, 5105, 15495, 7490, 11861, 5347, 2998, 5108, 3752, 9173, 7125, 11896, 5935, 5234, 7495, 7500, 7498, 11920, 2691; Payload ID: 15810 relates to Category No.: 16331, 2405, 15504, 5109, 7472, 7490, 11861, 15887, 5108, 5308, 307, 5403, 11896, 5101, 7495, 7500, 15769, 7499, 1173; Payload ID: 15811 relates to Category No.: 16331, 5308, 7472, 7490, 11861, 5308, 307, 5403, 7496; Payload ID: 15812 relates to Category No.: 7490, 7489, 6816, 11861, 1216, 6234, 7500; Payload ID: 15813 relates to Category No.: 7490, 16331, 12182, 12187, 12174, 11861; Payload ID: 15814 relates to Category No.: 7490, 16331, 7489, 11861, 7485, 7495, 7498, 2405, 15495, 11896; Payload ID: 15815 relates to Category No.: 6816, 2405, 7490, 11861, 7497; Payload ID: 15816 relates to Category No.: 16331, 6816, 11861, 16206, 1679, 65; Payload ID: 15817 relates to Category No.: 3303, 15503, 14471, 14234, 14471, 15524, 11861, 15528, 14233, 2405; Payload ID: 15818 relates to Category No.: 3303, 15503, 14471, 14471, 15528, 14233, 11861, 15504, 14234, 11886; Payload ID: 15819 relates to Category No.: 3303, 15503, 14471, 15491, 11861, 15496, 14240, 14471, 15528, 14239, 5109, 15503, 14239; Payload ID: 15820 relates to Category No.: 3303, 14471, 15528, 14233, 15503, 14471, 11861, 14234; Payload ID: 15821 relates to Category No.: 3303, 14471, 11861, 14234; Payload ID: 15822 relates to Category No.: 3303, 11861, 15528, 14239; Payload ID: 15823 relates to Category No.: 6816, 15629, 2267; Payload ID: 15824 relates to Category No.: 9282, 9226, 14196, 10116, 7268, 11861, 15699; Payload ID: 15825 relates to Category No.: 11861, 5347; Payload ID: 15826 relates to Category No.: 11861, 5347; Payload ID: 15827 relates to Category No.: 14652, 11861, 15495; Payload ID: 15828 relates to Category No.: 15495, 14652, 2405, 5109; Payload ID: 15829 relates to Category No.: 16331, 15895, 15495, 11981, 14652, 11920, 11861, 13735, 5111, 2405; Payload ID: 15831 relates to Category No.: 926, 9226, 14196, 961, 14203; Payload ID: 15832 relates to Category No.: 14652, 14234, 2405, 15495, 11920, 11861, 15530, 14233, 11886; Payload ID: 15833 relates to Category No.: 11861; Payload ID: 15834 relates to Category No.: 11861; Payload ID: 15835 relates to Category No.: 12399, 11861; Payload ID: 15836 relates to Category No.: 12399, 11861; Payload ID: 15837 relates to Category No.: 12399, 11861; Payload ID: 15838 relates to Category No.: 12399, 11861; Payload ID: 15839 relates to Category No.: 3303, 6816, 15503, 14471; Payload ID: 15840 relates to Category No.: 3303, 267, 12150, 12151, 9804, 9962, 11861; Payload ID: 15841 relates to Category No.: 3303, 267, 12150, 12151, 9804, 9962; Payload ID: 15842 relates to Category No.: 3303, 267, 12150, 12151, 9804; Payload ID: 15843 relates to Category No.: 11861; Payload ID: 15844 relates to Category No.: 11861; Payload ID: 15845 relates to Category No.: 11861; Payload ID: 15846 relates to Category No.: 11861; Payload ID: 15847 relates to Category No.: 11861; Payload ID: 15848 relates to Category No.: 11861; Payload ID: 15849 relates to Category No.: 1405, 5009, 11861, 14296; Payload ID: 15850 relates to Category No.: 1405, 11939, 5009, 11861, 5347, 4897, 14296, 6027, 12189, 2305, 5003; Payload ID: 15851 relates to Category No.: 1405, 5009, 11861, 14296; Payload ID: 15852 relates to Category No.: 4894, 12363, 11861, 14106; Payload ID: 15853 relates to Category No.: 11861; Payload ID: 15855 relates to Category No.: 11939, 11933; Payload ID: 15856 relates to Category No.: 4894, 12363, 11861; Payload ID: 15857 relates to Category No.: 11861; Payload ID: 15858 relates to Category No.: 16331, 11861, 14395, 11698, 9226; Payload ID: 15859 relates to Category No.: 6816, 11861, 158, 2770; Payload ID: 15860 relates to Category No.: 6816, 11861, 158, 2770; Payload ID: 15861 relates to Category No.: 11861; Payload ID: 15862 relates to Category No.: 3749, 11861, 158, 2770, 104; Payload ID: 15863 relates to Category No.: 15503, 14471, 6816, 14234, 11981, 11861, 5347, 15528, 14233, 12417, 2737, 5882, 15562, 9596, 11939, 11933, 14237; Payload ID: 15864 relates to Category No.: 3303, 6816, 15503, 14471, 14234, 15504, 3459, 15895, 15567, 14652, 11861, 9805, 15528, 14233, 14324, 2737, 15820, 5882, 15562, 9596, 327, 3731, 11939, 11933, 2405; Payload ID: 15865 relates to Category No.: 15503, 14471, 16331, 14234, 11939, 1178, 14471, 15504, 15524, 15895, 15567, 1153, 11981, 2690, 11861, 15887, 9805, 5347, 14324, 2737, 14229, 15562, 9596, 3731, 15503, 14235, 15503, 11861, 14243, 11933, 2405, 3459, 2406, 2566, 3303, 3752, 14652; Payload ID: 15866 relates to Category No.: 15503, 14471, 3303, 6816, 14234, 11939, 14471, 15524, 2690, 11861, 5347, 15528, 14233, 14324, 5882, 15503, 11861, 15562, 2606, 14243, 11933, 2405, 15528, 14255, 14252, 15503, 14252, 2566; Payload ID: 15867 relates to Category No.: 6816, 15503, 14471, 15895, 11861, 12417, 15562, 9596, 14237; Payload ID: 15868 relates to Category No.: 6816, 15503, 14471, 14234, 2405, 15524, 15895, 11861, 5347, 14324, 2737, 15562, 5436, 15820, 5882, 15811; Payload ID: 15869 relates to Category No.: 6816, 15503, 14471, 15524, 15895, 1153, 11861, 15562, 5436, 15820, 368, 5882, 2566; Payload ID: 15870 relates to Category No.: 3303, 6816, 15503, 14471, 11861, 15562, 9596; Payload ID: 15871 relates to Category No.: 10116, 11861; Payload ID: 15872 relates to Category No.: 15908, 15893, 9939, 6188, 11861, 14324, 368, 5882; Payload ID: 15873 relates to Category No.: 11861, 15908, 15893, 6188, 14652, 5347, 15567; Payload ID: 15874 relates to Category No.: 6816, 4894, 2491; Payload ID: 15875 relates to Category No.: 4894, 6816, 11861; Payload ID: 15876 relates to Category No.: 11939, 12402, 12399, 11861, 1706; Payload ID: 15877 relates to Category No.: 7192; Payload ID: 15878 relates to Category No.: 7192; Payload ID: 15879 relates to Category No.: 7192; Payload ID: 15880 relates to Category No.: 11861; Payload ID: 15881 relates to Category No.: 4894, 12359; Payload ID: 15882 relates to Category No.: 4894, 12359, 11861; Payload ID: 15883 relates to Category No.: 11861, 1105; Payload ID: 15884 relates to Category No.: 11861; Payload ID: 15890 relates to Category No.: 7192; Payload ID: 15891 relates to Category No.: 7192; Payload ID: 15899 relates to Category No.: 11861; Payload ID: 15904 relates to Category No.: 7192; Payload ID: 15905 relates to Category No.: 11861; Payload ID: 15912 relates to Category No.: 11861; Payload ID: 15915 relates to Category No.: 926, 9226, 954, 12142, 961, 10116, 11861, 5347, 4965; Payload ID: 15916 relates to Category No.: 11861; Payload ID: 15917 relates to Category No.: 9226, 11861; Payload ID: 15918 relates to Category No.: 9282, 9226, 7268, 14715; Payload ID: 15919 relates to Category No.: 10116, 11861; Payload ID: 15920 relates to Category No.: 6816; Payload ID: 15921 relates to Category No.: 9282, 9226, 14196, 10116, 7268, 15844, 11861; Payload ID: 15922 relates to Category No.: 14196, 10116, 11861; Payload ID: 15923 relates to Category No.: 10116, 11861; Payload ID: 15924 relates to Category No.: 10116, 11861, 3752, 5223; Payload ID: 15925 relates to Category No.: 9282, 9226, 14715, 14196, 10116, 15844, 11861, 14722; Payload ID: 15926 relates to Category No.: 10116, 11861, 15850; Payload ID: 15927 relates to Category No.: 9282, 9226, 11861, 14722; Payload ID: 15928 relates to Category No.: 16331, 9226, 11939, 10116, 7268, 11861, 14602, 11699, 15844; Payload ID: 15929 relates to Category No.: 14196, 11861; Payload ID: 15930 relates to Category No.: 14196, 11861; Payload ID: 15931 relates to Category No.: 10116, 11861, 14196; Payload ID: 15932 relates to Category No.: 10116, 11861; Payload ID: 15933 relates to Category No.: 10116, 11861, 5223; Payload ID: 15934 relates to Category No.: 3303; Payload ID: 15935 relates to Category No.: 15503, 14471; Payload ID: 15936 relates to Category No.: 3303, 11861; Payload ID: 15937 relates to Category No.: 3303, 15503, 14471; Payload ID: 15938 relates to Category No.: 15503, 14471, 11861; Payload ID: 15939 relates to Category No.: 15029, 11861, 1327, 11861; Payload ID: 15940 relates to Category No.: 15029, 11861, 1327; Payload ID: 15941 relates to Category No.: 15029, 11861; Payload ID: 15942 relates to Category No.: 15029; Payload ID: 15943 relates to Category No.: 15029; Payload ID: 15944 relates to Category No.: 15029, 11861; Payload ID: 15945 relates to Category No.: 15029; Payload ID: 15946 relates to Category No.: 15029; Payload ID: 15947 relates to Category No.: 15029, 11861; Payload ID: 15948 relates to Category No.: 15029; Payload ID: 15949 relates to Category No.: 15504, 15895, 10116, 11861, 11665, 5841, 12121; Payload ID: 15950 relates to Category No.: 15895, 10116, 11861, 12121, 15101; Payload ID: 15951 relates to Category No.: 11861, 12121, 15101; Payload ID: 15952 relates to Category No.: 11861, 12121; Payload ID: 15954 relates to Category No.: 11861, 943, 12107; Payload ID: 15955 relates to Category No.: 15895, 11861, 11886; Payload ID: 15956 relates to Category No.: 15895, 11861, 11886; Payload ID: 15957 relates to Category No.: 11978, 926, 6816, 11917, 12109, 10116, 11861, 9988, 512, 1201, 5956; Payload ID: 15958 relates to Category No.: 11861, 12077; Payload ID: 15959 relates to Category No.: 6816, 3688, 11861, 15265; Payload ID: 15960 relates to Category No.: 11861, 12077; Payload ID: 15961 relates to Category No.: 11861; Payload ID: 15962 relates to Category No.: 11861, 5347; Payload ID: 15964 relates to Category No.: 267, 11861, 15024; Payload ID: 15965 relates to Category No.: 11861, 12076, 1457; Payload ID: 15966 relates to Category No.: 11861; Payload ID: 15967 relates to Category No.: 4820, 15617, 11861, 16293, 3471, 9592; Payload ID: 15968 relates to Category No.: 11861; Payload ID: 15969 relates to Category No.: 6816, 6924, 11861, 7192; Payload ID: 15970 relates to Category No.: 6816, 11861, 15530, 14233, 5957, 14243, 14471, 15530, 14255; Payload ID: 15971 relates to Category No.: 6816, 14471, 11861, 15530, 14233, 2405, 15503, 14239; Payload ID: 15972 relates to Category No.: 6816, 2672, 14243, 15503, 14471, 14234, 15530, 14255, 15503, 14233; Payload ID: 15973 relates to Category No.: 14706, 11861; Payload ID: 15974 relates to Category No.: 11978, 926, 6478, 12109; Payload ID: 15975 relates to Category No.: 926, 3303, 16331, 15908, 4965, 6188, 11861; Payload ID: 15976 relates to Category No.: 926, 3303, 4965, 15491, 11861, 5096; Payload ID: 15977 relates to Category No.: 11939, 11895, 15504, 11861, 12064, 2269; Payload ID: 15978 relates to Category No.: 7192; Payload ID: 15979 relates to Category No.: 7192; Payload ID: 15980 relates to Category No.: 14196, 14712, 10116, 11861, 15859, 15861, 15865, 1284; Payload ID: 15981 relates to Category No.: 12142, 11861, 14198; Payload ID: 15982 relates to Category No.: 14082, 15491, 15495, 14652, 10116, 11861, 9173, 9122, 16224; Payload ID: 15983 relates to Category No.: 11895, 2491, 14733; Payload ID: 15984 relates to Category No.: 6816, 11861, 3752; Payload ID: 15985 relates to Category No.: 6187, 14730, 11861, 16296, 267; Payload ID: 15986 relates to Category No.: 6187, 14730, 11861, 16296; Payload ID: 15987 relates to Category No.: 6187, 14730, 11861; Payload ID: 15988 relates to Category No.: 6187, 5840, 14730, 11861, 16296; Payload ID: 15989 relates to Category No.: 5840, 16259, 14734; Payload ID: 15990 relates to Category No.: 14733, 16259, 11861, 16262, 14732, 16263; Payload ID: 15991 relates to Category No.: 5840, 16250, 16259, 11861; Payload ID: 15992 relates to Category No.: 14733, 11861, 16262, 16259; Payload ID: 15993 relates to Category No.: 5840, 16259, 11861, 1457, 14734; Payload ID: 15994 relates to Category No.: 14733, 16259, 11861, 5841, 16262; Payload ID: 15995 relates to Category No.: 5840, 16259, 11861; Payload ID: 15996 relates to Category No.: 14733, 16259, 11861, 5841, 16262; Payload ID: 15997 relates to Category No.: 5840, 16259, 11861, 14734, 16250; Payload ID: 15998 relates to Category No.: 5840, 16259, 15895, 11981, 1457, 11920, 11861, 5841, 3752, 4183, 14377, 712, 16262, 9060, 16263, 16260, 16261, 16264, 16250; Payload ID: 15999 relates to Category No.: 5840, 16259, 11861, 14730; Payload ID: 16000 relates to Category No.: 926, 5840, 16259, 11861; Payload ID: 16001 relates to Category No.: 5840, 16259, 5841, 11861; Payload ID: 16002 relates to Category No.: 5840, 16259, 11861; Payload ID: 16003 relates to Category No.: 16244, 5840, 14730, 11861; Payload ID: 16005 relates to Category No.: 14746, 11861, 6170, 4582; Payload ID: 16006 relates to Category No.: 14746, 6170, 11861, 4566, 620, 5053; Payload ID: 16007 relates to Category No.: 14746, 6170; Payload ID: 16008 relates to Category No.: 14746, 6357, 2323, 6009, 6350, 6173, 6089, 6363, 6178, 8992; Payload ID: 16009 relates to Category No.: 14746, 6057, 6170; Payload ID: 16010 relates to Category No.: 14746, 11861, 6170, 2847, 4582, 4566; Payload ID: 16011 relates to Category No.: 14746, 12399, 11861, 6173, 16206, 8992; Payload ID: 16012 relates to Category No.: 1194, 16206, 1193; Payload ID: 16013 relates to Category No.: 1194; Payload ID: 16014 relates to Category No.: 1194, 14759; Payload ID: 16015 relates to Category No.: 1194; Payload ID: 16016 relates to Category No.: 1194; Payload ID: 16017 relates to Category No.: 1194; Payload ID: 16018 relates to Category No.: 15138; Payload ID: 16019 relates to Category No.: 15629, 11939, 6576, 15584, 6820, 7192; Payload ID: 16020 relates to Category No.: 15629, 11861, 14772, 16333, 2678, 6576, 1371, 15584, 1374, 2543, 4163, 6096, 9024, 16076, 4165, 5469, 15546, 5298, 5870; Payload ID: 16021 relates to Category No.: 15629, 11981, 11677, 11673, 1653; Payload ID: 16022 relates to Category No.: 11981, 11677, 11673, 1653, 11861; Payload ID: 16023 relates to Category No.: 15629, 11981, 11677, 11673, 1653, 11675, 14325; Payload ID: 16024 relates to Category No.: 11981, 11677, 11673, 1653; Payload ID: 16025 relates to Category No.: 15629, 11677, 11861, 11673, 1653, 14741, 14750, 3752, 14745; Payload ID: 16026 relates to Category No.: 15629, 1653, 11677, 11673, 14741, 14745, 11861, 14750; Payload ID: 16027 relates to Category No.: 644, 11677, 11861, 11673, 1653, 14741, 14750, 14745; Payload ID: 16028 relates to Category No.: 11677, 11673; Payload ID: 16029 relates to Category No.: 11677, 11673, 1653; Payload ID:

16030 relates to Category No.: 15629, 14756, 14397; Payload ID: 16031 relates to Category No.: 15629, 14756; Payload ID: 16032 relates to Category No.: 15629, 14746, 2482, 15056, 15646; Payload ID: 16033 relates to Category No.: 15629, 6332; Payload ID: 16034 relates to Category No.: 15629, 14746, 2482, 15056, 5058, 3234, 9425, 6057; Payload ID: 16035 relates to Category No.: 15997, 15992, 16273; Payload ID: 16036 relates to Category No.: 15997, 11861, 1706, 15992; Payload ID: 16037 relates to Category No.: 15629, 9354, 9645, 12198, 7192; Payload ID: 16038 relates to Category No.: 15629, 9354, 11861, 9645, 5057; Payload ID: 16039 relates to Category No.: 15629, 15138, 11861; Payload ID: 16040 relates to Category No.: 15629, 15138; Payload ID: 16041 relates to Category No.: 15629, 15138; Payload ID: 16042 relates to Category No.: 15629, 844, 15411; Payload ID: 16043 relates to Category No.: 15138, 5996, 7212, 6928, 11861, 11939, 9430; Payload ID: 16044 relates to Category No.: 5996, 10116, 11861, 15138, 7212; Payload ID: 16045 relates to Category No.: 15138, 5996, 7212; Payload ID: 16046 relates to Category No.: 15138, 5996, 7212, 12340, 12342; Payload ID: 16047 relates to Category No.: 15138, 5996, 7212; Payload ID: 16048 relates to Category No.: 15138, 7212; Payload ID: 16049 relates to Category No.: 5996; Payload ID: 16050 relates to Category No.: 15138, 7212; Payload ID: 16051 relates to Category No.: 15138, 7212; Payload ID: 16052 relates to Category No.: 15629, 15411, 15138, 7212; Payload ID: 16053 relates to Category No.: 15138, 7212; Payload ID: 16054 relates to Category No.: 15138, 7212; Payload ID: 16055 relates to Category No.: 11861, 15138, 7212; Payload ID: 16056 relates to Category No.: 15071, 14549; Payload ID: 16057 relates to Category No.: 14762, 9813, 14749; Payload ID: 16058 relates to Category No.: 14762, 14749, 16243, 9426, 3476, 15990, 3540, 15472; Payload ID: 16059 relates to Category No.: 15138, 6170; Payload ID: 16060 relates to Category No.: 6170, 14747, 4033, 14762, 5473; Payload ID: 16061 relates to Category No.: 15138, 6170; Payload ID: 16062 relates to Category No.: 15629, 15619; Payload ID: 16063 relates to Category No.: 14762, 14749; Payload ID: 16064 relates to Category No.: 14762, 14749; Payload ID: 16065 relates to Category No.: 220; Payload ID: 16066 relates to Category No.: 7209, 3476, 3752, 14514; Payload ID: 16067 relates to Category No.: 7209, 11861, 3471, 3752, 618, 14514, 4961; Payload ID: 16069 relates to Category No.: 4236, 6897, 4230, 12445; Payload ID: 16070 relates to Category No.: 11861, 4236, 15348, 15350; Payload ID: 16071 relates to Category No.: 15350; Payload ID: 16072 relates to Category No.: 15629, 15071, 4540, 15619, 11861, 5347, 12107, 15046, 3025, 3206, 5957, 16310; Payload ID: 16073 relates to Category No.: 15629, 15071, 4540, 15619; Payload ID: 16074 relates to Category No.: 15629, 15071, 4540, 15619, 15046; Payload ID: 16075 relates to Category No.: 15629, 15071, 4540, 15619; Payload ID: 16076 relates to Category No.: 15629, 15071, 4540, 15619, 15046; Payload ID: 16077 relates to Category No.: 15629, 15071, 4540, 15619, 15046; Payload ID: 16078 relates to Category No.: 15629, 15071, 4540, 15619, 5047, 15046, 3025, 3206, 5538; Payload ID: 16079 relates to Category No.: 15629, 15071, 4540, 15619, 4532, 15046; Payload ID: 16080 relates to Category No.: 15629, 15071, 4540, 15619, 11861, 15046, 3206; Payload ID: 16081 relates to Category No.: 15629, 15071, 4540, 15619, 15046; Payload ID: 16082 relates to Category No.: 15629, 15071, 4540, 15619, 15046; Payload ID: 16083 relates to Category No.: 15629, 15071, 15619, 15046, 4540, 4532; Payload ID: 16084 relates to Category No.: 15629, 15071, 4540, 15619, 15046; Payload ID: 16085 relates to Category No.: 15629, 15071, 4540, 15619, 4306, 15046; Payload ID: 16086 relates to Category No.: 14564, 12399, 5473, 14749, 14747, 5054; Payload ID: 16087 relates to Category No.: 12399, 5473, 14749, 16206, 14747; Payload ID: 16088 relates to Category No.: 15619, 5847, 5467, 11861, 9426, 14766, 11939, 711, 2327; Payload ID: 16089 relates to Category No.: 5847, 11861, 14766, 15619; Payload ID: 16090 relates to Category No.: 15629, 15619, 5847, 5467, 14766; Payload ID: 16091 relates to Category No.: 5467, 14766, 711, 14544; Payload ID: 16092 relates to Category No.: 15619, 5467, 11861, 9426, 14766; Payload ID: 16093 relates to Category No.: 15619, 5467, 14766, 9608, 15990; Payload ID: 16094 relates to Category No.: 15619, 9428, 15046, 9034; Payload ID: 16095 relates to Category No.: 15629, 15619, 5847, 11861, 3432, 9428, 12343, 220, 9113, 14396, 11939, 5347, 7209; Payload ID: 16096 relates to Category No.: 7192; Payload ID: 16097 relates to Category No.: 15629, 15619, 5847, 3432, 9428, 2366, 12343, 14961; Payload ID: 16098 relates to Category No.: 15629, 5847, 11861, 3432, 9428, 12343, 15472; Payload ID: 16099 relates to Category No.: 15619, 9428, 618, 1611; Payload ID: 16100 relates to Category No.: 926, 15629, 15619, 5847, 11861, 15138, 3476, 9608, 12343, 1611, 1652; Payload ID: 16101 relates to Category No.: 926, 9282, 15629, 15619, 5847, 11861, 15138, 9608, 12343, 14396, 1611, 1652; Payload ID: 16102 relates to Category No.: 15619, 5467, 14766; Payload ID: 16103 relates to Category No.: 15619, 9428, 15046; Payload ID: 16104 relates to Category No.: 15619, 15046; Payload ID: 16105 relates to Category No.: 15629, 15617, 15619, 9426, 11861; Payload ID: 16106 relates to Category No.: 15895, 15138, 3476, 15629; Payload ID: 16107 relates to Category No.: 15629, 15619, 11861, 9426; Payload ID: 16108 relates to Category No.: 15619, 5467, 14766; Payload ID: 16109 relates to Category No.: 5467, 14766; Payload ID: 16110 relates to Category No.: 15619; Payload ID: 16111 relates to Category No.: 15629, 11861, 14757, 14741, 9229, 6053, 6048, 3025; Payload ID: 16112 relates to Category No.: 15629, 14757, 14758, 9229, 6053; Payload ID: 16113 relates to Category No.: 15629; Payload ID: 16114 relates to Category No.: 1392, 11679, 1405, 1401, 11861, 15138, 11666, 14734; Payload ID: 16115 relates to Category No.: 1405, 1401, 15138, 11666, 1392, 11679, 14734, 11917, 9022, 6574, 1371; Payload ID: 16116 relates to Category No.: 1405, 1401, 15138, 11666, 1392, 11679, 14734; Payload ID: 16117 relates to Category No.: 1405, 1401, 15138, 11666, 1392, 11679, 14734; Payload ID: 16118 relates to Category No.: 1405, 1401, 15138, 11666, 1392, 11679, 14734; Payload ID: 16119 relates to Category No.: 1405, 6170, 6057; Payload ID: 16120 relates to Category No.: 1405, 15629, 6170, 6057; Payload ID: 16122 relates to Category No.: 11861, 15138; Payload ID: 16123 relates to Category No.: 384; Payload ID: 16124 relates to Category No.: 754; Payload ID: 16126 relates to Category No.: 15138, 6170; Payload ID: 16127 relates to Category No.: 15629; Payload ID: 16128 relates to Category No.: 11861, 412, 15629; Payload ID: 16129 relates to Category No.: 15895, 10116, 11861, 412; Payload ID: 16130 relates to Category No.: 11861, 938; Payload ID: 16131 relates to Category No.: 2482; Payload ID: 16132 relates to Category No.: 11861, 3234; Payload ID: 16133 relates to Category No.: 6327; Payload ID: 16135 relates to Category No.: 10116, 9522; Payload ID: 16136 relates to Category No.: 11861, 2271, 935, 461, 2556, 4078, 4227, 7479, 653, 15629; Payload ID: 16137 relates to Category No.: 1405, 11861; Payload ID: 16138 relates to Category No.: 1405, 935; Payload ID: 16139 relates to Category No.: 1405; Payload ID: 16140 relates to Category No.: 15138, 11886, 9810; Payload ID: 16141 relates to Category No.: 4236; Payload ID: 16143 relates to Category No.: 5870; Payload ID: 16145 relates to Category No.: 3082; Payload ID: 16146 relates to Category No.: 12314; Payload ID: 16147 relates to Category No.: 12314; Payload ID: 16148 relates to Category No.: 14344; Payload ID: 16150 relates to Category No.: 7192; Payload ID: 16153 relates to Category No.: 15629; Payload ID: 16157 relates to Category No.: 935, 461, 2556, 653, 424; Payload ID: 16161 relates to Category No.: 11861, 7192; Payload ID: 16163 relates to Category No.: 11861; Payload ID: 16167 relates to Category No.: 14397, 2323, 711, 15076, 1180, 2330, 9494; Payload ID: 16168 relates to Category No.: 14397, 15076, 2323, 711, 1180, 9494, 709; Payload ID: 16169 relates to Category No.: 14397, 2323, 711, 15076, 1180, 9494; Payload ID: 16170 relates to Category No.: 14397, 711, 15629, 15503, 14471, 11861, 15493, 2323, 15076, 1180, 2330, 9494; Payload ID: 16171 relates to Category No.: 14397, 2323, 711, 15076, 1180, 2330, 9494, 5837; Payload ID: 16172 relates to Category No.: 14397, 2323, 711, 15076, 1180, 9494, 11861, 14812, 11939, 15504; Payload ID: 16173 relates to Category No.: 14397, 11861, 2323, 711, 9608, 15076, 3540, 1180, 2330, 9494, 4271, 4273, 4269; Payload ID: 16174 relates to Category No.: 14397, 15076, 2323, 711, 1180, 9494, 706; Payload ID: 16175 relates to Category No.: 14397, 11861, 2323, 711, 15076, 1180, 9494; Payload ID: 16176 relates to Category No.: 14397, 2323, 711, 943, 15076, 1180, 9494; Payload ID: 16177 relates to Category No.: 14397, 15076, 2323, 711, 1180, 9494; Payload ID: 16178 relates to Category No.: 1630, 6308, 4116, 16145, 9282, 11939, 11861; Payload ID: 16179 relates to Category No.: 926, 1630, 12402, 3752, 6308, 16145, 10008, 11743, 4116; Payload ID: 16180 relates to Category No.: 1630, 6308, 16145, 9282; Payload ID: 16181 relates to Category No.: 9282, 6308, 4116, 1630, 16145; Payload ID: 16182 relates to Category No.: 6308, 4116, 16145, 926, 1630, 2336, 11886; Payload ID: 16183 relates to Category No.: 1630, 6308, 16145, 9282; Payload ID: 16184 relates to Category No.: 9262, 12297, 9267, 12304; Payload ID: 16185 relates to Category No.: 9267, 12249; Payload ID: 16186 relates to Category No.: 9267, 12297, 12271; Payload ID: 16187 relates to Category No.: 9262; Payload ID: 16188 relates to Category No.: 9262; Payload ID: 16189 relates to Category No.: 9262; Payload ID: 16190 relates to Category No.: 9262, 7209; Payload ID: 16191 relates to Category No.: 1630, 623, 1646, 11861, 1095, 6089, 11933; Payload ID: 16192 relates to Category No.: 1630, 1646, 3464, 10116, 11861, 1428, 8992; Payload ID: 16193 relates to Category No.: 11861, 1650, 16333, 1403; Payload ID: 16194 relates to Category No.: 11861, 1650, 16333; Payload ID: 16195 relates to Category No.: 11861, 1650, 16334; Payload ID: 16196 relates to Category No.: 1650, 16333; Payload ID: 16197 relates to Category No.: 16331, 1650, 16333; Payload ID: 16198 relates to Category No.: 1650, 16333; Payload ID: 16199 relates to Category No.: 1650, 16333; Payload ID: 16200 relates to Category No.: 16331, 11939, 11861, 1650, 16333; Payload ID: 16201 relates to Category No.: 15503, 14471, 1650, 2405, 6184, 6185; Payload ID: 16202 relates to Category No.: 1650, 16333; Payload ID: 16203 relates to Category No.: 2678, 11861, 2680; Payload ID: 16204 relates to Category No.: 2678, 11861; Payload ID: 16205 relates to Category No.: 623, 4677, 4377; Payload ID: 16206 relates to Category No.: 14772, 237; Payload ID: 16207 relates to Category No.: 14762, 11861, 15138, 11939, 9608, 11886; Payload ID: 16208 relates to Category No.: 14762, 14749, 14734, 9809; Payload ID: 16209 relates to Category No.: 14762, 14749; Payload ID: 16210 relates to Category No.: 14564, 129; Payload ID: 16212 relates to Category No.: 15071, 9302, 2529; Payload ID: 16213 relates to Category No.: 754; Payload ID: 16214 relates to Category No.: 754; Payload ID: 16215 relates to Category No.: 15071, 9302, 11861, 15923; Payload ID: 16216 relates to Category No.: 754, 12317, 15941; Payload ID: 16217 relates to Category No.: 754, 9302, 12317; Payload ID: 16218 relates to Category No.: 15071, 9302, 11861, 15953; Payload ID: 16219 relates to Category No.: 11861, 15953, 15958; Payload ID: 16220 relates to Category No.: 15071; Payload ID: 16221 relates to Category No.: 15071, 9302; Payload ID: 16222 relates to Category No.: 15923; Payload ID: 16223 relates to Category No.: 754, 12317; Payload ID: 16224 relates to Category No.: 754; Payload ID: 16225 relates to Category No.: 754; Payload ID: 16226 relates to Category No.: 754; Payload ID: 16227 relates to Category No.: 754, 9302; Payload ID: 16228 relates to Category No.: 754; Payload ID: 16230 relates to Category No.: 7192; Payload ID: 16234 relates to Category No.: 11861; Payload ID: 16235 relates to Category No.: 11861; Payload ID: 16240 relates to Category No.: 4677, 5298, 5304, 6009, 6350; Payload ID: 16241 relates to Category No.: 4677, 5298, 5304, 6009, 6350; Payload ID: 16242 relates to Category No.: 623, 6364, 15138, 6009, 6350; Payload ID: 16243 relates to Category No.: 4677, 5298, 5304, 6009, 6350; Payload ID: 16244 relates to Category No.: 9435, 15629; Payload ID: 16245 relates to Category No.: 15629, 9435; Payload ID: 16246 relates to Category No.: 15629, 4547; Payload ID: 16247 relates to Category No.: 9435, 15629; Payload ID: 16248 relates to Category No.: 623, 11861, 14743, 8992, 6173; Payload ID: 16249 relates to Category No.: 623; Payload ID: 16250 relates to Category No.: 623; Payload ID: 16251 relates to Category No.: 623, 11861, 15138; Payload ID: 16252 relates to Category No.: 754, 15138, 6009, 6177, 6055, 6173; Payload ID: 16253 relates to Category No.: 623, 15138; Payload ID: 16254 relates to Category No.: 4677; Payload ID: 16255 relates to Category No.: 623; Payload ID: 16256 relates to Category No.: 6035, 6357, 11861, 6276, 6009, 6177, 6170, 6055, 6057, 6173, 6288; Payload ID: 16257 relates to Category No.: 623; Payload ID: 16258 relates to Category No.: 623, 11861; Payload ID: 16259 relates to Category No.: 6818, 16333, 5469, 12402; Payload ID: 16260 relates to Category No.: 6818, 16333; Payload ID: 16261 relates to Category No.: 6818, 16333; Payload ID: 16262 relates to Category No.: 6818, 11939, 11861, 16333; Payload ID: 16263 relates to Category No.: 6818, 16333, 4163; Payload ID: 16264 relates to Category No.: 6818, 16333; Payload ID: 16265 relates to Category No.: 6818, 16333; Payload ID: 16266 relates to Category No.: 6818, 16333; Payload ID: 16267 relates to Category No.: 6818, 7192; Payload ID: 16268 relates to Category No.: 6818, 16333; Payload ID: 16269 relates to Category No.: 6818, 11861, 16333; Payload ID: 16270 relates to Category No.: 6818; Payload ID: 16271 relates to Category No.: 6818, 16333; Payload ID: 16272 relates to Category No.: 6818; Payload ID: 16273 relates to Category No.: 15629, 11939, 5467, 11861, 711, 11854, 1180, 2330, 712, 709, 11895, 267, 3752; Payload ID: 16274 relates to Category No.: 11861; Payload ID: 16275 relates to Category No.: 5467, 15629, 709, 3752; Payload ID: 16276 relates to Category No.: 15629, 5467, 709, 711; Payload ID: 16277 relates to Category No.: 15629, 5467, 14744, 11861, 709; Payload ID: 16278 relates to Category No.: 15629, 5467, 14744, 709; Payload ID: 16279 relates to Category No.: 15629, 5467, 14744, 709; Payload ID: 16280 relates to Category No.: 15629, 5467, 14744, 709; Payload ID: 16281 relates to Category No.: 15629, 5467, 14744, 709, 711; Payload ID: 16282 relates to Category No.: 15629, 5467, 14744, 709, 711; Payload ID: 16283 relates to Category No.: 15629, 11917, 14730, 5467, 15138, 1180, 5296, 1280; Payload ID: 16284 relates to Category No.: 12399, 11861, 5870, 9636, 4163, 5861; Payload ID: 16285 relates to Category No.: 1650; Payload ID: 16286 relates to Category No.: 11861, 1650; Payload ID: 16287 relates to Category No.: 11861, 1650; Payload ID: 16288 relates to Category No.: 6035, 8992; Payload ID: 16289 relates to Category No.: 6035, 8992; Payload ID: 16290 relates to Category No.: 7192; Payload ID: 16291 relates to Category No.: 2366; Payload ID: 16292 relates to Category No.: 14564, 2366, 11861; Payload ID: 16293 relates to Category No.: 11861; Payload ID: 16296 relates to Category No.: 4540, 15138; Payload ID: 16300 relates to Category No.: 15629, 4230, 5298, 4236, 6897, 4986; Payload ID: 16301 relates to Category No.: 15138; Payload ID: 16302 relates to Category No.: 7192; Payload ID: 16303 relates to Category No.: 754, 3476, 7232; Payload ID: 16304 relates to Category No.: 754, 3476; Payload ID: 16305 relates to Category No.: 11861, 4986; Payload ID: 16306 relates to Category No.: 15629, 15138; Payload ID: 16307 relates to Category No.: 15629, 2366, 2368, 11861, 2361; Payload ID: 16308 relates to Category No.: 15629, 11861, 4542, 4540; Payload ID: 16309 relates to Category No.: 15629, 6329, 11861, 4542; Payload ID: 16310 relates to Category No.: 15629, 11861, 15138; Payload ID: 16311 relates to Category No.: 15629, 5837, 15138, 14748; Payload ID: 16312 relates to Category No.: 15629, 15138, 5996; Payload ID: 16313 relates to Category No.: 15629, 15138; Payload ID: 16314 relates to Category No.: 15629, 14758; Payload ID: 16315 relates to Category No.: 15629, 7392; Payload ID: 16316 relates to Category No.: 15629; Payload ID: 16317 relates to Category No.: 15629; Payload ID: 16318 relates to Category No.: 4551, 15070, 11861; Payload ID: 16319 relates to Category No.: 15629, 11939, 11933, 11861; Payload ID: 16320 relates to Category No.: 15629, 11933, 11861; Payload ID: 16321 relates to Category No.: 16206, 14131; Payload ID: 16322 relates to Category No.: 11861, 16206, 14131; Payload ID: 16323 relates to Category No.: 14131, 11861; Payload ID: 16324 relates to Category No.: 8982, 623; Payload ID: 16325 relates to Category No.: 8982, 4378, 11861; Payload ID: 16326 relates to Category No.: 8982, 4378, 8969; Payload ID: 16327 relates to Category No.: 8982, 11861, 4378; Payload ID: 16328 relates to Category No.: 8982, 4378, 8969; Payload ID: 16329 relates to Category No.: 8982, 11861, 7209, 9115; Payload ID: 16330 relates to Category No.: 8982, 11861, 7209, 3432, 3435, 12064, 3424, 12402, 11828, 11886, 3471, 12077; Payload ID: 16331 relates to Category No.: 277, 8982, 12359, 11861, 7209, 14517, 14514, 9060, 11939, 7393, 15181, 2545; Payload ID: 16332 relates to Category No.: 8982, 4679; Payload ID: 16333 relates to Category No.: 8982, 15237, 15235, 15232; Payload ID: 16334 relates to Category No.: 8982, 6350; Payload ID: 16335 relates to Category No.: 8982, 7192, 2763, 2765; Payload ID: 16336 relates to Category No.: 8982, 14743, 4679, 4677, 11861; Payload ID: 16337 relates to Category No.: 8982, 8980, 11781; Payload ID: 16338 relates to Category No.: 8982, 623; Payload ID: 16339 relates to Category No.: 8982, 623, 11861; Payload ID: 16340 relates to Category No.: 8982, 8992, 11861; Payload ID: 16341 relates to Category No.: 8982, 623, 11861; Payload ID: 16342 relates to Category No.: 8982, 623, 8980; Payload ID: 16343 relates to Category No.: 754, 9625, 623, 11861, 6089, 8992; Payload ID: 16344 relates to Category No.: 754, 623, 6276, 6345, 6364, 9625, 8992, 6035; Payload ID: 16345 relates to Category No.: 6035, 754, 623, 9625, 11861, 15472, 9428, 8992; Payload ID: 16346 relates to Category No.: 6035, 754, 623; Payload ID: 16347 relates to Category No.: 6035, 754, 623, 1095; Payload ID: 16348 relates to Category No.: 623, 11861, 2864; Payload ID: 16349 relates to Category No.: 6035, 754, 623; Payload ID: 16350 relates to Category No.: 754, 623, 11861, 6327, 832, 6282; Payload ID: 16351 relates to Category No.: 754, 623, 6327, 832, 6282, 1095, 5052, 5056, 6046, 6330, 5055; Payload ID: 16352 relates to Category No.: 754, 623, 6327, 832, 6282, 1095; Payload ID: 16353 relates to Category No.: 754, 623, 6357, 3482, 8992, 11861; Payload ID: 16354 relates to Category No.: 6035, 754, 623; Payload ID: 16355 relates to Category No.: 754, 623, 6327, 832, 6282, 1095; Payload ID: 16357 relates to Category No.: 1405, 1457, 11861, 2936, 5841, 1428, 712; Payload ID: 16358 relates to Category No.: 1457, 1428; Payload ID: 16359 relates to Category No.: 1457, 1428, 1427; Payload ID: 16360 relates to Category No.: 11939, 1428, 1429, 5347; Payload ID: 16361 relates to Category No.: 14771; Payload ID: 16362 relates to Category No.: 11890, 11861, 1327, 14771, 14754, 1457, 11861, 1439, 9887, 12078, 14755; Payload ID: 16363 relates to Category No.: 14771, 14754; Payload ID: 16364 relates to Category No.: 14771, 14754, 11861, 9608; Payload ID: 16365 relates to Category No.: 11890, 11861, 12402, 1153, 1135, 9805, 9608, 2326, 12107, 4867, 3430, 11920, 11886; Payload ID: 16366 relates to Category No.: 11890, 11895, 12402, 1153, 11861, 9805, 9608, 2269, 6337; Payload ID: 16367 relates to Category No.: 14771, 14754; Payload ID: 16368 relates to Category No.: 14771, 14754; Payload ID: 16369 relates to Category No.: 14771, 14754; Payload ID: 16370 relates to Category No.: 11939, 14771, 14754, 11861, 11678; Payload ID: 16371 relates to Category No.: 14771, 14754, 11678; Payload ID: 16372 relates to Category No.: 14771, 14754, 11861; Payload ID: 16373 relates to Category No.: 14771; Payload ID: 16374 relates to Category No.: 14771, 9518; Payload ID: 16375 relates to Category No.: 14771; Payload ID: 16376 relates to Category No.: 15629, 11861, 9426, 14766, 1193; Payload ID: 16377 relates to Category No.: 15629, 11861, 14766, 1193; Payload ID: 16378 relates to Category No.: 15629, 11861, 9426, 14766, 1193; Payload ID: 16379 relates to Category No.: 15629, 11861; Payload ID: 16380 relates to Category No.: 15629, 11861, 14766, 1193; Payload ID: 16381 relates to Category No.: 15629, 6229, 11861, 14766, 11811; Payload ID: 16382 relates to Category No.: 15629, 11861, 14766, 1193, 9426; Payload ID: 16383 relates to Category No.: 15629, 11861, 14766; Payload ID: 16384 relates to Category No.: 15629, 11861, 15411, 14766; Payload ID: 16385 relates to Category No.: 15629, 11861, 14766; Payload ID: 16386 relates to Category No.: 15629, 11861, 14766; Payload ID: 16387 relates to Category No.: 15629, 11861, 14766; Payload ID: 16388 relates to Category No.: 14379, 10154; Payload ID: 16389 relates to Category No.: 5259; Payload ID: 16390 relates to Category No.: 4820, 8957, 14784, 11861; Payload ID: 16391 relates to Category No.: 4820, 8957, 11861, 9608, 14784; Payload ID: 16392 relates to Category No.: 4820, 11861, 14784, 12402; Payload ID: 16393 relates to Category No.: 4820, 8957, 11861, 14784; Payload ID: 16394 relates to Category No.: 4820, 8957, 11861, 14784; Payload ID: 16395 relates to Category No.: 3303, 9226, 14196, 10116, 11861, 14322; Payload ID: 16396 relates to Category No.: 3303, 11933, 4894, 14107, 4924, 11861, 12389, 14537; Payload ID: 16397 relates to Category No.: 3303, 11933, 14107, 4924, 11861, 12389; Payload ID: 16398 relates to Category No.: 1405, 16331, 9619, 11861, 7236, 6027, 9592, 4710, 4720; Payload ID: 16399 relates to Category No.: 267, 5538, 11861, 2936, 14538, 11981; Payload ID: 16400 relates to Category No.: 6816, 15021, 10116, 11861, 2931, 15024, 11920; Payload ID: 16401 relates to Category No.: 15021, 11861, 16184, 15504; Payload ID: 16402 relates to Category No.: 16331, 9518, 1504, 7472, 6180, 3504, 5347; Payload ID: 16403 relates to Category No.: 1434, 1405, 11933, 12402, 1404, 11861, 5347, 5841, 11828, 13735; Payload ID: 16404 relates to Category No.: 11861, 3752, 8858, 8855, 8967, 9094; Payload ID: 16405 relates to Category No.: 15617, 467, 11861, 1146, 6334; Payload ID: 16406 relates to Category No.: 11861, 8960; Payload ID: 16407 relates to Category No.: 8960, 11861; Payload ID: 16408 relates to Category No.: 8960, 11861; Payload ID: 16409 relates to Category No.: 9857, 11939, 11933, 5538, 11861, 3774, 5347, 15545, 6118; Payload ID: 16410 relates to Category No.: 9857, 56, 11861, 943; Payload ID: 16411 relates to Category No.: 9857, 11861, 9865; Payload ID: 16412 relates to Category No.: 9857, 11861, 3752; Payload ID: 16413 relates to Category No.: 9857, 9882; Payload ID: 16414 relates to Category No.: 9857, 9880; Payload ID: 16415 relates to Category No.: 9857, 11861; Payload ID: 16416 relates to Category No.: 9857, 5347; Payload ID: 16417 relates to Category No.: 11895, 12402, 9857, 11861, 6337; Payload ID: 16418 relates to Category No.: 9857, 11861, 9887; Payload ID: 16419 relates to Category No.: 9857, 11861, 9882; Payload ID: 16420 relates to Category No.: 11939, 11933, 9857, 5538, 11861, 3774, 15545, 6118; Payload ID: 16421 relates to Category No.: 11861, 9882, 9887, 9857; Payload ID: 16422 relates to Category No.: 9857; Payload ID: 16423 relates to Category No.: 9857, 9882, 9890, 9888; Payload ID: 16424 relates to Category No.: 9857, 7192, 15820; Payload ID: 16425 relates to Category No.: 9857, 6974; Payload ID: 16426 relates to Category No.: 9857, 11861, 9890, 9882, 9880, 12081, 9888; Payload ID: 16427 relates to Category No.: 9857, 11861; Payload ID: 16428 relates to Category No.: 9857, 11861; Payload ID: 16429 relates to Category No.: 9857, 11861, 5347; Payload ID: 16430 relates to Category No.: 9857, 5538, 11861, 3774, 15545, 6118; Payload ID: 16431 relates to Category No.: 11933, 9857, 11861, 3505; Payload ID: 16432 relates to Category No.: 11939, 11933, 9857, 11861, 3505, 15820; Payload ID: 16433 relates to Category No.: 9857, 11861; Payload ID: 16434 relates to Category No.: 9857, 11861, 5347; Payload ID: 16435 relates to Category No.: 11861, 11939, 15895, 9857, 56, 848; Payload ID: 16436 relates to Category No.: 9882, 9887, 9857; Payload ID: 16437 relates to Category No.: 9857, 11861, 9882; Payload ID: 16438 relates to Category No.: 9857, 11861; Payload ID: 16439 relates to Category No.: 11861; Payload ID: 16440 relates to Category No.: 11861; Payload ID: 16441 relates to Category No.: 11861; Payload ID: 16442 relates to Category No.: 11861; Payload ID: 16443 relates to Category No.: 14251, 14471, 3303, 6816, 15503, 14471, 14234, 11939, 1178, 14471, 11895, 15504, 3459, 15524, 5109, 14243, 11861, 2691, 14244, 5235, 15528, 14233, 14237, 2690, 3731, 5101; Payload ID: 16444 relates to Category No.: 3303, 11939, 2405, 15504, 15491, 2874, 15495, 11920, 11861, 5347, 5957, 2418, 16331; Payload ID: 16445 relates to Category No.: 3303, 16331, 14564, 2405, 11861; Payload ID: 16446 relates to Category No.: 2405, 3303, 16331, 15503, 14471, 11861; Payload ID: 16447 relates to Category No.: 3303, 16331, 2405, 11861; Payload ID: 16448 relates to Category No.: 3303, 6816, 14251, 14471, 5109, 11861; Payload ID: 16449 relates to Category No.: 6816, 14251, 14471, 14243, 11861, 15530, 14233, 2405, 3459, 14237, 2690; Payload ID: 16450 relates to Category No.: 6816, 14251, 14471, 15491, 11861, 3303, 15503, 14471; Payload ID: 16451 relates to Category No.: 6816, 14243, 14471; Payload ID: 16452 relates to Category No.: 3303, 6816; Payload ID: 16453 relates to Category No.: 3303, 6816, 2999, 11861; Payload ID: 16454 relates to Category No.: 3303, 6816, 9226; Payload ID: 16455 relates to Category No.: 3303, 6816; Payload ID: 16456 relates to Category No.: 3303, 6816, 15503, 14471, 14471, 15524, 1153, 11861, 5108, 15530, 14233, 2405, 14234, 9226; Payload ID: 16457 relates to Category No.: 6816, 15503, 14471, 14471, 15524, 11861, 9226; Payload ID: 16458 relates to Category No.: 6816, 15503, 14471, 14471, 15524, 9226; Payload ID: 16459 relates to Category No.: 6816, 15503, 14471, 14471, 15524, 11861, 9226; Payload ID: 16460 relates to Category No.: 11861; Payload ID: 16461 relates to Category No.: 7192; Payload ID: 16462 relates to Category No.: 11861, 7192; Payload ID: 16463 relates to Category No.: 11861; Payload ID: 16469 relates to Category No.: 1405, 11861; Payload ID: 16470 relates to Category No.: 1405, 11861, 4720, 5009; Payload ID: 16471 relates to Category No.: 1405, 2858, 14504, 11861, 6826; Payload ID: 16472 relates to Category No.: 1405, 11861, 4720, 4016; Payload ID: 16473 relates to Category No.: 1405, 11861, 6826, 4720; Payload ID: 16474 relates to Category No.: 1405, 11861; Payload ID: 16475 relates to Category No.: 11861; Payload ID: 16476 relates to Category No.: 15895, 11861; Payload ID: 16477 relates to Category No.: 11861, 1680; Payload ID: 16478 relates to Category No.: 926, 16331, 15973, 6825, 9619, 11861; Payload ID: 16479 relates to Category No.: 926, 6965, 598, 11861, 6988, 1173; Payload ID: 16489 relates to Category No.: 11861; Payload ID: 16490 relates to Category No.: 11861; Payload ID: 16491 relates to Category No.: 4820, 4809, 11861, 5347, 3752; Payload ID: 16492 relates to Category No.: 15895, 11861, 14252; Payload ID: 16493 relates to Category No.: 11861; Payload ID: 16494 relates to Category No.: 267, 11939, 277, 10116, 11861, 5347, 6022; Payload ID: 16495 relates to Category No.: 267, 11861; Payload ID: 16496 relates to Category No.: 277, 11861; Payload ID: 16497 relates to Category No.: 11861; Payload ID: 16498 relates to Category No.: 1405, 15021, 277, 11861, 11933; Payload ID: 16499 relates to Category No.: 1405, 267, 15021, 1457, 11861, 11933, 11886, 12064, 15180; Payload ID: 16500 relates to Category No.: 267, 15021, 277, 11861, 712, 11933; Payload ID: 16501 relates to Category No.: 267, 15021, 9939, 1457, 10116, 11861, 4896, 712; Payload ID: 16502 relates to Category No.: 267, 15021, 9939, 11861; Payload ID: 16503 relates to Category No.: 267, 15021, 11861, 9939, 9805, 14812, 712; Payload ID: 16504 relates to Category No.: 267, 5960, 11861, 14812, 12107, 3505, 3512, 7409; Payload ID: 16505 relates to Category No.: 11981; Payload ID: 16506 relates to Category No.: 11981; Payload ID: 16507 relates to Category No.: 11981; Payload ID: 16509 relates to Category No.: 11981, 11861; Payload ID: 16511 relates to Category No.: 11981; Payload ID: 16512 relates to Category No.: 11981; Payload ID: 16515 relates to Category No.: 11978, 926, 12109, 11861; Payload ID: 16516 relates to Category No.: 9282, 9226, 10116, 11861, 15530, 14252, 14252, 15503, 14471, 15495, 14597; Payload ID: 16518 relates to Category No.: 6446, 11861; Payload ID: 16520 relates to Category No.: 6446; Payload ID: 16521 relates to Category No.: 6446; Payload ID: 16523 relates to Category No.: 5295; Payload ID: 16524 relates to Category No.: 11861; Payload ID: 16525 relates to Category No.: 11861; Payload ID: 16526 relates to Category No.: 4886, 5308, 11861; Payload ID: 16528 relates to Category No.: 7192; Payload ID: 16529 relates to Category No.: 11861, 11981; Payload ID: 16530 relates to Category No.: 11861; Payload ID: 16531 relates to Category No.: 15029, 11861, 11854; Payload ID: 16532 relates to Category No.: 11861; Payload ID: 16533 relates to Category No.: 11861, 1201; Payload ID: 16534 relates to Category No.: 9226; Payload ID: 16535 relates to Category No.: 6965, 11861, 7192; Payload ID: 16536 relates to Category No.: 12416, 6610, 5914, 5960, 11861, 7128; Payload ID: 16537 relates to Category No.: 1457, 11861; Payload ID: 16538 relates to Category No.: 11861; Payload ID: 16539 relates to Category No.: 11861, 7192; Payload ID: 16540 relates to Category No.: 11861, 11917; Payload ID: 16541 relates to Category No.: 11861, 7192; Payload ID: 16542 relates to Category No.: 11861; Payload ID: 16543 relates to Category No.: 12402, 277, 267; Payload ID: 16544 relates to Category No.: 11861; Payload ID: 16546 relates to Category No.: 3303, 10116, 11861, 3464, 14602; Payload ID: 16548 relates to Category No.: 11861, 7192; Payload ID: 16549 relates to Category No.: 11917, 14243, 15503, 14471, 15528, 14255; Payload ID: 16550 relates to Category No.: 3303, 11917; Payload ID: 16552 relates to Category No.: 14107, 4924, 11861, 12364; Payload ID: 16554 relates to Category No.: 11861, 1457; Payload ID: 16555 relates to Category No.: 11861; Payload ID: 16557 relates to Category No.: 11861, 7192; Payload ID: 16558 relates to Category No.: 1630, 11861; Payload ID: 16559 relates to Category No.: 1405; Payload ID: 16560 relates to Category No.: 11861; Payload ID: 16561 relates to Category No.: 11861, 3303, 11939; Payload ID: 16562 relates to Category No.: 7192; Payload ID: 16564 relates to Category No.: 7192; Payload ID: 16565 relates to Category No.: 267; Payload ID: 16567 relates to Category No.: 11861, 7192; Payload ID: 16569 relates to Category No.: 926; Payload ID: 16570 relates to Category No.: 926; Payload ID: 16571 relates to Category No.: 7405; Payload ID: 16573 relates to Category No.: 11861; Payload ID: 16574 relates to Category No.: 11861; Payload ID: 16577 relates to Category No.: 11861, 10116; Payload ID: 16578 relates to Category No.: 11861, 10116; Payload ID: 16579 relates to Category No.: 15503, 14471, 3303, 11861; Payload ID: 16580 relates to Category No.: 11939, 1630, 14844; Payload ID: 16581 relates to Category No.: 7462; Payload ID: 16582 relates to Category No.: 7462, 11861, 3224; Payload ID: 16583 relates to Category No.: 7462, 3224; Payload ID: 16584 relates to Category No.: 9518, 10130, 14851, 9118, 7426; Payload ID: 16585 relates to Category No.: 14849; Payload ID: 16588 relates to Category No.: 8959, 15793, 15797; Payload ID: 16589 relates to Category No.: 16331, 9226, 6816; Payload ID: 16590 relates to Category No.: 15908, 11861; Payload ID: 16591 relates to Category No.: 15893, 11861, 5347; Payload ID: 16593 relates to Category No.: 5308, 5308, 313, 11861, 14871; Payload ID: 16594 relates to Category No.: 6816, 14871; Payload ID: 16595 relates to Category No.: 6816, 14871, 11861; Payload ID: 16596 relates to Category No.: 14872, 6816, 14871; Payload ID: 16597 relates to Category No.: 5308, 5308, 313, 11861, 14871; Payload ID: 16598 relates to Category No.: 5308, 5308, 313, 7192, 14871; Payload ID: 16599 relates to Category No.: 11861; Payload ID: 16600 relates to Category No.: 5956, 14873, 2208; Payload ID: 16601 relates to Category No.: 926, 3303, 6478, 5956, 14879, 1457, 11861, 12077, 14854, 3110; Payload ID: 16602 relates to Category No.: 926, 5956, 14879, 11861, 12388, 14854, 3110; Payload ID: 16603 relates to Category No.: 1537, 12292, 11861, 14856; Payload ID: 16604 relates to Category No.: 14878; Payload ID: 16605 relates to Category No.: 14878; Payload ID: 16606 relates to Category No.: 4820, 14879, 4821, 14861; Payload ID: 16607 relates to Category No.: 4820, 5588, 6210, 14879, 4821, 11861; Payload ID: 16608 relates to Category No.: 4820, 5588, 6210, 14879, 11861; Payload ID: 16609 relates to Category No.: 4820, 6210, 14879; Payload ID: 16610 relates to Category No.: 4820, 14879; Payload ID: 16611 relates to Category No.: 11861, 11973; Payload ID: 16612 relates to Category No.: 14196, 15503, 14471, 14471, 14251, 14471, 11861, 2688, 15503, 14239, 14252, 14240, 9012, 15528, 14233, 15530, 14233, 3303, 14234, 15528, 14239, 14237, 15503, 14233; Payload ID: 16613 relates to Category No.: 15503, 14471, 14471; Payload ID: 16614 relates to Category No.: 15503, 14471, 14471, 14251, 14471; Payload ID: 16616 relates to Category No.: 6965, 11861; Payload ID: 16617 relates to Category No.: 6965, 11861; Payload ID: 16618 relates to Category No.: 11861; Payload ID: 16619 relates to Category No.: 11861, 3752, 5966; Payload ID: 16620 relates to Category No.: 6900, 11861; Payload ID: 16621 relates to Category No.: 7192; Payload ID: 16625 relates to Category No.: 14866, 11861; Payload ID: 16626 relates to Category No.: 14866; Payload ID: 16627 relates to Category No.: 14866; Payload ID: 16628 relates to Category No.: 267; Payload ID: 16629 relates to Category No.: 267; Payload ID: 16630 relates to Category No.: 11861; Payload ID: 16631 relates to Category No.: 11861, 7192; Payload ID: 16632 relates to Category No.: 11861; Payload ID: 16633 relates to Category No.: 11861; Payload ID: 16634 relates to Category No.: 11978, 926, 12109, 9096, 5588, 12145, 11861, 11981, 12421; Payload ID: 16635 relates to Category No.: 16331, 9226, 14196, 15495, 10116, 11861, 11701; Payload ID: 16636 relates to Category No.: 14196, 10116, 11861; Payload ID: 16637 relates to Category No.: 16331, 9226, 10116, 11861; Payload ID: 16638 relates to Category No.: 16331, 9226, 10116, 11861; Payload ID: 16639 relates to Category No.: 10116, 7268, 11861, 1201, 2405; Payload ID: 16640 relates to Category No.: 11861, 10116; Payload ID: 16641 relates to Category No.: 9226, 14196, 11861; Payload ID: 16642 relates to Category No.: 9282, 9226, 10116, 11861; Payload ID: 16644 relates to Category No.: 9282, 9226, 10116; Payload ID: 16645 relates to Category No.: 9282, 9226, 2405, 15524, 5109, 10116, 11861, 2688, 15525, 14240; Payload ID: 16646 relates to Category No.: 14196; Payload ID: 16647 relates to Category No.: 9282, 9226, 10116, 11861; Payload ID: 16648 relates to Category No.: 11861; Payload ID: 16649 relates to Category No.: 926, 3303, 5308, 1630; Payload ID: 16650 relates to Category No.: 16331; Payload ID: 16651 relates to Category No.: 11861; Payload ID: 16652 relates to Category No.: 6816, 11861, 735, 6242; Payload ID: 16653 relates to Category No.: 11861; Payload ID: 16654 relates to Category No.: 11981, 11861, 12110, 12108; Payload ID: 16655 relates to Category No.: 7192; Payload ID: 16656 relates to Category No.: 11861; Payload ID: 16657 relates to Category No.: 11981, 11861, 9805, 12110, 14947; Payload ID: 16658 relates to Category No.: 11981, 11861, 12110, 14947; Payload ID: 16660 relates to Category No.: 3303, 6816, 5923, 11861, 15887; Payload ID: 16661 relates to Category No.: 11861; Payload ID: 16662 relates to Category No.: 11861, 7192; Payload ID: 16663 relates to Category No.: 11861; Payload ID: 16664 relates to Category No.: 10116, 11861; Payload ID: 16665 relates to Category No.: 3303, 5105, 7192, 14221; Payload ID: 16666 relates to Category No.: 15493, 11861; Payload ID: 16667 relates to Category No.: 3303, 11933, 15491, 5096; Payload ID: 16668 relates to Category No.: 16331, 15503, 14471, 11933, 11861; Payload ID: 16669 relates to Category No.: 11933, 10116, 11861, 3752, 2405; Payload ID: 16670 relates to Category No.: 3303, 9226, 15503, 14471, 5105, 10116, 11861; Payload ID: 16671 relates to Category No.: 15491, 11861, 5096; Payload ID: 16673 relates to Category No.:

4207, 9518, 14929, 4075; Payload ID: 16674 relates to Category No.: 10116, 11861; Payload ID: 16675 relates to Category No.: 9282, 9226, 5105, 10116, 11861, 15872, 15861, 15915, 15874; Payload ID: 16676 relates to Category No.: 9282, 9226, 10116, 11861; Payload ID: 16677 relates to Category No.: 11861, 14538; Payload ID: 16678 relates to Category No.: 11861; Payload ID: 16680 relates to Category No.: 11861; Payload ID: 16681 relates to Category No.: 11981, 11861, 14536, 14537, 12081, 14538, 11886; Payload ID: 16682 relates to Category No.: 11861, 14538; Payload ID: 16683 relates to Category No.: 11981, 11861; Payload ID: 16684 relates to Category No.: 11978, 926, 4976, 5956, 12402, 9096, 5588, 12145, 11861, 14536, 5841, 3752, 5264, 5957, 14538, 14377, 4867, 9961, 3765, 11920, 11981, 3936, 11895, 1706, 11886, 5538, 11983; Payload ID: 16685 relates to Category No.: 11861, 14538; Payload ID: 16686 relates to Category No.: 11861, 12064, 14538; Payload ID: 16687 relates to Category No.: 11978, 926, 12402, 9096, 12145, 11861; Payload ID: 16688 relates to Category No.: 15973, 11861, 11886; Payload ID: 16689 relates to Category No.: 16331, 9226, 11861; Payload ID: 16691 relates to Category No.: 14196, 11920; Payload ID: 16692 relates to Category No.: 16331, 10116, 11861; Payload ID: 16693 relates to Category No.: 9282, 9226, 10116; Payload ID: 16694 relates to Category No.: 9282, 9226, 14196, 11861, 14219; Payload ID: 16695 relates to Category No.: 11978, 926, 6478, 12109, 10116, 11861; Payload ID: 16696 relates to Category No.: 11978, 926, 6478, 12109, 10116, 11861, 37; Payload ID: 16697 relates to Category No.: 11978, 926, 12109, 11861; Payload ID: 16698 relates to Category No.: 3303, 15503, 14471, 11861, 2691, 15528, 14233, 14471, 14234; Payload ID: 16699 relates to Category No.: 15491, 11861, 5347, 14240, 14251, 14471, 3303, 15503, 14471, 15504, 2405, 14234, 15524, 15528, 14252, 15503, 14239; Payload ID: 16700 relates to Category No.: 15503, 14471, 15525, 15528, 14233, 15591, 14196, 14246, 14237, 3732, 11861; Payload ID: 16701 relates to Category No.: 3303, 15525, 15528, 14233, 14246; Payload ID: 16702 relates to Category No.: 15503, 14471, 14471, 11861, 14243; Payload ID: 16703 relates to Category No.: 14471, 11861, 14251, 14471, 11933, 2405; Payload ID: 16704 relates to Category No.: 3303, 15503, 14471, 11861, 14251, 14471, 11933, 2405; Payload ID: 16705 relates to Category No.: 15504, 15524, 1153, 11861, 15503, 14239, 14251, 14471, 3303, 15503, 14471, 15491, 14471, 11933, 15528, 14255; Payload ID: 16706 relates to Category No.: 14234, 15524, 15528, 14233, 14251, 14471, 3303, 15503, 14471, 11861, 14471, 11933; Payload ID: 16707 relates to Category No.: 3303, 15503, 14471, 14471, 15524, 11861, 7010, 14251, 14471, 11933, 2405, 2406, 15525, 15528, 14233; Payload ID: 16708 relates to Category No.: 3303, 15503, 14471, 14251, 14471; Payload ID: 16709 relates to Category No.: 3303, 15503, 14471, 14249, 14237; Payload ID: 16710 relates to Category No.: 14471, 14251, 14471, 11861; Payload ID: 16711 relates to Category No.: 15503, 14471, 11861, 2691, 15525, 15528, 14233, 14246, 9227, 14251, 14471, 11933; Payload ID: 16712 relates to Category No.: 15503, 14471, 11861, 14251, 14471, 3303, 11933, 15524; Payload ID: 16713 relates to Category No.: 3303, 15503, 14471, 11861, 14471, 11933, 15524; Payload ID: 16714 relates to Category No.: 15503, 14471, 15524, 11861, 14471, 15503, 14239; Payload ID: 16715 relates to Category No.: 3303, 14237, 14251, 14471, 15503, 14471, 11861, 15504, 14471, 11933; Payload ID: 16716 relates to Category No.: 11978, 15503, 14471, 2405, 11861, 2691, 15528, 14233, 15503, 14239, 11974, 3731, 3732, 14251, 14471, 3303, 14471, 11933, 15524, 15528, 14255, 1153, 11704, 15525, 1178; Payload ID: 16718 relates to Category No.: 9962, 11861, 2773; Payload ID: 16719 relates to Category No.: 926, 6816, 159; Payload ID: 16720 relates to Category No.: 14552, 1160; Payload ID: 16721 relates to Category No.: 14552, 1160; Payload ID: 16722 relates to Category No.: 1160, 7451, 14552; Payload ID: 16723 relates to Category No.: 14552, 7227, 1160, 11861; Payload ID: 16724 relates to Category No.: 14552, 1160, 8843, 6004; Payload ID: 16725 relates to Category No.: 14552, 1160, 1161; Payload ID: 16726 relates to Category No.: 14552, 591; Payload ID: 16727 relates to Category No.: 14552; Payload ID: 16728 relates to Category No.: 14552, 591; Payload ID: 16729 relates to Category No.: 14552, 591, 2; Payload ID: 16730 relates to Category No.: 14552, 591; Payload ID: 16731 relates to Category No.: 14552, 591; Payload ID: 16732 relates to Category No.: 14552, 11861, 1162; Payload ID: 16733 relates to Category No.: 1630, 14552, 1162; Payload ID: 16734 relates to Category No.: 14552, 593; Payload ID: 16735 relates to Category No.: 14552, 14548, 593; Payload ID: 16736 relates to Category No.: 14552, 14548, 593; Payload ID: 16737 relates to Category No.: 14552, 14548, 593; Payload ID: 16738 relates to Category No.: 14552, 11861, 593; Payload ID: 16739 relates to Category No.: 14552; Payload ID: 16740 relates to Category No.: 1405, 11919, 14379, 5293, 11861, 6341, 6334; Payload ID: 16741 relates to Category No.: 1405, 11919, 14379, 5293, 11861, 6341, 6334; Payload ID: 16742 relates to Category No.: 6965, 11861; Payload ID: 16744 relates to Category No.: 6816, 15911, 6829, 11920, 11861; Payload ID: 16745 relates to Category No.: 6816, 6829, 11861, 9619; Payload ID: 16747 relates to Category No.: 5259; Payload ID: 16748 relates to Category No.: 11939, 4976, 5259, 3752, 11861; Payload ID: 16749 relates to Category No.: 9226, 9225, 10116, 11861, 15493; Payload ID: 16750 relates to Category No.: 1504, 11861, 4684, 14938; Payload ID: 16751 relates to Category No.: 2360, 2346; Payload ID: 16752 relates to Category No.: 6210, 11861; Payload ID: 16753 relates to Category No.: 4894, 6210, 11861; Payload ID: 16754 relates to Category No.: 2360, 6210, 11861, 2346; Payload ID: 16755 relates to Category No.: 6210; Payload ID: 16756 relates to Category No.: 6210, 1185; Payload ID: 16757 relates to Category No.: 6210; Payload ID: 16758 relates to Category No.: 6210; Payload ID: 16759 relates to Category No.: 4894, 6210; Payload ID: 16760 relates to Category No.: 926, 6974, 6965, 955, 10101, 6210, 11861; Payload ID: 16761 relates to Category No.: 5314; Payload ID: 16762 relates to Category No.: 14564, 11861, 15766; Payload ID: 16763 relates to Category No.: 11861, 1439, 15766; Payload ID: 16764 relates to Category No.: 15766; Payload ID: 16765 relates to Category No.: 11920, 15766, 11861; Payload ID: 16766 relates to Category No.: 15766; Payload ID: 16767 relates to Category No.: 10116, 11861, 14196, 12076, 3464; Payload ID: 16768 relates to Category No.: 3464, 10116, 11861; Payload ID: 16769 relates to Category No.: 11978, 926, 11939, 12109, 11861, 5347; Payload ID: 16770 relates to Category No.: 11978, 926, 11861, 5957, 11977, 12108; Payload ID: 16771 relates to Category No.: 11978, 926, 11861; Payload ID: 16773 relates to Category No.: 2796, 4154, 6816, 15629; Payload ID: 16774 relates to Category No.: 6816, 11861, 2796, 4154; Payload ID: 16775 relates to Category No.: 6816, 2796, 4154; Payload ID: 16776 relates to Category No.: 5865, 9518, 14942; Payload ID: 16777 relates to Category No.: 6816, 9518, 14942; Payload ID: 16778 relates to Category No.: 14196, 10116, 7268, 11861, 5223, 5224; Payload ID: 16780 relates to Category No.: 11861, 1201; Payload ID: 16781 relates to Category No.:

11861; Payload ID: 16782 relates to Category No.: 11861; Payload ID: 16783 relates to Category No.: 15491, 11861, 12107, 9771, 14361; Payload ID: 16784 relates to Category No.: 11861; Payload ID: 16785 relates to Category No.: 11861; Payload ID: 16786 relates to Category No.: 11861; Payload ID: 16787 relates to Category No.: 11861; Payload ID: 16788 relates to Category No.: 11861; Payload ID: 16789 relates to Category No.: 10116, 15598, 11861, 14196; Payload ID: 16790 relates to Category No.: 14196, 11861, 10116; Payload ID: 16791 relates to Category No.: 11861; Payload ID: 16792 relates to Category No.: 11861; Payload ID: 16793 relates to Category No.: 11861, 15542, 7192; Payload ID: 16794 relates to Category No.: 11861; Payload ID: 16795 relates to Category No.: 11861; Payload ID: 16796 relates to Category No.: 9518, 319, 9518, 319, 7477, 121, 2342; Payload ID: 16797 relates to Category No.: 6185, 15491, 11861, 6184; Payload ID: 16798 relates to Category No.: 6816, 1630, 15093, 14990; Payload ID: 16799 relates to Category No.: 3554, 9518, 319, 121, 2342, 611, 7515; Payload ID: 16800 relates to Category No.: 9518, 319, 121, 2342, 14977, 611; Payload ID: 16801 relates to Category No.: 2360, 6210, 11861, 2346; Payload ID: 16802 relates to Category No.: 1630, 12402, 4117, 11861, 15542, 15549, 2346, 6309, 9870, 14987, 9329, 11795; Payload ID: 16803 relates to Category No.: 9314, 4117, 11861, 2346, 2357, 14983; Payload ID: 16804 relates to Category No.: 9314, 15542, 15548, 4117, 2346, 2357, 14983; Payload ID: 16805 relates to Category No.: 11917, 3303, 15503, 14471, 11861, 14985, 11981, 14471, 2405, 15524, 11886, 14234, 15528, 14233; Payload ID: 16806 relates to Category No.: 14234, 11895, 11917, 11861, 15530, 14233, 3530, 3303, 15503, 14471, 15524; Payload ID: 16807 relates to Category No.: 5865, 9518, 1361; Payload ID: 16808 relates to Category No.: 3303, 3459, 11861; Payload ID: 16810 relates to Category No.: 11917, 11861; Payload ID: 16811 relates to Category No.: 11861; Payload ID: 16812 relates to Category No.: 15908, 11939, 15895, 15893, 11861, 1327, 6188, 4821, 14652, 11861, 15894, 3752, 15916, 5957, 5282, 15473, 5280, 7017; Payload ID: 16813 relates to Category No.: 11861, 14218, 5347, 11939; Payload ID: 16814 relates to Category No.: 11861, 7192, 5843; Payload ID: 16815 relates to Category No.: 12402, 11861, 4896, 1593; Payload ID: 16816 relates to Category No.: 7192, 11861; Payload ID: 16819 relates to Category No.: 11861; Payload ID: 16820 relates to Category No.: 11861; Payload ID: 16821 relates to Category No.: 14243, 11861; Payload ID: 16822 relates to Category No.: 7192; Payload ID: 16823 relates to Category No.: 11920, 11861, 11985, 11981, 9961; Payload ID: 16824 relates to Category No.: 7192; Payload ID: 16825 relates to Category No.: 11861; Payload ID: 16826 relates to Category No.: 11861; Payload ID: 16827 relates to Category No.: 11861; Payload ID: 16828 relates to Category No.: 10116, 11861, 11895, 2271, 5280; Payload ID: 16829 relates to Category No.: 11861, 7192; Payload ID: 16830 relates to Category No.: 7192; Payload ID: 16831 relates to Category No.: 840, 1457, 11861, 3936, 11886, 12077; Payload ID: 16832 relates to Category No.: 15503, 14471, 840, 1457, 11861, 11886, 12077; Payload ID: 16833 relates to Category No.: 840, 1457, 11861, 11886, 12077, 11920; Payload ID: 16834 relates to Category No.: 11861, 1201, 2405, 15528, 14255; Payload ID: 16835 relates to Category No.: 1201, 11861, 2405, 15528, 14255; Payload ID: 16836 relates to Category No.: 1201, 11861; Payload ID: 16837 relates to Category No.: 1405, 11861, 5347; Payload ID: 16838 relates to Category No.: 3416; Payload ID: 16839 relates to Category No.: 3416, 943, 2271, 7017; Payload ID: 16840 relates to Category No.: 1404, 11861, 1405, 5347, 11828, 6979; Payload ID: 16841 relates to Category No.: 11861, 1405, 1404, 14996; Payload ID: 16842 relates to Category No.: 926, 6974, 11933, 2405, 10116, 11861, 6654; Payload ID: 16843 relates to Category No.: 926, 11861, 3303; Payload ID: 16844 relates to Category No.: 926, 11933, 11861; Payload ID: 16845 relates to Category No.: 926, 6974, 11933, 11861, 3508, 2405, 6654; Payload ID: 16846 relates to Category No.: 926, 11933, 11861; Payload ID: 16847 relates to Category No.: 926, 11861; Payload ID: 16848 relates to Category No.: 926, 15895, 11861; Payload ID: 16849 relates to Category No.: 926, 11861; Payload ID: 16850 relates to Category No.: 3303, 2405, 10116, 11861; Payload ID: 16851 relates to Category No.: 9361, 11861, 3411; Payload ID: 16852 relates to Category No.: 3411, 9361; Payload ID: 16853 relates to Category No.: 14706, 14705, 11861; Payload ID: 16854 relates to Category No.: 3303, 14597, 15491, 10116, 11861, 15528, 14239; Payload ID: 16856 relates to Category No.: 11861, 7192; Payload ID: 16858 relates to Category No.: 11861; Payload ID: 16861 relates to Category No.: 4207, 9518, 15049, 11861, 9518, 319, 15050; Payload ID: 16862 relates to Category No.: 6816, 3554, 9518, 5875, 15049, 65, 87, 138, 11861, 15882; Payload ID: 16863 relates to Category No.: 6816, 4976, 3554, 15049, 9518, 319, 15050; Payload ID: 16864 relates to Category No.: 6816, 4976, 3554, 15050, 15882; Payload ID: 16865 relates to Category No.: 4820; Payload ID: 16866 relates to Category No.: 1630, 926, 6816, 11861, 15058; Payload ID: 16867 relates to Category No.: 4886, 1630, 10116, 2559, 15058, 15059; Payload ID: 16868 relates to Category No.: 926, 4886, 1630, 15059; Payload ID: 16869 relates to Category No.: 1630, 15060; Payload ID: 16870 relates to Category No.: 5308, 5311, 1630, 1504, 552, 9345, 15068; Payload ID: 16871 relates to Category No.: 1405, 1630, 15093, 7446, 870; Payload ID: 16872 relates to Category No.: 1405, 1630, 15093, 7446, 870; Payload ID: 16873 relates to Category No.: 6816, 9518, 11861, 11939; Payload ID: 16874 relates to Category No.: 11861, 11939, 6816; Payload ID: 16875 relates to Category No.: 9518, 12352, 15080; Payload ID: 16876 relates to Category No.: 926, 9518, 303, 15082; Payload ID: 16877 relates to Category No.: 4976, 9518, 7197, 7199, 15083, 6816; Payload ID: 16878 relates to Category No.: 15086, 14961, 11861, 14974, 3939, 4215; Payload ID: 16879 relates to Category No.: 15086, 11861; Payload ID: 16880 relates to Category No.: 15086, 11861, 14974, 865, 4215; Payload ID: 16881 relates to Category No.: 15086, 11861, 865, 4215; Payload ID: 16882 relates to Category No.: 15086, 11861, 865; Payload ID: 16883 relates to Category No.: 15086, 865; Payload ID: 16884 relates to Category No.: 15086, 11861, 865; Payload ID: 16885 relates to Category No.: 15086; Payload ID: 16886 relates to Category No.: 15086, 514, 865; Payload ID: 16887 relates to Category No.: 15086; Payload ID: 16888 relates to Category No.: 15086, 11861, 1196; Payload ID: 16889 relates to Category No.: 15086, 11861, 514, 14974; Payload ID: 16890 relates to Category No.: 15086; Payload ID: 16891 relates to Category No.: 2861, 7552; Payload ID: 16892 relates to Category No.: 14666, 3749, 11933, 11895, 11861, 15886, 960, 15095; Payload ID: 16893 relates to Category No.: 2861, 3663, 11861, 15103; Payload ID: 16894 relates to Category No.: 2861, 3663, 11861, 15103; Payload ID: 16895 relates to Category No.: 2861, 11861, 15103; Payload ID: 16896 relates to Category No.: 2861, 11861; Payload ID: 16897 relates to Category No.: 2861, 3663, 11861, 15103, 11920; Payload ID: 16898 relates to Category No.: 2861, 3663, 11861, 15103; Payload ID: 16899 relates to Category No.: 15100; Payload ID: 16901 relates to Category No.: 926, 9226, 14196, 10116, 11861, 14203; Payload ID: 16902 relates to Category No.: 16331, 6816, 11939, 2672, 12363, 11861, 15111, 5347, 2271, 12078, 3752; Payload ID: 16903 relates to Category No.: 6816, 15111, 11861, 9518, 3303, 3752, 9524, 5347, 6574; Payload ID: 16904 relates to Category No.: 16331, 2672, 6816, 5009, 11861, 15111; Payload ID: 16905 relates to Category No.: 267, 277, 11861; Payload ID: 16906 relates to Category No.: 11861, 1327, 11861, 11920, 15973, 11886, 5347, 2271, 5280, 2970; Payload ID: 16907 relates to Category No.: 14503, 14506, 11861; Payload ID: 16908 relates to Category No.: 3303, 16331, 15503, 14471; Payload ID: 16909 relates to Category No.: 12360; Payload ID: 16914 relates to Category No.: 15495, 11861; Payload ID: 16915 relates to Category No.: 11981, 5551, 11861, 11991, 5958; Payload ID: 16916 relates to Category No.: 5551, 11861, 11991, 14538, 5909, 4869; Payload ID: 16917 relates to Category No.: 11861, 11991; Payload ID: 16918 relates to Category No.: 11861, 11991; Payload ID: 16919 relates to Category No.: 11861, 12425, 11991, 3774; Payload ID: 16920 relates to Category No.: 11861, 11991; Payload ID: 16921 relates to Category No.: 11861, 14537; Payload ID: 16922 relates to Category No.: 14564, 15504, 15495, 11981, 11861, 1153; Payload ID: 16923 relates to Category No.: 7192; Payload ID: 16924 relates to Category No.: 11861; Payload ID: 16925 relates to Category No.: 11939, 11933; Payload ID: 16926 relates to Category No.: 16331, 2405, 14351, 5229, 11861, 15525, 12064, 5204, 5210, 14243; Payload ID: 16927 relates to Category No.: 11861, 16331, 5229, 15525, 5210, 6924; Payload ID: 16928 relates to Category No.: 5229, 11861, 5213; Payload ID: 16929 relates to Category No.: 11861, 5213; Payload ID: 16930 relates to Category No.: 7192; Payload ID: 16933 relates to Category No.: 6229, 1504; Payload ID: 16934 relates to Category No.: 1504; Payload ID: 16935 relates to Category No.: 3749, 4821; Payload ID: 16936 relates to Category No.: 11861; Payload ID: 16937 relates to Category No.: 1504, 11861; Payload ID: 16938 relates to Category No.: 11861, 2873; Payload ID: 16939 relates to Category No.: 7192; Payload ID: 16940 relates to Category No.: 11861; Payload ID: 16941 relates to Category No.: 3303, 14196, 10116; Payload ID: 16942 relates to Category No.: 3303, 14196, 10116; Payload ID: 16943 relates to Category No.: 14196, 9226, 10116, 11861; Payload ID: 16944 relates to Category No.: 9226, 14196, 10116; Payload ID: 16945 relates to Category No.: 14196, 10116, 11861; Payload ID: 16946 relates to Category No.: 14196, 11861, 5347; Payload ID: 16947 relates to Category No.: 14196, 11861, 5347; Payload ID: 16948 relates to Category No.: 1405, 11861; Payload ID: 16949 relates to Category No.: 14379, 11861, 10154; Payload ID: 16952 relates to Category No.: 5293; Payload ID: 16953 relates to Category No.: 11861, 7192; Payload ID: 16954 relates to Category No.: 1405, 11861; Payload ID: 16955 relates to Category No.: 1405, 11861, 2405; Payload ID: 16956 relates to Category No.: 11861; Payload ID: 16957 relates to Category No.: 12402, 11861, 5347, 5020; Payload ID: 16958 relates to Category No.: 926, 3303, 14196, 11939, 4965, 5308, 305, 961, 3464, 10116, 11861, 3325, 95; Payload ID: 16960 relates to Category No.: 6816, 6900, 11861, 5204, 14196, 14471, 2405, 14237, 2406; Payload ID: 16961 relates to Category No.: 15619, 5847, 15046; Payload ID: 16962 relates to Category No.: 15619, 15046; Payload ID: 16963 relates to Category No.: 1405, 11861, 3303, 926; Payload ID: 16964 relates to Category No.: 926, 3303, 9226, 4965, 5308, 305, 3385, 5308, 305, 5405, 9275, 11861, 714, 9280; Payload ID: 16965 relates to Category No.: 926, 942, 5105, 5308, 305, 11861, 4965, 15524, 15491, 3385, 14246, 2405; Payload ID: 16966 relates to Category No.: 926, 14234, 4965, 9539, 5105, 5308, 305, 15491, 3385, 15495, 9271, 11861, 12064, 14240, 15229, 3347, 6427, 14246, 686, 11886, 2405, 942; Payload ID: 16967 relates to Category No.: 926, 3303, 9226, 942, 4965, 5105, 5308, 305, 5308, 305, 5405, 9275, 11861; Payload ID: 16968 relates to Category No.: 926, 4965, 3385, 11861, 714; Payload ID: 16969 relates to Category No.: 3303, 14234, 9539, 15491, 9271, 11861, 14240, 15229; Payload ID: 16970 relates to Category No.: 3303, 14234, 15491, 9271, 11861, 12064, 14240, 2405; Payload ID: 16971 relates to Category No.: 3303, 14234, 15491, 9271, 11861, 14240, 2405; Payload ID: 16972 relates to Category No.: 11890, 15491, 11861, 12402, 2405; Payload ID: 16973 relates to Category No.: 14234, 15491, 9271, 11861, 14240; Payload ID: 16974 relates to Category No.: 15504, 12402, 15491, 11861, 6185, 9173, 6184, 2405; Payload ID: 16975 relates to Category No.: 7462, 14234, 2405, 15491, 9271, 11861, 12064, 14240, 6184, 14196; Payload ID: 16976 relates to Category No.: 926, 3303, 9226, 4965, 11861; Payload ID: 16977 relates to Category No.: 11861; Payload ID: 16978 relates to Category No.: 11861, 6185; Payload ID: 16979 relates to Category No.: 942, 14597, 11861; Payload ID: 16981 relates to Category No.: 10116, 11861; Payload ID: 16982 relates to Category No.: 11861, 1201; Payload ID: 16984 relates to Category No.: 4894; Payload ID: 16985 relates to Category No.: 4894, 11861; Payload ID: 16986 relates to Category No.: 11939, 11861, 4578; Payload ID: 16988 relates to Category No.: 926, 15629, 267, 1630, 11981, 11861, 1439; Payload ID: 16989 relates to Category No.: 926, 1630; Payload ID: 16990 relates to Category No.: 926, 1630; Payload ID: 16991 relates to Category No.: 4894, 11861, 14537, 11981; Payload ID: 16992 relates to Category No.: 15629, 15619, 11981, 12399, 11861; Payload ID: 16993 relates to Category No.: 15629, 15619, 11861; Payload ID: 16994 relates to Category No.: 15629, 15619, 11861; Payload ID: 16995 relates to Category No.: 11861; Payload ID: 16996 relates to Category No.: 11861; Payload ID: 16997 relates to Category No.: 11861, 14536, 12064; Payload ID: 16999 relates to Category No.: 9282, 9226, 9975, 11861, 9886, 9864, 11895, 11886, 14537, 14196, 5531; Payload ID: 17000 relates to Category No.: 9282, 9226, 14196, 11861, 9975, 9886, 5308; Payload ID: 17001 relates to Category No.: 11861, 15822, 11895; Payload ID: 17002 relates to Category No.: 11861; Payload ID: 17004 relates to Category No.: 11861; Payload ID: 17005 relates to Category No.: 11861; Payload ID: 17006 relates to Category No.: 3303, 11861; Payload ID: 17007 relates to Category No.: 3303, 11861, 11933; Payload ID: 17009 relates to Category No.: 3303, 11861, 11933; Payload ID: 17010 relates to Category No.: 15629, 2346, 12107, 11861, 5347, 14536; Payload ID: 17011 relates to Category No.: 15629; Payload ID: 17012 relates to Category No.: 15629; Payload ID: 17013 relates to Category No.: 267, 11861; Payload ID: 17014 relates to Category No.: 267, 11861, 37, 7328; Payload ID: 17015 relates to Category No.: 267, 11861; Payload ID: 17016 relates to Category No.: 15629, 11861; Payload ID: 17017 relates to Category No.: 14705, 11861, 15180; Payload ID: 17018 relates to Category No.: 14705, 11861, 15181, 1439; Payload ID: 17019 relates to Category No.: 14705, 15180, 11861; Payload ID: 17020 relates to Category No.: 14705, 15180, 11861; Payload ID: 17021 relates to Category No.: 9939, 2491, 56, 11981, 11861; Payload ID: 17022 relates to Category No.: 9282, 9226, 14196, 10116, 11861, 10115, 7267, 7265; Payload ID: 17023 relates to Category No.: 1405, 1438, 14706, 2491, 56, 11861, 15181, 9887, 6337, 1439, 11895, 1457, 9939, 9896, 15180, 5347; Payload ID: 17024 relates to Category No.:

1405, 1438, 15180, 2491, 11861, 5477; Payload ID: 17025 relates to Category No.: 1405, 1438, 15180, 2491, 11861, 14706, 9896; Payload ID: 17026 relates to Category No.: 1405, 15180, 2491, 11861, 14706, 9896; Payload ID: 17027 relates to Category No.: 1405, 1438, 15180, 2491, 11861, 5347; Payload ID: 17028 relates to Category No.: 1405, 1438, 15180, 2491, 11861, 11933; Payload ID: 17029 relates to Category No.: 1405, 11939, 15180, 2491, 11861, 5347, 11933, 1439; Payload ID: 17030 relates to Category No.: 1405, 1438, 15180, 2491, 11861; Payload ID: 17031 relates to Category No.: 15180, 2491, 11861, 1439; Payload ID: 17032 relates to Category No.: 1405, 1438, 15180, 2491, 11861, 5347, 11939, 11933; Payload ID: 17033 relates to Category No.: 1405, 1438, 15180, 2491, 11861; Payload ID: 17034 relates to Category No.: 1405, 1438, 15180, 2491, 11861; Payload ID: 17035 relates to Category No.: 15180, 2491, 11861; Payload ID: 17036 relates to Category No.: 1405, 15180, 2491, 11861; Payload ID: 17037 relates to Category No.: 1405, 1438, 15180, 2491, 11861; Payload ID: 17038 relates to Category No.: 1405, 15180, 2491, 11861, 11939, 11933, 9939; Payload ID: 17039 relates to Category No.: 1405, 1438, 15180, 2491, 11861; Payload ID: 17040 relates to Category No.: 1405, 1438, 15180, 2491, 11861; Payload ID: 17041 relates to Category No.: 1405, 1438, 15180, 12359, 2491, 11861, 8893; Payload ID: 17042 relates to Category No.: 1405, 1438, 15180, 12359, 2491, 11861, 8893, 9805, 9887, 9896; Payload ID: 17043 relates to Category No.: 1405, 1438, 15180, 12359, 2491, 11861, 8893; Payload ID: 17044 relates to Category No.: 1405, 16331, 1438, 9939, 8893, 15180, 12359, 2491, 11861; Payload ID: 17045 relates to Category No.: 1405, 1438, 15180, 12359, 2491, 11861; Payload ID: 17046 relates to Category No.: 15029, 11861; Payload ID: 17048 relates to Category No.: 11895, 11861, 4710; Payload ID: 17049 relates to Category No.: 11861, 9608; Payload ID: 17050 relates to Category No.: 11861; Payload ID: 17051 relates to Category No.: 11861, 15382, 4196, 11983; Payload ID: 17052 relates to Category No.: 11933, 4291, 11861, 5347, 2931, 5701, 12064, 15179, 11939, 11895, 1706, 4710, 4865, 3765; Payload ID: 17053 relates to Category No.: 11939, 11933, 11895, 11861; Payload ID: 17054 relates to Category No.: 15029, 15021, 11861, 5728, 15024, 16184; Payload ID: 17055 relates to Category No.: 11861; Payload ID: 17056 relates to Category No.: 11861; Payload ID: 17057 relates to Category No.: 16331, 15973, 15893, 6188, 11861, 15894, 2271, 943, 15915; Payload ID: 17058 relates to Category No.: 11861; Payload ID: 17060 relates to Category No.: 11861, 6185; Payload ID: 17061 relates to Category No.: 9226, 15495, 11861; Payload ID: 17062 relates to Category No.: 9226, 15495, 11861; Payload ID: 17063 relates to Category No.: 11861, 11920; Payload ID: 17064 relates to Category No.: 9226, 15495, 11861; Payload ID: 17065 relates to Category No.: 9226, 15495, 11861; Payload ID: 17066 relates to Category No.: 9226, 15495; Payload ID: 17067 relates to Category No.: 9226, 15495; Payload ID: 17068 relates to Category No.: 9226, 15495, 11861; Payload ID: 17069 relates to Category No.: 9226, 15495; Payload ID: 17070 relates to Category No.: 5960, 11861, 15181, 6965; Payload ID: 17071 relates to Category No.: 15181, 11861; Payload ID: 17072 relates to Category No.: 14705, 15180, 11861; Payload ID: 17073 relates to Category No.: 14706, 14705, 11861; Payload ID: 17074 relates to Category No.: 14706, 14705, 11861; Payload ID: 17075 relates to Category No.: 14705, 15180, 11861; Payload ID: 17076 relates to Category No.: 14706, 14705, 11861, 12081, 11981; Payload ID: 17077 relates to Category No.: 14705, 11861, 11920; Payload ID: 17078 relates to Category No.: 14706, 14705, 11861; Payload ID: 17079 relates to Category No.: 14706, 14705, 11861, 7393, 5957, 2325, 1403, 11933, 11920, 12064, 4710, 5841, 960, 11861, 1327, 1439, 7397; Payload ID: 17080 relates to Category No.: 14706, 14705, 11981, 11861, 11920; Payload ID: 17081 relates to Category No.: 11917, 14706, 14705, 11861, 1439; Payload ID: 17082 relates to Category No.: 14706, 14705, 11861, 813; Payload ID: 17083 relates to Category No.: 14706, 14705, 11861, 14870; Payload ID: 17084 relates to Category No.: 14706, 14705, 11861, 12064; Payload ID: 17085 relates to Category No.: 14705, 15180, 11861; Payload ID: 17086 relates to Category No.: 14706, 14705, 15180, 11861, 2325; Payload ID: 17087 relates to Category No.: 14705, 15180, 11861, 2325, 15895; Payload ID: 17088 relates to Category No.: 14706, 15180, 10116, 11861, 15181, 5347, 11981, 11920, 12064; Payload ID: 17089 relates to Category No.: 11861, 15182, 15181; Payload ID: 17090 relates to Category No.: 15180, 11861, 15181; Payload ID: 17091 relates to Category No.: 15180, 11861; Payload ID: 17092 relates to Category No.: 4894, 15180, 12359, 11861, 15181; Payload ID: 17093 relates to Category No.: 4894, 15180, 12359, 11861; Payload ID: 17094 relates to Category No.: 4901, 9887; Payload ID: 17095 relates to Category No.: 267, 15029, 1457, 14733, 11861, 5841, 943, 9060, 9608; Payload ID: 17096 relates to Category No.: 267, 15029, 1457, 11861, 9608; Payload ID: 17097 relates to Category No.: 267, 15029, 1457, 10116, 11861; Payload ID: 17098 relates to Category No.: 267, 11895, 15029, 11861; Payload ID: 17099 relates to Category No.: 15029, 11861, 267, 9608, 8910; Payload ID: 17100 relates to Category No.: 1405, 16331, 6478, 9518, 15524, 5105, 9939, 2672, 5960, 2859, 598, 11861, 5347, 4158, 15230, 9961, 3508, 813, 11920, 6965, 3752, 12064, 1173, 9925; Payload ID: 17101 relates to Category No.: 11861, 15895, 5347; Payload ID: 17102 relates to Category No.: 1405, 9938, 598, 1173; Payload ID: 17103 relates to Category No.: 11861; Payload ID: 17106 relates to Category No.: 15503, 14471, 14234, 15530, 14252, 15503, 14239, 14252, 14240, 14229, 14251, 14471, 11861, 14471, 3303; Payload ID: 17108 relates to Category No.: 11861, 11939, 12402, 12399, 1706; Payload ID: 17109 relates to Category No.: 11861; Payload ID: 17166 relates to Category No.: 11861; Payload ID: 17167 relates to Category No.: 11861; Payload ID: 17168 relates to Category No.: 11861; Payload ID: 17169 relates to Category No.: 11861; Payload ID: 17170 relates to Category No.: 11861; Payload ID: 17171 relates to Category No.: 11861; Payload ID: 17172 relates to Category No.: 11861; Payload ID: 17173 relates to Category No.: 11861; Payload ID: 17174 relates to Category No.: 11861; Payload ID: 17175 relates to Category No.: 11861; Payload ID: 17176 relates to Category No.: 11861; Payload ID: 17177 relates to Category No.: 11861; Payload ID: 17178 relates to Category No.: 11861; Payload ID: 17179 relates to Category No.: 11861; Payload ID: 17180 relates to Category No.: 11861; Payload ID: 17181 relates to Category No.: 11861; Payload ID: 17182 relates to Category No.: 11861; Payload ID: 17183 relates to Category No.: 11861; Payload ID: 17184 relates to Category No.: 11861; Payload ID: 17185 relates to Category No.: 11861; Payload ID: 17186 relates to Category No.: 11861; Payload ID: 17187 relates to Category No.: 11861; Payload ID: 17188 relates to Category No.: 11861; Payload ID: 17189 relates to Category No.: 11861; Payload ID: 17190 relates to Category No.: 11861; Payload ID: 17191 relates to Category No.: 11861; Payload ID: 17192 relates to Category No.: 11861; Payload ID: 17193 relates to Category No.: 11861; Payload ID: 17194 relates to Category No.: 11861; Payload ID: 17195 relates to Category No.: 11861; Payload ID: 17196 relates to Category No.: 11861; Payload ID: 17197 relates to Category No.: 11861; Payload ID: 17198 relates to Category No.: 11861; Payload ID: 17199 relates to Category No.: 11861; Payload ID: 17200 relates to Category No.: 11861; Payload ID: 17201 relates to Category No.: 11861; Payload ID: 17202 relates to Category No.: 11861; Payload ID: 17203 relates to Category No.: 11861; Payload ID: 17204 relates to Category No.: 11861; Payload ID: 17205 relates to Category No.: 11861; Payload ID: 17206 relates to Category No.: 11861; Payload ID: 17207 relates to Category No.: 11861; Payload ID: 17208 relates to Category No.: 11861; Payload ID: 17209 relates to Category No.: 11861; Payload ID: 17210 relates to Category No.: 11861; Payload ID: 17211 relates to Category No.: 15613; Payload ID: 17212 relates to Category No.: 11861; Payload ID: 17213 relates to Category No.: 11861; Payload ID: 17229 relates to Category No.: 11861; Payload ID: 17230 relates to Category No.: 11861; Payload ID: 17231 relates to Category No.: 11861; Payload ID: 17232 relates to Category No.: 11861; Payload ID: 17233 relates to Category No.: 11861; Payload ID: 17234 relates to Category No.: 11861; Payload ID: 17235 relates to Category No.: 11861; Payload ID: 17236 relates to Category No.: 11861; Payload ID: 17237 relates to Category No.: 11861; Payload ID: 17238 relates to Category No.: 11861; Payload ID: 17239 relates to Category No.: 11861; Payload ID: 17240 relates to Category No.: 11861; Payload ID: 17241 relates to Category No.: 11861; Payload ID: 17242 relates to Category No.: 11861; Payload ID: 17243 relates to Category No.: 11861; Payload ID: 17244 relates to Category No.: 11861; Payload ID: 17245 relates to Category No.: 11861; Payload ID: 17246 relates to Category No.: 11861; Payload ID: 17247 relates to Category No.: 11861; Payload ID: 17248 relates to Category No.: 11861; Payload ID: 17249 relates to Category No.: 11861; Payload ID: 17250 relates to Category No.: 11861; Payload ID: 17251 relates to Category No.: 11861; Payload ID: 17252 relates to Category No.: 11861; Payload ID: 17253 relates to Category No.: 11861; Payload ID: 17254 relates to Category No.: 11861; Payload ID: 17255 relates to Category No.: 11861; Payload ID: 17256 relates to Category No.: 11861; Payload ID: 17257 relates to Category No.: 11861; Payload ID: 17258 relates to Category No.: 11861; Payload ID: 17259 relates to Category No.: 11861; Payload ID: 17260 relates to Category No.: 11861; Payload ID: 17261 relates to Category No.: 11861; Payload ID: 17262 relates to Category No.: 11861; Payload ID: 17263 relates to Category No.: 11861; Payload ID: 17264 relates to Category No.: 11861; Payload ID: 17265 relates to Category No.: 11861; Payload ID: 17266 relates to Category No.: 11861; Payload ID: 17267 relates to Category No.: 11861; Payload ID: 17268 relates to Category No.: 11861; Payload ID: 17269 relates to Category No.: 11861; Payload ID: 17270 relates to Category No.: 11861; Payload ID: 17271 relates to Category No.: 11861; Payload ID: 17272 relates to Category No.: 11861; Payload ID: 17273 relates to Category No.: 11861; Payload ID: 17274 relates to Category No.: 11861; Payload ID: 17275 relates to Category No.: 11861; Payload ID: 17276 relates to Category No.: 11861; Payload ID: 17277 relates to Category No.: 11861; Payload ID: 17278 relates to Category No.: 11861; Payload ID: 17279 relates to Category No.: 11861; Payload ID: 17280 relates to Category No.: 11861; Payload ID: 17281 relates to Category No.: 11861; Payload ID: 17282 relates to Category No.: 11861; Payload ID: 17283 relates to Category No.: 11861; Payload ID: 17284 relates to Category No.: 11861; Payload ID: 17285 relates to Category No.: 11861; Payload ID: 17293 relates to Category No.: 11861; Payload ID: 17294 relates to Category No.: 11861; Payload ID: 17295 relates to Category No.: 11861; Payload ID: 17296 relates to Category No.: 11861; Payload ID: 17297 relates to Category No.: 11861; Payload ID: 17303 relates to Category No.: 11861; Payload ID: 17304 relates to Category No.: 11861; Payload ID: 17305 relates to Category No.: 11861; Payload ID: 17306 relates to Category No.: 11861; Payload ID: 17307 relates to Category No.: 11861; Payload ID: 17308 relates to Category No.: 11861; Payload ID: 17309 relates to Category No.: 11861; Payload ID: 17310 relates to Category No.: 11861; Payload ID: 17311 relates to Category No.: 9625, 6946, 11861; Payload ID: 17312 relates to Category No.: 11861; Payload ID: 17313 relates to Category No.: 12402, 11861; Payload ID: 17314 relates to Category No.: 12402; Payload ID: 17315 relates to Category No.: 4820, 15213, 11861, 15040; Payload ID: 17316 relates to Category No.: 4820, 15213, 11861, 15038; Payload ID: 17317 relates to Category No.: 4820, 11861, 15213; Payload ID: 17318 relates to Category No.: 12402, 11861, 15041; Payload ID: 17319 relates to Category No.: 3303, 12109, 15239, 11861, 5096, 6427; Payload ID: 17320 relates to Category No.: 926, 3303, 14471, 15504, 9539, 15524, 12109, 15491, 15239, 11861, 5096, 6427; Payload ID: 17321 relates to Category No.: 15503, 14471, 15491, 11861, 5096, 3936, 3752, 14218; Payload ID: 17322 relates to Category No.: 11933, 15491, 11861, 12064, 16224, 15409; Payload ID: 17323 relates to Category No.: 3303, 15503, 14471, 11933, 15504, 15491, 11861, 5096; Payload ID: 17324 relates to Category No.: 3303, 15503, 14471, 11933, 11895, 11861, 15493; Payload ID: 17325 relates to Category No.: 3303, 16331, 9282, 9226, 10116, 11861; Payload ID: 17326 relates to Category No.: 16331, 2405, 14471, 15524, 6829, 11861, 14251, 15239, 5832, 15503, 14236, 1201; Payload ID: 17327 relates to Category No.: 16331, 11861, 9539; Payload ID: 17328 relates to Category No.: 15503, 14471, 11933; Payload ID: 17329 relates to Category No.: 3303, 15503, 14471, 11933, 9014; Payload ID: 17330 relates to Category No.: 15503, 14471, 11917, 15524, 11861, 5096; Payload ID: 17331 relates to Category No.: 15503, 14471, 15491, 11861, 5096; Payload ID: 17332 relates to Category No.: 11933, 3303, 15503, 14471, 11861, 1201; Payload ID: 17333 relates to Category No.: 3303, 11933, 15491, 11861, 5096; Payload ID: 17334 relates to Category No.: 15503, 14471, 15504, 15524, 15491, 11861, 16224, 15409, 5101; Payload ID: 17335 relates to Category No.: 15504, 15524, 15491, 7192, 5101; Payload ID: 17336 relates to Category No.: 11933, 11861; Payload ID: 17337 relates to Category No.: 3303, 11933, 9539, 15524, 15491, 11861, 5096, 327, 1356; Payload ID: 17338 relates to Category No.: 11933, 15495, 11861; Payload ID: 17339 relates to Category No.: 15542, 15548, 48; Payload ID: 17340 relates to Category No.: 267, 15021, 5588, 277, 5538, 11861, 6190, 16184, 11886; Payload ID: 17341 relates to Category No.: 267, 15021, 15029, 277, 5538, 11861; Payload ID: 17342 relates to Category No.: 9816; Payload ID: 17343 relates to Category No.: 1405, 1438, 11861, 7192; Payload ID: 17344 relates to Category No.: 11978, 926, 12109, 11861, 9961, 9226; Payload ID: 17345 relates to Category No.: 3752, 712; Payload ID: 17346 relates to Category No.: 7489, 11861, 16331; Payload ID: 17347 relates to Category No.: 7489, 6816, 11861, 3752; Payload ID: 17348 relates to Category No.: 11978, 926, 6602, 15542, 5956, 12109, 11861; Payload ID: 17349 relates to Category No.: 11978, 926, 7126, 12109, 6602; Payload ID: 17350 relates to Category No.: 11978, 926, 15542, 12109, 6602, 11861, 11991; Payload ID: 17351 relates to Category No.: 11861, 15973, 9625, 9628, 6933, 15220, 15221; Payload ID: 17352 relates to Category No.: 11861, 11886; Payload ID: 17353 relates to Category No.:

9805, 7192; Payload ID: 17354 relates to Category No.: 14196, 14213, 15684, 1201; Payload ID: 17355 relates to Category No.: 3464, 14609, 11939, 11861, 3752, 12064, 7010, 11695; Payload ID: 17356 relates to Category No.: 9282, 9226, 14196, 15503, 14471, 3459, 10116, 11861, 5347, 7265, 15528, 14239; Payload ID: 17357 relates to Category No.: 9226, 6816, 11861, 10119, 97; Payload ID: 17358 relates to Category No.: 11981, 2491, 11861, 15887, 14537, 11977; Payload ID: 17359 relates to Category No.: 11981, 2491, 11861; Payload ID: 17360 relates to Category No.: 2491, 11861; Payload ID: 17361 relates to Category No.: 5308, 15376; Payload ID: 17362 relates to Category No.: 11933, 4820, 15227; Payload ID: 17363 relates to Category No.: 11933, 4820, 15227, 15124, 11861; Payload ID: 17364 relates to Category No.: 11933, 4820, 15227, 15124, 11861; Payload ID: 17365 relates to Category No.: 4820, 1226, 15227; Payload ID: 17366 relates to Category No.: 4820, 1226, 15227; Payload ID: 17367 relates to Category No.: 4820, 1226, 15227; Payload ID: 17368 relates to Category No.: 4820, 1226, 15227; Payload ID: 17369 relates to Category No.: 4820, 11861, 1226; Payload ID: 17370 relates to Category No.: 4820; Payload ID: 17371 relates to Category No.: 4820; Payload ID: 17372 relates to Category No.: 4820, 1226, 15227; Payload ID: 17373 relates to Category No.: 4820, 1226; Payload ID: 17374 relates to Category No.: 4820, 1226; Payload ID: 17375 relates to Category No.: 4820, 1226; Payload ID: 17376 relates to Category No.: 4820, 1226; Payload ID: 17377 relates to Category No.: 4820, 1226, 15227; Payload ID: 17378 relates to Category No.: 4820, 1226; Payload ID: 17379 relates to Category No.: 4820; Payload ID: 17380 relates to Category No.: 4820; Payload ID: 17381 relates to Category No.: 4820, 1226, 15227; Payload ID: 17382 relates to Category No.: 4820, 1226; Payload ID: 17383 relates to Category No.: 4820, 1226, 15227; Payload ID: 17384 relates to Category No.: 4820, 1226; Payload ID: 17385 relates to Category No.: 4820; Payload ID: 17386 relates to Category No.: 4820, 1226, 15227; Payload ID: 17387 relates to Category No.: 4820, 1226, 15227; Payload ID: 17388 relates to Category No.: 4820, 15227; Payload ID: 17389 relates to Category No.: 3303, 15504, 15524, 11861, 3752, 13735, 14234, 14237, 14244, 15503, 14471; Payload ID: 17390 relates to Category No.: 3303, 11861; Payload ID: 17391 relates to Category No.: 6816, 15503, 14471, 15239, 11861, 14223, 15503, 14222; Payload ID: 17392 relates to Category No.: 3303, 11861; Payload ID: 17393 relates to Category No.: 3303, 11861; Payload ID: 17394 relates to Category No.: 3303, 15503, 14471, 11861; Payload ID: 17395 relates to Category No.: 3303, 11861, 15493; Payload ID: 17396 relates to Category No.: 3084, 6816, 3640, 11753, 11861; Payload ID: 17397 relates to Category No.: 6816, 3640, 11753, 3084; Payload ID: 17398 relates to Category No.: 6816, 3640, 11753, 3084; Payload ID: 17399 relates to Category No.: 11978, 926, 12109; Payload ID: 17400 relates to Category No.: 11978, 926, 12109, 11861, 15029; Payload ID: 17401 relates to Category No.: 6816, 11861, 5957; Payload ID: 17402 relates to Category No.: 11895, 11861, 1153; Payload ID: 17403 relates to Category No.: 2874, 15180, 11861, 5050; Payload ID: 17404 relates to Category No.: 15180, 11861; Payload ID: 17405 relates to Category No.: 11933, 15180, 11861; Payload ID: 17406 relates to Category No.: 11861; Payload ID: 17408 relates to Category No.: 4894, 11861; Payload ID: 17409 relates to Category No.: 11978, 926; Payload ID: 17410 relates to Category No.: 4894, 4924, 11861, 9608; Payload ID: 17411 relates to Category No.: 4894, 11861; Payload ID: 17412 relates to Category No.: 4894, 11861; Payload ID: 17413 relates to Category No.: 4894; Payload ID: 17414 relates to Category No.: 4894, 11861; Payload ID: 17415 relates to Category No.: 4894, 11981, 11861; Payload ID: 17416 relates to Category No.: 4894, 11861; Payload ID: 17417 relates to Category No.: 4894, 11861; Payload ID: 17418 relates to Category No.: 4894, 11861; Payload ID: 17419 relates to Category No.: 4894, 11861; Payload ID: 17420 relates to Category No.: 4894, 1369, 11861; Payload ID: 17421 relates to Category No.: 4894, 12359, 11861; Payload ID: 17422 relates to Category No.: 4894, 267; Payload ID: 17423 relates to Category No.: 11939, 4894; Payload ID: 17424 relates to Category No.: 4894, 11861; Payload ID: 17425 relates to Category No.: 11861; Payload ID: 17426 relates to Category No.: 4894, 11861; Payload ID: 17427 relates to Category No.: 4894, 11861; Payload ID: 17428 relates to Category No.: 3303, 9226, 6816, 15503, 14471, 11861; Payload ID: 17431 relates to Category No.: 4894, 11861; Payload ID: 17432 relates to Category No.: 4894; Payload ID: 17433 relates to Category No.: 4894, 12359; Payload ID: 17434 relates to Category No.: 11861; Payload ID: 17435 relates to Category No.: 11861; Payload ID: 17436 relates to Category No.: 4894; Payload ID: 17437 relates to Category No.: 4894; Payload ID: 17438 relates to Category No.: 4894; Payload ID: 17439 relates to Category No.: 4894; Payload ID: 17440 relates to Category No.: 4894; Payload ID: 17441 relates to Category No.: 4894; Payload ID: 17442 relates to Category No.: 4894; Payload ID: 17443 relates to Category No.: 4894; Payload ID: 17444 relates to Category No.: 4894; Payload ID: 17445 relates to Category No.: 4894; Payload ID: 17446 relates to Category No.: 4894, 11861; Payload ID: 17447 relates to Category No.: 4894, 11861, 767; Payload ID: 17448 relates to Category No.: 4894, 12359, 11861; Payload ID: 17449 relates to Category No.: 4894; Payload ID: 17450 relates to Category No.: 1405, 4894; Payload ID: 17451 relates to Category No.: 1405, 4894, 11861; Payload ID: 17452 relates to Category No.: 1405, 4894, 11861; Payload ID: 17453 relates to Category No.: 267; Payload ID: 17454 relates to Category No.: 11861; Payload ID: 17455 relates to Category No.: 3303, 15503, 14471, 11939, 14471, 11917, 11861; Payload ID: 17456 relates to Category No.: 3303, 15503, 14471; Payload ID: 17457 relates to Category No.: 15503, 14471, 11861, 15530, 14233, 11939, 11933, 14234, 14249, 15525; Payload ID: 17458 relates to Category No.: 3303, 15503, 14471, 11939, 11933, 14249, 15525, 11861; Payload ID: 17459 relates to Category No.: 15503, 14471, 3303, 11861, 3732; Payload ID: 17460 relates to Category No.: 3303, 15503, 14471, 14234, 14471, 11861, 15530, 14233; Payload ID: 17461 relates to Category No.: 15503, 14471, 14243, 14252, 14229, 14246, 15528, 14233, 3303, 14234; Payload ID: 17462 relates to Category No.: 15503, 14471, 15524, 11861; Payload ID: 17463 relates to Category No.: 15503, 14471, 3303, 11861; Payload ID: 17464 relates to Category No.: 15503, 14471, 14234, 14471, 11861, 15530, 14233, 14252, 14229, 3303; Payload ID: 17465 relates to Category No.: 3303, 15503, 14471, 11861; Payload ID: 17466 relates to Category No.: 3303, 15503, 14471, 14471, 15504, 11861, 14243, 15528, 14255; Payload ID: 17467 relates to Category No.: 15503, 14471, 11861, 15530, 14252, 14252, 14229, 3303; Payload ID: 17468 relates to Category No.: 15503, 14471, 3303, 14237; Payload ID: 17469 relates to Category No.: 3303, 15491, 11861; Payload ID: 17470 relates to Category No.: 7489, 6816, 3731; Payload ID: 17471 relates to Category No.: 4924; Payload ID: 17472 relates to Category No.: 15503, 14471, 2405, 11917, 15524, 14251, 14471, 5109, 14243, 11861, 3752, 14252, 3530, 14240, 3303, 11933, 14237, 15525; Payload ID: 17473 relates to Category No.: 3303, 11917, 14251, 14471, 14243, 11861; Payload ID: 17474 relates to Category No.: 11861; Payload ID: 17475 relates to Category No.: 3303, 14471, 11861, 15528, 14233, 11933, 14234; Payload ID: 17476 relates to Category No.: 3303, 14471, 7192, 11861; Payload ID: 17477 relates to Category No.: 3303, 14471, 11861; Payload ID: 17479 relates to Category No.: 11861; Payload ID: 17481 relates to Category No.: 14107, 4924, 11861, 12417, 12364, 9939, 3765, 6965, 12363, 12425, 12388; Payload ID: 17482 relates to Category No.: 14107, 4924, 11861, 12417, 4894; Payload ID: 17483 relates to Category No.: 15629, 12202, 14292, 5298, 943; Payload ID: 17484 relates to Category No.: 3303, 11861, 11933; Payload ID: 17485 relates to Category No.: 926, 15973, 15895, 10116, 11861; Payload ID: 17487 relates to Category No.: 11861, 14249, 5347, 13735, 12107; Payload ID: 17494 relates to Category No.: 7249; Payload ID: 17495 relates to Category No.: 11861; Payload ID: 17496 relates to Category No.: 11861; Payload ID: 17497 relates to Category No.: 11861, 12076; Payload ID: 17498 relates to Category No.: 1630, 2557, 3488; Payload ID: 17499 relates to Category No.: 15503, 14471, 15528, 14233, 3303, 11861, 14234; Payload ID: 17500 relates to Category No.: 15503, 14471, 11861, 3303, 15503, 14239; Payload ID: 17501 relates to Category No.: 15503, 14471, 11861, 14252, 3303; Payload ID: 17502 relates to Category No.: 15503, 14471, 3303, 11861; Payload ID: 17503 relates to Category No.: 3303, 6816, 11861; Payload ID: 17504 relates to Category No.: 3303, 6816, 11861; Payload ID: 17505 relates to Category No.: 3303, 6816, 2405, 11861; Payload ID: 17506 relates to Category No.: 11978, 926, 6816, 9096, 9939, 12145, 11861; Payload ID: 17507 relates to Category No.: 11861; Payload ID: 17509 relates to Category No.: 11861; Payload ID: 17510 relates to Category No.: 11861, 9882; Payload ID: 17511 relates to Category No.: 11861; Payload ID: 17512 relates to Category No.: 11861; Payload ID: 17514 relates to Category No.: 11978, 926, 15612, 12399, 12145, 11861, 4865; Payload ID: 17515 relates to Category No.: 11861; Payload ID: 17517 relates to Category No.: 11861, 7192; Payload ID: 17518 relates to Category No.: 11861; Payload ID: 17519 relates to Category No.: 11861; Payload ID: 17520 relates to Category No.: 11861, 1201; Payload ID: 17521 relates to Category No.: 1201; Payload ID: 17522 relates to Category No.: 3303, 6816, 14196, 11939, 9304, 11861, 15699, 15265, 14281, 15492, 15250, 15271, 15270, 14282; Payload ID: 17523 relates to Category No.: 11861, 926, 14196, 15250; Payload ID: 17524 relates to Category No.: 11861, 11886, 1201, 11890; Payload ID: 17525 relates to Category No.: 3303, 11939, 11933, 6965, 11861, 15265, 3303, 1121, 3465; Payload ID: 17526 relates to Category No.: 3303, 11939, 11895, 11861, 15265, 3465; Payload ID: 17527 relates to Category No.: 3303, 11861; Payload ID: 17528 relates to Category No.: 14597, 11861, 15265, 15253; Payload ID: 17529 relates to Category No.: 11978, 926; Payload ID: 17530 relates to Category No.: 11861, 15179; Payload ID: 17531 relates to Category No.: 11861, 7192, 5347, 5588; Payload ID: 17532 relates to Category No.: 11861; Payload ID: 17533 relates to Category No.: 11861; Payload ID: 17534 relates to Category No.: 11939, 11933, 5009, 11861; Payload ID: 17535 relates to Category No.: 1405, 11939, 11933, 12402, 11861, 1706; Payload ID: 17536 relates to Category No.: 11939, 11933, 11861; Payload ID: 17537 relates to Category No.: 11939, 11861; Payload ID: 17538 relates to Category No.: 11861; Payload ID: 17539 relates to Category No.: 267, 10116, 11861, 6816; Payload ID: 17540 relates to Category No.: 6816, 9962, 11861, 5957; Payload ID: 17541 relates to Category No.: 11861, 6816; Payload ID: 17542 relates to Category No.: 267, 11861; Payload ID: 17543 relates to Category No.: 4864, 12402, 11861; Payload ID: 17544 relates to Category No.: 11861, 15265; Payload ID: 17545 relates to Category No.: 926, 9226, 6816, 14196, 11861, 10144, 3752, 7265, 14277, 9282; Payload ID: 17546 relates to Category No.: 1405, 6478, 11939, 11861, 11991, 9806; Payload ID: 17547 relates to Category No.: 16331, 10116; Payload ID: 17548 relates to Category No.: 6816; Payload ID: 17549 relates to Category No.: 7192; Payload ID: 17550 relates to Category No.: 11861, 1201; Payload ID: 17552 relates to Category No.: 11861; Payload ID: 17553 relates to Category No.: 11861; Payload ID: 17554 relates to Category No.: 16331, 11861; Payload ID: 17556 relates to Category No.: 11978, 926, 11981, 11861; Payload ID: 17559 relates to Category No.: 7192; Payload ID: 17562 relates to Category No.: 2667; Payload ID: 17563 relates to Category No.: 11861; Payload ID: 17564 relates to Category No.: 7192; Payload ID: 17566 relates to Category No.: 5096; Payload ID: 17570 relates to Category No.: 11861; Payload ID: 17575 relates to Category No.: 11861, 7192; Payload ID: 17582 relates to Category No.: 11861, 7192; Payload ID: 17583 relates to Category No.: 11861; Payload ID: 17586 relates to Category No.: 11978, 926, 6816, 12145, 11861, 12114, 12109; Payload ID: 17587 relates to Category No.: 11978, 926, 6816, 12109, 12145, 11861, 12114; Payload ID: 17588 relates to Category No.: 11978, 926, 6478, 12109, 11861; Payload ID: 17589 relates to Category No.: 11978, 926, 6478, 12109, 11861; Payload ID: 17590 relates to Category No.: 12109, 11978, 926, 6478, 11861; Payload ID: 17591 relates to Category No.: 11978, 926, 6478, 12109, 11861; Payload ID: 17592 relates to Category No.: 11978, 926, 6478, 12109, 11861; Payload ID: 17593 relates to Category No.: 11981, 11861; Payload ID: 17594 relates to Category No.: 3303, 16331, 5865, 6908, 15031; Payload ID: 17595 relates to Category No.: 3303, 16331, 11861, 4158, 6908; Payload ID: 17596 relates to Category No.: 3303, 16331, 6816, 11861, 6908; Payload ID: 17597 relates to Category No.: 3303, 14471; Payload ID: 17598 relates to Category No.: 3303; Payload ID: 17599 relates to Category No.: 11861; Payload ID: 17602 relates to Category No.: 11861; Payload ID: 17603 relates to Category No.: 1404, 11861; Payload ID: 17604 relates to Category No.: 3752; Payload ID: 17605 relates to Category No.: 11861, 3752; Payload ID: 17607 relates to Category No.: 15908, 3752; Payload ID: 17610 relates to Category No.: 11861; Payload ID: 17611 relates to Category No.: 7192; Payload ID: 17613 relates to Category No.: 7192; Payload ID: 17614 relates to Category No.: 3752; Payload ID: 17615 relates to Category No.: 5588, 11861, 735; Payload ID: 17616 relates to Category No.: 3752; Payload ID: 17617 relates to Category No.: 14564, 11861; Payload ID: 17619 relates to Category No.: 5588; Payload ID: 17620 relates to Category No.: 7192; Payload ID: 17621 relates to Category No.: 926, 5308, 11861; Payload ID: 17622 relates to Category No.: 15973, 11861; Payload ID: 17623 relates to Category No.: 11861, 1201; Payload ID: 17624 relates to Category No.: 11861; Payload ID: 17625 relates to Category No.: 9226, 11861; Payload ID: 17626 relates to Category No.: 11861; Payload ID: 17627 relates to Category No.: 11861; Payload ID: 17628 relates to Category No.: 11861; Payload ID: 17629 relates to Category No.: 11861; Payload ID: 17630 relates to Category No.: 11861; Payload ID: 17631 relates to Category No.: 11861; Payload ID: 17632 relates to Category No.: 11861; Payload ID: 17633 relates to Category No.: 11861; Payload ID: 17634 relates to Category No.: 11861; Payload ID: 17635 relates to Category No.: 11861; Payload ID: 17636 relates to Category No.: 11861; Payload ID: 17637 relates to Category No.: 11861, 7192; Payload ID: 17638 relates to Category No.: 11861; Payload ID: 17639 relates to Category No.: 11861; Payload ID: 17640 relates to Category No.: 11861, 16331, 15908, 6188; Payload ID: 17641 relates to Category No.: 11861; Payload ID: 17642 relates to Category No.: 11861; Payload ID: 17643 relates to Category No.: 11861; Payload ID: 17644 relates to Category No.: 11861, 5347; Payload ID: 17645 relates to Category No.: 11861; Payload ID: 17646 relates to Category No.: 11861; Payload ID: 17647 relates to Category No.: 11861; Payload ID: 17648 relates to Category No.: 11861; Payload ID: 17650 relates to Category No.: 7192, 11861; Payload ID: 17651 relates to Category No.: 11861; Payload ID: 17653 relates to Category No.: 11861; Payload ID: 17654 relates to Category No.: 11861, 3303, 2405; Payload ID: 17655 relates to Category No.: 11861; Payload ID: 17656 relates to Category No.: 11861; Payload ID: 17657 relates to Category No.: 11861; Payload ID: 17658 relates to Category No.: 11861, 14244; Payload ID: 17659 relates to Category No.: 9706, 4204, 11861; Payload ID: 17660 relates to Category No.: 9706, 4204, 11861, 7192; Payload ID: 17661 relates to Category No.: 9706, 4204, 11861; Payload ID: 17662 relates to Category No.: 11861; Payload ID: 17663 relates to Category No.: 11861; Payload ID: 17664 relates to Category No.: 16331; Payload ID: 17665 relates to Category No.: 16331; Payload ID: 17666 relates to Category No.: 7192; Payload ID: 17667 relates to Category No.: 3749, 1630, 12111, 11861, 5955; Payload ID: 17668 relates to Category No.: 16331, 5923, 11861; Payload ID: 17669 relates to Category No.: 16331, 11861; Payload ID: 17670 relates to Category No.: 3303, 15503, 14471, 14234, 15495, 11861, 15530, 14233, 2405, 2737; Payload ID: 17671 relates to Category No.: 3303, 15503, 14471; Payload ID: 17672 relates to Category No.: 3303; Payload ID: 17673 relates to Category No.: 3303, 11861; Payload ID: 17674 relates to Category No.: 3303; Payload ID: 17675 relates to Category No.: 3303, 9226, 6816, 11861; Payload ID: 17676 relates to Category No.: 3303, 16331, 9226, 11861; Payload ID: 17677 relates to Category No.: 3303, 6816, 9226; Payload ID: 17678 relates to Category No.: 3303, 9226, 6816, 11828; Payload ID: 17679 relates to Category No.: 9226, 3303, 6816, 11861; Payload ID: 17680 relates to Category No.: 3303, 9226, 6816, 11861, 12064, 1356; Payload ID: 17681 relates to Category No.: 3303, 9226, 6816, 11861; Payload ID: 17682 relates to Category No.: 9226, 6816, 15542, 14471, 15630; Payload ID: 17683 relates to Category No.: 16331, 9226, 14471, 11861, 5347; Payload ID: 17684 relates to Category No.: 3303, 9226, 6816; Payload ID: 17685 relates to Category No.: 3303, 9226, 6816, 11861; Payload ID: 17686 relates to Category No.: 11861; Payload ID: 17688 relates to Category No.: 15343, 926, 5956, 15340; Payload ID: 17689 relates to Category No.: 5308, 6478, 15352; Payload ID: 17690 relates to Category No.: 6816, 6825, 11861, 9629, 9619, 6829; Payload ID: 17691 relates to Category No.: 9549; Payload ID: 17692 relates to Category No.: 11861, 9549; Payload ID: 17694 relates to Category No.: 14351, 15360; Payload ID: 17695 relates to Category No.: 11919, 10116, 11861, 9518, 303, 3292, 9635; Payload ID: 17696 relates to Category No.: 11919, 11861, 9518, 303, 3292, 11886, 9648, 9649; Payload ID: 17697 relates to Category No.: 11918, 11861; Payload ID: 17698 relates to Category No.: 11861, 9635, 12168; Payload ID: 17700 relates to Category No.: 11861; Payload ID: 17701 relates to Category No.: 9747, 11861, 12169; Payload ID: 17702 relates to Category No.: 11919, 9518, 303, 3292, 15363, 9313, 11918; Payload ID: 17703 relates to Category No.: 11918, 11861, 5892; Payload ID: 17704 relates to Category No.: 9518, 303, 3292, 11919; Payload ID: 17705 relates to Category No.: 11861; Payload ID: 17706 relates to Category No.: 15895, 11861, 3753; Payload ID: 17707 relates to Category No.: 15363, 3554, 11919, 4207, 9518, 303, 7480, 9518, 11861; Payload ID: 17708 relates to Category No.: 15363, 4207, 9518, 303, 7480, 9518, 11861; Payload ID: 17709 relates to Category No.: 4207, 9518, 15363, 3554, 11919, 9518, 303, 7480, 11861; Payload ID: 17711 relates to Category No.: 11919, 9518, 303, 3292, 3293; Payload ID: 17712 relates to Category No.: 11861; Payload ID: 17713 relates to Category No.: 11861; Payload ID: 17714 relates to Category No.: 11918, 3293; Payload ID: 17715 relates to Category No.: 7192; Payload ID: 17716 relates to Category No.: 11918, 11861, 15357; Payload ID: 17717 relates to Category No.: 11918; Payload ID: 17718 relates to Category No.: 15364, 168; Payload ID: 17720 relates to Category No.: 11861, 7192; Payload ID: 17721 relates to Category No.: 3303, 14196, 11861; Payload ID: 17722 relates to Category No.: 14196, 11861; Payload ID: 17723 relates to Category No.: 11861, 14196; Payload ID: 17724 relates to Category No.: 14196, 11861; Payload ID: 17725 relates to Category No.: 14196, 11861; Payload ID: 17726 relates to Category No.: 14196, 11861; Payload ID: 17727 relates to Category No.: 9226, 6816, 11939, 94, 14597, 11861, 96, 3987, 7356, 7358; Payload ID: 17728 relates to Category No.: 9226, 6478, 11939, 96, 3987; Payload ID: 17729 relates to Category No.: 12292, 7192, 15373; Payload ID: 17730 relates to Category No.: 12292, 2874, 7192, 14486; Payload ID: 17731 relates to Category No.: 926, 9282, 11939, 11861, 15375, 632, 6188, 4282; Payload ID: 17732 relates to Category No.: 926, 9282, 7192, 15375, 632, 6188, 4282; Payload ID: 17733 relates to Category No.: 926, 9282, 11861, 7192, 15375, 632, 6188, 4282; Payload ID: 17734 relates to Category No.: 1405, 15617, 12399, 11861; Payload ID: 17735 relates to Category No.: 4864, 5259, 2874; Payload ID: 17736 relates to Category No.: 5009, 4016, 1405, 5588, 6024, 11861, 5347, 4196, 15561, 4183, 4710, 9896, 2590, 12189, 6334, 4178; Payload ID: 17737 relates to Category No.: 1405, 5009, 11861; Payload ID: 17738 relates to Category No.: 1405, 5009, 11861; Payload ID: 17739 relates to Category No.: 1405, 4864, 5588, 5009, 11861, 4196, 2566, 6027; Payload ID: 17741 relates to Category No.: 6825, 9619, 11861; Payload ID: 17744 relates to Category No.: 7192; Payload ID: 17745 relates to Category No.: 5865, 4976, 7223, 9518, 315, 16283, 15387; Payload ID: 17746 relates to Category No.: 4820, 4924, 11861, 15383, 15386; Payload ID: 17747 relates to Category No.: 14196, 10116; Payload ID: 17748 relates to Category No.: 14196, 6924; Payload ID: 17749 relates to Category No.: 14196, 6924; Payload ID: 17750 relates to Category No.: 4894, 5588, 11861, 4796, 11981, 3752; Payload ID: 17751 relates to Category No.: 2874; Payload ID: 17752 relates to Category No.: 926, 16331, 11861, 5347, 9255, 15391; Payload ID: 17753 relates to Category No.: 926, 15391, 5956, 9255, 3075; Payload ID: 17754 relates to Category No.: 4864, 15542, 15553, 15542, 15555, 9977, 10092, 15393, 12323; Payload ID: 17755 relates to Category No.: 4230, 15395, 11939, 9282, 7268, 3471, 2559; Payload ID: 17756 relates to Category No.: 7020, 11939, 2963, 3459, 5308, 313, 11861, 15984, 12324, 15031, 3343, 11983, 14248, 15097, 5308, 5310; Payload ID: 17757 relates to Category No.: 12402; Payload ID: 17759 relates to Category No.: 11861; Payload ID: 17760 relates to Category No.: 11861; Payload ID: 17761 relates to Category No.: 3303, 2405; Payload ID: 17762 relates to Category No.: 3303, 11861, 6022; Payload ID: 17763 relates to Category No.: 295, 11861; Payload ID: 17764 relates to Category No.:

295; Payload ID: 17765 relates to Category No.: 295; Payload ID: 17766 relates to Category No.: 295, 10116, 11861; Payload ID: 17767 relates to Category No.: 295, 11861; Payload ID: 17768 relates to Category No.: 11861; Payload ID: 17769 relates to Category No.: 5259, 11939, 12402, 11886, 705, 2271; Payload ID: 17770 relates to Category No.: 11861, 1201; Payload ID: 17771 relates to Category No.: 926, 15491, 12399, 14248, 10116, 11861, 15493, 2691, 6185, 9961, 16224, 15409; Payload ID: 17772 relates to Category No.: 11861, 6210, 5347; Payload ID: 17773 relates to Category No.: 15491, 11861; Payload ID: 17774 relates to Category No.: 15908, 15893, 6188, 11861, 15409, 1201, 16331; Payload ID: 17775 relates to Category No.: 926, 11861, 15493, 5347; Payload ID: 17776 relates to Category No.: 16331, 15491, 11861, 3936, 11828, 6184, 5101, 15905; Payload ID: 17777 relates to Category No.: 16331, 10116, 11861, 5621, 5957, 15409; Payload ID: 17778 relates to Category No.: 16331, 15503, 14471, 14471, 15408, 15504, 15524, 15403, 14968, 11920, 15239, 11861, 11886, 2406, 14251, 6183, 14602, 14973, 11939, 11917, 11933, 15503, 14239, 5826; Payload ID: 17779 relates to Category No.: 3303, 16331, 15503, 14471, 14471, 15403, 15495, 14968, 11861, 3752, 15408, 2406; Payload ID: 17780 relates to Category No.: 11861, 11939; Payload ID: 17781 relates to Category No.: 5836, 1405, 4976, 9747, 11861; Payload ID: 17782 relates to Category No.: 4820, 4816, 11861, 15413; Payload ID: 17783 relates to Category No.: 5259; Payload ID: 17784 relates to Category No.: 15503, 14471, 14471, 11861, 3459; Payload ID: 17785 relates to Category No.: 8959, 11861, 15416; Payload ID: 17786 relates to Category No.: 16331, 637, 6829, 9629, 6821; Payload ID: 17787 relates to Category No.: 4820, 15417; Payload ID: 17788 relates to Category No.: 9282, 9226, 10115, 10116, 11861, 992; Payload ID: 17789 relates to Category No.: 9282, 9226, 14196, 10116, 11861, 992; Payload ID: 17790 relates to Category No.: 3303, 9226; Payload ID: 17791 relates to Category No.: 3303, 9226; Payload ID: 17792 relates to Category No.: 3303, 9226; Payload ID: 17793 relates to Category No.: 3303, 9226; Payload ID: 17794 relates to Category No.: 3303, 9226, 11861, 7192; Payload ID: 17795 relates to Category No.: 3303, 9226; Payload ID: 17796 relates to Category No.: 3303, 9226, 11861; Payload ID: 17797 relates to Category No.: 11861; Payload ID: 17798 relates to Category No.: 1457, 11861, 11920; Payload ID: 17799 relates to Category No.: 11861, 11861, 1327, 11920, 4922, 11895; Payload ID: 17800 relates to Category No.: 11861; Payload ID: 17801 relates to Category No.: 11861, 11939, 11933; Payload ID: 17802 relates to Category No.: 11861; Payload ID: 17803 relates to Category No.: 6816, 4864, 2874, 11861, 11828, 6826; Payload ID: 17804 relates to Category No.: 11861, 11828, 6826, 6816, 5588, 3749; Payload ID: 17805 relates to Category No.: 6816, 11861, 11828, 6826; Payload ID: 17806 relates to Category No.: 6816, 11861, 11828, 6826; Payload ID: 17807 relates to Category No.: 14504, 3665; Payload ID: 17808 relates to Category No.: 4023, 14504; Payload ID: 17809 relates to Category No.: 3554, 1630, 5892, 2557, 4427, 4431; Payload ID: 17810 relates to Category No.: 1405, 11978, 926, 12109, 277, 11981, 1457, 12145, 11861, 5347, 3752, 11828, 12107, 15024, 322, 15249, 15030, 7328; Payload ID: 17811 relates to Category No.: 11861, 1327, 15429, 11861, 5841, 15024, 1253, 4121, 15430; Payload ID: 17814 relates to Category No.: 11861, 6242; Payload ID: 17815 relates to Category No.: 4820, 1146; Payload ID: 17819 relates to Category No.: 11861; Payload ID: 17823 relates to Category No.: 1405, 11861, 9946, 1439, 14537; Payload ID: 17825 relates to Category No.: 14564; Payload ID: 17826 relates to Category No.: 3303, 11861; Payload ID: 17828 relates to Category No.: 16331, 15895, 15777, 11861, 15355; Payload ID: 17829 relates to Category No.: 16331, 6816, 15908, 11861, 14564, 15895, 6188, 11981, 15777, 5347, 3752, 12081, 15355, 1681, 14861, 12402, 11886, 7127; Payload ID: 17830 relates to Category No.: 16331, 14564, 15908, 15895, 6188, 15777, 11861, 12081, 15355, 11981, 6816; Payload ID: 17831 relates to Category No.: 6965, 11861; Payload ID: 17832 relates to Category No.: 3303, 16331, 6816, 15908, 15895, 15777, 11861, 15355, 16296, 11981; Payload ID: 17833 relates to Category No.: 16331, 6816, 15908, 15895, 11861, 15355, 14564; Payload ID: 17834 relates to Category No.: 16331, 15908, 15895, 6188, 5109, 11981, 15777, 11861, 15889, 5347, 12064, 15355, 7127, 11979, 15893; Payload ID: 17835 relates to Category No.: 16331, 15908, 6188, 11861; Payload ID: 17836 relates to Category No.: 926, 15973, 11981, 10116, 15777, 11861; Payload ID: 17837 relates to Category No.: 15911, 11861, 7125; Payload ID: 17838 relates to Category No.: 11981, 11861, 10163; Payload ID: 17839 relates to Category No.: 11861, 10163; Payload ID: 17840 relates to Category No.: 14564, 11861, 5347, 3004, 5957, 1201, 1327, 15777, 11886; Payload ID: 17841 relates to Category No.: 2874, 15777, 11861; Payload ID: 17842 relates to Category No.: 11978, 926, 6816, 11895, 12109, 11861, 15744; Payload ID: 17843 relates to Category No.: 15629, 11861, 9887, 9877, 16228, 16218; Payload ID: 17844 relates to Category No.: 15629; Payload ID: 17845 relates to Category No.: 14564, 11861, 5957, 15455, 15889, 15895, 5613, 15819, 15097; Payload ID: 17846 relates to Category No.: 11939, 11933, 11861, 1327, 11861, 9887, 11983, 15449, 15445; Payload ID: 17847 relates to Category No.: 11933, 15617, 12399, 11861; Payload ID: 17848 relates to Category No.: 15617, 11861; Payload ID: 17849 relates to Category No.: 11933, 15617, 12399, 11861, 6242, 6245, 14581, 15641, 9654, 6258, 3214; Payload ID: 17850 relates to Category No.: 15617, 12399, 3464, 11861, 5347; Payload ID: 17851 relates to Category No.: 15617, 12399, 11861, 6242, 6245; Payload ID: 17852 relates to Category No.: 11861, 5621; Payload ID: 17853 relates to Category No.: 15617, 12399, 11861, 6240, 11933, 3214; Payload ID: 17854 relates to Category No.: 15617, 3464, 11861, 14602, 14609, 3471; Payload ID: 17855 relates to Category No.: 3303, 14196, 12399, 3464, 11861, 14602, 3471; Payload ID: 17856 relates to Category No.: 15617, 11861, 5621, 14609; Payload ID: 17857 relates to Category No.: 14564, 11981, 11861; Payload ID: 17858 relates to Category No.: 14564, 11861, 9939; Payload ID: 17859 relates to Category No.: 1405, 16331, 6825, 6829, 11861, 2566; Payload ID: 17860 relates to Category No.: 1405, 16331, 6825, 6829, 11861; Payload ID: 17861 relates to Category No.: 5105, 15495, 11861; Payload ID: 17862 relates to Category No.: 2405, 11861; Payload ID: 17863 relates to Category No.: 3303, 2405, 10116, 11861, 2691, 3375, 3376; Payload ID: 17864 relates to Category No.: 3303, 3375, 3376; Payload ID: 17865 relates to Category No.: 926, 3303, 6478, 11939, 11933, 2405, 11895, 3385, 5109, 10116, 11861, 15887, 3752, 3471, 3376, 11983, 3303, 1121; Payload ID: 17866 relates to Category No.: 926, 3303, 3376, 3303, 1121, 6816, 11933, 2405, 11895, 5109, 3752, 11983, 11861; Payload ID: 17867 relates to Category No.: 3303, 11895, 11861, 5347; Payload ID: 17868 relates to Category No.: 3303, 16331, 9226, 3375, 11861, 3372; Payload ID: 17869 relates to Category No.: 3303, 10116, 11861, 3375, 3372; Payload ID: 17870 relates to Category No.: 3303, 16331, 6816, 15908, 15893, 15101, 6188, 11861, 735, 3373; Payload ID: 17871 relates to Category No.: 11861; Payload ID: 17872 relates to Category No.: 2936, 943, 941, 11861, 6022; Payload ID: 17873 relates to Category No.: 943, 941, 11861; Payload ID: 17874 relates to Category No.: 926, 942, 15973, 5960, 11861, 2936, 7017; Payload ID: 17875 relates to Category No.: 926, 942, 11861; Payload ID: 17876 relates to Category No.: 926, 5259, 11861; Payload ID: 17877 relates to Category No.: 926, 942, 11861; Payload ID: 17878 relates to Category No.: 926; Payload ID: 17879 relates to Category No.: 11978, 926, 12109, 11861, 5956; Payload ID: 17880 relates to Category No.: 11978, 926, 12109, 11861; Payload ID: 17881 relates to Category No.: 3303, 2405, 14252; Payload ID: 17882 relates to Category No.: 11939, 2405, 11861, 3937, 9961; Payload ID: 17883 relates to Category No.: 2405, 3303, 11861; Payload ID: 17884 relates to Category No.: 1630, 9804, 11861, 4309, 1223; Payload ID: 17885 relates to Category No.: 9539, 11861, 9821; Payload ID: 17886 relates to Category No.: 11978, 926, 5308, 9539, 12109, 11861, 9988, 512; Payload ID: 17893 relates to Category No.: 7192; Payload ID: 17894 relates to Category No.: 11981, 11861; Payload ID: 17895 relates to Category No.: 926, 4886, 11981, 11861, 5400; Payload ID: 17897 relates to Category No.: 6816, 6825, 16293; Payload ID: 17898 relates to Category No.: 6816, 6825, 11861, 16293; Payload ID: 17899 relates to Category No.: 4820, 15476, 4810; Payload ID: 17900 relates to Category No.: 4820, 15476; Payload ID: 17901 relates to Category No.: 4820, 15669; Payload ID: 17902 relates to Category No.: 4820, 15476; Payload ID: 17903 relates to Category No.: 4820, 15476; Payload ID: 17904 relates to Category No.: 4820, 15476; Payload ID: 17905 relates to Category No.: 6816, 15895, 11861; Payload ID: 17906 relates to Category No.: 16331, 6188, 11861, 15893, 15908, 12417; Payload ID: 17907 relates to Category No.: 11978, 926, 12109, 11861; Payload ID: 17908 relates to Category No.: 11861, 12402; Payload ID: 17909 relates to Category No.: 11861; Payload ID: 17910 relates to Category No.: 12360, 11861; Payload ID: 17911 relates to Category No.: 11861, 14741; Payload ID: 17913 relates to Category No.: 11861; Payload ID: 17914 relates to Category No.: 11861; Payload ID: 17915 relates to Category No.: 15504, 11861, 5841; Payload ID: 17916 relates to Category No.: 11861; Payload ID: 17917 relates to Category No.: 11861; Payload ID: 17919 relates to Category No.: 11861, 12360; Payload ID: 17920 relates to Category No.: 11861; Payload ID: 17921 relates to Category No.: 11861; Payload ID: 17922 relates to Category No.: 11861; Payload ID: 17923 relates to Category No.: 11861; Payload ID: 17924 relates to Category No.: 11861; Payload ID: 17926 relates to Category No.: 11861, 4338; Payload ID: 17927 relates to Category No.: 12402, 11861, 4338, 3752; Payload ID: 17928 relates to Category No.: 11861; Payload ID: 17929 relates to Category No.: 11861; Payload ID: 17930 relates to Category No.: 6816, 11861; Payload ID: 17931 relates to Category No.: 11861, 9518, 319; Payload ID: 17932 relates to Category No.: 9518, 319; Payload ID: 17933 relates to Category No.: 14416, 1504, 7225, 1630; Payload ID: 17934 relates to Category No.: 2538; Payload ID: 17935 relates to Category No.: 6816, 2538; Payload ID: 17936 relates to Category No.: 3303, 16331, 11861; Payload ID: 17937 relates to Category No.: 3303, 11861; Payload ID: 17938 relates to Category No.: 3303, 16331, 9226, 11861, 15590; Payload ID: 17939 relates to Category No.: 3303, 16331, 9226, 11861, 15590; Payload ID: 17940 relates to Category No.: 3303, 16331, 9226; Payload ID: 17941 relates to Category No.: 15503, 14471, 16296, 11861; Payload ID: 17942 relates to Category No.: 16296; Payload ID: 17943 relates to Category No.: 16296; Payload ID: 17944 relates to Category No.: 16296, 15590; Payload ID: 17945 relates to Category No.: 11861, 16296; Payload ID: 17946 relates to Category No.: 16296; Payload ID: 17947 relates to Category No.: 16296; Payload ID: 17948 relates to Category No.: 16296; Payload ID: 17949 relates to Category No.: 15908, 11861; Payload ID: 17950 relates to Category No.: 15895, 11861, 15590; Payload ID: 17951 relates to Category No.: 3303, 15908, 11861, 15590; Payload ID: 17952 relates to Category No.: 3303, 15908, 11861; Payload ID: 17953 relates to Category No.: 3303, 15908; Payload ID: 17954 relates to Category No.: 3303; Payload ID: 17955 relates to Category No.: 3303; Payload ID: 17956 relates to Category No.: 9226, 10116, 11861, 3349; Payload ID: 17957 relates to Category No.: 15491, 10116, 11861, 14249, 14244, 11782; Payload ID: 17958 relates to Category No.: 11861; Payload ID: 17959 relates to Category No.: 15503, 14471, 14234, 11939, 1178, 11933, 15504, 11917, 15524, 14652, 11861, 15528, 14233, 3731, 3303, 3530, 1471, 5235; Payload ID: 17960 relates to Category No.: 3303, 15503, 14471, 11917; Payload ID: 17961 relates to Category No.: 16331, 11861; Payload ID: 17962 relates to Category No.: 16331, 11861; Payload ID: 17963 relates to Category No.: 1178, 11917, 15530, 14233, 15528, 14233, 3530, 686, 11861, 5109; Payload ID: 17964 relates to Category No.: 11917; Payload ID: 17965 relates to Category No.: 3303, 11917; Payload ID: 17966 relates to Category No.: 3303, 15503, 14471, 11861; Payload ID: 17967 relates to Category No.: 11917, 3303, 15503, 14471, 14234, 11939, 1178, 11933, 14471, 15504, 15524, 15491, 11861, 15530, 14233, 13735, 3530, 7127, 3731, 16226, 2405; Payload ID: 17968 relates to Category No.: 3303, 15503, 14471, 14234, 11939, 1178, 11933, 11895, 11917, 11861, 15528, 14233, 3530, 15503, 14471, 14265, 15503, 15319, 15320, 2405, 15495; Payload ID: 17969 relates to Category No.: 15503, 14471, 2405, 14471, 15524, 1153, 11861, 2688, 3303, 15530, 14255; Payload ID: 17970 relates to Category No.: 3303, 15503, 14471, 2405, 14471, 15524, 1153, 11861; Payload ID: 17971 relates to Category No.: 15503, 14471, 14234, 2405, 14471, 15504, 15524, 1153, 11981, 840, 11861, 9173, 4380, 14244, 14237; Payload ID: 17972 relates to Category No.: 15503, 14471, 14234, 2405, 10116, 11861, 15528, 14233, 3303, 1121, 7058, 3303, 4961, 15492; Payload ID: 17973 relates to Category No.: 15503, 14471, 14234, 11939, 2405, 14471, 11917, 15524, 14251, 14471, 15491, 15503, 14233, 2690, 11861, 15530, 14233, 15525, 15528, 14233, 14237, 15504; Payload ID: 17974 relates to Category No.: 15503, 14471, 3303, 11939, 11933, 14471, 11917, 14251, 14471, 15491, 15495, 2859, 11861, 14249, 14246, 14237, 15503, 14235, 3732, 15528, 14233, 2405; Payload ID: 17975 relates to Category No.: 14251, 14471, 14243, 11861; Payload ID: 17976 relates to Category No.: 14251, 14471, 14243, 15528, 14233, 3303, 11939, 11933, 14234; Payload ID: 17977 relates to Category No.: 3303, 15503, 14471, 11917, 14243, 11861, 2688, 15530, 14233, 15528, 14233, 14240, 14251, 14471; Payload ID: 17978 relates to Category No.: 3303, 11939, 14471, 11917, 15524, 5109, 11861, 15503, 14239, 3530, 15528, 14233, 14234; Payload ID: 17979 relates to Category No.: 3303, 10116, 11861, 14299, 14315; Payload ID: 17980 relates to Category No.: 10116, 14299, 15493, 14315; Payload ID: 17981 relates to Category No.: 15503, 14471, 14234, 11917, 15524, 15528, 14233, 3303; Payload ID: 17982 relates to Category No.: 3303, 15503, 14471, 14471, 11895, 11861; Payload ID: 17983 relates to Category No.: 15503, 14471, 14471, 15495, 11861; Payload ID: 17984 relates to Category No.: 3303, 15503, 14471, 11933, 14251, 14471; Payload ID: 17985 relates to Category No.: 3303, 15503, 14471, 15504, 14251, 14471, 15491, 11920, 11861; Payload ID: 17986 relates to Category No.: 3303, 15503, 14471, 15504, 14251, 14471, 11920, 11861, 15493; Payload ID: 17987 relates to Category No.: 14234, 11917, 15528, 14233, 15503, 14471, 15524, 3303; Payload ID: 17988 relates to Category No.: 15503, 14471, 14234, 11917, 15491, 15495, 11861, 15528, 14233; Payload ID: 17989 relates to Category No.: 3303, 15503, 14471, 11917; Payload ID: 17990 relates to Category No.: 3303, 11861, 2405; Payload ID: 17991 relates to Category No.: 926, 3303, 16331, 9226, 954, 3385, 11861; Payload ID: 17992 relates to Category No.: 15491, 5096; Payload ID: 17993 relates to Category No.: 3303, 16331, 11861; Payload ID: 17994 relates to Category No.: 3303, 16331, 15503, 14471, 2405, 15491, 5096, 11861; Payload ID: 17995 relates to Category No.: 15503, 14471, 15491, 11920, 11861, 5096, 6184, 6185; Payload ID: 17996 relates to Category No.: 3303, 6816, 15503, 14471, 15504, 14248, 6185, 3303, 1121; Payload ID: 17997 relates to Category No.: 11861, 12425, 14538, 15495, 14652; Payload ID: 17998 relates to Category No.: 11861, 16224; Payload ID: 17999 relates to Category No.: 15524, 5105, 15495, 1153, 11861, 12064, 3303; Payload ID: 18000 relates to Category No.: 15495, 11861; Payload ID: 18001 relates to Category No.: 11895, 15504, 15524, 5105, 15495, 1153, 11920, 11861; Payload ID: 18002 relates to Category No.: 11981, 10116, 11861, 15593, 9961; Payload ID: 18003 relates to Category No.: 14712, 10116, 11861; Payload ID: 18004 relates to Category No.: 15504, 11861, 14249, 5347, 2405, 15495; Payload ID: 18005 relates to Category No.: 15495, 11861; Payload ID: 18006 relates to Category No.: 11861; Payload ID: 18007 relates to Category No.: 11861, 7192, 2405, 15495, 13735, 15503, 14239; Payload ID: 18008 relates to Category No.: 11861; Payload ID: 18009 relates to Category No.: 4151, 11861, 4158, 15545, 4153; Payload ID: 18010 relates to Category No.: 15544, 11939, 3464, 10116, 11861, 5347, 4710, 16206, 2271, 5280, 15546; Payload ID: 18011 relates to Category No.: 11861, 15544, 4710, 2696; Payload ID: 18012 relates to Category No.: 5956, 11861, 9988, 512, 15493, 1201, 15491; Payload ID: 18013 relates to Category No.: 9282, 9226, 10116, 11861; Payload ID: 18014 relates to Category No.: 9282, 9226, 10116, 7268, 11861; Payload ID: 18015 relates to Category No.: 16331, 15491, 11861, 5882, 14296, 686; Payload ID: 18016 relates to Category No.: 11861; Payload ID: 18017 relates to Category No.: 11978, 10116, 11861; Payload ID: 18018 relates to Category No.: 4864, 11861, 3774, 4710; Payload ID: 18019 relates to Category No.: 4864, 2874, 11861, 735, 3752, 4710, 15820, 15826, 15828, 12108, 11939, 11933, 12064; Payload ID: 18020 relates to Category No.: 4864, 11939, 11933, 12402, 2874, 15567, 11861, 1146, 12418, 15826, 15828; Payload ID: 18021 relates to Category No.: 4864, 2874, 11861, 5347, 15561, 15820, 15826, 15828, 11933; Payload ID: 18022 relates to Category No.: 926, 12418, 15609, 11978, 6816, 12109, 14652, 11861, 15564, 12417, 15561, 4865, 5882, 15826, 15572, 12402; Payload ID: 18023 relates to Category No.: 15567, 14652, 11861; Payload ID: 18024 relates to Category No.: 11978, 926, 6816, 12109, 12399, 14652, 11861, 12418, 15561, 15609, 15820, 15828, 4720, 15572, 15565, 7127; Payload ID: 18025 relates to Category No.: 5009, 15567, 14652, 2694, 11861, 15561, 9608, 15826, 4720, 15572, 15566, 368, 4183; Payload ID: 18027 relates to Category No.: 5588, 11861, 2566, 4016; Payload ID: 18028 relates to Category No.: 11861, 11920; Payload ID: 18029 relates to Category No.: 9173, 11920; Payload ID: 18030 relates to Category No.: 11861, 11920; Payload ID: 18031 relates to Category No.: 267, 11861; Payload ID: 18032 relates to Category No.: 11861; Payload ID: 18033 relates to Category No.: 11861; Payload ID: 18034 relates to Category No.: 6816, 12173, 11861; Payload ID: 18035 relates to Category No.: 6816, 12173, 11861; Payload ID: 18036 relates to Category No.: 1405, 1630, 12173, 15542, 15548; Payload ID: 18037 relates to Category No.: 12173; Payload ID: 18038 relates to Category No.: 6816, 12173; Payload ID: 18039 relates to Category No.: 6816, 12173; Payload ID: 18040 relates to Category No.: 6816, 12173; Payload ID: 18041 relates to Category No.: 11861; Payload ID: 18045 relates to Category No.: 5840, 11861, 2267, 5775, 15274, 1401; Payload ID: 18046 relates to Category No.: 1647, 1401, 5840, 11861, 5478, 5841, 14996; Payload ID: 18047 relates to Category No.: 1401, 5840, 11861, 14996, 5478; Payload ID: 18048 relates to Category No.: 1153, 5840, 1369, 11861, 14996, 5478, 1401; Payload ID: 18049 relates to Category No.: 11861, 9805, 1201; Payload ID: 18050 relates to Category No.: 1401, 5840, 11861, 14996, 5478; Payload ID: 18051 relates to Category No.: 5840, 11861, 14996, 5478, 267, 1401, 1647, 322, 2491, 943; Payload ID: 18052 relates to Category No.: 5840, 11861, 14996, 5478, 1401; Payload ID: 18053 relates to Category No.: 1647, 5840; Payload ID: 18054 relates to Category No.: 5308, 465, 1401, 5840, 14730, 1647, 6576; Payload ID: 18055 relates to Category No.: 1647, 1401, 5840, 1393; Payload ID: 18056 relates to Category No.: 1393, 926, 1457, 5840, 1401; Payload ID: 18057 relates to Category No.: 5840, 16250, 11662, 1393, 14730; Payload ID: 18058 relates to Category No.: 926, 6816, 12109, 1401, 11861, 1647; Payload ID: 18059 relates to Category No.: 926, 12109, 6816, 5840, 11861, 267, 5956, 1401, 7393; Payload ID: 18060 relates to Category No.: 5840, 11861, 11939, 1401; Payload ID: 18061 relates to Category No.: 9988, 512, 926, 15617, 1401, 1457, 5840, 11861, 9961, 1454, 3970, 15275, 6186, 1647, 5347, 2326, 1650; Payload ID: 18062 relates to Category No.: 1647, 5840, 5847, 11861, 1401; Payload ID: 18063 relates to Category No.: 5840, 11861, 1401, 1647; Payload ID: 18064 relates to Category No.: 926, 267, 6965, 1647, 1401, 277, 11981, 1457, 5840, 598, 11861, 14536, 1173, 11983, 15007, 1654, 1401, 9449; Payload ID: 18065 relates to Category No.: 5840, 11861, 1401, 1457; Payload ID: 18066 relates to Category No.: 1401, 5840, 11861; Payload ID: 18067 relates to Category No.: 3303, 11861; Payload ID: 18068 relates to Category No.: 3303, 16331; Payload ID: 18069 relates to Category No.: 6816, 11939, 1630, 2559, 15586; Payload ID: 18070 relates to Category No.: 6816, 1630, 15586; Payload ID: 18071 relates to Category No.: 6816, 1630, 15586; Payload ID: 18072 relates to Category No.: 11861; Payload ID: 18075 relates to Category No.: 14471, 14597, 3688, 3303, 11861, 14196, 7268; Payload ID: 18076 relates to Category No.: 3303, 6816, 14471, 12142, 14597, 3688, 10116, 11861; Payload ID: 18077 relates to Category No.: 11861, 7192; Payload ID: 18078 relates to Category No.: 16331, 15629, 11939, 12142, 11861, 2271; Payload ID: 18079 relates to Category No.: 6816; Payload ID: 18080 relates to Category No.: 16331, 6816; Payload ID: 18081 relates to Category No.: 11880, 11682, 11861; Payload ID: 18082 relates to Category No.: 11880, 11682; Payload ID: 18083 relates to Category No.: 11861, 7192; Payload ID: 18084 relates to Category No.: 11880, 7123, 11861; Payload ID: 18085 relates to Category No.: 11861, 11880, 11682; Payload ID: 18086 relates to Category No.: 7192, 11880, 11682; Payload ID: 18087 relates to Category No.: 2271, 926, 11861, 11682; Payload ID: 18088 relates to Category No.: 14196, 12150, 9962, 12111, 11861, 14147, 5664; Payload ID: 18089 relates to Category No.: 6816, 11861, 11682; Payload ID: 18090 relates to Category No.: 16331, 6816; Payload ID: 18091 relates to Category No.: 16331, 15629, 11939, 12142, 11861, 2271, 6816; Payload ID: 18092 relates to Category No.: 11861; Payload ID: 18093 relates to Category No.: 15973, 11861, 11880, 11682, 7123; Payload ID: 18094 relates to Category No.: 11880, 11682, 7123; Payload ID: 18095 relates to Category No.: 11861, 11880, 12136; Payload ID: 18096 relates to Category No.: 4961, 11861; Payload ID: 18097 relates to Category No.: 11880, 10171, 12136; Payload ID: 18098 relates to Category No.: 7192, 11880, 10171; Payload ID: 18099 relates to Category No.: 12142; Payload ID: 18101 relates to Category No.: 11861, 11880, 12136; Payload ID: 18102 relates to Category No.: 11861, 12136; Payload ID: 18103 relates to Category No.: 11939, 2405, 4961, 10116, 7268, 11861, 7192, 7125, 15766, 9239, 3510; Payload ID: 18104 relates to Category No.: 12399, 11861; Payload ID: 18106 relates to Category No.: 11861; Payload ID: 18107 relates to Category No.: 11861, 2346, 5841, 1126, 681; Payload ID: 18108 relates to Category No.: 2346; Payload ID: 18109 relates to Category No.: 14503; Payload ID: 18110 relates to Category No.: 7192; Payload ID: 18114 relates to Category No.: 11861; Payload ID: 18116 relates to Category No.: 7192, 11861; Payload ID: 18117 relates to Category No.: 7192; Payload ID: 18118 relates to Category No.: 9518, 319, 9518, 319, 7477, 3028; Payload ID: 18119 relates to Category No.: 7192; Payload ID: 18125 relates to Category No.: 11861; Payload ID: 18129 relates to Category No.: 14771; Payload ID: 18132 relates to Category No.: 12142, 11861, 1201; Payload ID: 18133 relates to Category No.: 11861; Payload ID: 18134 relates to Category No.: 2694, 11861; Payload ID: 18135 relates to Category No.: 4820, 11861; Payload ID: 18136 relates to Category No.: 11861; Payload ID: 18137 relates to Category No.: 11861; Payload ID: 18138 relates to Category No.: 11861; Payload ID: 18139 relates to Category No.: 11861; Payload ID: 18140 relates to Category No.: 11861; Payload ID: 18141 relates to Category No.: 11861; Payload ID: 18142 relates to Category No.: 4875; Payload ID: 18143 relates to Category No.: 3007; Payload ID: 18144 relates to Category No.: 11861; Payload ID: 18146 relates to Category No.: 15895, 11861, 3752, 3689; Payload ID: 18147 relates to Category No.: 16244; Payload ID: 18148 relates to Category No.: 16244; Payload ID: 18152 relates to Category No.: 11861; Payload ID: 18154 relates to Category No.: 12402, 11861; Payload ID: 18157 relates to Category No.: 12402, 11861; Payload ID: 18158 relates to Category No.: 15180, 11861, 11886; Payload ID: 18159 relates to Category No.: 11861; Payload ID: 18161 relates to Category No.: 14564; Payload ID: 18162 relates to Category No.: 11861; Payload ID: 18165 relates to Category No.: 15180, 11861; Payload ID: 18167 relates to Category No.: 12150, 12151, 9804, 5840, 11861; Payload ID: 18168 relates to Category No.: 12150, 12151, 9804, 11861, 9872, 5840; Payload ID: 18169 relates to Category No.: 14503; Payload ID: 18170 relates to Category No.: 14503, 14506; Payload ID: 18171 relates to Category No.: 14503, 9619; Payload ID: 18172 relates to Category No.: 14503, 14506, 11861; Payload ID: 18173 relates to Category No.: 14503; Payload ID: 18174 relates to Category No.: 14503, 14379, 11861; Payload ID: 18175 relates to Category No.: 14503, 14379, 11861; Payload ID: 18176 relates to Category No.: 14503, 14379, 14506, 11861; Payload ID: 18177 relates to Category No.: 14503, 14379, 11861, 14733; Payload ID: 18178 relates to Category No.: 14503, 14379, 11861; Payload ID: 18179 relates to Category No.: 14503, 14379, 9619; Payload ID: 18180 relates to Category No.: 14503, 11861; Payload ID: 18181 relates to Category No.: 14503, 14506, 11861; Payload ID: 18182 relates to Category No.: 14503, 11861, 14506; Payload ID: 18183 relates to Category No.: 11861, 7192; Payload ID: 18184 relates to Category No.: 14564; Payload ID: 18185 relates to Category No.: 11861; Payload ID: 18186 relates to Category No.: 7192; Payload ID: 18188 relates to Category No.: 7192; Payload ID: 18189 relates to Category No.: 11861, 7192; Payload ID: 18190 relates to Category No.: 11861, 7192; Payload ID: 18191 relates to Category No.: 7192; Payload ID: 18192 relates to Category No.: 7192; Payload ID: 18193 relates to Category No.: 16250, 7192, 11861; Payload ID: 18194 relates to Category No.: 11861, 7192; Payload ID: 18195 relates to Category No.: 1404, 11861, 7192; Payload ID: 18197 relates to Category No.: 11861, 7192, 5347; Payload ID: 18198 relates to Category No.: 7192; Payload ID: 18199 relates to Category No.: 7192; Payload ID: 18200 relates to Category No.: 7192, 11861; Payload ID: 18201 relates to Category No.: 7192; Payload ID: 18202 relates to Category No.: 11861, 7192; Payload ID: 18203 relates to Category No.: 7192; Payload ID: 18204 relates to Category No.: 12399, 11861; Payload ID: 18205 relates to Category No.: 7192; Payload ID: 18206 relates to Category No.: 7192; Payload ID: 18207 relates to Category No.: 11861, 7192; Payload ID: 18208 relates to Category No.: 12359, 7192; Payload ID: 18209 relates to Category No.: 11861, 7192; Payload ID: 18210 relates to Category No.: 6816, 6188, 7192, 15894; Payload ID: 18212 relates to Category No.: 7192; Payload ID: 18213 relates to Category No.: 7192; Payload ID: 18214 relates to Category No.: 7192; Payload ID: 18215 relates to Category No.: 7192; Payload ID: 18216 relates to Category No.: 11861; Payload ID: 18223 relates to Category No.: 11861; Payload ID: 18224 relates to Category No.: 11861; Payload ID: 18226 relates to Category No.: 7192; Payload ID: 18229 relates to Category No.: 11861; Payload ID: 18230 relates to Category No.: 11861; Payload ID: 18232 relates to Category No.: 11861; Payload ID: 18234 relates to Category No.: 11861; Payload ID: 18242 relates to Category No.: 9629; Payload ID: 18243 relates to Category No.: 11861; Payload ID: 18246 relates to Category No.: 9226; Payload ID: 18247 relates to Category No.: 16331; Payload ID: 18254 relates to Category No.: 11861; Payload ID: 18257 relates to Category No.: 11861; Payload ID: 18258 relates to Category No.: 11939, 15504, 11981, 11861, 5347, 2818, 2819, 15895; Payload ID: 18259 relates to Category No.: 11861; Payload ID: 18260 relates to Category No.: 11672; Payload ID: 18261 relates to Category No.: 11861; Payload ID: 18262 relates to Category No.: 11861; Payload ID: 18268 relates to Category No.: 3303; Payload ID: 18270 relates to Category No.: 15468; Payload ID: 18271 relates to Category No.: 11861; Payload ID: 18272 relates to Category No.: 11861; Payload ID: 18273 relates to Category No.: 15629; Payload ID: 18274 relates to Category No.: 15629; Payload ID: 18275 relates to Category No.: 15629; Payload ID: 18276 relates to Category No.: 11861; Payload ID: 18279 relates to Category No.: 7192; Payload ID: 18280 relates to Category No.: 15895, 15893; Payload ID: 18281 relates to Category No.: 11861; Payload ID: 18282 relates to Category No.: 11861, 12107; Payload ID: 18284 relates to Category No.: 11939; Payload ID: 18287 relates to Category No.: 11861; Payload ID: 18292 relates to Category No.: 11861, 277, 6022; Payload ID: 18294 relates to Category No.: 11861; Payload ID: 18295 relates to Category No.: 11861; Payload ID: 18309 relates to Category No.: 11861; Payload ID: 18316 relates to Category No.: 15503, 14471; Payload ID: 18319 relates to Category No.: 11861; Payload ID: 18322 relates to Category No.: 11861; Payload ID: 18327 relates to Category No.: 11861; Payload ID: 18329 relates to Category No.: 754, 9302; Payload ID: 18330 relates to Category No.: 11861; Payload ID: 18333 relates to Category No.: 7192; Payload ID: 18336 relates to Category No.: 11861; Payload ID: 18338 relates to Category No.: 11861; Payload ID: 18345 relates to Category No.: 7192; Payload ID: 18346 relates to Category No.: 7192; Payload ID: 18348 relates to Category No.: 11861; Payload ID: 18355 relates to Category No.: 16244; Payload ID: 18356 relates to Category No.: 6829, 9671, 11861; Payload ID: 18357 relates to Category No.: 11861; Payload ID: 18358 relates to Category No.: 11861; Payload ID: 18360 relates to Category No.: 11861; Payload ID: 18361 relates to Category No.: 15026, 11861; Payload ID: 18362 relates to Category No.: 7192; Payload ID: 18363 relates to Category No.: 1401, 16250; Payload ID: 18364 relates to Category No.: 1647, 11662; Payload ID: 18365 relates to Category No.: 1647, 11662; Payload ID: 18369 relates to Category No.: 11861; Payload ID: 18372 relates to Category No.: 11861, 12107; Payload ID: 18376 relates to Category No.: 7192; Payload ID: 18379 relates to Category No.: 7192; Payload ID: 18380 relates to Category No.: 11861, 7192; Payload ID: 18382 relates to Category No.: 7192; Payload ID: 18384 relates to Category No.: 7192; Payload ID: 18385 relates to Category No.: 9885; Payload ID: 18386 relates to Category No.: 9885; Payload ID: 18387 relates to Category No.: 7192; Payload ID: 18388 relates to Category No.: 7192; Payload ID: 18389 relates to Category No.: 11861, 3663; Payload ID: 18393 relates to Category No.: 5308; Payload ID: 18394 relates to Category No.: 9282; Payload ID: 18395 relates to Category No.: 9282; Payload ID: 18396 relates to Category No.: 1393; Payload ID: 18397 relates to Category No.: 11861; Payload ID: 18399 relates to Category No.: 15973, 11861, 4198; Payload ID: 18400 relates to Category No.: 15542, 15548; Payload ID: 18402 relates to Category No.: 7192; Payload ID: 18405 relates to Category No.: 11861; Payload ID: 18408 relates to Category No.: 11861; Payload ID: 18410 relates to Category No.: 11861; Payload ID: 18413 relates to Category No.: 11861, 530, 531; Payload ID: 18416 relates to Category No.: 11861; Payload ID: 18419 relates to Category No.: 11861, 7192; Payload ID: 18420 relates to Category No.: 11861; Payload ID: 18422 relates to Category No.: 7192; Payload ID: 18423 relates to Category No.: 7192; Payload ID: 18427 relates to Category No.: 11861; Payload ID: 18430 relates to Category No.: 11861; Payload ID: 18431 relates to Category No.: 11861, 7192; Payload ID: 18432 relates to Category No.: 6816, 5308; Payload ID: 18433 relates to Category No.: 4820; Payload ID: 18435 relates to Category No.: 1201; Payload ID: 18436 relates to Category No.: 926, 942, 11939, 942, 2748, 9625, 11861, 456, 15220, 15221, 9643, 6937; Payload ID: 18437 relates to Category No.: 926, 942, 942, 2748, 9643, 15629, 11861, 9628, 15220, 6937, 15222, 9653, 6946; Payload ID: 18438 relates to Category No.: 12382, 12142, 10116, 11861, 9179, 1201; Payload ID: 18439 relates to Category No.: 12382, 12142, 11861, 9179, 1201; Payload ID: 18440 relates to Category No.: 12142, 12399, 11861, 5347, 9179, 1201; Payload ID: 18441 relates to Category No.: 5259, 11861, 5347, 11933, 5260, 15403; Payload ID: 18442 relates to Category No.: 15629, 10116, 11861; Payload ID: 18443 relates to Category No.: 4864, 11861; Payload ID: 18444 relates to Category No.: 11861, 2808; Payload ID: 18445 relates to Category No.: 11861; Payload ID: 18446 relates to Category No.: 1630, 547; Payload ID: 18447 relates to Category No.: 12402, 11861, 1327, 11861, 5841; Payload ID: 18448 relates to Category No.: 11978, 926, 15504, 15895, 7126, 11991, 15910; Payload ID: 18449 relates to Category No.: 11978, 926, 15504, 15895, 7126, 11991, 15910; Payload ID: 18450 relates to Category No.: 7126, 11978, 926, 15895, 15495, 11981, 11861, 11991, 15910, 3752; Payload ID: 18451 relates to Category No.: 1405, 11861, 1327; Payload ID: 18453 relates to Category No.: 11861; Payload ID: 18454 relates to Category No.: 16331, 6816, 15503, 14471, 2405, 14471, 14243, 11861, 14252, 15528, 14255; Payload ID: 18455 relates to Category No.: 11861, 12399, 14377; Payload ID: 18456 relates to Category No.: 12399, 11861, 14377, 9654, 6242, 6258; Payload ID: 18457 relates to Category No.: 11861; Payload ID: 18458 relates to Category No.: 12399, 11861; Payload ID: 18459 relates to Category No.: 11861; Payload ID: 18460 relates to Category No.: 16331, 11861; Payload ID: 18461 relates to Category No.: 16331, 11861; Payload ID: 18462 relates to Category No.: 6924, 11861, 14276; Payload ID: 18463 relates to Category No.: 5865, 9518, 6049, 15671, 9518, 317, 5414; Payload ID: 18464 relates to Category No.: 2405, 15525; Payload ID: 18465 relates to Category No.: 9282, 10116, 11861, 9226; Payload ID: 18466 relates to Category No.: 9282, 10116, 11861; Payload ID: 18467 relates to Category No.: 9282, 14196, 11861; Payload ID: 18468 relates to Category No.: 15895, 277, 4901, 7401; Payload ID: 18469 relates to Category No.: 11978, 926, 14107, 12109, 4924, 11861, 3752; Payload ID: 18470 relates to Category No.: 926, 6816, 4645, 11861, 4079, 15674; Payload ID: 18471 relates to Category No.: 15895, 11861, 15675, 5892; Payload ID: 18472 relates to Category No.: 16331, 11861, 7192; Payload ID: 18473 relates to Category No.: 11861, 16331, 6188, 15504, 11920, 15893, 15908; Payload ID: 18474 relates to Category No.: 16331, 6816, 11861, 14564, 15908, 6188; Payload ID: 18475 relates to Category No.: 16331, 11861, 7192; Payload ID: 18476 relates to Category No.: 16331, 6816, 11861; Payload ID: 18477 relates to Category No.: 3303, 16331, 11861, 5618, 7463, 9226; Payload ID: 18478 relates to Category No.: 11861; Payload ID: 18479 relates to Category No.: 16331, 15908, 11861, 1327, 6188, 11861, 6816; Payload ID: 18480 relates to Category No.: 16331, 11861, 15908, 6188, 15893, 6816; Payload ID: 18481 relates to Category No.: 3303, 16331, 14196, 15908, 6188, 11861, 5347; Payload ID: 18482 relates to Category No.: 16331, 15503, 14471, 11861, 1327, 6188, 15495, 11981, 11861; Payload ID: 18483 relates to Category No.: 3749, 16331, 6816, 4886, 15908, 4895, 6188, 11861, 5347, 4422; Payload ID: 18484 relates to Category No.: 16331, 15908, 2405, 9539, 12402, 15491, 6188, 11861, 3937, 6427, 11978, 14471, 15893, 6184; Payload ID: 18485 relates to Category No.: 16331, 15503, 14471, 10116, 11861, 15894, 250; Payload ID: 18486 relates to Category No.: 3303, 16331, 6816, 11861; Payload ID: 18487 relates to Category No.: 11861, 3303, 16331, 9226, 6816, 15908, 15612, 6188; Payload ID: 18488 relates to Category No.: 16331, 3303, 15908, 15503, 14471, 14471, 15895, 6188, 15495, 10116, 11861, 14246, 2418, 5975, 15491, 11978; Payload ID: 18489 relates to Category No.: 16331, 15503, 14471, 11861, 9539; Payload ID: 18490 relates to Category No.: 16331, 6816, 11895, 11861, 15893, 15908; Payload ID: 18491 relates to Category No.: 16331, 6188, 11861; Payload ID: 18492 relates to Category No.: 16331, 14196, 15908, 15893, 15491, 6188, 11861, 7393, 15887, 15593, 15229, 12107; Payload ID: 18493 relates to Category No.: 3303, 16331, 15908, 6188, 11861, 14324, 2737; Payload ID: 18494 relates to Category No.: 16331, 11861, 7192; Payload ID: 18495 relates to Category No.: 16331, 11861, 7192; Payload ID: 18496 relates to Category No.: 16331, 6816, 15908, 6188, 11861; Payload ID: 18497 relates to Category No.: 16331, 15908, 11939, 15895, 15893, 6188, 15777, 11861, 2405; Payload ID: 18498 relates to Category No.: 16331, 14564, 6188, 11861; Payload ID: 18499 relates to Category No.: 16331, 11861, 6188, 5347; Payload ID: 18500 relates to Category No.: 16331, 6188, 11861; Payload ID: 18501 relates to Category No.: 16331, 11861; Payload ID: 18502 relates to Category No.: 16331, 6188, 11861; Payload ID: 18503 relates to Category No.: 16331, 11861; Payload ID: 18504 relates to Category No.: 16331, 11861; Payload ID: 18505 relates to Category No.: 16331, 11861; Payload ID: 18506 relates to Category No.: 16331, 6816, 11861; Payload ID: 18507 relates to Category No.: 16331, 6816, 11861; Payload ID: 18508 relates to Category No.: 16331, 11861; Payload ID: 18509 relates to Category No.: 16331, 11861; Payload ID: 18510 relates to Category No.: 16331, 11981, 11861; Payload ID: 18511 relates to Category No.: 16331, 11861; Payload ID: 18512 relates to Category No.: 16331, 11861; Payload ID: 18513 relates to Category No.: 16331, 11861; Payload ID: 18514 relates to Category No.: 16331, 11861; Payload ID: 18515 relates to Category No.: 16331, 15908, 11939, 11861, 1327, 6188, 11981, 11861, 5347, 14581; Payload ID: 18516 relates to Category No.: 16331, 6188, 11861; Payload ID: 18517 relates to Category No.: 16331, 11861; Payload ID: 18518 relates to Category No.: 16331, 14564, 11861, 6965; Payload ID: 18519 relates to Category No.: 16331, 14564, 11861, 5347; Payload ID: 18520 relates to Category No.: 16331, 6816, 15908, 6188, 10116, 11861; Payload ID: 18521 relates to Category No.: 16331, 6188, 11861; Payload ID: 18522 relates to Category No.: 16331, 11861, 15893, 6816; Payload ID: 18523 relates to Category No.: 16331, 15893, 11861, 1327, 6188, 11981, 11861, 7192, 12146, 15504; Payload ID: 18524 relates to Category No.: 16331, 11861; Payload ID: 18525 relates to Category No.: 16331, 11861; Payload ID: 18526 relates to Category No.: 16331, 15908, 6188, 11861; Payload ID: 18527 relates to Category No.: 16331, 14564, 6188, 15429, 11861, 15893, 15908; Payload ID: 18528 relates to Category No.: 16331, 6816, 11861; Payload ID: 18529 relates to Category No.: 16331, 6816, 11861; Payload ID: 18530 relates to Category No.: 16331, 11861; Payload ID: 18531 relates to Category No.: 16331, 6816, 11861; Payload ID: 18532 relates to Category No.: 16331, 11861, 11939, 2405; Payload ID: 18533 relates to Category No.: 16331, 6816, 11861; Payload ID: 18534 relates to Category No.: 16331, 15908, 6188, 11861, 686, 5101; Payload ID: 18535 relates to Category No.: 16331, 11861, 15908, 6188; Payload ID: 18536 relates to Category No.: 16331, 11861; Payload ID: 18537 relates to Category No.: 16331, 15908, 6188, 15598, 11861, 7010, 15893; Payload ID: 18538 relates to Category No.: 16331, 11861, 9896, 15893, 15889; Payload ID: 18539 relates to Category No.: 16331, 6816, 11861; Payload ID: 18540 relates to Category No.: 16331, 6816, 11861; Payload ID: 18541 relates to Category No.: 16331, 6816, 11861; Payload ID: 18542 relates to Category No.: 16331, 11939, 6188, 11861, 5347; Payload ID: 18543 relates to Category No.: 16331, 6816, 15908, 11939, 6188, 11861, 14706; Payload ID: 18544 relates to Category No.: 16331, 6188, 11861; Payload ID: 18545 relates to Category No.: 16331, 6188, 11861; Payload ID: 18546 relates to Category No.: 16331, 11861; Payload ID: 18547 relates to Category No.: 6816, 14503, 9619, 3663, 14506, 11861, 9629, 15677; Payload ID: 18548 relates to Category No.: 14503, 637, 3663, 11861, 15677, 9629; Payload ID: 18550 relates to Category No.: 14564, 11861; Payload ID: 18551 relates to Category No.: 15542, 15679, 926, 15699, 15094; Payload ID: 18552 relates to Category No.: 6924, 14196, 3300, 15710; Payload ID: 18553 relates to Category No.: 926, 16331, 9226, 6816, 15703, 15542, 3267; Payload ID: 18554 relates to Category No.: 6816, 14196, 10116, 11861, 15699, 15685; Payload ID: 18555 relates to Category No.: 6924, 10116, 15699; Payload ID: 18556 relates to Category No.: 6924; Payload ID: 18557 relates to Category No.: 6924, 10116, 11861; Payload ID: 18558 relates to Category No.: 6924, 15699, 15685, 9226; Payload ID: 18559 relates to Category No.: 11861, 12054; Payload ID: 18560 relates to Category No.: 15542, 11861; Payload ID: 18561 relates to Category No.: 6924, 15710, 6816; Payload ID: 18562 relates to Category No.: 6816, 14196, 10116, 15699, 15685; Payload ID: 18563 relates to Category No.: 9282, 9226, 14213, 10116; Payload ID: 18564 relates to Category No.: 14213, 11861, 14352; Payload ID: 18565 relates to Category No.: 6816, 6924, 15689; Payload ID: 18566 relates to Category No.: 15683; Payload ID: 18567 relates to Category No.: 10116; Payload ID: 18568 relates to Category No.: 15680; Payload ID: 18569 relates to Category No.: 15680, 11861; Payload ID: 18570 relates to Category No.: 5308; Payload ID: 18571 relates to Category No.: 926, 14196, 9304, 15699, 15695, 2783, 2782, 937; Payload ID: 18572 relates to Category No.: 15542, 15556, 15690, 85; Payload ID: 18573 relates to Category No.: 9282, 9226, 10116, 11861; Payload ID: 18574 relates to Category No.: 926, 4886, 6478, 11861, 5347, 15699, 15705; Payload ID: 18575 relates to Category No.: 6401, 5865, 5875, 1630, 4225, 138; Payload ID: 18576 relates to Category No.: 5875, 1630, 5865, 4225; Payload ID: 18577 relates to Category No.: 6924; Payload ID: 18578 relates to Category No.: 11939, 5865, 9518, 315, 16283, 83, 679, 15699; Payload ID: 18579 relates to Category No.: 11861; Payload ID: 18580 relates to Category No.: 11861; Payload ID: 18581 relates to Category No.: 11861; Payload ID: 18582 relates to Category No.: 5009, 11861, 14296; Payload ID: 18583 relates to Category No.: 277, 15741; Payload ID: 18584 relates to Category No.: 15741, 267; Payload ID: 18585 relates to Category No.: 15741, 267; Payload ID: 18586 relates to Category No.: 277, 15741; Payload ID: 18587 relates to Category No.: 267, 15021, 11861, 2936, 15024; Payload ID: 18588 relates to Category No.: 267, 15024, 11861; Payload ID: 18589 relates to Category No.: 267, 11861, 7192; Payload ID: 18590 relates to Category No.: 1405, 267, 11861, 15024; Payload ID: 18591 relates to Category No.: 1405, 11939, 277, 11861, 1439, 15745, 15744; Payload ID: 18592 relates to Category No.: 1405, 267, 11861; Payload ID: 18593 relates to Category No.: 6816, 267, 11861; Payload ID: 18594 relates to Category No.: 267, 11861, 15745; Payload ID: 18595 relates to Category No.: 6816, 267, 11981, 11920, 11861, 1439, 1403, 15742, 15745; Payload ID: 18596 relates to Category No.: 11861, 15741, 15745; Payload ID: 18597 relates to Category No.: 942, 267, 11861, 15741, 15742, 15744, 15021, 11861, 1327; Payload ID: 18598 relates to Category No.: 267, 1439, 15741, 15742, 15744, 1431; Payload ID: 18599 relates to Category No.: 6816, 14196, 15850; Payload ID: 18600 relates to Category No.: 11861, 5841; Payload ID: 18601 relates to Category No.: 5841; Payload ID: 18602 relates to Category No.: 14196, 12223; Payload ID: 18603 relates to Category No.: 14196, 12223, 10116; Payload ID: 18604 relates to Category No.: 14503, 5347, 11828; Payload ID: 18605 relates to Category No.: 14503, 14506, 11861; Payload ID: 18606 relates to Category No.: 14503, 14506, 11861; Payload ID: 18607 relates to Category No.: 14503, 14506; Payload ID: 18608 relates to Category No.: 14503, 14506; Payload ID: 18609 relates to Category No.: 4976, 15748, 6816, 11861; Payload ID: 18610 relates to Category No.: 5865, 7223, 620, 9518, 315, 16283, 12446, 680, 15749; Payload ID: 18611 relates to Category No.: 5865, 7223, 620, 9518, 315, 16283, 12446, 680, 15749; Payload ID: 18613 relates to Category No.: 926, 9282, 632, 15755; Payload ID: 18614 relates to Category No.: 926, 9282, 11861, 632, 15755; Payload ID: 18615 relates to Category No.: 15590, 10116, 11861; Payload ID: 18616 relates to Category No.: 15503, 14471, 11861; Payload ID: 18617 relates to Category No.: 15503, 14471; Payload ID: 18618 relates to Category No.: 15503, 14471, 11861, 7257; Payload ID: 18619 relates to Category No.: 15503, 14471, 11861; Payload ID: 18620 relates to Category No.: 15727; Payload ID: 18621 relates to Category No.: 9226, 15727, 6401, 11861; Payload ID: 18622 relates to Category No.: 9226, 15727, 6401; Payload ID: 18623 relates to Category No.: 15727, 11861; Payload ID: 18624 relates to Category No.: 14706, 14705, 11861; Payload ID: 18625 relates to Category No.: 14471; Payload ID: 18626 relates to Category No.: 3752; Payload ID: 18627 relates to Category No.: 12393; Payload ID: 18628 relates to Category No.: 11861; Payload ID: 18629 relates to Category No.: 11861; Payload ID: 18631 relates to Category No.: 10116; Payload ID: 18632 relates to Category No.: 11861; Payload ID: 18634 relates to Category No.: 11861, 2271; Payload ID: 18635 relates to Category No.: 11861; Payload ID: 18636 relates to Category No.: 11978, 926, 12109, 12145, 11861, 12114; Payload ID: 18637 relates to Category No.: 4886, 15590, 4895, 10116, 11861; Payload ID: 18638 relates to Category No.: 9857, 11886, 11861; Payload ID: 18639 relates to Category No.: 277, 11861, 9887; Payload ID: 18640 relates to Category No.: 9857, 11886; Payload ID: 18641 relates to Category No.: 9857, 11861, 9887, 3752, 11886; Payload ID: 18642 relates to Category No.: 15503, 14471, 9857, 11861; Payload ID: 18643 relates to Category No.: 11861, 2271, 4898, 12064, 4893, 1201; Payload ID: 18644 relates to Category No.: 11939, 4894, 11861, 9805, 14660, 1201, 37; Payload ID: 18645 relates to Category No.: 15973, 10116, 2271, 15766; Payload ID: 18646 relates to Category No.: 11861; Payload ID: 18647 relates to Category No.: 4895, 2271; Payload ID: 18648 relates to Category No.: 1201; Payload ID: 18649 relates to Category No.: 11861, 2271, 15027; Payload ID: 18650 relates to Category No.: 11861; Payload ID: 18651 relates to Category No.: 11861, 6965, 15766, 15773; Payload ID: 18653 relates to Category No.: 6965, 11861, 15766; Payload ID: 18655 relates to Category No.: 15766; Payload ID: 18656 relates to Category No.: 926, 15774; Payload ID: 18657 relates to Category No.: 926, 15773, 11861; Payload ID: 18658 relates to Category No.: 926, 11861; Payload ID: 18659 relates to Category No.: 926, 6188; Payload ID: 18660 relates to Category No.: 926; Payload ID: 18661 relates to Category No.: 926, 6188; Payload ID: 18662 relates to Category No.: 926, 12175, 12175, 5442; Payload ID: 18663 relates to Category No.: 926, 6188, 15766; Payload ID: 18664 relates to Category No.: 926, 6188; Payload ID: 18665 relates to Category No.: 926, 6188, 11861, 15766; Payload ID: 18666 relates to Category No.: 926, 598, 1173, 15773; Payload ID: 18667 relates to Category No.: 12175, 12175, 5442, 926; Payload ID: 18668 relates to Category No.: 926, 6188; Payload ID: 18669 relates to Category No.: 4886, 15021, 4895, 15029, 11861, 11920; Payload ID: 18670 relates to Category No.: 4886, 4895, 15029, 15895, 3464, 11861, 15021; Payload ID: 18671 relates to Category No.: 4886, 15021, 4895, 15029, 11861; Payload ID: 18672 relates to Category No.: 4886, 15021, 4895, 11861; Payload ID: 18673 relates to Category No.: 4886, 15021, 4895, 11861; Payload ID: 18674 relates to Category No.: 4886, 15021, 4895, 11861, 7192; Payload ID: 18675 relates to Category No.: 4886, 15021, 4895, 11861, 3752; Payload ID: 18676 relates to Category No.: 4886, 15021, 4895, 7192; Payload ID: 18677 relates to Category No.: 4886, 4895, 15021; Payload ID: 18678 relates to Category No.: 4886, 15021, 4895; Payload ID: 18679 relates to Category No.: 4886, 4895, 15021; Payload ID: 18680 relates to Category No.: 4886, 15021, 4895; Payload ID: 18681 relates to Category No.: 4886, 15021, 4895, 11861; Payload ID: 18682 relates to Category No.: 4886, 15021, 4895, 11861, 9629; Payload ID: 18683 relates to Category No.: 4886, 15021, 4895, 11861; Payload ID: 18684 relates to Category No.: 4886, 15021, 4895, 15973, 3464, 6933; Payload ID: 18685 relates to Category No.: 4886, 15021, 4895, 7192; Payload ID: 18686 relates to Category No.: 4886, 15021, 4895, 7192; Payload ID: 18687 relates to Category No.: 4886, 4895, 15029, 15895, 11861, 6933, 15021, 11920, 11886, 4893; Payload ID: 18688 relates to Category No.: 4886, 15021, 4895; Payload ID: 18689 relates to Category No.: 4886, 15021, 4895; Payload ID: 18690 relates to Category No.: 4886, 15021, 4895, 11861; Payload ID: 18691 relates to Category No.: 4886, 4895, 15029; Payload ID: 18692 relates to Category No.: 15021, 11861, 4389, 6973; Payload ID: 18693 relates to Category No.: 15021, 15029, 11861, 4389, 6973; Payload ID: 18694 relates to Category No.: 15021, 11861, 4389, 6973; Payload ID: 18695 relates to Category No.: 15021, 6965, 4389, 6973; Payload ID: 18696 relates to Category No.: 15021, 6965, 4389, 6973; Payload ID: 18697 relates to Category No.: 14379, 2861, 10154, 9282, 2854; Payload ID: 18698 relates to Category No.: 4023, 14379, 2861, 11861, 10154, 6024; Payload ID: 18699 relates to Category No.: 9226, 14196, 11861; Payload ID: 18700 relates to Category No.: 6816, 11861; Payload ID: 18701 relates to Category No.: 9282, 9226, 14196; Payload ID: 18702 relates to Category No.: 926, 9226, 961, 7192; Payload ID: 18704 relates to Category No.: 2405, 6900, 15491, 10116, 11861; Payload ID: 18706 relates to Category No.: 11861; Payload ID: 18707 relates to Category No.: 7268, 11861, 12064; Payload ID: 18708 relates to Category No.: 926, 9226, 4965, 961, 10116, 11861; Payload ID: 18709 relates to Category No.: 15028, 11861; Payload ID: 18710 relates to Category No.: 3303, 9226, 11861; Payload ID: 18711 relates to Category No.: 15777, 11861; Payload ID: 18712 relates to Category No.: 6816, 12402, 2874, 15777, 11861, 15778; Payload ID: 18713 relates to Category No.: 2874, 15777, 11861, 15778; Payload ID: 18714 relates to Category No.: 12402, 2874, 15777, 11861; Payload ID: 18715 relates to Category No.: 2874, 15777, 11861, 12402; Payload ID: 18716 relates to Category No.: 12402, 2874, 15777, 11861; Payload ID: 18717 relates to Category No.: 12402, 2874, 2859, 15777, 11861; Payload ID: 18718 relates to Category No.: 12402, 2874, 15777, 11861; Payload ID: 18719 relates to Category No.: 12402, 2874, 15777, 11861, 15778; Payload ID: 18720 relates to Category No.: 12402, 2874, 15777, 11861, 15778; Payload ID: 18721 relates to Category No.: 12402, 2874, 15777, 11861; Payload ID: 18722 relates to Category No.: 12402, 2874, 15777, 11861, 15778; Payload ID: 18723 relates to Category No.: 15504, 12399, 11861, 11828, 15781, 15484, 3006; Payload ID: 18724 relates to Category No.: 12399, 11861, 15781, 15484; Payload ID: 18725 relates to Category No.: 15617, 11861, 15781, 15484; Payload ID: 18726 relates to Category No.: 15617, 11861, 15781, 15484; Payload ID: 18727 relates to Category No.: 6816, 15617, 12399, 11861, 2875, 15781; Payload ID: 18728 relates to Category No.: 12399, 2874, 11861, 15781; Payload ID: 18729 relates to Category No.: 11861; Payload ID: 18730 relates to Category No.: 12399, 11861; Payload ID: 18732 relates to Category No.: 11861, 15895, 15781, 16206; Payload ID: 18733 relates to Category No.: 12399; Payload ID: 18734 relates to Category No.: 15781, 11861; Payload ID: 18735 relates to Category No.: 11861, 15781; Payload ID: 18736 relates to Category No.: 11861, 15781, 15775; Payload ID: 18737 relates to Category No.: 15895, 11861, 15781; Payload ID: 18738 relates to Category No.: 11861, 15781; Payload ID: 18739 relates to Category No.: 12399, 11861, 15781; Payload ID: 18740 relates to Category No.: 11861, 16206, 15781; Payload ID: 18741 relates to Category No.: 12399, 11861, 15781; Payload ID: 18742 relates to Category No.: 15617, 11861, 15781; Payload ID: 18743 relates to Category No.: 12399, 11861, 15781, 2875; Payload ID: 18744 relates to Category No.: 15908, 11861, 4901, 11920; Payload ID: 18745 relates to Category No.: 14706; Payload ID: 18746 relates to Category No.: 3303, 16331, 15908, 15911, 6188, 5923, 11861, 15887, 11828, 12107, 5957; Payload ID: 18747 relates to Category No.: 5293; Payload ID: 18748 relates to Category No.: 2859, 11861; Payload ID: 18749 relates to Category No.: 11861; Payload ID: 18750 relates to Category No.: 11861; Payload ID: 18751 relates to Category No.: 9857, 9870; Payload ID: 18752 relates to Category No.: 1405, 11939, 11933, 11861; Payload ID: 18753 relates to Category No.: 11939, 11933, 11861, 5347; Payload ID: 18754 relates to Category No.: 11939, 11933, 10116, 11861; Payload ID: 18755 relates to Category No.: 11861; Payload ID: 18756 relates to Category No.: 3303, 6816, 15503, 14471, 14471, 9539, 2963, 3459, 15524, 11861, 926, 16331, 11933, 2405, 15504, 15895, 14251, 14471, 11981, 2672, 2691, 5347, 2271, 3752, 11828, 12425, 14252, 12064, 12081, 12107, 15528, 14255, 12077, 5101, 14243, 15528, 14233, 14237, 5112; Payload ID: 18757 relates to Category No.: 9539, 6900, 14248, 11861, 14229, 14471, 2963, 15265; Payload ID: 18758 relates to Category No.: 9539, 11861, 5347, 14537, 14538, 9014; Payload ID: 18759 relates to Category No.: 753, 11861; Payload ID: 18760 relates to Category No.: 11861, 15887; Payload ID: 18763 relates to Category No.: 16331, 11939, 9518, 12352, 7515, 7520; Payload ID: 18764 relates to Category No.: 7192; Payload ID: 18765 relates to Category No.: 3303, 6816, 15503, 14471, 2405, 14471, 9539, 2963, 3459, 15524, 11861, 5347, 16296, 15528, 14233, 15503, 15504, 11920; Payload ID: 18767 relates to Category No.: 7192, 5347; Payload ID: 18768 relates to Category No.: 3303, 6816, 15503, 14471, 14234, 2405, 15504, 9539, 2963, 3459, 15524, 14251, 14471, 11981, 11861, 5347, 15528, 14233, 14471; Payload ID: 18769 relates to Category No.: 1405, 10116, 11861, 15504; Payload ID: 18770 relates to Category No.: 11861; Payload ID: 18771 relates to Category No.: 11861; Payload ID: 18773 relates to Category No.: 11861; Payload ID: 18774 relates to Category No.: 3411, 6481; Payload ID: 18776 relates to Category No.: 3303, 11939, 15895, 11861, 15887, 1439, 16204, 15495, 6185; Payload ID: 18777 relates to Category No.: 12399, 11861; Payload ID: 18779 relates to Category No.: 5870, 16266, 2323; Payload ID: 18780 relates to Category No.: 11861, 2323; Payload ID: 18781 relates to Category No.: 2323, 5764; Payload ID: 18782 relates to Category No.: 926, 267, 295, 9887, 11886, 12145; Payload ID: 18783 relates to Category No.: 926, 267, 295, 10116, 9887, 11983; Payload ID: 18784 relates to Category No.: 11917, 1178, 15504, 14251, 14471, 11861, 3530, 15503, 14471, 11920, 11939, 11933; Payload ID: 18785 relates to Category No.: 3303, 11917, 11861, 15503, 14471, 11920, 2405, 15503, 14252; Payload ID: 18786 relates to Category No.: 14220, 3391; Payload ID: 18787 relates to Category No.: 11861; Payload ID: 18788 relates to Category No.: 16244, 5840, 11861, 5347, 7431; Payload ID: 18789 relates to Category No.: 16244, 11981, 5840, 11861, 5347, 7431; Payload ID: 18790 relates to Category No.: 11978, 926, 14234, 9096, 12145, 11861, 15528, 14233, 14242; Payload ID: 18791 relates to Category No.: 12402, 11861, 5347, 12417; Payload ID: 18792 relates to Category No.: 11978, 926, 15612, 12145, 11861, 12421, 9844, 16206, 11933; Payload ID: 18793 relates to Category No.: 11939, 11933, 9518, 7223, 2672, 11861, 7224; Payload ID: 18794 relates to Category No.: 2672, 9518, 315, 16283, 717, 680, 11939, 11933, 9518, 11861; Payload ID: 18795 relates to Category No.: 5109, 11920, 11861, 3752, 9961, 9985, 11895, 11886, 15495; Payload ID: 18796 relates to Category No.: 11933, 15895, 5109, 11920, 10116, 11861, 11665, 5841, 3752, 9961, 6944, 9985, 11886; Payload ID: 18797 relates to Category No.: 11933, 14733, 11920, 5551, 11861, 5841, 3752, 4517, 267; Payload ID: 18798 relates to Category No.: 11920, 5551, 10116, 11861, 11983, 11985, 12425; Payload ID: 18799 relates to Category No.: 11920, 11861, 12064, 11895, 5841, 37; Payload ID: 18800 relates to Category No.: 15504, 15895, 11981, 11920, 10116, 11861, 5347, 5956; Payload ID: 18801 relates to Category No.: 1630, 12292, 15489, 6346, 6367, 620; Payload ID: 18802 relates to Category No.: 5865, 7223, 11861, 3752, 9518, 315, 16283, 12446, 680, 15831, 11920, 4151, 620, 9524, 4158, 3424, 15306; Payload ID: 18803 relates to Category No.: 11978, 926, 9096, 12145, 11861, 4869, 15784; Payload ID: 18804 relates to Category No.: 11978, 926, 15612, 12145, 11861; Payload ID: 18805 relates to Category No.: 11978, 926, 14564, 9096, 12145, 11861, 5264; Payload ID: 18806 relates to Category No.: 11861, 5264, 11978, 926, 6816, 12109, 9096, 12145, 3774, 5347, 12114, 4897, 16296; Payload ID: 18807 relates to Category No.: 11978, 926, 9096; Payload ID: 18808 relates to Category No.: 9974, 3459, 14597, 11861, 3993, 135; Payload ID: 18809 relates to Category No.: 6478, 14597, 15495, 9225, 11861, 6574, 15841, 170; Payload ID: 18810 relates to Category No.: 12188; Payload ID: 18811 relates to Category No.: 12188; Payload ID: 18812 relates to Category No.: 926, 14564, 9282, 10116, 15840, 15699, 632, 5719; Payload ID: 18813 relates to Category No.: 926, 9282, 11939, 10116, 11861, 15840, 15699, 632, 15832; Payload ID: 18814 relates to Category No.: 9282, 9226, 6816, 10116, 11861; Payload ID: 18815 relates to Category No.: 14196, 9282, 9226, 6816; Payload ID: 18816 relates to Category No.: 9226, 6816, 11861, 14322; Payload ID: 18817 relates to Category No.: 9282, 9226, 14196, 10116, 11861, 3752, 11698, 1356; Payload ID: 18818 relates to Category No.: 9282, 9226, 14196, 10116, 11861; Payload ID: 18819 relates to Category No.: 11978, 926, 9226, 14196, 15542, 12109, 11861, 14147; Payload ID: 18821 relates to Category No.: 9225, 97; Payload ID: 18823 relates to Category No.: 11861; Payload ID: 18824 relates to Category No.: 11861; Payload ID: 18825 relates to Category No.: 11861; Payload ID: 18826 relates to Category No.: 11861; Payload ID: 18828 relates to Category No.: 753, 11861, 11711; Payload ID: 18829 relates to Category No.: 3303, 15503, 14471, 11861; Payload ID: 18830 relates to Category No.: 3303, 15503, 14471; Payload ID: 18831 relates to Category No.: 11861, 5347, 5957, 10163; Payload ID: 18832 relates to Category No.: 11861, 1201; Payload ID: 18833 relates to Category No.: 11861; Payload ID: 18834 relates to Category No.: 11861, 5347, 10163; Payload ID: 18835 relates to Category No.: 11861; Payload ID: 18836 relates to Category No.: 11861; Payload ID: 18837 relates to Category No.: 11861; Payload ID: 18838 relates to Category No.: 11861; Payload ID: 18839 relates to Category No.: 1593, 9818; Payload ID: 18840 relates to Category No.: 16331, 6816, 15895, 6825, 1630, 15881, 11861, 11886; Payload ID: 18841 relates to Category No.: 16331, 6816, 6825, 1630, 11861, 11886; Payload ID: 18842 relates to Category No.: 15881, 11861; Payload ID: 18843 relates to Category No.: 15881; Payload ID: 18844 relates to Category No.: 15881; Payload ID: 18845 relates to Category No.: 15881; Payload ID: 18846 relates to Category No.: 3554, 15881; Payload ID: 18847 relates to Category No.: 6816, 9518, 65, 15881, 11861, 11886; Payload ID: 18848 relates to Category No.: 15027, 11861; Payload ID: 18849 relates to Category No.: 11861; Payload ID: 18850 relates to Category No.: 12150, 11861; Payload ID: 18851 relates to Category No.: 11861, 15887; Payload ID: 18853 relates to Category No.: 10116, 11861; Payload ID: 18854 relates to Category No.: 10116, 11861; Payload ID: 18855 relates to Category No.: 11861; Payload ID: 18856 relates to Category No.: 10116, 11861, 11828; Payload ID: 18857 relates to Category No.: 15911, 6188, 2854, 15895, 9363, 11861, 15887, 560; Payload ID: 18858 relates to Category No.: 15911, 9619, 11861, 15887; Payload ID: 18859 relates to Category No.: 15911, 9363, 10116, 11861, 3665, 11835; Payload ID: 18860 relates to Category No.: 11861; Payload ID: 18861 relates to Category No.: 11861; Payload ID: 18862 relates to Category No.: 11861; Payload ID: 18863 relates to Category No.: 10116, 11861; Payload ID: 18864 relates to Category No.: 15911, 11861, 5922, 12402, 11886, 943; Payload ID: 18865 relates to Category No.: 5105, 5923, 11861; Payload ID: 18866 relates to Category No.: 16331, 15893, 6188, 6121, 11861, 15908; Payload ID: 18867 relates to Category No.: 16331, 15893, 6188, 11861, 6121; Payload ID: 18868 relates to Category No.: 16331, 15908, 15893, 6188, 11861; Payload ID: 18869 relates to Category No.: 16331, 15908, 6188, 1457, 11861, 1201; Payload ID: 18870 relates to Category No.: 16331, 14196, 15908, 6188, 11861, 15887, 15916; Payload ID: 18871 relates to Category No.: 16331, 6188, 7192; Payload ID: 18872 relates to Category No.: 6816, 15908, 15893, 6188, 11861, 15491; Payload ID: 18873 relates to Category No.: 15908, 15893, 6188, 11861; Payload ID: 18874 relates to Category No.: 15908, 15893, 6188, 11861; Payload ID: 18875 relates to Category No.: 6188; Payload ID: 18876 relates to Category No.: 11861, 15094; Payload ID: 18877 relates to Category No.: 15917, 2854, 15911, 11861; Payload ID: 18878 relates to Category No.: 2854, 15917, 9539, 15911, 10116, 11861, 5841; Payload ID: 18879 relates to Category No.: 15917, 15911, 2854, 11861; Payload ID: 18880 relates to Category No.: 2854, 15917, 15911, 11861; Payload ID: 18881 relates to Category No.: 16331, 2854, 15917, 15911, 15895, 9363, 11861, 15887, 2271, 11835, 1105, 15905, 15914; Payload ID: 18882 relates to Category No.: 2854, 15917, 15911, 11861, 3665, 15705, 11835, 2861; Payload ID: 18883 relates to Category No.: 2854, 15917, 15911, 1630, 15567, 14652, 11861, 5347, 15896; Payload ID: 18884 relates to Category No.: 16331, 2854, 15917, 15911, 5105, 15491, 15887, 11861; Payload ID: 18885 relates to Category No.: 15917, 2861; Payload ID: 18886 relates to Category No.: 2854, 15917, 15911; Payload ID: 18887 relates to Category No.: 2854, 15917, 15911; Payload ID: 18888 relates to Category No.: 2854, 15917, 15911; Payload ID: 18889 relates to Category No.: 2854, 15917, 15911; Payload ID: 18890 relates to Category No.: 2854, 15917, 15911; Payload ID: 18891 relates to Category No.: 2854, 15917, 15911; Payload ID: 18892 relates to Category No.: 2854, 15917, 15911; Payload ID: 18893 relates to Category No.: 2854, 15917, 15911; Payload ID: 18894 relates to Category No.: 2854, 15917, 15911, 11861; Payload ID: 18895 relates to Category No.: 2854, 15917, 15911; Payload ID: 18896 relates to Category No.: 2854, 15917, 15911; Payload ID: 18897 relates to Category No.: 2854, 15917, 15911; Payload ID: 18898 relates to Category No.: 15917; Payload ID: 18899 relates to Category No.: 15917, 2861; Payload ID: 18900 relates to Category No.: 15917, 2861; Payload ID: 18901 relates to Category No.: 15917, 2861; Payload ID: 18902 relates to Category No.: 15917, 2861; Payload ID: 18903 relates to Category No.: 15917, 2861; Payload ID: 18904 relates to Category No.: 15917, 2861; Payload ID: 18905 relates to Category No.: 15917, 2861; Payload ID: 18906 relates to Category No.: 15917, 2861; Payload ID: 18907 relates to Category No.: 15917, 2861; Payload ID: 18908 relates to Category No.: 2854, 15917, 15911; Payload ID: 18909 relates to Category No.: 15917; Payload ID: 18910 relates to Category No.: 15917; Payload ID: 18911 relates to Category No.: 2854, 15917, 15911, 11861, 5880; Payload ID: 18912 relates to Category No.: 6816, 2854, 15917, 15911, 11861, 5282, 15895, 6421; Payload ID: 18913 relates to Category No.: 6816, 2854, 15917, 15911, 15895, 11861, 2823, 5347; Payload ID: 18914 relates to Category No.: 16331, 2854, 15917, 15911, 4821, 11861; Payload ID: 18915 relates to Category No.: 2854, 15917, 6816, 15911, 15491, 2861, 11861, 7552; Payload ID: 18916 relates to Category No.: 16331, 2854, 15917, 15911, 15491, 11861, 3752, 6185, 4930; Payload ID: 18917 relates to Category No.: 2854, 15917, 15911, 11861, 1201; Payload ID: 18918 relates to Category No.: 2854, 15917, 15911, 15895, 9619, 11861, 15887, 943, 15097, 15912; Payload ID: 18919 relates to Category No.: 2854, 15917, 15911, 11861; Payload ID: 18920 relates to Category No.: 15917, 2861; Payload ID: 18921 relates to Category No.: 2854, 15917, 15911, 11861; Payload ID: 18922 relates to Category No.: 2854, 15911, 15917; Payload ID: 18923 relates to Category No.: 16331, 2854, 15917, 15911, 5105; Payload ID: 18924 relates to Category No.: 15917, 2861, 2854, 15911, 11861; Payload ID: 18925 relates to Category No.: 2854, 15917, 15911; Payload ID: 18926 relates to Category No.: 1405, 2854, 15917, 15911, 11861; Payload ID: 18927 relates to Category No.: 16331, 2854, 15917, 15911, 4821, 11861, 12379, 2861; Payload ID: 18928 relates to Category No.: 1201, 2854, 15917, 15911, 11861, 2861; Payload ID: 18929 relates to Category No.: 2854, 15917, 15911, 1201; Payload ID: 18930 relates to Category No.: 2854, 15917, 15911, 10116; Payload ID: 18931 relates to Category No.: 2854, 15917, 15911, 11981, 11861; Payload ID: 18932 relates to Category No.: 2854, 15917, 15911; Payload ID: 18933 relates to Category No.: 16331, 15917; Payload ID: 18934 relates to Category No.: 6816, 2854, 15917, 15911, 11861, 5347, 421; Payload ID: 18935 relates to Category No.: 2854, 15917, 15911; Payload ID: 18936 relates to Category No.: 2854, 15917, 15911, 5880; Payload ID: 18937 relates to Category No.: 2854, 15917, 15911, 11861; Payload ID: 18938 relates to Category No.: 2854, 15917, 15911; Payload ID: 18939 relates to Category No.: 16331, 2854, 15917, 15911, 11861; Payload ID: 18940 relates to Category No.: 16331, 2854, 15917, 15911; Payload ID: 18941 relates to Category No.: 15917, 15911, 11861; Payload ID: 18942 relates to Category No.: 2854, 15917, 15911, 11861, 16277; Payload ID: 18943 relates to Category No.: 2854, 15917, 15911, 11861; Payload ID: 18944 relates to Category No.: 16331, 2854, 15917, 15911, 5105, 11861, 2861; Payload ID: 18945 relates to Category No.: 16331, 2854, 15917, 15911, 9363, 11861, 15887; Payload ID: 18946 relates to Category No.: 2854, 15917, 15911; Payload ID: 18947 relates to Category No.: 16331, 2854, 15917, 15911; Payload ID: 18948 relates to Category No.: 15917; Payload ID: 18949 relates to Category No.: 15917, 11861; Payload ID: 18950 relates to Category No.: 9226, 2854, 15917, 15911, 1457, 11861; Payload ID: 18951 relates to Category No.: 11895, 2854, 15917, 15504, 9539, 15911, 15895, 11861, 2861; Payload ID: 18952 relates to Category No.: 2854, 15917, 15911, 11861, 14537; Payload ID: 18953 relates to Category No.: 2854, 15917, 15911, 2861, 11861, 2737, 1201; Payload ID: 18954 relates to Category No.: 2854, 15917, 15911, 2861, 2737, 1201;

Payload ID: 18955 relates to Category No.: 11861, 15097, 15102; Payload ID: 18956 relates to Category No.: 15908, 6188, 11861, 15916, 15893; Payload ID: 18957 relates to Category No.: 15908, 6188, 3752, 15916, 11861, 943; Payload ID: 18958 relates to Category No.: 15895, 15893, 11861, 15888, 15889; Payload ID: 18959 relates to Category No.: 15895, 15893, 11861, 15888; Payload ID: 18960 relates to Category No.: 926, 15895, 15893, 15888; Payload ID: 18961 relates to Category No.: 15895, 15893, 926, 15888; Payload ID: 18962 relates to Category No.: 926, 15908, 15895, 15893, 11861, 15888, 6188; Payload ID: 18963 relates to Category No.: 926, 15908, 15895, 15893, 11861, 15888, 6188; Payload ID: 18964 relates to Category No.: 926, 15908, 15895, 15893, 11861, 15888; Payload ID: 18965 relates to Category No.: 926, 15908, 11861, 15888, 6188; Payload ID: 18966 relates to Category No.: 926, 15908, 11861, 15888, 6188; Payload ID: 18967 relates to Category No.: 926, 15908, 11861, 15888, 6188; Payload ID: 18968 relates to Category No.: 926, 15908, 11861, 15888, 6188; Payload ID: 18969 relates to Category No.: 926, 15908, 11861, 15888, 5878, 6188; Payload ID: 18970 relates to Category No.: 926, 15908, 11861, 15888, 5878, 6188; Payload ID: 18971 relates to Category No.: 926, 6188, 15908, 11861, 15888; Payload ID: 18972 relates to Category No.: 926, 6188, 11861, 7551; Payload ID: 18973 relates to Category No.: 926, 15908, 15895, 15893, 15888, 6188; Payload ID: 18974 relates to Category No.: 926, 15908, 15895, 15893, 11861, 15888, 5347; Payload ID: 18975 relates to Category No.: 926, 15908, 15895, 15893, 11861, 15888, 6188; Payload ID: 18976 relates to Category No.: 926, 15504, 15101, 6188, 10116, 11861, 3752, 14186, 15098, 5234; Payload ID: 18977 relates to Category No.: 926, 15908, 15895, 11861, 15916; Payload ID: 18978 relates to Category No.: 926, 15908, 15895, 15491, 10116, 11861, 15888, 3752, 15907; Payload ID: 18979 relates to Category No.: 15908, 11861, 15906, 5878, 926, 6188; Payload ID: 18980 relates to Category No.: 926, 15908, 11861, 14168, 7551, 6188; Payload ID: 18981 relates to Category No.: 926, 15908, 15895, 15893, 10116, 11861, 15887, 15888, 6188; Payload ID: 18983 relates to Category No.: 926, 15908, 15895, 15893, 10116, 11861, 15888; Payload ID: 18984 relates to Category No.: 926, 11861, 15888; Payload ID: 18985 relates to Category No.: 926, 15908, 11861, 15888; Payload ID: 18987 relates to Category No.: 926, 11861, 15888; Payload ID: 18988 relates to Category No.: 926, 15908, 15895, 15893, 11861, 15888; Payload ID: 18989 relates to Category No.: 926, 15908, 15895, 15893, 15888, 6188; Payload ID: 18990 relates to Category No.: 926, 15908, 2405, 15895, 15893, 15888; Payload ID: 18991 relates to Category No.: 926, 15895, 15893, 6188, 11861; Payload ID: 18992 relates to Category No.: 15893, 926, 15908, 15895, 11861; Payload ID: 18993 relates to Category No.: 926, 15895, 15893, 11861, 15888; Payload ID: 18995 relates to Category No.: 11861, 15964; Payload ID: 18996 relates to Category No.: 11861; Payload ID: 18997 relates to Category No.: 11861, 2271, 15906; Payload ID: 18998 relates to Category No.: 11861; Payload ID: 18999 relates to Category No.: 11861, 7192, 12121; Payload ID: 19000 relates to Category No.: 11861; Payload ID: 19001 relates to Category No.: 9962, 12111, 11861; Payload ID: 19002 relates to Category No.: 926, 10116, 11861, 15886, 14666; Payload ID: 19003 relates to Category No.: 14666, 926, 3749, 6816, 11933, 11861, 15095, 15504; Payload ID: 19004 relates to Category No.: 926, 14666, 250, 7550, 11933, 11861, 6184; Payload ID: 19005 relates to Category No.: 926, 6816, 11861, 14666, 15962; Payload ID: 19006 relates to Category No.: 926, 11861, 15886, 4096, 14666; Payload ID: 19007 relates to Category No.: 926, 11861, 14666, 5877; Payload ID: 19008 relates to Category No.: 16331, 15908, 15503, 14471, 6900, 15893, 5105, 6905, 6188, 2690, 11861, 5347, 9272, 4991; Payload ID: 19009 relates to Category No.: 3303, 16331, 15908, 15893, 5105, 6188, 11861; Payload ID: 19010 relates to Category No.: 6816, 5116, 11861, 3274, 14234, 5117, 2405; Payload ID: 19011 relates to Category No.: 6965, 2405, 11861, 14249, 1173; Payload ID: 19012 relates to Category No.: 16331, 15908, 15895, 6188, 11861, 15916, 15893; Payload ID: 19013 relates to Category No.: 15895, 11861, 15887, 943, 10163, 5922, 5924; Payload ID: 19014 relates to Category No.: 11861; Payload ID: 19015 relates to Category No.: 11861, 15887; Payload ID: 19016 relates to Category No.: 11861, 15887, 12086, 217; Payload ID: 19017 relates to Category No.: 11861, 15887, 12086; Payload ID: 19018 relates to Category No.: 11861; Payload ID: 19019 relates to Category No.: 11861, 7192; Payload ID: 19020 relates to Category No.: 15504, 15895, 11861, 15887; Payload ID: 19021 relates to Category No.: 11861, 9226, 14284; Payload ID: 19022 relates to Category No.: 11939, 11933, 15542, 15554, 4562, 14961, 3753, 3752, 14077; Payload ID: 19023 relates to Category No.: 11939, 11933, 15542, 15554, 4562, 3752, 11983; Payload ID: 19024 relates to Category No.: 11939, 11933, 15542, 15554, 4562, 3752, 14077; Payload ID: 19025 relates to Category No.: 11939, 11933, 15542, 15554, 4562, 3752; Payload ID: 19026 relates to Category No.: 15542, 15554, 4562; Payload ID: 19027 relates to Category No.: 11939, 11933, 15542, 15554, 4562, 3752; Payload ID: 19028 relates to Category No.: 11939, 11933, 15542, 15554, 4562, 3753, 3752, 3471, 14077, 11983; Payload ID: 19029 relates to Category No.: 11939, 11933, 15542, 15554, 4562, 14961, 3753, 3752, 3471, 14077, 4103; Payload ID: 19030 relates to Category No.: 11939, 11933, 15542, 15554, 4562, 3753, 3752, 14077; Payload ID: 19031 relates to Category No.: 15542, 15554, 4562; Payload ID: 19032 relates to Category No.: 15542, 15554, 4562; Payload ID: 19033 relates to Category No.: 15542, 15554, 4562; Payload ID: 19034 relates to Category No.: 15542, 15554, 4562; Payload ID: 19035 relates to Category No.: 15542, 15554, 4562; Payload ID: 19036 relates to Category No.: 15542, 15554, 4562; Payload ID: 19037 relates to Category No.: 15542, 15554, 4562; Payload ID: 19038 relates to Category No.: 15542, 15554, 4562; Payload ID: 19039 relates to Category No.: 15542, 15554, 4562; Payload ID: 19040 relates to Category No.: 15542, 15554, 4562; Payload ID: 19041 relates to Category No.: 15542, 15554, 4562, 15943; Payload ID: 19042 relates to Category No.: 15542, 15554, 4562, 15943; Payload ID: 19043 relates to Category No.: 15542, 15554, 4562, 80, 15926; Payload ID: 19044 relates to Category No.: 4363, 15927, 4364, 15925; Payload ID: 19045 relates to Category No.: 4363, 15925; Payload ID: 19046 relates to Category No.: 4363, 15925; Payload ID: 19047 relates to Category No.: 4363, 15925, 4400; Payload ID: 19048 relates to Category No.: 4363, 15925; Payload ID: 19049 relates to Category No.: 11939, 4363, 598, 6574, 1173, 6001, 1171, 7450, 15927, 11861, 2936, 11981, 15542, 15553; Payload ID: 19050 relates to Category No.: 6816, 4363, 6001, 1171, 7450; Payload ID: 19051 relates to Category No.: 6816, 4363, 1171, 7450; Payload ID: 19052 relates to Category No.: 6816, 4363, 7450, 15542, 15553; Payload ID: 19053 relates to Category No.: 6816, 4363; Payload ID: 19054 relates to Category No.: 6816, 4363, 15542, 15553; Payload ID: 19055 relates to Category No.: 11939, 1630, 2557, 15946, 15928; Payload ID: 19056 relates to Category No.: 4363, 7452; Payload ID: 19057 relates to Category No.: 4363, 7452, 1131; Payload ID:

19058 relates to Category No.: 4363, 7452; Payload ID: 19059 relates to Category No.: 4363, 1163, 6002; Payload ID: 19060 relates to Category No.: 4363, 1131, 239; Payload ID: 19061 relates to Category No.: 4363; Payload ID: 19062 relates to Category No.: 4363, 12060; Payload ID: 19063 relates to Category No.: 4363; Payload ID: 19064 relates to Category No.: 15542, 15553; Payload ID: 19065 relates to Category No.: 3554, 9518, 321, 7477, 7472, 15929; Payload ID: 19066 relates to Category No.: 15542, 15553, 2209; Payload ID: 19067 relates to Category No.: 15933, 15973, 11861; Payload ID: 19068 relates to Category No.: 15542, 15553, 11861, 15933; Payload ID: 19069 relates to Category No.: 6816, 16046, 16018, 11861, 5347, 4532, 12319; Payload ID: 19070 relates to Category No.: 11939, 1630, 7490, 15939, 2557; Payload ID: 19071 relates to Category No.: 16018, 5347, 15949, 1504; Payload ID: 19072 relates to Category No.: 16018, 15949; Payload ID: 19073 relates to Category No.: 9518, 1630, 9518, 321, 7477, 7192; Payload ID: 19074 relates to Category No.: 6188, 11861, 15964; Payload ID: 19075 relates to Category No.: 15358, 7192, 15963; Payload ID: 19076 relates to Category No.: 15358, 11861, 15963; Payload ID: 19077 relates to Category No.: 5109, 11861, 5347; Payload ID: 19079 relates to Category No.: 7539; Payload ID: 19080 relates to Category No.: 7539; Payload ID: 19081 relates to Category No.: 7539; Payload ID: 19082 relates to Category No.: 3303, 14471; Payload ID: 19083 relates to Category No.: 6210, 11861; Payload ID: 19084 relates to Category No.: 6210, 11861; Payload ID: 19085 relates to Category No.: 6816, 11861, 15181, 12064, 3215; Payload ID: 19086 relates to Category No.: 6816, 11861, 3215, 14564, 12399; Payload ID: 19087 relates to Category No.: 6816, 11861, 3215; Payload ID: 19088 relates to Category No.: 11861, 12359; Payload ID: 19089 relates to Category No.: 11861, 1201, 5282; Payload ID: 19090 relates to Category No.: 11861, 1201, 5282; Payload ID: 19091 relates to Category No.: 9619, 11861; Payload ID: 19092 relates to Category No.: 11861; Payload ID: 19093 relates to Category No.: 11861; Payload ID: 19094 relates to Category No.: 11861, 8863; Payload ID: 19095 relates to Category No.: 11861; Payload ID: 19096 relates to Category No.: 14196; Payload ID: 19097 relates to Category No.: 11978, 926, 12109, 12359, 11861, 11886; Payload ID: 19098 relates to Category No.: 11978, 926, 12109, 11861; Payload ID: 19099 relates to Category No.: 11978, 926, 12109, 11861; Payload ID: 19100 relates to Category No.: 11978, 926, 12109, 1201; Payload ID: 19101 relates to Category No.: 1201; Payload ID: 19103 relates to Category No.: 7192; Payload ID: 19105 relates to Category No.: 14503; Payload ID: 19108 relates to Category No.: 11861; Payload ID: 19112 relates to Category No.: 11978, 926; Payload ID: 19113 relates to Category No.: 11861; Payload ID: 19114 relates to Category No.: 11861, 9507; Payload ID: 19115 relates to Category No.: 11861; Payload ID: 19116 relates to Category No.: 15629, 11861, 9507; Payload ID: 19117 relates to Category No.: 15491, 11861, 5235; Payload ID: 19118 relates to Category No.: 16331, 6816, 10116, 7271; Payload ID: 19119 relates to Category No.: 16331, 6188, 11861, 6816; Payload ID: 19120 relates to Category No.: 11861; Payload ID: 19121 relates to Category No.: 926, 3303, 16331, 14196, 2405, 4965, 961, 10116, 11861; Payload ID: 19122 relates to Category No.: 14196, 11861, 1201; Payload ID: 19123 relates to Category No.: 9282, 14196, 11861, 9239; Payload ID: 19124 relates to Category No.: 9282, 10116, 7268, 11861, 9239; Payload ID: 19127 relates to Category No.: 4886; Payload ID: 19128 relates to Category No.: 3303, 15503, 14471, 14471, 15495; Payload ID: 19129 relates to Category No.: 3303, 2405, 10116, 11861; Payload ID: 19130 relates to Category No.: 3303; Payload ID: 19131 relates to Category No.: 11939, 1178, 11933, 14471, 11917, 5109, 11981, 11861, 3752, 15503, 14239, 3303, 15503, 14471, 3459; Payload ID: 19132 relates to Category No.: 15503, 14471, 11939, 1178, 11933, 14471, 11917, 11861, 15503, 14239, 3303; Payload ID: 19133 relates to Category No.: 11917, 1405, 3303, 6595; Payload ID: 19134 relates to Category No.: 2963, 11861, 5308, 5310, 15984; Payload ID: 19135 relates to Category No.: 11861, 16011; Payload ID: 19136 relates to Category No.: 10116, 1201; Payload ID: 19138 relates to Category No.: 1537; Payload ID: 19139 relates to Category No.: 6816, 5308, 307, 1174; Payload ID: 19141 relates to Category No.: 2405, 11861, 14249, 12082, 9806; Payload ID: 19142 relates to Category No.: 1630, 9446, 9447; Payload ID: 19143 relates to Category No.: 1630, 15542, 15555, 16014; Payload ID: 19144 relates to Category No.: 1630, 11861, 15542, 15555, 16014; Payload ID: 19145 relates to Category No.: 926, 5956, 9255, 16011; Payload ID: 19146 relates to Category No.: 926, 5956, 11861, 16011; Payload ID: 19147 relates to Category No.: 926, 5956, 9255, 16011, 11861; Payload ID: 19148 relates to Category No.: 16022; Payload ID: 19149 relates to Category No.: 5259, 11861, 8959, 4821, 2731, 2730, 5111; Payload ID: 19150 relates to Category No.: 5259, 12402, 4821, 5260, 11861, 2731; Payload ID: 19151 relates to Category No.: 5259, 4821, 2731, 11861; Payload ID: 19152 relates to Category No.: 1405, 11861, 5353, 4023; Payload ID: 19153 relates to Category No.: 1405, 9620, 11861; Payload ID: 19154 relates to Category No.: 15086; Payload ID: 19155 relates to Category No.: 11939, 7225, 11861; Payload ID: 19156 relates to Category No.: 15029; Payload ID: 19157 relates to Category No.: 11861; Payload ID: 19158 relates to Category No.: 11861; Payload ID: 19160 relates to Category No.: 14230; Payload ID: 19161 relates to Category No.: 11861, 16029, 4158; Payload ID: 19162 relates to Category No.: 16032, 2559; Payload ID: 19163 relates to Category No.: 5259, 12402; Payload ID: 19164 relates to Category No.: 4820, 16033; Payload ID: 19165 relates to Category No.: 5259, 4821; Payload ID: 19166 relates to Category No.: 11861, 14812, 7409; Payload ID: 19167 relates to Category No.: 11861, 9608; Payload ID: 19168 relates to Category No.: 11861, 14812, 11939; Payload ID: 19169 relates to Category No.: 11861, 7393, 2566, 11939; Payload ID: 19170 relates to Category No.: 12142, 10116, 11861, 1201; Payload ID: 19171 relates to Category No.: 4894, 12359; Payload ID: 19172 relates to Category No.: 10116, 11861; Payload ID: 19174 relates to Category No.: 10116, 11861; Payload ID: 19175 relates to Category No.: 14712, 10116, 11861; Payload ID: 19176 relates to Category No.: 10116, 11861; Payload ID: 19177 relates to Category No.: 10116, 11861, 1201; Payload ID: 19178 relates to Category No.: 10116, 11861, 14669; Payload ID: 19179 relates to Category No.: 10116, 11861; Payload ID: 19180 relates to Category No.: 14712; Payload ID: 19181 relates to Category No.: 11861, 16331, 3516, 267, 15021, 5588, 11981, 16184, 277; Payload ID: 19182 relates to Category No.: 14706, 11861, 14537; Payload ID: 19183 relates to Category No.: 11861, 7192; Payload ID: 19184 relates to Category No.: 11861, 14232; Payload ID: 19185 relates to Category No.: 1201, 12399, 11861; Payload ID: 19186 relates to Category No.: 11978, 926, 12109, 11981, 5195, 11861, 5197, 9272; Payload ID: 19187 relates to Category No.: 11978, 926, 12109, 11981, 11920, 11861; Payload ID: 19188 relates to Category No.: 11978, 926, 12109, 12081; Payload ID: 19189 relates to Category No.: 16331, 11861, 1201, 9282, 15180, 11920; Payload ID: 19190 relates to Category No.: 11861; Payload ID: 19193 relates to Category No.: 11861; Payload ID: 19194 relates to Category No.: 267, 11861, 277; Payload ID: 19195 relates to Category No.: 6816, 11861, 1327, 15180, 11861, 267; Payload ID: 19196 relates to Category No.: 11939, 15029, 11861, 12064; Payload ID: 19197 relates to Category No.: 11861, 15887, 11886; Payload ID: 19198 relates to Category No.: 11861; Payload ID: 19199 relates to Category No.: 11861; Payload ID: 19200 relates to Category No.: 11895, 11861, 15887, 9882; Payload ID: 19201 relates to Category No.: 11861; Payload ID: 19202 relates to Category No.: 11861, 1439; Payload ID: 19203 relates to Category No.: 11861, 1439; Payload ID: 19205 relates to Category No.: 11861; Payload ID: 19206 relates to Category No.: 926, 942, 11895, 11920, 11861, 942, 2744; Payload ID: 19207 relates to Category No.: 926, 942, 11939, 11895, 11861, 942, 2744, 5347; Payload ID: 19208 relates to Category No.: 16331, 11861, 7192, 5347, 4896, 6965, 12107; Payload ID: 19209 relates to Category No.: 11861, 7192; Payload ID: 19210 relates to Category No.: 11861, 7192; Payload ID: 19211 relates to Category No.: 15180, 11861; Payload ID: 19212 relates to Category No.: 11861; Payload ID: 19213 relates to Category No.: 15180, 11861; Payload ID: 19214 relates to Category No.: 3303, 11861; Payload ID: 19215 relates to Category No.: 16331, 11861; Payload ID: 19216 relates to Category No.: 11861; Payload ID: 19217 relates to Category No.: 11978, 926, 5956, 12109, 11861, 5347, 9874, 9877, 3752, 12114, 37, 9062, 11981, 11983, 4893, 12077; Payload ID: 19218 relates to Category No.: 11978, 926, 12109, 11861, 11983; Payload ID: 19219 relates to Category No.: 11978, 926, 12109, 11861; Payload ID: 19220 relates to Category No.: 926, 5308, 942, 942, 15895, 6210, 11920, 10116, 11861, 12081, 1105, 15915, 10163, 3184, 15905, 6933, 5922, 12402, 11886, 5347, 456; Payload ID: 19221 relates to Category No.: 15911; Payload ID: 19222 relates to Category No.: 11861, 12181; Payload ID: 19223 relates to Category No.: 926, 9282, 630, 16074, 11861, 632; Payload ID: 19224 relates to Category No.: 926, 9282, 630, 16074, 632; Payload ID: 19225 relates to Category No.: 14564, 11933, 6965, 11920, 11861, 4170; Payload ID: 19226 relates to Category No.: 11939, 11933, 6965, 11861, 3752, 1173, 4170; Payload ID: 19227 relates to Category No.: 11861; Payload ID: 19228 relates to Category No.: 11861; Payload ID: 19229 relates to Category No.: 5308, 307, 5308, 307, 5403, 4796, 9564; Payload ID: 19230 relates to Category No.: 5308, 307, 5308, 307, 5403, 9564; Payload ID: 19231 relates to Category No.: 5308, 307, 9564, 5308, 307, 5403; Payload ID: 19232 relates to Category No.: 2405; Payload ID: 19233 relates to Category No.: 7192; Payload ID: 19238 relates to Category No.: 5588, 11727, 11861, 1706; Payload ID: 19239 relates to Category No.: 4864, 5009, 11939, 11933, 2874, 2282, 11861, 5347, 4196, 4016, 12400, 8965, 10092, 16084, 16082, 16081, 12402; Payload ID: 19240 relates to Category No.: 4864, 5009, 2282, 11861, 16081, 11939, 11933; Payload ID: 19241 relates to Category No.: 4864, 2282, 11861, 16083; Payload ID: 19242 relates to Category No.: 9226, 6816, 3303; Payload ID: 19243 relates to Category No.: 5259, 11861, 8959, 12402; Payload ID: 19244 relates to Category No.: 4820, 15617, 11861, 16098; Payload ID: 19245 relates to Category No.: 4820, 15617, 16098; Payload ID: 19246 relates to Category No.: 267, 14537, 11861, 11759; Payload ID: 19247 relates to Category No.: 11861; Payload ID: 19249 relates to Category No.: 11861, 15561; Payload ID: 19250 relates to Category No.: 6816, 14107, 4924, 11861, 15503, 14471, 12364; Payload ID: 19251 relates to Category No.: 6816, 14107, 4924, 11861, 3774; Payload ID: 19252 relates to Category No.: 6816, 4894, 14107, 4924, 11861, 14538, 12364, 3774; Payload ID: 19253 relates to Category No.: 12399, 753, 11861, 3752, 943, 15915; Payload ID: 19254 relates to Category No.: 11861, 14536, 3765, 14538, 12090, 11920, 11861, 1327; Payload ID: 19255 relates to Category No.: 14564, 10116, 11861, 14538; Payload ID: 19256 relates to Category No.: 3303, 14471, 11861; Payload ID: 19257 relates to Category No.: 3303, 14471, 15503, 14471, 2406, 15530, 14255, 14241; Payload ID: 19258 relates to Category No.: 3303, 15503, 14471, 14471, 2406, 15530, 14255, 14241; Payload ID: 19259 relates to Category No.: 1201; Payload ID: 19260 relates to Category No.: 1405, 1504, 5293, 11861, 4720, 12081; Payload ID: 19261 relates to Category No.: 3303, 14471, 15630; Payload ID: 19262 relates to Category No.: 1405, 11861, 1439, 787, 6341, 4710, 16153, 4717, 16151, 12448; Payload ID: 19263 relates to Category No.: 11895, 11861; Payload ID: 19264 relates to Category No.: 16331, 9518; Payload ID: 19265 relates to Category No.: 16331, 9518, 11861; Payload ID: 19266 relates to Category No.: 14706, 14705, 11861; Payload ID: 19267 relates to Category No.: 14706, 14705, 11861, 2325; Payload ID: 19268 relates to Category No.: 14706, 14705, 11861; Payload ID: 19269 relates to Category No.: 9939, 14706, 14705, 1457, 15180, 11861, 15181, 1439, 12107, 11895, 11886, 5347, 7393, 5841; Payload ID: 19270 relates to Category No.: 14706, 14705, 11861, 15181; Payload ID: 19271 relates to Category No.: 14706, 14705, 11861; Payload ID: 19272 relates to Category No.: 14706, 14705, 11861; Payload ID: 19273 relates to Category No.: 14706, 14705, 11861, 15180; Payload ID: 19274 relates to Category No.: 14706, 14705, 11861, 2325; Payload ID: 19275 relates to Category No.: 14564; Payload ID: 19276 relates to Category No.: 15491, 11895; Payload ID: 19277 relates to Category No.: 11861, 15491, 11895; Payload ID: 19278 relates to Category No.: 11895; Payload ID: 19279 relates to Category No.: 11861; Payload ID: 19280 relates to Category No.: 15503, 14471, 14471, 14251, 14471, 3303, 14564, 11861, 2405; Payload ID: 19281 relates to Category No.: 3303, 15503, 14471, 14471, 15504, 14251, 14471, 11861, 5101; Payload ID: 19282 relates to Category No.: 3303, 15503, 14471, 14234, 14471, 11861, 15530, 14233, 14243, 4517; Payload ID: 19283 relates to Category No.: 7393, 11861; Payload ID: 19284 relates to Category No.: 4864, 5259, 7192, 8959; Payload ID: 19285 relates to Category No.: 1405, 267, 11939, 277, 2859, 11861, 5347, 9887, 6431; Payload ID: 19286 relates to Category No.: 267, 15021; Payload ID: 19287 relates to Category No.: 15021, 11895, 15029, 3464, 11861, 5347, 4710, 14377, 5935, 15023; Payload ID: 19289 relates to Category No.: 277, 3516, 267, 15029, 15895, 1153, 1369, 11861, 581; Payload ID: 19290 relates to Category No.: 1405, 11861; Payload ID: 19291 relates to Category No.: 3303, 15503, 14471, 14471; Payload ID: 19292 relates to Category No.: 3303, 14471, 11861; Payload ID: 19293 relates to Category No.: 3303, 16331, 15503, 14471, 14471, 14968, 11861, 1391, 6268, 14087, 1389, 6267, 16226, 14251, 6183; Payload ID: 19294 relates to Category No.: 12352, 16238; Payload ID: 19295 relates to Category No.: 12352, 16238; Payload ID: 19296 relates to Category No.: 7192; Payload ID: 19297 relates to Category No.: 4720; Payload ID: 19298 relates to Category No.: 14379, 5588, 5009, 11861, 10154, 4016; Payload ID: 19299 relates to Category No.: 11978, 926, 6816, 11939, 15612, 12145, 12421, 11861, 2875, 11828, 14946; Payload ID: 19301 relates to Category No.: 3303, 15503, 14471, 14471, 11861, 15528, 14255; Payload ID: 19302 relates to Category No.: 3303, 15503, 14471, 11939, 11933, 14471, 15528, 14255, 15528, 14233, 14234, 11861; Payload ID: 19303 relates to Category No.: 3303, 15503, 14471, 14471, 15504, 11861, 15528, 14255, 15528, 14233, 14234; Payload ID: 19304 relates to Category No.: 3303, 15503, 14471, 14471, 15528, 14255; Payload ID: 19305 relates to Category No.: 3303, 15503, 14471, 11933, 14471, 11861, 15528, 14255; Payload ID: 19306 relates to Category No.: 3303, 15503, 14471, 14471, 15528, 14255, 11861, 15525, 15494, 14186; Payload ID: 19307 relates to Category No.: 11978, 926, 12109, 6602, 11861; Payload ID: 19308 relates to Category No.: 3303, 14234, 11861, 15528, 14233, 15503, 14471, 16277; Payload ID: 19309 relates to Category No.: 3303, 14234, 15528, 14233; Payload ID: 19310 relates to Category No.: 3303, 15503, 14471, 14234, 11861, 15528, 14233; Payload ID: 19311 relates to Category No.: 15503, 14471, 11917, 3303, 14234, 15504, 11861, 15528, 14233, 13735, 11886, 3530; Payload ID: 19312 relates to Category No.: 3303, 15503, 14471, 11917, 11861; Payload ID: 19313 relates to Category No.: 3303, 15503, 14471, 11917, 11861; Payload ID: 19314 relates to Category No.: 11981, 16243, 11861, 5841, 10171, 706, 11886; Payload ID: 19315 relates to Category No.: 16243, 9282, 11861, 10171; Payload ID: 19316 relates to Category No.: 16243, 9282, 10171; Payload ID: 19317 relates to Category No.: 9802; Payload ID: 19318 relates to Category No.: 9802; Payload ID: 19319 relates to Category No.: 9802; Payload ID: 19320 relates to Category No.: 11861, 15766; Payload ID: 19321 relates to Category No.: 15908, 15504, 15893, 11861, 3752; Payload ID: 19322 relates to Category No.: 11861, 11886; Payload ID: 19323 relates to Category No.: 11939, 5588, 11861, 5347, 2271, 11828, 2566, 12064, 4710, 5377; Payload ID: 19324 relates to Category No.: 11861, 5347; Payload ID: 19325 relates to Category No.: 1405, 11861, 5347; Payload ID: 19331 relates to Category No.: 7192; Payload ID: 19332 relates to Category No.: 926, 942; Payload ID: 19334 relates to Category No.: 1405, 11861; Payload ID: 19335 relates to Category No.: 11861, 7192; Payload ID: 19336 relates to Category No.: 11861; Payload ID: 19337 relates to Category No.: 11861, 1405; Payload ID: 19338 relates to Category No.: 926, 11861, 5194, 1201; Payload ID: 19339 relates to Category No.: 16331, 11861, 1201; Payload ID: 19340 relates to Category No.: 12142, 11861; Payload ID: 19341 relates to Category No.: 12142; Payload ID: 19342 relates to Category No.: 16331, 12142, 11861; Payload ID: 19343 relates to Category No.: 11861; Payload ID: 19344 relates to Category No.: 12142, 11861, 1201; Payload ID: 19346 relates to Category No.: 15629, 4894; Payload ID: 19347 relates to Category No.: 4886, 4895, 15895, 11861, 7393, 943, 4422, 3538; Payload ID: 19348 relates to Category No.: 4886, 4895, 15895, 11861, 943, 4422; Payload ID: 19349 relates to Category No.: 3303, 15503, 14471, 2405, 11861, 14240, 15528, 14239, 14471; Payload ID: 19350 relates to Category No.: 3303, 15503, 14471, 14234, 11939, 11933, 2405, 15504, 15524, 15895, 5109, 11981, 14243, 11861, 15530, 14233, 5347, 15528, 14233, 15503, 14239, 13735, 12064, 14240, 9014, 2406, 322, 327, 9809, 15528, 14239, 14471, 3752, 713, 11886; Payload ID: 19351 relates to Category No.: 3303, 15503, 14471, 2405, 14251, 14471, 15495, 14243, 11861, 2688; Payload ID: 19352 relates to Category No.: 11861; Payload ID: 19353 relates to Category No.: 11861; Payload ID: 19354 relates to Category No.: 11861; Payload ID: 19355 relates to Category No.: 11861; Payload ID: 19356 relates to Category No.: 11861; Payload ID: 19357 relates to Category No.: 10116, 11861; Payload ID: 19358 relates to Category No.: 11861, 2874; Payload ID: 19359 relates to Category No.: 11861; Payload ID: 19360 relates to Category No.: 11861; Payload ID: 19361 relates to Category No.: 11861; Payload ID: 19362 relates to Category No.: 11861; Payload ID: 19363 relates to Category No.: 11861; Payload ID: 19364 relates to Category No.: 11861, 12402; Payload ID: 19365 relates to Category No.: 14504, 9620, 7192; Payload ID: 19366 relates to Category No.: 14504, 9620; Payload ID: 19367 relates to Category No.: 9620; Payload ID: 19369 relates to Category No.: 14504, 9620; Payload ID: 19370 relates to Category No.: 14504, 9620; Payload ID: 19371 relates to Category No.: 2858, 14504, 9620, 3665, 895; Payload ID: 19372 relates to Category No.: 9620, 14504; Payload ID: 19373 relates to Category No.: 14504, 9620; Payload ID: 19374 relates to Category No.: 14504, 9620; Payload ID: 19375 relates to Category No.: 14504, 9620; Payload ID: 19376 relates to Category No.: 11861; Payload ID: 19377 relates to Category No.: 14504, 9620, 11861, 6826; Payload ID: 19378 relates to Category No.: 14504, 11861, 9620, 6826; Payload ID: 19379 relates to Category No.: 11861, 1201; Payload ID: 19380 relates to Category No.: 267, 15895, 598, 11861; Payload ID: 19381 relates to Category No.: 267, 12363, 11861, 11886; Payload ID: 19382 relates to Category No.: 267, 11861, 11886; Payload ID: 19383 relates to Category No.: 267; Payload ID: 19384 relates to Category No.: 267, 6965, 4901, 848; Payload ID: 19385 relates to Category No.: 267, 277, 11861, 11759; Payload ID: 19386 relates to Category No.: 267, 277, 11861; Payload ID: 19387 relates to Category No.: 267, 277, 14537; Payload ID: 19388 relates to Category No.: 16296; Payload ID: 19389 relates to Category No.: 11861, 5105, 5109, 3753; Payload ID: 19390 relates to Category No.: 16331, 6816, 56, 11861; Payload ID: 19391 relates to Category No.: 6816, 11861; Payload ID: 19392 relates to Category No.: 6816, 56, 11861, 1201, 1171; Payload ID: 19393 relates to Category No.: 3303, 11861, 14196, 2405, 14218; Payload ID: 19394 relates to Category No.: 11861; Payload ID: 19395 relates to Category No.: 11861; Payload ID: 19396 relates to Category No.: 11861; Payload ID: 19397 relates to Category No.: 14196, 11861; Payload ID: 19398 relates to Category No.: 11861; Payload ID: 19399 relates to Category No.: 267, 11861; Payload ID: 19400 relates to Category No.: 11861; Payload ID: 19401 relates to Category No.: 11861, 14147; Payload ID: 19402 relates to Category No.: 11861; Payload ID: 19403 relates to Category No.: 11861; Payload ID: 19404 relates to Category No.: 11861; Payload ID: 19405 relates to Category No.: 11861; Payload ID: 19406 relates to Category No.: 11861; Payload ID: 19407 relates to Category No.: 11861; Payload ID: 19408 relates to Category No.: 11861; Payload ID: 19409 relates to Category No.: 11861; Payload ID: 19410 relates to Category No.: 11861; Payload ID: 19411 relates to Category No.: 14712, 10116, 11861; Payload ID: 19412 relates to Category No.: 11861; Payload ID: 19413 relates to Category No.: 10116, 11861; Payload ID: 19414 relates to Category No.: 11861; Payload ID: 19415 relates to Category No.: 9857, 11861; Payload ID: 19416 relates to Category No.: 10116, 11861; Payload ID: 19417 relates to Category No.: 11861; Payload ID: 19418 relates to Category No.: 11861; Payload ID: 19419 relates to Category No.: 11861, 15686; Payload ID: 19420 relates to Category No.: 11861; Payload ID: 19421 relates to Category No.: 6965, 10116, 11861, 3508; Payload ID: 19422 relates to Category No.: 11861, 12359; Payload ID: 19423 relates to Category No.: 11861, 9882, 9880; Payload ID: 19424 relates to Category No.: 11861, 9882, 9880; Payload ID: 19425 relates to Category No.: 10116, 11861; Payload ID: 19426 relates to Category No.: 11861; Payload ID: 19427 relates to Category No.: 11861; Payload ID: 19428 relates to Category No.: 11861, 1405; Payload ID: 19429 relates to Category No.: 11861, 5208, 5099, 5100, 5098; Payload ID: 19430 relates to Category No.: 11861; Payload ID: 19431 relates to Category No.: 11861; Payload ID: 19432 relates to Category No.: 11861, 7192; Payload ID: 19433 relates to Category No.: 11861, 7192; Payload ID: 19434 relates to Category No.: 11861; Payload ID: 19435 relates to Category No.: 11861, 5543, 10116; Payload ID: 19436 relates to Category No.: 11861; Payload ID: 19437 relates to Category No.: 11861; Payload ID: 19438 relates to Category No.: 11861; Payload ID: 19439 relates to Category No.: 11861; Payload ID: 19440 relates to Category No.: 11861; Payload ID: 19441 relates to Category No.: 11861; Payload ID: 19442 relates to Category No.: 11861, 1201; Payload ID: 19443 relates to Category No.: 11861, 3752; Payload ID: 19444 relates to Category No.: 11861; Payload ID: 19445 relates to Category No.: 11861; Payload ID: 19446 relates to Category No.: 11861, 7192; Payload ID: 19447 relates to Category No.: 10116, 11861, 15493; Payload ID: 19448 relates to Category No.: 11861; Payload ID: 19449 relates to Category No.: 11861, 6185; Payload ID: 19450 relates to Category No.: 11861; Payload ID: 19451 relates to Category No.: 6965, 11861, 3508; Payload ID: 19452 relates to Category No.: 5208, 11861, 2405; Payload ID: 19453 relates to Category No.: 11861, 5956; Payload ID: 19455 relates to Category No.: 11861; Payload ID: 19456 relates to Category No.: 11861; Payload ID: 19457 relates to Category No.: 11861; Payload ID: 19458 relates to Category No.: 11861; Payload ID: 19459 relates to Category No.: 11861; Payload ID: 19460 relates to Category No.: 11861; Payload ID: 19461 relates to Category No.: 6900, 11861; Payload ID: 19462 relates to Category No.: 9518, 314, 11861; Payload ID: 19463 relates to Category No.: 14196, 11861, 14395; Payload ID: 19464 relates to Category No.: 12402, 11861, 9882, 9880, 3936, 686; Payload ID: 19465 relates to Category No.: 11861, 9890, 9882, 9880; Payload ID: 19466 relates to Category No.: 15908, 11861; Payload ID: 19467 relates to Category No.: 9939, 1201, 11861; Payload ID: 19468 relates to Category No.: 11861, 5308, 307, 5403, 12184; Payload ID: 19469 relates to Category No.: 11978, 926, 6478, 9096, 12145, 11861; Payload ID: 19470 relates to Category No.: 11978, 926, 6478, 9096; Payload ID: 19471 relates to Category No.: 926, 3303, 6816, 942, 11861, 5347; Payload ID: 19472 relates to Category No.: 926, 3303, 9282, 9226, 6478, 942, 11939, 4965, 954, 1630, 94, 953, 16325, 11861, 3993, 6574, 3325, 93, 11886, 1338, 948, 4834, 4289, 2405; Payload ID: 19473 relates to Category No.: 6816, 11861, 14528; Payload ID: 19474 relates to Category No.: 6924, 10116; Payload ID: 19475 relates to Category No.: 14351, 11861; Payload ID: 19476 relates to Category No.: 10116; Payload ID: 19477 relates to Category No.: 6816, 1504, 10147, 15542, 15553; Payload ID: 19479 relates to Category No.: 16331, 6816, 14196, 15503, 14471, 14471, 15524, 11861, 15528, 14233, 1356, 3459, 9226; Payload ID: 19480 relates to Category No.: 11861; Payload ID: 19481 relates to Category No.: 16331, 11861, 15495; Payload ID: 19482 relates to Category No.: 12402, 2874, 4291, 11861, 12400; Payload ID: 19483 relates to Category No.: 15524, 12402, 2874, 4291, 12400, 11861, 11920; Payload ID: 19484 relates to Category No.: 12402, 4291; Payload ID: 19485 relates to Category No.: 12402, 4291, 12400; Payload ID: 19486 relates to Category No.: 4894, 15524, 12402, 4291, 11861, 11977; Payload ID: 19487 relates to Category No.: 12402, 4291; Payload ID: 19488 relates to Category No.: 12402, 4291, 11861; Payload ID: 19489 relates to Category No.: 12402, 4291, 11861, 12400, 11920; Payload ID: 19490 relates to Category No.: 12402, 15491, 4291, 11861, 12400, 11920, 4292; Payload ID: 19491 relates to Category No.: 12402, 15495, 4291, 12400, 11861; Payload ID: 19492 relates to Category No.: 15503, 14471, 15524, 12402, 4291, 12400, 12426, 11861, 11920, 2874, 4292; Payload ID: 19493 relates to Category No.: 12402, 4291; Payload ID: 19494 relates to Category No.: 12402, 4291; Payload ID: 19495 relates to Category No.: 12402, 2874, 4291, 12400, 11861; Payload ID: 19496 relates to Category No.: 12402, 4291; Payload ID: 19497 relates to Category No.: 12402, 4291, 11861, 12400; Payload ID: 19498 relates to Category No.: 12402, 4291; Payload ID: 19499 relates to Category No.: 12402, 4291, 11861; Payload ID: 19500 relates to Category No.: 12402, 4291; Payload ID: 19501 relates to Category No.: 267, 11981, 11861, 5347, 14537, 4898, 9925; Payload ID: 19502 relates to Category No.: 267, 11861, 4898; Payload ID: 19503 relates to Category No.: 11978, 926, 12109, 11861, 9805, 11991, 2325, 6478, 11664, 11981, 12110; Payload ID: 19504 relates to Category No.: 11978, 926, 12109; Payload ID: 19505 relates to Category No.: 11978, 926, 12109, 11861, 2325; Payload ID: 19506 relates to Category No.: 11978, 926, 12109, 11861, 2325; Payload ID: 19507 relates to Category No.: 11861; Payload ID: 19508 relates to Category No.: 5588, 5009, 5547, 11861; Payload ID: 19509 relates to Category No.: 5588, 5547, 5009, 11861; Payload ID: 19510 relates to Category No.: 4864, 5588, 5547, 5009; Payload ID: 19511 relates to Category No.: 14564, 11861, 16293, 7360; Payload ID: 19512 relates to Category No.: 16331, 5229, 11861, 5213, 14471, 2405; Payload ID: 19513 relates to Category No.: 16331, 5229, 11861, 5208, 5206; Payload ID: 19514 relates to Category No.: 15895, 943, 327; Payload ID: 19515 relates to Category No.: 15086; Payload ID: 19517 relates to Category No.: 11890, 15491, 11861, 5957, 11861, 1327; Payload ID: 19518 relates to Category No.: 11890, 11861, 5957; Payload ID: 19519 relates to Category No.: 11861, 16296; Payload ID: 19520 relates to Category No.: 14597, 10116, 11861, 16296, 12086; Payload ID: 19521 relates to Category No.: 11861; Payload ID: 19522 relates to Category No.: 11861, 14246, 2406, 14237; Payload ID: 19523 relates to Category No.: 16331, 9226, 11861, 11782; Payload ID: 19524 relates to Category No.: 16296; Payload ID: 19525 relates to Category No.: 2405, 11861, 14232; Payload ID: 19526 relates to Category No.: 15908, 15893, 6188, 11861; Payload ID: 19527 relates to Category No.: 15908, 15504, 15893, 6188, 11861, 14252, 15528, 14252; Payload ID: 19528 relates to Category No.: 11917, 9518, 11861, 3752, 2557, 2559, 14246; Payload ID: 19529 relates to Category No.: 15491, 11861, 11939, 15495; Payload ID: 19530 relates to Category No.: 11890, 11861, 5957; Payload ID: 19531 relates to Category No.: 11861; Payload ID: 19532 relates to Category No.: 11861; Payload ID: 19533 relates to Category No.: 11861; Payload ID: 19534 relates to Category No.: 11861; Payload ID: 19536 relates to Category No.: 6816, 11939, 5865, 3554, 4207, 9518, 5875, 1630, 65, 9518, 308, 16302, 16303, 9518, 318, 7199, 11861; Payload ID: 19537 relates to Category No.: 3303, 15503, 14471, 11939, 11933, 14471, 15524, 15895, 11981, 14243, 11861, 2688, 3936, 11828, 2406, 3732, 14251, 14471, 14252, 5109, 9853; Payload ID: 19538 relates to Category No.: 4820, 15617, 12399, 16206; Payload ID: 19539 relates to Category No.: 2963, 6816, 11939, 11920, 11861; Payload ID: 19540 relates to Category No.: 3303, 2963, 14597, 5036, 11861, 1338; Payload ID: 19541 relates to Category No.: 7192; Payload ID: 19542 relates to Category No.: 11861, 16331; Payload ID: 19543 relates to Category No.: 267, 10116, 11861; Payload ID: 19544 relates to Category No.: 16331, 267, 11861, 566; Payload ID: 19553 relates to Category No.: 16331, 15908, 15893, 6188, 2859, 11861; Payload ID: 19554 relates to Category No.: 15629, 11861; Payload ID: 19555 relates to Category No.: 11861; Payload ID: 19556 relates to Category No.: 6816, 5308, 11939, 637, 6574, 6821; Payload ID: 19557 relates to Category No.: 5308, 6816, 637, 6829; Payload ID: 19558 relates to Category No.: 637, 6829, 6574; Payload ID: 19559 relates to Category No.: 11861, 7192; Payload ID: 19560 relates to Category No.: 2963, 11861, 3752; Payload ID: 19561 relates to Category No.: 926, 3303, 3459, 14597, 3385, 3640, 11861, 4288, 12434; Payload ID: 19562 relates to Category No.: 926, 3303, 3459, 14597, 3385, 11861, 4288, 12434, 2770; Payload ID: 19563 relates to Category No.: 3303, 11895, 11861; Payload ID: 19564 relates to Category No.: 926, 3303, 11895, 2963, 3459, 15524, 15895, 5308, 305, 953, 10116, 11861, 15265, 3465, 157; Payload ID: 19565 relates to Category No.: 926, 3303, 11895, 2963, 3459, 15524, 953, 10116, 11861, 15265, 3465, 157; Payload ID: 19566 relates to Category No.: 6816, 6825, 3387; Payload ID: 19568 relates to Category No.: 9546, 15358; Payload ID: 19569 relates to Category No.: 14503; Payload ID: 19571 relates to Category No.: 926, 942, 942, 2748, 9653, 6946, 11861, 9643; Payload ID: 19572 relates to Category No.: 11861; Payload ID: 19574 relates to Category No.: 11992; Payload ID: 19576 relates to Category No.: 15542, 15553, 15542, 15555; Payload ID: 19577 relates to Category No.: 4363, 11861, 6574, 1171, 16318, 15542, 15553; Payload ID: 19578 relates to Category No.: 242, 12158; Payload ID: 19579 relates to Category No.: 242, 12158; Payload ID: 19580 relates to Category No.: 926, 9988, 512, 16320; Payload ID: 19581 relates to Category No.: 3303, 9226, 14196, 15503, 14471, 14234, 3459, 10116, 11861, 15528, 14233, 4896, 2405, 14597, 14471, 7268, 15504, 9539; Payload ID: 19582 relates to Category No.: 3303, 9226, 2405, 7268, 7265, 6210, 14147, 15595; Payload ID: 19583 relates to Category No.: 3303, 9226, 15503, 14471, 3459, 15495, 10116, 14106, 7265, 14243, 11861, 14597, 15530, 14255; Payload ID: 19585 relates to Category No.: 6816, 6825; Payload ID: 19586 relates to Category No.: 6478, 1630, 5308, 307; Payload ID: 19587 relates to Category No.: 15239, 11861; Payload ID: 19588 relates to Category No.: 3303, 15503, 14471, 15021, 11895, 11861; Payload ID: 19589 relates to Category No.: 11978, 926, 12402, 9096, 12145, 11861, 5841, 3752, 3774; Payload ID: 19590 relates to Category No.: 15524, 15491, 15495, 11861, 2405, 11782, 11895, 14237, 15503, 14252; Payload ID: 19591 relates to Category No.: 11861; Payload ID: 19592 relates to Category No.: 11861; Payload ID: 19593 relates to Category No.: 11861; Payload ID: 19594 relates to Category No.: 11861; Payload ID: 19596 relates to Category No.: 11861, 5347; Payload ID: 19598 relates to Category No.: 11861; Payload ID: 19606 relates to Category No.: 14706, 14705, 12167; Payload ID: 19607 relates to Category No.: 10116, 11861, 15530, 14233; Payload ID: 19608 relates to Category No.: 926, 6816, 6825; Payload ID: 19609 relates to Category No.: 6816, 15911, 15895, 11861, 6422, 6421, 15913, 3829; Payload ID: 19610 relates to Category No.: 3464, 11861; Payload ID: 19611 relates to Category No.: 14196, 10116, 11861, 7429; Payload ID: 19612 relates to Category No.: 926, 9226, 4965, 961, 10116, 11861, 14218, 14279; Payload ID: 19613 relates to Category No.: 14176, 10116, 7429; Payload ID: 19614 relates to Category No.: 10116, 7429; Payload ID: 19615 relates to Category No.: 10116, 11861, 7429; Payload ID: 19616 relates to Category No.: 16331, 15491, 15495, 11861; Payload ID: 19617 relates to Category No.: 11861; Payload ID: 19618 relates to Category No.: 3303, 16331, 6816, 14196, 15503, 14471, 15524, 15491, 15495, 14652, 11861, 15530, 14233, 4288, 3732, 14471, 5109, 9226; Payload ID: 19619 relates to Category No.: 3303, 6816; Payload ID: 19621 relates to Category No.: 3303, 14196, 11861, 3463, 6110; Payload ID: 19622 relates to Category No.: 11978, 926, 12402, 9096, 12145, 11861, 9990; Payload ID: 19623 relates to Category No.: 3303, 9226, 6816, 15503, 14471; Payload ID: 19624 relates to Category No.: 3303, 9226, 6816, 15503, 14471; Payload ID: 19625 relates to Category No.: 3303, 6816, 15503, 14471, 11861; Payload ID: 19626 relates to Category No.: 3303, 9226, 6816, 15503, 14471; Payload ID: 19627 relates to Category No.: 3303, 6816, 15503, 14471, 7192; Payload ID: 19628 relates to Category No.: 9226, 15503, 14471, 3303, 6816; Payload ID: 19629 relates to Category No.: 6816, 11861, 7268; Payload ID: 19630 relates to Category No.: 3303, 6816, 15503, 14471, 10116, 7268, 11861, 992; Payload ID: 19631 relates to Category No.: 3303, 6816, 15503, 14471, 10116, 992, 7264; Payload ID: 19632 relates to Category No.: 3303, 16331, 9226, 6816, 15503, 14471; Payload ID: 19633 relates to Category No.: 9226, 6816; Payload ID: 19634 relates to Category No.: 6816, 15503, 14471, 11861, 14471; Payload ID: 19635 relates to Category No.: 9226, 6816; Payload ID: 19636 relates to Category No.: 9226, 6816; Payload ID: 19637 relates to Category No.: 3303, 6816, 11861, 9226; Payload ID: 19638 relates to Category No.: 3303, 9226, 6816; Payload ID: 19639 relates to Category No.: 15503, 14471, 3303, 9226, 6816, 11861; Payload ID: 19640 relates to Category No.: 15503, 14471, 3303, 9226, 6816; Payload ID: 19641 relates to Category No.: 9226, 6816, 15530, 14233, 3303, 11861; Payload ID: 19642 relates to Category No.: 9226, 6816, 15908, 6188; Payload ID: 19643 relates to Category No.: 9226, 6816; Payload ID: 19644 relates to Category No.: 3303, 9226, 6816; Payload ID: 19646 relates to Category No.: 9226, 6816, 15503, 14471, 15528, 14233, 11861, 14234; Payload ID: 19647 relates to Category No.: 3303, 6816, 15503, 14471, 2406, 9226; Payload ID: 19648 relates to Category No.: 6816, 15503, 14471, 14234, 14471, 11861, 15528, 14233; Payload ID: 19649 relates to Category No.: 3303, 6816, 9226; Payload ID: 19650 relates to Category No.: 3303, 6816; Payload ID: 19651 relates to Category No.: 16331, 4013, 222, 216, 211, 6186; Payload ID: 19652 relates to Category No.: 16331, 15908, 15893, 6188, 11861; Payload ID: 19653 relates to Category No.: 16331, 15893, 6188, 11861; Payload ID: 19654 relates to Category No.: 16331, 15908, 6188, 4291, 11861; Payload ID: 19655 relates to Category No.: 16331; Payload ID: 19656 relates to Category No.: 16331, 9518, 7192; Payload ID: 19657 relates to Category No.: 9282, 9226, 6816, 14196; Payload ID: 19658 relates to Category No.: 14196, 9282, 9226, 6816, 11861, 11698; Payload ID: 19659 relates to Category No.: 9226, 6816, 15503, 14471, 14243, 15528, 14233; Payload ID: 19660 relates to Category No.: 11861, 3303, 6816, 11939, 11933; Payload ID: 19661 relates to Category No.: 3303, 6816, 11861; Payload ID: 19662 relates to Category No.: 6816, 15503, 14471, 14243, 11861, 7192; Payload ID: 19663 relates to Category No.: 6816, 14243, 15530, 14255, 11861; Payload ID: 19664 relates to Category No.: 6816, 15503, 14471, 14471, 15524, 14251, 14471, 14243, 11861; Payload ID: 19665 relates to Category No.: 3303, 6816, 11939, 11861, 5347, 14240, 15530, 14239, 11895, 11920, 15503, 14471, 3459; Payload ID: 19666 relates to Category No.: 9226, 6816, 15503, 14471, 11861, 3303; Payload ID: 19667 relates to Category No.: 3303, 6816, 15503, 14471, 14471, 11861; Payload ID: 19668 relates to Category No.: 3303, 6816, 11861; Payload ID: 19669 relates to Category No.: 6816, 11861, 15530, 14233, 3303; Payload ID: 19670 relates to Category No.: 6816, 14251, 14471, 6905, 14243, 11861; Payload ID: 19671 relates to Category No.: 3303, 6816, 11861; Payload ID: 19672 relates to Category No.:

3303, 6816, 11861; Payload ID: 19673 relates to Category No.: 14251, 14471, 14243, 11861, 6816, 3303, 15503, 14471; Payload ID: 19674 relates to Category No.: 6816, 14243, 15530, 14255, 11861, 7192; Payload ID: 19675 relates to Category No.: 6816, 14243, 15530, 14255, 11861; Payload ID: 19676 relates to Category No.: 3303, 16331, 6816, 11861, 15495, 9226; Payload ID: 19677 relates to Category No.: 6816, 14471, 6905, 14243, 15530, 14255, 11861; Payload ID: 19678 relates to Category No.: 9226, 6816, 11861, 3303; Payload ID: 19679 relates to Category No.: 3303, 6816, 11861, 9226; Payload ID: 19680 relates to Category No.: 11861, 9226, 6816, 15503, 14471, 11939, 6905; Payload ID: 19681 relates to Category No.: 3303, 6816, 11861; Payload ID: 19682 relates to Category No.: 6816, 11939, 14471, 6905, 11981, 14243, 15530, 14255, 11861, 6906; Payload ID: 19683 relates to Category No.: 11861, 3303, 6816, 7192, 9226; Payload ID: 19684 relates to Category No.: 3303, 6816, 11861; Payload ID: 19685 relates to Category No.: 3303, 6816, 11861; Payload ID: 19686 relates to Category No.: 3303, 6816, 11861; Payload ID: 19687 relates to Category No.: 3303, 6816, 11861, 9226; Payload ID: 19688 relates to Category No.: 3303, 6816, 11861; Payload ID: 19689 relates to Category No.: 6816, 14251, 14471, 14243, 11861; Payload ID: 19690 relates to Category No.: 3303, 6816, 11861, 9226; Payload ID: 19691 relates to Category No.: 11861, 3303, 6816, 15503, 14471, 9226; Payload ID: 19692 relates to Category No.: 6816, 14251, 14471, 14243, 11861, 14471, 15504, 15492; Payload ID: 19693 relates to Category No.: 3303, 6816, 11861; Payload ID: 19694 relates to Category No.: 3303, 6816, 14243, 15530, 14255, 11861; Payload ID: 19695 relates to Category No.: 3303, 6816, 11861, 5101, 15530, 14233, 14234, 15503, 14471; Payload ID: 19696 relates to Category No.: 6816, 14251, 14471, 14243, 11861, 15528, 14233, 3303, 15503, 14471, 11939, 14234; Payload ID: 19697 relates to Category No.: 9226, 6816, 11861, 1201; Payload ID: 19698 relates to Category No.: 6816; Payload ID: 19699 relates to Category No.: 3303, 6816, 11861, 7192, 9226; Payload ID: 19700 relates to Category No.: 3303, 6816, 11861; Payload ID: 19701 relates to Category No.: 3303, 6816, 11861; Payload ID: 19702 relates to Category No.: 15503, 14471, 14251, 14471, 3303, 6816, 11861; Payload ID: 19703 relates to Category No.: 9226, 6816, 15503, 14471, 14471, 11861; Payload ID: 19704 relates to Category No.: 6816, 15503, 14471, 14471, 11861; Payload ID: 19705 relates to Category No.: 6816, 15503, 14471, 14471, 11861; Payload ID: 19706 relates to Category No.: 9226, 6816, 14251, 14471, 3303, 15503, 14471; Payload ID: 19707 relates to Category No.: 15503, 14471, 6816, 14243, 9226; Payload ID: 19708 relates to Category No.: 6816, 15503, 14471, 14243; Payload ID: 19709 relates to Category No.: 6816, 15503, 14471, 14234, 11861, 15528, 14233, 3303, 9226; Payload ID: 19710 relates to Category No.: 6816, 15503, 14471, 14471, 11861, 7192; Payload ID: 19711 relates to Category No.: 15503, 14471, 6816, 14471; Payload ID: 19712 relates to Category No.: 6816, 15503, 14471, 14471, 9226; Payload ID: 19713 relates to Category No.: 9226, 6816, 15503, 14471, 14471, 11861; Payload ID: 19714 relates to Category No.: 3303, 6816, 15503, 14471, 14251, 14471, 9226; Payload ID: 19715 relates to Category No.: 6816, 15503, 14471, 14471, 9226; Payload ID: 19716 relates to Category No.: 6816, 15503, 14471, 14471, 9226; Payload ID: 19717 relates to Category No.: 3303, 6816, 14251, 14471, 11861, 15503, 14471, 9226; Payload ID: 19718 relates to Category No.: 6816, 15503, 14471, 14471; Payload ID: 19719 relates to Category No.: 3303, 6816, 15503, 14471, 14251, 14471, 9226; Payload ID: 19720 relates to Category No.: 3303, 6816, 15503, 14471, 14251, 14471; Payload ID: 19721 relates to Category No.: 9226, 6816, 15503, 14471, 14251, 14471; Payload ID: 19722 relates to Category No.: 15503, 14471, 6816, 14471, 11861, 9226; Payload ID: 19723 relates to Category No.: 6816, 10116, 11861; Payload ID: 19724 relates to Category No.: 6816, 10116, 11861; Payload ID: 19725 relates to Category No.: 6816, 3655, 11861; Payload ID: 19726 relates to Category No.: 6816, 3655; Payload ID: 19727 relates to Category No.: 6816, 3655, 7192; Payload ID: 19728 relates to Category No.: 6816, 3655; Payload ID: 19729 relates to Category No.: 6816, 10116, 11861; Payload ID: 19730 relates to Category No.: 6816, 10115, 10116, 11861; Payload ID: 19731 relates to Category No.: 6816, 10116, 11861; Payload ID: 19732 relates to Category No.: 6816, 10116; Payload ID: 19733 relates to Category No.: 3303, 6816, 7192, 14652, 14324; Payload ID: 19734 relates to Category No.: 6816, 10116; Payload ID: 19735 relates to Category No.: 6816, 7192; Payload ID: 19736 relates to Category No.: 6816, 10116; Payload ID: 19737 relates to Category No.: 6816, 10116, 11861; Payload ID: 19738 relates to Category No.: 6816, 15503, 14471, 14471, 10116, 11861, 15530, 14255, 14241; Payload ID: 19739 relates to Category No.: 7489, 6816, 10116, 11861; Payload ID: 19741 relates to Category No.: 16331, 9282, 9226, 10116; Payload ID: 19742 relates to Category No.: 3303, 16331, 6816, 15503, 14471, 15491, 15495, 15530, 14255, 11861, 3530, 9226, 15504, 2405; Payload ID: 19743 relates to Category No.: 3303, 6816, 9807, 14324, 9226; Payload ID: 19744 relates to Category No.: 3303, 9226, 6816, 11861, 15493; Payload ID: 19745 relates to Category No.: 9226, 6816; Payload ID: 19746 relates to Category No.: 3303, 16331, 9226, 6816, 14471; Payload ID: 19747 relates to Category No.: 3303, 16331, 9226, 6816, 15503, 14471, 14471, 15524, 11861, 2691, 3752, 15503, 14239; Payload ID: 19748 relates to Category No.: 3303, 16331, 9226, 6816, 14471; Payload ID: 19749 relates to Category No.: 9226, 3303, 6816, 11861; Payload ID: 19750 relates to Category No.: 9226, 6816, 14234; Payload ID: 19751 relates to Category No.: 9226, 3303, 6816, 11861; Payload ID: 19752 relates to Category No.: 6816, 10116, 11861, 14537, 9383; Payload ID: 19753 relates to Category No.: 3303, 6816, 7192, 9226; Payload ID: 19754 relates to Category No.: 3303, 9226, 6816; Payload ID: 19755 relates to Category No.: 6816, 14234, 11861, 7192, 9226; Payload ID: 19756 relates to Category No.: 16331, 6816, 15503, 14471, 14234, 9226; Payload ID: 19757 relates to Category No.: 3303, 9226, 6816, 15503, 14471; Payload ID: 19758 relates to Category No.: 3303, 6816, 15503, 14471, 9226; Payload ID: 19759 relates to Category No.: 3303, 9226, 6816, 11861; Payload ID: 19760 relates to Category No.: 14251, 14471, 11861, 3303, 6816, 15503, 14471, 9226; Payload ID: 19761 relates to Category No.: 3303, 9226, 6816, 15503, 14471; Payload ID: 19762 relates to Category No.: 3303, 9226, 6816, 15503, 14471, 11861; Payload ID: 19763 relates to Category No.: 3303, 6816, 15503, 14471; Payload ID: 19764 relates to Category No.: 3303, 9226, 6816, 15503, 14471; Payload ID: 19765 relates to Category No.: 3303, 9226, 6816, 15495, 11861; Payload ID: 19766 relates to Category No.: 9226, 6816, 15503, 14471, 14234, 11861; Payload ID: 19767 relates to Category No.: 3303, 9226, 6816, 15503, 14471; Payload ID: 19768 relates to Category No.: 3303, 9226, 6816, 15503, 14471; Payload ID: 19769 relates to Category No.: 9226, 6816, 14234; Payload ID: 19770 relates to Category No.: 3303, 6816, 7192, 9226; Payload ID: 19771 relates to Category No.: 6816, 11861, 3303, 9226; Payload ID: 19772 relates to Category No.: 3303, 16331, 6816, 15503, 14471, 5009; Payload ID: 19773 relates to Category No.: 6816, 14234, 14471, 11861, 15530, 14233, 3303, 15503, 14471, 3459, 15525, 9226; Payload ID: 19774 relates to Category No.: 9226, 6816, 15503, 14471, 14243; Payload ID: 19775 relates to Category No.: 9226, 3303, 6816, 15503, 14471, 11861; Payload ID: 19776 relates to Category No.: 3303, 9226, 6816, 15503, 14471; Payload ID: 19777 relates to Category No.: 3303, 6816, 15503, 14471, 11861; Payload ID: 19778 relates to Category No.: 3303, 9226, 6816; Payload ID: 19779 relates to Category No.: 6816, 15503, 14471, 14471, 11861; Payload ID: 19780 relates to Category No.: 3303, 9226, 6816, 11861; Payload ID: 19781 relates to Category No.: 3303, 9226, 6816; Payload ID: 19782 relates to Category No.: 6816, 15503, 14471, 11939, 15524, 14251, 14471; Payload ID: 19783 relates to Category No.: 3303, 9226, 6816, 15503, 14471, 11861; Payload ID: 19784 relates to Category No.: 3303, 9226, 6816, 11861; Payload ID: 19785 relates to Category No.: 3303, 9226, 6816, 15503, 14471, 14251, 14471, 11861; Payload ID: 19786 relates to Category No.: 3303, 9226, 6816, 11861; Payload ID: 19787 relates to Category No.: 9226, 3303, 6816; Payload ID: 19788 relates to Category No.: 3303, 9226, 6816, 15503, 14471; Payload ID: 19789 relates to Category No.: 3303, 16331, 9226, 6816; Payload ID: 19790 relates to Category No.: 16331; Payload ID: 19791 relates to Category No.: 3303, 9226, 6816, 15503, 14471; Payload ID: 19792 relates to Category No.: 9226, 3303, 6816, 15503, 14471; Payload ID: 19793 relates to Category No.: 9226, 16331, 6816, 14234; Payload ID: 19794 relates to Category No.: 15503, 14471, 3303, 9226, 6816; Payload ID: 19795 relates to Category No.: 9226, 6816, 3303, 16331, 11861; Payload ID: 19796 relates to Category No.: 9226, 3303, 6816, 11861; Payload ID: 19797 relates to Category No.: 9226, 6816, 7192; Payload ID: 19798 relates to Category No.: 3303, 9226, 6816, 15503, 14471, 14251, 14471, 11861; Payload ID: 19799 relates to Category No.: 16331, 9226, 6816, 15503, 14471, 14471, 11861; Payload ID: 19800 relates to Category No.: 3303, 16331, 6816, 15503, 14471, 6965, 10116, 11861, 5009; Payload ID: 19801 relates to Category No.: 9226, 3303, 16331, 6816; Payload ID: 19802 relates to Category No.: 9226, 6816, 15503, 14471, 14243; Payload ID: 19803 relates to Category No.: 3303, 16331, 9226, 6816, 11861, 15493, 5347; Payload ID: 19804 relates to Category No.: 9226, 6816, 15503, 14471, 14471; Payload ID: 19805 relates to Category No.: 3303, 16331, 9226, 6816; Payload ID: 19806 relates to Category No.: 9226, 6816, 15503, 14471, 14471; Payload ID: 19807 relates to Category No.: 6816, 15503, 14471, 14234, 15524, 11861, 15530, 14233; Payload ID: 19808 relates to Category No.: 3303, 6816, 15503, 14471, 14234, 5079, 11861, 15530, 14233, 9226; Payload ID: 19809 relates to Category No.: 3303, 16331, 6816; Payload ID: 19810 relates to Category No.: 9226, 6816; Payload ID: 19811 relates to Category No.: 9226, 3303, 6816; Payload ID: 19812 relates to Category No.: 3303, 9226, 6816, 11861; Payload ID: 19813 relates to Category No.: 9226, 3303, 6816, 11861; Payload ID: 19814 relates to Category No.: 9226, 3303, 6816; Payload ID: 19815 relates to Category No.: 9226, 15503, 14471, 3303, 6816; Payload ID: 19816 relates to Category No.: 15503, 14471, 3303, 9226, 6816, 11861; Payload ID: 19817 relates to Category No.: 9226, 6816, 3303; Payload ID: 19818 relates to Category No.: 3303, 9226, 6816, 15503, 14471, 9226; Payload ID: 19819 relates to Category No.: 3303, 9226, 6816, 11861; Payload ID: 19820 relates to Category No.: 9226, 6816, 15503, 14471, 14471, 11861; Payload ID: 19821 relates to Category No.: 9226, 3303, 6816; Payload ID: 19822 relates to Category No.: 3303, 9226, 6816, 15503, 14471, 11861, 2405, 5109, 2691; Payload ID: 19823 relates to Category No.: 9226, 15503, 14471, 3303, 6816; Payload ID: 19824 relates to Category No.: 9226, 6816, 3303; Payload ID: 19825 relates to Category No.: 3303, 6816, 14196, 15503, 14471, 11861; Payload ID: 19826 relates to Category No.: 3303, 16331, 6816, 15503, 14471, 14471, 11861; Payload ID: 19827 relates to Category No.: 9226, 3303, 6816; Payload ID: 19828 relates to Category No.: 3303, 9226, 6816; Payload ID: 19829 relates to Category No.: 9226, 15503, 14471, 3303, 6816, 11861; Payload ID: 19830 relates to Category No.: 3303, 9226, 6816, 15503, 14471; Payload ID: 19831 relates to Category No.: 9226, 6816, 16331, 14234; Payload ID: 19832 relates to Category No.: 9226, 3303, 6816; Payload ID: 19833 relates to Category No.: 9226, 6816, 15503, 14471, 14243, 11861; Payload ID: 19834 relates to Category No.: 9226, 6816, 16331, 14234; Payload ID: 19835 relates to Category No.: 9226, 15503, 14471, 3303, 6816, 11861; Payload ID: 19836 relates to Category No.: 3303, 6816, 15503, 14471, 11861; Payload ID: 19837 relates to Category No.: 9226, 6816, 15503, 14471, 14471, 11861, 3303; Payload ID: 19838 relates to Category No.: 9226, 6816, 14234; Payload ID: 19839 relates to Category No.: 3303, 9226, 6816, 11861; Payload ID: 19840 relates to Category No.: 3303, 9226, 6816, 15503, 14471; Payload ID: 19841 relates to Category No.: 3303, 9226, 6816, 15503, 14471, 11861; Payload ID: 19842 relates to Category No.: 9226, 6816, 14234, 11861; Payload ID: 19843 relates to Category No.: 9226, 6816, 15503, 14471, 14471, 14251, 14471, 15495, 8985, 11861, 3303; Payload ID: 19844 relates to Category No.: 9226, 6816, 3303; Payload ID: 19845 relates to Category No.: 16331, 3303, 6816, 11861, 9226; Payload ID: 19846 relates to Category No.: 6816, 11861, 14237; Payload ID: 19847 relates to Category No.: 3303, 6816, 15503, 14471, 9226; Payload ID: 19848 relates to Category No.: 9226, 6816; Payload ID: 19849 relates to Category No.: 6816, 3303; Payload ID: 19850 relates to Category No.: 6816, 14251, 14471, 14243; Payload ID: 19851 relates to Category No.: 6816, 14251, 14471, 14243; Payload ID: 19852 relates to Category No.: 6816, 15503, 14471, 14234, 14471, 15524, 15495, 11861, 2688, 15530, 14233; Payload ID: 19853 relates to Category No.: 3303, 16331, 9226, 6816; Payload ID: 19854 relates to Category No.: 3303, 9226, 6816, 15503, 14471; Payload ID: 19855 relates to Category No.: 3303, 9226, 6816; Payload ID: 19856 relates to Category No.: 3303, 9226, 6816; Payload ID: 19857 relates to Category No.: 15503, 14471, 3303, 9226, 6816, 11861; Payload ID: 19858 relates to Category No.: 15503, 14471, 3303, 6816; Payload ID: 19859 relates to Category No.: 3303, 9226, 6816, 15503, 14471; Payload ID: 19860 relates to Category No.: 6816, 3303, 15528, 14233, 9226; Payload ID: 19861 relates to Category No.: 3303, 6816, 7192, 11861, 15503, 14252, 9226; Payload ID: 19862 relates to Category No.: 3303, 16331, 9226, 11861, 5347, 6816; Payload ID: 19863 relates to Category No.: 3303, 9226, 6816, 15503, 14471; Payload ID: 19864 relates to Category No.: 9226, 15503, 14471, 6816, 3303, 11861; Payload ID: 19865 relates to Category No.: 9226, 15503, 14471, 3303, 6816, 11861; Payload ID: 19866 relates to Category No.: 9226, 6816, 15503, 14471, 14243; Payload ID: 19867 relates to Category No.: 3303, 9226, 6816, 15503, 14471; Payload ID: 19868 relates to Category No.: 3303, 9226, 6816; Payload ID: 19869 relates to Category No.: 3303, 9226, 6816, 15503, 14471, 11861; Payload ID: 19870 relates to Category No.: 16331, 9226; Payload ID: 19871 relates to Category No.: 3303, 6816; Payload ID: 19872 relates to Category No.: 3303, 6816, 11861; Payload ID: 19873 relates to Category No.: 9226, 15503, 14471, 3303, 6816, 11861; Payload ID: 19874 relates to Category No.: 3303, 6816, 15503, 14471; Payload ID: 19875 relates to Category No.: 3303, 9226, 6816; Payload ID: 19876 relates to Category No.: 3303, 9226, 6816; Payload ID: 19877 relates to Category No.: 3303, 6816, 10116, 11861, 14232; Payload ID: 19878 relates to Category No.: 3303, 6816, 11861; Payload ID: 19879 relates to Category No.: 16331, 6816; Payload ID: 19880 relates to Category No.: 16331, 9226, 6816, 14234; Payload ID: 19881 relates to Category No.: 9226, 3303, 6816; Payload ID: 19882 relates to Category No.: 3303, 9226, 6816, 15503, 14471; Payload ID: 19883 relates to Category No.: 6816, 15524, 11861, 14237; Payload ID: 19884 relates to Category No.: 3303, 9226, 6816, 11861; Payload ID: 19885 relates to Category No.: 3303, 9226, 6816, 15503, 14471; Payload ID: 19886 relates to Category No.: 15503, 14471, 9226, 3303, 6816, 11861; Payload ID: 19887 relates to Category No.: 3303, 16331, 9226, 6816, 11861; Payload ID: 19888 relates to Category No.: 3303, 6816, 11861, 9226; Payload ID: 19889 relates to Category No.: 3303, 9226, 6816, 11861; Payload ID: 19890 relates to Category No.: 3303, 6816, 15503, 14471, 9226; Payload ID: 19891 relates to Category No.: 16331, 9226, 6816, 9539, 3464, 10116, 11861, 3752; Payload ID: 19892 relates to Category No.: 3303, 9226, 6816; Payload ID: 19893 relates to Category No.: 3303, 6816, 15503, 14471, 14471; Payload ID: 19894 relates to Category No.: 3303, 9226, 6816, 15530, 14255, 11861, 14241; Payload ID: 19895 relates to Category No.: 3303, 9226, 6816, 15503, 14471; Payload ID: 19896 relates to Category No.: 3303, 9226, 6816, 15503, 14471; Payload ID: 19897 relates to Category No.: 3303, 9226, 6816, 15503, 14471; Payload ID: 19898 relates to Category No.: 9226, 6816, 3303; Payload ID: 19899 relates to Category No.: 3303, 6816; Payload ID: 19900 relates to Category No.: 11861; Payload ID: 19901 relates to Category No.: 3303, 6816, 15495, 11861, 3936; Payload ID: 19902 relates to Category No.: 3303, 6816, 15503, 14471; Payload ID: 19903 relates to Category No.: 3303, 9226, 6816, 15503, 14471; Payload ID: 19904 relates to Category No.: 9226, 6816, 15503, 14471, 15524; Payload ID: 19905 relates to Category No.: 3303, 9226, 6816, 15503, 14471; Payload ID: 19906 relates to Category No.: 3303, 6816, 14471, 14537, 9226; Payload ID: 19907 relates to Category No.: 3303, 16331, 9226, 6816, 9539, 10116, 7265; Payload ID: 19908 relates to Category No.: 16331, 9226, 6816, 14196, 9539; Payload ID: 19909 relates to Category No.: 16331, 9226, 6816; Payload ID: 19910 relates to Category No.: 16331, 9226, 6816, 14196, 9539; Payload ID: 19911 relates to Category No.: 3303, 6816, 15503, 14471, 9226; Payload ID: 19912 relates to Category No.: 9226, 6816, 15503, 14471, 14471, 11861; Payload ID: 19913 relates to Category No.: 3303, 6816, 14234; Payload ID: 19914 relates to Category No.: 6816, 15503, 14471, 14471; Payload ID: 19915 relates to Category No.: 15503, 14471, 6816, 14471, 11861; Payload ID: 19916 relates to Category No.: 3303, 6816, 11861, 9226; Payload ID: 19917 relates to Category No.: 3303, 9226, 6816, 11861; Payload ID: 19918 relates to Category No.: 3303, 16331, 9226, 6816; Payload ID: 19919 relates to Category No.: 3303, 6816, 11861, 5347; Payload ID: 19920 relates to Category No.: 3303, 9226, 6816, 15503, 14471, 11861; Payload ID: 19921 relates to Category No.: 3303, 6816, 11861, 9226; Payload ID: 19922 relates to Category No.: 3303, 6816, 11861; Payload ID: 19923 relates to Category No.: 9226, 15503, 14471, 3303, 6816, 11861; Payload ID: 19924 relates to Category No.: 3303, 9226, 6816; Payload ID: 19925 relates to Category No.: 9226, 3303, 6816, 11861; Payload ID: 19926 relates to Category No.: 9226, 6816, 15503, 14471, 14243, 11861; Payload ID: 19927 relates to Category No.: 9226, 6816, 15503, 14471, 14243, 11861; Payload ID: 19928 relates to Category No.: 9226, 6816, 15503, 14471, 3303, 11861; Payload ID: 19929 relates to Category No.: 3303, 6816, 11861, 9226; Payload ID: 19930 relates to Category No.: 3303, 9226, 6816, 11861; Payload ID: 19931 relates to Category No.: 3303, 9226, 6816, 11861; Payload ID: 19932 relates to Category No.: 6816; Payload ID: 19933 relates to Category No.: 3303, 9226, 6816, 15503, 14471; Payload ID: 19934 relates to Category No.: 3303, 9226, 6816, 15503, 14471; Payload ID: 19935 relates to Category No.: 9226; Payload ID: 19936 relates to Category No.: 9226, 6816, 14234, 2405, 2691; Payload ID: 19937 relates to Category No.: 3303, 9226, 6816, 15503, 14471; Payload ID: 19938 relates to Category No.: 3303, 6816, 11861, 9226; Payload ID: 19939 relates to Category No.: 3303, 9226, 6816, 15503, 14471, 11861; Payload ID: 19940 relates to Category No.: 3303, 6816, 15503, 14471, 9226; Payload ID: 19941 relates to Category No.: 9226, 6816, 3303, 11861; Payload ID: 19942 relates to Category No.: 9226, 3303, 6816; Payload ID: 19943 relates to Category No.: 3303, 9226, 6816, 11861; Payload ID: 19944 relates to Category No.: 9226, 3303, 6816; Payload ID: 19945 relates to Category No.: 3303, 9226, 6816; Payload ID: 19946 relates to Category No.: 3303, 9226, 6816; Payload ID: 19947 relates to Category No.: 15503, 14471, 14251, 14471, 3303, 6816; Payload ID: 19948 relates to Category No.: 3303, 9226, 6816, 15503, 14471; Payload ID: 19949 relates to Category No.: 3303, 9226, 6816, 15503, 14471, 14251, 14471; Payload ID: 19950 relates to Category No.: 6816, 15503, 14471, 14471, 11861; Payload ID: 19951 relates to Category No.: 3303, 9226, 6816, 15503, 14471; Payload ID: 19952 relates to Category No.: 3303, 6816, 11861; Payload ID: 19953 relates to Category No.: 3303, 9226, 6816, 15503, 14471; Payload ID: 19954 relates to Category No.: 6816, 14234, 11861, 9226; Payload ID: 19955 relates to Category No.: 9226, 15503, 14471, 3303, 6816; Payload ID: 19956 relates to Category No.: 3303, 6816, 9226; Payload ID: 19957 relates to Category No.: 6816, 3303, 11861; Payload ID: 19958 relates to Category No.: 3303, 9226, 6816; Payload ID: 19959 relates to Category No.: 6816, 3303; Payload ID: 19960 relates to Category No.: 3303, 9226, 6816, 15503, 14471; Payload ID: 19961 relates to Category No.: 3303, 9226, 6816, 15503, 14471; Payload ID: 19962 relates to Category No.: 9226, 3303, 6816, 11861; Payload ID: 19963 relates to Category No.: 6816; Payload ID: 19964 relates to Category No.: 9226, 6816, 14234; Payload ID: 19965 relates to Category No.: 9226, 6816, 3303; Payload ID: 19966 relates to Category No.: 9226, 6816, 15503, 14471, 14243; Payload ID: 19967 relates to Category No.: 3303, 9226, 6816, 15503, 14471, 11861; Payload ID: 19968 relates to Category No.: 3303, 9226, 6816, 15503, 14471; Payload ID: 19969 relates to Category No.: 3303, 9226, 6816; Payload ID: 19970 relates to Category No.: 9226, 6816, 14234, 7192; Payload ID: 19971 relates to Category No.: 9226, 3303, 6816; Payload ID: 19972 relates to Category No.: 3303, 6816, 14251, 14471, 11861; Payload ID: 19973 relates to Category No.: 3303, 9226, 6816, 15503, 14471, 11861; Payload ID: 19974 relates to Category No.: 3303, 6816, 9226; Payload ID: 19975 relates to Category No.: 9226, 6816, 14234; Payload ID: 19976 relates to Category No.: 9226, 15503, 14471, 3303, 6816; Payload ID: 19977 relates to Category No.: 3303, 9226, 6816, 15503, 14471, 14251, 14471, 11861, 12107; Payload ID: 19978 relates to Category No.: 3303, 6816; Payload ID: 19979 relates to Category No.: 9226, 6816, 15503, 14471, 14471; Payload ID: 19980 relates to Category No.: 3303, 6816, 15503, 14471; Payload ID: 19981 relates to Category No.: 6816, 14234, 11861; Payload ID: 19982 relates to Category No.: 9226, 6816; Payload ID: 19983 relates to Category No.: 9226, 6816, 14234; Payload ID: 19984 relates to Category No.: 3303, 6816, 9226; Payload ID: 19985 relates to Category No.: 3303, 9226, 6816; Payload ID: 19986 relates to Category No.: 3303, 6816, 11861; Payload ID: 19987 relates to Category No.: 6816, 3303; Payload ID: 19988 relates to Category No.: 3303, 6816, 11861; Payload ID: 19989 relates to Category No.: 3303, 6816, 15524, 11861, 9226; Payload ID: 19990 relates to Category No.: 3303, 9226, 6816, 15503, 14471; Payload ID: 19991 relates to Category No.: 6816, 15503, 14471, 14471, 15524, 2690, 327, 9226; Payload ID: 19992 relates to Category No.: 3303, 9226, 6816; Payload ID: 19993 relates to Category No.: 3303, 6816, 15503, 14471, 9226; Payload ID: 19994 relates to Category No.: 3303, 6816, 14251, 14471; Payload ID: 19995 relates to Category No.: 9226, 6816, 14234; Payload ID: 19996 relates to Category No.: 3303, 6816, 11920, 9226; Payload ID: 19997 relates to Category No.: 14251, 14471, 14243, 6816, 11861; Payload ID: 19998 relates to Category No.: 9226, 6816, 15503, 14471, 15027; Payload ID: 19999 relates to Category No.: 3303, 6816; Payload ID: 20000 relates to Category No.: 9226, 3303, 6816; Payload ID: 20001 relates to Category No.: 9226, 15503, 14471, 3303, 6816; Payload ID: 20002 relates to Category No.: 9226, 6816, 3303; Payload ID: 20003 relates to Category No.: 9226, 3303, 6816; Payload ID: 20004 relates to Category No.: 3303, 6816, 9226; Payload ID: 20005 relates to Category No.: 9226, 15503, 14471, 3303, 6816; Payload ID: 20006 relates to Category No.: 9226, 6816, 14234, 15530, 14233, 14084; Payload ID: 20007 relates to Category No.: 3303, 9226, 6816, 15503, 14471, 11861, 15598, 9226; Payload ID: 20008 relates to Category No.: 3303, 6816; Payload ID: 20009 relates to Category No.: 9226, 6816, 14234, 11861; Payload ID: 20010 relates to Category No.: 9226, 15503, 14471, 6816, 3303, 11861; Payload ID: 20011 relates to Category No.: 9226, 15503, 14471, 6816, 3303; Payload ID: 20012 relates to Category No.: 3303, 9226, 6816; Payload ID: 20013 relates to Category No.: 9226, 6816, 15503, 14471, 14243; Payload ID: 20014 relates to Category No.: 9226, 6816, 15503, 14471, 14243; Payload ID: 20015 relates to Category No.: 9226, 15503, 14471, 3303, 6816, 11861; Payload ID: 20016 relates to Category No.: 9226, 6816, 15503, 14471, 14243; Payload ID: 20017 relates to Category No.: 9226, 6816, 15503, 14471, 14243; Payload ID: 20018 relates to Category No.: 3303, 9226, 6816; Payload ID: 20019 relates to Category No.: 3303, 9226, 6816, 11861; Payload ID: 20020 relates to Category No.: 9226, 6816, 3303; Payload ID: 20021 relates to Category No.: 3303, 9226, 6816; Payload ID: 20022 relates to Category No.: 3303, 9226, 6816; Payload ID: 20023 relates to Category No.: 9226, 6816, 3303, 11861; Payload ID: 20024 relates to Category No.: 3303, 9226, 6816; Payload ID: 20025 relates to Category No.: 9226, 6816, 15503, 14471, 14243; Payload ID: 20026 relates to Category No.: 6816, 14234, 9226; Payload ID: 20027 relates to Category No.: 3303, 9226, 6816; Payload ID: 20028 relates to Category No.: 9226, 6816, 15503, 14471, 15524, 11861; Payload ID: 20029 relates to Category No.: 3303, 9226, 6816, 15503, 14471; Payload ID: 20030 relates to Category No.: 9226, 6816, 3303; Payload ID: 20031 relates to Category No.: 9226, 6816, 15503, 14471, 15524, 11861; Payload ID: 20032 relates to Category No.: 9226, 15503, 14471, 3303, 6816; Payload ID: 20033 relates to Category No.: 3303, 9226, 6816, 11861; Payload ID: 20034 relates to Category No.: 3303, 9226, 6816; Payload ID: 20035 relates to Category No.: 9226, 6816, 15503, 14471, 14243; Payload ID: 20036 relates to Category No.: 9226, 15503, 14471, 15029, 3303, 6816; Payload ID: 20037 relates to Category No.: 3303, 6816, 11861; Payload ID: 20038 relates to Category No.: 3303, 9226, 6816, 15503, 14471; Payload ID: 20039 relates to Category No.: 9226, 6816, 3303; Payload ID: 20040 relates to Category No.: 9226, 6816, 3303; Payload ID: 20041 relates to Category No.: 3303, 6816, 14251, 14471, 11861; Payload ID: 20042 relates to Category No.: 9226, 15503, 14471, 3303, 6816; Payload ID: 20043 relates to Category No.: 3303, 9226, 6816; Payload ID: 20044 relates to Category No.: 3303, 6816, 10116; Payload ID: 20045 relates to Category No.: 14251, 14471, 14243, 6816, 11861; Payload ID: 20046 relates to Category No.: 6816, 14251, 14471, 14243, 11861; Payload ID: 20047 relates to Category No.: 9226, 3303, 6816; Payload ID: 20048 relates to Category No.: 9226, 6816, 15503, 14471, 14243; Payload ID: 20049 relates to Category No.: 9226, 6816, 15503, 14471, 14243; Payload ID: 20050 relates to Category No.: 9226, 15503, 14471, 6816; Payload ID: 20051 relates to Category No.: 9226, 6816, 15503, 14471; Payload ID: 20052 relates to Category No.: 6816, 15503, 14471, 14243, 9226; Payload ID: 20053 relates to Category No.: 3303, 9226, 6816, 11861; Payload ID: 20054 relates to Category No.: 9226, 6816, 15503, 14471, 14243; Payload ID: 20055 relates to Category No.: 3303, 9226, 6816; Payload ID: 20056 relates to Category No.: 3303, 6816, 11861; Payload ID: 20057 relates to Category No.: 3303, 16331, 9226, 6816, 15495, 11861; Payload ID: 20058 relates to Category No.: 3303, 6816; Payload ID: 20059 relates to Category No.: 9226, 6816; Payload ID: 20060 relates to Category No.: 9226, 3303, 6816; Payload ID: 20061 relates to Category No.: 3303, 9226, 6816; Payload ID: 20062 relates to Category No.: 6816, 16331, 10116, 11861; Payload ID: 20063 relates to Category No.: 3303, 9226, 6816, 11861; Payload ID: 20064 relates to Category No.: 3303, 6816, 15503, 14471, 9226; Payload ID: 20065 relates to Category No.: 3303, 9226, 6816, 15503, 14471; Payload ID: 20066 relates to Category No.: 3303, 9226, 6816, 15503, 14471; Payload ID: 20067 relates to Category No.: 3303, 9226, 6816, 15503, 14471, 11861; Payload ID: 20068 relates to Category No.: 6816; Payload ID: 20069 relates to Category No.: 6816; Payload ID: 20070 relates to Category No.: 3303, 9226, 6816; Payload ID: 20071 relates to Category No.: 9226, 15503, 14471, 3303, 6816; Payload ID: 20072 relates to Category No.: 9226, 6816, 15503, 14471, 15524; Payload ID: 20073 relates to Category No.: 3303, 9226, 6816, 11861, 7192; Payload ID: 20074 relates to Category No.: 3303, 9226, 6816, 15503, 14471; Payload ID: 20075 relates to Category No.: 3303, 9226, 6816, 15503, 14471; Payload ID: 20076 relates to Category No.: 3303, 9226, 6816; Payload ID: 20077 relates to Category No.: 3303, 6816, 9226; Payload ID: 20078 relates to Category No.: 9226, 3303, 6816; Payload ID: 20079 relates to Category No.: 3303, 9226, 6816, 15503, 14471; Payload ID: 20080 relates to Category No.: 16331, 9226, 6816, 10116, 11861; Payload ID: 20081 relates to Category No.: 9226, 6816, 15503, 14471, 3303; Payload ID: 20082 relates to Category No.: 3303, 9226, 6816, 15503, 14471, 11861; Payload ID: 20083 relates to Category No.: 9226, 3303, 6816, 11861; Payload ID: 20084 relates to Category No.: 9226, 6816, 14234; Payload ID: 20085 relates to Category No.: 3303, 9226, 6816, 11861; Payload ID: 20086 relates to Category No.: 6816, 3303, 15503, 14471, 9226; Payload ID: 20087 relates to Category No.: 3303, 6816, 15503, 14471; Payload ID: 20088 relates to Category No.: 9226, 15503, 14471, 3303, 6816; Payload ID: 20089 relates to Category No.: 9282, 9226, 16331, 6816, 14196, 3459, 10116; Payload ID: 20090 relates to Category No.: 6816, 15503, 14471, 14234, 15524, 11861, 15528, 14233, 12107; Payload ID: 20091 relates to Category No.: 3303, 9226, 6816, 14251, 14471; Payload ID: 20092 relates to Category No.: 3303, 6816, 9226; Payload ID: 20093 relates to Category No.: 16331, 6816, 15893, 6188, 11861; Payload ID: 20094 relates to Category No.: 3303, 6816, 11861, 9226; Payload ID: 20095 relates to Category No.: 3303, 6816; Payload ID: 20096 relates to Category No.: 9226, 6816, 15503, 14471, 15524, 11861; Payload ID: 20097 relates to Category No.: 9226, 6816, 3303, 11861; Payload ID: 20098 relates to Category No.: 9226, 6816, 3303; Payload ID: 20099 relates to Category No.: 3303, 6816; Payload ID: 20100 relates to Category No.: 3303, 9226, 6816, 15503, 14471, 11861, 7192; Payload ID: 20101 relates to Category No.: 9226, 6816, 15525; Payload ID: 20102 relates to Category No.: 9226, 6816; Payload ID: 20103 relates to Category No.: 6816, 15503, 14471, 14243; Payload ID: 20104 relates to Category No.: 3303, 9226, 6816, 11861, 15493; Payload ID: 20105 relates to Category No.: 6816, 14234, 7192; Payload ID: 20106 relates to Category No.: 3303, 9226, 6816, 15503, 14471; Payload ID: 20107 relates to Category No.: 9226, 15493, 3303, 6816; Payload ID: 20108 relates to Category No.: 3303, 6816, 15503, 14471, 9226; Payload ID: 20109 relates to Category No.: 3303, 9226, 6816; Payload ID: 20110 relates to Category No.: 3303, 9226, 6816, 11861; Payload ID: 20111 relates to Category No.: 15493, 3303, 9226, 6816, 11861; Payload ID: 20112 relates to Category No.: 3303, 6816, 9226; Payload ID: 20113 relates to Category No.: 3303, 9226, 6816; Payload ID: 20114 relates to Category No.: 9226, 3303, 16331, 6816, 14234, 15895, 11861; Payload ID: 20115 relates to Category No.: 9226, 6816, 14234; Payload ID: 20116 relates to Category No.: 3303, 9226, 6816, 15503, 14471; Payload ID: 20117 relates to Category No.: 3303, 6816, 9226; Payload ID: 20118 relates to Category No.: 9226, 6816, 14234, 11861; Payload ID: 20119 relates to Category No.: 9226, 6816, 14234; Payload ID: 20120 relates to Category No.: 3303, 9226, 6816, 15503, 14471; Payload ID: 20121 relates to Category No.: 9226, 6816, 14234; Payload ID: 20122 relates to Category No.: 6816, 14243, 15530, 14255; Payload ID: 20123 relates to Category No.: 3303, 9226, 6816; Payload ID: 20124 relates to Category No.: 3303, 6816; Payload ID: 20125 relates to Category No.: 3303, 9226, 6816, 7192; Payload ID: 20126 relates to Category No.: 3303, 9226, 6816; Payload ID: 20127 relates to Category No.: 3303, 9226, 6816, 11861; Payload ID: 20128 relates to Category No.: 6816, 15503, 14471, 14243, 9226; Payload ID: 20129 relates to Category No.: 3303, 6816, 9226; Payload ID: 20130 relates to Category No.: 9226, 6816, 14234, 11861; Payload ID: 20131 relates to Category No.: 15503, 14471, 9226, 6816, 3303; Payload ID: 20132 relates to Category No.: 3303, 6816, 7192; Payload ID: 20133 relates to Category No.: 3303, 9226, 6816, 15503, 14471, 11861; Payload ID: 20134 relates to Category No.: 9226, 15503, 14471, 3303, 6816; Payload ID: 20135 relates to Category No.: 3303, 6816; Payload ID: 20136 relates to Category No.: 3303, 9226, 6816; Payload ID: 20137 relates to Category No.: 9226, 3303, 6816; Payload ID: 20138 relates to Category No.: 9226, 6816, 11861, 13735; Payload ID: 20139 relates to Category No.: 6816; Payload ID: 20140 relates to Category No.: 9226, 6816, 3303; Payload ID: 20141 relates to Category No.: 3303, 9226, 6816; Payload ID: 20142 relates to Category No.: 3303, 9226, 6816; Payload ID: 20143 relates to Category No.: 3303, 9226, 6816; Payload ID: 20144 relates to Category No.: 6816; Payload ID: 20145 relates to Category No.: 9226, 3303, 6816, 11861; Payload ID: 20146 relates to Category No.: 9226, 6816, 14234; Payload ID: 20147 relates to Category No.: 3303, 9226, 6816; Payload ID: 20148 relates to Category No.: 15503, 14471, 3303, 6816; Payload ID: 20149 relates to Category No.: 3303, 6816, 15493, 9226; Payload ID: 20150 relates to Category No.: 3303, 6816, 15503, 14471, 14471, 14243, 11861; Payload ID: 20151 relates to Category No.: 9226, 6816, 14234; Payload ID: 20152 relates to Category No.: 9226, 6816; Payload ID: 20153 relates to Category No.: 9226, 6816, 14234; Payload ID: 20154 relates to Category No.: 9226, 15503, 14471, 6816; Payload ID: 20155 relates to Category No.: 9226, 6816; Payload ID: 20156 relates to Category No.: 9226; Payload ID: 20157 relates to Category No.: 9226, 3303, 6816; Payload ID: 20158 relates to Category No.: 9226, 6816, 14234; Payload ID: 20159 relates to Category No.: 9226, 15503, 14471, 3303, 6816; Payload ID: 20160 relates to Category No.: 9226, 6816, 14234; Payload ID: 20161 relates to Category No.: 9226, 6816; Payload ID: 20162 relates to Category No.: 3303, 9226, 6816; Payload ID: 20163 relates to Category No.: 9226, 6816, 14234; Payload ID: 20164 relates to Category No.: 9226, 6816, 14234; Payload ID: 20165 relates to Category No.: 9226, 6816, 14234; Payload ID: 20166 relates to Category No.: 9226, 6816, 14234; Payload ID: 20167 relates to Category No.: 9226, 6816, 14234; Payload ID: 20168 relates to Category No.: 3303, 9226, 15908; Payload ID: 20169 relates to Category No.: 3303, 9226, 6816, 14196, 15503, 14471; Payload ID: 20170 relates to Category No.: 9226, 6816; Payload ID: 20171 relates to Category No.: 9226, 6816, 15503, 14471, 14234, 15524, 15895, 11861, 15530, 14233; Payload ID: 20172 relates to Category No.: 9226, 11861, 6816; Payload ID: 20173 relates to Category No.: 3303, 9226, 6816; Payload ID: 20174 relates to Category No.: 6816, 11861, 2691, 15528, 14233; Payload ID: 20175 relates to Category No.: 3303, 9226, 6816, 7192, 15503, 14471; Payload ID: 20176 relates to Category No.: 16331, 9226, 6816, 15503, 14471, 14471; Payload ID: 20177 relates to Category No.: 9226, 6816, 3303, 11861; Payload ID: 20178 relates to Category No.: 9226, 6816; Payload ID: 20179 relates to Category No.: 9226, 15493, 6816, 3303; Payload ID: 20180 relates to Category No.: 3303, 9226, 6816; Payload ID: 20181 relates to Category No.: 3303, 9226, 6816, 11861; Payload ID: 20182 relates to Category No.: 3303, 9226, 6816; Payload ID: 20183 relates to Category No.: 3303, 6816, 10116; Payload ID: 20184 relates to Category No.: 3303, 9226, 6816, 7192; Payload ID: 20185 relates to Category No.: 3303, 6816, 14251, 14471, 9226; Payload ID: 20186 relates to Category No.: 3303, 6816; Payload ID: 20187 relates to Category No.: 9226, 6816, 15503, 14471, 14243, 11861; Payload ID: 20188 relates to Category No.: 9226, 6816, 15503, 14471, 14243; Payload ID: 20189 relates to Category No.: 3303, 6816, 11861; Payload ID: 20190 relates to Category No.: 9226, 6816, 3303; Payload ID: 20191 relates to Category No.: 3303, 9226, 6816; Payload ID: 20192 relates to Category No.: 3303, 9226, 6816, 7192; Payload ID: 20193 relates to Category No.: 9226, 3303, 6816, 11861; Payload ID: 20194 relates to Category No.: 9226, 6816, 15503, 14471, 3303; Payload ID: 20195 relates to Category No.: 3303, 9226, 6816, 15503, 14471; Payload ID: 20196 relates to Category No.: 3303, 6816; Payload ID: 20197 relates to Category No.: 3303, 9226, 6816, 15503, 14471; Payload ID: 20198 relates to Category No.: 3303, 6816; Payload ID: 20199 relates to Category No.: 9226, 6816, 3303, 11861; Payload ID: 20200 relates to Category No.: 9226, 6816, 3303; Payload ID: 20201 relates to Category No.: 9226, 6816; Payload ID: 20202 relates to Category No.: 3303, 9226, 6816, 15503, 14471; Payload ID: 20203 relates to Category No.: 9226, 6816, 15503, 14471, 14243, 11861, 7192; Payload ID: 20204 relates to Category No.: 3303, 9226, 6816, 15503, 14471; Payload ID: 20205 relates to Category No.: 3303, 9226, 6816; Payload ID: 20206 relates to Category No.: 9226, 6816, 15503, 14471, 14243, 11861; Payload ID: 20207 relates to Category No.: 9226, 6816, 15503, 14471, 14243; Payload ID: 20208 relates to Category No.: 9226, 6816, 3303; Payload ID: 20209 relates to Category No.: 3303, 16331, 9226, 6816, 15503, 14471, 14243, 11861; Payload ID: 20210 relates to Category No.: 3303, 6816; Payload ID: 20211 relates to Category No.: 3303, 6816; Payload ID: 20212 relates to Category No.: 6816; Payload ID: 20213 relates to Category No.: 6816; Payload ID: 20214 relates to Category No.: 6816, 14234, 9226; Payload ID: 20215 relates to Category No.: 3303, 6816, 15503, 14471, 9226; Payload ID: 20216 relates to Category No.: 3303, 9226, 6816, 15503, 14471; Payload ID: 20217 relates to Category No.: 9226, 6816, 15503, 14471, 14243; Payload ID: 20218 relates to Category No.: 3303, 9226, 6816; Payload ID: 20219 relates to Category No.: 9226, 15503, 14471, 6816; Payload ID: 20220 relates to Category No.: 3303, 9226, 6816, 15503, 14471; Payload ID: 20221 relates to Category No.: 9226, 6816, 15503, 14471, 15524, 11861; Payload ID: 20222 relates to Category No.: 3303, 9226, 6816; Payload ID: 20223 relates to Category No.: 3303, 6816, 9226; Payload ID: 20224 relates to Category No.: 3303, 9226, 6816; Payload ID: 20225 relates to Category No.: 9226, 15503, 14471, 3303, 6816, 11861; Payload ID: 20226 relates to Category No.: 16331, 9226, 6816, 11861; Payload ID: 20227 relates to Category No.: 6816, 15503, 14471, 14471, 15524; Payload ID: 20228 relates to Category No.: 3303, 6816, 15503, 14471; Payload ID: 20229 relates to Category No.: 15503, 14471, 3303, 9226, 6816; Payload ID: 20230 relates to Category No.: 6816, 15503, 14471, 14243; Payload ID: 20231 relates to Category No.: 6816; Payload ID: 20232 relates to Category No.: 9226, 6816, 3303, 16331; Payload ID: 20233 relates to Category No.: 3303, 9226, 6816, 15503, 14471; Payload ID: 20234 relates to Category No.: 9226, 6816, 11861; Payload ID: 20235 relates to Category No.: 3303, 9226, 6816, 11861; Payload ID: 20236 relates to Category No.: 9226, 3303, 6816; Payload ID: 20237 relates to Category No.: 9226, 3303, 6816, 11861; Payload ID: 20238 relates to Category No.: 9226, 3303, 6816, 15503, 14471, 14234, 15495, 11861; Payload ID: 20239 relates to Category No.: 9226, 3303, 6816; Payload ID: 20240 relates to Category No.: 9226, 6816; Payload ID: 20241 relates to Category No.: 9226, 6816; Payload ID: 20242 relates to Category No.: 3303, 9226, 6816; Payload ID: 20243 relates to Category No.: 9226, 6816, 11917, 7192; Payload ID: 20244 relates to Category No.: 3303, 6816, 15493, 9226; Payload ID: 20245 relates to Category No.: 9226, 6816; Payload ID: 20246 relates to Category No.: 3303, 9226, 6816, 15503, 14471; Payload ID: 20247 relates to Category No.: 9226, 15503, 14471, 6816; Payload ID: 20248 relates to Category No.: 3303, 9226, 6816; Payload ID: 20249 relates to Category No.: 9226, 16331, 6816, 15503, 14471, 14234, 15027; Payload ID: 20250 relates to Category No.: 9226, 3303, 16331, 6816, 15503, 14471; Payload ID: 20251 relates to Category No.: 16331, 9226, 6816, 15503, 14471, 14234; Payload ID: 20252 relates to Category No.: 9226, 6816, 3303, 16331, 15503, 14471; Payload ID: 20253 relates to Category No.: 9226, 6816, 14234; Payload ID: 20254 relates to Category No.: 3303, 9226, 6816; Payload ID: 20255 relates to Category No.: 9226, 6816, 15503, 14471, 14243; Payload ID: 20256 relates to Category No.: 3303, 6816, 15504, 11861, 15530, 14233, 14252, 14237, 14229; Payload ID: 20257 relates to Category No.: 3303, 16331, 6816, 15504, 15495, 11861, 15530, 14233, 14252, 14246, 9226; Payload ID: 20258 relates to Category No.: 3303, 6816, 15503, 14471, 15491, 14243; Payload ID: 20259 relates to Category No.: 3303, 6816, 15503, 14471, 14243; Payload ID: 20260 relates to Category No.: 3303, 16331; Payload ID: 20261 relates to Category No.: 3303, 16331, 9226, 6816, 10116, 11861; Payload ID: 20262 relates to Category No.: 16331, 9226, 6816; Payload ID: 20263 relates to Category No.: 9226, 6816, 15503, 14471, 14471, 11861, 3303; Payload ID: 20264 relates to Category No.: 3303, 9226, 6816, 15503, 14471, 14251, 14471, 7192; Payload ID: 20265 relates to Category No.: 3303, 9226, 6816, 15503, 14471, 14234, 2405, 14471, 11861, 15530, 14233; Payload ID: 20266 relates to Category No.: 9226, 6816, 15503, 14471, 14471, 11861; Payload ID: 20267 relates to Category No.: 3303, 16331, 9226, 6816, 15503, 14471, 11861; Payload ID: 20268 relates to Category No.: 3303, 9226, 6816, 15503, 14471, 11861; Payload ID: 20269 relates to Category No.: 6816, 15503, 14471, 14471, 9226; Payload ID: 20270 relates to Category No.: 6816, 11861; Payload ID: 20271 relates to Category No.: 16331; Payload ID: 20272 relates to Category No.: 16331, 11861; Payload ID: 20273 relates to Category No.: 16331, 11861; Payload ID: 20274 relates to Category No.: 3303, 16331; Payload ID: 20275 relates to Category No.: 16331, 11861; Payload ID: 20276 relates to Category No.: 3303, 16331, 11861, 7192; Payload ID: 20277 relates to Category No.: 3303, 16331, 11861, 7192, 10163; Payload ID: 20278 relates to Category No.: 16331; Payload ID: 20279 relates to Category No.: 3303, 9226, 6816, 11917, 11861, 15630; Payload ID: 20280 relates to Category No.: 3303, 6816; Payload ID: 20281 relates to Category No.: 3303, 6816, 11861; Payload ID: 20282 relates to Category No.: 3303, 9226, 6816, 11917, 11861; Payload ID: 20283 relates to Category No.: 3303, 9226, 6816; Payload ID: 20284 relates to Category No.: 3303, 9226, 6816, 11917; Payload ID: 20285 relates to Category No.: 9226, 11861; Payload ID: 20286 relates to Category No.: 9226, 15503, 14471; Payload ID: 20287 relates to Category No.: 6816, 11861; Payload ID: 20288 relates to Category No.: 6816; Payload ID: 20289 relates to Category No.: 6816, 11861; Payload ID: 20290 relates to Category No.: 6816, 10116, 11861; Payload ID: 20291 relates to Category No.: 16331, 11981, 11861; Payload ID: 20292 relates to Category No.: 6816, 11861; Payload ID: 20293 relates to Category No.: 9226, 6816, 15503, 14471, 14234, 14471, 11861, 15530, 14233; Payload ID: 20294 relates to Category No.: 16331, 9226, 11861; Payload ID: 20295 relates to Category No.: 16331, 9226, 9304, 11861, 10116, 14277; Payload ID: 20296 relates to Category No.: 16331, 9226, 11861, 6185; Payload ID: 20297 relates to Category No.: 16331, 9226, 11861; Payload ID: 20298 relates to Category No.: 16331, 9226, 9857, 11861; Payload ID: 20299 relates to Category No.: 16331, 9226; Payload ID: 20300 relates to Category No.: 16331, 9226, 10116, 11861; Payload ID: 20301 relates to Category No.: 16331, 9226; Payload ID: 20302 relates to Category No.: 16331, 9226, 9857; Payload ID: 20303 relates to Category No.: 16331, 9226, 10116; Payload ID: 20304 relates to Category No.: 16331, 9226, 10116; Payload ID: 20305 relates to Category No.: 16331, 9226, 6924; Payload ID: 20306 relates to Category No.: 16331, 9226; Payload ID: 20307 relates to Category No.: 16331, 9226, 9304, 10116, 14277; Payload ID: 20308 relates to Category No.: 16331, 9226, 10116, 11861; Payload ID: 20309 relates to Category No.: 16331, 10116, 11861, 9226; Payload ID:

20310 relates to Category No.: 16331, 9226, 10116; Payload ID: 20311 relates to Category No.: 16331; Payload ID: 20312 relates to Category No.: 16331; Payload ID: 20313 relates to Category No.: 16331, 9226; Payload ID: 20314 relates to Category No.: 3303, 16331, 12167, 9551; Payload ID: 20315 relates to Category No.: 16331, 12167; Payload ID: 20316 relates to Category No.: 16331, 12167; Payload ID: 20317 relates to Category No.: 16331, 12167, 9551; Payload ID: 20318 relates to Category No.: 16331, 14564, 12167, 11861, 6481, 9551; Payload ID: 20319 relates to Category No.: 16331, 12167, 9551; Payload ID: 20320 relates to Category No.: 16331, 12167, 9551; Payload ID: 20321 relates to Category No.: 16331, 12167, 9551; Payload ID: 20322 relates to Category No.: 16331, 14564, 12167, 11861, 5347, 6481, 9551; Payload ID: 20323 relates to Category No.: 16331, 12167, 9551; Payload ID: 20324 relates to Category No.: 16331, 12167; Payload ID: 20325 relates to Category No.: 16331, 12167, 9551; Payload ID: 20326 relates to Category No.: 16331, 12167, 9551; Payload ID: 20327 relates to Category No.: 16331, 12167, 9551; Payload ID: 20328 relates to Category No.: 16331, 12167, 11861; Payload ID: 20329 relates to Category No.: 16331, 12167; Payload ID: 20330 relates to Category No.: 16331, 12167, 11861; Payload ID: 20331 relates to Category No.: 16331, 12167, 9551; Payload ID: 20332 relates to Category No.: 16331, 12167; Payload ID: 20333 relates to Category No.: 16331, 12167, 9551, 11861; Payload ID: 20334 relates to Category No.: 16331, 12167, 9551; Payload ID: 20335 relates to Category No.: 16331, 12167, 9551; Payload ID: 20336 relates to Category No.: 16331, 12167, 9551, 11861; Payload ID: 20337 relates to Category No.: 16331, 12167, 9551, 12390; Payload ID: 20338 relates to Category No.: 6816, 16331, 56, 11861, 9874, 9877; Payload ID: 20339 relates to Category No.: 6816, 12142, 56, 11861, 9874; Payload ID: 20340 relates to Category No.: 16331, 6816, 11861, 9882; Payload ID: 20341 relates to Category No.: 926, 6816, 11861; Payload ID: 20342 relates to Category No.: 6816, 11861, 9882; Payload ID: 20343 relates to Category No.: 6816, 11861; Payload ID: 20344 relates to Category No.: 6816, 11861, 9882; Payload ID: 20345 relates to Category No.: 6816, 14506, 56, 11861; Payload ID: 20346 relates to Category No.: 16331, 15503, 14471, 2405, 14471, 14243, 14252, 15528, 14255; Payload ID: 20347 relates to Category No.: 16331; Payload ID: 20348 relates to Category No.: 6816, 5109, 9275, 11861, 2405; Payload ID: 20349 relates to Category No.: 6816; Payload ID: 20350 relates to Category No.: 6816, 11861, 15409; Payload ID: 20351 relates to Category No.: 6816, 11861, 5347, 3752; Payload ID: 20352 relates to Category No.: 3303, 16331, 9226, 6816, 14251, 14471; Payload ID: 20353 relates to Category No.: 3303, 9226, 6816, 15503, 14471; Payload ID: 20354 relates to Category No.: 3303, 16331, 9226, 6816, 14196, 9539; Payload ID: 20355 relates to Category No.: 16331, 9226, 3303, 14196, 11861; Payload ID: 20356 relates to Category No.: 16331, 9226, 9539, 10116, 11861; Payload ID: 20357 relates to Category No.: 3303, 16331, 9226, 6816, 14196, 9539, 11861; Payload ID: 20358 relates to Category No.: 16331, 6816; Payload ID: 20359 relates to Category No.: 16331; Payload ID: 20360 relates to Category No.: 16331, 11861, 6185; Payload ID: 20361 relates to Category No.: 16331, 9226, 11917; Payload ID: 20362 relates to Category No.: 16331, 15889, 11861; Payload ID: 20363 relates to Category No.: 3303, 16331; Payload ID: 20364 relates to Category No.: 3303, 16331, 11861; Payload ID: 20365 relates to Category No.: 16331, 14251, 14471, 11861; Payload ID: 20366 relates to Category No.: 3303, 16331, 9226; Payload ID: 20367 relates to Category No.: 6816, 11861; Payload ID: 20368 relates to Category No.: 16331, 2405, 6900, 5105, 15495, 14243, 11861, 15493; Payload ID: 20369 relates to Category No.: 6816; Payload ID: 20370 relates to Category No.: 6816, 5109; Payload ID: 20371 relates to Category No.: 6816, 11861; Payload ID: 20372 relates to Category No.: 16331, 2405, 5105, 14243, 11861, 14249, 15493, 13735, 12064; Payload ID: 20373 relates to Category No.: 1201, 16331, 6816, 15503, 14471, 10116; Payload ID: 20374 relates to Category No.: 16331, 15911, 5923, 11861; Payload ID: 20375 relates to Category No.: 16331, 14196, 15503, 14471, 10116, 11861; Payload ID: 20376 relates to Category No.: 926, 16331, 9226, 3655, 5923, 3640, 11861, 714; Payload ID: 20377 relates to Category No.: 16331; Payload ID: 20378 relates to Category No.: 16331, 6188, 11861, 15893, 15908, 12107; Payload ID: 20379 relates to Category No.: 16331; Payload ID: 20380 relates to Category No.: 16331; Payload ID: 20381 relates to Category No.: 16331; Payload ID: 20382 relates to Category No.: 16331; Payload ID: 20383 relates to Category No.: 16331, 11861; Payload ID: 20384 relates to Category No.: 16331; Payload ID: 20385 relates to Category No.: 9226, 6816, 15503, 14471, 11861, 1356; Payload ID: 20386 relates to Category No.: 9226, 6816, 7192; Payload ID: 20387 relates to Category No.: 3303, 16331, 11861; Payload ID: 20388 relates to Category No.: 1405, 16331; Payload ID: 20389 relates to Category No.: 3303, 6816, 15503, 14471, 11933, 15495, 11861; Payload ID: 20390 relates to Category No.: 3303, 6816, 15503, 14471, 11939, 11933, 15495, 11861, 5347; Payload ID: 20391 relates to Category No.: 3303, 15495, 6816, 15503, 14471, 11939, 11933, 11861; Payload ID: 20392 relates to Category No.: 6816, 6825, 6828; Payload ID: 20393 relates to Category No.: 16331, 9226, 14220, 3391; Payload ID: 20395 relates to Category No.: 9226, 6816; Payload ID: 20396 relates to Category No.: 9226; Payload ID: 20397 relates to Category No.: 9226; Payload ID: 20398 relates to Category No.: 9226; Payload ID: 20399 relates to Category No.: 11861; Payload ID: 20400 relates to Category No.: 11861; Payload ID: 20402 relates to Category No.: 2694, 259, 11861; Payload ID: 20403 relates to Category No.: 14564, 1504, 11861, 14996, 259, 6576; Payload ID: 20404 relates to Category No.: 14564, 259; Payload ID: 20406 relates to Category No.: 11861; Payload ID: 20407 relates to Category No.: 16331, 11861, 15593, 12425; Payload ID: 20408 relates to Category No.: 11861, 12064; Payload ID: 20409 relates to Category No.: 11861, 2191; Payload ID: 20410 relates to Category No.: 11861; Payload ID: 20411 relates to Category No.: 9226, 6816, 15503, 14471, 11861, 1356, 6351; Payload ID: 20412 relates to Category No.: 15908, 1201; Payload ID: 20413 relates to Category No.: 15908, 11861, 1201; Payload ID: 20414 relates to Category No.: 15908, 11861, 1201; Payload ID: 20416 relates to Category No.: 11861; Payload ID: 20417 relates to Category No.: 1504, 11861; Payload ID: 20418 relates to Category No.: 1504, 7192; Payload ID: 20419 relates to Category No.: 16331, 10116, 11861.

III. Pharmaceutical Compositions

The present teachings further comprise pharmaceutical compositions comprising one or more of the stimuli, biocircuits, effector modules or systems of the present invention, and optionally at least one pharmaceutically acceptable excipient or inert ingredient.

As used herein the term "pharmaceutical composition" refers to a preparation of one or more of the biocircuits or components described herein, or pharmaceutically acceptable salts thereof, optionally with other chemical components such as physiologically suitable carriers and excipients.

The term "excipient" or "inactive ingredient" refers to an inert or inactive substance added to a pharmaceutical composition to further facilitate administration of a compound. Non-limiting examples of such inert ingredients are disclosed herein under Formulations.

In some embodiments, compositions are administered to humans, human patients or subjects. For the purposes of the present disclosure, the phrase "active ingredient" generally refers to any one or more biocircuit system component to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Subjects to which administration of the pharmaceutical compositions is contemplated include, but are not limited to, non-human mammals, including agricultural animals such as cattle, horses, chickens and pigs, domestic animals such as cats, dogs, or research animals such as mice, rats, rabbits, dogs and non-human primates.

A pharmaceutical composition in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient or inert ingredient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

Efficacy of treatment or amelioration of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. In connection with the administration of compositions of the present invention, "effective against" for example a cancer, indicates that administration in a clinically appropriate manner results in a beneficial effect for at least a statistically significant fraction of patients, such as an improvement of symptoms, a cure, a reduction in disease load, reduction in tumor mass or cell numbers, extension of life, improvement in quality of life, or other effect generally recognized as positive by medical doctors familiar with treating the particular type of cancer.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given composition or formulation of the present invention can also be judged using an experimental animal model for the given disease as known in the art. When using an experimental animal model, efficacy of treatment is evidenced when a statistically significant change is observed.

Therapeutic Uses

Cancer

Various cancers may be treated with pharmaceutical compositions, biocircuits, biocircuit components, effector modules including their SREs or payloads of the present invention. As used herein, the term "cancer" refers to any of various malignant neoplasms characterized by the proliferation of anaplastic cells that tend to invade surrounding tissue and metastasize to new body sites and also refers to the pathological condition characterized by such malignant neoplastic growths. Cancers may be tumors or hematological malignancies, and include but are not limited to, all types of lymphomas/leukemias, carcinomas and sarcomas, such as those cancers or tumors found in the anus, bladder, bile duct, bone, brain, breast, cervix, colon/rectum, endometrium, esophagus, eye, gallbladder, head and neck, liver, kidney, larynx, lung, mediastinum (chest), mouth, ovaries, pancreas, penis, prostate, skin, small intestine, stomach, spinal marrow, tailbone, testicles, thyroid and uterus.

Types of carcinomas which may be treated with the compositions of the present invention include, but are not limited to, papilloma/carcinoma, choriocarcinoma, endodermal sinus tumor, teratoma, adenoma/adenocarcinoma, melanoma, fibroma, lipoma, leiomyoma, rhabdomyoma, mesothelioma, angioma, osteoma, chondroma, glioma, lymphoma/leukemia, squamous cell carcinoma, small cell carcinoma, large cell undifferentiated carcinomas, basal cell carcinoma and sinonasal undifferentiated carcinoma.

Types of carcinomas which may be treated with the compositions of the present invention include, but are not limited to, soft tissue sarcoma such as alveolar soft part sarcoma, angiosarcoma, dermatofibrosarcoma, desmoid tumor, desmoplastic small round cell tumor, extraskeletal chondrosarcoma, extraskeletal osteosarcoma, fibrosarcoma, hemangiopericytoma, hemangiosarcoma, Kaposi's sarcoma, leiomyosarcoma, liposarcoma, lymphangiosarcoma, lymphosarcoma, malignant fibrous histiocytoma, neurofibrosarcoma, rhabdomyosarcoma, synovial sarcoma, and Askin's tumor, Ewing's sarcoma (primitive neuroectodermal tumor), malignant hemangioendothelioma, malignant schwannoma, osteosarcoma, and chondrosarcoma.

As a non-limiting example, the carcinoma which may be treated may be Acute granulocytic leukemia, Acute lymphocytic leukemia, Acute myelogenous leukemia, Adenocarcinoma, Adenosarcoma, Adrenal cancer, Adrenocortical carcinoma, Anal cancer, Anaplastic astrocytoma, Angiosarcoma, Appendix cancer, Astrocytoma, Basal cell carcinoma, B-Cell lymphoma), Bile duct cancer, Bladder cancer, Bone cancer, Bowel cancer, Brain cancer, Brain stem glioma, Brain tumor, Breast cancer, Carcinoid tumors, Cervical cancer, Cholangiocarcinoma, Chondrosarcoma, Chronic lymphocytic leukemia, Chronic myelogenous leukemia, Colon cancer, Colorectal cancer, Craniopharyngioma, Cutaneous lymphoma, Cutaneous melanoma, Diffuse astrocytoma, Ductal carcinoma in situ, Endometrial cancer, Ependymoma, Epithelioid sarcoma, Esophageal cancer, Ewing sarcoma, Extrahepatic bile duct cancer, Eye cancer, Fallopian tube cancer, Fibrosarcoma, Gallbladder cancer, Gastric cancer, Gastrointestinal cancer, Gastrointestinal carcinoid cancer, Gastrointestinal stromal tumors, General, Germ cell tumor, Glioblastoma multiforme, Glioma, Hairy cell leukemia, Head and neck cancer, Hemangioendothelioma, Hodgkin lymphoma, Hodgkin's disease, Hodgkin's lymphoma, Hypopharyngeal cancer, Infiltrating ductal carcinoma, Infiltrating lobular carcinoma, Inflammatory breast cancer, Intestinal Cancer, Intrahepatic bile duct cancer, Invasive/infiltrating breast cancer, Islet cell cancer, Jaw cancer, Kaposi sarcoma, Kidney cancer, Laryngeal cancer, Leiomyosarcoma, Leptomeningeal metastases, Leukemia, Lip cancer, Liposarcoma, Liver cancer, Lobular carcinoma in situ, Low-grade astrocytoma, Lung cancer, Lymph node cancer, Lymphoma, Male breast cancer, Medullary carcinoma, Medulloblastoma, Melanoma, Meningioma, Merkel cell carcinoma, Mesenchymal chondrosarcoma, Mesenchymous, Mesothelioma, Metastatic breast cancer, Metastatic melanoma, Metastatic squamous neck cancer, Mixed gliomas, Mouth cancer, Mucinous carcinoma, Mucosal melanoma, Multiple myeloma, Nasal cavity cancer, Nasopharyngeal cancer, Neck cancer, Neuroblastoma, Neuroendocrine tumors, Non-Hodgkin lymphoma, Non-Hodgkin's lymphoma, Non-small cell lung cancer, Oat cell cancer, Ocular cancer, Ocular melanoma, Oligodendroglioma, Oral cancer, Oral cavity cancer, Oropharyngeal cancer, Osteogenic sarcoma, Osteosarcoma, Ovarian cancer, Ovarian epithelial cancer, Ovarian germ cell tumor, Ovarian primary peritoneal carcinoma, Ovarian sex cord stromal tumor, Paget's disease, Pancreatic cancer, Papillary carcinoma, Paranasal sinus cancer, Parathyroid cancer, Pelvic cancer, Penile cancer, Peripheral nerve cancer, Peritoneal cancer, Pharyngeal cancer, Pheochromocytoma, Pilocytic astrocytoma, Pineal region tumor, Pineoblastoma, Pituitary gland cancer, Primary central nervous system lymphoma, Prostate cancer, Rectal cancer, Renal cell cancer, Renal pelvis cancer, Rhabdomyosarcoma, Salivary gland cancer, Sarcoma, Sarcoma, bone, Sarcoma, soft tissue, Sarcoma, uterine, Sinus cancer, Skin cancer, Small cell lung cancer, Small intestine cancer, Soft tissue sarcoma, Spinal cancer, Spinal column cancer, Spinal cord cancer, Spinal tumor, Squamous cell carcinoma, Stomach cancer, Synovial sarcoma, T-cell lymphoma), Testicular cancer, Throat cancer, Thymoma/thymic carcinoma, Thyroid cancer, Tongue cancer, Tonsil cancer, Transitional cell cancer, Transitional cell cancer, Transitional cell cancer, Triple-negative breast cancer, Tubal cancer, Tubular carcinoma, Ureteral cancer, Ureteral cancer, Urethral cancer, Uterine adenocarcinoma, Uterine cancer, Uterine sarcoma, Vaginal cancer, and Vulvar cancer.

Combination Treatments

The invention further relates to the use of pharmaceutical compositions, biocircuits, biocircuit components, effector modules including their SREs or payloads of the present invention for treating one or more forms of cancer, in combination with other pharmaceuticals and/or other therapeutic methods, e.g., with known pharmaceuticals and/or known therapeutic methods, such as, for example, those which are currently employed for treating these disorders. For example, the pharmaceutical compositions, biocircuits, biocircuit components, effector modules including their SREs or payloads of the present invention can also be administered in conjunction with one or more additional anti-cancer treatments, such as biological, chemotherapy and radiotherapy. Accordingly, a treatment can include, for example, imatinib (Gleevac), all-trans-retinoic acid, a monoclonal antibody treatment (gemtuzumab, ozogamicin), chemotherapy (for example, chlorambucil, prednisone, prednisolone, vincristine, cytarabine, clofarabine, farnesyl transferase inhibitors, decitabine, inhibitors of MDR1), rituximab, interferon-α, anthracycline drugs (such as daunorubicin or idarubicin), L-asparaginase, doxorubicin, cyclophosphamide, doxorubicin, bleomycin, fludarabine, etoposide, pentostatin, or cladribine), bone marrow transplant, stem cell transplant, radiation therapy, anti-metabolite drugs (methotrexate and 6-mercaptopurine), or any of the antibodies taught herein such as those in Table 5 or combinations thereof.

Combinations with Radiation

Radiation therapy (also called radiotherapy, X-ray therapy, or irradiation) is the use of ionizing radiation to kill cancer cells and shrink tumors. Radiation therapy can be administered externally via external beam radiotherapy (EBRT) or internally via brachytherapy. The effects of radiation therapy are localized and confined to the region being treated. Radiation therapy may be used to treat almost every type of solid tumor, including cancers of the brain, breast, cervix, larynx, lung, pancreas, prostate, skin, stomach, uterus, or soft tissue sarcomas. Radiation is also used to treat leukemia and lymphoma.

Combination with Chemotherapy

Chemotherapy is the treatment of cancer with drugs that can destroy cancer cells. In current usage, the term "chemotherapy" usually refers to cytotoxic drugs which affect rapidly dividing cells in general, in contrast with targeted therapy. Chemotherapy drugs interfere with cell division in various possible ways, e.g. with the duplication of DNA or the separation of newly formed chromosomes. Most forms of chemotherapy target all rapidly dividing cells and are not specific to cancer cells, although some degree of specificity may come from the inability of many cancer cells to repair DNA damage, while normal cells generally can.

Most chemotherapy regimens are given in combination. Exemplary chemotherapeutic agents include, but are not limited to, 5-FU Enhancer, 9-AC, AG2037, AG3340, Aggrecanase Inhibitor, Aminoglutethimide, Amsacrine (m-AMSA), Asparaginase, Azacitidine, Batimastat (BB94), BAY 12-9566, BCH-4556, Bis-Naphtalimide, Busulfan, Capecitabine, Carboplatin, Carmustaine+Polifepr Osan, cdk4/cdk2 inhibitors, Chlorombucil, CI-994, Cisplatin, Cladribine, CS-682, Cytarabine HCl, D2163, Dactinomycin, Daunorubicin HCl, DepoCyt, Dexifosamide, Docetaxel, Dolastain, Doxifluridine, Doxorubicin, DX8951f, E 7070, EGFR, Epirubicin, Erythropoietin, Estramustine phosphate sodium, Etoposide (VP16-213), Farnesyl Transferase Inhibitor, FK 317, Flavopiridol, Floxuridine, Fludarabine, Fluorouracil (5-FU), Flutamide, Fragyline, Gemcitabine, Hexamethylmelamine (HMM), Hydroxyurea (hydroxycarbamide), Ifosfamide, Interferon Alfa-2a, Interferon Alfa-2b, Interleukin-2, Irinotecan, ISI 641, Krestin, Lemonal DP 2202, Leuprolide acetate (LHRH-releasing factor analogue), Levamisole, LiGLA (lithium-gamma linolenate), Lodine Seeds, Lometexol, Lomustine (CCNU), Marimistat, Mechlorethamine HCl (nitrogen mustard), Megestrol acetate, Meglamine GLA, Mercaptopurine, Mesna, Mitoguazone (methyl-GAG; methyl glyoxal bisguanylhydrazone; MGBG), Mitotane (o.p'-DDD), Mitoxantrone, Mitoxantrone HCl, MMI 270, MMP, MTA/LY 231514, Octreotide, ODN 698, OK-432, Oral Platinum, Oral Taxoid, Paclitaxel (TAXOL®), PARP Inhibitors, PD 183805, Pentostatin (2' deoxycoformycin), PKC 412, Plicamycin, Procarbazine HCl, PSC 833, Ralitrexed, RAS Farnesyl Transferase Inhibitor, RAS Oncogene Inhibitor, Semustine (methyl-CCNU), Streptozocin, Suramin, Tamoxifen citrate, Taxane Analog, Temozolomide, Teniposide (VM-26), Thioguanine, Thiotepa, Topotecan, Tyrosine Kinase, UFT (Tegafur/Uracil), Valrubicin, Vinblastine sulfate, Vindesine sulfate, VX-710, VX-853, YM 116, ZD 0101, ZD 0473/Anormed, ZD 1839, ZD 9331.

Immuno-Oncology and Cell Therapies

Recent progress in the field of cancer immunology has allowed the development of several approaches to help the immune system keep the cancer at bay. Such immunotherapy approaches include the targeting of cancer antigens through monoclonal antibodies or through adoptive transfer of ex vivo engineered T cells (e.g., which contain chimeric antigen receptors or engineered T cell receptors).

In some embodiments, pharmaceutical compositions, biocircuits, biocircuit components, effector modules including their SREs or payloads of the present invention may be used in the modulation or alteration or exploitation of the immune system to target one or more cancers. This approach may also be considered with other such biological approaches, e.g., immune response modifying therapies such as the administration of interferons, interleukins, colony-stimulating factors, other monoclonal antibodies, vaccines, gene therapy, and nonspecific immunomodulating agents are also envisioned as anti-cancer therapies to be combined with the pharmaceutical compositions, biocircuits, biocircuit components, effector modules including their SREs or payloads of the present invention.

Cancer immunotherapy refers to a diverse set of therapeutic strategies designed to induce the patients own immune system to fight the cancer. In some embodiments, pharmaceutical compositions, biocircuits, biocircuit components, effector modules including their SREs or payloads of the present invention are designed as immune-oncology therapeutics.

Cell Therapies

There are several types of cellular immunotherapies, including tumor infiltrating lymphocyte (TIL) therapy, genetically engineered T cells bearing chimeric antigen receptors (CARs), and recombinant TCR technology.

According to the present invention, the biocircuits and systems may be used in the development and implementation of cell therapies such as adoptive cell therapy. Certain effector modules useful in cell therapy are given in FIGS. 8-13. The biocircuits, their components, effector modules and their SREs and payloads may be used in cell therapies to effect TCR removal—TCR gene disruption, TCR engineering, to regulate epitope tagged receptors, in APC platforms for stimulating T cells, as a tool to enhance ex vivo APC stimulation, to improve methods of T cell expansion, in ex vivo stimulation with antigen, in TCR/CAR combinations, in the manipulation or regulation of TILs, in allogeneic cell therapy, in combination T cell therapy with other treatment lines (e.g. radiation, cytokines), to encode engineered TCRs, or modified TCRs, or to enhance T cells other than TCRs (e.g by introducing cytokine genes, genes for the checkpoint inhibitors PD1, CTLA4).

Components of the biocircuits useful in cell therapies include for example, those in Tables 14-16.

TABLE 14

T-Cell Receptor (heterodimer)

| Symbol | Name |
|---|---|
| TRA (TCRA) | T cell receptor alpha chain |
| TRAV | T cell receptor alpha chain variable region |
| TRAJ | T cell receptor alpha chain joining region |
| TRAC | T cell receptor alpha chain constant region |
| TRB (TCRB) | T cell receptor beta chain |
| TRBV | T cell receptor beta chain variable region |
| TRBD | T cell receptor beta chain diversity region |
| TRBJ | T cell receptor beta chain joining region |
| TRBC | T cell receptor beta chain constant region |
| TRD (TCRD) | T cell receptor delta chain |
| TRDV | T cell receptor delta chain variable region |
| TRDD | T cell receptor delta chain diversity region |
| TRDJ | T cell receptor delta chain joining region |
| TRDC | T cell receptor delta chain constant region |
| TRG (TCRG) | T cell receptor gamma chain |
| TRGV (variable) gene | T cell receptor gamma chain variable region |
| TRGJ (joining) gene | T cell receptor gamma chain joining region |
| TRGC (constant) gene | T cell receptor gamma chain constant region |

TABLE 15

T-Cell Co-Receptor

| Symbol | Name | NCBI Ref No. |
|---|---|---|
| CD4 | CD4 Molecule | NP_000607 |
| CD8 | T-cell surface glycoprotein CD8 alpha chain isoform 1 precursor | NP_001139345.1 (GI: 225007536) |
| CD8 | T-cell surface glycoprotein CD8 alpha chain isoform 2 precursor | NP_741969.1 (GI: 27886642) |
| CD8 | T-cell surface glycoprotein CD8 beta chain isoform 6 precursor | NP_001171571.1 (GI: 296010933) |
| CD8 | T-cell surface glycoprotein CD8 beta chain isoform 2 precursor | NP_757362.1 (GI: 27886639) |
| CD8 | T-cell surface glycoprotein CD8 beta chain isoform 4 precursor | NP_742100.1 (GI: 27886637) |
| CD8 | T-cell surface glycoprotein CD8 beta chain isoform 3 precursor | NP_742099.1 (GI: 27886635) |
| CD8 | T-cell surface glycoprotein CD8 beta chain isoform 5 precursor | NP_004922.1 (GI: 4826667) |

TABLE 16

T-Cell Receptor Signaling Transduction Complex

| Complex | Name | NCBI Ref No. |
|---|---|---|
| CD3 | CD3 delta chain | NP_000723 |
| CD3 | CD3 gamma chain | NP_000064 |
| CD3 | CD3 epsilon chain | NP_000724 |
| CD3 | CD3 zeta chain | NP_000725 |
| Other | CD3 Zeta-chain-associated protein kinase 70 (ZAP70) | NP_001070 |
| Other | Proto-oncogene tyrosine-protein kinase (FYN) | NP_002028 |

In some embodiments, improved response rates are obtained in support of cell therapies.

Expansion and persistence of cell populations may be achieved through regulation or fine tuning of the payloads, e.g., the receptors or pathway components in T cells, NK cells or other immune-related cells. In some embodiments, biocircuits, their components, SREs or effector modules are designed to spatially and/or temporally control the expression of proteins which enhance T-cell or NK cell response. In some embodiments, biocircuits, their components, SREs or effector modules are designed to spatially and/or temporally control the expression of proteins which inhibit T-cell or NK cell response.

In some embodiments, biocircuits, their components, SREs or effector modules are designed to reshape the tumor microenvironment to extend utility of the biocircuit or a pharmaceutical composition beyond direct cell killing.

In some embodiments, biocircuits, their components, SREs or effector modules are designed to reduce, mitigate or eliminate the CAR cytokine storm. In some embodiments, such reduction, mitigation and/or elimination occurs in solid tumors or tumor microenvironments.

In some embodiments, the effector modules may encode one or more cytokines.

In one embodiment, the payload of the invention may comprise IL2. In one aspect, the effector module of the invention may be DD-IL2 fusion polypeptide. The amino acid sequences corresponding to DD-IL2 and its components are listed in Table 17. In Table 17, the mutations in the sequences are underlined.

TABLE 17

DD-IL2 constructs

| Description | Amino Acid Sequence | Amino Acid SEQ ID NO | Nucleotide SEQ ID NO |
|---|---|---|---|
| IL2 signal sequence | MYRMQLLSCIALSLALVTNS | 213271 | 213279-213280 |
| Linker | EFSTEF | 213272 | 213281 |
| IL2 | APTSSSTKKTQLQLEHLLLDLQMILNGINNYKNPKLTRMLTFKFYMPKK ATELKHLQCLEEELKPLEEVLNLAQSKNFHLRPRDLISNINVIVLELKGS ETTFMCEYADETATIVEFLNRWITFCQSIISTLT | 213273 | 213282-213283 |
| FKBP (F36V, L106P) | GVQVETISPGDGRTFPKRGQTCVVHYTGMLEDGKKVDSSRDRNKPFK FMLGKQEVIRGWEEGVAQMSVGQRAKLTISPDYAYGATGHPGIIPPHA TLVFDVELLKPE | 213274 | 213284 |
| ecDHFR (R12Y, Y100I) | ISLIAALAVDYVIGMENAMPWNLPADLAWFKRNTLNKPVIMGRHTWESI GRPLPGRKNIILSSQPGTDDRVTWVKSVDEAIAACGDVPEIMVIGGGR VIEQFLPKAQKLYLTHIDAEVEGDTHFPDYEPDDWESVFSEFHDADAQ NSHSYCFEILERR | 213275 | 213285 |
| OT-IL2-001 (IL2 signal sequence; linker1 (EFSTEF); FKBP (F36V, L106P); linker2 (MH); IL2) | MYRMQLLSCIALSLALVTNSEFSTEFGVQVETISPGDGRTFPKRGQTC VVHYTGMLEDGKKVDSSRDRNKPFKFMLGKQEVIRGWEEGVAQMSV GQRAKLTISPDYAYGATGHPGIIPPHATLVFDVELLKPEMHAPTSSSTK KTQLQLEHLLLDLQMILNGINNYKNPKLTRMLTFKFYMPKKATELKHLQ CLEEELKPLEEVLNLAQSKNFHLRPRDLISNINVIVLELKGSETTFMCEY ADETATIVEFLNRWITFCQSIISTLT | 213276 | 213286 |
| OT-IL2-002 (Signal sequence-IL2) | MYRMQLLSCIALSLALVTNSAPTSSSTKKTQLQLEHLLLDLQMILNGINN YKNPKLTRMLTFKFYMPKKATELKHLQCLEEELKPLEEVLNLAQSKNF HLRPRDLISNINVIVLELKGSETTFMCEYADETATIVEFLNRWITFCQSIIS TLT | 213277 | 213287 |
| OT-IL2-003 (IL2 signal sequence; linker1 (EFSTEF); ecDHFR (R12Y, Y100I); linker2 (MH); IL2 | MYRMQLLSCIALSLALVTNSEFSTEFISLIAALAVDYVIGMENAMPWNLP ADLAWFKRNTLNKPVIMGRHTWESIGRPLPGRKNIILSSQPGTDDRVT WVKSVDEAIAACGDVPEIMVIGGGRVIEQFLPKAQKLYLTHIDAEVEGD THFPDYEPDDWESVFSEFHDADAQNSHSYCFEILERRMHAPTSSSTK KTQLQLEHLLLDLQMILNGINNYKNPKLTRMLTFKFYMPKKATELKHLQ CLEEELKPLEEVLNLAQSKNFHLRPRDLISNINVIVLELKGSETTFMCEY ADETATIVEFLNRWITFCQSIISTLT | 213278 | 213288 |

In one aspect, the effector module of the invention may be a DD-IL12 fusion polypeptide. Regulatable DD-IL12 fusion polypeptide may be directly used as an immunotherapeutic agent or be transduced into an immune effector cell (T cells and TIL cells) to generate modified T cells with greater in vivo expansion and survival capabilities for adoptive cell transfer. The need for harsh preconditioning regimens in current adoptive cell therapies may be minimized using regulated IL12 DD-IL12 may be utilized to modify tumor microenvironment and increase persistence in solid tumors that are currently refractory to tumor antigen targeted therapy. In some embodiments, CAR expressing T cells may be armored with DD regulated IL12 to relieve immunosuppression without systemic toxicity.

In some embodiments, the IL12 may be a Flexi IL12, wherein both p35 and p40 subunits, are encoded by a single cDNA that produces a single chain polypeptide. In some aspects, the DD-IL12 comprises the amino acid sequences as shown in Table 18. In Table 18, the mutations in the sequences are underlined.

TABLE 18

DD-IL12 constructs

| Description/ Construct ID | Amino Acid Sequence | Amino Acid SEQ ID NO | Nucleic Acid SEQ ID NO |
|---|---|---|---|
| p40 signal sequence | MCHQQLVISWFSLVFLASPLVA | 213289 | 213307-213315 |
| Linker | GGSGG | 213290 | 213316-213317 |
| Linker | GGGGSGGGGSGGGGS | 213291 | 213318-213322 |
| Furin cleavage site | SARNRQKRS | 213292 | 213324 |
| Furin cleavage site | ARNRQKRS | 213293 | 213325 |

TABLE 18-continued

DD-IL12 constructs

| Description/<br>Construct ID | Amino Acid Sequence | Amino Acid SEQ ID NO | Nucleic Acid SEQ ID NO |
|---|---|---|---|
| Modified Furin | ESRRVRRNKRSK | 213294 | 213326-213329 |
| p40 | IWELKKDVYVVELDWYPDAPGEMVVLTCDTPEEDGITWTLDQSSEVLGSGKTLTIQVK EFGDAGQYTCHKGGEVLSHSLLLLHKKEDGIWSTDILKDQKEPKNKTFLRCEAKNYSG RFTCWWLTTISTDLTFSVKSSRGSSDPQGVTCGAATLSAERVRGDNKEYEYSVECQE DSACPAAEESLPIEVMVDAVHKLKYENYTSSFFIRDIIKPDPPKNLQLKPLKNSRQVEVS WEYPDTWSTPHSYFSLTFCVQVQGKSKREKKDRVFTDKTSATVICRKNASISVRAQD RYYSSSWSEWASVPCS | 213295 | 213330-213338 |
| p35 | RNLPVATPDPGMFPCLHHSQNLLRAVSNMLQKARQTLEFYPCTSEEIDHEDITKDKTS TVEACLPLELTKNESCLNSRETSFITNGSCLASRKTSFMMALCLSSIYEDLKMYQVEFK TMNAKLLMDPKRQIFLDQNMLAVIDELMQALNFNSETVPQKSSLEEPDFYKTKIKLCILL HAFRIRAVTIDRVMSYLNAS | 213296 | 213339-213348 |
| FKBP (F36V, L106P) | GVQVETISPGDGRTFPKRGQTCVVHYTGMLEDGKKVDSSRDRNKPFKFMLGKQEVIR GWEEGVAQMSVGQRAKLTISPDYAYGATGHPGIIPPHATLVFDVELLKPE | 213274 | 213349-213351 |
| FKBP (E31G, F36V, R71G, K105E) | GVQVETISPGDGRTFPKRGQTCVVHYTGMLGDGKKVDSSRDRNKPFKFMLGKQEVI RGWEEGVAQMSVGQGAKLTISPDYAYGATGHPGIIPPHATLVFDVELLELE | 213297 | 213352-213354 |
| ecDHFR (R12Y, Y100I) | ISLIAALAVDYVIGMENAMPWNLPADLAWFKRNTLNKPVIMGRHTWESIGRPLPGRKNI ILSSQPGTDDRVTWVKSVDEAIAACGDVPEIMVIGGGRVIEQFLPKAQKLYLTHIDAEV EGDTHFPDYEPDDWESVFSEFHDADAQNSHSYCFEILERR | 213275 | 213355 |
| OT-IL12-001 (p40 signal sequence; FKBP (F36V, L106P); linker1 (GGSGG); p40; linker2 (G4S)3; p35) | MCHQQLVISWFSLVFLASPLVAGVQVETISPGDGRTFPKRGQTCVVHYTGMLEDGKK VDSSRDRNKPFKFMLGKQEVIRGWEEGVAQMSVGQRAKLTISPDYAYGATGHPGIIP PHATLVFDVELLKPEGGSGGIWELKKDVYVVELDWYPDAPGEMVVLTCDTPEEDGIT WTLDQSSEVLGSGKTLTIQVKEFGDAGQYTCHKGGEVLSHSLLLLHKKEDGIWSTDIL KDQKEPKNKTFLRCEAKNYSGRFTCWWLTTISTDLTFSVKSSRGSSDPQGVTCGAAT LSAERVRGDNKEYEYSVECQEDSACPAAEESLPIEVMVDAVHKLKYENYTSSFFIRDII KPDPPKNLQLKPLKNSRQVEVSWEYPDTWSTPHSYFSLTFCVQVQGKSKREKKDRV FTDKTSATVICRKNASISVRAQDRYYSSSWSEWASVPCSGGGGSGGGGSGGGGSR NLPVATPDPGMFPCLHHSQNLLRAVSNMLQKARQTLEFYPCTSEEIDHEDITKDKTST VEACLPLELTKNESCLNSRETSFITNGSCLASRKTSFMMALCLSSIYEDLKMYQVEFKT MNAKLLMDPKRQIFLDQNMLAVIDELMQALNFNSETVPQKSSLEEPDFYKTKIKLCILLH AFR RAVTIDRVMSYLNAS | 213299 | 213356 |
| OT-IL12-002 (FKBP (F36V, L106P); linker1 (GGSGG); p40 signal sequence; p40; linker 2 ((G4S)3); p35) | MGVQVETISPGDGRTFPKRGQTCVVHYTGMLEDGKKVDSSRDRNKPFKFMLGKQEV IRGWEEGVAQMSVGQRAKLTISPDYAYGATGHPGIIPPHATLVFDVELLKPEGGSGGM CHQQLVISWFSLVFLASPLVAIWELKKDVYVVELDWYPDAPGEMVVLTCDTPEEDGIT WTLDQSSEVLGSGKTLTIQVKEFGDAGQYTCHKGGEVLSHSLLLLHKKEDGIWSTDIL KDQKEPKNKTFLRCEAKNYSGRFTCWWLTTISTDLTFSVKSSRGSSDPQGVTCGAAT LSAERVRGDNKEYEYSVECQEDSACPAAEESLPIEVMVDAVHKLKYENYTSSFFIRDII KPDPPKNLQLKPLKNSRQVEVSWEYPDTWSTPHSYFSLTFCVQVQGKSKREKKDRV FTDKTSATVICRKNASISVRAQDRYYSSSWSEWASVPCSGGGGSGGGGSGGGGSR NLPVATPDPGMFPCLHHSQNLLRAVSNMLQKARQTLEFYPCTSEEIDHEDITKDKTST VEACLPLELTKNESCLNSRETSFITNGSCLASRKTSFMMALCLSSIYEDLKMYQVEFKT MNAKLLMDPKRQIFLDQNMLAVIDELMQALNFNSETVPQKSSLEEPDFYKTKIKLCILLH AFR RAVTIDRVMSYLNAS | 213300 | 213357 |
| OT-IL12-003 (p40 signal sequence; FKBP (F36V, L106P); furin (SARNRQKRS); p40; linker ((G4S)3); p35) | MCHQQLVISWFSLVFLASPLVAGVQVETISPGDGRTFPKRGQTCVVHYTGMLEDGKK VDSSRDRNKPFKFMLGKQEVIRGWEEGVAQMSVGQRAKLTISPDYAYGATGHPGIIP PHATLVFDVELLKPESARNRQKRSIWELKKDVYVVELDWYPDAPGEMVVLTCDTPEE DGITWTLDQSSEVLGSGKTLTIQVKEFGDAGQYTCHKGGEVLSHSLLLLHKKEDGIWS TDILKDQKEPKNKTFLRCEAKNYSGRFTCWWLTTISTDLTFSVKSSRGSSDPQGVTCG AATLSAERVRGDNKEYEYSVECQEDSACPAAEESLPIEVMVDAVHKLKYENYTSSFFI RDIIKPDPPKNLQLKPLKNSRQVEVSWEYPDTWSTPHSYFSLTFCVQVQGKSKREKK DRVFTDKTSATVICRKNASISVRAQDRYYSSSWSEWASVPCSGGGGSGGGGSGGG GSRNLPVATPDPGMFPCLHHSQNLLRAVSNMLQKARQTLEFYPCTSEEIDHEDITKDK TSTVEACLPLELTKNESCLNSRETSFITNGSCLASRKTSFMMALCLSSIYEDLKMYQVE FKTMNAKLLMDPKRQIFLDQNMLAVIDELMQALNFNSETVPQKSSLEEPDFYKTKIKLC ILLHAFRIRAVTIDRVMSYLNAS | 213301 | 213358 |
| OT-IL12-004 (p40 signal sequence; p40;l inker ((G4S)3); p35; furin (SARNRQKRS); FKBP (E31G, F36V, R71G, K105E)) | MCHQQLVISWFSLVFLASPLVAIWELKKDVYVVELDWYPDAPGEMVVLTCDTPEEDGI TWTLDQSSEVLGSGKTLTIQVKEFGDAGQYTCHKGGEVLSHSLLLLHKKEDGIWSTD ILKDQKEPKNKTFLRCEAKNYSGRFTCWWLTTISTDLTFSVKSSRGSSDPQGVTCGAA TLSAERVRGDNKEYEYSVECQEDSACPAAEESLPIEVMVDAVHKLKYENYTSSFFIRDI IKPDPPKNLQLKPLKNSRQVEVSWEYPDTWSTPHSYFSLTFCVQVQGKSKREKKDRV FTDKTSATVICRKNASISVRAQDRYYSSSWSEWASVPCSGGGGSGGGGSGGGGSR NLPVATPDPGMFPCLHHSQNLLRAVSNMLQKARQTLEFYPCTSEEIDHEDITKDKTST VEACLPLELTKNESCLNSRETSFITNGSCLASRKTSFMMALCLSSIYEDLKMYQVEFKT | 213302 | 213359 |

TABLE 18-continued

DD-IL12 constructs

| Description/ Construct ID | Amino Acid Sequence | Amino Acid SEQ ID NO | Nucleic Acid SEQ ID NO |
|---|---|---|---|
| | MNAKLLMDPKRQIFLDQNMLAVIDELMQALNFNSETVPQKSSLEEPDFYKTKIKLCILLH AFR RAVTIDRVMSYLNASARNRQKRSGVQVETISPGDGRTFPKRGQTCVVHYTGML GDGKKVDSSRDRNKPFKFMLGKQEVIRGWEEGVAQMSVGQGAKLTISPDYAYGATG HPGIIPPHATLVFDVELLELE | | |
| OT-IL12-005 (p40 signal sequence; p40; linker 1 ((G45)3); p35; linker 2(GGSG); FKBP (E31G, F36V, R71G, K105E)) | MCHQQLVISWFSLVFLASPLVAIWELKKDVYVVELDWYPDAPGEMVVLTCDTPEEDGI TWTLDQSSEVLGSGKTLTIQVKEFGDAGQYTCHKGGEVLSHSLLLLHKKEDGIWSTDI LKDQKEPKNKTFLRCEAKNYSGRFTCWWLTTISTDLTFSVKSSRGSSDPQGVTCGAA TLSAERVRGDNKEYEYSVECQEDSACPAAEESLPIEVMVDAVHKLKYENYTSSFFIRDI IKPDPPKNLQLKPLKNSRQVEVSWEYPDTWSTPHSYFSLTFCVQVQGKSKREKKDRV FTDKTSATVICRKNASISVRAQDRYYSSSWSEWASVPCSGGGGSGGGGSGGGGSR NLPVATPDPGMFPCLHHSQNLLRAVSNMLQKARQTLEFYPCTSEEIDHEDITKDKTST VEACLPLELTKNESCLNSRETSFITNGSCLASRKTSFMMALCLSSIYEDLKMYQVEFKT MNAKLLMDPKRQIFLDQNMLAVIDELMQALNFNSETVPQKSSLEEPDFYKTKIKLCILLH AFR RAVTIDRVMSYLNASGGSGGVQVETISPGDGRTFPKRGQTCVVHYTGMLGDGK KVDSSRDRNKPFKFMLGKQEVIRGWEEGVAQMSVGQGAKLTISPDYAYGATGHPGII PPHATLVFDVELLELE | 213303 | 213360 |
| OT-IL12-006 (p40 signal sequence; p40; linker((G45)3); p35) | MCHQQLVISWFSLVFLASPLVAIWELKKDVYVVELDWYPDAPGEMVVLTCDTPEEDGI TWTLDQSSEVLGSGKTLTIQVKEFGDAGQYTCHKGGEVLSHSLLLLHKKEDGIWSTDI LKDQKEPKNKTFLRCEAKNYSGRFTCWWLTTISTDLTFSVKSSRGSSDPQGVTCGAA TLSAERVRGDNKEYEYSVECQEDSACPAAEESLPIEVMVDAVHKLKYENYTSSFFIRDI IKPDPPKNLQLKPLKNSRQVEVSWEYPDTWSTPHSYFSLTFCVQVQGKSKREKKDRV FTDKTSATVICRKNASISVRAQDRYYSSSWSEWASVPCSGGGGSGGGGSGGGGSR NLPVATPDPGMFPCLHHSQNLLRAVSNMLQKARQTLEFYPCTSEEIDHEDITKDKTST VEACLPLELTKNESCLNSRETSFITNGSCLASRKTSFMMALCLSSIYEDLKMYQVEFKT MNAKLLMDPKRQIFLDQNMLAVIDELMQALNFNSETVPQKSSLEEPDFYKTKIKLCILLH AFR RAVTIDRVMSYLNAS | 213304 | 213361 |
| OT-IL12-007 (p40 signal sequence; ecDHFR (R12Y, Y100I); furin site (ESRRVRRN KRSK); p40; linker((G45)3); p35) | MCHQQLVISWFSLVFLASPLVAISLIAALAVDYVIGMENAMPWNLPADLAWFKRNTLNK PVIMGRHTWESIGRPLPGRKNIILSSQPGTDDRVTWVKSVDEAIAACGDVPEIMVIGGG RVIEQFLPKAQKLYLTHIDAEVEGDTHFPDYEPDDWESVFSEFHDADAQNSHSYCFEI LERRESRRVRRNKRSKIWELKKDVYVVELDWYPDAPGEMVVLTCDTPEEDGITWTLD QSSEVLGSGKTLTIQVKEFGDAGQYTCHKGGEVLSHSLLLLHKKEDGIWSTDILKDQK EPKNKTFLRCEAKNYSGRFTCWWLTTISTDLTFSVKSSRGSSDPQGVTCGAATLSAE RVRGDNKEYEYSVECQEDSACPAAEESLPIEVMVDAVHKLKYENYTSSFFIRDIIKPDP PKNLQLKPLKNSRQVEVSWEYPDTWSTPHSYFSLTFCVQVQGKSKREKKDRVFTDKT SATVICRKNASISVRAQDRYYSSSWSEWASVPCSGGGGSGGGGSGGGGSRNLPVA TPDPGMFPCLHHSQNLLRAVSNMLQKARQTLEFYPCTSEEIDHEDITKDKTSTVEACL PLELTKNESCLNSRETSFITNGSCLASRKTSFMMALCLSSIYEDLKMYQVEFKTMNAKL LMDPKRQIFLDQNMLAVIDELMQALNFNSETVPQKSSLEEPDFYKTKIKLCILLHAFRIR AVTIDRVMSYLNAS | 213305 | 213362 |
| OT-IL12-009 (p40 signal sequence; p40; linker((G4S)3); p35; furin (ESRRVRRNKRSK); FKBP (E31G, F36V, R71G, K105E)) | MCHQQLVISWFSLVFLASPLVAIWELKKDVYVVELDWYPDAPGEMVVLTCDTPEEDGI TWTLDQSSEVLGSGKTLTIQVKEFGDAGQYTCHKGGEVLSHSLLLLHKKEDGIWSTDI LKDQKEPKNKTFLRCEAKNYSGRFTCWWLTTISTDLTFSVKSSRGSSDPQGVTCGAA TLSAERVRGDNKEYEYSVECQEDSACPAAEESLPIEVMVDAVHKLKYENYTSSFFIRDI IKPDPPKNLQLKPLKNSRQVEVSWEYPDTWSTPHSYFSLTFCVQVQGKSKREKKDRV FTDKTSATVICRKNASISVRAQDRYYSSSWSEWASVPCSGGGGSGGGGSGGGGSR NLPVATPDPGMFPCLHHSQNLLRAVSNMLQKARQTLEFYPCTSEEIDHEDITKDKTST VEACLPLELTKNESCLNSRETSFITNGSCLASRKTSFMMALCLSSIYEDLKMYQVEFKT MNAKLLMDPKRQIFLDQNMLAVIDELMQALNFNSETVPQKSSLEEPDFYKTKIKLCILLH AFR RAVTIDRVMSYLNASESRRVRRNKRSKGVQVETISPGDGRTFPKRGQTCVVHYT GMLGDGKKVDSSRDRNKPFKFMLGKQEVIRGWEEGVAQMSVGQGAKLTISPDYAYG ATGHPGIIPPHATLVFDVELLELE | 213306 | 213363 |

In some embodiments, effector modules may encode, or be tuned or induced to produce, one or more cytokines for expansion of cells in the biocircuits of the invention. In such cases the cells may be tested for actual expansion. Expansion may be at least 5%, 10%, 20%, 30%, 40%, 50%, 60%, 70%, 80%, 90% or more. In some embodiments, the cytokine is IL-15. Effector modules encoding IL-15 may be designed to induce proliferation in cytotoxic populations and avoid stimulation of T regs. In other cases, the effector modules which induce proliferation in cytotoxic populations may also stimulate NK and NKT cells. Interleukin 15 is a potent immune stimulatory cytokine and an essential survival factor for T cells, and Natural Killer cells. Preclinical studies comparing IL2 and IL15, have shown than IL15 is associated with less toxicity than IL-2. In some embodiments, the effector module of the invention may be a DD-IL15 fusion polypeptide. IL15 polypeptide may also be modified to increase its binding affinity for the IL15 receptor. For example, the asparagine may be replaced by aspartic acid at position 72 of IL15 (SEQ ID NO. 2 of US patent publication US20140134128; the contents of which are incorporated by reference in their entirety). In some aspects, the DD-IL15 comprises the amino acid sequences listed in Table 19. In Table 19, the mutations in the sequences are in bold.

TABLE 19

DD IL15 constructs

| Description | Amino acid sequence | Amino Acid SEQ ID NO | Nucleic Acid SEQ ID NO |
|---|---|---|---|
| IL2 signal sequence | MYRMQLLSCIALSLALVTNS | 213271 | 213279-213280, 213392-213393 |
| Linker | EFSTEF | 213272 | 213281, 213394 |
| Linker | GGSGG | 213290 | 213316-213317, 213395-213397 |
| IL15 | NWVNVISDLKKIEDLIQSMHIDATLYTESDVHPSCKVTAMKCFL LELQVISLESGDASIHDTVENLIILANNSLSSNGNVTESGCKEC EELEEKNIKEFLQSFVHIVQMFINTS | 213389 | 213398-213401 |
| ecDHFR (R12Y, Y100I) | ISLIAALAVDYVIGMENAMPWNLPADLAWFKRNTLNKPVIMGR HTWESIGRPLPGRKNIILSSQPGTDDRVTWVKSVDEAIAACGD VPEIMVIGGGRVIEQFLPKAQKLYLTHIDAEVEGDTHFPDYEPD DWESVFSEFHDADAQNSHSYCFEILERR | 213275 | 213402 |
| OT-IL15-001 (IL2 signal sequence; IL15) | MYRMQLLSCIALSLALVTNSNWVNVISDLKKIEDLIQSMHIDAT LYTESDVHPSCKVTAMKCFLLELQVISLESGDASIHDTVENLIIL ANNSLSSNGNVTESGCKECEELEEKNIKEFLQSFVHIVQMFIN TS | 213390 | 213403 |
| OT-IL15-002 (IL2 signal sequence; linked [EFSTEF]; ecDHFR (R12Y, Y100I); linker2 [GGSGG]; IL15) | MYRMQLLSCIALSLALVTNSEFSTEFISLIAALAVDYVIGMENA MPWNLPADLAWFKRNTLNKPVIMGRHTWESIGRPLPGRKNIIL SSQPGTDDRVTWVKSVDEAIAACGDVPEIMVIGGGRVIEQFLP KAQKLYLTHIDAEVEGDTHFPDYEPDDWESVFSEFHDADAQN SHSYCFEILERRGGSGGNWVNVISDLKKIEDLIQSMHIDATLYT ESDVHPSCKVTAMKCFLLELQVISLESGDASIHDTVENLIILAN NSLSSNGNVTESGCKECEELEEKNIKEFLQSFVHIVQMFINTS | 213391 | 213404 |

In some embodiments, the effector modules of the present invention used for the expansion of cells may include a payload comprising any of the genes of the Ras superfamily including, but not limited to, RAS such as KRAS, NRAS, RRAS, RRAS2, MRAS, ERAS, and HRAS, DIRAS such as DIRAS1, DIRAS2, and DIRAS3, NKIRAS such as NKIRAS1, and NKIRAS2, RAL such as RALA, and RALB, RAP such as RAP1A, RAP1B, RAP2A, RAP2B, and RAP2C, RASD such as RASD1, and RASD2, RASL such as RASL10A, RASL10B, RASL11A, RASL11B, and RASL12, REM such as REM1, and REM2, GEM, RERG, RERGL and RRAD.

In some embodiments, the tumor microenvironment may be remodeled using a biocircuit containing an effector module encoding IL-17.

The immune system can be harnessed for the treatment of diseases beyond cancer. Biocircuits, their components, SREs or effector modules may be utilized in immunotherapy for the treatment of diseases including, but not limited to, autoimmune diseases, allergies, graft versus host disease, and diseases and disorders that may result in immunodeficiency such as acquired immune deficiency syndrome (AIDS).

In some embodiments, payloads of the present invention may be a chimeric antigen receptor (CAR), which when transduced into immune cells (e.g., T cells and NK cells), can re-direct the immune cells against the target (e.g., a tumor cell) which expresses a molecule recognized by the extracellular target moiety of the CAR.

As used herein, the term "chimeric antigen receptor (CAR)" refers to a synthetic receptor that mimics the TCR on the surface of T cells. In general, a CAR is composed of an extracellular targeting domain, a transmembrane domain/region and an intracellular signaling/activation domain. In a standard CAR receptor, the components: the extracellular targeting domain, transmembrane domain and intracellular signaling/activation domain, are linearly constructed as a single fusion protein. The extracellular region comprises a targeting domain/moiety (e.g., a scFv) that recognizes a specific tumor antigen or other tumor cell-surface molecules. The intracellular region may contain a signaling domain of TCR complex (e.g., the signal region of CD3), and/or one or more costimulatory signaling domains, such as those from CD28, 4-1BB (CD137) and OX-40 (CD134). For example, a "first-generation CAR" only has the CD3 signaling domain, whereas, a second-generation CARs has a CD3ζ signal domain plus one costimulatory signaling domain, and a third-generation CARs having CD3 signal domain plus two or more costimulatory signaling domains. A CAR, when expressed by a T cell, endows the T cell with antigen specificity determined by the extracellular targeting moiety of the CAR. It is also desirable to add one or more elements such as homing and suicide genes to develop a more competent and safer architecture of CAR, which has given rise to the so called the fourth-generation CAR.

In some embodiments, the extracellular targeting domain is joined through the hinge (also called space domain or spacer) and transmembrane regions to an intracellular signaling domain. The hinge may need to be varied to optimize the potency of CAR expressing cells towards the cancer cells due to the size of the target protein where the targeting moiety binds, and the size and affinity of the targeting domain itself. Upon recognition and binding of the targeting moiety to the target cell, the intracellular signaling domain leads to an activation signal for the CART cell, which is further amplified by the "second signal" from one or more intracellular costimulatory domains. The CAR T cell, once activated, can destroy the target cell.

In some embodiments, the CAR of the present invention may be split into two parts, each part is linked a dimerizing domain, such that an input that triggers the dimerization promotes assembly of the intact functional receptor. Wu and Lim recently reported a split CAR in which the extracellular CD19 binding domain and the intracellular signaling element are separated and linked to the FKBP domain and the FRB* (T2089L mutant of FKBP-rapamycin binding) domain that heterodimerize in the presence of the rapamycin analog AP21967. The split receptor is assembled in the presence of AP21967 and together with the specific antigen binding, activates T cells (Wu et al., *Science*, 2015, 625 (6258): aab4077).

In some embodiments, the CAR of the present invention may be designed as an inducible CAR. Sakemura et al recently reported the incorporation of a Tet-On inducible system to the CD19 CAR construct. The CD19 CAR is activated only in the presence of doxycycline (Dox). Sakemura reported that Tet-CD19CAR T cells in the presence of Dox were cytotoxic against CD19+ cell lines and had equivalent cytokine production and proliferation upon CD19 stimulation, compared with conventional CD19CAR T cells (Sakemura et al., Cancer Immuno. Res., 2016 Jun. 21, Epub ahead of print). In one example, this Tet-CAR may be the payload of the effector module under the control of SREs (e.g., DDs) of the invention. The dual systems provide more flexibility to turn-on and off the CAR expression in transduced T cells.

According to the present invention, the payload of the present invention may be a first-generation CAR, or a second-generation CAR, or a third-generation CAR, or a fourth-generation CAR. Representative effector module embodiments comprising CAR constructs are illustrated in FIG. 13-18.

In accordance with the invention, the extracellular target moiety of a CAR may be any agent that recognizes and binds to a given target molecule, for example, a neoantigen on tumor cells, with high specificity and affinity. The target moiety may be an antibody and variants thereof that specifically bind to a target molecule on tumor cells, or a peptide aptamer selected from a random sequence pool based on its ability to bind to the target molecule on tumor cells, or a variant or fragment thereof that can bind to the target molecule on tumor cells, or an antigen recognition domain from native T-cell receptor (TCR) (e.g. CD4 extracellular domain to recognize HIV infected cells), or exotic recognition components such as a linked cytokine that leads to recognition of target cells bearing the cytokine receptor, or a natural ligand of a receptor.

In some embodiments, the targeting domain of a CAR may be a Ig NAR, a Fab fragment, a Fab' fragment, a F(ab)'2 fragment, a F(ab)'3 fragment, Fv, a single chain variable fragment (scFv), a bis-scFv, a (scFv)2, a minibody, a diabody, a triabody, a tetrabody, a disulfide stabilized Fv protein (dsFv), a unitbody, a nanobody, or an antigen binding region derived from an antibody that specifically recognizes a target molecule, for example a tumor specific antigen (TSA). In one embodiment, the targeting moiety is a scFv antibody. The scFv domain, when it is expressed on the surface of a CART cell and subsequently binds to a target protein on a cancer cell, is able to maintain the CART cell in proximity to the cancer cell and to trigger the activation of the T cell. A scFv can be generated using routine recombinant DNA technology techniques and is discussed in the present invention.

In some embodiments, the targeting moiety of a CAR construct may be a natural ligand of the target molecule, or a variant and/or fragment thereof capable of binding the target molecule. In some aspects, the targeting moiety of a CAR may be a receptor of the target molecule, for example, a full length human CD27, as a CD70 receptor, may be fused in frame to the signaling domain of CD3ζ forming a CD27 chimeric receptor as an immunotherapeutic agent for CD70-positive malignancies (see, e.g., US patent publication NO.: US20130323214; the contents of which are incorporated by reference herein in their entirety)

In some embodiments, the targeting moiety of a CAR may recognize a tumor specific antigen (TSA), for example a cancer neoantigen whose expression is restricted to tumor cells.

As non-limiting examples, the CAR of the present invention may comprise the extracellular targeting domain capable of binding to a tumor specific antigen selected from 5T4, 707-AP, A33, AFP (α-fetoprotein), AKAP-4 (A kinase anchor protein 4), ALK, α5β1-integrin, androgen receptor, annexin II, alpha-actinin-4, ART-4, B1, B7H3, B7H4, BAGE (B melanoma antigen), BCMA, BCR-ABL fusion protein, beta-catenin, BKT-antigen, BTAA, CA-I (carbonic anhydrase I), CA50 (cancer antigen 50), CA125, CA15-3, CA195, CA242, calretinin, CAIX (carbonic anhydrase), CAMEL (cytotoxic T-lymphocyte recognized antigen on melanoma), CAM43, CAP-1, Caspase-8/m, CD4, CD5, CD7, CD19, CD20, CD22, CD23, CD25, CD27/m, CD28, CD30, CD33, CD34, CD36, CD38, CD40/CD154, CD41, CD44v6, CD44v7/8, CD45, CD49f, CD56, CD68\KP1, CD74, CD79a/CD79b, CD103, CD123, CD133, CD138, CD171, cdc27/m, CDK4 (cyclin dependent kinase 4), CDKN2A, CDS, CEA (carcinoembryonic antigen), CEACAM5, CEACAM6, chromogranin, c-Met, c-Myc, coa-1, CSAp, CT7, CT10, cyclophilin B, cyclin B1, cytoplasmic tyrosine kinases, cytokeratin, DAM-10, DAM-6, dek-can fusion protein, desmin, DEPDC1 (DEP domain containing 1), E2A-PRL, EBNA, EGF-R (epidermal growth factor receptor), EGP-1 (epithelial glycoprotein-1) (TROP-2), EGP-2, EGP-40, EGFR (epidermal growth factor receptor), EGFRvIII, EF-2, ELF2M, EMMPRIN, EpCAM (epithelial cell adhesion molecule), EphA2, Epstein Barr virus antigens, Erb (ErbB1; ErbB3; ErbB4), ETA (epithelial tumor antigen), ETV6-AML1 fusion protein, FAP (fibroblast activation protein), FBP (folate-binding protein), FGF-5, folate receptor a, FOS related antigen 1, fucosyl GM1, G250, GAGE (GAGE-1; GAGE-2), galactin, GD2 (ganglioside), GD3, GFAP (glial fibrillary acidic protein), GM2 (oncofetal antigen-immunogenic-1; OFA-I-1), GnT-V, Gp100, H4-RET, HAGE (helicase antigen), HER-2/neu, HIFs (hypoxia inducible factors), HIF-1α, HIF-2α, HLA-A2, HLA-A*0201-R170I, HLA-AII, HMWMAA, Hom/Mel-40, HSP70-2M (Heat shock protien 70), HST-2, HTgp-175, hTERT (or hTRT), human papillomavirus-E6/human papillomavirus-E7 and E6, ICE (immune-capture EIA), IGF-1R, IGH-IGK, IL-2R, IL-5, ILK (integrin-linked kinase), IMP3 (insulin-like growth factor II mRNA-binding protein 3), IRF4 (interferon regulatory factor 4), KDR (kinase insert domain receptor), KIAA0205, KRAB-zinc finger protein (KID)-3; KID31, KSA (17-1A), K-ras, LAGE, LCK, LDLR/FUT (LDLR-fucosyltransferaseAS fusion protein), LeY (Lewis Y), MAD-CT-1, MAGE (tyrosinase, melanoma-associated antigen) (MAGE-1; MAGE-3), melan-A tumor antigen (MART), MART-2/Ski, MC1R (melanocortin 1 receptor), MDM2, mesothelin, MPHOSPH1, MSA (muscle-specific actin), mTOR (mammalian targets of rapamycin), MUC-1, MUC-2, MUM-1 (melanoma associated antigen (mutated) 1), MUM-2, MUM-3, Myosin/m, MYL-RAR, NA88-A, N-acetylglucosaminyltransferase, neo-PAP, NF-KB (nuclear factor-kappa B), neurofilament, NSE (neuron-specific enolase), Notch receptors, NuMa, N-Ras, NY-BR-1, NY-CO-1, NY-ESO-1, Oncostatin M, OS-9, OY-TES1, p53 mutants, p190 minor bcr-abl, pl5(58), p185erbB2, p180erbB-3, PAGE (prostate associated gene), PAP (prostatic acid phosphatase), PAX3, PAX5, PDGFR (platelet derived growth factor receptor), cytochrome P450 involved in piperidine and pyrrolidine utilization (PIPA), Pmt-RAR alpha fusion protein, PR-3 (proteinase 3), PSA (prostate specific antigen), PSM, PSMA (Prostate stem cell antigen), PRAME (preferentially expressed antigen of melanoma), PTPRK, RAGE (renal tumor antigen), Raf (A-Raf, B-Raf and C-Raf), Ras, receptor tyrosine kinases, RCAS1, RGSS, ROR1 (receptor tyrosine kinase-like orphan receptor 1), RU1, RU2, SAGE, SART-1, SART-3, SCP-1, SDCCAG16, SP-17 (sperm protein 17), src-family, SSX (synovial sarcoma X breakpoint)-1, SSX-2(HOM-MEL-40), SSX-3, SSX-4, SSX-5, STAT-3, STAT-5, STAT-6, STEAD, STn, survivin, syk-ZAP70, TA-90 (Mac-2 binding protein/cyclophilin C-associated protein), TAAL6, TACSTD1 (tumor associated calcium signal transducer 1), TACSTD2, TAG-72-4, TAGE, TARP (T cell receptor gamma alternate reading frame protein), TEL/AML1 fusion protein, TEM1, TEM8 (endosialin or CD248), TGFβ, TIE2, TLP, TMPRSS2 ETS fusion gene, TNF-receptor (TNF-α receptor, TNF-β receptor; or TNF-γ receptor), transferrin receptor, TPS, TRP-1 (tyrosine related protein 1), TRP-2, TRP-2/INT2, TSP-180, VEGF receptor, WNT, WT-1 (Wilm's tumor antigen) and XAGE.

As non-limiting examples, the targeting moiety of the present invention may be a scFv antibody that recognizes a tumor specific antigen (TSA), for example scFvs of antibodies SS, SS1 and HN1 that specifically recognize and bind to human mesothelin (U.S. Pat. No. 9,359,447), scFv of antibody of GD2 (U.S. Pat. No. 9,315,585), a CD19 antigen binding domain (U.S. Pat. No. 9,328,156); a NKG2D ligand binding domain (U.S. Pat. No. 9,273,283; US patent publication NO.: US20160311906A1); human anti-mesothelin scFvs comprising the amino acid sequences of SEQ ID NO.: 11 and 12 of U.S. Pat. No. 9,272,002; an anti-CS1 binding agent (US patent publication NO.: US20160075784); an anti-BCMA binding domain (International Patent Publication NO.: WO2016/014565); anti-CD19 scFv antibody of SEQ ID NO.: 20 in U.S. Pat. No. 9,102,761; GFR alpha 4 antigen binding fragments having the amino acid sequences of SEQ ID NOs.: 59 and 79 of International patent publication NO.: 2016/025880; anti-CLL-1 (C-type lectin-like molecule 1) binding domains having the amino acid sequences of SEQ ID NO.:47, 44, 48, 49, 50, 39, 40, 41, 42, 43, 45, 46, 51, 73, 70, 74, 75, 76, 65, 66, 67, 68, 69, 71, 72, 77, 195, 86, 83, 87, 88, 89, 78, 79, 80, 81, 82, 84, 85, 90 and 196 of International Patent Publication NO.: WO2016014535); CD33 binding domains having the amino acid sequences of SEQ ID NOs.: 39-46 of International patent publication NO.: WO2016014576; a GPC3 (glypican-3) binding domain (SEQ ID NO.: 2 and SEQ ID NO.: 4 of International patent publication NO.: WO2016036973); a GFR alpha4 (Glycosylphosphatidylinositol (GPI)-linked GDNF family α-receptor 4 cell-surface receptor) binding domain (International Patent Publication NO.: WO2016025880); CD123 binding domains having the amino acid sequences of SEQ ID NOs.: 480, 483, 485, 478, 158, 159, 160, 157, 217, 218, 219, 216, 276, 277, 278, and 275 of International patent publication NO.: WO20160258896; an anti-ROR1 antibody or fragments thereof (International patent publication NO.: WO2016016344); scFvs specific to GPC-3 (SEQ ID NOs.: 1 and 24 of International patent publication NO.: WO2016049459); scFv for CSPG4 (SEQ ID NO.: 2 of International patent publication NO.: WO2015080981; scFv for folate receptor alpha (US Patent Publication NO.: US20170002072A1); the contents of each of which are incorporated herein by reference in their entirety.

The intracellular domain of a CAR fusion polypeptide, after binding to its target molecule, transmits a signal to the immune effector cell, activating at least one of the normal effector functions of immune effector cells, including cytolytic activity (e.g., cytokine secretion) or helper activity. Therefore, the intracellular domain comprises an "Intracellular signaling domain" of a T cell receptor (TCR). In some embodiments, the intracellular signaling domain of the present invention may contain signaling motifs which are known as immunoreceptor tyrosine-based activation motifs (ITAMs). In some embodiments, the intracellular region of the present invention further comprises one or more costimulatory signaling domains which provide additional signals to the immune effector cells. These costimulatory signaling domains, in combination with the signaling domain can further improve expansion, activation, memory, persistence, and tumor-eradicating efficiency of CAR engineered immune cells (e.g., CART cells). In some cases, the costimulatory signaling region contains 1, 2, 3, or 4 cytoplasmic domains of one or more intracellular signaling and/or costimulatory molecules. In some embodiments, the intracellular region of the present invention may comprise a functional signaling domain from a protein selected from the group consisting of an MHC class I molecule, a TNF receptor protein, an immunoglobulin-like protein, a cytokine receptor, an integrin, a signaling lymphocytic activation protein (SLAM) such as CD48, CD229, 2B4, CD84, NTB-A, CRACC, BLAME, CD2F-10, SLAMF6, SLAMF7, an activating NK cell receptor, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), SLAMF7, NKp80 (KLRF1), NKp44, NKp30, NKp46, CD19, CD4, CD8alpha, CD8beta, IL2R beta, IL2R gamma, IL7R alpha, IL-15Ra, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, NKD2C SLP76, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, CD270 (HVEM), GADS, SLP-76, PAG/Cbp, CD19a, a ligand that specifically binds with CD83, DAP 10, TRIM, ZAP70, Killer immunoglobulin receptors (KIRs) such as KIR2DL1, KIR2DL2/L3, KIR2DL4, KIR2DL5A, KIR2DL5B, KIR2DS1, KIR2DS2, KIR2DS3, KIR2DS4, KIR2DS5, KIR3DL1/S1, KIR3DL2, KIR3DL3, and KIR2DP1; lectin related NK cell receptors such as Ly49, Ly49A, and Ly49C.

In some embodiments, the CAR of the present invention may comprise a transmembrane domain. As used herein, the term "Transmembrane domain (TM)" refers broadly to an amino acid sequence of about 15 residues in length which spans the plasma membrane. More preferably, a transmembrane domain includes at least 20, 21, 22, 23, 24, 25, 26, 27, 28, 29, 30, 31, 32, 33, 34, 35, 36, 37, 38, 39, 40, 41, 42, 43, 44, or 45 amino acid residues and spans the plasma membrane. In some embodiments, the transmembrane domain of the present invention may be derived either from a natural or from a synthetic source. The transmembrane domain of a CAR may be derived from any naturally membrane-bound or transmembrane protein. In some embodiments, the transmembrane domain of the present invention may be selected from the group consisting of a CD8a transmembrane domain, a CD4 transmembrane domain, a CD 28 transmembrane domain, a CTLA-4 transmembrane domain, a PD-1 transmembrane domain, and a human IgG4 Fc region.

In some embodiments, the CAR of the present invention may comprise an optional hinge region (also called spacer). A hinge sequence is a short sequence of amino acids that facilitates flexibility of the extracellular targeting domain that moves the target binding domain away from the effector cell surface to enable proper cell/cell contact, target binding and effector cell activation (Patel et al., Gene Therapy, 1999; 6: 412-419). The hinge sequence may be positioned between the targeting moiety and the transmembrane domain. The hinge sequence can be any suitable sequence derived or obtained from any suitable molecule. The hinge sequence may be derived from all or part of an immunoglobulin (e.g., IgGI, IgG2, IgG3, IgG4) hinge region, i.e., the sequence that falls between the CHI and CH2 domains of an immunoglobulin, e.g., an IgG4 Fc hinge, the extracellular regions of type 1 membrane proteins such as CD8a CD4, CD28 and CD7, which may be a wild type sequence or a derivative.

In some embodiments, the CAR of the present invention may comprise one or more linkers selected from Table 11 or 12.

In one embodiment of the present invention, the CAR of the present invention is a CD19 specific CAR. In the context of the invention, an effector module may comprise an ecDHFR DD or FKBP DD operably linked to a CD19 CAR fusion construct. The amino acid sequences of CD19 CAR and its components are presented in Table 20. In Table 20, the transmembrane domain is italicized and underlined to differentiate it from the adjacent sequence components. The mutations in the sequences are in bold.

TABLE 20

CD19 CAR constructs

| Description | Amino Acid Sequence | Amino Acid SEQ ID NO | Nucleic Acid SEQ ID NO |
|---|---|---|---|
| CD19 scFv | DIQMTQTTSSLSASLGDRVTISCRASQDISKYLNWYQQKPDGTVKLLIYHTSRLH SGVPSRFSGSGSGTDYSLTISNLEQEDIATYFCQQGNTLPYTFGGGTKLEITGG GGSGGGGSGGGGSEVKLQESGPGLVAPSQSLSVTCTVSGVSLPDYGVSWIRQ PPRKGLEWLGVIWGSETTYYNSALKSRLTIIKDNSKSQVFLKMNSLQTDDTAIYY CAKHYYYGGSYAMDYWGQGTSVTVSS | 213405 | 23418-213422 |
| CD8α hinge--TM | TTTPAPRPPTPAPTIASQPLSLRPEACRPAAGGAVHTRGLDFACD*IYIWAPLAGT CGVLLLSLVIT*LYC | 213406 | 213423-213428 |
| CD3 zeta signaling domain | RVKFSRSADAPAYKQGQNQLYNELNLGRREEYDVLDKRRGRDPEMGGKPRRK NPQEGLYNELQKDKMAEAYSEIGMKGERRRGKGHDGLYQGLSTATKDTYDAL HMQALPPR | 213407 | 213429-213433 |
| 4-1BB intracellular signaling domain | KRGRKKLLYIFKQPFMRPVQTTQEEDGCSCRFPEEEEGGCEL | 213408 | 213434-213438 |
| CD8α leader | MALPVTALLPLALLHAARP | 213409 | 213439-213443 |
| FKBP (F36V, L106P) | GVQVETISPGDGRTFPKRGQTCVVHYTGMLEDGKKVDSSRDRNKPFKFMLGK QEVIRGWEEGVAQMSVGQRAKLTISPDYAYGATGHPGIIPPHATLVFDVELLKP E | 213274 | 213444-213445 |
| FKBP (E31G, F36V, R71G, K105E) | GVQVETISPGDGRTFPKRGQTCVVHYTGMLGDGKKVDSSRDRNKPFKFMLGK QEVIRGWEEGVAQMSVGQGAKLTISPDYAYGATGHPGIIPPHATLVFDVELLELE | 213297 | 213446 |
| ecDHFR (R12Y, Y100I) | ISLIAALAVDYVIGMENAMPWNLPADLAWFKRNTLNKPVIMGRHTWESIGRPLP GRKNIILSSQPGTDDRVTWVKSVDEAIAACGDVPEIMVIGGGRVIEQFLPKAQKL YLTHIDAEVEGDTHFPDYEPDDWESVFSEFHDADAQNSHSYCFEILERR | 213275 | 213447-213448 |
| ecDHFR (R12H, E129K) | ISLIAALAVDHVIGMENAMPWNLPADLAWFKRNTLNKPVIMGRHTWESIGRPLP GRKNIILSSQPGTDDRVTWVKSVDEAIAACGDVPEIMVIGGGRVYEQFLPKAQKL YLTHIDAEVEGDTHFPDYKPDDWESVFSEFHDADAQNSHSYCFEILERR | 213410 | 213449 |
| Linker | GGSGG | 213290 | 213395-213396 |
| OT-CD19 CAR-001 (CD8a leader; CD19 scFV (FM63); CD8a hinge + TM; 41BB; CD3zeta) | MALPVTALLPLALLHAARPDIQMTQTTSSLSASLGDRVTISCRASQDISKYLN WYQQKPDGTVKLLIYHTSRLHSGVPSRFSGSGSGTDYSLTISNLEQEDIATYFC QQGNTLPYTFGGGTKLEITGGGGSGGGGSGGGGSEVKLQESGPGLVAPSQSL SVTCTVSGVSLPDYGVSWIRQPPRKGLEWLGVIWGSETTYYNSALKSRLTIIKD NSKSQVFLKMNSLQTDDTAIYYCAKHYYYGGSYAMDYWGQGTSVTVSSTTTPA PRPPTPAPTIASQPLSLRPEACRPAAGGAVHTRGLDFACD*IYIWAPLAGTCGVLL LSLVIT*LYCKRGRKKLLYIFKQPFMRPVQTTQEEDGCSCRFPEEEEGGCELRVK FSRSADAPAYKQGQNQLYNELNLGRREEYDVLDKRRGRDPEMGGKPRRKNP QEGLYNELQKDKMAEAYSEIGMKGERRRGKGHDGLYQGLSTATKDTYDALHM QALPPR | 213411 | 213450 |
| OT-CD19 CAR-002 (CD8a leader; CD19 scFV; FKBP | MALPVTALLPLALLHAARPDIQMTQTTSSLSASLGDRVTISCRASQDISKYLN WYQQKPDGTVKLLIYHTSRLHSGVPSRFSGSGSGTDYSLTISNLEQEDIATYFC | 213412 | 213451 |

TABLE 20-continued

CD19 CAR constructs

| Description | Amino Acid Sequence | Amino Acid SEQ ID NO | Nucleic Acid SEQ ID NO |
|---|---|---|---|
| (F36V, L106P); CD8a hinge + TM; 41BB; CD3zeta) | QQGNTLPYTFGGGTKLEITGGGGSGGGGSGGGGSEVKLQESGPGLVAPSQSL SVTCTVSGVSLPDYGVSWIRQPPRKGLEWLGVIWGSETTYYNSALKSRLTIIKD NSKSQVFLKMNSLQTDDTAIYYCAKHYYYGGSYAMDYWGQGTSVTVSSGVQV ETISPGDGRTFPKRGQTCVVHYTGMLEDGKKVDSSRDRNKPFKFMLGKQEVIR GWEEGVAQMSVGQRAKLTISPDYAYGATGHPGIIPPHATLVFDVELLKPETTTP APRPPTPAPTIASQPLSLRPEACRPAAGGAVHTRGLDFACD*IYIWAPLAGTCGVL LLSLVIT*LYCKRGRKKLLYIFKQPFMRPVQTTQEEDGCSCRFPEEEEGGCELRV KFSRSADAPAYKQGQNQLYNELNLGRREEYDVLDKRRGRDPEMGGKPRRKNP QEGLYNELQKDKMAEAYSEIGMKGERRRGKGHDGLYQGLSTATKDTYDALHM QALPPR | | |
| OT-CD19 CAR-003 (CD8a leader; CD19 scFV; ecDHFR (R12Y, Y100I); CD8a hinge + TM; 41BB; CD3zeta) | MALPVTALLPLALLHAARPDIQMTQTTSSLSASLGDRVTISCRASQDISKYLN WYQQKPDGTVKLLIYHTSRLHSGVPSRFSGSGSGTDYSLTISNLEQEDIATYFC QQGNTLPYTFGGGTKLEITGGGGSGGGGSGGGGSEVKLQESGPGLVAPSQSL SVTCTVSGVSLPDYGVSWIRQPPRKGLEWLGVIWGSETTYYNSALKSRLTIIKD NSKSQVFLKMNSLQTDDTAIYYCAKHYYYGGSYAMDYWGQGTSVTVSSISLIAA LAVDYVIGMENAMPWNLPADLAWFKRNTLNKPVIMGRHTWESIGRPLPGRKNII LSSQPGTDDRVTWVKSVDEAIAACGDVPEIMVIGGGRVIEQFLPKAQKLYLTHID AEVEGDTHFPDYEPDDWESVFSEFHDADAQNSHSYCFEILERRTTTPAPRPPT PAPTIASQPLSLRPEACRPAAGGAVHTRGLDFACD*IYIWAPLAGTCGVLLLSLVIT* LYCKRGRKKLLYIFKQPFMRPVQTTQEEDGCSCRFPEEEEGGCELRVKFSRSA DAPAYKQGQNQLYNELNLGRREEYDVLDKRRGRDPEMGGKPRRKNPQEGLY NELQKDKMAEAYSEIGMKGERRRGKGHDGLYQGLSTATKDTYDALHMQALPP R | 213413 | 213452 |
| OT-CD19 CAR-004 (CD8a leader; CD19 scFV; CD8a hinge FKBP (F36V, L106P) CD8a TM- CD8 hinge seq following TM; 41BB; CD3zeta) | MALPVTALLPLALLHAARPDIQMTQTTSSLSASLGDRVTISCRASQDISKYLN WYQQKPDGTVKLLIYHTSRLHSGVPSRFSGSGSGTDYSLTISNLEQEDIATYFC QQGNTLPYTFGGGTKLEITGGGGSGGGGSGGGGSEVKLQESGPGLVAPSQSL SVTCTVSGVSLPDYGVSWIRQPPRKGLEWLGVIWGSETTYYNSALKSRLTIIKD NSKSQVFLKMNSLQTDDTAIYYCAKHYYYGGSYAMDYWGQGTSVTVSSTTTPA PRPPTPAPTIASQPLSLRPEACRPAAGGAVHTRGLDFACDGVQVETISPGDGRT FPKRGQTCVVHYTGMLEDGKKVDSSRDRNKPFKFMLGKQEVIRGWEEGVAQM SVGQRAKLTISPDYAYGATGHPGIIPPHATLVFDVELLKPE*IYIWAPLAGTCGVLL LSLVIT*LYCKRGRKKLLYIFKQPFMRPVQTTQEEDGCSCRFPEEEEGGCELRVK FSRSADAPAYKQGQNQLYNELNLGRREEYDVLDKRRGRDPEMGGKPRRKNP QEGLYNELQKDKMAEAYSEIGMKGERRRGKGHDGLYQGLSTATKDTYDALHM QALPPR | 213414 | 213453 |
| OT-CD19 CAR-005 (CD8a leader; CD19 scFV; ecDHFR (R12Y, Y100I); 41BB; CD3zeta) | MALPVTALLPLALLHAARPDIQMTQTTSSLSASLGDRVTISCRASQDISKYLN WYQQKPDGTVKLLIYHTSRLHSGVPSRFSGSGSGTDYSLTISNLEQEDIATYFC QQGNTLPYTFGGGTKLEITGGGGSGGGGSGGGGSEVKLQESGPGLVAPSQSL SVTCTVSGVSLPDYGVSWIRQPPRKGLEWLGVIWGSETTYYNSALKSRLTIIKD NSKSQVFLKMNSLQTDDTAIYYCAKHYYYGGSYAMDYWGQGTSVTVSSTTTPA PRPPTPAPTIASQPLSLRPEACRPAAGGAVHTRGLDFACDISLIAALAVDYVIGM ENAMPWNLPADLAWFKRNTLNKPVIMGRHTWESIGRPLPGRKNIILSSQPGTDD RVTWVKSVDEAIAACGDVPEIMVIGGGRVIEQFLPKAQKLYLTHIDAEVEGDTHF PDYEPDDWESVFSEFHDADAQNSHSYCFEILERR*IYIWAPLAGTCGVLLLSLVIT* LYCKRGRKKLLYIFKQPFMRPVQTTQEEDGCSCRFPEEEEGGCELRVKFSRSA DAPAYKQGQNQLYNELNLGRREEYDVLDKRRGRDPEMGGKPRRKNPQEGLY NELQKDKMAEAYSEIGMKGERRRGKGHDGLYQGLSTATKDTYDALHMQALPP R | 213415 | 213454 |
| OT-CD19C CAR-006 (CD8a leader; CD19 scFV; CD8a hinge + TM; 41BB; CD3zeta; linker1 (GGSGG) ecDHFR (R12H, E129K)) | MALPVTALLPLALLHAARPDIQMTQTTSSLSASLGDRVTISCRASQDISKYLN WYQQKPDGTVKLLIYHTSRLHSGVPSRFSGSGSGTDYSLTISNLEQEDIATYFC QQGNTLPYTFGGGTKLEITGGGGSGGGGSGGGGSEVKLQESGPGLVAPSQSL SVTCTVSGVSLPDYGVSWIRQPPRKGLEWLGVIWGSETTYYNSALKSRLTIIKD NSKSQVFLKMNSLQTDDTAIYYCAKHYYYGGSYAMDYWGQGTSVTVSSTTTPA PRPPTPAPTIASQPLSLRPEACRPAAGGAVHTRGLDFACD*IYIWAPLAGTCGVLL LSLVIT*LYCKRGRKKLLYIFKQPFMRPVQTTQEEDGCSCRFPEEEEGGCELRVK FSRSADAPAYKQGQNQLYNELNLGRREEYDVLDKRRGRDPEMGGKPRRKNP QEGLYNELQKDKMAEAYSEIGMKGERRRGKGHDGLYQGLSTATKDTYDALHM QALPPRGGSGGISLIAALAVDHVIGMENAMPWNLPADLAWFKRNTLNKPVIMGR HTWESIGRPLPGRKNIILSSQPGTDDRVTWVKSVDEAIAACGDVPEIMVIGGGRV YEQFLPKAQKLYLTHIDAEVEGDTHFPDYKPDDWESVFSEFHDADAQNSHSYC FEILERR | 213416 | 213455 |
| OT-CD19C-007 (CD8a leader; CD19 scFV; CD8a hinge + TM; 41BB; CD3zeta; linker1 (GGSGG); FKBP (E31G, F36V, R71G, K105E)) | MALPVTALLPLALLHAARPDIQMTQTTSSLSASLGDRVTISCRASQDISKYLN WYQQKPDGTVKLLIYHTSRLHSGVPSRFSGSGSGTDYSLTISNLEQEDIATYFC QQGNTLPYTFGGGTKLEITGGGGSGGGGSGGGGSEVKLQESGPGLVAPSQSL SVTCTVSGVSLPDYGVSWIRQPPRKGLEWLGVIWGSETTYYNSALKSRLTIIKD NSKSQVFLKMNSLQTDDTAIYYCAKHYYYGGSYAMDYWGQGTSVTVSSTTTPA PRPPTPAPTIASQPLSLRPEACRPAAGGAVHTRGLDFACD*IYIWAPLAGTCGVLL LSLVIT*LYCKRGRKKLLYIFKQPFMRPVQTTQEEDGCSCRFPEEEEGGCELRVK | 213417 | 213456 |

TABLE 20-continued

CD19 CAR constructs

| Description | Amino Acid Sequence | Amino Acid SEQ ID NO | Nucleic Acid SEQ ID NO |
|---|---|---|---|
| | FSRSADAPAYKQGQNQLYNELNLGRREEYDVLDKRRGRDPEMGGKPRRKNP QEGLYNELQKDKMAEAYSEIGMKGERRRGKGHDGLYQGLSTATKDTYDALHM QALPPRGGSGGGVQVETISPGDGRTFPKRGQTCWHYTGMLGDGKKVDSSRD RNKPFKFMLGKQEVIRGWEEGVAQMSVGQGAKLTISPDYAYGATGHPGIIPPHA TLVFDVELLELE | | |

In one embodiment, the payload of the invention may be a TCR specific for the NY-ESO-1 and LAGE-1 cancer testis antigens (NY-ESO$^{c259}$-T) that induces robust effector and memory T cells' expansion without inducing T cell exhaustion (See Melchiori et al. (2015) Molecular Therapy. 23, Sup1, p S204-S205. (the contents of which are incorporated herein by reference in their entirety).

In some embodiments, pharmaceutical compositions, biocircuits, biocircuit components, effector modules including their SREs or payloads of the present invention may be used in the modulation or alteration or exploitation of the immune system to target one or more self-reactive immune components such as auto antibodies and self-reactive immune cells to attenuate autoimmune diseases. In some embodiments, the SREs of the present invention may be utilized in regulating or tuning the Chimeric Auto Antibody Receptor (CAAR) based T cell therapy in order to optimize its utility in the treatment of autoimmune diseases (Ellebrecht C. T. et al., Science. 2016. Jul. 8; 353(6295):179-84; the contents of which are incorporated herein by reference in their entirety). In some embodiments, biocircuits, their components, SREs or effector modules are designed to modulate Tregs to attenuate autoimmune disorders. In such a case, IL-2 may be regulated using a singly tuned module or one having multiple tuned features as described herein.

In some embodiments, biocircuits, their components, SREs or effector modules may be utilized in immunotherapy-based treatments to attenuate or mitigate Graft vs. Host disease (GVHD). GVHD refers to a condition following stem cell or bone marrow transplant where in the allogeneic donor immune cells react against host tissue. In some embodiments, biocircuits, their components, SREs or effector modules are designed to modulate Tregs for the treatment of GVHD. In one embodiment, biocircuits containing an effector module encoding TNF-alpha may be used to modulate Tregs to minimize GVHD (Pierini, A. et al., Blood. 2016. Aug. 11; 128(6):866-71; the contents of which are incorporated herein by reference in their entirety).

In some embodiments, biocircuits, their components, SREs or effector modules are designed to be significantly less immunogenic than other biocircuits or switches in the art.

As used herein, "significantly less immunogenic" refers to a detectable decrease in immunogenicity. In another embodiment, the term refers to a fold decrease in immunogenicity. In another embodiment, the term refers to a decrease such that an effective amount of the biocircuits, their components, SREs or effector modules which can be administered without triggering a detectable immune response. In another embodiment, the term refers to a decrease such that the biocircuits, their components, SREs or effector modules can be repeatedly administered without eliciting an immune response. In another embodiment, the decrease is such that the biocircuits, their components, SREs or effector modules can be repeatedly administered without eliciting an immune response.

In another embodiment, the biocircuits, their components, SREs or effector modules is 2-fold less immunogenic than its unmodified counterpart or reference compound. In another embodiment, immunogenicity is reduced by a 3-fold factor. In another embodiment, immunogenicity is reduced by a 5-fold factor. In another embodiment, immunogenicity is reduced by a 7-fold factor. In another embodiment, immunogenicity is reduced by a 10-fold factor. In another embodiment, immunogenicity is reduced by a 15-fold factor. In another embodiment, immunogenicity is reduced by a fold factor. In another embodiment, immunogenicity is reduced by a 50-fold factor. In another embodiment, immunogenicity is reduced by a 100-fold factor. In another embodiment, immunogenicity is reduced by a 200-fold factor. In another embodiment, immunogenicity is reduced by a 500-fold factor. In another embodiment, immunogenicity is reduced by a 1000-fold factor. In another embodiment, immunogenicity is reduced by a 2000-fold factor. In another embodiment, immunogenicity is reduced by another fold difference.

Methods of determining immunogenicity are well known in the art, and include, e.g. measuring secretion of cytokines (e.g. IL-12, IFNalpha, TNF-alpha, RANTES, MIP-1alpha or beta, IL-6, IFN-beta, or IL-8), measuring expression of DC activation markers (e.g. CD83, HLA-DR, CD80 and CD86), or measuring ability to act as an adjuvant for an adaptive immune response.

In one embodiment, the chimeric antigen receptor (CAR) of the present invention may be a conditionally active CAR. A wild type protein or domain thereof, such as those described herein may be used to generate a conditionally active biologic protein which are reversibly or irreversibly inactivated at the wild type normal physiological conditions as well as to such conditionally active biologic proteins and domains and uses of such conditional active biologic proteins and domains are provided. Such methods and conditionally active proteins are taught in, for example, International Publication No. WO2016033331, the contents of which are incorporated herein by reference in their entirety. As a non-limiting example, the CAR comprises at least one antigen specific targeting region evolved from a wild type protein or a domain thereof and one or more of a decrease in activity in the assay at the normal physiological condition compared to the antigen specific targeting region of the wild-type protein or a domain thereof, and an increase in activity in the assay under the aberrant condition compared to the antigen specific targeting region of the wild-type protein or a domain thereof.

Diseases and Toxins

Various infectious diseases may be treated with pharmaceutical compositions, biocircuits, biocircuit components, effector modules including their SREs or payloads of the present invention. As used herein, the term "infectious disease" refers to any disorders caused by organisms such as bacteria, viruses, fungi or parasites. As a non-limiting example, the infectious disease may be Acute bacterial rhinosinusitis, 14-day measles, Acne, Acrodermatitis chronica atrophicans (ACA)-(late skin manifestation of latent Lyme disease), Acute hemorrhagic conjunctivitis, Acute hemorrhagic cystitis, Acute rhinosinusitis, Adult T-cell Leukemia-Lymphoma (ATLL), African Sleeping Sickness, AIDS (Acquired Immunodeficiency Syndrome), Alveolar hydatid, Amebiasis, Amebic meningoencephalitis, Anaplasmosis, Anthrax, Arboviral or parainfectious, Ascariasis—(Roundworm infections), Aseptic meningitis, Athlete's foot (Tinea pedis), Australian tick typhus, Avian Influenza, Babesiosis, Bacillary angiomatosis, Bacterial meningitis, Bacterial vaginosis, Balanitis, Balantidiasis, Bang's disease, Barmah Forest virus infection, Bartonellosis (Verruga peruana; Carrion's disease; Oroya fever), Bat Lyssavirus Infection, Bay sore (Chiclero's ulcer), Baylisascaris infection (Racoon roundworm infection), Beaver fever, Beef tapeworm, Bejel (endemic syphilis), Biphasic meningoencephalitis, Black Bane, Black death, Black piedra, Blackwater Fever, Blastomycosis, Blennorrhea of the newborn, Blepharitis, Boils, Bornholm disease (pleurodynia), *Borrelia miyamotoi* Disease, Botulism, Boutonneuse fever, Brazilian purpuric fever, Break Bone fever, Brill, Bronchiolitis, Bronchitis, Brucellosis (Bang's disease), Bubonic plague, Bullous impetigo, *Burkholderia mallei* (Glanders), *Burkholderia pseudomallei* (Melioidosis), Buruli ulcers (also Mycoburuli ulcers), Busse, Busse-Buschke disease (Cryptococcosis), California group encephalitis, Campylobacteriosis, Candidiasis, Canefield fever (Canicola fever; 7-day fever; Weil's disease; leptospirosis; canefield fever), Canicola fever, Capillariasis, Carate, Carbapenem-resistant Enterobacteriaceae (CRE), Carbuncle, Carrion's disease, Cat Scratch fever, Cave disease, Central Asian hemorrhagic fever, Central European tick, Cervical cancer, Chagas disease, Chancroid (Soft chancre), Chicago disease, Chickenpox (Varicella), Chiclero's ulcer, Chikungunya fever, Chlamydial infection, Cholera, Chromoblastomycosis, Ciguatera, Clap, Clonorchiasis (Liver fluke infection), *Clostridium Difficile* Infection, *Clostridium Perfringens* (Epsilon Toxin), Coccidioidomycosis fungal infection (Valley fever; desert rheumatism), Coenurosis, Colorado tick fever, Condyloma accuminata, Condyloma accuminata (Warts), Condyloma lata, Congo fever, Congo hemorrhagic fever virus, Conjunctivitis, cowpox, Crabs, Crimean, Croup, Cryptococcosis, Cryptosporidiosis (Crypto), Cutaneous Larval Migrans, Cyclosporiasis, Cystic hydatid, Cysticercosis, Cystitis, Czechoslovak tick, D68 (EV-D68), Dacryocytitis, Dandy fever, Darling's Disease, Deer fly fever, Dengue fever (1, 2, 3 and 4), Desert rheumatism, Devil's grip, Diphasic milk fever, Diphtheria, Disseminated Intravascular Coagulation, Dog tapeworm, Donovanosis, Donovanosis (Granuloma inguinale), Dracontiasis, Dracunculosis, Duke's disease, Dum Dum Disease, Durand-Nicholas-Favre disease, Dwarf tapeworm, *E. Coli* Infection (*E. coli*), Eastern equine encephalitis, Ebola Hemorrhagic Fever (Ebola virus disease EVD), Ectothrix, Ehrlichiosis (Sennetsu fever), Encephalitis, Endemic Relapsing fever, Endemic syphilis, Endophthalmitis, Endothrix, Enterobiasis (Pinworm infection), Enterotoxin—B Poisoning (Staph Food Poisoning), Enterovirus Infection, Epidemic Keratoconjunctivitis, Epidemic Relapsing fever, Epidemic typhus, Epiglottitis, Erysipells, Erysipeloid (Erysipelothricosis), Erythema chronicum migrans, Erythema infectiosum, Erythema marginatum, Erythema multiforme, Erythema nodosum, Erythema nodosum leprosum, Erythrasma, Espundia, Eumycotic mycetoma, European blastomycosis, Exanthem subitum (Sixth disease), Eyeworm, Far Eastern tick, Fascioliasis, Fievre boutonneuse (Tick typhus), Fifth Disease (erythema infectiosum), Filatow-Dukes' Disease (Scalded Skin Syndrome; Ritter's Disease), Fish tapeworm, Fitz-Hugh-Curtis syndrome—Perihepatitis, Flinders Island Spotted Fever, Flu (Influenza), Folliculitis, Four Corners Disease, Four Corners Disease (Human Pulmonary Syndrome (HPS), Frambesia, Francis disease, Furunculosis, Gas gangrene, Gastroenteritis, Genital Herpes, Genital Warts, German measles, Gerstmann-Straussler-Scheinker (GSS), Giardiasis, Gilchrist's disease, Gingivitis, Gingivostomatitis, Glanders, Glandular fever (infectious mononucleosis), Gnathostomiasis, Gonococcal Infection (Gonorrhea), Gonorrhea, Granuloma inguinale (Donovanosis), Guinea Worm, *Haemophilus* Influenza disease, Hamburger disease, Hansen's disease—leprosy, Hantaan disease, Hantaan-Korean hemorrhagic fever, Hantavirus Pulmonary Syndrome, Hantavirus Pulmonary Syndrome (HPS), Hard chancre, Hard measles, Haverhill fever—Rat bite fever, Head and Body Lice, Heartland fever, Helicobacterosis, Hemolytic Uremic Syndrome (HUS), Hepatitis A, Hepatitis B, Hepatitis C, Hepatitis D, Hepatitis E, Herpangina, Herpes—genital, Herpes labialis, Herpes—neonatal, Hidradenitis, Histoplasmosis, Histoplasmosis infection (Histoplasmosis), His-Werner disease, HIV infection, Hookworm infections, Hordeola, Hordeola (Stye), HTLV, HTLV-associated myelopathy (HAM), Human granulocytic ehrlichiosis, Human monocytic ehrlichiosis, Human Papillomavirus (HPV), Human Pulmonary Syndrome, Hydatid cyst, Hydrophobia, Impetigo, Including congenital (German Measles), Inclusion conjunctivitis, Inclusion conjunctivitis—Swimming Pool conjunctivitis—Pannus, Infantile diarrhea, Infectious Mononucleosis, Infectious myocarditis, Infectious pericarditis, Influenza, Isosporiasis, Israeli spotted fever, Japanese Encephalitis, Jock itch, Jorge Lobo disease—lobomycosis, Jungle yellow fever, Junin Argentinian hemorrhagic fever, Kala Azar, Kaposi's sarcoma, Keloidal blastomycosis, Keratoconjunctivitis, Kuru, Kyasanur forest disease, LaCrosse encephalitis, Lassa hemorrhagic fever, Legionellosis (Legionnaires Disease), Legionnaire's pneumonia, Lemierre's Syndrome (Postanginal septicemia), Lemming fever, Leprosy, Leptospirosis (Nanukayami fever; Weil's disease), Listeriosis (*Listeria*), Liver fluke infection, Lobo's mycosis, Lockjaw, Loiasis, Louping III, Ludwig's angina, Lung fluke infection, Lung fluke infection (Paragonimiasis), Lyme disease, Lymphogranuloma venereum infection (LGV), Machupo Bolivian hemorrhagic fever, Madura foot, Mal del pinto, Malaria, Malignant pustule, Malta fever, Marburg hemorrhagic fever, Masters disease, Maternal Sepsis (Puerperal fever), Measles, Mediterranean spotted fever, Melioidosis (Whitmore's disease), Meningitis, Meningococcal Disease, MERS, Milker's nodule, Molluscum contagiosum, Moniliasis, monkeypox, Mononucleosis, Mononucleosis-like syndrome, Montezuma's Revenge, Morbilli, MRSA (methicillin-resistant *Staphylococcus aureus*) infection, Mucormycosis—Zygomycosis, Multiple Organ Dysfunction Syndrome or MODS, Multiple-system atrophy (MSA), Mumps, Murine typhus, Murray Valley Encephalitis (MVE), Mycoburuli ulcers, Mycoburuli ulcers—Buruli ulcers, Mycotic vulvovaginitis, Myositis, Nanukayami fever, Necrotizing fasciitis, Necrotizing fasciitis—Type 1, Necrotizing fasciitis—Type 2, Negishi, New world spotted fever, Nocardiosis, Nongonococcal urethritis, Non-Polio (Non-Polio Enterovirus), Norovirus infection, North American blastomycosis, North Asian tick typhus, Norwalk virus infection, Norwegian itch, O'Hara disease, Omsk hemorrhagic fever, Onchoceriasis, Onychomycosis, Opisthorchiasis, Opthalmia neonatorium, Oral hairy leukoplakia, Orf, Oriental Sore, Oriental Spotted Fever, Ornithosis (Parrot fever; Psittacosis), Oroya fever, Otitis externa, Otitis media, Pannus, Paracoccidioidomycosis, Paragonimiasis, Paralytic Shellfish Poisoning (Paralytic Shellfish Poisoning), Paronychia (Whitlow), Parotitis, PCP pneumonia, Pediculosis, Peliosis hepatica, Pelvic Inflammatory Disease, Pertussis (also called Whooping cough), Phaeohyphomycosis, Pharyngoconjunctival fever, Piedra (White Piedra), Piedra (Black Piedra), Pigbel, Pink eye conjunctivitis, Pinta, Pinworm infection, Pitted Keratolysis, Pityriasis versicolor (Tinea versicolor), Plague; Bubonic, Pleurodynia, Pneumococcal Disease, Pneumocystosis, Pneumonia, Pneumonic (Plague), Polio or Poliomyelitis, Polycystic hydatid, Pontiac fever, Pork tapeworm, Posada-Wernicke disease, Postanginal septicemia, Powassan, Progressive multifocal leukencephalopathy, Progressive Rubella Panencephalitis, Prostatitis, Pseudomembranous colitis, Psittacosis, Puerperal fever, Pustular Rash diseases (Small pox), Pyelonephritis, Pylephlebitis, Q-Fever, Quinsy, Quintana fever (5-day fever), Rabbit fever, Rabies, Racoon roundworm infection, Rat bite fever, Rat tapeworm, Reiter Syndrome, Relapsing fever, Respiratory syncytial virus (RSV) infection, Rheumatic fever, Rhodotorulosis, Ricin Poisoning, Rickettsialpox, Rickettsiosis, Rift Valley Fever, Ringworm, Ritter's Disease, River Blindness, Rocky Mountain spotted fever, Rose Handler's disease (Sporotrichosis), Rose rash of infants, Roseola, Ross River fever, Rotavirus infection, Roundworm infections, Rubella, Rubeola, Russian spring, Salmonellosis gastroenteritis, San Joaquin Valley fever, Sao Paulo Encephalitis, Sao Paulo fever, SARS, Scabies Infestation (Scabies) (Norwegian itch), Scalded Skin Syndrome, Scarlet fever (Scarlatina), Schistosomiasis, Scombroid, Scrub typhus, Sennetsu fever, Sepsis (Septic shock), Severe Acute Respiratory Syndrome, Severe Acute Respiratory Syndrome (SARS), Shiga Toxigenic *Escherichia coli* (STECNTEC), Shigellosis gastroenteritis (*Shigella*), Shinbone fever, Shingles, Shipping fever, Siberian tick typhus, Sinusitis, Sixth disease, Slapped cheek disease, Sleeping sickness, Smallpox (Variola), Snail Fever, Soft chancre, Southern tick associated rash illness, Sparganosis, Spelunker's disease, Sporadic typhus, Sporotrichosis, Spotted fever, Spring, St. Louis encephalitis, Staphylococcal Food Poisoning, Staphylococcal Infection, Strep. throat, Streptococcal Disease, Streptococcal Toxic-Shock Syndrome, Strongyloiciasis, Stye, Subacute Sclerosing Panencephalitis, Subacute Sclerosing Panencephalitis (SSPE), Sudden Acute Respiratory Syndrome, Sudden Rash, Swimmer's ear, Swimmer's Itch, Swimming Pool conjunctivitis, Sylvatic yellow fever, Syphilis, Systemic Inflammatory Response Syndrome (SIRS), Tabes dorsalis (tertiary syphilis), Taeniasis, Taiga encephalitis, Tanner's disease, Tapeworm infections, Temporal lobe encephalitis, Temporal lobe encephalitis, tetani (Lock Jaw), Tetanus Infection, Threadworm infections, Thrush, Tick, Tick typhus, Tinea barbae, Tinea capitis, Tinea corporis, Tinea cruris, Tinea manuum, Tinea nigra, Tinea pedis, Tinea unguium, Tinea versicolor, Torulopsosis, Torulosis, Toxic Shock Syndrome, Toxoplasmosis, transmissible spongioform (CJD), Traveler's diarrhea, Trench fever 5, Trichinellosis, Trichomoniasis, Trichomycosis axillaris, Trichuriasis, Tropical Spastic Paraparesis (TSP), Trypanosomiasis, Tuberculosis (TB), Tuberculousis, Tularemia, Typhoid Fever, Typhus fever, Ulcus molle, Undulant fever, Urban yellow fever, Urethritis, Vaginitis, Vaginosis, Vancomycin Intermediate (VISA), Vancomycin Resistant (VRSA), Varicella, Venezuelan Equine encephalitis, Verruga peruana, *Vibrio cholerae* (Cholera), Vibriosis (*Vibrio*), Vincent's disease or Trench mouth, Viral conjunctivitis, Viral Meningitis, Viral meningoencephalitis, Viral rash, Visceral Larval Migrans, Vomito negro, Vulvovaginitis, Warts, Waterhouse, Weil's disease, West Nile Fever, Western equine encephalitis, Whipple's disease, Whipworm infection, White Piedra, Whitlow, Whitmore's disease, Winter diarrhea, Wolhynia fever, Wool sorters' disease, Yaws, Yellow Fever, Yersinosis, Yersinosis (*Yersinia*), Zahorsky's disease, Zika virus disease, Zoster, Zygomycosis, John Cunningham Virus (JCV), Human immunodeficiency virus (HIV), Influenza virus, Hepatitis B, Hepatitis C, Hepatitis D, Respiratory syncytial virus (RSV), Herpes simplex virus 1 and 2, Human Cytomegalovirus, Epstein-Barr virus, Varicella zoster virus, Coronaviruses, Poxviruses, Enterovirus 71, Rubella virus, Human papilloma virus, *Streptococcus pneumoniae, Streptococcus viridans, Staphylococcus aureus (S. aureus)*, Methicillin-resistant *Staphylococcus aureus* (MRSA), Vancomycin-intermediate *Staphylococcus aureus* (VISA), Vancomycin-resistant *Staphylococcus aureus* (VRSA), *Staphylococcus epidermidis (S. epidermidis), Clostridium Tetani, Bordetella pertussis, Bordetella parapertussis, Mycobacterium, Francisella Tularensis, Toxoplasma gondii, Candida (C. albicans, C. glabrata, C. parapsilosis, C. tropicalis, C. krusei* and *C. lusitaniae*) and/or any other infectious diseases, disorders or syndromes.

Various toxins may be treated with pharmaceutical compositions, biocircuits, biocircuit components, effector modules including their SREs or payloads of the present invention. Non-limited examples of toxins include Ricin, *Bacillus anthracis*, Shiga toxin and Shiga-like toxin, Botulinum toxins.

Various tropical diseases may be treated with pharmaceutical compositions, biocircuits, biocircuit components, effector modules including their SREs or payloads of the present invention. Non-limited examples of tropical diseases include Chikungunya fever, Dengue fever, Chagas disease, Rabies, Malaria, Ebola virus, Marburg virus, West Nile Virus, Yellow Fever, Japanese encephalitis virus, St. Louis encephalitis virus.

Various foodborne illnesses and gastroenteritis may be treated with pharmaceutical compositions, biocircuits, biocircuit components, effector modules including their SREs or payloads of the present invention. Non-limited examples of foodborne illnesses and gastroenteritis include Rotavirus, Norwalk virus (Norovirus), *Campylobacter jejuni, Clostridium difficile, Entamoeba histolytica, Helicobacter* Enterotoxin B of *Staphylococcus aureus*, Hepatitis A virus (HAV), Hepatitis E, *Listeria monocytogenes, Salmonella, Clostridium perfringens*, and *Salmonella*.

Various infectious agents may be treated with pharmaceutical compositions, biocircuits, biocircuit components, effector modules including their SREs or payloads of the present invention. Non-limited examples of infectious agents include adenoviruses, *Anaplasma phagocytophilium, Ascaris lumbricoides, Bacillus anthracis, Bacillus cereus, Bacteroides* sp, Barmah Forest virus, *Bartonella bacilliformis, Bartonella henselae, Bartonella quintana*, beta-toxin of *Clostridium perfringens, Bordetella pertussis, Bordetella parapertussis, Borrelia burgdorferi, Borrelia miyamotoi, Borrelia recurrentis, Borrelia* sp., Botulinum toxin, *Brucella* sp., *Burkholderia pseudomallei*, California encephalitis virus, *Campylobacter, Candida albicans*, chikungunya virus, *Chlamydia psittaci, Chlamydia trachomatis, Clonorchis sinensis, Clostridium difficile* bacteria, *Clostridium tetani*, Colorado tick fever virus, *Corynebacterium diphtheriae, Corynebacterium minutissimum, Coxiella burnetii,* coxsackie A, coxsackie B, Crimean-Congo hemorrhagic fever virus, cytomegalovirus, dengue virus, Eastern Equine encephalitis virus, Ebola viruses, echovirus, *Ehrlichia chaffeensis., Ehrlichia equi., Ehrlichia sp., Entamoeba histolytica, Enterobacter sp., Enterococcus faecalis,* Enterovirus 71, Epstein-Barr virus (EBV), *Erysipelothrix rhusiopathiae, Escherichia coli,* Flavivirus, *Fusobacterium necrophorum, Gardnerella vaginalis,* Group B *streptococcus, Haemophilus aegyptius, Haemophilus ducreyi, Haemophilus influenzae,* hantavirus, *Helicobacter pylori,* Hepatitis A, Hepatitis B, Hepatitis C, Hepatitis D, Hepatitis E, herpes simplex virus 1 and 2, human herpes virus 6, human herpes Virus 8, human immunodeficiency virus 1 and 2, human T-cell leukemia viruses I and II, influenza viruses (A, B, C), Jamestown Canyon virus, Japanese encephalitis antigenic, Japanese encephalitis virus, John Cunninham virus, juninvirus, Kaposi's Sarcoma-associated Herpes Virus (KSHV), *Klebsiella granulomatis, Klebsiella sp.,* Kyasanur Forest Disease virus, La Crosse virus, Lassavirus, *Legionella pneumophila, Leptospira interrogans, Listeria monocytogenes,* lymphocytic choriomeningitis virus, lyssavirus, Machupovirus, Marburg virus, measles virus, MERS coronavirus (MERS-CoV), *Micrococcus sedentarius, Mobiluncus sp.,* Molluscipoxvirus, *Moraxella catarrhalis,* Morbilli-Rubeola virus, Mumpsvirus, *Mycobacterium leprae, Mycobacterium tuberculosis, Mycobacterium ulcerans, Mycoplasma genitalium, Mycoplasma sp,* Nairovirus, *Neisseria gonorrhoeae, Neisseria meningitidis, Nocardia,* Norwalk virus, norovirus, Omsk hemorrhagic fever virus, papilloma virus, parainfluenza viruses 1-3, parapoxvirus, parvovirus B19, Peptostreptococccus sp., *Plasmodium* sp., polioviruses types I, II, and III, *Proteus* sp., *Pseudomonas aeruginosa, Pseudomonas pseudomallei, Pseudomonas* sp., rabies virus, respiratory syncytial virus, ricin toxin, *Rickettsia australis, Rickettsia conori, Rickettsia honei, Rickettsia prowazekii,* Ross River Virus, rotavirus, rubellavirus, Saint Louis encephalitis, *Salmonella Typhi, Sarcoptes scabiei,* SARS-associated coronavirus (SARS-CoV), *Serratia* sp., Shiga toxin and Shiga-like toxin, *Shigella* sp., Sin Nombre Virus, Snowshoe hare virus, *Staphylococcus aureus, Staphylococcus epidermidis, Streptobacillus moniliformis, Streptococcus pneumoniae, Streptococcus agalactiae, Streptococcus agalactiae, Streptococcus* group A-H, *Streptococcus pneumoniae, Streptococcus pyogenes, Treponema pallidum* subsp. *Pallidum, Treponema pallidum* var. *carateum, Treponema pallidum* var. *endemicum, Tropheryma whippelii, Ureaplasma urealyticum,* Varicella-Zoster virus, variola virus, *Vibrio cholerae,* West Nile virus, yellow fever virus, *Yersinia enterocolitica, Yersinia pestis,* and Zika virus.

Various rare diseases may be treated with pharmaceutical compositions, biocircuits, biocircuit components, effector modules including their SREs or payloads of the present invention. As used herein, the term "rare disease" refers to any disease that affects a small percentage of the population. As a non-limiting example, the rare disease may be Acrocephalosyndactylia, Acrodermatitis, Addison Disease, Adie Syndrome, Alagille Syndrome, Amylose, Amyotrophic Lateral Sclerosis, Angelman Syndrome, Angiolymphoid Hyperplasia with Eosinophilia, Arnold-Chiari Malformation, Arthritis, Juvenile Rheumatoid, Asperger Syndrome, Bardet-Biedl Syndrome, Barrett Esophagus, Beckwith-Wiedemann Syndrome, Behcet Syndrome, Bloom Syndrome, Bowen's Disease, Brachial Plexus Neuropathies, Brown-Sequard Syndrome, Budd-Chiari Syndrome, Burkitt Lymphoma, Carcinoma 256, Walker, Caroli Disease, Charcot-Marie-Tooth Disease, Chediak-Higashi Syndrome, Chiari-Frommel Syndrome, Chondrodysplasia Punctata, Colonic Pseudo-Obstruction, Colorectal Neoplasms, Hereditary Nonpolyposis, Craniofacial Dysostosis, Creutzfeldt-Jakob Syndrome, Crohn Disease, Cushing Syndrome, Cystic Fibrosis, Dandy-Walker Syndrome, De Lange Syndrome, Dementia, Vascular, Dermatitis Herpetiformis, DiGeorge Syndrome, Diffuse Cerebral Sclerosis of Schilder, Duane Retraction Syndrome, Dupuytren Contracture, Ebstein Anomaly, Eisenmenger Complex, Ellis-Van Creveld Syndrome, Encephalitis, Enchondromatosis, Epidermal Necrolysis, Toxic, Facial Hemiatrophy, Factor XII Deficiency, Fanconi Anemia, Felty's Syndrome, Fibrous Dysplasia, Polyostotic, Fox-Fordyce Disease, Friedreich Ataxia, Fusobacterium, Gardner Syndrome, Gaucher Disease, Gerstmann Syndrome, Giant Lymph Node Hyperplasia, Glycogen Storage Disease Type I, Glycogen Storage Disease Type II, Glycogen Storage Disease Type IV, Glycogen Storage Disease Type V, Glycogen Storage Disease Type VII, Goldenhar Syndrome, Guillain-Barre Syndrome, Hallermann's Syndrome, Hamartoma Syndrome, Multiple, Hartnup Disease, Hepatolenticular Degeneration, Hepatolenticular Degeneration, Hereditary Sensory and Motor Neuropathy, Hirschsprung Disease, Histiocytic Necrotizing Lymphadenitis, Histiocytosis, Langerhans-Cell, Hodgkin Disease, Homer Syndrome, Huntington Disease, Hyperaldosteronism, Hyperhidrosis, Hyperostosis, Diffuse Idiopathic Skeletal, Hypopituitarism, Inappropriate ADH Syndrome, Intestinal Polyps, Isaacs Syndrome, Kartagener Syndrome, Kearns-Sayre Syndrome, Klippel-Feil Syndrome, Klippel-Trenaunay-Weber Syndrome, Kluver-Bucy Syndrome, Korsakoff Syndrome, Lafora Disease, Lambert-Eaton Myasthenic Syndrome, Landau-Kleffner Syndrome, Langer-Giedion Syndrome, Leigh Disease, Lesch-Nyhan Syndrome, Leukodystrophy, Globoid Cell, Li-Fraumeni Syndrome, Long QT Syndrome, Machado-Joseph Disease, Mallory-Weiss Syndrome, Marek Disease, Marfan Syndrome, Meckel Diverticulum, Meige Syndrome, Melkersson-Rosenthal Syndrome, Meniere Disease, Mikulicz' Disease, Miller Fisher Syndrome, Mobius Syndrome, Moyamoya Disease, Mucocutaneous Lymph Node Syndrome, Mucopolysaccharidosis I, Mucopolysaccharidosis II, Mucopolysaccharidosis III, Mucopolysaccharidosis IV, Mucopolysaccharidosis VI, Multiple Endocrine Neoplasia Type 1, Munchausen Syndrome by Proxy, Muscular Atrophy, Spinal, Narcolepsy, Neuroaxonal Dystrophies, Neuromyelitis Optica, Neuronal Ceroid-Lipofuscinoses, Niemann-Pick Diseases, Noonan Syndrome, Optic Atrophies, Hereditary, Osteitis Deformans, Osteochondritis, Osteochondrodysplasias, Osteolysis, Osteoarthritis, Essential, Paget Disease Extramammary, Paget's Disease, Mammary, Panniculitis, Nodular Nonsuppurative, Papillon-Lefevre Disease, Paralysis, Pelizaeus-Merzbacher Disease, Pemphigus, Benign Familial, Penile Induration, Pericarditis, Constrictive, Peroxisomal Disorders, Peutz-Jeghers Syndrome, Pick Disease of the Brain, Pierre Robin Syndrome, Pigmentation Disorders, Pityriasis Lichenoides, Polycystic Ovary Syndrome, Polyendocrinopathies, Autoimmune, Prader-Willi Syndrome, Pupil Disorders, Rett Syndrome, Reye Syndrome, Rubinstein-Taybi Syndrome, Sandhoff Disease, Sarcoma, Ewing's, Schnitzler Syndrome, Sjogren's Syndrome, Sjogren-Larsson Syndrome, Smith-Lemli-Opitz Syndrome, Spinal Muscular Atrophies of Childhood, Sturge-Weber Syndrome, Sweating, Gustatory, Takayasu Arteritis, Tangier Disease, Tay-Sachs Disease, Thromboangiitis Obliterans, Thyroiditis, Autoimmune, Tietze's Syndrome, Togaviridae Infections, Tolosa-Hunt Syndrome, Tourette Syndrome, Uveomeningoencephalitic Syndrome, Waardenburg's Syndrome, Wegener Granulomatosis, Weil Disease, Werner Syndrome, Williams Syndrome, Wilms Tumor, Wolff-Parkinson-White Syndrome, Wolfram Syndrome, Wolman Disease, Zellweger Syndrome, Zollinger-Ellison Syndrome, and von Willebrand Diseases.

Various autoimmune diseases and autoimmune-related diseases may be treated with pharmaceutical compositions, biocircuits, biocircuit components, effector modules including their SREs or payloads of the present invention. As used herein, the term "autoimmune disease" refers to a disease in which the body produces antibodies that attack its own tissues. As a non-limiting example, the autoimmune disease may be Acute Disseminated Encephalomyelitis (ADEM), Acute necrotizing hemorrhagic leukoencephalitis, Addison's disease, Agammaglobulinemia, Alopecia areata, Amyloidosis, Ankylosing spondylitis, Anti-GBM/Anti-TBM nephritis, Antiphospholipid syndrome (APS), Autoimmune angioedema, Autoimmune aplastic anemia, Autoimmune dysautonomia, Autoimmune hepatitis, Autoimmune hyperlipidemia, Autoimmune immunodeficiency, Autoimmune inner ear disease (AIED), Autoimmune myocarditis, Autoimmune oophoritis, Autoimmune pancreatitis, Autoimmune retinopathy, Autoimmune thrombocytopenic purpura (ATP), Autoimmune thyroid disease, Autoimmune urticaria, Axonal & neuronal neuropathies, Balo disease, Behcet's disease, Bullous pemphigoid, Cardiomyopathy, Castleman disease, Celiac disease, Chagas disease, Chronic fatigue syndrome, Chronic inflammatory demyelinating polyneuropathy (CIDP), Chronic recurrent multifocal ostomyelitis (CRMO), Churg-Strauss syndrome, Cicatricial pemphigoid/benign mucosal pemphigoid, Crohn's disease, Cogans syndrome, Cold agglutinin disease, Congenital heart block, Coxsackie myocarditis, CREST disease, Essential mixed cryoglobulinemia, Demyelinating neuropathies, Dermatitis herpetiformis, Dermatomyositis, Devic's disease (neuromyelitis optica), Discoid lupus, Dressler's syndrome, Endometriosis, Eosinophilic esophagitis, Eosinophilic fasciitis, Erythema nodosum, Experimental allergic encephalomyelitis, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis (GPA) (formerly called Wegener's Granulomatosis), Graves' disease, Guillain-Barre syndrome, Hashimoto's encephalitis, Hashimoto's thyroiditis, Hemolytic anemia, Henoch-Schonlein purpura, Herpes gestationis, Hypogammaglobulinemia, Idiopathic thrombocytopenic purpura (ITP), IgA nephropathy, IgG4-related sclerosing disease, Immunoregulatory lipoproteins, Inclusion body myositis, Interstitial cystitis, Juvenile arthritis, Juvenile diabetes (Type 1 diabetes), Juvenile myositis, Kawasaki syndrome, Lambert-Eaton syndrome, Leukocytoclastic vasculitis, Lichen planus, Lichen sclerosis, Ligneous conjunctivitis, Linear IgA disease (LAD), Lupus (SLE), Lyme disease, chronic, Meniere's disease, Microscopic polyangiitis, Mixed connective tissue disease (MCTD), Mooren's ulcer, Mucha-Habermann disease, Multiple sclerosis, Myasthenia gravis, Myositis, Narcolepsy, Neuromyelitis optica (Devic's), Neutropenia, Ocular cicatricial pemphigoid, Optic neuritis, Palindromic rheumatism, PANDAS (Pediatric Autoimmune Neuropsychiatric Disorders Associated with *Streptococcus*), Paraneoplastic cerebellar degeneration, Paroxysmal nocturnal hemoglobinuria (PNH), Parry Romberg syndrome, Parsonnage-Turner syndrome, Pars planitis (peripheral uveitis), Pemphigus, Peripheral neuropathy, Perivenous encephalomyelitis, Pernicious anemia, POEMS syndrome, Polyarteritis nodosa, Type I, II, & III autoimmune polyglandular syndromes, Polymyalgia rheumatica, Polymyositis, Postmyocardial infarction syndrome, Postpericardiotomy syndrome, Progesterone dermatitis, Primary biliary cirrhosis, Primary sclerosing cholangitis, Psoriasis, Psoriatic arthritis, Idiopathic pulmonary fibrosis, Pyoderma gangrenosum, Pure red cell aplasia, Raynauds phenomenon, Reactive Arthritis, Reflex sympathetic dystrophy, Reiter's syndrome, Relapsing polychondritis, Restless legs syndrome, Retroperitoneal fibrosis, Rheumatic fever, Rheumatoid arthritis, Sarcoidosis, Schmidt syndrome, Scleritis, Scleroderma, Sjogren's syndrome, Sperm & testicular autoimmunity, Stiff person syndrome, Subacute bacterial endocarditis (SBE), Susac's syndrome, Sympathetic ophthalmia, Takayasu's arteritis, Temporal arteritis/Giant cell arteritis, Thrombocytopenic purpura (TTP), Tolosa-Hunt syndrome, Transverse myelitis, Ulcerative colitis, Undifferentiated connective tissue disease (UCTD), Uveitis, Vasculitis, Vesiculobullous dermatosis, Vitiligo, and Wegener's granulomatosis (now termed Granulomatosis with Polyangiitis (GPA).

Various kidney diseases may be treated with pharmaceutical compositions, biocircuits, biocircuit components, effector modules including their SREs or payloads of the present invention. As a non-limiting example, the kidney disease Abderhalden-Kaufmann-Lignac syndrome (Nephropathic Cystinosis), Abdominal Compartment Syndrome, Acute Kidney Failure/Acute Kidney Injury, Acute Lobar Nephronia, Acute Phosphate Nephropathy, Acute Tubular Necrosis, Adenine Phosphoribosyltransferase Deficiency, Adenovirus Nephritis, Alport Syndrome, Amyloidosis, ANCA Vasculitis Related to Endocarditis and Other Infections, Angiomyolipoma, Analgesic Nephropathy, Anorexia Nervosa and Kidney Disease, Angiotensin Antibodies and Focal Segmental Glomerulosclerosis, Antiphospholipid Syndrome, Anti-TNF-α Therapy-related Glomerulonephritis, APOL1 Mutations, Apparent Mineralocorticoid Excess Syndrome, Aristolochic Acid Nephropathy, Chinese Herbal Nephropathy, Balkan Endemic Nephropathy, Bartter Syndrome, Beeturia, β-Thalassemia Renal Disease, Bile Cast Nephropathy, BK Polyoma Virus Nephropathy in the Native Kidney, Bladder Rupture, Bladder Sphincter Dyssynergia, Bladder Tamponade, Border-Crossers' Nephropathy, Bourbon Virus and Acute Kidney Injury, Burnt Sugarcane Harvesting and Acute Renal Dysfunction, Byetta and Renal Failure, C1q Nephropathy, Cannabinoid Hyperemesis Acute Renal Failure, Cardiorenal syndrome, Carfilzomib-Indiced Renal Injury, CFHR5 nephropathy, Charcot-Marie-Tooth Disease with Glomerulopathy, Cherry Concentrate and Acute Kidney Injury, Cholesterol Emboli, Churg-Strauss syndrome, Chyluria, Colistin Nephrotoxicity, Collagenofibrotic Glomerulopathy, Collapsing Glomerulopathy, Collapsing Glomerulopathy Related to CMV, Congenital Nephrotic Syndrome, Conorenal syndrome (Mainzer-Saldino Syndrome or Saldino-Mainzer Disease), Contrast Nephropathy, Copper Sulpfate Intoxication, Cortical Necrosis, Crizotinib-related Acute Kidney Injury, Cryogobuinemia, Crystalglobulin-Induced Nephropathy, Crystal-Induced Acute Kidney injury, Cystic Kidney Disease, Acquired, Cystinuria, Dasatinib-Induced Nephrotic-Range Proteinuria, Dense Deposit Disease (MPGN Type 2), Dent Disease (X-linked Recessive Nephrolithiasis), Dialysis Disequilibrium Syndrome, Diabetes and Diabetic Kidney Disease, Diabetes Insipidus, Dietary Supplements and Renal Failure, Drugs of Abuse and Kidney Disease, Duplicated Ureter, EAST syndrome, Ebola and the Kidney, Ectopic Kidney, Ectopic Ureter, Edema, Swelling, Erdheim-Chester Disease, Fabry's Disease, Familial Hypocalciuric Hypercalcemia, Fanconi Syndrome, Fraser syndrome, Fibronectin Glomerulopathy, Fibrillary Glomerulonephritis and Immunotactoid Glomerulopathy, Fraley syndrome, Focal Segmental Glomerulosclerosis, Focal Sclerosis, Focal Glomerulosclerosis, Galloway Mowat syndrome, Giant Cell (Temporal) Arteritis with Kidney Involvement, Gestational Hypertension, Gitelman Syndrome, Glomerular Diseases, Glomerular Tubular Reflux, Glycosuria, Goodpasture Syndrome, Hair Dye Ingestion and Acute Kidney Injury, Hantavirus Infection Podocytopathy, Hematuria (Blood in Urine), Hemolytic Uremic Syndrome (HUS), Atypical Hemolytic Uremic Syndrome (aHUS), Hemophagocytic Syndrome, Hemorrhagic Cystitis, Hemorrhagic Fever with Renal Syndrome (HFRS, Hantavirus Renal Disease, Korean Hemorrhagic Fever, Epidemic Hemorrhagic Fever, Nephropathis Epidemica), Hemosiderosis related to Paroxysmal Nocturnal Hemoglobinuria and Hemolytic Anemia, Hepatic Glomerulopathy, Hepatic Veno-Occlusive Disease, Sinusoidal Obstruction Syndrome, Hepatitis C-Associated Renal Disease, Hepatorenal Syndrome, Herbal Supplements and Kidney Disease, High Blood Pressure and Kidney Disease, HIV-Associated Nephropathy (HIVAN), Horseshoe Kidney (Renal Fusion), Hunner's Ulcer, Hyperaldosteronism, Hypercalcemia, Hyperkalemia, Hypermagnesemia, Hypernatremia, Hyperoxaluria, Hyperphosphatemia, Hypocalcemia, Hypokalemia, Hypokalemia-induced renal dysfunction, Hypokalemic Periodic Paralysis, Hypomagnesemia, Hyponatremia, Hypophosphatemia, IgA Nephropathy, IgG4 Nephropathy, Interstitial Cystitis, Painful Bladder Syndrome (Questionnaire), Interstitial Nephritis, Ivemark's syndrome, Ketamine-Associated Bladder Dysfunction, Kidney Stones, Nephrolithiasis, Kombucha Tea Toxicity, Lead Nephropathy and Lead-Related Nephrotoxicity, Leptospirosis Renal Disease, Light Chain Deposition Disease, Monoclonal Immunoglobulin Deposition Disease, Liddle Syndrome, Lightwood-Albright Syndrome, Lipoprotein Glomerulopathy, Lithium Nephrotoxicity, LMX1B Mutations Cause Hereditary FSGS, Loin Pain Hematuria, Lupus, Systemic Lupus Erythematosis, Lupus Kidney Disease, Lupus Nephritis, Lupus Nephritis with Antineutrophil Cytoplasmic Antibody Seropositivity, Lyme Disease-Associated Glomerulonephritis, Malarial Nephropathy, Malignancy-Associated Renal Disease, Malignant Hypertension, Malakoplakia, Meatal Stenosis, Medullary Cystic Kidney Disease, Medullary Sponge Kidney, Megaureter, Melamine Toxicity and the Kidney, Membranoproliferative Glomerulonephritis, Membranous Nephropathy, MesoAmerican Nephropathy, Metabolic Acidosis, Metabolic Alkalosis, Methotrexate-related Renal Failure, Microscopic Polyangiitis, Milk-alkalai syndrome, Minimal Change Disease, MDMA (Molly; Ecstacy; 3,4-Methylenedioxymethamphetamine) and Kidney Failure, Multicystic dysplastic kidney, Multiple Myeloma, Myeloproliferative Neoplasms and Glomerulopathy, Nail-patella Syndrome, Nephrocalcinosis, Nephrogenic Systemic Fibrosis, Nephroptosis (Floating Kidney, Renal Ptosis), Nephrotic Syndrome, Neurogenic Bladder, Nodular Glomerulosclerosis, Non-Gonococcal Urethritis, Nutcracker syndrome, Orofaciodigital Syndrome, Orotic Aciduria, Orthostatic Hypotension, Orthostatic Proteinuria, Osmotic Diuresis, Ovarian Hyperstimulation Syndrome, Page Kidney, Papillary Necrosis, Papillorenal Syndrome (Renal-Coloboma Syndrome, Isolated Renal Hypoplasia), Parvovirus B19 and the Kidney, The Peritoneal-Renal Syndrome, Posterior Urethral Valve, Post-infectious Glomerulonephritis, Post-streptococcal Glomerulonephritis, Polyarteritis Nodosa, Polycystic Kidney Disease, Posterior Urethral Valves, Preeclampsia, Propofol infusion syndrome, Proliferative Glomerulonephritis with Monoclonal IgG Deposits (Nasr Disease), Propolis (Honeybee Resin) Related Renal Failure, Proteinuria (Protein in Urine), Pseudohyperaldosteronism, Pseudohypobicarbonatemia, Pseudohypoparathyroidism, Pulmonary-Renal Syndrome, Pyelonephritis (Kidney Infection), Pyonephrosis, Radiation Nephropathy, Ranolazine and the Kidney, Refeeding syndrome, Reflux Nephropathy, Rapidly Progressive Glomerulonephritis, Renal Abscess, Peripnephric Abscess, Renal Agenesis, Renal Arcuate Vein Microthrombi-Associated Acute Kidney Injury, Renal Artery Aneurysm, Renal Artery Stenosis, Renal Cell Cancer, Renal Cyst, Renal Hypouricemia with Exercise-induced Acute Renal Failure, Renal Infarction, Renal Osteodystrophy, Renal Tubular Acidosis, Renin Secreting Tumors (Juxtaglomerular Cell Tumor), Reset Osmostat, Retrocaval Ureter, Retroperitoneal Fibrosis, Rhabdomyolysis, Rhabdomyolysis related to Bariatric Surgery, Rheumatoid Arthritis-Associated Renal Disease, Sarcoidosis Renal Disease, Salt Wasting, Renal and Cerebral, Schistosomiasis and Glomerular Disease, Schimke immuno-osseous dysplasia, Scleroderma Renal Crisis, Serpentine Fibula-Polycystic Kidney Syndrome, Exner Syndrome, Sickle Cell Nephropathy, Silica Exposure and Chronic Kidney Disease, Sri Lankan Farmers' Kidney Disease, Sjögren's Syndrome and Renal Disease, Synthetic Cannabinoid Use and Acute Kidney Injury, Kidney Disease Following Hematopoietic Cell Transplantation, Kidney Disease Related to Stem Cell Transplantation, Thin Basement Membrane Disease, Benign Familial Hematuria, Trigonitis, Tuberculosis, Genitourinary, Tuberous Sclerosis, Tubular Dysgenesis, Immune Complex Tubulointerstitial Nephritis Due to Autoantibodies to the Proximal Tubule Brush Border, Tumor Lysis Syndrome, Uremia, Uremic Optic Neuropathy, Ureteritis Cystica, Ureterocele, Urethral Caruncle, Urethral Stricture, Urinary Incontinence, Urinary Tract Infection, Urinary Tract Obstruction, Vesicointestinal Fistula, Vesicoureteral Reflux, Volatile Anesthetics and Acute Kidney Injury, Von Hippel-Lindau Disease, Waldenstrom's Macroglobulinemic Glomerulonephritis, Warfarin-Related Nephropathy, Wasp Stings and Acute Kidney Injury, Wegener's Granulomatosis, Granulomatosis with Polyangiitis, West Nile Virus and Chronic Kidney Disease, and Wunderlich syndrome.

Various cardiovascular diseases may be treated with pharmaceutical compositions, biocircuits, biocircuit components, effector modules including their SREs or payloads of the present invention. As a non-limiting example, the cardiovascular disease may be Ischemic heart disease also known as coronary artery disease, Cerebrovascular disease (Stroke), Peripheral vascular disease, Heart failure, Rheumatic heart disease, and Congenital heart disease.

Various antibody deficiencies may be treated with pharmaceutical compositions, biocircuits, biocircuit components, effector modules including their SREs or payloads of the present invention. As a non-limiting example, the antibody deficiencies may be X-Linked Agammaglobulinemia (XLA), Autosomal Recessive Agammaglobulinemia (ARA), Common Variable Immune Deficiency (CVID), IgG (IgG1, IgG2, IgG3 and IgG4) Subclass Deficiency, Selective IgA Deficiency, Specific Antibody Deficiency (SAD), Transient Hypogammaglobulinemia of Infancy, Antibody Deficiency with Normal or Elevated Immunoglobulins, Selective IgM Deficiency, Immunodeficiency with Thymoma (Good's Syndrome), Transcobalamin II Deficiency, Warts, Hypogammaglobulinemia, Infection, Myelokathexis (WHIM) Syndrome, Drug-Induced Antibody Deficiency, Kappa Chain Deficiency, Heavy Chain Deficiencies, Post-Meiotic Segregation (PMS2) Disorder, and Unspecified Hypogammaglobulinemia.

Various ocular diseases may be treated with pharmaceutical compositions, biocircuits, biocircuit components, effector modules including their SREs or payloads of the present invention. As a non-limiting example, the ocular disease may be thyroid eye disease (TED), Graves' disease (GD) and orbitopathy, Retina Degeneration, Cataract, optic atrophy, macular degeneration, Leber congenital amaurosis, retinal degeneration, cone-rod dystrophy, Usher syndrome, leopard syndrome, photophobia, and photoaversion.

Various neurological diseases may be treated with pharmaceutical compositions, biocircuits, biocircuit components, effector modules including their SREs or payloads of the present invention. As a non-limiting example, the neurological disease may be Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adie's Syndrome, Adrenoleukodystrophy, Agenesis of the Corpus Callosum, Agnosia, Aicardi Syndrome, Aicardi-Goutieres Syndrome Disorder, AIDS—Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Arnold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosomal Dominant Arteriopathy with Subcortical Infarcts and Leukoencephalopathy (CADASIL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavernous Malformation, Cerebral Gigantism, Cerebral Hypoxia, Cerebral Palsy, Cerebro-Oculo-Facio-Skeletal Syndrome (COFS), Charcot-Marie-Tooth Disease, Chiari Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt-Jakob Disease, Cumulative Trauma Disorders, Cushing's Syndrome, Cytomegalic Inclusion Body Disease, Cytomegalovirus Infection, Dancing Eyes-Dancing Feet Syndrome, Dandy-Walker Syndrome, Dawson Disease, De Morsier's Syndrome, Dejerine-Klumpke Palsy, Dementia, Dementia—Multi-Infarct, Dementia—Semantic, Dementia—Subcortical, Dementia With Lewy Bodies, Dentate Cerebellar Ataxia, Dentatorubral Atrophy, Dermatomyositis, Developmental Dyspraxia, Devic's Syndrome, Diabetic Neuropathy, Diffuse Sclerosis, Dravet Syndrome, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Angiomatosis, Epilepsy, Epileptic Hemiplegia, Erb's Palsy, Erb-Duchenne and Dejerine-Klumpke Palsies, Essential Tremor, Extrapontine Myelinolysis, Fabry Disease, Fahr's Syndrome, Fainting, Familial Dysautonomia, Familial Hemangioma, Familial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy Infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, Globoid Cell Leukodystrophy, Glossopharyngeal Neuralgia, Glycogen Storage Disease, Guillain-Barré Syndrome, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-1 Associated Myelopathy, Hughes Syndrome, Huntington's Disease, Hydranencephaly, Hydrocephalus, Hydrocephalus—Normal Pressure, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Sayre Syndrome, Kennedy's Disease, Kinsbourne syndrome, Kleine-Levin Syndrome, Klippel-Feil Syndrome, Klippel-Trenaunay Syndrome (KTS), Klüver-Bucy Syndrome, Korsakoff's Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-In Syndrome, Lou Gehrig's Disease, Lupus—Neurological Sequelae, Lyme Disease—Neurological Complications, Machado-Joseph Disease, Macrencephaly, Megalencephaly, Melkersson-Rosenthal Syndrome, Meningitis, Meningitis and Encephalitis, Menkes Disease, Meralgia Paresthetica, Metachromatic Leukodystrophy, Microcephaly, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidosis, Multi-Infarct Dementia, Multifocal Motor Neuropathy, Multiple Sclerosis, Multiple System Atrophy, Multiple System Atrophy with Orthostatic Hypotension, Muscular Dystrophy, Myasthenia—Congenital, Myasthenia Gravis, Myelinoclastic Diffuse Sclerosis, Myoclonic Encephalopathy of Infants, Myoclonus, Myopathy, Myopathy—Congenital, Myopathy—Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscinosis, Neuronal Migration Disorders, Neuropathy—Hereditary, Neurosarcoidosis, Neurosyphilis, Neurotoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain—Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Pinched Nerve, Piriformis Syndrome, Pituitary Tumors, Polymyositis, Pompe Disease, Porencephaly, Post-Polio Syndrome, Postherpetic Neuralgia, Post infectious Encephalomyelitis, Postural Hypotension, Postural Orthostatic Tachycardia Syndrome, Postural Tachycardia Syndrome, Primary Dentatum Atrophy, Primary Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasmosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease—Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjögren's Syndrome, Sleep Apnea, Sleeping Sickness, Sotos Syndrome, Spasticity, Spina Bifida, Spinal Cord Infarction, Spinal Cord Injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VHL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome, Wilson Disease, Wolman's Disease, X-Linked Spinal and Bulbar Muscular Atrophy.

Various psychological disorders may be treated with pharmaceutical compositions, biocircuits, biocircuit components, effector modules including their SREs or payloads of the present invention. As a non-limiting example, the psychological disorders may be Aboulia, Absence epilepsy, Acute stress Disorder, Adjustment Disorders, Adverse effects of medication NOS, Age related cognitive decline, Agoraphobia, Alcohol Addiction, Alzheimer's Disease, Amnesia (also known as Amnestic Disorder), Amphetamine Addiction, Anorexia Nervosa, Anterograde amnesia, Antisocial personality disorder (also known as Sociopathy), Anxiety Disorder (Also known as Generalized Anxiety Disorder), Anxiolytic related disorders, Asperger's Syndrome (now part of Autism Spectrum Disorder), Attention Deficit Disorder (Also known as ADD), Attention Deficit Hyperactivity Disorder (Also known as ADHD), Autism Spectrum Disorder (also known as Autism), Autophagia, Avoidant Personality Disorder, Barbiturate related disorders, Benzodiazepine related disorders, Bereavement, Bibliomania, Binge Eating Disorder, Bipolar disorder (also known as Manic Depression, includes Bipolar I and Bipolar II), Body Dysmorphic Disorder, Borderline intellectual functioning, Borderline Personality Disorder, Breathing-Related Sleep Disorder, Brief Psychotic Disorder, Bruxism, Bulimia Nervosa, Caffeine Addiction, Cannabis Addiction, Catatonic disorder, Catatonic schizophrenia, Childhood amnesia, Childhood Disintegrative Disorder (now part of Autism Spectrum Disorder), Childhood Onset Fluency Disorder (formerly known as Stuttering), Circadian Rhythm Disorders, Claustrophobia, Cocaine related disorders, Communication disorder, Conduct Disorder, Conversion Disorder, Cotard delusion, Cyclothymia (also known as Cyclothymic Disorder), Delerium, Delusional Disorder, dementia, Dependent Personality Disorder (also known as Asthenic Personality Disorder), Depersonalization disorder (now known as Depersonalization/Derealization Disorder), Depression (also known as Major Depressive Disorder), Depressive personality disorder, Derealization disorder (now known as Depersonalization/Derealization Disorder), Dermotillomania, Desynchronosis, Developmental coordination disorder, Diogenes Syndrome, Disorder of written expression, Dispareunia, Dissocial Personality Disorder, Dissociative Amnesia, Dissociative Fugue, Dissociative Identity Disorder (formerly known as Multiple Personality Disorder), Down syndrome, Dyslexia, Dyspareunia, Dysthymia (now known as Persistent Depressive Disorder), Eating disorder NOS, Ekbom's Syndrome (Delusional Parasitosis), Emotionally unstable personality disorder, Encopresis, Enuresis (bedwetting), Erotomania, Exhibitionistic Disorder, Expressive language disorder, Factitious Disorder, Female Sexual Disorders, Fetishistic Disorder, Folie a deux, Fregoli delusion, Frotteuristic Disorder, Fugue State, Ganser syndrome, Gambling Addiction, Gender Dysphoria (formerly known as Gender Identity Disorder), Generalized Anxiety Disorder, General adaptation syndrome, Grandiose delusions, Hallucinogen Addiction, Haltlose personality disorder, Histrionic Personality Disorder, Primary hypersomnia, Huntington's Disease, Hypoactive sexual desire disorder, Hypochondriasis, Hypomania, Hyperkinetic syndrome, Hypersomnia, Hysteria, Impulse control disorder, Impulse control disorder NOS, Inhalant Addiction, Insomnia, Intellectual Development Disorder, Intermittent Explosive Disorder, Joubert syndrome, Kleptomania, Korsakoff's syndrome, Lacunar amnesia, Language Disorder, Learning Disorders, Major Depression (also known as Major Depressive Disorder), major depressive disorder, Male Sexual Disorders, Malingering, Mathematics disorder, Medication-related disorder, Melancholia, Mental Retardation (now known as Intellectual Development Disorder), Misophonia, Morbid jealousy, Multiple Personality Disorder (now known as Dissociative Identity Disorder), Munchausen Syndrome, Munchausen by Proxy, Narcissistic Personality Disorder, Narcolepsy, Neglect of child, Neurocognitive Disorder (formerly known as Dementia), Neuroleptic-related disorder, Nightmare Disorder, Non Rapid Eye Movement, Obsessive-Compulsive Disorder, Obsessive-Compulsive Personality Disorder (also known as Anankastic Personality Disorder), Oneirophrenia, Onychophagia, Opioid Addiction, Oppositional Defiant Disorder, Orthorexia (ON), Pain disorder, Panic attacks, Panic Disorder, Paranoid Personality Disorder, Parkinson's Disease, Partner relational problem, Passive-aggressive personality disorder, Pathological gambling, Pedophilic Disorder, Perfectionism, Persecutory delusion, Persistent Depressive Disorder (also known as Dysthymia), Personality change due to a general medical condition, Personality disorder, Pervasive developmental disorder (PDD), Phencyclidine related disorder, Phobic disorder, Phonological disorder, Physical abuse, Pica, Polysubstance related disorder, Postpartum Depression, Post-traumatic embitterment disorder (PTED), Post-Traumatic Stress Disorder, Premature ejaculation, Premenstrual Dysphoric Disorder, Psychogenic amnesia, Psychological factor affecting medical condition, Psychoneurotic personality disorder, Psychotic disorder, not otherwise specified, Pyromania, Reactive Attachment Disorder, Reading disorder, Recurrent brief depression, Relational disorder, REM Sleep Behavior Disorder, Restless Leg Syndrome, Retrograde amnesia, Retts Disorder (now part of Autism Spectrum Disorder), Rumination syndrome, Sadistic personality disorder, Schizoaffective Disorder, Schizoid Personality Disorder, Schizophrenia, Schizophreniform disorder, Schizotypal Personality Disorder, Seasonal Affective Disorder, Sedative, Hypnotic, or Anxiolytic Addiction, Selective Mutism, Self-defeating personality disorder, Separation Anxiety Disorder, Sexual Disorders Female, Sexual Disorders Male, Sexual Addiction, Sexual Masochism Disorder, Sexual Sadism Disorder, Shared Psychotic Disorder, Sleep Arousal Disorders, Sleep Paralysis, Sleep Terror Disorder (now part of Nightmare Disorder, Social Anxiety Disorder, Somatization Disorder, Specific Phobias, Stendhal syndrome, Stereotypic movement disorder, Stimulant Addiction, Stuttering (now known as Childhood Onset Fluency Disorder), Substance related disorder, Tardive dyskinesia, Tobacco Addiction, Tourettes Syndrome, Transient tic disorder, Transient global amnesia, Transvestic Disorder, Trichotillomania, Undifferentiated Somatoform Disorder, Vaginismus, and Voyeuristic Disorder.

Various lung diseases may be treated with pharmaceutical compositions, biocircuits, biocircuit components, effector modules including their SREs or payloads of the present invention. As a non-limiting example, the lung diseases may be Asbestosis, Asthma, Bronchiectasis, Bronchitis, Chronic Cough, Chronic Obstructive Pulmonary Disease (COPD), Croup, Cystic Fibrosis, Hantavirus, Idiopathic Pulmonary Fibrosis, Pertussis, Pleurisy, Pneumonia, Pulmonary Embolism, Pulmonary Hypertension, Sarcoidosis, Sleep Apnea, Spirometry, Sudden Infant Death Syndrome (SIDS), Tuberculosis, Alagille Syndrome, Autoimmune Hepatitis, Biliary Atresia, Cirrhosis, ERCP (Endoscopic Retrograde Cholangiopancreatography), and Hemochromatosis. Nonalcoholic Steatohepatitis, Porphyria, Primary Biliary Cirrhosis, Primary Sclerosing Cholangitis.

Various bone diseases may be treated with pharmaceutical compositions, biocircuits, biocircuit components, effector modules including their SREs or payloads of the present invention. As a non-limiting example, the bone diseases may be osteoporosis, neurofibromatosis, osteogenesis imperfecta (OI), rickets, osteosarcoma, achondroplasia, fracture, osteomyelitis, Ewing tumor of bone, osteomalacia, hip dysplasia, Paget disease of bone, marble bone disease, osteochondroma, bone cancer, bone disease, osteochondrosis, osteoma, fibrous dysplasia, cleidocranial dysostosis, osteoclastoma, bone cyst, metabolic bone disease, melorheostosis, callus, Caffey syndrome, and mandibulofacial dysostosis.

Various blood diseases may be treated with pharmaceutical compositions, biocircuits, biocircuit components, effector modules including their SREs or payloads of the present invention. As a non-limiting example, the blood diseases may be Anemia and CKD (for health care professionals), Aplastic Anemia and Myelodysplastic Syndromes, Deep Vein Thrombosis, Hemochromatosis, Hemophilia, Henoch-Schönlein Purpura, Idiopathic Thrombocytopenic Purpura, Iron-Deficiency Anemia, Pernicious Anemia, Pulmonary Embolism, Sickle Cell Anemia, Sickle Cell Trait and Other Hemoglobinopathies, Thalassemia, Thrombotic Thrombocytopenic Purpura, and Von Willebrand Disease.

Central Nervous System (CNS)

In some embodiments, pharmaceutical compositions, biocircuits, biocircuit components, effector modules including their SREs or payloads of the present invention may be used in the modulation or alteration or exploitation of proteins in the central nervous system including cerebrospinal (CSF) proteins.

In some examples, pharmaceutical compositions, biocircuits, biocircuit components, effector modules including their SREs or payloads of the present invention may be used to provide tunable ERT (enzyme replacement therapy) products to the central nervous system. Many lysosomal storage diseases (LSD) involve the CNS symptoms, such as mental retardation, seizures, profound neurodegeneration, behavioral abnormalities, and psycho-motor defects. ERT for LSDs is one of the true success stories in modern molecular medicine. The successful application of ERT relies on controlled lysosomal proteins (e.g., enzymes) and delivery to CNS cells. Compositions of the present invention may be used for ERT products for Mucopolysaccharidosis type II (Hunter Syndrome, iduronate sulfatase deficiency), Mucopolysaccharidosis type VI (Maroteaux-Lamy Syndrome, arylsulfatase B deficiency), Mucopolysaccharidosis type III (Sanfilippo A), Mucopolysaccharidosis type IV (MPS IV), Pompe disease (acid maltase deficiency), Niemann-Pick B (NP-B) disease, metachromatic leukodystrophy (MLD, Arylsufatase A deficiency), Krabbe disease, Wolman disease, and Sly syndrome.

In some examples, pharmaceutical compositions, biocircuits, biocircuit components, effector modules including their SREs or payloads of the present invention may be used to locally produce monoclonal antibodies against protein aggregates in the CNS and CSF. Such antibodies may be used to treat degenerative diseases like Alzheimer's disease (AD), Huntington's Disease (HD) and Parkinson's disease (PD).

In other examples, pharmaceutical compositions, biocircuits, biocircuit components, effector modules including their SREs or payloads of the present invention may be used to regulate neurotrophic factors in the central nervous system.

Gene Editing

The CRISPR-Cas9 system is a novel genome editing system which has been rapidly developed and implemented in a multitude of model organisms and cell types, and supplants other genome editing technologies, such as TALENs and ZFNs. CRISPRs are sequence motifs are present in bacterial and archaeal genomes, and are composed of short (about 24-48 nucleotide) direct repeats separated by similarly sized, unique spacers (Grissa et al. *BMC Bioinformatics* 8, 172 (2007)). They are generally flanked by a set of CRISPR-associated (Cas) protein-coding genes that are required for CRISPR maintenance and function (Barrangou et al., *Science* 315, 1709 (2007), Brouns et al., *Science* 321, 960 (2008), Haft et al. *PLoS Comput Biol* 1, e60 (2005)). CRISPR-Cas systems provide adaptive immunity against invasive genetic elements (e.g., viruses, phages and plasmids) (Horvath and Barrangou, *Science*, 2010, 327: 167-170; Bhaya et al., *Annu. Rev. Genet.*, 2011, 45: 273-297; and Brrangou R, *RNA*, 2013, 4: 267-278). Three different types of CRISPR-Cas systems have been classified in bacteria and the type II CRISPR-Cas system is most studied. In the bacterial Type II CRISPR-Cas system, small CRISPR RNAs (crRNAs) processed from the pre-repeat-spacer transcript (pre-crRNA) in the presence of a trans-activating RNA (tracrRNA)/Cas9 can form a duplex with the tracrRNA/Cas9 complex. The mature complex is recruited to a target double strand DNA sequence that is complementary to the spacer sequence in the tracrRNA: crRNA duplex to cleave the target DNA by Cas9 endonuclease (Garneau et al., *Nature*, 2010, 468: 67-71; Jinek et al., *Science*, 2012, 337: 816-821; Gasiunas et al., *Proc. Natl Acad. Sci. USA.*, 109: E2579-2586; and Haurwitz et al., *Science*, 2010, 329: 1355-1358). Target recognition and cleavage by the crRNA: tracrRNA/Cas9 complex in the type II CRISPR-CAS system not only requires a sequence in the tracrRNA: crRNA duplex that is a complementary to the target sequence (also called "protospacer" sequence) but also requires a protospacer adjacent motif (PAM) sequence located 3' end of the protospacer sequence of a target polynucleotide. The PAM motif can vary between different CRISPR-Cas systems.

CRISPR-Cas9 systems have been developed and modified for use in genetic editing and prove to be a high effective and specific technology for editing a nucleic acid sequence even in eukaryotic cells. Many researchers disclosed various modifications to the bacterial CRISPR-Cas systems and demonstrated that CRISPR-Cas systems can be used to manipulate a nucleic acid in a cell, such as in a mammalian cell and in a plant cell. Representative references include U.S. Pat. Nos. 8,993,233; 8,999,641; 8,945,839; 8,932,814; 8,906, 616; 8,895,308; 8,889,418; 8,889,356; 8,871,445; 8,865,406; 8,771,945; and 8,697,359; US patent publication NOs.: 20150031134; 20150203872; 20150218253; 20150176013; 20150191744; 20150071889; 20150067922; and 20150167000; each of which is incorporated herein by reference in their entirety.

However, controlling the effects and activity of the CRISPR-Cas system (e.g., guide RNA and nuclease) has been challenging and often can be problematic.

The biocircuits of the present invention and/or any of their components may be utilized in regulating or tuning the CRISPR/Cas9 system in order to optimize its utility.

Examples for tuning the system are shown in FIG. 19A and FIG. 19B.

In some embodiments, the payloads of the effector modules of the invention may include alternative isoforms or orthologs of the Cas9 enzyme.

The most commonly used Cas9 is derived from *Streptococcus pyogenes* and the RuvC domain can be inactivated by a D10A mutation and the HNH domain can be inactivated by an H840A mutation.

In addition to Cas9 derived from *S. pyogenes*, other RNA guided endonucleases (RGEN) may also be used for programmable genome editing. Cas9 sequences have been identified in more than 600 bacterial strains. Though Cas9 family shows high diversity of amino acid sequences and protein sizes, All Cas9 proteins share a common architecture with a central HNH nuclease domain and a split RuvC/RHase H domain. Examples of Cas9 orthologs from other bacterial strains including but not limited to, Cas proteins identified in *Acaryochloris marina* MBIC11017; *Acetohalobium arabaticum* DSM 5501; *Acidithiobacillus caldus*; *Acidithiobacillus ferrooxidans* ATCC 23270; *Alicyclobacillus acidocaldarius* LAA1; *Alicyclobacillus acidocaldarius* subsp. *acidocaldarius* DSM 446; *Allochromatium vinosum* DSM 180; *Ammonifex degensii* KC4; *Anabaena variabilis* ATCC 29413; *Arthrospira maxima* CS-328; *Arthrospira platensis* str. *Paraca*; *Arthrospira* sp. PCC 8005; *Bacillus pseudomycoides* DSM 12442; *Bacillus selenitireducens* MLS10; *Burkholderiales bacterium* 1_1_47; *Caldicellulosiruptor becscii* DSM 6725; *Candidatus Desulforudis audaxviator* MP104C; *Caldicellulosiruptor hydrothermalis*_108; *Clostridium* phage c-st; *Clostridium botulinum* A3 str. Loch Maree; *Clostridium botulinum* Ba4 str. 657; *Clostridium difficile* QCD-63q42; *Crocosphaera watsonii* WH 8501; *Cyanothece* sp. ATCC 51142; *Cyanothece* sp. CCY0110; *Cyanothece* sp. PCC 7424; *Cyanothece* sp. PCC 7822; *Exiguobacterium sibiricum* 255-15; *Finegoldia magna* ATCC 29328; *Ktedonobacter racemifer* DSM 44963; *Lactobacillus delbrueckii* subsp. *bulgaricus* PB2003/044-T3-4; *Lactobacillus salivarius* ATCC 11741; *Listeria innocua*; *Lyngbya* sp. PCC 8106; *Marinobacter* sp. ELB17; *Methanohalobium evestigatum* Z-7303; *Microcystis* phage Ma-LMM01; *Microcystis aeruginosa* NIES-843; *Microscilla marina* ATCC 23134; *Microcoleus chthonoplastes* PCC 7420; *Neisseria meningitidis*; *Nitrosococcus halophilus* Nc4; *Nocardiopsis dassonvillei* subsp. *dassonvillei* DSM 43111; *Nodularia spumigena* CCY9414; *Nostoc* sp. PCC 7120; *Oscillatoria* sp. PCC 6506; *Pelotomaculum thermopropionicum*_SI; *Petrotoga mobilis* SJ95; *Polaromonas naphthalenivorans* CJ2; *Polaromonas* sp. JS666; *Pseudoalteromonas haloplanktis* TAC125; *Streptomyces pristinaespiralis* ATCC 25486; *Streptomyces pristinaespiralis* ATCC 25486; *Streptococcus thermophilus*; *Streptomyces viridochromogenes* DSM 40736; *Streptosporangium roseum* DSM 43021; *Synechococcus* sp. PCC 7335; and *Thermosipho africanus* TCF52B (Chylinski et al., *RNA Biol.*, 2013; 10(5): 726-737).

In some embodiments, the payload of the present invention may be a split Cas-9 (Zetsche B et al. A split-Cas9 architecture for inducible genome editing and transcription modulation. Nat Biotechnol. 2015 February; 33(2):139-42; the contents of which are incorporated by reference in their entirety).

In addition to Cas9 orthologs, other Cas9 variants such as fusion proteins of inactive dCas9 and effector domains with different functions may serve as a platform for genetic modulation. Any of the foregoing enzymes may be useful in the present invention.

CRISPR/Cas9 based biocircuits may be generated by any of the methods taught in International Publication No.: WO2016106244 and Gao Y et al. Complex transcriptional modulation with orthogonal and inducible dCas9 regulators. Nat Methods. 2016 December; 13(12):1043-1049; the contents of each of which are incoporated herein by reference in their entirety).

The CRISPR/Cas9 system may also be utilized to modulate gene expression, which may be combined with its gene editing utility. In some embodiments, the payloads of the effector modules of the invention may include CRISPR associated transcriptional activators e.g VP64-p65-Rta (VPR); or repressors e.g Kruppel-associated box (KRAB) associated with the CRISPR/Cas9 system.

Stem Cell Applications

The biocircuits of the present invention and/or any of their components may be utilized in the regulated reprogramming of cells, stem cell engraftment or other application where controlled or tunable expression of such reprogramming factors are useful.

The biocircuits of the present invention may be used in reprogramming cells including stem cells or induced stem cells. Induction of induced pluripotent stem cells (IPSO) was first achieved by Takahashi and Yamanaka (*Cell*, 2006. 126(4):663-76; herein incorporated by reference in its entirety) using viral vectors to express KLF4, c-MYC, OCT4 and SOX2 otherwise collectively known as KMOS.

Excisable lentiviral and transposon vectors, repeated application of transient plasmid, episomal and adenovirus vectors have also been used to try to derive iPSC (Chang, C.-W., et al., *Stem Cells*, 2009. 27(5):1042-1049; Kaji, K., et al., *Nature*, 2009. 458(7239):771-5; Okita, K., et al., *Science*, 2008. 322(5903):949-53; Stadtfeld, M., et al., *Science*, 2008. 322(5903):945-9; Woltjen, K., et al., *Nature*, 2009; Yu, J., et al., *Science*, 2009:1172482; Fusaki, N., et al., *Proc Jpn Acad Ser B Phys Biol Sci*, 2009. 85(8):348-62; each of which is herein incorporated by reference in its entirety).

DNA-free methods to generate human iPSC has also been derived using serial protein transduction with recombinant proteins incorporating cell-penetrating peptide moieties (Kim, D., et al., *Cell Stem Cell*, 2009. 4(6): 472-476; Zhou, H., et al., *Cell Stem Cell*, 2009. 4(5):381-4; each of which is herein incorporated by reference in its entirety), and infectious transgene delivery using the Sendai virus (Fusaki, N., et al., *Proc Jpn Acad Ser B Phys Biol Sci*, 2009. 85(8): p. 348-62; herein incorporated by reference in its entirety).

The effector modules of the present invention may include a payload comprising any of the genes including, but not limited to, OCT such as OCT4, SOX such as SOX1, SOX2, SOX3, SOX15 and SOX18, NANOG, KLF such as KLF1, KLF2, KLF4 and KLF5, MYC such as c-MYC and n-MYC, REM2, TERT and LIN28 and variants thereof in support of reprogramming cells. Sequences of such reprogramming factors are taught in for example International Application PCT/US2013/074560, the contents of which are incorporated herein by reference in their entirety.

The effector modules of the present invention may include a payload comprising any of factors that contribute stem cell mobilization. In autologous stem cell therapy, sources of stem cells for transplantation may include the bone marrow, peripheral blood mononuclear cells and cord blood. Stem cells are stimulated out of these sources (e.g., the bone marrow) into the blood stream. So sufficient stem cells are available for collection for future reinfusion. One or a combination of cytokines strategies may be used to mobilize the stem cells including but not limited to G-CSF (filgrastim), GM-CSF, and chemotherapy preceding with cytokines (chemomobilization).

Metabolic Peptides and Hormones

In some embodiments, the biocircuits of the present invention and/or any of their components may be used to regulate peptides, natural or synthetic. Naturally occurring peptides may include but are not limited to, peptide hormones, natriuretic peptides, food peptides, and derivatives and precursors. Peptide hormones may be selected from amylin (IAPP), anti-mullerian hormone (AMH), adiponectin (Acrp30), adrenocorticotropic hormone (ACTH), angiotensinogen (AGT), antidiuretic hormone (ADH), Aprosin, atriopeptin (ANP), brain natriuretic peptide (BNP), calcitonin (CT), cholecystokinin (CCK), corticotropin-releasing hormone (CRH), cortistatin (CORT), encephalin, endothelin, erythropoietin (EPO), follicle-stimulating hormone (FSH), galanin (GAL), gastric inhibitory polypeptide (GIP), gastrin (GRP), ghrelin, glucagon (GCG), Glucagon-like peptide-1 (GLP1), gonadotropin-releasing hormone (GnRH), growth hormone-releasing hormone (GHRH), guanylin (GN), hepcidin (HAMP), human chorionic gonadotropin (HPL), growth hormone (GH), inhibin, insulin (INS), somatomedin, leptin (LEP), lipotropin (LPH), luteinizing hormone (LH), melanocyte stimulating hormone (MSH), motilin (MLN), orexin, oxytocin (OXT), pancreatic polypeptide, parathyroid hormone (PTH), pituitary adenylate cyclase-activating peptide (PACAP), prolactin (PRL), prolactin releasing hormone (PRH), relaxin (RLN), renin, secretin (SCT), Thrombopoietin (TPO), thyroid-stimulating hormone (TSH), thyrotropin-releasing hormone (TRH), vasoactive intestinal peptide (VIP), and uroguanylin (UGN). Natriuretic peptides may be selected from Cardiodilatin related peptide (CDD) (also known as atrial natriuretic peptide (ANP)), BNP and C-type natriuretic peptide (CNP) and Urodilatin.

Other peptides may include host defense peptides (HDPs) (also called antimicrobial peptides, AMPs), and other naturally occurring peptides.

The biocircuits of the present invention and/or any of their components may also be utilized for pulsatile release of hormones or other peptide drugs.

Enzyme Replacement Therapy (ERT)

Enzyme replacement therapy (ERT) is a medical treatment replacing an enzyme in a patient. ERT provides therapeutic interventions that address the underlying metabolic defect in many disorders caused by defective enzymes. Such disorders include, but are not limited to, lysosomal storage diseases (LSDs), congenital disorders of glycosylation, and metabolic disorders characterized by missing or reduced enzyme activity in the cytoplasm. Non-limiting examples of lysosomal storage diseases include: Activator Deficiency; Alpha-mannosidosis, Aspartylglucosaminuria, Cholesteryl ester storage disease, Chronic Hexosaminidase A Deficiency, Cystinosis, Danon disease, Gaucher disease, Fabry disease, Farber disease; Fucosidosis; Galactosialidosis, GMI gangliosidosis, I-Cell disease, Infantile Free Sialic Acid Storage Disease, Krabbe disease, Metachromatic Leukodystrophy, Pompe disease, Mucopolysaccharidosis I, Hurler syndrome, Hurler-Scheie syndrome, Scheie syndrome, Mucopolysaccharidosis II, Hunter syndrome, Mucopolysaccharidosis IV, Mucopolysaccharidosis VI, Lysosomal Acid lipase deficiency, Thrombocytopenia, Maroteaux-Lamy syndrome, Sly syndrome, Pycnodysostosis, Sandhoff disease, Schindler disease, Salla disease, Tay-Sachs, and Wolman disease.

In some embodiments, the biocircuits of the present invention and/or any of their components may also be utilized to regulate enzymatic activities during ERT. As a non-limiting example, payloads of the biocircuits of the present invention may be a functional lysosomal enzyme for ERT, such as a-D-mannosidase, N-aspartyl-β-glucosaminidase, acid lipase; hexosaminidase A, a-galactosidase A, β-galactosidase, lysosomal protease, ceramidase, fucosidase; β-glucosidase, N-acetylglucosamine-1-phosphotransferase, sulfatase, hyaluronidase, galactocerebrosidase; arylsulfatase A; N-acetylglucosamine-1-phosphotransferase; a-L-iduronidase; iduronate sulfatase; heparan sulfamidase; N-acetylglucosaminidase; acetyl-CoA:a-glucosaminide acetyltransferase; N-acetylglucosamine 6-sulfatase; N-acetylgalactosamine-6-sulfate sulfatase; N-acetylgalactosamine-4-sulfatase; β-glucuronidase; hyaluronidase; sialidase; sulfatase; sphingomyelinase; acid a-glucosidase; β-mannosidase; cathepsin K; β-hexosaminidase A; β-hexosaminidase B, a-N-acetylgalactosaminidase, sialin, and hexosaminidase.

Coagulation

Coagulation defects often cause hemorrhage and/or thrombosis. The best-known coagulation factor disorders are the hemophilias. The three main forms are hemophilia A (factor VIII deficiency), hemophilia B (factor IX deficiency or "Christmas disease") and hemophilia C (factor XI deficiency, mild bleeding tendency). Other disorders caused by defective coagulation factors also include, but are not limited to, Von Willebrand disease (caused by a defect in von Willebrand factor (vWF), Bernard-Soulier syndrome (caused by a defect or deficiency in GPIb, a receptor of vWF), thrombophlebitis (caused by mutations in Factor XII), Congenital afibrinogenemia, Familial renal amyloidosis (caused by mutations in Factor I), congenital proconvertin/factor VII deficiency, Thrombophilia (caused by Factor II deficiency), Congenital Factor X deficiency, Congenital Factor XIIIa/b deficiency, Prekallikrein/Fletcher Factor deficiency, Kininogen deficiency, Glomerulopathy with fibronectin deposits, Heparin cofactor II deficiency, Protein C deficiency, Protein S deficiency, Protein Z deficiency, Antithrombin III deficiency, Plasminogen deficiency, type I (ligneous conjunctivitis), Antiplasmin deficiency, Plasminogen activator inhibitor-1 deficiency, and Quebec platelet disorder.

Gene therapy for coagulation factor replacement is a medical treatment of disorders caused be coagulation deficiency. In accordance with the present invention, the biocircuits of the present invention and/or any of their components may also be utilized to regulate a coagulation factor used for gene therapy. In some examples, the coagulation factor may be selected from Factor I (fibrinogen), Factor II (prothrombin), Factor III (tissue factor), Factor IV, Factor V (proaccelerin), Factor VI, Factor VII (stable factor), Factor VIII (antihemophilic factor A), Factor IX (antihemophilic factor B), Factor X (Stuart-Prower factor), Factor XI (plasma thromboplastin antecedent), Factor XII (Hageman factor), Factor XIII (fibrin-stabilizing factor), von Willebrand factor, Prekallikrein (Fletcher factor), high-molecular-weight kininogen (HMWK) (Fitzgerald factor), fibronectin, antithrombin III, heparin cofactor II, protein C, protein S, protein Z, protein Z related protease inhibitor (ZPI), plasminogen, tissue plasminogen activator (tPA), urokiase, plasminogen, plasminogen activator inhibitor 1 (PAI1), and plasminogen activator inhibitor 2 (PAI2)

In one embodiment, the coagulate factor is Factor VIII for gene therapy of hemophilia, including wild type factor VIII, engineered Factor VIII, activated fVIII (fVIIIa), or the equivalent. Exemplary engineered Factor VIII may include those discussed by Roberts et al (*J. Genet. Syndr. Gene Ther.*, 2011, 1: S1-006; the contents of which are incorporated herein by reference in their entirety).

In another embodiment, the coagulate factor may be Factor IX for gene therapy of hemophilia B. The factor IX may be a recombinant factor IX as disclosed in U.S. Pat. Nos. 7,575,897; 7,700,734; 7,888,067; and 8,168,425; PCT patent application publication NO.: WO2016/075473; the contents of each of which are incorporated herein by reference in their entirety.

IV. Formulations

The compositions of the present invention may be formulated in any manner suitable for delivery. The formulation may be, but is not limited to, nanoparticles, poly (lactic-co-glycolic acid) (PLGA) microspheres, lipidoids, lipoplex, liposome, polymers, carbohydrates (including simple sugars), cationic lipids and combinations thereof.

In one embodiment, the formulation is a nanoparticle which may comprise at least one lipid. The lipid may be selected from, but is not limited to, DLin-DMA, DLin-K-DMA, 98N12-5, C12-200, DLin-MC3-DMA, DLin-KC2-DMA, DODMA, PLGA, PEG, PEG-DMG and PEGylated lipids. In another aspect, the lipid may be a cationic lipid such as, but not limited to, DLin-DMA, DLin-D-DMA, DLin-MC3-DMA, DLin-KC2-DMA and DODMA.

For polynucleotides of the invention, the formulation may be selected from any of those taught, for example, in International Application PCT/US2012/069610, the contents of which are incorporated herein by reference in its entirety.

Inactive Ingredients

In some embodiments, pharmaceutical or other formulations may comprise at least one excipient which is an inactive ingredient. As used herein, the term "Inactive ingredient" refers to one or more inactive agents included in formulations. In some embodiments, all, none or some of the inactive ingredients which may be used in the formulations of the present invention may be approved by the US Food and Drug Administration (FDA). A non-exhaustive list of inactive ingredients includes, 1,2,6-Hexanetriol, 1,2-Dimyristoyl-Sn-Glycero-3-(Phospho-S-(1-Glycerol)), 1,2-Dimyristoyl-Sn-Glycero-3-Phosphocholine, 1,2-Dioleoyl-Sn-Glycero-3-Phosphocholine, 1,2-Dipalmitoyl-Sn-Glycero-3-(Phospho-Rac-(1-Glycerol)), 1,2-Distearoyl-Sn-Glycero-3-(Phospho-Rac-(1-Glycerol)), 1,2-Distearoyl-Sn-Glycero-3-Phosphocholine, 1-O-Tolylbiguanide, 2-Ethyl-1, 6-Hexanediol, Acetic Acid, Acetic Acid, Glacial, Acetic Anhydride, Acetone, Acetone Sodium Bisulfite, Acetylated Lanolin Alcohols, Acetylated Monoglycerides, Acetylcysteine, Acetyltryptophan, DL-, Acrylates Copolymer, Acrylic Acid-Isooctyl Acrylate Copolymer, Acrylic Adhesive 788, Activated Charcoal, Adcote 72A103, Adhesive Tape, Adipic Acid, Aerotex Resin 3730, Alanine, Albumin Aggregated, Albumin Colloidal, Albumin Human, Alcohol, Alcohol, Dehydrated, Alcohol, Denatured, Alcohol, Diluted, Alfadex, Alginic Acid, Alkyl Ammonium Sulfonic Acid Betaine, Alkyl Aryl Sodium Sulfonate, Allantoin, Allyl .Alpha.-Ionone, Almond Oil, Alpha.-Terpineol, Alpha.-Tocopherol, Alpha.-Tocopherol Acetate, DL-, Alpha.-Tocopherol, DL-, Aluminum Acetate, Aluminum Chlorhydroxy Allantoinate, Aluminum Hydroxide, Aluminum Hydroxide—Sucrose, Hydrated, Aluminum Hydroxide Gel, Aluminum Hydroxide Gel F 500, Aluminum Hydroxide Gel F 5000, Aluminum Monostearate, Aluminum Oxide, Aluminum Polyester, Aluminum Silicate, Aluminum Starch Octenylsuccinate, Aluminum Stearate, Aluminum Subacetate, Aluminum Sulfate Anhydrous, Amerchol C, Amerchol-Cab, Aminomethylpropanol, Ammonia, Ammonia Solution, Ammonia Solution, Strong, Ammonium Acetate, Ammonium Hydroxide, Ammonium Lauryl Sulfate, Ammonium Nonoxynol-4 Sulfate, Ammonium Salt Of C-12-C-15 Linear Primary Alcohol Ethoxylate, Ammonium Sulfate, Ammonyx, Amphoteric-2, Amphoteric-9, Anethole, Anhydrous Citric Acid, Anhydrous Dextrose, Anhydrous Lactose, Anhydrous Trisodium Citrate, Aniseed Oil, Anoxid Sbn, Antifoam, Antipyrine, Apaflurane, Apricot Kernel Oil Peg-6 Esters, Aquaphor, Arginine, Arlacel, Ascorbic Acid, Ascorbyl Palmitate, Aspartic Acid, Balsam Peru, Barium Sulfate, Beeswax, Beeswax, Synthetic, Beheneth-10, Bentonite, Benzalkonium Chloride, Benzenesulfonic Acid, Benzethonium Chloride, Benzododecinium Bromide, Benzoic Acid, Benzyl Alcohol, Benzyl Benzoate, Benzyl Chloride, Betadex, Bibapcitide, Bismuth Subgallate, Boric Acid, Brocrinat, Butane, Butyl Alcohol, Butyl Ester Of Vinyl Methyl Ether/Maleic Anhydride Copolymer (125000 Mw), Butyl Stearate, Butylated Hydroxyanisole, Butylated Hydroxytoluene, Butylene Glycol, Butylparaben, Butyric Acid, C20-40 Pareth-24, Caffeine, Calcium, Calcium Carbonate, Calcium Chloride, Calcium Gluceptate, Calcium Hydroxide, Calcium Lactate, Calcobutrol, Caldiamide Sodium, Caloxetate Trisodium, Calteridol Calcium, Canada Balsam, Caprylic/Capric Triglyceride, Caprylic/Capric/Stearic Triglyceride, Captan, Captisol, Caramel, Carbomer 1342, Carbomer 1382, Carbomer 934, Carbomer 934p, Carbomer 940, Carbomer 941, Carbomer 980, Carbomer 981, Carbomer Homopolymer Type B (Allyl Pentaerythritol Crosslinked), Carbomer Homopolymer Type C (Allyl Pentaerythritol Crosslinked), Carbon Dioxide, Carboxy Vinyl Copolymer, Carboxymethylcellulose, Carboxymethylcellulose Sodium, Carboxypolymethylene, Carrageenan, Carrageenan Salt, Castor Oil, Cedar Leaf Oil, Cellulose, Cellulose, Microcrystalline, Cerasynt-Se, Ceresin, Ceteareth-12, Ceteareth-15, Ceteareth-30, Cetearyl Alcohol/Ceteareth-20, Cetearyl Ethylhexanoate, Ceteth-10, Ceteth-2, Ceteth-20, Ceteth-23, Cetostearyl Alcohol, Cetrimonium Chloride, Cetyl Alcohol, Cetyl Esters Wax, Cetyl Palmitate, Cetylpyridinium Chloride, Chlorobutanol, Chlorobutanol Hemihydrate, Chlorobutanol, Anhydrous, Chlorocresol, Chloroxylenol, Cholesterol, Choleth, Choleth-24, Citrate, Citric Acid, Citric Acid Monohydrate, Citric Acid, Hydrous, Cocamide Ether Sulfate, Cocamine Oxide, Coco Betaine, Coco Diethanolamide, Coco Monoethanolamide, Cocoa Butter, Coco-Glycerides, Coconut Oil, Coconut Oil, Hydrogenated, Coconut Oil/Palm Kernel Oil Glycerides, Hydrogenated, Cocoyl Caprylocaprate, Cola Nitida Seed Extract, Collagen, Coloring Suspension, Corn Oil, Cottonseed Oil, Cream Base, Creatine, Creatinine, Cresol, Croscarmellose Sodium, Crospovidone, Cupric Sulfate, Cupric Sulfate Anhydrous, Cyclomethicone, Cyclomethicone/Dimethicone Copolyol, Cysteine, Cysteine Hydrochloride, Cysteine Hydrochloride Anhydrous, Cysteine, DI-, D&C Red No. 28, D&C Red No. 33, D&C Red No. 36, D&C Red No. 39, D&C Yellow No. 10, Dalfampridine, Daubert 1-5 Pestr (Matte) 164z, Decyl Methyl Sulfoxide, Dehydag Wax Sx, Dehydroacetic Acid, Dehymuls E, Denatonium Benzoate, Deoxycholic Acid, Dextran, Dextran 40, Dextrin, Dextrose, Dextrose Monohydrate, Dextrose Solution, Diatrizoic Acid, Diazolidinyl Urea, Dichlorobenzyl Alcohol, Dichlorodifluoromethane, Dichlorotetrafluoroethane, Diethanolamine, Diethyl Pyrocarbonate, Diethyl Sebacate, Diethylene Glycol Monoethyl Ether, Diethylhexyl Phthalate, Dihydroxyaluminum Aminoacetate, Diisopropanolamine, Diisopropyl Adipate, Diisopropyl Dilinoleate, Dimethicone 350, Dimethicone Copolyol, Dimethicone Mdx4-4210, Dimethicone Medical Fluid 360, Dimethyl Isosorbide, Dimethyl Sulfoxide, Dimethylaminoethyl Methacrylate—Butyl Methacrylate—Methyl Methacrylate Copolymer, Dimethyldioctadecylammonium Bentonite, Dimethylsiloxane/Methylvinylsiloxane Copolymer, Dinoseb Ammonium Salt, Dipalmitoylphosphatidylglycerol, DI-, Dipropylene Glycol, Disodium Cocoamphodiacetate, Disodium Laureth Sulfosuccinate, Disodium Lauryl Sulfosuccinate, Disodium Sulfosalicylate, Disofenin, Divinylbenzene Styrene Copolymer, Dmdm Hydantoin, Docosanol, Docusate Sodium, Duro-Tak 280-2516, Duro-Tak 387-2516, Duro-Tak 80-1196, Duro-Tak 87-2070, Duro-Tak 87-2194, Duro-Tak 87-2287, Duro-Tak 87-2296, Duro-Tak 87-2888, Duro-Tak 87-2979, Edetate Calcium Disodium, Edetate Disodium, Edetate Disodium Anhydrous, Edetate Sodium, Edetic Acid, Egg Phospholipids, Entsufon, Entsufon Sodium, Epilactose, Epitetracycline Hydrochloride, Essence Bouquet 9200, Ethanolamine Hydrochloride, Ethyl Acetate, Ethyl Oleate, Ethylcelluloses, Ethylene Glycol, Ethylene Vinyl Acetate Copolymer, Ethylenediamine, Ethylenediamine Dihydrochloride, Ethylene-Propylene Copolymer, Ethylene-Vinyl Acetate Copolymer (28% Vinyl Acetate), Ethylene-Vinyl Acetate Copolymer (9% Vinylacetate), Ethylhexyl Hydroxystearate, Ethylparaben, Eucalyptol, Exametazime, Fat, Edible, Fat, Hard, Fatty Acid Esters, Fatty Acid Pentaerythriol Ester, Fatty Acids, Fatty Alcohol Citrate, Fatty Alcohols, Fd&C Blue No. 1, Fd&C Green No. 3, Fd&C Red No. 4, Fd&C Red No. 40, Fd&C Yellow No. 10 (Delisted), Fd&C Yellow No. 5, Fd&C Yellow No. 6, Ferric Chloride, Ferric Oxide, Flavor 89-186, Flavor 89-259, Flavor Df-119, Flavor Df-1530, Flavor Enhancer, Flavor Fig 827118, Flavor Raspberry Pfc-8407, Flavor Rhodia Pharmaceutical No. Rf 451, Fluorochlorohydrocarbons, Formaldehyde, Formaldehyde Solution, Fractionated Coconut Oil, Fragrance 3949-5, Fragrance 520a, Fragrance 6.007, Fragrance 91-122, Fragrance 9128-Y, Fragrance 93498g, Fragrance Balsam Pine No. 5124, Fragrance Bouquet 10328, Fragrance Chemoderm 6401-B, Fragrance Chemoderm 6411, Fragrance Cream No. 73457, Fragrance Cs-28197, Fragrance Felton 066m, Fragrance Firmenich 47373, Fragrance Givaudan Ess 9090/1c, Fragrance H-6540, Fragrance Herbal 10396, Fragrance Nj-1085, Fragrance P O FI-147, Fragrance Pa 52805, Fragrance Pera Derm D, Fragrance Rbd-9819, Fragrance Shaw Mudge U-7776, Fragrance Tf 044078, Fragrance Ungerer Honeysuckle K 2771, Fragrance Ungerer N5195, Fructose, Gadolinium Oxide, Galactose, Gamma Cyclodextrin, Gelatin, Gelatin, Crosslinked, Gelfoam Sponge, Gellan Gum (Low Acyl), Gelva 737, Gentisic Acid, Gentisic Acid Ethanolamide, Gluceptate Sodium, Gluceptate Sodium Dihydrate, Gluconolactone, Glucuronic Acid, Glutamic Acid, DI-, Glutathione, Glycerin, Glycerol Ester Of Hydrogenated Rosin, Glyceryl Citrate, Glyceryl Isostearate, Glyceryl Laurate, Glyceryl Monostearate, Glyceryl Oleate, Glyceryl Oleate/Propylene Glycol, Glyceryl Palmitate, Glyceryl Ricinoleate, Glyceryl Stearate, Glyceryl Stearate—Laureth-23, Glyceryl Stearate/Peg Stearate, Glyceryl Stearate/Peg-100 Stearate, Glyceryl Stearate/Peg-40 Stearate, Glyceryl Stearate-Stearamidoethyl Diethylamine, Glyceryl Trioleate, Glycine, Glycine Hydrochloride, Glycol Distearate, Glycol Stearate, Guanidine Hydrochloride, Guar Gum, Hair Conditioner (18n195-1m), Heptane, Hetastarch, Hexylene Glycol, High Density Polyethylene, Histidine, Human Albumin Microspheres, Hyaluronate Sodium, Hydrocarbon, Hydrocarbon Gel, Plasticized, Hydrochloric Acid, Hydrochloric Acid, Diluted, Hydrocortisone, Hydrogel Polymer, Hydrogen Peroxide, Hydrogenated Castor Oil, Hydrogenated Palm Oil, Hydrogenated Palm/Palm Kernel Oil Peg-6 Esters, Hydrogenated Polybutene 635-690, Hydroxide Ion, Hydroxyethyl Cellulose, Hydroxyethylpiperazine Ethane Sulfonic Acid, Hydroxymethyl Cellulose, Hydroxyoctacosanyl Hydroxystearate, Hydroxypropyl Cellulose, Hydroxypropyl Methylcellulose 2906, Hydroxypropyl-Bcyclodextrin, Hypromellose 2208 (15000 Mpa·S), Hypromellose 2910 (15000 Mpa·S), Hypromelloses, Imidurea, Iodine, Iodoxamic Acid, Iofetamine Hydrochloride, Irish Moss Extract, Isobutane, Isoceteth-20, Isoleucine, Isooctyl Acrylate, Isopropyl Alcohol, Isopropyl Isostearate, Isopropyl Myristate, Isopropyl Myristate—Myristyl Alcohol, Isopropyl Palmitate, Isopropyl Stearate, Isostearic Acid, Isostearyl Alcohol, Isotonic Sodium Chloride Solution, Jelene, Kaolin, Kathon Cg, Kathon Cg II, Lactate, Lactic Acid, Lactic Acid, DI-, Lactic Acid, L-, Lactobionic Acid, Lactose, Lactose Monohydrate, Lactose, Hydrous, Laneth, Lanolin, Lanolin Alcohol—Mineral Oil, Lanolin Alcohols, Lanolin Anhydrous, Lanolin Cholesterols, Lanolin Nonionic Derivatives, Lanolin, Ethoxylated, Lanolin, Hydrogenated, Lauralkonium Chloride, Lauramine Oxide, Laurdimonium Hydrolyzed Animal Collagen, Laureth Sulfate, Laureth-2, Laureth-23, Laureth-4, Lauric Diethanolamide, Lauric Myristic Diethanolamide, Lauroyl Sarcosine, Lauryl Lactate, Lauryl Sulfate, Lavandula Angustifolia Flowering Top, Lecithin, Lecithin Unbleached, Lecithin, Egg, Lecithin, Hydrogenated, Lecithin, Hydrogenated Soy, Lecithin, Soybean, Lemon Oil, Leucine, Levulinic Acid, Lidofenin, Light Mineral Oil, Light Mineral Oil (85 Ssu), Limonene, (+/−)-, Lipocol Sc-15, Lysine, Lysine Acetate, Lysine Monohydrate, Magnesium Aluminum Silicate, Magnesium Aluminum Silicate Hydrate, Magnesium Chloride, Magnesium Nitrate, Magnesium Stearate, Maleic Acid, Mannitol, Maprofix, Mebrofenin, Medical Adhesive Modified 5-15, Medical Antiform A-F Emulsion, Medronate Disodium, Medronic Acid, Meglumine, Menthol, Metacresol, Metaphosphoric Acid, Methanesulfonic Acid, Methionine, Methyl Alcohol, Methyl Gluceth-10, Methyl Gluceth-20, Methyl Gluceth-20 Sesquistearate, Methyl Glucose Sesquistearate, Methyl Laurate, Methyl Pyrrolidone, Methyl Salicylate, Methyl Stearate, Methylboronic Acid, Methylcellulose (4000 Mpa·S), Methylcelluloses, Methylchloroisothiazolinone, Methylene Blue, Methylisothiazolinone, Methylparaben, Microcrystalline Wax, Mineral Oil, Mono And Diglyceride, Monostearyl Citrate, Monothioglycerol, Multisterol Extract, Myristyl Alcohol, Myristyl Lactate, Myristyl-.Gamma.-Picolinium Chloride, N-(Carbamoyl-Methoxy Peg-40)-1,2-Distearoyl-Cephalin Sodium, N,N-Dimethylacetamide, Niacinamide, Nioxime, Nitric Acid, Nitrogen, Nonoxynol Iodine, Nonoxynol-15, Nonoxynol-9, Norflurane, Oatmeal, Octadecene-1/Maleic Acid Copolymer, Octanoic Acid, Octisalate, Octoxynol-1, Octoxynol-40, Octoxynol-9, Octyldodecanol, Octylphenol Polymethylene, Oleic Acid, Oleth-10/Oleth-5, Oleth-2, Oleth-20, Oleyl Alcohol, Oleyl Oleate, Olive Oil, Oxidronate Disodium, Oxyquinoline, Palm Kernel Oil, Palmitamine Oxide, Parabens, Paraffin, Paraffin, White Soft, Partum Creme 45/3, Peanut Oil, Peanut Oil, Refined, Pectin, Peg 6-32 Stearate/Glycol Stearate, Peg Vegetable Oil, Peg-100 Stearate, Peg-12 Glyceryl Laurate, Peg-120 Glyceryl Stearate, Peg-120 Methyl Glucose Dioleate, Peg-15 Cocamine, Peg-150 Distearate, Peg-2 Stearate, Peg-20 Sorbitan Isostearate, Peg-22 Methyl Ether/Dodecyl Glycol Copolymer, Peg-25 Propylene Glycol Stearate, Peg-4 Dilaurate, Peg-4 Laurate, Peg-40 Castor Oil, Peg-40 Sorbitan Diisostearate, Peg-45/Dodecyl Glycol Copolymer, Peg-5 Oleate, Peg-50 Stearate, Peg-54 Hydrogenated Castor Oil, Peg-6 Isostearate, Peg-60 Castor Oil, Peg-60 Hydrogenated Castor Oil, Peg-7 Methyl Ether, Peg-75 Lanolin, Peg-8 Laurate, Peg-8 Stearate, Pegoxol 7 Stearate, Pentadecalactone, Pentaerythritol Cocoate, Pentasodium Pentetate, Pentetate Calcium Trisodium, Pentetic Acid, Peppermint Oil, Perflutren, Perfume 25677, Perfume Bouquet, Perfume E-1991, Perfume Gd 5604, Perfume Tana 90/42 Scba, Perfume W-1952-1, Petrolatum, Petrolatum, White, Petroleum Distillates, Phenol, Phenol, Liquefied, Phenonip, Phenoxyethanol, Phenylalanine, Phenylethyl Alcohol, Phenylmercuric Acetate, Phenylmercuric Nitrate, Phosphatidyl Glycerol, Egg, Phospholipid, Phospholipid, Egg, Phospholipon 90g, Phosphoric Acid, Pine Needle Oil (*Pinus Sylvestris*), Piperazine Hexahydrate, Plastibase-50w, Polacrilin, Polidronium Chloride, Poloxamer 124, Poloxamer 181, Poloxamer 182, Poloxamer 188, Poloxamer 237, Poloxamer 407, Poly(Bis(P-Carboxyphenoxy)Propane Anhydride):Sebacic Acid, Poly(Dimethylsiloxane/Methylvinylsiloxane/Methylhydrogensiloxane) Dimethylvinyl Or Dimethylhydroxy Or Trimethyl Endblocked, Poly(DI-Lactic-Co-Glycolic Acid), (50:50, Poly(DI-Lactic-Co-Glycolic Acid), Ethyl Ester Terminated, (50:50, Polyacrylic Acid (250000 Mw), Polybutene (1400 Mw), Polycarbophil, Polyester, Polyester Polyamine Copolymer, Polyester Rayon, Polyethylene Glycol 1000, Polyethylene Glycol 1450, Polyethylene Glycol 1500, Polyethylene Glycol 1540, Polyethylene Glycol 200, Polyethylene Glycol 300, Polyethylene Glycol 300-1600, Polyethylene Glycol 3350, Polyethylene Glycol 400, Polyethylene Glycol 4000, Polyethylene Glycol 540, Polyethylene Glycol 600, Polyethylene Glycol 6000, Polyethylene Glycol 8000, Polyethylene Glycol 900, Polyethylene High Density Containing Ferric Oxide Black (<1%), Polyethylene Low Density Containing Barium Sulfate (20-24%), Polyethylene T, Polyethylene Terephthalates, Polyglactin, Polyglyceryl-3 Oleate, Polyglyceryl-4 Oleate, Polyhydroxyethyl Methacrylate, Polyisobutylene, Polyisobutylene (1100000 Mw), Polyisobutylene (35000 Mw), Polyisobutylene 178-236, Polyisobutylene 241-294, Polyisobutylene 35-39, Polyisobutylene Low Molecular Weight, Polyisobutylene Medium Molecular Weight, Polyisobutylene/Polybutene Adhesive, Polylactide, Polyols, Polyoxyethylene—Polyonpropylene 1800, Polyoxyethylene Alcohols, Polyoxyethylene Fatty Acid Esters, Polyoxyethylene Propylene, Polyoxyl 20 Cetostearyl Ether, Polyoxyl 35 Castor Oil, Polyoxyl 40 Hydrogenated Castor Oil, Polyoxyl 40 Stearate, Polyoxyl 400 Stearate, Polyoxyl 6 And Polyoxyl 32 Palmitostearate, Polyoxyl Distearate, Polyoxyl Glyceryl Stearate, Polyoxyl Lanolin, Polyoxyl Palmitate, Polyoxyl Stearate, Polypropylene, Polypropylene Glycol, Polyquaternium-10, Polyquaternium-7 (70/30 Acrylamide/Dadmac, Polysiloxane, Polysorbate 20, Polysorbate 40, Polysorbate 60, Polysorbate 65, Polysorbate 80, Polyurethane, Polyvinyl Acetate, Polyvinyl Alcohol, Polyvinyl Chloride, Polyvinyl Chloride-Polyvinyl Acetate Copolymer, Polyvinylpyridine, Poppy Seed Oil, Potash, Potassium Acetate, Potassium Alum, Potassium Bicarbonate, Potassium Bisulfite, Potassium Chloride, Potassium Citrate, Potassium Hydroxide, Potassium Metabisulfite, Potassium Phosphate, Dibasic, Potassium Phosphate, Monobasic, Potassium Soap, Potassium Sorbate, Povidone Acrylate Copolymer, Povidone Hydrogel, Povidone K17, Povidone K25, Povidone K29/32, Povidone K30, Povidone K90, Povidone K90f, Povidone/Eicosene Copolymer, Povidones, Ppg-12/Smdi Copolymer, Ppg-15 Stearyl Ether, Ppg-20 Methyl Glucose Ether Distearate, Ppg-26 Oleate, Product Wat, Proline, Promulgen D, Promulgen G, Propane, Propellant A-46, Propyl Gallate, Propylene Carbonate, Propylene Glycol, Propylene Glycol Diacetate, Propylene Glycol Dicaprylate, Propylene Glycol Monolaurate, Propylene Glycol Monopalmitostearate, Propylene Glycol Palmitostearate, Propylene Glycol Ricinoleate, Propylene Glycol/Diazolidinyl UrealMethylparaben/Propylparben, Propylparaben, Protamine Sulfate, Protein Hydrolysate, Pvm/Ma Copolymer, Quaternium-15, Quaternium-15 Cis-Form, Quaternium-52, Ra-2397, Ra-3011, Saccharin, Saccharin Sodium, Saccharin Sodium Anhydrous, Safflower Oil, Sd Alcohol 3a, Sd Alcohol 40, Sd Alcohol 40-2, Sd Alcohol 40b, Sepineo P 600, Serine, Sesame Oil, Shea Butter, Silastic Brand Medical Grade Tubing, Silastic Medical Adhesive, Silicone Type A, Silica, Dental, Silicon, Silicon Dioxide, Silicon Dioxide, Colloidal, Silicone, Silicone Adhesive 4102, Silicone Adhesive 4502, Silicone Adhesive Bio-Psa Q7-4201, Silicone Adhesive Bio-Psa Q7-4301, Silicone Emulsion, Silicone/Polyester Film Strip, Simethicone, Simethicone Emulsion, Sipon Ls 20np, Soda Ash, Sodium Acetate, Sodium Acetate Anhydrous, Sodium Alkyl Sulfate, Sodium Ascorbate, Sodium Benzoate, Sodium Bicarbonate, Sodium Bisulfate, Sodium Bisulfite, Sodium Borate, Sodium Borate Decahydrate, Sodium Carbonate, Sodium Carbonate Decahydrate, Sodium Carbonate Monohydrate, Sodium Cetostearyl Sulfate, Sodium Chlorate, Sodium Chloride, Sodium Chloride Injection, Sodium Chloride Injection, Bacteriostatic, Sodium Cholesteryl Sulfate, Sodium Citrate, Sodium Cocoyl Sarcosinate, Sodium Desoxycholate, Sodium Dithionite, Sodium Dodecylbenzenesulfonate, Sodium Formaldehyde Sulfoxylate, Sodium Gluconate, Sodium Hydroxide, Sodium Hypochlorite, Sodium Iodide, Sodium Lactate, Sodium Lactate, L-, Sodium Laureth-2 Sulfate, Sodium Laureth-3 Sulfate, Sodium Laureth-5 Sulfate, Sodium Lauroyl Sarcosinate, Sodium Lauryl Sulfate, Sodium Lauryl Sulfoacetate, Sodium Metabisulfite, Sodium Nitrate, Sodium Phosphate, Sodium Phosphate Dihydrate, Sodium Phosphate, Dibasic, Sodium Phosphate, Dibasic, Anhydrous, Sodium Phosphate, Dibasic, Dihydrate, Sodium Phosphate, Dibasic, Dodecahydrate, Sodium Phosphate, Dibasic, Heptahydrate, Sodium Phosphate, Monobasic, Sodium Phosphate, Monobasic, Anhydrous, Sodium Phosphate, Monobasic, Dihydrate, Sodium Phosphate, Monobasic, Monohydrate, Sodium Polyacrylate (2500000 Mw), Sodium Pyrophosphate, Sodium Pyrrolidone Carboxylate, Sodium Starch Glycolate, Sodium Succinate Hexahydrate, Sodium Sulfate, Sodium Sulfate Anhydrous, Sodium Sulfate Decahydrate, Sodium Sulfite, Sodium Sulfosuccinated Undecyclenic Monoalkylolamide, Sodium Tartrate, Sodium Thioglycolate, Sodium Thiomalate, Sodium Thiosulfate, Sodium Thiosulfate Anhydrous, Sodium Trimetaphosphate, Sodium Xylenesulfonate, Somay 44, Sorbic Acid, Sorbitan, Sorbitan Isostearate, Sorbitan Monolaurate, Sorbitan Monooleate, Sorbitan Monopalmitate, Sorbitan Monostearate, Sorbitan Sesquioleate, Sorbitan Trioleate, Sorbitan Tristearate, Sorbitol, Sorbitol Solution, Soybean Flour, Soybean Oil, Spearmint Oil, Spermaceti, Squalane, Stabilized Oxychloro Complex, Stannous 2-Ethylhexanoate, Stannous Chloride, Stannous Chloride Anhydrous, Stannous Fluoride, Stannous Tartrate, Starch, Starch 1500, Pregelatinized, Starch, Corn, Stearalkonium Chloride, Stearalkonium Hectorite/Propylene Carbonate, Stearamidoethyl Diethylamine, Steareth-10, Steareth-100, Steareth-2, Steareth-20, Steareth-21, Steareth-40, Stearic Acid, Stearic Diethanolamide, Stearoxytrimethylsilane, Steartrimonium Hydrolyzed Animal Collagen, Stearyl Alcohol, Sterile Water For Inhalation, Styrene/Isoprene/Styrene Block Copolymer, Succimer, Succinic Acid, Sucralose, Sucrose, Sucrose Distearate, Sucrose Polyesters, Sulfacetamide Sodium, Sulfobutylether .Beta.-Cyclodextrin, Sulfur Dioxide, Sulfuric Acid, Sulfurous Acid, Surfactol Qs, Tagatose, D-, Talc, Tall Oil, Tallow Glycerides, Tartaric Acid, Tartaric Acid, DI-, Tenox, Tenox-2, Tert-Butyl Alcohol, Tert-Butyl Hydroperoxide, Tert-Butylhydroquinone, Tetrakis(2-Methoxylsobutyllsocyanide)Copper(I) Tetrafluoroborate, Tetrapropyl Orthosilicate, Tetrofosmin, Theophylline, Thimerosal, Threonine, Thymol, Tin, Titanium Dioxide, Tocopherol, Tocophersolan, Triacetin, Tricaprylin, Trichloromonofluoromethane, Trideceth-10, Triethanolamine Lauryl Sulfate, Trifluoroacetic Acid, Triglycerides, Medium Chain, Trihydroxystearin, Trilaneth-4 Phosphate, Trilaureth-4 Phosphate, Trisodium Citrate Dihydrate, Trisodium Hedta, Triton 720, Triton X-200, Trolamine, Tromantadine, Tromethamine, Tryptophan, Tyloxapol, Tyrosine, Undecylenic Acid, Union 76 Amsco-Res 6038, Urea, Valine, Vegetable Oil, Vegetable Oil Glyceride, Hydrogenated, Vegetable Oil, Hydrogenated, Versetamide, Viscarin, Viscose/Cotton, Vitamin E, Wax, Emulsifying, Wecobee Fs, White Ceresin Wax, White Wax, Xanthan Gum, Zinc, Zinc Acetate, Zinc Carbonate, Zinc Chloride, and/or Zinc Oxide.

V. Dosing and Administration and Delivery

Dosing

The present invention provides methods comprising administering any one or more or component of a biocircuit system to a subject in need thereof. These may be administered to a subject using any amount and any route of administration effective for preventing or treating or imaging a disease, disorder, and/or condition (e.g., a disease, disorder, and/or condition relating to working memory deficits). The exact amount required will vary from subject to subject, depending on the species, age, and general condition of the subject, the severity of the disease, the particular composition, its mode of administration, its mode of activity, and the like.

Compositions in accordance with the invention are typically formulated in dosage unit form for ease of administration and uniformity of dosage. It will be understood, however, that the total daily usage of the compositions of the present invention may be decided by the attending physician within the scope of sound medical judgment. The specific therapeutically effective, prophylactically effective, or appropriate imaging dose level for any particular patient will depend upon a variety of factors including the disorder being treated and the severity of the disorder; the activity of the specific compound employed; the specific composition employed; the age, body weight, general health, sex and diet of the patient; the time of administration, route of administration, and rate of excretion of the specific compound employed; the duration of the treatment; drugs used in combination or coincidental with the specific compound employed; and like factors well known in the medical arts.

Administration

The pharmaceutical compositions, biocircuits, biocircuit components, effector modules including their SREs or payloads of the present invention may be administered by any route to achieve a therapeutically effective outcome. These include, but are not limited to enteral (into the intestine), gastroenteral, epidural (into the dura matter), oral (by way of the mouth), transdermal, peridural, intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intravenous bolus, intravenous drip, intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection (into a pathologic cavity) intracavitary (into the base of the penis), intravaginal administration, intrauterine, extra-amniotic administration, transdermal (diffusion through the intact skin for systemic distribution), transmucosal (diffusion through a mucous membrane), transvaginal, insufflation (snorting), sublingual, sublabial, enema, eye drops (onto the conjunctiva), in ear drops, auricular (in or by way of the ear), buccal (directed toward the cheek), conjunctival, cutaneous, dental (to a tooth or teeth), electro-osmosis, endocervical, endosinusial, endotracheal, extracorporeal, hemodialysis, infiltration, interstitial, intra-abdominal, intra-amniotic, intra-articular, intrabiliary, intrabronchial, intrabursal, intracartilaginous (within a cartilage), intracaudal (within the cauda equine), intracisternal (within the cisterna magna cerebellomedularis), intracorneal (within the cornea), dental intracornal, intracoronary (within the coronary arteries), intracorporus cavernosum (within the dilatable spaces of the corpus cavernosa of the penis), intradiscal (within a disc), intraductal (within a duct of a gland), intraduodenal (within the duodenum), intradural (within or beneath the dura), intraepidermal (to the epidermis), intraesophageal (to the esophagus), intragastric (within the stomach), intragingival (within the gingivae), intraileal (within the distal portion of the small intestine), intralesional (within or introduced directly to a localized lesion), intraluminal (within a lumen of a tube), intralymphatic (within the lymph), intramedullary (within the marrow cavity of a bone), intrameningeal (within the meninges), intramyocardial (within the myocardium), intraocular (within the eye), intraovarian (within the ovary), intrapericardial (within the pericardium), intrapleural (within the pleura), intraprostatic (within the prostate gland), intrapulmonary (within the lungs or its bronchi), intrasinal (within the nasal or periorbital sinuses), intraspinal (within the vertebral column), intrasynovial (within the synovial cavity of a joint), intratendinous (within a tendon), intratesticular (within the testicle), intrathecal (within the cerebrospinal fluid at any level of the cerebrospinal axis), intrathoracic (within the thorax), intratubular (within the tubules of an organ), intratumor (within a tumor), intratympanic (within the aurus media), intravascular (within a vessel or vessels), intraventricular (within a ventricle), iontophoresis (by means of electric current where ions of soluble salts migrate into the tissues of the body), irrigation (to bathe or flush open wounds or body cavities), laryngeal (directly upon the larynx), nasogastric (through the nose and into the stomach), occlusive dressing technique (topical route administration which is then covered by a dressing which occludes the area), ophthalmic (to the external eye), oropharyngeal (directly to the mouth and pharynx), parenteral, percutaneous, periarticular, peridural, perineural, periodontal, rectal, respiratory (within the respiratory tract by inhaling orally or nasally for local or systemic effect), retrobulbar (behind the pons or behind the eyeball), intramyocardial (entering the myocardium), soft tissue, subarachnoid, subconjunctival, submucosal, topical, transplacental (through or across the placenta), transtracheal (through the wall of the trachea), transtympanic (across or through the tympanic cavity), ureteral (to the ureter), urethral (to the urethra), vaginal, caudal block, diagnostic, nerve block, biliary perfusion, cardiac perfusion, photopheresis or spinal.

Parenteral and Injectable Administration

In some embodiments, pharmaceutical compositions, biocircuits, biocircuit components, effector modules including their SREs or payloads of the present invention may be administered parenterally. Liquid dosage forms for oral and parenteral administration include, but are not limited to, pharmaceutically acceptable emulsions, microemulsions, solutions, suspensions, syrups, and/or elixirs. In addition to active ingredients, liquid dosage forms may comprise inert diluents commonly used in the art such as, for example, water or other solvents, solubilizing agents and emulsifiers such as ethyl alcohol, isopropyl alcohol, ethyl carbonate, ethyl acetate, benzyl alcohol, benzyl benzoate, propylene glycol, 1,3-butylene glycol, dimethylformamide, oils (in particular, cottonseed, groundnut, corn, germ, olive, castor, and sesame oils), glycerol, tetrahydrofurfuryl alcohol, polyethylene glycols and fatty acid esters of sorbitan, and mixtures thereof. Besides inert diluents, oral compositions can include adjuvants such as wetting agents, emulsifying and suspending agents, sweetening, flavoring, and/or perfuming agents. In certain embodiments for parenteral administration, compositions are mixed with solubilizing agents such as CREMOPHOR®, alcohols, oils, modified oils, glycols, polysorbates, cyclodextrins, polymers, and/or combinations thereof. In other embodiments, surfactants are included such as hydroxypropylcellulose.

Injectable preparations, for example, sterile injectable aqueous or oleaginous suspensions may be formulated according to the known art using suitable dispersing agents, wetting agents, and/or suspending agents. Sterile injectable preparations may be sterile injectable solutions, suspensions, and/or emulsions in nontoxic parenterally acceptable diluents and/or solvents, for example, as a solution in 1,3-butanediol. Among the acceptable vehicles and solvents that may be employed are water, Ringer's solution, U.S.P., and isotonic sodium chloride solution. Sterile, fixed oils are conventionally employed as a solvent or suspending medium. For this purpose, any bland fixed oil can be employed including synthetic mono- or diglycerides. Fatty acids such as oleic acid can be used in the preparation of injectables.

Injectable formulations may be sterilized, for example, by filtration through a bacterial-retaining filter, and/or by incorporating sterilizing agents in the form of sterile solid compositions which can be dissolved or dispersed in sterile water or other sterile injectable medium prior to use.

In order to prolong the effect of active ingredients, it is often desirable to slow the absorption of active ingredients from subcutaneous or intramuscular injections. This may be accomplished by the use of liquid suspensions of crystalline or amorphous material with poor water solubility. The rate of absorption of active ingredients depends upon the rate of dissolution which, in turn, may depend upon crystal size and crystalline form. Alternatively, delayed absorption of a parenterally administered drug form is accomplished by dissolving or suspending the drug in an oil vehicle. Injectable depot forms are made by forming microencapsule matrices of the drug in biodegradable polymers such as polylactide-polyglycolide. Depending upon the ratio of drug to polymer and the nature of the particular polymer employed, the rate of drug release can be controlled. Examples of other biodegradable polymers include poly(orthoesters) and poly(anhydrides). Depot injectable formulations are prepared by entrapping the drug in liposomes or microemulsions which are compatible with body tissues.

Rectal and Vaginal Administration

In some embodiments, pharmaceutical compositions, biocircuits, biocircuit components, effector modules including their SREs or payloads of the present invention may be administered rectally and/or vaginally. Compositions for rectal or vaginal administration are typically suppositories which can be prepared by mixing compositions with suitable non-irritating excipients such as cocoa butter, polyethylene glycol or a suppository wax which are solid at ambient temperature but liquid at body temperature and therefore melt in the rectum or vaginal cavity and release the active ingredient.

Oral Administration

In some embodiments, pharmaceutical compositions, biocircuits, biocircuit components, effector modules including their SREs or payloads of the present invention may be administered orally. Solid dosage forms for oral administration include capsules, tablets, pills, powders, and granules. In such solid dosage forms, an active ingredient is mixed with at least one inert, pharmaceutically acceptable excipient such as sodium citrate or dicalcium phosphate and/or fillers or extenders (e.g. starches, lactose, sucrose, glucose, mannitol, and silicic acid), binders (e.g. carboxymethylcellulose, alginates, gelatin, polyvinylpyrrolidinone, sucrose, and acacia), humectants (e.g. glycerol), disintegrating agents (e.g. agar, calcium carbonate, potato or tapioca starch, alginic acid, certain silicates, and sodium carbonate), solution retarding agents (e.g. paraffin), absorption accelerators (e.g. quaternary ammonium compounds), wetting agents (e.g. cetyl alcohol and glycerol monostearate), absorbents (e.g. kaolin and bentonite clay), and lubricants (e.g. talc, calcium stearate, magnesium stearate, solid polyethylene glycols, sodium lauryl sulfate), and mixtures thereof. In the case of capsules, tablets and pills, the dosage form may comprise buffering agents.

Topical or Transdermal Administration

As described herein, pharmaceutical compositions, biocircuits, biocircuit components, effector modules including their SREs or payloads of the present invention may be formulated for administration topically. The skin may be an ideal target site for delivery as it is readily accessible. Three routes are commonly considered to deliver pharmaceutical compositions, biocircuits, biocircuit components, effector modules including their SREs or payloads of the present invention to the skin: (i) topical application (e.g. for local/regional treatment and/or cosmetic applications); (ii) intradermal injection (e.g. for local/regional treatment and/or cosmetic applications); and (iii) systemic delivery (e.g. for treatment of dermatologic diseases that affect both cutaneous and extracutaneous regions). Pharmaceutical compositions, biocircuits, biocircuit components, effector modules including their SREs or payloads of the present invention can be delivered to the skin by several different approaches known in the art.

In some embodiments, the invention provides for a variety of dressings (e.g., wound dressings) or bandages (e.g., adhesive bandages) for conveniently and/or effectively carrying out methods of the present invention. Typically dressing or bandages may comprise sufficient amounts of pharmaceutical compositions, biocircuits, biocircuit components, effector modules including their SREs or payloads of the present invention described herein to allow users to perform multiple treatments.

Dosage forms for topical and/or transdermal administration may include ointments, pastes, creams, lotions, gels, powders, solutions, sprays, inhalants and/or patches. Generally, active ingredients are admixed under sterile conditions with pharmaceutically acceptable excipients and/or any needed preservatives and/or buffers. Additionally, the present invention contemplates the use of transdermal patches, which often have the added advantage of providing controlled delivery of pharmaceutical compositions, biocircuits, biocircuit components, effector modules including their SREs or payloads of the present invention to the body. Such dosage forms may be prepared, for example, by dissolving and/or dispensing pharmaceutical compositions, biocircuits, biocircuit components, effector modules including their SREs or payloads in the proper medium. Alternatively, or additionally, rates may be controlled by either providing rate controlling membranes and/or by dispersing pharmaceutical compositions, biocircuits, biocircuit components, effector modules including their SREs or payloads in a polymer matrix and/or gel.

Formulations suitable for topical administration include, but are not limited to, liquid and/or semi liquid preparations such as liniments, lotions, oil in water and/or water in oil emulsions such as creams, ointments and/or pastes, and/or solutions and/or suspensions.

Topically-administrable formulations may, for example, comprise from about 1% to about 10% (w/w) active ingredient, although the concentration of active ingredient may be as high as the solubility limit of the active ingredient in the solvent. Formulations for topical administration may further comprise one or more of the additional ingredients described herein.

Depot Administration

As described herein, in some embodiments, pharmaceutical compositions, biocircuits, biocircuit components, effector modules including their SREs or payloads of the present invention are formulated in depots for extended release. Generally, specific organs or tissues ("target tissues") are targeted for administration.

In some aspects of the invention, pharmaceutical compositions, biocircuits, biocircuit components, effector modules including their SREs or payloads of the present invention are spatially retained within or proximal to target tissues. Provided are method of providing pharmaceutical compositions, biocircuits, biocircuit components, effector modules including their SREs or payloads to target tissues of mammalian subjects by contacting target tissues (which comprise one or more target cells) with pharmaceutical compositions, biocircuits, biocircuit components, effector modules including their SREs or payloads under conditions such that they are substantially retained in target tissues, meaning that at least 10, 20, 30, 40, 50, 60, 70, 80, 85, 90, 95, 96, 97, 98, 99, 99.9, 99.99 or greater than 99.99% of the composition is retained in the target tissues. Advantageously, retention is determined by measuring the amount of pharmaceutical compositions, biocircuits, biocircuit components, effector modules including their SREs or payloads that enter one or more target cells. For example, at least 1%, 5%, 10%, 20%, 30%, 40%, 50%, 60%, 70%, 80%, 85%, 90%, 95%, 96%, 97%, 98%, 99%, 99.9%, 99.99% or greater than 99.99% of pharmaceutical compositions, biocircuits, biocircuit components, effector modules including their SREs or payloads administered to subjects are present intracellularly at a period of time following administration. For example, intramuscular injection to mammalian subjects may be performed using aqueous compositions comprising pharmaceutical compositions, biocircuits, biocircuit components, effector modules including their SREs or payloads of the present invention and one or more transfection reagent, and retention is determined by measuring the amount of pharmaceutical compositions, biocircuits, biocircuit components, effector modules including their SREs or payloads present in muscle cells.

Certain aspects of the invention are directed to methods of providing pharmaceutical compositions, biocircuits, biocircuit components, effector modules including their SREs or payloads of the present invention to a target tissues of mammalian subjects, by contacting target tissues (comprising one or more target cells) with pharmaceutical compositions, biocircuits, biocircuit components, effector modules including their SREs or payloads under conditions such that they are substantially retained in such target tissues. Pharmaceutical compositions, biocircuits, biocircuit components, effector modules including their SREs or payloads comprise enough active ingredient such that the effect of interest is produced in at least one target cell. In some embodiments, pharmaceutical compositions, biocircuits, biocircuit components, effector modules including their SREs or payloads generally comprise one or more cell penetration agents, although "naked" formulations (such as without cell penetration agents or other agents) are also contemplated, with or without pharmaceutically acceptable carriers.

In some embodiments, the amount of a growth factor present in cells in a tissue is desirably increased. Preferably, this increase in growth factor is spatially restricted to cells within the target tissue. Thus, provided are methods of increasing the amount of growth factor of interest in tissues of mammalian subjects. In some embodiments, formulations are provided comprising pharmaceutical compositions, biocircuits, biocircuit components, effector modules including their SREs or payloads characterized in that the unit quantity provided has been determined to produce a desired level of growth factor of interest in a substantial percentage of cells contained within predetermined volumes of target tissue.

In some embodiments, formulations comprise a plurality of different pharmaceutical compositions, biocircuits, biocircuit components, effector modules including their SREs or payloads, where one or more than one targets biomolecules of interest. Optionally, formulations may also comprise cell penetration agents to assist in the intracellular delivery of pharmaceutical compositions, biocircuits, biocircuit components, effector modules including their SREs or payloads. In such embodiments, determinations are made of compound and/or composition dose required to target biomolecules of interest in substantial percentages of cells contained within predetermined volumes of the target tissue (generally, without targeting biomolecules of interest in adjacent or distal tissues.) Determined doses are then introduced directly into subject tissues. In some embodiments, the invention provides for pharmaceutical compositions, biocircuits, biocircuit components, effector modules including their SREs or payloads to be delivered in more than one administration or by split dose administration.

Pulmonary Administration

In some embodiments, pharmaceutical compositions, biocircuits, biocircuit components, effector modules including their SREs or payloads of the present invention may be prepared, packaged, and/or sold in formulations suitable for pulmonary administration. In some embodiments, such administration is via the buccal cavity. In some embodiments, formulations may comprise dry particles comprising active ingredients. In such embodiments, dry particles may have a diameter in the range from about 0.5 nm to about 7 nm or from about 1 nm to about 6 nm. In some embodiments, formulations may be in the form of dry powders for administration using devices comprising dry powder reservoirs to which streams of propellant may be directed to disperse such powder. In some embodiments, self-propelling solvent/powder dispensing containers may be used. In such embodiments, active ingredients may be dissolved and/or suspended in low-boiling propellant in sealed containers. Such powders may comprise particles wherein at least 98% of the particles by weight have diameters greater than 0.5 nm and at least 95% of the particles by number have diameters less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form.

Low boiling propellants generally include liquid propellants having a boiling point of below 65° F. at atmospheric pressure. Generally, propellants may constitute 50% to 99.9% (w/w) of the composition, and active ingredient may constitute 0.1% to 20% (w/w) of the composition. Propellants may further comprise additional ingredients such as liquid non-ionic and/or solid anionic surfactant and/or solid diluent (which may have particle sizes of the same order as particles comprising active ingredients).

Pharmaceutical compositions formulated for pulmonary delivery may provide active ingredients in the form of droplets of solution and/or suspension. Such formulations may be prepared, packaged, and/or sold as aqueous and/or dilute alcoholic solutions and/or suspensions, optionally sterile, comprising active ingredients, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm.

Intranasal, Nasal and Buccal Administration

In some embodiments, pharmaceutical compositions, biocircuits, biocircuit components, effector modules including their SREs or payloads of the present invention may be administered nasally and/or intranasaly. In some embodiments, formulations described herein as being useful for pulmonary delivery may also be useful for intranasal delivery. In some embodiments, formulations for intranasal administration comprise a coarse powder comprising the active ingredient and having an average particle from about 0.2 μm to 500 μm. Such formulations are administered in the manner in which snuff is taken, i.e. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, 0.1% to 20% (w/w) active ingredient, the balance comprising an orally dissolvable and/or degradable composition and, optionally, one or more of the additional ingredients described herein. Alternately, formulations suitable for buccal administration may comprise powders and/or an aerosolized and/or atomized solutions and/or suspensions comprising active ingredients. Such powdered, aerosolized, and/or aerosolized formulations, when dispersed, may comprise average particle and/or droplet sizes in the range of from about 0.1 nm to about 200 nm, and may further comprise one or more of any additional ingredients described herein.

Ophthalmic or Otic Administration

In some embodiments, pharmaceutical compositions, biocircuits, biocircuit components, effector modules including their SREs or payloads of the present invention may be prepared, packaged, and/or sold in formulations suitable for ophthalmic and/or otic administration. Such formulations may, for example, be in the form of eye and/or ear drops including, for example, a 0.1/1.0% (w/w) solution and/or suspension of the active ingredient in aqueous and/or oily liquid excipients. Such drops may further comprise buffering agents, salts, and/or one or more other of any additional ingredients described herein. Other ophthalmically-administrable formulations which are useful include those which comprise active ingredients in microcrystalline form and/or in liposomal preparations. Subretinal inserts may also be used as forms of administration.

Delivery

Naked Delivery

Pharmaceutical compositions, biocircuits, biocircuit components, effector modules including their SREs or payloads of the present invention may be delivered to cells, tissues, organs and/or organisms in naked form. As used herein in, the term "naked" refers to pharmaceutical compositions, biocircuits, biocircuit components, effector modules including their SREs or payloads delivered free from agents or modifications which promote transfection or permeability. The naked pharmaceutical compositions, biocircuits, biocircuit components, effector modules including their SREs or payloads may be delivered to the cells, tissues, organs and/or organisms using routes of administration known in the art and described herein. In some embodiments, naked delivery may include formulation in a simple buffer such as saline or PBS.

Formulated Delivery

In some embodiments, pharmaceutical compositions, biocircuits, biocircuit components, effector modules including their SREs or payloads of the present invention may be formulated, using methods described herein. Formulations may comprise pharmaceutical compositions, biocircuits, biocircuit components, effector modules including their SREs or payloads which may be modified and/or unmodified. Formulations may further include, but are not limited to, cell penetration agents, pharmaceutically acceptable carriers, delivery agents, bioerodible or biocompatible polymers, solvents, and/or sustained-release delivery depots. Formulations of the present invention may be delivered to cells using routes of administration known in the art and described herein.

Pharmaceutical compositions, biocircuits, biocircuit components, effector modules including their SREs or payloads may also be formulated for direct delivery to organs or tissues in any of several ways in the art including, but not limited to, direct soaking or bathing, via a catheter, by gels, powder, ointments, creams, gels, lotions, and/or drops, by using substrates such as fabric or biodegradable materials coated or impregnated with compositions, and the like.

Detectable Agents and LABELS

The stimuli, biocircuit systems and components, effector modules including the SREs and payloads may be associated with or bound to one or more radioactive agents or detectable agents.

These agents include various organic small molecules, inorganic compounds, nanoparticles, enzymes or enzyme substrates, fluorescent materials, luminescent materials (e.g., luminol), bioluminescent materials (e.g., luciferase, luciferin, and aequorin), chemiluminescent materials, radioactive materials (e.g., $^{18}$F, $^{67}$Ga, $^{81m}$Kr, $^{82}$Rb, $^{111}$In, $^{123}$I, $^{133}$Xe, $^{201}$Tl, $^{125}$I, $^{35}$S, $^{14}$C, $^{3}$H, or $^{99m}$Tc (e.g., as pertechnetate (technetate(VII), TcO$_4^-$)), and contrast agents (e.g., gold (e.g., gold nanoparticles), gadolinium (e.g., chelated Gd), iron oxides (e.g., superparamagnetic iron oxide (SPIO), monocrystalline iron oxide nanoparticles (MIONs), and ultrasmall superparamagnetic iron oxide (USPIO)), manganese chelates (e.g., Mn-DPDP), barium sulfate, iodinated contrast media (iohexol), microbubbles, or perfluorocarbons). Such optically-detectable labels include for example, without limitation, 4-acetamido-4'-isothiocyanatostilbene-2, 2'disulfonic acid; acridine and derivatives (e.g., acridine and acridine isothiocyanate); 5-(2'-aminoethyl)aminonaphthalene-1-sulfonic acid (EDANS); 4-amino-N-[3-vinylsulfonyl)phenyl]naphthalimide-3,5 disulfonate; N-(4-anilino-1-naphthyl)maleimide; anthranilamide; BODIPY; Brilliant Yellow; coumarin and derivatives (e.g., coumarin, 7-amino-4-methylcoumarin (AMC, Coumarin 120), and 7-amino-4-trifluoromethylcoumarin (Coumarin 151)); cyanine dyes; cyanosine; 4',6-diaminidino-2-phenylindole (DAPI); 5' 5"-dibromopyrogallol-sulfonaphthalein (Bromopyrogallol Red); 7-diethylamino-3-(4'-isothiocyanatophenyl)-4-methylcoumarin; diethylenetriamine pentaacetate; 4,4'-diisothiocyanatodihydro-stilbene-2,2'-disulfonic acid; 4,4'-diisothiocyanatostilbene-2,2'-disulfonic acid; 5-[dimethylamino]-naphthalene-1-sulfonyl chloride (DNS, dansylchloride); 4-dimethylaminophenylazophenyl-4'-isothiocyanate (DABITC); eosin and derivatives (e.g., eosin and eosin isothiocyanate); erythrosin and derivatives (e.g., erythrosin B and erythrosin isothiocyanate); ethidium; fluorescein and derivatives (e.g., 5-carboxyfluorescein (FAM), 5-(4,6-dichlorotriazin-2-yl)aminofluorescein (DTAF), 2',7'-dimethoxy-4'5'-dichloro-6-carboxyfluorescein, fluorescein, fluorescein isothiocyanate, X-rhodamine-5-(and-6)-isothiocyanate (QFITC or XRITC), and fluorescamine); 2-[2-[3-[[1,3-dihydro-1,1-dimethyl-3-(3-sulfopropyl)-2H-benz[e]indol-2-ylidene]ethylidene]-2-[4-(ethoxycarbonyl)-1-piperazinyl]-1-cyclopenten-1-yl]ethenyl]-1,1-dimethyl-3-(3-sulforpropyl)-1H-benz[e]indolium hydroxide, inner salt, compound with n,n-diethylethanamine (1:1) (IR144); 5-chloro-2-[2-[3-[(5-chloro-3-ethyl-2(3H)-benzothiazolylidene)ethylidene]-2-(diphenylamino)-1-cyclopenten-1-yl] ethenyl]-3-ethyl benzothiazolium perchlorate (IR140); Malachite Green isothiocyanate; 4-methylumbelliferone orthocresolphthalein; nitrotyrosine; pararosaniline; Phenol Red; B-phycoerythrin; o-phthaldialdehyde; pyrene and derivatives (e.g., pyrene, pyrene butyrate, and succinimidyl 1-pyrene); butyrate quantum dots; Reactive Red 4 (CIBACRON™ Brilliant Red 3B-A); rhodamine and derivatives (e.g., 6-carboxy-X-rhodamine (ROX), 6-carboxyrhodamine (R6G), lissamine rhodamine B sulfonyl chloride rhodarnine (Rhod), rhodamine B, rhodamine 123, rhodamine X isothiocyanate, sulforhodamine B, sulforhodamine 101, sulfonyl chloride derivative of sulforhodamine 101 (Texas Red), N,N,N',N'tetramethyl-6-carboxyrhodamine (TAMRA) tetramethyl rhodamine, and tetramethyl rhodamine isothiocyanate (TRITC)); riboflavin; rosolic acid; terbium chelate derivatives; Cyanine-3 (Cy3); Cyanine-5 (Cy5); cyanine-5.5 (Cy5.5), Cyanine-7 (Cy7); IRD 700; IRD 800; Alexa 647; La Jolta Blue; phthalo cyanine; and naphthalo cyanine.

In some embodiments, the detectable agent may be a non-detectable precursor that becomes detectable upon activation (e.g., fluorogenic tetrazine-fluorophore constructs (e.g., tetrazine-BODIPY FL, tetrazine-Oregon Green 488, or tetrazine-BODIPY TMR-X) or enzyme activatable fluorogenic agents (e.g., PROSENSE® (VisEn Medical))). In vitro assays in which the enzyme labeled compositions can be used include, but are not limited to, enzyme linked immunosorbent assays (ELISAs), immunoprecipitation assays, immunofluorescence, enzyme immunoassays (EIA), radioimmunoassays (RIA), and Western blot analysis.

Kits

The present invention includes a variety of kits for conveniently and/or effectively carrying out methods of the present invention. Typically, kits will comprise sufficient amounts and/or numbers of components to allow a user to perform one or multiple treatments of a subject(s) and/or to perform one or multiple experiments.

In one embodiment, the present invention provides kits for inhibiting genes in vitro or in vivo, comprising a biocircuit of the present invention or a combination of biocircuits of the present invention, optionally in combination with any other suitable active agents.

The kit may further comprise packaging and instructions and/or a delivery agent to form a formulation composition. The delivery agent may comprise, for example, saline, a buffered solution.

In additional embodiments, assay screening kits are provided. The kit includes a container for the screening assay. An instruction for the use of the assay and the information about the screening method are to be included in the kit.

VI. Delivery Modalities and/or Vectors

The biocircuit systems, effector modules, SREs and/or payloads of the present invention may be delivered using one or more modalities. The present invention also provides vectors that package polynucleotides of the invention encoding biocircuits, effector modules, SREs (DDs) and payload constructs, and combinations thereof. Vectors of the present invention may also be used to deliver the packaged polynucleotides to a cell, a local tissue site or a subject. These vectors may be of any kind, including DNA vectors, RNA vectors, plasmids, viral vectors and particles. Viral vector technology is well known and described in Sambrook et al. (2001, Molecular Cloning: A Laboratory Manual, Cold Spring Harbor Laboratory, New York). Viruses, which are useful as vectors include, but are not limited to lentiviral vectors, adenoviral vectors, adeno-associated viral (AAV) vectors, herpes simplex viral vectors, retroviral vectors, oncolytic viruses, and the like.

In general, vectors contain an origin of replication functional in at least one organism, a promoter sequence and convenient restriction endonuclease site, and one or more selectable markers e.g. a drug resistance gene.

As used herein a promoter is defined as a DNA sequence recognized by transcription machinery of the cell, required to initiate specific transcription of the polynucleotide sequence of the present invention. Vectors can comprise native or non-native promoters operably linked to the polynucleotides of the invention. The promoters selected may be strong, weak, constitutive, inducible, tissue specific, development stage-specific, and/or organism specific. One example of a suitable promoter is the immediate early cytomegalovirus (CMV) promoter, comprising the sequence of SEQ ID NO.: 213364. This promoter sequence is a strong constitutive promoter sequence capable of driving high levels of expression of polynucleotide sequence that is operatively linked to it. Another example of a preferred promoter is Elongation Growth Factor-1. Alpha (EF-1. alpha), comprising the sequence of SEQ ID NO.: 213365.

Other constitutive promoters may also be used, including, but not limited to simian virus 40 (SV40), mouse mammary tumor virus (MMTV), human immunodeficiency virus (HIV), long terminal repeat (LTR), promoter, an avian leukemia virus promoter, an Epstein-Barr virus immediate early promoter, a Rous sarcoma virus promoter as well as human gene promoters including, but not limited to the phosphoglycerate kinase (PGK) promoter, comprising the sequence of SEQ ID NO.: 213366, actin promoter, the myosin promoter, the hemoglobin promoter, the Ubiquitin C (Ubc) promoter, the human U6 small nuclear protein promoter and the creatine kinase promoter. In some instances, inducible promoters such as but not limited to metallothionine promoter, glucocorticoid promoter, a progesterone promoter, and a tetracycline promoter may be used.

In some embodiments, the optimal promoter may be selected based on its ability to achieve minimal expression of the SREs and payloads of the invention in the absence of the ligand and detectable expression in the presence of the ligand.

Additional promoter elements e.g. enhancers may be used to regulate the frequency of transcriptional initiation. Such regions may be located 10-100 base pairs upstream or downstream of the start site. In some instances, two or more promoter elements may be used to cooperatively or independently activate transcription.

In some embodiments, the recombinant expression vector may comprise regulatory sequences, such as transcription and translation initiation and termination codons, which are specific to the type of host cell into which the vector is to be introduced.

In some embodiments, the vector of the invention may comprise one or more payloads taught herein, wherein the two or more payloads may be included in one effector module. In this case, the two or more payloads are tuned by the same stimulus simultaneously. In other embodiments, the vector of the invention may comprise two or more effector modules, wherein each effector module comprises a different payload. In this case, the two or more effector modules and payloads are tuned by different stimuli, providing separately independent regulation of the two or more components.

Lentiviral Vehicles/Particles

In some embodiments, lentiviral vehicles/particles may be used as delivery modalities. Lentiviruses are subgroup of the Retroviridae family of viruses, named because reverse transcription of viral RNA genomes to DNA is required before integration into the host genome. As such, the most important features of lentiviral vehicles/particles are the integration of their genetic material into the genome of a target/host cell. Some examples of lentivirus include the Human Immunodeficiency Viruses: HIV-1 and HIV-2, the Simian Immunodeficiency Virus (SIV), feline immunodeficiency virus (FIV), bovine immunodeficiency virus (BIV), Jembrana Disease Virus (JDV), equine infectious anemia virus (EIAV), equine infectious anemia virus, visna-maedi and caprine arthritis encephalitis virus (CAEV).

Typically, lentiviral particles making up the gene delivery vehicle are replication defective on their own (also referred to as "self-inactivating"). Lentiviruses are able to infect both dividing and non-dividing cells by virtue of the entry mechanism through the intact host nuclear envelope (Naldini L et al., Curr. Opin. Biotechnol, 1998, 9: 457-463). Recombinant lentiviral vehicles/particles have been generated by multiply attenuating the HIV virulence genes, for example, the genes Env, Vif, Vpr, Vpu, Nef and Tat are deleted making the vector biologically safe. Correspondingly, lentiviral vehicles, for example, derived from HIV-1/HIV-2 can mediate the efficient delivery, integration and long-term expression of transgenes into non-dividing cells. As used herein, the term "recombinant" refers to a vector or other nucleic acid containing both lentiviral sequences and non-lentiviral retroviral sequences.

Lentiviral particles may be generated by co-expressing the virus packaging elements and the vector genome itself in a producer cell such as human HEK293T cells. These elements are usually provided in three or four separate plasmids. The producer cells are co-transfected with plasmids that encode lentiviral components including the core (i.e. structural proteins) and enzymatic components of the virus, and the envelope protein(s) (referred to as the packaging systems), and a plasmid that encodes the genome including a foreign transgene, to be transferred to the target cell, the vehicle itself (also referred to as the transfer vector). In general, the plasmids or vectors are included in a producer cell line. The plasmids/vectors are introduced via transfection, transduction or infection into the producer cell line. Methods for transfection, transduction or infection are well known by those of skill in the art. As non-limiting example, the packaging and transfer constructs can be introduced into producer cell lines by calcium phosphate transfection, lipofection or electroporation, generally together with a dominant selectable marker, such as neo, DHFR, Gln synthetase or ADA, followed by selection in the presence of the appropriate drug and isolation of clones.

The producer cell produces recombinant viral particles that contain the foreign gene, for example, the effector module of the present invention. The recombinant viral particles are recovered from the culture media and titrated by standard methods used by those of skill in the art. The recombinant lentiviral vehicles can be used to infect target cells.

Cells that can be used to produce high-titer lentiviral particles may include, but are not limited to, HEK293T cells, 293G cells, STAR cells (Relander et al., *Mol. Ther.*, 2005, 11: 452-459), FreeStyle™ 293 Expression System (ThermoFisher, Waltham, Mass.), and other HEK293T-based producer cell lines (e.g., Stewart et al., *Hum Gene Ther.* 2011, 22(3):357-369; Lee et al., *Biotechnol Bioeng,* 2012, 10996): 1551-1560; Throm et al., *Blood.* 2009, 113(21): 5104-5110; the contents of each of which are incorporated herein by reference in their entirety).

In some aspects, the envelope proteins may be heterologous envelop proteins from other viruses, such as the G protein of vesicular stomatitis virus (VSV G) or baculoviral gp64 envelop proteins. The VSV-G glycoprotein may especially be chosen among species classified in the vesiculovirus genus: Carajas virus (CJSV), Chandipura virus (CHPV), Cocal virus (COCV), Isfahan virus (ISFV), Maraba virus (MARAV), Piry virus (PIRYV), Vesicular stomatitis Alagoas virus (VSAV), Vesicular stomatitis Indiana virus (VSIV) and Vesicular stomatitis New Jersey virus (VSNJV) and/or stains provisionally classified in the vesiculovirus genus as Grass carp rhabdovirus, BeAn 157575 virus (BeAn 157575), Boteke virus (BTKV), Calchaqui virus (CQIV), Eel virus American (EVA), Gray Lodge virus (GLOV), Jurona virus (JURY), Klamath virus (KLAV), Kwatta virus (KWAV), La Joya virus (LJV), Malpais Spring virus (MSPV), Mount Elgon bat virus (MEBV), Perinet virus (PERV), Pike fry rhabdovirus (PFRV), Porton virus (PORV), Radi virus (RADIV), Spring viremia of carp virus (SVCV), Tupaia virus (TUPV), Ulcerative disease rhabdovirus (UDRV) and Yug Bogdanovac virus (YBV). The gp64 or other baculoviral env protein can be derived from *Autographa californica* nucleopolyhedrovirus (AcMNPV), *Anagrapha falcifera* nuclear polyhedrosis virus, *Bombyx mori* nuclear polyhedrosis virus, *Choristoneura fumiferana* nucleopolyhedrovirus, *Orgyia pseudotsugata* single capsid nuclear polyhedrosis virus, *Epiphyas postvittana* nucleopolyhedrovirus, *Hyphantria cunea* nucleopolyhedrovirus, *Galleria mellonella* nuclear polyhedrosis virus, Dhori virus, Thogoto virus, *Antheraea pemyi* nucleopolyhedrovirus or Batken virus.

Other elements provided in lentiviral particles may comprise retroviral LTR (long-terminal repeat) at either 5' or 3' terminus, a retroviral export element, optionally a lentiviral reverse response element (RRE), a promoter or active portion thereof, and a locus control region (LCR) or active portion thereof. The effector module is linked to the vector.

Methods for generating recombinant lentiviral particles are discussed in the art, for example, U.S. Pat. Nos. 8,846,385; 7,745,179; 7,629,153; 7,575,924; 7,179,903; and 6,808,905; the contents of each of which are incorporated herein by reference in their entirety.

Lentivirus vectors used may be selected from, but are not limited to pLVX, pLenti, pLenti6, pLJM1, FUGW, pWPXL, pWPI, pLenti CMV puro DEST, pLJM1-EGFP, pULTRA, pInducer20, pHIV-EGFP, pCW57.1, pTRPE, pELP5, pRRL, and pLionII.

Lentiviral vehicles are plasmid-based or virus-based and are known in the art (See, U.S. Pat. Nos. 9,260,725; 9,068,199; 9,023,646; 8,900,858; 8,748,169; 8,709,799; 8,420,104; 8,329,462; 8,076,106; 6,013,516; and 5,994,136; the contents of each of which are incorporated herein by reference in their entirety).

Adeno-Associated Viral Particles

Delivery of any of the biocircuits, biocircuit components, effector modules, SREs or payload constructs of the present invention may be achieved using recombinant adeno-associated viral (rAAV) vectors. Such vectors or viral particles may be designed to utilize any of the known serotype capsids or combinations of serotype capsids. Capsids may include but not limited to AAV1, AAV2, AAV2G9, AAV3, AAV3a, AAV3b, AAV3-3, AAV4, AAV4-4, AAV5, AAV6, AAV6.1, AAV6.2, AAV6.1.2, AAV7, AAV7.2, AAV8, AAV9, AAV9.11, AAV9.13, AAV9.16, AAV9.24, AAV9.45, AAV9.47, AAV9.61, AAV9.68, AAV9.84, AAV9.9, AAV10, AAV11, AAV12, AAV16.3, AAV24.1, AAV27.3, AAV42.12, AAV42-1b, AAV42-2, AAV42-3a, AAV42-3b, AAV42-4, AAV42-5a, AAV42-5b, AAV42-6b, AAV42-8, AAV42-10, AAV42-11, AAV42-12, AAV42-13, AAV42-15, AAV42-aa, AAV43-1, AAV43-12, AAV43-20, AAV43-21, AAV43-23, AAV43-25, AAV43-5, AAV44.1, AAV44.2, AAV44.5, AAV223.1, AAV223.2, AAV223.4, AAV223.5, AAV223.6, AAV223.7, AAV1-7/rh.48, AAV1-8/rh.49, AAV2-15/rh.62, AAV2-3/rh.61, AAV2-4/rh.50, AAV2-5/rh.51, AAV3.1/hu.6, AAV3.1/hu.9, AAV3-9/rh.52, AAV3-11/rh.53, AAV4-8/r11.64, AAV4-9/rh.54, AAV4-19/rh.55, AAV5-3/rh.57, AAV5-22/rh.58, AAV7.3/hu.7, AAV16.8/hu.10, AAV16.12/hu.11, AAV29.3/bb.1, AAV29.5/bb.2, AAV106.1/hu.37, AAV114.3/hu.40, AAV127.2/hu.41, AAV127.5/hu.42, AAV128.3/hu.44, AAV130.4/hu.48, AAV145.1/hu.53, AAV145.5/hu.54, AAV145.6/hu.55, AAV161.10/hu.60, AAV161.6/hu.61, AAV33.12/hu.17, AAV33.4/hu.15, AAV33.8/hu.16, AAV52/hu.19, AAV52.1/hu.20, AAV58.2/hu.25, AAVA3.3, AAVA3.4, AAVA3.5, AAVA3.7, AAVC1, AAVC2, AAVC5, AAV-DJ, AAV-DJ8, AAVF3, AAVF5, AAVH2, AAVH6, AAVLK03, AAVH-1/hu.1, AAVH-5/hu.3, AAVLG-10/rh.40, AAVLG-4/rh.38, AAVLG-9/hu.39, AAVN721-8/rh.43, AAVCh.5, AAVCh.5R1, AAVcy.2, AAVcy.3, AAVcy.4, AAVcy.5, AAVCy.5R1, AAVCy.5R2, AAVCy.5R3, AAVCy.5R4, AAVcy.6, AAVhu.1, AAVhu.2, AAVhu.3, AAVhu.4, AAVhu.5, AAVhu.6, AAVhu.7, AAVhu.9, AAVhu.10, AAVhu.11, AAVhu.13, AAVhu.15, AAVhu.16, AAVhu.17, AAVhu.18, AAVhu.20, AAVhu.21, AAVhu.22, AAVhu.23.2, AAVhu.24, AAVhu.25, AAVhu.27, AAVhu.28, AAVhu.29, AAVhu.29R, AAVhu.31, AAVhu.32, AAVhu.34, AAVhu.35, AAVhu.37, AAVhu.39, AAVhu.40, AAVhu.41, AAVhu.42, AAVhu.43, AAVhu.44, AAVhu.44R1, AAVhu.44R2, AAVhu.44R3, AAVhu.45, AAVhu.46, AAVhu.47, AAVhu.48, AAVhu.48R1, AAVhu.48R2, AAVhu.48R3, AAVhu.49, AAVhu.51, AAVhu.52, AAVhu.54, AAVhu.55, AAVhu.56, AAVhu.57, AAVhu.58, AAVhu.60, AAVhu.61, AAVhu.63, AAVhu.64, AAVhu.66, AAVhu.67, AAVhu.14/9, AAVhu.t 19, AAVrh.2, AAVrh.2R, AAVrh.8, AAVrh.8R, AAVrh.10, AAVrh.12, AAVrh.13, AAVrh.13R, AAVrh.14, AAVrh.17, AAVrh.18, AAVrh.19, AAVrh.20, AAVrh.21, AAVrh.22, AAVrh.23, AAVrh.24, AAVrh.25, AAVrh.31, AAVrh.32, AAVrh.33, AAVrh.34, AAVrh.35, AAVrh.36, AAVrh.37, AAVrh.37R2, AAVrh.38, AAVrh.39, AAVrh.40, AAVrh.46, AAVrh.48, AAVrh.48.1, AAVrh.48.1.2, AAVrh.48.2, AAVrh.49, AAVrh.51, AAVrh.52, AAVrh.53, AAVrh.54, AAVrh.56, AAVrh.57, AAVrh.58, AAVrh.61, AAVrh.64, AAVrh.64R1, AAVrh.64R2, AAVrh.67, AAVrh.73, and/or AAVrh.74.

In one embodiment, the AAV serotype may be or have a sequence as described in United States Publication No. US20030138772, herein incorporated by reference in its entirety, such as, but not limited to, AAV1 (SEQ ID NO: 6 and 64 of US20030138772), AAV2 (SEQ ID NO: 7 and 70 of US20030138772), AAV3 (SEQ ID NO: 8 and 71 of US20030138772), AAV4 (SEQ ID NO: 63 of US20030138772), AAV5 (SEQ ID NO: 114 of US20030138772), AAV6 (SEQ ID NO: 65 of US20030138772), AAV7 (SEQ ID NO: 1-3 of US20030138772), AAV8 (SEQ ID NO: 4 and 95 of US20030138772), AAV9 (SEQ ID NO: 5 and 100 of US20030138772), AAV10 (SEQ ID NO: 117 of US20030138772), AAV11 (SEQ ID NO: 118 of US20030138772), AAV12 (SEQ ID NO: 119 of US20030138772), AAVrh10 (amino acids 1 to 738 of SEQ ID NO: 81 of US20030138772) or variants thereof. Non limiting examples of variants include SEQ ID NOs: 9, 27-45, 47-62, 66-69, 73-81, 84-94, 96, 97, 99, 101-113 of US20030138772, the contents of which are herein incorporated by reference in its entirety.

In one embodiment, the AAV serotype may be or may have a sequence as described in United States Publication No. US20150159173, herein incorporated by reference in its entirety, such as, but not limited to, AAV2 (SEQ ID NO: 7 and 23 of US20150159173), rh20 (SEQ ID NO: 1 of US20150159173), rh32/33 (SEQ ID NO: 2 of US20150159173), rh39 (SEQ ID NO: 3, 20 and 36 of US20150159173), rh46 (SEQ ID NO: 4 and 22 of US20150159173), rh73 (SEQ ID NO: 5 of US20150159173), rh74 (SEQ ID NO: 6 of US20150159173), AAV6.1 (SEQ ID NO: 29 of US20150159173), rh.8 (SEQ ID NO: 41 of US20150159173), rh.48.1 (SEQ ID NO: 44 of US20150159173), hu.44 (SEQ ID NO: 45 of US20150159173), hu.29 (SEQ ID NO: 42 of US20150159173), hu.48 (SEQ ID NO: 38 of US20150159173), rh54 (SEQ ID NO: 49 of US20150159173), AAV2 (SEQ ID NO: 7 of US20150159173), cy.5 (SEQ ID NO: 8 and 24 of US20150159173), rh.10 (SEQ ID NO: 9 and 25 of US20150159173), rh.13 (SEQ ID NO: 10 and 26 of US20150159173), AAV1 (SEQ ID NO: 11 and 27 of US20150159173), AAV3 (SEQ ID NO: 12 and 28 of US20150159173), AAV6 (SEQ ID NO: 13 and 29 of US20150159173), MW (SEQ ID NO: 14 and 30 of US20150159173), AAV8 (SEQ ID NO: 15 and 31 of US20150159173), hu.13 (SEQ ID NO: 16 and 32 of US20150159173), hu.26 (SEQ ID NO: 17 and 33 of US20150159173), hu.37 (SEQ ID NO: 18 and 34 of US20150159173), hu.53 (SEQ ID NO: 19 and 35 of US20150159173), rh.43 (SEQ ID NO: 21 and 37 of US20150159173), rh2 (SEQ ID NO: 39 of US20150159173), rh.37 (SEQ ID NO: 40 of US20150159173), rh.64 (SEQ ID NO: 43 of US20150159173), rh.48 (SEQ ID NO: 44 of US20150159173), ch.5 (SEQ ID NO 46 of US20150159173), rh.67 (SEQ ID NO: 47 of US20150159173), rh.58 (SEQ ID NO: 48 of US20150159173), or variants thereof including, but not limited to Cy5R1, Cy5R2, Cy5R3, Cy5R4, rh.13R, rh.37R2, rh.2R, rh.8R, rh.48.1, rh.48.2, rh.48.1.2, hu.44R1, hu.44R2, hu.44R3, hu.29R, ch.5R1, rh64R1, rh64R2, AAV6.2, AAV6.1, AAV6.12, hu.48R1, hu.48R2, and hu.48R3.

In one embodiment, the AAV serotype may be or have the sequence as described in U.S. Pat. No. 7,198,951, herein incorporated by reference in its entirety, such as, but not limited to, AAV9 (SEQ ID NO: 1-3 of U.S. Pat. No. 7,198,951), AAV2 (SEQ ID NO: 4 of U.S. Pat. No. 7,198, 951), AAV1 (SEQ ID NO: 5 of U.S. Pat. No. 7,198,951), AAV3 (SEQ ID NO: 6 of U.S. Pat. No. 7,198,951), and AAV8 (SEQ ID NO: 7).

In one embodiment, the AAV serotype may be or have a mutation in the AAV9 sequence as described by N Pulicherla et al. (Molecular Therapy 19(6):1070-1078 (2011), herein incorporated by reference in its entirety), such as but not limited to, AAV9.9, AAV9.11, AAV9.13, AAV9.16, AAV9.24, AAV9.45, AAV9.47, AAV9.61, AAV9.68, AAV9.84.

In one embodiment, the AAV serotype may be or have a sequence as described in U.S. Pat. No. 6,156,303, herein incorporated by reference in its entirety, such as, but not limited to, AAV3B (SEQ ID NO: 1 and 10 of U.S. Pat. No. 6,156,303), AAV6 (SEQ ID NO: 2, 7 and 11 of U.S. Pat. No. 6,156,303), AAV2 (SEQ ID NO: 3 and 8 of U.S. Pat. No. 6,156,303), AAV3A (SEQ ID NO: 4 and 9, of U.S. Pat. No. 6,156,303), or derivatives thereof.

In one embodiment, the AAV serotype may be or may have a sequence as described in United States Publication No. US20140359799, herein incorporated by reference in its entirety, such as, but not limited to, AAV8 (SEQ ID NO: 1 of US20140359799), AAVDJ (SEQ ID NO: 2 and 3 of US20140359799), or variants thereof.

In one embodiment, the AAV serotype may be or have the sequence of AAV4 as described in International Publication No. WO1998011244, herein incorporated by reference in its entirety, such as, but not limited to AAV4 (SEQ ID NO: 1-20 of WO1998011244).

In one embodiment, the AAV serotype may be or have a mutation in the AAV2 sequence to generate AAV2G9 as described in International Publication No. WO2014144229 and herein incorporated by reference in its entirety.

In one embodiment, the AAV serotype may be or have a sequence as described in International Publication WO2005033321, herein incorporated by reference in its entirety, such as, but not limited to AAV1 (SEQ ID NO: 202 and 219 of WO2005033321), AAV2 (SEQ ID NO: 211 and 221 of WO2005033321), AAV3-3 (SEQ ID NO: 200 and 217 of WO2005033321), AAV4-4 (SEQ ID NO: 201 and 218 of WO2005033321), AAV5 (SEQ ID NO: 216 and 199 of WO2005033321), AAV6 (SEQ ID NO: 203 and 220 of WO2005033321), AAV7 (SEQ ID NO: 213 and 222 of WO2005033321), AAV8 (SEQ ID NO: 214 and 223 of WO2005033321), hu.14/AAV9 (SEQ ID NO: 3 and 123 of WO2005033321), hu.17 (SEQ ID NO: 83 of WO2005033321), hu.6 (SEQ ID NO: 84 of WO2005033321), hu.42 (SEQ ID NO: 85 of WO2005033321), rh.38 (SEQ ID NO: 86 of WO2005033321), hu.40 (SEQ ID NO: 87 of WO2005033321), hu.37 (SEQ ID NO: 88 of WO2005033321), rh.40 (SEQ ID NO: 92 of WO2005033321), rh.52 (SEQ ID NO: 96 of WO2005033321), rh.53 (SEQ ID NO: 97 of WO2005033321), rh.49 (SEQ ID NO: 103 of WO2005033321), rh.51 (SEQ ID NO: 104 of WO2005033321), rh.57 (SEQ ID NO: 105 of WO2005033321), rh.58 (SEQ ID NO: 106 of WO2005033321), rh.61 (SEQ ID NO: 107 of WO2005033321), rh.50 (SEQ ID NO: 108 of WO2005033321), rh.43 (SEQ ID NO: 163 of WO2005033321), rh.62 (SEQ ID NO: 114 of WO2005033321), rh.48 (SEQ ID NO: 115 of WO2005033321), 4-9/rh.54 (SEQ ID NO: 116 of WO2005033321), 4-19/rh.55 (SEQ ID NO: 117 of WO2005033321), hu.31 (SEQ ID NO: 121 of WO2005033321), hu.32 (SEQ ID NO: 122 of WO2005033321), hu.34 (SEQ ID NO: 125 of WO2005033321), hu.45 (SEQ ID NO: 127 of WO2005033321), hu.47 (SEQ ID NO: 128 of WO2005033321), hu.13 (SEQ ID NO: 129 of WO2005033321), hu.28 (SEQ ID NO: 130 of WO2005033321), hu.29 (SEQ ID NO: 132 of WO2005033321), hu.19 (SEQ ID NO: 133 of WO2005033321), hu.20 (SEQ ID NO: 134 of WO2005033321), hu.21 (SEQ ID NO: 135 of WO2005033321), hu.23.2 (SEQ ID NO: 137 of WO2005033321), hu.22 (SEQ ID NO: 138 of WO2005033321), hu.27 (SEQ ID NO: 140 of WO2005033321), hu.4 (SEQ ID NO: 141 of WO2005033321), hu.2 (SEQ ID NO: 143 of WO2005033321), hu.1 (SEQ ID NO: 144 of WO2005033321), hu.3 (SEQ ID NO: 145 of WO2005033321), hu.25 (SEQ ID NO: 146 of WO2005033321), hu.15 (SEQ ID NO: 147 of WO2005033321), hu.16 (SEQ ID NO: 148 of WO2005033321), hu.18 (SEQ ID NO: 149 of WO2005033321), hu.7 (SEQ ID NO: 150 of WO2005033321), hu.11 (SEQ ID NO: 153 of WO2005033321), hu.9 (SEQ ID NO: 155 of WO2005033321), hu.10 (SEQ ID NO: 156 of WO2005033321), hu.48 (SEQ ID NO: 157 of WO2005033321), hu.44 (SEQ ID NO: 144 of WO2005033321), hu.46 (SEQ ID NO: 159 of WO2005033321), hu.43 (SEQ ID NO: 160 of WO2005033321), hu.35 (SEQ ID NO: 164 of WO2005033321), hu.24 (SEQ ID NO: 136 of WO2005033321), rh.64 (SEQ ID NO: 99 of WO2005033321), hu.41 (SEQ ID NO: 91 of WO2005033321), hu.39 (SEQ ID NO: 102 of WO2005033321), hu.67 (SEQ ID NO: 198 of WO2005033321), hu.66 (SEQ ID NO: 197 of WO2005033321), hu.51 (SEQ ID NO: 190 of WO2005033321), hu.52 (SEQ ID NO: 191 of WO2005033321), hu.49 (SEQ ID NO: 189 of WO2005033321), hu.56 (SEQ ID NO: 192 of WO2005033321), hu.57 (SEQ ID NO: 193 of WO2005033321), hu.58 (SEQ ID NO: 194 of WO2005033321), hu.63 (SEQ ID NO: 195 of WO2005033321), hu.64 (SEQ ID NO: 196), hu.60 (SEQ ID NO: 184 of WO2005033321), hu.61 (SEQ ID NO: 185 of WO2005033321), hu.53 (SEQ ID NO: 186 of WO2005033321), hu.55 (SEQ ID NO: 187 of WO2005033321), hu.54 (SEQ ID NO: 188 of WO2005033321), hu.6 (SEQ ID NO: 84 of WO2005033321), rh.56 (SEQ ID NO: 152 of WO2005033321), or variants thereof. Non limiting examples of variants include SEQ ID NOs: 1, 2, 4-82, 89, 90, 93-95, 98, 100, 101, 109-113, 118-120, 124, 126, 131, 139, 142, 151, 154, 158, 161, 162, 165-183, 202, 204-212, 215, 219, 224-236 of WO2005033321, the contents of which are herein incorporated by reference in its entirety.

AAV vectors include not only single stranded vectors but self-complementary AAV vectors (scAAVs). scAAV vectors contain DNA which anneals together to form double stranded vector genome. By skipping second strand synthesis, scAAVs allow for rapid expression in the cell.

The rAAV vectors may be manufactured by standard methods in the art such as by triple transfection, in sf9 insect cells or in suspension cell cultures of human cells such as HEK293 cells.

The biocircuits, biocircuit components, effector modules, SREs or payload constructs may be encoded in one or more viral genomes to be packaged in the AAV capsids taught herein.

Such vector or viral genomes may also include, in addition to at least one or two ITRs (inverted terminal repeats), certain regulatory elements necessary for expression from the vector or viral genome. Such regulatory elements are well known in the art and include for example promoters, introns, spacers, stuffer sequences, and the like.

The biocircuits, biocircuit components, effector modules, SREs or payload constructs of the invention may be administered in one or more AAV particles.

In some embodiments, the effector modules may be administered in one or more AAV particles. In some embodiments, more than one effector module or SRE may be encoded in a viral genome.

Retroviral Vehicles/Particles (γ-Retroviral Vectors)

In some embodiments, retroviral vehicles/particles may be used to deliver the biocircuits, biocircuit components, effector modules, SREs or payload constructs of the present invention. Retroviral vectors (RVs) allow the permanent integration of a transgene in target cells. In addition to lentiviral vectors based on complex HIV-1/2, retroviral vectors based on simple gamma-retroviruses have been widely used to deliver therapeutic genes and demonstrated clinically as one of the most efficient and powerful gene delivery systems capable of transducing a broad range of cell types. Example species of Gamma retroviruses include the murine leukemia viruses (MLVs) and the feline leukemia viruses (FeLV).

In some embodiments, gamma-retroviral vectors derived from a mammalian gamma-retrovirus such as murine leukemia viruses (MLVs), are recombinant. The MLV families of gamma retroviruses include the ecotropic, amphotropic, xenotropic and polytropic subfamilies. Ecotropic viruses are able to infect only murine cells using mCAT-1 receptor. Examples of ecotropic viruses are Moloney MLV and AKV. Amphotropic viruses infect murine, human and other species through the Pit-2 receptor. One example of an amphotropic virus is the 4070A virus. Xenotropic and polytropic viruses utilize the same (Xpr1) receptor, but differ in their species tropism. Xenotropic viruses such as NZB-9-1 infect human and other species but not murine species, whereas polytropic viruses such as focus-forming viruses (MCF) infect murine, human and other species.

Gamma-retroviral vectors may be produced in packaging cells by co-transfecting the cells with several plasmids including one encoding the retroviral structural and enzymatic (gag-pol) polyprotein, one encoding the envelope (env) protein, and one encoding the vector mRNA comprising polynucleotide encoding the compositions of the present invention that is to be packaged in newly formed viral particles.

In some aspects, the recombinant gamma-retroviral vectors are pseudotyped with envelope proteins from other viruses. Envelope glycoproteins are incorporated in the outer lipid layer of the viral particles which can increase/alter the cell tropism. Exemplary envelop proteins include the gibbon ape leukemia virus envelope protein (GALV) or vesicular stomatitis virus G protein (VSV-G), or Simian endogenous retrovirus envelop protein, or Measles Virus H and F proteins, or Human immunodeficiency virus gp120 envelop protein, or cocal vesiculovirus envelop protein (See, e.g., U.S. application publication NO.: 2012/164118; the contents of which are incorporated herein by reference in its entirety). In other aspects, envelope glycoproteins may be genetically modified to incorporate targeting/binding ligands into gamma-retroviral vectors, binding ligands including, but not limited to, peptide ligands, single chain antibodies and growth factors (Waehler et al., Nat. Rev. Genet. 2007, 8(8):573-587; the contents of which are incorporated herein by reference in its entirety). These engineered glycoproteins can retarget vectors to cells expressing their corresponding target moieties. In other aspects, a "molecular bridge" may be introduced to direct vectors to specific cells. The molecular bridge has dual specificities: one end can recognize viral glycoproteins, and the other end can bind to the molecular determinant on the target cell. Such molecular bridges, for example ligand-receptor, avidin-biotin, and chemical conjugations, monoclonal antibodies and engineered fusogenic proteins, can direct the attachment of viral vectors to target cells for transduction (Yang et al., Biotechnol. Bioeng., 2008, 101(2): 357-368; and Maetzig et al., Viruses, 2011, 3, 677-713; the contents of each of which are incorporated herein by reference in their entirety).

In some embodiments, the recombinant gamma-retroviral vectors are self-inactivating (SIN) gammaretroviral vectors. The vectors are replication incompetent. SIN vectors may harbor a deletion within the 3' U3 region initially comprising enhancer/promoter activity. Furthermore, the 5' U3 region may be replaced with strong promoters (needed in the packaging cell line) derived from Cytomegalovirus or RSV, or an internal promotor of choice, and/or an enhancer element. The choice of the internal promotors may be made according to specific requirements of gene expression needed for a particular purpose of the invention.

In some embodiments, polynucleotides encoding the biocircuit, biocircuit components, effector module, SRE are inserted within the recombinant viral genome. The other components of the viral mRNA of a recombinant gamma-retroviral vector may be modified by insertion or removal of naturally occurring sequences (e.g., insertion of an IRES, insertion of a heterologous polynucleotide encoding a polypeptide or inhibitory nucleic acid of interest, shuffling of a more effective promoter from a different retrovirus or virus in place of the wild-type promoter and the like). In some examples, the recombinant gamma-retroviral vectors may comprise modified packaging signal, and/or primer binding site (PBS), and/or 5'-enhancer/promoter elements in the U3-region of the 5'-long terminal repeat (LTR), and/or 3'-SIN elements modified in the U3-region of the 3'-LTR. These modifications may increase the titers and the ability of infection.

Gammaretroviral vectors suitable for delivering biocircuit components, effector modules, SREs or payload constructs of the present invention may be selected from those disclosed in U.S. Pat. Nos. 8,828,718; 7,585,676; 7,351,585; U.S. application publication NO.: 2007/048285; PCT application publication NOs.: WO2010/113037; WO2014/121005; WO2015/056014; and EP Pat. NOs.: EP1757702; EP1757703 (the contents of each of which are incorporated herein by reference in their entirety).

Oncolytic Viral Vector

In some embodiments, polynucleotides of present invention may be packaged into oncolytic viruses. As used herein, the term "oncolytic virus" refers to a virus that preferentially infects and kills cancer cells such as vaccine viruses. An oncolytic virus can occur naturally or can be a genetically modified virus such as oncolytic adenovirus, and oncolytic herpes virus.

In some embodiments, oncolytic vaccine viruses may include viral particles of a thymidine kinase (TK)-deficient, granulocyte macrophage (GM)-colony stimulating factor (CSF)-expressing, replication-competent vaccinia virus vector sufficient to induce oncolysis of cells in the tumor; See e.g., U.S. Pat. No. 9,226,977; the contents of which are incorporated herein by reference in their entirety.

Messenger RNA (mRNA)

In some embodiments, the effector modules of the invention may be designed as a messenger RNA (mRNA). As used herein, the term "messenger RNA" (mRNA) refers to any polynucleotide which encodes a polypeptide of interest and which is capable of being translated to produce the encoded polypeptide of interest in vitro, in vivo, in situ or ex vivo. Such mRNA molecules may have the structural components or features of any of those taught in International Application number PCT/US2013/030062, the contents of which are incorporated herein by reference in its entirety.

Polynucleotides of the invention may also be designed as taught in, for example, Ribostem Limited in United Kingdom patent application serial number 0316089.2 filed on Jul. 9, 2003 now abandoned, PCT application number PCT/GB2004/002981 filed on Jul. 9, 2004 published as WO2005005622, U.S. patent application national phase entry Ser. No. 10/563,897 filed on Jun. 8, 2006 published as US20060247195 now abandoned, and European patent application national phase entry serial number EP2004743322 filed on Jul. 9, 2004 published as EP1646714 now withdrawn; Novozymes, Inc. in PCT application number PCT/US2007/88060 filed on Dec. 19, 2007 published as WO2008140615, United States patent application national phase entry Ser. No. 12/520,072 filed on Jul. 2, 2009 published as US20100028943 and European patent application national phase entry serial number EP2007874376 filed on Jul. 7, 2009 published as EP2104739; University of Rochester in PCT application number PCT/US2006/46120 filed on Dec. 4, 2006 published as WO2007064952 and U.S. patent application Ser. No. 11/606,995 filed on Dec. 1, 2006 published as US20070141030; BioNTech AG in European patent application serial number EP2007024312 filed Dec. 14, 2007 now abandoned, PCT application number PCT/EP2008/01059 filed on Dec. 12, 2008 published as WO2009077134, European patent application national phase entry serial number EP2008861423 filed on Jun. 2, 2010 published as EP2240572, U.S. patent application national phase entry Ser. No. 12/735,060 filed Nov. 24, 2010 published as US20110065103, German patent application serial number DE 10 2005 046 490 filed Sep. 28, 2005, PCT application PCT/EP2006/0448 filed Sep. 28, 2006 published as WO2007036366, national phase European patent EP1934345 published Mar. 21, 2012 and national phase U.S. patent application Ser. No. 11/992,638 filed Aug. 14, 2009 published as 20100129877; Immune Disease Institute Inc. in U.S. patent application Ser. No. 13/088,009 filed Apr. 15, 2011 published as US20120046346 and PCT application PCT/US2011/32679 filed Apr. 15, 2011 published as WO20110130624; Shire Human Genetic Therapeutics in U.S. patent application Ser. No. 12/957,340 filed on Nov. 20, 2010 published as US20110244026; Sequitur Inc. in PCT application PCT/US1998/019492 filed on Sep. 18, 1998 published as WO1999014346; The Scripps Research Institute in PCT application number PCT/US2010/00567 filed on Feb. 24, 2010 published as WO2010098861, and U.S. patent application national phase entry Ser. No. 13/203,229 filed Nov. 3, 2011 published as U520120053333; Ludwig-Maximillians University in PCT application number PCT/EP2010/004681 filed on Jul. 30, 2010 published as WO2011012316; Cellscript Inc. in U.S. Pat. No. 8,039,214 filed Jun. 30, 2008 and granted Oct. 18, 2011, U.S. patent application Ser. No. 12/962,498 filed on Dec. 7, 2010 published as US20110143436, Ser. No. 12/962,468 filed on Dec. 7, 2010 published as US20110143397, Ser. No. 13/237, 451 filed on Sep. 20, 2011 published as US20120009649, and PCT applications PCT/US2010/59305 filed Dec. 7, 2010 published as WO2011071931 and PCT/US2010/59317 filed on Dec. 7, 2010 published as WO2011071936; The Trustees of the University of Pennsylvania in PCT application number PCT/US2006/32372 filed on Aug. 21, 2006 published as WO2007024708, and U.S. patent application national phase entry Ser. No. 11/990,646 filed on Mar. 27, 2009 published as US20090286852; Curevac GMBH in German patent application serial numbers DE10 2001 027 283.9 filed Jun. 5, 2001, DE10 2001 062 480.8 filed Dec. 19, 2001, and DE 20 2006 051 516 filed Oct. 31, 2006 all abandoned, European patent numbers EP1392341 granted Mar. 30, 2005 and EP1458410 granted Jan. 2, 2008, PCT application numbers PCT/EP2002/06180 filed Jun. 5, 2002 published as WO2002098443, PCT/EP2002/14577 filed on Dec. 19, 2002 published as WO2003051401, PCT/EP2007/09469 filed on Dec. 31, 2007 published as WO2008052770, PCT/EP2008/03033 filed on Apr. 16, 2008 published as WO2009127230, PCT/EP2006/004784 filed on May 19, 2005 published as WO2006122828, PCT/EP2008/00081 filed on Jan. 8, 2007 published as WO2008083949, and U.S. patent application Ser. No. 10/729,830 filed on Dec. 5, 2003 published as US20050032730, Ser. No. 10/870,110 filed on Jun. 18, 2004 published as US20050059624, Ser. No. 11/914,945 filed on Jul. 7, 2008 published as US20080267873, Ser. No. 12/446,912 filed on Oct. 27, 2009 published as U52010047261 now abandoned, Ser. No. 12/522,214 filed on Jan. 4, 2010 published as US20100189729, Ser. No. 12/787,566 filed on May 26, 2010 published as US20110077287, Ser. No. 12/787,755 filed on May 26, 2010 published as US20100239608, Ser. No. 13/185,119 filed on Jul. 18, 2011 published as US20110269950, and Ser. No. 13/106,548 filed on May 12, 2011 published as US20110311472 all of which are herein incorporated by reference in their entirety.

In some embodiments, the effector modules may be designed as self amplifying RNA. "Self amplifying RNA" as used herein refers to RNA molecules that can replicate in the host resulting in the increase in the amount of the RNA and the protein encoded by the RNA. Such self amplifying RNA may have structural features or components of any of those taught in International Patent Application Publication No. WO2011005799 (the contents of which are incorporated herein by reference in their entirety.)

VII. Methods and Uses

The biocircuits, effector modules, SREs, stimuli, compositions or systems comprising one or more of the stimuli, biocircuits, effector modules of the present invention may be utilized in a large variety of applications including, but not limited to, therapeutics, diagnosis and prognosis, bioengineers, bioprocessing, biofactory, research agents, metabolomics, gene expression, enzyme replacement, etc.

Microbiome

The biocircuits of the present invention and/or any of their components may be utilized in regulating or tuning the microbiome. A diverse community of symbiotic, commensal and pathogenic microorganisms exist in all environmentally exposed sites in the body and is herein referred to as the "Microbiome." Environmentally exposed sites of the body that may be inhabited by a microbiome include the skin, nasopharynx, the oral cavity, respiratory tract, gastrointestinal tract, and the reproductive tract. The intimate association of the microbiome with the body has profound implications on human health and disease, including asthma, inflammatory bowel diseases, metabolic, cardiovascular diseases and cancer. Accordingly, in some embodiments, biocircuits, biocircuit components, effector modules including their SREs or payloads of the present invention may be used in the modulation or alteration or exploitation of the microbiome and/or the microenvironment of the microbiome.

In some embodiments, biocircuits of the present invention are triggered by one or more stimuli within the microbiome or the microenvironment of the microbiome. In one embodiment, such stimuli may be related to a disease state in the host.

In some embodiments, biocircuits of the present invention may be used in treating dysbiosis. As used herein "dysbiosis" refers to the disequilibrium between potentially detrimental and know beneficial microorganisms within the microbiome. As a non limiting example, biocircuits of the present invention may be used to treat obesity and metabolic disorders. Patients with such conditions have higher levels of Firmicutes phylum and lower levels of *Escherichia coli* in their feces. Increased proportions of *E. coli* in these patients has been associated with weight loss and lower levels of serum leptin.

In some embodiments, one or microbial proteins, RNA and/or other biomolecules may be utilized as payloads in the microbiome. As a non limiting example, the payload may be NAPE synthase, an enzyme that is responsible for the synthesis of N-acyl-phosphatidylethanolamine (NAPE). Transplantation of *Escherichia coli* engineered to express NAPE synthase into host organisms can prevent obesity by inducing satiety and reducing food intake (International Publication No. WO2013043719; the contents of which are incorporated by reference in their entirety).

In some embodiments, the microbiome may be engineered with biocircuits consisting of non-microbial biomolecules as payloads. Non limiting examples of payloads include, antiviral peptide, enzymes, neuropeptides, cytokines, and other soluble factors. Such strategies transform the microbiome into therapeutic agents for the treatment of diseases. As a non limiting example, Glucagon like peptide-1 may be used as a payload. Administration of *Lactobacillus gasseri* engineered to express Glucagon like peptide-1, induced insulin production in the host and decreased hyperglycemia (Duan, F., et al., Diabetes, 64, 1794-1803 (2015); the contents of which are incorporated by reference in their entirety).

In some embodiments, the microbiome may comprise a kill switch. As used herein the term "kill switch" refers to biocircuits of the present invention that include one or more toxins as a payload. Microorganisms engineered for in vivo administration may be programmed to die at a specific time, after the delivery of gene or genes, and/or after the host has experienced the therapeutic effect. Specifically, it may be useful to prevent long-term colonization of the host by the organisms or spread of the microorganisms outside the area of interest. Examples of toxins that can be used in kill switches include, but are not limited to, bacteriocins, lysins, and other molecules that cause cell death by lysing cell membranes, degrading cellular DNA, or other mechanisms.

Alterations in the composition of the microbiome may impact the action of anti-cancer therapies. Lida et al., have demonstrated that mice with intact microbiome are far more responsive to Oxaliplatin-based chemotherapy than germ-free mice (lida N., et al. Commensal bacteria control cancer response to therapy by modulating the tumor microenvironment. *Science,* 2013; 342: 967-70; the contents of which are incorporated by reference in their entirety). Microbiome composition also appears to be critical to elicit the beneficial effect. For example, *Parabacteroides distasonis* can dampen the therapeutic effects of cyclophosphamide therapy (Viaud S., et al., The intestinal microbiota modulates the anticancer immune effects of cyclophosphamide. *Science,* 2013; 342: 971-6). Thus in some embodiments, microbiome engineered with the biocircuits of the present invention may be used to improve the efficacy of the anti-cancer therapies.

In some embodiments, microbiome engineered with the biocircuits of the present invention may be used to improve the efficacy of the anti-cancer immunotherapies. Sivan et al., found that mice with *Bifidobacterium* in their gut microbiome were more responsive to immune check point blockage e.g. anti PD-L1 immunotherapy in subcutaneous melanoma tumor model (Sivan A., et al. Commensal *Bifidobacterium* promotes antitumor immunity and facilitates anti-PD-L1 efficacy. Science 2015; 350:1084-9; the contents of which are incorporated by reference in their entirety). In one embodiment, protein, RNA and/or other biomolecules derived from the microbiome may be used as payload to influence the efficacy of the anti-cancer immunotherapies.

Metabolite Biosensors

In some embodiments, biocircuits of the present invention may be used as metabolite biosensors. As used herein a "metabolite biosensor" refers to biocircuits that are capable of interacting and responding to metabolites. Biosensors described herein may be used in vitro, in vivo, and/or ex vivo. Biosensors described herein may also be used in cells, tissues, or in entire organisms.

Biocircuits of the present invention may couple metabolite sensing to payloads comprising a reporter moiety. Examples of reporter moieties include but are not limited to fluorescence reporters such as green fluorescent protein (GFP), β-galactosidase, or bioluminescent reporters such as luciferase. Biosensors of the present invention are superior to conventional methods of detection since they are more sensitive and allow real-time monitoring of metabolite dynamics, especially labile and low abundant metabolites.

In some embodiments, biosensors of the present invention may be engineered to couple the sensing of a metabolite with payloads that confer a fitness advantage to the cells, tissues or organisms. Payloads may be biomolecules that are necessary for survival under selective conditions. Such methods are useful in enrichment of cells with certain desirable characteristics.

Metabolite biosensors consisting of biocircuits of the present invention may also be used to control metabolic flux dynamically. This may be achieved by using payloads that may tune pathway enzymes in response to the level of the relevant metabolite, allowing for dynamic control of pathway activity.

Transgenic Organisms

In some embodiments, the present invention provides transgenic organisms that expresses nucleic acids that encode polypeptides of the present invention. As used herein the term "transgenic organism" refers to any non-human entity that contains artificially transferred, exogenous genetic material. This approach provides the ability to temporally regulate payloads within defined cells, tissues or in the entire organism. Such methods may be useful in creating transgenic models for certain disease states, or for studying embryonic development.

Biocircuits of the present invention may also be used to identify specific cell, tissues and/or organs within a transgenic organism where in a particular activity is located and effector modules described herein may designed to include a reporter moiety. Presence of the activity may result in the change in the expression of the reporter moiety.

In some embodiments, transgenic organisms may include biocircuits designed to be responsive a particular activity. Such activity may represent the stimulus. Effector modules may also include a cleavage site and/or a linker that is responsive to the activity within specific cells or tissues or organs within the organism. Cleavage at the cleavage site or linker releases the payload from the effector module.

Transgenic organisms described herein may include rodents, fish, reptiles, as well as invertebrates. In a preferred embodiment, such transgenic organisms may be selected from the rodent family including mouse, and rat.

Gene Transcription

Protein levels and activities in a biological system are tightly regulated through many mechanisms. One important mechanism is transcriptional regulation which requires transcription factors to bind to specific DNA sequences in order to regulate the expression of a gene of interest. In some embodiments, pharmaceutical compositions, biocircuits, biocircuit components, effector modules including their SREs or payloads of the present invention may be used to tune transcription factors. The double tunable systems in which SREs (e.g. DDs) drive the expression of transcription factors and the transcription factors control a target gene may provide greater control and production of proteins in a cell, a tissue, an organ and/or a biological system.

Tunable Regulations

The biocircuits of the present invention and/or any of their components may also be utilized to regulate the expression of another effector module such as a recombinant construct comprising a POI. In some embodiments, the biocircuits and/or effector modules may comprise a protease (also called peptidase or proteinase). The tunable protease could cleave an inactive construct to an active construct when the two components are co-introduced into a cell, a tissue or an organism.

In other examples, the biocircuits and/or effector modules comprising a protease may also be utilized to regulate protein processing including cleavage of the initial protein product to produce a smaller active protein or peptide.

In some embodiments, the biocircuits of the present invention and/or any of their components may comprise any of factors that play a role in protein processing and modification. Protein post-translational modification may include, but are not limited to, addition of hydrophobic groups by an enzyme (e.g., myristoylation, palmitoylation, isoprenylation, prenylation, farnesylation, geranylgeranylation, glypiation, and glycosylphosphatidylinositol (GPI) anchor); attachment of cofactors for enhanced function (e.g., lipoylation, flavin, phosphopantetheinylation, and heme C); addition of small chemical groups (e.g., acylation, formylation, alkylation, phosphorylation, methylation, arginylation, polyglutamylation, polyglycylation, butyrylation, glycosylation, propionylation, S-glutathionylation, S-nitrosylation, S-sulfenylation, succinylation, sulfation, and acetylation); linkage of othe proteins and/or peptides such as ISGylation, SUMOylation, ubiquitination, neddylation, and pupylation; chemical modification of amino acids; and structural changes.

Boolean Switches

Biocircuits of the present inventions may also be incorporated into the design of cellular Boolean Switches. As used herein, a Boolean switch refers to a circuit that is designed to perform a logical operation based on one or more inputs and which produces an output. Logical operations performed by Boolean switches but are not limited to, AND, OR, NOR, NAND, NOT, IMPLY, NIMPLY, XOR, and XNOR. OR as well as AND gates represent the most fundament logical operations where OR represents a scenario where any of the one or more inputs is required to produce an output, while AND represents a scenario where all of the inputs are required to generate an output. Compound Boolean switches that consist of multiple logical operations may also be generated using biocircuits of the invention. In some embodiments, biocircuits and/or any of their components may represent one or more inputs in a Boolean switch. In other embodiments, biocircuits of the invention may be combined with switches known in the art to generate Boolean Switches. The output of a Boolean Switches may depend on the payload utilized. As a non limiting example, an AND based Boolean Switch may be generated where a first input comprises a biocircuit with gene editing nuclease, Cas9, as the payload and a second input comprises a biocircuit with transcriptional activator, VPR, as the payload. In the presence of the target gene guide RNA, addition of the stimuli to both inputs is required for the transcriptional activation of target gene (Gao Y et al. (2016) Nat Methods. 13(12):1043-1049; the contents of which are incorporated by reference in their entirety).

Biofactories

The biocircuits of the present invention and/or any of their components may be utilized to regulate the levels of protein production in a biofactory. As used herein, the term "biofactory" refers to a cell, a tissue, an organ or an organism genetically modified or not, which can produce proteins with a number of applications including therapeutic purposes (inhibitors, enzymes, antibodies, antigens, etc.) or primary or secondary products of industrial interest. In some examples, the cell may be a prokaryotic cell, a eukaryotic cell, a mammalian cell, a plant cell, etc.

In some embodiments, the biocircuits of the present invention may be used to regulate medicament proteins produced in a target tissue, for example, the liver and the kidney. The liver is an organ that produces secreted proteins including major plasma proteins, factors in hemostasis and fibrinolysis, carrier proteins, hormones, prohormones and apolipoproteins, or a variety of short-lived metabolic peptides and enzymes which are usually tightly regulated, or other non-hepatic proteins. In the context, the liver fills a role of gene expression factory (biofactory), supplying a protein for treatment of a disease for example a metabolic disease.

In other embodiments, the biocircuits of the present invention may be used to regulate proteins for industrial processes.

Liver Targeting

The liver is an important organ that produces proteins and involves blood clotting and a number of metabolic functions. A variety of diseases can affect liver and targeting the liver for disease treatment has been a promising approach, especially liver-targeted gene therapy. The biocircuits of the present invention and/or any of their components may be utilized to regulate liver targeted gene therapy and gene transfer.

Proteins that can be targeted to the liver and constructed to the present biocircuits for regulation may include those in liver cancers such as hepatocellular carcinoma (HCC), Fibrolamellar HCC, Cholangiocarcinoma, Angiosarcoma and secondary liver cancer; inherited disorders caused by defective genes such as hemochromatosis, Wilson disease, tyrosinemia, alpha 1 antitrypsin deficiency, glycogen storage disease; metabolic disorders due to enzyme deficiency such as Gilbert's syndrome, lysosomal acid lipase deficiency (LALD) and Gaucher disease; autoimmune hepatitis; fatty liver diseases; and viral hepatitis (A, B and C). In some examples, the present biocircuits may be used to direct IL-12 for hepatocellular carcinoma (HCC), and IL-10 for diabetic neuropathy.

In some embodiments, the present biocircuits may be used to control liver specific gene products for gene therapy.

In some embodiments, the present biocircuits may be used to control liver proteins that are secreted (e.g., to blood).

Microfluidics

In some embodiments, cells containing biocircuits of the present invention and/or any of their components may be utilized in microfluidics devices. As used herein a "microfluidics device" refers to the manipulation of picoliter to nanoliter-scale volumes of fluids within artificially fabricated microsystems. Microfluidic devices comprising biocircuits of the present invention may be utilized to study cell culture models, cellular microenvironment, cell secretions, chemotaxis, apoptosis, vascular function, neuron cell growth, embryonic development, single cell metabolomics, gene expression, drug research, cellular separation, stem cell biology, bioreactors, three dimensional cell culture, and tissue engineering.

Microfluidics devices comprising biocircuits of the present invention may be used to express payload of interest within a subcellular region. In some embodiments, subcellular location specific expression of the payloads of interest may be achieved by delivery of the stimulus via channels within the microfluidic devices that generate a laminar flow near specific areas of the cell (Takayama S., et al. (2003). Chem Biol. 10(2):123-30; the contents of which are incorporated by reference in their entirety). In other embodiments, subcellular location specific expression of payloads of interest is achieved using Polydimethysiloxane-based culture devices as described in Uruyu D., et al., (2016) Sci Technol Adv Mater. 17(1):691-697 (the contents of which are incorporated by reference in their entirety).

Tracking SREs, Biocircuits and Cell Lines

In some embodiments, it may be desirable to track the compositions of the invention or the cells modified by the compositions of the invention. Tracking may be achieved by using payloads such as reporter moieties, which, as used herein, refers to any protein capable of creating a detectable signal, in response to an input. Examples include alkaline phosphatase, β-galactosidase, chloramphenicol acetyltransferase, β-glucuronidase, peroxidase, β-lactamase, catalytic antibodies, bioluminescent proteins e.g. luciferase, and fluorescent proteins such as Green fluorescent protein (GFP).

Reporter moieties may be used to monitor the response of the SREs upon addition of the ligand corresponding to the SRE. In other instances, reporter moieties may be used to track cell survival, persistence, cell growth, and/or localization in vitro, in vivo, or ex vivo.

In some embodiments, the preferred reporter moiety may be luciferase proteins. In one embodiment, the reporter moiety is the *Renilla* luciferase, or a firefly luciferase. Table 21 provides the amino acid sequences and nucleic acid sequences of the reporter moieties.

TABLE 21

DD-luciferase constructs

| Description | Amino acid sequence | Amino Acid SEQ ID NO. | Nucleic Acid SEQ ID NO |
|---|---|---|---|
| Renilla luciferase | MTSKVYDPEQRKRMITGPQWWARCKQMNVLDSFINYYDSEKHAENAVIFLHGNAASSYLWRHV VPHIEPVARCIIPDLIGMGKSGKSGNGSYRLLDHYKYLTAWFELLNLPKKIIFVGHDWGACLAFHYS YEHQDKIKAIVHAESVVDVIESWDEWPDIEEDIALIKSEEGEKMVLENNFFVETMLPSKIMRKLEPE EFAAYLEPFKEKGEVRRPTLSWPREIPLVKGGKPDVVQIVRNYNAYLRASDDLPKMFIESDPGFFS NAIVEGAKKFPNTEFVKVKGLHFSQEDAPDEMGKYIKSFVERVLKNEQ | 213367 | 213378 |
| Firefly Luciferase | MEDAKNIKKGPAPFYPLEDGTAGEQLHKAMKRYALVPGTIAFTDAHIEVDITYAEYFEMSVRLAEA MKRYGLNTNHRIVVCSENSLQFFMPVLGALFIGVAVAPANDIYNERELLNSMGISQPTVVFVSKKG LQKILNVQKKLPIIQKIIIMDSKTDYQGFQSMYTFVTSHLPPGFNEYDFVPESFDRDKTIALIMNSSG STGLPKGVALPHRTACVRFSHARDPIFGNQIIPDTAILSVVPFHHGFGMFTTLGYLICGFRVVLMYR FEEELFLRSLQDYKIQSALLVPTLFSFFAKSTLIDKYDLSNLHEIASGGAPLSKEVGEAVAKRFHLP GIRQGYGLTETTSAILITPEGDDKPGAVGKVVPFFEAKWDLDTGKTLGVNQRGELCVRGPMIMS GYVNNPEATNALIDKDGWLHSGDIAYWDEDEHFFIVDRLKSLIKYKGYQVAPAELESILLQHPNIFD AGVAGLPDDDAGELPAAVVVLEHGKTMTEKEIVDYVASQVTTAKKLRGGVVFVDEVPKGLTGKLD ARKIREILIKAKKGGKSKL | 213368 | 213379 |
| FKBP (F36V, L106P) | MGVQVETISPGDGRTFPKRGQTCVVHYTGMLEDGKKVDSSRDRNKPFKFMLGKQEVIRGWEEG VAQMSVGQRAKLTISPDYAYGATGHPGIIPPHATLVFDVELLKPE | 213369 | 213380 |
| FKBP (E31G, F36V, R71G, K105E) | MGVQVETISPGDGRTFPKRGQTCVVHYTGMLEDGKKVDSSRDRNKPFKFMLGKQEVIRGWEEG VAQMSVGQRAKLTISPDYAYGATGHPGIIPPHATLVFDVELLKPE | 213370 | 213381 |
| ecDHFR (R12Y, Y100I) | MISLIAALAVDYVIGMENAMPWNLPADLAWFKRNTLNKPVIMGRHTWESIGRPLPGRKNIILSSQP GTDDRVTWVKSVDEAIAACGDVPEIMVIGGGRVIEQFLPKAQKLYLTHIDAEVEGDTHFPDYEPDD WESVFSEFHDADAQNSHSYCFEILERR | 213371 | 213382 |
| ecDHFR (R12Y, Y100I) | ISLIAALAVDYVIGMENAMPWNLPADLAWFKRNTLNKPVIMGRHTWESIGRPLPGRKNIILSSQPGT DDRVTWVKSVDEAIAACGDVPEIMVIGGGRVIEQFLPKAQKLYLTHIDAEVEGDTHFPDYEPDDW ESVFSEFHDADAQNSHSYCFEILERR | 213275 | 213285 |
| OT-Rluc-001 (Renilla Luc) | MTSKVYDPEQRKRMITGPQWWARCKQMNVLDSFINYYDSEKHAENAVIFLHGNAASSYLWRHV VPHIEPVARCIIPDLIGMGKSGKSGNGSYRLLDHYKYLTAWFELLNLPKKIIFVGHDWGACLAFHYS YEHQDKIKAIVHAESVVDVIESWDEWPDIEEDIALIKSEEGEKMVLENNFFVETMLPSKIMRKLEPE EFAAYLEPFKEKGEVRRPTLSWPREIPLVKGGKPDVVQIVRNYNAYLRASDDLPKMFIESDPGFFS NAIVEGAKKFPNTEFVKVKGLHFSQEDAPDEMGKYIKSFVERVLKNEQ | 213372 | 213383 |
| OT-Fluc-002 (FKBP (F36V, 106P); linker (EF); Fluc) | MGVQVETISPGDGRTFPKRGQTCVVHYTGMLEDGKKVDSSRDRNKPFKFMLGKQEVIRGWEEG VAQMSVGQRAKLTISPDYAYGATGHPGIIPPHATLVFDVELLKPEEFMEDAKNIKKGPAPFYPLED GTAGEQLHKAMKRYALVPGTIAFTDAHIEVDITYAEYFEMSVRLAEAMKRYGLNTNHRIVVCSENS LQFFMPVLGALFIGVAVAPANDIYNERELLNSMGISQPTVVFVSKKGLQKILNVQKKLPIIQKIIIMDS KTDYQGFQSMYTFVTSHLPPGFNEYDFVPESFDRDKTIALIMNSSGSTGLPKGVALPHRTACVRF SHARDPIFGNQIIPDTAILSVVPFHHGFGMFTTLGYLICGFRVVLMYRFEEELFLRSLQDYKIQSALL VPTLFSFFAKSTLIDKYDLSNLHEIASGGAPLSKEVGEAVAKRFHLPGIRQGYGLTETTSAILITPEG DDKPGAVGKVVPFFEAKVVDLDTGKTLGVNQRGELCVRGPMIMSGYVNNPEATNALIDKDGWLH SGDIAYWDEDEHFFIVDRLKSLIKYKGYQVAPAELESILLQHPNIFDAGVAGLPDDDAGELPAAVVV LEHGKTMTEKEIVDYVASQVTTAKKLRGGVVFVDEVPKGLTGKLDARKIREILIKAKKGGKSKL | 213373 | 213384 |
| OT-Rluc-003 (FKBP (F36V, 106P); linker (SG); Renilla Luc) | MGVQVETISPGDGRTFPKRGQTCVVHYTGMLEDGKKVDSSRDRNKPFKFMLGKQEVIRGWEEG VAQMSVGQRAKLTISPDYAYGATGHPGIIPPHATLVFDVELLKPESGTSKVYDPEQRKRMITGPQ WWARCKQMNVLDSFINYYDSEKHAENAVIFLHGNAASSYLWRHVVPHIEPVARCIIPDLIGMGKS GKSGNGSYRLLDHYKYLTAWFELLNLPKKIIFVGHDWGACLAFHYSYEHQDKIKAIVHAESVVDVI ESWDEWPDIEEDIALIKSEEGEKMVLENNFFVETMLPSKIMRKLEPEEFAAYLEPFKEKGEVRRPT LSWPREIPLVKGGKPDVVQIVRNYNAYLRASDDLPKMFIESDPGFFSNAIVEGAKKFPNTEFVKVK GLHFSQEDAPDEMGKYIKSFVERVLKNEQ | 213374 | 213385 |
| OT-Rluc-004 (ecDHFR (R12Y, Y100I); linker (SG); Renilla Luc) | MISLIAALAVDYVIGMENAMPWNLPADLAWFKRNTLNKPVIMGRHTWESIGRPLPGRKNIILSSQP GTDDRVTWVKSVDEAIAACGDVPEIMVIGGGRVIEQFLPKAQKLYLTHIDAEVEGDTHFPDYEPDD WESVFSEFHDADAQNSHSYCFEILERRSGTSKVYDPEQRKRMITGPQWWARCKQMNVLDSFIN YYDSEKHAENAVIFLHGNAASSYLWRHVVPHIEPVARCIIPDLIGMGKSGKSGNGSYRLLDHYKYL TAWFELLNLPKKIIFVGHDWGACLAFHYSYEHQDKIKAIVHAESVVDVIESWDEWPDIEEDIALIKSE EGEKMVLENNFFVETMLPSKIMRKLEPEEFAAYLEPFKEKGEVRRPTLSWPREIPLVKGGKPDVV | 213375 | 213386 |

TABLE 21-continued

DD-luciferase constructs

| Description | Amino acid sequence | Amino Acid SEQ ID NO. | Nucleic Acid SEQ ID NO |
|---|---|---|---|
| | QIVRNYNAYLRASDDLPKMFIESDPGFFSNAIVEGAKKFPNTEFVKVKGLHFSQEDAPDEMGKYIK SFVERVLKNEQ | | |
| OT-Rluc-005 (Renilla Luc; linker (SG); FKBP (E31G, F36V, R71G, K105E)) | MTSKVYDPEQRKRMITGPQWWARCKQMNVLDSFINYYDSEKHAENAVIFLHGNAASSYLWRHV VPHIEPVARCIIPDLIGMGKSGKSGNGSYRLLDHYKYLTAWFELLNLPKKIIFVGHDWGACLAFHYS YEHQDKIKAIVHAESWDVIESWDEWPDIEEDIALIKSEEGEKMVLENNFFVETMLPSKIMRKLEPE EFAAYLEPPFKEKGEVRRPTLSWPREIPLVKGGKPDVVQIVRNYNAYLRASDDLPKMFIESDPGFFS NAIVEGAKKFPNTEFVKVKGLHFSQEDAPDEMGKYIKSFVERVLKNEQSGGVQVETISPGDGRTF PKRGQTCVVHYTGMLGDGKKVDSSRDRNKPFKFMLGKQEVIRGWEEGVAQMSVGQGAKLTISP DYAYGATGHPGIIPPHATLVFDVELLELE | 213376 | 213387 |
| OT-Rluc-006 (Renilla Luc; linker (SG); ecDHFR (R12Y, Y100I)) | MTSKVYDPEQRKRMITGPQWWARCKQMNVLDSFINYYDSEKHAENAVIFLHGNAASSYLWRHV VPHIEPVARCIIPDLIGMGKSGKSGNGSYRLLDHYKYLTAWFELLNLPKKIIFVGHDWGACLAFHYS YEHQDKIKAIVHAESWDVIESWDEWPDIEEDIALIKSEEGEKMVLENNFFVETMLPSKIMRKLEPE EFAAYLEPPFKEKGEVRRPTLSWPREIPLVKGGKPDVVQIVRNYNAYLRASDDLPKMFIESDPGFFS NAIVEGAKKFPNTEFVKVKGLHFSQEDAPDEMGKYIKSFVERVLKNEQSGISLIAALAVDYVIGMEN AMPWNLPADLAWFKRNTLNKPVIMGRHTWESIGRPLPGRKNIILSSQPGTDDRVTWVKSVDEAIA ACGDVPEIMVIGGGRVIEQFLPKAQKLYLTHIDAEVEGDTHFPDYEPDDWESVFSEFHDADAQNS HSYCFEILERR | 213377 | 213388 |

Chaperones

In some embodiments, effector modules of the present invention may include one or more chaperones to regulate the expression of the payload. Chaperones useful in the present invention may be cellular chaperones or small molecules referred to as pharmacological chaperones. Cellular chaperones refer to a large group of unrelated protein families whose role is to stabilize unfolded client proteins, or to unfold client proteins for translocation across membranes or for degradation, and/or to assist in their correct folding and assembly. Chaperones also cooperate with other components of the proteostasis network such as the proteasome system and autophagy to promote protein clearance. Examples of molecular chaperone families include small heat shock proteins such as hsp25; Heat shock protein 60 family proteins such as cpn60 and GroEL; Heat shock protein 70 family proteins such as DnaK and BiP; Heat shock protein 90 family proteins; Heat shock protein 100 family proteins such as Clp; lectin chaperones such as calnexin and calreticulin; and folding chaperones such as Protein disulfide isomerases (PDI), peptidyl prolyl ci-trans isomerase (PPI) and ERp57. In some embodiments, the payload of the present invention may be a cellular chaperone. In the absence of a stimulus which stabilizes the SRE, the cellular chaperone may bind to the SRE and is therefore unavailable to interact with its client proteins. In the presence of the stimulus specific to the SRE, the SRE is stabilized and the chaperone is available to interact with client proteins. In some embodiments, payloads of the present inventions may be appended to chaperones such that the stability or instability of the payload may be enhanced. In other embodiments, the SREs of the present invention may consist of one or more molecular chaperones.

Chaperones useful in the present invention may also include pharmacological chaperones which utilizes small molecules to facilitate the correct folding and stabilization of cellular proteins. Mutations in cellular proteins can result in protein misfolding and/or aggregation which ultimately results in their degradation. Pharmacological chaperones have been designed to bind to misfolded target proteins, facilitate their correct folding and thereby prevent their degradation. In some embodiments, SREs of the present invention may comprise one or more misfolded proteins and the stimulus specific to the SRE may include one or pharmacological chaperones such that the effector module is stabilized only in the presence of the pharmacological chaperone. In one example, the stimulus of the present invention may be pharmacological chaperone, deoxygalactonojirimycin (DGJ), and the SRE of present invention may be a R301Q mutant alpha Galacatose enzyme (see U.S. Pat. Nos. 6,274,597, 6,583,158, 6,589,964, 6,599,919, and 6,916,829; the contents of each of which are incorporated by reference in their entirety). In one embodiment, the SRE of the present invention may be acid β-glucosidase which may be stabilized by the isofagomine (IFG), and its derivatives, described in U.S. Pat. No. 6,583,158; the contents of which are incorporated by reference in their entirety.

T Cell Exhaustion

In some embodiments, biocircuits, their components, SREs or effector modules may be utilized to prevent T cell exhaustion. As used herein, "T cell exhaustion" refers to the stepwise and progressive loss of T cell function caused by chronic T cell activation. T cell exhaustion is a major factor limiting the efficacy of antiviral and antitumor immunotherapies. Exhausted T cells have low proliferative and cytokine producing capabilities concurrent with high rates of apoptosis and high surface expression of multiple inhibitory receptors. T cell activation leading to exhaustion may occur either in the presence or absence of the antigen.

In some embodiments, the biocircuits, and their components may be utilized to prevent T cell exhaustion in the context of Chimeric Antigen Receptor-T cell therapy (CAR-T). In this context, exhaustion in some instances, may be caused by the oligomerization of the scFvs of the CAR on the cell surface which leads to continuous activation of the intracellular domains of the CAR. As a non-limiting example, CARs of the present invention may include scFvs that are unable to oligomerize. As another non-limiting example, CARs that are rapidly internalized and re-expressed following antigen exposure may also be selected to prevent chronic scFv oligomerization on cell surface. In one embodiment, the framework region of the scFvs may be modified to prevent constitutive CAR signaling (Long et al. 2014. Cancer Research. 74(19) S1; the contents of which are incorporated by reference in their entirety). Tunable biocircuit systems of the present invention may be also used to regulate the surface expression of the CAR on the T cell surface to prevent chronic T cell activation. The CARs of the invention may also be engineered to minimize exhaustion. As a non-limiting example, the 41-BB signaling domain may be incorporated into CAR design to ameliorate T cell exhaustion. In some embodiments, any of the strategies disclosed by Long H A et al. may be utilized to prevent exhaustion (Long A H et al. (2015) Nature Medicine 21, 581-590; the contents of which are incorporated herein by reference in their entirety). In some embodiments, T cell metabolic pathways may be modified to diminish the susceptibility of T cells to exhaustion. Metabolic pathways may include, but are not limited to glycolysis, urea cycle, citric acid cycle, beta oxidation, fatty acid biosynthesis, pentose phosphate pathway, nucleotide biosynthesis, and glycogen metabolic pathways. As a non-limiting example, payloads that reduce the rate of glycolysis may be utilized to restrict or prevent T cell exhaustion (Long et al. Journal for Immunotherapy of Cancer 2013, 1(Suppl 1): P21; the contents of which are incorporated by reference in their entirety). In one embodiment, T cells of the present invention may be used in combination with inhibitors of glycolysis such as 2-deoxyglucose, and rapamycin.

In some embodiments, effector modules of the present invention, useful for immunotherapy may be placed under the transcriptional control of the T cell receptor alpha locus constant (TRAC) locus in the T cells. Eyquem et al. have shown that expression of the CAR from the TRAC locus prevents T cell exhaustion and the accelerated differentiation of T cells caused by excessive T cell activation (Eyquem J. et al (2017) Nature. 543(7643):113-117; the contents of which are incorporated herein by reference in their entirety).

In some embodiments, payloads of the invention may include, antibodies or fragments that target T cell surface markers associated with T cell exhaustion. T-cell surface markers associated with T cell exhaustion that may be used as payloads include, but are not limited to, CTLA-1, PD-1, TGIT, LAG-3, 2B4, BTLA, TIM3, VISTA, and CD96.

In one embodiment, the payload of the invention may be a CD276 CAR (with CD28, 4-IBB, and CD3 zeta intracellular domains), that does not show an upregulation of the markers associated with early T cell exhaustion (see International patent publication No. WO2017044699; the contents of which are incorporated by reference in their entirety).

VIII. Definitions

Described herein are compositions, methods, processes, kits and devices for the design, preparation, manufacture and/or formulation of biocircuit systems.

At various places in the present specification, features or functions of the compositions of the present disclosure are disclosed in groups or in ranges. It is specifically intended that the present disclosure include each and every individual subcombination of the members of such groups and ranges. The following is a non-limiting list of term definitions.

Activity: As used herein, the term "activity" refers to the condition in which things are happening or being done. Compositions of the invention may have activity and this activity may involve one or more biological events. In some embodiments, biological events may include cell signaling events. In some embodiments, biological events may include cell signaling events associated protein interactions with one or more corresponding proteins, receptors, small molecules or any of the biocircuit components described herein.

Administered in combination: As used herein, the term "administered in combination" or "combined administration" refers to simultaneous exposure of one or more subjects to two or more agents administered at the same time or within an interval such that the subject is at some point in time simultaneously exposed to both and/or such that there may be an overlap in the effect of each agent on the patient. In some embodiments, at least one dose of one or more agents is administered within about 24 hours, 12 hours, 6 hours, 3 hours, 1 hour, 30 minutes, 15 minutes, 10 minutes, 5 minutes, or 1 minute of at least one dose of one or more other agents. In some embodiments, administration occurs in overlapping dosage regimens. As used herein, the term "dosage regimen" refers to a plurality of doses spaced apart in time. Such doses may occur at regular intervals or may include one or more hiatus in administration. In some embodiments, the administration of individual doses of one or more compounds and/or compositions of the present invention, as described herein, are spaced sufficiently closely together such that a combinatorial (e.g., a synergistic) effect is achieved.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Antigens of interest or desired antigens: As used herein, the terms "antigens of interest" or "desired antigens" refers to those proteins and/or other biomolecules provided herein that are immunospecifically bound or interact with antibodies of the present invention and/or fragments, mutants, variants, and/or alterations thereof described herein. In some embodiments, antigens of interest may comprise any of the polypeptides or payloads or proteins described herein, or fragments or portions thereof.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, mean that the moieties are physically associated or connected with one another, either directly or via one or more additional moieties that serve as linking agents, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Biomolecule: As used herein, the term "biomolecule" is any natural molecule which is amino acid-based, nucleic acid-based, carbohydrate-based or lipid-based, and the like.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, a compounds and/or compositions of the present invention may be considered biologically active if even a portion of is biologically active or mimics an activity considered to biologically relevant.

Biological system: As used herein, the term "biological system" refers to a group of organs, tissues, cells, intracellular components, proteins, nucleic acids, molecules (including, but not limited to biomolecules) that function together to perform a certain biological task within cellular membranes, cellular compartments, cells, tissues, organs, organ systems, multicellular organisms, or any biological entity. In some embodiments, biological systems are cell signaling pathways comprising intracellular and/or extracellular cell signaling biomolecules.

Candidate antibody: As used herein, the term "candidate antibody" refers to an antibody from a pool of one or more antibody from which one or more desired antibodies may be selected.

Cellular matrix: As used herein, the term "cellular matrix" refers to the biochemical and structural environment associated with the outer portion of the cell membrane. Such cell membranes may also include platelet membranes. Components of the cellular matrix may include, but are not limited to proteoglycans, carbohydrate molecules, integral membrane proteins, glycolipids and the like.

Compound: As used herein, the term "compound," refers to a distinct chemical entity. The term may be used herein to refer to peptides, proteins, protein complexes, nucleic acids, polynucleotides or antibodies of the invention. In some embodiments, a particular compound may exist in one or more isomeric or isotopic forms (including, but not limited to stereoisomers, geometric isomers and isotopes). In some embodiments, a compound is provided or utilized in only a single such form. In some embodiments, a compound is provided or utilized as a mixture of two or more such forms (including, but not limited to a racemic mixture of stereoisomers). Those of skill in the art appreciate that some compounds exist in different such forms, show different properties and/or activities (including, but not limited to biological activities). In such cases it is within the ordinary skill of those in the art to select or avoid particular forms of the compound for use in accordance with the present invention. For example, compounds that contain asymmetrically substituted carbon atoms can be isolated in optically active or racemic forms. Methods on how to prepare optically active forms from optically active starting materials are known in the art, such as by resolution of racemic mixtures or by stereoselective synthesis.

Conserved: As used herein, the term "conserved" refers to nucleotides or amino acid residues of polynucleotide or polypeptide sequences, respectively, that are those that occur unaltered in the same position of two or more sequences being compared. Nucleotides or amino acids that are relatively conserved are those that are conserved among more related sequences than nucleotides or amino acids appearing elsewhere in the sequences.

In some embodiments, two or more sequences are said to be "completely conserved" if they are 100% identical to one another. In some embodiments, two or more sequences are said to be "highly conserved" if they are at least 70% identical, at least 80% identical, at least 90% identical, or at least 95% identical to one another. In some embodiments, two or more sequences are said to be "highly conserved" if they are about 70% identical, about 80% identical, about 90% identical, about 95%, about 98%, or about 99% identical to one another. In some embodiments, two or more sequences are said to be "conserved" if they are at least 30% identical, at least 40% identical, at least 50% identical, at least 60% identical, at least 70% identical, at least 80% identical, at least 90% identical, or at least 95% identical to one another. In some embodiments, two or more sequences are said to be "conserved" if they are about 30% identical, about 40% identical, about 50% identical, about 60% identical, about 70% identical, about 80% identical, about 90% identical, about 95% identical, about 98% identical, or about 99% identical to one another. Conservation of sequence may apply to the entire length of an oligonucleotide or polypeptide or may apply to a portion, region or feature thereof.

In one embodiment, conserved sequences are not contiguous. Those skilled in the art are able to appreciate how to achieve alignment when gaps in contiguous alignment are present between sequences, and to align corresponding residues not withstanding insertions or deletions present.

CRISPR-Cas system: As used herein, the term "CRISPR-Cas system" in general refers collectively to components/elements involved in directing the activity of CRISPR-associated ("Cas") proteins, including sequences encoding a Cas gene, a tracr (trans-activating CRISPR) sequence (e.g. tracrRNA or an active partial tracrRNA), a tracr-complementary sequence (encompassing a "direct repeat" and a tracrRNA-processed partial direct repeat in the context of an endogenous CRISPR system), a target (guide) sequence (also referred to as a "spacer" in the context of an endogenous CRISPR system), or other sequences and transcripts from a CRISPR locus. In some embodiments, one or more elements of a CRISPR system is derived from a type I, type II, or type III CRISPR-Cas system. In some embodiments, one or more elements of a CRISPR-Cas system is derived from a particular organism which may comprise an endogenous CRISPR-Cas system, such as *Streptococcus pyogenes*. In general, a CRISPR-Cas system is characterized by components that promote the formation of a CRISPR/Cas complex at the site of a target sequence (also referred to as a protospacer in the context of an endogenous CRISPR-Cas system). In the context of formation of a CRISPR complex, "target sequence" refers to a sequence to which a target recognition sequence is designed to have complementarity, where hybridization between a target sequence and a target recognition sequence promotes the formation of a CRISPR/Cas complex. A target sequence may comprise any polynucleotide, such as DNA or RNA polynucleotides. In some embodiments, a target sequence is located in the nucleus or cytoplasm of a cell.

CRISPR interference (CRISPRi): As used herein, the term "CRISPRi" refers to a genetic perturbation technique that allows for sequence-specific repression or activation of gene expression in prokaryotic and eukaryotic cells using CRISPR complexes. CRISPRi regulates gene expression primarily on the transcriptional level.

Delivery: As used herein, "delivery" refers to the act or manner of delivering a compound, substance, entity, moiety, cargo or payload.

Delivery Agent: As used herein, "delivery agent" refers to any agent which facilitates, at least in part, the in vivo delivery of one or more substances (including, but not limited to compounds and/or compositions of the present invention) to a cell, subject or other biological system cells.

Desired antibody: As used herein, the term "desired antibody" refers to an antibody that is sought after, in some cases from a pool of candidate antibodies.

Destabilized: As used herein, the term "destable," "destabilize," "destabilizing region", or "destabilizing domain" means a region or molecule that is less stable than a starting, reference, wild-type or native form of the same region or molecule.

Detectable label: As used herein, "detectable label" refers to one or more markers, signals, or moieties which are attached, incorporated or associated with another entity, which markers, signals or moieties are readily detected by methods known in the art including radiography, fluorescence, chemiluminescence, enzymatic activity, absorbance, immunological detection and the like. Detectable labels may include radioisotopes, fluorophores, chromophores, enzymes, dyes, metal ions, ligands, biotin, avidin, streptavidin and haptens, quantum dots, polyhistidine tags, myc tags, flag tags, human influenza hemagglutinin (HA) tags and the like. Detectable labels may be located at any position in the entity with which they are attached, incorporated or associated. For example, when attached, incorporated in or associated with a peptide or protein, they may be within the amino acids, the peptides, or proteins, or located at the N- or C-termini.

Distal: As used herein, the term "distal" means situated away from the center or away from a point or region of interest.

Engineered: As used herein, embodiments of the invention are "engineered" when they are designed to have a feature or property, whether structural or chemical, that varies from a starting point, wild type or native molecule.

Epitope: As used herein, an "epitope" refers to a surface or region on a molecule that is capable of interacting with components of another molecule. In some embodiments, when referring to a protein or protein module, an epitope may comprise a linear stretch of amino acids or a three dimensional structure formed by folded amino acid chains.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; (4) folding of a polypeptide or protein; and (5) post-translational modification of a polypeptide or protein.

Extracellular matrix: As used herein, the term, "extracellular matrix," or "ECM" refers to the area surrounding cells and/or the area between cells that typically comprises structural proteins as well as cell signaling molecules. Components of the extracellular matrix may include, but are not limited to proteins, nucleic acids, membranes, lipids and sugars that may be directly or indirectly associated with structural components of the extracellular environments. Structural components of the extracellular matrix may include, but are not limited to proteins, polysaccharides (e.g. hyaluronic acid) glycosaminoglycans and proteoglycans (e.g. heparin sulfate, chondroitin sulfate and keratin sulfate.) Such structural components may include, but are not limited to fibrous components (e.g. collagens and elastins) fibrillins, fibronectin, laminins, agrin, perlecan, decorin and the like.

Ex Vivo: As used herein, the term "ex vivo" refers to events that occur outside an organism (e.g., animal, plant, or microbe or cell or tissue thereof).

Feature: As used herein, a "feature" refers to a characteristic, a property, or a distinctive element.

Formulation: As used herein, a "formulation" includes at least a compound and/or composition of the present invention and a delivery agent.

Fragment: A "fragment," as used herein, refers to a portion. For example, fragments of proteins may comprise polypeptides obtained by digesting full-length protein. In some embodiments, a fragment of a protein includes at least 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, 100, 150, 200, 250 or more amino acids. In some embodiments, fragments of an antibody include portions of an antibody.

Functional: As used herein, a "functional" biological molecule is a biological entity with a structure and in a form in which it exhibits a property and/or activity by which it is characterized.

Guide RNA (gRNA): As used herein, the term "guide RNA" refers to a RNA molecule used in conjunction with a CRISPR associated system. The guide RNA may be composed of two RNA molecules, i.e., one RNA ("crRNA") which hybridizes to a target sequence and provides sequence specificity, and one RNA, the "tracrRNA", which is capable of hybridizing to the crRNA and forming a duplex with crRNA upon hybridization. In some embodiments the guide RNA may be a single guide RNA (sgRNA). sgRNA contains nucleotide sequence specific to a non-variable scaffold sequence of the 5' end of a target DNA (i.e. crRNA) and tracrRNA sequence. SgRNA can be delivered as RNA or by transforming with a plasmid with sgRNA coding sequence under a promotor sequence. The base pairing of sgRNA with the target sequence recruits a Cas protein (e.g., the Cas9 nuclease) to bind the DNA at that locus and cleave the target DNA sequence. As used herein, the term "crRNA" is intended to refer to the endogenous bacterial RNA that confers target specificity, which requires tracrRNA to bind to Cas9. As used herein, the term "tracrRNA" refers to the endogenous bacterial RNA that links the crRNA to the Cas9 nuclease and can bind any crRNA.

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is typically determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids. In many embodiments, homologous protein may show a large overall degree of homology and a high degree of homology over at least one short stretch of at least 3, 4, 5, 6, 7, 8, 9, 10, 11, 12, 13, 14, 15, 16, 17, 18, 19, 20, 25, 30, 35, 40, 45, 50 or more amino acids. In many embodiments, homologous proteins share one or more characteristic sequence elements. As used herein, the term "characteristic sequence element" refers to a motif present in related proteins. In some embodiments, the presence of such motifs correlates with a particular activity (such as biological activity).

Identity: As used herein, the term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, may be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined, for example using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., Nucleic Acids Research, 12(1), 387 (1984)), BLASTP, BLASTN, and FASTA Altschul, S. F. et al., J. Molec. Biol., 215, 403 (1990)).

Inhibit expression of a gene: As used herein, the phrase "inhibit expression of a gene" means to cause a reduction in the amount of an expression product of the gene. The expression product may be RNA transcribed from the gene (e.g. mRNA) or a polypeptide translated from mRNA transcribed from the gene. Typically, a reduction in the level of mRNA results in a reduction in the level of a polypeptide translated therefrom. The level of expression may be determined using standard techniques for measuring mRNA or protein.

In situ: As used herein, the term "in situ" refers to events that occur in the original, natural, or existing environment e.g. within an organism.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" is synonymous with "separated", but carries with it the inference separation was carried out by the hand of man. In one embodiment, an isolated substance or entity is one that has been separated from at least some of the components with which it was previously associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art. In some embodiments, isolation of a substance or entity includes disruption of chemical associations and/or bonds. In some embodiments, isolation includes only the separation from components with which the isolated substance or entity was previously combined and does not include such disruption.

Linker: As used herein, a linker refers to a moiety that connects two or more domains, moieties or entities. In one embodiment, a linker may comprise 10 or more atoms. In a further embodiment, a linker may comprise a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. In some embodiments, a linker may comprise one or more nucleic acids comprising one or more nucleotides. In some embodiments, the linker may comprise an amino acid, peptide, polypeptide or protein. In some embodiments, a moiety bound by a linker may include, but is not limited to an atom, a chemical group, a nucleoside, a nucleotide, a nucleobase, a sugar, a nucleic acid, an amino acid, a peptide, a polypeptide, a protein, a protein complex, a payload (e.g., a therapeutic agent), or a marker (including, but not limited to a chemical, fluorescent, radioactive or bioluminescent marker). The linker can be used for any useful purpose, such as to form multimers or conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers, Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bonds include an amido bond which may be cleaved for example by the use of tris(2-carboxyethyl)phosphine (TCEP), or other reducing agents, and/or photolysis, as well as an ester bond which may be cleaved for example by acidic or basic hydrolysis.

Modified: As used herein, the term "modified" refers to a changed state or structure of a molecule or entity as compared with a parent or reference molecule or entity. Molecules may be modified in many ways including chemically, structurally, and functionally. In some embodiments, compounds and/or compositions of the present invention are modified by the introduction of non-natural amino acids.

Mutation: As used herein, the term "mutation" refers to a change and/or alteration. In some embodiments, mutations may be changes and/or alterations to proteins (including peptides and polypeptides) and/or nucleic acids (including polynucleic acids). In some embodiments, mutations comprise changes and/or alterations to a protein and/or nucleic acid sequence. Such changes and/or alterations may comprise the addition, substitution and or deletion of one or more amino acids (in the case of proteins and/or peptides) and/or nucleotides (in the case of nucleic acids and or polynucleic acids). In embodiments wherein mutations comprise the addition and/or substitution of amino acids and/or nucleotides, such additions and/or substitutions may comprise 1 or more amino acid and/or nucleotide residues and may include modified amino acids and/or nucleotides.

Naturally occurring: As used herein, "naturally occurring" means existing in nature without artificial aid, or involvement of the hand of man.

Niche: As used herein, the term "niche" refers to a place, zone and/or habitat. In some embodiments, niches comprise cellular niches. As used herein, the term "cell niche" refers to a unique set of physiologic conditions in a cellular system within a tissue, organ or organ system within or derived from a mammalian organism. A cell niche may occur in vivo, in vitro, ex vivo, or in situ. Given the complex nature and the dynamic processes involved in growth factor signaling, a cell niche may be characterized functionally, spatially or temporally or may be used to refer to any environment that encompasses one or more cells. As such, in some embodiments a cell niche includes the environment of any cell adjacent to another cell that provides support, such as for example a nurse cell.

Non-human vertebrate: As used herein, a "non-human vertebrate" includes all vertebrates except *Homo sapiens*, including wild and domesticated species. Examples of non-human vertebrates include, but are not limited to, mammals, such as alpaca, banteng, bison, camel, cat, cattle, deer, dog, donkey, gayal, goat, guinea pig, horse, llama, mule, pig, rabbit, reindeer, sheep water buffalo, and yak.

Off-target: As used herein, "off target" refers to any unintended effect on any one or more target, gene and/or cellular transcript.

Operably linked: As used herein, the phrase "operably linked" refers to a functional connection between two or more molecules, constructs, transcripts, entities, moieties or the like.

Paratope: As used herein, a "paratope" refers to the antigen-binding site of an antibody.

Passive adsorption: As used herein, "passive adsorption" refers to a method of immobilizing solid-phase reactants on one or more surfaces (e.g. membranes, dishes, culture dishes, assay plates, etc.) Immobilization typically occurs due to affinity between such reactants and surface components.

Patient: As used herein, "patient" refers to a subject who may seek or be in need of treatment, requires treatment, is receiving treatment, will receive treatment, or a subject who is under care by a trained (e.g., licensed) professional for a particular disease or condition.

Peptide: As used herein, the term "peptide" refers to a chain of amino acids that is less than or equal to about 50 amino acids long, e.g., about 5, 10, 15, 20, 25, 30, 35, 40, 45, or 50 amino acids long.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: As used herein, the term "pharmaceutically acceptable excipient," as used herein, refers to any ingredient other than active agents (e.g., as described herein) present in pharmaceutical compositions and having the properties of being substantially nontoxic and non-inflammatory in subjects. In some embodiments, pharmaceutically acceptable excipients are vehicles capable of suspending and/or dissolving active agents. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: Pharmaceutically acceptable salts of the compounds described herein are forms of the disclosed compounds wherein the acid or base moiety is in its salt form (e.g., as generated by reacting a free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemisulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. Pharmaceutically acceptable salts include the conventional non-toxic salts, for example, from non-toxic inorganic or organic acids. In some embodiments a pharmaceutically acceptable salt is prepared from a parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in Remington's Pharmaceutical Sciences, 17th ed., Mack Publishing Company, Easton, Pa., 1985, p. 1418, Pharmaceutical Salts: Properties, Selection, and Use, P. H. Stahl and C. G. Wermuth (eds.), Wiley-VCH, 2008, and Berge et al., Journal of Pharmaceutical Science, 66, 1-19 (1977), each of which is incorporated herein by reference in its entirety. Pharmaceutically acceptable solvate: The term "pharmaceutically acceptable solvate," as used herein, refers to a crystalline form of a compound wherein molecules of a suitable solvent are incorporated in the crystal lattice. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N, N'-dimethylformamide (DMF), N, N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate." In some embodiments, the solvent incorporated into a solvate is of a type or at a level that is physiologically tolerable to an organism to which the solvate is administered (e.g., in a unit dosage form of a pharmaceutical composition).

Pharmacokinetic: As used herein, "pharmacokinetic" refers to any one or more properties of a molecule or compound as it relates to the determination of the fate of substances administered to living organisms. Pharmacokinetics are divided into several areas including the extent and rate of absorption, distribution, metabolism and excretion. This is commonly referred to as ADME where: (A) Absorption is the process of a substance entering the blood circulation; (D) Distribution is the dispersion or dissemination of substances throughout the fluids and tissues of the body; (M) Metabolism (or Biotransformation) is the irreversible transformation of parent compounds into daughter metabolites; and (E) Excretion (or Elimination) refers to the elimination of the substances from the body. In rare cases, some drugs irreversibly accumulate in body tissue.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may be covalently bonded or sequestered in some way until converted into the active drug moiety prior to, upon or after administration to a mammalian subject. Prodrugs can be prepared by modifying functional groups present in the compounds in such a way that the modifications are cleaved, either in routine manipulation or in vivo, to the parent compounds. Prodrugs include, among other things, compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Pro-drugs as Novel Delivery Systems," Vol. 14 of the A.C.S. Symposium Series, and in Bioreversible Carriers in Drug Design, ed. Edward B. Roche, American Pharmaceutical Association and Pergamon Press, 1987, both of which are hereby incorporated by reference in their entirety. The effector modules of the present invention may act as or be considered prodrugs.

Proliferate: As used herein, the term "proliferate" means to grow, expand, replicate or increase or cause to grow, expand, replicate or increase. "Proliferative" means having the ability to proliferate. "Anti-proliferative" means having properties counter to or in opposition to proliferative properties.

Protein of interest: As used herein, the terms "proteins of interest" or "desired proteins" include those provided herein and fragments, mutants, variants, and alterations thereof.

Proximal: As used herein, the term "proximal" means situated nearer to the center or to a point or region of interest.

Purified: As used herein, the term "purify" means to make substantially pure or clear from unwanted components, material defilement, admixture or imperfection. "Purified" refers to the state of being pure. "Purification" refers to the process of making pure.

Region: As used herein, the term "region" refers to a zone or general area. In some embodiments, when referring to a protein or protein module, a region may comprise a linear sequence of amino acids along the protein or protein module or may comprise a three dimensional area, an epitope and/or a cluster of epitopes. In some embodiments, regions comprise terminal regions. As used herein, the term "terminal region" refers to regions located at the ends or termini of a given agent. When referring to proteins, terminal regions may comprise N- and/or C-termini. N-termini refer to the end of a protein comprising an amino acid with a free amino group. C-termini refer to the end of a protein comprising an amino acid with a free carboxyl group. N- and/or C-terminal regions may there for comprise the N- and/or C-termini as well as surrounding amino acids. In some embodiments, N- and/or C-terminal regions comprise from about 3 amino acids to about 30 amino acids, from about 5 amino acids to about 40 amino acids, from about 10 amino acids to about 50 amino acids, from about 20 amino acids to about 100 amino acids and/or at least 100 amino acids. In some embodiments, N-terminal regions may comprise any length of amino acids that includes the N-terminus, but does not include the C-terminus. In some embodiments, C-terminal regions may comprise any length of amino acids, that include the C-terminus, but do not comprise the N-terminus.

Region of antibody recognition: As used herein, the term "region of antibody recognition" refers to one or more regions on one or more antigens or between two or more antigens that are specifically recognized and bound by corresponding antibodies. In some embodiments, regions of antibody recognition may comprise 1, 2, 3, 4, 5, 6, 7, 8, 9 or at least 10 amino acid residues. In some embodiments, regions of antibody recognition comprise a junction between two proteins or between two domains of the same protein that are in close proximity to one another.

Sample: As used herein, the term "sample" refers to an aliquot or portion taken from a source and/or provided for analysis or processing. In some embodiments, a sample is from a biological source such as a tissue, cell or component part (e.g. a body fluid, including but not limited to blood, mucus, lymphatic fluid, synovial fluid, cerebrospinal fluid, saliva, amniotic fluid, amniotic cord blood, urine, vaginal fluid and semen). In some embodiments, a sample may be or comprise a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. In some embodiments, a sample is or comprises a medium, such as a nutrient broth or gel, which may contain cellular components, such as proteins or nucleic acid molecule. In some embodiments, a "primary" sample is an aliquot of the source. In some embodiments, a primary sample is subjected to one or more processing (e.g., separation, purification, etc.) steps to prepare a sample for analysis or other use.

Signal Sequences: As used herein, the phrase "signal sequences" refers to a sequence which can direct the transport or localization of a protein.

Single unit dose: As used herein, a "single unit dose" is a dose of any therapeutic administered in one dose/at one time/single route/single point of contact, i.e., single administration event. In some embodiments, a single unit dose is provided as a discrete dosage form (e.g., a tablet, capsule, patch, loaded syringe, vial, etc.).

Similarity: As used herein, the term "similarly" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound or entity that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable. In some embodiments, stability is measured relative to an absolute value. In some embodiments, stability is measured relative to a secondary status or state or to a reference compound or entity.

Stimulus response element (SRE): the term "stimulus response element (SRE), as used herein, is a component of an effector module which is joined, attached, linked to or associated with one or more payloads of the effector module and in some instances is responsible for the responsive nature of the effector module to one or more stimuli. As used herein, the "responsive" nature of an SRE to a stimulus may be characterized by a covalent or non-covalent interaction, a direct or indirect association or a structural or chemical reaction to the stimulus. Further, the response of any SRE to a stimulus may be a matter of degree or kind. The response may be a partial response. The response may be a reversible response. The response may ultimately lead to a regulated signal or output. Such output signal may be of a relative nature to the stimulus, e.g., producing a modulatory effect of between 1 and 100 or a factored increase or decrease such as 2-fold, 3-fold, 4-fold, 5-fold, 10-fold or more. One non-limiting example of an SRE is a destabilizing domain (DD).

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term typically means within about 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, ex vivo, in situ or in the tissue or organ of an organism. The organism may be an animal, preferably a mammal, more preferably a human and most preferably a patient.

Target site: The term "target site" as used herein, refers to a region or area targeted by a given compound, composition or method of the invention. Target sites may include, but are not limited to cells, tissues, organs, organ systems, niches and the like.

Therapeutic Agent: The term "therapeutic agent" refers to any agent that, when administered to a subject, has a therapeutic, diagnostic, and/or prophylactic effect and/or elicits a desired biological and/or pharmacological effect. Therapeutic agents of the present invention include any of the biocircuit components taught herein either alone or in combination with other therapeutic agents.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose. In some embodiments, a therapeutically effective amount is administered in a dosage regimen comprising a plurality of doses. Those skilled in the art will appreciate that in some embodiments, a unit dosage form may be considered to comprise a therapeutically effective amount of a particular agent or entity if it comprises an amount that is effective when administered as part of such a dosage regimen.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in a 24 hr period. It may be administered as a single unit dose.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Tune: As used herein, the term "tune" means to adjust, balance or adapt one thing in response to a stimulus or toward a particular outcome. In one non-limiting example, the SREs and/or DDs of the present invention adjust, balance or adapt the function or structure of compositions to which they are appended, attached or associated with in response to particular stimuli and/or environments.

Unmodified: As used herein, "unmodified" refers to any substance, compound or molecule prior to being changed in any way. Unmodified may, but does not always, refer to the wild type or native form of a biomolecule or entity. Molecules or entities may undergo a series of modifications whereby each modified product may serve as the "unmodified" starting or reference molecule or entity for a subsequent modification.

EXAMPLES

Example 1. Screening Method to Identify Ligand Responsive SREs or DDs

Study Design

To engineer constructs that display ligand dependent stability, a candidate ligand binding domain (LBD) is selected and a cell-based screen using yellow fluorescent protein (YFP) as a reporter for protein stability is designed to identify mutants of the candidate LBD possessing the desired characteristics of a destabilizing domain: low protein levels in the absence of a ligand of the LBD, (i.e., low basal stability), large dynamic range, robust and predictable dose-response behavior, and rapid kinetics of degradation (Banaszynski, et al., (2006) *Cell;* 126(5): 995-1004). The candidate LBD binds to a desired ligand but not endogenous signaling molecules.

The candidate LBD sequence (as a template) is first mutated using a combination of nucleotide analog mutagenesis and error-prone PCR, to generate libraries of mutants based on the template candidate domain sequence. The libraries generated are cloned in-frame at either the 5'- or 3'-ends of the YFP gene, and a retroviral expression system is used to stably transduce the libraries of YFP fusions into NIH3T3 fibroblasts.

Screening Strategy I

The transduced NIH3T3 cells are subjected to three to four rounds of sorting using fluorescence-activated cell sorting (FACS) to screen the libraries of candidate DDs. Transduced NIH3T3 cells are cultured in the absence of the high affinity ligand of the ligand binding domain (LBD), and cells that exhibit low levels of YFP expression are selected through FACS. The selected cell population is cultured in the presence of the high affinity ligand of the ligand binding domain for a period of time (e.g., 24 hours), at which point cells are sorted again by FACS. Cells that exhibit high levels of YFP expression are selected through FACS and the selected cell population is split into two groups and treated again with the high affinity ligand of the ligand binding domain at different concentrations; one group treated with the lower concentration of the ligand and the other treated with a high concentration of the ligand, for a period of time (e.g., 24 hours), at which point cells are sorted again by FACS. Cells expressing mutants that are responsive to lower concentrations of the ligand are isolated.

The isolated cells responsible to the lower concentration of the ligand are treated with the ligand again and cells exhibiting low fluorescence levels are collected 4 hours following removal of the ligand from the media. This fourth sorting is designed to enrich cells that exhibit fast kinetics of degradation (Iwamoto et al., *Chem Biol.* 2010 Sep. 24; 17(9): 981-988).

The collected cells after four rounds of sorting are recovered. The identified candidate cells are harvested and the genomic DNA is extracted. The candidate DDs are amplified by PCR and isolated. The candidate DDs are sequenced and compared to the LBD template to identify the actual mutations in candidate DDs.

Screening Strategy II

The selected cell population is subject to additional one or more sorts by FACS in the absence of high affinity ligand of LBD and cells that exhibit low levels of YFP expression are selected for further analysis. Cells are treated with high affinity ligand of the ligand binding domain, for a period of time (e.g. 24 hours), and sorted again by FACS. Cells expressing high levels of YFP are selected for through FACS. Cells with high expression of YFP are treated with ligand again and cells exhibiting low fluorescence levels are collected 4 hours following removal of the ligand from the media to enrich cells that exhibit fast kinetics of degradation. Any of the sorting steps may be repeated to identify DDs with ligand dependent stability.

Example 2. *E. coli* DHFR (ecDHFR)-TMP Driven Assays

The ecDHFR plus trimethoprim system may be used to screen and or identify constructs useful in the invention. It was first described in 2010 (Iwamoto et al., *Chem Biol.* 2010; 17(9):981-8, the contents of which are incorporated herein by reference in their entirety).

Briefly, using this system, mutants of *E. coli* dihydrofolate reductase (ecDHFR) protein are engineered to be degraded when expressed in mammalian cells. When a destabilizing domain (DD) is fused to a protein of interest, its instability is conferred to the fused protein. Trimethoprim (TMP) is a high-affinity ligand for ecDHFR that stabilizes fusion proteins in a dose-dependent manner. The ability of TMP to cross the blood-brain barrier (BBB) enables the tunable regulation of proteins expressed in cells found within the mammalian central nervous system. The ecDHFR-TMP DD system can work in parallel to the existing FKBP/Shld1-based DD system, allowing simultaneous regulation of two proteins independently.

Example 3. Regulation of Protein Expression in Mammalian Cells and/or Systems

Regulation of Protein Expression in Mammalian Cells

Standard molecular cloning techniques are used to generate a fusion of the signal response element (SRE), e.g., a destabilization domain (DD) and the payload of interest (POI) into a retroviral plasmid, generating a SRE-POI construct. An epitope tag, FLAG-tag is appended to the protein of interest. The plasmids are packaged into viral particles following standard viral infection protocol. Harvested viral particles proceed immediately to creation of cell lines to test regulation of the POI expression in response to the ligand; or are frozen at −80° C. for future use.

To create a mammalian cell line containing the integrated SRE-POI transgene, NIH3T3 cells are plated and 3 mL filtered viral supernatant is added to the culture media. After four hours of infection, the viral media is replaced with 3T3 culture media. 48 hours after infection, cells with stable integration of the SRE-POI construct are selected by FACS and a fluorescent marker.

To test for ligand-dependent control of protein stability, equal numbers of cells with stable integration of the SRE-POI construct are plated in two cell culture plates; a high affinity ligand of the SRE is added in one plate and the other one is added with an equal volume of ethanol as a control. After incubation for 4 to 24 hours, the POI stability is assayed using either flow cytometry or western blotting.

A dose-response experiment using varying concentrations of the ligand and a time course assay is performed to test the ligand-dependent protein expression levels.

Regulation of Protein Expression in Living Animals (Mice)

The SRE-POI construct and cells with stable integration of the SRE-POI construct are created following the same procedure as discussed above. A tumor xenograft is used as a mechanism to delivery transgene in mice (Banaszynski et al., *Nat. Med.*, 2008, 14:1123-1127).

Day 1:

Culture cells containing a stably integrated SRE-POI transgene to 80% confluence and count number of cells. Adjust the number of cells to implant per animal depending on the growth of the cell line in animals.

Day 2:

Trypsinize, quench with complete media, and spin cells. Wash cells three times with PBS, and resuspend cells in 100 μL (10,000 cells per μL) of DMEM (no FBS) per animal. Xenograft cells subcutaneously (or at desired location) into mice anesthetized with isoflurane (2%).

After transplanted cells form stable grafts, treatment of the ligand of the SRE begins. The ligand is reconstituted in an injectable solution (e.g., 9:1 PEG400: Tween 80) at various concentrations, and injected intravenously to a test animal. A control animal is injected with the injection vehicle only.

Day 1 after the Injection:

The expression level of the POI is analyzed for testing experimental SRE-POI stability. For direct protein measurement, tumors are removed and the tumor tissue amount is standardized for tumor samples from each test animal. Tumor tissues are homogenized and assayed for protein levels via ELISA or immunoblotting using antibodies specific to the POI.

Mice are dosed with the ligand every 48 hours. SRE-POI stabilization is periodically analyzed for the phenotypic and/or functional effects of protein stabilization. For example, the tumor xenograft regression/size is measured as functional effects of POI stabilization dependent on the ligand treatment.

Example 4. DD Regulated IL2 Expression

FKBP (L106P) and ecDHFR (R12Y, Y100I) are well-characterized destabilizing domains which can confer instability to fusion partners (e.g., a POI). The instability is reversed by a synthetic ligand named Shield-1 that binds to FKBP; TMP that binds to DHFR. An IL2 polypeptide was linked to either FKBP (L106P) or ecDHFR (R12Y, Y100I). IL2 constructs were cloned into pLVX-IRES-Puro lentiviral vectors. An IL2 signal sequence was inserted at the N terminus of the construct.

Figure 20:
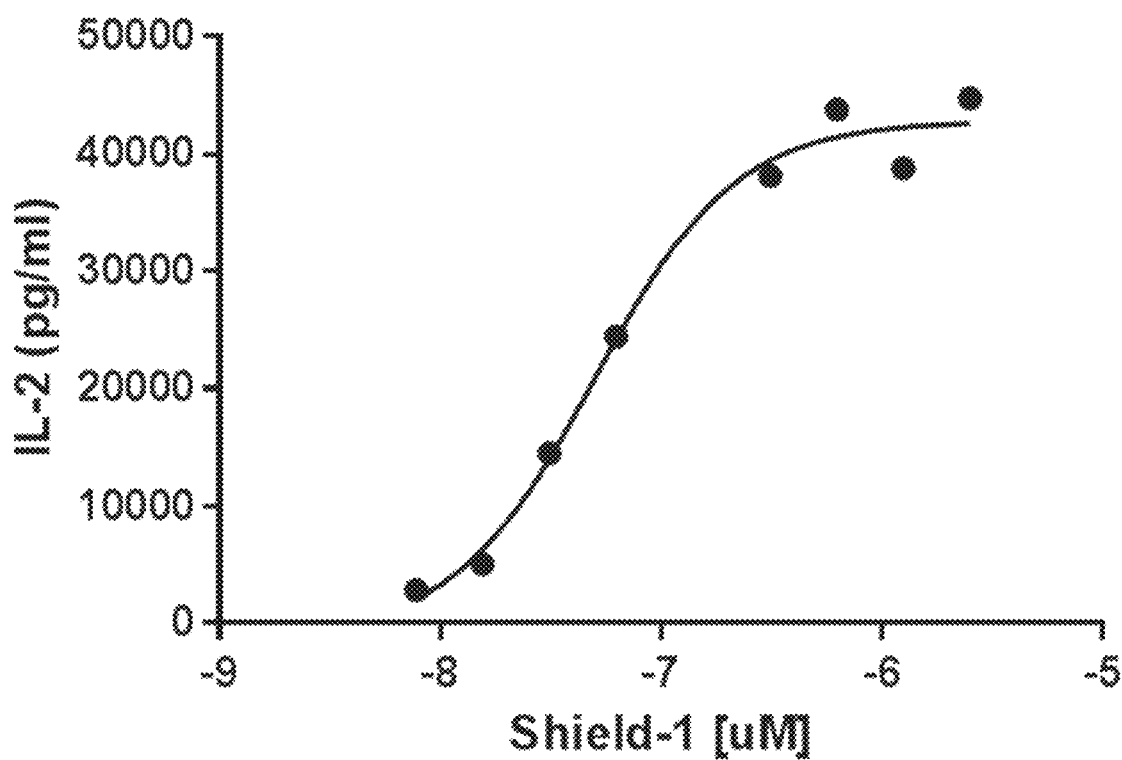
FIG. 20 is a line graph depicting DD-IL2 levels in response to varying concentrations of Shield-1.

To evaluate dependence of IL2 levels on Shield-1 dose, HCT116 cells were plated onto a 96-well plate and treated with varying concentrations of Shield-1. Media was then collected from cells and IL2 levels were quantified using IL2 ELISA (FIG. 20). IL2 increased with increase in Shield-1 concentration and plateaued at higher Shield-1 dose levels. The ECK of Shield-1 was determined to be 50 nM Example 5. DD Regulated IL12 Expression Several FKBP (DD)-IL12 and DHFR (DD)-IL12 constructs (as shown in Table 18) were cloned into pLVX-IRES-Puro lentiviral vectors. FKBP(DD) is positioned at either N-terminus (Construct ID # OT-IL12-001, OT-IL12-002 and OT-IL12-003) or C-terminus (OT-IL12-004, OT-IL12-005 and OT-IL12-009) of the fusion construct. ecDHFR (R12Y, Y100I) is located at the N-terminal end of the fusion construct (OT-IL12-007). A p40 signal sequence was inserted next to the DD or IL-12. In several constructs, a furin protease cleavage site or a modified furin site was included.

HEK293T cells were transiently transfected with 200 ng or 1 µg FKBP-IL12 plasmids (OT-IL12-001, OT-IL12-002, OT-IL12-003, OT-IL12-004, and OT-IL12-005), and treated with 10 µM Shield-1 or left untreated for 6 hours. Culture media was collected from transfected cells and diluted 1:50 to measure IL12 levels using p40 ELISA. Average IL12 ELISA readings are presented in Table 22.

TABLE 22

IL12 induction after transient transfection

| Construct ID | 10 µM Shield-1 | No Shield-1 |
|---|---|---|
| OT-IL12-001 | 1748.95 | 1289.61 |
| OT-IL12-002 | 50.73 | 18.01 |
| OT-IL12-003 | 2138.25 | 1762.55 |
| OT-IL12-004 | 1567.62 | 385.95 |
| OT-IL12-005 | 2670.80 | 1188.42 |
| HEK293T | −22.04 | −12.92 |

Treatment with Shield-1 resulted in a significant increase in IL12 over untreated with OT-IL12-004, and OT-IL12-005 constructs. OT-IL12-001, and OT-IL12-003 showed only modest increase in IL12 levels following Shield-1 treatment.

IL12 levels were also measured in cells following stable transfection. 500,000 cells stably transduced with OT-IL12-004 were plated in a 12 well plate and incubated overnight in growth media consisting of Dulbecco's Modified Eagle medium (DMEM) containing 10% fetal bovine serum (FBS). The next day the cells were treated with 1 µM Shield-1 or left untreated for 6 or 24 hours. Following treatment with Shield-1, growth media was collected from the cells and diluted 10, 40, 160 or 640 fold and FKBP-IL12 levels were quantified using IL12-p40 ELISA assay. Average IL12 ELISA readings are presented in Table 23.

TABLE 23

IL12 induction after stable transfection

| Media dilution (fold) | 6 hours | | 24 hours | |
|---|---|---|---|---|
| | 1 µM Shield-1 | No Shield-1 | 1 µM Shield-1 | No Shield-1 |
| 10 | 0.58 | 0.17 | 1.33 | 0.28 |
| 40 | 0.26 | 0.10 | 0.79 | 0.12 |
| 160 | 0.12 | 0.08 | 0.31 | 0.09 |
| 640 | 0.08 | 0.09 | 0.12 | 0.08 |

IL12 induction following both 6 and 24 hours of Shield-1 treatment was most prominent at the lowest dilution factor of 10. A mild induction of IL12 induction was also observed at media dilution factor of 40.

To evaluate Shield-1 dependent FKBP-IL12 induction over time, 2 million cells were plated in growth medium and incubated overnight in the presence of 1 µM Shield-1 or left untreated. Cells were then incubated for an additional 2-72 hours and growth media was collected for the cells at all time points. Growth media was diluted 400 fold and IL12 levels were measured using IL12 p40 ELISA. Average IL12 ELISA readings are presented in Table 24.

TABLE 24

IL12 induction over time

| Time (hrs) | 1 µM Shield-1 | No Shield-1 |
|---|---|---|
| 2 | 0.1774 | 0.12615 |
| 4 | 0.2567 | 0.1359 |
| 6 | 0.29085 | 0.12655 |
| 8 | 0.2752 | 0.1385 |
| 24 | 0.99475 | 0.1819 |
| 48 | 1.78525 | 0.23145 |
| 72 | 1.6288 | 0.25955 |

IL12 expression in Shield-1 treated cells was higher than untreated following 24, 48 and 72 hours after Shield-1 treatment.

To evaluate the dependence of FKBP-IL12 production on Shield-1 dose levels, OT-IL12-004 transduced HEK293T cells were plated at different densities (40,000 cells, 20,000 cells, 10,000 cells or 5,000 cells per well) onto a 96-well plate. Following overnight incubation, cells were treated with growth medium containing 0 to 10 µM Shield-1 for 24 hours. Media was then collected, diluted 400 fold and FKBP-IL12 levels were measured using IL12-p40 ELISA. Average IL12 ELISA readings are presented in Table 25.

TABLE 25

Dose and cell number dependent IL12 induction

| Shield-1 (µM) | 40000 cells/well | 20000 cells/well | 10000 cells/well | 5000 cells/well |
|---|---|---|---|---|
| 10.00 | 623.77 | 656.70 | 214.11 | 193.62 |
| 3.33 | 670.64 | 618.10 | 273.74 | 207.55 |
| 1.11 | 677.27 | 872.24 | 322.56 | 203.71 |
| 0.37 | 368.17 | 582.71 | 250.49 | 172.50 |
| 0.12 | 197.29 | 343.34 | 156.98 | 95.92 |
| 0.04 | 171.50 | 205.68 | 63.79 | 48.89 |
| 0.01 | 117.25 | 103.56 | 13.30 | −2.35 |
| 0.00 | 66.34 | 60.58 | 2.11 | −8.53 |
| 0.00 | 100.43 | 39.55 | −13.58 | −21.76 |
| 0.00 | 83.49 | 7.92 | −21.76 | −26.97 |

A dose dependent IL12 induction was observed at all cell numbers tested. IL12 induction increased with Shield-1 up to a dose of 1 µM; following which IL12 induction plateaued. Notably, greater IL12 induction was observed at 2000 and 4000 cells/well.

Example 6. FKBP and ecDHFR Regulated IL12 Mediated Functions

Figure 21A:
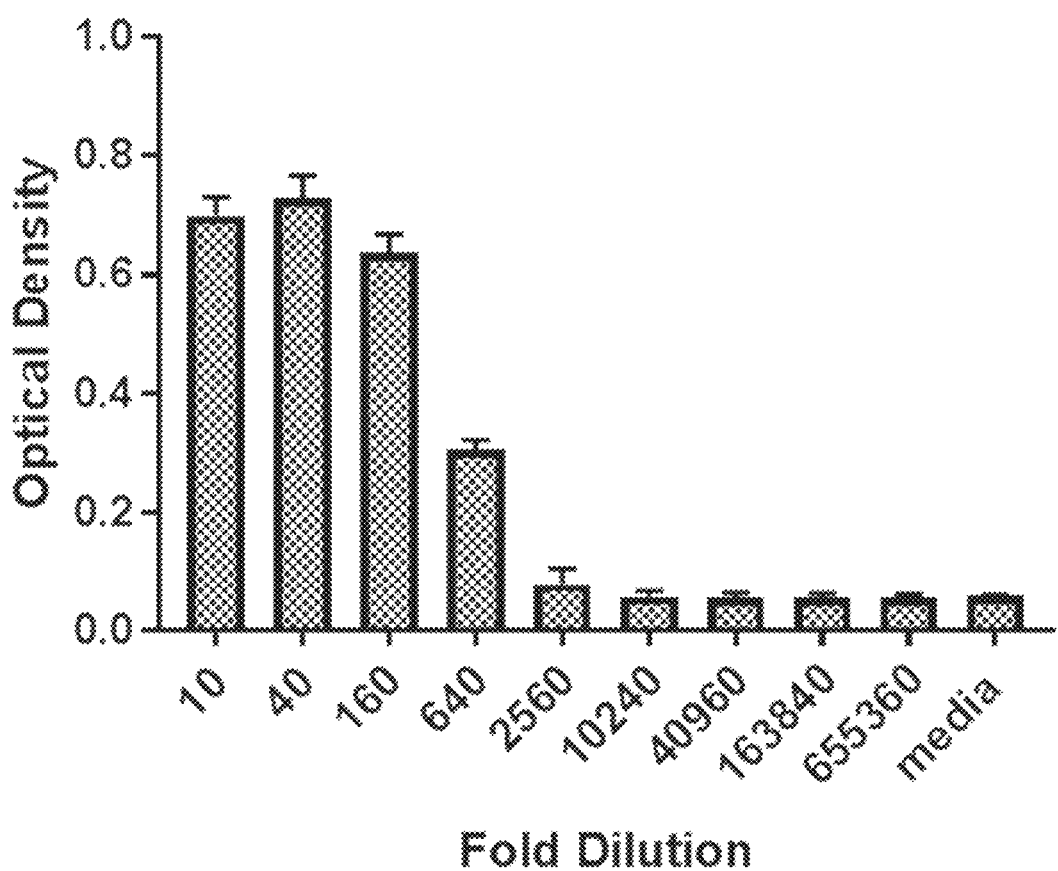
FIG. 21A is a bar graph depicting DD-IL12 levels in the various dilutions of media derived from cells expressing DD-IL12.

HEK-Blue sensor cells (InvivoGen, San Diego, Calif.) were utilized to evaluate whether DD regulated IL12 is capable of regulating signaling downstream of IL12. In these cells, the IL12 receptor, STAT4 and downstream transcriptional elements are tied to a reporter gene such that IL12 signaling can be monitored. To evaluate production of functional IL12, one million HEK 293T were transfected with 200 ng of OT-IL-12-003 plasmid using Lipofectamine 2000 (Thermo Fisher Scientific, Waltham, Mass.). 48 hours after transfection, cells were treated with growth media containing 10 µM Shield-1, incubated for another 24 hours, following which, media was collected. 50,000 HEK 293 Blue sensor cells were plated onto 96 well plates and incubated overnight with media (at different dilutions) from Shield-1 treated OT-IL12-003 expressing HEK293T cells. After overnight incubation, 20 µl media was removed from each well and incubated with 180 µl Quanti-Blue reagent (InvivoGen, San Diego, Calif.) for 30 minutes at 37° C. Absorption was measured at 620 nm using a spectrophotometer. To generate a standard curve, 180 µl Quanti-Blue reagent was mixed with 20 µl of recombinant IL12 at following concentrations 500, 250, 125, 62.5, 31.25, 15.62, 7.8 and 3.9 pg/ml. Functional IL12 concentrations were determined by comparing the optical density of each sample with IL12 standard curve. Measurable levels of functional IL12 were reached with 640 fold dilutions of IL12 containing growth media and further plateaued at higher concentrations of the media (FIG. 21A).

The dependence of functional IL12 production on the dose of Shield-1 used was also evaluated. 10,000 HEK293T cells stably transduced with OT-IL-12-004 were plated onto 96 well plated and treated with growth media containing 10, 3.33, 1.11, 0.37, 0.12, 0.04, 0.01, 0.005, 0.002 or 0 µM Shield-1 for 24 hours. Following Shield-1 treatment, media from cells was diluted 200 fold and 20 µL of the diluted media was added to HEK Blue sensor cells. After overnight incubation, 20 µl of media was removed from each well and incubated with 180 µl Quanti-Blue reagent (InvivoGen, San Diego, Calif.) for 30 minutes at 37° C. Absorption was measured at 620 nm using a spectrophotometer. To generate a standard curve, 180 µl Quanti-Blue reagent was mixed with 20 µl of recombinant IL12 at following concentrations 500, 250, 125, 62.5, 31.25, 15.62, 7.8 and 3.9 pg/ml. Functional IL12 concentrations were determined by comparing the optical density of each sample with IL12 standard curve. A dose dependent increase in the levels of functional IL12 levels was observed (FIG. 21B).

Example 7. DD Regulated Luciferase

Figure 22A:
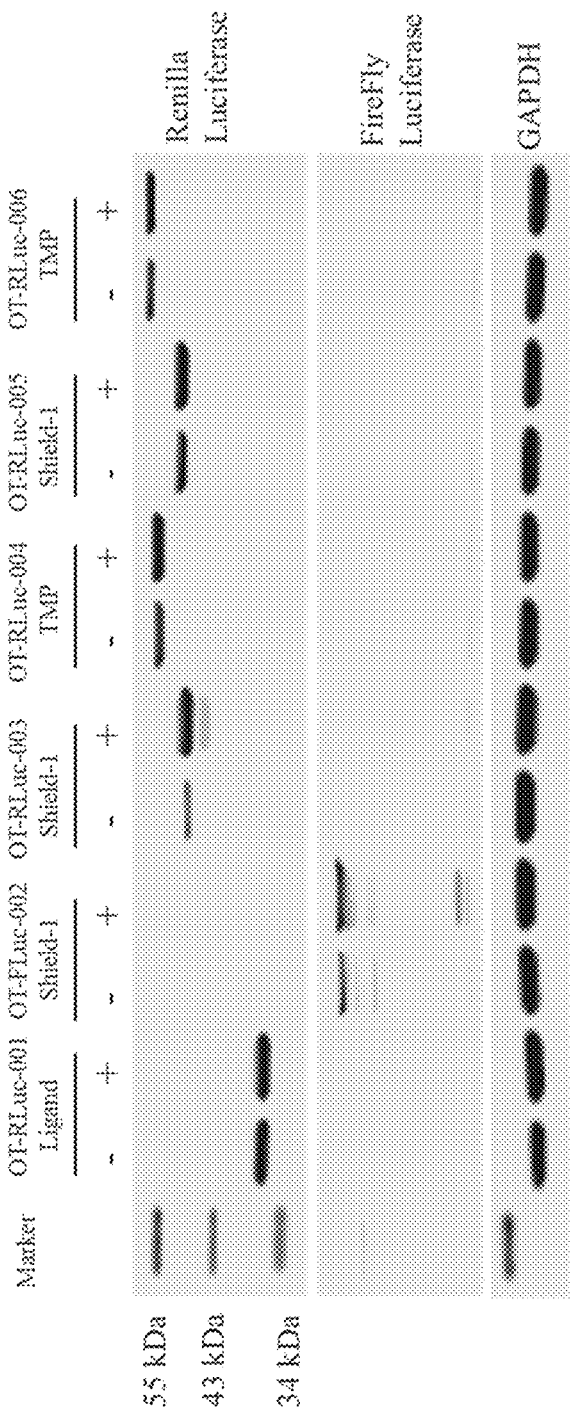
FIG. 22A is a western blot depicting luciferase levels in DD-luciferase expressing cells.

DD regulated luciferase can be used to track cells in vivo e.g. T cells. Firefly luciferase or *Renilla* luciferase may be utilized as the payload. HCT-116 cells were stably transduced with the constitutive (OT-RLuc-001) or DD regulated constructs (OT-RLuc-002, OT-RLuc-003, OT-RLuc-004, OT-RLuc-005 and OT-RLuc-006). Cells were treated with 1 µM Shield-1, or 10 µM Trimethoprim or vehicle control for 24 hours and luciferase expression and activity was measured. Luciferase expression was measured via western blotting using Anti-*Renilla* luciferase and anti-Firefly luciferase antibodies (Abcam, Cambridge, UK). Blots were also probed with anti-GAPDH antibody to ensure even protein loading in all samples. As expected, the constitutive luciferase construct (OT-RLuc-001) showed expression of *Renilla* luciferase both in the presence and absence of ligand. In contrast, OT-RLuc-003 showed strong Shield-1 dependent stabilization of *Renilla* luciferase. OT-RLuc-004, 005 and 006 showed modest stabilization of *Renilla* luciferase in the presence of their corresponding ligand, while OT-FLuc-002 showed modest stabilization of firefly luciferase with the addition of Shield-1 (FIG. 22A).

Figure 22B:
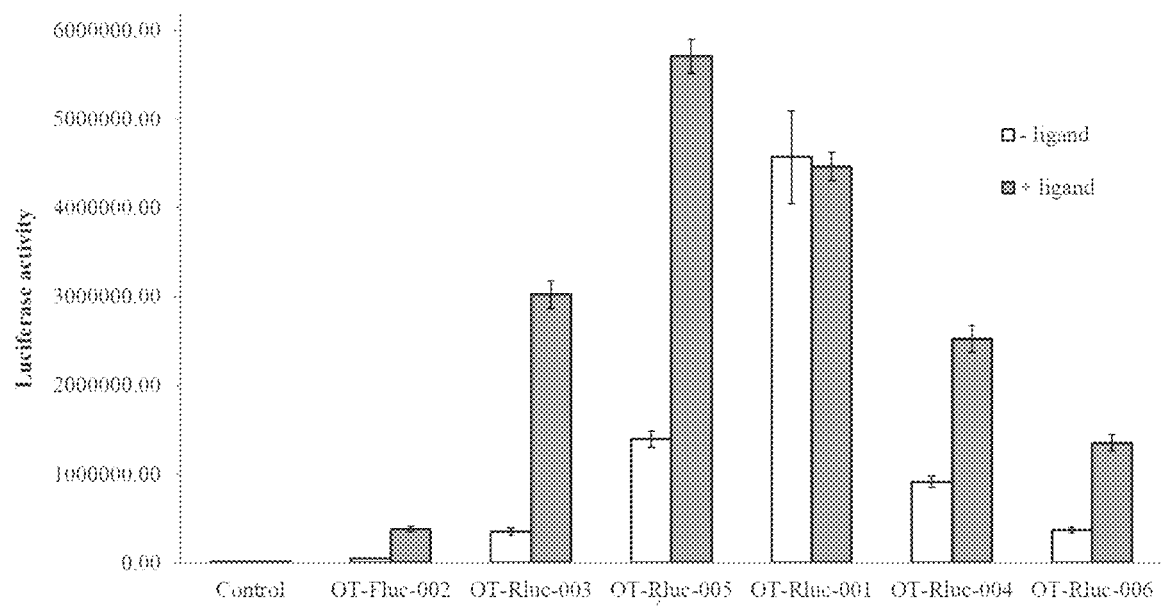
FIG. 22B depicts luciferase activity.

Ligand dependent activity of *Renilla* and firefly luciferase constructs was also measured in using coelentrazine and luciferin substrates respectively. Cells were treated with 1 µM Shield-1, or 10 µM Trimethoprim or vehicle control for 24 hours, lysed with assay lysis buffer and incubated with the luciferase substrate. Luciferase activity was measured as luminescence reading using a luminometer and the values were compared to control comprising of lysis buffer and substrate. In this assay, all DD regulated showed ligand dependent increase in luciferase activity compared to control. As expected, the constitutive construct OT-RLuc-001 showed high luciferase activity both in the presence and absence of ligand (FIG. 22B).

Example 8. Regulation of Glucagon Expression in Mammalian Cells and/or Systems for the Treatment of Hypoglycemia Hypoglycemia refers to a condition when the blood glucose levels are below normal. Blood glucose levels can be restored by administering glucagon. To generate biocircuits for the treatment of hypoglycemia, SREs fused to the payload of interest, glucagon, are cloned into retroviral vectors using standard molecular cloning techniques. Optional furin cleavage sites are included in the SREs to induce secretion of glucagon in non-secretory cells. NIH3T3 cells are transfected with retroviral vectors. Transfected cells are treated with high affinity ligand of the SRE and the glucagon expression is measured in the media using western blotting. Changes in glucose levels in the media is measured using mass spectrophotometry. An increase in glucagon protein levels and a concomitant increase in glucose levels in the media indicates that the ligand is able to stabilize the construct thereby allowing glucagon expression.

Example 9. SRE-Based Cas9 Expression Systems

CRISPR/Cas9 technology has been widely used to generate heritable genomic changes. However, constitutive expression of Cas9 can result in toxicity and off-target effects. These limitations may be overcome by generating a regulatable Cas9 expression system where the Cas9 is fused to an SRE. Lentiviral vectors consisting of a first vector where a single guide RNA (sgRNA) targeting a gene of interest is driven by a constitutive promoter, and a second vector containing Cas9 fused at its N-terminal with a ligand-responsive SRE under the control of a suitable promoter are generated (see FIG. 19A and FIG. 19B). The constructs are then transduced into target cells such as cancer cells and embryonic stem cells. The expression levels of Cas9 and target gene of interest are measured in the presence or absence of varying doses of the ligand specific to the SRE, using western blot and RT-PCR. Cas9 expression is expected to be below detection levels in untreated cells and cells are expected to show a ligand dose-dependent increase in Cas9 expression. In contrast, the expression levels of target gene of interest are expected to be high in the untreated cells and below detection levels in ligand treated cells.

Example 10. Ex Vivo Expansion of Stem Cells for Engraftment Using SRE Regulated Expansion Factors To generate biocircuits for the expansion of stem cells, SREs are fused to the payload of interest, a stem cell expansion factor such as GM-CSF, IL-3, Il-6, SCF, FL, or TPO. SRE fusion constructs are cloned into retroviral vectors and transduced into freshly isolated CD34+ hematopoietic stem cells. Cells are then treated with high affinity ligand of the SRE and the stem cell expansion factor expression is measured using western blotting. An increase in expansion factor protein level indicates that the ligand is able to stabilize the construct thereby allowing its expression. Growth of the transduced hematopoietic stem cells over time is also monitored to test the functionality of the construct.

Example 11. Regulation of Microbiome Using SREs or DDs

Microorganisms, e.g. bacteria used in microbiome therapy may be programmed to die at a specific time, after the delivery of gene or genes, and/or after the host has experienced the therapeutic effect. Standard molecular cloning techniques are used to generate a fusion of the signal response element (SRE), e.g., a destabilization domain (DD) and the payload of interest (POI), a bacterial toxin gene into an appropriate bacterial vector, generating a SRE-toxin construct. To facilitate monitoring of in vivo colonization by transformed bacteria, a detectable label, luciferase is also appended to the construct. Bacteria are transformed with the SRE-POI construct following standard transformation protocol and successfully transformed clones are sequence verified.

Colony forming unit (CFU) cell viability assays are used to measure ligand dependent protein stabilization and functionality of the SRE-toxin construct. Two overnight cultures are grown under survival conditions i.e. in the absence of ligand, following which a high affinity ligand of the SRE is added to one plate and the other plate is treated with an appropriate vehicle control. Samples are collected every two hours, serially diluted and spotted onto agar plates with appropriate survival signals. CFU and survival ratios are calculated.

To test functionality of SRE-toxin construct in vivo, mice are administered bacteria expressing SRE-toxin by oral gavage for up to 1 week. After successful colonization of the bacteria has been confirmed using bioluminescence imaging, treatment with the ligand of the SRE begins. Test group mice are injected with various concentrations of the ligand, while a control group is injected with the appropriate vehicle control. Ligand dependent expression of the toxin in the test group is expected to result in the death of colonized bacteria as measured by the loss of bioluminescence following ligand injection.

Example 12. Regulatable Expression of Biomolecules in the Liver

The liver may be exploited as a biofactory for the production of hepatic and non-hepatic proteins such as coagulation factors, insulin, growth hormones, cytokines, and enzymes. To generate regulatable biofactory, liver tropic adeno-associated virus vectors (rAAVs) such as rAAV2 and rAAV8 are engineered with SRE fused to payload of interest e.g. immunomodulatory cytokine, IL10. rAAV vector formulations are injected into mice via the tail vein. The number of injections and the dose of rAAV formulation delivered is optimized to the payload of interest. A few days after the delivery of the rAAV, mice are injected with the ligand specific to the SRE or appropriate vehicle control. Serum is isolated from the mice and IL10 levels are measured. IL10 levels are expected to be high in ligand treated mice and below detection in in vehicle control treated mice.

Example 13. Regulation of Ammonia Metabolizing Enzymes by SRE Based-Ammonia Biosensors Ammonia is a key nitrogen source and a metabolic intermediate. Yet, excess ammonia can be detrimental to cell growth, especially in artificial growth environments such as bioreactors. SREs that utilize ammonia as the ligand and contain payloads that are capable of metabolizing ammonia may be useful in mitigating the negative consequences of ammonia. To engineer constructs that display ammonia dependent stability, a candidate ammonia binding domain is selected and a screened as described in Example 1 to identify a binding domain with the desired characteristics of a destabilizing domain. An ammonia metabolizing enzyme such as Carbamoyl Phosphate Synthetase 1 is selected as the Payload of interest (POI). Next, standard molecular cloning techniques are used to generate a fusion of the signal response element (SRE), e.g., ammonia sensitive-destabilization domain and the POI. Constructs are packaged into lentiviral vectors and NIH3T3 cells are transfected with lentiviral vectors. Transfected cells are treated with ammonium and the POI expression is measured using western blotting. Changes in intracellular ammonia and related metabolites is measure using mass spectrophotometry. An increase in POI protein levels in the and a concomitant increase in intracellular levels of ammonia metabolism products indicates that ammonia is able to stabilize the construct thereby allowing its expression.

Example 14. Regulation of Protein Expression in Transgenic Animals (Mice

Standard molecular cloning techniques are used to generate a fusion of the signal response element (SRE), e.g., a destabilization domain (DD) and the payload of interest (POI) into a retroviral plasmid, generating a SRE-POI construct. The SRE-POI constructs are then microinjected into fertilized embryos and transplanted into pseudo pregnant female mice. Resulting offspring are genotyped to identify mice carrying transgene and mice positive for the transgene. To test the expression level of the SRE-POI transgene, mice are dosed with the ligand and POI protein stabilization is analyzed. Functional effects of POI stabilization dependent on the ligand treatment are also evaluated Example 15. DD Regulated IL15

To test ligand dependent IL15 production, 1 million HEK-293T cells were plated in a 6-well plate in growth media containing DMEM and 10% FBS and incubated overnight at 37° C. at 5% CO2. Cells were then transfected with 100 ng of OT-L15-001 (constitutive) or OT-IL15-002 (ecDHFR-IL15) using Lipofectamine 2000 and incubated for 48 hrs. Following the incubation, media was exchanged for growth medium containing 10 µM Trimethoprim or vehicle control and further incubated for 24 hrs. Media was collected and the undiluted media samples or media samples diluted 4, 16, 256, 1024, 4096 or 16384-fold were tested using human IL-15 ELISA. Average IL15 ELISA readings are presented in Table 26.

TABLE 26

DD-IL15 induction

| Media dilution (fold) | Vehicle | 10 μM TMP |
|---|---|---|
| 1 | 0.396 | 0.820 |
| 4 | 0.154 | 0.287 |
| 16 | 0.074 | 0.116 |
| 64 | 0.056 | 0.073 |
| 256 | 0.053 | 0.057 |
| 1024 | 0.053 | 0.048 |
| 4096 | 0.049 | 0.049 |
| 16384 | 0.050 | 0.049 |

The 64-fold, 16-fold, 4-fold diluted, and undiluted media samples showed IL15 levels greater than vehicle control, suggesting Trimethoprim dependent stabilization of IL15 at these dilutions.

Example 16. DD Regulated CD19 Chimeric Antigen Receptor

A CD19 CAR fusion polypeptide was linked to either FKBP-DD or ecDHFR-DD and the constructs were cloned into pLVX-IRES-Puro vector. FKBP, and ecDHFR were positioned either between the CD19 scFv and the CD8αhinge (OT-CD190-002, OT-CD19C-003), between the CD8αhinge and the transmembrane domain (OT-CD19C-004, OT-CD19C-005) or at the C terminus of the construct (OT-CD19C-006 and OT-CD19C-007). A constitutively expressed CAR construct, OT-CD19C-001 was used as a positive control.

Figure 23B:
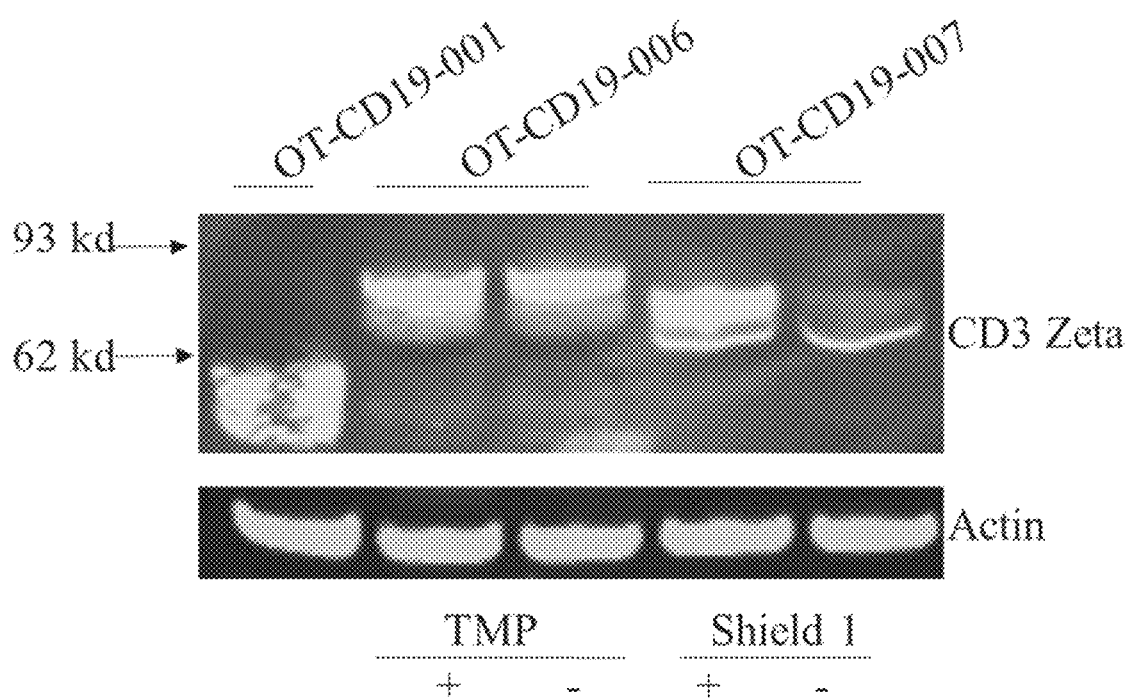

To test ligand dependent expression of DD-CD19 CAR constructs, 1 million HEK 293T cells were cultured in growth medium containing DMEM and 10% FBS and transfected with CAR constructs using Lipofectamine 2000. 48 hours after transfection, cells were treated with 1 μM or 10 μM Shield-1, 10 μM Trimethoprim, 1 μM Methotrexate, or vehicle control and incubated for 24 hours. Cells were harvested, lysed and immunoblotted for CD3 Zeta, a component of the CAR, using anti-CD247 (BD Pharmingen, Franklin Lanes, N.J.) and Alexa 555-conjugated-goat-anti mouse antibody (red) (Li-Cor, Lincoln, Nebr.). Lysates were also immunoblotted for Actin and probed with Alexa 488-conjugated secondary antibody (green) to confirm uniform protein loading in all the samples. Compared to the untreated control, OT-CD19C-002 and OT-CD19C-003 showed increased levels of CD3 Zeta in the presence of ligands, Shield-1 and TMP respectively, indicating the stabilization of the CD19 CAR (FIG. 23A). As shown in FIG. 23B, OT-CD19C-007 showed an increase in CD3 Zeta levels in the presence of Shield-1 and Methotrexate, indicating a ligand-dependent stabilization of CD19 CAR. As expected, the constutively expressed, OT-CD19C-001 showed strong expression of CD19 CAR in the absence of ligand treatment.

Figure 23C:
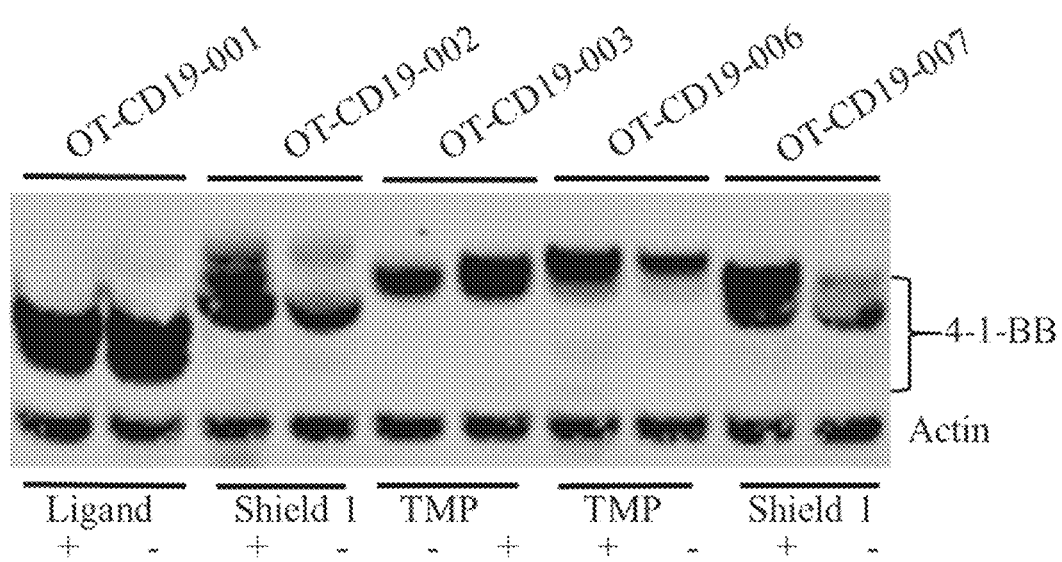
FIG. 23C is a western blot depicting 41-BB levels in CD19 CAR expressing cells.

Lysates from cells expressing CD19 CAR constructs were also immunoblotted for 4 1-BB, a component of the CAR. As shown in FIG. 23C, OT-CD19C-003, OT-CD19C-006 and OT-CD19C-007 showed increase in 4-1BB expression levels with the treatment of corresponding ligands—TMP and Shield-1, as compared to 4-1BB levels in the absence of ligand, indicating a ligand dependent stabilization of CD19 CAR.

Figure 23D:
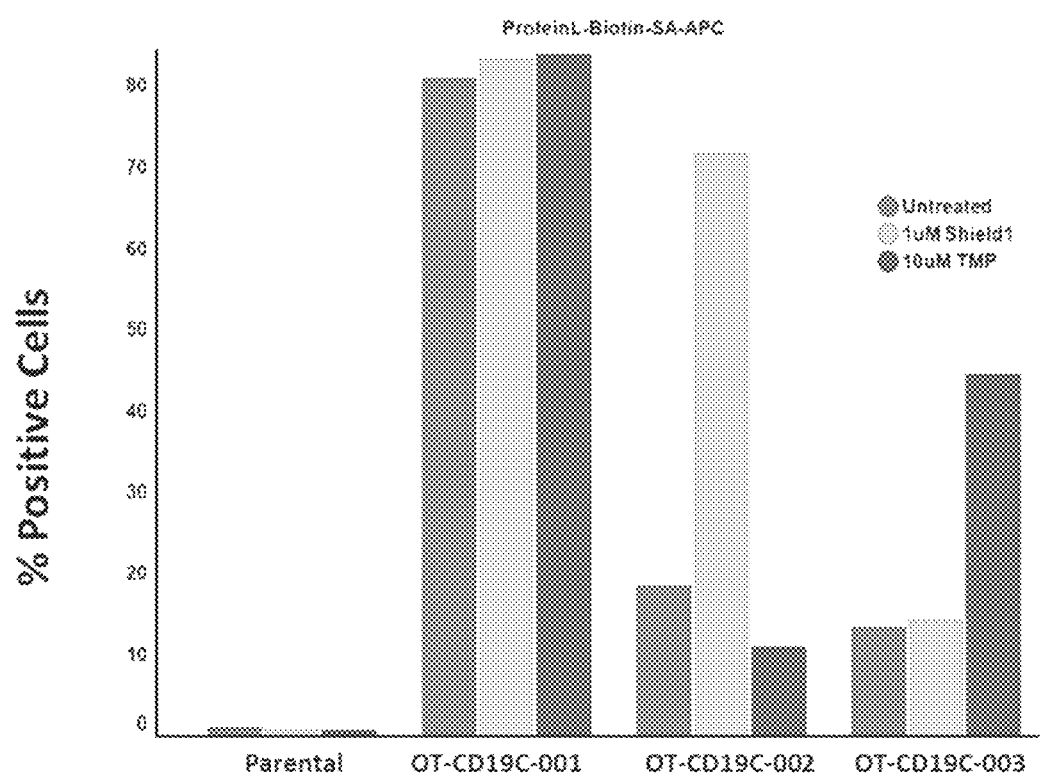
FIG. 23D is a bar graph depicting the surface expression of CD19 CAR.

Surface expression of DD-CD19 CAR constructs in HEK 293T cells was measured using Fluorescence activated cell sorting (FACS) with Protein L-Biotin-Strepavidin-Allophycocyanin which binds to the kappa light chain of the CAR (ThermoFisher Scientific, Waltham, Mass.). Cells were treated with 1 μM Shield-1, 1 μM Methotrexate, 10 μM Trimethoprim or vehicle control for 24 hours and subject to FACS analysis. As shown in FIG. 23D, surface expression of OT-CD19C-002 with FKBP-DD was detected only in the presence of Shield-1, while OT-CD19C-003 with ecDHFR-DD showed surface expression only in the presence of Trimethoprim. As expected, constitutively expressed construct OT-C19C-001 showed high expression both in ligand and control vehicle treated cells.

EQUIVALENTS AND SCOPE

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any antibiotic, therapeutic or active ingredient; any method of production; any method of use; etc.) can be excluded from any one or more claims, for any reason, whether or not related to the existence of prior art.

It is to be understood that the words which have been used are words of description rather than limitation, and that changes may be made within the purview of the appended claims without departing from the true scope and spirit of the invention in its broader aspects.

While the present invention has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the invention. The present invention is further illustrated by the following non-limiting examples.

LENGTHY TABLES

The patent contains a lengthy table section. A copy of the table is available in electronic form from the USPTO web site (https://seqdata.uspto.gov/?pageRequest=docDetail&DocID=US11446398B2). An electronic copy of the table will also be available from the USPTO upon request and payment of the fee set forth in 37 CFR 1.19(b)(3).

SEQUENCE LISTING (213456 sequences)

SEQ ID NO: 1 - protein, 165 aa, Homo sapiens
  Payload ID: 1;
  Gene Symbol: SEP15;
  Gene Name: 15 kDa selenoprt;
  ENSP ID: ENSP00000328729
  MOD_RES (96)..(96): Selenocysteine
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCGXKLGRFPQVQAFVRSDKPKLFRGLQIKYVRGSDPVLKLLDDNGNIAEELSILKWNTDSVEEFLSEKLERI

SEQ ID NO: 2 - protein, 124 aa, Homo sapiens
  Payload ID: 1;
  Gene Symbol: SEP15;
  Gene Name: 15 kDa selenoprt;
  ENSP ID: ENSP00000359585
  MOD_RES (96)..(96): Selenocysteine
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCGXKLGRFPQVQVCPWFRPCIKAFGRQWEHC

SEQ ID NO: 3 - protein, 144 aa, Homo sapiens
  Payload ID: 1;
  Gene Symbol: SEP15;
  Gene Name: 15 kDa selenoprt;
  ENSP ID: ENSP00000383810
MVAMAAGPSGCLVPAFGLRLLLATVLQAVSAFGAEFSSEACRELGFSSNLLCSSCDLLGQFNLLQLDPDCRGCCQEEAQFETKKYSSIVSKQECHHSNCMQELFLKFVDENWEGSLKSKLLLGVINPNCSEDCKSSMSVVQTLY

SEQ ID NO: 4 - protein, 123 aa, Homo sapiens
  Payload ID: 1;
  Gene Symbol: SEP15;
  Gene Name: 15 kDa selenoprt;
  ENSP ID: ENSP00000481113
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCGKLGRFPQVQVCPWFRPCIKAFGRQWEHC

SEQ ID NO: 5 - protein, 164 aa, Homo sapiens
  Payload ID: 1;
  Gene Symbol: SEP15;
  Gene Name: 15 kDa selenoprt;
  ENSP ID: ENSP00000484190
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCGKLGRFPQVQAFVRSDKPKLFRGLQIKYVRGSDPVLKLLDDNGNIAEELSILKWNTDSVEEFLSEKLERI

SEQ ID NO: 6 - protein, 88 aa, Homo sapiens
  Payload ID: 1;
  Gene Symbol: SEP15;
  Gene Name: 15 kDa selenoprt;
  ENSP ID: ENSP00000488294
FNLLQLDPDCRGCCQEEAQFETKKYSSIVSKQECHHSNCMQELFLKFVDENWEGSLKSKYVRGSDPVLKLLDDNGNIAEELSILKWNT

SEQ ID NO: 7 - protein, 31 aa, Homo sapiens
  Payload ID: 1;
  Gene Symbol: SEP15;
  Gene Name: 15 kDa selenoprt;
  ENSP ID: ENSP00000488471
  MOD_RES (1)..(1): Any amino acid
XGLRLLLATVLQAVSVDHLRSCHRESRSDCS

SEQ ID NO: 8 - protein, 283 aa, Homo sapiens
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000337463
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 9 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000364245

SEQ ID NO: 10 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000364248

SEQ ID NO: 11 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000372782

SEQ ID NO: 12 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000378874

SEQ ID NO: 13 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000378875

SEQ ID NO: 14 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000378877

SEQ ID NO: 15 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000382721

SEQ ID NO: 16 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000382723

SEQ ID NO: 17 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000382725

SEQ ID NO: 18 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000382726

SEQ ID NO: 19 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000382728

SEQ ID NO: 20 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000387738

SEQ ID NO: 21 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000387810

SEQ ID NO: 22 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000388090

SEQ ID NO: 23 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000388253

SEQ ID NO: 24 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000388815

SEQ ID NO: 25 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000388870

SEQ ID NO: 26 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000389516

SEQ ID NO: 27 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000390988

SEQ ID NO: 28 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000392083

SEQ ID NO: 29 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000392820

SEQ ID NO: 30 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000394919

SEQ ID NO: 31 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000395613

SEQ ID NO: 32 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000395863

SEQ ID NO: 33 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000397765

SEQ ID NO: 34 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000398016

SEQ ID NO: 35 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000401287

SEQ ID NO: 36 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000401410

SEQ ID NO: 37 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000404106

SEQ ID NO: 38 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000405565

SEQ ID NO: 39 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000405864

SEQ ID NO: 40 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000406582

SEQ ID NO: 41 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000406614

SEQ ID NO: 42 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000406615

SEQ ID NO: 43 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000407189

SEQ ID NO: 44 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000408032

SEQ ID NO: 45 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000408842

SEQ ID NO: 46 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000410831

SEQ ID NO: 47 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000412304

SEQ ID NO: 48 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000412805

SEQ ID NO: 49 - protein, 283 aa, Homo sapiens; identical to SEQ ID NO: 8
  Payload ID: 2;
  Gene Symbol: AGPAT1;
  Gene Name: 1-acylglycerol-3-phosphate O-acyltransferase 1;
  Uniprot ID:  Q99943;
  ENSP ID: ENSP00000415015

SEQ ID NO: 50 - protein, 246 aa, Homo sapiens
  Payload ID: 3;
  Gene Symbol: AGPAT2;
  Gene Name: 1-acylglycerol-3-phosphate O-acyltransferase 2;
  Uniprot ID:  O15120;
  ENSP ID: ENSP00000360759
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENVPIVPVVYSSFSSFYNTKKKFFTSGTVTVQVLEAIPTSGLTAADVPALVDTCHRAMRTTFLHISKTPQENGATAGSGVQPAQ

SEQ ID NO: 51 - protein, 278 aa, Homo sapiens
  Payload ID: 3;
  Gene Symbol: AGPAT2;
  Gene Name: 1-acylglycerol-3-phosphate O-acyltransferase 2;
  Uniprot ID:  O15120;
  ENSP ID: ENSP00000360761
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENLKVWIYPEGTRNDNGDLLPFKKGAFYLAVQAQVPIVPVVYSSFSSFYNTKKKFFTSGTVTVQVLEAIPTSGLTAADVPALVDTCHRAMRTTFLHISKTPQENGATAGSGVQPAQ

SEQ ID NO: 52 - protein, 278 aa, Homo sapiens; identical to SEQ ID NO: 51
  Payload ID: 3;
  Gene Symbol: AGPAT2;
  Gene Name: 1-acylglycerol-3-phosphate O-acyltransferase 2;
  Uniprot ID:  O15120;
  ENSP ID: ENSP00000438919

SEQ ID NO: 53 - protein, 376 aa, Homo sapiens
  Payload ID: 4;
  Gene Symbol: AGPAT3;
  Gene Name: 1-acylglycerol-3-phosphate O-acyltransferase 3;
  Uniprot ID:  Q9NRZ7;
  ENSP ID: ENSP00000291572
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 54 - protein, 376 aa, Homo sapiens; identical to SEQ ID NO: 53
  Payload ID: 4;
  Gene Symbol: AGPAT3;
  Gene Name: 1-acylglycerol-3-phosphate O-acyltransferase 3;
  Uniprot ID:  Q9NRZ7;
  ENSP ID: ENSP00000332989

SEQ ID NO: 55 - protein, 376 aa, Homo sapiens; identical to SEQ ID NO: 53
  Payload ID: 4;
  Gene Symbol: AGPAT3;
  Gene Name: 1-acylglycerol-3-phosphate O-acyltransferase 3;
  Uniprot ID:  Q9NRZ7;
  ENSP ID: ENSP00000381135

SEQ ID NO: 56 - protein, 376 aa, Homo sapiens; identical to SEQ ID NO: 53
  Payload ID: 4;
  Gene Symbol: AGPAT3;
  Gene Name: 1-acylglycerol-3-phosphate O-acyltransferase 3;
  Uniprot ID:  Q9NRZ7;
  ENSP ID: ENSP00000381138

SEQ ID NO: 57 - protein, 376 aa, Homo sapiens; identical to SEQ ID NO: 53
  Payload ID: 4;
  Gene Symbol: AGPAT3;
  Gene Name: 1-acylglycerol-3-phosphate O-acyltransferase 3;
  Uniprot ID:  Q9NRZ7;
  ENSP ID: ENSP00000381140

SEQ ID NO: 58 - protein, 79 aa, Homo sapiens
  Payload ID: 4;
  Gene Symbol: AGPAT3;
  Gene Name: 1-acylglycerol-3-phosphate O-acyltransferase 3;
  ENSP ID: ENSP00000389318
MGLLAFLKTQFVLHLLVGFVFVVSGLVINFVQLCTLALWPVSKQLYRRLNCRLAYSLWSQLVMLLEWWSCTECTLFTDQ

SEQ ID NO: 59 - protein, 38 aa, Homo sapiens
  Payload ID: 4;
  Gene Symbol: AGPAT3;
  Gene Name: 1-acylglycerol-3-phosphate O-acyltransferase 3;
  ENSP ID: ENSP00000394102
MGLLAFLKTQFVLHLLVGFVFVVSGLVINFVQLCTLAL

SEQ ID NO: 60 - protein, 128 aa, Homo sapiens
  Payload ID: 4;
  Gene Symbol: AGPAT3;
  Gene Name: 1-acylglycerol-3-phosphate O-acyltransferase 3;
  ENSP ID: ENSP00000412079
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLY

SEQ ID NO: 61 - protein, 255 aa, Homo sapiens
  Payload ID: 4;
  Gene Symbol: AGPAT3;
  Gene Name: 1-acylglycerol-3-phosphate O-acyltransferase 3;
  ENSP ID: ENSP00000413906
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCV

SEQ ID NO: 62 - protein, 255 aa, Homo sapiens; identical to SEQ ID NO: 61
  Payload ID: 4;
  Gene Symbol: AGPAT3;
  Gene Name: 1-acylglycerol-3-phosphate O-acyltransferase 3;
  ENSP ID: ENSP00000414440

SEQ ID NO: 63 - protein, 376 aa, Homo sapiens; identical to SEQ ID NO: 53
  Payload ID: 4;
  Gene Symbol: AGPAT3;
  Gene Name: 1-acylglycerol-3-phosphate O-acyltransferase 3;
  Uniprot ID:  Q9NRZ7;
  ENSP ID: ENSP00000443510

SEQ ID NO: 64 - protein, 378 aa, Homo sapiens
  Payload ID: 5;
  Gene Symbol: AGPAT4;
  Gene Name: 1-acylglycerol-3-phosphate O-acyltransferase 4;
  Uniprot ID:  Q9NRZ5;
  ENSP ID: ENSP00000314036
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 65 - protein, 159 aa, Homo sapiens
  Payload ID: 5;
  Gene Symbol: AGPAT4;
  Gene Name: 1-acylglycerol-3-phosphate O-acyltransferase 4;
  ENSP ID: ENSP00000355872
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGVSQKCIPPCLTHFSGSAPPLVFLLLVIQNLQKNQQSFYLMKWS

SEQ ID NO: 66 - protein, 118 aa, Homo sapiens
  Payload ID: 5;
  Gene Symbol: AGPAT4;
  Gene Name: 1-acylglycerol-3-phosphate O-acyltransferase 4;
  ENSP ID: ENSP00000355878
MDLAGLLKSQFLCHLVFCYVFIASGLIINTIQLFTLLLWPINKQLFRKINCRLSYCISSRLQGPGQERAGLCPNYRLDVVLHRDGLLFAQVGAGSQDGCHQFAAPPGLPREVFFPDSL

SEQ ID NO: 67 - protein, 105 aa, Homo sapiens
  Payload ID: 5;
  Gene Symbol: AGPAT4;
  Gene Name: 1-acylglycerol-3-phosphate O-acyltransferase 4;
  ENSP ID: ENSP00000400211
  MOD_RES (1)..(1): Any amino acid
XSAVYDCTLNFRNNENPTLLGVLNGKKYHADLYVRRIPLEDIPEDDDECSAWLHKLYQEKGWGDTEFSKQYVSVSRPGRLALCPSEKIAEQQVEVVHGFSKQSGE

SEQ ID NO: 68 - protein, 133 aa, Homo sapiens
  Payload ID: 5;
  Gene Symbol: AGPAT4;
  Gene Name: 1-acylglycerol-3-phosphate O-acyltransferase 4;
  ENSP ID: ENSP00000413901
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGFDLLHVACMPLELGLFS

SEQ ID NO: 69 - protein, 364 aa, Homo sapiens [sequence omitted]

SEQ ID NO: 70 - protein, 71 aa, Homo sapiens
  Payload ID: 6;
  Gene Symbol: AGPAT5;
  Gene Name: 1-acylglycerol-3-phosphate O-acyltransferase 5;
  ENSP ID: ENSP00000428152
  MOD_RES (1)..(1): Any amino acid
XFFENYTGVQVSRLPLPGLGVHPSSRGRGPLRSPTAGEGHPAGPADPARRARAASPPSSPHASCRSAEIAL

SEQ ID NO: 71 - protein, 88 aa, Homo sapiens
  Payload ID: 6;
  Gene Symbol: AGPAT5;
  Gene Name: 1-acylglycerol-3-phosphate O-acyltransferase 5;
  ENSP ID: ENSP00000430016
MLLSLVLHTYSMRYLLPSVVLLGTAPTYVLAWGVWRLLSAFLPARFYQALDDRLYCVYQSMVLFFFENYTGVQLTGLLLTSWPSGRMR

SEQ ID NO: 72 - protein, 181 aa, Homo sapiens
  Payload ID: 6;
  Gene Symbol: AGPAT5;
  Gene Name: 1-acylglycerol-3-phosphate O-acyltransferase 5;
  ENSP ID: ENSP00000430751
  MOD_RES (1)..(1): Any amino acid
XVLHALPAAQRRAPGHGAHLRVGLGGLAAALRLPARPLLPSAGRPALLRLPEHGALLLRELHRGPEFLCKECPKIHIHIDRIDKKDVPEEQEHMRRWLHERFEIKDKMLIEFYESPDPERRKRFPGKSVNSKLSIKKTLPSMLILSGLTAGMLMTDAGRKLYVNTWIYGTLLGCLWVTIKA

SEQ ID NO: 73 - protein, 501 aa, Homo sapiens
  Payload ID: 7;
  Gene Symbol: ACCS;
  Gene Name: 1-aminocyclopropane-1-carboxylate synthase homolog (Arabidopsis) (non-functional);
  Uniprot ID:  Q96QU6;
  ENSP ID: ENSP00000263776
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHLFLREEVAKFLSFYCKSPVPLRPENVVVLNGGASLFSALATVLCEAGEAFLIPTPYYGAITQHVCLYGNIRLAYVYLDSEVTGLDTRPFQLTVEKLEMALREAHSEGVKVKGLILISPQNPLGDVYSPEELQEYLVFAKRHRLHVIVDEVYMLSVFEKSVGYRSVLSLERLPDPQRTHVMWATSKDFGMSGLRFGTLYTENQDVATAVASLCRYHGLSGLVQYQMAQLLRDRDWINQVYLPENHARLKAAHTYVSEELRALGIPFLSRGAGFFIWVDLRKYLPKGTFEEEMLLWRRFLDNKVLLSFGKAFECKEPGWFRFVFSDQVHRLCLGMQRVQQVLAGKSQVAEDPRPSQSQEPSDQRR

SEQ ID NO: 74 - protein, 139 aa, Homo sapiens
  Payload ID: 7;
  Gene Symbol: ACCS;
  Gene Name: 1-aminocyclopropane-1-carboxylate synthase homolog (Arabidopsis) (non-functional);
  ENSP ID: ENSP00000434156
MFTLPQKDFRAPTTCLGPTCMQDLGSSHGEDLEGECSRKLDQKLPELRGVGDPAMISSDTSYLSSRGRMIKWFWDSAEEGYRTYHMDEYDEDKNPSGIINLGTSENKLCFDLLSWRLSQRDMQRVEPSLLQYADWRGHL

SEQ ID NO: 75 - protein, 77 aa, Homo sapiens
  Payload ID: 7;
  Gene Symbol: ACCS;
  Gene Name: 1-aminocyclopropane-1-carboxylate synthase homolog (Arabidopsis) (non-functional);
  ENSP ID: ENSP00000435919
MFTLPQKDFRAPTTCLGPTCMQDLGSSHGEDLEGECSRKLDQKLPELRGVGDPAMISSDTSYLSSRGRMIKWFWDSA

SEQ ID NO: 76 - protein, 568 aa, Homo sapiens
  Payload ID: 8;
  Gene Symbol: ACCSL;
  Gene Name: 1-aminocyclopropane-1-carboxylate synthase homolog (Arabidopsis) (non-functional)-like;
  Uniprot ID:  Q4AC99;
  ENSP ID: ENSP00000368109
MSHRSDTLPVPSGQRRGRVPRDHSIYTQLLEITLHLQQAMTEHFVQLTSRQGLSLEERRHTEAICEHEALLSRLICRMINLLQSGAASGLELQVPLPSEDSRGDVRYGQRAQLSGQPDPVPQLSDCEAAFVNRDLSIRGIDISVFYQSSFQDYNAYQKDKYHKDKNTLGFINLGTSENKLCMDLMTERLQESDMNCIEDTLLQYPDWRGQPFLREEVARFLTYYCRAPTRLDPENVVVLNGCCSVFCALAMVLCDPGEAFLVPAPFYGGFAFSSRLYAKVELIPVHLESEVTVTNTHPFQLTVDKLEEALLEARLEGKKVRGLVLINPQNPLGDIYSPDSLMKYLEFAKRYNLHVIIDEIYMLSVFDESITFHSILSMKSLPDSNRTHVIWGTSKDFGISGFRFGALYTHNKEVASAVSAFGYLHSISGITQHKLCQLLQNTEWIDKVYLPTNCYRLREAHKYITAELKALEIPFHNRSSGLYVWINLKKYLDPCTFEEERLLYCRFLDNKLLLSRGKTYMCKEPGWFCLIFADELPRLKLAMRRFCDVLQEQKEALIVKQLEDAMRE

SEQ ID NO: 77 - protein, 175 aa, Homo sapiens
  Payload ID: 8;
  Gene Symbol: ACCSL;
  Gene Name: 1-aminocyclopropane-1-carboxylate synthase homolog (Arabidopsis) (non-functional)-like;
  ENSP ID: ENSP00000436505
MSHRSDTLPVPSGQRRGRVPRDHSIYTQLLEITLHLQQAMTEHFVQLTSRQGLSLEERRHTEAICEHEALLSRLICRMINLLQSGAASGLELQVPLPSEDSRGDVRYGQRAQLSGQPDPVPQLSDCEAAFVNRDLSIRGIDISVFYQSSFQDYNAYQKDKYHKDKNTLGGARGLT

SEQ ID NO: 78 - protein, 259 aa, Homo sapiens
  Payload ID: 9;
  Gene Symbol: BPGM;
  Gene Name: 2,3-bisphosphoglycerate mutase;
  Uniprot ID:  P07738;
  ENSP ID: ENSP00000342032
MSKYKLIMLRHGEGAWNKENRFCSWVDQKLNSEGMEEARNCGKQLKALNFEFDLVFTSVLNRSIHTAWLILEELGQEWVPVESSWRLNERHYGALIGLNREQMALNHGEEQVRLWRRSYNVTPPPIEESHPYYQEIYNDRRYKVCDVPLDQLPRSESLKDVLERLLPYWNERIAPEVLRGKTILISAHGNSSRALLKHLEGISDEDIINITLPTGVPILLELDENLRAVGPHQFLGDQEAIQAAIKKVEDQGKVKQAKK

SEQ ID NO: 79 - protein, 259 aa, Homo sapiens; identical to SEQ ID NO: 78
  Payload ID: 9;
  Gene Symbol: BPGM;
  Gene Name: 2,3-bisphosphoglycerate mutase;
  Uniprot ID:  P07738;
  ENSP ID: ENSP00000376840

SEQ ID NO: 80 - protein, 259 aa, Homo sapiens; identical to SEQ ID NO: 78
  Payload ID: 9;
  Gene Symbol: BPGM;
  Gene Name: 2,3-bisphosphoglycerate mutase;
  Uniprot ID:  P07738;
  ENSP ID: ENSP00000399838

SEQ ID NO: 81 - protein, 78 aa, Homo sapiens
  Payload ID: 9;
  Gene Symbol: BPGM;
  Gene Name: 2,3-bisphosphoglycerate mutase;
  ENSP ID: ENSP00000403050
MSKYKLIMLRHGEGAWNKENRFCSWVDQKLNSEGMEEARNCGKQLKALNFEFDLVFTSVLNRSIHTAWLILEELGQEW

SEQ ID NO: 82 - protein, 401 aa, Homo sapiens
  Payload ID: 10;
  Gene Symbol: CNP;
  Gene Name: 2',3'-cyclic nucleotide 3' phosphodiesterase;
  Uniprot ID:  P09543;
  ENSP ID: ENSP00000377466
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 83 - protein, 421 aa, Homo sapiens
  Payload ID: 10;
  Gene Symbol: CNP;
  Gene Name: 2',3'-cyclic nucleotide 3' phosphodiesterase;
  Uniprot ID:  P09543;
  ENSP ID: ENSP00000377470
MNRGFSRKSHTFLPKIFFRKMSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSETLRKAGQVFLEELGNHKAFKKELRQFVPGDEPREKMDLVTYFGKRPPGVLHCTTKFCDYGKAPGAEEYAQQDVLKKSYSKAFTLTISALFVTPKTTGARVELSEQQLQLWPSDVDKLSPTDNLPRGSRAHITLGCAADVEAVQTGLDLLEILRQEKGGSRGEEVGELSRGKLYSLGNGRWMLTLAKNMEVRAIFTGYYGKGKPVPTQGSRKGGALQSCTII

SEQ ID NO: 84 - protein, 144 aa, Homo sapiens
  Payload ID: 10;
  Gene Symbol: CNP;
  Gene Name: 2',3'-cyclic nucleotide 3' phosphodiesterase;
  ENSP ID: ENSP00000413104
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEK

SEQ ID NO: 85 - protein, 120 aa, Homo sapiens
  Payload ID: 10;
  Gene Symbol: CNP;
  Gene Name: 2',3'-cyclic nucleotide 3' phosphodiesterase;
  ENSP ID: ENSP00000466807
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQ

SEQ ID NO: 86 - protein, 49 aa, Homo sapiens
  Payload ID: 10;
  Gene Symbol: CNP;
  Gene Name: 2',3'-cyclic nucleotide 3' phosphodiesterase;
  ENSP ID: ENSP00000467641
MSSLGMSPGRRWTWSPTLERDPQACCIAQPSFVTTGRLPGQRSTLNKMC

SEQ ID NO: 87 - protein, 164 aa, Homo sapiens
  Payload ID: 10;
  Gene Symbol: CNP;
  Gene Name: 2',3'-cyclic nucleotide 3' phosphodiesterase;
  ENSP ID: ENSP00000468198
MDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADDLKKLKPGLEKDFLPLYFGWFLTKKSSET

SEQ ID NO: 88 - protein, 153 aa, Homo sapiens
  Payload ID: 10;
  Gene Symbol: CNP;
  Gene Name: 2',3'-cyclic nucleotide 3' phosphodiesterase;
  ENSP ID: ENSP00000468471
MSSSGAKDKPELQFPFLQDEDTVATLLECKTLFILRGLPGSGKSTLARVIVDKYRDGTKMVSADAYKITPGARGAFSEEYKRLDEDLAAYCRRRDIRILVLDDTNHERERLEQLFEMADQYQYQVVLVEPKTAWRLDCAQLKEKNQWQLSADD

SEQ ID NO: 89 - protein, 335 aa, Homo sapiens
  Payload ID: 11;
  Gene Symbol: DECR1;
  Gene Name: 2,4-dienoyl CoA reductase 1, mitochondrial;
  Uniprot ID:  Q16698;
  ENSP ID: ENSP00000220764
MKLPARVFFTLGSRLPCGLAPRRFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 90 - protein, 205 aa, Homo sapiens
  Payload ID: 11;
  Gene Symbol: DECR1;
  Gene Name: 2,4-dienoyl CoA reductase 1, mitochondrial;
  ENSP ID: ENSP00000427936
MTAYLATGILWKEMFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAK

SEQ ID NO: 91 - protein, 43 aa, Homo sapiens
  Payload ID: 11;
  Gene Symbol: DECR1;
  Gene Name: 2,4-dienoyl CoA reductase 1, mitochondrial;
  ENSP ID: ENSP00000428162
  MOD_RES (1)..(1): Any amino acid
XAAEWGKYGMRFNVIQPGPIKTKECVWGREVCCGTNPDNAECH

SEQ ID NO: 92 - protein, 48 aa, Homo sapiens
  Payload ID: 11;
  Gene Symbol: DECR1;
  Gene Name: 2,4-dienoyl CoA reductase 1, mitochondrial;
  ENSP ID: ENSP00000428533
MKLPARVFFTLGSRLPCGLAPRRRCYHLIVFKEKWHSLLGEVLALVKE

SEQ ID NO: 93 - protein, 41 aa, Homo sapiens
  Payload ID: 11;
  Gene Symbol: DECR1;
  Gene Name: 2,4-dienoyl CoA reductase 1, mitochondrial;
  ENSP ID: ENSP00000428701
MKLPARVFFTLGSRLPCGLAPRREDGCFESYRRTNFFSNWK

SEQ ID NO: 94 - protein, 151 aa, Homo sapiens
  Payload ID: 11;
  Gene Symbol: DECR1;
  Gene Name: 2,4-dienoyl CoA reductase 1, mitochondrial;
  ENSP ID: ENSP00000429096
MLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAE

SEQ ID NO: 95 - protein, 41 aa, Homo sapiens; identical to SEQ ID NO: 93
  Payload ID: 11;
  Gene Symbol: DECR1;
  Gene Name: 2,4-dienoyl CoA reductase 1, mitochondrial;
  ENSP ID: ENSP00000429551

SEQ ID NO: 96 - protein, 326 aa, Homo sapiens
  Payload ID: 11;
  Gene Symbol: DECR1;
  Gene Name: 2,4-dienoyl CoA reductase 1, mitochondrial;
  Uniprot ID:  Q16698;
  ENSP ID: ENSP00000429779
MSGLGKKHLLLMGEFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETGSGFVVPSASAKAGVEAMSKSLAAEWGKYGMRFNVIQPGPIKTKGAFSRLDPTGTFEKEMIGRIPCGRLGTVEELANLAAFLCSDYASWINGAVIKFDGGEEVLISGEFNDLRKVTKEQWDTIEELIRKTKGS

SEQ ID NO: 97 - protein, 181 aa, Homo sapiens
  Payload ID: 11;
  Gene Symbol: DECR1;
  Gene Name: 2,4-dienoyl CoA reductase 1, mitochondrial;
  ENSP ID: ENSP00000430561
MFFSYGTKILYQNTEALQSKFFSPLQKAMLPPNSFQGKVAFITGGGTGLGKGMTTLLSSLGAQCVIASRKMDVLKATAEQISSQTGNKVHAIQCDVRDPDMVQNTVSELIKVAGHPNIVINNAAGNFISPTERLSPNAWKTITDIVLNGTAFVTLEIGKQLIKAQKGAAFLSITTIYAETG

SEQ ID NO: 98 - protein, 95 aa, Homo sapiens
  Payload ID: 11;
  Gene Symbol: DECR1;
  Gene Name: 2,4-dienoyl CoA reductase 1, mitochondrial;
  ENSP ID: ENSP00000430759
MKLPARVFFTLGSRLPCGLAPRRFFSYGTKILYQNTEALQSKFFSPLQKAMLPPNSFQGKVAFITGGGTGLGKGMTTLLSSLGAQCVIASRNAFL

SEQ ID NO: 99 - protein, 41 aa, Homo sapiens; identical to SEQ ID NO: 93
  Payload ID: 11;
  Gene Symbol: DECR1;
  Gene Name: 2,4-dienoyl CoA reductase 1, mitochondrial;
  ENSP ID: ENSP00000431045

SEQ ID NO: 100 - protein, 292 aa, Homo sapiens
  Payload ID: 12;
  Gene Symbol: DECR2;
  Gene Name: 2,4-dienoyl CoA reductase 2, peroxisomal;
  Uniprot ID:  Q9NUI1;
  ENSP ID: ENSP00000219481
MAQPPPDVEGDDCLPAYRHLFCPDLLRDKVAFITGGGSGIGFRIAEIFMRHGCHTVIASRSLPRVLTAARKLAGATGRRCLPLSMDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGGPQASLSTKVTASPLQRLGNKTEIAHSVLYLASPLASYVTGAVLVADGGAWLTFPNGVKGLPDFASFSAKL

SEQ ID NO: 101 - protein, 94 aa, Homo sapiens
  Payload ID: 12;
  Gene Symbol: DECR2;
  Gene Name: 2,4-dienoyl CoA reductase 2, peroxisomal;
  ENSP ID: ENSP00000393382
  MOD_RES (1)..(1): Any amino acid
XARKLAGATGRRCLPLSMDVRAPPAVMAAVDQALKEFGRIDILINCAAGNFLCPAGALSFNAFKTVMDIDTSGTFNVSRVLYEKFFRVGASCAL

SEQ ID NO: 102 - protein, 81 aa, Homo sapiens
  Payload ID: 12;
  Gene Symbol: DECR2;
  Gene Name: 2,4-dienoyl CoA reductase 2, peroxisomal;
  ENSP ID: ENSP00000395913
MAQPPPDVEGDDCLPAYRHLFCPDLLRDKVAFITGGGSGIGFRIAEIFMRHGCHTVIASRSLPRVLTRWVFTTLTRLVSNS

SEQ ID NO: 103 - protein, 211 aa, Homo sapiens
  Payload ID: 12;
  Gene Symbol: DECR2;
  Gene Name: 2,4-dienoyl CoA reductase 2, peroxisomal;
  Uniprot ID:  Q9NUI1;
  ENSP ID: ENSP00000399697
MAQPPPDVEGDDCLPAYRHLFCPDLLRDKVAFITGGGSGIGFRIAEIFMRASEDQMGHCSSSGTCLAGVATFMVIVGKQPPNQKSRETKEQGRQIPFVCVRHGCHTVIASRSLPRVLTAARKLAGATGRRCLPLSMDVRAPPAVMAAVDQALKEFGRIDILINCSSSSCGLPFCRCGRELPVPRWRLVLQRLQDRDGHRYQRHLQCVSCAL

SEQ ID NO: 104 - protein, 280 aa, Homo sapiens
  Payload ID: 12;
  Gene Symbol: DECR2;
  Gene Name: 2,4-dienoyl CoA reductase 2, peroxisomal;
  ENSP ID: ENSP00000400374
MAQPPPDVEGDDCLPAYRHLFCPDLLRDKVAFITGGGSGIGFRIAEIFMRHGCHTAARKLAGATGRRCLPLSMDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGGPQASLSTKVTASPLQRLGNKTEIAHSVLYLASPLASYVTGAVLVADGGAWLTFPNGVKGLPDFASFSAKL

SEQ ID NO: 105 - protein, 81 aa, Homo sapiens; identical to SEQ ID NO: 102
  Payload ID: 12;
  Gene Symbol: DECR2;
  Gene Name: 2,4-dienoyl CoA reductase 2, peroxisomal;
  ENSP ID: ENSP00000402180

SEQ ID NO: 106 - protein, 292 aa, Homo sapiens; identical to SEQ ID NO: 100
  Payload ID: 12;
  Gene Symbol: DECR2;
  Gene Name: 2,4-dienoyl CoA reductase 2, peroxisomal;
  Uniprot ID:  Q9NUI1;
  ENSP ID: ENSP00000481547

SEQ ID NO: 107 - protein, 81 aa, Homo sapiens; identical to SEQ ID NO: 102
  Payload ID: 12;
  Gene Symbol: DECR2;
  Gene Name: 2,4-dienoyl CoA reductase 2, peroxisomal;
  ENSP ID: ENSP00000486613

SEQ ID NO: 108 - protein, 81 aa, Homo sapiens; identical to SEQ ID NO: 102
  Payload ID: 12;
  Gene Symbol: DECR2;
  Gene Name: 2,4-dienoyl CoA reductase 2, peroxisomal;
  ENSP ID: ENSP00000486679

SEQ ID NO: 109 - protein, 280 aa, Homo sapiens; identical to SEQ ID NO: 104
  Payload ID: 12;
  Gene Symbol: DECR2;
  Gene Name: 2,4-dienoyl CoA reductase 2, peroxisomal;
  ENSP ID: ENSP00000487756

SEQ ID NO: 110 - protein, 142 aa, Homo sapiens
  Payload ID: 12;
  Gene Symbol: DECR2;
  Gene Name: 2,4-dienoyl CoA reductase 2, peroxisomal;
  ENSP ID: ENSP00000487776
MAQPPPDVEGDDCLPAYRHLFCPDLLRDKVAFITGGGSGIGFRIAEIFMRIQVPARGTGERSRIALGGVRTSRPLQAARKLAGATGRRCLPLSMDVRAPPAVMAAVDQALKEFGRIDILINCAAGNFLCPAGALSFNAFKTV

SEQ ID NO: 111 - protein, 81 aa, Homo sapiens; identical to SEQ ID NO: 102
  Payload ID: 12;
  Gene Symbol: DECR2;
  Gene Name: 2,4-dienoyl CoA reductase 2, peroxisomal;
  ENSP ID: ENSP00000487820

SEQ ID NO: 112 - protein, 81 aa, Homo sapiens; identical to SEQ ID NO: 102
  Payload ID: 12;
  Gene Symbol: DECR2;
  Gene Name: 2,4-dienoyl CoA reductase 2, peroxisomal;
  ENSP ID: ENSP00000487947

SEQ ID NO: 113 - protein, 238 aa, Homo sapiens
  Payload ID: 12;
  Gene Symbol: DECR2;
  Gene Name: 2,4-dienoyl CoA reductase 2, peroxisomal;
  ENSP ID: ENSP00000487969
MAQPPPDVEGDDCLPAYRHLFCPDLLRDKVAFITGGGSGIGFRIAEIFMRHGCHTVIASRSLPRVLTAARKLAGATGRRCLPLSMDVRAPPAVMAAVDQALKEFGRIDILINCESVLSEAPAAPAVSHSAGAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRL

SEQ ID NO: 114 - protein, 81 aa, Homo sapiens; identical to SEQ ID NO: 102
  Payload ID: 12;
  Gene Symbol: DECR2;
  Gene Name: 2,4-dienoyl CoA reductase 2, peroxisomal;
  ENSP ID: ENSP00000488142

SEQ ID NO: 115 - protein, 238 aa, Homo sapiens; identical to SEQ ID NO: 113
  Payload ID: 12;
  Gene Symbol: DECR2;
  Gene Name: 2,4-dienoyl CoA reductase 2, peroxisomal;
  ENSP ID: ENSP00000488501

SEQ ID NO: 116 - protein, 82 aa, Homo sapiens
  Payload ID: 12;
  Gene Symbol: DECR2;
  Gene Name: 2,4-dienoyl CoA reductase 2, peroxisomal;
  ENSP ID: ENSP00000488619
MAQPPPDVEGDDCLPAYRHLFCPDLLRDKVAFITGGGSGIGFRIAEIFMRHGCHTVIASRSLPRVLTVIRPPQPPKVPGLQV

SEQ ID NO: 117 - protein, 81 aa, Homo sapiens; identical to SEQ ID NO: 102
  Payload ID: 12;
  Gene Symbol: DECR2;
  Gene Name: 2,4-dienoyl CoA reductase 2, peroxisomal;
  ENSP ID: ENSP00000488728

SEQ ID NO: 118 - protein, 142 aa, Homo sapiens; identical to SEQ ID NO: 110
  Payload ID: 12;
  Gene Symbol: DECR2;
  Gene Name: 2,4-dienoyl CoA reductase 2, peroxisomal;
  ENSP ID: ENSP00000488732

SEQ ID NO: 119 - protein, 211 aa, Homo sapiens; identical to SEQ ID NO: 103
  Payload ID: 12;
  Gene Symbol: DECR2;
  Gene Name: 2,4-dienoyl CoA reductase 2, peroxisomal;
  Uniprot ID:  Q9NUI1;
  ENSP ID: ENSP00000488824

SEQ ID NO: 120 - protein, 94 aa, Homo sapiens; identical to SEQ ID NO: 101
  Payload ID: 12;
  Gene Symbol: DECR2;
  Gene Name: 2,4-dienoyl CoA reductase 2, peroxisomal;
  ENSP ID: ENSP00000488844
  MOD_RES (1)..(1): Any amino acid

SEQ ID NO: 121 - protein, 82 aa, Homo sapiens; identical to SEQ ID NO: 116
  Payload ID: 12;
  Gene Symbol: DECR2;
  Gene Name: 2,4-dienoyl CoA reductase 2, peroxisomal;
  ENSP ID: ENSP00000488859

SEQ ID NO: 122 - protein, 516 aa, Homo sapiens
  Payload ID: 13;
  Gene Symbol: DHCR24;
  Gene Name: 24-dehydrocholesterol reductase;
  Uniprot ID:  Q15392;
  ENSP ID: ENSP00000360316
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 123 - protein, 154 aa, Homo sapiens
  Payload ID: 13;
  Gene Symbol: DHCR24;
  Gene Name: 24-dehydrocholesterol reductase;
  ENSP ID: ENSP00000416585
  MOD_RES (1)..(1): Any amino acid
XSLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 124 - protein, 427 aa, Homo sapiens
  Payload ID: 13;
  Gene Symbol: DHCR24;
  Gene Name: 24-dehydrocholesterol reductase;
  ENSP ID: ENSP00000440191
MCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 125 - protein, 400 aa, Homo sapiens
  Payload ID: 14;
  Gene Symbol: OAS1;
  Gene Name: 2'-5'-oligoadenylate synthetase 1, 40/46kDa;
  Uniprot ID:  P00973;
  ENSP ID: ENSP00000202917
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLAESNSADDETDDPRRYQKYGYIGTHEYPHFSHRPSTLQAASTPQAEEDWTCTIL

SEQ ID NO: 126 - protein, 414 aa, Homo sapiens
  Payload ID: 14;
  Gene Symbol: OAS1;
  Gene Name: 2'-5'-oligoadenylate synthetase 1, 40/46kDa;
  Uniprot ID:  P00973;
  ENSP ID: ENSP00000388001
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLTQHTPGSIHPTGRRGLDLHHPLNASASWGKGLQCYLDQFLHFQVGLLIQRGQSSSVSWCIIQDRTQVS

SEQ ID NO: 127 - protein, 364 aa, Homo sapiens
  Payload ID: 14;
  Gene Symbol: OAS1;
  Gene Name: 2'-5'-oligoadenylate synthetase 1, 40/46kDa;
  Uniprot ID:  P00973;
  ENSP ID: ENSP00000415721
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVRPPASSLPFIPAPLHEA

SEQ ID NO: 128 - protein, 177 aa, Homo sapiens
  Payload ID: 14;
  Gene Symbol: OAS1;
  Gene Name: 2'-5'-oligoadenylate synthetase 1, 40/46kDa;
  ENSP ID: ENSP00000448001
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGESSQLLFLPLPISEQKSPTV

SEQ ID NO: 129 - protein, 302 aa, Homo sapiens
  Payload ID: 14;
  Gene Symbol: OAS1;
  Gene Name: 2'-5'-oligoadenylate synthetase 1, 40/46kDa;
  ENSP ID: ENSP00000448348
RNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRYAIPTWLSSPM

SEQ ID NO: 130 - protein, 360 aa, Homo sapiens
  Payload ID: 14;
  Gene Symbol: OAS1;
  Gene Name: 2'-5'-oligoadenylate synthetase 1, 40/46kDa;
  ENSP ID: ENSP00000448790
MMDLRNTPAKSLDKFIEDYLLPDTCFRMQINHAIDIICGFLKERCFRGSSYPVCVSKVVKGGSSGKGTTLRGRSDADLVVFLSPLTTFQDQLNRRGEFIQEIRRQLEACQRERAFSVKFEVQAPRWGNPRALSFVLSSLQLGEGVEFDVLPAFDALGQLTGGYKPNPQIYVKLIEECTDLQKEGEFSTCFTELQRDFLKQRPTKLKSLIRLVKHWYQNCKKKLGKLPPQYALELLTVYAWERGSMKTHFNTAQGFRTVLELVINYQQLCIYWTKYYDFKNPIIEKYLRRQLTKPRPVILDPADPTGNLGGGDPKGWRQLAQEAEAWLNYPCFKNWDGSPVSSWILLVNLTLVGRRNYTNN

SEQ ID NO: 131 - protein, 130 aa, Homo sapiens
  Payload ID: 14;
  Gene Symbol: OAS1;
  Gene Name: 2'-5'-oligoadenylate synthetase 1, 40/46kDa;
  ENSP ID: ENSP00000449053
FRTVLELVINYQQLCIYWTKYYDFKNPIIEKYLRRQLTKPRPVILDPADPTGNLGGGDPKGWRQLAQEAEAWLNYPCFKNWDGSPVSSWILLMRQRLREVRSLAQGHQLTSGGNGIQAQWTLKPVLMSLC

SEQ ID NO: 132 - protein, 83 aa, Homo sapiens
  Payload ID: 14;
  Gene Symbol: OAS1;
  Gene Name: 2'-5'-oligoadenylate synthetase 1, 40/46kDa;
  ENSP ID: ENSP00000450286
MMDLRNTPAKSLDKFIEDYLLPDTCFRMQINHAIDIICGFLKERCFRGSSYPVCVSKVVKCKKKLGKLPPQYALELLTVYAWE

SEQ ID NO: 133 - protein, 22 aa, Homo sapiens
  Payload ID: 14;
  Gene Symbol: OAS1;
  Gene Name: 2'-5'-oligoadenylate synthetase 1, 40/46kDa;
  ENSP ID: ENSP00000474083
  MOD_RES (1)..(1): Any amino acid
XPSTLQAASTPQAEEDWTCTIL

SEQ ID NO: 134 - protein, 15 aa, Homo sapiens
  Payload ID: 14;
  Gene Symbol: OAS1;
  Gene Name: 2'-5'-oligoadenylate synthetase 1, 40/46kDa;
  ENSP ID: ENSP00000475139
AESNSADDETDDPRR

SEQ ID NO: 135 - protein, 719 aa, Homo sapiens
  Payload ID: 15;
  Gene Symbol: OAS2;
  Gene Name: 2'-5'-oligoadenylate synthetase 2, 69/71kDa;
  Uniprot ID:  P29728;
  ENSP ID: ENSP00000342278
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPTMQTPGSCGARIHPIVNEMFSSRSHRILNNNSKRNF

SEQ ID NO: 136 - protein, 687 aa, Homo sapiens
  Payload ID: 15;
  Gene Symbol: OAS2;
  Gene Name: 2'-5'-oligoadenylate synthetase 2, 69/71kDa;
  Uniprot ID:  P29728;
  ENSP ID: ENSP00000376362
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPVKVI

SEQ ID NO: 137 - protein, 172 aa, Homo sapiens
  Payload ID: 15;
  Gene Symbol: OAS2;
  Gene Name: 2'-5'-oligoadenylate synthetase 2, 69/71kDa;
  Uniprot ID:  P29728;
  ENSP ID: ENSP00000411763
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSKHCWVSGEKSQRSGCQTALCNL

SEQ ID NO: 138 - protein, 270 aa, Homo sapiens
  Payload ID: 15;
  Gene Symbol: OAS2;
  Gene Name: 2'-5'-oligoadenylate synthetase 2, 69/71kDa;
  ENSP ID: ENSP00000446977
MGNGESQLSSVPAQKLGWFIQEYLKPYEECQTLIDEMVNTICDVLQEPEQFPLVQGVAIGGSYGRKTVLRGNSDGLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPG

SEQ ID NO: 139 - protein, 60 aa, Homo sapiens
  Payload ID: 15;
  Gene Symbol: OAS2;
  Gene Name: 2'-5'-oligoadenylate synthetase 2, 69/71kDa;
  ENSP ID: ENSP00000450307
MGNGESQLSSVPAQKLGWFIQEYLKPYEECQTLIDEMVNTICDVLQEPEQFPLVQGVAIA

SEQ ID NO: 140 - protein, 726 aa, Homo sapiens
  Payload ID: 15;
  Gene Symbol: OAS2;
  Gene Name: 2'-5'-oligoadenylate synthetase 2, 69/71kDa;
  ENSP ID: ENSP00000483679
MGNGESQLSSVPAQKLGWFIQEYLKPYEECQTLIDEMVNTICDVLQEPEQFPLVQGVAIGGSYGRKTVLRGNSDGTLVLFFSDLKQFQDQKRSQRDILDKTGDKLKFCLFTKWLKNNFEIQKSLDGFTIQVFTKNQRISFEVLAAFNALSLNDNPSPWIYRELKRSLDKTNASPGEFAVCFTELQQKFFDNRPGKLKDLILLIKHWHQQCQKKIKDLPSLSPYALELLTVYAWEQGCRKDNFDIAEGVRTVLELIKCQEKLCIYWMVNYNFEDETIRNILLHQLQSARPVILDPVDPTNNVSGDKICWQWLKKEAQTWLTSPNLDNELPAPSWNVLPAPLFTTPGHLLDKFIKEFLQPNKCFLEQIDSAVNIIRTFLKENCFRQSTAKIQIVRGGSTAKGTALKTGSDADLVVFHNSLKSYTSQKNERHKIVKEIHEQLKAFWREKEEELEVSFEPPKWKAPRVLSFSLKSKVLNESVSFDVLPAFNALGQLSSGSTPSPEVYAGLIDLYKSSDLPGGEFSTCFTVLQRNFIRSRPTKLKDLIRLVKHWYKECERKLKPKGSLPPKYALELLTIYAWEQGSGVPDFDTAEGFRTVLELVTQYQQLCIFWKVNYNFEDETVRKFLLSQLQKTRPVILDPAEPTGDVGGGDRWCWHLLAKEAKEWLSSPCFKDGTGNPIPPWKVPTMQTPGSCGARIHPIVNEMFSSRSHRILNNNSKRNFRSSGNRF

SEQ ID NO: 141 - protein, 1087 aa, Homo sapiens
  Payload ID: 16;
  Gene Symbol: OAS3;
  Gene Name: 2'-5'-oligoadenylate synthetase 3, 100kDa;
  Uniprot ID:  Q9Y6K5;
  ENSP ID: ENSP00000228928
MDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVCLQGLWKETLPPVYALELLTIFAWEQGCKKDAFSLAEGLRTVLGLIQQHQHLCVFWTVNYGFEDPAVGQFLQRQLKRPRPVILDPADPTWDLGNGAAWHWDLLAQEAASCYDHPCFLRGMGDPVQSWKGPGLPRAGCSGLGHPIQLDPNQKTPENSKSLNAVYPRAGSKPPSCPAPGPTGAASIVPSVPGMALDLSQIPTKELDRFIQDHLKPSPQFQEQVKKAIDIILRCLHENCVHKASRVSKGGSFGRGTDLRDGCDVELIIFLNCFTDYKDQGPRRAEILDEMRAQLESWWQDQVPSLSLQFPEQNVPEALQFQLVSTALKSWTDVSLLPAFDAVGQLSSGTKPNPQVYSRLLTSGCQEGEHKACFAELRRNFMNIRPVKLKNLILLVKHWYRQVAAQNKGKGPAPASLPPAYALELLTIFAWEQGCRQDCFNMAQGFRTVLGLVQQHQQLCVYWTVNYSTEDPAMRMHLLGQLRKPRPLVLDPADPTWNVGHGSWELLAQEAAALGMQACFLSRDGTSVQPWDVMPALLYQTPAGDLDKFISEFLQPNRQFLAQVNKAVDTICSFLKENCFRNSPIKVIKVVKGGSSAKGTALRGRSDADLVVFLSCFSQFTEQGNKRAEIISEIRAQLEACQQERQFEVKFEVSKWENPRVLSFSLTSQTMLDQSVDFDVLPAFDALGQLVSGSRPSSQVYVDLIHSYSNAGEYSTCFTELQRDFIISRPTKLKSLIRLVKHWYQQCTKISKGRGSLPPQHGLELLTVYAWEQGGKDSQFNMAEGFRTVLELVTQYRQLCIYWTINYNAKDKTVGDFLKQQLQKPRPIILDPADPTGNLGHNARWDLLAKEAAACTSALCCMGRNGIPIQPWPVKAAV

SEQ ID NO: 142 - protein, 166 aa, Homo sapiens
  Payload ID: 16;
  Gene Symbol: OAS3;
  Gene Name: 2'-5'-oligoadenylate synthetase 3, 100kDa;
  ENSP ID: ENSP00000447323
  MOD_RES (1)..(1): Any amino acid
XTICSFLKENCFRNSPIKVIKVVKERQFEVKFEVSKWENPRVLSFSLTSQTMLDQSVDFDVLPAFDALGQLVSGSRPSSQVYVDLIHSYSNAGEYSTCFTELQRDFIISRPTKLKSLIRLVKHWYQQCTKISKGRGSLPPQHGLELLTVYAWEQGGKDSQFNMAEG

SEQ ID NO: 143 - protein, 223 aa, Homo sapiens
  Payload ID: 16;
  Gene Symbol: OAS3;
  Gene Name: 2'-5'-oligoadenylate synthetase 3, 100kDa;
  ENSP ID: ENSP00000448388
MDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGQAGSGVKPKPQVYSTLLNSGCQGGEHAACFTELRRNFVNIRPAKLKNLILLVKHWYHQVKPLGRVSPDM

SEQ ID NO: 144 - protein, 177 aa, Homo sapiens
  Payload ID: 16;
  Gene Symbol: OAS3;
  Gene Name: 2'-5'-oligoadenylate synthetase 3, 100kDa;
  ENSP ID: ENSP00000449299
MDLYSTPAAALDRFVARRLQPRKEFVEKARRALGALAAALRERGGRLGAAAPRVLKTVKGGSSGRGTALKGGCDSELVIFLDCFKSYVDQRARRAEILSEMRASLESWWQNPVPGLRLTFPEQSVPGALQFRLTSVDLEDWMDVSLVPAFNVLGEGFLDHSRVGGKRSLGTTQDFQF

SEQ ID NO: 145 - protein, 514 aa, Homo sapiens
  Payload ID: 17;
  Gene Symbol: OASL;
  Gene Name: 2'-5'-oligoadenylate synthetase-like;
  Uniprot ID:  Q15646;
  ENSP ID: ENSP00000257570
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQYVKARSPRANLPPLYALELLTIYAWEMGTEEDENFMLDEGFTTVMDLLLEYEVICIYWTKYYTLHNAIIEDCVRKQLKKERPIILDPADPTLNVAEGYRWDIVAQRASQCLKQDCCYDNRENPISSWNVKRARDIHLTVEQRGYPDFNLIVNPYEPIRKVKEKIRRTRGYSGLQRLSFQVPGSERQLLSSRCSLAKYGIFSHTHIYLLETIPSEIQVFVKNPDGGSYAYAINPNSFILGLKQQIEDQQGLPKKQQQLEFQGQVLQDWLGLGIYGIQDSDTLILSKKKGEALFPAS

SEQ ID NO: 146 - protein, 255 aa, Homo sapiens
  Payload ID: 17;
  Gene Symbol: OASL;
  Gene Name: 2'-5'-oligoadenylate synthetase-like;
  Uniprot ID:  Q15646;
  ENSP ID: ENSP00000341125
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQAHHPGSGRPHPQRGRRVQMGHRCSEGLPVPETGLLL

SEQ ID NO: 147 - protein, 153 aa, Homo sapiens
  Payload ID: 17;
  Gene Symbol: OASL;
  Gene Name: 2'-5'-oligoadenylate synthetase-like;
  ENSP ID: ENSP00000444127
  MOD_RES (1)..(1): Any amino acid
XHTSLQAGLLRGSVAAAPPGVEGRGARRCADRGGVSEAGAFPGEAWAGPGCAGAEGSQGPSLPNSQPPPEVYVSLIKACGGPGNFCPSFSELQRNFVKHRPTKLKSLLRLVKHWYQQAHHPGSGRPHPQRGRRVQMGHRCSEGLPVPETGLLL

SEQ ID NO: 148 - protein, 384 aa, Homo sapiens
  Payload ID: 17;
  Gene Symbol: OASL;
  Gene Name: 2'-5'-oligoadenylate synthetase-like;
  Uniprot ID:  Q15646;
  ENSP ID: ENSP00000479512
MALMQELYSTPASRLDSFVAQWLQPHREWKEEVLDAVRTVEEFLRQEHFQGKRGLDQDVRVLKVVKVGSFGNGTVLRSTREVELVAFLSCFHSFQEAAKHHKDVLRLIWKTMWQSQDLLDLGLEDLRMEQRVPDALVFTIQTRGTAEPITVTIVPAYRALGPSLPNSQPPPEVYVSLIKACGGPGNFCPSFSELQRNFVKHRPTKLKSLLRLVKHWYQQRARDIHLTVEQRGYPDFNLIVNPYEPIRKVKEKIRRTRGYSGLQRLSFQVPGSERQLLSSRCSLAKYGIFSHTHIYLLETIPSEIQVFVKNPDGGSYAYAINPNSFILGLKQQIEDQQGLPKKQQQLEFQGQVLQDWLGLGIYGIQDSDTLILSKKKGEALFPAS

SEQ ID NO: 149 - protein, 270 aa, Homo sapiens
  Payload ID: 18;
  Gene Symbol: ADO;
  Gene Name: 2-aminoethanethiol (cysteamine) dioxygenase;
  Uniprot ID:  Q96SZ5;
  ENSP ID: ENSP00000362888
MPRDNMASLIQRIARQACLTFRGSGGGRGASDRDAASGPEAPMQPGFPENLSKLKSLLTQLRAEDLNIAPRKATLQPLPPNLPPVTYMHIYETDGFSLGVFLLKSGTSIPLHDHPGMHGMLKVLYGTVRISCMDKLDAGGGQRPRALPPEQQFEPPLQPREREAVRPGVLRSRAEYTEASGPCILTPHRDNLHQIDAVEGPAAFLDILAPPYDPDDGRDCHYYRVLEPVRPKEASSSACDLPREVWLLETPQADDFWCEGEPYPGPKVFP

SEQ ID NO: 150 - protein, 174 aa, Homo sapiens
  Payload ID: 19;
  Gene Symbol: DNPH1;
  Gene Name: 2'-deoxynucleoside 5'-phosphate N-hydrolase 1;
  Uniprot ID:  O43598;
  ENSP ID: ENSP00000230431
MAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRVLSAMIRGAADGSRFQVWDYEEGEVEALLDRYFEADPPGQVAASPDPTT

SEQ ID NO: 151 - protein, 148 aa, Homo sapiens
  Payload ID: 19;
  Gene Symbol: DNPH1;
  Gene Name: 2'-deoxynucleoside 5'-phosphate N-hydrolase 1;
  Uniprot ID:  O43598;
  ENSP ID: ENSP00000377556
MAAAMVPGRSESWERGEPGRPALYFCGSIRGGREDRTLYERIVSRLRRFGTVLTEHVAAAELGARGEEAAGGDRLIHEQDLEWLQQADVVVAEVTQPSLGVGYELGRAVAFNKRILCLFRPQSGRGEHPKPPSWLSMDPALSSFPGGL

SEQ ID NO: 152 - protein, 243 aa, Homo sapiens
  Payload ID: 19;
  Gene Symbol: DNPH1;
  Gene Name: 2'-deoxynucleoside 5'-phosphate N-hydrolase 1;
  ENSP ID: ENSP00000422440
AAAMVPGRSESWERGEPGRPALYFCGSIRGGREDRTLYERIVSRLRRFGTVLTEHVAAAELGARGEALGPRDAGTRARTWLGWQGPGLSAPPTPGSCAPGARSPPSYPGAPSSAPAREGNGPGLGLRGSQQACGWEEAAGGDRLIHEQDLEWLQQADVVVAEVTQPSLGVGYELGRAVAFNKRILCLFRPQSGRVLSAMIRGAADGSRFQVWDYEEGEVEALLDRYFEADPPGQVAASPDPTT

SEQ ID NO: 153 - protein, 578 aa, Homo sapiens [sequence omitted]

SEQ ID NO: 154 - protein, 119 aa, Homo sapiens
  Payload ID: 20;
  Gene Symbol: HACL1;
  Gene Name: 2-hydroxyacyl-CoA lyase 1;
  ENSP ID: ENSP00000373289
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWLKLVDYIPSSLPAQAA

SEQ ID NO: 155 - protein, 551 aa, Homo sapiens
  Payload ID: 20;
  Gene Symbol: HACL1;
  Gene Name: 2-hydroxyacyl-CoA lyase 1;
  Uniprot ID:  Q9UJ83;
  ENSP ID: ENSP00000390699
MPDSNFAERSEEQVSGAKVIAQALKTQDVEYIFGIVGIPVTEIAIAAQQLGIKYIGMRNEQAACYAASAIGYLTSRPLLVIGGSSERNQETMGAFQEFPQVEACRLYTKFSARPSSIEAIPFVIEKAVRSSIYGRPGACYVDIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 156 - protein, 244 aa, Homo sapiens
  Payload ID: 20;
  Gene Symbol: HACL1;
  Gene Name: 2-hydroxyacyl-CoA lyase 1;
  ENSP ID: ENSP00000391393
MPDSNFAERSEEQVSGAKVIAQALKTQDVEYIFGIVGIPVTEIAIAAQQLGIKYIGMRNEQAACYAASAIGYLTSRPLLVIGGSSERNQETMGAFQEFPQVEACRLYTKFSARPSSIEAIPFVIEKAVRSSIYGRPGACYVDIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRCVA

SEQ ID NO: 157 - protein, 137 aa, Homo sapiens
  Payload ID: 20;
  Gene Symbol: HACL1;
  Gene Name: 2-hydroxyacyl-CoA lyase 1;
  ENSP ID: ENSP00000392796
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWPLLVIGGSSERNQETMGAFQEFPQVHGTLHVTSY

SEQ ID NO: 158 - protein, 337 aa, Homo sapiens
  Payload ID: 20;
  Gene Symbol: HACL1;
  Gene Name: 2-hydroxyacyl-CoA lyase 1;
  ENSP ID: ENSP00000395278
MPDSNFAERSEEQVSGAKVIAQALKTQDVEYIFGIVGIPVTEIAIAAQQLGIKYIGMRNEQAVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 159 - protein, 157 aa, Homo sapiens
  Payload ID: 20;
  Gene Symbol: HACL1;
  Gene Name: 2-hydroxyacyl-CoA lyase 1;
  ENSP ID: ENSP00000395352
MPDSNFAERSEEQVSGAKVIAQALKTQDVEYIFGIVGIPVTEIAIAAQQLGIKYIGMRNEQAVEACRLYTKFSARPSSIEAIPFVIEKAVRSSIYGRPGACYVDIPADFVNLQVNVNSIKYMERCMSPPISMAETSAVCTAASVIRNAKQPLLIIGK

SEQ ID NO: 160 - protein, 496 aa, Homo sapiens
  Payload ID: 20;
  Gene Symbol: HACL1;
  Gene Name: 2-hydroxyacyl-CoA lyase 1;
  Uniprot ID:  Q9UJ83;
  ENSP ID: ENSP00000403656
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQLLEELDKTPWQYPPESKWWKTLREKMKSNEAASKELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 161 - protein, 518 aa, Homo sapiens
  Payload ID: 20;
  Gene Symbol: HACL1;
  Gene Name: 2-hydroxyacyl-CoA lyase 1;
  Uniprot ID:  Q9UJ83;
  ENSP ID: ENSP00000404883
MPDSNFAERSEEQVSGAKVIAQALKTQDVEYIFGIVGIPVTEIAIAAQQLGIKYIGMRNEQAACYAASAIGYLTSRPGVCLVVSGPGLIHALGGMANANMNCWPLLVIGGSSERNQETMGAFQEFPQAVRSSIYGRPGACYVDIPADFVNLQVNVNSIKYMERCMSPPISMAETSAVCTAASVIRNAKQPLLIIGKGAAYAHAEESIKKLVEQYKLPFLPTPMGKGVVPDNHPYCVGAARSRALQFADVIVLFGARLNWILHFGLPPRYQPDVKFIQVDICAEELGNNVKPAVTLLGNIHAVTKQELASKKSLPMNYYTVFYHVQEQLPRDCFVVSEGANTMDIGRTVLQNYLPRHRLDAGTFGTMGVGLGFAIAAAVVAKDRSPGQWIICVEGDSAFGFSGMEVETICRYNLPIILLVVNNNGIYQGFDTDTWKEMLKFQDATAVVPPMCLLPNSHYEQVMTAFGGKGYFVQTPEELQKSLRQSLADTTKPSLINIMIEPQATRKAQDFHWLTRSNM

SEQ ID NO: 162 - protein, 119 aa, Homo sapiens; identical to SEQ ID NO: 154
  Payload ID: 20;
  Gene Symbol: HACL1;
  Gene Name: 2-hydroxyacyl-CoA lyase 1;
  ENSP ID: ENSP00000486684

SEQ ID NO: 163 - protein, 39 aa, Homo sapiens
  Payload ID: 21;
  Gene Symbol: OGFOD1;
  Gene Name: 2-oxoglutarate and iron-dependent oxygenase domain containing 1;
  ENSP ID: ENSP00000337196
MDMDPFLHCVIPNFIQSQDFLEGLQKELMNLDFHENLMI

SEQ ID NO: 164 - protein, 46 aa, Homo sapiens
  Payload ID: 21;
  Gene Symbol: OGFOD1;
  Gene Name: 2-oxoglutarate and iron-dependent oxygenase domain containing 1;
  ENSP ID: ENSP00000455149
MDMDPFLHCVIPNFIQSQDFLEGLQKELMNLDFHEKYNDLYKFQQS

SEQ ID NO: 165 - protein, 109 aa, Homo sapiens
  Payload ID: 21;
  Gene Symbol: OGFOD1;
  Gene Name: 2-oxoglutarate and iron-dependent oxygenase domain containing 1;
  ENSP ID: ENSP00000456016
MNGKRPAEPGPARVGKKGKKEVMAEFSDAVTEETLKKQVAEAWSRRTPFSHEVIVMDMDPFLHCVIPNFIQSQDFLEGLQKELMNLDFHEKYNDLYKFQQEIPFFSLFS

SEQ ID NO: 166 - protein, 164 aa, Homo sapiens
  Payload ID: 21;
  Gene Symbol: OGFOD1;
  Gene Name: 2-oxoglutarate and iron-dependent oxygenase domain containing 1;
  ENSP ID: ENSP00000456111
MNGKRPAEPGPARVGKKGKKEVMAEFSDAVTEETLKKQVAEAWSRRTPFKVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAF

SEQ ID NO: 167 - protein, 542 aa, Homo sapiens
  Payload ID: 21;
  Gene Symbol: OGFOD1;
  Gene Name: 2-oxoglutarate and iron-dependent oxygenase domain containing 1;
  Uniprot ID:  Q8N543;
  ENSP ID: ENSP00000457258
MNGKRPAEPGPARVGKKGKKEVMAEFSDAVTEETLKKQVAEAWSRRTPFSHEVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPIPRSPHIPQDHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 168 - protein, 175 aa, Homo sapiens
  Payload ID: 21;
  Gene Symbol: OGFOD1;
  Gene Name: 2-oxoglutarate and iron-dependent oxygenase domain containing 1;
  ENSP ID: ENSP00000457553
MDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSR

SEQ ID NO: 169 - protein, 499 aa, Homo sapiens
  Payload ID: 21;
  Gene Symbol: OGFOD1;
  Gene Name: 2-oxoglutarate and iron-dependent oxygenase domain containing 1;
  ENSP ID: ENSP00000457746
MNGKRPAEPGPARVGKKGKKEVMAEFSDAVTEETLKKQVAEAWSRRTPFSHEVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQHEILYDWINPTYLDMDYQVQIQEEFEESSEILLKEFLKPEKFTKVCEALEHGHVEWSSRGPPNKRFYEKAEESKLPEILKECMKLFRSEALFLLLSNFTGLKLHFLAPSEEDEMNDKKEAETTDITEEGTSHSPPEPENNQMAISNNSQQSNEQTDPEPEENETKKESSVPMCQGELRHWKTGHYTLIHDHSKAEFALDLILYCGCEGWEPEYGGFTSYIAKGEDEELLTVNPESNSLALVYRDRETLKFVKHINHRSLEQKKTFPNRTGFWDFSFIYYE

SEQ ID NO: 170 - protein, 350 aa, Homo sapiens
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000228922
MATVGAPRHFCRCACFCTDNLYVARYGLHVRFRGEQQLRRDYGPILRSRGCVSAKDFQQLLAELEQEVERRQRLGQESAARKALIASSYHPARPEVYDSLQDAALAPEFLAVTEYSVSPDADLKGLLQRLETVSEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 171 - protein, 290 aa, Homo sapiens
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000380544
MVELEQEVERRQRLGQESAARKALIASSYHPARPEVYDSLQDAALAPEFLAVTEYSVSPDADLKGLLQRLETVSEEKRIYRVPVFTAPFCQALLEELEHFEQSDMPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 172 - protein, 186 aa, Homo sapiens
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000394175
MPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREPDLVDDEGFGDGFTREEPATVDVCALT

SEQ ID NO: 173 - protein, 160 aa, Homo sapiens
  Payload ID: 22;
  Gene Symbol: OGFOD2;
  Gene Name: 2-oxoglutarate and iron-dependent oxygenase domain containing 2;
  ENSP ID: ENSP00000438003
MPKGRPNTMNNYGVLLHELGLDEPLMTPLRERFLQPLMALLYPDCGGGRLDSHRAFVVKYAPGQDLELGCHYDNAELTLNVALGKVFTGGALYFGGLFQAPTALTEPLEVEHVVGQGVLHRGGQLHGARPLGTGERWNLVVWLRASAVRNSLCPMCCREP

SEQ ID NO: 174 - protein, 186 aa, Homo sapiens; identical to SEQ ID NO: 172
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000438192

SEQ ID NO: 175 - protein, 186 aa, Homo sapiens; identical to SEQ ID NO: 172
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000438327

SEQ ID NO: 176 - protein, 129 aa, Homo sapiens
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000439667
MATVGAPRHFCRCACFCTDNLYVARYGLHVRFRGEQQLRRDYGPILRSRGCVSAKDFQQLLAEWPQEDGRPHLVTTLCHPSLSRRWSGGSGWGRSQQLGKPSSRVPTTRHGLRSTTHCRMQLWPPSSWP

SEQ ID NO: 177 - protein, 207 aa, Homo sapiens
  Payload ID: 22;
  Gene Symbol: OGFOD2;
  Gene Name: 2-oxoglutarate and iron-dependent oxygenase domain containing 2;
  ENSP ID: ENSP00000442083
MATVGAPRHFCRCACFCTDNLYVARYGLHVRFRGEQQLRRDYGPILRSRGCVSAKDFQQLLAEAAARAAAPLPPPPSPGVSGGKLPRRVLSNLWNTGLGHDCLLSLCGPRWLSFFICTVASGGWEAPPGNNPVPPQLEQEVERRQRLGQESAARKALIASSYHPARPEVYDSLQDAALAPEFLAVTEYSVSPDADLKGLLQRLETVS

SEQ ID NO: 178 - protein, 160 aa, Homo sapiens; identical to SEQ ID NO: 173
  Payload ID: 22;
  Gene Symbol: OGFOD2;
  Gene Name: 2-oxoglutarate and iron-dependent oxygenase domain containing 2;
  ENSP ID: ENSP00000442476

SEQ ID NO: 179 - protein, 186 aa, Homo sapiens; identical to SEQ ID NO: 172
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000442817

SEQ ID NO: 180 - protein, 186 aa, Homo sapiens; identical to SEQ ID NO: 172
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000444436

SEQ ID NO: 181 - protein, 186 aa, Homo sapiens; identical to SEQ ID NO: 172
  Payload ID: 22;
  Gene Symbol: OGFOD2;
  Gene Name: 2-oxoglutarate and iron-dependent oxygenase domain containing 2;
  Uniprot ID:  Q6N063;
  ENSP ID: ENSP00000444608

SEQ ID NO: 182 - protein, 319 aa, Homo sapiens
  Payload ID: 23;
  Gene Symbol: OGFOD3;
  Gene Name: 2-oxoglutarate and iron-dependent oxygenase domain containing 3;
  Uniprot ID:  Q6PK18;
  ENSP ID: ENSP00000320116
MAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 183 - protein, 331 aa, Homo sapiens
  Payload ID: 23;
  Gene Symbol: OGFOD3;
  Gene Name: 2-oxoglutarate and iron-dependent oxygenase domain containing 3;
  Uniprot ID:  Q6PK18;
  ENSP ID: ENSP00000330075
MAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGCFCFRMMSCGFQEVNGPRASEAAGAKAGVRCPPGTHHPPERGETHAILEAESIAYC

SEQ ID NO: 184 - protein, 126 aa, Homo sapiens
  Payload ID: 23;
  Gene Symbol: OGFOD3;
  Gene Name: 2-oxoglutarate and iron-dependent oxygenase domain containing 3;
  ENSP ID: ENSP00000463566
MAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRLHSPKVRQRCHRCRHHQGGSGADSQRS

SEQ ID NO: 185 - protein, 241 aa, Homo sapiens
  Payload ID: 23;
  Gene Symbol: OGFOD3;
  Gene Name: 2-oxoglutarate and iron-dependent oxygenase domain containing 3;
  ENSP ID: ENSP00000464195
  MOD_RES (1)..(1): Any amino acid
XSLGADDGVAEVLARRGEVVAGRFIEVPCSEDYDSHRRLHSPKVRQRCHRCRHHQGGSGADSQASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 186 - protein, 95 aa, Homo sapiens
  Payload ID: 23;
  Gene Symbol: OGFOD3;
  Gene Name: 2-oxoglutarate and iron-dependent oxygenase domain containing 3;
  ENSP ID: ENSP00000466117
  MOD_RES (1)..(1): Any amino acid
XDEYWHAHVDKVTYGSFDYTSLLYLSNYLEDFGGGRFMFMEEGANKTVEPRAGEGFGRPASASRSPACLPSPQKSQSQQFCGKMKNSQSTRQAFS

SEQ ID NO: 187 - protein, 15 aa, Homo sapiens
  Payload ID: 23;
  Gene Symbol: OGFOD3;
  Gene Name: 2-oxoglutarate and iron-dependent oxygenase domain containing 3;
  ENSP ID: ENSP00000466184
MFMEEGANKTVEPRA

SEQ ID NO: 188 - protein, 219 aa, Homo sapiens
  Payload ID: 23;
  Gene Symbol: OGFOD3;
  Gene Name: 2-oxoglutarate and iron-dependent oxygenase domain containing 3;
  ENSP ID: ENSP00000467074
  MOD_RES (1)..(1): Any amino acid
XVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAVVLSHLCIRGRVWTSSLCKQEPSLSALTPEVPVTAVLWENEKLTEHKTGVFLRSQAAEASWDSKLHNFLAYFDLSHFKHDKYLSQTFCITIFFQIIKTTCLL

SEQ ID NO: 189 - protein, 480 aa, Homo sapiens
  Payload ID: 24;
  Gene Symbol: PXYLP1;
  Gene Name: 2-phosphoxylose phosphatase 1;
  Uniprot ID:  Q8TE99;
  ENSP ID: ENSP00000286353
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 190 - protein, 480 aa, Homo sapiens; identical to SEQ ID NO: 189
  Payload ID: 24;
  Gene Symbol: PXYLP1;
  Gene Name: 2-phosphoxylose phosphatase 1;
  Uniprot ID:  Q8TE99;
  ENSP ID: ENSP00000376733

SEQ ID NO: 191 - protein, 145 aa, Homo sapiens
  Payload ID: 24;
  Gene Symbol: PXYLP1;
  Gene Name: 2-phosphoxylose phosphatase 1;
  ENSP ID: ENSP00000421271
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFE

SEQ ID NO: 192 - protein, 442 aa, Homo sapiens
  Payload ID: 24;
  Gene Symbol: PXYLP1;
  Gene Name: 2-phosphoxylose phosphatase 1;
  ENSP ID: ENSP00000422558
MSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 193 - protein, 471 aa, Homo sapiens
  Payload ID: 24;
  Gene Symbol: PXYLP1;
  Gene Name: 2-phosphoxylose phosphatase 1;
  ENSP ID: ENSP00000422901
MRYFIKSMEHSVCPSSAVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 194 - protein, 130 aa, Homo sapiens
  Payload ID: 24;
  Gene Symbol: PXYLP1;
  Gene Name: 2-phosphoxylose phosphatase 1;
  ENSP ID: ENSP00000423702
MSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQT

SEQ ID NO: 195 - protein, 26 aa, Homo sapiens
  Payload ID: 24;
  Gene Symbol: PXYLP1;
  Gene Name: 2-phosphoxylose phosphatase 1;
  ENSP ID: ENSP00000425264
MLFRNRFLLLLALAALLAFVSLSLQF

SEQ ID NO: 196 - protein, 26 aa, Homo sapiens
  Payload ID: 24;
  Gene Symbol: PXYLP1;
  Gene Name: 2-phosphoxylose phosphatase 1;
  ENSP ID: ENSP00000426348
MLFRNRFLLLLALAALLAFVSLSLQF

SEQ ID NO: 197 - protein, 463 aa, Homo sapiens
  Payload ID: 24;
  Gene Symbol: PXYLP1;
  Gene Name: 2-phosphoxylose phosphatase 1;
  ENSP ID: ENSP00000426877
MDVLTALLLVHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 198 - protein, 95 aa, Homo sapiens
  Payload ID: 24;
  Gene Symbol: PXYLP1;
  Gene Name: 2-phosphoxylose phosphatase 1;
  ENSP ID: ENSP00000426956
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFI

SEQ ID NO: 199 - protein, 308 aa, Homo sapiens
  Payload ID: 25;
  Gene Symbol: BPNT1;
  Gene Name: 3'(2'), 5'-bisphosphate nucleotidase 1;
  Uniprot ID:  O95861;
  ENSP ID: ENSP00000318852
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 200 - protein, 291 aa, Homo sapiens
  Payload ID: 25;
  Gene Symbol: BPNT1;
  Gene Name: 3'(2'), 5'-bisphosphate nucleotidase 1;
  ENSP ID: ENSP00000346862
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYENNEKQQLREHRNEAKAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDV

SEQ ID NO: 201 - protein, 272 aa, Homo sapiens
  Payload ID: 25;
  Gene Symbol: BPNT1;
  Gene Name: 3'(2'), 5'-bisphosphate nucleotidase 1;
  Uniprot ID:  O95861;
  ENSP ID: ENSP00000410348
MASSNTVLMRLVASAYSIAQKAGMIVRRVIAEGDLGIVEKTCATDLQTKADRLAQMSICSSLARKFPKLTIIGEELVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 202 - protein, 253 aa, Homo sapiens
  Payload ID: 25;
  Gene Symbol: BPNT1;
  Gene Name: 3'(2'), 5'-bisphosphate nucleotidase 1;
  Uniprot ID:  O95861;
  ENSP ID: ENSP00000444398
MSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDCVAAMNPDAVLRVGGAGNKIIQLIEGKASAYVFASPGCKKWDTCAPEVILHAVGGKLTDIHGNVLQYHKDVKHMNSAGVLATLRNYDYYASRVPESIKNALVP

SEQ ID NO: 203 - protein, 308 aa, Homo sapiens; identical to SEQ ID NO: 199
  Payload ID: 25;
  Gene Symbol: BPNT1;
  Gene Name: 3'(2'), 5'-bisphosphate nucleotidase 1;
  Uniprot ID:  O95861;
  ENSP ID: ENSP00000446828

SEQ ID NO: 204 - protein, 136 aa, Homo sapiens
  Payload ID: 25;
  Gene Symbol: BPNT1;
  Gene Name: 3'(2'), 5'-bisphosphate nucleotidase 1;
  ENSP ID: ENSP00000446850
MASSNTVLMRLVASAYSIAQKAGMIVRRVIAEGDLGIVEKTCATDLQTKADRLAQMSICSSLARKFPKLTIIGEELVVWVDPLDGTKEYTEGLLDNVTVLIGIAYEGKAIAGVINQPYYNYEAGPDAVLGRTIWGV

SEQ ID NO: 205 - protein, 170 aa, Homo sapiens
  Payload ID: 25;
  Gene Symbol: BPNT1;
  Gene Name: 3'(2'), 5'-bisphosphate nucleotidase 1;
  ENSP ID: ENSP00000446953
MASSNTVLMRLVASAYSIAQKAGMIVRRVIAEGDLGIVEKTCATDLQTKADRLAQMSICSSLARKFPKLTIIGEELVVWVDPLDGTKEYTEGLLDNVTVLIGIAYEGKAIAGVINQPYYNYEAGPDAVLGRTIWGVLGLGAFGFQLKEVPAGKHIITTTRSHSNKLVTDC

SEQ ID NO: 206 - protein, 116 aa, Homo sapiens
  Payload ID: 25;
  Gene Symbol: BPNT1;
  Gene Name: 3'(2'), 5'-bisphosphate nucleotidase 1;
  ENSP ID: ENSP00000448740
MSICSSLARKFPKLTIIGEEDLPSEEVDQELIEDSQWEEILKQPCPSQYSAIKEEDLVVWVDPLDGTKEYTEGLLDNVTVLIGIAYEGKAIAGVINQPYYNYEAGPDAVLGRTIWG

SEQ ID NO: 207 - protein, 130 aa, Homo sapiens
  Payload ID: 25;
  Gene Symbol: BPNT1;
  Gene Name: 3'(2'), 5'-bisphosphate nucleotidase 1;
  ENSP ID: ENSP00000449883
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVDPLDGTKEYTEGLL

SEQ ID NO: 208 - protein, 888 aa, Homo sapiens [sequence omitted]

SEQ ID NO: 209 - protein, 835 aa, Homo sapiens
  Payload ID: 26;
  Gene Symbol: HMGCR;
  Gene Name: 3-hydroxy-3-methylglutaryl-CoA reductase;
  Uniprot ID:  P04035;
  ENSP ID: ENSP00000340816
MLSRLFRMHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVIHFLDKELTGLNEALPFFLLLIDLSRASTLAKFALSSNSQDEVRENIARGMAILGPTFTLDALVECLVIGVGTMSGVRQLEIMCCFGCMSVLANYFVFMTFFPACVSLVLELSRESREGRPIWQLSHFARVLEEEENKPNPVTQRVKMIMSLGLVLVHAHSRWIADPSPQNSTADTSKVSLGLDENVSKRIEPSVSLWQFYLSKMISMDIEQVITLSLALLLAVKYIFFEQTETESTLSLKNPITSPVVTQKKVPDNCCRREPMLVRNNQKCDSVEEETGINRERKVEVIKPLVAETDTPNRATFVVGNSSLLDTSSVLVTQEPEIELPREPRPNEECLQILGNAEKGAKFLSDAEIIQLVNAKHIPAYKLETLMETHERGVSIRRQLLSKKLSEPSSLQYLPYRDYNYSLLGGGASSRVLADGMTRGPVVRLPRACDSAEVKAWLETSEGFAVIKEAFDSTSRFARLQKLHTSIAGRNLYIRFQSRSGDAMGMNMISKGTEKALSKLHEYFPEMQILAVSGNYCTDKKPAAINWIEGRGKSVVCEAVIPAKVVREVLKTTTEAMIEVNINKNLVGSAMAGSIGGYNAHAANIVTAIYIACGQDAAQNVGSSNCITLMEASGPTNEDLYISCTMPSIEIGTVGGGTNLLPQQACLQMLGVQGACKDNPGENARQLARIVCGTVMAGELSLMAALAAGHLVKSHMIHNRSKINLQDLQGACTKKTA

SEQ ID NO: 210 - protein, 18 aa, Homo sapiens
  Payload ID: 26;
  Gene Symbol: HMGCR;
  Gene Name: 3-hydroxy-3-methylglutaryl-CoA reductase;
  ENSP ID: ENSP00000409100
MLSRLFRMHGLFVASHPW

SEQ ID NO: 211 - protein, 115 aa, Homo sapiens
  Payload ID: 26;
  Gene Symbol: HMGCR;
  Gene Name: 3-hydroxy-3-methylglutaryl-CoA reductase;
  ENSP ID: ENSP00000420871
YFPEMQILAVSGNYCTDKKPAAINWIEGRGKSVVCEAVIPAKVVREMLGVQGACKDNPGENARQLARIVCGTVMAGELSLMAALAAGHLVKSHMIHNRSKINLQDLQGACTKKTA

SEQ ID NO: 212 - protein, 165 aa, Homo sapiens
  Payload ID: 26;
  Gene Symbol: HMGCR;
  Gene Name: 3-hydroxy-3-methylglutaryl-CoA reductase;
  ENSP ID: ENSP00000421378
  MOD_RES (1)..(1): Any amino acid
XHEYFPEMQILAVSGNYCTDKKPAAINWIEGRGKSVVCEAVIPAKVVREVLKTTTEAMIEVNINKNLVGSAMAGSIGGYNAHAANIVTAIYIACGQMLGVQGACKDNPGENARQLARIVCGTVMAGELSLMAALAAGHLVKSHMIHNRSKINLQDLQGACTKKTA

SEQ ID NO: 213 - protein, 888 aa, Homo sapiens [sequence omitted]

SEQ ID NO: 214 - protein, 111 aa, Homo sapiens
  Payload ID: 26;
  Gene Symbol: HMGCR;
  Gene Name: 3-hydroxy-3-methylglutaryl-CoA reductase;
  ENSP ID: ENSP00000427340
MLSRLFRMHGLFVASHPWEVIVGTVTLTICMMSMNMFTGNNKICGWNYECPKFEEDVLSSDIIILTITRCIAILYIYFQFQNLRQLGSKYILGIAGLFTIFSSFVFSTVVI

SEQ ID NO: 215 - protein, 520 aa, Homo sapiens
  Payload ID: 27;
  Gene Symbol: HMGCS1;
  Gene Name: 3-hydroxy-3-methylglutaryl-CoA synthase 1 (soluble);
  Uniprot ID:  Q01581;
  ENSP ID: ENSP00000322706
MPGSLPLNAEACWPKDVGIVALEIYFPSQYVDQAELEKYDGVDAGKYTIGLGQAKMGFCTDREDINSLCMTVVQNLMERNNLSYDCIGRLEVGTETIIDKSKSVKTNLMQLFEESGNTDIEGIDTTNACYGGTAAVFNAVNWIESSSWDGRYALVVAGDIAVYATGNARPTGGVGAVALLIGPNAPLIFERGLRGTHMQHAYDFYKPDMLSEYPIVDGKLSIQCYLSALDRCYSVYCKKIHAQWQKEGNDKDFTLNDFGFMIFHSPYCKLVQKSLARMLLNDFLNDQNRDKNSIYSGLEAFGDVKLEDTYFDRDVEKAFMKASSELFSQKTKASLLVSNQNGNMYTSSVYGSLASVLAQYSPQQLAGKRIGVFSYGSGLAATLYSLKVTQDATPGSALDKITASLCDLKSRLDSRTGVAPDVFAENMKLREDTHHLVNYIPQGSIDSLFEGTWYLVRVDEKHRRTYARRPTPNDDTLDEGVGLVHSNIATEHIPSPAKKVPRLPATAAEPEAAVISNGEH

SEQ ID NO: 216 - protein, 520 aa, Homo sapiens; identical to SEQ ID NO: 215
  Payload ID: 27;
  Gene Symbol: HMGCS1;
  Gene Name: 3-hydroxy-3-methylglutaryl-CoA synthase 1 (soluble);
  Uniprot ID:  Q01581;
  ENSP ID: ENSP00000399402

SEQ ID NO: 217 - protein, 95 aa, Homo sapiens
  Payload ID: 27;
  Gene Symbol: HMGCS1;
  Gene Name: 3-hydroxy-3-methylglutaryl-CoA synthase 1 (soluble);
  ENSP ID: ENSP00000427339
MPGSLPLNAEACWPKDVGIVALEIYFPSQYVDQAELEKYDGVDAGKYTIGLGQAKMGFCTDREDINSLCMTVVQNLMERNNLSYDCIGRLEVGTE

SEQ ID NO: 218 - protein, 508 aa, Homo sapiens
  Payload ID: 28;
  Gene Symbol: HMGCS2;
  Gene Name: 3-hydroxy-3-methylglutaryl-CoA synthase 2 (mitochondrial) beta-mannosyltransferase-like;
  Uniprot ID:  P54868;
  ENSP ID: ENSP00000358414
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 219 - protein, 466 aa, Homo sapiens
  Payload ID: 28;
  Gene Symbol: HMGCS2;
  Gene Name: 3-hydroxy-3-methylglutaryl-CoA synthase 2 (mitochondrial);
  Uniprot ID:  P54868;
  ENSP ID: ENSP00000439495
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 220 - protein, 158 aa, Homo sapiens
  Payload ID: 29;
  Gene Symbol: HACD1;
  Gene Name: 3-hydroxyacyl-CoA dehydratase 1;
  ENSP ID: ENSP00000322923
MGRLTEAAAAGSGSRAAGWAGSPPTLLPLSPTSPRCAATMASSDEDGTNGGASEAGEDREAPGERRRLGVLATAWLTFYDIAMTAGRRLILSPRLECIGAISAHCQPQPPEFKRFSCLGLRSSWDYKRGPPRPINFCIFGRDRVSPCWPGWSRTPDLK

SEQ ID NO: 221 - protein, 288 aa, Homo sapiens
  Payload ID: 29;
  Gene Symbol: HACD1;
  Gene Name: 3-hydroxyacyl-CoA dehydratase 1;
  Uniprot ID:  B0YJ81;
  ENSP ID: ENSP00000355308
MGRLTEAAAAGSGSRAAGWAGSPPTLLPLSPTSPRCAATMASSDEDGTNGGASEAGEDREAPGERRRLGVLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARYNFFIILYPVGVAGELLTIYAALPHVKKTGMFSIRLPNKYNVSFDYYYFLLITMASYIPLFPQLYFHMLRQRRKVLHGEVIVEKDD

SEQ ID NO: 222 - protein, 174 aa, Homo sapiens
  Payload ID: 29;
  Gene Symbol: HACD1;
  Gene Name: 3-hydroxyacyl-CoA dehydratase 1;
  ENSP ID: ENSP00000462336
  MOD_RES (1)..(1): Any amino acid
XCAATMASSDEDGTNGGASEAGEDREAPGERRRLGVLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARWRYLAV

SEQ ID NO: 223 - protein, 37 aa, Homo sapiens
  Payload ID: 29;
  Gene Symbol: HACD1;
  Gene Name: 3-hydroxyacyl-CoA dehydratase 1;
  ENSP ID: ENSP00000462868
IVHCLIGIVPTSVIVTGVQVSSRIFMVWLITHSIKPI

SEQ ID NO: 224 - protein, 254 aa, Homo sapiens
  Payload ID: 30;
  Gene Symbol: HACD2;
  Gene Name: 3-hydroxyacyl-CoA dehydratase 2;
  Uniprot ID:  Q6Y1H2;
  ENSP ID: ENSP00000373153
MAAVAATAAAKGNGGGGGRAGAGDASGTRKKKGPGPLATAYLVIYNVVMTAGWLVIAVGLVRAYLAKGSYHSLYYSIEKPLKFFQTGALLEILHCAIGIVPSSVVLTSFQVMSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYNFSFDYYAFLILIMISYIPIFPQLYFHMIHQRRKILSHTEEHKKFE

SEQ ID NO: 225 - protein, 61 aa, Homo sapiens
  Payload ID: 30;
  Gene Symbol: HACD2;
  Gene Name: 3-hydroxyacyl-CoA dehydratase 2;
  ENSP ID: ENSP00000417567
  MOD_RES (1)..(1): Any amino acid
XYTLFIVLYPMGVSGELLTIYAALPFVRQAGLYSISLPNKYNFSFDYYAFLILIMISYIPS

SEQ ID NO: 226 - protein, 98 aa, Homo sapiens
  Payload ID: 30;
  Gene Symbol: HACD2;
  Gene Name: 3-hydroxyacyl-CoA dehydratase 2;
  ENSP ID: ENSP00000419237
MSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYN

SEQ ID NO: 227 - protein, 362 aa, Homo sapiens
  Payload ID: 31;
  Gene Symbol: HACD3;
  Gene Name: 3-hydroxyacyl-CoA dehydratase 3;
  Uniprot ID:  Q9P035;
  ENSP ID: ENSP00000261875
MENQVLTPHVYWAQRHRELYLRVELSDVQNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 228 - protein, 307 aa, Homo sapiens
  Payload ID: 31;
  Gene Symbol: HACD3;
  Gene Name: 3-hydroxyacyl-CoA dehydratase 3;
  Uniprot ID:  Q9P035;
  ENSP ID: ENSP00000392491
MENQVLTPHVYWAQRHRELYLRVELSDVQNPAISITENVLHFKAQGHGAKGDNVYEFHLEFLDLVKPEEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 229 - protein, 139 aa, Homo sapiens
  Payload ID: 31;
  Gene Symbol: HACD3;
  Gene Name: 3-hydroxyacyl-CoA dehydratase 3;
  ENSP ID: ENSP00000454610
MELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEI

SEQ ID NO: 230 - protein, 245 aa, Homo sapiens
  Payload ID: 31;
  Gene Symbol: HACD3;
  Gene Name: 3-hydroxyacyl-CoA dehydratase 3;
  ENSP ID: ENSP00000454873
MELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 231 - protein, 337 aa, Homo sapiens
  Payload ID: 31;
  Gene Symbol: HACD3;
  Gene Name: 3-hydroxyacyl-CoA dehydratase 3;
  ENSP ID: ENSP00000455530
MENQNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 232 - protein, 245 aa, Homo sapiens; identical to SEQ ID NO: 230
  Payload ID: 31;
  Gene Symbol: HACD3;
  Gene Name: 3-hydroxyacyl-CoA dehydratase 3;
  ENSP ID: ENSP00000455587

SEQ ID NO: 233 - protein, 245 aa, Homo sapiens; identical to SEQ ID NO: 230
  Payload ID: 31;
  Gene Symbol: HACD3;
  Gene Name: 3-hydroxyacyl-CoA dehydratase 3;
  ENSP ID: ENSP00000455686

SEQ ID NO: 234 - protein, 245 aa, Homo sapiens; identical to SEQ ID NO: 230
  Payload ID: 31;
  Gene Symbol: HACD3;
  Gene Name: 3-hydroxyacyl-CoA dehydratase 3;
  ENSP ID: ENSP00000456300

SEQ ID NO: 235 - protein, 400 aa, Homo sapiens
  Payload ID: 31;
  Gene Symbol: HACD3;
  Gene Name: 3-hydroxyacyl-CoA dehydratase 3;
  ENSP ID: ENSP00000456568
MENQVLTPHVYWAQRHRELYLRVELSDVQGLTLLPRLECSSVIIAHRSLELLGLSSPPGSAYQVGLQNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 236 - protein, 232 aa, Homo sapiens
  Payload ID: 32;
  Gene Symbol: HACD4;
  Gene Name: 3-hydroxyacyl-CoA dehydratase 4;
  Uniprot ID:  Q5VWC8;
  ENSP ID: ENSP00000419503
MGPLALPAWLQPRYRKNAYLFIYYLIQFCGHSWIFTNMTVRFFSFGKDSMVDTFYAIGLVMRLCQSVSLLELLHIYVGIESNHLLPRFLQLTERIIILFVVITSQEEVQEKYVVCVLFVFWNLLDMVRYTYSMLSVIGISYAVLTWLSQTLWMPIYPLCVLAEAFAIYQSLPYFESFGTYSTKLPFDLSIYFPYVLKIYLMMLFIGMYFTYSHLYSERRDILGIFPIKKKKM

SEQ ID NO: 237 - protein, 286 aa, Homo sapiens
  Payload ID: 33;
  Gene Symbol: HAAO;
  Gene Name: 3-hydroxyanthranilate 3,4-dioxygenase;
  Uniprot ID:  P46952;
  ENSP ID: ENSP00000294973
MERRLGVRAWVKENRGSFQPPVCNKLMHQEQLKVMFIGGPNTRKDYHIEEGEEVFYQLEGDMVLRVLEQGKHRDVVIRQGEIFLLPARVPHSPQRFANTVGLVVERRRLETELDGLRYYVGDTMDVLFEKWFYCKDLGTQLAPIIQEFFSSEQYRTGKPIPDQLLKEPPFPLSTRSIMEPMSLDAWLDSHHRELQAGTPLSLFGDTYETQVIAYGQGSSEGLRQNVDVWLWQLEGSSVVTMGGRRLSLAPDDSLLVLAGTSYAWERTQGSVALSVTQDPACKKPLG

SEQ ID NO: 238 - protein, 176 aa, Homo sapiens
  Payload ID: 33;
  Gene Symbol: HAAO;
  Gene Name: 3-hydroxyanthranilate 3,4-dioxygenase;
  ENSP ID: ENSP00000412601
MFIGGPNTRKDYHIEEGEEVFYQLEGDMVLRVLEQGKHRDVVIRQGEIFLLPARVPHSPQRFANTVGLVVERRRLETELDGLRYYVGDTMDVLFEKWFYCKDLGTQLAPIIQEFFSSEQYRTGKPIPDQLLKEPPFPLSTRSIMEPMSLDAWLDSHHRELQAGTPLSLFGDTYETQ

SEQ ID NO: 239 - protein, 343 aa, Homo sapiens
  Payload ID: 34;
  Gene Symbol: BDH1;
  Gene Name: 3-hydroxybutyrate dehydrogenase, type 1;
  Uniprot ID:  Q02338;
  ENSP ID: ENSP00000350914
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 240 - protein, 343 aa, Homo sapiens; identical to SEQ ID NO: 239
  Payload ID: 34;
  Gene Symbol: BDH1;
  Gene Name: 3-hydroxybutyrate dehydrogenase, type 1;
  Uniprot ID:  Q02338;
  ENSP ID: ENSP00000376183

SEQ ID NO: 241 - protein, 343 aa, Homo sapiens; identical to SEQ ID NO: 239
  Payload ID: 34;
  Gene Symbol: BDH1;
  Gene Name: 3-hydroxybutyrate dehydrogenase, type 1;
  Uniprot ID:  Q02338;
  ENSP ID: ENSP00000376184

SEQ ID NO: 242 - protein, 166 aa, Homo sapiens
  Payload ID: 34;
  Gene Symbol: BDH1;
  Gene Name: 3-hydroxybutyrate dehydrogenase, type 1;
  ENSP ID: ENSP00000387648
MKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESI

SEQ ID NO: 243 - protein, 89 aa, Homo sapiens
  Payload ID: 34;
  Gene Symbol: BDH1;
  Gene Name: 3-hydroxybutyrate dehydrogenase, type 1;
  ENSP ID: ENSP00000396149
MLATRLSRPLSRLPGKTLSACDRENGARRPLLLGSTSFIPIGRRTYASAAEPVGSKAVLVTGCDSGFGFSLAKHLHSKGFLVFAGCLMK

SEQ ID NO: 244 - protein, 50 aa, Homo sapiens
  Payload ID: 34;
  Gene Symbol: BDH1;
  Gene Name: 3-hydroxybutyrate dehydrogenase, type 1;
  ENSP ID: ENSP00000405462
MLATRLSRPLSRLPGKTLSACDRENGARRPLLLGSTSFIPIGRRTYASAA

SEQ ID NO: 245 - protein, 129 aa, Homo sapiens
  Payload ID: 34;
  Gene Symbol: BDH1;
  Gene Name: 3-hydroxybutyrate dehydrogenase, type 1;
  ENSP ID: ENSP00000408016
  MOD_RES (1)..(1): Any amino acid
XAGISTFGEVEFTSLETYKQVAEVNLWGTVRMTKSFLPLIRRAKGEWERELPPAPEPAPRVHLCSEWKYLSQQLQCPQLSRGRVVNISSMLGRMANPARSPYCITKFGVEAFSDCLRYEMYPLGVKVSV

SEQ ID NO: 246 - protein, 168 aa, Homo sapiens
  Payload ID: 34;
  Gene Symbol: BDH1;
  Gene Name: 3-hydroxybutyrate dehydrogenase, type 1;
  ENSP ID: ENSP00000408685
MASNGIQKRRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAK

SEQ ID NO: 247 - protein, 186 aa, Homo sapiens
  Payload ID: 34;
  Gene Symbol: BDH1;
  Gene Name: 3-hydroxybutyrate dehydrogenase, type 1;
  ENSP ID: ENSP00000409849
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRA

SEQ ID NO: 248 - protein, 256 aa, Homo sapiens
  Payload ID: 34;
  Gene Symbol: BDH1;
  Gene Name: 3-hydroxybutyrate dehydrogenase, type 1;
  ENSP ID: ENSP00000411014
MKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 249 - protein, 343 aa, Homo sapiens; identical to SEQ ID NO: 239
  Payload ID: 34;
  Gene Symbol: BDH1;
  Gene Name: 3-hydroxybutyrate dehydrogenase, type 1;
  Uniprot ID:  Q02338;
  ENSP ID: ENSP00000482744

SEQ ID NO: 250 - protein, 343 aa, Homo sapiens; identical to SEQ ID NO: 239
  Payload ID: 34;
  Gene Symbol: BDH1;
  Gene Name: 3-hydroxybutyrate dehydrogenase, type 1;
  Uniprot ID:  Q02338;
  ENSP ID: ENSP00000484421

SEQ ID NO: 251 - protein, 166 aa, Homo sapiens; identical to SEQ ID NO: 242
  Payload ID: 34;
  Gene Symbol: BDH1;
  Gene Name: 3-hydroxybutyrate dehydrogenase, type 1;
  ENSP ID: ENSP00000485973

SEQ ID NO: 252 - protein, 256 aa, Homo sapiens; identical to SEQ ID NO: 248
  Payload ID: 34;
  Gene Symbol: BDH1;
  Gene Name: 3-hydroxybutyrate dehydrogenase, type 1;
  ENSP ID: ENSP00000486316

SEQ ID NO: 253 - protein, 186 aa, Homo sapiens; identical to SEQ ID NO: 247
  Payload ID: 34;
  Gene Symbol: BDH1;
  Gene Name: 3-hydroxybutyrate dehydrogenase, type 1;
  ENSP ID: ENSP00000486552

SEQ ID NO: 254 - protein, 168 aa, Homo sapiens; identical to SEQ ID NO: 246
  Payload ID: 34;
  Gene Symbol: BDH1;
  Gene Name: 3-hydroxybutyrate dehydrogenase, type 1;
  ENSP ID: ENSP00000486776

SEQ ID NO: 255 - protein, 187 aa, Homo sapiens
  Payload ID: 34;
  Gene Symbol: BDH1;
  Gene Name: 3-hydroxybutyrate dehydrogenase, type 1;
  ENSP ID: ENSP00000487163
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAK

SEQ ID NO: 256 - protein, 89 aa, Homo sapiens; identical to SEQ ID NO: 243
  Payload ID: 34;
  Gene Symbol: BDH1;
  Gene Name: 3-hydroxybutyrate dehydrogenase, type 1;
  ENSP ID: ENSP00000487308

SEQ ID NO: 257 - protein, 245 aa, Homo sapiens
  Payload ID: 35;
  Gene Symbol: BDH2;
  Gene Name: 3-hydroxybutyrate dehydrogenase, type 2;
  Uniprot ID:  Q9BUT1;
  ENSP ID: ENSP00000296424
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIINMSSVASSVKGVVNRCVYSTTKAAVIGLTKSVAADFIQQGIRCNCVCPGTVDTPSLQERIQARGNPEEARNDFLKRQKTGRFATAEEIAMLCVYLASDESAYVTGNPVIIDGGWSL

SEQ ID NO: 258 - protein, 90 aa, Homo sapiens
  Payload ID: 35;
  Gene Symbol: BDH2;
  Gene Name: 3-hydroxybutyrate dehydrogenase, type 2;
  ENSP ID: ENSP00000421516
MGRLDGKVIILTAAAQGIGQAAALAFAREGAKVIATDINESKLQELEKYPGIQTRVLDVTKKKQIDQFANEVERLDVLFNVAGVCLGSPG

SEQ ID NO: 259 - protein, 116 aa, Homo sapiens
  Payload ID: 35;
  Gene Symbol: BDH2;
  Gene Name: 3-hydroxybutyrate dehydrogenase, type 2;
  ENSP ID: ENSP00000422891
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAF

SEQ ID NO: 260 - protein, 64 aa, Homo sapiens
  Payload ID: 35;
  Gene Symbol: BDH2;
  Gene Name: 3-hydroxybutyrate dehydrogenase, type 2;
  ENSP ID: ENSP00000424173
MGRLDGKVIILTAAAQGIGQAAALAFAREGAKVIATDINESKLQELEKYPVPLVLFFRYSNSCP

SEQ ID NO: 261 - protein, 130 aa, Homo sapiens
  Payload ID: 35;
  Gene Symbol: BDH2;
  Gene Name: 3-hydroxybutyrate dehydrogenase, type 2;
  ENSP ID: ENSP00000427442
MGRLDGKVIILTAAAQGIGQAAALAFAREGAKVIATDINESKLQELEKYPGIQTRVLDVTKKKQIDQFANEVERLDVLFNVAGFVHHGTVLDCEEKDWDFSMNLNVRSMYLMIKAFLPKMLAQKSGNIIN

SEQ ID NO: 262 - protein, 336 aa, Homo sapiens
  Payload ID: 36;
  Gene Symbol: HIBADH;
  Gene Name: 3-hydroxyisobutyrate dehydrogenase;
  Uniprot ID:  P31937;
  ENSP ID: ENSP00000265395
MAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 263 - protein, 206 aa, Homo sapiens
  Payload ID: 36;
  Gene Symbol: HIBADH;
  Gene Name: 3-hydroxyisobutyrate dehydrogenase;
  ENSP ID: ENSP00000390205
  MOD_RES (1)..(1): Any amino acid
XELPHTLKLPGLPLFPNKFLISLVLLILVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGV

SEQ ID NO: 264 - protein, 39 aa, Homo sapiens
  Payload ID: 36;
  Gene Symbol: HIBADH;
  Gene Name: 3-hydroxyisobutyrate dehydrogenase;
  ENSP ID: ENSP00000393365
MAASLRLLGAASGLRYWSRRLRPAAGSFAAGSIFPSRCC

SEQ ID NO: 265 - protein, 386 aa, Homo sapiens
  Payload ID: 37;
  Gene Symbol: HIBCH;
  Gene Name: 3-hydroxyisobutyryl-CoA hydrolase;
  Uniprot ID:  Q6NVY1;
  ENSP ID: ENSP00000352706
MGQREMWRLMSRFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 266 - protein, 338 aa, Homo sapiens
  Payload ID: 37;
  Gene Symbol: HIBCH;
  Gene Name: 3-hydroxyisobutyryl-CoA hydrolase;
  Uniprot ID:  Q6NVY1;
  ENSP ID: ENSP00000376144
MGQREMWRLMSRFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMF

SEQ ID NO: 267 - protein, 69 aa, Homo sapiens
  Payload ID: 37;
  Gene Symbol: HIBCH;
  Gene Name: 3-hydroxyisobutyryl-CoA hydrolase;
  ENSP ID: ENSP00000376145
  MOD_RES (1)..(1): Any amino acid
XISEAEKAKQKIAPVFFREEYMLNNAVGSCQKPYVALIHGITMGGDCSLMWVEVISCHDSKENLVTSLH

SEQ ID NO: 268 - protein, 163 aa, Homo sapiens
  Payload ID: 37;
  Gene Symbol: HIBCH;
  Gene Name: 3-hydroxyisobutyryl-CoA hydrolase;
  ENSP ID: ENSP00000386274
MLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 269 - protein, 128 aa, Homo sapiens
  Payload ID: 37;
  Gene Symbol: HIBCH;
  Gene Name: 3-hydroxyisobutyryl-CoA hydrolase;
  ENSP ID: ENSP00000387098
MLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRA

SEQ ID NO: 270 - protein, 273 aa, Homo sapiens
  Payload ID: 37;
  Gene Symbol: HIBCH;
  Gene Name: 3-hydroxyisobutyryl-CoA hydrolase;
  ENSP ID: ENSP00000387247
MPGMPGRARPGAASLPGQGPRRPARRGEEPSRRHRLTYPRRGDGARRSPARAPDPRRRGSGAGTLWFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLPRLQGKLGYFLALTGFRLKGRDVYRAGIATHFVDS

SEQ ID NO: 271 - protein, 38 aa, Homo sapiens
  Payload ID: 37;
  Gene Symbol: HIBCH;
  Gene Name: 3-hydroxyisobutyryl-CoA hydrolase;
  ENSP ID: ENSP00000398060
  MOD_RES (1)..(1): Any amino acid
XLIDKDQSPKWKPADLKEVTEEDLNNHFKSLGSSDLKF

SEQ ID NO: 272 - protein, 119 aa, Homo sapiens
  Payload ID: 37;
  Gene Symbol: HIBCH;
  Gene Name: 3-hydroxyisobutyryl-CoA hydrolase;
  ENSP ID: ENSP00000399263
QSKIDRDKSFILEEHMDKINSCFSANTVEEIIENLQQDGSSFALEQLKVINKMSPTSLKITLRQLMEGSSKTLQEVLTMEYRLSQACMRGHDFHEGVRAGKWQMGTYHFGEMGFVSICC

SEQ ID NO: 273 - protein, 52 aa, Homo sapiens
  Payload ID: 37;
  Gene Symbol: HIBCH;
  Gene Name: 3-hydroxyisobutyryl-CoA hydrolase;
  ENSP ID: ENSP00000414820
DVGGGYFLPRLQGKLGYFLALTGFRLKGRDVYRAGIATHFVDSEKNGDDTIT

SEQ ID NO: 274 - protein, 380 aa, Homo sapiens
  Payload ID: 37;
  Gene Symbol: HIBCH;
  Gene Name: 3-hydroxyisobutyryl-CoA hydrolase;
  ENSP ID: ENSP00000481055
MWRLMSRFNAFKRTNTILHHLRMSKHTDAAEEVLLEKKGCTGVITLNRPKFLNALTLNMIRQIYPQLKKWEQDPETFLIIIKGAGGKAFCAGGDIRVISEAEKAKQKIAPVFFREEYMLNNAVGSCQKPYVALIHGITMGGGVGLSVHGQFRVATEKCLFAMPETAIGLFPDVGGGYFLTTPRKTWLLPCINGFRLKGRDVYRAGIATHFVDSEKLAMLEEDLLALKSPSKENIASVLENYHTESKIDRDKSFILEEHMDKINSCFSANTVEEIIENLQQDGSSFALEQLKVINKMSPTSLKITLRQLMEGSSKTLQEVLTMEYRLSQACMRGHDFHEGVRAVLIDKDQSPKWKPADLKEVTEEDLNNHFKSLGSSDLKF

SEQ ID NO: 275 - protein, 182 aa, Homo sapiens
  Payload ID: 38;
  Gene Symbol: HMGCL;
  Gene Name: 3-hydroxymethyl-3-methylglutaryl-CoA lyase;
  ENSP ID: ENSP00000235958
  MOD_RES (1)..(1): Any amino acid
XKALPRRLVGLASLRAVSTSSMGTLPKRVKIVEVGPRDGLQNEKVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 276 - protein, 77 aa, Homo sapiens
  Payload ID: 38;
  Gene Symbol: HMGCL;
  Gene Name: 3-hydroxymethyl-3-methylglutaryl-CoA lyase;
  ENSP ID: ENSP00000363611
MLEARREWSRKVFPWSGATQQPGTPFHSPSQTLRRSAGQRPAGVPVPADVLLWTSSRLCVPPLMCSSPCPATCVSAC

SEQ ID NO: 277 - protein, 325 aa, Homo sapiens
  Payload ID: 38;
  Gene Symbol: HMGCL;
  Gene Name: 3-hydroxymethyl-3-methylglutaryl-CoA lyase;
  Uniprot ID:  P35914;
  ENSP ID: ENSP00000363614
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 278 - protein, 254 aa, Homo sapiens
  Payload ID: 38;
  Gene Symbol: HMGCL;
  Gene Name: 3-hydroxymethyl-3-methylglutaryl-CoA lyase;
  Uniprot ID:  P35914;
  ENSP ID: ENSP00000389281
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 279 - protein, 340 aa, Homo sapiens
  Payload ID: 39;
  Gene Symbol: HMGCLL1;
  Gene Name: 3-hydroxymethyl-3-methylglutaryl-CoA lyase-like 1;
  Uniprot ID:  Q8TB92;
  ENSP ID: ENSP00000274901
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQMADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 280 - protein, 308 aa, Homo sapiens
  Payload ID: 39;
  Gene Symbol: HMGCLL1;
  Gene Name: 3-hydroxymethyl-3-methylglutaryl-CoA lyase-like 1;
  Uniprot ID:  Q8TB92;
  ENSP ID: ENSP00000309737
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 281 - protein, 237 aa, Homo sapiens
  Payload ID: 39;
  Gene Symbol: HMGCLL1;
  Gene Name: 3-hydroxymethyl-3-methylglutaryl-CoA lyase-like 1;
  ENSP ID: ENSP00000359887
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 282 - protein, 53 aa, Homo sapiens
  Payload ID: 39;
  Gene Symbol: HMGCLL1;
  Gene Name: 3-hydroxymethyl-3-methylglutaryl-CoA lyase-like 1;
  Uniprot ID:  Q8TB92;
  ENSP ID: ENSP00000359889
MGNVPSAVKHCLSYQQLLREHLWIGDSVAGALDPAQELQSVMLMLHHGPLRKP

SEQ ID NO: 283 - protein, 370 aa, Homo sapiens
  Payload ID: 39;
  Gene Symbol: HMGCLL1;
  Gene Name: 3-hydroxymethyl-3-methylglutaryl-CoA lyase-like 1;
  Uniprot ID:  Q8TB92;
  ENSP ID: ENSP00000381654
MGNVPSAVKHCLSYQQLLREHLWIGDSVAGALDPAQTSLLTNLHCFQPDVSGFSVSLAGTVACIHWETSQLSGLPEFVKIVEVGPRDGLQNEKVIVPTDIKIEFINRLSQTGLSVIEVTSFVSSRWVPQMADHTEVMKGIHQYPGVRYPVLTPNLQGFHHAVAAGATEISVFGAASESFSKKNINCSIEESMGKFEEVVKSARHMNIPARGYVSCALGCPYEGSITPQKVTEVSKRLYGMGCYEISLGDTIGVGTPGSMKRMLESVMKEIPPGALAVHCHDTYGQALANILTALQMGINVVDSAVSGLGGCPYAKGASGNVATEDLIYMLNGLGLNTGVNLYKVMEAGDFICKAVNKTTNSKVAQASFNA

SEQ ID NO: 284 - protein, 151 aa, Homo sapiens
  Payload ID: 39;
  Gene Symbol: HMGCLL1;
  Gene Name: 3-hydroxymethyl-3-methylglutaryl-CoA lyase-like 1;
  ENSP ID: ENSP00000412924
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQVAAGATEISVFGAASESFSKKNINCSIEESMGKFEEVVKSARHMNIPARGYL

SEQ ID NO: 285 - protein, 174 aa, Homo sapiens
  Payload ID: 39;
  Gene Symbol: HMGCLL1;
  Gene Name: 3-hydroxymethyl-3-methylglutaryl-CoA lyase-like 1;
  ENSP ID: ENSP00000424309
MGNVPSAVKHCLSYQQLLREHLWIGDSVAGALDPAQETSQLSGLPEFVKIVEVGPRDGLQNEKVIVPTDIKIEFINRLSQTGLSVIEVTSFVSSRWVPQMGINVVDSAVSGLGGCPYAKGASGNVATEDLIYMLNGLGLNTGVNLYKVMEAGDFICKAVNKTTNSKVAQASFNA

SEQ ID NO: 286 - protein, 39 aa, Homo sapiens
  Payload ID: 39;
  Gene Symbol: HMGCLL1;
  Gene Name: 3-hydroxymethyl-3-methylglutaryl-CoA lyase-like 1;
  ENSP ID: ENSP00000426054
MGNVPSAVKHCLSYQQLLREHLWIGDSVAGALDPAQEKE

SEQ ID NO: 287 - protein, 268 aa, Homo sapiens
  Payload ID: 40;
  Gene Symbol: KDSR;
  Gene Name: 3-ketodihydrosphingosine reductase;
  Uniprot ID:  Q06136;
  ENSP ID: ENSP00000312939
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 288 - protein, 332 aa, Homo sapiens
  Payload ID: 40;
  Gene Symbol: KDSR;
  Gene Name: 3-ketodihydrosphingosine reductase;
  Uniprot ID:  Q06136;
  ENSP ID: ENSP00000385083
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 289 - protein, 155 aa, Homo sapiens
  Payload ID: 40;
  Gene Symbol: KDSR;
  Gene Name: 3-ketodihydrosphingosine reductase;
  ENSP ID: ENSP00000467962
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLERLMSINYLGSVYPSRAVITTM

SEQ ID NO: 290 - protein, 203 aa, Homo sapiens
  Payload ID: 40;
  Gene Symbol: KDSR;
  Gene Name: 3-ketodihydrosphingosine reductase;
  ENSP ID: ENSP00000468203
QDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIVVTMGLFRTIALFYLGSFDSIVRRCMMQREKSENADKTA

SEQ ID NO: 291 - protein, 520 aa, Homo sapiens
  Payload ID: 41;
  Gene Symbol: OXCT1;
  Gene Name: 3-oxoacid CoA transferase 1;
  Uniprot ID:  P55809;
  ENSP ID: ENSP00000196371
MAALKLLSSGLRLCASARGSGATWYKGCVCSFSTSAHRHTKFYTDPVEAVKDIPDGATVLVGGFGLCGIPENLIDALLKTGVKGLTAVSNNAGVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 292 - protein, 123 aa, Homo sapiens
  Payload ID: 41;
  Gene Symbol: OXCT1;
  Gene Name: 3-oxoacid CoA transferase 1;
  Uniprot ID:  P55809;
  ENSP ID: ENSP00000421143
MLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 293 - protein, 123 aa, Homo sapiens; identical to SEQ ID NO: 292
  Payload ID: 41;
  Gene Symbol: OXCT1;
  Gene Name: 3-oxoacid CoA transferase 1;
  Uniprot ID:  P55809;
  ENSP ID: ENSP00000423144

SEQ ID NO: 294 - protein, 334 aa, Homo sapiens
  Payload ID: 41;
  Gene Symbol: OXCT1;
  Gene Name: 3-oxoacid CoA transferase 1;
  ENSP ID: ENSP00000425348
MMVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 295 - protein, 517 aa, Homo sapiens
  Payload ID: 42;
  Gene Symbol: OXCT2;
  Gene Name: 3-oxoacid CoA transferase 2;
  Uniprot ID:  Q9BYC2;
  ENSP ID: ENSP00000361914
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 296 - protein, 459 aa, Homo sapiens
  Payload ID: 43;
  Gene Symbol: OXSM;
  Gene Name: 3-oxoacyl-ACP synthase, mitochondrial;
  Uniprot ID:  Q9NWU1;
  ENSP ID: ENSP00000280701
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDADVMVAGGTDSCISPLSLAGFSRARALSTNSDPKLACRPFHPKRDGFVMGEGAAVLVLEEYEHAVQRRARIYAEVLGYGLSGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 297 - protein, 220 aa, Homo sapiens
  Payload ID: 43;
  Gene Symbol: OXSM;
  Gene Name: 3-oxoacyl-ACP synthase, mitochondrial;
  ENSP ID: ENSP00000392334
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSF

SEQ ID NO: 298 - protein, 102 aa, Homo sapiens
  Payload ID: 43;
  Gene Symbol: OXSM;
  Gene Name: 3-oxoacyl-ACP synthase, mitochondrial;
  ENSP ID: ENSP00000404115
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEEPGL

SEQ ID NO: 299 - protein, 231 aa, Homo sapiens
  Payload ID: 43;
  Gene Symbol: OXSM;
  Gene Name: 3-oxoacyl-ACP synthase, mitochondrial;
  ENSP ID: ENSP00000409817
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDADVM

SEQ ID NO: 300 - protein, 376 aa, Homo sapiens
  Payload ID: 43;
  Gene Symbol: OXSM;
  Gene Name: 3-oxoacyl-ACP synthase, mitochondrial;
  Uniprot ID:  Q9NWU1;
  ENSP ID: ENSP00000411303
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 301 - protein, 102 aa, Homo sapiens; identical to SEQ ID NO: 298
  Payload ID: 43;
  Gene Symbol: OXSM;
  Gene Name: 3-oxoacyl-ACP synthase, mitochondrial;
  ENSP ID: ENSP00000487031

SEQ ID NO: 302 - protein, 624 aa, Homo sapiens
  Payload ID: 44;
  Gene Symbol: PAPSS1;
  Gene Name: 3'-phosphoadenosine 5'-phosphosulfate synthase 1;
  Uniprot ID:  O43252;
  ENSP ID: ENSP00000265174
MEIPGSLCKKVKLSNNAQNWGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEHHEDFEFISGTRMRKLAREGQKPPEGFMAPKAWTVLTEYYKSLEKA

SEQ ID NO: 303 - protein, 614 aa, Homo sapiens
  Payload ID: 45;
  Gene Symbol: PAPSS2;
  Gene Name: 3'-phosphoadenosine 5'-phosphosulfate synthase 2;
  Uniprot ID:  O95340;
  ENSP ID: ENSP00000354436
MSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 304 - protein, 619 aa, Homo sapiens
  Payload ID: 45;
  Gene Symbol: PAPSS2;
  Gene Name: 3'-phosphoadenosine 5'-phosphosulfate synthase 2;
  Uniprot ID:  O95340;
  ENSP ID: ENSP00000406157
MSGIKKQKTENQQKSTNVVYQAHHVSRNKRGQVVGTRGGFRGCTVWLTGLSGAGKTTISFALEEYLVSHAIPCYSLDGDNVRHGLNRNLGFSPGDREENIRRIAEVAKLFADAGLVCITSFISPFAKDRENARKIHESAGLPFFEIFVDAPLNICESRDVKGLYKRARAGEIKGFTGIDSDYEKPETPERVLKTNLSTVSDCVHQVVELLQEQNIVPYTIIKDIHELFVPENKLDHVRAEAETLPSLSITKLDLQWVQVLSEGWATPLKGFMREKEYLQVMHFDTLLDGMALPDGVINMSIPIVLPVSAEDKTRLEGCSKFVLAHGGRRVAILRDAEFYEHRKEERCSRVWGTTCTKHPHIKMVMESGDWLVGGDLQVLEKIRWNDGLDQYRLTPLELKQKCKEMNADAVFAFQLRNPVHNGHALLMQDTRRRLLERGYKHPVLLLHPLGGWTKDDDVPLDWRMKQHAAVLEEGVLDPKSTIVAIFPSPMLYAGPTEVQWHCRSRMIAGANFYIVGRDPAGMPHPETKKDLYEPTHGGKVLSMAPGLTSVEIIPFRVAAYNKAKKAMDFYDPARHNEFDFISGTRMRKLAREGENPPDGFMAPKAWKVLTDYYRSLEKN

SEQ ID NO: 305 - protein, 429 aa, Homo sapiens
  Payload ID: 46;
  Gene Symbol: PDPK1;
  Gene Name: 3-phosphoinositide dependent prt kinase 1;
  Uniprot ID:  O15530;
  ENSP ID: ENSP00000268673
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYATRANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 306 - protein, 556 aa, Homo sapiens
  Payload ID: 46;
  Gene Symbol: PDPK1;
  Gene Name: 3-phosphoinositide dependent prt kinase 1;
  Uniprot ID:  O15530;
  ENSP ID: ENSP00000344220
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 307 - protein, 529 aa, Homo sapiens
  Payload ID: 46;
  Gene Symbol: PDPK1;
  Gene Name: 3-phosphoinositide dependent prt kinase 1;
  ENSP ID: ENSP00000373876
MVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPWHQFVENNLILKMGPVDKRKGLFARRRQLLLTEGPHLYYVDPVNKVLKGEIPWSQELRPEAKNFKTFFVHTPNRTYYLMDPSGNAHKWCRKIQEVWRQRYQSHPDAAVQ

SEQ ID NO: 308 - protein, 454 aa, Homo sapiens
  Payload ID: 46;
  Gene Symbol: PDPK1;
  Gene Name: 3-phosphoinositide dependent prt kinase 1;
  Uniprot ID:  O15530;
  ENSP ID: ENSP00000395357
MARTTSQLYDAVPIQSSVVLCSCPSPSMVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGSFDETCTRFYTAEIVSALEYLHGKGIIHRDLKPENILLNEDMHIQITDFGTAKVLSPESKQARANSFVGTAQYVSPELLTEKSACKSSDLWALGCIIYQLVAGLPPFRAGNEYLIFQKIIKLEYDFPEKFFPKARDLVEKLLVLDATKRLGCEEMEGYGPLKAHPFFESVTWENLHQQTPPKLTAYLPAMSEDDEDCYGNYDNLLSQFGCMQVSSSSSSHSLSASDTGLPQRSGSNIEQYIHDLDSNSFELDLQFSEDEKRLLLEKQAGGNPCLTGRII

SEQ ID NO: 309 - protein, 35 aa, Homo sapiens
  Payload ID: 46;
  Gene Symbol: PDPK1;
  Gene Name: 3-phosphoinositide dependent prt kinase 1;
  ENSP ID: ENSP00000455025
MARTTSQLRNRPGLPPGTGSLAPPPAREAEGASSC

SEQ ID NO: 310 - protein, 40 aa, Homo sapiens
  Payload ID: 46;
  Gene Symbol: PDPK1;
  Gene Name: 3-phosphoinositide dependent prt kinase 1;
  ENSP ID: ENSP00000455438
  MOD_RES (1)..(1): Any amino acid
XHHSELETSILYFRRSLSWNMTFQKNSSLRQETSWRNFWF

SEQ ID NO: 311 - protein, 88 aa, Homo sapiens
  Payload ID: 46;
  Gene Symbol: PDPK1;
  Gene Name: 3-phosphoinositide dependent prt kinase 1;
  ENSP ID: ENSP00000455492
MKICTSRSQILEQQKSYPQRANKPGPTHSWEQRSTFLQSCSRRSPPVRDLWALGCIIYQLVAGLPPFRAGNEYLIFQKIIKLEYDFPE

SEQ ID NO: 312 - protein, 149 aa, Homo sapiens
  Payload ID: 46;
  Gene Symbol: PDPK1;
  Gene Name: 3-phosphoinositide dependent prt kinase 1;
  ENSP ID: ENSP00000455551
MVRTQTESSTPPGIPGGSRQGPAMDGTAAEPRPGAGSLQHAQPPPQPRKKRPEDFKFGKILGEGSFSTVVLARELATSREYAIKILEKRHIIKENKVPYVTRERDVMSRLDHPFFVKLYFTFQDDEKLYFGLSYAKNGELLKYIRKIGS

SEQ ID NO: 313 - protein, 55 aa, Homo sapiens
  Payload ID: 46;
  Gene Symbol: PDPK1;
  Gene Name: 3-phosphoinositide dependent prt kinase 1;
  ENSP ID: ENSP00000455684
MARTTSQLILDDSGRENSPFTARPRGIWVLLLPVAVLSVVGSPWEAECAGSPRGK

SEQ ID NO: 314 - protein, 500 aa, Homo sapiens
  Payload ID: 47;
  Gene Symbol: ABAT;
  Gene Name: 4-aminobutyrate aminotransferase;
  Uniprot ID:  P80404;
  ENSP ID: ENSP00000268251
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 315 - protein, 500 aa, Homo sapiens; identical to SEQ ID NO: 314
  Payload ID: 47;
  Gene Symbol: ABAT;
  Gene Name: 4-aminobutyrate aminotransferase;
  Uniprot ID:  P80404;
  ENSP ID: ENSP00000379845

SEQ ID NO: 316 - protein, 500 aa, Homo sapiens; identical to SEQ ID NO: 314
  Payload ID: 47;
  Gene Symbol: ABAT;
  Gene Name: 4-aminobutyrate aminotransferase;
  Uniprot ID:  P80404;
  ENSP ID: ENSP00000411916

SEQ ID NO: 317 - protein, 91 aa, Homo sapiens
  Payload ID: 47;
  Gene Symbol: ABAT;
  Gene Name: 4-aminobutyrate aminotransferase;
  ENSP ID: ENSP00000454415
MASMLLAQRLACSFQHSYRLLVPGSNPGSRHISQAAAKVDVEFDYDGPLMKTEVPGPRSQELMKQLNIIQNAEAVHFFCNYEESRGNYLVD

SEQ ID NO: 318 - protein, 515 aa, Homo sapiens
  Payload ID: 47;
  Gene Symbol: ABAT;
  Gene Name: 4-aminobutyrate aminotransferase;
  ENSP ID: ENSP00000454963
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKALPACDFEKPRSSPTSCLFQVWCWVAVVTNPFVSVPRWSSGITTLTCSSIFSVTS

SEQ ID NO: 319 - protein, 31 aa, Homo sapiens
  Payload ID: 47;
  Gene Symbol: ABAT;
  Gene Name: 4-aminobutyrate aminotransferase;
  ENSP ID: ENSP00000455184
MASMLLAQRLACSFQHSYRLLVPGSRHISQA

SEQ ID NO: 320 - protein, 53 aa, Homo sapiens
  Payload ID: 47;
  Gene Symbol: ABAT;
  Gene Name: 4-aminobutyrate aminotransferase;
  ENSP ID: ENSP00000455198
MASMLLAQRLACSFQHSYRLLVPGVNETAEYNSECRGCAFFLQLRREPRQLPG

SEQ ID NO: 321 - protein, 117 aa, Homo sapiens
  Payload ID: 47;
  Gene Symbol: ABAT;
  Gene Name: 4-aminobutyrate aminotransferase;
  ENSP ID: ENSP00000455502
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIESHCHPGWSAVA

SEQ ID NO: 322 - protein, 65 aa, Homo sapiens
  Payload ID: 47;
  Gene Symbol: ABAT;
  Gene Name: 4-aminobutyrate aminotransferase;
  ENSP ID: ENSP00000456267
MASMLLAQRLACSFQHSYRLLVPGSRHISQAAAKVDVEFDYDGPLMKTEVPGPRSQELMKQLNII

SEQ ID NO: 323 - protein, 515 aa, Homo sapiens
  Payload ID: 47;
  Gene Symbol: ABAT;
  Gene Name: 4-aminobutyrate aminotransferase;
  ENSP ID: ENSP00000456330
MWWQHAKGVPVPQGVMASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 324 - protein, 95 aa, Homo sapiens
  Payload ID: 47;
  Gene Symbol: ABAT;
  Gene Name: 4-aminobutyrate aminotransferase;
  ENSP ID: ENSP00000456392
MQLRGWQHAKGVPVPQGVMASMLLAQRLACSFQHSYRLLVPGSRHISQAAAKVDVEFDYDGPLMKTEVPGPRSQELMKQLNIIQNAEAVHFFCNY

SEQ ID NO: 325 - protein, 85 aa, Homo sapiens
  Payload ID: 48;
  Gene Symbol: HOGA1;
  Gene Name: 4-hydroxy-2-oxoglutarate aldolase 1;
  ENSP ID: ENSP00000359676
  MOD_RES (1)..(1): Any amino acid
XSGGDVTRIGLIVHKTRKQDFQVLAGSAGFLMASYALGAVGGVCALANVLGAQVCQLERLCCTGQWEDAQKLQHRLIEPNAAKIL

SEQ ID NO: 326 - protein, 327 aa, Homo sapiens [sequence omitted]

SEQ ID NO: 327 - protein, 164 aa, Homo sapiens
  Payload ID: 48;
  Gene Symbol: HOGA1;
  Gene Name: 4-hydroxy-2-oxoglutarate aldolase 1;
  Uniprot ID:  Q86XE5;
  ENSP ID: ENSP00000359681
MLGPQVWSSVRQGLSRSLSRNVGVWASGEGKKVDIAGIYPPVTTPFTATAEVDYGKLEENLHKLGTFPFRGAVGGVCALANVLGAQVCQLERLCCTGQWEDAQKLQHRLIEPNAAVTRRFGIPGLKKIMDWFGYYGGPCRAPLQELSPAEEEALRMDFTSNGWL

SEQ ID NO: 328 - protein, 393 aa, Homo sapiens
  Payload ID: 49;
  Gene Symbol: HPD;
  Gene Name: 4-hydroxyphenylpyruvate dioxygenase;
  ENSP ID: ENSP00000289004
MTTYSDKGAKPERGRFLHFHSVTFWVGNAKQATSFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 329 - protein, 354 aa, Homo sapiens
  Payload ID: 49;
  Gene Symbol: HPD;
  Gene Name: 4-hydroxyphenylpyruvate dioxygenase;
  Uniprot ID:  P32754;
  ENSP ID: ENSP00000441677
MGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 330 - protein, 371 aa, Homo sapiens
  Payload ID: 50;
  Gene Symbol: HPDL;
  Gene Name: 4-hydroxyphenylpyruvate dioxygenase-like;
  Uniprot ID:  Q96IR7;
  ENSP ID: ENSP00000335060
MAAPALRLCHIAFHVPAGQPLARNLQRLFGFQPLASREVDGWRQLALRSGDAVFLVNEGAGSGEPLYGLDPRHAVPSATNLCFDVADAGAATRELAALGCSVPVPPVRVRDAQGAATYAVVSSPAGILSLTLLERAGYRGPFLPGFRPVSSAPGPGWVSRVDHLTLACTPGSSPTLLRWFHDCLGFCHLPLSPGEDPELGLEMTAGFGLGGLRLTALQAQPGSIVPTLVLAESLPGATTRQDQVEQFLARHKGPGLQHVGLYTPNIVEATEGVATAGGQFLAPPGAYYQQPGKERQIRAAGHEPHLLARQGILLDGDKGKFLLQVFTKSLFTEDTFFLELIQRQGATGFGQGNIRALWQSVQEQSARSQEA

SEQ ID NO: 331 - protein, 201 aa, Homo sapiens
  Payload ID: 51;
  Gene Symbol: NT5C;
  Gene Name: 5', 3'-nucleotidase, cytosolic;
  Uniprot ID:  Q8TCD5;
  ENSP ID: ENSP00000245552
MARSVRVLVDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKYRWVEQHLGPQFVERIILTRDKTVVLGDLLIDDKDTVRGQEETPSWEHILFTCCHNRHLVLPPTRRRLLSWSDNWREILDSKRGAAQRE

SEQ ID NO: 332 - protein, 182 aa, Homo sapiens
  Payload ID: 51;
  Gene Symbol: NT5C;
  Gene Name: 5', 3'-nucleotidase, cytosolic;
  ENSP ID: ENSP00000461927
MARSVRVLVDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKYRWVEQHLGPQFVERIILTRDKTVVLGDLLIDDKDTVRGGDPKLGAHLVHLLPQSAPGPAPDKETAALLE

SEQ ID NO: 333 - protein, 117 aa, Homo sapiens
  Payload ID: 51;
  Gene Symbol: NT5C;
  Gene Name: 5', 3'-nucleotidase, cytosolic;
  Uniprot ID:  Q8TCD5;
  ENSP ID: ENSP00000462123
MARSVRVLVDMDGVLADFEAGLLRGFRRRFPEEPHVPLEQRRGFLAREQYRALRPDLADKVASVYEAPGFFLDLEPIPGALDAVREMNDLPDPLLKYHHCVGEKVWLPRPYSARGAA

SEQ ID NO: 334 - protein, 39 aa, Homo sapiens
  Payload ID: 51;
  Gene Symbol: NT5C;
  Gene Name: 5', 3'-nucleotidase, cytosolic;
  ENSP ID: ENSP00000462455
MNDLPDTQVFICTSPLLKYHHCVGEKVWLPRPYSARGAA

SEQ ID NO: 335 - protein, 153 aa, Homo sapiens
  Payload ID: 51;
  Gene Symbol: NT5C;
  Gene Name: 5', 3'-nucleotidase, cytosolic;
  ENSP ID: ENSP00000462697
VDMDGVLADFEAGLLRGFRRRFPEEPHVPLEQRRGFLAREQYRALRPDLADKVASVYEAPGFFLDLEPIPGALDAVREMNDLPDTQVFICTSPLLKYHHCVGEKEETPSWEHILFTCCHNRHLVLPPTRRRLLSWSDNWREILDSKRGAAQRE

SEQ ID NO: 336 - protein, 115 aa, Homo sapiens
  Payload ID: 51;
  Gene Symbol: NT5C;
  Gene Name: 5', 3'-nucleotidase, cytosolic;
  ENSP ID: ENSP00000462712
MNDLPDTQVFICTSPLLKYHHCVGEKYRWVEQHLGPQFVERIILTRDKTVVLGDLLIDDKDTVRGQEETPSWEHILFTCCHNRHLVLPPTRRRLLSWSDNWREILDSKRGAAQRE

SEQ ID NO: 337 - protein, 39 aa, Homo sapiens; identical to SEQ ID NO: 334
  Payload ID: 51;
  Gene Symbol: NT5C;
  Gene Name: 5', 3'-nucleotidase, cytosolic;
  ENSP ID: ENSP00000462981

SEQ ID NO: 338 - protein, 87 aa, Homo sapiens
  Payload ID: 51;
  Gene Symbol: NT5C;
  Gene Name: 5', 3'-nucleotidase, cytosolic;
  ENSP ID: ENSP00000463947
  MOD_RES (1)..(1): Any amino acid
XAPGFFLDLEPIPGALDAVREMNDLPDTQVFICTSPLLKYHHCVGEKARRRPQAGSTSCSPAATIGTWSCPRQGDGCSPGVTTGGRS

SEQ ID NO: 339 - protein, 203 aa, Homo sapiens
  Payload ID: 52;
  Gene Symbol: MTHFS;
  Gene Name: 5,10-m> 356ethenyltetrahydrofolate synthetase (5-formyltetrahydrofolate cyclo-ligase);
  Uniprot ID:  P49914;
  ENSP ID: ENSP00000258874
MAAAAVSSAKRSLRGELKQRLRAMSAEERLRQSRVLSQKVIAHSEYQKSKRISIFLSMQDEIETEEIIKDIFQRGKICFIPRYRFQSNHMDMVRIESPEEISLLPKTSWNIPQPGEGDVREEALSTGGLDLIFMPGLGFDKHGNRLGRGKGYYDAYLKRCLQHQEVKPYTLALAFKEQICLQVPVNENDMKVDEVLYEDSSTA

SEQ ID NO: 340 - protein, 39 aa, Homo sapiens
  Payload ID: 52;
  Gene Symbol: MTHFS;
  Gene Name: 5,10-methenyltetrahydrofolate synthetase (5-formyltetrahydrofolate cyclo-ligase);
  ENSP ID: ENSP00000454318
  MOD_RES (1)..(1): Any amino acid
XVKPYTLALAFKEQICLQVPVNENDMKVDEVLYEDSSTA

SEQ ID NO: 341 - protein, 44 aa, Homo sapiens
  Payload ID: 52;
  Gene Symbol: MTHFS;
  Gene Name: 5,10-methenyltetrahydrofolate synthetase (5-formyltetrahydrofolate cyclo-ligase);
  ENSP ID: ENSP00000454626
MAAAAVSSAKRSLRGELKQRLRAMSAEERLRQSRVLSQKVRGRP

SEQ ID NO: 342 - protein, 232 aa, Homo sapiens
  Payload ID: 52;
  Gene Symbol: MTHFS;
  Gene Name: 5,10-methenyltetrahydrofolate synthetase (5-formyltetrahydrofolate cyclo-ligase);
  ENSP ID: ENSP00000489076
MPGTVGTAGHLYHPRQWRCRLRGPGEGPGSGRSGGRAATAPRHRSPNRGGRAGPRGPHEGWVPRARGEVIAHSEYQKSKRISIFLSMQDEIETEEIIKDIFQRGKICFIPRYRFQSNHMDMVRIESPEEISLLPKTSWNIPQPGEGDVREEALSTGGLDLIFMPGLGFDKHGNRLGRGKGYYDAYLKRCLQHQEVKPYTLALAFKEQICLQVPVNENDMKVDEVLYEDSSTA

SEQ ID NO: 343 - protein, 228 aa, Homo sapiens
  Payload ID: 53;
  Gene Symbol: NT5M;
  Gene Name: 5',3'-nucleotidase, mitochondrial;
  Uniprot ID:  Q9NPB1;
  ENSP ID: ENSP00000373674
MIRLGGWCARRLCSAAVPAGRRGAAGGLGLAGGRALRVLVDMDGVLADFEGGFLRKFRARFPDQPFIALEDRRGFWVSEQYGRLRPGLSEKAISIWESKNFFFELEPLPGAVEAVKEMASLQNTDVFICTSPIKMFKYCPYEKYAWVEKYFGPDFLEQIVLTRDKTVVSADLLIDDRPDITGAEPTPSWEHVLFTACHNQHLQLQPPRRRLHSWADDWKAILDSKRPC

SEQ ID NO: 344 - protein, 93 aa, Homo sapiens
  Payload ID: 53;
  Gene Symbol: NT5M;
  Gene Name: 5',3'-nucleotidase, mitochondrial;
  ENSP ID: ENSP00000463674
MIRLGGWCARRLCSAAVPAGRRGAAGGLGLAGGRALRVLVDMDGVLADFEGGFLRKFRARFPDQPFIALEDRRGFWVSEQYGRLRPGLSSWPC

SEQ ID NO: 345 - protein, 113 aa, Homo sapiens
  Payload ID: 53;
  Gene Symbol: NT5M;
  Gene Name: 5',3'-nucleotidase, mitochondrial;
  ENSP ID: ENSP00000464303
MIRLGGWCARRLCSAAVPAGRRGAAGGLGLAGGRALRVLVDMDGVLADFEGGFLRKFRARFPDQPFIALEDRRGFWVSEQYGRLRPGLSVSVPAPPRAGPPSRPEPQTPPLRR

SEQ ID NO: 346 - protein, 51 aa, Homo sapiens
  Payload ID: 53;
  Gene Symbol: NT5M;
  Gene Name: 5',3'-nucleotidase, mitochondrial;
  ENSP ID: ENSP00000467567
  MOD_RES (1)..(1): Any amino acid
XGVLADFEGGFLRKFRARFPDQPFIALEDRRGFWVSEQYGRLRPGLSSWPC

SEQ ID NO: 347 - protein, 234 aa, Homo sapiens
  Payload ID: 53;
  Gene Symbol: NT5M;
  Gene Name: 5',3'-nucleotidase, mitochondrial;
  ENSP ID: ENSP00000481269
MIRLGGWCARRLCSAAVPAGRRGAAGGLGLAGGRALRVLVDMDGVLADFEGGFLRKFRARFPDQPFIALEDRRGFWVSEQYGRLRPGLSEKAISIWESKNFFFELEPLPGAVEAVKEMASLQNTDVFICTSPIKMFKYCPYEKYAWVEKYFGPDFLEQIVLTRDKTVVSADLLIDDRPDITGKWPATGAEPTPSWEHVLFTACHNQHLQLQPPRRRLHSWADDWKAILDSKRPC

SEQ ID NO: 348 - protein, 1706 aa, Homo sapiens
  Payload ID: 54;
  Gene Symbol: XRN1;
  Gene Name: 5'-3' exoribonuclease 1;
  Uniprot ID:  Q8IZH2;
  ENSP ID: ENSP00000264951
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKEKKKLKGQENSLCWTALDKNEGEMITSKDNLEDETEDDDLFETEFRQYKRTYYMTKMGVDVVSDDFLADQAACYVQAIQWILHYYYHGVQSWSWYYPYHYAPFLSDIHNISTLKIHFELGKPFKPFEQLLAVLPAASKNLLPACYQHLMTNEDSPIIEYYPPDFKTDLNGKQQEWEAVVLIPFIDEKRLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTGWDHYGSNYALGAANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 349 - protein, 1694 aa, Homo sapiens
  Payload ID: 54;
  Gene Symbol: XRN1;
  Gene Name: 5'-3' exoribonuclease 1;
  Uniprot ID:  Q8IZH2;
  ENSP ID: ENSP00000376707
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKEKKKLKGQENSLCWTALDKNEGEMITSKDNLEDETEDDDLFETEFRQYKRTYYMTKMGVDVVSDDFLADQAACYVQAIQWILHYYYHGVQSWSWYYPYHYAPFLSDIHNISTLKIHFELGKPFKPFEQLLAVLPAASKNLLPACYQHLMTNEDSPIIEYYPPDFKTDLNGKQQEWEAVVLIPFIDEKRLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMKGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 350 - protein, 459 aa, Homo sapiens
  Payload ID: 54;
  Gene Symbol: XRN1;
  Gene Name: 5'-3' exoribonuclease 1;
  Uniprot ID:  Q8IZH2;
  ENSP ID: ENSP00000418404
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKEKKKLKGQENSLCWTALDKNEGEMITSKDNLEDETEDDDLFETEFRQYKRTYYMTKMGVDVVSEYVFANAFILK

SEQ ID NO: 351 - protein, 63 aa, Homo sapiens
  Payload ID: 54;
  Gene Symbol: XRN1;
  Gene Name: 5'-3' exoribonuclease 1;
  ENSP ID: ENSP00000419219
  MOD_RES (1)..(1): Any amino acid
XEECKSPKAECWSQKMSNKQPNSGIENFLASLNISKENEVQSSHHGEPPSEEHLSPQSFAMKR

SEQ ID NO: 352 - protein, 1160 aa, Homo sapiens
  Payload ID: 54;
  Gene Symbol: XRN1;
  Gene Name: 5'-3' exoribonuclease 1;
  ENSP ID: ENSP00000419683
  MOD_RES (1)..(1): Any amino acid
XTNEDSPIIEYYPPDFKTDLNGKQQEWEAVVLIPFIDERLLEAMETCNHSLKKEERKRNQHSECLMCWYDRDTEFIYPSPWPEKFPAIERCCTRYKIISLDAWRVDINKNKITRIDQKALYFCGFPTLKHIRHKFFLKKSGVQVFQQSSRGENMMLEILVDAESDELTVENVASSVLGKSVFVNWPHLEEARVVAVSDGETKFYLEEPPGTQKLYSGRTAPPSKVVHLGDKEQSNWAKEVQGISEHYLRRKGIIINETSAVVYAQLLTGRKYQINQNGEVRLEKQWSKQVVPFVYQTIVKDIRAFDSRFSNIKTLDDLFPLRSMVFMLGTPYYGCTGEVQDSGDVITEGRIRVIFSIPCEPNLDALIQNQHKYSIKYNPGYVLASRLGVSGYLVSRFTGSIFIGRGSRRNPHGDHKANVGLNLKFNKKNEEVPGYTKKVGSEWMYSSAAEQLLAEYLERAPELFSYIAKNSQEDVFYEDDIWPGENENGAEKVQEIITWLKGHPVSTLSRSSCDLQILDAAIVEKIEEEVEKCKQRKNNKKVRVTVKPHLLYRPLEQQHGVIPDRDAEFCLFDRVVNVRENFSVPVGLRGTIIGIKGANREADVLFEVLFDEEFPGGLTIRCSPGRGYRLPTSALVNLSHGSRSETGNQKLTAIVKPQPAVHQHSSSSSVSSGHLGALNHSPQSLFVPTQVPTKDDDEFCNIWQSLQGSGKMQYFQPTIQEKGAVLPQEISQVNQHHKSGFNDNSVKYQQRKHDPHRKFKEECKSPKAECWSQKMSNKQPNSGIENFLASLNISKENEVQSSHHGEPPSEEHLSPQSFAMKGTRMLKEILKIDGSNTVDHKNEIKQIANEIPVSSNRRDEYGLPSQPKQNKKLASYMNKPHSANEYHNVQSMDNMCWPAPSQIPPVSTPVTELSRICSLVGMPQPDFSFLRMPQTMTVCQVKLSNGLLVHGPQCHSENEAKEKAALFALQQLGSLGMNFPLPSQVFANYPSAVPPGTIPPAFPPPTANIMPSSSHLFGSMPWGPSVPVPGKPFHHTLYSGTMPMAGGIPGGVHNQFIPLQVTKKRVANKKNFENKEAQSSQATPVQTSQPDSSNIVKVSPRESSSASLKSSPIAQPASSFQVETASQGHSISHHKSTPISSSRRKSRKLAVNFGVSKPSE

SEQ ID NO: 353 - protein, 165 aa, Homo sapiens
  Payload ID: 54;
  Gene Symbol: XRN1;
  Gene Name: 5'-3' exoribonuclease 1;
  ENSP ID: ENSP00000420634
MARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINH

SEQ ID NO: 354 - protein, 107 aa, Homo sapiens
  Payload ID: 54;
  Gene Symbol: XRN1;
  Gene Name: 5'-3' exoribonuclease 1;
  ENSP ID: ENSP00000420786
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRLCLD

SEQ ID NO: 355 - protein, 950 aa, Homo sapiens
  Payload ID: 55;
  Gene Symbol: XRN2;
  Gene Name: 5'-3' exoribonuclease 2;
  Uniprot ID:  Q9H0D6;
  ENSP ID: ENSP00000366396
MGVPAFFRWLSRKYPSIIVNCVEEKPKECNGVKIPVDASKPNPNDVEFDNLYLDMNGIIHPCTHPEDKPAPKNEDEMMVAIFEYIDRLFSIVRPRRLLYMAIDGVAPRAKMNQQRSRRFRASKEGMEAAVEKQRVREEILAKGGFLPPEEIKERFDSNCITPGTEFMDNLAKCLRYYIADRLNNDPGWKNLTVILSDASAPGEGEHKIMDYIRRQRAQPNHDPNTHHCLCGADADLIMLGLATHEPNFTIIREEFKPNKPKPCGLCNQFGHEVKDCEGLPREKKGKHDELADSLPCAEGEFIFLRLNVLREYLERELTMASLPFTFDVERSIDDWVFMCFFVGNDFLPHLPSLEIRENAIDRLVNIYKNVVHKTGGYLTESGYVNLQRVQMIMLAVGEVEDSIFKKRKDDEDSFRRRQKEKRKRMKRDQPAFTPSGILTPHALGSRNSPGSQVASNPRQAAYEMRMQNNSSPSISPNTSFTSDGSPSPLGGIKRKAEDSDSEPEPEDNVRLWEAGWKQRYYKNKFDVDAADEKFRRKVVQSYVEGLCWVLRYYYQGCASWKWYYPFHYAPFASDFEGIADMPSDFEKGTKPFKPLEQLMGVFPAASGNFLPPSWRKLMSDPDSSIIDFYPEDFAIDLNGKKYAWQGVALLPFVDERRLRAALEEVYPDLTPEETRRNSLGGDVLFVGKHHPLHDFILELYQTGSTEPVEVPPELCHGIQGKFSLDEEAILPDQIVCSPVPMLRDLTQNTVVSINFKDPQFAEDYIFKAVMLPGARKPAAVLKPSDWEKSSNGRQWKPQLGFNRDRRPVHLDQAAFRTLGHVMPRGSGTGIYSNAAPPPVTYQGNLYRPLLRGQAQIPKLMSNMRPQDSWRGPPPLFQQQRFDRGVGAEPLLPWNRMLQTQNAAFQPNQYQMLAGPGGYPPRRDDRGGRQGYPREGRKYPLPPPSGRYNWN

SEQ ID NO: 356 - protein, 592 aa, Homo sapiens
  Payload ID: 56;
  Gene Symbol: ATIC;
  Gene Name: 5-aminoimidazole-4-carboxamide ribonucleotide formyltransferase/IMP cyclohydrolase;
  Uniprot ID:  P31939;
  ENSP ID: ENSP00000236959
MAPGQLALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 357 - protein, 84 aa, Homo sapiens
  Payload ID: 56;
  Gene Symbol: ATIC;
  Gene Name: 5-aminoimidazole-4-carboxamide ribonucleotide formyltransferase/IMP cyclohydrolase;
  ENSP ID: ENSP00000388675
MAPGQLALFSVSDKTGLVEFARNLTALGLNLVASGGTAKALRDAGLAVRDVSELTGFPEMLGGRVKTLHPAVHAELLPAISIPL

SEQ ID NO: 358 - protein, 43 aa, Homo sapiens
  Payload ID: 56;
  Gene Symbol: ATIC;
  Gene Name: 5-aminoimidazole-4-carboxamide ribonucleotide formyltransferase/IMP cyclohydrolase;
  ENSP ID: ENSP00000394317
MAPGQLGEALAERRGLRPRLRPPTLPPWRRPAGPGTAGAALRD

SEQ ID NO: 359 - protein, 231 aa, Homo sapiens
  Payload ID: 56;
  Gene Symbol: ATIC;
  Gene Name: 5-aminoimidazole-4-carboxamide ribonucleotide formyltransferase/IMP cyclohydrolase;
  ENSP ID: ENSP00000401936
  MOD_RES (1)..(1): Any amino acid
XIFLQVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRVSMELGAFA

SEQ ID NO: 360 - protein, 170 aa, Homo sapiens
  Payload ID: 56;
  Gene Symbol: ATIC;
  Gene Name: 5-aminoimidazole-4-carboxamide ribonucleotide formyltransferase/IMP cyclohydrolase;
  ENSP ID: ENSP00000402393
MLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPIT

SEQ ID NO: 361 - protein, 43 aa, Homo sapiens; identical to SEQ ID NO: 358
  Payload ID: 56;
  Gene Symbol: ATIC;
  Gene Name: 5-aminoimidazole-4-carboxamide ribonucleotide formyltransferase/IMP cyclohydrolase;
  ENSP ID: ENSP00000406792

SEQ ID NO: 362 - protein, 591 aa, Homo sapiens
  Payload ID: 56;
  Gene Symbol: ATIC;
  Gene Name: 5-aminoimidazole-4-carboxamide ribonucleotide formyltransferase/IMP cyclohydrolase;
  Uniprot ID:  P31939;
  ENSP ID: ENSP00000415935
MSSLSALFSVSDKTGLVEFARNLTALGLNLVASGGTAKALRDAGLAVRDVSELTGFPEMLGGRVKTLHPAVHAGILARNIPEDNADMARLDFNLIRVVACNLYPFVKTVASPGVTVEEAVEQIDIGGVTLLRAAAKNHARVTVVCEPEDYVVVSTEMQSSESKDTSLETRRQLALKAFTHTAQYDEAISDYFRKQYSKGVSQMPLRYGMNPHQTPAQLYTLQPKLPITVLNGAPGFINLCDALNAWQLVKELKEALGIPAAASFKHVSPAGAAVGIPLSEDEAKVCMVYDLYKTLTPISAAYARARGADRMSSFGDFVALSDVCDVPTAKIISREVSDGIIAPGYEEEALTILSKKKNGNYCVLQMDQSYKPDENEVRTLFGLHLSQKRNNGVVDKSLFSNVVTKNKDLPESALRDLIVATIAVKYTQSNSVCYAKNGQVIGIGAGQQSRIHCTRLAGDKANYWWLRHHPQVLSMKFKTGVKRAEISNAIDQYVTGTIGEDEDLIKWKALFEEVPELLTEAEKKEWVEKLTEVSISSDAFFPFRDNVDRAKRSGVAYIAAPSGSAADKVVIEACDELGIILAHTNLRLFHH

SEQ ID NO: 363 - protein, 640 aa, Homo sapiens
  Payload ID: 57;
  Gene Symbol: ALAS1;
  Gene Name: 5'-aminolevulinate synthase 1;
  Uniprot ID:  P13196;
  ENSP ID: ENSP00000309259
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 364 - protein, 640 aa, Homo sapiens; identical to SEQ ID NO: 363
  Payload ID: 57;
  Gene Symbol: ALAS1;
  Gene Name: 5'-aminolevulinate synthase 1;
  Uniprot ID:  P13196;
  ENSP ID: ENSP00000378416

SEQ ID NO: 365 - protein, 237 aa, Homo sapiens
  Payload ID: 57;
  Gene Symbol: ALAS1;
  Gene Name: 5'-aminolevulinate synthase 1;
  ENSP ID: ENSP00000417352
  MOD_RES (1)..(1): Any amino acid
XRVPKYIFRHNDVSHLRELLQRSDPSVPKIVAFETVHSMDGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 366 - protein, 640 aa, Homo sapiens; identical to SEQ ID NO: 363
  Payload ID: 57;
  Gene Symbol: ALAS1;
  Gene Name: 5'-aminolevulinate synthase 1;
  Uniprot ID:  P13196;
  ENSP ID: ENSP00000417719

SEQ ID NO: 367 - protein, 640 aa, Homo sapiens; identical to SEQ ID NO: 363
  Payload ID: 57;
  Gene Symbol: ALAS1;
  Gene Name: 5'-aminolevulinate synthase 1;
  Uniprot ID:  P13196;
  ENSP ID: ENSP00000418779

SEQ ID NO: 368 - protein, 117 aa, Homo sapiens
  Payload ID: 57;
  Gene Symbol: ALAS1;
  Gene Name: 5'-aminolevulinate synthase 1;
  ENSP ID: ENSP00000419423
  MOD_RES (1)..(1): Any amino acid
XRRQHQRNVKLMRQMLMDAGLPVVHCPSHIIPVRVADAAKNTEVCDELMSRHNIYVQAINYPTVPRGEELLRIAPTPHHTPQMMNYFLGEYLGSCWCLTEELHKAVFAVFIIEALQR

SEQ ID NO: 369 - protein, 587 aa, Homo sapiens
  Payload ID: 58;
  Gene Symbol: ALAS2;
  Gene Name: 5'-aminolevulinate synthase 2;
  Uniprot ID:  P22557;
  ENSP ID: ENSP00000332369
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 370 - protein, 550 aa, Homo sapiens
  Payload ID: 58;
  Gene Symbol: ALAS2;
  Gene Name: 5'-aminolevulinate synthase 2;
  Uniprot ID:  P22557;
  ENSP ID: ENSP00000337131
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 371 - protein, 574 aa, Homo sapiens
  Payload ID: 58;
  Gene Symbol: ALAS2;
  Gene Name: 5'-aminolevulinate synthase 2;
  Uniprot ID:  P22557;
  ENSP ID: ENSP00000379501
MRGGEVALGWNKKKRLFCEDFRFKMVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 372 - protein, 221 aa, Homo sapiens
  Payload ID: 58;
  Gene Symbol: ALAS2;
  Gene Name: 5'-aminolevulinate synthase 2;
  ENSP ID: ENSP00000407204
  MOD_RES (1)..(1): Any amino acid
XLSFVRPQCRATDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTL

SEQ ID NO: 373 - protein, 232 aa, Homo sapiens
  Payload ID: 59;
  Gene Symbol: AZI2;
  Gene Name: 5-azacytidine induced 2;
  Uniprot ID:  Q9H6S1;
  ENSP ID: ENSP00000335609
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISRVSVAQPGVQWRNHGIA

SEQ ID NO: 374 - protein, 243 aa, Homo sapiens
  Payload ID: 59;
  Gene Symbol: AZI2;
  Gene Name: 5-azacytidine induced 2;
  Uniprot ID:  Q9H6S1;
  ENSP ID: ENSP00000389577
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISRQSICSTAWSAVAQSWDSMNFEDCSLFA

SEQ ID NO: 375 - protein, 243 aa, Homo sapiens; identical to SEQ ID NO: 374
  Payload ID: 59;
  Gene Symbol: AZI2;
  Gene Name: 5-azacytidine induced 2;
  Uniprot ID:  Q9H6S1;
  ENSP ID: ENSP00000391696

SEQ ID NO: 376 - protein, 76 aa, Homo sapiens
  Payload ID: 59;
  Gene Symbol: AZI2;
  Gene Name: 5-azacytidine induced 2;
  ENSP ID: ENSP00000403133
  MOD_RES (1)..(1): Any amino acid
XLKSRDLQKLSISSDNMQHAYWELKREMSNLHLVTQVQAELLRKLKTSTAIKKALSQNRAMRSTAPVLGTHGVKDK

SEQ ID NO: 377 - protein, 215 aa, Homo sapiens
  Payload ID: 59;
  Gene Symbol: AZI2;
  Gene Name: 5-azacytidine induced 2;
  ENSP ID: ENSP00000412820
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSIS

SEQ ID NO: 378 - protein, 95 aa, Homo sapiens
  Payload ID: 59;
  Gene Symbol: AZI2;
  Gene Name: 5-azacytidine induced 2;
  ENSP ID: ENSP00000416380
MDALVEDDICILNHEKAHKRDTVTPVSIYSGDESVASHFALVTAYEDIKKRLKDSEKENSLLKKRIRFLEEKLIARFEEETSSVGREQVNKAYHA

SEQ ID NO: 379 - protein, 392 aa, Homo sapiens
  Payload ID: 59;
  Gene Symbol: AZI2;
  Gene Name: 5-azacytidine induced 2;
  Uniprot ID:  Q9H6S1;
  ENSP ID: ENSP00000419371
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKTKTLPLPNLPPLHYLDQHNQNCLYKN

SEQ ID NO: 380 - protein, 354 aa, Homo sapiens
  Payload ID: 60;
  Gene Symbol: HMCES;
  Gene Name: 5-hydroxymethylcytosine (hmC) binding, ES cell-specific;
  Uniprot ID:  Q96FZ2;
  ENSP ID: ENSP00000372955
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 381 - protein, 354 aa, Homo sapiens; identical to SEQ ID NO: 380
  Payload ID: 60;
  Gene Symbol: HMCES;
  Gene Name: 5-hydroxymethylcytosine (hmC) binding, ES cell-specific;
  Uniprot ID:  Q96FZ2;
  ENSP ID: ENSP00000374385

SEQ ID NO: 382 - protein, 312 aa, Homo sapiens
  Payload ID: 60;
  Gene Symbol: HMCES;
  Gene Name: 5-hydroxymethylcytosine (hmC) binding, ES cell-specific;
  ENSP ID: ENSP00000392966
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGTAGLLEQWLKREKEEEPVAKRPYSQ

SEQ ID NO: 383 - protein, 140 aa, Homo sapiens
  Payload ID: 60;
  Gene Symbol: HMCES;
  Gene Name: 5-hydroxymethylcytosine (hmC) binding, ES cell-specific;
  ENSP ID: ENSP00000421895
MCGRTSCHLPRDVLTRACAYQDRRGQQRLPEWRDPDKYCPSYNKSPQSNSPVLLSRLHFEKSGSIGAADSPENWEKVWDNWRLLTMAGIFDCWEPPEGGDVLYSYTIITVDSCKGLSDIHHRMPAILDGEEAVSKWLDFG

SEQ ID NO: 384 - protein, 282 aa, Homo sapiens
  Payload ID: 60;
  Gene Symbol: HMCES;
  Gene Name: 5-hydroxymethylcytosine (hmC) binding, ES cell-specific;
  ENSP ID: ENSP00000423132
MCGRTSCHLPRDVLTRACAYQDRRGQQRLPEWRDPDKYCPSYNKSPQSNSPVLLSRLHFEKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLVVKKELRASGSSQRMLQWLATKSPKKEDSKTPQKEESDVPQWSSQFLQKSPLPTKRGT

SEQ ID NO: 385 - protein, 233 aa, Homo sapiens
  Payload ID: 60;
  Gene Symbol: HMCES;
  Gene Name: 5-hydroxymethylcytosine (hmC) binding, ES cell-specific;
  ENSP ID: ENSP00000424594
MCGRTSCHLPRDVLTRACAYQDRRGQQRLPEWRDPDKYCPSYNKSPQSNSPVLLSRLHFEKDADSSERIIAPMRWGLVPSWFKESDPSKLQFNTTNCRSDTVMEKRSFKVPLGKGRRCVVLADGFYEWQRCQGTNQRQPYFIYFPQIKTEKSGSIGAADSPENWEKVWDNWRLLTMAGIFDCWEPPEGGDVLYSYTIITVDSCKGLSDIHHRMPAILDGEEAVSKWLDFGEVS

SEQ ID NO: 386 - protein, 354 aa, Homo sapiens; identical to SEQ ID NO: 380
  Payload ID: 60;
  Gene Symbol: HMCES;
  Gene Name: 5-hydroxymethylcytosine (hmC) binding, ES cell-specific;
  Uniprot ID:  Q96FZ2;
  ENSP ID: ENSP00000426215

SEQ ID NO: 387 - protein, 183 aa, Homo sapiens
  Payload ID: 60;
  Gene Symbol: HMCES;
  Gene Name: 5-hydroxymethylcytosine (hmC) binding, ES cell-specific;
  ENSP ID: ENSP00000426276
MCGRTSCHLPRDVLTRACAYQDRRGQQRLPEWRDPDKYCPSYNKSPQSNSPVLLSRLHFEKSGSIGAADSPENWEKVWDNWRLLTMAGIFDCWEPPEGGDVLYSYTIITVDSCKGLSDIHHRMPAILDGEEAVSKWLDFGEVSTQEALKLIHPTENITFHAVSSVVNNSRNNTPECLAPVDLV

SEQ ID NO: 388 - protein, 422 aa, Homo sapiens
  Payload ID: 61;
  Gene Symbol: HTR1A;
  Gene Name: 5-hydroxytryptamine (serotonin) receptor 1A, G prt-coupled;
  Uniprot ID:  P08908;
  ENSP ID: ENSP00000316244
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRRAAALISLTWLIGFLISIPPMLGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTVKTLGIIMGTFILCWLPFFIVALVLPFCESSCHMPTLLGAIINWLGYSNSLLNPVIYAYFNKDFQNAFKKIIKCKFCRQ

SEQ ID NO: 389 - protein, 41 aa, Homo sapiens
  Payload ID: 61;
  Gene Symbol: HTR1A;
  Gene Name: 5-hydroxytryptamine (serotonin) receptor 1A, G prt-coupled;
  ENSP ID: ENSP00000423433
MDVLSPGQGNNTTSPPAPFETGGNTTGISDVTVSYQVITSL

SEQ ID NO: 390 - protein, 390 aa, Homo sapiens
  Payload ID: 62;
  Gene Symbol: HTR1B;
  Gene Name: 5-hydroxytryptamine (serotonin) receptor 1B, G prt-coupled;
  Uniprot ID:  P28222;
  ENSP ID: ENSP00000358963
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 391 - protein, 377 aa, Homo sapiens
  Payload ID: 63;
  Gene Symbol: HTR1D;
  Gene Name: 5-hydroxytryptamine (serotonin) receptor 1D, G prt-coupled;
  Uniprot ID:  P28221;
  ENSP ID: ENSP00000363748
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKATKILGIILGAFIICWLPFFVVSLVLPICRDSCWIHPALFDFFTWLGYLNSLINPIIYTVFNEEFRQAFQKIVPFRKAS

SEQ ID NO: 392 - protein, 365 aa, Homo sapiens
  Payload ID: 64;
  Gene Symbol: HTR1E;
  Gene Name: 5-hydroxytryptamine (serotonin) receptor 1E, G prt-coupled;
  Uniprot ID:  P28566;
  ENSP ID: ENSP00000307766
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 393 - protein, 366 aa, Homo sapiens
  Payload ID: 65;
  Gene Symbol: HTR1F;
  Gene Name: 5-hydroxytryptamine (serotonin) receptor 1F, G prt-coupled;
  Uniprot ID:  P30939;
  ENSP ID: ENSP00000322924
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 394 - protein, 471 aa, Homo sapiens
  Payload ID: 66;
  Gene Symbol: HTR2A;
  Gene Name: 5-hydroxytryptamine (serotonin) receptor 2A, G prt-coupled;
  Uniprot ID:  P28223;
  ENSP ID: ENSP00000367959
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 395 - protein, 471 aa, Homo sapiens; identical to SEQ ID NO: 394
  Payload ID: 66;
  Gene Symbol: HTR2A;
  Gene Name: 5-hydroxytryptamine (serotonin) receptor 2A, G prt-coupled;
  Uniprot ID:  P28223;
  ENSP ID: ENSP00000437737

SEQ ID NO: 396 - protein, 387 aa, Homo sapiens
  Payload ID: 66;
  Gene Symbol: HTR2A;
  Gene Name: 5-hydroxytryptamine (serotonin) receptor 2A, G prt-coupled;
  Uniprot ID:  P28223;
  ENSP ID: ENSP00000441861
MQFLKSAKQKPNYYHIMLVEDQEEGTLHQFNYCERCSESQNNKCISCVDPEDKWYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 397 - protein, 110 aa, Homo sapiens
  Payload ID: 66;
  Gene Symbol: HTR2A;
  Gene Name: 5-hydroxytryptamine (serotonin) receptor 2A, G prt-coupled;
  ENSP ID: ENSP00000482708
FNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGEWH

SEQ ID NO: 398 - protein, 481 aa, Homo sapiens
  Payload ID: 67;
  Gene Symbol: HTR2B;
  Gene Name: 5-hydroxytryptamine (serotonin) receptor 2B, G prt-coupled;
  Uniprot ID:  P41595;
  ENSP ID: ENSP00000258400
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRASKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 399 - protein, 458 aa, Homo sapiens
  Payload ID: 68;
  Gene Symbol: HTR2C;
  Gene Name: 5-hydroxytryptamine (serotonin) receptor 2C, G prt-coupled;
  Uniprot ID:  P28335;
  ENSP ID: ENSP00000276198
MVNLRNAVHSFLVHLIGLLVWQSDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 400 - protein, 248 aa, Homo sapiens
  Payload ID: 68;
  Gene Symbol: HTR2C;
  Gene Name: 5-hydroxytryptamine (serotonin) receptor 2C, G prt-coupled;
  Uniprot ID:  P28335;
  ENSP ID: ENSP00000361018
MVNLRNAVHSFLVHLIGLLVWQSDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRCISSYPCDWTEGRRKGVREQHDVRAQRPKFRSYWVLRSFLHTADDYGDYVLPDHLRSAPTSFDVTARPHRGTAWTKSGFPEVLQEEYGRGRELCKP

SEQ ID NO: 401 - protein, 458 aa, Homo sapiens; identical to SEQ ID NO: 399
  Payload ID: 68;
  Gene Symbol: HTR2C;
  Gene Name: 5-hydroxytryptamine (serotonin) receptor 2C, G prt-coupled;
  Uniprot ID:  P28335;
  ENSP ID: ENSP00000361019

SEQ ID NO: 402 - protein, 463 aa, Homo sapiens
  Payload ID: 69;
  Gene Symbol: HTR3A;
  Gene Name: 5-hydroxytryptamine (serotonin) receptor 3A, ionotropic;
  Uniprot ID:  P46098;
  ENSP ID: ENSP00000299961
MHRSFLQARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 403 - protein, 516 aa, Homo sapiens
  Payload ID: 69;
  Gene Symbol: HTR3A;
  Gene Name: 5-hydroxytryptamine (serotonin) receptor 3A, ionotropic;
  Uniprot ID:  P46098;
  ENSP ID: ENSP00000347754
MLGKLAMLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 404 - protein, 484 aa, Homo sapiens
  Payload ID: 69;
  Gene Symbol: HTR3A;
  Gene Name: 5-hydroxytryptamine (serotonin) receptor 3A, ionotropic;
  Uniprot ID:  P46098;
  ENSP ID: ENSP00000364648
MLGKLAMLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 405 - protein, 238 aa, Homo sapiens
  Payload ID: 69;
  Gene Symbol: HTR3A;
  Gene Name: 5-hydroxytryptamine (serotonin) receptor 3A, ionotropic;
  ENSP ID: ENSP00000423653
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTSGHPPAAPLLCGQPATAQHLPHGHGHRGLLPAPQQWREGLFQDYTPPGLLGLPDHRF

SEQ ID NO: 406 - protein, 478 aa, Homo sapiens
  Payload ID: 69;
  Gene Symbol: HTR3A;
  Gene Name: 5-hydroxytryptamine (serotonin) receptor 3A, ionotropic;
  Uniprot ID:  P46098;
  ENSP ID: ENSP00000424189
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 407 - protein, 510 aa, Homo sapiens
  Payload ID: 69;
  Gene Symbol: HTR3A;
  Gene Name: 5-hydroxytryptamine (serotonin) receptor 3A, ionotropic;
  Uniprot ID:  P46098;
  ENSP ID: ENSP00000424776
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 408 - protein, 441 aa, Homo sapiens
  Payload ID: 70;
  Gene Symbol: HTR3B;
  Gene Name: 5-hydroxytryptamine (serotonin) receptor 3B, ionotropic;
  Uniprot ID:  O95264;
  ENSP ID: ENSP00000260191
MLSSVMAPLWACILVAAGILATDTHHPQDSALYHLSKQLLQKYHKEVRPVYNWTKATTVYLDLFVHAILDVDAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNVVMRRHPLVYVVSLLIPSIFLMLVDLGSFYLPPNCRARIVFKTSVLVGYTVFRVNMSNQVPRSVGSTPLIGHFFTICMAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 409 - protein, 175 aa, Homo sapiens
  Payload ID: 70;
  Gene Symbol: HTR3B;
  Gene Name: 5-hydroxytryptamine (serotonin) receptor 3B, ionotropic;
  ENSP ID: ENSP00000440894
  MOD_RES (1)..(1): Any amino acid
XAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNGTSSPSAWPSWFSA

SEQ ID NO: 410 - protein, 430 aa, Homo sapiens
  Payload ID: 70;
  Gene Symbol: HTR3B;
  Gene Name: 5-hydroxytryptamine (serotonin) receptor 3B, ionotropic;
  Uniprot ID:  O95264;
  ENSP ID: ENSP00000443118
MIVYFPGILATDTHHPQDSALYHLSKQLLQKYHKEVRPVYNWTKATTVYLDLFVHAILDVDAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNVVMRRHPLVYVVSLLIPSIFLMLVDLGSFYLPPNCRARIVFKTSVLVGYTVFRVNMSNQVPRSVGSTPLIGHFFTICMAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 411 - protein, 447 aa, Homo sapiens
  Payload ID: 71;
  Gene Symbol: HTR3C;
  Gene Name: 5-hydroxytryptamine (serotonin) receptor 3C, ionotropic;
  Uniprot ID:  Q8WXA8;
  ENSP ID: ENSP00000322617
MEGGWPARQSALLCLTVSLLLQGRGDAFTINCSGFDQHGVDPAVFQAVFDRKAFRPFTNYSIPTRVNISFTLSAILGVDAQLQLLTSFLWMDLVWDNPFINWNPKECVGINKLTVLAENLWLPDIFIVESMDVDQTPSGLTAYISSEGRIKYDKPMRVTSICNLDIFYFPFDQQNCTFTFSSFLYTVDSMLLGMDKEVWEITDTSRKVIQTQGEWELLGINKATPKMSMGNNLYDQIMFYVAIRRRPSLYIINLLVPSSFLVAIDALSFYLPAESENRAPFKITLLLGYNVFLLMMNDLLPASGTPLISVYFALCLSLMVVSLLETVFITYLLHVATTQPPPMPRWLHSLLLHCTSPGRCCPTAPQKGNKGLGLTLTHLPGPKEPGELAGKKLGPRETEPDGGSGWTKTQLMELWVQFSHAMDTLLFRLYLLFMASSILTVIVLWNT

SEQ ID NO: 412 - protein, 279 aa, Homo sapiens
  Payload ID: 72;
  Gene Symbol: HTR3D;
  Gene Name: 5-hydroxytryptamine (serotonin) receptor 3D, ionotropic;
  ENSP ID: ENSP00000334315
MASMSIVKATSNTISQCGWSASANWTPSISPSMDRGERSPSALSPTQVAIRRRCRPSPYVVNFLVPSGILIAIDALSFYLPLESGNCAPFKMTVLLGYSVFLLMMNDLLPATSTSSHASLVRPHPSRDQKRGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 413 - protein, 454 aa, Homo sapiens
  Payload ID: 72;
  Gene Symbol: HTR3D;
  Gene Name: 5-hydroxytryptamine (serotonin) receptor 3D, ionotropic;
  Uniprot ID:  Q70Z44;
  ENSP ID: ENSP00000371929
MQKHSPGPPALALLSQSLLTTGNGDTLIINCPGFGQHRVDPAAFQAVFDRKAIGPVTNYSVATHVNISFTLSAIWNCYSRIHTFNCHHARPWHNQFVQWNPDECGGIKKSGMATENLWLSDVFIEESVDQTPAGLMASMSIVKATSNTISQCGWSASANWTPSISPSMDRARAWRRMSRSFQIHHRTSFRTRREWVLLGIQKRTIKVTVATNQYEQAIFHVAIRRRCRPSPYVVNFLVPSGILIAIDALSFYLPLESGNCAPFKMTVLLGYSVFLLMMNDLLPATSTSSHASLVAPLALMQTPLPAGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 414 - protein, 233 aa, Homo sapiens
  Payload ID: 72;
  Gene Symbol: HTR3D;
  Gene Name: 5-hydroxytryptamine (serotonin) receptor 3D, ionotropic;
  Uniprot ID:  Q70Z44;
  ENSP ID: ENSP00000389268
MVAIRRRCRPSPYVVNFLVPSGILIAIDALSFYLPLESGNCAPFKMTVLLGYSVFLLMMNDLLPATSTSSHASLVRPHPSRDQKRGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 415 - protein, 404 aa, Homo sapiens
  Payload ID: 72;
  Gene Symbol: HTR3D;
  Gene Name: 5-hydroxytryptamine (serotonin) receptor 3D, ionotropic;
  Uniprot ID:  Q70Z44;
  ENSP ID: ENSP00000405409
MERGWFHGKGFLLGFILHLLLQDSHLQLVTSFLWLNMWNPDECGGIKKSGMATENLWLSDVFIEESVDQTPAGLMASMSIVKATSNTISQCGWSASANWTPSISPSMDRGERSPSALSPTQVTRAWRRMSRSFQIHHRTSFRTRREWVLLGIQKRTIKVTVATNQYEQAIFHVAIRRRCRPSPYVVNFLVPSGILIAIDALSFYLPLESGNCAPFKMTVLLGYSVFLLMMNDLLPATSTSSHASLVRPHPSRDQKRGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 416 - protein, 471 aa, Homo sapiens
  Payload ID: 73;
  Gene Symbol: HTR3E;
  Gene Name: 5-hydroxytryptamine (serotonin) receptor 3E, ionotropic;
  Uniprot ID:  A5X5Y0;
  ENSP ID: ENSP00000335511
MLAFILSRATPRPALGPLSYREHRVALLHLTHSMSTTGRGVTFTINCSGFGQHGADPTALNSVFNRKPFRPVTNISVPTQVNISFAMSAILDVNEQLHLLSSFLWLEMVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 417 - protein, 158 aa, Homo sapiens
  Payload ID: 73;
  Gene Symbol: HTR3E;
  Gene Name: 5-hydroxytryptamine (serotonin) receptor 3E, ionotropic;
  ENSP ID: ENSP00000391254
MSAILDVNEQLHLLSSFLWLEMVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSR

SEQ ID NO: 418 - protein, 456 aa, Homo sapiens
  Payload ID: 73;
  Gene Symbol: HTR3E;
  Gene Name: 5-hydroxytryptamine (serotonin) receptor 3E, ionotropic;
  Uniprot ID:  A5X5Y0;
  ENSP ID: ENSP00000395833
MLAFILSRATPRPALGPLSYREHRVALLHLTHSMSTTGRGVTFTINCSGFGQHGADPTALNSVFNRKPFRPVTNISVPTQVNISFAMSAILDVVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 419 - protein, 456 aa, Homo sapiens
  Payload ID: 73;
  Gene Symbol: HTR3E;
  Gene Name: 5-hydroxytryptamine (serotonin) receptor 3E, ionotropic;
  Uniprot ID:  A5X5Y0;
  ENSP ID: ENSP00000401444
MEGSWFHRKRFSFYLLLGFLLQGRGVTFTINCSGFGQHGADPTALNSVFNRKPFRPVTNISVPTQVNISFAMSAILDVNEQLHLLSSFLWLEMVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 420 - protein, 441 aa, Homo sapiens
  Payload ID: 73;
  Gene Symbol: HTR3E;
  Gene Name: 5-hydroxytryptamine (serotonin) receptor 3E, ionotropic;
  Uniprot ID:  A5X5Y0;
  ENSP ID: ENSP00000401900
MEGSWFHRKRFSFYLLLGFLLQGRGVTFTINCSGFGQHGADPTALNSVFNRKPFRPVTNISVPTQVNISFAMSAILDVVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 421 - protein, 482 aa, Homo sapiens
  Payload ID: 73;
  Gene Symbol: HTR3E;
  Gene Name: 5-hydroxytryptamine (serotonin) receptor 3E, ionotropic;
  Uniprot ID:  A5X5Y0;
  ENSP ID: ENSP00000406050
MLAFILSRATPRPALGPLSYREHRVALLHLTHSMSTTGRGVTFTINCSGFGQHGADPTALNSVFNRKPFRPVTNISVPTQVNISFAMSAILDVVWDNPFISWNPEECEGITKMSMAAKNLWLPDIFIIELCVSRAGQREVPSPGSHRDHSLPLGPLMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 422 - protein, 428 aa, Homo sapiens
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000353915
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRTDFLFDRDILARYWTKPARAGPFSGTLSIRCLTARKPVLGDAVECGGQWESQCHPPATSPLVAAQPSDT

SEQ ID NO: 423 - protein, 428 aa, Homo sapiens; identical to SEQ ID NO: 422
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000355037

SEQ ID NO: 424 - protein, 388 aa, Homo sapiens
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000367120
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 425 - protein, 411 aa, Homo sapiens
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000427913
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSSGTETDRKKLWNKEEKIDQTIQMPKRKRKKKASLSYEDLILLGRKSCFREGK

SEQ ID NO: 426 - protein, 387 aa, Homo sapiens
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000428320
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRYTVLHRGHHQELEKLPIHNDPESLESCF

SEQ ID NO: 427 - protein, 87 aa, Homo sapiens
  Payload ID: 74;
  Gene Symbol: HTR4;
  Gene Name: 5-hydroxytryptamine (serotonin) receptor 4, G prt-coupled;
  ENSP ID: ENSP00000429634
MCHLVRLSHASPFSLLHFPGFIPRRRMEETRAKLVCLQSSCRAWRDLSSMIIQGELDQVLLRPAAWMLYIQKDPVGIEIQLTHAYFL

SEQ ID NO: 428 - protein, 371 aa, Homo sapiens
  Payload ID: 74;
  Gene Symbol: HTR4;
  Gene Name: 5-hydroxytryptamine (serotonin) receptor 4, G prt-coupled;
  ENSP ID: ENSP00000430451
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRAVRGNRNSTSSA

SEQ ID NO: 429 - protein, 378 aa, Homo sapiens
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000430874
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLSGCSPVSSFLLLFCNRPVPV

SEQ ID NO: 430 - protein, 378 aa, Homo sapiens; identical to SEQ ID NO: 429
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000430979

SEQ ID NO: 431 - protein, 360 aa, Homo sapiens
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000435904
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRF

SEQ ID NO: 432 - protein, 388 aa, Homo sapiens; identical to SEQ ID NO: 424
  Payload ID: 74;
  Gene Symbol: HTR4;
  Gene Name: 5-hydroxytryptamine (serotonin) receptor 4, G prt-coupled;
  Uniprot ID:  Q13639;
  ENSP ID: ENSP00000485747

SEQ ID NO: 433 - protein, 357 aa, Homo sapiens
  Payload ID: 75;
  Gene Symbol: HTR5A;
  Gene Name: 5-hydroxytryptamine (serotonin) receptor 5A, G prt-coupled;
  Uniprot ID:  P47898;
  ENSP ID: ENSP00000287907
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAALMVGILIGVFVLCWIPFFLTELISPLCSCDIPAIWKSIFLWLGYSNSFFNPLIYTAFNKNYNSAFKNFFSRQH

SEQ ID NO: 434 - protein, 440 aa, Homo sapiens
  Payload ID: 76;
  Gene Symbol: HTR6;
  Gene Name: 5-hydroxytryptamine (serotonin) receptor 6, G prt-coupled;
  Uniprot ID:  P50406;
  ENSP ID: ENSP00000289753
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 435 - protein, 445 aa, Homo sapiens
  Payload ID: 77;
  Gene Symbol: HTR7;
  Gene Name: 5-hydroxytryptamine (serotonin) receptor 7, adenylate cyclase-coupled;
  Uniprot ID:  P34969;
  ENSP ID: ENSP00000277874
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLQNADYCRKKGHDS

SEQ ID NO: 436 - protein, 479 aa, Homo sapiens
  Payload ID: 77;
  Gene Symbol: HTR7;
  Gene Name: 5-hydroxytryptamine (serotonin) receptor 7, adenylate cyclase-coupled;
  Uniprot ID:  P34969;
  ENSP ID: ENSP00000337949
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLRACTRRVLLRPEKRPPVSVWVLQSPDHHNWLADKMLTTVEKKVMIHD

SEQ ID NO: 437 - protein, 432 aa, Homo sapiens
  Payload ID: 77;
  Gene Symbol: HTR7;
  Gene Name: 5-hydroxytryptamine (serotonin) receptor 7, adenylate cyclase-coupled;
  Uniprot ID:  P34969;
  ENSP ID: ENSP00000360784
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVL

SEQ ID NO: 438 - protein, 819 aa, Homo sapiens
  Payload ID: 78;
  Gene Symbol: MTR;
  Gene Name: 5-methyltetrahydrofolate-homocysteine methyltransferase;
  ENSP ID: ENSP00000355535
GMLDGPSAMTRFCNLIASEPDIAKVPLCIDSSNFAVIEAGLKCCQGKCIVNSISLKEGEATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 439 - protein, 1265 aa, Homo sapiens
  Payload ID: 78;
  Gene Symbol: MTR;
  Gene Name: 5-methyltetrahydrofolate-homocysteine methyltransferase;
  Uniprot ID:  Q99707;
  ENSP ID: ENSP00000355536
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 440 - protein, 1214 aa, Homo sapiens
  Payload ID: 78;
  Gene Symbol: MTR;
  Gene Name: 5-methyltetrahydrofolate-homocysteine methyltransferase;
  Uniprot ID:  Q99707;
  ENSP ID: ENSP00000441845
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 441 - protein, 725 aa, Homo sapiens
  Payload ID: 79;
  Gene Symbol: MTRR;
  Gene Name: 5-methyltetrahydrofolate-homocysteine methyltransferase reductase;
  Uniprot ID:  Q9UBK8;
  ENSP ID: ENSP00000264668
MGAASVRAGARLVEVALCSFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 442 - protein, 698 aa, Homo sapiens
  Payload ID: 79;
  Gene Symbol: MTRR;
  Gene Name: 5-methyltetrahydrofolate-homocysteine methyltransferase reductase;
  Uniprot ID:  Q9UBK8;
  ENSP ID: ENSP00000402510
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGATLPQHIPAGCSLQFIFTWCLEIRAIPKKAFLRALVDYTSDSAEKRRLQELCSKQGAADYSRFVRDACACLLDLLLAFPSCQPPLSLLLEHLPKLQPRPYSCASSSLFHPGKLHFVFNIVEFLSTATTEVLRKGVCTGWLALLVASVLQPNIHASHEDSGKALAPKISISPRTTNSFHLPDDPSIPIIMVGPGTGIAPFIGFLQHREKLQEQHPDGNFGAMWLFFGCRHKDRDYLFRKELRHFLKHGILTHLKVSFSRDAPVGEEEAPAKYVQDNIQLHGQQVARILLQENGHIYVCGDAKNMAKDVHDALVQIISKEVGVEKLEAMKTLATLKEEKRYLQDIWS

SEQ ID NO: 443 - protein, 112 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000421318
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIID

SEQ ID NO: 444 - protein, 372 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000421991
  MOD_RES (1)..(1): Any amino acid
XFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRSVPPLSQASLNIPGLPPEYLQVHLQESLGQEESQVSVTSADPVFQVPISKAVQLTTNDAIKTTLLVELDISNTDFSYQPGDAFSVICPNSDSEVQSLLQRLQLEDKREHCVLLKIKADTKKKGIFASPCGLYQ

SEQ ID NO: 445 - protein, 115 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000423139
  MOD_RES (1)..(1): Any amino acid
XVRAGARLVEVALCSFTVTCLEVMRRFLLLYATQQGQAKAIAEEICEQAVVHGFSADLHCISESDKYDLKTETAPLVVVVSTTGTGDPPDTARKFVKEIQNQTLPVDFFAHLRSR

SEQ ID NO: 446 - protein, 160 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000423863
  MOD_RES (1)..(1): Any amino acid
XVRAGARLVEVALCRFVPGWRGVGLGDSEYTYFCNGGKIIDKRLQELGARHFYDTGHADDCVGLELVVEPWIAGLWPALRKHFRSSRGQEEISGALPVASPASSRTDLVKSELLHIESQVELLRFDDSGRKDSEVLKQNAVNSNQSNVVIEDFESSLTRS

SEQ ID NO: 447 - protein, 156 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000424599
MRRFLLLYATQQGQAKAIAEEICEQAVVHGFSADLHCISESDKYDLKTETAPLVVVVSTTGTGDPPDTARKFVKEIQNQTLPVDFFAHLRYGLLGLGDSEYTYFCNGGKIIDKRLQELGARHFYDTGHADDCVGLELVVEPWIAGLWPALRKHFRS

SEQ ID NO: 448 - protein, 46 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000424644
MRRFLLLYATQQGQAKAIAEEICEQAVVHGFSADLHCISESDKCEK

SEQ ID NO: 449 - protein, 81 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000424719
  MOD_RES (1)..(1): Any amino acid
XVRAGARLVEVALCSFTVTCLEVMRRFLLLYATQQGQAKAIAEEICEQAVVHGFSADLHCISESDKVSVIQNTPTFAMGGR

SEQ ID NO: 450 - protein, 58 aa, Homo sapiens
  Payload ID: 79;
  Gene Symbol: MTRR;
  Gene Name: 5-methyltetrahydrofolate-homocysteine methyltransferase reductase;
  Uniprot ID:  Q9UBK8;
  ENSP ID: ENSP00000426132
MRRFLLLYATQQGQAKAIAEEICEQAVVHGFSADLHCISESDKVSVIQNTPTFAMGGR

SEQ ID NO: 451 - protein, 92 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000426710
MRRFLLLYATQQGQAKAIAEEICEQAVVHGFSADLHCISESDKYDLKTETAPLVVVVSTTGTGDPPDTARKFVKEIQNQTLPVDFFAHLRSR

SEQ ID NO: 452 - protein, 58 aa, Homo sapiens; identical to SEQ ID NO: 450
  Payload ID: 79;
  Gene Symbol: MTRR;
  Gene Name: 5-methyltetrahydrofolate-homocysteine methyltransferase reductase;
  Uniprot ID:  Q9UBK8;
  ENSP ID: ENSP00000427200

SEQ ID NO: 453 - protein, 41 aa, Homo sapiens
  Payload ID: 79;
  Gene Symbol: MTRR;
  Gene Name: 5-methyltetrahydrofolate-homocysteine methyltransferase reductase;
  ENSP ID: ENSP00000427416
MRRFLLLYATQQGQAKAIAEEICEQAVVHGFSADLHCISES

SEQ ID NO: 454 - protein, 455 aa, Homo sapiens
  Payload ID: 80;
  Gene Symbol: NT5DC1;
  Gene Name: 5'-nucleotidase domain containing 1;
  Uniprot ID:  Q5TFE4;
  ENSP ID: ENSP00000326858
MAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKENCGIYFPEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKVVYFGDSMHSDIFPARHYSNWETVLILEELRGDEGTRSQRPEESEPLEKKGKYEGPKAKPLNTSSKKWGSFFIDSVLGLENTEDSLVYTWSCKRISTYSTIAIPSIEAIAELPLDYKFTRFSSSNSKTAGYYPNPPLVLSSDETLISK

SEQ ID NO: 455 - protein, 195 aa, Homo sapiens
  Payload ID: 80;
  Gene Symbol: NT5DC1;
  Gene Name: 5'-nucleotidase domain containing 1;
  ENSP ID: ENSP00000393578
MAQHFSLAACDVVGFDLDHTLCRYNLPESAPLIYNSFAQFLVKEKGYDKELLNVTPEDWDFCCKGLALDLEDGNFLKLANNGTVLRASHGTKMMTPEVLAEAYGKKEWKHFLSDTGMACRSGKYYFYDNYFDLPGALLCARVVDYLTKLNNGQKTFDFWKDIVAAIQHNYKMSAFKVRRLATSLLQDISTSFILI

SEQ ID NO: 456 - protein, 141 aa, Homo sapiens
  Payload ID: 80;
  Gene Symbol: NT5DC1;
  Gene Name: 5'-nucleotidase domain containing 1;
  ENSP ID: ENSP00000433238
  MOD_RES (1)..(1): Any amino acid
XNYKMSAFKEIKRDPGRYLHSCPESVKKWLRQLKNAGKILLLITSSHSDYCRLLCEYILGNDFTDLFDIVITNALKPGFFSHLPSQRPFRTLENDEEQEALPSLDKPGWYSQGNAVHLYELLKKMTGKPEPKKIFTRISVS

SEQ ID NO: 457 - protein, 520 aa, Homo sapiens
  Payload ID: 81;
  Gene Symbol: NT5DC2;
  Gene Name: 5'-nucleotidase domain containing 2;
  Uniprot ID:  Q9H857;
  ENSP ID: ENSP00000302468
MRVESGSAQERGILLESLSTLLEKTTASHEGRAPGNRELTDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 458 - protein, 557 aa, Homo sapiens
  Payload ID: 81;
  Gene Symbol: NT5DC2;
  Gene Name: 5'-nucleotidase domain containing 2;
  Uniprot ID:  Q9H857;
  ENSP ID: ENSP00000406933
MAGAGLRAAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKYPEGIRKYDYNPSFAIRGLHYDIQKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 459 - protein, 258 aa, Homo sapiens
  Payload ID: 81;
  Gene Symbol: NT5DC2;
  Gene Name: 5'-nucleotidase domain containing 2;
  ENSP ID: ENSP00000417269
  MOD_RES (1)..(1): Any amino acid
XQDMRRLVHDLLPPEVCSLLNPAAIYANNEISLRDVEVYGFDYDYTLAQYADALHPEIFSTARDILIEHYKSLLMKIDAFHYVQLGTAYRGLQPVPDEEGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQ

SEQ ID NO: 460 - protein, 85 aa, Homo sapiens
  Payload ID: 81;
  Gene Symbol: NT5DC2;
  Gene Name: 5'-nucleotidase domain containing 2;
  ENSP ID: ENSP00000418583
MKIDAFHYVQLGTAYRGLQPVPDEEGPSIKQFMDIFSLPEMALLSCVVDYFLGHSLEFDQAHLYKDVTDAIRDVHVKGLMYQWIE

SEQ ID NO: 461 - protein, 194 aa, Homo sapiens
  Payload ID: 81;
  Gene Symbol: NT5DC2;
  Gene Name: 5'-nucleotidase domain containing 2;
  ENSP ID: ENSP00000418780
WRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELSCLLNYRVDFTFYPRRTPLQHEAPLWMDQLCTGCMKTPFLGDMAHIR

SEQ ID NO: 462 - protein, 532 aa, Homo sapiens
  Payload ID: 81;
  Gene Symbol: NT5DC2;
  Gene Name: 5'-nucleotidase domain containing 2;
  Uniprot ID:  Q9H857;
  ENSP ID: ENSP00000419547
MAGAGLRAAARRWLLCGGHGGPRAASSSPSCPGCGPPGPGAHCPGVPRSAPAQAPTSGADLSAHLWARYQDMRRLVHDLLPPEVCSLLNPAAIYANNEISLRDVEVYGFDYDYTLAQYADALHPEIFSTARDILIEHYKSLLMKIDAFHYVQLGTAYRGLQPVPDEEVIELYGGTQHIPLYQMSGFYGKGPSIKQFMDIFSLPEMALLSCVVDYFLGHSLEFDQAHLYKDVTDAIRDVHVKGLMYQWIEQDMEKYILRGDETFAVLSRLVAHGKQLFLITNSPFSFVDKGMRHMVGPDWRQLFDVVIVQADKPSFFTDRRKPFRKLDEKGSLQWDRITRLEKGKIYRQGNLFDFLRLTEWRGPRVLYFGDHLYSDLADLMLRHGWRTGAIIPELEREIRIINTEQYMHSLTWQQALTGLLERMQTYQDAESRQVLAAWMKERQELRCITKALFNAQFGSIFRTFHNPTYFSRRLVRFSDLYMASLSCLLNYRVDFTFYPRRTPLQHEAPLWMDQLCTGCMKTPFLGDMAHIR

SEQ ID NO: 463 - protein, 111 aa, Homo sapiens
  Payload ID: 81;
  Gene Symbol: NT5DC2;
  Gene Name: 5'-nucleotidase domain containing 2;
  ENSP ID: ENSP00000419774
MRVESGSAQERGILLESLSTLLEKTTASHEGRAPGNRELTGQCGQLPRSEPSGRSDRGPQPCSARPSHLVSGRRLPCRPLGLPQRGPGTGKRGKGSLFVRPTSCPPRSAVS

SEQ ID NO: 464 - protein, 548 aa, Homo sapiens
  Payload ID: 82;
  Gene Symbol: NT5DC3;
  Gene Name: 5'-nucleotidase domain containing 3;
  Uniprot ID:  Q86UY8;
  ENSP ID: ENSP00000376615
MTMAAAAVVARGAGARAATAAALRGGCGTAARGRPCAGPARPLCTAPGTAPDMKRYLWERYREAKRSTEELVPSIMSNLLNPDAIFSNNEMSLSDIEIYGFDYDYTLVFYSKHLHTLIFNAARDLLINEHRYPAEIRKYEYDPNFAIRGLHYDVQRAVLMKIDAFHYIQLGTVYRGLSVVPDEEVIEMYEGSHVPLEQMSDFYGKSSHGNTMKQFMDIFSLPEMTLLSCVNEYFLKNNIDYEPVHLYKDVKDSIRDVHIKGIMYRAIEADIEKYICYAEQTRAVLAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLADLTLKHGWRTGAIIPELRSELKIMNTEQYIQTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 465 - protein, 135 aa, Homo sapiens
  Payload ID: 82;
  Gene Symbol: NT5DC3;
  Gene Name: 5'-nucleotidase domain containing 3;
  ENSP ID: ENSP00000399171
  MOD_RES (1)..(1): Any amino acid
XAKLADHGKKMFLITNSPSSFVDKGMSYIVGKDWRDLFDVVIVQAEKPNFFNDKRRPFRKMNEKGVLLWDKIHKLQKGQIYKQGNLYEFLKLTGWRGSRVLYFGDHIYSDLATMVNDSRPSVSAGVVTHGNYFQN

SEQ ID NO: 466 - protein, 122 aa, Homo sapiens
  Payload ID: 82;
  Gene Symbol: NT5DC3;
  Gene Name: 5'-nucleotidase domain containing 3;
  ENSP ID: ENSP00000413657
  MOD_RES (1)..(1): Any amino acid
XTMTWLQTLTGLLEQMQVHRDAESQLVLQEWKKERKEMREMTKSFFNAQFGSLFRTDQNPTYFLRRLSRFADIYMASLSCLLNYDVSHTFYPRRTPLQHELPAWSERPPTFGTPLLQEAQAK

SEQ ID NO: 467 - protein, 428 aa, Homo sapiens
  Payload ID: 83;
  Gene Symbol: NT5DC4;
  Gene Name: 5'-nucleotidase domain containing 4;
  Uniprot ID:  Q86YG4;
  ENSP ID: ENSP00000330247
MPAWIFVNRSLALGKIRCFGFDMDYTLAAYKSPAYEALTFELLLERLVCIGYPHEILRYTYDPTFPTRRLVFDELYGNLLKVDAHGNVLLGAYGFTFLSEAEIWSFYPSKFIQRDDLQCFYILNMLFNLPETYLYACLVDFFSGCSRYTNCDTGYQHGNLFMSFRSLFQDVTDAMNNIHQSGCLKKTLEDLEKYVKKDPRLPILLGKMKEVGKVFLATNSSYNYTNAIMTYLFSISEAEASGRPWRSYFDLIVVDTQKPHFFAEGLVLRQVNTDSGKLHVGTYTGPHQHCAVYSGGSSDMVCELLGVRGMDILYIGDHIFGDILKSKKRQGWRTCLVVPELSWELDIWAQEKERLEELKRLDTHLADIYQHMDGSSCELQVINFTKREIQMPHESVVEQEQANLDPASCLLSCNQRSLPAKSCLSSAI

SEQ ID NO: 468 - protein, 368 aa, Homo sapiens
  Payload ID: 84;
  Gene Symbol: NT5C1A;
  Gene Name: 5'-nucleotidase, cytosolic IA;
  Uniprot ID:  Q9BXI3;
  ENSP ID: ENSP00000235628
MEPGQPREPQEPREPGPGAETAAAPVWEEAKIFYDNLAPKKKPKSPKPQNAVTIAVSSRALFRMDEEQQIYTEQGVEEYVRYQLEHENEPFSPGPAFPFVKALEAVNRRLRELYPDSEDVFDIVLMTNNHAQVGVRLINSINHYDLFIERFCMTGGNSPICYLKAYHTNLYLSADAEKVREAIDEGIAAATIFSPSRDVVVSQSQLRVAFDGDAVLFSDESERIVKAHGLDRFFEHEKAHENKPLAQGPLKGFLEALGRLQKKFYSKGLRLECPIRTYLVTARSAASSGARALKTLRSWGLETDEALFLAGAPKGPLLEKIRPHIFFDDQMFHVAGAQEMGTVAAHVPYGVAQTPRRTAPAKQAPSAQ

SEQ ID NO: 469 - protein, 550 aa, Homo sapiens
  Payload ID: 85;
  Gene Symbol: NT5C1B;
  Gene Name: 5'-nucleotidase, cytosolic IB;
  Uniprot ID:  Q96P26;
  ENSP ID: ENSP00000305979
MSQTSLKQKKNEPGMRSSKESLEAEKRKESDKTGVRLSNQGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 470 - protein, 610 aa, Homo sapiens
  Payload ID: 85;
  Gene Symbol: NT5C1B;
  Gene Name: 5'-nucleotidase, cytosolic IB;
  Uniprot ID:  Q96P26;
  ENSP ID: ENSP00000352904
MSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 471 - protein, 203 aa, Homo sapiens
  Payload ID: 85;
  Gene Symbol: NT5C1B;
  Gene Name: 5'-nucleotidase, cytosolic IB;
  ENSP ID: ENSP00000383905
MSQTSLKQKKNEPGMRSSKESLEAEKRKESDKTGVRLSNQGSQESSLRKTDSRGYLVRSQWSRISRSPSTKAPSIDEPRSRNTSAKVELPSSPRSSHPRRPSCPGRWTRGLPRPQSPILAPGAAPKCKRIRRPGPKASCGKSARPGTRSRWNIRARPPPSGSPPASAGGSTPPPPSWTATLCPSSSSSSGRTRTTTRLPTGHP

SEQ ID NO: 472 - protein, 265 aa, Homo sapiens
  Payload ID: 85;
  Gene Symbol: NT5C1B;
  Gene Name: 5'-nucleotidase, cytosolic IB;
  ENSP ID: ENSP00000390811
  MOD_RES (1)..(1): Any amino acid
XRKGLQPTALDLALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRLGSIAAYGFNKKFSS

SEQ ID NO: 473 - protein, 205 aa, Homo sapiens
  Payload ID: 85;
  Gene Symbol: NT5C1B;
  Gene Name: 5'-nucleotidase, cytosolic IB;
  ENSP ID: ENSP00000401656
MSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRVSRDHTTDSGGEPQTTWGSQESSLRKTDSRGYLVRSQWSRISRSPSTKAPSIDEPRSRNTSAKLPSSSTSSRTPSTSPSLHDSSPPPLSGQPSLQPPASPQLPRS

SEQ ID NO: 474 - protein, 561 aa, Homo sapiens
  Payload ID: 86;
  Gene Symbol: NT5C2;
  Gene Name: 5'-nucleotidase, cytosolic II;
  Uniprot ID:  P49902;
  ENSP ID: ENSP00000339479
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTDKIMTYLFDFPHGPKPGSSHRPWQSYFDLILVDARKPLFFGEGTVLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKKVTHDMDMCYGMMGSLFRSGSRQTLFASQVMRYADLYAASFINLLYYPFSYLFRAAHVLMPHESTVEHTHVDINEMESPLATRNRTSVDFKDTDYKRHQLTRSISEIKPPNLFPLAPQEITHCHDEDDDEEEEEEEE

SEQ ID NO: 475 - protein, 561 aa, Homo sapiens; identical to SEQ ID NO: 474
  Payload ID: 86;
  Gene Symbol: NT5C2;
  Gene Name: 5'-nucleotidase, cytosolic II;
  Uniprot ID:  P49902;
  ENSP ID: ENSP00000383960

SEQ ID NO: 476 - protein, 265 aa, Homo sapiens
  Payload ID: 86;
  Gene Symbol: NT5C2;
  Gene Name: 5'-nucleotidase, cytosolic II;
  ENSP ID: ENSP00000396468
MSTSWSDRLQNAADMPANMDKHALKKYRREAYHRVFVNRSLAMEKIKCFGFDMDYTLAVYKSPEYESLGFELTVERLVSIGYPQELLSFAYDSTFPTRGLVFDTLYGNLLKVDAYGNLLVCAHGFNFIRGSQVAVQKRPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDGKLPLLLSRMKEVGKVFLATNSDYKYTD

SEQ ID NO: 477 - protein, 146 aa, Homo sapiens
  Payload ID: 86;
  Gene Symbol: NT5C2;
  Gene Name: 5'-nucleotidase, cytosolic II;
  ENSP ID: ENSP00000408112
VLRQVDTKTGKLKIGTYTGPLQHGIVYSGGSSDTICDLLGAKGKDILYIGDHIFGDILKSKKRQGWRTFLVIPELAQELHVWTDKSSLFEELQSLDIFLAELYKHLDSSSNERPDISSIQRRIKMPHESTVEHTHVDINEMESPLA

SEQ ID NO: 478 - protein, 174 aa, Homo sapiens
  Payload ID: 86;
  Gene Symbol: NT5C2;
  Gene Name: 5'-nucleotidase, cytosolic II;
  ENSP ID: ENSP00000411330
VSIGYPQELLSFAYDSTFPTRGLVFDTLYGNLLKVDAYGNLLVCAHGFNFIRGSQVAVQKRPETREQYPNKFIQRDDTERFYILNTLFNLPETYLLACLVDFFTNCPRYTSCETGFKDGDLFMSYRSMFQDVRDAVDWVHYKGSLKEKTVENLEKYVVKDSKSSRIQYFLKVLW

SEQ ID NO: 479 - protein, 157 aa, Homo sapiens
  Payload ID: 86;
  Gene Symbol: NT5C2;
  Gene Name: 5'-nucleotidase, cytosolic II;
  ENSP ID: ENSP00000447664
  MOD_RES (1)..(1): Any amino acid
XSLGFELTVERLVSIGYPQELLSFAYDSTFPTRGLVFDTLYGNLLKVDAYGNLLVCAHGFNFIRGPETREQYPNKFIQRDDTERFYILNTLFNLPETYLLACLVDFFTNCPRYTSEFSASERCHIANLRDGTAPAAPCRLSPPTRPLSLPVCCSHHF

SEQ ID NO: 480 - protein, 62 aa, Homo sapiens
  Payload ID: 86;
  Gene Symbol: NT5C2;
  Gene Name: 5'-nucleotidase, cytosolic II;
  ENSP ID: ENSP00000474091
MSTSWSDRLQNAADMPANMDKHALKKYRREAYHRVFVNRSLAMEKIKCFGFDMDYTLAGEPV

SEQ ID NO: 481 - protein, 44 aa, Homo sapiens
  Payload ID: 86;
  Gene Symbol: NT5C2;
  Gene Name: 5'-nucleotidase, cytosolic II;
  ENSP ID: ENSP00000474247
MSTSWSDRLQNAADMPANMDKHALKKYRREAYHRRASVTPSRLE

SEQ ID NO: 482 - protein, 336 aa, Homo sapiens
  Payload ID: 87;
  Gene Symbol: NT5C3A;
  Gene Name: 5'-nucleotidase, cytosolic IIIA;
  Uniprot ID:  Q9H0P0;
  ENSP ID: ENSP00000242210
MRAPSMDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 483 - protein, 285 aa, Homo sapiens
  Payload ID: 87;
  Gene Symbol: NT5C3A;
  Gene Name: 5'-nucleotidase, cytosolic IIIA;
  Uniprot ID:  Q9H0P0;
  ENSP ID: ENSP00000371039
MPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 484 - protein, 297 aa, Homo sapiens
  Payload ID: 87;
  Gene Symbol: NT5C3A;
  Gene Name: 5'-nucleotidase, cytosolic IIIA;
  Uniprot ID:  Q9H0P0;
  ENSP ID: ENSP00000379456
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 485 - protein, 297 aa, Homo sapiens; identical to SEQ ID NO: 484
  Payload ID: 87;
  Gene Symbol: NT5C3A;
  Gene Name: 5'-nucleotidase, cytosolic IIIA;
  Uniprot ID:  Q9H0P0;
  ENSP ID: ENSP00000385261

SEQ ID NO: 486 - protein, 285 aa, Homo sapiens; identical to SEQ ID NO: 483
  Payload ID: 87;
  Gene Symbol: NT5C3A;
  Gene Name: 5'-nucleotidase, cytosolic IIIA;
  Uniprot ID:  Q9H0P0;
  ENSP ID: ENSP00000387166

SEQ ID NO: 487 - protein, 205 aa, Homo sapiens
  Payload ID: 87;
  Gene Symbol: NT5C3A;
  Gene Name: 5'-nucleotidase, cytosolic IIIA;
  ENSP ID: ENSP00000387205
MTNQESAVHVKMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETVRISNRSS

SEQ ID NO: 488 - protein, 54 aa, Homo sapiens
  Payload ID: 87;
  Gene Symbol: NT5C3A;
  Gene Name: 5'-nucleotidase, cytosolic IIIA;
  ENSP ID: ENSP00000389676
MRAPSMDRAAVARVGAVASASVCALVAGVVLAQYIFTLKRKTGRKTKIIEMKIG

SEQ ID NO: 489 - protein, 42 aa, Homo sapiens
  Payload ID: 87;
  Gene Symbol: NT5C3A;
  Gene Name: 5'-nucleotidase, cytosolic IIIA;
  ENSP ID: ENSP00000401161
MPEFQKSSVRIKNPTRVEEIICGLIKGGAAKLQIITDFDMTL

SEQ ID NO: 490 - protein, 331 aa, Homo sapiens
  Payload ID: 87;
  Gene Symbol: NT5C3A;
  Gene Name: 5'-nucleotidase, cytosolic IIIA;
  ENSP ID: ENSP00000476480
MDRAAVARVGAVASASVCALVAGVVLAQYIFTLKRKTGRKTKIIEMMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 491 - protein, 336 aa, Homo sapiens; identical to SEQ ID NO: 482
  Payload ID: 87;
  Gene Symbol: NT5C3A;
  Gene Name: 5'-nucleotidase, cytosolic IIIA;
  Uniprot ID:  Q9H0P0;
  ENSP ID: ENSP00000484415

SEQ ID NO: 492 - protein, 300 aa, Homo sapiens
  Payload ID: 88;
  Gene Symbol: NT5C3B;
  Gene Name: 5'-nucleotidase, cytosolic IIIB;
  Uniprot ID:  Q969T7;
  ENSP ID: ENSP00000389948
MAEEVSTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDGFLQGFKGQLIHTYNKNSSACENSGYFQQLEGKTNVILLGDSIGDLTMADGVPGVQNILKIGFLNDKVEERRERYMDSYDIVLEKDETLDVVNGLLQHILCQGVQLEMQGP

SEQ ID NO: 493 - protein, 74 aa, Homo sapiens
  Payload ID: 88;
  Gene Symbol: NT5C3B;
  Gene Name: 5'-nucleotidase, cytosolic IIIB;
  ENSP ID: ENSP00000392092
MAEEVRREEASGVGRARTPTPGALRAPQLVTEAPPLHPGEHPDEGHGPDAAAWAGAGDRGRPPQGRRRPVTGDF

SEQ ID NO: 494 - protein, 227 aa, Homo sapiens
  Payload ID: 88;
  Gene Symbol: NT5C3B;
  Gene Name: 5'-nucleotidase, cytosolic IIIB;
  ENSP ID: ENSP00000397742
MAEEVSTLMKATVLMRQPGRVQEIVGALRKGGGDRLQVISDFDMTLSRFAYNGKRCPSSYNILDNSKIISEECRKELTALLHHYYPIEIDPHRTVKEKLPHMVEWEGYKTFFNTLYHNNIPLFIFSAGIGDILEEIIRQMKVFHPNIHIVSNYMDFNEDGFLQGFKGQLIHTYNKNSSACENSGYFQQLEGKTNVILLGDSIGDLTMADGVPGVQNILKIGFLNDKV

SEQ ID NO: 495 - protein, 200 aa, Homo sapiens
  Payload ID: 88;
  Gene Symbol: NT5C3B;
  Gene Name: 5'-nucleotidase, cytosolic IIIB;
  ENSP ID: ENSP00000429878
MAEEVISDFDMTLSRFAYNGKRCPSSYNILDNSKIISEECRKELTALLHHYYPIEIDPHRTVKEKLPHMVEWWTKAHNLLCQQKIQKFQIAQVVRESNAMLREGYKTFFNTLYHNNIPLFIFSAGIGDILEEIIRQMKVFHPNIHIVSNYMDFNEDVEERRERYMDSYDIVLEKDETLDVVNGLLQHILCQGVQLEMQGP

SEQ ID NO: 496 - protein, 57 aa, Homo sapiens
  Payload ID: 88;
  Gene Symbol: NT5C3B;
  Gene Name: 5'-nucleotidase, cytosolic IIIB;
  ENSP ID: ENSP00000431066
MAEEVSTLMKATVLMRQPGRVQEIVGALRKGGGDRLQISQYGHAASSNWTEGAHTST

SEQ ID NO: 497 - protein, 105 aa, Homo sapiens
  Payload ID: 88;
  Gene Symbol: NT5C3B;
  Gene Name: 5'-nucleotidase, cytosolic IIIB;
  ENSP ID: ENSP00000475710
AHNLLCQQKIQKFQIAQVVRESNAMLREGYKTFFNTLYHNNIPLFIFSAGIGDILEEIIRQMKVFHPNIHIVSNYMDFNEDVSQILFGLGKDEGWGPPARAVNSA

SEQ ID NO: 498 - protein, 574 aa, Homo sapiens
  Payload ID: 89;
  Gene Symbol: NT5E;
  Gene Name: 5'-nucleotidase, ecto (CD73);
  Uniprot ID:  P21589;
  ENSP ID: ENSP00000257770
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 499 - protein, 264 aa, Homo sapiens
  Payload ID: 89;
  Gene Symbol: NT5E;
  Gene Name: 5'-nucleotidase, ecto (CD73);
  ENSP ID: ENSP00000358660
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNCFKRIAWARMSR

SEQ ID NO: 500 - protein, 524 aa, Homo sapiens
  Payload ID: 89;
  Gene Symbol: NT5E;
  Gene Name: 5'-nucleotidase, ecto (CD73);
  Uniprot ID:  P21589;
  ENSP ID: ENSP00000358665
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 501 - protein, 179 aa, Homo sapiens
  Payload ID: 89;
  Gene Symbol: NT5E;
  Gene Name: 5'-nucleotidase, ecto (CD73);
  ENSP ID: ENSP00000387630
  MOD_RES (1)..(1): Any amino acid
XNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGDLKECCPICINQDDSWKEQPTAQTYLNTWF

SEQ ID NO: 502 - protein, 230 aa, Homo sapiens
  Payload ID: 89;
  Gene Symbol: NT5E;
  Gene Name: 5'-nucleotidase, ecto (CD73);
  ENSP ID: ENSP00000414674
  MOD_RES (1)..(1): Any amino acid
XDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGIHVVYDLSRKPGDRVVKLDVLCTKCRVPSYDPLKMDEVYKVILPNFLANGGDGFQMIKDEL

SEQ ID NO: 503 - protein, 1288 aa, Homo sapiens
  Payload ID: 90;
  Gene Symbol: OPLAH;
  Gene Name: 5-oxoprolinase (ATP-hydrolysing);
  Uniprot ID:  O14841;
  ENSP ID: ENSP00000480476
MGSPEGRFHFAIDRGGTFTDVFAQCPGGHVRVLKLLSEDPANYADAPTEGIRRILEQEAGMLLPRDQPLDSSHIASIRMGTTVATNALLERKGERVALLVTRGFRDLLHIGTQARGDLFDLAVPMPEVLYEEVLEVDERVVLHRGEAGTGTPVKGRTGDLLEVQQPVDLGALRGKLEGLLSRGIRSLAVVLMHSYTWAQHEQQVGVLARELGFTHVSLSSEAMPMVRIVPRGHTACADAYLTPAIQRYVQGFCRGFQGQLKDVQVLFMRSDGGLAPMDTFSGSSAVLSGPAGGVVGYSATTYQQEGGQPVIGFDMGGTSTDVSRYAGEFEHVFEASTAGVTLQAPQLDINTVAAGGGSRLFFRSGLFVVGPESAGAHPGPACYRKGGPVTVTDANLVLGRLLPASFPCIFGPGENQPLSPEASRKALEAVATEVNSFLTNGPCPASPLSLEEVAMGFVRVANEAMCRPIRALTQARGHDPSAHVLACFGGAGGQHACAIARALGMDTVHIHRHSGLLSALGLALADVVHEAQEPCSLLYAPETFVQLDQRLSRLEEQCVDALQAQGFPRSQISTESFLHLRYQGTDCALMVSAHQHPATARSPRAGDFGAAFVERYMREFGFVIPERPVVVDDVRVRGTGRSGLRLEDAPKAQTGPPRVDKMTQCYFEGGYQETPVYLLAELGYGHKLHGPCLIIDSNSTILVEPGCQAEVTKTGDICISVGAEVPGTVGPQLDPIQLSIFSHRFMSIAEQMGRILQRTAISTNIKERLDFSCALFGPDGGLVSNAPHIPVHLGAMQETVQFQIQHLGADLHPGDVLLSNHPSAGGSHLPDLTVITPVFWPGQTRPVFYVASRGHHADIGGITPGSMPPHSTMLQQEGAVFLSFKLVQGGVFQEEAVTEALRAPGKVPNCSGTRNLHDNLSDLRAQVAANQKGIQLVGELIGQYGLDVVQAYMGHIQANAELAVRDMLRAFGTSRQARGLPLEVSSEDHMDDGSPIRLRVQISLSQGSAVFDFSGTGPEVFGNLNAPRAVTLSALIYCLRCLVGRDIPLNQGCLAPVRVVIPRGSILDPSPEAAVVGGNVLTSQRVVDVILGAFGACAASQGCMNNVTLGNAHMGYYETVAGGAGAGPSWHGRSGVHSHMTNTRITDPEILESRYPVILRRFELRRGSGGRGRFRGGDGVTRELLFREEALLSVLTERRAFRPYGLHGGEPGARGLNLLIRKNGRTVNLGGKTSVTVYPGDVFCLHTPGGGGYGDPEDPAPPPGSPPQALAFPEHGSVYEYRRAQEAV

SEQ ID NO: 504 - protein, 157 aa, Homo sapiens
  Payload ID: 90;
  Gene Symbol: OPLAH;
  Gene Name: 5-oxoprolinase (ATP-hydrolysing);
  ENSP ID: ENSP00000481640
MGSPEGRFHFAIDRGGTFTDVFAQCPGGHVRVLKLLSEDPANYADAPTEGIRRILEQEAGMLLPRDQPLDSSHIASIRMGTTVATNALLERKGERVALLVTRGFRDLLHIGTQARGDLFDLAVPMPEVLYEEVLEVDERVVLHRGEAGTGTPVKGRT

SEQ ID NO: 505 - protein, 450 aa, Homo sapiens
  Payload ID: 91;
  Gene Symbol: PHYKPL;
  Gene Name: 5-phosphohydroxy-L-lysine phospho-lyase;
  Uniprot ID:  Q8IUZ5;
  ENSP ID: ENSP00000310978
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 506 - protein, 219 aa, Homo sapiens
  Payload ID: 91;
  Gene Symbol: PHYKPL;
  Gene Name: 5-phosphohydroxy-L-lysine phospho-lyase;
  ENSP ID: ENSP00000321290
MAADQRPKADTLALRQRLISHLFSGSGRLTRTHAEMSKEATEAENAFRNNPKFQRLVTPSASCFATTCGVERQVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGR

SEQ ID NO: 507 - protein, 182 aa, Homo sapiens
  Payload ID: 91;
  Gene Symbol: PHYKPL;
  Gene Name: 5-phosphohydroxy-L-lysine phospho-lyase;
  ENSP ID: ENSP00000377128
  MOD_RES (1)..(1): Any amino acid
XVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 508 - protein, 123 aa, Homo sapiens
  Payload ID: 91;
  Gene Symbol: PHYKPL;
  Gene Name: 5-phosphohydroxy-L-lysine phospho-lyase;
  ENSP ID: ENSP00000421810
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGWGNSSSKKGT

SEQ ID NO: 509 - protein, 65 aa, Homo sapiens
  Payload ID: 91;
  Gene Symbol: PHYKPL;
  Gene Name: 5-phosphohydroxy-L-lysine phospho-lyase;
  ENSP ID: ENSP00000423806
MAADQRPKADTLALRQRLISSSCRLFFPEDPVKIVRAQGQYMYDEQGAEYIDCISNVAHVRITAT

SEQ ID NO: 510 - protein, 115 aa, Homo sapiens
  Payload ID: 91;
  Gene Symbol: PHYKPL;
  Gene Name: 5-phosphohydroxy-L-lysine phospho-lyase;
  ENSP ID: ENSP00000424608
QAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVVCTAQLNNSDMLSSLG

SEQ ID NO: 511 - protein, 55 aa, Homo sapiens
  Payload ID: 91;
  Gene Symbol: PHYKPL;
  Gene Name: 5-phosphohydroxy-L-lysine phospho-lyase;
  ENSP ID: ENSP00000425425
MAADQRPKADTLALRQRLIRHAALWSPHGTGQPPFLRIRETDADTCRNEQGGHRG

SEQ ID NO: 512 - protein, 28 aa, Homo sapiens
  Payload ID: 91;
  Gene Symbol: PHYKPL;
  Gene Name: 5-phosphohydroxy-L-lysine phospho-lyase;
  ENSP ID: ENSP00000427444
IAAFFAESLPSVGGQIIPPAGYFSQVAE

SEQ ID NO: 513 - protein, 191 aa, Homo sapiens
  Payload ID: 92;
  Gene Symbol:;
  Gene Name: 60S ribosomal prt L7a [Source:UniProtKB/Swiss-Prot;Acc:P62424];
  ENSP ID: ENSP00000486063
MLVRLNVRCSCRGVVLGGCRKLLASLVQPKGKKAKGKKVAPAPAVVKKQEAKKVVNPLFEKRPKNFGIGQDIQPKRDLTRFVKWPRYIRLQRQRAILYKRLKVPPAINQFTQALDRQTATQLLKLAHKYRPETKQEKKQRLLARAEKKAAGKGDVPTKRPPVLRAGVNTVTTLVENKKAQLVVIAHDVDPI

SEQ ID NO: 514 - protein, 151 aa, Homo sapiens
  Payload ID: 92;
  Gene Symbol:;
  Gene Name: 60S ribosomal prt L7a [Source:UniProtKB/Swiss-Prot;Acc:P62424];
  ENSP ID: ENSP00000486855
MAPLYQAAGKGDVPTKRPPVLRAGVNTVTTLVENKKAQLVVIAHDVDPIELVVFLPALCRKMGVPYCIIKGKARLGRLVHRKTCTTVAFTQVNSEDKGALAKLVEAIRTNYNDRYDEIRRHWGGNVLGPKSVARIAKLEKAKAKELATKLG

SEQ ID NO: 515 - protein, 266 aa, Homo sapiens [sequence omitted]

SEQ ID NO: 516 - protein, 271 aa, Homo sapiens
  Payload ID: 93;
  Gene Symbol: PFKFB1;
  Gene Name: 6-phosphofructo-2-kinase/fructose-2,6-biphosphatase 1;
  ENSP ID: ENSP00000364131
MSPEMGELTQTRLQKIWIPHSSGSSRLQRRRGSSIPQFTNSPTMVIMVGLPARGKTYISTKLTRYLNWIGTPTKDNMEALQIRKQCALAALKDVHNYLSHEEGHVAVFDATNTTRERRSLILQFAKEHGYKGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 517 - protein, 471 aa, Homo sapiens
  Payload ID: 93;
  Gene Symbol: PFKFB1;
  Gene Name: 6-phosphofructo-2-kinase/fructose-2,6-biphosphatase 1;
  Uniprot ID:  P16118;
  ENSP ID: ENSP00000364145
MSPEMGELTQTRLQKIWIPHSSGSSRLQRRRGSSIPQFTNSPTMVIMVGLPARGKTYISTKLTRYLNWIGTPTKVFNLGQYRREAVSYKNYEFFLPDNMEALQIRKQCALAALKDVHNYLSHEEGHVAVFDATNTTRERRSLILQFAKEHGYKVFFIESICNDPGIIAENIRQVKLGSPDYIDCDREKVLEDFLKRIECYEVNYQPLDEELDSHLSYIKIFDVGTRYMVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 518 - protein, 406 aa, Homo sapiens
  Payload ID: 93;
  Gene Symbol: PFKFB1;
  Gene Name: 6-phosphofructo-2-kinase/fructose-2,6-biphosphatase 1;
  Uniprot ID:  P16118;
  ENSP ID: ENSP00000444074
MEEKTSRIKVFNLGQYRREAVSYKNYEFFLPDNMEALQIRKQCALAALKDVHNYLSHEEGHVAVFDATNTTRERRSLILQFAKEHGYKVFFIESICNDPGIIAENIRQVKLGSPDYIDCDREKVLEDFLKRIECYEVNYQPLDEELDSHLSYIKIFDVGTRYMVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 519 - protein, 244 aa, Homo sapiens
  Payload ID: 93;
  Gene Symbol: PFKFB1;
  Gene Name: 6-phosphofructo-2-kinase/fructose-2,6-biphosphatase 1;
  ENSP ID: ENSP00000480232
MVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 520 - protein, 471 aa, Homo sapiens
  Payload ID: 94;
  Gene Symbol: PFKFB2;
  Gene Name: 6-phosphofructo-2-kinase/fructose-2,6-biphosphatase 2;
  Uniprot ID:  O60825;
  ENSP ID: ENSP00000356046
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTAAETTLAVRRRPSAASLMLPC

SEQ ID NO: 521 - protein, 505 aa, Homo sapiens
  Payload ID: 94;
  Gene Symbol: PFKFB2;
  Gene Name: 6-phosphofructo-2-kinase/fructose-2,6-biphosphatase 2;
  Uniprot ID:  O60825;
  ENSP ID: ENSP00000356047
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIAVFDATNTTRERRDMILNFAEQNSFKVFFVESVCDDPDVIAANILEVKVSSPDYPERNRENVMEDFLKRIECYKVTYRPLDPDNYDKDLSFIKVINVGQRFLVNRVQDYIQSKIVYYLMNIHVQPRTIYLCRHGESEFNLLGKIGGDSGLSVRGKQFAQALRKFLEEQEITDLKVWTSQLKRTIQTAESLGVPYEQWKILNEIDAGVCEEMTYAEIEKRYPEEFALRDQEKYLYRYPGGESYQDLVQRLEPVIMELERQGNVLVISHQAVMRCLLAYFLDKGADELPYLRCPLHTIFKLTPVAYGCKVETIKLNVEAVNTHRDKPTNNFPKNQTPVRMRRNSFTPLSSSNTIRRPRNYSVGSRPLKPLSPLRAQDMQEGAD

SEQ ID NO: 522 - protein, 96 aa, Homo sapiens
  Payload ID: 94;
  Gene Symbol: PFKFB2;
  Gene Name: 6-phosphofructo-2-kinase/fructose-2,6-biphosphatase 2;
  ENSP ID: ENSP00000408717
MSGASSSEQNNNSYETKTPNLRMSEKKCSWASYMTNSPTLIVMIGLPARGKTYVSKKLTRYLNWIGVPTKGQETSPIWWGHHIILLLKDLGVFYSV

SEQ ID NO: 523 - protein, 125 aa, Homo sapiens
  Payload ID: 94;
  Gene Symbol: PFKFB2;
  Gene Name: 6-phosphofructo-2-kinase/fructose-2,6-biphosphatase 2;
  ENSP ID: ENSP00000439420
MSGASSSEQNNNSYETKTPNLRMSEKKCSWASYMTNSPTLIVMIGLPARGKTYVSKKLTRYLNWIGVPTKVFNLGVYRREAVKSYKSYDFFRHDNEEAMKIRKQCALVALEDVKAYLTEENGQIA

SEQ ID NO: 524 - protein, 44 aa, Homo sapiens
  Payload ID: 94;
  Gene Symbol: PFKFB2;
  Gene Name: 6-phosphofructo-2-kinase/fructose-2,6-biphosphatase 2;
  ENSP ID: ENSP00000484769
MSGASSSEQNNNSYETKTPNLRMSEKKCCWSAVTGSWLTATLNS

SEQ ID NO: 525 - protein, 49 aa, Homo sapiens
  Payload ID: 94;
  Gene Symbol: PFKFB2;
  Gene Name: 6-phosphofructo-2-kinase/fructose-2,6-biphosphatase 2;
  ENSP ID: ENSP00000484988
MSGASSSEQNNNSYETKTPNLRMSEKKCSWASYMTNSPTLIVMIGLPAR

SEQ ID NO: 526 - protein, 514 aa, Homo sapiens
  Payload ID: 95;
  Gene Symbol: PFKFB3;
  Gene Name: 6-phosphofructo-2-kinase/fructose-2,6-biphosphatase 3;
  Uniprot ID:  Q16875;
  ENSP ID: ENSP00000353712
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLT

SEQ ID NO: 527 - protein, 520 aa, Homo sapiens
  Payload ID: 95;
  Gene Symbol: PFKFB3;
  Gene Name: 6-phosphofructo-2-kinase/fructose-2,6-biphosphatase 3;
  Uniprot ID:  Q16875;
  ENSP ID: ENSP00000369100
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 528 - protein, 513 aa, Homo sapiens
  Payload ID: 95;
  Gene Symbol: PFKFB3;
  Gene Name: 6-phosphofructo-2-kinase/fructose-2,6-biphosphatase 3;
  ENSP ID: ENSP00000369105
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACL

SEQ ID NO: 529 - protein, 526 aa, Homo sapiens
  Payload ID: 95;
  Gene Symbol: PFKFB3;
  Gene Name: 6-phosphofructo-2-kinase/fructose-2,6-biphosphatase 3;
  ENSP ID: ENSP00000369111
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQPLLGQACLRTVCHIFSKFSPY

SEQ ID NO: 530 - protein, 500 aa, Homo sapiens
  Payload ID: 95;
  Gene Symbol: PFKFB3;
  Gene Name: 6-phosphofructo-2-kinase/fructose-2,6-biphosphatase 3;
  Uniprot ID:  Q16875;
  ENSP ID: ENSP00000369115
MPFRKACGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 531 - protein, 143 aa, Homo sapiens
  Payload ID: 95;
  Gene Symbol: PFKFB3;
  Gene Name: 6-phosphofructo-2-kinase/fructose-2,6-biphosphatase 3;
  ENSP ID: ENSP00000390285
  MOD_RES (1)..(1): Any amino acid
XVEEQNLKDLRVWTSQLKSTIQTAEALRLPYEQWKALNEIDASYQDLVQRLEPVIMELERQENVLVICHQAVLRCLLAYFLDKSAEEMPYLKCPLHTVLKLTPVAYGCRVESIYLNVESVCTHRERSENMKGSRSSADSSRKH

SEQ ID NO: 532 - protein, 31 aa, Homo sapiens
  Payload ID: 95;
  Gene Symbol: PFKFB3;
  Gene Name: 6-phosphofructo-2-kinase/fructose-2,6-biphosphatase 3;
  ENSP ID: ENSP00000404995
IYLNVESVCTHRERSENMKGSRSSADSSRKH

SEQ ID NO: 533 - protein, 92 aa, Homo sapiens
  Payload ID: 95;
  Gene Symbol: PFKFB3;
  Gene Name: 6-phosphofructo-2-kinase/fructose-2,6-biphosphatase 3;
  ENSP ID: ENSP00000416677
IYLNVESVCTHRERSEDAKKGPNPLMRRNSVTPLASPEPTKKPRINSFEEHVASTSAALPSCLPPEVPTQLPGQPLLGQACLNWKGVMRNAA

SEQ ID NO: 534 - protein, 455 aa, Homo sapiens
  Payload ID: 95;
  Gene Symbol: PFKFB3;
  Gene Name: 6-phosphofructo-2-kinase/fructose-2,6-biphosphatase 3;
  ENSP ID: ENSP00000432356
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEAAKSTTLC

SEQ ID NO: 535 - protein, 455 aa, Homo sapiens; identical to SEQ ID NO: 534
  Payload ID: 95;
  Gene Symbol: PFKFB3;
  Gene Name: 6-phosphofructo-2-kinase/fructose-2,6-biphosphatase 3;
  ENSP ID: ENSP00000433771

SEQ ID NO: 536 - protein, 61 aa, Homo sapiens
  Payload ID: 95;
  Gene Symbol: PFKFB3;
  Gene Name: 6-phosphofructo-2-kinase/fructose-2,6-biphosphatase 3;
  ENSP ID: ENSP00000434342
IYLNVESVCTHRERSEGLSLFPRLECGGAVTAHCSLNLLGSSDPPASASRVAETTGCKEGT

SEQ ID NO: 537 - protein, 455 aa, Homo sapiens; identical to SEQ ID NO: 534
  Payload ID: 95;
  Gene Symbol: PFKFB3;
  Gene Name: 6-phosphofructo-2-kinase/fructose-2,6-biphosphatase 3;
  ENSP ID: ENSP00000434628

SEQ ID NO: 538 - protein, 455 aa, Homo sapiens; identical to SEQ ID NO: 534
  Payload ID: 95;
  Gene Symbol: PFKFB3;
  Gene Name: 6-phosphofructo-2-kinase/fructose-2,6-biphosphatase 3;
  ENSP ID: ENSP00000436885

SEQ ID NO: 539 - protein, 534 aa, Homo sapiens
  Payload ID: 95;
  Gene Symbol: PFKFB3;
  Gene Name: 6-phosphofructo-2-kinase/fructose-2,6-biphosphatase 3;
  Uniprot ID:  Q16875;
  ENSP ID: ENSP00000443319
MGEGGQKEGDSQQAGALPLLCQLDTFSPKATVFGVSINPACGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 540 - protein, 455 aa, Homo sapiens; identical to SEQ ID NO: 534
  Payload ID: 95;
  Gene Symbol: PFKFB3;
  Gene Name: 6-phosphofructo-2-kinase/fructose-2,6-biphosphatase 3;
  ENSP ID: ENSP00000486311

SEQ ID NO: 541 - protein, 526 aa, Homo sapiens; identical to SEQ ID NO: 529
  Payload ID: 95;
  Gene Symbol: PFKFB3;
  Gene Name: 6-phosphofructo-2-kinase/fructose-2,6-biphosphatase 3;
  ENSP ID: ENSP00000487277

SEQ ID NO: 542 - protein, 469 aa, Homo sapiens
  Payload ID: 96;
  Gene Symbol: PFKFB4;
  Gene Name: 6-phosphofructo-2-kinase/fructose-2,6-biphosphatase 4;
  Uniprot ID:  Q16877;
  ENSP ID: ENSP00000232375
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 543 - protein, 434 aa, Homo sapiens
  Payload ID: 96;
  Gene Symbol: PFKFB4;
  Gene Name: 6-phosphofructo-2-kinase/fructose-2,6-biphosphatase 4;
  Uniprot ID:  Q16877;
  ENSP ID: ENSP00000373240
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDASYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 544 - protein, 462 aa, Homo sapiens
  Payload ID: 96;
  Gene Symbol: PFKFB4;
  Gene Name: 6-phosphofructo-2-kinase/fructose-2,6-biphosphatase 4;
  ENSP ID: ENSP00000388394
MASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 545 - protein, 38 aa, Homo sapiens
  Payload ID: 96;
  Gene Symbol: PFKFB4;
  Gene Name: 6-phosphofructo-2-kinase/fructose-2,6-biphosphatase 4;
  ENSP ID: ENSP00000389169
MASPRELTQNPLKKIWMPYSNGRPALHACQRGELSKVG

SEQ ID NO: 546 - protein, 175 aa, Homo sapiens
  Payload ID: 96;
  Gene Symbol: PFKFB4;
  Gene Name: 6-phosphofructo-2-kinase/fructose-2,6-biphosphatase 4;
  ENSP ID: ENSP00000393047
MTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDL

SEQ ID NO: 547 - protein, 80 aa, Homo sapiens
  Payload ID: 96;
  Gene Symbol: PFKFB4;
  Gene Name: 6-phosphofructo-2-kinase/fructose-2,6-biphosphatase 4;
  ENSP ID: ENSP00000400772
MASPRELTQNPLKKIWMPYSNGRPALHACQRGGGLVFQQEEGCLLALKLSLGRNFSRDVLRIETEKYAVWACVCVPGHCA

SEQ ID NO: 548 - protein, 318 aa, Homo sapiens
  Payload ID: 96;
  Gene Symbol: PFKFB4;
  Gene Name: 6-phosphofructo-2-kinase/fructose-2,6-biphosphatase 4;
  ENSP ID: ENSP00000407657
MDRGSLGGSSLTDLGPGSSRRVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDA

SEQ ID NO: 549 - protein, 129 aa, Homo sapiens
  Payload ID: 96;
  Gene Symbol: PFKFB4;
  Gene Name: 6-phosphofructo-2-kinase/fructose-2,6-biphosphatase 4;
  ENSP ID: ENSP00000415764
MRARDSTGHPLMLREQTLGQHLHGEDTGEWEHTCEVCMTNCPTLIVMVGLPARGKTYISKKLTRYLNWIGVPTREFNVGQYRRDVVKTYKSFEFFLPDNEEGLKIRKQCALAALRDVRRFLSEEGGHVA

SEQ ID NO: 550 - protein, 258 aa, Homo sapiens
  Payload ID: 97;
  Gene Symbol: PGLS;
  Gene Name: 6-phosphogluconolactonase;
  Uniprot ID:  O95336;
  ENSP ID: ENSP00000252603
MAAPAPGLISVFSSSQELGAALAQLVAQRAACCLAGARARFALGLSGGSLVSMLARELPAAVAPAGPASLARWTLGFCDERLVPFDHAESTYGLYRTHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGKAAVLKRILEDQEENPLPAALVQPHTGKLCWFLDEAAARLLTVPFEKHSTL

SEQ ID NO: 551 - protein, 179 aa, Homo sapiens
  Payload ID: 97;
  Gene Symbol: PGLS;
  Gene Name: 6-phosphogluconolactonase;
  ENSP ID: ENSP00000471446
MAAPAPGLISVFSSSQELGAALAQLVAQRAACCLAGARARFALGLSGGSLVSMLARELPAAVAPAGPASLARWTLGFCDERLVPFDHAESTYGLYRTHLLSRLPIPESQVITINPELPVEEAAEDYAKKLRQELPQGSLADPFEESPLRGHSPALGSLKATRPLLPRHSKGTPSRFSTC

SEQ ID NO: 552 - protein, 147 aa, Homo sapiens
  Payload ID: 97;
  Gene Symbol: PGLS;
  Gene Name: 6-phosphogluconolactonase;
  ENSP ID: ENSP00000471951
AGPASLARWTLGFCDERLVPFDHAESTYGLYRTHLLSRLPIPESQVITINPELPVEEAAEDYAKKLRQAFQGDSIPVFDLLILGVGPDGHTCSLFPDHPLLQRILEDQEENPLPAALVQPHTGKLCWFLDEAAARLLTVPFEKHSTL

SEQ ID NO: 553 - protein, 216 aa, Homo sapiens
  Payload ID: 97;
  Gene Symbol: PGLS;
  Gene Name: 6-phosphogluconolactonase;
  ENSP ID: ENSP00000472345
MAAPAPGLISVFSSSQELGAALAQLVAQRAACCLAGARARFALGLSGGSLVSMLARELPAAVAPAGPASLARWTLGFCDERLVPFDHAESTYGLYRMEKLRPEETHLLSRLPIPESQVITINPELPVEEAAEDYAKKLRQAFQGDSIPVFDLLILGVGPDGHTCSLFPDHPLLQEREKIVAPISDSPKPPPQRVTLTLPVLNAARTVIFVATGEGK

SEQ ID NO: 554 - protein, 145 aa, Homo sapiens
  Payload ID: 98;
  Gene Symbol: PTS;
  Gene Name: 6-pyruvoyltetrahydropterin synthase;
  Uniprot ID:  Q03393;
  ENSP ID: ENSP00000280362
MSTEGGGRRCQAQVSRRISFSASHRLYSKFLSDEENLKLFGKCNNPNGHGHNYKVVVTVHGEIDPATGMVMNLADLKKYMEEAIMQPLDHKNLDMDVPYFADVVSTTENVAVYIWDNLQKVLPVGVLYKVKVYETDNNIVVYKGE

SEQ ID NO: 555 - protein, 61 aa, Homo sapiens
  Payload ID: 98;
  Gene Symbol: PTS;
  Gene Name: 6-pyruvoyltetrahydropterin synthase;
  ENSP ID: ENSP00000431750
MSTEGGGRRCQAQVSRRISFSASHRLYSKFLSDEENLKLFGKCNNPNGHGHNYKGGDYAAP

SEQ ID NO: 556 - protein, 55 aa, Homo sapiens
  Payload ID: 98;
  Gene Symbol: PTS;
  Gene Name: 6-pyruvoyltetrahydropterin synthase;
  ENSP ID: ENSP00000433469
MSTEGGGRRCQAQVSRRISFSASHRLYSKFLSDEENLKLFGKCNNPNGHGHNYKD

SEQ ID NO: 557 - protein, 77 aa, Homo sapiens
  Payload ID: 98;
  Gene Symbol: PTS;
  Gene Name: 6-pyruvoyltetrahydropterin synthase;
  ENSP ID: ENSP00000434688
MVMNLADLKKYMEEAIMQPLDHKNLDMDVPYFADVVSTTENVAVYIWDNLQKVLPVGVLYKVKVYETDNNIVVYKGE

SEQ ID NO: 558 - protein, 55 aa, Homo sapiens; identical to SEQ ID NO: 556
  Payload ID: 98;
  Gene Symbol: PTS;
  Gene Name: 6-pyruvoyltetrahydropterin synthase;
  ENSP ID: ENSP00000435895

SEQ ID NO: 559 - protein, 475 aa, Homo sapiens
  Payload ID: 99;
  Gene Symbol: DHCR7;
  Gene Name: 7-dehydrocholesterol reductase;
  Uniprot ID:  Q9UBM7;
  ENSP ID: ENSP00000347717
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 560 - protein, 475 aa, Homo sapiens; identical to SEQ ID NO: 559
  Payload ID: 99;
  Gene Symbol: DHCR7;
  Gene Name: 7-dehydrocholesterol reductase;
  Uniprot ID:  Q9UBM7;
  ENSP ID: ENSP00000384739

SEQ ID NO: 561 - protein, 116 aa, Homo sapiens
  Payload ID: 99;
  Gene Symbol: DHCR7;
  Gene Name: 7-dehydrocholesterol reductase;
  ENSP ID: ENSP00000432256
  MOD_RES (1)..(1): Any amino acid
XFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQMRNAAVEAE

SEQ ID NO: 562 - protein, 105 aa, Homo sapiens
  Payload ID: 99;
  Gene Symbol: DHCR7;
  Gene Name: 7-dehydrocholesterol reductase;
  ENSP ID: ENSP00000432589
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVT

SEQ ID NO: 563 - protein, 221 aa, Homo sapiens
  Payload ID: 99;
  Gene Symbol: DHCR7;
  Gene Name: 7-dehydrocholesterol reductase;
  ENSP ID: ENSP00000435011
INLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKEFRVSSTAVLPAQTDFL

SEQ ID NO: 564 - protein, 258 aa, Homo sapiens
  Payload ID: 99;
  Gene Symbol: DHCR7;
  Gene Name: 7-dehydrocholesterol reductase;
  ENSP ID: ENSP00000435047
MAAKSQPNIPKAKSLDGVTNDRTASQGQWGRACCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETW

SEQ ID NO: 565 - protein, 73 aa, Homo sapiens
  Payload ID: 99;
  Gene Symbol: DHCR7;
  Gene Name: 7-dehydrocholesterol reductase;
  ENSP ID: ENSP00000435058
MGPSVTACIRPRREVDWFSLASVIFLLLFAPFIVYYFIMACDQYSCALTGPVVDIVTGHARLSDIWAKTPPIT

SEQ ID NO: 566 - protein, 164 aa, Homo sapiens
  Payload ID: 99;
  Gene Symbol: DHCR7;
  Gene Name: 7-dehydrocholesterol reductase;
  ENSP ID: ENSP00000435668
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHL

SEQ ID NO: 567 - protein, 107 aa, Homo sapiens
  Payload ID: 99;
  Gene Symbol: DHCR7;
  Gene Name: 7-dehydrocholesterol reductase;
  ENSP ID: ENSP00000435707
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQ

SEQ ID NO: 568 - protein, 245 aa, Homo sapiens
  Payload ID: 99;
  Gene Symbol: DHCR7;
  Gene Name: 7-dehydrocholesterol reductase;
  ENSP ID: ENSP00000435956
TGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQKRTRRQGVCQRQSWGLTPGRWAPEPTLLSSPWAKHRLTPSPSPPRVCTWCTTPCSCPPRTPWASCCWAWWATTSSGWPTTRRTCSAARMGAASSGAGSPRSSSAPTHPPMGRGTTASCWCRASGAWPATSTTSAT

SEQ ID NO: 569 - protein, 91 aa, Homo sapiens
  Payload ID: 99;
  Gene Symbol: DHCR7;
  Gene Name: 7-dehydrocholesterol reductase;
  ENSP ID: ENSP00000436007
MAAKSQPNIPKAKSLDGVTNDRTASQGQWGRAWEVDWFSLASVIFLLLFAPFIVYYFIMACDQYSCALTGPVVDIVTGHARLSDIWAKTPP

SEQ ID NO: 570 - protein, 357 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000303132
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 571 - protein, 356 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000305527
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQALCQVITTFMTFLGPHRLDQMPPEELQTSSSRLGGPPWQCI

SEQ ID NO: 572 - protein, 410 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000305584
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQATPPSYRCCSVPTCANPAMLRSHQQSAERVPKGRKARWGTLDKEIPQAPSPPFPTSLSPSPPSLMLGRGLPVTTSKARHPQIKQSVCTTRWGGGY

SEQ ID NO: 573 - protein, 424 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000306561
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 574 - protein, 345 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000342851
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVLFSADLRQSRHAQEPPAKRRKGSKGPEG

SEQ ID NO: 575 - protein, 263 aa, Homo sapiens
  Payload ID: 100;
  Gene Symbol: OGG1;
  Gene Name: 8-oxoguanine DNA glycosylase;
  ENSP ID: ENSP00000344899
  MOD_RES (1)..(1): Any amino acid
XVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKGLLGNAFDGHQLLRPLIFCQDHLREGPPIGRGDSQGEELEPQLPSSLSSIPYGFCDHCWTKDVDDPPLVTHPSPGSRDGHMTQAWPVKVVSPLATVIGHVMQASLLAL

SEQ ID NO: 576 - protein, 324 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000345520
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVSVPRCPP

SEQ ID NO: 577 - protein, 195 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000373337
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPPWQCI

SEQ ID NO: 578 - protein, 222 aa, Homo sapiens
  Payload ID: 100;
  Gene Symbol: OGG1;
  Gene Name: 8-oxoguanine DNA glycosylase;
  ENSP ID: ENSP00000390337
  MOD_RES (1)..(1): Any amino acid
XPCGPPSRALALSCAWTWFCLLDNLSGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAVSVPRCPP

SEQ ID NO: 579 - protein, 168 aa, Homo sapiens
  Payload ID: 100;
  Gene Symbol: OGG1;
  Gene Name: 8-oxoguanine DNA glycosylase;
  ENSP ID: ENSP00000393726
  MOD_RES (1)..(1): Any amino acid
XASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGG

SEQ ID NO: 580 - protein, 52 aa, Homo sapiens
  Payload ID: 100;
  Gene Symbol: OGG1;
  Gene Name: 8-oxoguanine DNA glycosylase;
  ENSP ID: ENSP00000396034
MPARALLPRRMGHRTLASTPALWASIPCPRSELRLDLVLPSGQSFRWLTASA

SEQ ID NO: 581 - protein, 128 aa, Homo sapiens
  Payload ID: 100;
  Gene Symbol: OGG1;
  Gene Name: 8-oxoguanine DNA glycosylase;
  ENSP ID: ENSP00000399810
  MOD_RES (1)..(1): Any amino acid
XELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGVPVPAEGLLTSASAFQSPLRSRQPEADRR

SEQ ID NO: 582 - protein, 132 aa, Homo sapiens
  Payload ID: 100;
  Gene Symbol: OGG1;
  Gene Name: 8-oxoguanine DNA glycosylase;
  ENSP ID: ENSP00000402713
  MOD_RES (1)..(1): Any amino acid
XMMSPTMASPACRPWLVADCICLMALDKPQAVPVDVHMWHIAQRDYSWHPTTSQAKGPSPQTNKELGNFFRSLWGPYAGWAQATPPSYRCCSVPTCANPAMLRSHQQSAERVPKGRKARWGTLDKEIPQAPS

SEQ ID NO: 583 - protein, 322 aa, Homo sapiens
  Payload ID: 100;
  Gene Symbol: OGG1;
  Gene Name: 8-oxoguanine DNA glycosylase;
  Uniprot ID:  O15527;
  ENSP ID: ENSP00000403598
MPARALLPRRMGHRTLASTPALWASIPCPRSELRLDLVLPSGQSFRWREQSPAHWSGVLADQVWTLTQTEEQLHCTVYRGDKSQASRPTPDELEAVRKYFQLDVTLAQLYHHWGSVDSHFQEVAQKFQGVRLLRQDPIECLFSFICSSNNNIARITGMVERLCQAFGPRLIQLDDVTYHGFPSLQALAGPEVEAHLRKLGLGYRARYVSASARAILEEQGGLAWLQQLRESSYEEAHKALCILPGVGTKVADCICLMALDKPQAVPVDVHMWHIAQRDYSWHPTTSQAKGPSPQTNKELGNFFRSLWGPYAGWAQAAGSDAS

SEQ ID NO: 584 - protein, 593 aa, Homo sapiens
  Payload ID: 101;
  Gene Symbol: AKAP1;
  Gene Name: A kinase (PRKA) anchor prt 1;
  Uniprot ID:  Q92667;
  ENSP ID: ENSP00000314075
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGVAAPPPGKRGTLITRCPGFFEC

SEQ ID NO: 585 - protein, 903 aa, Homo sapiens
  Payload ID: 101;
  Gene Symbol: AKAP1;
  Gene Name: A kinase (PRKA) anchor prt 1;
  Uniprot ID:  Q92667;
  ENSP ID: ENSP00000337736
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 586 - protein, 593 aa, Homo sapiens; identical to SEQ ID NO: 584
  Payload ID: 101;
  Gene Symbol: AKAP1;
  Gene Name: A kinase (PRKA) anchor prt 1;
  Uniprot ID:  Q92667;
  ENSP ID: ENSP00000433212

SEQ ID NO: 587 - protein, 903 aa, Homo sapiens; identical to SEQ ID NO: 585
  Payload ID: 101;
  Gene Symbol: AKAP1;
  Gene Name: A kinase (PRKA) anchor prt 1;
  Uniprot ID:  Q92667;
  ENSP ID: ENSP00000443139

SEQ ID NO: 588 - protein, 137 aa, Homo sapiens
  Payload ID: 101;
  Gene Symbol: AKAP1;
  Gene Name: A kinase (PRKA) anchor prt 1;
  ENSP ID: ENSP00000458164
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTG

SEQ ID NO: 589 - protein, 139 aa, Homo sapiens
  Payload ID: 101;
  Gene Symbol: AKAP1;
  Gene Name: A kinase (PRKA) anchor prt 1;
  ENSP ID: ENSP00000458370
  MOD_RES (1)..(1): Any amino acid
XGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQLASALCSLKISK

SEQ ID NO: 590 - protein, 204 aa, Homo sapiens
  Payload ID: 101;
  Gene Symbol: AKAP1;
  Gene Name: A kinase (PRKA) anchor prt 1;
  ENSP ID: ENSP00000458378
AEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEDLGAEDGWTMDAEADHSGGSDRNSMDSVDSCCSLKKTESFQNAQAGSNPKKVDLIIWEIEVPKHLVGRLIGKQGR

SEQ ID NO: 591 - protein, 7 aa, Homo sapiens
  Payload ID: 101;
  Gene Symbol: AKAP1;
  Gene Name: A kinase (PRKA) anchor prt 1;
  ENSP ID: ENSP00000458982
MAIQFRS

SEQ ID NO: 592 - protein, 182 aa, Homo sapiens
  Payload ID: 101;
  Gene Symbol: AKAP1;
  Gene Name: A kinase (PRKA) anchor prt 1;
  ENSP ID: ENSP00000459521
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGY

SEQ ID NO: 593 - protein, 186 aa, Homo sapiens
  Payload ID: 101;
  Gene Symbol: AKAP1;
  Gene Name: A kinase (PRKA) anchor prt 1;
  ENSP ID: ENSP00000459808
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVP

SEQ ID NO: 594 - protein, 903 aa, Homo sapiens; identical to SEQ ID NO: 585
  Payload ID: 101;
  Gene Symbol: AKAP1;
  Gene Name: A kinase (PRKA) anchor prt 1;
  Uniprot ID:  Q92667;
  ENSP ID: ENSP00000459895

SEQ ID NO: 595 - protein, 903 aa, Homo sapiens; identical to SEQ ID NO: 585
  Payload ID: 101;
  Gene Symbol: AKAP1;
  Gene Name: A kinase (PRKA) anchor prt 1;
  Uniprot ID:  Q92667;
  ENSP ID: ENSP00000459968

SEQ ID NO: 596 - protein, 95 aa, Homo sapiens
  Payload ID: 101;
  Gene Symbol: AKAP1;
  Gene Name: A kinase (PRKA) anchor prt 1;
  ENSP ID: ENSP00000460209
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPAL

SEQ ID NO: 597 - protein, 83 aa, Homo sapiens
  Payload ID: 101;
  Gene Symbol: AKAP1;
  Gene Name: A kinase (PRKA) anchor prt 1;
  ENSP ID: ENSP00000460514
MAIQFRSLFPLALPGMLALLGWWWFFSRKKGHVSSHDEQQVEAGAVQLRADPAIKEPLPVEDVCPKVVSTPPSVTEPPEKELS

SEQ ID NO: 598 - protein, 47 aa, Homo sapiens
  Payload ID: 101;
  Gene Symbol: AKAP1;
  Gene Name: A kinase (PRKA) anchor prt 1;
  ENSP ID: ENSP00000460557
MAIQFRSLFPLALPGMLALLGWWWFFSRKKGHVSSHDEQQVEAGAVQ

SEQ ID NO: 599 - protein, 179 aa, Homo sapiens
  Payload ID: 101;
  Gene Symbol: AKAP1;
  Gene Name: A kinase (PRKA) anchor prt 1;
  ENSP ID: ENSP00000460762
VIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDETGFSIVQFKNK

SEQ ID NO: 600 - protein, 7 aa, Homo sapiens
  Payload ID: 101;
  Gene Symbol: AKAP1;
  Gene Name: A kinase (PRKA) anchor prt 1;
  ENSP ID: ENSP00000461418
MAIQFRS

SEQ ID NO: 601 - protein, 360 aa, Homo sapiens
  Payload ID: 101;
  Gene Symbol: AKAP1;
  Gene Name: A kinase (PRKA) anchor prt 1;
  ENSP ID: ENSP00000461854
LPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVESLTLSPCRFREQKSFWTV

SEQ ID NO: 602 - protein, 903 aa, Homo sapiens; identical to SEQ ID NO: 585
  Payload ID: 101;
  Gene Symbol: AKAP1;
  Gene Name: A kinase (PRKA) anchor prt 1;
  Uniprot ID:  Q92667;
  ENSP ID: ENSP00000478212

SEQ ID NO: 603 - protein, 662 aa, Homo sapiens
  Payload ID: 102;
  Gene Symbol: AKAP10;
  Gene Name: A kinase (PRKA) anchor prt 10;
  Uniprot ID:  O43572;
  ENSP ID: ENSP00000225737
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKVFLPGFLSSNLYYKYLNDLIHSVRGDEFLGGNVSLTAPGSVGPPDESHPGSSDSSASQSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 604 - protein, 604 aa, Homo sapiens
  Payload ID: 102;
  Gene Symbol: AKAP10;
  Gene Name: A kinase (PRKA) anchor prt 10;
  ENSP ID: ENSP00000378907
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLGRSCLDYQTQETKSSLSKTLEQVLHDTIVLPYFIQFMELRRMEHLVKFWLEAESFHSTTWSRIRAHSLNTVKQSSLAEPVSPSKKHETTASFLTDSLDKRLEDSGSAQLFMTHSEGIDLNNRTNSTQNHLLLSQECDSAHSLRLEMARAGTHQVSMETQESSSTLTVASRNSPASPLKELSGKLMKSIEQDAVNTFTKYISPDAAKPIPITEAMRNDIIARICGEDGQVDPNCFVLAQSIVFSAMEQEHFSEFLRSHHFCKYQIEVLTSGTVYLADILFCESALFYFSEYMEKEDAVNILQFWLAADNFQSQLAAKKGQYDGQEAQNDAMILYDKYFSLQATHPLGFDDVVRLEIESNICREGGPLPNCFTTPLRQAWTTMEKSSVKKASIKILKNFDEAIIVDAASLDPESLYQRTYAGKMTFGRVSDLGQFIRESEPEPDVRKSKGSMFSQAMKKWVQGNTDEAQEELAWKIAKMIVSDIMQQAQYDQPLEKSTKL

SEQ ID NO: 605 - protein, 138 aa, Homo sapiens
  Payload ID: 102;
  Gene Symbol: AKAP10;
  Gene Name: A kinase (PRKA) anchor prt 10;
  ENSP ID: ENSP00000458637
MRGAGPSPRQSPRTLRPDPGPAMSFFRRKVKGKEQEKTSDVKSIKALKIMPCWRLQDQVMLQSMPFLPTWTPFQVAGQPHLRSSQATWRPLILVTWADLVWTTRLKRPNQAFLRPLNKSCTTLLSSLTSFNSWNFGEW

SEQ ID NO: 606 - protein, 66 aa, Homo sapiens
  Payload ID: 102;
  Gene Symbol: AKAP10;
  Gene Name: A kinase (PRKA) anchor prt 10;
  ENSP ID: ENSP00000461040
MRGAGPSPRQSPRTLRPDPGPAMSFFRRKVKGKEQEKTSDVKSIKGCRTKSCCNQCHFCQHGLLFK

SEQ ID NO: 607 - protein, 63 aa, Homo sapiens
  Payload ID: 102;
  Gene Symbol: AKAP10;
  Gene Name: A kinase (PRKA) anchor prt 10;
  ENSP ID: ENSP00000461793
MRGAGPSPRQSPRTLRPDPGPAMSFFRRKVKGKEQEKTSDVKSIKVETEFHHVSQYGLDLLTL

SEQ ID NO: 608 - protein, 78 aa, Homo sapiens
  Payload ID: 102;
  Gene Symbol: AKAP10;
  Gene Name: A kinase (PRKA) anchor prt 10;
  ENSP ID: ENSP00000463398
LALLALLMSLTQGVLTALRLRKMTFGRVSDLGQFIRESEPEPDVRKSKGSMFSQAMKKWVQGNTDEAQEELAWKIAKM

SEQ ID NO: 609 - protein, 150 aa, Homo sapiens
  Payload ID: 102;
  Gene Symbol: AKAP10;
  Gene Name: A kinase (PRKA) anchor prt 10;
  ENSP ID: ENSP00000464079
MRGAGPSPRQSPRTLRPDPGPAMSFFRRKVKGKEQEKTSDVKSIKASISVHSPQKSTKNHALLEAAGPSHVAINAISANMDSFSSSRTATLKKQPSHMEAAHFGDLDLVWTTRLKRPNQAFLRPLNKSCTTLLSSLTSFNSWNFGEWSIW

SEQ ID NO: 610 - protein, 59 aa, Homo sapiens
  Payload ID: 102;
  Gene Symbol: AKAP10;
  Gene Name: A kinase (PRKA) anchor prt 10;
  ENSP ID: ENSP00000464294
  MOD_RES (1)..(1): Any amino acid
XKYISPDAAKPIPITEAMRNDIIARICGEDGQVDPNCFVLAQSIVFSAMEQDTWKKRMQ

SEQ ID NO: 611 - protein, 31 aa, Homo sapiens
  Payload ID: 102;
  Gene Symbol: AKAP10;
  Gene Name: A kinase (PRKA) anchor prt 10;
  ENSP ID: ENSP00000466329
  MOD_RES (1)..(1): Any amino acid
XLTAPGSVGPPDESHPGSSDSSASQCEKSQY

SEQ ID NO: 612 - protein, 1901 aa, Homo sapiens
  Payload ID: 103;
  Gene Symbol: AKAP11;
  Gene Name: A kinase (PRKA) anchor prt 11;
  Uniprot ID:  Q9UKA4;
  ENSP ID: ENSP00000025301
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLDPYRNEVSQLYSFSTSLVHSITKDAKEELTASLVGLPKSLTDSCLFEKSGYEEDNECHVTPELPKSLQPSSQNHRFYHSTGSLNGYGCGDNVVQAVEQYAKKVVDDTLELTLGSTVFRVSETTKSADRVTYAEKLSPLTGQACRYCDLKELHNCTGNSSQHFFRQGSLASSKPASNPKFSSRYQKSRIFHLSVPQIHVNLDKKAVLAEKIVAEAIEKAERELSSTSLAADSGIGQEGASFAESLATETMTAAVTNVGHAVSSSKEIEDFQSTESVSSQQMNLSIGDDSTGSWSNLSFEDEHQDESSSFHHLSESNGNSSSWSSLGLEGDLYEDNLSFPTSDSDGPDDKDEEHEDEVEGLGQDGKTLLITNIDMEPCTVDPQLRIILQWLIASEAEVAELYFHDSANKEFMLLSKQLQEKGWKVGDLLQAVLQYYEVMEKASSEERCKSLFDWLLENA

SEQ ID NO: 613 - protein, 1782 aa, Homo sapiens
  Payload ID: 104;
  Gene Symbol: AKAP12;
  Gene Name: A kinase (PRKA) anchor prt 12;
  Uniprot ID:  Q02952;
  ENSP ID: ENSP00000253332
MGAGSSTEQRSPEQPPEGSSTPAEPEPSGGGPSAEAAPDTTADPAIAASDPATKLLQKNGQLSTINGVAEQDELSLQEGDLNGQKGALNGQGALNSQEEEEVIVTEVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 614 - protein, 1684 aa, Homo sapiens
  Payload ID: 104;
  Gene Symbol: AKAP12;
  Gene Name: A kinase (PRKA) anchor prt 12;
  Uniprot ID:  Q02952;
  ENSP ID: ENSP00000346702
MLGTITITVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 615 - protein, 1677 aa, Homo sapiens
  Payload ID: 104;
  Gene Symbol: AKAP12;
  Gene Name: A kinase (PRKA) anchor prt 12;
  Uniprot ID:  Q02952;
  ENSP ID: ENSP00000352794
MVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 616 - protein, 1782 aa, Homo sapiens; identical to SEQ ID NO: 613
  Payload ID: 104;
  Gene Symbol: AKAP12;
  Gene Name: A kinase (PRKA) anchor prt 12;
  Uniprot ID:  Q02952;
  ENSP ID: ENSP00000384537

SEQ ID NO: 617 - protein, 2817 aa, Homo sapiens
  Payload ID: 105;
  Gene Symbol: AKAP13;
  Gene Name: A kinase (PRKA) anchor prt 13;
  Uniprot ID:  Q12802;
  ENSP ID: ENSP00000354718
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 618 - protein, 1434 aa, Homo sapiens
  Payload ID: 105;
  Gene Symbol: AKAP13;
  Gene Name: A kinase (PRKA) anchor prt 13;
  ENSP ID: ENSP00000378018
MYERHKRRYSLCDISKVDRTVDVVLLKINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 619 - protein, 2813 aa, Homo sapiens
  Payload ID: 105;
  Gene Symbol: AKAP13;
  Gene Name: A kinase (PRKA) anchor prt 13;
  Uniprot ID:  Q12802;
  ENSP ID: ENSP00000378026
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 620 - protein, 93 aa, Homo sapiens
  Payload ID: 105;
  Gene Symbol: AKAP13;
  Gene Name: A kinase (PRKA) anchor prt 13;
  ENSP ID: ENSP00000452622
MNIQQQLMKTNLKQMDSLMPLMMTAQDPSSAPETDGQFLPCAPEPTDPQRLSSSEETESTQCCPGSPVAQTESPCDLSSIVEEENTDRSCRKK

SEQ ID NO: 621 - protein, 146 aa, Homo sapiens
  Payload ID: 105;
  Gene Symbol: AKAP13;
  Gene Name: A kinase (PRKA) anchor prt 13;
  ENSP ID: ENSP00000452698
MGLRYSGCLGSHVENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPC

SEQ ID NO: 622 - protein, 275 aa, Homo sapiens
  Payload ID: 105;
  Gene Symbol: AKAP13;
  Gene Name: A kinase (PRKA) anchor prt 13;
  ENSP ID: ENSP00000453205
PSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSMSWCPSGVQYSAGLSADFNYRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGL

SEQ ID NO: 623 - protein, 38 aa, Homo sapiens
  Payload ID: 105;
  Gene Symbol: AKAP13;
  Gene Name: A kinase (PRKA) anchor prt 13;
  ENSP ID: ENSP00000453620
MKLNPQQAPLYGDCVVTVLLAEEDKAEDDVVFYLVFLG

SEQ ID NO: 624 - protein, 179 aa, Homo sapiens
  Payload ID: 105;
  Gene Symbol: AKAP13;
  Gene Name: A kinase (PRKA) anchor prt 13;
  Uniprot ID:  Q12802;
  ENSP ID: ENSP00000453634
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHGENLYDLQTHFKFVIFLLFF

SEQ ID NO: 625 - protein, 1745 aa, Homo sapiens
  Payload ID: 105;
  Gene Symbol: AKAP13;
  Gene Name: A kinase (PRKA) anchor prt 13;
  ENSP ID: ENSP00000453768
MKLNPQQAPLYGDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLMKTNLKQMDSLMPLMMTAQDPSSAPETDGQFLPCAPEPTDPQRLSSSEETESTQCCPGSPVAQTESPCDLSSIVEEENTDRSCRKKNKGVERKGEEVEPAPIVDSGTVSDQDSCLQSLPDCGVKGTEGLSSCGNRNEETGTKSSGMPTDQESLSSGDAVLQRDLVMEPGTAQYSSGGELGGISTTNVSTPDTAGEMEHGLMNPDATVWKNVLQGGESTKERFENSNIGTAGASDVHVTSKPVDKISVPNCAPAASSLDGNKPAESSLAFSNEETSTEKTAETETSRSREESADAPVDQNSVVIPAAAKDKISDGLEPYTLLAAGIGEAMSPSDLALLGLEEDVMPHQNSETNSSHAQSQKGKSSPICSTTGDDKLCADSACQQNTVTSSGDLVAKLCDNIVSESESTTARQPSSQDPPDASHCEDPQAHTVTSDPVRDTQERADFCPFKVVDNKGQRKDVKLDKPLTNMLEVVSHPHPVVPKMEKELVPDQAVISDSTFSLANSPGSESVTKDDALSFVPSQKEKGTATPELHTATDYRDGPDGNSNEPDTRPLEDRAVGLSTSSTAAELQHGMGNTSLTGLGGEHEGPAPPAIPEALNIKGNTDSSLQSVGKATLALDSVLTEEGKLLVVSESSAAQEQDKDKAVTCSSIKENALSSGTLQEEQRTPPPGQDTQQFHEKSISADCAKDKALQLSNSPGASSAFLKAETEHNKEVAPQVSLLTQGGAAQSLVPPGASLATESRQEALGAEHNSSALLPCLLPDGSDGSDALNCSQPSPLDVGVKNTQSQGKTSACEVSGDVTVDVTGVNALQGMAEPRRENISHNTQDILIPNVLLSQEKNAVLGLPVALQDKAVTDPQGVGTPEMIPLDWEKGKLEGADHSCTMGDAEEAQIDDEAHPVLLQPVAKELPTDMELSAHDDGAPAGVREVMRAPPSGRERSTPSLPCMVSAQDAPLPKGADLIEEAASRIVDAVIEQVKAAGALLTEGEACHMSLSSPELGPLTKGLESAFTEKVSTFPPGESLPMGSTPEEATGSLAGCFAGREEPEKIILPVQGPEPAAEMPDVKAEDEVDFRASSISEEVAVGSIAATLKMKQGPMTQAINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSK

SEQ ID NO: 626 - protein, 1429 aa, Homo sapiens
  Payload ID: 105;
  Gene Symbol: AKAP13;
  Gene Name: A kinase (PRKA) anchor prt 13;
  ENSP ID: ENSP00000477780
MLYINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSSMRVLGDVVRRPPIHRRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSENEEEKKMLDTRARELKEQLHQKDQKILLLLEEKEMIFRDMAECSTPLPEDCSPTHSPRVLFRSNTEEALKGGPLMKSAINEVEILQGLVSGNLGGTLGPTVSSPIEQDVVGPVSLPRRAETFGGFDSHQMNASKGGEKEEGDDGQDLRRTESDSGLKKGGNANLVFMLKRNSEQVVQSVVHLYELLSALQGVVLQQDSYIEDQKLVLSERALTRSLSRPSSLIEQEKQRSLEKQRQDLANLQKQQAQYLEEKRRREREWEARERELREREALLAQREEEVQQGQQDLEKEREELQQKKGTYQYDLERLRAAQKQLEREQEQLRREAERLSQRQTERDLCQVSHPHTKLMRIPSFFPSPEEPPSPSAPSIAKSGSLDSELSVSPKRNSISRTHKDKGPFHILSSTSQTNKGPEGQSQAPASTSASTRLFGLTKPKEKKEKKKKNKTSRSQPGDGPASEVSAEGEEIFC

SEQ ID NO: 627 - protein, 166 aa, Homo sapiens
  Payload ID: 105;
  Gene Symbol: AKAP13;
  Gene Name: A kinase (PRKA) anchor prt 13;
  ENSP ID: ENSP00000480789
MSIKWARFHEVPHITVRFIGPKHGEEKEKEKDKIKEKEKDSKDKEKDKKTVNGHTFSSIPVVGPISCSQCMKPFTNKDAYTCANCSAFVHKGCRESLASCAKVKMKQPKGSLQAHDTSSLPTVIMRNKPSQPKERPRSAVLLVDETATTPIFANRRSQQSVSLSKS

SEQ ID NO: 628 - protein, 967 aa, Homo sapiens
  Payload ID: 105;
  Gene Symbol: AKAP13;
  Gene Name: A kinase (PRKA) anchor prt 13;
  ENSP ID: ENSP00000481485
MYERHKRRYSLCDISKVDRTVDVVLLKINRENWCTIEPCPDAASLLASKQSPECENFLDVGLGRECTSKQGVLKRESGSDSDLFHSPSDDMDSIIFPKPEEEHLACDITGSSSSTDDTASLDRHSSHGSDVSLSQILKPNRSRDRQSLDGFYSHGMGAEGRESESEPADPGDVEEEEMDSITEVPANCSVLRSSMRSLSPFRRHSWGPGKNAASDAEMNHRSFSLEGLTGGAGVGNKPSSSLEVSSANAEELRHPFSGEERVDSLVSLSEEDLESDQREHRMFDQQICHRSKQQGFNYCTSAISSPLTKSISLMTISHPGLDNSRPFHSTFHNTSANLTESITEENYNFLPHSPSKKDSEWKSGTKVSRTFSYIKNKMSSSKKSKEKEKEKDKIKEKEKDSKDKEKDKKTVNGHTFSSIPVVGPISCSQCMKPFTNKDAYTCANCSAFVHKGCRESLASCAKVKMKPKGSLQAHDTSSLPTVIMRNKPSQPKERPRSAVLLVDETATTPIFANRRSQQSVSLSKSVSIQNITGVGNDENMSNTWKFLSHSTDSLNKISKVNESTESLTDEGVGTDMNEGQLLGDFEIESKQLEAESWSRIIDSKFLKQQKKDVVKRQEVIYELMQTEFHHVRTLKIMSGVYSQGMMADLLFEQQMVEKLFPCLDELISIHSQFFQRILERKKESLVDKSEKNFLIKRIGDVLVNQFSGENAERLKKTYGKFCGQHNQSVNYFKDLYAKDKRFQAFVKKKMSSSVVRRLGIPECILLVTQRITKYPVLFQRILQCTKDNEVEQEDLAQSLSLVKDVIGAVDSKVASYEKKVRLNEIYTKTDSKSIMRMKSGQMFAKEDLKRKKLVRDGSVFLKNAAGRLKEVQAVLLTDILVFLQEKDQKYIFASLDQKSTVISLKKLIVREVAHEEKGLFLISMGMTDPEMVEVHASSKEERNSWIQIIQDTINTLNRDEDEGIPSE

SEQ ID NO: 629 - protein, 66 aa, Homo sapiens
  Payload ID: 105;
  Gene Symbol: AKAP13;
  Gene Name: A kinase (PRKA) anchor prt 13;
  ENSP ID: ENSP00000482058
MSSSKKSKEKEKEKDKIKEKEKDSKDKEKDKKTVNGHTFSSIPVVGPISCSQCMKPFTNKDAYTCA

SEQ ID NO: 630 - protein, 98 aa, Homo sapiens
  Payload ID: 105;
  Gene Symbol: AKAP13;
  Gene Name: A kinase (PRKA) anchor prt 13;
  ENSP ID: ENSP00000483091
MPDVKAEDEVDFRASSISEEVAVGSIAATLKMKQGPMTQAINRENWCTIEPCPDAASLLASKQSPECENFLDVGLGRECTSKQGVLKRESGSDSDLFH

SEQ ID NO: 631 - protein, 137 aa, Homo sapiens
  Payload ID: 106;
  Gene Symbol: AKAP14;
  Gene Name: A kinase (PRKA) anchor prt 14;
  Uniprot ID:  Q86UN6;
  ENSP ID: ENSP00000334680
MSETQNSTSQKAMDEDNKAASQTMPNTQDKNYEDELTQVALALVEDVINYAVKIVEEERNPLKNIKWMTHGEFTVEKGLKQIDEYFSDAPIVVSYVGDHQALVHRPGMVRFRENWQKNLTDAKYSFMESFPFLFNRV

SEQ ID NO: 632 - protein, 89 aa, Homo sapiens
  Payload ID: 106;
  Gene Symbol: AKAP14;
  Gene Name: A kinase (PRKA) anchor prt 14;
  Uniprot ID:  Q86UN6;
  ENSP ID: ENSP00000360476
MSETQNSTSQKAMDEDNKAASQTMPNTQDKNYEDELTQVALALVEDVINYAVKIVEEERNPLKNIKWMTHGEFTVEKGLKQIDEYFSVS

SEQ ID NO: 633 - protein, 137 aa, Homo sapiens; identical to SEQ ID NO: 631
  Payload ID: 106;
  Gene Symbol: AKAP14;
  Gene Name: A kinase (PRKA) anchor prt 14;
  Uniprot ID:  Q86UN6;
  ENSP ID: ENSP00000360479

SEQ ID NO: 634 - protein, 197 aa, Homo sapiens
  Payload ID: 106;
  Gene Symbol: AKAP14;
  Gene Name: A kinase (PRKA) anchor prt 14;
  Uniprot ID:  Q86UN6;
  ENSP ID: ENSP00000360485
MSETQNSTSQKAMDEDNKAASQTMPNTQDKNYEDELTQVALALVEDVINYAVKIVEEERNPLKNIKWMTHGEFTVEKGLKQIDEYFSKCVSKKCWAHGVEFVERKDLIHSFLYIYYVHWSISTADLPVARISAGTYFTMKVSKTKPPDAPIVVSYVGDHQALVHRPGMVRFRENWQKNLTDAKYSFMESFPFLFNRV

SEQ ID NO: 635 - protein, 695 aa, Homo sapiens
  Payload ID: 107;
  Gene Symbol: AKAP17A;
  Gene Name: A kinase (PRKA) anchor prt 17A;
  Uniprot ID:  Q02040;
  ENSP ID: ENSP00000324827
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKAVKLREQEQKEEKLRLQQQEERRRLQEAELRRVEEEKERALGLQRKERELRERLLSILLSKKPDDSHTHDELGVAHADLLQPVLDILQTVSSGCVSATTLHPLGGQPPAGAPKESPAHPEADGAPKSVNGSVAEEAPCKEVQSSCRVVPEDGSPEKRCPGGVLSCIPDNNQQPKGIPACEQNVSRKDTRSEQDKCNREPSKGRGRATGDGLADRHKRERSRARRASSREDGRPRKERRPHKKHAYKDDSPRRRSTSPDHTRSRRSHSKDRHRRERSRERRGSASRKHSRHRRRSERSRSRSPSRHRSTWNR

SEQ ID NO: 636 - protein, 446 aa, Homo sapiens
  Payload ID: 107;
  Gene Symbol: AKAP17A;
  Gene Name: A kinase (PRKA) anchor prt 17A;
  ENSP ID: ENSP00000370660
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKVPGGSLCSRQPRPGCPQCPPLKCGRRHGAVSPPAAAVATKPALMPRMTAPSREGVALVCRSR

SEQ ID NO: 637 - protein, 385 aa, Homo sapiens
  Payload ID: 107;
  Gene Symbol: AKAP17A;
  Gene Name: A kinase (PRKA) anchor prt 17A;
  Uniprot ID:  Q02040;
  ENSP ID: ENSP00000435479
MAAATIVHDTSEAVELCPAYGLYLKPITKMTISVALPQLKQPGKSISNWEVMERLKGMVQNHQFSTLRISKSTMDFIRFEGEVENKSLVKSFLACLDGKTIKLSGFSDILKVRAAEFKIDFPTRHDWDSFFRDAKDMNETLPGERPDTIHLEGLPCKWFALKESGSEKPSEDVLVKVFEKFGEIRNVDIPMLDPYREEMTGRNFHTFSFGGHLNFEAYVQYREYMGFIQAMSALRGMKLMYKGEDGKAVACNIKVSFDSTKHLSDASIKKRQLERQKLQELEQQREEQKRREKEAEERQRAEERKQKELEELERERKREEKLRKREQKQRDRELRRNQKKLEKLQAEEQKQLQEKIKLEERKLLLAQRNLQSIRLIAELLSRAKL

SEQ ID NO: 638 - protein, 859 aa, Homo sapiens
  Payload ID: 108;
  Gene Symbol: AKAP2;
  Gene Name: A kinase (PRKA) anchor prt 2;
  Uniprot ID:  Q9Y2D5;
  ENSP ID: ENSP00000259318
MEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 639 - protein, 948 aa, Homo sapiens
  Payload ID: 108;
  Gene Symbol: AKAP2;
  Gene Name: A kinase (PRKA) anchor prt 2;
  Uniprot ID:  Q9Y2D5;
  ENSP ID: ENSP00000363649
MRWPQPGAAARLPPESPGPPESPGPPEREAAAARRWTGAEPQDCAPGSGRPEKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSVLEATRVNRRKSALALRWEAGIYANQEEEDNE

SEQ ID NO: 640 - protein, 961 aa, Homo sapiens
  Payload ID: 108;
  Gene Symbol: AKAP2;
  Gene Name: A kinase (PRKA) anchor prt 2;
  Uniprot ID:  Q9Y2D5;
  ENSP ID: ENSP00000404782
MRWPQPGAAARLPPESPGPPESPGPPEREAAAARRWTGAEPQDCAPGSGRPEKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAAQEREEELKRQRQVLQSTQSPRTKNAPSLPSRTCYKTAPGKIEKVKPPPSPTTEGPSLQPDLAPEEAAGTQRPKNLMQTLMEDYETHKSKRRERMDDSSYTSKLLSCKVTSEVLEATRVNRRKSALALRWEAGIYANQEEEDNE

SEQ ID NO: 641 - protein, 778 aa, Homo sapiens
  Payload ID: 108;
  Gene Symbol: AKAP2;
  Gene Name: A kinase (PRKA) anchor prt 2;
  ENSP ID: ENSP00000419268
MIATWMLFSLFTKPPQLSEDDIWLKSEGDNYSATLLEPAASSLSPDHKNMEIEVSVAECKSVPGITSTPHPMDHPSAFYSPPHNGLLTDHHESLDNDVAREIRYLDEVLEANCCDSAVDGTYNGTSSPEPGAVVLVGGLSPPVHEATQPEPTERTASRQAPPHIELSNSSPDPMAEAERTNGHSPSQPRDALGDSLQVPVSPSSTTSSRCSSRDGEFTLTTLKKEAKFELRAFHEDKKPSKLFEDDEHEKEQYCIRKVRPSEEMLELEKERRELIRSQAVKKNPGIAAKWWNPPQEKTIEEQLDEEHLESHKKYKERKERRAQQEQLLLQKQLQQQQQQPPSQLCTAPASSHERASMIDKAKEDIVTEQIDFSAARKQFQLMENSRQAVAKGQSTPRLFSIKPFYRPLGSVNSDKPLTNPRPPSVGGPPEDSGASAAKGQKSPGALETPSAAGSQGNTASQGKEGPYSEPSKRGPLSKLWAEDGEFTSARAVLTVVKDDDHGILDQFSRSVNVSLTQEELDSGLDELSVRSQDTTVLETLSNDFSMDNISDSGASNETTNALQENSLADFSLPQTPQTDNPSEGRGEGVSKSFSDHGFYSPSSTLGDSPLVDDPLEYQAGLLVQNAIQQAIAEQVDKAVSKTSRDGAEQQGPEATVEEAEAAAFGSEKPQSMFEPPQVSSPVQEKRDVLPKILPAEDRALRERGPPQPLPAVQPSGPINMEETRPEGSYFSKYSEAAELRSTASLLATQESDVMVGPFKLRSRKQRTLSMIEEEIRAA

SEQ ID NO: 642 - protein, 54 aa, Homo sapiens
  Payload ID: 108;
  Gene Symbol: AKAP2;
  Gene Name: A kinase (PRKA) anchor prt 2;
  ENSP ID: ENSP00000419364
MRWPQPGAAARLPPESPGPPESPGPPEREAAAARRWTGAEPQDCAPGSGRPEGK

SEQ ID NO: 643 - protein, 853 aa, Homo sapiens
  Payload ID: 109;
  Gene Symbol: AKAP3;
  Gene Name: A kinase (PRKA) anchor prt 3;
  Uniprot ID:  O75969;
  ENSP ID: ENSP00000228850
MSEKVDWLQSQNGVCKVDVYSPGDNQAQDWKMDTSTDPVRVLSWLRRDLEKSTAEFQDVRFKPGESFGGETSNSGDPHKGFSVDYYNTTTKGTPERLHFEMTHKEIPCQGPRAQLGNGSSVDEVSFYANRLTNLVIAMARKEINEKIDGSENKCVYQSLYMGNEPTPTKSLSKIASELVNETVSACSRNAAPDKAPGSGDRVSGSSQSPPNLKYKSTLKIKESTKERQGPDDKPPSKKSFFYKEVFESRNGDYAREGGRFFPRERKRFRGQERPDDFTASVSEGIMTYANSVVSDMMVSIMKTLKIQVKDTTIATILLKKVLLKHAKEVVSDLIDSFLRNLHSVTGTLMTDTQFVSAVKRTVFSHGSQKATDIMDAMLRKLYNVMFAKKVPEHVRKAQDKAESYSLISMKGMGDPKNRNVNFAMKSETKLREKMYSEPKSEEETCAKTLGEHIIKEGLTLWHKTQQKECKSLGFQHAAFEAPNTQRKPASDISFEYPEDIGNLSLPPYPPEKPENFMYDSDSWAEDLIVSALLLIQYHLAQGGRRDARSFVEAAGTTNFPANEPPVAPDESCLKSAPIVGDQEQAEKKDLRSVFFNFIRNLLSETIFKRDQSPEPKVPEQPVKEDRKLCERPLASSPPRLYEDDETPGALSGLTKMAVSQIDGHMSGQMVEHLMNSVMKLCVIIAKSCDASLAELGDDKSGDASRLTSAFPDSLYECLPAKGTGSAEAVLQNAYQAIHNEMRGTSGQPPEGCAAPTVIVSNHNLTDTVQNKQLQAVLQWVAASELNVPILYFAGDDEGIQEKLLQLSAAAVDKGCSVGEVLQSVLRYEKERQLNEAVGNVTPLQLLDWLMVNL

SEQ ID NO: 644 - protein, 96 aa, Homo sapiens
  Payload ID: 109;
  Gene Symbol: AKAP3;
  Gene Name: A kinase (PRKA) anchor prt 3;
  ENSP ID: ENSP00000439382
MSEKVDWLQSQNGVCKVDVYSPGDNQAQDWKMDTSTDPVRVLSWLRRDLEKSTAEFQDVRFKPGESFGGETSNSGDPHKGFSVDYYNTTTKGTPER

SEQ ID NO: 645 - protein, 853 aa, Homo sapiens; identical to SEQ ID NO: 643
  Payload ID: 109;
  Gene Symbol: AKAP3;
  Gene Name: A kinase (PRKA) anchor prt 3;
  Uniprot ID:  O75969;
  ENSP ID: ENSP00000440994

SEQ ID NO: 646 - protein, 161 aa, Homo sapiens
  Payload ID: 109;
  Gene Symbol: AKAP3;
  Gene Name: A kinase (PRKA) anchor prt 3;
  ENSP ID: ENSP00000442376
MSEKVDWLQSQNGVCKVDVYSPGDNQAQDWKMDTSTDPVRVLSWLRRDLEKSTAEFQDVRFKPGESFGGETSNSGDPHKGFSVDYYNTTTKGTPERLHFEMTHKEIPCQGPRAQLGNGSSVDEVSFYANRLTNLVIAMARKEINEKIDGSENKCVYQSLYM

SEQ ID NO: 647 - protein, 854 aa, Homo sapiens
  Payload ID: 110;
  Gene Symbol: AKAP4;
  Gene Name: A kinase (PRKA) anchor prt 4;
  Uniprot ID:  Q5JQC9;
  ENSP ID: ENSP00000351327
MMAYSDTTMMSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 648 - protein, 845 aa, Homo sapiens
  Payload ID: 110;
  Gene Symbol: AKAP4;
  Gene Name: A kinase (PRKA) anchor prt 4;
  Uniprot ID:  Q5JQC9;
  ENSP ID: ENSP00000365232
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISPRTPASKIASEMAYEAVELTAAEMRGTGEESREGGQKSFLYSELSNKSKSGDKQMSQRESKEFADSISKGLMVYANQVASDMMVSLMKTLKVHSSGKPIPASVVLKRVLLRHTKEIVSDLIDSCMKNLHNITGVLMTDSDFVSAVKRNLFNQWKQNATDIMEAMLKRLVSALIGEEKETKSQSLSYASLKAGSHDPKCRNQSLEFSTMKAEMKERDKGKMKSDPCKSLTSAEKVGEHILKEGLTIWNQKQGNSCKVATKACSNKDEKGEKINASTDSLAKDLIVSALKLIQYHLTQQTKGKDTCEEDCPGSTMGYMAQSTQYEKCGGGQSAKALSVKQLESHRAPGPSTCQKENQHLDSQKMDMSNIVLMLIQKLLNENPFKCEDPCEGENKCSEPRASKAASMSNRSDKAEEQCQEHQELDCTSGMKQANGQFIDKLVESVMKLCLIMAKYSNDGAALAELEEQAASANKPNFRGTRCIHSGAMPQNYQDSLGHEVIVNNQCSTNSLQKQLQAVLQWIAASQFNVPMLYFMGDKDGQLEKLPQVSAKAAEKGYSVGGLLQEVMKFAKERQPDEAVGKVARKQLLDWLLANL

SEQ ID NO: 649 - protein, 213 aa, Homo sapiens
  Payload ID: 110;
  Gene Symbol: AKAP4;
  Gene Name: A kinase (PRKA) anchor prt 4;
  ENSP ID: ENSP00000402403
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQNTCEEDCPGSTMGYMAQSTQYEKCGGGQSAKAL

SEQ ID NO: 650 - protein, 254 aa, Homo sapiens
  Payload ID: 110;
  Gene Symbol: AKAP4;
  Gene Name: A kinase (PRKA) anchor prt 4;
  ENSP ID: ENSP00000412279
MSDDIDWLRSHRGVCKVDLYNPEGQQDQDRKVICFVDVSTLNVEDKDYKDAASSSSEGNLNLGSLEEKEIIVIKDTEKKDQSKTEGSVCLFKQAPSDPVSVLNWLLSDLQKYALGFQHALSPSTSTCKHKVGDTEGEYHRASSENCYSVYADQVNIDYLMNRPQNLRLEMTAAKNTNNNQSPSAPPAKPPSTQRAVISPDGECSIDDLSFYVNRLSSLVIQMAHKEIKEKLEGKSKCLHHSICPSPGNKERISP

SEQ ID NO: 651 - protein, 427 aa, Homo sapiens
  Payload ID: 111;
  Gene Symbol: AKAP5;
  Gene Name: A kinase (PRKA) anchor prt 5;
  Uniprot ID:  P24588;
  ENSP ID: ENSP00000315615
METTISEIHVENKDEKRSAEGSPGAERQKEKASMLCFKRRKKAAKALKPKAGSEAADVARKCPQEAGASDQPEPTRGAWASLKRLVTRRKRSESSKQQKPLEGEMQPAINAEDADLSKKKAKSRLKIPCIKFPRGPKRSNHSKIIEDSDCSIKVQEEAEILDIQTQTPLNDQATKAKSTQDLSEGISRKDGDEVCESNVSNSTTSGEKVISVELGLDNGHSAIQTGTLILEEIETIKEKQDVQPQQASPLETSETDHQQPVLSDVPPLPAIPDQQIVEEASNSTLESAPNGKDYESTEIVAEETKPKDTELSQESDFKENGITEEKSKSEESKRMEPIAIIITDTEISEFDVTKSKNVPKQFLISAENEQVGVFANDNGFEDRTSEQYETLLIETASSLVKNAIQLSIEQLVNEMASDDNKINNLLQ

SEQ ID NO: 652 - protein, 427 aa, Homo sapiens; identical to SEQ ID NO: 651
  Payload ID: 111;
  Gene Symbol: AKAP5;
  Gene Name: A kinase (PRKA) anchor prt 5;
  Uniprot ID:  P24588;
  ENSP ID: ENSP00000378207

SEQ ID NO: 653 - protein, 2319 aa, Homo sapiens
  Payload ID: 112;
  Gene Symbol: AKAP6;
  Gene Name: A kinase (PRKA) anchor prt 6;
  Uniprot ID:  Q13023;
  ENSP ID: ENSP00000280979
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKDICEDISDHVEQIHALLETEFSLKLLSYSVNVIVDIHAVQLLWHQLRVSVLVLRERILQGLQDANGNYTRQTDILQAFSEETKEGRLDSLTEVDDSGQLTIKCSQNYLSLDCGITAFELSDYSPSEDLLSGLGDMTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLLSKHKSKKGQASSPSHVTRNGEVVEAWYGSDEYLALPSHLKQTEVLALKLENLTKLLPQKPRGETIQNIDDWELSEMNSDSEIYPTYHVKKKHTRLGRVSPSSSSDIASSLGESIESGPLSDILSDEESSMPLAGMKKYADEKSERASSSEKNESHSATKSALIQKLMQDIQHQDNYEAIWEKIEGFVNKLDEFIQWLNEAMETTENWTPPKAEMDDLKLYLETHLSFKLNVDSHCALKEAVEEEGHQLLELIASHKAGLKDMLRMIASQWKELQRQIKRQHSWILRALDTIKAEILATDVSVEDEEGTGSPKAEVQLCYLEAQRDAVEQMSLKLYSEQYTSSSKRKEEFADMSKVHSVGSNGLLDFDSEYQELWDWLIDMESLVMDSHDLMMSEEQQQHLYKRYSVEMSIRHLKKTELLSKVEALKKGGVLLPNDLLEKVDSINEKWELLGKTLGEKIQDTMAGHSGSSPRDLLSPESGSLVRQLEVRIKELKGWLRDTELFIFNSCLRQEKEGTMNTEKQLQYFKSLCREIKQRRRGVASILRLCQHLLDDRETCNLNADHQPMQLIIVNLERRWEAIVMQAVQWQTRLQKKMGKESETLNVIDPGLMDLNGMSEDALEWDEMDISNKLISLNEESNDLDQELQPVIPSLKLGETSNEDPGYDEEADNHGGSQYASNITAPSSPHIYQVYSLHNVELYEDNHMPFLKNNPKVTGMTQPNVLTKSLSKDSSFSSTKSLPDLLGGSNLVKPCACHGGDMSQNSGSESGIVSEGDTETTTNSEMCLLNAVDGSPSNLETEHLDPQMGDAVNVLKQKFTDEGESIKLPNSSQSSISPVGCVNGKVGDLNSITKHTPDCLGEELQGKHDVFTFYDYSYLQGSKLKLPMIMKQSQSEKAHVEDPLLRGFYFDKKSCKSKHQTTELQPDVPPHERILASASHEMDRISYKSGNIEKTFTGMQNAKQLSLLSHSSSIESLSPGGDLFGLGIFKNGSDSLQRSTSLESWLTSYKSNEDLFSCHSSGDISVSSGSVGELSKRTLDLLNRLENIQSPSEQKIKRSVSDITLQSSSQKMSFTGQMSLDIASSINEDSAASLTELSSSDELSLCSEDIVLHKNKIPESNASFRKRLTRSVADESDVNVSMIVNVSCTSACTDDEDDSDLLSSSTLTLTEEELCIKDEDDDSSIATDDEIYEDCTLMSGLDYIKNELQTWIRPKLSLTRDKKRCNVSDEMKGSKDISSSEMTNPSDTLNIETLLNGSVKRVSENNGNGKNSSHTHELGTKRENKKTIFKVNKDPYVADMENGNIEGIPERQKGKPNVTSKVSENLGSHGKEISESEHCKCKALMDSLDDSNTAGKEFVSQDVRHLPKKCPNHHHFENQSTASTPTEKSFSELALETRFNNRQDSDALKSSDDAPSMAGKSAGCCLALEQNGTEENASISNISCCNCEPDVFHQKDAEDCSVHNFVKEIIDMASTALKSKSQPENEVAAPTSLTQIKEKVLEHSHRPIQLRKGDFYSYLSLSSHDSDCGEVTNYIEEKSSTPLPLDTTDSGLDDKEDIECFFEACVEGDSDGEEPCFSSAPPNESAVPSEAAMPLQATACSSEFSDSSLSADDADTVALSSPSSQERAEVGKEVNGLPQTSSGCAENLEFTPSKLDSEKESSGKPGESGMPEEHNAASAKSKVQDLSLKANQPTDKAALHPSPKTLTCEENLLNLHEKRHRNMHR

SEQ ID NO: 654 - protein, 1075 aa, Homo sapiens
  Payload ID: 112;
  Gene Symbol: AKAP6;
  Gene Name: A kinase (PRKA) anchor prt 6;
  Uniprot ID:  Q13023;
  ENSP ID: ENSP00000450531
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKDICEDISDHVEQIHALLETEFSLKLLSYSVNVIVDIHAVQLLWHQLRVSVLVLRERILQGLQDANGNYTRQTDILQAFSEETKEGRLDSLTEVDDSGQLTIKCSQNYLSLDCGITAFELSDYSPSEDLLSGLGDMTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLLSKHKSKKGQASSPSHVTRNGEVVEAWYGSDEYLALPSHLKQTEVLALKLENLTKLLPQKPRGETIQNIDDWELSEMNSDSEIYPTYHVKKKHTRLGRVSPSSSSDIASSLGESIESGPLSDILSDEESSMPLAGMKKYADEKSERASSSEKNESHSATKSALIQKLMQDIQHQDNYEAIWEKIEGFVNKLDEFIQWLNEAMETTENWTPPKAEMDDLKLYLETHLSFKLNVDSHCALKEAVEEEGHQLLELIASHKAGLKDMLRMIASQWKELQRQIKRQHSWILRALDTIKAEILATDVSVEDEEGTGSPKAEVQLCYLEAQRDAVEQMSLKLYSEQYTSSSKRKEEFADMSKVHSVGSNGLLDFDSEYQELWDWLIDMESLVMDSHDLMMSEEQQQHLYKRYSVEMSIRHLKKTELLSKVEALKKGGVLLPNDLLEKVDSINEKWELLGVFAFLLLFVGYVYIFCVVKYSVRFLI

SEQ ID NO: 655 - protein, 108 aa, Homo sapiens
  Payload ID: 112;
  Gene Symbol: AKAP6;
  Gene Name: A kinase (PRKA) anchor prt 6;
  ENSP ID: ENSP00000451146
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLK

SEQ ID NO: 656 - protein, 356 aa, Homo sapiens
  Payload ID: 112;
  Gene Symbol: AKAP6;
  Gene Name: A kinase (PRKA) anchor prt 6;
  ENSP ID: ENSP00000451239
MTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLL

SEQ ID NO: 657 - protein, 25 aa, Homo sapiens
  Payload ID: 112;
  Gene Symbol: AKAP6;
  Gene Name: A kinase (PRKA) anchor prt 6;
  ENSP ID: ENSP00000451246
MTSSQVKTKPFDSWSYSEMEKEFPE

SEQ ID NO: 658 - protein, 1245 aa, Homo sapiens
  Payload ID: 112;
  Gene Symbol: AKAP6;
  Gene Name: A kinase (PRKA) anchor prt 6;
  ENSP ID: ENSP00000451247
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKDICEDISDHVEQIHALLETEFSLKLLSYSVNVIVDIHAVQLLWHQLRVSVLVLRERILQGLQDANGNYTRQTDILQAFSEETKEGRLDSLTEVDDSGQLTIKCSQNYLSLDCGITAFELSDYSPSEDLLSGLGDMTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLLSKHKSKKGQASSPSHVTRNGEVVEAWYGSDEYLALPSHLKQTEVLALKLENLTKLLPQKPRGETIQNIDDWELSEMNSDSEIYPTYHVKKKHTRLGRVSPSSSSDIASSLGESIESGPLSDILSDEESSMPLAGMKKYADEKSERASSSEKNESHSATKSALIQKLMQDIQHQDNYEAIWEKIEGFVNKLDEFIQWLNEAMETTENWTPPKAEMDDLKLYLETHLSFKLNVDSHCALKEAVEEEGHQLLELIASHKAGLKDMLRMIASQWKELQRQIKRQHSWILRALDTIKAEILATDVSVEDEEGTGSPKAEVQLCYLEAQRDAVEQMSLKLYSEQYTSSSKRKEEFADMSKVHSVGSNGLLDFDSEYQELWDWLIDMESLVMDSHDLMMSEEQQQHLYKRYSVEMSIRHLKKTELLSKVEALKKGGVLLPNDLLEKVDSINEKWELLGKTLGEKIQDTMAGHSGSSPRDLLSPESGSLVRQLEVRIKELKGWLRDTELFIFNSCLRQEKEGTMNTEKQLQYFKSLCREIKQRRRGVASILRLCQHLLDDRETCNLNADHQPMQLIIVNLERRWEAIVMQAVQWQTRLQKKMGKESIRLAATQGWPHPPALGWPLVPSRLSLPFITLTSPKMNLPSKCVFSTQAL

SEQ ID NO: 659 - protein, 118 aa, Homo sapiens
  Payload ID: 112;
  Gene Symbol: AKAP6;
  Gene Name: A kinase (PRKA) anchor prt 6;
  ENSP ID: ENSP00000452109
  MOD_RES (1)..(1): Any amino acid
XNTEKQLQYFKSLCREIKQRRRGVASILRLCQHLLDDRETCNLNADHQPMQLIIVNLERRWEAIVMQAVQWQTRLQKKMGKESVSDAFFKHNCLSFSQTKNNSFRLGNGVHLINGFTN

SEQ ID NO: 660 - protein, 47 aa, Homo sapiens
  Payload ID: 112;
  Gene Symbol: AKAP6;
  Gene Name: A kinase (PRKA) anchor prt 6;
  ENSP ID: ENSP00000452204
MTSSQVKTKPFDSWSYSEMEKEFPELIRSVGLLTVAADSISTNGSEA

SEQ ID NO: 661 - protein, 84 aa, Homo sapiens
  Payload ID: 113;
  Gene Symbol: AKAP7;
  Gene Name: A kinase (PRKA) anchor prt 7;
  ENSP ID: ENSP00000263050
MLKKKQSNGYYHCESSIVIGEKNGGEPDDAELVRLSKRLVENAVLKAVQQYLEETQNKNKPGEGSSVKTEAADQNGNDNENNRK

SEQ ID NO: 662 - protein, 81 aa, Homo sapiens
  Payload ID: 113;
  Gene Symbol: AKAP7;
  Gene Name: A kinase (PRKA) anchor prt 7;
  Uniprot ID:  O43687;
  ENSP ID: ENSP00000345149
MGQLCCFPFSRDEGKISEKNGGEPDDAELVRLSKRLVENAVLKAVQQYLEETQNKNKPGEGSSVKTEAADQNGNDNENNRK

SEQ ID NO: 663 - protein, 348 aa, Homo sapiens
  Payload ID: 113;
  Gene Symbol: AKAP7;
  Gene Name: A kinase (PRKA) anchor prt 7;
  Uniprot ID:  Q9P0M2;
  ENSP ID: ENSP00000405252
MERPEAGGINSNECENVSRKKKMSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGEKNGGEPDDAELVRLSKRLVENAVLKAVQQYLEETQNKNKPGEGSSVKTEAADQNGNDNENNRK

SEQ ID NO: 664 - protein, 104 aa, Homo sapiens
  Payload ID: 113;
  Gene Symbol: AKAP7;
  Gene Name: A kinase (PRKA) anchor prt 7;
  Uniprot ID:  O43687;
  ENSP ID: ENSP00000418208
MGQLCCFPFSRDEGKISELESSSSAVLQRYSKDIPSWSSGEKNGGEPDDAELVRLSKRLVENAVLKAVQQYLEETQNKNKPGEGSSVKTEAADQNGNDNENNRK

SEQ ID NO: 665 - protein, 350 aa, Homo sapiens
  Payload ID: 113;
  Gene Symbol: AKAP7;
  Gene Name: A kinase (PRKA) anchor prt 7;
  ENSP ID: ENSP00000441048
MERPEAGINSNECENVSRKKKMSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGKKPIGIRDLINEALHRETMGLKSKVKQIKELLLKPETQARIRRELFEGRLINNSNSANDVDFSTTLT

SEQ ID NO: 666 - protein, 51 aa, Homo sapiens
  Payload ID: 113;
  Gene Symbol: AKAP7;
  Gene Name: A kinase (PRKA) anchor prt 7;
  ENSP ID: ENSP00000445486
  MOD_RES (1)..(1): Any amino acid
XTDEPQINLKRSQENEWVKSDQVKKRKKKRKDYQPNYFLSIPITNKERSRC

SEQ ID NO: 667 - protein, 87 aa, Homo sapiens
  Payload ID: 113;
  Gene Symbol: AKAP7;
  Gene Name: A kinase (PRKA) anchor prt 7;
  ENSP ID: ENSP00000446022
MLKKKQSNGYYHCESSIVIGKKPIGIRDLINEALHRETMGLKSKVKQIKELLLKPETQARIRRELFEGRLINNSNSANDVDFSTTLT

SEQ ID NO: 668 - protein, 692 aa, Homo sapiens
  Payload ID: 114;
  Gene Symbol: AKAP8;
  Gene Name: A kinase (PRKA) anchor prt 8;
  Uniprot ID:  O43823;
  ENSP ID: ENSP00000269701
MDQGYGGYGAWSAGPANTQGAYGTGVASWQGYENYNYYGAQNTSVTTGATYSYGPASWEAAKANDGGLAAGAPAMHMASYGPEPCTDNSDSLIAKINQRLDMMSKEGGRGGSGGGGEGIQDRESSFRFQPFESYDSRPCLPEHNPYRPSYSYDYEFDLGSDRNGSFGGQYSECRDPARERGSLDGFMRGRGQGRFQDRSNPGTFMRSDPFVPPAASSEPLSTPWNELNYVGGRGLGGPSPSRPPPSLFSQSMAPDYGVMGMQGAGGYDSTMPYGCGRSQPRMRDRDRPKRRGFDRFGPDGTGRKRKQFQLYEEPDTKLARVDSEGDFSENDDAAGDFRSGDEEFKGEDELCDSGRQRGEKEDEDEDVKKRREKQRRRDRTRDRAADRIQFACSVCKFRSFDDEEIQKHLQSKFHKETLRFISTKLPDKTVEFLQEYIVNRNKKIEKRRQELMEKETAKPKPDPFKGIGQEHFFKKIEAAHCLACDMLIPAQPQLLQRHLHSVDHNHNRRLAAEQFKKTSLHVAKSVLNNRHIVKMLEKYLKGEDPFTSETVDPEMEGDDNLGGEDKKETPEEVAADVLAEVITAAVRAVDGEGAPAPESSGEPAEDEGPTDTAEAGSDPQAEQLLEEQVPCGTAHEKGVPKARSEAAEAGNGAETMAAEAESAQTRVAPAPAAADAEVEQTDAESKDAVPTE

SEQ ID NO: 669 - protein, 133 aa, Homo sapiens
  Payload ID: 114;
  Gene Symbol: AKAP8;
  Gene Name: A kinase (PRKA) anchor prt 8;
  ENSP ID: ENSP00000468902
MDQGYGGYGAWSAGPANTQGAYGTGVASWQAPSASSRSSPMTPGPACRSTTPTAPATATTMSSTWGPTAMAALGGSTVNAETQPGSGAPLMASCGAGARAASRTGATLAPSCAATPSCPPLRPLSPCPRPGTS

SEQ ID NO: 670 - protein, 178 aa, Homo sapiens
  Payload ID: 114;
  Gene Symbol: AKAP8;
  Gene Name: A kinase (PRKA) anchor prt 8;
  ENSP ID: ENSP00000469908
  MOD_RES (1)..(1): Any amino acid
XRGRGQGRFQDRSNPGTFMRSDPFVPPAASSEPLSTPWNELNYVGGRGLGGPSPSRPPPSLFSQSMAPDYGVMGMQGAGGYDSTMPYGCGRSQPRMRDRDRPKRRGFDRFGPDGTGRKRKQFQLYEEPDTKLARVDSEGDFSENDDAAGDFRSGDEEFKGEDELCDSGRQRGPATYPG

SEQ ID NO: 671 - protein, 646 aa, Homo sapiens
  Payload ID: 115;
  Gene Symbol: AKAP8L;
  Gene Name: A kinase (PRKA) anchor prt 8-like;
  Uniprot ID:  Q9ULX6;
  ENSP ID: ENSP00000380557
MSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIQQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 672 - protein, 162 aa, Homo sapiens
  Payload ID: 115;
  Gene Symbol: AKAP8L;
  Gene Name: A kinase (PRKA) anchor prt 8-like;
  ENSP ID: ENSP00000470067
MSYTGFVQGSETTLQSTYSDTSAQPTCDYGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGN

SEQ ID NO: 673 - protein, 66 aa, Homo sapiens
  Payload ID: 115;
  Gene Symbol: AKAP8L;
  Gene Name: A kinase (PRKA) anchor prt 8-like;
  ENSP ID: ENSP00000470906
MSYTGFVQGSETTLQSTYSDTSAQPTCDYGYGTWNSGTNRGYEGYGYGYGYGQDNTTNYGYELTSA

SEQ ID NO: 674 - protein, 161 aa, Homo sapiens
  Payload ID: 115;
  Gene Symbol: AKAP8L;
  Gene Name: A kinase (PRKA) anchor prt 8-like;
  ENSP ID: ENSP00000470912
MSYTGFVQGSETTLQSTYSDTSAQPTCDYDTLVSVFVSVSVCLPSACPHHLSVSVSLTAGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRS

SEQ ID NO: 675 - protein, 585 aa, Homo sapiens
  Payload ID: 115;
  Gene Symbol: AKAP8L;
  Gene Name: A kinase (PRKA) anchor prt 8-like;
  Uniprot ID:  Q9ULX6;
  ENSP ID: ENSP00000470952
MSYTGFVQGSETTLQSTYSDTSAQPTCDYGYGTWNSGTNRGYEGYGYGYGYGQDNTTNYGYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIQQIYRDQDLTQEIAMEHFVKKVEAAHCAACDLFIPMQFGIIQKHLKTMDHNRNRRLMMEQSKKSSLMVARSILNNKLISKKLERYLKGENPFTDSPEEEKEQEEAEGGALDEGAQGEAAGISEGAEGVPAQPPVPPEPAPGAVSPPPPPPPEEEEEGAVPLLGGALQRQIRGIPGLDVEDDEEGGGGAP

SEQ ID NO: 676 - protein, 45 aa, Homo sapiens
  Payload ID: 115;
  Gene Symbol: AKAP8L;
  Gene Name: A kinase (PRKA) anchor prt 8-like;
  ENSP ID: ENSP00000471958
MSYTGFVQGSETTLQSTYSDTSAQPTCDYGYGTWNSGTNRELTSA

SEQ ID NO: 677 - protein, 109 aa, Homo sapiens
  Payload ID: 115;
  Gene Symbol: AKAP8L;
  Gene Name: A kinase (PRKA) anchor prt 8-like;
  ENSP ID: ENSP00000472188
MATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMR

SEQ ID NO: 678 - protein, 431 aa, Homo sapiens
  Payload ID: 115;
  Gene Symbol: AKAP8L;
  Gene Name: A kinase (PRKA) anchor prt 8-like;
  ENSP ID: ENSP00000477434
MSYTGFVQGSETTLQSTYSDTSAQPTCDYGYGTWNSGTNRGYEGYGYGYGYGQDNTTNYGINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERAPALALASSASDSCSCWTFLSLAGARPLGSPDKADPVAQIRTSGRGSSLCVLCANTGPSMRTRWPAILTASSTRNTLST

SEQ ID NO: 679 - protein, 3907 aa, Homo sapiens
  Payload ID: 116;
  Gene Symbol: AKAP9;
  Gene Name: A kinase (PRKA) anchor prt 9;
  Uniprot ID:  Q99996;
  ENSP ID: ENSP00000348573
MEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 680 - protein, 3126 aa, Homo sapiens
  Payload ID: 116;
  Gene Symbol: AKAP9;
  Gene Name: A kinase (PRKA) anchor prt 9;
  ENSP ID: ENSP00000350813
MEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQGMLYDKLIWLHKQVKRFHFVFFLIIIKLKHIFLVTFSSHSHNVKDTIYINYSRG

SEQ ID NO: 681 - protein, 3910 aa, Homo sapiens
  Payload ID: 116;
  Gene Symbol: AKAP9;
  Gene Name: A kinase (PRKA) anchor prt 9;
  ENSP ID: ENSP00000351922
MEDEERQKKLEAGKAKVGEPEGYFLFSLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEVFGFYNMCFSTLCDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 682 - protein, 1769 aa, Homo sapiens
  Payload ID: 116;
  Gene Symbol: AKAP9;
  Gene Name: A kinase (PRKA) anchor prt 9;
  ENSP ID: ENSP00000378042
EKLEFRVRELEQALLVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGALSLTTSWQHHSARPTAPLSLKFFHTH

SEQ ID NO: 683 - protein, 314 aa, Homo sapiens
  Payload ID: 116;
  Gene Symbol: AKAP9;
  Gene Name: A kinase (PRKA) anchor prt 9;
  ENSP ID: ENSP00000378065
MEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMVCLF

SEQ ID NO: 684 - protein, 232 aa, Homo sapiens
  Payload ID: 116;
  Gene Symbol: AKAP9;
  Gene Name: A kinase (PRKA) anchor prt 9;
  ENSP ID: ENSP00000391704
PSKKQKKKRKTSSSKHDVSAHHDLNIDQSQCNEMYINSSQRVESTVIPESTIMRTLHSGEITSHEQGFSVELESEISTTADDCSSEEEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQD

SEQ ID NO: 685 - protein, 318 aa, Homo sapiens
  Payload ID: 116;
  Gene Symbol: AKAP9;
  Gene Name: A kinase (PRKA) anchor prt 9;
  ENSP ID: ENSP00000406937
  MOD_RES (1)..(1): Any amino acid
XHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQGMLYDKLIWLHKQVKRFHFVFFLIIIKLKHIFLVTFSSHSHNVKDTIYINYSRG

SEQ ID NO: 686 - protein, 1637 aa, Homo sapiens
  Payload ID: 116;
  Gene Symbol: AKAP9;
  Gene Name: A kinase (PRKA) anchor prt 9;
  ENSP ID: ENSP00000480807
MEDEERQKKLEAGKAKVGELIFFFLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQTRRD

SEQ ID NO: 687 - protein, 183 aa, Homo sapiens
  Payload ID: 117;
  Gene Symbol: AKIP1;
  Gene Name: A kinase (PRKA) interacting prt 1;
  Uniprot ID:  Q9NQ31;
  ENSP ID: ENSP00000299576
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 688 - protein, 210 aa, Homo sapiens
  Payload ID: 117;
  Gene Symbol: AKIP1;
  Gene Name: A kinase (PRKA) interacting prt 1;
  Uniprot ID:  Q9NQ31;
  ENSP ID: ENSP00000310459
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFPV

SEQ ID NO: 689 - protein, 183 aa, Homo sapiens
  Payload ID: 117;
  Gene Symbol: AKIP1;
  Gene Name: A kinase (PRKA) interacting prt 1;
  Uniprot ID:  Q9NQ31;
  ENSP ID: ENSP00000310644
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQAENISKDLYIEVYPGTYSVTVGSNDLTKKTHVVAVDSGQSVDLVFPV

SEQ ID NO: 690 - protein, 183 aa, Homo sapiens; identical to SEQ ID NO: 687
  Payload ID: 117;
  Gene Symbol: AKIP1;
  Gene Name: A kinase (PRKA) interacting prt 1;
  Uniprot ID:  Q9NQ31;
  ENSP ID: ENSP00000379885

SEQ ID NO: 691 - protein, 210 aa, Homo sapiens; identical to SEQ ID NO: 688
  Payload ID: 117;
  Gene Symbol: AKIP1;
  Gene Name: A kinase (PRKA) interacting prt 1;
  Uniprot ID:  Q9NQ31;
  ENSP ID: ENSP00000431331

SEQ ID NO: 692 - protein, 151 aa, Homo sapiens
  Payload ID: 117;
  Gene Symbol: AKIP1;
  Gene Name: A kinase (PRKA) interacting prt 1;
  ENSP ID: ENSP00000431602
AAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQAENISKDLYIEVYPGTYSVTVGSNDLTKKTHVVAVDSGQSVDLVFPV

SEQ ID NO: 693 - protein, 195 aa, Homo sapiens
  Payload ID: 117;
  Gene Symbol: AKIP1;
  Gene Name: A kinase (PRKA) interacting prt 1;
  ENSP ID: ENSP00000433510
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQRKDRKKTSLGPGGSYQISEHAPEASQPVSTELLTHWVSPPLQLHEPVDMVLRGLFELSL

SEQ ID NO: 694 - protein, 168 aa, Homo sapiens
  Payload ID: 117;
  Gene Symbol: AKIP1;
  Gene Name: A kinase (PRKA) interacting prt 1;
  ENSP ID: ENSP00000434726
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQRKDRKKTSLGPGGSYQISEHAPEASQPVSTELLTHWVSPPLQLHEPVDMVLRGLFELSL

SEQ ID NO: 695 - protein, 179 aa, Homo sapiens
  Payload ID: 117;
  Gene Symbol: AKIP1;
  Gene Name: A kinase (PRKA) interacting prt 1;
  ENSP ID: ENSP00000434785
MDNCLAAAALNGVDRRSLQRSARLALEVLERAKRRAVDWHALERPKGCMGVLAREAPHLEKQPAAGPQRVLPGEREERPPTLSASFRTMAEFMDYTSSQCGKYYSSVPEEGGATHVYRYHRGESKLHMCLDIGNGQRKDRKKTSLGPGGSYQISEHAPEASQPVSTELLTHWVSPPLQL

SEQ ID NO: 696 - protein, 168 aa, Homo sapiens; identical to SEQ ID NO: 694
  Payload ID: 117;
  Gene Symbol: AKIP1;
  Gene Name: A kinase (PRKA) interacting prt 1;
  ENSP ID: ENSP00000434820

SEQ ID NO: 697 - protein, 101 aa, Homo sapiens
  Payload ID: 117;
  Gene Symbol: AKIP1;
  Gene Name: A kinase (PRKA) interacting prt 1;
  ENSP ID: ENSP00000436989
MAEFMDYTSSQCGKYYSSVPEEGGATHVYRYHRGESKLHMCLDIGNGQRKDRKKTSLGPGGSYQISEHAPEASQPAENISKDLYIEVYPGTYSVTVGSNDL

SEQ ID NO: 698 - protein, 384 aa, Homo sapiens
  Payload ID: 118;
  Gene Symbol: AAR2;
  Gene Name: AAR2 splicing  factor homolog;
  Uniprot ID:  Q9Y312;
  ENSP ID: ENSP00000313674
MAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQVFFSSACSIAVDATLRKKAEKFQAHLTKKFRWDFAAEPEDCAPVVVELPEGIEMG

SEQ ID NO: 699 - protein, 384 aa, Homo sapiens; identical to SEQ ID NO: 698
  Payload ID: 118;
  Gene Symbol: AAR2;
  Gene Name: AAR2 splicing  factor homolog;
  Uniprot ID:  Q9Y312;
  ENSP ID: ENSP00000363043

SEQ ID NO: 700 - protein, 398 aa, Homo sapiens
  Payload ID: 118;
  Gene Symbol: AAR2;
  Gene Name: AAR2 splicing  factor homolog;
  ENSP ID: ENSP00000380455
MAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQRQSLAVSPRLKCSDLIIARCSLELLGSYDPPTSASRVAGTTGRYHHTRLINNNKKNCRDKVFLCCPGWS

SEQ ID NO: 701 - protein, 523 aa, Homo sapiens
  Payload ID: 119;
  Gene Symbol: ADCK1;
  Gene Name: aarF domain containing kinase 1;
  Uniprot ID:  Q86TW2;
  ENSP ID: ENSP00000238561
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 702 - protein, 455 aa, Homo sapiens
  Payload ID: 119;
  Gene Symbol: ADCK1;
  Gene Name: aarF domain containing kinase 1;
  Uniprot ID:  Q86TW2;
  ENSP ID: ENSP00000339663
MARKALKLASWTSMALAASGIYFYSNKYLDPNDFGAVRVGRAVATTAVISYDYLTSLKSVPYGSEEYLQLRSKIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKVPRIHWDLSTERVLLMEFVDGGQVNDRDYMERNKIDVNEISRHLGKMYSEMIFVNGFVHCDPHPGNVLVRKHPGTGKAEIVLLDHGLYQMLTEEFRLNYCHLWQSLIWTDMKRVKEYSQRLGAGDLYPLFACMLTARSWDSVNRGISQAPVTATEDLEIRNNAANYLPQISHLLNHVPRQMLLILKTNDLLRGIEAALGTRASASSFLNMSRCCIRALAEHKKKNTCSFFRRTQISFSEAFNLWQINLHELILRVKGLKLADRVLALICWLFPAPL

SEQ ID NO: 703 - protein, 218 aa, Homo sapiens
  Payload ID: 119;
  Gene Symbol: ADCK1;
  Gene Name: aarF domain containing kinase 1;
  ENSP ID: ENSP00000377256
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEVLVLAVKQLFPEFEFMWLVDEAKKNLPLELDFLNEGRNAEKVSQMLRHFDFLKPGQQSETASQGTTTTTKKKWDRKL

SEQ ID NO: 704 - protein, 122 aa, Homo sapiens
  Payload ID: 119;
  Gene Symbol: ADCK1;
  Gene Name: aarF domain containing kinase 1;
  ENSP ID: ENSP00000451271
MARKALKLASWTSMALAASGIYFYSNKYLDPNDFGAVRVGRAVATTAVISYDYLTSLKSVPYGSEEYLQLRSKSLAVSPRLECIGVISAHCNLYLLGSSDSPASASQVAGTTGAPSLCQASL

SEQ ID NO: 705 - protein, 265 aa, Homo sapiens
  Payload ID: 119;
  Gene Symbol: ADCK1;
  Gene Name: aarF domain containing kinase 1;
  ENSP ID: ENSP00000451549
MARKALKLASWTSMALAASGIYFYSNKYLDPNDFGAVRVGRAVATTAVISYDYLTSLKSVPYGSEEYLQLRSKVHLRSARRLCELCCANRGTFIKVGQHLGALDYLLPEEYTSTLKVLHSQAPQSSMQEIRQVIREDLGKEIHDLFQSFDDTPLGTASLAQVHKAVLHDGRTVAVKVQHPKVRAQSSKDILLMEVLVLAVKQLFPEFEFMWLVDEAKKNLPLELDFLNEGRNAEKVSQMLRHFDFLKISRHLGKMYSEMIFVNGF

SEQ ID NO: 706 - protein, 626 aa, Homo sapiens
  Payload ID: 120;
  Gene Symbol: ADCK2;
  Gene Name: aarF domain containing kinase 2;
  Uniprot ID:  Q7Z695;
  ENSP ID: ENSP00000072869
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVKLESNFASIVFAIMVLEGLGRSLDPKLDILEAARPFLLTGPVCPP

SEQ ID NO: 707 - protein, 470 aa, Homo sapiens
  Payload ID: 120;
  Gene Symbol: ADCK2;
  Gene Name: aarF domain containing kinase 2;
  ENSP ID: ENSP00000417367
  MOD_RES (1)..(1): Any amino acid
XCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVLRGHSKQAERGWDGSRWLGGRTPAGHAAPRASAHQVQCGGGKGTKRRQSLP

SEQ ID NO: 708 - protein, 223 aa, Homo sapiens
  Payload ID: 120;
  Gene Symbol: ADCK2;
  Gene Name: aarF domain containing kinase 2;
  ENSP ID: ENSP00000420288
IDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQLHVSSLLSSVFKLLMTHKVKLESNFASIVFAIMVLEGLGRSLDPKLDILEAARPFLLTGPVCPP

SEQ ID NO: 709 - protein, 590 aa, Homo sapiens
  Payload ID: 120;
  Gene Symbol: ADCK2;
  Gene Name: aarF domain containing kinase 2;
  ENSP ID: ENSP00000420512
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVKSQFIPAPS

SEQ ID NO: 710 - protein, 407 aa, Homo sapiens
  Payload ID: 120;
  Gene Symbol: ADCK2;
  Gene Name: aarF domain containing kinase 2;
  ENSP ID: ENSP00000480996
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPSYGSWDVLKLGHQFQM

SEQ ID NO: 711 - protein, 647 aa, Homo sapiens
  Payload ID: 121;
  Gene Symbol: ADCK3;
  Gene Name: aarF domain containing kinase 3;
  Uniprot ID:  Q8NI60;
  ENSP ID: ENSP00000355739
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 712 - protein, 595 aa, Homo sapiens
  Payload ID: 121;
  Gene Symbol: ADCK3;
  Gene Name: aarF domain containing kinase 3;
  Uniprot ID:  Q8NI60;
  ENSP ID: ENSP00000355740
MFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 713 - protein, 647 aa, Homo sapiens; identical to SEQ ID NO: 711
  Payload ID: 121;
  Gene Symbol: ADCK3;
  Gene Name: aarF domain containing kinase 3;
  Uniprot ID:  Q8NI60;
  ENSP ID: ENSP00000355741

(The sequence listing continues in the following parts.)

The invention claimed is:

1. A regulatable human T cell engineered to express an effector module or a population of regulatable human T cells engineered to express the effector module, wherein the effector module comprises:
   a first component and a second component,
   wherein said first component is a stimulus response element (SRE) comprising an FK506 binding protein (FKBP) destabilizing domain (DD), wherein the FKBP DD comprises mutations F36V and L106P and comprises SEQ ID NO: 213274 or comprises mutation E31G, F36V, R71G, and K105E and comprises SEQ ID NO: 213297 and
   wherein said second component is a chimeric antigen receptor that recognizes a C19 antigen, and wherein said effector module is responsive to at least one stimulus.

2. The regulatable human T cell or population of regulatable human T cells of claim 1, wherein the T cells are primary T cells.

3. The regulatable human T cell or population of regulatable human T cells of claim 1, wherein the T cell is selected from the group consisting of cytotoxic T cells, helper T cells, memory T cells, regulatory T cells, tissue infiltrating T cells and combinations thereof.

4. The regulatable human T cell or population of regulatable human T cells of claim 1, wherein the regulatable human T cell or population of regulatable human T cells is obtained from a subject suffering from, being treated for, diagnosed with, or suspected of having a disorder selected from the group consisting of an immune disorder including autoimmune disorders and a hyperproliferative condition including cancer, an infectious disease, a non-infectious disease, and graft vs. host disease.

5. The regulatable human T cell or population of regulatable human T cells of claim 1, wherein the effector module comprises:
   FKBP DD comprising mutations F36V L106P (SEQ ID NO: 213574), and further comprising CD8a leader, CD19 scFV, CD8a hinge, CD8a transmembrane domain, 41BB, and CD3zeta and having the amino acid sequence set forth in SEQ ID NO: 213412 or SEQ ID NO: 213414, or
   FKBP DD comprising mutations E31G, F36V, R71G, and K105E (SEQ ID NO: 213297), and further comprising a CD8a leader, CD19 scFV, CD8a hinge, CD8a transmembrane domain, 41BB, CD3zeta, and a linker and having the amino acid sequence set forth in SEQ ID NO: 213417.

6. The regulatable human T cell or population of regulatable human T cells of claim 1, wherein the at least one stimulus is Shield-1.

7. A pharmaceutical composition comprising the regulatable human T cell or population of regulatable human T cells of claim 1.

* * * * *